US008207316B1

(12) United States Patent
Bentwich

(10) Patent No.: US 8,207,316 B1
(45) Date of Patent: *Jun. 26, 2012

(54) HCMV-RELATED NUCLEIC ACIDS AND MICRORNA

(75) Inventor: Itzhak Bentwich, Kfar Daniel (IL)

(73) Assignee: Rosetta Genomics, Inc., Rehovot (IL)

( * ) Notice: Subject to any disclaimer, the term of this patent is extended or adjusted under 35 U.S.C. 154(b) by 1214 days.

This patent is subject to a terminal disclaimer.

(21) Appl. No.: 10/707,003

(22) Filed: Oct. 30, 2003

Related U.S. Application Data

(63) Continuation of application No. 10/604,984, filed on Aug. 29, 2003, and a continuation-in-part of application No. 10/303,778, filed on Nov. 26, 2002, now abandoned, and a continuation-in-part of application No. 10/310,188, filed on Dec. 5, 2002, now abandoned, and a continuation-in-part of application No. 10/604,945, filed on Aug. 27, 2003, and a continuation-in-part of application No. 10/604,942, filed on Aug. 28, 2003, and a continuation-in-part of application No. 10/604,943, filed on Aug. 28, 2003, and a continuation-in-part of application No. 10/604,944, filed on Aug. 28, 2003, now Pat. No. 7,217,807, and a continuation-in-part of application No. 10/605,838, filed on Oct. 30, 2003, now abandoned, and a continuation-in-part of application No. 10/605,840, filed on Oct. 30, 2003, now abandoned.

(60) Provisional application No. 60/457,788, filed on Mar. 27, 2003, provisional application No. 60/441,241, filed on Jan. 17, 2003, provisional application No. 60/411,230, filed on Jan. 17, 2003.

(51) Int. Cl.
C07H 21/02 (2006.01)
C07H 21/04 (2006.01)
C12Q 1/68 (2006.01)
C12N 5/00 (2006.01)
A01N 43/04 (2006.01)
A61K 31/70 (2006.01)

(52) U.S. Cl. .......... 536/23.1; 536/24.5; 435/6; 435/375; 514/44

(58) Field of Classification Search .................. 536/23.1, 536/24.5; 435/6
See application file for complete search history.

(56) References Cited

U.S. PATENT DOCUMENTS

| 6,027,880 | A  | * | 2/2000  | Cronin et al.  | 435/6   |
|-----------|----|---|---------|----------------|---------|
| 6,503,756 | B1 | * | 1/2003  | Freier et al.  | 435/455 |
| 6,506,559 | B1 | * | 1/2003  | Fire et al.    | 435/6   |
| 2001/0053519 | A1 | * | 12/2001 | Fodor et al. | 435/6 |
| 2002/0086356 | A1 |   | 7/2002  | Tuschl et al. |        |
| 2007/0031850 | A1 | * | 2/2007  | Mounts et al. | 435/6  |

FOREIGN PATENT DOCUMENTS

| EP | 1013775 A1 | * | 6/2000 |
| WO | WO 99/34016 | * | 8/1999 |
| WO | WO 01/68836 | | 9/2001 |
| WO | WO 02/44321 | | 6/2002 |
| WO | WO 02/094185 | | 11/2002 |
| WO | WO 01/75164 | | 2/2003 |

OTHER PUBLICATIONS

Monte et al., Stably expressed antisense RNA to cytomegalovirus UL83 inhibts viral replication, 1996, Journal of Virology, vol. 70, pp. 2086-2094.*
Paul et al., Effective expression of small interfering RNA in human cells, May 2002, Nature Biotechnology, vol. 29, pp. 505-508.*
Lee, R. C., R. L. Feinbaum and V. Ambros. The *C. elegans* heterochronic gene lin-4 encodes small RNAs with antisense complementarity to lin-14 Cell Dec. 3, 1993 843-854 75.
Wightman, B., I. Ha and G. Ruvkun. Posttranscriptional regulation of the heterochronic gene lin-14 by lin-4 mediates temporal pattern formation in *C. elegans* Cell Dec. 3, 1993 855-862 75.
Gallinaro, H., L. Domenjoud and M. Jacob. Structural study of the 5' end of a synthetic premessenger RNA from adenovirus. Evidence for a long-range exon-intron interaction J Mol Biol Jul. 15, 1994 205-225 240.
Lu, C. and R. Bablanian. Characterization of small nontranslated polyadenylylated RNAs in vaccinia virus-infected cells Proc Natl Acad Sci U S A Mar. 5, 1996 2037-2042 93.
Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Education Council Urology Jun. 1996 863-869 47.
Engdahl HM, Hjalt TA, Wagner EG. A two unit antisense RNA cassette test system for silencing of target genes. Nucleic Acids Res. Aug. 15, 1997 3218-27 25.
Smith, D. S., P. A. Humphrey and W. J. Catalona. The early detection of prostate carcinoma with prostate specific antigen: the Washington University experience Cancer Nov. 1, 1997 1852-1856 80.
Dsouza, M., N. Larsen and R. Overbeek. Searching for patterns in genomic data Trends Genet Dec. 1997 497-498 13.

(Continued)

*Primary Examiner* — J. E Angell
*Assistant Examiner* — Dana Shin
(74) *Attorney, Agent, or Firm* — Teddy Scott, Jr.; Polsinelli Shughart

(57) ABSTRACT

The present invention relates to a group of noel viral RNA regulatory genes, here identified as "viral genomic address messenger genes"or "VGAM genes", and as "Viral genomic record"or "VGR genes". VGAM genes selectively inhibit translation of known host target genes, and are believed to represent a pervasive viral attack mechanism. VGR genes encode an "operon"-like cluster of VGAM genes. VGAM and viral VGR genes may therefore be useful in diagnosing, preventing and treating viral disease. Several nucleic acid molecules are provided respectively encoding several VGAM genes, as are vectors and probes, both comprising the nucleic acid molecules, and methods and systems for detecting VGAM genes, and for counteracting their activity.

4 Claims, 17 Drawing Sheets

OTHER PUBLICATIONS

Moss, E. G., R. C. Lee and V. Ambros. The cold shock domain protein LIN-28 controls developmental timing in *C. elegans* and is regulated by the lin-4 RNA Cell 1997 637 88.

Fire, A., S. Xu, M. K. Montgomery, S. A. Kostas, S. E. Driver and C. C. Mello. Potent and specific genetic interference by double-stranded RNA in *Caenorhabditis elegans* Nature Feb. 19, 1998.

Waterhouse, P. M., M. W. Graham and M. B. Wang. Virus resistance and gene silencing in plants can be induced by simultaneous expression of sense and antisense RNA Proc Natl Acad Sci U S A Nov. 10, 1998 13959-13964 95.

Ngo, H., C. Tschudi, K. Gull and E. Ullu. Double-stranded RNA induces mRNA degradation in *Trypanosoma brucei* Proc Natl Acad Sci U S A Dec. 8, 1998 14687-14692 95.

Verma, S. and F. Eckstein. Modified oligonucleotides: synthesis and strategy for users Annu Rev Biochem *No date in Pubmed* 1998 99-134 67.

Wuchty, S., W. Fontana, I. L. Hofacker and P. Schuster. Complete suboptimal folding of RNA and the stability of secondary structures Biopolymers Feb. 1999 145-165 49.

Mathews, D. H., J. Sabina, M. Zuker and D. H. Turner. Expanded sequence dependence of thermodynamic parameters improves prediction of RNA secondary structure J Mol Biol May 21, 1999 911-940 288.

Chang, P. L. Encapsulation for somatic gene therapy Ann N Y Acad Sci Jun. 18, 1999 146-158 875.

Zhang, M. Q. Large-scale gene expression data analysis: a new challenge to computational biologists Genome Res Aug. 1999 681-688 9.

Grisaru, D., M. Sternfeld, A. Eldor, D. Glick and H. Soreq. Structural roles of acetylcholinesterase variants in biology and pathology Eur J Biochem Sep. 1999 672-686 264.

Fire, A. RNA-triggered gene silencing Trends Genet Sep. 1999 358-363 15.

Tabara, H., M. Sarkissian, W. G. Kelly, J. Fleenor, A. Grishok, L. Timmons, A. Fire and C. C. Mello. The rde-1 gene, RNA interference, and transposon silencing in *C. elegans* Cell Oct. 15, 1999 123-132 99.

Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.

Olsen, P. H. and V. Ambros. The lin-4 regulatory RNA controls developmental timing in *Caenorhabditis elegans* by blocking LIN-14 protein synthesis after the initiation of translation Dev Biol Dec. 15, 1999 671-680 216.

Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

Reinhart, B. J., F. J. Slack, M. Basson, A. E. Pasquinelli, J. C. Bettinger, A. E. Rougvie, H. R. Horvitz and G. Ruvkun. The 21-nucleotide let-7 RNA regulates developmental timing in *Caenorhabditis elegans* Nature Feb. 24, 2000 901-906 403.

Pitt, J. N., J. A. Schisa and J. R. Priess. P granules in the germ cells of *Caenorhabditis elegans* adults are associated with clusters of nuclear pores and contain RNA Dev Biol Mar. 15, 2000 315-333.

Hammond, S. M., E. Bernstein, D. Beach and G. J. Hannon. An RNA-directed nuclease mediates post-transcriptional gene silencing in Drosophila cells Nature Mar. 16, 2000 293-296 404.

Slack, F. J., M. Basson, Z. Liu, V. Ambros, H. R. Horvitz and G. Ruvkun. The lin-41 RBCC gene acts in the *C. elegans* heterochronic pathway between the let-7 regulatory RNA and the LIN-29 transcription factor Mol Cell Apr. 2000 659-669 5.

Fortier, E. and J. M. Belote. Temperature-dependent gene silencing by an expressed inverted repeat in Drosophila Genesis Apr. 2000 240-244 26.

Mourrain, P., C. Beclin, T. Elmayan, F. Feuerbach, C. Godon, J. B. Morel, D. Jouette, A. M. Lacombe, S. Nikic, N. Picault, K. Remoue, M. Sanial, T. A. Vo and H. Vaucheret. Arabidopsis SGS2 and SGS3 genes are required for posttranscriptional gene silencing and natural virus resistance Cell May 26, 2000 533-542 101.

Sijen, T. and J. M. Kooter. Post-transcriptional gene-silencing: RNAs on the attack or on the defense? Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Dubridge, J. Kirchner, K. Fearon, J. Mao and K. Corcoran. Gene expression analysis by massively parallel signature sequencing (MPSS) on microbead arrays Nat Biotechnol Jun. 2000 630-634 18.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells AIDS Res Hum Retroviruses Jul. 1, 2000 995.

Nilsson, M., G. Barbany, D. O. Antson, K. Gertow and U. Landegren. Enhanced detection and distinction of RNA by enzymatic probe ligation Nat Biotechnol Jul. 2000 791-793 18.

Kent, W. J. and A. M. Zahler. Conservation, regulation, synteny, and introns in a large-scale *C. briggsae—C. elegans* genomic alignment Genome Res Aug. 2000 1115-1125 10.

Kennerdell, J. R. and R. W. Carthew. Heritable gene silencing in Drosphila using double-stranded RNA Nat Biotechnol Aug. 2000 896-898 18.

Smith, N. A., S. P. Singh, M. B. Wang, P. A. Stoutjesdijk, A. G. Green and P. M. Waterhouse. Total silencing by intron-spliced hairpin RNAs Nature Sep. 21, 2000 319-320 407.

Voinnet, O., C. Lederer and D. C. Baulcombe. A viral movement protein prevents spread of the gene silencing signal in *Nicotiana benthamana* Cell Sep. 29, 2000 157-167 103.

Mette MF, Aufsatz W, van der Winden J, Matzke MA, Matzke AJ. Transcriptional silencing and promoter methylation triggered by double-stranded RNA. EMBO J. Oct. 2, 2000 5194-201 19.

Yang, D., H. Lu and J. W. Erickson. Evidence that processed small dsRNAs may mediate sequence-specific mRNA degradation during RNAi in Drosophila embryos Curr Biol Oct. 5, 2000 1191-1200 10.

Anandalakshmi, R., R. Marathe, X. Ge, J. M. Herr, Jr., C. Mau, A. Mallory, G. Pruss, L. Bowman and V. B. Vance. A calmodulin-related protein that suppresses posttranscriptional gene silencing in plants Science Oct. 6, 2000 142-144 290.

Fagard, M., S. Boutet, J. B. Morel, C. Bellini and H. Vaucheret. AGO1, QDE-2, and RDE-1 are related proteins required for post-transcriptional gene silencing in plants, quelling in fungi, and RNA interference in animals Proc Natl Acad Sci U S A Oct. 10, 2000 11650-11654 97.

Pasquinelli, A. E., B. J. Reinhart, F. Slack, M. Q. Martindale, M. I. Kuroda, B. Maller, D. C. Hayward, E. E. Ball, B. Degnan, P. Muller, J. Spring, A. Srinivasan, M. Fishman, J. Finnerty, J. Corbo, M. Levine, P. Leahy, E. Davidson and G. Ruvkun. Conservation of the sequence and temporal expression of let-7 heterochronic regulatory RNA Nature Nov. 2, 2000 86-89 408.

Llave, C., K. D. Kasschau and J. C. Carrington. Virus-encoded suppressor of posttranscriptional gene silencing targets a maintenance step in the silencing pathway Proc Natl Acad Sci U S A Nov. 21, 2000 13401-13406 9.

Cogoni, C. and G. Macino. Post-transcriptional gene silencing across kingdoms Curr Opin Genet Dev Dec. 2000 638-643 10.

Elbashir, S. M., W. Lendeckel and T. Tuschl. RNA interference is mediated by 21- and 22-nucleotide RNAs Genes Dev Jan. 15, 2001 188-200 15.

Bernstein, E., A. A. Caudy, S. M. Hammond and G. J. Hannon. Role for a bidentate ribonuclease in the initiation step of RNA interference Nature Jan. 18, 2001 363-366 409.

Vaucheret, H. and M. Fagard. Transcriptional gene silencing in plants: targets, inducers and regulators Trends Genet Jan. 2001 29-35 17.

Thomas, C. L., L. Jones, D. C. Baulcombe and A. J. Maule. Size constraints for targeting post-transcriptional gene silencing and for RNA-directed methylation in *Nicotiana benthamiana* using a potato virus X vector Plant J Feb. 2001 417-425 25.

Galyam, N., D. Grisaru, M. Grifman, N. Melamed-Book, F. Eckstein, S. Seidman, A. Eldor and H. Soreq. Complex host cell responses to antisense suppression of ACHE gene expression Antisense Nucleic Acid Drug Dev Feb. 2001 51-57 11.

Sharp, P. A. RNA interference—2001 Genes Dev Mar. 1, 2001 485-490 15.

Mallory, A. C., L. Ely, T. H. Smith, R. Marathe, R. Anandalakshmi, M. Fagard., H. Vaucheret, G. Pruss, L. Bowman and V. B. Vance. HC-Pro suppression of transgene silencing eliminates the small RNAs but not transgene methylation or the mobile signal Plant Cell Mar. 2001 (571-583 13).

Matzke, M. A., A. J. Matzke, G. J. Pruss and V. B. Vance. RNA-based silencing strategies in plants Curr Opin Genet Dev Apr. 2001 221-227 11.

Schisa, J. A., J. N. Pitt and J. R. Priess. Analysis of RNA associated with *P granules* in germ cells of *C. elegans* adults Development Apr. 2001 1287-1298 128.

Di Serio, F., H. Schob, A. Iglesias, C. Tarina, E. Bouldoires and F. Meins, Jr. Sense- and antisense-mediated gene silencing in tobacco is inhibited by the same viral suppressors and is associated with accumulation of small RNAs Proc Natl Acad Sci U S A May 22, 2001 6506-6510 98.

Elbashir, S. M., J. Harborth, W. Lendeckel, A. Yalcin, K. Weber and T. Tuschl. Duplexes of 21-nucleotide RNAs mediate RNA interference in cultured mammalian cells Nature May 24, 2001 494-498 411.

Piccin, A., A. Salameh, C. Benna, F. Sandrelli, G. Mazzotta, M. Zordan, E. Rosato, C. P. Kyriacou and R. Costa. Efficient and heritable functional knock-out of an adult phenotype in Drosophila using a GAL4-driven hairpin RNA incorporating a heterologous spacer Nucleic Acids Res Jun. 15, 2001 E55-55 29.

Vance, V. and H. Vaucheret. RNA silencing in plants—defense and counterdefense Science Jun. 22, 2001 2277-2280 292.

Argaman, L., R. Hershberg, J. Vogel, G. Bejerano, E. G. Wagner, H. Margalit and S. Altuvia. Novel small RNA-encoding genes in the intergenic regions of *Escherichia coli* Curr Biol Jun. 26, 2001 941-950 11.

Grishok, A., A. E. Pasquinelli, D. Conte, N. Li, S. Parrish, I. HA, D. L. Baillie, A. Fire, G. Ruvkun and C. C. Mello. Genes and mechanisms related to RNA interference regulate expression of the small temporal RNAs that control *C. elegans* developmental timing Cell Jul. 13, 2001 23-34 106.

Hutvagner, G., J. McLachlan, A. E. Pasquinelli, E. Balint, T. Tuschl and P. D. Zamore. A cellular function for the RNA-interference enzyme Dicer in the maturation of the let-7 small temporal RNA Science Aug. 3, 2001 834-838 293.

Hammond, S. M., S. Boettcher, A. A. Caudy, R. Kobayashi and G. J. Hannon. Argonaute2, a link between genetic and biochemical analyses of RNAi Science Aug. 10, 2001 1146-1150 293.

Vaucheret, H., C. Beclin and M. Fagard. Post-transcriptional gene silencing in plants J Cell Sci Sep. 2001 3083-3091 114.

Wesley, S. V., C. A. Helliwell, N. A. Smith, M. B. Wang, D. T. Rouse, Q. Liu, P. S. Gooding, S. P. Singh, D. Abbott, P. A. Stoutjesdijk, S. P. Robinson, A. P. Gleave, A. G. Green and P. M. Waterhouse. Construct design for efficient, effective and high-throughput gene silencing in plants Plant J Sep. 2001 581-590 27.

Mattick, J. S. and M. J. Gagen. The evolution of controlled multitasked gene networks: the role of introns and other noncoding RNAs in the development of complex organisms Mol Biol Evol Sep. 2001 1611-1630 18.

Carter, R. J., I. Dubchak and S. R. Holbrook. A computational approach to identify genes for functional RNAs in genomic sequences Nucleic Acids Res Oct. 1, 2001 3928-3938 29.

Moss, E. G. RNA interference: it's a small RNA world Curr Biol Oct. 2, 2001 R772-775 11.

Ketting, R. F., S. E. Fischer, E. Bernstein, T. Sijen, G. J. Hannon and R. H. Plasterk. Dicer functions in RNA interference and in synthesis of small RNA involved in developmental timing in *C. elegans* Genes Dev Oct. 15, 2001 2654-2659 15.

Ruvkun, G. Molecular biology. Glimpses of a tiny RNA world Science Oct. 26, 2001 797-799 294.

Lee, R. C. and V. Ambros. An extensive class of small RNAs in *Caenorhabditis elegans* Science Oct. 26, 2001 862-864 294.

Lau, N. C., L. P. Lim, E. G. Weinstein and D. P. Bartel. An abundant class of tiny RNAs with probable regulatory roles in *Caenorhabditis elegans* Science Oct. 26, 2001 858-862 294.

Lagos-Quintana, M., R. Rauhut, W. Lendeckel and T. Tuschl. Identification of novel genes coding for small expressed RNAs Science Oct. 26, 2001 853-858 294.

Itaya, A., A. Folimonov, Y. Matsuda, R. S. Nelson and B. Ding. Potato spindle tuber viroid as inducer of RNA silencing in infected tomato Mol Plant Microbe Interact Nov. 2001 1332-1334 14.

Mattick, J. S. Non-coding RNAs: the architects of eukaryotic complexity EMBO Rep Nov. 2001 986-991 2.

Elbashir, S. M., J. Martinez, A. Patkaniowska, W. Lendeckel and T. Tuschl. Functional anatomy of siRNAs for mediating efficient RNAi in *Drosophila melanogaster* embryo lysate Embo J Dec. 3, 2001 6877-6888 20.

Ambros, V. microRNAs: tiny regulators with great potential Cell Dec. 28, 2001 823-826 107.

Blaszczyk, J., J. E. Tropea, M. Bubunenko, K. M. Routzahn, D. S. Waugh, D. L. Court and X. Ji. Crystallographic and modeling studies of RNase III suggest a mechanism for double-stranded RNA cleavage Structure Dec. 2001 1225-1236 9.

Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.

Smallridge, R. A small fortune Nat Rev Mol Cell Biol Dec. 2001 867 2.

Eddy, S. R. Non-coding RNA genes and the modern RNA world Nat Rev Genet Dec. 2001 919-929 2.

Lu, C. M. miRNA bead detection Genaco Biomedical Products PHS 398 2001 1.

Matzke, M., A. J. Matzke and J. M. Kooter. RNA: guiding gene silencing 2001 1080 293.

Grosshans, H. And F. J. Slack. Micro-RNAs: small is plentiful J Cell Biol Jan. 7, 2002 17-21 156.

Meshorer, E., C. Erb, R. Gazit, L. Pavlovsky, D. Kaufer, A. Friedman, D. Glick, N. Ben-Arie and H. Soreq. Alternative splicing and neuritic mRNA translocation under long-term neuronal hypersensitivity Science Jan. 18, 2002 508-512 295.

Paddison, P. J., A. A. Caudy and G. J. Hannon. Stable suppression of gene expression by RNAi in mammalian cells Proc Natl Acad Sci U S A Feb. 5, 2002 1443-1448 99.

Moss, E. G. MicroRNAs: hidden in the genome Curr Biol Feb. 19, 2002 R138-140 12.

Banerjee, D. and F. Slack. Control of developmental timing by small temporal RNAs: a paradigm for RNA-mediated regulation of gene expression Bioessays Feb. 2002 119-129 24.

Elbashir, S. M., J. Harborth, K. Weber and T. Tuschl. Analysis of gene function in somatic mammalian cells using small interfering RNAs Methods Feb. 2002 199-213 26.

Han, Y. and D. Grierson. Relationship between small antisense RNAs and aberrant RNAs associated with sense transgene mediated gene silencing in tomato Plant J Feb. 2002 509-519 29.

Nicholson, R. H. and A. W. Nicholson. Molecular characterization of a mouse cDNA encoding Dicer, a ribonuclease III ortholog involved in RNA interference Mamm Genome Feb. 2002 67-73 13.

Puerta-Fernandez, E., A. Barroso-DelJesus and A. Berzal-Herranz. Anchoring hairpin ribozymes to long target RNAs by loop-loop RNA interactions Antisense Nucleic Acid Drug Dev Feb. 2002 1-9 12.

Giordano, E., R. Rendina, I. Peluso and M. Furia. RNAi triggered by symmetrically transcribed transgenes in *Drosophila melanogaster* Genetics Feb. 2002 637-648 160.

Martens, H., J. Novotny, J. Oberstrass, T. L. Steck, P. Postlethwait and W. Nellen. RNAi in Dictyostelium: the role of RNA-directed RNA polymerases and double-stranded RNase Mol Biol Cell Feb. 2002 445-453 13.

Mourelatos, Z., J. Dostie, S. Paushkin, A. Sharma, B. Charroux, L. Abel, J. Rappsilber, M. Mann and G. Dreyfuss. miRNPs: a novel class of ribonucleoproteins containing numerous microRNAs Genes Dev Mar. 15, 2002 720-728 16.

Seggerson, K., L. Tang and E. G. Moss. Two genetic circuits repress the *Caenorhabditis elegans* heterochronic gene lin-28 after translation initiation Dev Biol Mar. 15, 2002 215-225 243.

Morel, J. B., C. Godon, P. Mourrain, C. Beclin, S. Boutet, F. Feuerbach, F. Proux and H. Vaucheret. Fertile hypomorphic ARGONAUTE (ago1) mutants impaired in post-transcriptional gene silencing and virus resistance Plant Cell Mar. 2002 629-639 14.

Catalanotto, C., G. Azzalin, G. Macino and C. Cogoni. Involvement of small RNAs and role of the qde genes in the gene silencing pathway in Neurospora Genes Dev Apr. 1, 2002 790-795 16.
Boutla, A., K. Kalantidis, N. Tavernarakis, M. Tsagris and M. Tabler. Induction of RNA interference in *Caenorhabditis elegans* by RNAs derived from plants exhibiting post-transcriptional gene silencing Nucleic Acids Res Apr. 1, 2002 1688-1694 30.
Pasquinelli, A. E. and G. Ruvkun. Control of developmental timing by micrornas and their targets Annu Rev Cell Dev Biol Epub 2002 Apr. 2, 2002 495-513 18.
Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.
Beclin, C., S. Boutet, P. Waterhouse and H. Vaucheret. A branched pathway for transgene-induced RNA silencing in plants Curr Biol Apr. 16, 2002 684-688 12.
Eddy, S. R. Computational genomics of noncoding RNA genes Cell Apr. 19, 2002 137-140 109.
Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.
Kent, W. J. BLAT—the BLAST-like alignment tool Genome Res Apr. 2002 656-664 12.
Hutvagner, G. and P. D. Zamore. RNAi: nature abhors a double-strand Curr Opin Genet Dev Apr. 2002 225-232 12.
Nilsson, M., J. Baner, M. Mendel-Hartvig, F. Dahl, D. O. Antson, M. Gullberg and U. Landegren. Making ends meet in genetic analysis using padlock probes Hum Mutat Apr. 2002 410-415 19.
Pasquinelli, A. E. MicroRNAs: deviants no longer Trends Genet Apr. 2002 171-173 18.
Lai, E. C. Micro RNAs are complementary to 3' UTR sequence motifs that mediate negative post-transcriptional regulation Nat Genet Apr. 2002 363-364 30.
Schwarz, D. S. and P. D. Zamore. Why do miRNAs live in the miRNP? Genes Dev May 1, 2002 1025-1031 16.
Brantl, S. Antisense-RNA regulation and RNA interference Biochim Biophys Acta May 3, 2002 15-25 1575.
Li, H., W. X. Li and S. W. Ding. Induction and suppression of RNA silencing by an animal virus Science May 17, 2002 1319-1321 296.
Zamore, P. D. Ancient pathways programmed by small RNAs Science May 17, 2002 1265-1269 296.
Chen, S., E. A. Lesnik, T. A. Hall, R. Sampath, R. H. Griffey, D. J. Ecker and L. B. Blyn. A bioinformatics based approach to discover small RNA genes in the *Escherichia coli* genome Biosystems Mar.-May 2002 157-177 65.
Lee, N. S., T. Dohjima, G. Bauer, H. Li, M. J. Li, A. Ehsani, P. Salvaterra and J. Rossi. Expression of small interfering RNAs targeted against HIV-1 rev transcripts in human cells Nat Biotechnol May 2002 500-505 20.
Draghici, S. Statistical intelligence: effective analysis of high-density microarray data Drug Discov Today Jun. 1, 2002 S55-63 7.
Silhavy, D., A. Molnar, A. Lucioli, G. Szittya, C. Hornyik, M. Tavazza and J. Burgyan. A viral protein suppresses RNA silencing and binds silencing-generated, 21—to 25-nucleotide double-stranded RNAs Embo J Jun. 17, 2002 3070-3080 21.
Ayash-Rashkovsky, M., Z. Weisman, J. Diveley, R. B. Moss, Z. Bentwich and G. Borkow. Generation of Th1 immune responses to inactivated, gp120-depleted HIV-1 in mice with a dominant Th2 biased immune profile via immunostimulatory [correction of imunostimulatory] oligonucleotides—relevance to AIDS vaccines in developing countries Vaccine Jun. 21, 2002 2684-2692 20.
Tabara, H., E. Yigit, H. Siomi and C. C. Mello. The dsRNA binding protein RDE-4 interacts with RDE-1, DCR-1, and a DExH-box helicase to direct RNAi in *C. elegans* Cell Jun. 28, 2002 861-871 109.
Bettencourt, R., O. Terenius and I. Faye. Hemolin gene silencing by ds-RNA injected into *Cecropia pupae* is lethal to next generation embryos Insect Mol Biol Jun. 2002 267-271 11.
Hooper, N. M. and A. J. Turner. The search for alpha-secretase and its potential as a therapeutic approach to Alzheimer s disease Curr Med Chem Jun. 2002 1107-1119 9.
Liu, Q., S. Singh and A. Green. High-oleic and high-stearic cotton-seed oils: nutritionally improved cooking oils developed using gene silencing J Am Coll Nutr Jun. 2002 205S-211S 21.

Zeng, Y., E. J. Wagner and B. R. Cullen. Both natural and designed micro RNAs can inhibit the expression of cognate mRNAs when expressed in human cells Mol Cell Jun. 2002 1327-1333 9.
McManus, M. T., C. P. Petersen, B. B. Haines, J. Chen and P. A. Sharp. Gene silencing using micro-RNA designed hairpins RNA Jun. 2002 842-850 8.
Reinhart, B. J., E. G. Weinstein, M. W. Rhoades, B. Bartel and D. P. Bartel. MicroRNAs in plants Genes Dev Jul. 1, 2002 1616-1626 16.
McCaffrey, A. P., L. Meuse, T. T. Pham, D. S. Conklin, G. J. Hannon and M. A. Kay. RNA interference in adult mice Nature Jul. 4, 2002 38-39 418.
Hannon, G. J. RNA interference Nature Jul. 11, 2002 244-251 418.
Dennis, C. The brave new world of RNA Nature Jul. 11, 2002 122-124 418.
Jacque, J. M., K. Triques and M. Stevenson. Modulation of HIV-1 replication by RNA interference Nature Jul. 25, 2002 435-438 418.
Cullen, B. R. RNA interference: antiviral defense and genetic tool Nat Immunol Jul. 2002 597-599 3.
Ma, C. and A. Mitra. Intrinsic direct repeats generate consistent post-transcriptional gene silencing in tobacco Plant J Jul. 2002 37-49 31.
Novina, C. D., M. F. Murray, D. M. Dykxhoorn, P. J. Beresford, J. Riess, S. K. Lee, R. G. Collman, J. Lieberman, P. Shankar and P. A. Sharp. siRNA-directed inhibition of HIV-1 infection Nat Med Jul. 2002 681-686 8.
Pomerantz, R. J. RNA interference meets HIV-1: will silence be golden? Nat Med Jul. 2002 659-660 8.
Zeng, Y. and B. R. Cullen. RNA interference in human cells is restricted to the cytoplasm Rna Jul. 2002 855-860 8.
Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.
Llave, C., K. D. Kasschau, M. A. Rector and J. C. Carrington. Endogenous and silencing-associated small RNAs in plants Plant Cell Jul. 2002 1605-1619 14.
Rhoades, M. W., B. J. Reinhart, L. P. Lim, C. B. Burge, B. Bartel and D. P. Bartel. Prediction of plant microRNA targets Cell Aug. 23, 2002 513-520 110.
Hipfner, D. R., K. Weigmann and S. M. Cohen. The bantam gene regulates *Drosophila* growth Genetics Aug. 2002 1527-1537 161.
Liu, Q., S. P. Singh and A. G. Green. High-stearic and High-oleic cottonseed oils produced by hairpin RNA-mediated post-transcriptional gene silencing Plant Physiol Aug. 2002 1732-1743 129.
Stoutjesdijk, P. A., S. P. Singh, Q. Liu, C. J. Hurlstone, P. A. Waterhouse and A. G. Green. hpRNA-mediated targeting of the *Arabidopsis* FAD2 gene gives highly efficient and stable silencing Plant Physiol Aug. 2002 1723-1731 129.
Suzuma, S., S. Asari, K. Bunai, K. Yoshino, Y. Ando, H. Kakeshita, M. Fujita, K. Nakamura and K. Yamane. Identification and characterization of novel small RNAs in the aspS-yrvM intergenic region of the *Bacillus subtilis* genome Microbiology Aug. 2002 2591-2598 148.
Milligan, L., T. Forne, E. Antoine, M. Weber, B. Hemonnot, L. Dandolo, C. Brunel and G. Cathala. Turnover of primary transcripts is a major step in the regulation of mouse H19 gene expression EMBO Rep Aug. 2002 774-779 3.
Hamilton, A., O. Voinnet, L. Chappell and D. Baulcombe. Two classes of short interfering RNA in RNA silencing Embo J Sep. 2, 2002 4671-4679 21.
Lee, Y., K. Jeon, J. T. Lee, S. Kim and V. N. Kim. MicroRNA maturation: stepwise processing and subcellular localization Embo J Sep. 2, 2002 4663-4670 21.
Klahre, U., P. Crete, S. A. Leuenberger, V. A. Iglesias and F. Meins, Jr. High molecular weight RNAs and small interfering RNAs induce systemic posttranscriptional gene silencing in plants Proc Natl Acad Sci U S A Sep. 3, 2002 11981-11986 99.
Park, W., J. Li, R. Song, J. Messing and X. Chen. Carpel Factory, a Dicer homolog, and HEN1, a novel protein, act in microRNA metabolism in *Arabidopsis thaliana* Curr Biol Sep. 3, 2002 1484-1495 12.
Jiang, M. and J. Milner. Selective silencing of viral gene expression in HPV-positive human cervical carcinoma cells treated with siRNA, a primer of RNA interference Oncogene Sep. 5, 2002 6041-6048 21.

Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.

Allshire, R. Molecular biology. RNAi and heterochromatin—a hushed-up affair Science Sep. 13, 2002 1818-1819 297.

Reinhart, B. J. and D. P. Bartel. Small RNAs correspond to centromere heterochromatic repeats Science Sep. 13, 2002 1831 297.

Volpe, T. A., C. Kidner, I. M. Hall, G. Teng, S. I. Grewal and R. A. Martienssen. Regulation of heterochromatic silencing and histone H3 lysine-9 methylation by RNAi Science Sep. 13, 2002 1833-1837 297.

Baulcombe, D. DNA events. An RNA microcosm Science Sep. 20, 2002 2002-2003 297.

Llave, C., Z. Xie, K. D. Kasschau and J. C. Carrington. Cleavage of Scarecrow-like mRNA targets directed by a class of *Arabidopsis* miRNA Science Sep. 20, 2002 2053-2056 297.

Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.

Hutvagner, G. and P. D. Zamore. A microRNA in a multiple-turnover RNAi enzyme complex Science Sep. 20, 2002 2056-2060 297.

Coburn, G. A. and B. R. Cullen. Potent and specific inhibition of human immunodeficiency virus type 1 replication by RNA interference J Virol Sep. 2002 9225-9231 76.

Caudy, A. A., M. Myers, G. J. Hannon and S. M. Hammond. Fragile X-related protein and VIG associate with the RNA interference machinery Genes Dev Oct. 1, 2002 2491-2496 16.

Ishizuka, A., M. C. Siomi and H. Siomi. A *Drosophila* fragile X protein interacts with components of RNAi and ribosomal proteins Genes Dev Oct. 1, 2002 2497-2508 16.

Voinnet, O. RNA silencing: small RNAs as ubiquitous regulators of gene expression Curr Opin Plant Biol Oct. 2002 444-451 5.

Golden, T. A., S. E. Schauer, J. D. Lang, S. Pien, A. R. Mushegian, U. Grossniklaus, D. W. Meinke and A. Ray. Short Integuments1/Suspensor1/Carpel Factory, a Dicer homolog, is a maternal effect gene required for embryo development in *Arabidopsis* Plant Physiol Oct. 2002 808-822 130.

Merkle, I., M. J. Van Ooij, F. J. Van Kuppeveld, D. H. Glaudemans, J. M. Galama, A. Henke, R. Zell and W. J. Melchers. Biological significance of a human enterovirus B-specific RNA element in the 3' nontranslated region J Virol Oct. 2002 9900-9909 76.

Froeyen, M. and P. Herdewijn. RNA as a target for drug design, the example of Tat-TAR interaction Curr Top Med Chem Oct. 2002 1123-1145 2.

Carmell, M. A., Z. Xuan, M. Q. Zhang and G. J. Hannon. The Argonaute family: tentacles that reach into RNAi, developmental control, stem cell maintenance, and tumorigenesis Genes Dev Nov. 1, 2002 2733-2742 16.

Provost, P., D. Dishart, J. Doucet, D. Frendewey, B. Samuelsson and O. Radmark. Ribonuclease activity and RNA binding of recombinant human Dicer Embo J Nov. 1, 2002 5864-5874 21.

Zhang, H., F. A. Kolb, V. Brondani, E. Billy and W. Filipowicz. Human Dicer preferentially cleaves dsRNAs at their termini without a requirement for ATP Embo J Nov. 1, 2002 5875-5885 21.

Mallory, A. C., B. J. Reinhart, D. Bartel, V. B. Vance and L. H. Bowman. A viral suppressor of RNA silencing differentially regulates the accumulation of short interfering RNAs and micro-RNAs in tobacco Proc Natl Acad Sci U S A Nov. 12, 2002 15228-15233 99.

Gottesman, S. Stealth regulation: biological circuits with small RNA switches Genes Dev Nov. 15, 2002 2829-2842 16.

Calin, G. A., C. D. Dumitru, M. Shimizu, R. Bichi, S. Zupo, E. Noch, H. Aldler, S. Rattan, M. Keating, K. Rai, L. Rassenti, T. Kipps, M. Negrini, F. Bullrich and C. M. Croce. Frequent deletions and downregulation of micro-RNA genes miR15 and miR16 at 13q14 in chronic lymphocytic leukemia Proc Natl Acad Sci U S A Nov. 26, 2002 15524-15529 99.

Gaudilliere, B., Y. Shi and A. Bonni. RNA interference reveals a requirement for myocyte enhancer factor 2A in activity-dependent neuronal survival J Biol Chem Nov. 29, 2002 46442-46446 277.

Jones, L. Revealing micro-RNAs in plants Trends Plant Sci Nov. 2002 473-475 7.

Schauer, S. E., S. E. Jacobsen, D. W. Meinke and A. Ray. Dicer-LIKE1: blind men and elephants in *Arabidopsis* development Trends Plant Sci Nov. 2002 487-491 7.

Okazaki, Y., M. Furuno, T. Kasukawa, J. Adachi, H. Bono, S. Kondo, et al. Analysis of the mouse transcriptome based on functional annotation of 60,770 full-length cDNAs Nature Dec. 5, 2002 563-573 420.

Dennis, C. Small RNAs: the genome's guiding hand? Nature Dec. 19-26, 2002 732 420.

Uchida, N., S. Hoshino, H. Imataka, N. Sonenberg and T. Katada. A novel role of the mammalian GSPT/eRF3 associating with poly(A)-binding protein in Cap/Poly(A)-dependent translation J Biol Chem Dec. 27, 2002 50286-50292 277.

Huttenhofer, A., J. Brosius and J. P. Bachellerie. RNomics: identification and function of small, non-messenger RNAs Curr Opin Chem Biol Dec. 2002 835-843 6.

Wood, N. T. Unravelling the molecular basis of viral suppression of PTGS Trends Plant Sci 2002 384 7.

Cohen, O., C. Erb, D. Ginzberg, Y. Pollak, S. Seidman, S. Shoham, R. Yirmiya and H. Soreq. Neuronal overexpression of "readthrough" acetylcholinesterase is associated with antisense-suppressible behavioral impairments Mol Psychiatry *No date in pubmed* 2002 874-885 7.

Mlotshwa, S., O. Voinnet, M. F. Mette, M. Matzke, H. Vaucheret, S. W. Ding, G. Pruss and V. B. Vance. RNA silencing and the mobile silencing signal Plant Cell *No date in pubmed* 2002 S289-301 14 Suppl.

Tang, G., B. J. Reinhart, D. P. Bartel and P. D. Zamore. A biochemical framework for RNA silencing in plants Genes Dev Jan. 1, 2003 49-63 17.

Kawasaki, H. and K. Taira. Short hairpin type of dsRNAs that are controlled by tRNA(Val) promoter significantly induce RNAi-mediated gene silencing in the cytoplasm of human cells Nucleic Acids Res Jan. 15, 2003 700-707 31.

Ashrafi, K., F. Y. Chang, J. L. Watts, A. G. Fraser, R. S. Kamath, J. Ahringer and G. Ruvkun. Genome-wide RNAi analysis of *Caenorhabditis elegans* fat regulatory genes Nature Jan. 16, 2003 268-272 421.

Kamath, R. S., A. G. Fraser, Y. Dong, G. Poulin, R. Durbin, M. Gotta, A. Kanapin, N. Le Bot, S. Moreno, M. Sohrmann, D. P. Welchman, P. Zipperlen and J. Ahringer. Systematic functional analysis of the *Caenorhabditis elegans* genome using RNAi Nature Jan. 16, 2003 231-237 421.

Tuschl, T. Functional genomics: RNA sets the standard Nature Jan. 16, 2003 220-221 421.

Iyer, L. M., E. V. Koonin and L. Aravind. Evolutionary connection between the catalytic subunits of DNA-dependent RNA polymerases and eukaryotic RNA-dependent RNA polymerases and the origin of RNA polymerases BMC Struct Biol Jan. 28, 2003 1 3.

Shi, Y. Mammalian RNAi for the masses Trends Genet Jan. 2003 9-12 19.

Cerutti, H. RNA interference: traveling in the cell and gaining functions? Trends Genet Jan. 2003 39-46 19.

Zeng, Y. and B. R. Cullen. Sequence requirements for micro RNA processing and function in human cells Rna Jan. 2003 112-123 9.

Kawasaki, H., E. Suyama, M. Iyo and K. Taira. siRNAs generated by recombinant human Dicer induce specific and significant but target site-independent gene silencing in human cells Nucleic Acids Res Feb. 1, 2003 981-987 31.

Reiner, A., D. Yekutieli and Y. Benjamin!. Identifying differentially expressed genes using false discovery rate controlling procedures Bioinformatics Feb. 12, 2003 368-375 19.

Doench, J. G., C. P. Petersen and P. A. Sharp. siRNAs can function as miRNAs Genes Dev Feb. 15, 2003 438-442 17.

Gupta, V., A. Cherkassky, P. Chatis, R. Joseph, A. L. Johnson, J. Broadbent, T. Erickson and J. Dimeo. Directly labeled mRNA produces highly precise and unbiased differential expression data Nucleic Acids Res Feb. 15, 2003 e13 31.

Boffelli, D., J. McAuliffe, D. Ovcharenko, K. D. Lewis, I. Ovcharenko, L. Pachter and E. M. Rubin. Phylogenetic shadowing of primate sequences to find functional regions of the human genome Science Feb. 28, 2003 1391-1394 299.

Kasschau, K. D., Z. Xie, E. Allen, C. Llave, E. J. Chapman, K. A. Krizan and J. C. Carrington. P1/HC-Pro, a viral suppressor of RNA silencing, interferes with *Arabidopsis* development and miRNA unction Dev Cell Feb. 2003 205-217 4.

Carmell, M. A., L. Zhang, D. S. Conklin, G. J. Hannon and T. A. Rosenquist. Germline transmission of RNAi in mice Nat Struct Biol Feb. 2003 91-92 10.

Dostie, J., Z. Mourelatos, M. Yang, A. Sharma and G. Dreyfuss. Numerous microRNPs in neuronal cells containing novel microRNAs Rna Feb. 2003 180-186 9.

Lagos-Quintana, M., R. Rauhut, J. Meyer, A. Borkhardt and T. Tuschl. New microRNAs from mouse and human Rna Feb. 2003 175-179 9.

Wilson, J. A., S. Jayasena, A. Khvorova, S. Sabatinos, I. G. Rodrigue-Gervais, S. Arya, Sarangi, M. Harris-Brandts, S. Beaulieu and C. D. Richardson. RNA interference blocks gene expression and RNA synthesis from hepatitis C replicons propagated in human liver cells Proc Natl Acad Sci U S A Mar. 4, 2003 2783-2788 100.

Lim, L. P., M. E. Glasner, S. Yekta, C. B. Burge and D. P. Bartel. Vertebrate microRNA genes Science Mar. 7, 2003 1540 299.

Maniataki, E., A. E. Martinez De Alba, R. Sagesser, M. Tabler and M. Tsagris. Viroid RNA systemic spread may depend on the interaction of a 71-nucleotide bulged hairpin with the host protein VirP1 Rna Mar. 2003 346-354 9.

Ambros, V., B. Bartel, D. P. Bartel, C. B. Burge, J. C. Carrington, X. Chen, G. Dreyfuss, S. R. Eddy, S. Griffiths-Jones, M. Marshall, M. Matzke, G. Ruvkun and T. Tuschl. A uniform system for microRNA annotation RNA Mar. 2003 277-279 9.

Findley, S. D., M. Tamanaha, N. J. Clegg and H. Ruohola-Baker. Maelstrom, a *Drosophila* spindle-class gene, encodes a protein that colocalizes with Vasa and RDE1/AGO1 homolog, Aubergine, in nuage Development Mar. 2003 859-871 130.

Konforti, B. The news and you Nat Struct Biol 2003 147 10.

Stein, T. D. And J. A. Johnson. Genetic programming by the proteolytic fragments of the amyloid precursor protein: somewhere between confusion and clarity Rev Neurosci *No date in pubmed* 2003 317-341 14.

Szymanski, M., M. Z. Barciszewska, M. Zywicki and J. Barciszewski. Noncoding RNA transcripts J Appl Genet *No Datein Pubmed* 2003 1-19 44.

Hulme JT et al. J. Biol. Chem. 2002;277(6):4079-87.

Brennecke J. PLoS Biology 2005;3(3):e85.

Doench JG and Sharp PA. Genes Dev, 2004;18(5):504-11.

Enright AJ. Genome Biology 2003;5:R1.

Lai EC. Nature Genetics 2002;30:363-4.

Lai EC. Genome Biology 2004;5:115.

Lewis BP. Cell 2003;115:787-98.

Stark A. PLoS Biology 2003;1(3):397-409.

Vella MC. Chemistry & Biology 2004;11:1619-23.

* cited by examiner

FIG. 8

```
   ┌─────────────────────┐
   │  POTENTIAL NOVEL    │
   │  HOST TARGET GENE   │
   │ HAVING BINDING-SITE/S│
   └──────────┬──────────┘
              ▼
         ╱ FUNCTION ╲  N
         ╲  KNOWN?  ╱─────┐
              │ Y         │
              ▼           │
         ╱ DISEASE ╲   N  │
         ╲ RELATED?╱─────┤
              │ Y         │
              ▼           │
         ╱ SPECIFIC╲   N  │
         ╲ UTILITY?╱─────┤
              │ Y         │
              ▼           ▼
   ┌──────────────┐  ┌──────────────┐
   │   ACCEPT     │  │   REJECT     │
   │NOVEL VIRAL   │  │POTENTIAL     │
   │   GENE       │  │ VIRAL GENE   │
   └──────────────┘  └──────────────┘
```

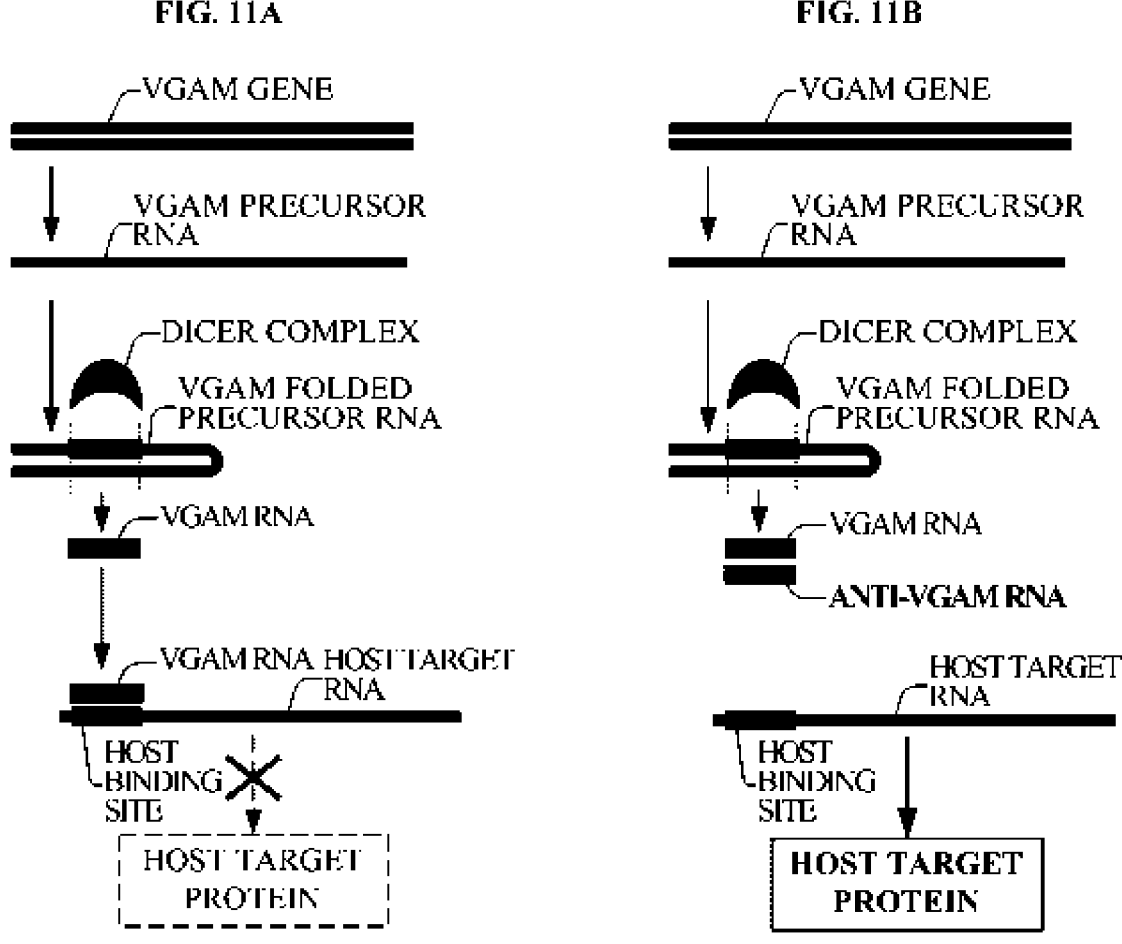

EST72223 sequence:

FIG. 12A

CCCTTATTAGAGGATTCTGCTCATGCCAGG**GTGAGGTAGTAAGTTGT
ATTGTTGTGGGTAGGGATATTAGGCCCCAATTAGAAGATAACTAT
ACAACTTACTACTTTCCC**TGGTGTGTGGCATATTCACACTTAGTCTTA  MIR98
GCAGTGTTGCCTCCATCAGACAAAGTTGTAGATGTTCCTTGGATAATT
TGGACTGGAAGAAAAGAGACATGGAAGGGGACAGATGGTGTTTAGG
GTGAGGCAGATGTCATTATAAAGTGACTTGTCTTTCATTAATTGGAGC
ATATAATTATTTTACCTTTGGGCATGAACTCATTTTGCTATTCTTCAAC
TGTGTAATGATTGCATTTTATTAGTAATAGAACAGGAATGTGTGCAAG
GGAATGGAAAGCATACTTTAAGAATTTTGGGCCAGGCGCGGTGGTTC
ATGCCTGTAATCCCAGCATTTTTGGGAGGCCGAGGCGGGTGGATCA
CCTGAGGTCAGGAGTTCGAGACCAACCTGGCCAACACGGCGAAACC
CCGCCTCTACTCAAATACAAAAATTAGCCAGGCTTGGTGACACTCGC
CTGTGGA**TCCCAGCTACTCAGGAGGCTGAGGCAGGAGAATTGCTTGA
ACCCAGGAAGTGGAGGCTTCAGTGAGCTGAGAACACGCCACTGCA**  GAM24
CTCCAGTCCTGGGCAACAGAGCAAGACTCTGTCTCAGGAAAAAAA
AG

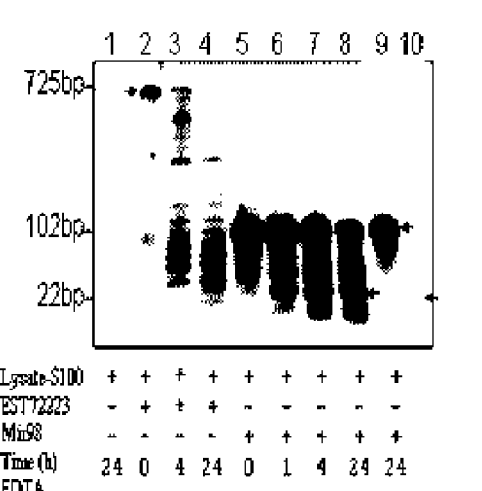

FIG. 12B

MIR98

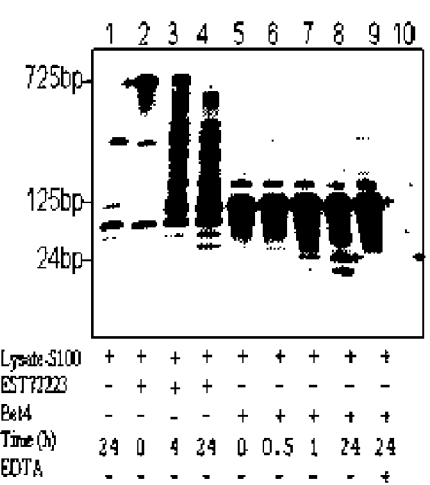

FIG. 12C

GAM24

FIG. 12D

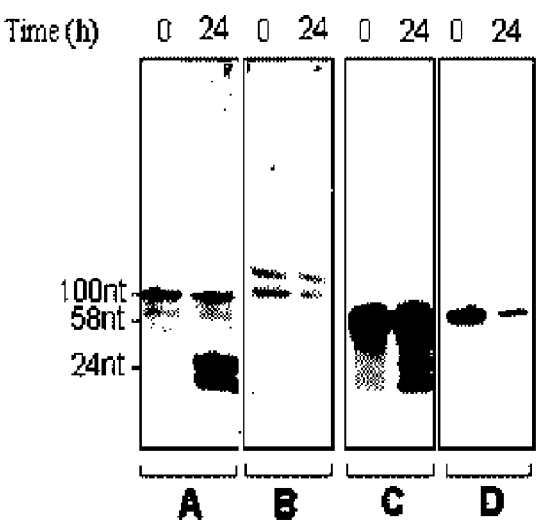

FIG. 13A

```
dbEST Id.7929020(Image4514344) sequence:
GCAAAAACTGGAAGCATTCCCTTTGAAAACTGGCACAAGACAGGGATGCCCTCT
CTCACCGCTCCTATTCAACATAGTGTTGGAAGTTCTGGCCAGGGCAATTAGGCA
GGAGAAGGAAATAAAGGGTATTCAATTAGGAAAAGAGCAAGTCAAATTGTTCCT
GTTTGCAGATGACATGATTGTATATCTAGAAAACCCCATTGTCTCAGCCCCAAA
TCTCCTTAAGCTGATAAGCAACTTCAGCAAAGTCTCAGGATACAAAATAAATCT
ACAAAAATCACAAGCATTCTTACACACCAACAACAGAAAAACAGAGCCAAATCA
TGAGTGAACTCCCATTCACAATTGCTTCAAAGAGAATAAAATACCTAGGAATCC
AACTTACAAGGGATGTGAAGGACCTCTTCAAGGAGAACTACAAACCACTGCTCA
AGGAAATAAAAGAGGATACAAACAAATGGAAGAACATTCCATGCTCATGGGTAG
GAAGAATCAATATTGTGAAAATGGCCATACTGCCCAAGGTAATTTACAGATTCA
ATGCCATCCCATCAAGCTACCAATGACTTTCTTCACAGAATTGGAAAAAACTA
CTTTAAAGTTCATATGGAACCAAAAAGAGCCCGCATCGCCAAGTCAATCCTAA
GCCAAAAGAACAAAGCTGGAGGCATCACACTACCTGACTTCAAACTTTACTACA  GAM23
AGGCTACAGTAACCAAAACACCATGGTACTGGTACCAAAACACACATATACATC
AATGGAACAGAACAGAGCCCTCAGAAATAACGCCGAATACCTACAACTATCTGA
TCTTTGACAAACCTGAGAAAACAAGCAATGGGGAAGGATTCCCTATTTAATA
AATGGTGCTGGAAAACTGACTAGCCATATGTACAAAGCTGAAACTGGATCCCT
TCCTTACACCTTATACAAAAATCAATTCAAGATGGATTAAAGATTTAAACGTTA
GACCTAAAACCATAAAACCCTAGAAGAAAACCTAGGCATTACCATTCAGGACA
TAGGCATGGGCAAGGACTTCATGTCCAAAACACCAAAAGCAATGGCAACAAAAG
ACAAAATTGACAAATGGGATCTAATTAAACTAAAGAGCTTCTGCACAGCAAAAG
AAACTACCATCAGAGTGAACAGGCAACCTACAAAATGGGAGAAAATTTTCGCAA   GAM2
CCTACTCATCTGACAAAGGGCTAATATCCACAATCTACAATGAACTCAAACAAA    5
TTTACAAAAAAAAAAAAAAA
```

FIG. 13B

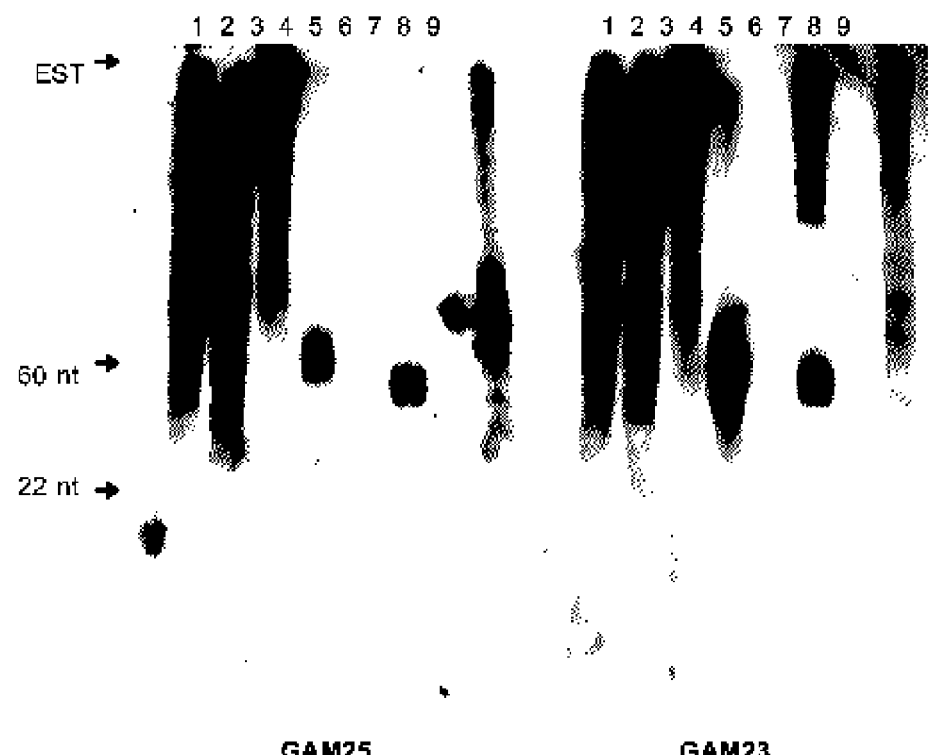

GAM25          GAM23

GAM25

FIG. 14A
dbEST Id.1388749 (Image1020185) Sequence:
ACTCCTATCAACAGTGTAAAAGCATTCCTGTTTCTCCATAATCTTGCCAGCATCTT
TTCATTTTTTGAATTATAGCCATTCTGACTGTTGTGAGATGGTGTCTCATTGTGG
TTTTGATTTGCATTTCTCAGATGATCAGTGATGTTGAAGTTTTTTGTTTGTTGGC
TGCATGTATGCCTTCTTTTGAAAAGTGTCTGTTTGTGTCCTTTGACCACTTTCTAA
TGGGGTTGAGTTTTTTTTCTTGTAAATTTGTTTAAGTTCCTTGTAGATGCTGGAT
ATTAGACCTTTGTCAGATGGATAGAGTGCAAAAATTTTCTCCCATTCTGTAGGTTG
TCGGTTTACTCTGTTGATAGGTTCTTAATGCTGTGCAGAAGCTCTTTAGTTTAATT
AGATCCCATTTGTCAATTTTGGCTTTTGTTGCAATTGCTTTTGGCATCTTCGTCAT
GAAATCTTTGCCCTTGCCTGTGTCCTGAATGGCATTGCCTAGGTTTTCTTCCAGGA
TTTTTATAGTTTTGGGTTGTAGATTTAAGTCTTTAATCCATCTTGAGTTAACTTTT
GTATATGGTTAAGGAAGGGCCCGTTTCAATTTGCTGCAAATGGCTAGCCAGTTC
TCCAGCACCATTTATTAAATAGGGAATCTTTTCCCCATTGCTTCCTTTTGTCAGG
TTTGTCAAAGATCACATGGTTGTAGGTGTGTGGTCTTATTTCTGGGTTCTCTATTC
TGTTCCATTGGGCTATGGGCCGGTTCTGTACCACCACTATGCTGTTTTGGGTACCA
TAGTCTTGTAGAATGTTTGAAGCTGGGTAGCATGATGCCTCTAGCTTTGCTCTTCT
TGCTAAGAAATGTCTTGGCTATTTGGGCTCTTTTTGGTTCCATATGAATTTTAAA
ATAGCTTTTTCTAGGTCTGTAAAGAATGTGAATAGTAGTTTAATGGGCCTAGCATT
TAATTTACAGATTGCCTTGGGCAGTGTGGTCATTTTCACGATATTGATCCTTCCTG
TCTGTGAGCATATGTTTTTCCATTTGTTTGTGTCATCTCTGATTTCTTTGAATAAT
GGTTTATAGTTATCCTTGAAAAGGTCCTTCACTTTTCTTGTTAGCTGTATTCCTAG
ATATTATACTCTTCTTGTGGCAATTGTGAATGGGAGTTAATTCATGAGTTTTCTCT GAM 26
CGGCTTGCCTGTTGTTGGTGTATAGGAATGCTAGTGACTTTTGCACATTGATTTTG
TATCCTGACACTTTCTTGAAGTTGCTTATCAGCTAAGAAGTTTTTGAGCTGACATG
ATGGAGTTTTCTAGATATAGGATCATATCATCTGCAAACAAAGATAGTTTGACTTC
CTGTCTTCCTATTTGAATAGCTTTTCTTTCTTTCTCTTGCCTGATTGCCTTGGTGA
GAATTTCTAATACTCTCTTGAATAGGAGTGGTGAGCTCGTGCCAA

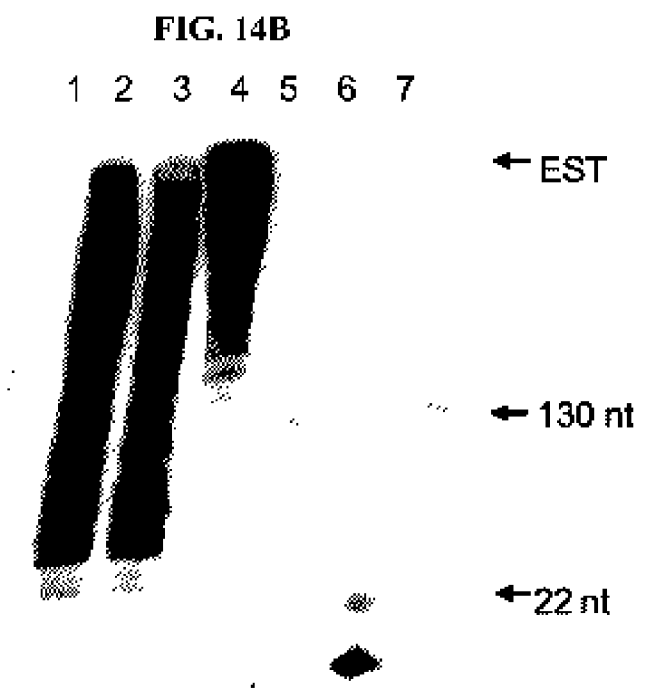

FIG. 14B

GAM26

HCMV-RELATED NUCLEIC ACIDS AND MICRORNA

BACKGROUND OF INVENTION

Continuation Statement

This application is a continuation of U.S. Provisional Patent Application Ser. No. 60/457,788, filed 27 Mar. 2003, entitled "Bioinformatically Detectable Group of Novel Viral Regulatory Genes and Uses of Thereof", and is a continuation of U.S. patent application Ser. No. 10/604,984, filed 29Aug 2003, entitled "Bioinformatically Detectable Group of Novel Viral Regulatory Genes and Uses of Thereof", and is continuation in part of U.S. patent application Ser. No. 10/604,945, filed 27 Aug. 2003, entitled "Bioinformatically Detectable Group of Novel Viral Regulatory Genes and Uses of Thereof", and is a continuation in part of U.S. patent application Ser. No. 10/303,778, filed 26 Nov. 2002, entitled "Bioinformatically Detectable Group of Novel Viral Regulatory Genes and Uses of Thereof", and is a continuation in part of U.S. Provisional Patent Application Ser. No. 60/411,230, filed 17 Jan. 2003, entitled "Bioinformatically Detectable Group of Novel HIV Regulatory Genes and Uses of Thereof", and is a continuation in part of U.S. patent application Ser. No. 10/604,944, filed 28 Aug. 2003, entitled "Bioinformatically Detectable Group of Novel HIV Regulatory Genes and Uses of Thereof", and is a continuation in part of U.S. Provisional Patent Application Ser. No. 60/441,241, filed 17 Jan. 2003, entitled "Bioinformatically Detectable Group of Novel Vaccinia Regulatory Genes and Uses of Thereof", and is a continuation in part of U.S. patent application Ser. No. 10/604,943, filed 28 Aug. 2003, entitled "Bioinformatically Detectable Group of Novel Vaccinia Regulatory Genes and Uses of Thereof", and is a continuation in part of U.S. patent application Ser. No. 10/604,942, filed 28 Aug. 2003, entitled "Bioinformatically Detectable Group of Novel Viral Regulatory Genes and Uses of Thereof", and is a continuation in part of U.S. patent application Ser. No. 10/310,188, filed 5 Dec. 2002, entitled "Bioinformatically Detectable Group of Novel Viral Regulatory Genes and Uses of Thereof", and is a continuation in part of U.S. patent application Ser. No. 10/605,838, filed 30 Oct. 2003, entitled "Bioinformatically Detectable Group of Novel HIV Regulatory Genes and Uses of Thereof", and is a continuation in part of U.S. patent application Ser. No. 10/605,840, filed 30 Oct. 2003, entitled "Bioinformatically Detectable Group of Novel Vaccinia Regulatory Genes and Uses of Thereof", the disclosures of which applications are all hereby incorporated by reference and claims priority therefrom

FIELD OF THE INVENTION

The present invention relates to a group of bioinformatically detectable novel viral RNA regulatory genes, here identified as "viral genomic address messenger" or "VGAM" genes.

DESCRIPTION OF PRIOR ART

Small RNAs are known to perform diverse cellular functions, including post-transcriptional gene expression regulation. The first two such RNA genes, Lin-4 and Let-7, were identified by genetic analysis of Caenorhabditis Elegans (Elegans) developmental timing, and were termed short temporal RNA (stRNA) (Wightman, B., Ha, I., Ruvkun, G., Cell 75, 855 (1993); Erdmann, V. A. et al., Nucleic Acids Res. 29, 189 (2001); Lee, R. C., Feinbaum, R. L., Ambros, V., Cell 75, 843 (1993); Reinhart, B. et al., Nature 403, 901 (2000)).

Lin-4 and Let-7 each transcribe a ~22 nucleotide (nt) RNA, which acts a post transcriptional repressor of target mRNAs, by binding to elements in the 3"-untranslated region (UTR) of these target mRNAs, which are complimentary to the 22 nt sequence of Lin-4 and Let-7 respectively. While Lin-4 and Let-7 are expressed at different developmental stage, first larval stage and fourth larval stage respectively, both specify the temporal progression of cell fates, by triggering post-transcriptional control over other genes (Wightman, B., Ha, I., Ruvkun, G., Cell 75, 855 (1993); Slack et al., Mol. Cell 5, 659 (2000)). Let-7 as well as its temporal regulation have been demonstrated to be conserved in all major groups of bilaterally symmetrical animals, from nematodes, through flies to human S (Pasquinelli, A., et al. Nature 408, 86 (2000)).

The initial transcription product of Lin-4 and Let-7 is a ~60-80 nt RNA, the nucleotide sequence of the first half of which is partially complimentary to that of its second half, therefore allowing this RNA to fold onto itself, forming a "hairpin structure". The final gene product is a ~22 nt RNA, which is "diced" from the above mentioned "hairpin structure", by an enzyme called Dicer, which also apparently also mediates the complimentary binding of this ~22 nt segment to a binding site in the 3" UTR of its target gene.

Recent studies have uncovered 93 new genes in this class, now referred to as micro RNA or miRNA genes, in genomes of Elegans, Drosophilea, and Human (Lagos-Quintana, M., Rauhut, R., Lendeckel, W., Tuschl, T., Science 294, 853 (2001); Lau, N. C., Lim, L. P., Weinstein, E. G., Bartel, D. P., Science 294, 858 (2001); Lee, R. C., Ambros, V., Science 294, 862 (2001). Like the well studied Lin-4 and Let-7, all newly found MIR genes produce a ~60-80 nt RNA having a nucleotide sequence capable of forming a "hairpin structure". Expressions of the precursor ~60-80 nt RNA and of the resulting diced ~22 nt RNA of most of these newly discovered MIR genes have been detected.

Based on the striking homology of the newly discovered MIR genes to their well-studied predecessors Lin-4 and Let-7, the new MIR genes are believed to have a similar basic function as that of Lin-4 and Let-7: modulation of target genes by complimentary binding to the UTR of these target genes, with special emphasis on modulation of developmental control processes. This is despite the fact that the above mentioned recent studies did not find target genes to which the newly discovered MIR genes complementarily bind. While existing evidence suggests that the number of regula-

LENGTHY TABLES

The patent contains a lengthy table section. A copy of the table is available in electronic form from the USPTO web site (http://seqdata.uspto.gov/?pageRequest=docDetail&DocID=US08207316B1). An electronic copy of the table will also be available from the USPTO upon request and payment of the fee set forth in 37 CFR 1.19(b)(3).

tory RNA genes "may turn out to be very large, numbering in the hundreds or even thousands in each genome", detecting such genes is challenging (Ruvkun G., "Perspective: Glimpses of a tiny RNA world", Science 294, 779 (2001)).

The ability to detect novel RNA genes is limited by the methodologies used to detect such genes. All RNA genes identified so far either present a visibly discernable whole body phenotype, as do Lin-4 and Let-7 (Wightman et. al., Cell 75, 855 (1993); Reinhart et al., Nature 403, 901 (2000)), or produce significant enough quantities of RNA so as to be detected by the standard biochemical genomic techniques, as do the 93 recently detected miRNA genes. Since a limited number clones were sequenced by the researchers discovering these genes, 300 by Bartel and 100 by Tuschl (Bartel et. al., Science 294 ,858 (2001); Tuschl et. al., Science 294, 853 (2001)), the RNA genes found can not be much rarer than 1% of all RNA genes. The recently detected miRNA genes therefore represent the more prevalent among the miRNA gene family.

Current methodology has therefore been unable to detect RNA genes which either do not present a visually discernable whole body phenotype, or are rare (e.g. rarer than 0.1% of all RNA genes), and therefore do not produce significant enough quantities of RNA so as to be detected by standard biochemical technique. To date, miRNA have not been detected in viruses.

SUMMARY OF INVENTION

The present invention relates to a novel group of bioinformatically detectable, viral regulatory RNA genes, which repress expression of host target host genes, by means of complementary hybridization to binding sites in untranslated regions of these host target host genes. It is believed that this novel group of viral genes represent a pervasive viral mechanism of attacking hosts, and that therefore knowledge of this novel group of viral genes may be useful in preventing and treating viral diseases.

In various preferred embodiments, the present invention seeks to provide improved method and system for detection and prevention of viral disease, which is mediated by this group of novel viral genes.

Accordingly, the invention provides several substantially pure nucleic acids (e.g., genomic nucleic acid, cDNA or synthetic nucleic acid) each encoding a novel viral gene of the VGAM group of gene, vectors comprising the nucleic acids , probes comprising the nucleic acids , a method and system for selectively modulating translation of known “target” genes utilizing the vectors, and a method and system for detecting expression of known “target” genes utilizing the probe.

By “substantially pure nucleic acid” is meant nucleic acid that is free of the genes which, in the naturally-occurring genome of the organism from which the nucleic acid of the invention is derived, flank the genes discovered and isolated by the present invention. The term therefore includes, for example, a recombinant nucleic acid which is incorporated into a vector, into an autonomously replicating plasmid or virus, or into the genomic nucleic acid of a prokaryote or eukaryote at a site other than its natural site; or which exists as a separate molecule (e.g., a cDNA or a genomic or cDNA fragment produced by PCR or restriction endonuclease digestion) independent of other sequences. It also includes a recombinant nucleic acid which is part of a hybrid gene encoding additional polypeptide sequence.

“Inhibiting translation” is defined as the ability to prevent synthesis of a specific protein encoded by a respective gene, by means of inhibiting the translation of the mRNA of this gene. “Translation inhibiter site” is defined as the minimal nucleic acid sequence sufficient to inhibit translation.

There is thus provided in accordance with a preferred embodiment of the present invention a bioinformatically detectable novel viral gene encoding substantially pure nucleic acid wherein: RNA encoded by the bioinformatically detectable novel viral gene is about 18 to about 24 nucleotides in length, and originates from an RNA precursor, which RNA precursor is about 50 to about 120 nucleotides in length, a nucleotide sequence of a first half of the RNA precursor is a partial inversed-reversed sequence of a nucleotide sequence of a second half thereof, a nucleotide sequence of the RNA encoded by the novel viral gene is a partial inversed-reversed sequence of a nucleotide sequence of a binding site associated with at least one host target gene, and a function of the novel viral gene is bioinformatically deducible.

There is further provided in accordance with another preferred embodiment of the present invention a method for anti-viral treatment comprising neutralizing said RNA.

Further in accordance with a preferred embodiment of the present invention the neutralizing comprises: synthesizing a complementary nucleic acid molecule, a nucleic sequence of which complementary nucleic acid molecule is a partial inversed-reversed sequence of said RNA, and transfecting host cells with the complementary nucleic acid molecule, thereby complementarily binding said RNA.

Further in accordance with a preferred embodiment of the present invention the neutralizing comprises immunologically neutralizing.

There is still further provided in accordance with another preferred embodiment of the present invention a bioinformatically detectable novel viral gene encoding substantially pure nucleic acid wherein: RNA encoded by the bioinformatically detectable novel viral gene includes a plurality of RNA sections, each of the RNA sections being about 50 to about 120 nucleotides in length, and including an RNA segment, which RNA segment is about 18 to about 24 nucleotides in length, a nucleotide sequence of a first half of each of the RNA sections encoded by the novel viral gene is a partial inversed-reversed sequence of nucleotide sequence of a second half thereof, a nucleotide sequence of each of the RNA segments encoded by the novel viral gene is a partial inversed-reversed sequence of the nucleotide sequence of a binding site associated with at least one target host gene, and a function of the novel viral gene is bioinformatically deducible from the following data elements: the nucleotide sequence of the RNA encoded by the novel viral gene, a nucleotide sequence of the at least one target host gene, and function of the at least one target host gene.

Further in accordance with a preferred embodiment of the present invention the function of the novel viral gene is bioinformatically deducible from the following data elements: the nucleotide sequence of the RNA encoded by the bioinformatically detectable novel viral gene, a nucleotide sequence of the at least one target host gene, and a function of the at least one target host gene.

Still further in accordance with a preferred embodiment of the present invention the RNA encoded by the novel viral gene complementarily binds the binding site associated with the at least one target host gene, thereby modulating expression of the at least one target host gene.

Additionally in accordance with a preferred embodiment of the present invention the binding site associated with at least one target host gene is located in an untranslated region of RNA encoded by the at least one target host gene.

Moreover in accordance with a preferred embodiment of the present invention the function of the novel viral gene is selective inhibition of translation of the at least one target host gene, which selective inhibition includes complementary hybridization of the RNA encoded by the novel viral gene to the binding site.

Further in accordance with a preferred embodiment of the present invention the invention includes a vector including the DNA.

Still further in accordance with a preferred embodiment of the present invention the invention includes a method of selectively inhibiting translation of at least one gene, including introducing the vector.

Moreover in accordance with a preferred embodiment of the present invention the introducing includes utilizing RNAi pathway.

Additionally in accordance with a preferred embodiment of the present invention the invention includes a gene expression inhibition system including: the vector, and a vector inserter, functional to insert the vector into a cell, thereby selectively inhibiting translation of at least one gene.

Further in accordance with a preferred embodiment of the present invention the invention includes a probe including the DNA.

Still further in accordance with a preferred embodiment of the present invention the invention includes a method of selectively detecting expression of at least one gene, including using the probe.

Additionally in accordance with a preferred embodiment of the present invention the invention includes a gene expression detection system including: the probe, and a gene expression detector functional to selectively detect expression of at least one gene.

Further in accordance with a preferred embodiment of the present invention the invention includes an anti-viral substance capable of neutralizing the RNA.

Still further in accordance with a preferred embodiment of the present invention the neutralizing includes complementarily binding the RNA.

Additionally in accordance with a preferred embodiment of the present invention the neutralizing includes immunologically neutralizing.

Moreover in accordance with a preferred embodiment of the present invention the invention includes a method for anti-viral treatment including neutralizing the RNA.

Further in accordance with a preferred embodiment of the present invention the neutralizing includes: synthesizing a complementary nucleic acid molecule, a nucleic sequence of which complementary nucleic acid molecule is a partial inversed-reversed sequence of the RNA, and transfecting host cells with the complementary nucleic acid molecule, thereby complementarily binding the RNA.

Still further in accordance with a preferred embodiment of the present invention the neutralizing includes immunologically neutralizing.

BRIEF DESCRIPTION OF DRAWINGS

FIG. 8 is a simplified flowchart illustrating operation of a function & utility analyzer constructed and operative in accordance with a preferred embodiment of the present invention;

FIGS. 11A and 11B are simplified diagrams, which when taken together illustrate a mode of gene therapy applicable to genes of the novel group of genes of the present invention;

FIG. 12A is an annotated sequence of EST72223 (SEQ ID NO:46756) comprising novel gene GAM24 detected by the gene detection system of the present invention;

FIGS. 12B and 12C are pictures of laboratory results, which when taken together demonstrate laboratory confirmation of expression of the bioinformatically detected novel gene GAM24 of FIG. 12A;

FIG. 12D provides pictures of laboratory results, which when taken together demonstrate further laboratory confirmation of expression of the bioinformatically detected novel gene GAM24 of FIG. 12A;

FIG. 13A is an annotated sequence of an EST7929020 (SEQ ID NO:46757) comprising novel genes GAM23 and GAM25 detected by the gene detection system of the present invention;

FIG. 13B is a picture of laboratory results, which confirm expression of bioinformatically detected novel genes GAM23 and GAM25 of FIG. 13A;

FIG. 14A is an annotated sequence of an EST1388749 (SEQ ID NO:46758) comprising novel gene GAM26 detected by the gene detection system of the present invention;

FIG. 14B is a picture of laboratory results, which confirm expression of the bioinformatically detected novel gene GAM26 of FIG. 14A.

BRIEF DESCRIPTION OF SEQUENCES

A Sequence Listing of genomic sequences of the present invention designated SEQ ID:1 through SEQ ID:46755 is attached to this application. The genomic listing comprises the following nucleotide sequences: Genomic sequences designated SEQ ID:1 through SEQ ID:2725 are nucleotide sequences of 2725 gene precursors of respective novel genes of the present invention; Genomic sequences designated SEQ ID:2726 through SEQ ID:5450 are nucleotide sequences of 2725 genes of the present invention; and Genomic sequences designated SEQ ID:5451 through SEQ ID:46755 are nucleotide sequences of 41305 host target binding sites.

DETAILED DESCRIPTION

Figure 1:
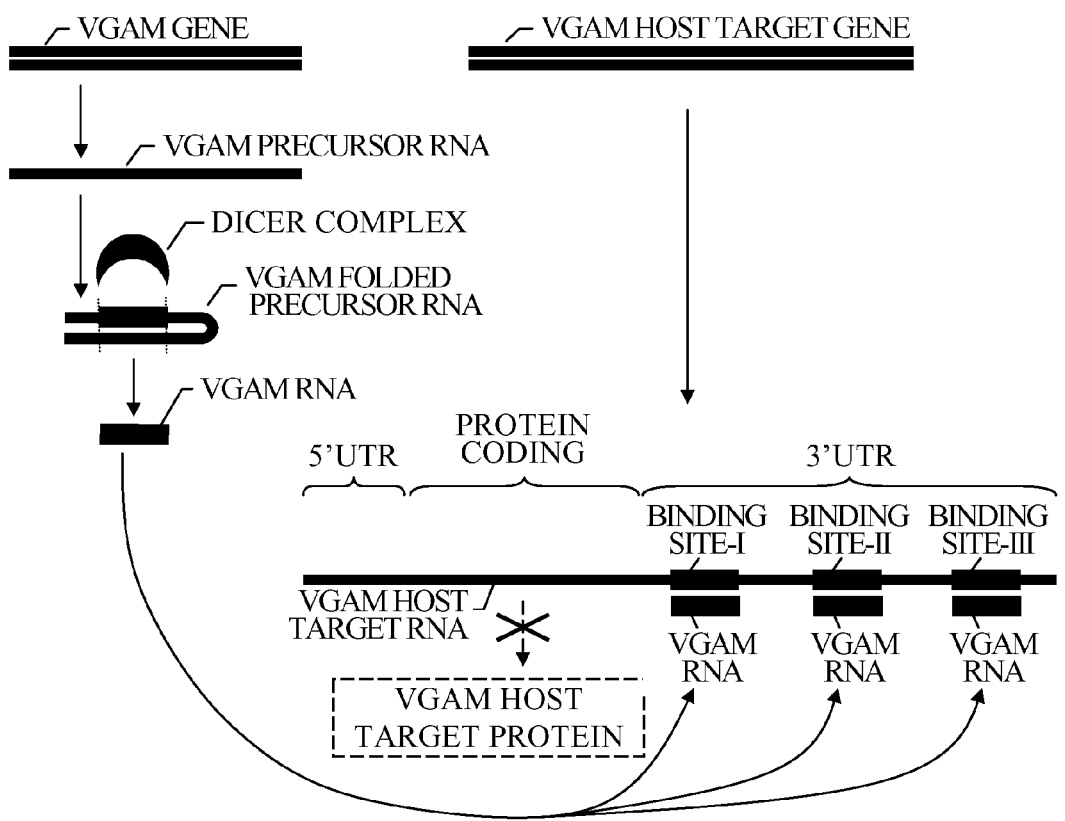
FIG. 1 is a simplified diagram illustrating a mode by which viral genes of a novel group of viral genes of the present invention, modulate expression of known host target genes.

Reference is now made to FIG. 1 which is a simplified diagram illustrating a mode by which genes of a novel group of viral genes of the present invention, modulate expression of known host target genes.

The novel genes of the present invention are viral micro RNA (miRNA)-like, regulatory RNA genes, modulating expression of known host target genes. This mode of modulation is common to other known miRNA genes, as described hereinabove with reference to the background of the invention section.

VGAM GENE is a viral gene contained in the virus genome and TARGET GENE is a human gene contained in the DNA of the human genome.

VGAM GENE encodes a VGAM PRECURSOR RNA. However, similar to other miRNA genes, and unlike most ordinary genes, its RNA, VGAM PRECURSOR RNA, does not encode a protein.

VGAM PRECURSOR RNA folds onto itself, forming VGAM FOLDED PRECURSOR RNA. As FIG. 1 illustrates, VGAM FOLDED PRECURSOR RNA forms a "hairpin structure" folding onto itself. As is well known in the art, this "hairpin structure" is typical genes of the miRNA genes, and is due to the fact that nucleotide sequence of the first half of the RNA of a gene in this group is an accurate or partial inversed-reversed sequence of the nucleotide sequence of its second half. By "inversed-reversed" is meant a sequence which is reversed and wherein each nucleotide is replaced by a complimentary nucleotide, as is well known in the art (e.g. ATGGC is the inversed-reversed sequence of GCCAT).

An enzyme complex, designated DICER COMPLEX, "dices" the VGAM FOLDED PRECURSOR RNA into a single stranded RNA segment, about 22 nucleotides long, designated VGAM RNA. As is known in the art, "dicing" of the hairpin structured RNA precursor into shorter RNA segments about 22 nucleotides long by a Dicer type enzyme is catalyzed by an enzyme complex comprising an enzyme called Dicer together with other necessary proteins.

VGAM HOST TARGET GENE encodes a corresponding messenger RNA, designated VGAM HOST TARGET RNA. This VGAM HOST TARGET RNA comprises three regions: a 5" untranslated region, a protein coding region and a 3' untranslated region, designated 5'UTR, PROTEIN CODING and 3'UTR respectively.

VGAM RNA binds complementarily a BINDING SITE, located on the 3'UTR segment of TARGET RNA. This complementarily binding is due to the fact that the nucleotide sequence of VGAM RNA is an accurate or partial inversed-reversed sequence of the nucleotide sequence of BINDING SITE.

The complimentary binding of VGAM RNA to BINDING SITE inhibits translation of VGAM HOST TARGET RNA into VGAM HOST TARGET PROTEIN. VGAM HOST TARGET PROTEIN is therefore outlined by a broken line.

It is appreciated by one skilled in the art that the mode of transcriptional inhibition illustrated by FIG. 1 with specific reference to VGAM genes of the present invention, is in fact common to all other miRNA genes. A specific complimentary binding site has been demonstrated only for Lin-4 and Let-7. All the other 93 newly discovered miRNA genes are also believed by those skilled in the art to modulate expression of other genes by complimentary binding, although specific complimentary binding sites for these genes have not yet been found (Ruvkun G., "Perspective: Glimpses of a tiny RNA world", Science 294, 779 (2001)). The present invention discloses a novel group of viral genes, the VGAM genes, belonging to the miRNA genes group, and for which a specific an complimentary binding has been determined.

Figure 2:
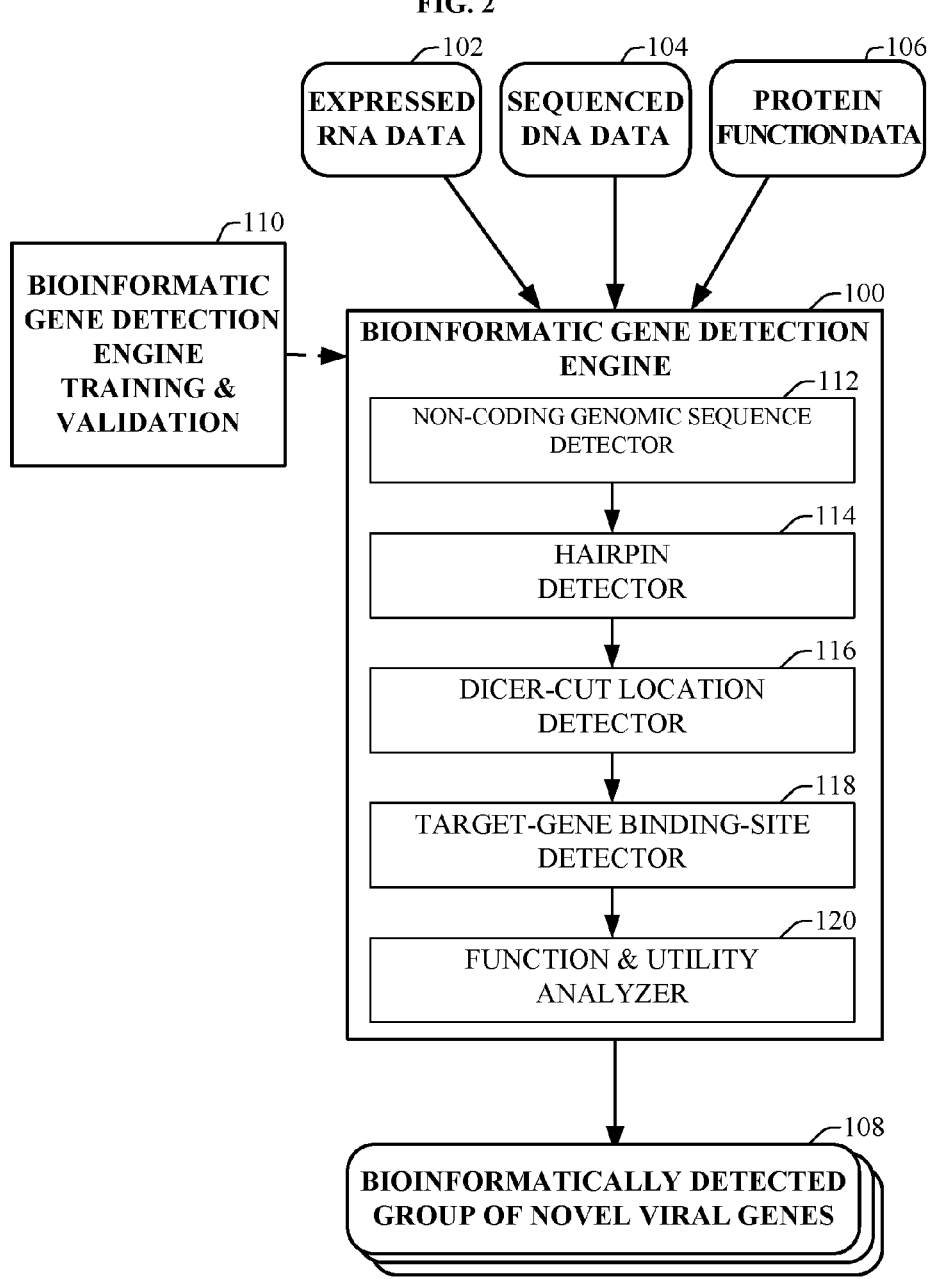
FIG. 2 is a simplified block diagram illustrating a bioinformatic gene detection system capable of detecting genes of the novel group of genes of the present invention, which system is constructed and operative in accordance with a preferred embodiment of the present invention.

Reference is now made to FIG. 2 which is a simplified block diagram illustrating a bioinformatic gene detection system capable of detecting genes of the novel group of genes of the present invention, which system is constructed and operative in accordance with a preferred embodiment of the present invention.

A centerpiece of the present invention is a bioinformatic gene detection engine 100, which is a preferred implementation of a mechanism capable of bioinformatically detecting genes of the novel group of genes of the present invention.

The function of the bioinformatic gene detection engine 100 is as follows: it receives three types of input, expressed RNA data 102, sequenced DNA data 104, and protein function data 106, performs a complex process of analysis of this data as elaborated below, and based on this analysis produces output of a bioinformatically detected group of novel genes designated 108

Expressed RNA data 102 comprises published expressed sequence tags (EST) data, , published mRNA data, as well as other sources of published RNA data. Sequenced DNA data 104 comprises alphanumeric data describing sequenced genomic data, which preferably includes annotation data such as location of known protein coding regions relative to the sequenced data. Protein function data 106 comprises scientific publications reporting studies which elucidated physiological function known proteins, and their connection, involvement and possible utility in treatment and diagnosis of various diseases. Expressed RNA data 102, sequenced DNA data 104 may preferably be obtained from data published by the National Center for Bioinformatics (NCBI) at the National Institute of Health (NIH), as well as from various other published data sources. Protein function data 106 may preferably be obtained from any one of numerous relevant published data sources, such as the Online Mendelian Inherited Disease In Man (OMIM) database developed by John Hopkins University, and also published by NCBI.

Prior to actual detection of bioinformatically detected novel genes 108 by the bioinformatic gene detection engine 100, a process of bioinformatic gene detection engine training & validation designated 110 takes place. This process uses the known miRNA genes as a training set (some 200 such genes have been found to date using biological laboratory means), to train the bioinformatic gene detection engine 100 to bioinformatically recognize miRNA-like genes, and their respective potential target binding sites. Bioinformatic gene detection engine training & validation 110 is further describe hereinbelow with reference to FIG. 3.

The bioinformatic gene detection engine 100 comprises several modules which are preferably activated sequentially, and are described as follows:

A non-coding genomic sequence detector 112 operative to bioinformatically detect non-protein coding genomic sequences. The non-coding genomic sequence detector 112 is further described hereinbelow with reference to FIGS. 4A and 4B.

A hairpin detector 114 operative to bioinformatically detect genomic "hairpin-shaped" sequences, similar to VGAM FOLDED PRECURSOR of FIG. 1. The hairpin detector 114 is further described hereinbelow with reference to FIGS. 5A and 5B.

A dicer-cut location detector 116 operative to bioinformatically detect the location on a hairpin shaped sequence which is enzymatically cut by DICER COMPLEX of FIG. 1. The dicer-cut location detector 116 is further described hereinbelow with reference to FIG. 6A.

A target-gene binding-site detector 118 operative to bioinformatically detect host target having binding sites, the nucleotide sequence of which is partially complementary to that of a given genomic sequence, such as a sequence cut by DICER COMPLEX of FIG. 1. The target-gene binding-site detector 118 is further described hereinbelow with reference to FIGS. 7A and 7B.

A function & utility analyzer 120 operative to analyze function and utility of host target, in order to identify host target which have a significant clinical function and utility. The function & utility analyzer 120 is further described hereinbelow with reference to FIG. 8.

Hardware implementation of the bioinformatic gene detection engine 100 is important, since significant computing power is preferably required in order to perform the computation of bioinformatic gene detection engine 100 in reasonable time and cost. As an example, it is estimated that using one powerful 8-processor PC Server, over 30 months of computing time (at 24 hours per day) would be required in order to detect all miRNA genes in human EST data, and their respective binding sites.

For example, in order to address this challenge at reasonable time and cost, a preferred embodiment of the present invention may comprise a cluster of a large number of personal computers (PCs), such as 100 PCs (Pentium IV, 1.7 GHz, with 40 GB storage each), connected by Ethernet to several strong servers, such as 4 servers (2-CPU, Xeon 2.2 GHz, with 200 GB storage each), combined with an 8-processor server (8-CPU, Xeon 550 Mhz w/ 8 GB RAM) connected via 2 HBA fiber-channels to an EMC Clariion 100-disks, 3.6 Terabyte storage device. Additionally, preferably an efficient database computer program, such as Microsoft (TM) SQL-Server database computer program is used and is optimized to the specific requirements of bioinformatic gene detection engine 100. Furthermore, the PCs are preferably optimized to operate close to 100% CPU usage continuously, as is known in the art. Using suitable hardware and software may preferably reduce the required calculation time in the abovementioned example from 30 months to 20 days.

It is appreciated that the abovementioned hardware configuration is not meant to be limiting, and is given as an illustration only. The present invention may be implemented in a wide variety of hardware and software configurations.

The present invention discloses 2725 novel viral genes of the VGAM group of genes, which have been detected bioinformatically, as described hereinbelow with reference to FIG. 1 through FIG. 8. Laboratory confirmation of 4 genes of the GAM group of genes is described hereinbelow with reference to FIGS. 12 through 14.

Figure 3:
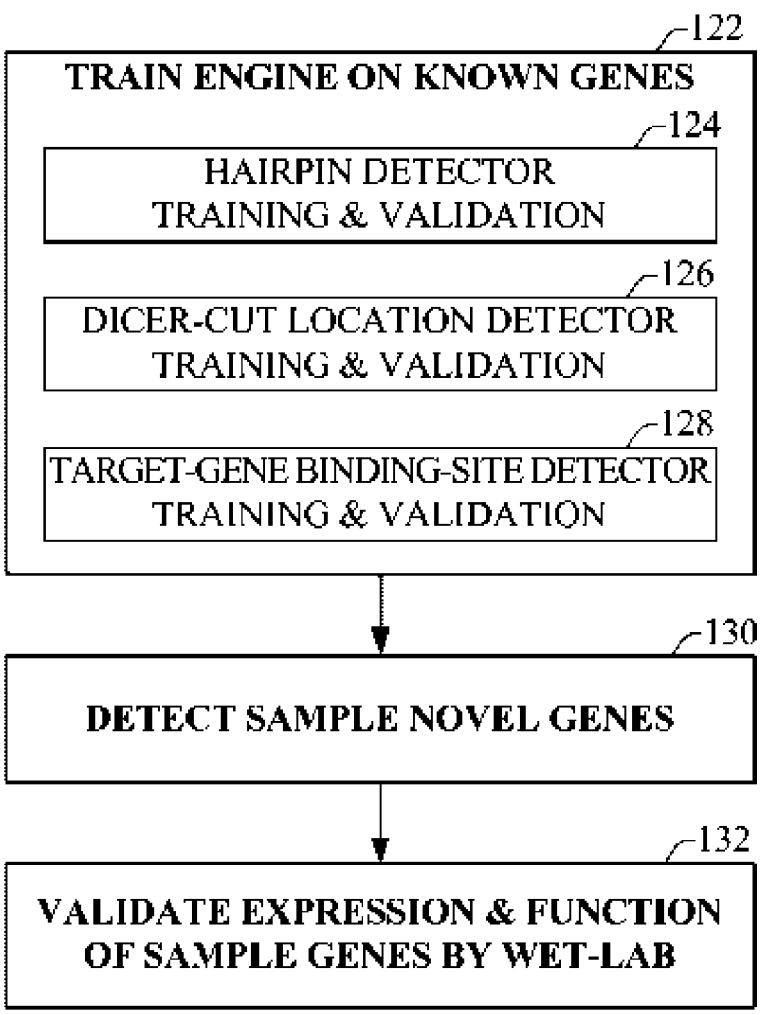
FIG. 3 is a simplified flowchart illustrating operation of a mechanism for training of a computer system to recognize the novel genes of the present invention, which mechanism is constructed and operative in accordance with a preferred embodiment of the present invention.

Reference is now made to FIG. 3 which is a simplified flowchart illustrating operation of a mechanism for training of a computer system to recognize the novel genes of the present invention. This mechanism is a preferred implementation of the bioinformatic gene detection engine training & validation 110 described hereinabove with reference to FIG. 2.

Bioinformatic gene detection engine training & validation 110 of FIG. 2 begins by training the bioinformatic gene detection engine to recognize known miRNA genes, as designated by numeral 122. This training step comprises hairpin detector training & validation 124, further described hereinbelow with reference to FIG. 12A, dicer-cut location detector training & validation 126, further described hereinbelow with reference to FIGS. 6A and 6B, and target-gene binding-site detector training & validation 128, further described hereinbelow with reference to FIG. 7A.

Next, the bioinformatic gene detection engine 100 is used to bioinformatically detect sample novel genes, as designated by numeral 130. An example of a sample novel gene thus detected is described hereinbelow with reference to FIG. 12.

Finally, wet lab experiments are preferably conducted in order to validate expression and preferably function the sample novel genes detected by the bioinformatic gene detection engine 100 in the previous step. An example of wet-lab validation of the abovementioned sample novel gene bioinformatically detected by the system is described hereinbelow with reference to FIGS. 13A and 13B.

Figure 4A:
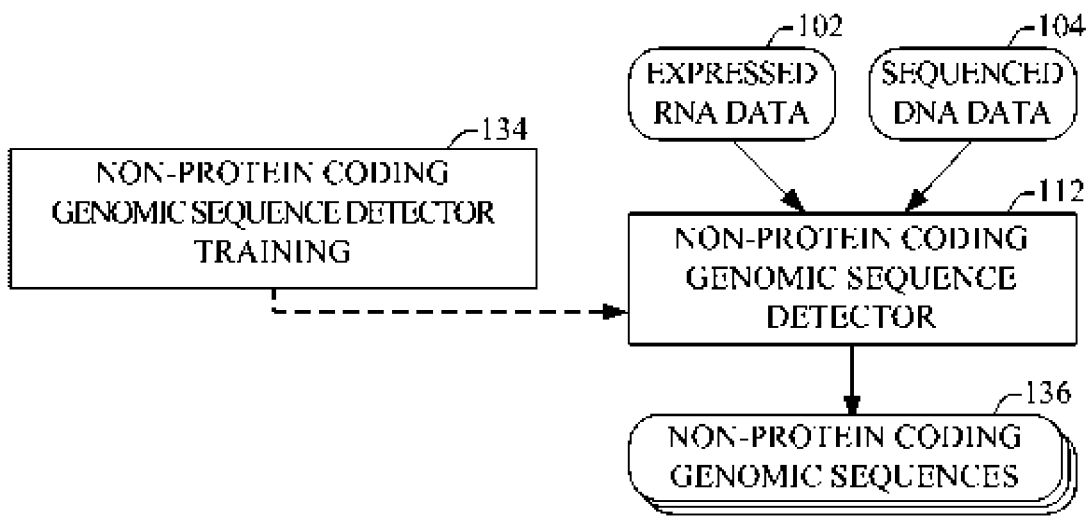
FIG. 4A is a simplified block diagram of a non-coding genomic sequence detector constructed and operative in accordance with a preferred embodiment of the present invention.

Reference is now made to FIG. 4A which is a simplified block diagram of a preferred implementation of the non-coding genomic sequence detector 112 described hereinabove with reference to FIG. 2. Non-protein coding genomic sequence detector 112 of FIG. 2 preferably receives as input at least two types of published genomic data: expressed RNA data 102, including EST data and mRNA data, and sequenced DNA data 104. After its initial training, indicated by numeral 134, and based on the abovementioned input data, the non-protein coding genomic sequence detector 112 produces as output a plurality of non-protein coding genomic sequences 136. Preferred operation of the non-protein coding genomic sequence detector 112 is described hereinbelow with reference to FIG. 4B.

Figure 4B:
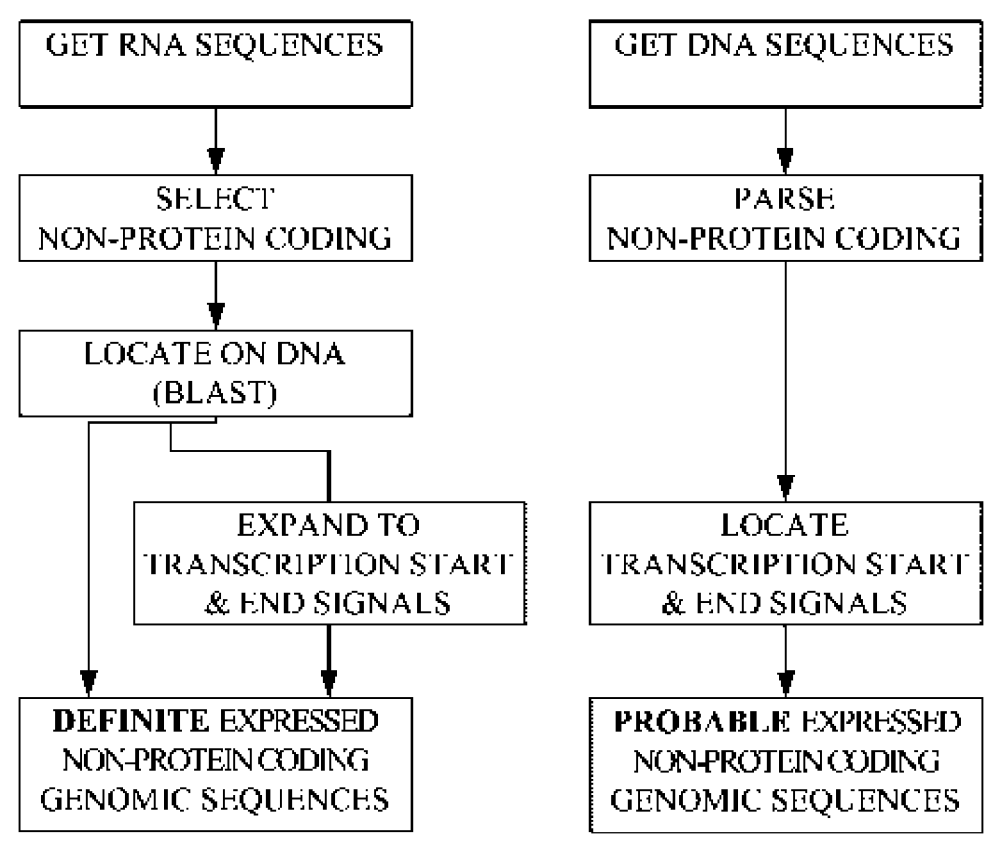
FIG. 4B is a simplified flowchart illustrating operation of a non-coding genomic sequence detector constructed and operative in accordance with a preferred embodiment of the present invention.

Reference is now made to FIG. 4B which is a simplified flowchart illustrating a preferred operation of the non-coding genomic sequence detector 112 of FIG. 2. Detection of non-protein coding genomic sequences to be further analyzed by the system generally preferably progresses in one of the following two paths.

A first path for detecting non-protein coding genomic sequences begins by receiving a plurality of known RNA sequences, such as EST data. Each RNA sequence is first compared to all known protein-coding sequences, in order to select only those RNA sequences which are non-protein coding. This can preferably be performed by BLAST comparison of the RNA sequence to known protein coding sequences. The abovementioned BLAST comparison to the DNA preferably also provides the localization of the RNA on the DNA.

Optionally, an attempt may be made to "expend" the non-protein RNA sequences thus found, by searching for transcription start and end signals, upstream and downstream of location of the RNA on the DNA respectively, as is well known in the art.

A second path for detecting non-protein coding genomic sequences starts by receiving DNA sequences. The DNA sequences are parsed into non protein coding sequences, based on published DNA annotation data: extracting those DNA sequences which are between known protein coding sequences. Next, transcription start and end signals are sought. If such signals are found, and depending on their "strength", probable expressed non-protein coding genomic sequences are yielded.

Figure 5A:
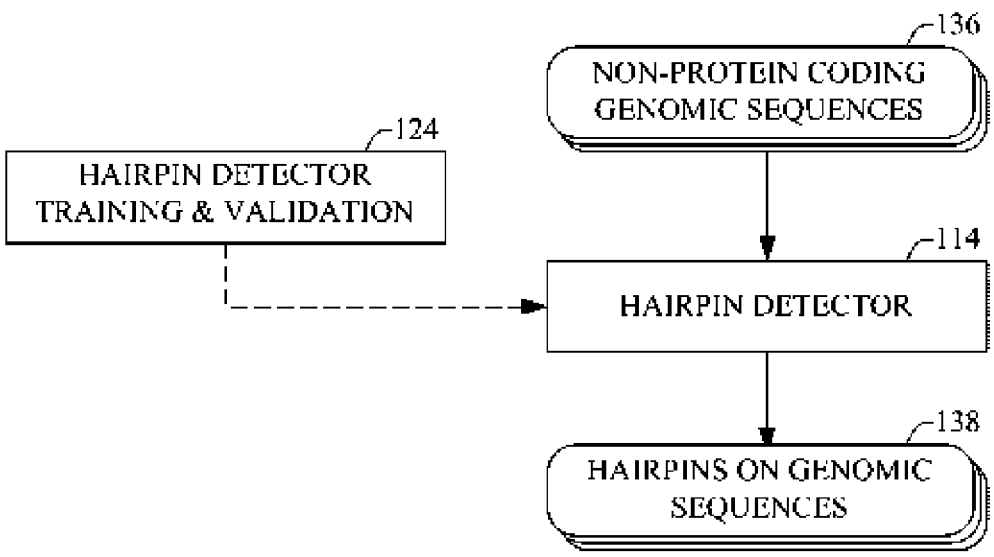
FIG. 5A is a simplified block diagram of a hairpin detector constructed and operative in accordance with a preferred embodiment of the present invention.

Reference is now made to FIG. 5A which is a simplified block diagram of a preferred implementation of the hairpin detector 114 described hereinabove with reference to FIG. 2.

The goal of the hairpin detector 114 is to detect "hairpin" shaped genomic sequences, similar to those of known miRNA genes. As mentioned hereinabove with reference to FIG. 1, a "hairpin" genomic sequence refers to a genomic sequence which "folds onto itself" forming a hairpin like shape, due to the fact that nucleotide sequence of the first half of the nucleotide sequence is an accurate or The hairpin detector 114 of FIG. 2 receives as input a plurality of non-protein coding genomic sequences 136 of FIG. 4A, and after a phase of hairpin detector training & validation 124 of FIG. 3, is operative to detect and output "hairpin shaped" sequences found in the input expressed non-protein coding sequences, designated by numeral 138.

The phase of hairpin detector training & validation 124 is an iterative process of applying the hairpin detector 114 to known hairpin shaped miRNA genes, calibrating the hairpin detector 114 such that it identifies the training set of known hairpins, as well as sequences which are similar thereto. Preferred operation of the hairpin detector 114 is described hereinbelow with reference to FIG. 5B.

Figure 5B:
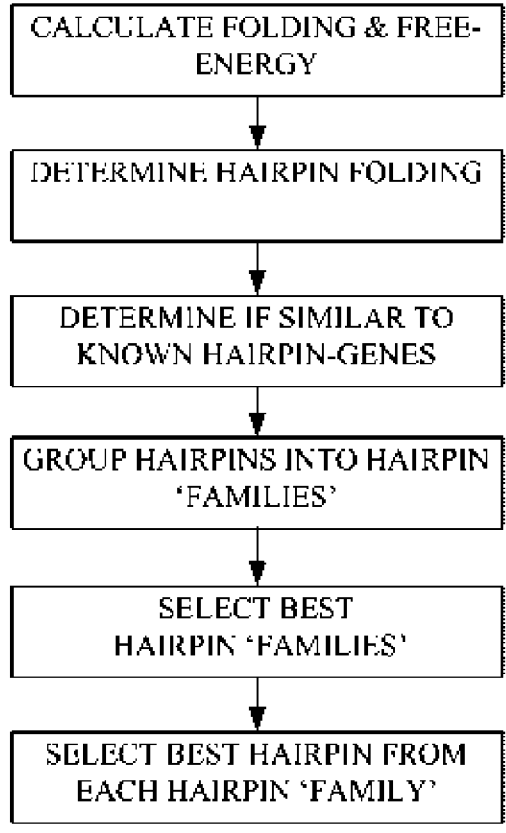
FIG. 5B is a simplified flowchart illustrating operation of a hairpin detector constructed and operative in accordance with a preferred embodiment of the present invention.

Reference is now made to FIG. 5B which is a simplified flowchart illustrating a preferred operation of the hairpin detector 114 of FIG. 2.

A hairpin structure is a two dimensional folding structure, resulting from the nucleotide sequence pattern: the nucleotide sequence of the first half of the hairpin sequence is an inversed-reversed sequence of the second half thereof. Different methodologies are known in the art for detection of various two dimensional and three dimensional hairpin structures.

In a preferred embodiment of the present invention, the hairpin detector 114 initially calculates possible 2-dimensional (2D) folding patterns of a given one of the non-protein coding genomic sequences 136, preferably using a 2D folding algorithm based on free-energy calculation, such as the Zucker algorithm, as is well known in the art.

Next, the hairpin detector 114 analyzes the results of the 2D folding, in order to determine the presence, and location of hairpin structures. A 2D folding algorithm typically provides as output a listing of the base-pairing of the 2D folded shape, i.e. a listing of which all two pairs of nucleotides in the sequence which will bond. The goal of this second step, is to asses this base-pairing listing, in order to determine if it describes a hairpin type bonding pattern.

The hairpin detector 114 then assess those hairpin structures found by the previous step, comparing them to hairpins of known miRNA genes, using various parameters such as length, free-energy, amount and type of mismatches, etc. Only hairpins that bear statistically significant resemblance of the population of hairpins of known miRNAs, according to the abovementioned parameters are accepted.

Lastly, the hairpin detector 114 attempts to select those hairpin structures which are as stable as the hairpins of know miRNA genes. This may be achieved in various manners. A preferred embodiment of the present invention utilizes the following methodology comprising three steps:

First, the hairpin detector 114 attempts to group potential hairpins into "families" of closely related hairpins. As is known in the art, a free-energy calculation algorithm, typically provides multiple "versions" each describing a different possible 2D folding pattern for the given genomic sequence, and the free energy of such possible folding. The hairpin detector 114 therefore preferably assesses all hairpins found on all "versions", grouping hairpins which appear in different versions, but which share near identical locations into a common "family" of hairpins. For example, all hairpins in different versions, the center of which is within 7 nucleotides of each other may preferably be grouped to a single "family".

Next, hairpin "families" are assessed, in order to select only those families which represent hairpins that are as stable as those of known miRNA hairpins. For example, preferably only families which are represented in at least 65% of the free-energy calculation 2D folding versions, are considered stable.

Finally, an attempt is made to select the most suitable hairpin from each selected family. For example, preferably the hairpin which appears in more versions than other hairpins, and in versions the free-energy of which is lower, may be selected.

Figure 6A:
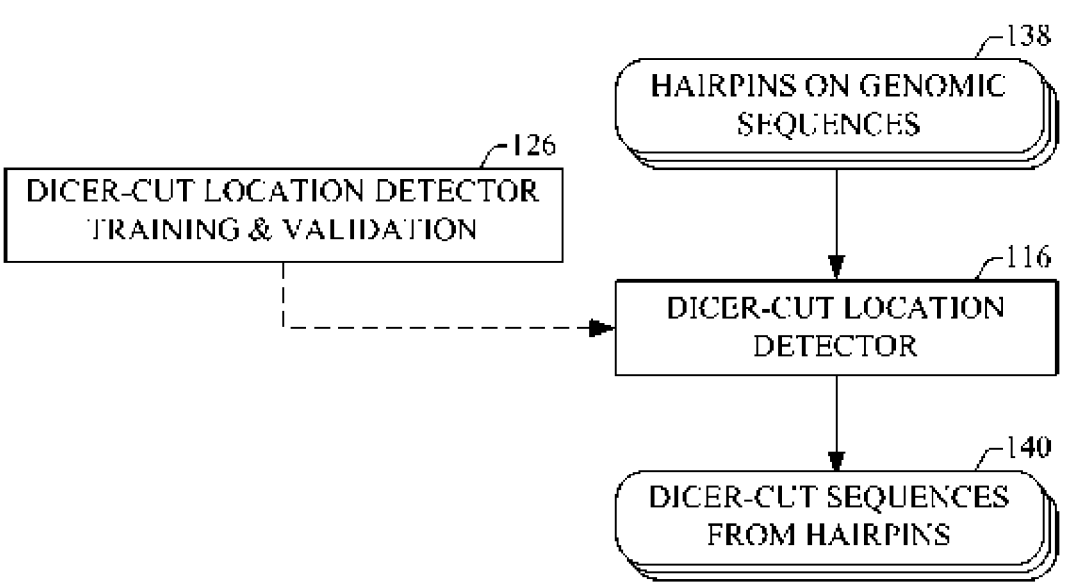
FIG. 6A is a simplified block diagram of a dicer-cut location detector constructed and operative in accordance with a preferred embodiment of the present invention.
Figure 6B:
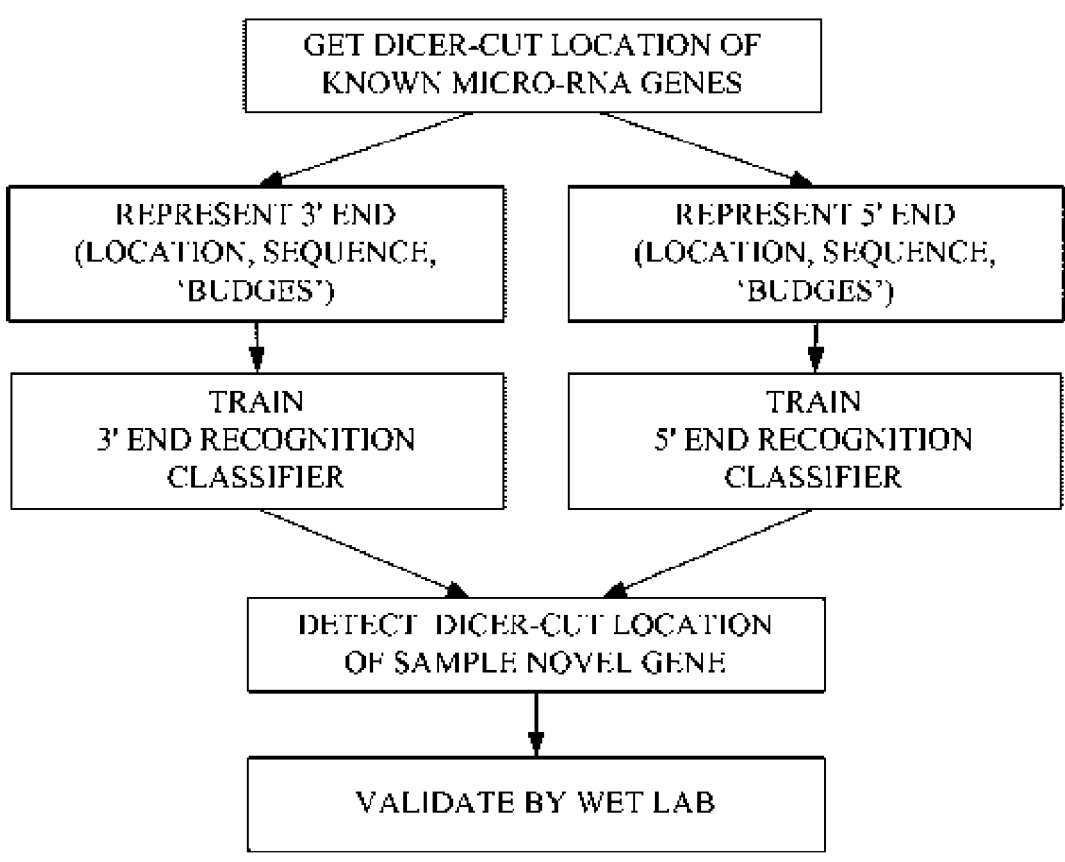
FIG. 6B is a simplified flowchart illustrating training of a dicer-cut location detector constructed and operative in accordance with a preferred embodiment of the present invention.

Reference is now made to FIG. 6A which is a simplified block diagram of a preferred implementation of the dicer-cut location detector 116 described hereinabove with reference to FIG. 2.

The goal of the dicer-cut location detector 116 is to detect the location in which DICER COMPLEX of FIG. 1, comprising the enzyme Dicer, would "dice" the given hairpin sequence, similar to VGAM FOLDED PRECURSOR RNA, yielding VGAM RNA both of FIG. 1.

The dicer-cut location detector 116 of FIG. 2 therefore receives as input a plurality of hairpins on genomic sequences 138 of FIG. 5A, which were calculated by the previous step, and after a phase of dicer-cut location detector training & validation 126 of FIG. 3, is operative to detect a respective plurality of dicer-cut sequences from hairpins 140, one for each hairpin.

In a preferred embodiment of the present invention, the dicer-cut location detector 116 preferably uses a combination of neural networks, Bayesian networks, Markovian modeling, and Support Vector Machines (SVMs) trained on the known dicer-cut locations of known miRNA genes, in order to detect dicer-cut locations. Dicer-cut location detector training & validation 126, which is further described hereinbelow with reference to FIG. 6B.

Figure 6C:
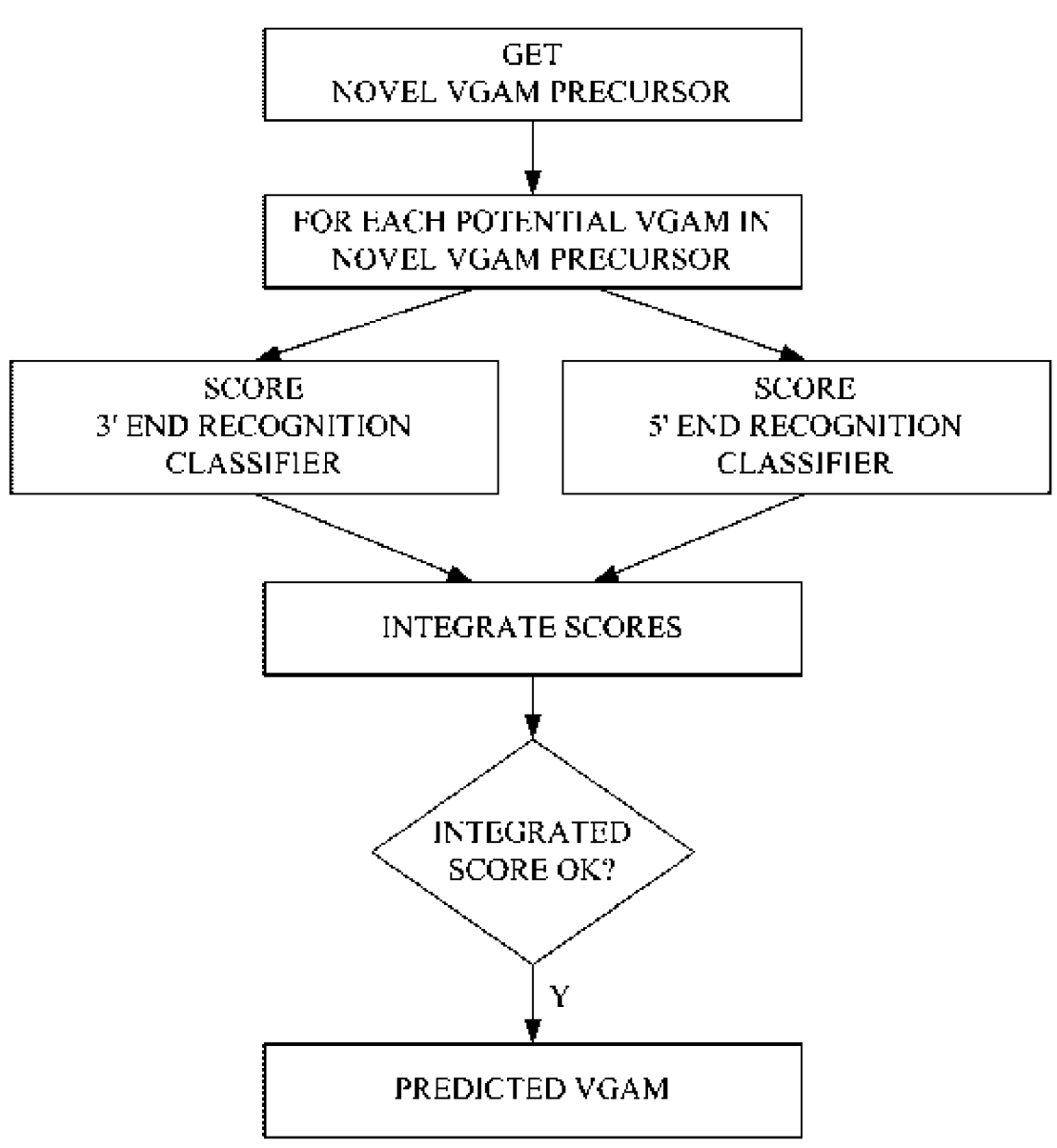
FIG. 6C is a simplified flowchart illustrating prediction of a viral genomic address messenger.

Reference is now made to FIG. 6 B which is a simplified flowchart illustrating a preferred implementation of dicer-cut location detector training & validation 126 of FIG. 3. Dicer-cut location detector 116 first preprocesses known miRNA hairpins and their respective dicer-cut locations, so as to be able to properly analyze them and train the detection system accordingly:

The folding pattern is calculated for each known miRNA, preferably based on free-energy calculation, and the size of the hairpin, the size of the loop at the center of the hairpin, and "bulges" (i.e. mismatched base-pairs) in the folded hairpin are noted.

The dicer-cut location, which is known for known miRNA genes, is noted relative to the above, as well as to the nucleotides in each location along the hairpin. Frequency of identity of nucleotides, and nucleotide-pairing, relative to their location in the hairpin, and relative to the known dicer-cut location in the known miRNA genes is analyzed and modeled.

Different techniques are well known in the art for analysis of existing pattern from a given "training set" of species belonging to a genus, which techniques are then capable, to a certain degree, to detect similar patterns in other species not belonging to the training-set genus. Such techniques include, but are not limited to neural networks, Bayesian networks, Support Vector Machines (SVM), Genetic Algorithms, Markovian modeling, and others, as is well known in the art.

Using such techniques, preferably a combination of several of the above techniques, the known hairpins are represented as a several different networks (such as neural, Bayesian, or SVM) input and output layers. Both nucleotide, and "bulge" (i.e. nucleotide pairing or mismatch) are represented for each position in the hairpin, at the input layer, and a corresponding true/false flag at each position, indicating whether it was diced by dicer at the output layer. Multiple networks are preferably used concurrently, and the results therefrom are integrated and further optimized. Markovian modeling may also be used to validate the results and enhance their accuracy. Finally, the bioinformatic detection of dicer-cut location of a sample novel is confirmed by wet-lab experimentation.

Figure 7A:
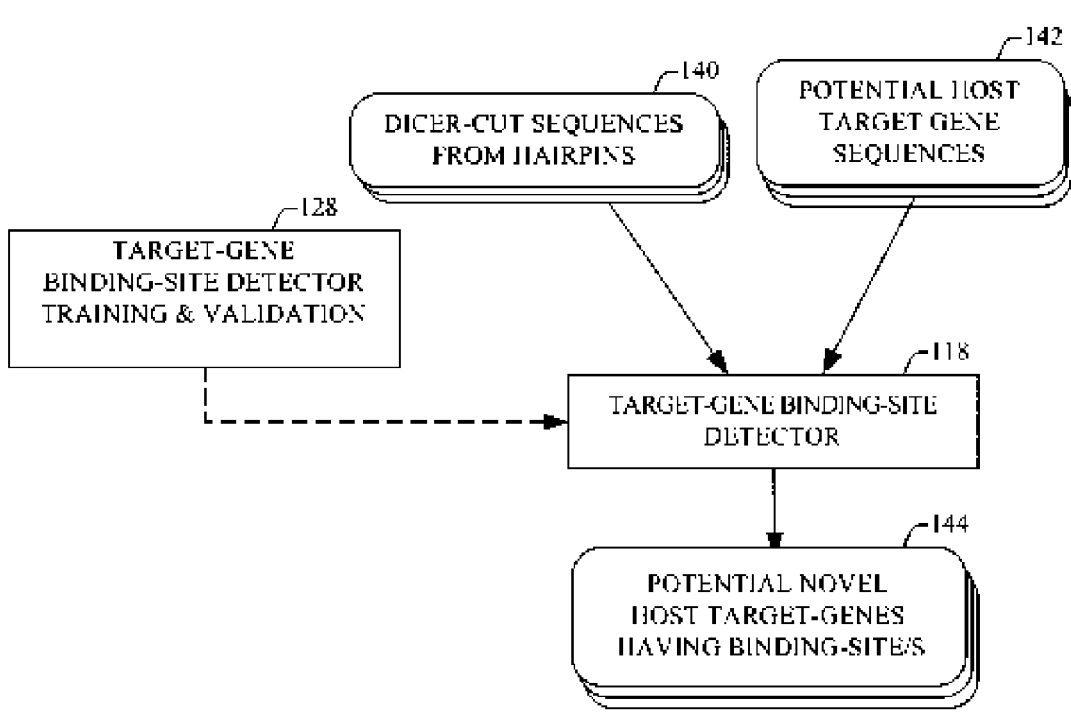
FIG. 7A is a simplified block diagram of a target-gene binding-site detector constructed and operative in accordance with a preferred embodiment of the present invention.

Reference is now made to FIG. 7A which is a simplified block diagram of a preferred implementation of the target-gene binding-site detector 118 described hereinabove with reference to FIG. 2. The goal of the target-gene binding-site detector 118 is to detect a BINDING SITE of FIG. 1, located in an untranslated region of the RNA of a known gene, the nucleotide sequence of which BINDING SITE is at least partially complementary to that of a VGAM RNA of FIG. 1, thereby determining that the abovementioned known gene is a target gene of VGAM of FIG. 1.

The target-gene binding-site detector 118 of FIG. 2 therefore receives as input a plurality of dicer-cut sequences from hairpins 140 of FIG. 6A which were calculated by the previous step, and a plurality of potential target gene sequences 142 which derive sequence DNA data 104 of FIG. 2, and after a phase of target-gene binding-site detector training & validation 128 of FIG. 3, is operative to detect target-genes having binding site/s 144 the nucleotide sequence of which is at least partially complementary to that of each of the plurality of dicer-cut sequences from hairpins 140. Preferred operation of the target-gene binding-site detector is further described hereinbelow with reference to FIG. 7B.

Figure 7B:
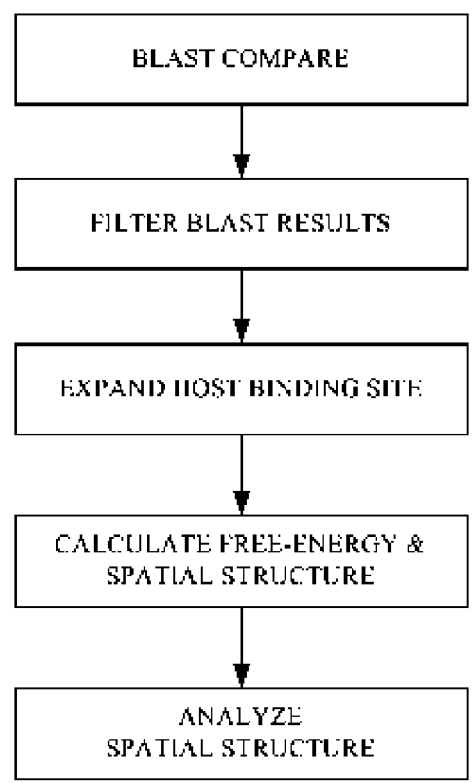
FIG. 7B is a simplified flowchart illustrating operation of a target-gene binding-site detector constructed and operative in accordance with a preferred embodiment of the present invention.

Reference is now made to FIG. 7B which is a simplified flowchart illustrating a preferred operation of the target-gene binding-site detector 118 of FIG. 2. In a preferred embodiment of the present invention, the target-gene binding-site detector 118 first performs a BLAST comparison of the nucleotide sequence of each of the plurality of dicer-cut sequences from hairpins 140, to the potential target gene sequences 142, in order to find crude potential matches. Blast results are then filtered to results which are similar to those of known binding sites (e.g. binding sites of miRNA genes Lin-4 and Let-7 to target genes Lin-14, Lin-41, Lin 28 etc.). Next the binding site is expanded, checking if nucleotide sequenced immediately adjacent to the binding site found by BLAST, may improve the match. Suitable binding sites, then are computed for free-energy and spatial structure. The results are analyzed, selecting only those binding sites, which have free-energy and spatial structure similar to that of known binding sites.

Reference is now made to FIG. 8 which is a simplified flowchart illustrating a preferred operation of the function & utility analyzer 120 described hereinabove with reference to FIG. 2. The goal of the function & utility analyzer 120 is to determine if a potential target gene is in fact a valid clinically useful target gene. Since a potential novel VGAM gene binding a binding site in the UTR of a target gene is understood to inhibit expression of that target gene, and if that target gene is shown to have a valid clinical utility, then in such a case it follows that the potential novel gene itself also has a valid useful function which is the opposite of that of the target gene.

The function & utility analyzer 120 preferably receives as input a plurality of potential novel target genes having binding-site/s 144, generated by the target-gene binding-site detector 118, both of FIG. 7A. Each potential gene, is evaluated as follows:

First the system first checks to see if the function of the potential target gene is scientifically well established. Preferably, this can be achieved bioinformatically by searching various published data sources presenting information on known function of proteins. Many such data sources exist and are published as is well known in the art.

Next, for those target genes the function of which is scientifically known and is well documented, the system then checks if scientific research data exists which links them to known diseases. For example, a preferred embodiment of the present invention utilizes the OMIM(TM) database published by NCBI, which summarizes research publications relating to genes which have been shown to be associated with diseases.

Finally, the specific possible utility of the target gene is evaluated. While this process too may be facilitated by bioinformatic means, it might require human evaluation of published scientific research regarding the target gene, in order to determine the utility of the target gene to the diagnosis and or treatment of specific disease. Only potential novel genes, the target-genes of which have passed all three examinations, are accepted as novel genes.

Figure 9:
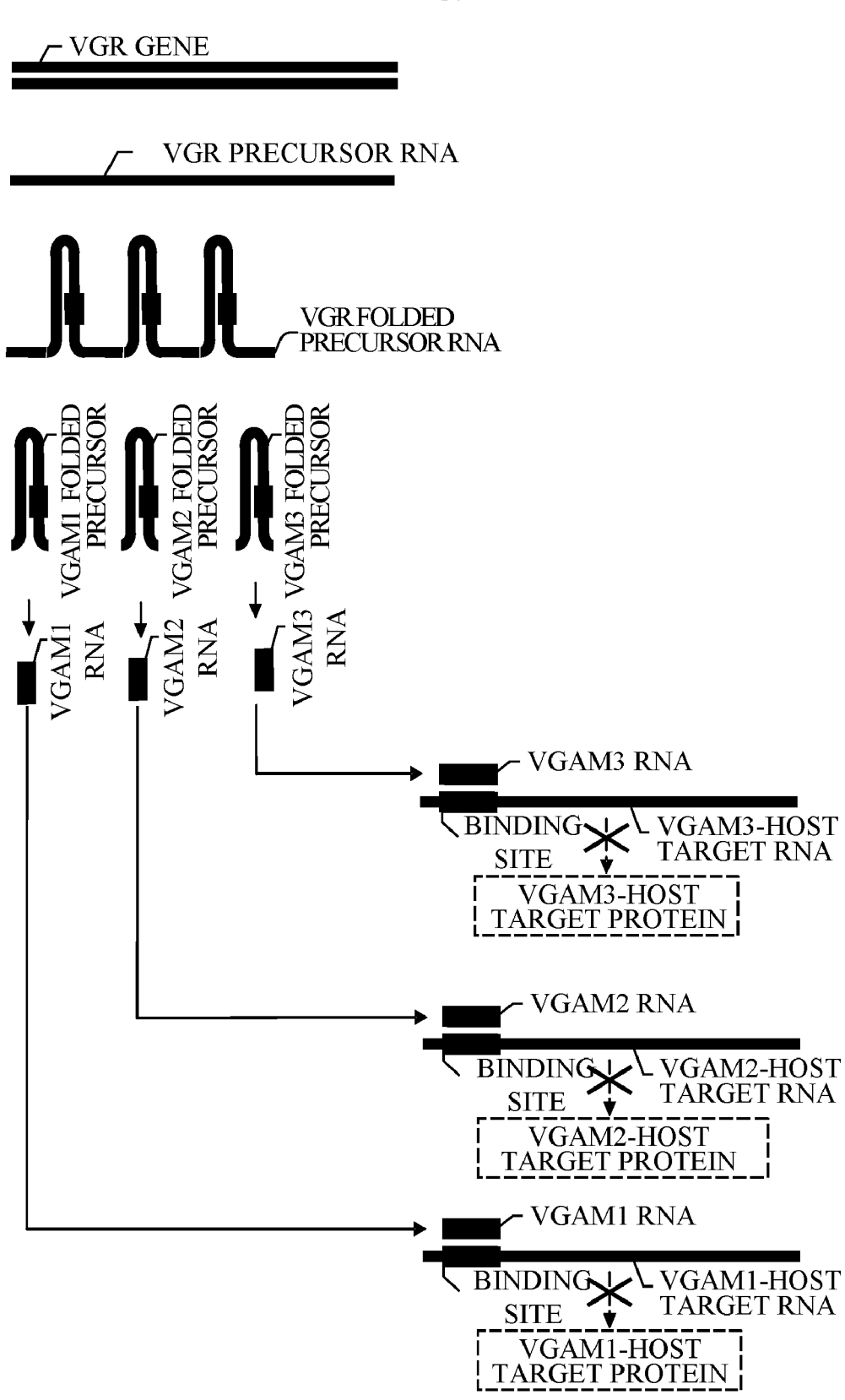
FIG. 9 is a simplified diagram describing a novel bioinformatically detected group of regulatory viral genes, referred to here as Viral Genomic Record (VGR) genes, each of which encodes an "operon-like" cluster of novel viral miRNA-like genes, which in turn modulates expression of a plurality of host target genes.

Reference is now made to FIG. 9, which is a simplified diagram describing a novel bioinformatically detected group of regulatory genes, referred to here as Viral Genomic Record (VGR) genes, that encode an "operon-like" cluster of novel viral miRNA-like genes, each modulating expression of a plurality of host target genes, the function and utility of which target genes is known.

VGR GENE (Viral Genomic Record Gene) is gene of a novel bioinformatically detected group of regulatory, non protein coding, RNA genes. The method by which VGR is detected is described hereinabove with reference to FIGS. 1-9.

VGR GENE encodes an RNA molecule, typically several hundred nucleotides long, designated VGR PRECURSOR RNA.

VGR PRECURSOR RNA folds spatially, as illustrated by VGR FOLDED PRECURSOR RNA, into a plurality of what is known in the art as "hairpin structures". The nucleotide sequence of VGR PRECURSOR RNA comprises a plurality of segments, the first half of each such segment having a nucleotide sequence which is at least a partial inversed-reversed sequence of the second half thereof, thereby causing formation of a plurality of "hairpin" structures, as is well known in the art.

VGR FOLDED PRECURSOR RNA is naturally processed by cellular enzymatic activity, into 3 separate hairpin shaped RNA segments, each corresponding to VGAM FOLDED PRECURSOR RNA of FIG. 1, designated VGAM1 FOLDED PRECURSOR, VGAM2 FOLDED PRECURSOR and VGAM3 FOLDED PRECURSOR respectively.

The above mentioned VGAM precursors, are diced by DICER COMPLEX of FIG. 1, yielding short RNA segments of about 22 nucleotides in length, each corresponding to VGAM RNA of FIG. 1, designated VGAM1 RNA, VGAM2 RNA and VGAM3 RNA respectively.

VGAM1 RNA, VGAM2 RNA and VGAM3 RNA each bind complementarily to binding sites located in untranslated regions of respective host target, designated VGAM1-HOST TARGET RNA, VGAM2-HOST TARGET RNA and VGAM3-HOST TARGET RNA respectively. This binding inhibits translation of the respective target proteins designated VGAM1-HOST TARGET PROTEIN, VGAM2-HOST TARGET PROTEIN and VGAM3-HOST TARGET PROTEIN respectively.

The structure of VGAM genes comprised in a VGR GENE, and their mode of modulation of expression of their respective target genes is described hereinabove with reference to FIG. 1. The bioinformatic approach to detection of VGAM genes comprised in a VGR GENE is described hereinabove with reference to FIGS. 1 through 9.

The present invention discloses 3283 novel viral genes of the VGR group of genes, which have been detected bioinformatically, as described hereinbelow with reference to FIG. 1 through FIG. 9. Laboratory confirmation of three genes of the VGR group of genes is described hereinbelow with reference to FIGS. 12A through 14B.

In summary, the current invention discloses a very large number of novel viral VGR genes, each of which encodes a plurality of VGAM genes, which in turn may modulate expression of a plurality of host target proteins.

Figure 10:
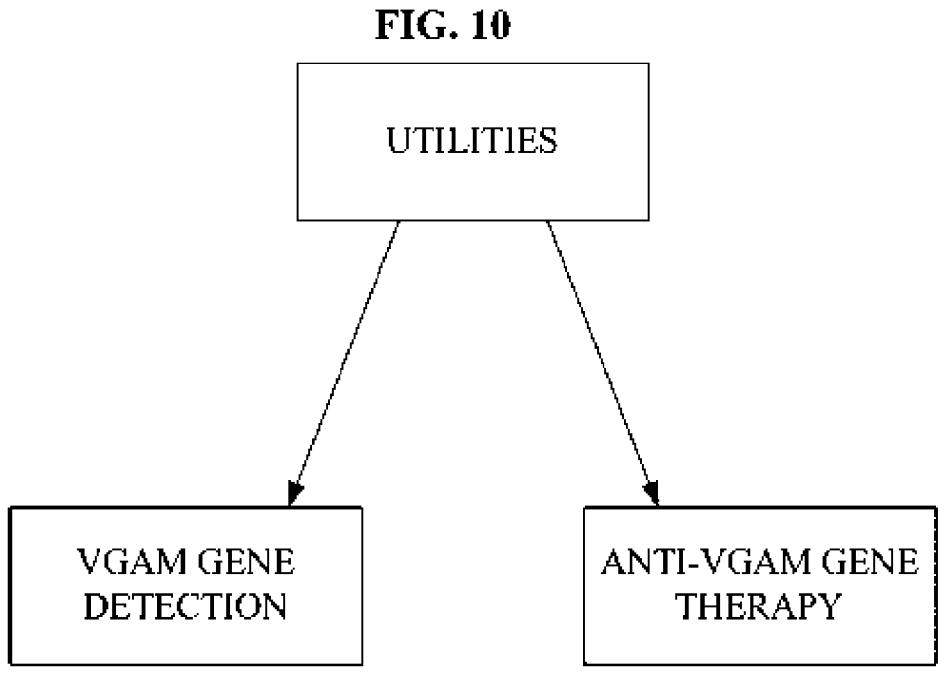
FIG. 10 is a block diagram illustrating different utilities of genes of a novel group of genes, and operons of a novel group of operons, both of the present invention.

Reference is now made to FIG. 10 which is a block diagram illustrating different utilities of genes of the novel group of genes of the present invention referred to here as VGAM genes and VGR genes.

The present invention discloses a first plurality of novel genes referred to here as VGAM genes, and a second plurality of operon-like genes referred to here as VGR genes, each of the VGR genes encoding a plurality of VGAM genes. The present invention further discloses a very large number of known target-genes, which are bound by, and the expression of which is modulated by each of the novel genes of the present invention. Published scientific data referenced by the present invention provides specific, substantial, and credible evidence that the abovementioned target genes modulated by novel genes of the present invention, are associated with various diseases. Specific novel genes of the present invention, target genes thereof and diseases associated therewith, are described hereinbelow with reference to FIG. 1 through FIG. 8. It is therefore appreciated that a function of VGAM genes and VGR genes of the present invention is modulation of expression of target genes related to known diseases, and that therefore utilities of novel genes of the present invention include diagnosis and treatment of the abovementioned diseases. FIG. 10 describes various types of diagnostic and therapeutic utilities of novel genes of the present invention.

A utility of novel genes of the present invention is detection of VGAM genes and of VGR genes. It is appreciated that since VGAM genes and VGR genes modulate expression of disease related target genes, that detection of expression of VGAM genes in clinical scenarios associated with said diseases is a specific, substantial and credible utility. Diagnosis of novel genes of the present invention may preferably be implemented by RNA expression detection techniques, including but not limited to biochips, as is well known in the art. Diagnosis of expression of genes of the present invention may be useful for research purposes, in order to further understand the connection between the novel genes of the present invention and the abovementioned related diseases, for disease diagnosis and prevention purposes, and for monitoring disease progress.

Another utility of novel genes of the present invention is anti-VGAM gene therapy, a mode of therapy which allows up regulation of a disease related target-gene of a novel VGAM gene of the present invention, by lowering levels of the novel VGAM gene which naturally inhibits expression of that target gene. This mode of therapy is particularly useful with respect to target genes which have been shown to be under-expressed in association with a specific disease. Anti-VGAM gene therapy is further discussed hereinbelow with reference to FIGS. 11A and 11B.

A further utility of novel genes of the present invention is VGAM replacement therapy, a mode of therapy which achieves down regulation of a disease related target-gene of a novel VGAM gene of the present invention, by raising levels of the VGAM gene which naturally inhibits expression of that target gene. This mode of therapy is particularly useful with respect to target genes which have been shown to be over-expressed in association with a specific disease. VGAM replacement therapy involves introduction of supplementary VGAM gene products into a cell, or stimulation of a cell to produce excess VGAM gene products. VGAM replacement therapy may preferably be achieved by transfecting cells with an artificial DNA molecule encoding a VGAM gene, which causes the cells to produce the VGAM gene product, as is well known in the art.

Yet a further utility of novel genes of the present invention is modified VGAM therapy. Disease conditions are likely to exist, in which a mutation in a binding site of a VGAM gene prevents natural VGAM gene to effectively bind inhibit a disease related target-gene, causing up regulation of that target gene, and thereby contributing to the disease pathology. In such conditions, a modified VGAM gene is designed which effectively binds the mutated VGAM binding site, i.e. is an effective anti-sense of the mutated VGAM binding site, and is introduced in disease effected cells. Modified VGAM therapy is preferably achieved by transfecting cells with an artificial DNA molecule encoding the modified VGAM gene, which causes the cells to produce the modified VGAM gene product, as is well known in the art.

An additional utility of novel genes of the present invention is induced cellular differentiation therapy. As aspect of the present invention is finding genes which determine cellular differentiation, as described hereinabove with reference to FIG. 11. Induced cellular differentiation therapy comprises transfection of cell with such VGAM genes thereby determining their differentiation as desired. It is appreciated that this approach may be widely applicable, inter alia as a means for auto transplantation harvesting cells of one cell-type from a patient, modifying their differentiation as desired, and then transplanting them back into the patient. It is further appreciated that this approach may also be utilized to modify cell differentiation in vivo, by transfecting cells in a genetically diseased tissue with a cell-differentiation determining VGAM gene, thus stimulating these cells to differentiate appropriately.

Reference is now made to FIGS. 11A and 11B, simplified diagrams which when taken together illustrate anti-VGAM gene therapy mentioned hereinabove with reference to FIG. 10. A utility of novel genes of the present invention is anti-VGAM gene therapy, a mode of therapy which allows up regulation of a disease related target-gene of a novel VGAM gene of the present invention, by lowering levels of the novel VGAM gene which naturally inhibits expression of that target gene. FIG. 11A shows a normal VGAM gene, inhibiting translation of a target gene of VGAM gene, by binding to a BINDING SITE found in an untranslated region of TARGET RNA, as described hereinabove with reference to FIG. 1.

FIG. 11B shows an example of anti-VGAM gene therapy. ANTI-VGAM RNA is short artificial RNA molecule the sequence of which is an anti-sense of VGAM RNA. Anti-VGAM treatment comprises transfecting diseased cells with ANTI-VGAM RNA, or with a DNA encoding thereof. The ANTI-VGAM RNA binds the natural VGAM RNA, thereby preventing binding of natural VGAM RNA to its BINDING SITE. This prevents natural translation inhibition of TARGET RNA by VGAM RNA, thereby up regulating expression of TARGET PROTEIN.

It is appreciated that anti-VGAM gene therapy is particularly useful with respect to target genes which have been shown to be under-expressed in association with a specific disease.

Reference is now made to FIG. 12A which is an annotated sequence of an EST comprising a novel gene detected by the gene detection system of the present invention. FIG. 12A shows the nucleotide sequence of a known human non-protein coding EST (Expressed Sequence Tag), identified as EST72223. It is appreciated that the sequence of this EST comprises sequences of one known miRNA gene, identified as MIR98, and of one novel GAM gene, referred to here as GAM24, detected by the bioinformatic gene detection system of the present invention, described hereinabove with reference to FIG. 2.

Reference is now made to FIGS. 12B and 12C that are pictures of laboratory results, which when taken together demonstrate laboratory confirmation of expression of the bioinformatically detected novel gene of FIG. 12A. Reference is now made to FIG. 12B which is a Northern blot analysis of MIR-98 and EST72223 transcripts. MIR-98 and EST72223 were reacted with MIR-98 and GAM24 probes as indicated in the figure. It is appreciated that the probes of both MIR-98 and GAM24 reacted with EST72223, indicating that EST72223 contains the sequences of MIR-98 and of GAM24. It is further appreciated that the probe of GAM24 does not cross-react with MIR-98.

Reference is now made to FIG. 12C. A Northern blot analysis of EST72223 and MIR-98 transfections were performed, subsequently marking RNA by the MIR-98 and GAM24 probes. Left, Northern reacted with MIR-98, Right, Northern reacted with GAM24. The molecular Sizes of EST72223, MIR-98 and GAM24 are indicated by arrows. Hela are control cells that have not been introduced to exogenous RNA. EST and MIR-98 Transfections are RNA obtained from Hela transfected with EST72223 and MIR-98, respectively. MIR-98 and EST are the transcripts used for the transfection experiment. The results indicate that EST72223, when transfected into Hela cells, is cut yielding known miRNA gene MIR-98 and novel miRNA gene GAM24.

Reference is now made to FIG. 12D, which is a Northern blot of a lisate experiment with MIR-98 and GAM24. Northern blot analysis of hairpins in EST72223. Left, Northern reacted with predicted Mir-98 hairpin probe, Right, Northern reacted with predicted GAM24 hairpin probe. The molecular size of EST Is indicated by arrow. The molecular sizes of Mir-98 and GAM24 are 80 nt and 100 nt, respectively as indicated by arrows. The 22 nt molecular marker is indicated by arrow. 1-Hela lysate; 2-EST incubated 4h with Hela lysate; 3-EST without lysate; 4-Mir transcript incubated 4h with Hela lysate; 5-Mir transcript incubated overnight with Hela lysate; 6-Mir transcript without lysate; 7-RNA extracted from Hela cells following transfection with Mir transcript.

Technical methods used in experiments, the results of which are depicted in FIGS. 12B, 12C and 12D are as follows:

Transcript preparations: Digoxigenin (DIG) labeled transcripts were prepared from EST72223 (TIGER), MIR98 and predicted precursor hairpins by using a DIG RNA labeling kit (Roche Molecular Biochemicals) according to the manufacturer's protocol. Briefly, PCR products with T7 promoter at the 5" end or T3 promoter at the 3" end were prepared from each DNA in order to use it as a template to prepare sense and antisense transcripts, respectively. MIR-98 was amplified using EST72223 as a template with T7miR98 forward primer: 5-"TAATACGACTCACTATAGGGTGAGGTAG-TAAGTTGTATTGTT-3" (SEQ ID NO:46759) and T3miR98 reverse primer: 5"-AATTAACCCTCACTAAAGGGAAAG-TAGTAAGTTGTATAGTT-3" (SEQ ID NO:46760) EST72223 was amplified with T7-EST 72223 forward primer: 5"-TAATACGACTCACTATAGGCCCTTATTA-GAGGATTCTGCT-3"(SEQ ID NO:46761) and T3-EST72223 reverse primer: 5"-AATTAACCCTCAC-TAAAGGTTTTTTTTTCCTGAGACAGAGT-3" (SEQ ID NO:46762) Bet-4 was amplified using EST72223 as a template with Bet-4 forward primer: 5"-GAGGCAGGAGAAT-TGCTTGA- 3" (SEQ ID NO:46763) and T3-EST72223 reverse primer: 5"-AATTAACCCTCACTAAAGGCCT-GAGACAGAGTCTTGCTC-3" (SEQ ID NO:46764). The PCR products were cleaned and used for DIG-labeled or unlabeled transcription reactions with the appropriate polymerase. For transfection experiments, CAP reaction was performed by using a mMessage mMachine kit (Ambion).

Transfection procedure: Transfection of Hela cells was performed by using TransMessenger reagent (Qiagen) according to the manufacture's protocol. Briefly, Hela cells were seeded to 1-2x $10^6$ cells per plate a day before transfection. Two µg RNA transcripts were mixed with 8 µl Enhancer in a final volume of 100 µl, mixed and incubated at room temperature for 5 min. 16 µl TransMessenger reagent was added to the RNA-Enhancer, mixed and incubated for additional 10 min. Cell plates were washed with sterile PBS twice and then incubated with the transfection mix diluted with 2.5 ml DMEM medium without serum. Cells were incubated with transfection mix for three hours under their normal growth condition (370C and 5% CO2) before the transfection mix was removed and a fresh DMEM medium containing serum was added to the cells. Cells were left to grow 48 hours before harvesting.

*Target RNA cleavage assay:* Cap-labeled target RNAs were generated using mMessage mMachine$^{TM}$(Ambion). Caped RNA transcripts were preincubated at 300C for 15 min in supplemented Hela S100 obtained from Computer Cell Culture, Mos, Belgium. After addition of all components, final concentrations were 100 mM target RNA, 1 mM ATP, 0.2 mM GTP, 10 U/ml RNasin, 30 µg/ml creatine kinase, 25 mM creatine phosphate, and 50% S100 extract. Incubation was continued for 4 hours to overnight. Cleavage reaction was stopped by the addition of 8 volumes of proteinase K buffer (200 Mm Tris-Hcl, pH 7.5, 25 m M EDTA, 300 mM NaCl, and 2% SDS). Proteinase K, dissolved in 50 mM Tris-HCl, pH 8, 5 mM CaCl2, and 50% glycerol, was added to a final concentration of 0.6 mg/ml. Sample were subjected to phenol/chlorophorm extraction and kept frozen until analyzed by urea-TBE PAGE.

Northern analysis: RNAs were extracted from cells by using Tri-reagent according to the manufacture's protocol. The RNAs were dissolved in water and heated to 650C to disrupt any association of the 25 nt RNA with larger RNA molecules. RNA were placed on ice and incubated for 30 min with PEG (MW=8000) in a final concentration of 5% and NaCl in a final concentration of 0.5M to precipitate high molecular weight nucleic acid. The RNAs were centrifuged at 10,000xg for 10 min to pellet the high molecular weight nucleic acid. The supernatant containing the low molecular weight RNAs was collected and three volumes of ethanol was added. The RNAs were placed at -200C for at least two hours and then centrifuged at 10,000xg for 10 min. The pellets were dissolved in Urea-TBE buffer (1Xtbe, 7M urea) for further analysis by a Northern blot.

RNA samples were boiled for 5 min before loading on 15%-8% polyacrylamide (19:1) gels containing 7M urea and 1xTBE. Gels were run in 1xTBE at a constant voltage of 300V and then transferred into a nylon membrane. The membrane was exposed to 3min ultraviolet light to cross link the RNAs to the membrane. Hybridization was performed overnight with DIG-labeled probes at 420C. Membranes were washed twice with SSCx2 and 0.2% SDS for 10 min. at 420C and then washed twice with SSCx0.5 for 5 min at room temperature. The membrane was then developed by using a DIG luminescent detection kit (Roche) using anti DIG and CSPD reaction, according to the manufacturer's protocol.

It is appreciated that the data presented in FIGS. 12A, 12B, 12C and 12D, when taken together validate the function of the bioinformatic gene detection engine 100 of FIG. 2. FIG. 12A shows a novel GAM gene bioinformatically detected by the bioinformatic gene detection engine 100, and FIGS. 12B, 12C and 12D show laboratory confirmation of the expression of this novel gene. This is in accord with the engine training and validation methodology described hereinabove with reference to FIG. 3.

Reference is now made to FIG. 13A which is an annotated sequence of an EST comprising a novel gene detected by the gene detection system of the present invention. FIG. 13A shows the nucleotide sequence of a known human non-protein coding EST (Expressed Sequence Tag), identified as EST 7929020. It is appreciated that the sequence of this EST comprises sequences of two novel GAM genes, referred to here as GAM23 and GAM25, detected by the bioinformatic gene detection system of the present invention, described hereinabove with reference to FIG. 2.

Reference is now made to FIG. 13B which presents pictures of laboratory results, that demonstrate laboratory confirmation of expression of the bioinformatically detected novel gene of FIG. 13A. Northern blot analysis of hairpins in EST7929020. Left, Northern reacted with predicted GAM25 hairpin probe, Right, Northern reacted with predicted GAM23 hairpin probe. The molecular size of EST is indicated by arrow. The molecular sizes of GAM23 and GAM25 are 60 nt, as indicated by arrow. The 22 nt molecular marker is indicated by arrow. 1-Hela lysate; 2-EST incubated 4h with Hela lysate; 3-EST incubated overnight with Hela lysate; 4-EST without lysate; 5-GAM transcript; 6-GAM 22 nt marker;7-GAM PCR probe; 8-RNA from control Hela cells; 9-RNA extracted from Hela cells following transfection with EST.

Figure 13C:
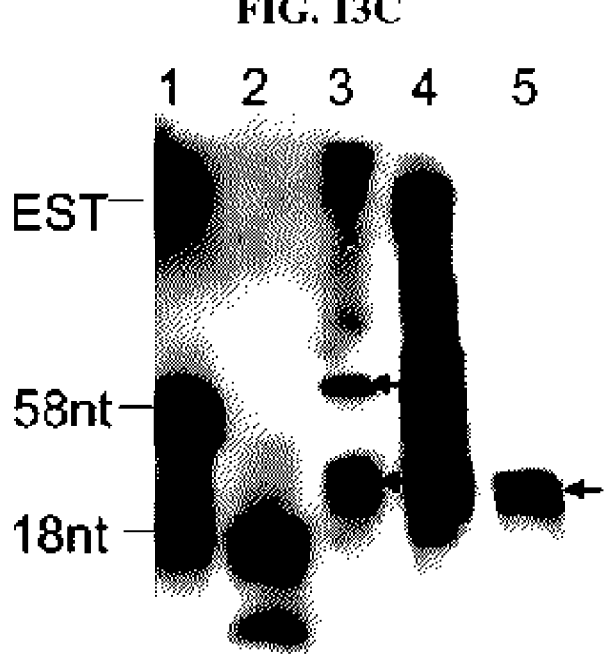
FIG. 13C is a picture of laboratory results, which confirm endogenous expression of bioinformatically detected novel gene GAM25 of FIG. 15A.

Reference is now made to FIG. 13C which is a picture of a Northern blot confirming Endogenous expression of bioinformatically detected gene GAM25 of FIG. 13A from in Hela cells. Northern was reacted with a predicted GAM25 hairpin probe. The molecular size of EST7929020 is indicated. The molecular sizes of GAM25 is 58 nt, as indicated. A 19 nt DNA oligo molecular marker is indicated. Endogenous expression of GAM25 in Hela total RNA fraction and in S-100 fraction is indicated by arrows. 1-GAM25 transcript; 2-GAM25 DNA oligo marker; 3-RNA from control Hela cells; 4-RNA extracted from Hela cells following transfection with EST; 5-RNA extracted from S-100 Hela lysate.

Reference is now made to FIG. 14A which is an annotated sequence of an EST comprising a novel gene detected by the gene detection system of the present invention. FIG. 14A shows the nucleotide sequence of a known human non-protein coding EST (Expressed Sequence Tag), identified as EST 1388749. It is appreciated that the sequence of this EST comprises sequence of a novel GAM gene, referred to here as GAM26, detected by the bioinformatic gene detection system of the present invention, described hereinabove with reference to FIG. 2.

Reference is now made to FIG. 14B which is a picture of Northern blot analysis, confirming expression of novel bioinformatically detected gene GAM26, and natural processing thereof from EST1388749. Northern reacted with predicted GAM26 hairpin probe. The molecular size of EST is indicated by arrow. The molecular sizes of GAM26 is 130 nt, as indicated by arrow. The 22 nt molecular marker is indicated by arrow. 1-Hela lysate; 2-EST incubated 4h with Hela lysate; 3-EST incubated overnight with Hela lysate; 4-EST without lysate; 5-GAM transcript; 6-GAM 22 nt marker; 7-GAM PCR probe.

FIG. 9 further provides a conceptual description of novel bioinformatically detected regulatory viral gene, referred to here as Viral Genomic Record 2740(VGR2740) viral gene, which encodes an 'operon-like' cluster of novel viral micro RNA-like genes, each of which in turn modulates expression of at least one host target gene, the function and utility of which at least one host target gene is known in the art.

VGR2740 gene, herein designated VGR GENE, is a novel bioinformatically detected regulatory, non protein coding, RNA viral gene. The method by which VGR2740 gene was detected is described hereinabove with reference to FIGS. 1-9.

VGR2740 gene encodes VGR2740 precursor RNA, herein designated VGR PRECURSOR RNA, an RNA molecule, typically several hundred nucleotides long.

VGR2740 precursor RNA folds spatially, forming VGR2740 folded precursor RNA, herein designated VGR FOLDED PRECURSOR RNA. It is appreciated that VGR2740 folded precursor RNA comprises a plurality of what is known in the art as 'hairpin' structures. These 'hairpin' structures are due to the fact that the nucleotide sequence of VGR2740 precursor RNA comprises a plurality of segments, the first half of each such segment having a nucleotide sequence which is at least a partial inversed-reversed sequence of the second half thereof, as is well known in the art.

VGR2740 folded precursor RNA is naturally processed by cellular enzymatic activity into at least 2 separate VGAM precursor RNAs, VGAM15 precursor RNA and VGAM16 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM15 RNA and VGAM16 RNA, herein schematically represented by VGAM1 RNA through VGAM3 RNA, each of which VGAM RNAs corresponding to VGAM RNA of FIG. 1.

VGAM15 RNA, herein schematically represented by VGAM1 RNA through VGAM3 RNA, binds complementarily to a host target binding site located in an untranslated region of VGAM15 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM15 host target RNA into VGAM15 host target protein, herein schematically represented by VGAM1 HOST TARGET PROTEIN through VGAM3 HOST TARGET PROTEIN, all of FIG. 1.

VGAM16 RNA, herein schematically represented by VGAM1 RNA through VGAM3 RNA, binds complementarily to a host target binding site located in an untranslated region of VGAM16 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM16 host target RNA into VGAM16 host target protein, herein schematically represented by VGAM1 HOST TARGET PROTEIN through VGAM3 HOST TARGET PROTEIN, all of FIG. 1.

It is appreciated that a function of VGR2740 gene, herein designated VGR GENE, is inhibition of expression of host target genes, as part of a novel viral mechanism of attacking a host. Accordingly, utilities of VGR2740 gene include diagnosis, prevention and treatment of viral infection by Human Herpesvirus 7. Specific functions, and accordingly utilities, of VGR2740 gene correlate with, and may be deduced from, the identity of the host target genes, which are inhibited by VGAM RNAs comprised in the 'operon-like' cluster of VGR2740 gene: VGAM15 host target protein and VGAM16 host target protein, herein schematically represented by VGAM1 HOST TARGET PROTEIN through VGAM3 HOST TARGET PROTEIN. The function of these host target genes is elaborated hereinabove with reference to VGAM15 and VGAM16. FIG. 9 further provides a conceptual description of novel bioinformatically detected regulatory viral gene, referred to here as Viral Genomic Record 2741(VGR2741) viral gene, which encodes an 'operon-like' cluster of novel viral micro RNA-like genes, each of which in turn modulates expression of at least one host target gene, the function and utility of which at least one host target gene is known in the art.

VGR2741 gene, herein designated VGR GENE, is a novel bioinformatically detected regulatory, non protein coding, RNA viral gene. The method by which VGR2741 gene was detected is described hereinabove with reference to FIGS. 1-9.

VGR2741 gene encodes VGR2741 precursor RNA, herein designated VGR PRECURSOR RNA, an RNA molecule, typically several hundred nucleotides long.

VGR2741 precursor RNA folds spatially, forming VGR2741 folded precursor RNA, herein designated VGR FOLDED PRECURSOR RNA. It is appreciated that VGR2741 folded precursor RNA comprises a plurality of what is known in the art as 'hairpin' structures. These 'hairpin' structures are due to the fact that the nucleotide sequence of VGR2741 precursor RNA comprises a plurality of segments, the first half of each such segment having a nucleotide sequence which is at least a partial inversed-reversed sequence of the second half thereof, as is well known in the art.

VGR2741 folded precursor RNA is naturally processed by cellular enzymatic activity into at least 8 separate VGAM precursor RNAs, VGAM18 precursor RNA, VGAM19 precursor RNA, VGAM20 precursor RNA, VGAM21 precursor RNA, VGAM22 precursor RNA, VGAM23 precursor RNA, VGAM24 precursor RNA and VGAM25 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM18 RNA, VGAM19 RNA, VGAM20 RNA, VGAM21 RNA, VGAM22 RNA, VGAM23 RNA, VGAM24 RNA and VGAM25 RNA, herein schematically represented by VGAM1 RNA through VGAM3 RNA, each of which VGAM RNAs corresponding to VGAM RNA of FIG. 1.

VGAM18 RNA, herein schematically represented by VGAM1 RNA through VGAM3 RNA, binds complementarily to a host target binding site located in an untranslated region of VGAM18 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM18 host target RNA into VGAM18 host target protein, herein schematically represented by VGAM1 HOST TARGET PROTEIN through VGAM3 HOST TARGET PROTEIN, all of FIG. 1.

VGAM19 RNA, herein schematically represented by VGAM1 RNA through VGAM3 RNA, binds complementarily to a host target binding site located in an untranslated region of VGAM19 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM19 host target RNA into VGAM19 host target protein, herein schematically represented by VGAM1 HOST TARGET PROTEIN through VGAM3 HOST TARGET PROTEIN, all of FIG. 1.

VGAM20 RNA, herein schematically represented by VGAM1 RNA through VGAM3 RNA, binds complementarily to a host target binding site located in an untranslated region of VGAM20 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM20 host target RNA into VGAM20 host target protein, herein schematically represented by VGAM1 HOST TARGET PROTEIN through VGAM3 HOST TARGET PROTEIN, all of FIG. 1.

VGAM21 RNA, herein schematically represented by VGAM1 RNA through VGAM3 RNA, binds complementarily to a host target binding site located in an untranslated region of VGAM21 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM21 host target RNA into VGAM21 host target protein, herein schematically represented by VGAM1 HOST TARGET PROTEIN through VGAM3 HOST TARGET PROTEIN, all of FIG. 1.

VGAM22 RNA, herein schematically represented by VGAM1 RNA through VGAM3 RNA, binds complementarily to a host target binding site located in an untranslated region of VGAM22 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM22 host target RNA into VGAM22 host target protein, herein schematically represented by VGAM1 HOST TARGET PROTEIN through VGAM3 HOST TARGET PROTEIN, all of FIG. 1.

VGAM23 RNA, herein schematically represented by VGAM1 RNA through VGAM3 RNA, binds complementarily to a host target binding site located in an untranslated region of VGAM23 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM23 host target RNA into VGAM23 host target protein, herein schematically represented by VGAM1 HOST TARGET PROTEIN through VGAM3 HOST TARGET PROTEIN, all of FIG. 1.

VGAM24 RNA, herein schematically represented by VGAM1 RNA through VGAM3 RNA, binds complementarily to a host target binding site located in an untranslated region of VGAM24 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM24 host target RNA into VGAM24 host target protein, herein schematically represented by VGAM1 HOST TARGET PROTEIN through VGAM3 HOST TARGET PROTEIN, all of FIG. 1.

VGAM25 RNA, herein schematically represented by VGAM1 RNA through VGAM3 RNA, binds complementarily to a host target binding site located in an untranslated region of VGAM25 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM25 host target RNA into VGAM25 host target protein, herein schematically represented by VGAM1 HOST TARGET PROTEIN through VGAM3 HOST TARGET PROTEIN, all of FIG. 1.

It is appreciated that a function of VGR2741 gene, herein designated VGR GENE, is inhibition of expression of host target genes, as part of a novel viral mechanism of attacking a host. Accordingly, utilities of VGR2741 gene include diagnosis, prevention and treatment of viral infection by Invertebrate Iridescent Virus 6. Specific functions, and accordingly utilities, of VGR2741 gene correlate with, and may be deduced from, the identity of the host target genes, which are inhibited by VGAM RNAs comprised in the 'operon-like' cluster of VGR2741 gene: VGAM18 host target protein, VGAM19 host target protein, VGAM20 host target protein, VGAM21 host target protein, VGAM22 host target protein, VGAM23 host target protein, VGAM24 host target protein and VGAM25 host target protein, herein schematically represented by VGAM1 HOST TARGET PROTEIN through VGAM3 HOST TARGET PROTEIN. The function of these host target genes is elaborated hereinabove with reference to VGAM18, VGAM19, VGAM20, VGAM21, VGAM22, VGAM23, VGAM24 and VGAM25. FIG. 9 further provides a conceptual description of novel bioinformatically detected regulatory viral gene, referred to here as Viral Genomic Record 2742(VGR2742) viral gene, which encodes an 'operon-like' cluster of novel viral micro RNA-like genes, each of which in turn modulates expression of at least one host target gene, the function and utility of which at least one host target gene is known in the art.

VGR2742 gene, herein designated VGR GENE, is a novel bioinformatically detected regulatory, non protein coding, RNA viral gene. The method by which VGR2742 gene was detected is described hereinabove with reference to FIGS. 1-9.

VGR2742 gene encodes VGR2742 precursor RNA, herein designated VGR PRECURSOR RNA, an RNA molecule, typically several hundred nucleotides long.

VGR2742 precursor RNA folds spatially, forming VGR2742 folded precursor RNA, herein designated VGR FOLDED PRECURSOR RNA. It is appreciated that VGR2742 folded precursor RNA comprises a plurality of what is known in the art as 'hairpin' structures. These 'hairpin' structures are due to the fact that the nucleotide sequence of VGR2742 precursor RNA comprises a plurality of segments, the first half of each such segment having a nucleotide sequence which is at least a partial inversed-reversed sequence of the second half thereof, as is well known in the art.

VGR2742 folded precursor RNA is naturally processed by cellular enzymatic activity into at least 8 separate VGAM precursor RNAs, VGAM26 precursor RNA, VGAM27 precursor RNA, VGAM28 precursor RNA, VGAM29 precursor RNA, VGAM30 precursor RNA, VGAM31 precursor RNA, VGAM32 precursor RNA and VGAM33 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM26 RNA, VGAM27 RNA, VGAM28 RNA, VGAM29 RNA, VGAM30 RNA, VGAM31 RNA, VGAM32 RNA and VGAM33 RNA, herein schematically represented by VGAM1 RNA through VGAM3 RNA, each of which VGAM RNAs corresponding to VGAM RNA of FIG. 1.

VGAM26 RNA, herein schematically represented by VGAM1 RNA through VGAM3 RNA, binds complementarily to a host target binding site located in an untranslated region of VGAM26 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM26 host target RNA into VGAM26 host target protein, herein schematically represented by VGAM1 HOST TARGET PROTEIN through VGAM3 HOST TARGET PROTEIN, all of FIG. 1.

VGAM27 RNA, herein schematically represented by VGAM1 RNA through VGAM3 RNA, binds complementarily to a host target binding site located in an untranslated region of VGAM27 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM27 host target RNA into VGAM27 host target protein, herein schematically represented by VGAM1 HOST TARGET PROTEIN through VGAM3 HOST TARGET PROTEIN, all of FIG. 1.

VGAM28 RNA, herein schematically represented by VGAM1 RNA through VGAM3 RNA, binds complementarily to a host target binding site located in an untranslated region of VGAM28 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM28 host target RNA into VGAM28 host target protein, herein schematically represented by VGAM1 HOST TARGET PROTEIN through VGAM3 HOST TARGET PROTEIN, all of FIG. 1.

VGAM29 RNA, herein schematically represented by VGAM1 RNA through VGAM3 RNA, binds complementarily to a host target binding site located in an untranslated region of VGAM29 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM29 host target RNA into VGAM29 host target protein, herein schematically represented by VGAM1 HOST TARGET PROTEIN through VGAM3 HOST TARGET PROTEIN, all of FIG. 1.

VGAM30 RNA, herein schematically represented by VGAM1 RNA through VGAM3 RNA, binds complementarily to a host target binding site located in an untranslated region of VGAM30 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM30 host target RNA into VGAM30 host target protein, herein schematically represented by VGAM1 HOST TARGET PROTEIN through VGAM3 HOST TARGET PROTEIN, all of FIG. 1.

VGAM31 RNA, herein schematically represented by VGAM1 RNA through VGAM3 RNA, binds complementarily to a host target binding site located in an untranslated region of VGAM31 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM31 host target RNA into VGAM31 host target protein, herein schematically represented by VGAM1 HOST TARGET PROTEIN through VGAM3 HOST TARGET PROTEIN, all of FIG. 1.

VGAM32 RNA, herein schematically represented by VGAM1 RNA through VGAM3 RNA, binds complementarily to a host target binding site located in an untranslated region of VGAM32 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM32 host target RNA into VGAM32 host target protein, herein schematically represented by VGAM1 HOST TARGET PROTEIN through VGAM3 HOST TARGET PROTEIN, all of FIG. 1.

VGAM33 RNA, herein schematically represented by VGAM1 RNA through VGAM3 RNA, binds complementarily to a host target binding site located in an untranslated region of VGAM33 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM33 host target RNA into VGAM33 host target protein, herein schematically represented by VGAM1 HOST TARGET PROTEIN through VGAM3 HOST TARGET PROTEIN, all of FIG. 1.

It is appreciated that a function of VGR2742 gene, herein designated VGR GENE, is inhibition of expression of host target genes, as part of a novel viral mechanism of attacking a host. Accordingly, utilities of VGR2742 gene include diagnosis, prevention and treatment of viral infection by Invertebrate Iridescent Virus 6. Specific functions, and accordingly utilities, of VGR2742 gene correlate with, and may be deduced from, the identity of the host target genes, which are inhibited by VGAM RNAs comprised in the 'operon-like' cluster of VGR2742 gene: VGAM26 host target protein, VGAM27 host target protein, VGAM28 host target protein, VGAM29 host target protein, VGAM30 host target protein, VGAM31 host target protein, VGAM32 host target protein and VGAM33 host target protein, herein schematically represented by VGAM1 HOST TARGET PROTEIN through VGAM3 HOST TARGET PROTEIN. The function of these host target genes is elaborated hereinabove with reference to VGAM26, VGAM27, VGAM28, VGAM29, VGAM30, VGAM31, VGAM32 and VGAM33. FIG. 9 further provides a conceptual description of novel bioinformatically detected regulatory viral gene, referred to here as Viral Genomic Record 2743(VGR2743) viral gene, which encodes an 'operon-like' cluster of novel viral micro RNA-like genes, each of which in turn modulates expression of at least one host target gene, the function and utility of which at least one host target gene is known in the art.

VGR2743 gene, herein designated VGR GENE, is a novel bioinformatically detected regulatory, non protein coding, RNA viral gene. The method by which VGR2743 gene was detected is described hereinabove with reference to FIGS. 1-9.

VGR2743 gene encodes VGR2743 precursor RNA, herein designated VGR PRECURSOR RNA, an RNA molecule, typically several hundred nucleotides long.

VGR2743 precursor RNA folds spatially, forming VGR2743 folded precursor RNA, herein designated VGR FOLDED PRECURSOR RNA. It is appreciated that VGR2743 folded precursor RNA comprises a plurality of what is known in the art as 'hairpin' structures. These 'hairpin' structures are due to the fact that the nucleotide sequence of VGR2743 precursor RNA comprises a plurality of segments, the first half of each such segment having a nucleotide sequence which is at least a partial inversed-reversed sequence of the second half thereof, as is well known in the art.

VGR2743 folded precursor RNA is naturally processed by cellular enzymatic activity into at least 8 separate VGAM precursor RNAs, VGAM34 precursor RNA, VGAM35 precursor RNA, VGAM36 precursor RNA, VGAM37 precursor RNA, VGAM38 precursor RNA, VGAM39 precursor RNA, VGAM40 precursor RNA and VGAM41 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM34 RNA, VGAM35 RNA, VGAM36 RNA, VGAM37 RNA, VGAM38 RNA, VGAM39 RNA, VGAM40 RNA and VGAM41 RNA, herein schematically represented by VGAM1 RNA through VGAM3 RNA, each of which VGAM RNAs corresponding to VGAM RNA of FIG. 1.

VGAM34 RNA, herein schematically represented by VGAM1 RNA through VGAM3 RNA, binds complementarily to a host target binding site located in an untranslated region of VGAM34 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM34 host target RNA into VGAM34 host target protein, herein schematically represented by VGAM1 HOST TARGET PROTEIN through VGAM3 HOST TARGET PROTEIN, all of FIG. 1.

VGAM35 RNA, herein schematically represented by VGAM1 RNA through VGAM3 RNA, binds complementarily to a host target binding site located in an untranslated region of VGAM35 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM35 host target RNA into VGAM35 host target protein, herein schematically represented by VGAM1 HOST TARGET PROTEIN through VGAM3 HOST TARGET PROTEIN, all of FIG. 1.

VGAM36 RNA, herein schematically represented by VGAM1 RNA through VGAM3 RNA, binds complementarily to a host target binding site located in an untranslated region of VGAM36 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM36 host target RNA into VGAM36 host target protein, herein schematically represented by VGAM1 HOST TARGET PROTEIN through VGAM3 HOST TARGET PROTEIN, all of FIG. 1.

VGAM37 RNA, herein schematically represented by VGAM1 RNA through VGAM3 RNA, binds complementarily to a host target binding site located in an untranslated region of VGAM37 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM37 host target RNA into VGAM37 host target protein, herein schematically represented by VGAM1 HOST TARGET PROTEIN through VGAM3 HOST TARGET PROTEIN, all of FIG. 1.

VGAM38 RNA, herein schematically represented by VGAM1 RNA through VGAM3 RNA, binds complementarily to a host target binding site located in an untranslated region of VGAM38 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM38 host target RNA into VGAM38 host target protein, herein schematically represented by VGAM1 HOST TARGET PROTEIN through VGAM3 HOST TARGET PROTEIN, all of FIG. 1.

VGAM39 RNA, herein schematically represented by VGAM1 RNA through VGAM3 RNA, binds complementarily to a host target binding site located in an untranslated region of VGAM39 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM39 host target RNA into VGAM39 host target protein, herein schematically represented by VGAM1 HOST TARGET PROTEIN through VGAM3 HOST TARGET PROTEIN, all of FIG. 1.

VGAM40 RNA, herein schematically represented by VGAM1 RNA through VGAM3 RNA, binds complementarily to a host target binding site located in an untranslated region of VGAM40 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM40 host target RNA into VGAM40 host target protein, herein schematically represented by VGAM1 HOST TARGET PROTEIN through VGAM3 HOST TARGET PROTEIN, all of FIG. 1.

VGAM41 RNA, herein schematically represented by VGAM1 RNA through VGAM3 RNA, binds complementarily to a host target binding site located in an untranslated region of VGAM41 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM41 host target RNA into VGAM41 host target protein, herein schematically represented by VGAM1 HOST TARGET PROTEIN through VGAM3 HOST TARGET PROTEIN, all of FIG. 1.

It is appreciated that a function of VGR2743 gene, herein designated VGR GENE, is inhibition of expression of host target genes, as part of a novel viral mechanism of attacking a host. Accordingly, utilities of VGR2743 gene include diagnosis, prevention and treatment of viral infection by Invertebrate Iridescent Virus 6. Specific functions, and accordingly utilities, of VGR2743 gene correlate with, and may be deduced from, the identity of the host target genes, which are inhibited by VGAM RNAs comprised in the 'operon-like' cluster of VGR2743 gene: VGAM34 host target protein, VGAM35 host target protein, VGAM36 host target protein, VGAM37 host target protein, VGAM38 host target protein, VGAM39 host target protein, VGAM40 host target protein and VGAM41 host target protein, herein schematically represented by VGAM1 HOST TARGET PROTEIN through VGAM3 HOST TARGET PROTEIN. The function of these host target genes is elaborated hereinabove with reference to VGAM34, VGAM35, VGAM36, VGAM37, VGAM38, VGAM39, VGAM40 and VGAM41. FIG. 9 further provides a conceptual description of novel bioinformatically detected regulatory viral gene, referred to here as Viral Genomic Record 2744(VGR2744) viral gene, which encodes an 'operon-like' cluster of novel viral micro RNA-like genes, each of which in turn modulates expression of at least one host target gene, the function and utility of which at least one host target gene is known in the art.

VGR2744 gene, herein designated VGR GENE, is a novel bioinformatically detected regulatory, non protein coding, RNA viral gene. The method by which VGR2744 gene was detected is described hereinabove with reference to FIGS. 1-9.

VGR2744 gene encodes VGR2744 precursor RNA, herein designated VGR PRECURSOR RNA, an RNA molecule, typically several hundred nucleotides long.

VGR2744 precursor RNA folds spatially, forming VGR2744 folded precursor RNA, herein designated VGR FOLDED PRECURSOR RNA. It is appreciated that VGR2744 folded precursor RNA comprises a plurality of what is known in the art as 'hairpin' structures. These 'hairpin' structures are due to the fact that the nucleotide sequence of VGR2744 precursor RNA comprises a plurality of segments, the first half of each such segment having a nucleotide sequence which is at least a partial inversed-reversed sequence of the second half thereof, as is well known in the art.

VGR2744 folded precursor RNA is naturally processed by cellular enzymatic activity into at least 8 separate VGAM precursor RNAs, VGAM42 precursor RNA, VGAM43 precursor RNA, VGAM44 precursor RNA, VGAM45 precursor RNA, VGAM46 precursor RNA, VGAM47 precursor RNA, VGAM48 precursor RNA and VGAM49 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM42 RNA, VGAM43 RNA, VGAM44 RNA, VGAM45 RNA, VGAM46 RNA, VGAM47 RNA, VGAM48 RNA and VGAM49 RNA, herein schematically represented by VGAM1 RNA through VGAM3 RNA, each of which VGAM RNAs corresponding to VGAM RNA of FIG. 1.

VGAM42 RNA, herein schematically represented by VGAM1 RNA through VGAM3 RNA, binds complementarily to a host target binding site located in an untranslated region of VGAM42 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM42 host target RNA into VGAM42 host target protein, herein schematically represented by VGAM1 HOST TARGET PROTEIN through VGAM3 HOST TARGET PROTEIN, all of FIG. 1.

VGAM43 RNA, herein schematically represented by VGAM1 RNA through VGAM3 RNA, binds complementarily to a host target binding site located in an untranslated region of VGAM43 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM43 host target RNA into VGAM43 host target protein, herein schematically represented by VGAM1 HOST TARGET PROTEIN through VGAM3 HOST TARGET PROTEIN, all of FIG. 1.

VGAM44 RNA, herein schematically represented by VGAM1 RNA through VGAM3 RNA, binds complementarily to a host target binding site located in an untranslated region of VGAM44 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM44 host target RNA into VGAM44 host target protein, herein schematically represented by VGAM1 HOST TARGET PROTEIN through VGAM3 HOST TARGET PROTEIN, all of FIG. 1.

VGAM45 RNA, herein schematically represented by VGAM1 RNA through VGAM3 RNA, binds complementarily to a host target binding site located in an untranslated region of VGAM45 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM45 host target RNA into VGAM45 host target protein, herein schematically represented by VGAM1 HOST TARGET PROTEIN through VGAM3 HOST TARGET PROTEIN, all of FIG. 1.

VGAM46 RNA, herein schematically represented by VGAM1 RNA through VGAM3 RNA, binds complementarily to a host target binding site located in an untranslated region of VGAM46 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM46 host target RNA into VGAM46 host target protein, herein schematically represented by VGAM1 HOST TARGET PROTEIN through VGAM3 HOST TARGET PROTEIN, all of FIG. 1.

VGAM47 RNA, herein schematically represented by VGAM1 RNA through VGAM3 RNA, binds complementarily to a host target binding site located in an untranslated region of VGAM47 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM47 host target RNA into VGAM47 host target protein, herein schematically represented by VGAM1 HOST TARGET PROTEIN through VGAM3 HOST TARGET PROTEIN, all of FIG. 1.

VGAM48 RNA, herein schematically represented by VGAM1 RNA through VGAM3 RNA, binds complementarily to a host target binding site located in an untranslated region of VGAM48 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM48 host target RNA into VGAM48 host target protein, herein schematically represented by VGAM1 HOST TARGET PROTEIN through VGAM3 HOST TARGET PROTEIN, all of FIG. 1.

VGAM49 RNA, herein schematically represented by VGAM1 RNA through VGAM3 RNA, binds complementarily to a host target binding site located in an untranslated region of VGAM49 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM49 host target RNA into VGAM49 host target protein, herein schematically represented by VGAM1 HOST TARGET PROTEIN through VGAM3 HOST TARGET PROTEIN, all of FIG. 1.

It is appreciated that a function of VGR2744 gene, herein designated VGR GENE, is inhibition of expression of host target genes, as part of a novel viral mechanism of attacking a host. Accordingly, utilities of VGR2744 gene include diagnosis, prevention and treatment of viral infection by Invertebrate Iridescent Virus 6. Specific functions, and accordingly utilities, of VGR2744 gene correlate with, and may be deduced from, the identity of the host target genes, which are inhibited by VGAM RNAs comprised in the 'operon-like' cluster of VGR2744 gene: VGAM42 host target protein, VGAM43 host target protein, VGAM44 host target protein, VGAM45 host target protein, VGAM46 host target protein, VGAM47 host target protein, VGAM48 host target protein and VGAM49 host target protein, herein schematically represented by VGAM1 HOST TARGET PROTEIN through VGAM3 HOST TARGET PROTEIN. The function of these host target genes is elaborated hereinabove with reference to VGAM42, VGAM43, VGAM44, VGAM45, VGAM46, VGAM47, VGAM48 and VGAM49. FIG. 9 further provides a conceptual description of novel bioinformatically detected regulatory viral gene, referred to here as Viral Genomic Record 2745(VGR2745) viral gene, which encodes an 'operon-like' cluster of novel viral micro RNA-like genes, each of which in turn modulates expression of at least one host target gene, the function and utility of which at least one host target gene is known in the art.

VGR2745 gene, herein designated VGR GENE, is a novel bioinformatically detected regulatory, non protein coding, RNA viral gene. The method by which VGR2745 gene was detected is described hereinabove with reference to FIGS. 1-9.

VGR2745 gene encodes VGR2745 precursor RNA, herein designated VGR PRECURSOR RNA, an RNA molecule, typically several hundred nucleotides long.

VGR2745 precursor RNA folds spatially, forming VGR2745 folded precursor RNA, herein designated VGR FOLDED PRECURSOR RNA. It is appreciated that VGR2745 folded precursor RNA comprises a plurality of what is known in the art as 'hairpin' structures. These 'hairpin' structures are due to the fact that the nucleotide sequence of VGR2745 precursor RNA comprises a plurality of segments, the first half of each such segment having a nucleotide sequence which is at least a partial inversed-reversed sequence of the second half thereof, as is well known in the art.

VGR2745 folded precursor RNA is naturally processed by cellular enzymatic activity into at least 8 separate VGAM precursor RNAs, VGAM50 precursor RNA, VGAM51 precursor RNA, VGAM52 precursor RNA, VGAM53 precursor RNA, VGAM54 precursor RNA, VGAM55 precursor RNA, VGAM56 precursor RNA and VGAM57 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM50 RNA, VGAM51 RNA, VGAM52 RNA, VGAM53 RNA, VGAM54 RNA, VGAM55 RNA, VGAM56 RNA and VGAM57 RNA, herein schematically represented by VGAM1 RNA through VGAM3 RNA, each of which VGAM RNAs corresponding to VGAM RNA of FIG. 1.

VGAM50 RNA, herein schematically represented by VGAM1 RNA through VGAM3 RNA, binds complementarily to a host target binding site located in an untranslated region of VGAM50 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM50 host target RNA into VGAM50 host target protein, herein schematically represented by VGAM1 HOST TARGET PROTEIN through VGAM3 HOST TARGET PROTEIN, all of FIG. 1.

VGAM51 RNA, herein schematically represented by VGAM1 RNA through VGAM3 RNA, binds complementarily to a host target binding site located in an untranslated region of VGAM51 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM51 host target RNA into VGAM51 host target protein, herein schematically represented by VGAM1 HOST TARGET PROTEIN through VGAM3 HOST TARGET PROTEIN, all of FIG. 1.

VGAM52 RNA, herein schematically represented by VGAM1 RNA through VGAM3 RNA, binds complementarily to a host target binding site located in an untranslated region of VGAM52 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM52 host target RNA into VGAM52 host target protein, herein schematically represented by VGAM1 HOST TARGET PROTEIN through VGAM3 HOST TARGET PROTEIN, all of FIG. 1.

VGAM53 RNA, herein schematically represented by VGAM1 RNA through VGAM3 RNA, binds complementarily to a host target binding site located in an untranslated region of VGAM53 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM53 host target RNA into VGAM53 host target protein, herein schematically represented by VGAM1 HOST TARGET PROTEIN through VGAM3 HOST TARGET PROTEIN, all of FIG. 1.

VGAM54 RNA, herein schematically represented by VGAM1 RNA through VGAM3 RNA, binds complementarily to a host target binding site located in an untranslated region of VGAM54 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM54 host target RNA into VGAM54 host target protein, herein schematically represented by VGAM1 HOST TARGET PROTEIN through VGAM3 HOST TARGET PROTEIN, all of FIG. 1.

VGAM55 RNA, herein schematically represented by VGAM1 RNA through VGAM3 RNA, binds complementarily to a host target binding site located in an untranslated region of VGAM55 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM55 host target RNA into VGAM55 host target protein, herein schematically represented by VGAM1 HOST TARGET PROTEIN through VGAM3 HOST TARGET PROTEIN, all of FIG. 1.

VGAM56 RNA, herein schematically represented by VGAM1 RNA through VGAM3 RNA, binds complementarily to a host target binding site located in an untranslated region of VGAM56 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM56 host target RNA into VGAM56 host target protein, herein schematically represented by VGAM1 HOST TARGET PROTEIN through VGAM3 HOST TARGET PROTEIN, all of FIG. 1.

VGAM57 RNA, herein schematically represented by VGAM1 RNA through VGAM3 RNA, binds complementarily to a host target binding site located in an untranslated region of VGAM57 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM57 host target RNA into VGAM57 host target protein, herein schematically represented by VGAM1 HOST TARGET PROTEIN through VGAM3 HOST TARGET PROTEIN, all of FIG. 1.

It is appreciated that a function of VGR2745 gene, herein designated VGR GENE, is inhibition of expression of host target genes, as part of a novel viral mechanism of attacking a host. Accordingly, utilities of VGR2745 gene include diagnosis, prevention and treatment of viral infection by Invertebrate Iridescent Virus 6. Specific functions, and accordingly utilities, of VGR2745 gene correlate with, and may be deduced from, the identity of the host target genes, which are inhibited by VGAM RNAs comprised in the 'operon-like' cluster of VGR2745 gene: VGAM50 host target protein, VGAM51 host target protein, VGAM52 host target protein, VGAM53 host target protein, VGAM54 host target protein, VGAM55 host target protein, VGAM56 host target protein and VGAM57 host target protein, herein schematically represented by VGAM1 HOST TARGET PROTEIN through VGAM3 HOST TARGET PROTEIN. The function of these host target genes is elaborated hereinabove with reference to VGAM50, VGAM51, VGAM52, VGAM53, VGAM54, VGAM55, VGAM56 and VGAM57. FIG. 9 further provides a conceptual description of novel bioinformatically detected regulatory viral gene, referred to here as Viral Genomic Record 2746(VGR2746) viral gene, which encodes an 'operon-like' cluster of novel viral micro RNA-like genes, each of which in turn modulates expression of at least one host target gene, the function and utility of which at least one host target gene is known in the art.

VGR2746 gene, herein designated VGR GENE, is a novel bioinformatically detected regulatory, non protein coding, RNA viral gene. The method by which VGR2746 gene was detected is described hereinabove with reference to FIGS. 1-9.

VGR2746 gene encodes VGR2746 precursor RNA, herein designated VGR PRECURSOR RNA, an RNA molecule, typically several hundred nucleotides long.

VGR2746 precursor RNA folds spatially, forming VGR2746 folded precursor RNA, herein designated VGR FOLDED PRECURSOR RNA. It is appreciated that VGR2746 folded precursor RNA comprises a plurality of what is known in the art as 'hairpin' structures. These 'hairpin' structures are due to the fact that the nucleotide sequence of VGR2746 precursor RNA comprises a plurality of segments, the first half of each such segment having a nucleotide sequence which is at least a partial inversed-reversed sequence of the second half thereof, as is well known in the art.

VGR2746 folded precursor RNA is naturally processed by cellular enzymatic activity into at least 8 separate VGAM precursor RNAs, VGAM58 precursor RNA, VGAM59 precursor RNA, VGAM60 precursor RNA, VGAM61 precursor RNA, VGAM62 precursor RNA, VGAM63 precursor RNA, VGAM64 precursor RNA and VGAM65 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM58 RNA, VGAM59 RNA, VGAM60 RNA, VGAM61 RNA, VGAM62 RNA, VGAM63 RNA, VGAM64 RNA and VGAM65 RNA, herein schematically represented by VGAM1 RNA through VGAM3 RNA, each of which VGAM RNAs corresponding to VGAM RNA of FIG. 1.

VGAM58 RNA, herein schematically represented by VGAM1 RNA through VGAM3 RNA, binds complementarily to a host target binding site located in an untranslated region of VGAM58 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM58 host target RNA into VGAM58 host target protein, herein schematically represented by VGAM1 HOST TARGET PROTEIN through VGAM3 HOST TARGET PROTEIN, all of FIG. 1.

VGAM59 RNA, herein schematically represented by VGAM1 RNA through VGAM3 RNA, binds complementarily to a host target binding site located in an untranslated region of VGAM59 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM59 host target RNA into VGAM59 host target protein, herein schematically represented by VGAM1 HOST TARGET PROTEIN through VGAM3 HOST TARGET PROTEIN, all of FIG. 1.

VGAM60 RNA, herein schematically represented by VGAM1 RNA through VGAM3 RNA, binds complementarily to a host target binding site located in an untranslated region of VGAM60 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM60 host target RNA into VGAM60 host target protein, herein schematically represented by VGAM1 HOST TARGET PROTEIN through VGAM3 HOST TARGET PROTEIN, all of FIG. 1.

VGAM61 RNA, herein schematically represented by VGAM1 RNA through VGAM3 RNA, binds complementarily to a host target binding site located in an untranslated region of VGAM61 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM61 host target RNA into VGAM61 host target protein, herein schematically represented by VGAM1 HOST TARGET PROTEIN through VGAM3 HOST TARGET PROTEIN, all of FIG. 1.

VGAM62 RNA, herein schematically represented by VGAM1 RNA through VGAM3 RNA, binds complementarily to a host target binding site located in an untranslated region of VGAM62 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM62 host target RNA into VGAM62 host target protein, herein schematically represented by VGAM1 HOST TARGET PROTEIN through VGAM3 HOST TARGET PROTEIN, all of FIG. 1.

VGAM63 RNA, herein schematically represented by VGAM1 RNA through VGAM3 RNA, binds complementarily to a host target binding site located in an untranslated region of VGAM63 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM63 host target RNA into VGAM63 host target protein, herein schematically represented by VGAM1 HOST TARGET PROTEIN through VGAM3 HOST TARGET PROTEIN, all of FIG. 1.

VGAM64 RNA, herein schematically represented by VGAM1 RNA through VGAM3 RNA, binds complementarily to a host target binding site located in an untranslated region of VGAM64 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM64 host target RNA into VGAM64 host target protein, herein schematically represented by VGAM1 HOST TARGET PROTEIN through VGAM3 HOST TARGET PROTEIN, all of FIG. 1.

VGAM65 RNA, herein schematically represented by VGAM1 RNA through VGAM3 RNA, binds complementarily to a host target binding site located in an untranslated region of VGAM65 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM65 host target RNA into VGAM65 host target protein, herein schematically represented by VGAM1 HOST TARGET PROTEIN through VGAM3 HOST TARGET PROTEIN, all of FIG. 1.

It is appreciated that a function of VGR2746 gene, herein designated VGR GENE, is inhibition of expression of host target genes, as part of a novel viral mechanism of attacking a host. Accordingly, utilities of VGR2746 gene include diagnosis, prevention and treatment of viral infection by Invertebrate Iridescent Virus 6. Specific functions, and accordingly utilities, of VGR2746 gene correlate with, and may be deduced from, the identity of the host target genes, which are inhibited by VGAM RNAs comprised in the 'operon-like' cluster of VGR2746 gene: VGAM58 host target protein, VGAM59 host target protein, VGAM60 host target protein, VGAM61 host target protein, VGAM62 host target protein, VGAM63 host target protein, VGAM64 host target protein and VGAM65 host target protein, herein schematically represented by VGAM1 HOST TARGET PROTEIN through VGAM3 HOST TARGET PROTEIN. The function of these host target genes is elaborated hereinabove with reference to VGAM58, VGAM59, VGAM60, VGAM61, VGAM62, VGAM63, VGAM64 and VGAM65. FIG. 9 further provides a conceptual description of novel bioinformatically detected regulatory viral gene, referred to here as Viral Genomic Record 2747(VGR2747) viral gene, which encodes an 'operon-like' cluster of novel viral micro RNA-like genes, each of which in turn modulates expression of at least one host target gene, the function and utility of which at least one host target gene is known in the art.

VGR2747 gene, herein designated VGR GENE, is a novel bioinformatically detected regulatory, non protein coding, RNA viral gene. The method by which VGR2747 gene was detected is described hereinabove with reference to FIGS. 1-9.

VGR2747 gene encodes VGR2747 precursor RNA, herein designated VGR PRECURSOR RNA, an RNA molecule, typically several hundred nucleotides long.

VGR2747 precursor RNA folds spatially, forming VGR2747 folded precursor RNA, herein designated VGR FOLDED PRECURSOR RNA. It is appreciated that VGR2747 folded precursor RNA comprises a plurality of what is known in the art as 'hairpin' structures. These 'hairpin' structures are due to the fact that the nucleotide sequence of VGR2747 precursor RNA comprises a plurality of segments, the first half of each such segment having a nucleotide sequence which is at least a partial inversed-reversed sequence of the second half thereof, as is well known in the art.

VGR2747 folded precursor RNA is naturally processed by cellular enzymatic activity into at least 8 separate VGAM precursor RNAs, VGAM66 precursor RNA, VGAM67 precursor RNA, VGAM68 precursor RNA, VGAM69 precursor RNA, VGAM70 precursor RNA, VGAM71 precursor RNA, VGAM72 precursor RNA and VGAM73 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM66 RNA, VGAM67 RNA, VGAM68 RNA, VGAM69 RNA, VGAM70 RNA, VGAM71 RNA, VGAM72 RNA and VGAM73 RNA, herein schematically represented by VGAM1 RNA through VGAM3 RNA, each of which VGAM RNAs corresponding to VGAM RNA of FIG. 1.

VGAM66 RNA, herein schematically represented by VGAM1 RNA through VGAM3 RNA, binds complementarily to a host target binding site located in an untranslated region of VGAM66 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM66 host target RNA into VGAM66 host target protein, herein schematically represented by VGAM1 HOST TARGET PROTEIN through VGAM3 HOST TARGET PROTEIN, all of FIG. 1.

VGAM67 RNA, herein schematically represented by VGAM1 RNA through VGAM3 RNA, binds complementarily to a host target binding site located in an untranslated region of VGAM67 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM67 host target RNA into VGAM67 host target protein, herein schematically represented by VGAM1 HOST TARGET PROTEIN through VGAM3 HOST TARGET PROTEIN, all of FIG. 1.

VGAM68 RNA, herein schematically represented by VGAM1 RNA through VGAM3 RNA, binds complementarily to a host target binding site located in an untranslated region of VGAM68 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM68 host target RNA into VGAM68 host target protein, herein schematically represented by VGAM1 HOST TARGET PROTEIN through VGAM3 HOST TARGET PROTEIN, all of FIG. 1.

VGAM69 RNA, herein schematically represented by VGAM1 RNA through VGAM3 RNA, binds complementarily to a host target binding site located in an untranslated region of VGAM69 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM69 host target RNA into VGAM69 host target protein, herein schematically represented by VGAM1 HOST TARGET PROTEIN through VGAM3 HOST TARGET PROTEIN, all of FIG. 1.

VGAM70 RNA, herein schematically represented by VGAM1 RNA through VGAM3 RNA, binds complementarily to a host target binding site located in an untranslated region of VGAM70 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM70 host target RNA into VGAM70 host target protein, herein schematically represented by VGAM1 HOST TARGET PROTEIN through VGAM3 HOST TARGET PROTEIN, all of FIG. 1.

VGAM71 RNA, herein schematically represented by VGAM1 RNA through VGAM3 RNA, binds complementarily to a host target binding site located in an untranslated region of VGAM71 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM71 host target RNA into VGAM71 host target protein, herein schematically represented by VGAM1 HOST TARGET PROTEIN through VGAM3 HOST TARGET PROTEIN, all of FIG. 1.

VGAM72 RNA, herein schematically represented by VGAM1 RNA through VGAM3 RNA, binds complementarily to a host target binding site located in an untranslated region of VGAM72 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM72 host target RNA into VGAM72 host target protein, herein schematically represented by VGAM1 HOST TARGET PROTEIN through VGAM3 HOST TARGET PROTEIN, all of FIG. 1.

VGAM73 RNA, herein schematically represented by VGAM1 RNA through VGAM3 RNA, binds complementarily to a host target binding site located in an untranslated region of VGAM73 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM73 host target RNA into VGAM73 host target protein, herein schematically represented by VGAM1 HOST TARGET PROTEIN through VGAM3 HOST TARGET PROTEIN, all of FIG. 1.

It is appreciated that a function of VGR2747 gene, herein designated VGR GENE, is inhibition of expression of host target genes, as part of a novel viral mechanism of attacking a host. Accordingly, utilities of VGR2747 gene include diagnosis, prevention and treatment of viral infection by Invertebrate Iridescent Virus 6. Specific functions, and accordingly utilities, of VGR2747 gene correlate with, and may be deduced from, the identity of the host target genes, which are inhibited by VGAM RNAs comprised in the 'operon-like' cluster of VGR2747 gene: VGAM66 host target protein, VGAM67 host target protein, VGAM68 host target protein, VGAM69 host target protein, VGAM70 host target protein, VGAM71 host target protein, VGAM72 host target protein and VGAM73 host target protein, herein schematically represented by VGAM1 HOST TARGET PROTEIN through VGAM3 HOST TARGET PROTEIN. The function of these host target genes is elaborated hereinabove with reference to VGAM66, VGAM67, VGAM68, VGAM69, VGAM70, VGAM71, VGAM72 and VGAM73. FIG. 9 further provides a conceptual description of novel bioinformatically detected regulatory viral gene, referred to here as Viral Genomic Record 2748(VGR2748) viral gene, which encodes an 'operon-like' cluster of novel viral micro RNA-like genes, each of which in turn modulates expression of at least one host target gene, the function and utility of which at least one host target gene is known in the art.

VGR2748 gene, herein designated VGR GENE, is a novel bioinformatically detected regulatory, non protein coding, RNA viral gene. The method by which VGR2748 gene was detected is described hereinabove with reference to FIGS. 1-9.

VGR2748 gene encodes VGR2748 precursor RNA, herein designated VGR PRECURSOR RNA, an RNA molecule, typically several hundred nucleotides long.

VGR2748 precursor RNA folds spatially, forming VGR2748 folded precursor RNA, herein designated VGR FOLDED PRECURSOR RNA. It is appreciated that VGR2748 folded precursor RNA comprises a plurality of what is known in the art as 'hairpin' structures. These 'hairpin' structures are due to the fact that the nucleotide sequence of VGR2748 precursor RNA comprises a plurality of segments, the first half of each such segment having a nucleotide sequence which is at least a partial inversed-reversed sequence of the second half thereof, as is well known in the art.

VGR2748 folded precursor RNA is naturally processed by cellular enzymatic activity into at least 2 separate VGAM precursor RNAs, VGAM76 precursor RNA and VGAM77 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM76 RNA and VGAM77 RNA, herein schematically represented by VGAM1 RNA through VGAM3 RNA, each of which VGAM RNAs corresponding to VGAM RNA of FIG. 1.

VGAM76 RNA, herein schematically represented by VGAM1 RNA through VGAM3 RNA, binds complementarily to a host target binding site located in an untranslated region of VGAM76 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM76 host target RNA into VGAM76 host target protein, herein schematically represented by VGAM1 HOST TARGET PROTEIN through VGAM3 HOST TARGET PROTEIN, all of FIG. 1.

VGAM77 RNA, herein schematically represented by VGAM1 RNA through VGAM3 RNA, binds complementarily to a host target binding site located in an untranslated region of VGAM77 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM77 host target RNA into VGAM77 host target protein, herein schematically represented by VGAM1 HOST TARGET PROTEIN through VGAM3 HOST TARGET PROTEIN, all of FIG. 1.

It is appreciated that a function of VGR2748 gene, herein designated VGR GENE, is inhibition of expression of host target genes, as part of a novel viral mechanism of attacking a host. Accordingly, utilities of VGR2748 gene include diagnosis, prevention and treatment of viral infection by Murine Adenovirus A. Specific functions, and accordingly utilities, of VGR2748 gene correlate with, and may be deduced from, the identity of the host target genes, which are inhibited by VGAM RNAs comprised in the 'operon-like' cluster of VGR2748 gene: VGAM76 host target protein and VGAM77 host target protein, herein schematically represented by VGAM1 HOST TARGET PROTEIN through VGAM3 HOST TARGET PROTEIN. The function of these host target genes is elaborated hereinabove with reference to VGAM76 and VGAM77. FIG. 9 further provides a conceptual description of novel bioinformatically detected regulatory viral gene, referred to here as Viral Genomic Record 2749(VGR2749) viral gene, which encodes an 'operon-like' cluster of novel viral micro RNA-like genes, each of which in turn modulates expression of at least one host target gene, the function and utility of which at least one host target gene is known in the art.

VGR2749 gene, herein designated VGR GENE, is a novel bioinformatically detected regulatory, non protein coding, RNA viral gene. The method by which VGR2749 gene was detected is described hereinabove with reference to FIGS. 1-9.

VGR2749 gene encodes VGR2749 precursor RNA, herein designated VGR PRECURSOR RNA, an RNA molecule, typically several hundred nucleotides long.

VGR2749 precursor RNA folds spatially, forming VGR2749 folded precursor RNA, herein designated VGR FOLDED PRECURSOR RNA. It is appreciated that VGR2749 folded precursor RNA comprises a plurality of what is known in the art as 'hairpin' structures. These 'hairpin' structures are due to the fact that the nucleotide sequence of VGR2749 precursor RNA comprises a plurality of segments, the first half of each such segment having a nucleotide sequence which is at least a partial inversed-reversed sequence of the second half thereof, as is well known in the art.

VGR2749 folded precursor RNA is naturally processed by cellular enzymatic activity into at least 8 separate VGAM precursor RNAs, VGAM78 precursor RNA, VGAM79 precursor RNA, VGAM80 precursor RNA, VGAM81 precursor RNA, VGAM82 precursor RNA, VGAM83 precursor RNA, VGAM84 precursor RNA and VGAM85 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM78 RNA, VGAM79 RNA, VGAM80 RNA, VGAM81 RNA, VGAM82 RNA, VGAM83 RNA, VGAM84 RNA and VGAM85 RNA, herein schematically represented by VGAM1 RNA through VGAM3 RNA, each of which VGAM RNAs corresponding to VGAM RNA of FIG. 1.

VGAM78 RNA, herein schematically represented by VGAM1 RNA through VGAM3 RNA, binds complementarily to a host target binding site located in an untranslated region of VGAM78 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM78 host target RNA into VGAM78 host target protein, herein schematically represented by VGAM1 HOST TARGET PROTEIN through VGAM3 HOST TARGET PROTEIN, all of FIG. 1.

VGAM79 RNA, herein schematically represented by VGAM1 RNA through VGAM3 RNA, binds complementarily to a host target binding site located in an untranslated region of VGAM79 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM79 host target RNA into VGAM79 host target protein, herein schematically represented by VGAM1 HOST TARGET PROTEIN through VGAM3 HOST TARGET PROTEIN, all of FIG. 1.

VGAM80 RNA, herein schematically represented by VGAM1 RNA through VGAM3 RNA, binds complementarily to a host target binding site located in an untranslated region of VGAM80 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM80 host target RNA into VGAM80 host target protein, herein schematically represented by VGAM1 HOST TARGET PROTEIN through VGAM3 HOST TARGET PROTEIN, all of FIG. 1.

VGAM81 RNA, herein schematically represented by VGAM1 RNA through VGAM3 RNA, binds complementarily to a host target binding site located in an untranslated region of VGAM81 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM81 host target RNA into VGAM81 host target protein, herein schematically represented by VGAM1 HOST TARGET PROTEIN through VGAM3 HOST TARGET PROTEIN, all of FIG. 1.

VGAM82 RNA, herein schematically represented by VGAM1 RNA through VGAM3 RNA, binds complementarily to a host target binding site located in an untranslated region of VGAM82 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM82 host target RNA into VGAM82 host target protein, herein schematically represented by VGAM1 HOST TARGET PROTEIN through VGAM3 HOST TARGET PROTEIN, all of FIG. 1.

VGAM83 RNA, herein schematically represented by VGAM1 RNA through VGAM3 RNA, binds complementarily to a host target binding site located in an untranslated region of VGAM83 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM83 host target RNA into VGAM83 host target protein, herein schematically represented by VGAM1 HOST TARGET PROTEIN through VGAM3 HOST TARGET PROTEIN, all of FIG. 1.

VGAM84 RNA, herein schematically represented by VGAM1 RNA through VGAM3 RNA, binds complementarily to a host target binding site located in an untranslated region of VGAM84 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM84 host target RNA into VGAM84 host target protein, herein schematically represented by VGAM1 HOST TARGET PROTEIN through VGAM3 HOST TARGET PROTEIN, all of FIG. 1.

VGAM85 RNA, herein schematically represented by VGAM1 RNA through VGAM3 RNA, binds complementarily to a host target binding site located in an untranslated region of VGAM85 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM85 host target RNA into VGAM85 host target protein, herein schematically represented by VGAM1 HOST TARGET PROTEIN through VGAM3 HOST TARGET PROTEIN, all of FIG. 1.

It is appreciated that a function of VGR2749 gene, herein designated VGR GENE, is inhibition of expression of host target genes, as part of a novel viral mechanism of attacking a host. Accordingly, utilities of VGR2749 gene include diagnosis, prevention and treatment of viral infection by Plutella Xylostella Granulovirus. Specific functions, and accordingly utilities, of VGR2749 gene correlate with, and may be deduced from, the identity of the host target genes, which are inhibited by VGAM RNAs comprised in the 'operon-like' cluster of VGR2749 gene: VGAM78 host target protein, VGAM79 host target protein, VGAM80 host target protein, VGAM81 host target protein, VGAM82 host target protein, VGAM83 host target protein, VGAM84 host target protein and VGAM85 host target protein, herein schematically represented by VGAM1 HOST TARGET PROTEIN through VGAM3 HOST TARGET PROTEIN. The function of these host target genes is elaborated hereinabove with reference to VGAM78, VGAM79, VGAM80, VGAM81, VGAM82, VGAM83, VGAM84 and VGAM85. FIG. 9 further provides a conceptual description of novel bioinformatically detected regulatory viral gene, referred to here as Viral Genomic Record 2750(VGR2750) viral gene, which encodes an 'operon-like' cluster of novel viral micro RNA-like genes, each of which in turn modulates expression of at least one host target gene, the function and utility of which at least one host target gene is known in the art.

VGR2750 gene, herein designated VGR GENE, is a novel bioinformatically detected regulatory, non protein coding, RNA viral gene. The method by which VGR2750 gene was detected is described hereinabove with reference to FIGS. 1-9.

VGR2750 gene encodes VGR2750 precursor RNA, herein designated VGR PRECURSOR RNA, an RNA molecule, typically several hundred nucleotides long.

VGR2750 precursor RNA folds spatially, forming VGR2750 folded precursor RNA, herein designated VGR FOLDED PRECURSOR RNA. It is appreciated that VGR2750 folded precursor RNA comprises a plurality of what is known in the art as 'hairpin' structures. These 'hairpin' structures are due to the fact that the nucleotide sequence of VGR2750 precursor RNA comprises a plurality of segments, the first half of each such segment having a nucleotide sequence which is at least a partial inversed-reversed sequence of the second half thereof, as is well known in the art.

VGR2750 folded precursor RNA is naturally processed by cellular enzymatic activity into at least 8 separate VGAM precursor RNAs, VGAM86 precursor RNA, VGAM87 precursor RNA, VGAM88 precursor RNA, VGAM89 precursor RNA, VGAM90 precursor RNA, VGAM91 precursor RNA, VGAM92 precursor RNA and VGAM93 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM86 RNA, VGAM87 RNA, VGAM88 RNA, VGAM89 RNA, VGAM90 RNA, VGAM91 RNA, VGAM92 RNA and VGAM93 RNA, herein schematically represented by VGAM1 RNA through VGAM3 RNA, each of which VGAM RNAs corresponding to VGAM RNA of FIG. 1.

VGAM86 RNA, herein schematically represented by VGAM1 RNA through VGAM3 RNA, binds complementarily to a host target binding site located in an untranslated region of VGAM86 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM86 host target RNA into VGAM86 host target protein, herein schematically represented by VGAM1 HOST TARGET PROTEIN through VGAM3 HOST TARGET PROTEIN, all of FIG. 1.

VGAM87 RNA, herein schematically represented by VGAM1 RNA through VGAM3 RNA, binds complementarily to a host target binding site located in an untranslated region of VGAM87 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM87 host target RNA into VGAM87 host target protein, herein schematically represented by VGAM1 HOST TARGET PROTEIN through VGAM3 HOST TARGET PROTEIN, all of FIG. 1.

VGAM88 RNA, herein schematically represented by VGAM1 RNA through VGAM3 RNA, binds complementarily to a host target binding site located in an untranslated region of VGAM88 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM88 host target RNA into VGAM88 host target protein, herein schematically represented by VGAM1 HOST TARGET PROTEIN through VGAM3 HOST TARGET PROTEIN, all of FIG. 1.

VGAM89 RNA, herein schematically represented by VGAM1 RNA through VGAM3 RNA, binds complementarily to a host target binding site located in an untranslated region of VGAM89 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM89 host target RNA into VGAM89 host target protein, herein schematically represented by VGAM1 HOST TARGET PROTEIN through VGAM3 HOST TARGET PROTEIN, all of FIG. 1.

VGAM90 RNA, herein schematically represented by VGAM1 RNA through VGAM3 RNA, binds complementarily to a host target binding site located in an untranslated region of VGAM90 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM90 host target RNA into VGAM90 host target protein, herein schematically represented by VGAM1 HOST TARGET PROTEIN through VGAM3 HOST TARGET PROTEIN, all of FIG. 1.

VGAM91 RNA, herein schematically represented by VGAM1 RNA through VGAM3 RNA, binds complementarily to a host target binding site located in an untranslated region of VGAM91 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM91 host target RNA into VGAM91 host target protein, herein schematically represented by VGAM1 HOST TARGET PROTEIN through VGAM3 HOST TARGET PROTEIN, all of FIG. 1.

VGAM92 RNA, herein schematically represented by VGAM1 RNA through VGAM3 RNA, binds complementarily to a host target binding site located in an untranslated region of VGAM92 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM92 host target RNA into VGAM92 host target protein, herein schematically represented by VGAM1 HOST TARGET PROTEIN through VGAM3 HOST TARGET PROTEIN, all of FIG. 1.

VGAM93 RNA, herein schematically represented by VGAM1 RNA through VGAM3 RNA, binds complementarily to a host target binding site located in an untranslated region of VGAM93 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM93 host target RNA into VGAM93 host target protein, herein schematically represented by VGAM1 HOST TARGET PROTEIN through VGAM3 HOST TARGET PROTEIN, all of FIG. 1.

It is appreciated that a function of VGR2750 gene, herein designated VGR GENE, is inhibition of expression of host target genes, as part of a novel viral mechanism of attacking a host. Accordingly, utilities of VGR2750 gene include diagnosis, prevention and treatment of viral infection by Plutella Xylostella Granulovirus. Specific functions, and accordingly utilities, of VGR2750 gene correlate with, and may be deduced from, the identity of the host target genes, which are inhibited by VGAM RNAs comprised in the 'operon-like' cluster of VGR2750 gene: VGAM86 host target protein, VGAM87 host target protein, VGAM88 host target protein, VGAM89 host target protein, VGAM90 host target protein, VGAM91 host target protein, VGAM92 host target protein and VGAM93 host target protein, herein schematically represented by VGAM1 HOST TARGET PROTEIN through VGAM3 HOST TARGET PROTEIN. The function of these host target genes is elaborated hereinabove with reference to VGAM86, VGAM87, VGAM88, VGAM89, VGAM90, VGAM91, VGAM92 and VGAM93. FIG. 9 further provides a conceptual description of novel bioinformatically detected regulatory viral gene, referred to here as Viral Genomic Record 2751(VGR2751) viral gene, which encodes an 'operon-like' cluster of novel viral micro RNA-like genes, each of which in turn modulates expression of at least one host target gene, the function and utility of which at least one host target gene is known in the art.

VGR2751 gene, herein designated VGR GENE, is a novel bioinformatically detected regulatory, non protein coding, RNA viral gene. The method by which VGR2751 gene was detected is described hereinabove with reference to FIGS. 1-9.

VGR2751 gene encodes VGR2751 precursor RNA, herein designated VGR PRECURSOR RNA, an RNA molecule, typically several hundred nucleotides long.

VGR2751 precursor RNA folds spatially, forming VGR2751 folded precursor RNA, herein designated VGR FOLDED PRECURSOR RNA. It is appreciated that VGR2751 folded precursor RNA comprises a plurality of what is known in the art as 'hairpin' structures. These 'hairpin' structures are due to the fact that the nucleotide sequence of VGR2751 precursor RNA comprises a plurality of segments, the first half of each such segment having a nucleotide sequence which is at least a partial inversed-reversed sequence of the second half thereof, as is well known in the art.

VGR2751 folded precursor RNA is naturally processed by cellular enzymatic activity into at least 8 separate VGAM precursor RNAs, VGAM94 precursor RNA, VGAM95 precursor RNA, VGAM96 precursor RNA, VGAM97 precursor RNA, VGAM98 precursor RNA, VGAM99 precursor RNA, VGAM100 precursor RNA and VGAM101 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM94 RNA, VGAM95 RNA, VGAM96 RNA, VGAM97 RNA, VGAM98 RNA, VGAM99 RNA, VGAM100 RNA and VGAM101 RNA, herein schematically represented by VGAM1 RNA through VGAM3 RNA, each of which VGAM RNAs corresponding to VGAM RNA of FIG. 1.

VGAM94 RNA, herein schematically represented by VGAM1 RNA through VGAM3 RNA, binds complementarily to a host target binding site located in an untranslated region of VGAM94 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM94 host target RNA into VGAM94 host target protein, herein schematically represented by VGAM1 HOST TARGET PROTEIN through VGAM3 HOST TARGET PROTEIN, all of FIG. 1.

VGAM95 RNA, herein schematically represented by VGAM1 RNA through VGAM3 RNA, binds complementarily to a host target binding site located in an untranslated region of VGAM95 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM95 host target RNA into VGAM95 host target protein, herein schematically represented by VGAM1 HOST TARGET PROTEIN through VGAM3 HOST TARGET PROTEIN, all of FIG. 1.

VGAM96 RNA, herein schematically represented by VGAM1 RNA through VGAM3 RNA, binds complementarily to a host target binding site located in an untranslated region of VGAM96 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM96 host target RNA into VGAM96 host target protein, herein schematically represented by VGAM1 HOST TARGET PROTEIN through VGAM3 HOST TARGET PROTEIN, all of FIG. 1.

VGAM97 RNA, herein schematically represented by VGAM1 RNA through VGAM3 RNA, binds complementarily to a host target binding site located in an untranslated region of VGAM97 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM97 host target RNA into VGAM97 host target protein, herein schematically represented by VGAM1 HOST TARGET PROTEIN through VGAM3 HOST TARGET PROTEIN, all of FIG. 1.

VGAM98 RNA, herein schematically represented by VGAM1 RNA through VGAM3 RNA, binds complementarily to a host target binding site located in an untranslated region of VGAM98 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM98 host target RNA into VGAM98 host target protein, herein schematically represented by VGAM1 HOST TARGET PROTEIN through VGAM3 HOST TARGET PROTEIN, all of FIG. 1.

VGAM99 RNA, herein schematically represented by VGAM1 RNA through VGAM3 RNA, binds complementarily to a host target binding site located in an untranslated region of VGAM99 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM99 host target RNA into VGAM99 host target protein, herein schematically represented by VGAM1 HOST TARGET PROTEIN through VGAM3 HOST TARGET PROTEIN, all of FIG. 1.

VGAM100 RNA, herein schematically represented by VGAM1 RNA through VGAM3 RNA, binds complementarily to a host target binding site located in an untranslated region of VGAM100 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM100 host target RNA into VGAM100 host target protein, herein schematically represented by VGAM1 HOST TARGET PROTEIN through VGAM3 HOST TARGET PROTEIN, all of FIG. 1.

VGAM101 RNA, herein schematically represented by VGAM1 RNA through VGAM3 RNA, binds complementarily to a host target binding site located in an untranslated region of VGAM101 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM101 host target RNA into VGAM101 host target protein, herein schematically represented by VGAM1 HOST TARGET PROTEIN through VGAM3 HOST TARGET PROTEIN, all of FIG. 1.

It is appreciated that a function of VGR2751 gene, herein designated VGR GENE, is inhibition of expression of host target genes, as part of a novel viral mechanism of attacking a host. Accordingly, utilities of VGR2751 gene include diagnosis, prevention and treatment of viral infection by Plutella Xylostella Granulovirus. Specific functions, and accordingly utilities, of VGR2751 gene correlate with, and may be deduced from, the identity of the host target genes, which are inhibited by VGAM RNAs comprised in the 'operon-like' cluster of VGR2751 gene: VGAM94 host target protein, VGAM95 host target protein, VGAM96 host target protein, VGAM97 host target protein, VGAM98 host target protein, VGAM99 host target protein, VGAM100 host target protein and VGAM101 host target protein, herein schematically represented by VGAM1 HOST TARGET PROTEIN through VGAM3 HOST TARGET PROTEIN. The function of these host target genes is elaborated hereinabove with reference to VGAM94, VGAM95, VGAM96, VGAM97, VGAM98, VGAM99, VGAM100 and VGAM101. FIG. 9 further provides a conceptual description of novel bioinformatically detected regulatory viral gene, referred to here as Viral Genomic Record 2752(VGR2752) viral gene, which encodes an 'operon-like' cluster of novel viral micro RNA-like genes, each of which in turn modulates expression of at least one host target gene, the function and utility of which at least one host target gene is known in the art.

VGR2752 gene, herein designated VGR GENE, is a novel bioinformatically detected regulatory, non protein coding, RNA viral gene. The method by which VGR2752 gene was detected is described hereinabove with reference to FIGS. 1-9.

VGR2752 gene encodes VGR2752 precursor RNA, herein designated VGR PRECURSOR RNA, an RNA molecule, typically several hundred nucleotides long.

VGR2752 precursor RNA folds spatially, forming VGR2752 folded precursor RNA, herein designated VGR FOLDED PRECURSOR RNA. It is appreciated that VGR2752 folded precursor RNA comprises a plurality of what is known in the art as 'hairpin' structures. These 'hairpin' structures are due to the fact that the nucleotide sequence of VGR2752 precursor RNA comprises a plurality of segments, the first half of each such segment having a nucleotide sequence which is at least a partial inversed-reversed sequence of the second half thereof, as is well known in the art.

VGR2752 folded precursor RNA is naturally processed by cellular enzymatic activity into at least 4 separate VGAM precursor RNAs, VGAM102 precursor RNA, VGAM103 precursor RNA, VGAM104 precursor RNA and VGAM105 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM102 RNA, VGAM103 RNA, VGAM104 RNA and VGAM105 RNA, herein schematically represented by VGAM1 RNA through VGAM3 RNA, each of which VGAM RNAs corresponding to VGAM RNA of FIG. 1.

VGAM102 RNA, herein schematically represented by VGAM1 RNA through VGAM3 RNA, binds complementarily to a host target binding site located in an untranslated region of VGAM102 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM102 host target RNA into VGAM102 host target protein, herein schematically represented by VGAM1 HOST TARGET PROTEIN through VGAM3 HOST TARGET PROTEIN, all of FIG. 1.

VGAM103 RNA, herein schematically represented by VGAM1 RNA through VGAM3 RNA, binds complementarily to a host target binding site located in an untranslated region of VGAM103 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM103 host target RNA into VGAM103 host target protein, herein schematically represented by VGAM1 HOST TARGET PROTEIN through VGAM3 HOST TARGET PROTEIN, all of FIG. 1.

VGAM104 RNA, herein schematically represented by VGAM1 RNA through VGAM3 RNA, binds complementarily to a host target binding site located in an untranslated region of VGAM104 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM104 host target RNA into VGAM104 host target protein, herein schematically represented by VGAM1 HOST TARGET PROTEIN through VGAM3 HOST TARGET PROTEIN, all of FIG. 1.

VGAM105 RNA, herein schematically represented by VGAM1 RNA through VGAM3 RNA, binds complementarily to a host target binding site located in an untranslated region of VGAM105 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM105 host target RNA into VGAM105 host target protein, herein schematically represented by VGAM1 HOST TARGET PROTEIN through VGAM3 HOST TARGET PROTEIN, all of FIG. 1.

It is appreciated that a function of VGR2752 gene, herein designated VGR GENE, is inhibition of expression of host target genes, as part of a novel viral mechanism of attacking a host. Accordingly, utilities of VGR2752 gene include diagnosis, prevention and treatment of viral infection by Plutella Xylostella Granulovirus. Specific functions, and accordingly utilities, of VGR2752 gene correlate with, and may be deduced from, the identity of the host target genes, which are inhibited by VGAM RNAs comprised in the 'operon-like' cluster of VGR2752 gene: VGAM102 host target protein, VGAM103 host target protein, VGAM104 host target protein and VGAM105 host target protein, herein schematically represented by VGAM1 HOST TARGET PROTEIN through VGAM3 HOST TARGET PROTEIN. The function of these host target genes is elaborated hereinabove with reference to VGAM102, VGAM103, VGAM104 and VGAM105. FIG. 9 further provides a conceptual description of novel bioinformatically detected regulatory viral gene, referred to here as Viral Genomic Record 2753(VGR2753) viral gene, which encodes an 'operon-like' cluster of novel viral micro RNA-like genes, each of which in turn modulates expression of at least one host target gene, the function and utility of which at least one host target gene is known in the art.

VGR2753 gene, herein designated VGR GENE, is a novel bioinformatically detected regulatory, non protein coding, RNA viral gene. The method by which VGR2753 gene was detected is described hereinabove with reference to FIGS. 1-9.

VGR2753 gene encodes VGR2753 precursor RNA, herein designated VGR PRECURSOR RNA, an RNA molecule, typically several hundred nucleotides long.

VGR2753 precursor RNA folds spatially, forming VGR2753 folded precursor RNA, herein designated VGR FOLDED PRECURSOR RNA. It is appreciated that VGR2753 folded precursor RNA comprises a plurality of what is known in the art as 'hairpin' structures. These 'hairpin' structures are due to the fact that the nucleotide sequence of VGR2753 precursor RNA comprises a plurality of segments, the first half of each such segment having a nucleotide sequence which is at least a partial inversed-reversed sequence of the second half thereof, as is well known in the art.

VGR2753 folded precursor RNA is naturally processed by cellular enzymatic activity into at least 4 separate VGAM precursor RNAs, VGAM106 precursor RNA, VGAM107 precursor RNA, VGAM108 precursor RNA and VGAM109 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM106 RNA, VGAM107 RNA, VGAM108 RNA and VGAM109 RNA, herein schematically represented by VGAM1 RNA through VGAM3 RNA, each of which VGAM RNAs corresponding to VGAM RNA of FIG. 1.

VGAM106 RNA, herein schematically represented by VGAM1 RNA through VGAM3 RNA, binds complementarily to a host target binding site located in an untranslated region of VGAM106 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM106 host target RNA into VGAM106 host target protein, herein schematically represented by VGAM1 HOST TARGET PROTEIN through VGAM3 HOST TARGET PROTEIN, all of FIG. 1.

VGAM107 RNA, herein schematically represented by VGAM1 RNA through VGAM3 RNA, binds complementarily to a host target binding site located in an untranslated region of VGAM107 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM107 host target RNA into VGAM107 host target protein, herein schematically represented by VGAM1 HOST TARGET PROTEIN through VGAM3 HOST TARGET PROTEIN, all of FIG. 1.

VGAM108 RNA, herein schematically represented by VGAM1 RNA through VGAM3 RNA, binds complementarily to a host target binding site located in an untranslated region of VGAM108 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM108 host target RNA into VGAM108 host target protein, herein schematically represented by VGAM1 HOST TARGET PROTEIN through VGAM3 HOST TARGET PROTEIN, all of FIG. 1.

VGAM109 RNA, herein schematically represented by VGAM1 RNA through VGAM3 RNA, binds complementarily to a host target binding site located in an untranslated region of VGAM109 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM109 host target RNA into VGAM109 host target protein, herein schematically represented by VGAM1 HOST TARGET PROTEIN through VGAM3 HOST TARGET PROTEIN, all of FIG. 1.

It is appreciated that a function of VGR2753 gene, herein designated VGR GENE, is inhibition of expression of host target genes, as part of a novel viral mechanism of attacking a host. Accordingly, utilities of VGR2753 gene include diagnosis, prevention and treatment of viral infection by Saimiriine Herpesvirus 2. Specific functions, and accordingly utilities, of VGR2753 gene correlate with, and may be deduced from, the identity of the host target genes, which are inhibited by VGAM RNAs comprised in the 'operon-like' cluster of VGR2753 gene: VGAM106 host target protein, VGAM107 host target protein, VGAM108 host target protein and VGAM109 host target protein, herein schematically represented by VGAM1 HOST TARGET PROTEIN through VGAM3 HOST TARGET PROTEIN. The function of these host target genes is elaborated hereinabove with reference to VGAM106, VGAM107, VGAM108 and VGAM109. FIG. 9 further provides a conceptual description of novel bioinformatically detected regulatory viral gene, referred to here as Viral Genomic Record 2754(VGR2754) viral gene, which encodes an 'operon-like' cluster of novel viral micro RNA-like genes, each of which in turn modulates expression of at least one host target gene, the function and utility of which at least one host target gene is known in the art.

VGR2754 gene, herein designated VGR GENE, is a novel bioinformatically detected regulatory, non protein coding, RNA viral gene. The method by which VGR2754 gene was detected is described hereinabove with reference to FIGS. 1-9.

VGR2754 gene encodes VGR2754 precursor RNA, herein designated VGR PRECURSOR RNA, an RNA molecule, typically several hundred nucleotides long.

VGR2754 precursor RNA folds spatially, forming VGR2754 folded precursor RNA, herein designated VGR FOLDED PRECURSOR RNA. It is appreciated that VGR2754 folded precursor RNA comprises a plurality of what is known in the art as 'hairpin' structures. These 'hairpin' structures are due to the fact that the nucleotide sequence of VGR2754 precursor RNA comprises a plurality of segments, the first half of each such segment having a nucleotide sequence which is at least a partial inversed-reversed sequence of the second half thereof, as is well known in the art.

VGR2754 folded precursor RNA is naturally processed by cellular enzymatic activity into at least 8 separate VGAM precursor RNAs, VGAM110 precursor RNA, VGAM111 precursor RNA, VGAM112 precursor RNA, VGAM113 precursor RNA, VGAM114 precursor RNA, VGAM115 precursor RNA, VGAM116 precursor RNA and VGAM117 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM110 RNA, VGAM111 RNA, VGAM112 RNA, VGAM113 RNA, VGAM114 RNA, VGAM115 RNA, VGAM116 RNA and VGAM117 RNA, herein schematically represented by VGAM1 RNA through VGAM3 RNA, each of which VGAM RNAs corresponding to VGAM RNA of FIG. 1.

VGAM110 RNA, herein schematically represented by VGAM1 RNA through VGAM3 RNA, binds complementarily to a host target binding site located in an untranslated region of VGAM110 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM110 host target RNA into VGAM110 host target protein, herein schematically represented by VGAM1 HOST TARGET PROTEIN through VGAM3 HOST TARGET PROTEIN, all of FIG. 1.

VGAM111 RNA, herein schematically represented by VGAM1 RNA through VGAM3 RNA, binds complementarily to a host target binding site located in an untranslated region of VGAM111 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM111 host target RNA into VGAM111 host target protein, herein schematically represented by VGAM1 HOST TARGET PROTEIN through VGAM3 HOST TARGET PROTEIN, all of FIG. 1.

VGAM112 RNA, herein schematically represented by VGAM1 RNA through VGAM3 RNA, binds complementarily to a host target binding site located in an untranslated region of VGAM112 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM112 host target RNA into VGAM112 host target protein, herein schematically represented by VGAM1 HOST TARGET PROTEIN through VGAM3 HOST TARGET PROTEIN, all of FIG. 1.

VGAM113 RNA, herein schematically represented by VGAM1 RNA through VGAM3 RNA, binds complementarily to a host target binding site located in an untranslated region of VGAM113 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM113 host target RNA into VGAM113 host target protein, herein schematically represented by VGAM1 HOST TARGET PROTEIN through VGAM3 HOST TARGET PROTEIN, all of FIG. 1.

VGAM114 RNA, herein schematically represented by VGAM1 RNA through VGAM3 RNA, binds complementarily to a host target binding site located in an untranslated region of VGAM114 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM114 host target RNA into VGAM114 host target protein, herein schematically represented by VGAM1 HOST TARGET PROTEIN through VGAM3 HOST TARGET PROTEIN, all of FIG. 1.

VGAM115 RNA, herein schematically represented by VGAM1 RNA through VGAM3 RNA, binds complementarily to a host target binding site located in an untranslated region of VGAM115 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM115 host target RNA into VGAM115 host target protein, herein schematically represented by VGAM1 HOST TARGET PROTEIN through VGAM3 HOST TARGET PROTEIN, all of FIG. 1.

VGAM116 RNA, herein schematically represented by VGAM1 RNA through VGAM3 RNA, binds complementarily to a host target binding site located in an untranslated region of VGAM116 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM116 host target RNA into VGAM116 host target protein, herein schematically represented by VGAM1 HOST TARGET PROTEIN through VGAM3 HOST TARGET PROTEIN, all of FIG. 1.

VGAM117 RNA, herein schematically represented by VGAM1 RNA through VGAM3 RNA, binds complementarily to a host target binding site located in an untranslated region of VGAM117 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM117 host target RNA into VGAM117 host target protein, herein schematically represented by VGAM1 HOST TARGET PROTEIN through VGAM3 HOST TARGET PROTEIN, all of FIG. 1.

It is appreciated that a function of VGR2754 gene, herein designated VGR GENE, is inhibition of expression of host target genes, as part of a novel viral mechanism of attacking a host. Accordingly, utilities of VGR2754 gene include diagnosis, prevention and treatment of viral infection by Shrimp White Spot Syndrome Virus (white spot bacilliform virus). Specific functions, and accordingly utilities, of VGR2754 gene correlate with, and may be deduced from, the identity of the host target genes, which are inhibited by VGAM RNAs comprised in the 'operon-like' cluster of VGR2754 gene: VGAM110 host target protein, VGAM111 host target protein, VGAM112 host target protein, VGAM113 host target protein, VGAM114 host target protein, VGAM115 host target protein, VGAM116 host target protein and VGAM117 host target protein, herein schematically represented by VGAM1 HOST TARGET PROTEIN through VGAM3 HOST TARGET PROTEIN. The function of these host target genes is elaborated hereinabove with reference to VGAM110, VGAM111, VGAM112, VGAM113, VGAM114, VGAM115, VGAM116 and VGAM117. FIG. 9 further provides a conceptual description of novel bioinformatically detected regulatory viral gene, referred to here as Viral Genomic Record 2755(VGR2755) viral gene, which encodes an 'operon-like' cluster of novel viral micro RNA-like genes, each of which in turn modulates expression of at least one host target gene, the function and utility of which at least one host target gene is known in the art.

VGR2755 gene, herein designated VGR GENE, is a novel bioinformatically detected regulatory, non protein coding, RNA viral gene. The method by which VGR2755 gene was detected is described hereinabove with reference to FIGS. 1-9.

VGR2755 gene encodes VGR2755 precursor RNA, herein designated VGR PRECURSOR RNA, an RNA molecule, typically several hundred nucleotides long.

VGR2755 precursor RNA folds spatially, forming VGR2755 folded precursor RNA, herein designated VGR FOLDED PRECURSOR RNA. It is appreciated that VGR2755 folded precursor RNA comprises a plurality of what is known in the art as 'hairpin' structures. These 'hairpin' structures are due to the fact that the nucleotide sequence of VGR2755 precursor RNA comprises a plurality of segments, the first half of each such segment having a nucleotide sequence which is at least a partial inversed-reversed sequence of the second half thereof, as is well known in the art.

VGR2755 folded precursor RNA is naturally processed by cellular enzymatic activity into at least 8 separate VGAM precursor RNAs, VGAM118 precursor RNA, VGAM119 precursor RNA, VGAM120 precursor RNA, VGAM121 precursor RNA, VGAM122 precursor RNA, VGAM123 precursor RNA, VGAM124 precursor RNA and VGAM125 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM118 RNA, VGAM119 RNA, VGAM120 RNA, VGAM121 RNA, VGAM122 RNA, VGAM123 RNA, VGAM124 RNA and VGAM125 RNA, herein schematically represented by VGAM1 RNA through VGAM3 RNA, each of which VGAM RNAs corresponding to VGAM RNA of FIG. 1.

VGAM118 RNA, herein schematically represented by VGAM1 RNA through VGAM3 RNA, binds complementarily to a host target binding site located in an untranslated region of VGAM118 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM118 host target RNA into VGAM118 host target protein, herein schematically represented by VGAM1 HOST TARGET PROTEIN through VGAM3 HOST TARGET PROTEIN, all of FIG. 1.

VGAM119 RNA, herein schematically represented by VGAM1 RNA through VGAM3 RNA, binds complementarily to a host target binding site located in an untranslated region of VGAM119 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM119 host target RNA into VGAM119 host target protein, herein schematically represented by VGAM1 HOST TARGET PROTEIN through VGAM3 HOST TARGET PROTEIN, all of FIG. 1.

VGAM120 RNA, herein schematically represented by VGAM1 RNA through VGAM3 RNA, binds complementarily to a host target binding site located in an untranslated region of VGAM120 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM120 host target RNA into VGAM120 host target protein, herein schematically represented by VGAM1 HOST TARGET PROTEIN through VGAM3 HOST TARGET PROTEIN, all of FIG. 1.

VGAM121 RNA, herein schematically represented by VGAM1 RNA through VGAM3 RNA, binds complementarily to a host target binding site located in an untranslated region of VGAM121 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM121 host target RNA into VGAM121 host target protein, herein schematically represented by VGAM1 HOST TARGET PROTEIN through VGAM3 HOST TARGET PROTEIN, all of FIG. 1.

VGAM122 RNA, herein schematically represented by VGAM1 RNA through VGAM3 RNA, binds complementarily to a host target binding site located in an untranslated region of VGAM122 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM122 host target RNA into VGAM122 host target protein, herein schematically represented by VGAM1 HOST TARGET PROTEIN through VGAM3 HOST TARGET PROTEIN, all of FIG. 1.

VGAM123 RNA, herein schematically represented by VGAM1 RNA through VGAM3 RNA, binds complementarily to a host target binding site located in an untranslated region of VGAM123 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM123 host target RNA into VGAM123 host target protein, herein schematically represented by VGAM1 HOST TARGET PROTEIN through VGAM3 HOST TARGET PROTEIN, all of FIG. 1.

VGAM124 RNA, herein schematically represented by VGAM1 RNA through VGAM3 RNA, binds complementarily to a host target binding site located in an untranslated region of VGAM124 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM124 host target RNA into VGAM124 host target protein, herein schematically represented by VGAM1 HOST TARGET PROTEIN through VGAM3 HOST TARGET PROTEIN, all of FIG. 1.

VGAM125 RNA, herein schematically represented by VGAM1 RNA through VGAM3 RNA, binds complementarily to a host target binding site located in an untranslated region of VGAM125 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM125 host target RNA into VGAM125 host target protein, herein schematically represented by VGAM1 HOST TARGET PROTEIN through VGAM3 HOST TARGET PROTEIN, all of FIG. 1.

It is appreciated that a function of VGR2755 gene, herein designated VGR GENE, is inhibition of expression of host target genes, as part of a novel viral mechanism of attacking a host. Accordingly, utilities of VGR2755 gene include diagnosis, prevention and treatment of viral infection by Shrimp White Spot Syndrome Virus (white spot bacilliform virus). Specific functions, and accordingly utilities, of VGR2755 gene correlate with, and may be deduced from, the identity of the host target genes, which are inhibited by VGAM RNAs comprised in the 'operon-like' cluster of VGR2755 gene: VGAM118 host target protein, VGAM119 host target protein, VGAM120 host target protein, VGAM121 host target protein, VGAM122 host target protein, VGAM123 host target protein, VGAM124 host target protein and VGAM125 host target protein, herein schematically represented by VGAM1 HOST TARGET PROTEIN through VGAM3 HOST TARGET PROTEIN. The function of these host target genes is elaborated hereinabove with reference to VGAM118, VGAM119, VGAM120, VGAM121, VGAM122, VGAM123, VGAM124 and VGAM125. FIG. 9 further provides a conceptual description of novel bioinformatically detected regulatory viral gene, referred to here as Viral Genomic Record 2756(VGR2756) viral gene, which encodes an 'operon-like' cluster of novel viral micro RNA-like genes, each of which in turn modulates expression of at least one host target gene, the function and utility of which at least one host target gene is known in the art.

VGR2756 gene, herein designated VGR GENE, is a novel bioinformatically detected regulatory, non protein coding, RNA viral gene. The method by which VGR2756 gene was detected is described hereinabove with reference to FIGS. 1-9.

VGR2756 gene encodes VGR2756 precursor RNA, herein designated VGR PRECURSOR RNA, an RNA molecule, typically several hundred nucleotides long.

VGR2756 precursor RNA folds spatially, forming VGR2756 folded precursor RNA, herein designated VGR FOLDED PRECURSOR RNA. It is appreciated that VGR2756 folded precursor RNA comprises a plurality of what is known in the art as 'hairpin' structures. These 'hairpin' structures are due to the fact that the nucleotide sequence of VGR2756 precursor RNA comprises a plurality of segments, the first half of each such segment having a nucleotide sequence which is at least a partial inversed-reversed sequence of the second half thereof, as is well known in the art.

VGR2756 folded precursor RNA is naturally processed by cellular enzymatic activity into at least 8 separate VGAM precursor RNAs, VGAM126 precursor RNA, VGAM127 precursor RNA, VGAM128 precursor RNA, VGAM129 precursor RNA, VGAM130 precursor RNA, VGAM131 precursor RNA, VGAM132 precursor RNA and VGAM133 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM126 RNA, VGAM127 RNA, VGAM128 RNA, VGAM129 RNA, VGAM130 RNA, VGAM131 RNA, VGAM132 RNA and VGAM133 RNA, herein schematically represented by VGAM1 RNA through VGAM3 RNA, each of which VGAM RNAs corresponding to VGAM RNA of FIG. 1.

VGAM126 RNA, herein schematically represented by VGAM1 RNA through VGAM3 RNA, binds complementarily to a host target binding site located in an untranslated region of VGAM126 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM126 host target RNA into VGAM126 host target protein, herein schematically represented by VGAM1 HOST TARGET PROTEIN through VGAM3 HOST TARGET PROTEIN, all of FIG. 1.

VGAM127 RNA, herein schematically represented by VGAM1 RNA through VGAM3 RNA, binds complementarily to a host target binding site located in an untranslated region of VGAM127 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM127 host target RNA into VGAM127 host target protein, herein schematically represented by VGAM1 HOST TARGET PROTEIN through VGAM3 HOST TARGET PROTEIN, all of FIG. 1.

VGAM128 RNA, herein schematically represented by VGAM1 RNA through VGAM3 RNA, binds complementarily to a host target binding site located in an untranslated region of VGAM128 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM128 host target RNA into VGAM128 host target protein, herein schematically represented by VGAM1 HOST TARGET PROTEIN through VGAM3 HOST TARGET PROTEIN, all of FIG. 1.

VGAM129 RNA, herein schematically represented by VGAM1 RNA through VGAM3 RNA, binds complementarily to a host target binding site located in an untranslated region of VGAM129 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM129 host target RNA into VGAM129 host target protein, herein schematically represented by VGAM1 HOST TARGET PROTEIN through VGAM3 HOST TARGET PROTEIN, all of FIG. 1.

VGAM130 RNA, herein schematically represented by VGAM1 RNA through VGAM3 RNA, binds complementarily to a host target binding site located in an untranslated region of VGAM130 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM130 host target RNA into VGAM130 host target protein, herein schematically represented by VGAM1 HOST TARGET PROTEIN through VGAM3 HOST TARGET PROTEIN, all of FIG. 1.

VGAM131 RNA, herein schematically represented by VGAM1 RNA through VGAM3 RNA, binds complementarily to a host target binding site located in an untranslated region of VGAM131 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM131 host target RNA into VGAM131 host target protein, herein schematically represented by VGAM1 HOST TARGET PROTEIN through VGAM3 HOST TARGET PROTEIN, all of FIG. 1.

VGAM132 RNA, herein schematically represented by VGAM1 RNA through VGAM3 RNA, binds complementarily to a host target binding site located in an untranslated region of VGAM132 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM132 host target RNA into VGAM132 host target protein, herein schematically represented by VGAM1 HOST TARGET PROTEIN through VGAM3 HOST TARGET PROTEIN, all of FIG. 1.

VGAM133 RNA, herein schematically represented by VGAM1 RNA through VGAM3 RNA, binds complementarily to a host target binding site located in an untranslated region of VGAM133 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM133 host target RNA into VGAM133 host target protein, herein schematically represented by VGAM1 HOST TARGET PROTEIN through VGAM3 HOST TARGET PROTEIN, all of FIG. 1.

It is appreciated that a function of VGR2756 gene, herein designated VGR GENE, is inhibition of expression of host target genes, as part of a novel viral mechanism of attacking a host. Accordingly, utilities of VGR2756 gene include diagnosis, prevention and treatment of viral infection by Shrimp White Spot Syndrome Virus (white spot bacilliform virus). Specific functions, and accordingly utilities, of VGR2756 gene correlate with, and may be deduced from, the identity of the host target genes, which are inhibited by VGAM RNAs comprised in the 'operon-like' cluster of VGR2756 gene: VGAM126 host target protein, VGAM127 host target protein, VGAM128 host target protein, VGAM129 host target protein, VGAM130 host target protein, VGAM131 host target protein, VGAM132 host target protein and VGAM133 host target protein, herein schematically represented by VGAM1 HOST TARGET PROTEIN through VGAM3 HOST TARGET PROTEIN. The function of these host target genes is elaborated hereinabove with reference to VGAM126, VGAM127, VGAM128, VGAM129, VGAM130, VGAM131, VGAM132 and VGAM133. FIG. 9 further provides a conceptual description of novel bioinformatically detected regulatory viral gene, referred to here as Viral Genomic Record 2757(VGR2757) viral gene, which encodes an 'operon-like' cluster of novel viral micro RNA-like genes, each of which in turn modulates expression of at least one host target gene, the function and utility of which at least one host target gene is known in the art.

VGR2757 gene, herein designated VGR GENE, is a novel bioinformatically detected regulatory, non protein coding, RNA viral gene. The method by which VGR2757 gene was detected is described hereinabove with reference to FIGS. 1-9.

VGR2757 gene encodes VGR2757 precursor RNA, herein designated VGR PRECURSOR RNA, an RNA molecule, typically several hundred nucleotides long.

VGR2757 precursor RNA folds spatially, forming VGR2757 folded precursor RNA, herein designated VGR FOLDED PRECURSOR RNA. It is appreciated that VGR2757 folded precursor RNA comprises a plurality of what is known in the art as 'hairpin' structures. These 'hairpin' structures are due to the fact that the nucleotide sequence of VGR2757 precursor RNA comprises a plurality of segments, the first half of each such segment having a nucleotide sequence which is at least a partial inversed-reversed sequence of the second half thereof, as is well known in the art.

VGR2757 folded precursor RNA is naturally processed by cellular enzymatic activity into at least 8 separate VGAM precursor RNAs, VGAM134 precursor RNA, VGAM135 precursor RNA, VGAM136 precursor RNA, VGAM137 precursor RNA, VGAM138 precursor RNA, VGAM139 precursor RNA, VGAM140 precursor RNA and VGAM141 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM134 RNA, VGAM135 RNA, VGAM136 RNA, VGAM137 RNA, VGAM138 RNA, VGAM139 RNA, VGAM140 RNA and VGAM141 RNA, herein schematically represented by VGAM1 RNA through VGAM3 RNA, each of which VGAM RNAs corresponding to VGAM RNA of FIG. 1.

VGAM134 RNA, herein schematically represented by VGAM1 RNA through VGAM3 RNA, binds complementarily to a host target binding site located in an untranslated region of VGAM134 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM134 host target RNA into VGAM134 host target protein, herein schematically represented by VGAM1 HOST TARGET PROTEIN through VGAM3 HOST TARGET PROTEIN, all of FIG. 1.

VGAM135 RNA, herein schematically represented by VGAM1 RNA through VGAM3 RNA, binds complementarily to a host target binding site located in an untranslated region of VGAM135 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM135 host target RNA into VGAM135 host target protein, herein schematically represented by VGAM1 HOST TARGET PROTEIN through VGAM3 HOST TARGET PROTEIN, all of FIG. 1.

VGAM136 RNA, herein schematically represented by VGAM1 RNA through VGAM3 RNA, binds complementarily to a host target binding site located in an untranslated region of VGAM136 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM136 host target RNA into VGAM136 host target protein, herein schematically represented by VGAM1 HOST TARGET PROTEIN through VGAM3 HOST TARGET PROTEIN, all of FIG. 1.

VGAM137 RNA, herein schematically represented by VGAM1 RNA through VGAM3 RNA, binds complementarily to a host target binding site located in an untranslated region of VGAM137 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM137 host target RNA into VGAM137 host target protein, herein schematically represented by VGAM1 HOST TARGET PROTEIN through VGAM3 HOST TARGET PROTEIN, all of FIG. 1.

VGAM138 RNA, herein schematically represented by VGAM1 RNA through VGAM3 RNA, binds complementarily to a host target binding site located in an untranslated region of VGAM138 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM138 host target RNA into VGAM138 host target protein, herein schematically represented by VGAM1 HOST TARGET PROTEIN through VGAM3 HOST TARGET PROTEIN, all of FIG. 1.

VGAM139 RNA, herein schematically represented by VGAM1 RNA through VGAM3 RNA, binds complementarily to a host target binding site located in an untranslated region of VGAM139 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM139 host target RNA into VGAM139 host target protein, herein schematically represented by VGAM1 HOST TARGET PROTEIN through VGAM3 HOST TARGET PROTEIN, all of FIG. 1.

VGAM140 RNA, herein schematically represented by VGAM1 RNA through VGAM3 RNA, binds complementarily to a host target binding site located in an untranslated region of VGAM140 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM140 host target RNA into VGAM140 host target protein, herein schematically represented by VGAM1 HOST TARGET PROTEIN through VGAM3 HOST TARGET PROTEIN, all of FIG. 1.

VGAM141 RNA, herein schematically represented by VGAM1 RNA through VGAM3 RNA, binds complementarily to a host target binding site located in an untranslated region of VGAM141 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM141 host target RNA into VGAM141 host target protein, herein schematically represented by VGAM1 HOST TARGET PROTEIN through VGAM3 HOST TARGET PROTEIN, all of FIG. 1.

It is appreciated that a function of VGR2757 gene, herein designated VGR GENE, is inhibition of expression of host target genes, as part of a novel viral mechanism of attacking a host. Accordingly, utilities of VGR2757 gene include diagnosis, prevention and treatment of viral infection by Shrimp White Spot Syndrome Virus (white spot bacilliform virus). Specific functions, and accordingly utilities, of VGR2757 gene correlate with, and may be deduced from, the identity of the host target genes, which are inhibited by VGAM RNAs comprised in the 'operon-like' cluster of VGR2757 gene: VGAM134 host target protein, VGAM135 host target protein, VGAM136 host target protein, VGAM137 host target protein, VGAM138 host target protein, VGAM139 host target protein, VGAM140 host target protein and VGAM141 host target protein, herein schematically represented by VGAM1 HOST TARGET PROTEIN through VGAM3 HOST TARGET PROTEIN. The function of these host target genes is elaborated hereinabove with reference to VGAM134, VGAM135, VGAM136, VGAM137, VGAM138, VGAM139, VGAM140 and VGAM141. FIG. 9 further provides a conceptual description of novel bioinformatically detected regulatory viral gene, referred to here as Viral Genomic Record 2758(VGR2758) viral gene, which encodes an 'operon-like' cluster of novel viral micro RNA-like genes, each of which in turn modulates expression of at least one host target gene, the function and utility of which at least one host target gene is known in the art.

VGR2758 gene, herein designated VGR GENE, is a novel bioinformatically detected regulatory, non protein coding, RNA viral gene. The method by which VGR2758 gene was detected is described hereinabove with reference to FIGS. 1-9.

VGR2758 gene encodes VGR2758 precursor RNA, herein designated VGR PRECURSOR RNA, an RNA molecule, typically several hundred nucleotides long.

VGR2758 precursor RNA folds spatially, forming VGR2758 folded precursor RNA, herein designated VGR FOLDED PRECURSOR RNA. It is appreciated that VGR2758 folded precursor RNA comprises a plurality of what is known in the art as 'hairpin' structures. These 'hairpin' structures are due to the fact that the nucleotide sequence of VGR2758 precursor RNA comprises a plurality of segments, the first half of each such segment having a nucleotide sequence which is at least a partial inversed-reversed sequence of the second half thereof, as is well known in the art.

VGR2758 folded precursor RNA is naturally processed by cellular enzymatic activity into at least 8 separate VGAM precursor RNAs, VGAM142 precursor RNA, VGAM143 precursor RNA, VGAM144 precursor RNA, VGAM145 precursor RNA, VGAM146 precursor RNA, VGAM147 precursor RNA, VGAM148 precursor RNA and VGAM149 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM142 RNA, VGAM143 RNA, VGAM144 RNA, VGAM145 RNA, VGAM146 RNA, VGAM147 RNA, VGAM148 RNA and VGAM149 RNA, herein schematically represented by VGAM1 RNA through VGAM3 RNA, each of which VGAM RNAs corresponding to VGAM RNA of FIG. 1.

VGAM142 RNA, herein schematically represented by VGAM1 RNA through VGAM3 RNA, binds complementarily to a host target binding site located in an untranslated region of VGAM142 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM142 host target RNA into VGAM142 host target protein, herein schematically represented by VGAM1 HOST TARGET PROTEIN through VGAM3 HOST TARGET PROTEIN, all of FIG. 1.

VGAM143 RNA, herein schematically represented by VGAM1 RNA through VGAM3 RNA, binds complementarily to a host target binding site located in an untranslated region of VGAM143 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM143 host target RNA into VGAM143 host target protein, herein schematically represented by VGAM1 HOST TARGET PROTEIN through VGAM3 HOST TARGET PROTEIN, all of FIG. 1.

VGAM144 RNA, herein schematically represented by VGAM1 RNA through VGAM3 RNA, binds complementarily to a host target binding site located in an untranslated region of VGAM144 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM144 host target RNA into VGAM144 host target protein, herein schematically represented by VGAM1 HOST TARGET PROTEIN through VGAM3 HOST TARGET PROTEIN, all of FIG. 1.

VGAM145 RNA, herein schematically represented by VGAM1 RNA through VGAM3 RNA, binds complementarily to a host target binding site located in an untranslated region of VGAM145 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM145 host target RNA into VGAM145 host target protein, herein schematically represented by VGAM1 HOST TARGET PROTEIN through VGAM3 HOST TARGET PROTEIN, all of FIG. 1.

VGAM146 RNA, herein schematically represented by VGAM1 RNA through VGAM3 RNA, binds complementarily to a host target binding site located in an untranslated region of VGAM146 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM146 host target RNA into VGAM146 host target protein, herein schematically represented by VGAM1 HOST TARGET PROTEIN through VGAM3 HOST TARGET PROTEIN, all of FIG. 1.

VGAM147 RNA, herein schematically represented by VGAM1 RNA through VGAM3 RNA, binds complementarily to a host target binding site located in an untranslated region of VGAM147 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM147 host target RNA into VGAM147 host target protein, herein schematically represented by VGAM1 HOST TARGET PROTEIN through VGAM3 HOST TARGET PROTEIN, all of FIG. 1.

VGAM148 RNA, herein schematically represented by VGAM1 RNA through VGAM3 RNA, binds complementarily to a host target binding site located in an untranslated region of VGAM148 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM148 host target RNA into VGAM148 host target protein, herein schematically represented by VGAM1 HOST TARGET PROTEIN through VGAM3 HOST TARGET PROTEIN, all of FIG. 1.

VGAM149 RNA, herein schematically represented by VGAM1 RNA through VGAM3 RNA, binds complementarily to a host target binding site located in an untranslated region of VGAM149 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM149 host target RNA into VGAM149 host target protein, herein schematically represented by VGAM1 HOST TARGET PROTEIN through VGAM3 HOST TARGET PROTEIN, all of FIG. 1.

It is appreciated that a function of VGR2758 gene, herein designated VGR GENE, is inhibition of expression of host target genes, as part of a novel viral mechanism of attacking a host. Accordingly, utilities of VGR2758 gene include diagnosis, prevention and treatment of viral infection by Shrimp White Spot Syndrome Virus (white spot bacilliform virus). Specific functions, and accordingly utilities, of VGR2758 gene correlate with, and may be deduced from, the identity of the host target genes, which are inhibited by VGAM RNAs comprised in the 'operon-like' cluster of VGR2758 gene: VGAM142 host target protein, VGAM143 host target protein, VGAM144 host target protein, VGAM145 host target protein, VGAM146 host target protein, VGAM147 host target protein, VGAM148 host target protein and VGAM149 host target protein, herein schematically represented by VGAM1 HOST TARGET PROTEIN through VGAM3 HOST TARGET PROTEIN. The function of these host target genes is elaborated hereinabove with reference to VGAM142, VGAM143, VGAM144, VGAM145, VGAM146, VGAM147, VGAM148 and VGAM149. FIG. 9 further provides a conceptual description of novel bioinformatically detected regulatory viral gene, referred to here as Viral Genomic Record 2759(VGR2759) viral gene, which encodes an 'operon-like' cluster of novel viral micro RNA-like genes, each of which in turn modulates expression of at least one host target gene, the function and utility of which at least one host target gene is known in the art.

VGR2759 gene, herein designated VGR GENE, is a novel bioinformatically detected regulatory, non protein coding, RNA viral gene. The method by which VGR2759 gene was detected is described hereinabove with reference to FIGS. 1-9.

VGR2759 gene encodes VGR2759 precursor RNA, herein designated VGR PRECURSOR RNA, an RNA molecule, typically several hundred nucleotides long.

VGR2759 precursor RNA folds spatially, forming VGR2759 folded precursor RNA, herein designated VGR FOLDED PRECURSOR RNA. It is appreciated that VGR2759 folded precursor RNA comprises a plurality of what is known in the art as 'hairpin' structures. These 'hairpin' structures are due to the fact that the nucleotide sequence of VGR2759 precursor RNA comprises a plurality of segments, the first half of each such segment having a nucleotide sequence which is at least a partial inversed-reversed sequence of the second half thereof, as is well known in the art.

VGR2759 folded precursor RNA is naturally processed by cellular enzymatic activity into at least 8 separate VGAM precursor RNAs, VGAM150 precursor RNA, VGAM151 precursor RNA, VGAM152 precursor RNA, VGAM153 precursor RNA, VGAM154 precursor RNA, VGAM155 precursor RNA, VGAM156 precursor RNA and VGAM157 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM150 RNA, VGAM151 RNA, VGAM152 RNA, VGAM153 RNA, VGAM154 RNA, VGAM155 RNA, VGAM156 RNA and VGAM157 RNA, herein schematically represented by VGAM1 RNA through VGAM3 RNA, each of which VGAM RNAs corresponding to VGAM RNA of FIG. 1.

VGAM150 RNA, herein schematically represented by VGAM1 RNA through VGAM3 RNA, binds complementarily to a host target binding site located in an untranslated region of VGAM150 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM150 host target RNA into VGAM150 host target protein, herein schematically represented by VGAM1 HOST TARGET PROTEIN through VGAM3 HOST TARGET PROTEIN, all of FIG. 1.

VGAM151 RNA, herein schematically represented by VGAM1 RNA through VGAM3 RNA, binds complementarily to a host target binding site located in an untranslated region of VGAM151 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM151 host target RNA into VGAM151 host target protein, herein schematically represented by VGAM1 HOST TARGET PROTEIN through VGAM3 HOST TARGET PROTEIN, all of FIG. 1.

VGAM152 RNA, herein schematically represented by VGAM1 RNA through VGAM3 RNA, binds complementarily to a host target binding site located in an untranslated region of VGAM152 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM152 host target RNA into VGAM152 host target protein, herein schematically represented by VGAM1 HOST TARGET PROTEIN through VGAM3 HOST TARGET PROTEIN, all of FIG. 1.

VGAM153 RNA, herein schematically represented by VGAM1 RNA through VGAM3 RNA, binds complementarily to a host target binding site located in an untranslated region of VGAM153 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM153 host target RNA into VGAM153 host target protein, herein schematically represented by VGAM1 HOST TARGET PROTEIN through VGAM3 HOST TARGET PROTEIN, all of FIG. 1.

VGAM154 RNA, herein schematically represented by VGAM1 RNA through VGAM3 RNA, binds complementarily to a host target binding site located in an untranslated region of VGAM154 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM154 host target RNA into VGAM154 host target protein, herein schematically represented by VGAM1 HOST TARGET PROTEIN through VGAM3 HOST TARGET PROTEIN, all of FIG. 1.

VGAM155 RNA, herein schematically represented by VGAM1 RNA through VGAM3 RNA, binds complementarily to a host target binding site located in an untranslated region of VGAM155 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM155 host target RNA into VGAM155 host target protein, herein schematically represented by VGAM1 HOST TARGET PROTEIN through VGAM3 HOST TARGET PROTEIN, all of FIG. 1.

VGAM156 RNA, herein schematically represented by VGAM1 RNA through VGAM3 RNA, binds complementarily to a host target binding site located in an untranslated region of VGAM156 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM156 host target RNA into VGAM156 host target protein, herein schematically represented by VGAM1 HOST TARGET PROTEIN through VGAM3 HOST TARGET PROTEIN, all of FIG. 1.

VGAM157 RNA, herein schematically represented by VGAM1 RNA through VGAM3 RNA, binds complementarily to a host target binding site located in an untranslated region of VGAM157 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM157 host target RNA into VGAM157 host target protein, herein schematically represented by VGAM1 HOST TARGET PROTEIN through VGAM3 HOST TARGET PROTEIN, all of FIG. 1.

It is appreciated that a function of VGR2759 gene, herein designated VGR GENE, is inhibition of expression of host target genes, as part of a novel viral mechanism of attacking a host. Accordingly, utilities of VGR2759 gene include diagnosis, prevention and treatment of viral infection by Shrimp White Spot Syndrome Virus (white spot bacilliform virus). Specific functions, and accordingly utilities, of VGR2759 gene correlate with, and may be deduced from, the identity of the host target genes, which are inhibited by VGAM RNAs comprised in the 'operon-like' cluster of VGR2759 gene: VGAM150 host target protein, VGAM151 host target protein, VGAM152 host target protein, VGAM153 host target protein, VGAM154 host target protein, VGAM155 host target protein, VGAM156 host target protein and VGAM157 host target protein, herein schematically represented by VGAM1 HOST TARGET PROTEIN through VGAM3 HOST TARGET PROTEIN. The function of these host target genes is elaborated hereinabove with reference to VGAM150, VGAM151, VGAM152, VGAM153, VGAM154, VGAM155, VGAM156 and VGAM157. FIG. 9 further provides a conceptual description of novel bioinformatically detected regulatory viral gene, referred to here as Viral Genomic Record 2760(VGR2760) viral gene, which encodes an 'operon-like' cluster of novel viral micro RNA-like genes, each of which in turn modulates expression of at least one host target gene, the function and utility of which at least one host target gene is known in the art.

VGR2760 gene, herein designated VGR GENE, is a novel bioinformatically detected regulatory, non protein coding, RNA viral gene. The method by which VGR2760 gene was detected is described hereinabove with reference to FIGS. 1-9.

VGR2760 gene encodes VGR2760 precursor RNA, herein designated VGR PRECURSOR RNA, an RNA molecule, typically several hundred nucleotides long.

VGR2760 precursor RNA folds spatially, forming VGR2760 folded precursor RNA, herein designated VGR FOLDED PRECURSOR RNA. It is appreciated that VGR2760 folded precursor RNA comprises a plurality of what is known in the art as 'hairpin' structures. These 'hairpin' structures are due to the fact that the nucleotide sequence of VGR2760 precursor RNA comprises a plurality of segments, the first half of each such segment having a nucleotide sequence which is at least a partial inversed-reversed sequence of the second half thereof, as is well known in the art.

VGR2760 folded precursor RNA is naturally processed by cellular enzymatic activity into at least 8 separate VGAM precursor RNAs, VGAM158 precursor RNA, VGAM159 precursor RNA, VGAM160 precursor RNA, VGAM161 precursor RNA, VGAM162 precursor RNA, VGAM163 precursor RNA, VGAM164 precursor RNA and VGAM165 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM158 RNA, VGAM159 RNA, VGAM160 RNA, VGAM161 RNA, VGAM162 RNA, VGAM163 RNA, VGAM164 RNA and VGAM165 RNA, herein schematically represented by VGAM1 RNA through VGAM3 RNA, each of which VGAM RNAs corresponding to VGAM RNA of FIG. 1.

VGAM158 RNA, herein schematically represented by VGAM1 RNA through VGAM3 RNA, binds complementarily to a host target binding site located in an untranslated region of VGAM158 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM158 host target RNA into VGAM158 host target protein, herein schematically represented by VGAM1 HOST TARGET PROTEIN through VGAM3 HOST TARGET PROTEIN, all of FIG. 1.

VGAM159 RNA, herein schematically represented by VGAM1 RNA through VGAM3 RNA, binds complementarily to a host target binding site located in an untranslated region of VGAM159 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM159 host target RNA into VGAM159 host target protein, herein schematically represented by VGAM1 HOST TARGET PROTEIN through VGAM3 HOST TARGET PROTEIN, all of FIG. 1.

VGAM160 RNA, herein schematically represented by VGAM1 RNA through VGAM3 RNA, binds complementarily to a host target binding site located in an untranslated region of VGAM160 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM160 host target RNA into VGAM160 host target protein, herein schematically represented by VGAM1 HOST TARGET PROTEIN through VGAM3 HOST TARGET PROTEIN, all of FIG. 1.

VGAM161 RNA, herein schematically represented by VGAM1 RNA through VGAM3 RNA, binds complementarily to a host target binding site located in an untranslated region of VGAM161 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM161 host target RNA into VGAM161 host target protein, herein schematically represented by VGAM1 HOST TARGET PROTEIN through VGAM3 HOST TARGET PROTEIN, all of FIG. 1.

VGAM162 RNA, herein schematically represented by VGAM1 RNA through VGAM3 RNA, binds complementarily to a host target binding site located in an untranslated region of VGAM162 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM162 host target RNA into VGAM162 host target protein, herein schematically represented by VGAM1 HOST TARGET PROTEIN through VGAM3 HOST TARGET PROTEIN, all of FIG. 1.

VGAM163 RNA, herein schematically represented by VGAM1 RNA through VGAM3 RNA, binds complementarily to a host target binding site located in an untranslated region of VGAM163 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM163 host target RNA into VGAM163 host target protein, herein schematically represented by VGAM1 HOST TARGET PROTEIN through VGAM3 HOST TARGET PROTEIN, all of FIG. 1.

VGAM164 RNA, herein schematically represented by VGAM1 RNA through VGAM3 RNA, binds complementarily to a host target binding site located in an untranslated region of VGAM164 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM164 host target RNA into VGAM164 host target protein, herein schematically represented by VGAM1 HOST TARGET PROTEIN through VGAM3 HOST TARGET PROTEIN, all of FIG. 1.

VGAM165 RNA, herein schematically represented by VGAM1 RNA through VGAM3 RNA, binds complementarily to a host target binding site located in an untranslated region of VGAM165 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM165 host target RNA into VGAM165 host target protein, herein schematically represented by VGAM1 HOST TARGET PROTEIN through VGAM3 HOST TARGET PROTEIN, all of FIG. 1.

It is appreciated that a function of VGR2760 gene, herein designated VGR GENE, is inhibition of expression of host target genes, as part of a novel viral mechanism of attacking a host. Accordingly, utilities of VGR2760 gene include diagnosis, prevention and treatment of viral infection by Shrimp White Spot Syndrome Virus (white spot bacilliform virus). Specific functions, and accordingly utilities, of VGR2760 gene correlate with, and may be deduced from, the identity of the host target genes, which are inhibited by VGAM RNAs comprised in the 'operon-like' cluster of VGR2760 gene: VGAM158 host target protein, VGAM159 host target protein, VGAM160 host target protein, VGAM161 host target protein, VGAM162 host target protein, VGAM163 host target protein, VGAM164 host target protein and VGAM165 host target protein, herein schematically represented by VGAM1 HOST TARGET PROTEIN through VGAM3 HOST TARGET PROTEIN. The function of these host target genes is elaborated hereinabove with reference to VGAM158, VGAM159, VGAM160, VGAM161, VGAM162, VGAM163, VGAM164 and VGAM165. FIG. 9 further provides a conceptual description of novel bioinformatically detected regulatory viral gene, referred to here as Viral Genomic Record 2761(VGR2761) viral gene, which encodes an 'operon-like' cluster of novel viral micro RNA-like genes, each of which in turn modulates expression of at least one host target gene, the function and utility of which at least one host target gene is known in the art.

VGR2761 gene, herein designated VGR GENE, is a novel bioinformatically detected regulatory, non protein coding, RNA viral gene. The method by which VGR2761 gene was detected is described hereinabove with reference to FIGS. 1-9.

VGR2761 gene encodes VGR2761 precursor RNA, herein designated VGR PRECURSOR RNA, an RNA molecule, typically several hundred nucleotides long.

VGR2761 precursor RNA folds spatially, forming VGR2761 folded precursor RNA, herein designated VGR FOLDED PRECURSOR RNA. It is appreciated that VGR2761 folded precursor RNA comprises a plurality of what is known in the art as 'hairpin' structures. These 'hairpin' structures are due to the fact that the nucleotide sequence of VGR2761 precursor RNA comprises a plurality of segments, the first half of each such segment having a nucleotide sequence which is at least a partial inversed-reversed sequence of the second half thereof, as is well known in the art.

VGR2761 folded precursor RNA is naturally processed by cellular enzymatic activity into at least 8 separate VGAM precursor RNAs, VGAM166 precursor RNA, VGAM167 precursor RNA, VGAM168 precursor RNA, VGAM169 precursor RNA, VGAM170 precursor RNA, VGAM171 precursor RNA, VGAM172 precursor RNA and VGAM173 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM166 RNA, VGAM167 RNA, VGAM168 RNA, VGAM169 RNA, VGAM170 RNA, VGAM171 RNA, VGAM172 RNA and VGAM173 RNA, herein schematically represented by VGAM1 RNA through VGAM3 RNA, each of which VGAM RNAs corresponding to VGAM RNA of FIG. 1.

VGAM166 RNA, herein schematically represented by VGAM1 RNA through VGAM3 RNA, binds complementarily to a host target binding site located in an untranslated region of VGAM166 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM166 host target RNA into VGAM166 host target protein, herein schematically represented by VGAM1 HOST TARGET PROTEIN through VGAM3 HOST TARGET PROTEIN, all of FIG. 1.

VGAM167 RNA, herein schematically represented by VGAM1 RNA through VGAM3 RNA, binds complementarily to a host target binding site located in an untranslated region of VGAM167 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM167 host target RNA into VGAM167 host target protein, herein schematically represented by VGAM1 HOST TARGET PROTEIN through VGAM3 HOST TARGET PROTEIN, all of FIG. 1.

VGAM168 RNA, herein schematically represented by VGAM1 RNA through VGAM3 RNA, binds complementarily to a host target binding site located in an untranslated region of VGAM168 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM168 host target RNA into VGAM168 host target protein, herein schematically represented by VGAM1 HOST TARGET PROTEIN through VGAM3 HOST TARGET PROTEIN, all of FIG. 1.

VGAM169 RNA, herein schematically represented by VGAM1 RNA through VGAM3 RNA, binds complementarily to a host target binding site located in an untranslated region of VGAM169 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM169 host target RNA into VGAM169 host target protein, herein schematically represented by VGAM1 HOST TARGET PROTEIN through VGAM3 HOST TARGET PROTEIN, all of FIG. 1.

VGAM170 RNA, herein schematically represented by VGAM1 RNA through VGAM3 RNA, binds complementarily to a host target binding site located in an untranslated region of VGAM170 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM170 host target RNA into VGAM170 host target protein, herein schematically represented by VGAM1 HOST TARGET PROTEIN through VGAM3 HOST TARGET PROTEIN, all of FIG. 1.

VGAM171 RNA, herein schematically represented by VGAM1 RNA through VGAM3 RNA, binds complementarily to a host target binding site located in an untranslated region of VGAM171 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM171 host target RNA into VGAM171 host target protein, herein schematically represented by VGAM1 HOST TARGET PROTEIN through VGAM3 HOST TARGET PROTEIN, all of FIG. 1.

VGAM172 RNA, herein schematically represented by VGAM1 RNA through VGAM3 RNA, binds complementarily to a host target binding site located in an untranslated region of VGAM172 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM172 host target RNA into VGAM172 host target protein, herein schematically represented by VGAM1 HOST TARGET PROTEIN through VGAM3 HOST TARGET PROTEIN, all of FIG. 1.

VGAM173 RNA, herein schematically represented by VGAM1 RNA through VGAM3 RNA, binds complementarily to a host target binding site located in an untranslated region of VGAM173 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM173 host target RNA into VGAM173 host target protein, herein schematically represented by VGAM1 HOST TARGET PROTEIN through VGAM3 HOST TARGET PROTEIN, all of FIG. 1.

It is appreciated that a function of VGR2761 gene, herein designated VGR GENE, is inhibition of expression of host target genes, as part of a novel viral mechanism of attacking a host. Accordingly, utilities of VGR2761 gene include diagnosis, prevention and treatment of viral infection by Shrimp White Spot Syndrome Virus (white spot baciliform virus). Specific functions, and accordingly utilities, of VGR2761 gene correlate with, and may be deduced from, the identity of the host target genes, which are inhibited by VGAM RNAs comprised in the 'operon-like' cluster of VGR2761 gene: VGAM166 host target protein, VGAM167 host target protein, VGAM168 host target protein, VGAM169 host target protein, VGAM170 host target protein, VGAM171 host target protein, VGAM172 host target protein and VGAM173 host target protein, herein schematically represented by VGAM1 HOST TARGET PROTEIN through VGAM3

HOST TARGET PROTEIN. The function of these host target genes is elaborated hereinabove with reference to VGAM166, VGAM167, VGAM168, VGAM169, VGAM170, VGAM171, VGAM172 and VGAM173. FIG. 9 further provides a conceptual description of novel bioinformatically detected regulatory viral gene, referred to here as Viral Genomic Record 2762(VGR2762) viral gene, which encodes an 'operon-like' cluster of novel viral micro RNA-like genes, each of which in turn modulates expression of at least one host target gene, the function and utility of which at least one host target gene is known in the art.

VGR2762 gene, herein designated VGR GENE, is a novel bioinformatically detected regulatory, non protein coding, RNA viral gene. The method by which VGR2762 gene was detected is described hereinabove with reference to FIGS. 1-9.

VGR2762 gene encodes VGR2762 precursor RNA, herein designated VGR PRECURSOR RNA, an RNA molecule, typically several hundred nucleotides long.

VGR2762 precursor RNA folds spatially, forming VGR2762 folded precursor RNA, herein designated VGR FOLDED PRECURSOR RNA. It is appreciated that VGR2762 folded precursor RNA comprises a plurality of what is known in the art as 'hairpin' structures. These 'hairpin' structures are due to the fact that the nucleotide sequence of VGR2762 precursor RNA comprises a plurality of segments, the first half of each such segment having a nucleotide sequence which is at least a partial inversed-reversed sequence of the second half thereof, as is well known in the art.

VGR2762 folded precursor RNA is naturally processed by cellular enzymatic activity into at least 8 separate VGAM precursor RNAs, VGAM174 precursor RNA, VGAM175 precursor RNA, VGAM176 precursor RNA, VGAM177 precursor RNA, VGAM178 precursor RNA, VGAM179 precursor RNA, VGAM180 precursor RNA and VGAM181 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM174 RNA, VGAM175 RNA, VGAM176 RNA, VGAM177 RNA, VGAM178 RNA, VGAM179 RNA, VGAM180 RNA and VGAM181 RNA, herein schematically represented by VGAM1 RNA through VGAM3 RNA, each of which VGAM RNAs corresponding to VGAM RNA of FIG. 1.

VGAM174 RNA, herein schematically represented by VGAM1 RNA through VGAM3 RNA, binds complementarily to a host target binding site located in an untranslated region of VGAM174 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM174 host target RNA into VGAM174 host target protein, herein schematically represented by VGAM1 HOST TARGET PROTEIN through VGAM3 HOST TARGET PROTEIN, all of FIG. 1.

VGAM175 RNA, herein schematically represented by VGAM1 RNA through VGAM3 RNA, binds complementarily to a host target binding site located in an untranslated region of VGAM175 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM175 host target RNA into VGAM175 host target protein, herein schematically represented by VGAM1 HOST TARGET PROTEIN through VGAM3 HOST TARGET PROTEIN, all of FIG. 1.

VGAM176 RNA, herein schematically represented by VGAM1 RNA through VGAM3 RNA, binds complementarily to a host target binding site located in an untranslated region of VGAM176 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM176 host target RNA into VGAM176 host target protein, herein schematically represented by VGAM1 HOST TARGET PROTEIN through VGAM3 HOST TARGET PROTEIN, all of FIG. 1.

VGAM177 RNA, herein schematically represented by VGAM1 RNA through VGAM3 RNA, binds complementarily to a host target binding site located in an untranslated region of VGAM177 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM177 host target RNA into VGAM177 host target protein, herein schematically represented by VGAM1 HOST TARGET PROTEIN through VGAM3 HOST TARGET PROTEIN, all of FIG. 1.

VGAM178 RNA, herein schematically represented by VGAM1 RNA through VGAM3 RNA, binds complementarily to a host target binding site located in an untranslated region of VGAM178 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM178 host target RNA into VGAM178 host target protein, herein schematically represented by VGAM1 HOST TARGET PROTEIN through VGAM3 HOST TARGET PROTEIN, all of FIG. 1.

VGAM179 RNA, herein schematically represented by VGAM1 RNA through VGAM3 RNA, binds complementarily to a host target binding site located in an untranslated region of VGAM179 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM179 host target RNA into VGAM179 host target protein, herein schematically represented by VGAM1 HOST TARGET PROTEIN through VGAM3 HOST TARGET PROTEIN, all of FIG. 1.

VGAM180 RNA, herein schematically represented by VGAM1 RNA through VGAM3 RNA, binds complementarily to a host target binding site located in an untranslated region of VGAM180 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM180 host target RNA into VGAM180 host target protein, herein schematically represented by VGAM1 HOST TARGET PROTEIN through VGAM3 HOST TARGET PROTEIN, all of FIG. 1.

VGAM181 RNA, herein schematically represented by VGAM1 RNA through VGAM3 RNA, binds complementarily to a host target binding site located in an untranslated region of VGAM181 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM181 host target RNA into VGAM181 host target protein, herein schematically represented by VGAM1 HOST TARGET PROTEIN through VGAM3 HOST TARGET PROTEIN, all of FIG. 1.

It is appreciated that a function of VGR2762 gene, herein designated VGR GENE, is inhibition of expression of host target genes, as part of a novel viral mechanism of attacking a host. Accordingly, utilities of VGR2762 gene include diagnosis, prevention and treatment of viral infection by Shrimp White Spot Syndrome Virus (white spot bacilliform virus). Specific functions, and accordingly utilities, of VGR2762 gene correlate with, and may be deduced from, the identity of the host target genes, which are inhibited by VGAM RNAs comprised in the 'operon-like' cluster of VGR2762 gene: VGAM174 host target protein, VGAM175 host target protein, VGAM176 host target protein, VGAM177 host target protein, VGAM178 host target protein, VGAM179 host target protein, VGAM180 host target protein and VGAM181 host target protein, herein schematically represented by VGAM1 HOST TARGET PROTEIN through VGAM3 HOST TARGET PROTEIN. The function of these host target genes is elaborated hereinabove with reference to VGAM174, VGAM175, VGAM176, VGAM177, VGAM178, VGAM179, VGAM180 and VGAM181. FIG. 9 further provides a conceptual description of novel bioinformatically detected regulatory viral gene, referred to here as Viral Genomic Record 2763(VGR2763) viral gene, which encodes an 'operon-like' cluster of novel viral micro RNA-like genes, each of which in turn modulates expression of at least one host target gene, the function and utility of which at least one host target gene is known in the art.

VGR2763 gene, herein designated VGR GENE, is a novel bioinformatically detected regulatory, non protein coding, RNA viral gene. The method by which VGR2763 gene was detected is described hereinabove with reference to FIGS. 1-9.

VGR2763 gene encodes VGR2763 precursor RNA, herein designated VGR PRECURSOR RNA, an RNA molecule, typically several hundred nucleotides long.

VGR2763 precursor RNA folds spatially, forming VGR2763 folded precursor RNA, herein designated VGR FOLDED PRECURSOR RNA. It is appreciated that VGR2763 folded precursor RNA comprises a plurality of what is known in the art as 'hairpin' structures. These 'hairpin' structures are due to the fact that the nucleotide sequence of VGR2763 precursor RNA comprises a plurality of segments, the first half of each such segment having a nucleotide sequence which is at least a partial inversed-reversed sequence of the second half thereof, as is well known in the art.

VGR2763 folded precursor RNA is naturally processed by cellular enzymatic activity into at least 8 separate VGAM precursor RNAs, VGAM182 precursor RNA, VGAM183 precursor RNA, VGAM184 precursor RNA, VGAM185 precursor RNA, VGAM186 precursor RNA, VGAM187 precursor RNA, VGAM188 precursor RNA and VGAM189 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM182 RNA, VGAM183 RNA, VGAM184 RNA, VGAM185 RNA, VGAM186 RNA, VGAM187 RNA, VGAM188 RNA and VGAM189 RNA, herein schematically represented by VGAM1 RNA through VGAM3 RNA, each of which VGAM RNAs corresponding to VGAM RNA of FIG. 1.

VGAM182 RNA, herein schematically represented by VGAM1 RNA through VGAM3 RNA, binds complementarily to a host target binding site located in an untranslated region of VGAM182 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM182 host target RNA into VGAM182 host target protein, herein schematically represented by VGAM1 HOST TARGET PROTEIN through VGAM3 HOST TARGET PROTEIN, all of FIG. 1.

VGAM183 RNA, herein schematically represented by VGAM1 RNA through VGAM3 RNA, binds complementarily to a host target binding site located in an untranslated region of VGAM183 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM183 host target RNA into VGAM183 host target protein, herein schematically represented by VGAM1 HOST TARGET PROTEIN through VGAM3 HOST TARGET PROTEIN, all of FIG. 1.

VGAM184 RNA, herein schematically represented by VGAM1 RNA through VGAM3 RNA, binds complementarily to a host target binding site located in an untranslated region of VGAM184 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM184 host target RNA into VGAM184 host target protein, herein schematically represented by VGAM1 HOST TARGET PROTEIN through VGAM3 HOST TARGET PROTEIN, all of FIG. 1.

VGAM185 RNA, herein schematically represented by VGAM1 RNA through VGAM3 RNA, binds complementarily to a host target binding site located in an untranslated region of VGAM185 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM185 host target RNA into VGAM185 host target protein, herein schematically represented by VGAM1 HOST TARGET PROTEIN through VGAM3 HOST TARGET PROTEIN, all of FIG. 1.

VGAM186 RNA, herein schematically represented by VGAM1 RNA through VGAM3 RNA, binds complementarily to a host target binding site located in an untranslated region of VGAM186 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM186 host target RNA into VGAM186 host target protein, herein schematically represented by VGAM1 HOST TARGET PROTEIN through VGAM3 HOST TARGET PROTEIN, all of FIG. 1.

VGAM187 RNA, herein schematically represented by VGAM1 RNA through VGAM3 RNA, binds complementarily to a host target binding site located in an untranslated region of VGAM187 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM187 host target RNA into VGAM187 host target protein, herein schematically represented by VGAM1 HOST TARGET PROTEIN through VGAM3 HOST TARGET PROTEIN, all of FIG. 1.

VGAM188 RNA, herein schematically represented by VGAM1 RNA through VGAM3 RNA, binds complementarily to a host target binding site located in an untranslated region of VGAM188 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM188 host target RNA into VGAM188 host target protein, herein schematically represented by VGAM1 HOST TARGET PROTEIN through VGAM3 HOST TARGET PROTEIN, all of FIG. 1.

VGAM189 RNA, herein schematically represented by VGAM1 RNA through VGAM3 RNA, binds complementarily to a host target binding site located in an untranslated region of VGAM189 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM189 host target RNA into VGAM189 host target protein, herein schematically represented by VGAM1 HOST TARGET PROTEIN through VGAM3 HOST TARGET PROTEIN, all of FIG. 1.

It is appreciated that a function of VGR2763 gene, herein designated VGR GENE, is inhibition of expression of host target genes, as part of a novel viral mechanism of attacking a host. Accordingly, utilities of VGR2763 gene include diagnosis, prevention and treatment of viral infection by Shrimp White Spot Syndrome Virus (white spot baciliform virus). Specific functions, and accordingly utilities, of VGR2763 gene correlate with, and may be deduced from, the identity of the host target genes, which are inhibited by VGAM RNAs comprised in the 'operon-like' cluster of VGR2763 gene: VGAM182 host target protein, VGAM183 host target protein, VGAM184 host target protein, VGAM185 host target protein, VGAM186 host target protein, VGAM187 host target protein, VGAM188 host target protein and VGAM189 host target protein, herein schematically represented by VGAM1 HOST TARGET PROTEIN through VGAM3 HOST TARGET PROTEIN. The function of these host target genes is elaborated hereinabove with reference to VGAM182, VGAM183, VGAM184, VGAM185, VGAM186, VGAM187, VGAM188 and VGAM189. FIG. 9 further provides a conceptual description of novel bioinformatically detected regulatory viral gene, referred to here as Viral Genomic Record 2764(VGR2764) viral gene, which encodes an 'operon-like' cluster of novel viral micro RNA-like genes, each of which in turn modulates expression of at least one host target gene, the function and utility of which at least one host target gene is known in the art.

VGR2764 gene, herein designated VGR GENE, is a novel bioinformatically detected regulatory, non protein coding, RNA viral gene. The method by which VGR2764 gene was detected is described hereinabove with reference to FIGS. 1-9.

VGR2764 gene encodes VGR2764 precursor RNA, herein designated VGR PRECURSOR RNA, an RNA molecule, typically several hundred nucleotides long.

VGR2764 precursor RNA folds spatially, forming VGR2764 folded precursor RNA, herein designated VGR FOLDED PRECURSOR RNA. It is appreciated that VGR2764 folded precursor RNA comprises a plurality of what is known in the art as 'hairpin' structures. These 'hairpin' structures are due to the fact that the nucleotide sequence of VGR2764 precursor RNA comprises a plurality of segments, the first half of each such segment having a nucleotide sequence which is at least a partial inversed-reversed sequence of the second half thereof, as is well known in the art.

VGR2764 folded precursor RNA is naturally processed by cellular enzymatic activity into at least 8 separate VGAM precursor RNAs, VGAM190 precursor RNA, VGAM191 precursor RNA, VGAM192 precursor RNA, VGAM193 precursor RNA, VGAM194 precursor RNA, VGAM195 precursor RNA, VGAM196 precursor RNA and VGAM197 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM190 RNA, VGAM191 RNA, VGAM192 RNA, VGAM193 RNA, VGAM194 RNA, VGAM195 RNA, VGAM196 RNA and VGAM197 RNA, herein schematically represented by VGAM1 RNA through VGAM3 RNA, each of which VGAM RNAs corresponding to VGAM RNA of FIG. 1.

VGAM190 RNA, herein schematically represented by VGAM1 RNA through VGAM3 RNA, binds complementarily to a host target binding site located in an untranslated region of VGAM190 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM190 host target RNA into VGAM190 host target protein, herein schematically represented by VGAM1 HOST TARGET PROTEIN through VGAM3 HOST TARGET PROTEIN, all of FIG. 1.

VGAM191 RNA, herein schematically represented by VGAM1 RNA through VGAM3 RNA, binds complementarily to a host target binding site located in an untranslated region of VGAM191 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM191 host target RNA into VGAM191 host target protein, herein schematically represented by VGAM1 HOST TARGET PROTEIN through VGAM3 HOST TARGET PROTEIN, all of FIG. 1.

VGAM192 RNA, herein schematically represented by VGAM1 RNA through VGAM3 RNA, binds complementarily to a host target binding site located in an untranslated region of VGAM192 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM192 host target RNA into VGAM192 host target protein, herein schematically represented by VGAM1 HOST TARGET PROTEIN through VGAM3 HOST TARGET PROTEIN, all of FIG. 1.

VGAM193 RNA, herein schematically represented by VGAM1 RNA through VGAM3 RNA, binds complementarily to a host target binding site located in an untranslated region of VGAM193 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM193 host target RNA into VGAM193 host target protein, herein schematically represented by VGAM1 HOST TARGET PROTEIN through VGAM3 HOST TARGET PROTEIN, all of FIG. 1.

VGAM194 RNA, herein schematically represented by VGAM1 RNA through VGAM3 RNA, binds complementarily to a host target binding site located in an untranslated region of VGAM194 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM194 host target RNA into VGAM194 host target protein, herein schematically represented by VGAM1 HOST TARGET PROTEIN through VGAM3 HOST TARGET PROTEIN, all of FIG. 1.

VGAM195 RNA, herein schematically represented by VGAM1 RNA through VGAM3 RNA, binds complementarily to a host target binding site located in an untranslated region of VGAM195 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM195 host target RNA into VGAM195 host target protein, herein schematically represented by VGAM1 HOST TARGET PROTEIN through VGAM3 HOST TARGET PROTEIN, all of FIG. 1.

VGAM196 RNA, herein schematically represented by VGAM1 RNA through VGAM3 RNA, binds complementarily to a host target binding site located in an untranslated region of VGAM196 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM196 host target RNA into VGAM196 host target protein, herein schematically represented by VGAM1 HOST TARGET PROTEIN through VGAM3 HOST TARGET PROTEIN, all of FIG. 1.

VGAM197 RNA, herein schematically represented by VGAM1 RNA through VGAM3 RNA, binds complementarily to a host target binding site located in an untranslated region of VGAM197 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM197 host target RNA into VGAM197 host target protein, herein schematically represented by VGAM1 HOST TARGET PROTEIN through VGAM3 HOST TARGET PROTEIN, all of FIG. 1.

It is appreciated that a function of VGR2764 gene, herein designated VGR GENE, is inhibition of expression of host target genes, as part of a novel viral mechanism of attacking a host. Accordingly, utilities of VGR2764 gene include diagnosis, prevention and treatment of viral infection by Shrimp White Spot Syndrome Virus (white spot baciliform virus). Specific functions, and accordingly utilities, of VGR2764 gene correlate with, and may be deduced from, the identity of the host target genes, which are inhibited by VGAM RNAs comprised in the 'operon-like' cluster of VGR2764 gene: VGAM190 host target protein, VGAM191 host target protein, VGAM192 host target protein, VGAM193 host target protein, VGAM194 host target protein, VGAM195 host target protein, VGAM196 host target protein and VGAM197 host target protein, herein schematically represented by VGAM1 HOST TARGET PROTEIN through VGAM3 HOST TARGET PROTEIN. The function of these host target genes is elaborated hereinabove with reference to VGAM190, VGAM191, VGAM192, VGAM193, VGAM194, VGAM195, VGAM196 and VGAM197. FIG. 9 further provides a conceptual description of novel bioinformatically detected regulatory viral gene, referred to here as Viral Genomic Record 2765(VGR2765) viral gene, which encodes an 'operon-like' cluster of novel viral micro RNA-like genes, each of which in turn modulates expression of at least one host target gene, the function and utility of which at least one host target gene is known in the art.

VGR2765 gene, herein designated VGR GENE, is a novel bioinformatically detected regulatory, non protein coding, RNA viral gene. The method by which VGR2765 gene was detected is described hereinabove with reference to FIGS. 1-9.

VGR2765 gene encodes VGR2765 precursor RNA, herein designated VGR PRECURSOR RNA, an RNA molecule, typically several hundred nucleotides long.

VGR2765 precursor RNA folds spatially, forming VGR2765 folded precursor RNA, herein designated VGR FOLDED PRECURSOR RNA. It is appreciated that VGR2765 folded precursor RNA comprises a plurality of what is known in the art as 'hairpin' structures. These 'hairpin' structures are due to the fact that the nucleotide sequence of VGR2765 precursor RNA comprises a plurality of segments, the first half of each such segment having a nucleotide sequence which is at least a partial inversed-reversed sequence of the second half thereof, as is well known in the art.

VGR2765 folded precursor RNA is naturally processed by cellular enzymatic activity into at least 8 separate VGAM precursor RNAs, VGAM198 precursor RNA, VGAM199 precursor RNA, VGAM200 precursor RNA, VGAM201 precursor RNA, VGAM202 precursor RNA, VGAM203 precursor RNA, VGAM204 precursor RNA and VGAM205 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM198 RNA, VGAM199 RNA, VGAM200 RNA, VGAM201 RNA, VGAM202 RNA, VGAM203 RNA, VGAM204 RNA and VGAM205 RNA, herein schematically represented by VGAM1 RNA through VGAM3 RNA, each of which VGAM RNAs corresponding to VGAM RNA of FIG. 1.

VGAM198 RNA, herein schematically represented by VGAM1 RNA through VGAM3 RNA, binds complementarily to a host target binding site located in an untranslated region of VGAM198 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM198 host target RNA into VGAM198 host target protein, herein schematically represented by VGAM1 HOST TARGET PROTEIN through VGAM3 HOST TARGET PROTEIN, all of FIG. 1.

VGAM199 RNA, herein schematically represented by VGAM1 RNA through VGAM3 RNA, binds complementarily to a host target binding site located in an untranslated region of VGAM199 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM199 host target RNA into VGAM199 host target protein, herein schematically represented by VGAM1 HOST TARGET PROTEIN through VGAM3 HOST TARGET PROTEIN, all of FIG. 1.

VGAM200 RNA, herein schematically represented by VGAM1 RNA through VGAM3 RNA, binds complementarily to a host target binding site located in an untranslated region of VGAM200 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM200 host target RNA into VGAM200 host target protein, herein schematically represented by VGAM1 HOST TARGET PROTEIN through VGAM3 HOST TARGET PROTEIN, all of FIG. 1.

VGAM201 RNA, herein schematically represented by VGAM1 RNA through VGAM3 RNA, binds complementarily to a host target binding site located in an untranslated region of VGAM201 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM201 host target RNA into VGAM201 host target protein, herein schematically represented by VGAM1 HOST TARGET PROTEIN through VGAM3 HOST TARGET PROTEIN, all of FIG. 1.

VGAM202 RNA, herein schematically represented by VGAM1 RNA through VGAM3 RNA, binds complementarily to a host target binding site located in an untranslated region of VGAM202 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM202 host target RNA into VGAM202 host target protein, herein schematically represented by VGAM1 HOST TARGET PROTEIN through VGAM3 HOST TARGET PROTEIN, all of FIG. 1.

VGAM203 RNA, herein schematically represented by VGAM1 RNA through VGAM3 RNA, binds complementarily to a host target binding site located in an untranslated region of VGAM203 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM203 host target RNA into VGAM203 host target protein, herein schematically represented by VGAM1 HOST TARGET PROTEIN through VGAM3 HOST TARGET PROTEIN, all of FIG. 1.

VGAM204 RNA, herein schematically represented by VGAM1 RNA through VGAM3 RNA, binds complementarily to a host target binding site located in an untranslated region of VGAM204 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM204 host target RNA into VGAM204 host target protein, herein schematically represented by VGAM1 HOST TARGET PROTEIN through VGAM3 HOST TARGET PROTEIN, all of FIG. 1.

VGAM205 RNA, herein schematically represented by VGAM1 RNA through VGAM3 RNA, binds complementarily to a host target binding site located in an untranslated region of VGAM205 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM205 host target RNA into VGAM205 host target protein, herein schematically represented by VGAM1 HOST TARGET PROTEIN through VGAM3 HOST TARGET PROTEIN, all of FIG. 1.

It is appreciated that a function of VGR2765 gene, herein designated VGR GENE, is inhibition of expression of host target genes, as part of a novel viral mechanism of attacking a host. Accordingly, utilities of VGR2765 gene include diagnosis, prevention and treatment of viral infection by Shrimp White Spot Syndrome Virus (white spot baciiliform virus). Specific functions, and accordingly utilities, of VGR2765 gene correlate with, and may be deduced from, the identity of the host target genes, which are inhibited by VGAM RNAs comprised in the 'operon-like' cluster of VGR2765 gene: VGAM198 host target protein, VGAM199 host target protein, VGAM200 host target protein, VGAM201 host target protein, VGAM202 host target protein, VGAM203 host target protein, VGAM204 host target protein and VGAM205 host target protein, herein schematically represented by VGAM1 HOST TARGET PROTEIN through VGAM3 HOST TARGET PROTEIN. The function of these host target genes is elaborated hereinabove with reference to VGAM198, VGAM199, VGAM200, VGAM201, VGAM202, VGAM203, VGAM204 and VGAM205. FIG. 9 further provides a conceptual description of novel bioinformatically detected regulatory viral gene, referred to here as Viral Genomic Record 2766(VGR2766) viral gene, which encodes an 'operon-like' cluster of novel viral micro RNA-like genes, each of which in turn modulates expression of at least one host target gene, the function and utility of which at least one host target gene is known in the art.

VGR2766 gene, herein designated VGR GENE, is a novel bioinformatically detected regulatory, non protein coding, RNA viral gene. The method by which VGR2766 gene was detected is described hereinabove with reference to FIGS. 1-9.

VGR2766 gene encodes VGR2766 precursor RNA, herein designated VGR PRECURSOR RNA, an RNA molecule, typically several hundred nucleotides long.

VGR2766 precursor RNA folds spatially, forming VGR2766 folded precursor RNA, herein designated VGR FOLDED PRECURSOR RNA. It is appreciated that VGR2766 folded precursor RNA comprises a plurality of what is known in the art as 'hairpin' structures. These 'hairpin' structures are due to the fact that the nucleotide sequence of VGR2766 precursor RNA comprises a plurality of segments, the first half of each such segment having a nucleotide sequence which is at least a partial inversed-reversed sequence of the second half thereof, as is well known in the art.

VGR2766 folded precursor RNA is naturally processed by cellular enzymatic activity into at least 5 separate VGAM precursor RNAs, VGAM206 precursor RNA, VGAM207 precursor RNA, VGAM208 precursor RNA, VGAM209 precursor RNA and VGAM210 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM206 RNA, VGAM207 RNA, VGAM208 RNA, VGAM209 RNA and VGAM210 RNA, herein schematically represented by VGAM1 RNA through VGAM3 RNA, each of which VGAM RNAs corresponding to VGAM RNA of FIG. 1.

VGAM206 RNA, herein schematically represented by VGAM1 RNA through VGAM3 RNA, binds complementarily to a host target binding site located in an untranslated region of VGAM206 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM206 host target RNA into VGAM206 host target protein, herein schematically represented by VGAM1 HOST TARGET PROTEIN through VGAM3 HOST TARGET PROTEIN, all of FIG. 1.

VGAM207 RNA, herein schematically represented by VGAM1 RNA through VGAM3 RNA, binds complementarily to a host target binding site located in an untranslated region of VGAM207 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM207 host target RNA into VGAM207 host target protein, herein schematically represented by VGAM1 HOST TARGET PROTEIN through VGAM3 HOST TARGET PROTEIN, all of FIG. 1.

VGAM208 RNA, herein schematically represented by VGAM1 RNA through VGAM3 RNA, binds complementarily to a host target binding site located in an untranslated region of VGAM208 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM208 host target RNA into VGAM208 host target protein, herein schematically represented by VGAM1 HOST TARGET PROTEIN through VGAM3 HOST TARGET PROTEIN, all of FIG. 1.

VGAM209 RNA, herein schematically represented by VGAM1 RNA through VGAM3 RNA, binds complementarily to a host target binding site located in an untranslated region of VGAM209 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM209 host target RNA into VGAM209 host target protein, herein schematically represented by VGAM1 HOST TARGET PROTEIN through VGAM3 HOST TARGET PROTEIN, all of FIG. 1.

VGAM210 RNA, herein schematically represented by VGAM1 RNA through VGAM3 RNA, binds complementarily to a host target binding site located in an untranslated region of VGAM210 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM210 host target RNA into VGAM210 host target protein, herein schematically represented by VGAM1 HOST TARGET PROTEIN through VGAM3 HOST TARGET PROTEIN, all of FIG. 1.

It is appreciated that a function of VGR2766 gene, herein designated VGR GENE, is inhibition of expression of host target genes, as part of a novel viral mechanism of attacking a host. Accordingly, utilities of VGR2766 gene include diagnosis, prevention and treatment of viral infection by Shrimp White Spot Syndrome Virus (white spot baciliform virus). Specific functions, and accordingly utilities, of VGR2766 gene correlate with, and may be deduced from, the identity of the host target genes, which are inhibited by VGAM RNAs comprised in the 'operon-like' cluster of VGR2766 gene: VGAM206 host target protein, VGAM207 host target protein, VGAM208 host target protein, VGAM209 host target protein and VGAM210 host target protein, herein schematically represented by VGAM1 HOST TARGET PROTEIN through VGAM3 HOST TARGET PROTEIN. The function of these host target genes is elaborated hereinabove with reference to VGAM206, VGAM207, VGAM208, VGAM209 and VGAM210. FIG. 9 further provides a conceptual description of novel bioinformatically detected regulatory viral gene, referred to here as Viral Genomic Record 2767(VGR2767) viral gene, which encodes an 'operon-like' cluster of novel viral micro RNA-like genes, each of which in turn modulates expression of at least one host target gene, the function and utility of which at least one host target gene is known in the art.

VGR2767 gene, herein designated VGR GENE, is a novel bioinformatically detected regulatory, non protein coding, RNA viral gene. The method by which VGR2767 gene was detected is described hereinabove with reference to FIGS. 1-9.

VGR2767 gene encodes VGR2767 precursor RNA, herein designated VGR PRECURSOR RNA, an RNA molecule, typically several hundred nucleotides long.

VGR2767 precursor RNA folds spatially, forming VGR2767 folded precursor RNA, herein designated VGR FOLDED PRECURSOR RNA. It is appreciated that VGR2767 folded precursor RNA comprises a plurality of what is known in the art as 'hairpin' structures. These 'hairpin' structures are due to the fact that the nucleotide sequence of VGR2767 precursor RNA comprises a plurality of segments, the first half of each such segment having a nucleotide sequence which is at least a partial inversed-reversed sequence of the second half thereof, as is well known in the art.

VGR2767 folded precursor RNA is naturally processed by cellular enzymatic activity into at least 3 separate VGAM precursor RNAs, VGAM211 precursor RNA, VGAM212 precursor RNA and VGAM213 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM211 RNA, VGAM212 RNA and VGAM213 RNA, herein schematically represented by VGAM1 RNA through VGAM3 RNA, each of which VGAM RNAs corresponding to VGAM RNA of FIG. 1.

VGAM211 RNA, herein schematically represented by VGAM1 RNA through VGAM3 RNA, binds complementarily to a host target binding site located in an untranslated region of VGAM211 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM211 host target RNA into VGAM211 host target protein, herein schematically represented by VGAM1 HOST TARGET PROTEIN through VGAM3 HOST TARGET PROTEIN, all of FIG. 1.

VGAM212 RNA, herein schematically represented by VGAM1 RNA through VGAM3 RNA, binds complementarily to a host target binding site located in an untranslated region of VGAM212 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM212 host target RNA into VGAM212 host target protein, herein schematically represented by VGAM1 HOST TARGET PROTEIN through VGAM3 HOST TARGET PROTEIN, all of FIG. 1.

VGAM213 RNA, herein schematically represented by VGAM1 RNA through VGAM3 RNA, binds complementarily to a host target binding site located in an untranslated region of VGAM213 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM213 host target RNA into VGAM213 host target protein, herein schematically represented by VGAM1 HOST TARGET PROTEIN through VGAM3 HOST TARGET PROTEIN, all of FIG. 1.

It is appreciated that a function of VGR2767 gene, herein designated VGR GENE, is inhibition of expression of host target genes, as part of a novel viral mechanism of attacking a host. Accordingly, utilities of VGR2767 gene include diagnosis, prevention and treatment of viral infection by Simian Virus 40. Specific functions, and accordingly utilities, of VGR2767 gene correlate with, and may be deduced from, the identity of the host target genes, which are inhibited by VGAM RNAs comprised in the 'operon-like' cluster of VGR2767 gene: VGAM211 host target protein, VGAM212 host target protein and VGAM213 host target protein, herein schematically represented by VGAM1 HOST TARGET PROTEIN through VGAM3 HOST TARGET PROTEIN. The function of these host target genes is elaborated hereinabove with reference to VGAM211, VGAM212 and VGAM213. FIG. 9 further provides a conceptual description of novel bioinformatically detected regulatory viral gene, referred to here as Viral Genomic Record 2768(VGR2768) viral gene, which encodes an 'operon-like' cluster of novel viral micro RNA-like genes, each of which in turn modulates expression of at least one host target gene, the function and utility of which at least one host target gene is known in the art.

VGR2768 gene, herein designated VGR GENE, is a novel bioinformatically detected regulatory, non protein coding, RNA viral gene. The method by which VGR2768 gene was detected is described hereinabove with reference to FIGS. 1-9.

VGR2768 gene encodes VGR2768 precursor RNA, herein designated VGR PRECURSOR RNA, an RNA molecule, typically several hundred nucleotides long.

VGR2768 precursor RNA folds spatially, forming VGR2768 folded precursor RNA, herein designated VGR FOLDED PRECURSOR RNA. It is appreciated that VGR2768 folded precursor RNA comprises a plurality of what is known in the art as 'hairpin' structures. These 'hairpin' structures are due to the fact that the nucleotide sequence of VGR2768 precursor RNA comprises a plurality of segments, the first half of each such segment having a nucleotide sequence which is at least a partial inversed-reversed sequence of the second half thereof, as is well known in the art.

VGR2768 folded precursor RNA is naturally processed by cellular enzymatic activity into at least 2 separate VGAM precursor RNAs, VGAM214 precursor RNA and VGAM215 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM214 RNA and VGAM215 RNA, herein schematically represented by VGAM1 RNA through VGAM3 RNA, each of which VGAM RNAs corresponding to VGAM RNA of FIG. 1.

VGAM214 RNA, herein schematically represented by VGAM1 RNA through VGAM3 RNA, binds complementarily to a host target binding site located in an untranslated region of VGAM214 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM214 host target RNA into VGAM214 host target protein, herein schematically represented by VGAM1 HOST TARGET PROTEIN through VGAM3 HOST TARGET PROTEIN, all of FIG. 1.

VGAM215 RNA, herein schematically represented by VGAM1 RNA through VGAM3 RNA, binds complementarily to a host target binding site located in an untranslated region of VGAM215 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM215 host target RNA into VGAM215 host target protein, herein schematically represented by VGAM1 HOST TARGET PROTEIN through VGAM3 HOST TARGET PROTEIN, all of FIG. 1.

It is appreciated that a function of VGR2768 gene, herein designated VGR GENE, is inhibition of expression of host target genes, as part of a novel viral mechanism of attacking a host. Accordingly, utilities of VGR2768 gene include diagnosis, prevention and treatment of viral infection by Autographa Californica Nucleopolyhedrovirus. Specific functions, and accordingly utilities, of VGR2768 gene correlate with, and may be deduced from, the identity of the host target genes, which are inhibited by VGAM RNAs comprised in the 'operon-like' cluster of VGR2768 gene: VGAM214 host target protein and VGAM215 host target protein, herein schematically represented by VGAM1 HOST TARGET PROTEIN through VGAM3 HOST TARGET PROTEIN. The function of these host target genes is elaborated hereinabove with reference to VGAM214 and VGAM215. FIG. 9 further provides a conceptual description of novel bioinformatically detected regulatory viral gene, referred to here as Viral Genomic Record 2769(VGR2769) viral gene, which encodes an 'operon-like' cluster of novel viral micro RNA-like genes, each of which in turn modulates expression of at least one host target gene, the function and utility of which at least one host target gene is known in the art.

VGR2769 gene, herein designated VGR GENE, is a novel bioinformatically detected regulatory, non protein coding, RNA viral gene. The method by which VGR2769 gene was detected is described hereinabove with reference to FIGS. 1-9.

VGR2769 gene encodes VGR2769 precursor RNA, herein designated VGR PRECURSOR RNA, an RNA molecule, typically several hundred nucleotides long.

VGR2769 precursor RNA folds spatially, forming VGR2769 folded precursor RNA, herein designated VGR FOLDED PRECURSOR RNA. It is appreciated that VGR2769 folded precursor RNA comprises a plurality of what is known in the art as 'hairpin' structures. These 'hairpin' structures are due to the fact that the nucleotide sequence of VGR2769 precursor RNA comprises a plurality of segments, the first half of each such segment having a nucleotide sequence which is at least a partial inversed-reversed sequence of the second half thereof, as is well known in the art.

VGR2769 folded precursor RNA is naturally processed by cellular enzymatic activity into at least 2 separate VGAM precursor RNAs, VGAM216 precursor RNA and VGAM217 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM216 RNA and VGAM217 RNA, herein schematically represented by VGAM1 RNA through VGAM3 RNA, each of which VGAM RNAs corresponding to VGAM RNA of FIG. 1.

VGAM216 RNA, herein schematically represented by VGAM1 RNA through VGAM3 RNA, binds complementarily to a host target binding site located in an untranslated region of VGAM216 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM216 host target RNA into VGAM216 host target protein, herein schematically represented by VGAM1 HOST TARGET PROTEIN through VGAM3 HOST TARGET PROTEIN, all of FIG. 1.

VGAM217 RNA, herein schematically represented by VGAM1 RNA through VGAM3 RNA, binds complementarily to a host target binding site located in an untranslated region of VGAM217 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM217 host target RNA into VGAM217 host target protein, herein schematically represented by VGAM1 HOST TARGET PROTEIN through VGAM3 HOST TARGET PROTEIN, all of FIG. 1.

It is appreciated that a function of VGR2769 gene, herein designated VGR GENE, is inhibition of expression of host target genes, as part of a novel viral mechanism of attacking a host. Accordingly, utilities of VGR2769 gene include diagnosis, prevention and treatment of viral infection by Avian Leukosis Virus. Specific functions, and accordingly utilities, of VGR2769 gene correlate with, and may be deduced from, the identity of the host target genes, which are inhibited by VGAM RNAs comprised in the 'operon-like' cluster of VGR2769 gene: VGAM216 host target protein and VGAM217 host target protein, herein schematically represented by VGAM1 HOST TARGET PROTEIN through VGAM3 HOST TARGET PROTEIN. The function of these host target genes is elaborated hereinabove with reference to VGAM216 and VGAM217. FIG. 9 further provides a conceptual description of novel bioinformatically detected regulatory viral gene, referred to here as Viral Genomic Record 2770(VGR2770) viral gene, which encodes an 'operon-like' cluster of novel viral micro RNA-like genes, each of which in turn modulates expression of at least one host target gene, the function and utility of which at least one host target gene is known in the art.

VGR2770 gene, herein designated VGR GENE, is a novel bioinformatically detected regulatory, non protein coding, RNA viral gene. The method by which VGR2770 gene was detected is described hereinabove with reference to FIGS. 1-9.

VGR2770 gene encodes VGR2770 precursor RNA, herein designated VGR PRECURSOR RNA, an RNA molecule, typically several hundred nucleotides long.

VGR2770 precursor RNA folds spatially, forming VGR2770 folded precursor RNA, herein designated VGR FOLDED PRECURSOR RNA. It is appreciated that VGR2770 folded precursor RNA comprises a plurality of what is known in the art as 'hairpin' structures. These 'hairpin' structures are due to the fact that the nucleotide sequence of VGR2770 precursor RNA comprises a plurality of segments, the first half of each such segment having a nucleotide sequence which is at least a partial inversed-reversed sequence of the second half thereof, as is well known in the art.

VGR2770 folded precursor RNA is naturally processed by cellular enzymatic activity into at least 2 separate VGAM precursor RNAs, VGAM218 precursor RNA and VGAM219 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM218 RNA and VGAM219 RNA, herein schematically represented by VGAM1 RNA through VGAM3 RNA, each of which VGAM RNAs corresponding to VGAM RNA of FIG. 1.

VGAM218 RNA, herein schematically represented by VGAM1 RNA through VGAM3 RNA, binds complementarily to a host target binding site located in an untranslated region of VGAM218 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM218 host target RNA into VGAM218 host target protein, herein schematically represented by VGAM1 HOST TARGET PROTEIN through VGAM3 HOST TARGET PROTEIN, all of FIG. 1.

VGAM219 RNA, herein schematically represented by VGAM1 RNA through VGAM3 RNA, binds complementarily to a host target binding site located in an untranslated region of VGAM219 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM219 host target RNA into VGAM219 host target protein, herein schematically represented by VGAM1 HOST TARGET PROTEIN through VGAM3 HOST TARGET PROTEIN, all of FIG. 1.

It is appreciated that a function of VGR2770 gene, herein designated VGR GENE, is inhibition of expression of host target genes, as part of a novel viral mechanism of attacking a host. Accordingly, utilities of VGR2770 gene include diagnosis, prevention and treatment of viral infection by Bovine Leukemia Virus. Specific functions, and accordingly utilities, of VGR2770 gene correlate with, and may be deduced from, the identity of the host target genes, which are inhibited by VGAM RNAs comprised in the 'operon-like' cluster of VGR2770 gene: VGAM218 host target protein and VGAM219 host target protein, herein schematically represented by VGAM1 HOST TARGET PROTEIN through VGAM3 HOST TARGET PROTEIN. The function of these host target genes is elaborated hereinabove with reference to VGAM218 and VGAM219. FIG. 9 further provides a conceptual description of novel bioinformatically detected regulatory viral gene, referred to here as Viral Genomic Record 2771(VGR2771) viral gene, which encodes an 'operon-like' cluster of novel viral micro RNA-like genes, each of which in turn modulates expression of at least one host target gene, the function and utility of which at least one host target gene is known in the art.

VGR2771 gene, herein designated VGR GENE, is a novel bioinformatically detected regulatory, non protein coding, RNA viral gene. The method by which VGR2771 gene was detected is described hereinabove with reference to FIGS. 1-9.

VGR2771 gene encodes VGR2771 precursor RNA, herein designated VGR PRECURSOR RNA, an RNA molecule, typically several hundred nucleotides long.

VGR2771 precursor RNA folds spatially, forming VGR2771 folded precursor RNA, herein designated VGR FOLDED PRECURSOR RNA. It is appreciated that VGR2771 folded precursor RNA comprises a plurality of what is known in the art as 'hairpin' structures. These 'hairpin' structures are due to the fact that the nucleotide sequence of VGR2771 precursor RNA comprises a plurality of segments, the first half of each such segment having a nucleotide sequence which is at least a partial inversed-reversed sequence of the second half thereof, as is well known in the art.

VGR2771 folded precursor RNA is naturally processed by cellular enzymatic activity into at least 8 separate VGAM precursor RNAs, VGAM220 precursor RNA, VGAM221 precursor RNA, VGAM222 precursor RNA, VGAM223 precursor RNA, VGAM224 precursor RNA, VGAM225 precursor RNA, VGAM226 precursor RNA and VGAM227 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM220 RNA, VGAM221 RNA, VGAM222 RNA, VGAM223 RNA, VGAM224 RNA, VGAM225 RNA, VGAM226 RNA and VGAM227 RNA, herein schematically represented by VGAM1 RNA through VGAM3 RNA, each of which VGAM RNAs corresponding to VGAM RNA of FIG. 1.

VGAM220 RNA, herein schematically represented by VGAM1 RNA through VGAM3 RNA, binds complementarily to a host target binding site located in an untranslated region of VGAM220 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM220 host target RNA into VGAM220 host target protein, herein schematically represented by VGAM1 HOST TARGET PROTEIN through VGAM3 HOST TARGET PROTEIN, all of FIG. 1.

VGAM221 RNA, herein schematically represented by VGAM1 RNA through VGAM3 RNA, binds complementarily to a host target binding site located in an untranslated region of VGAM221 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM221 host target RNA into VGAM221 host target protein, herein schematically represented by VGAM1 HOST TARGET PROTEIN through VGAM3 HOST TARGET PROTEIN, all of FIG. 1.

VGAM222 RNA, herein schematically represented by VGAM1 RNA through VGAM3 RNA, binds complementarily to a host target binding site located in an untranslated region of VGAM222 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM222 host target RNA into VGAM222 host target protein, herein schematically represented by VGAM1 HOST TARGET PROTEIN through VGAM3 HOST TARGET PROTEIN, all of FIG. 1.

VGAM223 RNA, herein schematically represented by VGAM1 RNA through VGAM3 RNA, binds complementarily to a host target binding site located in an untranslated region of VGAM223 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM223 host target RNA into VGAM223 host target protein, herein schematically represented by VGAM1 HOST TARGET PROTEIN through VGAM3 HOST TARGET PROTEIN, all of FIG. 1.

VGAM224 RNA, herein schematically represented by VGAM1 RNA through VGAM3 RNA, binds complementarily to a host target binding site located in an untranslated region of VGAM224 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM224 host target RNA into VGAM224 host target protein, herein schematically represented by VGAM1 HOST TARGET PROTEIN through VGAM3 HOST TARGET PROTEIN, all of FIG. 1.

VGAM225 RNA, herein schematically represented by VGAM1 RNA through VGAM3 RNA, binds complementarily to a host target binding site located in an untranslated region of VGAM225 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM225 host target RNA into VGAM225 host target protein, herein schematically represented by VGAM1 HOST TARGET PROTEIN through VGAM3 HOST TARGET PROTEIN, all of FIG. 1.

VGAM226 RNA, herein schematically represented by VGAM1 RNA through VGAM3 RNA, binds complementarily to a host target binding site located in an untranslated region of VGAM226 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM226 host target RNA into VGAM226 host target protein, herein schematically represented by VGAM1 HOST TARGET PROTEIN through VGAM3 HOST TARGET PROTEIN, all of FIG. 1.

VGAM227 RNA, herein schematically represented by VGAM1 RNA through VGAM3 RNA, binds complementarily to a host target binding site located in an untranslated region of VGAM227 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM227 host target RNA into VGAM227 host target protein, herein schematically represented by VGAM1 HOST TARGET PROTEIN through VGAM3 HOST TARGET PROTEIN, all of FIG. 1.

It is appreciated that a function of VGR2771 gene, herein designated VGR GENE, is inhibition of expression of host target genes, as part of a novel viral mechanism of attacking a host. Accordingly, utilities of VGR2771 gene include diagnosis, prevention and treatment of viral infection by Callitrichine Herpesvirus 3. Specific functions, and accordingly utilities, of VGR2771 gene correlate with, and may be deduced from, the identity of the host target genes, which are inhibited by VGAM RNAs comprised in the 'operon-like' cluster of VGR2771 gene: VGAM220 host target protein, VGAM221 host target protein, VGAM222 host target protein, VGAM223 host target protein, VGAM224 host target protein, VGAM225 host target protein, VGAM226 host target protein and VGAM227 host target protein, herein schematically represented by VGAM1 HOST TARGET PROTEIN through VGAM3 HOST TARGET PROTEIN. The function of these host target genes is elaborated hereinabove with reference to VGAM220, VGAM221, VGAM222, VGAM223, VGAM224, VGAM225, VGAM226 and VGAM227. FIG. 9 further provides a conceptual description of novel bioinformatically detected regulatory viral gene, referred to here as Viral Genomic Record 2772(VGR2772) viral gene, which encodes an 'operon-like' cluster of novel viral micro RNA-like genes, each of which in turn modulates expression of at least one host target gene, the function and utility of which at least one host target gene is known in the art.

VGR2772 gene, herein designated VGR GENE, is a novel bioinformatically detected regulatory, non protein coding, RNA viral gene. The method by which VGR2772 gene was detected is described hereinabove with reference to FIGS. 1-9.

VGR2772 gene encodes VGR2772 precursor RNA, herein designated VGR PRECURSOR RNA, an RNA molecule, typically several hundred nucleotides long.

VGR2772 precursor RNA folds spatially, forming VGR2772 folded precursor RNA, herein designated VGR FOLDED PRECURSOR RNA. It is appreciated that VGR2772 folded precursor RNA comprises a plurality of what is known in the art as 'hairpin' structures. These 'hairpin' structures are due to the fact that the nucleotide sequence of VGR2772 precursor RNA comprises a plurality of segments, the first half of each such segment having a nucleotide sequence which is at least a partial inversed-reversed sequence of the second half thereof, as is well known in the art.

VGR2772 folded precursor RNA is naturally processed by cellular enzymatic activity into at least 8 separate VGAM precursor RNAs, VGAM228 precursor RNA, VGAM229 precursor RNA, VGAM230 precursor RNA, VGAM231 precursor RNA, VGAM232 precursor RNA, VGAM233 precursor RNA, VGAM234 precursor RNA and VGAM235 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM228 RNA, VGAM229 RNA, VGAM230 RNA, VGAM231 RNA, VGAM232 RNA, VGAM233 RNA, VGAM234 RNA and VGAM235 RNA, herein schematically represented by VGAM1 RNA through VGAM3 RNA, each of which VGAM RNAs corresponding to VGAM RNA of FIG. 1.

VGAM228 RNA, herein schematically represented by VGAM1 RNA through VGAM3 RNA, binds complementarily to a host target binding site located in an untranslated region of VGAM228 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM228 host target RNA into VGAM228 host target protein, herein schematically represented by VGAM1 HOST TARGET PROTEIN through VGAM3 HOST TARGET PROTEIN, all of FIG. 1.

VGAM229 RNA, herein schematically represented by VGAM1 RNA through VGAM3 RNA, binds complementarily to a host target binding site located in an untranslated region of VGAM229 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM229 host target RNA into VGAM229 host target protein, herein schematically represented by VGAM1 HOST TARGET PROTEIN through VGAM3 HOST TARGET PROTEIN, all of FIG. 1.

VGAM230 RNA, herein schematically represented by VGAM1 RNA through VGAM3 RNA, binds complementarily to a host target binding site located in an untranslated region of VGAM230 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM230 host target RNA into VGAM230 host target protein, herein schematically represented by VGAM1 HOST TARGET PROTEIN through VGAM3 HOST TARGET PROTEIN, all of FIG. 1.

VGAM231 RNA, herein schematically represented by VGAM1 RNA through VGAM3 RNA, binds complementarily to a host target binding site located in an untranslated region of VGAM231 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM231 host target RNA into VGAM231 host target protein, herein schematically represented by VGAM1 HOST TARGET PROTEIN through VGAM3 HOST TARGET PROTEIN, all of FIG. 1.

VGAM232 RNA, herein schematically represented by VGAM1 RNA through VGAM3 RNA, binds complementarily to a host target binding site located in an untranslated region of VGAM232 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM232 host target RNA into VGAM232 host target protein, herein schematically represented by VGAM1 HOST TARGET PROTEIN through VGAM3 HOST TARGET PROTEIN, all of FIG. 1.

VGAM233 RNA, herein schematically represented by VGAM1 RNA through VGAM3 RNA, binds complementarily to a host target binding site located in an untranslated region of VGAM233 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM233 host target RNA into VGAM233 host target protein, herein schematically represented by VGAM1 HOST TARGET PROTEIN through VGAM3 HOST TARGET PROTEIN, all of FIG. 1.

VGAM234 RNA, herein schematically represented by VGAM1 RNA through VGAM3 RNA, binds complementarily to a host target binding site located in an untranslated region of VGAM234 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM234 host target RNA into VGAM234 host target protein, herein schematically represented by VGAM1 HOST TARGET PROTEIN through VGAM3 HOST TARGET PROTEIN, all of FIG. 1.

VGAM235 RNA, herein schematically represented by VGAM1 RNA through VGAM3 RNA, binds complementarily to a host target binding site located in an untranslated region of VGAM235 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM235 host target RNA into VGAM235 host target protein, herein schematically represented by VGAM1 HOST TARGET PROTEIN through VGAM3 HOST TARGET PROTEIN, all of FIG. 1.

It is appreciated that a function of VGR2772 gene, herein designated VGR GENE, is inhibition of expression of host target genes, as part of a novel viral mechanism of attacking a host. Accordingly, utilities of VGR2772 gene include diagnosis, prevention and treatment of viral infection by Callitrichine Herpesvirus 3. Specific functions, and accordingly utilities, of VGR2772 gene correlate with, and may be deduced from, the identity of the host target genes, which are inhibited by VGAM RNAs comprised in the 'operon-like' cluster of VGR2772 gene: VGAM228 host target protein, VGAM229 host target protein, VGAM230 host target protein, VGAM231 host target protein, VGAM232 host target protein, VGAM233 host target protein, VGAM234 host target protein and VGAM235 host target protein, herein schematically represented by VGAM1 HOST TARGET PROTEIN through VGAM3 HOST TARGET PROTEIN. The function of these host target genes is elaborated hereinabove with reference to VGAM228, VGAM229, VGAM230, VGAM231, VGAM232, VGAM233, VGAM234 and VGAM235. FIG. 9 further provides a conceptual description of novel bioinformatically detected regulatory viral gene, referred to here as Viral Genomic Record 2773(VGR2773) viral gene, which encodes an 'operon-like' cluster of novel viral micro RNA-like genes, each of which in turn modulates expression of at least one host target gene, the function and utility of which at least one host target gene is known in the art.

VGR2773 gene, herein designated VGR GENE, is a novel bioinformatically detected regulatory, non protein coding, RNA viral gene. The method by which VGR2773 gene was detected is described hereinabove with reference to FIGS. 1-9.

VGR2773 gene encodes VGR2773 precursor RNA, herein designated VGR PRECURSOR RNA, an RNA molecule, typically several hundred nucleotides long.

VGR2773 precursor RNA folds spatially, forming VGR2773 folded precursor RNA, herein designated VGR FOLDED PRECURSOR RNA. It is appreciated that VGR2773 folded precursor RNA comprises a plurality of what is known in the art as 'hairpin' structures. These 'hairpin' structures are due to the fact that the nucleotide sequence of VGR2773 precursor RNA comprises a plurality of segments, the first half of each such segment having a nucleotide sequence which is at least a partial inversed-reversed sequence of the second half thereof, as is well known in the art.

VGR2773 folded precursor RNA is naturally processed by cellular enzymatic activity into at least 8 separate VGAM precursor RNAs, VGAM236 precursor RNA, VGAM237 precursor RNA, VGAM238 precursor RNA, VGAM239 precursor RNA, VGAM240 precursor RNA, VGAM241 precursor RNA, VGAM242 precursor RNA and VGAM243 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM236 RNA, VGAM237 RNA, VGAM238 RNA, VGAM239 RNA, VGAM240 RNA, VGAM241 RNA, VGAM242 RNA and VGAM243 RNA, herein schematically represented by VGAM1 RNA through VGAM3 RNA, each of which VGAM RNAs corresponding to VGAM RNA of FIG. 1.

VGAM236 RNA, herein schematically represented by VGAM1 RNA through VGAM3 RNA, binds complementarily to a host target binding site located in an untranslated region of VGAM236 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM236 host target RNA into VGAM236 host target protein, herein schematically represented by VGAM1 HOST TARGET PROTEIN through VGAM3 HOST TARGET PROTEIN, all of FIG. 1.

VGAM237 RNA, herein schematically represented by VGAM1 RNA through VGAM3 RNA, binds complementarily to a host target binding site located in an untranslated region of VGAM237 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM237 host target RNA into VGAM237 host target protein, herein schematically represented by VGAM1 HOST TARGET PROTEIN through VGAM3 HOST TARGET PROTEIN, all of FIG. 1.

VGAM238 RNA, herein schematically represented by VGAM1 RNA through VGAM3 RNA, binds complementarily to a host target binding site located in an untranslated region of VGAM238 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM238 host target RNA into VGAM238 host target protein, herein schematically represented by VGAM1 HOST TARGET PROTEIN through VGAM3 HOST TARGET PROTEIN, all of FIG. 1.

VGAM239 RNA, herein schematically represented by VGAM1 RNA through VGAM3 RNA, binds complementarily to a host target binding site located in an untranslated region of VGAM239 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM239 host target RNA into VGAM239 host target protein, herein schematically represented by VGAM1 HOST TARGET PROTEIN through VGAM3 HOST TARGET PROTEIN, all of FIG. 1.

VGAM240 RNA, herein schematically represented by VGAM1 RNA through VGAM3 RNA, binds complementarily to a host target binding site located in an untranslated region of VGAM240 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM240 host target RNA into VGAM240 host target protein, herein schematically represented by VGAM1 HOST TARGET PROTEIN through VGAM3 HOST TARGET PROTEIN, all of FIG. 1.

VGAM241 RNA, herein schematically represented by VGAM1 RNA through VGAM3 RNA, binds complementarily to a host target binding site located in an untranslated region of VGAM241 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM241 host target RNA into VGAM241 host target protein, herein schematically represented by VGAM1 HOST TARGET PROTEIN through VGAM3 HOST TARGET PROTEIN, all of FIG. 1.

VGAM242 RNA, herein schematically represented by VGAM1 RNA through VGAM3 RNA, binds complementarily to a host target binding site located in an untranslated region of VGAM242 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM242 host target RNA into VGAM242 host target protein, herein schematically represented by VGAM1 HOST TARGET PROTEIN through VGAM3 HOST TARGET PROTEIN, all of FIG. 1.

VGAM243 RNA, herein schematically represented by VGAM1 RNA through VGAM3 RNA, binds complementarily to a host target binding site located in an untranslated region of VGAM243 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM243 host target RNA into VGAM243 host target protein, herein schematically represented by VGAM1 HOST TARGET PROTEIN through VGAM3 HOST TARGET PROTEIN, all of FIG. 1.

It is appreciated that a function of VGR2773 gene, herein designated VGR GENE, is inhibition of expression of host target genes, as part of a novel viral mechanism of attacking a host. Accordingly, utilities of VGR2773 gene include diagnosis, prevention and treatment of viral infection by Callitrichine Herpesvirus 3. Specific functions, and accordingly utilities, of VGR2773 gene correlate with, and may be deduced from, the identity of the host target genes, which are inhibited by VGAM RNAs comprised in the 'operon-like' cluster of VGR2773 gene: VGAM236 host target protein, VGAM237 host target protein, VGAM238 host target protein, VGAM239 host target protein, VGAM240 host target protein, VGAM241 host target protein, VGAM242 host target protein and VGAM243 host target protein, herein schematically represented by VGAM1 HOST TARGET PROTEIN through VGAM3 HOST TARGET PROTEIN. The function of these host target genes is elaborated hereinabove with reference to VGAM236, VGAM237, VGAM238, VGAM239, VGAM240, VGAM241, VGAM242 and VGAM243. FIG. 9 further provides a conceptual description of novel bioinformatically detected regulatory viral gene, referred to here as Viral Genomic Record 2774(VGR2774) viral gene, which encodes an 'operon-like' cluster of novel viral micro RNA-like genes, each of which in turn modulates expression of at least one host target gene, the function and utility of which at least one host target gene is known in the art.

VGR2774 gene, herein designated VGR GENE, is a novel bioinformatically detected regulatory, non protein coding, RNA viral gene. The method by which VGR2774 gene was detected is described hereinabove with reference to FIGS. 1-9.

VGR2774 gene encodes VGR2774 precursor RNA, herein designated VGR PRECURSOR RNA, an RNA molecule, typically several hundred nucleotides long.

VGR2774 precursor RNA folds spatially, forming VGR2774 folded precursor RNA, herein designated VGR FOLDED PRECURSOR RNA. It is appreciated that VGR2774 folded precursor RNA comprises a plurality of what is known in the art as 'hairpin' structures. These 'hairpin' structures are due to the fact that the nucleotide sequence of VGR2774 precursor RNA comprises a plurality of segments, the first half of each such segment having a nucleotide sequence which is at least a partial inversed-reversed sequence of the second half thereof, as is well known in the art.

VGR2774 folded precursor RNA is naturally processed by cellular enzymatic activity into at least 8 separate VGAM precursor RNAs, VGAM244 precursor RNA, VGAM245 precursor RNA, VGAM246 precursor RNA, VGAM247 precursor RNA, VGAM248 precursor RNA, VGAM249 precursor RNA, VGAM250 precursor RNA and VGAM251 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM244 RNA, VGAM245 RNA, VGAM246 RNA, VGAM247 RNA, VGAM248 RNA, VGAM249 RNA, VGAM250 RNA and VGAM251 RNA, herein schematically represented by VGAM1 RNA through VGAM3 RNA, each of which VGAM RNAs corresponding to VGAM RNA of FIG. 1.

VGAM244 RNA, herein schematically represented by VGAM1 RNA through VGAM3 RNA, binds complementarily to a host target binding site located in an untranslated region of VGAM244 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM244 host target RNA into VGAM244 host target protein, herein schematically represented by VGAM1 HOST TARGET PROTEIN through VGAM3 HOST TARGET PROTEIN, all of FIG. 1.

VGAM245 RNA, herein schematically represented by VGAM1 RNA through VGAM3 RNA, binds complementarily to a host target binding site located in an untranslated region of VGAM245 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM245 host target RNA into VGAM245 host target protein, herein schematically represented by VGAM1 HOST TARGET PROTEIN through VGAM3 HOST TARGET PROTEIN, all of FIG. 1.

VGAM246 RNA, herein schematically represented by VGAM1 RNA through VGAM3 RNA, binds complementarily to a host target binding site located in an untranslated region of VGAM246 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM246 host target RNA into VGAM246 host target protein, herein schematically represented by VGAM1 HOST TARGET PROTEIN through VGAM3 HOST TARGET PROTEIN, all of FIG. 1.

VGAM247 RNA, herein schematically represented by VGAM1 RNA through VGAM3 RNA, binds complementarily to a host target binding site located in an untranslated region of VGAM247 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM247 host target RNA into VGAM247 host target protein, herein schematically represented by VGAM1 HOST TARGET PROTEIN through VGAM3 HOST TARGET PROTEIN, all of FIG. 1.

VGAM248 RNA, herein schematically represented by VGAM1 RNA through VGAM3 RNA, binds complementarily to a host target binding site located in an untranslated region of VGAM248 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM248 host target RNA into VGAM248 host target protein, herein schematically represented by VGAM1 HOST TARGET PROTEIN through VGAM3 HOST TARGET PROTEIN, all of FIG. 1.

VGAM249 RNA, herein schematically represented by VGAM1 RNA through VGAM3 RNA, binds complementarily to a host target binding site located in an untranslated region of VGAM249 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM249 host target RNA into VGAM249 host target protein, herein schematically represented by VGAM1 HOST TARGET PROTEIN through VGAM3 HOST TARGET PROTEIN, all of FIG. 1.

VGAM250 RNA, herein schematically represented by VGAM1 RNA through VGAM3 RNA, binds complementarily to a host target binding site located in an untranslated region of VGAM250 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM250 host target RNA into VGAM250 host target protein, herein schematically represented by VGAM1 HOST TARGET PROTEIN through VGAM3 HOST TARGET PROTEIN, all of FIG. 1.

VGAM251 RNA, herein schematically represented by VGAM1 RNA through VGAM3 RNA, binds complementarily to a host target binding site located in an untranslated region of VGAM251 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM251 host target RNA into VGAM251 host target protein, herein schematically represented by VGAM1 HOST TARGET PROTEIN through VGAM3 HOST TARGET PROTEIN, all of FIG. 1.

It is appreciated that a function of VGR2774 gene, herein designated VGR GENE, is inhibition of expression of host target genes, as part of a novel viral mechanism of attacking a host. Accordingly, utilities of VGR2774 gene include diagnosis, prevention and treatment of viral infection by Callitrichine Herpesvirus 3. Specific functions, and accordingly utilities, of VGR2774 gene correlate with, and may be deduced from, the identity of the host target genes, which are inhibited by VGAM RNAs comprised in the 'operon-like' cluster of VGR2774 gene: VGAM244 host target protein, VGAM245 host target protein, VGAM246 host target protein, VGAM247 host target protein, VGAM248 host target protein, VGAM249 host target protein, VGAM250 host target protein and VGAM251 host target protein, herein schematically represented by VGAM1 HOST TARGET PROTEIN through VGAM3 HOST TARGET PROTEIN. The function of these host target genes is elaborated hereinabove with reference to VGAM244, VGAM245, VGAM246, VGAM247, VGAM248, VGAM249, VGAM250 and VGAM251. FIG. 9 further provides a conceptual description of novel bioinformatically detected regulatory viral gene, referred to here as Viral Genomic Record 2775(VGR2775) viral gene, which encodes an 'operon-like' cluster of novel viral micro RNA-like genes, each of which in turn modulates expression of at least one host target gene, the function and utility of which at least one host target gene is known in the art.

VGR2775 gene, herein designated VGR GENE, is a novel bioinformatically detected regulatory, non protein coding, RNA viral gene. The method by which VGR2775 gene was detected is described hereinabove with reference to FIGS. 1-9.

VGR2775 gene encodes VGR2775 precursor RNA, herein designated VGR PRECURSOR RNA, an RNA molecule, typically several hundred nucleotides long.

VGR2775 precursor RNA folds spatially, forming VGR2775 folded precursor RNA, herein designated VGR FOLDED PRECURSOR RNA. It is appreciated that VGR2775 folded precursor RNA comprises a plurality of what is known in the art as 'hairpin' structures. These 'hairpin' structures are due to the fact that the nucleotide sequence of VGR2775 precursor RNA comprises a plurality of segments, the first half of each such segment having a nucleotide sequence which is at least a partial inversed-reversed sequence of the second half thereof, as is well known in the art.

VGR2775 folded precursor RNA is naturally processed by cellular enzymatic activity into at least 8 separate VGAM precursor RNAs, VGAM252 precursor RNA, VGAM253 precursor RNA, VGAM254 precursor RNA, VGAM255 precursor RNA, VGAM256 precursor RNA, VGAM257 precursor RNA, VGAM258 precursor RNA and VGAM259 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM252 RNA, VGAM253 RNA, VGAM254 RNA, VGAM255 RNA, VGAM256 RNA, VGAM257 RNA, VGAM258 RNA and VGAM259 RNA, herein schematically represented by VGAM1 RNA through VGAM3 RNA, each of which VGAM RNAs corresponding to VGAM RNA of FIG. 1.

VGAM252 RNA, herein schematically represented by VGAM1 RNA through VGAM3 RNA, binds complementarily to a host target binding site located in an untranslated region of VGAM252 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM252 host target RNA into VGAM252 host target protein, herein schematically represented by VGAM1 HOST TARGET PROTEIN through VGAM3 HOST TARGET PROTEIN, all of FIG. 1.

VGAM253 RNA, herein schematically represented by VGAM1 RNA through VGAM3 RNA, binds complementarily to a host target binding site located in an untranslated region of VGAM253 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM253 host target RNA into VGAM253 host target protein, herein schematically represented by VGAM1 HOST TARGET PROTEIN through VGAM3 HOST TARGET PROTEIN, all of FIG. 1.

VGAM254 RNA, herein schematically represented by VGAM1 RNA through VGAM3 RNA, binds complementarily to a host target binding site located in an untranslated region of VGAM254 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM254 host target RNA into VGAM254 host target protein, herein schematically represented by VGAM1 HOST TARGET PROTEIN through VGAM3 HOST TARGET PROTEIN, all of FIG. 1.

VGAM255 RNA, herein schematically represented by VGAM1 RNA through VGAM3 RNA, binds complementarily to a host target binding site located in an untranslated region of VGAM255 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM255 host target RNA into VGAM255 host target protein, herein schematically represented by VGAM1 HOST TARGET PROTEIN through VGAM3 HOST TARGET PROTEIN, all of FIG. 1.

VGAM256 RNA, herein schematically represented by VGAM1 RNA through VGAM3 RNA, binds complementarily to a host target binding site located in an untranslated region of VGAM256 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM256 host target RNA into VGAM256 host target protein, herein schematically represented by VGAM1 HOST TARGET PROTEIN through VGAM3 HOST TARGET PROTEIN, all of FIG. 1.

VGAM257 RNA, herein schematically represented by VGAM1 RNA through VGAM3 RNA, binds complementarily to a host target binding site located in an untranslated region of VGAM257 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM257 host target RNA into VGAM257 host target protein, herein schematically represented by VGAM1 HOST TARGET PROTEIN through VGAM3 HOST TARGET PROTEIN, all of FIG. 1.

VGAM258 RNA, herein schematically represented by VGAM1 RNA through VGAM3 RNA, binds complementarily to a host target binding site located in an untranslated region of VGAM258 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM258 host target RNA into VGAM258 host target protein, herein schematically represented by VGAM1 HOST TARGET PROTEIN through VGAM3 HOST TARGET PROTEIN, all of FIG. 1.

VGAM259 RNA, herein schematically represented by VGAM1 RNA through VGAM3 RNA, binds complementarily to a host target binding site located in an untranslated region of VGAM259 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM259 host target RNA into VGAM259 host target protein, herein schematically represented by VGAM1 HOST TARGET PROTEIN through VGAM3 HOST TARGET PROTEIN, all of FIG. 1.

It is appreciated that a function of VGR2775 gene, herein designated VGR GENE, is inhibition of expression of host target genes, as part of a novel viral mechanism of attacking a host. Accordingly, utilities of VGR2775 gene include diagnosis, prevention and treatment of viral infection by Callitrichine Herpesvirus 3. Specific functions, and accordingly utilities, of VGR2775 gene correlate with, and may be deduced from, the identity of the host target genes, which are inhibited by VGAM RNAs comprised in the 'operon-like' cluster of VGR2775 gene: VGAM252 host target protein, VGAM253 host target protein, VGAM254 host target protein, VGAM255 host target protein, VGAM256 host target protein, VGAM257 host target protein, VGAM258 host target protein and VGAM259 host target protein, herein schematically represented by VGAM1 HOST TARGET PROTEIN through VGAM3 HOST TARGET PROTEIN. The function of these host target genes is elaborated hereinabove with reference to VGAM252, VGAM253, VGAM254, VGAM255, VGAM256, VGAM257, VGAM258 and VGAM259. FIG. 9 further provides a conceptual description of novel bioinformatically detected regulatory viral gene, referred to here as Viral Genomic Record 2776(VGR2776) viral gene, which encodes an 'operon-like' cluster of novel viral micro RNA-like genes, each of which in turn modulates expression of at least one host target gene, the function and utility of which at least one host target gene is known in the art.

VGR2776 gene, herein designated VGR GENE, is a novel bioinformatically detected regulatory, non protein coding, RNA viral gene. The method by which VGR2776 gene was detected is described hereinabove with reference to FIGS. 1-9.

VGR2776 gene encodes VGR2776 precursor RNA, herein designated VGR PRECURSOR RNA, an RNA molecule, typically several hundred nucleotides long.

VGR2776 precursor RNA folds spatially, forming VGR2776 folded precursor RNA, herein designated VGR FOLDED PRECURSOR RNA. It is appreciated that VGR2776 folded precursor RNA comprises a plurality of what is known in the art as 'hairpin' structures. These 'hairpin' structures are due to the fact that the nucleotide sequence of VGR2776 precursor RNA comprises a plurality of segments, the first half of each such segment having a nucleotide sequence which is at least a partial inversed-reversed sequence of the second half thereof, as is well known in the art.

VGR2776 folded precursor RNA is naturally processed by cellular enzymatic activity into at least 6 separate VGAM precursor RNAs, VGAM260 precursor RNA, VGAM261 precursor RNA, VGAM262 precursor RNA, VGAM263 precursor RNA, VGAM264 precursor RNA and VGAM265 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM260 RNA, VGAM261 RNA, VGAM262 RNA, VGAM263 RNA, VGAM264 RNA and VGAM265 RNA, herein schematically represented by VGAM1 RNA through VGAM3 RNA, each of which VGAM RNAs corresponding to VGAM RNA of FIG. 1.

VGAM260 RNA, herein schematically represented by VGAM1 RNA through VGAM3 RNA, binds complementarily to a host target binding site located in an untranslated region of VGAM260 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM260 host target RNA into VGAM260 host target protein, herein schematically represented by VGAM1 HOST TARGET PROTEIN through VGAM3 HOST TARGET PROTEIN, all of FIG. 1.

VGAM261 RNA, herein schematically represented by VGAM1 RNA through VGAM3 RNA, binds complementarily to a host target binding site located in an untranslated region of VGAM261 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM261 host target RNA into VGAM261 host target protein, herein schematically represented by VGAM1 HOST TARGET PROTEIN through VGAM3 HOST TARGET PROTEIN, all of FIG. 1.

VGAM262 RNA, herein schematically represented by VGAM1 RNA through VGAM3 RNA, binds complementarily to a host target binding site located in an untranslated region of VGAM262 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM262 host target RNA into VGAM262 host target protein, herein schematically represented by VGAM1 HOST TARGET PROTEIN through VGAM3 HOST TARGET PROTEIN, all of FIG. 1.

VGAM263 RNA, herein schematically represented by VGAM1 RNA through VGAM3 RNA, binds complementarily to a host target binding site located in an untranslated region of VGAM263 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM263 host target RNA into VGAM263 host target protein, herein schematically represented by VGAM1 HOST TARGET PROTEIN through VGAM3 HOST TARGET PROTEIN, all of FIG. 1.

VGAM264 RNA, herein schematically represented by VGAM1 RNA through VGAM3 RNA, binds complementarily to a host target binding site located in an untranslated region of VGAM264 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM264 host target RNA into VGAM264 host target protein, herein schematically represented by VGAM1 HOST TARGET PROTEIN through VGAM3 HOST TARGET PROTEIN, all of FIG. 1.

VGAM265 RNA, herein schematically represented by VGAM1 RNA through VGAM3 RNA, binds complementarily to a host target binding site located in an untranslated region of VGAM265 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM265 host target RNA into VGAM265 host target protein, herein schematically represented by VGAM1 HOST TARGET PROTEIN through VGAM3 HOST TARGET PROTEIN, all of FIG. 1.

It is appreciated that a function of VGR2776 gene, herein designated VGR GENE, is inhibition of expression of host target genes, as part of a novel viral mechanism of attacking a host. Accordingly, utilities of VGR2776 gene include diagnosis, prevention and treatment of viral infection by Callitrichine Herpesvirus 3. Specific functions, and accordingly utilities, of VGR2776 gene correlate with, and may be deduced from, the identity of the host target genes, which are inhibited by VGAM RNAs comprised in the 'operon-like' cluster of VGR2776 gene: VGAM260 host target protein, VGAM261 host target protein, VGAM262 host target protein, VGAM263 host target protein, VGAM264 host target protein and VGAM265 host target protein, herein schematically represented by VGAM1 HOST TARGET PROTEIN through VGAM3 HOST TARGET PROTEIN. The function of these host target genes is elaborated hereinabove with reference to VGAM260, VGAM261, VGAM262, VGAM263, VGAM264 and VGAM265. FIG. 9 further provides a conceptual description of novel bioinformatically detected regulatory viral gene, referred to here as Viral Genomic Record 2777(VGR2777) viral gene, which encodes an 'operon-like' cluster of novel viral micro RNA-like genes, each of which in turn modulates expression of at least one host target gene, the function and utility of which at least one host target gene is known in the art.

VGR2777 gene, herein designated VGR GENE, is a novel bioinformatically detected regulatory, non protein coding, RNA viral gene. The method by which VGR2777 gene was detected is described hereinabove with reference to FIGS. 1-9.

VGR2777 gene encodes VGR2777 precursor RNA, herein designated VGR PRECURSOR RNA, an RNA molecule, typically several hundred nucleotides long.

VGR2777 precursor RNA folds spatially, forming VGR2777 folded precursor RNA, herein designated VGR FOLDED PRECURSOR RNA. It is appreciated that VGR2777 folded precursor RNA comprises a plurality of what is known in the art as 'hairpin' structures. These 'hairpin' structures are due to the fact that the nucleotide sequence of VGR2777 precursor RNA comprises a plurality of segments, the first half of each such segment having a nucleotide sequence which is at least a partial inversed-reversed sequence of the second half thereof, as is well known in the art.

VGR2777 folded precursor RNA is naturally processed by cellular enzymatic activity into at least 8 separate VGAM precursor RNAs, VGAM266 precursor RNA, VGAM267 precursor RNA, VGAM268 precursor RNA, VGAM269 precursor RNA, VGAM270 precursor RNA, VGAM271 precursor RNA, VGAM272 precursor RNA and VGAM273 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM266 RNA, VGAM267 RNA, VGAM268 RNA, VGAM269 RNA, VGAM270 RNA, VGAM271 RNA, VGAM272 RNA and VGAM273 RNA, herein schematically represented by VGAM1 RNA through VGAM3 RNA, each of which VGAM RNAs corresponding to VGAM RNA of FIG. 1.

VGAM266 RNA, herein schematically represented by VGAM1 RNA through VGAM3 RNA, binds complementarily to a host target binding site located in an untranslated region of VGAM266 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM266 host target RNA into VGAM266 host target protein, herein schematically represented by VGAM1 HOST TARGET PROTEIN through VGAM3 HOST TARGET PROTEIN, all of FIG. 1.

VGAM267 RNA, herein schematically represented by VGAM1 RNA through VGAM3 RNA, binds complementarily to a host target binding site located in an untranslated region of VGAM267 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM267 host target RNA into VGAM267 host target protein, herein schematically represented by VGAM1 HOST TARGET PROTEIN through VGAM3 HOST TARGET PROTEIN, all of FIG. 1.

VGAM268 RNA, herein schematically represented by VGAM1 RNA through VGAM3 RNA, binds complementarily to a host target binding site located in an untranslated region of VGAM268 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM268 host target RNA into VGAM268 host target protein, herein schematically represented by VGAM1 HOST TARGET PROTEIN through VGAM3 HOST TARGET PROTEIN, all of FIG. 1.

VGAM269 RNA, herein schematically represented by VGAM1 RNA through VGAM3 RNA, binds complementarily to a host target binding site located in an untranslated region of VGAM269 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM269 host target RNA into VGAM269 host target protein, herein schematically represented by VGAM1 HOST TARGET PROTEIN through VGAM3 HOST TARGET PROTEIN, all of FIG. 1.

VGAM270 RNA, herein schematically represented by VGAM1 RNA through VGAM3 RNA, binds complementarily to a host target binding site located in an untranslated region of VGAM270 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM270 host target RNA into VGAM270 host target protein, herein schematically represented by VGAM1 HOST TARGET PROTEIN through VGAM3 HOST TARGET PROTEIN, all of FIG. 1.

VGAM271 RNA, herein schematically represented by VGAM1 RNA through VGAM3 RNA, binds complementarily to a host target binding site located in an untranslated region of VGAM271 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM271 host target RNA into VGAM271 host target protein, herein schematically represented by VGAM1 HOST TARGET PROTEIN through VGAM3 HOST TARGET PROTEIN, all of FIG. 1.

VGAM272 RNA, herein schematically represented by VGAM1 RNA through VGAM3 RNA, binds complementarily to a host target binding site located in an untranslated region of VGAM272 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM272 host target RNA into VGAM272 host target protein, herein schematically represented by VGAM1 HOST TARGET PROTEIN through VGAM3 HOST TARGET PROTEIN, all of FIG. 1.

VGAM273 RNA, herein schematically represented by VGAM1 RNA through VGAM3 RNA, binds complementarily to a host target binding site located in an untranslated region of VGAM273 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM273 host target RNA into VGAM273 host target protein, herein schematically represented by VGAM1 HOST TARGET PROTEIN through VGAM3 HOST TARGET PROTEIN, all of FIG. 1.

It is appreciated that a function of VGR2777 gene, herein designated VGR GENE, is inhibition of expression of host target genes, as part of a novel viral mechanism of attacking a host. Accordingly, utilities of VGR2777 gene include diagnosis, prevention and treatment of viral infection by Epiphyas Postvittana Nucleopolyhedrovirus. Specific functions, and accordingly utilities, of VGR2777 gene correlate with, and may be deduced from, the identity of the host target genes, which are inhibited by VGAM RNAs comprised in the 'operon-like' cluster of VGR2777 gene: VGAM266 host target protein, VGAM267 host target protein, VGAM268 host target protein, VGAM269 host target protein, VGAM270 host target protein, VGAM271 host target protein, VGAM272 host target protein and VGAM273 host target protein, herein schematically represented by VGAM1 HOST TARGET PROTEIN through VGAM3 HOST TARGET PROTEIN. The function of these host target genes is elaborated hereinabove with reference to VGAM266, VGAM267, VGAM268, VGAM269, VGAM270, VGAM271, VGAM272 and VGAM273. FIG. 9 further provides a conceptual description of novel bioinformatically detected regulatory viral gene, referred to here as Viral Genomic Record 2778(VGR2778) viral gene, which encodes an 'operon-like' cluster of novel viral micro RNA-like genes, each of which in turn modulates expression of at least one host target gene, the function and utility of which at least one host target gene is known in the art.

VGR2778 gene, herein designated VGR GENE, is a novel bioinformatically detected regulatory, non protein coding, RNA viral gene. The method by which VGR2778 gene was detected is described hereinabove with reference to FIGS. 1-9.

VGR2778 gene encodes VGR2778 precursor RNA, herein designated VGR PRECURSOR RNA, an RNA molecule, typically several hundred nucleotides long.

VGR2778 precursor RNA folds spatially, forming VGR2778 folded precursor RNA, herein designated VGR FOLDED PRECURSOR RNA. It is appreciated that VGR2778 folded precursor RNA comprises a plurality of what is known in the art as 'hairpin' structures. These 'hairpin' structures are due to the fact that the nucleotide sequence of VGR2778 precursor RNA comprises a plurality of segments, the first half of each such segment having a nucleotide sequence which is at least a partial inversed-reversed sequence of the second half thereof, as is well known in the art.

VGR2778 folded precursor RNA is naturally processed by cellular enzymatic activity into at least 8 separate VGAM precursor RNAs, VGAM274 precursor RNA, VGAM275 precursor RNA, VGAM276 precursor RNA, VGAM277 precursor RNA, VGAM278 precursor RNA, VGAM279 precursor RNA, VGAM280 precursor RNA and VGAM281 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM274 RNA, VGAM275 RNA, VGAM276 RNA, VGAM277 RNA, VGAM278 RNA, VGAM279 RNA, VGAM280 RNA and VGAM281 RNA, herein schematically represented by VGAM1 RNA through VGAM3 RNA, each of which VGAM RNAs corresponding to VGAM RNA of FIG. 1.

VGAM274 RNA, herein schematically represented by VGAM1 RNA through VGAM3 RNA, binds complementarily to a host target binding site located in an untranslated region of VGAM274 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM274 host target RNA into VGAM274 host target protein, herein schematically represented by VGAM1 HOST TARGET PROTEIN through VGAM3 HOST TARGET PROTEIN, all of FIG. 1.

VGAM275 RNA, herein schematically represented by VGAM1 RNA through VGAM3 RNA, binds complementarily to a host target binding site located in an untranslated region of VGAM275 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM275 host target RNA into VGAM275 host target protein, herein schematically represented by VGAM1 HOST TARGET PROTEIN through VGAM3 HOST TARGET PROTEIN, all of FIG. 1.

VGAM276 RNA, herein schematically represented by VGAM1 RNA through VGAM3 RNA, binds complementarily to a host target binding site located in an untranslated region of VGAM276 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM276 host target RNA into VGAM276 host target protein, herein schematically represented by VGAM1 HOST TARGET PROTEIN through VGAM3 HOST TARGET PROTEIN, all of FIG. 1.

VGAM277 RNA, herein schematically represented by VGAM1 RNA through VGAM3 RNA, binds complementarily to a host target binding site located in an untranslated region of VGAM277 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM277 host target RNA into VGAM277 host target protein, herein schematically represented by VGAM1 HOST TARGET PROTEIN through VGAM3 HOST TARGET PROTEIN, all of FIG. 1.

VGAM278 RNA, herein schematically represented by VGAM1 RNA through VGAM3 RNA, binds complementarily to a host target binding site located in an untranslated region of VGAM278 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM278 host target RNA into VGAM278 host target protein, herein schematically represented by VGAM1 HOST TARGET PROTEIN through VGAM3 HOST TARGET PROTEIN, all of FIG. 1.

VGAM279 RNA, herein schematically represented by VGAM1 RNA through VGAM3 RNA, binds complementarily to a host target binding site located in an untranslated region of VGAM279 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM279 host target RNA into VGAM279 host target protein, herein schematically represented by VGAM1 HOST TARGET PROTEIN through VGAM3 HOST TARGET PROTEIN, all of FIG. 1.

VGAM280 RNA, herein schematically represented by VGAM1 RNA through VGAM3 RNA, binds complementarily to a host target binding site located in an untranslated region of VGAM280 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM280 host target RNA into VGAM280 host target protein, herein schematically represented by VGAM1 HOST TARGET PROTEIN through VGAM3 HOST TARGET PROTEIN, all of FIG. 1.

VGAM281 RNA, herein schematically represented by VGAM1 RNA through VGAM3 RNA, binds complementarily to a host target binding site located in an untranslated region of VGAM281 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM281 host target RNA into VGAM281 host target protein, herein schematically represented by VGAM1 HOST TARGET PROTEIN through VGAM3 HOST TARGET PROTEIN, all of FIG. 1.

It is appreciated that a function of VGR2778 gene, herein designated VGR GENE, is inhibition of expression of host target genes, as part of a novel viral mechanism of attacking a host. Accordingly, utilities of VGR2778 gene include diagnosis, prevention and treatment of viral infection by Epiphyas Postvittana Nucleopolyhedrovirus. Specific functions, and accordingly utilities, of VGR2778 gene correlate with, and may be deduced from, the identity of the host target genes, which are inhibited by VGAM RNAs comprised in the 'operon-like' cluster of VGR2778 gene: VGAM274 host target protein, VGAM275 host target protein, VGAM276 host target protein, VGAM277 host target protein, VGAM278 host target protein, VGAM279 host target protein, VGAM280 host target protein and VGAM281 host target protein, herein schematically represented by VGAM1 HOST TARGET PROTEIN through VGAM3 HOST TARGET PROTEIN. The function of these host target genes is elaborated hereinabove with reference to VGAM274, VGAM275, VGAM276, VGAM277, VGAM278, VGAM279, VGAM280 and VGAM281. FIG. 9 further provides a conceptual description of novel bioinformatically detected regulatory viral gene, referred to here as Viral Genomic Record 2779(VGR2779) viral gene, which encodes an 'operon-like' cluster of novel viral micro RNA-like genes, each of which in turn modulates expression of at least one host target gene, the function and utility of which at least one host target gene is known in the art.

VGR2779 gene, herein designated VGR GENE, is a novel bioinformatically detected regulatory, non protein coding, RNA viral gene. The method by which VGR2779 gene was detected is described hereinabove with reference to FIGS. 1-9.

VGR2779 gene encodes VGR2779 precursor RNA, herein designated VGR PRECURSOR RNA, an RNA molecule, typically several hundred nucleotides long.

VGR2779 precursor RNA folds spatially, forming VGR2779 folded precursor RNA, herein designated VGR FOLDED PRECURSOR RNA. It is appreciated that VGR2779 folded precursor RNA comprises a plurality of what is known in the art as 'hairpin' structures. These 'hairpin' structures are due to the fact that the nucleotide sequence of VGR2779 precursor RNA comprises a plurality of segments, the first half of each such segment having a nucleotide sequence which is at least a partial inversed-reversed sequence of the second half thereof, as is well known in the art.

VGR2779 folded precursor RNA is naturally processed by cellular enzymatic activity into at least 8 separate VGAM precursor RNAs, VGAM282 precursor RNA, VGAM283 precursor RNA, VGAM284 precursor RNA, VGAM285 precursor RNA, VGAM286 precursor RNA, VGAM287 precursor RNA, VGAM288 precursor RNA and VGAM289 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM282 RNA, VGAM283 RNA, VGAM284 RNA, VGAM285 RNA, VGAM286 RNA, VGAM287 RNA, VGAM288 RNA and VGAM289 RNA, herein schematically represented by VGAM1 RNA through VGAM3 RNA, each of which VGAM RNAs corresponding to VGAM RNA of FIG. 1.

VGAM282 RNA, herein schematically represented by VGAM1 RNA through VGAM3 RNA, binds complementarily to a host target binding site located in an untranslated region of VGAM282 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM282 host target RNA into VGAM282 host target protein, herein schematically represented by VGAM1 HOST TARGET PROTEIN through VGAM3 HOST TARGET PROTEIN, all of FIG. 1.

VGAM283 RNA, herein schematically represented by VGAM1 RNA through VGAM3 RNA, binds complementarily to a host target binding site located in an untranslated region of VGAM283 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM283 host target RNA into VGAM283 host target protein, herein schematically represented by VGAM1 HOST TARGET PROTEIN through VGAM3 HOST TARGET PROTEIN, all of FIG. 1.

VGAM284 RNA, herein schematically represented by VGAM1 RNA through VGAM3 RNA, binds complementarily to a host target binding site located in an untranslated region of VGAM284 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM284 host target RNA into VGAM284 host target protein, herein schematically represented by VGAM1 HOST TARGET PROTEIN through VGAM3 HOST TARGET PROTEIN, all of FIG. 1.

VGAM285 RNA, herein schematically represented by VGAM1 RNA through VGAM3 RNA, binds complementarily to a host target binding site located in an untranslated region of VGAM285 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM285 host target RNA into VGAM285 host target protein, herein schematically represented by VGAM1 HOST TARGET PROTEIN through VGAM3 HOST TARGET PROTEIN, all of FIG. 1.

VGAM286 RNA, herein schematically represented by VGAM1 RNA through VGAM3 RNA, binds complementarily to a host target binding site located in an untranslated region of VGAM286 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM286 host target RNA into VGAM286 host target protein, herein schematically represented by VGAM1 HOST TARGET PROTEIN through VGAM3 HOST TARGET PROTEIN, all of FIG. 1.

VGAM287 RNA, herein schematically represented by VGAM1 RNA through VGAM3 RNA, binds complementarily to a host target binding site located in an untranslated region of VGAM287 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM287 host target RNA into VGAM287 host target protein, herein schematically represented by VGAM1 HOST TARGET PROTEIN through VGAM3 HOST TARGET PROTEIN, all of FIG. 1.

VGAM288 RNA, herein schematically represented by VGAM1 RNA through VGAM3 RNA, binds complementarily to a host target binding site located in an untranslated region of VGAM288 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM288 host target RNA into VGAM288 host target protein, herein schematically represented by VGAM1 HOST TARGET PROTEIN through VGAM3 HOST TARGET PROTEIN, all of FIG. 1.

VGAM289 RNA, herein schematically represented by VGAM1 RNA through VGAM3 RNA, binds complementarily to a host target binding site located in an untranslated region of VGAM289 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM289 host target RNA into VGAM289 host target protein, herein schematically represented by VGAM1 HOST TARGET PROTEIN through VGAM3 HOST TARGET PROTEIN, all of FIG. 1.

It is appreciated that a function of VGR2779 gene, herein designated VGR GENE, is inhibition of expression of host target genes, as part of a novel viral mechanism of attacking a host. Accordingly, utilities of VGR2779 gene include diagnosis, prevention and treatment of viral infection by Epiphyas Postvittana Nucleopolyhedrovirus. Specific functions, and accordingly utilities, of VGR2779 gene correlate with, and may be deduced from, the identity of the host target genes, which are inhibited by VGAM RNAs comprised in the 'operon-like' cluster of VGR2779 gene: VGAM282 host target protein, VGAM283 host target protein, VGAM284 host target protein, VGAM285 host target protein, VGAM286 host target protein, VGAM287 host target protein, VGAM288 host target protein and VGAM289 host target protein, herein schematically represented by VGAM1 HOST TARGET PROTEIN through VGAM3 HOST TARGET PROTEIN. The function of these host target genes is elaborated hereinabove with reference to VGAM282, VGAM283, VGAM284, VGAM285, VGAM286, VGAM287, VGAM288 and VGAM289. FIG. 9 further provides a conceptual description of novel bioinformatically detected regulatory viral gene, referred to here as Viral Genomic Record 2780(VGR2780) viral gene, which encodes an 'operon-like' cluster of novel viral micro RNA-like genes, each of which in turn modulates expression of at least one host target gene, the function and utility of which at least one host target gene is known in the art.

VGR2780 gene, herein designated VGR GENE, is a novel bioinformatically detected regulatory, non protein coding, RNA viral gene. The method by which VGR2780 gene was detected is described hereinabove with reference to FIGS. 1-9.

VGR2780 gene encodes VGR2780 precursor RNA, herein designated VGR PRECURSOR RNA, an RNA molecule, typically several hundred nucleotides long.

VGR2780 precursor RNA folds spatially, forming VGR2780 folded precursor RNA, herein designated VGR FOLDED PRECURSOR RNA. It is appreciated that VGR2780 folded precursor RNA comprises a plurality of what is known in the art as 'hairpin' structures. These 'hairpin' structures are due to the fact that the nucleotide sequence of VGR2780 precursor RNA comprises a plurality of segments, the first half of each such segment having a nucleotide sequence which is at least a partial inversed-reversed sequence of the second half thereof, as is well known in the art.

VGR2780 folded precursor RNA is naturally processed by cellular enzymatic activity into at least 8 separate VGAM precursor RNAs, VGAM290 precursor RNA, VGAM291 precursor RNA, VGAM292 precursor RNA, VGAM293 precursor RNA, VGAM294 precursor RNA, VGAM295 precursor RNA, VGAM296 precursor RNA and VGAM297 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM290 RNA, VGAM291 RNA, VGAM292 RNA, VGAM293 RNA, VGAM294 RNA, VGAM295 RNA, VGAM296 RNA and VGAM297 RNA, herein schematically represented by VGAM1 RNA through VGAM3 RNA, each of which VGAM RNAs corresponding to VGAM RNA of FIG. 1.

VGAM290 RNA, herein schematically represented by VGAM1 RNA through VGAM3 RNA, binds complementarily to a host target binding site located in an untranslated region of VGAM290 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM290 host target RNA into VGAM290 host target protein, herein schematically represented by VGAM1 HOST TARGET PROTEIN through VGAM3 HOST TARGET PROTEIN, all of FIG. 1.

VGAM291 RNA, herein schematically represented by VGAM1 RNA through VGAM3 RNA, binds complementarily to a host target binding site located in an untranslated region of VGAM291 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM291 host target RNA into VGAM291 host target protein, herein schematically represented by VGAM1 HOST TARGET PROTEIN through VGAM3 HOST TARGET PROTEIN, all of FIG. 1.

VGAM292 RNA, herein schematically represented by VGAM1 RNA through VGAM3 RNA, binds complementarily to a host target binding site located in an untranslated region of VGAM292 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM292 host target RNA into VGAM292 host target protein, herein schematically represented by VGAM1 HOST TARGET PROTEIN through VGAM3 HOST TARGET PROTEIN, all of FIG. 1.

VGAM293 RNA, herein schematically represented by VGAM1 RNA through VGAM3 RNA, binds complementarily to a host target binding site located in an untranslated region of VGAM293 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM293 host target RNA into VGAM293 host target protein, herein schematically represented by VGAM1 HOST TARGET PROTEIN through VGAM3 HOST TARGET PROTEIN, all of FIG. 1.

VGAM294 RNA, herein schematically represented by VGAM1 RNA through VGAM3 RNA, binds complementarily to a host target binding site located in an untranslated region of VGAM294 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM294 host target RNA into VGAM294 host target protein, herein schematically represented by VGAM1 HOST TARGET PROTEIN through VGAM3 HOST TARGET PROTEIN, all of FIG. 1.

VGAM295 RNA, herein schematically represented by VGAM1 RNA through VGAM3 RNA, binds complementarily to a host target binding site located in an untranslated region of VGAM295 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM295 host target RNA into VGAM295 host target protein, herein schematically represented by VGAM1 HOST TARGET PROTEIN through VGAM3 HOST TARGET PROTEIN, all of FIG. 1.

VGAM296 RNA, herein schematically represented by VGAM1 RNA through VGAM3 RNA, binds complementarily to a host target binding site located in an untranslated region of VGAM296 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM296 host target RNA into VGAM296 host target protein, herein schematically represented by VGAM1 HOST TARGET PROTEIN through VGAM3 HOST TARGET PROTEIN, all of FIG. 1.

VGAM297 RNA, herein schematically represented by VGAM1 RNA through VGAM3 RNA, binds complementarily to a host target binding site located in an untranslated region of VGAM297 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM297 host target RNA into VGAM297 host target protein, herein schematically represented by VGAM1 HOST TARGET PROTEIN through VGAM3 HOST TARGET PROTEIN, all of FIG. 1.

It is appreciated that a function of VGR2780 gene, herein designated VGR GENE, is inhibition of expression of host target genes, as part of a novel viral mechanism of attacking a host. Accordingly, utilities of VGR2780 gene include diagnosis, prevention and treatment of viral infection by Epiphyas Postvittana Nucleopolyhedrovirus. Specific functions, and accordingly utilities, of VGR2780 gene correlate with, and may be deduced from, the identity of the host target genes, which are inhibited by VGAM RNAs comprised in the 'operon-like' cluster of VGR2780 gene: VGAM290 host target protein, VGAM291 host target protein, VGAM292 host target protein, VGAM293 host target protein, VGAM294 host target protein, VGAM295 host target protein, VGAM296 host target protein and VGAM297 host target protein, herein schematically represented by VGAM1 HOST TARGET PROTEIN through VGAM3 HOST TARGET PROTEIN. The function of these host target genes is elaborated hereinabove with reference to VGAM290, VGAM291, VGAM292, VGAM293, VGAM294, VGAM295, VGAM296 and VGAM297. FIG. 9 further provides a conceptual description of novel bioinformatically detected regulatory viral gene, referred to here as Viral Genomic Record 2781(VGR2781) viral gene, which encodes an 'operon-like' cluster of novel viral micro RNA-like genes, each of which in turn modulates expression of at least one host target gene, the function and utility of which at least one host target gene is known in the art.

VGR2781 gene, herein designated VGR GENE, is a novel bioinformatically detected regulatory, non protein coding, RNA viral gene. The method by which VGR2781 gene was detected is described hereinabove with reference to FIGS. 1-9.

VGR2781 gene encodes VGR2781 precursor RNA, herein designated VGR PRECURSOR RNA, an RNA molecule, typically several hundred nucleotides long.

VGR2781 precursor RNA folds spatially, forming VGR2781 folded precursor RNA, herein designated VGR FOLDED PRECURSOR RNA. It is appreciated that VGR2781 folded precursor RNA comprises a plurality of what is known in the art as 'hairpin' structures. These 'hairpin' structures are due to the fact that the nucleotide sequence of VGR2781 precursor RNA comprises a plurality of segments, the first half of each such segment having a nucleotide sequence which is at least a partial inversed-reversed sequence of the second half thereof, as is well known in the art.

VGR2781 folded precursor RNA is naturally processed by cellular enzymatic activity into at least 6 separate VGAM precursor RNAs, VGAM298 precursor RNA, VGAM299 precursor RNA, VGAM300 precursor RNA, VGAM301 precursor RNA, VGAM302 precursor RNA and VGAM303 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM298 RNA, VGAM299 RNA, VGAM300 RNA, VGAM301 RNA, VGAM302 RNA and VGAM303 RNA, herein schematically represented by VGAM1 RNA through VGAM3 RNA, each of which VGAM RNAs corresponding to VGAM RNA of FIG. 1.

VGAM298 RNA, herein schematically represented by VGAM1 RNA through VGAM3 RNA, binds complementarily to a host target binding site located in an untranslated region of VGAM298 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM298 host target RNA into VGAM298 host target protein, herein schematically represented by VGAM1 HOST TARGET PROTEIN through VGAM3 HOST TARGET PROTEIN, all of FIG. 1.

VGAM299 RNA, herein schematically represented by VGAM1 RNA through VGAM3 RNA, binds complementarily to a host target binding site located in an untranslated region of VGAM299 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM299 host target RNA into VGAM299 host target protein, herein schematically represented by VGAM1 HOST TARGET PROTEIN through VGAM3 HOST TARGET PROTEIN, all of FIG. 1.

VGAM300 RNA, herein schematically represented by VGAM1 RNA through VGAM3 RNA, binds complementarily to a host target binding site located in an untranslated region of VGAM300 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM300 host target RNA into VGAM300 host target protein, herein schematically represented by VGAM1 HOST TARGET PROTEIN through VGAM3 HOST TARGET PROTEIN, all of FIG. 1.

VGAM301 RNA, herein schematically represented by VGAM1 RNA through VGAM3 RNA, binds complementarily to a host target binding site located in an untranslated region of VGAM301 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM301 host target RNA into VGAM301 host target protein, herein schematically represented by VGAM1 HOST TARGET PROTEIN through VGAM3 HOST TARGET PROTEIN, all of FIG. 1.

VGAM302 RNA, herein schematically represented by VGAM1 RNA through VGAM3 RNA, binds complementarily to a host target binding site located in an untranslated region of VGAM302 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM302 host target RNA into VGAM302 host target protein, herein schematically represented by VGAM1 HOST TARGET PROTEIN through VGAM3 HOST TARGET PROTEIN, all of FIG. 1.

VGAM303 RNA, herein schematically represented by VGAM1 RNA through VGAM3 RNA, binds complementarily to a host target binding site located in an untranslated region of VGAM303 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM303 host target RNA into VGAM303 host target protein, herein schematically represented by VGAM1 HOST TARGET PROTEIN through VGAM3 HOST TARGET PROTEIN, all of FIG. 1.

It is appreciated that a function of VGR2781 gene, herein designated VGR GENE, is inhibition of expression of host target genes, as part of a novel viral mechanism of attacking a host. Accordingly, utilities of VGR2781 gene include diagnosis, prevention and treatment of viral infection by Epiphyas Postvittana Nucleopolyhedrovirus. Specific functions, and accordingly utilities, of VGR2781 gene correlate with, and may be deduced from, the identity of the host target genes, which are inhibited by VGAM RNAs comprised in the 'operon-like' cluster of VGR2781 gene: VGAM298 host target protein, VGAM299 host target protein, VGAM300 host target protein, VGAM301 host target protein, VGAM302 host target protein and VGAM303 host target protein, herein schematically represented by VGAM1 HOST TARGET PROTEIN through VGAM3 HOST TARGET PROTEIN. The function of these host target genes is elaborated hereinabove with reference to VGAM298, VGAM299, VGAM300, VGAM301, VGAM302 and VGAM303. FIG. 9 further provides a conceptual description of novel bioinformatically detected regulatory viral gene, referred to here as Viral Genomic Record 2782(VGR2782) viral gene, which encodes an 'operon-like' cluster of novel viral micro RNA-like genes, each of which in turn modulates expression of at least one host target gene, the function and utility of which at least one host target gene is known in the art.

VGR2782 gene, herein designated VGR GENE, is a novel bioinformatically detected regulatory, non protein coding, RNA viral gene. The method by which VGR2782 gene was detected is described hereinabove with reference to FIGS. 1-9.

VGR2782 gene encodes VGR2782 precursor RNA, herein designated VGR PRECURSOR RNA, an RNA molecule, typically several hundred nucleotides long.

VGR2782 precursor RNA folds spatially, forming VGR2782 folded precursor RNA, herein designated VGR FOLDED PRECURSOR RNA. It is appreciated that VGR2782 folded precursor RNA comprises a plurality of what is known in the art as 'hairpin' structures. These 'hairpin' structures are due to the fact that the nucleotide sequence of VGR2782 precursor RNA comprises a plurality of segments, the first half of each such segment having a nucleotide sequence which is at least a partial inversed-reversed sequence of the second half thereof, as is well known in the art.

VGR2782 folded precursor RNA is naturally processed by cellular enzymatic activity into at least 3 separate VGAM precursor RNAs, VGAM304 precursor RNA, VGAM305 precursor RNA and VGAM306 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM304 RNA, VGAM305 RNA and VGAM306 RNA, herein schematically represented by VGAM1 RNA through VGAM3 RNA, each of which VGAM RNAs corresponding to VGAM RNA of FIG. 1.

VGAM304 RNA, herein schematically represented by VGAM1 RNA through VGAM3 RNA, binds complementarily to a host target binding site located in an untranslated region of VGAM304 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM304 host target RNA into VGAM304 host target protein, herein schematically represented by VGAM1 HOST TARGET PROTEIN through VGAM3 HOST TARGET PROTEIN, all of FIG. 1.

VGAM305 RNA, herein schematically represented by VGAM1 RNA through VGAM3 RNA, binds complementarily to a host target binding site located in an untranslated region of VGAM305 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM305 host target RNA into VGAM305 host target protein, herein schematically represented by VGAM1 HOST TARGET PROTEIN through VGAM3 HOST TARGET PROTEIN, all of FIG. 1.

VGAM306 RNA, herein schematically represented by VGAM1 RNA through VGAM3 RNA, binds complementarily to a host target binding site located in an untranslated region of VGAM306 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM306 host target RNA into VGAM306 host target protein, herein schematically represented by VGAM1 HOST TARGET PROTEIN through VGAM3 HOST TARGET PROTEIN, all of FIG. 1.

It is appreciated that a function of VGR2782 gene, herein designated VGR GENE, is inhibition of expression of host target genes, as part of a novel viral mechanism of attacking a host. Accordingly, utilities of VGR2782 gene include diagnosis, prevention and treatment of viral infection by Equine Herpesvirus 4. Specific functions, and accordingly utilities, of VGR2782 gene correlate with, and may be deduced from, the identity of the host target genes, which are inhibited by VGAM RNAs comprised in the 'operon-like' cluster of VGR2782 gene: VGAM304 host target protein, VGAM305 host target protein and VGAM306 host target protein, herein schematically represented by VGAM1 HOST TARGET PROTEIN through VGAM3 HOST TARGET PROTEIN. The function of these host target genes is elaborated hereinabove with reference to VGAM304, VGAM305 and VGAM306. FIG. 9 further provides a conceptual description of novel bioinformatically detected regulatory viral gene, referred to here as Viral Genomic Record 2783(VGR2783) viral gene, which encodes an 'operon-like' cluster of novel viral micro RNA-like genes, each of which in turn modulates expression of at least one host target gene, the function and utility of which at least one host target gene is known in the art.

VGR2783 gene, herein designated VGR GENE, is a novel bioinformatically detected regulatory, non protein coding, RNA viral gene. The method by which VGR2783 gene was detected is described hereinabove with reference to FIGS. 1-9.

VGR2783 gene encodes VGR2783 precursor RNA, herein designated VGR PRECURSOR RNA, an RNA molecule, typically several hundred nucleotides long.

VGR2783 precursor RNA folds spatially, forming VGR2783 folded precursor RNA, herein designated VGR FOLDED PRECURSOR RNA. It is appreciated that VGR2783 folded precursor RNA comprises a plurality of what is known in the art as 'hairpin' structures. These 'hairpin' structures are due to the fact that the nucleotide sequence of VGR2783 precursor RNA comprises a plurality of segments, the first half of each such segment having a nucleotide sequence which is at least a partial inversed-reversed sequence of the second half thereof, as is well known in the art.

VGR2783 folded precursor RNA is naturally processed by cellular enzymatic activity into at least 3 separate VGAM precursor RNAs, VGAM310 precursor RNA, VGAM311 precursor RNA and VGAM312 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM310 RNA, VGAM311 RNA and VGAM312 RNA, herein schematically represented by VGAM1 RNA through VGAM3 RNA, each of which VGAM RNAs corresponding to VGAM RNA of FIG. 1.

VGAM310 RNA, herein schematically represented by VGAM1 RNA through VGAM3 RNA, binds complementarily to a host target binding site located in an untranslated region of VGAM310 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM310 host target RNA into VGAM310 host target protein, herein schematically represented by VGAM1 HOST TARGET PROTEIN through VGAM3 HOST TARGET PROTEIN, all of FIG. 1.

VGAM311 RNA, herein schematically represented by VGAM1 RNA through VGAM3 RNA, binds complementarily to a host target binding site located in an untranslated region of VGAM311 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM311 host target RNA into VGAM311 host target protein, herein schematically represented by VGAM1 HOST TARGET PROTEIN through VGAM3 HOST TARGET PROTEIN, all of FIG. 1.

VGAM312 RNA, herein schematically represented by VGAM1 RNA through VGAM3 RNA, binds complementarily to a host target binding site located in an untranslated region of VGAM312 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM312 host target RNA into VGAM312 host target protein, herein schematically represented by VGAM1 HOST TARGET PROTEIN through VGAM3 HOST TARGET PROTEIN, all of FIG. 1.

It is appreciated that a function of VGR2783 gene, herein designated VGR GENE, is inhibition of expression of host target genes, as part of a novel viral mechanism of attacking a host. Accordingly, utilities of VGR2783 gene include diagnosis, prevention and treatment of viral infection by Pothos Latent Virus. Specific functions, and accordingly utilities, of VGR2783 gene correlate with, and may be deduced from, the identity of the host target genes, which are inhibited by VGAM RNAs comprised in the 'operon-like' cluster of VGR2783 gene: VGAM310 host target protein, VGAM311 host target protein and VGAM312 host target protein, herein schematically represented by VGAM1 HOST TARGET PROTEIN through VGAM3 HOST TARGET PROTEIN. The function of these host target genes is elaborated hereinabove with reference to VGAM310, VGAM311 and VGAM312. FIG. 9 further provides a conceptual description of novel bioinformatically detected regulatory viral gene, referred to here as Viral Genomic Record 2784(VGR2784) viral gene, which encodes an 'operon-like' cluster of novel viral micro RNA-like genes, each of which in turn modulates expression of at least one host target gene, the function and utility of which at least one host target gene is known in the art.

VGR2784 gene, herein designated VGR GENE, is a novel bioinformatically detected regulatory, non protein coding, RNA viral gene. The method by which VGR2784 gene was detected is described hereinabove with reference to FIGS. 1-9.

VGR2784 gene encodes VGR2784 precursor RNA, herein designated VGR PRECURSOR RNA, an RNA molecule, typically several hundred nucleotides long.

VGR2784 precursor RNA folds spatially, forming VGR2784 folded precursor RNA, herein designated VGR FOLDED PRECURSOR RNA. It is appreciated that VGR2784 folded precursor RNA comprises a plurality of what is known in the art as 'hairpin' structures. These 'hairpin' structures are due to the fact that the nucleotide sequence of VGR2784 precursor RNA comprises a plurality of segments, the first half of each such segment having a nucleotide sequence which is at least a partial inversed-reversed sequence of the second half thereof, as is well known in the art.

VGR2784 folded precursor RNA is naturally processed by cellular enzymatic activity into at least 4 separate VGAM precursor RNAs, VGAM315 precursor RNA, VGAM316 precursor RNA, VGAM317 precursor RNA and VGAM318 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM315 RNA, VGAM316 RNA, VGAM317 RNA and VGAM318 RNA, herein schematically represented by VGAM1 RNA through VGAM3 RNA, each of which VGAM RNAs corresponding to VGAM RNA of FIG. 1.

VGAM315 RNA, herein schematically represented by VGAM1 RNA through VGAM3 RNA, binds complementarily to a host target binding site located in an untranslated region of VGAM315 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM315 host target RNA into VGAM315 host target protein, herein schematically represented by VGAM1 HOST TARGET PROTEIN through VGAM3 HOST TARGET PROTEIN, all of FIG. 1.

VGAM316 RNA, herein schematically represented by VGAM1 RNA through VGAM3 RNA, binds complementarily to a host target binding site located in an untranslated region of VGAM316 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM316 host target RNA into VGAM316 host target protein, herein schematically represented by VGAM1 HOST TARGET PROTEIN through VGAM3 HOST TARGET PROTEIN, all of FIG. 1.

VGAM317 RNA, herein schematically represented by VGAM1 RNA through VGAM3 RNA, binds complementarily to a host target binding site located in an untranslated region of VGAM317 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM317 host target RNA into VGAM317 host target protein, herein schematically represented by VGAM1 HOST TARGET PROTEIN through VGAM3 HOST TARGET PROTEIN, all of FIG. 1.

VGAM318 RNA, herein schematically represented by VGAM1 RNA through VGAM3 RNA, binds complementarily to a host target binding site located in an untranslated region of VGAM318 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM318 host target RNA into VGAM318 host target protein, herein schematically represented by VGAM1 HOST TARGET PROTEIN through VGAM3 HOST TARGET PROTEIN, all of FIG. 1.

It is appreciated that a function of VGR2784 gene, herein designated VGR GENE, is inhibition of expression of host target genes, as part of a novel viral mechanism of attacking a host. Accordingly, utilities of VGR2784 gene include diagnosis, prevention and treatment of viral infection by Cryphonectria Hypovirus 3. Specific functions, and accordingly utilities, of VGR2784 gene correlate with, and may be deduced from, the identity of the host target genes, which are inhibited by VGAM RNAs comprised in the 'operon-like' cluster of VGR2784 gene: VGAM315 host target protein, VGAM316 host target protein, VGAM317 host target protein and VGAM318 host target protein, herein schematically represented by VGAM1 HOST TARGET PROTEIN through VGAM3 HOST TARGET PROTEIN. The function of these host target genes is elaborated hereinabove with reference to VGAM315, VGAM316, VGAM317 and VGAM318. FIG. 9 further provides a conceptual description of novel bioinformatically detected regulatory viral gene, referred to here as Viral Genomic Record 2785(VGR2785) viral gene, which encodes an 'operon-like' cluster of novel viral micro RNA-like genes, each of which in turn modulates expression of at least one host target gene, the function and utility of which at least one host target gene is known in the art.

VGR2785 gene, herein designated VGR GENE, is a novel bioinformatically detected regulatory, non protein coding, RNA viral gene. The method by which VGR2785 gene was detected is described hereinabove with reference to FIGS. 1-9.

VGR2785 gene encodes VGR2785 precursor RNA, herein designated VGR PRECURSOR RNA, an RNA molecule, typically several hundred nucleotides long.

VGR2785 precursor RNA folds spatially, forming VGR2785 folded precursor RNA, herein designated VGR FOLDED PRECURSOR RNA. It is appreciated that VGR2785 folded precursor RNA comprises a plurality of what is known in the art as 'hairpin' structures. These 'hairpin' structures are due to the fact that the nucleotide sequence of VGR2785 precursor RNA comprises a plurality of segments, the first half of each such segment having a nucleotide sequence which is at least a partial inversed-reversed sequence of the second half thereof, as is well known in the art.

VGR2785 folded precursor RNA is naturally processed by cellular enzymatic activity into at least 2 separate VGAM precursor RNAs, VGAM319 precursor RNA and VGAM320 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM319 RNA and VGAM320 RNA, herein schematically represented by VGAM1 RNA through VGAM3 RNA, each of which VGAM RNAs corresponding to VGAM RNA of FIG. 1.

VGAM319 RNA, herein schematically represented by VGAM1 RNA through VGAM3 RNA, binds complementarily to a host target binding site located in an untranslated region of VGAM319 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM319 host target RNA into VGAM319 host target protein, herein schematically represented by VGAM1 HOST TARGET PROTEIN through VGAM3 HOST TARGET PROTEIN, all of FIG. 1.

VGAM320 RNA, herein schematically represented by VGAM1 RNA through VGAM3 RNA, binds complementarily to a host target binding site located in an untranslated region of VGAM320 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM320 host target RNA into VGAM320 host target protein, herein schematically represented by VGAM1 HOST TARGET PROTEIN through VGAM3 HOST TARGET PROTEIN, all of FIG. 1.

It is appreciated that a function of VGR2785 gene, herein designated VGR GENE, is inhibition of expression of host target genes, as part of a novel viral mechanism of attacking a host. Accordingly, utilities of VGR2785 gene include diagnosis, prevention and treatment of viral infection by Myxoma Virus. Specific functions, and accordingly utilities, of VGR2785 gene correlate with, and may be deduced from, the identity of the host target genes, which are inhibited by VGAM RNAs comprised in the 'operon-like' cluster of VGR2785 gene: VGAM319 host target protein and VGAM320 host target protein, herein schematically represented by VGAM1 HOST TARGET PROTEIN through VGAM3 HOST TARGET PROTEIN. The function of these host target genes is elaborated hereinabove with reference to VGAM319 and VGAM320. FIG. 9 further provides a conceptual description of novel bioinformatically detected regulatory viral gene, referred to here as Viral Genomic Record 2786(VGR2786) viral gene, which encodes an 'operon-like' cluster of novel viral micro RNA-like genes, each of which in turn modulates expression of at least one host target gene, the function and utility of which at least one host target gene is known in the art.

VGR2786 gene, herein designated VGR GENE, is a novel bioinformatically detected regulatory, non protein coding, RNA viral gene. The method by which VGR2786 gene was detected is described hereinabove with reference to FIGS. 1-9.

VGR2786 gene encodes VGR2786 precursor RNA, herein designated VGR PRECURSOR RNA, an RNA molecule, typically several hundred nucleotides long.

VGR2786 precursor RNA folds spatially, forming VGR2786 folded precursor RNA, herein designated VGR FOLDED PRECURSOR RNA. It is appreciated that VGR2786 folded precursor RNA comprises a plurality of what is known in the art as 'hairpin' structures. These 'hairpin' structures are due to the fact that the nucleotide sequence of VGR2786 precursor RNA comprises a plurality of segments, the first half of each such segment having a nucleotide sequence which is at least a partial inversed-reversed sequence of the second half thereof, as is well known in the art.

VGR2786 folded precursor RNA is naturally processed by cellular enzymatic activity into at least 3 separate VGAM precursor RNAs, VGAM324 precursor RNA, VGAM325 precursor RNA and VGAM326 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM324 RNA, VGAM325 RNA and VGAM326 RNA, herein schematically represented by VGAM1 RNA through VGAM3 RNA, each of which VGAM RNAs corresponding to VGAM RNA of FIG. 1.

VGAM324 RNA, herein schematically represented by VGAM1 RNA through VGAM3 RNA, binds complementarily to a host target binding site located in an untranslated region of VGAM324 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM324 host target RNA into VGAM324 host target protein, herein schematically represented by VGAM1 HOST TARGET PROTEIN through VGAM3 HOST TARGET PROTEIN, all of FIG. 1.

VGAM325 RNA, herein schematically represented by VGAM1 RNA through VGAM3 RNA, binds complementarily to a host target binding site located in an untranslated region of VGAM325 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM325 host target RNA into VGAM325 host target protein, herein schematically represented by VGAM1 HOST TARGET PROTEIN through VGAM3 HOST TARGET PROTEIN, all of FIG. 1.

VGAM326 RNA, herein schematically represented by VGAM1 RNA through VGAM3 RNA, binds complementarily to a host target binding site located in an untranslated region of VGAM326 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM326 host target RNA into VGAM326 host target protein, herein schematically represented by VGAM1 HOST TARGET PROTEIN through VGAM3 HOST TARGET PROTEIN, all of FIG. 1.

It is appreciated that a function of VGR2786 gene, herein designated VGR GENE, is inhibition of expression of host target genes, as part of a novel viral mechanism of attacking a host. Accordingly, utilities of VGR2786 gene include diagnosis, prevention and treatment of viral infection by Rabbit Fibroma Virus. Specific functions, and accordingly utilities, of VGR2786 gene correlate with, and may be deduced from, the identity of the host target genes, which are inhibited by VGAM RNAs comprised in the 'operon-like' cluster of VGR2786 gene: VGAM324 host target protein, VGAM325 host target protein and VGAM326 host target protein, herein schematically represented by VGAM1 HOST TARGET PROTEIN through VGAM3 HOST TARGET PROTEIN. The function of these host target genes is elaborated hereinabove with reference to VGAM324, VGAM325 and VGAM326. FIG. 9 further provides a conceptual description of novel bioinformatically detected regulatory viral gene, referred to here as Viral Genomic Record 2787(VGR2787) viral gene, which encodes an 'operon-like' cluster of novel viral micro RNA-like genes, each of which in turn modulates expression of at least one host target gene, the function and utility of which at least one host target gene is known in the art.

VGR2787 gene, herein designated VGR GENE, is a novel bioinformatically detected regulatory, non protein coding, RNA viral gene. The method by which VGR2787 gene was detected is described hereinabove with reference to FIGS. 1-9.

VGR2787 gene encodes VGR2787 precursor RNA, herein designated VGR PRECURSOR RNA, an RNA molecule, typically several hundred nucleotides long.

VGR2787 precursor RNA folds spatially, forming VGR2787 folded precursor RNA, herein designated VGR FOLDED PRECURSOR RNA. It is appreciated that VGR2787 folded precursor RNA comprises a plurality of what is known in the art as 'hairpin' structures. These 'hairpin' structures are due to the fact that the nucleotide sequence of VGR2787 precursor RNA comprises a plurality of segments, the first half of each such segment having a nucleotide sequence which is at least a partial inversed-reversed sequence of the second half thereof, as is well known in the art.

VGR2787 folded precursor RNA is naturally processed by cellular enzymatic activity into at least 2 separate VGAM precursor RNAs, VGAM333 precursor RNA and VGAM334 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM333 RNA and VGAM334 RNA, herein schematically represented by VGAM1 RNA through VGAM3 RNA, each of which VGAM RNAs corresponding to VGAM RNA of FIG. 1.

VGAM333 RNA, herein schematically represented by VGAM1 RNA through VGAM3 RNA, binds complementarily to a host target binding site located in an untranslated region of VGAM333 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM333 host target RNA into VGAM333 host target protein, herein schematically represented by VGAM1 HOST TARGET PROTEIN through VGAM3 HOST TARGET PROTEIN, all of FIG. 1.

VGAM334 RNA, herein schematically represented by VGAM1 RNA through VGAM3 RNA, binds complementarily to a host target binding site located in an untranslated region of VGAM334 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM334 host target RNA into VGAM334 host target protein, herein schematically represented by VGAM1 HOST TARGET PROTEIN through VGAM3 HOST TARGET PROTEIN, all of FIG. 1.

It is appreciated that a function of VGR2787 gene, herein designated VGR GENE, is inhibition of expression of host target genes, as part of a novel viral mechanism of attacking a host. Accordingly, utilities of VGR2787 gene include diagnosis, prevention and treatment of viral infection by Human Herpesvirus 3. Specific functions, and accordingly utilities, of VGR2787 gene correlate with, and may be deduced from, the identity of the host target genes, which are inhibited by VGAM RNAs comprised in the 'operon-like' cluster of VGR2787 gene: VGAM333 host target protein and VGAM334 host target protein, herein schematically represented by VGAM1 HOST TARGET PROTEIN through VGAM3 HOST TARGET PROTEIN. The function of these host target genes is elaborated hereinabove with reference to VGAM333 and VGAM334. FIG. 9 further provides a conceptual description of novel bioinformatically detected regulatory viral gene, referred to here as Viral Genomic Record 2788(VGR2788) viral gene, which encodes an 'operon-like' cluster of novel viral micro RNA-like genes, each of which in turn modulates expression of at least one host target gene, the function and utility of which at least one host target gene is known in the art.

VGR2788 gene, herein designated VGR GENE, is a novel bioinformatically detected regulatory, non protein coding, RNA viral gene. The method by which VGR2788 gene was detected is described hereinabove with reference to FIGS. 1-9.

VGR2788 gene encodes VGR2788 precursor RNA, herein designated VGR PRECURSOR RNA, an RNA molecule, typically several hundred nucleotides long.

VGR2788 precursor RNA folds spatially, forming VGR2788 folded precursor RNA, herein designated VGR FOLDED PRECURSOR RNA. It is appreciated that VGR2788 folded precursor RNA comprises a plurality of what is known in the art as 'hairpin' structures. These 'hairpin' structures are due to the fact that the nucleotide sequence of VGR2788 precursor RNA comprises a plurality of segments, the first half of each such segment having a nucleotide sequence which is at least a partial inversed-reversed sequence of the second half thereof, as is well known in the art.

VGR2788 folded precursor RNA is naturally processed by cellular enzymatic activity into at least 5 separate VGAM precursor RNAs, VGAM335 precursor RNA, VGAM336 precursor RNA, VGAM337 precursor RNA, VGAM338 precursor RNA and VGAM339 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM335 RNA, VGAM336 RNA, VGAM337 RNA, VGAM338 RNA and VGAM339 RNA, herein schematically represented by VGAM1 RNA through VGAM3 RNA, each of which VGAM RNAs corresponding to VGAM RNA of FIG. 1.

VGAM335 RNA, herein schematically represented by VGAM1 RNA through VGAM3 RNA, binds complementarily to a host target binding site located in an untranslated region of VGAM335 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM335 host target RNA into VGAM335 host target protein, herein schematically represented by VGAM1 HOST TARGET PROTEIN through VGAM3 HOST TARGET PROTEIN, all of FIG. 1.

VGAM336 RNA, herein schematically represented by VGAM1 RNA through VGAM3 RNA, binds complementarily to a host target binding site located in an untranslated region of VGAM336 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM336 host target RNA into VGAM336 host target protein, herein schematically represented by VGAM1 HOST TARGET PROTEIN through VGAM3 HOST TARGET PROTEIN, all of FIG. 1.

VGAM337 RNA, herein schematically represented by VGAM1 RNA through VGAM3 RNA, binds complementarily to a host target binding site located in an untranslated region of VGAM337 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM337 host target RNA into VGAM337 host target protein, herein schematically represented by VGAM1 HOST TARGET PROTEIN through VGAM3 HOST TARGET PROTEIN, all of FIG. 1.

VGAM338 RNA, herein schematically represented by VGAM1 RNA through VGAM3 RNA, binds complementarily to a host target binding site located in an untranslated region of VGAM338 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM338 host target RNA into VGAM338 host target protein, herein schematically represented by VGAM1 HOST TARGET PROTEIN through VGAM3 HOST TARGET PROTEIN, all of FIG. 1.

VGAM339 RNA, herein schematically represented by VGAM1 RNA through VGAM3 RNA, binds complementarily to a host target binding site located in an untranslated region of VGAM339 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM339 host target RNA into VGAM339 host target protein, herein schematically represented by VGAM1 HOST TARGET PROTEIN through VGAM3 HOST TARGET PROTEIN, all of FIG. 1.

It is appreciated that a function of VGR2788 gene, herein designated VGR GENE, is inhibition of expression of host target genes, as part of a novel viral mechanism of attacking a host. Accordingly, utilities of VGR2788 gene include diagnosis, prevention and treatment of viral infection by Saimiriine Herpesvirus 2. Specific functions, and accordingly utilities, of VGR2788 gene correlate with, and may be deduced from, the identity of the host target genes, which are inhibited by VGAM RNAs comprised in the 'operon-like' cluster of VGR2788 gene: VGAM335 host target protein, VGAM336 host target protein, VGAM337 host target protein, VGAM338 host target protein and VGAM339 host target protein, herein schematically represented by VGAM1 HOST TARGET PROTEIN through VGAM3 HOST TARGET PROTEIN. The function of these host target genes is elaborated hereinabove with reference to VGAM335, VGAM336, VGAM337, VGAM338 and VGAM339. FIG. 9 further provides a conceptual description of novel bioinformatically detected regulatory viral gene, referred to here as Viral Genomic Record 2789(VGR2789) viral gene, which encodes an 'operon-like' cluster of novel viral micro RNA-like genes, each of which in turn modulates expression of at least one host target gene, the function and utility of which at least one host target gene is known in the art.

VGR2789 gene, herein designated VGR GENE, is a novel bioinformatically detected regulatory, non protein coding, RNA viral gene. The method by which VGR2789 gene was detected is described hereinabove with reference to FIGS. 1-9.

VGR2789 gene encodes VGR2789 precursor RNA, herein designated VGR PRECURSOR RNA, an RNA molecule, typically several hundred nucleotides long.

VGR2789 precursor RNA folds spatially, forming VGR2789 folded precursor RNA, herein designated VGR FOLDED PRECURSOR RNA. It is appreciated that VGR2789 folded precursor RNA comprises a plurality of what is known in the art as 'hairpin' structures. These 'hairpin' structures are due to the fact that the nucleotide sequence of VGR2789 precursor RNA comprises a plurality of segments, the first half of each such segment having a nucleotide sequence which is at least a partial inversed-reversed sequence of the second half thereof, as is well known in the art.

VGR2789 folded precursor RNA is naturally processed by cellular enzymatic activity into at least 5 separate VGAM precursor RNAs, VGAM340 precursor RNA, VGAM341 precursor RNA, VGAM342 precursor RNA, VGAM343 precursor RNA and VGAM344 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM340 RNA, VGAM341 RNA, VGAM342 RNA, VGAM343 RNA and VGAM344 RNA, herein schematically represented by VGAM1 RNA through VGAM3 RNA, each of which VGAM RNAs corresponding to VGAM RNA of FIG. 1.

VGAM340 RNA, herein schematically represented by VGAM1 RNA through VGAM3 RNA, binds complementarily to a host target binding site located in an untranslated region of VGAM340 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM340 host target RNA into VGAM340 host target protein, herein schematically represented by VGAM1 HOST TARGET PROTEIN through VGAM3 HOST TARGET PROTEIN, all of FIG. 1.

VGAM341 RNA, herein schematically represented by VGAM1 RNA through VGAM3 RNA, binds complementarily to a host target binding site located in an untranslated region of VGAM341 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM341 host target RNA into VGAM341 host target protein, herein schematically represented by VGAM1 HOST TARGET PROTEIN through VGAM3 HOST TARGET PROTEIN, all of FIG. 1.

VGAM342 RNA, herein schematically represented by VGAM1 RNA through VGAM3 RNA, binds complementarily to a host target binding site located in an untranslated region of VGAM342 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM342 host target RNA into VGAM342 host target protein, herein schematically represented by VGAM1 HOST TARGET PROTEIN through VGAM3 HOST TARGET PROTEIN, all of FIG. 1.

VGAM343 RNA, herein schematically represented by VGAM1 RNA through VGAM3 RNA, binds complementarily to a host target binding site located in an untranslated region of VGAM343 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM343 host target RNA into VGAM343 host target protein, herein schematically represented by VGAM1 HOST TARGET PROTEIN through VGAM3 HOST TARGET PROTEIN, all of FIG. 1.

VGAM344 RNA, herein schematically represented by VGAM1 RNA through VGAM3 RNA, binds complementarily to a host target binding site located in an untranslated region of VGAM344 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM344 host target RNA into VGAM344 host target protein, herein schematically represented by VGAM1 HOST TARGET PROTEIN through VGAM3 HOST TARGET PROTEIN, all of FIG. 1.

It is appreciated that a function of VGR2789 gene, herein designated VGR GENE, is inhibition of expression of host target genes, as part of a novel viral mechanism of attacking a host. Accordingly, utilities of VGR2789 gene include diagnosis, prevention and treatment of viral infection by Tobacco Mosaic Virus. Specific functions, and accordingly utilities, of VGR2789 gene correlate with, and may be deduced from, the identity of the host target genes, which are inhibited by VGAM RNAs comprised in the 'operon-like' cluster of VGR2789 gene: VGAM340 host target protein, VGAM341 host target protein, VGAM342 host target protein, VGAM343 host target protein and VGAM344 host target protein, herein schematically represented by VGAM1 HOST TARGET PROTEIN through VGAM3 HOST TARGET PROTEIN. The function of these host target genes is elaborated hereinabove with reference to VGAM340, VGAM341, VGAM342, VGAM343 and VGAM344. FIG. 9 further provides a conceptual description of novel bioinformatically detected regulatory viral gene, referred to here as Viral Genomic Record 2790(VGR2790) viral gene, which encodes an 'operon-like' cluster of novel viral micro RNA-like genes, each of which in turn modulates expression of at least one host target gene, the function and utility of which at least one host target gene is known in the art.

VGR2790 gene, herein designated VGR GENE, is a novel bioinformatically detected regulatory, non protein coding, RNA viral gene. The method by which VGR2790 gene was detected is described hereinabove with reference to FIGS. 1-9.

VGR2790 gene encodes VGR2790 precursor RNA, herein designated VGR PRECURSOR RNA, an RNA molecule, typically several hundred nucleotides long.

VGR2790 precursor RNA folds spatially, forming VGR2790 folded precursor RNA, herein designated VGR FOLDED PRECURSOR RNA. It is appreciated that VGR2790 folded precursor RNA comprises a plurality of what is known in the art as 'hairpin' structures. These 'hairpin' structures are due to the fact that the nucleotide sequence of VGR2790 precursor RNA comprises a plurality of segments, the first half of each such segment having a nucleotide sequence which is at least a partial inversed-reversed sequence of the second half thereof, as is well known in the art.

VGR2790 folded precursor RNA is naturally processed by cellular enzymatic activity into at least 2 separate VGAM precursor RNAs, VGAM346 precursor RNA and VGAM347 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM346 RNA and VGAM347 RNA, herein schematically represented by VGAM1 RNA through VGAM3 RNA, each of which VGAM RNAs corresponding to VGAM RNA of FIG. 1.

VGAM346 RNA, herein schematically represented by VGAM1 RNA through VGAM3 RNA, binds complementarily to a host target binding site located in an untranslated region of VGAM346 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM346 host target RNA into VGAM346 host target protein, herein schematically represented by VGAM1 HOST TARGET PROTEIN through VGAM3 HOST TARGET PROTEIN, all of FIG. 1.

VGAM347 RNA, herein schematically represented by VGAM1 RNA through VGAM3 RNA, binds complementarily to a host target binding site located in an untranslated region of VGAM347 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM347 host target RNA into VGAM347 host target protein, herein schematically represented by VGAM1 HOST TARGET PROTEIN through VGAM3 HOST TARGET PROTEIN, all of FIG. 1.

It is appreciated that a function of VGR2790 gene, herein designated VGR GENE, is inhibition of expression of host target genes, as part of a novel viral mechanism of attacking a host. Accordingly, utilities of VGR2790 gene include diagnosis, prevention and treatment of viral infection by Black Beetle Virus. Specific functions, and accordingly utilities, of VGR2790 gene correlate with, and may be deduced from, the identity of the host target genes, which are inhibited by VGAM RNAs comprised in the 'operon-like' cluster of VGR2790 gene: VGAM346 host target protein and VGAM347 host target protein, herein schematically represented by VGAM1 HOST TARGET PROTEIN through VGAM3 HOST TARGET PROTEIN. The function of these host target genes is elaborated hereinabove with reference to VGAM346 and VGAM347. FIG. 9 further provides a conceptual description of novel bioinformatically detected regulatory viral gene, referred to here as Viral Genomic Record 2791(VGR2791) viral gene, which encodes an 'operon-like' cluster of novel viral micro RNA-like genes, each of which in turn modulates expression of at least one host target gene, the function and utility of which at least one host target gene is known in the art.

VGR2791 gene, herein designated VGR GENE, is a novel bioinformatically detected regulatory, non protein coding, RNA viral gene. The method by which VGR2791 gene was detected is described hereinabove with reference to FIGS. 1-9.

VGR2791 gene encodes VGR2791 precursor RNA, herein designated VGR PRECURSOR RNA, an RNA molecule, typically several hundred nucleotides long.

VGR2791 precursor RNA folds spatially, forming VGR2791 folded precursor RNA, herein designated VGR FOLDED PRECURSOR RNA. It is appreciated that VGR2791 folded precursor RNA comprises a plurality of what is known in the art as 'hairpin' structures. These 'hairpin' structures are due to the fact that the nucleotide sequence of VGR2791 precursor RNA comprises a plurality of segments, the first half of each such segment having a nucleotide sequence which is at least a partial inversed-reversed sequence of the second half thereof, as is well known in the art.

VGR2791 folded precursor RNA is naturally processed by cellular enzymatic activity into at least 2 separate VGAM precursor RNAs, VGAM348 precursor RNA and VGAM349 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM348 RNA and VGAM349 RNA, herein schematically represented by VGAM1 RNA through VGAM3 RNA, each of which VGAM RNAs corresponding to VGAM RNA of FIG. 1.

VGAM348 RNA, herein schematically represented by VGAM1 RNA through VGAM3 RNA, binds complementarily to a host target binding site located in an untranslated region of VGAM348 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM348 host target RNA into VGAM348 host target protein, herein schematically represented by VGAM1 HOST TARGET PROTEIN through VGAM3 HOST TARGET PROTEIN, all of FIG. 1.

VGAM349 RNA, herein schematically represented by VGAM1 RNA through VGAM3 RNA, binds complementarily to a host target binding site located in an untranslated region of VGAM349 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM349 host target RNA into VGAM349 host target protein, herein schematically represented by VGAM1 HOST TARGET PROTEIN through VGAM3 HOST TARGET PROTEIN, all of FIG. 1.

It is appreciated that a function of VGR2791 gene, herein designated VGR GENE, is inhibition of expression of host target genes, as part of a novel viral mechanism of attacking a host. Accordingly, utilities of VGR2791 gene include diagnosis, prevention and treatment of viral infection by Human Enterovirus C. Specific functions, and accordingly utilities, of VGR2791 gene correlate with, and may be deduced from, the identity of the host target genes, which are inhibited by VGAM RNAs comprised in the 'operon-like' cluster of VGR2791 gene: VGAM348 host target protein and VGAM349 host target protein, herein schematically represented by VGAM1 HOST TARGET PROTEIN through VGAM3 HOST TARGET PROTEIN. The function of these host target genes is elaborated hereinabove with reference to VGAM348 and VGAM349. FIG. 9 further provides a conceptual description of novel bioinformatically detected regulatory viral gene, referred to here as Viral Genomic Record 2792(VGR2792) viral gene, which encodes an 'operon-like' cluster of novel viral micro RNA-like genes, each of which in turn modulates expression of at least one host target gene, the function and utility of which at least one host target gene is known in the art.

VGR2792 gene, herein designated VGR GENE, is a novel bioinformatically detected regulatory, non protein coding, RNA viral gene. The method by which VGR2792 gene was detected is described hereinabove with reference to FIGS. 1-9.

VGR2792 gene encodes VGR2792 precursor RNA, herein designated VGR PRECURSOR RNA, an RNA molecule, typically several hundred nucleotides long.

VGR2792 precursor RNA folds spatially, forming VGR2792 folded precursor RNA, herein designated VGR FOLDED PRECURSOR RNA. It is appreciated that VGR2792 folded precursor RNA comprises a plurality of what is known in the art as 'hairpin' structures. These 'hairpin' structures are due to the fact that the nucleotide sequence of VGR2792 precursor RNA comprises a plurality of segments, the first half of each such segment having a nucleotide sequence which is at least a partial inversed-reversed sequence of the second half thereof, as is well known in the art.

VGR2792 folded precursor RNA is naturally processed by cellular enzymatic activity into at least 8 separate VGAM precursor RNAs, VGAM350 precursor RNA, VGAM351 precursor RNA, VGAM352 precursor RNA, VGAM353 precursor RNA, VGAM354 precursor RNA, VGAM355 precursor RNA, VGAM356 precursor RNA and VGAM357 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM350 RNA, VGAM351 RNA, VGAM352 RNA, VGAM353 RNA, VGAM354 RNA, VGAM355 RNA, VGAM356 RNA and VGAM357 RNA, herein schematically represented by VGAM1 RNA through VGAM3 RNA, each of which VGAM RNAs corresponding to VGAM RNA of FIG. 1.

VGAM350 RNA, herein schematically represented by VGAM1 RNA through VGAM3 RNA, binds complementarily to a host target binding site located in an untranslated region of VGAM350 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM350 host target RNA into VGAM350 host target protein, herein schematically represented by VGAM1 HOST TARGET PROTEIN through VGAM3 HOST TARGET PROTEIN, all of FIG. 1.

VGAM351 RNA, herein schematically represented by VGAM1 RNA through VGAM3 RNA, binds complementarily to a host target binding site located in an untranslated region of VGAM351 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM351 host target RNA into VGAM351 host target protein, herein schematically represented by VGAM1 HOST TARGET PROTEIN through VGAM3 HOST TARGET PROTEIN, all of FIG. 1.

VGAM352 RNA, herein schematically represented by VGAM1 RNA through VGAM3 RNA, binds complementarily to a host target binding site located in an untranslated region of VGAM352 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM352 host target RNA into VGAM352 host target protein, herein schematically represented by VGAM1 HOST TARGET PROTEIN through VGAM3 HOST TARGET PROTEIN, all of FIG. 1.

VGAM353 RNA, herein schematically represented by VGAM1 RNA through VGAM3 RNA, binds complementarily to a host target binding site located in an untranslated region of VGAM353 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM353 host target RNA into VGAM353 host target protein, herein schematically represented by VGAM1 HOST TARGET PROTEIN through VGAM3 HOST TARGET PROTEIN, all of FIG. 1.

VGAM354 RNA, herein schematically represented by VGAM1 RNA through VGAM3 RNA, binds complementarily to a host target binding site located in an untranslated region of VGAM354 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM354 host target RNA into VGAM354 host target protein, herein schematically represented by VGAM1 HOST TARGET PROTEIN through VGAM3 HOST TARGET PROTEIN, all of FIG. 1.

VGAM355 RNA, herein schematically represented by VGAM1 RNA through VGAM3 RNA, binds complementarily to a host target binding site located in an untranslated region of VGAM355 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM355 host target RNA into VGAM355 host target protein, herein schematically represented by VGAM1 HOST TARGET PROTEIN through VGAM3 HOST TARGET PROTEIN, all of FIG. 1.

VGAM356 RNA, herein schematically represented by VGAM1 RNA through VGAM3 RNA, binds complementarily to a host target binding site located in an untranslated region of VGAM356 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM356 host target RNA into VGAM356 host target protein, herein schematically represented by VGAM1 HOST TARGET PROTEIN through VGAM3 HOST TARGET PROTEIN, all of FIG. 1.

VGAM357 RNA, herein schematically represented by VGAM1 RNA through VGAM3 RNA, binds complementarily to a host target binding site located in an untranslated region of VGAM357 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM357 host target RNA into VGAM357 host target protein, herein schematically represented by VGAM1 HOST TARGET PROTEIN through VGAM3 HOST TARGET PROTEIN, all of FIG. 1.

It is appreciated that a function of VGR2792 gene, herein designated VGR GENE, is inhibition of expression of host target genes, as part of a novel viral mechanism of attacking a host. Accordingly, utilities of VGR2792 gene include diagnosis, prevention and treatment of viral infection by Avian Infectious Bronchitis Virus. Specific functions, and accordingly utilities, of VGR2792 gene correlate with, and may be deduced from, the identity of the host target genes, which are inhibited by VGAM RNAs comprised in the 'operon-like' cluster of VGR2792 gene: VGAM350 host target protein, VGAM351 host target protein, VGAM352 host target protein, VGAM353 host target protein, VGAM354 host target protein, VGAM355 host target protein, VGAM356 host target protein and VGAM357 host target protein, herein schematically represented by VGAM1 HOST TARGET PROTEIN through VGAM3 HOST TARGET PROTEIN. The function of these host target genes is elaborated hereinabove with reference to VGAM350, VGAM351, VGAM352, VGAM353, VGAM354, VGAM355, VGAM356 and VGAM357. FIG. 9 further provides a conceptual description of novel bioinformatically detected regulatory viral gene, referred to here as Viral Genomic Record 2793(VGR2793) viral gene, which encodes an 'operon-like' cluster of novel viral micro RNA-like genes, each of which in turn modulates expression of at least one host target gene, the function and utility of which at least one host target gene is known in the art.

VGR2793 gene, herein designated VGR GENE, is a novel bioinformatically detected regulatory, non protein coding, RNA viral gene. The method by which VGR2793 gene was detected is described hereinabove with reference to FIGS. 1-9.

VGR2793 gene encodes VGR2793 precursor RNA, herein designated VGR PRECURSOR RNA, an RNA molecule, typically several hundred nucleotides long.

VGR2793 precursor RNA folds spatially, forming VGR2793 folded precursor RNA, herein designated VGR FOLDED PRECURSOR RNA. It is appreciated that VGR2793 folded precursor RNA comprises a plurality of what is known in the art as 'hairpin' structures. These 'hairpin' structures are due to the fact that the nucleotide sequence of VGR2793 precursor RNA comprises a plurality of segments, the first half of each such segment having a nucleotide sequence which is at least a partial inversed-reversed sequence of the second half thereof, as is well known in the art.

VGR2793 folded precursor RNA is naturally processed by cellular enzymatic activity into at least 7 separate VGAM precursor RNAs, VGAM358 precursor RNA, VGAM359 precursor RNA, VGAM360 precursor RNA, VGAM361 precursor RNA, VGAM362 precursor RNA, VGAM363 precursor RNA and VGAM364 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM358 RNA, VGAM359 RNA, VGAM360 RNA, VGAM361 RNA, VGAM362 RNA, VGAM363 RNA and VGAM364 RNA, herein schematically represented by VGAM1 RNA through VGAM3 RNA, each of which VGAM RNAs corresponding to VGAM RNA of FIG. 1.

VGAM358 RNA, herein schematically represented by VGAM1 RNA through VGAM3 RNA, binds complementarily to a host target binding site located in an untranslated region of VGAM358 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM358 host target RNA into VGAM358 host target protein, herein schematically represented by VGAM1 HOST TARGET PROTEIN through VGAM3 HOST TARGET PROTEIN, all of FIG. 1.

VGAM359 RNA, herein schematically represented by VGAM1 RNA through VGAM3 RNA, binds complementarily to a host target binding site located in an untranslated region of VGAM359 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM359 host target RNA into VGAM359 host target protein, herein schematically represented by VGAM1 HOST TARGET PROTEIN through VGAM3 HOST TARGET PROTEIN, all of FIG. 1.

VGAM360 RNA, herein schematically represented by VGAM1 RNA through VGAM3 RNA, binds complementarily to a host target binding site located in an untranslated region of VGAM360 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM360 host target RNA into VGAM360 host target protein, herein schematically represented by VGAM1 HOST TARGET PROTEIN through VGAM3 HOST TARGET PROTEIN, all of FIG. 1.

VGAM361 RNA, herein schematically represented by VGAM1 RNA through VGAM3 RNA, binds complementarily to a host target binding site located in an untranslated region of VGAM361 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM361 host target RNA into VGAM361 host target protein, herein schematically represented by VGAM1 HOST TARGET PROTEIN through VGAM3 HOST TARGET PROTEIN, all of FIG. 1.

VGAM362 RNA, herein schematically represented by VGAM1 RNA through VGAM3 RNA, binds complementarily to a host target binding site located in an untranslated region of VGAM362 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM362 host target RNA into VGAM362 host target protein, herein schematically represented by VGAM1 HOST TARGET PROTEIN through VGAM3 HOST TARGET PROTEIN, all of FIG. 1.

VGAM363 RNA, herein schematically represented by VGAM1 RNA through VGAM3 RNA, binds complementarily to a host target binding site located in an untranslated region of VGAM363 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM363 host target RNA into VGAM363 host target protein, herein schematically represented by VGAM1 HOST TARGET PROTEIN through VGAM3 HOST TARGET PROTEIN, all of FIG. 1.

VGAM364 RNA, herein schematically represented by VGAM1 RNA through VGAM3 RNA, binds complementarily to a host target binding site located in an untranslated region of VGAM364 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM364 host target RNA into VGAM364 host target protein, herein schematically represented by VGAM1 HOST TARGET PROTEIN through VGAM3 HOST TARGET PROTEIN, all of FIG. 1.

It is appreciated that a function of VGR2793 gene, herein designated VGR GENE, is inhibition of expression of host target genes, as part of a novel viral mechanism of attacking a host. Accordingly, utilities of VGR2793 gene include diagnosis, prevention and treatment of viral infection by Avian Infectious Bronchitis Virus. Specific functions, and accordingly utilities, of VGR2793 gene correlate with, and may be deduced from, the identity of the host target genes, which are inhibited by VGAM RNAs comprised in the 'operon-like' cluster of VGR2793 gene: VGAM358 host target protein, VGAM359 host target protein, VGAM360 host target protein, VGAM361 host target protein, VGAM362 host target protein, VGAM363 host target protein and VGAM364 host target protein, herein schematically represented by VGAM1 HOST TARGET PROTEIN through VGAM3 HOST TARGET PROTEIN. The function of these host target genes is elaborated hereinabove with reference to VGAM358, VGAM359, VGAM360, VGAM361, VGAM362, VGAM363 and VGAM364. FIG. 9 further provides a conceptual description of novel bioinformatically detected regulatory viral gene, referred to here as Viral Genomic Record 2794(VGR2794) viral gene, which encodes an 'operon-like' cluster of novel viral micro RNA-like genes, each of which in turn modulates expression of at least one host target gene, the function and utility of which at least one host target gene is known in the art.

VGR2794 gene, herein designated VGR GENE, is a novel bioinformatically detected regulatory, non protein coding, RNA viral gene. The method by which VGR2794 gene was detected is described hereinabove with reference to FIGS. 1-9.

VGR2794 gene encodes VGR2794 precursor RNA, herein designated VGR PRECURSOR RNA, an RNA molecule, typically several hundred nucleotides long.

VGR2794 precursor RNA folds spatially, forming VGR2794 folded precursor RNA, herein designated VGR FOLDED PRECURSOR RNA. It is appreciated that VGR2794 folded precursor RNA comprises a plurality of what is known in the art as 'hairpin' structures. These 'hairpin' structures are due to the fact that the nucleotide sequence of VGR2794 precursor RNA comprises a plurality of segments, the first half of each such segment having a nucleotide sequence which is at least a partial inversed-reversed sequence of the second half thereof, as is well known in the art.

VGR2794 folded precursor RNA is naturally processed by cellular enzymatic activity into at least 4 separate VGAM precursor RNAs, VGAM365 precursor RNA, VGAM366 precursor RNA, VGAM367 precursor RNA and VGAM368 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM365 RNA, VGAM366 RNA, VGAM367 RNA and VGAM368 RNA, herein schematically represented by VGAM1 RNA through VGAM3 RNA, each of which VGAM RNAs corresponding to VGAM RNA of FIG. 1.

VGAM365 RNA, herein schematically represented by VGAM1 RNA through VGAM3 RNA, binds complementarily to a host target binding site located in an untranslated region of VGAM365 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM365 host target RNA into VGAM365 host target protein, herein schematically represented by VGAM1 HOST TARGET PROTEIN through VGAM3 HOST TARGET PROTEIN, all of FIG. 1.

VGAM366 RNA, herein schematically represented by VGAM1 RNA through VGAM3 RNA, binds complementarily to a host target binding site located in an untranslated region of VGAM366 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM366 host target RNA into VGAM366 host target protein, herein schematically represented by VGAM1 HOST TARGET PROTEIN through VGAM3 HOST TARGET PROTEIN, all of FIG. 1.

VGAM367 RNA, herein schematically represented by VGAM1 RNA through VGAM3 RNA, binds complementarily to a host target binding site located in an untranslated region of VGAM367 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM367 host target RNA into VGAM367 host target protein, herein schematically represented by VGAM1 HOST TARGET PROTEIN through VGAM3 HOST TARGET PROTEIN, all of FIG. 1.

VGAM368 RNA, herein schematically represented by VGAM1 RNA through VGAM3 RNA, binds complementarily to a host target binding site located in an untranslated region of VGAM368 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM368 host target RNA into VGAM368 host target protein, herein schematically represented by VGAM1 HOST TARGET PROTEIN through VGAM3 HOST TARGET PROTEIN, all of FIG. 1.

It is appreciated that a function of VGR2794 gene, herein designated VGR GENE, is inhibition of expression of host target genes, as part of a novel viral mechanism of attacking a host. Accordingly, utilities of VGR2794 gene include diagnosis, prevention and treatment of viral infection by Avian Infectious Bronchitis Virus. Specific functions, and accordingly utilities, of VGR2794 gene correlate with, and may be deduced from, the identity of the host target genes, which are inhibited by VGAM RNAs comprised in the 'operon-like' cluster of VGR2794 gene: VGAM365 host target protein, VGAM366 host target protein, VGAM367 host target protein and VGAM368 host target protein, herein schematically represented by VGAM1 HOST TARGET PROTEIN through VGAM3 HOST TARGET PROTEIN. The function of these host target genes is elaborated hereinabove with reference to VGAM365, VGAM366, VGAM367 and VGAM368. FIG. 9 further provides a conceptual description of novel bioinformatically detected regulatory viral gene, referred to here as Viral Genomic Record 2795(VGR2795) viral gene, which encodes an 'operon-like' cluster of novel viral micro RNA-like genes, each of which in turn modulates expression of at least one host target gene, the function and utility of which at least one host target gene is known in the art.

VGR2795 gene, herein designated VGR GENE, is a novel bioinformatically detected regulatory, non protein coding, RNA viral gene. The method by which VGR2795 gene was detected is described hereinabove with reference to FIGS. 1-9.

VGR2795 gene encodes VGR2795 precursor RNA, herein designated VGR PRECURSOR RNA, an RNA molecule, typically several hundred nucleotides long.

VGR2795 precursor RNA folds spatially, forming VGR2795 folded precursor RNA, herein designated VGR FOLDED PRECURSOR RNA. It is appreciated that VGR2795 folded precursor RNA comprises a plurality of what is known in the art as 'hairpin' structures. These 'hairpin' structures are due to the fact that the nucleotide sequence of VGR2795 precursor RNA comprises a plurality of segments, the first half of each such segment having a nucleotide sequence which is at least a partial inversed-reversed sequence of the second half thereof, as is well known in the art.

VGR2795 folded precursor RNA is naturally processed by cellular enzymatic activity into at least 7 separate VGAM precursor RNAs, VGAM369 precursor RNA, VGAM370 precursor RNA, VGAM371 precursor RNA, VGAM372 precursor RNA, VGAM373 precursor RNA, VGAM374 precursor RNA and VGAM375 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM369 RNA, VGAM370 RNA, VGAM371 RNA, VGAM372 RNA, VGAM373 RNA, VGAM374 RNA and VGAM375 RNA, herein schematically represented by VGAM1 RNA through VGAM3 RNA, each of which VGAM RNAs corresponding to VGAM RNA of FIG. 1.

VGAM369 RNA, herein schematically represented by VGAM1 RNA through VGAM3 RNA, binds complementarily to a host target binding site located in an untranslated region of VGAM369 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM369 host target RNA into VGAM369 host target protein, herein schematically represented by VGAM1 HOST TARGET PROTEIN through VGAM3 HOST TARGET PROTEIN, all of FIG. 1.

VGAM370 RNA, herein schematically represented by VGAM1 RNA through VGAM3 RNA, binds complementarily to a host target binding site located in an untranslated region of VGAM370 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM370 host target RNA into VGAM370 host target protein, herein schematically represented by VGAM1 HOST TARGET PROTEIN through VGAM3 HOST TARGET PROTEIN, all of FIG. 1.

VGAM371 RNA, herein schematically represented by VGAM1 RNA through VGAM3 RNA, binds complementarily to a host target binding site located in an untranslated region of VGAM371 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM371 host target RNA into VGAM371 host target protein, herein schematically represented by VGAM1 HOST TARGET PROTEIN through VGAM3 HOST TARGET PROTEIN, all of FIG. 1.

VGAM372 RNA, herein schematically represented by VGAM1 RNA through VGAM3 RNA, binds complementarily to a host target binding site located in an untranslated region of VGAM372 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM372 host target RNA into VGAM372 host target protein, herein schematically represented by VGAM1 HOST TARGET PROTEIN through VGAM3 HOST TARGET PROTEIN, all of FIG. 1.

VGAM373 RNA, herein schematically represented by VGAM1 RNA through VGAM3 RNA, binds complementarily to a host target binding site located in an untranslated region of VGAM373 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM373 host target RNA into VGAM373 host target protein, herein schematically represented by VGAM1 HOST TARGET PROTEIN through VGAM3 HOST TARGET PROTEIN, all of FIG. 1.

VGAM374 RNA, herein schematically represented by VGAM1 RNA through VGAM3 RNA, binds complementarily to a host target binding site located in an untranslated region of VGAM374 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM374 host target RNA into VGAM374 host target protein, herein schematically represented by VGAM1 HOST TARGET PROTEIN through VGAM3 HOST TARGET PROTEIN, all of FIG. 1.

VGAM375 RNA, herein schematically represented by VGAM1 RNA through VGAM3 RNA, binds complementarily to a host target binding site located in an untranslated region of VGAM375 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM375 host target RNA into VGAM375 host target protein, herein schematically represented by VGAM1 HOST TARGET PROTEIN through VGAM3 HOST TARGET PROTEIN, all of FIG. 1.

It is appreciated that a function of VGR2795 gene, herein designated VGR GENE, is inhibition of expression of host target genes, as part of a novel viral mechanism of attacking a host. Accordingly, utilities of VGR2795 gene include diagnosis, prevention and treatment of viral infection by Avian Infectious Bronchitis Virus. Specific functions, and accordingly utilities, of VGR2795 gene correlate with, and may be deduced from, the identity of the host target genes, which are inhibited by VGAM RNAs comprised in the 'operon-like' cluster of VGR2795 gene: VGAM369 host target protein, VGAM370 host target protein, VGAM371 host target protein, VGAM372 host target protein, VGAM373 host target protein, VGAM374 host target protein and VGAM375 host target protein, herein schematically represented by VGAM1 HOST TARGET PROTEIN through VGAM3 HOST TARGET PROTEIN. The function of these host target genes is elaborated hereinabove with reference to VGAM369, VGAM370, VGAM371, VGAM372, VGAM373, VGAM374 and VGAM375. FIG. 9 further provides a conceptual description of novel bioinformatically detected regulatory viral gene, referred to here as Viral Genomic Record 2796(VGR2796) viral gene, which encodes an 'operon-like' cluster of novel viral micro RNA-like genes, each of which in turn modulates expression of at least one host target gene, the function and utility of which at least one host target gene is known in the art.

VGR2796 gene, herein designated VGR GENE, is a novel bioinformatically detected regulatory, non protein coding, RNA viral gene. The method by which VGR2796 gene was detected is described hereinabove with reference to FIGS. 1-9.

VGR2796 gene encodes VGR2796 precursor RNA, herein designated VGR PRECURSOR RNA, an RNA molecule, typically several hundred nucleotides long.

VGR2796 precursor RNA folds spatially, forming VGR2796 folded precursor RNA, herein designated VGR FOLDED PRECURSOR RNA. It is appreciated that VGR2796 folded precursor RNA comprises a plurality of what is known in the art as 'hairpin' structures. These 'hairpin' structures are due to the fact that the nucleotide sequence of VGR2796 precursor RNA comprises a plurality of segments, the first half of each such segment having a nucleotide sequence which is at least a partial inversed-reversed sequence of the second half thereof, as is well known in the art.

VGR2796 folded precursor RNA is naturally processed by cellular enzymatic activity into at least 2 separate VGAM precursor RNAs, VGAM376 precursor RNA and VGAM377 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM376 RNA and VGAM377 RNA, herein schematically represented by VGAM1 RNA through VGAM3 RNA, each of which VGAM RNAs corresponding to VGAM RNA of FIG. 1.

VGAM376 RNA, herein schematically represented by VGAM1 RNA through VGAM3 RNA, binds complementarily to a host target binding site located in an untranslated region of VGAM376 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM376 host target RNA into VGAM376 host target protein, herein schematically represented by VGAM1 HOST TARGET PROTEIN through VGAM3 HOST TARGET PROTEIN, all of FIG. 1.

VGAM377 RNA, herein schematically represented by VGAM1 RNA through VGAM3 RNA, binds complementarily to a host target binding site located in an untranslated region of VGAM377 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM377 host target RNA into VGAM377 host target protein, herein schematically represented by VGAM1 HOST TARGET PROTEIN through VGAM3 HOST TARGET PROTEIN, all of FIG. 1.

It is appreciated that a function of VGR2796 gene, herein designated VGR GENE, is inhibition of expression of host target genes, as part of a novel viral mechanism of attacking a host. Accordingly, utilities of VGR2796 gene include diagnosis, prevention and treatment of viral infection by Eggplant Mosaic Virus. Specific functions, and accordingly utilities, of VGR2796 gene correlate with, and may be deduced from, the identity of the host target genes, which are inhibited by VGAM RNAs comprised in the 'operon-like' cluster of VGR2796 gene: VGAM376 host target protein and VGAM377 host target protein, herein schematically represented by VGAM1 HOST TARGET PROTEIN through VGAM3 HOST TARGET PROTEIN. The function of these host target genes is elaborated hereinabove with reference to VGAM376 and VGAM377. FIG. 9 further provides a conceptual description of novel bioinformatically detected regulatory viral gene, referred to here as Viral Genomic Record 2797(VGR2797) viral gene, which encodes an 'operon-like' cluster of novel viral micro RNA-like genes, each of which in turn modulates expression of at least one host target gene, the function and utility of which at least one host target gene is known in the art.

VGR2797 gene, herein designated VGR GENE, is a novel bioinformatically detected regulatory, non protein coding, RNA viral gene. The method by which VGR2797 gene was detected is described hereinabove with reference to FIGS. 1-9.

VGR2797 gene encodes VGR2797 precursor RNA, herein designated VGR PRECURSOR RNA, an RNA molecule, typically several hundred nucleotides long.

VGR2797 precursor RNA folds spatially, forming VGR2797 folded precursor RNA, herein designated VGR FOLDED PRECURSOR RNA. It is appreciated that VGR2797 folded precursor RNA comprises a plurality of what is known in the art as 'hairpin' structures. These 'hairpin' structures are due to the fact that the nucleotide sequence of VGR2797 precursor RNA comprises a plurality of segments, the first half of each such segment having a nucleotide sequence which is at least a partial inversed-reversed sequence of the second half thereof, as is well known in the art.

VGR2797 folded precursor RNA is naturally processed by cellular enzymatic activity into at least 4 separate VGAM precursor RNAs, VGAM378 precursor RNA, VGAM379 precursor RNA, VGAM380 precursor RNA and VGAM381 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM378 RNA, VGAM379 RNA, VGAM380 RNA and VGAM381 RNA, herein schematically represented by VGAM1 RNA through VGAM3 RNA, each of which VGAM RNAs corresponding to VGAM RNA of FIG. 1.

VGAM378 RNA, herein schematically represented by VGAM1 RNA through VGAM3 RNA, binds complementarily to a host target binding site located in an untranslated region of VGAM378 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM378 host target RNA into VGAM378 host target protein, herein schematically represented by VGAM1 HOST TARGET PROTEIN through VGAM3 HOST TARGET PROTEIN, all of FIG. 1.

VGAM379 RNA, herein schematically represented by VGAM1 RNA through VGAM3 RNA, binds complementarily to a host target binding site located in an untranslated region of VGAM379 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM379 host target RNA into VGAM379 host target protein, herein schematically represented by VGAM1 HOST TARGET PROTEIN through VGAM3 HOST TARGET PROTEIN, all of FIG. 1.

VGAM380 RNA, herein schematically represented by VGAM1 RNA through VGAM3 RNA, binds complementarily to a host target binding site located in an untranslated region of VGAM380 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM380 host target RNA into VGAM380 host target protein, herein schematically represented by VGAM1 HOST TARGET PROTEIN through VGAM3 HOST TARGET PROTEIN, all of FIG. 1.

VGAM381 RNA, herein schematically represented by VGAM1 RNA through VGAM3 RNA, binds complementarily to a host target binding site located in an untranslated region of VGAM381 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM381 host target RNA into VGAM381 host target protein, herein schematically represented by VGAM1 HOST TARGET PROTEIN through VGAM3 HOST TARGET PROTEIN, all of FIG. 1.

It is appreciated that a function of VGR2797 gene, herein designated VGR GENE, is inhibition of expression of host target genes, as part of a novel viral mechanism of attacking a host. Accordingly, utilities of VGR2797 gene include diagnosis, prevention and treatment of viral infection by Feline Immunodeficiency Virus. Specific functions, and accordingly utilities, of VGR2797 gene correlate with, and may be deduced from, the identity of the host target genes, which are inhibited by VGAM RNAs comprised in the 'operon-like' cluster of VGR2797 gene: VGAM378 host target protein, VGAM379 host target protein, VGAM380 host target protein and VGAM381 host target protein, herein schematically represented by VGAM1 HOST TARGET PROTEIN through VGAM3 HOST TARGET PROTEIN. The function of these host target genes is elaborated hereinabove with reference to VGAM378, VGAM379, VGAM380 and VGAM381. FIG. 9 further provides a conceptual description of novel bioinformatically detected regulatory viral gene, referred to here as Viral Genomic Record 2798(VGR2798) viral gene, which encodes an 'operon-like' cluster of novel viral micro RNA-like genes, each of which in turn modulates expression of at least one host target gene, the function and utility of which at least one host target gene is known in the art.

VGR2798 gene, herein designated VGR GENE, is a novel bioinformatically detected regulatory, non protein coding, RNA viral gene. The method by which VGR2798 gene was detected is described hereinabove with reference to FIGS. 1-9.

VGR2798 gene encodes VGR2798 precursor RNA, herein designated VGR PRECURSOR RNA, an RNA molecule, typically several hundred nucleotides long.

VGR2798 precursor RNA folds spatially, forming VGR2798 folded precursor RNA, herein designated VGR FOLDED PRECURSOR RNA. It is appreciated that VGR2798 folded precursor RNA comprises a plurality of what is known in the art as 'hairpin' structures. These 'hairpin' structures are due to the fact that the nucleotide sequence of VGR2798 precursor RNA comprises a plurality of segments, the first half of each such segment having a nucleotide sequence which is at least a partial inversed-reversed sequence of the second half thereof, as is well known in the art.

VGR2798 folded precursor RNA is naturally processed by cellular enzymatic activity into at least 5 separate VGAM precursor RNAs, VGAM382 precursor RNA, VGAM383 precursor RNA, VGAM384 precursor RNA, VGAM385 precursor RNA and VGAM386 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM382 RNA, VGAM383 RNA, VGAM384 RNA, VGAM385 RNA and VGAM386 RNA, herein schematically represented by VGAM1 RNA through VGAM3 RNA, each of which VGAM RNAs corresponding to VGAM RNA of FIG. 1.

VGAM382 RNA, herein schematically represented by VGAM1 RNA through VGAM3 RNA, binds complementarily to a host target binding site located in an untranslated region of VGAM382 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM382 host target RNA into VGAM382 host target protein, herein schematically represented by VGAM1 HOST TARGET PROTEIN through VGAM3 HOST TARGET PROTEIN, all of FIG. 1.

VGAM383 RNA, herein schematically represented by VGAM1 RNA through VGAM3 RNA, binds complementarily to a host target binding site located in an untranslated region of VGAM383 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM383 host target RNA into VGAM383 host target protein, herein schematically represented by VGAM1 HOST TARGET PROTEIN through VGAM3 HOST TARGET PROTEIN, all of FIG. 1.

VGAM384 RNA, herein schematically represented by VGAM1 RNA through VGAM3 RNA, binds complementarily to a host target binding site located in an untranslated region of VGAM384 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM384 host target RNA into VGAM384 host target protein, herein schematically represented by VGAM1 HOST TARGET PROTEIN through VGAM3 HOST TARGET PROTEIN, all of FIG. 1.

VGAM385 RNA, herein schematically represented by VGAM1 RNA through VGAM3 RNA, binds complementarily to a host target binding site located in an untranslated region of VGAM385 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM385 host target RNA into VGAM385 host target protein, herein schematically represented by VGAM1 HOST TARGET PROTEIN through VGAM3 HOST TARGET PROTEIN, all of FIG. 1.

VGAM386 RNA, herein schematically represented by VGAM1 RNA through VGAM3 RNA, binds complementarily to a host target binding site located in an untranslated region of VGAM386 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM386 host target RNA into VGAM386 host target protein, herein schematically represented by VGAM1 HOST TARGET PROTEIN through VGAM3 HOST TARGET PROTEIN, all of FIG. 1.

It is appreciated that a function of VGR2798 gene, herein designated VGR GENE, is inhibition of expression of host target genes, as part of a novel viral mechanism of attacking a host. Accordingly, utilities of VGR2798 gene include diagnosis, prevention and treatment of viral infection by Hepatitis A Virus. Specific functions, and accordingly utilities, of VGR2798 gene correlate with, and may be deduced from, the identity of the host target genes, which are inhibited by VGAM RNAs comprised in the 'operon-like' cluster of VGR2798 gene: VGAM382 host target protein, VGAM383 host target protein, VGAM384 host target protein, VGAM385 host target protein and VGAM386 host target protein, herein schematically represented by VGAM1 HOST TARGET PROTEIN through VGAM3 HOST TARGET PROTEIN. The function of these host target genes is elaborated hereinabove with reference to VGAM382, VGAM383, VGAM384, VGAM385 and VGAM386. FIG. 9 further provides a conceptual description of novel bioinformatically detected regulatory viral gene, referred to here as Viral Genomic Record 2799(VGR2799) viral gene, which encodes an 'operon-like' cluster of novel viral micro RNA-like genes, each of which in turn modulates expression of at least one host target gene, the function and utility of which at least one host target gene is known in the art.

VGR2799 gene, herein designated VGR GENE, is a novel bioinformatically detected regulatory, non protein coding, RNA viral gene. The method by which VGR2799 gene was detected is described hereinabove with reference to FIGS. 1-9.

VGR2799 gene encodes VGR2799 precursor RNA, herein designated VGR PRECURSOR RNA, an RNA molecule, typically several hundred nucleotides long.

VGR2799 precursor RNA folds spatially, forming VGR2799 folded precursor RNA, herein designated VGR FOLDED PRECURSOR RNA. It is appreciated that VGR2799 folded precursor RNA comprises a plurality of what is known in the art as 'hairpin' structures. These 'hairpin' structures are due to the fact that the nucleotide sequence of VGR2799 precursor RNA comprises a plurality of segments, the first half of each such segment having a nucleotide sequence which is at least a partial inversed-reversed sequence of the second half thereof, as is well known in the art.

VGR2799 folded precursor RNA is naturally processed by cellular enzymatic activity into at least 5 separate VGAM precursor RNAs, VGAM387 precursor RNA, VGAM388 precursor RNA, VGAM389 precursor RNA, VGAM390 precursor RNA and VGAM391 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM387 RNA, VGAM388 RNA, VGAM389 RNA, VGAM390 RNA and VGAM391 RNA, herein schematically represented by VGAM1 RNA through VGAM3 RNA, each of which VGAM RNAs corresponding to VGAM RNA of FIG. 1.

VGAM387 RNA, herein schematically represented by VGAM1 RNA through VGAM3 RNA, binds complementarily to a host target binding site located in an untranslated region of VGAM387 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM387 host target RNA into VGAM387 host target protein, herein schematically represented by VGAM1 HOST TARGET PROTEIN through VGAM3 HOST TARGET PROTEIN, all of FIG. 1.

VGAM388 RNA, herein schematically represented by VGAM1 RNA through VGAM3 RNA, binds complementarily to a host target binding site located in an untranslated region of VGAM388 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM388 host target RNA into VGAM388 host target protein, herein schematically represented by VGAM1 HOST TARGET PROTEIN through VGAM3 HOST TARGET PROTEIN, all of FIG. 1.

VGAM389 RNA, herein schematically represented by VGAM1 RNA through VGAM3 RNA, binds complementarily to a host target binding site located in an untranslated region of VGAM389 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM389 host target RNA into VGAM389 host target protein, herein schematically represented by VGAM1 HOST TARGET PROTEIN through VGAM3 HOST TARGET PROTEIN, all of FIG. 1.

VGAM390 RNA, herein schematically represented by VGAM1 RNA through VGAM3 RNA, binds complementarily to a host target binding site located in an untranslated region of VGAM390 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM390 host target RNA into VGAM390 host target protein, herein schematically represented by VGAM1 HOST TARGET PROTEIN through VGAM3 HOST TARGET PROTEIN, all of FIG. 1.

VGAM391 RNA, herein schematically represented by VGAM1 RNA through VGAM3 RNA, binds complementarily to a host target binding site located in an untranslated region of VGAM391 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM391 host target RNA into VGAM391 host target protein, herein schematically represented by VGAM1 HOST TARGET PROTEIN through VGAM3 HOST TARGET PROTEIN, all of FIG. 1.

It is appreciated that a function of VGR2799 gene, herein designated VGR GENE, is inhibition of expression of host target genes, as part of a novel viral mechanism of attacking a host. Accordingly, utilities of VGR2799 gene include diagnosis, prevention and treatment of viral infection by Equine Herpesvirus 1. Specific functions, and accordingly utilities, of VGR2799 gene correlate with, and may be deduced from, the identity of the host target genes, which are inhibited by VGAM RNAs comprised in the 'operon-like' cluster of VGR2799 gene: VGAM387 host target protein, VGAM388 host target protein, VGAM389 host target protein, VGAM390 host target protein and VGAM391 host target protein, herein schematically represented by VGAM1 HOST TARGET PROTEIN through VGAM3 HOST TARGET PROTEIN. The function of these host target genes is elaborated hereinabove with reference to VGAM387, VGAM388, VGAM389, VGAM390 and VGAM391. FIG. 9 further provides a conceptual description of novel bioinformatically detected regulatory viral gene, referred to here as Viral Genomic Record 2800(VGR2800) viral gene, which encodes an 'operon-like' cluster of novel viral micro RNA-like genes, each of which in turn modulates expression of at least one host target gene, the function and utility of which at least one host target gene is known in the art.

VGR2800 gene, herein designated VGR GENE, is a novel bioinformatically detected regulatory, non protein coding, RNA viral gene. The method by which VGR2800 gene was detected is described hereinabove with reference to FIGS. 1-9.

VGR2800 gene encodes VGR2800 precursor RNA, herein designated VGR PRECURSOR RNA, an RNA molecule, typically several hundred nucleotides long.

VGR2800 precursor RNA folds spatially, forming VGR2800 folded precursor RNA, herein designated VGR FOLDED PRECURSOR RNA. It is appreciated that VGR2800 folded precursor RNA comprises a plurality of what is known in the art as 'hairpin' structures. These 'hairpin' structures are due to the fact that the nucleotide sequence of VGR2800 precursor RNA comprises a plurality of segments, the first half of each such segment having a nucleotide sequence which is at least a partial inversed-reversed sequence of the second half thereof, as is well known in the art.

VGR2800 folded precursor RNA is naturally processed by cellular enzymatic activity into at least 8 separate VGAM precursor RNAs, VGAM393 precursor RNA, VGAM394 precursor RNA, VGAM395 precursor RNA, VGAM396 precursor RNA, VGAM397 precursor RNA, VGAM398 precursor RNA, VGAM399 precursor RNA and VGAM400 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM393 RNA, VGAM394 RNA, VGAM395 RNA, VGAM396 RNA, VGAM397 RNA, VGAM398 RNA, VGAM399 RNA and VGAM400 RNA, herein schematically represented by VGAM1 RNA through VGAM3 RNA, each of which VGAM RNAs corresponding to VGAM RNA of FIG. 1.

VGAM393 RNA, herein schematically represented by VGAM1 RNA through VGAM3 RNA, binds complementarily to a host target binding site located in an untranslated region of VGAM393 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM393 host target RNA into VGAM393 host target protein, herein schematically represented by VGAM1 HOST TARGET PROTEIN through VGAM3 HOST TARGET PROTEIN, all of FIG. 1.

VGAM394 RNA, herein schematically represented by VGAM1 RNA through VGAM3 RNA, binds complementarily to a host target binding site located in an untranslated region of VGAM394 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM394 host target RNA into VGAM394 host target protein, herein schematically represented by VGAM1 HOST TARGET PROTEIN through VGAM3 HOST TARGET PROTEIN, all of FIG. 1.

VGAM395 RNA, herein schematically represented by VGAM1 RNA through VGAM3 RNA, binds complementarily to a host target binding site located in an untranslated region of VGAM395 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM395 host target RNA into VGAM395 host target protein, herein schematically represented by VGAM1 HOST TARGET PROTEIN through VGAM3 HOST TARGET PROTEIN, all of FIG. 1.

VGAM396 RNA, herein schematically represented by VGAM1 RNA through VGAM3 RNA, binds complementarily to a host target binding site located in an untranslated region of VGAM396 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM396 host target RNA into VGAM396 host target protein, herein schematically represented by VGAM1 HOST TARGET PROTEIN through VGAM3 HOST TARGET PROTEIN, all of FIG. 1.

VGAM397 RNA, herein schematically represented by VGAM1 RNA through VGAM3 RNA, binds complementarily to a host target binding site located in an untranslated region of VGAM397 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM397 host target RNA into VGAM397 host target protein, herein schematically represented by VGAM1 HOST TARGET PROTEIN through VGAM3 HOST TARGET PROTEIN, all of FIG. 1.

VGAM398 RNA, herein schematically represented by VGAM1 RNA through VGAM3 RNA, binds complementarily to a host target binding site located in an untranslated region of VGAM398 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM398 host target RNA into VGAM398 host target protein, herein schematically represented by VGAM1 HOST TARGET PROTEIN through VGAM3 HOST TARGET PROTEIN, all of FIG. 1.

VGAM399 RNA, herein schematically represented by VGAM1 RNA through VGAM3 RNA, binds complementarily to a host target binding site located in an untranslated region of VGAM399 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM399 host target RNA into VGAM399 host target protein, herein schematically represented by VGAM1 HOST TARGET PROTEIN through VGAM3 HOST TARGET PROTEIN, all of FIG. 1.

VGAM400 RNA, herein schematically represented by VGAM1 RNA through VGAM3 RNA, binds complementarily to a host target binding site located in an untranslated region of VGAM400 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM400 host target RNA into VGAM400 host target protein, herein schematically represented by VGAM1 HOST TARGET PROTEIN through VGAM3 HOST TARGET PROTEIN, all of FIG. 1.

It is appreciated that a function of VGR2800 gene, herein designated VGR GENE, is inhibition of expression of host target genes, as part of a novel viral mechanism of attacking a host. Accordingly, utilities of VGR2800 gene include diagnosis, prevention and treatment of viral infection by Cryphonectria Hypovirus 1. Specific functions, and accordingly utilities, of VGR2800 gene correlate with, and may be deduced from, the identity of the host target genes, which are inhibited by VGAM RNAs comprised in the 'operon-like' cluster of VGR2800 gene: VGAM393 host target protein, VGAM394 host target protein, VGAM395 host target protein, VGAM396 host target protein, VGAM397 host target protein, VGAM398 host target protein, VGAM399 host target protein and VGAM400 host target protein, herein schematically represented by VGAM1 HOST TARGET PROTEIN through VGAM3 HOST TARGET PROTEIN. The function of these host target genes is elaborated hereinabove with reference to VGAM393, VGAM394, VGAM395, VGAM396, VGAM397, VGAM398, VGAM399 and VGAM400. FIG. 9 further provides a conceptual description of novel bioinformatically detected regulatory viral gene, referred to here as Viral Genomic Record 2801(VGR2801) viral gene, which encodes an 'operon-like' cluster of novel viral micro RNA-like genes, each of which in turn modulates expression of at least one host target gene, the function and utility of which at least one host target gene is known in the art.

VGR2801 gene, herein designated VGR GENE, is a novel bioinformatically detected regulatory, non protein coding, RNA viral gene. The method by which VGR2801 gene was detected is described hereinabove with reference to FIGS. 1-9.

VGR2801 gene encodes VGR2801 precursor RNA, herein designated VGR PRECURSOR RNA, an RNA molecule, typically several hundred nucleotides long.

VGR2801 precursor RNA folds spatially, forming VGR2801 folded precursor RNA, herein designated VGR FOLDED PRECURSOR RNA. It is appreciated that VGR2801 folded precursor RNA comprises a plurality of what is known in the art as 'hairpin' structures. These 'hairpin' structures are due to the fact that the nucleotide sequence of VGR2801 precursor RNA comprises a plurality of segments, the first half of each such segment having a nucleotide sequence which is at least a partial inversed-reversed sequence of the second half thereof, as is well known in the art.

VGR2801 folded precursor RNA is naturally processed by cellular enzymatic activity into at least 6 separate VGAM precursor RNAs, VGAM401 precursor RNA, VGAM402 precursor RNA, VGAM403 precursor RNA, VGAM404 precursor RNA, VGAM405 precursor RNA and VGAM406 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM401 RNA, VGAM402 RNA, VGAM403 RNA, VGAM404 RNA, VGAM405 RNA and VGAM406 RNA, herein schematically represented by VGAM1 RNA through VGAM3 RNA, each of which VGAM RNAs corresponding to VGAM RNA of FIG. 1.

VGAM401 RNA, herein schematically represented by VGAM1 RNA through VGAM3 RNA, binds complementarily to a host target binding site located in an untranslated region of VGAM401 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM401 host target RNA into VGAM401 host target protein, herein schematically represented by VGAM1 HOST TARGET PROTEIN through VGAM3 HOST TARGET PROTEIN, all of FIG. 1.

VGAM402 RNA, herein schematically represented by VGAM1 RNA through VGAM3 RNA, binds complementarily to a host target binding site located in an untranslated region of VGAM402 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM402 host target RNA into VGAM402 host target protein, herein schematically represented by VGAM1 HOST TARGET PROTEIN through VGAM3 HOST TARGET PROTEIN, all of FIG. 1.

VGAM403 RNA, herein schematically represented by VGAM1 RNA through VGAM3 RNA, binds complementarily to a host target binding site located in an untranslated region of VGAM403 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM403 host target RNA into VGAM403 host target protein, herein schematically represented by VGAM1 HOST TARGET PROTEIN through VGAM3 HOST TARGET PROTEIN, all of FIG. 1.

VGAM404 RNA, herein schematically represented by VGAM1 RNA through VGAM3 RNA, binds complementarily to a host target binding site located in an untranslated region of VGAM404 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM404 host target RNA into VGAM404 host target protein, herein schematically represented by VGAM1 HOST TARGET PROTEIN through VGAM3 HOST TARGET PROTEIN, all of FIG. 1.

VGAM405 RNA, herein schematically represented by VGAM1 RNA through VGAM3 RNA, binds complementarily to a host target binding site located in an untranslated region of VGAM405 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM405 host target RNA into VGAM405 host target protein, herein schematically represented by VGAM1 HOST TARGET PROTEIN through VGAM3 HOST TARGET PROTEIN, all of FIG. 1.

VGAM406 RNA, herein schematically represented by VGAM1 RNA through VGAM3 RNA, binds complementarily to a host target binding site located in an untranslated region of VGAM406 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM406 host target RNA into VGAM406 host target protein, herein schematically represented by VGAM1 HOST TARGET PROTEIN through VGAM3 HOST TARGET PROTEIN, all of FIG. 1.

It is appreciated that a function of VGR2801 gene, herein designated VGR GENE, is inhibition of expression of host target genes, as part of a novel viral mechanism of attacking a host. Accordingly, utilities of VGR2801 gene include diagnosis, prevention and treatment of viral infection by Cryphonectria Hypovirus 1. Specific functions, and accordingly utilities, of VGR2801 gene correlate with, and may be deduced from, the identity of the host target genes, which are inhibited by VGAM RNAs comprised in the 'operon-like' cluster of VGR2801 gene: VGAM401 host target protein, VGAM402 host target protein, VGAM403 host target protein, VGAM404 host target protein, VGAM405 host target protein and VGAM406 host target protein, herein schematically represented by VGAM1 HOST TARGET PROTEIN through VGAM3 HOST TARGET PROTEIN. The function of these host target genes is elaborated hereinabove with reference to VGAM401, VGAM402, VGAM403, VGAM404, VGAM405 and VGAM406. FIG. 9 further provides a conceptual description of novel bioinformatically detected regulatory viral gene, referred to here as Viral Genomic Record 2802(VGR2802) viral gene, which encodes an 'operon-like' cluster of novel viral micro RNA-like genes, each of which in turn modulates expression of at least one host target gene, the function and utility of which at least one host target gene is known in the art.

VGR2802 gene, herein designated VGR GENE, is a novel bioinformatically detected regulatory, non protein coding, RNA viral gene. The method by which VGR2802 gene was detected is described hereinabove with reference to FIGS. 1-9.

VGR2802 gene encodes VGR2802 precursor RNA, herein designated VGR PRECURSOR RNA, an RNA molecule, typically several hundred nucleotides long.

VGR2802 precursor RNA folds spatially, forming VGR2802 folded precursor RNA, herein designated VGR FOLDED PRECURSOR RNA. It is appreciated that VGR2802 folded precursor RNA comprises a plurality of what is known in the art as 'hairpin' structures. These 'hairpin' structures are due to the fact that the nucleotide sequence of VGR2802 precursor RNA comprises a plurality of segments, the first half of each such segment having a nucleotide sequence which is at least a partial inversed-reversed sequence of the second half thereof, as is well known in the art.

VGR2802 folded precursor RNA is naturally processed by cellular enzymatic activity into at least 3 separate VGAM precursor RNAs, VGAM407 precursor RNA, VGAM408 precursor RNA and VGAM409 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM407 RNA, VGAM408 RNA and VGAM409 RNA, herein schematically represented by VGAM1 RNA through VGAM3 RNA, each of which VGAM RNAs corresponding to VGAM RNA of FIG. 1.

VGAM407 RNA, herein schematically represented by VGAM1 RNA through VGAM3 RNA, binds complementarily to a host target binding site located in an untranslated region of VGAM407 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM407 host target RNA into VGAM407 host target protein, herein schematically represented by VGAM1 HOST TARGET PROTEIN through VGAM3 HOST TARGET PROTEIN, all of FIG. 1.

VGAM408 RNA, herein schematically represented by VGAM1 RNA through VGAM3 RNA, binds complementarily to a host target binding site located in an untranslated region of VGAM408 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM408 host target RNA into VGAM408 host target protein, herein schematically represented by VGAM1 HOST TARGET PROTEIN through VGAM3 HOST TARGET PROTEIN, all of FIG. 1.

VGAM409 RNA, herein schematically represented by VGAM1 RNA through VGAM3 RNA, binds complementarily to a host target binding site located in an untranslated region of VGAM409 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM409 host target RNA into VGAM409 host target protein, herein schematically represented by VGAM1 HOST TARGET PROTEIN through VGAM3 HOST TARGET PROTEIN, all of FIG. 1.

It is appreciated that a function of VGR2802 gene, herein designated VGR GENE, is inhibition of expression of host target genes, as part of a novel viral mechanism of attacking a host. Accordingly, utilities of VGR2802 gene include diagnosis, prevention and treatment of viral infection by Melon Necrotic Spot Virus. Specific functions, and accordingly utilities, of VGR2802 gene correlate with, and may be deduced from, the identity of the host target genes, which are inhibited by VGAM RNAs comprised in the 'operon-like' cluster of VGR2802 gene: VGAM407 host target protein, VGAM408 host target protein and VGAM409 host target protein, herein schematically represented by VGAM1 HOST TARGET PROTEIN through VGAM3 HOST TARGET PROTEIN. The function of these host target genes is elaborated hereinabove with reference to VGAM407, VGAM408 and VGAM409. FIG. 9 further provides a conceptual description of novel bioinformatically detected regulatory viral gene, referred to here as Viral Genomic Record 2803(VGR2803) viral gene, which encodes an 'operon-like' cluster of novel viral micro RNA-like genes, each of which in turn modulates expression of at least one host target gene, the function and utility of which at least one host target gene is known in the art.

VGR2803 gene, herein designated VGR GENE, is a novel bioinformatically detected regulatory, non protein coding, RNA viral gene. The method by which VGR2803 gene was detected is described hereinabove with reference to FIGS. 1-9.

VGR2803 gene encodes VGR2803 precursor RNA, herein designated VGR PRECURSOR RNA, an RNA molecule, typically several hundred nucleotides long.

VGR2803 precursor RNA folds spatially, forming VGR2803 folded precursor RNA, herein designated VGR FOLDED PRECURSOR RNA. It is appreciated that VGR2803 folded precursor RNA comprises a plurality of what is known in the art as 'hairpin' structures. These 'hairpin' structures are due to the fact that the nucleotide sequence of VGR2803 precursor RNA comprises a plurality of segments, the first half of each such segment having a nucleotide sequence which is at least a partial inversed-reversed sequence of the second half thereof, as is well known in the art.

VGR2803 folded precursor RNA is naturally processed by cellular enzymatic activity into at least 3 separate VGAM precursor RNAs, VGAM410 precursor RNA, VGAM411 precursor RNA and VGAM412 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM410 RNA, VGAM411 RNA and VGAM412 RNA, herein schematically represented by VGAM1 RNA through VGAM3 RNA, each of which VGAM RNAs corresponding to VGAM RNA of FIG. 1.

VGAM410 RNA, herein schematically represented by VGAM1 RNA through VGAM3 RNA, binds complementarily to a host target binding site located in an untranslated region of VGAM410 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM410 host target RNA into VGAM410 host target protein, herein schematically represented by VGAM1 HOST TARGET PROTEIN through VGAM3 HOST TARGET PROTEIN, all of FIG. 1.

VGAM411 RNA, herein schematically represented by VGAM1 RNA through VGAM3 RNA, binds complementarily to a host target binding site located in an untranslated region of VGAM411 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM411 host target RNA into VGAM411 host target protein, herein schematically represented by VGAM1 HOST TARGET PROTEIN through VGAM3 HOST TARGET PROTEIN, all of FIG. 1.

VGAM412 RNA, herein schematically represented by VGAM1 RNA through VGAM3 RNA, binds complementarily to a host target binding site located in an untranslated region of VGAM412 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM412 host target RNA into VGAM412 host target protein, herein schematically represented by VGAM1 HOST TARGET PROTEIN through VGAM3 HOST TARGET PROTEIN, all of FIG. 1.

It is appreciated that a function of VGR2803 gene, herein designated VGR GENE, is inhibition of expression of host target genes, as part of a novel viral mechanism of attacking a host. Accordingly, utilities of VGR2803 gene include diagnosis, prevention and treatment of viral infection by O'nyong-nyong Virus. Specific functions, and accordingly utilities, of VGR2803 gene correlate with, and may be deduced from, the identity of the host target genes, which are inhibited by VGAM RNAs comprised in the 'operon-like' cluster of VGR2803 gene: VGAM410 host target protein, VGAM411 host target protein and VGAM412 host target protein, herein schematically represented by VGAM1 HOST TARGET PROTEIN through VGAM3 HOST TARGET PROTEIN. The function of these host target genes is elaborated hereinabove with reference to VGAM410, VGAM411 and VGAM412. FIG. 9 further provides a conceptual description of novel bioinformatically detected regulatory viral gene, referred to here as Viral Genomic Record 2804(VGR2804) viral gene, which encodes an 'operon-like' cluster of novel viral micro RNA-like genes, each of which in turn modulates expression of at least one host target gene, the function and utility of which at least one host target gene is known in the art.

VGR2804 gene, herein designated VGR GENE, is a novel bioinformatically detected regulatory, non protein coding, RNA viral gene. The method by which VGR2804 gene was detected is described hereinabove with reference to FIGS. 1-9.

VGR2804 gene encodes VGR2804 precursor RNA, herein designated VGR PRECURSOR RNA, an RNA molecule, typically several hundred nucleotides long.

VGR2804 precursor RNA folds spatially, forming VGR2804 folded precursor RNA, herein designated VGR FOLDED PRECURSOR RNA. It is appreciated that VGR2804 folded precursor RNA comprises a plurality of what is known in the art as 'hairpin' structures. These 'hairpin' structures are due to the fact that the nucleotide sequence of VGR2804 precursor RNA comprises a plurality of segments, the first half of each such segment having a nucleotide sequence which is at least a partial inversed-reversed sequence of the second half thereof, as is well known in the art.

VGR2804 folded precursor RNA is naturally processed by cellular enzymatic activity into at least 7 separate VGAM precursor RNAs, VGAM413 precursor RNA, VGAM414 precursor RNA, VGAM415 precursor RNA, VGAM416 precursor RNA, VGAM417 precursor RNA, VGAM418 precursor RNA and VGAM419 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM413 RNA, VGAM414 RNA, VGAM415 RNA, VGAM416 RNA, VGAM417 RNA, VGAM418 RNA and VGAM419 RNA, herein schematically represented by VGAM1 RNA through VGAM3 RNA, each of which VGAM RNAs corresponding to VGAM RNA of FIG. 1.

VGAM413 RNA, herein schematically represented by VGAM1 RNA through VGAM3 RNA, binds complementarily to a host target binding site located in an untranslated region of VGAM413 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM413 host target RNA into VGAM413 host target protein, herein schematically represented by VGAM1 HOST TARGET PROTEIN through VGAM3 HOST TARGET PROTEIN, all of FIG. 1.

VGAM414 RNA, herein schematically represented by VGAM1 RNA through VGAM3 RNA, binds complementarily to a host target binding site located in an untranslated region of VGAM414 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM414 host target RNA into VGAM414 host target protein, herein schematically represented by VGAM1 HOST TARGET PROTEIN through VGAM3 HOST TARGET PROTEIN, all of FIG. 1.

VGAM415 RNA, herein schematically represented by VGAM1 RNA through VGAM3 RNA, binds complementarily to a host target binding site located in an untranslated region of VGAM415 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM415 host target RNA into VGAM415 host target protein, herein schematically represented by VGAM1 HOST TARGET PROTEIN through VGAM3 HOST TARGET PROTEIN, all of FIG. 1.

VGAM416 RNA, herein schematically represented by VGAM1 RNA through VGAM3 RNA, binds complementarily to a host target binding site located in an untranslated region of VGAM416 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM416 host target RNA into VGAM416 host target protein, herein schematically represented by VGAM1 HOST TARGET PROTEIN through VGAM3 HOST TARGET PROTEIN, all of FIG. 1.

VGAM417 RNA, herein schematically represented by VGAM1 RNA through VGAM3 RNA, binds complementarily to a host target binding site located in an untranslated region of VGAM417 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM417 host target RNA into VGAM417 host target protein, herein schematically represented by VGAM1 HOST TARGET PROTEIN through VGAM3 HOST TARGET PROTEIN, all of FIG. 1.

VGAM418 RNA, herein schematically represented by VGAM1 RNA through VGAM3 RNA, binds complementarily to a host target binding site located in an untranslated region of VGAM418 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM418 host target RNA into VGAM418 host target protein, herein schematically represented by VGAM1 HOST TARGET PROTEIN through VGAM3 HOST TARGET PROTEIN, all of FIG. 1.

VGAM419 RNA, herein schematically represented by VGAM1 RNA through VGAM3 RNA, binds complementarily to a host target binding site located in an untranslated region of VGAM419 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM419 host target RNA into VGAM419 host target protein, herein schematically represented by VGAM1 HOST TARGET PROTEIN through VGAM3 HOST TARGET PROTEIN, all of FIG. 1.

It is appreciated that a function of VGR2804 gene, herein designated VGR GENE, is inhibition of expression of host target genes, as part of a novel viral mechanism of attacking a host. Accordingly, utilities of VGR2804 gene include diagnosis, prevention and treatment of viral infection by Pepper Mottle Virus. Specific functions, and accordingly utilities, of VGR2804 gene correlate with, and may be deduced from, the identity of the host target genes, which are inhibited by VGAM RNAs comprised in the 'operon-like' cluster of VGR2804 gene: VGAM413 host target protein, VGAM414 host target protein, VGAM415 host target protein, VGAM416 host target protein, VGAM417 host target protein, VGAM418 host target protein and VGAM419 host target protein, herein schematically represented by VGAM1 HOST TARGET PROTEIN through VGAM3 HOST TARGET PROTEIN. The function of these host target genes is elaborated hereinabove with reference to VGAM413, VGAM414, VGAM415, VGAM416, VGAM417, VGAM418 and VGAM419. FIG. 9 further provides a conceptual description of novel bioinformatically detected regulatory viral gene, referred to here as Viral Genomic Record 2805(VGR2805) viral gene, which encodes an 'operon-like' cluster of novel viral micro RNA-like genes, each of which in turn modulates expression of at least one host target gene, the function and utility of which at least one host target gene is known in the art.

VGR2805 gene, herein designated VGR GENE, is a novel bioinformatically detected regulatory, non protein coding, RNA viral gene. The method by which VGR2805 gene was detected is described hereinabove with reference to FIGS. 1-9.

VGR2805 gene encodes VGR2805 precursor RNA, herein designated VGR PRECURSOR RNA, an RNA molecule, typically several hundred nucleotides long.

VGR2805 precursor RNA folds spatially, forming VGR2805 folded precursor RNA, herein designated VGR FOLDED PRECURSOR RNA. It is appreciated that VGR2805 folded precursor RNA comprises a plurality of what is known in the art as 'hairpin' structures. These 'hairpin' structures are due to the fact that the nucleotide sequence of VGR2805 precursor RNA comprises a plurality of segments, the first half of each such segment having a nucleotide sequence which is at least a partial inversed-reversed sequence of the second half thereof, as is well known in the art.

VGR2805 folded precursor RNA is naturally processed by cellular enzymatic activity into at least 2 separate VGAM precursor RNAs, VGAM420 precursor RNA and VGAM421 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM420 RNA and VGAM421 RNA, herein schematically represented by VGAM1 RNA through VGAM3 RNA, each of which VGAM RNAs corresponding to VGAM RNA of FIG. 1.

VGAM420 RNA, herein schematically represented by VGAM1 RNA through VGAM3 RNA, binds complementarily to a host target binding site located in an untranslated region of VGAM420 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM420 host target RNA into VGAM420 host target protein, herein schematically represented by VGAM1 HOST TARGET PROTEIN through VGAM3 HOST TARGET PROTEIN, all of FIG. 1.

VGAM421 RNA, herein schematically represented by VGAM1 RNA through VGAM3 RNA, binds complementarily to a host target binding site located in an untranslated region of VGAM421 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM421 host target RNA into VGAM421 host target protein, herein schematically represented by VGAM1 HOST TARGET PROTEIN through VGAM3 HOST TARGET PROTEIN, all of FIG. 1.

It is appreciated that a function of VGR2805 gene, herein designated VGR GENE, is inhibition of expression of host target genes, as part of a novel viral mechanism of attacking a host. Accordingly, utilities of VGR2805 gene include diagnosis, prevention and treatment of viral infection by Human Papillomavirus Type 39. Specific functions, and accordingly utilities, of VGR2805 gene correlate with, and may be deduced from, the identity of the host target genes, which are inhibited by VGAM RNAs comprised in the 'operon-like' cluster of VGR2805 gene: VGAM420 host target protein and VGAM421 host target protein, herein schematically represented by VGAM1 HOST TARGET PROTEIN through VGAM3 HOST TARGET PROTEIN. The function of these host target genes is elaborated hereinabove with reference to VGAM420 and VGAM421. FIG. 9 further provides a conceptual description of novel bioinformatically detected regulatory viral gene, referred to here as Viral Genomic Record 2806(VGR2806) viral gene, which encodes an 'operon-like' cluster of novel viral micro RNA-like genes, each of which in turn modulates expression of at least one host target gene, the function and utility of which at least one host target gene is known in the art.

VGR2806 gene, herein designated VGR GENE, is a novel bioinformatically detected regulatory, non protein coding, RNA viral gene. The method by which VGR2806 gene was detected is described hereinabove with reference to FIGS. 1-9.

VGR2806 gene encodes VGR2806 precursor RNA, herein designated VGR PRECURSOR RNA, an RNA molecule, typically several hundred nucleotides long.

VGR2806 precursor RNA folds spatially, forming VGR2806 folded precursor RNA, herein designated VGR FOLDED PRECURSOR RNA. It is appreciated that VGR2806 folded precursor RNA comprises a plurality of what is known in the art as 'hairpin' structures. These 'hairpin' structures are due to the fact that the nucleotide sequence of VGR2806 precursor RNA comprises a plurality of segments, the first half of each such segment having a nucleotide sequence which is at least a partial inversed-reversed sequence of the second half thereof, as is well known in the art.

VGR2806 folded precursor RNA is naturally processed by cellular enzymatic activity into at least 2 separate VGAM precursor RNAs, VGAM422 precursor RNA and VGAM423 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM422 RNA and VGAM423 RNA, herein schematically represented by VGAM1 RNA through VGAM3 RNA, each of which VGAM RNAs corresponding to VGAM RNA of FIG. 1.

VGAM422 RNA, herein schematically represented by VGAM1 RNA through VGAM3 RNA, binds complementarily to a host target binding site located in an untranslated region of VGAM422 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM422 host target RNA into VGAM422 host target protein, herein schematically represented by VGAM1 HOST TARGET PROTEIN through VGAM3 HOST TARGET PROTEIN, all of FIG. 1.

VGAM423 RNA, herein schematically represented by VGAM1 RNA through VGAM3 RNA, binds complementarily to a host target binding site located in an untranslated region of VGAM423 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM423 host target RNA into VGAM423 host target protein, herein schematically represented by VGAM1 HOST TARGET PROTEIN through VGAM3 HOST TARGET PROTEIN, all of FIG. 1.

It is appreciated that a function of VGR2806 gene, herein designated VGR GENE, is inhibition of expression of host target genes, as part of a novel viral mechanism of attacking a host. Accordingly, utilities of VGR2806 gene include diagnosis, prevention and treatment of viral infection by Canine Parvovirus. Specific functions, and accordingly utilities, of VGR2806 gene correlate with, and may be deduced from, the identity of the host target genes, which are inhibited by VGAM RNAs comprised in the 'operon-like' cluster of VGR2806 gene: VGAM422 host target protein and VGAM423 host target protein, herein schematically represented by VGAM1 HOST TARGET PROTEIN through VGAM3 HOST TARGET PROTEIN. The function of these host target genes is elaborated hereinabove with reference to VGAM422 and VGAM423. FIG. 9 further provides a conceptual description of novel bioinformatically detected regulatory viral gene, referred to here as Viral Genomic Record 2807(VGR2807) viral gene, which encodes an 'operon-like' cluster of novel viral micro RNA-like genes, each of which in turn modulates expression of at least one host target gene, the function and utility of which at least one host target gene is known in the art.

VGR2807 gene, herein designated VGR GENE, is a novel bioinformatically detected regulatory, non protein coding, RNA viral gene. The method by which VGR2807 gene was detected is described hereinabove with reference to FIGS. 1-9.

VGR2807 gene encodes VGR2807 precursor RNA, herein designated VGR PRECURSOR RNA, an RNA molecule, typically several hundred nucleotides long.

VGR2807 precursor RNA folds spatially, forming VGR2807 folded precursor RNA, herein designated VGR FOLDED PRECURSOR RNA. It is appreciated that VGR2807 folded precursor RNA comprises a plurality of what is known in the art as 'hairpin' structures. These 'hairpin' structures are due to the fact that the nucleotide sequence of VGR2807 precursor RNA comprises a plurality of segments, the first half of each such segment having a nucleotide sequence which is at least a partial inversed-reversed sequence of the second half thereof, as is well known in the art.

VGR2807 folded precursor RNA is naturally processed by cellular enzymatic activity into at least 5 separate VGAM precursor RNAs, VGAM424 precursor RNA, VGAM425 precursor RNA, VGAM426 precursor RNA, VGAM427 precursor RNA and VGAM428 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM424 RNA, VGAM425 RNA, VGAM426 RNA, VGAM427 RNA and VGAM428 RNA, herein schematically represented by VGAM1 RNA through VGAM3 RNA, each of which VGAM RNAs corresponding to VGAM RNA of FIG. 1.

VGAM424 RNA, herein schematically represented by VGAM1 RNA through VGAM3 RNA, binds complementarily to a host target binding site located in an untranslated region of VGAM424 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM424 host target RNA into VGAM424 host target protein, herein schematically represented by VGAM1 HOST TARGET PROTEIN through VGAM3 HOST TARGET PROTEIN, all of FIG. 1.

VGAM425 RNA, herein schematically represented by VGAM1 RNA through VGAM3 RNA, binds complementarily to a host target binding site located in an untranslated region of VGAM425 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM425 host target RNA into VGAM425 host target protein, herein schematically represented by VGAM1 HOST TARGET PROTEIN through VGAM3 HOST TARGET PROTEIN, all of FIG. 1.

VGAM426 RNA, herein schematically represented by VGAM1 RNA through VGAM3 RNA, binds complementarily to a host target binding site located in an untranslated region of VGAM426 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM426 host target RNA into VGAM426 host target protein, herein schematically represented by VGAM1 HOST TARGET PROTEIN through VGAM3 HOST TARGET PROTEIN, all of FIG. 1.

VGAM427 RNA, herein schematically represented by VGAM1 RNA through VGAM3 RNA, binds complementarily to a host target binding site located in an untranslated region of VGAM427 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM427 host target RNA into VGAM427 host target protein, herein schematically represented by VGAM1 HOST TARGET PROTEIN through VGAM3 HOST TARGET PROTEIN, all of FIG. 1.

VGAM428 RNA, herein schematically represented by VGAM1 RNA through VGAM3 RNA, binds complementarily to a host target binding site located in an untranslated region of VGAM428 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM428 host target RNA into VGAM428 host target protein, herein schematically represented by VGAM1 HOST TARGET PROTEIN through VGAM3 HOST TARGET PROTEIN, all of FIG. 1.

It is appreciated that a function of VGR2807 gene, herein designated VGR GENE, is inhibition of expression of host target genes, as part of a novel viral mechanism of attacking a host. Accordingly, utilities of VGR2807 gene include diagnosis, prevention and treatment of viral infection by Rabies Virus. Specific functions, and accordingly utilities, of VGR2807 gene correlate with, and may be deduced from, the identity of the host target genes, which are inhibited by VGAM RNAs comprised in the 'operon-like' cluster of VGR2807 gene: VGAM424 host target protein, VGAM425 host target protein, VGAM426 host target protein, VGAM427 host target protein and VGAM428 host target protein, herein schematically represented by VGAM1 HOST TARGET PROTEIN through VGAM3 HOST TARGET PROTEIN. The function of these host target genes is elaborated hereinabove with reference to VGAM424, VGAM425, VGAM426, VGAM427 and VGAM428. FIG. 9 further provides a conceptual description of novel bioinformatically detected regulatory viral gene, referred to here as Viral Genomic Record 2808(VGR2808) viral gene, which encodes an 'operon-like' cluster of novel viral micro RNA-like genes, each of which in turn modulates expression of at least one host target gene, the function and utility of which at least one host target gene is known in the art.

VGR2808 gene, herein designated VGR GENE, is a novel bioinformatically detected regulatory, non protein coding, RNA viral gene. The method by which VGR2808 gene was detected is described hereinabove with reference to FIGS. 1-9.

VGR2808 gene encodes VGR2808 precursor RNA, herein designated VGR PRECURSOR RNA, an RNA molecule, typically several hundred nucleotides long.

VGR2808 precursor RNA folds spatially, forming VGR2808 folded precursor RNA, herein designated VGR FOLDED PRECURSOR RNA. It is appreciated that VGR2808 folded precursor RNA comprises a plurality of what is known in the art as 'hairpin' structures. These 'hairpin' structures are due to the fact that the nucleotide sequence of VGR2808 precursor RNA comprises a plurality of segments, the first half of each such segment having a nucleotide sequence which is at least a partial inversed-reversed sequence of the second half thereof, as is well known in the art.

VGR2808 folded precursor RNA is naturally processed by cellular enzymatic activity into at least 5 separate VGAM precursor RNAs, VGAM429 precursor RNA, VGAM430 precursor RNA, VGAM431 precursor RNA, VGAM432 precursor RNA and VGAM433 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM429 RNA, VGAM430 RNA, VGAM431 RNA, VGAM432 RNA and VGAM433 RNA, herein schematically represented by VGAM1 RNA through VGAM3 RNA, each of which VGAM RNAs corresponding to VGAM RNA of FIG. 1.

VGAM429 RNA, herein schematically represented by VGAM1 RNA through VGAM3 RNA, binds complementarily to a host target binding site located in an untranslated region of VGAM429 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM429 host target RNA into VGAM429 host target protein, herein schematically represented by VGAM1 HOST TARGET PROTEIN through VGAM3 HOST TARGET PROTEIN, all of FIG. 1.

VGAM430 RNA, herein schematically represented by VGAM1 RNA through VGAM3 RNA, binds complementarily to a host target binding site located in an untranslated region of VGAM430 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM430 host target RNA into VGAM430 host target protein, herein schematically represented by VGAM1 HOST TARGET PROTEIN through VGAM3 HOST TARGET PROTEIN, all of FIG. 1.

VGAM431 RNA, herein schematically represented by VGAM1 RNA through VGAM3 RNA, binds complementarily to a host target binding site located in an untranslated region of VGAM431 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM431 host target RNA into VGAM431 host target protein, herein schematically represented by VGAM1 HOST TARGET PROTEIN through VGAM3 HOST TARGET PROTEIN, all of FIG. 1.

VGAM432 RNA, herein schematically represented by VGAM1 RNA through VGAM3 RNA, binds complementarily to a host target binding site located in an untranslated region of VGAM432 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM432 host target RNA into VGAM432 host target protein, herein schematically represented by VGAM1 HOST TARGET PROTEIN through VGAM3 HOST TARGET PROTEIN, all of FIG. 1.

VGAM433 RNA, herein schematically represented by VGAM1 RNA through VGAM3 RNA, binds complementarily to a host target binding site located in an untranslated region of VGAM433 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM433 host target RNA into VGAM433 host target protein, herein schematically represented by VGAM1 HOST TARGET PROTEIN through VGAM3 HOST TARGET PROTEIN, all of FIG. 1.

It is appreciated that a function of VGR2808 gene, herein designated VGR GENE, is inhibition of expression of host target genes, as part of a novel viral mechanism of attacking a host. Accordingly, utilities of VGR2808 gene include diagnosis, prevention and treatment of viral infection by Rabbit Hemorrhagic Disease Virus. Specific functions, and accordingly utilities, of VGR2808 gene correlate with, and may be deduced from, the identity of the host target genes, which are inhibited by VGAM RNAs comprised in the 'operon-like' cluster of VGR2808 gene: VGAM429 host target protein, VGAM430 host target protein, VGAM431 host target protein, VGAM432 host target protein and VGAM433 host target protein, herein schematically represented by VGAM1 HOST TARGET PROTEIN through VGAM3 HOST TARGET PROTEIN. The function of these host target genes is elaborated hereinabove with reference to VGAM429, VGAM430, VGAM431, VGAM432 and VGAM433. FIG. 9 further provides a conceptual description of novel bioinformatically detected regulatory viral gene, referred to here as Viral Genomic Record 2809(VGR2809) viral gene, which encodes an 'operon-like' cluster of novel viral micro RNA-like genes, each of which in turn modulates expression of at least one host target gene, the function and utility of which at least one host target gene is known in the art.

VGR2809 gene, herein designated VGR GENE, is a novel bioinformatically detected regulatory, non protein coding, RNA viral gene. The method by which VGR2809 gene was detected is described hereinabove with reference to FIGS. 1-9.

VGR2809 gene encodes VGR2809 precursor RNA, herein designated VGR PRECURSOR RNA, an RNA molecule, typically several hundred nucleotides long.

VGR2809 precursor RNA folds spatially, forming VGR2809 folded precursor RNA, herein designated VGR FOLDED PRECURSOR RNA. It is appreciated that VGR2809 folded precursor RNA comprises a plurality of what is known in the art as 'hairpin' structures. These 'hairpin' structures are due to the fact that the nucleotide sequence of VGR2809 precursor RNA comprises a plurality of segments, the first half of each such segment having a nucleotide sequence which is at least a partial inversed-reversed sequence of the second half thereof, as is well known in the art.

VGR2809 folded precursor RNA is naturally processed by cellular enzymatic activity into at least 3 separate VGAM precursor RNAs, VGAM434 precursor RNA, VGAM435 precursor RNA and VGAM436 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM434 RNA, VGAM435 RNA and VGAM436 RNA, herein schematically represented by VGAM1 RNA through VGAM3 RNA, each of which VGAM RNAs corresponding to VGAM RNA of FIG. 1.

VGAM434 RNA, herein schematically represented by VGAM1 RNA through VGAM3 RNA, binds complementarily to a host target binding site located in an untranslated region of VGAM434 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM434 host target RNA into VGAM434 host target protein, herein schematically represented by VGAM1 HOST TARGET PROTEIN through VGAM3 HOST TARGET PROTEIN, all of FIG. 1.

VGAM435 RNA, herein schematically represented by VGAM1 RNA through VGAM3 RNA, binds complementarily to a host target binding site located in an untranslated region of VGAM435 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM435 host target RNA into VGAM435 host target protein, herein schematically represented by VGAM1 HOST TARGET PROTEIN through VGAM3 HOST TARGET PROTEIN, all of FIG. 1.

VGAM436 RNA, herein schematically represented by VGAM1 RNA through VGAM3 RNA, binds complementarily to a host target binding site located in an untranslated region of VGAM436 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM436 host target RNA into VGAM436 host target protein, herein schematically represented by VGAM1 HOST TARGET PROTEIN through VGAM3 HOST TARGET PROTEIN, all of FIG. 1.

It is appreciated that a function of VGR2809 gene, herein designated VGR GENE, is inhibition of expression of host target genes, as part of a novel viral mechanism of attacking a host. Accordingly, utilities of VGR2809 gene include diagnosis, prevention and treatment of viral infection by Sendai Virus. Specific functions, and accordingly utilities, of VGR2809 gene correlate with, and may be deduced from, the identity of the host target genes, which are inhibited by VGAM RNAs comprised in the 'operon-like' cluster of VGR2809 gene: VGAM434 host target protein, VGAM435 host target protein and VGAM436 host target protein, herein schematically represented by VGAM1 HOST TARGET PROTEIN through VGAM3 HOST TARGET PROTEIN. The function of these host target genes is elaborated hereinabove with reference to VGAM434, VGAM435 and VGAM436. FIG. 9 further provides a conceptual description of novel bioinformatically detected regulatory viral gene, referred to here as Viral Genomic Record 2810(VGR2810) viral gene, which encodes an 'operon-like' cluster of novel viral micro RNA-like genes, each of which in turn modulates expression of at least one host target gene, the function and utility of which at least one host target gene is known in the art.

VGR2810 gene, herein designated VGR GENE, is a novel bioinformatically detected regulatory, non protein coding, RNA viral gene. The method by which VGR2810 gene was detected is described hereinabove with reference to FIGS. 1-9.

VGR2810 gene encodes VGR2810 precursor RNA, herein designated VGR PRECURSOR RNA, an RNA molecule, typically several hundred nucleotides long.

VGR2810 precursor RNA folds spatially, forming VGR2810 folded precursor RNA, herein designated VGR FOLDED PRECURSOR RNA. It is appreciated that VGR2810 folded precursor RNA comprises a plurality of what is known in the art as 'hairpin' structures. These 'hairpin' structures are due to the fact that the nucleotide sequence of VGR2810 precursor RNA comprises a plurality of segments, the first half of each such segment having a nucleotide sequence which is at least a partial inversed-reversed sequence of the second half thereof, as is well known in the art.

VGR2810 folded precursor RNA is naturally processed by cellular enzymatic activity into at least 3 separate VGAM precursor RNAs, VGAM437 precursor RNA, VGAM438 precursor RNA and VGAM439 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM437 RNA, VGAM438 RNA and VGAM439 RNA, herein schematically represented by VGAM1 RNA through VGAM3 RNA, each of which VGAM RNAs corresponding to VGAM RNA of FIG. 1.

VGAM437 RNA, herein schematically represented by VGAM1 RNA through VGAM3 RNA, binds complementarily to a host target binding site located in an untranslated region of VGAM437 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM437 host target RNA into VGAM437 host target protein, herein schematically represented by VGAM1 HOST TARGET PROTEIN through VGAM3 HOST TARGET PROTEIN, all of FIG. 1.

VGAM438 RNA, herein schematically represented by VGAM1 RNA through VGAM3 RNA, binds complementarily to a host target binding site located in an untranslated region of VGAM438 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM438 host target RNA into VGAM438 host target protein, herein schematically represented by VGAM1 HOST TARGET PROTEIN through VGAM3 HOST TARGET PROTEIN, all of FIG. 1.

VGAM439 RNA, herein schematically represented by VGAM1 RNA through VGAM3 RNA, binds complementarily to a host target binding site located in an untranslated region of VGAM439 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM439 host target RNA into VGAM439 host target protein, herein schematically represented by VGAM1 HOST TARGET PROTEIN through VGAM3 HOST TARGET PROTEIN, all of FIG. 1.

It is appreciated that a function of VGR2810 gene, herein designated VGR GENE, is inhibition of expression of host target genes, as part of a novel viral mechanism of attacking a host. Accordingly, utilities of VGR2810 gene include diagnosis, prevention and treatment of viral infection by Tomato Bushy Stunt Virus. Specific functions, and accordingly utilities, of VGR2810 gene correlate with, and may be deduced from, the identity of the host target genes, which are inhibited by VGAM RNAs comprised in the 'operon-like' cluster of VGR2810 gene: VGAM437 host target protein, VGAM438 host target protein and VGAM439 host target protein, herein schematically represented by VGAM1 HOST TARGET PROTEIN through VGAM3 HOST TARGET PROTEIN. The function of these host target genes is elaborated hereinabove with reference to VGAM437, VGAM438 and VGAM439. FIG. 9 further provides a conceptual description of novel bioinformatically detected regulatory viral gene, referred to here as Viral Genomic Record 2811(VGR2811) viral gene, which encodes an 'operon-like' cluster of novel viral micro RNA-like genes, each of which in turn modulates expression of at least one host target gene, the function and utility of which at least one host target gene is known in the art.

VGR2811 gene, herein designated VGR GENE, is a novel bioinformatically detected regulatory, non protein coding, RNA viral gene. The method by which VGR2811 gene was detected is described hereinabove with reference to FIGS. 1-9.

VGR2811 gene encodes VGR2811 precursor RNA, herein designated VGR PRECURSOR RNA, an RNA molecule, typically several hundred nucleotides long.

VGR2811 precursor RNA folds spatially, forming VGR2811 folded precursor RNA, herein designated VGR FOLDED PRECURSOR RNA. It is appreciated that VGR2811 folded precursor RNA comprises a plurality of what is known in the art as 'hairpin' structures. These 'hairpin' structures are due to the fact that the nucleotide sequence of VGR2811 precursor RNA comprises a plurality of segments, the first half of each such segment having a nucleotide sequence which is at least a partial inversed-reversed sequence of the second half thereof, as is well known in the art.

VGR2811 folded precursor RNA is naturally processed by cellular enzymatic activity into at least 2 separate VGAM precursor RNAs, VGAM441 precursor RNA and VGAM442 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM441 RNA and VGAM442 RNA, herein schematically represented by VGAM1 RNA through VGAM3 RNA, each of which VGAM RNAs corresponding to VGAM RNA of FIG. 1.

VGAM441 RNA, herein schematically represented by VGAM1 RNA through VGAM3 RNA, binds complementarily to a host target binding site located in an untranslated region of VGAM441 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM441 host target RNA into VGAM441 host target protein, herein schematically represented by VGAM1 HOST TARGET PROTEIN through VGAM3 HOST TARGET PROTEIN, all of FIG. 1.

VGAM442 RNA, herein schematically represented by VGAM1 RNA through VGAM3 RNA, binds complementarily to a host target binding site located in an untranslated region of VGAM442 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM442 host target RNA into VGAM442 host target protein, herein schematically represented by VGAM1 HOST TARGET PROTEIN through VGAM3 HOST TARGET PROTEIN, all of FIG. 1.

It is appreciated that a function of VGR2811 gene, herein designated VGR GENE, is inhibition of expression of host target genes, as part of a novel viral mechanism of attacking a host. Accordingly, utilities of VGR2811 gene include diagnosis, prevention and treatment of viral infection by Vaccinia Virus. Specific functions, and accordingly utilities, of VGR2811 gene correlate with, and may be deduced from, the identity of the host target genes, which are inhibited by VGAM RNAs comprised in the 'operon-like' cluster of VGR2811 gene: VGAM441 host target protein and VGAM442 host target protein, herein schematically represented by VGAM1 HOST TARGET PROTEIN through VGAM3 HOST TARGET PROTEIN. The function of these host target genes is elaborated hereinabove with reference to VGAM441 and VGAM442. FIG. 9 further provides a conceptual description of novel bioinformatically detected regulatory viral gene, referred to here as Viral Genomic Record 2812(VGR2812) viral gene, which encodes an 'operon-like' cluster of novel viral micro RNA-like genes, each of which in turn modulates expression of at least one host target gene, the function and utility of which at least one host target gene is known in the art.

VGR2812 gene, herein designated VGR GENE, is a novel bioinformatically detected regulatory, non protein coding, RNA viral gene. The method by which VGR2812 gene was detected is described hereinabove with reference to FIGS. 1-9.

VGR2812 gene encodes VGR2812 precursor RNA, herein designated VGR PRECURSOR RNA, an RNA molecule, typically several hundred nucleotides long.

VGR2812 precursor RNA folds spatially, forming VGR2812 folded precursor RNA, herein designated VGR FOLDED PRECURSOR RNA. It is appreciated that VGR2812 folded precursor RNA comprises a plurality of what is known in the art as 'hairpin' structures. These 'hairpin' structures are due to the fact that the nucleotide sequence of VGR2812 precursor RNA comprises a plurality of segments, the first half of each such segment having a nucleotide sequence which is at least a partial inversed-reversed sequence of the second half thereof, as is well known in the art.

VGR2812 folded precursor RNA is naturally processed by cellular enzymatic activity into at least 2 separate VGAM precursor RNAs, VGAM443 precursor RNA and VGAM444 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM443 RNA and VGAM444 RNA, herein schematically represented by VGAM1 RNA through VGAM3 RNA, each of which VGAM RNAs corresponding to VGAM RNA of FIG. 1.

VGAM443 RNA, herein schematically represented by VGAM1 RNA through VGAM3 RNA, binds complementarily to a host target binding site located in an untranslated region of VGAM443 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM443 host target RNA into VGAM443 host target protein, herein schematically represented by VGAM1 HOST TARGET PROTEIN through VGAM3 HOST TARGET PROTEIN, all of FIG. 1.

VGAM444 RNA, herein schematically represented by VGAM1 RNA through VGAM3 RNA, binds complementarily to a host target binding site located in an untranslated region of VGAM444 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM444 host target RNA into VGAM444 host target protein, herein schematically represented by VGAM1 HOST TARGET PROTEIN through VGAM3 HOST TARGET PROTEIN, all of FIG. 1.

It is appreciated that a function of VGR2812 gene, herein designated VGR GENE, is inhibition of expression of host target genes, as part of a novel viral mechanism of attacking a host. Accordingly, utilities of VGR2812 gene include diagnosis, prevention and treatment of viral infection by Vaccinia Virus. Specific functions, and accordingly utilities, of VGR2812 gene correlate with, and may be deduced from, the identity of the host target genes, which are inhibited by VGAM RNAs comprised in the 'operon-like' cluster of VGR2812 gene: VGAM443 host target protein and VGAM444 host target protein, herein schematically represented by VGAM1 HOST TARGET PROTEIN through VGAM3 HOST TARGET PROTEIN. The function of these host target genes is elaborated hereinabove with reference to VGAM443 and VGAM444. FIG. 9 further provides a conceptual description of novel bioinformatically detected regulatory viral gene, referred to here as Viral Genomic Record 2813(VGR2813) viral gene, which encodes an 'operon-like' cluster of novel viral micro RNA-like genes, each of which in turn modulates expression of at least one host target gene, the function and utility of which at least one host target gene is known in the art.

VGR2813 gene, herein designated VGR GENE, is a novel bioinformatically detected regulatory, non protein coding, RNA viral gene. The method by which VGR2813 gene was detected is described hereinabove with reference to FIGS. 1-9.

VGR2813 gene encodes VGR2813 precursor RNA, herein designated VGR PRECURSOR RNA, an RNA molecule, typically several hundred nucleotides long.

VGR2813 precursor RNA folds spatially, forming VGR2813 folded precursor RNA, herein designated VGR FOLDED PRECURSOR RNA. It is appreciated that VGR2813 folded precursor RNA comprises a plurality of what is known in the art as 'hairpin' structures. These 'hairpin' structures are due to the fact that the nucleotide sequence of VGR2813 precursor RNA comprises a plurality of segments, the first half of each such segment having a nucleotide sequence which is at least a partial inversed-reversed sequence of the second half thereof, as is well known in the art.

VGR2813 folded precursor RNA is naturally processed by cellular enzymatic activity into at least 2 separate VGAM precursor RNAs, VGAM445 precursor RNA and VGAM446 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM445 RNA and VGAM446 RNA, herein schematically represented by VGAM1 RNA through VGAM3 RNA, each of which VGAM RNAs corresponding to VGAM RNA of FIG. 1.

VGAM445 RNA, herein schematically represented by VGAM1 RNA through VGAM3 RNA, binds complementarily to a host target binding site located in an untranslated region of VGAM445 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM445 host target RNA into VGAM445 host target protein, herein schematically represented by VGAM1 HOST TARGET PROTEIN through VGAM3 HOST TARGET PROTEIN, all of FIG. 1.

VGAM446 RNA, herein schematically represented by VGAM1 RNA through VGAM3 RNA, binds complementarily to a host target binding site located in an untranslated region of VGAM446 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM446 host target RNA into VGAM446 host target protein, herein schematically represented by VGAM1 HOST TARGET PROTEIN through VGAM3 HOST TARGET PROTEIN, all of FIG. 1.

It is appreciated that a function of VGR2813 gene, herein designated VGR GENE, is inhibition of expression of host target genes, as part of a novel viral mechanism of attacking a host. Accordingly, utilities of VGR2813 gene include diagnosis, prevention and treatment of viral infection by Human Papillomavirus Type 17. Specific functions, and accordingly utilities, of VGR2813 gene correlate with, and may be deduced from, the identity of the host target genes, which are inhibited by VGAM RNAs comprised in the 'operon-like' cluster of VGR2813 gene: VGAM445 host target protein and VGAM446 host target protein, herein schematically represented by VGAM1 HOST TARGET PROTEIN through VGAM3 HOST TARGET PROTEIN. The function of these host target genes is elaborated hereinabove with reference to VGAM445 and VGAM446. FIG. 9 further provides a conceptual description of novel bioinformatically detected regulatory viral gene, referred to here as Viral Genomic Record 2814(VGR2814) viral gene, which encodes an 'operon-like' cluster of novel viral micro RNA-like genes, each of which in turn modulates expression of at least one host target gene, the function and utility of which at least one host target gene is known in the art.

VGR2814 gene, herein designated VGR GENE, is a novel bioinformatically detected regulatory, non protein coding, RNA viral gene. The method by which VGR2814 gene was detected is described hereinabove with reference to FIGS. 1-9.

VGR2814 gene encodes VGR2814 precursor RNA, herein designated VGR PRECURSOR RNA, an RNA molecule, typically several hundred nucleotides long.

VGR2814 precursor RNA folds spatially, forming VGR2814 folded precursor RNA, herein designated VGR FOLDED PRECURSOR RNA. It is appreciated that VGR2814 folded precursor RNA comprises a plurality of what is known in the art as 'hairpin' structures. These 'hairpin' structures are due to the fact that the nucleotide sequence of VGR2814 precursor RNA comprises a plurality of segments, the first half of each such segment having a nucleotide sequence which is at least a partial inversed-reversed sequence of the second half thereof, as is well known in the art.

VGR2814 folded precursor RNA is naturally processed by cellular enzymatic activity into at least 2 separate VGAM precursor RNAs, VGAM447 precursor RNA and VGAM448 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM447 RNA and VGAM448 RNA, herein schematically represented by VGAM1 RNA through VGAM3 RNA, each of which VGAM RNAs corresponding to VGAM RNA of FIG. 1.

VGAM447 RNA, herein schematically represented by VGAM1 RNA through VGAM3 RNA, binds complementarily to a host target binding site located in an untranslated region of VGAM447 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM447 host target RNA into VGAM447 host target protein, herein schematically represented by VGAM1 HOST TARGET PROTEIN through VGAM3 HOST TARGET PROTEIN, all of FIG. 1.

VGAM448 RNA, herein schematically represented by VGAM1 RNA through VGAM3 RNA, binds complementarily to a host target binding site located in an untranslated region of VGAM448 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM448 host target RNA into VGAM448 host target protein, herein schematically represented by VGAM1 HOST TARGET PROTEIN through VGAM3 HOST TARGET PROTEIN, all of FIG. 1.

It is appreciated that a function of VGR2814 gene, herein designated VGR GENE, is inhibition of expression of host target genes, as part of a novel viral mechanism of attacking a host. Accordingly, utilities of VGR2814 gene include diagnosis, prevention and treatment of viral infection by Human Papillomavirus Type 40. Specific functions, and accordingly utilities, of VGR2814 gene correlate with, and may be deduced from, the identity of the host target genes, which are inhibited by VGAM RNAs comprised in the 'operon-like' cluster of VGR2814 gene: VGAM447 host target protein and VGAM448 host target protein, herein schematically represented by VGAM1 HOST TARGET PROTEIN through VGAM3 HOST TARGET PROTEIN. The function of these host target genes is elaborated hereinabove with reference to VGAM447 and VGAM448. FIG. 9 further provides a conceptual description of novel bioinformatically detected regulatory viral gene, referred to here as Viral Genomic Record 2815(VGR2815) viral gene, which encodes an 'operon-like' cluster of novel viral micro RNA-like genes, each of which in turn modulates expression of at least one host target gene, the function and utility of which at least one host target gene is known in the art.

VGR2815 gene, herein designated VGR GENE, is a novel bioinformatically detected regulatory, non protein coding, RNA viral gene. The method by which VGR2815 gene was detected is described hereinabove with reference to FIGS. 1-9.

VGR2815 gene encodes VGR2815 precursor RNA, herein designated VGR PRECURSOR RNA, an RNA molecule, typically several hundred nucleotides long.

VGR2815 precursor RNA folds spatially, forming VGR2815 folded precursor RNA, herein designated VGR FOLDED PRECURSOR RNA. It is appreciated that VGR2815 folded precursor RNA comprises a plurality of what is known in the art as 'hairpin' structures. These 'hairpin' structures are due to the fact that the nucleotide sequence of VGR2815 precursor RNA comprises a plurality of segments, the first half of each such segment having a nucleotide sequence which is at least a partial inversed-reversed sequence of the second half thereof, as is well known in the art.

VGR2815 folded precursor RNA is naturally processed by cellular enzymatic activity into at least 3 separate VGAM precursor RNAs, VGAM450 precursor RNA, VGAM451 precursor RNA and VGAM452 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM450 RNA, VGAM451 RNA and VGAM452 RNA, herein schematically represented by VGAM1 RNA through VGAM3 RNA, each of which VGAM RNAs corresponding to VGAM RNA of FIG. 1.

VGAM450 RNA, herein schematically represented by VGAM1 RNA through VGAM3 RNA, binds complementarily to a host target binding site located in an untranslated region of VGAM450 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM450 host target RNA into VGAM450 host target protein, herein schematically represented by VGAM1 HOST TARGET PROTEIN through VGAM3 HOST TARGET PROTEIN, all of FIG. 1.

VGAM451 RNA, herein schematically represented by VGAM1 RNA through VGAM3 RNA, binds complementarily to a host target binding site located in an untranslated region of VGAM451 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM451 host target RNA into VGAM451 host target protein, herein schematically represented by VGAM1 HOST TARGET PROTEIN through VGAM3 HOST TARGET PROTEIN, all of FIG. 1.

VGAM452 RNA, herein schematically represented by VGAM1 RNA through VGAM3 RNA, binds complementarily to a host target binding site located in an untranslated region of VGAM452 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM452 host target RNA into VGAM452 host target protein, herein schematically represented by VGAM1 HOST TARGET PROTEIN through VGAM3 HOST TARGET PROTEIN, all of FIG. 1.

It is appreciated that a function of VGR2815 gene, herein designated VGR GENE, is inhibition of expression of host target genes, as part of a novel viral mechanism of attacking a host. Accordingly, utilities of VGR2815 gene include diagnosis, prevention and treatment of viral infection by Cardamine Chlorotic Fleck Virus. Specific functions, and accordingly utilities, of VGR2815 gene correlate with, and may be deduced from, the identity of the host target genes, which are inhibited by VGAM RNAs comprised in the 'operon-like' cluster of VGR2815 gene: VGAM450 host target protein, VGAM451 host target protein and VGAM452 host target protein, herein schematically represented by VGAM1 HOST TARGET PROTEIN through VGAM3 HOST TARGET PROTEIN. The function of these host target genes is elaborated hereinabove with reference to VGAM450, VGAM451 and VGAM452. FIG. 9 further provides a conceptual description of novel bioinformatically detected regulatory viral gene, referred to here as Viral Genomic Record 2816(VGR2816) viral gene, which encodes an 'operon-like' cluster of novel viral micro RNA-like genes, each of which in turn modulates expression of at least one host target gene, the function and utility of which at least one host target gene is known in the art.

VGR2816 gene, herein designated VGR GENE, is a novel bioinformatically detected regulatory, non protein coding, RNA viral gene. The method by which VGR2816 gene was detected is described hereinabove with reference to FIGS. 1-9.

VGR2816 gene encodes VGR2816 precursor RNA, herein designated VGR PRECURSOR RNA, an RNA molecule, typically several hundred nucleotides long.

VGR2816 precursor RNA folds spatially, forming VGR2816 folded precursor RNA, herein designated VGR FOLDED PRECURSOR RNA. It is appreciated that VGR2816 folded precursor RNA comprises a plurality of what is known in the art as 'hairpin' structures. These 'hairpin' structures are due to the fact that the nucleotide sequence of VGR2816 precursor RNA comprises a plurality of segments, the first half of each such segment having a nucleotide sequence which is at least a partial inversed-reversed sequence of the second half thereof, as is well known in the art.

VGR2816 folded precursor RNA is naturally processed by cellular enzymatic activity into at least 3 separate VGAM precursor RNAs, VGAM453 precursor RNA, VGAM454 precursor RNA and VGAM455 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM453 RNA, VGAM454 RNA and VGAM455 RNA, herein schematically represented by VGAM1 RNA through VGAM3 RNA, each of which VGAM RNAs corresponding to VGAM RNA of FIG. 1.

VGAM453 RNA, herein schematically represented by VGAM1 RNA through VGAM3 RNA, binds complementarily to a host target binding site located in an untranslated region of VGAM453 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM453 host target RNA into VGAM453 host target protein, herein schematically represented by VGAM1 HOST TARGET PROTEIN through VGAM3 HOST TARGET PROTEIN, all of FIG. 1.

VGAM454 RNA, herein schematically represented by VGAM1 RNA through VGAM3 RNA, binds complementarily to a host target binding site located in an untranslated region of VGAM454 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM454 host target RNA into VGAM454 host target protein, herein schematically represented by VGAM1 HOST TARGET PROTEIN through VGAM3 HOST TARGET PROTEIN, all of FIG. 1.

VGAM455 RNA, herein schematically represented by VGAM1 RNA through VGAM3 RNA, binds complementarily to a host target binding site located in an untranslated region of VGAM455 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM455 host target RNA into VGAM455 host target protein, herein schematically represented by VGAM1 HOST TARGET PROTEIN through VGAM3 HOST TARGET PROTEIN, all of FIG. 1.

It is appreciated that a function of VGR2816 gene, herein designated VGR GENE, is inhibition of expression of host target genes, as part of a novel viral mechanism of attacking a host. Accordingly, utilities of VGR2816 gene include diagnosis, prevention and treatment of viral infection by Borna Disease Virus. Specific functions, and accordingly utilities, of VGR2816 gene correlate with, and may be deduced from, the identity of the host target genes, which are inhibited by VGAM RNAs comprised in the 'operon-like' cluster of VGR2816 gene: VGAM453 host target protein, VGAM454 host target protein and VGAM455 host target protein, herein schematically represented by VGAM1 HOST TARGET PROTEIN through VGAM3 HOST TARGET PROTEIN. The function of these host target genes is elaborated hereinabove with reference to VGAM453, VGAM454 and VGAM455. FIG. 9 further provides a conceptual description of novel bioinformatically detected regulatory viral gene, referred to here as Viral Genomic Record 2817(VGR2817) viral gene, which encodes an 'operon-like' cluster of novel viral micro RNA-like genes, each of which in turn modulates expression of at least one host target gene, the function and utility of which at least one host target gene is known in the art.

VGR2817 gene, herein designated VGR GENE, is a novel bioinformatically detected regulatory, non protein coding, RNA viral gene. The method by which VGR2817 gene was detected is described hereinabove with reference to FIGS. 1-9.

VGR2817 gene encodes VGR2817 precursor RNA, herein designated VGR PRECURSOR RNA, an RNA molecule, typically several hundred nucleotides long.

VGR2817 precursor RNA folds spatially, forming VGR2817 folded precursor RNA, herein designated VGR FOLDED PRECURSOR RNA. It is appreciated that VGR2817 folded precursor RNA comprises a plurality of what is known in the art as 'hairpin' structures. These 'hairpin' structures are due to the fact that the nucleotide sequence of VGR2817 precursor RNA comprises a plurality of segments, the first half of each such segment having a nucleotide sequence which is at least a partial inversed-reversed sequence of the second half thereof, as is well known in the art.

VGR2817 folded precursor RNA is naturally processed by cellular enzymatic activity into at least 2 separate VGAM precursor RNAs, VGAM456 precursor RNA and VGAM457 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM456 RNA and VGAM457 RNA, herein schematically represented by VGAM1 RNA through VGAM3 RNA, each of which VGAM RNAs corresponding to VGAM RNA of FIG. 1.

VGAM456 RNA, herein schematically represented by VGAM1 RNA through VGAM3 RNA, binds complementarily to a host target binding site located in an untranslated region of VGAM456 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM456 host target RNA into VGAM456 host target protein, herein schematically represented by VGAM1 HOST TARGET PROTEIN through VGAM3 HOST TARGET PROTEIN, all of FIG. 1.

VGAM457 RNA, herein schematically represented by VGAM1 RNA through VGAM3 RNA, binds complementarily to a host target binding site located in an untranslated region of VGAM457 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM457 host target RNA into VGAM457 host target protein, herein schematically represented by VGAM1 HOST TARGET PROTEIN through VGAM3 HOST TARGET PROTEIN, all of FIG. 1.

It is appreciated that a function of VGR2817 gene, herein designated VGR GENE, is inhibition of expression of host target genes, as part of a novel viral mechanism of attacking a host. Accordingly, utilities of VGR2817 gene include diagnosis, prevention and treatment of viral infection by Variola Virus. Specific functions, and accordingly utilities, of VGR2817 gene correlate with, and may be deduced from, the identity of the host target genes, which are inhibited by VGAM RNAs comprised in the 'operon-like' cluster of VGR2817 gene: VGAM456 host target protein and VGAM457 host target protein, herein schematically represented by VGAM1 HOST TARGET PROTEIN through VGAM3 HOST TARGET PROTEIN. The function of these host target genes is elaborated hereinabove with reference to VGAM456 and VGAM457. FIG. 9 further provides a conceptual description of novel bioinformatically detected regulatory viral gene, referred to here as Viral Genomic Record 2818(VGR2818) viral gene, which encodes an 'operon-like' cluster of novel viral micro RNA-like genes, each of which in turn modulates expression of at least one host target gene, the function and utility of which at least one host target gene is known in the art.

VGR2818 gene, herein designated VGR GENE, is a novel bioinformatically detected regulatory, non protein coding, RNA viral gene. The method by which VGR2818 gene was detected is described hereinabove with reference to FIGS. 1-9.

VGR2818 gene encodes VGR2818 precursor RNA, herein designated VGR PRECURSOR RNA, an RNA molecule, typically several hundred nucleotides long.

VGR2818 precursor RNA folds spatially, forming VGR2818 folded precursor RNA, herein designated VGR FOLDED PRECURSOR RNA. It is appreciated that VGR2818 folded precursor RNA comprises a plurality of what is known in the art as 'hairpin' structures. These 'hairpin' structures are due to the fact that the nucleotide sequence of VGR2818 precursor RNA comprises a plurality of segments, the first half of each such segment having a nucleotide sequence which is at least a partial inversed-reversed sequence of the second half thereof, as is well known in the art.

VGR2818 folded precursor RNA is naturally processed by cellular enzymatic activity into at least 2 separate VGAM precursor RNAs, VGAM458 precursor RNA and VGAM459 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM458 RNA and VGAM459 RNA, herein schematically represented by VGAM1 RNA through VGAM3 RNA, each of which VGAM RNAs corresponding to VGAM RNA of FIG. 1.

VGAM458 RNA, herein schematically represented by VGAM1 RNA through VGAM3 RNA, binds complementarily to a host target binding site located in an untranslated region of VGAM458 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM458 host target RNA into VGAM458 host target protein, herein schematically represented by VGAM1 HOST TARGET PROTEIN through VGAM3 HOST TARGET PROTEIN, all of FIG. 1.

VGAM459 RNA, herein schematically represented by VGAM1 RNA through VGAM3 RNA, binds complementarily to a host target binding site located in an untranslated region of VGAM459 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM459 host target RNA into VGAM459 host target protein, herein schematically represented by VGAM1 HOST TARGET PROTEIN through VGAM3 HOST TARGET PROTEIN, all of FIG. 1.

It is appreciated that a function of VGR2818 gene, herein designated VGR GENE, is inhibition of expression of host target genes, as part of a novel viral mechanism of attacking a host. Accordingly, utilities of VGR2818 gene include diagnosis, prevention and treatment of viral infection by Camelpox Virus. Specific functions, and accordingly utilities, of VGR2818 gene correlate with, and may be deduced from, the identity of the host target genes, which are inhibited by VGAM RNAs comprised in the 'operon-like' cluster of VGR2818 gene: VGAM458 host target protein and VGAM459 host target protein, herein schematically represented by VGAM1 HOST TARGET PROTEIN through VGAM3 HOST TARGET PROTEIN. The function of these host target genes is elaborated hereinabove with reference to VGAM458 and VGAM459. FIG. 9 further provides a conceptual description of novel bioinformatically detected regulatory viral gene, referred to here as Viral Genomic Record 2819(VGR2819) viral gene, which encodes an 'operon-like' cluster of novel viral micro RNA-like genes, each of which in turn modulates expression of at least one host target gene, the function and utility of which at least one host target gene is known in the art.

VGR2819 gene, herein designated VGR GENE, is a novel bioinformatically detected regulatory, non protein coding, RNA viral gene. The method by which VGR2819 gene was detected is described hereinabove with reference to FIGS. 1-9.

VGR2819 gene encodes VGR2819 precursor RNA, herein designated VGR PRECURSOR RNA, an RNA molecule, typically several hundred nucleotides long.

VGR2819 precursor RNA folds spatially, forming VGR2819 folded precursor RNA, herein designated VGR FOLDED PRECURSOR RNA. It is appreciated that VGR2819 folded precursor RNA comprises a plurality of what is known in the art as 'hairpin' structures. These 'hairpin' structures are due to the fact that the nucleotide sequence of VGR2819 precursor RNA comprises a plurality of segments, the first half of each such segment having a nucleotide sequence which is at least a partial inversed-reversed sequence of the second half thereof, as is well known in the art.

VGR2819 folded precursor RNA is naturally processed by cellular enzymatic activity into at least 3 separate VGAM precursor RNAs, VGAM462 precursor RNA, VGAM463 precursor RNA and VGAM464 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM462 RNA, VGAM463 RNA and VGAM464 RNA, herein schematically represented by VGAM1 RNA through VGAM3 RNA, each of which VGAM RNAs corresponding to VGAM RNA of FIG. 1.

VGAM462 RNA, herein schematically represented by VGAM1 RNA through VGAM3 RNA, binds complementarily to a host target binding site located in an untranslated region of VGAM462 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM462 host target RNA into VGAM462 host target protein, herein schematically represented by VGAM1 HOST TARGET PROTEIN through VGAM3 HOST TARGET PROTEIN, all of FIG. 1.

VGAM463 RNA, herein schematically represented by VGAM1 RNA through VGAM3 RNA, binds complementarily to a host target binding site located in an untranslated region of VGAM463 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM463 host target RNA into VGAM463 host target protein, herein schematically represented by VGAM1 HOST TARGET PROTEIN through VGAM3 HOST TARGET PROTEIN, all of FIG. 1.

VGAM464 RNA, herein schematically represented by VGAM1 RNA through VGAM3 RNA, binds complementarily to a host target binding site located in an untranslated region of VGAM464 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM464 host target RNA into VGAM464 host target protein, herein schematically represented by VGAM1 HOST TARGET PROTEIN through VGAM3 HOST TARGET PROTEIN, all of FIG. 1.

It is appreciated that a function of VGR2819 gene, herein designated VGR GENE, is inhibition of expression of host target genes, as part of a novel viral mechanism of attacking a host. Accordingly, utilities of VGR2819 gene include diagnosis, prevention and treatment of viral infection by Variola Virus. Specific functions, and accordingly utilities, of VGR2819 gene correlate with, and may be deduced from, the identity of the host target genes, which are inhibited by VGAM RNAs comprised in the 'operon-like' cluster of VGR2819 gene: VGAM462 host target protein, VGAM463 host target protein and VGAM464 host target protein, herein schematically represented by VGAM1 HOST TARGET PROTEIN through VGAM3 HOST TARGET PROTEIN. The function of these host target genes is elaborated hereinabove with reference to VGAM462, VGAM463 and VGAM464. FIG. 9 further provides a conceptual description of novel bioinformatically detected regulatory viral gene, referred to here as Viral Genomic Record 2820(VGR2820) viral gene, which encodes an 'operon-like' cluster of novel viral micro RNA-like genes, each of which in turn modulates expression of at least one host target gene, the function and utility of which at least one host target gene is known in the art.

VGR2820 gene, herein designated VGR GENE, is a novel bioinformatically detected regulatory, non protein coding, RNA viral gene. The method by which VGR2820 gene was detected is described hereinabove with reference to FIGS. 1-9.

VGR2820 gene encodes VGR2820 precursor RNA, herein designated VGR PRECURSOR RNA, an RNA molecule, typically several hundred nucleotides long.

VGR2820 precursor RNA folds spatially, forming VGR2820 folded precursor RNA, herein designated VGR FOLDED PRECURSOR RNA. It is appreciated that VGR2820 folded precursor RNA comprises a plurality of what is known in the art as 'hairpin' structures. These 'hairpin' structures are due to the fact that the nucleotide sequence of VGR2820 precursor RNA comprises a plurality of segments, the first half of each such segment having a nucleotide sequence which is at least a partial inversed-reversed sequence of the second half thereof, as is well known in the art.

VGR2820 folded precursor RNA is naturally processed by cellular enzymatic activity into at least 2 separate VGAM precursor RNAs, VGAM466 precursor RNA and VGAM467 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM466 RNA and VGAM467 RNA, herein schematically represented by VGAM1 RNA through VGAM3 RNA, each of which VGAM RNAs corresponding to VGAM RNA of FIG. 1.

VGAM466 RNA, herein schematically represented by VGAM1 RNA through VGAM3 RNA, binds complementarily to a host target binding site located in an untranslated region of VGAM466 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM466 host target RNA into VGAM466 host target protein, herein schematically represented by VGAM1 HOST TARGET PROTEIN through VGAM3 HOST TARGET PROTEIN, all of FIG. 1.

VGAM467 RNA, herein schematically represented by VGAM1 RNA through VGAM3 RNA, binds complementarily to a host target binding site located in an untranslated region of VGAM467 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM467 host target RNA into VGAM467 host target protein, herein schematically represented by VGAM1 HOST TARGET PROTEIN through VGAM3 HOST TARGET PROTEIN, all of FIG. 1.

It is appreciated that a function of VGR2820 gene, herein designated VGR GENE, is inhibition of expression of host target genes, as part of a novel viral mechanism of attacking a host. Accordingly, utilities of VGR2820 gene include diagnosis, prevention and treatment of viral infection by Autographa Californica Nucleopolyhedrovirus. Specific functions, and accordingly utilities, of VGR2820 gene correlate with, and may be deduced from, the identity of the host target genes, which are inhibited by VGAM RNAs comprised in the 'operon-like' cluster of VGR2820 gene: VGAM466 host target protein and VGAM467 host target protein, herein schematically represented by VGAM1 HOST TARGET PROTEIN through VGAM3 HOST TARGET PROTEIN. The function of these host target genes is elaborated hereinabove with reference to VGAM466 and VGAM467. FIG. 9 further provides a conceptual description of novel bioinformatically detected regulatory viral gene, referred to here as Viral Genomic Record 2821(VGR2821) viral gene, which encodes an 'operon-like' cluster of novel viral micro RNA-like genes, each of which in turn modulates expression of at least one host target gene, the function and utility of which at least one host target gene is known in the art.

VGR2821 gene, herein designated VGR GENE, is a novel bioinformatically detected regulatory, non protein coding, RNA viral gene. The method by which VGR2821 gene was detected is described hereinabove with reference to FIGS. 1-9.

VGR2821 gene encodes VGR2821 precursor RNA, herein designated VGR PRECURSOR RNA, an RNA molecule, typically several hundred nucleotides long.

VGR2821 precursor RNA folds spatially, forming VGR2821 folded precursor RNA, herein designated VGR FOLDED PRECURSOR RNA. It is appreciated that VGR2821 folded precursor RNA comprises a plurality of what is known in the art as 'hairpin' structures. These 'hairpin' structures are due to the fact that the nucleotide sequence of VGR2821 precursor RNA comprises a plurality of segments, the first half of each such segment having a nucleotide sequence which is at least a partial inversed-reversed sequence of the second half thereof, as is well known in the art.

VGR2821 folded precursor RNA is naturally processed by cellular enzymatic activity into at least 5 separate VGAM precursor RNAs, VGAM472 precursor RNA, VGAM473 precursor RNA, VGAM474 precursor RNA, VGAM475 precursor RNA and VGAM476 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM472 RNA, VGAM473 RNA, VGAM474 RNA, VGAM475 RNA and VGAM476 RNA, herein schematically represented by VGAM1 RNA through VGAM3 RNA, each of which VGAM RNAs corresponding to VGAM RNA of FIG. 1.

VGAM472 RNA, herein schematically represented by VGAM1 RNA through VGAM3 RNA, binds complementarily to a host target binding site located in an untranslated region of VGAM472 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM472 host target RNA into VGAM472 host target protein, herein schematically represented by VGAM1 HOST TARGET PROTEIN through VGAM3 HOST TARGET PROTEIN, all of FIG. 1.

VGAM473 RNA, herein schematically represented by VGAM1 RNA through VGAM3 RNA, binds complementarily to a host target binding site located in an untranslated region of VGAM473 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM473 host target RNA into VGAM473 host target protein, herein schematically represented by VGAM1 HOST TARGET PROTEIN through VGAM3 HOST TARGET PROTEIN, all of FIG. 1.

VGAM474 RNA, herein schematically represented by VGAM1 RNA through VGAM3 RNA, binds complementarily to a host target binding site located in an untranslated region of VGAM474 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM474 host target RNA into VGAM474 host target protein, herein schematically represented by VGAM1 HOST TARGET PROTEIN through VGAM3 HOST TARGET PROTEIN, all of FIG. 1.

VGAM475 RNA, herein schematically represented by VGAM1 RNA through VGAM3 RNA, binds complementarily to a host target binding site located in an untranslated region of VGAM475 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM475 host target RNA into VGAM475 host target protein, herein schematically represented by VGAM1 HOST TARGET PROTEIN through VGAM3 HOST TARGET PROTEIN, all of FIG. 1.

VGAM476 RNA, herein schematically represented by VGAM1 RNA through VGAM3 RNA, binds complementarily to a host target binding site located in an untranslated region of VGAM476 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM476 host target RNA into VGAM476 host target protein, herein schematically represented by VGAM1 HOST TARGET PROTEIN through VGAM3 HOST TARGET PROTEIN, all of FIG. 1.

It is appreciated that a function of VGR2821 gene, herein designated VGR GENE, is inhibition of expression of host target genes, as part of a novel viral mechanism of attacking a host. Accordingly, utilities of VGR2821 gene include diagnosis, prevention and treatment of viral infection by Tick-borne Encephalitis Virus. Specific functions, and accordingly utilities, of VGR2821 gene correlate with, and may be deduced from, the identity of the host target genes, which are inhibited by VGAM RNAs comprised in the 'operon-like' cluster of VGR2821 gene: VGAM472 host target protein, VGAM473 host target protein, VGAM474 host target protein, VGAM475 host target protein and VGAM476 host target protein, herein schematically represented by VGAM1 HOST TARGET PROTEIN through VGAM3 HOST TARGET PROTEIN. The function of these host target genes is elaborated hereinabove with reference to VGAM472, VGAM473, VGAM474, VGAM475 and VGAM476. FIG. 9 further provides a conceptual description of novel bioinformatically detected regulatory viral gene, referred to here as Viral Genomic Record 2822(VGR2822) viral gene, which encodes an 'operon-like' cluster of novel viral micro RNA-like genes, each of which in turn modulates expression of at least one host target gene, the function and utility of which at least one host target gene is known in the art.

VGR2822 gene, herein designated VGR GENE, is a novel bioinformatically detected regulatory, non protein coding, RNA viral gene. The method by which VGR2822 gene was detected is described hereinabove with reference to FIGS. 1-9.

VGR2822 gene encodes VGR2822 precursor RNA, herein designated VGR PRECURSOR RNA, an RNA molecule, typically several hundred nucleotides long.

VGR2822 precursor RNA folds spatially, forming VGR2822 folded precursor RNA, herein designated VGR FOLDED PRECURSOR RNA. It is appreciated that VGR2822 folded precursor RNA comprises a plurality of what is known in the art as 'hairpin' structures. These 'hairpin' structures are due to the fact that the nucleotide sequence of VGR2822 precursor RNA comprises a plurality of segments, the first half of each such segment having a nucleotide sequence which is at least a partial inversed-reversed sequence of the second half thereof, as is well known in the art.

VGR2822 folded precursor RNA is naturally processed by cellular enzymatic activity into at least 8 separate VGAM precursor RNAs, VGAM477 precursor RNA, VGAM478 precursor RNA, VGAM479 precursor RNA, VGAM480 precursor RNA, VGAM481 precursor RNA, VGAM482 precursor RNA, VGAM483 precursor RNA and VGAM484 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM477 RNA, VGAM478 RNA, VGAM479 RNA, VGAM480 RNA, VGAM481 RNA, VGAM482 RNA, VGAM483 RNA and VGAM484 RNA, herein schematically represented by VGAM1 RNA through VGAM3 RNA, each of which VGAM RNAs corresponding to VGAM RNA of FIG. 1.

VGAM477 RNA, herein schematically represented by VGAM1 RNA through VGAM3 RNA, binds complementarily to a host target binding site located in an untranslated region of VGAM477 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM477 host target RNA into VGAM477 host target protein, herein schematically represented by VGAM1 HOST TARGET PROTEIN through VGAM3 HOST TARGET PROTEIN, all of FIG. 1.

VGAM478 RNA, herein schematically represented by VGAM1 RNA through VGAM3 RNA, binds complementarily to a host target binding site located in an untranslated region of VGAM478 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM478 host target RNA into VGAM478 host target protein, herein schematically represented by VGAM1 HOST TARGET PROTEIN through VGAM3 HOST TARGET PROTEIN, all of FIG. 1.

VGAM479 RNA, herein schematically represented by VGAM1 RNA through VGAM3 RNA, binds complementarily to a host target binding site located in an untranslated region of VGAM479 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM479 host target RNA into VGAM479 host target protein, herein schematically represented by VGAM1 HOST TARGET PROTEIN through VGAM3 HOST TARGET PROTEIN, all of FIG. 1.

VGAM480 RNA, herein schematically represented by VGAM1 RNA through VGAM3 RNA, binds complementarily to a host target binding site located in an untranslated region of VGAM480 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM480 host target RNA into VGAM480 host target protein, herein schematically represented by VGAM1 HOST TARGET PROTEIN through VGAM3 HOST TARGET PROTEIN, all of FIG. 1.

VGAM481 RNA, herein schematically represented by VGAM1 RNA through VGAM3 RNA, binds complementarily to a host target binding site located in an untranslated region of VGAM481 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM481 host target RNA into VGAM481 host target protein, herein schematically represented by VGAM1 HOST TARGET PROTEIN through VGAM3 HOST TARGET PROTEIN, all of FIG. 1.

VGAM482 RNA, herein schematically represented by VGAM1 RNA through VGAM3 RNA, binds complementarily to a host target binding site located in an untranslated region of VGAM482 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM482 host target RNA into VGAM482 host target protein, herein schematically represented by VGAM1 HOST TARGET PROTEIN through VGAM3 HOST TARGET PROTEIN, all of FIG. 1.

VGAM483 RNA, herein schematically represented by VGAM1 RNA through VGAM3 RNA, binds complementarily to a host target binding site located in an untranslated region of VGAM483 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM483 host target RNA into VGAM483 host target protein, herein schematically represented by VGAM1 HOST TARGET PROTEIN through VGAM3 HOST TARGET PROTEIN, all of FIG. 1.

VGAM484 RNA, herein schematically represented by VGAM1 RNA through VGAM3 RNA, binds complementarily to a host target binding site located in an untranslated region of VGAM484 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM484 host target RNA into VGAM484 host target protein, herein schematically represented by VGAM1 HOST TARGET PROTEIN through VGAM3 HOST TARGET PROTEIN, all of FIG. 1.

It is appreciated that a function of VGR2822 gene, herein designated VGR GENE, is inhibition of expression of host target genes, as part of a novel viral mechanism of attacking a host. Accordingly, utilities of VGR2822 gene include diagnosis, prevention and treatment of viral infection by Hepatitis G Virus. Specific functions, and accordingly utilities, of VGR2822 gene correlate with, and may be deduced from, the identity of the host target genes, which are inhibited by VGAM RNAs comprised in the 'operon-like' cluster of VGR2822 gene: VGAM477 host target protein, VGAM478 host target protein, VGAM479 host target protein, VGAM480 host target protein, VGAM481 host target protein, VGAM482 host target protein, VGAM483 host target protein and VGAM484 host target protein, herein schematically represented by VGAM1 HOST TARGET PROTEIN through VGAM3 HOST TARGET PROTEIN. The function of these host target genes is elaborated hereinabove with reference to VGAM477, VGAM478, VGAM479, VGAM480, VGAM481, VGAM482, VGAM483 and VGAM484. FIG. 9 further provides a conceptual description of novel bioinformatically detected regulatory viral gene, referred to here as Viral Genomic Record 2823(VGR2823) viral gene, which encodes an 'operon-like' cluster of novel viral micro RNA-like genes, each of which in turn modulates expression of at least one host target gene, the function and utility of which at least one host target gene is known in the art.

VGR2823 gene, herein designated VGR GENE, is a novel bioinformatically detected regulatory, non protein coding, RNA viral gene. The method by which VGR2823 gene was detected is described hereinabove with reference to FIGS. 1-9.

VGR2823 gene encodes VGR2823 precursor RNA, herein designated VGR PRECURSOR RNA, an RNA molecule, typically several hundred nucleotides long.

VGR2823 precursor RNA folds spatially, forming VGR2823 folded precursor RNA, herein designated VGR FOLDED PRECURSOR RNA. It is appreciated that VGR2823 folded precursor RNA comprises a plurality of what is known in the art as 'hairpin' structures. These 'hairpin' structures are due to the fact that the nucleotide sequence of VGR2823 precursor RNA comprises a plurality of segments, the first half of each such segment having a nucleotide sequence which is at least a partial inversed-reversed sequence of the second half thereof, as is well known in the art.

VGR2823 folded precursor RNA is naturally processed by cellular enzymatic activity into at least 8 separate VGAM precursor RNAs, VGAM485 precursor RNA, VGAM486 precursor RNA, VGAM487 precursor RNA, VGAM488 precursor RNA, VGAM489 precursor RNA, VGAM490 precursor RNA, VGAM491 precursor RNA and VGAM492 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM485 RNA, VGAM486 RNA, VGAM487 RNA, VGAM488 RNA, VGAM489 RNA, VGAM490 RNA, VGAM491 RNA and VGAM492 RNA, herein schematically represented by VGAM1 RNA through VGAM3 RNA, each of which VGAM RNAs corresponding to VGAM RNA of FIG. 1.

VGAM485 RNA, herein schematically represented by VGAM1 RNA through VGAM3 RNA, binds complementarily to a host target binding site located in an untranslated region of VGAM485 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM485 host target RNA into VGAM485 host target protein, herein schematically represented by VGAM1 HOST TARGET PROTEIN through VGAM3 HOST TARGET PROTEIN, all of FIG. 1.

VGAM486 RNA, herein schematically represented by VGAM1 RNA through VGAM3 RNA, binds complementarily to a host target binding site located in an untranslated region of VGAM486 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM486 host target RNA into VGAM486 host target protein, herein schematically represented by VGAM1 HOST TARGET PROTEIN through VGAM3 HOST TARGET PROTEIN, all of FIG. 1.

VGAM487 RNA, herein schematically represented by VGAM1 RNA through VGAM3 RNA, binds complementarily to a host target binding site located in an untranslated region of VGAM487 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM487 host target RNA into VGAM487 host target protein, herein schematically represented by VGAM1 HOST TARGET PROTEIN through VGAM3 HOST TARGET PROTEIN, all of FIG. 1.

VGAM488 RNA, herein schematically represented by VGAM1 RNA through VGAM3 RNA, binds complementarily to a host target binding site located in an untranslated region of VGAM488 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM488 host target RNA into VGAM488 host target protein, herein schematically represented by VGAM1 HOST TARGET PROTEIN through VGAM3 HOST TARGET PROTEIN, all of FIG. 1.

VGAM489 RNA, herein schematically represented by VGAM1 RNA through VGAM3 RNA, binds complementarily to a host target binding site located in an untranslated region of VGAM489 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM489 host target RNA into VGAM489 host target protein, herein schematically represented by VGAM1 HOST TARGET PROTEIN through VGAM3 HOST TARGET PROTEIN, all of FIG. 1.

VGAM490 RNA, herein schematically represented by VGAM1 RNA through VGAM3 RNA, binds complementarily to a host target binding site located in an untranslated region of VGAM490 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM490 host target RNA into VGAM490 host target protein, herein schematically represented by VGAM1 HOST TARGET PROTEIN through VGAM3 HOST TARGET PROTEIN, all of FIG. 1.

VGAM491 RNA, herein schematically represented by VGAM1 RNA through VGAM3 RNA, binds complementarily to a host target binding site located in an untranslated region of VGAM491 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM491 host target RNA into VGAM491 host target protein, herein schematically represented by VGAM1 HOST TARGET PROTEIN through VGAM3 HOST TARGET PROTEIN, all of FIG. 1.

VGAM492 RNA, herein schematically represented by VGAM1 RNA through VGAM3 RNA, binds complementarily to a host target binding site located in an untranslated region of VGAM492 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM492 host target RNA into VGAM492 host target protein, herein schematically represented by VGAM1 HOST TARGET PROTEIN through VGAM3 HOST TARGET PROTEIN, all of FIG. 1.

It is appreciated that a function of VGR2823 gene, herein designated VGR GENE, is inhibition of expression of host target genes, as part of a novel viral mechanism of attacking a host. Accordingly, utilities of VGR2823 gene include diagnosis, prevention and treatment of viral infection by Hepatitis G Virus. Specific functions, and accordingly utilities, of VGR2823 gene correlate with, and may be deduced from, the identity of the host target genes, which are inhibited by VGAM RNAs comprised in the 'operon-like' cluster of VGR2823 gene: VGAM485 host target protein, VGAM486 host target protein, VGAM487 host target protein, VGAM488 host target protein, VGAM489 host target protein, VGAM490 host target protein, VGAM491 host target protein and VGAM492 host target protein, herein schematically represented by VGAM1 HOST TARGET PROTEIN through VGAM3 HOST TARGET PROTEIN. The function of these host target genes is elaborated hereinabove with reference to VGAM485, VGAM486, VGAM487, VGAM488, VGAM489, VGAM490, VGAM491 and VGAM492. FIG. 9 further provides a conceptual description of novel bioinformatically detected regulatory viral gene, referred to here as Viral Genomic Record 2824(VGR2824) viral gene, which encodes an 'operon-like' cluster of novel viral micro RNA-like genes, each of which in turn modulates expression of at least one host target gene, the function and utility of which at least one host target gene is known in the art.

VGR2824 gene, herein designated VGR GENE, is a novel bioinformatically detected regulatory, non protein coding, RNA viral gene. The method by which VGR2824 gene was detected is described hereinabove with reference to FIGS. 1-9.

VGR2824 gene encodes VGR2824 precursor RNA, herein designated VGR PRECURSOR RNA, an RNA molecule, typically several hundred nucleotides long.

VGR2824 precursor RNA folds spatially, forming VGR2824 folded precursor RNA, herein designated VGR FOLDED PRECURSOR RNA. It is appreciated that VGR2824 folded precursor RNA comprises a plurality of what is known in the art as 'hairpin' structures. These 'hairpin' structures are due to the fact that the nucleotide sequence of VGR2824 precursor RNA comprises a plurality of segments, the first half of each such segment having a nucleotide sequence which is at least a partial inversed-reversed sequence of the second half thereof, as is well known in the art.

VGR2824 folded precursor RNA is naturally processed by cellular enzymatic activity into at least 3 separate VGAM precursor RNAs, VGAM493 precursor RNA, VGAM494 precursor RNA and VGAM495 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM493 RNA, VGAM494 RNA and VGAM495 RNA, herein schematically represented by VGAM1 RNA through VGAM3 RNA, each of which VGAM RNAs corresponding to VGAM RNA of FIG. 1.

VGAM493 RNA, herein schematically represented by VGAM1 RNA through VGAM3 RNA, binds complementarily to a host target binding site located in an untranslated region of VGAM493 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM493 host target RNA into VGAM493 host target protein, herein schematically represented by VGAM1 HOST TARGET PROTEIN through VGAM3 HOST TARGET PROTEIN, all of FIG. 1.

VGAM494 RNA, herein schematically represented by VGAM1 RNA through VGAM3 RNA, binds complementarily to a host target binding site located in an untranslated region of VGAM494 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM494 host target RNA into VGAM494 host target protein, herein schematically represented by VGAM1 HOST TARGET PROTEIN through VGAM3 HOST TARGET PROTEIN, all of FIG. 1.

VGAM495 RNA, herein schematically represented by VGAM1 RNA through VGAM3 RNA, binds complementarily to a host target binding site located in an untranslated region of VGAM495 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM495 host target RNA into VGAM495 host target protein, herein schematically represented by VGAM1 HOST TARGET PROTEIN through VGAM3 HOST TARGET PROTEIN, all of FIG. 1.

It is appreciated that a function of VGR2824 gene, herein designated VGR GENE, is inhibition of expression of host target genes, as part of a novel viral mechanism of attacking a host. Accordingly, utilities of VGR2824 gene include diagnosis, prevention and treatment of viral infection by Hepatitis G Virus. Specific functions, and accordingly utilities, of VGR2824 gene correlate with, and may be deduced from, the identity of the host target genes, which are inhibited by VGAM RNAs comprised in the 'operon-like' cluster of VGR2824 gene: VGAM493 host target protein, VGAM494 host target protein and VGAM495 host target protein, herein schematically represented by VGAM1 HOST TARGET PROTEIN through VGAM3 HOST TARGET PROTEIN. The function of these host target genes is elaborated hereinabove with reference to VGAM493, VGAM494 and VGAM495. FIG. 9 further provides a conceptual description of novel bioinformatically detected regulatory viral gene, referred to here as Viral Genomic Record 2825(VGR2825) viral gene, which encodes an 'operon-like' cluster of novel viral micro RNA-like genes, each of which in turn modulates expression of at least one host target gene, the function and utility of which at least one host target gene is known in the art.

VGR2825 gene, herein designated VGR GENE, is a novel bioinformatically detected regulatory, non protein coding, RNA viral gene. The method by which VGR2825 gene was detected is described hereinabove with reference to FIGS. 1-9.

VGR2825 gene encodes VGR2825 precursor RNA, herein designated VGR PRECURSOR RNA, an RNA molecule, typically several hundred nucleotides long.

VGR2825 precursor RNA folds spatially, forming VGR2825 folded precursor RNA, herein designated VGR FOLDED PRECURSOR RNA. It is appreciated that VGR2825 folded precursor RNA comprises a plurality of what is known in the art as 'hairpin' structures. These 'hairpin' structures are due to the fact that the nucleotide sequence of VGR2825 precursor RNA comprises a plurality of segments, the first half of each such segment having a nucleotide sequence which is at least a partial inversed-reversed sequence of the second half thereof, as is well known in the art.

VGR2825 folded precursor RNA is naturally processed by cellular enzymatic activity into at least 2 separate VGAM precursor RNAs, VGAM496 precursor RNA and VGAM497 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM496 RNA and VGAM497 RNA, herein schematically represented by VGAM1 RNA through VGAM3 RNA, each of which VGAM RNAs corresponding to VGAM RNA of FIG. 1.

VGAM496 RNA, herein schematically represented by VGAM1 RNA through VGAM3 RNA, binds complementarily to a host target binding site located in an untranslated region of VGAM496 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM496 host target RNA into VGAM496 host target protein, herein schematically represented by VGAM1 HOST TARGET PROTEIN through VGAM3 HOST TARGET PROTEIN, all of FIG. 1.

VGAM497 RNA, herein schematically represented by VGAM1 RNA through VGAM3 RNA, binds complementarily to a host target binding site located in an untranslated region of VGAM497 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM497 host target RNA into VGAM497 host target protein, herein schematically represented by VGAM1 HOST TARGET PROTEIN through VGAM3 HOST TARGET PROTEIN, all of FIG. 1.

It is appreciated that a function of VGR2825 gene, herein designated VGR GENE, is inhibition of expression of host target genes, as part of a novel viral mechanism of attacking a host. Accordingly, utilities of VGR2825 gene include diagnosis, prevention and treatment of viral infection by Human Herpesvirus 7. Specific functions, and accordingly utilities, of VGR2825 gene correlate with, and may be deduced from, the identity of the host target genes, which are inhibited by VGAM RNAs comprised in the 'operon-like' cluster of VGR2825 gene: VGAM496 host target protein and VGAM497 host target protein, herein schematically represented by VGAM1 HOST TARGET PROTEIN through VGAM3 HOST TARGET PROTEIN. The function of these host target genes is elaborated hereinabove with reference to VGAM496 and VGAM497. FIG. 9 further provides a conceptual description of novel bioinformatically detected regulatory viral gene, referred to here as Viral Genomic Record 2826(VGR2826) viral gene, which encodes an 'operon-like' cluster of novel viral micro RNA-like genes, each of which in turn modulates expression of at least one host target gene, the function and utility of which at least one host target gene is known in the art.

VGR2826 gene, herein designated VGR GENE, is a novel bioinformatically detected regulatory, non protein coding, RNA viral gene. The method by which VGR2826 gene was detected is described hereinabove with reference to FIGS. 1-9.

VGR2826 gene encodes VGR2826 precursor RNA, herein designated VGR PRECURSOR RNA, an RNA molecule, typically several hundred nucleotides long.

VGR2826 precursor RNA folds spatially, forming VGR2826 folded precursor RNA, herein designated VGR FOLDED PRECURSOR RNA. It is appreciated that VGR2826 folded precursor RNA comprises a plurality of what is known in the art as 'hairpin' structures. These 'hairpin' structures are due to the fact that the nucleotide sequence of VGR2826 precursor RNA comprises a plurality of segments, the first half of each such segment having a nucleotide sequence which is at least a partial inversed-reversed sequence of the second half thereof, as is well known in the art.

VGR2826 folded precursor RNA is naturally processed by cellular enzymatic activity into at least 2 separate VGAM precursor RNAs, VGAM499 precursor RNA and VGAM500 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM499 RNA and VGAM500 RNA, herein schematically represented by VGAM1 RNA through VGAM3 RNA, each of which VGAM RNAs corresponding to VGAM RNA of FIG. 1.

VGAM499 RNA, herein schematically represented by VGAM1 RNA through VGAM3 RNA, binds complementarily to a host target binding site located in an untranslated region of VGAM499 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM499 host target RNA into VGAM499 host target protein, herein schematically represented by VGAM1 HOST TARGET PROTEIN through VGAM3 HOST TARGET PROTEIN, all of FIG. 1.

VGAM500 RNA, herein schematically represented by VGAM1 RNA through VGAM3 RNA, binds complementarily to a host target binding site located in an untranslated region of VGAM500 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM500 host target RNA into VGAM500 host target protein, herein schematically represented by VGAM1 HOST TARGET PROTEIN through VGAM3 HOST TARGET PROTEIN, all of FIG. 1.

It is appreciated that a function of VGR2826 gene, herein designated VGR GENE, is inhibition of expression of host target genes, as part of a novel viral mechanism of attacking a host. Accordingly, utilities of VGR2826 gene include diagnosis, prevention and treatment of viral infection by Strawberry Vein Banding Virus (SVBV). Specific functions, and accordingly utilities, of VGR2826 gene correlate with, and may be deduced from, the identity of the host target genes, which are inhibited by VGAM RNAs comprised in the 'operon-like' cluster of VGR2826 gene: VGAM499 host target protein and VGAM500 host target protein, herein schematically represented by VGAM1 HOST TARGET PROTEIN through VGAM3 HOST TARGET PROTEIN. The function of these host target genes is elaborated hereinabove with reference to VGAM499 and VGAM500. FIG. 9 further provides a conceptual description of novel bioinformatically detected regulatory viral gene, referred to here as Viral Genomic Record 2827(VGR2827) viral gene, which encodes an 'operon-like' cluster of novel viral micro RNA-like genes, each of which in turn modulates expression of at least one host target gene, the function and utility of which at least one host target gene is known in the art.

VGR2827 gene, herein designated VGR GENE, is a novel bioinformatically detected regulatory, non protein coding, RNA viral gene. The method by which VGR2827 gene was detected is described hereinabove with reference to FIGS. 1-9.

VGR2827 gene encodes VGR2827 precursor RNA, herein designated VGR PRECURSOR RNA, an RNA molecule, typically several hundred nucleotides long.

VGR2827 precursor RNA folds spatially, forming VGR2827 folded precursor RNA, herein designated VGR FOLDED PRECURSOR RNA. It is appreciated that VGR2827 folded precursor RNA comprises a plurality of what is known in the art as 'hairpin' structures. These 'hairpin' structures are due to the fact that the nucleotide sequence of VGR2827 precursor RNA comprises a plurality of segments, the first half of each such segment having a nucleotide sequence which is at least a partial inversed-reversed sequence of the second half thereof, as is well known in the art.

VGR2827 folded precursor RNA is naturally processed by cellular enzymatic activity into at least 2 separate VGAM precursor RNAs, VGAM501 precursor RNA and VGAM502 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM501 RNA and VGAM502 RNA, herein schematically represented by VGAM1 RNA through VGAM3 RNA, each of which VGAM RNAs corresponding to VGAM RNA of FIG. 1.

VGAM501 RNA, herein schematically represented by VGAM1 RNA through VGAM3 RNA, binds complementarily to a host target binding site located in an untranslated region of VGAM501 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM501 host target RNA into VGAM501 host target protein, herein schematically represented by VGAM1 HOST TARGET PROTEIN through VGAM3 HOST TARGET PROTEIN, all of FIG. 1.

VGAM502 RNA, herein schematically represented by VGAM1 RNA through VGAM3 RNA, binds complementarily to a host target binding site located in an untranslated region of VGAM502 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM502 host target RNA into VGAM502 host target protein, herein schematically represented by VGAM1 HOST TARGET PROTEIN through VGAM3 HOST TARGET PROTEIN, all of FIG. 1.

It is appreciated that a function of VGR2827 gene, herein designated VGR GENE, is inhibition of expression of host target genes, as part of a novel viral mechanism of attacking a host. Accordingly, utilities of VGR2827 gene include diagnosis, prevention and treatment of viral infection by Carrot Mottle Mimic Virus. Specific functions, and accordingly utilities, of VGR2827 gene correlate with, and may be deduced from, the identity of the host target genes, which are inhibited by VGAM RNAs comprised in the 'operon-like' cluster of VGR2827 gene: VGAM501 host target protein and VGAM502 host target protein, herein schematically represented by VGAM1 HOST TARGET PROTEIN through VGAM3 HOST TARGET PROTEIN. The function of these host target genes is elaborated hereinabove with reference to VGAM501 and VGAM502. FIG. 9 further provides a conceptual description of novel bioinformatically detected regulatory viral gene, referred to here as Viral Genomic Record 2828(VGR2828) viral gene, which encodes an 'operon-like' cluster of novel viral micro RNA-like genes, each of which in turn modulates expression of at least one host target gene, the function and utility of which at least one host target gene is known in the art.

VGR2828 gene, herein designated VGR GENE, is a novel bioinformatically detected regulatory, non protein coding, RNA viral gene. The method by which VGR2828 gene was detected is described hereinabove with reference to FIGS. 1-9.

VGR2828 gene encodes VGR2828 precursor RNA, herein designated VGR PRECURSOR RNA, an RNA molecule, typically several hundred nucleotides long.

VGR2828 precursor RNA folds spatially, forming VGR2828 folded precursor RNA, herein designated VGR FOLDED PRECURSOR RNA. It is appreciated that VGR2828 folded precursor RNA comprises a plurality of what is known in the art as 'hairpin' structures. These 'hairpin' structures are due to the fact that the nucleotide sequence of VGR2828 precursor RNA comprises a plurality of segments, the first half of each such segment having a nucleotide sequence which is at least a partial inversed-reversed sequence of the second half thereof, as is well known in the art.

VGR2828 folded precursor RNA is naturally processed by cellular enzymatic activity into at least 3 separate VGAM precursor RNAs, VGAM506 precursor RNA, VGAM507 precursor RNA and VGAM508 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM506 RNA, VGAM507 RNA and VGAM508 RNA, herein schematically represented by VGAM1 RNA through VGAM3 RNA, each of which VGAM RNAs corresponding to VGAM RNA of FIG. 1.

VGAM506 RNA, herein schematically represented by VGAM1 RNA through VGAM3 RNA, binds complementarily to a host target binding site located in an untranslated region of VGAM506 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM506 host target RNA into VGAM506 host target protein, herein schematically represented by VGAM1 HOST TARGET PROTEIN through VGAM3 HOST TARGET PROTEIN, all of FIG. 1.

VGAM507 RNA, herein schematically represented by VGAM1 RNA through VGAM3 RNA, binds complementarily to a host target binding site located in an untranslated region of VGAM507 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM507 host target RNA into VGAM507 host target protein, herein schematically represented by VGAM1 HOST TARGET PROTEIN through VGAM3 HOST TARGET PROTEIN, all of FIG. 1.

VGAM508 RNA, herein schematically represented by VGAM1 RNA through VGAM3 RNA, binds complementarily to a host target binding site located in an untranslated region of VGAM508 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM508 host target RNA into VGAM508 host target protein, herein schematically represented by VGAM1 HOST TARGET PROTEIN through VGAM3 HOST TARGET PROTEIN, all of FIG. 1.

It is appreciated that a function of VGR2828 gene, herein designated VGR GENE, is inhibition of expression of host target genes, as part of a novel viral mechanism of attacking a host. Accordingly, utilities of VGR2828 gene include diagnosis, prevention and treatment of viral infection by Saguaro Cactus Virus. Specific functions, and accordingly utilities, of VGR2828 gene correlate with, and may be deduced from, the identity of the host target genes, which are inhibited by VGAM RNAs comprised in the 'operon-like' cluster of VGR2828 gene: VGAM506 host target protein, VGAM507 host target protein and VGAM508 host target protein, herein schematically represented by VGAM1 HOST TARGET PROTEIN through VGAM3 HOST TARGET PROTEIN. The function of these host target genes is elaborated hereinabove with reference to VGAM506, VGAM507 and VGAM508. FIG. 9 further provides a conceptual description of novel bioinformatically detected regulatory viral gene, referred to here as Viral Genomic Record 2829(VGR2829) viral gene, which encodes an 'operon-like' cluster of novel viral micro RNA-like genes, each of which in turn modulates expression of at least one host target gene, the function and utility of which at least one host target gene is known in the art.

VGR2829 gene, herein designated VGR GENE, is a novel bioinformatically detected regulatory, non protein coding, RNA viral gene. The method by which VGR2829 gene was detected is described hereinabove with reference to FIGS. 1-9.

VGR2829 gene encodes VGR2829 precursor RNA, herein designated VGR PRECURSOR RNA, an RNA molecule, typically several hundred nucleotides long.

VGR2829 precursor RNA folds spatially, forming VGR2829 folded precursor RNA, herein designated VGR FOLDED PRECURSOR RNA. It is appreciated that VGR2829 folded precursor RNA comprises a plurality of what is known in the art as 'hairpin' structures. These 'hairpin' structures are due to the fact that the nucleotide sequence of VGR2829 precursor RNA comprises a plurality of segments, the first half of each such segment having a nucleotide sequence which is at least a partial inversed-reversed sequence of the second half thereof, as is well known in the art.

VGR2829 folded precursor RNA is naturally processed by cellular enzymatic activity into at least 2 separate VGAM precursor RNAs, VGAM509 precursor RNA and VGAM510 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM509 RNA and VGAM510 RNA, herein schematically represented by VGAM1 RNA through VGAM3 RNA, each of which VGAM RNAs corresponding to VGAM RNA of FIG. 1.

VGAM509 RNA, herein schematically represented by VGAM1 RNA through VGAM3 RNA, binds complementarily to a host target binding site located in an untranslated region of VGAM509 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM509 host target RNA into VGAM509 host target protein, herein schematically represented by VGAM1 HOST TARGET PROTEIN through VGAM3 HOST TARGET PROTEIN, all of FIG. 1.

VGAM510 RNA, herein schematically represented by VGAM1 RNA through VGAM3 RNA, binds complementarily to a host target binding site located in an untranslated region of VGAM510 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM510 host target RNA into VGAM510 host target protein, herein schematically represented by VGAM1 HOST TARGET PROTEIN through VGAM3 HOST TARGET PROTEIN, all of FIG. 1.

It is appreciated that a function of VGR2829 gene, herein designated VGR GENE, is inhibition of expression of host target genes, as part of a novel viral mechanism of attacking a host. Accordingly, utilities of VGR2829 gene include diagnosis, prevention and treatment of viral infection by Papaya Ringspot Virus. Specific functions, and accordingly utilities, of VGR2829 gene correlate with, and may be deduced from, the identity of the host target genes, which are inhibited by VGAM RNAs comprised in the 'operon-like' cluster of VGR2829 gene: VGAM509 host target protein and VGAM510 host target protein, herein schematically represented by VGAM1 HOST TARGET PROTEIN through VGAM3 HOST TARGET PROTEIN. The function of these host target genes is elaborated hereinabove with reference to VGAM509 and VGAM510. FIG. 9 further provides a conceptual description of novel bioinformatically detected regulatory viral gene, referred to here as Viral Genomic Record 2830(VGR2830) viral gene, which encodes an 'operon-like' cluster of novel viral micro RNA-like genes, each of which in turn modulates expression of at least one host target gene, the function and utility of which at least one host target gene is known in the art.

VGR2830 gene, herein designated VGR GENE, is a novel bioinformatically detected regulatory, non protein coding, RNA viral gene. The method by which VGR2830 gene was detected is described hereinabove with reference to FIGS. 1-9.

VGR2830 gene encodes VGR2830 precursor RNA, herein designated VGR PRECURSOR RNA, an RNA molecule, typically several hundred nucleotides long.

VGR2830 precursor RNA folds spatially, forming VGR2830 folded precursor RNA, herein designated VGR FOLDED PRECURSOR RNA. It is appreciated that VGR2830 folded precursor RNA comprises a plurality of what is known in the art as 'hairpin' structures. These 'hairpin' structures are due to the fact that the nucleotide sequence of VGR2830 precursor RNA comprises a plurality of segments, the first half of each such segment having a nucleotide sequence which is at least a partial inversed-reversed sequence of the second half thereof, as is well known in the art.

VGR2830 folded precursor RNA is naturally processed by cellular enzymatic activity into at least 5 separate VGAM precursor RNAs, VGAM511 precursor RNA, VGAM512 precursor RNA, VGAM513 precursor RNA, VGAM514 precursor RNA and VGAM515 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM511 RNA, VGAM512 RNA, VGAM513 RNA, VGAM514 RNA and VGAM515 RNA, herein schematically represented by VGAM1 RNA through VGAM3 RNA, each of which VGAM RNAs corresponding to VGAM RNA of FIG. 1.

VGAM511 RNA, herein schematically represented by VGAM1 RNA through VGAM3 RNA, binds complementarily to a host target binding site located in an untranslated region of VGAM511 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM511 host target RNA into VGAM511 host target protein, herein schematically represented by VGAM1 HOST TARGET PROTEIN through VGAM3 HOST TARGET PROTEIN, all of FIG. 1.

VGAM512 RNA, herein schematically represented by VGAM1 RNA through VGAM3 RNA, binds complementarily to a host target binding site located in an untranslated region of VGAM512 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM512 host target RNA into VGAM512 host target protein, herein schematically represented by VGAM1 HOST TARGET PROTEIN through VGAM3 HOST TARGET PROTEIN, all of FIG. 1.

VGAM513 RNA, herein schematically represented by VGAM1 RNA through VGAM3 RNA, binds complementarily to a host target binding site located in an untranslated region of VGAM513 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM513 host target RNA into VGAM513 host target protein, herein schematically represented by VGAM1 HOST TARGET PROTEIN through VGAM3 HOST TARGET PROTEIN, all of FIG. 1.

VGAM514 RNA, herein schematically represented by VGAM1 RNA through VGAM3 RNA, binds complementarily to a host target binding site located in an untranslated region of VGAM514 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM514 host target RNA into VGAM514 host target protein, herein schematically represented by VGAM1 HOST TARGET PROTEIN through VGAM3 HOST TARGET PROTEIN, all of FIG. 1.

VGAM515 RNA, herein schematically represented by VGAM1 RNA through VGAM3 RNA, binds complementarily to a host target binding site located in an untranslated region of VGAM515 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM515 host target RNA into VGAM515 host target protein, herein schematically represented by VGAM1 HOST TARGET PROTEIN through VGAM3 HOST TARGET PROTEIN, all of FIG. 1.

It is appreciated that a function of VGR2830 gene, herein designated VGR GENE, is inhibition of expression of host target genes, as part of a novel viral mechanism of attacking a host. Accordingly, utilities of VGR2830 gene include diagnosis, prevention and treatment of viral infection by Cucumber Green Mottle Mosaic Virus. Specific functions, and accordingly utilities, of VGR2830 gene correlate with, and may be deduced from, the identity of the host target genes, which are inhibited by VGAM RNAs comprised in the 'operon-like' cluster of VGR2830 gene: VGAM511 host target protein, VGAM512 host target protein, VGAM513 host target protein, VGAM514 host target protein and VGAM515 host target protein, herein schematically represented by VGAM1 HOST TARGET PROTEIN through VGAM3 HOST TARGET PROTEIN. The function of these host target genes is elaborated hereinabove with reference to VGAM511, VGAM512, VGAM513, VGAM514 and VGAM515. FIG. 9 further provides a conceptual description of novel bioinformatically detected regulatory viral gene, referred to here as Viral Genomic Record 2831(VGR2831) viral gene, which encodes an 'operon-like' cluster of novel viral micro RNA-like genes, each of which in turn modulates expression of at least one host target gene, the function and utility of which at least one host target gene is known in the art.

VGR2831 gene, herein designated VGR GENE, is a novel bioinformatically detected regulatory, non protein coding, RNA viral gene. The method by which VGR2831 gene was detected is described hereinabove with reference to FIGS. 1-9.

VGR2831 gene encodes VGR2831 precursor RNA, herein designated VGR PRECURSOR RNA, an RNA molecule, typically several hundred nucleotides long.

VGR2831 precursor RNA folds spatially, forming VGR2831 folded precursor RNA, herein designated VGR FOLDED PRECURSOR RNA. It is appreciated that VGR2831 folded precursor RNA comprises a plurality of what is known in the art as 'hairpin' structures. These 'hairpin' structures are due to the fact that the nucleotide sequence of VGR2831 precursor RNA comprises a plurality of segments, the first half of each such segment having a nucleotide sequence which is at least a partial inversed-reversed sequence of the second half thereof, as is well known in the art.

VGR2831 folded precursor RNA is naturally processed by cellular enzymatic activity into at least 2 separate VGAM precursor RNAs, VGAM516 precursor RNA and VGAM517 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM516 RNA and VGAM517 RNA, herein schematically represented by VGAM1 RNA through VGAM3 RNA, each of which VGAM RNAs corresponding to VGAM RNA of FIG. 1.

VGAM516 RNA, herein schematically represented by VGAM1 RNA through VGAM3 RNA, binds complementarily to a host target binding site located in an untranslated region of VGAM516 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM516 host target RNA into VGAM516 host target protein, herein schematically represented by VGAM1 HOST TARGET PROTEIN through VGAM3 HOST TARGET PROTEIN, all of FIG. 1.

VGAM517 RNA, herein schematically represented by VGAM1 RNA through VGAM3 RNA, binds complementarily to a host target binding site located in an untranslated region of VGAM517 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM517 host target RNA into VGAM517 host target protein, herein schematically represented by VGAM1 HOST TARGET PROTEIN through VGAM3 HOST TARGET PROTEIN, all of FIG. 1.

It is appreciated that a function of VGR2831 gene, herein designated VGR GENE, is inhibition of expression of host target genes, as part of a novel viral mechanism of attacking a host. Accordingly, utilities of VGR2831 gene include diagnosis, prevention and treatment of viral infection by Galinsoga Mosaic Virus. Specific functions, and accordingly utilities, of VGR2831 gene correlate with, and may be deduced from, the identity of the host target genes, which are inhibited by VGAM RNAs comprised in the 'operon-like' cluster of VGR2831 gene: VGAM516 host target protein and VGAM517 host target protein, herein schematically represented by VGAM1 HOST TARGET PROTEIN through VGAM3 HOST TARGET PROTEIN. The function of these host target genes is elaborated hereinabove with reference to VGAM516 and VGAM517. FIG. 9 further provides a conceptual description of novel bioinformatically detected regulatory viral gene, referred to here as Viral Genomic Record 2832(VGR2832) viral gene, which encodes an 'operon-like' cluster of novel viral micro RNA-like genes, each of which in turn modulates expression of at least one host target gene, the function and utility of which at least one host target gene is known in the art.

VGR2832 gene, herein designated VGR GENE, is a novel bioinformatically detected regulatory, non protein coding, RNA viral gene. The method by which VGR2832 gene was detected is described hereinabove with reference to FIGS. 1-9.

VGR2832 gene encodes VGR2832 precursor RNA, herein designated VGR PRECURSOR RNA, an RNA molecule, typically several hundred nucleotides long.

VGR2832 precursor RNA folds spatially, forming VGR2832 folded precursor RNA, herein designated VGR FOLDED PRECURSOR RNA. It is appreciated that VGR2832 folded precursor RNA comprises a plurality of what is known in the art as 'hairpin' structures. These 'hairpin' structures are due to the fact that the nucleotide sequence of VGR2832 precursor RNA comprises a plurality of segments, the first half of each such segment having a nucleotide sequence which is at least a partial inversed-reversed sequence of the second half thereof, as is well known in the art.

VGR2832 folded precursor RNA is naturally processed by cellular enzymatic activity into at least 2 separate VGAM precursor RNAs, VGAM519 precursor RNA and VGAM520 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM519 RNA and VGAM520 RNA, herein schematically represented by VGAM1 RNA through VGAM3 RNA, each of which VGAM RNAs corresponding to VGAM RNA of FIG. 1.

VGAM519 RNA, herein schematically represented by VGAM1 RNA through VGAM3 RNA, binds complementarily to a host target binding site located in an untranslated region of VGAM519 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM519 host target RNA into VGAM519 host target protein, herein schematically represented by VGAM1 HOST TARGET PROTEIN through VGAM3 HOST TARGET PROTEIN, all of FIG. 1.

VGAM520 RNA, herein schematically represented by VGAM1 RNA through VGAM3 RNA, binds complementarily to a host target binding site located in an untranslated region of VGAM520 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM520 host target RNA into VGAM520 host target protein, herein schematically represented by VGAM1 HOST TARGET PROTEIN through VGAM3 HOST TARGET PROTEIN, all of FIG. 1.

It is appreciated that a function of VGR2832 gene, herein designated VGR GENE, is inhibition of expression of host target genes, as part of a novel viral mechanism of attacking a host. Accordingly, utilities of VGR2832 gene include diagnosis, prevention and treatment of viral infection by Lymphocystis Disease Virus 1. Specific functions, and accordingly utilities, of VGR2832 gene correlate with, and may be deduced from, the identity of the host target genes, which are inhibited by VGAM RNAs comprised in the 'operon-like' cluster of VGR2832 gene: VGAM519 host target protein and VGAM520 host target protein, herein schematically represented by VGAM1 HOST TARGET PROTEIN through VGAM3 HOST TARGET PROTEIN. The function of these host target genes is elaborated hereinabove with reference to VGAM519 and VGAM520. FIG. 9 further provides a conceptual description of novel bioinformatically detected regulatory viral gene, referred to here as Viral Genomic Record 2833(VGR2833) viral gene, which encodes an 'operon-like' cluster of novel viral micro RNA-like genes, each of which in turn modulates expression of at least one host target gene, the function and utility of which at least one host target gene is known in the art.

VGR2833 gene, herein designated VGR GENE, is a novel bioinformatically detected regulatory, non protein coding, RNA viral gene. The method by which VGR2833 gene was detected is described hereinabove with reference to FIGS. 1-9.

VGR2833 gene encodes VGR2833 precursor RNA, herein designated VGR PRECURSOR RNA, an RNA molecule, typically several hundred nucleotides long.

VGR2833 precursor RNA folds spatially, forming VGR2833 folded precursor RNA, herein designated VGR FOLDED PRECURSOR RNA. It is appreciated that VGR2833 folded precursor RNA comprises a plurality of what is known in the art as 'hairpin' structures. These 'hairpin' structures are due to the fact that the nucleotide sequence of VGR2833 precursor RNA comprises a plurality of segments, the first half of each such segment having a nucleotide sequence which is at least a partial inversed-reversed sequence of the second half thereof, as is well known in the art.

VGR2833 folded precursor RNA is naturally processed by cellular enzymatic activity into at least 2 separate VGAM precursor RNAs, VGAM521 precursor RNA and VGAM522 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM521 RNA and VGAM522 RNA, herein schematically represented by VGAM1 RNA through VGAM3 RNA, each of which VGAM RNAs corresponding to VGAM RNA of FIG. 1.

VGAM521 RNA, herein schematically represented by VGAM1 RNA through VGAM3 RNA, binds complementarily to a host target binding site located in an untranslated region of VGAM521 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM521 host target RNA into VGAM521 host target protein, herein schematically represented by VGAM1 HOST TARGET PROTEIN through VGAM3 HOST TARGET PROTEIN, all of FIG. 1.

VGAM522 RNA, herein schematically represented by VGAM1 RNA through VGAM3 RNA, binds complementarily to a host target binding site located in an untranslated region of VGAM522 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM522 host target RNA into VGAM522 host target protein, herein schematically represented by VGAM1 HOST TARGET PROTEIN through VGAM3 HOST TARGET PROTEIN, all of FIG. 1.

It is appreciated that a function of VGR2833 gene, herein designated VGR GENE, is inhibition of expression of host target genes, as part of a novel viral mechanism of attacking a host. Accordingly, utilities of VGR2833 gene include diagnosis, prevention and treatment of viral infection by Lymphocystis Disease Virus 1. Specific functions, and accordingly utilities, of VGR2833 gene correlate with, and may be deduced from, the identity of the host target genes, which are inhibited by VGAM RNAs comprised in the 'operon-like' cluster of VGR2833 gene: VGAM521 host target protein and VGAM522 host target protein, herein schematically represented by VGAM1 HOST TARGET PROTEIN through VGAM3 HOST TARGET PROTEIN. The function of these host target genes is elaborated hereinabove with reference to VGAM521 and VGAM522. FIG. 9 further provides a conceptual description of novel bioinformatically detected regulatory viral gene, referred to here as Viral Genomic Record 2834(VGR2834) viral gene, which encodes an 'operon-like' cluster of novel viral micro RNA-like genes, each of which in turn modulates expression of at least one host target gene, the function and utility of which at least one host target gene is known in the art.

VGR2834 gene, herein designated VGR GENE, is a novel bioinformatically detected regulatory, non protein coding, RNA viral gene. The method by which VGR2834 gene was detected is described hereinabove with reference to FIGS. 1-9.

VGR2834 gene encodes VGR2834 precursor RNA, herein designated VGR PRECURSOR RNA, an RNA molecule, typically several hundred nucleotides long.

VGR2834 precursor RNA folds spatially, forming VGR2834 folded precursor RNA, herein designated VGR FOLDED PRECURSOR RNA. It is appreciated that VGR2834 folded precursor RNA comprises a plurality of what is known in the art as 'hairpin' structures. These 'hairpin' structures are due to the fact that the nucleotide sequence of VGR2834 precursor RNA comprises a plurality of segments, the first half of each such segment having a nucleotide sequence which is at least a partial inversed-reversed sequence of the second half thereof, as is well known in the art.

VGR2834 folded precursor RNA is naturally processed by cellular enzymatic activity into at least 2 separate VGAM precursor RNAs, VGAM523 precursor RNA and VGAM524 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM523 RNA and VGAM524 RNA, herein schematically represented by VGAM1 RNA through VGAM3 RNA, each of which VGAM RNAs corresponding to VGAM RNA of FIG. 1.

VGAM523 RNA, herein schematically represented by VGAM1 RNA through VGAM3 RNA, binds complementarily to a host target binding site located in an untranslated region of VGAM523 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM523 host target RNA into VGAM523 host target protein, herein schematically represented by VGAM1 HOST TARGET PROTEIN through VGAM3 HOST TARGET PROTEIN, all of FIG. 1.

VGAM524 RNA, herein schematically represented by VGAM1 RNA through VGAM3 RNA, binds complementarily to a host target binding site located in an untranslated region of VGAM524 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM524 host target RNA into VGAM524 host target protein, herein schematically represented by VGAM1 HOST TARGET PROTEIN through VGAM3 HOST TARGET PROTEIN, all of FIG. 1.

It is appreciated that a function of VGR2834 gene, herein designated VGR GENE, is inhibition of expression of host target genes, as part of a novel viral mechanism of attacking a host. Accordingly, utilities of VGR2834 gene include diagnosis, prevention and treatment of viral infection by Murid Herpesvirus 4. Specific functions, and accordingly utilities, of VGR2834 gene correlate with, and may be deduced from, the identity of the host target genes, which are inhibited by VGAM RNAs comprised in the 'operon-like' cluster of VGR2834 gene: VGAM523 host target protein and VGAM524 host target protein, herein schematically represented by VGAM1 HOST TARGET PROTEIN through VGAM3 HOST TARGET PROTEIN. The function of these host target genes is elaborated hereinabove with reference to VGAM523 and VGAM524. FIG. 9 further provides a conceptual description of novel bioinformatically detected regulatory viral gene, referred to here as Viral Genomic Record 2835(VGR2835) viral gene, which encodes an 'operon-like' cluster of novel viral micro RNA-like genes, each of which in turn modulates expression of at least one host target gene, the function and utility of which at least one host target gene is known in the art.

VGR2835 gene, herein designated VGR GENE, is a novel bioinformatically detected regulatory, non protein coding, RNA viral gene. The method by which VGR2835 gene was detected is described hereinabove with reference to FIGS. 1-9.

VGR2835 gene encodes VGR2835 precursor RNA, herein designated VGR PRECURSOR RNA, an RNA molecule, typically several hundred nucleotides long.

VGR2835 precursor RNA folds spatially, forming VGR2835 folded precursor RNA, herein designated VGR FOLDED PRECURSOR RNA. It is appreciated that VGR2835 folded precursor RNA comprises a plurality of what is known in the art as 'hairpin' structures. These 'hairpin' structures are due to the fact that the nucleotide sequence of VGR2835 precursor RNA comprises a plurality of segments, the first half of each such segment having a nucleotide sequence which is at least a partial inversed-reversed sequence of the second half thereof, as is well known in the art.

VGR2835 folded precursor RNA is naturally processed by cellular enzymatic activity into at least 2 separate VGAM precursor RNAs, VGAM525 precursor RNA and VGAM526 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM525 RNA and VGAM526 RNA, herein schematically represented by VGAM1 RNA through VGAM3 RNA, each of which VGAM RNAs corresponding to VGAM RNA of FIG. 1.

VGAM525 RNA, herein schematically represented by VGAM1 RNA through VGAM3 RNA, binds complementarily to a host target binding site located in an untranslated region of VGAM525 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM525 host target RNA into VGAM525 host target protein, herein schematically represented by VGAM1 HOST TARGET PROTEIN through VGAM3 HOST TARGET PROTEIN, all of FIG. 1.

VGAM526 RNA, herein schematically represented by VGAM1 RNA through VGAM3 RNA, binds complementarily to a host target binding site located in an untranslated region of VGAM526 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM526 host target RNA into VGAM526 host target protein, herein schematically represented by VGAM1 HOST TARGET PROTEIN through VGAM3 HOST TARGET PROTEIN, all of FIG. 1.

It is appreciated that a function of VGR2835 gene, herein designated VGR GENE, is inhibition of expression of host target genes, as part of a novel viral mechanism of attacking a host. Accordingly, utilities of VGR2835 gene include diagnosis, prevention and treatment of viral infection by Murid Herpesvirus 4. Specific functions, and accordingly utilities, of VGR2835 gene correlate with, and may be deduced from, the identity of the host target genes, which are inhibited by VGAM RNAs comprised in the 'operon-like' cluster of VGR2835 gene: VGAM525 host target protein and VGAM526 host target protein, herein schematically represented by VGAM1 HOST TARGET PROTEIN through VGAM3 HOST TARGET PROTEIN. The function of these host target genes is elaborated hereinabove with reference to VGAM525 and VGAM526. FIG. 9 further provides a conceptual description of novel bioinformatically detected regulatory viral gene, referred to here as Viral Genomic Record 2836(VGR2836) viral gene, which encodes an 'operon-like' cluster of novel viral micro RNA-like genes, each of which in turn modulates expression of at least one host target gene, the function and utility of which at least one host target gene is known in the art.

VGR2836 gene, herein designated VGR GENE, is a novel bioinformatically detected regulatory, non protein coding, RNA viral gene. The method by which VGR2836 gene was detected is described hereinabove with reference to FIGS. 1-9.

VGR2836 gene encodes VGR2836 precursor RNA, herein designated VGR PRECURSOR RNA, an RNA molecule, typically several hundred nucleotides long.

VGR2836 precursor RNA folds spatially, forming VGR2836 folded precursor RNA, herein designated VGR FOLDED PRECURSOR RNA. It is appreciated that VGR2836 folded precursor RNA comprises a plurality of what is known in the art as 'hairpin' structures. These 'hairpin' structures are due to the fact that the nucleotide sequence of VGR2836 precursor RNA comprises a plurality of segments, the first half of each such segment having a nucleotide sequence which is at least a partial inversed-reversed sequence of the second half thereof, as is well known in the art.

VGR2836 folded precursor RNA is naturally processed by cellular enzymatic activity into at least 2 separate VGAM precursor RNAs, VGAM536 precursor RNA and VGAM537 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM536 RNA and VGAM537 RNA, herein schematically represented by VGAM1 RNA through VGAM3 RNA, each of which VGAM RNAs corresponding to VGAM RNA of FIG. 1.

VGAM536 RNA, herein schematically represented by VGAM1 RNA through VGAM3 RNA, binds complementarily to a host target binding site located in an untranslated region of VGAM536 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM536 host target RNA into VGAM536 host target protein, herein schematically represented by VGAM1 HOST TARGET PROTEIN through VGAM3 HOST TARGET PROTEIN, all of FIG. 1.

VGAM537 RNA, herein schematically represented by VGAM1 RNA through VGAM3 RNA, binds complementarily to a host target binding site located in an untranslated region of VGAM537 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM537 host target RNA into VGAM537 host target protein, herein schematically represented by VGAM1 HOST TARGET PROTEIN through VGAM3 HOST TARGET PROTEIN, all of FIG. 1.

It is appreciated that a function of VGR2836 gene, herein designated VGR GENE, is inhibition of expression of host target genes, as part of a novel viral mechanism of attacking a host. Accordingly, utilities of VGR2836 gene include diagnosis, prevention and treatment of viral infection by Ateline Herpesvirus 3. Specific functions, and accordingly utilities, of VGR2836 gene correlate with, and may be deduced from, the identity of the host target genes, which are inhibited by VGAM RNAs comprised in the 'operon-like' cluster of VGR2836 gene: VGAM536 host target protein and VGAM537 host target protein, herein schematically represented by VGAM1 HOST TARGET PROTEIN through VGAM3 HOST TARGET PROTEIN. The function of these host target genes is elaborated hereinabove with reference to VGAM536 and VGAM537. FIG. 9 further provides a conceptual description of novel bioinformatically detected regulatory viral gene, referred to here as Viral Genomic Record 2837(VGR2837) viral gene, which encodes an 'operon-like' cluster of novel viral micro RNA-like genes, each of which in turn modulates expression of at least one host target gene, the function and utility of which at least one host target gene is known in the art.

VGR2837 gene, herein designated VGR GENE, is a novel bioinformatically detected regulatory, non protein coding, RNA viral gene. The method by which VGR2837 gene was detected is described hereinabove with reference to FIGS. 1-9.

VGR2837 gene encodes VGR2837 precursor RNA, herein designated VGR PRECURSOR RNA, an RNA molecule, typically several hundred nucleotides long.

VGR2837 precursor RNA folds spatially, forming VGR2837 folded precursor RNA, herein designated VGR FOLDED PRECURSOR RNA. It is appreciated that VGR2837 folded precursor RNA comprises a plurality of what is known in the art as 'hairpin' structures. These 'hairpin' structures are due to the fact that the nucleotide sequence of VGR2837 precursor RNA comprises a plurality of segments, the first half of each such segment having a nucleotide sequence which is at least a partial inversed-reversed sequence of the second half thereof, as is well known in the art.

VGR2837 folded precursor RNA is naturally processed by cellular enzymatic activity into at least 3 separate VGAM precursor RNAs, VGAM539 precursor RNA, VGAM540 precursor RNA and VGAM541 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM539 RNA, VGAM540 RNA and VGAM541 RNA, herein schematically represented by VGAM1 RNA through VGAM3 RNA, each of which VGAM RNAs corresponding to VGAM RNA of FIG. 1.

VGAM539 RNA, herein schematically represented by VGAM1 RNA through VGAM3 RNA, binds complementarily to a host target binding site located in an untranslated region of VGAM539 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM539 host target RNA into VGAM539 host target protein, herein schematically represented by VGAM1 HOST TARGET PROTEIN through VGAM3 HOST TARGET PROTEIN, all of FIG. 1.

VGAM540 RNA, herein schematically represented by VGAM1 RNA through VGAM3 RNA, binds complementarily to a host target binding site located in an untranslated region of VGAM540 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM540 host target RNA into VGAM540 host target protein, herein schematically represented by VGAM1 HOST TARGET PROTEIN through VGAM3 HOST TARGET PROTEIN, all of FIG. 1.

VGAM541 RNA, herein schematically represented by VGAM1 RNA through VGAM3 RNA, binds complementarily to a host target binding site located in an untranslated region of VGAM541 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM541 host target RNA into VGAM541 host target protein, herein schematically represented by VGAM1 HOST TARGET PROTEIN through VGAM3 HOST TARGET PROTEIN, all of FIG. 1.

It is appreciated that a function of VGR2837 gene, herein designated VGR GENE, is inhibition of expression of host target genes, as part of a novel viral mechanism of attacking a host. Accordingly, utilities of VGR2837 gene include diagnosis, prevention and treatment of viral infection by Bovine Respiratory Syncytial Virus. Specific functions, and accordingly utilities, of VGR2837 gene correlate with, and may be deduced from, the identity of the host target genes, which are inhibited by VGAM RNAs comprised in the 'operon-like' cluster of VGR2837 gene: VGAM539 host target protein, VGAM540 host target protein and VGAM541 host target protein, herein schematically represented by VGAM1 HOST TARGET PROTEIN through VGAM3 HOST TARGET PROTEIN. The function of these host target genes is elaborated hereinabove with reference to VGAM539, VGAM540 and VGAM541. FIG. 9 further provides a conceptual description of novel bioinformatically detected regulatory viral gene, referred to here as Viral Genomic Record 2838(VGR2838) viral gene, which encodes an 'operon-like' cluster of novel viral micro RNA-like genes, each of which in turn modulates expression of at least one host target gene, the function and utility of which at least one host target gene is known in the art.

VGR2838 gene, herein designated VGR GENE, is a novel bioinformatically detected regulatory, non protein coding, RNA viral gene. The method by which VGR2838 gene was detected is described hereinabove with reference to FIGS. 1-9.

VGR2838 gene encodes VGR2838 precursor RNA, herein designated VGR PRECURSOR RNA, an RNA molecule, typically several hundred nucleotides long.

VGR2838 precursor RNA folds spatially, forming VGR2838 folded precursor RNA, herein designated VGR FOLDED PRECURSOR RNA. It is appreciated that VGR2838 folded precursor RNA comprises a plurality of what is known in the art as 'hairpin' structures. These 'hairpin' structures are due to the fact that the nucleotide sequence of VGR2838 precursor RNA comprises a plurality of segments, the first half of each such segment having a nucleotide sequence which is at least a partial inversed-reversed sequence of the second half thereof, as is well known in the art.

VGR2838 folded precursor RNA is naturally processed by cellular enzymatic activity into at least 2 separate VGAM precursor RNAs, VGAM546 precursor RNA and VGAM547 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM546 RNA and VGAM547 RNA, herein schematically represented by VGAM1 RNA through VGAM3 RNA, each of which VGAM RNAs corresponding to VGAM RNA of FIG. 1.

VGAM546 RNA, herein schematically represented by VGAM1 RNA through VGAM3 RNA, binds complementarily to a host target binding site located in an untranslated region of VGAM546 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM546 host target RNA into VGAM546 host target protein, herein schematically represented by VGAM1 HOST TARGET PROTEIN through VGAM3 HOST TARGET PROTEIN, all of FIG. 1.

VGAM547 RNA, herein schematically represented by VGAM1 RNA through VGAM3 RNA, binds complementarily to a host target binding site located in an untranslated region of VGAM547 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM547 host target RNA into VGAM547 host target protein, herein schematically represented by VGAM1 HOST TARGET PROTEIN through VGAM3 HOST TARGET PROTEIN, all of FIG. 1.

It is appreciated that a function of VGR2838 gene, herein designated VGR GENE, is inhibition of expression of host target genes, as part of a novel viral mechanism of attacking a host. Accordingly, utilities of VGR2838 gene include diagnosis, prevention and treatment of viral infection by Peanut Stunt Virus. Specific functions, and accordingly utilities, of VGR2838 gene correlate with, and may be deduced from, the identity of the host target genes, which are inhibited by VGAM RNAs comprised in the 'operon-like' cluster of VGR2838 gene: VGAM546 host target protein and VGAM547 host target protein, herein schematically represented by VGAM1 HOST TARGET PROTEIN through VGAM3 HOST TARGET PROTEIN. The function of these host target genes is elaborated hereinabove with reference to VGAM546 and VGAM547. FIG. 9 further provides a conceptual description of novel bioinformatically detected regulatory viral gene, referred to here as Viral Genomic Record 2839(VGR2839) viral gene, which encodes an 'operon-like' cluster of novel viral micro RNA-like genes, each of which in turn modulates expression of at least one host target gene, the function and utility of which at least one host target gene is known in the art.

VGR2839 gene, herein designated VGR GENE, is a novel bioinformatically detected regulatory, non protein coding, RNA viral gene. The method by which VGR2839 gene was detected is described hereinabove with reference to FIGS. 1-9.

VGR2839 gene encodes VGR2839 precursor RNA, herein designated VGR PRECURSOR RNA, an RNA molecule, typically several hundred nucleotides long.

VGR2839 precursor RNA folds spatially, forming VGR2839 folded precursor RNA, herein designated VGR FOLDED PRECURSOR RNA. It is appreciated that VGR2839 folded precursor RNA comprises a plurality of what is known in the art as 'hairpin' structures. These 'hairpin' structures are due to the fact that the nucleotide sequence of VGR2839 precursor RNA comprises a plurality of segments, the first half of each such segment having a nucleotide sequence which is at least a partial inversed-reversed sequence of the second half thereof, as is well known in the art.

VGR2839 folded precursor RNA is naturally processed by cellular enzymatic activity into at least 2 separate VGAM precursor RNAs, VGAM550 precursor RNA and VGAM551 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM550

RNA and VGAM551 RNA, herein schematically represented by VGAM1 RNA through VGAM3 RNA, each of which VGAM RNAs corresponding to VGAM RNA of FIG. 1.

VGAM550 RNA, herein schematically represented by VGAM1 RNA through VGAM3 RNA, binds complementarily to a host target binding site located in an untranslated region of VGAM550 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM550 host target RNA into VGAM550 host target protein, herein schematically represented by VGAM1 HOST TARGET PROTEIN through VGAM3 HOST TARGET PROTEIN, all of FIG. 1.

VGAM551 RNA, herein schematically represented by VGAM1 RNA through VGAM3 RNA, binds complementarily to a host target binding site located in an untranslated region of VGAM551 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM551 host target RNA into VGAM551 host target protein, herein schematically represented by VGAM1 HOST TARGET PROTEIN through VGAM3 HOST TARGET PROTEIN, all of FIG. 1.

It is appreciated that a function of VGR2839 gene, herein designated VGR GENE, is inhibition of expression of host target genes, as part of a novel viral mechanism of attacking a host. Accordingly, utilities of VGR2839 gene include diagnosis, prevention and treatment of viral infection by Leishmania RNA Virus 2-1. Specific functions, and accordingly utilities, of VGR2839 gene correlate with, and may be deduced from, the identity of the host target genes, which are inhibited by VGAM RNAs comprised in the 'operon-like' cluster of VGR2839 gene: VGAM550 host target protein and VGAM551 host target protein, herein schematically represented by VGAM1 HOST TARGET PROTEIN through VGAM3 HOST TARGET PROTEIN. The function of these host target genes is elaborated hereinabove with reference to VGAM550 and VGAM551. FIG. 9 further provides a conceptual description of novel bioinformatically detected regulatory viral gene, referred to here as Viral Genomic Record 2840(VGR2840) viral gene, which encodes an 'operon-like' cluster of novel viral micro RNA-like genes, each of which in turn modulates expression of at least one host target gene, the function and utility of which at least one host target gene is known in the art.

VGR2840 gene, herein designated VGR GENE, is a novel bioinformatically detected regulatory, non protein coding, RNA viral gene. The method by which VGR2840 gene was detected is described hereinabove with reference to FIGS. 1-9.

VGR2840 gene encodes VGR2840 precursor RNA, herein designated VGR PRECURSOR RNA, an RNA molecule, typically several hundred nucleotides long.

VGR2840 precursor RNA folds spatially, forming VGR2840 folded precursor RNA, herein designated VGR FOLDED PRECURSOR RNA. It is appreciated that VGR2840 folded precursor RNA comprises a plurality of what is known in the art as 'hairpin' structures. These 'hairpin' structures are due to the fact that the nucleotide sequence of VGR2840 precursor RNA comprises a plurality of segments, the first half of each such segment having a nucleotide sequence which is at least a partial inversed-reversed sequence of the second half thereof, as is well known in the art.

VGR2840 folded precursor RNA is naturally processed by cellular enzymatic activity into at least 3 separate VGAM precursor RNAs, VGAM554 precursor RNA, VGAM555 precursor RNA and VGAM556 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM554 RNA, VGAM555 RNA and VGAM556 RNA, herein schematically represented by VGAM1 RNA through VGAM3 RNA, each of which VGAM RNAs corresponding to VGAM RNA of FIG. 1.

VGAM554 RNA, herein schematically represented by VGAM1 RNA through VGAM3 RNA, binds complementarily to a host target binding site located in an untranslated region of VGAM554 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM554 host target RNA into VGAM554 host target protein, herein schematically represented by VGAM1 HOST TARGET PROTEIN through VGAM3 HOST TARGET PROTEIN, all of FIG. 1.

VGAM555 RNA, herein schematically represented by VGAM1 RNA through VGAM3 RNA, binds complementarily to a host target binding site located in an untranslated region of VGAM555 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM555 host target RNA into VGAM555 host target protein, herein schematically represented by VGAM1 HOST TARGET PROTEIN through VGAM3 HOST TARGET PROTEIN, all of FIG. 1.

VGAM556 RNA, herein schematically represented by VGAM1 RNA through VGAM3 RNA, binds complementarily to a host target binding site located in an untranslated region of VGAM556 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM556 host target RNA into VGAM556 host target protein, herein schematically represented by VGAM1 HOST TARGET PROTEIN through VGAM3 HOST TARGET PROTEIN, all of FIG. 1.

It is appreciated that a function of VGR2840 gene, herein designated VGR GENE, is inhibition of expression of host target genes, as part of a novel viral mechanism of attacking a host. Accordingly, utilities of VGR2840 gene include diagnosis, prevention and treatment of viral infection by Spodoptera Exigua Nucleopolyhedrovirus. Specific functions, and accordingly utilities, of VGR2840 gene correlate with, and may be deduced from, the identity of the host target genes, which are inhibited by VGAM RNAs comprised in the 'operon-like' cluster of VGR2840 gene: VGAM554 host target protein, VGAM555 host target protein and VGAM556 host target protein, herein schematically represented by VGAM1 HOST TARGET PROTEIN through VGAM3

HOST TARGET PROTEIN. The function of these host target genes is elaborated hereinabove with reference to VGAM554, VGAM555 and VGAM556. FIG. 9 further provides a conceptual description of novel bioinformatically detected regulatory viral gene, referred to here as Viral Genomic Record 2841(VGR2841) viral gene, which encodes an 'operon-like' cluster of novel viral micro RNA-like genes, each of which in turn modulates expression of at least one host target gene, the function and utility of which at least one host target gene is known in the art.

VGR2841 gene, herein designated VGR GENE, is a novel bioinformatically detected regulatory, non protein coding, RNA viral gene. The method by which VGR2841 gene was detected is described hereinabove with reference to FIGS. 1-9.

VGR2841 gene encodes VGR2841 precursor RNA, herein designated VGR PRECURSOR RNA, an RNA molecule, typically several hundred nucleotides long.

VGR2841 precursor RNA folds spatially, forming VGR2841 folded precursor RNA, herein designated VGR FOLDED PRECURSOR RNA. It is appreciated that VGR2841 folded precursor RNA comprises a plurality of what is known in the art as 'hairpin' structures. These 'hairpin' structures are due to the fact that the nucleotide sequence of VGR2841 precursor RNA comprises a plurality of segments, the first half of each such segment having a nucleotide sequence which is at least a partial inversed-reversed sequence of the second half thereof, as is well known in the art.

VGR2841 folded precursor RNA is naturally processed by cellular enzymatic activity into at least 3 separate VGAM precursor RNAs, VGAM562 precursor RNA, VGAM563 precursor RNA and VGAM564 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM562 RNA, VGAM563 RNA and VGAM564 RNA, herein schematically represented by VGAM1 RNA through VGAM3 RNA, each of which VGAM RNAs corresponding to VGAM RNA of FIG. 1.

VGAM562 RNA, herein schematically represented by VGAM1 RNA through VGAM3 RNA, binds complementarily to a host target binding site located in an untranslated region of VGAM562 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM562 host target RNA into VGAM562 host target protein, herein schematically represented by VGAM1 HOST TARGET PROTEIN through VGAM3 HOST TARGET PROTEIN, all of FIG. 1.

VGAM563 RNA, herein schematically represented by VGAM1 RNA through VGAM3 RNA, binds complementarily to a host target binding site located in an untranslated region of VGAM563 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM563 host target RNA into VGAM563 host target protein, herein schematically represented by VGAM1 HOST TARGET PROTEIN through VGAM3 HOST TARGET PROTEIN, all of FIG. 1.

VGAM564 RNA, herein schematically represented by VGAM1 RNA through VGAM3 RNA, binds complementarily to a host target binding site located in an untranslated region of VGAM564 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM564 host target RNA into VGAM564 host target protein, herein schematically represented by VGAM1 HOST TARGET PROTEIN through VGAM3 HOST TARGET PROTEIN, all of FIG. 1.

It is appreciated that a function of VGR2841 gene, herein designated VGR GENE, is inhibition of expression of host target genes, as part of a novel viral mechanism of attacking a host. Accordingly, utilities of VGR2841 gene include diagnosis, prevention and treatment of viral infection by Fowlpox Virus. Specific functions, and accordingly utilities, of VGR2841 gene correlate with, and may be deduced from, the identity of the host target genes, which are inhibited by VGAM RNAs comprised in the 'operon-like' cluster of VGR2841 gene: VGAM562 host target protein, VGAM563 host target protein and VGAM564 host target protein, herein schematically represented by VGAM1 HOST TARGET PROTEIN through VGAM3 HOST TARGET PROTEIN. The function of these host target genes is elaborated hereinabove with reference to VGAM562, VGAM563 and VGAM564. FIG. 9 further provides a conceptual description of novel bioinformatically detected regulatory viral gene, referred to here as Viral Genomic Record 2842(VGR2842) viral gene, which encodes an 'operon-like' cluster of novel viral micro RNA-like genes, each of which in turn modulates expression of at least one host target gene, the function and utility of which at least one host target gene is known in the art.

VGR2842 gene, herein designated VGR GENE, is a novel bioinformatically detected regulatory, non protein coding, RNA viral gene. The method by which VGR2842 gene was detected is described hereinabove with reference to FIGS. 1-9.

VGR2842 gene encodes VGR2842 precursor RNA, herein designated VGR PRECURSOR RNA, an RNA molecule, typically several hundred nucleotides long.

VGR2842 precursor RNA folds spatially, forming VGR2842 folded precursor RNA, herein designated VGR FOLDED PRECURSOR RNA. It is appreciated that VGR2842 folded precursor RNA comprises a plurality of what is known in the art as 'hairpin' structures. These 'hairpin' structures are due to the fact that the nucleotide sequence of VGR2842 precursor RNA comprises a plurality of segments, the first half of each such segment having a nucleotide sequence which is at least a partial inversed-reversed sequence of the second half thereof, as is well known in the art.

VGR2842 folded precursor RNA is naturally processed by cellular enzymatic activity into at least 2 separate VGAM precursor RNAs, VGAM565 precursor RNA and VGAM566 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM565

RNA and VGAM566 RNA, herein schematically represented by VGAM1 RNA through VGAM3 RNA, each of which VGAM RNAs corresponding to VGAM RNA of FIG. 1.

VGAM565 RNA, herein schematically represented by VGAM1 RNA through VGAM3 RNA, binds complementarily to a host target binding site located in an untranslated region of VGAM565 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM565 host target RNA into VGAM565 host target protein, herein schematically represented by VGAM1 HOST TARGET PROTEIN through VGAM3 HOST TARGET PROTEIN, all of FIG. 1.

VGAM566 RNA, herein schematically represented by VGAM1 RNA through VGAM3 RNA, binds complementarily to a host target binding site located in an untranslated region of VGAM566 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM566 host target RNA into VGAM566 host target protein, herein schematically represented by VGAM1 HOST TARGET PROTEIN through VGAM3 HOST TARGET PROTEIN, all of FIG. 1.

It is appreciated that a function of VGR2842 gene, herein designated VGR GENE, is inhibition of expression of host target genes, as part of a novel viral mechanism of attacking a host. Accordingly, utilities of VGR2842 gene include diagnosis, prevention and treatment of viral infection by Fowlpox Virus. Specific functions, and accordingly utilities, of VGR2842 gene correlate with, and may be deduced from, the identity of the host target genes, which are inhibited by VGAM RNAs comprised in the 'operon-like' cluster of VGR2842 gene: VGAM565 host target protein and VGAM566 host target protein, herein schematically represented by VGAM1 HOST TARGET PROTEIN through VGAM3 HOST TARGET PROTEIN. The function of these host target genes is elaborated hereinabove with reference to VGAM565 and VGAM566. FIG. 9 further provides a conceptual description of novel bioinformatically detected regulatory viral gene, referred to here as Viral Genomic Record 2843(VGR2843) viral gene, which encodes an 'operon-like' cluster of novel viral micro RNA-like genes, each of which in turn modulates expression of at least one host target gene, the function and utility of which at least one host target gene is known in the art.

VGR2843 gene, herein designated VGR GENE, is a novel bioinformatically detected regulatory, non protein coding, RNA viral gene. The method by which VGR2843 gene was detected is described hereinabove with reference to FIGS. 1-9.

VGR2843 gene encodes VGR2843 precursor RNA, herein designated VGR PRECURSOR RNA, an RNA molecule, typically several hundred nucleotides long.

VGR2843 precursor RNA folds spatially, forming VGR2843 folded precursor RNA, herein designated VGR FOLDED PRECURSOR RNA. It is appreciated that VGR2843 folded precursor RNA comprises a plurality of what is known in the art as 'hairpin' structures. These 'hairpin' structures are due to the fact that the nucleotide sequence of VGR2843 precursor RNA comprises a plurality of segments, the first half of each such segment having a nucleotide sequence which is at least a partial inversed-reversed sequence of the second half thereof, as is well known in the art.

VGR2843 folded precursor RNA is naturally processed by cellular enzymatic activity into at least 4 separate VGAM precursor RNAs, VGAM567 precursor RNA, VGAM568 precursor RNA, VGAM569 precursor RNA and VGAM570 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM567 RNA, VGAM568 RNA, VGAM569 RNA and VGAM570 RNA, herein schematically represented by VGAM1 RNA through VGAM3 RNA, each of which VGAM RNAs corresponding to VGAM RNA of FIG. 1.

VGAM567 RNA, herein schematically represented by VGAM1 RNA through VGAM3 RNA, binds complementarily to a host target binding site located in an untranslated region of VGAM567 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM567 host target RNA into VGAM567 host target protein, herein schematically represented by VGAM1 HOST TARGET PROTEIN through VGAM3 HOST TARGET PROTEIN, all of FIG. 1.

VGAM568 RNA, herein schematically represented by VGAM1 RNA through VGAM3 RNA, binds complementarily to a host target binding site located in an untranslated region of VGAM568 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM568 host target RNA into VGAM568 host target protein, herein schematically represented by VGAM1 HOST TARGET PROTEIN through VGAM3 HOST TARGET PROTEIN, all of FIG. 1.

VGAM569 RNA, herein schematically represented by VGAM1 RNA through VGAM3 RNA, binds complementarily to a host target binding site located in an untranslated region of VGAM569 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM569 host target RNA into VGAM569 host target protein, herein schematically represented by VGAM1 HOST TARGET PROTEIN through VGAM3 HOST TARGET PROTEIN, all of FIG. 1.

VGAM570 RNA, herein schematically represented by VGAM1 RNA through VGAM3 RNA, binds complementarily to a host target binding site located in an untranslated region of VGAM570 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM570 host target RNA into VGAM570 host target protein, herein schematically represented by VGAM1 HOST TARGET PROTEIN through VGAM3 HOST TARGET PROTEIN, all of FIG. 1.

It is appreciated that a function of VGR2843 gene, herein designated VGR GENE, is inhibition of expression of host target genes, as part of a novel viral mechanism of attacking a host. Accordingly, utilities of VGR2843 gene include diagnosis, prevention and treatment of viral infection by Fowlpox Virus. Specific functions, and accordingly utilities, of VGR2843 gene correlate with, and may be deduced from, the identity of the host target genes, which are inhibited by VGAM RNAs comprised in the 'operon-like' cluster of VGR2843 gene: VGAM567 host target protein, VGAM568 host target protein, VGAM569 host target protein and VGAM570 host target protein, herein schematically represented by VGAM1 HOST TARGET PROTEIN through VGAM3 HOST TARGET PROTEIN. The function of these host target genes is elaborated hereinabove with reference to VGAM567, VGAM568, VGAM569 and VGAM570. FIG. 9 further provides a conceptual description of novel bioinformatically detected regulatory viral gene, referred to here as Viral Genomic Record 2844(VGR2844) viral gene, which encodes an 'operon-like' cluster of novel viral micro RNA-like genes, each of which in turn modulates expression of at least one host target gene, the function and utility of which at least one host target gene is known in the art.

VGR2844 gene, herein designated VGR GENE, is a novel bioinformatically detected regulatory, non protein coding, RNA viral gene. The method by which VGR2844 gene was detected is described hereinabove with reference to FIGS. 1-9.

VGR2844 gene encodes VGR2844 precursor RNA, herein designated VGR PRECURSOR RNA, an RNA molecule, typically several hundred nucleotides long.

VGR2844 precursor RNA folds spatially, forming VGR2844 folded precursor RNA, herein designated VGR FOLDED PRECURSOR RNA. It is appreciated that VGR2844 folded precursor RNA comprises a plurality of what is known in the art as 'hairpin' structures. These 'hairpin' structures are due to the fact that the nucleotide sequence of VGR2844 precursor RNA comprises a plurality of segments, the first half of each such segment having a nucleotide sequence which is at least a partial inversed-reversed sequence of the second half thereof, as is well known in the art.

VGR2844 folded precursor RNA is naturally processed by cellular enzymatic activity into at least 4 separate VGAM precursor RNAs, VGAM571 precursor RNA, VGAM572 precursor RNA, VGAM573 precursor RNA and VGAM574 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM571 RNA, VGAM572 RNA, VGAM573 RNA and VGAM574 RNA, herein schematically represented by VGAM1 RNA through VGAM3 RNA, each of which VGAM RNAs corresponding to VGAM RNA of FIG. 1.

VGAM571 RNA, herein schematically represented by VGAM1 RNA through VGAM3 RNA, binds complementarily to a host target binding site located in an untranslated region of VGAM571 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM571 host target RNA into VGAM571 host target protein, herein schematically represented by VGAM1 HOST TARGET PROTEIN through VGAM3 HOST TARGET PROTEIN, all of FIG. 1.

VGAM572 RNA, herein schematically represented by VGAM1 RNA through VGAM3 RNA, binds complementarily to a host target binding site located in an untranslated region of VGAM572 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM572 host target RNA into VGAM572 host target protein, herein schematically represented by VGAM1 HOST TARGET PROTEIN through VGAM3 HOST TARGET PROTEIN, all of FIG. 1.

VGAM573 RNA, herein schematically represented by VGAM1 RNA through VGAM3 RNA, binds complementarily to a host target binding site located in an untranslated region of VGAM573 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM573 host target RNA into VGAM573 host target protein, herein schematically represented by VGAM1 HOST TARGET PROTEIN through VGAM3 HOST TARGET PROTEIN, all of FIG. 1.

VGAM574 RNA, herein schematically represented by VGAM1 RNA through VGAM3 RNA, binds complementarily to a host target binding site located in an untranslated region of VGAM574 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM574 host target RNA into VGAM574 host target protein, herein schematically represented by VGAM1 HOST TARGET PROTEIN through VGAM3 HOST TARGET PROTEIN, all of FIG. 1.

It is appreciated that a function of VGR2844 gene, herein designated VGR GENE, is inhibition of expression of host target genes, as part of a novel viral mechanism of attacking a host. Accordingly, utilities of VGR2844 gene include diagnosis, prevention and treatment of viral infection by Fowlpox Virus. Specific functions, and accordingly utilities, of VGR2844 gene correlate with, and may be deduced from, the identity of the host target genes, which are inhibited by VGAM RNAs comprised in the 'operon-like' cluster of VGR2844 gene: VGAM571 host target protein, VGAM572 host target protein, VGAM573 host target protein and VGAM574 host target protein, herein schematically represented by VGAM1 HOST TARGET PROTEIN through VGAM3 HOST TARGET PROTEIN. The function of these host target genes is elaborated hereinabove with reference to VGAM571, VGAM572, VGAM573 and VGAM574. FIG. 9 further provides a conceptual description of novel bioinformatically detected regulatory viral gene, referred to here as Viral Genomic Record 2845(VGR2845) viral gene, which encodes an 'operon-like' cluster of novel viral micro RNA-like genes, each of which in turn modulates expression of at least one host target gene, the function and utility of which at least one host target gene is known in the art.

VGR2845 gene, herein designated VGR GENE, is a novel bioinformatically detected regulatory, non protein coding, RNA viral gene. The method by which VGR2845 gene was detected is described hereinabove with reference to FIGS. 1-9.

VGR2845 gene encodes VGR2845 precursor RNA, herein designated VGR PRECURSOR RNA, an RNA molecule, typically several hundred nucleotides long.

VGR2845 precursor RNA folds spatially, forming VGR2845 folded precursor RNA, herein designated VGR FOLDED PRECURSOR RNA. It is appreciated that VGR2845 folded precursor RNA comprises a plurality of what is known in the art as 'hairpin' structures. These 'hairpin' structures are due to the fact that the nucleotide sequence of VGR2845 precursor RNA comprises a plurality of segments, the first half of each such segment having a nucleotide sequence which is at least a partial inversed-reversed sequence of the second half thereof, as is well known in the art.

VGR2845 folded precursor RNA is naturally processed by cellular enzymatic activity into at least 2 separate VGAM precursor RNAs, VGAM575 precursor RNA and VGAM576 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM575 RNA and VGAM576 RNA, herein schematically represented by VGAM1 RNA through VGAM3 RNA, each of which VGAM RNAs corresponding to VGAM RNA of FIG. 1.

VGAM575 RNA, herein schematically represented by VGAM1 RNA through VGAM3 RNA, binds complementarily to a host target binding site located in an untranslated region of VGAM575 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM575 host target RNA into VGAM575 host target protein, herein schematically represented by VGAM1 HOST TARGET PROTEIN through VGAM3 HOST TARGET PROTEIN, all of FIG. 1.

VGAM576 RNA, herein schematically represented by VGAM1 RNA through VGAM3 RNA, binds complementarily to a host target binding site located in an untranslated region of VGAM576 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM576 host target RNA into VGAM576 host target protein, herein schematically represented by VGAM1 HOST TARGET PROTEIN through VGAM3 HOST TARGET PROTEIN, all of FIG. 1.

It is appreciated that a function of VGR2845 gene, herein designated VGR GENE, is inhibition of expression of host target genes, as part of a novel viral mechanism of attacking a host. Accordingly, utilities of VGR2845 gene include diagnosis, prevention and treatment of viral infection by Fowlpox Virus. Specific functions, and accordingly utilities, of VGR2845 gene correlate with, and may be deduced from, the identity of the host target genes, which are inhibited by VGAM RNAs comprised in the 'operon-like' cluster of VGR2845 gene: VGAM575 host target protein and VGAM576 host target protein, herein schematically represented by VGAM1 HOST TARGET PROTEIN through VGAM3 HOST TARGET PROTEIN. The function of these host target genes is elaborated hereinabove with reference to VGAM575 and VGAM576. FIG. 9 further provides a conceptual description of novel bioinformatically detected regulatory viral gene, referred to here as Viral Genomic Record 2846(VGR2846) viral gene, which encodes an 'operon-like' cluster of novel viral micro RNA-like genes, each of which in turn modulates expression of at least one host target gene, the function and utility of which at least one host target gene is known in the art.

VGR2846 gene, herein designated VGR GENE, is a novel bioinformatically detected regulatory, non protein coding, RNA viral gene. The method by which VGR2846 gene was detected is described hereinabove with reference to FIGS. 1-9.

VGR2846 gene encodes VGR2846 precursor RNA, herein designated VGR PRECURSOR RNA, an RNA molecule, typically several hundred nucleotides long.

VGR2846 precursor RNA folds spatially, forming VGR2846 folded precursor RNA, herein designated VGR FOLDED PRECURSOR RNA. It is appreciated that VGR2846 folded precursor RNA comprises a plurality of what is known in the art as 'hairpin' structures. These 'hairpin' structures are due to the fact that the nucleotide sequence of VGR2846 precursor RNA comprises a plurality of segments, the first half of each such segment having a nucleotide sequence which is at least a partial inversed-reversed sequence of the second half thereof, as is well known in the art.

VGR2846 folded precursor RNA is naturally processed by cellular enzymatic activity into at least 2 separate VGAM precursor RNAs, VGAM577 precursor RNA and VGAM578 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM577 RNA and VGAM578 RNA, herein schematically represented by VGAM1 RNA through VGAM3 RNA, each of which VGAM RNAs corresponding to VGAM RNA of FIG. 1.

VGAM577 RNA, herein schematically represented by VGAM1 RNA through VGAM3 RNA, binds complementarily to a host target binding site located in an untranslated region of VGAM577 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM577 host target RNA into VGAM577 host target protein, herein schematically represented by VGAM1 HOST TARGET PROTEIN through VGAM3 HOST TARGET PROTEIN, all of FIG. 1.

VGAM578 RNA, herein schematically represented by VGAM1 RNA through VGAM3 RNA, binds complementarily to a host target binding site located in an untranslated region of VGAM578 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM578 host target RNA into VGAM578 host target protein, herein schematically represented by VGAM1 HOST TARGET PROTEIN through VGAM3 HOST TARGET PROTEIN, all of FIG. 1.

It is appreciated that a function of VGR2846 gene, herein designated VGR GENE, is inhibition of expression of host target genes, as part of a novel viral mechanism of attacking a host. Accordingly, utilities of VGR2846 gene include diagnosis, prevention and treatment of viral infection by Fowlpox Virus. Specific functions, and accordingly utilities, of VGR2846 gene correlate with, and may be deduced from, the identity of the host target genes, which are inhibited by VGAM RNAs comprised in the 'operon-like' cluster of VGR2846 gene: VGAM577 host target protein and VGAM578 host target protein, herein schematically represented by VGAM1 HOST TARGET PROTEIN through VGAM3 HOST TARGET PROTEIN. The function of these host target genes is elaborated hereinabove with reference to VGAM577 and VGAM578. FIG. 9 further provides a conceptual description of novel bioinformatically detected regulatory viral gene, referred to here as Viral Genomic Record 2847(VGR2847) viral gene, which encodes an 'operon-like' cluster of novel viral micro RNA-like genes, each of which in turn modulates expression of at least one host target gene, the function and utility of which at least one host target gene is known in the art.

VGR2847 gene, herein designated VGR GENE, is a novel bioinformatically detected regulatory, non protein coding, RNA viral gene. The method by which VGR2847 gene was detected is described hereinabove with reference to FIGS. 1-9.

VGR2847 gene encodes VGR2847 precursor RNA, herein designated VGR PRECURSOR RNA, an RNA molecule, typically several hundred nucleotides long.

VGR2847 precursor RNA folds spatially, forming VGR2847 folded precursor RNA, herein designated VGR FOLDED PRECURSOR RNA. It is appreciated that VGR2847 folded precursor RNA comprises a plurality of what is known in the art as 'hairpin' structures. These 'hairpin' structures are due to the fact that the nucleotide sequence of VGR2847 precursor RNA comprises a plurality of segments, the first half of each such segment having a nucleotide sequence which is at least a partial inversed-reversed sequence of the second half thereof, as is well known in the art.

VGR2847 folded precursor RNA is naturally processed by cellular enzymatic activity into at least 2 separate VGAM precursor RNAs, VGAM580 precursor RNA and VGAM581 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM580 RNA and VGAM581 RNA, herein schematically represented by VGAM1 RNA through VGAM3 RNA, each of which VGAM RNAs corresponding to VGAM RNA of FIG. 1.

VGAM580 RNA, herein schematically represented by VGAM1 RNA through VGAM3 RNA, binds complementarily to a host target binding site located in an untranslated region of VGAM580 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM580 host target RNA into VGAM580 host target protein, herein schematically represented by VGAM1 HOST TARGET PROTEIN through VGAM3 HOST TARGET PROTEIN, all of FIG. 1.

VGAM581 RNA, herein schematically represented by VGAM1 RNA through VGAM3 RNA, binds complementarily to a host target binding site located in an untranslated region of VGAM581 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM581 host target RNA into VGAM581 host target protein, herein schematically represented by VGAM1 HOST TARGET PROTEIN through VGAM3 HOST TARGET PROTEIN, all of FIG. 1.

It is appreciated that a function of VGR2847 gene, herein designated VGR GENE, is inhibition of expression of host target genes, as part of a novel viral mechanism of attacking a host. Accordingly, utilities of VGR2847 gene include diagnosis, prevention and treatment of viral infection by Fowlpox Virus. Specific functions, and accordingly utilities, of VGR2847 gene correlate with, and may be deduced from, the identity of the host target genes, which are inhibited by VGAM RNAs comprised in the 'operon-like' cluster of VGR2847 gene: VGAM580 host target protein and VGAM581 host target protein, herein schematically represented by VGAM1 HOST TARGET PROTEIN through VGAM3 HOST TARGET PROTEIN. The function of these host target genes is elaborated hereinabove with reference to VGAM580 and VGAM581. FIG. 9 further provides a conceptual description of novel bioinformatically detected regulatory viral gene, referred to here as Viral Genomic Record 2848(VGR2848) viral gene, which encodes an 'operon-like' cluster of novel viral micro RNA-like genes, each of which in turn modulates expression of at least one host target gene, the function and utility of which at least one host target gene is known in the art.

VGR2848 gene, herein designated VGR GENE, is a novel bioinformatically detected regulatory, non protein coding, RNA viral gene. The method by which VGR2848 gene was detected is described hereinabove with reference to FIGS. 1-9.

VGR2848 gene encodes VGR2848 precursor RNA, herein designated VGR PRECURSOR RNA, an RNA molecule, typically several hundred nucleotides long.

VGR2848 precursor RNA folds spatially, forming VGR2848 folded precursor RNA, herein designated VGR FOLDED PRECURSOR RNA. It is appreciated that VGR2848 folded precursor RNA comprises a plurality of what is known in the art as 'hairpin' structures. These 'hairpin' structures are due to the fact that the nucleotide sequence of VGR2848 precursor RNA comprises a plurality of segments, the first half of each such segment having a nucleotide sequence which is at least a partial inversed-reversed sequence of the second half thereof, as is well known in the art.

VGR2848 folded precursor RNA is naturally processed by cellular enzymatic activity into at least 3 separate VGAM precursor RNAs, VGAM585 precursor RNA, VGAM586 precursor RNA and VGAM587 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM585 RNA, VGAM586 RNA and VGAM587 RNA, herein schematically represented by VGAM1 RNA through VGAM3 RNA, each of which VGAM RNAs corresponding to VGAM RNA of FIG. 1.

VGAM585 RNA, herein schematically represented by VGAM1 RNA through VGAM3 RNA, binds complementarily to a host target binding site located in an untranslated region of VGAM585 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM585 host target RNA into VGAM585 host target protein, herein schematically represented by VGAM1 HOST TARGET PROTEIN through VGAM3 HOST TARGET PROTEIN, all of FIG. 1.

VGAM586 RNA, herein schematically represented by VGAM1 RNA through VGAM3 RNA, binds complementarily to a host target binding site located in an untranslated region of VGAM586 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM586 host target RNA into VGAM586 host target protein, herein schematically represented by VGAM1 HOST TARGET PROTEIN through VGAM3 HOST TARGET PROTEIN, all of FIG. 1.

VGAM587 RNA, herein schematically represented by VGAM1 RNA through VGAM3 RNA, binds complementarily to a host target binding site located in an untranslated region of VGAM587 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM587 host target RNA into VGAM587 host target protein, herein schematically represented by VGAM1 HOST TARGET PROTEIN through VGAM3 HOST TARGET PROTEIN, all of FIG. 1.

It is appreciated that a function of VGR2848 gene, herein designated VGR GENE, is inhibition of expression of host target genes, as part of a novel viral mechanism of attacking a host. Accordingly, utilities of VGR2848 gene include diagnosis, prevention and treatment of viral infection by Gallid Herpesvirus 2. Specific functions, and accordingly utilities, of VGR2848 gene correlate with, and may be deduced from, the identity of the host target genes, which are inhibited by VGAM RNAs comprised in the 'operon-like' cluster of VGR2848 gene: VGAM585 host target protein, VGAM586 host target protein and VGAM587 host target protein, herein schematically represented by VGAM1 HOST TARGET PROTEIN through VGAM3 HOST TARGET PROTEIN. The function of these host target genes is elaborated hereinabove with reference to VGAM585, VGAM586 and VGAM587. FIG. 9 further provides a conceptual description of novel bioinformatically detected regulatory viral gene, referred to here as Viral Genomic Record 2849(VGR2849) viral gene, which encodes an 'operon-like' cluster of novel viral micro RNA-like genes, each of which in turn modulates expression of at least one host target gene, the function and utility of which at least one host target gene is known in the art.

VGR2849 gene, herein designated VGR GENE, is a novel bioinformatically detected regulatory, non protein coding, RNA viral gene. The method by which VGR2849 gene was detected is described hereinabove with reference to FIGS. 1-9.

VGR2849 gene encodes VGR2849 precursor RNA, herein designated VGR PRECURSOR RNA, an RNA molecule, typically several hundred nucleotides long.

VGR2849 precursor RNA folds spatially, forming VGR2849 folded precursor RNA, herein designated VGR FOLDED PRECURSOR RNA. It is appreciated that VGR2849 folded precursor RNA comprises a plurality of what is known in the art as 'hairpin' structures. These 'hairpin' structures are due to the fact that the nucleotide sequence of VGR2849 precursor RNA comprises a plurality of segments, the first half of each such segment having a nucleotide sequence which is at least a partial inversed-reversed sequence of the second half thereof, as is well known in the art.

VGR2849 folded precursor RNA is naturally processed by cellular enzymatic activity into at least 3 separate VGAM precursor RNAs, VGAM588 precursor RNA, VGAM589 precursor RNA and VGAM590 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM588 RNA, VGAM589 RNA and VGAM590 RNA, herein schematically represented by VGAM1 RNA through VGAM3 RNA, each of which VGAM RNAs corresponding to VGAM RNA of FIG. 1.

VGAM588 RNA, herein schematically represented by VGAM1 RNA through VGAM3 RNA, binds complementarily to a host target binding site located in an untranslated region of VGAM588 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM588 host target RNA into VGAM588 host target protein, herein schematically represented by VGAM1 HOST TARGET PROTEIN through VGAM3 HOST TARGET PROTEIN, all of FIG. 1.

VGAM589 RNA, herein schematically represented by VGAM1 RNA through VGAM3 RNA, binds complementarily to a host target binding site located in an untranslated region of VGAM589 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM589 host target RNA into VGAM589 host target protein, herein schematically represented by VGAM1 HOST TARGET PROTEIN through VGAM3 HOST TARGET PROTEIN, all of FIG. 1.

VGAM590 RNA, herein schematically represented by VGAM1 RNA through VGAM3 RNA, binds complementarily to a host target binding site located in an untranslated region of VGAM590 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM590 host target RNA into VGAM590 host target protein, herein schematically represented by VGAM1 HOST TARGET PROTEIN through VGAM3 HOST TARGET PROTEIN, all of FIG. 1.

It is appreciated that a function of VGR2849 gene, herein designated VGR GENE, is inhibition of expression of host target genes, as part of a novel viral mechanism of attacking a host. Accordingly, utilities of VGR2849 gene include diagnosis, prevention and treatment of viral infection by Gallid Herpesvirus 2. Specific functions, and accordingly utilities, of VGR2849 gene correlate with, and may be deduced from, the identity of the host target genes, which are inhibited by VGAM RNAs comprised in the 'operon-like' cluster of VGR2849 gene: VGAM588 host target protein, VGAM589 host target protein and VGAM590 host target protein, herein schematically represented by VGAM1 HOST TARGET PROTEIN through VGAM3 HOST TARGET PROTEIN. The function of these host target genes is elaborated hereinabove with reference to VGAM588, VGAM589 and VGAM590. FIG. 9 further provides a conceptual description of novel bioinformatically detected regulatory viral gene, referred to here as Viral Genomic Record 2850(VGR2850) viral gene, which encodes an 'operon-like' cluster of novel viral micro RNA-like genes, each of which in turn modulates expression of at least one host target gene, the function and utility of which at least one host target gene is known in the art.

VGR2850 gene, herein designated VGR GENE, is a novel bioinformatically detected regulatory, non protein coding, RNA viral gene. The method by which VGR2850 gene was detected is described hereinabove with reference to FIGS. 1-9.

VGR2850 gene encodes VGR2850 precursor RNA, herein designated VGR PRECURSOR RNA, an RNA molecule, typically several hundred nucleotides long.

VGR2850 precursor RNA folds spatially, forming VGR2850 folded precursor RNA, herein designated VGR FOLDED PRECURSOR RNA. It is appreciated that VGR2850 folded precursor RNA comprises a plurality of what is known in the art as 'hairpin' structures. These 'hairpin' structures are due to the fact that the nucleotide sequence of VGR2850 precursor RNA comprises a plurality of segments, the first half of each such segment having a nucleotide sequence which is at least a partial inversed-reversed sequence of the second half thereof, as is well known in the art.

VGR2850 folded precursor RNA is naturally processed by cellular enzymatic activity into at least 2 separate VGAM precursor RNAs, VGAM591 precursor RNA and VGAM592 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM591 RNA and VGAM592 RNA, herein schematically represented by VGAM1 RNA through VGAM3 RNA, each of which VGAM RNAs corresponding to VGAM RNA of FIG. 1.

VGAM591 RNA, herein schematically represented by VGAM1 RNA through VGAM3 RNA, binds complementarily to a host target binding site located in an untranslated region of VGAM591 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM591 host target RNA into VGAM591 host target protein, herein schematically represented by VGAM1 HOST TARGET PROTEIN through VGAM3 HOST TARGET PROTEIN, all of FIG. 1.

VGAM592 RNA, herein schematically represented by VGAM1 RNA through VGAM3 RNA, binds complementarily to a host target binding site located in an untranslated region of VGAM592 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM592 host target RNA into VGAM592 host target protein, herein schematically represented by VGAM1 HOST TARGET PROTEIN through VGAM3 HOST TARGET PROTEIN, all of FIG. 1.

It is appreciated that a function of VGR2850 gene, herein designated VGR GENE, is inhibition of expression of host target genes, as part of a novel viral mechanism of attacking a host. Accordingly, utilities of VGR2850 gene include diagnosis, prevention and treatment of viral infection by Gallid Herpesvirus 2. Specific functions, and accordingly utilities, of VGR2850 gene correlate with, and may be deduced from, the identity of the host target genes, which are inhibited by VGAM RNAs comprised in the 'operon-like' cluster of VGR2850 gene: VGAM591 host target protein and VGAM592 host target protein, herein schematically represented by VGAM1 HOST TARGET PROTEIN through VGAM3 HOST TARGET PROTEIN. The function of these host target genes is elaborated hereinabove with reference to VGAM591 and VGAM592. FIG. 9 further provides a conceptual description of novel bioinformatically detected regulatory viral gene, referred to here as Viral Genomic Record 2851(VGR2851) viral gene, which encodes an 'operon-like' cluster of novel viral micro RNA-like genes, each of which in turn modulates expression of at least one host target gene, the function and utility of which at least one host target gene is known in the art.

VGR2851 gene, herein designated VGR GENE, is a novel bioinformatically detected regulatory, non protein coding, RNA viral gene. The method by which VGR2851 gene was detected is described hereinabove with reference to FIGS. 1-9.

VGR2851 gene encodes VGR2851 precursor RNA, herein designated VGR PRECURSOR RNA, an RNA molecule, typically several hundred nucleotides long.

VGR2851 precursor RNA folds spatially, forming VGR2851 folded precursor RNA, herein designated VGR FOLDED PRECURSOR RNA. It is appreciated that VGR2851 folded precursor RNA comprises a plurality of what is known in the art as 'hairpin' structures. These 'hairpin' structures are due to the fact that the nucleotide sequence of VGR2851 precursor RNA comprises a plurality of segments, the first half of each such segment having a nucleotide sequence which is at least a partial inversed-reversed sequence of the second half thereof, as is well known in the art.

VGR2851 folded precursor RNA is naturally processed by cellular enzymatic activity into at least 3 separate VGAM precursor RNAs, VGAM594 precursor RNA, VGAM595 precursor RNA and VGAM596 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM594 RNA, VGAM595 RNA and VGAM596 RNA, herein schematically represented by VGAM1 RNA through VGAM3 RNA, each of which VGAM RNAs corresponding to VGAM RNA of FIG. 1.

VGAM594 RNA, herein schematically represented by VGAM1 RNA through VGAM3 RNA, binds complementarily to a host target binding site located in an untranslated region of VGAM594 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM594 host target RNA into VGAM594 host target protein, herein schematically represented by VGAM1 HOST TARGET PROTEIN through VGAM3 HOST TARGET PROTEIN, all of FIG. 1.

VGAM595 RNA, herein schematically represented by VGAM1 RNA through VGAM3 RNA, binds complementarily to a host target binding site located in an untranslated region of VGAM595 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM595 host target RNA into VGAM595 host target protein, herein schematically represented by VGAM1 HOST TARGET PROTEIN through VGAM3 HOST TARGET PROTEIN, all of FIG. 1.

VGAM596 RNA, herein schematically represented by VGAM1 RNA through VGAM3 RNA, binds complementarily to a host target binding site located in an untranslated region of VGAM596 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM596 host target RNA into VGAM596 host target protein, herein schematically represented by VGAM1 HOST TARGET PROTEIN through VGAM3 HOST TARGET PROTEIN, all of FIG. 1.

It is appreciated that a function of VGR2851 gene, herein designated VGR GENE, is inhibition of expression of host target genes, as part of a novel viral mechanism of attacking a host. Accordingly, utilities of VGR2851 gene include diagnosis, prevention and treatment of viral infection by Northern Cereal Mosaic Virus. Specific functions, and accordingly utilities, of VGR2851 gene correlate with, and may be deduced from, the identity of the host target genes, which are inhibited by VGAM RNAs comprised in the 'operon-like' cluster of VGR2851 gene: VGAM594 host target protein, VGAM595 host target protein and VGAM596 host target protein, herein schematically represented by VGAM1 HOST TARGET PROTEIN through VGAM3 HOST TARGET PROTEIN. The function of these host target genes is elaborated hereinabove with reference to VGAM594, VGAM595 and VGAM596. FIG. 9 further provides a conceptual description of novel bioinformatically detected regulatory viral gene, referred to here as Viral Genomic Record 2852(VGR2852) viral gene, which encodes an 'operon-like' cluster of novel viral micro RNA-like genes, each of which in turn modulates expression of at least one host target gene, the function and utility of which at least one host target gene is known in the art.

VGR2852 gene, herein designated VGR GENE, is a novel bioinformatically detected regulatory, non protein coding, RNA viral gene. The method by which VGR2852 gene was detected is described hereinabove with reference to FIGS. 1-9.

VGR2852 gene encodes VGR2852 precursor RNA, herein designated VGR PRECURSOR RNA, an RNA molecule, typically several hundred nucleotides long.

VGR2852 precursor RNA folds spatially, forming VGR2852 folded precursor RNA, herein designated VGR FOLDED PRECURSOR RNA. It is appreciated that VGR2852 folded precursor RNA comprises a plurality of what is known in the art as 'hairpin' structures. These 'hairpin' structures are due to the fact that the nucleotide sequence of VGR2852 precursor RNA comprises a plurality of segments, the first half of each such segment having a nucleotide sequence which is at least a partial inversed-reversed sequence of the second half thereof, as is well known in the art.

VGR2852 folded precursor RNA is naturally processed by cellular enzymatic activity into at least 8 separate VGAM precursor RNAs, VGAM597 precursor RNA, VGAM598 precursor RNA, VGAM599 precursor RNA, VGAM600 precursor RNA, VGAM601 precursor RNA, VGAM602 precursor RNA, VGAM603 precursor RNA and VGAM604 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM597 RNA, VGAM598 RNA, VGAM599 RNA, VGAM600 RNA, VGAM601 RNA, VGAM602 RNA, VGAM603 RNA and VGAM604 RNA, herein schematically represented by VGAM1 RNA through VGAM3 RNA, each of which VGAM RNAs corresponding to VGAM RNA of FIG. 1.

VGAM597 RNA, herein schematically represented by VGAM1 RNA through VGAM3 RNA, binds complementarily to a host target binding site located in an untranslated region of VGAM597 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM597 host target RNA into VGAM597 host target protein, herein schematically represented by VGAM1 HOST TARGET PROTEIN through VGAM3 HOST TARGET PROTEIN, all of FIG. 1.

VGAM598 RNA, herein schematically represented by VGAM1 RNA through VGAM3 RNA, binds complementarily to a host target binding site located in an untranslated region of VGAM598 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM598 host target RNA into VGAM598 host target protein, herein schematically represented by VGAM1 HOST TARGET PROTEIN through VGAM3 HOST TARGET PROTEIN, all of FIG. 1.

VGAM599 RNA, herein schematically represented by VGAM1 RNA through VGAM3 RNA, binds complementarily to a host target binding site located in an untranslated region of VGAM599 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM599 host target RNA into VGAM599 host target protein, herein schematically represented by VGAM1 HOST TARGET PROTEIN through VGAM3 HOST TARGET PROTEIN, all of FIG. 1.

VGAM600 RNA, herein schematically represented by VGAM1 RNA through VGAM3 RNA, binds complementarily to a host target binding site located in an untranslated region of VGAM600 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM600 host target RNA into VGAM600 host target protein, herein schematically represented by VGAM1 HOST TARGET PROTEIN through VGAM3 HOST TARGET PROTEIN, all of FIG. 1.

VGAM601 RNA, herein schematically represented by VGAM1 RNA through VGAM3 RNA, binds complementarily to a host target binding site located in an untranslated region of VGAM601 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM601 host target RNA into VGAM601 host target protein, herein schematically represented by VGAM1 HOST TARGET PROTEIN through VGAM3 HOST TARGET PROTEIN, all of FIG. 1.

VGAM602 RNA, herein schematically represented by VGAM1 RNA through VGAM3 RNA, binds complementarily to a host target binding site located in an untranslated region of VGAM602 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM602 host target RNA into VGAM602 host target protein, herein schematically represented by VGAM1 HOST TARGET PROTEIN through VGAM3 HOST TARGET PROTEIN, all of FIG. 1.

VGAM603 RNA, herein schematically represented by VGAM1 RNA through VGAM3 RNA, binds complementarily to a host target binding site located in an untranslated region of VGAM603 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM603 host target RNA into VGAM603 host target protein, herein schematically represented by VGAM1 HOST TARGET PROTEIN through VGAM3 HOST TARGET PROTEIN, all of FIG. 1.

VGAM604 RNA, herein schematically represented by VGAM1 RNA through VGAM3 RNA, binds complementarily to a host target binding site located in an untranslated region of VGAM604 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM604 host target RNA into VGAM604 host target protein, herein schematically represented by VGAM1 HOST TARGET PROTEIN through VGAM3 HOST TARGET PROTEIN, all of FIG. 1.

It is appreciated that a function of VGR2852 gene, herein designated VGR GENE, is inhibition of expression of host target genes, as part of a novel viral mechanism of attacking a host. Accordingly, utilities of VGR2852 gene include diagnosis, prevention and treatment of viral infection by Transmissible Gastroenteritis Virus. Specific functions, and accordingly utilities, of VGR2852 gene correlate with, and may be deduced from, the identity of the host target genes, which are inhibited by VGAM RNAs comprised in the 'operon-like' cluster of VGR2852 gene: VGAM597 host target protein, VGAM598 host target protein, VGAM599 host target protein, VGAM600 host target protein, VGAM601 host target protein, VGAM602 host target protein, VGAM603 host target protein and VGAM604 host target protein, herein schematically represented by VGAM1 HOST TARGET PROTEIN through VGAM3 HOST TARGET PROTEIN. The function of these host target genes is elaborated hereinabove with reference to VGAM597, VGAM598, VGAM599, VGAM600, VGAM601, VGAM602, VGAM603 and VGAM604. FIG. 9 further provides a conceptual description of novel bioinformatically detected regulatory viral gene, referred to here as Viral Genomic Record 2853(VGR2853) viral gene, which encodes an 'operon-like' cluster of novel viral micro RNA-like genes, each of which in turn modulates expression of at least one host target gene, the function and utility of which at least one host target gene is known in the art.

VGR2853 gene, herein designated VGR GENE, is a novel bioinformatically detected regulatory, non protein coding, RNA viral gene. The method by which VGR2853 gene was detected is described hereinabove with reference to FIGS. 1-9.

VGR2853 gene encodes VGR2853 precursor RNA, herein designated VGR PRECURSOR RNA, an RNA molecule, typically several hundred nucleotides long.

VGR2853 precursor RNA folds spatially, forming VGR2853 folded precursor RNA, herein designated VGR FOLDED PRECURSOR RNA. It is appreciated that VGR2853 folded precursor RNA comprises a plurality of what is known in the art as 'hairpin' structures. These 'hairpin' structures are due to the fact that the nucleotide sequence of VGR2853 precursor RNA comprises a plurality of segments, the first half of each such segment having a nucleotide sequence which is at least a partial inversed-reversed sequence of the second half thereof, as is well known in the art.

VGR2853 folded precursor RNA is naturally processed by cellular enzymatic activity into at least 2 separate VGAM precursor RNAs, VGAM605 precursor RNA and VGAM606 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM605 RNA and VGAM606 RNA, herein schematically represented by VGAM1 RNA through VGAM3 RNA, each of which VGAM RNAs corresponding to VGAM RNA of FIG. 1.

VGAM605 RNA, herein schematically represented by VGAM1 RNA through VGAM3 RNA, binds complementarily to a host target binding site located in an untranslated region of VGAM605 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM605 host target RNA into VGAM605 host target protein, herein schematically represented by VGAM1 HOST TARGET PROTEIN through VGAM3 HOST TARGET PROTEIN, all of FIG. 1.

VGAM606 RNA, herein schematically represented by VGAM1 RNA through VGAM3 RNA, binds complementarily to a host target binding site located in an untranslated region of VGAM606 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM606 host target RNA into VGAM606 host target protein, herein schematically represented by VGAM1 HOST TARGET PROTEIN through VGAM3 HOST TARGET PROTEIN, all of FIG. 1.

It is appreciated that a function of VGR2853 gene, herein designated VGR GENE, is inhibition of expression of host target genes, as part of a novel viral mechanism of attacking a host. Accordingly, utilities of VGR2853 gene include diagnosis, prevention and treatment of viral infection by Transmissible Gastroenteritis Virus. Specific functions, and accordingly utilities, of VGR2853 gene correlate with, and may be deduced from, the identity of the host target genes, which are inhibited by VGAM RNAs comprised in the 'operon-like' cluster of VGR2853 gene: VGAM605 host target protein and VGAM606 host target protein, herein schematically represented by VGAM1 HOST TARGET PROTEIN through VGAM3 HOST TARGET PROTEIN. The function of these host target genes is elaborated hereinabove with reference to VGAM605 and VGAM606. FIG. 9 further provides a conceptual description of novel bioinformatically detected regulatory viral gene, referred to here as Viral Genomic Record 2854(VGR2854) viral gene, which encodes an 'operon-like' cluster of novel viral micro RNA-like genes, each of which in turn modulates expression of at least one host target gene, the function and utility of which at least one host target gene is known in the art.

VGR2854 gene, herein designated VGR GENE, is a novel bioinformatically detected regulatory, non protein coding, RNA viral gene. The method by which VGR2854 gene was detected is described hereinabove with reference to FIGS. 1-9.

VGR2854 gene encodes VGR2854 precursor RNA, herein designated VGR PRECURSOR RNA, an RNA molecule, typically several hundred nucleotides long.

VGR2854 precursor RNA folds spatially, forming VGR2854 folded precursor RNA, herein designated VGR FOLDED PRECURSOR RNA. It is appreciated that VGR2854 folded precursor RNA comprises a plurality of what is known in the art as 'hairpin' structures. These 'hairpin' structures are due to the fact that the nucleotide sequence of VGR2854 precursor RNA comprises a plurality of segments, the first half of each such segment having a nucleotide sequence which is at least a partial inversed-reversed sequence of the second half thereof, as is well known in the art.

VGR2854 folded precursor RNA is naturally processed by cellular enzymatic activity into at least 4 separate VGAM precursor RNAs, VGAM607 precursor RNA, VGAM608 precursor RNA, VGAM609 precursor RNA and VGAM610 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM607 RNA, VGAM608 RNA, VGAM609 RNA and VGAM610 RNA, herein schematically represented by VGAM1 RNA through VGAM3 RNA, each of which VGAM RNAs corresponding to VGAM RNA of FIG. 1.

VGAM607 RNA, herein schematically represented by VGAM1 RNA through VGAM3 RNA, binds complementarily to a host target binding site located in an untranslated region of VGAM607 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM607 host target RNA into VGAM607 host target protein, herein schematically represented by VGAM1 HOST TARGET PROTEIN through VGAM3 HOST TARGET PROTEIN, all of FIG. 1.

VGAM608 RNA, herein schematically represented by VGAM1 RNA through VGAM3 RNA, binds complementarily to a host target binding site located in an untranslated region of VGAM608 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM608 host target RNA into VGAM608 host target protein, herein schematically represented by VGAM1 HOST TARGET PROTEIN through VGAM3 HOST TARGET PROTEIN, all of FIG. 1.

VGAM609 RNA, herein schematically represented by VGAM1 RNA through VGAM3 RNA, binds complementarily to a host target binding site located in an untranslated region of VGAM609 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM609 host target RNA into VGAM609 host target protein, herein schematically represented by VGAM1 HOST TARGET PROTEIN through VGAM3 HOST TARGET PROTEIN, all of FIG. 1.

VGAM610 RNA, herein schematically represented by VGAM1 RNA through VGAM3 RNA, binds complementarily to a host target binding site located in an untranslated region of VGAM610 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM610 host target RNA into VGAM610 host target protein, herein schematically represented by VGAM1 HOST TARGET PROTEIN through VGAM3 HOST TARGET PROTEIN, all of FIG. 1.

It is appreciated that a function of VGR2854 gene, herein designated VGR GENE, is inhibition of expression of host target genes, as part of a novel viral mechanism of attacking a host. Accordingly, utilities of VGR2854 gene include diagnosis, prevention and treatment of viral infection by Rice Grassy Stunt Virus. Specific functions, and accordingly utilities, of VGR2854 gene correlate with, and may be deduced from, the identity of the host target genes, which are inhibited by VGAM RNAs comprised in the 'operon-like' cluster of VGR2854 gene: VGAM607 host target protein, VGAM608 host target protein, VGAM609 host target protein and VGAM610 host target protein, herein schematically represented by VGAM1 HOST TARGET PROTEIN through VGAM3 HOST TARGET PROTEIN. The function of these host target genes is elaborated hereinabove with reference to VGAM607, VGAM608, VGAM609 and VGAM610. FIG. 9 further provides a conceptual description of novel bioinformatically detected regulatory viral gene, referred to here as Viral Genomic Record 2855(VGR2855) viral gene, which encodes an 'operon-like' cluster of novel viral micro RNA-like genes, each of which in turn modulates expression of at least one host target gene, the function and utility of which at least one host target gene is known in the art.

VGR2855 gene, herein designated VGR GENE, is a novel bioinformatically detected regulatory, non protein coding, RNA viral gene. The method by which VGR2855 gene was detected is described hereinabove with reference to FIGS. 1-9.

VGR2855 gene encodes VGR2855 precursor RNA, herein designated VGR PRECURSOR RNA, an RNA molecule, typically several hundred nucleotides long.

VGR2855 precursor RNA folds spatially, forming VGR2855 folded precursor RNA, herein designated VGR FOLDED PRECURSOR RNA. It is appreciated that VGR2855 folded precursor RNA comprises a plurality of what is known in the art as 'hairpin' structures. These 'hairpin' structures are due to the fact that the nucleotide sequence of VGR2855 precursor RNA comprises a plurality of segments, the first half of each such segment having a nucleotide sequence which is at least a partial inversed-reversed sequence of the second half thereof, as is well known in the art.

VGR2855 folded precursor RNA is naturally processed by cellular enzymatic activity into at least 2 separate VGAM precursor RNAs, VGAM613 precursor RNA and VGAM614 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM613 RNA and VGAM614 RNA, herein schematically represented by VGAM1 RNA through VGAM3 RNA, each of which VGAM RNAs corresponding to VGAM RNA of FIG. 1.

VGAM613 RNA, herein schematically represented by VGAM1 RNA through VGAM3 RNA, binds complementarily to a host target binding site located in an untranslated region of VGAM613 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM613 host target RNA into VGAM613 host target protein, herein schematically represented by VGAM1 HOST TARGET PROTEIN through VGAM3 HOST TARGET PROTEIN, all of FIG. 1.

VGAM614 RNA, herein schematically represented by VGAM1 RNA through VGAM3 RNA, binds complementarily to a host target binding site located in an untranslated region of VGAM614 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM614 host target RNA into VGAM614 host target protein, herein schematically represented by VGAM1 HOST TARGET PROTEIN through VGAM3 HOST TARGET PROTEIN, all of FIG. 1.

It is appreciated that a function of VGR2855 gene, herein designated VGR GENE, is inhibition of expression of host target genes, as part of a novel viral mechanism of attacking a host. Accordingly, utilities of VGR2855 gene include diagnosis, prevention and treatment of viral infection by Xestia C-nigrum Granulovirus. Specific functions, and accordingly utilities, of VGR2855 gene correlate with, and may be deduced from, the identity of the host target genes, which are inhibited by VGAM RNAs comprised in the 'operon-like' cluster of VGR2855 gene: VGAM613 host target protein and VGAM614 host target protein, herein schematically represented by VGAM1 HOST TARGET PROTEIN through VGAM3 HOST TARGET PROTEIN. The function of these host target genes is elaborated hereinabove with reference to VGAM613 and VGAM614. FIG. 9 further provides a conceptual description of novel bioinformatically detected regulatory viral gene, referred to here as Viral Genomic Record 2856(VGR2856) viral gene, which encodes an 'operon-like' cluster of novel viral micro RNA-like genes, each of which in turn modulates expression of at least one host target gene, the function and utility of which at least one host target gene is known in the art.

VGR2856 gene, herein designated VGR GENE, is a novel bioinformatically detected regulatory, non protein coding, RNA viral gene. The method by which VGR2856 gene was detected is described hereinabove with reference to FIGS. 1-9.

VGR2856 gene encodes VGR2856 precursor RNA, herein designated VGR PRECURSOR RNA, an RNA molecule, typically several hundred nucleotides long.

VGR2856 precursor RNA folds spatially, forming VGR2856 folded precursor RNA, herein designated VGR FOLDED PRECURSOR RNA. It is appreciated that VGR2856 folded precursor RNA comprises a plurality of what is known in the art as 'hairpin' structures. These 'hairpin' structures are due to the fact that the nucleotide sequence of VGR2856 precursor RNA comprises a plurality of segments, the first half of each such segment having a nucleotide sequence which is at least a partial inversed-reversed sequence of the second half thereof, as is well known in the art.

VGR2856 folded precursor RNA is naturally processed by cellular enzymatic activity into at least 2 separate VGAM precursor RNAs, VGAM615 precursor RNA and VGAM616 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM615 RNA and VGAM616 RNA, herein schematically represented by VGAM1 RNA through VGAM3 RNA, each of which VGAM RNAs corresponding to VGAM RNA of FIG. 1.

VGAM615 RNA, herein schematically represented by VGAM1 RNA through VGAM3 RNA, binds complementarily to a host target binding site located in an untranslated region of VGAM615 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM615 host target RNA into VGAM615 host target protein, herein schematically represented by VGAM1 HOST TARGET PROTEIN through VGAM3 HOST TARGET PROTEIN, all of FIG. 1.

VGAM616 RNA, herein schematically represented by VGAM1 RNA through VGAM3 RNA, binds complementarily to a host target binding site located in an untranslated region of VGAM616 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM616 host target RNA into VGAM616 host target protein, herein schematically represented by VGAM1 HOST TARGET PROTEIN through VGAM3 HOST TARGET PROTEIN, all of FIG. 1.

It is appreciated that a function of VGR2856 gene, herein designated VGR GENE, is inhibition of expression of host target genes, as part of a novel viral mechanism of attacking a host. Accordingly, utilities of VGR2856 gene include diagnosis, prevention and treatment of viral infection by Xestia C-nigrum Granulovirus. Specific functions, and accordingly utilities, of VGR2856 gene correlate with, and may be deduced from, the identity of the host target genes, which are inhibited by VGAM RNAs comprised in the 'operon-like' cluster of VGR2856 gene: VGAM615 host target protein and VGAM616 host target protein, herein schematically represented by VGAM1 HOST TARGET PROTEIN through VGAM3 HOST TARGET PROTEIN. The function of these host target genes is elaborated hereinabove with reference to VGAM615 and VGAM616. FIG. 9 further provides a conceptual description of novel bioinformatically detected regulatory viral gene, referred to here as Viral Genomic Record 2857(VGR2857) viral gene, which encodes an 'operon-like' cluster of novel viral micro RNA-like genes, each of which in turn modulates expression of at least one host target gene, the function and utility of which at least one host target gene is known in the art.

VGR2857 gene, herein designated VGR GENE, is a novel bioinformatically detected regulatory, non protein coding, RNA viral gene. The method by which VGR2857 gene was detected is described hereinabove with reference to FIGS. 1-9.

VGR2857 gene encodes VGR2857 precursor RNA, herein designated VGR PRECURSOR RNA, an RNA molecule, typically several hundred nucleotides long.

VGR2857 precursor RNA folds spatially, forming VGR2857 folded precursor RNA, herein designated VGR FOLDED PRECURSOR RNA. It is appreciated that VGR2857 folded precursor RNA comprises a plurality of what is known in the art as 'hairpin' structures. These 'hairpin' structures are due to the fact that the nucleotide sequence of VGR2857 precursor RNA comprises a plurality of segments, the first half of each such segment having a nucleotide sequence which is at least a partial inversed-reversed sequence of the second half thereof, as is well known in the art.

VGR2857 folded precursor RNA is naturally processed by cellular enzymatic activity into at least 8 separate VGAM precursor RNAs, VGAM619 precursor RNA, VGAM620 precursor RNA, VGAM621 precursor RNA, VGAM622 precursor RNA, VGAM623 precursor RNA, VGAM624 precursor RNA, VGAM625 precursor RNA and VGAM626 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM619 RNA, VGAM620 RNA, VGAM621 RNA, VGAM622 RNA, VGAM623 RNA, VGAM624 RNA, VGAM625 RNA and VGAM626 RNA, herein schematically represented by VGAM1 RNA through VGAM3 RNA, each of which VGAM RNAs corresponding to VGAM RNA of FIG. 1.

VGAM619 RNA, herein schematically represented by VGAM1 RNA through VGAM3 RNA, binds complementarily to a host target binding site located in an untranslated region of VGAM619 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM619 host target RNA into VGAM619 host target protein, herein schematically represented by VGAM1 HOST TARGET PROTEIN through VGAM3 HOST TARGET PROTEIN, all of FIG. 1.

VGAM620 RNA, herein schematically represented by VGAM1 RNA through VGAM3 RNA, binds complementarily to a host target binding site located in an untranslated region of VGAM620 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM620 host target RNA into VGAM620 host target protein, herein schematically represented by VGAM1 HOST TARGET PROTEIN through VGAM3 HOST TARGET PROTEIN, all of FIG. 1.

VGAM621 RNA, herein schematically represented by VGAM1 RNA through VGAM3 RNA, binds complementarily to a host target binding site located in an untranslated region of VGAM621 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM621 host target RNA into VGAM621 host target protein, herein schematically represented by VGAM1 HOST TARGET PROTEIN through VGAM3 HOST TARGET PROTEIN, all of FIG. 1.

VGAM622 RNA, herein schematically represented by VGAM1 RNA through VGAM3 RNA, binds complementarily to a host target binding site located in an untranslated region of VGAM622 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM622 host target RNA into VGAM622 host target protein, herein schematically represented by VGAM1 HOST TARGET PROTEIN through VGAM3 HOST TARGET PROTEIN, all of FIG. 1.

VGAM623 RNA, herein schematically represented by VGAM1 RNA through VGAM3 RNA, binds complementarily to a host target binding site located in an untranslated region of VGAM623 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM623 host target RNA into VGAM623 host target protein, herein schematically represented by VGAM1 HOST TARGET PROTEIN through VGAM3 HOST TARGET PROTEIN, all of FIG. 1.

VGAM624 RNA, herein schematically represented by VGAM1 RNA through VGAM3 RNA, binds complementarily to a host target binding site located in an untranslated region of VGAM624 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM624 host target RNA into VGAM624 host target protein, herein schematically represented by VGAM1 HOST TARGET PROTEIN through VGAM3 HOST TARGET PROTEIN, all of FIG. 1.

VGAM625 RNA, herein schematically represented by VGAM1 RNA through VGAM3 RNA, binds complementarily to a host target binding site located in an untranslated region of VGAM625 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM625 host target RNA into VGAM625 host target protein, herein schematically represented by VGAM1 HOST TARGET PROTEIN through VGAM3 HOST TARGET PROTEIN, all of FIG. 1.

VGAM626 RNA, herein schematically represented by VGAM1 RNA through VGAM3 RNA, binds complementarily to a host target binding site located in an untranslated region of VGAM626 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM626 host target RNA into VGAM626 host target protein, herein schematically represented by VGAM1 HOST TARGET PROTEIN through VGAM3 HOST TARGET PROTEIN, all of FIG. 1.

It is appreciated that a function of VGR2857 gene, herein designated VGR GENE, is inhibition of expression of host target genes, as part of a novel viral mechanism of attacking a host. Accordingly, utilities of VGR2857 gene include diagnosis, prevention and treatment of viral infection by Hepatitis GB Virus C. Specific functions, and accordingly utilities, of VGR2857 gene correlate with, and may be deduced from, the identity of the host target genes, which are inhibited by VGAM RNAs comprised in the 'operon-like' cluster of VGR2857 gene: VGAM619 host target protein, VGAM620 host target protein, VGAM621 host target protein, VGAM622 host target protein, VGAM623 host target protein, VGAM624 host target protein, VGAM625 host target protein and VGAM626 host target protein, herein schematically represented by VGAM1 HOST TARGET PROTEIN through VGAM3 HOST TARGET PROTEIN. The function of these host target genes is elaborated hereinabove with reference to VGAM619, VGAM620, VGAM621, VGAM622, VGAM623, VGAM624, VGAM625 and VGAM626. FIG. 9 further provides a conceptual description of novel bioinformatically detected regulatory viral gene, referred to here as Viral Genomic Record 2858(VGR2858) viral gene, which encodes an 'operon-like' cluster of novel viral micro RNA-like genes, each of which in turn modulates expression of at least one host target gene, the function and utility of which at least one host target gene is known in the art.

VGR2858 gene, herein designated VGR GENE, is a novel bioinformatically detected regulatory, non protein coding, RNA viral gene. The method by which VGR2858 gene was detected is described hereinabove with reference to FIGS. 1-9.

VGR2858 gene encodes VGR2858 precursor RNA, herein designated VGR PRECURSOR RNA, an RNA molecule, typically several hundred nucleotides long.

VGR2858 precursor RNA folds spatially, forming VGR2858 folded precursor RNA, herein designated VGR FOLDED PRECURSOR RNA. It is appreciated that VGR2858 folded precursor RNA comprises a plurality of what is known in the art as 'hairpin' structures. These 'hairpin' structures are due to the fact that the nucleotide sequence of VGR2858 precursor RNA comprises a plurality of segments, the first half of each such segment having a nucleotide sequence which is at least a partial inversed-reversed sequence of the second half thereof, as is well known in the art.

VGR2858 folded precursor RNA is naturally processed by cellular enzymatic activity into at least 4 separate VGAM precursor RNAs, VGAM627 precursor RNA, VGAM628 precursor RNA, VGAM629 precursor RNA and VGAM630 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM627 RNA, VGAM628 RNA, VGAM629 RNA and VGAM630 RNA, herein schematically represented by VGAM1 RNA through VGAM3 RNA, each of which VGAM RNAs corresponding to VGAM RNA of FIG. 1.

VGAM627 RNA, herein schematically represented by VGAM1 RNA through VGAM3 RNA, binds complementarily to a host target binding site located in an untranslated region of VGAM627 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM627 host target RNA into VGAM627 host target protein, herein schematically represented by VGAM1 HOST TARGET PROTEIN through VGAM3 HOST TARGET PROTEIN, all of FIG. 1.

VGAM628 RNA, herein schematically represented by VGAM1 RNA through VGAM3 RNA, binds complementarily to a host target binding site located in an untranslated region of VGAM628 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM628 host target RNA into VGAM628 host target protein, herein schematically represented by VGAM1 HOST TARGET PROTEIN through VGAM3 HOST TARGET PROTEIN, all of FIG. 1.

VGAM629 RNA, herein schematically represented by VGAM1 RNA through VGAM3 RNA, binds complementarily to a host target binding site located in an untranslated region of VGAM629 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM629 host target RNA into VGAM629 host target protein, herein schematically represented by VGAM1 HOST TARGET PROTEIN through VGAM3 HOST TARGET PROTEIN, all of FIG. 1.

VGAM630 RNA, herein schematically represented by VGAM1 RNA through VGAM3 RNA, binds complementarily to a host target binding site located in an untranslated region of VGAM630 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM630 host target RNA into VGAM630 host target protein, herein schematically represented by VGAM1 HOST TARGET PROTEIN through VGAM3 HOST TARGET PROTEIN, all of FIG. 1.

It is appreciated that a function of VGR2858 gene, herein designated VGR GENE, is inhibition of expression of host target genes, as part of a novel viral mechanism of attacking a host. Accordingly, utilities of VGR2858 gene include diagnosis, prevention and treatment of viral infection by Hepatitis GB Virus C. Specific functions, and accordingly utilities, of VGR2858 gene correlate with, and may be deduced from, the identity of the host target genes, which are inhibited by VGAM RNAs comprised in the 'operon-like' cluster of VGR2858 gene: VGAM627 host target protein, VGAM628 host target protein, VGAM629 host target protein and VGAM630 host target protein, herein schematically represented by VGAM1 HOST TARGET PROTEIN through VGAM3 HOST TARGET PROTEIN. The function of these host target genes is elaborated hereinabove with reference to VGAM627, VGAM628, VGAM629 and VGAM630. FIG. 9 further provides a conceptual description of novel bioinformatically detected regulatory viral gene, referred to here as Viral Genomic Record 2859(VGR2859) viral gene, which encodes an 'operon-like' cluster of novel viral micro RNA-like genes, each of which in turn modulates expression of at least one host target gene, the function and utility of which at least one host target gene is known in the art.

VGR2859 gene, herein designated VGR GENE, is a novel bioinformatically detected regulatory, non protein coding, RNA viral gene. The method by which VGR2859 gene was detected is described hereinabove with reference to FIGS. 1-9.

VGR2859 gene encodes VGR2859 precursor RNA, herein designated VGR PRECURSOR RNA, an RNA molecule, typically several hundred nucleotides long.

VGR2859 precursor RNA folds spatially, forming VGR2859 folded precursor RNA, herein designated VGR FOLDED PRECURSOR RNA. It is appreciated that VGR2859 folded precursor RNA comprises a plurality of what is known in the art as 'hairpin' structures. These 'hairpin' structures are due to the fact that the nucleotide sequence of VGR2859 precursor RNA comprises a plurality of segments, the first half of each such segment having a nucleotide sequence which is at least a partial inversed-reversed sequence of the second half thereof, as is well known in the art.

VGR2859 folded precursor RNA is naturally processed by cellular enzymatic activity into at least 2 separate VGAM precursor RNAs, VGAM631 precursor RNA and VGAM632 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM631 RNA and VGAM632 RNA, herein schematically represented by VGAM1 RNA through VGAM3 RNA, each of which VGAM RNAs corresponding to VGAM RNA of FIG. 1.

VGAM631 RNA, herein schematically represented by VGAM1 RNA through VGAM3 RNA, binds complementarily to a host target binding site located in an untranslated region of VGAM631 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM631 host target RNA into VGAM631 host target protein, herein schematically represented by VGAM1 HOST TARGET PROTEIN through VGAM3 HOST TARGET PROTEIN, all of FIG. 1.

VGAM632 RNA, herein schematically represented by VGAM1 RNA through VGAM3 RNA, binds complementarily to a host target binding site located in an untranslated region of VGAM632 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM632 host target RNA into VGAM632 host target protein, herein schematically represented by VGAM1 HOST TARGET PROTEIN through VGAM3 HOST TARGET PROTEIN, all of FIG. 1.

It is appreciated that a function of VGR2859 gene, herein designated VGR GENE, is inhibition of expression of host target genes, as part of a novel viral mechanism of attacking a host. Accordingly, utilities of VGR2859 gene include diagnosis, prevention and treatment of viral infection by Ovine Astrovirus. Specific functions, and accordingly utilities, of VGR2859 gene correlate with, and may be deduced from, the identity of the host target genes, which are inhibited by VGAM RNAs comprised in the 'operon-like' cluster of VGR2859 gene: VGAM631 host target protein and VGAM632 host target protein, herein schematically represented by VGAM1 HOST TARGET PROTEIN through VGAM3 HOST TARGET PROTEIN. The function of these host target genes is elaborated hereinabove with reference to VGAM631 and VGAM632. FIG. 9 further provides a conceptual description of novel bioinformatically detected regulatory viral gene, referred to here as Viral Genomic Record 2860(VGR2860) viral gene, which encodes an 'operon-like' cluster of novel viral micro RNA-like genes, each of which in turn modulates expression of at least one host target gene, the function and utility of which at least one host target gene is known in the art.

VGR2860 gene, herein designated VGR GENE, is a novel bioinformatically detected regulatory, non protein coding, RNA viral gene. The method by which VGR2860 gene was detected is described hereinabove with reference to FIGS. 1-9.

VGR2860 gene encodes VGR2860 precursor RNA, herein designated VGR PRECURSOR RNA, an RNA molecule, typically several hundred nucleotides long.

VGR2860 precursor RNA folds spatially, forming VGR2860 folded precursor RNA, herein designated VGR FOLDED PRECURSOR RNA. It is appreciated that VGR2860 folded precursor RNA comprises a plurality of what is known in the art as 'hairpin' structures. These 'hairpin' structures are due to the fact that the nucleotide sequence of VGR2860 precursor RNA comprises a plurality of segments, the first half of each such segment having a nucleotide sequence which is at least a partial inversed-reversed sequence of the second half thereof, as is well known in the art.

VGR2860 folded precursor RNA is naturally processed by cellular enzymatic activity into at least 2 separate VGAM precursor RNAs, VGAM633 precursor RNA and VGAM634 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM633 RNA and VGAM634 RNA, herein schematically represented by VGAM1 RNA through VGAM3 RNA, each of which VGAM RNAs corresponding to VGAM RNA of FIG. 1.

VGAM633 RNA, herein schematically represented by VGAM1 RNA through VGAM3 RNA, binds complementarily to a host target binding site located in an untranslated region of VGAM633 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM633 host target RNA into VGAM633 host target protein, herein schematically represented by VGAM1 HOST TARGET PROTEIN through VGAM3 HOST TARGET PROTEIN, all of FIG. 1.

VGAM634 RNA, herein schematically represented by VGAM1 RNA through VGAM3 RNA, binds complementarily to a host target binding site located in an untranslated region of VGAM634 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM634 host target RNA into VGAM634 host target protein, herein schematically represented by VGAM1 HOST TARGET PROTEIN through VGAM3 HOST TARGET PROTEIN, all of FIG. 1.

It is appreciated that a function of VGR2860 gene, herein designated VGR GENE, is inhibition of expression of host target genes, as part of a novel viral mechanism of attacking a host. Accordingly, utilities of VGR2860 gene include diagnosis, prevention and treatment of viral infection by Turkey Astrovirus. Specific functions, and accordingly utilities, of VGR2860 gene correlate with, and may be deduced from, the identity of the host target genes, which are inhibited by VGAM RNAs comprised in the 'operon-like' cluster of VGR2860 gene: VGAM633 host target protein and VGAM634 host target protein, herein schematically represented by VGAM1 HOST TARGET PROTEIN through VGAM3 HOST TARGET PROTEIN. The function of these host target genes is elaborated hereinabove with reference to VGAM633 and VGAM634. FIG. 9 further provides a conceptual description of novel bioinformatically detected regulatory viral gene, referred to here as Viral Genomic Record 2861(VGR2861) viral gene, which encodes an 'operon-like' cluster of novel viral micro RNA-like genes, each of which in turn modulates expression of at least one host target gene, the function and utility of which at least one host target gene is known in the art.

VGR2861 gene, herein designated VGR GENE, is a novel bioinformatically detected regulatory, non protein coding, RNA viral gene. The method by which VGR2861 gene was detected is described hereinabove with reference to FIGS. 1-9.

VGR2861 gene encodes VGR2861 precursor RNA, herein designated VGR PRECURSOR RNA, an RNA molecule, typically several hundred nucleotides long.

VGR2861 precursor RNA folds spatially, forming VGR2861 folded precursor RNA, herein designated VGR FOLDED PRECURSOR RNA. It is appreciated that VGR2861 folded precursor RNA comprises a plurality of what is known in the art as 'hairpin' structures. These 'hairpin' structures are due to the fact that the nucleotide sequence of VGR2861 precursor RNA comprises a plurality of segments, the first half of each such segment having a nucleotide sequence which is at least a partial inversed-reversed sequence of the second half thereof, as is well known in the art.

VGR2861 folded precursor RNA is naturally processed by cellular enzymatic activity into at least 2 separate VGAM precursor RNAs, VGAM635 precursor RNA and VGAM636 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM635 RNA and VGAM636 RNA, herein schematically represented by VGAM1 RNA through VGAM3 RNA, each of which VGAM RNAs corresponding to VGAM RNA of FIG. 1.

VGAM635 RNA, herein schematically represented by VGAM1 RNA through VGAM3 RNA, binds complementarily to a host target binding site located in an untranslated region of VGAM635 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM635 host target RNA into VGAM635 host target protein, herein schematically represented by VGAM1 HOST TARGET PROTEIN through VGAM3 HOST TARGET PROTEIN, all of FIG. 1.

VGAM636 RNA, herein schematically represented by VGAM1 RNA through VGAM3 RNA, binds complementarily to a host target binding site located in an untranslated region of VGAM636 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM636 host target RNA into VGAM636 host target protein, herein schematically represented by VGAM1 HOST TARGET PROTEIN through VGAM3 HOST TARGET PROTEIN, all of FIG. 1.

It is appreciated that a function of VGR2861 gene, herein designated VGR GENE, is inhibition of expression of host target genes, as part of a novel viral mechanism of attacking a host. Accordingly, utilities of VGR2861 gene include diagnosis, prevention and treatment of viral infection by Cherry Mottle Leaf Virus. Specific functions, and accordingly utilities, of VGR2861 gene correlate with, and may be deduced from, the identity of the host target genes, which are inhibited by VGAM RNAs comprised in the 'operon-like' cluster of VGR2861 gene: VGAM635 host target protein and VGAM636 host target protein, herein schematically represented by VGAM1 HOST TARGET PROTEIN through VGAM3 HOST TARGET PROTEIN. The function of these host target genes is elaborated hereinabove with reference to VGAM635 and VGAM636. FIG. 9 further provides a conceptual description of novel bioinformatically detected regulatory viral gene, referred to here as Viral Genomic Record 2862(VGR2862) viral gene, which encodes an 'operon-like' cluster of novel viral micro RNA-like genes, each of which in turn modulates expression of at least one host target gene, the function and utility of which at least one host target gene is known in the art.

VGR2862 gene, herein designated VGR GENE, is a novel bioinformatically detected regulatory, non protein coding, RNA viral gene. The method by which VGR2862 gene was detected is described hereinabove with reference to FIGS. 1-9.

VGR2862 gene encodes VGR2862 precursor RNA, herein designated VGR PRECURSOR RNA, an RNA molecule, typically several hundred nucleotides long.

VGR2862 precursor RNA folds spatially, forming VGR2862 folded precursor RNA, herein designated VGR FOLDED PRECURSOR RNA. It is appreciated that VGR2862 folded precursor RNA comprises a plurality of what is known in the art as 'hairpin' structures. These 'hairpin' structures are due to the fact that the nucleotide sequence of VGR2862 precursor RNA comprises a plurality of segments, the first half of each such segment having a nucleotide sequence which is at least a partial inversed-reversed sequence of the second half thereof, as is well known in the art.

VGR2862 folded precursor RNA is naturally processed by cellular enzymatic activity into at least 3 separate VGAM precursor RNAs, VGAM638 precursor RNA, VGAM639 precursor RNA and VGAM640 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM638 RNA, VGAM639 RNA and VGAM640 RNA, herein schematically represented by VGAM1 RNA through VGAM3 RNA, each of which VGAM RNAs corresponding to VGAM RNA of FIG. 1.

VGAM638 RNA, herein schematically represented by VGAM1 RNA through VGAM3 RNA, binds complementarily to a host target binding site located in an untranslated region of VGAM638 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM638 host target RNA into VGAM638 host target protein, herein schematically represented by VGAM1 HOST TARGET PROTEIN through VGAM3 HOST TARGET PROTEIN, all of FIG. 1.

VGAM639 RNA, herein schematically represented by VGAM1 RNA through VGAM3 RNA, binds complementarily to a host target binding site located in an untranslated region of VGAM639 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM639 host target RNA into VGAM639 host target protein, herein schematically represented by VGAM1 HOST TARGET PROTEIN through VGAM3 HOST TARGET PROTEIN, all of FIG. 1.

VGAM640 RNA, herein schematically represented by VGAM1 RNA through VGAM3 RNA, binds complementarily to a host target binding site located in an untranslated region of VGAM640 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM640 host target RNA into VGAM640 host target protein, herein schematically represented by VGAM1 HOST TARGET PROTEIN through VGAM3 HOST TARGET PROTEIN, all of FIG. 1.

It is appreciated that a function of VGR2862 gene, herein designated VGR GENE, is inhibition of expression of host target genes, as part of a novel viral mechanism of attacking a host. Accordingly, utilities of VGR2862 gene include diagnosis, prevention and treatment of viral infection by Turnip Mosaic Virus. Specific functions, and accordingly utilities, of VGR2862 gene correlate with, and may be deduced from, the identity of the host target genes, which are inhibited by VGAM RNAs comprised in the 'operon-like' cluster of VGR2862 gene: VGAM638 host target protein, VGAM639 host target protein and VGAM640 host target protein, herein schematically represented by VGAM1 HOST TARGET PROTEIN through VGAM3 HOST TARGET PROTEIN. The function of these host target genes is elaborated hereinabove with reference to VGAM638, VGAM639 and VGAM640. FIG. 9 further provides a conceptual description of novel bioinformatically detected regulatory viral gene, referred to here as Viral Genomic Record 2863(VGR2863) viral gene, which encodes an 'operon-like' cluster of novel viral micro RNA-like genes, each of which in turn modulates expression of at least one host target gene, the function and utility of which at least one host target gene is known in the art.

VGR2863 gene, herein designated VGR GENE, is a novel bioinformatically detected regulatory, non protein coding, RNA viral gene. The method by which VGR2863 gene was detected is described hereinabove with reference to FIGS. 1-9.

VGR2863 gene encodes VGR2863 precursor RNA, herein designated VGR PRECURSOR RNA, an RNA molecule, typically several hundred nucleotides long.

VGR2863 precursor RNA folds spatially, forming VGR2863 folded precursor RNA, herein designated VGR FOLDED PRECURSOR RNA. It is appreciated that VGR2863 folded precursor RNA comprises a plurality of what is known in the art as 'hairpin' structures. These 'hairpin' structures are due to the fact that the nucleotide sequence of VGR2863 precursor RNA comprises a plurality of segments, the first half of each such segment having a nucleotide sequence which is at least a partial inversed-reversed sequence of the second half thereof, as is well known in the art.

VGR2863 folded precursor RNA is naturally processed by cellular enzymatic activity into at least 2 separate VGAM precursor RNAs, VGAM644 precursor RNA and VGAM645 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM644 RNA and VGAM645 RNA, herein schematically represented by VGAM1 RNA through VGAM3 RNA, each of which VGAM RNAs corresponding to VGAM RNA of FIG. 1.

VGAM644 RNA, herein schematically represented by VGAM1 RNA through VGAM3 RNA, binds complementarily to a host target binding site located in an untranslated region of VGAM644 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM644 host target RNA into VGAM644 host target protein, herein schematically represented by VGAM1 HOST TARGET PROTEIN through VGAM3 HOST TARGET PROTEIN, all of FIG. 1.

VGAM645 RNA, herein schematically represented by VGAM1 RNA through VGAM3 RNA, binds complementarily to a host target binding site located in an untranslated region of VGAM645 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM645 host target RNA into VGAM645 host target protein, herein schematically represented by VGAM1 HOST TARGET PROTEIN through VGAM3 HOST TARGET PROTEIN, all of FIG. 1.

It is appreciated that a function of VGR2863 gene, herein designated VGR GENE, is inhibition of expression of host target genes, as part of a novel viral mechanism of attacking a host. Accordingly, utilities of VGR2863 gene include diagnosis, prevention and treatment of viral infection by Parvovirus H1. Specific functions, and accordingly utilities, of VGR2863 gene correlate with, and may be deduced from, the identity of the host target genes, which are inhibited by VGAM RNAs comprised in the 'operon-like' cluster of VGR2863 gene: VGAM644 host target protein and VGAM645 host target protein, herein schematically represented by VGAM1 HOST TARGET PROTEIN through VGAM3 HOST TARGET PROTEIN. The function of these host target genes is elaborated hereinabove with reference to VGAM644 and VGAM645. FIG. 9 further provides a conceptual description of novel bioinformatically detected regulatory viral gene, referred to here as Viral Genomic Record 2864(VGR2864) viral gene, which encodes an 'operon-like' cluster of novel viral micro RNA-like genes, each of which in turn modulates expression of at least one host target gene, the function and utility of which at least one host target gene is known in the art.

VGR2864 gene, herein designated VGR GENE, is a novel bioinformatically detected regulatory, non protein coding, RNA viral gene. The method by which VGR2864 gene was detected is described hereinabove with reference to FIGS. 1-9.

VGR2864 gene encodes VGR2864 precursor RNA, herein designated VGR PRECURSOR RNA, an RNA molecule, typically several hundred nucleotides long.

VGR2864 precursor RNA folds spatially, forming VGR2864 folded precursor RNA, herein designated VGR FOLDED PRECURSOR RNA. It is appreciated that VGR2864 folded precursor RNA comprises a plurality of what is known in the art as 'hairpin' structures. These 'hairpin' structures are due to the fact that the nucleotide sequence of VGR2864 precursor RNA comprises a plurality of segments, the first half of each such segment having a nucleotide sequence which is at least a partial inversed-reversed sequence of the second half thereof, as is well known in the art.

VGR2864 folded precursor RNA is naturally processed by cellular enzymatic activity into at least 3 separate VGAM precursor RNAs, VGAM647 precursor RNA, VGAM648 precursor RNA and VGAM649 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM647 RNA, VGAM648 RNA and VGAM649 RNA, herein schematically represented by VGAM1 RNA through VGAM3 RNA, each of which VGAM RNAs corresponding to VGAM RNA of FIG. 1.

VGAM647 RNA, herein schematically represented by VGAM1 RNA through VGAM3 RNA, binds complementarily to a host target binding site located in an untranslated region of VGAM647 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM647 host target RNA into VGAM647 host target protein, herein schematically represented by VGAM1 HOST TARGET PROTEIN through VGAM3 HOST TARGET PROTEIN, all of FIG. 1.

VGAM648 RNA, herein schematically represented by VGAM1 RNA through VGAM3 RNA, binds complementarily to a host target binding site located in an untranslated region of VGAM648 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM648 host target RNA into VGAM648 host target protein, herein schematically represented by VGAM1 HOST TARGET PROTEIN through VGAM3 HOST TARGET PROTEIN, all of FIG. 1.

VGAM649 RNA, herein schematically represented by VGAM1 RNA through VGAM3 RNA, binds complementarily to a host target binding site located in an untranslated region of VGAM649 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM649 host target RNA into VGAM649 host target protein, herein schematically represented by VGAM1 HOST TARGET PROTEIN through VGAM3 HOST TARGET PROTEIN, all of FIG. 1.

It is appreciated that a function of VGR2864 gene, herein designated VGR GENE, is inhibition of expression of host target genes, as part of a novel viral mechanism of attacking a host. Accordingly, utilities of VGR2864 gene include diagnosis, prevention and treatment of viral infection by Acute Bee Paralysis Virus. Specific functions, and accordingly utilities, of VGR2864 gene correlate with, and may be deduced from, the identity of the host target genes, which are inhibited by VGAM RNAs comprised in the 'operon-like' cluster of VGR2864 gene: VGAM647 host target protein, VGAM648 host target protein and VGAM649 host target protein, herein schematically represented by VGAM1 HOST TARGET PROTEIN through VGAM3 HOST TARGET PROTEIN. The function of these host target genes is elaborated hereinabove with reference to VGAM647, VGAM648 and VGAM649. FIG. 9 further provides a conceptual description of novel bioinformatically detected regulatory viral gene, referred to here as Viral Genomic Record 2865(VGR2865) viral gene, which encodes an 'operon-like' cluster of novel viral micro RNA-like genes, each of which in turn modulates expression of at least one host target gene, the function and utility of which at least one host target gene is known in the art.

VGR2865 gene, herein designated VGR GENE, is a novel bioinformatically detected regulatory, non protein coding, RNA viral gene. The method by which VGR2865 gene was detected is described hereinabove with reference to FIGS. 1-9.

VGR2865 gene encodes VGR2865 precursor RNA, herein designated VGR PRECURSOR RNA, an RNA molecule, typically several hundred nucleotides long.

VGR2865 precursor RNA folds spatially, forming VGR2865 folded precursor RNA, herein designated VGR FOLDED PRECURSOR RNA. It is appreciated that VGR2865 folded precursor RNA comprises a plurality of what is known in the art as 'hairpin' structures. These 'hairpin' structures are due to the fact that the nucleotide sequence of VGR2865 precursor RNA comprises a plurality of segments, the first half of each such segment having a nucleotide sequence which is at least a partial inversed-reversed sequence of the second half thereof, as is well known in the art.

VGR2865 folded precursor RNA is naturally processed by cellular enzymatic activity into at least 2 separate VGAM precursor RNAs, VGAM652 precursor RNA and VGAM653 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM652 RNA and VGAM653 RNA, herein schematically represented by VGAM1 RNA through VGAM3 RNA, each of which VGAM RNAs corresponding to VGAM RNA of FIG. 1.

VGAM652 RNA, herein schematically represented by VGAM1 RNA through VGAM3 RNA, binds complementarily to a host target binding site located in an untranslated region of VGAM652 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM652 host target RNA into VGAM652 host target protein, herein schematically represented by VGAM1 HOST TARGET PROTEIN through VGAM3 HOST TARGET PROTEIN, all of FIG. 1.

VGAM653 RNA, herein schematically represented by VGAM1 RNA through VGAM3 RNA, binds complementarily to a host target binding site located in an untranslated region of VGAM653 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM653 host target RNA into VGAM653 host target protein, herein schematically represented by VGAM1 HOST TARGET PROTEIN through VGAM3 HOST TARGET PROTEIN, all of FIG. 1.

It is appreciated that a function of VGR2865 gene, herein designated VGR GENE, is inhibition of expression of host target genes, as part of a novel viral mechanism of attacking a host. Accordingly, utilities of VGR2865 gene include diagnosis, prevention and treatment of viral infection by Meleagrid Herpesvirus 1. Specific functions, and accordingly utilities, of VGR2865 gene correlate with, and may be deduced from, the identity of the host target genes, which are inhibited by VGAM RNAs comprised in the 'operon-like' cluster of VGR2865 gene: VGAM652 host target protein and VGAM653 host target protein, herein schematically represented by VGAM1 HOST TARGET PROTEIN through VGAM3 HOST TARGET PROTEIN. The function of these host target genes is elaborated hereinabove with reference to VGAM652 and VGAM653. FIG. 9 further provides a conceptual description of novel bioinformatically detected regulatory viral gene, referred to here as Viral Genomic Record 2866(VGR2866) viral gene, which encodes an 'operon-like' cluster of novel viral micro RNA-like genes, each of which in turn modulates expression of at least one host target gene, the function and utility of which at least one host target gene is known in the art.

VGR2866 gene, herein designated VGR GENE, is a novel bioinformatically detected regulatory, non protein coding, RNA viral gene. The method by which VGR2866 gene was detected is described hereinabove with reference to FIGS. 1-9.

VGR2866 gene encodes VGR2866 precursor RNA, herein designated VGR PRECURSOR RNA, an RNA molecule, typically several hundred nucleotides long.

VGR2866 precursor RNA folds spatially, forming VGR2866 folded precursor RNA, herein designated VGR FOLDED PRECURSOR RNA. It is appreciated that VGR2866 folded precursor RNA comprises a plurality of what is known in the art as 'hairpin' structures. These 'hairpin' structures are due to the fact that the nucleotide sequence of VGR2866 precursor RNA comprises a plurality of segments, the first half of each such segment having a nucleotide sequence which is at least a partial inversed-reversed sequence of the second half thereof, as is well known in the art.

VGR2866 folded precursor RNA is naturally processed by cellular enzymatic activity into at least 4 separate VGAM precursor RNAs, VGAM654 precursor RNA, VGAM655 precursor RNA, VGAM656 precursor RNA and VGAM657 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM654 RNA, VGAM655 RNA, VGAM656 RNA and VGAM657 RNA, herein schematically represented by VGAM1 RNA through VGAM3 RNA, each of which VGAM RNAs corresponding to VGAM RNA of FIG. 1.

VGAM654 RNA, herein schematically represented by VGAM1 RNA through VGAM3 RNA, binds complementarily to a host target binding site located in an untranslated region of VGAM654 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM654 host target RNA into VGAM654 host target protein, herein schematically represented by VGAM1 HOST TARGET PROTEIN through VGAM3 HOST TARGET PROTEIN, all of FIG. 1.

VGAM655 RNA, herein schematically represented by VGAM1 RNA through VGAM3 RNA, binds complementarily to a host target binding site located in an untranslated region of VGAM655 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM655 host target RNA into VGAM655 host target protein, herein schematically represented by VGAM1 HOST TARGET PROTEIN through VGAM3 HOST TARGET PROTEIN, all of FIG. 1.

VGAM656 RNA, herein schematically represented by VGAM1 RNA through VGAM3 RNA, binds complementarily to a host target binding site located in an untranslated region of VGAM656 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM656 host target RNA into VGAM656 host target protein, herein schematically represented by VGAM1 HOST TARGET PROTEIN through VGAM3 HOST TARGET PROTEIN, all of FIG. 1.

VGAM657 RNA, herein schematically represented by VGAM1 RNA through VGAM3 RNA, binds complementarily to a host target binding site located in an untranslated region of VGAM657 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM657 host target RNA into VGAM657 host target protein, herein schematically represented by VGAM1 HOST TARGET PROTEIN through VGAM3 HOST TARGET PROTEIN, all of FIG. 1.

It is appreciated that a function of VGR2866 gene, herein designated VGR GENE, is inhibition of expression of host target genes, as part of a novel viral mechanism of attacking a host. Accordingly, utilities of VGR2866 gene include diagnosis, prevention and treatment of viral infection by Meleagrid Herpesvirus 1. Specific functions, and accordingly utilities, of VGR2866 gene correlate with, and may be deduced from, the identity of the host target genes, which are inhibited by VGAM RNAs comprised in the 'operon-like' cluster of VGR2866 gene: VGAM654 host target protein, VGAM655 host target protein, VGAM656 host target protein and VGAM657 host target protein, herein schematically represented by VGAM1 HOST TARGET PROTEIN through VGAM3 HOST TARGET PROTEIN. The function of these host target genes is elaborated hereinabove with reference to VGAM654, VGAM655, VGAM656 and VGAM657. FIG. 9 further provides a conceptual description of novel bioinformatically detected regulatory viral gene, referred to here as Viral Genomic Record 2867(VGR2867) viral gene, which encodes an 'operon-like' cluster of novel viral micro RNA-like genes, each of which in turn modulates expression of at least one host target gene, the function and utility of which at least one host target gene is known in the art.

VGR2867 gene, herein designated VGR GENE, is a novel bioinformatically detected regulatory, non protein coding, RNA viral gene. The method by which VGR2867 gene was detected is described hereinabove with reference to FIGS. 1-9.

VGR2867 gene encodes VGR2867 precursor RNA, herein designated VGR PRECURSOR RNA, an RNA molecule, typically several hundred nucleotides long.

VGR2867 precursor RNA folds spatially, forming VGR2867 folded precursor RNA, herein designated VGR FOLDED PRECURSOR RNA. It is appreciated that VGR2867 folded precursor RNA comprises a plurality of what is known in the art as 'hairpin' structures. These 'hairpin' structures are due to the fact that the nucleotide sequence of VGR2867 precursor RNA comprises a plurality of segments, the first half of each such segment having a nucleotide sequence which is at least a partial inversed-reversed sequence of the second half thereof, as is well known in the art.

VGR2867 folded precursor RNA is naturally processed by cellular enzymatic activity into at least 3 separate VGAM precursor RNAs, VGAM658 precursor RNA, VGAM659 precursor RNA and VGAM660 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM658 RNA, VGAM659 RNA and VGAM660 RNA, herein schematically represented by VGAM1 RNA through VGAM3 RNA, each of which VGAM RNAs corresponding to VGAM RNA of FIG. 1.

VGAM658 RNA, herein schematically represented by VGAM1 RNA through VGAM3 RNA, binds complementarily to a host target binding site located in an untranslated region of VGAM658 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM658 host target RNA into VGAM658 host target protein, herein schematically represented by VGAM1 HOST TARGET PROTEIN through VGAM3 HOST TARGET PROTEIN, all of FIG. 1.

VGAM659 RNA, herein schematically represented by VGAM1 RNA through VGAM3 RNA, binds complementarily to a host target binding site located in an untranslated region of VGAM659 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM659 host target RNA into VGAM659 host target protein, herein schematically represented by VGAM1 HOST TARGET PROTEIN through VGAM3 HOST TARGET PROTEIN, all of FIG. 1.

VGAM660 RNA, herein schematically represented by VGAM1 RNA through VGAM3 RNA, binds complementarily to a host target binding site located in an untranslated region of VGAM660 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM660 host target RNA into VGAM660 host target protein, herein schematically represented by VGAM1 HOST TARGET PROTEIN through VGAM3 HOST TARGET PROTEIN, all of FIG. 1.

It is appreciated that a function of VGR2867 gene, herein designated VGR GENE, is inhibition of expression of host target genes, as part of a novel viral mechanism of attacking a host. Accordingly, utilities of VGR2867 gene include diagnosis, prevention and treatment of viral infection by Meleagrid Herpesvirus 1. Specific functions, and accordingly utilities, of VGR2867 gene correlate with, and may be deduced from, the identity of the host target genes, which are inhibited by VGAM RNAs comprised in the 'operon-like' cluster of VGR2867 gene: VGAM658 host target protein, VGAM659 host target protein and VGAM660 host target protein, herein schematically represented by VGAM1 HOST TARGET PROTEIN through VGAM3 HOST TARGET PROTEIN.

The function of these host target genes is elaborated hereinabove with reference to VGAM658, VGAM659 and VGAM660. FIG. 9 further provides a conceptual description of novel bioinformatically detected regulatory viral gene, referred to here as Viral Genomic Record 2868(VGR2868) viral gene, which encodes an 'operon-like' cluster of novel viral micro RNA-like genes, each of which in turn modulates expression of at least one host target gene, the function and utility of which at least one host target gene is known in the art.

VGR2868 gene, herein designated VGR GENE, is a novel bioinformatically detected regulatory, non protein coding, RNA viral gene. The method by which VGR2868 gene was detected is described hereinabove with reference to FIGS. 1-9.

VGR2868 gene encodes VGR2868 precursor RNA, herein designated VGR PRECURSOR RNA, an RNA molecule, typically several hundred nucleotides long.

VGR2868 precursor RNA folds spatially, forming VGR2868 folded precursor RNA, herein designated VGR FOLDED PRECURSOR RNA. It is appreciated that VGR2868 folded precursor RNA comprises a plurality of what is known in the art as 'hairpin' structures. These 'hairpin' structures are due to the fact that the nucleotide sequence of VGR2868 precursor RNA comprises a plurality of segments, the first half of each such segment having a nucleotide sequence which is at least a partial inversed-reversed sequence of the second half thereof, as is well known in the art.

VGR2868 folded precursor RNA is naturally processed by cellular enzymatic activity into at least 3 separate VGAM precursor RNAs, VGAM663 precursor RNA, VGAM664 precursor RNA and VGAM665 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM663 RNA, VGAM664 RNA and VGAM665 RNA, herein schematically represented by VGAM1 RNA through VGAM3 RNA, each of which VGAM RNAs corresponding to VGAM RNA of FIG. 1.

VGAM663 RNA, herein schematically represented by VGAM1 RNA through VGAM3 RNA, binds complementarily to a host target binding site located in an untranslated region of VGAM663 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM663 host target RNA into VGAM663 host target protein, herein schematically represented by VGAM1 HOST TARGET PROTEIN through VGAM3 HOST TARGET PROTEIN, all of FIG. 1.

VGAM664 RNA, herein schematically represented by VGAM1 RNA through VGAM3 RNA, binds complementarily to a host target binding site located in an untranslated region of VGAM664 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM664 host target RNA into VGAM664 host target protein, herein schematically represented by VGAM1 HOST TARGET PROTEIN through VGAM3 HOST TARGET PROTEIN, all of FIG. 1.

VGAM665 RNA, herein schematically represented by VGAM1 RNA through VGAM3 RNA, binds complementarily to a host target binding site located in an untranslated region of VGAM665 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM665 host target RNA into VGAM665 host target protein, herein schematically represented by VGAM1 HOST TARGET PROTEIN through VGAM3 HOST TARGET PROTEIN, all of FIG. 1.

It is appreciated that a function of VGR2868 gene, herein designated VGR GENE, is inhibition of expression of host target genes, as part of a novel viral mechanism of attacking a host. Accordingly, utilities of VGR2868 gene include diagnosis, prevention and treatment of viral infection by Rachiplusia Ou Multiple Nucleopolyhedrovirus. Specific functions, and accordingly utilities, of VGR2868 gene correlate with, and may be deduced from, the identity of the host target genes, which are inhibited by VGAM RNAs comprised in the 'operon-like' cluster of VGR2868 gene: VGAM663 host target protein, VGAM664 host target protein and VGAM665 host target protein, herein schematically represented by VGAM1 HOST TARGET PROTEIN through VGAM3 HOST TARGET PROTEIN. The function of these host target genes is elaborated hereinabove with reference to VGAM663, VGAM664 and VGAM665. FIG. 9 further provides a conceptual description of novel bioinformatically detected regulatory viral gene, referred to here as Viral Genomic Record 2869(VGR2869) viral gene, which encodes an 'operon-like' cluster of novel viral micro RNA-like genes, each of which in turn modulates expression of at least one host target gene, the function and utility of which at least one host target gene is known in the art.

VGR2869 gene, herein designated VGR GENE, is a novel bioinformatically detected regulatory, non protein coding, RNA viral gene. The method by which VGR2869 gene was detected is described hereinabove with reference to FIGS. 1-9.

VGR2869 gene encodes VGR2869 precursor RNA, herein designated VGR PRECURSOR RNA, an RNA molecule, typically several hundred nucleotides long.

VGR2869 precursor RNA folds spatially, forming VGR2869 folded precursor RNA, herein designated VGR FOLDED PRECURSOR RNA. It is appreciated that VGR2869 folded precursor RNA comprises a plurality of what is known in the art as 'hairpin' structures. These 'hairpin' structures are due to the fact that the nucleotide sequence of VGR2869 precursor RNA comprises a plurality of segments, the first half of each such segment having a nucleotide sequence which is at least a partial inversed-reversed sequence of the second half thereof, as is well known in the art.

VGR2869 folded precursor RNA is naturally processed by cellular enzymatic activity into at least 2 separate VGAM precursor RNAs, VGAM671 precursor RNA and VGAM672 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM671

RNA and VGAM672 RNA, herein schematically represented by VGAM1 RNA through VGAM3 RNA, each of which VGAM RNAs corresponding to VGAM RNA of FIG. 1.

VGAM671 RNA, herein schematically represented by VGAM1 RNA through VGAM3 RNA, binds complementarily to a host target binding site located in an untranslated region of VGAM671 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM671 host target RNA into VGAM671 host target protein, herein schematically represented by VGAM1 HOST TARGET PROTEIN through VGAM3 HOST TARGET PROTEIN, all of FIG. 1.

VGAM672 RNA, herein schematically represented by VGAM1 RNA through VGAM3 RNA, binds complementarily to a host target binding site located in an untranslated region of VGAM672 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM672 host target RNA into VGAM672 host target protein, herein schematically represented by VGAM1 HOST TARGET PROTEIN through VGAM3 HOST TARGET PROTEIN, all of FIG. 1.

It is appreciated that a function of VGR2869 gene, herein designated VGR GENE, is inhibition of expression of host target genes, as part of a novel viral mechanism of attacking a host. Accordingly, utilities of VGR2869 gene include diagnosis, prevention and treatment of viral infection by Yaba-like Disease Virus. Specific functions, and accordingly utilities, of VGR2869 gene correlate with, and may be deduced from, the identity of the host target genes, which are inhibited by VGAM RNAs comprised in the 'operon-like' cluster of VGR2869 gene: VGAM671 host target protein and VGAM672 host target protein, herein schematically represented by VGAM1 HOST TARGET PROTEIN through VGAM3 HOST TARGET PROTEIN. The function of these host target genes is elaborated hereinabove with reference to VGAM671 and VGAM672. FIG. 9 further provides a conceptual description of novel bioinformatically detected regulatory viral gene, referred to here as Viral Genomic Record 2870(VGR2870) viral gene, which encodes an 'operon-like' cluster of novel viral micro RNA-like genes, each of which in turn modulates expression of at least one host target gene, the function and utility of which at least one host target gene is known in the art.

VGR2870 gene, herein designated VGR GENE, is a novel bioinformatically detected regulatory, non protein coding, RNA viral gene. The method by which VGR2870 gene was detected is described hereinabove with reference to FIGS. 1-9.

VGR2870 gene encodes VGR2870 precursor RNA, herein designated VGR PRECURSOR RNA, an RNA molecule, typically several hundred nucleotides long.

VGR2870 precursor RNA folds spatially, forming VGR2870 folded precursor RNA, herein designated VGR FOLDED PRECURSOR RNA. It is appreciated that VGR2870 folded precursor RNA comprises a plurality of what is known in the art as 'hairpin' structures. These 'hairpin' structures are due to the fact that the nucleotide sequence of VGR2870 precursor RNA comprises a plurality of segments, the first half of each such segment having a nucleotide sequence which is at least a partial inversed-reversed sequence of the second half thereof, as is well known in the art.

VGR2870 folded precursor RNA is naturally processed by cellular enzymatic activity into at least 8 separate VGAM precursor RNAs, VGAM673 precursor RNA, VGAM674 precursor RNA, VGAM675 precursor RNA, VGAM676 precursor RNA, VGAM677 precursor RNA, VGAM678 precursor RNA, VGAM679 precursor RNA and VGAM680 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM673 RNA, VGAM674 RNA, VGAM675 RNA, VGAM676 RNA, VGAM677 RNA, VGAM678 RNA, VGAM679 RNA and VGAM680 RNA, herein schematically represented by VGAM1 RNA through VGAM3 RNA, each of which VGAM RNAs corresponding to VGAM RNA of FIG. 1.

VGAM673 RNA, herein schematically represented by VGAM1 RNA through VGAM3 RNA, binds complementarily to a host target binding site located in an untranslated region of VGAM673 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM673 host target RNA into VGAM673 host target protein, herein schematically represented by VGAM1 HOST TARGET PROTEIN through VGAM3 HOST TARGET PROTEIN, all of FIG. 1.

VGAM674 RNA, herein schematically represented by VGAM1 RNA through VGAM3 RNA, binds complementarily to a host target binding site located in an untranslated region of VGAM674 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM674 host target RNA into VGAM674 host target protein, herein schematically represented by VGAM1 HOST TARGET PROTEIN through VGAM3 HOST TARGET PROTEIN, all of FIG. 1.

VGAM675 RNA, herein schematically represented by VGAM1 RNA through VGAM3 RNA, binds complementarily to a host target binding site located in an untranslated region of VGAM675 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM675 host target RNA into VGAM675 host target protein, herein schematically represented by VGAM1 HOST TARGET PROTEIN through VGAM3 HOST TARGET PROTEIN, all of FIG. 1.

VGAM676 RNA, herein schematically represented by VGAM1 RNA through VGAM3 RNA, binds complementarily to a host target binding site located in an untranslated region of VGAM676 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM676 host target RNA into VGAM676 host target protein, herein schematically represented by VGAM1 HOST TARGET PROTEIN through VGAM3 HOST TARGET PROTEIN, all of FIG. 1.

VGAM677 RNA, herein schematically represented by VGAM1 RNA through VGAM3 RNA, binds complementarily to a host target binding site located in an untranslated region of VGAM677 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM677 host target RNA into VGAM677 host target protein, herein schematically represented by VGAM1 HOST TARGET PROTEIN through VGAM3 HOST TARGET PROTEIN, all of FIG. 1.

VGAM678 RNA, herein schematically represented by VGAM1 RNA through VGAM3 RNA, binds complementarily to a host target binding site located in an untranslated region of VGAM678 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM678 host target RNA into VGAM678 host target protein, herein schematically represented by VGAM1 HOST TARGET PROTEIN through VGAM3 HOST TARGET PROTEIN, all of FIG. 1.

VGAM679 RNA, herein schematically represented by VGAM1 RNA through VGAM3 RNA, binds complementarily to a host target binding site located in an untranslated region of VGAM679 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM679 host target RNA into VGAM679 host target protein, herein schematically represented by VGAM1 HOST TARGET PROTEIN through VGAM3 HOST TARGET PROTEIN, all of FIG. 1.

VGAM680 RNA, herein schematically represented by VGAM1 RNA through VGAM3 RNA, binds complementarily to a host target binding site located in an untranslated region of VGAM680 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM680 host target RNA into VGAM680 host target protein, herein schematically represented by VGAM1 HOST TARGET PROTEIN through VGAM3 HOST TARGET PROTEIN, all of FIG. 1.

It is appreciated that a function of VGR2870 gene, herein designated VGR GENE, is inhibition of expression of host target genes, as part of a novel viral mechanism of attacking a host. Accordingly, utilities of VGR2870 gene include diagnosis, prevention and treatment of viral infection by Human Coronavirus 229E. Specific functions, and accordingly utilities, of VGR2870 gene correlate with, and may be deduced from, the identity of the host target genes, which are inhibited by VGAM RNAs comprised in the 'operon-like' cluster of VGR2870 gene: VGAM673 host target protein, VGAM674 host target protein, VGAM675 host target protein, VGAM676 host target protein, VGAM677 host target protein, VGAM678 host target protein, VGAM679 host target protein and VGAM680 host target protein, herein schematically represented by VGAM1 HOST TARGET PROTEIN through VGAM3 HOST TARGET PROTEIN. The function of these host target genes is elaborated hereinabove with reference to VGAM673, VGAM674, VGAM675, VGAM676, VGAM677, VGAM678, VGAM679 and VGAM680. FIG. 9 further provides a conceptual description of novel bioinformatically detected regulatory viral gene, referred to here as Viral Genomic Record 2871(VGR2871) viral gene, which encodes an 'operon-like' cluster of novel viral micro RNA-like genes, each of which in turn modulates expression of at least one host target gene, the function and utility of which at least one host target gene is known in the art.

VGR2871 gene, herein designated VGR GENE, is a novel bioinformatically detected regulatory, non protein coding, RNA viral gene. The method by which VGR2871 gene was detected is described hereinabove with reference to FIGS. 1-9.

VGR2871 gene encodes VGR2871 precursor RNA, herein designated VGR PRECURSOR RNA, an RNA molecule, typically several hundred nucleotides long.

VGR2871 precursor RNA folds spatially, forming VGR2871 folded precursor RNA, herein designated VGR FOLDED PRECURSOR RNA. It is appreciated that VGR2871 folded precursor RNA comprises a plurality of what is known in the art as 'hairpin' structures. These 'hairpin' structures are due to the fact that the nucleotide sequence of VGR2871 precursor RNA comprises a plurality of segments, the first half of each such segment having a nucleotide sequence which is at least a partial inversed-reversed sequence of the second half thereof, as is well known in the art.

VGR2871 folded precursor RNA is naturally processed by cellular enzymatic activity into at least 8 separate VGAM precursor RNAs, VGAM681 precursor RNA, VGAM682 precursor RNA, VGAM683 precursor RNA, VGAM684 precursor RNA, VGAM685 precursor RNA, VGAM686 precursor RNA, VGAM687 precursor RNA and VGAM688 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM681 RNA, VGAM682 RNA, VGAM683 RNA, VGAM684 RNA, VGAM685 RNA, VGAM686 RNA, VGAM687 RNA and VGAM688 RNA, herein schematically represented by VGAM1 RNA through VGAM3 RNA, each of which VGAM RNAs corresponding to VGAM RNA of FIG. 1.

VGAM681 RNA, herein schematically represented by VGAM1 RNA through VGAM3 RNA, binds complementarily to a host target binding site located in an untranslated region of VGAM681 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM681 host target RNA into VGAM681 host target protein, herein schematically represented by VGAM1 HOST TARGET PROTEIN through VGAM3 HOST TARGET PROTEIN, all of FIG. 1.

VGAM682 RNA, herein schematically represented by VGAM1 RNA through VGAM3 RNA, binds complementarily to a host target binding site located in an untranslated region of VGAM682 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM682 host target RNA into VGAM682 host target protein, herein schematically represented by VGAM1 HOST TARGET PROTEIN through VGAM3 HOST TARGET PROTEIN, all of FIG. 1.

VGAM683 RNA, herein schematically represented by VGAM1 RNA through VGAM3 RNA, binds complementarily to a host target binding site located in an untranslated region of VGAM683 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM683 host target RNA into VGAM683 host target protein, herein schematically represented by VGAM1 HOST TARGET PROTEIN through VGAM3 HOST TARGET PROTEIN, all of FIG. 1.

VGAM684 RNA, herein schematically represented by VGAM1 RNA through VGAM3 RNA, binds complementarily to a host target binding site located in an untranslated region of VGAM684 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM684 host target RNA into VGAM684 host target protein, herein schematically represented by VGAM1 HOST TARGET PROTEIN through VGAM3 HOST TARGET PROTEIN, all of FIG. 1.

VGAM685 RNA, herein schematically represented by VGAM1 RNA through VGAM3 RNA, binds complementarily to a host target binding site located in an untranslated region of VGAM685 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM685 host target RNA into VGAM685 host target protein, herein schematically represented by VGAM1 HOST TARGET PROTEIN through VGAM3 HOST TARGET PROTEIN, all of FIG. 1.

VGAM686 RNA, herein schematically represented by VGAM1 RNA through VGAM3 RNA, binds complementarily to a host target binding site located in an untranslated region of VGAM686 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM686 host target RNA into VGAM686 host target protein, herein schematically represented by VGAM1 HOST TARGET PROTEIN through VGAM3 HOST TARGET PROTEIN, all of FIG. 1.

VGAM687 RNA, herein schematically represented by VGAM1 RNA through VGAM3 RNA, binds complementarily to a host target binding site located in an untranslated region of VGAM687 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM687 host target RNA into VGAM687 host target protein, herein schematically represented by VGAM1 HOST TARGET PROTEIN through VGAM3 HOST TARGET PROTEIN, all of FIG. 1.

VGAM688 RNA, herein schematically represented by VGAM1 RNA through VGAM3 RNA, binds complementarily to a host target binding site located in an untranslated region of VGAM688 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM688 host target RNA into VGAM688 host target protein, herein schematically represented by VGAM1 HOST TARGET PROTEIN through VGAM3 HOST TARGET PROTEIN, all of FIG. 1.

It is appreciated that a function of VGR2871 gene, herein designated VGR GENE, is inhibition of expression of host target genes, as part of a novel viral mechanism of attacking a host. Accordingly, utilities of VGR2871 gene include diagnosis, prevention and treatment of viral infection by Human Coronavirus 229E. Specific functions, and accordingly utilities, of VGR2871 gene correlate with, and may be deduced from, the identity of the host target genes, which are inhibited by VGAM RNAs comprised in the 'operon-like' cluster of VGR2871 gene: VGAM681 host target protein, VGAM682 host target protein, VGAM683 host target protein, VGAM684 host target protein, VGAM685 host target protein, VGAM686 host target protein, VGAM687 host target protein and VGAM688 host target protein, herein schematically represented by VGAM1 HOST TARGET PROTEIN through VGAM3 HOST TARGET PROTEIN. The function of these host target genes is elaborated hereinabove with reference to VGAM681, VGAM682, VGAM683, VGAM684, VGAM685, VGAM686, VGAM687 and VGAM688. FIG. 9 further provides a conceptual description of novel bioinformatically detected regulatory viral gene, referred to here as Viral Genomic Record 2872(VGR2872) viral gene, which encodes an 'operon-like' cluster of novel viral micro RNA-like genes, each of which in turn modulates expression of at least one host target gene, the function and utility of which at least one host target gene is known in the art.

VGR2872 gene, herein designated VGR GENE, is a novel bioinformatically detected regulatory, non protein coding, RNA viral gene. The method by which VGR2872 gene was detected is described hereinabove with reference to FIGS. 1-9.

VGR2872 gene encodes VGR2872 precursor RNA, herein designated VGR PRECURSOR RNA, an RNA molecule, typically several hundred nucleotides long.

VGR2872 precursor RNA folds spatially, forming VGR2872 folded precursor RNA, herein designated VGR FOLDED PRECURSOR RNA. It is appreciated that VGR2872 folded precursor RNA comprises a plurality of what is known in the art as 'hairpin' structures. These 'hairpin' structures are due to the fact that the nucleotide sequence of VGR2872 precursor RNA comprises a plurality of segments, the first half of each such segment having a nucleotide sequence which is at least a partial inversed-reversed sequence of the second half thereof, as is well known in the art.

VGR2872 folded precursor RNA is naturally processed by cellular enzymatic activity into at least 8 separate VGAM precursor RNAs, VGAM689 precursor RNA, VGAM690 precursor RNA, VGAM691 precursor RNA, VGAM692 precursor RNA, VGAM693 precursor RNA, VGAM694 precursor RNA, VGAM695 precursor RNA and VGAM696 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM689 RNA, VGAM690 RNA, VGAM691 RNA, VGAM692 RNA, VGAM693 RNA, VGAM694 RNA, VGAM695 RNA and VGAM696 RNA, herein schematically represented by VGAM1 RNA through VGAM3 RNA, each of which VGAM RNAs corresponding to VGAM RNA of FIG. 1.

VGAM689 RNA, herein schematically represented by VGAM1 RNA through VGAM3 RNA, binds complementarily to a host target binding site located in an untranslated region of VGAM689 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM689 host target RNA into VGAM689 host target protein, herein schematically represented by VGAM1 HOST TARGET PROTEIN through VGAM3 HOST TARGET PROTEIN, all of FIG. 1.

VGAM690 RNA, herein schematically represented by VGAM1 RNA through VGAM3 RNA, binds complementarily to a host target binding site located in an untranslated region of VGAM690 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM690 host target RNA into VGAM690 host target protein, herein schematically represented by VGAM1 HOST TARGET PROTEIN through VGAM3 HOST TARGET PROTEIN, all of FIG. 1.

VGAM691 RNA, herein schematically represented by VGAM1 RNA through VGAM3 RNA, binds complementarily to a host target binding site located in an untranslated region of VGAM691 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM691 host target RNA into VGAM691 host target protein, herein schematically represented by VGAM1 HOST TARGET PROTEIN through VGAM3 HOST TARGET PROTEIN, all of FIG. 1.

VGAM692 RNA, herein schematically represented by VGAM1 RNA through VGAM3 RNA, binds complementarily to a host target binding site located in an untranslated region of VGAM692 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM692 host target RNA into VGAM692 host target protein, herein schematically represented by VGAM1 HOST TARGET PROTEIN through VGAM3 HOST TARGET PROTEIN, all of FIG. 1.

VGAM693 RNA, herein schematically represented by VGAM1 RNA through VGAM3 RNA, binds complementarily to a host target binding site located in an untranslated region of VGAM693 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM693 host target RNA into VGAM693 host target protein, herein schematically represented by VGAM1 HOST TARGET PROTEIN through VGAM3 HOST TARGET PROTEIN, all of FIG. 1.

VGAM694 RNA, herein schematically represented by VGAM1 RNA through VGAM3 RNA, binds complementarily to a host target binding site located in an untranslated region of VGAM694 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM694 host target RNA into VGAM694 host target protein, herein schematically represented by VGAM1 HOST TARGET PROTEIN through VGAM3 HOST TARGET PROTEIN, all of FIG. 1.

VGAM695 RNA, herein schematically represented by VGAM1 RNA through VGAM3 RNA, binds complementarily to a host target binding site located in an untranslated region of VGAM695 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM695 host target RNA into VGAM695 host target protein, herein schematically represented by VGAM1 HOST TARGET PROTEIN through VGAM3 HOST TARGET PROTEIN, all of FIG. 1.

VGAM696 RNA, herein schematically represented by VGAM1 RNA through VGAM3 RNA, binds complementarily to a host target binding site located in an untranslated region of VGAM696 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM696 host target RNA into VGAM696 host target protein, herein schematically represented by VGAM1 HOST TARGET PROTEIN through VGAM3 HOST TARGET PROTEIN, all of FIG. 1.

It is appreciated that a function of VGR2872 gene, herein designated VGR GENE, is inhibition of expression of host target genes, as part of a novel viral mechanism of attacking a host. Accordingly, utilities of VGR2872 gene include diagnosis, prevention and treatment of viral infection by Human Coronavirus 229E. Specific functions, and accordingly utilities, of VGR2872 gene correlate with, and may be deduced from, the identity of the host target genes, which are inhibited by VGAM RNAs comprised in the 'operon-like' cluster of VGR2872 gene: VGAM689 host target protein, VGAM690 host target protein, VGAM691 host target protein, VGAM692 host target protein, VGAM693 host target protein, VGAM694 host target protein, VGAM695 host target protein and VGAM696 host target protein, herein schematically represented by VGAM1 HOST TARGET PROTEIN through VGAM3 HOST TARGET PROTEIN. The function of these host target genes is elaborated hereinabove with reference to VGAM689, VGAM690, VGAM691, VGAM692, VGAM693, VGAM694, VGAM695 and VGAM696. FIG. 9 further provides a conceptual description of novel bioinformatically detected regulatory viral gene, referred to here as Viral Genomic Record 2873(VGR2873) viral gene, which encodes an 'operon-like' cluster of novel viral micro RNA-like genes, each of which in turn modulates expression of at least one host target gene, the function and utility of which at least one host target gene is known in the art.

VGR2873 gene, herein designated VGR GENE, is a novel bioinformatically detected regulatory, non protein coding, RNA viral gene. The method by which VGR2873 gene was detected is described hereinabove with reference to FIGS. 1-9.

VGR2873 gene encodes VGR2873 precursor RNA, herein designated VGR PRECURSOR RNA, an RNA molecule, typically several hundred nucleotides long.

VGR2873 precursor RNA folds spatially, forming VGR2873 folded precursor RNA, herein designated VGR FOLDED PRECURSOR RNA. It is appreciated that VGR2873 folded precursor RNA comprises a plurality of what is known in the art as 'hairpin' structures. These 'hairpin' structures are due to the fact that the nucleotide sequence of VGR2873 precursor RNA comprises a plurality of segments, the first half of each such segment having a nucleotide sequence which is at least a partial inversed-reversed sequence of the second half thereof, as is well known in the art.

VGR2873 folded precursor RNA is naturally processed by cellular enzymatic activity into at least 4 separate VGAM precursor RNAs, VGAM697 precursor RNA, VGAM698 precursor RNA, VGAM699 precursor RNA and VGAM700 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM697 RNA, VGAM698 RNA, VGAM699 RNA and VGAM700 RNA, herein schematically represented by VGAM1 RNA through VGAM3 RNA, each of which VGAM RNAs corresponding to VGAM RNA of FIG. 1.

VGAM697 RNA, herein schematically represented by VGAM1 RNA through VGAM3 RNA, binds complementarily to a host target binding site located in an untranslated region of VGAM697 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM697 host target RNA into VGAM697 host target protein, herein schematically represented by VGAM1 HOST TARGET PROTEIN through VGAM3 HOST TARGET PROTEIN, all of FIG. 1.

VGAM698 RNA, herein schematically represented by VGAM1 RNA through VGAM3 RNA, binds complementarily to a host target binding site located in an untranslated region of VGAM698 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM698 host target RNA into VGAM698 host target protein, herein schematically represented by VGAM1 HOST TARGET PROTEIN through VGAM3 HOST TARGET PROTEIN, all of FIG. 1.

VGAM699 RNA, herein schematically represented by VGAM1 RNA through VGAM3 RNA, binds complementarily to a host target binding site located in an untranslated region of VGAM699 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM699 host target RNA into VGAM699 host target protein, herein schematically represented by VGAM1 HOST TARGET PROTEIN through VGAM3 HOST TARGET PROTEIN, all of FIG. 1.

VGAM700 RNA, herein schematically represented by VGAM1 RNA through VGAM3 RNA, binds complementarily to a host target binding site located in an untranslated region of VGAM700 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM700 host target RNA into VGAM700 host target protein, herein schematically represented by VGAM1 HOST TARGET PROTEIN through VGAM3 HOST TARGET PROTEIN, all of FIG. 1.

It is appreciated that a function of VGR2873 gene, herein designated VGR GENE, is inhibition of expression of host target genes, as part of a novel viral mechanism of attacking a host. Accordingly, utilities of VGR2873 gene include diagnosis, prevention and treatment of viral infection by Human Coronavirus 229E. Specific functions, and accordingly utilities, of VGR2873 gene correlate with, and may be deduced from, the identity of the host target genes, which are inhibited by VGAM RNAs comprised in the 'operon-like' cluster of VGR2873 gene: VGAM697 host target protein, VGAM698 host target protein, VGAM699 host target protein and VGAM700 host target protein, herein schematically represented by VGAM1 HOST TARGET PROTEIN through VGAM3 HOST TARGET PROTEIN. The function of these host target genes is elaborated hereinabove with reference to VGAM697, VGAM698, VGAM699 and VGAM700. FIG. 9 further provides a conceptual description of novel bioinformatically detected regulatory viral gene, referred to here as Viral Genomic Record 2874(VGR2874) viral gene, which encodes an 'operon-like' cluster of novel viral micro RNA-like genes, each of which in turn modulates expression of at least one host target gene, the function and utility of which at least one host target gene is known in the art.

VGR2874 gene, herein designated VGR GENE, is a novel bioinformatically detected regulatory, non protein coding, RNA viral gene. The method by which VGR2874 gene was detected is described hereinabove with reference to FIGS. 1-9.

VGR2874 gene encodes VGR2874 precursor RNA, herein designated VGR PRECURSOR RNA, an RNA molecule, typically several hundred nucleotides long.

VGR2874 precursor RNA folds spatially, forming VGR2874 folded precursor RNA, herein designated VGR FOLDED PRECURSOR RNA. It is appreciated that VGR2874 folded precursor RNA comprises a plurality of what is known in the art as 'hairpin' structures. These 'hairpin' structures are due to the fact that the nucleotide sequence of VGR2874 precursor RNA comprises a plurality of segments, the first half of each such segment having a nucleotide sequence which is at least a partial inversed-reversed sequence of the second half thereof, as is well known in the art.

VGR2874 folded precursor RNA is naturally processed by cellular enzymatic activity into at least 6 separate VGAM precursor RNAs, VGAM701 precursor RNA, VGAM702 precursor RNA, VGAM703 precursor RNA, VGAM704 precursor RNA, VGAM705 precursor RNA and VGAM706 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM701 RNA, VGAM702 RNA, VGAM703 RNA, VGAM704 RNA, VGAM705 RNA and VGAM706 RNA, herein schematically represented by VGAM1 RNA through VGAM3 RNA, each of which VGAM RNAs corresponding to VGAM RNA of FIG. 1.

VGAM701 RNA, herein schematically represented by VGAM1 RNA through VGAM3 RNA, binds complementarily to a host target binding site located in an untranslated region of VGAM701 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM701 host target RNA into VGAM701 host target protein, herein schematically represented by VGAM1 HOST TARGET PROTEIN through VGAM3 HOST TARGET PROTEIN, all of FIG. 1.

VGAM702 RNA, herein schematically represented by VGAM1 RNA through VGAM3 RNA, binds complementarily to a host target binding site located in an untranslated region of VGAM702 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM702 host target RNA into VGAM702 host target protein, herein schematically represented by VGAM1 HOST TARGET PROTEIN through VGAM3 HOST TARGET PROTEIN, all of FIG. 1.

VGAM703 RNA, herein schematically represented by VGAM1 RNA through VGAM3 RNA, binds complementarily to a host target binding site located in an untranslated region of VGAM703 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM703 host target RNA into VGAM703 host target protein, herein schematically represented by VGAM1 HOST TARGET PROTEIN through VGAM3 HOST TARGET PROTEIN, all of FIG. 1.

VGAM704 RNA, herein schematically represented by VGAM1 RNA through VGAM3 RNA, binds complementarily to a host target binding site located in an untranslated region of VGAM704 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM704 host target RNA into VGAM704 host target protein, herein schematically represented by VGAM1 HOST TARGET PROTEIN through VGAM3 HOST TARGET PROTEIN, all of FIG. 1.

VGAM705 RNA, herein schematically represented by VGAM1 RNA through VGAM3 RNA, binds complementarily to a host target binding site located in an untranslated region of VGAM705 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM705 host target RNA into VGAM705 host target protein, herein schematically represented by VGAM1 HOST TARGET PROTEIN through VGAM3 HOST TARGET PROTEIN, all of FIG. 1.

VGAM706 RNA, herein schematically represented by VGAM1 RNA through VGAM3 RNA, binds complementarily to a host target binding site located in an untranslated region of VGAM706 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM706 host target RNA into VGAM706 host target protein, herein schematically represented by VGAM1 HOST TARGET PROTEIN through VGAM3 HOST TARGET PROTEIN, all of FIG. 1.

It is appreciated that a function of VGR2874 gene, herein designated VGR GENE, is inhibition of expression of host target genes, as part of a novel viral mechanism of attacking a host. Accordingly, utilities of VGR2874 gene include diagnosis, prevention and treatment of viral infection by Human Coronavirus 229E. Specific functions, and accordingly utilities, of VGR2874 gene correlate with, and may be deduced from, the identity of the host target genes, which are inhibited by VGAM RNAs comprised in the 'operon-like' cluster of VGR2874 gene: VGAM701 host target protein, VGAM702 host target protein, VGAM703 host target protein, VGAM704 host target protein, VGAM705 host target protein and VGAM706 host target protein, herein schematically represented by VGAM1 HOST TARGET PROTEIN through VGAM3 HOST TARGET PROTEIN. The function of these host target genes is elaborated hereinabove with reference to VGAM701, VGAM702, VGAM703, VGAM704, VGAM705 and VGAM706. FIG. 9 further provides a conceptual description of novel bioinformatically detected regulatory viral gene, referred to here as Viral Genomic Record 2875(VGR2875) viral gene, which encodes an 'operon-like' cluster of novel viral micro RNA-like genes, each of which in turn modulates expression of at least one host target gene, the function and utility of which at least one host target gene is known in the art.

VGR2875 gene, herein designated VGR GENE, is a novel bioinformatically detected regulatory, non protein coding, RNA viral gene. The method by which VGR2875 gene was detected is described hereinabove with reference to FIGS. 1-9.

VGR2875 gene encodes VGR2875 precursor RNA, herein designated VGR PRECURSOR RNA, an RNA molecule, typically several hundred nucleotides long.

VGR2875 precursor RNA folds spatially, forming VGR2875 folded precursor RNA, herein designated VGR FOLDED PRECURSOR RNA. It is appreciated that VGR2875 folded precursor RNA comprises a plurality of what is known in the art as 'hairpin' structures. These 'hairpin' structures are due to the fact that the nucleotide sequence of VGR2875 precursor RNA comprises a plurality of segments, the first half of each such segment having a nucleotide sequence which is at least a partial inversed-reversed sequence of the second half thereof, as is well known in the art.

VGR2875 folded precursor RNA is naturally processed by cellular enzymatic activity into at least 3 separate VGAM precursor RNAs, VGAM710 precursor RNA, VGAM711 precursor RNA and VGAM712 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM710 RNA, VGAM711 RNA and VGAM712 RNA, herein schematically represented by VGAM1 RNA through VGAM3 RNA, each of which VGAM RNAs corresponding to VGAM RNA of FIG. 1.

VGAM710 RNA, herein schematically represented by VGAM1 RNA through VGAM3 RNA, binds complementarily to a host target binding site located in an untranslated region of VGAM710 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM710 host target RNA into VGAM710 host target protein, herein schematically represented by VGAM1 HOST TARGET PROTEIN through VGAM3 HOST TARGET PROTEIN, all of FIG. 1.

VGAM711 RNA, herein schematically represented by VGAM1 RNA through VGAM3 RNA, binds complementarily to a host target binding site located in an untranslated region of VGAM711 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM711 host target RNA into VGAM711 host target protein, herein schematically represented by VGAM1 HOST TARGET PROTEIN through VGAM3 HOST TARGET PROTEIN, all of FIG. 1.

VGAM712 RNA, herein schematically represented by VGAM1 RNA through VGAM3 RNA, binds complementarily to a host target binding site located in an untranslated region of VGAM712 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM712 host target RNA into VGAM712 host target protein, herein schematically represented by VGAM1 HOST TARGET PROTEIN through VGAM3 HOST TARGET PROTEIN, all of FIG. 1.

It is appreciated that a function of VGR2875 gene, herein designated VGR GENE, is inhibition of expression of host target genes, as part of a novel viral mechanism of attacking a host. Accordingly, utilities of VGR2875 gene include diagnosis, prevention and treatment of viral infection by Pestivirus Type 2. Specific functions, and accordingly utilities, of VGR2875 gene correlate with, and may be deduced from, the identity of the host target genes, which are inhibited by VGAM RNAs comprised in the 'operon-like' cluster of VGR2875 gene: VGAM710 host target protein, VGAM711 host target protein and VGAM712 host target protein, herein schematically represented by VGAM1 HOST TARGET PROTEIN through VGAM3 HOST TARGET PROTEIN. The function of these host target genes is elaborated hereinabove with reference to VGAM710, VGAM711 and VGAM712. FIG. 9 further provides a conceptual description of novel bioinformatically detected regulatory viral gene, referred to here as Viral Genomic Record 2876(VGR2876) viral gene, which encodes an 'operon-like' cluster of novel viral micro RNA-like genes, each of which in turn modulates expression of at least one host target gene, the function and utility of which at least one host target gene is known in the art.

VGR2876 gene, herein designated VGR GENE, is a novel bioinformatically detected regulatory, non protein coding, RNA viral gene. The method by which VGR2876 gene was detected is described hereinabove with reference to FIGS. 1-9.

VGR2876 gene encodes VGR2876 precursor RNA, herein designated VGR PRECURSOR RNA, an RNA molecule, typically several hundred nucleotides long.

VGR2876 precursor RNA folds spatially, forming VGR2876 folded precursor RNA, herein designated VGR FOLDED PRECURSOR RNA. It is appreciated that VGR2876 folded precursor RNA comprises a plurality of what is known in the art as 'hairpin' structures. These 'hairpin' structures are due to the fact that the nucleotide sequence of VGR2876 precursor RNA comprises a plurality of segments, the first half of each such segment having a nucleotide sequence which is at least a partial inversed-reversed sequence of the second half thereof, as is well known in the art.

VGR2876 folded precursor RNA is naturally processed by cellular enzymatic activity into at least 2 separate VGAM precursor RNAs, VGAM713 precursor RNA and VGAM714 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM713 RNA and VGAM714 RNA, herein schematically represented by VGAM1 RNA through VGAM3 RNA, each of which VGAM RNAs corresponding to VGAM RNA of FIG. 1.

VGAM713 RNA, herein schematically represented by VGAM1 RNA through VGAM3 RNA, binds complementarily to a host target binding site located in an untranslated region of VGAM713 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM713 host target RNA into VGAM713 host target protein, herein schematically represented by VGAM1 HOST TARGET PROTEIN through VGAM3 HOST TARGET PROTEIN, all of FIG. 1.

VGAM714 RNA, herein schematically represented by VGAM1 RNA through VGAM3 RNA, binds complementarily to a host target binding site located in an untranslated region of VGAM714 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM714 host target RNA into VGAM714 host target protein, herein schematically represented by VGAM1 HOST TARGET PROTEIN through VGAM3 HOST TARGET PROTEIN, all of FIG. 1.

It is appreciated that a function of VGR2876 gene, herein designated VGR GENE, is inhibition of expression of host target genes, as part of a novel viral mechanism of attacking a host. Accordingly, utilities of VGR2876 gene include diagnosis, prevention and treatment of viral infection by Bovine Herpesvirus 4. Specific functions, and accordingly utilities, of VGR2876 gene correlate with, and may be deduced from, the identity of the host target genes, which are inhibited by VGAM RNAs comprised in the 'operon-like' cluster of VGR2876 gene: VGAM713 host target protein and VGAM714 host target protein, herein schematically represented by VGAM1 HOST TARGET PROTEIN through VGAM3 HOST TARGET PROTEIN. The function of these host target genes is elaborated hereinabove with reference to VGAM713 and VGAM714. FIG. 9 further provides a conceptual description of novel bioinformatically detected regulatory viral gene, referred to here as Viral Genomic Record 2877(VGR2877) viral gene, which encodes an 'operon-like' cluster of novel viral micro RNA-like genes, each of which in turn modulates expression of at least one host target gene, the function and utility of which at least one host target gene is known in the art.

VGR2877 gene, herein designated VGR GENE, is a novel bioinformatically detected regulatory, non protein coding, RNA viral gene. The method by which VGR2877 gene was detected is described hereinabove with reference to FIGS. 1-9.

VGR2877 gene encodes VGR2877 precursor RNA, herein designated VGR PRECURSOR RNA, an RNA molecule, typically several hundred nucleotides long.

VGR2877 precursor RNA folds spatially, forming VGR2877 folded precursor RNA, herein designated VGR FOLDED PRECURSOR RNA. It is appreciated that VGR2877 folded precursor RNA comprises a plurality of what is known in the art as 'hairpin' structures. These 'hairpin' structures are due to the fact that the nucleotide sequence of VGR2877 precursor RNA comprises a plurality of segments, the first half of each such segment having a nucleotide sequence which is at least a partial inversed-reversed sequence of the second half thereof, as is well known in the art.

VGR2877 folded precursor RNA is naturally processed by cellular enzymatic activity into at least 4 separate VGAM precursor RNAs, VGAM715 precursor RNA, VGAM716 precursor RNA, VGAM717 precursor RNA and VGAM718 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM715 RNA, VGAM716 RNA, VGAM717 RNA and VGAM718 RNA, herein schematically represented by VGAM1 RNA through VGAM3 RNA, each of which VGAM RNAs corresponding to VGAM RNA of FIG. 1.

VGAM715 RNA, herein schematically represented by VGAM1 RNA through VGAM3 RNA, binds complementarily to a host target binding site located in an untranslated region of VGAM715 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM715 host target RNA into VGAM715 host target protein, herein schematically represented by VGAM1 HOST TARGET PROTEIN through VGAM3 HOST TARGET PROTEIN, all of FIG. 1.

VGAM716 RNA, herein schematically represented by VGAM1 RNA through VGAM3 RNA, binds complementarily to a host target binding site located in an untranslated region of VGAM716 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM716 host target RNA into VGAM716 host target protein, herein schematically represented by VGAM1 HOST TARGET PROTEIN through VGAM3 HOST TARGET PROTEIN, all of FIG. 1.

VGAM717 RNA, herein schematically represented by VGAM1 RNA through VGAM3 RNA, binds complementarily to a host target binding site located in an untranslated region of VGAM717 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM717 host target RNA into VGAM717 host target protein, herein schematically represented by VGAM1 HOST TARGET PROTEIN through VGAM3 HOST TARGET PROTEIN, all of FIG. 1.

VGAM718 RNA, herein schematically represented by VGAM1 RNA through VGAM3 RNA, binds complementarily to a host target binding site located in an untranslated region of VGAM718 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM718 host target RNA into VGAM718 host target protein, herein schematically represented by VGAM1 HOST TARGET PROTEIN through VGAM3 HOST TARGET PROTEIN, all of FIG. 1.

It is appreciated that a function of VGR2877 gene, herein designated VGR GENE, is inhibition of expression of host target genes, as part of a novel viral mechanism of attacking a host. Accordingly, utilities of VGR2877 gene include diagnosis, prevention and treatment of viral infection by Cercopithecine Herpesvirus 7. Specific functions, and accordingly utilities, of VGR2877 gene correlate with, and may be deduced from, the identity of the host target genes, which are inhibited by VGAM RNAs comprised in the 'operon-like' cluster of VGR2877 gene: VGAM715 host target protein, VGAM716 host target protein, VGAM717 host target protein and VGAM718 host target protein, herein schematically represented by VGAM1 HOST TARGET PROTEIN through VGAM3 HOST TARGET PROTEIN. The function of these host target genes is elaborated hereinabove with reference to VGAM715, VGAM716, VGAM717 and VGAM718. FIG. 9 further provides a conceptual description of novel bioinformatically detected regulatory viral gene, referred to here as Viral Genomic Record 2878(VGR2878) viral gene, which encodes an 'operon-like' cluster of novel viral micro RNA-like genes, each of which in turn modulates expression of at least one host target gene, the function and utility of which at least one host target gene is known in the art.

VGR2878 gene, herein designated VGR GENE, is a novel bioinformatically detected regulatory, non protein coding, RNA viral gene. The method by which VGR2878 gene was detected is described hereinabove with reference to FIGS. 1-9.

VGR2878 gene encodes VGR2878 precursor RNA, herein designated VGR PRECURSOR RNA, an RNA molecule, typically several hundred nucleotides long.

VGR2878 precursor RNA folds spatially, forming VGR2878 folded precursor RNA, herein designated VGR FOLDED PRECURSOR RNA. It is appreciated that VGR2878 folded precursor RNA comprises a plurality of what is known in the art as 'hairpin' structures. These 'hairpin' structures are due to the fact that the nucleotide sequence of VGR2878 precursor RNA comprises a plurality of segments, the first half of each such segment having a nucleotide sequence which is at least a partial inversed-reversed sequence of the second half thereof, as is well known in the art.

VGR2878 folded precursor RNA is naturally processed by cellular enzymatic activity into at least 2 separate VGAM precursor RNAs, VGAM719 precursor RNA and VGAM720 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM719 RNA and VGAM720 RNA, herein schematically represented by VGAM1 RNA through VGAM3 RNA, each of which VGAM RNAs corresponding to VGAM RNA of FIG. 1.

VGAM719 RNA, herein schematically represented by VGAM1 RNA through VGAM3 RNA, binds complementarily to a host target binding site located in an untranslated region of VGAM719 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM719 host target RNA into VGAM719 host target protein, herein schematically represented by VGAM1 HOST TARGET PROTEIN through VGAM3 HOST TARGET PROTEIN, all of FIG. 1.

VGAM720 RNA, herein schematically represented by VGAM1 RNA through VGAM3 RNA, binds complementarily to a host target binding site located in an untranslated region of VGAM720 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM720 host target RNA into VGAM720 host target protein, herein schematically represented by VGAM1 HOST TARGET PROTEIN through VGAM3 HOST TARGET PROTEIN, all of FIG. 1.

It is appreciated that a function of VGR2878 gene, herein designated VGR GENE, is inhibition of expression of host target genes, as part of a novel viral mechanism of attacking a host. Accordingly, utilities of VGR2878 gene include diagnosis, prevention and treatment of viral infection by Ectocarpus Siliculosus Virus. Specific functions, and accordingly utilities, of VGR2878 gene correlate with, and may be deduced from, the identity of the host target genes, which are inhibited by VGAM RNAs comprised in the 'operon-like' cluster of VGR2878 gene: VGAM719 host target protein and VGAM720 host target protein, herein schematically represented by VGAM1 HOST TARGET PROTEIN through VGAM3 HOST TARGET PROTEIN. The function of these host target genes is elaborated hereinabove with reference to VGAM719 and VGAM720. FIG. 9 further provides a conceptual description of novel bioinformatically detected regulatory viral gene, referred to here as Viral Genomic Record 2879(VGR2879) viral gene, which encodes an 'operon-like' cluster of novel viral micro RNA-like genes, each of which in turn modulates expression of at least one host target gene, the function and utility of which at least one host target gene is known in the art.

VGR2879 gene, herein designated VGR GENE, is a novel bioinformatically detected regulatory, non protein coding, RNA viral gene. The method by which VGR2879 gene was detected is described hereinabove with reference to FIGS. 1-9.

VGR2879 gene encodes VGR2879 precursor RNA, herein designated VGR PRECURSOR RNA, an RNA molecule, typically several hundred nucleotides long.

VGR2879 precursor RNA folds spatially, forming VGR2879 folded precursor RNA, herein designated VGR FOLDED PRECURSOR RNA. It is appreciated that VGR2879 folded precursor RNA comprises a plurality of what is known in the art as 'hairpin' structures. These 'hairpin' structures are due to the fact that the nucleotide sequence of VGR2879 precursor RNA comprises a plurality of segments, the first half of each such segment having a nucleotide sequence which is at least a partial inversed-reversed sequence of the second half thereof, as is well known in the art.

VGR2879 folded precursor RNA is naturally processed by cellular enzymatic activity into at least 5 separate VGAM precursor RNAs, VGAM721 precursor RNA, VGAM722 precursor RNA, VGAM723 precursor RNA, VGAM724 precursor RNA and VGAM725 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM721 RNA, VGAM722 RNA, VGAM723 RNA, VGAM724 RNA and VGAM725 RNA, herein schematically represented by VGAM1 RNA through VGAM3 RNA, each of which VGAM RNAs corresponding to VGAM RNA of FIG. 1.

VGAM721 RNA, herein schematically represented by VGAM1 RNA through VGAM3 RNA, binds complementarily to a host target binding site located in an untranslated region of VGAM721 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM721 host target RNA into VGAM721 host target protein, herein schematically represented by VGAM1 HOST TARGET PROTEIN through VGAM3 HOST TARGET PROTEIN, all of FIG. 1.

VGAM722 RNA, herein schematically represented by VGAM1 RNA through VGAM3 RNA, binds complementarily to a host target binding site located in an untranslated region of VGAM722 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM722 host target RNA into VGAM722 host target protein, herein schematically represented by VGAM1 HOST TARGET PROTEIN through VGAM3 HOST TARGET PROTEIN, all of FIG. 1.

VGAM723 RNA, herein schematically represented by VGAM1 RNA through VGAM3 RNA, binds complementarily to a host target binding site located in an untranslated region of VGAM723 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM723 host target RNA into VGAM723 host target protein, herein schematically represented by VGAM1 HOST TARGET PROTEIN through VGAM3 HOST TARGET PROTEIN, all of FIG. 1.

VGAM724 RNA, herein schematically represented by VGAM1 RNA through VGAM3 RNA, binds complementarily to a host target binding site located in an untranslated region of VGAM724 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM724 host target RNA into VGAM724 host target protein, herein schematically represented by VGAM1 HOST TARGET PROTEIN through VGAM3 HOST TARGET PROTEIN, all of FIG. 1.

VGAM725 RNA, herein schematically represented by VGAM1 RNA through VGAM3 RNA, binds complementarily to a host target binding site located in an untranslated region of VGAM725 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM725 host target RNA into VGAM725 host target protein, herein schematically represented by VGAM1 HOST TARGET PROTEIN through VGAM3 HOST TARGET PROTEIN, all of FIG. 1.

It is appreciated that a function of VGR2879 gene, herein designated VGR GENE, is inhibition of expression of host target genes, as part of a novel viral mechanism of attacking a host. Accordingly, utilities of VGR2879 gene include diagnosis, prevention and treatment of viral infection by Tomato Mosaic Virus. Specific functions, and accordingly utilities, of VGR2879 gene correlate with, and may be deduced from, the identity of the host target genes, which are inhibited by VGAM RNAs comprised in the 'operon-like' cluster of VGR2879 gene: VGAM721 host target protein, VGAM722 host target protein, VGAM723 host target protein, VGAM724 host target protein and VGAM725 host target protein, herein schematically represented by VGAM1 HOST TARGET PROTEIN through VGAM3 HOST TARGET PROTEIN. The function of these host target genes is elaborated hereinabove with reference to VGAM721, VGAM722, VGAM723, VGAM724 and VGAM725. FIG. 9 further provides a conceptual description of novel bioinformatically detected regulatory viral gene, referred to here as Viral Genomic Record 2880(VGR2880) viral gene, which encodes an 'operon-like' cluster of novel viral micro RNA-like genes, each of which in turn modulates expression of at least one host target gene, the function and utility of which at least one host target gene is known in the art.

VGR2880 gene, herein designated VGR GENE, is a novel bioinformatically detected regulatory, non protein coding, RNA viral gene. The method by which VGR2880 gene was detected is described hereinabove with reference to FIGS. 1-9.

VGR2880 gene encodes VGR2880 precursor RNA, herein designated VGR PRECURSOR RNA, an RNA molecule, typically several hundred nucleotides long.

VGR2880 precursor RNA folds spatially, forming VGR2880 folded precursor RNA, herein designated VGR FOLDED PRECURSOR RNA. It is appreciated that VGR2880 folded precursor RNA comprises a plurality of what is known in the art as 'hairpin' structures. These 'hairpin' structures are due to the fact that the nucleotide sequence of VGR2880 precursor RNA comprises a plurality of segments, the first half of each such segment having a nucleotide sequence which is at least a partial inversed-reversed sequence of the second half thereof, as is well known in the art.

VGR2880 folded precursor RNA is naturally processed by cellular enzymatic activity into at least 2 separate VGAM precursor RNAs, VGAM727 precursor RNA and VGAM728 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM727 RNA and VGAM728 RNA, herein schematically represented by VGAM1 RNA through VGAM3 RNA, each of which VGAM RNAs corresponding to VGAM RNA of FIG. 1.

VGAM727 RNA, herein schematically represented by VGAM1 RNA through VGAM3 RNA, binds complementarily to a host target binding site located in an untranslated region of VGAM727 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM727 host target RNA into VGAM727 host target protein, herein schematically represented by VGAM1 HOST TARGET PROTEIN through VGAM3 HOST TARGET PROTEIN, all of FIG. 1.

VGAM728 RNA, herein schematically represented by VGAM1 RNA through VGAM3 RNA, binds complementarily to a host target binding site located in an untranslated region of VGAM728 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM728 host target RNA into VGAM728 host target protein, herein schematically represented by VGAM1 HOST TARGET PROTEIN through VGAM3 HOST TARGET PROTEIN, all of FIG. 1.

It is appreciated that a function of VGR2880 gene, herein designated VGR GENE, is inhibition of expression of host target genes, as part of a novel viral mechanism of attacking a host. Accordingly, utilities of VGR2880 gene include diagnosis, prevention and treatment of viral infection by Aconitum Latent Virus. Specific functions, and accordingly utilities, of VGR2880 gene correlate with, and may be deduced from, the identity of the host target genes, which are inhibited by VGAM RNAs comprised in the 'operon-like' cluster of VGR2880 gene: VGAM727 host target protein and VGAM728 host target protein, herein schematically represented by VGAM1 HOST TARGET PROTEIN through VGAM3 HOST TARGET PROTEIN. The function of these host target genes is elaborated hereinabove with reference to VGAM727 and VGAM728. FIG. 9 further provides a conceptual description of novel bioinformatically detected regulatory viral gene, referred to here as Viral Genomic Record 2881(VGR2881) viral gene, which encodes an 'operon-like' cluster of novel viral micro RNA-like genes, each of which in turn modulates expression of at least one host target gene, the function and utility of which at least one host target gene is known in the art.

VGR2881 gene, herein designated VGR GENE, is a novel bioinformatically detected regulatory, non protein coding, RNA viral gene. The method by which VGR2881 gene was detected is described hereinabove with reference to FIGS. 1-9.

VGR2881 gene encodes VGR2881 precursor RNA, herein designated VGR PRECURSOR RNA, an RNA molecule, typically several hundred nucleotides long.

VGR2881 precursor RNA folds spatially, forming VGR2881 folded precursor RNA, herein designated VGR FOLDED PRECURSOR RNA. It is appreciated that VGR2881 folded precursor RNA comprises a plurality of what is known in the art as 'hairpin' structures. These 'hairpin' structures are due to the fact that the nucleotide sequence of VGR2881 precursor RNA comprises a plurality of segments, the first half of each such segment having a nucleotide sequence which is at least a partial inversed-reversed sequence of the second half thereof, as is well known in the art.

VGR2881 folded precursor RNA is naturally processed by cellular enzymatic activity into at least 4 separate VGAM precursor RNAs, VGAM729 precursor RNA, VGAM730 precursor RNA, VGAM731 precursor RNA and VGAM732 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM729 RNA, VGAM730 RNA, VGAM731 RNA and VGAM732 RNA, herein schematically represented by VGAM1 RNA through VGAM3 RNA, each of which VGAM RNAs corresponding to VGAM RNA of FIG. 1.

VGAM729 RNA, herein schematically represented by VGAM1 RNA through VGAM3 RNA, binds complementarily to a host target binding site located in an untranslated region of VGAM729 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM729 host target RNA into VGAM729 host target protein, herein schematically represented by VGAM1 HOST TARGET PROTEIN through VGAM3 HOST TARGET PROTEIN, all of FIG. 1.

VGAM730 RNA, herein schematically represented by VGAM1 RNA through VGAM3 RNA, binds complementarily to a host target binding site located in an untranslated region of VGAM730 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM730 host target RNA into VGAM730 host target protein, herein schematically represented by VGAM1 HOST TARGET PROTEIN through VGAM3 HOST TARGET PROTEIN, all of FIG. 1.

VGAM731 RNA, herein schematically represented by VGAM1 RNA through VGAM3 RNA, binds complementarily to a host target binding site located in an untranslated region of VGAM731 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM731 host target RNA into VGAM731 host target protein, herein schematically represented by VGAM1 HOST TARGET PROTEIN through VGAM3 HOST TARGET PROTEIN, all of FIG. 1.

VGAM732 RNA, herein schematically represented by VGAM1 RNA through VGAM3 RNA, binds complementarily to a host target binding site located in an untranslated region of VGAM732 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM732 host target RNA into VGAM732 host target protein, herein schematically represented by VGAM1 HOST TARGET PROTEIN through VGAM3 HOST TARGET PROTEIN, all of FIG. 1.

It is appreciated that a function of VGR2881 gene, herein designated VGR GENE, is inhibition of expression of host target genes, as part of a novel viral mechanism of attacking a host. Accordingly, utilities of VGR2881 gene include diagnosis, prevention and treatment of viral infection by Cydia Pomonella Granulovirus. Specific functions, and accordingly utilities, of VGR2881 gene correlate with, and may be deduced from, the identity of the host target genes, which are inhibited by VGAM RNAs comprised in the 'operon-like' cluster of VGR2881 gene: VGAM729 host target protein, VGAM730 host target protein, VGAM731 host target protein and VGAM732 host target protein, herein schematically represented by VGAM1 HOST TARGET PROTEIN through VGAM3 HOST TARGET PROTEIN. The function of these host target genes is elaborated hereinabove with reference to VGAM729, VGAM730, VGAM731 and VGAM732. FIG. 9 further provides a conceptual description of novel bioinformatically detected regulatory viral gene, referred to here as Viral Genomic Record 2882(VGR2882) viral gene, which encodes an 'operon-like' cluster of novel viral micro RNA-like genes, each of which in turn modulates expression of at least one host target gene, the function and utility of which at least one host target gene is known in the art.

VGR2882 gene, herein designated VGR GENE, is a novel bioinformatically detected regulatory, non protein coding, RNA viral gene. The method by which VGR2882 gene was detected is described hereinabove with reference to FIGS. 1-9.

VGR2882 gene encodes VGR2882 precursor RNA, herein designated VGR PRECURSOR RNA, an RNA molecule, typically several hundred nucleotides long.

VGR2882 precursor RNA folds spatially, forming VGR2882 folded precursor RNA, herein designated VGR FOLDED PRECURSOR RNA. It is appreciated that VGR2882 folded precursor RNA comprises a plurality of what is known in the art as 'hairpin' structures. These 'hairpin' structures are due to the fact that the nucleotide sequence of VGR2882 precursor RNA comprises a plurality of segments, the first half of each such segment having a nucleotide sequence which is at least a partial inversed-reversed sequence of the second half thereof, as is well known in the art.

VGR2882 folded precursor RNA is naturally processed by cellular enzymatic activity into at least 6 separate VGAM precursor RNAs, VGAM733 precursor RNA, VGAM734 precursor RNA, VGAM735 precursor RNA, VGAM736 precursor RNA, VGAM737 precursor RNA and VGAM738 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM733

RNA, VGAM734 RNA, VGAM735 RNA, VGAM736 RNA, VGAM737 RNA and VGAM738 RNA, herein schematically represented by VGAM1 RNA through VGAM3 RNA, each of which VGAM RNAs corresponding to VGAM RNA of FIG. 1.

VGAM733 RNA, herein schematically represented by VGAM1 RNA through VGAM3 RNA, binds complementarily to a host target binding site located in an untranslated region of VGAM733 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM733 host target RNA into VGAM733 host target protein, herein schematically represented by VGAM1 HOST TARGET PROTEIN through VGAM3 HOST TARGET PROTEIN, all of FIG. 1.

VGAM734 RNA, herein schematically represented by VGAM1 RNA through VGAM3 RNA, binds complementarily to a host target binding site located in an untranslated region of VGAM734 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM734 host target RNA into VGAM734 host target protein, herein schematically represented by VGAM1 HOST TARGET PROTEIN through VGAM3 HOST TARGET PROTEIN, all of FIG. 1.

VGAM735 RNA, herein schematically represented by VGAM1 RNA through VGAM3 RNA, binds complementarily to a host target binding site located in an untranslated region of VGAM735 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM735 host target RNA into VGAM735 host target protein, herein schematically represented by VGAM1 HOST TARGET PROTEIN through VGAM3 HOST TARGET PROTEIN, all of FIG. 1.

VGAM736 RNA, herein schematically represented by VGAM1 RNA through VGAM3 RNA, binds complementarily to a host target binding site located in an untranslated region of VGAM736 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM736 host target RNA into VGAM736 host target protein, herein schematically represented by VGAM1 HOST TARGET PROTEIN through VGAM3 HOST TARGET PROTEIN, all of FIG. 1.

VGAM737 RNA, herein schematically represented by VGAM1 RNA through VGAM3 RNA, binds complementarily to a host target binding site located in an untranslated region of VGAM737 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM737 host target RNA into VGAM737 host target protein, herein schematically represented by VGAM1 HOST TARGET PROTEIN through VGAM3 HOST TARGET PROTEIN, all of FIG. 1.

VGAM738 RNA, herein schematically represented by VGAM1 RNA through VGAM3 RNA, binds complementarily to a host target binding site located in an untranslated region of VGAM738 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM738 host target RNA into VGAM738 host target protein, herein schematically represented by VGAM1 HOST TARGET PROTEIN through VGAM3 HOST TARGET PROTEIN, all of FIG. 1.

It is appreciated that a function of VGR2882 gene, herein designated VGR GENE, is inhibition of expression of host target genes, as part of a novel viral mechanism of attacking a host. Accordingly, utilities of VGR2882 gene include diagnosis, prevention and treatment of viral infection by Barley Yellow Mosaic Virus. Specific functions, and accordingly utilities, of VGR2882 gene correlate with, and may be deduced from, the identity of the host target genes, which are inhibited by VGAM RNAs comprised in the 'operon-like' cluster of VGR2882 gene: VGAM733 host target protein, VGAM734 host target protein, VGAM735 host target protein, VGAM736 host target protein, VGAM737 host target protein and VGAM738 host target protein, herein schematically represented by VGAM1 HOST TARGET PROTEIN through VGAM3 HOST TARGET PROTEIN. The function of these host target genes is elaborated hereinabove with reference to VGAM733, VGAM734, VGAM735, VGAM736, VGAM737 and VGAM738. FIG. 9 further provides a conceptual description of novel bioinformatically detected regulatory viral gene, referred to here as Viral Genomic Record 2883(VGR2883) viral gene, which encodes an 'operon-like' cluster of novel viral micro RNA-like genes, each of which in turn modulates expression of at least one host target gene, the function and utility of which at least one host target gene is known in the art.

VGR2883 gene, herein designated VGR GENE, is a novel bioinformatically detected regulatory, non protein coding, RNA viral gene. The method by which VGR2883 gene was detected is described hereinabove with reference to FIGS. 1-9.

VGR2883 gene encodes VGR2883 precursor RNA, herein designated VGR PRECURSOR RNA, an RNA molecule, typically several hundred nucleotides long.

VGR2883 precursor RNA folds spatially, forming VGR2883 folded precursor RNA, herein designated VGR FOLDED PRECURSOR RNA. It is appreciated that VGR2883 folded precursor RNA comprises a plurality of what is known in the art as 'hairpin' structures. These 'hairpin' structures are due to the fact that the nucleotide sequence of VGR2883 precursor RNA comprises a plurality of segments, the first half of each such segment having a nucleotide sequence which is at least a partial inversed-reversed sequence of the second half thereof, as is well known in the art.

VGR2883 folded precursor RNA is naturally processed by cellular enzymatic activity into at least 4 separate VGAM precursor RNAs, VGAM739 precursor RNA, VGAM740 precursor RNA, VGAM741 precursor RNA and VGAM742 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM739 RNA, VGAM740 RNA, VGAM741 RNA and VGAM742

RNA, herein schematically represented by VGAM1 RNA through VGAM3 RNA, each of which VGAM RNAs corresponding to VGAM RNA of FIG. 1.

VGAM739 RNA, herein schematically represented by VGAM1 RNA through VGAM3 RNA, binds complementarily to a host target binding site located in an untranslated region of VGAM739 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM739 host target RNA into VGAM739 host target protein, herein schematically represented by VGAM1 HOST TARGET PROTEIN through VGAM3 HOST TARGET PROTEIN, all of FIG. 1.

VGAM740 RNA, herein schematically represented by VGAM1 RNA through VGAM3 RNA, binds complementarily to a host target binding site located in an untranslated region of VGAM740 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM740 host target RNA into VGAM740 host target protein, herein schematically represented by VGAM1 HOST TARGET PROTEIN through VGAM3 HOST TARGET PROTEIN, all of FIG. 1.

VGAM741 RNA, herein schematically represented by VGAM1 RNA through VGAM3 RNA, binds complementarily to a host target binding site located in an untranslated region of VGAM741 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM741 host target RNA into VGAM741 host target protein, herein schematically represented by VGAM1 HOST TARGET PROTEIN through VGAM3 HOST TARGET PROTEIN, all of FIG. 1.

VGAM742 RNA, herein schematically represented by VGAM1 RNA through VGAM3 RNA, binds complementarily to a host target binding site located in an untranslated region of VGAM742 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM742 host target RNA into VGAM742 host target protein, herein schematically represented by VGAM1 HOST TARGET PROTEIN through VGAM3 HOST TARGET PROTEIN, all of FIG. 1.

It is appreciated that a function of VGR2883 gene, herein designated VGR GENE, is inhibition of expression of host target genes, as part of a novel viral mechanism of attacking a host. Accordingly, utilities of VGR2883 gene include diagnosis, prevention and treatment of viral infection by Taura Syndrome Virus. Specific functions, and accordingly utilities, of VGR2883 gene correlate with, and may be deduced from, the identity of the host target genes, which are inhibited by VGAM RNAs comprised in the 'operon-like' cluster of VGR2883 gene: VGAM739 host target protein, VGAM740 host target protein, VGAM741 host target protein and VGAM742 host target protein, herein schematically represented by VGAM1 HOST TARGET PROTEIN through VGAM3 HOST TARGET PROTEIN. The function of these host target genes is elaborated hereinabove with reference to VGAM739, VGAM740, VGAM741 and VGAM742. FIG. 9 further provides a conceptual description of novel bioinformatically detected regulatory viral gene, referred to here as Viral Genomic Record 2884(VGR2884) viral gene, which encodes an 'operon-like' cluster of novel viral micro RNA-like genes, each of which in turn modulates expression of at least one host target gene, the function and utility of which at least one host target gene is known in the art.

VGR2884 gene, herein designated VGR GENE, is a novel bioinformatically detected regulatory, non protein coding, RNA viral gene. The method by which VGR2884 gene was detected is described hereinabove with reference to FIGS. 1-9.

VGR2884 gene encodes VGR2884 precursor RNA, herein designated VGR PRECURSOR RNA, an RNA molecule, typically several hundred nucleotides long.

VGR2884 precursor RNA folds spatially, forming VGR2884 folded precursor RNA, herein designated VGR FOLDED PRECURSOR RNA. It is appreciated that VGR2884 folded precursor RNA comprises a plurality of what is known in the art as 'hairpin' structures. These 'hairpin' structures are due to the fact that the nucleotide sequence of VGR2884 precursor RNA comprises a plurality of segments, the first half of each such segment having a nucleotide sequence which is at least a partial inversed-reversed sequence of the second half thereof, as is well known in the art.

VGR2884 folded precursor RNA is naturally processed by cellular enzymatic activity into at least 8 separate VGAM precursor RNAs, VGAM744 precursor RNA, VGAM745 precursor RNA, VGAM746 precursor RNA, VGAM747 precursor RNA, VGAM748 precursor RNA, VGAM749 precursor RNA, VGAM750 precursor RNA and VGAM751 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM744 RNA, VGAM745 RNA, VGAM746 RNA, VGAM747 RNA, VGAM748 RNA, VGAM749 RNA, VGAM750 RNA and VGAM751 RNA, herein schematically represented by VGAM1 RNA through VGAM3 RNA, each of which VGAM RNAs corresponding to VGAM RNA of FIG. 1.

VGAM744 RNA, herein schematically represented by VGAM1 RNA through VGAM3 RNA, binds complementarily to a host target binding site located in an untranslated region of VGAM744 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM744 host target RNA into VGAM744 host target protein, herein schematically represented by VGAM1 HOST TARGET PROTEIN through VGAM3 HOST TARGET PROTEIN, all of FIG. 1.

VGAM745 RNA, herein schematically represented by VGAM1 RNA through VGAM3 RNA, binds complementarily to a host target binding site located in an untranslated region of VGAM745 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM745 host target RNA into VGAM745 host target protein, herein schematically represented by VGAM1 HOST TARGET PROTEIN through VGAM3 HOST TARGET PROTEIN, all of FIG. 1.

VGAM746 RNA, herein schematically represented by VGAM1 RNA through VGAM3 RNA, binds complementarily to a host target binding site located in an untranslated region of VGAM746 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM746 host target RNA into VGAM746 host target protein, herein schematically represented by VGAM1 HOST TARGET PROTEIN through VGAM3 HOST TARGET PROTEIN, all of FIG. 1.

VGAM747 RNA, herein schematically represented by VGAM1 RNA through VGAM3 RNA, binds complementarily to a host target binding site located in an untranslated region of VGAM747 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM747 host target RNA into VGAM747 host target protein, herein schematically represented by VGAM1 HOST TARGET PROTEIN through VGAM3 HOST TARGET PROTEIN, all of FIG. 1.

VGAM748 RNA, herein schematically represented by VGAM1 RNA through VGAM3 RNA, binds complementarily to a host target binding site located in an untranslated region of VGAM748 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM748 host target RNA into VGAM748 host target protein, herein schematically represented by VGAM1 HOST TARGET PROTEIN through VGAM3 HOST TARGET PROTEIN, all of FIG. 1.

VGAM749 RNA, herein schematically represented by VGAM1 RNA through VGAM3 RNA, binds complementarily to a host target binding site located in an untranslated region of VGAM749 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM749 host target RNA into VGAM749 host target protein, herein schematically represented by VGAM1 HOST TARGET PROTEIN through VGAM3 HOST TARGET PROTEIN, all of FIG. 1.

VGAM750 RNA, herein schematically represented by VGAM1 RNA through VGAM3 RNA, binds complementarily to a host target binding site located in an untranslated region of VGAM750 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM750 host target RNA into VGAM750 host target protein, herein schematically represented by VGAM1 HOST TARGET PROTEIN through VGAM3 HOST TARGET PROTEIN, all of FIG. 1.

VGAM751 RNA, herein schematically represented by VGAM1 RNA through VGAM3 RNA, binds complementarily to a host target binding site located in an untranslated region of VGAM751 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM751 host target RNA into VGAM751 host target protein, herein schematically represented by VGAM1 HOST TARGET PROTEIN through VGAM3 HOST TARGET PROTEIN, all of FIG. 1.

It is appreciated that a function of VGR2884 gene, herein designated VGR GENE, is inhibition of expression of host target genes, as part of a novel viral mechanism of attacking a host. Accordingly, utilities of VGR2884 gene include diagnosis, prevention and treatment of viral infection by Bovine Coronavirus. Specific functions, and accordingly utilities, of VGR2884 gene correlate with, and may be deduced from, the identity of the host target genes, which are inhibited by VGAM RNAs comprised in the 'operon-like' cluster of VGR2884 gene: VGAM744 host target protein, VGAM745 host target protein, VGAM746 host target protein, VGAM747 host target protein, VGAM748 host target protein, VGAM749 host target protein, VGAM750 host target protein and VGAM751 host target protein, herein schematically represented by VGAM1 HOST TARGET PROTEIN through VGAM3 HOST TARGET PROTEIN. The function of these host target genes is elaborated hereinabove with reference to VGAM744, VGAM745, VGAM746, VGAM747, VGAM748, VGAM749, VGAM750 and VGAM751. FIG. 9 further provides a conceptual description of novel bioinformatically detected regulatory viral gene, referred to here as Viral Genomic Record 2885(VGR2885) viral gene, which encodes an 'operon-like' cluster of novel viral micro RNA-like genes, each of which in turn modulates expression of at least one host target gene, the function and utility of which at least one host target gene is known in the art.

VGR2885 gene, herein designated VGR GENE, is a novel bioinformatically detected regulatory, non protein coding, RNA viral gene. The method by which VGR2885 gene was detected is described hereinabove with reference to FIGS. 1-9.

VGR2885 gene encodes VGR2885 precursor RNA, herein designated VGR PRECURSOR RNA, an RNA molecule, typically several hundred nucleotides long.

VGR2885 precursor RNA folds spatially, forming VGR2885 folded precursor RNA, herein designated VGR FOLDED PRECURSOR RNA. It is appreciated that VGR2885 folded precursor RNA comprises a plurality of what is known in the art as 'hairpin' structures. These 'hairpin' structures are due to the fact that the nucleotide sequence of VGR2885 precursor RNA comprises a plurality of segments, the first half of each such segment having a nucleotide sequence which is at least a partial inversed-reversed sequence of the second half thereof, as is well known in the art.

VGR2885 folded precursor RNA is naturally processed by cellular enzymatic activity into at least 8 separate VGAM precursor RNAs, VGAM752 precursor RNA, VGAM753 precursor RNA, VGAM754 precursor RNA, VGAM755 precursor RNA, VGAM756 precursor RNA, VGAM757 precursor RNA, VGAM758 precursor RNA and VGAM759 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM752

RNA, VGAM753 RNA, VGAM754 RNA, VGAM755 RNA, VGAM756 RNA, VGAM757 RNA, VGAM758 RNA and VGAM759 RNA, herein schematically represented by VGAM1 RNA through VGAM3 RNA, each of which VGAM RNAs corresponding to VGAM RNA of FIG. 1.

VGAM752 RNA, herein schematically represented by VGAM1 RNA through VGAM3 RNA, binds complementarily to a host target binding site located in an untranslated region of VGAM752 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM752 host target RNA into VGAM752 host target protein, herein schematically represented by VGAM1 HOST TARGET PROTEIN through VGAM3 HOST TARGET PROTEIN, all of FIG. 1.

VGAM753 RNA, herein schematically represented by VGAM1 RNA through VGAM3 RNA, binds complementarily to a host target binding site located in an untranslated region of VGAM753 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM753 host target RNA into VGAM753 host target protein, herein schematically represented by VGAM1 HOST TARGET PROTEIN through VGAM3 HOST TARGET PROTEIN, all of FIG. 1.

VGAM754 RNA, herein schematically represented by VGAM1 RNA through VGAM3 RNA, binds complementarily to a host target binding site located in an untranslated region of VGAM754 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM754 host target RNA into VGAM754 host target protein, herein schematically represented by VGAM1 HOST TARGET PROTEIN through VGAM3 HOST TARGET PROTEIN, all of FIG. 1.

VGAM755 RNA, herein schematically represented by VGAM1 RNA through VGAM3 RNA, binds complementarily to a host target binding site located in an untranslated region of VGAM755 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM755 host target RNA into VGAM755 host target protein, herein schematically represented by VGAM1 HOST TARGET PROTEIN through VGAM3 HOST TARGET PROTEIN, all of FIG. 1.

VGAM756 RNA, herein schematically represented by VGAM1 RNA through VGAM3 RNA, binds complementarily to a host target binding site located in an untranslated region of VGAM756 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM756 host target RNA into VGAM756 host target protein, herein schematically represented by VGAM1 HOST TARGET PROTEIN through VGAM3 HOST TARGET PROTEIN, all of FIG. 1.

VGAM757 RNA, herein schematically represented by VGAM1 RNA through VGAM3 RNA, binds complementarily to a host target binding site located in an untranslated region of VGAM757 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM757 host target RNA into VGAM757 host target protein, herein schematically represented by VGAM1 HOST TARGET PROTEIN through VGAM3 HOST TARGET PROTEIN, all of FIG. 1.

VGAM758 RNA, herein schematically represented by VGAM1 RNA through VGAM3 RNA, binds complementarily to a host target binding site located in an untranslated region of VGAM758 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM758 host target RNA into VGAM758 host target protein, herein schematically represented by VGAM1 HOST TARGET PROTEIN through VGAM3 HOST TARGET PROTEIN, all of FIG. 1.

VGAM759 RNA, herein schematically represented by VGAM1 RNA through VGAM3 RNA, binds complementarily to a host target binding site located in an untranslated region of VGAM759 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM759 host target RNA into VGAM759 host target protein, herein schematically represented by VGAM1 HOST TARGET PROTEIN through VGAM3 HOST TARGET PROTEIN, all of FIG. 1.

It is appreciated that a function of VGR2885 gene, herein designated VGR GENE, is inhibition of expression of host target genes, as part of a novel viral mechanism of attacking a host. Accordingly, utilities of VGR2885 gene include diagnosis, prevention and treatment of viral infection by Bovine Coronavirus. Specific functions, and accordingly utilities, of VGR2885 gene correlate with, and may be deduced from, the identity of the host target genes, which are inhibited by VGAM RNAs comprised in the 'operon-like' cluster of VGR2885 gene: VGAM752 host target protein, VGAM753 host target protein, VGAM754 host target protein, VGAM755 host target protein, VGAM756 host target protein, VGAM757 host target protein, VGAM758 host target protein and VGAM759 host target protein, herein schematically represented by VGAM1 HOST TARGET PROTEIN through VGAM3 HOST TARGET PROTEIN. The function of these host target genes is elaborated hereinabove with reference to VGAM752, VGAM753, VGAM754, VGAM755, VGAM756, VGAM757, VGAM758 and VGAM759. FIG. 9 further provides a conceptual description of novel bioinformatically detected regulatory viral gene, referred to here as Viral Genomic Record 2886(VGR2886) viral gene, which encodes an 'operon-like' cluster of novel viral micro RNA-like genes, each of which in turn modulates expression of at least one host target gene, the function and utility of which at least one host target gene is known in the art.

VGR2886 gene, herein designated VGR GENE, is a novel bioinformatically detected regulatory, non protein coding, RNA viral gene. The method by which VGR2886 gene was detected is described hereinabove with reference to FIGS. 1-9.

VGR2886 gene encodes VGR2886 precursor RNA, herein designated VGR PRECURSOR RNA, an RNA molecule, typically several hundred nucleotides long.

VGR2886 precursor RNA folds spatially, forming VGR2886 folded precursor RNA, herein designated VGR FOLDED PRECURSOR RNA. It is appreciated that VGR2886 folded precursor RNA comprises a plurality of what is known in the art as 'hairpin' structures. These 'hairpin' structures are due to the fact that the nucleotide sequence of VGR2886 precursor RNA comprises a plurality of segments, the first half of each such segment having a nucleotide sequence which is at least a partial inversed-reversed sequence of the second half thereof, as is well known in the art.

VGR2886 folded precursor RNA is naturally processed by cellular enzymatic activity into at least 8 separate VGAM precursor RNAs, VGAM760 precursor RNA, VGAM761 precursor RNA, VGAM762 precursor RNA, VGAM763 precursor RNA, VGAM764 precursor RNA, VGAM765 precursor RNA, VGAM766 precursor RNA and VGAM767 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM760 RNA, VGAM761 RNA, VGAM762 RNA, VGAM763 RNA, VGAM764 RNA, VGAM765 RNA, VGAM766 RNA and VGAM767 RNA, herein schematically represented by VGAM1 RNA through VGAM3 RNA, each of which VGAM RNAs corresponding to VGAM RNA of FIG. 1.

VGAM760 RNA, herein schematically represented by VGAM1 RNA through VGAM3 RNA, binds complementarily to a host target binding site located in an untranslated region of VGAM760 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM760 host target RNA into VGAM760 host target protein, herein schematically represented by VGAM1 HOST TARGET PROTEIN through VGAM3 HOST TARGET PROTEIN, all of FIG. 1.

VGAM761 RNA, herein schematically represented by VGAM1 RNA through VGAM3 RNA, binds complementarily to a host target binding site located in an untranslated region of VGAM761 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM761 host target RNA into VGAM761 host target protein, herein schematically represented by VGAM1 HOST TARGET PROTEIN through VGAM3 HOST TARGET PROTEIN, all of FIG. 1.

VGAM762 RNA, herein schematically represented by VGAM1 RNA through VGAM3 RNA, binds complementarily to a host target binding site located in an untranslated region of VGAM762 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM762 host target RNA into VGAM762 host target protein, herein schematically represented by VGAM1 HOST TARGET PROTEIN through VGAM3 HOST TARGET PROTEIN, all of FIG. 1.

VGAM763 RNA, herein schematically represented by VGAM1 RNA through VGAM3 RNA, binds complementarily to a host target binding site located in an untranslated region of VGAM763 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM763 host target RNA into VGAM763 host target protein, herein schematically represented by VGAM1 HOST TARGET PROTEIN through VGAM3 HOST TARGET PROTEIN, all of FIG. 1.

VGAM764 RNA, herein schematically represented by VGAM1 RNA through VGAM3 RNA, binds complementarily to a host target binding site located in an untranslated region of VGAM764 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM764 host target RNA into VGAM764 host target protein, herein schematically represented by VGAM1 HOST TARGET PROTEIN through VGAM3 HOST TARGET PROTEIN, all of FIG. 1.

VGAM765 RNA, herein schematically represented by VGAM1 RNA through VGAM3 RNA, binds complementarily to a host target binding site located in an untranslated region of VGAM765 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM765 host target RNA into VGAM765 host target protein, herein schematically represented by VGAM1 HOST TARGET PROTEIN through VGAM3 HOST TARGET PROTEIN, all of FIG. 1.

VGAM766 RNA, herein schematically represented by VGAM1 RNA through VGAM3 RNA, binds complementarily to a host target binding site located in an untranslated region of VGAM766 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM766 host target RNA into VGAM766 host target protein, herein schematically represented by VGAM1 HOST TARGET PROTEIN through VGAM3 HOST TARGET PROTEIN, all of FIG. 1.

VGAM767 RNA, herein schematically represented by VGAM1 RNA through VGAM3 RNA, binds complementarily to a host target binding site located in an untranslated region of VGAM767 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM767 host target RNA into VGAM767 host target protein, herein schematically represented by VGAM1 HOST TARGET PROTEIN through VGAM3 HOST TARGET PROTEIN, all of FIG. 1.

It is appreciated that a function of VGR2886 gene, herein designated VGR GENE, is inhibition of expression of host target genes, as part of a novel viral mechanism of attacking a host. Accordingly, utilities of VGR2886 gene include diagnosis, prevention and treatment of viral infection by Bovine Coronavirus. Specific functions, and accordingly utilities, of VGR2886 gene correlate with, and may be deduced from, the identity of the host target genes, which are inhibited by VGAM RNAs comprised in the 'operon-like' cluster of VGR2886 gene: VGAM760 host target protein, VGAM761 host target protein, VGAM762 host target protein, VGAM763 host target protein, VGAM764 host target protein, VGAM765 host target protein, VGAM766 host target protein and VGAM767 host target protein, herein schematically represented by VGAM1 HOST TARGET PROTEIN through VGAM3 HOST TARGET PROTEIN. The function of these host target genes is elaborated hereinabove with reference to VGAM760, VGAM761, VGAM762, VGAM763, VGAM764, VGAM765, VGAM766 and VGAM767. FIG. 9 further provides a conceptual description of novel bioinformatically detected regulatory viral gene, referred to here as Viral Genomic Record 2887(VGR2887) viral gene, which encodes an 'operon-like' cluster of novel viral micro RNA-like genes, each of which in turn modulates expression of at least one host target gene, the function and utility of which at least one host target gene is known in the art.

VGR2887 gene, herein designated VGR GENE, is a novel bioinformatically detected regulatory, non protein coding, RNA viral gene. The method by which VGR2887 gene was detected is described hereinabove with reference to FIGS. 1-9.

VGR2887 gene encodes VGR2887 precursor RNA, herein designated VGR PRECURSOR RNA, an RNA molecule, typically several hundred nucleotides long.

VGR2887 precursor RNA folds spatially, forming VGR2887 folded precursor RNA, herein designated VGR FOLDED PRECURSOR RNA. It is appreciated that VGR2887 folded precursor RNA comprises a plurality of what is known in the art as 'hairpin' structures. These 'hairpin' structures are due to the fact that the nucleotide sequence of VGR2887 precursor RNA comprises a plurality of segments, the first half of each such segment having a nucleotide sequence which is at least a partial inversed-reversed sequence of the second half thereof, as is well known in the art.

VGR2887 folded precursor RNA is naturally processed by cellular enzymatic activity into at least 2 separate VGAM precursor RNAs, VGAM768 precursor RNA and VGAM769 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM768 RNA and VGAM769 RNA, herein schematically represented by VGAM1 RNA through VGAM3 RNA, each of which VGAM RNAs corresponding to VGAM RNA of FIG. 1.

VGAM768 RNA, herein schematically represented by VGAM1 RNA through VGAM3 RNA, binds complementarily to a host target binding site located in an untranslated region of VGAM768 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM768 host target RNA into VGAM768 host target protein, herein schematically represented by VGAM1 HOST TARGET PROTEIN through VGAM3 HOST TARGET PROTEIN, all of FIG. 1.

VGAM769 RNA, herein schematically represented by VGAM1 RNA through VGAM3 RNA, binds complementarily to a host target binding site located in an untranslated region of VGAM769 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM769 host target RNA into VGAM769 host target protein, herein schematically represented by VGAM1 HOST TARGET PROTEIN through VGAM3 HOST TARGET PROTEIN, all of FIG. 1.

It is appreciated that a function of VGR2887 gene, herein designated VGR GENE, is inhibition of expression of host target genes, as part of a novel viral mechanism of attacking a host. Accordingly, utilities of VGR2887 gene include diagnosis, prevention and treatment of viral infection by Bovine Coronavirus. Specific functions, and accordingly utilities, of VGR2887 gene correlate with, and may be deduced from, the identity of the host target genes, which are inhibited by VGAM RNAs comprised in the 'operon-like' cluster of VGR2887 gene: VGAM768 host target protein and VGAM769 host target protein, herein schematically represented by VGAM1 HOST TARGET PROTEIN through VGAM3 HOST TARGET PROTEIN. The function of these host target genes is elaborated hereinabove with reference to VGAM768 and VGAM769. FIG. 9 further provides a conceptual description of novel bioinformatically detected regulatory viral gene, referred to here as Viral Genomic Record 2888(VGR2888) viral gene, which encodes an 'operon-like' cluster of novel viral micro RNA-like genes, each of which in turn modulates expression of at least one host target gene, the function and utility of which at least one host target gene is known in the art.

VGR2888 gene, herein designated VGR GENE, is a novel bioinformatically detected regulatory, non protein coding, RNA viral gene. The method by which VGR2888 gene was detected is described hereinabove with reference to FIGS. 1-9.

VGR2888 gene encodes VGR2888 precursor RNA, herein designated VGR PRECURSOR RNA, an RNA molecule, typically several hundred nucleotides long.

VGR2888 precursor RNA folds spatially, forming VGR2888 folded precursor RNA, herein designated VGR FOLDED PRECURSOR RNA. It is appreciated that VGR2888 folded precursor RNA comprises a plurality of what is known in the art as 'hairpin' structures. These 'hairpin' structures are due to the fact that the nucleotide sequence of VGR2888 precursor RNA comprises a plurality of segments, the first half of each such segment having a nucleotide sequence which is at least a partial inversed-reversed sequence of the second half thereof, as is well known in the art.

VGR2888 folded precursor RNA is naturally processed by cellular enzymatic activity into at least 5 separate VGAM precursor RNAs, VGAM771 precursor RNA, VGAM772 precursor RNA, VGAM773 precursor RNA, VGAM774 precursor RNA and VGAM775 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM771 RNA, VGAM772 RNA, VGAM773 RNA, VGAM774 RNA and VGAM775 RNA, herein schematically represented by VGAM1 RNA through VGAM3 RNA, each of which VGAM RNAs corresponding to VGAM RNA of FIG. 1.

VGAM771 RNA, herein schematically represented by VGAM1 RNA through VGAM3 RNA, binds complementarily to a host target binding site located in an untranslated region of VGAM771 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM771 host target RNA into VGAM771 host target protein, herein schematically represented by VGAM1 HOST TARGET PROTEIN through VGAM3 HOST TARGET PROTEIN, all of FIG. 1.

VGAM772 RNA, herein schematically represented by VGAM1 RNA through VGAM3 RNA, binds complementarily to a host target binding site located in an untranslated region of VGAM772 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM772 host target RNA into VGAM772 host target protein, herein schematically represented by VGAM1 HOST TARGET PROTEIN through VGAM3 HOST TARGET PROTEIN, all of FIG. 1.

VGAM773 RNA, herein schematically represented by VGAM1 RNA through VGAM3 RNA, binds complementarily to a host target binding site located in an untranslated region of VGAM773 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM773 host target RNA into VGAM773 host target protein, herein schematically represented by VGAM1 HOST TARGET PROTEIN through VGAM3 HOST TARGET PROTEIN, all of FIG. 1.

VGAM774 RNA, herein schematically represented by VGAM1 RNA through VGAM3 RNA, binds complementarily to a host target binding site located in an untranslated region of VGAM774 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM774 host target RNA into VGAM774 host target protein, herein schematically represented by VGAM1 HOST TARGET PROTEIN through VGAM3 HOST TARGET PROTEIN, all of FIG. 1.

VGAM775 RNA, herein schematically represented by VGAM1 RNA through VGAM3 RNA, binds complementarily to a host target binding site located in an untranslated region of VGAM775 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM775 host target RNA into VGAM775 host target protein, herein schematically represented by VGAM1 HOST TARGET PROTEIN through VGAM3 HOST TARGET PROTEIN, all of FIG. 1.

It is appreciated that a function of VGR2888 gene, herein designated VGR GENE, is inhibition of expression of host target genes, as part of a novel viral mechanism of attacking a host. Accordingly, utilities of VGR2888 gene include diagnosis, prevention and treatment of viral infection by Bovine Coronavirus. Specific functions, and accordingly utilities, of VGR2888 gene correlate with, and may be deduced from, the identity of the host target genes, which are inhibited by VGAM RNAs comprised in the 'operon-like' cluster of VGR2888 gene: VGAM771 host target protein, VGAM772 host target protein, VGAM773 host target protein, VGAM774 host target protein and VGAM775 host target protein, herein schematically represented by VGAM1 HOST TARGET PROTEIN through VGAM3 HOST TARGET PROTEIN. The function of these host target genes is elaborated hereinabove with reference to VGAM771, VGAM772, VGAM773, VGAM774 and VGAM775. FIG. 9 further provides a conceptual description of novel bioinformatically detected regulatory viral gene, referred to here as Viral Genomic Record 2889(VGR2889) viral gene, which encodes an 'operon-like' cluster of novel viral micro RNA-like genes, each of which in turn modulates expression of at least one host target gene, the function and utility of which at least one host target gene is known in the art.

VGR2889 gene, herein designated VGR GENE, is a novel bioinformatically detected regulatory, non protein coding, RNA viral gene. The method by which VGR2889 gene was detected is described hereinabove with reference to FIGS. 1-9.

VGR2889 gene encodes VGR2889 precursor RNA, herein designated VGR PRECURSOR RNA, an RNA molecule, typically several hundred nucleotides long.

VGR2889 precursor RNA folds spatially, forming VGR2889 folded precursor RNA, herein designated VGR FOLDED PRECURSOR RNA. It is appreciated that VGR2889 folded precursor RNA comprises a plurality of what is known in the art as 'hairpin' structures. These 'hairpin' structures are due to the fact that the nucleotide sequence of VGR2889 precursor RNA comprises a plurality of segments, the first half of each such segment having a nucleotide sequence which is at least a partial inversed-reversed sequence of the second half thereof, as is well known in the art.

VGR2889 folded precursor RNA is naturally processed by cellular enzymatic activity into at least 4 separate VGAM precursor RNAs, VGAM781 precursor RNA, VGAM782 precursor RNA, VGAM783 precursor RNA and VGAM784 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM781 RNA, VGAM782 RNA, VGAM783 RNA and VGAM784 RNA, herein schematically represented by VGAM1 RNA through VGAM3 RNA, each of which VGAM RNAs corresponding to VGAM RNA of FIG. 1.

VGAM781 RNA, herein schematically represented by VGAM1 RNA through VGAM3 RNA, binds complementarily to a host target binding site located in an untranslated region of VGAM781 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM781 host target RNA into VGAM781 host target protein, herein schematically represented by VGAM1 HOST TARGET PROTEIN through VGAM3 HOST TARGET PROTEIN, all of FIG. 1.

VGAM782 RNA, herein schematically represented by VGAM1 RNA through VGAM3 RNA, binds complementarily to a host target binding site located in an untranslated region of VGAM782 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM782 host target RNA into VGAM782 host target protein, herein schematically represented by VGAM1 HOST TARGET PROTEIN through VGAM3 HOST TARGET PROTEIN, all of FIG. 1.

VGAM783 RNA, herein schematically represented by VGAM1 RNA through VGAM3 RNA, binds complementarily to a host target binding site located in an untranslated region of VGAM783 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM783 host target RNA into VGAM783 host target protein, herein schematically represented by VGAM1 HOST TARGET PROTEIN through VGAM3 HOST TARGET PROTEIN, all of FIG. 1.

VGAM784 RNA, herein schematically represented by VGAM1 RNA through VGAM3 RNA, binds complementarily to a host target binding site located in an untranslated region of VGAM784 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM784 host target RNA into VGAM784 host target protein, herein schematically represented by VGAM1 HOST TARGET PROTEIN through VGAM3 HOST TARGET PROTEIN, all of FIG. 1.

It is appreciated that a function of VGR2889 gene, herein designated VGR GENE, is inhibition of expression of host target genes, as part of a novel viral mechanism of attacking a host. Accordingly, utilities of VGR2889 gene include diagnosis, prevention and treatment of viral infection by Deer Tick Virus. Specific functions, and accordingly utilities, of VGR2889 gene correlate with, and may be deduced from, the identity of the host target genes, which are inhibited by VGAM RNAs comprised in the 'operon-like' cluster of VGR2889 gene: VGAM781 host target protein, VGAM782 host target protein, VGAM783 host target protein and VGAM784 host target protein, herein schematically represented by VGAM1 HOST TARGET PROTEIN through VGAM3 HOST TARGET PROTEIN. The function of these host target genes is elaborated hereinabove with reference to VGAM781, VGAM782, VGAM783 and VGAM784. FIG. 9 further provides a conceptual description of novel bioinformatically detected regulatory viral gene, referred to here as Viral Genomic Record 2890(VGR2890) viral gene, which encodes an 'operon-like' cluster of novel viral micro RNA-like genes, each of which in turn modulates expression of at least one host target gene, the function and utility of which at least one host target gene is known in the art.

VGR2890 gene, herein designated VGR GENE, is a novel bioinformatically detected regulatory, non protein coding, RNA viral gene. The method by which VGR2890 gene was detected is described hereinabove with reference to FIGS. 1-9.

VGR2890 gene encodes VGR2890 precursor RNA, herein designated VGR PRECURSOR RNA, an RNA molecule, typically several hundred nucleotides long.

VGR2890 precursor RNA folds spatially, forming VGR2890 folded precursor RNA, herein designated VGR FOLDED PRECURSOR RNA. It is appreciated that VGR2890 folded precursor RNA comprises a plurality of what is known in the art as 'hairpin' structures. These 'hairpin' structures are due to the fact that the nucleotide sequence of VGR2890 precursor RNA comprises a plurality of segments, the first half of each such segment having a nucleotide sequence which is at least a partial inversed-reversed sequence of the second half thereof, as is well known in the art.

VGR2890 folded precursor RNA is naturally processed by cellular enzymatic activity into at least 4 separate VGAM precursor RNAs, VGAM785 precursor RNA, VGAM786 precursor RNA, VGAM787 precursor RNA and VGAM788 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM785 RNA, VGAM786 RNA, VGAM787 RNA and VGAM788 RNA, herein schematically represented by VGAM1 RNA through VGAM3 RNA, each of which VGAM RNAs corresponding to VGAM RNA of FIG. 1.

VGAM785 RNA, herein schematically represented by VGAM1 RNA through VGAM3 RNA, binds complementarily to a host target binding site located in an untranslated region of VGAM785 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM785 host target RNA into VGAM785 host target protein, herein schematically represented by VGAM1 HOST TARGET PROTEIN through VGAM3 HOST TARGET PROTEIN, all of FIG. 1.

VGAM786 RNA, herein schematically represented by VGAM1 RNA through VGAM3 RNA, binds complementarily to a host target binding site located in an untranslated region of VGAM786 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM786 host target RNA into VGAM786 host target protein, herein schematically represented by VGAM1 HOST TARGET PROTEIN through VGAM3 HOST TARGET PROTEIN, all of FIG. 1.

VGAM787 RNA, herein schematically represented by VGAM1 RNA through VGAM3 RNA, binds complementarily to a host target binding site located in an untranslated region of VGAM787 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM787 host target RNA into VGAM787 host target protein, herein schematically represented by VGAM1 HOST TARGET PROTEIN through VGAM3 HOST TARGET PROTEIN, all of FIG. 1.

VGAM788 RNA, herein schematically represented by VGAM1 RNA through VGAM3 RNA, binds complementarily to a host target binding site located in an untranslated region of VGAM788 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM788 host target RNA into VGAM788 host target protein, herein schematically represented by VGAM1 HOST TARGET PROTEIN through VGAM3 HOST TARGET PROTEIN, all of FIG. 1.

It is appreciated that a function of VGR2890 gene, herein designated VGR GENE, is inhibition of expression of host target genes, as part of a novel viral mechanism of attacking a host. Accordingly, utilities of VGR2890 gene include diagnosis, prevention and treatment of viral infection by Zucchini Yellow Mosaic Virus. Specific functions, and accordingly utilities, of VGR2890 gene correlate with, and may be deduced from, the identity of the host target genes, which are inhibited by VGAM RNAs comprised in the 'operon-like' cluster of VGR2890 gene: VGAM785 host target protein, VGAM786 host target protein, VGAM787 host target protein and VGAM788 host target protein, herein schematically represented by VGAM1 HOST TARGET PROTEIN through VGAM3 HOST TARGET PROTEIN. The function of these host target genes is elaborated hereinabove with reference to VGAM785, VGAM786, VGAM787 and VGAM788. FIG. 9 further provides a conceptual description of novel bioinformatically detected regulatory viral gene, referred to here as Viral Genomic Record 2891(VGR2891) viral gene, which encodes an 'operon-like' cluster of novel viral micro RNA-like genes, each of which in turn modulates expression of at least one host target gene, the function and utility of which at least one host target gene is known in the art.

VGR2891 gene, herein designated VGR GENE, is a novel bioinformatically detected regulatory, non protein coding, RNA viral gene. The method by which VGR2891 gene was detected is described hereinabove with reference to FIGS. 1-9.

VGR2891 gene encodes VGR2891 precursor RNA, herein designated VGR PRECURSOR RNA, an RNA molecule, typically several hundred nucleotides long.

VGR2891 precursor RNA folds spatially, forming VGR2891 folded precursor RNA, herein designated VGR FOLDED PRECURSOR RNA. It is appreciated that VGR2891 folded precursor RNA comprises a plurality of what is known in the art as 'hairpin' structures. These 'hairpin' structures are due to the fact that the nucleotide sequence of VGR2891 precursor RNA comprises a plurality of segments, the first half of each such segment having a nucleotide sequence which is at least a partial inversed-reversed sequence of the second half thereof, as is well known in the art.

VGR2891 folded precursor RNA is naturally processed by cellular enzymatic activity into at least 3 separate VGAM precursor RNAs, VGAM789 precursor RNA, VGAM790 precursor RNA and VGAM791 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM789 RNA, VGAM790 RNA and VGAM791 RNA, herein schematically represented by VGAM1 RNA through VGAM3 RNA, each of which VGAM RNAs corresponding to VGAM RNA of FIG. 1.

VGAM789 RNA, herein schematically represented by VGAM1 RNA through VGAM3 RNA, binds complementarily to a host target binding site located in an untranslated region of VGAM789 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM789 host target RNA into VGAM789 host target protein, herein schematically represented by VGAM1 HOST TARGET PROTEIN through VGAM3 HOST TARGET PROTEIN, all of FIG. 1.

VGAM790 RNA, herein schematically represented by VGAM1 RNA through VGAM3 RNA, binds complementarily to a host target binding site located in an untranslated region of VGAM790 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM790 host target RNA into VGAM790 host target protein, herein schematically represented by VGAM1 HOST TARGET PROTEIN through VGAM3 HOST TARGET PROTEIN, all of FIG. 1.

VGAM791 RNA, herein schematically represented by VGAM1 RNA through VGAM3 RNA, binds complementarily to a host target binding site located in an untranslated region of VGAM791 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM791 host target RNA into VGAM791 host target protein, herein schematically represented by VGAM1 HOST TARGET PROTEIN through VGAM3 HOST TARGET PROTEIN, all of FIG. 1.

It is appreciated that a function of VGR2891 gene, herein designated VGR GENE, is inhibition of expression of host target genes, as part of a novel viral mechanism of attacking a host. Accordingly, utilities of VGR2891 gene include diagnosis, prevention and treatment of viral infection by Shrimp White Spot Syndrome Virus (white spot bacilliform virus). Specific functions, and accordingly utilities, of VGR2891 gene correlate with, and may be deduced from, the identity of the host target genes, which are inhibited by VGAM RNAs comprised in the 'operon-like' cluster of VGR2891 gene: VGAM789 host target protein, VGAM790 host target protein and VGAM791 host target protein, herein schematically represented by VGAM1 HOST TARGET PROTEIN through VGAM3 HOST TARGET PROTEIN. The function of these host target genes is elaborated hereinabove with reference to VGAM789, VGAM790 and VGAM791. FIG. 9 further provides a conceptual description of novel bioinformatically detected regulatory viral gene, referred to here as Viral Genomic Record 2892(VGR2892) viral gene, which encodes an 'operon-like' cluster of novel viral micro RNA-like genes, each of which in turn modulates expression of at least one host target gene, the function and utility of which at least one host target gene is known in the art.

VGR2892 gene, herein designated VGR GENE, is a novel bioinformatically detected regulatory, non protein coding, RNA viral gene. The method by which VGR2892 gene was detected is described hereinabove with reference to FIGS. 1-9.

VGR2892 gene encodes VGR2892 precursor RNA, herein designated VGR PRECURSOR RNA, an RNA molecule, typically several hundred nucleotides long.

VGR2892 precursor RNA folds spatially, forming VGR2892 folded precursor RNA, herein designated VGR FOLDED PRECURSOR RNA. It is appreciated that VGR2892 folded precursor RNA comprises a plurality of what is known in the art as 'hairpin' structures. These 'hairpin' structures are due to the fact that the nucleotide sequence of VGR2892 precursor RNA comprises a plurality of segments, the first half of each such segment having a nucleotide sequence which is at least a partial inversed-reversed sequence of the second half thereof, as is well known in the art.

VGR2892 folded precursor RNA is naturally processed by cellular enzymatic activity into at least 2 separate VGAM precursor RNAs, VGAM792 precursor RNA and VGAM793 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM792 RNA and VGAM793 RNA, herein schematically represented by VGAM1 RNA through VGAM3 RNA, each of which VGAM RNAs corresponding to VGAM RNA of FIG. 1.

VGAM792 RNA, herein schematically represented by VGAM1 RNA through VGAM3 RNA, binds complementarily to a host target binding site located in an untranslated region of VGAM792 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM792 host target RNA into VGAM792 host target protein, herein schematically represented by VGAM1 HOST TARGET PROTEIN through VGAM3 HOST TARGET PROTEIN, all of FIG. 1.

VGAM793 RNA, herein schematically represented by VGAM1 RNA through VGAM3 RNA, binds complementarily to a host target binding site located in an untranslated region of VGAM793 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM793 host target RNA into VGAM793 host target protein, herein schematically represented by VGAM1 HOST TARGET PROTEIN through VGAM3 HOST TARGET PROTEIN, all of FIG. 1.

It is appreciated that a function of VGR2892 gene, herein designated VGR GENE, is inhibition of expression of host target genes, as part of a novel viral mechanism of attacking a host. Accordingly, utilities of VGR2892 gene include diagnosis, prevention and treatment of viral infection by Shrimp White Spot Syndrome Virus (white spot bacilliform virus). Specific functions, and accordingly utilities, of VGR2892 gene correlate with, and may be deduced from, the identity of the host target genes, which are inhibited by VGAM RNAs comprised in the 'operon-like' cluster of VGR2892 gene: VGAM792 host target protein and VGAM793 host target protein, herein schematically represented by VGAM1 HOST TARGET PROTEIN through VGAM3 HOST TARGET PROTEIN. The function of these host target genes is elaborated hereinabove with reference to VGAM792 and VGAM793. FIG. 9 further provides a conceptual description of novel bioinformatically detected regulatory viral gene, referred to here as Viral Genomic Record 2893(VGR2893) viral gene, which encodes an 'operon-like' cluster of novel viral micro RNA-like genes, each of which in turn modulates expression of at least one host target gene, the function and utility of which at least one host target gene is known in the art.

VGR2893 gene, herein designated VGR GENE, is a novel bioinformatically detected regulatory, non protein coding, RNA viral gene. The method by which VGR2893 gene was detected is described hereinabove with reference to FIGS. 1-9.

VGR2893 gene encodes VGR2893 precursor RNA, herein designated VGR PRECURSOR RNA, an RNA molecule, typically several hundred nucleotides long.

VGR2893 precursor RNA folds spatially, forming VGR2893 folded precursor RNA, herein designated VGR FOLDED PRECURSOR RNA. It is appreciated that VGR2893 folded precursor RNA comprises a plurality of what is known in the art as 'hairpin' structures. These 'hairpin' structures are due to the fact that the nucleotide sequence of VGR2893 precursor RNA comprises a plurality of segments, the first half of each such segment having a nucleotide sequence which is at least a partial inversed-reversed sequence of the second half thereof, as is well known in the art.

VGR2893 folded precursor RNA is naturally processed by cellular enzymatic activity into at least 2 separate VGAM precursor RNAs, VGAM795 precursor RNA and VGAM796 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM795 RNA and VGAM796 RNA, herein schematically represented by VGAM1 RNA through VGAM3 RNA, each of which VGAM RNAs corresponding to VGAM RNA of FIG. 1.

VGAM795 RNA, herein schematically represented by VGAM1 RNA through VGAM3 RNA, binds complementarily to a host target binding site located in an untranslated region of VGAM795 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM795 host target RNA into VGAM795 host target protein, herein schematically represented by VGAM1 HOST TARGET PROTEIN through VGAM3 HOST TARGET PROTEIN, all of FIG. 1.

VGAM796 RNA, herein schematically represented by VGAM1 RNA through VGAM3 RNA, binds complementarily to a host target binding site located in an untranslated region of VGAM796 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM796 host target RNA into VGAM796 host target protein, herein schematically represented by VGAM1 HOST TARGET PROTEIN through VGAM3 HOST TARGET PROTEIN, all of FIG. 1.

It is appreciated that a function of VGR2893 gene, herein designated VGR GENE, is inhibition of expression of host target genes, as part of a novel viral mechanism of attacking a host. Accordingly, utilities of VGR2893 gene include diagnosis, prevention and treatment of viral infection by Shrimp White Spot Syndrome Virus (white spot bacilliform virus). Specific functions, and accordingly utilities, of VGR2893 gene correlate with, and may be deduced from, the identity of the host target genes, which are inhibited by VGAM RNAs comprised in the 'operon-like' cluster of VGR2893 gene: VGAM795 host target protein and VGAM796 host target protein, herein schematically represented by VGAM1 HOST TARGET PROTEIN through VGAM3 HOST TARGET PROTEIN. The function of these host target genes is elaborated hereinabove with reference to VGAM795 and VGAM796. FIG. 9 further provides a conceptual description of novel bioinformatically detected regulatory viral gene, referred to here as Viral Genomic Record 2894(VGR2894) viral gene, which encodes an 'operon-like' cluster of novel viral micro RNA-like genes, each of which in turn modulates expression of at least one host target gene, the function and utility of which at least one host target gene is known in the art.

VGR2894 gene, herein designated VGR GENE, is a novel bioinformatically detected regulatory, non protein coding, RNA viral gene. The method by which VGR2894 gene was detected is described hereinabove with reference to FIGS. 1-9.

VGR2894 gene encodes VGR2894 precursor RNA, herein designated VGR PRECURSOR RNA, an RNA molecule, typically several hundred nucleotides long.

VGR2894 precursor RNA folds spatially, forming VGR2894 folded precursor RNA, herein designated VGR FOLDED PRECURSOR RNA. It is appreciated that VGR2894 folded precursor RNA comprises a plurality of what is known in the art as 'hairpin' structures. These 'hairpin' structures are due to the fact that the nucleotide sequence of VGR2894 precursor RNA comprises a plurality of segments, the first half of each such segment having a nucleotide sequence which is at least a partial inversed-reversed sequence of the second half thereof, as is well known in the art.

VGR2894 folded precursor RNA is naturally processed by cellular enzymatic activity into at least 2 separate VGAM precursor RNAs, VGAM797 precursor RNA and VGAM798 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM797 RNA and VGAM798 RNA, herein schematically represented by VGAM1 RNA through VGAM3 RNA, each of which VGAM RNAs corresponding to VGAM RNA of FIG. 1.

VGAM797 RNA, herein schematically represented by VGAM1 RNA through VGAM3 RNA, binds complementarily to a host target binding site located in an untranslated region of VGAM797 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM797 host target RNA into VGAM797 host target protein, herein schematically represented by VGAM1 HOST TARGET PROTEIN through VGAM3 HOST TARGET PROTEIN, all of FIG. 1.

VGAM798 RNA, herein schematically represented by VGAM1 RNA through VGAM3 RNA, binds complementarily to a host target binding site located in an untranslated region of VGAM798 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM798 host target RNA into VGAM798 host target protein, herein schematically represented by VGAM1 HOST TARGET PROTEIN through VGAM3 HOST TARGET PROTEIN, all of FIG. 1.

It is appreciated that a function of VGR2894 gene, herein designated VGR GENE, is inhibition of expression of host target genes, as part of a novel viral mechanism of attacking a host. Accordingly, utilities of VGR2894 gene include diagnosis, prevention and treatment of viral infection by Shrimp White Spot Syndrome Virus (white spot bacilliform virus). Specific functions, and accordingly utilities, of VGR2894 gene correlate with, and may be deduced from, the identity of the host target genes, which are inhibited by VGAM RNAs comprised in the 'operon-like' cluster of VGR2894 gene: VGAM797 host target protein and VGAM798 host target protein, herein schematically represented by VGAM1 HOST TARGET PROTEIN through VGAM3 HOST TARGET PROTEIN. The function of these host target genes is elaborated hereinabove with reference to VGAM797 and VGAM798. FIG. 9 further provides a conceptual description of novel bioinformatically detected regulatory viral gene, referred to here as Viral Genomic Record 2895(VGR2895) viral gene, which encodes an 'operon-like' cluster of novel viral micro RNA-like genes, each of which in turn modulates expression of at least one host target gene, the function and utility of which at least one host target gene is known in the art.

VGR2895 gene, herein designated VGR GENE, is a novel bioinformatically detected regulatory, non protein coding, RNA viral gene. The method by which VGR2895 gene was detected is described hereinabove with reference to FIGS. 1-9.

VGR2895 gene encodes VGR2895 precursor RNA, herein designated VGR PRECURSOR RNA, an RNA molecule, typically several hundred nucleotides long.

VGR2895 precursor RNA folds spatially, forming VGR2895 folded precursor RNA, herein designated VGR FOLDED PRECURSOR RNA. It is appreciated that VGR2895 folded precursor RNA comprises a plurality of what is known in the art as 'hairpin' structures. These 'hairpin' structures are due to the fact that the nucleotide sequence of VGR2895 precursor RNA comprises a plurality of segments, the first half of each such segment having a nucleotide sequence which is at least a partial inversed-reversed sequence of the second half thereof, as is well known in the art.

VGR2895 folded precursor RNA is naturally processed by cellular enzymatic activity into at least 2 separate VGAM precursor RNAs, VGAM799 precursor RNA and VGAM800 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM799 RNA and VGAM800 RNA, herein schematically represented by VGAM1 RNA through VGAM3 RNA, each of which VGAM RNAs corresponding to VGAM RNA of FIG. 1.

VGAM799 RNA, herein schematically represented by VGAM1 RNA through VGAM3 RNA, binds complementarily to a host target binding site located in an untranslated region of VGAM799 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM799 host target RNA into VGAM799 host target protein, herein schematically represented by VGAM1 HOST TARGET PROTEIN through VGAM3 HOST TARGET PROTEIN, all of FIG. 1.

VGAM800 RNA, herein schematically represented by VGAM1 RNA through VGAM3 RNA, binds complementarily to a host target binding site located in an untranslated region of VGAM800 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM800 host target RNA into VGAM800 host target protein, herein schematically represented by VGAM1 HOST TARGET PROTEIN through VGAM3 HOST TARGET PROTEIN, all of FIG. 1.

It is appreciated that a function of VGR2895 gene, herein designated VGR GENE, is inhibition of expression of host target genes, as part of a novel viral mechanism of attacking a host. Accordingly, utilities of VGR2895 gene include diagnosis, prevention and treatment of viral infection by Shrimp White Spot Syndrome Virus (white spot bacilliform virus). Specific functions, and accordingly utilities, of VGR2895 gene correlate with, and may be deduced from, the identity of the host target genes, which are inhibited by VGAM RNAs comprised in the 'operon-like' cluster of VGR2895 gene: VGAM799 host target protein and VGAM800 host target protein, herein schematically represented by VGAM1 HOST TARGET PROTEIN through VGAM3 HOST TARGET PROTEIN. The function of these host target genes is elaborated hereinabove with reference to VGAM799 and VGAM800. FIG. 9 further provides a conceptual description of novel bioinformatically detected regulatory viral gene, referred to here as Viral Genomic Record 2896(VGR2896) viral gene, which encodes an 'operon-like' cluster of novel viral micro RNA-like genes, each of which in turn modulates expression of at least one host target gene, the function and utility of which at least one host target gene is known in the art.

VGR2896 gene, herein designated VGR GENE, is a novel bioinformatically detected regulatory, non protein coding, RNA viral gene. The method by which VGR2896 gene was detected is described hereinabove with reference to FIGS. 1-9.

VGR2896 gene encodes VGR2896 precursor RNA, herein designated VGR PRECURSOR RNA, an RNA molecule, typically several hundred nucleotides long.

VGR2896 precursor RNA folds spatially, forming VGR2896 folded precursor RNA, herein designated VGR FOLDED PRECURSOR RNA. It is appreciated that VGR2896 folded precursor RNA comprises a plurality of what is known in the art as 'hairpin' structures. These 'hairpin' structures are due to the fact that the nucleotide sequence of VGR2896 precursor RNA comprises a plurality of segments, the first half of each such segment having a nucleotide sequence which is at least a partial inversed-reversed sequence of the second half thereof, as is well known in the art.

VGR2896 folded precursor RNA is naturally processed by cellular enzymatic activity into at least 3 separate VGAM precursor RNAs, VGAM801 precursor RNA, VGAM802 precursor RNA and VGAM803 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM801 RNA, VGAM802 RNA and VGAM803 RNA, herein schematically represented by VGAM1 RNA through VGAM3 RNA, each of which VGAM RNAs corresponding to VGAM RNA of FIG. 1.

VGAM801 RNA, herein schematically represented by VGAM1 RNA through VGAM3 RNA, binds complementarily to a host target binding site located in an untranslated region of VGAM801 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM801 host target RNA into VGAM801 host target protein, herein schematically represented by VGAM1 HOST TARGET PROTEIN through VGAM3 HOST TARGET PROTEIN, all of FIG. 1.

VGAM802 RNA, herein schematically represented by VGAM1 RNA through VGAM3 RNA, binds complementarily to a host target binding site located in an untranslated region of VGAM802 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM802 host target RNA into VGAM802 host target protein, herein schematically represented by VGAM1 HOST TARGET PROTEIN through VGAM3 HOST TARGET PROTEIN, all of FIG. 1.

VGAM803 RNA, herein schematically represented by VGAM1 RNA through VGAM3 RNA, binds complementarily to a host target binding site located in an untranslated region of VGAM803 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM803 host target RNA into VGAM803 host target protein, herein schematically represented by VGAM1 HOST TARGET PROTEIN through VGAM3 HOST TARGET PROTEIN, all of FIG. 1.

It is appreciated that a function of VGR2896 gene, herein designated VGR GENE, is inhibition of expression of host target genes, as part of a novel viral mechanism of attacking a host. Accordingly, utilities of VGR2896 gene include diagnosis, prevention and treatment of viral infection by Murid Herpesvirus 4. Specific functions, and accordingly utilities, of VGR2896 gene correlate with, and may be deduced from, the identity of the host target genes, which are inhibited by VGAM RNAs comprised in the 'operon-like' cluster of VGR2896 gene: VGAM801 host target protein, VGAM802 host target protein and VGAM803 host target protein, herein schematically represented by VGAM1 HOST TARGET PROTEIN through VGAM3 HOST TARGET PROTEIN. The function of these host target genes is elaborated hereinabove with reference to VGAM801, VGAM802 and VGAM803. FIG. 9 further provides a conceptual description of novel bioinformatically detected regulatory viral gene, referred to here as Viral Genomic Record 2897(VGR2897) viral gene, which encodes an 'operon-like' cluster of novel viral micro RNA-like genes, each of which in turn modulates expression of at least one host target gene, the function and utility of which at least one host target gene is known in the art.

VGR2897 gene, herein designated VGR GENE, is a novel bioinformatically detected regulatory, non protein coding, RNA viral gene. The method by which VGR2897 gene was detected is described hereinabove with reference to FIGS. 1-9.

VGR2897 gene encodes VGR2897 precursor RNA, herein designated VGR PRECURSOR RNA, an RNA molecule, typically several hundred nucleotides long.

VGR2897 precursor RNA folds spatially, forming VGR2897 folded precursor RNA, herein designated VGR FOLDED PRECURSOR RNA. It is appreciated that VGR2897 folded precursor RNA comprises a plurality of what is known in the art as 'hairpin' structures. These 'hairpin' structures are due to the fact that the nucleotide sequence of VGR2897 precursor RNA comprises a plurality of segments, the first half of each such segment having a nucleotide sequence which is at least a partial inversed-reversed sequence of the second half thereof, as is well known in the art.

VGR2897 folded precursor RNA is naturally processed by cellular enzymatic activity into at least 3 separate VGAM precursor RNAs, VGAM807 precursor RNA, VGAM808 precursor RNA and VGAM809 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM807 RNA, VGAM808 RNA and VGAM809 RNA, herein schematically represented by VGAM1 RNA through VGAM3 RNA, each of which VGAM RNAs corresponding to VGAM RNA of FIG. 1.

VGAM807 RNA, herein schematically represented by VGAM1 RNA through VGAM3 RNA, binds complementarily to a host target binding site located in an untranslated region of VGAM807 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM807 host target RNA into VGAM807 host target protein, herein schematically represented by VGAM1 HOST TARGET PROTEIN through VGAM3 HOST TARGET PROTEIN, all of FIG. 1.

VGAM808 RNA, herein schematically represented by VGAM1 RNA through VGAM3 RNA, binds complementarily to a host target binding site located in an untranslated region of VGAM808 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM808 host target RNA into VGAM808 host target protein, herein schematically represented by VGAM1 HOST TARGET PROTEIN through VGAM3 HOST TARGET PROTEIN, all of FIG. 1.

VGAM809 RNA, herein schematically represented by VGAM1 RNA through VGAM3 RNA, binds complementarily to a host target binding site located in an untranslated region of VGAM809 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM809 host target RNA into VGAM809 host target protein, herein schematically represented by VGAM1 HOST TARGET PROTEIN through VGAM3 HOST TARGET PROTEIN, all of FIG. 1.

It is appreciated that a function of VGR2897 gene, herein designated VGR GENE, is inhibition of expression of host target genes, as part of a novel viral mechanism of attacking a host. Accordingly, utilities of VGR2897 gene include diagnosis, prevention and treatment of viral infection by Equine Herpesvirus 2. Specific functions, and accordingly utilities, of VGR2897 gene correlate with, and may be deduced from, the identity of the host target genes, which are inhibited by VGAM RNAs comprised in the 'operon-like' cluster of VGR2897 gene: VGAM807 host target protein, VGAM808 host target protein and VGAM809 host target protein, herein schematically represented by VGAM1 HOST TARGET PROTEIN through VGAM3 HOST TARGET PROTEIN. The function of these host target genes is elaborated hereinabove with reference to VGAM807, VGAM808 and VGAM809. FIG. 9 further provides a conceptual description of novel bioinformatically detected regulatory viral gene, referred to here as Viral Genomic Record 2898(VGR2898) viral gene, which encodes an 'operon-like' cluster of novel viral micro RNA-like genes, each of which in turn modulates expression of at least one host target gene, the function and utility of which at least one host target gene is known in the art.

VGR2898 gene, herein designated VGR GENE, is a novel bioinformatically detected regulatory, non protein coding, RNA viral gene. The method by which VGR2898 gene was detected is described hereinabove with reference to FIGS. 1-9.

VGR2898 gene encodes VGR2898 precursor RNA, herein designated VGR PRECURSOR RNA, an RNA molecule, typically several hundred nucleotides long.

VGR2898 precursor RNA folds spatially, forming VGR2898 folded precursor RNA, herein designated VGR FOLDED PRECURSOR RNA. It is appreciated that VGR2898 folded precursor RNA comprises a plurality of what is known in the art as 'hairpin' structures. These 'hairpin' structures are due to the fact that the nucleotide sequence of VGR2898 precursor RNA comprises a plurality of segments, the first half of each such segment having a nucleotide sequence which is at least a partial inversed-reversed sequence of the second half thereof, as is well known in the art.

VGR2898 folded precursor RNA is naturally processed by cellular enzymatic activity into at least 3 separate VGAM precursor RNAs, VGAM812 precursor RNA, VGAM813 precursor RNA and VGAM814 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM812 RNA, VGAM813 RNA and VGAM814 RNA, herein schematically represented by VGAM1 RNA through VGAM3 RNA, each of which VGAM RNAs corresponding to VGAM RNA of FIG. 1.

VGAM812 RNA, herein schematically represented by VGAM1 RNA through VGAM3 RNA, binds complementarily to a host target binding site located in an untranslated region of VGAM812 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM812 host target RNA into VGAM812 host target protein, herein schematically represented by VGAM1 HOST TARGET PROTEIN through VGAM3 HOST TARGET PROTEIN, all of FIG. 1.

VGAM813 RNA, herein schematically represented by VGAM1 RNA through VGAM3 RNA, binds complementarily to a host target binding site located in an untranslated region of VGAM813 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM813 host target RNA into VGAM813 host target protein, herein schematically represented by VGAM1 HOST TARGET PROTEIN through VGAM3 HOST TARGET PROTEIN, all of FIG. 1.

VGAM814 RNA, herein schematically represented by VGAM1 RNA through VGAM3 RNA, binds complementarily to a host target binding site located in an untranslated region of VGAM814 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM814 host target RNA into VGAM814 host target protein, herein schematically represented by VGAM1 HOST TARGET PROTEIN through VGAM3 HOST TARGET PROTEIN, all of FIG. 1.

It is appreciated that a function of VGR2898 gene, herein designated VGR GENE, is inhibition of expression of host target genes, as part of a novel viral mechanism of attacking a host. Accordingly, utilities of VGR2898 gene include diagnosis, prevention and treatment of viral infection by Murid Herpesvirus 4. Specific functions, and accordingly utilities, of VGR2898 gene correlate with, and may be deduced from, the identity of the host target genes, which are inhibited by VGAM RNAs comprised in the 'operon-like' cluster of VGR2898 gene: VGAM812 host target protein, VGAM813 host target protein and VGAM814 host target protein, herein schematically represented by VGAM1 HOST TARGET PROTEIN through VGAM3 HOST TARGET PROTEIN. The function of these host target genes is elaborated hereinabove with reference to VGAM812, VGAM813 and VGAM814. FIG. 9 further provides a conceptual description of novel bioinformatically detected regulatory viral gene, referred to here as Viral Genomic Record 2899(VGR2899) viral gene, which encodes an 'operon-like' cluster of novel viral micro RNA-like genes, each of which in turn modulates expression of at least one host target gene, the function and utility of which at least one host target gene is known in the art.

VGR2899 gene, herein designated VGR GENE, is a novel bioinformatically detected regulatory, non protein coding, RNA viral gene. The method by which VGR2899 gene was detected is described hereinabove with reference to FIGS. 1-9.

VGR2899 gene encodes VGR2899 precursor RNA, herein designated VGR PRECURSOR RNA, an RNA molecule, typically several hundred nucleotides long.

VGR2899 precursor RNA folds spatially, forming VGR2899 folded precursor RNA, herein designated VGR FOLDED PRECURSOR RNA. It is appreciated that VGR2899 folded precursor RNA comprises a plurality of what is known in the art as 'hairpin' structures. These 'hairpin' structures are due to the fact that the nucleotide sequence of VGR2899 precursor RNA comprises a plurality of segments, the first half of each such segment having a nucleotide sequence which is at least a partial inversed-reversed sequence of the second half thereof, as is well known in the art.

VGR2899 folded precursor RNA is naturally processed by cellular enzymatic activity into at least 2 separate VGAM precursor RNAs, VGAM815 precursor RNA and VGAM816 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM815 RNA and VGAM816 RNA, herein schematically represented by VGAM1 RNA through VGAM3 RNA, each of which VGAM RNAs corresponding to VGAM RNA of FIG. 1.

VGAM815 RNA, herein schematically represented by VGAM1 RNA through VGAM3 RNA, binds complementarily to a host target binding site located in an untranslated region of VGAM815 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM815 host target RNA into VGAM815 host target protein, herein schematically represented by VGAM1 HOST TARGET PROTEIN through VGAM3 HOST TARGET PROTEIN, all of FIG. 1.

VGAM816 RNA, herein schematically represented by VGAM1 RNA through VGAM3 RNA, binds complementarily to a host target binding site located in an untranslated region of VGAM816 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM816 host target RNA into VGAM816 host target protein, herein schematically represented by VGAM1 HOST TARGET PROTEIN through VGAM3 HOST TARGET PROTEIN, all of FIG. 1.

It is appreciated that a function of VGR2899 gene, herein designated VGR GENE, is inhibition of expression of host target genes, as part of a novel viral mechanism of attacking a host. Accordingly, utilities of VGR2899 gene include diagnosis, prevention and treatment of viral infection by Macaca Mulatta Rhadinovirus. Specific functions, and accordingly utilities, of VGR2899 gene correlate with, and may be deduced from, the identity of the host target genes, which are inhibited by VGAM RNAs comprised in the 'operon-like' cluster of VGR2899 gene: VGAM815 host target protein and VGAM816 host target protein, herein schematically represented by VGAM1 HOST TARGET PROTEIN through VGAM3 HOST TARGET PROTEIN. The function of these host target genes is elaborated hereinabove with reference to VGAM815 and VGAM816. FIG. 9 further provides a conceptual description of novel bioinformatically detected regulatory viral gene, referred to here as Viral Genomic Record 2900(VGR2900) viral gene, which encodes an 'operon-like' cluster of novel viral micro RNA-like genes, each of which in turn modulates expression of at least one host target gene, the function and utility of which at least one host target gene is known in the art.

VGR2900 gene, herein designated VGR GENE, is a novel bioinformatically detected regulatory, non protein coding, RNA viral gene. The method by which VGR2900 gene was detected is described hereinabove with reference to FIGS. 1-9.

VGR2900 gene encodes VGR2900 precursor RNA, herein designated VGR PRECURSOR RNA, an RNA molecule, typically several hundred nucleotides long.

VGR2900 precursor RNA folds spatially, forming VGR2900 folded precursor RNA, herein designated VGR FOLDED PRECURSOR RNA. It is appreciated that VGR2900 folded precursor RNA comprises a plurality of what is known in the art as 'hairpin' structures. These 'hairpin' structures are due to the fact that the nucleotide sequence of VGR2900 precursor RNA comprises a plurality of segments, the first half of each such segment having a nucleotide sequence which is at least a partial inversed-reversed sequence of the second half thereof, as is well known in the art.

VGR2900 folded precursor RNA is naturally processed by cellular enzymatic activity into at least 2 separate VGAM precursor RNAs, VGAM821 precursor RNA and VGAM822 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM821 RNA and VGAM822 RNA, herein schematically represented by VGAM1 RNA through VGAM3 RNA, each of which VGAM RNAs corresponding to VGAM RNA of FIG. 1.

VGAM821 RNA, herein schematically represented by VGAM1 RNA through VGAM3 RNA, binds complementarily to a host target binding site located in an untranslated region of VGAM821 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM821 host target RNA into VGAM821 host target protein, herein schematically represented by VGAM1 HOST TARGET PROTEIN through VGAM3 HOST TARGET PROTEIN, all of FIG. 1.

VGAM822 RNA, herein schematically represented by VGAM1 RNA through VGAM3 RNA, binds complementarily to a host target binding site located in an untranslated region of VGAM822 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM822 host target RNA into VGAM822 host target protein, herein schematically represented by VGAM1 HOST TARGET PROTEIN through VGAM3 HOST TARGET PROTEIN, all of FIG. 1.

It is appreciated that a function of VGR2900 gene, herein designated VGR GENE, is inhibition of expression of host target genes, as part of a novel viral mechanism of attacking a host. Accordingly, utilities of VGR2900 gene include diagnosis, prevention and treatment of viral infection by Human Herpesvirus 6. Specific functions, and accordingly utilities, of VGR2900 gene correlate with, and may be deduced from, the identity of the host target genes, which are inhibited by VGAM RNAs comprised in the 'operon-like' cluster of VGR2900 gene: VGAM821 host target protein and VGAM822 host target protein, herein schematically represented by VGAM1 HOST TARGET PROTEIN through VGAM3 HOST TARGET PROTEIN. The function of these host target genes is elaborated hereinabove with reference to VGAM821 and VGAM822. FIG. 9 further provides a conceptual description of novel bioinformatically detected regulatory viral gene, referred to here as Viral Genomic Record 2901 (VGR2901) viral gene, which encodes an 'operon-like' cluster of novel viral micro RNA-like genes, each of which in turn modulates expression of at least one host target gene, the function and utility of which at least one host target gene is known in the art.

VGR2901 gene, herein designated VGR GENE, is a novel bioinformatically detected regulatory, non protein coding, RNA viral gene. The method by which VGR2901 gene was detected is described hereinabove with reference to FIGS. 1-9.

VGR2901 gene encodes VGR2901 precursor RNA, herein designated VGR PRECURSOR RNA, an RNA molecule, typically several hundred nucleotides long.

VGR2901 precursor RNA folds spatially, forming VGR2901 folded precursor RNA, herein designated VGR FOLDED PRECURSOR RNA. It is appreciated that VGR2901 folded precursor RNA comprises a plurality of what is known in the art as 'hairpin' structures. These 'hairpin' structures are due to the fact that the nucleotide sequence of VGR2901 precursor RNA comprises a plurality of segments, the first half of each such segment having a nucleotide sequence which is at least a partial inversed-reversed sequence of the second half thereof, as is well known in the art.

VGR2901 folded precursor RNA is naturally processed by cellular enzymatic activity into at least 2 separate VGAM precursor RNAs, VGAM823 precursor RNA and VGAM824 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM823 RNA and VGAM824 RNA, herein schematically represented by VGAM1 RNA through VGAM3 RNA, each of which VGAM RNAs corresponding to VGAM RNA of FIG. 1.

VGAM823 RNA, herein schematically represented by VGAM1 RNA through VGAM3 RNA, binds complementarily to a host target binding site located in an untranslated region of VGAM823 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM823 host target RNA into VGAM823 host target protein, herein schematically represented by VGAM1 HOST TARGET PROTEIN through VGAM3 HOST TARGET PROTEIN, all of FIG. 1.

VGAM824 RNA, herein schematically represented by VGAM1 RNA through VGAM3 RNA, binds complementarily to a host target binding site located in an untranslated region of VGAM824 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM824 host target RNA into VGAM824 host target protein, herein schematically represented by VGAM1 HOST TARGET PROTEIN through VGAM3 HOST TARGET PROTEIN, all of FIG. 1.

It is appreciated that a function of VGR2901 gene, herein designated VGR GENE, is inhibition of expression of host target genes, as part of a novel viral mechanism of attacking a host. Accordingly, utilities of VGR2901 gene include diagnosis, prevention and treatment of viral infection by African Swine Fever Virus. Specific functions, and accordingly utilities, of VGR2901 gene correlate with, and may be deduced from, the identity of the host target genes, which are inhibited by VGAM RNAs comprised in the 'operon-like' cluster of VGR2901 gene: VGAM823 host target protein and VGAM824 host target protein, herein schematically represented by VGAM1 HOST TARGET PROTEIN through VGAM3 HOST TARGET PROTEIN. The function of these host target genes is elaborated hereinabove with reference to VGAM823 and VGAM824. FIG. 9 further provides a conceptual description of novel bioinformatically detected regulatory viral gene, referred to here as Viral Genomic Record 2902(VGR2902) viral gene, which encodes an 'operon-like' cluster of novel viral micro RNA-like genes, each of which in turn modulates expression of at least one host target gene, the function and utility of which at least one host target gene is known in the art.

VGR2902 gene, herein designated VGR GENE, is a novel bioinformatically detected regulatory, non protein coding, RNA viral gene. The method by which VGR2902 gene was detected is described hereinabove with reference to FIGS. 1-9.

VGR2902 gene encodes VGR2902 precursor RNA, herein designated VGR PRECURSOR RNA, an RNA molecule, typically several hundred nucleotides long.

VGR2902 precursor RNA folds spatially, forming VGR2902 folded precursor RNA, herein designated VGR FOLDED PRECURSOR RNA. It is appreciated that VGR2902 folded precursor RNA comprises a plurality of what is known in the art as 'hairpin' structures. These 'hairpin' structures are due to the fact that the nucleotide sequence of VGR2902 precursor RNA comprises a plurality of segments, the first half of each such segment having a nucleotide sequence which is at least a partial inversed-reversed sequence of the second half thereof, as is well known in the art.

VGR2902 folded precursor RNA is naturally processed by cellular enzymatic activity into at least 2 separate VGAM precursor RNAs, VGAM826 precursor RNA and VGAM827 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM826 RNA and VGAM827 RNA, herein schematically represented by VGAM1 RNA through VGAM3 RNA, each of which VGAM RNAs corresponding to VGAM RNA of FIG. 1.

VGAM826 RNA, herein schematically represented by VGAM1 RNA through VGAM3 RNA, binds complementarily to a host target binding site located in an untranslated region of VGAM826 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM826 host target RNA into VGAM826 host target protein, herein schematically represented by VGAM1 HOST TARGET PROTEIN through VGAM3 HOST TARGET PROTEIN, all of FIG. 1.

VGAM827 RNA, herein schematically represented by VGAM1 RNA through VGAM3 RNA, binds complementarily to a host target binding site located in an untranslated region of VGAM827 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM827 host target RNA into VGAM827 host target protein, herein schematically represented by VGAM1 HOST TARGET PROTEIN through VGAM3 HOST TARGET PROTEIN, all of FIG. 1.

It is appreciated that a function of VGR2902 gene, herein designated VGR GENE, is inhibition of expression of host target genes, as part of a novel viral mechanism of attacking a host. Accordingly, utilities of VGR2902 gene include diagnosis, prevention and treatment of viral infection by Bovine Herpesvirus 4. Specific functions, and accordingly utilities, of VGR2902 gene correlate with, and may be deduced from, the identity of the host target genes, which are inhibited by VGAM RNAs comprised in the 'operon-like' cluster of VGR2902 gene: VGAM826 host target protein and VGAM827 host target protein, herein schematically represented by VGAM1 HOST TARGET PROTEIN through VGAM3 HOST TARGET PROTEIN. The function of these host target genes is elaborated hereinabove with reference to VGAM826 and VGAM827. FIG. 9 further provides a conceptual description of novel bioinformatically detected regulatory viral gene, referred to here as Viral Genomic Record 2903(VGR2903) viral gene, which encodes an 'operon-like' cluster of novel viral micro RNA-like genes, each of which in turn modulates expression of at least one host target gene, the function and utility of which at least one host target gene is known in the art.

VGR2903 gene, herein designated VGR GENE, is a novel bioinformatically detected regulatory, non protein coding, RNA viral gene. The method by which VGR2903 gene was detected is described hereinabove with reference to FIGS. 1-9.

VGR2903 gene encodes VGR2903 precursor RNA, herein designated VGR PRECURSOR RNA, an RNA molecule, typically several hundred nucleotides long.

VGR2903 precursor RNA folds spatially, forming VGR2903 folded precursor RNA, herein designated VGR FOLDED PRECURSOR RNA. It is appreciated that VGR2903 folded precursor RNA comprises a plurality of what is known in the art as 'hairpin' structures. These 'hairpin' structures are due to the fact that the nucleotide sequence of VGR2903 precursor RNA comprises a plurality of segments, the first half of each such segment having a nucleotide sequence which is at least a partial inversed-reversed sequence of the second half thereof, as is well known in the art.

VGR2903 folded precursor RNA is naturally processed by cellular enzymatic activity into at least 3 separate VGAM precursor RNAs, VGAM828 precursor RNA, VGAM829 precursor RNA and VGAM830 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM828 RNA, VGAM829 RNA and VGAM830 RNA, herein schematically represented by VGAM1 RNA through VGAM3 RNA, each of which VGAM RNAs corresponding to VGAM RNA of FIG. 1.

VGAM828 RNA, herein schematically represented by VGAM1 RNA through VGAM3 RNA, binds complementarily to a host target binding site located in an untranslated region of VGAM828 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM828 host target RNA into VGAM828 host target protein, herein schematically represented by VGAM1 HOST TARGET PROTEIN through VGAM3 HOST TARGET PROTEIN, all of FIG. 1.

VGAM829 RNA, herein schematically represented by VGAM1 RNA through VGAM3 RNA, binds complementarily to a host target binding site located in an untranslated region of VGAM829 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM829 host target RNA into VGAM829 host target protein, herein schematically represented by VGAM1 HOST TARGET PROTEIN through VGAM3 HOST TARGET PROTEIN, all of FIG. 1.

VGAM830 RNA, herein schematically represented by VGAM1 RNA through VGAM3 RNA, binds complementarily to a host target binding site located in an untranslated region of VGAM830 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM830 host target RNA into VGAM830 host target protein, herein schematically represented by VGAM1 HOST TARGET PROTEIN through VGAM3 HOST TARGET PROTEIN, all of FIG. 1.

It is appreciated that a function of VGR2903 gene, herein designated VGR GENE, is inhibition of expression of host target genes, as part of a novel viral mechanism of attacking a host. Accordingly, utilities of VGR2903 gene include diagnosis, prevention and treatment of viral infection by African Swine Fever Virus. Specific functions, and accordingly utilities, of VGR2903 gene correlate with, and may be deduced from, the identity of the host target genes, which are inhibited by VGAM RNAs comprised in the 'operon-like' cluster of VGR2903 gene: VGAM828 host target protein, VGAM829 host target protein and VGAM830 host target protein, herein schematically represented by VGAM1 HOST TARGET PROTEIN through VGAM3 HOST TARGET PROTEIN. The function of these host target genes is elaborated hereinabove with reference to VGAM828, VGAM829 and VGAM830. FIG. 9 further provides a conceptual description of novel bioinformatically detected regulatory viral gene, referred to here as Viral Genomic Record 2904(VGR2904) viral gene, which encodes an 'operon-like' cluster of novel viral micro RNA-like genes, each of which in turn modulates expression of at least one host target gene, the function and utility of which at least one host target gene is known in the art.

VGR2904 gene, herein designated VGR GENE, is a novel bioinformatically detected regulatory, non protein coding, RNA viral gene. The method by which VGR2904 gene was detected is described hereinabove with reference to FIGS. 1-9.

VGR2904 gene encodes VGR2904 precursor RNA, herein designated VGR PRECURSOR RNA, an RNA molecule, typically several hundred nucleotides long.

VGR2904 precursor RNA folds spatially, forming VGR2904 folded precursor RNA, herein designated VGR FOLDED PRECURSOR RNA. It is appreciated that VGR2904 folded precursor RNA comprises a plurality of what is known in the art as 'hairpin' structures. These 'hairpin' structures are due to the fact that the nucleotide sequence of VGR2904 precursor RNA comprises a plurality of segments, the first half of each such segment having a nucleotide sequence which is at least a partial inversed-reversed sequence of the second half thereof, as is well known in the art.

VGR2904 folded precursor RNA is naturally processed by cellular enzymatic activity into at least 2 separate VGAM precursor RNAs, VGAM831 precursor RNA and VGAM832 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM831 RNA and VGAM832 RNA, herein schematically represented by VGAM1 RNA through VGAM3 RNA, each of which VGAM RNAs corresponding to VGAM RNA of FIG. 1.

VGAM831 RNA, herein schematically represented by VGAM1 RNA through VGAM3 RNA, binds complementarily to a host target binding site located in an untranslated region of VGAM831 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM831 host target RNA into VGAM831 host target protein, herein schematically represented by VGAM1 HOST TARGET PROTEIN through VGAM3 HOST TARGET PROTEIN, all of FIG. 1.

VGAM832 RNA, herein schematically represented by VGAM1 RNA through VGAM3 RNA, binds complementarily to a host target binding site located in an untranslated region of VGAM832 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM832 host target RNA into VGAM832 host target protein, herein schematically represented by VGAM1 HOST TARGET PROTEIN through VGAM3 HOST TARGET PROTEIN, all of FIG. 1.

It is appreciated that a function of VGR2904 gene, herein designated VGR GENE, is inhibition of expression of host target genes, as part of a novel viral mechanism of attacking a host. Accordingly, utilities of VGR2904 gene include diagnosis, prevention and treatment of viral infection by Human Herpesvirus 6B. Specific functions, and accordingly utilities, of VGR2904 gene correlate with, and may be deduced from, the identity of the host target genes, which are inhibited by VGAM RNAs comprised in the 'operon-like' cluster of VGR2904 gene: VGAM831 host target protein and VGAM832 host target protein, herein schematically represented by VGAM1 HOST TARGET PROTEIN through VGAM3 HOST TARGET PROTEIN. The function of these host target genes is elaborated hereinabove with reference to VGAM831 and VGAM832. FIG. 9 further provides a conceptual description of novel bioinformatically detected regulatory viral gene, referred to here as Viral Genomic Record 2905(VGR2905) viral gene, which encodes an 'operon-like' cluster of novel viral micro RNA-like genes, each of which in turn modulates expression of at least one host target gene, the function and utility of which at least one host target gene is known in the art.

VGR2905 gene, herein designated VGR GENE, is a novel bioinformatically detected regulatory, non protein coding, RNA viral gene. The method by which VGR2905 gene was detected is described hereinabove with reference to FIGS. 1-9.

VGR2905 gene encodes VGR2905 precursor RNA, herein designated VGR PRECURSOR RNA, an RNA molecule, typically several hundred nucleotides long.

VGR2905 precursor RNA folds spatially, forming VGR2905 folded precursor RNA, herein designated VGR FOLDED PRECURSOR RNA. It is appreciated that VGR2905 folded precursor RNA comprises a plurality of what is known in the art as 'hairpin' structures. These 'hairpin' structures are due to the fact that the nucleotide sequence of VGR2905 precursor RNA comprises a plurality of segments, the first half of each such segment having a nucleotide sequence which is at least a partial inversed-reversed sequence of the second half thereof, as is well known in the art.

VGR2905 folded precursor RNA is naturally processed by cellular enzymatic activity into at least 6 separate VGAM precursor RNAs, VGAM833 precursor RNA, VGAM834 precursor RNA, VGAM835 precursor RNA, VGAM836 precursor RNA, VGAM837 precursor RNA and VGAM838 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM833 RNA, VGAM834 RNA, VGAM835 RNA, VGAM836 RNA, VGAM837 RNA and VGAM838 RNA, herein schematically represented by VGAM1 RNA through VGAM3 RNA, each of which VGAM RNAs corresponding to VGAM RNA of FIG. 1.

VGAM833 RNA, herein schematically represented by VGAM1 RNA through VGAM3 RNA, binds complementarily to a host target binding site located in an untranslated region of VGAM833 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM833 host target RNA into VGAM833 host target protein, herein schematically represented by VGAM1 HOST TARGET PROTEIN through VGAM3 HOST TARGET PROTEIN, all of FIG. 1.

VGAM834 RNA, herein schematically represented by VGAM1 RNA through VGAM3 RNA, binds complementarily to a host target binding site located in an untranslated region of VGAM834 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM834 host target RNA into VGAM834 host target protein, herein schematically represented by VGAM1 HOST TARGET PROTEIN through VGAM3 HOST TARGET PROTEIN, all of FIG. 1.

VGAM835 RNA, herein schematically represented by VGAM1 RNA through VGAM3 RNA, binds complementarily to a host target binding site located in an untranslated region of VGAM835 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM835 host target RNA into VGAM835 host target protein, herein schematically represented by VGAM1 HOST TARGET PROTEIN through VGAM3 HOST TARGET PROTEIN, all of FIG. 1.

VGAM836 RNA, herein schematically represented by VGAM1 RNA through VGAM3 RNA, binds complementarily to a host target binding site located in an untranslated region of VGAM836 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM836 host target RNA into VGAM836 host target protein, herein schematically represented by VGAM1 HOST TARGET PROTEIN through VGAM3 HOST TARGET PROTEIN, all of FIG. 1.

VGAM837 RNA, herein schematically represented by VGAM1 RNA through VGAM3 RNA, binds complementarily to a host target binding site located in an untranslated region of VGAM837 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM837 host target RNA into VGAM837 host target protein, herein schematically represented by VGAM1 HOST TARGET PROTEIN through VGAM3 HOST TARGET PROTEIN, all of FIG. 1.

VGAM838 RNA, herein schematically represented by VGAM1 RNA through VGAM3 RNA, binds complementarily to a host target binding site located in an untranslated region of VGAM838 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM838 host target RNA into VGAM838 host target protein, herein schematically represented by VGAM1 HOST TARGET PROTEIN through VGAM3 HOST TARGET PROTEIN, all of FIG. 1.

It is appreciated that a function of VGR2905 gene, herein designated VGR GENE, is inhibition of expression of host target genes, as part of a novel viral mechanism of attacking a host. Accordingly, utilities of VGR2905 gene include diagnosis, prevention and treatment of viral infection by Monkeypox Virus. Specific functions, and accordingly utilities, of VGR2905 gene correlate with, and may be deduced from, the identity of the host target genes, which are inhibited by VGAM RNAs comprised in the 'operon-like' cluster of VGR2905 gene: VGAM833 host target protein, VGAM834 host target protein, VGAM835 host target protein, VGAM836 host target protein, VGAM837 host target protein and VGAM838 host target protein, herein schematically represented by VGAM1 HOST TARGET PROTEIN through VGAM3 HOST TARGET PROTEIN. The function of these host target genes is elaborated hereinabove with reference to VGAM833, VGAM834, VGAM835, VGAM836, VGAM837 and VGAM838. FIG. 9 further provides a conceptual description of novel bioinformatically detected regulatory viral gene, referred to here as Viral Genomic Record 2906(VGR2906) viral gene, which encodes an 'operon-like' cluster of novel viral micro RNA-like genes, each of which in turn modulates expression of at least one host target gene, the function and utility of which at least one host target gene is known in the art.

VGR2906 gene, herein designated VGR GENE, is a novel bioinformatically detected regulatory, non protein coding, RNA viral gene. The method by which VGR2906 gene was detected is described hereinabove with reference to FIGS. 1-9.

VGR2906 gene encodes VGR2906 precursor RNA, herein designated VGR PRECURSOR RNA, an RNA molecule, typically several hundred nucleotides long.

VGR2906 precursor RNA folds spatially, forming VGR2906 folded precursor RNA, herein designated VGR FOLDED PRECURSOR RNA. It is appreciated that VGR2906 folded precursor RNA comprises a plurality of what is known in the art as 'hairpin' structures. These 'hairpin' structures are due to the fact that the nucleotide sequence of VGR2906 precursor RNA comprises a plurality of segments, the first half of each such segment having a nucleotide sequence which is at least a partial inversed-reversed sequence of the second half thereof, as is well known in the art.

VGR2906 folded precursor RNA is naturally processed by cellular enzymatic activity into at least 2 separate VGAM precursor RNAs, VGAM841 precursor RNA and VGAM842 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM841 RNA and VGAM842 RNA, herein schematically represented by VGAM1 RNA through VGAM3 RNA, each of which VGAM RNAs corresponding to VGAM RNA of FIG. 1.

VGAM841 RNA, herein schematically represented by VGAM1 RNA through VGAM3 RNA, binds complementarily to a host target binding site located in an untranslated region of VGAM841 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM841 host target RNA into VGAM841 host target protein, herein schematically represented by VGAM1 HOST TARGET PROTEIN through VGAM3 HOST TARGET PROTEIN, all of FIG. 1.

VGAM842 RNA, herein schematically represented by VGAM1 RNA through VGAM3 RNA, binds complementarily to a host target binding site located in an untranslated region of VGAM842 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM842 host target RNA into VGAM842 host target protein, herein schematically represented by VGAM1 HOST TARGET PROTEIN through VGAM3 HOST TARGET PROTEIN, all of FIG. 1.

It is appreciated that a function of VGR2906 gene, herein designated VGR GENE, is inhibition of expression of host target genes, as part of a novel viral mechanism of attacking a host. Accordingly, utilities of VGR2906 gene include diagnosis, prevention and treatment of viral infection by Equine Herpesvirus 2. Specific functions, and accordingly utilities, of VGR2906 gene correlate with, and may be deduced from, the identity of the host target genes, which are inhibited by VGAM RNAs comprised in the 'operon-like' cluster of VGR2906 gene: VGAM841 host target protein and VGAM842 host target protein, herein schematically represented by VGAM1 HOST TARGET PROTEIN through VGAM3 HOST TARGET PROTEIN. The function of these host target genes is elaborated hereinabove with reference to VGAM841 and VGAM842. FIG. 9 further provides a conceptual description of novel bioinformatically detected regulatory viral gene, referred to here as Viral Genomic Record 2907(VGR2907) viral gene, which encodes an 'operon-like' cluster of novel viral micro RNA-like genes, each of which in turn modulates expression of at least one host target gene, the function and utility of which at least one host target gene is known in the art.

VGR2907 gene, herein designated VGR GENE, is a novel bioinformatically detected regulatory, non protein coding, RNA viral gene. The method by which VGR2907 gene was detected is described hereinabove with reference to FIGS. 1-9.

VGR2907 gene encodes VGR2907 precursor RNA, herein designated VGR PRECURSOR RNA, an RNA molecule, typically several hundred nucleotides long.

VGR2907 precursor RNA folds spatially, forming VGR2907 folded precursor RNA, herein designated VGR FOLDED PRECURSOR RNA. It is appreciated that VGR2907 folded precursor RNA comprises a plurality of what is known in the art as 'hairpin' structures. These 'hairpin' structures are due to the fact that the nucleotide sequence of VGR2907 precursor RNA comprises a plurality of segments, the first half of each such segment having a nucleotide sequence which is at least a partial inversed-reversed sequence of the second half thereof, as is well known in the art.

VGR2907 folded precursor RNA is naturally processed by cellular enzymatic activity into at least 2 separate VGAM precursor RNAs, VGAM843 precursor RNA and VGAM844 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM843 RNA and VGAM844 RNA, herein schematically represented by VGAM1 RNA through VGAM3 RNA, each of which VGAM RNAs corresponding to VGAM RNA of FIG. 1.

VGAM843 RNA, herein schematically represented by VGAM1 RNA through VGAM3 RNA, binds complementarily to a host target binding site located in an untranslated region of VGAM843 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM843 host target RNA into VGAM843 host target protein, herein schematically represented by VGAM1 HOST TARGET PROTEIN through VGAM3 HOST TARGET PROTEIN, all of FIG. 1.

VGAM844 RNA, herein schematically represented by VGAM1 RNA through VGAM3 RNA, binds complementarily to a host target binding site located in an untranslated region of VGAM844 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM844 host target RNA into VGAM844 host target protein, herein schematically represented by VGAM1 HOST TARGET PROTEIN through VGAM3 HOST TARGET PROTEIN, all of FIG. 1.

It is appreciated that a function of VGR2907 gene, herein designated VGR GENE, is inhibition of expression of host target genes, as part of a novel viral mechanism of attacking a host. Accordingly, utilities of VGR2907 gene include diagnosis, prevention and treatment of viral infection by Monkeypox Virus. Specific functions, and accordingly utilities, of VGR2907 gene correlate with, and may be deduced from, the identity of the host target genes, which are inhibited by VGAM RNAs comprised in the 'operon-like' cluster of VGR2907 gene: VGAM843 host target protein and VGAM844 host target protein, herein schematically represented by VGAM1 HOST TARGET PROTEIN through VGAM3 HOST TARGET PROTEIN. The function of these host target genes is elaborated hereinabove with reference to VGAM843 and VGAM844. FIG. 9 further provides a conceptual description of novel bioinformatically detected regulatory viral gene, referred to here as Viral Genomic Record 2908(VGR2908) viral gene, which encodes an 'operon-like' cluster of novel viral micro RNA-like genes, each of which in turn modulates expression of at least one host target gene, the function and utility of which at least one host target gene is known in the art.

VGR2908 gene, herein designated VGR GENE, is a novel bioinformatically detected regulatory, non protein coding, RNA viral gene. The method by which VGR2908 gene was detected is described hereinabove with reference to FIGS. 1-9.

VGR2908 gene encodes VGR2908 precursor RNA, herein designated VGR PRECURSOR RNA, an RNA molecule, typically several hundred nucleotides long.

VGR2908 precursor RNA folds spatially, forming VGR2908 folded precursor RNA, herein designated VGR FOLDED PRECURSOR RNA. It is appreciated that VGR2908 folded precursor RNA comprises a plurality of what is known in the art as 'hairpin' structures. These 'hairpin' structures are due to the fact that the nucleotide sequence of VGR2908 precursor RNA comprises a plurality of segments, the first half of each such segment having a nucleotide sequence which is at least a partial inversed-reversed sequence of the second half thereof, as is well known in the art.

VGR2908 folded precursor RNA is naturally processed by cellular enzymatic activity into at least 4 separate VGAM precursor RNAs, VGAM845 precursor RNA, VGAM846 precursor RNA, VGAM847 precursor RNA and VGAM848 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM845 RNA, VGAM846 RNA, VGAM847 RNA and VGAM848 RNA, herein schematically represented by VGAM1 RNA through VGAM3 RNA, each of which VGAM RNAs corresponding to VGAM RNA of FIG. 1.

VGAM845 RNA, herein schematically represented by VGAM1 RNA through VGAM3 RNA, binds complementarily to a host target binding site located in an untranslated region of VGAM845 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM845 host target RNA into VGAM845 host target protein, herein schematically represented by VGAM1 HOST TARGET PROTEIN through VGAM3 HOST TARGET PROTEIN, all of FIG. 1.

VGAM846 RNA, herein schematically represented by VGAM1 RNA through VGAM3 RNA, binds complementarily to a host target binding site located in an untranslated region of VGAM846 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM846 host target RNA into VGAM846 host target protein, herein schematically represented by VGAM1 HOST TARGET PROTEIN through VGAM3 HOST TARGET PROTEIN, all of FIG. 1.

VGAM847 RNA, herein schematically represented by VGAM1 RNA through VGAM3 RNA, binds complementarily to a host target binding site located in an untranslated region of VGAM847 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM847 host target RNA into VGAM847 host target protein, herein schematically represented by VGAM1 HOST TARGET PROTEIN through VGAM3 HOST TARGET PROTEIN, all of FIG. 1.

VGAM848 RNA, herein schematically represented by VGAM1 RNA through VGAM3 RNA, binds complementarily to a host target binding site located in an untranslated region of VGAM848 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM848 host target RNA into VGAM848 host target protein, herein schematically represented by VGAM1 HOST TARGET PROTEIN through VGAM3 HOST TARGET PROTEIN, all of FIG. 1.

It is appreciated that a function of VGR2908 gene, herein designated VGR GENE, is inhibition of expression of host target genes, as part of a novel viral mechanism of attacking a host. Accordingly, utilities of VGR2908 gene include diagnosis, prevention and treatment of viral infection by Gallid Herpesvirus 2. Specific functions, and accordingly utilities, of VGR2908 gene correlate with, and may be deduced from, the identity of the host target genes, which are inhibited by VGAM RNAs comprised in the 'operon-like' cluster of VGR2908 gene: VGAM845 host target protein, VGAM846 host target protein, VGAM847 host target protein and VGAM848 host target protein, herein schematically represented by VGAM1 HOST TARGET PROTEIN through VGAM3 HOST TARGET PROTEIN. The function of these host target genes is elaborated hereinabove with reference to VGAM845, VGAM846, VGAM847 and VGAM848. FIG. 9 further provides a conceptual description of novel bioinformatically detected regulatory viral gene, referred to here as Viral Genomic Record 2909(VGR2909) viral gene, which encodes an 'operon-like' cluster of novel viral micro RNA-like genes, each of which in turn modulates expression of at least one host target gene, the function and utility of which at least one host target gene is known in the art.

VGR2909 gene, herein designated VGR GENE, is a novel bioinformatically detected regulatory, non protein coding, RNA viral gene. The method by which VGR2909 gene was detected is described hereinabove with reference to FIGS. 1-9.

VGR2909 gene encodes VGR2909 precursor RNA, herein designated VGR PRECURSOR RNA, an RNA molecule, typically several hundred nucleotides long.

VGR2909 precursor RNA folds spatially, forming VGR2909 folded precursor RNA, herein designated VGR FOLDED PRECURSOR RNA. It is appreciated that VGR2909 folded precursor RNA comprises a plurality of what is known in the art as 'hairpin' structures. These 'hairpin' structures are due to the fact that the nucleotide sequence of VGR2909 precursor RNA comprises a plurality of segments, the first half of each such segment having a nucleotide sequence which is at least a partial inversed-reversed sequence of the second half thereof, as is well known in the art.

VGR2909 folded precursor RNA is naturally processed by cellular enzymatic activity into at least 3 separate VGAM precursor RNAs, VGAM849 precursor RNA, VGAM850 precursor RNA and VGAM851 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM849 RNA, VGAM850 RNA and VGAM851 RNA, herein schematically represented by VGAM1 RNA through VGAM3 RNA, each of which VGAM RNAs corresponding to VGAM RNA of FIG. 1.

VGAM849 RNA, herein schematically represented by VGAM1 RNA through VGAM3 RNA, binds complementarily to a host target binding site located in an untranslated region of VGAM849 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM849 host target RNA into VGAM849 host target protein, herein schematically represented by VGAM1 HOST TARGET PROTEIN through VGAM3 HOST TARGET PROTEIN, all of FIG. 1.

VGAM850 RNA, herein schematically represented by VGAM1 RNA through VGAM3 RNA, binds complementarily to a host target binding site located in an untranslated region of VGAM850 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM850 host target RNA into VGAM850 host target protein, herein schematically represented by VGAM1 HOST TARGET PROTEIN through VGAM3 HOST TARGET PROTEIN, all of FIG. 1.

VGAM851 RNA, herein schematically represented by VGAM1 RNA through VGAM3 RNA, binds complementarily to a host target binding site located in an untranslated region of VGAM851 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM851 host target RNA into VGAM851 host target protein, herein schematically represented by VGAM1 HOST TARGET PROTEIN through VGAM3 HOST TARGET PROTEIN, all of FIG. 1.

It is appreciated that a function of VGR2909 gene, herein designated VGR GENE, is inhibition of expression of host target genes, as part of a novel viral mechanism of attacking a host. Accordingly, utilities of VGR2909 gene include diagnosis, prevention and treatment of viral infection by Lymphocystis Disease Virus 1. Specific functions, and accordingly utilities, of VGR2909 gene correlate with, and may be deduced from, the identity of the host target genes, which are inhibited by VGAM RNAs comprised in the 'operon-like' cluster of VGR2909 gene: VGAM849 host target protein, VGAM850 host target protein and VGAM851 host target protein, herein schematically represented by VGAM1 HOST TARGET PROTEIN through VGAM3 HOST TARGET PROTEIN. The function of these host target genes is elaborated hereinabove with reference to VGAM849, VGAM850 and VGAM851. FIG. 9 further provides a conceptual description of novel bioinformatically detected regulatory viral gene, referred to here as Viral Genomic Record 2910(VGR2910) viral gene, which encodes an 'operon-like' cluster of novel viral micro RNA-like genes, each of which in turn modulates expression of at least one host target gene, the function and utility of which at least one host target gene is known in the art.

VGR2910 gene, herein designated VGR GENE, is a novel bioinformatically detected regulatory, non protein coding, RNA viral gene. The method by which VGR2910 gene was detected is described hereinabove with reference to FIGS. 1-9.

VGR2910 gene encodes VGR2910 precursor RNA, herein designated VGR PRECURSOR RNA, an RNA molecule, typically several hundred nucleotides long.

VGR2910 precursor RNA folds spatially, forming VGR2910 folded precursor RNA, herein designated VGR FOLDED PRECURSOR RNA. It is appreciated that VGR2910 folded precursor RNA comprises a plurality of what is known in the art as 'hairpin' structures. These 'hairpin' structures are due to the fact that the nucleotide sequence of VGR2910 precursor RNA comprises a plurality of segments, the first half of each such segment having a nucleotide sequence which is at least a partial inversed-reversed sequence of the second half thereof, as is well known in the art.

VGR2910 folded precursor RNA is naturally processed by cellular enzymatic activity into at least 2 separate VGAM precursor RNAs, VGAM855 precursor RNA and VGAM856 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM855 RNA and VGAM856 RNA, herein schematically represented by VGAM1 RNA through VGAM3 RNA, each of which VGAM RNAs corresponding to VGAM RNA of FIG. 1.

VGAM855 RNA, herein schematically represented by VGAM1 RNA through VGAM3 RNA, binds complementarily to a host target binding site located in an untranslated region of VGAM855 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM855 host target RNA into VGAM855 host target protein, herein schematically represented by VGAM1 HOST TARGET PROTEIN through VGAM3 HOST TARGET PROTEIN, all of FIG. 1.

VGAM856 RNA, herein schematically represented by VGAM1 RNA through VGAM3 RNA, binds complementarily to a host target binding site located in an untranslated region of VGAM856 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM856 host target RNA into VGAM856 host target protein, herein schematically represented by VGAM1 HOST TARGET PROTEIN through VGAM3 HOST TARGET PROTEIN, all of FIG. 1.

It is appreciated that a function of VGR2910 gene, herein designated VGR GENE, is inhibition of expression of host target genes, as part of a novel viral mechanism of attacking a host. Accordingly, utilities of VGR2910 gene include diagnosis, prevention and treatment of viral infection by African Swine Fever Virus. Specific functions, and accordingly utilities, of VGR2910 gene correlate with, and may be deduced from, the identity of the host target genes, which are inhibited by VGAM RNAs comprised in the 'operon-like' cluster of VGR2910 gene: VGAM855 host target protein and VGAM856 host target protein, herein schematically represented by VGAM1 HOST TARGET PROTEIN through VGAM3 HOST TARGET PROTEIN. The function of these host target genes is elaborated hereinabove with reference to VGAM855 and VGAM856. FIG. 9 further provides a conceptual description of novel bioinformatically detected regulatory viral gene, referred to here as Viral Genomic Record 2911 (VGR2911) viral gene, which encodes an 'operon-like' cluster of novel viral micro RNA-like genes, each of which in turn modulates expression of at least one host target gene, the function and utility of which at least one host target gene is known in the art.

VGR2911 gene, herein designated VGR GENE, is a novel bioinformatically detected regulatory, non protein coding, RNA viral gene. The method by which VGR2911 gene was detected is described hereinabove with reference to FIGS. 1-9.

VGR2911 gene encodes VGR2911 precursor RNA, herein designated VGR PRECURSOR RNA, an RNA molecule, typically several hundred nucleotides long.

VGR2911 precursor RNA folds spatially, forming VGR2911 folded precursor RNA, herein designated VGR FOLDED PRECURSOR RNA. It is appreciated that VGR2911 folded precursor RNA comprises a plurality of what is known in the art as 'hairpin' structures. These 'hairpin' structures are due to the fact that the nucleotide sequence of VGR2911 precursor RNA comprises a plurality of segments, the first half of each such segment having a nucleotide sequence which is at least a partial inversed-reversed sequence of the second half thereof, as is well known in the art.

VGR2911 folded precursor RNA is naturally processed by cellular enzymatic activity into at least 3 separate VGAM precursor RNAs, VGAM857 precursor RNA, VGAM858 precursor RNA and VGAM859 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM857 RNA, VGAM858 RNA and VGAM859 RNA, herein schematically represented by VGAM1 RNA through VGAM3 RNA, each of which VGAM RNAs corresponding to VGAM RNA of FIG. 1.

VGAM857 RNA, herein schematically represented by VGAM1 RNA through VGAM3 RNA, binds complementarily to a host target binding site located in an untranslated region of VGAM857 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM857 host target RNA into VGAM857 host target protein, herein schematically represented by VGAM1 HOST TARGET PROTEIN through VGAM3 HOST TARGET PROTEIN, all of FIG. 1.

VGAM858 RNA, herein schematically represented by VGAM1 RNA through VGAM3 RNA, binds complementarily to a host target binding site located in an untranslated region of VGAM858 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM858 host target RNA into VGAM858 host target protein, herein schematically represented by VGAM1 HOST TARGET PROTEIN through VGAM3 HOST TARGET PROTEIN, all of FIG. 1.

VGAM859 RNA, herein schematically represented by VGAM1 RNA through VGAM3 RNA, binds complementarily to a host target binding site located in an untranslated region of VGAM859 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM859 host target RNA into VGAM859 host target protein, herein schematically represented by VGAM1 HOST TARGET PROTEIN through VGAM3 HOST TARGET PROTEIN, all of FIG. 1.

It is appreciated that a function of VGR2911 gene, herein designated VGR GENE, is inhibition of expression of host target genes, as part of a novel viral mechanism of attacking a host. Accordingly, utilities of VGR2911 gene include diagnosis, prevention and treatment of viral infection by Ectromelia Virus. Specific functions, and accordingly utilities, of VGR2911 gene correlate with, and may be deduced from, the identity of the host target genes, which are inhibited by VGAM RNAs comprised in the 'operon-like' cluster of VGR2911 gene: VGAM857 host target protein, VGAM858 host target protein and VGAM859 host target protein, herein schematically represented by VGAM1 HOST TARGET PROTEIN through VGAM3 HOST TARGET PROTEIN.

The function of these host target genes is elaborated hereinabove with reference to VGAM857, VGAM858 and VGAM859. FIG. 9 further provides a conceptual description of novel bioinformatically detected regulatory viral gene, referred to here as Viral Genomic Record 2912(VGR2912) viral gene, which encodes an 'operon-like' cluster of novel viral micro RNA-like genes, each of which in turn modulates expression of at least one host target gene, the function and utility of which at least one host target gene is known in the art.

VGR2912 gene, herein designated VGR GENE, is a novel bioinformatically detected regulatory, non protein coding, RNA viral gene. The method by which VGR2912 gene was detected is described hereinabove with reference to FIGS. 1-9.

VGR2912 gene encodes VGR2912 precursor RNA, herein designated VGR PRECURSOR RNA, an RNA molecule, typically several hundred nucleotides long.

VGR2912 precursor RNA folds spatially, forming VGR2912 folded precursor RNA, herein designated VGR FOLDED PRECURSOR RNA. It is appreciated that VGR2912 folded precursor RNA comprises a plurality of what is known in the art as 'hairpin' structures. These 'hairpin' structures are due to the fact that the nucleotide sequence of VGR2912 precursor RNA comprises a plurality of segments, the first half of each such segment having a nucleotide sequence which is at least a partial inversed-reversed sequence of the second half thereof, as is well known in the art.

VGR2912 folded precursor RNA is naturally processed by cellular enzymatic activity into at least 4 separate VGAM precursor RNAs, VGAM861 precursor RNA, VGAM862 precursor RNA, VGAM863 precursor RNA and VGAM864 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM861 RNA, VGAM862 RNA, VGAM863 RNA and VGAM864 RNA, herein schematically represented by VGAM1 RNA through VGAM3 RNA, each of which VGAM RNAs corresponding to VGAM RNA of FIG. 1.

VGAM861 RNA, herein schematically represented by VGAM1 RNA through VGAM3 RNA, binds complementarily to a host target binding site located in an untranslated region of VGAM861 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM861 host target RNA into VGAM861 host target protein, herein schematically represented by VGAM1 HOST TARGET PROTEIN through VGAM3 HOST TARGET PROTEIN, all of FIG. 1.

VGAM862 RNA, herein schematically represented by VGAM1 RNA through VGAM3 RNA, binds complementarily to a host target binding site located in an untranslated region of VGAM862 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM862 host target RNA into VGAM862 host target protein, herein schematically represented by VGAM1 HOST TARGET PROTEIN through VGAM3 HOST TARGET PROTEIN, all of FIG. 1.

VGAM863 RNA, herein schematically represented by VGAM1 RNA through VGAM3 RNA, binds complementarily to a host target binding site located in an untranslated region of VGAM863 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM863 host target RNA into VGAM863 host target protein, herein schematically represented by VGAM1 HOST TARGET PROTEIN through VGAM3 HOST TARGET PROTEIN, all of FIG. 1.

VGAM864 RNA, herein schematically represented by VGAM1 RNA through VGAM3 RNA, binds complementarily to a host target binding site located in an untranslated region of VGAM864 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM864 host target RNA into VGAM864 host target protein, herein schematically represented by VGAM1 HOST TARGET PROTEIN through VGAM3 HOST TARGET PROTEIN, all of FIG. 1.

It is appreciated that a function of VGR2912 gene, herein designated VGR GENE, is inhibition of expression of host target genes, as part of a novel viral mechanism of attacking a host. Accordingly, utilities of VGR2912 gene include diagnosis, prevention and treatment of viral infection by Ictalurid Herpesvirus 1. Specific functions, and accordingly utilities, of VGR2912 gene correlate with, and may be deduced from, the identity of the host target genes, which are inhibited by VGAM RNAs comprised in the 'operon-like' cluster of VGR2912 gene: VGAM861 host target protein, VGAM862 host target protein, VGAM863 host target protein and VGAM864 host target protein, herein schematically represented by VGAM1 HOST TARGET PROTEIN through VGAM3 HOST TARGET PROTEIN. The function of these host target genes is elaborated hereinabove with reference to VGAM861, VGAM862, VGAM863 and VGAM864. FIG. 9 further provides a conceptual description of novel bioinformatically detected regulatory viral gene, referred to here as Viral Genomic Record 2913(VGR2913) viral gene, which encodes an 'operon-like' cluster of novel viral micro RNA-like genes, each of which in turn modulates expression of at least one host target gene, the function and utility of which at least one host target gene is known in the art.

VGR2913 gene, herein designated VGR GENE, is a novel bioinformatically detected regulatory, non protein coding, RNA viral gene. The method by which VGR2913 gene was detected is described hereinabove with reference to FIGS. 1-9.

VGR2913 gene encodes VGR2913 precursor RNA, herein designated VGR PRECURSOR RNA, an RNA molecule, typically several hundred nucleotides long.

VGR2913 precursor RNA folds spatially, forming VGR2913 folded precursor RNA, herein designated VGR FOLDED PRECURSOR RNA. It is appreciated that VGR2913 folded precursor RNA comprises a plurality of what is known in the art as 'hairpin' structures. These 'hairpin' structures are due to the fact that the nucleotide sequence of VGR2913 precursor RNA comprises a plurality of segments, the first half of each such segment having a nucleotide sequence which is at least a partial inversed-reversed sequence of the second half thereof, as is well known in the art.

VGR2913 folded precursor RNA is naturally processed by cellular enzymatic activity into at least 2 separate VGAM precursor RNAs, VGAM865 precursor RNA and VGAM866 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM865 RNA and VGAM866 RNA, herein schematically represented by VGAM1 RNA through VGAM3 RNA, each of which VGAM RNAs corresponding to VGAM RNA of FIG. 1.

VGAM865 RNA, herein schematically represented by VGAM1 RNA through VGAM3 RNA, binds complementarily to a host target binding site located in an untranslated region of VGAM865 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM865 host target RNA into VGAM865 host target protein, herein schematically represented by VGAM1 HOST TARGET PROTEIN through VGAM3 HOST TARGET PROTEIN, all of FIG. 1.

VGAM866 RNA, herein schematically represented by VGAM1 RNA through VGAM3 RNA, binds complementarily to a host target binding site located in an untranslated region of VGAM866 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM866 host target RNA into VGAM866 host target protein, herein schematically represented by VGAM1 HOST TARGET PROTEIN through VGAM3 HOST TARGET PROTEIN, all of FIG. 1.

It is appreciated that a function of VGR2913 gene, herein designated VGR GENE, is inhibition of expression of host target genes, as part of a novel viral mechanism of attacking a host. Accordingly, utilities of VGR2913 gene include diagnosis, prevention and treatment of viral infection by Swinepox Virus. Specific functions, and accordingly utilities, of VGR2913 gene correlate with, and may be deduced from, the identity of the host target genes, which are inhibited by VGAM RNAs comprised in the 'operon-like' cluster of VGR2913 gene: VGAM865 host target protein and VGAM866 host target protein, herein schematically represented by VGAM1 HOST TARGET PROTEIN through VGAM3 HOST TARGET PROTEIN. The function of these host target genes is elaborated hereinabove with reference to VGAM865 and VGAM866. FIG. 9 further provides a conceptual description of novel bioinformatically detected regulatory viral gene, referred to here as Viral Genomic Record 2914(VGR2914) viral gene, which encodes an 'operon-like' cluster of novel viral micro RNA-like genes, each of which in turn modulates expression of at least one host target gene, the function and utility of which at least one host target gene is known in the art.

VGR2914 gene, herein designated VGR GENE, is a novel bioinformatically detected regulatory, non protein coding, RNA viral gene. The method by which VGR2914 gene was detected is described hereinabove with reference to FIGS. 1-9.

VGR2914 gene encodes VGR2914 precursor RNA, herein designated VGR PRECURSOR RNA, an RNA molecule, typically several hundred nucleotides long.

VGR2914 precursor RNA folds spatially, forming VGR2914 folded precursor RNA, herein designated VGR FOLDED PRECURSOR RNA. It is appreciated that VGR2914 folded precursor RNA comprises a plurality of what is known in the art as 'hairpin' structures. These 'hairpin' structures are due to the fact that the nucleotide sequence of VGR2914 precursor RNA comprises a plurality of segments, the first half of each such segment having a nucleotide sequence which is at least a partial inversed-reversed sequence of the second half thereof, as is well known in the art.

VGR2914 folded precursor RNA is naturally processed by cellular enzymatic activity into at least 2 separate VGAM precursor RNAs, VGAM867 precursor RNA and VGAM868 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM867 RNA and VGAM868 RNA, herein schematically represented by VGAM1 RNA through VGAM3 RNA, each of which VGAM RNAs corresponding to VGAM RNA of FIG. 1.

VGAM867 RNA, herein schematically represented by VGAM1 RNA through VGAM3 RNA, binds complementarily to a host target binding site located in an untranslated region of VGAM867 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM867 host target RNA into VGAM867 host target protein, herein schematically represented by VGAM1 HOST TARGET PROTEIN through VGAM3 HOST TARGET PROTEIN, all of FIG. 1.

VGAM868 RNA, herein schematically represented by VGAM1 RNA through VGAM3 RNA, binds complementarily to a host target binding site located in an untranslated region of VGAM868 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM868 host target RNA into VGAM868 host target protein, herein schematically represented by VGAM1 HOST TARGET PROTEIN through VGAM3 HOST TARGET PROTEIN, all of FIG. 1.

It is appreciated that a function of VGR2914 gene, herein designated VGR GENE, is inhibition of expression of host target genes, as part of a novel viral mechanism of attacking a host. Accordingly, utilities of VGR2914 gene include diagnosis, prevention and treatment of viral infection by Turkey Adenovirus 3. Specific functions, and accordingly utilities, of VGR2914 gene correlate with, and may be deduced from, the identity of the host target genes, which are inhibited by VGAM RNAs comprised in the 'operon-like' cluster of VGR2914 gene: VGAM867 host target protein and VGAM868 host target protein, herein schematically represented by VGAM1 HOST TARGET PROTEIN through VGAM3 HOST TARGET PROTEIN. The function of these host target genes is elaborated hereinabove with reference to VGAM867 and VGAM868. FIG. 9 further provides a conceptual description of novel bioinformatically detected regulatory viral gene, referred to here as Viral Genomic Record 2915(VGR2915) viral gene, which encodes an 'operon-like' cluster of novel viral micro RNA-like genes, each of which in turn modulates expression of at least one host target gene, the function and utility of which at least one host target gene is known in the art.

VGR2915 gene, herein designated VGR GENE, is a novel bioinformatically detected regulatory, non protein coding, RNA viral gene. The method by which VGR2915 gene was detected is described hereinabove with reference to FIGS. 1-9.

VGR2915 gene encodes VGR2915 precursor RNA, herein designated VGR PRECURSOR RNA, an RNA molecule, typically several hundred nucleotides long.

VGR2915 precursor RNA folds spatially, forming VGR2915 folded precursor RNA, herein designated VGR FOLDED PRECURSOR RNA. It is appreciated that VGR2915 folded precursor RNA comprises a plurality of what is known in the art as 'hairpin' structures. These 'hairpin' structures are due to the fact that the nucleotide sequence of VGR2915 precursor RNA comprises a plurality of segments, the first half of each such segment having a nucleotide sequence which is at least a partial inversed-reversed sequence of the second half thereof, as is well known in the art.

VGR2915 folded precursor RNA is naturally processed by cellular enzymatic activity into at least 5 separate VGAM precursor RNAs, VGAM869 precursor RNA, VGAM870 precursor RNA, VGAM871 precursor RNA, VGAM872 precursor RNA and VGAM873 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM869 RNA, VGAM870 RNA, VGAM871 RNA, VGAM872 RNA and VGAM873 RNA, herein schematically represented by VGAM1 RNA through VGAM3 RNA, each of which VGAM RNAs corresponding to VGAM RNA of FIG. 1.

VGAM869 RNA, herein schematically represented by VGAM1 RNA through VGAM3 RNA, binds complementarily to a host target binding site located in an untranslated region of VGAM869 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM869 host target RNA into VGAM869 host target protein, herein schematically represented by VGAM1 HOST TARGET PROTEIN through VGAM3 HOST TARGET PROTEIN, all of FIG. 1.

VGAM870 RNA, herein schematically represented by VGAM1 RNA through VGAM3 RNA, binds complementarily to a host target binding site located in an untranslated region of VGAM870 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM870 host target RNA into VGAM870 host target protein, herein schematically represented by VGAM1 HOST TARGET PROTEIN through VGAM3 HOST TARGET PROTEIN, all of FIG. 1.

VGAM871 RNA, herein schematically represented by VGAM1 RNA through VGAM3 RNA, binds complementarily to a host target binding site located in an untranslated region of VGAM871 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM871 host target RNA into VGAM871 host target protein, herein schematically represented by VGAM1 HOST TARGET PROTEIN through VGAM3 HOST TARGET PROTEIN, all of FIG. 1.

VGAM872 RNA, herein schematically represented by VGAM1 RNA through VGAM3 RNA, binds complementarily to a host target binding site located in an untranslated region of VGAM872 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM872 host target RNA into VGAM872 host target protein, herein schematically represented by VGAM1 HOST TARGET PROTEIN through VGAM3 HOST TARGET PROTEIN, all of FIG. 1.

VGAM873 RNA, herein schematically represented by VGAM1 RNA through VGAM3 RNA, binds complementarily to a host target binding site located in an untranslated region of VGAM873 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM873 host target RNA into VGAM873 host target protein, herein schematically represented by VGAM1 HOST TARGET PROTEIN through VGAM3 HOST TARGET PROTEIN, all of FIG. 1.

It is appreciated that a function of VGR2915 gene, herein designated VGR GENE, is inhibition of expression of host target genes, as part of a novel viral mechanism of attacking a host. Accordingly, utilities of VGR2915 gene include diagnosis, prevention and treatment of viral infection by Fowlpox Virus. Specific functions, and accordingly utilities, of VGR2915 gene correlate with, and may be deduced from, the identity of the host target genes, which are inhibited by VGAM RNAs comprised in the 'operon-like' cluster of VGR2915 gene: VGAM869 host target protein, VGAM870 host target protein, VGAM871 host target protein, VGAM872 host target protein and VGAM873 host target protein, herein schematically represented by VGAM1 HOST TARGET PROTEIN through VGAM3 HOST TARGET PROTEIN. The function of these host target genes is elaborated hereinabove with reference to VGAM869, VGAM870, VGAM871, VGAM872 and VGAM873. FIG. 9 further provides a conceptual description of novel bioinformatically detected regulatory viral gene, referred to here as Viral Genomic Record 2916(VGR2916) viral gene, which encodes an 'operon-like' cluster of novel viral micro RNA-like genes, each of which in turn modulates expression of at least one host target gene, the function and utility of which at least one host target gene is known in the art.

VGR2916 gene, herein designated VGR GENE, is a novel bioinformatically detected regulatory, non protein coding, RNA viral gene. The method by which VGR2916 gene was detected is described hereinabove with reference to FIGS. 1-9.

VGR2916 gene encodes VGR2916 precursor RNA, herein designated VGR PRECURSOR RNA, an RNA molecule, typically several hundred nucleotides long.

VGR2916 precursor RNA folds spatially, forming VGR2916 folded precursor RNA, herein designated VGR FOLDED PRECURSOR RNA. It is appreciated that VGR2916 folded precursor RNA comprises a plurality of what is known in the art as 'hairpin' structures. These 'hairpin' structures are due to the fact that the nucleotide sequence of VGR2916 precursor RNA comprises a plurality of segments, the first half of each such segment having a nucleotide sequence which is at least a partial inversed-reversed sequence of the second half thereof, as is well known in the art.

VGR2916 folded precursor RNA is naturally processed by cellular enzymatic activity into at least 3 separate VGAM precursor RNAs, VGAM875 precursor RNA, VGAM876 precursor RNA and VGAM877 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM875 RNA, VGAM876 RNA and VGAM877 RNA, herein schematically represented by VGAM1 RNA through VGAM3 RNA, each of which VGAM RNAs corresponding to VGAM RNA of FIG. 1.

VGAM875 RNA, herein schematically represented by VGAM1 RNA through VGAM3 RNA, binds complementarily to a host target binding site located in an untranslated region of VGAM875 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM875 host target RNA into VGAM875 host target protein, herein schematically represented by VGAM1 HOST TARGET PROTEIN through VGAM3 HOST TARGET PROTEIN, all of FIG. 1.

VGAM876 RNA, herein schematically represented by VGAM1 RNA through VGAM3 RNA, binds complementarily to a host target binding site located in an untranslated region of VGAM876 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM876 host target RNA into VGAM876 host target protein, herein schematically represented by VGAM1 HOST TARGET PROTEIN through VGAM3 HOST TARGET PROTEIN, all of FIG. 1.

VGAM877 RNA, herein schematically represented by VGAM1 RNA through VGAM3 RNA, binds complementarily to a host target binding site located in an untranslated region of VGAM877 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM877 host target RNA into VGAM877 host target protein, herein schematically represented by VGAM1 HOST TARGET PROTEIN through VGAM3 HOST TARGET PROTEIN, all of FIG. 1.

It is appreciated that a function of VGR2916 gene, herein designated VGR GENE, is inhibition of expression of host target genes, as part of a novel viral mechanism of attacking a host. Accordingly, utilities of VGR2916 gene include diagnosis, prevention and treatment of viral infection by Human Herpesvirus 5. Specific functions, and accordingly utilities, of VGR2916 gene correlate with, and may be deduced from, the identity of the host target genes, which are inhibited by VGAM RNAs comprised in the 'operon-like' cluster of VGR2916 gene: VGAM875 host target protein, VGAM876 host target protein and VGAM877 host target protein, herein schematically represented by VGAM1 HOST TARGET PROTEIN through VGAM3 HOST TARGET PROTEIN. The function of these host target genes is elaborated hereinabove with reference to VGAM875, VGAM876 and VGAM877. FIG. 9 further provides a conceptual description of novel bioinformatically detected regulatory viral gene, referred to here as Viral Genomic Record 2917(VGR2917) viral gene, which encodes an 'operon-like' cluster of novel viral micro RNA-like genes, each of which in turn modulates expression of at least one host target gene, the function and utility of which at least one host target gene is known in the art.

VGR2917 gene, herein designated VGR GENE, is a novel bioinformatically detected regulatory, non protein coding, RNA viral gene. The method by which VGR2917 gene was detected is described hereinabove with reference to FIGS. 1-9.

VGR2917 gene encodes VGR2917 precursor RNA, herein designated VGR PRECURSOR RNA, an RNA molecule, typically several hundred nucleotides long.

VGR2917 precursor RNA folds spatially, forming VGR2917 folded precursor RNA, herein designated VGR FOLDED PRECURSOR RNA. It is appreciated that VGR2917 folded precursor RNA comprises a plurality of what is known in the art as 'hairpin' structures. These 'hairpin' structures are due to the fact that the nucleotide sequence of VGR2917 precursor RNA comprises a plurality of segments, the first half of each such segment having a nucleotide sequence which is at least a partial inversed-reversed sequence of the second half thereof, as is well known in the art.

VGR2917 folded precursor RNA is naturally processed by cellular enzymatic activity into at least 2 separate VGAM precursor RNAs, VGAM880 precursor RNA and VGAM881 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM880 RNA and VGAM881 RNA, herein schematically represented by VGAM1 RNA through VGAM3 RNA, each of which VGAM RNAs corresponding to VGAM RNA of FIG. 1.

VGAM880 RNA, herein schematically represented by VGAM1 RNA through VGAM3 RNA, binds complementarily to a host target binding site located in an untranslated region of VGAM880 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM880 host target RNA into VGAM880 host target protein, herein schematically represented by VGAM1 HOST TARGET PROTEIN through VGAM3 HOST TARGET PROTEIN, all of FIG. 1.

VGAM881 RNA, herein schematically represented by VGAM1 RNA through VGAM3 RNA, binds complementarily to a host target binding site located in an untranslated region of VGAM881 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM881 host target RNA into VGAM881 host target protein, herein schematically represented by VGAM1 HOST TARGET PROTEIN through VGAM3 HOST TARGET PROTEIN, all of FIG. 1.

It is appreciated that a function of VGR2917 gene, herein designated VGR GENE, is inhibition of expression of host target genes, as part of a novel viral mechanism of attacking a host. Accordingly, utilities of VGR2917 gene include diagnosis, prevention and treatment of viral infection by Gallid Herpesvirus 3. Specific functions, and accordingly utilities, of VGR2917 gene correlate with, and may be deduced from, the identity of the host target genes, which are inhibited by VGAM RNAs comprised in the 'operon-like' cluster of VGR2917 gene: VGAM880 host target protein and VGAM881 host target protein, herein schematically represented by VGAM1 HOST TARGET PROTEIN through VGAM3 HOST TARGET PROTEIN. The function of these host target genes is elaborated hereinabove with reference to VGAM880 and VGAM881. FIG. 9 further provides a conceptual description of novel bioinformatically detected regulatory viral gene, referred to here as Viral Genomic Record 2918(VGR2918) viral gene, which encodes an 'operon-like' cluster of novel viral micro RNA-like genes, each of which in turn modulates expression of at least one host target gene, the function and utility of which at least one host target gene is known in the art.

VGR2918 gene, herein designated VGR GENE, is a novel bioinformatically detected regulatory, non protein coding, RNA viral gene. The method by which VGR2918 gene was detected is described hereinabove with reference to FIGS. 1-9.

VGR2918 gene encodes VGR2918 precursor RNA, herein designated VGR PRECURSOR RNA, an RNA molecule, typically several hundred nucleotides long.

VGR2918 precursor RNA folds spatially, forming VGR2918 folded precursor RNA, herein designated VGR FOLDED PRECURSOR RNA. It is appreciated that VGR2918 folded precursor RNA comprises a plurality of what is known in the art as 'hairpin' structures. These 'hairpin' structures are due to the fact that the nucleotide sequence of VGR2918 precursor RNA comprises a plurality of segments, the first half of each such segment having a nucleotide sequence which is at least a partial inversed-reversed sequence of the second half thereof, as is well known in the art.

VGR2918 folded precursor RNA is naturally processed by cellular enzymatic activity into at least 2 separate VGAM precursor RNAs, VGAM886 precursor RNA and VGAM887 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM886 RNA and VGAM887 RNA, herein schematically represented by VGAM1 RNA through VGAM3 RNA, each of which VGAM RNAs corresponding to VGAM RNA of FIG. 1.

VGAM886 RNA, herein schematically represented by VGAM1 RNA through VGAM3 RNA, binds complementarily to a host target binding site located in an untranslated region of VGAM886 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM886 host target RNA into VGAM886 host target protein, herein schematically represented by VGAM1 HOST TARGET PROTEIN through VGAM3 HOST TARGET PROTEIN, all of FIG. 1.

VGAM887 RNA, herein schematically represented by VGAM1 RNA through VGAM3 RNA, binds complementarily to a host target binding site located in an untranslated region of VGAM887 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM887 host target RNA into VGAM887 host target protein, herein schematically represented by VGAM1 HOST TARGET PROTEIN through VGAM3 HOST TARGET PROTEIN, all of FIG. 1.

It is appreciated that a function of VGR2918 gene, herein designated VGR GENE, is inhibition of expression of host target genes, as part of a novel viral mechanism of attacking a host. Accordingly, utilities of VGR2918 gene include diagnosis, prevention and treatment of viral infection by Vaccinia Virus. Specific functions, and accordingly utilities, of VGR2918 gene correlate with, and may be deduced from, the identity of the host target genes, which are inhibited by VGAM RNAs comprised in the 'operon-like' cluster of VGR2918 gene: VGAM886 host target protein and VGAM887 host target protein, herein schematically represented by VGAM1 HOST TARGET PROTEIN through VGAM3 HOST TARGET PROTEIN. The function of these host target genes is elaborated hereinabove with reference to VGAM886 and VGAM887. FIG. 9 further provides a conceptual description of novel bioinformatically detected regulatory viral gene, referred to here as Viral Genomic Record 2919(VGR2919) viral gene, which encodes an 'operon-like' cluster of novel viral micro RNA-like genes, each of which in turn modulates expression of at least one host target gene, the function and utility of which at least one host target gene is known in the art.

VGR2919 gene, herein designated VGR GENE, is a novel bioinformatically detected regulatory, non protein coding, RNA viral gene. The method by which VGR2919 gene was detected is described hereinabove with reference to FIGS. 1-9.

VGR2919 gene encodes VGR2919 precursor RNA, herein designated VGR PRECURSOR RNA, an RNA molecule, typically several hundred nucleotides long.

VGR2919 precursor RNA folds spatially, forming VGR2919 folded precursor RNA, herein designated VGR FOLDED PRECURSOR RNA. It is appreciated that VGR2919 folded precursor RNA comprises a plurality of what is known in the art as 'hairpin' structures. These 'hairpin' structures are due to the fact that the nucleotide sequence of VGR2919 precursor RNA comprises a plurality of segments, the first half of each such segment having a nucleotide sequence which is at least a partial inversed-reversed sequence of the second half thereof, as is well known in the art.

VGR2919 folded precursor RNA is naturally processed by cellular enzymatic activity into at least 4 separate VGAM precursor RNAs, VGAM888 precursor RNA, VGAM889 precursor RNA, VGAM890 precursor RNA and VGAM891 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM888 RNA, VGAM889 RNA, VGAM890 RNA and VGAM891 RNA, herein schematically represented by VGAM1 RNA through VGAM3 RNA, each of which VGAM RNAs corresponding to VGAM RNA of FIG. 1.

VGAM888 RNA, herein schematically represented by VGAM1 RNA through VGAM3 RNA, binds complementarily to a host target binding site located in an untranslated region of VGAM888 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM888 host target RNA into VGAM888 host target protein, herein schematically represented by VGAM1 HOST TARGET PROTEIN through VGAM3 HOST TARGET PROTEIN, all of FIG. 1.

VGAM889 RNA, herein schematically represented by VGAM1 RNA through VGAM3 RNA, binds complementarily to a host target binding site located in an untranslated region of VGAM889 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM889 host target RNA into VGAM889 host target protein, herein schematically represented by VGAM1 HOST TARGET PROTEIN through VGAM3 HOST TARGET PROTEIN, all of FIG. 1.

VGAM890 RNA, herein schematically represented by VGAM1 RNA through VGAM3 RNA, binds complementarily to a host target binding site located in an untranslated region of VGAM890 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM890 host target RNA into VGAM890 host target protein, herein schematically represented by VGAM1 HOST TARGET PROTEIN through VGAM3 HOST TARGET PROTEIN, all of FIG. 1.

VGAM891 RNA, herein schematically represented by VGAM1 RNA through VGAM3 RNA, binds complementarily to a host target binding site located in an untranslated region of VGAM891 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM891 host target RNA into VGAM891 host target protein, herein schematically represented by VGAM1 HOST TARGET PROTEIN through VGAM3 HOST TARGET PROTEIN, all of FIG. 1.

It is appreciated that a function of VGR2919 gene, herein designated VGR GENE, is inhibition of expression of host target genes, as part of a novel viral mechanism of attacking a host. Accordingly, utilities of VGR2919 gene include diagnosis, prevention and treatment of viral infection by Human Herpesvirus 4. Specific functions, and accordingly utilities, of VGR2919 gene correlate with, and may be deduced from, the identity of the host target genes, which are inhibited by VGAM RNAs comprised in the 'operon-like' cluster of VGR2919 gene: VGAM888 host target protein, VGAM889 host target protein, VGAM890 host target protein and VGAM891 host target protein, herein schematically represented by VGAM1 HOST TARGET PROTEIN through VGAM3 HOST TARGET PROTEIN. The function of these host target genes is elaborated hereinabove with reference to VGAM888, VGAM889, VGAM890 and VGAM891. FIG. 9 further provides a conceptual description of novel bioinformatically detected regulatory viral gene, referred to here as Viral Genomic Record 2920(VGR2920) viral gene, which encodes an 'operon-like' cluster of novel viral micro RNA-like genes, each of which in turn modulates expression of at least one host target gene, the function and utility of which at least one host target gene is known in the art.

VGR2920 gene, herein designated VGR GENE, is a novel bioinformatically detected regulatory, non protein coding, RNA viral gene. The method by which VGR2920 gene was detected is described hereinabove with reference to FIGS. 1-9.

VGR2920 gene encodes VGR2920 precursor RNA, herein designated VGR PRECURSOR RNA, an RNA molecule, typically several hundred nucleotides long.

VGR2920 precursor RNA folds spatially, forming VGR2920 folded precursor RNA, herein designated VGR FOLDED PRECURSOR RNA. It is appreciated that VGR2920 folded precursor RNA comprises a plurality of what is known in the art as 'hairpin' structures. These 'hairpin' structures are due to the fact that the nucleotide sequence of VGR2920 precursor RNA comprises a plurality of segments, the first half of each such segment having a nucleotide sequence which is at least a partial inversed-reversed sequence of the second half thereof, as is well known in the art.

VGR2920 folded precursor RNA is naturally processed by cellular enzymatic activity into at least 3 separate VGAM precursor RNAs, VGAM892 precursor RNA, VGAM893 precursor RNA and VGAM894 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM892 RNA, VGAM893 RNA and VGAM894 RNA, herein schematically represented by VGAM1 RNA through VGAM3 RNA, each of which VGAM RNAs corresponding to VGAM RNA of FIG. 1.

VGAM892 RNA, herein schematically represented by VGAM1 RNA through VGAM3 RNA, binds complementarily to a host target binding site located in an untranslated region of VGAM892 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM892 host target RNA into VGAM892 host target protein, herein schematically represented by VGAM1 HOST TARGET PROTEIN through VGAM3 HOST TARGET PROTEIN, all of FIG. 1.

VGAM893 RNA, herein schematically represented by VGAM1 RNA through VGAM3 RNA, binds complementarily to a host target binding site located in an untranslated region of VGAM893 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM893 host target RNA into VGAM893 host target protein, herein schematically represented by VGAM1 HOST TARGET PROTEIN through VGAM3 HOST TARGET PROTEIN, all of FIG. 1.

VGAM894 RNA, herein schematically represented by VGAM1 RNA through VGAM3 RNA, binds complementarily to a host target binding site located in an untranslated region of VGAM894 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM894 host target RNA into VGAM894 host target protein, herein schematically represented by VGAM1 HOST TARGET PROTEIN through VGAM3 HOST TARGET PROTEIN, all of FIG. 1.

It is appreciated that a function of VGR2920 gene, herein designated VGR GENE, is inhibition of expression of host target genes, as part of a novel viral mechanism of attacking a host. Accordingly, utilities of VGR2920 gene include diagnosis, prevention and treatment of viral infection by Periplaneta Fuliginosa Densovirus. Specific functions, and accordingly utilities, of VGR2920 gene correlate with, and may be deduced from, the identity of the host target genes, which are inhibited by VGAM RNAs comprised in the 'operon-like' cluster of VGR2920 gene: VGAM892 host target protein, VGAM893 host target protein and VGAM894 host target protein, herein schematically represented by VGAM1 HOST TARGET PROTEIN through VGAM3 HOST TARGET PROTEIN. The function of these host target genes is elaborated hereinabove with reference to VGAM892, VGAM893 and VGAM894. FIG. 9 further provides a conceptual description of novel bioinformatically detected regulatory viral gene, referred to here as Viral Genomic Record 2921(VGR2921) viral gene, which encodes an 'operon-like' cluster of novel viral micro RNA-like genes, each of which in turn modulates expression of at least one host target gene, the function and utility of which at least one host target gene is known in the art.

VGR2921 gene, herein designated VGR GENE, is a novel bioinformatically detected regulatory, non protein coding, RNA viral gene. The method by which VGR2921 gene was detected is described hereinabove with reference to FIGS. 1-9.

VGR2921 gene encodes VGR2921 precursor RNA, herein designated VGR PRECURSOR RNA, an RNA molecule, typically several hundred nucleotides long.

VGR2921 precursor RNA folds spatially, forming VGR2921 folded precursor RNA, herein designated VGR FOLDED PRECURSOR RNA. It is appreciated that VGR2921 folded precursor RNA comprises a plurality of what is known in the art as 'hairpin' structures. These 'hairpin' structures are due to the fact that the nucleotide sequence of VGR2921 precursor RNA comprises a plurality of segments, the first half of each such segment having a nucleotide sequence which is at least a partial inversed-reversed sequence of the second half thereof, as is well known in the art.

VGR2921 folded precursor RNA is naturally processed by cellular enzymatic activity into at least 3 separate VGAM precursor RNAs, VGAM895 precursor RNA, VGAM896 precursor RNA and VGAM897 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM895 RNA, VGAM896 RNA and VGAM897 RNA, herein schematically represented by VGAM1 RNA through VGAM3 RNA, each of which VGAM RNAs corresponding to VGAM RNA of FIG. 1.

VGAM895 RNA, herein schematically represented by VGAM1 RNA through VGAM3 RNA, binds complementarily to a host target binding site located in an untranslated region of VGAM895 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM895 host target RNA into VGAM895 host target protein, herein schematically represented by VGAM1 HOST TARGET PROTEIN through VGAM3 HOST TARGET PROTEIN, all of FIG. 1.

VGAM896 RNA, herein schematically represented by VGAM1 RNA through VGAM3 RNA, binds complementarily to a host target binding site located in an untranslated region of VGAM896 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM896 host target RNA into VGAM896 host target protein, herein schematically represented by VGAM1 HOST TARGET PROTEIN through VGAM3 HOST TARGET PROTEIN, all of FIG. 1.

VGAM897 RNA, herein schematically represented by VGAM1 RNA through VGAM3 RNA, binds complementarily to a host target binding site located in an untranslated region of VGAM897 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM897 host target RNA into VGAM897 host target protein, herein schematically represented by VGAM1 HOST TARGET PROTEIN through VGAM3 HOST TARGET PROTEIN, all of FIG. 1.

It is appreciated that a function of VGR2921 gene, herein designated VGR GENE, is inhibition of expression of host target genes, as part of a novel viral mechanism of attacking a host. Accordingly, utilities of VGR2921 gene include diagnosis, prevention and treatment of viral infection by Gallid Herpesvirus 2. Specific functions, and accordingly utilities, of VGR2921 gene correlate with, and may be deduced from, the identity of the host target genes, which are inhibited by VGAM RNAs comprised in the 'operon-like' cluster of VGR2921 gene: VGAM895 host target protein, VGAM896 host target protein and VGAM897 host target protein, herein schematically represented by VGAM1 HOST TARGET PROTEIN through VGAM3 HOST TARGET PROTEIN. The function of these host target genes is elaborated hereinabove with reference to VGAM895, VGAM896 and VGAM897. FIG. 9 further provides a conceptual description of novel bioinformatically detected regulatory viral gene, referred to here as Viral Genomic Record 2922(VGR2922) viral gene, which encodes an 'operon-like' cluster of novel viral micro RNA-like genes, each of which in turn modulates expression of at least one host target gene, the function and utility of which at least one host target gene is known in the art.

VGR2922 gene, herein designated VGR GENE, is a novel bioinformatically detected regulatory, non protein coding, RNA viral gene. The method by which VGR2922 gene was detected is described hereinabove with reference to FIGS. 1-9.

VGR2922 gene encodes VGR2922 precursor RNA, herein designated VGR PRECURSOR RNA, an RNA molecule, typically several hundred nucleotides long.

VGR2922 precursor RNA folds spatially, forming VGR2922 folded precursor RNA, herein designated VGR FOLDED PRECURSOR RNA. It is appreciated that VGR2922 folded precursor RNA comprises a plurality of what is known in the art as 'hairpin' structures. These 'hairpin' structures are due to the fact that the nucleotide sequence of VGR2922 precursor RNA comprises a plurality of segments, the first half of each such segment having a nucleotide sequence which is at least a partial inversed-reversed sequence of the second half thereof, as is well known in the art.

VGR2922 folded precursor RNA is naturally processed by cellular enzymatic activity into at least 2 separate VGAM precursor RNAs, VGAM901 precursor RNA and VGAM902 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM901 RNA and VGAM902 RNA, herein schematically represented by VGAM1 RNA through VGAM3 RNA, each of which VGAM RNAs corresponding to VGAM RNA of FIG. 1.

VGAM901 RNA, herein schematically represented by VGAM1 RNA through VGAM3 RNA, binds complementarily to a host target binding site located in an untranslated region of VGAM901 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM901 host target RNA into VGAM901 host target protein, herein schematically represented by VGAM1 HOST TARGET PROTEIN through VGAM3 HOST TARGET PROTEIN, all of FIG. 1.

VGAM902 RNA, herein schematically represented by VGAM1 RNA through VGAM3 RNA, binds complementarily to a host target binding site located in an untranslated region of VGAM902 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM902 host target RNA into VGAM902 host target protein, herein schematically represented by VGAM1 HOST TARGET PROTEIN through VGAM3 HOST TARGET PROTEIN, all of FIG. 1.

It is appreciated that a function of VGR2922 gene, herein designated VGR GENE, is inhibition of expression of host target genes, as part of a novel viral mechanism of attacking a host. Accordingly, utilities of VGR2922 gene include diagnosis, prevention and treatment of viral infection by Sulfolobus Virus SIRV-1. Specific functions, and accordingly utilities, of VGR2922 gene correlate with, and may be deduced from, the identity of the host target genes, which are inhibited by VGAM RNAs comprised in the 'operon-like' cluster of VGR2922 gene: VGAM901 host target protein and VGAM902 host target protein, herein schematically represented by VGAM1 HOST TARGET PROTEIN through VGAM3 HOST TARGET PROTEIN. The function of these host target genes is elaborated hereinabove with reference to VGAM901 and VGAM902. FIG. 9 further provides a conceptual description of novel bioinformatically detected regulatory viral gene, referred to here as Viral Genomic Record 2923(VGR2923) viral gene, which encodes an 'operon-like' cluster of novel viral micro RNA-like genes, each of which in turn modulates expression of at least one host target gene, the function and utility of which at least one host target gene is known in the art.

VGR2923 gene, herein designated VGR GENE, is a novel bioinformatically detected regulatory, non protein coding, RNA viral gene. The method by which VGR2923 gene was detected is described hereinabove with reference to FIGS. 1-9.

VGR2923 gene encodes VGR2923 precursor RNA, herein designated VGR PRECURSOR RNA, an RNA molecule, typically several hundred nucleotides long.

VGR2923 precursor RNA folds spatially, forming VGR2923 folded precursor RNA, herein designated VGR FOLDED PRECURSOR RNA. It is appreciated that VGR2923 folded precursor RNA comprises a plurality of what is known in the art as 'hairpin' structures. These 'hairpin' structures are due to the fact that the nucleotide sequence of VGR2923 precursor RNA comprises a plurality of segments, the first half of each such segment having a nucleotide sequence which is at least a partial inversed-reversed sequence of the second half thereof, as is well known in the art.

VGR2923 folded precursor RNA is naturally processed by cellular enzymatic activity into at least 2 separate VGAM precursor RNAs, VGAM903 precursor RNA and VGAM904 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM903 RNA and VGAM904 RNA, herein schematically represented by VGAM1 RNA through VGAM3 RNA, each of which VGAM RNAs corresponding to VGAM RNA of FIG. 1.

VGAM903 RNA, herein schematically represented by VGAM1 RNA through VGAM3 RNA, binds complementarily to a host target binding site located in an untranslated region of VGAM903 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM903 host target RNA into VGAM903 host target protein, herein schematically represented by VGAM1 HOST TARGET PROTEIN through VGAM3 HOST TARGET PROTEIN, all of FIG. 1.

VGAM904 RNA, herein schematically represented by VGAM1 RNA through VGAM3 RNA, binds complementarily to a host target binding site located in an untranslated region of VGAM904 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM904 host target RNA into VGAM904 host target protein, herein schematically represented by VGAM1 HOST TARGET PROTEIN through VGAM3 HOST TARGET PROTEIN, all of FIG. 1.

It is appreciated that a function of VGR2923 gene, herein designated VGR GENE, is inhibition of expression of host target genes, as part of a novel viral mechanism of attacking a host. Accordingly, utilities of VGR2923 gene include diagnosis, prevention and treatment of viral infection by Melanoplus Sanguinipes Entomopoxvirus. Specific functions, and accordingly utilities, of VGR2923 gene correlate with, and may be deduced from, the identity of the host target genes, which are inhibited by VGAM RNAs comprised in the 'operon-like' cluster of VGR2923 gene: VGAM903 host target protein and VGAM904 host target protein, herein schematically represented by VGAM1 HOST TARGET PROTEIN through VGAM3 HOST TARGET PROTEIN. The function of these host target genes is elaborated hereinabove with reference to VGAM903 and VGAM904. FIG. 9 further provides a conceptual description of novel bioinformatically detected regulatory viral gene, referred to here as Viral Genomic Record 2924(VGR2924) viral gene, which encodes an 'operon-like' cluster of novel viral micro RNA-like genes, each of which in turn modulates expression of at least one host target gene, the function and utility of which at least one host target gene is known in the art.

VGR2924 gene, herein designated VGR GENE, is a novel bioinformatically detected regulatory, non protein coding, RNA viral gene. The method by which VGR2924 gene was detected is described hereinabove with reference to FIGS. 1-9.

VGR2924 gene encodes VGR2924 precursor RNA, herein designated VGR PRECURSOR RNA, an RNA molecule, typically several hundred nucleotides long.

VGR2924 precursor RNA folds spatially, forming VGR2924 folded precursor RNA, herein designated VGR FOLDED PRECURSOR RNA. It is appreciated that VGR2924 folded precursor RNA comprises a plurality of what is known in the art as 'hairpin' structures. These 'hairpin' structures are due to the fact that the nucleotide sequence of VGR2924 precursor RNA comprises a plurality of segments, the first half of each such segment having a nucleotide sequence which is at least a partial inversed-reversed sequence of the second half thereof, as is well known in the art.

VGR2924 folded precursor RNA is naturally processed by cellular enzymatic activity into at least 4 separate VGAM precursor RNAs, VGAM905 precursor RNA, VGAM906 precursor RNA, VGAM907 precursor RNA and VGAM908 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM905 RNA, VGAM906 RNA, VGAM907 RNA and VGAM908 RNA, herein schematically represented by VGAM1 RNA through VGAM3 RNA, each of which VGAM RNAs corresponding to VGAM RNA of FIG. 1.

VGAM905 RNA, herein schematically represented by VGAM1 RNA through VGAM3 RNA, binds complementarily to a host target binding site located in an untranslated region of VGAM905 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM905 host target RNA into VGAM905 host target protein, herein schematically represented by VGAM1 HOST TARGET PROTEIN through VGAM3 HOST TARGET PROTEIN, all of FIG. 1.

VGAM906 RNA, herein schematically represented by VGAM1 RNA through VGAM3 RNA, binds complementarily to a host target binding site located in an untranslated region of VGAM906 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM906 host target RNA into VGAM906 host target protein, herein schematically represented by VGAM1 HOST TARGET PROTEIN through VGAM3 HOST TARGET PROTEIN, all of FIG. 1.

VGAM907 RNA, herein schematically represented by VGAM1 RNA through VGAM3 RNA, binds complementarily to a host target binding site located in an untranslated region of VGAM907 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM907 host target RNA into VGAM907 host target protein, herein schematically represented by VGAM1 HOST TARGET PROTEIN through VGAM3 HOST TARGET PROTEIN, all of FIG. 1.

VGAM908 RNA, herein schematically represented by VGAM1 RNA through VGAM3 RNA, binds complementarily to a host target binding site located in an untranslated region of VGAM908 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM908 host target RNA into VGAM908 host target protein, herein schematically represented by VGAM1 HOST TARGET PROTEIN through VGAM3 HOST TARGET PROTEIN, all of FIG. 1.

It is appreciated that a function of VGR2924 gene, herein designated VGR GENE, is inhibition of expression of host target genes, as part of a novel viral mechanism of attacking a host. Accordingly, utilities of VGR2924 gene include diagnosis, prevention and treatment of viral infection by Saimiriine Herpesvirus 2. Specific functions, and accordingly utilities, of VGR2924 gene correlate with, and may be deduced from, the identity of the host target genes, which are inhibited by VGAM RNAs comprised in the 'operon-like' cluster of VGR2924 gene: VGAM905 host target protein, VGAM906 host target protein, VGAM907 host target protein and VGAM908 host target protein, herein schematically represented by VGAM1 HOST TARGET PROTEIN through VGAM3 HOST TARGET PROTEIN. The function of these host target genes is elaborated hereinabove with reference to VGAM905, VGAM906, VGAM907 and VGAM908. FIG. 9 further provides a conceptual description of novel bioinformatically detected regulatory viral gene, referred to here as Viral Genomic Record 2925(VGR2925) viral gene, which encodes an 'operon-like' cluster of novel viral micro RNA-like genes, each of which in turn modulates expression of at least one host target gene, the function and utility of which at least one host target gene is known in the art.

VGR2925 gene, herein designated VGR GENE, is a novel bioinformatically detected regulatory, non protein coding, RNA viral gene. The method by which VGR2925 gene was detected is described hereinabove with reference to FIGS. 1-9.

VGR2925 gene encodes VGR2925 precursor RNA, herein designated VGR PRECURSOR RNA, an RNA molecule, typically several hundred nucleotides long.

VGR2925 precursor RNA folds spatially, forming VGR2925 folded precursor RNA, herein designated VGR FOLDED PRECURSOR RNA. It is appreciated that VGR2925 folded precursor RNA comprises a plurality of what is known in the art as 'hairpin' structures. These 'hairpin' structures are due to the fact that the nucleotide sequence of VGR2925 precursor RNA comprises a plurality of segments, the first half of each such segment having a nucleotide sequence which is at least a partial inversed-reversed sequence of the second half thereof, as is well known in the art.

VGR2925 folded precursor RNA is naturally processed by cellular enzymatic activity into at least 2 separate VGAM precursor RNAs, VGAM909 precursor RNA and VGAM910 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM909 RNA and VGAM910 RNA, herein schematically represented by VGAM1 RNA through VGAM3 RNA, each of which VGAM RNAs corresponding to VGAM RNA of FIG. 1.

VGAM909 RNA, herein schematically represented by VGAM1 RNA through VGAM3 RNA, binds complementarily to a host target binding site located in an untranslated region of VGAM909 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM909 host target RNA into VGAM909 host target protein, herein schematically represented by VGAM1 HOST TARGET PROTEIN through VGAM3 HOST TARGET PROTEIN, all of FIG. 1.

VGAM910 RNA, herein schematically represented by VGAM1 RNA through VGAM3 RNA, binds complementarily to a host target binding site located in an untranslated region of VGAM910 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM910 host target RNA into VGAM910 host target protein, herein schematically represented by VGAM1 HOST TARGET PROTEIN through VGAM3 HOST TARGET PROTEIN, all of FIG. 1.

It is appreciated that a function of VGR2925 gene, herein designated VGR GENE, is inhibition of expression of host target genes, as part of a novel viral mechanism of attacking a host. Accordingly, utilities of VGR2925 gene include diagnosis, prevention and treatment of viral infection by Alcelaphine Herpesvirus 1. Specific functions, and accordingly utilities, of VGR2925 gene correlate with, and may be deduced from, the identity of the host target genes, which are inhibited by VGAM RNAs comprised in the 'operon-like' cluster of VGR2925 gene: VGAM909 host target protein and VGAM910 host target protein, herein schematically represented by VGAM1 HOST TARGET PROTEIN through VGAM3 HOST TARGET PROTEIN. The function of these host target genes is elaborated hereinabove with reference to VGAM909 and VGAM910. FIG. 9 further provides a conceptual description of novel bioinformatically detected regulatory viral gene, referred to here as Viral Genomic Record 2926(VGR2926) viral gene, which encodes an 'operon-like' cluster of novel viral micro RNA-like genes, each of which in turn modulates expression of at least one host target gene, the function and utility of which at least one host target gene is known in the art.

VGR2926 gene, herein designated VGR GENE, is a novel bioinformatically detected regulatory, non protein coding, RNA viral gene. The method by which VGR2926 gene was detected is described hereinabove with reference to FIGS. 1-9.

VGR2926 gene encodes VGR2926 precursor RNA, herein designated VGR PRECURSOR RNA, an RNA molecule, typically several hundred nucleotides long.

VGR2926 precursor RNA folds spatially, forming VGR2926 folded precursor RNA, herein designated VGR FOLDED PRECURSOR RNA. It is appreciated that VGR2926 folded precursor RNA comprises a plurality of what is known in the art as 'hairpin' structures. These 'hairpin' structures are due to the fact that the nucleotide sequence of VGR2926 precursor RNA comprises a plurality of segments, the first half of each such segment having a nucleotide sequence which is at least a partial inversed-reversed sequence of the second half thereof, as is well known in the art.

VGR2926 folded precursor RNA is naturally processed by cellular enzymatic activity into at least 2 separate VGAM precursor RNAs, VGAM911 precursor RNA and VGAM912 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM911 RNA and VGAM912 RNA, herein schematically represented by VGAM1 RNA through VGAM3 RNA, each of which VGAM RNAs corresponding to VGAM RNA of FIG. 1.

VGAM911 RNA, herein schematically represented by VGAM1 RNA through VGAM3 RNA, binds complementarily to a host target binding site located in an untranslated region of VGAM911 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM911 host target RNA into VGAM911 host target protein, herein schematically represented by VGAM1 HOST TARGET PROTEIN through VGAM3 HOST TARGET PROTEIN, all of FIG. 1.

VGAM912 RNA, herein schematically represented by VGAM1 RNA through VGAM3 RNA, binds complementarily to a host target binding site located in an untranslated region of VGAM912 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM912 host target RNA into VGAM912 host target protein, herein schematically represented by VGAM1 HOST TARGET PROTEIN through VGAM3 HOST TARGET PROTEIN, all of FIG. 1.

It is appreciated that a function of VGR2926 gene, herein designated VGR GENE, is inhibition of expression of host target genes, as part of a novel viral mechanism of attacking a host. Accordingly, utilities of VGR2926 gene include diagnosis, prevention and treatment of viral infection by Human Herpesvirus 8. Specific functions, and accordingly utilities, of VGR2926 gene correlate with, and may be deduced from, the identity of the host target genes, which are inhibited by VGAM RNAs comprised in the 'operon-like' cluster of VGR2926 gene: VGAM911 host target protein and VGAM912 host target protein, herein schematically represented by VGAM1 HOST TARGET PROTEIN through VGAM3 HOST TARGET PROTEIN. The function of these host target genes is elaborated hereinabove with reference to VGAM911 and VGAM912. FIG. 9 further provides a conceptual description of novel bioinformatically detected regulatory viral gene, referred to here as Viral Genomic Record 2927(VGR2927) viral gene, which encodes an 'operon-like' cluster of novel viral micro RNA-like genes, each of which in turn modulates expression of at least one host target gene, the function and utility of which at least one host target gene is known in the art.

VGR2927 gene, herein designated VGR GENE, is a novel bioinformatically detected regulatory, non protein coding, RNA viral gene. The method by which VGR2927 gene was detected is described hereinabove with reference to FIGS. 1-9.

VGR2927 gene encodes VGR2927 precursor RNA, herein designated VGR PRECURSOR RNA, an RNA molecule, typically several hundred nucleotides long.

VGR2927 precursor RNA folds spatially, forming VGR2927 folded precursor RNA, herein designated VGR FOLDED PRECURSOR RNA. It is appreciated that VGR2927 folded precursor RNA comprises a plurality of what is known in the art as 'hairpin' structures. These 'hairpin' structures are due to the fact that the nucleotide sequence of VGR2927 precursor RNA comprises a plurality of segments, the first half of each such segment having a nucleotide sequence which is at least a partial inversed-reversed sequence of the second half thereof, as is well known in the art.

VGR2927 folded precursor RNA is naturally processed by cellular enzymatic activity into at least 2 separate VGAM precursor RNAs, VGAM913 precursor RNA and VGAM914 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM913 RNA and VGAM914 RNA, herein schematically represented by VGAM1 RNA through VGAM3 RNA, each of which VGAM RNAs corresponding to VGAM RNA of FIG. 1.

VGAM913 RNA, herein schematically represented by VGAM1 RNA through VGAM3 RNA, binds complementarily to a host target binding site located in an untranslated region of VGAM913 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM913 host target RNA into VGAM913 host target protein, herein schematically represented by VGAM1 HOST TARGET PROTEIN through VGAM3 HOST TARGET PROTEIN, all of FIG. 1.

VGAM914 RNA, herein schematically represented by VGAM1 RNA through VGAM3 RNA, binds complementarily to a host target binding site located in an untranslated region of VGAM914 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM914 host target RNA into VGAM914 host target protein, herein schematically represented by VGAM1 HOST TARGET PROTEIN through VGAM3 HOST TARGET PROTEIN, all of FIG. 1.

It is appreciated that a function of VGR2927 gene, herein designated VGR GENE, is inhibition of expression of host target genes, as part of a novel viral mechanism of attacking a host. Accordingly, utilities of VGR2927 gene include diagnosis, prevention and treatment of viral infection by Pothos Latent Virus. Specific functions, and accordingly utilities, of VGR2927 gene correlate with, and may be deduced from, the identity of the host target genes, which are inhibited by VGAM RNAs comprised in the 'operon-like' cluster of VGR2927 gene: VGAM913 host target protein and VGAM914 host target protein, herein schematically represented by VGAM1 HOST TARGET PROTEIN through VGAM3 HOST TARGET PROTEIN. The function of these host target genes is elaborated hereinabove with reference to VGAM913 and VGAM914. FIG. 9 further provides a conceptual description of novel bioinformatically detected regulatory viral gene, referred to here as Viral Genomic Record 2928(VGR2928) viral gene, which encodes an 'operon-like' cluster of novel viral micro RNA-like genes, each of which in turn modulates expression of at least one host target gene, the function and utility of which at least one host target gene is known in the art.

VGR2928 gene, herein designated VGR GENE, is a novel bioinformatically detected regulatory, non protein coding, RNA viral gene. The method by which VGR2928 gene was detected is described hereinabove with reference to FIGS. 1-9.

VGR2928 gene encodes VGR2928 precursor RNA, herein designated VGR PRECURSOR RNA, an RNA molecule, typically several hundred nucleotides long.

VGR2928 precursor RNA folds spatially, forming VGR2928 folded precursor RNA, herein designated VGR FOLDED PRECURSOR RNA. It is appreciated that VGR2928 folded precursor RNA comprises a plurality of what is known in the art as 'hairpin' structures. These 'hairpin' structures are due to the fact that the nucleotide sequence of VGR2928 precursor RNA comprises a plurality of segments, the first half of each such segment having a nucleotide sequence which is at least a partial inversed-reversed sequence of the second half thereof, as is well known in the art.

VGR2928 folded precursor RNA is naturally processed by cellular enzymatic activity into at least 2 separate VGAM precursor RNAs, VGAM915 precursor RNA and VGAM916 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM915 RNA and VGAM916 RNA, herein schematically represented by VGAM1 RNA through VGAM3 RNA, each of which VGAM RNAs corresponding to VGAM RNA of FIG. 1.

VGAM915 RNA, herein schematically represented by VGAM1 RNA through VGAM3 RNA, binds complementarily to a host target binding site located in an untranslated region of VGAM915 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM915 host target RNA into VGAM915 host target protein, herein schematically represented by VGAM1 HOST TARGET PROTEIN through VGAM3 HOST TARGET PROTEIN, all of FIG. 1.

VGAM916 RNA, herein schematically represented by VGAM1 RNA through VGAM3 RNA, binds complementarily to a host target binding site located in an untranslated region of VGAM916 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM916 host target RNA into VGAM916 host target protein, herein schematically represented by VGAM1 HOST TARGET PROTEIN through VGAM3 HOST TARGET PROTEIN, all of FIG. 1.

It is appreciated that a function of VGR2928 gene, herein designated VGR GENE, is inhibition of expression of host target genes, as part of a novel viral mechanism of attacking a host. Accordingly, utilities of VGR2928 gene include diagnosis, prevention and treatment of viral infection by Trichoplusia Ni Cytoplasmic Polyhedrosis Virus 15. Specific functions, and accordingly utilities, of VGR2928 gene correlate with, and may be deduced from, the identity of the host target genes, which are inhibited by VGAM RNAs comprised in the 'operon-like' cluster of VGR2928 gene: VGAM915 host target protein and VGAM916 host target protein, herein schematically represented by VGAM1 HOST TARGET PROTEIN through VGAM3 HOST TARGET PROTEIN. The function of these host target genes is elaborated hereinabove with reference to VGAM915 and VGAM916. FIG. 9 further provides a conceptual description of novel bioinformatically detected regulatory viral gene, referred to here as Viral Genomic Record 2929(VGR2929) viral gene, which encodes an 'operon-like' cluster of novel viral micro RNA-like genes, each of which in turn modulates expression of at least one host target gene, the function and utility of which at least one host target gene is known in the art.

VGR2929 gene, herein designated VGR GENE, is a novel bioinformatically detected regulatory, non protein coding, RNA viral gene. The method by which VGR2929 gene was detected is described hereinabove with reference to FIGS. 1-9.

VGR2929 gene encodes VGR2929 precursor RNA, herein designated VGR PRECURSOR RNA, an RNA molecule, typically several hundred nucleotides long.

VGR2929 precursor RNA folds spatially, forming VGR2929 folded precursor RNA, herein designated VGR FOLDED PRECURSOR RNA. It is appreciated that VGR2929 folded precursor RNA comprises a plurality of what is known in the art as 'hairpin' structures. These 'hairpin' structures are due to the fact that the nucleotide sequence of VGR2929 precursor RNA comprises a plurality of segments, the first half of each such segment having a nucleotide sequence which is at least a partial inversed-reversed sequence of the second half thereof, as is well known in the art.

VGR2929 folded precursor RNA is naturally processed by cellular enzymatic activity into at least 2 separate VGAM precursor RNAs, VGAM918 precursor RNA and VGAM919 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM918 RNA and VGAM919 RNA, herein schematically represented by VGAM1 RNA through VGAM3 RNA, each of which VGAM RNAs corresponding to VGAM RNA of FIG. 1.

VGAM918 RNA, herein schematically represented by VGAM1 RNA through VGAM3 RNA, binds complementarily to a host target binding site located in an untranslated region of VGAM918 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM918 host target RNA into VGAM918 host target protein, herein schematically represented by VGAM1 HOST TARGET PROTEIN through VGAM3 HOST TARGET PROTEIN, all of FIG. 1.

VGAM919 RNA, herein schematically represented by VGAM1 RNA through VGAM3 RNA, binds complementarily to a host target binding site located in an untranslated region of VGAM919 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM919 host target RNA into VGAM919 host target protein, herein schematically represented by VGAM1 HOST TARGET PROTEIN through VGAM3 HOST TARGET PROTEIN, all of FIG. 1.

It is appreciated that a function of VGR2929 gene, herein designated VGR GENE, is inhibition of expression of host target genes, as part of a novel viral mechanism of attacking a host. Accordingly, utilities of VGR2929 gene include diagnosis, prevention and treatment of viral infection by Vaccinia Virus. Specific functions, and accordingly utilities, of VGR2929 gene correlate with, and may be deduced from, the identity of the host target genes, which are inhibited by VGAM RNAs comprised in the 'operon-like' cluster of VGR2929 gene: VGAM918 host target protein and VGAM919 host target protein, herein schematically represented by VGAM1 HOST TARGET PROTEIN through VGAM3 HOST TARGET PROTEIN. The function of these host target genes is elaborated hereinabove with reference to VGAM918 and VGAM919. FIG. 9 further provides a conceptual description of novel bioinformatically detected regulatory viral gene, referred to here as Viral Genomic Record 2930(VGR2930) viral gene, which encodes an 'operon-like' cluster of novel viral micro RNA-like genes, each of which in turn modulates expression of at least one host target gene, the function and utility of which at least one host target gene is known in the art.

VGR2930 gene, herein designated VGR GENE, is a novel bioinformatically detected regulatory, non protein coding, RNA viral gene. The method by which VGR2930 gene was detected is described hereinabove with reference to FIGS. 1-9.

VGR2930 gene encodes VGR2930 precursor RNA, herein designated VGR PRECURSOR RNA, an RNA molecule, typically several hundred nucleotides long.

VGR2930 precursor RNA folds spatially, forming VGR2930 folded precursor RNA, herein designated VGR FOLDED PRECURSOR RNA. It is appreciated that VGR2930 folded precursor RNA comprises a plurality of what is known in the art as 'hairpin' structures. These 'hairpin' structures are due to the fact that the nucleotide sequence of VGR2930 precursor RNA comprises a plurality of segments, the first half of each such segment having a nucleotide sequence which is at least a partial inversed-reversed sequence of the second half thereof, as is well known in the art.

VGR2930 folded precursor RNA is naturally processed by cellular enzymatic activity into at least 3 separate VGAM precursor RNAs, VGAM921 precursor RNA, VGAM922 precursor RNA and VGAM923 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM921 RNA, VGAM922 RNA and VGAM923 RNA, herein schematically represented by VGAM1 RNA through VGAM3 RNA, each of which VGAM RNAs corresponding to VGAM RNA of FIG. 1.

VGAM921 RNA, herein schematically represented by VGAM1 RNA through VGAM3 RNA, binds complementarily to a host target binding site located in an untranslated region of VGAM921 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM921 host target RNA into VGAM921 host target protein, herein schematically represented by VGAM1 HOST TARGET PROTEIN through VGAM3 HOST TARGET PROTEIN, all of FIG. 1.

VGAM922 RNA, herein schematically represented by VGAM1 RNA through VGAM3 RNA, binds complementarily to a host target binding site located in an untranslated region of VGAM922 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM922 host target RNA into VGAM922 host target protein, herein schematically represented by VGAM1 HOST TARGET PROTEIN through VGAM3 HOST TARGET PROTEIN, all of FIG. 1.

VGAM923 RNA, herein schematically represented by VGAM1 RNA through VGAM3 RNA, binds complementarily to a host target binding site located in an untranslated region of VGAM923 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM923 host target RNA into VGAM923 host target protein, herein schematically represented by VGAM1 HOST TARGET PROTEIN through VGAM3 HOST TARGET PROTEIN, all of FIG. 1.

It is appreciated that a function of VGR2930 gene, herein designated VGR GENE, is inhibition of expression of host target genes, as part of a novel viral mechanism of attacking a host. Accordingly, utilities of VGR2930 gene include diagnosis, prevention and treatment of viral infection by Peanut Clump Virus. Specific functions, and accordingly utilities, of VGR2930 gene correlate with, and may be deduced from, the identity of the host target genes, which are inhibited by VGAM RNAs comprised in the 'operon-like' cluster of VGR2930 gene: VGAM921 host target protein, VGAM922 host target protein and VGAM923 host target protein, herein schematically represented by VGAM1 HOST TARGET PROTEIN through VGAM3 HOST TARGET PROTEIN. The function of these host target genes is elaborated hereinabove with reference to VGAM921, VGAM922 and VGAM923. FIG. 9 further provides a conceptual description of novel bioinformatically detected regulatory viral gene, referred to here as Viral Genomic Record 2931(VGR2931) viral gene, which encodes an 'operon-like' cluster of novel viral micro RNA-like genes, each of which in turn modulates expression of at least one host target gene, the function and utility of which at least one host target gene is known in the art.

VGR2931 gene, herein designated VGR GENE, is a novel bioinformatically detected regulatory, non protein coding, RNA viral gene. The method by which VGR2931 gene was detected is described hereinabove with reference to FIGS. 1-9.

VGR2931 gene encodes VGR2931 precursor RNA, herein designated VGR PRECURSOR RNA, an RNA molecule, typically several hundred nucleotides long.

VGR2931 precursor RNA folds spatially, forming VGR2931 folded precursor RNA, herein designated VGR FOLDED PRECURSOR RNA. It is appreciated that VGR2931 folded precursor RNA comprises a plurality of what is known in the art as 'hairpin' structures. These 'hairpin' structures are due to the fact that the nucleotide sequence of VGR2931 precursor RNA comprises a plurality of segments, the first half of each such segment having a nucleotide sequence which is at least a partial inversed-reversed sequence of the second half thereof, as is well known in the art.

VGR2931 folded precursor RNA is naturally processed by cellular enzymatic activity into at least 6 separate VGAM precursor RNAs, VGAM924 precursor RNA, VGAM925 precursor RNA, VGAM926 precursor RNA, VGAM927 precursor RNA, VGAM928 precursor RNA and VGAM929 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM924 RNA, VGAM925 RNA, VGAM926 RNA, VGAM927 RNA, VGAM928 RNA and VGAM929 RNA, herein schematically represented by VGAM1 RNA through VGAM3 RNA, each of which VGAM RNAs corresponding to VGAM RNA of FIG. 1.

VGAM924 RNA, herein schematically represented by VGAM1 RNA through VGAM3 RNA, binds complementarily to a host target binding site located in an untranslated region of VGAM924 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM924 host target RNA into VGAM924 host target protein, herein schematically represented by VGAM1 HOST TARGET PROTEIN through VGAM3 HOST TARGET PROTEIN, all of FIG. 1.

VGAM925 RNA, herein schematically represented by VGAM1 RNA through VGAM3 RNA, binds complementarily to a host target binding site located in an untranslated region of VGAM925 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM925 host target RNA into VGAM925 host target protein, herein schematically represented by VGAM1 HOST TARGET PROTEIN through VGAM3 HOST TARGET PROTEIN, all of FIG. 1.

VGAM926 RNA, herein schematically represented by VGAM1 RNA through VGAM3 RNA, binds complementarily to a host target binding site located in an untranslated region of VGAM926 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM926 host target RNA into VGAM926 host target protein, herein schematically represented by VGAM1 HOST TARGET PROTEIN through VGAM3 HOST TARGET PROTEIN, all of FIG. 1.

VGAM927 RNA, herein schematically represented by VGAM1 RNA through VGAM3 RNA, binds complementarily to a host target binding site located in an untranslated region of VGAM927 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM927 host target RNA into VGAM927 host target protein, herein schematically represented by VGAM1 HOST TARGET PROTEIN through VGAM3 HOST TARGET PROTEIN, all of FIG. 1.

VGAM928 RNA, herein schematically represented by VGAM1 RNA through VGAM3 RNA, binds complementarily to a host target binding site located in an untranslated region of VGAM928 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM928 host target RNA into VGAM928 host target protein, herein schematically represented by VGAM1 HOST TARGET PROTEIN through VGAM3 HOST TARGET PROTEIN, all of FIG. 1.

VGAM929 RNA, herein schematically represented by VGAM1 RNA through VGAM3 RNA, binds complementarily to a host target binding site located in an untranslated region of VGAM929 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM929 host target RNA into VGAM929 host target protein, herein schematically represented by VGAM1 HOST TARGET PROTEIN through VGAM3 HOST TARGET PROTEIN, all of FIG. 1.

It is appreciated that a function of VGR2931 gene, herein designated VGR GENE, is inhibition of expression of host target genes, as part of a novel viral mechanism of attacking a host. Accordingly, utilities of VGR2931 gene include diagnosis, prevention and treatment of viral infection by Infectious Spleen and Kidney Necrosis Virus. Specific functions, and accordingly utilities, of VGR2931 gene correlate with, and may be deduced from, the identity of the host target genes, which are inhibited by VGAM RNAs comprised in the 'operon-like' cluster of VGR2931 gene: VGAM924 host target protein, VGAM925 host target protein, VGAM926 host target protein, VGAM927 host target protein, VGAM928 host target protein and VGAM929 host target protein, herein schematically represented by VGAM1 HOST TARGET PROTEIN through VGAM3 HOST TARGET PROTEIN. The function of these host target genes is elaborated hereinabove with reference to VGAM924, VGAM925, VGAM926, VGAM927, VGAM928 and VGAM929. FIG. 9 further provides a conceptual description of novel bioinformatically detected regulatory viral gene, referred to here as Viral Genomic Record 2932(VGR2932) viral gene, which encodes an 'operon-like' cluster of novel viral micro RNA-like genes, each of which in turn modulates expression of at least one host target gene, the function and utility of which at least one host target gene is known in the art.

VGR2932 gene, herein designated VGR GENE, is a novel bioinformatically detected regulatory, non protein coding, RNA viral gene. The method by which VGR2932 gene was detected is described hereinabove with reference to FIGS. 1-9.

VGR2932 gene encodes VGR2932 precursor RNA, herein designated VGR PRECURSOR RNA, an RNA molecule, typically several hundred nucleotides long.

VGR2932 precursor RNA folds spatially, forming VGR2932 folded precursor RNA, herein designated VGR FOLDED PRECURSOR RNA. It is appreciated that VGR2932 folded precursor RNA comprises a plurality of what is known in the art as 'hairpin' structures. These 'hairpin' structures are due to the fact that the nucleotide sequence of VGR2932 precursor RNA comprises a plurality of segments, the first half of each such segment having a nucleotide sequence which is at least a partial inversed-reversed sequence of the second half thereof, as is well known in the art.

VGR2932 folded precursor RNA is naturally processed by cellular enzymatic activity into at least 3 separate VGAM precursor RNAs, VGAM932 precursor RNA, VGAM933 precursor RNA and VGAM934 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM932 RNA, VGAM933 RNA and VGAM934 RNA, herein schematically represented by VGAM1 RNA through VGAM3 RNA, each of which VGAM RNAs corresponding to VGAM RNA of FIG. 1.

VGAM932 RNA, herein schematically represented by VGAM1 RNA through VGAM3 RNA, binds complementarily to a host target binding site located in an untranslated region of VGAM932 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM932 host target RNA into VGAM932 host target protein, herein schematically represented by VGAM1 HOST TARGET PROTEIN through VGAM3 HOST TARGET PROTEIN, all of FIG. 1.

VGAM933 RNA, herein schematically represented by VGAM1 RNA through VGAM3 RNA, binds complementarily to a host target binding site located in an untranslated region of VGAM933 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM933 host target RNA into VGAM933 host target protein, herein schematically represented by VGAM1 HOST TARGET PROTEIN through VGAM3 HOST TARGET PROTEIN, all of FIG. 1.

VGAM934 RNA, herein schematically represented by VGAM1 RNA through VGAM3 RNA, binds complementarily to a host target binding site located in an untranslated region of VGAM934 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM934 host target RNA into VGAM934 host target protein, herein schematically represented by VGAM1 HOST TARGET PROTEIN through VGAM3 HOST TARGET PROTEIN, all of FIG. 1.

It is appreciated that a function of VGR2932 gene, herein designated VGR GENE, is inhibition of expression of host target genes, as part of a novel viral mechanism of attacking a host. Accordingly, utilities of VGR2932 gene include diagnosis, prevention and treatment of viral infection by Human Herpesvirus 4. Specific functions, and accordingly utilities, of VGR2932 gene correlate with, and may be deduced from, the identity of the host target genes, which are inhibited by VGAM RNAs comprised in the 'operon-like' cluster of VGR2932 gene: VGAM932 host target protein, VGAM933 host target protein and VGAM934 host target protein, herein schematically represented by VGAM1 HOST TARGET PROTEIN through VGAM3 HOST TARGET PROTEIN. The function of these host target genes is elaborated hereinabove with reference to VGAM932, VGAM933 and VGAM934. FIG. 9 further provides a conceptual description of novel bioinformatically detected regulatory viral gene, referred to here as Viral Genomic Record 2933(VGR2933) viral gene, which encodes an 'operon-like' cluster of novel viral micro RNA-like genes, each of which in turn modulates expression of at least one host target gene, the function and utility of which at least one host target gene is known in the art.

VGR2933 gene, herein designated VGR GENE, is a novel bioinformatically detected regulatory, non protein coding, RNA viral gene. The method by which VGR2933 gene was detected is described hereinabove with reference to FIGS. 1-9.

VGR2933 gene encodes VGR2933 precursor RNA, herein designated VGR PRECURSOR RNA, an RNA molecule, typically several hundred nucleotides long.

VGR2933 precursor RNA folds spatially, forming VGR2933 folded precursor RNA, herein designated VGR FOLDED PRECURSOR RNA. It is appreciated that VGR2933 folded precursor RNA comprises a plurality of what is known in the art as 'hairpin' structures. These 'hairpin' structures are due to the fact that the nucleotide sequence of VGR2933 precursor RNA comprises a plurality of segments, the first half of each such segment having a nucleotide sequence which is at least a partial inversed-reversed sequence of the second half thereof, as is well known in the art.

VGR2933 folded precursor RNA is naturally processed by cellular enzymatic activity into at least 3 separate VGAM precursor RNAs, VGAM935 precursor RNA, VGAM936 precursor RNA and VGAM937 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM935 RNA, VGAM936 RNA and VGAM937 RNA, herein schematically represented by VGAM1 RNA through VGAM3 RNA, each of which VGAM RNAs corresponding to VGAM RNA of FIG. 1.

VGAM935 RNA, herein schematically represented by VGAM1 RNA through VGAM3 RNA, binds complementarily to a host target binding site located in an untranslated region of VGAM935 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM935 host target RNA into VGAM935 host target protein, herein schematically represented by VGAM1 HOST TARGET PROTEIN through VGAM3 HOST TARGET PROTEIN, all of FIG. 1.

VGAM936 RNA, herein schematically represented by VGAM1 RNA through VGAM3 RNA, binds complementarily to a host target binding site located in an untranslated region of VGAM936 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM936 host target RNA into VGAM936 host target protein, herein schematically represented by VGAM1 HOST TARGET PROTEIN through VGAM3 HOST TARGET PROTEIN, all of FIG. 1.

VGAM937 RNA, herein schematically represented by VGAM1 RNA through VGAM3 RNA, binds complementarily to a host target binding site located in an untranslated region of VGAM937 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM937 host target RNA into VGAM937 host target protein, herein schematically represented by VGAM1 HOST TARGET PROTEIN through VGAM3 HOST TARGET PROTEIN, all of FIG. 1.

It is appreciated that a function of VGR2933 gene, herein designated VGR GENE, is inhibition of expression of host target genes, as part of a novel viral mechanism of attacking a host. Accordingly, utilities of VGR2933 gene include diagnosis, prevention and treatment of viral infection by Melanoplus Sanguinipes Entomopoxvirus. Specific functions, and accordingly utilities, of VGR2933 gene correlate with, and may be deduced from, the identity of the host target genes, which are inhibited by VGAM RNAs comprised in the 'operon-like' cluster of VGR2933 gene: VGAM935 host target protein, VGAM936 host target protein and VGAM937 host target protein, herein schematically represented by VGAM1 HOST TARGET PROTEIN through VGAM3 HOST TARGET PROTEIN. The function of these host target genes is elaborated hereinabove with reference to VGAM935, VGAM936 and VGAM937. FIG. 9 further provides a conceptual description of novel bioinformatically detected regulatory viral gene, referred to here as Viral Genomic Record 2934(VGR2934) viral gene, which encodes an 'operon-like' cluster of novel viral micro RNA-like genes, each of which in turn modulates expression of at least one host target gene, the function and utility of which at least one host target gene is known in the art.

VGR2934 gene, herein designated VGR GENE, is a novel bioinformatically detected regulatory, non protein coding, RNA viral gene. The method by which VGR2934 gene was detected is described hereinabove with reference to FIGS. 1-9.

VGR2934 gene encodes VGR2934 precursor RNA, herein designated VGR PRECURSOR RNA, an RNA molecule, typically several hundred nucleotides long.

VGR2934 precursor RNA folds spatially, forming VGR2934 folded precursor RNA, herein designated VGR FOLDED PRECURSOR RNA. It is appreciated that VGR2934 folded precursor RNA comprises a plurality of what is known in the art as 'hairpin' structures. These 'hairpin' structures are due to the fact that the nucleotide sequence of VGR2934 precursor RNA comprises a plurality of segments, the first half of each such segment having a nucleotide sequence which is at least a partial inversed-reversed sequence of the second half thereof, as is well known in the art.

VGR2934 folded precursor RNA is naturally processed by cellular enzymatic activity into at least 3 separate VGAM precursor RNAs, VGAM938 precursor RNA, VGAM939 precursor RNA and VGAM940 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM938 RNA, VGAM939 RNA and VGAM940 RNA, herein schematically represented by VGAM1 RNA through VGAM3 RNA, each of which VGAM RNAs corresponding to VGAM RNA of FIG. 1.

VGAM938 RNA, herein schematically represented by VGAM1 RNA through VGAM3 RNA, binds complementarily to a host target binding site located in an untranslated region of VGAM938 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM938 host target RNA into VGAM938 host target protein, herein schematically represented by VGAM1 HOST TARGET PROTEIN through VGAM3 HOST TARGET PROTEIN, all of FIG. 1.

VGAM939 RNA, herein schematically represented by VGAM1 RNA through VGAM3 RNA, binds complementarily to a host target binding site located in an untranslated region of VGAM939 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM939 host target RNA into VGAM939 host target protein, herein schematically represented by VGAM1 HOST TARGET PROTEIN through VGAM3 HOST TARGET PROTEIN, all of FIG. 1.

VGAM940 RNA, herein schematically represented by VGAM1 RNA through VGAM3 RNA, binds complementarily to a host target binding site located in an untranslated region of VGAM940 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM940 host target RNA into VGAM940 host target protein, herein schematically represented by VGAM1 HOST TARGET PROTEIN through VGAM3 HOST TARGET PROTEIN, all of FIG. 1.

It is appreciated that a function of VGR2934 gene, herein designated VGR GENE, is inhibition of expression of host target genes, as part of a novel viral mechanism of attacking a host. Accordingly, utilities of VGR2934 gene include diagnosis, prevention and treatment of viral infection by Beet Soil-borne Mosaic Virus. Specific functions, and accordingly utilities, of VGR2934 gene correlate with, and may be deduced from, the identity of the host target genes, which are inhibited by VGAM RNAs comprised in the 'operon-like' cluster of VGR2934 gene: VGAM938 host target protein, VGAM939 host target protein and VGAM940 host target protein, herein schematically represented by VGAM1 HOST TARGET PROTEIN through VGAM3 HOST TARGET PROTEIN. The function of these host target genes is elaborated hereinabove with reference to VGAM938, VGAM939 and VGAM940. FIG. 9 further provides a conceptual description of novel bioinformatically detected regulatory viral gene, referred to here as Viral Genomic Record 2935(VGR2935) viral gene, which encodes an 'operon-like' cluster of novel viral micro RNA-like genes, each of which in turn modulates expression of at least one host target gene, the function and utility of which at least one host target gene is known in the art.

VGR2935 gene, herein designated VGR GENE, is a novel bioinformatically detected regulatory, non protein coding, RNA viral gene. The method by which VGR2935 gene was detected is described hereinabove with reference to FIGS. 1-9.

VGR2935 gene encodes VGR2935 precursor RNA, herein designated VGR PRECURSOR RNA, an RNA molecule, typically several hundred nucleotides long.

VGR2935 precursor RNA folds spatially, forming VGR2935 folded precursor RNA, herein designated VGR FOLDED PRECURSOR RNA. It is appreciated that VGR2935 folded precursor RNA comprises a plurality of what is known in the art as 'hairpin' structures. These 'hairpin' structures are due to the fact that the nucleotide sequence of VGR2935 precursor RNA comprises a plurality of segments, the first half of each such segment having a nucleotide sequence which is at least a partial inversed-reversed sequence of the second half thereof, as is well known in the art.

VGR2935 folded precursor RNA is naturally processed by cellular enzymatic activity into at least 3 separate VGAM precursor RNAs, VGAM941 precursor RNA, VGAM942 precursor RNA and VGAM943 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM941 RNA, VGAM942 RNA and VGAM943 RNA, herein schematically represented by VGAM1 RNA through VGAM3 RNA, each of which VGAM RNAs corresponding to VGAM RNA of FIG. 1.

VGAM941 RNA, herein schematically represented by VGAM1 RNA through VGAM3 RNA, binds complementarily to a host target binding site located in an untranslated region of VGAM941 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM941 host target RNA into VGAM941 host target protein, herein schematically represented by VGAM1 HOST TARGET PROTEIN through VGAM3 HOST TARGET PROTEIN, all of FIG. 1.

VGAM942 RNA, herein schematically represented by VGAM1 RNA through VGAM3 RNA, binds complementarily to a host target binding site located in an untranslated region of VGAM942 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM942 host target RNA into VGAM942 host target protein, herein schematically represented by VGAM1 HOST TARGET PROTEIN through VGAM3 HOST TARGET PROTEIN, all of FIG. 1.

VGAM943 RNA, herein schematically represented by VGAM1 RNA through VGAM3 RNA, binds complementarily to a host target binding site located in an untranslated region of VGAM943 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM943 host target RNA into VGAM943 host target protein, herein schematically represented by VGAM1 HOST TARGET PROTEIN through VGAM3 HOST TARGET PROTEIN, all of FIG. 1.

It is appreciated that a function of VGR2935 gene, herein designated VGR GENE, is inhibition of expression of host target genes, as part of a novel viral mechanism of attacking a host. Accordingly, utilities of VGR2935 gene include diagnosis, prevention and treatment of viral infection by Infectious Spleen and Kidney Necrosis Virus. Specific functions, and accordingly utilities, of VGR2935 gene correlate with, and may be deduced from, the identity of the host target genes, which are inhibited by VGAM RNAs comprised in the 'operon-like' cluster of VGR2935 gene: VGAM941 host target protein, VGAM942 host target protein and VGAM943 host target protein, herein schematically represented by VGAM1 HOST TARGET PROTEIN through VGAM3 HOST TARGET PROTEIN. The function of these host target genes is elaborated hereinabove with reference to VGAM941, VGAM942 and VGAM943. FIG. 9 further provides a conceptual description of novel bioinformatically detected regulatory viral gene, referred to here as Viral Genomic Record 2936(VGR2936) viral gene, which encodes an 'operon-like' cluster of novel viral micro RNA-like genes, each of which in turn modulates expression of at least one host target gene, the function and utility of which at least one host target gene is known in the art.

VGR2936 gene, herein designated VGR GENE, is a novel bioinformatically detected regulatory, non protein coding, RNA viral gene. The method by which VGR2936 gene was detected is described hereinabove with reference to FIGS. 1-9.

VGR2936 gene encodes VGR2936 precursor RNA, herein designated VGR PRECURSOR RNA, an RNA molecule, typically several hundred nucleotides long.

VGR2936 precursor RNA folds spatially, forming VGR2936 folded precursor RNA, herein designated VGR FOLDED PRECURSOR RNA. It is appreciated that VGR2936 folded precursor RNA comprises a plurality of what is known in the art as 'hairpin' structures. These 'hairpin' structures are due to the fact that the nucleotide sequence of VGR2936 precursor RNA comprises a plurality of segments, the first half of each such segment having a nucleotide sequence which is at least a partial inversed-reversed sequence of the second half thereof, as is well known in the art.

VGR2936 folded precursor RNA is naturally processed by cellular enzymatic activity into at least 2 separate VGAM precursor RNAs, VGAM944 precursor RNA and VGAM945 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM944 RNA and VGAM945 RNA, herein schematically represented by VGAM1 RNA through VGAM3 RNA, each of which VGAM RNAs corresponding to VGAM RNA of FIG. 1.

VGAM944 RNA, herein schematically represented by VGAM1 RNA through VGAM3 RNA, binds complementarily to a host target binding site located in an untranslated region of VGAM944 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM944 host target RNA into VGAM944 host target protein, herein schematically represented by VGAM1 HOST TARGET PROTEIN through VGAM3 HOST TARGET PROTEIN, all of FIG. 1.

VGAM945 RNA, herein schematically represented by VGAM1 RNA through VGAM3 RNA, binds complementarily to a host target binding site located in an untranslated region of VGAM945 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM945 host target RNA into VGAM945 host target protein, herein schematically represented by VGAM1 HOST TARGET PROTEIN through VGAM3 HOST TARGET PROTEIN, all of FIG. 1.

It is appreciated that a function of VGR2936 gene, herein designated VGR GENE, is inhibition of expression of host target genes, as part of a novel viral mechanism of attacking a host. Accordingly, utilities of VGR2936 gene include diagnosis, prevention and treatment of viral infection by Human Herpesvirus 7. Specific functions, and accordingly utilities, of VGR2936 gene correlate with, and may be deduced from, the identity of the host target genes, which are inhibited by VGAM RNAs comprised in the 'operon-like' cluster of VGR2936 gene: VGAM944 host target protein and VGAM945 host target protein, herein schematically represented by VGAM1 HOST TARGET PROTEIN through VGAM3 HOST TARGET PROTEIN. The function of these host target genes is elaborated hereinabove with reference to VGAM944 and VGAM945. FIG. 9 further provides a conceptual description of novel bioinformatically detected regulatory viral gene, referred to here as Viral Genomic Record 2937(VGR2937) viral gene, which encodes an 'operon-like' cluster of novel viral micro RNA-like genes, each of which in turn modulates expression of at least one host target gene, the function and utility of which at least one host target gene is known in the art.

VGR2937 gene, herein designated VGR GENE, is a novel bioinformatically detected regulatory, non protein coding, RNA viral gene. The method by which VGR2937 gene was detected is described hereinabove with reference to FIGS. 1-9.

VGR2937 gene encodes VGR2937 precursor RNA, herein designated VGR PRECURSOR RNA, an RNA molecule, typically several hundred nucleotides long.

VGR2937 precursor RNA folds spatially, forming VGR2937 folded precursor RNA, herein designated VGR FOLDED PRECURSOR RNA. It is appreciated that VGR2937 folded precursor RNA comprises a plurality of what is known in the art as 'hairpin' structures. These 'hairpin' structures are due to the fact that the nucleotide sequence of VGR2937 precursor RNA comprises a plurality of segments, the first half of each such segment having a nucleotide sequence which is at least a partial inversed-reversed sequence of the second half thereof, as is well known in the art.

VGR2937 folded precursor RNA is naturally processed by cellular enzymatic activity into at least 2 separate VGAM precursor RNAs, VGAM946 precursor RNA and VGAM947 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM946 RNA and VGAM947 RNA, herein schematically represented by VGAM1 RNA through VGAM3 RNA, each of which VGAM RNAs corresponding to VGAM RNA of FIG. 1.

VGAM946 RNA, herein schematically represented by VGAM1 RNA through VGAM3 RNA, binds complementarily to a host target binding site located in an untranslated region of VGAM946 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM946 host target RNA into VGAM946 host target protein, herein schematically represented by VGAM1 HOST TARGET PROTEIN through VGAM3 HOST TARGET PROTEIN, all of FIG. 1.

VGAM947 RNA, herein schematically represented by VGAM1 RNA through VGAM3 RNA, binds complementarily to a host target binding site located in an untranslated region of VGAM947 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM947 host target RNA into VGAM947 host target protein, herein schematically represented by VGAM1 HOST TARGET PROTEIN through VGAM3 HOST TARGET PROTEIN, all of FIG. 1.

It is appreciated that a function of VGR2937 gene, herein designated VGR GENE, is inhibition of expression of host target genes, as part of a novel viral mechanism of attacking a host. Accordingly, utilities of VGR2937 gene include diagnosis, prevention and treatment of viral infection by Human Herpesvirus 6. Specific functions, and accordingly utilities, of VGR2937 gene correlate with, and may be deduced from, the identity of the host target genes, which are inhibited by VGAM RNAs comprised in the 'operon-like' cluster of VGR2937 gene: VGAM946 host target protein and VGAM947 host target protein, herein schematically represented by VGAM1 HOST TARGET PROTEIN through VGAM3 HOST TARGET PROTEIN. The function of these host target genes is elaborated hereinabove with reference to VGAM946 and VGAM947. FIG. 9 further provides a conceptual description of novel bioinformatically detected regulatory viral gene, referred to here as Viral Genomic Record 2938(VGR2938) viral gene, which encodes an 'operon-like' cluster of novel viral micro RNA-like genes, each of which in turn modulates expression of at least one host target gene, the function and utility of which at least one host target gene is known in the art.

VGR2938 gene, herein designated VGR GENE, is a novel bioinformatically detected regulatory, non protein coding, RNA viral gene. The method by which VGR2938 gene was detected is described hereinabove with reference to FIGS. 1-9.

VGR2938 gene encodes VGR2938 precursor RNA, herein designated VGR PRECURSOR RNA, an RNA molecule, typically several hundred nucleotides long.

VGR2938 precursor RNA folds spatially, forming VGR2938 folded precursor RNA, herein designated VGR FOLDED PRECURSOR RNA. It is appreciated that VGR2938 folded precursor RNA comprises a plurality of what is known in the art as 'hairpin' structures. These 'hairpin' structures are due to the fact that the nucleotide sequence of VGR2938 precursor RNA comprises a plurality of segments, the first half of each such segment having a nucleotide sequence which is at least a partial inversed-reversed sequence of the second half thereof, as is well known in the art.

VGR2938 folded precursor RNA is naturally processed by cellular enzymatic activity into at least 2 separate VGAM precursor RNAs, VGAM948 precursor RNA and VGAM949 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM948 RNA and VGAM949 RNA, herein schematically represented by VGAM1 RNA through VGAM3 RNA, each of which VGAM RNAs corresponding to VGAM RNA of FIG. 1.

VGAM948 RNA, herein schematically represented by VGAM1 RNA through VGAM3 RNA, binds complementarily to a host target binding site located in an untranslated region of VGAM948 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM948 host target RNA into VGAM948 host target protein, herein schematically represented by VGAM1 HOST TARGET PROTEIN through VGAM3 HOST TARGET PROTEIN, all of FIG. 1.

VGAM949 RNA, herein schematically represented by VGAM1 RNA through VGAM3 RNA, binds complementarily to a host target binding site located in an untranslated region of VGAM949 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM949 host target RNA into VGAM949 host target protein, herein schematically represented by VGAM1 HOST TARGET PROTEIN through VGAM3 HOST TARGET PROTEIN, all of FIG. 1.

It is appreciated that a function of VGR2938 gene, herein designated VGR GENE, is inhibition of expression of host target genes, as part of a novel viral mechanism of attacking a host. Accordingly, utilities of VGR2938 gene include diagnosis, prevention and treatment of viral infection by Carnation Italian Ringspot Virus. Specific functions, and accordingly utilities, of VGR2938 gene correlate with, and may be deduced from, the identity of the host target genes, which are inhibited by VGAM RNAs comprised in the 'operon-like' cluster of VGR2938 gene: VGAM948 host target protein and VGAM949 host target protein, herein schematically represented by VGAM1 HOST TARGET PROTEIN through VGAM3 HOST TARGET PROTEIN. The function of these host target genes is elaborated hereinabove with reference to VGAM948 and VGAM949. FIG. 9 further provides a conceptual description of novel bioinformatically detected regulatory viral gene, referred to here as Viral Genomic Record 2939(VGR2939) viral gene, which encodes an 'operon-like' cluster of novel viral micro RNA-like genes, each of which in turn modulates expression of at least one host target gene, the function and utility of which at least one host target gene is known in the art.

VGR2939 gene, herein designated VGR GENE, is a novel bioinformatically detected regulatory, non protein coding, RNA viral gene. The method by which VGR2939 gene was detected is described hereinabove with reference to FIGS. 1-9.

VGR2939 gene encodes VGR2939 precursor RNA, herein designated VGR PRECURSOR RNA, an RNA molecule, typically several hundred nucleotides long.

VGR2939 precursor RNA folds spatially, forming VGR2939 folded precursor RNA, herein designated VGR FOLDED PRECURSOR RNA. It is appreciated that VGR2939 folded precursor RNA comprises a plurality of what is known in the art as 'hairpin' structures. These 'hairpin' structures are due to the fact that the nucleotide sequence of VGR2939 precursor RNA comprises a plurality of segments, the first half of each such segment having a nucleotide sequence which is at least a partial inversed-reversed sequence of the second half thereof, as is well known in the art.

VGR2939 folded precursor RNA is naturally processed by cellular enzymatic activity into at least 3 separate VGAM precursor RNAs, VGAM950 precursor RNA, VGAM951 precursor RNA and VGAM952 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM950 RNA, VGAM951 RNA and VGAM952 RNA, herein schematically represented by VGAM1 RNA through VGAM3 RNA, each of which VGAM RNAs corresponding to VGAM RNA of FIG. 1.

VGAM950 RNA, herein schematically represented by VGAM1 RNA through VGAM3 RNA, binds complementarily to a host target binding site located in an untranslated region of VGAM950 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM950 host target RNA into VGAM950 host target protein, herein schematically represented by VGAM1 HOST TARGET PROTEIN through VGAM3 HOST TARGET PROTEIN, all of FIG. 1.

VGAM951 RNA, herein schematically represented by VGAM1 RNA through VGAM3 RNA, binds complementarily to a host target binding site located in an untranslated region of VGAM951 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM951 host target RNA into VGAM951 host target protein, herein schematically represented by VGAM1 HOST TARGET PROTEIN through VGAM3 HOST TARGET PROTEIN, all of FIG. 1.

VGAM952 RNA, herein schematically represented by VGAM1 RNA through VGAM3 RNA, binds complementarily to a host target binding site located in an untranslated region of VGAM952 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM952 host target RNA into VGAM952 host target protein, herein schematically represented by VGAM1 HOST TARGET PROTEIN through VGAM3 HOST TARGET PROTEIN, all of FIG. 1.

It is appreciated that a function of VGR2939 gene, herein designated VGR GENE, is inhibition of expression of host target genes, as part of a novel viral mechanism of attacking a host. Accordingly, utilities of VGR2939 gene include diagnosis, prevention and treatment of viral infection by Tomato Bushy Stunt Virus. Specific functions, and accordingly utilities, of VGR2939 gene correlate with, and may be deduced from, the identity of the host target genes, which are inhibited by VGAM RNAs comprised in the 'operon-like' cluster of VGR2939 gene: VGAM950 host target protein, VGAM951 host target protein and VGAM952 host target protein, herein schematically represented by VGAM1 HOST TARGET PROTEIN through VGAM3 HOST TARGET PROTEIN. The function of these host target genes is elaborated hereinabove with reference to VGAM950, VGAM951 and VGAM952. FIG. 9 further provides a conceptual description of novel bioinformatically detected regulatory viral gene, referred to here as Viral Genomic Record 2940(VGR2940) viral gene, which encodes an 'operon-like' cluster of novel viral micro RNA-like genes, each of which in turn modulates expression of at least one host target gene, the function and utility of which at least one host target gene is known in the art.

VGR2940 gene, herein designated VGR GENE, is a novel bioinformatically detected regulatory, non protein coding, RNA viral gene. The method by which VGR2940 gene was detected is described hereinabove with reference to FIGS. 1-9.

VGR2940 gene encodes VGR2940 precursor RNA, herein designated VGR PRECURSOR RNA, an RNA molecule, typically several hundred nucleotides long.

VGR2940 precursor RNA folds spatially, forming VGR2940 folded precursor RNA, herein designated VGR FOLDED PRECURSOR RNA. It is appreciated that VGR2940 folded precursor RNA comprises a plurality of what is known in the art as 'hairpin' structures. These 'hairpin' structures are due to the fact that the nucleotide sequence of VGR2940 precursor RNA comprises a plurality of segments, the first half of each such segment having a nucleotide sequence which is at least a partial inversed-reversed sequence of the second half thereof, as is well known in the art.

VGR2940 folded precursor RNA is naturally processed by cellular enzymatic activity into at least 6 separate VGAM precursor RNAs, VGAM953 precursor RNA, VGAM954 precursor RNA, VGAM955 precursor RNA, VGAM956 precursor RNA, VGAM957 precursor RNA and VGAM958 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM953 RNA, VGAM954 RNA, VGAM955 RNA, VGAM956 RNA, VGAM957 RNA and VGAM958 RNA, herein schematically represented by VGAM1 RNA through VGAM3 RNA, each of which VGAM RNAs corresponding to VGAM RNA of FIG. 1.

VGAM953 RNA, herein schematically represented by VGAM1 RNA through VGAM3 RNA, binds complementarily to a host target binding site located in an untranslated region of VGAM953 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM953 host target RNA into VGAM953 host target protein, herein schematically represented by VGAM1 HOST TARGET PROTEIN through VGAM3 HOST TARGET PROTEIN, all of FIG. 1.

VGAM954 RNA, herein schematically represented by VGAM1 RNA through VGAM3 RNA, binds complementarily to a host target binding site located in an untranslated region of VGAM954 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM954 host target RNA into VGAM954 host target protein, herein schematically represented by VGAM1 HOST TARGET PROTEIN through VGAM3 HOST TARGET PROTEIN, all of FIG. 1.

VGAM955 RNA, herein schematically represented by VGAM1 RNA through VGAM3 RNA, binds complementarily to a host target binding site located in an untranslated region of VGAM955 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM955 host target RNA into VGAM955 host target protein, herein schematically represented by VGAM1 HOST TARGET PROTEIN through VGAM3 HOST TARGET PROTEIN, all of FIG. 1.

VGAM956 RNA, herein schematically represented by VGAM1 RNA through VGAM3 RNA, binds complementarily to a host target binding site located in an untranslated region of VGAM956 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM956 host target RNA into VGAM956 host target protein, herein schematically represented by VGAM1 HOST TARGET PROTEIN through VGAM3 HOST TARGET PROTEIN, all of FIG. 1.

VGAM957 RNA, herein schematically represented by VGAM1 RNA through VGAM3 RNA, binds complementarily to a host target binding site located in an untranslated region of VGAM957 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM957 host target RNA into VGAM957 host target protein, herein schematically represented by VGAM1 HOST TARGET PROTEIN through VGAM3 HOST TARGET PROTEIN, all of FIG. 1.

VGAM958 RNA, herein schematically represented by VGAM1 RNA through VGAM3 RNA, binds complementarily to a host target binding site located in an untranslated region of VGAM958 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM958 host target RNA into VGAM958 host target protein, herein schematically represented by VGAM1 HOST TARGET PROTEIN through VGAM3 HOST TARGET PROTEIN, all of FIG. 1.

It is appreciated that a function of VGR2940 gene, herein designated VGR GENE, is inhibition of expression of host target genes, as part of a novel viral mechanism of attacking a host. Accordingly, utilities of VGR2940 gene include diagnosis, prevention and treatment of viral infection by Tomato Spotted Wilt Virus. Specific functions, and accordingly utilities, of VGR2940 gene correlate with, and may be deduced from, the identity of the host target genes, which are inhibited by VGAM RNAs comprised in the 'operon-like' cluster of VGR2940 gene: VGAM953 host target protein, VGAM954 host target protein, VGAM955 host target protein, VGAM956 host target protein, VGAM957 host target protein and VGAM958 host target protein, herein schematically represented by VGAM1 HOST TARGET PROTEIN through VGAM3 HOST TARGET PROTEIN. The function of these host target genes is elaborated hereinabove with reference to VGAM953, VGAM954, VGAM955, VGAM956, VGAM957 and VGAM958. FIG. 9 further provides a conceptual description of novel bioinformatically detected regulatory viral gene, referred to here as Viral Genomic Record 2941(VGR2941) viral gene, which encodes an 'operon-like' cluster of novel viral micro RNA-like genes, each of which in turn modulates expression of at least one host target gene, the function and utility of which at least one host target gene is known in the art.

VGR2941 gene, herein designated VGR GENE, is a novel bioinformatically detected regulatory, non protein coding, RNA viral gene. The method by which VGR2941 gene was detected is described hereinabove with reference to FIGS. 1-9.

VGR2941 gene encodes VGR2941 precursor RNA, herein designated VGR PRECURSOR RNA, an RNA molecule, typically several hundred nucleotides long.

VGR2941 precursor RNA folds spatially, forming VGR2941 folded precursor RNA, herein designated VGR FOLDED PRECURSOR RNA. It is appreciated that VGR2941 folded precursor RNA comprises a plurality of what is known in the art as 'hairpin' structures. These 'hairpin' structures are due to the fact that the nucleotide sequence of VGR2941 precursor RNA comprises a plurality of segments, the first half of each such segment having a nucleotide sequence which is at least a partial inversed-reversed sequence of the second half thereof, as is well known in the art.

VGR2941 folded precursor RNA is naturally processed by cellular enzymatic activity into at least 3 separate VGAM precursor RNAs, VGAM959 precursor RNA, VGAM960 precursor RNA and VGAM961 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM959 RNA, VGAM960 RNA and VGAM961 RNA, herein schematically represented by VGAM1 RNA through VGAM3 RNA, each of which VGAM RNAs corresponding to VGAM RNA of FIG. 1.

VGAM959 RNA, herein schematically represented by VGAM1 RNA through VGAM3 RNA, binds complementarily to a host target binding site located in an untranslated region of VGAM959 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM959 host target RNA into VGAM959 host target protein, herein schematically represented by VGAM1 HOST TARGET PROTEIN through VGAM3 HOST TARGET PROTEIN, all of FIG. 1.

VGAM960 RNA, herein schematically represented by VGAM1 RNA through VGAM3 RNA, binds complementarily to a host target binding site located in an untranslated region of VGAM960 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM960 host target RNA into VGAM960 host target protein, herein schematically represented by VGAM1 HOST TARGET PROTEIN through VGAM3 HOST TARGET PROTEIN, all of FIG. 1.

VGAM961 RNA, herein schematically represented by VGAM1 RNA through VGAM3 RNA, binds complementarily to a host target binding site located in an untranslated region of VGAM961 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM961 host target RNA into VGAM961 host target protein, herein schematically represented by VGAM1 HOST TARGET PROTEIN through VGAM3 HOST TARGET PROTEIN, all of FIG. 1.

It is appreciated that a function of VGR2941 gene, herein designated VGR GENE, is inhibition of expression of host target genes, as part of a novel viral mechanism of attacking a host. Accordingly, utilities of VGR2941 gene include diagnosis, prevention and treatment of viral infection by Lumpy Skin Disease Virus. Specific functions, and accordingly utilities, of VGR2941 gene correlate with, and may be deduced from, the identity of the host target genes, which are inhibited by VGAM RNAs comprised in the 'operon-like' cluster of VGR2941 gene: VGAM959 host target protein, VGAM960 host target protein and VGAM961 host target protein, herein schematically represented by VGAM1 HOST TARGET PROTEIN through VGAM3 HOST TARGET PROTEIN. The function of these host target genes is elaborated hereinabove with reference to VGAM959, VGAM960 and VGAM961. FIG. 9 further provides a conceptual description of novel bioinformatically detected regulatory viral gene, referred to here as Viral Genomic Record 2942(VGR2942) viral gene, which encodes an 'operon-like' cluster of novel viral micro RNA-like genes, each of which in turn modulates expression of at least one host target gene, the function and utility of which at least one host target gene is known in the art.

VGR2942 gene, herein designated VGR GENE, is a novel bioinformatically detected regulatory, non protein coding, RNA viral gene. The method by which VGR2942 gene was detected is described hereinabove with reference to FIGS. 1-9.

VGR2942 gene encodes VGR2942 precursor RNA, herein designated VGR PRECURSOR RNA, an RNA molecule, typically several hundred nucleotides long.

VGR2942 precursor RNA folds spatially, forming VGR2942 folded precursor RNA, herein designated VGR FOLDED PRECURSOR RNA. It is appreciated that VGR2942 folded precursor RNA comprises a plurality of what is known in the art as 'hairpin' structures. These 'hairpin' structures are due to the fact that the nucleotide sequence of VGR2942 precursor RNA comprises a plurality of segments, the first half of each such segment having a nucleotide sequence which is at least a partial inversed-reversed sequence of the second half thereof, as is well known in the art.

VGR2942 folded precursor RNA is naturally processed by cellular enzymatic activity into at least 5 separate VGAM precursor RNAs, VGAM962 precursor RNA, VGAM963 precursor RNA, VGAM964 precursor RNA, VGAM965 precursor RNA and VGAM966 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM962 RNA, VGAM963 RNA, VGAM964 RNA, VGAM965 RNA and VGAM966 RNA, herein schematically represented by VGAM1 RNA through VGAM3 RNA, each of which VGAM RNAs corresponding to VGAM RNA of FIG. 1.

VGAM962 RNA, herein schematically represented by VGAM1 RNA through VGAM3 RNA, binds complementarily to a host target binding site located in an untranslated region of VGAM962 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM962 host target RNA into VGAM962 host target protein, herein schematically represented by VGAM1 HOST TARGET PROTEIN through VGAM3 HOST TARGET PROTEIN, all of FIG. 1.

VGAM963 RNA, herein schematically represented by VGAM1 RNA through VGAM3 RNA, binds complementarily to a host target binding site located in an untranslated region of VGAM963 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM963 host target RNA into VGAM963 host target protein, herein schematically represented by VGAM1 HOST TARGET PROTEIN through VGAM3 HOST TARGET PROTEIN, all of FIG. 1.

VGAM964 RNA, herein schematically represented by VGAM1 RNA through VGAM3 RNA, binds complementarily to a host target binding site located in an untranslated region of VGAM964 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM964 host target RNA into VGAM964 host target protein, herein schematically represented by VGAM1 HOST TARGET PROTEIN through VGAM3 HOST TARGET PROTEIN, all of FIG. 1.

VGAM965 RNA, herein schematically represented by VGAM1 RNA through VGAM3 RNA, binds complementarily to a host target binding site located in an untranslated region of VGAM965 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM965 host target RNA into VGAM965 host target protein, herein schematically represented by VGAM1 HOST TARGET PROTEIN through VGAM3 HOST TARGET PROTEIN, all of FIG. 1.

VGAM966 RNA, herein schematically represented by VGAM1 RNA through VGAM3 RNA, binds complementarily to a host target binding site located in an untranslated region of VGAM966 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM966 host target RNA into VGAM966 host target protein, herein schematically represented by VGAM1 HOST TARGET PROTEIN through VGAM3 HOST TARGET PROTEIN, all of FIG. 1.

It is appreciated that a function of VGR2942 gene, herein designated VGR GENE, is inhibition of expression of host target genes, as part of a novel viral mechanism of attacking a host. Accordingly, utilities of VGR2942 gene include diagnosis, prevention and treatment of viral infection by Meleagrid Herpesvirus 1. Specific functions, and accordingly utilities, of VGR2942 gene correlate with, and may be deduced from, the identity of the host target genes, which are inhibited by VGAM RNAs comprised in the 'operon-like' cluster of VGR2942 gene: VGAM962 host target protein, VGAM963 host target protein, VGAM964 host target protein, VGAM965 host target protein and VGAM966 host target protein, herein schematically represented by VGAM1 HOST TARGET PROTEIN through VGAM3 HOST TARGET PROTEIN. The function of these host target genes is elaborated hereinabove with reference to VGAM962, VGAM963, VGAM964, VGAM965 and VGAM966. FIG. 9 further provides a conceptual description of novel bioinformatically detected regulatory viral gene, referred to here as Viral Genomic Record 2943(VGR2943) viral gene, which encodes an 'operon-like' cluster of novel viral micro RNA-like genes, each of which in turn modulates expression of at least one host target gene, the function and utility of which at least one host target gene is known in the art.

VGR2943 gene, herein designated VGR GENE, is a novel bioinformatically detected regulatory, non protein coding, RNA viral gene. The method by which VGR2943 gene was detected is described hereinabove with reference to FIGS. 1-9.

VGR2943 gene encodes VGR2943 precursor RNA, herein designated VGR PRECURSOR RNA, an RNA molecule, typically several hundred nucleotides long.

VGR2943 precursor RNA folds spatially, forming VGR2943 folded precursor RNA, herein designated VGR FOLDED PRECURSOR RNA. It is appreciated that VGR2943 folded precursor RNA comprises a plurality of what is known in the art as 'hairpin' structures. These 'hairpin' structures are due to the fact that the nucleotide sequence of VGR2943 precursor RNA comprises a plurality of segments, the first half of each such segment having a nucleotide sequence which is at least a partial inversed-reversed sequence of the second half thereof, as is well known in the art.

VGR2943 folded precursor RNA is naturally processed by cellular enzymatic activity into at least 4 separate VGAM precursor RNAs, VGAM967 precursor RNA, VGAM968 precursor RNA, VGAM969 precursor RNA and VGAM970 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM967 RNA, VGAM968 RNA, VGAM969 RNA and VGAM970 RNA, herein schematically represented by VGAM1 RNA through VGAM3 RNA, each of which VGAM RNAs corresponding to VGAM RNA of FIG. 1.

VGAM967 RNA, herein schematically represented by VGAM1 RNA through VGAM3 RNA, binds complementarily to a host target binding site located in an untranslated region of VGAM967 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM967 host target RNA into VGAM967 host target protein, herein schematically represented by VGAM1 HOST TARGET PROTEIN through VGAM3 HOST TARGET PROTEIN, all of FIG. 1.

VGAM968 RNA, herein schematically represented by VGAM1 RNA through VGAM3 RNA, binds complementarily to a host target binding site located in an untranslated region of VGAM968 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM968 host target RNA into VGAM968 host target protein, herein schematically represented by VGAM1 HOST TARGET PROTEIN through VGAM3 HOST TARGET PROTEIN, all of FIG. 1.

VGAM969 RNA, herein schematically represented by VGAM1 RNA through VGAM3 RNA, binds complementarily to a host target binding site located in an untranslated region of VGAM969 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM969 host target RNA into VGAM969 host target protein, herein schematically represented by VGAM1 HOST TARGET PROTEIN through VGAM3 HOST TARGET PROTEIN, all of FIG. 1.

VGAM970 RNA, herein schematically represented by VGAM1 RNA through VGAM3 RNA, binds complementarily to a host target binding site located in an untranslated region of VGAM970 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM970 host target RNA into VGAM970 host target protein, herein schematically represented by VGAM1 HOST TARGET PROTEIN through VGAM3 HOST TARGET PROTEIN, all of FIG. 1.

It is appreciated that a function of VGR2943 gene, herein designated VGR GENE, is inhibition of expression of host target genes, as part of a novel viral mechanism of attacking a host. Accordingly, utilities of VGR2943 gene include diagnosis, prevention and treatment of viral infection by Sheeppox Virus. Specific functions, and accordingly utilities, of VGR2943 gene correlate with, and may be deduced from, the identity of the host target genes, which are inhibited by VGAM RNAs comprised in the 'operon-like' cluster of VGR2943 gene: VGAM967 host target protein, VGAM968 host target protein, VGAM969 host target protein and VGAM970 host target protein, herein schematically represented by VGAM1 HOST TARGET PROTEIN through VGAM3 HOST TARGET PROTEIN. The function of these host target genes is elaborated hereinabove with reference to VGAM967, VGAM968, VGAM969 and VGAM970. FIG. 9 further provides a conceptual description of novel bioinformatically detected regulatory viral gene, referred to here as Viral Genomic Record 2944(VGR2944) viral gene, which encodes an 'operon-like' cluster of novel viral micro RNA-like genes, each of which in turn modulates expression of at least one host target gene, the function and utility of which at least one host target gene is known in the art.

VGR2944 gene, herein designated VGR GENE, is a novel bioinformatically detected regulatory, non protein coding, RNA viral gene. The method by which VGR2944 gene was detected is described hereinabove with reference to FIGS. 1-9.

VGR2944 gene encodes VGR2944 precursor RNA, herein designated VGR PRECURSOR RNA, an RNA molecule, typically several hundred nucleotides long.

VGR2944 precursor RNA folds spatially, forming VGR2944 folded precursor RNA, herein designated VGR FOLDED PRECURSOR RNA. It is appreciated that VGR2944 folded precursor RNA comprises a plurality of what is known in the art as 'hairpin' structures. These 'hairpin' structures are due to the fact that the nucleotide sequence of VGR2944 precursor RNA comprises a plurality of segments, the first half of each such segment having a nucleotide sequence which is at least a partial inversed-reversed sequence of the second half thereof, as is well known in the art.

VGR2944 folded precursor RNA is naturally processed by cellular enzymatic activity into at least 2 separate VGAM precursor RNAs, VGAM971 precursor RNA and VGAM972 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM971 RNA and VGAM972 RNA, herein schematically represented by VGAM1 RNA through VGAM3 RNA, each of which VGAM RNAs corresponding to VGAM RNA of FIG. 1.

VGAM971 RNA, herein schematically represented by VGAM1 RNA through VGAM3 RNA, binds complementarily to a host target binding site located in an untranslated region of VGAM971 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM971 host target RNA into VGAM971 host target protein, herein schematically represented by VGAM1 HOST TARGET PROTEIN through VGAM3 HOST TARGET PROTEIN, all of FIG. 1.

VGAM972 RNA, herein schematically represented by VGAM1 RNA through VGAM3 RNA, binds complementarily to a host target binding site located in an untranslated region of VGAM972 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM972 host target RNA into VGAM972 host target protein, herein schematically represented by VGAM1 HOST TARGET PROTEIN through VGAM3 HOST TARGET PROTEIN, all of FIG. 1.

It is appreciated that a function of VGR2944 gene, herein designated VGR GENE, is inhibition of expression of host target genes, as part of a novel viral mechanism of attacking a host. Accordingly, utilities of VGR2944 gene include diagnosis, prevention and treatment of viral infection by Melanoplus Sanguinipes Entomopoxvirus. Specific functions, and accordingly utilities, of VGR2944 gene correlate with, and may be deduced from, the identity of the host target genes, which are inhibited by VGAM RNAs comprised in the 'operon-like' cluster of VGR2944 gene: VGAM971 host target protein and VGAM972 host target protein, herein schematically represented by VGAM1 HOST TARGET PROTEIN through VGAM3 HOST TARGET PROTEIN. The function of these host target genes is elaborated hereinabove with reference to VGAM971 and VGAM972. FIG. 9 further provides a conceptual description of novel bioinformatically detected regulatory viral gene, referred to here as Viral Genomic Record 2945(VGR2945) viral gene, which encodes an 'operon-like' cluster of novel viral micro RNA-like genes, each of which in turn modulates expression of at least one host target gene, the function and utility of which at least one host target gene is known in the art.

VGR2945 gene, herein designated VGR GENE, is a novel bioinformatically detected regulatory, non protein coding, RNA viral gene. The method by which VGR2945 gene was detected is described hereinabove with reference to FIGS. 1-9.

VGR2945 gene encodes VGR2945 precursor RNA, herein designated VGR PRECURSOR RNA, an RNA molecule, typically several hundred nucleotides long.

VGR2945 precursor RNA folds spatially, forming VGR2945 folded precursor RNA, herein designated VGR FOLDED PRECURSOR RNA. It is appreciated that VGR2945 folded precursor RNA comprises a plurality of what is known in the art as 'hairpin' structures. These 'hairpin' structures are due to the fact that the nucleotide sequence of VGR2945 precursor RNA comprises a plurality of segments, the first half of each such segment having a nucleotide sequence which is at least a partial inversed-reversed sequence of the second half thereof, as is well known in the art.

VGR2945 folded precursor RNA is naturally processed by cellular enzymatic activity into at least 5 separate VGAM precursor RNAs, VGAM975 precursor RNA, VGAM976 precursor RNA, VGAM977 precursor RNA, VGAM978 precursor RNA and VGAM979 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM975 RNA, VGAM976 RNA, VGAM977 RNA, VGAM978 RNA and VGAM979 RNA, herein schematically represented by VGAM1 RNA through VGAM3 RNA, each of which VGAM RNAs corresponding to VGAM RNA of FIG. 1.

VGAM975 RNA, herein schematically represented by VGAM1 RNA through VGAM3 RNA, binds complementarily to a host target binding site located in an untranslated region of VGAM975 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM975 host target RNA into VGAM975 host target protein, herein schematically represented by VGAM1 HOST TARGET PROTEIN through VGAM3 HOST TARGET PROTEIN, all of FIG. 1.

VGAM976 RNA, herein schematically represented by VGAM1 RNA through VGAM3 RNA, binds complementarily to a host target binding site located in an untranslated region of VGAM976 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM976 host target RNA into VGAM976 host target protein, herein schematically represented by VGAM1 HOST TARGET PROTEIN through VGAM3 HOST TARGET PROTEIN, all of FIG. 1.

VGAM977 RNA, herein schematically represented by VGAM1 RNA through VGAM3 RNA, binds complementarily to a host target binding site located in an untranslated region of VGAM977 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM977 host target RNA into VGAM977 host target protein, herein schematically represented by VGAM1 HOST TARGET PROTEIN through VGAM3 HOST TARGET PROTEIN, all of FIG. 1.

VGAM978 RNA, herein schematically represented by VGAM1 RNA through VGAM3 RNA, binds complementarily to a host target binding site located in an untranslated region of VGAM978 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM978 host target RNA into VGAM978 host target protein, herein schematically represented by VGAM1 HOST TARGET PROTEIN through VGAM3 HOST TARGET PROTEIN, all of FIG. 1.

VGAM979 RNA, herein schematically represented by VGAM1 RNA through VGAM3 RNA, binds complementarily to a host target binding site located in an untranslated region of VGAM979 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM979 host target RNA into VGAM979 host target protein, herein schematically represented by VGAM1 HOST TARGET PROTEIN through VGAM3 HOST TARGET PROTEIN, all of FIG. 1.

It is appreciated that a function of VGR2945 gene, herein designated VGR GENE, is inhibition of expression of host target genes, as part of a novel viral mechanism of attacking a host. Accordingly, utilities of VGR2945 gene include diagnosis, prevention and treatment of viral infection by Variola Virus. Specific functions, and accordingly utilities, of VGR2945 gene correlate with, and may be deduced from, the identity of the host target genes, which are inhibited by VGAM RNAs comprised in the 'operon-like' cluster of VGR2945 gene: VGAM975 host target protein, VGAM976 host target protein, VGAM977 host target protein, VGAM978 host target protein and VGAM979 host target protein, herein schematically represented by VGAM1 HOST TARGET PROTEIN through VGAM3 HOST TARGET PROTEIN. The function of these host target genes is elaborated hereinabove with reference to VGAM975, VGAM976, VGAM977, VGAM978 and VGAM979. FIG. 9 further provides a conceptual description of novel bioinformatically detected regulatory viral gene, referred to here as Viral Genomic Record 2946(VGR2946) viral gene, which encodes an 'operon-like' cluster of novel viral micro RNA-like genes, each of which in turn modulates expression of at least one host target gene, the function and utility of which at least one host target gene is known in the art.

VGR2946 gene, herein designated VGR GENE, is a novel bioinformatically detected regulatory, non protein coding, RNA viral gene. The method by which VGR2946 gene was detected is described hereinabove with reference to FIGS. 1-9.

VGR2946 gene encodes VGR2946 precursor RNA, herein designated VGR PRECURSOR RNA, an RNA molecule, typically several hundred nucleotides long.

VGR2946 precursor RNA folds spatially, forming VGR2946 folded precursor RNA, herein designated VGR FOLDED PRECURSOR RNA. It is appreciated that VGR2946 folded precursor RNA comprises a plurality of what is known in the art as 'hairpin' structures. These 'hairpin' structures are due to the fact that the nucleotide sequence of VGR2946 precursor RNA comprises a plurality of segments, the first half of each such segment having a nucleotide sequence which is at least a partial inversed-reversed sequence of the second half thereof, as is well known in the art.

VGR2946 folded precursor RNA is naturally processed by cellular enzymatic activity into at least 5 separate VGAM precursor RNAs, VGAM980 precursor RNA, VGAM981 precursor RNA, VGAM982 precursor RNA, VGAM983 precursor RNA and VGAM984 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM980 RNA, VGAM981 RNA, VGAM982 RNA, VGAM983 RNA and VGAM984 RNA, herein schematically represented by VGAM1 RNA through VGAM3 RNA, each of which VGAM RNAs corresponding to VGAM RNA of FIG. 1.

VGAM980 RNA, herein schematically represented by VGAM1 RNA through VGAM3 RNA, binds complementarily to a host target binding site located in an untranslated region of VGAM980 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM980 host target RNA into VGAM980 host target protein, herein schematically represented by VGAM1 HOST TARGET PROTEIN through VGAM3 HOST TARGET PROTEIN, all of FIG. 1.

VGAM981 RNA, herein schematically represented by VGAM1 RNA through VGAM3 RNA, binds complementarily to a host target binding site located in an untranslated region of VGAM981 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM981 host target RNA into VGAM981 host target protein, herein schematically represented by VGAM1 HOST TARGET PROTEIN through VGAM3 HOST TARGET PROTEIN, all of FIG. 1.

VGAM982 RNA, herein schematically represented by VGAM1 RNA through VGAM3 RNA, binds complementarily to a host target binding site located in an untranslated region of VGAM982 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM982 host target RNA into VGAM982 host target protein, herein schematically represented by VGAM1 HOST TARGET PROTEIN through VGAM3 HOST TARGET PROTEIN, all of FIG. 1.

VGAM983 RNA, herein schematically represented by VGAM1 RNA through VGAM3 RNA, binds complementarily to a host target binding site located in an untranslated region of VGAM983 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM983 host target RNA into VGAM983 host target protein, herein schematically represented by VGAM1 HOST TARGET PROTEIN through VGAM3 HOST TARGET PROTEIN, all of FIG. 1.

VGAM984 RNA, herein schematically represented by VGAM1 RNA through VGAM3 RNA, binds complementarily to a host target binding site located in an untranslated region of VGAM984 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM984 host target RNA into VGAM984 host target protein, herein schematically represented by VGAM1 HOST TARGET PROTEIN through VGAM3 HOST TARGET PROTEIN, all of FIG. 1.

It is appreciated that a function of VGR2946 gene, herein designated VGR GENE, is inhibition of expression of host target genes, as part of a novel viral mechanism of attacking a host. Accordingly, utilities of VGR2946 gene include diagnosis, prevention and treatment of viral infection by Ectromelia Virus. Specific functions, and accordingly utilities, of VGR2946 gene correlate with, and may be deduced from, the identity of the host target genes, which are inhibited by VGAM RNAs comprised in the 'operon-like' cluster of VGR2946 gene: VGAM980 host target protein, VGAM981 host target protein, VGAM982 host target protein, VGAM983 host target protein and VGAM984 host target protein, herein schematically represented by VGAM1 HOST TARGET PROTEIN through VGAM3 HOST TARGET PROTEIN. The function of these host target genes is elaborated hereinabove with reference to VGAM980, VGAM981, VGAM982, VGAM983 and VGAM984. FIG. 9 further provides a conceptual description of novel bioinformatically detected regulatory viral gene, referred to here as Viral Genomic Record 2947(VGR2947) viral gene, which encodes an 'operon-like' cluster of novel viral micro RNA-like genes, each of which in turn modulates expression of at least one host target gene, the function and utility of which at least one host target gene is known in the art.

VGR2947 gene, herein designated VGR GENE, is a novel bioinformatically detected regulatory, non protein coding, RNA viral gene. The method by which VGR2947 gene was detected is described hereinabove with reference to FIGS. 1-9.

VGR2947 gene encodes VGR2947 precursor RNA, herein designated VGR PRECURSOR RNA, an RNA molecule, typically several hundred nucleotides long.

VGR2947 precursor RNA folds spatially, forming VGR2947 folded precursor RNA, herein designated VGR FOLDED PRECURSOR RNA. It is appreciated that VGR2947 folded precursor RNA comprises a plurality of what is known in the art as 'hairpin' structures. These 'hairpin' structures are due to the fact that the nucleotide sequence of VGR2947 precursor RNA comprises a plurality of segments, the first half of each such segment having a nucleotide sequence which is at least a partial inversed-reversed sequence of the second half thereof, as is well known in the art.

VGR2947 folded precursor RNA is naturally processed by cellular enzymatic activity into at least 5 separate VGAM precursor RNAs, VGAM986 precursor RNA, VGAM987 precursor RNA, VGAM988 precursor RNA, VGAM989 precursor RNA and VGAM990 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM986 RNA, VGAM987 RNA, VGAM988 RNA, VGAM989 RNA and VGAM990 RNA, herein schematically represented by VGAM1 RNA through VGAM3 RNA, each of which VGAM RNAs corresponding to VGAM RNA of FIG. 1.

VGAM986 RNA, herein schematically represented by VGAM1 RNA through VGAM3 RNA, binds complementarily to a host target binding site located in an untranslated region of VGAM986 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM986 host target RNA into VGAM986 host target protein, herein schematically represented by VGAM1 HOST TARGET PROTEIN through VGAM3 HOST TARGET PROTEIN, all of FIG. 1.

VGAM987 RNA, herein schematically represented by VGAM1 RNA through VGAM3 RNA, binds complementarily to a host target binding site located in an untranslated region of VGAM987 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM987 host target RNA into VGAM987 host target protein, herein schematically represented by VGAM1 HOST TARGET PROTEIN through VGAM3 HOST TARGET PROTEIN, all of FIG. 1.

VGAM988 RNA, herein schematically represented by VGAM1 RNA through VGAM3 RNA, binds complementarily to a host target binding site located in an untranslated region of VGAM988 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM988 host target RNA into VGAM988 host target protein, herein schematically represented by VGAM1 HOST TARGET PROTEIN through VGAM3 HOST TARGET PROTEIN, all of FIG. 1.

VGAM989 RNA, herein schematically represented by VGAM1 RNA through VGAM3 RNA, binds complementarily to a host target binding site located in an untranslated region of VGAM989 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM989 host target RNA into VGAM989 host target protein, herein schematically represented by VGAM1 HOST TARGET PROTEIN through VGAM3 HOST TARGET PROTEIN, all of FIG. 1.

VGAM990 RNA, herein schematically represented by VGAM1 RNA through VGAM3 RNA, binds complementarily to a host target binding site located in an untranslated region of VGAM990 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM990 host target RNA into VGAM990 host target protein, herein schematically represented by VGAM1 HOST TARGET PROTEIN through VGAM3 HOST TARGET PROTEIN, all of FIG. 1.

It is appreciated that a function of VGR2947 gene, herein designated VGR GENE, is inhibition of expression of host target genes, as part of a novel viral mechanism of attacking a host. Accordingly, utilities of VGR2947 gene include diagnosis, prevention and treatment of viral infection by Leishmania RNA Virus 1-4. Specific functions, and accordingly utilities, of VGR2947 gene correlate with, and may be deduced from, the identity of the host target genes, which are inhibited by VGAM RNAs comprised in the 'operon-like' cluster of VGR2947 gene: VGAM986 host target protein, VGAM987 host target protein, VGAM988 host target protein, VGAM989 host target protein and VGAM990 host target protein, herein schematically represented by VGAM1 HOST TARGET PROTEIN through VGAM3 HOST TARGET PROTEIN. The function of these host target genes is elaborated hereinabove with reference to VGAM986, VGAM987, VGAM988, VGAM989 and VGAM990. FIG. 9 further provides a conceptual description of novel bioinformatically detected regulatory viral gene, referred to here as Viral Genomic Record 2948(VGR2948) viral gene, which encodes an 'operon-like' cluster of novel viral micro RNA-like genes, each of which in turn modulates expression of at least one host target gene, the function and utility of which at least one host target gene is known in the art.

VGR2948 gene, herein designated VGR GENE, is a novel bioinformatically detected regulatory, non protein coding, RNA viral gene. The method by which VGR2948 gene was detected is described hereinabove with reference to FIGS. 1-9.

VGR2948 gene encodes VGR2948 precursor RNA, herein designated VGR PRECURSOR RNA, an RNA molecule, typically several hundred nucleotides long.

VGR2948 precursor RNA folds spatially, forming VGR2948 folded precursor RNA, herein designated VGR FOLDED PRECURSOR RNA. It is appreciated that VGR2948 folded precursor RNA comprises a plurality of what is known in the art as 'hairpin' structures. These 'hairpin' structures are due to the fact that the nucleotide sequence of VGR2948 precursor RNA comprises a plurality of segments, the first half of each such segment having a nucleotide sequence which is at least a partial inversed-reversed sequence of the second half thereof, as is well known in the art.

VGR2948 folded precursor RNA is naturally processed by cellular enzymatic activity into at least 6 separate VGAM precursor RNAs, VGAM991 precursor RNA, VGAM992 precursor RNA, VGAM993 precursor RNA, VGAM994 precursor RNA, VGAM995 precursor RNA and VGAM996 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM991 RNA, VGAM992 RNA, VGAM993 RNA, VGAM994 RNA, VGAM995 RNA and VGAM996 RNA, herein schematically represented by VGAM1 RNA through VGAM3 RNA, each of which VGAM RNAs corresponding to VGAM RNA of FIG. 1.

VGAM991 RNA, herein schematically represented by VGAM1 RNA through VGAM3 RNA, binds complementarily to a host target binding site located in an untranslated region of VGAM991 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM991 host target RNA into VGAM991 host target protein, herein schematically represented by VGAM1 HOST TARGET PROTEIN through VGAM3 HOST TARGET PROTEIN, all of FIG. 1.

VGAM992 RNA, herein schematically represented by VGAM1 RNA through VGAM3 RNA, binds complementarily to a host target binding site located in an untranslated region of VGAM992 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM992 host target RNA into VGAM992 host target protein, herein schematically represented by VGAM1 HOST TARGET PROTEIN through VGAM3 HOST TARGET PROTEIN, all of FIG. 1.

VGAM993 RNA, herein schematically represented by VGAM1 RNA through VGAM3 RNA, binds complementarily to a host target binding site located in an untranslated region of VGAM993 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM993 host target RNA into VGAM993 host target protein, herein schematically represented by VGAM1 HOST TARGET PROTEIN through VGAM3 HOST TARGET PROTEIN, all of FIG. 1.

VGAM994 RNA, herein schematically represented by VGAM1 RNA through VGAM3 RNA, binds complementarily to a host target binding site located in an untranslated region of VGAM994 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM994 host target RNA into VGAM994 host target protein, herein schematically represented by VGAM1 HOST TARGET PROTEIN through VGAM3 HOST TARGET PROTEIN, all of FIG. 1.

VGAM995 RNA, herein schematically represented by VGAM1 RNA through VGAM3 RNA, binds complementarily to a host target binding site located in an untranslated region of VGAM995 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM995 host target RNA into VGAM995 host target protein, herein schematically represented by VGAM1 HOST TARGET PROTEIN through VGAM3 HOST TARGET PROTEIN, all of FIG. 1.

VGAM996 RNA, herein schematically represented by VGAM1 RNA through VGAM3 RNA, binds complementarily to a host target binding site located in an untranslated region of VGAM996 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM996 host target RNA into VGAM996 host target protein, herein schematically represented by VGAM1 HOST TARGET PROTEIN through VGAM3 HOST TARGET PROTEIN, all of FIG. 1.

It is appreciated that a function of VGR2948 gene, herein designated VGR GENE, is inhibition of expression of host target genes, as part of a novel viral mechanism of attacking a host. Accordingly, utilities of VGR2948 gene include diagnosis, prevention and treatment of viral infection by Leishmania RNA Virus 1-1. Specific functions, and accordingly utilities, of VGR2948 gene correlate with, and may be deduced from, the identity of the host target genes, which are inhibited by VGAM RNAs comprised in the 'operon-like' cluster of VGR2948 gene: VGAM991 host target protein, VGAM992 host target protein, VGAM993 host target protein, VGAM994 host target protein, VGAM995 host target protein and VGAM996 host target protein, herein schematically represented by VGAM1 HOST TARGET PROTEIN through VGAM3 HOST TARGET PROTEIN. The function of these host target genes is elaborated hereinabove with reference to VGAM991, VGAM992, VGAM993, VGAM994, VGAM995 and VGAM996. FIG. 9 further provides a conceptual description of novel bioinformatically detected regulatory viral gene, referred to here as Viral Genomic Record 2949(VGR2949) viral gene, which encodes an 'operon-like' cluster of novel viral micro RNA-like genes, each of which in turn modulates expression of at least one host target gene, the function and utility of which at least one host target gene is known in the art.

VGR2949 gene, herein designated VGR GENE, is a novel bioinformatically detected regulatory, non protein coding, RNA viral gene. The method by which VGR2949 gene was detected is described hereinabove with reference to FIGS. 1-9.

VGR2949 gene encodes VGR2949 precursor RNA, herein designated VGR PRECURSOR RNA, an RNA molecule, typically several hundred nucleotides long.

VGR2949 precursor RNA folds spatially, forming VGR2949 folded precursor RNA, herein designated VGR FOLDED PRECURSOR RNA. It is appreciated that VGR2949 folded precursor RNA comprises a plurality of what is known in the art as 'hairpin' structures. These 'hairpin' structures are due to the fact that the nucleotide sequence of VGR2949 precursor RNA comprises a plurality of segments, the first half of each such segment having a nucleotide sequence which is at least a partial inversed-reversed sequence of the second half thereof, as is well known in the art.

VGR2949 folded precursor RNA is naturally processed by cellular enzymatic activity into at least 5 separate VGAM precursor RNAs, VGAM997 precursor RNA, VGAM998 precursor RNA, VGAM999 precursor RNA, VGAM1000 precursor RNA and VGAM1001 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM997 RNA, VGAM998 RNA, VGAM999 RNA, VGAM1000 RNA and VGAM1001 RNA, herein schematically represented by VGAM1 RNA through VGAM3 RNA, each of which VGAM RNAs corresponding to VGAM RNA of FIG. 1.

VGAM997 RNA, herein schematically represented by VGAM1 RNA through VGAM3 RNA, binds complementarily to a host target binding site located in an untranslated region of VGAM997 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM997 host target RNA into VGAM997 host target protein, herein schematically represented by VGAM1 HOST TARGET PROTEIN through VGAM3 HOST TARGET PROTEIN, all of FIG. 1.

VGAM998 RNA, herein schematically represented by VGAM1 RNA through VGAM3 RNA, binds complementarily to a host target binding site located in an untranslated region of VGAM998 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM998 host target RNA into VGAM998 host target protein, herein schematically represented by VGAM1 HOST TARGET PROTEIN through VGAM3 HOST TARGET PROTEIN, all of FIG. 1.

VGAM999 RNA, herein schematically represented by VGAM1 RNA through VGAM3 RNA, binds complementarily to a host target binding site located in an untranslated region of VGAM999 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM999 host target RNA into VGAM999 host target protein, herein schematically represented by VGAM1 HOST TARGET PROTEIN through VGAM3 HOST TARGET PROTEIN, all of FIG. 1.

VGAM1000 RNA, herein schematically represented by VGAM1 RNA through VGAM3 RNA, binds complementarily to a host target binding site located in an untranslated region of VGAM1000 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1000 host target RNA into VGAM1000 host target protein, herein schematically represented by VGAM1 HOST TARGET PROTEIN through VGAM3 HOST TARGET PROTEIN, all of FIG. 1.

VGAM1001 RNA, herein schematically represented by VGAM1 RNA through VGAM3 RNA, binds complementarily to a host target binding site located in an untranslated region of VGAM1001 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1001 host target RNA into VGAM1001 host target protein, herein schematically represented by VGAM1 HOST TARGET PROTEIN through VGAM3 HOST TARGET PROTEIN, all of FIG. 1.

It is appreciated that a function of VGR2949 gene, herein designated VGR GENE, is inhibition of expression of host target genes, as part of a novel viral mechanism of attacking a host. Accordingly, utilities of VGR2949 gene include diagnosis, prevention and treatment of viral infection by Cowpox Virus. Specific functions, and accordingly utilities, of VGR2949 gene correlate with, and may be deduced from, the identity of the host target genes, which are inhibited by VGAM RNAs comprised in the 'operon-like' cluster of VGR2949 gene: VGAM997 host target protein, VGAM998 host target protein, VGAM999 host target protein, VGAM1000 host target protein and VGAM1001 host target protein, herein schematically represented by VGAM1 HOST TARGET PROTEIN through VGAM3 HOST TARGET PROTEIN. The function of these host target genes is elaborated hereinabove with reference to VGAM997, VGAM998, VGAM999, VGAM1000 and VGAM1001. FIG. 9 further provides a conceptual description of novel bioinformatically detected regulatory viral gene, referred to here as Viral Genomic Record 2950(VGR2950) viral gene, which encodes an 'operon-like' cluster of novel viral micro RNA-like genes, each of which in turn modulates expression of at least one host target gene, the function and utility of which at least one host target gene is known in the art.

VGR2950 gene, herein designated VGR GENE, is a novel bioinformatically detected regulatory, non protein coding, RNA viral gene. The method by which VGR2950 gene was detected is described hereinabove with reference to FIGS. 1-9.

VGR2950 gene encodes VGR2950 precursor RNA, herein designated VGR PRECURSOR RNA, an RNA molecule, typically several hundred nucleotides long.

VGR2950 precursor RNA folds spatially, forming VGR2950 folded precursor RNA, herein designated VGR FOLDED PRECURSOR RNA. It is appreciated that VGR2950 folded precursor RNA comprises a plurality of what is known in the art as 'hairpin' structures. These 'hairpin' structures are due to the fact that the nucleotide sequence of VGR2950 precursor RNA comprises a plurality of segments, the first half of each such segment having a nucleotide sequence which is at least a partial inversed-reversed sequence of the second half thereof, as is well known in the art.

VGR2950 folded precursor RNA is naturally processed by cellular enzymatic activity into at least 7 separate VGAM precursor RNAs, VGAM1002 precursor RNA, VGAM1003 precursor RNA, VGAM1004 precursor RNA, VGAM1005 precursor RNA, VGAM1006 precursor RNA, VGAM1007 precursor RNA and VGAM1008 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1002 RNA, VGAM1003 RNA, VGAM1004 RNA, VGAM1005 RNA, VGAM1006 RNA, VGAM1007 RNA and VGAM1008 RNA, herein schematically represented by VGAM1 RNA through VGAM3 RNA, each of which VGAM RNAs corresponding to VGAM RNA of FIG. 1.

VGAM1002 RNA, herein schematically represented by VGAM1 RNA through VGAM3 RNA, binds complementarily to a host target binding site located in an untranslated region of VGAM1002 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1002 host target RNA into VGAM1002 host target protein, herein schematically represented by VGAM1 HOST TARGET PROTEIN through VGAM3 HOST TARGET PROTEIN, all of FIG. 1.

VGAM1003 RNA, herein schematically represented by VGAM1 RNA through VGAM3 RNA, binds complementarily to a host target binding site located in an untranslated region of VGAM1003 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1003 host target RNA into VGAM1003 host target protein, herein schematically represented by VGAM1 HOST TARGET PROTEIN through VGAM3 HOST TARGET PROTEIN, all of FIG. 1.

VGAM1004 RNA, herein schematically represented by VGAM1 RNA through VGAM3 RNA, binds complementarily to a host target binding site located in an untranslated region of VGAM1004 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1004 host target RNA into VGAM1004 host target protein, herein schematically represented by VGAM1 HOST TARGET PROTEIN through VGAM3 HOST TARGET PROTEIN, all of FIG. 1.

VGAM1005 RNA, herein schematically represented by VGAM1 RNA through VGAM3 RNA, binds complementarily to a host target binding site located in an untranslated region of VGAM1005 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1005 host target RNA into VGAM1005 host target protein, herein schematically represented by VGAM1 HOST TARGET PROTEIN through VGAM3 HOST TARGET PROTEIN, all of FIG. 1.

VGAM1006 RNA, herein schematically represented by VGAM1 RNA through VGAM3 RNA, binds complementarily to a host target binding site located in an untranslated region of VGAM1006 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1006 host target RNA into VGAM1006 host target protein, herein schematically represented by VGAM1 HOST TARGET PROTEIN through VGAM3 HOST TARGET PROTEIN, all of FIG. 1.

VGAM1007 RNA, herein schematically represented by VGAM1 RNA through VGAM3 RNA, binds complementarily to a host target binding site located in an untranslated region of VGAM1007 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1007 host target RNA into VGAM1007 host target protein, herein schematically represented by VGAM1 HOST TARGET PROTEIN through VGAM3 HOST TARGET PROTEIN, all of FIG. 1.

VGAM1008 RNA, herein schematically represented by VGAM1 RNA through VGAM3 RNA, binds complementarily to a host target binding site located in an untranslated region of VGAM1008 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1008 host target RNA into VGAM1008 host target protein, herein schematically represented by VGAM1 HOST TARGET PROTEIN through VGAM3 HOST TARGET PROTEIN, all of FIG. 1.

It is appreciated that a function of VGR2950 gene, herein designated VGR GENE, is inhibition of expression of host target genes, as part of a novel viral mechanism of attacking a host. Accordingly, utilities of VGR2950 gene include diagnosis, prevention and treatment of viral infection by Chimpanzee Cytomegalovirus. Specific functions, and accordingly utilities, of VGR2950 gene correlate with, and may be deduced from, the identity of the host target genes, which are inhibited by VGAM RNAs comprised in the 'operon-like' cluster of VGR2950 gene: VGAM1002 host target protein, VGAM1003 host target protein, VGAM1004 host target protein, VGAM1005 host target protein, VGAM1006 host target protein, VGAM1007 host target protein and VGAM1008 host target protein, herein schematically represented by VGAM1 HOST TARGET PROTEIN through VGAM3 HOST TARGET PROTEIN. The function of these host target genes is elaborated hereinabove with reference to VGAM1002, VGAM1003, VGAM1004, VGAM1005, VGAM1006, VGAM1007 and VGAM1008. FIG. 9 further provides a conceptual description of novel bioinformatically detected regulatory viral gene, referred to here as Viral Genomic Record 2951 (VGR2951) viral gene, which encodes an 'operon-like' cluster of novel viral micro RNA-like genes, each of which in turn modulates expression of at least one host target gene, the function and utility of which at least one host target gene is known in the art.

VGR2951 gene, herein designated VGR GENE, is a novel bioinformatically detected regulatory, non protein coding, RNA viral gene. The method by which VGR2951 gene was detected is described hereinabove with reference to FIGS. 1-9.

VGR2951 gene encodes VGR2951 precursor RNA, herein designated VGR PRECURSOR RNA, an RNA molecule, typically several hundred nucleotides long.

VGR2951 precursor RNA folds spatially, forming VGR2951 folded precursor RNA, herein designated VGR FOLDED PRECURSOR RNA. It is appreciated that VGR2951 folded precursor RNA comprises a plurality of what is known in the art as 'hairpin' structures. These 'hairpin' structures are due to the fact that the nucleotide sequence of VGR2951 precursor RNA comprises a plurality of segments, the first half of each such segment having a nucleotide sequence which is at least a partial inversed-reversed sequence of the second half thereof, as is well known in the art.

VGR2951 folded precursor RNA is naturally processed by cellular enzymatic activity into at least 3 separate VGAM precursor RNAs, VGAM1009 precursor RNA, VGAM1010 precursor RNA and VGAM1011 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1009 RNA, VGAM1010 RNA and VGAM1011 RNA, herein schematically represented by VGAM1 RNA through VGAM3 RNA, each of which VGAM RNAs corresponding to VGAM RNA of FIG. 1.

VGAM1009 RNA, herein schematically represented by VGAM1 RNA through VGAM3 RNA, binds complementarily to a host target binding site located in an untranslated region of VGAM1009 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1009 host target RNA into VGAM1009 host target protein, herein schematically represented by VGAM1 HOST TARGET PROTEIN through VGAM3 HOST TARGET PROTEIN, all of FIG. 1.

VGAM1010 RNA, herein schematically represented by VGAM1 RNA through VGAM3 RNA, binds complementarily to a host target binding site located in an untranslated region of VGAM1010 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1010 host target RNA into VGAM1010 host target protein, herein schematically represented by VGAM1 HOST TARGET PROTEIN through VGAM3 HOST TARGET PROTEIN, all of FIG. 1.

VGAM1011 RNA, herein schematically represented by VGAM1 RNA through VGAM3 RNA, binds complementarily to a host target binding site located in an untranslated region of VGAM1011 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1011 host target RNA into VGAM1011 host target protein, herein schematically represented by VGAM1 HOST TARGET PROTEIN through VGAM3 HOST TARGET PROTEIN, all of FIG. 1.

It is appreciated that a function of VGR2951 gene, herein designated VGR GENE, is inhibition of expression of host target genes, as part of a novel viral mechanism of attacking a host. Accordingly, utilities of VGR2951 gene include diagnosis, prevention and treatment of viral infection by Equine Herpesvirus 4. Specific functions, and accordingly utilities, of VGR2951 gene correlate with, and may be deduced from, the identity of the host target genes, which are inhibited by VGAM RNAs comprised in the 'operon-like' cluster of VGR2951 gene: VGAM1009 host target protein, VGAM1010 host target protein and VGAM1011 host target protein, herein schematically represented by VGAM1 HOST TARGET PROTEIN through VGAM3 HOST TARGET PROTEIN. The function of these host target genes is elaborated hereinabove with reference to VGAM1009, VGAM1010 and VGAM1011. FIG. 9 further provides a conceptual description of novel bioinformatically detected regulatory viral gene, referred to here as Viral Genomic Record 2952(VGR2952) viral gene, which encodes an 'operon-like' cluster of novel viral micro RNA-like genes, each of which in turn modulates expression of at least one host target gene, the function and utility of which at least one host target gene is known in the art.

VGR2952 gene, herein designated VGR GENE, is a novel bioinformatically detected regulatory, non protein coding, RNA viral gene. The method by which VGR2952 gene was detected is described hereinabove with reference to FIGS. 1-9.

VGR2952 gene encodes VGR2952 precursor RNA, herein designated VGR PRECURSOR RNA, an RNA molecule, typically several hundred nucleotides long.

VGR2952 precursor RNA folds spatially, forming VGR2952 folded precursor RNA, herein designated VGR FOLDED PRECURSOR RNA. It is appreciated that VGR2952 folded precursor RNA comprises a plurality of what is known in the art as 'hairpin' structures. These 'hairpin' structures are due to the fact that the nucleotide sequence of VGR2952 precursor RNA comprises a plurality of segments, the first half of each such segment having a nucleotide sequence which is at least a partial inversed-reversed sequence of the second half thereof, as is well known in the art.

VGR2952 folded precursor RNA is naturally processed by cellular enzymatic activity into at least 2 separate VGAM precursor RNAs, VGAM1012 precursor RNA and VGAM1013 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1012 RNA and VGAM1013 RNA, herein schematically represented by VGAM1 RNA through VGAM3 RNA, each of which VGAM RNAs corresponding to VGAM RNA of FIG. 1.

VGAM1012 RNA, herein schematically represented by VGAM1 RNA through VGAM3 RNA, binds complementarily to a host target binding site located in an untranslated region of VGAM1012 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1012 host target RNA into VGAM1012 host target protein, herein schematically represented by VGAM1 HOST TARGET PROTEIN through VGAM3 HOST TARGET PROTEIN, all of FIG. 1.

VGAM1013 RNA, herein schematically represented by VGAM1 RNA through VGAM3 RNA, binds complementarily to a host target binding site located in an untranslated region of VGAM1013 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1013 host target RNA into VGAM1013 host target protein, herein schematically represented by VGAM1 HOST TARGET PROTEIN through VGAM3 HOST TARGET PROTEIN, all of FIG. 1.

It is appreciated that a function of VGR2952 gene, herein designated VGR GENE, is inhibition of expression of host target genes, as part of a novel viral mechanism of attacking a host. Accordingly, utilities of VGR2952 gene include diagnosis, prevention and treatment of viral infection by Equine Herpesvirus 1. Specific functions, and accordingly utilities, of VGR2952 gene correlate with, and may be deduced from, the identity of the host target genes, which are inhibited by VGAM RNAs comprised in the 'operon-like' cluster of VGR2952 gene: VGAM1012 host target protein and VGAM1013 host target protein, herein schematically represented by VGAM1 HOST TARGET PROTEIN through VGAM3 HOST TARGET PROTEIN. The function of these host target genes is elaborated hereinabove with reference to VGAM1012 and VGAM1013. FIG. 9 further provides a conceptual description of novel bioinformatically detected regulatory viral gene, referred to here as Viral Genomic Record 2953(VGR2953) viral gene, which encodes an 'operon-like' cluster of novel viral micro RNA-like genes, each of which in turn modulates expression of at least one host target gene, the function and utility of which at least one host target gene is known in the art.

VGR2953 gene, herein designated VGR GENE, is a novel bioinformatically detected regulatory, non protein coding, RNA viral gene. The method by which VGR2953 gene was detected is described hereinabove with reference to FIGS. 1-9.

VGR2953 gene encodes VGR2953 precursor RNA, herein designated VGR PRECURSOR RNA, an RNA molecule, typically several hundred nucleotides long.

VGR2953 precursor RNA folds spatially, forming VGR2953 folded precursor RNA, herein designated VGR FOLDED PRECURSOR RNA. It is appreciated that VGR2953 folded precursor RNA comprises a plurality of what is known in the art as 'hairpin' structures. These 'hairpin' structures are due to the fact that the nucleotide sequence of VGR2953 precursor RNA comprises a plurality of segments, the first half of each such segment having a nucleotide sequence which is at least a partial inversed-reversed sequence of the second half thereof, as is well known in the art.

VGR2953 folded precursor RNA is naturally processed by cellular enzymatic activity into at least 2 separate VGAM precursor RNAs, VGAM1015 precursor RNA and VGAM1016 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1015 RNA and VGAM1016 RNA, herein schematically represented by VGAM1 RNA through VGAM3 RNA, each of which VGAM RNAs corresponding to VGAM RNA of FIG. 1.

VGAM1015 RNA, herein schematically represented by VGAM1 RNA through VGAM3 RNA, binds complementarily to a host target binding site located in an untranslated region of VGAM1015 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1015 host target RNA into VGAM1015 host target protein, herein schematically represented by VGAM1 HOST TARGET PROTEIN through VGAM3 HOST TARGET PROTEIN, all of FIG. 1.

VGAM1016 RNA, herein schematically represented by VGAM1 RNA through VGAM3 RNA, binds complementarily to a host target binding site located in an untranslated region of VGAM1016 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1016 host target RNA into VGAM1016 host target protein, herein schematically represented by VGAM1 HOST TARGET PROTEIN through VGAM3 HOST TARGET PROTEIN, all of FIG. 1.

It is appreciated that a function of VGR2953 gene, herein designated VGR GENE, is inhibition of expression of host target genes, as part of a novel viral mechanism of attacking a host. Accordingly, utilities of VGR2953 gene include diagnosis, prevention and treatment of viral infection by Broad Bean Necrosis Virus. Specific functions, and accordingly utilities, of VGR2953 gene correlate with, and may be deduced from, the identity of the host target genes, which are inhibited by VGAM RNAs comprised in the 'operon-like' cluster of VGR2953 gene: VGAM1015 host target protein and VGAM1016 host target protein, herein schematically represented by VGAM1 HOST TARGET PROTEIN through VGAM3 HOST TARGET PROTEIN. The function of these host target genes is elaborated hereinabove with reference to VGAM1015 and VGAM1016. FIG. 9 further provides a conceptual description of novel bioinformatically detected regulatory viral gene, referred to here as Viral Genomic Record 2954(VGR2954) viral gene, which encodes an 'operon-like' cluster of novel viral micro RNA-like genes, each of which in turn modulates expression of at least one host target gene, the function and utility of which at least one host target gene is known in the art.

VGR2954 gene, herein designated VGR GENE, is a novel bioinformatically detected regulatory, non protein coding, RNA viral gene. The method by which VGR2954 gene was detected is described hereinabove with reference to FIGS. 1-9.

VGR2954 gene encodes VGR2954 precursor RNA, herein designated VGR PRECURSOR RNA, an RNA molecule, typically several hundred nucleotides long.

VGR2954 precursor RNA folds spatially, forming VGR2954 folded precursor RNA, herein designated VGR FOLDED PRECURSOR RNA. It is appreciated that VGR2954 folded precursor RNA comprises a plurality of what is known in the art as 'hairpin' structures. These 'hairpin' structures are due to the fact that the nucleotide sequence of VGR2954 precursor RNA comprises a plurality of segments, the first half of each such segment having a nucleotide sequence which is at least a partial inversed-reversed sequence of the second half thereof, as is well known in the art.

VGR2954 folded precursor RNA is naturally processed by cellular enzymatic activity into at least 3 separate VGAM precursor RNAs, VGAM1017 precursor RNA, VGAM1018 precursor RNA and VGAM1019 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1017 RNA, VGAM1018 RNA and VGAM1019 RNA, herein schematically represented by VGAM1 RNA through VGAM3 RNA, each of which VGAM RNAs corresponding to VGAM RNA of FIG. 1.

VGAM1017 RNA, herein schematically represented by VGAM1 RNA through VGAM3 RNA, binds complementarily to a host target binding site located in an untranslated region of VGAM1017 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1017 host target RNA into VGAM1017 host target protein, herein schematically represented by VGAM1 HOST TARGET PROTEIN through VGAM3 HOST TARGET PROTEIN, all of FIG. 1.

VGAM1018 RNA, herein schematically represented by VGAM1 RNA through VGAM3 RNA, binds complementarily to a host target binding site located in an untranslated region of VGAM1018 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1018 host target RNA into VGAM1018 host target protein, herein schematically represented by VGAM1 HOST TARGET PROTEIN through VGAM3 HOST TARGET PROTEIN, all of FIG. 1.

VGAM1019 RNA, herein schematically represented by VGAM1 RNA through VGAM3 RNA, binds complementarily to a host target binding site located in an untranslated region of VGAM1019 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1019 host target RNA into VGAM1019 host target protein, herein schematically represented by VGAM1 HOST TARGET PROTEIN through VGAM3 HOST TARGET PROTEIN, all of FIG. 1.

It is appreciated that a function of VGR2954 gene, herein designated VGR GENE, is inhibition of expression of host target genes, as part of a novel viral mechanism of attacking a host. Accordingly, utilities of VGR2954 gene include diagnosis, prevention and treatment of viral infection by Beet Western Yellows Virus. Specific functions, and accordingly utilities, of VGR2954 gene correlate with, and may be deduced from, the identity of the host target genes, which are inhibited by VGAM RNAs comprised in the 'operon-like' cluster of VGR2954 gene: VGAM1017 host target protein, VGAM1018 host target protein and VGAM1019 host target protein, herein schematically represented by VGAM1 HOST TARGET PROTEIN through VGAM3 HOST TARGET PROTEIN. The function of these host target genes is elaborated hereinabove with reference to VGAM1017, VGAM1018 and VGAM1019. FIG. 9 further provides a conceptual description of novel bioinformatically detected regulatory viral gene, referred to here as Viral Genomic Record 2955(VGR2955) viral gene, which encodes an 'operon-like' cluster of novel viral micro RNA-like genes, each of which in turn modulates expression of at least one host target gene, the function and utility of which at least one host target gene is known in the art.

VGR2955 gene, herein designated VGR GENE, is a novel bioinformatically detected regulatory, non protein coding, RNA viral gene. The method by which VGR2955 gene was detected is described hereinabove with reference to FIGS. 1-9.

VGR2955 gene encodes VGR2955 precursor RNA, herein designated VGR PRECURSOR RNA, an RNA molecule, typically several hundred nucleotides long.

VGR2955 precursor RNA folds spatially, forming VGR2955 folded precursor RNA, herein designated VGR FOLDED PRECURSOR RNA. It is appreciated that VGR2955 folded precursor RNA comprises a plurality of what is known in the art as 'hairpin' structures. These 'hairpin' structures are due to the fact that the nucleotide sequence of VGR2955 precursor RNA comprises a plurality of segments, the first half of each such segment having a nucleotide sequence which is at least a partial inversed-reversed sequence of the second half thereof, as is well known in the art.

VGR2955 folded precursor RNA is naturally processed by cellular enzymatic activity into at least 7 separate VGAM precursor RNAs, VGAM1020 precursor RNA, VGAM1021 precursor RNA, VGAM1022 precursor RNA, VGAM1023 precursor RNA, VGAM1024 precursor RNA, VGAM1025 precursor RNA and VGAM1026 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1020 RNA, VGAM1021 RNA, VGAM1022 RNA, VGAM1023 RNA, VGAM1024 RNA, VGAM1025 RNA and VGAM1026 RNA, herein schematically represented by VGAM1 RNA through VGAM3 RNA, each of which VGAM RNAs corresponding to VGAM RNA of FIG. 1.

VGAM1020 RNA, herein schematically represented by VGAM1 RNA through VGAM3 RNA, binds complementarily to a host target binding site located in an untranslated region of VGAM1020 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1020 host target RNA into VGAM1020 host target protein, herein schematically represented by VGAM1 HOST TARGET PROTEIN through VGAM3 HOST TARGET PROTEIN, all of FIG. 1.

VGAM1021 RNA, herein schematically represented by VGAM1 RNA through VGAM3 RNA, binds complementarily to a host target binding site located in an untranslated region of VGAM1021 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1021 host target RNA into VGAM1021 host target protein, herein schematically represented by VGAM1 HOST TARGET PROTEIN through VGAM3 HOST TARGET PROTEIN, all of FIG. 1.

VGAM1022 RNA, herein schematically represented by VGAM1 RNA through VGAM3 RNA, binds complementarily to a host target binding site located in an untranslated region of VGAM1022 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1022 host target RNA into VGAM1022 host target protein, herein schematically represented by VGAM1 HOST TARGET PROTEIN through VGAM3 HOST TARGET PROTEIN, all of FIG. 1.

VGAM1023 RNA, herein schematically represented by VGAM1 RNA through VGAM3 RNA, binds complementarily to a host target binding site located in an untranslated region of VGAM1023 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1023 host target RNA into VGAM1023 host target protein, herein schematically represented by VGAM1 HOST TARGET PROTEIN through VGAM3 HOST TARGET PROTEIN, all of FIG. 1.

VGAM1024 RNA, herein schematically represented by VGAM1 RNA through VGAM3 RNA, binds complementarily to a host target binding site located in an untranslated region of VGAM1024 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1024 host target RNA into VGAM1024 host target protein, herein schematically represented by VGAM1 HOST TARGET PROTEIN through VGAM3 HOST TARGET PROTEIN, all of FIG. 1.

VGAM1025 RNA, herein schematically represented by VGAM1 RNA through VGAM3 RNA, binds complementarily to a host target binding site located in an untranslated region of VGAM1025 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1025 host target RNA into VGAM1025 host target protein, herein schematically represented by VGAM1 HOST TARGET PROTEIN through VGAM3 HOST TARGET PROTEIN, all of FIG. 1.

VGAM1026 RNA, herein schematically represented by VGAM1 RNA through VGAM3 RNA, binds complementarily to a host target binding site located in an untranslated region of VGAM1026 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1026 host target RNA into VGAM1026 host target protein, herein schematically represented by VGAM1 HOST TARGET PROTEIN through VGAM3 HOST TARGET PROTEIN, all of FIG. 1.

It is appreciated that a function of VGR2955 gene, herein designated VGR GENE, is inhibition of expression of host target genes, as part of a novel viral mechanism of attacking a host. Accordingly, utilities of VGR2955 gene include diagnosis, prevention and treatment of viral infection by Cereal Yellow Dwarf Virus - RPV. Specific functions, and accordingly utilities, of VGR2955 gene correlate with, and may be deduced from, the identity of the host target genes, which are inhibited by VGAM RNAs comprised in the 'operon-like' cluster of VGR2955 gene: VGAM1020 host target protein, VGAM1021 host target protein, VGAM1022 host target protein, VGAM1023 host target protein, VGAM1024 host target protein, VGAM1025 host target protein and VGAM1026 host target protein, herein schematically represented by VGAM1 HOST TARGET PROTEIN through VGAM3 HOST TARGET PROTEIN. The function of these host target genes is elaborated hereinabove with reference to VGAM1020, VGAM1021, VGAM1022, VGAM1023, VGAM1024, VGAM1025 and VGAM1026. FIG. 9 further provides a conceptual description of novel bioinformatically detected regulatory viral gene, referred to here as Viral Genomic Record 2956(VGR2956) viral gene, which encodes an 'operon-like' cluster of novel viral micro RNA-like genes, each of which in turn modulates expression of at least one host target gene, the function and utility of which at least one host target gene is known in the art.

VGR2956 gene, herein designated VGR GENE, is a novel bioinformatically detected regulatory, non protein coding, RNA viral gene. The method by which VGR2956 gene was detected is described hereinabove with reference to FIGS. 1-9.

VGR2956 gene encodes VGR2956 precursor RNA, herein designated VGR PRECURSOR RNA, an RNA molecule, typically several hundred nucleotides long.

VGR2956 precursor RNA folds spatially, forming VGR2956 folded precursor RNA, herein designated VGR FOLDED PRECURSOR RNA. It is appreciated that VGR2956 folded precursor RNA comprises a plurality of what is known in the art as 'hairpin' structures. These 'hairpin' structures are due to the fact that the nucleotide sequence of VGR2956 precursor RNA comprises a plurality of segments, the first half of each such segment having a nucleotide sequence which is at least a partial inversed-reversed sequence of the second half thereof, as is well known in the art.

VGR2956 folded precursor RNA is naturally processed by cellular enzymatic activity into at least 2 separate VGAM precursor RNAs, VGAM1027 precursor RNA and VGAM1028 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1027 RNA and VGAM1028 RNA, herein schematically represented by VGAM1 RNA through VGAM3 RNA, each of which VGAM RNAs corresponding to VGAM RNA of FIG. 1.

VGAM1027 RNA, herein schematically represented by VGAM1 RNA through VGAM3 RNA, binds complementarily to a host target binding site located in an untranslated region of VGAM1027 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1027 host target RNA into VGAM1027 host target protein, herein schematically represented by VGAM1 HOST TARGET PROTEIN through VGAM3 HOST TARGET PROTEIN, all of FIG. 1.

VGAM1028 RNA, herein schematically represented by VGAM1 RNA through VGAM3 RNA, binds complementarily to a host target binding site located in an untranslated region of VGAM1028 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1028 host target RNA into VGAM1028 host target protein, herein schematically represented by VGAM1 HOST TARGET PROTEIN through VGAM3 HOST TARGET PROTEIN, all of FIG. 1.

It is appreciated that a function of VGR2956 gene, herein designated VGR GENE, is inhibition of expression of host target genes, as part of a novel viral mechanism of attacking a host. Accordingly, utilities of VGR2956 gene include diagnosis, prevention and treatment of viral infection by Ictalurid Herpesvirus 1. Specific functions, and accordingly utilities, of VGR2956 gene correlate with, and may be deduced from, the identity of the host target genes, which are inhibited by VGAM RNAs comprised in the 'operon-like' cluster of VGR2956 gene: VGAM1027 host target protein and VGAM1028 host target protein, herein schematically represented by VGAM1 HOST TARGET PROTEIN through VGAM3 HOST TARGET PROTEIN. The function of these host target genes is elaborated hereinabove with reference to VGAM1027 and VGAM1028. FIG. 9 further provides a conceptual description of novel bioinformatically detected regulatory viral gene, referred to here as Viral Genomic Record 2957(VGR2957) viral gene, which encodes an 'operon-like' cluster of novel viral micro RNA-like genes, each of which in turn modulates expression of at least one host target gene, the function and utility of which at least one host target gene is known in the art.

VGR2957 gene, herein designated VGR GENE, is a novel bioinformatically detected regulatory, non protein coding, RNA viral gene. The method by which VGR2957 gene was detected is described hereinabove with reference to FIGS. 1-9.

VGR2957 gene encodes VGR2957 precursor RNA, herein designated VGR PRECURSOR RNA, an RNA molecule, typically several hundred nucleotides long.

VGR2957 precursor RNA folds spatially, forming VGR2957 folded precursor RNA, herein designated VGR FOLDED PRECURSOR RNA. It is appreciated that VGR2957 folded precursor RNA comprises a plurality of what is known in the art as 'hairpin' structures. These 'hairpin' structures are due to the fact that the nucleotide sequence of VGR2957 precursor RNA comprises a plurality of segments, the first half of each such segment having a nucleotide sequence which is at least a partial inversed-reversed sequence of the second half thereof, as is well known in the art.

VGR2957 folded precursor RNA is naturally processed by cellular enzymatic activity into at least 2 separate VGAM precursor RNAs, VGAM1030 precursor RNA and VGAM1031 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1030 RNA and VGAM1031 RNA, herein schematically represented by VGAM1 RNA through VGAM3 RNA, each of which VGAM RNAs corresponding to VGAM RNA of FIG. 1.

VGAM1030 RNA, herein schematically represented by VGAM1 RNA through VGAM3 RNA, binds complementarily to a host target binding site located in an untranslated region of VGAM1030 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1030 host target RNA into VGAM1030 host target protein, herein schematically represented by VGAM1 HOST TARGET PROTEIN through VGAM3 HOST TARGET PROTEIN, all of FIG. 1.

VGAM1031 RNA, herein schematically represented by VGAM1 RNA through VGAM3 RNA, binds complementarily to a host target binding site located in an untranslated region of VGAM1031 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1031 host target RNA into VGAM1031 host target protein, herein schematically represented by VGAM1 HOST TARGET PROTEIN through VGAM3 HOST TARGET PROTEIN, all of FIG. 1.

It is appreciated that a function of VGR2957 gene, herein designated VGR GENE, is inhibition of expression of host target genes, as part of a novel viral mechanism of attacking a host. Accordingly, utilities of VGR2957 gene include diagnosis, prevention and treatment of viral infection by Beet Mild Yellowing Virus. Specific functions, and accordingly utilities, of VGR2957 gene correlate with, and may be deduced from, the identity of the host target genes, which are inhibited by VGAM RNAs comprised in the 'operon-like' cluster of VGR2957 gene: VGAM1030 host target protein and VGAM1031 host target protein, herein schematically represented by VGAM1 HOST TARGET PROTEIN through VGAM3 HOST TARGET PROTEIN. The function of these host target genes is elaborated hereinabove with reference to VGAM1030 and VGAM1031. FIG. 9 further provides a conceptual description of novel bioinformatically detected regulatory viral gene, referred to here as Viral Genomic Record 2958(VGR2958) viral gene, which encodes an 'operon-like' cluster of novel viral micro RNA-like genes, each of which in turn modulates expression of at least one host target gene, the function and utility of which at least one host target gene is known in the art.

VGR2958 gene, herein designated VGR GENE, is a novel bioinformatically detected regulatory, non protein coding, RNA viral gene. The method by which VGR2958 gene was detected is described hereinabove with reference to FIGS. 1-9.

VGR2958 gene encodes VGR2958 precursor RNA, herein designated VGR PRECURSOR RNA, an RNA molecule, typically several hundred nucleotides long.

VGR2958 precursor RNA folds spatially, forming VGR2958 folded precursor RNA, herein designated VGR FOLDED PRECURSOR RNA. It is appreciated that VGR2958 folded precursor RNA comprises a plurality of what is known in the art as 'hairpin' structures. These 'hairpin' structures are due to the fact that the nucleotide sequence of VGR2958 precursor RNA comprises a plurality of segments, the first half of each such segment having a nucleotide sequence which is at least a partial inversed-reversed sequence of the second half thereof, as is well known in the art.

VGR2958 folded precursor RNA is naturally processed by cellular enzymatic activity into at least 5 separate VGAM precursor RNAs, VGAM1032 precursor RNA, VGAM1033 precursor RNA, VGAM1034 precursor RNA, VGAM1035 precursor RNA and VGAM1036 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1032 RNA, VGAM1033 RNA, VGAM1034 RNA, VGAM1035 RNA and VGAM1036 RNA, herein schematically represented by VGAM1 RNA through VGAM3 RNA, each of which VGAM RNAs corresponding to VGAM RNA of FIG. 1.

VGAM1032 RNA, herein schematically represented by VGAM1 RNA through VGAM3 RNA, binds complementarily to a host target binding site located in an untranslated region of VGAM1032 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1032 host target RNA into VGAM1032 host target protein, herein schematically represented by VGAM1 HOST TARGET PROTEIN through VGAM3 HOST TARGET PROTEIN, all of FIG. 1.

VGAM1033 RNA, herein schematically represented by VGAM1 RNA through VGAM3 RNA, binds complementarily to a host target binding site located in an untranslated region of VGAM1033 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1033 host target RNA into VGAM1033 host target protein, herein schematically represented by VGAM1 HOST TARGET PROTEIN through VGAM3 HOST TARGET PROTEIN, all of FIG. 1.

VGAM1034 RNA, herein schematically represented by VGAM1 RNA through VGAM3 RNA, binds complementarily to a host target binding site located in an untranslated region of VGAM1034 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1034 host target RNA into VGAM1034 host target protein, herein schematically represented by VGAM1 HOST TARGET PROTEIN through VGAM3 HOST TARGET PROTEIN, all of FIG. 1.

VGAM1035 RNA, herein schematically represented by VGAM1 RNA through VGAM3 RNA, binds complementarily to a host target binding site located in an untranslated region of VGAM1035 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1035 host target RNA into VGAM1035 host target protein, herein schematically represented by VGAM1 HOST TARGET PROTEIN through VGAM3 HOST TARGET PROTEIN, all of FIG. 1.

VGAM1036 RNA, herein schematically represented by VGAM1 RNA through VGAM3 RNA, binds complementarily to a host target binding site located in an untranslated region of VGAM1036 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1036 host target RNA into VGAM1036 host target protein, herein schematically represented by VGAM1 HOST TARGET PROTEIN through VGAM3 HOST TARGET PROTEIN, all of FIG. 1.

It is appreciated that a function of VGR2958 gene, herein designated VGR GENE, is inhibition of expression of host target genes, as part of a novel viral mechanism of attacking a host. Accordingly, utilities of VGR2958 gene include diagnosis, prevention and treatment of viral infection by Cercopithecine Herpesvirus 7. Specific functions, and accordingly utilities, of VGR2958 gene correlate with, and may be deduced from, the identity of the host target genes, which are inhibited by VGAM RNAs comprised in the 'operon-like' cluster of VGR2958 gene: VGAM1032 host target protein, VGAM1033 host target protein, VGAM1034 host target protein, VGAM1035 host target protein and VGAM1036 host target protein, herein schematically represented by VGAM1 HOST TARGET PROTEIN through VGAM3 HOST TARGET PROTEIN. The function of these host target genes is elaborated hereinabove with reference to VGAM1032, VGAM1033, VGAM1034, VGAM1035 and VGAM1036.

FIG. 9 further provides a conceptual description of novel bioinformatically detected regulatory viral gene, referred to here as Viral Genomic Record 2959(VGR2959) viral gene, which encodes an 'operon-like' cluster of novel viral micro RNA-like genes, each of which in turn modulates expression of at least one host target gene, the function and utility of which at least one host target gene is known in the art.

VGR2959 gene, herein designated VGR GENE, is a novel bioinformatically detected regulatory, non protein coding, RNA viral gene. The method by which VGR2959 gene was detected is described hereinabove with reference to FIGS. 1-9.

VGR2959 gene encodes VGR2959 precursor RNA, herein designated VGR PRECURSOR RNA, an RNA molecule, typically several hundred nucleotides long.

VGR2959 precursor RNA folds spatially, forming VGR2959 folded precursor RNA, herein designated VGR FOLDED PRECURSOR RNA. It is appreciated that VGR2959 folded precursor RNA comprises a plurality of what is known in the art as 'hairpin' structures. These 'hairpin' structures are due to the fact that the nucleotide sequence of VGR2959 precursor RNA comprises a plurality of segments, the first half of each such segment having a nucleotide sequence which is at least a partial inversed-reversed sequence of the second half thereof, as is well known in the art.

VGR2959 folded precursor RNA is naturally processed by cellular enzymatic activity into at least 4 separate VGAM precursor RNAs, VGAM1037 precursor RNA, VGAM1038 precursor RNA, VGAM1039 precursor RNA and VGAM1040 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1037 RNA, VGAM1038 RNA, VGAM1039 RNA and VGAM1040 RNA, herein schematically represented by VGAM1 RNA through VGAM3 RNA, each of which VGAM RNAs corresponding to VGAM RNA of FIG. 1.

VGAM1037 RNA, herein schematically represented by VGAM1 RNA through VGAM3 RNA, binds complementarily to a host target binding site located in an untranslated region of VGAM1037 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1037 host target RNA into VGAM1037 host target protein, herein schematically represented by VGAM1 HOST TARGET PROTEIN through VGAM3 HOST TARGET PROTEIN, all of FIG. 1.

VGAM1038 RNA, herein schematically represented by VGAM1 RNA through VGAM3 RNA, binds complementarily to a host target binding site located in an untranslated region of VGAM1038 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1038 host target RNA into VGAM1038 host target protein, herein schematically represented by VGAM1 HOST TARGET PROTEIN through VGAM3 HOST TARGET PROTEIN, all of FIG. 1.

VGAM1039 RNA, herein schematically represented by VGAM1 RNA through VGAM3 RNA, binds complementarily to a host target binding site located in an untranslated region of VGAM1039 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1039 host target RNA into VGAM1039 host target protein, herein schematically represented by VGAM1 HOST TARGET PROTEIN through VGAM3 HOST TARGET PROTEIN, all of FIG. 1.

VGAM1040 RNA, herein schematically represented by VGAM1 RNA through VGAM3 RNA, binds complementarily to a host target binding site located in an untranslated region of VGAM1040 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1040 host target RNA into VGAM1040 host target protein, herein schematically represented by VGAM1 HOST TARGET PROTEIN through VGAM3 HOST TARGET PROTEIN, all of FIG. 1.

It is appreciated that a function of VGR2959 gene, herein designated VGR GENE, is inhibition of expression of host target genes, as part of a novel viral mechanism of attacking a host. Accordingly, utilities of VGR2959 gene include diagnosis, prevention and treatment of viral infection by Molluscum Contagiosum Virus. Specific functions, and accordingly utilities, of VGR2959 gene correlate with, and may be deduced from, the identity of the host target genes, which are inhibited by VGAM RNAs comprised in the 'operon-like' cluster of VGR2959 gene: VGAM1037 host target protein, VGAM1038 host target protein, VGAM1039 host target protein and VGAM1040 host target protein, herein schematically represented by VGAM1 HOST TARGET PROTEIN through VGAM3 HOST TARGET PROTEIN. The function of these host target genes is elaborated hereinabove with reference to VGAM1037, VGAM1038, VGAM1039 and VGAM1040. FIG. 9 further provides a conceptual description of novel bioinformatically detected regulatory viral gene, referred to here as Viral Genomic Record 2960(VGR2960) viral gene, which encodes an 'operon-like' cluster of novel viral micro RNA-like genes, each of which in turn modulates expression of at least one host target gene, the function and utility of which at least one host target gene is known in the art.

VGR2960 gene, herein designated VGR GENE, is a novel bioinformatically detected regulatory, non protein coding, RNA viral gene. The method by which VGR2960 gene was detected is described hereinabove with reference to FIGS. 1-9.

VGR2960 gene encodes VGR2960 precursor RNA, herein designated VGR PRECURSOR RNA, an RNA molecule, typically several hundred nucleotides long.

VGR2960 precursor RNA folds spatially, forming VGR2960 folded precursor RNA, herein designated VGR FOLDED PRECURSOR RNA. It is appreciated that VGR2960 folded precursor RNA comprises a plurality of what is known in the art as 'hairpin' structures. These 'hairpin' structures are due to the fact that the nucleotide sequence of VGR2960 precursor RNA comprises a plurality of segments, the first half of each such segment having a nucleotide sequence which is at least a partial inversed-reversed sequence of the second half thereof, as is well known in the art.

VGR2960 folded precursor RNA is naturally processed by cellular enzymatic activity into at least 3 separate VGAM precursor RNAs, VGAM1041 precursor RNA, VGAM1042 precursor RNA and VGAM1043 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1041 RNA, VGAM1042 RNA and VGAM1043 RNA, herein schematically represented by VGAM1 RNA through VGAM3 RNA, each of which VGAM RNAs corresponding to VGAM RNA of FIG. 1.

VGAM1041 RNA, herein schematically represented by VGAM1 RNA through VGAM3 RNA, binds complementarily to a host target binding site located in an untranslated region of VGAM1041 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1041 host target RNA into VGAM1041 host target protein, herein schematically represented by VGAM1 HOST TARGET PROTEIN through VGAM3 HOST TARGET PROTEIN, all of FIG. 1.

VGAM1042 RNA, herein schematically represented by VGAM1 RNA through VGAM3 RNA, binds complementarily to a host target binding site located in an untranslated region of VGAM1042 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1042 host target RNA into VGAM1042 host target protein, herein schematically represented by VGAM1 HOST TARGET PROTEIN through VGAM3 HOST TARGET PROTEIN, all of FIG. 1.

VGAM1043 RNA, herein schematically represented by VGAM1 RNA through VGAM3 RNA, binds complementarily to a host target binding site located in an untranslated region of VGAM1043 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1043 host target RNA into VGAM1043 host target protein, herein schematically represented by VGAM1 HOST TARGET PROTEIN through VGAM3 HOST TARGET PROTEIN, all of FIG. 1.

It is appreciated that a function of VGR2960 gene, herein designated VGR GENE, is inhibition of expression of host target genes, as part of a novel viral mechanism of attacking a host. Accordingly, utilities of VGR2960 gene include diagnosis, prevention and treatment of viral infection by White Clover Mosaic Virus. Specific functions, and accordingly utilities, of VGR2960 gene correlate with, and may be deduced from, the identity of the host target genes, which are inhibited by VGAM RNAs comprised in the 'operon-like' cluster of VGR2960 gene: VGAM1041 host target protein, VGAM1042 host target protein and VGAM1043 host target protein, herein schematically represented by VGAM1 HOST TARGET PROTEIN through VGAM3 HOST TARGET PROTEIN. The function of these host target genes is elaborated hereinabove with reference to VGAM1041, VGAM1042 and VGAM1043. FIG. 9 further provides a conceptual description of novel bioinformatically detected regulatory viral gene, referred to here as Viral Genomic Record 2961(VGR2961) viral gene, which encodes an 'operon-like' cluster of novel viral micro RNA-like genes, each of which in turn modulates expression of at least one host target gene, the function and utility of which at least one host target gene is known in the art.

VGR2961 gene, herein designated VGR GENE, is a novel bioinformatically detected regulatory, non protein coding, RNA viral gene. The method by which VGR2961 gene was detected is described hereinabove with reference to FIGS. 1-9.

VGR2961 gene encodes VGR2961 precursor RNA, herein designated VGR PRECURSOR RNA, an RNA molecule, typically several hundred nucleotides long.

VGR2961 precursor RNA folds spatially, forming VGR2961 folded precursor RNA, herein designated VGR FOLDED PRECURSOR RNA. It is appreciated that VGR2961 folded precursor RNA comprises a plurality of what is known in the art as 'hairpin' structures. These 'hairpin' structures are due to the fact that the nucleotide sequence of VGR2961 precursor RNA comprises a plurality of segments, the first half of each such segment having a nucleotide sequence which is at least a partial inversed-reversed sequence of the second half thereof, as is well known in the art.

VGR2961 folded precursor RNA is naturally processed by cellular enzymatic activity into at least 3 separate VGAM precursor RNAs, VGAM1044 precursor RNA, VGAM1045 precursor RNA and VGAM1046 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1044 RNA, VGAM1045 RNA and VGAM1046 RNA, herein schematically represented by VGAM1 RNA through VGAM3 RNA, each of which VGAM RNAs corresponding to VGAM RNA of FIG. 1.

VGAM1044 RNA, herein schematically represented by VGAM1 RNA through VGAM3 RNA, binds complementarily to a host target binding site located in an untranslated region of VGAM1044 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1044 host target RNA into VGAM1044 host target protein, herein schematically represented by VGAM1 HOST TARGET PROTEIN through VGAM3 HOST TARGET PROTEIN, all of FIG. 1.

VGAM1045 RNA, herein schematically represented by VGAM1 RNA through VGAM3 RNA, binds complementarily to a host target binding site located in an untranslated region of VGAM1045 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1045 host target RNA into VGAM1045 host target protein, herein schematically represented by VGAM1 HOST TARGET PROTEIN through VGAM3 HOST TARGET PROTEIN, all of FIG. 1.

VGAM1046 RNA, herein schematically represented by VGAM1 RNA through VGAM3 RNA, binds complementarily to a host target binding site located in an untranslated region of VGAM1046 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1046 host target RNA into VGAM1046 host target protein, herein schematically represented by VGAM1 HOST TARGET PROTEIN through VGAM3 HOST TARGET PROTEIN, all of FIG. 1.

It is appreciated that a function of VGR2961 gene, herein designated VGR GENE, is inhibition of expression of host target genes, as part of a novel viral mechanism of attacking a host. Accordingly, utilities of VGR2961 gene include diagnosis, prevention and treatment of viral infection by Human Herpesvirus 8. Specific functions, and accordingly utilities, of VGR2961 gene correlate with, and may be deduced from, the identity of the host target genes, which are inhibited by VGAM RNAs comprised in the 'operon-like' cluster of VGR2961 gene: VGAM1044 host target protein, VGAM1045 host target protein and VGAM1046 host target protein, herein schematically represented by VGAM1 HOST TARGET PROTEIN through VGAM3 HOST TARGET PROTEIN. The function of these host target genes is elaborated hereinabove with reference to VGAM1044, VGAM1045 and VGAM1046. FIG. 9 further provides a conceptual description of novel bioinformatically detected regulatory viral gene, referred to here as Viral Genomic Record 2962(VGR2962) viral gene, which encodes an 'operon-like' cluster of novel viral micro RNA-like genes, each of which in turn modulates expression of at least one host target gene, the function and utility of which at least one host target gene is known in the art.

VGR2962 gene, herein designated VGR GENE, is a novel bioinformatically detected regulatory, non protein coding, RNA viral gene. The method by which VGR2962 gene was detected is described hereinabove with reference to FIGS. 1-9.

VGR2962 gene encodes VGR2962 precursor RNA, herein designated VGR PRECURSOR RNA, an RNA molecule, typically several hundred nucleotides long.

VGR2962 precursor RNA folds spatially, forming VGR2962 folded precursor RNA, herein designated VGR FOLDED PRECURSOR RNA. It is appreciated that VGR2962 folded precursor RNA comprises a plurality of what is known in the art as 'hairpin' structures. These 'hairpin' structures are due to the fact that the nucleotide sequence of VGR2962 precursor RNA comprises a plurality of segments, the first half of each such segment having a nucleotide sequence which is at least a partial inversed-reversed sequence of the second half thereof, as is well known in the art.

VGR2962 folded precursor RNA is naturally processed by cellular enzymatic activity into at least 3 separate VGAM precursor RNAs, VGAM1047 precursor RNA, VGAM1048 precursor RNA and VGAM1049 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1047 RNA, VGAM1048 RNA and VGAM1049 RNA, herein schematically represented by VGAM1 RNA through VGAM3 RNA, each of which VGAM RNAs corresponding to VGAM RNA of FIG. 1.

VGAM1047 RNA, herein schematically represented by VGAM1 RNA through VGAM3 RNA, binds complementarily to a host target binding site located in an untranslated region of VGAM1047 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1047 host target RNA into VGAM1047 host target protein, herein schematically represented by VGAM1 HOST TARGET PROTEIN through VGAM3 HOST TARGET PROTEIN, all of FIG. 1.

VGAM1048 RNA, herein schematically represented by VGAM1 RNA through VGAM3 RNA, binds complementarily to a host target binding site located in an untranslated region of VGAM1048 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1048 host target RNA into VGAM1048 host target protein, herein schematically represented by VGAM1 HOST TARGET PROTEIN through VGAM3 HOST TARGET PROTEIN, all of FIG. 1.

VGAM1049 RNA, herein schematically represented by VGAM1 RNA through VGAM3 RNA, binds complementarily to a host target binding site located in an untranslated region of VGAM1049 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1049 host target RNA into VGAM1049 host target protein, herein schematically represented by VGAM1 HOST TARGET PROTEIN through VGAM3 HOST TARGET PROTEIN, all of FIG. 1.

It is appreciated that a function of VGR2962 gene, herein designated VGR GENE, is inhibition of expression of host target genes, as part of a novel viral mechanism of attacking a host. Accordingly, utilities of VGR2962 gene include diagnosis, prevention and treatment of viral infection by Strawberry Mild Yellow Edge Virus. Specific functions, and accordingly utilities, of VGR2962 gene correlate with, and may be deduced from, the identity of the host target genes, which are inhibited by VGAM RNAs comprised in the 'operon-like' cluster of VGR2962 gene: VGAM1047 host target protein, VGAM1048 host target protein and VGAM1049 host target protein, herein schematically represented by VGAM1 HOST TARGET PROTEIN through VGAM3 HOST TARGET PROTEIN. The function of these host target genes is elaborated hereinabove with reference to VGAM1047, VGAM1048 and VGAM1049. FIG. 9 further provides a conceptual description of novel bioinformatically detected regulatory viral gene, referred to here as Viral Genomic Record 2963(VGR2963) viral gene, which encodes an 'operon-like' cluster of novel viral micro RNA-like genes, each of which in turn modulates expression of at least one host target gene, the function and utility of which at least one host target gene is known in the art.

VGR2963 gene, herein designated VGR GENE, is a novel bioinformatically detected regulatory, non protein coding, RNA viral gene. The method by which VGR2963 gene was detected is described hereinabove with reference to FIGS. 1-9.

VGR2963 gene encodes VGR2963 precursor RNA, herein designated VGR PRECURSOR RNA, an RNA molecule, typically several hundred nucleotides long.

VGR2963 precursor RNA folds spatially, forming VGR2963 folded precursor RNA, herein designated VGR FOLDED PRECURSOR RNA. It is appreciated that VGR2963 folded precursor RNA comprises a plurality of what is known in the art as 'hairpin' structures. These 'hairpin' structures are due to the fact that the nucleotide sequence of VGR2963 precursor RNA comprises a plurality of segments, the first half of each such segment having a nucleotide sequence which is at least a partial inversed-reversed sequence of the second half thereof, as is well known in the art.

VGR2963 folded precursor RNA is naturally processed by cellular enzymatic activity into at least 4 separate VGAM precursor RNAs, VGAM1050 precursor RNA, VGAM1051 precursor RNA, VGAM1052 precursor RNA and VGAM1053 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1050 RNA, VGAM1051 RNA, VGAM1052 RNA and VGAM1053 RNA, herein schematically represented by VGAM1 RNA through VGAM3 RNA, each of which VGAM RNAs corresponding to VGAM RNA of FIG. 1.

VGAM1050 RNA, herein schematically represented by VGAM1 RNA through VGAM3 RNA, binds complementarily to a host target binding site located in an untranslated region of VGAM1050 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1050 host target RNA into VGAM1050 host target protein, herein schematically represented by VGAM1 HOST TARGET PROTEIN through VGAM3 HOST TARGET PROTEIN, all of FIG. 1.

VGAM1051 RNA, herein schematically represented by VGAM1 RNA through VGAM3 RNA, binds complementarily to a host target binding site located in an untranslated region of VGAM1051 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1051 host target RNA into VGAM1051 host target protein, herein schematically represented by VGAM1 HOST TARGET PROTEIN through VGAM3 HOST TARGET PROTEIN, all of FIG. 1.

VGAM1052 RNA, herein schematically represented by VGAM1 RNA through VGAM3 RNA, binds complementarily to a host target binding site located in an untranslated region of VGAM1052 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1052 host target RNA into VGAM1052 host target protein, herein schematically represented by VGAM1 HOST TARGET PROTEIN through VGAM3 HOST TARGET PROTEIN, all of FIG. 1.

VGAM1053 RNA, herein schematically represented by VGAM1 RNA through VGAM3 RNA, binds complementarily to a host target binding site located in an untranslated region of VGAM1053 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1053 host target RNA into VGAM1053 host target protein, herein schematically represented by VGAM1 HOST TARGET PROTEIN through VGAM3 HOST TARGET PROTEIN, all of FIG. 1.

It is appreciated that a function of VGR2963 gene, herein designated VGR GENE, is inhibition of expression of host target genes, as part of a novel viral mechanism of attacking a host. Accordingly, utilities of VGR2963 gene include diagnosis, prevention and treatment of viral infection by Meleagrid Herpesvirus 1. Specific functions, and accordingly utilities, of VGR2963 gene correlate with, and may be deduced from, the identity of the host target genes, which are inhibited by VGAM RNAs comprised in the 'operon-like' cluster of VGR2963 gene: VGAM1050 host target protein, VGAM1051 host target protein, VGAM1052 host target protein and VGAM1053 host target protein, herein schematically represented by VGAM1 HOST TARGET PROTEIN through VGAM3 HOST TARGET PROTEIN. The function of these host target genes is elaborated hereinabove with reference to VGAM1050, VGAM1051, VGAM1052 and VGAM1053. FIG. 9 further provides a conceptual description of novel bioinformatically detected regulatory viral gene, referred to here as Viral Genomic Record 2964(VGR2964) viral gene, which encodes an 'operon-like' cluster of novel viral micro RNA-like genes, each of which in turn modulates expression of at least one host target gene, the function and utility of which at least one host target gene is known in the art.

VGR2964 gene, herein designated VGR GENE, is a novel bioinformatically detected regulatory, non protein coding, RNA viral gene. The method by which VGR2964 gene was detected is described hereinabove with reference to FIGS. 1-9.

VGR2964 gene encodes VGR2964 precursor RNA, herein designated VGR PRECURSOR RNA, an RNA molecule, typically several hundred nucleotides long.

VGR2964 precursor RNA folds spatially, forming VGR2964 folded precursor RNA, herein designated VGR FOLDED PRECURSOR RNA. It is appreciated that VGR2964 folded precursor RNA comprises a plurality of what is known in the art as 'hairpin' structures. These 'hairpin' structures are due to the fact that the nucleotide sequence of VGR2964 precursor RNA comprises a plurality of segments, the first half of each such segment having a nucleotide sequence which is at least a partial inversed-reversed sequence of the second half thereof, as is well known in the art.

VGR2964 folded precursor RNA is naturally processed by cellular enzymatic activity into at least 2 separate VGAM precursor RNAs, VGAM1055 precursor RNA and VGAM1056 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1055 RNA and VGAM1056 RNA, herein schematically represented by VGAM1 RNA through VGAM3 RNA, each of which VGAM RNAs corresponding to VGAM RNA of FIG. 1.

VGAM1055 RNA, herein schematically represented by VGAM1 RNA through VGAM3 RNA, binds complementarily to a host target binding site located in an untranslated region of VGAM1055 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1055 host target RNA into VGAM1055 host target protein, herein schematically represented by VGAM1 HOST TARGET PROTEIN through VGAM3 HOST TARGET PROTEIN, all of FIG. 1.

VGAM1056 RNA, herein schematically represented by VGAM1 RNA through VGAM3 RNA, binds complementarily to a host target binding site located in an untranslated region of VGAM1056 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1056 host target RNA into VGAM1056 host target protein, herein schematically represented by VGAM1 HOST TARGET PROTEIN through VGAM3 HOST TARGET PROTEIN, all of FIG. 1.

It is appreciated that a function of VGR2964 gene, herein designated VGR GENE, is inhibition of expression of host target genes, as part of a novel viral mechanism of attacking a host. Accordingly, utilities of VGR2964 gene include diagnosis, prevention and treatment of viral infection by Mayaro Virus. Specific functions, and accordingly utilities, of VGR2964 gene correlate with, and may be deduced from, the identity of the host target genes, which are inhibited by VGAM RNAs comprised in the 'operon-like' cluster of VGR2964 gene: VGAM1055 host target protein and VGAM1056 host target protein, herein schematically represented by VGAM1 HOST TARGET PROTEIN through VGAM3 HOST TARGET PROTEIN. The function of these host target genes is elaborated hereinabove with reference to VGAM1055 and VGAM1056. FIG. 9 further provides a conceptual description of novel bioinformatically detected regulatory viral gene, referred to here as Viral Genomic Record 2965(VGR2965) viral gene, which encodes an 'operon-like' cluster of novel viral micro RNA-like genes, each of which in turn modulates expression of at least one host target gene, the function and utility of which at least one host target gene is known in the art.

VGR2965 gene, herein designated VGR GENE, is a novel bioinformatically detected regulatory, non protein coding, RNA viral gene. The method by which VGR2965 gene was detected is described hereinabove with reference to FIGS. 1-9.

VGR2965 gene encodes VGR2965 precursor RNA, herein designated VGR PRECURSOR RNA, an RNA molecule, typically several hundred nucleotides long.

VGR2965 precursor RNA folds spatially, forming VGR2965 folded precursor RNA, herein designated VGR FOLDED PRECURSOR RNA. It is appreciated that VGR2965 folded precursor RNA comprises a plurality of what is known in the art as 'hairpin' structures. These 'hairpin' structures are due to the fact that the nucleotide sequence of VGR2965 precursor RNA comprises a plurality of segments, the first half of each such segment having a nucleotide sequence which is at least a partial inversed-reversed sequence of the second half thereof, as is well known in the art.

VGR2965 folded precursor RNA is naturally processed by cellular enzymatic activity into at least 3 separate VGAM precursor RNAs, VGAM1057 precursor RNA, VGAM1058 precursor RNA and VGAM1059 precursor RNA, herein schematically represented by VGAM1 FOLDED PRECUR- SOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1057 RNA, VGAM1058 RNA and VGAM1059 RNA, herein schematically represented by VGAM1 RNA through VGAM3 RNA, each of which VGAM RNAs corresponding to VGAM RNA of FIG. 1.

VGAM1057 RNA, herein schematically represented by VGAM1 RNA through VGAM3 RNA, binds complementarily to a host target binding site located in an untranslated region of VGAM1057 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1057 host target RNA into VGAM1057 host target protein, herein schematically represented by VGAM1 HOST TARGET PROTEIN through VGAM3 HOST TARGET PROTEIN, all of FIG. 1.

VGAM1058 RNA, herein schematically represented by VGAM1 RNA through VGAM3 RNA, binds complementarily to a host target binding site located in an untranslated region of VGAM1058 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1058 host target RNA into VGAM1058 host target protein, herein schematically represented by VGAM1 HOST TARGET PROTEIN through VGAM3 HOST TARGET PROTEIN, all of FIG. 1.

VGAM1059 RNA, herein schematically represented by VGAM1 RNA through VGAM3 RNA, binds complementarily to a host target binding site located in an untranslated region of VGAM1059 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1059 host target RNA into VGAM1059 host target protein, herein schematically represented by VGAM1 HOST TARGET PROTEIN through VGAM3 HOST TARGET PROTEIN, all of FIG. 1.

It is appreciated that a function of VGR2965 gene, herein designated VGR GENE, is inhibition of expression of host target genes, as part of a novel viral mechanism of attacking a host. Accordingly, utilities of VGR2965 gene include diagnosis, prevention and treatment of viral infection by Murid Herpesvirus 4. Specific functions, and accordingly utilities, of VGR2965 gene correlate with, and may be deduced from, the identity of the host target genes, which are inhibited by VGAM RNAs comprised in the 'operon-like' cluster of VGR2965 gene: VGAM1057 host target protein, VGAM1058 host target protein and VGAM1059 host target protein, herein schematically represented by VGAM1 HOST TARGET PROTEIN through VGAM3 HOST TARGET PROTEIN. The function of these host target genes is elaborated hereinabove with reference to VGAM1057, VGAM1058 and VGAM1059. FIG. 9 further provides a conceptual description of novel bioinformatically detected regulatory viral gene, referred to here as Viral Genomic Record 2966(VGR2966) viral gene, which encodes an 'operon-like' cluster of novel viral micro RNA-like genes, each of which in turn modulates expression of at least one host target gene, the function and utility of which at least one host target gene is known in the art.

VGR2966 gene, herein designated VGR GENE, is a novel bioinformatically detected regulatory, non protein coding, RNA viral gene. The method by which VGR2966 gene was detected is described hereinabove with reference to FIGS. 1-9.

VGR2966 gene encodes VGR2966 precursor RNA, herein designated VGR PRECURSOR RNA, an RNA molecule, typically several hundred nucleotides long.

VGR2966 precursor RNA folds spatially, forming VGR2966 folded precursor RNA, herein designated VGR FOLDED PRECURSOR RNA. It is appreciated that VGR2966 folded precursor RNA comprises a plurality of what is known in the art as 'hairpin' structures. These 'hairpin' structures are due to the fact that the nucleotide sequence of VGR2966 precursor RNA comprises a plurality of segments, the first half of each such segment having a nucleotide sequence which is at least a partial inversed-reversed sequence of the second half thereof, as is well known in the art.

VGR2966 folded precursor RNA is naturally processed by cellular enzymatic activity into at least 2 separate VGAM precursor RNAs, VGAM1061 precursor RNA and VGAM1062 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1061 RNA and VGAM1062 RNA, herein schematically represented by VGAM1 RNA through VGAM3 RNA, each of which VGAM RNAs corresponding to VGAM RNA of FIG. 1.

VGAM1061 RNA, herein schematically represented by VGAM1 RNA through VGAM3 RNA, binds complementarily to a host target binding site located in an untranslated region of VGAM1061 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1061 host target RNA into VGAM1061 host target protein, herein schematically represented by VGAM1 HOST TARGET PROTEIN through VGAM3 HOST TARGET PROTEIN, all of FIG. 1.

VGAM1062 RNA, herein schematically represented by VGAM1 RNA through VGAM3 RNA, binds complementarily to a host target binding site located in an untranslated region of VGAM1062 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1062 host target RNA into VGAM1062 host target protein, herein schematically represented by VGAM1 HOST TARGET PROTEIN through VGAM3 HOST TARGET PROTEIN, all of FIG. 1.

It is appreciated that a function of VGR2966 gene, herein designated VGR GENE, is inhibition of expression of host target genes, as part of a novel viral mechanism of attacking a host. Accordingly, utilities of VGR2966 gene include diagnosis, prevention and treatment of viral infection by Canine Adenovirus Type 1. Specific functions, and accordingly utilities, of VGR2966 gene correlate with, and may be deduced from, the identity of the host target genes, which are inhibited by VGAM RNAs comprised in the 'operon-like' cluster of VGR2966 gene: VGAM1061 host target protein and VGAM1062 host target protein, herein schematically represented by VGAM1 HOST TARGET PROTEIN through VGAM3 HOST TARGET PROTEIN. The function of these host target genes is elaborated hereinabove with reference to VGAM1061 and VGAM1062. FIG. 9 further provides a conceptual description of novel bioinformatically detected regulatory viral gene, referred to here as Viral Genomic Record 2967(VGR2967) viral gene, which encodes an 'operon-like' cluster of novel viral micro RNA-like genes, each of which in turn modulates expression of at least one host target gene, the function and utility of which at least one host target gene is known in the art.

VGR2967 gene, herein designated VGR GENE, is a novel bioinformatically detected regulatory, non protein coding, RNA viral gene. The method by which VGR2967 gene was detected is described hereinabove with reference to FIGS. 1-9.

VGR2967 gene encodes VGR2967 precursor RNA, herein designated VGR PRECURSOR RNA, an RNA molecule, typically several hundred nucleotides long.

VGR2967 precursor RNA folds spatially, forming VGR2967 folded precursor RNA, herein designated VGR FOLDED PRECURSOR RNA. It is appreciated that VGR2967 folded precursor RNA comprises a plurality of what is known in the art as 'hairpin' structures. These 'hairpin' structures are due to the fact that the nucleotide sequence of VGR2967 precursor RNA comprises a plurality of segments, the first half of each such segment having a nucleotide sequence which is at least a partial inversed-reversed sequence of the second half thereof, as is well known in the art.

VGR2967 folded precursor RNA is naturally processed by cellular enzymatic activity into at least 4 separate VGAM precursor RNAs, VGAM1063 precursor RNA, VGAM1064 precursor RNA, VGAM1065 precursor RNA and VGAM1066 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1063 RNA, VGAM1064 RNA, VGAM1065 RNA and VGAM1066 RNA, herein schematically represented by VGAM1 RNA through VGAM3 RNA, each of which VGAM RNAs corresponding to VGAM RNA of FIG. 1.

VGAM1063 RNA, herein schematically represented by VGAM1 RNA through VGAM3 RNA, binds complementarily to a host target binding site located in an untranslated region of VGAM1063 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1063 host target RNA into VGAM1063 host target protein, herein schematically represented by VGAM1 HOST TARGET PROTEIN through VGAM3 HOST TARGET PROTEIN, all of FIG. 1.

VGAM1064 RNA, herein schematically represented by VGAM1 RNA through VGAM3 RNA, binds complementarily to a host target binding site located in an untranslated region of VGAM1064 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1064 host target RNA into VGAM1064 host target protein, herein schematically represented by VGAM1 HOST TARGET PROTEIN through VGAM3 HOST TARGET PROTEIN, all of FIG. 1.

VGAM1065 RNA, herein schematically represented by VGAM1 RNA through VGAM3 RNA, binds complementarily to a host target binding site located in an untranslated region of VGAM1065 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1065 host target RNA into VGAM1065 host target protein, herein schematically represented by VGAM1 HOST TARGET PROTEIN through VGAM3 HOST TARGET PROTEIN, all of FIG. 1.

VGAM1066 RNA, herein schematically represented by VGAM1 RNA through VGAM3 RNA, binds complementarily to a host target binding site located in an untranslated region of VGAM1066 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1066 host target RNA into VGAM1066 host target protein, herein schematically represented by VGAM1 HOST TARGET PROTEIN through VGAM3 HOST TARGET PROTEIN, all of FIG. 1.

It is appreciated that a function of VGR2967 gene, herein designated VGR GENE, is inhibition of expression of host target genes, as part of a novel viral mechanism of attacking a host. Accordingly, utilities of VGR2967 gene include diagnosis, prevention and treatment of viral infection by Tulip Virus X. Specific functions, and accordingly utilities, of VGR2967 gene correlate with, and may be deduced from, the identity of the host target genes, which are inhibited by VGAM RNAs comprised in the 'operon-like' cluster of VGR2967 gene: VGAM1063 host target protein, VGAM1064 host target protein, VGAM1065 host target protein and VGAM1066 host target protein, herein schematically represented by VGAM1 HOST TARGET PROTEIN through VGAM3 HOST TARGET PROTEIN. The function of these host target genes is elaborated hereinabove with reference to VGAM1063, VGAM1064, VGAM1065 and VGAM1066. FIG. 9 further provides a conceptual description of novel bioinformatically detected regulatory viral gene, referred to here as Viral Genomic Record 2968(VGR2968) viral gene, which encodes an 'operon-like' cluster of novel viral micro RNA-like genes, each of which in turn modulates expression of at least one host target gene, the function and utility of which at least one host target gene is known in the art.

VGR2968 gene, herein designated VGR GENE, is a novel bioinformatically detected regulatory, non protein coding, RNA viral gene. The method by which VGR2968 gene was detected is described hereinabove with reference to FIGS. 1-9.

VGR2968 gene encodes VGR2968 precursor RNA, herein designated VGR PRECURSOR RNA, an RNA molecule, typically several hundred nucleotides long.

VGR2968 precursor RNA folds spatially, forming VGR2968 folded precursor RNA, herein designated VGR FOLDED PRECURSOR RNA. It is appreciated that VGR2968 folded precursor RNA comprises a plurality of what is known in the art as 'hairpin' structures. These 'hairpin' structures are due to the fact that the nucleotide sequence of VGR2968 precursor RNA comprises a plurality of segments, the first half of each such segment having a nucleotide sequence which is at least a partial inversed-reversed sequence of the second half thereof, as is well known in the art.

VGR2968 folded precursor RNA is naturally processed by cellular enzymatic activity into at least 8 separate VGAM precursor RNAs, VGAM1067 precursor RNA, VGAM1068 precursor RNA, VGAM1069 precursor RNA, VGAM1070 precursor RNA, VGAM1071 precursor RNA, VGAM1072 precursor RNA, VGAM1073 precursor RNA and VGAM1074 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1067 RNA, VGAM1068 RNA, VGAM1069 RNA, VGAM1070 RNA, VGAM1071 RNA, VGAM1072 RNA, VGAM1073 RNA and VGAM1074 RNA, herein schematically represented by VGAM1 RNA through VGAM3 RNA, each of which VGAM RNAs corresponding to VGAM RNA of FIG. 1.

VGAM1067 RNA, herein schematically represented by VGAM1 RNA through VGAM3 RNA, binds complementarily to a host target binding site located in an untranslated region of VGAM1067 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1067 host target RNA into VGAM1067 host target protein, herein schematically represented by VGAM1 HOST TARGET PROTEIN through VGAM3 HOST TARGET PROTEIN, all of FIG. 1.

VGAM1068 RNA, herein schematically represented by VGAM1 RNA through VGAM3 RNA, binds complementarily to a host target binding site located in an untranslated region of VGAM1068 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1068 host target RNA into VGAM1068 host target protein, herein schematically represented by VGAM1 HOST TARGET PROTEIN through VGAM3 HOST TARGET PROTEIN, all of FIG. 1.

VGAM1069 RNA, herein schematically represented by VGAM1 RNA through VGAM3 RNA, binds complementarily to a host target binding site located in an untranslated region of VGAM1069 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1069 host target RNA into VGAM1069 host target protein, herein schematically represented by VGAM1 HOST TARGET PROTEIN through VGAM3 HOST TARGET PROTEIN, all of FIG. 1.

VGAM1070 RNA, herein schematically represented by VGAM1 RNA through VGAM3 RNA, binds complementarily to a host target binding site located in an untranslated region of VGAM1070 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1070 host target RNA into VGAM1070 host target protein, herein schematically represented by VGAM1 HOST TARGET PROTEIN through VGAM3 HOST TARGET PROTEIN, all of FIG. 1.

VGAM1071 RNA, herein schematically represented by VGAM1 RNA through VGAM3 RNA, binds complementarily to a host target binding site located in an untranslated region of VGAM1071 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1071 host target RNA into VGAM1071 host target protein, herein schematically represented by VGAM1 HOST TARGET PROTEIN through VGAM3 HOST TARGET PROTEIN, all of FIG. 1.

VGAM1072 RNA, herein schematically represented by VGAM1 RNA through VGAM3 RNA, binds complementarily to a host target binding site located in an untranslated region of VGAM1072 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1072 host target RNA into VGAM1072 host target protein, herein schematically represented by VGAM1 HOST TARGET PROTEIN through VGAM3 HOST TARGET PROTEIN, all of FIG. 1.

VGAM1073 RNA, herein schematically represented by VGAM1 RNA through VGAM3 RNA, binds complementarily to a host target binding site located in an untranslated region of VGAM1073 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1073 host target RNA into VGAM1073 host target protein, herein schematically represented by VGAM1 HOST TARGET PROTEIN through VGAM3 HOST TARGET PROTEIN, all of FIG. 1.

VGAM1074 RNA, herein schematically represented by VGAM1 RNA through VGAM3 RNA, binds complementarily to a host target binding site located in an untranslated region of VGAM1074 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1074 host target RNA into VGAM1074 host target protein, herein schematically represented by VGAM1 HOST TARGET PROTEIN through VGAM3 HOST TARGET PROTEIN, all of FIG. 1.

It is appreciated that a function of VGR2968 gene, herein designated VGR GENE, is inhibition of expression of host target genes, as part of a novel viral mechanism of attacking a host. Accordingly, utilities of VGR2968 gene include diagnosis, prevention and treatment of viral infection by Porcine Epidemic Diarrhea Virus. Specific functions, and accordingly utilities, of VGR2968 gene correlate with, and may be deduced from, the identity of the host target genes, which are inhibited by VGAM RNAs comprised in the 'operon-like' cluster of VGR2968 gene: VGAM1067 host target protein, VGAM1068 host target protein, VGAM1069 host target protein, VGAM1070 host target protein, VGAM1071 host target protein, VGAM1072 host target protein, VGAM1073 host target protein and VGAM1074 host target protein, herein schematically represented by VGAM1 HOST TARGET PROTEIN through VGAM3 HOST TARGET PROTEIN. The function of these host target genes is elaborated hereinabove with reference to VGAM1067, VGAM1068, VGAM1069, VGAM1070, VGAM1071, VGAM1072, VGAM1073 and VGAM1074. FIG. 9 further provides a conceptual description of novel bioinformatically detected regulatory viral gene, referred to here as Viral Genomic Record 2969(VGR2969) viral gene, which encodes an 'operon-like' cluster of novel viral micro RNA-like genes, each of which in turn modulates expression of at least one host target gene, the function and utility of which at least one host target gene is known in the art.

VGR2969 gene, herein designated VGR GENE, is a novel bioinformatically detected regulatory, non protein coding, RNA viral gene. The method by which VGR2969 gene was detected is described hereinabove with reference to FIGS. 1-9.

VGR2969 gene encodes VGR2969 precursor RNA, herein designated VGR PRECURSOR RNA, an RNA molecule, typically several hundred nucleotides long.

VGR2969 precursor RNA folds spatially, forming VGR2969 folded precursor RNA, herein designated VGR FOLDED PRECURSOR RNA. It is appreciated that VGR2969 folded precursor RNA comprises a plurality of what is known in the art as 'hairpin' structures. These 'hairpin' structures are due to the fact that the nucleotide sequence of VGR2969 precursor RNA comprises a plurality of segments, the first half of each such segment having a nucleotide sequence which is at least a partial inversed-reversed sequence of the second half thereof, as is well known in the art.

VGR2969 folded precursor RNA is naturally processed by cellular enzymatic activity into at least 8 separate VGAM precursor RNAs, VGAM1075 precursor RNA, VGAM1076 precursor RNA, VGAM1077 precursor RNA, VGAM1078 precursor RNA, VGAM1079 precursor RNA, VGAM1080 precursor RNA, VGAM1081 precursor RNA and VGAM1082 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1075 RNA, VGAM1076 RNA, VGAM1077 RNA, VGAM1078 RNA, VGAM1079 RNA, VGAM1080 RNA, VGAM1081 RNA and VGAM1082 RNA, herein schematically represented by VGAM1 RNA through VGAM3 RNA, each of which VGAM RNAs corresponding to VGAM RNA of FIG. 1.

VGAM1075 RNA, herein schematically represented by VGAM1 RNA through VGAM3 RNA, binds complementarily to a host target binding site located in an untranslated region of VGAM1075 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1075 host target RNA into VGAM1075 host target protein, herein schematically represented by VGAM1 HOST TARGET PROTEIN through VGAM3 HOST TARGET PROTEIN, all of FIG. 1.

VGAM1076 RNA, herein schematically represented by VGAM1 RNA through VGAM3 RNA, binds complementarily to a host target binding site located in an untranslated region of VGAM1076 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1076 host target RNA into VGAM1076 host target protein, herein schematically represented by VGAM1 HOST TARGET PROTEIN through VGAM3 HOST TARGET PROTEIN, all of FIG. 1.

VGAM1077 RNA, herein schematically represented by VGAM1 RNA through VGAM3 RNA, binds complementarily to a host target binding site located in an untranslated region of VGAM1077 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1077 host target RNA into VGAM1077 host target protein, herein schematically represented by VGAM1 HOST TARGET PROTEIN through VGAM3 HOST TARGET PROTEIN, all of FIG. 1.

VGAM1078 RNA, herein schematically represented by VGAM1 RNA through VGAM3 RNA, binds complementarily to a host target binding site located in an untranslated region of VGAM1078 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1078 host target RNA into VGAM1078 host target protein, herein schematically represented by VGAM1 HOST TARGET PROTEIN through VGAM3 HOST TARGET PROTEIN, all of FIG. 1.

VGAM1079 RNA, herein schematically represented by VGAM1 RNA through VGAM3 RNA, binds complementarily to a host target binding site located in an untranslated region of VGAM1079 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1079 host target RNA into VGAM1079 host target protein, herein schematically represented by VGAM1 HOST TARGET PROTEIN through VGAM3 HOST TARGET PROTEIN, all of FIG. 1.

VGAM1080 RNA, herein schematically represented by VGAM1 RNA through VGAM3 RNA, binds complementarily to a host target binding site located in an untranslated region of VGAM1080 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1080 host target RNA into VGAM1080 host target protein, herein schematically represented by VGAM1 HOST TARGET PROTEIN through VGAM3 HOST TARGET PROTEIN, all of FIG. 1.

VGAM1081 RNA, herein schematically represented by VGAM1 RNA through VGAM3 RNA, binds complementarily to a host target binding site located in an untranslated region of VGAM1081 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1081 host target RNA into VGAM1081 host target protein, herein schematically represented by VGAM1 HOST TARGET PROTEIN through VGAM3 HOST TARGET PROTEIN, all of FIG. 1.

VGAM1082 RNA, herein schematically represented by VGAM1 RNA through VGAM3 RNA, binds complementarily to a host target binding site located in an untranslated region of VGAM1082 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1082 host target RNA into VGAM1082 host target protein, herein schematically represented by VGAM1 HOST TARGET PROTEIN through VGAM3 HOST TARGET PROTEIN, all of FIG. 1.

It is appreciated that a function of VGR2969 gene, herein designated VGR GENE, is inhibition of expression of host target genes, as part of a novel viral mechanism of attacking a host. Accordingly, utilities of VGR2969 gene include diagnosis, prevention and treatment of viral infection by Porcine Epidemic Diarrhea Virus. Specific functions, and accordingly utilities, of VGR2969 gene correlate with, and may be deduced from, the identity of the host target genes, which are inhibited by VGAM RNAs comprised in the 'operon-like' cluster of VGR2969 gene: VGAM1075 host target protein, VGAM1076 host target protein, VGAM1077 host target protein, VGAM1078 host target protein, VGAM1079 host target protein, VGAM1080 host target protein, VGAM1081 host target protein and VGAM1082 host target protein, herein schematically represented by VGAM1 HOST TARGET PROTEIN through VGAM3 HOST TARGET PROTEIN. The function of these host target genes is elaborated hereinabove with reference to VGAM1075, VGAM1076, VGAM1077, VGAM1078, VGAM1079, VGAM1080, VGAM1081 and VGAM1082. FIG. 9 further provides a conceptual description of novel bioinformatically detected regulatory viral gene, referred to here as Viral Genomic Record 2970(VGR2970) viral gene, which encodes an 'operon-like' cluster of novel viral micro RNA-like genes, each of which in turn modulates expression of at least one host target gene, the function and utility of which at least one host target gene is known in the art.

VGR2970 gene, herein designated VGR GENE, is a novel bioinformatically detected regulatory, non protein coding, RNA viral gene. The method by which VGR2970 gene was detected is described hereinabove with reference to FIGS. 1-9.

VGR2970 gene encodes VGR2970 precursor RNA, herein designated VGR PRECURSOR RNA, an RNA molecule, typically several hundred nucleotides long.

VGR2970 precursor RNA folds spatially, forming VGR2970 folded precursor RNA, herein designated VGR FOLDED PRECURSOR RNA. It is appreciated that VGR2970 folded precursor RNA comprises a plurality of what is known in the art as 'hairpin' structures. These 'hairpin' structures are due to the fact that the nucleotide sequence of VGR2970 precursor RNA comprises a plurality of segments, the first half of each such segment having a nucleotide sequence which is at least a partial inversed-reversed sequence of the second half thereof, as is well known in the art.

VGR2970 folded precursor RNA is naturally processed by cellular enzymatic activity into at least 8 separate VGAM precursor RNAs, VGAM1083 precursor RNA, VGAM1084 precursor RNA, VGAM1085 precursor RNA, VGAM1086 precursor RNA, VGAM1087 precursor RNA, VGAM1088 precursor RNA, VGAM1089 precursor RNA and VGAM1090 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1083 RNA, VGAM1084 RNA, VGAM1085 RNA, VGAM1086 RNA, VGAM1087 RNA, VGAM1088 RNA, VGAM1089 RNA and VGAM1090 RNA, herein schematically represented by VGAM1 RNA through VGAM3 RNA, each of which VGAM RNAs corresponding to VGAM RNA of FIG. 1.

VGAM1083 RNA, herein schematically represented by VGAM1 RNA through VGAM3 RNA, binds complementarily to a host target binding site located in an untranslated region of VGAM1083 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1083 host target RNA into VGAM1083 host target protein, herein schematically represented by VGAM1 HOST TARGET PROTEIN through VGAM3 HOST TARGET PROTEIN, all of FIG. 1.

VGAM1084 RNA, herein schematically represented by VGAM1 RNA through VGAM3 RNA, binds complementarily to a host target binding site located in an untranslated region of VGAM1084 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1084 host target RNA into VGAM1084 host target protein, herein schematically represented by VGAM1 HOST TARGET PROTEIN through VGAM3 HOST TARGET PROTEIN, all of FIG. 1.

VGAM1085 RNA, herein schematically represented by VGAM1 RNA through VGAM3 RNA, binds complementarily to a host target binding site located in an untranslated region of VGAM1085 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1085 host target RNA into VGAM1085 host target protein, herein schematically represented by VGAM1 HOST TARGET PROTEIN through VGAM3 HOST TARGET PROTEIN, all of FIG. 1.

VGAM1086 RNA, herein schematically represented by VGAM1 RNA through VGAM3 RNA, binds complementarily to a host target binding site located in an untranslated region of VGAM1086 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM1086 host target RNA into VGAM1086 host target protein, herein schematically represented by VGAM1 HOST TARGET PROTEIN through VGAM3 HOST TARGET PROTEIN, all of FIG. 1.

VGAM1087 RNA, herein schematically represented by VGAM1 RNA through VGAM3 RNA, binds complementarily to a host target binding site located in an untranslated region of VGAM1087 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1087 host target RNA into VGAM1087 host target protein, herein schematically represented by VGAM1 HOST TARGET PROTEIN through VGAM3 HOST TARGET PROTEIN, all of FIG. 1.

VGAM1088 RNA, herein schematically represented by VGAM1 RNA through VGAM3 RNA, binds complementarily to a host target binding site located in an untranslated region of VGAM1088 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1088 host target RNA into VGAM1088 host target protein, herein schematically represented by VGAM1 HOST TARGET PROTEIN through VGAM3 HOST TARGET PROTEIN, all of FIG. 1.

VGAM1089 RNA, herein schematically represented by VGAM1 RNA through VGAM3 RNA, binds complementarily to a host target binding site located in an untranslated region of VGAM1089 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1089 host target RNA into VGAM1089 host target protein, herein schematically represented by VGAM1 HOST TARGET PROTEIN through VGAM3 HOST TARGET PROTEIN, all of FIG. 1.

VGAM1090 RNA, herein schematically represented by VGAM1 RNA through VGAM3 RNA, binds complementarily to a host target binding site located in an untranslated region of VGAM1090 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1090 host target RNA into VGAM1090 host target protein, herein schematically represented by VGAM1 HOST TARGET PROTEIN through VGAM3 HOST TARGET PROTEIN, all of FIG. 1.

It is appreciated that a function of VGR2970 gene, herein designated VGR GENE, is inhibition of expression of host target genes, as part of a novel viral mechanism of attacking a host. Accordingly, utilities of VGR2970 gene include diagnosis, prevention and treatment of viral infection by Porcine Epidemic Diarrhea Virus. Specific functions, and accordingly utilities, of VGR2970 gene correlate with, and may be deduced from, the identity of the host target genes, which are inhibited by VGAM RNAs comprised in the 'operon-like' cluster of VGR2970 gene: VGAM1083 host target protein, VGAM1084 host target protein, VGAM1085 host target protein, VGAM1086 host target protein, VGAM1087 host target protein, VGAM1088 host target protein, VGAM1089 host target protein and VGAM1090 host target protein, herein schematically represented by VGAM1 HOST TARGET PROTEIN through VGAM3 HOST TARGET PROTEIN. The function of these host target genes is elaborated hereinabove with reference to VGAM1083, VGAM1084, VGAM1085, VGAM1086, VGAM1087, VGAM1088, VGAM1089 and VGAM1090. FIG. 9 further provides a conceptual description of novel bioinformatically detected regulatory viral gene, referred to here as Viral Genomic Record 2971 (VGR2971) viral gene, which encodes an 'operon-like' cluster of novel viral micro RNA-like genes, each of which in turn modulates expression of at least one host target gene, the function and utility of which at least one host target gene is known in the art.

VGR2971 gene, herein designated VGR GENE, is a novel bioinformatically detected regulatory, non protein coding, RNA viral gene. The method by which VGR2971 gene was detected is described hereinabove with reference to FIGS. 1-9.

VGR2971 gene encodes VGR2971 precursor RNA, herein designated VGR PRECURSOR RNA, an RNA molecule, typically several hundred nucleotides long.

VGR2971 precursor RNA folds spatially, forming VGR2971 folded precursor RNA, herein designated VGR FOLDED PRECURSOR RNA. It is appreciated that VGR2971 folded precursor RNA comprises a plurality of what is known in the art as 'hairpin' structures. These 'hairpin' structures are due to the fact that the nucleotide sequence of VGR2971 precursor RNA comprises a plurality of segments, the first half of each such segment having a nucleotide sequence which is at least a partial inversed-reversed sequence of the second half thereof, as is well known in the art.

VGR2971 folded precursor RNA is naturally processed by cellular enzymatic activity into at least 5 separate VGAM precursor RNAs, VGAM1091 precursor RNA, VGAM1092 precursor RNA, VGAM1093 precursor RNA, VGAM1094 precursor RNA and VGAM1095 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1091 RNA, VGAM1092 RNA, VGAM1093 RNA, VGAM1094 RNA and VGAM1095 RNA, herein schematically represented by VGAM1 RNA through VGAM3 RNA, each of which VGAM RNAs corresponding to VGAM RNA of FIG. 1.

VGAM1091 RNA, herein schematically represented by VGAM1 RNA through VGAM3 RNA, binds complementarily to a host target binding site located in an untranslated region of VGAM1091 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1091 host target RNA into VGAM1091 host target protein, herein schematically represented by VGAM1 HOST TARGET PROTEIN through VGAM3 HOST TARGET PROTEIN, all of FIG. 1.

VGAM1092 RNA, herein schematically represented by VGAM1 RNA through VGAM3 RNA, binds complementarily to a host target binding site located in an untranslated region of VGAM1092 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1092 host target RNA into VGAM1092 host target protein, herein schematically represented by VGAM1 HOST TARGET PROTEIN through VGAM3 HOST TARGET PROTEIN, all of FIG. 1.

VGAM1093 RNA, herein schematically represented by VGAM1 RNA through VGAM3 RNA, binds complementarily to a host target binding site located in an untranslated region of VGAM1093 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1093 host target RNA into VGAM1093 host target protein, herein schematically represented by VGAM1 HOST TARGET PROTEIN through VGAM3 HOST TARGET PROTEIN, all of FIG. 1.

VGAM1094 RNA, herein schematically represented by VGAM1 RNA through VGAM3 RNA, binds complementarily to a host target binding site located in an untranslated region of VGAM1094 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1094 host target RNA into VGAM1094 host target protein, herein schematically represented by VGAM1 HOST TARGET PROTEIN through VGAM3 HOST TARGET PROTEIN, all of FIG. 1.

VGAM1095 RNA, herein schematically represented by VGAM1 RNA through VGAM3 RNA, binds complementarily to a host target binding site located in an untranslated region of VGAM1095 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1095 host target RNA into VGAM1095 host target protein, herein schematically represented by VGAM1 HOST TARGET PROTEIN through VGAM3 HOST TARGET PROTEIN, all of FIG. 1.

It is appreciated that a function of VGR2971 gene, herein designated VGR GENE, is inhibition of expression of host target genes, as part of a novel viral mechanism of attacking a host. Accordingly, utilities of VGR2971 gene include diagnosis, prevention and treatment of viral infection by Poinsettia Mosaic Virus. Specific functions, and accordingly utilities, of VGR2971 gene correlate with, and may be deduced from, the identity of the host target genes, which are inhibited by VGAM RNAs comprised in the 'operon-like' cluster of VGR2971 gene: VGAM1091 host target protein, VGAM1092 host target protein, VGAM1093 host target protein, VGAM1094 host target protein and VGAM1095 host target protein, herein schematically represented by VGAM1 HOST TARGET PROTEIN through VGAM3 HOST TARGET PROTEIN. The function of these host target genes is elaborated hereinabove with reference to VGAM1091, VGAM1092, VGAM1093, VGAM1094 and VGAM1095.

FIG. 9 further provides a conceptual description of novel bioinformatically detected regulatory viral gene, referred to here as Viral Genomic Record 2972(VGR2972) viral gene, which encodes an 'operon-like' cluster of novel viral micro RNA-like genes, each of which in turn modulates expression of at least one host target gene, the function and utility of which at least one host target gene is known in the art.

VGR2972 gene, herein designated VGR GENE, is a novel bioinformatically detected regulatory, non protein coding, RNA viral gene. The method by which VGR2972 gene was detected is described hereinabove with reference to FIGS. 1-9.

VGR2972 gene encodes VGR2972 precursor RNA, herein designated VGR PRECURSOR RNA, an RNA molecule, typically several hundred nucleotides long.

VGR2972 precursor RNA folds spatially, forming VGR2972 folded precursor RNA, herein designated VGR FOLDED PRECURSOR RNA. It is appreciated that VGR2972 folded precursor RNA comprises a plurality of what is known in the art as 'hairpin' structures. These 'hairpin' structures are due to the fact that the nucleotide sequence of VGR2972 precursor RNA comprises a plurality of segments, the first half of each such segment having a nucleotide sequence which is at least a partial inversed-reversed sequence of the second half thereof, as is well known in the art.

VGR2972 folded precursor RNA is naturally processed by cellular enzymatic activity into at least 8 separate VGAM precursor RNAs, VGAM1096 precursor RNA, VGAM1097 precursor RNA, VGAM1098 precursor RNA, VGAM1099 precursor RNA, VGAM1100 precursor RNA, VGAM1101 precursor RNA, VGAM1102 precursor RNA and VGAM1103 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1096 RNA, VGAM1097 RNA, VGAM1098 RNA, VGAM1099 RNA, VGAM1100 RNA, VGAM1101 RNA, VGAM1102 RNA and VGAM1103 RNA, herein schematically represented by VGAM1 RNA through VGAM3 RNA, each of which VGAM RNAs corresponding to VGAM RNA of FIG. 1.

VGAM1096 RNA, herein schematically represented by VGAM1 RNA through VGAM3 RNA, binds complementarily to a host target binding site located in an untranslated region of VGAM1096 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1096 host target RNA into VGAM1096 host target protein, herein schematically represented by VGAM1 HOST TARGET PROTEIN through VGAM3 HOST TARGET PROTEIN, all of FIG. 1.

VGAM1097 RNA, herein schematically represented by VGAM1 RNA through VGAM3 RNA, binds complementarily to a host target binding site located in an untranslated region of VGAM1097 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1097 host target RNA into VGAM1097 host target protein, herein schematically represented by VGAM1 HOST TARGET PROTEIN through VGAM3 HOST TARGET PROTEIN, all of FIG. 1.

VGAM1098 RNA, herein schematically represented by VGAM1 RNA through VGAM3 RNA, binds complementarily to a host target binding site located in an untranslated region of VGAM1098 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1098 host target RNA into VGAM1098 host target protein, herein schematically represented by VGAM1 HOST TARGET PROTEIN through VGAM3 HOST TARGET PROTEIN, all of FIG. 1.

VGAM1099 RNA, herein schematically represented by VGAM1 RNA through VGAM3 RNA, binds complementarily to a host target binding site located in an untranslated region of VGAM1099 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1099 host target RNA into VGAM1099 host target protein, herein schematically represented by VGAM1 HOST TARGET PROTEIN through VGAM3 HOST TARGET PROTEIN, all of FIG. 1.

VGAM1100 RNA, herein schematically represented by VGAM1 RNA through VGAM3 RNA, binds complementarily to a host target binding site located in an untranslated region of VGAM1100 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1100 host target RNA into VGAM1100 host target protein, herein schematically represented by VGAM1 HOST TARGET PROTEIN through VGAM3 HOST TARGET PROTEIN, all of FIG. 1.

VGAM1101 RNA, herein schematically represented by VGAM1 RNA through VGAM3 RNA, binds complementarily to a host target binding site located in an untranslated region of VGAM1101 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1101 host target RNA into VGAM1101 host target protein, herein schematically represented by VGAM1 HOST TARGET PROTEIN through VGAM3 HOST TARGET PROTEIN, all of FIG. 1.

VGAM1102 RNA, herein schematically represented by VGAM1 RNA through VGAM3 RNA, binds complementarily to a host target binding site located in an untranslated region of VGAM1102 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1102 host target RNA into VGAM1102 host target protein, herein schematically represented by VGAM1 HOST TARGET PROTEIN through VGAM3 HOST TARGET PROTEIN, all of FIG. 1.

VGAM1103 RNA, herein schematically represented by VGAM1 RNA through VGAM3 RNA, binds complementarily to a host target binding site located in an untranslated region of VGAM1103 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1103 host target RNA into VGAM1103 host target protein, herein schematically represented by VGAM1 HOST TARGET PROTEIN through VGAM3 HOST TARGET PROTEIN, all of FIG. 1.

It is appreciated that a function of VGR2972 gene, herein designated VGR GENE, is inhibition of expression of host target genes, as part of a novel viral mechanism of attacking a host. Accordingly, utilities of VGR2972 gene include diagnosis, prevention and treatment of viral infection by Strawberry Mottle Virus. Specific functions, and accordingly utilities, of VGR2972 gene correlate with, and may be deduced from, the identity of the host target genes, which are inhibited by VGAM RNAs comprised in the 'operon-like' cluster of VGR2972 gene: VGAM1096 host target protein, VGAM1097 host target protein, VGAM1098 host target protein, VGAM1099 host target protein, VGAM1100 host target protein, VGAM1101 host target protein, VGAM1102 host target protein and VGAM1103 host target protein, herein schematically represented by VGAM1 HOST TARGET PROTEIN through VGAM3 HOST TARGET PROTEIN. The function of these host target genes is elaborated hereinabove with reference to VGAM1096, VGAM1097, VGAM1098, VGAM1099, VGAM1100, VGAM1101, VGAM1102 and VGAM1103. FIG. 9 further provides a conceptual description of novel bioinformatically detected regulatory viral gene, referred to here as Viral Genomic Record 2973(VGR2973) viral gene, which encodes an 'operon-like' cluster of novel viral micro RNA-like genes, each of which in turn modulates expression of at least one host target gene, the function and utility of which at least one host target gene is known in the art.

VGR2973 gene, herein designated VGR GENE, is a novel bioinformatically detected regulatory, non protein coding, RNA viral gene. The method by which VGR2973 gene was detected is described hereinabove with reference to FIGS. 1-9.

VGR2973 gene encodes VGR2973 precursor RNA, herein designated VGR PRECURSOR RNA, an RNA molecule, typically several hundred nucleotides long.

VGR2973 precursor RNA folds spatially, forming VGR2973 folded precursor RNA, herein designated VGR FOLDED PRECURSOR RNA. It is appreciated that VGR2973 folded precursor RNA comprises a plurality of what is known in the art as 'hairpin' structures. These 'hairpin' structures are due to the fact that the nucleotide sequence of VGR2973 precursor RNA comprises a plurality of segments, the first half of each such segment having a nucleotide sequence which is at least a partial inversed-reversed sequence of the second half thereof, as is well known in the art.

VGR2973 folded precursor RNA is naturally processed by cellular enzymatic activity into at least 3 separate VGAM precursor RNAs, VGAM1104 precursor RNA, VGAM1105 precursor RNA and VGAM1106 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1104 RNA, VGAM1105 RNA and VGAM1106 RNA, herein schematically represented by VGAM1 RNA through VGAM3 RNA, each of which VGAM RNAs corresponding to VGAM RNA of FIG. 1.

VGAM1104 RNA, herein schematically represented by VGAM1 RNA through VGAM3 RNA, binds complementarily to a host target binding site located in an untranslated region of VGAM1104 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1104 host target RNA into VGAM1104 host target protein, herein schematically represented by VGAM1 HOST TARGET PROTEIN through VGAM3 HOST TARGET PROTEIN, all of FIG. 1.

VGAM1105 RNA, herein schematically represented by VGAM1 RNA through VGAM3 RNA, binds complementarily to a host target binding site located in an untranslated region of VGAM1105 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1105 host target RNA into VGAM1105 host target protein, herein schematically represented by VGAM1 HOST TARGET PROTEIN through VGAM3 HOST TARGET PROTEIN, all of FIG. 1.

VGAM1106 RNA, herein schematically represented by VGAM1 RNA through VGAM3 RNA, binds complementarily to a host target binding site located in an untranslated region of VGAM1106 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1106 host target RNA into VGAM1106 host target protein, herein schematically represented by VGAM1 HOST TARGET PROTEIN through VGAM3 HOST TARGET PROTEIN, all of FIG. 1.

It is appreciated that a function of VGR2973 gene, herein designated VGR GENE, is inhibition of expression of host target genes, as part of a novel viral mechanism of attacking a host. Accordingly, utilities of VGR2973 gene include diagnosis, prevention and treatment of viral infection by Human Herpesvirus 2. Specific functions, and accordingly utilities, of VGR2973 gene correlate with, and may be deduced from, the identity of the host target genes, which are inhibited by VGAM RNAs comprised in the 'operon-like' cluster of VGR2973 gene: VGAM1104 host target protein, VGAM1105 host target protein and VGAM1106 host target protein, herein schematically represented by VGAM1 HOST TARGET PROTEIN through VGAM3 HOST TARGET PROTEIN. The function of these host target genes is elaborated hereinabove with reference to VGAM1104, VGAM1105 and VGAM1106. FIG. 9 further provides a conceptual description of novel bioinformatically detected regulatory viral gene, referred to here as Viral Genomic Record 2974(VGR2974) viral gene, which encodes an 'operon-like' cluster of novel viral micro RNA-like genes, each of which in turn modulates expression of at least one host target gene, the function and utility of which at least one host target gene is known in the art.

VGR2974 gene, herein designated VGR GENE, is a novel bioinformatically detected regulatory, non protein coding, RNA viral gene. The method by which VGR2974 gene was detected is described hereinabove with reference to FIGS. 1-9.

VGR2974 gene encodes VGR2974 precursor RNA, herein designated VGR PRECURSOR RNA, an RNA molecule, typically several hundred nucleotides long.

VGR2974 precursor RNA folds spatially, forming VGR2974 folded precursor RNA, herein designated VGR FOLDED PRECURSOR RNA. It is appreciated that VGR2974 folded precursor RNA comprises a plurality of what is known in the art as 'hairpin' structures. These 'hairpin' structures are due to the fact that the nucleotide sequence of VGR2974 precursor RNA comprises a plurality of segments, the first half of each such segment having a nucleotide sequence which is at least a partial inversed-reversed sequence of the second half thereof, as is well known in the art.

VGR2974 folded precursor RNA is naturally processed by cellular enzymatic activity into at least 2 separate VGAM precursor RNAs, VGAM1108 precursor RNA and VGAM1109 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1108 RNA and VGAM1109 RNA, herein schematically represented by VGAM1 RNA through VGAM3 RNA, each of which VGAM RNAs corresponding to VGAM RNA of FIG. 1.

VGAM1108 RNA, herein schematically represented by VGAM1 RNA through VGAM3 RNA, binds complementarily to a host target binding site located in an untranslated region of VGAM1108 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1108 host target RNA into VGAM1108 host target protein, herein schematically represented by VGAM1 HOST TARGET PROTEIN through VGAM3 HOST TARGET PROTEIN, all of FIG. 1.

VGAM1109 RNA, herein schematically represented by VGAM1 RNA through VGAM3 RNA, binds complementarily to a host target binding site located in an untranslated region of VGAM1109 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1109 host target RNA into VGAM1109 host target protein, herein schematically represented by VGAM1 HOST TARGET PROTEIN through VGAM3 HOST TARGET PROTEIN, all of FIG. 1.

It is appreciated that a function of VGR2974 gene, herein designated VGR GENE, is inhibition of expression of host target genes, as part of a novel viral mechanism of attacking a host. Accordingly, utilities of VGR2974 gene include diagnosis, prevention and treatment of viral infection by Chimpanzee Cytomegalovirus. Specific functions, and accordingly utilities, of VGR2974 gene correlate with, and may be deduced from, the identity of the host target genes, which are inhibited by VGAM RNAs comprised in the 'operon-like' cluster of VGR2974 gene: VGAM1108 host target protein and VGAM1109 host target protein, herein schematically represented by VGAM1 HOST TARGET PROTEIN through VGAM3 HOST TARGET PROTEIN. The function of these host target genes is elaborated hereinabove with reference to VGAM1108 and VGAM1109. FIG. 9 further provides a conceptual description of novel bioinformatically detected regulatory viral gene, referred to here as Viral Genomic Record 2975(VGR2975) viral gene, which encodes an 'operon-like' cluster of novel viral micro RNA-like genes, each of which in turn modulates expression of at least one host target gene, the function and utility of which at least one host target gene is known in the art.

VGR2975 gene, herein designated VGR GENE, is a novel bioinformatically detected regulatory, non protein coding, RNA viral gene. The method by which VGR2975 gene was detected is described hereinabove with reference to FIGS. 1-9.

VGR2975 gene encodes VGR2975 precursor RNA, herein designated VGR PRECURSOR RNA, an RNA molecule, typically several hundred nucleotides long.

VGR2975 precursor RNA folds spatially, forming VGR2975 folded precursor RNA, herein designated VGR FOLDED PRECURSOR RNA. It is appreciated that VGR2975 folded precursor RNA comprises a plurality of what is known in the art as 'hairpin' structures. These 'hairpin' structures are due to the fact that the nucleotide sequence of VGR2975 precursor RNA comprises a plurality of segments, the first half of each such segment having a nucleotide sequence which is at least a partial inversed-reversed sequence of the second half thereof, as is well known in the art.

VGR2975 folded precursor RNA is naturally processed by cellular enzymatic activity into at least 5 separate VGAM precursor RNAs, VGAM1111 precursor RNA, VGAM1112 precursor RNA, VGAM1113 precursor RNA, VGAM1114 precursor RNA and VGAM1115 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1111 RNA, VGAM1112 RNA, VGAM1113 RNA, VGAM1114 RNA and VGAM1115 RNA, herein schematically represented by VGAM1 RNA through VGAM3 RNA, each of which VGAM RNAs corresponding to VGAM RNA of FIG. 1.

VGAM1111 RNA, herein schematically represented by VGAM1 RNA through VGAM3 RNA, binds complementarily to a host target binding site located in an untranslated region of VGAM1111 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1111 host target RNA into VGAM1111 host target protein, herein schematically represented by VGAM1 HOST TARGET PROTEIN through VGAM3 HOST TARGET PROTEIN, all of FIG. 1.

VGAM1112 RNA, herein schematically represented by VGAM1 RNA through VGAM3 RNA, binds complementarily to a host target binding site located in an untranslated region of VGAM1112 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1112 host target RNA into VGAM1112 host target protein, herein schematically represented by VGAM1 HOST TARGET PROTEIN through VGAM3 HOST TARGET PROTEIN, all of FIG. 1.

VGAM1113 RNA, herein schematically represented by VGAM1 RNA through VGAM3 RNA, binds complementarily to a host target binding site located in an untranslated region of VGAM1113 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1113 host target RNA into VGAM1113 host target protein, herein schematically represented by VGAM1 HOST TARGET PROTEIN through VGAM3 HOST TARGET PROTEIN, all of FIG. 1.

VGAM1114 RNA, herein schematically represented by VGAM1 RNA through VGAM3 RNA, binds complementarily to a host target binding site located in an untranslated region of VGAM1114 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1114 host target RNA into VGAM1114 host target protein, herein schematically represented by VGAM1 HOST TARGET PROTEIN through VGAM3 HOST TARGET PROTEIN, all of FIG. 1.

VGAM1115 RNA, herein schematically represented by VGAM1 RNA through VGAM3 RNA, binds complementarily to a host target binding site located in an untranslated region of VGAM1115 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1115 host target RNA into VGAM1115 host target protein, herein schematically represented by VGAM1 HOST TARGET PROTEIN through VGAM3 HOST TARGET PROTEIN, all of FIG. 1.

It is appreciated that a function of VGR2975 gene, herein designated VGR GENE, is inhibition of expression of host target genes, as part of a novel viral mechanism of attacking a host. Accordingly, utilities of VGR2975 gene include diagnosis, prevention and treatment of viral infection by Camelpox Virus. Specific functions, and accordingly utilities, of VGR2975 gene correlate with, and may be deduced from, the identity of the host target genes, which are inhibited by VGAM RNAs comprised in the 'operon-like' cluster of VGR2975 gene: VGAM1111 host target protein, VGAM1112 host target protein, VGAM1113 host target protein, VGAM1114 host target protein and VGAM1115 host target protein, herein schematically represented by VGAM1 HOST TARGET PROTEIN through VGAM3 HOST TARGET PROTEIN. The function of these host target genes is elaborated hereinabove with reference to VGAM1111, VGAM1112, VGAM1113, VGAM1114 and VGAM1115.

FIG. 9 further provides a conceptual description of novel bioinformatically detected regulatory viral gene, referred to here as Viral Genomic Record 2976(VGR2976) viral gene, which encodes an 'operon-like' cluster of novel viral micro RNA-like genes, each of which in turn modulates expression of at least one host target gene, the function and utility of which at least one host target gene is known in the art.

VGR2976 gene, herein designated VGR GENE, is a novel bioinformatically detected regulatory, non protein coding, RNA viral gene. The method by which VGR2976 gene was detected is described hereinabove with reference to FIGS. 1-9.

VGR2976 gene encodes VGR2976 precursor RNA, herein designated VGR PRECURSOR RNA, an RNA molecule, typically several hundred nucleotides long.

VGR2976 precursor RNA folds spatially, forming VGR2976 folded precursor RNA, herein designated VGR FOLDED PRECURSOR RNA. It is appreciated that VGR2976 folded precursor RNA comprises a plurality of what is known in the art as 'hairpin' structures. These 'hairpin' structures are due to the fact that the nucleotide sequence of VGR2976 precursor RNA comprises a plurality of segments, the first half of each such segment having a nucleotide sequence which is at least a partial inversed-reversed sequence of the second half thereof, as is well known in the art.

VGR2976 folded precursor RNA is naturally processed by cellular enzymatic activity into at least 5 separate VGAM precursor RNAs, VGAM1116 precursor RNA, VGAM1117 precursor RNA, VGAM1118 precursor RNA, VGAM1119 precursor RNA and VGAM1120 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1116 RNA, VGAM1117 RNA, VGAM1118 RNA, VGAM1119 RNA and VGAM1120 RNA, herein schematically represented by VGAM1 RNA through VGAM3 RNA, each of which VGAM RNAs corresponding to VGAM RNA of FIG. 1.

VGAM1116 RNA, herein schematically represented by VGAM1 RNA through VGAM3 RNA, binds complementarily to a host target binding site located in an untranslated region of VGAM1116 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1116 host target RNA into VGAM1116 host target protein, herein schematically represented by VGAM1 HOST TARGET PROTEIN through VGAM3 HOST TARGET PROTEIN, all of FIG. 1.

VGAM1117 RNA, herein schematically represented by VGAM1 RNA through VGAM3 RNA, binds complementarily to a host target binding site located in an untranslated region of VGAM1117 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1117 host target RNA into VGAM1117 host target protein, herein schematically represented by VGAM1 HOST TARGET PROTEIN through VGAM3 HOST TARGET PROTEIN, all of FIG. 1.

VGAM1118 RNA, herein schematically represented by VGAM1 RNA through VGAM3 RNA, binds complementarily to a host target binding site located in an untranslated region of VGAM1118 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1118 host target RNA into VGAM1118 host target protein, herein schematically represented by VGAM1 HOST TARGET PROTEIN through VGAM3 HOST TARGET PROTEIN, all of FIG. 1.

VGAM1119 RNA, herein schematically represented by VGAM1 RNA through VGAM3 RNA, binds complementarily to a host target binding site located in an untranslated region of VGAM1119 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1119 host target RNA into VGAM1119 host target protein, herein schematically represented by VGAM1 HOST TARGET PROTEIN through VGAM3 HOST TARGET PROTEIN, all of FIG. 1.

VGAM1120 RNA, herein schematically represented by VGAM1 RNA through VGAM3 RNA, binds complementarily to a host target binding site located in an untranslated region of VGAM1120 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1120 host target RNA into VGAM1120 host target protein, herein schematically represented by VGAM1 HOST TARGET PROTEIN through VGAM3 HOST TARGET PROTEIN, all of FIG. 1.

It is appreciated that a function of VGR2976 gene, herein designated VGR GENE, is inhibition of expression of host target genes, as part of a novel viral mechanism of attacking a host. Accordingly, utilities of VGR2976 gene include diagnosis, prevention and treatment of viral infection by Monkeypox Virus. Specific functions, and accordingly utilities, of VGR2976 gene correlate with, and may be deduced from, the identity of the host target genes, which are inhibited by VGAM RNAs comprised in the 'operon-like' cluster of VGR2976 gene: VGAM1116 host target protein, VGAM1117 host target protein, VGAM1118 host target protein, VGAM1119 host target protein and VGAM1120 host target protein, herein schematically represented by VGAM1 HOST TARGET PROTEIN through VGAM3 HOST TARGET PROTEIN. The function of these host target genes is elaborated hereinabove with reference to VGAM1116, VGAM1117, VGAM1118, VGAM1119 and VGAM1120.

FIG. 9 further provides a conceptual description of novel bioinformatically detected regulatory viral gene, referred to here as Viral Genomic Record 2977(VGR2977) viral gene, which encodes an 'operon-like' cluster of novel viral micro RNA-like genes, each of which in turn modulates expression of at least one host target gene, the function and utility of which at least one host target gene is known in the art.

VGR2977 gene, herein designated VGR GENE, is a novel bioinformatically detected regulatory, non protein coding, RNA viral gene. The method by which VGR2977 gene was detected is described hereinabove with reference to FIGS. 1-9.

VGR2977 gene encodes VGR2977 precursor RNA, herein designated VGR PRECURSOR RNA, an RNA molecule, typically several hundred nucleotides long.

VGR2977 precursor RNA folds spatially, forming VGR2977 folded precursor RNA, herein designated VGR FOLDED PRECURSOR RNA. It is appreciated that VGR2977 folded precursor RNA comprises a plurality of what is known in the art as 'hairpin' structures. These 'hairpin' structures are due to the fact that the nucleotide sequence of VGR2977 precursor RNA comprises a plurality of segments, the first half of each such segment having a nucleotide sequence which is at least a partial inversed-reversed sequence of the second half thereof, as is well known in the art.

VGR2977 folded precursor RNA is naturally processed by cellular enzymatic activity into at least 5 separate VGAM precursor RNAs, VGAM1121 precursor RNA, VGAM1122 precursor RNA, VGAM1123 precursor RNA, VGAM1124 precursor RNA and VGAM1125 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1121 RNA, VGAM1122 RNA, VGAM1123 RNA, VGAM1124 RNA and VGAM1125 RNA, herein schematically represented by VGAM1 RNA through VGAM3 RNA, each of which VGAM RNAs corresponding to VGAM RNA of FIG. 1.

VGAM1121 RNA, herein schematically represented by VGAM1 RNA through VGAM3 RNA, binds complementarily to a host target binding site located in an untranslated region of VGAM1121 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1121 host target RNA into VGAM1121 host target protein, herein schematically represented by VGAM1 HOST TARGET PROTEIN through VGAM3 HOST TARGET PROTEIN, all of FIG. 1.

VGAM1122 RNA, herein schematically represented by VGAM1 RNA through VGAM3 RNA, binds complementarily to a host target binding site located in an untranslated region of VGAM1122 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1122 host target RNA into VGAM1122 host target protein, herein schematically represented by VGAM1 HOST TARGET PROTEIN through VGAM3 HOST TARGET PROTEIN, all of FIG. 1.

VGAM1123 RNA, herein schematically represented by VGAM1 RNA through VGAM3 RNA, binds complementarily to a host target binding site located in an untranslated region of VGAM1123 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1123 host target RNA into VGAM1123 host target protein, herein schematically represented by VGAM1 HOST TARGET PROTEIN through VGAM3 HOST TARGET PROTEIN, all of FIG. 1.

VGAM1124 RNA, herein schematically represented by VGAM1 RNA through VGAM3 RNA, binds complementarily to a host target binding site located in an untranslated region of VGAM1124 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1124 host target RNA into VGAM1124 host target protein, herein schematically represented by VGAM1 HOST TARGET PROTEIN through VGAM3 HOST TARGET PROTEIN, all of FIG. 1.

VGAM1125 RNA, herein schematically represented by VGAM1 RNA through VGAM3 RNA, binds complementarily to a host target binding site located in an untranslated region of VGAM1125 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1125 host target RNA into VGAM1125 host target protein, herein schematically represented by VGAM1 HOST TARGET PROTEIN through VGAM3 HOST TARGET PROTEIN, all of FIG. 1.

It is appreciated that a function of VGR2977 gene, herein designated VGR GENE, is inhibition of expression of host target genes, as part of a novel viral mechanism of attacking a host. Accordingly, utilities of VGR2977 gene include diagnosis, prevention and treatment of viral infection by Saimiriine Herpesvirus 2. Specific functions, and accordingly utilities, of VGR2977 gene correlate with, and may be deduced from, the identity of the host target genes, which are inhibited by VGAM RNAs comprised in the 'operon-like' cluster of VGR2977 gene: VGAM1121 host target protein, VGAM1122 host target protein, VGAM1123 host target protein, VGAM1124 host target protein and VGAM1125 host target protein, herein schematically represented by VGAM1 HOST TARGET PROTEIN through VGAM3 HOST TARGET PROTEIN. The function of these host target genes is elaborated hereinabove with reference to VGAM1121, VGAM1122, VGAM1123, VGAM1124 and VGAM1125.

FIG. 9 further provides a conceptual description of novel bioinformatically detected regulatory viral gene, referred to here as Viral Genomic Record 2978(VGR2978) viral gene, which encodes an 'operon-like' cluster of novel viral micro RNA-like genes, each of which in turn modulates expression of at least one host target gene, the function and utility of which at least one host target gene is known in the art.

VGR2978 gene, herein designated VGR GENE, is a novel bioinformatically detected regulatory, non protein coding, RNA viral gene. The method by which VGR2978 gene was detected is described hereinabove with reference to FIGS. 1-9.

VGR2978 gene encodes VGR2978 precursor RNA, herein designated VGR PRECURSOR RNA, an RNA molecule, typically several hundred nucleotides long.

VGR2978 precursor RNA folds spatially, forming VGR2978 folded precursor RNA, herein designated VGR FOLDED PRECURSOR RNA. It is appreciated that VGR2978 folded precursor RNA comprises a plurality of what is known in the art as 'hairpin' structures. These 'hairpin' structures are due to the fact that the nucleotide sequence of VGR2978 precursor RNA comprises a plurality of segments, the first half of each such segment having a nucleotide sequence which is at least a partial inversed-reversed sequence of the second half thereof, as is well known in the art.

VGR2978 folded precursor RNA is naturally processed by cellular enzymatic activity into at least 6 separate VGAM precursor RNAs, VGAM1127 precursor RNA, VGAM1128 precursor RNA, VGAM1129 precursor RNA, VGAM1130 precursor RNA, VGAM1131 precursor RNA and VGAM1132 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1127 RNA, VGAM1128 RNA, VGAM1129 RNA, VGAM1130 RNA, VGAM1131 RNA and VGAM1132 RNA, herein schematically represented by VGAM1 RNA through VGAM3 RNA, each of which VGAM RNAs corresponding to VGAM RNA of FIG. 1.

VGAM1127 RNA, herein schematically represented by VGAM1 RNA through VGAM3 RNA, binds complementarily to a host target binding site located in an untranslated region of VGAM1127 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1127 host target RNA into VGAM1127 host target protein, herein schematically represented by VGAM1 HOST TARGET PROTEIN through VGAM3 HOST TARGET PROTEIN, all of FIG. 1.

VGAM1128 RNA, herein schematically represented by VGAM1 RNA through VGAM3 RNA, binds complementarily to a host target binding site located in an untranslated region of VGAM1128 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1128 host target RNA into VGAM1128 host target protein, herein schematically represented by VGAM1 HOST TARGET PROTEIN through VGAM3 HOST TARGET PROTEIN, all of FIG. 1.

VGAM1129 RNA, herein schematically represented by VGAM1 RNA through VGAM3 RNA, binds complementarily to a host target binding site located in an untranslated region of VGAM1129 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1129 host target RNA into VGAM1129 host target protein, herein schematically represented by VGAM1 HOST TARGET PROTEIN through VGAM3 HOST TARGET PROTEIN, all of FIG. 1.

VGAM1130 RNA, herein schematically represented by VGAM1 RNA through VGAM3 RNA, binds complementarily to a host target binding site located in an untranslated region of VGAM1130 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1130 host target RNA into VGAM1130 host target protein, herein schematically represented by VGAM1 HOST TARGET PROTEIN through VGAM3 HOST TARGET PROTEIN, all of FIG. 1.

VGAM1131 RNA, herein schematically represented by VGAM1 RNA through VGAM3 RNA, binds complementarily to a host target binding site located in an untranslated region of VGAM1131 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1131 host target RNA into VGAM1131 host target protein, herein schematically represented by VGAM1 HOST TARGET PROTEIN through VGAM3 HOST TARGET PROTEIN, all of FIG. 1.

VGAM1132 RNA, herein schematically represented by VGAM1 RNA through VGAM3 RNA, binds complementarily to a host target binding site located in an untranslated region of VGAM1132 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1132 host target RNA into VGAM1132 host target protein, herein schematically represented by VGAM1 HOST TARGET PROTEIN through VGAM3 HOST TARGET PROTEIN, all of FIG. 1.

It is appreciated that a function of VGR2978 gene, herein designated VGR GENE, is inhibition of expression of host target genes, as part of a novel viral mechanism of attacking a host. Accordingly, utilities of VGR2978 gene include diagnosis, prevention and treatment of viral infection by Barley Stripe Mosaic Virus. Specific functions, and accordingly utilities, of VGR2978 gene correlate with, and may be deduced from, the identity of the host target genes, which are inhibited by VGAM RNAs comprised in the 'operon-like' cluster of VGR2978 gene: VGAM1127 host target protein, VGAM1128 host target protein, VGAM1129 host target protein, VGAM1130 host target protein, VGAM1131 host target protein and VGAM1132 host target protein, herein schematically represented by VGAM1 HOST TARGET PROTEIN through VGAM3 HOST TARGET PROTEIN. The function of these host target genes is elaborated hereinabove with reference to VGAM1127, VGAM1128, VGAM1129, VGAM1130, VGAM1131 and VGAM1132. FIG. 9 further provides a conceptual description of novel bioinformatically detected regulatory viral gene, referred to here as Viral Genomic Record 2979(VGR2979) viral gene, which encodes an 'operon-like' cluster of novel viral micro RNA-like genes, each of which in turn modulates expression of at least one host target gene, the function and utility of which at least one host target gene is known in the art.

VGR2979 gene, herein designated VGR GENE, is a novel bioinformatically detected regulatory, non protein coding, RNA viral gene. The method by which VGR2979 gene was detected is described hereinabove with reference to FIGS. 1-9.

VGR2979 gene encodes VGR2979 precursor RNA, herein designated VGR PRECURSOR RNA, an RNA molecule, typically several hundred nucleotides long.

VGR2979 precursor RNA folds spatially, forming VGR2979 folded precursor RNA, herein designated VGR FOLDED PRECURSOR RNA. It is appreciated that VGR2979 folded precursor RNA comprises a plurality of what is known in the art as 'hairpin' structures. These 'hairpin' structures are due to the fact that the nucleotide sequence of VGR2979 precursor RNA comprises a plurality of segments, the first half of each such segment having a nucleotide sequence which is at least a partial inversed-reversed sequence of the second half thereof, as is well known in the art.

VGR2979 folded precursor RNA is naturally processed by cellular enzymatic activity into at least 3 separate VGAM precursor RNAs, VGAM1133 precursor RNA, VGAM1134 precursor RNA and VGAM1135 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1133 RNA, VGAM1134 RNA and VGAM1135 RNA, herein schematically represented by VGAM1 RNA through VGAM3 RNA, each of which VGAM RNAs corresponding to VGAM RNA of FIG. 1.

VGAM1133 RNA, herein schematically represented by VGAM1 RNA through VGAM3 RNA, binds complementarily to a host target binding site located in an untranslated region of VGAM1133 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1133 host target RNA into VGAM1133 host target protein, herein schematically represented by VGAM1 HOST TARGET PROTEIN through VGAM3 HOST TARGET PROTEIN, all of FIG. 1.

VGAM1134 RNA, herein schematically represented by VGAM1 RNA through VGAM3 RNA, binds complementarily to a host target binding site located in an untranslated region of VGAM1134 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1134 host target RNA into VGAM1134 host target protein, herein schematically represented by VGAM1 HOST TARGET PROTEIN through VGAM3 HOST TARGET PROTEIN, all of FIG. 1.

VGAM1135 RNA, herein schematically represented by VGAM1 RNA through VGAM3 RNA, binds complementarily to a host target binding site located in an untranslated region of VGAM1135 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1135 host target RNA into VGAM1135 host target protein, herein schematically represented by VGAM1 HOST TARGET PROTEIN through VGAM3 HOST TARGET PROTEIN, all of FIG. 1.

It is appreciated that a function of VGR2979 gene, herein designated VGR GENE, is inhibition of expression of host target genes, as part of a novel viral mechanism of attacking a host. Accordingly, utilities of VGR2979 gene include diagnosis, prevention and treatment of viral infection by Maize Rayado Fino Virus. Specific functions, and accordingly utilities, of VGR2979 gene correlate with, and may be deduced from, the identity of the host target genes, which are inhibited by VGAM RNAs comprised in the 'operon-like' cluster of VGR2979 gene: VGAM1133 host target protein, VGAM1134 host target protein and VGAM1135 host target protein, herein schematically represented by VGAM1 HOST TARGET PROTEIN through VGAM3 HOST TARGET PROTEIN. The function of these host target genes is elaborated hereinabove with reference to VGAM1133, VGAM1134 and VGAM1135. FIG. 9 further provides a conceptual description of novel bioinformatically detected regulatory viral gene, referred to here as Viral Genomic Record 2980(VGR2980) viral gene, which encodes an 'operon-like' cluster of novel viral micro RNA-like genes, each of which in turn modulates expression of at least one host target gene, the function and utility of which at least one host target gene is known in the art.

VGR2980 gene, herein designated VGR GENE, is a novel bioinformatically detected regulatory, non protein coding, RNA viral gene. The method by which VGR2980 gene was detected is described hereinabove with reference to FIGS. 1-9.

VGR2980 gene encodes VGR2980 precursor RNA, herein designated VGR PRECURSOR RNA, an RNA molecule, typically several hundred nucleotides long.

VGR2980 precursor RNA folds spatially, forming VGR2980 folded precursor RNA, herein designated VGR FOLDED PRECURSOR RNA. It is appreciated that VGR2980 folded precursor RNA comprises a plurality of what is known in the art as 'hairpin' structures. These 'hairpin' structures are due to the fact that the nucleotide sequence of VGR2980 precursor RNA comprises a plurality of segments, the first half of each such segment having a nucleotide sequence which is at least a partial inversed-reversed sequence of the second half thereof, as is well known in the art.

VGR2980 folded precursor RNA is naturally processed by cellular enzymatic activity into at least 3 separate VGAM precursor RNAs, VGAM1136 precursor RNA, VGAM1137 precursor RNA and VGAM1138 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1136 RNA, VGAM1137 RNA and VGAM1138 RNA, herein schematically represented by VGAM1 RNA through VGAM3 RNA, each of which VGAM RNAs corresponding to VGAM RNA of FIG. 1.

VGAM1136 RNA, herein schematically represented by VGAM1 RNA through VGAM3 RNA, binds complementarily to a host target binding site located in an untranslated region of VGAM1136 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1136 host target RNA into VGAM1136 host target protein, herein schematically represented by VGAM1 HOST TARGET PROTEIN through VGAM3 HOST TARGET PROTEIN, all of FIG. 1.

VGAM1137 RNA, herein schematically represented by VGAM1 RNA through VGAM3 RNA, binds complementarily to a host target binding site located in an untranslated region of VGAM1137 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1137 host target RNA into VGAM1137 host target protein, herein schematically represented by VGAM1 HOST TARGET PROTEIN through VGAM3 HOST TARGET PROTEIN, all of FIG. 1.

VGAM1138 RNA, herein schematically represented by VGAM1 RNA through VGAM3 RNA, binds complementarily to a host target binding site located in an untranslated region of VGAM1138 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1138 host target RNA into VGAM1138 host target protein, herein schematically represented by VGAM1 HOST TARGET PROTEIN through VGAM3 HOST TARGET PROTEIN, all of FIG. 1.

It is appreciated that a function of VGR2980 gene, herein designated VGR GENE, is inhibition of expression of host target genes, as part of a novel viral mechanism of attacking a host. Accordingly, utilities of VGR2980 gene include diagnosis, prevention and treatment of viral infection by Beet Mild Yellowing Virus. Specific functions, and accordingly utilities, of VGR2980 gene correlate with, and may be deduced from, the identity of the host target genes, which are inhibited by VGAM RNAs comprised in the 'operon-like' cluster of VGR2980 gene: VGAM1136 host target protein, VGAM1137 host target protein and VGAM1138 host target protein, herein schematically represented by VGAM1 HOST TARGET PROTEIN through VGAM3 HOST TARGET PROTEIN. The function of these host target genes is elaborated hereinabove with reference to VGAM1136, VGAM1137 and VGAM1138. FIG. 9 further provides a conceptual description of novel bioinformatically detected regulatory viral gene, referred to here as Viral Genomic Record 2981(VGR2981) viral gene, which encodes an 'operon-like' cluster of novel viral micro RNA-like genes, each of which in turn modulates expression of at least one host target gene, the function and utility of which at least one host target gene is known in the art.

VGR2981 gene, herein designated VGR GENE, is a novel bioinformatically detected regulatory, non protein coding, RNA viral gene. The method by which VGR2981 gene was detected is described hereinabove with reference to FIGS. 1-9.

VGR2981 gene encodes VGR2981 precursor RNA, herein designated VGR PRECURSOR RNA, an RNA molecule, typically several hundred nucleotides long.

VGR2981 precursor RNA folds spatially, forming VGR2981 folded precursor RNA, herein designated VGR FOLDED PRECURSOR RNA. It is appreciated that VGR2981 folded precursor RNA comprises a plurality of what is known in the art as 'hairpin' structures. These 'hairpin' structures are due to the fact that the nucleotide sequence of VGR2981 precursor RNA comprises a plurality of segments, the first half of each such segment having a nucleotide sequence which is at least a partial inversed-reversed sequence of the second half thereof, as is well known in the art.

VGR2981 folded precursor RNA is naturally processed by cellular enzymatic activity into at least 3 separate VGAM precursor RNAs, VGAM1139 precursor RNA, VGAM1140 precursor RNA and VGAM1141 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1139 RNA, VGAM1140 RNA and VGAM1141 RNA, herein schematically represented by VGAM1 RNA through VGAM3 RNA, each of which VGAM RNAs corresponding to VGAM RNA of FIG. 1.

VGAM1139 RNA, herein schematically represented by VGAM1 RNA through VGAM3 RNA, binds complementarily to a host target binding site located in an untranslated region of VGAM1139 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1139 host target RNA into VGAM1139 host target protein, herein schematically represented by VGAM1 HOST TARGET PROTEIN through VGAM3 HOST TARGET PROTEIN, all of FIG. 1.

VGAM1140 RNA, herein schematically represented by VGAM1 RNA through VGAM3 RNA, binds complementarily to a host target binding site located in an untranslated region of VGAM1140 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1140 host target RNA into VGAM1140 host target protein, herein schematically represented by VGAM1 HOST TARGET PROTEIN through VGAM3 HOST TARGET PROTEIN, all of FIG. 1.

VGAM1141 RNA, herein schematically represented by VGAM1 RNA through VGAM3 RNA, binds complementarily to a host target binding site located in an untranslated region of VGAM1141 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1141 host target RNA into VGAM1141 host target protein, herein schematically represented by VGAM1 HOST TARGET PROTEIN through VGAM3 HOST TARGET PROTEIN, all of FIG. 1.

It is appreciated that a function of VGR2981 gene, herein designated VGR GENE, is inhibition of expression of host target genes, as part of a novel viral mechanism of attacking a host. Accordingly, utilities of VGR2981 gene include diagnosis, prevention and treatment of viral infection by Chayote Mosaic Tymovirus. Specific functions, and accordingly utilities, of VGR2981 gene correlate with, and may be deduced from, the identity of the host target genes, which are inhibited by VGAM RNAs comprised in the 'operon-like' cluster of VGR2981 gene: VGAM1139 host target protein, VGAM1140 host target protein and VGAM1141 host target protein, herein schematically represented by VGAM1 HOST TARGET PROTEIN through VGAM3 HOST TARGET PROTEIN. The function of these host target genes is elaborated hereinabove with reference to VGAM1139, VGAM1140 and VGAM1141. FIG. 9 further provides a conceptual description of novel bioinformatically detected regulatory viral gene, referred to here as Viral Genomic Record 2982(VGR2982) viral gene, which encodes an 'operon-like' cluster of novel viral micro RNA-like genes, each of which in turn modulates expression of at least one host target gene, the function and utility of which at least one host target gene is known in the art.

VGR2982 gene, herein designated VGR GENE, is a novel bioinformatically detected regulatory, non protein coding, RNA viral gene. The method by which VGR2982 gene was detected is described hereinabove with reference to FIGS. 1-9.

VGR2982 gene encodes VGR2982 precursor RNA, herein designated VGR PRECURSOR RNA, an RNA molecule, typically several hundred nucleotides long.

VGR2982 precursor RNA folds spatially, forming VGR2982 folded precursor RNA, herein designated VGR FOLDED PRECURSOR RNA. It is appreciated that VGR2982 folded precursor RNA comprises a plurality of what is known in the art as 'hairpin' structures. These 'hairpin' structures are due to the fact that the nucleotide sequence of VGR2982 precursor RNA comprises a plurality of segments, the first half of each such segment having a nucleotide sequence which is at least a partial inversed-reversed sequence of the second half thereof, as is well known in the art.

VGR2982 folded precursor RNA is naturally processed by cellular enzymatic activity into at least 4 separate VGAM precursor RNAs, VGAM1142 precursor RNA, VGAM1143 precursor RNA, VGAM1144 precursor RNA and VGAM1145 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1142 RNA, VGAM1143 RNA, VGAM1144 RNA and VGAM1145 RNA, herein schematically represented by VGAM1 RNA through VGAM3 RNA, each of which VGAM RNAs corresponding to VGAM RNA of FIG. 1.

VGAM1142 RNA, herein schematically represented by VGAM1 RNA through VGAM3 RNA, binds complementarily to a host target binding site located in an untranslated region of VGAM1142 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1142 host target RNA into VGAM1142 host target protein, herein schematically represented by VGAM1 HOST TARGET PROTEIN through VGAM3 HOST TARGET PROTEIN, all of FIG. 1.

VGAM1143 RNA, herein schematically represented by VGAM1 RNA through VGAM3 RNA, binds complementarily to a host target binding site located in an untranslated region of VGAM1143 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1143 host target RNA into VGAM1143 host target protein, herein schematically represented by VGAM1 HOST TARGET PROTEIN through VGAM3 HOST TARGET PROTEIN, all of FIG. 1.

VGAM1144 RNA, herein schematically represented by VGAM1 RNA through VGAM3 RNA, binds complementarily to a host target binding site located in an untranslated region of VGAM1144 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1144 host target RNA into VGAM1144 host target protein, herein schematically represented by VGAM1 HOST TARGET PROTEIN through VGAM3 HOST TARGET PROTEIN, all of FIG. 1.

VGAM1145 RNA, herein schematically represented by VGAM1 RNA through VGAM3 RNA, binds complementarily to a host target binding site located in an untranslated region of VGAM1145 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1145 host target RNA into VGAM1145 host target protein, herein schematically represented by VGAM1 HOST TARGET PROTEIN through VGAM3 HOST TARGET PROTEIN, all of FIG. 1.

It is appreciated that a function of VGR2982 gene, herein designated VGR GENE, is inhibition of expression of host target genes, as part of a novel viral mechanism of attacking a host. Accordingly, utilities of VGR2982 gene include diagnosis, prevention and treatment of viral infection by Bamboo Mosaic Virus. Specific functions, and accordingly utilities, of VGR2982 gene correlate with, and may be deduced from, the identity of the host target genes, which are inhibited by VGAM RNAs comprised in the 'operon-like' cluster of VGR2982 gene: VGAM1142 host target protein, VGAM1143 host target protein, VGAM1144 host target protein and VGAM1145 host target protein, herein schematically represented by VGAM1 HOST TARGET PROTEIN through VGAM3 HOST TARGET PROTEIN. The function of these host target genes is elaborated hereinabove with reference to VGAM1142, VGAM1143, VGAM1144 and VGAM1145.

FIG. 9 further provides a conceptual description of novel bioinformatically detected regulatory viral gene, referred to here as Viral Genomic Record 2983(VGR2983) viral gene, which encodes an 'operon-like' cluster of novel viral micro RNA-like genes, each of which in turn modulates expression of at least one host target gene, the function and utility of which at least one host target gene is known in the art.

VGR2983 gene, herein designated VGR GENE, is a novel bioinformatically detected regulatory, non protein coding, RNA viral gene. The method by which VGR2983 gene was detected is described hereinabove with reference to FIGS. 1-9.

VGR2983 gene encodes VGR2983 precursor RNA, herein designated VGR PRECURSOR RNA, an RNA molecule, typically several hundred nucleotides long.

VGR2983 precursor RNA folds spatially, forming VGR2983 folded precursor RNA, herein designated VGR FOLDED PRECURSOR RNA. It is appreciated that VGR2983 folded precursor RNA comprises a plurality of what is known in the art as 'hairpin' structures. These 'hairpin' structures are due to the fact that the nucleotide sequence of VGR2983 precursor RNA comprises a plurality of segments, the first half of each such segment having a nucleotide sequence which is at least a partial inversed-reversed sequence of the second half thereof, as is well known in the art.

VGR2983 folded precursor RNA is naturally processed by cellular enzymatic activity into at least 2 separate VGAM precursor RNAs, VGAM1146 precursor RNA and VGAM1147 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1146 RNA and VGAM1147 RNA, herein schematically represented by VGAM1 RNA through VGAM3 RNA, each of which VGAM RNAs corresponding to VGAM RNA of FIG. 1.

VGAM1146 RNA, herein schematically represented by VGAM1 RNA through VGAM3 RNA, binds complementarily to a host target binding site located in an untranslated region of VGAM1146 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1146 host target RNA into VGAM1146 host target protein, herein schematically represented by VGAM1 HOST TARGET PROTEIN through VGAM3 HOST TARGET PROTEIN, all of FIG. 1.

VGAM1147 RNA, herein schematically represented by VGAM1 RNA through VGAM3 RNA, binds complementarily to a host target binding site located in an untranslated region of VGAM1147 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1147 host target RNA into VGAM1147 host target protein, herein schematically represented by VGAM1 HOST TARGET PROTEIN through VGAM3 HOST TARGET PROTEIN, all of FIG. 1.

It is appreciated that a function of VGR2983 gene, herein designated VGR GENE, is inhibition of expression of host target genes, as part of a novel viral mechanism of attacking a host. Accordingly, utilities of VGR2983 gene include diagnosis, prevention and treatment of viral infection by Fowlpox Virus. Specific functions, and accordingly utilities, of VGR2983 gene correlate with, and may be deduced from, the identity of the host target genes, which are inhibited by VGAM RNAs comprised in the 'operon-like' cluster of VGR2983 gene: VGAM1146 host target protein and VGAM1147 host target protein, herein schematically represented by VGAM1 HOST TARGET PROTEIN through VGAM3 HOST TARGET PROTEIN. The function of these host target genes is elaborated hereinabove with reference to VGAM1146 and VGAM1147. FIG. 9 further provides a conceptual description of novel bioinformatically detected regulatory viral gene, referred to here as Viral Genomic Record 2984(VGR2984) viral gene, which encodes an 'operon-like' cluster of novel viral micro RNA-like genes, each of which in turn modulates expression of at least one host target gene, the function and utility of which at least one host target gene is known in the art.

VGR2984 gene, herein designated VGR GENE, is a novel bioinformatically detected regulatory, non protein coding, RNA viral gene. The method by which VGR2984 gene was detected is described hereinabove with reference to FIGS. 1-9.

VGR2984 gene encodes VGR2984 precursor RNA, herein designated VGR PRECURSOR RNA, an RNA molecule, typically several hundred nucleotides long.

VGR2984 precursor RNA folds spatially, forming VGR2984 folded precursor RNA, herein designated VGR FOLDED PRECURSOR RNA. It is appreciated that VGR2984 folded precursor RNA comprises a plurality of what is known in the art as 'hairpin' structures. These 'hairpin' structures are due to the fact that the nucleotide sequence of VGR2984 precursor RNA comprises a plurality of segments, the first half of each such segment having a nucleotide sequence which is at least a partial inversed-reversed sequence of the second half thereof, as is well known in the art.

VGR2984 folded precursor RNA is naturally processed by cellular enzymatic activity into at least 3 separate VGAM precursor RNAs, VGAM1148 precursor RNA, VGAM1149 precursor RNA and VGAM1150 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1148 RNA, VGAM1149 RNA and VGAM1150 RNA, herein schematically represented by VGAM1 RNA through VGAM3 RNA, each of which VGAM RNAs corresponding to VGAM RNA of FIG. 1.

VGAM1148 RNA, herein schematically represented by VGAM1 RNA through VGAM3 RNA, binds complementarily to a host target binding site located in an untranslated region of VGAM1148 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1148 host target RNA into VGAM1148 host target protein, herein schematically represented by VGAM1 HOST TARGET PROTEIN through VGAM3 HOST TARGET PROTEIN, all of FIG. 1.

VGAM1149 RNA, herein schematically represented by VGAM1 RNA through VGAM3 RNA, binds complementarily to a host target binding site located in an untranslated region of VGAM1149 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1149 host target RNA into VGAM1149 host target protein, herein schematically represented by VGAM1 HOST TARGET PROTEIN through VGAM3 HOST TARGET PROTEIN, all of FIG. 1.

VGAM1150 RNA, herein schematically represented by VGAM1 RNA through VGAM3 RNA, binds complementarily to a host target binding site located in an untranslated region of VGAM1150 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1150 host target RNA into VGAM1150 host target protein, herein schematically represented by VGAM1 HOST TARGET PROTEIN through VGAM3 HOST TARGET PROTEIN, all of FIG. 1.

It is appreciated that a function of VGR2984 gene, herein designated VGR GENE, is inhibition of expression of host target genes, as part of a novel viral mechanism of attacking a host. Accordingly, utilities of VGR2984 gene include diagnosis, prevention and treatment of viral infection by Cercopithecine Herpesvirus 7. Specific functions, and accordingly utilities, of VGR2984 gene correlate with, and may be deduced from, the identity of the host target genes, which are inhibited by VGAM RNAs comprised in the 'operon-like' cluster of VGR2984 gene: VGAM1148 host target protein, VGAM1149 host target protein and VGAM1150 host target protein, herein schematically represented by VGAM1 HOST TARGET PROTEIN through VGAM3 HOST TARGET PROTEIN. The function of these host target genes is elaborated hereinabove with reference to VGAM1148, VGAM1149 and VGAM1150. FIG. 9 further provides a conceptual description of novel bioinformatically detected regulatory viral gene, referred to here as Viral Genomic Record 2985(VGR2985) viral gene, which encodes an 'operon-like' cluster of novel viral micro RNA-like genes, each of which in turn modulates expression of at least one host target gene, the function and utility of which at least one host target gene is known in the art.

VGR2985 gene, herein designated VGR GENE, is a novel bioinformatically detected regulatory, non protein coding, RNA viral gene. The method by which VGR2985 gene was detected is described hereinabove with reference to FIGS. 1-9.

VGR2985 gene encodes VGR2985 precursor RNA, herein designated VGR PRECURSOR RNA, an RNA molecule, typically several hundred nucleotides long.

VGR2985 precursor RNA folds spatially, forming VGR2985 folded precursor RNA, herein designated VGR FOLDED PRECURSOR RNA. It is appreciated that VGR2985 folded precursor RNA comprises a plurality of what is known in the art as 'hairpin' structures. These 'hairpin' structures are due to the fact that the nucleotide sequence of VGR2985 precursor RNA comprises a plurality of segments, the first half of each such segment having a nucleotide sequence which is at least a partial inversed-reversed sequence of the second half thereof, as is well known in the art.

VGR2985 folded precursor RNA is naturally processed by cellular enzymatic activity into at least 4 separate VGAM precursor RNAs, VGAM1151 precursor RNA, VGAM1152 precursor RNA, VGAM1153 precursor RNA and VGAM1154 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1151 RNA, VGAM1152 RNA, VGAM1153 RNA and VGAM1154 RNA, herein schematically represented by VGAM1 RNA through VGAM3 RNA, each of which VGAM RNAs corresponding to VGAM RNA of FIG. 1.

VGAM1151 RNA, herein schematically represented by VGAM1 RNA through VGAM3 RNA, binds complementarily to a host target binding site located in an untranslated region of VGAM1151 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1151 host target RNA into VGAM1151 host target protein, herein schematically represented by VGAM1 HOST TARGET PROTEIN through VGAM3 HOST TARGET PROTEIN, all of FIG. 1.

VGAM1152 RNA, herein schematically represented by VGAM1 RNA through VGAM3 RNA, binds complementarily to a host target binding site located in an untranslated region of VGAM1152 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1152 host target RNA into VGAM1152 host target protein, herein schematically represented by VGAM1 HOST TARGET PROTEIN through VGAM3 HOST TARGET PROTEIN, all of FIG. 1.

VGAM1153 RNA, herein schematically represented by VGAM1 RNA through VGAM3 RNA, binds complementarily to a host target binding site located in an untranslated region of VGAM1153 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1153 host target RNA into VGAM1153 host target protein, herein schematically represented by VGAM1 HOST TARGET PROTEIN through VGAM3 HOST TARGET PROTEIN, all of FIG. 1.

VGAM1154 RNA, herein schematically represented by VGAM1 RNA through VGAM3 RNA, binds complementarily to a host target binding site located in an untranslated region of VGAM1154 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1154 host target RNA into VGAM1154 host target protein, herein schematically represented by VGAM1 HOST TARGET PROTEIN through VGAM3 HOST TARGET PROTEIN, all of FIG. 1.

It is appreciated that a function of VGR2985 gene, herein designated VGR GENE, is inhibition of expression of host target genes, as part of a novel viral mechanism of attacking a host. Accordingly, utilities of VGR2985 gene include diagnosis, prevention and treatment of viral infection by Cowpox Virus. Specific functions, and accordingly utilities, of VGR2985 gene correlate with, and may be deduced from, the identity of the host target genes, which are inhibited by VGAM RNAs comprised in the 'operon-like' cluster of VGR2985 gene: VGAM1151 host target protein, VGAM1152 host target protein, VGAM1153 host target protein and VGAM1154 host target protein, herein schematically represented by VGAM1 HOST TARGET PROTEIN through VGAM3 HOST TARGET PROTEIN. The function of these host target genes is elaborated hereinabove with reference to VGAM1151, VGAM1152, VGAM1153 and VGAM1154. FIG. 9 further provides a conceptual description of novel bioinformatically detected regulatory viral gene, referred to here as Viral Genomic Record 2986(VGR2986) viral gene, which encodes an 'operon-like' cluster of novel viral micro RNA-like genes, each of which in turn modulates expression of at least one host target gene, the function and utility of which at least one host target gene is known in the art.

VGR2986 gene, herein designated VGR GENE, is a novel bioinformatically detected regulatory, non protein coding, RNA viral gene. The method by which VGR2986 gene was detected is described hereinabove with reference to FIGS. 1-9.

VGR2986 gene encodes VGR2986 precursor RNA, herein designated VGR PRECURSOR RNA, an RNA molecule, typically several hundred nucleotides long.

VGR2986 precursor RNA folds spatially, forming VGR2986 folded precursor RNA, herein designated VGR FOLDED PRECURSOR RNA. It is appreciated that VGR2986 folded precursor RNA comprises a plurality of what is known in the art as 'hairpin' structures. These 'hairpin' structures are due to the fact that the nucleotide sequence of VGR2986 precursor RNA comprises a plurality of segments, the first half of each such segment having a nucleotide sequence which is at least a partial inversed-reversed sequence of the second half thereof, as is well known in the art.

VGR2986 folded precursor RNA is naturally processed by cellular enzymatic activity into at least 3 separate VGAM precursor RNAs, VGAM1155 precursor RNA, VGAM1156 precursor RNA and VGAM1157 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1155 RNA, VGAM1156 RNA and VGAM1157 RNA, herein schematically represented by VGAM1 RNA through VGAM3 RNA, each of which VGAM RNAs corresponding to VGAM RNA of FIG. 1.

VGAM1155 RNA, herein schematically represented by VGAM1 RNA through VGAM3 RNA, binds complementarily to a host target binding site located in an untranslated region of VGAM1155 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1155 host target RNA into VGAM1155 host target protein, herein schematically represented by VGAM1 HOST TARGET PROTEIN through VGAM3 HOST TARGET PROTEIN, all of FIG. 1.

VGAM1156 RNA, herein schematically represented by VGAM1 RNA through VGAM3 RNA, binds complementarily to a host target binding site located in an untranslated region of VGAM1156 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1156 host target RNA into VGAM1156 host target protein, herein schematically represented by VGAM1 HOST TARGET PROTEIN through VGAM3 HOST TARGET PROTEIN, all of FIG. 1.

VGAM1157 RNA, herein schematically represented by VGAM1 RNA through VGAM3 RNA, binds complementarily to a host target binding site located in an untranslated region of VGAM1157 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1157 host target RNA into VGAM1157 host target protein, herein schematically represented by VGAM1 HOST TARGET PROTEIN through VGAM3 HOST TARGET PROTEIN, all of FIG. 1.

It is appreciated that a function of VGR2986 gene, herein designated VGR GENE, is inhibition of expression of host target genes, as part of a novel viral mechanism of attacking a host. Accordingly, utilities of VGR2986 gene include diagnosis, prevention and treatment of viral infection by Cowpox Virus. Specific functions, and accordingly utilities, of VGR2986 gene correlate with, and may be deduced from, the identity of the host target genes, which are inhibited by VGAM RNAs comprised in the 'operon-like' cluster of VGR2986 gene: VGAM1155 host target protein, VGAM1156 host target protein and VGAM1157 host target protein, herein schematically represented by VGAM1 HOST TARGET PROTEIN through VGAM3 HOST TARGET PROTEIN. The function of these host target genes is elaborated hereinabove with reference to VGAM1155, VGAM1156 and VGAM1157. FIG. 9 further provides a conceptual description of novel bioinformatically detected regulatory viral gene, referred to here as Viral Genomic Record 2987(VGR2987) viral gene, which encodes an 'operon-like' cluster of novel viral micro RNA-like genes, each of which in turn modulates expression of at least one host target gene, the function and utility of which at least one host target gene is known in the art.

VGR2987 gene, herein designated VGR GENE, is a novel bioinformatically detected regulatory, non protein coding, RNA viral gene. The method by which VGR2987 gene was detected is described hereinabove with reference to FIGS. 1-9.

VGR2987 gene encodes VGR2987 precursor RNA, herein designated VGR PRECURSOR RNA, an RNA molecule, typically several hundred nucleotides long.

VGR2987 precursor RNA folds spatially, forming VGR2987 folded precursor RNA, herein designated VGR FOLDED PRECURSOR RNA. It is appreciated that VGR2987 folded precursor RNA comprises a plurality of what is known in the art as 'hairpin' structures. These 'hairpin' structures are due to the fact that the nucleotide sequence of VGR2987 precursor RNA comprises a plurality of segments, the first half of each such segment having a nucleotide sequence which is at least a partial inversed-reversed sequence of the second half thereof, as is well known in the art.

VGR2987 folded precursor RNA is naturally processed by cellular enzymatic activity into at least 3 separate VGAM precursor RNAs, VGAM1159 precursor RNA, VGAM1160 precursor RNA and VGAM1161 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1159 RNA, VGAM1160 RNA and VGAM1161 RNA, herein schematically represented by VGAM1 RNA through VGAM3 RNA, each of which VGAM RNAs corresponding to VGAM RNA of FIG. 1.

VGAM1159 RNA, herein schematically represented by VGAM1 RNA through VGAM3 RNA, binds complementarily to a host target binding site located in an untranslated region of VGAM1159 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1159 host target RNA into VGAM1159 host target protein, herein schematically represented by VGAM1 HOST TARGET PROTEIN through VGAM3 HOST TARGET PROTEIN, all of FIG. 1.

VGAM1160 RNA, herein schematically represented by VGAM1 RNA through VGAM3 RNA, binds complementarily to a host target binding site located in an untranslated region of VGAM1160 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1160 host target RNA into VGAM1160 host target protein, herein schematically represented by VGAM1 HOST TARGET PROTEIN through VGAM3 HOST TARGET PROTEIN, all of FIG. 1.

VGAM1161 RNA, herein schematically represented by VGAM1 RNA through VGAM3 RNA, binds complementarily to a host target binding site located in an untranslated region of VGAM1161 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1161 host target RNA into VGAM1161 host target protein, herein schematically represented by VGAM1 HOST TARGET PROTEIN through VGAM3 HOST TARGET PROTEIN, all of FIG. 1.

It is appreciated that a function of VGR2987 gene, herein designated VGR GENE, is inhibition of expression of host target genes, as part of a novel viral mechanism of attacking a host. Accordingly, utilities of VGR2987 gene include diagnosis, prevention and treatment of viral infection by Meleagrid Herpesvirus 1. Specific functions, and accordingly utilities, of VGR2987 gene correlate with, and may be deduced from, the identity of the host target genes, which are inhibited by VGAM RNAs comprised in the 'operon-like' cluster of VGR2987 gene: VGAM1159 host target protein, VGAM1160 host target protein and VGAM1161 host target protein, herein schematically represented by VGAM1 HOST TARGET PROTEIN through VGAM3 HOST TARGET PROTEIN. The function of these host target genes is elaborated hereinabove with reference to VGAM1159, VGAM1160 and VGAM1161. FIG. 9 further provides a conceptual description of novel bioinformatically detected regulatory viral gene, referred to here as Viral Genomic Record 2988(VGR2988) viral gene, which encodes an 'operon-like' cluster of novel viral micro RNA-like genes, each of which in turn modulates expression of at least one host target gene, the function and utility of which at least one host target gene is known in the art.

VGR2988 gene, herein designated VGR GENE, is a novel bioinformatically detected regulatory, non protein coding, RNA viral gene. The method by which VGR2988 gene was detected is described hereinabove with reference to FIGS. 1-9.

VGR2988 gene encodes VGR2988 precursor RNA, herein designated VGR PRECURSOR RNA, an RNA molecule, typically several hundred nucleotides long.

VGR2988 precursor RNA folds spatially, forming VGR2988 folded precursor RNA, herein designated VGR FOLDED PRECURSOR RNA. It is appreciated that VGR2988 folded precursor RNA comprises a plurality of what is known in the art as 'hairpin' structures. These 'hairpin' structures are due to the fact that the nucleotide sequence of VGR2988 precursor RNA comprises a plurality of segments, the first half of each such segment having a nucleotide sequence which is at least a partial inversed-reversed sequence of the second half thereof, as is well known in the art.

VGR2988 folded precursor RNA is naturally processed by cellular enzymatic activity into at least 4 separate VGAM precursor RNAs, VGAM1162 precursor RNA, VGAM1163 precursor RNA, VGAM1164 precursor RNA and VGAM1165 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1162 RNA, VGAM1163 RNA, VGAM1164 RNA and VGAM1165 RNA, herein schematically represented by VGAM1 RNA through VGAM3 RNA, each of which VGAM RNAs corresponding to VGAM RNA of FIG. 1.

VGAM1162 RNA, herein schematically represented by VGAM1 RNA through VGAM3 RNA, binds complementarily to a host target binding site located in an untranslated region of VGAM1162 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1162 host target RNA into VGAM1162 host target protein, herein schematically represented by VGAM1 HOST TARGET PROTEIN through VGAM3 HOST TARGET PROTEIN, all of FIG. 1.

VGAM1163 RNA, herein schematically represented by VGAM1 RNA through VGAM3 RNA, binds complementarily to a host target binding site located in an untranslated region of VGAM1163 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1163 host target RNA into VGAM1163 host target protein, herein schematically represented by VGAM1 HOST TARGET PROTEIN through VGAM3 HOST TARGET PROTEIN, all of FIG. 1.

VGAM1164 RNA, herein schematically represented by VGAM1 RNA through VGAM3 RNA, binds complementarily to a host target binding site located in an untranslated region of VGAM1164 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1164 host target RNA into VGAM1164 host target protein, herein schematically represented by VGAM1 HOST TARGET PROTEIN through VGAM3 HOST TARGET PROTEIN, all of FIG. 1.

VGAM1165 RNA, herein schematically represented by VGAM1 RNA through VGAM3 RNA, binds complementarily to a host target binding site located in an untranslated region of VGAM1165 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1165 host target RNA into VGAM1165 host target protein, herein schematically represented by VGAM1 HOST TARGET PROTEIN through VGAM3 HOST TARGET PROTEIN, all of FIG. 1.

It is appreciated that a function of VGR2988 gene, herein designated VGR GENE, is inhibition of expression of host target genes, as part of a novel viral mechanism of attacking a host. Accordingly, utilities of VGR2988 gene include diagnosis, prevention and treatment of viral infection by Ectromelia Virus. Specific functions, and accordingly utilities, of VGR2988 gene correlate with, and may be deduced from, the identity of the host target genes, which are inhibited by VGAM RNAs comprised in the 'operon-like' cluster of VGR2988 gene: VGAM1162 host target protein, VGAM1163 host target protein, VGAM1164 host target protein and VGAM1165 host target protein, herein schematically represented by VGAM1 HOST TARGET PROTEIN through VGAM3 HOST TARGET PROTEIN. The function of these host target genes is elaborated hereinabove with reference to VGAM1162, VGAM1163, VGAM1164 and VGAM1165. FIG. 9 further provides a conceptual description of novel bioinformatically detected regulatory viral gene, referred to here as Viral Genomic Record 2989(VGR2989) viral gene, which encodes an 'operon-like' cluster of novel viral micro RNA-like genes, each of which in turn modulates expression of at least one host target gene, the function and utility of which at least one host target gene is known in the art.

VGR2989 gene, herein designated VGR GENE, is a novel bioinformatically detected regulatory, non protein coding, RNA viral gene. The method by which VGR2989 gene was detected is described hereinabove with reference to FIGS. 1-9.

VGR2989 gene encodes VGR2989 precursor RNA, herein designated VGR PRECURSOR RNA, an RNA molecule, typically several hundred nucleotides long.

VGR2989 precursor RNA folds spatially, forming VGR2989 folded precursor RNA, herein designated VGR FOLDED PRECURSOR RNA. It is appreciated that VGR2989 folded precursor RNA comprises a plurality of what is known in the art as 'hairpin' structures. These 'hairpin' structures are due to the fact that the nucleotide sequence of VGR2989 precursor RNA comprises a plurality of segments, the first half of each such segment having a nucleotide sequence which is at least a partial inversed-reversed sequence of the second half thereof, as is well known in the art.

VGR2989 folded precursor RNA is naturally processed by cellular enzymatic activity into at least 2 separate VGAM precursor RNAs, VGAM1166 precursor RNA and VGAM1167 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1166 RNA and VGAM1167 RNA, herein schematically represented by VGAM1 RNA through VGAM3 RNA, each of which VGAM RNAs corresponding to VGAM RNA of FIG. 1.

VGAM1166 RNA, herein schematically represented by VGAM1 RNA through VGAM3 RNA, binds complementarily to a host target binding site located in an untranslated region of VGAM1166 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1166 host target RNA into VGAM1166 host target protein, herein schematically represented by VGAM1 HOST TARGET PROTEIN through VGAM3 HOST TARGET PROTEIN, all of FIG. 1.

VGAM1167 RNA, herein schematically represented by VGAM1 RNA through VGAM3 RNA, binds complementarily to a host target binding site located in an untranslated region of VGAM1167 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1167 host target RNA into VGAM1167 host target protein, herein schematically represented by VGAM1 HOST TARGET PROTEIN through VGAM3 HOST TARGET PROTEIN, all of FIG. 1.

It is appreciated that a function of VGR2989 gene, herein designated VGR GENE, is inhibition of expression of host target genes, as part of a novel viral mechanism of attacking a host. Accordingly, utilities of VGR2989 gene include diagnosis, prevention and treatment of viral infection by Cucumber Green Mottle Mosaic Virus. Specific functions, and accordingly utilities, of VGR2989 gene correlate with, and may be deduced from, the identity of the host target genes, which are inhibited by VGAM RNAs comprised in the 'operon-like' cluster of VGR2989 gene: VGAM1166 host target protein and VGAM1167 host target protein, herein schematically represented by VGAM1 HOST TARGET PROTEIN through VGAM3 HOST TARGET PROTEIN. The function of these host target genes is elaborated hereinabove with reference to VGAM1166 and VGAM1167. FIG. 9 further provides a conceptual description of novel bioinformatically detected regulatory viral gene, referred to here as Viral Genomic Record 2990(VGR2990) viral gene, which encodes an 'operon-like' cluster of novel viral micro RNA-like genes, each of which in turn modulates expression of at least one host target gene, the function and utility of which at least one host target gene is known in the art.

VGR2990 gene, herein designated VGR GENE, is a novel bioinformatically detected regulatory, non protein coding, RNA viral gene. The method by which VGR2990 gene was detected is described hereinabove with reference to FIGS. 1-9.

VGR2990 gene encodes VGR2990 precursor RNA, herein designated VGR PRECURSOR RNA, an RNA molecule, typically several hundred nucleotides long.

VGR2990 precursor RNA folds spatially, forming VGR2990 folded precursor RNA, herein designated VGR FOLDED PRECURSOR RNA. It is appreciated that VGR2990 folded precursor RNA comprises a plurality of what is known in the art as 'hairpin' structures. These 'hairpin' structures are due to the fact that the nucleotide sequence of VGR2990 precursor RNA comprises a plurality of segments, the first half of each such segment having a nucleotide sequence which is at least a partial inversed-reversed sequence of the second half thereof, as is well known in the art.

VGR2990 folded precursor RNA is naturally processed by cellular enzymatic activity into at least 2 separate VGAM precursor RNAs, VGAM1168 precursor RNA and VGAM1169 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1168 RNA and VGAM1169 RNA, herein schematically represented by VGAM1 RNA through VGAM3 RNA, each of which VGAM RNAs corresponding to VGAM RNA of FIG. 1.

VGAM1168 RNA, herein schematically represented by VGAM1 RNA through VGAM3 RNA, binds complementarily to a host target binding site located in an untranslated region of VGAM1168 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1168 host target RNA into VGAM1168 host target protein, herein schematically represented by VGAM1 HOST TARGET PROTEIN through VGAM3 HOST TARGET PROTEIN, all of FIG. 1.

VGAM1169 RNA, herein schematically represented by VGAM1 RNA through VGAM3 RNA, binds complementarily to a host target binding site located in an untranslated region of VGAM1169 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM1169 host target RNA into VGAM1169 host target protein, herein schematically represented by VGAM1 HOST TARGET PROTEIN through VGAM3 HOST TARGET PROTEIN, all of FIG. 1.

It is appreciated that a function of VGR2990 gene, herein designated VGR GENE, is inhibition of expression of host target genes, as part of a novel viral mechanism of attacking a host. Accordingly, utilities of VGR2990 gene include diagnosis, prevention and treatment of viral infection by Rana Tigrina Ranavirus. Specific functions, and accordingly utilities, of VGR2990 gene correlate with, and may be deduced from, the identity of the host target genes, which are inhibited by VGAM RNAs comprised in the 'operon-like' cluster of VGR2990 gene: VGAM1168 host target protein and VGAM1169 host target protein, herein schematically represented by VGAM1 HOST TARGET PROTEIN through VGAM3 HOST TARGET PROTEIN. The function of these host target genes is elaborated hereinabove with reference to VGAM1168 and VGAM1169. FIG. 9 further provides a conceptual description of novel bioinformatically detected regulatory viral gene, referred to here as Viral Genomic Record 2991(VGR2991) viral gene, which encodes an 'operon-like' cluster of novel viral micro RNA-like genes, each of which in turn modulates expression of at least one host target gene, the function and utility of which at least one host target gene is known in the art.

VGR2991 gene, herein designated VGR GENE, is a novel bioinformatically detected regulatory, non protein coding, RNA viral gene. The method by which VGR2991 gene was detected is described hereinabove with reference to FIGS. 1-9.

VGR2991 gene encodes VGR2991 precursor RNA, herein designated VGR PRECURSOR RNA, an RNA molecule, typically several hundred nucleotides long.

VGR2991 precursor RNA folds spatially, forming VGR2991 folded precursor RNA, herein designated VGR FOLDED PRECURSOR RNA. It is appreciated that VGR2991 folded precursor RNA comprises a plurality of what is known in the art as 'hairpin' structures. These 'hairpin' structures are due to the fact that the nucleotide sequence of VGR2991 precursor RNA comprises a plurality of segments, the first half of each such segment having a nucleotide sequence which is at least a partial inversed-reversed sequence of the second half thereof, as is well known in the art.

VGR2991 folded precursor RNA is naturally processed by cellular enzymatic activity into at least 3 separate VGAM precursor RNAs, VGAM1171 precursor RNA, VGAM1172 precursor RNA and VGAM1173 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1171 RNA, VGAM1172 RNA and VGAM1173 RNA, herein schematically represented by VGAM1 RNA through VGAM3 RNA, each of which VGAM RNAs corresponding to VGAM RNA of FIG. 1.

VGAM1171 RNA, herein schematically represented by VGAM1 RNA through VGAM3 RNA, binds complementarily to a host target binding site located in an untranslated region of VGAM1171 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1171 host target RNA into VGAM1171 host target protein, herein schematically represented by VGAM1 HOST TARGET PROTEIN through VGAM3 HOST TARGET PROTEIN, all of FIG. 1.

VGAM1172 RNA, herein schematically represented by VGAM1 RNA through VGAM3 RNA, binds complementarily to a host target binding site located in an untranslated region of VGAM1172 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1172 host target RNA into VGAM1172 host target protein, herein schematically represented by VGAM1 HOST TARGET PROTEIN through VGAM3 HOST TARGET PROTEIN, all of FIG. 1.

VGAM1173 RNA, herein schematically represented by VGAM1 RNA through VGAM3 RNA, binds complementarily to a host target binding site located in an untranslated region of VGAM1173 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1173 host target RNA into VGAM1173 host target protein, herein schematically represented by VGAM1 HOST TARGET PROTEIN through VGAM3 HOST TARGET PROTEIN, all of FIG. 1.

It is appreciated that a function of VGR2991 gene, herein designated VGR GENE, is inhibition of expression of host target genes, as part of a novel viral mechanism of attacking a host. Accordingly, utilities of VGR2991 gene include diagnosis, prevention and treatment of viral infection by Cucumber Fruit Mottle Mosaic Virus. Specific functions, and accordingly utilities, of VGR2991 gene correlate with, and may be deduced from, the identity of the host target genes, which are inhibited by VGAM RNAs comprised in the 'operon-like' cluster of VGR2991 gene: VGAM1171 host target protein, VGAM1172 host target protein and VGAM1173 host target protein, herein schematically represented by VGAM1 HOST TARGET PROTEIN through VGAM3 HOST TARGET PROTEIN. The function of these host target genes is elaborated hereinabove with reference to VGAM1171, VGAM1172 and VGAM1173. FIG. 9 further provides a conceptual description of novel bioinformatically detected regulatory viral gene, referred to here as Viral Genomic Record 2992(VGR2992) viral gene, which encodes an 'operon-like' cluster of novel viral micro RNA-like genes, each of which in turn modulates expression of at least one host target gene, the function and utility of which at least one host target gene is known in the art.

VGR2992 gene, herein designated VGR GENE, is a novel bioinformatically detected regulatory, non protein coding, RNA viral gene. The method by which VGR2992 gene was detected is described hereinabove with reference to FIGS. 1-9.

VGR2992 gene encodes VGR2992 precursor RNA, herein designated VGR PRECURSOR RNA, an RNA molecule, typically several hundred nucleotides long.

VGR2992 precursor RNA folds spatially, forming VGR2992 folded precursor RNA, herein designated VGR FOLDED PRECURSOR RNA. It is appreciated that VGR2992 folded precursor RNA comprises a plurality of what is known in the art as 'hairpin' structures. These 'hairpin' structures are due to the fact that the nucleotide sequence of VGR2992 precursor RNA comprises a plurality of segments, the first half of each such segment having a nucleotide sequence which is at least a partial inversed-reversed sequence of the second half thereof, as is well known in the art.

VGR2992 folded precursor RNA is naturally processed by cellular enzymatic activity into at least 3 separate VGAM precursor RNAs, VGAM1174 precursor RNA, VGAM1175 precursor RNA and VGAM1176 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1174 RNA, VGAM1175 RNA and VGAM1176 RNA, herein schematically represented by VGAM1 RNA through VGAM3 RNA, each of which VGAM RNAs corresponding to VGAM RNA of FIG. 1.

VGAM1174 RNA, herein schematically represented by VGAM1 RNA through VGAM3 RNA, binds complementarily to a host target binding site located in an untranslated region of VGAM1174 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1174 host target RNA into VGAM1174 host target protein, herein schematically represented by VGAM1 HOST TARGET PROTEIN through VGAM3 HOST TARGET PROTEIN, all of FIG. 1.

VGAM1175 RNA, herein schematically represented by VGAM1 RNA through VGAM3 RNA, binds complementarily to a host target binding site located in an untranslated region of VGAM1175 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1175 host target RNA into VGAM1175 host target protein, herein schematically represented by VGAM1 HOST TARGET PROTEIN through VGAM3 HOST TARGET PROTEIN, all of FIG. 1.

VGAM1176 RNA, herein schematically represented by VGAM1 RNA through VGAM3 RNA, binds complementarily to a host target binding site located in an untranslated region of VGAM1176 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1176 host target RNA into VGAM1176 host target protein, herein schematically represented by VGAM1 HOST TARGET PROTEIN through VGAM3 HOST TARGET PROTEIN, all of FIG. 1.

It is appreciated that a function of VGR2992 gene, herein designated VGR GENE, is inhibition of expression of host target genes, as part of a novel viral mechanism of attacking a host. Accordingly, utilities of VGR2992 gene include diagnosis, prevention and treatment of viral infection by Rift Valley Fever Virus. Specific functions, and accordingly utilities, of VGR2992 gene correlate with, and may be deduced from, the identity of the host target genes, which are inhibited by VGAM RNAs comprised in the 'operon-like' cluster of VGR2992 gene: VGAM1174 host target protein, VGAM1175 host target protein and VGAM1176 host target protein, herein schematically represented by VGAM1 HOST TARGET PROTEIN through VGAM3 HOST TARGET PROTEIN. The function of these host target genes is elaborated hereinabove with reference to VGAM1174, VGAM1175 and VGAM1176. FIG. 9 further provides a conceptual description of novel bioinformatically detected regulatory viral gene, referred to here as Viral Genomic Record 2993(VGR2993) viral gene, which encodes an 'operon-like' cluster of novel viral micro RNA-like genes, each of which in turn modulates expression of at least one host target gene, the function and utility of which at least one host target gene is known in the art.

VGR2993 gene, herein designated VGR GENE, is a novel bioinformatically detected regulatory, non protein coding, RNA viral gene. The method by which VGR2993 gene was detected is described hereinabove with reference to FIGS. 1-9.

VGR2993 gene encodes VGR2993 precursor RNA, herein designated VGR PRECURSOR RNA, an RNA molecule, typically several hundred nucleotides long.

VGR2993 precursor RNA folds spatially, forming VGR2993 folded precursor RNA, herein designated VGR FOLDED PRECURSOR RNA. It is appreciated that VGR2993 folded precursor RNA comprises a plurality of what is known in the art as 'hairpin' structures. These 'hairpin' structures are due to the fact that the nucleotide sequence of VGR2993 precursor RNA comprises a plurality of segments, the first half of each such segment having a nucleotide sequence which is at least a partial inversed-reversed sequence of the second half thereof, as is well known in the art.

VGR2993 folded precursor RNA is naturally processed by cellular enzymatic activity into at least 5 separate VGAM precursor RNAs, VGAM1177 precursor RNA, VGAM1178 precursor RNA, VGAM1179 precursor RNA, VGAM1180 precursor RNA and VGAM1181 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1177 RNA, VGAM1178 RNA, VGAM1179 RNA, VGAM1180 RNA and VGAM1181 RNA, herein schematically represented by VGAM1 RNA through VGAM3 RNA, each of which VGAM RNAs corresponding to VGAM RNA of FIG. 1.

VGAM1177 RNA, herein schematically represented by VGAM1 RNA through VGAM3 RNA, binds complementarily to a host target binding site located in an untranslated region of VGAM1177 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1177 host target RNA into VGAM1177 host target protein, herein schematically represented by VGAM1 HOST TARGET PROTEIN through VGAM3 HOST TARGET PROTEIN, all of FIG. 1.

VGAM1178 RNA, herein schematically represented by VGAM1 RNA through VGAM3 RNA, binds complementarily to a host target binding site located in an untranslated region of VGAM1178 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1178 host target RNA into VGAM1178 host target protein, herein schematically represented by VGAM1 HOST TARGET PROTEIN through VGAM3 HOST TARGET PROTEIN, all of FIG. 1.

VGAM1179 RNA, herein schematically represented by VGAM1 RNA through VGAM3 RNA, binds complementarily to a host target binding site located in an untranslated region of VGAM1179 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1179 host target RNA into VGAM1179 host target protein, herein schematically represented by VGAM1 HOST TARGET PROTEIN through VGAM3 HOST TARGET PROTEIN, all of FIG. 1.

VGAM1180 RNA, herein schematically represented by VGAM1 RNA through VGAM3 RNA, binds complementarily to a host target binding site located in an untranslated region of VGAM1180 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1180 host target RNA into VGAM1180 host target protein, herein schematically represented by VGAM1 HOST TARGET PROTEIN through VGAM3 HOST TARGET PROTEIN, all of FIG. 1.

VGAM1181 RNA, herein schematically represented by VGAM1 RNA through VGAM3 RNA, binds complementarily to a host target binding site located in an untranslated region of VGAM1181 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1181 host target RNA into VGAM1181 host target protein, herein schematically represented by VGAM1 HOST TARGET PROTEIN through VGAM3 HOST TARGET PROTEIN, all of FIG. 1.

It is appreciated that a function of VGR2993 gene, herein designated VGR GENE, is inhibition of expression of host target genes, as part of a novel viral mechanism of attacking a host. Accordingly, utilities of VGR2993 gene include diagnosis, prevention and treatment of viral infection by Odontoglossum Ringspot Virus. Specific functions, and accordingly utilities, of VGR2993 gene correlate with, and may be deduced from, the identity of the host target genes, which are inhibited by VGAM RNAs comprised in the 'operon-like' cluster of VGR2993 gene: VGAM1177 host target protein, VGAM1178 host target protein, VGAM1179 host target protein, VGAM1180 host target protein and VGAM1181 host target protein, herein schematically represented by VGAM1 HOST TARGET PROTEIN through VGAM3 HOST TARGET PROTEIN. The function of these host target genes is elaborated hereinabove with reference to VGAM1177, VGAM1178, VGAM1179, VGAM1180 and VGAM1181. FIG. 9 further provides a conceptual description of novel bioinformatically detected regulatory viral gene, referred to here as Viral Genomic Record 2994(VGR2994) viral gene, which encodes an 'operon-like' cluster of novel viral micro RNA-like genes, each of which in turn modulates expression of at least one host target gene, the function and utility of which at least one host target gene is known in the art.

VGR2994 gene, herein designated VGR GENE, is a novel bioinformatically detected regulatory, non protein coding, RNA viral gene. The method by which VGR2994 gene was detected is described hereinabove with reference to FIGS. 1-9.

VGR2994 gene encodes VGR2994 precursor RNA, herein designated VGR PRECURSOR RNA, an RNA molecule, typically several hundred nucleotides long.

VGR2994 precursor RNA folds spatially, forming VGR2994 folded precursor RNA, herein designated VGR FOLDED PRECURSOR RNA. It is appreciated that VGR2994 folded precursor RNA comprises a plurality of what is known in the art as 'hairpin' structures. These 'hairpin' structures are due to the fact that the nucleotide sequence of VGR2994 precursor RNA comprises a plurality of segments, the first half of each such segment having a nucleotide sequence which is at least a partial inversed-reversed sequence of the second half thereof, as is well known in the art.

VGR2994 folded precursor RNA is naturally processed by cellular enzymatic activity into at least 3 separate VGAM precursor RNAs, VGAM1183 precursor RNA, VGAM1184 precursor RNA and VGAM1185 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1183 RNA, VGAM1184 RNA and VGAM1185 RNA, herein schematically represented by VGAM1 RNA through VGAM3 RNA, each of which VGAM RNAs corresponding to VGAM RNA of FIG. 1.

VGAM1183 RNA, herein schematically represented by VGAM1 RNA through VGAM3 RNA, binds complementarily to a host target binding site located in an untranslated region of VGAM1183 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1183 host target RNA into VGAM1183 host target protein, herein schematically represented by VGAM1 HOST TARGET PROTEIN through VGAM3 HOST TARGET PROTEIN, all of FIG. 1.

VGAM1184 RNA, herein schematically represented by VGAM1 RNA through VGAM3 RNA, binds complementarily to a host target binding site located in an untranslated region of VGAM1184 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1184 host target RNA into VGAM1184 host target protein, herein schematically represented by VGAM1 HOST TARGET PROTEIN through VGAM3 HOST TARGET PROTEIN, all of FIG. 1.

VGAM1185 RNA, herein schematically represented by VGAM1 RNA through VGAM3 RNA, binds complementarily to a host target binding site located in an untranslated region of VGAM1185 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM1185 host target RNA into VGAM1185 host target protein, herein schematically represented by VGAM1 HOST TARGET PROTEIN through VGAM3 HOST TARGET PROTEIN, all of FIG. 1.

It is appreciated that a function of VGR2994 gene, herein designated VGR GENE, is inhibition of expression of host target genes, as part of a novel viral mechanism of attacking a host. Accordingly, utilities of VGR2994 gene include diagnosis, prevention and treatment of viral infection by Cactus Virus X. Specific functions, and accordingly utilities, of VGR2994 gene correlate with, and may be deduced from, the identity of the host target genes, which are inhibited by VGAM RNAs comprised in the 'operon-like' cluster of VGR2994 gene: VGAM1183 host target protein, VGAM1184 host target protein and VGAM1185 host target protein, herein schematically represented by VGAM1 HOST TARGET PROTEIN through VGAM3 HOST TARGET PROTEIN. The function of these host target genes is elaborated hereinabove with reference to VGAM1183, VGAM1184 and VGAM1185. FIG. 9 further provides a conceptual description of novel bioinformatically detected regulatory viral gene, referred to here as Viral Genomic Record 2995(VGR2995) viral gene, which encodes an 'operon-like' cluster of novel viral micro RNA-like genes, each of which in turn modulates expression of at least one host target gene, the function and utility of which at least one host target gene is known in the art.

VGR2995 gene, herein designated VGR GENE, is a novel bioinformatically detected regulatory, non protein coding, RNA viral gene. The method by which VGR2995 gene was detected is described hereinabove with reference to FIGS. 1-9.

VGR2995 gene encodes VGR2995 precursor RNA, herein designated VGR PRECURSOR RNA, an RNA molecule, typically several hundred nucleotides long.

VGR2995 precursor RNA folds spatially, forming VGR2995 folded precursor RNA, herein designated VGR FOLDED PRECURSOR RNA. It is appreciated that VGR2995 folded precursor RNA comprises a plurality of what is known in the art as 'hairpin' structures. These 'hairpin' structures are due to the fact that the nucleotide sequence of VGR2995 precursor RNA comprises a plurality of segments, the first half of each such segment having a nucleotide sequence which is at least a partial inversed-reversed sequence of the second half thereof, as is well known in the art.

VGR2995 folded precursor RNA is naturally processed by cellular enzymatic activity into at least 3 separate VGAM precursor RNAs, VGAM1186 precursor RNA, VGAM1187 precursor RNA and VGAM1188 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1186 RNA, VGAM1187 RNA and VGAM1188 RNA, herein schematically represented by VGAM1 RNA through VGAM3 RNA, each of which VGAM RNAs corresponding to VGAM RNA of FIG. 1.

VGAM1186 RNA, herein schematically represented by VGAM1 RNA through VGAM3 RNA, binds complementarily to a host target binding site located in an untranslated region of VGAM1186 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1186 host target RNA into VGAM1186 host target protein, herein schematically represented by VGAM1 HOST TARGET PROTEIN through VGAM3 HOST TARGET PROTEIN, all of FIG. 1.

VGAM1187 RNA, herein schematically represented by VGAM1 RNA through VGAM3 RNA, binds complementarily to a host target binding site located in an untranslated region of VGAM1187 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1187 host target RNA into VGAM1187 host target protein, herein schematically represented by VGAM1 HOST TARGET PROTEIN through VGAM3 HOST TARGET PROTEIN, all of FIG. 1.

VGAM1188 RNA, herein schematically represented by VGAM1 RNA through VGAM3 RNA, binds complementarily to a host target binding site located in an untranslated region of VGAM1188 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1188 host target RNA into VGAM1188 host target protein, herein schematically represented by VGAM1 HOST TARGET PROTEIN through VGAM3 HOST TARGET PROTEIN, all of FIG. 1.

It is appreciated that a function of VGR2995 gene, herein designated VGR GENE, is inhibition of expression of host target genes, as part of a novel viral mechanism of attacking a host. Accordingly, utilities of VGR2995 gene include diagnosis, prevention and treatment of viral infection by Human Adenovirus C. Specific functions, and accordingly utilities, of VGR2995 gene correlate with, and may be deduced from, the identity of the host target genes, which are inhibited by VGAM RNAs comprised in the 'operon-like' cluster of VGR2995 gene: VGAM1186 host target protein, VGAM1187 host target protein and VGAM1188 host target protein, herein schematically represented by VGAM1 HOST TARGET PROTEIN through VGAM3 HOST TARGET PROTEIN. The function of these host target genes is elaborated hereinabove with reference to VGAM1186, VGAM1187 and VGAM1188. FIG. 9 further provides a conceptual description of novel bioinformatically detected regulatory viral gene, referred to here as Viral Genomic Record 2996(VGR2996) viral gene, which encodes an 'operon-like' cluster of novel viral micro RNA-like genes, each of which in turn modulates expression of at least one host target gene, the function and utility of which at least one host target gene is known in the art.

VGR2996 gene, herein designated VGR GENE, is a novel bioinformatically detected regulatory, non protein coding, RNA viral gene. The method by which VGR2996 gene was detected is described hereinabove with reference to FIGS. 1-9.

VGR2996 gene encodes VGR2996 precursor RNA, herein designated VGR PRECURSOR RNA, an RNA molecule, typically several hundred nucleotides long.

VGR2996 precursor RNA folds spatially, forming VGR2996 folded precursor RNA, herein designated VGR FOLDED PRECURSOR RNA. It is appreciated that VGR2996 folded precursor RNA comprises a plurality of what is known in the art as 'hairpin' structures. These 'hairpin' structures are due to the fact that the nucleotide sequence of VGR2996 precursor RNA comprises a plurality of segments, the first half of each such segment having a nucleotide sequence which is at least a partial inversed-reversed sequence of the second half thereof, as is well known in the art.

VGR2996 folded precursor RNA is naturally processed by cellular enzymatic activity into at least 3 separate VGAM precursor RNAs, VGAM1189 precursor RNA, VGAM1190 precursor RNA and VGAM1191 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1189 RNA, VGAM1190 RNA and VGAM1191 RNA, herein schematically represented by VGAM1 RNA through VGAM3 RNA, each of which VGAM RNAs corresponding to VGAM RNA of FIG. 1.

VGAM1189 RNA, herein schematically represented by VGAM1 RNA through VGAM3 RNA, binds complementarily to a host target binding site located in an untranslated region of VGAM1189 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1189 host target RNA into VGAM1189 host target protein, herein schematically represented by VGAM1 HOST TARGET PROTEIN through VGAM3 HOST TARGET PROTEIN, all of FIG. 1.

VGAM1190 RNA, herein schematically represented by VGAM1 RNA through VGAM3 RNA, binds complementarily to a host target binding site located in an untranslated region of VGAM1190 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1190 host target RNA into VGAM1190 host target protein, herein schematically represented by VGAM1 HOST TARGET PROTEIN through VGAM3 HOST TARGET PROTEIN, all of FIG. 1.

VGAM1191 RNA, herein schematically represented by VGAM1 RNA through VGAM3 RNA, binds complementarily to a host target binding site located in an untranslated region of VGAM1191 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1191 host target RNA into VGAM1191 host target protein, herein schematically represented by VGAM1 HOST TARGET PROTEIN through VGAM3 HOST TARGET PROTEIN, all of FIG. 1.

It is appreciated that a function of VGR2996 gene, herein designated VGR GENE, is inhibition of expression of host target genes, as part of a novel viral mechanism of attacking a host. Accordingly, utilities of VGR2996 gene include diagnosis, prevention and treatment of viral infection by Botrytis Virus F. Specific functions, and accordingly utilities, of VGR2996 gene correlate with, and may be deduced from, the identity of the host target genes, which are inhibited by VGAM RNAs comprised in the 'operon-like' cluster of VGR2996 gene: VGAM1189 host target protein, VGAM1190 host target protein and VGAM1191 host target protein, herein schematically represented by VGAM1 HOST TARGET PROTEIN through VGAM3 HOST TARGET PROTEIN. The function of these host target genes is elaborated hereinabove with reference to VGAM1189, VGAM1190 and VGAM1191. FIG. 9 further provides a conceptual description of novel bioinformatically detected regulatory viral gene, referred to here as Viral Genomic Record 2997(VGR2997) viral gene, which encodes an 'operon-like' cluster of novel viral micro RNA-like genes, each of which in turn modulates expression of at least one host target gene, the function and utility of which at least one host target gene is known in the art.

VGR2997 gene, herein designated VGR GENE, is a novel bioinformatically detected regulatory, non protein coding, RNA viral gene. The method by which VGR2997 gene was detected is described hereinabove with reference to FIGS. 1-9.

VGR2997 gene encodes VGR2997 precursor RNA, herein designated VGR PRECURSOR RNA, an RNA molecule, typically several hundred nucleotides long.

VGR2997 precursor RNA folds spatially, forming VGR2997 folded precursor RNA, herein designated VGR FOLDED PRECURSOR RNA. It is appreciated that VGR2997 folded precursor RNA comprises a plurality of what is known in the art as 'hairpin' structures. These 'hairpin' structures are due to the fact that the nucleotide sequence of VGR2997 precursor RNA comprises a plurality of segments, the first half of each such segment having a nucleotide sequence which is at least a partial inversed-reversed sequence of the second half thereof, as is well known in the art.

VGR2997 folded precursor RNA is naturally processed by cellular enzymatic activity into at least 3 separate VGAM precursor RNAs, VGAM1192 precursor RNA, VGAM1193 precursor RNA and VGAM1194 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1192 RNA, VGAM1193 RNA and VGAM1194 RNA, herein schematically represented by VGAM1 RNA through VGAM3 RNA, each of which VGAM RNAs corresponding to VGAM RNA of FIG. 1.

VGAM1192 RNA, herein schematically represented by VGAM1 RNA through VGAM3 RNA, binds complementarily to a host target binding site located in an untranslated region of VGAM1192 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1192 host target RNA into VGAM1192 host target protein, herein schematically represented by VGAM1 HOST TARGET PROTEIN through VGAM3 HOST TARGET PROTEIN, all of FIG. 1.

VGAM1193 RNA, herein schematically represented by VGAM1 RNA through VGAM3 RNA, binds complementarily to a host target binding site located in an untranslated region of VGAM1193 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1193 host target RNA into VGAM1193 host target protein, herein schematically represented by VGAM1 HOST TARGET PROTEIN through VGAM3 HOST TARGET PROTEIN, all of FIG. 1.

VGAM1194 RNA, herein schematically represented by VGAM1 RNA through VGAM3 RNA, binds complementarily to a host target binding site located in an untranslated region of VGAM1194 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1194 host target RNA into VGAM1194 host target protein, herein schematically represented by VGAM1 HOST TARGET PROTEIN through VGAM3 HOST TARGET PROTEIN, all of FIG. 1.

It is appreciated that a function of VGR2997 gene, herein designated VGR GENE, is inhibition of expression of host target genes, as part of a novel viral mechanism of attacking a host. Accordingly, utilities of VGR2997 gene include diagnosis, prevention and treatment of viral infection by Cowpox Virus. Specific functions, and accordingly utilities, of VGR2997 gene correlate with, and may be deduced from, the identity of the host target genes, which are inhibited by VGAM RNAs comprised in the 'operon-like' cluster of VGR2997 gene: VGAM1192 host target protein, VGAM1193 host target protein and VGAM1194 host target protein, herein schematically represented by VGAM1 HOST TARGET PROTEIN through VGAM3 HOST TARGET PROTEIN. The function of these host target genes is elaborated hereinabove with reference to VGAM1192, VGAM1193 and VGAM1194. FIG. 9 further provides a conceptual description of novel bioinformatically detected regulatory viral gene, referred to here as Viral Genomic Record 2998(VGR2998) viral gene, which encodes an 'operon-like' cluster of novel viral micro RNA-like genes, each of which in turn modulates expression of at least one host target gene, the function and utility of which at least one host target gene is known in the art.

VGR2998 gene, herein designated VGR GENE, is a novel bioinformatically detected regulatory, non protein coding, RNA viral gene. The method by which VGR2998 gene was detected is described hereinabove with reference to FIGS. 1-9.

VGR2998 gene encodes VGR2998 precursor RNA, herein designated VGR PRECURSOR RNA, an RNA molecule, typically several hundred nucleotides long.

VGR2998 precursor RNA folds spatially, forming VGR2998 folded precursor RNA, herein designated VGR FOLDED PRECURSOR RNA. It is appreciated that VGR2998 folded precursor RNA comprises a plurality of what is known in the art as 'hairpin' structures. These 'hairpin' structures are due to the fact that the nucleotide sequence of VGR2998 precursor RNA comprises a plurality of segments, the first half of each such segment having a nucleotide sequence which is at least a partial inversed-reversed sequence of the second half thereof, as is well known in the art.

VGR2998 folded precursor RNA is naturally processed by cellular enzymatic activity into at least 4 separate VGAM precursor RNAs, VGAM1195 precursor RNA, VGAM1196 precursor RNA, VGAM1197 precursor RNA and VGAM1198 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1195 RNA, VGAM1196 RNA, VGAM1197 RNA and VGAM1198 RNA, herein schematically represented by VGAM1 RNA through VGAM3 RNA, each of which VGAM RNAs corresponding to VGAM RNA of FIG. 1.

VGAM1195 RNA, herein schematically represented by VGAM1 RNA through VGAM3 RNA, binds complementarily to a host target binding site located in an untranslated region of VGAM1195 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1195 host target RNA into VGAM1195 host target protein, herein schematically represented by VGAM1 HOST TARGET PROTEIN through VGAM3 HOST TARGET PROTEIN, all of FIG. 1.

VGAM1196 RNA, herein schematically represented by VGAM1 RNA through VGAM3 RNA, binds complementarily to a host target binding site located in an untranslated region of VGAM1196 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1196 host target RNA into VGAM1196 host target protein, herein schematically represented by VGAM1 HOST TARGET PROTEIN through VGAM3 HOST TARGET PROTEIN, all of FIG. 1.

VGAM1197 RNA, herein schematically represented by VGAM1 RNA through VGAM3 RNA, binds complementarily to a host target binding site located in an untranslated region of VGAM1197 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1197 host target RNA into VGAM1197 host target protein, herein schematically represented by VGAM1 HOST TARGET PROTEIN through VGAM3 HOST TARGET PROTEIN, all of FIG. 1.

VGAM1198 RNA, herein schematically represented by VGAM1 RNA through VGAM3 RNA, binds complementarily to a host target binding site located in an untranslated region of VGAM1198 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1198 host target RNA into VGAM1198 host target protein, herein schematically represented by VGAM1 HOST TARGET PROTEIN through VGAM3 HOST TARGET PROTEIN, all of FIG. 1.

It is appreciated that a function of VGR2998 gene, herein designated VGR GENE, is inhibition of expression of host target genes, as part of a novel viral mechanism of attacking a host. Accordingly, utilities of VGR2998 gene include diagnosis, prevention and treatment of viral infection by Equine Herpesvirus 1. Specific functions, and accordingly utilities, of VGR2998 gene correlate with, and may be deduced from, the identity of the host target genes, which are inhibited by VGAM RNAs comprised in the 'operon-like' cluster of VGR2998 gene: VGAM1195 host target protein, VGAM1196 host target protein, VGAM1197 host target protein and VGAM1198 host target protein, herein schematically represented by VGAM1 HOST TARGET PROTEIN through VGAM3 HOST TARGET PROTEIN. The function of these host target genes is elaborated hereinabove with reference to VGAM1195, VGAM1196, VGAM1197 and VGAM1198. FIG. 9 further provides a conceptual description of novel bioinformatically detected regulatory viral gene, referred to here as Viral Genomic Record 2999(VGR2999) viral gene, which encodes an 'operon-like' cluster of novel viral micro RNA-like genes, each of which in turn modulates expression of at least one host target gene, the function and utility of which at least one host target gene is known in the art.

VGR2999 gene, herein designated VGR GENE, is a novel bioinformatically detected regulatory, non protein coding, RNA viral gene. The method by which VGR2999 gene was detected is described hereinabove with reference to FIGS. 1-9.

VGR2999 gene encodes VGR2999 precursor RNA, herein designated VGR PRECURSOR RNA, an RNA molecule, typically several hundred nucleotides long.

VGR2999 precursor RNA folds spatially, forming VGR2999 folded precursor RNA, herein designated VGR FOLDED PRECURSOR RNA. It is appreciated that VGR2999 folded precursor RNA comprises a plurality of what is known in the art as 'hairpin' structures. These 'hairpin' structures are due to the fact that the nucleotide sequence of VGR2999 precursor RNA comprises a plurality of segments, the first half of each such segment having a nucleotide sequence which is at least a partial inversed-reversed sequence of the second half thereof, as is well known in the art.

VGR2999 folded precursor RNA is naturally processed by cellular enzymatic activity into at least 4 separate VGAM precursor RNAs, VGAM1199 precursor RNA, VGAM1200 precursor RNA, VGAM1201 precursor RNA and VGAM1202 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1199 RNA, VGAM1200 RNA, VGAM1201 RNA and VGAM1202 RNA, herein schematically represented by VGAM1 RNA through VGAM3 RNA, each of which VGAM RNAs corresponding to VGAM RNA of FIG. 1.

VGAM1199 RNA, herein schematically represented by VGAM1 RNA through VGAM3 RNA, binds complementarily to a host target binding site located in an untranslated region of VGAM1199 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1199 host target RNA into VGAM1199 host target protein, herein schematically represented by VGAM1 HOST TARGET PROTEIN through VGAM3 HOST TARGET PROTEIN, all of FIG. 1.

VGAM1200 RNA, herein schematically represented by VGAM1 RNA through VGAM3 RNA, binds complementarily to a host target binding site located in an untranslated region of VGAM1200 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1200 host target RNA into VGAM1200 host target protein, herein schematically represented by VGAM1 HOST TARGET PROTEIN through VGAM3 HOST TARGET PROTEIN, all of FIG. 1.

VGAM1201 RNA, herein schematically represented by VGAM1 RNA through VGAM3 RNA, binds complementarily to a host target binding site located in an untranslated region of VGAM1201 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1201 host target RNA into VGAM1201 host target protein, herein schematically represented by VGAM1 HOST TARGET PROTEIN through VGAM3 HOST TARGET PROTEIN, all of FIG. 1.

VGAM1202 RNA, herein schematically represented by VGAM1 RNA through VGAM3 RNA, binds complementarily to a host target binding site located in an untranslated region of VGAM1202 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1202 host target RNA into VGAM1202 host target protein, herein schematically represented by VGAM1 HOST TARGET PROTEIN through VGAM3 HOST TARGET PROTEIN, all of FIG. 1.

It is appreciated that a function of VGR2999 gene, herein designated VGR GENE, is inhibition of expression of host target genes, as part of a novel viral mechanism of attacking a host. Accordingly, utilities of VGR2999 gene include diagnosis, prevention and treatment of viral infection by Avian Nephritis Virus. Specific functions, and accordingly utilities, of VGR2999 gene correlate with, and may be deduced from, the identity of the host target genes, which are inhibited by VGAM RNAs comprised in the 'operon-like' cluster of VGR2999 gene: VGAM1199 host target protein, VGAM1200 host target protein, VGAM1201 host target protein and VGAM1202 host target protein, herein schematically represented by VGAM1 HOST TARGET PROTEIN through VGAM3 HOST TARGET PROTEIN. The function of these host target genes is elaborated hereinabove with reference to VGAM1199, VGAM1200, VGAM1201 and VGAM1202. FIG. 9 further provides a conceptual description of novel bioinformatically detected regulatory viral gene, referred to here as Viral Genomic Record 3000(VGR3000) viral gene, which encodes an 'operon-like' cluster of novel viral micro RNA-like genes, each of which in turn modulates expression of at least one host target gene, the function and utility of which at least one host target gene is known in the art.

VGR3000 gene, herein designated VGR GENE, is a novel bioinformatically detected regulatory, non protein coding, RNA viral gene. The method by which VGR3000 gene was detected is described hereinabove with reference to FIGS. 1-9.

VGR3000 gene encodes VGR3000 precursor RNA, herein designated VGR PRECURSOR RNA, an RNA molecule, typically several hundred nucleotides long.

VGR3000 precursor RNA folds spatially, forming VGR3000 folded precursor RNA, herein designated VGR FOLDED PRECURSOR RNA. It is appreciated that VGR3000 folded precursor RNA comprises a plurality of what is known in the art as 'hairpin' structures. These 'hairpin' structures are due to the fact that the nucleotide sequence of VGR3000 precursor RNA comprises a plurality of segments, the first half of each such segment having a nucleotide sequence which is at least a partial inversed-reversed sequence of the second half thereof, as is well known in the art.

VGR3000 folded precursor RNA is naturally processed by cellular enzymatic activity into at least 3 separate VGAM precursor RNAs, VGAM1203 precursor RNA, VGAM1204 precursor RNA and VGAM1205 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1203 RNA, VGAM1204 RNA and VGAM1205 RNA, herein schematically represented by VGAM1 RNA through VGAM3 RNA, each of which VGAM RNAs corresponding to VGAM RNA of FIG. 1.

VGAM1203 RNA, herein schematically represented by VGAM1 RNA through VGAM3 RNA, binds complementarily to a host target binding site located in an untranslated region of VGAM1203 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1203 host target RNA into VGAM1203 host target protein, herein schematically represented by VGAM1 HOST TARGET PROTEIN through VGAM3 HOST TARGET PROTEIN, all of FIG. 1.

VGAM1204 RNA, herein schematically represented by VGAM1 RNA through VGAM3 RNA, binds complementarily to a host target binding site located in an untranslated region of VGAM1204 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1204 host target RNA into VGAM1204 host target protein, herein schematically represented by VGAM1 HOST TARGET PROTEIN through VGAM3 HOST TARGET PROTEIN, all of FIG. 1.

VGAM1205 RNA, herein schematically represented by VGAM1 RNA through VGAM3 RNA, binds complementarily to a host target binding site located in an untranslated region of VGAM1205 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1205 host target RNA into VGAM1205 host target protein, herein schematically represented by VGAM1 HOST TARGET PROTEIN through VGAM3 HOST TARGET PROTEIN, all of FIG. 1.

It is appreciated that a function of VGR3000 gene, herein designated VGR GENE, is inhibition of expression of host target genes, as part of a novel viral mechanism of attacking a host. Accordingly, utilities of VGR3000 gene include diagnosis, prevention and treatment of viral infection by Scallion Virus X. Specific functions, and accordingly utilities, of VGR3000 gene correlate with, and may be deduced from, the identity of the host target genes, which are inhibited by VGAM RNAs comprised in the 'operon-like' cluster of VGR3000 gene: VGAM1203 host target protein, VGAM1204 host target protein and VGAM1205 host target protein, herein schematically represented by VGAM1 HOST TARGET PROTEIN through VGAM3 HOST TARGET PROTEIN. The function of these host target genes is elaborated hereinabove with reference to VGAM1203, VGAM1204 and VGAM1205. FIG. 9 further provides a conceptual description of novel bioinformatically detected regulatory viral gene, referred to here as Viral Genomic Record 3001(VGR3001) viral gene, which encodes an 'operon-like' cluster of novel viral micro RNA-like genes, each of which in turn modulates expression of at least one host target gene, the function and utility of which at least one host target gene is known in the art.

VGR3001 gene, herein designated VGR GENE, is a novel bioinformatically detected regulatory, non protein coding, RNA viral gene. The method by which VGR3001 gene was detected is described hereinabove with reference to FIGS. 1-9.

VGR3001 gene encodes VGR3001 precursor RNA, herein designated VGR PRECURSOR RNA, an RNA molecule, typically several hundred nucleotides long.

VGR3001 precursor RNA folds spatially, forming VGR3001 folded precursor RNA, herein designated VGR FOLDED PRECURSOR RNA. It is appreciated that VGR3001 folded precursor RNA comprises a plurality of what is known in the art as 'hairpin' structures. These 'hairpin' structures are due to the fact that the nucleotide sequence of VGR3001 precursor RNA comprises a plurality of segments, the first half of each such segment having a nucleotide sequence which is at least a partial inversed-reversed sequence of the second half thereof, as is well known in the art.

VGR3001 folded precursor RNA is naturally processed by cellular enzymatic activity into at least 4 separate VGAM precursor RNAs, VGAM1206 precursor RNA, VGAM1207 precursor RNA, VGAM1208 precursor RNA and VGAM1209 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1206 RNA, VGAM1207 RNA, VGAM1208 RNA and VGAM1209 RNA, herein schematically represented by VGAM1 RNA through VGAM3 RNA, each of which VGAM RNAs corresponding to VGAM RNA of FIG. 1.

VGAM1206 RNA, herein schematically represented by VGAM1 RNA through VGAM3 RNA, binds complementarily to a host target binding site located in an untranslated region of VGAM1206 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1206 host target RNA into VGAM1206 host target protein, herein schematically represented by VGAM1 HOST TARGET PROTEIN through VGAM3 HOST TARGET PROTEIN, all of FIG. 1.

VGAM1207 RNA, herein schematically represented by VGAM1 RNA through VGAM3 RNA, binds complementarily to a host target binding site located in an untranslated region of VGAM1207 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1207 host target RNA into VGAM1207 host target protein, herein schematically represented by VGAM1 HOST TARGET PROTEIN through VGAM3 HOST TARGET PROTEIN, all of FIG. 1.

VGAM1208 RNA, herein schematically represented by VGAM1 RNA through VGAM3 RNA, binds complementarily to a host target binding site located in an untranslated region of VGAM1208 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1208 host target RNA into VGAM1208 host target protein, herein schematically represented by VGAM1 HOST TARGET PROTEIN through VGAM3 HOST TARGET PROTEIN, all of FIG. 1.

VGAM1209 RNA, herein schematically represented by VGAM1 RNA through VGAM3 RNA, binds complementarily to a host target binding site located in an untranslated region of VGAM1209 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1209 host target RNA into VGAM1209 host target protein, herein schematically represented by VGAM1 HOST TARGET PROTEIN through VGAM3 HOST TARGET PROTEIN, all of FIG. 1.

It is appreciated that a function of VGR3001 gene, herein designated VGR GENE, is inhibition of expression of host target genes, as part of a novel viral mechanism of attacking a host. Accordingly, utilities of VGR3001 gene include diagnosis, prevention and treatment of viral infection by Clover Yellow Mosaic Virus. Specific functions, and accordingly utilities, of VGR3001 gene correlate with, and may be deduced from, the identity of the host target genes, which are inhibited by VGAM RNAs comprised in the 'operon-like' cluster of VGR3001 gene: VGAM1206 host target protein, VGAM1207 host target protein, VGAM1208 host target protein and VGAM1209 host target protein, herein schematically represented by VGAM1 HOST TARGET PROTEIN through VGAM3 HOST TARGET PROTEIN. The function of these host target genes is elaborated hereinabove with reference to VGAM1206, VGAM1207, VGAM1208 and VGAM1209. FIG. 9 further provides a conceptual description of novel bioinformatically detected regulatory viral gene, referred to here as Viral Genomic Record 3002(VGR3002) viral gene, which encodes an 'operon-like' cluster of novel viral micro RNA-like genes, each of which in turn modulates expression of at least one host target gene, the function and utility of which at least one host target gene is known in the art.

VGR3002 gene, herein designated VGR GENE, is a novel bioinformatically detected regulatory, non protein coding, RNA viral gene. The method by which VGR3002 gene was detected is described hereinabove with reference to FIGS. 1-9.

VGR3002 gene encodes VGR3002 precursor RNA, herein designated VGR PRECURSOR RNA, an RNA molecule, typically several hundred nucleotides long.

VGR3002 precursor RNA folds spatially, forming VGR3002 folded precursor RNA, herein designated VGR FOLDED PRECURSOR RNA. It is appreciated that VGR3002 folded precursor RNA comprises a plurality of what is known in the art as 'hairpin' structures. These 'hairpin' structures are due to the fact that the nucleotide sequence of VGR3002 precursor RNA comprises a plurality of segments, the first half of each such segment having a nucleotide sequence which is at least a partial inversed-reversed sequence of the second half thereof, as is well known in the art.

VGR3002 folded precursor RNA is naturally processed by cellular enzymatic activity into at least 3 separate VGAM precursor RNAs, VGAM1210 precursor RNA, VGAM1211 precursor RNA and VGAM1212 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1210 RNA, VGAM1211 RNA and VGAM1212 RNA, herein schematically represented by VGAM1 RNA through VGAM3 RNA, each of which VGAM RNAs corresponding to VGAM RNA of FIG. 1.

VGAM1210 RNA, herein schematically represented by VGAM1 RNA through VGAM3 RNA, binds complementarily to a host target binding site located in an untranslated region of VGAM1210 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1210 host target RNA into VGAM1210 host target protein, herein schematically represented by VGAM1 HOST TARGET PROTEIN through VGAM3 HOST TARGET PROTEIN, all of FIG. 1.

VGAM1211 RNA, herein schematically represented by VGAM1 RNA through VGAM3 RNA, binds complementarily to a host target binding site located in an untranslated region of VGAM1211 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1211 host target RNA into VGAM1211 host target protein, herein schematically represented by VGAM1 HOST TARGET PROTEIN through VGAM3 HOST TARGET PROTEIN, all of FIG. 1.

VGAM1212 RNA, herein schematically represented by VGAM1 RNA through VGAM3 RNA, binds complementarily to a host target binding site located in an untranslated region of VGAM1212 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1212 host target RNA into VGAM1212 host target protein, herein schematically represented by VGAM1 HOST TARGET PROTEIN through VGAM3 HOST TARGET PROTEIN, all of FIG. 1.

It is appreciated that a function of VGR3002 gene, herein designated VGR GENE, is inhibition of expression of host target genes, as part of a novel viral mechanism of attacking a host. Accordingly, utilities of VGR3002 gene include diagnosis, prevention and treatment of viral infection by Camelpox Virus. Specific functions, and accordingly utilities, of VGR3002 gene correlate with, and may be deduced from, the identity of the host target genes, which are inhibited by VGAM RNAs comprised in the 'operon-like' cluster of VGR3002 gene: VGAM1210 host target protein, VGAM1211 host target protein and VGAM1212 host target protein, herein schematically represented by VGAM1 HOST TARGET PROTEIN through VGAM3 HOST TARGET PROTEIN. The function of these host target genes is elaborated hereinabove with reference to VGAM1210, VGAM1211 and VGAM1212. FIG. 9 further provides a conceptual description of novel bioinformatically detected regulatory viral gene, referred to here as Viral Genomic Record 3003(VGR3003) viral gene, which encodes an 'operon-like' cluster of novel viral micro RNA-like genes, each of which in turn modulates expression of at least one host target gene, the function and utility of which at least one host target gene is known in the art.

VGR3003 gene, herein designated VGR GENE, is a novel bioinformatically detected regulatory, non protein coding, RNA viral gene. The method by which VGR3003 gene was detected is described hereinabove with reference to FIGS. 1-9.

VGR3003 gene encodes VGR3003 precursor RNA, herein designated VGR PRECURSOR RNA, an RNA molecule, typically several hundred nucleotides long.

VGR3003 precursor RNA folds spatially, forming VGR3003 folded precursor RNA, herein designated VGR FOLDED PRECURSOR RNA. It is appreciated that VGR3003 folded precursor RNA comprises a plurality of what is known in the art as 'hairpin' structures. These 'hairpin' structures are due to the fact that the nucleotide sequence of VGR3003 precursor RNA comprises a plurality of segments, the first half of each such segment having a nucleotide sequence which is at least a partial inversed-reversed sequence of the second half thereof, as is well known in the art.

VGR3003 folded precursor RNA is naturally processed by cellular enzymatic activity into at least 4 separate VGAM precursor RNAs, VGAM1214 precursor RNA, VGAM1215 precursor RNA, VGAM1216 precursor RNA and VGAM1217 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1214 RNA, VGAM1215 RNA, VGAM1216 RNA and VGAM1217 RNA, herein schematically represented by VGAM1 RNA through VGAM3 RNA, each of which VGAM RNAs corresponding to VGAM RNA of FIG. 1.

VGAM1214 RNA, herein schematically represented by VGAM1 RNA through VGAM3 RNA, binds complementarily to a host target binding site located in an untranslated region of VGAM1214 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1214 host target RNA into VGAM1214 host target protein, herein schematically represented by VGAM1 HOST TARGET PROTEIN through VGAM3 HOST TARGET PROTEIN, all of FIG. 1.

VGAM1215 RNA, herein schematically represented by VGAM1 RNA through VGAM3 RNA, binds complementarily to a host target binding site located in an untranslated region of VGAM1215 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1215 host target RNA into VGAM1215 host target protein, herein schematically represented by VGAM1 HOST TARGET PROTEIN through VGAM3 HOST TARGET PROTEIN, all of FIG. 1.

VGAM1216 RNA, herein schematically represented by VGAM1 RNA through VGAM3 RNA, binds complementarily to a host target binding site located in an untranslated region of VGAM1216 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1216 host target RNA into VGAM1216 host target protein, herein schematically represented by VGAM1 HOST TARGET PROTEIN through VGAM3 HOST TARGET PROTEIN, all of FIG. 1.

VGAM1217 RNA, herein schematically represented by VGAM1 RNA through VGAM3 RNA, binds complementarily to a host target binding site located in an untranslated region of VGAM1217 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1217 host target RNA into VGAM1217 host target protein, herein schematically represented by VGAM1 HOST TARGET PROTEIN through VGAM3 HOST TARGET PROTEIN, all of FIG. 1.

It is appreciated that a function of VGR3003 gene, herein designated VGR GENE, is inhibition of expression of host target genes, as part of a novel viral mechanism of attacking a host. Accordingly, utilities of VGR3003 gene include diagnosis, prevention and treatment of viral infection by Tupaia Herpesvirus. Specific functions, and accordingly utilities, of VGR3003 gene correlate with, and may be deduced from, the identity of the host target genes, which are inhibited by VGAM RNAs comprised in the 'operon-like' cluster of VGR3003 gene: VGAM1214 host target protein, VGAM1215 host target protein, VGAM1216 host target protein and VGAM1217 host target protein, herein schematically represented by VGAM1 HOST TARGET PROTEIN through VGAM3 HOST TARGET PROTEIN. The function of these host target genes is elaborated hereinabove with reference to VGAM1214, VGAM1215, VGAM1216 and VGAM1217. FIG. 9 further provides a conceptual description of novel bioinformatically detected regulatory viral gene, referred to here as Viral Genomic Record 3004(VGR3004) viral gene, which encodes an 'operon-like' cluster of novel viral micro RNA-like genes, each of which in turn modulates expression of at least one host target gene, the function and utility of which at least one host target gene is known in the art.

VGR3004 gene, herein designated VGR GENE, is a novel bioinformatically detected regulatory, non protein coding, RNA viral gene. The method by which VGR3004 gene was detected is described hereinabove with reference to FIGS. 1-9.

VGR3004 gene encodes VGR3004 precursor RNA, herein designated VGR PRECURSOR RNA, an RNA molecule, typically several hundred nucleotides long.

VGR3004 precursor RNA folds spatially, forming VGR3004 folded precursor RNA, herein designated VGR FOLDED PRECURSOR RNA. It is appreciated that VGR3004 folded precursor RNA comprises a plurality of what is known in the art as 'hairpin' structures. These 'hairpin' structures are due to the fact that the nucleotide sequence of VGR3004 precursor RNA comprises a plurality of segments, the first half of each such segment having a nucleotide sequence which is at least a partial inversed-reversed sequence of the second half thereof, as is well known in the art.

VGR3004 folded precursor RNA is naturally processed by cellular enzymatic activity into at least 2 separate VGAM precursor RNAs, VGAM1218 precursor RNA and VGAM1219 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1218 RNA and VGAM1219 RNA, herein schematically represented by VGAM1 RNA through VGAM3 RNA, each of which VGAM RNAs corresponding to VGAM RNA of FIG. 1.

VGAM1218 RNA, herein schematically represented by VGAM1 RNA through VGAM3 RNA, binds complementarily to a host target binding site located in an untranslated region of VGAM1218 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1218 host target RNA into VGAM1218 host target protein, herein schematically represented by VGAM1 HOST TARGET PROTEIN through VGAM3 HOST TARGET PROTEIN, all of FIG. 1.

VGAM1219 RNA, herein schematically represented by VGAM1 RNA through VGAM3 RNA, binds complementarily to a host target binding site located in an untranslated region of VGAM1219 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1219 host target RNA into VGAM1219 host target protein, herein schematically represented by VGAM1 HOST TARGET PROTEIN through VGAM3 HOST TARGET PROTEIN, all of FIG. 1.

It is appreciated that a function of VGR3004 gene, herein designated VGR GENE, is inhibition of expression of host target genes, as part of a novel viral mechanism of attacking a host. Accordingly, utilities of VGR3004 gene include diagnosis, prevention and treatment of viral infection by Fowlpox Virus. Specific functions, and accordingly utilities, of VGR3004 gene correlate with, and may be deduced from, the identity of the host target genes, which are inhibited by VGAM RNAs comprised in the 'operon-like' cluster of VGR3004 gene: VGAM1218 host target protein and VGAM1219 host target protein, herein schematically represented by VGAM1 HOST TARGET PROTEIN through VGAM3 HOST TARGET PROTEIN. The function of these host target genes is elaborated hereinabove with reference to VGAM1218 and VGAM1219. FIG. 9 further provides a conceptual description of novel bioinformatically detected regulatory viral gene, referred to here as Viral Genomic Record 3005(VGR3005) viral gene, which encodes an 'operon-like' cluster of novel viral micro RNA-like genes, each of which in turn modulates expression of at least one host target gene, the function and utility of which at least one host target gene is known in the art.

VGR3005 gene, herein designated VGR GENE, is a novel bioinformatically detected regulatory, non protein coding, RNA viral gene. The method by which VGR3005 gene was detected is described hereinabove with reference to FIGS. 1-9.

VGR3005 gene encodes VGR3005 precursor RNA, herein designated VGR PRECURSOR RNA, an RNA molecule, typically several hundred nucleotides long.

VGR3005 precursor RNA folds spatially, forming VGR3005 folded precursor RNA, herein designated VGR FOLDED PRECURSOR RNA. It is appreciated that VGR3005 folded precursor RNA comprises a plurality of what is known in the art as 'hairpin' structures. These 'hairpin' structures are due to the fact that the nucleotide sequence of VGR3005 precursor RNA comprises a plurality of segments, the first half of each such segment having a nucleotide sequence which is at least a partial inversed-reversed sequence of the second half thereof, as is well known in the art.

VGR3005 folded precursor RNA is naturally processed by cellular enzymatic activity into at least 3 separate VGAM precursor RNAs, VGAM1220 precursor RNA, VGAM1221 precursor RNA and VGAM1222 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1220 RNA, VGAM1221 RNA and VGAM1222 RNA, herein schematically represented by VGAM1 RNA through VGAM3 RNA, each of which VGAM RNAs corresponding to VGAM RNA of FIG. 1.

VGAM1220 RNA, herein schematically represented by VGAM1 RNA through VGAM3 RNA, binds complementarily to a host target binding site located in an untranslated region of VGAM1220 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1220 host target RNA into VGAM1220 host target protein, herein schematically represented by VGAM1 HOST TARGET PROTEIN through VGAM3 HOST TARGET PROTEIN, all of FIG. 1.

VGAM1221 RNA, herein schematically represented by VGAM1 RNA through VGAM3 RNA, binds complementarily to a host target binding site located in an untranslated region of VGAM1221 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1221 host target RNA into VGAM1221 host target protein, herein schematically represented by VGAM1 HOST TARGET PROTEIN through VGAM3 HOST TARGET PROTEIN, all of FIG. 1.

VGAM1222 RNA, herein schematically represented by VGAM1 RNA through VGAM3 RNA, binds complementarily to a host target binding site located in an untranslated region of VGAM1222 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1222 host target RNA into VGAM1222 host target protein, herein schematically represented by VGAM1 HOST TARGET PROTEIN through VGAM3 HOST TARGET PROTEIN, all of FIG. 1.

It is appreciated that a function of VGR3005 gene, herein designated VGR GENE, is inhibition of expression of host target genes, as part of a novel viral mechanism of attacking a host. Accordingly, utilities of VGR3005 gene include diagnosis, prevention and treatment of viral infection by Fowl Adenovirus D. Specific functions, and accordingly utilities, of VGR3005 gene correlate with, and may be deduced from, the identity of the host target genes, which are inhibited by VGAM RNAs comprised in the 'operon-like' cluster of VGR3005 gene: VGAM1220 host target protein, VGAM1221 host target protein and VGAM1222 host target protein, herein schematically represented by VGAM1 HOST TARGET PROTEIN through VGAM3 HOST TARGET PROTEIN. The function of these host target genes is elaborated hereinabove with reference to VGAM1220, VGAM1221 and VGAM1222. FIG. 9 further provides a conceptual description of novel bioinformatically detected regulatory viral gene, referred to here as Viral Genomic Record 3006(VGR3006) viral gene, which encodes an 'operon-like' cluster of novel viral micro RNA-like genes, each of which in turn modulates expression of at least one host target gene, the function and utility of which at least one host target gene is known in the art.

VGR3006 gene, herein designated VGR GENE, is a novel bioinformatically detected regulatory, non protein coding, RNA viral gene. The method by which VGR3006 gene was detected is described hereinabove with reference to FIGS. 1-9.

VGR3006 gene encodes VGR3006 precursor RNA, herein designated VGR PRECURSOR RNA, an RNA molecule, typically several hundred nucleotides long.

VGR3006 precursor RNA folds spatially, forming VGR3006 folded precursor RNA, herein designated VGR FOLDED PRECURSOR RNA. It is appreciated that VGR3006 folded precursor RNA comprises a plurality of what is known in the art as 'hairpin' structures. These 'hairpin' structures are due to the fact that the nucleotide sequence of VGR3006 precursor RNA comprises a plurality of segments, the first half of each such segment having a nucleotide sequence which is at least a partial inversed-reversed sequence of the second half thereof, as is well known in the art.

VGR3006 folded precursor RNA is naturally processed by cellular enzymatic activity into at least 2 separate VGAM precursor RNAs, VGAM1223 precursor RNA and VGAM1224 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1223 RNA and VGAM1224 RNA, herein schematically represented by VGAM1 RNA through VGAM3 RNA, each of which VGAM RNAs corresponding to VGAM RNA of FIG. 1.

VGAM1223 RNA, herein schematically represented by VGAM1 RNA through VGAM3 RNA, binds complementarily to a host target binding site located in an untranslated region of VGAM1223 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1223 host target RNA into VGAM1223 host target protein, herein schematically represented by VGAM1 HOST TARGET PROTEIN through VGAM3 HOST TARGET PROTEIN, all of FIG. 1.

VGAM1224 RNA, herein schematically represented by VGAM1 RNA through VGAM3 RNA, binds complementarily to a host target binding site located in an untranslated region of VGAM1224 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1224 host target RNA into VGAM1224 host target protein, herein schematically represented by VGAM1 HOST TARGET PROTEIN through VGAM3 HOST TARGET PROTEIN, all of FIG. 1.

It is appreciated that a function of VGR3006 gene, herein designated VGR GENE, is inhibition of expression of host target genes, as part of a novel viral mechanism of attacking a host. Accordingly, utilities of VGR3006 gene include diagnosis, prevention and treatment of viral infection by Equine Herpesvirus 2. Specific functions, and accordingly utilities, of VGR3006 gene correlate with, and may be deduced from, the identity of the host target genes, which are inhibited by VGAM RNAs comprised in the 'operon-like' cluster of VGR3006 gene: VGAM1223 host target protein and VGAM1224 host target protein, herein schematically represented by VGAM1 HOST TARGET PROTEIN through VGAM3 HOST TARGET PROTEIN. The function of these host target genes is elaborated hereinabove with reference to VGAM1223 and VGAM1224. FIG. 9 further provides a conceptual description of novel bioinformatically detected regulatory viral gene, referred to here as Viral Genomic Record 3007(VGR3007) viral gene, which encodes an 'operon-like' cluster of novel viral micro RNA-like genes, each of which in turn modulates expression of at least one host target gene, the function and utility of which at least one host target gene is known in the art.

VGR3007 gene, herein designated VGR GENE, is a novel bioinformatically detected regulatory, non protein coding, RNA viral gene. The method by which VGR3007 gene was detected is described hereinabove with reference to FIGS. 1-9.

VGR3007 gene encodes VGR3007 precursor RNA, herein designated VGR PRECURSOR RNA, an RNA molecule, typically several hundred nucleotides long.

VGR3007 precursor RNA folds spatially, forming VGR3007 folded precursor RNA, herein designated VGR FOLDED PRECURSOR RNA. It is appreciated that VGR3007 folded precursor RNA comprises a plurality of what is known in the art as 'hairpin' structures. These 'hairpin' structures are due to the fact that the nucleotide sequence of VGR3007 precursor RNA comprises a plurality of segments, the first half of each such segment having a nucleotide sequence which is at least a partial inversed-reversed sequence of the second half thereof, as is well known in the art.

VGR3007 folded precursor RNA is naturally processed by cellular enzymatic activity into at least 4 separate VGAM precursor RNAs, VGAM1226 precursor RNA, VGAM1227 precursor RNA, VGAM1228 precursor RNA and VGAM1229 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1226 RNA, VGAM1227 RNA, VGAM1228 RNA and VGAM1229 RNA, herein schematically represented by VGAM1 RNA through VGAM3 RNA, each of which VGAM RNAs corresponding to VGAM RNA of FIG. 1.

VGAM1226 RNA, herein schematically represented by VGAM1 RNA through VGAM3 RNA, binds complementarily to a host target binding site located in an untranslated region of VGAM1226 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1226 host target RNA into VGAM1226 host target protein, herein schematically represented by VGAM1 HOST TARGET PROTEIN through VGAM3 HOST TARGET PROTEIN, all of FIG. 1.

VGAM1227 RNA, herein schematically represented by VGAM1 RNA through VGAM3 RNA, binds complementarily to a host target binding site located in an untranslated region of VGAM1227 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1227 host target RNA into VGAM1227 host target protein, herein schematically represented by VGAM1 HOST TARGET PROTEIN through VGAM3 HOST TARGET PROTEIN, all of FIG. 1.

VGAM1228 RNA, herein schematically represented by VGAM1 RNA through VGAM3 RNA, binds complementarily to a host target binding site located in an untranslated region of VGAM1228 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1228 host target RNA into VGAM1228 host target protein, herein schematically represented by VGAM1 HOST TARGET PROTEIN through VGAM3 HOST TARGET PROTEIN, all of FIG. 1.

VGAM1229 RNA, herein schematically represented by VGAM1 RNA through VGAM3 RNA, binds complementarily to a host target binding site located in an untranslated region of VGAM1229 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1229 host target RNA into VGAM1229 host target protein, herein schematically represented by VGAM1 HOST TARGET PROTEIN through VGAM3 HOST TARGET PROTEIN, all of FIG. 1.

It is appreciated that a function of VGR3007 gene, herein designated VGR GENE, is inhibition of expression of host target genes, as part of a novel viral mechanism of attacking a host. Accordingly, utilities of VGR3007 gene include diagnosis, prevention and treatment of viral infection by Tacaribe Virus. Specific functions, and accordingly utilities, of VGR3007 gene correlate with, and may be deduced from, the identity of the host target genes, which are inhibited by VGAM RNAs comprised in the 'operon-like' cluster of VGR3007 gene: VGAM1226 host target protein, VGAM1227 host target protein, VGAM1228 host target protein and VGAM1229 host target protein, herein schematically represented by VGAM1 HOST TARGET PROTEIN through VGAM3 HOST TARGET PROTEIN. The function of these host target genes is elaborated hereinabove with reference to VGAM1226, VGAM1227, VGAM1228 and VGAM1229.

FIG. 9 further provides a conceptual description of novel bioinformatically detected regulatory viral gene, referred to here as Viral Genomic Record 3008(VGR3008) viral gene, which encodes an 'operon-like' cluster of novel viral micro RNA-like genes, each of which in turn modulates expression of at least one host target gene, the function and utility of which at least one host target gene is known in the art.

VGR3008 gene, herein designated VGR GENE, is a novel bioinformatically detected regulatory, non protein coding, RNA viral gene. The method by which VGR3008 gene was detected is described hereinabove with reference to FIGS. 1-9.

VGR3008 gene encodes VGR3008 precursor RNA, herein designated VGR PRECURSOR RNA, an RNA molecule, typically several hundred nucleotides long.

VGR3008 precursor RNA folds spatially, forming VGR3008 folded precursor RNA, herein designated VGR FOLDED PRECURSOR RNA. It is appreciated that VGR3008 folded precursor RNA comprises a plurality of what is known in the art as 'hairpin' structures. These 'hairpin' structures are due to the fact that the nucleotide sequence of VGR3008 precursor RNA comprises a plurality of segments, the first half of each such segment having a nucleotide sequence which is at least a partial inversed-reversed sequence of the second half thereof, as is well known in the art.

VGR3008 folded precursor RNA is naturally processed by cellular enzymatic activity into at least 5 separate VGAM precursor RNAs, VGAM1230 precursor RNA, VGAM1231 precursor RNA, VGAM1232 precursor RNA, VGAM1233 precursor RNA and VGAM1234 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1230 RNA, VGAM1231 RNA, VGAM1232 RNA, VGAM1233 RNA and VGAM1234 RNA, herein schematically represented by VGAM1 RNA through VGAM3 RNA, each of which VGAM RNAs corresponding to VGAM RNA of FIG. 1.

VGAM1230 RNA, herein schematically represented by VGAM1 RNA through VGAM3 RNA, binds complementarily to a host target binding site located in an untranslated region of VGAM1230 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1230 host target RNA into VGAM1230 host target protein, herein schematically represented by VGAM1 HOST TARGET PROTEIN through VGAM3 HOST TARGET PROTEIN, all of FIG. 1.

VGAM1231 RNA, herein schematically represented by VGAM1 RNA through VGAM3 RNA, binds complementarily to a host target binding site located in an untranslated region of VGAM1231 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1231 host target RNA into VGAM1231 host target protein, herein schematically represented by VGAM1 HOST TARGET PROTEIN through VGAM3 HOST TARGET PROTEIN, all of FIG. 1.

VGAM1232 RNA, herein schematically represented by VGAM1 RNA through VGAM3 RNA, binds complementarily to a host target binding site located in an untranslated region of VGAM1232 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1232 host target RNA into VGAM1232 host target protein, herein schematically represented by VGAM1 HOST TARGET PROTEIN through VGAM3 HOST TARGET PROTEIN, all of FIG. 1.

VGAM1233 RNA, herein schematically represented by VGAM1 RNA through VGAM3 RNA, binds complementarily to a host target binding site located in an untranslated region of VGAM1233 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1233 host target RNA into VGAM1233 host target protein, herein schematically represented by VGAM1 HOST TARGET PROTEIN through VGAM3 HOST TARGET PROTEIN, all of FIG. 1.

VGAM1234 RNA, herein schematically represented by VGAM1 RNA through VGAM3 RNA, binds complementarily to a host target binding site located in an untranslated region of VGAM1234 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1234 host target RNA into VGAM1234 host target protein, herein schematically represented by VGAM1 HOST TARGET PROTEIN through VGAM3 HOST TARGET PROTEIN, all of FIG. 1.

It is appreciated that a function of VGR3008 gene, herein designated VGR GENE, is inhibition of expression of host target genes, as part of a novel viral mechanism of attacking a host. Accordingly, utilities of VGR3008 gene include diagnosis, prevention and treatment of viral infection by Equine Herpesvirus 2. Specific functions, and accordingly utilities, of VGR3008 gene correlate with, and may be deduced from, the identity of the host target genes, which are inhibited by VGAM RNAs comprised in the 'operon-like' cluster of VGR3008 gene: VGAM1230 host target protein, VGAM1231 host target protein, VGAM1232 host target protein, VGAM1233 host target protein and VGAM1234 host target protein, herein schematically represented by VGAM1 HOST TARGET PROTEIN through VGAM3 HOST TARGET PROTEIN. The function of these host target genes is elaborated hereinabove with reference to VGAM1230, VGAM1231, VGAM1232, VGAM1233 and VGAM1234. FIG. 9 further provides a conceptual description of novel bioinformatically detected regulatory viral gene, referred to here as Viral Genomic Record 3009(VGR3009) viral gene, which encodes an 'operon-like' cluster of novel viral micro RNA-like genes, each of which in turn modulates expression of at least one host target gene, the function and utility of which at least one host target gene is known in the art.

VGR3009 gene, herein designated VGR GENE, is a novel bioinformatically detected regulatory, non protein coding, RNA viral gene. The method by which VGR3009 gene was detected is described hereinabove with reference to FIGS. 1-9.

VGR3009 gene encodes VGR3009 precursor RNA, herein designated VGR PRECURSOR RNA, an RNA molecule, typically several hundred nucleotides long.

VGR3009 precursor RNA folds spatially, forming VGR3009 folded precursor RNA, herein designated VGR FOLDED PRECURSOR RNA. It is appreciated that VGR3009 folded precursor RNA comprises a plurality of what is known in the art as 'hairpin' structures. These 'hairpin' structures are due to the fact that the nucleotide sequence of VGR3009 precursor RNA comprises a plurality of segments, the first half of each such segment having a nucleotide sequence which is at least a partial inversed-reversed sequence of the second half thereof, as is well known in the art.

VGR3009 folded precursor RNA is naturally processed by cellular enzymatic activity into at least 6 separate VGAM precursor RNAs, VGAM1235 precursor RNA, VGAM1236 precursor RNA, VGAM1237 precursor RNA, VGAM1238 precursor RNA, VGAM1239 precursor RNA and VGAM1240 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1235 RNA, VGAM1236 RNA, VGAM1237 RNA, VGAM1238 RNA, VGAM1239 RNA and VGAM1240 RNA, herein schematically represented by VGAM1 RNA through VGAM3 RNA, each of which VGAM RNAs corresponding to VGAM RNA of FIG. 1.

VGAM1235 RNA, herein schematically represented by VGAM1 RNA through VGAM3 RNA, binds complementarily to a host target binding site located in an untranslated region of VGAM1235 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1235 host target RNA into VGAM1235 host target protein, herein schematically represented by VGAM1 HOST TARGET PROTEIN through VGAM3 HOST TARGET PROTEIN, all of FIG. 1.

VGAM1236 RNA, herein schematically represented by VGAM1 RNA through VGAM3 RNA, binds complementarily to a host target binding site located in an untranslated region of VGAM1236 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1236 host target RNA into VGAM1236 host target protein, herein schematically represented by VGAM1 HOST TARGET PROTEIN through VGAM3 HOST TARGET PROTEIN, all of FIG. 1.

VGAM1237 RNA, herein schematically represented by VGAM1 RNA through VGAM3 RNA, binds complementarily to a host target binding site located in an untranslated region of VGAM1237 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1237 host target RNA into VGAM1237 host target protein, herein schematically represented by VGAM1 HOST TARGET PROTEIN through VGAM3 HOST TARGET PROTEIN, all of FIG. 1.

VGAM1238 RNA, herein schematically represented by VGAM1 RNA through VGAM3 RNA, binds complementarily to a host target binding site located in an untranslated region of VGAM1238 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1238 host target RNA into VGAM1238 host target protein, herein schematically represented by VGAM1 HOST TARGET PROTEIN through VGAM3 HOST TARGET PROTEIN, all of FIG. 1.

VGAM1239 RNA, herein schematically represented by VGAM1 RNA through VGAM3 RNA, binds complementarily to a host target binding site located in an untranslated region of VGAM1239 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1239 host target RNA into VGAM1239 host target protein, herein schematically represented by VGAM1 HOST TARGET PROTEIN through VGAM3 HOST TARGET PROTEIN, all of FIG. 1.

VGAM1240 RNA, herein schematically represented by VGAM1 RNA through VGAM3 RNA, binds complementarily to a host target binding site located in an untranslated region of VGAM1240 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1240 host target RNA into VGAM1240 host target protein, herein schematically represented by VGAM1 HOST TARGET PROTEIN through VGAM3 HOST TARGET PROTEIN, all of FIG. 1.

It is appreciated that a function of VGR3009 gene, herein designated VGR GENE, is inhibition of expression of host target genes, as part of a novel viral mechanism of attacking a host. Accordingly, utilities of VGR3009 gene include diagnosis, prevention and treatment of viral infection by Bovine Herpesvirus 4. Specific functions, and accordingly utilities, of VGR3009 gene correlate with, and may be deduced from, the identity of the host target genes, which are inhibited by VGAM RNAs comprised in the 'operon-like' cluster of VGR3009 gene: VGAM1235 host target protein, VGAM1236 host target protein, VGAM1237 host target protein, VGAM1238 host target protein, VGAM1239 host target protein and VGAM1240 host target protein, herein schematically represented by VGAM1 HOST TARGET PROTEIN through VGAM3 HOST TARGET PROTEIN. The function of these host target genes is elaborated hereinabove with reference to VGAM1235, VGAM1236, VGAM1237, VGAM1238, VGAM1239 and VGAM1240. FIG. 9 further provides a conceptual description of novel bioinformatically detected regulatory viral gene, referred to here as Viral Genomic Record 3010(VGR3010) viral gene, which encodes an 'operon-like' cluster of novel viral micro RNA-like genes, each of which in turn modulates expression of at least one host target gene, the function and utility of which at least one host target gene is known in the art.

VGR3010 gene, herein designated VGR GENE, is a novel bioinformatically detected regulatory, non protein coding, RNA viral gene. The method by which VGR3010 gene was detected is described hereinabove with reference to FIGS. 1-9.

VGR3010 gene encodes VGR3010 precursor RNA, herein designated VGR PRECURSOR RNA, an RNA molecule, typically several hundred nucleotides long.

VGR3010 precursor RNA folds spatially, forming VGR3010 folded precursor RNA, herein designated VGR FOLDED PRECURSOR RNA. It is appreciated that VGR3010 folded precursor RNA comprises a plurality of what is known in the art as 'hairpin' structures. These 'hairpin' structures are due to the fact that the nucleotide sequence of VGR3010 precursor RNA comprises a plurality of segments, the first half of each such segment having a nucleotide sequence which is at least a partial inversed-reversed sequence of the second half thereof, as is well known in the art.

VGR3010 folded precursor RNA is naturally processed by cellular enzymatic activity into at least 2 separate VGAM precursor RNAs, VGAM1241 precursor RNA and VGAM1242 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1241 RNA and VGAM1242 RNA, herein schematically represented by VGAM1 RNA through VGAM3 RNA, each of which VGAM RNAs corresponding to VGAM RNA of FIG. 1.

VGAM1241 RNA, herein schematically represented by VGAM1 RNA through VGAM3 RNA, binds complementarily to a host target binding site located in an untranslated region of VGAM1241 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1241 host target RNA into VGAM1241 host target protein, herein schematically represented by VGAM1 HOST TARGET PROTEIN through VGAM3 HOST TARGET PROTEIN, all of FIG. 1.

VGAM1242 RNA, herein schematically represented by VGAM1 RNA through VGAM3 RNA, binds complementarily to a host target binding site located in an untranslated region of VGAM1242 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1242 host target RNA into VGAM1242 host target protein, herein schematically represented by VGAM1 HOST TARGET PROTEIN through VGAM3 HOST TARGET PROTEIN, all of FIG. 1.

It is appreciated that a function of VGR3010 gene, herein designated VGR GENE, is inhibition of expression of host target genes, as part of a novel viral mechanism of attacking a host. Accordingly, utilities of VGR3010 gene include diagnosis, prevention and treatment of viral infection by Gallid Herpesvirus 3. Specific functions, and accordingly utilities, of VGR3010 gene correlate with, and may be deduced from, the identity of the host target genes, which are inhibited by VGAM RNAs comprised in the 'operon-like' cluster of VGR3010 gene: VGAM1241 host target protein and VGAM1242 host target protein, herein schematically represented by VGAM1 HOST TARGET PROTEIN through VGAM3 HOST TARGET PROTEIN. The function of these host target genes is elaborated hereinabove with reference to VGAM1241 and VGAM1242. FIG. 9 further provides a conceptual description of novel bioinformatically detected regulatory viral gene, referred to here as Viral Genomic Record 3011(VGR3011) viral gene, which encodes an 'operon-like' cluster of novel viral micro RNA-like genes, each of which in turn modulates expression of at least one host target gene, the function and utility of which at least one host target gene is known in the art.

VGR3011 gene, herein designated VGR GENE, is a novel bioinformatically detected regulatory, non protein coding, RNA viral gene. The method by which VGR3011 gene was detected is described hereinabove with reference to FIGS. 1-9.

VGR3011 gene encodes VGR3011 precursor RNA, herein designated VGR PRECURSOR RNA, an RNA molecule, typically several hundred nucleotides long.

VGR3011 precursor RNA folds spatially, forming VGR3011 folded precursor RNA, herein designated VGR FOLDED PRECURSOR RNA. It is appreciated that VGR3011 folded precursor RNA comprises a plurality of what is known in the art as 'hairpin' structures. These 'hairpin' structures are due to the fact that the nucleotide sequence of VGR3011 precursor RNA comprises a plurality of segments, the first half of each such segment having a nucleotide sequence which is at least a partial inversed-reversed sequence of the second half thereof, as is well known in the art.

VGR3011 folded precursor RNA is naturally processed by cellular enzymatic activity into at least 4 separate VGAM precursor RNAs, VGAM1243 precursor RNA, VGAM1244 precursor RNA, VGAM1245 precursor RNA and VGAM1246 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1243 RNA, VGAM1244 RNA, VGAM1245 RNA and VGAM1246 RNA, herein schematically represented by VGAM1 RNA through VGAM3 RNA, each of which VGAM RNAs corresponding to VGAM RNA of FIG. 1.

VGAM1243 RNA, herein schematically represented by VGAM1 RNA through VGAM3 RNA, binds complementarily to a host target binding site located in an untranslated region of VGAM1243 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1243 host target RNA into VGAM1243 host target protein, herein schematically represented by VGAM1 HOST TARGET PROTEIN through VGAM3 HOST TARGET PROTEIN, all of FIG. 1.

VGAM1244 RNA, herein schematically represented by VGAM1 RNA through VGAM3 RNA, binds complementarily to a host target binding site located in an untranslated region of VGAM1244 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1244 host target RNA into VGAM1244 host target protein, herein schematically represented by VGAM1 HOST TARGET PROTEIN through VGAM3 HOST TARGET PROTEIN, all of FIG. 1.

VGAM1245 RNA, herein schematically represented by VGAM1 RNA through VGAM3 RNA, binds complementarily to a host target binding site located in an untranslated region of VGAM1245 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1245 host target RNA into VGAM1245 host target protein, herein schematically represented by VGAM1 HOST TARGET PROTEIN through VGAM3 HOST TARGET PROTEIN, all of FIG. 1.

VGAM1246 RNA, herein schematically represented by VGAM1 RNA through VGAM3 RNA, binds complementarily to a host target binding site located in an untranslated region of VGAM1246 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1246 host target RNA into VGAM1246 host target protein, herein schematically represented by VGAM1 HOST TARGET PROTEIN through VGAM3 HOST TARGET PROTEIN, all of FIG. 1.

It is appreciated that a function of VGR3011 gene, herein designated VGR GENE, is inhibition of expression of host target genes, as part of a novel viral mechanism of attacking a host. Accordingly, utilities of VGR3011 gene include diagnosis, prevention and treatment of viral infection by Turkey Adenovirus 3. Specific functions, and accordingly utilities, of VGR3011 gene correlate with, and may be deduced from, the identity of the host target genes, which are inhibited by VGAM RNAs comprised in the 'operon-like' cluster of VGR3011 gene: VGAM1243 host target protein, VGAM1244 host target protein, VGAM1245 host target protein and VGAM1246 host target protein, herein schematically represented by VGAM1 HOST TARGET PROTEIN through VGAM3 HOST TARGET PROTEIN. The function of these host target genes is elaborated hereinabove with reference to VGAM1243, VGAM1244, VGAM1245 and VGAM1246. FIG. 9 further provides a conceptual description of novel bioinformatically detected regulatory viral gene, referred to here as Viral Genomic Record 3012(VGR3012) viral gene, which encodes an 'operon-like' cluster of novel viral micro RNA-like genes, each of which in turn modulates expression of at least one host target gene, the function and utility of which at least one host target gene is known in the art.

VGR3012 gene, herein designated VGR GENE, is a novel bioinformatically detected regulatory, non protein coding, RNA viral gene. The method by which VGR3012 gene was detected is described hereinabove with reference to FIGS. 1-9.

VGR3012 gene encodes VGR3012 precursor RNA, herein designated VGR PRECURSOR RNA, an RNA molecule, typically several hundred nucleotides long.

VGR3012 precursor RNA folds spatially, forming VGR3012 folded precursor RNA, herein designated VGR FOLDED PRECURSOR RNA. It is appreciated that VGR3012 folded precursor RNA comprises a plurality of what is known in the art as 'hairpin' structures. These 'hairpin' structures are due to the fact that the nucleotide sequence of VGR3012 precursor RNA comprises a plurality of segments, the first half of each such segment having a nucleotide sequence which is at least a partial inversed-reversed sequence of the second half thereof, as is well known in the art.

VGR3012 folded precursor RNA is naturally processed by cellular enzymatic activity into at least 5 separate VGAM precursor RNAs, VGAM1247 precursor RNA, VGAM1248 precursor RNA, VGAM1249 precursor RNA, VGAM1250 precursor RNA and VGAM1251 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1247 RNA, VGAM1248 RNA, VGAM1249 RNA, VGAM1250 RNA and VGAM1251 RNA, herein schematically represented by VGAM1 RNA through VGAM3 RNA, each of which VGAM RNAs corresponding to VGAM RNA of FIG. 1.

VGAM1247 RNA, herein schematically represented by VGAM1 RNA through VGAM3 RNA, binds complementarily to a host target binding site located in an untranslated region of VGAM1247 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1247 host target RNA into VGAM1247 host target protein, herein schematically represented by VGAM1 HOST TARGET PROTEIN through VGAM3 HOST TARGET PROTEIN, all of FIG. 1.

VGAM1248 RNA, herein schematically represented by VGAM1 RNA through VGAM3 RNA, binds complementarily to a host target binding site located in an untranslated region of VGAM1248 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1248 host target RNA into VGAM1248 host target protein, herein schematically represented by VGAM1 HOST TARGET PROTEIN through VGAM3 HOST TARGET PROTEIN, all of FIG. 1.

VGAM1249 RNA, herein schematically represented by VGAM1 RNA through VGAM3 RNA, binds complementarily to a host target binding site located in an untranslated region of VGAM1249 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1249 host target RNA into VGAM1249 host target protein, herein schematically represented by VGAM1 HOST TARGET PROTEIN through VGAM3 HOST TARGET PROTEIN, all of FIG. 1.

VGAM1250 RNA, herein schematically represented by VGAM1 RNA through VGAM3 RNA, binds complementarily to a host target binding site located in an untranslated region of VGAM1250 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1250 host target RNA into VGAM1250 host target protein, herein schematically represented by VGAM1 HOST TARGET PROTEIN through VGAM3 HOST TARGET PROTEIN, all of FIG. 1.

VGAM1251 RNA, herein schematically represented by VGAM1 RNA through VGAM3 RNA, binds complementarily to a host target binding site located in an untranslated region of VGAM1251 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1251 host target RNA into VGAM1251 host target protein, herein schematically represented by VGAM1 HOST TARGET PROTEIN through VGAM3 HOST TARGET PROTEIN, all of FIG. 1.

It is appreciated that a function of VGR3012 gene, herein designated VGR GENE, is inhibition of expression of host target genes, as part of a novel viral mechanism of attacking a host. Accordingly, utilities of VGR3012 gene include diagnosis, prevention and treatment of viral infection by Monkeypox Virus. Specific functions, and accordingly utilities, of VGR3012 gene correlate with, and may be deduced from, the identity of the host target genes, which are inhibited by VGAM RNAs comprised in the 'operon-like' cluster of VGR3012 gene: VGAM1247 host target protein, VGAM1248 host target protein, VGAM1249 host target protein, VGAM1250 host target protein and VGAM1251 host target protein, herein schematically represented by VGAM1 HOST TARGET PROTEIN through VGAM3 HOST TARGET PROTEIN. The function of these host target genes is elaborated hereinabove with reference to VGAM1247, VGAM1248, VGAM1249, VGAM1250 and VGAM1251.

FIG. 9 further provides a conceptual description of novel bioinformatically detected regulatory viral gene, referred to here as Viral Genomic Record 3013(VGR3013) viral gene, which encodes an 'operon-like' cluster of novel viral micro RNA-like genes, each of which in turn modulates expression of at least one host target gene, the function and utility of which at least one host target gene is known in the art.

VGR3013 gene, herein designated VGR GENE, is a novel bioinformatically detected regulatory, non protein coding, RNA viral gene. The method by which VGR3013 gene was detected is described hereinabove with reference to FIGS. 1-9.

VGR3013 gene encodes VGR3013 precursor RNA, herein designated VGR PRECURSOR RNA, an RNA molecule, typically several hundred nucleotides long.

VGR3013 precursor RNA folds spatially, forming VGR3013 folded precursor RNA, herein designated VGR FOLDED PRECURSOR RNA. It is appreciated that VGR3013 folded precursor RNA comprises a plurality of what is known in the art as 'hairpin' structures. These 'hairpin' structures are due to the fact that the nucleotide sequence of VGR3013 precursor RNA comprises a plurality of segments, the first half of each such segment having a nucleotide sequence which is at least a partial inversed-reversed sequence of the second half thereof, as is well known in the art.

VGR3013 folded precursor RNA is naturally processed by cellular enzymatic activity into at least 5 separate VGAM precursor RNAs, VGAM1252 precursor RNA, VGAM1253 precursor RNA, VGAM1254 precursor RNA, VGAM1255 precursor RNA and VGAM1256 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1252 RNA, VGAM1253 RNA, VGAM1254 RNA, VGAM1255 RNA and VGAM1256 RNA, herein schematically represented by VGAM1 RNA through VGAM3 RNA, each of which VGAM RNAs corresponding to VGAM RNA of FIG. 1.

VGAM1252 RNA, herein schematically represented by VGAM1 RNA through VGAM3 RNA, binds complementarily to a host target binding site located in an untranslated region of VGAM1252 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1252 host target RNA into VGAM1252 host target protein, herein schematically represented by VGAM1 HOST TARGET PROTEIN through VGAM3 HOST TARGET PROTEIN, all of FIG. 1.

VGAM1253 RNA, herein schematically represented by VGAM1 RNA through VGAM3 RNA, binds complementarily to a host target binding site located in an untranslated region of VGAM1253 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1253 host target RNA into VGAM1253 host target protein, herein schematically represented by VGAM1 HOST TARGET PROTEIN through VGAM3 HOST TARGET PROTEIN, all of FIG. 1.

VGAM1254 RNA, herein schematically represented by VGAM1 RNA through VGAM3 RNA, binds complementarily to a host target binding site located in an untranslated region of VGAM1254 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1254 host target RNA into VGAM1254 host target protein, herein schematically represented by VGAM1 HOST TARGET PROTEIN through VGAM3 HOST TARGET PROTEIN, all of FIG. 1.

VGAM1255 RNA, herein schematically represented by VGAM1 RNA through VGAM3 RNA, binds complementarily to a host target binding site located in an untranslated region of VGAM1255 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1255 host target RNA into VGAM1255 host target protein, herein schematically represented by VGAM1 HOST TARGET PROTEIN through VGAM3 HOST TARGET PROTEIN, all of FIG. 1.

VGAM1256 RNA, herein schematically represented by VGAM1 RNA through VGAM3 RNA, binds complementarily to a host target binding site located in an untranslated region of VGAM1256 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1256 host target RNA into VGAM1256 host target protein, herein schematically represented by VGAM1 HOST TARGET PROTEIN through VGAM3 HOST TARGET PROTEIN, all of FIG. 1.

It is appreciated that a function of VGR3013 gene, herein designated VGR GENE, is inhibition of expression of host target genes, as part of a novel viral mechanism of attacking a host. Accordingly, utilities of VGR3013 gene include diagnosis, prevention and treatment of viral infection by Human Adenovirus D. Specific functions, and accordingly utilities, of VGR3013 gene correlate with, and may be deduced from, the identity of the host target genes, which are inhibited by VGAM RNAs comprised in the 'operon-like' cluster of VGR3013 gene: VGAM1252 host target protein, VGAM1253 host target protein, VGAM1254 host target protein, VGAM1255 host target protein and VGAM1256 host target protein, herein schematically represented by VGAM1 HOST TARGET PROTEIN through VGAM3 HOST TARGET PROTEIN. The function of these host target genes is elaborated hereinabove with reference to VGAM1252, VGAM1253, VGAM1254, VGAM1255 and VGAM1256.

FIG. 9 further provides a conceptual description of novel bioinformatically detected regulatory viral gene, referred to here as Viral Genomic Record 3014(VGR3014) viral gene, which encodes an 'operon-like' cluster of novel viral micro RNA-like genes, each of which in turn modulates expression of at least one host target gene, the function and utility of which at least one host target gene is known in the art.

VGR3014 gene, herein designated VGR GENE, is a novel bioinformatically detected regulatory, non protein coding, RNA viral gene. The method by which VGR3014 gene was detected is described hereinabove with reference to FIGS. 1-9.

VGR3014 gene encodes VGR3014 precursor RNA, herein designated VGR PRECURSOR RNA, an RNA molecule, typically several hundred nucleotides long.

VGR3014 precursor RNA folds spatially, forming VGR3014 folded precursor RNA, herein designated VGR FOLDED PRECURSOR RNA. It is appreciated that VGR3014 folded precursor RNA comprises a plurality of what is known in the art as 'hairpin' structures. These 'hairpin' structures are due to the fact that the nucleotide sequence of VGR3014 precursor RNA comprises a plurality of segments, the first half of each such segment having a nucleotide sequence which is at least a partial inversed-reversed sequence of the second half thereof, as is well known in the art.

VGR3014 folded precursor RNA is naturally processed by cellular enzymatic activity into at least 2 separate VGAM precursor RNAs, VGAM1257 precursor RNA and VGAM1258 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1257 RNA and VGAM1258 RNA, herein schematically represented by VGAM1 RNA through VGAM3 RNA, each of which VGAM RNAs corresponding to VGAM RNA of FIG. 1.

VGAM1257 RNA, herein schematically represented by VGAM1 RNA through VGAM3 RNA, binds complementarily to a host target binding site located in an untranslated region of VGAM1257 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1257 host target RNA into VGAM1257 host target protein, herein schematically represented by VGAM1 HOST TARGET PROTEIN through VGAM3 HOST TARGET PROTEIN, all of FIG. 1.

VGAM1258 RNA, herein schematically represented by VGAM1 RNA through VGAM3 RNA, binds complementarily to a host target binding site located in an untranslated region of VGAM1258 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1258 host target RNA into VGAM1258 host target protein, herein schematically represented by VGAM1 HOST TARGET PROTEIN through VGAM3 HOST TARGET PROTEIN, all of FIG. 1.

It is appreciated that a function of VGR3014 gene, herein designated VGR GENE, is inhibition of expression of host target genes, as part of a novel viral mechanism of attacking a host. Accordingly, utilities of VGR3014 gene include diagnosis, prevention and treatment of viral infection by Yaba-like Disease Virus. Specific functions, and accordingly utilities, of VGR3014 gene correlate with, and may be deduced from, the identity of the host target genes, which are inhibited by VGAM RNAs comprised in the 'operon-like' cluster of VGR3014 gene: VGAM1257 host target protein and VGAM1258 host target protein, herein schematically represented by VGAM1 HOST TARGET PROTEIN through VGAM3 HOST TARGET PROTEIN. The function of these host target genes is elaborated hereinabove with reference to VGAM1257 and VGAM1258. FIG. 9 further provides a conceptual description of novel bioinformatically detected regulatory viral gene, referred to here as Viral Genomic Record 3015(VGR3015) viral gene, which encodes an 'operon-like' cluster of novel viral micro RNA-like genes, each of which in turn modulates expression of at least one host target gene, the function and utility of which at least one host target gene is known in the art.

VGR3015 gene, herein designated VGR GENE, is a novel bioinformatically detected regulatory, non protein coding, RNA viral gene. The method by which VGR3015 gene was detected is described hereinabove with reference to FIGS. 1-9.

VGR3015 gene encodes VGR3015 precursor RNA, herein designated VGR PRECURSOR RNA, an RNA molecule, typically several hundred nucleotides long.

VGR3015 precursor RNA folds spatially, forming VGR3015 folded precursor RNA, herein designated VGR FOLDED PRECURSOR RNA. It is appreciated that VGR3015 folded precursor RNA comprises a plurality of what is known in the art as 'hairpin' structures. These 'hairpin' structures are due to the fact that the nucleotide sequence of VGR3015 precursor RNA comprises a plurality of segments, the first half of each such segment having a nucleotide sequence which is at least a partial inversed-reversed sequence of the second half thereof, as is well known in the art.

VGR3015 folded precursor RNA is naturally processed by cellular enzymatic activity into at least 4 separate VGAM precursor RNAs, VGAM1259 precursor RNA, VGAM1260 precursor RNA, VGAM1261 precursor RNA and VGAM1262 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1259 RNA, VGAM1260 RNA, VGAM1261 RNA and VGAM1262 RNA, herein schematically represented by VGAM1 RNA through VGAM3 RNA, each of which VGAM RNAs corresponding to VGAM RNA of FIG. 1.

VGAM1259 RNA, herein schematically represented by VGAM1 RNA through VGAM3 RNA, binds complementarily to a host target binding site located in an untranslated region of VGAM1259 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1259 host target RNA into VGAM1259 host target protein, herein schematically represented by VGAM1 HOST TARGET PROTEIN through VGAM3 HOST TARGET PROTEIN, all of FIG. 1.

VGAM1260 RNA, herein schematically represented by VGAM1 RNA through VGAM3 RNA, binds complementarily to a host target binding site located in an untranslated region of VGAM1260 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1260 host target RNA into VGAM1260 host target protein, herein schematically represented by VGAM1 HOST TARGET PROTEIN through VGAM3 HOST TARGET PROTEIN, all of FIG. 1.

VGAM1261 RNA, herein schematically represented by VGAM1 RNA through VGAM3 RNA, binds complementarily to a host target binding site located in an untranslated region of VGAM1261 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1261 host target RNA into VGAM1261 host target protein, herein schematically represented by VGAM1 HOST TARGET PROTEIN through VGAM3 HOST TARGET PROTEIN, all of FIG. 1.

VGAM1262 RNA, herein schematically represented by VGAM1 RNA through VGAM3 RNA, binds complementarily to a host target binding site located in an untranslated region of VGAM1262 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1262 host target RNA into VGAM1262 host target protein, herein schematically represented by VGAM1 HOST TARGET PROTEIN through VGAM3 HOST TARGET PROTEIN, all of FIG. 1.

It is appreciated that a function of VGR3015 gene, herein designated VGR GENE, is inhibition of expression of host target genes, as part of a novel viral mechanism of attacking a host. Accordingly, utilities of VGR3015 gene include diagnosis, prevention and treatment of viral infection by Blackcurrant Reversion Virus. Specific functions, and accordingly utilities, of VGR3015 gene correlate with, and may be deduced from, the identity of the host target genes, which are inhibited by VGAM RNAs comprised in the 'operon-like' cluster of VGR3015 gene: VGAM1259 host target protein, VGAM1260 host target protein, VGAM1261 host target protein and VGAM1262 host target protein, herein schematically represented by VGAM1 HOST TARGET PROTEIN through VGAM3 HOST TARGET PROTEIN. The function of these host target genes is elaborated hereinabove with reference to VGAM1259, VGAM1260, VGAM1261 and VGAM1262.

FIG. 9 further provides a conceptual description of novel bioinformatically detected regulatory viral gene, referred to here as Viral Genomic Record 3016(VGR3016) viral gene, which encodes an 'operon-like' cluster of novel viral micro RNA-like genes, each of which in turn modulates expression of at least one host target gene, the function and utility of which at least one host target gene is known in the art.

VGR3016 gene, herein designated VGR GENE, is a novel bioinformatically detected regulatory, non protein coding, RNA viral gene. The method by which VGR3016 gene was detected is described hereinabove with reference to FIGS. 1-9.

VGR3016 gene encodes VGR3016 precursor RNA, herein designated VGR PRECURSOR RNA, an RNA molecule, typically several hundred nucleotides long.

VGR3016 precursor RNA folds spatially, forming VGR3016 folded precursor RNA, herein designated VGR FOLDED PRECURSOR RNA. It is appreciated that VGR3016 folded precursor RNA comprises a plurality of what is known in the art as 'hairpin' structures. These 'hairpin' structures are due to the fact that the nucleotide sequence of VGR3016 precursor RNA comprises a plurality of segments, the first half of each such segment having a nucleotide sequence which is at least a partial inversed-reversed sequence of the second half thereof, as is well known in the art.

VGR3016 folded precursor RNA is naturally processed by cellular enzymatic activity into at least 5 separate VGAM precursor RNAs, VGAM1263 precursor RNA, VGAM1264 precursor RNA, VGAM1265 precursor RNA, VGAM1266 precursor RNA and VGAM1267 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1263 RNA, VGAM1264 RNA, VGAM1265 RNA, VGAM1266 RNA and VGAM1267 RNA, herein schematically represented by VGAM1 RNA through VGAM3 RNA, each of which VGAM RNAs corresponding to VGAM RNA of FIG. 1.

VGAM1263 RNA, herein schematically represented by VGAM1 RNA through VGAM3 RNA, binds complementarily to a host target binding site located in an untranslated region of VGAM1263 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1263 host target RNA into VGAM1263 host target protein, herein schematically represented by VGAM1 HOST TARGET PROTEIN through VGAM3 HOST TARGET PROTEIN, all of FIG. 1.

VGAM1264 RNA, herein schematically represented by VGAM1 RNA through VGAM3 RNA, binds complementarily to a host target binding site located in an untranslated region of VGAM1264 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1264 host target RNA into VGAM1264 host target protein, herein schematically represented by VGAM1 HOST TARGET PROTEIN through VGAM3 HOST TARGET PROTEIN, all of FIG. 1.

VGAM1265 RNA, herein schematically represented by VGAM1 RNA through VGAM3 RNA, binds complementarily to a host target binding site located in an untranslated region of VGAM1265 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1265 host target RNA into VGAM1265 host target protein, herein schematically represented by VGAM1 HOST TARGET PROTEIN through VGAM3 HOST TARGET PROTEIN, all of FIG. 1.

VGAM1266 RNA, herein schematically represented by VGAM1 RNA through VGAM3 RNA, binds complementarily to a host target binding site located in an untranslated region of VGAM1266 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1266 host target RNA into VGAM1266 host target protein, herein schematically represented by VGAM1 HOST TARGET PROTEIN through VGAM3 HOST TARGET PROTEIN, all of FIG. 1.

VGAM1267 RNA, herein schematically represented by VGAM1 RNA through VGAM3 RNA, binds complementarily to a host target binding site located in an untranslated region of VGAM1267 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1267 host target RNA into VGAM1267 host target protein, herein schematically represented by VGAM1 HOST TARGET PROTEIN through VGAM3 HOST TARGET PROTEIN, all of FIG. 1.

It is appreciated that a function of VGR3016 gene, herein designated VGR GENE, is inhibition of expression of host target genes, as part of a novel viral mechanism of attacking a host. Accordingly, utilities of VGR3016 gene include diagnosis, prevention and treatment of viral infection by Beet Soil-borne Mosaic Virus. Specific functions, and accordingly utilities, of VGR3016 gene correlate with, and may be deduced from, the identity of the host target genes, which are inhibited by VGAM RNAs comprised in the 'operon-like' cluster of VGR3016 gene: VGAM1263 host target protein, VGAM1264 host target protein, VGAM1265 host target protein, VGAM1266 host target protein and VGAM1267 host target protein, herein schematically represented by VGAM1 HOST TARGET PROTEIN through VGAM3 HOST TARGET PROTEIN. The function of these host target genes is elaborated hereinabove with reference to VGAM1263, VGAM1264, VGAM1265, VGAM1266 and VGAM1267. FIG. 9 further provides a conceptual description of novel bioinformatically detected regulatory viral gene, referred to here as Viral Genomic Record 3017(VGR3017) viral gene, which encodes an 'operon-like' cluster of novel viral micro RNA-like genes, each of which in turn modulates expression of at least one host target gene, the function and utility of which at least one host target gene is known in the art.

VGR3017 gene, herein designated VGR GENE, is a novel bioinformatically detected regulatory, non protein coding, RNA viral gene. The method by which VGR3017 gene was detected is described hereinabove with reference to FIGS. 1-9.

VGR3017 gene encodes VGR3017 precursor RNA, herein designated VGR PRECURSOR RNA, an RNA molecule, typically several hundred nucleotides long.

VGR3017 precursor RNA folds spatially, forming VGR3017 folded precursor RNA, herein designated VGR FOLDED PRECURSOR RNA. It is appreciated that VGR3017 folded precursor RNA comprises a plurality of what is known in the art as 'hairpin' structures. These 'hairpin' structures are due to the fact that the nucleotide sequence of VGR3017 precursor RNA comprises a plurality of segments, the first half of each such segment having a nucleotide sequence which is at least a partial inversed-reversed sequence of the second half thereof, as is well known in the art.

VGR3017 folded precursor RNA is naturally processed by cellular enzymatic activity into at least 5 separate VGAM precursor RNAs, VGAM1268 precursor RNA, VGAM1269 precursor RNA, VGAM1270 precursor RNA, VGAM1271 precursor RNA and VGAM1272 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1268 RNA, VGAM1269 RNA, VGAM1270 RNA, VGAM1271 RNA and VGAM1272 RNA, herein schematically represented by VGAM1 RNA through VGAM3 RNA, each of which VGAM RNAs corresponding to VGAM RNA of FIG. 1.

VGAM1268 RNA, herein schematically represented by VGAM1 RNA through VGAM3 RNA, binds complementarily to a host target binding site located in an untranslated region of VGAM1268 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1268 host target RNA into VGAM1268 host target protein, herein schematically represented by VGAM1 HOST TARGET PROTEIN through VGAM3 HOST TARGET PROTEIN, all of FIG. 1.

VGAM1269 RNA, herein schematically represented by VGAM1 RNA through VGAM3 RNA, binds complementarily to a host target binding site located in an untranslated region of VGAM1269 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1269 host target RNA into VGAM1269 host target protein, herein schematically represented by VGAM1 HOST TARGET PROTEIN through VGAM3 HOST TARGET PROTEIN, all of FIG. 1.

VGAM1270 RNA, herein schematically represented by VGAM1 RNA through VGAM3 RNA, binds complementarily to a host target binding site located in an untranslated region of VGAM1270 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1270 host target RNA into VGAM1270 host target protein, herein schematically represented by VGAM1 HOST TARGET PROTEIN through VGAM3 HOST TARGET PROTEIN, all of FIG. 1.

VGAM1271 RNA, herein schematically represented by VGAM1 RNA through VGAM3 RNA, binds complementarily to a host target binding site located in an untranslated region of VGAM1271 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1271 host target RNA into VGAM1271 host target protein, herein schematically represented by VGAM1 HOST TARGET PROTEIN through VGAM3 HOST TARGET PROTEIN, all of FIG. 1.

VGAM1272 RNA, herein schematically represented by VGAM1 RNA through VGAM3 RNA, binds complementarily to a host target binding site located in an untranslated region of VGAM1272 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1272 host target RNA into VGAM1272 host target protein, herein schematically represented by VGAM1 HOST TARGET PROTEIN through VGAM3 HOST TARGET PROTEIN, all of FIG. 1.

It is appreciated that a function of VGR3017 gene, herein designated VGR GENE, is inhibition of expression of host target genes, as part of a novel viral mechanism of attacking a host. Accordingly, utilities of VGR3017 gene include diagnosis, prevention and treatment of viral infection by Grapevine Virus A. Specific functions, and accordingly utilities, of VGR3017 gene correlate with, and may be deduced from, the identity of the host target genes, which are inhibited by VGAM RNAs comprised in the 'operon-like' cluster of VGR3017 gene: VGAM1268 host target protein, VGAM1269 host target protein, VGAM1270 host target protein, VGAM1271 host target protein and VGAM1272 host target protein, herein schematically represented by VGAM1 HOST TARGET PROTEIN through VGAM3 HOST TARGET PROTEIN. The function of these host target genes is elaborated hereinabove with reference to VGAM1268, VGAM1269, VGAM1270, VGAM1271 and VGAM1272. FIG. 9 further provides a conceptual description of novel bioinformatically detected regulatory viral gene, referred to here as Viral Genomic Record 3018(VGR3018) viral gene, which encodes an 'operon-like' cluster of novel viral micro RNA-like genes, each of which in turn modulates expression of at least one host target gene, the function and utility of which at least one host target gene is known in the art.

VGR3018 gene, herein designated VGR GENE, is a novel bioinformatically detected regulatory, non protein coding, RNA viral gene. The method by which VGR3018 gene was detected is described hereinabove with reference to FIGS. 1-9.

VGR3018 gene encodes VGR3018 precursor RNA, herein designated VGR PRECURSOR RNA, an RNA molecule, typically several hundred nucleotides long.

VGR3018 precursor RNA folds spatially, forming VGR3018 folded precursor RNA, herein designated VGR FOLDED PRECURSOR RNA. It is appreciated that VGR3018 folded precursor RNA comprises a plurality of what is known in the art as 'hairpin' structures. These 'hairpin' structures are due to the fact that the nucleotide sequence of VGR3018 precursor RNA comprises a plurality of segments, the first half of each such segment having a nucleotide sequence which is at least a partial inversed-reversed sequence of the second half thereof, as is well known in the art.

VGR3018 folded precursor RNA is naturally processed by cellular enzymatic activity into at least 4 separate VGAM precursor RNAs, VGAM1273 precursor RNA, VGAM1274 precursor RNA, VGAM1275 precursor RNA and VGAM1276 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1273 RNA, VGAM1274 RNA, VGAM1275 RNA and VGAM1276 RNA, herein schematically represented by VGAM1 RNA through VGAM3 RNA, each of which VGAM RNAs corresponding to VGAM RNA of FIG. 1.

VGAM1273 RNA, herein schematically represented by VGAM1 RNA through VGAM3 RNA, binds complementarily to a host target binding site located in an untranslated region of VGAM1273 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1273 host target RNA into VGAM1273 host target protein, herein schematically represented by VGAM1 HOST TARGET PROTEIN through VGAM3 HOST TARGET PROTEIN, all of FIG. 1.

VGAM1274 RNA, herein schematically represented by VGAM1 RNA through VGAM3 RNA, binds complementarily to a host target binding site located in an untranslated region of VGAM1274 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1274 host target RNA into VGAM1274 host target protein, herein schematically represented by VGAM1 HOST TARGET PROTEIN through VGAM3 HOST TARGET PROTEIN, all of FIG. 1.

VGAM1275 RNA, herein schematically represented by VGAM1 RNA through VGAM3 RNA, binds complementarily to a host target binding site located in an untranslated region of VGAM1275 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1275 host target RNA into VGAM1275 host target protein, herein schematically represented by VGAM1 HOST TARGET PROTEIN through VGAM3 HOST TARGET PROTEIN, all of FIG. 1.

VGAM1276 RNA, herein schematically represented by VGAM1 RNA through VGAM3 RNA, binds complementarily to a host target binding site located in an untranslated region of VGAM1276 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1276 host target RNA into VGAM1276 host target protein, herein schematically represented by VGAM1 HOST TARGET PROTEIN through VGAM3 HOST TARGET PROTEIN, all of FIG. 1.

It is appreciated that a function of VGR3018 gene, herein designated VGR GENE, is inhibition of expression of host target genes, as part of a novel viral mechanism of attacking a host. Accordingly, utilities of VGR3018 gene include diagnosis, prevention and treatment of viral infection by A-2 Plaque Virus. Specific functions, and accordingly utilities, of VGR3018 gene correlate with, and may be deduced from, the identity of the host target genes, which are inhibited by VGAM RNAs comprised in the 'operon-like' cluster of VGR3018 gene: VGAM1273 host target protein, VGAM1274 host target protein, VGAM1275 host target protein and VGAM1276 host target protein, herein schematically represented by VGAM1 HOST TARGET PROTEIN through VGAM3 HOST TARGET PROTEIN. The function of these host target genes is elaborated hereinabove with reference to VGAM1273, VGAM1274, VGAM1275 and VGAM1276.

FIG. 9 further provides a conceptual description of novel bioinformatically detected regulatory viral gene, referred to here as Viral Genomic Record 3019(VGR3019) viral gene, which encodes an 'operon-like' cluster of novel viral micro RNA-like genes, each of which in turn modulates expression of at least one host target gene, the function and utility of which at least one host target gene is known in the art.

VGR3019 gene, herein designated VGR GENE, is a novel bioinformatically detected regulatory, non protein coding, RNA viral gene. The method by which VGR3019 gene was detected is described hereinabove with reference to FIGS. 1-9.

VGR3019 gene encodes VGR3019 precursor RNA, herein designated VGR PRECURSOR RNA, an RNA molecule, typically several hundred nucleotides long.

VGR3019 precursor RNA folds spatially, forming VGR3019 folded precursor RNA, herein designated VGR FOLDED PRECURSOR RNA. It is appreciated that VGR3019 folded precursor RNA comprises a plurality of what is known in the art as 'hairpin' structures. These 'hairpin' structures are due to the fact that the nucleotide sequence of VGR3019 precursor RNA comprises a plurality of segments, the first half of each such segment having a nucleotide sequence which is at least a partial inversed-reversed sequence of the second half thereof, as is well known in the art.

VGR3019 folded precursor RNA is naturally processed by cellular enzymatic activity into at least 4 separate VGAM precursor RNAs, VGAM1277 precursor RNA, VGAM1278 precursor RNA, VGAM1279 precursor RNA and VGAM1280 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1277 RNA, VGAM1278 RNA, VGAM1279 RNA and VGAM1280 RNA, herein schematically represented by VGAM1 RNA through VGAM3 RNA, each of which VGAM RNAs corresponding to VGAM RNA of FIG. 1.

VGAM1277 RNA, herein schematically represented by VGAM1 RNA through VGAM3 RNA, binds complementarily to a host target binding site located in an untranslated region of VGAM1277 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1277 host target RNA into VGAM1277 host target protein, herein schematically represented by VGAM1 HOST TARGET PROTEIN through VGAM3 HOST TARGET PROTEIN, all of FIG. 1.

VGAM1278 RNA, herein schematically represented by VGAM1 RNA through VGAM3 RNA, binds complementarily to a host target binding site located in an untranslated region of VGAM1278 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1278 host target RNA into VGAM1278 host target protein, herein schematically represented by VGAM1 HOST TARGET PROTEIN through VGAM3 HOST TARGET PROTEIN, all of FIG. 1.

VGAM1279 RNA, herein schematically represented by VGAM1 RNA through VGAM3 RNA, binds complementarily to a host target binding site located in an untranslated region of VGAM1279 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1279 host target RNA into VGAM1279 host target protein, herein schematically represented by VGAM1 HOST TARGET PROTEIN through VGAM3 HOST TARGET PROTEIN, all of FIG. 1.

VGAM1280 RNA, herein schematically represented by VGAM1 RNA through VGAM3 RNA, binds complementarily to a host target binding site located in an untranslated region of VGAM1280 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1280 host target RNA into VGAM1280 host target protein, herein schematically represented by VGAM1 HOST TARGET PROTEIN through VGAM3 HOST TARGET PROTEIN, all of FIG. 1.

It is appreciated that a function of VGR3019 gene, herein designated VGR GENE, is inhibition of expression of host target genes, as part of a novel viral mechanism of attacking a host. Accordingly, utilities of VGR3019 gene include diagnosis, prevention and treatment of viral infection by Human Enterovirus C. Specific functions, and accordingly utilities, of VGR3019 gene correlate with, and may be deduced from, the identity of the host target genes, which are inhibited by VGAM RNAs comprised in the 'operon-like' cluster of VGR3019 gene: VGAM1277 host target protein, VGAM1278 host target protein, VGAM1279 host target protein and VGAM1280 host target protein, herein schematically represented by VGAM1 HOST TARGET PROTEIN through VGAM3 HOST TARGET PROTEIN. The function of these host target genes is elaborated hereinabove with reference to VGAM1277, VGAM1278, VGAM1279 and VGAM1280.

FIG. 9 further provides a conceptual description of novel bioinformatically detected regulatory viral gene, referred to here as Viral Genomic Record 3020(VGR3020) viral gene, which encodes an 'operon-like' cluster of novel viral micro RNA-like genes, each of which in turn modulates expression of at least one host target gene, the function and utility of which at least one host target gene is known in the art.

VGR3020 gene, herein designated VGR GENE, is a novel bioinformatically detected regulatory, non protein coding, RNA viral gene. The method by which VGR3020 gene was detected is described hereinabove with reference to FIGS. 1-9.

VGR3020 gene encodes VGR3020 precursor RNA, herein designated VGR PRECURSOR RNA, an RNA molecule, typically several hundred nucleotides long.

VGR3020 precursor RNA folds spatially, forming VGR3020 folded precursor RNA, herein designated VGR FOLDED PRECURSOR RNA. It is appreciated that VGR3020 folded precursor RNA comprises a plurality of what is known in the art as 'hairpin' structures. These 'hairpin' structures are due to the fact that the nucleotide sequence of VGR3020 precursor RNA comprises a plurality of segments, the first half of each such segment having a nucleotide sequence which is at least a partial inversed-reversed sequence of the second half thereof, as is well known in the art.

VGR3020 folded precursor RNA is naturally processed by cellular enzymatic activity into at least 7 separate VGAM precursor RNAs, VGAM1281 precursor RNA, VGAM1282 precursor RNA, VGAM1283 precursor RNA, VGAM1284 precursor RNA, VGAM1285 precursor RNA, VGAM1286 precursor RNA and VGAM1287 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1281 RNA, VGAM1282 RNA, VGAM1283 RNA, VGAM1284 RNA, VGAM1285 RNA, VGAM1286 RNA and VGAM1287 RNA, herein schematically represented by VGAM1 RNA through VGAM3 RNA, each of which VGAM RNAs corresponding to VGAM RNA of FIG. 1.

VGAM1281 RNA, herein schematically represented by VGAM1 RNA through VGAM3 RNA, binds complementarily to a host target binding site located in an untranslated region of VGAM1281 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1281 host target RNA into VGAM1281 host target protein, herein schematically represented by VGAM1 HOST TARGET PROTEIN through VGAM3 HOST TARGET PROTEIN, all of FIG. 1.

VGAM1282 RNA, herein schematically represented by VGAM1 RNA through VGAM3 RNA, binds complementarily to a host target binding site located in an untranslated region of VGAM1282 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1282 host target RNA into VGAM1282 host target protein, herein schematically represented by VGAM1 HOST TARGET PROTEIN through VGAM3 HOST TARGET PROTEIN, all of FIG. 1.

VGAM1283 RNA, herein schematically represented by VGAM1 RNA through VGAM3 RNA, binds complementarily to a host target binding site located in an untranslated region of VGAM1283 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1283 host target RNA into VGAM1283 host target protein, herein schematically represented by VGAM1 HOST TARGET PROTEIN through VGAM3 HOST TARGET PROTEIN, all of FIG. 1.

VGAM1284 RNA, herein schematically represented by VGAM1 RNA through VGAM3 RNA, binds complementarily to a host target binding site located in an untranslated region of VGAM1284 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1284 host target RNA into VGAM1284 host target protein, herein schematically represented by VGAM1 HOST TARGET PROTEIN through VGAM3 HOST TARGET PROTEIN, all of FIG. 1.

VGAM1285 RNA, herein schematically represented by VGAM1 RNA through VGAM3 RNA, binds complementarily to a host target binding site located in an untranslated region of VGAM1285 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1285 host target RNA into VGAM1285 host target protein, herein schematically represented by VGAM1 HOST TARGET PROTEIN through VGAM3 HOST TARGET PROTEIN, all of FIG. 1.

VGAM1286 RNA, herein schematically represented by VGAM1 RNA through VGAM3 RNA, binds complementarily to a host target binding site located in an untranslated region of VGAM1286 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1286 host target RNA into VGAM1286 host target protein, herein schematically represented by VGAM1 HOST TARGET PROTEIN through VGAM3 HOST TARGET PROTEIN, all of FIG. 1.

VGAM1287 RNA, herein schematically represented by VGAM1 RNA through VGAM3 RNA, binds complementarily to a host target binding site located in an untranslated region of VGAM1287 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1287 host target RNA into VGAM1287 host target protein, herein schematically represented by VGAM1 HOST TARGET PROTEIN through VGAM3 HOST TARGET PROTEIN, all of FIG. 1.

It is appreciated that a function of VGR3020 gene, herein designated VGR GENE, is inhibition of expression of host target genes, as part of a novel viral mechanism of attacking a host. Accordingly, utilities of VGR3020 gene include diagnosis, prevention and treatment of viral infection by Beet Virus Q. Specific functions, and accordingly utilities, of VGR3020 gene correlate with, and may be deduced from, the identity of the host target genes, which are inhibited by VGAM RNAs comprised in the 'operon-like' cluster of VGR3020 gene: VGAM1281 host target protein, VGAM1282 host target protein, VGAM1283 host target protein, VGAM1284 host target protein, VGAM1285 host target protein, VGAM1286 host target protein and VGAM1287 host target protein, herein schematically represented by VGAM1 HOST TARGET PROTEIN through VGAM3 HOST TARGET PROTEIN. The function of these host target genes is elaborated hereinabove with reference to VGAM1281, VGAM1282, VGAM1283, VGAM1284, VGAM1285, VGAM1286 and VGAM1287. FIG. 9 further provides a conceptual description of novel bioinformatically detected regulatory viral gene, referred to here as Viral Genomic Record 3021(VGR3021) viral gene, which encodes an 'operon-like' cluster of novel viral micro RNA-like genes, each of which in turn modulates expression of at least one host target gene, the function and utility of which at least one host target gene is known in the art.

VGR3021 gene, herein designated VGR GENE, is a novel bioinformatically detected regulatory, non protein coding, RNA viral gene. The method by which VGR3021 gene was detected is described hereinabove with reference to FIGS. 1-9.

VGR3021 gene encodes VGR3021 precursor RNA, herein designated VGR PRECURSOR RNA, an RNA molecule, typically several hundred nucleotides long.

VGR3021 precursor RNA folds spatially, forming VGR3021 folded precursor RNA, herein designated VGR FOLDED PRECURSOR RNA. It is appreciated that VGR3021 folded precursor RNA comprises a plurality of what is known in the art as 'hairpin' structures. These 'hairpin' structures are due to the fact that the nucleotide sequence of VGR3021 precursor RNA comprises a plurality of segments, the first half of each such segment having a nucleotide sequence which is at least a partial inversed-reversed sequence of the second half thereof, as is well known in the art.

VGR3021 folded precursor RNA is naturally processed by cellular enzymatic activity into at least 2 separate VGAM precursor RNAs, VGAM1288 precursor RNA and VGAM1289 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1288 RNA and VGAM1289 RNA, herein schematically represented by VGAM1 RNA through VGAM3 RNA, each of which VGAM RNAs corresponding to VGAM RNA of FIG. 1.

VGAM1288 RNA, herein schematically represented by VGAM1 RNA through VGAM3 RNA, binds complementarily to a host target binding site located in an untranslated region of VGAM1288 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1288 host target RNA into VGAM1288 host target protein, herein schematically represented by VGAM1 HOST TARGET PROTEIN through VGAM3 HOST TARGET PROTEIN, all of FIG. 1.

VGAM1289 RNA, herein schematically represented by VGAM1 RNA through VGAM3 RNA, binds complementarily to a host target binding site located in an untranslated region of VGAM1289 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1289 host target RNA into VGAM1289 host target protein, herein schematically represented by VGAM1 HOST TARGET PROTEIN through VGAM3 HOST TARGET PROTEIN, all of FIG. 1.

It is appreciated that a function of VGR3021 gene, herein designated VGR GENE, is inhibition of expression of host target genes, as part of a novel viral mechanism of attacking a host. Accordingly, utilities of VGR3021 gene include diagnosis, prevention and treatment of viral infection by Saimiriine Herpesvirus 2. Specific functions, and accordingly utilities, of VGR3021 gene correlate with, and may be deduced from, the identity of the host target genes, which are inhibited by VGAM RNAs comprised in the 'operon-like' cluster of VGR3021 gene: VGAM1288 host target protein and VGAM1289 host target protein, herein schematically represented by VGAM1 HOST TARGET PROTEIN through VGAM3 HOST TARGET PROTEIN. The function of these host target genes is elaborated hereinabove with reference to VGAM1288 and VGAM1289. FIG. 9 further provides a conceptual description of novel bioinformatically detected regulatory viral gene, referred to here as Viral Genomic Record 3022(VGR3022) viral gene, which encodes an 'operon-like' cluster of novel viral micro RNA-like genes, each of which in turn modulates expression of at least one host target gene, the function and utility of which at least one host target gene is known in the art.

VGR3022 gene, herein designated VGR GENE, is a novel bioinformatically detected regulatory, non protein coding, RNA viral gene. The method by which VGR3022 gene was detected is described hereinabove with reference to FIGS. 1-9.

VGR3022 gene encodes VGR3022 precursor RNA, herein designated VGR PRECURSOR RNA, an RNA molecule, typically several hundred nucleotides long.

VGR3022 precursor RNA folds spatially, forming VGR3022 folded precursor RNA, herein designated VGR FOLDED PRECURSOR RNA. It is appreciated that VGR3022 folded precursor RNA comprises a plurality of what is known in the art as 'hairpin' structures. These 'hairpin' structures are due to the fact that the nucleotide sequence of VGR3022 precursor RNA comprises a plurality of segments, the first half of each such segment having a nucleotide sequence which is at least a partial inversed-reversed sequence of the second half thereof, as is well known in the art.

VGR3022 folded precursor RNA is naturally processed by cellular enzymatic activity into at least 3 separate VGAM precursor RNAs, VGAM1291 precursor RNA, VGAM1292 precursor RNA and VGAM1293 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1291 RNA, VGAM1292 RNA and VGAM1293 RNA, herein schematically represented by VGAM1 RNA through VGAM3 RNA, each of which VGAM RNAs corresponding to VGAM RNA of FIG. 1.

VGAM1291 RNA, herein schematically represented by VGAM1 RNA through VGAM3 RNA, binds complementarily to a host target binding site located in an untranslated region of VGAM1291 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1291 host target RNA into VGAM1291 host target protein, herein schematically represented by VGAM1 HOST TARGET PROTEIN through VGAM3 HOST TARGET PROTEIN, all of FIG. 1.

VGAM1292 RNA, herein schematically represented by VGAM1 RNA through VGAM3 RNA, binds complementarily to a host target binding site located in an untranslated region of VGAM1292 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1292 host target RNA into VGAM1292 host target protein, herein schematically represented by VGAM1 HOST TARGET PROTEIN through VGAM3 HOST TARGET PROTEIN, all of FIG. 1.

VGAM1293 RNA, herein schematically represented by VGAM1 RNA through VGAM3 RNA, binds complementarily to a host target binding site located in an untranslated region of VGAM1293 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1293 host target RNA into VGAM1293 host target protein, herein schematically represented by VGAM1 HOST TARGET PROTEIN through VGAM3 HOST TARGET PROTEIN, all of FIG. 1.

It is appreciated that a function of VGR3022 gene, herein designated VGR GENE, is inhibition of expression of host target genes, as part of a novel viral mechanism of attacking a host. Accordingly, utilities of VGR3022 gene include diagnosis, prevention and treatment of viral infection by Swinepox Virus. Specific functions, and accordingly utilities, of VGR3022 gene correlate with, and may be deduced from, the identity of the host target genes, which are inhibited by VGAM RNAs comprised in the 'operon-like' cluster of VGR3022 gene: VGAM1291 host target protein, VGAM1292 host target protein and VGAM1293 host target protein, herein schematically represented by VGAM1 HOST TARGET PROTEIN through VGAM3 HOST TARGET PROTEIN. The function of these host target genes is elaborated hereinabove with reference to VGAM1291, VGAM1292 and VGAM1293. FIG. 9 further provides a conceptual description of novel bioinformatically detected regulatory viral gene, referred to here as Viral Genomic Record 3023(VGR3023) viral gene, which encodes an 'operon-like' cluster of novel viral micro RNA-like genes, each of which in turn modulates expression of at least one host target gene, the function and utility of which at least one host target gene is known in the art.

VGR3023 gene, herein designated VGR GENE, is a novel bioinformatically detected regulatory, non protein coding, RNA viral gene. The method by which VGR3023 gene was detected is described hereinabove with reference to FIGS. 1-9.

VGR3023 gene encodes VGR3023 precursor RNA, herein designated VGR PRECURSOR RNA, an RNA molecule, typically several hundred nucleotides long.

VGR3023 precursor RNA folds spatially, forming VGR3023 folded precursor RNA, herein designated VGR FOLDED PRECURSOR RNA. It is appreciated that VGR3023 folded precursor RNA comprises a plurality of what is known in the art as 'hairpin' structures. These 'hairpin' structures are due to the fact that the nucleotide sequence of VGR3023 precursor RNA comprises a plurality of segments, the first half of each such segment having a nucleotide sequence which is at least a partial inversed-reversed sequence of the second half thereof, as is well known in the art.

VGR3023 folded precursor RNA is naturally processed by cellular enzymatic activity into at least 3 separate VGAM precursor RNAs, VGAM1294 precursor RNA, VGAM1295 precursor RNA and VGAM1296 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1294 RNA, VGAM1295 RNA and VGAM1296 RNA, herein schematically represented by VGAM1 RNA through VGAM3 RNA, each of which VGAM RNAs corresponding to VGAM RNA of FIG. 1.

VGAM1294 RNA, herein schematically represented by VGAM1 RNA through VGAM3 RNA, binds complementarily to a host target binding site located in an untranslated region of VGAM1294 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1294 host target RNA into VGAM1294 host target protein, herein schematically represented by VGAM1 HOST TARGET PROTEIN through VGAM3 HOST TARGET PROTEIN, all of FIG. 1.

VGAM1295 RNA, herein schematically represented by VGAM1 RNA through VGAM3 RNA, binds complementarily to a host target binding site located in an untranslated region of VGAM1295 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1295 host target RNA into VGAM1295 host target protein, herein schematically represented by VGAM1 HOST TARGET PROTEIN through VGAM3 HOST TARGET PROTEIN, all of FIG. 1.

VGAM1296 RNA, herein schematically represented by VGAM1 RNA through VGAM3 RNA, binds complementarily to a host target binding site located in an untranslated region of VGAM1296 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1296 host target RNA into VGAM1296 host target protein, herein schematically represented by VGAM1 HOST TARGET PROTEIN through VGAM3 HOST TARGET PROTEIN, all of FIG. 1.

It is appreciated that a function of VGR3023 gene, herein designated VGR GENE, is inhibition of expression of host target genes, as part of a novel viral mechanism of attacking a host. Accordingly, utilities of VGR3023 gene include diagnosis, prevention and treatment of viral infection by Vaccinia Virus. Specific functions, and accordingly utilities, of VGR3023 gene correlate with, and may be deduced from, the identity of the host target genes, which are inhibited by VGAM RNAs comprised in the 'operon-like' cluster of VGR3023 gene: VGAM1294 host target protein, VGAM1295 host target protein and VGAM1296 host target protein, herein schematically represented by VGAM1 HOST TARGET PROTEIN through VGAM3 HOST TARGET PROTEIN. The function of these host target genes is elaborated hereinabove with reference to VGAM1294, VGAM1295 and VGAM1296. FIG. 9 further provides a conceptual description of novel bioinformatically detected regulatory viral gene, referred to here as Viral Genomic Record 3024(VGR3024) viral gene, which encodes an 'operon-like' cluster of novel viral micro RNA-like genes, each of which in turn modulates expression of at least one host target gene, the function and utility of which at least one host target gene is known in the art.

VGR3024 gene, herein designated VGR GENE, is a novel bioinformatically detected regulatory, non protein coding, RNA viral gene. The method by which VGR3024 gene was detected is described hereinabove with reference to FIGS. 1-9.

VGR3024 gene encodes VGR3024 precursor RNA, herein designated VGR PRECURSOR RNA, an RNA molecule, typically several hundred nucleotides long.

VGR3024 precursor RNA folds spatially, forming VGR3024 folded precursor RNA, herein designated VGR FOLDED PRECURSOR RNA. It is appreciated that VGR3024 folded precursor RNA comprises a plurality of what is known in the art as 'hairpin' structures. These 'hairpin' structures are due to the fact that the nucleotide sequence of VGR3024 precursor RNA comprises a plurality of segments, the first half of each such segment having a nucleotide sequence which is at least a partial inversed-reversed sequence of the second half thereof, as is well known in the art.

VGR3024 folded precursor RNA is naturally processed by cellular enzymatic activity into at least 5 separate VGAM precursor RNAs, VGAM1297 precursor RNA, VGAM1298 precursor RNA, VGAM1299 precursor RNA, VGAM1300 precursor RNA and VGAM1301 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1297 RNA, VGAM1298 RNA, VGAM1299 RNA, VGAM1300 RNA and VGAM1301 RNA, herein schematically represented by VGAM1 RNA through VGAM3 RNA, each of which VGAM RNAs corresponding to VGAM RNA of FIG. 1.

VGAM1297 RNA, herein schematically represented by VGAM1 RNA through VGAM3 RNA, binds complementarily to a host target binding site located in an untranslated region of VGAM1297 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1297 host target RNA into VGAM1297 host target protein, herein schematically represented by VGAM1 HOST TARGET PROTEIN through VGAM3 HOST TARGET PROTEIN, all of FIG. 1.

VGAM1298 RNA, herein schematically represented by VGAM1 RNA through VGAM3 RNA, binds complementarily to a host target binding site located in an untranslated region of VGAM1298 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1298 host target RNA into VGAM1298 host target protein, herein schematically represented by VGAM1 HOST TARGET PROTEIN through VGAM3 HOST TARGET PROTEIN, all of FIG. 1.

VGAM1299 RNA, herein schematically represented by VGAM1 RNA through VGAM3 RNA, binds complementarily to a host target binding site located in an untranslated region of VGAM1299 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1299 host target RNA into VGAM1299 host target protein, herein schematically represented by VGAM1 HOST TARGET PROTEIN through VGAM3 HOST TARGET PROTEIN, all of FIG. 1.

VGAM1300 RNA, herein schematically represented by VGAM1 RNA through VGAM3 RNA, binds complementarily to a host target binding site located in an untranslated region of VGAM1300 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1300 host target RNA into VGAM1300 host target protein, herein schematically represented by VGAM1 HOST TARGET PROTEIN through VGAM3 HOST TARGET PROTEIN, all of FIG. 1.

VGAM1301 RNA, herein schematically represented by VGAM1 RNA through VGAM3 RNA, binds complementarily to a host target binding site located in an untranslated region of VGAM1301 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1301 host target RNA into VGAM1301 host target protein, herein schematically represented by VGAM1 HOST TARGET PROTEIN through VGAM3 HOST TARGET PROTEIN, all of FIG. 1.

It is appreciated that a function of VGR3024 gene, herein designated VGR GENE, is inhibition of expression of host target genes, as part of a novel viral mechanism of attacking a host. Accordingly, utilities of VGR3024 gene include diagnosis, prevention and treatment of viral infection by Yaba-like Disease Virus. Specific functions, and accordingly utilities, of VGR3024 gene correlate with, and may be deduced from, the identity of the host target genes, which are inhibited by VGAM RNAs comprised in the 'operon-like' cluster of VGR3024 gene: VGAM1297 host target protein, VGAM1298 host target protein, VGAM1299 host target protein, VGAM1300 host target protein and VGAM1301 host target protein, herein schematically represented by VGAM1 HOST TARGET PROTEIN through VGAM3 HOST TARGET PROTEIN. The function of these host target genes is elaborated hereinabove with reference to VGAM1297, VGAM1298, VGAM1299, VGAM1300 and VGAM1301.

FIG. 9 further provides a conceptual description of novel bioinformatically detected regulatory viral gene, referred to here as Viral Genomic Record 3025(VGR3025) viral gene, which encodes an 'operon-like' cluster of novel viral micro RNA-like genes, each of which in turn modulates expression of at least one host target gene, the function and utility of which at least one host target gene is known in the art.

VGR3025 gene, herein designated VGR GENE, is a novel bioinformatically detected regulatory, non protein coding, RNA viral gene. The method by which VGR3025 gene was detected is described hereinabove with reference to FIGS. 1-9.

VGR3025 gene encodes VGR3025 precursor RNA, herein designated VGR PRECURSOR RNA, an RNA molecule, typically several hundred nucleotides long.

VGR3025 precursor RNA folds spatially, forming VGR3025 folded precursor RNA, herein designated VGR FOLDED PRECURSOR RNA. It is appreciated that VGR3025 folded precursor RNA comprises a plurality of what is known in the art as 'hairpin' structures. These 'hairpin' structures are due to the fact that the nucleotide sequence of VGR3025 precursor RNA comprises a plurality of segments, the first half of each such segment having a nucleotide sequence which is at least a partial inversed-reversed sequence of the second half thereof, as is well known in the art.

VGR3025 folded precursor RNA is naturally processed by cellular enzymatic activity into at least 3 separate VGAM precursor RNAs, VGAM1302 precursor RNA, VGAM1303 precursor RNA and VGAM1304 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1302 RNA, VGAM1303 RNA and VGAM1304 RNA, herein schematically represented by VGAM1 RNA through VGAM3 RNA, each of which VGAM RNAs corresponding to VGAM RNA of FIG. 1.

VGAM1302 RNA, herein schematically represented by VGAM1 RNA through VGAM3 RNA, binds complementarily to a host target binding site located in an untranslated region of VGAM1302 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1302 host target RNA into VGAM1302 host target protein, herein schematically represented by VGAM1 HOST TARGET PROTEIN through VGAM3 HOST TARGET PROTEIN, all of FIG. 1.

VGAM1303 RNA, herein schematically represented by VGAM1 RNA through VGAM3 RNA, binds complementarily to a host target binding site located in an untranslated region of VGAM1303 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM1303 host target RNA into VGAM1303 host target protein, herein schematically represented by VGAM1 HOST TARGET PROTEIN through VGAM3 HOST TARGET PROTEIN, all of FIG. 1.

VGAM1304 RNA, herein schematically represented by VGAM1 RNA through VGAM3 RNA, binds complementarily to a host target binding site located in an untranslated region of VGAM1304 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1304 host target RNA into VGAM1304 host target protein, herein schematically represented by VGAM1 HOST TARGET PROTEIN through VGAM3 HOST TARGET PROTEIN, all of FIG. 1.

It is appreciated that a function of VGR3025 gene, herein designated VGR GENE, is inhibition of expression of host target genes, as part of a novel viral mechanism of attacking a host. Accordingly, utilities of VGR3025 gene include diagnosis, prevention and treatment of viral infection by Human Herpesvirus 5. Specific functions, and accordingly utilities, of VGR3025 gene correlate with, and may be deduced from, the identity of the host target genes, which are inhibited by VGAM RNAs comprised in the 'operon-like' cluster of VGR3025 gene: VGAM1302 host target protein, VGAM1303 host target protein and VGAM1304 host target protein, herein schematically represented by VGAM1 HOST TARGET PROTEIN through VGAM3 HOST TARGET PROTEIN. The function of these host target genes is elaborated hereinabove with reference to VGAM1302, VGAM1303 and VGAM1304. FIG. 9 further provides a conceptual description of novel bioinformatically detected regulatory viral gene, referred to here as Viral Genomic Record 3026(VGR3026) viral gene, which encodes an 'operon-like' cluster of novel viral micro RNA-like genes, each of which in turn modulates expression of at least one host target gene, the function and utility of which at least one host target gene is known in the art.

VGR3026 gene, herein designated VGR GENE, is a novel bioinformatically detected regulatory, non protein coding, RNA viral gene. The method by which VGR3026 gene was detected is described hereinabove with reference to FIGS. 1-9.

VGR3026 gene encodes VGR3026 precursor RNA, herein designated VGR PRECURSOR RNA, an RNA molecule, typically several hundred nucleotides long.

VGR3026 precursor RNA folds spatially, forming VGR3026 folded precursor RNA, herein designated VGR FOLDED PRECURSOR RNA. It is appreciated that VGR3026 folded precursor RNA comprises a plurality of what is known in the art as 'hairpin' structures. These 'hairpin' structures are due to the fact that the nucleotide sequence of VGR3026 precursor RNA comprises a plurality of segments, the first half of each such segment having a nucleotide sequence which is at least a partial inversed-reversed sequence of the second half thereof, as is well known in the art.

VGR3026 folded precursor RNA is naturally processed by cellular enzymatic activity into at least 4 separate VGAM precursor RNAs, VGAM1305 precursor RNA, VGAM1306 precursor RNA, VGAM1307 precursor RNA and VGAM1308 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1305 RNA, VGAM1306 RNA, VGAM1307 RNA and VGAM1308 RNA, herein schematically represented by VGAM1 RNA through VGAM3 RNA, each of which VGAM RNAs corresponding to VGAM RNA of FIG. 1.

VGAM1305 RNA, herein schematically represented by VGAM1 RNA through VGAM3 RNA, binds complementarily to a host target binding site located in an untranslated region of VGAM1305 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1305 host target RNA into VGAM1305 host target protein, herein schematically represented by VGAM1 HOST TARGET PROTEIN through VGAM3 HOST TARGET PROTEIN, all of FIG. 1.

VGAM1306 RNA, herein schematically represented by VGAM1 RNA through VGAM3 RNA, binds complementarily to a host target binding site located in an untranslated region of VGAM1306 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1306 host target RNA into VGAM1306 host target protein, herein schematically represented by VGAM1 HOST TARGET PROTEIN through VGAM3 HOST TARGET PROTEIN, all of FIG. 1.

VGAM1307 RNA, herein schematically represented by VGAM1 RNA through VGAM3 RNA, binds complementarily to a host target binding site located in an untranslated region of VGAM1307 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1307 host target RNA into VGAM1307 host target protein, herein schematically represented by VGAM1 HOST TARGET PROTEIN through VGAM3 HOST TARGET PROTEIN, all of FIG. 1.

VGAM1308 RNA, herein schematically represented by VGAM1 RNA through VGAM3 RNA, binds complementarily to a host target binding site located in an untranslated region of VGAM1308 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1308 host target RNA into VGAM1308 host target protein, herein schematically represented by VGAM1 HOST TARGET PROTEIN through VGAM3 HOST TARGET PROTEIN, all of FIG. 1.

It is appreciated that a function of VGR3026 gene, herein designated VGR GENE, is inhibition of expression of host target genes, as part of a novel viral mechanism of attacking a host. Accordingly, utilities of VGR3026 gene include diagnosis, prevention and treatment of viral infection by Foot-and-mouth Disease Virus SAT 2 (FMDV-SAT2). Specific functions, and accordingly utilities, of VGR3026 gene correlate with, and may be deduced from, the identity of the host target genes, which are inhibited by VGAM RNAs comprised in the 'operon-like' cluster of VGR3026 gene: VGAM1305 host target protein, VGAM1306 host target protein, VGAM1307 host target protein and VGAM1308 host target protein, herein schematically represented by VGAM1 HOST TARGET PROTEIN through VGAM3 HOST TARGET PROTEIN. The function of these host target genes is elaborated hereinabove with reference to VGAM1305, VGAM1306, VGAM1307 and VGAM1308. FIG. 9 further provides a conceptual description of novel bioinformatically detected regulatory viral gene, referred to here as Viral Genomic Record 3027(VGR3027) viral gene, which encodes an 'operon-like' cluster of novel viral micro RNA-like genes, each of which in turn modulates expression of at least one host target gene, the function and utility of which at least one host target gene is known in the art.

VGR3027 gene, herein designated VGR GENE, is a novel bioinformatically detected regulatory, non protein coding, RNA viral gene. The method by which VGR3027 gene was detected is described hereinabove with reference to FIGS. 1-9.

VGR3027 gene encodes VGR3027 precursor RNA, herein designated VGR PRECURSOR RNA, an RNA molecule, typically several hundred nucleotides long.

VGR3027 precursor RNA folds spatially, forming VGR3027 folded precursor RNA, herein designated VGR FOLDED PRECURSOR RNA. It is appreciated that VGR3027 folded precursor RNA comprises a plurality of what is known in the art as 'hairpin' structures. These 'hairpin' structures are due to the fact that the nucleotide sequence of VGR3027 precursor RNA comprises a plurality of segments, the first half of each such segment having a nucleotide sequence which is at least a partial inversed-reversed sequence of the second half thereof, as is well known in the art.

VGR3027 folded precursor RNA is naturally processed by cellular enzymatic activity into at least 2 separate VGAM precursor RNAs, VGAM1309 precursor RNA and VGAM1310 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1309 RNA and VGAM1310 RNA, herein schematically represented by VGAM1 RNA through VGAM3 RNA, each of which VGAM RNAs corresponding to VGAM RNA of FIG. 1.

VGAM1309 RNA, herein schematically represented by VGAM1 RNA through VGAM3 RNA, binds complementarily to a host target binding site located in an untranslated region of VGAM1309 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1309 host target RNA into VGAM1309 host target protein, herein schematically represented by VGAM1 HOST TARGET PROTEIN through VGAM3 HOST TARGET PROTEIN, all of FIG. 1.

VGAM1310 RNA, herein schematically represented by VGAM1 RNA through VGAM3 RNA, binds complementarily to a host target binding site located in an untranslated region of VGAM1310 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1310 host target RNA into VGAM1310 host target protein, herein schematically represented by VGAM1 HOST TARGET PROTEIN through VGAM3 HOST TARGET PROTEIN, all of FIG. 1.

It is appreciated that a function of VGR3027 gene, herein designated VGR GENE, is inhibition of expression of host target genes, as part of a novel viral mechanism of attacking a host. Accordingly, utilities of VGR3027 gene include diagnosis, prevention and treatment of viral infection by Human Adenovirus D. Specific functions, and accordingly utilities, of VGR3027 gene correlate with, and may be deduced from, the identity of the host target genes, which are inhibited by VGAM RNAs comprised in the 'operon-like' cluster of VGR3027 gene: VGAM1309 host target protein and VGAM1310 host target protein, herein schematically represented by VGAM1 HOST TARGET PROTEIN through VGAM3 HOST TARGET PROTEIN. The function of these host target genes is elaborated hereinabove with reference to VGAM1309 and VGAM1310. FIG. 9 further provides a conceptual description of novel bioinformatically detected regulatory viral gene, referred to here as Viral Genomic Record 3028(VGR3028) viral gene, which encodes an 'operon-like' cluster of novel viral micro RNA-like genes, each of which in turn modulates expression of at least one host target gene, the function and utility of which at least one host target gene is known in the art.

VGR3028 gene, herein designated VGR GENE, is a novel bioinformatically detected regulatory, non protein coding, RNA viral gene. The method by which VGR3028 gene was detected is described hereinabove with reference to FIGS. 1-9.

VGR3028 gene encodes VGR3028 precursor RNA, herein designated VGR PRECURSOR RNA, an RNA molecule, typically several hundred nucleotides long.

VGR3028 precursor RNA folds spatially, forming VGR3028 folded precursor RNA, herein designated VGR FOLDED PRECURSOR RNA. It is appreciated that VGR3028 folded precursor RNA comprises a plurality of what is known in the art as 'hairpin' structures. These 'hairpin' structures are due to the fact that the nucleotide sequence of VGR3028 precursor RNA comprises a plurality of segments, the first half of each such segment having a nucleotide sequence which is at least a partial inversed-reversed sequence of the second half thereof, as is well known in the art.

VGR3028 folded precursor RNA is naturally processed by cellular enzymatic activity into at least 6 separate VGAM precursor RNAs, VGAM1311 precursor RNA, VGAM1312 precursor RNA, VGAM1313 precursor RNA, VGAM1314 precursor RNA, VGAM1315 precursor RNA and VGAM1316 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1311 RNA, VGAM1312 RNA, VGAM1313 RNA, VGAM1314 RNA, VGAM1315 RNA and VGAM1316 RNA, herein schematically represented by VGAM1 RNA through VGAM3 RNA, each of which VGAM RNAs corresponding to VGAM RNA of FIG. 1.

VGAM1311 RNA, herein schematically represented by VGAM1 RNA through VGAM3 RNA, binds complementarily to a host target binding site located in an untranslated region of VGAM1311 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1311 host target RNA into VGAM1311 host target protein, herein schematically represented by VGAM1 HOST TARGET PROTEIN through VGAM3 HOST TARGET PROTEIN, all of FIG. 1.

VGAM1312 RNA, herein schematically represented by VGAM1 RNA through VGAM3 RNA, binds complementarily to a host target binding site located in an untranslated region of VGAM1312 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1312 host target RNA into VGAM1312 host target protein, herein schematically represented by VGAM1 HOST TARGET PROTEIN through VGAM3 HOST TARGET PROTEIN, all of FIG. 1.

VGAM1313 RNA, herein schematically represented by VGAM1 RNA through VGAM3 RNA, binds complementarily to a host target binding site located in an untranslated region of VGAM1313 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1313 host target RNA into VGAM1313 host target protein, herein schematically represented by VGAM1 HOST TARGET PROTEIN through VGAM3 HOST TARGET PROTEIN, all of FIG. 1.

VGAM1314 RNA, herein schematically represented by VGAM1 RNA through VGAM3 RNA, binds complementarily to a host target binding site located in an untranslated region of VGAM1314 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1314 host target RNA into VGAM1314 host target protein, herein schematically represented by VGAM1 HOST TARGET PROTEIN through VGAM3 HOST TARGET PROTEIN, all of FIG. 1.

VGAM1315 RNA, herein schematically represented by VGAM1 RNA through VGAM3 RNA, binds complementarily to a host target binding site located in an untranslated region of VGAM1315 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1315 host target RNA into VGAM1315 host target protein, herein schematically represented by VGAM1 HOST TARGET PROTEIN through VGAM3 HOST TARGET PROTEIN, all of FIG. 1.

VGAM1316 RNA, herein schematically represented by VGAM1 RNA through VGAM3 RNA, binds complementarily to a host target binding site located in an untranslated region of VGAM1316 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1316 host target RNA into VGAM1316 host target protein, herein schematically represented by VGAM1 HOST TARGET PROTEIN through VGAM3 HOST TARGET PROTEIN, all of FIG. 1.

It is appreciated that a function of VGR3028 gene, herein designated VGR GENE, is inhibition of expression of host target genes, as part of a novel viral mechanism of attacking a host. Accordingly, utilities of VGR3028 gene include diagnosis, prevention and treatment of viral infection by Foot-and-mouth Disease Virus C. Specific functions, and accordingly utilities, of VGR3028 gene correlate with, and may be deduced from, the identity of the host target genes, which are inhibited by VGAM RNAs comprised in the 'operon-like' cluster of VGR3028 gene: VGAM1311 host target protein, VGAM1312 host target protein, VGAM1313 host target protein, VGAM1314 host target protein, VGAM1315 host target protein and VGAM1316 host target protein, herein schematically represented by VGAM1 HOST TARGET PROTEIN through VGAM3 HOST TARGET PROTEIN. The function of these host target genes is elaborated hereinabove with reference to VGAM1311, VGAM1312, VGAM1313, VGAM1314, VGAM1315 and VGAM1316. FIG. 9 further provides a conceptual description of novel bioinformatically detected regulatory viral gene, referred to here as Viral Genomic Record 3029(VGR3029) viral gene, which encodes an 'operon-like' cluster of novel viral micro RNA-like genes, each of which in turn modulates expression of at least one host target gene, the function and utility of which at least one host target gene is known in the art.

VGR3029 gene, herein designated VGR GENE, is a novel bioinformatically detected regulatory, non protein coding, RNA viral gene. The method by which VGR3029 gene was detected is described hereinabove with reference to FIGS. 1-9.

VGR3029 gene encodes VGR3029 precursor RNA, herein designated VGR PRECURSOR RNA, an RNA molecule, typically several hundred nucleotides long.

VGR3029 precursor RNA folds spatially, forming VGR3029 folded precursor RNA, herein designated VGR FOLDED PRECURSOR RNA. It is appreciated that VGR3029 folded precursor RNA comprises a plurality of what is known in the art as 'hairpin' structures. These 'hairpin' structures are due to the fact that the nucleotide sequence of VGR3029 precursor RNA comprises a plurality of segments, the first half of each such segment having a nucleotide sequence which is at least a partial inversed-reversed sequence of the second half thereof, as is well known in the art.

VGR3029 folded precursor RNA is naturally processed by cellular enzymatic activity into at least 3 separate VGAM precursor RNAs, VGAM1317 precursor RNA, VGAM1318 precursor RNA and VGAM1319 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1317 RNA, VGAM1318 RNA and VGAM1319 RNA, herein schematically represented by VGAM1 RNA through VGAM3 RNA, each of which VGAM RNAs corresponding to VGAM RNA of FIG. 1.

VGAM1317 RNA, herein schematically represented by VGAM1 RNA through VGAM3 RNA, binds complementarily to a host target binding site located in an untranslated region of VGAM1317 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1317 host target RNA into VGAM1317 host target protein, herein schematically represented by VGAM1 HOST TARGET PROTEIN through VGAM3 HOST TARGET PROTEIN, all of FIG. 1.

VGAM1318 RNA, herein schematically represented by VGAM1 RNA through VGAM3 RNA, binds complementarily to a host target binding site located in an untranslated region of VGAM1318 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1318 host target RNA into VGAM1318 host target protein, herein schematically represented by VGAM1 HOST TARGET PROTEIN through VGAM3 HOST TARGET PROTEIN, all of FIG. 1.

VGAM1319 RNA, herein schematically represented by VGAM1 RNA through VGAM3 RNA, binds complementarily to a host target binding site located in an untranslated region of VGAM1319 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1319 host target RNA into VGAM1319 host target protein, herein schematically represented by VGAM1 HOST TARGET PROTEIN through VGAM3 HOST TARGET PROTEIN, all of FIG. 1.

It is appreciated that a function of VGR3029 gene, herein designated VGR GENE, is inhibition of expression of host target genes, as part of a novel viral mechanism of attacking a host. Accordingly, utilities of VGR3029 gene include diagnosis, prevention and treatment of viral infection by Foot-and-mouth Disease Virus O. Specific functions, and accordingly utilities, of VGR3029 gene correlate with, and may be deduced from, the identity of the host target genes, which are inhibited by VGAM RNAs comprised in the 'operon-like' cluster of VGR3029 gene: VGAM1317 host target protein, VGAM1318 host target protein and VGAM1319 host target protein, herein schematically represented by VGAM1 HOST TARGET PROTEIN through VGAM3 HOST TARGET PROTEIN. The function of these host target genes is elaborated hereinabove with reference to VGAM1317, VGAM1318 and VGAM1319. FIG. 9 further provides a conceptual description of novel bioinformatically detected regulatory viral gene, referred to here as Viral Genomic Record 3030(VGR3030) viral gene, which encodes an 'operon-like' cluster of novel viral micro RNA-like genes, each of which in turn modulates expression of at least one host target gene, the function and utility of which at least one host target gene is known in the art.

VGR3030 gene, herein designated VGR GENE, is a novel bioinformatically detected regulatory, non protein coding, RNA viral gene. The method by which VGR3030 gene was detected is described hereinabove with reference to FIGS. 1-9.

VGR3030 gene encodes VGR3030 precursor RNA, herein designated VGR PRECURSOR RNA, an RNA molecule, typically several hundred nucleotides long.

VGR3030 precursor RNA folds spatially, forming VGR3030 folded precursor RNA, herein designated VGR FOLDED PRECURSOR RNA. It is appreciated that VGR3030 folded precursor RNA comprises a plurality of what is known in the art as 'hairpin' structures. These 'hairpin' structures are due to the fact that the nucleotide sequence of VGR3030 precursor RNA comprises a plurality of segments, the first half of each such segment having a nucleotide sequence which is at least a partial inversed-reversed sequence of the second half thereof, as is well known in the art.

VGR3030 folded precursor RNA is naturally processed by cellular enzymatic activity into at least 2 separate VGAM precursor RNAs, VGAM1320 precursor RNA and VGAM1321 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1320 RNA and VGAM1321 RNA, herein schematically represented by VGAM1 RNA through VGAM3 RNA, each of which VGAM RNAs corresponding to VGAM RNA of FIG. 1.

VGAM1320 RNA, herein schematically represented by VGAM1 RNA through VGAM3 RNA, binds complementarily to a host target binding site located in an untranslated region of VGAM1320 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1320 host target RNA into VGAM1320 host target protein, herein schematically represented by VGAM1 HOST TARGET PROTEIN through VGAM3 HOST TARGET PROTEIN, all of FIG. 1.

VGAM1321 RNA, herein schematically represented by VGAM1 RNA through VGAM3 RNA, binds complementarily to a host target binding site located in an untranslated region of VGAM1321 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1321 host target RNA into VGAM1321 host target protein, herein schematically represented by VGAM1 HOST TARGET PROTEIN through VGAM3 HOST TARGET PROTEIN, all of FIG. 1.

It is appreciated that a function of VGR3030 gene, herein designated VGR GENE, is inhibition of expression of host target genes, as part of a novel viral mechanism of attacking a host. Accordingly, utilities of VGR3030 gene include diagnosis, prevention and treatment of viral infection by Melanoplus Sanguinipes Entomopoxvirus. Specific functions, and accordingly utilities, of VGR3030 gene correlate with, and may be deduced from, the identity of the host target genes, which are inhibited by VGAM RNAs comprised in the 'operon-like' cluster of VGR3030 gene: VGAM1320 host target protein and VGAM1321 host target protein, herein schematically represented by VGAM1 HOST TARGET PROTEIN through VGAM3 HOST TARGET PROTEIN. The function of these host target genes is elaborated hereinabove with reference to VGAM1320 and VGAM1321. FIG. 9 further provides a conceptual description of novel bioinformatically detected regulatory viral gene, referred to here as Viral Genomic Record 3031(VGR3031) viral gene, which encodes an 'operon-like' cluster of novel viral micro RNA-like genes, each of which in turn modulates expression of at least one host target gene, the function and utility of which at least one host target gene is known in the art.

VGR3031 gene, herein designated VGR GENE, is a novel bioinformatically detected regulatory, non protein coding, RNA viral gene. The method by which VGR3031 gene was detected is described hereinabove with reference to FIGS. 1-9.

VGR3031 gene encodes VGR3031 precursor RNA, herein designated VGR PRECURSOR RNA, an RNA molecule, typically several hundred nucleotides long.

VGR3031 precursor RNA folds spatially, forming VGR3031 folded precursor RNA, herein designated VGR FOLDED PRECURSOR RNA. It is appreciated that VGR3031 folded precursor RNA comprises a plurality of what is known in the art as 'hairpin' structures. These 'hairpin' structures are due to the fact that the nucleotide sequence of VGR3031 precursor RNA comprises a plurality of segments, the first half of each such segment having a nucleotide sequence which is at least a partial inversed-reversed sequence of the second half thereof, as is well known in the art.

VGR3031 folded precursor RNA is naturally processed by cellular enzymatic activity into at least 4 separate VGAM precursor RNAs, VGAM1322 precursor RNA, VGAM1323 precursor RNA, VGAM1324 precursor RNA and VGAM1325 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1322 RNA, VGAM1323 RNA, VGAM1324 RNA and VGAM1325 RNA, herein schematically represented by VGAM1 RNA through VGAM3 RNA, each of which VGAM RNAs corresponding to VGAM RNA of FIG. 1.

VGAM1322 RNA, herein schematically represented by VGAM1 RNA through VGAM3 RNA, binds complementarily to a host target binding site located in an untranslated region of VGAM1322 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1322 host target RNA into VGAM1322 host target protein, herein schematically represented by VGAM1 HOST TARGET PROTEIN through VGAM3 HOST TARGET PROTEIN, all of FIG. 1.

VGAM1323 RNA, herein schematically represented by VGAM1 RNA through VGAM3 RNA, binds complementarily to a host target binding site located in an untranslated region of VGAM1323 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1323 host target RNA into VGAM1323 host target protein, herein schematically represented by VGAM1 HOST TARGET PROTEIN through VGAM3 HOST TARGET PROTEIN, all of FIG. 1.

VGAM1324 RNA, herein schematically represented by VGAM1 RNA through VGAM3 RNA, binds complementarily to a host target binding site located in an untranslated region of VGAM1324 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1324 host target RNA into VGAM1324 host target protein, herein schematically represented by VGAM1 HOST TARGET PROTEIN through VGAM3 HOST TARGET PROTEIN, all of FIG. 1.

VGAM1325 RNA, herein schematically represented by VGAM1 RNA through VGAM3 RNA, binds complementarily to a host target binding site located in an untranslated region of VGAM1325 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1325 host target RNA into VGAM1325 host target protein, herein schematically represented by VGAM1 HOST TARGET PROTEIN through VGAM3 HOST TARGET PROTEIN, all of FIG. 1.

It is appreciated that a function of VGR3031 gene, herein designated VGR GENE, is inhibition of expression of host target genes, as part of a novel viral mechanism of attacking a host. Accordingly, utilities of VGR3031 gene include diagnosis, prevention and treatment of viral infection by Garlic Latent Virus. Specific functions, and accordingly utilities, of VGR3031 gene correlate with, and may be deduced from, the identity of the host target genes, which are inhibited by VGAM RNAs comprised in the 'operon-like' cluster of VGR3031 gene: VGAM1322 host target protein, VGAM1323 host target protein, VGAM1324 host target protein and VGAM1325 host target protein, herein schematically represented by VGAM1 HOST TARGET PROTEIN through VGAM3 HOST TARGET PROTEIN. The function of these host target genes is elaborated hereinabove with reference to VGAM1322, VGAM1323, VGAM1324 and VGAM1325.

FIG. 9 further provides a conceptual description of novel bioinformatically detected regulatory viral gene, referred to here as Viral Genomic Record 3032(VGR3032) viral gene, which encodes an 'operon-like' cluster of novel viral micro RNA-like genes, each of which in turn modulates expression of at least one host target gene, the function and utility of which at least one host target gene is known in the art.

VGR3032 gene, herein designated VGR GENE, is a novel bioinformatically detected regulatory, non protein coding, RNA viral gene. The method by which VGR3032 gene was detected is described hereinabove with reference to FIGS. 1-9.

VGR3032 gene encodes VGR3032 precursor RNA, herein designated VGR PRECURSOR RNA, an RNA molecule, typically several hundred nucleotides long.

VGR3032 precursor RNA folds spatially, forming VGR3032 folded precursor RNA, herein designated VGR FOLDED PRECURSOR RNA. It is appreciated that VGR3032 folded precursor RNA comprises a plurality of what is known in the art as 'hairpin' structures. These 'hairpin' structures are due to the fact that the nucleotide sequence of VGR3032 precursor RNA comprises a plurality of segments, the first half of each such segment having a nucleotide sequence which is at least a partial inversed-reversed sequence of the second half thereof, as is well known in the art.

VGR3032 folded precursor RNA is naturally processed by cellular enzymatic activity into at least 3 separate VGAM precursor RNAs, VGAM1326 precursor RNA, VGAM1327 precursor RNA and VGAM1328 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1326 RNA, VGAM1327 RNA and VGAM1328 RNA, herein schematically represented by VGAM1 RNA through VGAM3 RNA, each of which VGAM RNAs corresponding to VGAM RNA of FIG. 1.

VGAM1326 RNA, herein schematically represented by VGAM1 RNA through VGAM3 RNA, binds complementarily to a host target binding site located in an untranslated region of VGAM1326 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1326 host target RNA into VGAM1326 host target protein, herein schematically represented by VGAM1 HOST TARGET PROTEIN through VGAM3 HOST TARGET PROTEIN, all of FIG. 1.

VGAM1327 RNA, herein schematically represented by VGAM1 RNA through VGAM3 RNA, binds complementarily to a host target binding site located in an untranslated region of VGAM1327 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1327 host target RNA into VGAM1327 host target protein, herein schematically represented by VGAM1 HOST TARGET PROTEIN through VGAM3 HOST TARGET PROTEIN, all of FIG. 1.

VGAM1328 RNA, herein schematically represented by VGAM1 RNA through VGAM3 RNA, binds complementarily to a host target binding site located in an untranslated region of VGAM1328 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1328 host target RNA into VGAM1328 host target protein, herein schematically represented by VGAM1 HOST TARGET PROTEIN through VGAM3 HOST TARGET PROTEIN, all of FIG. 1.

It is appreciated that a function of VGR3032 gene, herein designated VGR GENE, is inhibition of expression of host target genes, as part of a novel viral mechanism of attacking a host. Accordingly, utilities of VGR3032 gene include diagnosis, prevention and treatment of viral infection by Myxoma Virus. Specific functions, and accordingly utilities, of VGR3032 gene correlate with, and may be deduced from, the identity of the host target genes, which are inhibited by VGAM RNAs comprised in the 'operon-like' cluster of VGR3032 gene: VGAM1326 host target protein, VGAM1327 host target protein and VGAM1328 host target protein, herein schematically represented by VGAM1 HOST TARGET PROTEIN through VGAM3 HOST TARGET PROTEIN. The function of these host target genes is elaborated hereinabove with reference to VGAM1326, VGAM1327 and VGAM1328. FIG. 9 further provides a conceptual description of novel bioinformatically detected regulatory viral gene, referred to here as Viral Genomic Record 3033(VGR3033) viral gene, which encodes an 'operon-like' cluster of novel viral micro RNA-like genes, each of which in turn modulates expression of at least one host target gene, the function and utility of which at least one host target gene is known in the art.

VGR3033 gene, herein designated VGR GENE, is a novel bioinformatically detected regulatory, non protein coding, RNA viral gene. The method by which VGR3033 gene was detected is described hereinabove with reference to FIGS. 1-9.

VGR3033 gene encodes VGR3033 precursor RNA, herein designated VGR PRECURSOR RNA, an RNA molecule, typically several hundred nucleotides long.

VGR3033 precursor RNA folds spatially, forming VGR3033 folded precursor RNA, herein designated VGR FOLDED PRECURSOR RNA. It is appreciated that VGR3033 folded precursor RNA comprises a plurality of what is known in the art as 'hairpin' structures. These 'hairpin' structures are due to the fact that the nucleotide sequence of VGR3033 precursor RNA comprises a plurality of segments, the first half of each such segment having a nucleotide sequence which is at least a partial inversed-reversed sequence of the second half thereof, as is well known in the art.

VGR3033 folded precursor RNA is naturally processed by cellular enzymatic activity into at least 6 separate VGAM precursor RNAs, VGAM1330 precursor RNA, VGAM1331 precursor RNA, VGAM1332 precursor RNA, VGAM1333 precursor RNA, VGAM1334 precursor RNA and VGAM1335 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1330 RNA, VGAM1331 RNA, VGAM1332 RNA, VGAM1333 RNA, VGAM1334 RNA and VGAM1335 RNA, herein schematically represented by VGAM1 RNA through VGAM3 RNA, each of which VGAM RNAs corresponding to VGAM RNA of FIG. 1.

VGAM1330 RNA, herein schematically represented by VGAM1 RNA through VGAM3 RNA, binds complementarily to a host target binding site located in an untranslated region of VGAM1330 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1330 host target RNA into VGAM1330 host target protein, herein schematically represented by VGAM1 HOST TARGET PROTEIN through VGAM3 HOST TARGET PROTEIN, all of FIG. 1.

VGAM1331 RNA, herein schematically represented by VGAM1 RNA through VGAM3 RNA, binds complementarily to a host target binding site located in an untranslated region of VGAM1331 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1331 host target RNA into VGAM1331 host target protein, herein schematically represented by VGAM1 HOST TARGET PROTEIN through VGAM3 HOST TARGET PROTEIN, all of FIG. 1.

VGAM1332 RNA, herein schematically represented by VGAM1 RNA through VGAM3 RNA, binds complementarily to a host target binding site located in an untranslated region of VGAM1332 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1332 host target RNA into VGAM1332 host target protein, herein schematically represented by VGAM1 HOST TARGET PROTEIN through VGAM3 HOST TARGET PROTEIN, all of FIG. 1.

VGAM1333 RNA, herein schematically represented by VGAM1 RNA through VGAM3 RNA, binds complementarily to a host target binding site located in an untranslated region of VGAM1333 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1333 host target RNA into VGAM1333 host target protein, herein schematically represented by VGAM1 HOST TARGET PROTEIN through VGAM3 HOST TARGET PROTEIN, all of FIG. 1.

VGAM1334 RNA, herein schematically represented by VGAM1 RNA through VGAM3 RNA, binds complementarily to a host target binding site located in an untranslated region of VGAM1334 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1334 host target RNA into VGAM1334 host target protein, herein schematically represented by VGAM1 HOST TARGET PROTEIN through VGAM3 HOST TARGET PROTEIN, all of FIG. 1.

VGAM1335 RNA, herein schematically represented by VGAM1 RNA through VGAM3 RNA, binds complementarily to a host target binding site located in an untranslated region of VGAM1335 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1335 host target RNA into VGAM1335 host target protein, herein schematically represented by VGAM1 HOST TARGET PROTEIN through VGAM3 HOST TARGET PROTEIN, all of FIG. 1.

It is appreciated that a function of VGR3033 gene, herein designated VGR GENE, is inhibition of expression of host target genes, as part of a novel viral mechanism of attacking a host. Accordingly, utilities of VGR3033 gene include diagnosis, prevention and treatment of viral infection by Human Adenovirus A. Specific functions, and accordingly utilities, of VGR3033 gene correlate with, and may be deduced from, the identity of the host target genes, which are inhibited by VGAM RNAs comprised in the 'operon-like' cluster of VGR3033 gene: VGAM1330 host target protein, VGAM1331 host target protein, VGAM1332 host target protein, VGAM1333 host target protein, VGAM1334 host target protein and VGAM1335 host target protein, herein schematically represented by VGAM1 HOST TARGET PROTEIN through VGAM3 HOST TARGET PROTEIN. The function of these host target genes is elaborated hereinabove with reference to VGAM1330, VGAM1331, VGAM1332, VGAM1333, VGAM1334 and VGAM1335. FIG. 9 further provides a conceptual description of novel bioinformatically detected regulatory viral gene, referred to here as Viral Genomic Record 3034(VGR3034) viral gene, which encodes an 'operon-like' cluster of novel viral micro RNA-like genes, each of which in turn modulates expression of at least one host target gene, the function and utility of which at least one host target gene is known in the art.

VGR3034 gene, herein designated VGR GENE, is a novel bioinformatically detected regulatory, non protein coding, RNA viral gene. The method by which VGR3034 gene was detected is described hereinabove with reference to FIGS. 1-9.

VGR3034 gene encodes VGR3034 precursor RNA, herein designated VGR PRECURSOR RNA, an RNA molecule, typically several hundred nucleotides long.

VGR3034 precursor RNA folds spatially, forming VGR3034 folded precursor RNA, herein designated VGR FOLDED PRECURSOR RNA. It is appreciated that VGR3034 folded precursor RNA comprises a plurality of what is known in the art as 'hairpin' structures. These 'hairpin' structures are due to the fact that the nucleotide sequence of VGR3034 precursor RNA comprises a plurality of segments, the first half of each such segment having a nucleotide sequence which is at least a partial inversed-reversed sequence of the second half thereof, as is well known in the art.

VGR3034 folded precursor RNA is naturally processed by cellular enzymatic activity into at least 2 separate VGAM precursor RNAs, VGAM1336 precursor RNA and VGAM1337 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1336 RNA and VGAM1337 RNA, herein schematically represented by VGAM1 RNA through VGAM3 RNA, each of which VGAM RNAs corresponding to VGAM RNA of FIG. 1.

VGAM1336 RNA, herein schematically represented by VGAM1 RNA through VGAM3 RNA, binds complementarily to a host target binding site located in an untranslated region of VGAM1336 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1336 host target RNA into VGAM1336 host target protein, herein schematically represented by VGAM1 HOST TARGET PROTEIN through VGAM3 HOST TARGET PROTEIN, all of FIG. 1.

VGAM1337 RNA, herein schematically represented by VGAM1 RNA through VGAM3 RNA, binds complementarily to a host target binding site located in an untranslated region of VGAM1337 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1337 host target RNA into VGAM1337 host target protein, herein schematically represented by VGAM1 HOST TARGET PROTEIN through VGAM3 HOST TARGET PROTEIN, all of FIG. 1.

It is appreciated that a function of VGR3034 gene, herein designated VGR GENE, is inhibition of expression of host target genes, as part of a novel viral mechanism of attacking a host. Accordingly, utilities of VGR3034 gene include diagnosis, prevention and treatment of viral infection by Sheeppox Virus. Specific functions, and accordingly utilities, of VGR3034 gene correlate with, and may be deduced from, the identity of the host target genes, which are inhibited by VGAM RNAs comprised in the 'operon-like' cluster of VGR3034 gene: VGAM1336 host target protein and VGAM1337 host target protein, herein schematically represented by VGAM1 HOST TARGET PROTEIN through VGAM3 HOST TARGET PROTEIN. The function of these host target genes is elaborated hereinabove with reference to VGAM1336 and VGAM1337. FIG. 9 further provides a conceptual description of novel bioinformatically detected regulatory viral gene, referred to here as Viral Genomic Record 3035(VGR3035) viral gene, which encodes an 'operon-like' cluster of novel viral micro RNA-like genes, each of which in turn modulates expression of at least one host target gene, the function and utility of which at least one host target gene is known in the art.

VGR3035 gene, herein designated VGR GENE, is a novel bioinformatically detected regulatory, non protein coding, RNA viral gene. The method by which VGR3035 gene was detected is described hereinabove with reference to FIGS. 1-9.

VGR3035 gene encodes VGR3035 precursor RNA, herein designated VGR PRECURSOR RNA, an RNA molecule, typically several hundred nucleotides long.

VGR3035 precursor RNA folds spatially, forming VGR3035 folded precursor RNA, herein designated VGR FOLDED PRECURSOR RNA. It is appreciated that VGR3035 folded precursor RNA comprises a plurality of what is known in the art as 'hairpin' structures. These 'hairpin' structures are due to the fact that the nucleotide sequence of VGR3035 precursor RNA comprises a plurality of segments, the first half of each such segment having a nucleotide sequence which is at least a partial inversed-reversed sequence of the second half thereof, as is well known in the art.

VGR3035 folded precursor RNA is naturally processed by cellular enzymatic activity into at least 4 separate VGAM precursor RNAs, VGAM1340 precursor RNA, VGAM1341 precursor RNA, VGAM1342 precursor RNA and VGAM1343 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1340 RNA, VGAM1341 RNA, VGAM1342 RNA and VGAM1343 RNA, herein schematically represented by VGAM1 RNA through VGAM3 RNA, each of which VGAM RNAs corresponding to VGAM RNA of FIG. 1.

VGAM1340 RNA, herein schematically represented by VGAM1 RNA through VGAM3 RNA, binds complementarily to a host target binding site located in an untranslated region of VGAM1340 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1340 host target RNA into VGAM1340 host target protein, herein schematically represented by VGAM1 HOST TARGET PROTEIN through VGAM3 HOST TARGET PROTEIN, all of FIG. 1.

VGAM1341 RNA, herein schematically represented by VGAM1 RNA through VGAM3 RNA, binds complementarily to a host target binding site located in an untranslated region of VGAM1341 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1341 host target RNA into VGAM1341 host target protein, herein schematically represented by VGAM1 HOST TARGET PROTEIN through VGAM3 HOST TARGET PROTEIN, all of FIG. 1.

VGAM1342 RNA, herein schematically represented by VGAM1 RNA through VGAM3 RNA, binds complementarily to a host target binding site located in an untranslated region of VGAM1342 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1342 host target RNA into VGAM1342 host target protein, herein schematically represented by VGAM1 HOST TARGET PROTEIN through VGAM3 HOST TARGET PROTEIN, all of FIG. 1.

VGAM1343 RNA, herein schematically represented by VGAM1 RNA through VGAM3 RNA, binds complementarily to a host target binding site located in an untranslated region of VGAM1343 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1343 host target RNA into VGAM1343 host target protein, herein schematically represented by VGAM1 HOST TARGET PROTEIN through VGAM3 HOST TARGET PROTEIN, all of FIG. 1.

It is appreciated that a function of VGR3035 gene, herein designated VGR GENE, is inhibition of expression of host target genes, as part of a novel viral mechanism of attacking a host. Accordingly, utilities of VGR3035 gene include diagnosis, prevention and treatment of viral infection by Garlic Virus A. Specific functions, and accordingly utilities, of VGR3035 gene correlate with, and may be deduced from, the identity of the host target genes, which are inhibited by VGAM RNAs comprised in the 'operon-like' cluster of VGR3035 gene: VGAM1340 host target protein, VGAM1341 host target protein, VGAM1342 host target protein and VGAM1343 host target protein, herein schematically represented by VGAM1 HOST TARGET PROTEIN through VGAM3 HOST TARGET PROTEIN. The function of these host target genes is elaborated hereinabove with reference to VGAM1340, VGAM1341, VGAM1342 and VGAM1343. FIG. 9 further provides a conceptual description of novel bioinformatically detected regulatory viral gene, referred to here as Viral Genomic Record 3036(VGR3036) viral gene, which encodes an 'operon-like' cluster of novel viral micro RNA-like genes, each of which in turn modulates expression of at least one host target gene, the function and utility of which at least one host target gene is known in the art.

VGR3036 gene, herein designated VGR GENE, is a novel bioinformatically detected regulatory, non protein coding, RNA viral gene. The method by which VGR3036 gene was detected is described hereinabove with reference to FIGS. 1-9.

VGR3036 gene encodes VGR3036 precursor RNA, herein designated VGR PRECURSOR RNA, an RNA molecule, typically several hundred nucleotides long.

VGR3036 precursor RNA folds spatially, forming VGR3036 folded precursor RNA, herein designated VGR FOLDED PRECURSOR RNA. It is appreciated that VGR3036 folded precursor RNA comprises a plurality of what is known in the art as 'hairpin' structures. These 'hairpin' structures are due to the fact that the nucleotide sequence of VGR3036 precursor RNA comprises a plurality of segments, the first half of each such segment having a nucleotide sequence which is at least a partial inversed-reversed sequence of the second half thereof, as is well known in the art.

VGR3036 folded precursor RNA is naturally processed by cellular enzymatic activity into at least 8 separate VGAM precursor RNAs, VGAM1346 precursor RNA, VGAM1347 precursor RNA, VGAM1348 precursor RNA, VGAM1349 precursor RNA, VGAM1350 precursor RNA, VGAM1351 precursor RNA, VGAM1352 precursor RNA and VGAM1353 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1346 RNA, VGAM1347 RNA, VGAM1348 RNA, VGAM1349 RNA, VGAM1350 RNA, VGAM1351 RNA, VGAM1352 RNA and VGAM1353 RNA, herein schematically represented by VGAM1 RNA through VGAM3 RNA, each of which VGAM RNAs corresponding to VGAM RNA of FIG. 1.

VGAM1346 RNA, herein schematically represented by VGAM1 RNA through VGAM3 RNA, binds complementarily to a host target binding site located in an untranslated region of VGAM1346 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1346 host target RNA into VGAM1346 host target protein, herein schematically represented by VGAM1 HOST TARGET PROTEIN through VGAM3 HOST TARGET PROTEIN, all of FIG. 1.

VGAM1347 RNA, herein schematically represented by VGAM1 RNA through VGAM3 RNA, binds complementarily to a host target binding site located in an untranslated region of VGAM1347 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1347 host target RNA into VGAM1347 host target protein, herein schematically represented by VGAM1 HOST TARGET PROTEIN through VGAM3 HOST TARGET PROTEIN, all of FIG. 1.

VGAM1348 RNA, herein schematically represented by VGAM1 RNA through VGAM3 RNA, binds complementarily to a host target binding site located in an untranslated region of VGAM1348 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1348 host target RNA into VGAM1348 host target protein, herein schematically represented by VGAM1 HOST TARGET PROTEIN through VGAM3 HOST TARGET PROTEIN, all of FIG. 1.

VGAM1349 RNA, herein schematically represented by VGAM1 RNA through VGAM3 RNA, binds complementarily to a host target binding site located in an untranslated region of VGAM1349 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1349 host target RNA into VGAM1349 host target protein, herein schematically represented by VGAM1 HOST TARGET PROTEIN through VGAM3 HOST TARGET PROTEIN, all of FIG. 1.

VGAM1350 RNA, herein schematically represented by VGAM1 RNA through VGAM3 RNA, binds complementarily to a host target binding site located in an untranslated region of VGAM1350 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1350 host target RNA into VGAM1350 host target protein, herein schematically represented by VGAM1 HOST TARGET PROTEIN through VGAM3 HOST TARGET PROTEIN, all of FIG. 1.

VGAM1351 RNA, herein schematically represented by VGAM1 RNA through VGAM3 RNA, binds complementarily to a host target binding site located in an untranslated region of VGAM1351 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1351 host target RNA into VGAM1351 host target protein, herein schematically represented by VGAM1 HOST TARGET PROTEIN through VGAM3 HOST TARGET PROTEIN, all of FIG. 1.

VGAM1352 RNA, herein schematically represented by VGAM1 RNA through VGAM3 RNA, binds complementarily to a host target binding site located in an untranslated region of VGAM1352 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1352 host target RNA into VGAM1352 host target protein, herein schematically represented by VGAM1 HOST TARGET PROTEIN through VGAM3 HOST TARGET PROTEIN, all of FIG. 1.

VGAM1353 RNA, herein schematically represented by VGAM1 RNA through VGAM3 RNA, binds complementarily to a host target binding site located in an untranslated region of VGAM1353 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1353 host target RNA into VGAM1353 host target protein, herein schematically represented by VGAM1 HOST TARGET PROTEIN through VGAM3 HOST TARGET PROTEIN, all of FIG. 1.

It is appreciated that a function of VGR3036 gene, herein designated VGR GENE, is inhibition of expression of host target genes, as part of a novel viral mechanism of attacking a host. Accordingly, utilities of VGR3036 gene include diagnosis, prevention and treatment of viral infection by Fowlpox Virus. Specific functions, and accordingly utilities, of VGR3036 gene correlate with, and may be deduced from, the identity of the host target genes, which are inhibited by VGAM RNAs comprised in the 'operon-like' cluster of VGR3036 gene: VGAM1346 host target protein, VGAM1347 host target protein, VGAM1348 host target protein, VGAM1349 host target protein, VGAM1350 host target protein, VGAM1351 host target protein, VGAM1352 host target protein and VGAM1353 host target protein, herein schematically represented by VGAM1 HOST TARGET PROTEIN through VGAM3 HOST TARGET PROTEIN. The function of these host target genes is elaborated hereinabove with reference to VGAM1346, VGAM1347, VGAM1348, VGAM1349, VGAM1350, VGAM1351, VGAM1352 and VGAM1353. FIG. 9 further provides a conceptual description of novel bioinformatically detected regulatory viral gene, referred to here as Viral Genomic Record 3037(VGR3037) viral gene, which encodes an 'operon-like' cluster of novel viral micro RNA-like genes, each of which in turn modulates expression of at least one host target gene, the function and utility of which at least one host target gene is known in the art.

VGR3037 gene, herein designated VGR GENE, is a novel bioinformatically detected regulatory, non protein coding, RNA viral gene. The method by which VGR3037 gene was detected is described hereinabove with reference to FIGS. 1-9.

VGR3037 gene encodes VGR3037 precursor RNA, herein designated VGR PRECURSOR RNA, an RNA molecule, typically several hundred nucleotides long.

VGR3037 precursor RNA folds spatially, forming VGR3037 folded precursor RNA, herein designated VGR FOLDED PRECURSOR RNA. It is appreciated that VGR3037 folded precursor RNA comprises a plurality of what is known in the art as 'hairpin' structures. These 'hairpin' structures are due to the fact that the nucleotide sequence of VGR3037 precursor RNA comprises a plurality of segments, the first half of each such segment having a nucleotide sequence which is at least a partial inversed-reversed sequence of the second half thereof, as is well known in the art.

VGR3037 folded precursor RNA is naturally processed by cellular enzymatic activity into at least 8 separate VGAM precursor RNAs, VGAM1354 precursor RNA, VGAM1355 precursor RNA, VGAM1356 precursor RNA, VGAM1357 precursor RNA, VGAM1358 precursor RNA, VGAM1359 precursor RNA, VGAM1360 precursor RNA and VGAM1361 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1354 RNA, VGAM1355 RNA, VGAM1356 RNA, VGAM1357 RNA, VGAM1358 RNA, VGAM1359 RNA, VGAM1360 RNA and VGAM1361 RNA, herein schematically represented by VGAM1 RNA through VGAM3 RNA, each of which VGAM RNAs corresponding to VGAM RNA of FIG. 1.

VGAM1354 RNA, herein schematically represented by VGAM1 RNA through VGAM3 RNA, binds complementarily to a host target binding site located in an untranslated region of VGAM1354 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1354 host target RNA into VGAM1354 host target protein, herein schematically represented by VGAM1 HOST TARGET PROTEIN through VGAM3 HOST TARGET PROTEIN, all of FIG. 1.

VGAM1355 RNA, herein schematically represented by VGAM1 RNA through VGAM3 RNA, binds complementarily to a host target binding site located in an untranslated region of VGAM1355 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1355 host target RNA into VGAM1355 host target protein, herein schematically represented by VGAM1 HOST TARGET PROTEIN through VGAM3 HOST TARGET PROTEIN, all of FIG. 1.

VGAM1356 RNA, herein schematically represented by VGAM1 RNA through VGAM3 RNA, binds complementarily to a host target binding site located in an untranslated region of VGAM1356 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1356 host target RNA into VGAM1356 host target protein, herein schematically represented by VGAM1 HOST TARGET PROTEIN through VGAM3 HOST TARGET PROTEIN, all of FIG. 1.

VGAM1357 RNA, herein schematically represented by VGAM1 RNA through VGAM3 RNA, binds complementarily to a host target binding site located in an untranslated region of VGAM1357 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1357 host target RNA into VGAM1357 host target protein, herein schematically represented by VGAM1 HOST TARGET PROTEIN through VGAM3 HOST TARGET PROTEIN, all of FIG. 1.

VGAM1358 RNA, herein schematically represented by VGAM1 RNA through VGAM3 RNA, binds complementarily to a host target binding site located in an untranslated region of VGAM1358 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1358 host target RNA into VGAM1358 host target protein, herein schematically represented by VGAM1 HOST TARGET PROTEIN through VGAM3 HOST TARGET PROTEIN, all of FIG. 1.

VGAM1359 RNA, herein schematically represented by VGAM1 RNA through VGAM3 RNA, binds complementarily to a host target binding site located in an untranslated region of VGAM1359 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1359 host target RNA into VGAM1359 host target protein, herein schematically represented by VGAM1 HOST TARGET PROTEIN through VGAM3 HOST TARGET PROTEIN, all of FIG. 1.

VGAM1360 RNA, herein schematically represented by VGAM1 RNA through VGAM3 RNA, binds complementarily to a host target binding site located in an untranslated region of VGAM1360 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1360 host target RNA into VGAM1360 host target protein, herein schematically represented by VGAM1 HOST TARGET PROTEIN through VGAM3 HOST TARGET PROTEIN, all of FIG. 1.

VGAM1361 RNA, herein schematically represented by VGAM1 RNA through VGAM3 RNA, binds complementarily to a host target binding site located in an untranslated region of VGAM1361 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1361 host target RNA into VGAM1361 host target protein, herein schematically represented by VGAM1 HOST TARGET PROTEIN through VGAM3 HOST TARGET PROTEIN, all of FIG. 1.

It is appreciated that a function of VGR3037 gene, herein designated VGR GENE, is inhibition of expression of host target genes, as part of a novel viral mechanism of attacking a host. Accordingly, utilities of VGR3037 gene include diagnosis, prevention and treatment of viral infection by Triatoma Virus. Specific functions, and accordingly utilities, of VGR3037 gene correlate with, and may be deduced from, the identity of the host target genes, which are inhibited by VGAM RNAs comprised in the 'operon-like' cluster of VGR3037 gene: VGAM1354 host target protein, VGAM1355 host target protein, VGAM1356 host target protein, VGAM1357 host target protein, VGAM1358 host target protein, VGAM1359 host target protein, VGAM1360 host target protein and VGAM1361 host target protein, herein schematically represented by VGAM1 HOST TARGET PROTEIN through VGAM3 HOST TARGET PROTEIN. The function of these host target genes is elaborated hereinabove with reference to VGAM1354, VGAM1355, VGAM1356, VGAM1357, VGAM1358, VGAM1359, VGAM1360 and VGAM1361. FIG. 9 further provides a conceptual description of novel bioinformatically detected regulatory viral gene, referred to here as Viral Genomic Record 3038(VGR3038) viral gene, which encodes an 'operon-like' cluster of novel viral micro RNA-like genes, each of which in turn modulates expression of at least one host target gene, the function and utility of which at least one host target gene is known in the art.

VGR3038 gene, herein designated VGR GENE, is a novel bioinformatically detected regulatory, non protein coding, RNA viral gene. The method by which VGR3038 gene was detected is described hereinabove with reference to FIGS. 1-9.

VGR3038 gene encodes VGR3038 precursor RNA, herein designated VGR PRECURSOR RNA, an RNA molecule, typically several hundred nucleotides long.

VGR3038 precursor RNA folds spatially, forming VGR3038 folded precursor RNA, herein designated VGR FOLDED PRECURSOR RNA. It is appreciated that VGR3038 folded precursor RNA comprises a plurality of what is known in the art as 'hairpin' structures. These 'hairpin' structures are due to the fact that the nucleotide sequence of VGR3038 precursor RNA comprises a plurality of segments, the first half of each such segment having a nucleotide sequence which is at least a partial inversed-reversed sequence of the second half thereof, as is well known in the art.

VGR3038 folded precursor RNA is naturally processed by cellular enzymatic activity into at least 4 separate VGAM precursor RNAs, VGAM1362 precursor RNA, VGAM1363 precursor RNA, VGAM1364 precursor RNA and VGAM1365 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1362 RNA, VGAM1363 RNA, VGAM1364 RNA and VGAM1365 RNA, herein schematically represented by VGAM1 RNA through VGAM3 RNA, each of which VGAM RNAs corresponding to VGAM RNA of FIG. 1.

VGAM1362 RNA, herein schematically represented by VGAM1 RNA through VGAM3 RNA, binds complementarily to a host target binding site located in an untranslated region of VGAM1362 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1362 host target RNA into VGAM1362 host target protein, herein schematically represented by VGAM1 HOST TARGET PROTEIN through VGAM3 HOST TARGET PROTEIN, all of FIG. 1.

VGAM1363 RNA, herein schematically represented by VGAM1 RNA through VGAM3 RNA, binds complementarily to a host target binding site located in an untranslated region of VGAM1363 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1363 host target RNA into VGAM1363 host target protein, herein schematically represented by VGAM1 HOST TARGET PROTEIN through VGAM3 HOST TARGET PROTEIN, all of FIG. 1.

VGAM1364 RNA, herein schematically represented by VGAM1 RNA through VGAM3 RNA, binds complementarily to a host target binding site located in an untranslated region of VGAM1364 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1364 host target RNA into VGAM1364 host target protein, herein schematically represented by VGAM1 HOST TARGET PROTEIN through VGAM3 HOST TARGET PROTEIN, all of FIG. 1.

VGAM1365 RNA, herein schematically represented by VGAM1 RNA through VGAM3 RNA, binds complementarily to a host target binding site located in an untranslated region of VGAM1365 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1365 host target RNA into VGAM1365 host target protein, herein schematically represented by VGAM1 HOST TARGET PROTEIN through VGAM3 HOST TARGET PROTEIN, all of FIG. 1.

It is appreciated that a function of VGR3038 gene, herein designated VGR GENE, is inhibition of expression of host target genes, as part of a novel viral mechanism of attacking a host. Accordingly, utilities of VGR3038 gene include diagnosis, prevention and treatment of viral infection by Duck Adenovirus 1. Specific functions, and accordingly utilities, of VGR3038 gene correlate with, and may be deduced from, the identity of the host target genes, which are inhibited by VGAM RNAs comprised in the 'operon-like' cluster of VGR3038 gene: VGAM1362 host target protein, VGAM1363 host target protein, VGAM1364 host target protein and VGAM1365 host target protein, herein schematically represented by VGAM1 HOST TARGET PROTEIN through VGAM3 HOST TARGET PROTEIN. The function of these host target genes is elaborated hereinabove with reference to VGAM1362, VGAM1363, VGAM1364 and VGAM1365.

FIG. 9 further provides a conceptual description of novel bioinformatically detected regulatory viral gene, referred to here as Viral Genomic Record 3039(VGR3039) viral gene, which encodes an 'operon-like' cluster of novel viral micro RNA-like genes, each of which in turn modulates expression of at least one host target gene, the function and utility of which at least one host target gene is known in the art.

VGR3039 gene, herein designated VGR GENE, is a novel bioinformatically detected regulatory, non protein coding, RNA viral gene. The method by which VGR3039 gene was detected is described hereinabove with reference to FIGS. 1-9.

VGR3039 gene encodes VGR3039 precursor RNA, herein designated VGR PRECURSOR RNA, an RNA molecule, typically several hundred nucleotides long.

VGR3039 precursor RNA folds spatially, forming VGR3039 folded precursor RNA, herein designated VGR FOLDED PRECURSOR RNA. It is appreciated that VGR3039 folded precursor RNA comprises a plurality of what is known in the art as 'hairpin' structures. These 'hairpin' structures are due to the fact that the nucleotide sequence of VGR3039 precursor RNA comprises a plurality of segments, the first half of each such segment having a nucleotide sequence which is at least a partial inversed-reversed sequence of the second half thereof, as is well known in the art.

VGR3039 folded precursor RNA is naturally processed by cellular enzymatic activity into at least 6 separate VGAM precursor RNAs, VGAM1366 precursor RNA, VGAM1367 precursor RNA, VGAM1368 precursor RNA, VGAM1369 precursor RNA, VGAM1370 precursor RNA and VGAM1371 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1366 RNA, VGAM1367 RNA, VGAM1368 RNA, VGAM1369 RNA, VGAM1370 RNA and VGAM1371 RNA, herein schematically represented by VGAM1 RNA through VGAM3 RNA, each of which VGAM RNAs corresponding to VGAM RNA of FIG. 1.

VGAM1366 RNA, herein schematically represented by VGAM1 RNA through VGAM3 RNA, binds complementarily to a host target binding site located in an untranslated region of VGAM1366 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1366 host target RNA into VGAM1366 host target protein, herein schematically represented by VGAM1 HOST TARGET PROTEIN through VGAM3 HOST TARGET PROTEIN, all of FIG. 1.

VGAM1367 RNA, herein schematically represented by VGAM1 RNA through VGAM3 RNA, binds complementarily to a host target binding site located in an untranslated region of VGAM1367 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1367 host target RNA into VGAM1367 host target protein, herein schematically represented by VGAM1 HOST TARGET PROTEIN through VGAM3 HOST TARGET PROTEIN, all of FIG. 1.

VGAM1368 RNA, herein schematically represented by VGAM1 RNA through VGAM3 RNA, binds complementarily to a host target binding site located in an untranslated region of VGAM1368 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1368 host target RNA into VGAM1368 host target protein, herein schematically represented by VGAM1 HOST TARGET PROTEIN through VGAM3 HOST TARGET PROTEIN, all of FIG. 1.

VGAM1369 RNA, herein schematically represented by VGAM1 RNA through VGAM3 RNA, binds complementarily to a host target binding site located in an untranslated region of VGAM1369 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1369 host target RNA into VGAM1369 host target protein, herein schematically represented by VGAM1 HOST TARGET PROTEIN through VGAM3 HOST TARGET PROTEIN, all of FIG. 1.

VGAM1370 RNA, herein schematically represented by VGAM1 RNA through VGAM3 RNA, binds complementarily to a host target binding site located in an untranslated region of VGAM1370 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1370 host target RNA into VGAM1370 host target protein, herein schematically represented by VGAM1 HOST TARGET PROTEIN through VGAM3 HOST TARGET PROTEIN, all of FIG. 1.

VGAM1371 RNA, herein schematically represented by VGAM1 RNA through VGAM3 RNA, binds complementarily to a host target binding site located in an untranslated region of VGAM1371 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1371 host target RNA into VGAM1371 host target protein, herein schematically represented by VGAM1 HOST TARGET PROTEIN through VGAM3 HOST TARGET PROTEIN, all of FIG. 1.

It is appreciated that a function of VGR3039 gene, herein designated VGR GENE, is inhibition of expression of host target genes, as part of a novel viral mechanism of attacking a host. Accordingly, utilities of VGR3039 gene include diagnosis, prevention and treatment of viral infection by Human Herpesvirus 6. Specific functions, and accordingly utilities, of VGR3039 gene correlate with, and may be deduced from, the identity of the host target genes, which are inhibited by VGAM RNAs comprised in the 'operon-like' cluster of VGR3039 gene: VGAM1366 host target protein, VGAM1367 host target protein, VGAM1368 host target protein, VGAM1369 host target protein, VGAM1370 host target protein and VGAM1371 host target protein, herein schematically represented by VGAM1 HOST TARGET PROTEIN through VGAM3 HOST TARGET PROTEIN. The function of these host target genes is elaborated hereinabove with reference to VGAM1366, VGAM1367, VGAM1368, VGAM1369, VGAM1370 and VGAM1371. FIG. 9 further provides a conceptual description of novel bioinformatically detected regulatory viral gene, referred to here as Viral Genomic Record 3040(VGR3040) viral gene, which encodes an 'operon-like' cluster of novel viral micro RNA-like genes, each of which in turn modulates expression of at least one host target gene, the function and utility of which at least one host target gene is known in the art.

VGR3040 gene, herein designated VGR GENE, is a novel bioinformatically detected regulatory, non protein coding, RNA viral gene. The method by which VGR3040 gene was detected is described hereinabove with reference to FIGS. 1-9.

VGR3040 gene encodes VGR3040 precursor RNA, herein designated VGR PRECURSOR RNA, an RNA molecule, typically several hundred nucleotides long.

VGR3040 precursor RNA folds spatially, forming VGR3040 folded precursor RNA, herein designated VGR FOLDED PRECURSOR RNA. It is appreciated that VGR3040 folded precursor RNA comprises a plurality of what is known in the art as 'hairpin' structures. These 'hairpin' structures are due to the fact that the nucleotide sequence of VGR3040 precursor RNA comprises a plurality of segments, the first half of each such segment having a nucleotide sequence which is at least a partial inversed-reversed sequence of the second half thereof, as is well known in the art.

VGR3040 folded precursor RNA is naturally processed by cellular enzymatic activity into at least 6 separate VGAM precursor RNAs, VGAM1372 precursor RNA, VGAM1373 precursor RNA, VGAM1374 precursor RNA, VGAM1375 precursor RNA, VGAM1376 precursor RNA and VGAM1377 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1372 RNA, VGAM1373 RNA, VGAM1374 RNA, VGAM1375 RNA, VGAM1376 RNA and VGAM1377 RNA, herein schematically represented by VGAM1 RNA through VGAM3 RNA, each of which VGAM RNAs corresponding to VGAM RNA of FIG. 1.

VGAM1372 RNA, herein schematically represented by VGAM1 RNA through VGAM3 RNA, binds complementarily to a host target binding site located in an untranslated region of VGAM1372 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1372 host target RNA into VGAM1372 host target protein, herein schematically represented by VGAM1 HOST TARGET PROTEIN through VGAM3 HOST TARGET PROTEIN, all of FIG. 1.

VGAM1373 RNA, herein schematically represented by VGAM1 RNA through VGAM3 RNA, binds complementarily to a host target binding site located in an untranslated region of VGAM1373 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1373 host target RNA into VGAM1373 host target protein, herein schematically represented by VGAM1 HOST TARGET PROTEIN through VGAM3 HOST TARGET PROTEIN, all of FIG. 1.

VGAM1374 RNA, herein schematically represented by VGAM1 RNA through VGAM3 RNA, binds complementarily to a host target binding site located in an untranslated region of VGAM1374 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1374 host target RNA into VGAM1374 host target protein, herein schematically represented by VGAM1 HOST TARGET PROTEIN through VGAM3 HOST TARGET PROTEIN, all of FIG. 1.

VGAM1375 RNA, herein schematically represented by VGAM1 RNA through VGAM3 RNA, binds complementarily to a host target binding site located in an untranslated region of VGAM1375 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1375 host target RNA into VGAM1375 host target protein, herein schematically represented by VGAM1 HOST TARGET PROTEIN through VGAM3 HOST TARGET PROTEIN, all of FIG. 1.

VGAM1376 RNA, herein schematically represented by VGAM1 RNA through VGAM3 RNA, binds complementarily to a host target binding site located in an untranslated region of VGAM1376 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1376 host target RNA into VGAM1376 host target protein, herein schematically represented by VGAM1 HOST TARGET PROTEIN through VGAM3 HOST TARGET PROTEIN, all of FIG. 1.

VGAM1377 RNA, herein schematically represented by VGAM1 RNA through VGAM3 RNA, binds complementarily to a host target binding site located in an untranslated region of VGAM1377 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1377 host target RNA into VGAM1377 host target protein, herein schematically represented by VGAM1 HOST TARGET PROTEIN through VGAM3 HOST TARGET PROTEIN, all of FIG. 1.

It is appreciated that a function of VGR3040 gene, herein designated VGR GENE, is inhibition of expression of host target genes, as part of a novel viral mechanism of attacking a host. Accordingly, utilities of VGR3040 gene include diagnosis, prevention and treatment of viral infection by Alcelaphine Herpesvirus 1. Specific functions, and accordingly utilities, of VGR3040 gene correlate with, and may be deduced from, the identity of the host target genes, which are inhibited by VGAM RNAs comprised in the 'operon-like' cluster of VGR3040 gene: VGAM1372 host target protein, VGAM1373 host target protein, VGAM1374 host target protein, VGAM1375 host target protein, VGAM1376 host target protein and VGAM1377 host target protein, herein schematically represented by VGAM1 HOST TARGET PROTEIN through VGAM3 HOST TARGET PROTEIN. The function of these host target genes is elaborated hereinabove with reference to VGAM1372, VGAM1373, VGAM1374, VGAM1375, VGAM1376 and VGAM1377. FIG. 9 further provides a conceptual description of novel bioinformatically detected regulatory viral gene, referred to here as Viral Genomic Record 3041(VGR3041) viral gene, which encodes an 'operon-like' cluster of novel viral micro RNA-like genes, each of which in turn modulates expression of at least one host target gene, the function and utility of which at least one host target gene is known in the art.

VGR3041 gene, herein designated VGR GENE, is a novel bioinformatically detected regulatory, non protein coding, RNA viral gene. The method by which VGR3041 gene was detected is described hereinabove with reference to FIGS. 1-9.

VGR3041 gene encodes VGR3041 precursor RNA, herein designated VGR PRECURSOR RNA, an RNA molecule, typically several hundred nucleotides long.

VGR3041 precursor RNA folds spatially, forming VGR3041 folded precursor RNA, herein designated VGR FOLDED PRECURSOR RNA. It is appreciated that VGR3041 folded precursor RNA comprises a plurality of what is known in the art as 'hairpin' structures. These 'hairpin' structures are due to the fact that the nucleotide sequence of VGR3041 precursor RNA comprises a plurality of segments, the first half of each such segment having a nucleotide sequence which is at least a partial inversed-reversed sequence of the second half thereof, as is well known in the art.

VGR3041 folded precursor RNA is naturally processed by cellular enzymatic activity into at least 2 separate VGAM precursor RNAs, VGAM1378 precursor RNA and VGAM1379 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1378 RNA and VGAM1379 RNA, herein schematically represented by VGAM1 RNA through VGAM3 RNA, each of which VGAM RNAs corresponding to VGAM RNA of FIG. 1.

VGAM1378 RNA, herein schematically represented by VGAM1 RNA through VGAM3 RNA, binds complementarily to a host target binding site located in an untranslated region of VGAM1378 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1378 host target RNA into VGAM1378 host target protein, herein schematically represented by VGAM1 HOST TARGET PROTEIN through VGAM3 HOST TARGET PROTEIN, all of FIG. 1.

VGAM1379 RNA, herein schematically represented by VGAM1 RNA through VGAM3 RNA, binds complementarily to a host target binding site located in an untranslated region of VGAM1379 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1379 host target RNA into VGAM1379 host target protein, herein schematically represented by VGAM1 HOST TARGET PROTEIN through VGAM3 HOST TARGET PROTEIN, all of FIG. 1.

It is appreciated that a function of VGR3041 gene, herein designated VGR GENE, is inhibition of expression of host target genes, as part of a novel viral mechanism of attacking a host. Accordingly, utilities of VGR3041 gene include diagnosis, prevention and treatment of viral infection by Human Herpesvirus 1. Specific functions, and accordingly utilities, of VGR3041 gene correlate with, and may be deduced from, the identity of the host target genes, which are inhibited by VGAM RNAs comprised in the 'operon-like' cluster of VGR3041 gene: VGAM1378 host target protein and VGAM1379 host target protein, herein schematically represented by VGAM1 HOST TARGET PROTEIN through VGAM3 HOST TARGET PROTEIN. The function of these host target genes is elaborated hereinabove with reference to VGAM1378 and VGAM1379. FIG. 9 further provides a conceptual description of novel bioinformatically detected regulatory viral gene, referred to here as Viral Genomic Record 3042(VGR3042) viral gene, which encodes an 'operon-like' cluster of novel viral micro RNA-like genes, each of which in turn modulates expression of at least one host target gene, the function and utility of which at least one host target gene is known in the art.

VGR3042 gene, herein designated VGR GENE, is a novel bioinformatically detected regulatory, non protein coding, RNA viral gene. The method by which VGR3042 gene was detected is described hereinabove with reference to FIGS. 1-9.

VGR3042 gene encodes VGR3042 precursor RNA, herein designated VGR PRECURSOR RNA, an RNA molecule, typically several hundred nucleotides long.

VGR3042 precursor RNA folds spatially, forming VGR3042 folded precursor RNA, herein designated VGR FOLDED PRECURSOR RNA. It is appreciated that VGR3042 folded precursor RNA comprises a plurality of what is known in the art as 'hairpin' structures. These 'hairpin' structures are due to the fact that the nucleotide sequence of VGR3042 precursor RNA comprises a plurality of segments, the first half of each such segment having a nucleotide sequence which is at least a partial inversed-reversed sequence of the second half thereof, as is well known in the art.

VGR3042 folded precursor RNA is naturally processed by cellular enzymatic activity into at least 8 separate VGAM precursor RNAs, VGAM1380 precursor RNA, VGAM1381 precursor RNA, VGAM1382 precursor RNA, VGAM1383 precursor RNA, VGAM1384 precursor RNA, VGAM1385 precursor RNA, VGAM1386 precursor RNA and VGAM1387 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1380 RNA, VGAM1381 RNA, VGAM1382 RNA, VGAM1383 RNA, VGAM1384 RNA, VGAM1385 RNA, VGAM1386 RNA and VGAM1387 RNA, herein schematically represented by VGAM1 RNA through VGAM3 RNA, each of which VGAM RNAs corresponding to VGAM RNA of FIG. 1.

VGAM1380 RNA, herein schematically represented by VGAM1 RNA through VGAM3 RNA, binds complementarily to a host target binding site located in an untranslated region of VGAM1380 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1380 host target RNA into VGAM1380 host target protein, herein schematically represented by VGAM1 HOST TARGET PROTEIN through VGAM3 HOST TARGET PROTEIN, all of FIG. 1.

VGAM1381 RNA, herein schematically represented by VGAM1 RNA through VGAM3 RNA, binds complementarily to a host target binding site located in an untranslated region of VGAM1381 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1381 host target RNA into VGAM1381 host target protein, herein schematically represented by VGAM1 HOST TARGET PROTEIN through VGAM3 HOST TARGET PROTEIN, all of FIG. 1.

VGAM1382 RNA, herein schematically represented by VGAM1 RNA through VGAM3 RNA, binds complementarily to a host target binding site located in an untranslated region of VGAM1382 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1382 host target RNA into VGAM1382 host target protein, herein schematically represented by VGAM1 HOST TARGET PROTEIN through VGAM3 HOST TARGET PROTEIN, all of FIG. 1.

VGAM1383 RNA, herein schematically represented by VGAM1 RNA through VGAM3 RNA, binds complementarily to a host target binding site located in an untranslated region of VGAM1383 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1383 host target RNA into VGAM1383 host target protein, herein schematically represented by VGAM1 HOST TARGET PROTEIN through VGAM3 HOST TARGET PROTEIN, all of FIG. 1.

VGAM1384 RNA, herein schematically represented by VGAM1 RNA through VGAM3 RNA, binds complementarily to a host target binding site located in an untranslated region of VGAM1384 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1384 host target RNA into VGAM1384 host target protein, herein schematically represented by VGAM1 HOST TARGET PROTEIN through VGAM3 HOST TARGET PROTEIN, all of FIG. 1.

VGAM1385 RNA, herein schematically represented by VGAM1 RNA through VGAM3 RNA, binds complementarily to a host target binding site located in an untranslated region of VGAM1385 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1385 host target RNA into VGAM1385 host target protein, herein schematically represented by VGAM1 HOST TARGET PROTEIN through VGAM3 HOST TARGET PROTEIN, all of FIG. 1.

VGAM1386 RNA, herein schematically represented by VGAM1 RNA through VGAM3 RNA, binds complementarily to a host target binding site located in an untranslated region of VGAM1386 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1386 host target RNA into VGAM1386 host target protein, herein schematically represented by VGAM1 HOST TARGET PROTEIN through VGAM3 HOST TARGET PROTEIN, all of FIG. 1.

VGAM1387 RNA, herein schematically represented by VGAM1 RNA through VGAM3 RNA, binds complementarily to a host target binding site located in an untranslated region of VGAM1387 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1387 host target RNA into VGAM1387 host target protein, herein schematically represented by VGAM1 HOST TARGET PROTEIN through VGAM3 HOST TARGET PROTEIN, all of FIG. 1.

It is appreciated that a function of VGR3042 gene, herein designated VGR GENE, is inhibition of expression of host target genes, as part of a novel viral mechanism of attacking a host. Accordingly, utilities of VGR3042 gene include diagnosis, prevention and treatment of viral infection by Himetobi P Virus. Specific functions, and accordingly utilities, of VGR3042 gene correlate with, and may be deduced from, the identity of the host target genes, which are inhibited by VGAM RNAs comprised in the 'operon-like' cluster of VGR3042 gene: VGAM1380 host target protein, VGAM1381 host target protein, VGAM1382 host target protein, VGAM1383 host target protein, VGAM1384 host target protein, VGAM1385 host target protein, VGAM1386 host target protein and VGAM1387 host target protein, herein schematically represented by VGAM1 HOST TARGET PROTEIN through VGAM3 HOST TARGET PROTEIN. The function of these host target genes is elaborated hereinabove with reference to VGAM1380, VGAM1381, VGAM1382, VGAM1383, VGAM1384, VGAM1385, VGAM1386 and VGAM1387. FIG. 9 further provides a conceptual description of novel bioinformatically detected regulatory viral gene, referred to here as Viral Genomic Record 3043(VGR3043) viral gene, which encodes an 'operon-like' cluster of novel viral micro RNA-like genes, each of which in turn modulates expression of at least one host target gene, the function and utility of which at least one host target gene is known in the art.

VGR3043 gene, herein designated VGR GENE, is a novel bioinformatically detected regulatory, non protein coding, RNA viral gene. The method by which VGR3043 gene was detected is described hereinabove with reference to FIGS. 1-9.

VGR3043 gene encodes VGR3043 precursor RNA, herein designated VGR PRECURSOR RNA, an RNA molecule, typically several hundred nucleotides long.

VGR3043 precursor RNA folds spatially, forming VGR3043 folded precursor RNA, herein designated VGR FOLDED PRECURSOR RNA. It is appreciated that VGR3043 folded precursor RNA comprises a plurality of what is known in the art as 'hairpin' structures. These 'hairpin' structures are due to the fact that the nucleotide sequence of VGR3043 precursor RNA comprises a plurality of segments, the first half of each such segment having a nucleotide sequence which is at least a partial inversed-reversed sequence of the second half thereof, as is well known in the art.

VGR3043 folded precursor RNA is naturally processed by cellular enzymatic activity into at least 3 separate VGAM precursor RNAs, VGAM1388 precursor RNA, VGAM1389 precursor RNA and VGAM1390 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1388 RNA, VGAM1389 RNA and VGAM1390 RNA, herein schematically represented by VGAM1 RNA through VGAM3 RNA, each of which VGAM RNAs corresponding to VGAM RNA of FIG. 1.

VGAM1388 RNA, herein schematically represented by VGAM1 RNA through VGAM3 RNA, binds complementarily to a host target binding site located in an untranslated region of VGAM1388 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1388 host target RNA into VGAM1388 host target protein, herein schematically represented by VGAM1 HOST TARGET PROTEIN through VGAM3 HOST TARGET PROTEIN, all of FIG. 1.

VGAM1389 RNA, herein schematically represented by VGAM1 RNA through VGAM3 RNA, binds complementarily to a host target binding site located in an untranslated region of VGAM1389 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1389 host target RNA into VGAM1389 host target protein, herein schematically represented by VGAM1 HOST TARGET PROTEIN through VGAM3 HOST TARGET PROTEIN, all of FIG. 1.

VGAM1390 RNA, herein schematically represented by VGAM1 RNA through VGAM3 RNA, binds complementarily to a host target binding site located in an untranslated region of VGAM1390 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1390 host target RNA into VGAM1390 host target protein, herein schematically represented by VGAM1 HOST TARGET PROTEIN through VGAM3 HOST TARGET PROTEIN, all of FIG. 1.

It is appreciated that a function of VGR3043 gene, herein designated VGR GENE, is inhibition of expression of host target genes, as part of a novel viral mechanism of attacking a host. Accordingly, utilities of VGR3043 gene include diagnosis, prevention and treatment of viral infection by Cercopithecine Herpesvirus 7. Specific functions, and accordingly utilities, of VGR3043 gene correlate with, and may be deduced from, the identity of the host target genes, which are inhibited by VGAM RNAs comprised in the 'operon-like' cluster of VGR3043 gene: VGAM1388 host target protein, VGAM1389 host target protein and VGAM1390 host target protein, herein schematically represented by VGAM1 HOST TARGET PROTEIN through VGAM3 HOST TARGET PROTEIN. The function of these host target genes is elaborated hereinabove with reference to VGAM1388, VGAM1389 and VGAM1390. FIG. 9 further provides a conceptual description of novel bioinformatically detected regulatory viral gene, referred to here as Viral Genomic Record 3044(VGR3044) viral gene, which encodes an 'operon-like' cluster of novel viral micro RNA-like genes, each of which in turn modulates expression of at least one host target gene, the function and utility of which at least one host target gene is known in the art.

VGR3044 gene, herein designated VGR GENE, is a novel bioinformatically detected regulatory, non protein coding, RNA viral gene. The method by which VGR3044 gene was detected is described hereinabove with reference to FIGS. 1-9.

VGR3044 gene encodes VGR3044 precursor RNA, herein designated VGR PRECURSOR RNA, an RNA molecule, typically several hundred nucleotides long.

VGR3044 precursor RNA folds spatially, forming VGR3044 folded precursor RNA, herein designated VGR FOLDED PRECURSOR RNA. It is appreciated that VGR3044 folded precursor RNA comprises a plurality of what is known in the art as 'hairpin' structures. These 'hairpin' structures are due to the fact that the nucleotide sequence of VGR3044 precursor RNA comprises a plurality of segments, the first half of each such segment having a nucleotide sequence which is at least a partial inversed-reversed sequence of the second half thereof, as is well known in the art.

VGR3044 folded precursor RNA is naturally processed by cellular enzymatic activity into at least 4 separate VGAM precursor RNAs, VGAM1391 precursor RNA, VGAM1392 precursor RNA, VGAM1393 precursor RNA and VGAM1394 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1391 RNA, VGAM1392 RNA, VGAM1393 RNA and VGAM1394 RNA, herein schematically represented by VGAM1 RNA through VGAM3 RNA, each of which VGAM RNAs corresponding to VGAM RNA of FIG. 1.

VGAM1391 RNA, herein schematically represented by VGAM1 RNA through VGAM3 RNA, binds complementarily to a host target binding site located in an untranslated region of VGAM1391 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1391 host target RNA into VGAM1391 host target protein, herein schematically represented by VGAM1 HOST TARGET PROTEIN through VGAM3 HOST TARGET PROTEIN, all of FIG. 1.

VGAM1392 RNA, herein schematically represented by VGAM1 RNA through VGAM3 RNA, binds complementarily to a host target binding site located in an untranslated region of VGAM1392 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1392 host target RNA into VGAM1392 host target protein, herein schematically represented by VGAM1 HOST TARGET PROTEIN through VGAM3 HOST TARGET PROTEIN, all of FIG. 1.

VGAM1393 RNA, herein schematically represented by VGAM1 RNA through VGAM3 RNA, binds complementarily to a host target binding site located in an untranslated region of VGAM1393 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1393 host target RNA into VGAM1393 host target protein, herein schematically represented by VGAM1 HOST TARGET PROTEIN through VGAM3 HOST TARGET PROTEIN, all of FIG. 1.

VGAM1394 RNA, herein schematically represented by VGAM1 RNA through VGAM3 RNA, binds complementarily to a host target binding site located in an untranslated region of VGAM1394 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1394 host target RNA into VGAM1394 host target protein, herein schematically represented by VGAM1 HOST TARGET PROTEIN through VGAM3 HOST TARGET PROTEIN, all of FIG. 1.

It is appreciated that a function of VGR3044 gene, herein designated VGR GENE, is inhibition of expression of host target genes, as part of a novel viral mechanism of attacking a host. Accordingly, utilities of VGR3044 gene include diagnosis, prevention and treatment of viral infection by Wheat Streak Mosaic Virus. Specific functions, and accordingly utilities, of VGR3044 gene correlate with, and may be deduced from, the identity of the host target genes, which are inhibited by VGAM RNAs comprised in the 'operon-like' cluster of VGR3044 gene: VGAM1391 host target protein, VGAM1392 host target protein, VGAM1393 host target protein and VGAM1394 host target protein, herein schematically represented by VGAM1 HOST TARGET PROTEIN through VGAM3 HOST TARGET PROTEIN. The function of these host target genes is elaborated hereinabove with reference to VGAM1391, VGAM1392, VGAM1393 and VGAM1394.

FIG. 9 further provides a conceptual description of novel bioinformatically detected regulatory viral gene, referred to here as Viral Genomic Record 3045(VGR3045) viral gene, which encodes an 'operon-like' cluster of novel viral micro RNA-like genes, each of which in turn modulates expression of at least one host target gene, the function and utility of which at least one host target gene is known in the art.

VGR3045 gene, herein designated VGR GENE, is a novel bioinformatically detected regulatory, non protein coding, RNA viral gene. The method by which VGR3045 gene was detected is described hereinabove with reference to FIGS. 1-9.

VGR3045 gene encodes VGR3045 precursor RNA, herein designated VGR PRECURSOR RNA, an RNA molecule, typically several hundred nucleotides long.

VGR3045 precursor RNA folds spatially, forming VGR3045 folded precursor RNA, herein designated VGR FOLDED PRECURSOR RNA. It is appreciated that VGR3045 folded precursor RNA comprises a plurality of what is known in the art as 'hairpin' structures. These 'hairpin' structures are due to the fact that the nucleotide sequence of VGR3045 precursor RNA comprises a plurality of segments, the first half of each such segment having a nucleotide sequence which is at least a partial inversed-reversed sequence of the second half thereof, as is well known in the art.

VGR3045 folded precursor RNA is naturally processed by cellular enzymatic activity into at least 3 separate VGAM precursor RNAs, VGAM1395 precursor RNA, VGAM1396 precursor RNA and VGAM1397 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1395 RNA, VGAM1396 RNA and VGAM1397 RNA, herein schematically represented by VGAM1 RNA through VGAM3 RNA, each of which VGAM RNAs corresponding to VGAM RNA of FIG. 1.

VGAM1395 RNA, herein schematically represented by VGAM1 RNA through VGAM3 RNA, binds complementarily to a host target binding site located in an untranslated region of VGAM1395 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1395 host target RNA into VGAM1395 host target protein, herein schematically represented by VGAM1 HOST TARGET PROTEIN through VGAM3 HOST TARGET PROTEIN, all of FIG. 1.

VGAM1396 RNA, herein schematically represented by VGAM1 RNA through VGAM3 RNA, binds complementarily to a host target binding site located in an untranslated region of VGAM1396 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1396 host target RNA into VGAM1396 host target protein, herein schematically represented by VGAM1 HOST TARGET PROTEIN through VGAM3 HOST TARGET PROTEIN, all of FIG. 1.

VGAM1397 RNA, herein schematically represented by VGAM1 RNA through VGAM3 RNA, binds complementarily to a host target binding site located in an untranslated region of VGAM1397 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1397 host target RNA into VGAM1397 host target protein, herein schematically represented by VGAM1 HOST TARGET PROTEIN through VGAM3 HOST TARGET PROTEIN, all of FIG. 1.

It is appreciated that a function of VGR3045 gene, herein designated VGR GENE, is inhibition of expression of host target genes, as part of a novel viral mechanism of attacking a host. Accordingly, utilities of VGR3045 gene include diagnosis, prevention and treatment of viral infection by Cowpea Aphid-borne Mosaic Virus. Specific functions, and accordingly utilities, of VGR3045 gene correlate with, and may be deduced from, the identity of the host target genes, which are inhibited by VGAM RNAs comprised in the 'operon-like' cluster of VGR3045 gene: VGAM1395 host target protein, VGAM1396 host target protein and VGAM1397 host target protein, herein schematically represented by VGAM1 HOST TARGET PROTEIN through VGAM3 HOST TARGET PROTEIN. The function of these host target genes is elaborated hereinabove with reference to VGAM1395, VGAM1396 and VGAM1397. FIG. 9 further provides a conceptual description of novel bioinformatically detected regulatory viral gene, referred to here as Viral Genomic Record 3046(VGR3046) viral gene, which encodes an 'operon-like' cluster of novel viral micro RNA-like genes, each of which in turn modulates expression of at least one host target gene, the function and utility of which at least one host target gene is known in the art.

VGR3046 gene, herein designated VGR GENE, is a novel bioinformatically detected regulatory, non protein coding, RNA viral gene. The method by which VGR3046 gene was detected is described hereinabove with reference to FIGS. 1-9.

VGR3046 gene encodes VGR3046 precursor RNA, herein designated VGR PRECURSOR RNA, an RNA molecule, typically several hundred nucleotides long.

VGR3046 precursor RNA folds spatially, forming VGR3046 folded precursor RNA, herein designated VGR FOLDED PRECURSOR RNA. It is appreciated that VGR3046 folded precursor RNA comprises a plurality of what is known in the art as 'hairpin' structures. These 'hairpin' structures are due to the fact that the nucleotide sequence of VGR3046 precursor RNA comprises a plurality of segments, the first half of each such segment having a nucleotide sequence which is at least a partial inversed-reversed sequence of the second half thereof, as is well known in the art.

VGR3046 folded precursor RNA is naturally processed by cellular enzymatic activity into at least 7 separate VGAM precursor RNAs, VGAM1398 precursor RNA, VGAM1399 precursor RNA, VGAM1400 precursor RNA, VGAM1401 precursor RNA, VGAM1402 precursor RNA, VGAM1403 precursor RNA and VGAM1404 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1398 RNA, VGAM1399 RNA, VGAM1400 RNA, VGAM1401 RNA, VGAM1402 RNA, VGAM1403 RNA and VGAM1404 RNA, herein schematically represented by VGAM1 RNA through VGAM3 RNA, each of which VGAM RNAs corresponding to VGAM RNA of FIG. 1.

VGAM1398 RNA, herein schematically represented by VGAM1 RNA through VGAM3 RNA, binds complementarily to a host target binding site located in an untranslated region of VGAM1398 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1398 host target RNA into VGAM1398 host target protein, herein schematically represented by VGAM1 HOST TARGET PROTEIN through VGAM3 HOST TARGET PROTEIN, all of FIG. 1.

VGAM1399 RNA, herein schematically represented by VGAM1 RNA through VGAM3 RNA, binds complementarily to a host target binding site located in an untranslated region of VGAM1399 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1399 host target RNA into VGAM1399 host target protein, herein schematically represented by VGAM1 HOST TARGET PROTEIN through VGAM3 HOST TARGET PROTEIN, all of FIG. 1.

VGAM1400 RNA, herein schematically represented by VGAM1 RNA through VGAM3 RNA, binds complementarily to a host target binding site located in an untranslated region of VGAM1400 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1400 host target RNA into VGAM1400 host target protein, herein schematically represented by VGAM1 HOST TARGET PROTEIN through VGAM3 HOST TARGET PROTEIN, all of FIG. 1.

VGAM1401 RNA, herein schematically represented by VGAM1 RNA through VGAM3 RNA, binds complementarily to a host target binding site located in an untranslated region of VGAM1401 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1401 host target RNA into VGAM1401 host target protein, herein schematically represented by VGAM1 HOST TARGET PROTEIN through VGAM3 HOST TARGET PROTEIN, all of FIG. 1.

VGAM1402 RNA, herein schematically represented by VGAM1 RNA through VGAM3 RNA, binds complementarily to a host target binding site located in an untranslated region of VGAM1402 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1402 host target RNA into VGAM1402 host target protein, herein schematically represented by VGAM1 HOST TARGET PROTEIN through VGAM3 HOST TARGET PROTEIN, all of FIG. 1.

VGAM1403 RNA, herein schematically represented by VGAM1 RNA through VGAM3 RNA, binds complementarily to a host target binding site located in an untranslated region of VGAM1403 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1403 host target RNA into VGAM1403 host target protein, herein schematically represented by VGAM1 HOST TARGET PROTEIN through VGAM3 HOST TARGET PROTEIN, all of FIG. 1.

VGAM1404 RNA, herein schematically represented by VGAM1 RNA through VGAM3 RNA, binds complementarily to a host target binding site located in an untranslated region of VGAM1404 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1404 host target RNA into VGAM1404 host target protein, herein schematically represented by VGAM1 HOST TARGET PROTEIN through VGAM3 HOST TARGET PROTEIN, all of FIG. 1.

It is appreciated that a function of VGR3046 gene, herein designated VGR GENE, is inhibition of expression of host target genes, as part of a novel viral mechanism of attacking a host. Accordingly, utilities of VGR3046 gene include diagnosis, prevention and treatment of viral infection by Perina Nuda Picorna-like Virus. Specific functions, and accordingly utilities, of VGR3046 gene correlate with, and may be deduced from, the identity of the host target genes, which are inhibited by VGAM RNAs comprised in the 'operon-like' cluster of VGR3046 gene: VGAM1398 host target protein, VGAM1399 host target protein, VGAM1400 host target protein, VGAM1401 host target protein, VGAM1402 host target protein, VGAM1403 host target protein and VGAM1404 host target protein, herein schematically represented by VGAM1 HOST TARGET PROTEIN through VGAM3 HOST TARGET PROTEIN. The function of these host target genes is elaborated hereinabove with reference to VGAM1398, VGAM1399, VGAM1400, VGAM1401, VGAM1402, VGAM1403 and VGAM1404. FIG. 9 further provides a conceptual description of novel bioinformatically detected regulatory viral gene, referred to here as Viral Genomic Record 3047(VGR3047) viral gene, which encodes an 'operon-like' cluster of novel viral micro RNA-like genes, each of which in turn modulates expression of at least one host target gene, the function and utility of which at least one host target gene is known in the art.

VGR3047 gene, herein designated VGR GENE, is a novel bioinformatically detected regulatory, non protein coding, RNA viral gene. The method by which VGR3047 gene was detected is described hereinabove with reference to FIGS. 1-9.

VGR3047 gene encodes VGR3047 precursor RNA, herein designated VGR PRECURSOR RNA, an RNA molecule, typically several hundred nucleotides long.

VGR3047 precursor RNA folds spatially, forming VGR3047 folded precursor RNA, herein designated VGR FOLDED PRECURSOR RNA. It is appreciated that VGR3047 folded precursor RNA comprises a plurality of what is known in the art as 'hairpin' structures. These 'hairpin' structures are due to the fact that the nucleotide sequence of VGR3047 precursor RNA comprises a plurality of segments, the first half of each such segment having a nucleotide sequence which is at least a partial inversed-reversed sequence of the second half thereof, as is well known in the art.

VGR3047 folded precursor RNA is naturally processed by cellular enzymatic activity into at least 2 separate VGAM precursor RNAs, VGAM1405 precursor RNA and VGAM1406 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1405 RNA and VGAM1406 RNA, herein schematically represented by VGAM1 RNA through VGAM3 RNA, each of which VGAM RNAs corresponding to VGAM RNA of FIG. 1.

VGAM1405 RNA, herein schematically represented by VGAM1 RNA through VGAM3 RNA, binds complementarily to a host target binding site located in an untranslated region of VGAM1405 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1405 host target RNA into VGAM1405 host target protein, herein schematically represented by VGAM1 HOST TARGET PROTEIN through VGAM3 HOST TARGET PROTEIN, all of FIG. 1.

VGAM1406 RNA, herein schematically represented by VGAM1 RNA through VGAM3 RNA, binds complementarily to a host target binding site located in an untranslated region of VGAM1406 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1406 host target RNA into VGAM1406 host target protein, herein schematically represented by VGAM1 HOST TARGET PROTEIN through VGAM3 HOST TARGET PROTEIN, all of FIG. 1.

It is appreciated that a function of VGR3047 gene, herein designated VGR GENE, is inhibition of expression of host target genes, as part of a novel viral mechanism of attacking a host. Accordingly, utilities of VGR3047 gene include diagnosis, prevention and treatment of viral infection by Perina Nuda Picorna-like Virus. Specific functions, and accordingly utilities, of VGR3047 gene correlate with, and may be deduced from, the identity of the host target genes, which are inhibited by VGAM RNAs comprised in the 'operon-like' cluster of VGR3047 gene: VGAM1405 host target protein and VGAM1406 host target protein, herein schematically represented by VGAM1 HOST TARGET PROTEIN through VGAM3 HOST TARGET PROTEIN. The function of these host target genes is elaborated hereinabove with reference to VGAM1405 and VGAM1406. FIG. 9 further provides a conceptual description of novel bioinformatically detected regulatory viral gene, referred to here as Viral Genomic Record 3048(VGR3048) viral gene, which encodes an 'operon-like' cluster of novel viral micro RNA-like genes, each of which in turn modulates expression of at least one host target gene, the function and utility of which at least one host target gene is known in the art.

VGR3048 gene, herein designated VGR GENE, is a novel bioinformatically detected regulatory, non protein coding, RNA viral gene. The method by which VGR3048 gene was detected is described hereinabove with reference to FIGS. 1-9.

VGR3048 gene encodes VGR3048 precursor RNA, herein designated VGR PRECURSOR RNA, an RNA molecule, typically several hundred nucleotides long.

VGR3048 precursor RNA folds spatially, forming VGR3048 folded precursor RNA, herein designated VGR FOLDED PRECURSOR RNA. It is appreciated that VGR3048 folded precursor RNA comprises a plurality of what is known in the art as 'hairpin' structures. These 'hairpin' structures are due to the fact that the nucleotide sequence of VGR3048 precursor RNA comprises a plurality of segments, the first half of each such segment having a nucleotide sequence which is at least a partial inversed-reversed sequence of the second half thereof, as is well known in the art.

VGR3048 folded precursor RNA is naturally processed by cellular enzymatic activity into at least 5 separate VGAM precursor RNAs, VGAM1407 precursor RNA, VGAM1408 precursor RNA, VGAM1409 precursor RNA, VGAM1410 precursor RNA and VGAM1411 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1407 RNA, VGAM1408 RNA, VGAM1409 RNA, VGAM1410 RNA and VGAM1411 RNA, herein schematically represented by VGAM1 RNA through VGAM3 RNA, each of which VGAM RNAs corresponding to VGAM RNA of FIG. 1.

VGAM1407 RNA, herein schematically represented by VGAM1 RNA through VGAM3 RNA, binds complementarily to a host target binding site located in an untranslated region of VGAM1407 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1407 host target RNA into VGAM1407 host target protein, herein schematically represented by VGAM1 HOST TARGET PROTEIN through VGAM3 HOST TARGET PROTEIN, all of FIG. 1.

VGAM1408 RNA, herein schematically represented by VGAM1 RNA through VGAM3 RNA, binds complementarily to a host target binding site located in an untranslated region of VGAM1408 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1408 host target RNA into VGAM1408 host target protein, herein schematically represented by VGAM1 HOST TARGET PROTEIN through VGAM3 HOST TARGET PROTEIN, all of FIG. 1.

VGAM1409 RNA, herein schematically represented by VGAM1 RNA through VGAM3 RNA, binds complementarily to a host target binding site located in an untranslated region of VGAM1409 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1409 host target RNA into VGAM1409 host target protein, herein schematically represented by VGAM1 HOST TARGET PROTEIN through VGAM3 HOST TARGET PROTEIN, all of FIG. 1.

VGAM1410 RNA, herein schematically represented by VGAM1 RNA through VGAM3 RNA, binds complementarily to a host target binding site located in an untranslated region of VGAM1410 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1410 host target RNA into VGAM1410 host target protein, herein schematically represented by VGAM1 HOST TARGET PROTEIN through VGAM3 HOST TARGET PROTEIN, all of FIG. 1.

VGAM1411 RNA, herein schematically represented by VGAM1 RNA through VGAM3 RNA, binds complementarily to a host target binding site located in an untranslated region of VGAM1411 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1411 host target RNA into VGAM1411 host target protein, herein schematically represented by VGAM1 HOST TARGET PROTEIN through VGAM3 HOST TARGET PROTEIN, all of FIG. 1.

It is appreciated that a function of VGR3048 gene, herein designated VGR GENE, is inhibition of expression of host target genes, as part of a novel viral mechanism of attacking a host. Accordingly, utilities of VGR3048 gene include diagnosis, prevention and treatment of viral infection by Acute Bee Paralysis Virus. Specific functions, and accordingly utilities, of VGR3048 gene correlate with, and may be deduced from, the identity of the host target genes, which are inhibited by VGAM RNAs comprised in the 'operon-like' cluster of VGR3048 gene: VGAM1407 host target protein, VGAM1408 host target protein, VGAM1409 host target protein, VGAM1410 host target protein and VGAM1411 host target protein, herein schematically represented by VGAM1 HOST TARGET PROTEIN through VGAM3 HOST TARGET PROTEIN. The function of these host target genes is elaborated hereinabove with reference to VGAM1407, VGAM1408, VGAM1409, VGAM1410 and VGAM1411.

FIG. 9 further provides a conceptual description of novel bioinformatically detected regulatory viral gene, referred to here as Viral Genomic Record 3049(VGR3049) viral gene, which encodes an 'operon-like' cluster of novel viral micro RNA-like genes, each of which in turn modulates expression of at least one host target gene, the function and utility of which at least one host target gene is known in the art.

VGR3049 gene, herein designated VGR GENE, is a novel bioinformatically detected regulatory, non protein coding, RNA viral gene. The method by which VGR3049 gene was detected is described hereinabove with reference to FIGS. 1-9.

VGR3049 gene encodes VGR3049 precursor RNA, herein designated VGR PRECURSOR RNA, an RNA molecule, typically several hundred nucleotides long.

VGR3049 precursor RNA folds spatially, forming VGR3049 folded precursor RNA, herein designated VGR FOLDED PRECURSOR RNA. It is appreciated that VGR3049 folded precursor RNA comprises a plurality of what is known in the art as 'hairpin' structures. These 'hairpin' structures are due to the fact that the nucleotide sequence of VGR3049 precursor RNA comprises a plurality of segments, the first half of each such segment having a nucleotide sequence which is at least a partial inversed-reversed sequence of the second half thereof, as is well known in the art.

VGR3049 folded precursor RNA is naturally processed by cellular enzymatic activity into at least 4 separate VGAM precursor RNAs, VGAM1412 precursor RNA, VGAM1413 precursor RNA, VGAM1414 precursor RNA and VGAM1415 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1412 RNA, VGAM1413 RNA, VGAM1414 RNA and VGAM1415 RNA, herein schematically represented by VGAM1 RNA through VGAM3 RNA, each of which VGAM RNAs corresponding to VGAM RNA of FIG. 1.

VGAM1412 RNA, herein schematically represented by VGAM1 RNA through VGAM3 RNA, binds complementarily to a host target binding site located in an untranslated region of VGAM1412 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1412 host target RNA into VGAM1412 host target protein, herein schematically represented by VGAM1 HOST TARGET PROTEIN through VGAM3 HOST TARGET PROTEIN, all of FIG. 1.

VGAM1413 RNA, herein schematically represented by VGAM1 RNA through VGAM3 RNA, binds complementarily to a host target binding site located in an untranslated region of VGAM1413 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1413 host target RNA into VGAM1413 host target protein, herein schematically represented by VGAM1 HOST TARGET PROTEIN through VGAM3 HOST TARGET PROTEIN, all of FIG. 1.

VGAM1414 RNA, herein schematically represented by VGAM1 RNA through VGAM3 RNA, binds complementarily to a host target binding site located in an untranslated region of VGAM1414 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1414 host target RNA into VGAM1414 host target protein, herein schematically represented by VGAM1 HOST TARGET PROTEIN through VGAM3 HOST TARGET PROTEIN, all of FIG. 1.

VGAM1415 RNA, herein schematically represented by VGAM1 RNA through VGAM3 RNA, binds complementarily to a host target binding site located in an untranslated region of VGAM1415 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1415 host target RNA into VGAM1415 host target protein, herein schematically represented by VGAM1 HOST TARGET PROTEIN through VGAM3 HOST TARGET PROTEIN, all of FIG. 1.

It is appreciated that a function of VGR3049 gene, herein designated VGR GENE, is inhibition of expression of host target genes, as part of a novel viral mechanism of attacking a host. Accordingly, utilities of VGR3049 gene include diagnosis, prevention and treatment of viral infection by Bean Yellow Mosaic Virus. Specific functions, and accordingly utilities, of VGR3049 gene correlate with, and may be deduced from, the identity of the host target genes, which are inhibited by VGAM RNAs comprised in the 'operon-like' cluster of VGR3049 gene: VGAM1412 host target protein, VGAM1413 host target protein, VGAM1414 host target protein and VGAM1415 host target protein, herein schematically represented by VGAM1 HOST TARGET PROTEIN through VGAM3 HOST TARGET PROTEIN. The function of these host target genes is elaborated hereinabove with reference to VGAM1412, VGAM1413, VGAM1414 and VGAM1415.

FIG. 9 further provides a conceptual description of novel bioinformatically detected regulatory viral gene, referred to here as Viral Genomic Record 3050(VGR3050) viral gene, which encodes an 'operon-like' cluster of novel viral micro RNA-like genes, each of which in turn modulates expression of at least one host target gene, the function and utility of which at least one host target gene is known in the art.

VGR3050 gene, herein designated VGR GENE, is a novel bioinformatically detected regulatory, non protein coding, RNA viral gene. The method by which VGR3050 gene was detected is described hereinabove with reference to FIGS. 1-9.

VGR3050 gene encodes VGR3050 precursor RNA, herein designated VGR PRECURSOR RNA, an RNA molecule, typically several hundred nucleotides long.

VGR3050 precursor RNA folds spatially, forming VGR3050 folded precursor RNA, herein designated VGR FOLDED PRECURSOR RNA. It is appreciated that VGR3050 folded precursor RNA comprises a plurality of what is known in the art as 'hairpin' structures. These 'hairpin' structures are due to the fact that the nucleotide sequence of VGR3050 precursor RNA comprises a plurality of segments, the first half of each such segment having a nucleotide sequence which is at least a partial inversed-reversed sequence of the second half thereof, as is well known in the art.

VGR3050 folded precursor RNA is naturally processed by cellular enzymatic activity into at least 4 separate VGAM precursor RNAs, VGAM1416 precursor RNA, VGAM1417 precursor RNA, VGAM1418 precursor RNA and VGAM1419 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1416 RNA, VGAM1417 RNA, VGAM1418 RNA and VGAM1419 RNA, herein schematically represented by VGAM1 RNA through VGAM3 RNA, each of which VGAM RNAs corresponding to VGAM RNA of FIG. 1.

VGAM1416 RNA, herein schematically represented by VGAM1 RNA through VGAM3 RNA, binds complementarily to a host target binding site located in an untranslated region of VGAM1416 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1416 host target RNA into VGAM1416 host target protein, herein schematically represented by VGAM1 HOST TARGET PROTEIN through VGAM3 HOST TARGET PROTEIN, all of FIG. 1.

VGAM1417 RNA, herein schematically represented by VGAM1 RNA through VGAM3 RNA, binds complementarily to a host target binding site located in an untranslated region of VGAM1417 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1417 host target RNA into VGAM1417 host target protein, herein schematically represented by VGAM1 HOST TARGET PROTEIN through VGAM3 HOST TARGET PROTEIN, all of FIG. 1.

VGAM1418 RNA, herein schematically represented by VGAM1 RNA through VGAM3 RNA, binds complementarily to a host target binding site located in an untranslated region of VGAM1418 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1418 host target RNA into VGAM1418 host target protein, herein schematically represented by VGAM1 HOST TARGET PROTEIN through VGAM3 HOST TARGET PROTEIN, all of FIG. 1.

VGAM1419 RNA, herein schematically represented by VGAM1 RNA through VGAM3 RNA, binds complementarily to a host target binding site located in an untranslated region of VGAM1419 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1419 host target RNA into VGAM1419 host target protein, herein schematically represented by VGAM1 HOST TARGET PROTEIN through VGAM3 HOST TARGET PROTEIN, all of FIG. 1.

It is appreciated that a function of VGR3050 gene, herein designated VGR GENE, is inhibition of expression of host target genes, as part of a novel viral mechanism of attacking a host. Accordingly, utilities of VGR3050 gene include diagnosis, prevention and treatment of viral infection by Ryegrass Mosaic Virus. Specific functions, and accordingly utilities, of VGR3050 gene correlate with, and may be deduced from, the identity of the host target genes, which are inhibited by VGAM RNAs comprised in the 'operon-like' cluster of VGR3050 gene: VGAM1416 host target protein, VGAM1417 host target protein, VGAM1418 host target protein and VGAM1419 host target protein, herein schematically represented by VGAM1 HOST TARGET PROTEIN through VGAM3 HOST TARGET PROTEIN. The function of these host target genes is elaborated hereinabove with reference to VGAM1416, VGAM1417, VGAM1418 and VGAM1419. FIG. 9 further provides a conceptual description of novel bioinformatically detected regulatory viral gene, referred to here as Viral Genomic Record 3051(VGR3051) viral gene, which encodes an 'operon-like' cluster of novel viral micro RNA-like genes, each of which in turn modulates expression of at least one host target gene, the function and utility of which at least one host target gene is known in the art.

VGR3051 gene, herein designated VGR GENE, is a novel bioinformatically detected regulatory, non protein coding, RNA viral gene. The method by which VGR3051 gene was detected is described hereinabove with reference to FIGS. 1-9.

VGR3051 gene encodes VGR3051 precursor RNA, herein designated VGR PRECURSOR RNA, an RNA molecule, typically several hundred nucleotides long.

VGR3051 precursor RNA folds spatially, forming VGR3051 folded precursor RNA, herein designated VGR FOLDED PRECURSOR RNA. It is appreciated that VGR3051 folded precursor RNA comprises a plurality of what is known in the art as 'hairpin' structures. These 'hairpin' structures are due to the fact that the nucleotide sequence of VGR3051 precursor RNA comprises a plurality of segments, the first half of each such segment having a nucleotide sequence which is at least a partial inversed-reversed sequence of the second half thereof, as is well known in the art.

VGR3051 folded precursor RNA is naturally processed by cellular enzymatic activity into at least 4 separate VGAM precursor RNAs, VGAM1420 precursor RNA, VGAM1421 precursor RNA, VGAM1422 precursor RNA and VGAM1423 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1420 RNA, VGAM1421 RNA, VGAM1422 RNA and VGAM1423 RNA, herein schematically represented by VGAM1 RNA through VGAM3 RNA, each of which VGAM RNAs corresponding to VGAM RNA of FIG. 1.

VGAM1420 RNA, herein schematically represented by VGAM1 RNA through VGAM3 RNA, binds complementarily to a host target binding site located in an untranslated region of VGAM1420 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1420 host target RNA into VGAM1420 host target protein, herein schematically represented by VGAM1 HOST TARGET PROTEIN through VGAM3 HOST TARGET PROTEIN, all of FIG. 1.

VGAM1421 RNA, herein schematically represented by VGAM1 RNA through VGAM3 RNA, binds complementarily to a host target binding site located in an untranslated region of VGAM1421 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1421 host target RNA into VGAM1421 host target protein, herein schematically represented by VGAM1 HOST TARGET PROTEIN through VGAM3 HOST TARGET PROTEIN, all of FIG. 1.

VGAM1422 RNA, herein schematically represented by VGAM1 RNA through VGAM3 RNA, binds complementarily to a host target binding site located in an untranslated region of VGAM1422 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1422 host target RNA into VGAM1422 host target protein, herein schematically represented by VGAM1 HOST TARGET PROTEIN through VGAM3 HOST TARGET PROTEIN, all of FIG. 1.

VGAM1423 RNA, herein schematically represented by VGAM1 RNA through VGAM3 RNA, binds complementarily to a host target binding site located in an untranslated region of VGAM1423 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1423 host target RNA into VGAM1423 host target protein, herein schematically represented by VGAM1 HOST TARGET PROTEIN through VGAM3 HOST TARGET PROTEIN, all of FIG. 1.

It is appreciated that a function of VGR3051 gene, herein designated VGR GENE, is inhibition of expression of host target genes, as part of a novel viral mechanism of attacking a host. Accordingly, utilities of VGR3051 gene include diagnosis, prevention and treatment of viral infection by Hepatitis GB Virus A. Specific functions, and accordingly utilities, of VGR3051 gene correlate with, and may be deduced from, the identity of the host target genes, which are inhibited by VGAM RNAs comprised in the 'operon-like' cluster of VGR3051 gene: VGAM1420 host target protein, VGAM1421 host target protein, VGAM1422 host target protein and VGAM1423 host target protein, herein schematically represented by VGAM1 HOST TARGET PROTEIN through VGAM3 HOST TARGET PROTEIN. The function of these host target genes is elaborated hereinabove with reference to VGAM1420, VGAM1421, VGAM1422 and VGAM1423. FIG. 9 further provides a conceptual description of novel bioinformatically detected regulatory viral gene, referred to here as Viral Genomic Record 3052(VGR3052) viral gene, which encodes an 'operon-like' cluster of novel viral micro RNA-like genes, each of which in turn modulates expression of at least one host target gene, the function and utility of which at least one host target gene is known in the art.

VGR3052 gene, herein designated VGR GENE, is a novel bioinformatically detected regulatory, non protein coding, RNA viral gene. The method by which VGR3052 gene was detected is described hereinabove with reference to FIGS. 1-9.

VGR3052 gene encodes VGR3052 precursor RNA, herein designated VGR PRECURSOR RNA, an RNA molecule, typically several hundred nucleotides long.

VGR3052 precursor RNA folds spatially, forming VGR3052 folded precursor RNA, herein designated VGR FOLDED PRECURSOR RNA. It is appreciated that VGR3052 folded precursor RNA comprises a plurality of what is known in the art as 'hairpin' structures. These 'hairpin' structures are due to the fact that the nucleotide sequence of VGR3052 precursor RNA comprises a plurality of segments, the first half of each such segment having a nucleotide sequence which is at least a partial inversed-reversed sequence of the second half thereof, as is well known in the art.

VGR3052 folded precursor RNA is naturally processed by cellular enzymatic activity into at least 7 separate VGAM precursor RNAs, VGAM1424 precursor RNA, VGAM1425 precursor RNA, VGAM1426 precursor RNA, VGAM1427 precursor RNA, VGAM1428 precursor RNA, VGAM1429 precursor RNA and VGAM1430 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1424 RNA, VGAM1425 RNA, VGAM1426 RNA, VGAM1427 RNA, VGAM1428 RNA, VGAM1429 RNA and VGAM1430 RNA, herein schematically represented by VGAM1 RNA through VGAM3 RNA, each of which VGAM RNAs corresponding to VGAM RNA of FIG. 1.

VGAM1424 RNA, herein schematically represented by VGAM1 RNA through VGAM3 RNA, binds complementarily to a host target binding site located in an untranslated region of VGAM1424 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1424 host target RNA into VGAM1424 host target protein, herein schematically represented by VGAM1 HOST TARGET PROTEIN through VGAM3 HOST TARGET PROTEIN, all of FIG. 1.

VGAM1425 RNA, herein schematically represented by VGAM1 RNA through VGAM3 RNA, binds complementarily to a host target binding site located in an untranslated region of VGAM1425 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1425 host target RNA into VGAM1425 host target protein, herein schematically represented by VGAM1 HOST TARGET PROTEIN through VGAM3 HOST TARGET PROTEIN, all of FIG. 1.

VGAM1426 RNA, herein schematically represented by VGAM1 RNA through VGAM3 RNA, binds complementarily to a host target binding site located in an untranslated region of VGAM1426 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1426 host target RNA into VGAM1426 host target protein, herein schematically represented by VGAM1 HOST TARGET PROTEIN through VGAM3 HOST TARGET PROTEIN, all of FIG. 1.

VGAM1427 RNA, herein schematically represented by VGAM1 RNA through VGAM3 RNA, binds complementarily to a host target binding site located in an untranslated region of VGAM1427 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1427 host target RNA into VGAM1427 host target protein, herein schematically represented by VGAM1 HOST TARGET PROTEIN through VGAM3 HOST TARGET PROTEIN, all of FIG. 1.

VGAM1428 RNA, herein schematically represented by VGAM1 RNA through VGAM3 RNA, binds complementarily to a host target binding site located in an untranslated region of VGAM1428 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1428 host target RNA into VGAM1428 host target protein, herein schematically represented by VGAM1 HOST TARGET PROTEIN through VGAM3 HOST TARGET PROTEIN, all of FIG. 1.

VGAM1429 RNA, herein schematically represented by VGAM1 RNA through VGAM3 RNA, binds complementarily to a host target binding site located in an untranslated region of VGAM1429 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1429 host target RNA into VGAM1429 host target protein, herein schematically represented by VGAM1 HOST TARGET PROTEIN through VGAM3 HOST TARGET PROTEIN, all of FIG. 1.

VGAM1430 RNA, herein schematically represented by VGAM1 RNA through VGAM3 RNA, binds complementarily to a host target binding site located in an untranslated region of VGAM1430 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1430 host target RNA into VGAM1430 host target protein, herein schematically represented by VGAM1 HOST TARGET PROTEIN through VGAM3 HOST TARGET PROTEIN, all of FIG. 1.

It is appreciated that a function of VGR3052 gene, herein designated VGR GENE, is inhibition of expression of host target genes, as part of a novel viral mechanism of attacking a host. Accordingly, utilities of VGR3052 gene include diagnosis, prevention and treatment of viral infection by Clover Yellow Vein Virus. Specific functions, and accordingly utilities, of VGR3052 gene correlate with, and may be deduced from, the identity of the host target genes, which are inhibited by VGAM RNAs comprised in the 'operon-like' cluster of VGR3052 gene: VGAM1424 host target protein, VGAM1425 host target protein, VGAM1426 host target protein, VGAM1427 host target protein, VGAM1428 host target protein, VGAM1429 host target protein and VGAM1430 host target protein, herein schematically represented by VGAM1 HOST TARGET PROTEIN through VGAM3 HOST TARGET PROTEIN. The function of these host target genes is elaborated hereinabove with reference to VGAM1424, VGAM1425, VGAM1426, VGAM1427, VGAM1428, VGAM1429 and VGAM1430. FIG. 9 further provides a conceptual description of novel bioinformatically detected regulatory viral gene, referred to here as Viral Genomic Record 3053(VGR3053) viral gene, which encodes an 'operon-like' cluster of novel viral micro RNA-like genes, each of which in turn modulates expression of at least one host target gene, the function and utility of which at least one host target gene is known in the art.

VGR3053 gene, herein designated VGR GENE, is a novel bioinformatically detected regulatory, non protein coding, RNA viral gene. The method by which VGR3053 gene was detected is described hereinabove with reference to FIGS. 1-9.

VGR3053 gene encodes VGR3053 precursor RNA, herein designated VGR PRECURSOR RNA, an RNA molecule, typically several hundred nucleotides long.

VGR3053 precursor RNA folds spatially, forming VGR3053 folded precursor RNA, herein designated VGR FOLDED PRECURSOR RNA. It is appreciated that VGR3053 folded precursor RNA comprises a plurality of what is known in the art as 'hairpin' structures. These 'hairpin' structures are due to the fact that the nucleotide sequence of VGR3053 precursor RNA comprises a plurality of segments, the first half of each such segment having a nucleotide sequence which is at least a partial inversed-reversed sequence of the second half thereof, as is well known in the art.

VGR3053 folded precursor RNA is naturally processed by cellular enzymatic activity into at least 7 separate VGAM precursor RNAs, VGAM1431 precursor RNA, VGAM1432 precursor RNA, VGAM1433 precursor RNA, VGAM1434 precursor RNA, VGAM1435 precursor RNA, VGAM1436 precursor RNA and VGAM1437 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1431 RNA, VGAM1432 RNA, VGAM1433 RNA, VGAM1434 RNA, VGAM1435 RNA, VGAM1436 RNA and VGAM1437 RNA, herein schematically represented by VGAM1 RNA through VGAM3 RNA, each of which VGAM RNAs corresponding to VGAM RNA of FIG. 1.

VGAM1431 RNA, herein schematically represented by VGAM1 RNA through VGAM3 RNA, binds complementarily to a host target binding site located in an untranslated region of VGAM1431 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1431 host target RNA into VGAM1431 host target protein, herein schematically represented by VGAM1 HOST TARGET PROTEIN through VGAM3 HOST TARGET PROTEIN, all of FIG. 1.

VGAM1432 RNA, herein schematically represented by VGAM1 RNA through VGAM3 RNA, binds complementarily to a host target binding site located in an untranslated region of VGAM1432 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1432 host target RNA into VGAM1432 host target protein, herein schematically represented by VGAM1 HOST TARGET PROTEIN through VGAM3 HOST TARGET PROTEIN, all of FIG. 1.

VGAM1433 RNA, herein schematically represented by VGAM1 RNA through VGAM3 RNA, binds complementarily to a host target binding site located in an untranslated region of VGAM1433 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1433 host target RNA into VGAM1433 host target protein, herein schematically represented by VGAM1 HOST TARGET PROTEIN through VGAM3 HOST TARGET PROTEIN, all of FIG. 1.

VGAM1434 RNA, herein schematically represented by VGAM1 RNA through VGAM3 RNA, binds complementarily to a host target binding site located in an untranslated region of VGAM1434 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1434 host target RNA into VGAM1434 host target protein, herein schematically represented by VGAM1 HOST TARGET PROTEIN through VGAM3 HOST TARGET PROTEIN, all of FIG. 1.

VGAM1435 RNA, herein schematically represented by VGAM1 RNA through VGAM3 RNA, binds complementarily to a host target binding site located in an untranslated region of VGAM1435 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1435 host target RNA into VGAM1435 host target protein, herein schematically represented by VGAM1 HOST TARGET PROTEIN through VGAM3 HOST TARGET PROTEIN, all of FIG. 1.

VGAM1436 RNA, herein schematically represented by VGAM1 RNA through VGAM3 RNA, binds complementarily to a host target binding site located in an untranslated region of VGAM1436 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1436 host target RNA into VGAM1436 host target protein, herein schematically represented by VGAM1 HOST TARGET PROTEIN through VGAM3 HOST TARGET PROTEIN, all of FIG. 1.

VGAM1437 RNA, herein schematically represented by VGAM1 RNA through VGAM3 RNA, binds complementarily to a host target binding site located in an untranslated region of VGAM1437 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1437 host target RNA into VGAM1437 host target protein, herein schematically represented by VGAM1 HOST TARGET PROTEIN through VGAM3 HOST TARGET PROTEIN, all of FIG. 1.

It is appreciated that a function of VGR3053 gene, herein designated VGR GENE, is inhibition of expression of host target genes, as part of a novel viral mechanism of attacking a host. Accordingly, utilities of VGR3053 gene include diagnosis, prevention and treatment of viral infection by Potato Virus A. Specific functions, and accordingly utilities, of VGR3053 gene correlate with, and may be deduced from, the identity of the host target genes, which are inhibited by VGAM RNAs comprised in the 'operon-like' cluster of VGR3053 gene: VGAM1431 host target protein, VGAM1432 host target protein, VGAM1433 host target protein, VGAM1434 host target protein, VGAM1435 host target protein, VGAM1436 host target protein and VGAM1437 host target protein, herein schematically represented by VGAM1 HOST TARGET PROTEIN through VGAM3 HOST TARGET PROTEIN. The function of these host target genes is elaborated hereinabove with reference to VGAM1431, VGAM1432, VGAM1433, VGAM1434, VGAM1435, VGAM1436 and VGAM1437. FIG. 9 further provides a conceptual description of novel bioinformatically detected regulatory viral gene, referred to here as Viral Genomic Record 3054(VGR3054) viral gene, which encodes an 'operon-like' cluster of novel viral micro RNA-like genes, each of which in turn modulates expression of at least one host target gene, the function and utility of which at least one host target gene is known in the art.

VGR3054 gene, herein designated VGR GENE, is a novel bioinformatically detected regulatory, non protein coding, RNA viral gene. The method by which VGR3054 gene was detected is described hereinabove with reference to FIGS. 1-9.

VGR3054 gene encodes VGR3054 precursor RNA, herein designated VGR PRECURSOR RNA, an RNA molecule, typically several hundred nucleotides long.

VGR3054 precursor RNA folds spatially, forming VGR3054 folded precursor RNA, herein designated VGR FOLDED PRECURSOR RNA. It is appreciated that VGR3054 folded precursor RNA comprises a plurality of what is known in the art as 'hairpin' structures. These 'hairpin' structures are due to the fact that the nucleotide sequence of VGR3054 precursor RNA comprises a plurality of segments, the first half of each such segment having a nucleotide sequence which is at least a partial inversed-reversed sequence of the second half thereof, as is well known in the art.

VGR3054 folded precursor RNA is naturally processed by cellular enzymatic activity into at least 5 separate VGAM precursor RNAs, VGAM1438 precursor RNA, VGAM1439 precursor RNA, VGAM1440 precursor RNA, VGAM1441 precursor RNA and VGAM1442 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1438 RNA, VGAM1439 RNA, VGAM1440 RNA, VGAM1441 RNA and VGAM1442 RNA, herein schematically represented by VGAM1 RNA through VGAM3 RNA, each of which VGAM RNAs corresponding to VGAM RNA of FIG. 1.

VGAM1438 RNA, herein schematically represented by VGAM1 RNA through VGAM3 RNA, binds complementarily to a host target binding site located in an untranslated region of VGAM1438 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1438 host target RNA into VGAM1438 host target protein, herein schematically represented by VGAM1 HOST TARGET PROTEIN through VGAM3 HOST TARGET PROTEIN, all of FIG. 1.

VGAM1439 RNA, herein schematically represented by VGAM1 RNA through VGAM3 RNA, binds complementarily to a host target binding site located in an untranslated region of VGAM1439 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1439 host target RNA into VGAM1439 host target protein, herein schematically represented by VGAM1 HOST TARGET PROTEIN through VGAM3 HOST TARGET PROTEIN, all of FIG. 1.

VGAM1440 RNA, herein schematically represented by VGAM1 RNA through VGAM3 RNA, binds complementarily to a host target binding site located in an untranslated region of VGAM1440 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1440 host target RNA into VGAM1440 host target protein, herein schematically represented by VGAM1 HOST TARGET PROTEIN through VGAM3 HOST TARGET PROTEIN, all of FIG. 1.

VGAM1441 RNA, herein schematically represented by VGAM1 RNA through VGAM3 RNA, binds complementarily to a host target binding site located in an untranslated region of VGAM1441 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1441 host target RNA into VGAM1441 host target protein, herein schematically represented by VGAM1 HOST TARGET PROTEIN through VGAM3 HOST TARGET PROTEIN, all of FIG. 1.

VGAM1442 RNA, herein schematically represented by VGAM1 RNA through VGAM3 RNA, binds complementarily to a host target binding site located in an untranslated region of VGAM1442 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1442 host target RNA into VGAM1442 host target protein, herein schematically represented by VGAM1 HOST TARGET PROTEIN through VGAM3 HOST TARGET PROTEIN, all of FIG. 1.

It is appreciated that a function of VGR3054 gene, herein designated VGR GENE, is inhibition of expression of host target genes, as part of a novel viral mechanism of attacking a host. Accordingly, utilities of VGR3054 gene include diagnosis, prevention and treatment of viral infection by Bean Common Mosaic Necrosis Virus. Specific functions, and accordingly utilities, of VGR3054 gene correlate with, and may be deduced from, the identity of the host target genes, which are inhibited by VGAM RNAs comprised in the 'operon-like' cluster of VGR3054 gene: VGAM1438 host target protein, VGAM1439 host target protein, VGAM1440 host target protein, VGAM1441 host target protein and VGAM1442 host target protein, herein schematically represented by VGAM1 HOST TARGET PROTEIN through VGAM3 HOST TARGET PROTEIN. The function of these host target genes is elaborated hereinabove with reference to VGAM1438, VGAM1439, VGAM1440, VGAM1441 and VGAM1442. FIG. 9 further provides a conceptual description of novel bioinformatically detected regulatory viral gene, referred to here as Viral Genomic Record 3055(VGR3055) viral gene, which encodes an 'operon-like' cluster of novel viral micro RNA-like genes, each of which in turn modulates expression of at least one host target gene, the function and utility of which at least one host target gene is known in the art.

VGR3055 gene, herein designated VGR GENE, is a novel bioinformatically detected regulatory, non protein coding, RNA viral gene. The method by which VGR3055 gene was detected is described hereinabove with reference to FIGS. 1-9.

VGR3055 gene encodes VGR3055 precursor RNA, herein designated VGR PRECURSOR RNA, an RNA molecule, typically several hundred nucleotides long.

VGR3055 precursor RNA folds spatially, forming VGR3055 folded precursor RNA, herein designated VGR FOLDED PRECURSOR RNA. It is appreciated that VGR3055 folded precursor RNA comprises a plurality of what is known in the art as 'hairpin' structures. These 'hairpin' structures are due to the fact that the nucleotide sequence of VGR3055 precursor RNA comprises a plurality of segments, the first half of each such segment having a nucleotide sequence which is at least a partial inversed-reversed sequence of the second half thereof, as is well known in the art.

VGR3055 folded precursor RNA is naturally processed by cellular enzymatic activity into at least 6 separate VGAM precursor RNAs, VGAM1443 precursor RNA, VGAM1444 precursor RNA, VGAM1445 precursor RNA, VGAM1446 precursor RNA, VGAM1447 precursor RNA and VGAM1448 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1443 RNA, VGAM1444 RNA, VGAM1445 RNA, VGAM1446 RNA, VGAM1447 RNA and VGAM1448 RNA, herein schematically represented by VGAM1 RNA through VGAM3 RNA, each of which VGAM RNAs corresponding to VGAM RNA of FIG. 1.

VGAM1443 RNA, herein schematically represented by VGAM1 RNA through VGAM3 RNA, binds complementarily to a host target binding site located in an untranslated region of VGAM1443 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1443 host target RNA into VGAM1443 host target protein, herein schematically represented by VGAM1 HOST TARGET PROTEIN through VGAM3 HOST TARGET PROTEIN, all of FIG. 1.

VGAM1444 RNA, herein schematically represented by VGAM1 RNA through VGAM3 RNA, binds complementarily to a host target binding site located in an untranslated region of VGAM1444 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1444 host target RNA into VGAM1444 host target protein, herein schematically represented by VGAM1 HOST TARGET PROTEIN through VGAM3 HOST TARGET PROTEIN, all of FIG. 1.

VGAM1445 RNA, herein schematically represented by VGAM1 RNA through VGAM3 RNA, binds complementarily to a host target binding site located in an untranslated region of VGAM1445 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1445 host target RNA into VGAM1445 host target protein, herein schematically represented by VGAM1 HOST TARGET PROTEIN through VGAM3 HOST TARGET PROTEIN, all of FIG. 1.

VGAM1446 RNA, herein schematically represented by VGAM1 RNA through VGAM3 RNA, binds complementarily to a host target binding site located in an untranslated region of VGAM1446 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1446 host target RNA into VGAM1446 host target protein, herein schematically represented by VGAM1 HOST TARGET PROTEIN through VGAM3 HOST TARGET PROTEIN, all of FIG. 1.

VGAM1447 RNA, herein schematically represented by VGAM1 RNA through VGAM3 RNA, binds complementarily to a host target binding site located in an untranslated region of VGAM1447 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1447 host target RNA into VGAM1447 host target protein, herein schematically represented by VGAM1 HOST TARGET PROTEIN through VGAM3 HOST TARGET PROTEIN, all of FIG. 1.

VGAM1448 RNA, herein schematically represented by VGAM1 RNA through VGAM3 RNA, binds complementarily to a host target binding site located in an untranslated region of VGAM1448 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1448 host target RNA into VGAM1448 host target protein, herein schematically represented by VGAM1 HOST TARGET PROTEIN through VGAM3 HOST TARGET PROTEIN, all of FIG. 1.

It is appreciated that a function of VGR3055 gene, herein designated VGR GENE, is inhibition of expression of host target genes, as part of a novel viral mechanism of attacking a host. Accordingly, utilities of VGR3055 gene include diagnosis, prevention and treatment of viral infection by Pepper Mottle Virus. Specific functions, and accordingly utilities, of VGR3055 gene correlate with, and may be deduced from, the identity of the host target genes, which are inhibited by VGAM RNAs comprised in the 'operon-like' cluster of VGR3055 gene: VGAM1443 host target protein, VGAM1444 host target protein, VGAM1445 host target protein, VGAM1446 host target protein, VGAM1447 host target protein and VGAM1448 host target protein, herein schematically represented by VGAM1 HOST TARGET PROTEIN through VGAM3 HOST TARGET PROTEIN. The function of these host target genes is elaborated hereinabove with reference to VGAM1443, VGAM1444, VGAM1445, VGAM1446, VGAM1447 and VGAM1448. FIG. 9 further provides a conceptual description of novel bioinformatically detected regulatory viral gene, referred to here as Viral Genomic Record 3056(VGR3056) viral gene, which encodes an 'operon-like' cluster of novel viral micro RNA-like genes, each of which in turn modulates expression of at least one host target gene, the function and utility of which at least one host target gene is known in the art.

VGR3056 gene, herein designated VGR GENE, is a novel bioinformatically detected regulatory, non protein coding, RNA viral gene. The method by which VGR3056 gene was detected is described hereinabove with reference to FIGS. 1-9.

VGR3056 gene encodes VGR3056 precursor RNA, herein designated VGR PRECURSOR RNA, an RNA molecule, typically several hundred nucleotides long.

VGR3056 precursor RNA folds spatially, forming VGR3056 folded precursor RNA, herein designated VGR FOLDED PRECURSOR RNA. It is appreciated that VGR3056 folded precursor RNA comprises a plurality of what is known in the art as 'hairpin' structures. These 'hairpin' structures are due to the fact that the nucleotide sequence of VGR3056 precursor RNA comprises a plurality of segments, the first half of each such segment having a nucleotide sequence which is at least a partial inversed-reversed sequence of the second half thereof, as is well known in the art.

VGR3056 folded precursor RNA is naturally processed by cellular enzymatic activity into at least 8 separate VGAM precursor RNAs, VGAM1449 precursor RNA, VGAM1450 precursor RNA, VGAM1451 precursor RNA, VGAM1452 precursor RNA, VGAM1453 precursor RNA, VGAM1454 precursor RNA, VGAM1455 precursor RNA and VGAM1456 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1449 RNA, VGAM1450 RNA, VGAM1451 RNA, VGAM1452 RNA, VGAM1453 RNA, VGAM1454 RNA, VGAM1455 RNA and VGAM1456 RNA, herein schematically represented by VGAM1 RNA through VGAM3 RNA, each of which VGAM RNAs corresponding to VGAM RNA of FIG. 1.

VGAM1449 RNA, herein schematically represented by VGAM1 RNA through VGAM3 RNA, binds complementarily to a host target binding site located in an untranslated region of VGAM1449 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1449 host target RNA into VGAM1449 host target protein, herein schematically represented by VGAM1 HOST TARGET PROTEIN through VGAM3 HOST TARGET PROTEIN, all of FIG. 1.

VGAM1450 RNA, herein schematically represented by VGAM1 RNA through VGAM3 RNA, binds complementarily to a host target binding site located in an untranslated region of VGAM1450 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1450 host target RNA into VGAM1450 host target protein, herein schematically represented by VGAM1 HOST TARGET PROTEIN through VGAM3 HOST TARGET PROTEIN, all of FIG. 1.

VGAM1451 RNA, herein schematically represented by VGAM1 RNA through VGAM3 RNA, binds complementarily to a host target binding site located in an untranslated region of VGAM1451 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1451 host target RNA into VGAM1451 host target protein, herein schematically represented by VGAM1 HOST TARGET PROTEIN through VGAM3 HOST TARGET PROTEIN, all of FIG. 1.

VGAM1452 RNA, herein schematically represented by VGAM1 RNA through VGAM3 RNA, binds complementarily to a host target binding site located in an untranslated region of VGAM1452 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1452 host target RNA into VGAM1452 host target protein, herein schematically represented by VGAM1 HOST TARGET PROTEIN through VGAM3 HOST TARGET PROTEIN, all of FIG. 1.

VGAM1453 RNA, herein schematically represented by VGAM1 RNA through VGAM3 RNA, binds complementarily to a host target binding site located in an untranslated region of VGAM1453 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1453 host target RNA into VGAM1453 host target protein, herein schematically represented by VGAM1 HOST TARGET PROTEIN through VGAM3 HOST TARGET PROTEIN, all of FIG. 1.

VGAM1454 RNA, herein schematically represented by VGAM1 RNA through VGAM3 RNA, binds complementarily to a host target binding site located in an untranslated region of VGAM1454 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1454 host target RNA into VGAM1454 host target protein, herein schematically represented by VGAM1 HOST TARGET PROTEIN through VGAM3 HOST TARGET PROTEIN, all of FIG. 1.

VGAM1455 RNA, herein schematically represented by VGAM1 RNA through VGAM3 RNA, binds complementarily to a host target binding site located in an untranslated region of VGAM1455 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1455 host target RNA into VGAM1455 host target protein, herein schematically represented by VGAM1 HOST TARGET PROTEIN through VGAM3 HOST TARGET PROTEIN, all of FIG. 1.

VGAM1456 RNA, herein schematically represented by VGAM1 RNA through VGAM3 RNA, binds complementarily to a host target binding site located in an untranslated region of VGAM1456 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1456 host target RNA into VGAM1456 host target protein, herein schematically represented by VGAM1 HOST TARGET PROTEIN through VGAM3 HOST TARGET PROTEIN, all of FIG. 1.

It is appreciated that a function of VGR3056 gene, herein designated VGR GENE, is inhibition of expression of host target genes, as part of a novel viral mechanism of attacking a host. Accordingly, utilities of VGR3056 gene include diagnosis, prevention and treatment of viral infection by Equine Herpesvirus 2. Specific functions, and accordingly utilities, of VGR3056 gene correlate with, and may be deduced from, the identity of the host target genes, which are inhibited by VGAM RNAs comprised in the 'operon-like' cluster of VGR3056 gene: VGAM1449 host target protein, VGAM1450 host target protein, VGAM1451 host target protein, VGAM1452 host target protein, VGAM1453 host target protein, VGAM1454 host target protein, VGAM1455 host target protein and VGAM1456 host target protein, herein schematically represented by VGAM1 HOST TARGET PROTEIN through VGAM3 HOST TARGET PROTEIN. The function of these host target genes is elaborated hereinabove with reference to VGAM1449, VGAM1450, VGAM1451, VGAM1452, VGAM1453, VGAM1454, VGAM1455 and VGAM1456. FIG. 9 further provides a conceptual description of novel bioinformatically detected regulatory viral gene, referred to here as Viral Genomic Record 3057(VGR3057) viral gene, which encodes an 'operon-like' cluster of novel viral micro RNA-like genes, each of which in turn modulates expression of at least one host target gene, the function and utility of which at least one host target gene is known in the art.

VGR3057 gene, herein designated VGR GENE, is a novel bioinformatically detected regulatory, non protein coding, RNA viral gene. The method by which VGR3057 gene was detected is described hereinabove with reference to FIGS. 1-9.

VGR3057 gene encodes VGR3057 precursor RNA, herein designated VGR PRECURSOR RNA, an RNA molecule, typically several hundred nucleotides long.

VGR3057 precursor RNA folds spatially, forming VGR3057 folded precursor RNA, herein designated VGR FOLDED PRECURSOR RNA. It is appreciated that VGR3057 folded precursor RNA comprises a plurality of what is known in the art as 'hairpin' structures. These 'hairpin' structures are due to the fact that the nucleotide sequence of VGR3057 precursor RNA comprises a plurality of segments, the first half of each such segment having a nucleotide sequence which is at least a partial inversed-reversed sequence of the second half thereof, as is well known in the art.

VGR3057 folded precursor RNA is naturally processed by cellular enzymatic activity into at least 8 separate VGAM precursor RNAs, VGAM1457 precursor RNA, VGAM1458 precursor RNA, VGAM1459 precursor RNA, VGAM1460 precursor RNA, VGAM1461 precursor RNA, VGAM1462 precursor RNA, VGAM1463 precursor RNA and VGAM1464 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1457 RNA, VGAM1458 RNA, VGAM1459 RNA, VGAM1460 RNA, VGAM1461 RNA, VGAM1462 RNA, VGAM1463 RNA and VGAM1464 RNA, herein schematically represented by VGAM1 RNA through VGAM3 RNA, each of which VGAM RNAs corresponding to VGAM RNA of FIG. 1.

VGAM1457 RNA, herein schematically represented by VGAM1 RNA through VGAM3 RNA, binds complementarily to a host target binding site located in an untranslated region of VGAM1457 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1457 host target RNA into VGAM1457 host target protein, herein schematically represented by VGAM1 HOST TARGET PROTEIN through VGAM3 HOST TARGET PROTEIN, all of FIG. 1.

VGAM1458 RNA, herein schematically represented by VGAM1 RNA through VGAM3 RNA, binds complementarily to a host target binding site located in an untranslated region of VGAM1458 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1458 host target RNA into VGAM1458 host target protein, herein schematically represented by VGAM1 HOST TARGET PROTEIN through VGAM3 HOST TARGET PROTEIN, all of FIG. 1.

VGAM1459 RNA, herein schematically represented by VGAM1 RNA through VGAM3 RNA, binds complementarily to a host target binding site located in an untranslated region of VGAM1459 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1459 host target RNA into VGAM1459 host target protein, herein schematically represented by VGAM1 HOST TARGET PROTEIN through VGAM3 HOST TARGET PROTEIN, all of FIG. 1.

VGAM1460 RNA, herein schematically represented by VGAM1 RNA through VGAM3 RNA, binds complementarily to a host target binding site located in an untranslated region of VGAM1460 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1460 host target RNA into VGAM1460 host target protein, herein schematically represented by VGAM1 HOST TARGET PROTEIN through VGAM3 HOST TARGET PROTEIN, all of FIG. 1.

VGAM1461 RNA, herein schematically represented by VGAM1 RNA through VGAM3 RNA, binds complementarily to a host target binding site located in an untranslated region of VGAM1461 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1461 host target RNA into VGAM1461 host target protein, herein schematically represented by VGAM1 HOST TARGET PROTEIN through VGAM3 HOST TARGET PROTEIN, all of FIG. 1.

VGAM1462 RNA, herein schematically represented by VGAM1 RNA through VGAM3 RNA, binds complementarily to a host target binding site located in an untranslated region of VGAM1462 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1462 host target RNA into VGAM1462 host target protein, herein schematically represented by VGAM1 HOST TARGET PROTEIN through VGAM3 HOST TARGET PROTEIN, all of FIG. 1.

VGAM1463 RNA, herein schematically represented by VGAM1 RNA through VGAM3 RNA, binds complementarily to a host target binding site located in an untranslated region of VGAM1463 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1463 host target RNA into VGAM1463 host target protein, herein schematically represented by VGAM1 HOST TARGET PROTEIN through VGAM3 HOST TARGET PROTEIN, all of FIG. 1.

VGAM1464 RNA, herein schematically represented by VGAM1 RNA through VGAM3 RNA, binds complementarily to a host target binding site located in an untranslated region of VGAM1464 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1464 host target RNA into VGAM1464 host target protein, herein schematically represented by VGAM1 HOST TARGET PROTEIN through VGAM3 HOST TARGET PROTEIN, all of FIG. 1.

It is appreciated that a function of VGR3057 gene, herein designated VGR GENE, is inhibition of expression of host target genes, as part of a novel viral mechanism of attacking a host. Accordingly, utilities of VGR3057 gene include diagnosis, prevention and treatment of viral infection by Equine Herpesvirus 2. Specific functions, and accordingly utilities, of VGR3057 gene correlate with, and may be deduced from, the identity of the host target genes, which are inhibited by VGAM RNAs comprised in the 'operon-like' cluster of VGR3057 gene: VGAM1457 host target protein, VGAM1458 host target protein, VGAM1459 host target protein, VGAM1460 host target protein, VGAM1461 host target protein, VGAM1462 host target protein, VGAM1463 host target protein and VGAM1464 host target protein, herein schematically represented by VGAM1 HOST TARGET PROTEIN through VGAM3 HOST TARGET PROTEIN. The function of these host target genes is elaborated hereinabove with reference to VGAM1457, VGAM1458, VGAM1459, VGAM1460, VGAM1461, VGAM1462, VGAM1463 and VGAM1464. FIG. 9 further provides a conceptual description of novel bioinformatically detected regulatory viral gene, referred to here as Viral Genomic Record 3058(VGR3058) viral gene, which encodes an 'operon-like' cluster of novel viral micro RNA-like genes, each of which in turn modulates expression of at least one host target gene, the function and utility of which at least one host target gene is known in the art.

VGR3058 gene, herein designated VGR GENE, is a novel bioinformatically detected regulatory, non protein coding, RNA viral gene. The method by which VGR3058 gene was detected is described hereinabove with reference to FIGS. 1-9.

VGR3058 gene encodes VGR3058 precursor RNA, herein designated VGR PRECURSOR RNA, an RNA molecule, typically several hundred nucleotides long.

VGR3058 precursor RNA folds spatially, forming VGR3058 folded precursor RNA, herein designated VGR FOLDED PRECURSOR RNA. It is appreciated that VGR3058 folded precursor RNA comprises a plurality of what is known in the art as 'hairpin' structures. These 'hairpin' structures are due to the fact that the nucleotide sequence of VGR3058 precursor RNA comprises a plurality of segments, the first half of each such segment having a nucleotide sequence which is at least a partial inversed-reversed sequence of the second half thereof, as is well known in the art.

VGR3058 folded precursor RNA is naturally processed by cellular enzymatic activity into at least 3 separate VGAM precursor RNAs, VGAM1465 precursor RNA, VGAM1466 precursor RNA and VGAM1467 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1465 RNA, VGAM1466 RNA and VGAM1467 RNA, herein schematically represented by VGAM1 RNA through VGAM3 RNA, each of which VGAM RNAs corresponding to VGAM RNA of FIG. 1.

VGAM1465 RNA, herein schematically represented by VGAM1 RNA through VGAM3 RNA, binds complementarily to a host target binding site located in an untranslated region of VGAM1465 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1465 host target RNA into VGAM1465 host target protein, herein schematically represented by VGAM1 HOST TARGET PROTEIN through VGAM3 HOST TARGET PROTEIN, all of FIG. 1.

VGAM1466 RNA, herein schematically represented by VGAM1 RNA through VGAM3 RNA, binds complementarily to a host target binding site located in an untranslated region of VGAM1466 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1466 host target RNA into VGAM1466 host target protein, herein schematically represented by VGAM1 HOST TARGET PROTEIN through VGAM3 HOST TARGET PROTEIN, all of FIG. 1.

VGAM1467 RNA, herein schematically represented by VGAM1 RNA through VGAM3 RNA, binds complementarily to a host target binding site located in an untranslated region of VGAM1467 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1467 host target RNA into VGAM1467 host target protein, herein schematically represented by VGAM1 HOST TARGET PROTEIN through VGAM3 HOST TARGET PROTEIN, all of FIG. 1.

It is appreciated that a function of VGR3058 gene, herein designated VGR GENE, is inhibition of expression of host target genes, as part of a novel viral mechanism of attacking a host. Accordingly, utilities of VGR3058 gene include diagnosis, prevention and treatment of viral infection by Equine Herpesvirus 2. Specific functions, and accordingly utilities, of VGR3058 gene correlate with, and may be deduced from, the identity of the host target genes, which are inhibited by VGAM RNAs comprised in the 'operon-like' cluster of VGR3058 gene: VGAM1465 host target protein, VGAM1466 host target protein and VGAM1467 host target protein, herein schematically represented by VGAM1 HOST TARGET PROTEIN through VGAM3 HOST TARGET PROTEIN. The function of these host target genes is elaborated hereinabove with reference to VGAM1465, VGAM1466 and VGAM1467. FIG. 9 further provides a conceptual description of novel bioinformatically detected regulatory viral gene, referred to here as Viral Genomic Record 3059(VGR3059) viral gene, which encodes an 'operon-like' cluster of novel viral micro RNA-like genes, each of which in turn modulates expression of at least one host target gene, the function and utility of which at least one host target gene is known in the art.

VGR3059 gene, herein designated VGR GENE, is a novel bioinformatically detected regulatory, non protein coding, RNA viral gene. The method by which VGR3059 gene was detected is described hereinabove with reference to FIGS. 1-9.

VGR3059 gene encodes VGR3059 precursor RNA, herein designated VGR PRECURSOR RNA, an RNA molecule, typically several hundred nucleotides long.

VGR3059 precursor RNA folds spatially, forming VGR3059 folded precursor RNA, herein designated VGR FOLDED PRECURSOR RNA. It is appreciated that VGR3059 folded precursor RNA comprises a plurality of what is known in the art as 'hairpin' structures. These 'hairpin' structures are due to the fact that the nucleotide sequence of VGR3059 precursor RNA comprises a plurality of segments, the first half of each such segment having a nucleotide sequence which is at least a partial inversed-reversed sequence of the second half thereof, as is well known in the art.

VGR3059 folded precursor RNA is naturally processed by cellular enzymatic activity into at least 2 separate VGAM precursor RNAs, VGAM1468 precursor RNA and VGAM1469 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1468 RNA and VGAM1469 RNA, herein schematically represented by VGAM1 RNA through VGAM3 RNA, each of which VGAM RNAs corresponding to VGAM RNA of FIG. 1.

VGAM1468 RNA, herein schematically represented by VGAM1 RNA through VGAM3 RNA, binds complementarily to a host target binding site located in an untranslated region of VGAM1468 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1468 host target RNA into VGAM1468 host target protein, herein schematically represented by VGAM1 HOST TARGET PROTEIN through VGAM3 HOST TARGET PROTEIN, all of FIG. 1.

VGAM1469 RNA, herein schematically represented by VGAM1 RNA through VGAM3 RNA, binds complementarily to a host target binding site located in an untranslated region of VGAM1469 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1469 host target RNA into VGAM1469 host target protein, herein schematically represented by VGAM1 HOST TARGET PROTEIN through VGAM3 HOST TARGET PROTEIN, all of FIG. 1.

It is appreciated that a function of VGR3059 gene, herein designated VGR GENE, is inhibition of expression of host target genes, as part of a novel viral mechanism of attacking a host. Accordingly, utilities of VGR3059 gene include diagnosis, prevention and treatment of viral infection by Infectious Flacherie Virus. Specific functions, and accordingly utilities, of VGR3059 gene correlate with, and may be deduced from, the identity of the host target genes, which are inhibited by VGAM RNAs comprised in the 'operon-like' cluster of VGR3059 gene: VGAM1468 host target protein and VGAM1469 host target protein, herein schematically represented by VGAM1 HOST TARGET PROTEIN through VGAM3 HOST TARGET PROTEIN. The function of these host target genes is elaborated hereinabove with reference to VGAM1468 and VGAM1469. FIG. 9 further provides a conceptual description of novel bioinformatically detected regulatory viral gene, referred to here as Viral Genomic Record 3060(VGR3060) viral gene, which encodes an 'operon-like' cluster of novel viral micro RNA-like genes, each of which in turn modulates expression of at least one host target gene, the function and utility of which at least one host target gene is known in the art.

VGR3060 gene, herein designated VGR GENE, is a novel bioinformatically detected regulatory, non protein coding, RNA viral gene. The method by which VGR3060 gene was detected is described hereinabove with reference to FIGS. 1-9.

VGR3060 gene encodes VGR3060 precursor RNA, herein designated VGR PRECURSOR RNA, an RNA molecule, typically several hundred nucleotides long.

VGR3060 precursor RNA folds spatially, forming VGR3060 folded precursor RNA, herein designated VGR FOLDED PRECURSOR RNA. It is appreciated that VGR3060 folded precursor RNA comprises a plurality of what is known in the art as 'hairpin' structures. These 'hairpin' structures are due to the fact that the nucleotide sequence of VGR3060 precursor RNA comprises a plurality of segments, the first half of each such segment having a nucleotide sequence which is at least a partial inversed-reversed sequence of the second half thereof, as is well known in the art.

VGR3060 folded precursor RNA is naturally processed by cellular enzymatic activity into at least 8 separate VGAM precursor RNAs, VGAM1470 precursor RNA, VGAM1471 precursor RNA, VGAM1472 precursor RNA, VGAM1473 precursor RNA, VGAM1474 precursor RNA, VGAM1475 precursor RNA, VGAM1476 precursor RNA and VGAM1477 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1470 RNA, VGAM1471 RNA, VGAM1472 RNA, VGAM1473 RNA, VGAM1474 RNA, VGAM1475 RNA, VGAM1476 RNA and VGAM1477 RNA, herein schematically represented by VGAM1 RNA through VGAM3 RNA, each of which VGAM RNAs corresponding to VGAM RNA of FIG. 1.

VGAM1470 RNA, herein schematically represented by VGAM1 RNA through VGAM3 RNA, binds complementarily to a host target binding site located in an untranslated region of VGAM1470 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1470 host target RNA into VGAM1470 host target protein, herein schematically represented by VGAM1 HOST TARGET PROTEIN through VGAM3 HOST TARGET PROTEIN, all of FIG. 1.

VGAM1471 RNA, herein schematically represented by VGAM1 RNA through VGAM3 RNA, binds complementarily to a host target binding site located in an untranslated region of VGAM1471 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1471 host target RNA into VGAM1471 host target protein, herein schematically represented by VGAM1 HOST TARGET PROTEIN through VGAM3 HOST TARGET PROTEIN, all of FIG. 1.

VGAM1472 RNA, herein schematically represented by VGAM1 RNA through VGAM3 RNA, binds complementarily to a host target binding site located in an untranslated region of VGAM1472 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1472 host target RNA into VGAM1472 host target protein, herein schematically represented by VGAM1 HOST TARGET PROTEIN through VGAM3 HOST TARGET PROTEIN, all of FIG. 1.

VGAM1473 RNA, herein schematically represented by VGAM1 RNA through VGAM3 RNA, binds complementarily to a host target binding site located in an untranslated region of VGAM1473 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1473 host target RNA into VGAM1473 host target protein, herein schematically represented by VGAM1 HOST TARGET PROTEIN through VGAM3 HOST TARGET PROTEIN, all of FIG. 1.

VGAM1474 RNA, herein schematically represented by VGAM1 RNA through VGAM3 RNA, binds complementarily to a host target binding site located in an untranslated region of VGAM1474 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1474 host target RNA into VGAM1474 host target protein, herein schematically represented by VGAM1 HOST TARGET PROTEIN through VGAM3 HOST TARGET PROTEIN, all of FIG. 1.

VGAM1475 RNA, herein schematically represented by VGAM1 RNA through VGAM3 RNA, binds complementarily to a host target binding site located in an untranslated region of VGAM1475 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1475 host target RNA into VGAM1475 host target protein, herein schematically represented by VGAM1 HOST TARGET PROTEIN through VGAM3 HOST TARGET PROTEIN, all of FIG. 1.

VGAM1476 RNA, herein schematically represented by VGAM1 RNA through VGAM3 RNA, binds complementarily to a host target binding site located in an untranslated region of VGAM1476 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1476 host target RNA into VGAM1476 host target protein, herein schematically represented by VGAM1 HOST TARGET PROTEIN through VGAM3 HOST TARGET PROTEIN, all of FIG. 1.

VGAM1477 RNA, herein schematically represented by VGAM1 RNA through VGAM3 RNA, binds complementarily to a host target binding site located in an untranslated region of VGAM1477 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1477 host target RNA into VGAM1477 host target protein, herein schematically represented by VGAM1 HOST TARGET PROTEIN through VGAM3 HOST TARGET PROTEIN, all of FIG. 1.

It is appreciated that a function of VGR3060 gene, herein designated VGR GENE, is inhibition of expression of host target genes, as part of a novel viral mechanism of attacking a host. Accordingly, utilities of VGR3060 gene include diagnosis, prevention and treatment of viral infection by Cocksfoot Streak Virus (CSV). Specific functions, and accordingly utilities, of VGR3060 gene correlate with, and may be deduced from, the identity of the host target genes, which are inhibited by VGAM RNAs comprised in the 'operon-like' cluster of VGR3060 gene: VGAM1470 host target protein, VGAM1471 host target protein, VGAM1472 host target protein, VGAM1473 host target protein, VGAM1474 host target protein, VGAM1475 host target protein, VGAM1476 host target protein and VGAM1477 host target protein, herein schematically represented by VGAM1 HOST TARGET PROTEIN through VGAM3 HOST TARGET PROTEIN. The function of these host target genes is elaborated hereinabove with reference to VGAM1470, VGAM1471, VGAM1472, VGAM1473, VGAM1474, VGAM1475, VGAM1476 and VGAM1477. FIG. 9 further provides a conceptual description of novel bioinformatically detected regulatory viral gene, referred to here as Viral Genomic Record 3061(VGR3061) viral gene, which encodes an 'operon-like' cluster of novel viral micro RNA-like genes, each of which in turn modulates expression of at least one host target gene, the function and utility of which at least one host target gene is known in the art.

VGR3061 gene, herein designated VGR GENE, is a novel bioinformatically detected regulatory, non protein coding, RNA viral gene. The method by which VGR3061 gene was detected is described hereinabove with reference to FIGS. 1-9.

VGR3061 gene encodes VGR3061 precursor RNA, herein designated VGR PRECURSOR RNA, an RNA molecule, typically several hundred nucleotides long.

VGR3061 precursor RNA folds spatially, forming VGR3061 folded precursor RNA, herein designated VGR FOLDED PRECURSOR RNA. It is appreciated that VGR3061 folded precursor RNA comprises a plurality of what is known in the art as 'hairpin' structures. These 'hairpin' structures are due to the fact that the nucleotide sequence of VGR3061 precursor RNA comprises a plurality of segments, the first half of each such segment having a nucleotide sequence which is at least a partial inversed-reversed sequence of the second half thereof, as is well known in the art.

VGR3061 folded precursor RNA is naturally processed by cellular enzymatic activity into at least 6 separate VGAM precursor RNAs, VGAM1478 precursor RNA, VGAM1479 precursor RNA, VGAM1480 precursor RNA, VGAM1481 precursor RNA, VGAM1482 precursor RNA and VGAM1483 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1478 RNA, VGAM1479 RNA, VGAM1480 RNA, VGAM1481 RNA, VGAM1482 RNA and VGAM1483 RNA, herein schematically represented by VGAM1 RNA through VGAM3 RNA, each of which VGAM RNAs corresponding to VGAM RNA of FIG. 1.

VGAM1478 RNA, herein schematically represented by VGAM1 RNA through VGAM3 RNA, binds complementarily to a host target binding site located in an untranslated region of VGAM1478 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1478 host target RNA into VGAM1478 host target protein, herein schematically represented by VGAM1 HOST TARGET PROTEIN through VGAM3 HOST TARGET PROTEIN, all of FIG. 1.

VGAM1479 RNA, herein schematically represented by VGAM1 RNA through VGAM3 RNA, binds complementarily to a host target binding site located in an untranslated region of VGAM1479 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1479 host target RNA into VGAM1479 host target protein, herein schematically represented by VGAM1 HOST TARGET PROTEIN through VGAM3 HOST TARGET PROTEIN, all of FIG. 1.

VGAM1480 RNA, herein schematically represented by VGAM1 RNA through VGAM3 RNA, binds complementarily to a host target binding site located in an untranslated region of VGAM1480 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1480 host target RNA into VGAM1480 host target protein, herein schematically represented by VGAM1 HOST TARGET PROTEIN through VGAM3 HOST TARGET PROTEIN, all of FIG. 1.

VGAM1481 RNA, herein schematically represented by VGAM1 RNA through VGAM3 RNA, binds complementarily to a host target binding site located in an untranslated region of VGAM1481 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1481 host target RNA into VGAM1481 host target protein, herein schematically represented by VGAM1 HOST TARGET PROTEIN through VGAM3 HOST TARGET PROTEIN, all of FIG. 1.

VGAM1482 RNA, herein schematically represented by VGAM1 RNA through VGAM3 RNA, binds complementarily to a host target binding site located in an untranslated region of VGAM1482 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1482 host target RNA into VGAM1482 host target protein, herein schematically represented by VGAM1 HOST TARGET PROTEIN through VGAM3 HOST TARGET PROTEIN, all of FIG. 1.

VGAM1483 RNA, herein schematically represented by VGAM1 RNA through VGAM3 RNA, binds complementarily to a host target binding site located in an untranslated region of VGAM1483 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1483 host target RNA into VGAM1483 host target protein, herein schematically represented by VGAM1 HOST TARGET PROTEIN through VGAM3 HOST TARGET PROTEIN, all of FIG. 1.

It is appreciated that a function of VGR3061 gene, herein designated VGR GENE, is inhibition of expression of host target genes, as part of a novel viral mechanism of attacking a host. Accordingly, utilities of VGR3061 gene include diagnosis, prevention and treatment of viral infection by Brome Streak Mosaic Virus. Specific functions, and accordingly utilities, of VGR3061 gene correlate with, and may be deduced from, the identity of the host target genes, which are inhibited by VGAM RNAs comprised in the 'operon-like' cluster of VGR3061 gene: VGAM1478 host target protein, VGAM1479 host target protein, VGAM1480 host target protein, VGAM1481 host target protein, VGAM1482 host target protein and VGAM1483 host target protein, herein schematically represented by VGAM1 HOST TARGET PROTEIN through VGAM3 HOST TARGET PROTEIN. The function of these host target genes is elaborated hereinabove with reference to VGAM1478, VGAM1479, VGAM1480, VGAM1481, VGAM1482 and VGAM1483. FIG. 9 further provides a conceptual description of novel bioinformatically detected regulatory viral gene, referred to here as Viral Genomic Record 3062(VGR3062) viral gene, which encodes an 'operon-like' cluster of novel viral micro RNA-like genes, each of which in turn modulates expression of at least one host target gene, the function and utility of which at least one host target gene is known in the art.

VGR3062 gene, herein designated VGR GENE, is a novel bioinformatically detected regulatory, non protein coding, RNA viral gene. The method by which VGR3062 gene was detected is described hereinabove with reference to FIGS. 1-9.

VGR3062 gene encodes VGR3062 precursor RNA, herein designated VGR PRECURSOR RNA, an RNA molecule, typically several hundred nucleotides long.

VGR3062 precursor RNA folds spatially, forming VGR3062 folded precursor RNA, herein designated VGR FOLDED PRECURSOR RNA. It is appreciated that VGR3062 folded precursor RNA comprises a plurality of what is known in the art as 'hairpin' structures. These 'hairpin' structures are due to the fact that the nucleotide sequence of VGR3062 precursor RNA comprises a plurality of segments, the first half of each such segment having a nucleotide sequence which is at least a partial inversed-reversed sequence of the second half thereof, as is well known in the art.

VGR3062 folded precursor RNA is naturally processed by cellular enzymatic activity into at least 4 separate VGAM precursor RNAs, VGAM1484 precursor RNA, VGAM1485 precursor RNA, VGAM1486 precursor RNA and VGAM1487 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1484 RNA, VGAM1485 RNA, VGAM1486 RNA and VGAM1487 RNA, herein schematically represented by VGAM1 RNA through VGAM3 RNA, each of which VGAM RNAs corresponding to VGAM RNA of FIG. 1.

VGAM1484 RNA, herein schematically represented by VGAM1 RNA through VGAM3 RNA, binds complementarily to a host target binding site located in an untranslated region of VGAM1484 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1484 host target RNA into VGAM1484 host target protein, herein schematically represented by VGAM1 HOST TARGET PROTEIN through VGAM3 HOST TARGET PROTEIN, all of FIG. 1.

VGAM1485 RNA, herein schematically represented by VGAM1 RNA through VGAM3 RNA, binds complementarily to a host target binding site located in an untranslated region of VGAM1485 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1485 host target RNA into VGAM1485 host target protein, herein schematically represented by VGAM1 HOST TARGET PROTEIN through VGAM3 HOST TARGET PROTEIN, all of FIG. 1.

VGAM1486 RNA, herein schematically represented by VGAM1 RNA through VGAM3 RNA, binds complementarily to a host target binding site located in an untranslated region of VGAM1486 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1486 host target RNA into VGAM1486 host target protein, herein schematically represented by VGAM1 HOST TARGET PROTEIN through VGAM3 HOST TARGET PROTEIN, all of FIG. 1.

VGAM1487 RNA, herein schematically represented by VGAM1 RNA through VGAM3 RNA, binds complementarily to a host target binding site located in an untranslated region of VGAM1487 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1487 host target RNA into VGAM1487 host target protein, herein schematically represented by VGAM1 HOST TARGET PROTEIN through VGAM3 HOST TARGET PROTEIN, all of FIG. 1.

It is appreciated that a function of VGR3062 gene, herein designated VGR GENE, is inhibition of expression of host target genes, as part of a novel viral mechanism of attacking a host. Accordingly, utilities of VGR3062 gene include diagnosis, prevention and treatment of viral infection by Gallid Herpesvirus 2. Specific functions, and accordingly utilities, of VGR3062 gene correlate with, and may be deduced from, the identity of the host target genes, which are inhibited by VGAM RNAs comprised in the 'operon-like' cluster of VGR3062 gene: VGAM1484 host target protein, VGAM1485 host target protein, VGAM1486 host target protein and VGAM1487 host target protein, herein schematically represented by VGAM1 HOST TARGET PROTEIN through VGAM3 HOST TARGET PROTEIN. The function of these host target genes is elaborated hereinabove with reference to VGAM1484, VGAM1485, VGAM1486 and VGAM1487. FIG. 9 further provides a conceptual description of novel bioinformatically detected regulatory viral gene, referred to here as Viral Genomic Record 3063(VGR3063) viral gene, which encodes an 'operon-like' cluster of novel viral micro RNA-like genes, each of which in turn modulates expression of at least one host target gene, the function and utility of which at least one host target gene is known in the art.

VGR3063 gene, herein designated VGR GENE, is a novel bioinformatically detected regulatory, non protein coding, RNA viral gene. The method by which VGR3063 gene was detected is described hereinabove with reference to FIGS. 1-9.

VGR3063 gene encodes VGR3063 precursor RNA, herein designated VGR PRECURSOR RNA, an RNA molecule, typically several hundred nucleotides long.

VGR3063 precursor RNA folds spatially, forming VGR3063 folded precursor RNA, herein designated VGR FOLDED PRECURSOR RNA. It is appreciated that VGR3063 folded precursor RNA comprises a plurality of what is known in the art as 'hairpin' structures. These 'hairpin' structures are due to the fact that the nucleotide sequence of VGR3063 precursor RNA comprises a plurality of segments, the first half of each such segment having a nucleotide sequence which is at least a partial inversed-reversed sequence of the second half thereof, as is well known in the art.

VGR3063 folded precursor RNA is naturally processed by cellular enzymatic activity into at least 4 separate VGAM precursor RNAs, VGAM1488 precursor RNA, VGAM1489 precursor RNA, VGAM1490 precursor RNA and VGAM1491 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1488 RNA, VGAM1489 RNA, VGAM1490 RNA and VGAM1491 RNA, herein schematically represented by VGAM1 RNA through VGAM3 RNA, each of which VGAM RNAs corresponding to VGAM RNA of FIG. 1.

VGAM1488 RNA, herein schematically represented by VGAM1 RNA through VGAM3 RNA, binds complementarily to a host target binding site located in an untranslated region of VGAM1488 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1488 host target RNA into VGAM1488 host target protein, herein schematically represented by VGAM1 HOST TARGET PROTEIN through VGAM3 HOST TARGET PROTEIN, all of FIG. 1.

VGAM1489 RNA, herein schematically represented by VGAM1 RNA through VGAM3 RNA, binds complementarily to a host target binding site located in an untranslated region of VGAM1489 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1489 host target RNA into VGAM1489 host target protein, herein schematically represented by VGAM1 HOST TARGET PROTEIN through VGAM3 HOST TARGET PROTEIN, all of FIG. 1.

VGAM1490 RNA, herein schematically represented by VGAM1 RNA through VGAM3 RNA, binds complementarily to a host target binding site located in an untranslated region of VGAM1490 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1490 host target RNA into VGAM1490 host target protein, herein schematically represented by VGAM1 HOST TARGET PROTEIN through VGAM3 HOST TARGET PROTEIN, all of FIG. 1.

VGAM1491 RNA, herein schematically represented by VGAM1 RNA through VGAM3 RNA, binds complementarily to a host target binding site located in an untranslated region of VGAM1491 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1491 host target RNA into VGAM1491 host target protein, herein schematically represented by VGAM1 HOST TARGET PROTEIN through VGAM3 HOST TARGET PROTEIN, all of FIG. 1.

It is appreciated that a function of VGR3063 gene, herein designated VGR GENE, is inhibition of expression of host target genes, as part of a novel viral mechanism of attacking a host. Accordingly, utilities of VGR3063 gene include diagnosis, prevention and treatment of viral infection by Plum Pox Virus. Specific functions, and accordingly utilities, of VGR3063 gene correlate with, and may be deduced from, the identity of the host target genes, which are inhibited by VGAM RNAs comprised in the 'operon-like' cluster of VGR3063 gene: VGAM1488 host target protein, VGAM1489 host target protein, VGAM1490 host target protein and VGAM1491 host target protein, herein schematically represented by VGAM1 HOST TARGET PROTEIN through VGAM3 HOST TARGET PROTEIN. The function of these host target genes is elaborated hereinabove with reference to VGAM1488, VGAM1489, VGAM1490 and VGAM1491. FIG. 9 further provides a conceptual description of novel bioinformatically detected regulatory viral gene, referred to here as Viral Genomic Record 3064(VGR3064) viral gene, which encodes an 'operon-like' cluster of novel viral micro RNA-like genes, each of which in turn modulates expression of at least one host target gene, the function and utility of which at least one host target gene is known in the art.

VGR3064 gene, herein designated VGR GENE, is a novel bioinformatically detected regulatory, non protein coding, RNA viral gene. The method by which VGR3064 gene was detected is described hereinabove with reference to FIGS. 1-9.

VGR3064 gene encodes VGR3064 precursor RNA, herein designated VGR PRECURSOR RNA, an RNA molecule, typically several hundred nucleotides long.

VGR3064 precursor RNA folds spatially, forming VGR3064 folded precursor RNA, herein designated VGR FOLDED PRECURSOR RNA. It is appreciated that VGR3064 folded precursor RNA comprises a plurality of what is known in the art as 'hairpin' structures. These 'hairpin' structures are due to the fact that the nucleotide sequence of VGR3064 precursor RNA comprises a plurality of segments, the first half of each such segment having a nucleotide sequence which is at least a partial inversed-reversed sequence of the second half thereof, as is well known in the art.

VGR3064 folded precursor RNA is naturally processed by cellular enzymatic activity into at least 4 separate VGAM precursor RNAs, VGAM1492 precursor RNA, VGAM1493 precursor RNA, VGAM1494 precursor RNA and VGAM1495 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1492 RNA, VGAM1493 RNA, VGAM1494 RNA and VGAM1495 RNA, herein schematically represented by VGAM1 RNA through VGAM3 RNA, each of which VGAM RNAs corresponding to VGAM RNA of FIG. 1.

VGAM1492 RNA, herein schematically represented by VGAM1 RNA through VGAM3 RNA, binds complementarily to a host target binding site located in an untranslated region of VGAM1492 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1492 host target RNA into VGAM1492 host target protein, herein schematically represented by VGAM1 HOST TARGET PROTEIN through VGAM3 HOST TARGET PROTEIN, all of FIG. 1.

VGAM1493 RNA, herein schematically represented by VGAM1 RNA through VGAM3 RNA, binds complementarily to a host target binding site located in an untranslated region of VGAM1493 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1493 host target RNA into VGAM1493 host target protein, herein schematically represented by VGAM1 HOST TARGET PROTEIN through VGAM3 HOST TARGET PROTEIN, all of FIG. 1.

VGAM1494 RNA, herein schematically represented by VGAM1 RNA through VGAM3 RNA, binds complementarily to a host target binding site located in an untranslated region of VGAM1494 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1494 host target RNA into VGAM1494 host target protein, herein schematically represented by VGAM1 HOST TARGET PROTEIN through VGAM3 HOST TARGET PROTEIN, all of FIG. 1.

VGAM1495 RNA, herein schematically represented by VGAM1 RNA through VGAM3 RNA, binds complementarily to a host target binding site located in an untranslated region of VGAM1495 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1495 host target RNA into VGAM1495 host target protein, herein schematically represented by VGAM1 HOST TARGET PROTEIN through VGAM3 HOST TARGET PROTEIN, all of FIG. 1.

It is appreciated that a function of VGR3064 gene, herein designated VGR GENE, is inhibition of expression of host target genes, as part of a novel viral mechanism of attacking a host. Accordingly, utilities of VGR3064 gene include diagnosis, prevention and treatment of viral infection by Johnsongrass Mosaic Virus. Specific functions, and accordingly utilities, of VGR3064 gene correlate with, and may be deduced from, the identity of the host target genes, which are inhibited by VGAM RNAs comprised in the 'operon-like' cluster of VGR3064 gene: VGAM1492 host target protein, VGAM1493 host target protein, VGAM1494 host target protein and VGAM1495 host target protein, herein schematically represented by VGAM1 HOST TARGET PROTEIN through VGAM3 HOST TARGET PROTEIN. The function of these host target genes is elaborated hereinabove with reference to VGAM1492, VGAM1493, VGAM1494 and VGAM1495.

FIG. 9 further provides a conceptual description of novel bioinformatically detected regulatory viral gene, referred to here as Viral Genomic Record 3065(VGR3065) viral gene, which encodes an 'operon-like' cluster of novel viral micro RNA-like genes, each of which in turn modulates expression of at least one host target gene, the function and utility of which at least one host target gene is known in the art.

VGR3065 gene, herein designated VGR GENE, is a novel bioinformatically detected regulatory, non protein coding, RNA viral gene. The method by which VGR3065 gene was detected is described hereinabove with reference to FIGS. 1-9.

VGR3065 gene encodes VGR3065 precursor RNA, herein designated VGR PRECURSOR RNA, an RNA molecule, typically several hundred nucleotides long.

VGR3065 precursor RNA folds spatially, forming VGR3065 folded precursor RNA, herein designated VGR FOLDED PRECURSOR RNA. It is appreciated that VGR3065 folded precursor RNA comprises a plurality of what is known in the art as 'hairpin' structures. These 'hairpin' structures are due to the fact that the nucleotide sequence of VGR3065 precursor RNA comprises a plurality of segments, the first half of each such segment having a nucleotide sequence which is at least a partial inversed-reversed sequence of the second half thereof, as is well known in the art.

VGR3065 folded precursor RNA is naturally processed by cellular enzymatic activity into at least 4 separate VGAM precursor RNAs, VGAM1496 precursor RNA, VGAM1497 precursor RNA, VGAM1498 precursor RNA and VGAM1499 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1496 RNA, VGAM1497 RNA, VGAM1498 RNA and VGAM1499 RNA, herein schematically represented by VGAM1 RNA through VGAM3 RNA, each of which VGAM RNAs corresponding to VGAM RNA of FIG. 1.

VGAM1496 RNA, herein schematically represented by VGAM1 RNA through VGAM3 RNA, binds complementarily to a host target binding site located in an untranslated region of VGAM1496 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1496 host target RNA into VGAM1496 host target protein, herein schematically represented by VGAM1 HOST TARGET PROTEIN through VGAM3 HOST TARGET PROTEIN, all of FIG. 1.

VGAM1497 RNA, herein schematically represented by VGAM1 RNA through VGAM3 RNA, binds complementarily to a host target binding site located in an untranslated region of VGAM1497 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1497 host target RNA into VGAM1497 host target protein, herein schematically represented by VGAM1 HOST TARGET PROTEIN through VGAM3 HOST TARGET PROTEIN, all of FIG. 1.

VGAM1498 RNA, herein schematically represented by VGAM1 RNA through VGAM3 RNA, binds complementarily to a host target binding site located in an untranslated region of VGAM1498 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1498 host target RNA into VGAM1498 host target protein, herein schematically represented by VGAM1 HOST TARGET PROTEIN through VGAM3 HOST TARGET PROTEIN, all of FIG. 1.

VGAM1499 RNA, herein schematically represented by VGAM1 RNA through VGAM3 RNA, binds complementarily to a host target binding site located in an untranslated region of VGAM1499 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1499 host target RNA into VGAM1499 host target protein, herein schematically represented by VGAM1 HOST TARGET PROTEIN through VGAM3 HOST TARGET PROTEIN, all of FIG. 1.

It is appreciated that a function of VGR3065 gene, herein designated VGR GENE, is inhibition of expression of host target genes, as part of a novel viral mechanism of attacking a host. Accordingly, utilities of VGR3065 gene include diagnosis, prevention and treatment of viral infection by Alcelaphine Herpesvirus 1. Specific functions, and accordingly utilities, of VGR3065 gene correlate with, and may be deduced from, the identity of the host target genes, which are inhibited by VGAM RNAs comprised in the 'operon-like' cluster of VGR3065 gene: VGAM1496 host target protein, VGAM1497 host target protein, VGAM1498 host target protein and VGAM1499 host target protein, herein schematically represented by VGAM1 HOST TARGET PROTEIN through VGAM3 HOST TARGET PROTEIN. The function of these host target genes is elaborated hereinabove with reference to VGAM1496, VGAM1497, VGAM1498 and VGAM1499.

FIG. 9 further provides a conceptual description of novel bioinformatically detected regulatory viral gene, referred to here as Viral Genomic Record 3066(VGR3066) viral gene, which encodes an 'operon-like' cluster of novel viral micro RNA-like genes, each of which in turn modulates expression of at least one host target gene, the function and utility of which at least one host target gene is known in the art.

VGR3066 gene, herein designated VGR GENE, is a novel bioinformatically detected regulatory, non protein coding, RNA viral gene. The method by which VGR3066 gene was detected is described hereinabove with reference to FIGS. 1-9.

VGR3066 gene encodes VGR3066 precursor RNA, herein designated VGR PRECURSOR RNA, an RNA molecule, typically several hundred nucleotides long.

VGR3066 precursor RNA folds spatially, forming VGR3066 folded precursor RNA, herein designated VGR FOLDED PRECURSOR RNA. It is appreciated that VGR3066 folded precursor RNA comprises a plurality of what is known in the art as 'hairpin' structures. These 'hairpin' structures are due to the fact that the nucleotide sequence of VGR3066 precursor RNA comprises a plurality of segments, the first half of each such segment having a nucleotide sequence which is at least a partial inversed-reversed sequence of the second half thereof, as is well known in the art.

VGR3066 folded precursor RNA is naturally processed by cellular enzymatic activity into at least 8 separate VGAM precursor RNAs, VGAM1500 precursor RNA, VGAM1501 precursor RNA, VGAM1502 precursor RNA, VGAM1503 precursor RNA, VGAM1504 precursor RNA, VGAM1505 precursor RNA, VGAM1506 precursor RNA and VGAM1507 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1500 RNA, VGAM1501 RNA, VGAM1502 RNA, VGAM1503 RNA, VGAM1504 RNA, VGAM1505 RNA, VGAM1506 RNA and VGAM1507 RNA, herein schematically represented by VGAM1 RNA through VGAM3 RNA, each of which VGAM RNAs corresponding to VGAM RNA of FIG. 1.

VGAM1500 RNA, herein schematically represented by VGAM1 RNA through VGAM3 RNA, binds complementarily to a host target binding site located in an untranslated region of VGAM1500 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1500 host target RNA into VGAM1500 host target protein, herein schematically represented by VGAM1 HOST TARGET PROTEIN through VGAM3 HOST TARGET PROTEIN, all of FIG. 1.

VGAM1501 RNA, herein schematically represented by VGAM1 RNA through VGAM3 RNA, binds complementarily to a host target binding site located in an untranslated region of VGAM1501 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1501 host target RNA into VGAM1501 host target protein, herein schematically represented by VGAM1 HOST TARGET PROTEIN through VGAM3 HOST TARGET PROTEIN, all of FIG. 1.

VGAM1502 RNA, herein schematically represented by VGAM1 RNA through VGAM3 RNA, binds complementarily to a host target binding site located in an untranslated region of VGAM1502 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1502 host target RNA into VGAM1502 host target protein, herein schematically represented by VGAM1 HOST TARGET PROTEIN through VGAM3 HOST TARGET PROTEIN, all of FIG. 1.

VGAM1503 RNA, herein schematically represented by VGAM1 RNA through VGAM3 RNA, binds complementarily to a host target binding site located in an untranslated region of VGAM1503 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1503 host target RNA into VGAM1503 host target protein, herein schematically represented by VGAM1 HOST TARGET PROTEIN through VGAM3 HOST TARGET PROTEIN, all of FIG. 1.

VGAM1504 RNA, herein schematically represented by VGAM1 RNA through VGAM3 RNA, binds complementarily to a host target binding site located in an untranslated region of VGAM1504 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1504 host target RNA into VGAM1504 host target protein, herein schematically represented by VGAM1 HOST TARGET PROTEIN through VGAM3 HOST TARGET PROTEIN, all of FIG. 1.

VGAM1505 RNA, herein schematically represented by VGAM1 RNA through VGAM3 RNA, binds complementarily to a host target binding site located in an untranslated region of VGAM1505 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1505 host target RNA into VGAM1505 host target protein, herein schematically represented by VGAM1 HOST TARGET PROTEIN through VGAM3 HOST TARGET PROTEIN, all of FIG. 1.

VGAM1506 RNA, herein schematically represented by VGAM1 RNA through VGAM3 RNA, binds complementarily to a host target binding site located in an untranslated region of VGAM1506 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1506 host target RNA into VGAM1506 host target protein, herein schematically represented by VGAM1 HOST TARGET PROTEIN through VGAM3 HOST TARGET PROTEIN, all of FIG. 1.

VGAM1507 RNA, herein schematically represented by VGAM1 RNA through VGAM3 RNA, binds complementarily to a host target binding site located in an untranslated region of VGAM1507 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1507 host target RNA into VGAM1507 host target protein, herein schematically represented by VGAM1 HOST TARGET PROTEIN through VGAM3 HOST TARGET PROTEIN, all of FIG. 1.

It is appreciated that a function of VGR3066 gene, herein designated VGR GENE, is inhibition of expression of host target genes, as part of a novel viral mechanism of attacking a host. Accordingly, utilities of VGR3066 gene include diagnosis, prevention and treatment of viral infection by Aphid Lethal Paralysis Virus. Specific functions, and accordingly utilities, of VGR3066 gene correlate with, and may be deduced from, the identity of the host target genes, which are inhibited by VGAM RNAs comprised in the 'operon-like' cluster of VGR3066 gene: VGAM1500 host target protein, VGAM1501 host target protein, VGAM1502 host target protein, VGAM1503 host target protein, VGAM1504 host target protein, VGAM1505 host target protein, VGAM1506 host target protein and VGAM1507 host target protein, herein schematically represented by VGAM1 HOST TARGET PROTEIN through VGAM3 HOST TARGET PROTEIN. The function of these host target genes is elaborated hereinabove with reference to VGAM1500, VGAM1501, VGAM1502, VGAM1503, VGAM1504, VGAM1505, VGAM1506 and VGAM1507. FIG. 9 further provides a conceptual description of novel bioinformatically detected regulatory viral gene, referred to here as Viral Genomic Record 3067(VGR3067) viral gene, which encodes an 'operon-like' cluster of novel viral micro RNA-like genes, each of which in turn modulates expression of at least one host target gene, the function and utility of which at least one host target gene is known in the art.

VGR3067 gene, herein designated VGR GENE, is a novel bioinformatically detected regulatory, non protein coding, RNA viral gene. The method by which VGR3067 gene was detected is described hereinabove with reference to FIGS. 1-9.

VGR3067 gene encodes VGR3067 precursor RNA, herein designated VGR PRECURSOR RNA, an RNA molecule, typically several hundred nucleotides long.

VGR3067 precursor RNA folds spatially, forming VGR3067 folded precursor RNA, herein designated VGR FOLDED PRECURSOR RNA. It is appreciated that VGR3067 folded precursor RNA comprises a plurality of what is known in the art as 'hairpin' structures. These 'hairpin' structures are due to the fact that the nucleotide sequence of VGR3067 precursor RNA comprises a plurality of segments, the first half of each such segment having a nucleotide sequence which is at least a partial inversed-reversed sequence of the second half thereof, as is well known in the art.

VGR3067 folded precursor RNA is naturally processed by cellular enzymatic activity into at least 4 separate VGAM precursor RNAs, VGAM1508 precursor RNA, VGAM1509 precursor RNA, VGAM1510 precursor RNA and VGAM1511 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1508 RNA, VGAM1509 RNA, VGAM1510 RNA and VGAM1511 RNA, herein schematically represented by VGAM1 RNA through VGAM3 RNA, each of which VGAM RNAs corresponding to VGAM RNA of FIG. 1.

VGAM1508 RNA, herein schematically represented by VGAM1 RNA through VGAM3 RNA, binds complementarily to a host target binding site located in an untranslated region of VGAM1508 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1508 host target RNA into VGAM1508 host target protein, herein schematically represented by VGAM1 HOST TARGET PROTEIN through VGAM3 HOST TARGET PROTEIN, all of FIG. 1.

VGAM1509 RNA, herein schematically represented by VGAM1 RNA through VGAM3 RNA, binds complementarily to a host target binding site located in an untranslated region of VGAM1509 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1509 host target RNA into VGAM1509 host target protein, herein schematically represented by VGAM1 HOST TARGET PROTEIN through VGAM3 HOST TARGET PROTEIN, all of FIG. 1.

VGAM1510 RNA, herein schematically represented by VGAM1 RNA through VGAM3 RNA, binds complementarily to a host target binding site located in an untranslated region of VGAM1510 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1510 host target RNA into VGAM1510 host target protein, herein schematically represented by VGAM1 HOST TARGET PROTEIN through VGAM3 HOST TARGET PROTEIN, all of FIG. 1.

VGAM1511 RNA, herein schematically represented by VGAM1 RNA through VGAM3 RNA, binds complementarily to a host target binding site located in an untranslated region of VGAM1511 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1511 host target RNA into VGAM1511 host target protein, herein schematically represented by VGAM1 HOST TARGET PROTEIN through VGAM3 HOST TARGET PROTEIN, all of FIG. 1.

It is appreciated that a function of VGR3067 gene, herein designated VGR GENE, is inhibition of expression of host target genes, as part of a novel viral mechanism of attacking a host. Accordingly, utilities of VGR3067 gene include diagnosis, prevention and treatment of viral infection by Potato Virus V. Specific functions, and accordingly utilities, of VGR3067 gene correlate with, and may be deduced from, the identity of the host target genes, which are inhibited by VGAM RNAs comprised in the 'operon-like' cluster of VGR3067 gene: VGAM1508 host target protein, VGAM1509 host target protein, VGAM1510 host target protein and VGAM1511 host target protein, herein schematically represented by VGAM1 HOST TARGET PROTEIN through VGAM3 HOST TARGET PROTEIN. The function of these host target genes is elaborated hereinabove with reference to VGAM1508, VGAM1509, VGAM1510 and VGAM1511. FIG. 9 further provides a conceptual description of novel bioinformatically detected regulatory viral gene, referred to here as Viral Genomic Record 3068(VGR3068) viral gene, which encodes an 'operon-like' cluster of novel viral micro RNA-like genes, each of which in turn modulates expression of at least one host target gene, the function and utility of which at least one host target gene is known in the art.

VGR3068 gene, herein designated VGR GENE, is a novel bioinformatically detected regulatory, non protein coding, RNA viral gene. The method by which VGR3068 gene was detected is described hereinabove with reference to FIGS. 1-9.

VGR3068 gene encodes VGR3068 precursor RNA, herein designated VGR PRECURSOR RNA, an RNA molecule, typically several hundred nucleotides long.

VGR3068 precursor RNA folds spatially, forming VGR3068 folded precursor RNA, herein designated VGR FOLDED PRECURSOR RNA. It is appreciated that VGR3068 folded precursor RNA comprises a plurality of what is known in the art as 'hairpin' structures. These 'hairpin' structures are due to the fact that the nucleotide sequence of VGR3068 precursor RNA comprises a plurality of segments, the first half of each such segment having a nucleotide sequence which is at least a partial inversed-reversed sequence of the second half thereof, as is well known in the art.

VGR3068 folded precursor RNA is naturally processed by cellular enzymatic activity into at least 5 separate VGAM precursor RNAs, VGAM1512 precursor RNA, VGAM1513 precursor RNA, VGAM1514 precursor RNA, VGAM1515 precursor RNA and VGAM1516 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1512 RNA, VGAM1513 RNA, VGAM1514 RNA, VGAM1515 RNA and VGAM1516 RNA, herein schematically represented by VGAM1 RNA through VGAM3 RNA, each of which VGAM RNAs corresponding to VGAM RNA of FIG. 1.

VGAM1512 RNA, herein schematically represented by VGAM1 RNA through VGAM3 RNA, binds complementarily to a host target binding site located in an untranslated region of VGAM1512 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1512 host target RNA into VGAM1512 host target protein, herein schematically represented by VGAM1 HOST TARGET PROTEIN through VGAM3 HOST TARGET PROTEIN, all of FIG. 1.

VGAM1513 RNA, herein schematically represented by VGAM1 RNA through VGAM3 RNA, binds complementarily to a host target binding site located in an untranslated region of VGAM1513 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1513 host target RNA into VGAM1513 host target protein, herein schematically represented by VGAM1 HOST TARGET PROTEIN through VGAM3 HOST TARGET PROTEIN, all of FIG. 1.

VGAM1514 RNA, herein schematically represented by VGAM1 RNA through VGAM3 RNA, binds complementarily to a host target binding site located in an untranslated region of VGAM1514 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1514 host target RNA into VGAM1514 host target protein, herein schematically represented by VGAM1 HOST TARGET PROTEIN through VGAM3 HOST TARGET PROTEIN, all of FIG. 1.

VGAM1515 RNA, herein schematically represented by VGAM1 RNA through VGAM3 RNA, binds complementarily to a host target binding site located in an untranslated region of VGAM1515 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1515 host target RNA into VGAM1515 host target protein, herein schematically represented by VGAM1 HOST TARGET PROTEIN through VGAM3 HOST TARGET PROTEIN, all of FIG. 1.

VGAM1516 RNA, herein schematically represented by VGAM1 RNA through VGAM3 RNA, binds complementarily to a host target binding site located in an untranslated region of VGAM1516 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1516 host target RNA into VGAM1516 host target protein, herein schematically represented by VGAM1 HOST TARGET PROTEIN through VGAM3 HOST TARGET PROTEIN, all of FIG. 1.

It is appreciated that a function of VGR3068 gene, herein designated VGR GENE, is inhibition of expression of host target genes, as part of a novel viral mechanism of attacking a host. Accordingly, utilities of VGR3068 gene include diagnosis, prevention and treatment of viral infection by Parsnip Yellow Fleck Virus. Specific functions, and accordingly utilities, of VGR3068 gene correlate with, and may be deduced from, the identity of the host target genes, which are inhibited by VGAM RNAs comprised in the 'operon-like' cluster of VGR3068 gene: VGAM1512 host target protein, VGAM1513 host target protein, VGAM1514 host target protein, VGAM1515 host target protein and VGAM1516 host target protein, herein schematically represented by VGAM1 HOST TARGET PROTEIN through VGAM3 HOST TARGET PROTEIN. The function of these host target genes is elaborated hereinabove with reference to VGAM1512, VGAM1513, VGAM1514, VGAM1515 and VGAM1516.

FIG. 9 further provides a conceptual description of novel bioinformatically detected regulatory viral gene, referred to here as Viral Genomic Record 3069(VGR3069) viral gene, which encodes an 'operon-like' cluster of novel viral micro RNA-like genes, each of which in turn modulates expression of at least one host target gene, the function and utility of which at least one host target gene is known in the art.

VGR3069 gene, herein designated VGR GENE, is a novel bioinformatically detected regulatory, non protein coding, RNA viral gene. The method by which VGR3069 gene was detected is described hereinabove with reference to FIGS. 1-9.

VGR3069 gene encodes VGR3069 precursor RNA, herein designated VGR PRECURSOR RNA, an RNA molecule, typically several hundred nucleotides long.

VGR3069 precursor RNA folds spatially, forming VGR3069 folded precursor RNA, herein designated VGR FOLDED PRECURSOR RNA. It is appreciated that VGR3069 folded precursor RNA comprises a plurality of what is known in the art as 'hairpin' structures. These 'hairpin' structures are due to the fact that the nucleotide sequence of VGR3069 precursor RNA comprises a plurality of segments, the first half of each such segment having a nucleotide sequence which is at least a partial inversed-reversed sequence of the second half thereof, as is well known in the art.

VGR3069 folded precursor RNA is naturally processed by cellular enzymatic activity into at least 3 separate VGAM precursor RNAs, VGAM1517 precursor RNA, VGAM1518 precursor RNA and VGAM1519 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1517 RNA, VGAM1518 RNA and VGAM1519 RNA, herein schematically represented by VGAM1 RNA through VGAM3 RNA, each of which VGAM RNAs corresponding to VGAM RNA of FIG. 1.

VGAM1517 RNA, herein schematically represented by VGAM1 RNA through VGAM3 RNA, binds complementarily to a host target binding site located in an untranslated region of VGAM1517 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1517 host target RNA into VGAM1517 host target protein, herein schematically represented by VGAM1 HOST TARGET PROTEIN through VGAM3 HOST TARGET PROTEIN, all of FIG. 1.

VGAM1518 RNA, herein schematically represented by VGAM1 RNA through VGAM3 RNA, binds complementarily to a host target binding site located in an untranslated region of VGAM1518 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1518 host target RNA into VGAM1518 host target protein, herein schematically represented by VGAM1 HOST TARGET PROTEIN through VGAM3 HOST TARGET PROTEIN, all of FIG. 1.

VGAM1519 RNA, herein schematically represented by VGAM1 RNA through VGAM3 RNA, binds complementarily to a host target binding site located in an untranslated region of VGAM1519 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1519 host target RNA into VGAM1519 host target protein, herein schematically represented by VGAM1 HOST TARGET PROTEIN through VGAM3 HOST TARGET PROTEIN, all of FIG. 1.

It is appreciated that a function of VGR3069 gene, herein designated VGR GENE, is inhibition of expression of host target genes, as part of a novel viral mechanism of attacking a host. Accordingly, utilities of VGR3069 gene include diagnosis, prevention and treatment of viral infection by Pea Seed-borne Mosaic Virus. Specific functions, and accordingly utilities, of VGR3069 gene correlate with, and may be deduced from, the identity of the host target genes, which are inhibited by VGAM RNAs comprised in the 'operon-like' cluster of VGR3069 gene: VGAM1517 host target protein, VGAM1518 host target protein and VGAM1519 host target protein, herein schematically represented by VGAM1 HOST TARGET PROTEIN through VGAM3 HOST TARGET PROTEIN. The function of these host target genes is elaborated hereinabove with reference to VGAM1517, VGAM1518 and VGAM1519. FIG. 9 further provides a conceptual description of novel bioinformatically detected regulatory viral gene, referred to here as Viral Genomic Record 3070(VGR3070) viral gene, which encodes an 'operon-like' cluster of novel viral micro RNA-like genes, each of which in turn modulates expression of at least one host target gene, the function and utility of which at least one host target gene is known in the art.

VGR3070 gene, herein designated VGR GENE, is a novel bioinformatically detected regulatory, non protein coding, RNA viral gene. The method by which VGR3070 gene was detected is described hereinabove with reference to FIGS. 1-9.

VGR3070 gene encodes VGR3070 precursor RNA, herein designated VGR PRECURSOR RNA, an RNA molecule, typically several hundred nucleotides long.

VGR3070 precursor RNA folds spatially, forming VGR3070 folded precursor RNA, herein designated VGR FOLDED PRECURSOR RNA. It is appreciated that VGR3070 folded precursor RNA comprises a plurality of what is known in the art as 'hairpin' structures. These 'hairpin' structures are due to the fact that the nucleotide sequence of VGR3070 precursor RNA comprises a plurality of segments, the first half of each such segment having a nucleotide sequence which is at least a partial inversed-reversed sequence of the second half thereof, as is well known in the art.

VGR3070 folded precursor RNA is naturally processed by cellular enzymatic activity into at least 8 separate VGAM precursor RNAs, VGAM1520 precursor RNA, VGAM1521 precursor RNA, VGAM1522 precursor RNA, VGAM1523 precursor RNA, VGAM1524 precursor RNA, VGAM1525 precursor RNA, VGAM1526 precursor RNA and VGAM1527 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1520 RNA, VGAM1521 RNA, VGAM1522 RNA, VGAM1523 RNA, VGAM1524 RNA, VGAM1525 RNA, VGAM1526 RNA and VGAM1527 RNA, herein schematically represented by VGAM1 RNA through VGAM3 RNA, each of which VGAM RNAs corresponding to VGAM RNA of FIG. 1.

VGAM1520 RNA, herein schematically represented by VGAM1 RNA through VGAM3 RNA, binds complementarily to a host target binding site located in an untranslated region of VGAM1520 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1520 host target RNA into VGAM1520 host target protein, herein schematically represented by VGAM1 HOST TARGET PROTEIN through VGAM3 HOST TARGET PROTEIN, all of FIG. 1.

VGAM1521 RNA, herein schematically represented by VGAM1 RNA through VGAM3 RNA, binds complementarily to a host target binding site located in an untranslated region of VGAM1521 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1521 host target RNA into VGAM1521 host target protein, herein schematically represented by VGAM1 HOST TARGET PROTEIN through VGAM3 HOST TARGET PROTEIN, all of FIG. 1.

VGAM1522 RNA, herein schematically represented by VGAM1 RNA through VGAM3 RNA, binds complementarily to a host target binding site located in an untranslated region of VGAM1522 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1522 host target RNA into VGAM1522 host target protein, herein schematically represented by VGAM1 HOST TARGET PROTEIN through VGAM3 HOST TARGET PROTEIN, all of FIG. 1.

VGAM1523 RNA, herein schematically represented by VGAM1 RNA through VGAM3 RNA, binds complementarily to a host target binding site located in an untranslated region of VGAM1523 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1523 host target RNA into VGAM1523 host target protein, herein schematically represented by VGAM1 HOST TARGET PROTEIN through VGAM3 HOST TARGET PROTEIN, all of FIG. 1.

VGAM1524 RNA, herein schematically represented by VGAM1 RNA through VGAM3 RNA, binds complementarily to a host target binding site located in an untranslated region of VGAM1524 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1524 host target RNA into VGAM1524 host target protein, herein schematically represented by VGAM1 HOST TARGET PROTEIN through VGAM3 HOST TARGET PROTEIN, all of FIG. 1.

VGAM1525 RNA, herein schematically represented by VGAM1 RNA through VGAM3 RNA, binds complementarily to a host target binding site located in an untranslated region of VGAM1525 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1525 host target RNA into VGAM1525 host target protein, herein schematically represented by VGAM1 HOST TARGET PROTEIN through VGAM3 HOST TARGET PROTEIN, all of FIG. 1.

VGAM1526 RNA, herein schematically represented by VGAM1 RNA through VGAM3 RNA, binds complementarily to a host target binding site located in an untranslated region of VGAM1526 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1526 host target RNA into VGAM1526 host target protein, herein schematically represented by VGAM1 HOST TARGET PROTEIN through VGAM3 HOST TARGET PROTEIN, all of FIG. 1.

VGAM1527 RNA, herein schematically represented by VGAM1 RNA through VGAM3 RNA, binds complementarily to a host target binding site located in an untranslated region of VGAM1527 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1527 host target RNA into VGAM1527 host target protein, herein schematically represented by VGAM1 HOST TARGET PROTEIN through VGAM3 HOST TARGET PROTEIN, all of FIG. 1.

It is appreciated that a function of VGR3070 gene, herein designated VGR GENE, is inhibition of expression of host target genes, as part of a novel viral mechanism of attacking a host. Accordingly, utilities of VGR3070 gene include diagnosis, prevention and treatment of viral infection by Ectromelia Virus. Specific functions, and accordingly utilities, of VGR3070 gene correlate with, and may be deduced from, the identity of the host target genes, which are inhibited by VGAM RNAs comprised in the 'operon-like' cluster of VGR3070 gene: VGAM1520 host target protein, VGAM1521 host target protein, VGAM1522 host target protein, VGAM1523 host target protein, VGAM1524 host target protein, VGAM1525 host target protein, VGAM1526 host target protein and VGAM1527 host target protein, herein schematically represented by VGAM1 HOST TARGET PROTEIN through VGAM3 HOST TARGET PROTEIN. The function of these host target genes is elaborated hereinabove with reference to VGAM1520, VGAM1521, VGAM1522, VGAM1523, VGAM1524, VGAM1525, VGAM1526 and VGAM1527. FIG. 9 further provides a conceptual description of novel bioinformatically detected regulatory viral gene, referred to here as Viral Genomic Record 3071(VGR3071) viral gene, which encodes an 'operon-like' cluster of novel viral micro RNA-like genes, each of which in turn modulates expression of at least one host target gene, the function and utility of which at least one host target gene is known in the art.

VGR3071 gene, herein designated VGR GENE, is a novel bioinformatically detected regulatory, non protein coding, RNA viral gene. The method by which VGR3071 gene was detected is described hereinabove with reference to FIGS. 1-9.

VGR3071 gene encodes VGR3071 precursor RNA, herein designated VGR PRECURSOR RNA, an RNA molecule, typically several hundred nucleotides long.

VGR3071 precursor RNA folds spatially, forming VGR3071 folded precursor RNA, herein designated VGR FOLDED PRECURSOR RNA. It is appreciated that VGR3071 folded precursor RNA comprises a plurality of what is known in the art as 'hairpin' structures. These 'hairpin' structures are due to the fact that the nucleotide sequence of VGR3071 precursor RNA comprises a plurality of segments, the first half of each such segment having a nucleotide sequence which is at least a partial inversed-reversed sequence of the second half thereof, as is well known in the art.

VGR3071 folded precursor RNA is naturally processed by cellular enzymatic activity into at least 4 separate VGAM precursor RNAs, VGAM1528 precursor RNA, VGAM1529 precursor RNA, VGAM1530 precursor RNA and VGAM1531 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1528 RNA, VGAM1529 RNA, VGAM1530 RNA and VGAM1531 RNA, herein schematically represented by VGAM1 RNA through VGAM3 RNA, each of which VGAM RNAs corresponding to VGAM RNA of FIG. 1.

VGAM1528 RNA, herein schematically represented by VGAM1 RNA through VGAM3 RNA, binds complementarily to a host target binding site located in an untranslated region of VGAM1528 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1528 host target RNA into VGAM1528 host target protein, herein schematically represented by VGAM1 HOST TARGET PROTEIN through VGAM3 HOST TARGET PROTEIN, all of FIG. 1.

VGAM1529 RNA, herein schematically represented by VGAM1 RNA through VGAM3 RNA, binds complementarily to a host target binding site located in an untranslated region of VGAM1529 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1529 host target RNA into VGAM1529 host target protein, herein schematically represented by VGAM1 HOST TARGET PROTEIN through VGAM3 HOST TARGET PROTEIN, all of FIG. 1.

VGAM1530 RNA, herein schematically represented by VGAM1 RNA through VGAM3 RNA, binds complementarily to a host target binding site located in an untranslated region of VGAM1530 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1530 host target RNA into VGAM1530 host target protein, herein schematically represented by VGAM1 HOST TARGET PROTEIN through VGAM3 HOST TARGET PROTEIN, all of FIG. 1.

VGAM1531 RNA, herein schematically represented by VGAM1 RNA through VGAM3 RNA, binds complementarily to a host target binding site located in an untranslated region of VGAM1531 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1531 host target RNA into VGAM1531 host target protein, herein schematically represented by VGAM1 HOST TARGET PROTEIN through VGAM3 HOST TARGET PROTEIN, all of FIG. 1.

It is appreciated that a function of VGR3071 gene, herein designated VGR GENE, is inhibition of expression of host target genes, as part of a novel viral mechanism of attacking a host. Accordingly, utilities of VGR3071 gene include diagnosis, prevention and treatment of viral infection by Ectromelia Virus. Specific functions, and accordingly utilities, of VGR3071 gene correlate with, and may be deduced from, the identity of the host target genes, which are inhibited by VGAM RNAs comprised in the 'operon-like' cluster of VGR3071 gene: VGAM1528 host target protein, VGAM1529 host target protein, VGAM1530 host target protein and VGAM1531 host target protein, herein schematically represented by VGAM1 HOST TARGET PROTEIN through VGAM3 HOST TARGET PROTEIN. The function of these host target genes is elaborated hereinabove with reference to VGAM1528, VGAM1529, VGAM1530 and VGAM1531. FIG. 9 further provides a conceptual description of novel bioinformatically detected regulatory viral gene, referred to here as Viral Genomic Record 3072(VGR3072) viral gene, which encodes an 'operon-like' cluster of novel viral micro RNA-like genes, each of which in turn modulates expression of at least one host target gene, the function and utility of which at least one host target gene is known in the art.

VGR3072 gene, herein designated VGR GENE, is a novel bioinformatically detected regulatory, non protein coding, RNA viral gene. The method by which VGR3072 gene was detected is described hereinabove with reference to FIGS. 1-9.

VGR3072 gene encodes VGR3072 precursor RNA, herein designated VGR PRECURSOR RNA, an RNA molecule, typically several hundred nucleotides long.

VGR3072 precursor RNA folds spatially, forming VGR3072 folded precursor RNA, herein designated VGR FOLDED PRECURSOR RNA. It is appreciated that VGR3072 folded precursor RNA comprises a plurality of what is known in the art as 'hairpin' structures. These 'hairpin' structures are due to the fact that the nucleotide sequence of VGR3072 precursor RNA comprises a plurality of segments, the first half of each such segment having a nucleotide sequence which is at least a partial inversed-reversed sequence of the second half thereof, as is well known in the art.

VGR3072 folded precursor RNA is naturally processed by cellular enzymatic activity into at least 6 separate VGAM precursor RNAs, VGAM1532 precursor RNA, VGAM1533 precursor RNA, VGAM1534 precursor RNA, VGAM1535 precursor RNA, VGAM1536 precursor RNA and VGAM1537 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1532 RNA, VGAM1533 RNA, VGAM1534 RNA, VGAM1535 RNA, VGAM1536 RNA and VGAM1537 RNA, herein schematically represented by VGAM1 RNA through VGAM3 RNA, each of which VGAM RNAs corresponding to VGAM RNA of FIG. 1.

VGAM1532 RNA, herein schematically represented by VGAM1 RNA through VGAM3 RNA, binds complementarily to a host target binding site located in an untranslated region of VGAM1532 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1532 host target RNA into VGAM1532 host target protein, herein schematically represented by VGAM1 HOST TARGET PROTEIN through VGAM3 HOST TARGET PROTEIN, all of FIG. 1.

VGAM1533 RNA, herein schematically represented by VGAM1 RNA through VGAM3 RNA, binds complementarily to a host target binding site located in an untranslated region of VGAM1533 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1533 host target RNA into VGAM1533 host target protein, herein schematically represented by VGAM1 HOST TARGET PROTEIN through VGAM3 HOST TARGET PROTEIN, all of FIG. 1.

VGAM1534 RNA, herein schematically represented by VGAM1 RNA through VGAM3 RNA, binds complementarily to a host target binding site located in an untranslated region of VGAM1534 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1534 host target RNA into VGAM1534 host target protein, herein schematically represented by VGAM1 HOST TARGET PROTEIN through VGAM3 HOST TARGET PROTEIN, all of FIG. 1.

VGAM1535 RNA, herein schematically represented by VGAM1 RNA through VGAM3 RNA, binds complementarily to a host target binding site located in an untranslated region of VGAM1535 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1535 host target RNA into VGAM1535 host target protein, herein schematically represented by VGAM1 HOST TARGET PROTEIN through VGAM3 HOST TARGET PROTEIN, all of FIG. 1.

VGAM1536 RNA, herein schematically represented by VGAM1 RNA through VGAM3 RNA, binds complementarily to a host target binding site located in an untranslated region of VGAM1536 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1536 host target RNA into VGAM1536 host target protein, herein schematically represented by VGAM1 HOST TARGET PROTEIN through VGAM3 HOST TARGET PROTEIN, all of FIG. 1.

VGAM1537 RNA, herein schematically represented by VGAM1 RNA through VGAM3 RNA, binds complementarily to a host target binding site located in an untranslated region of VGAM1537 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1537 host target RNA into VGAM1537 host target protein, herein schematically represented by VGAM1 HOST TARGET PROTEIN through VGAM3 HOST TARGET PROTEIN, all of FIG. 1.

It is appreciated that a function of VGR3072 gene, herein designated VGR GENE, is inhibition of expression of host target genes, as part of a novel viral mechanism of attacking a host. Accordingly, utilities of VGR3072 gene include diagnosis, prevention and treatment of viral infection by Cowpox Virus. Specific functions, and accordingly utilities, of VGR3072 gene correlate with, and may be deduced from, the identity of the host target genes, which are inhibited by VGAM RNAs comprised in the 'operon-like' cluster of VGR3072 gene: VGAM1532 host target protein, VGAM1533 host target protein, VGAM1534 host target protein, VGAM1535 host target protein, VGAM1536 host target protein and VGAM1537 host target protein, herein schematically represented by VGAM1 HOST TARGET PROTEIN through VGAM3 HOST TARGET PROTEIN. The function of these host target genes is elaborated hereinabove with reference to VGAM1532, VGAM1533, VGAM1534, VGAM1535, VGAM1536 and VGAM1537. FIG. 9 further provides a conceptual description of novel bioinformatically detected regulatory viral gene, referred to here as Viral Genomic Record 3073(VGR3073) viral gene, which encodes an 'operon-like' cluster of novel viral micro RNA-like genes, each of which in turn modulates expression of at least one host target gene, the function and utility of which at least one host target gene is known in the art.

VGR3073 gene, herein designated VGR GENE, is a novel bioinformatically detected regulatory, non protein coding, RNA viral gene. The method by which VGR3073 gene was detected is described hereinabove with reference to FIGS. 1-9.

VGR3073 gene encodes VGR3073 precursor RNA, herein designated VGR PRECURSOR RNA, an RNA molecule, typically several hundred nucleotides long.

VGR3073 precursor RNA folds spatially, forming VGR3073 folded precursor RNA, herein designated VGR FOLDED PRECURSOR RNA. It is appreciated that VGR3073 folded precursor RNA comprises a plurality of what is known in the art as 'hairpin' structures. These 'hairpin' structures are due to the fact that the nucleotide sequence of VGR3073 precursor RNA comprises a plurality of segments, the first half of each such segment having a nucleotide sequence which is at least a partial inversed-reversed sequence of the second half thereof, as is well known in the art.

VGR3073 folded precursor RNA is naturally processed by cellular enzymatic activity into at least 4 separate VGAM precursor RNAs, VGAM1538 precursor RNA, VGAM1539 precursor RNA, VGAM1540 precursor RNA and VGAM1541 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1538 RNA, VGAM1539 RNA, VGAM1540 RNA and VGAM1541 RNA, herein schematically represented by VGAM1 RNA through VGAM3 RNA, each of which VGAM RNAs corresponding to VGAM RNA of FIG. 1.

VGAM1538 RNA, herein schematically represented by VGAM1 RNA through VGAM3 RNA, binds complementarily to a host target binding site located in an untranslated region of VGAM1538 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1538 host target RNA into VGAM1538 host target protein, herein schematically represented by VGAM1 HOST TARGET PROTEIN through VGAM3 HOST TARGET PROTEIN, all of FIG. 1.

VGAM1539 RNA, herein schematically represented by VGAM1 RNA through VGAM3 RNA, binds complementarily to a host target binding site located in an untranslated region of VGAM1539 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1539 host target RNA into VGAM1539 host target protein, herein schematically represented by VGAM1 HOST TARGET PROTEIN through VGAM3 HOST TARGET PROTEIN, all of FIG. 1.

VGAM1540 RNA, herein schematically represented by VGAM1 RNA through VGAM3 RNA, binds complementarily to a host target binding site located in an untranslated region of VGAM1540 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1540 host target RNA into VGAM1540 host target protein, herein schematically represented by VGAM1 HOST TARGET PROTEIN through VGAM3 HOST TARGET PROTEIN, all of FIG. 1.

VGAM1541 RNA, herein schematically represented by VGAM1 RNA through VGAM3 RNA, binds complementarily to a host target binding site located in an untranslated region of VGAM1541 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1541 host target RNA into VGAM1541 host target protein, herein schematically represented by VGAM1 HOST TARGET PROTEIN through VGAM3 HOST TARGET PROTEIN, all of FIG. 1.

It is appreciated that a function of VGR3073 gene, herein designated VGR GENE, is inhibition of expression of host target genes, as part of a novel viral mechanism of attacking a host. Accordingly, utilities of VGR3073 gene include diagnosis, prevention and treatment of viral infection by Monkeypox Virus. Specific functions, and accordingly utilities, of VGR3073 gene correlate with, and may be deduced from, the identity of the host target genes, which are inhibited by VGAM RNAs comprised in the 'operon-like' cluster of VGR3073 gene: VGAM1538 host target protein, VGAM1539 host target protein, VGAM1540 host target protein and VGAM1541 host target protein, herein schematically represented by VGAM1 HOST TARGET PROTEIN through VGAM3 HOST TARGET PROTEIN. The function of these host target genes is elaborated hereinabove with reference to VGAM1538, VGAM1539, VGAM1540 and VGAM1541. FIG. 9 further provides a conceptual description of novel bioinformatically detected regulatory viral gene, referred to here as Viral Genomic Record 3074(VGR3074) viral gene, which encodes an 'operon-like' cluster of novel viral micro RNA-like genes, each of which in turn modulates expression of at least one host target gene, the function and utility of which at least one host target gene is known in the art.

VGR3074 gene, herein designated VGR GENE, is a novel bioinformatically detected regulatory, non protein coding, RNA viral gene. The method by which VGR3074 gene was detected is described hereinabove with reference to FIGS. 1-9.

VGR3074 gene encodes VGR3074 precursor RNA, herein designated VGR PRECURSOR RNA, an RNA molecule, typically several hundred nucleotides long.

VGR3074 precursor RNA folds spatially, forming VGR3074 folded precursor RNA, herein designated VGR FOLDED PRECURSOR RNA. It is appreciated that VGR3074 folded precursor RNA comprises a plurality of what is known in the art as 'hairpin' structures. These 'hairpin' structures are due to the fact that the nucleotide sequence of VGR3074 precursor RNA comprises a plurality of segments, the first half of each such segment having a nucleotide sequence which is at least a partial inversed-reversed sequence of the second half thereof, as is well known in the art.

VGR3074 folded precursor RNA is naturally processed by cellular enzymatic activity into at least 6 separate VGAM precursor RNAs, VGAM1542 precursor RNA, VGAM1543 precursor RNA, VGAM1544 precursor RNA, VGAM1545 precursor RNA, VGAM1546 precursor RNA and VGAM1547 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1542 RNA, VGAM1543 RNA, VGAM1544 RNA, VGAM1545 RNA, VGAM1546 RNA and VGAM1547 RNA, herein schematically represented by VGAM1 RNA through VGAM3 RNA, each of which VGAM RNAs corresponding to VGAM RNA of FIG. 1.

VGAM1542 RNA, herein schematically represented by VGAM1 RNA through VGAM3 RNA, binds complementarily to a host target binding site located in an untranslated region of VGAM1542 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1542 host target RNA into VGAM1542 host target protein, herein schematically represented by VGAM1 HOST TARGET PROTEIN through VGAM3 HOST TARGET PROTEIN, all of FIG. 1.

VGAM1543 RNA, herein schematically represented by VGAM1 RNA through VGAM3 RNA, binds complementarily to a host target binding site located in an untranslated region of VGAM1543 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1543 host target RNA into VGAM1543 host target protein, herein schematically represented by VGAM1 HOST TARGET PROTEIN through VGAM3 HOST TARGET PROTEIN, all of FIG. 1.

VGAM1544 RNA, herein schematically represented by VGAM1 RNA through VGAM3 RNA, binds complementarily to a host target binding site located in an untranslated region of VGAM1544 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1544 host target RNA into VGAM1544 host target protein, herein schematically represented by VGAM1 HOST TARGET PROTEIN through VGAM3 HOST TARGET PROTEIN, all of FIG. 1.

VGAM1545 RNA, herein schematically represented by VGAM1 RNA through VGAM3 RNA, binds complementarily to a host target binding site located in an untranslated region of VGAM1545 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1545 host target RNA into VGAM1545 host target protein, herein schematically represented by VGAM1 HOST TARGET PROTEIN through VGAM3 HOST TARGET PROTEIN, all of FIG. 1.

VGAM1546 RNA, herein schematically represented by VGAM1 RNA through VGAM3 RNA, binds complementarily to a host target binding site located in an untranslated region of VGAM1546 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1546 host target RNA into VGAM1546 host target protein, herein schematically represented by VGAM1 HOST TARGET PROTEIN through VGAM3 HOST TARGET PROTEIN, all of FIG. 1.

VGAM1547 RNA, herein schematically represented by VGAM1 RNA through VGAM3 RNA, binds complementarily to a host target binding site located in an untranslated region of VGAM1547 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1547 host target RNA into VGAM1547 host target protein, herein schematically represented by VGAM1 HOST TARGET PROTEIN through VGAM3 HOST TARGET PROTEIN, all of FIG. 1.

It is appreciated that a function of VGR3074 gene, herein designated VGR GENE, is inhibition of expression of host target genes, as part of a novel viral mechanism of attacking a host. Accordingly, utilities of VGR3074 gene include diagnosis, prevention and treatment of viral infection by Variola Virus. Specific functions, and accordingly utilities, of VGR3074 gene correlate with, and may be deduced from, the identity of the host target genes, which are inhibited by VGAM RNAs comprised in the 'operon-like' cluster of VGR3074 gene: VGAM1542 host target protein, VGAM1543 host target protein, VGAM1544 host target protein, VGAM1545 host target protein, VGAM1546 host target protein and VGAM1547 host target protein, herein schematically represented by VGAM1 HOST TARGET PROTEIN through VGAM3 HOST TARGET PROTEIN. The function of these host target genes is elaborated hereinabove with reference to VGAM1542, VGAM1543, VGAM1544, VGAM1545, VGAM1546 and VGAM1547. FIG. 9 further provides a conceptual description of novel bioinformatically detected regulatory viral gene, referred to here as Viral Genomic Record 3075(VGR3075) viral gene, which encodes an 'operon-like' cluster of novel viral micro RNA-like genes, each of which in turn modulates expression of at least one host target gene, the function and utility of which at least one host target gene is known in the art.

VGR3075 gene, herein designated VGR GENE, is a novel bioinformatically detected regulatory, non protein coding, RNA viral gene. The method by which VGR3075 gene was detected is described hereinabove with reference to FIGS. 1-9.

VGR3075 gene encodes VGR3075 precursor RNA, herein designated VGR PRECURSOR RNA, an RNA molecule, typically several hundred nucleotides long.

VGR3075 precursor RNA folds spatially, forming VGR3075 folded precursor RNA, herein designated VGR FOLDED PRECURSOR RNA. It is appreciated that VGR3075 folded precursor RNA comprises a plurality of what is known in the art as 'hairpin' structures. These 'hairpin' structures are due to the fact that the nucleotide sequence of VGR3075 precursor RNA comprises a plurality of segments, the first half of each such segment having a nucleotide sequence which is at least a partial inversed-reversed sequence of the second half thereof, as is well known in the art.

VGR3075 folded precursor RNA is naturally processed by cellular enzymatic activity into at least 8 separate VGAM precursor RNAs, VGAM1548 precursor RNA, VGAM1549 precursor RNA, VGAM1550 precursor RNA, VGAM1551 precursor RNA, VGAM1552 precursor RNA, VGAM1553 precursor RNA, VGAM1554 precursor RNA and VGAM1555 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1548 RNA, VGAM1549 RNA, VGAM1550 RNA, VGAM1551 RNA, VGAM1552 RNA, VGAM1553 RNA, VGAM1554 RNA and VGAM1555 RNA, herein schematically represented by VGAM1 RNA through VGAM3 RNA, each of which VGAM RNAs corresponding to VGAM RNA of FIG. 1.

VGAM1548 RNA, herein schematically represented by VGAM1 RNA through VGAM3 RNA, binds complementarily to a host target binding site located in an untranslated region of VGAM1548 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1548 host target RNA into VGAM1548 host target protein, herein schematically represented by VGAM1 HOST TARGET PROTEIN through VGAM3 HOST TARGET PROTEIN, all of FIG. 1.

VGAM1549 RNA, herein schematically represented by VGAM1 RNA through VGAM3 RNA, binds complementarily to a host target binding site located in an untranslated region of VGAM1549 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1549 host target RNA into VGAM1549 host target protein, herein schematically represented by VGAM1 HOST TARGET PROTEIN through VGAM3 HOST TARGET PROTEIN, all of FIG. 1.

VGAM1550 RNA, herein schematically represented by VGAM1 RNA through VGAM3 RNA, binds complementarily to a host target binding site located in an untranslated region of VGAM1550 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1550 host target RNA into VGAM1550 host target protein, herein schematically represented by VGAM1 HOST TARGET PROTEIN through VGAM3 HOST TARGET PROTEIN, all of FIG. 1.

VGAM1551 RNA, herein schematically represented by VGAM1 RNA through VGAM3 RNA, binds complementarily to a host target binding site located in an untranslated region of VGAM1551 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1551 host target RNA into VGAM1551 host target protein, herein schematically represented by VGAM1 HOST TARGET PROTEIN through VGAM3 HOST TARGET PROTEIN, all of FIG. 1.

VGAM1552 RNA, herein schematically represented by VGAM1 RNA through VGAM3 RNA, binds complementarily to a host target binding site located in an untranslated region of VGAM1552 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1552 host target RNA into VGAM1552 host target protein, herein schematically represented by VGAM1 HOST TARGET PROTEIN through VGAM3 HOST TARGET PROTEIN, all of FIG. 1.

VGAM1553 RNA, herein schematically represented by VGAM1 RNA through VGAM3 RNA, binds complementarily to a host target binding site located in an untranslated region of VGAM1553 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1553 host target RNA into VGAM1553 host target protein, herein schematically represented by VGAM1 HOST TARGET PROTEIN through VGAM3 HOST TARGET PROTEIN, all of FIG. 1.

VGAM1554 RNA, herein schematically represented by VGAM1 RNA through VGAM3 RNA, binds complementarily to a host target binding site located in an untranslated region of VGAM1554 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1554 host target RNA into VGAM1554 host target protein, herein schematically represented by VGAM1 HOST TARGET PROTEIN through VGAM3 HOST TARGET PROTEIN, all of FIG. 1.

VGAM1555 RNA, herein schematically represented by VGAM1 RNA through VGAM3 RNA, binds complementarily to a host target binding site located in an untranslated region of VGAM1555 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1555 host target RNA into VGAM1555 host target protein, herein schematically represented by VGAM1 HOST TARGET PROTEIN through VGAM3 HOST TARGET PROTEIN, all of FIG. 1.

It is appreciated that a function of VGR3075 gene, herein designated VGR GENE, is inhibition of expression of host target genes, as part of a novel viral mechanism of attacking a host. Accordingly, utilities of VGR3075 gene include diagnosis, prevention and treatment of viral infection by Macaca Mulatta Rhadinovirus. Specific functions, and accordingly utilities, of VGR3075 gene correlate with, and may be deduced from, the identity of the host target genes, which are inhibited by VGAM RNAs comprised in the 'operon-like' cluster of VGR3075 gene: VGAM1548 host target protein, VGAM1549 host target protein, VGAM1550 host target protein, VGAM1551 host target protein, VGAM1552 host target protein, VGAM1553 host target protein, VGAM1554 host target protein and VGAM1555 host target protein, herein schematically represented by VGAM1 HOST TARGET PROTEIN through VGAM3 HOST TARGET PROTEIN. The function of these host target genes is elaborated hereinabove with reference to VGAM1548, VGAM1549, VGAM1550, VGAM1551, VGAM1552, VGAM1553, VGAM1554 and VGAM1555. FIG. 9 further provides a conceptual description of novel bioinformatically detected regulatory viral gene, referred to here as Viral Genomic Record 3076(VGR3076) viral gene, which encodes an 'operon-like' cluster of novel viral micro RNA-like genes, each of which in turn modulates expression of at least one host target gene, the function and utility of which at least one host target gene is known in the art.

VGR3076 gene, herein designated VGR GENE, is a novel bioinformatically detected regulatory, non protein coding, RNA viral gene. The method by which VGR3076 gene was detected is described hereinabove with reference to FIGS. 1-9.

VGR3076 gene encodes VGR3076 precursor RNA, herein designated VGR PRECURSOR RNA, an RNA molecule, typically several hundred nucleotides long.

VGR3076 precursor RNA folds spatially, forming VGR3076 folded precursor RNA, herein designated VGR FOLDED PRECURSOR RNA. It is appreciated that VGR3076 folded precursor RNA comprises a plurality of what is known in the art as 'hairpin' structures. These 'hairpin' structures are due to the fact that the nucleotide sequence of VGR3076 precursor RNA comprises a plurality of segments, the first half of each such segment having a nucleotide sequence which is at least a partial inversed-reversed sequence of the second half thereof, as is well known in the art.

VGR3076 folded precursor RNA is naturally processed by cellular enzymatic activity into at least 2 separate VGAM precursor RNAs, VGAM1556 precursor RNA and VGAM1557 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1556 RNA and VGAM1557 RNA, herein schematically represented by VGAM1 RNA through VGAM3 RNA, each of which VGAM RNAs corresponding to VGAM RNA of FIG. 1.

VGAM1556 RNA, herein schematically represented by VGAM1 RNA through VGAM3 RNA, binds complementarily to a host target binding site located in an untranslated region of VGAM1556 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1556 host target RNA into VGAM1556 host target protein, herein schematically represented by VGAM1 HOST TARGET PROTEIN through VGAM3 HOST TARGET PROTEIN, all of FIG. 1.

VGAM1557 RNA, herein schematically represented by VGAM1 RNA through VGAM3 RNA, binds complementarily to a host target binding site located in an untranslated region of VGAM1557 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1557 host target RNA into VGAM1557 host target protein, herein schematically represented by VGAM1 HOST TARGET PROTEIN through VGAM3 HOST TARGET PROTEIN, all of FIG. 1.

It is appreciated that a function of VGR3076 gene, herein designated VGR GENE, is inhibition of expression of host target genes, as part of a novel viral mechanism of attacking a host. Accordingly, utilities of VGR3076 gene include diagnosis, prevention and treatment of viral infection by Macaca Mulatta Rhadinovirus. Specific functions, and accordingly utilities, of VGR3076 gene correlate with, and may be deduced from, the identity of the host target genes, which are inhibited by VGAM RNAs comprised in the 'operon-like' cluster of VGR3076 gene: VGAM1556 host target protein and VGAM1557 host target protein, herein schematically represented by VGAM1 HOST TARGET PROTEIN through VGAM3 HOST TARGET PROTEIN. The function of these host target genes is elaborated hereinabove with reference to VGAM1556 and VGAM1557. FIG. 9 further provides a conceptual description of novel bioinformatically detected regulatory viral gene, referred to here as Viral Genomic Record 3077(VGR3077) viral gene, which encodes an 'operon-like' cluster of novel viral micro RNA-like genes, each of which in turn modulates expression of at least one host target gene, the function and utility of which at least one host target gene is known in the art.

VGR3077 gene, herein designated VGR GENE, is a novel bioinformatically detected regulatory, non protein coding, RNA viral gene. The method by which VGR3077 gene was detected is described hereinabove with reference to FIGS. 1-9.

VGR3077 gene encodes VGR3077 precursor RNA, herein designated VGR PRECURSOR RNA, an RNA molecule, typically several hundred nucleotides long.

VGR3077 precursor RNA folds spatially, forming VGR3077 folded precursor RNA, herein designated VGR FOLDED PRECURSOR RNA. It is appreciated that VGR3077 folded precursor RNA comprises a plurality of what is known in the art as 'hairpin' structures. These 'hairpin' structures are due to the fact that the nucleotide sequence of VGR3077 precursor RNA comprises a plurality of segments, the first half of each such segment having a nucleotide sequence which is at least a partial inversed-reversed sequence of the second half thereof, as is well known in the art.

VGR3077 folded precursor RNA is naturally processed by cellular enzymatic activity into at least 6 separate VGAM precursor RNAs, VGAM1558 precursor RNA, VGAM1559 precursor RNA, VGAM1560 precursor RNA, VGAM1561 precursor RNA, VGAM1562 precursor RNA and VGAM1563 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1558 RNA, VGAM1559 RNA, VGAM1560 RNA, VGAM1561 RNA, VGAM1562 RNA and VGAM1563 RNA, herein schematically represented by VGAM1 RNA through VGAM3 RNA, each of which VGAM RNAs corresponding to VGAM RNA of FIG. 1.

VGAM1558 RNA, herein schematically represented by VGAM1 RNA through VGAM3 RNA, binds complementarily to a host target binding site located in an untranslated region of VGAM1558 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1558 host target RNA into VGAM1558 host target protein, herein schematically represented by VGAM1 HOST TARGET PROTEIN through VGAM3 HOST TARGET PROTEIN, all of FIG. 1.

VGAM1559 RNA, herein schematically represented by VGAM1 RNA through VGAM3 RNA, binds complementarily to a host target binding site located in an untranslated region of VGAM1559 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1559 host target RNA into VGAM1559 host target protein, herein schematically represented by VGAM1 HOST TARGET PROTEIN through VGAM3 HOST TARGET PROTEIN, all of FIG. 1.

VGAM1560 RNA, herein schematically represented by VGAM1 RNA through VGAM3 RNA, binds complementarily to a host target binding site located in an untranslated region of VGAM1560 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1560 host target RNA into VGAM1560 host target protein, herein schematically represented by VGAM1 HOST TARGET PROTEIN through VGAM3 HOST TARGET PROTEIN, all of FIG. 1.

VGAM1561 RNA, herein schematically represented by VGAM1 RNA through VGAM3 RNA, binds complementarily to a host target binding site located in an untranslated region of VGAM1561 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1561 host target RNA into VGAM1561 host target protein, herein schematically represented by VGAM1 HOST TARGET PROTEIN through VGAM3 HOST TARGET PROTEIN, all of FIG. 1.

VGAM1562 RNA, herein schematically represented by VGAM1 RNA through VGAM3 RNA, binds complementarily to a host target binding site located in an untranslated region of VGAM1562 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1562 host target RNA into VGAM1562 host target protein, herein schematically represented by VGAM1 HOST TARGET PROTEIN through VGAM3 HOST TARGET PROTEIN, all of FIG. 1.

VGAM1563 RNA, herein schematically represented by VGAM1 RNA through VGAM3 RNA, binds complementarily to a host target binding site located in an untranslated region of VGAM1563 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1563 host target RNA into VGAM1563 host target protein, herein schematically represented by VGAM1 HOST TARGET PROTEIN through VGAM3 HOST TARGET PROTEIN, all of FIG. 1.

It is appreciated that a function of VGR3077 gene, herein designated VGR GENE, is inhibition of expression of host target genes, as part of a novel viral mechanism of attacking a host. Accordingly, utilities of VGR3077 gene include diagnosis, prevention and treatment of viral infection by Bean Common Mosaic Virus. Specific functions, and accordingly utilities, of VGR3077 gene correlate with, and may be deduced from, the identity of the host target genes, which are inhibited by VGAM RNAs comprised in the 'operon-like' cluster of VGR3077 gene: VGAM1558 host target protein, VGAM1559 host target protein, VGAM1560 host target protein, VGAM1561 host target protein, VGAM1562 host target protein and VGAM1563 host target protein, herein schematically represented by VGAM1 HOST TARGET PROTEIN through VGAM3 HOST TARGET PROTEIN. The function of these host target genes is elaborated hereinabove with reference to VGAM1558, VGAM1559, VGAM1560, VGAM1561, VGAM1562 and VGAM1563. FIG. 9 further provides a conceptual description of novel bioinformatically detected regulatory viral gene, referred to here as Viral Genomic Record 3078(VGR3078) viral gene, which encodes an 'operon-like' cluster of novel viral micro RNA-like genes, each of which in turn modulates expression of at least one host target gene, the function and utility of which at least one host target gene is known in the art.

VGR3078 gene, herein designated VGR GENE, is a novel bioinformatically detected regulatory, non protein coding, RNA viral gene. The method by which VGR3078 gene was detected is described hereinabove with reference to FIGS. 1-9.

VGR3078 gene encodes VGR3078 precursor RNA, herein designated VGR PRECURSOR RNA, an RNA molecule, typically several hundred nucleotides long.

VGR3078 precursor RNA folds spatially, forming VGR3078 folded precursor RNA, herein designated VGR FOLDED PRECURSOR RNA. It is appreciated that VGR3078 folded precursor RNA comprises a plurality of what is known in the art as 'hairpin' structures. These 'hairpin' structures are due to the fact that the nucleotide sequence of VGR3078 precursor RNA comprises a plurality of segments, the first half of each such segment having a nucleotide sequence which is at least a partial inversed-reversed sequence of the second half thereof, as is well known in the art.

VGR3078 folded precursor RNA is naturally processed by cellular enzymatic activity into at least 3 separate VGAM precursor RNAs, VGAM1564 precursor RNA, VGAM1565 precursor RNA and VGAM1566 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1564 RNA, VGAM1565 RNA and VGAM1566 RNA, herein schematically represented by VGAM1 RNA through VGAM3 RNA, each of which VGAM RNAs corresponding to VGAM RNA of FIG. 1.

VGAM1564 RNA, herein schematically represented by VGAM1 RNA through VGAM3 RNA, binds complementarily to a host target binding site located in an untranslated region of VGAM1564 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1564 host target RNA into VGAM1564 host target protein, herein schematically represented by VGAM1 HOST TARGET PROTEIN through VGAM3 HOST TARGET PROTEIN, all of FIG. 1.

VGAM1565 RNA, herein schematically represented by VGAM1 RNA through VGAM3 RNA, binds complementarily to a host target binding site located in an untranslated region of VGAM1565 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1565 host target RNA into VGAM1565 host target protein, herein schematically represented by VGAM1 HOST TARGET PROTEIN through VGAM3 HOST TARGET PROTEIN, all of FIG. 1.

VGAM1566 RNA, herein schematically represented by VGAM1 RNA through VGAM3 RNA, binds complementarily to a host target binding site located in an untranslated region of VGAM1566 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1566 host target RNA into VGAM1566 host target protein, herein schematically represented by VGAM1 HOST TARGET PROTEIN through VGAM3 HOST TARGET PROTEIN, all of FIG. 1.

It is appreciated that a function of VGR3078 gene, herein designated VGR GENE, is inhibition of expression of host target genes, as part of a novel viral mechanism of attacking a host. Accordingly, utilities of VGR3078 gene include diagnosis, prevention and treatment of viral infection by Human Herpesvirus 5. Specific functions, and accordingly utilities, of VGR3078 gene correlate with, and may be deduced from, the identity of the host target genes, which are inhibited by VGAM RNAs comprised in the 'operon-like' cluster of VGR3078 gene: VGAM1564 host target protein, VGAM1565 host target protein and VGAM1566 host target protein, herein schematically represented by VGAM1 HOST TARGET PROTEIN through VGAM3 HOST TARGET PROTEIN. The function of these host target genes is elaborated hereinabove with reference to VGAM1564, VGAM1565 and VGAM1566. FIG. 9 further provides a conceptual description of novel bioinformatically detected regulatory viral gene, referred to here as Viral Genomic Record 3079(VGR3079) viral gene, which encodes an 'operon-like' cluster of novel viral micro RNA-like genes, each of which in turn modulates expression of at least one host target gene, the function and utility of which at least one host target gene is known in the art.

VGR3079 gene, herein designated VGR GENE, is a novel bioinformatically detected regulatory, non protein coding, RNA viral gene. The method by which VGR3079 gene was detected is described hereinabove with reference to FIGS. 1-9.

VGR3079 gene encodes VGR3079 precursor RNA, herein designated VGR PRECURSOR RNA, an RNA molecule, typically several hundred nucleotides long.

VGR3079 precursor RNA folds spatially, forming VGR3079 folded precursor RNA, herein designated VGR FOLDED PRECURSOR RNA. It is appreciated that VGR3079 folded precursor RNA comprises a plurality of what is known in the art as 'hairpin' structures. These 'hairpin' structures are due to the fact that the nucleotide sequence of VGR3079 precursor RNA comprises a plurality of segments, the first half of each such segment having a nucleotide sequence which is at least a partial inversed-reversed sequence of the second half thereof, as is well known in the art.

VGR3079 folded precursor RNA is naturally processed by cellular enzymatic activity into at least 4 separate VGAM precursor RNAs, VGAM1567 precursor RNA, VGAM1568 precursor RNA, VGAM1569 precursor RNA and VGAM1570 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1567 RNA, VGAM1568 RNA, VGAM1569 RNA and VGAM1570 RNA, herein schematically represented by VGAM1 RNA through VGAM3 RNA, each of which VGAM RNAs corresponding to VGAM RNA of FIG. 1.

VGAM1567 RNA, herein schematically represented by VGAM1 RNA through VGAM3 RNA, binds complementarily to a host target binding site located in an untranslated region of VGAM1567 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1567 host target RNA into VGAM1567 host target protein, herein schematically represented by VGAM1 HOST TARGET PROTEIN through VGAM3 HOST TARGET PROTEIN, all of FIG. 1.

VGAM1568 RNA, herein schematically represented by VGAM1 RNA through VGAM3 RNA, binds complementarily to a host target binding site located in an untranslated region of VGAM1568 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1568 host target RNA into VGAM1568 host target protein, herein schematically represented by VGAM1 HOST TARGET PROTEIN through VGAM3 HOST TARGET PROTEIN, all of FIG. 1.

VGAM1569 RNA, herein schematically represented by VGAM1 RNA through VGAM3 RNA, binds complementarily to a host target binding site located in an untranslated region of VGAM1569 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1569 host target RNA into VGAM1569 host target protein, herein schematically represented by VGAM1 HOST TARGET PROTEIN through VGAM3 HOST TARGET PROTEIN, all of FIG. 1.

VGAM1570 RNA, herein schematically represented by VGAM1 RNA through VGAM3 RNA, binds complementarily to a host target binding site located in an untranslated region of VGAM1570 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1570 host target RNA into VGAM1570 host target protein, herein schematically represented by VGAM1 HOST TARGET PROTEIN through VGAM3 HOST TARGET PROTEIN, all of FIG. 1.

It is appreciated that a function of VGR3079 gene, herein designated VGR GENE, is inhibition of expression of host target genes, as part of a novel viral mechanism of attacking a host. Accordingly, utilities of VGR3079 gene include diagnosis, prevention and treatment of viral infection by Human Herpesvirus 5. Specific functions, and accordingly utilities, of VGR3079 gene correlate with, and may be deduced from, the identity of the host target genes, which are inhibited by VGAM RNAs comprised in the 'operon-like' cluster of VGR3079 gene: VGAM1567 host target protein, VGAM1568 host target protein, VGAM1569 host target protein and VGAM1570 host target protein, herein schematically represented by VGAM1 HOST TARGET PROTEIN through VGAM3 HOST TARGET PROTEIN. The function of these host target genes is elaborated hereinabove with reference to VGAM1567, VGAM1568, VGAM1569 and VGAM1570.

FIG. 9 further provides a conceptual description of novel bioinformatically detected regulatory viral gene, referred to here as Viral Genomic Record 3080(VGR3080) viral gene, which encodes an 'operon-like' cluster of novel viral micro RNA-like genes, each of which in turn modulates expression of at least one host target gene, the function and utility of which at least one host target gene is known in the art.

VGR3080 gene, herein designated VGR GENE, is a novel bioinformatically detected regulatory, non protein coding, RNA viral gene. The method by which VGR3080 gene was detected is described hereinabove with reference to FIGS. 1-9.

VGR3080 gene encodes VGR3080 precursor RNA, herein designated VGR PRECURSOR RNA, an RNA molecule, typically several hundred nucleotides long.

VGR3080 precursor RNA folds spatially, forming VGR3080 folded precursor RNA, herein designated VGR FOLDED PRECURSOR RNA. It is appreciated that VGR3080 folded precursor RNA comprises a plurality of what is known in the art as 'hairpin' structures. These 'hairpin' structures are due to the fact that the nucleotide sequence of VGR3080 precursor RNA comprises a plurality of segments, the first half of each such segment having a nucleotide sequence which is at least a partial inversed-reversed sequence of the second half thereof, as is well known in the art.

VGR3080 folded precursor RNA is naturally processed by cellular enzymatic activity into at least 8 separate VGAM precursor RNAs, VGAM1571 precursor RNA, VGAM1572 precursor RNA, VGAM1573 precursor RNA, VGAM1574 precursor RNA, VGAM1575 precursor RNA, VGAM1576 precursor RNA, VGAM1577 precursor RNA and VGAM1578 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1571 RNA, VGAM1572 RNA, VGAM1573 RNA, VGAM1574 RNA, VGAM1575 RNA, VGAM1576 RNA, VGAM1577 RNA and VGAM1578 RNA, herein schematically represented by VGAM1 RNA through VGAM3 RNA, each of which VGAM RNAs corresponding to VGAM RNA of FIG. 1.

VGAM1571 RNA, herein schematically represented by VGAM1 RNA through VGAM3 RNA, binds complementarily to a host target binding site located in an untranslated region of VGAM1571 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1571 host target RNA into VGAM1571 host target protein, herein schematically represented by VGAM1 HOST TARGET PROTEIN through VGAM3 HOST TARGET PROTEIN, all of FIG. 1.

VGAM1572 RNA, herein schematically represented by VGAM1 RNA through VGAM3 RNA, binds complementarily to a host target binding site located in an untranslated region of VGAM1572 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1572 host target RNA into VGAM1572 host target protein, herein schematically represented by VGAM1 HOST TARGET PROTEIN through VGAM3 HOST TARGET PROTEIN, all of FIG. 1.

VGAM1573 RNA, herein schematically represented by VGAM1 RNA through VGAM3 RNA, binds complementarily to a host target binding site located in an untranslated region of VGAM1573 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1573 host target RNA into VGAM1573 host target protein, herein schematically represented by VGAM1 HOST TARGET PROTEIN through VGAM3 HOST TARGET PROTEIN, all of FIG. 1.

VGAM1574 RNA, herein schematically represented by VGAM1 RNA through VGAM3 RNA, binds complementarily to a host target binding site located in an untranslated region of VGAM1574 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1574 host target RNA into VGAM1574 host target protein, herein schematically represented by VGAM1 HOST TARGET PROTEIN through VGAM3 HOST TARGET PROTEIN, all of FIG. 1.

VGAM1575 RNA, herein schematically represented by VGAM1 RNA through VGAM3 RNA, binds complementarily to a host target binding site located in an untranslated region of VGAM1575 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1575 host target RNA into VGAM1575 host target protein, herein schematically represented by VGAM1 HOST TARGET PROTEIN through VGAM3 HOST TARGET PROTEIN, all of FIG. 1.

VGAM1576 RNA, herein schematically represented by VGAM1 RNA through VGAM3 RNA, binds complementarily to a host target binding site located in an untranslated region of VGAM1576 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1576 host target RNA into VGAM1576 host target protein, herein schematically represented by VGAM1 HOST TARGET PROTEIN through VGAM3 HOST TARGET PROTEIN, all of FIG. 1.

VGAM1577 RNA, herein schematically represented by VGAM1 RNA through VGAM3 RNA, binds complementarily to a host target binding site located in an untranslated region of VGAM1577 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1577 host target RNA into VGAM1577 host target protein, herein schematically represented by VGAM1 HOST TARGET PROTEIN through VGAM3 HOST TARGET PROTEIN, all of FIG. 1.

VGAM1578 RNA, herein schematically represented by VGAM1 RNA through VGAM3 RNA, binds complementarily to a host target binding site located in an untranslated region of VGAM1578 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1578 host target RNA into VGAM1578 host target protein, herein schematically represented by VGAM1 HOST TARGET PROTEIN through VGAM3 HOST TARGET PROTEIN, all of FIG. 1.

It is appreciated that a function of VGR3080 gene, herein designated VGR GENE, is inhibition of expression of host target genes, as part of a novel viral mechanism of attacking a host. Accordingly, utilities of VGR3080 gene include diagnosis, prevention and treatment of viral infection by Rhopalosiphum Padi Virus. Specific functions, and accordingly utilities, of VGR3080 gene correlate with, and may be deduced from, the identity of the host target genes, which are inhibited by VGAM RNAs comprised in the 'operon-like' cluster of VGR3080 gene: VGAM1571 host target protein, VGAM1572 host target protein, VGAM1573 host target protein, VGAM1574 host target protein, VGAM1575 host target protein, VGAM1576 host target protein, VGAM1577 host target protein and VGAM1578 host target protein, herein schematically represented by VGAM1 HOST TARGET PROTEIN through VGAM3 HOST TARGET PROTEIN. The function of these host target genes is elaborated hereinabove with reference to VGAM1571, VGAM1572, VGAM1573, VGAM1574, VGAM1575, VGAM1576, VGAM1577 and VGAM1578. FIG. 9 further provides a conceptual description of novel bioinformatically detected regulatory viral gene, referred to here as Viral Genomic Record 3081(VGR3081) viral gene, which encodes an 'operon-like' cluster of novel viral micro RNA-like genes, each of which in turn modulates expression of at least one host target gene, the function and utility of which at least one host target gene is known in the art.

VGR3081 gene, herein designated VGR GENE, is a novel bioinformatically detected regulatory, non protein coding, RNA viral gene. The method by which VGR3081 gene was detected is described hereinabove with reference to FIGS. 1-9.

VGR3081 gene encodes VGR3081 precursor RNA, herein designated VGR PRECURSOR RNA, an RNA molecule, typically several hundred nucleotides long.

VGR3081 precursor RNA folds spatially, forming VGR3081 folded precursor RNA, herein designated VGR FOLDED PRECURSOR RNA. It is appreciated that VGR3081 folded precursor RNA comprises a plurality of what is known in the art as 'hairpin' structures. These 'hairpin' structures are due to the fact that the nucleotide sequence of VGR3081 precursor RNA comprises a plurality of segments, the first half of each such segment having a nucleotide sequence which is at least a partial inversed-reversed sequence of the second half thereof, as is well known in the art.

VGR3081 folded precursor RNA is naturally processed by cellular enzymatic activity into at least 2 separate VGAM precursor RNAs, VGAM1579 precursor RNA and VGAM1580 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1579 RNA and VGAM1580 RNA, herein schematically represented by VGAM1 RNA through VGAM3 RNA, each of which VGAM RNAs corresponding to VGAM RNA of FIG. 1.

VGAM1579 RNA, herein schematically represented by VGAM1 RNA through VGAM3 RNA, binds complementarily to a host target binding site located in an untranslated region of VGAM1579 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1579 host target RNA into VGAM1579 host target protein, herein schematically represented by VGAM1 HOST TARGET PROTEIN through VGAM3 HOST TARGET PROTEIN, all of FIG. 1.

VGAM1580 RNA, herein schematically represented by VGAM1 RNA through VGAM3 RNA, binds complementarily to a host target binding site located in an untranslated region of VGAM1580 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1580 host target RNA into VGAM1580 host target protein, herein schematically represented by VGAM1 HOST TARGET PROTEIN through VGAM3 HOST TARGET PROTEIN, all of FIG. 1.

It is appreciated that a function of VGR3081 gene, herein designated VGR GENE, is inhibition of expression of host target genes, as part of a novel viral mechanism of attacking a host. Accordingly, utilities of VGR3081 gene include diagnosis, prevention and treatment of viral infection by Rhopalosiphum Padi Virus. Specific functions, and accordingly utilities, of VGR3081 gene correlate with, and may be deduced from, the identity of the host target genes, which are inhibited by VGAM RNAs comprised in the 'operon-like' cluster of VGR3081 gene: VGAM1579 host target protein and VGAM1580 host target protein, herein schematically represented by VGAM1 HOST TARGET PROTEIN through VGAM3 HOST TARGET PROTEIN. The function of these host target genes is elaborated hereinabove with reference to VGAM1579 and VGAM1580. FIG. 9 further provides a conceptual description of novel bioinformatically detected regulatory viral gene, referred to here as Viral Genomic Record 3082(VGR3082) viral gene, which encodes an 'operon-like' cluster of novel viral micro RNA-like genes, each of which in turn modulates expression of at least one host target gene, the function and utility of which at least one host target gene is known in the art.

VGR3082 gene, herein designated VGR GENE, is a novel bioinformatically detected regulatory, non protein coding, RNA viral gene. The method by which VGR3082 gene was detected is described hereinabove with reference to FIGS. 1-9.

VGR3082 gene encodes VGR3082 precursor RNA, herein designated VGR PRECURSOR RNA, an RNA molecule, typically several hundred nucleotides long.

VGR3082 precursor RNA folds spatially, forming VGR3082 folded precursor RNA, herein designated VGR FOLDED PRECURSOR RNA. It is appreciated that VGR3082 folded precursor RNA comprises a plurality of what is known in the art as 'hairpin' structures. These 'hairpin' structures are due to the fact that the nucleotide sequence of VGR3082 precursor RNA comprises a plurality of segments, the first half of each such segment having a nucleotide sequence which is at least a partial inversed-reversed sequence of the second half thereof, as is well known in the art.

VGR3082 folded precursor RNA is naturally processed by cellular enzymatic activity into at least 8 separate VGAM precursor RNAs, VGAM1581 precursor RNA, VGAM1582 precursor RNA, VGAM1583 precursor RNA, VGAM1584 precursor RNA, VGAM1585 precursor RNA, VGAM1586 precursor RNA, VGAM1587 precursor RNA and VGAM1588 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1581 RNA, VGAM1582 RNA, VGAM1583 RNA, VGAM1584 RNA, VGAM1585 RNA, VGAM1586 RNA, VGAM1587 RNA and VGAM1588 RNA, herein schematically represented by VGAM1 RNA through VGAM3 RNA, each of which VGAM RNAs corresponding to VGAM RNA of FIG. 1.

VGAM1581 RNA, herein schematically represented by VGAM1 RNA through VGAM3 RNA, binds complementarily to a host target binding site located in an untranslated region of VGAM1581 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1581 host target RNA into VGAM1581 host target protein, herein schematically represented by VGAM1 HOST TARGET PROTEIN through VGAM3 HOST TARGET PROTEIN, all of FIG. 1.

VGAM1582 RNA, herein schematically represented by VGAM1 RNA through VGAM3 RNA, binds complementarily to a host target binding site located in an untranslated region of VGAM1582 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1582 host target RNA into VGAM1582 host target protein, herein schematically represented by VGAM1 HOST TARGET PROTEIN through VGAM3 HOST TARGET PROTEIN, all of FIG. 1.

VGAM1583 RNA, herein schematically represented by VGAM1 RNA through VGAM3 RNA, binds complementarily to a host target binding site located in an untranslated region of VGAM1583 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1583 host target RNA into VGAM1583 host target protein, herein schematically represented by VGAM1 HOST TARGET PROTEIN through VGAM3 HOST TARGET PROTEIN, all of FIG. 1.

VGAM1584 RNA, herein schematically represented by VGAM1 RNA through VGAM3 RNA, binds complementarily to a host target binding site located in an untranslated region of VGAM1584 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1584 host target RNA into VGAM1584 host target protein, herein schematically represented by VGAM1 HOST TARGET PROTEIN through VGAM3 HOST TARGET PROTEIN, all of FIG. 1.

VGAM1585 RNA, herein schematically represented by VGAM1 RNA through VGAM3 RNA, binds complementarily to a host target binding site located in an untranslated region of VGAM1585 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1585 host target RNA into VGAM1585 host target protein, herein schematically represented by VGAM1 HOST TARGET PROTEIN through VGAM3 HOST TARGET PROTEIN, all of FIG. 1.

VGAM1586 RNA, herein schematically represented by VGAM1 RNA through VGAM3 RNA, binds complementarily to a host target binding site located in an untranslated region of VGAM1586 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1586 host target RNA into VGAM1586 host target protein, herein schematically represented by VGAM1 HOST TARGET PROTEIN through VGAM3 HOST TARGET PROTEIN, all of FIG. 1.

VGAM1587 RNA, herein schematically represented by VGAM1 RNA through VGAM3 RNA, binds complementarily to a host target binding site located in an untranslated region of VGAM1587 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1587 host target RNA into VGAM1587 host target protein, herein schematically represented by VGAM1 HOST TARGET PROTEIN through VGAM3 HOST TARGET PROTEIN, all of FIG. 1.

VGAM1588 RNA, herein schematically represented by VGAM1 RNA through VGAM3 RNA, binds complementarily to a host target binding site located in an untranslated region of VGAM1588 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1588 host target RNA into VGAM1588 host target protein, herein schematically represented by VGAM1 HOST TARGET PROTEIN through VGAM3 HOST TARGET PROTEIN, all of FIG. 1.

It is appreciated that a function of VGR3082 gene, herein designated VGR GENE, is inhibition of expression of host target genes, as part of a novel viral mechanism of attacking a host. Accordingly, utilities of VGR3082 gene include diagnosis, prevention and treatment of viral infection by Saimiriine Herpesvirus 2. Specific functions, and accordingly utilities, of VGR3082 gene correlate with, and may be deduced from, the identity of the host target genes, which are inhibited by VGAM RNAs comprised in the 'operon-like' cluster of VGR3082 gene: VGAM1581 host target protein, VGAM1582 host target protein, VGAM1583 host target protein, VGAM1584 host target protein, VGAM1585 host target protein, VGAM1586 host target protein, VGAM1587 host target protein and VGAM1588 host target protein, herein schematically represented by VGAM1 HOST TARGET PROTEIN through VGAM3 HOST TARGET PROTEIN. The function of these host target genes is elaborated hereinabove with reference to VGAM1581, VGAM1582, VGAM1583, VGAM1584, VGAM1585, VGAM1586, VGAM1587 and VGAM1588. FIG. 9 further provides a conceptual description of novel bioinformatically detected regulatory viral gene, referred to here as Viral Genomic Record 3083(VGR3083) viral gene, which encodes an 'operon-like' cluster of novel viral micro RNA-like genes, each of which in turn modulates expression of at least one host target gene, the function and utility of which at least one host target gene is known in the art.

VGR3083 gene, herein designated VGR GENE, is a novel bioinformatically detected regulatory, non protein coding, RNA viral gene. The method by which VGR3083 gene was detected is described hereinabove with reference to FIGS. 1-9.

VGR3083 gene encodes VGR3083 precursor RNA, herein designated VGR PRECURSOR RNA, an RNA molecule, typically several hundred nucleotides long.

VGR3083 precursor RNA folds spatially, forming VGR3083 folded precursor RNA, herein designated VGR FOLDED PRECURSOR RNA. It is appreciated that VGR3083 folded precursor RNA comprises a plurality of what is known in the art as 'hairpin' structures. These 'hairpin' structures are due to the fact that the nucleotide sequence of VGR3083 precursor RNA comprises a plurality of segments, the first half of each such segment having a nucleotide sequence which is at least a partial inversed-reversed sequence of the second half thereof, as is well known in the art.

VGR3083 folded precursor RNA is naturally processed by cellular enzymatic activity into at least 5 separate VGAM precursor RNAs, VGAM1589 precursor RNA, VGAM1590 precursor RNA, VGAM1591 precursor RNA, VGAM1592 precursor RNA and VGAM1593 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1589 RNA, VGAM1590 RNA, VGAM1591 RNA, VGAM1592 RNA and VGAM1593 RNA, herein schematically represented by VGAM1 RNA through VGAM3 RNA, each of which VGAM RNAs corresponding to VGAM RNA of FIG. 1.

VGAM1589 RNA, herein schematically represented by VGAM1 RNA through VGAM3 RNA, binds complementarily to a host target binding site located in an untranslated region of VGAM1589 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1589 host target RNA into VGAM1589 host target protein, herein schematically represented by VGAM1 HOST TARGET PROTEIN through VGAM3 HOST TARGET PROTEIN, all of FIG. 1.

VGAM1590 RNA, herein schematically represented by VGAM1 RNA through VGAM3 RNA, binds complementarily to a host target binding site located in an untranslated region of VGAM1590 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1590 host target RNA into VGAM1590 host target protein, herein schematically represented by VGAM1 HOST TARGET PROTEIN through VGAM3 HOST TARGET PROTEIN, all of FIG. 1.

VGAM1591 RNA, herein schematically represented by VGAM1 RNA through VGAM3 RNA, binds complementarily to a host target binding site located in an untranslated region of VGAM1591 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1591 host target RNA into VGAM1591 host target protein, herein schematically represented by VGAM1 HOST TARGET PROTEIN through VGAM3 HOST TARGET PROTEIN, all of FIG. 1.

VGAM1592 RNA, herein schematically represented by VGAM1 RNA through VGAM3 RNA, binds complementarily to a host target binding site located in an untranslated region of VGAM1592 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1592 host target RNA into VGAM1592 host target protein, herein schematically represented by VGAM1 HOST TARGET PROTEIN through VGAM3 HOST TARGET PROTEIN, all of FIG. 1.

VGAM1593 RNA, herein schematically represented by VGAM1 RNA through VGAM3 RNA, binds complementarily to a host target binding site located in an untranslated region of VGAM1593 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1593 host target RNA into VGAM1593 host target protein, herein schematically represented by VGAM1 HOST TARGET PROTEIN through VGAM3 HOST TARGET PROTEIN, all of FIG. 1.

It is appreciated that a function of VGR3083 gene, herein designated VGR GENE, is inhibition of expression of host target genes, as part of a novel viral mechanism of attacking a host. Accordingly, utilities of VGR3083 gene include diagnosis, prevention and treatment of viral infection by Ateline Herpesvirus 3. Specific functions, and accordingly utilities, of VGR3083 gene correlate with, and may be deduced from, the identity of the host target genes, which are inhibited by VGAM RNAs comprised in the 'operon-like' cluster of VGR3083 gene: VGAM1589 host target protein, VGAM1590 host target protein, VGAM1591 host target protein, VGAM1592 host target protein and VGAM1593 host target protein, herein schematically represented by VGAM1 HOST TARGET PROTEIN through VGAM3 HOST TARGET PROTEIN. The function of these host target genes is elaborated hereinabove with reference to VGAM1589, VGAM1590, VGAM1591, VGAM1592 and VGAM1593. FIG. 9 further provides a conceptual description of novel bioinformatically detected regulatory viral gene, referred to here as Viral Genomic Record 3084(VGR3084) viral gene, which encodes an 'operon-like' cluster of novel viral micro RNA-like genes, each of which in turn modulates expression of at least one host target gene, the function and utility of which at least one host target gene is known in the art.

VGR3084 gene, herein designated VGR GENE, is a novel bioinformatically detected regulatory, non protein coding, RNA viral gene. The method by which VGR3084 gene was detected is described hereinabove with reference to FIGS. 1-9.

VGR3084 gene encodes VGR3084 precursor RNA, herein designated VGR PRECURSOR RNA, an RNA molecule, typically several hundred nucleotides long.

VGR3084 precursor RNA folds spatially, forming VGR3084 folded precursor RNA, herein designated VGR FOLDED PRECURSOR RNA. It is appreciated that VGR3084 folded precursor RNA comprises a plurality of what is known in the art as 'hairpin' structures. These 'hairpin' structures are due to the fact that the nucleotide sequence of VGR3084 precursor RNA comprises a plurality of segments, the first half of each such segment having a nucleotide sequence which is at least a partial inversed-reversed sequence of the second half thereof, as is well known in the art.

VGR3084 folded precursor RNA is naturally processed by cellular enzymatic activity into at least 4 separate VGAM precursor RNAs, VGAM1594 precursor RNA, VGAM1595 precursor RNA, VGAM1596 precursor RNA and VGAM1597 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1594 RNA, VGAM1595 RNA, VGAM1596 RNA and VGAM1597 RNA, herein schematically represented by VGAM1 RNA through VGAM3 RNA, each of which VGAM RNAs corresponding to VGAM RNA of FIG. 1.

VGAM1594 RNA, herein schematically represented by VGAM1 RNA through VGAM3 RNA, binds complementarily to a host target binding site located in an untranslated region of VGAM1594 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1594 host target RNA into VGAM1594 host target protein, herein schematically represented by VGAM1 HOST TARGET PROTEIN through VGAM3 HOST TARGET PROTEIN, all of FIG. 1.

VGAM1595 RNA, herein schematically represented by VGAM1 RNA through VGAM3 RNA, binds complementarily to a host target binding site located in an untranslated region of VGAM1595 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1595 host target RNA into VGAM1595 host target protein, herein schematically represented by VGAM1 HOST TARGET PROTEIN through VGAM3 HOST TARGET PROTEIN, all of FIG. 1.

VGAM1596 RNA, herein schematically represented by VGAM1 RNA through VGAM3 RNA, binds complementarily to a host target binding site located in an untranslated region of VGAM1596 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1596 host target RNA into VGAM1596 host target protein, herein schematically represented by VGAM1 HOST TARGET PROTEIN through VGAM3 HOST TARGET PROTEIN, all of FIG. 1.

VGAM1597 RNA, herein schematically represented by VGAM1 RNA through VGAM3 RNA, binds complementarily to a host target binding site located in an untranslated region of VGAM1597 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1597 host target RNA into VGAM1597 host target protein, herein schematically represented by VGAM1 HOST TARGET PROTEIN through VGAM3 HOST TARGET PROTEIN, all of FIG. 1.

It is appreciated that a function of VGR3084 gene, herein designated VGR GENE, is inhibition of expression of host target genes, as part of a novel viral mechanism of attacking a host. Accordingly, utilities of VGR3084 gene include diagnosis, prevention and treatment of viral infection by Leek Yellow Stripe Potyvirus. Specific functions, and accordingly utilities, of VGR3084 gene correlate with, and may be deduced from, the identity of the host target genes, which are inhibited by VGAM RNAs comprised in the 'operon-like' cluster of VGR3084 gene: VGAM1594 host target protein, VGAM1595 host target protein, VGAM1596 host target protein and VGAM1597 host target protein, herein schematically represented by VGAM1 HOST TARGET PROTEIN through VGAM3 HOST TARGET PROTEIN. The function of these host target genes is elaborated hereinabove with reference to VGAM1594, VGAM1595, VGAM1596 and VGAM1597.

FIG. 9 further provides a conceptual description of novel bioinformatically detected regulatory viral gene, referred to here as Viral Genomic Record 3085(VGR3085) viral gene, which encodes an 'operon-like' cluster of novel viral micro RNA-like genes, each of which in turn modulates expression of at least one host target gene, the function and utility of which at least one host target gene is known in the art.

VGR3085 gene, herein designated VGR GENE, is a novel bioinformatically detected regulatory, non protein coding, RNA viral gene. The method by which VGR3085 gene was detected is described hereinabove with reference to FIGS. 1-9.

VGR3085 gene encodes VGR3085 precursor RNA, herein designated VGR PRECURSOR RNA, an RNA molecule, typically several hundred nucleotides long.

VGR3085 precursor RNA folds spatially, forming VGR3085 folded precursor RNA, herein designated VGR FOLDED PRECURSOR RNA. It is appreciated that VGR3085 folded precursor RNA comprises a plurality of what is known in the art as 'hairpin' structures. These 'hairpin' structures are due to the fact that the nucleotide sequence of VGR3085 precursor RNA comprises a plurality of segments, the first half of each such segment having a nucleotide sequence which is at least a partial inversed-reversed sequence of the second half thereof, as is well known in the art.

VGR3085 folded precursor RNA is naturally processed by cellular enzymatic activity into at least 5 separate VGAM precursor RNAs, VGAM1598 precursor RNA, VGAM1599 precursor RNA, VGAM1600 precursor RNA, VGAM1601 precursor RNA and VGAM1602 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1598 RNA, VGAM1599 RNA, VGAM1600 RNA, VGAM1601 RNA and VGAM1602 RNA, herein schematically represented by VGAM1 RNA through VGAM3 RNA, each of which VGAM RNAs corresponding to VGAM RNA of FIG. 1.

VGAM1598 RNA, herein schematically represented by VGAM1 RNA through VGAM3 RNA, binds complementarily to a host target binding site located in an untranslated region of VGAM1598 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1598 host target RNA into VGAM1598 host target protein, herein schematically represented by VGAM1 HOST TARGET PROTEIN through VGAM3 HOST TARGET PROTEIN, all of FIG. 1.

VGAM1599 RNA, herein schematically represented by VGAM1 RNA through VGAM3 RNA, binds complementarily to a host target binding site located in an untranslated region of VGAM1599 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1599 host target RNA into VGAM1599 host target protein, herein schematically represented by VGAM1 HOST TARGET PROTEIN through VGAM3 HOST TARGET PROTEIN, all of FIG. 1.

VGAM1600 RNA, herein schematically represented by VGAM1 RNA through VGAM3 RNA, binds complementarily to a host target binding site located in an untranslated region of VGAM1600 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1600 host target RNA into VGAM1600 host target protein, herein schematically represented by VGAM1 HOST TARGET PROTEIN through VGAM3 HOST TARGET PROTEIN, all of FIG. 1.

VGAM1601 RNA, herein schematically represented by VGAM1 RNA through VGAM3 RNA, binds complementarily to a host target binding site located in an untranslated region of VGAM1601 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1601 host target RNA into VGAM1601 host target protein, herein schematically represented by VGAM1 HOST TARGET PROTEIN through VGAM3 HOST TARGET PROTEIN, all of FIG. 1.

VGAM1602 RNA, herein schematically represented by VGAM1 RNA through VGAM3 RNA, binds complementarily to a host target binding site located in an untranslated region of VGAM1602 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1602 host target RNA into VGAM1602 host target protein, herein schematically represented by VGAM1 HOST TARGET PROTEIN through VGAM3 HOST TARGET PROTEIN, all of FIG. 1.

It is appreciated that a function of VGR3085 gene, herein designated VGR GENE, is inhibition of expression of host target genes, as part of a novel viral mechanism of attacking a host. Accordingly, utilities of VGR3085 gene include diagnosis, prevention and treatment of viral infection by Human Adenovirus E. Specific functions, and accordingly utilities, of VGR3085 gene correlate with, and may be deduced from, the identity of the host target genes, which are inhibited by VGAM RNAs comprised in the 'operon-like' cluster of VGR3085 gene: VGAM1598 host target protein, VGAM1599 host target protein, VGAM1600 host target protein, VGAM1601 host target protein and VGAM1602 host target protein, herein schematically represented by VGAM1 HOST TARGET PROTEIN through VGAM3 HOST TARGET PROTEIN. The function of these host target genes is elaborated hereinabove with reference to VGAM1598, VGAM1599, VGAM1600, VGAM1601 and VGAM1602.

FIG. 9 further provides a conceptual description of novel bioinformatically detected regulatory viral gene, referred to here as Viral Genomic Record 3086(VGR3086) viral gene, which encodes an 'operon-like' cluster of novel viral micro RNA-like genes, each of which in turn modulates expression of at least one host target gene, the function and utility of which at least one host target gene is known in the art.

VGR3086 gene, herein designated VGR GENE, is a novel bioinformatically detected regulatory, non protein coding, RNA viral gene. The method by which VGR3086 gene was detected is described hereinabove with reference to FIGS. 1-9.

VGR3086 gene encodes VGR3086 precursor RNA, herein designated VGR PRECURSOR RNA, an RNA molecule, typically several hundred nucleotides long.

VGR3086 precursor RNA folds spatially, forming VGR3086 folded precursor RNA, herein designated VGR FOLDED PRECURSOR RNA. It is appreciated that VGR3086 folded precursor RNA comprises a plurality of what is known in the art as 'hairpin' structures. These 'hairpin' structures are due to the fact that the nucleotide sequence of VGR3086 precursor RNA comprises a plurality of segments, the first half of each such segment having a nucleotide sequence which is at least a partial inversed-reversed sequence of the second half thereof, as is well known in the art.

VGR3086 folded precursor RNA is naturally processed by cellular enzymatic activity into at least 6 separate VGAM precursor RNAs, VGAM1603 precursor RNA, VGAM1604 precursor RNA, VGAM1605 precursor RNA, VGAM1606 precursor RNA, VGAM1607 precursor RNA and VGAM1608 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1603 RNA, VGAM1604 RNA, VGAM1605 RNA, VGAM1606 RNA, VGAM1607 RNA and VGAM1608 RNA, herein schematically represented by VGAM1 RNA through VGAM3 RNA, each of which VGAM RNAs corresponding to VGAM RNA of FIG. 1.

VGAM1603 RNA, herein schematically represented by VGAM1 RNA through VGAM3 RNA, binds complementarily to a host target binding site located in an untranslated region of VGAM1603 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1603 host target RNA into VGAM1603 host target protein, herein schematically represented by VGAM1 HOST TARGET PROTEIN through VGAM3 HOST TARGET PROTEIN, all of FIG. 1.

VGAM1604 RNA, herein schematically represented by VGAM1 RNA through VGAM3 RNA, binds complementarily to a host target binding site located in an untranslated region of VGAM1604 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1604 host target RNA into VGAM1604 host target protein, herein schematically represented by VGAM1 HOST TARGET PROTEIN through VGAM3 HOST TARGET PROTEIN, all of FIG. 1.

VGAM1605 RNA, herein schematically represented by VGAM1 RNA through VGAM3 RNA, binds complementarily to a host target binding site located in an untranslated region of VGAM1605 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1605 host target RNA into VGAM1605 host target protein, herein schematically represented by VGAM1 HOST TARGET PROTEIN through VGAM3 HOST TARGET PROTEIN, all of FIG. 1.

VGAM1606 RNA, herein schematically represented by VGAM1 RNA through VGAM3 RNA, binds complementarily to a host target binding site located in an untranslated region of VGAM1606 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1606 host target RNA into VGAM1606 host target protein, herein schematically represented by VGAM1 HOST TARGET PROTEIN through VGAM3 HOST TARGET PROTEIN, all of FIG. 1.

VGAM1607 RNA, herein schematically represented by VGAM1 RNA through VGAM3 RNA, binds complementarily to a host target binding site located in an untranslated region of VGAM1607 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1607 host target RNA into VGAM1607 host target protein, herein schematically represented by VGAM1 HOST TARGET PROTEIN through VGAM3 HOST TARGET PROTEIN, all of FIG. 1.

VGAM1608 RNA, herein schematically represented by VGAM1 RNA through VGAM3 RNA, binds complementarily to a host target binding site located in an untranslated region of VGAM1608 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1608 host target RNA into VGAM1608 host target protein, herein schematically represented by VGAM1 HOST TARGET PROTEIN through VGAM3 HOST TARGET PROTEIN, all of FIG. 1.

It is appreciated that a function of VGR3086 gene, herein designated VGR GENE, is inhibition of expression of host target genes, as part of a novel viral mechanism of attacking a host. Accordingly, utilities of VGR3086 gene include diagnosis, prevention and treatment of viral infection by Taura Syndrome Virus. Specific functions, and accordingly utilities, of VGR3086 gene correlate with, and may be deduced from, the identity of the host target genes, which are inhibited by VGAM RNAs comprised in the 'operon-like' cluster of VGR3086 gene: VGAM1603 host target protein, VGAM1604 host target protein, VGAM1605 host target protein, VGAM1606 host target protein, VGAM1607 host target protein and VGAM1608 host target protein, herein schematically represented by VGAM1 HOST TARGET PROTEIN through VGAM3 HOST TARGET PROTEIN. The function of these host target genes is elaborated hereinabove with reference to VGAM1603, VGAM1604, VGAM1605, VGAM1606, VGAM1607 and VGAM1608. FIG. 9 further provides a conceptual description of novel bioinformatically detected regulatory viral gene, referred to here as Viral Genomic Record 3087(VGR3087) viral gene, which encodes an 'operon-like' cluster of novel viral micro RNA-like genes, each of which in turn modulates expression of at least one host target gene, the function and utility of which at least one host target gene is known in the art.

VGR3087 gene, herein designated VGR GENE, is a novel bioinformatically detected regulatory, non protein coding, RNA viral gene. The method by which VGR3087 gene was detected is described hereinabove with reference to FIGS. 1-9.

VGR3087 gene encodes VGR3087 precursor RNA, herein designated VGR PRECURSOR RNA, an RNA molecule, typically several hundred nucleotides long.

VGR3087 precursor RNA folds spatially, forming VGR3087 folded precursor RNA, herein designated VGR FOLDED PRECURSOR RNA. It is appreciated that VGR3087 folded precursor RNA comprises a plurality of what is known in the art as 'hairpin' structures. These 'hairpin' structures are due to the fact that the nucleotide sequence of VGR3087 precursor RNA comprises a plurality of segments, the first half of each such segment having a nucleotide sequence which is at least a partial inversed-reversed sequence of the second half thereof, as is well known in the art.

VGR3087 folded precursor RNA is naturally processed by cellular enzymatic activity into at least 8 separate VGAM precursor RNAs, VGAM1609 precursor RNA, VGAM1610 precursor RNA, VGAM1611 precursor RNA, VGAM1612 precursor RNA, VGAM1613 precursor RNA, VGAM1614 precursor RNA, VGAM1615 precursor RNA and VGAM1616 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1609 RNA, VGAM1610 RNA, VGAM1611 RNA, VGAM1612 RNA, VGAM1613 RNA, VGAM1614 RNA, VGAM1615 RNA and VGAM1616 RNA, herein schematically represented by VGAM1 RNA through VGAM3 RNA, each of which VGAM RNAs corresponding to VGAM RNA of FIG. 1.

VGAM1609 RNA, herein schematically represented by VGAM1 RNA through VGAM3 RNA, binds complementarily to a host target binding site located in an untranslated region of VGAM1609 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1609 host target RNA into VGAM1609 host target protein, herein schematically represented by VGAM1 HOST TARGET PROTEIN through VGAM3 HOST TARGET PROTEIN, all of FIG. 1.

VGAM1610 RNA, herein schematically represented by VGAM1 RNA through VGAM3 RNA, binds complementarily to a host target binding site located in an untranslated region of VGAM1610 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1610 host target RNA into VGAM1610 host target protein, herein schematically represented by VGAM1 HOST TARGET PROTEIN through VGAM3 HOST TARGET PROTEIN, all of FIG. 1.

VGAM1611 RNA, herein schematically represented by VGAM1 RNA through VGAM3 RNA, binds complementarily to a host target binding site located in an untranslated region of VGAM1611 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1611 host target RNA into VGAM1611 host target protein, herein schematically represented by VGAM1 HOST TARGET PROTEIN through VGAM3 HOST TARGET PROTEIN, all of FIG. 1.

VGAM1612 RNA, herein schematically represented by VGAM1 RNA through VGAM3 RNA, binds complementarily to a host target binding site located in an untranslated region of VGAM1612 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1612 host target RNA into VGAM1612 host target protein, herein schematically represented by VGAM1 HOST TARGET PROTEIN through VGAM3 HOST TARGET PROTEIN, all of FIG. 1.

VGAM1613 RNA, herein schematically represented by VGAM1 RNA through VGAM3 RNA, binds complementarily to a host target binding site located in an untranslated region of VGAM1613 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1613 host target RNA into VGAM1613 host target protein, herein schematically represented by VGAM1 HOST TARGET PROTEIN through VGAM3 HOST TARGET PROTEIN, all of FIG. 1.

VGAM1614 RNA, herein schematically represented by VGAM1 RNA through VGAM3 RNA, binds complementarily to a host target binding site located in an untranslated region of VGAM1614 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1614 host target RNA into VGAM1614 host target protein, herein schematically represented by VGAM1 HOST TARGET PROTEIN through VGAM3 HOST TARGET PROTEIN, all of FIG. 1.

VGAM1615 RNA, herein schematically represented by VGAM1 RNA through VGAM3 RNA, binds complementarily to a host target binding site located in an untranslated region of VGAM1615 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1615 host target RNA into VGAM1615 host target protein, herein schematically represented by VGAM1 HOST TARGET PROTEIN through VGAM3 HOST TARGET PROTEIN, all of FIG. 1.

VGAM1616 RNA, herein schematically represented by VGAM1 RNA through VGAM3 RNA, binds complementarily to a host target binding site located in an untranslated region of VGAM1616 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1616 host target RNA into VGAM1616 host target protein, herein schematically represented by VGAM1 HOST TARGET PROTEIN through VGAM3 HOST TARGET PROTEIN, all of FIG. 1.

It is appreciated that a function of VGR3087 gene, herein designated VGR GENE, is inhibition of expression of host target genes, as part of a novel viral mechanism of attacking a host. Accordingly, utilities of VGR3087 gene include diagnosis, prevention and treatment of viral infection by Chimpanzee Cytomegalovirus. Specific functions, and accordingly utilities, of VGR3087 gene correlate with, and may be deduced from, the identity of the host target genes, which are inhibited by VGAM RNAs comprised in the 'operon-like' cluster of VGR3087 gene: VGAM1609 host target protein, VGAM1610 host target protein, VGAM1611 host target protein, VGAM1612 host target protein, VGAM1613 host target protein, VGAM1614 host target protein, VGAM1615 host target protein and VGAM1616 host target protein, herein schematically represented by VGAM1 HOST TARGET PROTEIN through VGAM3 HOST TARGET PROTEIN. The function of these host target genes is elaborated hereinabove with reference to VGAM1609, VGAM1610, VGAM1611, VGAM1612, VGAM1613, VGAM1614, VGAM1615 and VGAM1616. FIG. 9 further provides a conceptual description of novel bioinformatically detected regulatory viral gene, referred to here as Viral Genomic Record 3088(VGR3088) viral gene, which encodes an 'operon-like' cluster of novel viral micro RNA-like genes, each of which in turn modulates expression of at least one host target gene, the function and utility of which at least one host target gene is known in the art.

VGR3088 gene, herein designated VGR GENE, is a novel bioinformatically detected regulatory, non protein coding, RNA viral gene. The method by which VGR3088 gene was detected is described hereinabove with reference to FIGS. 1-9.

VGR3088 gene encodes VGR3088 precursor RNA, herein designated VGR PRECURSOR RNA, an RNA molecule, typically several hundred nucleotides long.

VGR3088 precursor RNA folds spatially, forming VGR3088 folded precursor RNA, herein designated VGR FOLDED PRECURSOR RNA. It is appreciated that VGR3088 folded precursor RNA comprises a plurality of what is known in the art as 'hairpin' structures. These 'hairpin' structures are due to the fact that the nucleotide sequence of VGR3088 precursor RNA comprises a plurality of segments, the first half of each such segment having a nucleotide sequence which is at least a partial inversed-reversed sequence of the second half thereof, as is well known in the art.

VGR3088 folded precursor RNA is naturally processed by cellular enzymatic activity into at least 5 separate VGAM precursor RNAs, VGAM1617 precursor RNA, VGAM1618 precursor RNA, VGAM1619 precursor RNA, VGAM1620 precursor RNA and VGAM1621 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1617 RNA, VGAM1618 RNA, VGAM1619 RNA, VGAM1620 RNA and VGAM1621 RNA, herein schematically represented by VGAM1 RNA through VGAM3 RNA, each of which VGAM RNAs corresponding to VGAM RNA of FIG. 1.

VGAM1617 RNA, herein schematically represented by VGAM1 RNA through VGAM3 RNA, binds complementarily to a host target binding site located in an untranslated region of VGAM1617 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1617 host target RNA into VGAM1617 host target protein, herein schematically represented by VGAM1 HOST TARGET PROTEIN through VGAM3 HOST TARGET PROTEIN, all of FIG. 1.

VGAM1618 RNA, herein schematically represented by VGAM1 RNA through VGAM3 RNA, binds complementarily to a host target binding site located in an untranslated region of VGAM1618 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1618 host target RNA into VGAM1618 host target protein, herein schematically represented by VGAM1 HOST TARGET PROTEIN through VGAM3 HOST TARGET PROTEIN, all of FIG. 1.

VGAM1619 RNA, herein schematically represented by VGAM1 RNA through VGAM3 RNA, binds complementarily to a host target binding site located in an untranslated region of VGAM1619 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1619 host target RNA into VGAM1619 host target protein, herein schematically represented by VGAM1 HOST TARGET PROTEIN through VGAM3 HOST TARGET PROTEIN, all of FIG. 1.

VGAM1620 RNA, herein schematically represented by VGAM1 RNA through VGAM3 RNA, binds complementarily to a host target binding site located in an untranslated region of VGAM1620 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1620 host target RNA into VGAM1620 host target protein, herein schematically represented by VGAM1 HOST TARGET PROTEIN through VGAM3 HOST TARGET PROTEIN, all of FIG. 1.

VGAM1621 RNA, herein schematically represented by VGAM1 RNA through VGAM3 RNA, binds complementarily to a host target binding site located in an untranslated region of VGAM1621 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1621 host target RNA into VGAM1621 host target protein, herein schematically represented by VGAM1 HOST TARGET PROTEIN through VGAM3 HOST TARGET PROTEIN, all of FIG. 1.

It is appreciated that a function of VGR3088 gene, herein designated VGR GENE, is inhibition of expression of host target genes, as part of a novel viral mechanism of attacking a host. Accordingly, utilities of VGR3088 gene include diagnosis, prevention and treatment of viral infection by Fowl Adenovirus D. Specific functions, and accordingly utilities, of VGR3088 gene correlate with, and may be deduced from, the identity of the host target genes, which are inhibited by VGAM RNAs comprised in the 'operon-like' cluster of VGR3088 gene: VGAM1617 host target protein, VGAM1618 host target protein, VGAM1619 host target protein, VGAM1620 host target protein and VGAM1621 host target protein, herein schematically represented by VGAM1 HOST TARGET PROTEIN through VGAM3 HOST TARGET PROTEIN. The function of these host target genes is elaborated hereinabove with reference to VGAM1617, VGAM1618, VGAM1619, VGAM1620 and VGAM1621.

FIG. 9 further provides a conceptual description of novel bioinformatically detected regulatory viral gene, referred to here as Viral Genomic Record 3089(VGR3089) viral gene, which encodes an 'operon-like' cluster of novel viral micro RNA-like genes, each of which in turn modulates expression of at least one host target gene, the function and utility of which at least one host target gene is known in the art.

VGR3089 gene, herein designated VGR GENE, is a novel bioinformatically detected regulatory, non protein coding, RNA viral gene. The method by which VGR3089 gene was detected is described hereinabove with reference to FIGS. 1-9.

VGR3089 gene encodes VGR3089 precursor RNA, herein designated VGR PRECURSOR RNA, an RNA molecule, typically several hundred nucleotides long.

VGR3089 precursor RNA folds spatially, forming VGR3089 folded precursor RNA, herein designated VGR FOLDED PRECURSOR RNA. It is appreciated that VGR3089 folded precursor RNA comprises a plurality of what is known in the art as 'hairpin' structures. These 'hairpin' structures are due to the fact that the nucleotide sequence of VGR3089 precursor RNA comprises a plurality of segments, the first half of each such segment having a nucleotide sequence which is at least a partial inversed-reversed sequence of the second half thereof, as is well known in the art.

VGR3089 folded precursor RNA is naturally processed by cellular enzymatic activity into at least 8 separate VGAM precursor RNAs, VGAM1622 precursor RNA, VGAM1623 precursor RNA, VGAM1624 precursor RNA, VGAM1625 precursor RNA, VGAM1626 precursor RNA, VGAM1627 precursor RNA, VGAM1628 precursor RNA and VGAM1629 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1622 RNA, VGAM1623 RNA, VGAM1624 RNA, VGAM1625 RNA, VGAM1626 RNA, VGAM1627 RNA, VGAM1628 RNA and VGAM1629 RNA, herein schematically represented by VGAM1 RNA through VGAM3 RNA, each of which VGAM RNAs corresponding to VGAM RNA of FIG. 1.

VGAM1622 RNA, herein schematically represented by VGAM1 RNA through VGAM3 RNA, binds complementarily to a host target binding site located in an untranslated region of VGAM1622 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1622 host target RNA into VGAM1622 host target protein, herein schematically represented by VGAM1 HOST TARGET PROTEIN through VGAM3 HOST TARGET PROTEIN, all of FIG. 1.

VGAM1623 RNA, herein schematically represented by VGAM1 RNA through VGAM3 RNA, binds complementarily to a host target binding site located in an untranslated region of VGAM1623 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1623 host target RNA into VGAM1623 host target protein, herein schematically represented by VGAM1 HOST TARGET PROTEIN through VGAM3 HOST TARGET PROTEIN, all of FIG. 1.

VGAM1624 RNA, herein schematically represented by VGAM1 RNA through VGAM3 RNA, binds complementarily to a host target binding site located in an untranslated region of VGAM1624 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1624 host target RNA into VGAM1624 host target protein, herein schematically represented by VGAM1 HOST TARGET PROTEIN through VGAM3 HOST TARGET PROTEIN, all of FIG. 1.

VGAM1625 RNA, herein schematically represented by VGAM1 RNA through VGAM3 RNA, binds complementarily to a host target binding site located in an untranslated region of VGAM1625 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1625 host target RNA into VGAM1625 host target protein, herein schematically represented by VGAM1 HOST TARGET PROTEIN through VGAM3 HOST TARGET PROTEIN, all of FIG. 1.

VGAM1626 RNA, herein schematically represented by VGAM1 RNA through VGAM3 RNA, binds complementarily to a host target binding site located in an untranslated region of VGAM1626 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1626 host target RNA into VGAM1626 host target protein, herein schematically represented by VGAM1 HOST TARGET PROTEIN through VGAM3 HOST TARGET PROTEIN, all of FIG. 1.

VGAM1627 RNA, herein schematically represented by VGAM1 RNA through VGAM3 RNA, binds complementarily to a host target binding site located in an untranslated region of VGAM1627 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1627 host target RNA into VGAM1627 host target protein, herein schematically represented by VGAM1 HOST TARGET PROTEIN through VGAM3 HOST TARGET PROTEIN, all of FIG. 1.

VGAM1628 RNA, herein schematically represented by VGAM1 RNA through VGAM3 RNA, binds complementarily to a host target binding site located in an untranslated region of VGAM1628 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1628 host target RNA into VGAM1628 host target protein, herein schematically represented by VGAM1 HOST TARGET PROTEIN through VGAM3 HOST TARGET PROTEIN, all of FIG. 1.

VGAM1629 RNA, herein schematically represented by VGAM1 RNA through VGAM3 RNA, binds complementarily to a host target binding site located in an untranslated region of VGAM1629 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1629 host target RNA into VGAM1629 host target protein, herein schematically represented by VGAM1 HOST TARGET PROTEIN through VGAM3 HOST TARGET PROTEIN, all of FIG. 1.

It is appreciated that a function of VGR3089 gene, herein designated VGR GENE, is inhibition of expression of host target genes, as part of a novel viral mechanism of attacking a host. Accordingly, utilities of VGR3089 gene include diagnosis, prevention and treatment of viral infection by Bovine Herpesvirus 4. Specific functions, and accordingly utilities, of VGR3089 gene correlate with, and may be deduced from, the identity of the host target genes, which are inhibited by VGAM RNAs comprised in the 'operon-like' cluster of VGR3089 gene: VGAM1622 host target protein, VGAM1623 host target protein, VGAM1624 host target protein, VGAM1625 host target protein, VGAM1626 host target protein, VGAM1627 host target protein, VGAM1628 host target protein and VGAM1629 host target protein, herein schematically represented by VGAM1 HOST TARGET PROTEIN through VGAM3 HOST TARGET PROTEIN. The function of these host target genes is elaborated hereinabove with reference to VGAM1622, VGAM1623, VGAM1624, VGAM1625, VGAM1626, VGAM1627, VGAM1628 and VGAM1629. FIG. 9 further provides a conceptual description of novel bioinformatically detected regulatory viral gene, referred to here as Viral Genomic Record 3090(VGR3090) viral gene, which encodes an 'operon-like' cluster of novel viral micro RNA-like genes, each of which in turn modulates expression of at least one host target gene, the function and utility of which at least one host target gene is known in the art.

VGR3090 gene, herein designated VGR GENE, is a novel bioinformatically detected regulatory, non protein coding, RNA viral gene. The method by which VGR3090 gene was detected is described hereinabove with reference to FIGS. 1-9.

VGR3090 gene encodes VGR3090 precursor RNA, herein designated VGR PRECURSOR RNA, an RNA molecule, typically several hundred nucleotides long.

VGR3090 precursor RNA folds spatially, forming VGR3090 folded precursor RNA, herein designated VGR FOLDED PRECURSOR RNA. It is appreciated that VGR3090 folded precursor RNA comprises a plurality of what is known in the art as 'hairpin' structures. These 'hairpin' structures are due to the fact that the nucleotide sequence of VGR3090 precursor RNA comprises a plurality of segments, the first half of each such segment having a nucleotide sequence which is at least a partial inversed-reversed sequence of the second half thereof, as is well known in the art.

VGR3090 folded precursor RNA is naturally processed by cellular enzymatic activity into at least 5 separate VGAM precursor RNAs, VGAM1630 precursor RNA, VGAM1631 precursor RNA, VGAM1632 precursor RNA, VGAM1633 precursor RNA and VGAM1634 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1630 RNA, VGAM1631 RNA, VGAM1632 RNA, VGAM1633 RNA and VGAM1634 RNA, herein schematically represented by VGAM1 RNA through VGAM3 RNA, each of which VGAM RNAs corresponding to VGAM RNA of FIG. 1.

VGAM1630 RNA, herein schematically represented by VGAM1 RNA through VGAM3 RNA, binds complementarily to a host target binding site located in an untranslated region of VGAM1630 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1630 host target RNA into VGAM1630 host target protein, herein schematically represented by VGAM1 HOST TARGET PROTEIN through VGAM3 HOST TARGET PROTEIN, all of FIG. 1.

VGAM1631 RNA, herein schematically represented by VGAM1 RNA through VGAM3 RNA, binds complementarily to a host target binding site located in an untranslated region of VGAM1631 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1631 host target RNA into VGAM1631 host target protein, herein schematically represented by VGAM1 HOST TARGET PROTEIN through VGAM3 HOST TARGET PROTEIN, all of FIG. 1.

VGAM1632 RNA, herein schematically represented by VGAM1 RNA through VGAM3 RNA, binds complementarily to a host target binding site located in an untranslated region of VGAM1632 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1632 host target RNA into VGAM1632 host target protein, herein schematically represented by VGAM1 HOST TARGET PROTEIN through VGAM3 HOST TARGET PROTEIN, all of FIG. 1.

VGAM1633 RNA, herein schematically represented by VGAM1 RNA through VGAM3 RNA, binds complementarily to a host target binding site located in an untranslated region of VGAM1633 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1633 host target RNA into VGAM1633 host target protein, herein schematically represented by VGAM1 HOST TARGET PROTEIN through VGAM3 HOST TARGET PROTEIN, all of FIG. 1.

VGAM1634 RNA, herein schematically represented by VGAM1 RNA through VGAM3 RNA, binds complementarily to a host target binding site located in an untranslated region of VGAM1634 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1634 host target RNA into VGAM1634 host target protein, herein schematically represented by VGAM1 HOST TARGET PROTEIN through VGAM3 HOST TARGET PROTEIN, all of FIG. 1.

It is appreciated that a function of VGR3090 gene, herein designated VGR GENE, is inhibition of expression of host target genes, as part of a novel viral mechanism of attacking a host. Accordingly, utilities of VGR3090 gene include diagnosis, prevention and treatment of viral infection by Bovine Herpesvirus 4. Specific functions, and accordingly utilities, of VGR3090 gene correlate with, and may be deduced from, the identity of the host target genes, which are inhibited by VGAM RNAs comprised in the 'operon-like' cluster of VGR3090 gene: VGAM1630 host target protein, VGAM1631 host target protein, VGAM1632 host target protein, VGAM1633 host target protein and VGAM1634 host target protein, herein schematically represented by VGAM1 HOST TARGET PROTEIN through VGAM3 HOST TARGET PROTEIN. The function of these host target genes is elaborated hereinabove with reference to VGAM1630, VGAM1631, VGAM1632, VGAM1633 and VGAM1634.

FIG. 9 further provides a conceptual description of novel bioinformatically detected regulatory viral gene, referred to here as Viral Genomic Record 3091(VGR3091) viral gene, which encodes an 'operon-like' cluster of novel viral micro RNA-like genes, each of which in turn modulates expression of at least one host target gene, the function and utility of which at least one host target gene is known in the art.

VGR3091 gene, herein designated VGR GENE, is a novel bioinformatically detected regulatory, non protein coding, RNA viral gene. The method by which VGR3091 gene was detected is described hereinabove with reference to FIGS. 1-9.

VGR3091 gene encodes VGR3091 precursor RNA, herein designated VGR PRECURSOR RNA, an RNA molecule, typically several hundred nucleotides long.

VGR3091 precursor RNA folds spatially, forming VGR3091 folded precursor RNA, herein designated VGR FOLDED PRECURSOR RNA. It is appreciated that VGR3091 folded precursor RNA comprises a plurality of what is known in the art as 'hairpin' structures. These 'hairpin' structures are due to the fact that the nucleotide sequence of VGR3091 precursor RNA comprises a plurality of segments, the first half of each such segment having a nucleotide sequence which is at least a partial inversed-reversed sequence of the second half thereof, as is well known in the art.

VGR3091 folded precursor RNA is naturally processed by cellular enzymatic activity into at least 6 separate VGAM precursor RNAs, VGAM1635 precursor RNA, VGAM1636 precursor RNA, VGAM1637 precursor RNA, VGAM1638 precursor RNA, VGAM1639 precursor RNA and VGAM1640 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1635 RNA, VGAM1636 RNA, VGAM1637 RNA, VGAM1638 RNA, VGAM1639 RNA and VGAM1640 RNA, herein schematically represented by VGAM1 RNA through VGAM3 RNA, each of which VGAM RNAs corresponding to VGAM RNA of FIG. 1.

VGAM1635 RNA, herein schematically represented by VGAM1 RNA through VGAM3 RNA, binds complementarily to a host target binding site located in an untranslated region of VGAM1635 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1635 host target RNA into VGAM1635 host target protein, herein schematically represented by VGAM1 HOST TARGET PROTEIN through VGAM3 HOST TARGET PROTEIN, all of FIG. 1.

VGAM1636 RNA, herein schematically represented by VGAM1 RNA through VGAM3 RNA, binds complementarily to a host target binding site located in an untranslated region of VGAM1636 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1636 host target RNA into VGAM1636 host target protein, herein schematically represented by VGAM1 HOST TARGET PROTEIN through VGAM3 HOST TARGET PROTEIN, all of FIG. 1.

VGAM1637 RNA, herein schematically represented by VGAM1 RNA through VGAM3 RNA, binds complementarily to a host target binding site located in an untranslated region of VGAM1637 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1637 host target RNA into VGAM1637 host target protein, herein schematically represented by VGAM1 HOST TARGET PROTEIN through VGAM3 HOST TARGET PROTEIN, all of FIG. 1.

VGAM1638 RNA, herein schematically represented by VGAM1 RNA through VGAM3 RNA, binds complementarily to a host target binding site located in an untranslated region of VGAM1638 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1638 host target RNA into VGAM1638 host target protein, herein schematically represented by VGAM1 HOST TARGET PROTEIN through VGAM3 HOST TARGET PROTEIN, all of FIG. 1.

VGAM1639 RNA, herein schematically represented by VGAM1 RNA through VGAM3 RNA, binds complementarily to a host target binding site located in an untranslated region of VGAM1639 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1639 host target RNA into VGAM1639 host target protein, herein schematically represented by VGAM1 HOST TARGET PROTEIN through VGAM3 HOST TARGET PROTEIN, all of FIG. 1.

VGAM1640 RNA, herein schematically represented by VGAM1 RNA through VGAM3 RNA, binds complementarily to a host target binding site located in an untranslated region of VGAM1640 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1640 host target RNA into VGAM1640 host target protein, herein schematically represented by VGAM1 HOST TARGET PROTEIN through VGAM3 HOST TARGET PROTEIN, all of FIG. 1.

It is appreciated that a function of VGR3091 gene, herein designated VGR GENE, is inhibition of expression of host target genes, as part of a novel viral mechanism of attacking a host. Accordingly, utilities of VGR3091 gene include diagnosis, prevention and treatment of viral infection by Human Herpesvirus 8. Specific functions, and accordingly utilities, of VGR3091 gene correlate with, and may be deduced from, the identity of the host target genes, which are inhibited by VGAM RNAs comprised in the 'operon-like' cluster of VGR3091 gene: VGAM1635 host target protein, VGAM1636 host target protein, VGAM1637 host target protein, VGAM1638 host target protein, VGAM1639 host target protein and VGAM1640 host target protein, herein schematically represented by VGAM1 HOST TARGET PROTEIN through VGAM3 HOST TARGET PROTEIN. The function of these host target genes is elaborated hereinabove with reference to VGAM1635, VGAM1636, VGAM1637, VGAM1638, VGAM1639 and VGAM1640. FIG. 9 further provides a conceptual description of novel bioinformatically detected regulatory viral gene, referred to here as Viral Genomic Record 3092(VGR3092) viral gene, which encodes an 'operon-like' cluster of novel viral micro RNA-like genes, each of which in turn modulates expression of at least one host target gene, the function and utility of which at least one host target gene is known in the art.

VGR3092 gene, herein designated VGR GENE, is a novel bioinformatically detected regulatory, non protein coding, RNA viral gene. The method by which VGR3092 gene was detected is described hereinabove with reference to FIGS. 1-9.

VGR3092 gene encodes VGR3092 precursor RNA, herein designated VGR PRECURSOR RNA, an RNA molecule, typically several hundred nucleotides long.

VGR3092 precursor RNA folds spatially, forming VGR3092 folded precursor RNA, herein designated VGR FOLDED PRECURSOR RNA. It is appreciated that VGR3092 folded precursor RNA comprises a plurality of what is known in the art as 'hairpin' structures. These 'hairpin' structures are due to the fact that the nucleotide sequence of VGR3092 precursor RNA comprises a plurality of segments, the first half of each such segment having a nucleotide sequence which is at least a partial inversed-reversed sequence of the second half thereof, as is well known in the art.

VGR3092 folded precursor RNA is naturally processed by cellular enzymatic activity into at least 3 separate VGAM precursor RNAs, VGAM1641 precursor RNA, VGAM1642 precursor RNA and VGAM1643 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1641 RNA, VGAM1642 RNA and VGAM1643 RNA, herein schematically represented by VGAM1 RNA through VGAM3 RNA, each of which VGAM RNAs corresponding to VGAM RNA of FIG. 1.

VGAM1641 RNA, herein schematically represented by VGAM1 RNA through VGAM3 RNA, binds complementarily to a host target binding site located in an untranslated region of VGAM1641 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1641 host target RNA into VGAM1641 host target protein, herein schematically represented by VGAM1 HOST TARGET PROTEIN through VGAM3 HOST TARGET PROTEIN, all of FIG. 1.

VGAM1642 RNA, herein schematically represented by VGAM1 RNA through VGAM3 RNA, binds complementarily to a host target binding site located in an untranslated region of VGAM1642 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1642 host target RNA into VGAM1642 host target protein, herein schematically represented by VGAM1 HOST TARGET PROTEIN through VGAM3 HOST TARGET PROTEIN, all of FIG. 1.

VGAM1643 RNA, herein schematically represented by VGAM1 RNA through VGAM3 RNA, binds complementarily to a host target binding site located in an untranslated region of VGAM1643 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1643 host target RNA into VGAM1643 host target protein, herein schematically represented by VGAM1 HOST TARGET PROTEIN through VGAM3 HOST TARGET PROTEIN, all of FIG. 1.

It is appreciated that a function of VGR3092 gene, herein designated VGR GENE, is inhibition of expression of host target genes, as part of a novel viral mechanism of attacking a host. Accordingly, utilities of VGR3092 gene include diagnosis, prevention and treatment of viral infection by Cell Fusing Agent Virus. Specific functions, and accordingly utilities, of VGR3092 gene correlate with, and may be deduced from, the identity of the host target genes, which are inhibited by VGAM RNAs comprised in the 'operon-like' cluster of VGR3092 gene: VGAM1641 host target protein, VGAM1642 host target protein and VGAM1643 host target protein, herein schematically represented by VGAM1 HOST TARGET PROTEIN through VGAM3 HOST TARGET PROTEIN. The function of these host target genes is elaborated hereinabove with reference to VGAM1641, VGAM1642 and VGAM1643. FIG. 9 further provides a conceptual description of novel bioinformatically detected regulatory viral gene, referred to here as Viral Genomic Record 3093(VGR3093) viral gene, which encodes an 'operon-like' cluster of novel viral micro RNA-like genes, each of which in turn modulates expression of at least one host target gene, the function and utility of which at least one host target gene is known in the art.

VGR3093 gene, herein designated VGR GENE, is a novel bioinformatically detected regulatory, non protein coding, RNA viral gene. The method by which VGR3093 gene was detected is described hereinabove with reference to FIGS. 1-9.

VGR3093 gene encodes VGR3093 precursor RNA, herein designated VGR PRECURSOR RNA, an RNA molecule, typically several hundred nucleotides long.

VGR3093 precursor RNA folds spatially, forming VGR3093 folded precursor RNA, herein designated VGR FOLDED PRECURSOR RNA. It is appreciated that VGR3093 folded precursor RNA comprises a plurality of what is known in the art as 'hairpin' structures. These 'hairpin' structures are due to the fact that the nucleotide sequence of VGR3093 precursor RNA comprises a plurality of segments, the first half of each such segment having a nucleotide sequence which is at least a partial inversed-reversed sequence of the second half thereof, as is well known in the art.

VGR3093 folded precursor RNA is naturally processed by cellular enzymatic activity into at least 3 separate VGAM precursor RNAs, VGAM1644 precursor RNA, VGAM1645 precursor RNA and VGAM1646 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1644 RNA, VGAM1645 RNA and VGAM1646 RNA, herein schematically represented by VGAM1 RNA through VGAM3 RNA, each of which VGAM RNAs corresponding to VGAM RNA of FIG. 1.

VGAM1644 RNA, herein schematically represented by VGAM1 RNA through VGAM3 RNA, binds complementarily to a host target binding site located in an untranslated region of VGAM1644 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1644 host target RNA into VGAM1644 host target protein, herein schematically represented by VGAM1 HOST TARGET PROTEIN through VGAM3 HOST TARGET PROTEIN, all of FIG. 1.

VGAM1645 RNA, herein schematically represented by VGAM1 RNA through VGAM3 RNA, binds complementarily to a host target binding site located in an untranslated region of VGAM1645 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1645 host target RNA into VGAM1645 host target protein, herein schematically represented by VGAM1 HOST TARGET PROTEIN through VGAM3 HOST TARGET PROTEIN, all of FIG. 1.

VGAM1646 RNA, herein schematically represented by VGAM1 RNA through VGAM3 RNA, binds complementarily to a host target binding site located in an untranslated region of VGAM1646 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1646 host target RNA into VGAM1646 host target protein, herein schematically represented by VGAM1 HOST TARGET PROTEIN through VGAM3 HOST TARGET PROTEIN, all of FIG. 1.

It is appreciated that a function of VGR3093 gene, herein designated VGR GENE, is inhibition of expression of host target genes, as part of a novel viral mechanism of attacking a host. Accordingly, utilities of VGR3093 gene include diagnosis, prevention and treatment of viral infection by Dengue Virus. Specific functions, and accordingly utilities, of VGR3093 gene correlate with, and may be deduced from, the identity of the host target genes, which are inhibited by VGAM RNAs comprised in the 'operon-like' cluster of VGR3093 gene: VGAM1644 host target protein, VGAM1645 host target protein and VGAM1646 host target protein, herein schematically represented by VGAM1 HOST TARGET PROTEIN through VGAM3 HOST TARGET PROTEIN. The function of these host target genes is elaborated hereinabove with reference to VGAM1644, VGAM1645 and VGAM1646. FIG. 9 further provides a conceptual description of novel bioinformatically detected regulatory viral gene, referred to here as Viral Genomic Record 3094(VGR3094) viral gene, which encodes an 'operon-like' cluster of novel viral micro RNA-like genes, each of which in turn modulates expression of at least one host target gene, the function and utility of which at least one host target gene is known in the art.

VGR3094 gene, herein designated VGR GENE, is a novel bioinformatically detected regulatory, non protein coding, RNA viral gene. The method by which VGR3094 gene was detected is described hereinabove with reference to FIGS. 1-9.

VGR3094 gene encodes VGR3094 precursor RNA, herein designated VGR PRECURSOR RNA, an RNA molecule, typically several hundred nucleotides long.

VGR3094 precursor RNA folds spatially, forming VGR3094 folded precursor RNA, herein designated VGR FOLDED PRECURSOR RNA. It is appreciated that VGR3094 folded precursor RNA comprises a plurality of what is known in the art as 'hairpin' structures. These 'hairpin' structures are due to the fact that the nucleotide sequence of VGR3094 precursor RNA comprises a plurality of segments, the first half of each such segment having a nucleotide sequence which is at least a partial inversed-reversed sequence of the second half thereof, as is well known in the art.

VGR3094 folded precursor RNA is naturally processed by cellular enzymatic activity into at least 5 separate VGAM precursor RNAs, VGAM1647 precursor RNA, VGAM1648 precursor RNA, VGAM1649 precursor RNA, VGAM1650 precursor RNA and VGAM1651 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1647 RNA, VGAM1648 RNA, VGAM1649 RNA, VGAM1650 RNA and VGAM1651 RNA, herein schematically represented by VGAM1 RNA through VGAM3 RNA, each of which VGAM RNAs corresponding to VGAM RNA of FIG. 1.

VGAM1647 RNA, herein schematically represented by VGAM1 RNA through VGAM3 RNA, binds complementarily to a host target binding site located in an untranslated region of VGAM1647 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1647 host target RNA into VGAM1647 host target protein, herein schematically represented by VGAM1 HOST TARGET PROTEIN through VGAM3 HOST TARGET PROTEIN, all of FIG. 1.

VGAM1648 RNA, herein schematically represented by VGAM1 RNA through VGAM3 RNA, binds complementarily to a host target binding site located in an untranslated region of VGAM1648 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1648 host target RNA into VGAM1648 host target protein, herein schematically represented by VGAM1 HOST TARGET PROTEIN through VGAM3 HOST TARGET PROTEIN, all of FIG. 1.

VGAM1649 RNA, herein schematically represented by VGAM1 RNA through VGAM3 RNA, binds complementarily to a host target binding site located in an untranslated region of VGAM1649 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1649 host target RNA into VGAM1649 host target protein, herein schematically represented by VGAM1 HOST TARGET PROTEIN through VGAM3 HOST TARGET PROTEIN, all of FIG. 1.

VGAM1650 RNA, herein schematically represented by VGAM1 RNA through VGAM3 RNA, binds complementarily to a host target binding site located in an untranslated region of VGAM1650 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1650 host target RNA into VGAM1650 host target protein, herein schematically represented by VGAM1 HOST TARGET PROTEIN through VGAM3 HOST TARGET PROTEIN, all of FIG. 1.

VGAM1651 RNA, herein schematically represented by VGAM1 RNA through VGAM3 RNA, binds complementarily to a host target binding site located in an untranslated region of VGAM1651 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1651 host target RNA into VGAM1651 host target protein, herein schematically represented by VGAM1 HOST TARGET PROTEIN through VGAM3 HOST TARGET PROTEIN, all of FIG. 1.

It is appreciated that a function of VGR3094 gene, herein designated VGR GENE, is inhibition of expression of host target genes, as part of a novel viral mechanism of attacking a host. Accordingly, utilities of VGR3094 gene include diagnosis, prevention and treatment of viral infection by Human Herpesvirus 8. Specific functions, and accordingly utilities, of VGR3094 gene correlate with, and may be deduced from, the identity of the host target genes, which are inhibited by VGAM RNAs comprised in the 'operon-like' cluster of VGR3094 gene: VGAM1647 host target protein, VGAM1648 host target protein, VGAM1649 host target protein, VGAM1650 host target protein and VGAM1651 host target protein, herein schematically represented by VGAM1 HOST TARGET PROTEIN through VGAM3 HOST TARGET PROTEIN. The function of these host target genes is elaborated hereinabove with reference to VGAM1647, VGAM1648, VGAM1649, VGAM1650 and VGAM1651.

FIG. 9 further provides a conceptual description of novel bioinformatically detected regulatory viral gene, referred to here as Viral Genomic Record 3095(VGR3095) viral gene, which encodes an 'operon-like' cluster of novel viral micro RNA-like genes, each of which in turn modulates expression of at least one host target gene, the function and utility of which at least one host target gene is known in the art.

VGR3095 gene, herein designated VGR GENE, is a novel bioinformatically detected regulatory, non protein coding, RNA viral gene. The method by which VGR3095 gene was detected is described hereinabove with reference to FIGS. 1-9.

VGR3095 gene encodes VGR3095 precursor RNA, herein designated VGR PRECURSOR RNA, an RNA molecule, typically several hundred nucleotides long.

VGR3095 precursor RNA folds spatially, forming VGR3095 folded precursor RNA, herein designated VGR FOLDED PRECURSOR RNA. It is appreciated that VGR3095 folded precursor RNA comprises a plurality of what is known in the art as 'hairpin' structures. These 'hairpin' structures are due to the fact that the nucleotide sequence of VGR3095 precursor RNA comprises a plurality of segments, the first half of each such segment having a nucleotide sequence which is at least a partial inversed-reversed sequence of the second half thereof, as is well known in the art.

VGR3095 folded precursor RNA is naturally processed by cellular enzymatic activity into at least 4 separate VGAM precursor RNAs, VGAM1652 precursor RNA, VGAM1653 precursor RNA, VGAM1654 precursor RNA and VGAM1655 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1652 RNA, VGAM1653 RNA, VGAM1654 RNA and VGAM1655 RNA, herein schematically represented by VGAM1 RNA through VGAM3 RNA, each of which VGAM RNAs corresponding to VGAM RNA of FIG. 1.

VGAM1652 RNA, herein schematically represented by VGAM1 RNA through VGAM3 RNA, binds complementarily to a host target binding site located in an untranslated region of VGAM1652 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1652 host target RNA into VGAM1652 host target protein, herein schematically represented by VGAM1 HOST TARGET PROTEIN through VGAM3 HOST TARGET PROTEIN, all of FIG. 1.

VGAM1653 RNA, herein schematically represented by VGAM1 RNA through VGAM3 RNA, binds complementarily to a host target binding site located in an untranslated region of VGAM1653 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1653 host target RNA into VGAM1653 host target protein, herein schematically represented by VGAM1 HOST TARGET PROTEIN through VGAM3 HOST TARGET PROTEIN, all of FIG. 1.

VGAM1654 RNA, herein schematically represented by VGAM1 RNA through VGAM3 RNA, binds complementarily to a host target binding site located in an untranslated region of VGAM1654 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1654 host target RNA into VGAM1654 host target protein, herein schematically represented by VGAM1 HOST TARGET PROTEIN through VGAM3 HOST TARGET PROTEIN, all of FIG. 1.

VGAM1655 RNA, herein schematically represented by VGAM1 RNA through VGAM3 RNA, binds complementarily to a host target binding site located in an untranslated region of VGAM1655 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1655 host target RNA into VGAM1655 host target protein, herein schematically represented by VGAM1 HOST TARGET PROTEIN through VGAM3 HOST TARGET PROTEIN, all of FIG. 1.

It is appreciated that a function of VGR3095 gene, herein designated VGR GENE, is inhibition of expression of host target genes, as part of a novel viral mechanism of attacking a host. Accordingly, utilities of VGR3095 gene include diagnosis, prevention and treatment of viral infection by Yellow Fever Virus. Specific functions, and accordingly utilities, of VGR3095 gene correlate with, and may be deduced from, the identity of the host target genes, which are inhibited by VGAM RNAs comprised in the 'operon-like' cluster of VGR3095 gene: VGAM1652 host target protein, VGAM1653 host target protein, VGAM1654 host target protein and VGAM1655 host target protein, herein schematically represented by VGAM1 HOST TARGET PROTEIN through VGAM3 HOST TARGET PROTEIN. The function of these host target genes is elaborated hereinabove with reference to VGAM1652, VGAM1653, VGAM1654 and VGAM1655.

FIG. 9 further provides a conceptual description of novel bioinformatically detected regulatory viral gene, referred to here as Viral Genomic Record 3096(VGR3096) viral gene, which encodes an 'operon-like' cluster of novel viral micro RNA-like genes, each of which in turn modulates expression of at least one host target gene, the function and utility of which at least one host target gene is known in the art.

VGR3096 gene, herein designated VGR GENE, is a novel bioinformatically detected regulatory, non protein coding, RNA viral gene. The method by which VGR3096 gene was detected is described hereinabove with reference to FIGS. 1-9.

VGR3096 gene encodes VGR3096 precursor RNA, herein designated VGR PRECURSOR RNA, an RNA molecule, typically several hundred nucleotides long.

VGR3096 precursor RNA folds spatially, forming VGR3096 folded precursor RNA, herein designated VGR FOLDED PRECURSOR RNA. It is appreciated that VGR3096 folded precursor RNA comprises a plurality of what is known in the art as 'hairpin' structures. These 'hairpin' structures are due to the fact that the nucleotide sequence of VGR3096 precursor RNA comprises a plurality of segments, the first half of each such segment having a nucleotide sequence which is at least a partial inversed-reversed sequence of the second half thereof, as is well known in the art.

VGR3096 folded precursor RNA is naturally processed by cellular enzymatic activity into at least 5 separate VGAM precursor RNAs, VGAM1656 precursor RNA, VGAM1657 precursor RNA, VGAM1658 precursor RNA, VGAM1659 precursor RNA and VGAM1660 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1656 RNA, VGAM1657 RNA, VGAM1658 RNA, VGAM1659 RNA and VGAM1660 RNA, herein schematically represented by VGAM1 RNA through VGAM3 RNA, each of which VGAM RNAs corresponding to VGAM RNA of FIG. 1.

VGAM1656 RNA, herein schematically represented by VGAM1 RNA through VGAM3 RNA, binds complementarily to a host target binding site located in an untranslated region of VGAM1656 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1656 host target RNA into VGAM1656 host target protein, herein schematically represented by VGAM1 HOST TARGET PROTEIN through VGAM3 HOST TARGET PROTEIN, all of FIG. 1.

VGAM1657 RNA, herein schematically represented by VGAM1 RNA through VGAM3 RNA, binds complementarily to a host target binding site located in an untranslated region of VGAM1657 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1657 host target RNA into VGAM1657 host target protein, herein schematically represented by VGAM1 HOST TARGET PROTEIN through VGAM3 HOST TARGET PROTEIN, all of FIG. 1.

VGAM1658 RNA, herein schematically represented by VGAM1 RNA through VGAM3 RNA, binds complementarily to a host target binding site located in an untranslated region of VGAM1658 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1658 host target RNA into VGAM1658 host target protein, herein schematically represented by VGAM1 HOST TARGET PROTEIN through VGAM3 HOST TARGET PROTEIN, all of FIG. 1.

VGAM1659 RNA, herein schematically represented by VGAM1 RNA through VGAM3 RNA, binds complementarily to a host target binding site located in an untranslated region of VGAM1659 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1659 host target RNA into VGAM1659 host target protein, herein schematically represented by VGAM1 HOST TARGET PROTEIN through VGAM3 HOST TARGET PROTEIN, all of FIG. 1.

VGAM1660 RNA, herein schematically represented by VGAM1 RNA through VGAM3 RNA, binds complementarily to a host target binding site located in an untranslated region of VGAM1660 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1660 host target RNA into VGAM1660 host target protein, herein schematically represented by VGAM1 HOST TARGET PROTEIN through VGAM3 HOST TARGET PROTEIN, all of FIG. 1.

It is appreciated that a function of VGR3096 gene, herein designated VGR GENE, is inhibition of expression of host target genes, as part of a novel viral mechanism of attacking a host. Accordingly, utilities of VGR3096 gene include diagnosis, prevention and treatment of viral infection by Molluscum Contagiosum Virus. Specific functions, and accordingly utilities, of VGR3096 gene correlate with, and may be deduced from, the identity of the host target genes, which are inhibited by VGAM RNAs comprised in the 'operon-like' cluster of VGR3096 gene: VGAM1656 host target protein, VGAM1657 host target protein, VGAM1658 host target protein, VGAM1659 host target protein and VGAM1660 host target protein, herein schematically represented by VGAM1 HOST TARGET PROTEIN through VGAM3 HOST TARGET PROTEIN. The function of these host target genes is elaborated hereinabove with reference to VGAM1656, VGAM1657, VGAM1658, VGAM1659 and VGAM1660. FIG. 9 further provides a conceptual description of novel bioinformatically detected regulatory viral gene, referred to here as Viral Genomic Record 3097(VGR3097) viral gene, which encodes an 'operon-like' cluster of novel viral micro RNA-like genes, each of which in turn modulates expression of at least one host target gene, the function and utility of which at least one host target gene is known in the art.

VGR3097 gene, herein designated VGR GENE, is a novel bioinformatically detected regulatory, non protein coding, RNA viral gene. The method by which VGR3097 gene was detected is described hereinabove with reference to FIGS. 1-9.

VGR3097 gene encodes VGR3097 precursor RNA, herein designated VGR PRECURSOR RNA, an RNA molecule, typically several hundred nucleotides long.

VGR3097 precursor RNA folds spatially, forming VGR3097 folded precursor RNA, herein designated VGR FOLDED PRECURSOR RNA. It is appreciated that VGR3097 folded precursor RNA comprises a plurality of what is known in the art as 'hairpin' structures. These 'hairpin' structures are due to the fact that the nucleotide sequence of VGR3097 precursor RNA comprises a plurality of segments, the first half of each such segment having a nucleotide sequence which is at least a partial inversed-reversed sequence of the second half thereof, as is well known in the art.

VGR3097 folded precursor RNA is naturally processed by cellular enzymatic activity into at least 4 separate VGAM precursor RNAs, VGAM1661 precursor RNA, VGAM1662 precursor RNA, VGAM1663 precursor RNA and VGAM1664 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1661 RNA, VGAM1662 RNA, VGAM1663 RNA and VGAM1664 RNA, herein schematically represented by VGAM1 RNA through VGAM3 RNA, each of which VGAM RNAs corresponding to VGAM RNA of FIG. 1.

VGAM1661 RNA, herein schematically represented by VGAM1 RNA through VGAM3 RNA, binds complementarily to a host target binding site located in an untranslated region of VGAM1661 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1661 host target RNA into VGAM1661 host target protein, herein schematically represented by VGAM1 HOST TARGET PROTEIN through VGAM3 HOST TARGET PROTEIN, all of FIG. 1.

VGAM1662 RNA, herein schematically represented by VGAM1 RNA through VGAM3 RNA, binds complementarily to a host target binding site located in an untranslated region of VGAM1662 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1662 host target RNA into VGAM1662 host target protein, herein schematically represented by VGAM1 HOST TARGET PROTEIN through VGAM3 HOST TARGET PROTEIN, all of FIG. 1.

VGAM1663 RNA, herein schematically represented by VGAM1 RNA through VGAM3 RNA, binds complementarily to a host target binding site located in an untranslated region of VGAM1663 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1663 host target RNA into VGAM1663 host target protein, herein schematically represented by VGAM1 HOST TARGET PROTEIN through VGAM3 HOST TARGET PROTEIN, all of FIG. 1.

VGAM1664 RNA, herein schematically represented by VGAM1 RNA through VGAM3 RNA, binds complementarily to a host target binding site located in an untranslated region of VGAM1664 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1664 host target RNA into VGAM1664 host target protein, herein schematically represented by VGAM1 HOST TARGET PROTEIN through VGAM3 HOST TARGET PROTEIN, all of FIG. 1.

It is appreciated that a function of VGR3097 gene, herein designated VGR GENE, is inhibition of expression of host target genes, as part of a novel viral mechanism of attacking a host. Accordingly, utilities of VGR3097 gene include diagnosis, prevention and treatment of viral infection by Cercopithecine Herpesvirus 7. Specific functions, and accordingly utilities, of VGR3097 gene correlate with, and may be deduced from, the identity of the host target genes, which are inhibited by VGAM RNAs comprised in the 'operon-like' cluster of VGR3097 gene: VGAM1661 host target protein, VGAM1662 host target protein, VGAM1663 host target protein and VGAM1664 host target protein, herein schematically represented by VGAM1 HOST TARGET PROTEIN through VGAM3 HOST TARGET PROTEIN. The function of these host target genes is elaborated hereinabove with reference to VGAM1661, VGAM1662, VGAM1663 and VGAM1664. FIG. 9 further provides a conceptual description of novel bioinformatically detected regulatory viral gene, referred to here as Viral Genomic Record 3098(VGR3098) viral gene, which encodes an 'operon-like' cluster of novel viral micro RNA-like genes, each of which in turn modulates expression of at least one host target gene, the function and utility of which at least one host target gene is known in the art.

VGR3098 gene, herein designated VGR GENE, is a novel bioinformatically detected regulatory, non protein coding, RNA viral gene. The method by which VGR3098 gene was detected is described hereinabove with reference to FIGS. 1-9.

VGR3098 gene encodes VGR3098 precursor RNA, herein designated VGR PRECURSOR RNA, an RNA molecule, typically several hundred nucleotides long.

VGR3098 precursor RNA folds spatially, forming VGR3098 folded precursor RNA, herein designated VGR FOLDED PRECURSOR RNA. It is appreciated that VGR3098 folded precursor RNA comprises a plurality of what is known in the art as 'hairpin' structures. These 'hairpin' structures are due to the fact that the nucleotide sequence of VGR3098 precursor RNA comprises a plurality of segments, the first half of each such segment having a nucleotide sequence which is at least a partial inversed-reversed sequence of the second half thereof, as is well known in the art.

VGR3098 folded precursor RNA is naturally processed by cellular enzymatic activity into at least 3 separate VGAM precursor RNAs, VGAM1665 precursor RNA, VGAM1666 precursor RNA and VGAM1667 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1665 RNA, VGAM1666 RNA and VGAM1667 RNA, herein schematically represented by VGAM1 RNA through VGAM3 RNA, each of which VGAM RNAs corresponding to VGAM RNA of FIG. 1.

VGAM1665 RNA, herein schematically represented by VGAM1 RNA through VGAM3 RNA, binds complementarily to a host target binding site located in an untranslated region of VGAM1665 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1665 host target RNA into VGAM1665 host target protein, herein schematically represented by VGAM1 HOST TARGET PROTEIN through VGAM3 HOST TARGET PROTEIN, all of FIG. 1.

VGAM1666 RNA, herein schematically represented by VGAM1 RNA through VGAM3 RNA, binds complementarily to a host target binding site located in an untranslated region of VGAM1666 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1666 host target RNA into VGAM1666 host target protein, herein schematically represented by VGAM1 HOST TARGET PROTEIN through VGAM3 HOST TARGET PROTEIN, all of FIG. 1.

VGAM1667 RNA, herein schematically represented by VGAM1 RNA through VGAM3 RNA, binds complementarily to a host target binding site located in an untranslated region of VGAM1667 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1667 host target RNA into VGAM1667 host target protein, herein schematically represented by VGAM1 HOST TARGET PROTEIN through VGAM3 HOST TARGET PROTEIN, all of FIG. 1.

It is appreciated that a function of VGR3098 gene, herein designated VGR GENE, is inhibition of expression of host target genes, as part of a novel viral mechanism of attacking a host. Accordingly, utilities of VGR3098 gene include diagnosis, prevention and treatment of viral infection by Infectious Spleen and Kidney Necrosis Virus. Specific functions, and accordingly utilities, of VGR3098 gene correlate with, and may be deduced from, the identity of the host target genes, which are inhibited by VGAM RNAs comprised in the 'operon-like' cluster of VGR3098 gene: VGAM1665 host target protein, VGAM1666 host target protein and VGAM1667 host target protein, herein schematically represented by VGAM1 HOST TARGET PROTEIN through VGAM3 HOST TARGET PROTEIN. The function of these host target genes is elaborated hereinabove with reference to VGAM1665, VGAM1666 and VGAM1667. FIG. 9 further provides a conceptual description of novel bioinformatically detected regulatory viral gene, referred to here as Viral Genomic Record 3099(VGR3099) viral gene, which encodes an 'operon-like' cluster of novel viral micro RNA-like genes, each of which in turn modulates expression of at least one host target gene, the function and utility of which at least one host target gene is known in the art.

VGR3099 gene, herein designated VGR GENE, is a novel bioinformatically detected regulatory, non protein coding, RNA viral gene. The method by which VGR3099 gene was detected is described hereinabove with reference to FIGS. 1-9.

VGR3099 gene encodes VGR3099 precursor RNA, herein designated VGR PRECURSOR RNA, an RNA molecule, typically several hundred nucleotides long.

VGR3099 precursor RNA folds spatially, forming VGR3099 folded precursor RNA, herein designated VGR FOLDED PRECURSOR RNA. It is appreciated that VGR3099 folded precursor RNA comprises a plurality of what is known in the art as 'hairpin' structures. These 'hairpin' structures are due to the fact that the nucleotide sequence of VGR3099 precursor RNA comprises a plurality of segments, the first half of each such segment having a nucleotide sequence which is at least a partial inversed-reversed sequence of the second half thereof, as is well known in the art.

VGR3099 folded precursor RNA is naturally processed by cellular enzymatic activity into at least 4 separate VGAM precursor RNAs, VGAM1668 precursor RNA, VGAM1669 precursor RNA, VGAM1670 precursor RNA and VGAM1671 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1668 RNA, VGAM1669 RNA, VGAM1670 RNA and VGAM1671 RNA, herein schematically represented by VGAM1 RNA through VGAM3 RNA, each of which VGAM RNAs corresponding to VGAM RNA of FIG. 1.

VGAM1668 RNA, herein schematically represented by VGAM1 RNA through VGAM3 RNA, binds complementarily to a host target binding site located in an untranslated region of VGAM1668 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1668 host target RNA into VGAM1668 host target protein, herein schematically represented by VGAM1 HOST TARGET PROTEIN through VGAM3 HOST TARGET PROTEIN, all of FIG. 1.

VGAM1669 RNA, herein schematically represented by VGAM1 RNA through VGAM3 RNA, binds complementarily to a host target binding site located in an untranslated region of VGAM1669 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1669 host target RNA into VGAM1669 host target protein, herein schematically represented by VGAM1 HOST TARGET PROTEIN through VGAM3 HOST TARGET PROTEIN, all of FIG. 1.

VGAM1670 RNA, herein schematically represented by VGAM1 RNA through VGAM3 RNA, binds complementarily to a host target binding site located in an untranslated region of VGAM1670 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1670 host target RNA into VGAM1670 host target protein, herein schematically represented by VGAM1 HOST TARGET PROTEIN through VGAM3 HOST TARGET PROTEIN, all of FIG. 1.

VGAM1671 RNA, herein schematically represented by VGAM1 RNA through VGAM3 RNA, binds complementarily to a host target binding site located in an untranslated region of VGAM1671 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1671 host target RNA into VGAM1671 host target protein, herein schematically represented by VGAM1 HOST TARGET PROTEIN through VGAM3 HOST TARGET PROTEIN, all of FIG. 1.

It is appreciated that a function of VGR3099 gene, herein designated VGR GENE, is inhibition of expression of host target genes, as part of a novel viral mechanism of attacking a host. Accordingly, utilities of VGR3099 gene include diagnosis, prevention and treatment of viral infection by Human Adenovirus D. Specific functions, and accordingly utilities, of VGR3099 gene correlate with, and may be deduced from, the identity of the host target genes, which are inhibited by VGAM RNAs comprised in the 'operon-like' cluster of VGR3099 gene: VGAM1668 host target protein, VGAM1669 host target protein, VGAM1670 host target protein and VGAM1671 host target protein, herein schematically represented by VGAM1 HOST TARGET PROTEIN through VGAM3 HOST TARGET PROTEIN. The function of these host target genes is elaborated hereinabove with reference to VGAM1668, VGAM1669, VGAM1670 and VGAM1671.

FIG. 9 further provides a conceptual description of novel bioinformatically detected regulatory viral gene, referred to here as Viral Genomic Record 3100(VGR3100) viral gene, which encodes an 'operon-like' cluster of novel viral micro RNA-like genes, each of which in turn modulates expression of at least one host target gene, the function and utility of which at least one host target gene is known in the art.

VGR3100 gene, herein designated VGR GENE, is a novel bioinformatically detected regulatory, non protein coding, RNA viral gene. The method by which VGR3100 gene was detected is described hereinabove with reference to FIGS. 1-9.

VGR3100 gene encodes VGR3100 precursor RNA, herein designated VGR PRECURSOR RNA, an RNA molecule, typically several hundred nucleotides long.

VGR3100 precursor RNA folds spatially, forming VGR3100 folded precursor RNA, herein designated VGR FOLDED PRECURSOR RNA. It is appreciated that VGR3100 folded precursor RNA comprises a plurality of what is known in the art as 'hairpin' structures. These 'hairpin' structures are due to the fact that the nucleotide sequence of VGR3100 precursor RNA comprises a plurality of segments, the first half of each such segment having a nucleotide sequence which is at least a partial inversed-reversed sequence of the second half thereof, as is well known in the art.

VGR3100 folded precursor RNA is naturally processed by cellular enzymatic activity into at least 3 separate VGAM precursor RNAs, VGAM1672 precursor RNA, VGAM1673 precursor RNA and VGAM1674 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1672 RNA, VGAM1673 RNA and VGAM1674 RNA, herein schematically represented by VGAM1 RNA through VGAM3 RNA, each of which VGAM RNAs corresponding to VGAM RNA of FIG. 1.

VGAM1672 RNA, herein schematically represented by VGAM1 RNA through VGAM3 RNA, binds complementarily to a host target binding site located in an untranslated region of VGAM1672 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1672 host target RNA into VGAM1672 host target protein, herein schematically represented by VGAM1 HOST TARGET PROTEIN through VGAM3 HOST TARGET PROTEIN, all of FIG. 1.

VGAM1673 RNA, herein schematically represented by VGAM1 RNA through VGAM3 RNA, binds complementarily to a host target binding site located in an untranslated region of VGAM1673 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1673 host target RNA into VGAM1673 host target protein, herein schematically represented by VGAM1 HOST TARGET PROTEIN through VGAM3 HOST TARGET PROTEIN, all of FIG. 1.

VGAM1674 RNA, herein schematically represented by VGAM1 RNA through VGAM3 RNA, binds complementarily to a host target binding site located in an untranslated region of VGAM1674 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1674 host target RNA into VGAM1674 host target protein, herein schematically represented by VGAM1 HOST TARGET PROTEIN through VGAM3 HOST TARGET PROTEIN, all of FIG. 1.

It is appreciated that a function of VGR3100 gene, herein designated VGR GENE, is inhibition of expression of host target genes, as part of a novel viral mechanism of attacking a host. Accordingly, utilities of VGR3100 gene include diagnosis, prevention and treatment of viral infection by Tick-borne Encephalitis Virus. Specific functions, and accordingly utilities, of VGR3100 gene correlate with, and may be deduced from, the identity of the host target genes, which are inhibited by VGAM RNAs comprised in the 'operon-like' cluster of VGR3100 gene: VGAM1672 host target protein, VGAM1673 host target protein and VGAM1674 host target protein, herein schematically represented by VGAM1 HOST TARGET PROTEIN through VGAM3 HOST TARGET PROTEIN. The function of these host target genes is elaborated hereinabove with reference to VGAM1672, VGAM1673 and VGAM1674. FIG. 9 further provides a conceptual description of novel bioinformatically detected regulatory viral gene, referred to here as Viral Genomic Record 3101(VGR3101) viral gene, which encodes an 'operon-like' cluster of novel viral micro RNA-like genes, each of which in turn modulates expression of at least one host target gene, the function and utility of which at least one host target gene is known in the art.

VGR3101 gene, herein designated VGR GENE, is a novel bioinformatically detected regulatory, non protein coding, RNA viral gene. The method by which VGR3101 gene was detected is described hereinabove with reference to FIGS. 1-9.

VGR3101 gene encodes VGR3101 precursor RNA, herein designated VGR PRECURSOR RNA, an RNA molecule, typically several hundred nucleotides long.

VGR3101 precursor RNA folds spatially, forming VGR3101 folded precursor RNA, herein designated VGR FOLDED PRECURSOR RNA. It is appreciated that VGR3101 folded precursor RNA comprises a plurality of what is known in the art as 'hairpin' structures. These 'hairpin' structures are due to the fact that the nucleotide sequence of VGR3101 precursor RNA comprises a plurality of segments, the first half of each such segment having a nucleotide sequence which is at least a partial inversed-reversed sequence of the second half thereof, as is well known in the art.

VGR3101 folded precursor RNA is naturally processed by cellular enzymatic activity into at least 6 separate VGAM precursor RNAs, VGAM1675 precursor RNA, VGAM1676 precursor RNA, VGAM1677 precursor RNA, VGAM1678 precursor RNA, VGAM1679 precursor RNA and VGAM1680 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1675 RNA, VGAM1676 RNA, VGAM1677 RNA, VGAM1678 RNA, VGAM1679 RNA and VGAM1680 RNA, herein schematically represented by VGAM1 RNA through VGAM3 RNA, each of which VGAM RNAs corresponding to VGAM RNA of FIG. 1.

VGAM1675 RNA, herein schematically represented by VGAM1 RNA through VGAM3 RNA, binds complementarily to a host target binding site located in an untranslated region of VGAM1675 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1675 host target RNA into VGAM1675 host target protein, herein schematically represented by VGAM1 HOST TARGET PROTEIN through VGAM3 HOST TARGET PROTEIN, all of FIG. 1.

VGAM1676 RNA, herein schematically represented by VGAM1 RNA through VGAM3 RNA, binds complementarily to a host target binding site located in an untranslated region of VGAM1676 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1676 host target RNA into VGAM1676 host target protein, herein schematically represented by VGAM1 HOST TARGET PROTEIN through VGAM3 HOST TARGET PROTEIN, all of FIG. 1.

VGAM1677 RNA, herein schematically represented by VGAM1 RNA through VGAM3 RNA, binds complementarily to a host target binding site located in an untranslated region of VGAM1677 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1677 host target RNA into VGAM1677 host target protein, herein schematically represented by VGAM1 HOST TARGET PROTEIN through VGAM3 HOST TARGET PROTEIN, all of FIG. 1.

VGAM1678 RNA, herein schematically represented by VGAM1 RNA through VGAM3 RNA, binds complementarily to a host target binding site located in an untranslated region of VGAM1678 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1678 host target RNA into VGAM1678 host target protein, herein schematically represented by VGAM1 HOST TARGET PROTEIN through VGAM3 HOST TARGET PROTEIN, all of FIG. 1.

VGAM1679 RNA, herein schematically represented by VGAM1 RNA through VGAM3 RNA, binds complementarily to a host target binding site located in an untranslated region of VGAM1679 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1679 host target RNA into VGAM1679 host target protein, herein schematically represented by VGAM1 HOST TARGET PROTEIN through VGAM3 HOST TARGET PROTEIN, all of FIG. 1.

VGAM1680 RNA, herein schematically represented by VGAM1 RNA through VGAM3 RNA, binds complementarily to a host target binding site located in an untranslated region of VGAM1680 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1680 host target RNA into VGAM1680 host target protein, herein schematically represented by VGAM1 HOST TARGET PROTEIN through VGAM3 HOST TARGET PROTEIN, all of FIG. 1.

It is appreciated that a function of VGR3101 gene, herein designated VGR GENE, is inhibition of expression of host target genes, as part of a novel viral mechanism of attacking a host. Accordingly, utilities of VGR3101 gene include diagnosis, prevention and treatment of viral infection by Viral Hemorrhagic Sep.icemia Virus. Specific functions, and accordingly utilities, of VGR3101 gene correlate with, and may be deduced from, the identity of the host target genes, which are inhibited by VGAM RNAs comprised in the 'operon-like' cluster of VGR3101 gene: VGAM1675 host target protein, VGAM1676 host target protein, VGAM1677 host target protein, VGAM1678 host target protein, VGAM1679 host target protein and VGAM1680 host target protein, herein schematically represented by VGAM1 HOST TARGET PROTEIN through VGAM3 HOST TARGET PROTEIN. The function of these host target genes is elaborated hereinabove with reference to VGAM1675, VGAM1676, VGAM1677, VGAM1678, VGAM1679 and VGAM1680. FIG. 9 further provides a conceptual description of novel bioinformatically detected regulatory viral gene, referred to here as Viral Genomic Record 3102(VGR3102) viral gene, which encodes an 'operon-like' cluster of novel viral micro RNA-like genes, each of which in turn modulates expression of at least one host target gene, the function and utility of which at least one host target gene is known in the art.

VGR3102 gene, herein designated VGR GENE, is a novel bioinformatically detected regulatory, non protein coding, RNA viral gene. The method by which VGR3102 gene was detected is described hereinabove with reference to FIGS. 1-9.

VGR3102 gene encodes VGR3102 precursor RNA, herein designated VGR PRECURSOR RNA, an RNA molecule, typically several hundred nucleotides long.

VGR3102 precursor RNA folds spatially, forming VGR3102 folded precursor RNA, herein designated VGR FOLDED PRECURSOR RNA. It is appreciated that VGR3102 folded precursor RNA comprises a plurality of what is known in the art as 'hairpin' structures. These 'hairpin' structures are due to the fact that the nucleotide sequence of VGR3102 precursor RNA comprises a plurality of segments, the first half of each such segment having a nucleotide sequence which is at least a partial inversed-reversed sequence of the second half thereof, as is well known in the art.

VGR3102 folded precursor RNA is naturally processed by cellular enzymatic activity into at least 6 separate VGAM precursor RNAs, VGAM1681 precursor RNA, VGAM1682 precursor RNA, VGAM1683 precursor RNA, VGAM1684 precursor RNA, VGAM1685 precursor RNA and VGAM1686 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1681 RNA, VGAM1682 RNA, VGAM1683 RNA, VGAM1684 RNA, VGAM1685 RNA and VGAM1686 RNA, herein schematically represented by VGAM1 RNA through VGAM3 RNA, each of which VGAM RNAs corresponding to VGAM RNA of FIG. 1.

VGAM1681 RNA, herein schematically represented by VGAM1 RNA through VGAM3 RNA, binds complementarily to a host target binding site located in an untranslated region of VGAM1681 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1681 host target RNA into VGAM1681 host target protein, herein schematically represented by VGAM1 HOST TARGET PROTEIN through VGAM3 HOST TARGET PROTEIN, all of FIG. 1.

VGAM1682 RNA, herein schematically represented by VGAM1 RNA through VGAM3 RNA, binds complementarily to a host target binding site located in an untranslated region of VGAM1682 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1682 host target RNA into VGAM1682 host target protein, herein schematically represented by VGAM1 HOST TARGET PROTEIN through VGAM3 HOST TARGET PROTEIN, all of FIG. 1.

VGAM1683 RNA, herein schematically represented by VGAM1 RNA through VGAM3 RNA, binds complementarily to a host target binding site located in an untranslated region of VGAM1683 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1683 host target RNA into VGAM1683 host target protein, herein schematically represented by VGAM1 HOST TARGET PROTEIN through VGAM3 HOST TARGET PROTEIN, all of FIG. 1.

VGAM1684 RNA, herein schematically represented by VGAM1 RNA through VGAM3 RNA, binds complementarily to a host target binding site located in an untranslated region of VGAM1684 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1684 host target RNA into VGAM1684 host target protein, herein schematically represented by VGAM1 HOST TARGET PROTEIN through VGAM3 HOST TARGET PROTEIN, all of FIG. 1.

VGAM1685 RNA, herein schematically represented by VGAM1 RNA through VGAM3 RNA, binds complementarily to a host target binding site located in an untranslated region of VGAM1685 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1685 host target RNA into VGAM1685 host target protein, herein schematically represented by VGAM1 HOST TARGET PROTEIN through VGAM3 HOST TARGET PROTEIN, all of FIG. 1.

VGAM1686 RNA, herein schematically represented by VGAM1 RNA through VGAM3 RNA, binds complementarily to a host target binding site located in an untranslated region of VGAM1686 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1686 host target RNA into VGAM1686 host target protein, herein schematically represented by VGAM1 HOST TARGET PROTEIN through VGAM3 HOST TARGET PROTEIN, all of FIG. 1.

It is appreciated that a function of VGR3102 gene, herein designated VGR GENE, is inhibition of expression of host target genes, as part of a novel viral mechanism of attacking a host. Accordingly, utilities of VGR3102 gene include diagnosis, prevention and treatment of viral infection by Vesicular Stomatitis Indiana Virus. Specific functions, and accordingly utilities, of VGR3102 gene correlate with, and may be deduced from, the identity of the host target genes, which are inhibited by VGAM RNAs comprised in the 'operon-like' cluster of VGR3102 gene: VGAM1681 host target protein, VGAM1682 host target protein, VGAM1683 host target protein, VGAM1684 host target protein, VGAM1685 host target protein and VGAM1686 host target protein, herein schematically represented by VGAM1 HOST TARGET PROTEIN through VGAM3 HOST TARGET PROTEIN. The function of these host target genes is elaborated hereinabove with reference to VGAM1681, VGAM1682, VGAM1683, VGAM1684, VGAM1685 and VGAM1686. FIG. 9 further provides a conceptual description of novel bioinformatically detected regulatory viral gene, referred to here as Viral Genomic Record 3103(VGR3103) viral gene, which encodes an 'operon-like' cluster of novel viral micro RNA-like genes, each of which in turn modulates expression of at least one host target gene, the function and utility of which at least one host target gene is known in the art.

VGR3103 gene, herein designated VGR GENE, is a novel bioinformatically detected regulatory, non protein coding, RNA viral gene. The method by which VGR3103 gene was detected is described hereinabove with reference to FIGS. 1-9.

VGR3103 gene encodes VGR3103 precursor RNA, herein designated VGR PRECURSOR RNA, an RNA molecule, typically several hundred nucleotides long.

VGR3103 precursor RNA folds spatially, forming VGR3103 folded precursor RNA, herein designated VGR FOLDED PRECURSOR RNA. It is appreciated that VGR3103 folded precursor RNA comprises a plurality of what is known in the art as 'hairpin' structures. These 'hairpin' structures are due to the fact that the nucleotide sequence of VGR3103 precursor RNA comprises a plurality of segments, the first half of each such segment having a nucleotide sequence which is at least a partial inversed-reversed sequence of the second half thereof, as is well known in the art.

VGR3103 folded precursor RNA is naturally processed by cellular enzymatic activity into at least 3 separate VGAM precursor RNAs, VGAM1687 precursor RNA, VGAM1688 precursor RNA and VGAM1689 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1687 RNA, VGAM1688 RNA and VGAM1689 RNA, herein schematically represented by VGAM1 RNA through VGAM3 RNA, each of which VGAM RNAs corresponding to VGAM RNA of FIG. 1.

VGAM1687 RNA, herein schematically represented by VGAM1 RNA through VGAM3 RNA, binds complementarily to a host target binding site located in an untranslated region of VGAM1687 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1687 host target RNA into VGAM1687 host target protein, herein schematically represented by VGAM1 HOST TARGET PROTEIN through VGAM3 HOST TARGET PROTEIN, all of FIG. 1.

VGAM1688 RNA, herein schematically represented by VGAM1 RNA through VGAM3 RNA, binds complementarily to a host target binding site located in an untranslated region of VGAM1688 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1688 host target RNA into VGAM1688 host target protein, herein schematically represented by VGAM1 HOST TARGET PROTEIN through VGAM3 HOST TARGET PROTEIN, all of FIG. 1.

VGAM1689 RNA, herein schematically represented by VGAM1 RNA through VGAM3 RNA, binds complementarily to a host target binding site located in an untranslated region of VGAM1689 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1689 host target RNA into VGAM1689 host target protein, herein schematically represented by VGAM1 HOST TARGET PROTEIN through VGAM3 HOST TARGET PROTEIN, all of FIG. 1.

It is appreciated that a function of VGR3103 gene, herein designated VGR GENE, is inhibition of expression of host target genes, as part of a novel viral mechanism of attacking a host. Accordingly, utilities of VGR3103 gene include diagnosis, prevention and treatment of viral infection by Chimpanzee Cytomegalovirus. Specific functions, and accordingly utilities, of VGR3103 gene correlate with, and may be deduced from, the identity of the host target genes, which are inhibited by VGAM RNAs comprised in the 'operon-like' cluster of VGR3103 gene: VGAM1687 host target protein, VGAM1688 host target protein and VGAM1689 host target protein, herein schematically represented by VGAM1 HOST TARGET PROTEIN through VGAM3 HOST TARGET PROTEIN. The function of these host target genes is elaborated hereinabove with reference to VGAM1687, VGAM1688 and VGAM1689. FIG. 9 further provides a conceptual description of novel bioinformatically detected regulatory viral gene, referred to here as Viral Genomic Record 3104(VGR3104) viral gene, which encodes an 'operon-like' cluster of novel viral micro RNA-like genes, each of which in turn modulates expression of at least one host target gene, the function and utility of which at least one host target gene is known in the art.

VGR3104 gene, herein designated VGR GENE, is a novel bioinformatically detected regulatory, non protein coding, RNA viral gene. The method by which VGR3104 gene was detected is described hereinabove with reference to FIGS. 1-9.

VGR3104 gene encodes VGR3104 precursor RNA, herein designated VGR PRECURSOR RNA, an RNA molecule, typically several hundred nucleotides long.

VGR3104 precursor RNA folds spatially, forming VGR3104 folded precursor RNA, herein designated VGR FOLDED PRECURSOR RNA. It is appreciated that VGR3104 folded precursor RNA comprises a plurality of what is known in the art as 'hairpin' structures. These 'hairpin' structures are due to the fact that the nucleotide sequence of VGR3104 precursor RNA comprises a plurality of segments, the first half of each such segment having a nucleotide sequence which is at least a partial inversed-reversed sequence of the second half thereof, as is well known in the art.

VGR3104 folded precursor RNA is naturally processed by cellular enzymatic activity into at least 8 separate VGAM precursor RNAs, VGAM1690 precursor RNA, VGAM1691 precursor RNA, VGAM1692 precursor RNA, VGAM1693 precursor RNA, VGAM1694 precursor RNA, VGAM1695 precursor RNA, VGAM1696 precursor RNA and VGAM1697 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1690 RNA, VGAM1691 RNA, VGAM1692 RNA, VGAM1693 RNA, VGAM1694 RNA, VGAM1695 RNA, VGAM1696 RNA and VGAM1697 RNA, herein schematically represented by VGAM1 RNA through VGAM3 RNA, each of which VGAM RNAs corresponding to VGAM RNA of FIG. 1.

VGAM1690 RNA, herein schematically represented by VGAM1 RNA through VGAM3 RNA, binds complementarily to a host target binding site located in an untranslated region of VGAM1690 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1690 host target RNA into VGAM1690 host target protein, herein schematically represented by VGAM1 HOST TARGET PROTEIN through VGAM3 HOST TARGET PROTEIN, all of FIG. 1.

VGAM1691 RNA, herein schematically represented by VGAM1 RNA through VGAM3 RNA, binds complementarily to a host target binding site located in an untranslated region of VGAM1691 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1691 host target RNA into VGAM1691 host target protein, herein schematically represented by VGAM1 HOST TARGET PROTEIN through VGAM3 HOST TARGET PROTEIN, all of FIG. 1.

VGAM1692 RNA, herein schematically represented by VGAM1 RNA through VGAM3 RNA, binds complementarily to a host target binding site located in an untranslated region of VGAM1692 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1692 host target RNA into VGAM1692 host target protein, herein schematically represented by VGAM1 HOST TARGET PROTEIN through VGAM3 HOST TARGET PROTEIN, all of FIG. 1.

VGAM1693 RNA, herein schematically represented by VGAM1 RNA through VGAM3 RNA, binds complementarily to a host target binding site located in an untranslated region of VGAM1693 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1693 host target RNA into VGAM1693 host target protein, herein schematically represented by VGAM1 HOST TARGET PROTEIN through VGAM3 HOST TARGET PROTEIN, all of FIG. 1.

VGAM1694 RNA, herein schematically represented by VGAM1 RNA through VGAM3 RNA, binds complementarily to a host target binding site located in an untranslated region of VGAM1694 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1694 host target RNA into VGAM1694 host target protein, herein schematically represented by VGAM1 HOST TARGET PROTEIN through VGAM3 HOST TARGET PROTEIN, all of FIG. 1.

VGAM1695 RNA, herein schematically represented by VGAM1 RNA through VGAM3 RNA, binds complementarily to a host target binding site located in an untranslated region of VGAM1695 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1695 host target RNA into VGAM1695 host target protein, herein schematically represented by VGAM1 HOST TARGET PROTEIN through VGAM3 HOST TARGET PROTEIN, all of FIG. 1.

VGAM1696 RNA, herein schematically represented by VGAM1 RNA through VGAM3 RNA, binds complementarily to a host target binding site located in an untranslated region of VGAM1696 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1696 host target RNA into VGAM1696 host target protein, herein schematically represented by VGAM1 HOST TARGET PROTEIN through VGAM3 HOST TARGET PROTEIN, all of FIG. 1.

VGAM1697 RNA, herein schematically represented by VGAM1 RNA through VGAM3 RNA, binds complementarily to a host target binding site located in an untranslated region of VGAM1697 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1697 host target RNA into VGAM1697 host target protein, herein schematically represented by VGAM1 HOST TARGET PROTEIN through VGAM3 HOST TARGET PROTEIN, all of FIG. 1.

It is appreciated that a function of VGR3104 gene, herein designated VGR GENE, is inhibition of expression of host target genes, as part of a novel viral mechanism of attacking a host. Accordingly, utilities of VGR3104 gene include diagnosis, prevention and treatment of viral infection by Ectocarpus Siliculosus Virus. Specific functions, and accordingly utilities, of VGR3104 gene correlate with, and may be deduced from, the identity of the host target genes, which are inhibited by VGAM RNAs comprised in the 'operon-like' cluster of VGR3104 gene: VGAM1690 host target protein, VGAM1691 host target protein, VGAM1692 host target protein, VGAM1693 host target protein, VGAM1694 host target protein, VGAM1695 host target protein, VGAM1696 host target protein and VGAM1697 host target protein, herein schematically represented by VGAM1 HOST TARGET PROTEIN through VGAM3 HOST TARGET PROTEIN. The function of these host target genes is elaborated hereinabove with reference to VGAM1690, VGAM1691, VGAM1692, VGAM1693, VGAM1694, VGAM1695, VGAM1696 and VGAM1697. FIG. 9 further provides a conceptual description of novel bioinformatically detected regulatory viral gene, referred to here as Viral Genomic Record 3105(VGR3105) viral gene, which encodes an 'operon-like' cluster of novel viral micro RNA-like genes, each of which in turn modulates expression of at least one host target gene, the function and utility of which at least one host target gene is known in the art.

VGR3105 gene, herein designated VGR GENE, is a novel bioinformatically detected regulatory, non protein coding, RNA viral gene. The method by which VGR3105 gene was detected is described hereinabove with reference to FIGS. 1-9.

VGR3105 gene encodes VGR3105 precursor RNA, herein designated VGR PRECURSOR RNA, an RNA molecule, typically several hundred nucleotides long.

VGR3105 precursor RNA folds spatially, forming VGR3105 folded precursor RNA, herein designated VGR FOLDED PRECURSOR RNA. It is appreciated that VGR3105 folded precursor RNA comprises a plurality of what is known in the art as 'hairpin' structures. These 'hairpin' structures are due to the fact that the nucleotide sequence of VGR3105 precursor RNA comprises a plurality of segments, the first half of each such segment having a nucleotide sequence which is at least a partial inversed-reversed sequence of the second half thereof, as is well known in the art.

VGR3105 folded precursor RNA is naturally processed by cellular enzymatic activity into at least 8 separate VGAM precursor RNAs, VGAM1698 precursor RNA, VGAM1699 precursor RNA, VGAM1700 precursor RNA, VGAM1701 precursor RNA, VGAM1702 precursor RNA, VGAM1703 precursor RNA, VGAM1704 precursor RNA and VGAM1705 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1698 RNA, VGAM1699 RNA, VGAM1700 RNA, VGAM1701 RNA, VGAM1702 RNA, VGAM1703 RNA, VGAM1704 RNA and VGAM1705 RNA, herein schematically represented by VGAM1 RNA through VGAM3 RNA, each of which VGAM RNAs corresponding to VGAM RNA of FIG. 1.

VGAM1698 RNA, herein schematically represented by VGAM1 RNA through VGAM3 RNA, binds complementarily to a host target binding site located in an untranslated region of VGAM1698 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1698 host target RNA into VGAM1698 host target protein, herein schematically represented by VGAM1 HOST TARGET PROTEIN through VGAM3 HOST TARGET PROTEIN, all of FIG. 1.

VGAM1699 RNA, herein schematically represented by VGAM1 RNA through VGAM3 RNA, binds complementarily to a host target binding site located in an untranslated region of VGAM1699 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1699 host target RNA into VGAM1699 host target protein, herein schematically represented by VGAM1 HOST TARGET PROTEIN through VGAM3 HOST TARGET PROTEIN, all of FIG. 1.

VGAM1700 RNA, herein schematically represented by VGAM1 RNA through VGAM3 RNA, binds complementarily to a host target binding site located in an untranslated region of VGAM1700 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1700 host target RNA into VGAM1700 host target protein, herein schematically represented by VGAM1 HOST TARGET PROTEIN through VGAM3 HOST TARGET PROTEIN, all of FIG. 1.

VGAM1701 RNA, herein schematically represented by VGAM1 RNA through VGAM3 RNA, binds complementarily to a host target binding site located in an untranslated region of VGAM1701 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1701 host target RNA into VGAM1701 host target protein, herein schematically represented by VGAM1 HOST TARGET PROTEIN through VGAM3 HOST TARGET PROTEIN, all of FIG. 1.

VGAM1702 RNA, herein schematically represented by VGAM1 RNA through VGAM3 RNA, binds complementarily to a host target binding site located in an untranslated region of VGAM1702 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1702 host target RNA into VGAM1702 host target protein, herein schematically represented by VGAM1 HOST TARGET PROTEIN through VGAM3 HOST TARGET PROTEIN, all of FIG. 1.

VGAM1703 RNA, herein schematically represented by VGAM1 RNA through VGAM3 RNA, binds complementarily to a host target binding site located in an untranslated region of VGAM1703 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1703 host target RNA into VGAM1703 host target protein, herein schematically represented by VGAM1 HOST TARGET PROTEIN through VGAM3 HOST TARGET PROTEIN, all of FIG. 1.

VGAM1704 RNA, herein schematically represented by VGAM1 RNA through VGAM3 RNA, binds complementarily to a host target binding site located in an untranslated region of VGAM1704 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1704 host target RNA into VGAM1704 host target protein, herein schematically represented by VGAM1 HOST TARGET PROTEIN through VGAM3 HOST TARGET PROTEIN, all of FIG. 1.

VGAM1705 RNA, herein schematically represented by VGAM1 RNA through VGAM3 RNA, binds complementarily to a host target binding site located in an untranslated region of VGAM1705 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1705 host target RNA into VGAM1705 host target protein, herein schematically represented by VGAM1 HOST TARGET PROTEIN through VGAM3 HOST TARGET PROTEIN, all of FIG. 1.

It is appreciated that a function of VGR3105 gene, herein designated VGR GENE, is inhibition of expression of host target genes, as part of a novel viral mechanism of attacking a host. Accordingly, utilities of VGR3105 gene include diagnosis, prevention and treatment of viral infection by Ectocarpus Siliculosus Virus. Specific functions, and accordingly utilities, of VGR3105 gene correlate with, and may be deduced from, the identity of the host target genes, which are inhibited by VGAM RNAs comprised in the 'operon-like' cluster of VGR3105 gene: VGAM1698 host target protein, VGAM1699 host target protein, VGAM1700 host target protein, VGAM1701 host target protein, VGAM1702 host target protein, VGAM1703 host target protein, VGAM1704 host target protein and VGAM1705 host target protein, herein schematically represented by VGAM1 HOST TARGET PROTEIN through VGAM3 HOST TARGET PROTEIN. The function of these host target genes is elaborated hereinabove with reference to VGAM1698, VGAM1699, VGAM1700, VGAM1701, VGAM1702, VGAM1703, VGAM1704 and VGAM1705. FIG. 9 further provides a conceptual description of novel bioinformatically detected regulatory viral gene, referred to here as Viral Genomic Record 3106(VGR3106) viral gene, which encodes an 'operon-like' cluster of novel viral micro RNA-like genes, each of which in turn modulates expression of at least one host target gene, the function and utility of which at least one host target gene is known in the art.

VGR3106 gene, herein designated VGR GENE, is a novel bioinformatically detected regulatory, non protein coding, RNA viral gene. The method by which VGR3106 gene was detected is described hereinabove with reference to FIGS. 1-9.

VGR3106 gene encodes VGR3106 precursor RNA, herein designated VGR PRECURSOR RNA, an RNA molecule, typically several hundred nucleotides long.

VGR3106 precursor RNA folds spatially, forming VGR3106 folded precursor RNA, herein designated VGR FOLDED PRECURSOR RNA. It is appreciated that VGR3106 folded precursor RNA comprises a plurality of what is known in the art as 'hairpin' structures. These 'hairpin' structures are due to the fact that the nucleotide sequence of VGR3106 precursor RNA comprises a plurality of segments, the first half of each such segment having a nucleotide sequence which is at least a partial inversed-reversed sequence of the second half thereof, as is well known in the art.

VGR3106 folded precursor RNA is naturally processed by cellular enzymatic activity into at least 2 separate VGAM precursor RNAs, VGAM1706 precursor RNA and VGAM1707 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1706 RNA and VGAM1707 RNA, herein schematically represented by VGAM1 RNA through VGAM3 RNA, each of which VGAM RNAs corresponding to VGAM RNA of FIG. 1.

VGAM1706 RNA, herein schematically represented by VGAM1 RNA through VGAM3 RNA, binds complementarily to a host target binding site located in an untranslated region of VGAM1706 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1706 host target RNA into VGAM1706 host target protein, herein schematically represented by VGAM1 HOST TARGET PROTEIN through VGAM3 HOST TARGET PROTEIN, all of FIG. 1.

VGAM1707 RNA, herein schematically represented by VGAM1 RNA through VGAM3 RNA, binds complementarily to a host target binding site located in an untranslated region of VGAM1707 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1707 host target RNA into VGAM1707 host target protein, herein schematically represented by VGAM1 HOST TARGET PROTEIN through VGAM3 HOST TARGET PROTEIN, all of FIG. 1.

It is appreciated that a function of VGR3106 gene, herein designated VGR GENE, is inhibition of expression of host target genes, as part of a novel viral mechanism of attacking a host. Accordingly, utilities of VGR3106 gene include diagnosis, prevention and treatment of viral infection by Ectocarpus Siliculosus Virus. Specific functions, and accordingly utilities, of VGR3106 gene correlate with, and may be deduced from, the identity of the host target genes, which are inhibited by VGAM RNAs comprised in the 'operon-like' cluster of VGR3106 gene: VGAM1706 host target protein and VGAM1707 host target protein, herein schematically represented by VGAM1 HOST TARGET PROTEIN through VGAM3 HOST TARGET PROTEIN. The function of these host target genes is elaborated hereinabove with reference to VGAM1706 and VGAM1707. FIG. 9 further provides a conceptual description of novel bioinformatically detected regulatory viral gene, referred to here as Viral Genomic Record 3107(VGR3107) viral gene, which encodes an 'operon-like' cluster of novel viral micro RNA-like genes, each of which in turn modulates expression of at least one host target gene, the function and utility of which at least one host target gene is known in the art.

VGR3107 gene, herein designated VGR GENE, is a novel bioinformatically detected regulatory, non protein coding, RNA viral gene. The method by which VGR3107 gene was detected is described hereinabove with reference to FIGS. 1-9.

VGR3107 gene encodes VGR3107 precursor RNA, herein designated VGR PRECURSOR RNA, an RNA molecule, typically several hundred nucleotides long.

VGR3107 precursor RNA folds spatially, forming VGR3107 folded precursor RNA, herein designated VGR FOLDED PRECURSOR RNA. It is appreciated that VGR3107 folded precursor RNA comprises a plurality of what is known in the art as 'hairpin' structures. These 'hairpin' structures are due to the fact that the nucleotide sequence of VGR3107 precursor RNA comprises a plurality of segments, the first half of each such segment having a nucleotide sequence which is at least a partial inversed-reversed sequence of the second half thereof, as is well known in the art.

VGR3107 folded precursor RNA is naturally processed by cellular enzymatic activity into at least 3 separate VGAM precursor RNAs, VGAM1709 precursor RNA, VGAM1710 precursor RNA and VGAM1711 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1709 RNA, VGAM1710 RNA and VGAM1711 RNA, herein schematically represented by VGAM1 RNA through VGAM3 RNA, each of which VGAM RNAs corresponding to VGAM RNA of FIG. 1.

VGAM1709 RNA, herein schematically represented by VGAM1 RNA through VGAM3 RNA, binds complementarily to a host target binding site located in an untranslated region of VGAM1709 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1709 host target RNA into VGAM1709 host target protein, herein schematically represented by VGAM1 HOST TARGET PROTEIN through VGAM3 HOST TARGET PROTEIN, all of FIG. 1.

VGAM1710 RNA, herein schematically represented by VGAM1 RNA through VGAM3 RNA, binds complementarily to a host target binding site located in an untranslated region of VGAM1710 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1710 host target RNA into VGAM1710 host target protein, herein schematically represented by VGAM1 HOST TARGET PROTEIN through VGAM3 HOST TARGET PROTEIN, all of FIG. 1.

VGAM1711 RNA, herein schematically represented by VGAM1 RNA through VGAM3 RNA, binds complementarily to a host target binding site located in an untranslated region of VGAM1711 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1711 host target RNA into VGAM1711 host target protein, herein schematically represented by VGAM1 HOST TARGET PROTEIN through VGAM3 HOST TARGET PROTEIN, all of FIG. 1.

It is appreciated that a function of VGR3107 gene, herein designated VGR GENE, is inhibition of expression of host target genes, as part of a novel viral mechanism of attacking a host. Accordingly, utilities of VGR3107 gene include diagnosis, prevention and treatment of viral infection by Semliki Forest Virus. Specific functions, and accordingly utilities, of VGR3107 gene correlate with, and may be deduced from, the identity of the host target genes, which are inhibited by VGAM RNAs comprised in the 'operon-like' cluster of VGR3107 gene: VGAM1709 host target protein, VGAM1710 host target protein and VGAM1711 host target protein, herein schematically represented by VGAM1 HOST TARGET PROTEIN through VGAM3 HOST TARGET PROTEIN. The function of these host target genes is elaborated hereinabove with reference to VGAM1709, VGAM1710 and VGAM1711. FIG. 9 further provides a conceptual description of novel bioinformatically detected regulatory viral gene, referred to here as Viral Genomic Record 3108(VGR3108) viral gene, which encodes an 'operon-like' cluster of novel viral micro RNA-like genes, each of which in turn modulates expression of at least one host target gene, the function and utility of which at least one host target gene is known in the art.

VGR3108 gene, herein designated VGR GENE, is a novel bioinformatically detected regulatory, non protein coding, RNA viral gene. The method by which VGR3108 gene was detected is described hereinabove with reference to FIGS. 1-9.

VGR3108 gene encodes VGR3108 precursor RNA, herein designated VGR PRECURSOR RNA, an RNA molecule, typically several hundred nucleotides long.

VGR3108 precursor RNA folds spatially, forming VGR3108 folded precursor RNA, herein designated VGR FOLDED PRECURSOR RNA. It is appreciated that VGR3108 folded precursor RNA comprises a plurality of what is known in the art as 'hairpin' structures. These 'hairpin' structures are due to the fact that the nucleotide sequence of VGR3108 precursor RNA comprises a plurality of segments, the first half of each such segment having a nucleotide sequence which is at least a partial inversed-reversed sequence of the second half thereof, as is well known in the art.

VGR3108 folded precursor RNA is naturally processed by cellular enzymatic activity into at least 5 separate VGAM precursor RNAs, VGAM1712 precursor RNA, VGAM1713 precursor RNA, VGAM1714 precursor RNA, VGAM1715 precursor RNA and VGAM1716 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1712 RNA, VGAM1713 RNA, VGAM1714 RNA, VGAM1715 RNA and VGAM1716 RNA, herein schematically represented by VGAM1 RNA through VGAM3 RNA, each of which VGAM RNAs corresponding to VGAM RNA of FIG. 1.

VGAM1712 RNA, herein schematically represented by VGAM1 RNA through VGAM3 RNA, binds complementarily to a host target binding site located in an untranslated region of VGAM1712 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1712 host target RNA into VGAM1712 host target protein, herein schematically represented by VGAM1 HOST TARGET PROTEIN through VGAM3 HOST TARGET PROTEIN, all of FIG. 1.

VGAM1713 RNA, herein schematically represented by VGAM1 RNA through VGAM3 RNA, binds complementarily to a host target binding site located in an untranslated region of VGAM1713 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1713 host target RNA into VGAM1713 host target protein, herein schematically represented by VGAM1 HOST TARGET PROTEIN through VGAM3 HOST TARGET PROTEIN, all of FIG. 1.

VGAM1714 RNA, herein schematically represented by VGAM1 RNA through VGAM3 RNA, binds complementarily to a host target binding site located in an untranslated region of VGAM1714 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1714 host target RNA into VGAM1714 host target protein, herein schematically represented by VGAM1 HOST TARGET PROTEIN through VGAM3 HOST TARGET PROTEIN, all of FIG. 1.

VGAM1715 RNA, herein schematically represented by VGAM1 RNA through VGAM3 RNA, binds complementarily to a host target binding site located in an untranslated region of VGAM1715 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1715 host target RNA into VGAM1715 host target protein, herein schematically represented by VGAM1 HOST TARGET PROTEIN through VGAM3 HOST TARGET PROTEIN, all of FIG. 1.

VGAM1716 RNA, herein schematically represented by VGAM1 RNA through VGAM3 RNA, binds complementarily to a host target binding site located in an untranslated region of VGAM1716 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1716 host target RNA into VGAM1716 host target protein, herein schematically represented by VGAM1 HOST TARGET PROTEIN through VGAM3 HOST TARGET PROTEIN, all of FIG. 1.

It is appreciated that a function of VGR3108 gene, herein designated VGR GENE, is inhibition of expression of host target genes, as part of a novel viral mechanism of attacking a host. Accordingly, utilities of VGR3108 gene include diagnosis, prevention and treatment of viral infection by Sindbis Virus. Specific functions, and accordingly utilities, of VGR3108 gene correlate with, and may be deduced from, the identity of the host target genes, which are inhibited by VGAM RNAs comprised in the 'operon-like' cluster of VGR3108 gene: VGAM1712 host target protein, VGAM1713 host target protein, VGAM1714 host target protein, VGAM1715 host target protein and VGAM1716 host target protein, herein schematically represented by VGAM1 HOST TARGET PROTEIN through VGAM3 HOST TARGET PROTEIN. The function of these host target genes is elaborated hereinabove with reference to VGAM1712, VGAM1713, VGAM1714, VGAM1715 and VGAM1716.

FIG. 9 further provides a conceptual description of novel bioinformatically detected regulatory viral gene, referred to here as Viral Genomic Record 3109(VGR3109) viral gene, which encodes an 'operon-like' cluster of novel viral micro RNA-like genes, each of which in turn modulates expression of at least one host target gene, the function and utility of which at least one host target gene is known in the art.

VGR3109 gene, herein designated VGR GENE, is a novel bioinformatically detected regulatory, non protein coding, RNA viral gene. The method by which VGR3109 gene was detected is described hereinabove with reference to FIGS. 1-9.

VGR3109 gene encodes VGR3109 precursor RNA, herein designated VGR PRECURSOR RNA, an RNA molecule, typically several hundred nucleotides long.

VGR3109 precursor RNA folds spatially, forming VGR3109 folded precursor RNA, herein designated VGR FOLDED PRECURSOR RNA. It is appreciated that VGR3109 folded precursor RNA comprises a plurality of what is known in the art as 'hairpin' structures. These 'hairpin' structures are due to the fact that the nucleotide sequence of VGR3109 precursor RNA comprises a plurality of segments, the first half of each such segment having a nucleotide sequence which is at least a partial inversed-reversed sequence of the second half thereof, as is well known in the art.

VGR3109 folded precursor RNA is naturally processed by cellular enzymatic activity into at least 2 separate VGAM precursor RNAs, VGAM1717 precursor RNA and VGAM1718 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1717 RNA and VGAM1718 RNA, herein schematically represented by VGAM1 RNA through VGAM3 RNA, each of which VGAM RNAs corresponding to VGAM RNA of FIG. 1.

VGAM1717 RNA, herein schematically represented by VGAM1 RNA through VGAM3 RNA, binds complementarily to a host target binding site located in an untranslated region of VGAM1717 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1717 host target RNA into VGAM1717 host target protein, herein schematically represented by VGAM1 HOST TARGET PROTEIN through VGAM3 HOST TARGET PROTEIN, all of FIG. 1.

VGAM1718 RNA, herein schematically represented by VGAM1 RNA through VGAM3 RNA, binds complementarily to a host target binding site located in an untranslated region of VGAM1718 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1718 host target RNA into VGAM1718 host target protein, herein schematically represented by VGAM1 HOST TARGET PROTEIN through VGAM3 HOST TARGET PROTEIN, all of FIG. 1.

It is appreciated that a function of VGR3109 gene, herein designated VGR GENE, is inhibition of expression of host target genes, as part of a novel viral mechanism of attacking a host. Accordingly, utilities of VGR3109 gene include diagnosis, prevention and treatment of viral infection by Molluscum Contagiosum Virus. Specific functions, and accordingly utilities, of VGR3109 gene correlate with, and may be deduced from, the identity of the host target genes, which are inhibited by VGAM RNAs comprised in the 'operon-like' cluster of VGR3109 gene: VGAM1717 host target protein and VGAM1718 host target protein, herein schematically represented by VGAM1 HOST TARGET PROTEIN through VGAM3 HOST TARGET PROTEIN. The function of these host target genes is elaborated hereinabove with reference to VGAM1717 and VGAM1718. FIG. 9 further provides a conceptual description of novel bioinformatically detected regulatory viral gene, referred to here as Viral Genomic Record 3110(VGR3110) viral gene, which encodes an 'operon-like' cluster of novel viral micro RNA-like genes, each of which in turn modulates expression of at least one host target gene, the function and utility of which at least one host target gene is known in the art.

VGR3110 gene, herein designated VGR GENE, is a novel bioinformatically detected regulatory, non protein coding, RNA viral gene. The method by which VGR3110 gene was detected is described hereinabove with reference to FIGS. 1-9.

VGR3110 gene encodes VGR3110 precursor RNA, herein designated VGR PRECURSOR RNA, an RNA molecule, typically several hundred nucleotides long.

VGR3110 precursor RNA folds spatially, forming VGR3110 folded precursor RNA, herein designated VGR FOLDED PRECURSOR RNA. It is appreciated that VGR3110 folded precursor RNA comprises a plurality of what is known in the art as 'hairpin' structures. These 'hairpin' structures are due to the fact that the nucleotide sequence of VGR3110 precursor RNA comprises a plurality of segments, the first half of each such segment having a nucleotide sequence which is at least a partial inversed-reversed sequence of the second half thereof, as is well known in the art.

VGR3110 folded precursor RNA is naturally processed by cellular enzymatic activity into at least 2 separate VGAM precursor RNAs, VGAM1719 precursor RNA and VGAM1720 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1719 RNA and VGAM1720 RNA, herein schematically represented by VGAM1 RNA through VGAM3 RNA, each of which VGAM RNAs corresponding to VGAM RNA of FIG. 1.

VGAM1719 RNA, herein schematically represented by VGAM1 RNA through VGAM3 RNA, binds complementarily to a host target binding site located in an untranslated region of VGAM1719 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1719 host target RNA into VGAM1719 host target protein, herein schematically represented by VGAM1 HOST TARGET PROTEIN through VGAM3 HOST TARGET PROTEIN, all of FIG. 1.

VGAM1720 RNA, herein schematically represented by VGAM1 RNA through VGAM3 RNA, binds complementarily to a host target binding site located in an untranslated region of VGAM1720 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1720 host target RNA into VGAM1720 host target protein, herein schematically represented by VGAM1 HOST TARGET PROTEIN through VGAM3 HOST TARGET PROTEIN, all of FIG. 1.

It is appreciated that a function of VGR3110 gene, herein designated VGR GENE, is inhibition of expression of host target genes, as part of a novel viral mechanism of attacking a host. Accordingly, utilities of VGR3110 gene include diagnosis, prevention and treatment of viral infection by Rat Cytomegalovirus. Specific functions, and accordingly utilities, of VGR3110 gene correlate with, and may be deduced from, the identity of the host target genes, which are inhibited by VGAM RNAs comprised in the 'operon-like' cluster of VGR3110 gene: VGAM1719 host target protein and VGAM1720 host target protein, herein schematically represented by VGAM1 HOST TARGET PROTEIN through VGAM3 HOST TARGET PROTEIN. The function of these host target genes is elaborated hereinabove with reference to VGAM1719 and VGAM1720. FIG. 9 further provides a conceptual description of novel bioinformatically detected regulatory viral gene, referred to here as Viral Genomic Record 3111(VGR3111) viral gene, which encodes an 'operon-like' cluster of novel viral micro RNA-like genes, each of which in turn modulates expression of at least one host target gene, the function and utility of which at least one host target gene is known in the art.

VGR3111 gene, herein designated VGR GENE, is a novel bioinformatically detected regulatory, non protein coding, RNA viral gene. The method by which VGR3111 gene was detected is described hereinabove with reference to FIGS. 1-9.

VGR3111 gene encodes VGR3111 precursor RNA, herein designated VGR PRECURSOR RNA, an RNA molecule, typically several hundred nucleotides long.

VGR3111 precursor RNA folds spatially, forming VGR3111 folded precursor RNA, herein designated VGR FOLDED PRECURSOR RNA. It is appreciated that VGR3111 folded precursor RNA comprises a plurality of what is known in the art as 'hairpin' structures. These 'hairpin' structures are due to the fact that the nucleotide sequence of VGR3111 precursor RNA comprises a plurality of segments, the first half of each such segment having a nucleotide sequence which is at least a partial inversed-reversed sequence of the second half thereof, as is well known in the art.

VGR3111 folded precursor RNA is naturally processed by cellular enzymatic activity into at least 3 separate VGAM precursor RNAs, VGAM1721 precursor RNA, VGAM1722 precursor RNA and VGAM1723 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1721 RNA, VGAM1722 RNA and VGAM1723 RNA, herein schematically represented by VGAM1 RNA through VGAM3 RNA, each of which VGAM RNAs corresponding to VGAM RNA of FIG. 1.

VGAM1721 RNA, herein schematically represented by VGAM1 RNA through VGAM3 RNA, binds complementarily to a host target binding site located in an untranslated region of VGAM1721 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1721 host target RNA into VGAM1721 host target protein, herein schematically represented by VGAM1 HOST TARGET PROTEIN through VGAM3 HOST TARGET PROTEIN, all of FIG. 1.

VGAM1722 RNA, herein schematically represented by VGAM1 RNA through VGAM3 RNA, binds complementarily to a host target binding site located in an untranslated region of VGAM1722 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1722 host target RNA into VGAM1722 host target protein, herein schematically represented by VGAM1 HOST TARGET PROTEIN through VGAM3 HOST TARGET PROTEIN, all of FIG. 1.

VGAM1723 RNA, herein schematically represented by VGAM1 RNA through VGAM3 RNA, binds complementarily to a host target binding site located in an untranslated region of VGAM1723 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1723 host target RNA into VGAM1723 host target protein, herein schematically represented by VGAM1 HOST TARGET PROTEIN through VGAM3 HOST TARGET PROTEIN, all of FIG. 1.

It is appreciated that a function of VGR3111 gene, herein designated VGR GENE, is inhibition of expression of host target genes, as part of a novel viral mechanism of attacking a host. Accordingly, utilities of VGR3111 gene include diagnosis, prevention and treatment of viral infection by Myxoma Virus. Specific functions, and accordingly utilities, of VGR3111 gene correlate with, and may be deduced from, the identity of the host target genes, which are inhibited by VGAM RNAs comprised in the 'operon-like' cluster of VGR3111 gene: VGAM1721 host target protein, VGAM1722 host target protein and VGAM1723 host target protein, herein schematically represented by VGAM1 HOST TARGET PROTEIN through VGAM3 HOST TARGET PROTEIN. The function of these host target genes is elaborated hereinabove with reference to VGAM1721, VGAM1722 and VGAM1723. FIG. 9 further provides a conceptual description of novel bioinformatically detected regulatory viral gene, referred to here as Viral Genomic Record 3112(VGR3112) viral gene, which encodes an 'operon-like' cluster of novel viral micro RNA-like genes, each of which in turn modulates expression of at least one host target gene, the function and utility of which at least one host target gene is known in the art.

VGR3112 gene, herein designated VGR GENE, is a novel bioinformatically detected regulatory, non protein coding, RNA viral gene. The method by which VGR3112 gene was detected is described hereinabove with reference to FIGS. 1-9.

VGR3112 gene encodes VGR3112 precursor RNA, herein designated VGR PRECURSOR RNA, an RNA molecule, typically several hundred nucleotides long.

VGR3112 precursor RNA folds spatially, forming VGR3112 folded precursor RNA, herein designated VGR FOLDED PRECURSOR RNA. It is appreciated that VGR3112 folded precursor RNA comprises a plurality of what is known in the art as 'hairpin' structures. These 'hairpin' structures are due to the fact that the nucleotide sequence of VGR3112 precursor RNA comprises a plurality of segments, the first half of each such segment having a nucleotide sequence which is at least a partial inversed-reversed sequence of the second half thereof, as is well known in the art.

VGR3112 folded precursor RNA is naturally processed by cellular enzymatic activity into at least 7 separate VGAM precursor RNAs, VGAM1724 precursor RNA, VGAM1725 precursor RNA, VGAM1726 precursor RNA, VGAM1727 precursor RNA, VGAM1728 precursor RNA, VGAM1729 precursor RNA and VGAM1730 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1724 RNA, VGAM1725 RNA, VGAM1726 RNA, VGAM1727 RNA, VGAM1728 RNA, VGAM1729 RNA and VGAM1730 RNA, herein schematically represented by VGAM1 RNA through VGAM3 RNA, each of which VGAM RNAs corresponding to VGAM RNA of FIG. 1.

VGAM1724 RNA, herein schematically represented by VGAM1 RNA through VGAM3 RNA, binds complementarily to a host target binding site located in an untranslated region of VGAM1724 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1724 host target RNA into VGAM1724 host target protein, herein schematically represented by VGAM1 HOST TARGET PROTEIN through VGAM3 HOST TARGET PROTEIN, all of FIG. 1.

VGAM1725 RNA, herein schematically represented by VGAM1 RNA through VGAM3 RNA, binds complementarily to a host target binding site located in an untranslated region of VGAM1725 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1725 host target RNA into VGAM1725 host target protein, herein schematically represented by VGAM1 HOST TARGET PROTEIN through VGAM3 HOST TARGET PROTEIN, all of FIG. 1.

VGAM1726 RNA, herein schematically represented by VGAM1 RNA through VGAM3 RNA, binds complementarily to a host target binding site located in an untranslated region of VGAM1726 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1726 host target RNA into VGAM1726 host target protein, herein schematically represented by VGAM1 HOST TARGET PROTEIN through VGAM3 HOST TARGET PROTEIN, all of FIG. 1.

VGAM1727 RNA, herein schematically represented by VGAM1 RNA through VGAM3 RNA, binds complementarily to a host target binding site located in an untranslated region of VGAM1727 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1727 host target RNA into VGAM1727 host target protein, herein schematically represented by VGAM1 HOST TARGET PROTEIN through VGAM3 HOST TARGET PROTEIN, all of FIG. 1.

VGAM1728 RNA, herein schematically represented by VGAM1 RNA through VGAM3 RNA, binds complementarily to a host target binding site located in an untranslated region of VGAM1728 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1728 host target RNA into VGAM1728 host target protein, herein schematically represented by VGAM1 HOST TARGET PROTEIN through VGAM3 HOST TARGET PROTEIN, all of FIG. 1.

VGAM1729 RNA, herein schematically represented by VGAM1 RNA through VGAM3 RNA, binds complementarily to a host target binding site located in an untranslated region of VGAM1729 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1729 host target RNA into VGAM1729 host target protein, herein schematically represented by VGAM1 HOST TARGET PROTEIN through VGAM3 HOST TARGET PROTEIN, all of FIG. 1.

VGAM1730 RNA, herein schematically represented by VGAM1 RNA through VGAM3 RNA, binds complementarily to a host target binding site located in an untranslated region of VGAM1730 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1730 host target RNA into VGAM1730 host target protein, herein schematically represented by VGAM1 HOST TARGET PROTEIN through VGAM3 HOST TARGET PROTEIN, all of FIG. 1.

It is appreciated that a function of VGR3112 gene, herein designated VGR GENE, is inhibition of expression of host target genes, as part of a novel viral mechanism of attacking a host. Accordingly, utilities of VGR3112 gene include diagnosis, prevention and treatment of viral infection by Rabies Virus. Specific functions, and accordingly utilities, of VGR3112 gene correlate with, and may be deduced from, the identity of the host target genes, which are inhibited by VGAM RNAs comprised in the 'operon-like' cluster of VGR3112 gene: VGAM1724 host target protein, VGAM1725 host target protein, VGAM1726 host target protein, VGAM1727 host target protein, VGAM1728 host target protein, VGAM1729 host target protein and VGAM1730 host target protein, herein schematically represented by VGAM1 HOST TARGET PROTEIN through VGAM3 HOST TARGET PROTEIN. The function of these host target genes is elaborated hereinabove with reference to VGAM1724, VGAM1725, VGAM1726, VGAM1727, VGAM1728, VGAM1729 and VGAM1730. FIG. 9 further provides a conceptual description of novel bioinformatically detected regulatory viral gene, referred to here as Viral Genomic Record 3113(VGR3113) viral gene, which encodes an 'operon-like' cluster of novel viral micro RNA-like genes, each of which in turn modulates expression of at least one host target gene, the function and utility of which at least one host target gene is known in the art.

VGR3113 gene, herein designated VGR GENE, is a novel bioinformatically detected regulatory, non protein coding, RNA viral gene. The method by which VGR3113 gene was detected is described hereinabove with reference to FIGS. 1-9.

VGR3113 gene encodes VGR3113 precursor RNA, herein designated VGR PRECURSOR RNA, an RNA molecule, typically several hundred nucleotides long.

VGR3113 precursor RNA folds spatially, forming VGR3113 folded precursor RNA, herein designated VGR FOLDED PRECURSOR RNA. It is appreciated that VGR3113 folded precursor RNA comprises a plurality of what is known in the art as 'hairpin' structures. These 'hairpin' structures are due to the fact that the nucleotide sequence of VGR3113 precursor RNA comprises a plurality of segments, the first half of each such segment having a nucleotide sequence which is at least a partial inversed-reversed sequence of the second half thereof, as is well known in the art.

VGR3113 folded precursor RNA is naturally processed by cellular enzymatic activity into at least 2 separate VGAM precursor RNAs, VGAM1731 precursor RNA and VGAM1732 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1731 RNA and VGAM1732 RNA, herein schematically represented by VGAM1 RNA through VGAM3 RNA, each of which VGAM RNAs corresponding to VGAM RNA of FIG. 1.

VGAM1731 RNA, herein schematically represented by VGAM1 RNA through VGAM3 RNA, binds complementarily to a host target binding site located in an untranslated region of VGAM1731 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1731 host target RNA into VGAM1731 host target protein, herein schematically represented by VGAM1 HOST TARGET PROTEIN through VGAM3 HOST TARGET PROTEIN, all of FIG. 1.

VGAM1732 RNA, herein schematically represented by VGAM1 RNA through VGAM3 RNA, binds complementarily to a host target binding site located in an untranslated region of VGAM1732 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1732 host target RNA into VGAM1732 host target protein, herein schematically represented by VGAM1 HOST TARGET PROTEIN through VGAM3 HOST TARGET PROTEIN, all of FIG. 1.

It is appreciated that a function of VGR3113 gene, herein designated VGR GENE, is inhibition of expression of host target genes, as part of a novel viral mechanism of attacking a host. Accordingly, utilities of VGR3113 gene include diagnosis, prevention and treatment of viral infection by Rabies Virus. Specific functions, and accordingly utilities, of VGR3113 gene correlate with, and may be deduced from, the identity of the host target genes, which are inhibited by VGAM RNAs comprised in the 'operon-like' cluster of VGR3113 gene: VGAM1731 host target protein and VGAM1732 host target protein, herein schematically represented by VGAM1 HOST TARGET PROTEIN through VGAM3 HOST TARGET PROTEIN. The function of these host target genes is elaborated hereinabove with reference to VGAM1731 and VGAM1732. FIG. 9 further provides a conceptual description of novel bioinformatically detected regulatory viral gene, referred to here as Viral Genomic Record 3114(VGR3114) viral gene, which encodes an 'operon-like' cluster of novel viral micro RNA-like genes, each of which in turn modulates expression of at least one host target gene, the function and utility of which at least one host target gene is known in the art.

VGR3114 gene, herein designated VGR GENE, is a novel bioinformatically detected regulatory, non protein coding, RNA viral gene. The method by which VGR3114 gene was detected is described hereinabove with reference to FIGS. 1-9.

VGR3114 gene encodes VGR3114 precursor RNA, herein designated VGR PRECURSOR RNA, an RNA molecule, typically several hundred nucleotides long.

VGR3114 precursor RNA folds spatially, forming VGR3114 folded precursor RNA, herein designated VGR FOLDED PRECURSOR RNA. It is appreciated that VGR3114 folded precursor RNA comprises a plurality of what is known in the art as 'hairpin' structures. These 'hairpin' structures are due to the fact that the nucleotide sequence of VGR3114 precursor RNA comprises a plurality of segments, the first half of each such segment having a nucleotide sequence which is at least a partial inversed-reversed sequence of the second half thereof, as is well known in the art.

VGR3114 folded precursor RNA is naturally processed by cellular enzymatic activity into at least 8 separate VGAM precursor RNAs, VGAM1733 precursor RNA, VGAM1734 precursor RNA, VGAM1735 precursor RNA, VGAM1736 precursor RNA, VGAM1737 precursor RNA, VGAM1738 precursor RNA, VGAM1739 precursor RNA and VGAM1740 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1733 RNA, VGAM1734 RNA, VGAM1735 RNA, VGAM1736 RNA, VGAM1737 RNA, VGAM1738 RNA, VGAM1739 RNA and VGAM1740 RNA, herein schematically represented by VGAM1 RNA through VGAM3 RNA, each of which VGAM RNAs corresponding to VGAM RNA of FIG. 1.

VGAM1733 RNA, herein schematically represented by VGAM1 RNA through VGAM3 RNA, binds complementarily to a host target binding site located in an untranslated region of VGAM1733 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1733 host target RNA into VGAM1733 host target protein, herein schematically represented by VGAM1 HOST TARGET PROTEIN through VGAM3 HOST TARGET PROTEIN, all of FIG. 1.

VGAM1734 RNA, herein schematically represented by VGAM1 RNA through VGAM3 RNA, binds complementarily to a host target binding site located in an untranslated region of VGAM1734 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1734 host target RNA into VGAM1734 host target protein, herein schematically represented by VGAM1 HOST TARGET PROTEIN through VGAM3 HOST TARGET PROTEIN, all of FIG. 1.

VGAM1735 RNA, herein schematically represented by VGAM1 RNA through VGAM3 RNA, binds complementarily to a host target binding site located in an untranslated region of VGAM1735 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1735 host target RNA into VGAM1735 host target protein, herein schematically represented by VGAM1 HOST TARGET PROTEIN through VGAM3 HOST TARGET PROTEIN, all of FIG. 1.

VGAM1736 RNA, herein schematically represented by VGAM1 RNA through VGAM3 RNA, binds complementarily to a host target binding site located in an untranslated region of VGAM1736 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1736 host target RNA into VGAM1736 host target protein, herein schematically represented by VGAM1 HOST TARGET PROTEIN through VGAM3 HOST TARGET PROTEIN, all of FIG. 1.

VGAM1737 RNA, herein schematically represented by VGAM1 RNA through VGAM3 RNA, binds complementarily to a host target binding site located in an untranslated region of VGAM1737 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1737 host target RNA into VGAM1737 host target protein, herein schematically represented by VGAM1 HOST TARGET PROTEIN through VGAM3 HOST TARGET PROTEIN, all of FIG. 1.

VGAM1738 RNA, herein schematically represented by VGAM1 RNA through VGAM3 RNA, binds complementarily to a host target binding site located in an untranslated region of VGAM1738 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1738 host target RNA into VGAM1738 host target protein, herein schematically represented by VGAM1 HOST TARGET PROTEIN through VGAM3 HOST TARGET PROTEIN, all of FIG. 1.

VGAM1739 RNA, herein schematically represented by VGAM1 RNA through VGAM3 RNA, binds complementarily to a host target binding site located in an untranslated region of VGAM1739 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1739 host target RNA into VGAM1739 host target protein, herein schematically represented by VGAM1 HOST TARGET PROTEIN through VGAM3 HOST TARGET PROTEIN, all of FIG. 1.

VGAM1740 RNA, herein schematically represented by VGAM1 RNA through VGAM3 RNA, binds complementarily to a host target binding site located in an untranslated region of VGAM1740 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1740 host target RNA into VGAM1740 host target protein, herein schematically represented by VGAM1 HOST TARGET PROTEIN through VGAM3 HOST TARGET PROTEIN, all of FIG. 1.

It is appreciated that a function of VGR3114 gene, herein designated VGR GENE, is inhibition of expression of host target genes, as part of a novel viral mechanism of attacking a host. Accordingly, utilities of VGR3114 gene include diagnosis, prevention and treatment of viral infection by Human Herpesvirus 3. Specific functions, and accordingly utilities, of VGR3114 gene correlate with, and may be deduced from, the identity of the host target genes, which are inhibited by VGAM RNAs comprised in the 'operon-like' cluster of VGR3114 gene: VGAM1733 host target protein, VGAM1734 host target protein, VGAM1735 host target protein, VGAM1736 host target protein, VGAM1737 host target protein, VGAM1738 host target protein, VGAM1739 host target protein and VGAM1740 host target protein, herein schematically represented by VGAM1 HOST TARGET PROTEIN through VGAM3 HOST TARGET PROTEIN. The function of these host target genes is elaborated hereinabove with reference to VGAM1733, VGAM1734, VGAM1735, VGAM1736, VGAM1737, VGAM1738, VGAM1739 and VGAM1740. FIG. 9 further provides a conceptual description of novel bioinformatically detected regulatory viral gene, referred to here as Viral Genomic Record 3115(VGR3115) viral gene, which encodes an 'operon-like' cluster of novel viral micro RNA-like genes, each of which in turn modulates expression of at least one host target gene, the function and utility of which at least one host target gene is known in the art.

VGR3115 gene, herein designated VGR GENE, is a novel bioinformatically detected regulatory, non protein coding, RNA viral gene. The method by which VGR3115 gene was detected is described hereinabove with reference to FIGS. 1-9.

VGR3115 gene encodes VGR3115 precursor RNA, herein designated VGR PRECURSOR RNA, an RNA molecule, typically several hundred nucleotides long.

VGR3115 precursor RNA folds spatially, forming VGR3115 folded precursor RNA, herein designated VGR FOLDED PRECURSOR RNA. It is appreciated that VGR3115 folded precursor RNA comprises a plurality of what is known in the art as 'hairpin' structures. These 'hairpin' structures are due to the fact that the nucleotide sequence of VGR3115 precursor RNA comprises a plurality of segments, the first half of each such segment having a nucleotide sequence which is at least a partial inversed-reversed sequence of the second half thereof, as is well known in the art.

VGR3115 folded precursor RNA is naturally processed by cellular enzymatic activity into at least 6 separate VGAM precursor RNAs, VGAM1741 precursor RNA, VGAM1742 precursor RNA, VGAM1743 precursor RNA, VGAM1744 precursor RNA, VGAM1745 precursor RNA and VGAM1746 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1741 RNA, VGAM1742 RNA, VGAM1743 RNA, VGAM1744 RNA, VGAM1745 RNA and VGAM1746 RNA, herein schematically represented by VGAM1 RNA through VGAM3 RNA, each of which VGAM RNAs corresponding to VGAM RNA of FIG. 1.

VGAM1741 RNA, herein schematically represented by VGAM1 RNA through VGAM3 RNA, binds complementarily to a host target binding site located in an untranslated region of VGAM1741 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1741 host target RNA into VGAM1741 host target protein, herein schematically represented by VGAM1 HOST TARGET PROTEIN through VGAM3 HOST TARGET PROTEIN, all of FIG. 1.

VGAM1742 RNA, herein schematically represented by VGAM1 RNA through VGAM3 RNA, binds complementarily to a host target binding site located in an untranslated region of VGAM1742 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1742 host target RNA into VGAM1742 host target protein, herein schematically represented by VGAM1 HOST TARGET PROTEIN through VGAM3 HOST TARGET PROTEIN, all of FIG. 1.

VGAM1743 RNA, herein schematically represented by VGAM1 RNA through VGAM3 RNA, binds complementarily to a host target binding site located in an untranslated region of VGAM1743 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1743 host target RNA into VGAM1743 host target protein, herein schematically represented by VGAM1 HOST TARGET PROTEIN through VGAM3 HOST TARGET PROTEIN, all of FIG. 1.

VGAM1744 RNA, herein schematically represented by VGAM1 RNA through VGAM3 RNA, binds complementarily to a host target binding site located in an untranslated region of VGAM1744 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1744 host target RNA into VGAM1744 host target protein, herein schematically represented by VGAM1 HOST TARGET PROTEIN through VGAM3 HOST TARGET PROTEIN, all of FIG. 1.

VGAM1745 RNA, herein schematically represented by VGAM1 RNA through VGAM3 RNA, binds complementarily to a host target binding site located in an untranslated region of VGAM1745 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1745 host target RNA into VGAM1745 host target protein, herein schematically represented by VGAM1 HOST TARGET PROTEIN through VGAM3 HOST TARGET PROTEIN, all of FIG. 1.

VGAM1746 RNA, herein schematically represented by VGAM1 RNA through VGAM3 RNA, binds complementarily to a host target binding site located in an untranslated region of VGAM1746 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1746 host target RNA into VGAM1746 host target protein, herein schematically represented by VGAM1 HOST TARGET PROTEIN through VGAM3 HOST TARGET PROTEIN, all of FIG. 1.

It is appreciated that a function of VGR3115 gene, herein designated VGR GENE, is inhibition of expression of host target genes, as part of a novel viral mechanism of attacking a host. Accordingly, utilities of VGR3115 gene include diagnosis, prevention and treatment of viral infection by Cercopithecine Herpesvirus 7. Specific functions, and accordingly utilities, of VGR3115 gene correlate with, and may be deduced from, the identity of the host target genes, which are inhibited by VGAM RNAs comprised in the 'operon-like' cluster of VGR3115 gene: VGAM1741 host target protein, VGAM1742 host target protein, VGAM1743 host target protein, VGAM1744 host target protein, VGAM1745 host target protein and VGAM1746 host target protein, herein schematically represented by VGAM1 HOST TARGET PROTEIN through VGAM3 HOST TARGET PROTEIN. The function of these host target genes is elaborated hereinabove with reference to VGAM1741, VGAM1742, VGAM1743, VGAM1744, VGAM1745 and VGAM1746. FIG. 9 further provides a conceptual description of novel bioinformatically detected regulatory viral gene, referred to here as Viral Genomic Record 3116(VGR3116) viral gene, which encodes an 'operon-like' cluster of novel viral micro RNA-like genes, each of which in turn modulates expression of at least one host target gene, the function and utility of which at least one host target gene is known in the art.

VGR3116 gene, herein designated VGR GENE, is a novel bioinformatically detected regulatory, non protein coding, RNA viral gene. The method by which VGR3116 gene was detected is described hereinabove with reference to FIGS. 1-9.

VGR3116 gene encodes VGR3116 precursor RNA, herein designated VGR PRECURSOR RNA, an RNA molecule, typically several hundred nucleotides long.

VGR3116 precursor RNA folds spatially, forming VGR3116 folded precursor RNA, herein designated VGR FOLDED PRECURSOR RNA. It is appreciated that VGR3116 folded precursor RNA comprises a plurality of what is known in the art as 'hairpin' structures. These 'hairpin' structures are due to the fact that the nucleotide sequence of VGR3116 precursor RNA comprises a plurality of segments, the first half of each such segment having a nucleotide sequence which is at least a partial inversed-reversed sequence of the second half thereof, as is well known in the art.

VGR3116 folded precursor RNA is naturally processed by cellular enzymatic activity into at least 8 separate VGAM precursor RNAs, VGAM1747 precursor RNA, VGAM1748 precursor RNA, VGAM1749 precursor RNA, VGAM1750 precursor RNA, VGAM1751 precursor RNA, VGAM1752 precursor RNA, VGAM1753 precursor RNA and VGAM1754 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1747 RNA, VGAM1748 RNA, VGAM1749 RNA, VGAM1750 RNA, VGAM1751 RNA, VGAM1752 RNA, VGAM1753 RNA and VGAM1754 RNA, herein schematically represented by VGAM1 RNA through VGAM3 RNA, each of which VGAM RNAs corresponding to VGAM RNA of FIG. 1.

VGAM1747 RNA, herein schematically represented by VGAM1 RNA through VGAM3 RNA, binds complementarily to a host target binding site located in an untranslated region of VGAM1747 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1747 host target RNA into VGAM1747 host target protein, herein schematically represented by VGAM1 HOST TARGET PROTEIN through VGAM3 HOST TARGET PROTEIN, all of FIG. 1.

VGAM1748 RNA, herein schematically represented by VGAM1 RNA through VGAM3 RNA, binds complementarily to a host target binding site located in an untranslated region of VGAM1748 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1748 host target RNA into VGAM1748 host target protein, herein schematically represented by VGAM1 HOST TARGET PROTEIN through VGAM3 HOST TARGET PROTEIN, all of FIG. 1.

VGAM1749 RNA, herein schematically represented by VGAM1 RNA through VGAM3 RNA, binds complementarily to a host target binding site located in an untranslated region of VGAM1749 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1749 host target RNA into VGAM1749 host target protein, herein schematically represented by VGAM1 HOST TARGET PROTEIN through VGAM3 HOST TARGET PROTEIN, all of FIG. 1.

VGAM1750 RNA, herein schematically represented by VGAM1 RNA through VGAM3 RNA, binds complementarily to a host target binding site located in an untranslated region of VGAM1750 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1750 host target RNA into VGAM1750 host target protein, herein schematically represented by VGAM1 HOST TARGET PROTEIN through VGAM3 HOST TARGET PROTEIN, all of FIG. 1.

VGAM1751 RNA, herein schematically represented by VGAM1 RNA through VGAM3 RNA, binds complementarily to a host target binding site located in an untranslated region of VGAM1751 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1751 host target RNA into VGAM1751 host target protein, herein schematically represented by VGAM1 HOST TARGET PROTEIN through VGAM3 HOST TARGET PROTEIN, all of FIG. 1.

VGAM1752 RNA, herein schematically represented by VGAM1 RNA through VGAM3 RNA, binds complementarily to a host target binding site located in an untranslated region of VGAM1752 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1752 host target RNA into VGAM1752 host target protein, herein schematically represented by VGAM1 HOST TARGET PROTEIN through VGAM3 HOST TARGET PROTEIN, all of FIG. 1.

VGAM1753 RNA, herein schematically represented by VGAM1 RNA through VGAM3 RNA, binds complementarily to a host target binding site located in an untranslated region of VGAM1753 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1753 host target RNA into VGAM1753 host target protein, herein schematically represented by VGAM1 HOST TARGET PROTEIN through VGAM3 HOST TARGET PROTEIN, all of FIG. 1.

VGAM1754 RNA, herein schematically represented by VGAM1 RNA through VGAM3 RNA, binds complementarily to a host target binding site located in an untranslated region of VGAM1754 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1754 host target RNA into VGAM1754 host target protein, herein schematically represented by VGAM1 HOST TARGET PROTEIN through VGAM3 HOST TARGET PROTEIN, all of FIG. 1.

It is appreciated that a function of VGR3116 gene, herein designated VGR GENE, is inhibition of expression of host target genes, as part of a novel viral mechanism of attacking a host. Accordingly, utilities of VGR3116 gene include diagnosis, prevention and treatment of viral infection by Camelpox Virus. Specific functions, and accordingly utilities, of VGR3116 gene correlate with, and may be deduced from, the identity of the host target genes, which are inhibited by VGAM RNAs comprised in the 'operon-like' cluster of VGR3116 gene: VGAM1747 host target protein, VGAM1748 host target protein, VGAM1749 host target protein, VGAM1750 host target protein, VGAM1751 host target protein, VGAM1752 host target protein, VGAM1753 host target protein and VGAM1754 host target protein, herein schematically represented by VGAM1 HOST TARGET PROTEIN through VGAM3 HOST TARGET PROTEIN. The function of these host target genes is elaborated hereinabove with reference to VGAM1747, VGAM1748, VGAM1749, VGAM1750, VGAM1751, VGAM1752, VGAM1753 and VGAM1754. FIG. 9 further provides a conceptual description of novel bioinformatically detected regulatory viral gene, referred to here as Viral Genomic Record 3117(VGR3117) viral gene, which encodes an 'operon-like' cluster of novel viral micro RNA-like genes, each of which in turn modulates expression of at least one host target gene, the function and utility of which at least one host target gene is known in the art.

VGR3117 gene, herein designated VGR GENE, is a novel bioinformatically detected regulatory, non protein coding, RNA viral gene. The method by which VGR3117 gene was detected is described hereinabove with reference to FIGS. 1-9.

VGR3117 gene encodes VGR3117 precursor RNA, herein designated VGR PRECURSOR RNA, an RNA molecule, typically several hundred nucleotides long.

VGR3117 precursor RNA folds spatially, forming VGR3117 folded precursor RNA, herein designated VGR FOLDED PRECURSOR RNA. It is appreciated that VGR3117 folded precursor RNA comprises a plurality of what is known in the art as 'hairpin' structures. These 'hairpin' structures are due to the fact that the nucleotide sequence of VGR3117 precursor RNA comprises a plurality of segments, the first half of each such segment having a nucleotide sequence which is at least a partial inversed-reversed sequence of the second half thereof, as is well known in the art.

VGR3117 folded precursor RNA is naturally processed by cellular enzymatic activity into at least 4 separate VGAM precursor RNAs, VGAM1755 precursor RNA, VGAM1756 precursor RNA, VGAM1757 precursor RNA and VGAM1758 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1755 RNA, VGAM1756 RNA, VGAM1757 RNA and VGAM1758 RNA, herein schematically represented by VGAM1 RNA through VGAM3 RNA, each of which VGAM RNAs corresponding to VGAM RNA of FIG. 1.

VGAM1755 RNA, herein schematically represented by VGAM1 RNA through VGAM3 RNA, binds complementarily to a host target binding site located in an untranslated region of VGAM1755 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1755 host target RNA into VGAM1755 host target protein, herein schematically represented by VGAM1 HOST TARGET PROTEIN through VGAM3 HOST TARGET PROTEIN, all of FIG. 1.

VGAM1756 RNA, herein schematically represented by VGAM1 RNA through VGAM3 RNA, binds complementarily to a host target binding site located in an untranslated region of VGAM1756 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1756 host target RNA into VGAM1756 host target protein, herein schematically represented by VGAM1 HOST TARGET PROTEIN through VGAM3 HOST TARGET PROTEIN, all of FIG. 1.

VGAM1757 RNA, herein schematically represented by VGAM1 RNA through VGAM3 RNA, binds complementarily to a host target binding site located in an untranslated region of VGAM1757 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1757 host target RNA into VGAM1757 host target protein, herein schematically represented by VGAM1 HOST TARGET PROTEIN through VGAM3 HOST TARGET PROTEIN, all of FIG. 1.

VGAM1758 RNA, herein schematically represented by VGAM1 RNA through VGAM3 RNA, binds complementarily to a host target binding site located in an untranslated region of VGAM1758 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1758 host target RNA into VGAM1758 host target protein, herein schematically represented by VGAM1 HOST TARGET PROTEIN through VGAM3 HOST TARGET PROTEIN, all of FIG. 1.

It is appreciated that a function of VGR3117 gene, herein designated VGR GENE, is inhibition of expression of host target genes, as part of a novel viral mechanism of attacking a host. Accordingly, utilities of VGR3117 gene include diagnosis, prevention and treatment of viral infection by Camelpox Virus. Specific functions, and accordingly utilities, of VGR3117 gene correlate with, and may be deduced from, the identity of the host target genes, which are inhibited by VGAM RNAs comprised in the 'operon-like' cluster of VGR3117 gene: VGAM1755 host target protein, VGAM1756 host target protein, VGAM1757 host target protein and VGAM1758 host target protein, herein schematically represented by VGAM1 HOST TARGET PROTEIN through VGAM3 HOST TARGET PROTEIN. The function of these host target genes is elaborated hereinabove with reference to VGAM1755, VGAM1756, VGAM1757 and VGAM1758.

FIG. 9 further provides a conceptual description of novel bioinformatically detected regulatory viral gene, referred to here as Viral Genomic Record 3118(VGR3118) viral gene, which encodes an 'operon-like' cluster of novel viral micro RNA-like genes, each of which in turn modulates expression of at least one host target gene, the function and utility of which at least one host target gene is known in the art.

VGR3118 gene, herein designated VGR GENE, is a novel bioinformatically detected regulatory, non protein coding, RNA viral gene. The method by which VGR3118 gene was detected is described hereinabove with reference to FIGS. 1-9.

VGR3118 gene encodes VGR3118 precursor RNA, herein designated VGR PRECURSOR RNA, an RNA molecule, typically several hundred nucleotides long.

VGR3118 precursor RNA folds spatially, forming VGR3118 folded precursor RNA, herein designated VGR FOLDED PRECURSOR RNA. It is appreciated that VGR3118 folded precursor RNA comprises a plurality of what is known in the art as 'hairpin' structures. These 'hairpin' structures are due to the fact that the nucleotide sequence of VGR3118 precursor RNA comprises a plurality of segments, the first half of each such segment having a nucleotide sequence which is at least a partial inversed-reversed sequence of the second half thereof, as is well known in the art.

VGR3118 folded precursor RNA is naturally processed by cellular enzymatic activity into at least 8 separate VGAM precursor RNAs, VGAM1759 precursor RNA, VGAM1760 precursor RNA, VGAM1761 precursor RNA, VGAM1762 precursor RNA, VGAM1763 precursor RNA, VGAM1764 precursor RNA, VGAM1765 precursor RNA and VGAM1766 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1759 RNA, VGAM1760 RNA, VGAM1761 RNA, VGAM1762 RNA, VGAM1763 RNA, VGAM1764 RNA, VGAM1765 RNA and VGAM1766 RNA, herein schematically represented by VGAM1 RNA through VGAM3 RNA, each of which VGAM RNAs corresponding to VGAM RNA of FIG. 1.

VGAM1759 RNA, herein schematically represented by VGAM1 RNA through VGAM3 RNA, binds complementarily to a host target binding site located in an untranslated region of VGAM1759 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1759 host target RNA into VGAM1759 host target protein, herein schematically represented by VGAM1 HOST TARGET PROTEIN through VGAM3 HOST TARGET PROTEIN, all of FIG. 1.

VGAM1760 RNA, herein schematically represented by VGAM1 RNA through VGAM3 RNA, binds complementarily to a host target binding site located in an untranslated region of VGAM1760 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1760 host target RNA into VGAM1760 host target protein, herein schematically represented by VGAM1 HOST TARGET PROTEIN through VGAM3 HOST TARGET PROTEIN, all of FIG. 1.

VGAM1761 RNA, herein schematically represented by VGAM1 RNA through VGAM3 RNA, binds complementarily to a host target binding site located in an untranslated region of VGAM1761 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1761 host target RNA into VGAM1761 host target protein, herein schematically represented by VGAM1 HOST TARGET PROTEIN through VGAM3 HOST TARGET PROTEIN, all of FIG. 1.

VGAM1762 RNA, herein schematically represented by VGAM1 RNA through VGAM3 RNA, binds complementarily to a host target binding site located in an untranslated region of VGAM1762 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1762 host target RNA into VGAM1762 host target protein, herein schematically represented by VGAM1 HOST TARGET PROTEIN through VGAM3 HOST TARGET PROTEIN, all of FIG. 1.

VGAM1763 RNA, herein schematically represented by VGAM1 RNA through VGAM3 RNA, binds complementarily to a host target binding site located in an untranslated region of VGAM1763 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1763 host target RNA into VGAM1763 host target protein, herein schematically represented by VGAM1 HOST TARGET PROTEIN through VGAM3 HOST TARGET PROTEIN, all of FIG. 1.

VGAM1764 RNA, herein schematically represented by VGAM1 RNA through VGAM3 RNA, binds complementarily to a host target binding site located in an untranslated region of VGAM1764 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1764 host target RNA into VGAM1764 host target protein, herein schematically represented by VGAM1 HOST TARGET PROTEIN through VGAM3 HOST TARGET PROTEIN, all of FIG. 1.

VGAM1765 RNA, herein schematically represented by VGAM1 RNA through VGAM3 RNA, binds complementarily to a host target binding site located in an untranslated region of VGAM1765 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1765 host target RNA into VGAM1765 host target protein, herein schematically represented by VGAM1 HOST TARGET PROTEIN through VGAM3 HOST TARGET PROTEIN, all of FIG. 1.

VGAM1766 RNA, herein schematically represented by VGAM1 RNA through VGAM3 RNA, binds complementarily to a host target binding site located in an untranslated region of VGAM1766 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1766 host target RNA into VGAM1766 host target protein, herein schematically represented by VGAM1 HOST TARGET PROTEIN through VGAM3 HOST TARGET PROTEIN, all of FIG. 1.

It is appreciated that a function of VGR3118 gene, herein designated VGR GENE, is inhibition of expression of host target genes, as part of a novel viral mechanism of attacking a host. Accordingly, utilities of VGR3118 gene include diagnosis, prevention and treatment of viral infection by Bovine Viral Diarrhea Virus Genotype 2 (BVDV-2). Specific functions, and accordingly utilities, of VGR3118 gene correlate with, and may be deduced from, the identity of the host target genes, which are inhibited by VGAM RNAs comprised in the 'operon-like' cluster of VGR3118 gene: VGAM1759 host target protein, VGAM1760 host target protein, VGAM1761 host target protein, VGAM1762 host target protein, VGAM1763 host target protein, VGAM1764 host target protein, VGAM1765 host target protein and VGAM1766 host target protein, herein schematically represented by VGAM1 HOST TARGET PROTEIN through VGAM3 HOST TARGET PROTEIN. The function of these host target genes is elaborated hereinabove with reference to VGAM1759, VGAM1760, VGAM1761, VGAM1762, VGAM1763, VGAM1764, VGAM1765 and VGAM1766. FIG. 9 further provides a conceptual description of novel bioinformatically detected regulatory viral gene, referred to here as Viral Genomic Record 3119(VGR3119) viral gene, which encodes an 'operon-like' cluster of novel viral micro RNA-like genes, each of which in turn modulates expression of at least one host target gene, the function and utility of which at least one host target gene is known in the art.

VGR3119 gene, herein designated VGR GENE, is a novel bioinformatically detected regulatory, non protein coding, RNA viral gene. The method by which VGR3119 gene was detected is described hereinabove with reference to FIGS. 1-9.

VGR3119 gene encodes VGR3119 precursor RNA, herein designated VGR PRECURSOR RNA, an RNA molecule, typically several hundred nucleotides long.

VGR3119 precursor RNA folds spatially, forming VGR3119 folded precursor RNA, herein designated VGR FOLDED PRECURSOR RNA. It is appreciated that VGR3119 folded precursor RNA comprises a plurality of what is known in the art as 'hairpin' structures. These 'hairpin' structures are due to the fact that the nucleotide sequence of VGR3119 precursor RNA comprises a plurality of segments, the first half of each such segment having a nucleotide sequence which is at least a partial inversed-reversed sequence of the second half thereof, as is well known in the art.

VGR3119 folded precursor RNA is naturally processed by cellular enzymatic activity into at least 4 separate VGAM precursor RNAs, VGAM1767 precursor RNA, VGAM1768 precursor RNA, VGAM1769 precursor RNA and VGAM1770 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1767 RNA, VGAM1768 RNA, VGAM1769 RNA and VGAM1770 RNA, herein schematically represented by VGAM1 RNA through VGAM3 RNA, each of which VGAM RNAs corresponding to VGAM RNA of FIG. 1.

VGAM1767 RNA, herein schematically represented by VGAM1 RNA through VGAM3 RNA, binds complementarily to a host target binding site located in an untranslated region of VGAM1767 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1767 host target RNA into VGAM1767 host target protein, herein schematically represented by VGAM1 HOST TARGET PROTEIN through VGAM3 HOST TARGET PROTEIN, all of FIG. 1.

VGAM1768 RNA, herein schematically represented by VGAM1 RNA through VGAM3 RNA, binds complementarily to a host target binding site located in an untranslated region of VGAM1768 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1768 host target RNA into VGAM1768 host target protein, herein schematically represented by VGAM1 HOST TARGET PROTEIN through VGAM3 HOST TARGET PROTEIN, all of FIG. 1.

VGAM1769 RNA, herein schematically represented by VGAM1 RNA through VGAM3 RNA, binds complementarily to a host target binding site located in an untranslated region of VGAM1769 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1769 host target RNA into VGAM1769 host target protein, herein schematically represented by VGAM1 HOST TARGET PROTEIN through VGAM3 HOST TARGET PROTEIN, all of FIG. 1.

VGAM1770 RNA, herein schematically represented by VGAM1 RNA through VGAM3 RNA, binds complementarily to a host target binding site located in an untranslated region of VGAM1770 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1770 host target RNA into VGAM1770 host target protein, herein schematically represented by VGAM1 HOST TARGET PROTEIN through VGAM3 HOST TARGET PROTEIN, all of FIG. 1.

It is appreciated that a function of VGR3119 gene, herein designated VGR GENE, is inhibition of expression of host target genes, as part of a novel viral mechanism of attacking a host. Accordingly, utilities of VGR3119 gene include diagnosis, prevention and treatment of viral infection by Rabbit Fibroma Virus. Specific functions, and accordingly utilities, of VGR3119 gene correlate with, and may be deduced from, the identity of the host target genes, which are inhibited by VGAM RNAs comprised in the 'operon-like' cluster of VGR3119 gene: VGAM1767 host target protein, VGAM1768 host target protein, VGAM1769 host target protein and VGAM1770 host target protein, herein schematically represented by VGAM1 HOST TARGET PROTEIN through VGAM3 HOST TARGET PROTEIN. The function of these host target genes is elaborated hereinabove with reference to VGAM1767, VGAM1768, VGAM1769 and VGAM1770.

FIG. 9 further provides a conceptual description of novel bioinformatically detected regulatory viral gene, referred to here as Viral Genomic Record 3120(VGR3120) viral gene, which encodes an 'operon-like' cluster of novel viral micro RNA-like genes, each of which in turn modulates expression of at least one host target gene, the function and utility of which at least one host target gene is known in the art.

VGR3120 gene, herein designated VGR GENE, is a novel bioinformatically detected regulatory, non protein coding, RNA viral gene. The method by which VGR3120 gene was detected is described hereinabove with reference to FIGS. 1-9.

VGR3120 gene encodes VGR3120 precursor RNA, herein designated VGR PRECURSOR RNA, an RNA molecule, typically several hundred nucleotides long.

VGR3120 precursor RNA folds spatially, forming VGR3120 folded precursor RNA, herein designated VGR FOLDED PRECURSOR RNA. It is appreciated that VGR3120 folded precursor RNA comprises a plurality of what is known in the art as 'hairpin' structures. These 'hairpin' structures are due to the fact that the nucleotide sequence of VGR3120 precursor RNA comprises a plurality of segments, the first half of each such segment having a nucleotide sequence which is at least a partial inversed-reversed sequence of the second half thereof, as is well known in the art.

VGR3120 folded precursor RNA is naturally processed by cellular enzymatic activity into at least 2 separate VGAM precursor RNAs, VGAM1771 precursor RNA and VGAM1772 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1771 RNA and VGAM1772 RNA, herein schematically represented by VGAM1 RNA through VGAM3 RNA, each of which VGAM RNAs corresponding to VGAM RNA of FIG. 1.

VGAM1771 RNA, herein schematically represented by VGAM1 RNA through VGAM3 RNA, binds complementarily to a host target binding site located in an untranslated region of VGAM1771 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1771 host target RNA into VGAM1771 host target protein, herein schematically represented by VGAM1 HOST TARGET PROTEIN through VGAM3 HOST TARGET PROTEIN, all of FIG. 1.

VGAM1772 RNA, herein schematically represented by VGAM1 RNA through VGAM3 RNA, binds complementarily to a host target binding site located in an untranslated region of VGAM1772 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1772 host target RNA into VGAM1772 host target protein, herein schematically represented by VGAM1 HOST TARGET PROTEIN through VGAM3 HOST TARGET PROTEIN, all of FIG. 1.

It is appreciated that a function of VGR3120 gene, herein designated VGR GENE, is inhibition of expression of host target genes, as part of a novel viral mechanism of attacking a host. Accordingly, utilities of VGR3120 gene include diagnosis, prevention and treatment of viral infection by Pestivirus Type 1. Specific functions, and accordingly utilities, of VGR3120 gene correlate with, and may be deduced from, the identity of the host target genes, which are inhibited by VGAM RNAs comprised in the 'operon-like' cluster of VGR3120 gene: VGAM1771 host target protein and VGAM1772 host target protein, herein schematically represented by VGAM1 HOST TARGET PROTEIN through VGAM3 HOST TARGET PROTEIN. The function of these host target genes is elaborated hereinabove with reference to VGAM1771 and VGAM1772. FIG. 9 further provides a conceptual description of novel bioinformatically detected regulatory viral gene, referred to here as Viral Genomic Record 3121(VGR3121) viral gene, which encodes an 'operon-like' cluster of novel viral micro RNA-like genes, each of which in turn modulates expression of at least one host target gene, the function and utility of which at least one host target gene is known in the art.

VGR3121 gene, herein designated VGR GENE, is a novel bioinformatically detected regulatory, non protein coding, RNA viral gene. The method by which VGR3121 gene was detected is described hereinabove with reference to FIGS. 1-9.

VGR3121 gene encodes VGR3121 precursor RNA, herein designated VGR PRECURSOR RNA, an RNA molecule, typically several hundred nucleotides long.

VGR3121 precursor RNA folds spatially, forming VGR3121 folded precursor RNA, herein designated VGR FOLDED PRECURSOR RNA. It is appreciated that VGR3121 folded precursor RNA comprises a plurality of what is known in the art as 'hairpin' structures. These 'hairpin' structures are due to the fact that the nucleotide sequence of VGR3121 precursor RNA comprises a plurality of segments, the first half of each such segment having a nucleotide sequence which is at least a partial inversed-reversed sequence of the second half thereof, as is well known in the art.

VGR3121 folded precursor RNA is naturally processed by cellular enzymatic activity into at least 8 separate VGAM precursor RNAs, VGAM1773 precursor RNA, VGAM1774 precursor RNA, VGAM1775 precursor RNA, VGAM1776 precursor RNA, VGAM1777 precursor RNA, VGAM1778 precursor RNA, VGAM1779 precursor RNA and VGAM1780 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1773 RNA, VGAM1774 RNA, VGAM1775 RNA, VGAM1776 RNA, VGAM1777 RNA, VGAM1778 RNA, VGAM1779 RNA and VGAM1780 RNA, herein schematically represented by VGAM1 RNA through VGAM3 RNA, each of which VGAM RNAs corresponding to VGAM RNA of FIG. 1.

VGAM1773 RNA, herein schematically represented by VGAM1 RNA through VGAM3 RNA, binds complementarily to a host target binding site located in an untranslated region of VGAM1773 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1773 host target RNA into VGAM1773 host target protein, herein schematically represented by VGAM1 HOST TARGET PROTEIN through VGAM3 HOST TARGET PROTEIN, all of FIG. 1.

VGAM1774 RNA, herein schematically represented by VGAM1 RNA through VGAM3 RNA, binds complementarily to a host target binding site located in an untranslated region of VGAM1774 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1774 host target RNA into VGAM1774 host target protein, herein schematically represented by VGAM1 HOST TARGET PROTEIN through VGAM3 HOST TARGET PROTEIN, all of FIG. 1.

VGAM1775 RNA, herein schematically represented by VGAM1 RNA through VGAM3 RNA, binds complementarily to a host target binding site located in an untranslated region of VGAM1775 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1775 host target RNA into VGAM1775 host target protein, herein schematically represented by VGAM1 HOST TARGET PROTEIN through VGAM3 HOST TARGET PROTEIN, all of FIG. 1.

VGAM1776 RNA, herein schematically represented by VGAM1 RNA through VGAM3 RNA, binds complementarily to a host target binding site located in an untranslated region of VGAM1776 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1776 host target RNA into VGAM1776 host target protein, herein schematically represented by VGAM1 HOST TARGET PROTEIN through VGAM3 HOST TARGET PROTEIN, all of FIG. 1.

VGAM1777 RNA, herein schematically represented by VGAM1 RNA through VGAM3 RNA, binds complementarily to a host target binding site located in an untranslated region of VGAM1777 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1777 host target RNA into VGAM1777 host target protein, herein schematically represented by VGAM1 HOST TARGET PROTEIN through VGAM3 HOST TARGET PROTEIN, all of FIG. 1.

VGAM1778 RNA, herein schematically represented by VGAM1 RNA through VGAM3 RNA, binds complementarily to a host target binding site located in an untranslated region of VGAM1778 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1778 host target RNA into VGAM1778 host target protein, herein schematically represented by VGAM1 HOST TARGET PROTEIN through VGAM3 HOST TARGET PROTEIN, all of FIG. 1.

VGAM1779 RNA, herein schematically represented by VGAM1 RNA through VGAM3 RNA, binds complementarily to a host target binding site located in an untranslated region of VGAM1779 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1779 host target RNA into VGAM1779 host target protein, herein schematically represented by VGAM1 HOST TARGET PROTEIN through VGAM3 HOST TARGET PROTEIN, all of FIG. 1.

VGAM1780 RNA, herein schematically represented by VGAM1 RNA through VGAM3 RNA, binds complementarily to a host target binding site located in an untranslated region of VGAM1780 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1780 host target RNA into VGAM1780 host target protein, herein schematically represented by VGAM1 HOST TARGET PROTEIN through VGAM3 HOST TARGET PROTEIN, all of FIG. 1.

It is appreciated that a function of VGR3121 gene, herein designated VGR GENE, is inhibition of expression of host target genes, as part of a novel viral mechanism of attacking a host. Accordingly, utilities of VGR3121 gene include diagnosis, prevention and treatment of viral infection by Cryphonectria Hypovirus 1. Specific functions, and accordingly utilities, of VGR3121 gene correlate with, and may be deduced from, the identity of the host target genes, which are inhibited by VGAM RNAs comprised in the 'operon-like' cluster of VGR3121 gene: VGAM1773 host target protein, VGAM1774 host target protein, VGAM1775 host target protein, VGAM1776 host target protein, VGAM1777 host target protein, VGAM1778 host target protein, VGAM1779 host target protein and VGAM1780 host target protein, herein schematically represented by VGAM1 HOST TARGET PROTEIN through VGAM3 HOST TARGET PROTEIN. The function of these host target genes is elaborated hereinabove with reference to VGAM1773, VGAM1774, VGAM1775, VGAM1776, VGAM1777, VGAM1778, VGAM1779 and VGAM1780. FIG. 9 further provides a conceptual description of novel bioinformatically detected regulatory viral gene, referred to here as Viral Genomic Record 3122(VGR3122) viral gene, which encodes an 'operon-like' cluster of novel viral micro RNA-like genes, each of which in turn modulates expression of at least one host target gene, the function and utility of which at least one host target gene is known in the art.

VGR3122 gene, herein designated VGR GENE, is a novel bioinformatically detected regulatory, non protein coding, RNA viral gene. The method by which VGR3122 gene was detected is described hereinabove with reference to FIGS. 1-9.

VGR3122 gene encodes VGR3122 precursor RNA, herein designated VGR PRECURSOR RNA, an RNA molecule, typically several hundred nucleotides long.

VGR3122 precursor RNA folds spatially, forming VGR3122 folded precursor RNA, herein designated VGR FOLDED PRECURSOR RNA. It is appreciated that VGR3122 folded precursor RNA comprises a plurality of what is known in the art as 'hairpin' structures. These 'hairpin' structures are due to the fact that the nucleotide sequence of VGR3122 precursor RNA comprises a plurality of segments, the first half of each such segment having a nucleotide sequence which is at least a partial inversed-reversed sequence of the second half thereof, as is well known in the art.

VGR3122 folded precursor RNA is naturally processed by cellular enzymatic activity into at least 2 separate VGAM precursor RNAs, VGAM1781 precursor RNA and VGAM1782 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1781 RNA and VGAM1782 RNA, herein schematically represented by VGAM1 RNA through VGAM3 RNA, each of which VGAM RNAs corresponding to VGAM RNA of FIG. 1.

VGAM1781 RNA, herein schematically represented by VGAM1 RNA through VGAM3 RNA, binds complementarily to a host target binding site located in an untranslated region of VGAM1781 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1781 host target RNA into VGAM1781 host target protein, herein schematically represented by VGAM1 HOST TARGET PROTEIN through VGAM3 HOST TARGET PROTEIN, all of FIG. 1.

VGAM1782 RNA, herein schematically represented by VGAM1 RNA through VGAM3 RNA, binds complementarily to a host target binding site located in an untranslated region of VGAM1782 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1782 host target RNA into VGAM1782 host target protein, herein schematically represented by VGAM1 HOST TARGET PROTEIN through VGAM3 HOST TARGET PROTEIN, all of FIG. 1.

It is appreciated that a function of VGR3122 gene, herein designated VGR GENE, is inhibition of expression of host target genes, as part of a novel viral mechanism of attacking a host. Accordingly, utilities of VGR3122 gene include diagnosis, prevention and treatment of viral infection by Cryphonectria Hypovirus 1. Specific functions, and accordingly utilities, of VGR3122 gene correlate with, and may be deduced from, the identity of the host target genes, which are inhibited by VGAM RNAs comprised in the 'operon-like' cluster of VGR3122 gene: VGAM1781 host target protein and VGAM1782 host target protein, herein schematically represented by VGAM1 HOST TARGET PROTEIN through VGAM3 HOST TARGET PROTEIN. The function of these host target genes is elaborated hereinabove with reference to VGAM1781 and VGAM1782. FIG. 9 further provides a conceptual description of novel bioinformatically detected regulatory viral gene, referred to here as Viral Genomic Record 3123(VGR3123) viral gene, which encodes an 'operon-like' cluster of novel viral micro RNA-like genes, each of which in turn modulates expression of at least one host target gene, the function and utility of which at least one host target gene is known in the art.

VGR3123 gene, herein designated VGR GENE, is a novel bioinformatically detected regulatory, non protein coding, RNA viral gene. The method by which VGR3123 gene was detected is described hereinabove with reference to FIGS. 1-9.

VGR3123 gene encodes VGR3123 precursor RNA, herein designated VGR PRECURSOR RNA, an RNA molecule, typically several hundred nucleotides long.

VGR3123 precursor RNA folds spatially, forming VGR3123 folded precursor RNA, herein designated VGR FOLDED PRECURSOR RNA. It is appreciated that VGR3123 folded precursor RNA comprises a plurality of what is known in the art as 'hairpin' structures. These 'hairpin' structures are due to the fact that the nucleotide sequence of VGR3123 precursor RNA comprises a plurality of segments, the first half of each such segment having a nucleotide sequence which is at least a partial inversed-reversed sequence of the second half thereof, as is well known in the art.

VGR3123 folded precursor RNA is naturally processed by cellular enzymatic activity into at least 7 separate VGAM precursor RNAs, VGAM1783 precursor RNA, VGAM1784 precursor RNA, VGAM1785 precursor RNA, VGAM1786 precursor RNA, VGAM1787 precursor RNA, VGAM1788 precursor RNA and VGAM1789 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1783 RNA, VGAM1784 RNA, VGAM1785 RNA, VGAM1786 RNA, VGAM1787 RNA, VGAM1788 RNA and VGAM1789 RNA, herein schematically represented by VGAM1 RNA through VGAM3 RNA, each of which VGAM RNAs corresponding to VGAM RNA of FIG. 1.

VGAM1783 RNA, herein schematically represented by VGAM1 RNA through VGAM3 RNA, binds complementarily to a host target binding site located in an untranslated region of VGAM1783 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1783 host target RNA into VGAM1783 host target protein, herein schematically represented by VGAM1 HOST TARGET PROTEIN through VGAM3 HOST TARGET PROTEIN, all of FIG. 1.

VGAM1784 RNA, herein schematically represented by VGAM1 RNA through VGAM3 RNA, binds complementarily to a host target binding site located in an untranslated region of VGAM1784 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1784 host target RNA into VGAM1784 host target protein, herein schematically represented by VGAM1 HOST TARGET PROTEIN through VGAM3 HOST TARGET PROTEIN, all of FIG. 1.

VGAM1785 RNA, herein schematically represented by VGAM1 RNA through VGAM3 RNA, binds complementarily to a host target binding site located in an untranslated region of VGAM1785 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1785 host target RNA into VGAM1785 host target protein, herein schematically represented by VGAM1 HOST TARGET PROTEIN through VGAM3 HOST TARGET PROTEIN, all of FIG. 1.

VGAM1786 RNA, herein schematically represented by VGAM1 RNA through VGAM3 RNA, binds complementarily to a host target binding site located in an untranslated region of VGAM1786 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1786 host target RNA into VGAM1786 host target protein, herein schematically represented by VGAM1 HOST TARGET PROTEIN through VGAM3 HOST TARGET PROTEIN, all of FIG. 1.

VGAM1787 RNA, herein schematically represented by VGAM1 RNA through VGAM3 RNA, binds complementarily to a host target binding site located in an untranslated region of VGAM1787 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1787 host target RNA into VGAM1787 host target protein, herein schematically represented by VGAM1 HOST TARGET PROTEIN through VGAM3 HOST TARGET PROTEIN, all of FIG. 1.

VGAM1788 RNA, herein schematically represented by VGAM1 RNA through VGAM3 RNA, binds complementarily to a host target binding site located in an untranslated region of VGAM1788 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1788 host target RNA into VGAM1788 host target protein, herein schematically represented by VGAM1 HOST TARGET PROTEIN through VGAM3 HOST TARGET PROTEIN, all of FIG. 1.

VGAM1789 RNA, herein schematically represented by VGAM1 RNA through VGAM3 RNA, binds complementarily to a host target binding site located in an untranslated region of VGAM1789 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1789 host target RNA into VGAM1789 host target protein, herein schematically represented by VGAM1 HOST TARGET PROTEIN through VGAM3 HOST TARGET PROTEIN, all of FIG. 1.

It is appreciated that a function of VGR3123 gene, herein designated VGR GENE, is inhibition of expression of host target genes, as part of a novel viral mechanism of attacking a host. Accordingly, utilities of VGR3123 gene include diagnosis, prevention and treatment of viral infection by Fowlpox Virus. Specific functions, and accordingly utilities, of VGR3123 gene correlate with, and may be deduced from, the identity of the host target genes, which are inhibited by VGAM RNAs comprised in the 'operon-like' cluster of VGR3123 gene: VGAM1783 host target protein, VGAM1784 host target protein, VGAM1785 host target protein, VGAM1786 host target protein, VGAM1787 host target protein, VGAM1788 host target protein and VGAM1789 host target protein, herein schematically represented by VGAM1 HOST TARGET PROTEIN through VGAM3 HOST TARGET PROTEIN. The function of these host target genes is elaborated hereinabove with reference to VGAM1783, VGAM1784, VGAM1785, VGAM1786, VGAM1787, VGAM1788 and VGAM1789. FIG. 9 further provides a conceptual description of novel bioinformatically detected regulatory viral gene, referred to here as Viral Genomic Record 3124(VGR3124) viral gene, which encodes an 'operon-like' cluster of novel viral micro RNA-like genes, each of which in turn modulates expression of at least one host target gene, the function and utility of which at least one host target gene is known in the art.

VGR3124 gene, herein designated VGR GENE, is a novel bioinformatically detected regulatory, non protein coding, RNA viral gene. The method by which VGR3124 gene was detected is described hereinabove with reference to FIGS. 1-9.

VGR3124 gene encodes VGR3124 precursor RNA, herein designated VGR PRECURSOR RNA, an RNA molecule, typically several hundred nucleotides long.

VGR3124 precursor RNA folds spatially, forming VGR3124 folded precursor RNA, herein designated VGR FOLDED PRECURSOR RNA. It is appreciated that VGR3124 folded precursor RNA comprises a plurality of what is known in the art as 'hairpin' structures. These 'hairpin' structures are due to the fact that the nucleotide sequence of VGR3124 precursor RNA comprises a plurality of segments, the first half of each such segment having a nucleotide sequence which is at least a partial inversed-reversed sequence of the second half thereof, as is well known in the art.

VGR3124 folded precursor RNA is naturally processed by cellular enzymatic activity into at least 7 separate VGAM precursor RNAs, VGAM1790 precursor RNA, VGAM1791 precursor RNA, VGAM1792 precursor RNA, VGAM1793 precursor RNA, VGAM1794 precursor RNA, VGAM1795 precursor RNA and VGAM1796 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1790 RNA, VGAM1791 RNA, VGAM1792 RNA, VGAM1793 RNA, VGAM1794 RNA, VGAM1795 RNA and VGAM1796 RNA, herein schematically represented by VGAM1 RNA through VGAM3 RNA, each of which VGAM RNAs corresponding to VGAM RNA of FIG. 1.

VGAM1790 RNA, herein schematically represented by VGAM1 RNA through VGAM3 RNA, binds complementarily to a host target binding site located in an untranslated region of VGAM1790 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1790 host target RNA into VGAM1790 host target protein, herein schematically represented by VGAM1 HOST TARGET PROTEIN through VGAM3 HOST TARGET PROTEIN, all of FIG. 1.

VGAM1791 RNA, herein schematically represented by VGAM1 RNA through VGAM3 RNA, binds complementarily to a host target binding site located in an untranslated region of VGAM1791 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1791 host target RNA into VGAM1791 host target protein, herein schematically represented by VGAM1 HOST TARGET PROTEIN through VGAM3 HOST TARGET PROTEIN, all of FIG. 1.

VGAM1792 RNA, herein schematically represented by VGAM1 RNA through VGAM3 RNA, binds complementarily to a host target binding site located in an untranslated region of VGAM1792 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1792 host target RNA into VGAM1792 host target protein, herein schematically represented by VGAM1 HOST TARGET PROTEIN through VGAM3 HOST TARGET PROTEIN, all of FIG. 1.

VGAM1793 RNA, herein schematically represented by VGAM1 RNA through VGAM3 RNA, binds complementarily to a host target binding site located in an untranslated region of VGAM1793 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1793 host target RNA into VGAM1793 host target protein, herein schematically represented by VGAM1 HOST TARGET PROTEIN through VGAM3 HOST TARGET PROTEIN, all of FIG. 1.

VGAM1794 RNA, herein schematically represented by VGAM1 RNA through VGAM3 RNA, binds complementarily to a host target binding site located in an untranslated region of VGAM1794 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1794 host target RNA into VGAM1794 host target protein, herein schematically represented by VGAM1 HOST TARGET PROTEIN through VGAM3 HOST TARGET PROTEIN, all of FIG. 1.

VGAM1795 RNA, herein schematically represented by VGAM1 RNA through VGAM3 RNA, binds complementarily to a host target binding site located in an untranslated region of VGAM1795 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1795 host target RNA into VGAM1795 host target protein, herein schematically represented by VGAM1 HOST TARGET PROTEIN through VGAM3 HOST TARGET PROTEIN, all of FIG. 1.

VGAM1796 RNA, herein schematically represented by VGAM1 RNA through VGAM3 RNA, binds complementarily to a host target binding site located in an untranslated region of VGAM1796 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1796 host target RNA into VGAM1796 host target protein, herein schematically represented by VGAM1 HOST TARGET PROTEIN through VGAM3 HOST TARGET PROTEIN, all of FIG. 1.

It is appreciated that a function of VGR3124 gene, herein designated VGR GENE, is inhibition of expression of host target genes, as part of a novel viral mechanism of attacking a host. Accordingly, utilities of VGR3124 gene include diagnosis, prevention and treatment of viral infection by Rana Tigrina Ranavirus. Specific functions, and accordingly utilities, of VGR3124 gene correlate with, and may be deduced from, the identity of the host target genes, which are inhibited by VGAM RNAs comprised in the 'operon-like' cluster of VGR3124 gene: VGAM1790 host target protein, VGAM1791 host target protein, VGAM1792 host target protein, VGAM1793 host target protein, VGAM1794 host target protein, VGAM1795 host target protein and VGAM1796 host target protein, herein schematically represented by VGAM1 HOST TARGET PROTEIN through VGAM3 HOST TARGET PROTEIN. The function of these host target genes is elaborated hereinabove with reference to VGAM1790, VGAM1791, VGAM1792, VGAM1793, VGAM1794, VGAM1795 and VGAM1796. FIG. 9 further provides a conceptual description of novel bioinformatically detected regulatory viral gene, referred to here as Viral Genomic Record 3125(VGR3125) viral gene, which encodes an 'operon-like' cluster of novel viral micro RNA-like genes, each of which in turn modulates expression of at least one host target gene, the function and utility of which at least one host target gene is known in the art.

VGR3125 gene, herein designated VGR GENE, is a novel bioinformatically detected regulatory, non protein coding, RNA viral gene. The method by which VGR3125 gene was detected is described hereinabove with reference to FIGS. 1-9.

VGR3125 gene encodes VGR3125 precursor RNA, herein designated VGR PRECURSOR RNA, an RNA molecule, typically several hundred nucleotides long.

VGR3125 precursor RNA folds spatially, forming VGR3125 folded precursor RNA, herein designated VGR FOLDED PRECURSOR RNA. It is appreciated that VGR3125 folded precursor RNA comprises a plurality of what is known in the art as 'hairpin' structures. These 'hairpin' structures are due to the fact that the nucleotide sequence of VGR3125 precursor RNA comprises a plurality of segments, the first half of each such segment having a nucleotide sequence which is at least a partial inversed-reversed sequence of the second half thereof, as is well known in the art.

VGR3125 folded precursor RNA is naturally processed by cellular enzymatic activity into at least 2 separate VGAM precursor RNAs, VGAM1797 precursor RNA and VGAM1798 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1797 RNA and VGAM1798 RNA, herein schematically represented by VGAM1 RNA through VGAM3 RNA, each of which VGAM RNAs corresponding to VGAM RNA of FIG. 1.

VGAM1797 RNA, herein schematically represented by VGAM1 RNA through VGAM3 RNA, binds complementarily to a host target binding site located in an untranslated region of VGAM1797 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1797 host target RNA into VGAM1797 host target protein, herein schematically represented by VGAM1 HOST TARGET PROTEIN through VGAM3 HOST TARGET PROTEIN, all of FIG. 1.

VGAM1798 RNA, herein schematically represented by VGAM1 RNA through VGAM3 RNA, binds complementarily to a host target binding site located in an untranslated region of VGAM1798 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1798 host target RNA into VGAM1798 host target protein, herein schematically represented by VGAM1 HOST TARGET PROTEIN through VGAM3 HOST TARGET PROTEIN, all of FIG. 1.

It is appreciated that a function of VGR3125 gene, herein designated VGR GENE, is inhibition of expression of host target genes, as part of a novel viral mechanism of attacking a host. Accordingly, utilities of VGR3125 gene include diagnosis, prevention and treatment of viral infection by Rana Tigrina Ranavirus. Specific functions, and accordingly utilities, of VGR3125 gene correlate with, and may be deduced from, the identity of the host target genes, which are inhibited by VGAM RNAs comprised in the 'operon-like' cluster of VGR3125 gene: VGAM1797 host target protein and VGAM1798 host target protein, herein schematically represented by VGAM1 HOST TARGET PROTEIN through VGAM3 HOST TARGET PROTEIN. The function of these host target genes is elaborated hereinabove with reference to VGAM1797 and VGAM1798. FIG. 9 further provides a conceptual description of novel bioinformatically detected regulatory viral gene, referred to here as Viral Genomic Record 3126(VGR3126) viral gene, which encodes an 'operon-like' cluster of novel viral micro RNA-like genes, each of which in turn modulates expression of at least one host target gene, the function and utility of which at least one host target gene is known in the art.

VGR3126 gene, herein designated VGR GENE, is a novel bioinformatically detected regulatory, non protein coding, RNA viral gene. The method by which VGR3126 gene was detected is described hereinabove with reference to FIGS. 1-9.

VGR3126 gene encodes VGR3126 precursor RNA, herein designated VGR PRECURSOR RNA, an RNA molecule, typically several hundred nucleotides long.

VGR3126 precursor RNA folds spatially, forming VGR3126 folded precursor RNA, herein designated VGR FOLDED PRECURSOR RNA. It is appreciated that VGR3126 folded precursor RNA comprises a plurality of what is known in the art as 'hairpin' structures. These 'hairpin' structures are due to the fact that the nucleotide sequence of VGR3126 precursor RNA comprises a plurality of segments, the first half of each such segment having a nucleotide sequence which is at least a partial inversed-reversed sequence of the second half thereof, as is well known in the art.

VGR3126 folded precursor RNA is naturally processed by cellular enzymatic activity into at least 8 separate VGAM precursor RNAs, VGAM1799 precursor RNA, VGAM1800 precursor RNA, VGAM1801 precursor RNA, VGAM1802 precursor RNA, VGAM1803 precursor RNA, VGAM1804 precursor RNA, VGAM1805 precursor RNA and VGAM1806 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1799 RNA, VGAM1800 RNA, VGAM1801 RNA, VGAM1802 RNA, VGAM1803 RNA, VGAM1804 RNA, VGAM1805 RNA and VGAM1806 RNA, herein schematically represented by VGAM1 RNA through VGAM3 RNA, each of which VGAM RNAs corresponding to VGAM RNA of FIG. 1.

VGAM1799 RNA, herein schematically represented by VGAM1 RNA through VGAM3 RNA, binds complementarily to a host target binding site located in an untranslated region of VGAM1799 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1799 host target RNA into VGAM1799 host target protein, herein schematically represented by VGAM1 HOST TARGET PROTEIN through VGAM3 HOST TARGET PROTEIN, all of FIG. 1.

VGAM1800 RNA, herein schematically represented by VGAM1 RNA through VGAM3 RNA, binds complementarily to a host target binding site located in an untranslated region of VGAM1800 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1800 host target RNA into VGAM1800 host target protein, herein schematically represented by VGAM1 HOST TARGET PROTEIN through VGAM3 HOST TARGET PROTEIN, all of FIG. 1.

VGAM1801 RNA, herein schematically represented by VGAM1 RNA through VGAM3 RNA, binds complementarily to a host target binding site located in an untranslated region of VGAM1801 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1801 host target RNA into VGAM1801 host target protein, herein schematically represented by VGAM1 HOST TARGET PROTEIN through VGAM3 HOST TARGET PROTEIN, all of FIG. 1.

VGAM1802 RNA, herein schematically represented by VGAM1 RNA through VGAM3 RNA, binds complementarily to a host target binding site located in an untranslated region of VGAM1802 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1802 host target RNA into VGAM1802 host target protein, herein schematically represented by VGAM1 HOST TARGET PROTEIN through VGAM3 HOST TARGET PROTEIN, all of FIG. 1.

VGAM1803 RNA, herein schematically represented by VGAM1 RNA through VGAM3 RNA, binds complementarily to a host target binding site located in an untranslated region of VGAM1803 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1803 host target RNA into VGAM1803 host target protein, herein schematically represented by VGAM1 HOST TARGET PROTEIN through VGAM3 HOST TARGET PROTEIN, all of FIG. 1.

VGAM1804 RNA, herein schematically represented by VGAM1 RNA through VGAM3 RNA, binds complementarily to a host target binding site located in an untranslated region of VGAM1804 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1804 host target RNA into VGAM1804 host target protein, herein schematically represented by VGAM1 HOST TARGET PROTEIN through VGAM3 HOST TARGET PROTEIN, all of FIG. 1.

VGAM1805 RNA, herein schematically represented by VGAM1 RNA through VGAM3 RNA, binds complementarily to a host target binding site located in an untranslated region of VGAM1805 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1805 host target RNA into VGAM1805 host target protein, herein schematically represented by VGAM1 HOST TARGET PROTEIN through VGAM3 HOST TARGET PROTEIN, all of FIG. 1.

VGAM1806 RNA, herein schematically represented by VGAM1 RNA through VGAM3 RNA, binds complementarily to a host target binding site located in an untranslated region of VGAM1806 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1806 host target RNA into VGAM1806 host target protein, herein schematically represented by VGAM1 HOST TARGET PROTEIN through VGAM3 HOST TARGET PROTEIN, all of FIG. 1.

It is appreciated that a function of VGR3126 gene, herein designated VGR GENE, is inhibition of expression of host target genes, as part of a novel viral mechanism of attacking a host. Accordingly, utilities of VGR3126 gene include diagnosis, prevention and treatment of viral infection by Tupaia Herpesvirus. Specific functions, and accordingly utilities, of VGR3126 gene correlate with, and may be deduced from, the identity of the host target genes, which are inhibited by VGAM RNAs comprised in the 'operon-like' cluster of VGR3126 gene: VGAM1799 host target protein, VGAM1800 host target protein, VGAM1801 host target protein, VGAM1802 host target protein, VGAM1803 host target protein, VGAM1804 host target protein, VGAM1805 host target protein and VGAM1806 host target protein, herein schematically represented by VGAM1 HOST TARGET PROTEIN through VGAM3 HOST TARGET PROTEIN. The function of these host target genes is elaborated hereinabove with reference to VGAM1799, VGAM1800, VGAM1801, VGAM1802, VGAM1803, VGAM1804, VGAM1805 and VGAM1806. FIG. 9 further provides a conceptual description of novel bioinformatically detected regulatory viral gene, referred to here as Viral Genomic Record 3127(VGR3127) viral gene, which encodes an 'operon-like' cluster of novel viral micro RNA-like genes, each of which in turn modulates expression of at least one host target gene, the function and utility of which at least one host target gene is known in the art.

VGR3127 gene, herein designated VGR GENE, is a novel bioinformatically detected regulatory, non protein coding, RNA viral gene. The method by which VGR3127 gene was detected is described hereinabove with reference to FIGS. 1-9.

VGR3127 gene encodes VGR3127 precursor RNA, herein designated VGR PRECURSOR RNA, an RNA molecule, typically several hundred nucleotides long.

VGR3127 precursor RNA folds spatially, forming VGR3127 folded precursor RNA, herein designated VGR FOLDED PRECURSOR RNA. It is appreciated that VGR3127 folded precursor RNA comprises a plurality of what is known in the art as 'hairpin' structures. These 'hairpin' structures are due to the fact that the nucleotide sequence of VGR3127 precursor RNA comprises a plurality of segments, the first half of each such segment having a nucleotide sequence which is at least a partial inversed-reversed sequence of the second half thereof, as is well known in the art.

VGR3127 folded precursor RNA is naturally processed by cellular enzymatic activity into at least 3 separate VGAM precursor RNAs, VGAM1807 precursor RNA, VGAM1808 precursor RNA and VGAM1809 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1807 RNA, VGAM1808 RNA and VGAM1809 RNA, herein schematically represented by VGAM1 RNA through VGAM3 RNA, each of which VGAM RNAs corresponding to VGAM RNA of FIG. 1.

VGAM1807 RNA, herein schematically represented by VGAM1 RNA through VGAM3 RNA, binds complementarily to a host target binding site located in an untranslated region of VGAM1807 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1807 host target RNA into VGAM1807 host target protein, herein schematically represented by VGAM1 HOST TARGET PROTEIN through VGAM3 HOST TARGET PROTEIN, all of FIG. 1.

VGAM1808 RNA, herein schematically represented by VGAM1 RNA through VGAM3 RNA, binds complementarily to a host target binding site located in an untranslated region of VGAM1808 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1808 host target RNA into VGAM1808 host target protein, herein schematically represented by VGAM1 HOST TARGET PROTEIN through VGAM3 HOST TARGET PROTEIN, all of FIG. 1.

VGAM1809 RNA, herein schematically represented by VGAM1 RNA through VGAM3 RNA, binds complementarily to a host target binding site located in an untranslated region of VGAM1809 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1809 host target RNA into VGAM1809 host target protein, herein schematically represented by VGAM1 HOST TARGET PROTEIN through VGAM3 HOST TARGET PROTEIN, all of FIG. 1.

It is appreciated that a function of VGR3127 gene, herein designated VGR GENE, is inhibition of expression of host target genes, as part of a novel viral mechanism of attacking a host. Accordingly, utilities of VGR3127 gene include diagnosis, prevention and treatment of viral infection by Rana Tigrina Ranavirus. Specific functions, and accordingly utilities, of VGR3127 gene correlate with, and may be deduced from, the identity of the host target genes, which are inhibited by VGAM RNAs comprised in the 'operon-like' cluster of VGR3127 gene: VGAM1807 host target protein, VGAM1808 host target protein and VGAM1809 host target protein, herein schematically represented by VGAM1 HOST TARGET PROTEIN through VGAM3 HOST TARGET PROTEIN. The function of these host target genes is elaborated hereinabove with reference to VGAM1807, VGAM1808 and VGAM1809. FIG. 9 further provides a conceptual description of novel bioinformatically detected regulatory viral gene, referred to here as Viral Genomic Record 3128(VGR3128) viral gene, which encodes an 'operon-like' cluster of novel viral micro RNA-like genes, each of which in turn modulates expression of at least one host target gene, the function and utility of which at least one host target gene is known in the art.

VGR3128 gene, herein designated VGR GENE, is a novel bioinformatically detected regulatory, non protein coding, RNA viral gene. The method by which VGR3128 gene was detected is described hereinabove with reference to FIGS. 1-9.

VGR3128 gene encodes VGR3128 precursor RNA, herein designated VGR PRECURSOR RNA, an RNA molecule, typically several hundred nucleotides long.

VGR3128 precursor RNA folds spatially, forming VGR3128 folded precursor RNA, herein designated VGR FOLDED PRECURSOR RNA. It is appreciated that VGR3128 folded precursor RNA comprises a plurality of what is known in the art as 'hairpin' structures. These 'hairpin' structures are due to the fact that the nucleotide sequence of VGR3128 precursor RNA comprises a plurality of segments, the first half of each such segment having a nucleotide sequence which is at least a partial inversed-reversed sequence of the second half thereof, as is well known in the art.

VGR3128 folded precursor RNA is naturally processed by cellular enzymatic activity into at least 6 separate VGAM precursor RNAs, VGAM1810 precursor RNA, VGAM1811 precursor RNA, VGAM1812 precursor RNA, VGAM1813 precursor RNA, VGAM1814 precursor RNA and VGAM1815 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1810 RNA, VGAM1811 RNA, VGAM1812 RNA, VGAM1813 RNA, VGAM1814 RNA and VGAM1815 RNA, herein schematically represented by VGAM1 RNA through VGAM3 RNA, each of which VGAM RNAs corresponding to VGAM RNA of FIG. 1.

VGAM1810 RNA, herein schematically represented by VGAM1 RNA through VGAM3 RNA, binds complementarily to a host target binding site located in an untranslated region of VGAM1810 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1810 host target RNA into VGAM1810 host target protein, herein schematically represented by VGAM1 HOST TARGET PROTEIN through VGAM3 HOST TARGET PROTEIN, all of FIG. 1.

VGAM1811 RNA, herein schematically represented by VGAM1 RNA through VGAM3 RNA, binds complementarily to a host target binding site located in an untranslated region of VGAM1811 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1811 host target RNA into VGAM1811 host target protein, herein schematically represented by VGAM1 HOST TARGET PROTEIN through VGAM3 HOST TARGET PROTEIN, all of FIG. 1.

VGAM1812 RNA, herein schematically represented by VGAM1 RNA through VGAM3 RNA, binds complementarily to a host target binding site located in an untranslated region of VGAM1812 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1812 host target RNA into VGAM1812 host target protein, herein schematically represented by VGAM1 HOST TARGET PROTEIN through VGAM3 HOST TARGET PROTEIN, all of FIG. 1.

VGAM1813 RNA, herein schematically represented by VGAM1 RNA through VGAM3 RNA, binds complementarily to a host target binding site located in an untranslated region of VGAM1813 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1813 host target RNA into VGAM1813 host target protein, herein schematically represented by VGAM1 HOST TARGET PROTEIN through VGAM3 HOST TARGET PROTEIN, all of FIG. 1.

VGAM1814 RNA, herein schematically represented by VGAM1 RNA through VGAM3 RNA, binds complementarily to a host target binding site located in an untranslated region of VGAM1814 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1814 host target RNA into VGAM1814 host target protein, herein schematically represented by VGAM1 HOST TARGET PROTEIN through VGAM3 HOST TARGET PROTEIN, all of FIG. 1.

VGAM1815 RNA, herein schematically represented by VGAM1 RNA through VGAM3 RNA, binds complementarily to a host target binding site located in an untranslated region of VGAM1815 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1815 host target RNA into VGAM1815 host target protein, herein schematically represented by VGAM1 HOST TARGET PROTEIN through VGAM3 HOST TARGET PROTEIN, all of FIG. 1.

It is appreciated that a function of VGR3128 gene, herein designated VGR GENE, is inhibition of expression of host target genes, as part of a novel viral mechanism of attacking a host. Accordingly, utilities of VGR3128 gene include diagnosis, prevention and treatment of viral infection by Equine Herpesvirus 1. Specific functions, and accordingly utilities, of VGR3128 gene correlate with, and may be deduced from, the identity of the host target genes, which are inhibited by VGAM RNAs comprised in the 'operon-like' cluster of VGR3128 gene: VGAM1810 host target protein, VGAM1811 host target protein, VGAM1812 host target protein, VGAM1813 host target protein, VGAM1814 host target protein and VGAM1815 host target protein, herein schematically represented by VGAM1 HOST TARGET PROTEIN through VGAM3 HOST TARGET PROTEIN. The function of these host target genes is elaborated hereinabove with reference to VGAM1810, VGAM1811, VGAM1812, VGAM1813, VGAM1814 and VGAM1815. FIG. 9 further provides a conceptual description of novel bioinformatically detected regulatory viral gene, referred to here as Viral Genomic Record 3129(VGR3129) viral gene, which encodes an 'operon-like' cluster of novel viral micro RNA-like genes, each of which in turn modulates expression of at least one host target gene, the function and utility of which at least one host target gene is known in the art.

VGR3129 gene, herein designated VGR GENE, is a novel bioinformatically detected regulatory, non protein coding, RNA viral gene. The method by which VGR3129 gene was detected is described hereinabove with reference to FIGS. 1-9.

VGR3129 gene encodes VGR3129 precursor RNA, herein designated VGR PRECURSOR RNA, an RNA molecule, typically several hundred nucleotides long.

VGR3129 precursor RNA folds spatially, forming VGR3129 folded precursor RNA, herein designated VGR FOLDED PRECURSOR RNA. It is appreciated that VGR3129 folded precursor RNA comprises a plurality of what is known in the art as 'hairpin' structures. These 'hairpin' structures are due to the fact that the nucleotide sequence of VGR3129 precursor RNA comprises a plurality of segments, the first half of each such segment having a nucleotide sequence which is at least a partial inversed-reversed sequence of the second half thereof, as is well known in the art.

VGR3129 folded precursor RNA is naturally processed by cellular enzymatic activity into at least 8 separate VGAM precursor RNAs, VGAM1816 precursor RNA, VGAM1817 precursor RNA, VGAM1818 precursor RNA, VGAM1819 precursor RNA, VGAM1820 precursor RNA, VGAM1821 precursor RNA, VGAM1822 precursor RNA and VGAM1823 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1816 RNA, VGAM1817 RNA, VGAM1818 RNA, VGAM1819 RNA, VGAM1820 RNA, VGAM1821 RNA, VGAM1822 RNA and VGAM1823 RNA, herein schematically represented by VGAM1 RNA through VGAM3 RNA, each of which VGAM RNAs corresponding to VGAM RNA of FIG. 1.

VGAM1816 RNA, herein schematically represented by VGAM1 RNA through VGAM3 RNA, binds complementarily to a host target binding site located in an untranslated region of VGAM1816 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1816 host target RNA into VGAM1816 host target protein, herein schematically represented by VGAM1 HOST TARGET PROTEIN through VGAM3 HOST TARGET PROTEIN, all of FIG. 1.

VGAM1817 RNA, herein schematically represented by VGAM1 RNA through VGAM3 RNA, binds complementarily to a host target binding site located in an untranslated region of VGAM1817 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1817 host target RNA into VGAM1817 host target protein, herein schematically represented by VGAM1 HOST TARGET PROTEIN through VGAM3 HOST TARGET PROTEIN, all of FIG. 1.

VGAM1818 RNA, herein schematically represented by VGAM1 RNA through VGAM3 RNA, binds complementarily to a host target binding site located in an untranslated region of VGAM1818 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1818 host target RNA into VGAM1818 host target protein, herein schematically represented by VGAM1 HOST TARGET PROTEIN through VGAM3 HOST TARGET PROTEIN, all of FIG. 1.

VGAM1819 RNA, herein schematically represented by VGAM1 RNA through VGAM3 RNA, binds complementarily to a host target binding site located in an untranslated region of VGAM1819 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1819 host target RNA into VGAM1819 host target protein, herein schematically represented by VGAM1 HOST TARGET PROTEIN through VGAM3 HOST TARGET PROTEIN, all of FIG. 1.

VGAM1820 RNA, herein schematically represented by VGAM1 RNA through VGAM3 RNA, binds complementarily to a host target binding site located in an untranslated region of VGAM1820 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1820 host target RNA into VGAM1820 host target protein, herein schematically represented by VGAM1 HOST TARGET PROTEIN through VGAM3 HOST TARGET PROTEIN, all of FIG. 1.

VGAM1821 RNA, herein schematically represented by VGAM1 RNA through VGAM3 RNA, binds complementarily to a host target binding site located in an untranslated region of VGAM1821 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1821 host target RNA into VGAM1821 host target protein, herein schematically represented by VGAM1 HOST TARGET PROTEIN through VGAM3 HOST TARGET PROTEIN, all of FIG. 1.

VGAM1822 RNA, herein schematically represented by VGAM1 RNA through VGAM3 RNA, binds complementarily to a host target binding site located in an untranslated region of VGAM1822 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1822 host target RNA into VGAM1822 host target protein, herein schematically represented by VGAM1 HOST TARGET PROTEIN through VGAM3 HOST TARGET PROTEIN, all of FIG. 1.

VGAM1823 RNA, herein schematically represented by VGAM1 RNA through VGAM3 RNA, binds complementarily to a host target binding site located in an untranslated region of VGAM1823 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1823 host target RNA into VGAM1823 host target protein, herein schematically represented by VGAM1 HOST TARGET PROTEIN through VGAM3 HOST TARGET PROTEIN, all of FIG. 1.

It is appreciated that a function of VGR3129 gene, herein designated VGR GENE, is inhibition of expression of host target genes, as part of a novel viral mechanism of attacking a host. Accordingly, utilities of VGR3129 gene include diagnosis, prevention and treatment of viral infection by Camelpox Virus. Specific functions, and accordingly utilities, of VGR3129 gene correlate with, and may be deduced from, the identity of the host target genes, which are inhibited by VGAM RNAs comprised in the 'operon-like' cluster of VGR3129 gene: VGAM1816 host target protein, VGAM1817 host target protein, VGAM1818 host target protein, VGAM1819 host target protein, VGAM1820 host target protein, VGAM1821 host target protein, VGAM1822 host target protein and VGAM1823 host target protein, herein schematically represented by VGAM1 HOST TARGET PROTEIN through VGAM3 HOST TARGET PROTEIN. The function of these host target genes is elaborated hereinabove with reference to VGAM1816, VGAM1817, VGAM1818, VGAM1819, VGAM1820, VGAM1821, VGAM1822 and VGAM1823. FIG. 9 further provides a conceptual description of novel bioinformatically detected regulatory viral gene, referred to here as Viral Genomic Record 3130(VGR3130) viral gene, which encodes an 'operon-like' cluster of novel viral micro RNA-like genes, each of which in turn modulates expression of at least one host target gene, the function and utility of which at least one host target gene is known in the art.

VGR3130 gene, herein designated VGR GENE, is a novel bioinformatically detected regulatory, non protein coding, RNA viral gene. The method by which VGR3130 gene was detected is described hereinabove with reference to FIGS. 1-9.

VGR3130 gene encodes VGR3130 precursor RNA, herein designated VGR PRECURSOR RNA, an RNA molecule, typically several hundred nucleotides long.

VGR3130 precursor RNA folds spatially, forming VGR3130 folded precursor RNA, herein designated VGR FOLDED PRECURSOR RNA. It is appreciated that VGR3130 folded precursor RNA comprises a plurality of what is known in the art as 'hairpin' structures. These 'hairpin' structures are due to the fact that the nucleotide sequence of VGR3130 precursor RNA comprises a plurality of segments, the first half of each such segment having a nucleotide sequence which is at least a partial inversed-reversed sequence of the second half thereof, as is well known in the art.

VGR3130 folded precursor RNA is naturally processed by cellular enzymatic activity into at least 3 separate VGAM precursor RNAs, VGAM1824 precursor RNA, VGAM1825 precursor RNA and VGAM1826 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1824 RNA, VGAM1825 RNA and VGAM1826 RNA, herein schematically represented by VGAM1 RNA through VGAM3 RNA, each of which VGAM RNAs corresponding to VGAM RNA of FIG. 1.

VGAM1824 RNA, herein schematically represented by VGAM1 RNA through VGAM3 RNA, binds complementarily to a host target binding site located in an untranslated region of VGAM1824 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1824 host target RNA into VGAM1824 host target protein, herein schematically represented by VGAM1 HOST TARGET PROTEIN through VGAM3 HOST TARGET PROTEIN, all of FIG. 1.

VGAM1825 RNA, herein schematically represented by VGAM1 RNA through VGAM3 RNA, binds complementarily to a host target binding site located in an untranslated region of VGAM1825 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1825 host target RNA into VGAM1825 host target protein, herein schematically represented by VGAM1 HOST TARGET PROTEIN through VGAM3 HOST TARGET PROTEIN, all of FIG. 1.

VGAM1826 RNA, herein schematically represented by VGAM1 RNA through VGAM3 RNA, binds complementarily to a host target binding site located in an untranslated region of VGAM1826 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1826 host target RNA into VGAM1826 host target protein, herein schematically represented by VGAM1 HOST TARGET PROTEIN through VGAM3 HOST TARGET PROTEIN, all of FIG. 1.

It is appreciated that a function of VGR3130 gene, herein designated VGR GENE, is inhibition of expression of host target genes, as part of a novel viral mechanism of attacking a host. Accordingly, utilities of VGR3130 gene include diagnosis, prevention and treatment of viral infection by Cryphonectria Hypovirus. Specific functions, and accordingly utilities, of VGR3130 gene correlate with, and may be deduced from, the identity of the host target genes, which are inhibited by VGAM RNAs comprised in the 'operon-like' cluster of VGR3130 gene: VGAM1824 host target protein, VGAM1825 host target protein and VGAM1826 host target protein, herein schematically represented by VGAM1 HOST TARGET PROTEIN through VGAM3 HOST TARGET PROTEIN. The function of these host target genes is elaborated hereinabove with reference to VGAM1824, VGAM1825 and VGAM1826. FIG. 9 further provides a conceptual description of novel bioinformatically detected regulatory viral gene, referred to here as Viral Genomic Record 3131(VGR3131) viral gene, which encodes an 'operon-like' cluster of novel viral micro RNA-like genes, each of which in turn modulates expression of at least one host target gene, the function and utility of which at least one host target gene is known in the art.

VGR3131 gene, herein designated VGR GENE, is a novel bioinformatically detected regulatory, non protein coding, RNA viral gene. The method by which VGR3131 gene was detected is described hereinabove with reference to FIGS. 1-9.

VGR3131 gene encodes VGR3131 precursor RNA, herein designated VGR PRECURSOR RNA, an RNA molecule, typically several hundred nucleotides long.

VGR3131 precursor RNA folds spatially, forming VGR3131 folded precursor RNA, herein designated VGR FOLDED PRECURSOR RNA. It is appreciated that VGR3131 folded precursor RNA comprises a plurality of what is known in the art as 'hairpin' structures. These 'hairpin' structures are due to the fact that the nucleotide sequence of VGR3131 precursor RNA comprises a plurality of segments, the first half of each such segment having a nucleotide sequence which is at least a partial inversed-reversed sequence of the second half thereof, as is well known in the art.

VGR3131 folded precursor RNA is naturally processed by cellular enzymatic activity into at least 3 separate VGAM precursor RNAs, VGAM1827 precursor RNA, VGAM1828 precursor RNA and VGAM1829 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1827 RNA, VGAM1828 RNA and VGAM1829 RNA, herein schematically represented by VGAM1 RNA through VGAM3 RNA, each of which VGAM RNAs corresponding to VGAM RNA of FIG. 1.

VGAM1827 RNA, herein schematically represented by VGAM1 RNA through VGAM3 RNA, binds complementarily to a host target binding site located in an untranslated region of VGAM1827 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1827 host target RNA into VGAM1827 host target protein, herein schematically represented by VGAM1 HOST TARGET PROTEIN through VGAM3 HOST TARGET PROTEIN, all of FIG. 1.

VGAM1828 RNA, herein schematically represented by VGAM1 RNA through VGAM3 RNA, binds complementarily to a host target binding site located in an untranslated region of VGAM1828 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1828 host target RNA into VGAM1828 host target protein, herein schematically represented by VGAM1 HOST TARGET PROTEIN through VGAM3 HOST TARGET PROTEIN, all of FIG. 1.

VGAM1829 RNA, herein schematically represented by VGAM1 RNA through VGAM3 RNA, binds complementarily to a host target binding site located in an untranslated region of VGAM1829 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1829 host target RNA into VGAM1829 host target protein, herein schematically represented by VGAM1 HOST TARGET PROTEIN through VGAM3 HOST TARGET PROTEIN, all of FIG. 1.

It is appreciated that a function of VGR3131 gene, herein designated VGR GENE, is inhibition of expression of host target genes, as part of a novel viral mechanism of attacking a host. Accordingly, utilities of VGR3131 gene include diagnosis, prevention and treatment of viral infection by Rabbit Fibroma Virus. Specific functions, and accordingly utilities, of VGR3131 gene correlate with, and may be deduced from, the identity of the host target genes, which are inhibited by VGAM RNAs comprised in the 'operon-like' cluster of VGR3131 gene: VGAM1827 host target protein, VGAM1828 host target protein and VGAM1829 host target protein, herein schematically represented by VGAM1 HOST TARGET PROTEIN through VGAM3 HOST TARGET PROTEIN. The function of these host target genes is elaborated hereinabove with reference to VGAM1827, VGAM1828 and VGAM1829. FIG. 9 further provides a conceptual description of novel bioinformatically detected regulatory viral gene, referred to here as Viral Genomic Record 3132(VGR3132) viral gene, which encodes an 'operon-like' cluster of novel viral micro RNA-like genes, each of which in turn modulates expression of at least one host target gene, the function and utility of which at least one host target gene is known in the art.

VGR3132 gene, herein designated VGR GENE, is a novel bioinformatically detected regulatory, non protein coding, RNA viral gene. The method by which VGR3132 gene was detected is described hereinabove with reference to FIGS. 1-9.

VGR3132 gene encodes VGR3132 precursor RNA, herein designated VGR PRECURSOR RNA, an RNA molecule, typically several hundred nucleotides long.

VGR3132 precursor RNA folds spatially, forming VGR3132 folded precursor RNA, herein designated VGR FOLDED PRECURSOR RNA. It is appreciated that VGR3132 folded precursor RNA comprises a plurality of what is known in the art as 'hairpin' structures. These 'hairpin' structures are due to the fact that the nucleotide sequence of VGR3132 precursor RNA comprises a plurality of segments, the first half of each such segment having a nucleotide sequence which is at least a partial inversed-reversed sequence of the second half thereof, as is well known in the art.

VGR3132 folded precursor RNA is naturally processed by cellular enzymatic activity into at least 5 separate VGAM precursor RNAs, VGAM1830 precursor RNA, VGAM1831 precursor RNA, VGAM1832 precursor RNA, VGAM1833 precursor RNA and VGAM1834 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1830 RNA, VGAM1831 RNA, VGAM1832 RNA, VGAM1833 RNA and VGAM1834 RNA, herein schematically represented by VGAM1 RNA through VGAM3 RNA, each of which VGAM RNAs corresponding to VGAM RNA of FIG. 1.

VGAM1830 RNA, herein schematically represented by VGAM1 RNA through VGAM3 RNA, binds complementarily to a host target binding site located in an untranslated region of VGAM1830 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1830 host target RNA into VGAM1830 host target protein, herein schematically represented by VGAM1 HOST TARGET PROTEIN through VGAM3 HOST TARGET PROTEIN, all of FIG. 1.

VGAM1831 RNA, herein schematically represented by VGAM1 RNA through VGAM3 RNA, binds complementarily to a host target binding site located in an untranslated region of VGAM1831 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1831 host target RNA into VGAM1831 host target protein, herein schematically represented by VGAM1 HOST TARGET PROTEIN through VGAM3 HOST TARGET PROTEIN, all of FIG. 1.

VGAM1832 RNA, herein schematically represented by VGAM1 RNA through VGAM3 RNA, binds complementarily to a host target binding site located in an untranslated region of VGAM1832 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1832 host target RNA into VGAM1832 host target protein, herein schematically represented by VGAM1 HOST TARGET PROTEIN through VGAM3 HOST TARGET PROTEIN, all of FIG. 1.

VGAM1833 RNA, herein schematically represented by VGAM1 RNA through VGAM3 RNA, binds complementarily to a host target binding site located in an untranslated region of VGAM1833 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1833 host target RNA into VGAM1833 host target protein, herein schematically represented by VGAM1 HOST TARGET PROTEIN through VGAM3 HOST TARGET PROTEIN, all of FIG. 1.

VGAM1834 RNA, herein schematically represented by VGAM1 RNA through VGAM3 RNA, binds complementarily to a host target binding site located in an untranslated region of VGAM1834 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1834 host target RNA into VGAM1834 host target protein, herein schematically represented by VGAM1 HOST TARGET PROTEIN through VGAM3 HOST TARGET PROTEIN, all of FIG. 1.

It is appreciated that a function of VGR3132 gene, herein designated VGR GENE, is inhibition of expression of host target genes, as part of a novel viral mechanism of attacking a host. Accordingly, utilities of VGR3132 gene include diagnosis, prevention and treatment of viral infection by Camelpox Virus. Specific functions, and accordingly utilities, of VGR3132 gene correlate with, and may be deduced from, the identity of the host target genes, which are inhibited by VGAM RNAs comprised in the 'operon-like' cluster of VGR3132 gene: VGAM1830 host target protein, VGAM1831 host target protein, VGAM1832 host target protein, VGAM1833 host target protein and VGAM1834 host target protein, herein schematically represented by VGAM1 HOST TARGET PROTEIN through VGAM3 HOST TARGET PROTEIN. The function of these host target genes is elaborated hereinabove with reference to VGAM1830, VGAM1831, VGAM1832, VGAM1833 and VGAM1834. FIG. 9 further provides a conceptual description of novel bioinformatically detected regulatory viral gene, referred to here as Viral Genomic Record 3133(VGR3133) viral gene, which encodes an 'operon-like' cluster of novel viral micro RNA-like genes, each of which in turn modulates expression of at least one host target gene, the function and utility of which at least one host target gene is known in the art.

VGR3133 gene, herein designated VGR GENE, is a novel bioinformatically detected regulatory, non protein coding, RNA viral gene. The method by which VGR3133 gene was detected is described hereinabove with reference to FIGS. 1-9.

VGR3133 gene encodes VGR3133 precursor RNA, herein designated VGR PRECURSOR RNA, an RNA molecule, typically several hundred nucleotides long.

VGR3133 precursor RNA folds spatially, forming VGR3133 folded precursor RNA, herein designated VGR FOLDED PRECURSOR RNA. It is appreciated that VGR3133 folded precursor RNA comprises a plurality of what is known in the art as 'hairpin' structures. These 'hairpin' structures are due to the fact that the nucleotide sequence of VGR3133 precursor RNA comprises a plurality of segments, the first half of each such segment having a nucleotide sequence which is at least a partial inversed-reversed sequence of the second half thereof, as is well known in the art.

VGR3133 folded precursor RNA is naturally processed by cellular enzymatic activity into at least 5 separate VGAM precursor RNAs, VGAM1835 precursor RNA, VGAM1836 precursor RNA, VGAM1837 precursor RNA, VGAM1838 precursor RNA and VGAM1839 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1835 RNA, VGAM1836 RNA, VGAM1837 RNA, VGAM1838 RNA and VGAM1839 RNA, herein schematically represented by VGAM1 RNA through VGAM3 RNA, each of which VGAM RNAs corresponding to VGAM RNA of FIG. 1.

VGAM1835 RNA, herein schematically represented by VGAM1 RNA through VGAM3 RNA, binds complementarily to a host target binding site located in an untranslated region of VGAM1835 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1835 host target RNA into VGAM1835 host target protein, herein schematically represented by VGAM1 HOST TARGET PROTEIN through VGAM3 HOST TARGET PROTEIN, all of FIG. 1.

VGAM1836 RNA, herein schematically represented by VGAM1 RNA through VGAM3 RNA, binds complementarily to a host target binding site located in an untranslated region of VGAM1836 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1836 host target RNA into VGAM1836 host target protein, herein schematically represented by VGAM1 HOST TARGET PROTEIN through VGAM3 HOST TARGET PROTEIN, all of FIG. 1.

VGAM1837 RNA, herein schematically represented by VGAM1 RNA through VGAM3 RNA, binds complementarily to a host target binding site located in an untranslated region of VGAM1837 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1837 host target RNA into VGAM1837 host target protein, herein schematically represented by VGAM1 HOST TARGET PROTEIN through VGAM3 HOST TARGET PROTEIN, all of FIG. 1.

VGAM1838 RNA, herein schematically represented by VGAM1 RNA through VGAM3 RNA, binds complementarily to a host target binding site located in an untranslated region of VGAM1838 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1838 host target RNA into VGAM1838 host target protein, herein schematically represented by VGAM1 HOST TARGET PROTEIN through VGAM3 HOST TARGET PROTEIN, all of FIG. 1.

VGAM1839 RNA, herein schematically represented by VGAM1 RNA through VGAM3 RNA, binds complementarily to a host target binding site located in an untranslated region of VGAM1839 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM1839 host target RNA into VGAM1839 host target protein, herein schematically represented by VGAM1 HOST TARGET PROTEIN through VGAM3 HOST TARGET PROTEIN, all of FIG. 1.

It is appreciated that a function of VGR3133 gene, herein designated VGR GENE, is inhibition of expression of host target genes, as part of a novel viral mechanism of attacking a host. Accordingly, utilities of VGR3133 gene include diagnosis, prevention and treatment of viral infection by Fowlpox Virus. Specific functions, and accordingly utilities, of VGR3133 gene correlate with, and may be deduced from, the identity of the host target genes, which are inhibited by VGAM RNAs comprised in the 'operon-like' cluster of VGR3133 gene: VGAM1835 host target protein, VGAM1836 host target protein, VGAM1837 host target protein, VGAM1838 host target protein and VGAM1839 host target protein, herein schematically represented by VGAM1 HOST TARGET PROTEIN through VGAM3 HOST TARGET PROTEIN. The function of these host target genes is elaborated hereinabove with reference to VGAM1835, VGAM1836, VGAM1837, VGAM1838 and VGAM1839. FIG. 9 further provides a conceptual description of novel bioinformatically detected regulatory viral gene, referred to here as Viral Genomic Record 3134(VGR3134) viral gene, which encodes an 'operon-like' cluster of novel viral micro RNA-like genes, each of which in turn modulates expression of at least one host target gene, the function and utility of which at least one host target gene is known in the art.

VGR3134 gene, herein designated VGR GENE, is a novel bioinformatically detected regulatory, non protein coding, RNA viral gene. The method by which VGR3134 gene was detected is described hereinabove with reference to FIGS. 1-9.

VGR3134 gene encodes VGR3134 precursor RNA, herein designated VGR PRECURSOR RNA, an RNA molecule, typically several hundred nucleotides long.

VGR3134 precursor RNA folds spatially, forming VGR3134 folded precursor RNA, herein designated VGR FOLDED PRECURSOR RNA. It is appreciated that VGR3134 folded precursor RNA comprises a plurality of what is known in the art as 'hairpin' structures. These 'hairpin' structures are due to the fact that the nucleotide sequence of VGR3134 precursor RNA comprises a plurality of segments, the first half of each such segment having a nucleotide sequence which is at least a partial inversed-reversed sequence of the second half thereof, as is well known in the art.

VGR3134 folded precursor RNA is naturally processed by cellular enzymatic activity into at least 2 separate VGAM precursor RNAs, VGAM1840 precursor RNA and VGAM1841 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1840 RNA and VGAM1841 RNA, herein schematically represented by VGAM1 RNA through VGAM3 RNA, each of which VGAM RNAs corresponding to VGAM RNA of FIG. 1.

VGAM1840 RNA, herein schematically represented by VGAM1 RNA through VGAM3 RNA, binds complementarily to a host target binding site located in an untranslated region of VGAM1840 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1840 host target RNA into VGAM1840 host target protein, herein schematically represented by VGAM1 HOST TARGET PROTEIN through VGAM3 HOST TARGET PROTEIN, all of FIG. 1.

VGAM1841 RNA, herein schematically represented by VGAM1 RNA through VGAM3 RNA, binds complementarily to a host target binding site located in an untranslated region of VGAM1841 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1841 host target RNA into VGAM1841 host target protein, herein schematically represented by VGAM1 HOST TARGET PROTEIN through VGAM3 HOST TARGET PROTEIN, all of FIG. 1.

It is appreciated that a function of VGR3134 gene, herein designated VGR GENE, is inhibition of expression of host target genes, as part of a novel viral mechanism of attacking a host. Accordingly, utilities of VGR3134 gene include diagnosis, prevention and treatment of viral infection by Cowpea Mottle Virus. Specific functions, and accordingly utilities, of VGR3134 gene correlate with, and may be deduced from, the identity of the host target genes, which are inhibited by VGAM RNAs comprised in the 'operon-like' cluster of VGR3134 gene: VGAM1840 host target protein and VGAM1841 host target protein, herein schematically represented by VGAM1 HOST TARGET PROTEIN through VGAM3 HOST TARGET PROTEIN. The function of these host target genes is elaborated hereinabove with reference to VGAM1840 and VGAM1841. FIG. 9 further provides a conceptual description of novel bioinformatically detected regulatory viral gene, referred to here as Viral Genomic Record 3135(VGR3135) viral gene, which encodes an 'operon-like' cluster of novel viral micro RNA-like genes, each of which in turn modulates expression of at least one host target gene, the function and utility of which at least one host target gene is known in the art.

VGR3135 gene, herein designated VGR GENE, is a novel bioinformatically detected regulatory, non protein coding, RNA viral gene. The method by which VGR3135 gene was detected is described hereinabove with reference to FIGS. 1-9.

VGR3135 gene encodes VGR3135 precursor RNA, herein designated VGR PRECURSOR RNA, an RNA molecule, typically several hundred nucleotides long.

VGR3135 precursor RNA folds spatially, forming VGR3135 folded precursor RNA, herein designated VGR FOLDED PRECURSOR RNA. It is appreciated that VGR3135 folded precursor RNA comprises a plurality of what is known in the art as 'hairpin' structures. These 'hairpin' structures are due to the fact that the nucleotide sequence of VGR3135 precursor RNA comprises a plurality of segments, the first half of each such segment having a nucleotide sequence which is at least a partial inversed-reversed sequence of the second half thereof, as is well known in the art.

VGR3135 folded precursor RNA is naturally processed by cellular enzymatic activity into at least 5 separate VGAM precursor RNAs, VGAM1842 precursor RNA, VGAM1843 precursor RNA, VGAM1844 precursor RNA, VGAM1845 precursor RNA and VGAM1846 precursor RNA, herein schematically represented by VGAM1 FOLDED PRECUR- SOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1842 RNA, VGAM1843 RNA, VGAM1844 RNA, VGAM1845 RNA and VGAM1846 RNA, herein schematically represented by VGAM1 RNA through VGAM3 RNA, each of which VGAM RNAs corresponding to VGAM RNA of FIG. 1.

VGAM1842 RNA, herein schematically represented by VGAM1 RNA through VGAM3 RNA, binds complementarily to a host target binding site located in an untranslated region of VGAM1842 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1842 host target RNA into VGAM1842 host target protein, herein schematically represented by VGAM1 HOST TARGET PROTEIN through VGAM3 HOST TARGET PROTEIN, all of FIG. 1.

VGAM1843 RNA, herein schematically represented by VGAM1 RNA through VGAM3 RNA, binds complementarily to a host target binding site located in an untranslated region of VGAM1843 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1843 host target RNA into VGAM1843 host target protein, herein schematically represented by VGAM1 HOST TARGET PROTEIN through VGAM3 HOST TARGET PROTEIN, all of FIG. 1.

VGAM1844 RNA, herein schematically represented by VGAM1 RNA through VGAM3 RNA, binds complementarily to a host target binding site located in an untranslated region of VGAM1844 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1844 host target RNA into VGAM1844 host target protein, herein schematically represented by VGAM1 HOST TARGET PROTEIN through VGAM3 HOST TARGET PROTEIN, all of FIG. 1.

VGAM1845 RNA, herein schematically represented by VGAM1 RNA through VGAM3 RNA, binds complementarily to a host target binding site located in an untranslated region of VGAM1845 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1845 host target RNA into VGAM1845 host target protein, herein schematically represented by VGAM1 HOST TARGET PROTEIN through VGAM3 HOST TARGET PROTEIN, all of FIG. 1.

VGAM1846 RNA, herein schematically represented by VGAM1 RNA through VGAM3 RNA, binds complementarily to a host target binding site located in an untranslated region of VGAM1846 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1846 host target RNA into VGAM1846 host target protein, herein schematically represented by VGAM1 HOST TARGET PROTEIN through VGAM3 HOST TARGET PROTEIN, all of FIG. 1.

It is appreciated that a function of VGR3135 gene, herein designated VGR GENE, is inhibition of expression of host target genes, as part of a novel viral mechanism of attacking a host. Accordingly, utilities of VGR3135 gene include diagnosis, prevention and treatment of viral infection by Chimpanzee Cytomegalovirus. Specific functions, and accordingly utilities, of VGR3135 gene correlate with, and may be deduced from, the identity of the host target genes, which are inhibited by VGAM RNAs comprised in the 'operon-like' cluster of VGR3135 gene: VGAM1842 host target protein, VGAM1843 host target protein, VGAM1844 host target protein, VGAM1845 host target protein and VGAM1846 host target protein, herein schematically represented by VGAM1 HOST TARGET PROTEIN through VGAM3 HOST TARGET PROTEIN. The function of these host target genes is elaborated hereinabove with reference to VGAM1842, VGAM1843, VGAM1844, VGAM1845 and VGAM1846. FIG. 9 further provides a conceptual description of novel bioinformatically detected regulatory viral gene, referred to here as Viral Genomic Record 3136(VGR3136) viral gene, which encodes an 'operon-like' cluster of novel viral micro RNA-like genes, each of which in turn modulates expression of at least one host target gene, the function and utility of which at least one host target gene is known in the art.

VGR3136 gene, herein designated VGR GENE, is a novel bioinformatically detected regulatory, non protein coding, RNA viral gene. The method by which VGR3136 gene was detected is described hereinabove with reference to FIGS. 1-9.

VGR3136 gene encodes VGR3136 precursor RNA, herein designated VGR PRECURSOR RNA, an RNA molecule, typically several hundred nucleotides long.

VGR3136 precursor RNA folds spatially, forming VGR3136 folded precursor RNA, herein designated VGR FOLDED PRECURSOR RNA. It is appreciated that VGR3136 folded precursor RNA comprises a plurality of what is known in the art as 'hairpin' structures. These 'hairpin' structures are due to the fact that the nucleotide sequence of VGR3136 precursor RNA comprises a plurality of segments, the first half of each such segment having a nucleotide sequence which is at least a partial inversed-reversed sequence of the second half thereof, as is well known in the art.

VGR3136 folded precursor RNA is naturally processed by cellular enzymatic activity into at least 7 separate VGAM precursor RNAs, VGAM1847 precursor RNA, VGAM1848 precursor RNA, VGAM1849 precursor RNA, VGAM1850 precursor RNA, VGAM1851 precursor RNA, VGAM1852 precursor RNA and VGAM1853 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1847 RNA, VGAM1848 RNA, VGAM1849 RNA, VGAM1850 RNA, VGAM1851 RNA, VGAM1852 RNA and VGAM1853 RNA, herein schematically represented by VGAM1 RNA through VGAM3 RNA, each of which VGAM RNAs corresponding to VGAM RNA of FIG. 1.

VGAM1847 RNA, herein schematically represented by VGAM1 RNA through VGAM3 RNA, binds complementarily to a host target binding site located in an untranslated region of VGAM1847 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1847 host target RNA into VGAM1847 host target protein, herein schematically represented by VGAM1 HOST TARGET PROTEIN through VGAM3 HOST TARGET PROTEIN, all of FIG. 1.

VGAM1848 RNA, herein schematically represented by VGAM1 RNA through VGAM3 RNA, binds complementarily to a host target binding site located in an untranslated region of VGAM1848 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1848 host target RNA into VGAM1848 host target protein, herein schematically represented by VGAM1 HOST TARGET PROTEIN through VGAM3 HOST TARGET PROTEIN, all of FIG. 1.

VGAM1849 RNA, herein schematically represented by VGAM1 RNA through VGAM3 RNA, binds complementarily to a host target binding site located in an untranslated region of VGAM1849 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1849 host target RNA into VGAM1849 host target protein, herein schematically represented by VGAM1 HOST TARGET PROTEIN through VGAM3 HOST TARGET PROTEIN, all of FIG. 1.

VGAM1850 RNA, herein schematically represented by VGAM1 RNA through VGAM3 RNA, binds complementarily to a host target binding site located in an untranslated region of VGAM1850 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1850 host target RNA into VGAM1850 host target protein, herein schematically represented by VGAM1 HOST TARGET PROTEIN through VGAM3 HOST TARGET PROTEIN, all of FIG. 1.

VGAM1851 RNA, herein schematically represented by VGAM1 RNA through VGAM3 RNA, binds complementarily to a host target binding site located in an untranslated region of VGAM1851 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1851 host target RNA into VGAM1851 host target protein, herein schematically represented by VGAM1 HOST TARGET PROTEIN through VGAM3 HOST TARGET PROTEIN, all of FIG. 1.

VGAM1852 RNA, herein schematically represented by VGAM1 RNA through VGAM3 RNA, binds complementarily to a host target binding site located in an untranslated region of VGAM1852 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1852 host target RNA into VGAM1852 host target protein, herein schematically represented by VGAM1 HOST TARGET PROTEIN through VGAM3 HOST TARGET PROTEIN, all of FIG. 1.

VGAM1853 RNA, herein schematically represented by VGAM1 RNA through VGAM3 RNA, binds complementarily to a host target binding site located in an untranslated region of VGAM1853 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1853 host target RNA into VGAM1853 host target protein, herein schematically represented by VGAM1 HOST TARGET PROTEIN through VGAM3 HOST TARGET PROTEIN, all of FIG. 1.

It is appreciated that a function of VGR3136 gene, herein designated VGR GENE, is inhibition of expression of host target genes, as part of a novel viral mechanism of attacking a host. Accordingly, utilities of VGR3136 gene include diagnosis, prevention and treatment of viral infection by Sonchus Yellow Net Virus. Specific functions, and accordingly utilities, of VGR3136 gene correlate with, and may be deduced from, the identity of the host target genes, which are inhibited by VGAM RNAs comprised in the 'operon-like' cluster of VGR3136 gene: VGAM1847 host target protein, VGAM1848 host target protein, VGAM1849 host target protein, VGAM1850 host target protein, VGAM1851 host target protein, VGAM1852 host target protein and VGAM1853 host target protein, herein schematically represented by VGAM1 HOST TARGET PROTEIN through VGAM3 HOST TARGET PROTEIN. The function of these host target genes is elaborated hereinabove with reference to VGAM1847, VGAM1848, VGAM1849, VGAM1850, VGAM1851, VGAM1852 and VGAM1853. FIG. 9 further provides a conceptual description of novel bioinformatically detected regulatory viral gene, referred to here as Viral Genomic Record 3137(VGR3137) viral gene, which encodes an 'operon-like' cluster of novel viral micro RNA-like genes, each of which in turn modulates expression of at least one host target gene, the function and utility of which at least one host target gene is known in the art.

VGR3137 gene, herein designated VGR GENE, is a novel bioinformatically detected regulatory, non protein coding, RNA viral gene. The method by which VGR3137 gene was detected is described hereinabove with reference to FIGS. 1-9.

VGR3137 gene encodes VGR3137 precursor RNA, herein designated VGR PRECURSOR RNA, an RNA molecule, typically several hundred nucleotides long.

VGR3137 precursor RNA folds spatially, forming VGR3137 folded precursor RNA, herein designated VGR FOLDED PRECURSOR RNA. It is appreciated that VGR3137 folded precursor RNA comprises a plurality of what is known in the art as 'hairpin' structures. These 'hairpin' structures are due to the fact that the nucleotide sequence of VGR3137 precursor RNA comprises a plurality of segments, the first half of each such segment having a nucleotide sequence which is at least a partial inversed-reversed sequence of the second half thereof, as is well known in the art.

VGR3137 folded precursor RNA is naturally processed by cellular enzymatic activity into at least 2 separate VGAM precursor RNAs, VGAM1854 precursor RNA and VGAM1855 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1854 RNA and VGAM1855 RNA, herein schematically represented by VGAM1 RNA through VGAM3 RNA, each of which VGAM RNAs corresponding to VGAM RNA of FIG. 1.

VGAM1854 RNA, herein schematically represented by VGAM1 RNA through VGAM3 RNA, binds complementarily to a host target binding site located in an untranslated region of VGAM1854 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1854 host target RNA into VGAM1854 host target protein, herein schematically represented by VGAM1 HOST TARGET PROTEIN through VGAM3 HOST TARGET PROTEIN, all of FIG. 1.

VGAM1855 RNA, herein schematically represented by VGAM1 RNA through VGAM3 RNA, binds complementarily to a host target binding site located in an untranslated region of VGAM1855 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1855 host target RNA into VGAM1855 host target protein, herein schematically represented by VGAM1 HOST TARGET PROTEIN through VGAM3 HOST TARGET PROTEIN, all of FIG. 1.

It is appreciated that a function of VGR3137 gene, herein designated VGR GENE, is inhibition of expression of host target genes, as part of a novel viral mechanism of attacking a host. Accordingly, utilities of VGR3137 gene include diagnosis, prevention and treatment of viral infection by Cowpea Chlorotic Mottle Virus. Specific functions, and accordingly utilities, of VGR3137 gene correlate with, and may be deduced from, the identity of the host target genes, which are inhibited by VGAM RNAs comprised in the 'operon-like' cluster of VGR3137 gene: VGAM1854 host target protein and VGAM1855 host target protein, herein schematically represented by VGAM1 HOST TARGET PROTEIN through VGAM3 HOST TARGET PROTEIN. The function of these host target genes is elaborated hereinabove with reference to VGAM1854 and VGAM1855. FIG. 9 further provides a conceptual description of novel bioinformatically detected regulatory viral gene, referred to here as Viral Genomic Record 3138(VGR3138) viral gene, which encodes an 'operon-like' cluster of novel viral micro RNA-like genes, each of which in turn modulates expression of at least one host target gene, the function and utility of which at least one host target gene is known in the art.

VGR3138 gene, herein designated VGR GENE, is a novel bioinformatically detected regulatory, non protein coding, RNA viral gene. The method by which VGR3138 gene was detected is described hereinabove with reference to FIGS. 1-9.

VGR3138 gene encodes VGR3138 precursor RNA, herein designated VGR PRECURSOR RNA, an RNA molecule, typically several hundred nucleotides long.

VGR3138 precursor RNA folds spatially, forming VGR3138 folded precursor RNA, herein designated VGR FOLDED PRECURSOR RNA. It is appreciated that VGR3138 folded precursor RNA comprises a plurality of what is known in the art as 'hairpin' structures. These 'hairpin' structures are due to the fact that the nucleotide sequence of VGR3138 precursor RNA comprises a plurality of segments, the first half of each such segment having a nucleotide sequence which is at least a partial inversed-reversed sequence of the second half thereof, as is well known in the art.

VGR3138 folded precursor RNA is naturally processed by cellular enzymatic activity into at least 6 separate VGAM precursor RNAs, VGAM1856 precursor RNA, VGAM1857 precursor RNA, VGAM1858 precursor RNA, VGAM1859 precursor RNA, VGAM1860 precursor RNA and VGAM1861 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1856 RNA, VGAM1857 RNA, VGAM1858 RNA, VGAM1859 RNA, VGAM1860 RNA and VGAM1861 RNA, herein schematically represented by VGAM1 RNA through VGAM3 RNA, each of which VGAM RNAs corresponding to VGAM RNA of FIG. 1.

VGAM1856 RNA, herein schematically represented by VGAM1 RNA through VGAM3 RNA, binds complementarily to a host target binding site located in an untranslated region of VGAM1856 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1856 host target RNA into VGAM1856 host target protein, herein schematically represented by VGAM1 HOST TARGET PROTEIN through VGAM3 HOST TARGET PROTEIN, all of FIG. 1.

VGAM1857 RNA, herein schematically represented by VGAM1 RNA through VGAM3 RNA, binds complementarily to a host target binding site located in an untranslated region of VGAM1857 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1857 host target RNA into VGAM1857 host target protein, herein schematically represented by VGAM1 HOST TARGET PROTEIN through VGAM3 HOST TARGET PROTEIN, all of FIG. 1.

VGAM1858 RNA, herein schematically represented by VGAM1 RNA through VGAM3 RNA, binds complementarily to a host target binding site located in an untranslated region of VGAM1858 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1858 host target RNA into VGAM1858 host target protein, herein schematically represented by VGAM1 HOST TARGET PROTEIN through VGAM3 HOST TARGET PROTEIN, all of FIG. 1.

VGAM1859 RNA, herein schematically represented by VGAM1 RNA through VGAM3 RNA, binds complementarily to a host target binding site located in an untranslated region of VGAM1859 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1859 host target RNA into VGAM1859 host target protein, herein schematically represented by VGAM1 HOST TARGET PROTEIN through VGAM3 HOST TARGET PROTEIN, all of FIG. 1.

VGAM1860 RNA, herein schematically represented by VGAM1 RNA through VGAM3 RNA, binds complementarily to a host target binding site located in an untranslated region of VGAM1860 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1860 host target RNA into VGAM1860 host target protein, herein schematically represented by VGAM1 HOST TARGET PROTEIN through VGAM3 HOST TARGET PROTEIN, all of FIG. 1.

VGAM1861 RNA, herein schematically represented by VGAM1 RNA through VGAM3 RNA, binds complementarily to a host target binding site located in an untranslated region of VGAM1861 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1861 host target RNA into VGAM1861 host target protein, herein schematically represented by VGAM1 HOST TARGET PROTEIN through VGAM3 HOST TARGET PROTEIN, all of FIG. 1.

It is appreciated that a function of VGR3138 gene, herein designated VGR GENE, is inhibition of expression of host target genes, as part of a novel viral mechanism of attacking a host. Accordingly, utilities of VGR3138 gene include diagnosis, prevention and treatment of viral infection by Rice Yellow Stunt Virus. Specific functions, and accordingly utilities, of VGR3138 gene correlate with, and may be deduced from, the identity of the host target genes, which are inhibited by VGAM RNAs comprised in the 'operon-like' cluster of VGR3138 gene: VGAM1856 host target protein, VGAM1857 host target protein, VGAM1858 host target protein, VGAM1859 host target protein, VGAM1860 host target protein and VGAM1861 host target protein, herein schematically represented by VGAM1 HOST TARGET PROTEIN through VGAM3 HOST TARGET PROTEIN. The function of these host target genes is elaborated hereinabove with reference to VGAM1856, VGAM1857, VGAM1858, VGAM1859, VGAM1860 and VGAM1861. FIG. 9 further provides a conceptual description of novel bioinformatically detected regulatory viral gene, referred to here as Viral Genomic Record 3139(VGR3139) viral gene, which encodes an 'operon-like' cluster of novel viral micro RNA-like genes, each of which in turn modulates expression of at least one host target gene, the function and utility of which at least one host target gene is known in the art.

VGR3139 gene, herein designated VGR GENE, is a novel bioinformatically detected regulatory, non protein coding, RNA viral gene. The method by which VGR3139 gene was detected is described hereinabove with reference to FIGS. 1-9.

VGR3139 gene encodes VGR3139 precursor RNA, herein designated VGR PRECURSOR RNA, an RNA molecule, typically several hundred nucleotides long.

VGR3139 precursor RNA folds spatially, forming VGR3139 folded precursor RNA, herein designated VGR FOLDED PRECURSOR RNA. It is appreciated that VGR3139 folded precursor RNA comprises a plurality of what is known in the art as 'hairpin' structures. These 'hairpin' structures are due to the fact that the nucleotide sequence of VGR3139 precursor RNA comprises a plurality of segments, the first half of each such segment having a nucleotide sequence which is at least a partial inversed-reversed sequence of the second half thereof, as is well known in the art.

VGR3139 folded precursor RNA is naturally processed by cellular enzymatic activity into at least 6 separate VGAM precursor RNAs, VGAM1863 precursor RNA, VGAM1864 precursor RNA, VGAM1865 precursor RNA, VGAM1866 precursor RNA, VGAM1867 precursor RNA and VGAM1868 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1863 RNA, VGAM1864 RNA, VGAM1865 RNA, VGAM1866 RNA, VGAM1867 RNA and VGAM1868 RNA, herein schematically represented by VGAM1 RNA through VGAM3 RNA, each of which VGAM RNAs corresponding to VGAM RNA of FIG. 1.

VGAM1863 RNA, herein schematically represented by VGAM1 RNA through VGAM3 RNA, binds complementarily to a host target binding site located in an untranslated region of VGAM1863 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1863 host target RNA into VGAM1863 host target protein, herein schematically represented by VGAM1 HOST TARGET PROTEIN through VGAM3 HOST TARGET PROTEIN, all of FIG. 1.

VGAM1864 RNA, herein schematically represented by VGAM1 RNA through VGAM3 RNA, binds complementarily to a host target binding site located in an untranslated region of VGAM1864 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1864 host target RNA into VGAM1864 host target protein, herein schematically represented by VGAM1 HOST TARGET PROTEIN through VGAM3 HOST TARGET PROTEIN, all of FIG. 1.

VGAM1865 RNA, herein schematically represented by VGAM1 RNA through VGAM3 RNA, binds complementarily to a host target binding site located in an untranslated region of VGAM1865 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1865 host target RNA into VGAM1865 host target protein, herein schematically represented by VGAM1 HOST TARGET PROTEIN through VGAM3 HOST TARGET PROTEIN, all of FIG. 1.

VGAM1866 RNA, herein schematically represented by VGAM1 RNA through VGAM3 RNA, binds complementarily to a host target binding site located in an untranslated region of VGAM1866 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1866 host target RNA into VGAM1866 host target protein, herein schematically represented by VGAM1 HOST TARGET PROTEIN through VGAM3 HOST TARGET PROTEIN, all of FIG. 1.

VGAM1867 RNA, herein schematically represented by VGAM1 RNA through VGAM3 RNA, binds complementarily to a host target binding site located in an untranslated region of VGAM1867 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1867 host target RNA into VGAM1867 host target protein, herein schematically represented by VGAM1 HOST TARGET PROTEIN through VGAM3 HOST TARGET PROTEIN, all of FIG. 1.

VGAM1868 RNA, herein schematically represented by VGAM1 RNA through VGAM3 RNA, binds complementarily to a host target binding site located in an untranslated region of VGAM1868 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1868 host target RNA into VGAM1868 host target protein, herein schematically represented by VGAM1 HOST TARGET PROTEIN through VGAM3 HOST TARGET PROTEIN, all of FIG. 1.

It is appreciated that a function of VGR3139 gene, herein designated VGR GENE, is inhibition of expression of host target genes, as part of a novel viral mechanism of attacking a host. Accordingly, utilities of VGR3139 gene include diagnosis, prevention and treatment of viral infection by Callitrichine Herpesvirus 3. Specific functions, and accordingly utilities, of VGR3139 gene correlate with, and may be deduced from, the identity of the host target genes, which are inhibited by VGAM RNAs comprised in the 'operon-like' cluster of VGR3139 gene: VGAM1863 host target protein, VGAM1864 host target protein, VGAM1865 host target protein, VGAM1866 host target protein, VGAM1867 host target protein and VGAM1868 host target protein, herein schematically represented by VGAM1 HOST TARGET PROTEIN through VGAM3 HOST TARGET PROTEIN. The function of these host target genes is elaborated hereinabove with reference to VGAM1863, VGAM1864, VGAM1865, VGAM1866, VGAM1867 and VGAM1868. FIG. 9 further provides a conceptual description of novel bioinformatically detected regulatory viral gene, referred to here as Viral Genomic Record 3140(VGR3140) viral gene, which encodes an 'operon-like' cluster of novel viral micro RNA-like genes, each of which in turn modulates expression of at least one host target gene, the function and utility of which at least one host target gene is known in the art.

VGR3140 gene, herein designated VGR GENE, is a novel bioinformatically detected regulatory, non protein coding, RNA viral gene. The method by which VGR3140 gene was detected is described hereinabove with reference to FIGS. 1-9.

VGR3140 gene encodes VGR3140 precursor RNA, herein designated VGR PRECURSOR RNA, an RNA molecule, typically several hundred nucleotides long.

VGR3140 precursor RNA folds spatially, forming VGR3140 folded precursor RNA, herein designated VGR FOLDED PRECURSOR RNA. It is appreciated that VGR3140 folded precursor RNA comprises a plurality of what is known in the art as 'hairpin' structures. These 'hairpin' structures are due to the fact that the nucleotide sequence of VGR3140 precursor RNA comprises a plurality of segments, the first half of each such segment having a nucleotide sequence which is at least a partial inversed-reversed sequence of the second half thereof, as is well known in the art.

VGR3140 folded precursor RNA is naturally processed by cellular enzymatic activity into at least 8 separate VGAM precursor RNAs, VGAM1870 precursor RNA, VGAM1871 precursor RNA, VGAM1872 precursor RNA, VGAM1873 precursor RNA, VGAM1874 precursor RNA, VGAM1875 precursor RNA, VGAM1876 precursor RNA and VGAM1877 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1870 RNA, VGAM1871 RNA, VGAM1872 RNA, VGAM1873 RNA, VGAM1874 RNA, VGAM1875 RNA, VGAM1876 RNA and VGAM1877 RNA, herein schematically represented by VGAM1 RNA through VGAM3 RNA, each of which VGAM RNAs corresponding to VGAM RNA of FIG. 1.

VGAM1870 RNA, herein schematically represented by VGAM1 RNA through VGAM3 RNA, binds complementarily to a host target binding site located in an untranslated region of VGAM1870 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1870 host target RNA into VGAM1870 host target protein, herein schematically represented by VGAM1 HOST TARGET PROTEIN through VGAM3 HOST TARGET PROTEIN, all of FIG. 1.

VGAM1871 RNA, herein schematically represented by VGAM1 RNA through VGAM3 RNA, binds complementarily to a host target binding site located in an untranslated region of VGAM1871 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1871 host target RNA into VGAM1871 host target protein, herein schematically represented by VGAM1 HOST TARGET PROTEIN through VGAM3 HOST TARGET PROTEIN, all of FIG. 1.

VGAM1872 RNA, herein schematically represented by VGAM1 RNA through VGAM3 RNA, binds complementarily to a host target binding site located in an untranslated region of VGAM1872 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM1872 host target RNA into VGAM1872 host target protein, herein schematically represented by VGAM1 HOST TARGET PROTEIN through VGAM3 HOST TARGET PROTEIN, all of FIG. 1.

VGAM1873 RNA, herein schematically represented by VGAM1 RNA through VGAM3 RNA, binds complementarily to a host target binding site located in an untranslated region of VGAM1873 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1873 host target RNA into VGAM1873 host target protein, herein schematically represented by VGAM1 HOST TARGET PROTEIN through VGAM3 HOST TARGET PROTEIN, all of FIG. 1.

VGAM1874 RNA, herein schematically represented by VGAM1 RNA through VGAM3 RNA, binds complementarily to a host target binding site located in an untranslated region of VGAM1874 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1874 host target RNA into VGAM1874 host target protein, herein schematically represented by VGAM1 HOST TARGET PROTEIN through VGAM3 HOST TARGET PROTEIN, all of FIG. 1.

VGAM1875 RNA, herein schematically represented by VGAM1 RNA through VGAM3 RNA, binds complementarily to a host target binding site located in an untranslated region of VGAM1875 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1875 host target RNA into VGAM1875 host target protein, herein schematically represented by VGAM1 HOST TARGET PROTEIN through VGAM3 HOST TARGET PROTEIN, all of FIG. 1.

VGAM1876 RNA, herein schematically represented by VGAM1 RNA through VGAM3 RNA, binds complementarily to a host target binding site located in an untranslated region of VGAM1876 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1876 host target RNA into VGAM1876 host target protein, herein schematically represented by VGAM1 HOST TARGET PROTEIN through VGAM3 HOST TARGET PROTEIN, all of FIG. 1.

VGAM1877 RNA, herein schematically represented by VGAM1 RNA through VGAM3 RNA, binds complementarily to a host target binding site located in an untranslated region of VGAM1877 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1877 host target RNA into VGAM1877 host target protein, herein schematically represented by VGAM1 HOST TARGET PROTEIN through VGAM3 HOST TARGET PROTEIN, all of FIG. 1.

It is appreciated that a function of VGR3140 gene, herein designated VGR GENE, is inhibition of expression of host target genes, as part of a novel viral mechanism of attacking a host. Accordingly, utilities of VGR3140 gene include diagnosis, prevention and treatment of viral infection by Fowlpox Virus. Specific functions, and accordingly utilities, of VGR3140 gene correlate with, and may be deduced from, the identity of the host target genes, which are inhibited by VGAM RNAs comprised in the 'operon-like' cluster of VGR3140 gene: VGAM1870 host target protein, VGAM1871 host target protein, VGAM1872 host target protein, VGAM1873 host target protein, VGAM1874 host target protein, VGAM1875 host target protein, VGAM1876 host target protein and VGAM1877 host target protein, herein schematically represented by VGAM1 HOST TARGET PROTEIN through VGAM3 HOST TARGET PROTEIN. The function of these host target genes is elaborated hereinabove with reference to VGAM1870, VGAM1871, VGAM1872, VGAM1873, VGAM1874, VGAM1875, VGAM1876 and VGAM1877. FIG. 9 further provides a conceptual description of novel bioinformatically detected regulatory viral gene, referred to here as Viral Genomic Record 3141(VGR3141) viral gene, which encodes an 'operon-like' cluster of novel viral micro RNA-like genes, each of which in turn modulates expression of at least one host target gene, the function and utility of which at least one host target gene is known in the art.

VGR3141 gene, herein designated VGR GENE, is a novel bioinformatically detected regulatory, non protein coding, RNA viral gene. The method by which VGR3141 gene was detected is described hereinabove with reference to FIGS. 1-9.

VGR3141 gene encodes VGR3141 precursor RNA, herein designated VGR PRECURSOR RNA, an RNA molecule, typically several hundred nucleotides long.

VGR3141 precursor RNA folds spatially, forming VGR3141 folded precursor RNA, herein designated VGR FOLDED PRECURSOR RNA. It is appreciated that VGR3141 folded precursor RNA comprises a plurality of what is known in the art as 'hairpin' structures. These 'hairpin' structures are due to the fact that the nucleotide sequence of VGR3141 precursor RNA comprises a plurality of segments, the first half of each such segment having a nucleotide sequence which is at least a partial inversed-reversed sequence of the second half thereof, as is well known in the art.

VGR3141 folded precursor RNA is naturally processed by cellular enzymatic activity into at least 7 separate VGAM precursor RNAs, VGAM1878 precursor RNA, VGAM1879 precursor RNA, VGAM1880 precursor RNA, VGAM1881 precursor RNA, VGAM1882 precursor RNA, VGAM1883 precursor RNA and VGAM1884 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1878 RNA, VGAM1879 RNA, VGAM1880 RNA, VGAM1881 RNA, VGAM1882 RNA, VGAM1883 RNA and VGAM1884 RNA, herein schematically represented by VGAM1 RNA through VGAM3 RNA, each of which VGAM RNAs corresponding to VGAM RNA of FIG. 1.

VGAM1878 RNA, herein schematically represented by VGAM1 RNA through VGAM3 RNA, binds complementarily to a host target binding site located in an untranslated region of VGAM1878 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1878 host target RNA into VGAM1878 host target protein, herein schematically represented by VGAM1 HOST TARGET PROTEIN through VGAM3 HOST TARGET PROTEIN, all of FIG. 1.

VGAM1879 RNA, herein schematically represented by VGAM1 RNA through VGAM3 RNA, binds complementarily to a host target binding site located in an untranslated region of VGAM1879 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1879 host target RNA into VGAM1879 host target protein, herein schematically represented by VGAM1 HOST TARGET PROTEIN through VGAM3 HOST TARGET PROTEIN, all of FIG. 1.

VGAM1880 RNA, herein schematically represented by VGAM1 RNA through VGAM3 RNA, binds complementarily to a host target binding site located in an untranslated region of VGAM1880 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1880 host target RNA into VGAM1880 host target protein, herein schematically represented by VGAM1 HOST TARGET PROTEIN through VGAM3 HOST TARGET PROTEIN, all of FIG. 1.

VGAM1881 RNA, herein schematically represented by VGAM1 RNA through VGAM3 RNA, binds complementarily to a host target binding site located in an untranslated region of VGAM1881 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1881 host target RNA into VGAM1881 host target protein, herein schematically represented by VGAM1 HOST TARGET PROTEIN through VGAM3 HOST TARGET PROTEIN, all of FIG. 1.

VGAM1882 RNA, herein schematically represented by VGAM1 RNA through VGAM3 RNA, binds complementarily to a host target binding site located in an untranslated region of VGAM1882 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1882 host target RNA into VGAM1882 host target protein, herein schematically represented by VGAM1 HOST TARGET PROTEIN through VGAM3 HOST TARGET PROTEIN, all of FIG. 1.

VGAM1883 RNA, herein schematically represented by VGAM1 RNA through VGAM3 RNA, binds complementarily to a host target binding site located in an untranslated region of VGAM1883 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1883 host target RNA into VGAM1883 host target protein, herein schematically represented by VGAM1 HOST TARGET PROTEIN through VGAM3 HOST TARGET PROTEIN, all of FIG. 1.

VGAM1884 RNA, herein schematically represented by VGAM1 RNA through VGAM3 RNA, binds complementarily to a host target binding site located in an untranslated region of VGAM1884 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1884 host target RNA into VGAM1884 host target protein, herein schematically represented by VGAM1 HOST TARGET PROTEIN through VGAM3 HOST TARGET PROTEIN, all of FIG. 1.

It is appreciated that a function of VGR3141 gene, herein designated VGR GENE, is inhibition of expression of host target genes, as part of a novel viral mechanism of attacking a host. Accordingly, utilities of VGR3141 gene include diagnosis, prevention and treatment of viral infection by Bovine Respiratory Syncytial Virus. Specific functions, and accordingly utilities, of VGR3141 gene correlate with, and may be deduced from, the identity of the host target genes, which are inhibited by VGAM RNAs comprised in the 'operon-like' cluster of VGR3141 gene: VGAM1878 host target protein, VGAM1879 host target protein, VGAM1880 host target protein, VGAM1881 host target protein, VGAM1882 host target protein, VGAM1883 host target protein and VGAM1884 host target protein, herein schematically represented by VGAM1 HOST TARGET PROTEIN through VGAM3 HOST TARGET PROTEIN. The function of these host target genes is elaborated hereinabove with reference to VGAM1878, VGAM1879, VGAM1880, VGAM1881, VGAM1882, VGAM1883 and VGAM1884. FIG. 9 further provides a conceptual description of novel bioinformatically detected regulatory viral gene, referred to here as Viral Genomic Record 3142(VGR3142) viral gene, which encodes an 'operon-like' cluster of novel viral micro RNA-like genes, each of which in turn modulates expression of at least one host target gene, the function and utility of which at least one host target gene is known in the art.

VGR3142 gene, herein designated VGR GENE, is a novel bioinformatically detected regulatory, non protein coding, RNA viral gene. The method by which VGR3142 gene was detected is described hereinabove with reference to FIGS. 1-9.

VGR3142 gene encodes VGR3142 precursor RNA, herein designated VGR PRECURSOR RNA, an RNA molecule, typically several hundred nucleotides long.

VGR3142 precursor RNA folds spatially, forming VGR3142 folded precursor RNA, herein designated VGR FOLDED PRECURSOR RNA. It is appreciated that VGR3142 folded precursor RNA comprises a plurality of what is known in the art as 'hairpin' structures. These 'hairpin' structures are due to the fact that the nucleotide sequence of VGR3142 precursor RNA comprises a plurality of segments, the first half of each such segment having a nucleotide sequence which is at least a partial inversed-reversed sequence of the second half thereof, as is well known in the art.

VGR3142 folded precursor RNA is naturally processed by cellular enzymatic activity into at least 7 separate VGAM precursor RNAs, VGAM1885 precursor RNA, VGAM1886 precursor RNA, VGAM1887 precursor RNA, VGAM1888 precursor RNA, VGAM1889 precursor RNA, VGAM1890 precursor RNA and VGAM1891 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1885 RNA, VGAM1886 RNA, VGAM1887 RNA, VGAM1888 RNA, VGAM1889 RNA, VGAM1890 RNA and VGAM1891 RNA, herein schematically represented by VGAM1 RNA through VGAM3 RNA, each of which VGAM RNAs corresponding to VGAM RNA of FIG. 1.

VGAM1885 RNA, herein schematically represented by VGAM1 RNA through VGAM3 RNA, binds complementarily to a host target binding site located in an untranslated region of VGAM1885 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1885 host target RNA into VGAM1885 host target protein, herein schematically represented by VGAM1 HOST TARGET PROTEIN through VGAM3 HOST TARGET PROTEIN, all of FIG. 1.

VGAM1886 RNA, herein schematically represented by VGAM1 RNA through VGAM3 RNA, binds complementarily to a host target binding site located in an untranslated region of VGAM1886 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1886 host target RNA into VGAM1886 host target protein, herein schematically represented by VGAM1 HOST TARGET PROTEIN through VGAM3 HOST TARGET PROTEIN, all of FIG. 1.

VGAM1887 RNA, herein schematically represented by VGAM1 RNA through VGAM3 RNA, binds complementarily to a host target binding site located in an untranslated region of VGAM1887 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1887 host target RNA into VGAM1887 host target protein, herein schematically represented by VGAM1 HOST TARGET PROTEIN through VGAM3 HOST TARGET PROTEIN, all of FIG. 1.

VGAM1888 RNA, herein schematically represented by VGAM1 RNA through VGAM3 RNA, binds complementarily to a host target binding site located in an untranslated region of VGAM1888 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1888 host target RNA into VGAM1888 host target protein, herein schematically represented by VGAM1 HOST TARGET PROTEIN through VGAM3 HOST TARGET PROTEIN, all of FIG. 1.

VGAM1889 RNA, herein schematically represented by VGAM1 RNA through VGAM3 RNA, binds complementarily to a host target binding site located in an untranslated region of VGAM1889 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1889 host target RNA into VGAM1889 host target protein, herein schematically represented by VGAM1 HOST TARGET PROTEIN through VGAM3 HOST TARGET PROTEIN, all of FIG. 1.

VGAM1890 RNA, herein schematically represented by VGAM1 RNA through VGAM3 RNA, binds complementarily to a host target binding site located in an untranslated region of VGAM1890 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1890 host target RNA into VGAM1890 host target protein, herein schematically represented by VGAM1 HOST TARGET PROTEIN through VGAM3 HOST TARGET PROTEIN, all of FIG. 1.

VGAM1891 RNA, herein schematically represented by VGAM1 RNA through VGAM3 RNA, binds complementarily to a host target binding site located in an untranslated region of VGAM1891 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1891 host target RNA into VGAM1891 host target protein, herein schematically represented by VGAM1 HOST TARGET PROTEIN through VGAM3 HOST TARGET PROTEIN, all of FIG. 1.

It is appreciated that a function of VGR3142 gene, herein designated VGR GENE, is inhibition of expression of host target genes, as part of a novel viral mechanism of attacking a host. Accordingly, utilities of VGR3142 gene include diagnosis, prevention and treatment of viral infection by Newcastle Disease Virus. Specific functions, and accordingly utilities, of VGR3142 gene correlate with, and may be deduced from, the identity of the host target genes, which are inhibited by VGAM RNAs comprised in the 'operon-like' cluster of VGR3142 gene: VGAM1885 host target protein, VGAM1886 host target protein, VGAM1887 host target protein, VGAM1888 host target protein, VGAM1889 host target protein, VGAM1890 host target protein and VGAM1891 host target protein, herein schematically represented by VGAM1 HOST TARGET PROTEIN through VGAM3 HOST TARGET PROTEIN. The function of these host target genes is elaborated hereinabove with reference to VGAM1885, VGAM1886, VGAM1887, VGAM1888, VGAM1889, VGAM1890 and VGAM1891. FIG. 9 further provides a conceptual description of novel bioinformatically detected regulatory viral gene, referred to here as Viral Genomic Record 3143(VGR3143) viral gene, which encodes an 'operon-like' cluster of novel viral micro RNA-like genes, each of which in turn modulates expression of at least one host target gene, the function and utility of which at least one host target gene is known in the art.

VGR3143 gene, herein designated VGR GENE, is a novel bioinformatically detected regulatory, non protein coding, RNA viral gene. The method by which VGR3143 gene was detected is described hereinabove with reference to FIGS. 1-9.

VGR3143 gene encodes VGR3143 precursor RNA, herein designated VGR PRECURSOR RNA, an RNA molecule, typically several hundred nucleotides long.

VGR3143 precursor RNA folds spatially, forming VGR3143 folded precursor RNA, herein designated VGR FOLDED PRECURSOR RNA. It is appreciated that VGR3143 folded precursor RNA comprises a plurality of what is known in the art as 'hairpin' structures. These 'hairpin' structures are due to the fact that the nucleotide sequence of VGR3143 precursor RNA comprises a plurality of segments, the first half of each such segment having a nucleotide sequence which is at least a partial inversed-reversed sequence of the second half thereof, as is well known in the art.

VGR3143 folded precursor RNA is naturally processed by cellular enzymatic activity into at least 2 separate VGAM precursor RNAs, VGAM1892 precursor RNA and VGAM1893 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1892 RNA and VGAM1893 RNA, herein schematically represented by VGAM1 RNA through VGAM3 RNA, each of which VGAM RNAs corresponding to VGAM RNA of FIG. 1.

VGAM1892 RNA, herein schematically represented by VGAM1 RNA through VGAM3 RNA, binds complementarily to a host target binding site located in an untranslated region of VGAM1892 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1892 host target RNA into VGAM1892 host target protein, herein schematically represented by VGAM1 HOST TARGET PROTEIN through VGAM3 HOST TARGET PROTEIN, all of FIG. 1.

VGAM1893 RNA, herein schematically represented by VGAM1 RNA through VGAM3 RNA, binds complementarily to a host target binding site located in an untranslated region of VGAM1893 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1893 host target RNA into VGAM1893 host target protein, herein schematically represented by VGAM1 HOST TARGET PROTEIN through VGAM3 HOST TARGET PROTEIN, all of FIG. 1.

It is appreciated that a function of VGR3143 gene, herein designated VGR GENE, is inhibition of expression of host target genes, as part of a novel viral mechanism of attacking a host. Accordingly, utilities of VGR3143 gene include diagnosis, prevention and treatment of viral infection by Newcastle Disease Virus. Specific functions, and accordingly utilities, of VGR3143 gene correlate with, and may be deduced from, the identity of the host target genes, which are inhibited by VGAM RNAs comprised in the 'operon-like' cluster of VGR3143 gene: VGAM1892 host target protein and VGAM1893 host target protein, herein schematically represented by VGAM1 HOST TARGET PROTEIN through VGAM3 HOST TARGET PROTEIN. The function of these host target genes is elaborated hereinabove with reference to VGAM1892 and VGAM1893. FIG. 9 further provides a conceptual description of novel bioinformatically detected regulatory viral gene, referred to here as Viral Genomic Record 3144(VGR3144) viral gene, which encodes an 'operon-like' cluster of novel viral micro RNA-like genes, each of which in turn modulates expression of at least one host target gene, the function and utility of which at least one host target gene is known in the art.

VGR3144 gene, herein designated VGR GENE, is a novel bioinformatically detected regulatory, non protein coding, RNA viral gene. The method by which VGR3144 gene was detected is described hereinabove with reference to FIGS. 1-9.

VGR3144 gene encodes VGR3144 precursor RNA, herein designated VGR PRECURSOR RNA, an RNA molecule, typically several hundred nucleotides long.

VGR3144 precursor RNA folds spatially, forming VGR3144 folded precursor RNA, herein designated VGR FOLDED PRECURSOR RNA. It is appreciated that VGR3144 folded precursor RNA comprises a plurality of what is known in the art as 'hairpin' structures. These 'hairpin' structures are due to the fact that the nucleotide sequence of VGR3144 precursor RNA comprises a plurality of segments, the first half of each such segment having a nucleotide sequence which is at least a partial inversed-reversed sequence of the second half thereof, as is well known in the art.

VGR3144 folded precursor RNA is naturally processed by cellular enzymatic activity into at least 8 separate VGAM precursor RNAs, VGAM1894 precursor RNA, VGAM1895 precursor RNA, VGAM1896 precursor RNA, VGAM1897 precursor RNA, VGAM1898 precursor RNA, VGAM1899 precursor RNA, VGAM1900 precursor RNA and VGAM1901 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1894 RNA, VGAM1895 RNA, VGAM1896 RNA, VGAM1897 RNA, VGAM1898 RNA, VGAM1899 RNA, VGAM1900 RNA and VGAM1901 RNA, herein schematically represented by VGAM1 RNA through VGAM3 RNA, each of which VGAM RNAs corresponding to VGAM RNA of FIG. 1.

VGAM1894 RNA, herein schematically represented by VGAM1 RNA through VGAM3 RNA, binds complementarily to a host target binding site located in an untranslated region of VGAM1894 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1894 host target RNA into VGAM1894 host target protein, herein schematically represented by VGAM1 HOST TARGET PROTEIN through VGAM3 HOST TARGET PROTEIN, all of FIG. 1.

VGAM1895 RNA, herein schematically represented by VGAM1 RNA through VGAM3 RNA, binds complementarily to a host target binding site located in an untranslated region of VGAM1895 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1895 host target RNA into VGAM1895 host target protein, herein schematically represented by VGAM1 HOST TARGET PROTEIN through VGAM3 HOST TARGET PROTEIN, all of FIG. 1.

VGAM1896 RNA, herein schematically represented by VGAM1 RNA through VGAM3 RNA, binds complementarily to a host target binding site located in an untranslated region of VGAM1896 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1896 host target RNA into VGAM1896 host target protein, herein schematically represented by VGAM1 HOST TARGET PROTEIN through VGAM3 HOST TARGET PROTEIN, all of FIG. 1.

VGAM1897 RNA, herein schematically represented by VGAM1 RNA through VGAM3 RNA, binds complementarily to a host target binding site located in an untranslated region of VGAM1897 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1897 host target RNA into VGAM1897 host target protein, herein schematically represented by VGAM1 HOST TARGET PROTEIN through VGAM3 HOST TARGET PROTEIN, all of FIG. 1.

VGAM1898 RNA, herein schematically represented by VGAM1 RNA through VGAM3 RNA, binds complementarily to a host target binding site located in an untranslated region of VGAM1898 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1898 host target RNA into VGAM1898 host target protein, herein schematically represented by VGAM1 HOST TARGET PROTEIN through VGAM3 HOST TARGET PROTEIN, all of FIG. 1.

VGAM1899 RNA, herein schematically represented by VGAM1 RNA through VGAM3 RNA, binds complementarily to a host target binding site located in an untranslated region of VGAM1899 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1899 host target RNA into VGAM1899 host target protein, herein schematically represented by VGAM1 HOST TARGET PROTEIN through VGAM3 HOST TARGET PROTEIN, all of FIG. 1.

VGAM1900 RNA, herein schematically represented by VGAM1 RNA through VGAM3 RNA, binds complementarily to a host target binding site located in an untranslated region of VGAM1900 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1900 host target RNA into VGAM1900 host target protein, herein schematically represented by VGAM1 HOST TARGET PROTEIN through VGAM3 HOST TARGET PROTEIN, all of FIG. 1.

VGAM1901 RNA, herein schematically represented by VGAM1 RNA through VGAM3 RNA, binds complementarily to a host target binding site located in an untranslated region of VGAM1901 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1901 host target RNA into VGAM1901 host target protein, herein schematically represented by VGAM1 HOST TARGET PROTEIN through VGAM3 HOST TARGET PROTEIN, all of FIG. 1.

It is appreciated that a function of VGR3144 gene, herein designated VGR GENE, is inhibition of expression of host target genes, as part of a novel viral mechanism of attacking a host. Accordingly, utilities of VGR3144 gene include diagnosis, prevention and treatment of viral infection by Respiratory Syncytial Virus. Specific functions, and accordingly utilities, of VGR3144 gene correlate with, and may be deduced from, the identity of the host target genes, which are inhibited by VGAM RNAs comprised in the 'operon-like' cluster of VGR3144 gene: VGAM1894 host target protein, VGAM1895 host target protein, VGAM1896 host target protein, VGAM1897 host target protein, VGAM1898 host target protein, VGAM1899 host target protein, VGAM1900 host target protein and VGAM1901 host target protein, herein schematically represented by VGAM1 HOST TARGET PROTEIN through VGAM3 HOST TARGET PROTEIN. The function of these host target genes is elaborated hereinabove with reference to VGAM1894, VGAM1895, VGAM1896, VGAM1897, VGAM1898, VGAM1899, VGAM1900 and VGAM1901. FIG. 9 further provides a conceptual description of novel bioinformatically detected regulatory viral gene, referred to here as Viral Genomic Record 3145(VGR3145) viral gene, which encodes an 'operon-like' cluster of novel viral micro RNA-like genes, each of which in turn modulates expression of at least one host target gene, the function and utility of which at least one host target gene is known in the art.

VGR3145 gene, herein designated VGR GENE, is a novel bioinformatically detected regulatory, non protein coding, RNA viral gene. The method by which VGR3145 gene was detected is described hereinabove with reference to FIGS. 1-9.

VGR3145 gene encodes VGR3145 precursor RNA, herein designated VGR PRECURSOR RNA, an RNA molecule, typically several hundred nucleotides long.

VGR3145 precursor RNA folds spatially, forming VGR3145 folded precursor RNA, herein designated VGR FOLDED PRECURSOR RNA. It is appreciated that VGR3145 folded precursor RNA comprises a plurality of what is known in the art as 'hairpin' structures. These 'hairpin' structures are due to the fact that the nucleotide sequence of VGR3145 precursor RNA comprises a plurality of segments, the first half of each such segment having a nucleotide sequence which is at least a partial inversed-reversed sequence of the second half thereof, as is well known in the art.

VGR3145 folded precursor RNA is naturally processed by cellular enzymatic activity into at least 3 separate VGAM precursor RNAs, VGAM1902 precursor RNA, VGAM1903 precursor RNA and VGAM1904 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1902 RNA, VGAM1903 RNA and VGAM1904 RNA, herein schematically represented by VGAM1 RNA through VGAM3 RNA, each of which VGAM RNAs corresponding to VGAM RNA of FIG. 1.

VGAM1902 RNA, herein schematically represented by VGAM1 RNA through VGAM3 RNA, binds complementarily to a host target binding site located in an untranslated region of VGAM1902 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1902 host target RNA into VGAM1902 host target protein, herein schematically represented by VGAM1 HOST TARGET PROTEIN through VGAM3 HOST TARGET PROTEIN, all of FIG. 1.

VGAM1903 RNA, herein schematically represented by VGAM1 RNA through VGAM3 RNA, binds complementarily to a host target binding site located in an untranslated region of VGAM1903 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1903 host target RNA into VGAM1903 host target protein, herein schematically represented by VGAM1 HOST TARGET PROTEIN through VGAM3 HOST TARGET PROTEIN, all of FIG. 1.

VGAM1904 RNA, herein schematically represented by VGAM1 RNA through VGAM3 RNA, binds complementarily to a host target binding site located in an untranslated region of VGAM1904 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1904 host target RNA into VGAM1904 host target protein, herein schematically represented by VGAM1 HOST TARGET PROTEIN through VGAM3 HOST TARGET PROTEIN, all of FIG. 1.

It is appreciated that a function of VGR3145 gene, herein designated VGR GENE, is inhibition of expression of host target genes, as part of a novel viral mechanism of attacking a host. Accordingly, utilities of VGR3145 gene include diagnosis, prevention and treatment of viral infection by Respiratory Syncytial Virus. Specific functions, and accordingly utilities, of VGR3145 gene correlate with, and may be deduced from, the identity of the host target genes, which are inhibited by VGAM RNAs comprised in the 'operon-like' cluster of VGR3145 gene: VGAM1902 host target protein, VGAM1903 host target protein and VGAM1904 host target protein, herein schematically represented by VGAM1 HOST TARGET PROTEIN through VGAM3 HOST TARGET PROTEIN. The function of these host target genes is elaborated hereinabove with reference to VGAM1902, VGAM1903 and VGAM1904. FIG. 9 further provides a conceptual description of novel bioinformatically detected regulatory viral gene, referred to here as Viral Genomic Record 3146(VGR3146) viral gene, which encodes an 'operon-like' cluster of novel viral micro RNA-like genes, each of which in turn modulates expression of at least one host target gene, the function and utility of which at least one host target gene is known in the art.

VGR3146 gene, herein designated VGR GENE, is a novel bioinformatically detected regulatory, non protein coding, RNA viral gene. The method by which VGR3146 gene was detected is described hereinabove with reference to FIGS. 1-9.

VGR3146 gene encodes VGR3146 precursor RNA, herein designated VGR PRECURSOR RNA, an RNA molecule, typically several hundred nucleotides long.

VGR3146 precursor RNA folds spatially, forming VGR3146 folded precursor RNA, herein designated VGR FOLDED PRECURSOR RNA. It is appreciated that VGR3146 folded precursor RNA comprises a plurality of what is known in the art as 'hairpin' structures. These 'hairpin' structures are due to the fact that the nucleotide sequence of VGR3146 precursor RNA comprises a plurality of segments, the first half of each such segment having a nucleotide sequence which is at least a partial inversed-reversed sequence of the second half thereof, as is well known in the art.

VGR3146 folded precursor RNA is naturally processed by cellular enzymatic activity into at least 2 separate VGAM precursor RNAs, VGAM1905 precursor RNA and VGAM1906 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1905 RNA and VGAM1906 RNA, herein schematically represented by VGAM1 RNA through VGAM3 RNA, each of which VGAM RNAs corresponding to VGAM RNA of FIG. 1.

VGAM1905 RNA, herein schematically represented by VGAM1 RNA through VGAM3 RNA, binds complementarily to a host target binding site located in an untranslated region of VGAM1905 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1905 host target RNA into VGAM1905 host target protein, herein schematically represented by VGAM1 HOST TARGET PROTEIN through VGAM3 HOST TARGET PROTEIN, all of FIG. 1.

VGAM1906 RNA, herein schematically represented by VGAM1 RNA through VGAM3 RNA, binds complementarily to a host target binding site located in an untranslated region of VGAM1906 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1906 host target RNA into VGAM1906 host target protein, herein schematically represented by VGAM1 HOST TARGET PROTEIN through VGAM3 HOST TARGET PROTEIN, all of FIG. 1.

It is appreciated that a function of VGR3146 gene, herein designated VGR GENE, is inhibition of expression of host target genes, as part of a novel viral mechanism of attacking a host. Accordingly, utilities of VGR3146 gene include diagnosis, prevention and treatment of viral infection by Sendai Virus. Specific functions, and accordingly utilities, of VGR3146 gene correlate with, and may be deduced from, the identity of the host target genes, which are inhibited by VGAM RNAs comprised in the 'operon-like' cluster of VGR3146 gene: VGAM1905 host target protein and VGAM1906 host target protein, herein schematically represented by VGAM1 HOST TARGET PROTEIN through VGAM3 HOST TARGET PROTEIN. The function of these host target genes is elaborated hereinabove with reference to VGAM1905 and VGAM1906. FIG. 9 further provides a conceptual description of novel bioinformatically detected regulatory viral gene, referred to here as Viral Genomic Record 3147(VGR3147) viral gene, which encodes an 'operon-like' cluster of novel viral micro RNA-like genes, each of which in turn modulates expression of at least one host target gene, the function and utility of which at least one host target gene is known in the art.

VGR3147 gene, herein designated VGR GENE, is a novel bioinformatically detected regulatory, non protein coding, RNA viral gene. The method by which VGR3147 gene was detected is described hereinabove with reference to FIGS. 1-9.

VGR3147 gene encodes VGR3147 precursor RNA, herein designated VGR PRECURSOR RNA, an RNA molecule, typically several hundred nucleotides long.

VGR3147 precursor RNA folds spatially, forming VGR3147 folded precursor RNA, herein designated VGR FOLDED PRECURSOR RNA. It is appreciated that VGR3147 folded precursor RNA comprises a plurality of what is known in the art as 'hairpin' structures. These 'hairpin' structures are due to the fact that the nucleotide sequence of VGR3147 precursor RNA comprises a plurality of segments, the first half of each such segment having a nucleotide sequence which is at least a partial inversed-reversed sequence of the second half thereof, as is well known in the art.

VGR3147 folded precursor RNA is naturally processed by cellular enzymatic activity into at least 7 separate VGAM precursor RNAs, VGAM1907 precursor RNA, VGAM1908 precursor RNA, VGAM1909 precursor RNA, VGAM1910 precursor RNA, VGAM1911 precursor RNA, VGAM1912 precursor RNA and VGAM1913 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1907 RNA, VGAM1908 RNA, VGAM1909 RNA, VGAM1910 RNA, VGAM1911 RNA, VGAM1912 RNA and VGAM1913 RNA, herein schematically represented by VGAM1 RNA through VGAM3 RNA, each of which VGAM RNAs corresponding to VGAM RNA of FIG. 1.

VGAM1907 RNA, herein schematically represented by VGAM1 RNA through VGAM3 RNA, binds complementarily to a host target binding site located in an untranslated region of VGAM1907 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1907 host target RNA into VGAM1907 host target protein, herein schematically represented by VGAM1 HOST TARGET PROTEIN through VGAM3 HOST TARGET PROTEIN, all of FIG. 1.

VGAM1908 RNA, herein schematically represented by VGAM1 RNA through VGAM3 RNA, binds complementarily to a host target binding site located in an untranslated region of VGAM1908 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1908 host target RNA into VGAM1908 host target protein, herein schematically represented by VGAM1 HOST TARGET PROTEIN through VGAM3 HOST TARGET PROTEIN, all of FIG. 1.

VGAM1909 RNA, herein schematically represented by VGAM1 RNA through VGAM3 RNA, binds complementarily to a host target binding site located in an untranslated region of VGAM1909 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1909 host target RNA into VGAM1909 host target protein, herein schematically represented by VGAM1 HOST TARGET PROTEIN through VGAM3 HOST TARGET PROTEIN, all of FIG. 1.

VGAM1910 RNA, herein schematically represented by VGAM1 RNA through VGAM3 RNA, binds complementarily to a host target binding site located in an untranslated region of VGAM1910 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1910 host target RNA into VGAM1910 host target protein, herein schematically represented by VGAM1 HOST TARGET PROTEIN through VGAM3 HOST TARGET PROTEIN, all of FIG. 1.

VGAM1911 RNA, herein schematically represented by VGAM1 RNA through VGAM3 RNA, binds complementarily to a host target binding site located in an untranslated region of VGAM1911 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1911 host target RNA into VGAM1911 host target protein, herein schematically represented by VGAM1 HOST TARGET PROTEIN through VGAM3 HOST TARGET PROTEIN, all of FIG. 1.

VGAM1912 RNA, herein schematically represented by VGAM1 RNA through VGAM3 RNA, binds complementarily to a host target binding site located in an untranslated region of VGAM1912 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1912 host target RNA into VGAM1912 host target protein, herein schematically represented by VGAM1 HOST TARGET PROTEIN through VGAM3 HOST TARGET PROTEIN, all of FIG. 1.

VGAM1913 RNA, herein schematically represented by VGAM1 RNA through VGAM3 RNA, binds complementarily to a host target binding site located in an untranslated region of VGAM1913 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1913 host target RNA into VGAM1913 host target protein, herein schematically represented by VGAM1 HOST TARGET PROTEIN through VGAM3 HOST TARGET PROTEIN, all of FIG. 1.

It is appreciated that a function of VGR3147 gene, herein designated VGR GENE, is inhibition of expression of host target genes, as part of a novel viral mechanism of attacking a host. Accordingly, utilities of VGR3147 gene include diagnosis, prevention and treatment of viral infection by Human Parainfluenza Virus 3. Specific functions, and accordingly utilities, of VGR3147 gene correlate with, and may be deduced from, the identity of the host target genes, which are inhibited by VGAM RNAs comprised in the 'operon-like' cluster of VGR3147 gene: VGAM1907 host target protein, VGAM1908 host target protein, VGAM1909 host target protein, VGAM1910 host target protein, VGAM1911 host target protein, VGAM1912 host target protein and VGAM1913 host target protein, herein schematically represented by VGAM1 HOST TARGET PROTEIN through VGAM3 HOST TARGET PROTEIN. The function of these host target genes is elaborated hereinabove with reference to VGAM1907, VGAM1908, VGAM1909, VGAM1910, VGAM1911, VGAM1912 and VGAM1913. FIG. 9 further provides a conceptual description of novel bioinformatically detected regulatory viral gene, referred to here as Viral Genomic Record 3148(VGR3148) viral gene, which encodes an 'operon-like' cluster of novel viral micro RNA-like genes, each of which in turn modulates expression of at least one host target gene, the function and utility of which at least one host target gene is known in the art.

VGR3148 gene, herein designated VGR GENE, is a novel bioinformatically detected regulatory, non protein coding, RNA viral gene. The method by which VGR3148 gene was detected is described hereinabove with reference to FIGS. 1-9.

VGR3148 gene encodes VGR3148 precursor RNA, herein designated VGR PRECURSOR RNA, an RNA molecule, typically several hundred nucleotides long.

VGR3148 precursor RNA folds spatially, forming VGR3148 folded precursor RNA, herein designated VGR FOLDED PRECURSOR RNA. It is appreciated that VGR3148 folded precursor RNA comprises a plurality of what is known in the art as 'hairpin' structures. These 'hairpin' structures are due to the fact that the nucleotide sequence of VGR3148 precursor RNA comprises a plurality of segments, the first half of each such segment having a nucleotide sequence which is at least a partial inversed-reversed sequence of the second half thereof, as is well known in the art.

VGR3148 folded precursor RNA is naturally processed by cellular enzymatic activity into at least 2 separate VGAM precursor RNAs, VGAM1914 precursor RNA and VGAM1915 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1914 RNA and VGAM1915 RNA, herein schematically represented by VGAM1 RNA through VGAM3 RNA, each of which VGAM RNAs corresponding to VGAM RNA of FIG. 1.

VGAM1914 RNA, herein schematically represented by VGAM1 RNA through VGAM3 RNA, binds complementarily to a host target binding site located in an untranslated region of VGAM1914 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1914 host target RNA into VGAM1914 host target protein, herein schematically represented by VGAM1 HOST TARGET PROTEIN through VGAM3 HOST TARGET PROTEIN, all of FIG. 1.

VGAM1915 RNA, herein schematically represented by VGAM1 RNA through VGAM3 RNA, binds complementarily to a host target binding site located in an untranslated region of VGAM1915 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1915 host target RNA into VGAM1915 host target protein, herein schematically represented by VGAM1 HOST TARGET PROTEIN through VGAM3 HOST TARGET PROTEIN, all of FIG. 1.

It is appreciated that a function of VGR3148 gene, herein designated VGR GENE, is inhibition of expression of host target genes, as part of a novel viral mechanism of attacking a host. Accordingly, utilities of VGR3148 gene include diagnosis, prevention and treatment of viral infection by Human Parainfluenza Virus 3. Specific functions, and accordingly utilities, of VGR3148 gene correlate with, and may be deduced from, the identity of the host target genes, which are inhibited by VGAM RNAs comprised in the 'operon-like' cluster of VGR3148 gene: VGAM1914 host target protein and VGAM1915 host target protein, herein schematically represented by VGAM1 HOST TARGET PROTEIN through VGAM3 HOST TARGET PROTEIN. The function of these host target genes is elaborated hereinabove with reference to VGAM1914 and VGAM1915. FIG. 9 further provides a conceptual description of novel bioinformatically detected regulatory viral gene, referred to here as Viral Genomic Record 3149(VGR3149) viral gene, which encodes an 'operon-like' cluster of novel viral micro RNA-like genes, each of which in turn modulates expression of at least one host target gene, the function and utility of which at least one host target gene is known in the art.

VGR3149 gene, herein designated VGR GENE, is a novel bioinformatically detected regulatory, non protein coding, RNA viral gene. The method by which VGR3149 gene was detected is described hereinabove with reference to FIGS. 1-9.

VGR3149 gene encodes VGR3149 precursor RNA, herein designated VGR PRECURSOR RNA, an RNA molecule, typically several hundred nucleotides long.

VGR3149 precursor RNA folds spatially, forming VGR3149 folded precursor RNA, herein designated VGR FOLDED PRECURSOR RNA. It is appreciated that VGR3149 folded precursor RNA comprises a plurality of what is known in the art as 'hairpin' structures. These 'hairpin' structures are due to the fact that the nucleotide sequence of VGR3149 precursor RNA comprises a plurality of segments, the first half of each such segment having a nucleotide sequence which is at least a partial inversed-reversed sequence of the second half thereof, as is well known in the art.

VGR3149 folded precursor RNA is naturally processed by cellular enzymatic activity into at least 3 separate VGAM precursor RNAs, VGAM1916 precursor RNA, VGAM1917 precursor RNA and VGAM1918 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1916 RNA, VGAM1917 RNA and VGAM1918 RNA, herein schematically represented by VGAM1 RNA through VGAM3 RNA, each of which VGAM RNAs corresponding to VGAM RNA of FIG. 1.

VGAM1916 RNA, herein schematically represented by VGAM1 RNA through VGAM3 RNA, binds complementarily to a host target binding site located in an untranslated region of VGAM1916 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1916 host target RNA into VGAM1916 host target protein, herein schematically represented by VGAM1 HOST TARGET PROTEIN through VGAM3 HOST TARGET PROTEIN, all of FIG. 1.

VGAM1917 RNA, herein schematically represented by VGAM1 RNA through VGAM3 RNA, binds complementarily to a host target binding site located in an untranslated region of VGAM1917 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1917 host target RNA into VGAM1917 host target protein, herein schematically represented by VGAM1 HOST TARGET PROTEIN through VGAM3 HOST TARGET PROTEIN, all of FIG. 1.

VGAM1918 RNA, herein schematically represented by VGAM1 RNA through VGAM3 RNA, binds complementarily to a host target binding site located in an untranslated region of VGAM1918 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1918 host target RNA into VGAM1918 host target protein, herein schematically represented by VGAM1 HOST TARGET PROTEIN through VGAM3 HOST TARGET PROTEIN, all of FIG. 1.

It is appreciated that a function of VGR3149 gene, herein designated VGR GENE, is inhibition of expression of host target genes, as part of a novel viral mechanism of attacking a host. Accordingly, utilities of VGR3149 gene include diagnosis, prevention and treatment of viral infection by Human Parainfluenza Virus 1 Strain Washington/1964. Specific functions, and accordingly utilities, of VGR3149 gene correlate with, and may be deduced from, the identity of the host target genes, which are inhibited by VGAM RNAs comprised in the 'operon-like' cluster of VGR3149 gene: VGAM1916 host target protein, VGAM1917 host target protein and VGAM1918 host target protein, herein schematically represented by VGAM1 HOST TARGET PROTEIN through VGAM3 HOST TARGET PROTEIN. The function of these host target genes is elaborated hereinabove with reference to VGAM1916, VGAM1917 and VGAM1918. FIG. 9 further provides a conceptual description of novel bioinformatically detected regulatory viral gene, referred to here as Viral Genomic Record 3150(VGR3150) viral gene, which encodes an 'operon-like' cluster of novel viral micro RNA-like genes, each of which in turn modulates expression of at least one host target gene, the function and utility of which at least one host target gene is known in the art.

VGR3150 gene, herein designated VGR GENE, is a novel bioinformatically detected regulatory, non protein coding, RNA viral gene. The method by which VGR3150 gene was detected is described hereinabove with reference to FIGS. 1-9.

VGR3150 gene encodes VGR3150 precursor RNA, herein designated VGR PRECURSOR RNA, an RNA molecule, typically several hundred nucleotides long.

VGR3150 precursor RNA folds spatially, forming VGR3150 folded precursor RNA, herein designated VGR FOLDED PRECURSOR RNA. It is appreciated that VGR3150 folded precursor RNA comprises a plurality of what is known in the art as 'hairpin' structures. These 'hairpin' structures are due to the fact that the nucleotide sequence of VGR3150 precursor RNA comprises a plurality of segments, the first half of each such segment having a nucleotide sequence which is at least a partial inversed-reversed sequence of the second half thereof, as is well known in the art.

VGR3150 folded precursor RNA is naturally processed by cellular enzymatic activity into at least 7 separate VGAM precursor RNAs, VGAM1920 precursor RNA, VGAM1921 precursor RNA, VGAM1922 precursor RNA, VGAM1923 precursor RNA, VGAM1924 precursor RNA, VGAM1925 precursor RNA and VGAM1926 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1920 RNA, VGAM1921 RNA, VGAM1922 RNA, VGAM1923 RNA, VGAM1924 RNA, VGAM1925 RNA and VGAM1926 RNA, herein schematically represented by VGAM1 RNA through VGAM3 RNA, each of which VGAM RNAs corresponding to VGAM RNA of FIG. 1.

VGAM1920 RNA, herein schematically represented by VGAM1 RNA through VGAM3 RNA, binds complementarily to a host target binding site located in an untranslated region of VGAM1920 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1920 host target RNA into VGAM1920 host target protein, herein schematically represented by VGAM1 HOST TARGET PROTEIN through VGAM3 HOST TARGET PROTEIN, all of FIG. 1.

VGAM1921 RNA, herein schematically represented by VGAM1 RNA through VGAM3 RNA, binds complementarily to a host target binding site located in an untranslated region of VGAM1921 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1921 host target RNA into VGAM1921 host target protein, herein schematically represented by VGAM1 HOST TARGET PROTEIN through VGAM3 HOST TARGET PROTEIN, all of FIG. 1.

VGAM1922 RNA, herein schematically represented by VGAM1 RNA through VGAM3 RNA, binds complementarily to a host target binding site located in an untranslated region of VGAM1922 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1922 host target RNA into VGAM1922 host target protein, herein schematically represented by VGAM1 HOST TARGET PROTEIN through VGAM3 HOST TARGET PROTEIN, all of FIG. 1.

VGAM1923 RNA, herein schematically represented by VGAM1 RNA through VGAM3 RNA, binds complementarily to a host target binding site located in an untranslated region of VGAM1923 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1923 host target RNA into VGAM1923 host target protein, herein schematically represented by VGAM1 HOST TARGET PROTEIN through VGAM3 HOST TARGET PROTEIN, all of FIG. 1.

VGAM1924 RNA, herein schematically represented by VGAM1 RNA through VGAM3 RNA, binds complementarily to a host target binding site located in an untranslated region of VGAM1924 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1924 host target RNA into VGAM1924 host target protein, herein schematically represented by VGAM1 HOST TARGET PROTEIN through VGAM3 HOST TARGET PROTEIN, all of FIG. 1.

VGAM1925 RNA, herein schematically represented by VGAM1 RNA through VGAM3 RNA, binds complementarily to a host target binding site located in an untranslated region of VGAM1925 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1925 host target RNA into VGAM1925 host target protein, herein schematically represented by VGAM1 HOST TARGET PROTEIN through VGAM3 HOST TARGET PROTEIN, all of FIG. 1.

VGAM1926 RNA, herein schematically represented by VGAM1 RNA through VGAM3 RNA, binds complementarily to a host target binding site located in an untranslated region of VGAM1926 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1926 host target RNA into VGAM1926 host target protein, herein schematically represented by VGAM1 HOST TARGET PROTEIN through VGAM3 HOST TARGET PROTEIN, all of FIG. 1.

It is appreciated that a function of VGR3150 gene, herein designated VGR GENE, is inhibition of expression of host target genes, as part of a novel viral mechanism of attacking a host. Accordingly, utilities of VGR3150 gene include diagnosis, prevention and treatment of viral infection by Canine Distemper Virus. Specific functions, and accordingly utilities, of VGR3150 gene correlate with, and may be deduced from, the identity of the host target genes, which are inhibited by VGAM RNAs comprised in the 'operon-like' cluster of VGR3150 gene: VGAM1920 host target protein, VGAM1921 host target protein, VGAM1922 host target protein, VGAM1923 host target protein, VGAM1924 host target protein, VGAM1925 host target protein and VGAM1926 host target protein, herein schematically represented by VGAM1 HOST TARGET PROTEIN through VGAM3 HOST TARGET PROTEIN. The function of these host target genes is elaborated hereinabove with reference to VGAM1920, VGAM1921, VGAM1922, VGAM1923, VGAM1924, VGAM1925 and VGAM1926. FIG. 9 further provides a conceptual description of novel bioinformatically detected regulatory viral gene, referred to here as Viral Genomic Record 3151(VGR3151) viral gene, which encodes an 'operon-like' cluster of novel viral micro RNA-like genes, each of which in turn modulates expression of at least one host target gene, the function and utility of which at least one host target gene is known in the art.

VGR3151 gene, herein designated VGR GENE, is a novel bioinformatically detected regulatory, non protein coding, RNA viral gene. The method by which VGR3151 gene was detected is described hereinabove with reference to FIGS. 1-9.

VGR3151 gene encodes VGR3151 precursor RNA, herein designated VGR PRECURSOR RNA, an RNA molecule, typically several hundred nucleotides long.

VGR3151 precursor RNA folds spatially, forming VGR3151 folded precursor RNA, herein designated VGR FOLDED PRECURSOR RNA. It is appreciated that VGR3151 folded precursor RNA comprises a plurality of what is known in the art as 'hairpin' structures. These 'hairpin' structures are due to the fact that the nucleotide sequence of VGR3151 precursor RNA comprises a plurality of segments, the first half of each such segment having a nucleotide sequence which is at least a partial inversed-reversed sequence of the second half thereof, as is well known in the art.

VGR3151 folded precursor RNA is naturally processed by cellular enzymatic activity into at least 2 separate VGAM precursor RNAs, VGAM1927 precursor RNA and VGAM1928 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1927 RNA and VGAM1928 RNA, herein schematically represented by VGAM1 RNA through VGAM3 RNA, each of which VGAM RNAs corresponding to VGAM RNA of FIG. 1.

VGAM1927 RNA, herein schematically represented by VGAM1 RNA through VGAM3 RNA, binds complementarily to a host target binding site located in an untranslated region of VGAM1927 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1927 host target RNA into VGAM1927 host target protein, herein schematically represented by VGAM1 HOST TARGET PROTEIN through VGAM3 HOST TARGET PROTEIN, all of FIG. 1.

VGAM1928 RNA, herein schematically represented by VGAM1 RNA through VGAM3 RNA, binds complementarily to a host target binding site located in an untranslated region of VGAM1928 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1928 host target RNA into VGAM1928 host target protein, herein schematically represented by VGAM1 HOST TARGET PROTEIN through VGAM3 HOST TARGET PROTEIN, all of FIG. 1.

It is appreciated that a function of VGR3151 gene, herein designated VGR GENE, is inhibition of expression of host target genes, as part of a novel viral mechanism of attacking a host. Accordingly, utilities of VGR3151 gene include diagnosis, prevention and treatment of viral infection by Canine Distemper Virus. Specific functions, and accordingly utilities, of VGR3151 gene correlate with, and may be deduced from, the identity of the host target genes, which are inhibited by VGAM RNAs comprised in the 'operon-like' cluster of VGR3151 gene: VGAM1927 host target protein and VGAM1928 host target protein, herein schematically represented by VGAM1 HOST TARGET PROTEIN through VGAM3 HOST TARGET PROTEIN. The function of these host target genes is elaborated hereinabove with reference to VGAM1927 and VGAM1928. FIG. 9 further provides a conceptual description of novel bioinformatically detected regulatory viral gene, referred to here as Viral Genomic Record 3152(VGR3152) viral gene, which encodes an 'operon-like' cluster of novel viral micro RNA-like genes, each of which in turn modulates expression of at least one host target gene, the function and utility of which at least one host target gene is known in the art.

VGR3152 gene, herein designated VGR GENE, is a novel bioinformatically detected regulatory, non protein coding, RNA viral gene. The method by which VGR3152 gene was detected is described hereinabove with reference to FIGS. 1-9.

VGR3152 gene encodes VGR3152 precursor RNA, herein designated VGR PRECURSOR RNA, an RNA molecule, typically several hundred nucleotides long.

VGR3152 precursor RNA folds spatially, forming VGR3152 folded precursor RNA, herein designated VGR FOLDED PRECURSOR RNA. It is appreciated that VGR3152 folded precursor RNA comprises a plurality of what is known in the art as 'hairpin' structures. These 'hairpin' structures are due to the fact that the nucleotide sequence of VGR3152 precursor RNA comprises a plurality of segments, the first half of each such segment having a nucleotide sequence which is at least a partial inversed-reversed sequence of the second half thereof, as is well known in the art.

VGR3152 folded precursor RNA is naturally processed by cellular enzymatic activity into at least 7 separate VGAM precursor RNAs, VGAM1930 precursor RNA, VGAM1931 precursor RNA, VGAM1932 precursor RNA, VGAM1933 precursor RNA, VGAM1934 precursor RNA, VGAM1935 precursor RNA and VGAM1936 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1930 RNA, VGAM1931 RNA, VGAM1932 RNA, VGAM1933 RNA, VGAM1934 RNA, VGAM1935 RNA and VGAM1936 RNA, herein schematically represented by VGAM1 RNA through VGAM3 RNA, each of which VGAM RNAs corresponding to VGAM RNA of FIG. 1.

VGAM1930 RNA, herein schematically represented by VGAM1 RNA through VGAM3 RNA, binds complementarily to a host target binding site located in an untranslated region of VGAM1930 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1930 host target RNA into VGAM1930 host target protein, herein schematically represented by VGAM1 HOST TARGET PROTEIN through VGAM3 HOST TARGET PROTEIN, all of FIG. 1.

VGAM1931 RNA, herein schematically represented by VGAM1 RNA through VGAM3 RNA, binds complementarily to a host target binding site located in an untranslated region of VGAM1931 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1931 host target RNA into VGAM1931 host target protein, herein schematically represented by VGAM1 HOST TARGET PROTEIN through VGAM3 HOST TARGET PROTEIN, all of FIG. 1.

VGAM1932 RNA, herein schematically represented by VGAM1 RNA through VGAM3 RNA, binds complementarily to a host target binding site located in an untranslated region of VGAM1932 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1932 host target RNA into VGAM1932 host target protein, herein schematically represented by VGAM1 HOST TARGET PROTEIN through VGAM3 HOST TARGET PROTEIN, all of FIG. 1.

VGAM1933 RNA, herein schematically represented by VGAM1 RNA through VGAM3 RNA, binds complementarily to a host target binding site located in an untranslated region of VGAM1933 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1933 host target RNA into VGAM1933 host target protein, herein schematically represented by VGAM1 HOST TARGET PROTEIN through VGAM3 HOST TARGET PROTEIN, all of FIG. 1.

VGAM1934 RNA, herein schematically represented by VGAM1 RNA through VGAM3 RNA, binds complementarily to a host target binding site located in an untranslated region of VGAM1934 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1934 host target RNA into VGAM1934 host target protein, herein schematically represented by VGAM1 HOST TARGET PROTEIN through VGAM3 HOST TARGET PROTEIN, all of FIG. 1.

VGAM1935 RNA, herein schematically represented by VGAM1 RNA through VGAM3 RNA, binds complementarily to a host target binding site located in an untranslated region of VGAM1935 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1935 host target RNA into VGAM1935 host target protein, herein schematically represented by VGAM1 HOST TARGET PROTEIN through VGAM3 HOST TARGET PROTEIN, all of FIG. 1.

VGAM1936 RNA, herein schematically represented by VGAM1 RNA through VGAM3 RNA, binds complementarily to a host target binding site located in an untranslated region of VGAM1936 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1936 host target RNA into VGAM1936 host target protein, herein schematically represented by VGAM1 HOST TARGET PROTEIN through VGAM3 HOST TARGET PROTEIN, all of FIG. 1.

It is appreciated that a function of VGR3152 gene, herein designated VGR GENE, is inhibition of expression of host target genes, as part of a novel viral mechanism of attacking a host. Accordingly, utilities of VGR3152 gene include diagnosis, prevention and treatment of viral infection by Human Herpesvirus 4. Specific functions, and accordingly utilities, of VGR3152 gene correlate with, and may be deduced from, the identity of the host target genes, which are inhibited by VGAM RNAs comprised in the 'operon-like' cluster of VGR3152 gene: VGAM1930 host target protein, VGAM1931 host target protein, VGAM1932 host target protein, VGAM1933 host target protein, VGAM1934 host target protein, VGAM1935 host target protein and VGAM1936 host target protein, herein schematically represented by VGAM1 HOST TARGET PROTEIN through VGAM3 HOST TARGET PROTEIN. The function of these host target genes is elaborated hereinabove with reference to VGAM1930, VGAM1931, VGAM1932, VGAM1933, VGAM1934, VGAM1935 and VGAM1936. FIG. 9 further provides a conceptual description of novel bioinformatically detected regulatory viral gene, referred to here as Viral Genomic Record 3153(VGR3153) viral gene, which encodes an 'operon-like' cluster of novel viral micro RNA-like genes, each of which in turn modulates expression of at least one host target gene, the function and utility of which at least one host target gene is known in the art.

VGR3153 gene, herein designated VGR GENE, is a novel bioinformatically detected regulatory, non protein coding, RNA viral gene. The method by which VGR3153 gene was detected is described hereinabove with reference to FIGS. 1-9.

VGR3153 gene encodes VGR3153 precursor RNA, herein designated VGR PRECURSOR RNA, an RNA molecule, typically several hundred nucleotides long.

VGR3153 precursor RNA folds spatially, forming VGR3153 folded precursor RNA, herein designated VGR FOLDED PRECURSOR RNA. It is appreciated that VGR3153 folded precursor RNA comprises a plurality of what is known in the art as 'hairpin' structures. These 'hairpin' structures are due to the fact that the nucleotide sequence of VGR3153 precursor RNA comprises a plurality of segments, the first half of each such segment having a nucleotide sequence which is at least a partial inversed-reversed sequence of the second half thereof, as is well known in the art.

VGR3153 folded precursor RNA is naturally processed by cellular enzymatic activity into at least 2 separate VGAM precursor RNAs, VGAM1937 precursor RNA and VGAM1938 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1937 RNA and VGAM1938 RNA, herein schematically represented by VGAM1 RNA through VGAM3 RNA, each of which VGAM RNAs corresponding to VGAM RNA of FIG. 1.

VGAM1937 RNA, herein schematically represented by VGAM1 RNA through VGAM3 RNA, binds complementarily to a host target binding site located in an untranslated region of VGAM1937 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1937 host target RNA into VGAM1937 host target protein, herein schematically represented by VGAM1 HOST TARGET PROTEIN through VGAM3 HOST TARGET PROTEIN, all of FIG. 1.

VGAM1938 RNA, herein schematically represented by VGAM1 RNA through VGAM3 RNA, binds complementarily to a host target binding site located in an untranslated region of VGAM1938 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1938 host target RNA into VGAM1938 host target protein, herein schematically represented by VGAM1 HOST TARGET PROTEIN through VGAM3 HOST TARGET PROTEIN, all of FIG. 1.

It is appreciated that a function of VGR3153 gene, herein designated VGR GENE, is inhibition of expression of host target genes, as part of a novel viral mechanism of attacking a host. Accordingly, utilities of VGR3153 gene include diagnosis, prevention and treatment of viral infection by Human Herpesvirus 4. Specific functions, and accordingly utilities, of VGR3153 gene correlate with, and may be deduced from, the identity of the host target genes, which are inhibited by VGAM RNAs comprised in the 'operon-like' cluster of VGR3153 gene: VGAM1937 host target protein and VGAM1938 host target protein, herein schematically represented by VGAM1 HOST TARGET PROTEIN through VGAM3 HOST TARGET PROTEIN. The function of these host target genes is elaborated hereinabove with reference to VGAM1937 and VGAM1938. FIG. 9 further provides a conceptual description of novel bioinformatically detected regulatory viral gene, referred to here as Viral Genomic Record 3154(VGR3154) viral gene, which encodes an 'operon-like' cluster of novel viral micro RNA-like genes, each of which in turn modulates expression of at least one host target gene, the function and utility of which at least one host target gene is known in the art.

VGR3154 gene, herein designated VGR GENE, is a novel bioinformatically detected regulatory, non protein coding, RNA viral gene. The method by which VGR3154 gene was detected is described hereinabove with reference to FIGS. 1-9.

VGR3154 gene encodes VGR3154 precursor RNA, herein designated VGR PRECURSOR RNA, an RNA molecule, typically several hundred nucleotides long.

VGR3154 precursor RNA folds spatially, forming VGR3154 folded precursor RNA, herein designated VGR FOLDED PRECURSOR RNA. It is appreciated that VGR3154 folded precursor RNA comprises a plurality of what is known in the art as 'hairpin' structures. These 'hairpin' structures are due to the fact that the nucleotide sequence of VGR3154 precursor RNA comprises a plurality of segments, the first half of each such segment having a nucleotide sequence which is at least a partial inversed-reversed sequence of the second half thereof, as is well known in the art.

VGR3154 folded precursor RNA is naturally processed by cellular enzymatic activity into at least 8 separate VGAM precursor RNAs, VGAM1940 precursor RNA, VGAM1941 precursor RNA, VGAM1942 precursor RNA, VGAM1943 precursor RNA, VGAM1944 precursor RNA, VGAM1945 precursor RNA, VGAM1946 precursor RNA and VGAM1947 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1940 RNA, VGAM1941 RNA, VGAM1942 RNA, VGAM1943 RNA, VGAM1944 RNA, VGAM1945 RNA, VGAM1946 RNA and VGAM1947 RNA, herein schematically represented by VGAM1 RNA through VGAM3 RNA, each of which VGAM RNAs corresponding to VGAM RNA of FIG. 1.

VGAM1940 RNA, herein schematically represented by VGAM1 RNA through VGAM3 RNA, binds complementarily to a host target binding site located in an untranslated region of VGAM1940 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1940 host target RNA into VGAM1940 host target protein, herein schematically represented by VGAM1 HOST TARGET PROTEIN through VGAM3 HOST TARGET PROTEIN, all of FIG. 1.

VGAM1941 RNA, herein schematically represented by VGAM1 RNA through VGAM3 RNA, binds complementarily to a host target binding site located in an untranslated region of VGAM1941 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1941 host target RNA into VGAM1941 host target protein, herein schematically represented by VGAM1 HOST TARGET PROTEIN through VGAM3 HOST TARGET PROTEIN, all of FIG. 1.

VGAM1942 RNA, herein schematically represented by VGAM1 RNA through VGAM3 RNA, binds complementarily to a host target binding site located in an untranslated region of VGAM1942 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1942 host target RNA into VGAM1942 host target protein, herein schematically represented by VGAM1 HOST TARGET PROTEIN through VGAM3 HOST TARGET PROTEIN, all of FIG. 1.

VGAM1943 RNA, herein schematically represented by VGAM1 RNA through VGAM3 RNA, binds complementarily to a host target binding site located in an untranslated region of VGAM1943 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1943 host target RNA into VGAM1943 host target protein, herein schematically represented by VGAM1 HOST TARGET PROTEIN through VGAM3 HOST TARGET PROTEIN, all of FIG. 1.

VGAM1944 RNA, herein schematically represented by VGAM1 RNA through VGAM3 RNA, binds complementarily to a host target binding site located in an untranslated region of VGAM1944 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1944 host target RNA into VGAM1944 host target protein, herein schematically represented by VGAM1 HOST TARGET PROTEIN through VGAM3 HOST TARGET PROTEIN, all of FIG. 1.

VGAM1945 RNA, herein schematically represented by VGAM1 RNA through VGAM3 RNA, binds complementarily to a host target binding site located in an untranslated region of VGAM1945 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1945 host target RNA into VGAM1945 host target protein, herein schematically represented by VGAM1 HOST TARGET PROTEIN through VGAM3 HOST TARGET PROTEIN, all of FIG. 1.

VGAM1946 RNA, herein schematically represented by VGAM1 RNA through VGAM3 RNA, binds complementarily to a host target binding site located in an untranslated region of VGAM1946 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1946 host target RNA into VGAM1946 host target protein, herein schematically represented by VGAM1 HOST TARGET PROTEIN through VGAM3 HOST TARGET PROTEIN, all of FIG. 1.

VGAM1947 RNA, herein schematically represented by VGAM1 RNA through VGAM3 RNA, binds complementarily to a host target binding site located in an untranslated region of VGAM1947 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1947 host target RNA into VGAM1947 host target protein, herein schematically represented by VGAM1 HOST TARGET PROTEIN through VGAM3 HOST TARGET PROTEIN, all of FIG. 1.

It is appreciated that a function of VGR3154 gene, herein designated VGR GENE, is inhibition of expression of host target genes, as part of a novel viral mechanism of attacking a host. Accordingly, utilities of VGR3154 gene include diagnosis, prevention and treatment of viral infection by Variola Virus. Specific functions, and accordingly utilities, of VGR3154 gene correlate with, and may be deduced from, the identity of the host target genes, which are inhibited by VGAM RNAs comprised in the 'operon-like' cluster of VGR3154 gene: VGAM1940 host target protein, VGAM1941 host target protein, VGAM1942 host target protein, VGAM1943 host target protein, VGAM1944 host target protein, VGAM1945 host target protein, VGAM1946 host target protein and VGAM1947 host target protein, herein schematically represented by VGAM1 HOST TARGET PROTEIN through VGAM3 HOST TARGET PROTEIN. The function of these host target genes is elaborated hereinabove with reference to VGAM1940, VGAM1941, VGAM1942, VGAM1943, VGAM1944, VGAM1945, VGAM1946 and VGAM1947. FIG. 9 further provides a conceptual description of novel bioinformatically detected regulatory viral gene, referred to here as Viral Genomic Record 3155(VGR3155) viral gene, which encodes an 'operon-like' cluster of novel viral micro RNA-like genes, each of which in turn modulates expression of at least one host target gene, the function and utility of which at least one host target gene is known in the art.

VGR3155 gene, herein designated VGR GENE, is a novel bioinformatically detected regulatory, non protein coding, RNA viral gene. The method by which VGR3155 gene was detected is described hereinabove with reference to FIGS. 1-9.

VGR3155 gene encodes VGR3155 precursor RNA, herein designated VGR PRECURSOR RNA, an RNA molecule, typically several hundred nucleotides long.

VGR3155 precursor RNA folds spatially, forming VGR3155 folded precursor RNA, herein designated VGR FOLDED PRECURSOR RNA. It is appreciated that VGR3155 folded precursor RNA comprises a plurality of what is known in the art as 'hairpin' structures. These 'hairpin' structures are due to the fact that the nucleotide sequence of VGR3155 precursor RNA comprises a plurality of segments, the first half of each such segment having a nucleotide sequence which is at least a partial inversed-reversed sequence of the second half thereof, as is well known in the art.

VGR3155 folded precursor RNA is naturally processed by cellular enzymatic activity into at least 7 separate VGAM precursor RNAs, VGAM1948 precursor RNA, VGAM1949 precursor RNA, VGAM1950 precursor RNA, VGAM1951 precursor RNA, VGAM1952 precursor RNA, VGAM1953 precursor RNA and VGAM1954 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1948 RNA, VGAM1949 RNA, VGAM1950 RNA, VGAM1951 RNA, VGAM1952 RNA, VGAM1953 RNA and VGAM1954 RNA, herein schematically represented by VGAM1 RNA through VGAM3 RNA, each of which VGAM RNAs corresponding to VGAM RNA of FIG. 1.

VGAM1948 RNA, herein schematically represented by VGAM1 RNA through VGAM3 RNA, binds complementarily to a host target binding site located in an untranslated region of VGAM1948 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1948 host target RNA into VGAM1948 host target protein, herein schematically represented by VGAM1 HOST TARGET PROTEIN through VGAM3 HOST TARGET PROTEIN, all of FIG. 1.

VGAM1949 RNA, herein schematically represented by VGAM1 RNA through VGAM3 RNA, binds complementarily to a host target binding site located in an untranslated region of VGAM1949 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1949 host target RNA into VGAM1949 host target protein, herein schematically represented by VGAM1 HOST TARGET PROTEIN through VGAM3 HOST TARGET PROTEIN, all of FIG. 1.

VGAM1950 RNA, herein schematically represented by VGAM1 RNA through VGAM3 RNA, binds complementarily to a host target binding site located in an untranslated region of VGAM1950 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1950 host target RNA into VGAM1950 host target protein, herein schematically represented by VGAM1 HOST TARGET PROTEIN through VGAM3 HOST TARGET PROTEIN, all of FIG. 1.

VGAM1951 RNA, herein schematically represented by VGAM1 RNA through VGAM3 RNA, binds complementarily to a host target binding site located in an untranslated region of VGAM1951 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1951 host target RNA into VGAM1951 host target protein, herein schematically represented by VGAM1 HOST TARGET PROTEIN through VGAM3 HOST TARGET PROTEIN, all of FIG. 1.

VGAM1952 RNA, herein schematically represented by VGAM1 RNA through VGAM3 RNA, binds complementarily to a host target binding site located in an untranslated region of VGAM1952 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1952 host target RNA into VGAM1952 host target protein, herein schematically represented by VGAM1 HOST TARGET PROTEIN through VGAM3 HOST TARGET PROTEIN, all of FIG. 1.

VGAM1953 RNA, herein schematically represented by VGAM1 RNA through VGAM3 RNA, binds complementarily to a host target binding site located in an untranslated region of VGAM1953 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1953 host target RNA into VGAM1953 host target protein, herein schematically represented by VGAM1 HOST TARGET PROTEIN through VGAM3 HOST TARGET PROTEIN, all of FIG. 1.

VGAM1954 RNA, herein schematically represented by VGAM1 RNA through VGAM3 RNA, binds complementarily to a host target binding site located in an untranslated region of VGAM1954 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1954 host target RNA into VGAM1954 host target protein, herein schematically represented by VGAM1 HOST TARGET PROTEIN through VGAM3 HOST TARGET PROTEIN, all of FIG. 1.

It is appreciated that a function of VGR3155 gene, herein designated VGR GENE, is inhibition of expression of host target genes, as part of a novel viral mechanism of attacking a host. Accordingly, utilities of VGR3155 gene include diagnosis, prevention and treatment of viral infection by Avian Paramyxovirus 6. Specific functions, and accordingly utilities, of VGR3155 gene correlate with, and may be deduced from, the identity of the host target genes, which are inhibited by VGAM RNAs comprised in the 'operon-like' cluster of VGR3155 gene: VGAM1948 host target protein, VGAM1949 host target protein, VGAM1950 host target protein, VGAM1951 host target protein, VGAM1952 host target protein, VGAM1953 host target protein and VGAM1954 host target protein, herein schematically represented by VGAM1 HOST TARGET PROTEIN through VGAM3 HOST TARGET PROTEIN. The function of these host target genes is elaborated hereinabove with reference to VGAM1948, VGAM1949, VGAM1950, VGAM1951, VGAM1952, VGAM1953 and VGAM1954. FIG. 9 further provides a conceptual description of novel bioinformatically detected regulatory viral gene, referred to here as Viral Genomic Record 3156(VGR3156) viral gene, which encodes an 'operon-like' cluster of novel viral micro RNA-like genes, each of which in turn modulates expression of at least one host target gene, the function and utility of which at least one host target gene is known in the art.

VGR3156 gene, herein designated VGR GENE, is a novel bioinformatically detected regulatory, non protein coding, RNA viral gene. The method by which VGR3156 gene was detected is described hereinabove with reference to FIGS. 1-9.

VGR3156 gene encodes VGR3156 precursor RNA, herein designated VGR PRECURSOR RNA, an RNA molecule, typically several hundred nucleotides long.

VGR3156 precursor RNA folds spatially, forming VGR3156 folded precursor RNA, herein designated VGR FOLDED PRECURSOR RNA. It is appreciated that VGR3156 folded precursor RNA comprises a plurality of what is known in the art as 'hairpin' structures. These 'hairpin' structures are due to the fact that the nucleotide sequence of VGR3156 precursor RNA comprises a plurality of segments, the first half of each such segment having a nucleotide sequence which is at least a partial inversed-reversed sequence of the second half thereof, as is well known in the art.

VGR3156 folded precursor RNA is naturally processed by cellular enzymatic activity into at least 6 separate VGAM precursor RNAs, VGAM1955 precursor RNA, VGAM1956 precursor RNA, VGAM1957 precursor RNA, VGAM1958 precursor RNA, VGAM1959 precursor RNA and VGAM1960 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1955 RNA, VGAM1956 RNA, VGAM1957 RNA, VGAM1958 RNA, VGAM1959 RNA and VGAM1960 RNA, herein schematically represented by VGAM1 RNA through VGAM3 RNA, each of which VGAM RNAs corresponding to VGAM RNA of FIG. 1.

VGAM1955 RNA, herein schematically represented by VGAM1 RNA through VGAM3 RNA, binds complementarily to a host target binding site located in an untranslated region of VGAM1955 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1955 host target RNA into VGAM1955 host target protein, herein schematically represented by VGAM1 HOST TARGET PROTEIN through VGAM3 HOST TARGET PROTEIN, all of FIG. 1.

VGAM1956 RNA, herein schematically represented by VGAM1 RNA through VGAM3 RNA, binds complementarily to a host target binding site located in an untranslated region of VGAM1956 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1956 host target RNA into VGAM1956 host target protein, herein schematically represented by VGAM1 HOST TARGET PROTEIN through VGAM3 HOST TARGET PROTEIN, all of FIG. 1.

VGAM1957 RNA, herein schematically represented by VGAM1 RNA through VGAM3 RNA, binds complementarily to a host target binding site located in an untranslated region of VGAM1957 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1957 host target RNA into VGAM1957 host target protein, herein schematically represented by VGAM1 HOST TARGET PROTEIN through VGAM3 HOST TARGET PROTEIN, all of FIG. 1.

VGAM1958 RNA, herein schematically represented by VGAM1 RNA through VGAM3 RNA, binds complementarily to a host target binding site located in an untranslated region of VGAM1958 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1958 host target RNA into VGAM1958 host target protein, herein schematically represented by VGAM1 HOST TARGET PROTEIN through VGAM3 HOST TARGET PROTEIN, all of FIG. 1.

VGAM1959 RNA, herein schematically represented by VGAM1 RNA through VGAM3 RNA, binds complementarily to a host target binding site located in an untranslated region of VGAM1959 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1959 host target RNA into VGAM1959 host target protein, herein schematically represented by VGAM1 HOST TARGET PROTEIN through VGAM3 HOST TARGET PROTEIN, all of FIG. 1.

VGAM1960 RNA, herein schematically represented by VGAM1 RNA through VGAM3 RNA, binds complementarily to a host target binding site located in an untranslated region of VGAM1960 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1960 host target RNA into VGAM1960 host target protein, herein schematically represented by VGAM1 HOST TARGET PROTEIN through VGAM3 HOST TARGET PROTEIN, all of FIG. 1.

It is appreciated that a function of VGR3156 gene, herein designated VGR GENE, is inhibition of expression of host target genes, as part of a novel viral mechanism of attacking a host. Accordingly, utilities of VGR3156 gene include diagnosis, prevention and treatment of viral infection by Macaca Mulatta Rhadinovirus. Specific functions, and accordingly utilities, of VGR3156 gene correlate with, and may be deduced from, the identity of the host target genes, which are inhibited by VGAM RNAs comprised in the 'operon-like' cluster of VGR3156 gene: VGAM1955 host target protein, VGAM1956 host target protein, VGAM1957 host target protein, VGAM1958 host target protein, VGAM1959 host target protein and VGAM1960 host target protein, herein schematically represented by VGAM1 HOST TARGET PROTEIN through VGAM3 HOST TARGET PROTEIN. The function of these host target genes is elaborated hereinabove with reference to VGAM1955, VGAM1956, VGAM1957, VGAM1958, VGAM1959 and VGAM1960. FIG. 9 further provides a conceptual description of novel bioinformatically detected regulatory viral gene, referred to here as Viral Genomic Record 3157(VGR3157) viral gene, which encodes an 'operon-like' cluster of novel viral micro RNA-like genes, each of which in turn modulates expression of at least one host target gene, the function and utility of which at least one host target gene is known in the art.

VGR3157 gene, herein designated VGR GENE, is a novel bioinformatically detected regulatory, non protein coding, RNA viral gene. The method by which VGR3157 gene was detected is described hereinabove with reference to FIGS. 1-9.

VGR3157 gene encodes VGR3157 precursor RNA, herein designated VGR PRECURSOR RNA, an RNA molecule, typically several hundred nucleotides long.

VGR3157 precursor RNA folds spatially, forming VGR3157 folded precursor RNA, herein designated VGR FOLDED PRECURSOR RNA. It is appreciated that VGR3157 folded precursor RNA comprises a plurality of what is known in the art as 'hairpin' structures. These 'hairpin' structures are due to the fact that the nucleotide sequence of VGR3157 precursor RNA comprises a plurality of segments, the first half of each such segment having a nucleotide sequence which is at least a partial inversed-reversed sequence of the second half thereof, as is well known in the art.

VGR3157 folded precursor RNA is naturally processed by cellular enzymatic activity into at least 3 separate VGAM precursor RNAs, VGAM1961 precursor RNA, VGAM1962 precursor RNA and VGAM1963 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1961 RNA, VGAM1962 RNA and VGAM1963 RNA, herein schematically represented by VGAM1 RNA through VGAM3 RNA, each of which VGAM RNAs corresponding to VGAM RNA of FIG. 1.

VGAM1961 RNA, herein schematically represented by VGAM1 RNA through VGAM3 RNA, binds complementarily to a host target binding site located in an untranslated region of VGAM1961 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1961 host target RNA into VGAM1961 host target protein, herein schematically represented by VGAM1 HOST TARGET PROTEIN through VGAM3 HOST TARGET PROTEIN, all of FIG. 1.

VGAM1962 RNA, herein schematically represented by VGAM1 RNA through VGAM3 RNA, binds complementarily to a host target binding site located in an untranslated region of VGAM1962 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1962 host target RNA into VGAM1962 host target protein, herein schematically represented by VGAM1 HOST TARGET PROTEIN through VGAM3 HOST TARGET PROTEIN, all of FIG. 1.

VGAM1963 RNA, herein schematically represented by VGAM1 RNA through VGAM3 RNA, binds complementarily to a host target binding site located in an untranslated region of VGAM1963 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1963 host target RNA into VGAM1963 host target protein, herein schematically represented by VGAM1 HOST TARGET PROTEIN through VGAM3 HOST TARGET PROTEIN, all of FIG. 1.

It is appreciated that a function of VGR3157 gene, herein designated VGR GENE, is inhibition of expression of host target genes, as part of a novel viral mechanism of attacking a host. Accordingly, utilities of VGR3157 gene include diagnosis, prevention and treatment of viral infection by Camelpox Virus. Specific functions, and accordingly utilities, of VGR3157 gene correlate with, and may be deduced from, the identity of the host target genes, which are inhibited by VGAM RNAs comprised in the 'operon-like' cluster of VGR3157 gene: VGAM1961 host target protein, VGAM1962 host target protein and VGAM1963 host target protein, herein schematically represented by VGAM1 HOST TARGET PROTEIN through VGAM3 HOST TARGET PROTEIN. The function of these host target genes is elaborated hereinabove with reference to VGAM1961, VGAM1962 and VGAM1963. FIG. 9 further provides a conceptual description of novel bioinformatically detected regulatory viral gene, referred to here as Viral Genomic Record 3158(VGR3158) viral gene, which encodes an 'operon-like' cluster of novel viral micro RNA-like genes, each of which in turn modulates expression of at least one host target gene, the function and utility of which at least one host target gene is known in the art.

VGR3158 gene, herein designated VGR GENE, is a novel bioinformatically detected regulatory, non protein coding, RNA viral gene. The method by which VGR3158 gene was detected is described hereinabove with reference to FIGS. 1-9.

VGR3158 gene encodes VGR3158 precursor RNA, herein designated VGR PRECURSOR RNA, an RNA molecule, typically several hundred nucleotides long.

VGR3158 precursor RNA folds spatially, forming VGR3158 folded precursor RNA, herein designated VGR FOLDED PRECURSOR RNA. It is appreciated that VGR3158 folded precursor RNA comprises a plurality of what is known in the art as 'hairpin' structures. These 'hairpin' structures are due to the fact that the nucleotide sequence of VGR3158 precursor RNA comprises a plurality of segments, the first half of each such segment having a nucleotide sequence which is at least a partial inversed-reversed sequence of the second half thereof, as is well known in the art.

VGR3158 folded precursor RNA is naturally processed by cellular enzymatic activity into at least 8 separate VGAM precursor RNAs, VGAM1964 precursor RNA, VGAM1965 precursor RNA, VGAM1966 precursor RNA, VGAM1967 precursor RNA, VGAM1968 precursor RNA, VGAM1969 precursor RNA, VGAM1970 precursor RNA and VGAM1971 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1964 RNA, VGAM1965 RNA, VGAM1966 RNA, VGAM1967 RNA, VGAM1968 RNA, VGAM1969 RNA, VGAM1970 RNA and VGAM1971 RNA, herein schematically represented by VGAM1 RNA through VGAM3 RNA, each of which VGAM RNAs corresponding to VGAM RNA of FIG. 1.

VGAM1964 RNA, herein schematically represented by VGAM1 RNA through VGAM3 RNA, binds complementarily to a host target binding site located in an untranslated region of VGAM1964 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1964 host target RNA into VGAM1964 host target protein, herein schematically represented by VGAM1 HOST TARGET PROTEIN through VGAM3 HOST TARGET PROTEIN, all of FIG. 1.

VGAM1965 RNA, herein schematically represented by VGAM1 RNA through VGAM3 RNA, binds complementarily to a host target binding site located in an untranslated region of VGAM1965 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1965 host target RNA into VGAM1965 host target protein, herein schematically represented by VGAM1 HOST TARGET PROTEIN through VGAM3 HOST TARGET PROTEIN, all of FIG. 1.

VGAM1966 RNA, herein schematically represented by VGAM1 RNA through VGAM3 RNA, binds complementarily to a host target binding site located in an untranslated region of VGAM1966 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1966 host target RNA into VGAM1966 host target protein, herein schematically represented by VGAM1 HOST TARGET PROTEIN through VGAM3 HOST TARGET PROTEIN, all of FIG. 1.

VGAM1967 RNA, herein schematically represented by VGAM1 RNA through VGAM3 RNA, binds complementarily to a host target binding site located in an untranslated region of VGAM1967 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1967 host target RNA into VGAM1967 host target protein, herein schematically represented by VGAM1 HOST TARGET PROTEIN through VGAM3 HOST TARGET PROTEIN, all of FIG. 1.

VGAM1968 RNA, herein schematically represented by VGAM1 RNA through VGAM3 RNA, binds complementarily to a host target binding site located in an untranslated region of VGAM1968 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1968 host target RNA into VGAM1968 host target protein, herein schematically represented by VGAM1 HOST TARGET PROTEIN through VGAM3 HOST TARGET PROTEIN, all of FIG. 1.

VGAM1969 RNA, herein schematically represented by VGAM1 RNA through VGAM3 RNA, binds complementarily to a host target binding site located in an untranslated region of VGAM1969 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1969 host target RNA into VGAM1969 host target protein, herein schematically represented by VGAM1 HOST TARGET PROTEIN through VGAM3 HOST TARGET PROTEIN, all of FIG. 1.

VGAM1970 RNA, herein schematically represented by VGAM1 RNA through VGAM3 RNA, binds complementarily to a host target binding site located in an untranslated region of VGAM1970 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1970 host target RNA into VGAM1970 host target protein, herein schematically represented by VGAM1 HOST TARGET PROTEIN through VGAM3 HOST TARGET PROTEIN, all of FIG. 1.

VGAM1971 RNA, herein schematically represented by VGAM1 RNA through VGAM3 RNA, binds complementarily to a host target binding site located in an untranslated region of VGAM1971 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1971 host target RNA into VGAM1971 host target protein, herein schematically represented by VGAM1 HOST TARGET PROTEIN through VGAM3 HOST TARGET PROTEIN, all of FIG. 1.

It is appreciated that a function of VGR3158 gene, herein designated VGR GENE, is inhibition of expression of host target genes, as part of a novel viral mechanism of attacking a host. Accordingly, utilities of VGR3158 gene include diagnosis, prevention and treatment of viral infection by Rana Tigrina Ranavirus. Specific functions, and accordingly utilities, of VGR3158 gene correlate with, and may be deduced from, the identity of the host target genes, which are inhibited by VGAM RNAs comprised in the 'operon-like' cluster of VGR3158 gene: VGAM1964 host target protein, VGAM1965 host target protein, VGAM1966 host target protein, VGAM1967 host target protein, VGAM1968 host target protein, VGAM1969 host target protein, VGAM1970 host target protein and VGAM1971 host target protein, herein schematically represented by VGAM1 HOST TARGET PROTEIN through VGAM3 HOST TARGET PROTEIN. The function of these host target genes is elaborated hereinabove with reference to VGAM1964, VGAM1965, VGAM1966, VGAM1967, VGAM1968, VGAM1969, VGAM1970 and VGAM1971. FIG. 9 further provides a conceptual description of novel bioinformatically detected regulatory viral gene, referred to here as Viral Genomic Record 3159(VGR3159) viral gene, which encodes an 'operon-like' cluster of novel viral micro RNA-like genes, each of which in turn modulates expression of at least one host target gene, the function and utility of which at least one host target gene is known in the art.

VGR3159 gene, herein designated VGR GENE, is a novel bioinformatically detected regulatory, non protein coding, RNA viral gene. The method by which VGR3159 gene was detected is described hereinabove with reference to FIGS. 1-9.

VGR3159 gene encodes VGR3159 precursor RNA, herein designated VGR PRECURSOR RNA, an RNA molecule, typically several hundred nucleotides long.

VGR3159 precursor RNA folds spatially, forming VGR3159 folded precursor RNA, herein designated VGR FOLDED PRECURSOR RNA. It is appreciated that VGR3159 folded precursor RNA comprises a plurality of what is known in the art as 'hairpin' structures. These 'hairpin' structures are due to the fact that the nucleotide sequence of VGR3159 precursor RNA comprises a plurality of segments, the first half of each such segment having a nucleotide sequence which is at least a partial inversed-reversed sequence of the second half thereof, as is well known in the art.

VGR3159 folded precursor RNA is naturally processed by cellular enzymatic activity into at least 7 separate VGAM precursor RNAs, VGAM1972 precursor RNA, VGAM1973 precursor RNA, VGAM1974 precursor RNA, VGAM1975 precursor RNA, VGAM1976 precursor RNA, VGAM1977 precursor RNA and VGAM1978 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1972 RNA, VGAM1973 RNA, VGAM1974 RNA, VGAM1975 RNA, VGAM1976 RNA, VGAM1977 RNA and VGAM1978 RNA, herein schematically represented by VGAM1 RNA through VGAM3 RNA, each of which VGAM RNAs corresponding to VGAM RNA of FIG. 1.

VGAM1972 RNA, herein schematically represented by VGAM1 RNA through VGAM3 RNA, binds complementarily to a host target binding site located in an untranslated region of VGAM1972 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1972 host target RNA into VGAM1972 host target protein, herein schematically represented by VGAM1 HOST TARGET PROTEIN through VGAM3 HOST TARGET PROTEIN, all of FIG. 1.

VGAM1973 RNA, herein schematically represented by VGAM1 RNA through VGAM3 RNA, binds complementarily to a host target binding site located in an untranslated region of VGAM1973 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1973 host target RNA into VGAM1973 host target protein, herein schematically represented by VGAM1 HOST TARGET PROTEIN through VGAM3 HOST TARGET PROTEIN, all of FIG. 1.

VGAM1974 RNA, herein schematically represented by VGAM1 RNA through VGAM3 RNA, binds complementarily to a host target binding site located in an untranslated region of VGAM1974 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1974 host target RNA into VGAM1974 host target protein, herein schematically represented by VGAM1 HOST TARGET PROTEIN through VGAM3 HOST TARGET PROTEIN, all of FIG. 1.

VGAM1975 RNA, herein schematically represented by VGAM1 RNA through VGAM3 RNA, binds complementarily to a host target binding site located in an untranslated region of VGAM1975 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1975 host target RNA into VGAM1975 host target protein, herein schematically represented by VGAM1 HOST TARGET PROTEIN through VGAM3 HOST TARGET PROTEIN, all of FIG. 1.

VGAM1976 RNA, herein schematically represented by VGAM1 RNA through VGAM3 RNA, binds complementarily to a host target binding site located in an untranslated region of VGAM1976 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1976 host target RNA into VGAM1976 host target protein, herein schematically represented by VGAM1 HOST TARGET PROTEIN through VGAM3 HOST TARGET PROTEIN, all of FIG. 1.

VGAM1977 RNA, herein schematically represented by VGAM1 RNA through VGAM3 RNA, binds complementarily to a host target binding site located in an untranslated region of VGAM1977 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1977 host target RNA into VGAM1977 host target protein, herein schematically represented by VGAM1 HOST TARGET PROTEIN through VGAM3 HOST TARGET PROTEIN, all of FIG. 1.

VGAM1978 RNA, herein schematically represented by VGAM1 RNA through VGAM3 RNA, binds complementarily to a host target binding site located in an untranslated region of VGAM1978 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1978 host target RNA into VGAM1978 host target protein, herein schematically represented by VGAM1 HOST TARGET PROTEIN through VGAM3 HOST TARGET PROTEIN, all of FIG. 1.

It is appreciated that a function of VGR3159 gene, herein designated VGR GENE, is inhibition of expression of host target genes, as part of a novel viral mechanism of attacking a host. Accordingly, utilities of VGR3159 gene include diagnosis, prevention and treatment of viral infection by Bovine Herpesvirus 4. Specific functions, and accordingly utilities, of VGR3159 gene correlate with, and may be deduced from, the identity of the host target genes, which are inhibited by VGAM RNAs comprised in the 'operon-like' cluster of VGR3159 gene: VGAM1972 host target protein, VGAM1973 host target protein, VGAM1974 host target protein, VGAM1975 host target protein, VGAM1976 host target protein, VGAM1977 host target protein and VGAM1978 host target protein, herein schematically represented by VGAM1 HOST TARGET PROTEIN through VGAM3 HOST TARGET PROTEIN. The function of these host target genes is elaborated hereinabove with reference to VGAM1972, VGAM1973, VGAM1974, VGAM1975, VGAM1976, VGAM1977 and VGAM1978. FIG. 9 further provides a conceptual description of novel bioinformatically detected regulatory viral gene, referred to here as Viral Genomic Record 3160(VGR3160) viral gene, which encodes an 'operon-like' cluster of novel viral micro RNA-like genes, each of which in turn modulates expression of at least one host target gene, the function and utility of which at least one host target gene is known in the art.

VGR3160 gene, herein designated VGR GENE, is a novel bioinformatically detected regulatory, non protein coding, RNA viral gene. The method by which VGR3160 gene was detected is described hereinabove with reference to FIGS. 1-9.

VGR3160 gene encodes VGR3160 precursor RNA, herein designated VGR PRECURSOR RNA, an RNA molecule, typically several hundred nucleotides long.

VGR3160 precursor RNA folds spatially, forming VGR3160 folded precursor RNA, herein designated VGR FOLDED PRECURSOR RNA. It is appreciated that VGR3160 folded precursor RNA comprises a plurality of what is known in the art as 'hairpin' structures. These 'hairpin' structures are due to the fact that the nucleotide sequence of VGR3160 precursor RNA comprises a plurality of segments, the first half of each such segment having a nucleotide sequence which is at least a partial inversed-reversed sequence of the second half thereof, as is well known in the art.

VGR3160 folded precursor RNA is naturally processed by cellular enzymatic activity into at least 2 separate VGAM precursor RNAs, VGAM1979 precursor RNA and VGAM1980 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1979 RNA and VGAM1980 RNA, herein schematically represented by VGAM1 RNA through VGAM3 RNA, each of which VGAM RNAs corresponding to VGAM RNA of FIG. 1.

VGAM1979 RNA, herein schematically represented by VGAM1 RNA through VGAM3 RNA, binds complementarily to a host target binding site located in an untranslated region of VGAM1979 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1979 host target RNA into VGAM1979 host target protein, herein schematically represented by VGAM1 HOST TARGET PROTEIN through VGAM3 HOST TARGET PROTEIN, all of FIG. 1.

VGAM1980 RNA, herein schematically represented by VGAM1 RNA through VGAM3 RNA, binds complementarily to a host target binding site located in an untranslated region of VGAM1980 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1980 host target RNA into VGAM1980 host target protein, herein schematically represented by VGAM1 HOST TARGET PROTEIN through VGAM3 HOST TARGET PROTEIN, all of FIG. 1.

It is appreciated that a function of VGR3160 gene, herein designated VGR GENE, is inhibition of expression of host target genes, as part of a novel viral mechanism of attacking a host. Accordingly, utilities of VGR3160 gene include diagnosis, prevention and treatment of viral infection by Bovine Herpesvirus 4. Specific functions, and accordingly utilities, of VGR3160 gene correlate with, and may be deduced from, the identity of the host target genes, which are inhibited by VGAM RNAs comprised in the 'operon-like' cluster of VGR3160 gene: VGAM1979 host target protein and VGAM1980 host target protein, herein schematically represented by VGAM1 HOST TARGET PROTEIN through VGAM3 HOST TARGET PROTEIN. The function of these host target genes is elaborated hereinabove with reference to VGAM1979 and VGAM1980. FIG. 9 further provides a conceptual description of novel bioinformatically detected regulatory viral gene, referred to here as Viral Genomic Record 3161(VGR3161) viral gene, which encodes an 'operon-like' cluster of novel viral micro RNA-like genes, each of which in turn modulates expression of at least one host target gene, the function and utility of which at least one host target gene is known in the art.

VGR3161 gene, herein designated VGR GENE, is a novel bioinformatically detected regulatory, non protein coding, RNA viral gene. The method by which VGR3161 gene was detected is described hereinabove with reference to FIGS. 1-9.

VGR3161 gene encodes VGR3161 precursor RNA, herein designated VGR PRECURSOR RNA, an RNA molecule, typically several hundred nucleotides long.

VGR3161 precursor RNA folds spatially, forming VGR3161 folded precursor RNA, herein designated VGR FOLDED PRECURSOR RNA. It is appreciated that VGR3161 folded precursor RNA comprises a plurality of what is known in the art as 'hairpin' structures. These 'hairpin' structures are due to the fact that the nucleotide sequence of VGR3161 precursor RNA comprises a plurality of segments, the first half of each such segment having a nucleotide sequence which is at least a partial inversed-reversed sequence of the second half thereof, as is well known in the art.

VGR3161 folded precursor RNA is naturally processed by cellular enzymatic activity into at least 7 separate VGAM precursor RNAs, VGAM1981 precursor RNA, VGAM1982 precursor RNA, VGAM1983 precursor RNA, VGAM1984 precursor RNA, VGAM1985 precursor RNA, VGAM1986 precursor RNA and VGAM1987 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1981 RNA, VGAM1982 RNA, VGAM1983 RNA, VGAM1984 RNA, VGAM1985 RNA, VGAM1986 RNA and VGAM1987 RNA, herein schematically represented by VGAM1 RNA through VGAM3 RNA, each of which VGAM RNAs corresponding to VGAM RNA of FIG. 1.

VGAM1981 RNA, herein schematically represented by VGAM1 RNA through VGAM3 RNA, binds complementarily to a host target binding site located in an untranslated region of VGAM1981 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1981 host target RNA into VGAM1981 host target protein, herein schematically represented by VGAM1 HOST TARGET PROTEIN through VGAM3 HOST TARGET PROTEIN, all of FIG. 1.

VGAM1982 RNA, herein schematically represented by VGAM1 RNA through VGAM3 RNA, binds complementarily to a host target binding site located in an untranslated region of VGAM1982 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1982 host target RNA into VGAM1982 host target protein, herein schematically represented by VGAM1 HOST TARGET PROTEIN through VGAM3 HOST TARGET PROTEIN, all of FIG. 1.

VGAM1983 RNA, herein schematically represented by VGAM1 RNA through VGAM3 RNA, binds complementarily to a host target binding site located in an untranslated region of VGAM1983 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1983 host target RNA into VGAM1983 host target protein, herein schematically represented by VGAM1 HOST TARGET PROTEIN through VGAM3 HOST TARGET PROTEIN, all of FIG. 1.

VGAM1984 RNA, herein schematically represented by VGAM1 RNA through VGAM3 RNA, binds complementarily to a host target binding site located in an untranslated region of VGAM1984 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1984 host target RNA into VGAM1984 host target protein, herein schematically represented by VGAM1 HOST TARGET PROTEIN through VGAM3 HOST TARGET PROTEIN, all of FIG. 1.

VGAM1985 RNA, herein schematically represented by VGAM1 RNA through VGAM3 RNA, binds complementarily to a host target binding site located in an untranslated region of VGAM1985 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1985 host target RNA into VGAM1985 host target protein, herein schematically represented by VGAM1 HOST TARGET PROTEIN through VGAM3 HOST TARGET PROTEIN, all of FIG. 1.

VGAM1986 RNA, herein schematically represented by VGAM1 RNA through VGAM3 RNA, binds complementarily to a host target binding site located in an untranslated region of VGAM1986 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1986 host target RNA into VGAM1986 host target protein, herein schematically represented by VGAM1 HOST TARGET PROTEIN through VGAM3 HOST TARGET PROTEIN, all of FIG. 1.

VGAM1987 RNA, herein schematically represented by VGAM1 RNA through VGAM3 RNA, binds complementarily to a host target binding site located in an untranslated region of VGAM1987 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1987 host target RNA into VGAM1987 host target protein, herein schematically represented by VGAM1 HOST TARGET PROTEIN through VGAM3 HOST TARGET PROTEIN, all of FIG. 1.

It is appreciated that a function of VGR3161 gene, herein designated VGR GENE, is inhibition of expression of host target genes, as part of a novel viral mechanism of attacking a host. Accordingly, utilities of VGR3161 gene include diagnosis, prevention and treatment of viral infection by Hendra Virus. Specific functions, and accordingly utilities, of VGR3161 gene correlate with, and may be deduced from, the identity of the host target genes, which are inhibited by VGAM RNAs comprised in the 'operon-like' cluster of VGR3161 gene: VGAM1981 host target protein, VGAM1982 host target protein, VGAM1983 host target protein, VGAM1984 host target protein, VGAM1985 host target protein, VGAM1986 host target protein and VGAM1987 host target protein, herein schematically represented by VGAM1 HOST TARGET PROTEIN through VGAM3 HOST TARGET PROTEIN. The function of these host target genes is elaborated hereinabove with reference to VGAM1981, VGAM1982, VGAM1983, VGAM1984, VGAM1985, VGAM1986 and VGAM1987. FIG. 9 further provides a conceptual description of novel bioinformatically detected regulatory viral gene, referred to here as Viral Genomic Record 3162(VGR3162) viral gene, which encodes an 'operon-like' cluster of novel viral micro RNA-like genes, each of which in turn modulates expression of at least one host target gene, the function and utility of which at least one host target gene is known in the art.

VGR3162 gene, herein designated VGR GENE, is a novel bioinformatically detected regulatory, non protein coding, RNA viral gene. The method by which VGR3162 gene was detected is described hereinabove with reference to FIGS. 1-9.

VGR3162 gene encodes VGR3162 precursor RNA, herein designated VGR PRECURSOR RNA, an RNA molecule, typically several hundred nucleotides long.

VGR3162 precursor RNA folds spatially, forming VGR3162 folded precursor RNA, herein designated VGR FOLDED PRECURSOR RNA. It is appreciated that VGR3162 folded precursor RNA comprises a plurality of what is known in the art as 'hairpin' structures. These 'hairpin' structures are due to the fact that the nucleotide sequence of VGR3162 precursor RNA comprises a plurality of segments, the first half of each such segment having a nucleotide sequence which is at least a partial inversed-reversed sequence of the second half thereof, as is well known in the art.

VGR3162 folded precursor RNA is naturally processed by cellular enzymatic activity into at least 2 separate VGAM precursor RNAs, VGAM1988 precursor RNA and VGAM1989 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1988 RNA and VGAM1989 RNA, herein schematically represented by VGAM1 RNA through VGAM3 RNA, each of which VGAM RNAs corresponding to VGAM RNA of FIG. 1.

VGAM1988 RNA, herein schematically represented by VGAM1 RNA through VGAM3 RNA, binds complementarily to a host target binding site located in an untranslated region of VGAM1988 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1988 host target RNA into VGAM1988 host target protein, herein schematically represented by VGAM1 HOST TARGET PROTEIN through VGAM3 HOST TARGET PROTEIN, all of FIG. 1.

VGAM1989 RNA, herein schematically represented by VGAM1 RNA through VGAM3 RNA, binds complementarily to a host target binding site located in an untranslated region of VGAM1989 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1989 host target RNA into VGAM1989 host target protein, herein schematically represented by VGAM1 HOST TARGET PROTEIN through VGAM3 HOST TARGET PROTEIN, all of FIG. 1.

It is appreciated that a function of VGR3162 gene, herein designated VGR GENE, is inhibition of expression of host target genes, as part of a novel viral mechanism of attacking a host. Accordingly, utilities of VGR3162 gene include diagnosis, prevention and treatment of viral infection by Hendra Virus. Specific functions, and accordingly utilities, of VGR3162 gene correlate with, and may be deduced from, the identity of the host target genes, which are inhibited by VGAM RNAs comprised in the 'operon-like' cluster of VGR3162 gene: VGAM1988 host target protein and VGAM1989 host target protein, herein schematically represented by VGAM1 HOST TARGET PROTEIN through VGAM3 HOST TARGET PROTEIN. The function of these host target genes is elaborated hereinabove with reference to VGAM1988 and VGAM1989. FIG. 9 further provides a conceptual description of novel bioinformatically detected regulatory viral gene, referred to here as Viral Genomic Record 3163(VGR3163) viral gene, which encodes an 'operon-like' cluster of novel viral micro RNA-like genes, each of which in turn modulates expression of at least one host target gene, the function and utility of which at least one host target gene is known in the art.

VGR3163 gene, herein designated VGR GENE, is a novel bioinformatically detected regulatory, non protein coding, RNA viral gene. The method by which VGR3163 gene was detected is described hereinabove with reference to FIGS. 1-9.

VGR3163 gene encodes VGR3163 precursor RNA, herein designated VGR PRECURSOR RNA, an RNA molecule, typically several hundred nucleotides long.

VGR3163 precursor RNA folds spatially, forming VGR3163 folded precursor RNA, herein designated VGR FOLDED PRECURSOR RNA. It is appreciated that VGR3163 folded precursor RNA comprises a plurality of what is known in the art as 'hairpin' structures. These 'hairpin' structures are due to the fact that the nucleotide sequence of VGR3163 precursor RNA comprises a plurality of segments, the first half of each such segment having a nucleotide sequence which is at least a partial inversed-reversed sequence of the second half thereof, as is well known in the art.

VGR3163 folded precursor RNA is naturally processed by cellular enzymatic activity into at least 8 separate VGAM precursor RNAs, VGAM1990 precursor RNA, VGAM1991 precursor RNA, VGAM1992 precursor RNA, VGAM1993 precursor RNA, VGAM1994 precursor RNA, VGAM1995 precursor RNA, VGAM1996 precursor RNA and VGAM1997 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1990 RNA, VGAM1991 RNA, VGAM1992 RNA, VGAM1993 RNA, VGAM1994 RNA, VGAM1995 RNA, VGAM1996 RNA and VGAM1997 RNA, herein schematically represented by VGAM1 RNA through VGAM3 RNA, each of which VGAM RNAs corresponding to VGAM RNA of FIG. 1.

VGAM1990 RNA, herein schematically represented by VGAM1 RNA through VGAM3 RNA, binds complementarily to a host target binding site located in an untranslated region of VGAM1990 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1990 host target RNA into VGAM1990 host target protein, herein schematically represented by VGAM1 HOST TARGET PROTEIN through VGAM3 HOST TARGET PROTEIN, all of FIG. 1.

VGAM1991 RNA, herein schematically represented by VGAM1 RNA through VGAM3 RNA, binds complementarily to a host target binding site located in an untranslated region of VGAM1991 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1991 host target RNA into VGAM1991 host target protein, herein schematically represented by VGAM1 HOST TARGET PROTEIN through VGAM3 HOST TARGET PROTEIN, all of FIG. 1.

VGAM1992 RNA, herein schematically represented by VGAM1 RNA through VGAM3 RNA, binds complementarily to a host target binding site located in an untranslated region of VGAM1992 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1992 host target RNA into VGAM1992 host target protein, herein schematically represented by VGAM1 HOST TARGET PROTEIN through VGAM3 HOST TARGET PROTEIN, all of FIG. 1.

VGAM1993 RNA, herein schematically represented by VGAM1 RNA through VGAM3 RNA, binds complementarily to a host target binding site located in an untranslated region of VGAM1993 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1993 host target RNA into VGAM1993 host target protein, herein schematically represented by VGAM1 HOST TARGET PROTEIN through VGAM3 HOST TARGET PROTEIN, all of FIG. 1.

VGAM1994 RNA, herein schematically represented by VGAM1 RNA through VGAM3 RNA, binds complementarily to a host target binding site located in an untranslated region of VGAM1994 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1994 host target RNA into VGAM1994 host target protein, herein schematically represented by VGAM1 HOST TARGET PROTEIN through VGAM3 HOST TARGET PROTEIN, all of FIG. 1.

VGAM1995 RNA, herein schematically represented by VGAM1 RNA through VGAM3 RNA, binds complementarily to a host target binding site located in an untranslated region of VGAM1995 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1995 host target RNA into VGAM1995 host target protein, herein schematically represented by VGAM1 HOST TARGET PROTEIN through VGAM3 HOST TARGET PROTEIN, all of FIG. 1.

VGAM1996 RNA, herein schematically represented by VGAM1 RNA through VGAM3 RNA, binds complementarily to a host target binding site located in an untranslated region of VGAM1996 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1996 host target RNA into VGAM1996 host target protein, herein schematically represented by VGAM1 HOST TARGET PROTEIN through VGAM3 HOST TARGET PROTEIN, all of FIG. 1.

VGAM1997 RNA, herein schematically represented by VGAM1 RNA through VGAM3 RNA, binds complementarily to a host target binding site located in an untranslated region of VGAM1997 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1997 host target RNA into VGAM1997 host target protein, herein schematically represented by VGAM1 HOST TARGET PROTEIN through VGAM3 HOST TARGET PROTEIN, all of FIG. 1.

It is appreciated that a function of VGR3163 gene, herein designated VGR GENE, is inhibition of expression of host target genes, as part of a novel viral mechanism of attacking a host. Accordingly, utilities of VGR3163 gene include diagnosis, prevention and treatment of viral infection by Nipah Virus. Specific functions, and accordingly utilities, of VGR3163 gene correlate with, and may be deduced from, the identity of the host target genes, which are inhibited by VGAM RNAs comprised in the 'operon-like' cluster of VGR3163 gene: VGAM1990 host target protein, VGAM1991 host target protein, VGAM1992 host target protein, VGAM1993 host target protein, VGAM1994 host target protein, VGAM1995 host target protein, VGAM1996 host target protein and VGAM1997 host target protein, herein schematically represented by VGAM1 HOST TARGET PROTEIN through VGAM3 HOST TARGET PROTEIN. The function of these host target genes is elaborated hereinabove with reference to VGAM1990, VGAM1991, VGAM1992, VGAM1993, VGAM1994, VGAM1995, VGAM1996 and VGAM1997. FIG. 9 further provides a conceptual description of novel bioinformatically detected regulatory viral gene, referred to here as Viral Genomic Record 3164(VGR3164) viral gene, which encodes an 'operon-like' cluster of novel viral micro RNA-like genes, each of which in turn modulates expression of at least one host target gene, the function and utility of which at least one host target gene is known in the art.

VGR3164 gene, herein designated VGR GENE, is a novel bioinformatically detected regulatory, non protein coding, RNA viral gene. The method by which VGR3164 gene was detected is described hereinabove with reference to FIGS. 1-9.

VGR3164 gene encodes VGR3164 precursor RNA, herein designated VGR PRECURSOR RNA, an RNA molecule, typically several hundred nucleotides long.

VGR3164 precursor RNA folds spatially, forming VGR3164 folded precursor RNA, herein designated VGR FOLDED PRECURSOR RNA. It is appreciated that VGR3164 folded precursor RNA comprises a plurality of what is known in the art as 'hairpin' structures. These 'hairpin' structures are due to the fact that the nucleotide sequence of VGR3164 precursor RNA comprises a plurality of segments, the first half of each such segment having a nucleotide sequence which is at least a partial inversed-reversed sequence of the second half thereof, as is well known in the art.

VGR3164 folded precursor RNA is naturally processed by cellular enzymatic activity into at least 6 separate VGAM precursor RNAs, VGAM1998 precursor RNA, VGAM1999 precursor RNA, VGAM2000 precursor RNA, VGAM2001 precursor RNA, VGAM2002 precursor RNA and VGAM2003 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1998 RNA, VGAM1999 RNA, VGAM2000 RNA, VGAM2001 RNA, VGAM2002 RNA and VGAM2003 RNA, herein schematically represented by VGAM1 RNA through VGAM3 RNA, each of which VGAM RNAs corresponding to VGAM RNA of FIG. 1.

VGAM1998 RNA, herein schematically represented by VGAM1 RNA through VGAM3 RNA, binds complementarily to a host target binding site located in an untranslated region of VGAM1998 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1998 host target RNA into VGAM1998 host target protein, herein schematically represented by VGAM1 HOST TARGET PROTEIN through VGAM3 HOST TARGET PROTEIN, all of FIG. 1.

VGAM1999 RNA, herein schematically represented by VGAM1 RNA through VGAM3 RNA, binds complementarily to a host target binding site located in an untranslated region of VGAM1999 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1999 host target RNA into VGAM1999 host target protein, herein schematically represented by VGAM1 HOST TARGET PROTEIN through VGAM3 HOST TARGET PROTEIN, all of FIG. 1.

VGAM2000 RNA, herein schematically represented by VGAM1 RNA through VGAM3 RNA, binds complementarily to a host target binding site located in an untranslated region of VGAM2000 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2000 host target RNA into VGAM2000 host target protein, herein schematically represented by VGAM1 HOST TARGET PROTEIN through VGAM3 HOST TARGET PROTEIN, all of FIG. 1.

VGAM2001 RNA, herein schematically represented by VGAM1 RNA through VGAM3 RNA, binds complementarily to a host target binding site located in an untranslated region of VGAM2001 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2001 host target RNA into VGAM2001 host target protein, herein schematically represented by VGAM1 HOST TARGET PROTEIN through VGAM3 HOST TARGET PROTEIN, all of FIG. 1.

VGAM2002 RNA, herein schematically represented by VGAM1 RNA through VGAM3 RNA, binds complementarily to a host target binding site located in an untranslated region of VGAM2002 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2002 host target RNA into VGAM2002 host target protein, herein schematically represented by VGAM1 HOST TARGET PROTEIN through VGAM3 HOST TARGET PROTEIN, all of FIG. 1.

VGAM2003 RNA, herein schematically represented by VGAM1 RNA through VGAM3 RNA, binds complementarily to a host target binding site located in an untranslated region of VGAM2003 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2003 host target RNA into VGAM2003 host target protein, herein schematically represented by VGAM1 HOST TARGET PROTEIN through VGAM3 HOST TARGET PROTEIN, all of FIG. 1.

It is appreciated that a function of VGR3164 gene, herein designated VGR GENE, is inhibition of expression of host target genes, as part of a novel viral mechanism of attacking a host. Accordingly, utilities of VGR3164 gene include diagnosis, prevention and treatment of viral infection by Nipah Virus. Specific functions, and accordingly utilities, of VGR3164 gene correlate with, and may be deduced from, the identity of the host target genes, which are inhibited by VGAM RNAs comprised in the 'operon-like' cluster of VGR3164 gene: VGAM1998 host target protein, VGAM1999 host target protein, VGAM2000 host target protein, VGAM2001 host target protein, VGAM2002 host target protein and VGAM2003 host target protein, herein schematically represented by VGAM1 HOST TARGET PROTEIN through VGAM3 HOST TARGET PROTEIN. The function of these host target genes is elaborated hereinabove with reference to VGAM1998, VGAM1999, VGAM2000, VGAM2001, VGAM2002 and VGAM2003. FIG. 9 further provides a conceptual description of novel bioinformatically detected regulatory viral gene, referred to here as Viral Genomic Record 3165(VGR3165) viral gene, which encodes an 'operon-like' cluster of novel viral micro RNA-like genes, each of which in turn modulates expression of at least one host target gene, the function and utility of which at least one host target gene is known in the art.

VGR3165 gene, herein designated VGR GENE, is a novel bioinformatically detected regulatory, non protein coding, RNA viral gene. The method by which VGR3165 gene was detected is described hereinabove with reference to FIGS. 1-9.

VGR3165 gene encodes VGR3165 precursor RNA, herein designated VGR PRECURSOR RNA, an RNA molecule, typically several hundred nucleotides long.

VGR3165 precursor RNA folds spatially, forming VGR3165 folded precursor RNA, herein designated VGR FOLDED PRECURSOR RNA. It is appreciated that VGR3165 folded precursor RNA comprises a plurality of what is known in the art as 'hairpin' structures. These 'hairpin' structures are due to the fact that the nucleotide sequence of VGR3165 precursor RNA comprises a plurality of segments, the first half of each such segment having a nucleotide sequence which is at least a partial inversed-reversed sequence of the second half thereof, as is well known in the art.

VGR3165 folded precursor RNA is naturally processed by cellular enzymatic activity into at least 3 separate VGAM precursor RNAs, VGAM2004 precursor RNA, VGAM2005 precursor RNA and VGAM2006 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2004 RNA, VGAM2005 RNA and VGAM2006 RNA, herein schematically represented by VGAM1 RNA through VGAM3 RNA, each of which VGAM RNAs corresponding to VGAM RNA of FIG. 1.

VGAM2004 RNA, herein schematically represented by VGAM1 RNA through VGAM3 RNA, binds complementarily to a host target binding site located in an untranslated region of VGAM2004 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2004 host target RNA into VGAM2004 host target protein, herein schematically represented by VGAM1 HOST TARGET PROTEIN through VGAM3 HOST TARGET PROTEIN, all of FIG. 1.

VGAM2005 RNA, herein schematically represented by VGAM1 RNA through VGAM3 RNA, binds complementarily to a host target binding site located in an untranslated region of VGAM2005 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2005 host target RNA into VGAM2005 host target protein, herein schematically represented by VGAM1 HOST TARGET PROTEIN through VGAM3 HOST TARGET PROTEIN, all of FIG. 1.

VGAM2006 RNA, herein schematically represented by VGAM1 RNA through VGAM3 RNA, binds complementarily to a host target binding site located in an untranslated region of VGAM2006 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2006 host target RNA into VGAM2006 host target protein, herein schematically represented by VGAM1 HOST TARGET PROTEIN through VGAM3 HOST TARGET PROTEIN, all of FIG. 1.

It is appreciated that a function of VGR3165 gene, herein designated VGR GENE, is inhibition of expression of host target genes, as part of a novel viral mechanism of attacking a host. Accordingly, utilities of VGR3165 gene include diagnosis, prevention and treatment of viral infection by Chimpanzee Cytomegalovirus. Specific functions, and accordingly utilities, of VGR3165 gene correlate with, and may be deduced from, the identity of the host target genes, which are inhibited by VGAM RNAs comprised in the 'operon-like' cluster of VGR3165 gene: VGAM2004 host target protein, VGAM2005 host target protein and VGAM2006 host target protein, herein schematically represented by VGAM1 HOST TARGET PROTEIN through VGAM3 HOST TARGET PROTEIN. The function of these host target genes is elaborated hereinabove with reference to VGAM2004, VGAM2005 and VGAM2006. FIG. 9 further provides a conceptual description of novel bioinformatically detected regulatory viral gene, referred to here as Viral Genomic Record 3166(VGR3166) viral gene, which encodes an 'operon-like' cluster of novel viral micro RNA-like genes, each of which in turn modulates expression of at least one host target gene, the function and utility of which at least one host target gene is known in the art.

VGR3166 gene, herein designated VGR GENE, is a novel bioinformatically detected regulatory, non protein coding, RNA viral gene. The method by which VGR3166 gene was detected is described hereinabove with reference to FIGS. 1-9.

VGR3166 gene encodes VGR3166 precursor RNA, herein designated VGR PRECURSOR RNA, an RNA molecule, typically several hundred nucleotides long.

VGR3166 precursor RNA folds spatially, forming VGR3166 folded precursor RNA, herein designated VGR FOLDED PRECURSOR RNA. It is appreciated that VGR3166 folded precursor RNA comprises a plurality of what is known in the art as 'hairpin' structures. These 'hairpin' structures are due to the fact that the nucleotide sequence of VGR3166 precursor RNA comprises a plurality of segments, the first half of each such segment having a nucleotide sequence which is at least a partial inversed-reversed sequence of the second half thereof, as is well known in the art.

VGR3166 folded precursor RNA is naturally processed by cellular enzymatic activity into at least 8 separate VGAM precursor RNAs, VGAM2007 precursor RNA, VGAM2008 precursor RNA, VGAM2009 precursor RNA, VGAM2010 precursor RNA, VGAM2011 precursor RNA, VGAM2012 precursor RNA, VGAM2013 precursor RNA and VGAM2014 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2007 RNA, VGAM2008 RNA, VGAM2009 RNA, VGAM2010 RNA, VGAM2011 RNA, VGAM2012 RNA, VGAM2013 RNA and VGAM2014 RNA, herein schematically represented by VGAM1 RNA through VGAM3 RNA, each of which VGAM RNAs corresponding to VGAM RNA of FIG. 1.

VGAM2007 RNA, herein schematically represented by VGAM1 RNA through VGAM3 RNA, binds complementarily to a host target binding site located in an untranslated region of VGAM2007 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2007 host target RNA into VGAM2007 host target protein, herein schematically represented by VGAM1 HOST TARGET PROTEIN through VGAM3 HOST TARGET PROTEIN, all of FIG. 1.

VGAM2008 RNA, herein schematically represented by VGAM1 RNA through VGAM3 RNA, binds complementarily to a host target binding site located in an untranslated region of VGAM2008 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2008 host target RNA into VGAM2008 host target protein, herein schematically represented by VGAM1 HOST TARGET PROTEIN through VGAM3 HOST TARGET PROTEIN, all of FIG. 1.

VGAM2009 RNA, herein schematically represented by VGAM1 RNA through VGAM3 RNA, binds complementarily to a host target binding site located in an untranslated region of VGAM2009 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2009 host target RNA into VGAM2009 host target protein, herein schematically represented by VGAM1 HOST TARGET PROTEIN through VGAM3 HOST TARGET PROTEIN, all of FIG. 1.

VGAM2010 RNA, herein schematically represented by VGAM1 RNA through VGAM3 RNA, binds complementarily to a host target binding site located in an untranslated region of VGAM2010 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2010 host target RNA into VGAM2010 host target protein, herein schematically represented by VGAM1 HOST TARGET PROTEIN through VGAM3 HOST TARGET PROTEIN, all of FIG. 1.

VGAM2011 RNA, herein schematically represented by VGAM1 RNA through VGAM3 RNA, binds complementarily to a host target binding site located in an untranslated region of VGAM2011 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2011 host target RNA into VGAM2011 host target protein, herein schematically represented by VGAM1 HOST TARGET PROTEIN through VGAM3 HOST TARGET PROTEIN, all of FIG. 1.

VGAM2012 RNA, herein schematically represented by VGAM1 RNA through VGAM3 RNA, binds complementarily to a host target binding site located in an untranslated region of VGAM2012 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2012 host target RNA into VGAM2012 host target protein, herein schematically represented by VGAM1 HOST TARGET PROTEIN through VGAM3 HOST TARGET PROTEIN, all of FIG. 1.

VGAM2013 RNA, herein schematically represented by VGAM1 RNA through VGAM3 RNA, binds complementarily to a host target binding site located in an untranslated region of VGAM2013 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2013 host target RNA into VGAM2013 host target protein, herein schematically represented by VGAM1 HOST TARGET PROTEIN through VGAM3 HOST TARGET PROTEIN, all of FIG. 1.

VGAM2014 RNA, herein schematically represented by VGAM1 RNA through VGAM3 RNA, binds complementarily to a host target binding site located in an untranslated region of VGAM2014 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2014 host target RNA into VGAM2014 host target protein, herein schematically represented by VGAM1 HOST TARGET PROTEIN through VGAM3 HOST TARGET PROTEIN, all of FIG. 1.

It is appreciated that a function of VGR3166 gene, herein designated VGR GENE, is inhibition of expression of host target genes, as part of a novel viral mechanism of attacking a host. Accordingly, utilities of VGR3166 gene include diagnosis, prevention and treatment of viral infection by Reston Ebola Virus (REBOV). Specific functions, and accordingly utilities, of VGR3166 gene correlate with, and may be deduced from, the identity of the host target genes, which are inhibited by VGAM RNAs comprised in the 'operon-like' cluster of VGR3166 gene: VGAM2007 host target protein, VGAM2008 host target protein, VGAM2009 host target protein, VGAM2010 host target protein, VGAM2011 host target protein, VGAM2012 host target protein, VGAM2013 host target protein and VGAM2014 host target protein, herein schematically represented by VGAM1 HOST TARGET PROTEIN through VGAM3 HOST TARGET PROTEIN. The function of these host target genes is elaborated hereinabove with reference to VGAM2007, VGAM2008, VGAM2009, VGAM2010, VGAM2011, VGAM2012, VGAM2013 and VGAM2014. FIG. 9 further provides a conceptual description of novel bioinformatically detected regulatory viral gene, referred to here as Viral Genomic Record 3167(VGR3167) viral gene, which encodes an 'operon-like' cluster of novel viral micro RNA-like genes, each of which in turn modulates expression of at least one host target gene, the function and utility of which at least one host target gene is known in the art.

VGR3167 gene, herein designated VGR GENE, is a novel bioinformatically detected regulatory, non protein coding, RNA viral gene. The method by which VGR3167 gene was detected is described hereinabove with reference to FIGS. 1-9.

VGR3167 gene encodes VGR3167 precursor RNA, herein designated VGR PRECURSOR RNA, an RNA molecule, typically several hundred nucleotides long.

VGR3167 precursor RNA folds spatially, forming VGR3167 folded precursor RNA, herein designated VGR FOLDED PRECURSOR RNA. It is appreciated that VGR3167 folded precursor RNA comprises a plurality of what is known in the art as 'hairpin' structures. These 'hairpin' structures are due to the fact that the nucleotide sequence of VGR3167 precursor RNA comprises a plurality of segments, the first half of each such segment having a nucleotide sequence which is at least a partial inversed-reversed sequence of the second half thereof, as is well known in the art.

VGR3167 folded precursor RNA is naturally processed by cellular enzymatic activity into at least 8 separate VGAM precursor RNAs, VGAM2015 precursor RNA, VGAM2016 precursor RNA, VGAM2017 precursor RNA, VGAM2018 precursor RNA, VGAM2019 precursor RNA, VGAM2020 precursor RNA, VGAM2021 precursor RNA and VGAM2022 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2015 RNA, VGAM2016 RNA, VGAM2017 RNA, VGAM2018 RNA, VGAM2019 RNA, VGAM2020 RNA, VGAM2021 RNA and VGAM2022 RNA, herein schematically represented by VGAM1 RNA through VGAM3 RNA, each of which VGAM RNAs corresponding to VGAM RNA of FIG. 1.

VGAM2015 RNA, herein schematically represented by VGAM1 RNA through VGAM3 RNA, binds complementarily to a host target binding site located in an untranslated region of VGAM2015 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2015 host target RNA into VGAM2015 host target protein, herein schematically represented by VGAM1 HOST TARGET PROTEIN through VGAM3 HOST TARGET PROTEIN, all of FIG. 1.

VGAM2016 RNA, herein schematically represented by VGAM1 RNA through VGAM3 RNA, binds complementarily to a host target binding site located in an untranslated region of VGAM2016 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2016 host target RNA into VGAM2016 host target protein, herein schematically represented by VGAM1 HOST TARGET PROTEIN through VGAM3 HOST TARGET PROTEIN, all of FIG. 1.

VGAM2017 RNA, herein schematically represented by VGAM1 RNA through VGAM3 RNA, binds complementarily to a host target binding site located in an untranslated region of VGAM2017 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2017 host target RNA into VGAM2017 host target protein, herein schematically represented by VGAM1 HOST TARGET PROTEIN through VGAM3 HOST TARGET PROTEIN, all of FIG. 1.

VGAM2018 RNA, herein schematically represented by VGAM1 RNA through VGAM3 RNA, binds complementarily to a host target binding site located in an untranslated region of VGAM2018 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2018 host target RNA into VGAM2018 host target protein, herein schematically represented by VGAM1 HOST TARGET PROTEIN through VGAM3 HOST TARGET PROTEIN, all of FIG. 1.

VGAM2019 RNA, herein schematically represented by VGAM1 RNA through VGAM3 RNA, binds complementarily to a host target binding site located in an untranslated region of VGAM2019 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2019 host target RNA into VGAM2019 host target protein, herein schematically represented by VGAM1 HOST TARGET PROTEIN through VGAM3 HOST TARGET PROTEIN, all of FIG. 1.

VGAM2020 RNA, herein schematically represented by VGAM1 RNA through VGAM3 RNA, binds complementarily to a host target binding site located in an untranslated region of VGAM2020 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2020 host target RNA into VGAM2020 host target protein, herein schematically represented by VGAM1 HOST TARGET PROTEIN through VGAM3 HOST TARGET PROTEIN, all of FIG. 1.

VGAM2021 RNA, herein schematically represented by VGAM1 RNA through VGAM3 RNA, binds complementarily to a host target binding site located in an untranslated region of VGAM2021 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2021 host target RNA into VGAM2021 host target protein, herein schematically represented by VGAM1 HOST TARGET PROTEIN through VGAM3 HOST TARGET PROTEIN, all of FIG. 1.

VGAM2022 RNA, herein schematically represented by VGAM1 RNA through VGAM3 RNA, binds complementarily to a host target binding site located in an untranslated region of VGAM2022 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2022 host target RNA into VGAM2022 host target protein, herein schematically represented by VGAM1 HOST TARGET PROTEIN through VGAM3 HOST TARGET PROTEIN, all of FIG. 1.

It is appreciated that a function of VGR3167 gene, herein designated VGR GENE, is inhibition of expression of host target genes, as part of a novel viral mechanism of attacking a host. Accordingly, utilities of VGR3167 gene include diagnosis, prevention and treatment of viral infection by Kyuri Green Mottle Mosaic Virus. Specific functions, and accordingly utilities, of VGR3167 gene correlate with, and may be deduced from, the identity of the host target genes, which are inhibited by VGAM RNAs comprised in the 'operon-like' cluster of VGR3167 gene: VGAM2015 host target protein, VGAM2016 host target protein, VGAM2017 host target protein, VGAM2018 host target protein, VGAM2019 host target protein, VGAM2020 host target protein, VGAM2021 host target protein and VGAM2022 host target protein, herein schematically represented by VGAM1 HOST TARGET PROTEIN through VGAM3 HOST TARGET PROTEIN. The function of these host target genes is elaborated hereinabove with reference to VGAM2015, VGAM2016, VGAM2017, VGAM2018, VGAM2019, VGAM2020, VGAM2021 and VGAM2022. FIG. 9 further provides a conceptual description of novel bioinformatically detected regulatory viral gene, referred to here as Viral Genomic Record 3168(VGR3168) viral gene, which encodes an 'operon-like' cluster of novel viral micro RNA-like genes, each of which in turn modulates expression of at least one host target gene, the function and utility of which at least one host target gene is known in the art.

VGR3168 gene, herein designated VGR GENE, is a novel bioinformatically detected regulatory, non protein coding, RNA viral gene. The method by which VGR3168 gene was detected is described hereinabove with reference to FIGS. 1-9.

VGR3168 gene encodes VGR3168 precursor RNA, herein designated VGR PRECURSOR RNA, an RNA molecule, typically several hundred nucleotides long.

VGR3168 precursor RNA folds spatially, forming VGR3168 folded precursor RNA, herein designated VGR FOLDED PRECURSOR RNA. It is appreciated that VGR3168 folded precursor RNA comprises a plurality of what is known in the art as 'hairpin' structures. These 'hairpin' structures are due to the fact that the nucleotide sequence of VGR3168 precursor RNA comprises a plurality of segments, the first half of each such segment having a nucleotide sequence which is at least a partial inversed-reversed sequence of the second half thereof, as is well known in the art.

VGR3168 folded precursor RNA is naturally processed by cellular enzymatic activity into at least 8 separate VGAM precursor RNAs, VGAM2023 precursor RNA, VGAM2024 precursor RNA, VGAM2025 precursor RNA, VGAM2026 precursor RNA, VGAM2027 precursor RNA, VGAM2028 precursor RNA, VGAM2029 precursor RNA and VGAM2030 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2023 RNA, VGAM2024 RNA, VGAM2025 RNA, VGAM2026 RNA, VGAM2027 RNA, VGAM2028 RNA, VGAM2029 RNA and VGAM2030 RNA, herein schematically represented by VGAM1 RNA through VGAM3 RNA, each of which VGAM RNAs corresponding to VGAM RNA of FIG. 1.

VGAM2023 RNA, herein schematically represented by VGAM1 RNA through VGAM3 RNA, binds complementarily to a host target binding site located in an untranslated region of VGAM2023 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2023 host target RNA into VGAM2023 host target protein, herein schematically represented by VGAM1 HOST TARGET PROTEIN through VGAM3 HOST TARGET PROTEIN, all of FIG. 1.

VGAM2024 RNA, herein schematically represented by VGAM1 RNA through VGAM3 RNA, binds complementarily to a host target binding site located in an untranslated region of VGAM2024 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2024 host target RNA into VGAM2024 host target protein, herein schematically represented by VGAM1 HOST TARGET PROTEIN through VGAM3 HOST TARGET PROTEIN, all of FIG. 1.

VGAM2025 RNA, herein schematically represented by VGAM1 RNA through VGAM3 RNA, binds complementarily to a host target binding site located in an untranslated region of VGAM2025 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2025 host target RNA into VGAM2025 host target protein, herein schematically represented by VGAM1 HOST TARGET PROTEIN through VGAM3 HOST TARGET PROTEIN, all of FIG. 1.

VGAM2026 RNA, herein schematically represented by VGAM1 RNA through VGAM3 RNA, binds complementarily to a host target binding site located in an untranslated region of VGAM2026 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2026 host target RNA into VGAM2026 host target protein, herein schematically represented by VGAM1 HOST TARGET PROTEIN through VGAM3 HOST TARGET PROTEIN, all of FIG. 1.

VGAM2027 RNA, herein schematically represented by VGAM1 RNA through VGAM3 RNA, binds complementarily to a host target binding site located in an untranslated region of VGAM2027 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2027 host target RNA into VGAM2027 host target protein, herein schematically represented by VGAM1 HOST TARGET PROTEIN through VGAM3 HOST TARGET PROTEIN, all of FIG. 1.

VGAM2028 RNA, herein schematically represented by VGAM1 RNA through VGAM3 RNA, binds complementarily to a host target binding site located in an untranslated region of VGAM2028 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2028 host target RNA into VGAM2028 host target protein, herein schematically represented by VGAM1 HOST TARGET PROTEIN through VGAM3 HOST TARGET PROTEIN, all of FIG. 1.

VGAM2029 RNA, herein schematically represented by VGAM1 RNA through VGAM3 RNA, binds complementarily to a host target binding site located in an untranslated region of VGAM2029 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2029 host target RNA into VGAM2029 host target protein, herein schematically represented by VGAM1 HOST TARGET PROTEIN through VGAM3 HOST TARGET PROTEIN, all of FIG. 1.

VGAM2030 RNA, herein schematically represented by VGAM1 RNA through VGAM3 RNA, binds complementarily to a host target binding site located in an untranslated region of VGAM2030 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2030 host target RNA into VGAM2030 host target protein, herein schematically represented by VGAM1 HOST TARGET PROTEIN through VGAM3 HOST TARGET PROTEIN, all of FIG. 1.

It is appreciated that a function of VGR3168 gene, herein designated VGR GENE, is inhibition of expression of host target genes, as part of a novel viral mechanism of attacking a host. Accordingly, utilities of VGR3168 gene include diagnosis, prevention and treatment of viral infection by Zaire Ebola Virus (ZEBOV). Specific functions, and accordingly utilities, of VGR3168 gene correlate with, and may be deduced from, the identity of the host target genes, which are inhibited by VGAM RNAs comprised in the 'operon-like' cluster of VGR3168 gene: VGAM2023 host target protein, VGAM2024 host target protein, VGAM2025 host target protein, VGAM2026 host target protein, VGAM2027 host target protein, VGAM2028 host target protein, VGAM2029 host target protein and VGAM2030 host target protein, herein schematically represented by VGAM1 HOST TARGET PROTEIN through VGAM3 HOST TARGET PROTEIN. The function of these host target genes is elaborated hereinabove with reference to VGAM2023, VGAM2024, VGAM2025, VGAM2026, VGAM2027, VGAM2028, VGAM2029 and VGAM2030. FIG. 9 further provides a conceptual description of novel bioinformatically detected regulatory viral gene, referred to here as Viral Genomic Record 3169(VGR3169) viral gene, which encodes an 'operon-like' cluster of novel viral micro RNA-like genes, each of which in turn modulates expression of at least one host target gene, the function and utility of which at least one host target gene is known in the art.

VGR3169 gene, herein designated VGR GENE, is a novel bioinformatically detected regulatory, non protein coding, RNA viral gene. The method by which VGR3169 gene was detected is described hereinabove with reference to FIGS. 1-9.

VGR3169 gene encodes VGR3169 precursor RNA, herein designated VGR PRECURSOR RNA, an RNA molecule, typically several hundred nucleotides long.

VGR3169 precursor RNA folds spatially, forming VGR3169 folded precursor RNA, herein designated VGR FOLDED PRECURSOR RNA. It is appreciated that VGR3169 folded precursor RNA comprises a plurality of what is known in the art as 'hairpin' structures. These 'hairpin' structures are due to the fact that the nucleotide sequence of VGR3169 precursor RNA comprises a plurality of segments, the first half of each such segment having a nucleotide sequence which is at least a partial inversed-reversed sequence of the second half thereof, as is well known in the art.

VGR3169 folded precursor RNA is naturally processed by cellular enzymatic activity into at least 5 separate VGAM precursor RNAs, VGAM2031 precursor RNA, VGAM2032 precursor RNA, VGAM2033 precursor RNA, VGAM2034 precursor RNA and VGAM2035 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2031 RNA, VGAM2032 RNA, VGAM2033 RNA, VGAM2034 RNA and VGAM2035 RNA, herein schematically represented by VGAM1 RNA through VGAM3 RNA, each of which VGAM RNAs corresponding to VGAM RNA of FIG. 1.

VGAM2031 RNA, herein schematically represented by VGAM1 RNA through VGAM3 RNA, binds complementarily to a host target binding site located in an untranslated region of VGAM2031 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2031 host target RNA into VGAM2031 host target protein, herein schematically represented by VGAM1 HOST TARGET PROTEIN through VGAM3 HOST TARGET PROTEIN, all of FIG. 1.

VGAM2032 RNA, herein schematically represented by VGAM1 RNA through VGAM3 RNA, binds complementarily to a host target binding site located in an untranslated region of VGAM2032 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2032 host target RNA into VGAM2032 host target protein, herein schematically represented by VGAM1 HOST TARGET PROTEIN through VGAM3 HOST TARGET PROTEIN, all of FIG. 1.

VGAM2033 RNA, herein schematically represented by VGAM1 RNA through VGAM3 RNA, binds complementarily to a host target binding site located in an untranslated region of VGAM2033 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2033 host target RNA into VGAM2033 host target protein, herein schematically represented by VGAM1 HOST TARGET PROTEIN through VGAM3 HOST TARGET PROTEIN, all of FIG. 1.

VGAM2034 RNA, herein schematically represented by VGAM1 RNA through VGAM3 RNA, binds complementarily to a host target binding site located in an untranslated region of VGAM2034 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2034 host target RNA into VGAM2034 host target protein, herein schematically represented by VGAM1 HOST TARGET PROTEIN through VGAM3 HOST TARGET PROTEIN, all of FIG. 1.

VGAM2035 RNA, herein schematically represented by VGAM1 RNA through VGAM3 RNA, binds complementarily to a host target binding site located in an untranslated region of VGAM2035 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2035 host target RNA into VGAM2035 host target protein, herein schematically represented by VGAM1 HOST TARGET PROTEIN through VGAM3 HOST TARGET PROTEIN, all of FIG. 1.

It is appreciated that a function of VGR3169 gene, herein designated VGR GENE, is inhibition of expression of host target genes, as part of a novel viral mechanism of attacking a host. Accordingly, utilities of VGR3169 gene include diagnosis, prevention and treatment of viral infection by Zaire Ebola Virus (ZEBOV). Specific functions, and accordingly utilities, of VGR3169 gene correlate with, and may be deduced from, the identity of the host target genes, which are inhibited by VGAM RNAs comprised in the 'operon-like' cluster of VGR3169 gene: VGAM2031 host target protein, VGAM2032 host target protein, VGAM2033 host target protein, VGAM2034 host target protein and VGAM2035 host target protein, herein schematically represented by VGAM1

HOST TARGET PROTEIN through VGAM3 HOST TARGET PROTEIN. The function of these host target genes is elaborated hereinabove with reference to VGAM2031, VGAM2032, VGAM2033, VGAM2034 and VGAM2035. FIG. 9 further provides a conceptual description of novel bioinformatically detected regulatory viral gene, referred to here as Viral Genomic Record 3170(VGR3170) viral gene, which encodes an 'operon-like' cluster of novel viral micro RNA-like genes, each of which in turn modulates expression of at least one host target gene, the function and utility of which at least one host target gene is known in the art.

VGR3170 gene, herein designated VGR GENE, is a novel bioinformatically detected regulatory, non protein coding, RNA viral gene. The method by which VGR3170 gene was detected is described hereinabove with reference to FIGS. 1-9.

VGR3170 gene encodes VGR3170 precursor RNA, herein designated VGR PRECURSOR RNA, an RNA molecule, typically several hundred nucleotides long.

VGR3170 precursor RNA folds spatially, forming VGR3170 folded precursor RNA, herein designated VGR FOLDED PRECURSOR RNA. It is appreciated that VGR3170 folded precursor RNA comprises a plurality of what is known in the art as 'hairpin' structures. These 'hairpin' structures are due to the fact that the nucleotide sequence of VGR3170 precursor RNA comprises a plurality of segments, the first half of each such segment having a nucleotide sequence which is at least a partial inversed-reversed sequence of the second half thereof, as is well known in the art.

VGR3170 folded precursor RNA is naturally processed by cellular enzymatic activity into at least 6 separate VGAM precursor RNAs, VGAM2036 precursor RNA, VGAM2037 precursor RNA, VGAM2038 precursor RNA, VGAM2039 precursor RNA, VGAM2040 precursor RNA and VGAM2041 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2036 RNA, VGAM2037 RNA, VGAM2038 RNA, VGAM2039 RNA, VGAM2040 RNA and VGAM2041 RNA, herein schematically represented by VGAM1 RNA through VGAM3 RNA, each of which VGAM RNAs corresponding to VGAM RNA of FIG. 1.

VGAM2036 RNA, herein schematically represented by VGAM1 RNA through VGAM3 RNA, binds complementarily to a host target binding site located in an untranslated region of VGAM2036 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2036 host target RNA into VGAM2036 host target protein, herein schematically represented by VGAM1 HOST TARGET PROTEIN through VGAM3 HOST TARGET PROTEIN, all of FIG. 1.

VGAM2037 RNA, herein schematically represented by VGAM1 RNA through VGAM3 RNA, binds complementarily to a host target binding site located in an untranslated region of VGAM2037 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2037 host target RNA into VGAM2037 host target protein, herein schematically represented by VGAM1 HOST TARGET PROTEIN through VGAM3 HOST TARGET PROTEIN, all of FIG. 1.

VGAM2038 RNA, herein schematically represented by VGAM1 RNA through VGAM3 RNA, binds complementarily to a host target binding site located in an untranslated region of VGAM2038 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2038 host target RNA into VGAM2038 host target protein, herein schematically represented by VGAM1 HOST TARGET PROTEIN through VGAM3 HOST TARGET PROTEIN, all of FIG. 1.

VGAM2039 RNA, herein schematically represented by VGAM1 RNA through VGAM3 RNA, binds complementarily to a host target binding site located in an untranslated region of VGAM2039 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2039 host target RNA into VGAM2039 host target protein, herein schematically represented by VGAM1 HOST TARGET PROTEIN through VGAM3 HOST TARGET PROTEIN, all of FIG. 1.

VGAM2040 RNA, herein schematically represented by VGAM1 RNA through VGAM3 RNA, binds complementarily to a host target binding site located in an untranslated region of VGAM2040 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2040 host target RNA into VGAM2040 host target protein, herein schematically represented by VGAM1 HOST TARGET PROTEIN through VGAM3 HOST TARGET PROTEIN, all of FIG. 1.

VGAM2041 RNA, herein schematically represented by VGAM1 RNA through VGAM3 RNA, binds complementarily to a host target binding site located in an untranslated region of VGAM2041 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2041 host target RNA into VGAM2041 host target protein, herein schematically represented by VGAM1 HOST TARGET PROTEIN through VGAM3 HOST TARGET PROTEIN, all of FIG. 1.

It is appreciated that a function of VGR3170 gene, herein designated VGR GENE, is inhibition of expression of host target genes, as part of a novel viral mechanism of attacking a host. Accordingly, utilities of VGR3170 gene include diagnosis, prevention and treatment of viral infection by Marburg Virus. Specific functions, and accordingly utilities, of VGR3170 gene correlate with, and may be deduced from, the identity of the host target genes, which are inhibited by VGAM RNAs comprised in the 'operon-like' cluster of VGR3170 gene: VGAM2036 host target protein, VGAM2037 host target protein, VGAM2038 host target protein, VGAM2039 host target protein, VGAM2040 host target protein and VGAM2041 host target protein, herein schematically represented by VGAM1 HOST TARGET PROTEIN through VGAM3 HOST TARGET PROTEIN. The function of these host target genes is elaborated hereinabove with reference to VGAM2036, VGAM2037, VGAM2038, VGAM2039, VGAM2040 and VGAM2041. FIG. 9 further provides a conceptual description of novel bioinformatically detected regulatory viral gene, referred to here as Viral Genomic Record 3171(VGR3171) viral gene, which encodes an 'operon-like' cluster of novel viral micro RNA-like genes, each of which in turn modulates expression of at least one host target gene, the function and utility of which at least one host target gene is known in the art.

VGR3171 gene, herein designated VGR GENE, is a novel bioinformatically detected regulatory, non protein coding, RNA viral gene. The method by which VGR3171 gene was detected is described hereinabove with reference to FIGS. 1-9.

VGR3171 gene encodes VGR3171 precursor RNA, herein designated VGR PRECURSOR RNA, an RNA molecule, typically several hundred nucleotides long.

VGR3171 precursor RNA folds spatially, forming VGR3171 folded precursor RNA, herein designated VGR FOLDED PRECURSOR RNA. It is appreciated that VGR3171 folded precursor RNA comprises a plurality of what is known in the art as 'hairpin' structures. These 'hairpin' structures are due to the fact that the nucleotide sequence of VGR3171 precursor RNA comprises a plurality of segments, the first half of each such segment having a nucleotide sequence which is at least a partial inversed-reversed sequence of the second half thereof, as is well known in the art.

VGR3171 folded precursor RNA is naturally processed by cellular enzymatic activity into at least 8 separate VGAM precursor RNAs, VGAM2042 precursor RNA, VGAM2043 precursor RNA, VGAM2044 precursor RNA, VGAM2045 precursor RNA, VGAM2046 precursor RNA, VGAM2047 precursor RNA, VGAM2048 precursor RNA and VGAM2049 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2042 RNA, VGAM2043 RNA, VGAM2044 RNA, VGAM2045 RNA, VGAM2046 RNA, VGAM2047 RNA, VGAM2048 RNA and VGAM2049 RNA, herein schematically represented by VGAM1 RNA through VGAM3 RNA, each of which VGAM RNAs corresponding to VGAM RNA of FIG. 1.

VGAM2042 RNA, herein schematically represented by VGAM1 RNA through VGAM3 RNA, binds complementarily to a host target binding site located in an untranslated region of VGAM2042 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2042 host target RNA into VGAM2042 host target protein, herein schematically represented by VGAM1 HOST TARGET PROTEIN through VGAM3 HOST TARGET PROTEIN, all of FIG. 1.

VGAM2043 RNA, herein schematically represented by VGAM1 RNA through VGAM3 RNA, binds complementarily to a host target binding site located in an untranslated region of VGAM2043 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2043 host target RNA into VGAM2043 host target protein, herein schematically represented by VGAM1 HOST TARGET PROTEIN through VGAM3 HOST TARGET PROTEIN, all of FIG. 1.

VGAM2044 RNA, herein schematically represented by VGAM1 RNA through VGAM3 RNA, binds complementarily to a host target binding site located in an untranslated region of VGAM2044 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2044 host target RNA into VGAM2044 host target protein, herein schematically represented by VGAM1 HOST TARGET PROTEIN through VGAM3 HOST TARGET PROTEIN, all of FIG. 1.

VGAM2045 RNA, herein schematically represented by VGAM1 RNA through VGAM3 RNA, binds complementarily to a host target binding site located in an untranslated region of VGAM2045 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2045 host target RNA into VGAM2045 host target protein, herein schematically represented by VGAM1 HOST TARGET PROTEIN through VGAM3 HOST TARGET PROTEIN, all of FIG. 1.

VGAM2046 RNA, herein schematically represented by VGAM1 RNA through VGAM3 RNA, binds complementarily to a host target binding site located in an untranslated region of VGAM2046 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2046 host target RNA into VGAM2046 host target protein, herein schematically represented by VGAM1 HOST TARGET PROTEIN through VGAM3 HOST TARGET PROTEIN, all of FIG. 1.

VGAM2047 RNA, herein schematically represented by VGAM1 RNA through VGAM3 RNA, binds complementarily to a host target binding site located in an untranslated region of VGAM2047 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2047 host target RNA into VGAM2047 host target protein, herein schematically represented by VGAM1 HOST TARGET PROTEIN through VGAM3 HOST TARGET PROTEIN, all of FIG. 1.

VGAM2048 RNA, herein schematically represented by VGAM1 RNA through VGAM3 RNA, binds complementarily to a host target binding site located in an untranslated region of VGAM2048 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2048 host target RNA into VGAM2048 host target protein, herein schematically represented by VGAM1 HOST TARGET PROTEIN through VGAM3 HOST TARGET PROTEIN, all of FIG. 1.

VGAM2049 RNA, herein schematically represented by VGAM1 RNA through VGAM3 RNA, binds complementarily to a host target binding site located in an untranslated region of VGAM2049 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2049 host target RNA into VGAM2049 host target protein, herein schematically represented by VGAM1 HOST TARGET PROTEIN through VGAM3 HOST TARGET PROTEIN, all of FIG. 1.

It is appreciated that a function of VGR3171 gene, herein designated VGR GENE, is inhibition of expression of host target genes, as part of a novel viral mechanism of attacking a host. Accordingly, utilities of VGR3171 gene include diagnosis, prevention and treatment of viral infection by Human Herpesvirus 5. Specific functions, and accordingly utilities, of VGR3171 gene correlate with, and may be deduced from, the identity of the host target genes, which are inhibited by VGAM RNAs comprised in the 'operon-like' cluster of VGR3171 gene: VGAM2042 host target protein, VGAM2043 host target protein, VGAM2044 host target protein, VGAM2045 host target protein, VGAM2046 host target protein, VGAM2047 host target protein, VGAM2048 host target protein and VGAM2049 host target protein, herein schematically represented by VGAM1 HOST TARGET PROTEIN through VGAM3 HOST TARGET PROTEIN. The function of these host target genes is elaborated hereinabove with reference to VGAM2042, VGAM2043, VGAM2044, VGAM2045, VGAM2046, VGAM2047, VGAM2048 and VGAM2049. FIG. 9 further provides a conceptual description of novel bioinformatically detected regulatory viral gene, referred to here as Viral Genomic Record 3172(VGR3172) viral gene, which encodes an 'operon-like' cluster of novel viral micro RNA-like genes, each of which in turn modulates expression of at least one host target gene, the function and utility of which at least one host target gene is known in the art.

VGR3172 gene, herein designated VGR GENE, is a novel bioinformatically detected regulatory, non protein coding, RNA viral gene. The method by which VGR3172 gene was detected is described hereinabove with reference to FIGS. 1-9.

VGR3172 gene encodes VGR3172 precursor RNA, herein designated VGR PRECURSOR RNA, an RNA molecule, typically several hundred nucleotides long.

VGR3172 precursor RNA folds spatially, forming VGR3172 folded precursor RNA, herein designated VGR FOLDED PRECURSOR RNA. It is appreciated that VGR3172 folded precursor RNA comprises a plurality of what is known in the art as 'hairpin' structures. These 'hairpin' structures are due to the fact that the nucleotide sequence of VGR3172 precursor RNA comprises a plurality of segments, the first half of each such segment having a nucleotide sequence which is at least a partial inversed-reversed sequence of the second half thereof, as is well known in the art.

VGR3172 folded precursor RNA is naturally processed by cellular enzymatic activity into at least 4 separate VGAM precursor RNAs, VGAM2050 precursor RNA, VGAM2051 precursor RNA, VGAM2052 precursor RNA and VGAM2053 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2050 RNA, VGAM2051 RNA, VGAM2052 RNA and VGAM2053 RNA, herein schematically represented by VGAM1 RNA through VGAM3 RNA, each of which VGAM RNAs corresponding to VGAM RNA of FIG. 1.

VGAM2050 RNA, herein schematically represented by VGAM1 RNA through VGAM3 RNA, binds complementarily to a host target binding site located in an untranslated region of VGAM2050 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2050 host target RNA into VGAM2050 host target protein, herein schematically represented by VGAM1 HOST TARGET PROTEIN through VGAM3 HOST TARGET PROTEIN, all of FIG. 1.

VGAM2051 RNA, herein schematically represented by VGAM1 RNA through VGAM3 RNA, binds complementarily to a host target binding site located in an untranslated region of VGAM2051 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2051 host target RNA into VGAM2051 host target protein, herein schematically represented by VGAM1 HOST TARGET PROTEIN through VGAM3 HOST TARGET PROTEIN, all of FIG. 1.

VGAM2052 RNA, herein schematically represented by VGAM1 RNA through VGAM3 RNA, binds complementarily to a host target binding site located in an untranslated region of VGAM2052 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2052 host target RNA into VGAM2052 host target protein, herein schematically represented by VGAM1 HOST TARGET PROTEIN through VGAM3 HOST TARGET PROTEIN, all of FIG. 1.

VGAM2053 RNA, herein schematically represented by VGAM1 RNA through VGAM3 RNA, binds complementarily to a host target binding site located in an untranslated region of VGAM2053 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2053 host target RNA into VGAM2053 host target protein, herein schematically represented by VGAM1 HOST TARGET PROTEIN through VGAM3 HOST TARGET PROTEIN, all of FIG. 1.

It is appreciated that a function of VGR3172 gene, herein designated VGR GENE, is inhibition of expression of host target genes, as part of a novel viral mechanism of attacking a host. Accordingly, utilities of VGR3172 gene include diagnosis, prevention and treatment of viral infection by Ovine Adenovirus A. Specific functions, and accordingly utilities, of VGR3172 gene correlate with, and may be deduced from, the identity of the host target genes, which are inhibited by VGAM RNAs comprised in the 'operon-like' cluster of VGR3172 gene: VGAM2050 host target protein, VGAM2051 host target protein, VGAM2052 host target protein and VGAM2053 host target protein, herein schematically represented by VGAM1 HOST TARGET PROTEIN through VGAM3 HOST TARGET PROTEIN. The function of these host target genes is elaborated hereinabove with reference to VGAM2050, VGAM2051, VGAM2052 and VGAM2053. FIG. 9 further provides a conceptual description of novel bioinformatically detected regulatory viral gene, referred to here as Viral Genomic Record 3173(VGR3173) viral gene, which encodes an 'operon-like' cluster of novel viral micro RNA-like genes, each of which in turn modulates expression of at least one host target gene, the function and utility of which at least one host target gene is known in the art.

VGR3173 gene, herein designated VGR GENE, is a novel bioinformatically detected regulatory, non protein coding, RNA viral gene. The method by which VGR3173 gene was detected is described hereinabove with reference to FIGS. 1-9.

VGR3173 gene encodes VGR3173 precursor RNA, herein designated VGR PRECURSOR RNA, an RNA molecule, typically several hundred nucleotides long.

VGR3173 precursor RNA folds spatially, forming VGR3173 folded precursor RNA, herein designated VGR FOLDED PRECURSOR RNA. It is appreciated that VGR3173 folded precursor RNA comprises a plurality of what is known in the art as 'hairpin' structures. These 'hairpin' structures are due to the fact that the nucleotide sequence of VGR3173 precursor RNA comprises a plurality of segments, the first half of each such segment having a nucleotide sequence which is at least a partial inversed-reversed sequence of the second half thereof, as is well known in the art.

VGR3173 folded precursor RNA is naturally processed by cellular enzymatic activity into at least 8 separate VGAM precursor RNAs, VGAM2054 precursor RNA, VGAM2055 precursor RNA, VGAM2056 precursor RNA, VGAM2057 precursor RNA, VGAM2058 precursor RNA, VGAM2059 precursor RNA, VGAM2060 precursor RNA and VGAM2061 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2054 RNA, VGAM2055 RNA, VGAM2056 RNA, VGAM2057 RNA, VGAM2058 RNA, VGAM2059 RNA, VGAM2060 RNA and VGAM2061 RNA, herein schematically represented by VGAM1 RNA through VGAM3 RNA, each of which VGAM RNAs corresponding to VGAM RNA of FIG. 1.

VGAM2054 RNA, herein schematically represented by VGAM1 RNA through VGAM3 RNA, binds complementarily to a host target binding site located in an untranslated region of VGAM2054 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2054 host target RNA into VGAM2054 host target protein, herein schematically represented by VGAM1 HOST TARGET PROTEIN through VGAM3 HOST TARGET PROTEIN, all of FIG. 1.

VGAM2055 RNA, herein schematically represented by VGAM1 RNA through VGAM3 RNA, binds complementarily to a host target binding site located in an untranslated region of VGAM2055 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2055 host target RNA into VGAM2055 host target protein, herein schematically represented by VGAM1 HOST TARGET PROTEIN through VGAM3 HOST TARGET PROTEIN, all of FIG. 1.

VGAM2056 RNA, herein schematically represented by VGAM1 RNA through VGAM3 RNA, binds complementarily to a host target binding site located in an untranslated region of VGAM2056 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2056 host target RNA into VGAM2056 host target protein, herein schematically represented by VGAM1 HOST TARGET PROTEIN through VGAM3 HOST TARGET PROTEIN, all of FIG. 1.

VGAM2057 RNA, herein schematically represented by VGAM1 RNA through VGAM3 RNA, binds complementarily to a host target binding site located in an untranslated region of VGAM2057 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2057 host target RNA into VGAM2057 host target protein, herein schematically represented by VGAM1 HOST TARGET PROTEIN through VGAM3 HOST TARGET PROTEIN, all of FIG. 1.

VGAM2058 RNA, herein schematically represented by VGAM1 RNA through VGAM3 RNA, binds complementarily to a host target binding site located in an untranslated region of VGAM2058 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2058 host target RNA into VGAM2058 host target protein, herein schematically represented by VGAM1 HOST TARGET PROTEIN through VGAM3 HOST TARGET PROTEIN, all of FIG. 1.

VGAM2059 RNA, herein schematically represented by VGAM1 RNA through VGAM3 RNA, binds complementarily to a host target binding site located in an untranslated region of VGAM2059 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2059 host target RNA into VGAM2059 host target protein, herein schematically represented by VGAM1 HOST TARGET PROTEIN through VGAM3 HOST TARGET PROTEIN, all of FIG. 1.

VGAM2060 RNA, herein schematically represented by VGAM1 RNA through VGAM3 RNA, binds complementarily to a host target binding site located in an untranslated region of VGAM2060 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2060 host target RNA into VGAM2060 host target protein, herein schematically represented by VGAM1 HOST TARGET PROTEIN through VGAM3 HOST TARGET PROTEIN, all of FIG. 1.

VGAM2061 RNA, herein schematically represented by VGAM1 RNA through VGAM3 RNA, binds complementarily to a host target binding site located in an untranslated region of VGAM2061 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2061 host target RNA into VGAM2061 host target protein, herein schematically represented by VGAM1 HOST TARGET PROTEIN through VGAM3 HOST TARGET PROTEIN, all of FIG. 1.

It is appreciated that a function of VGR3173 gene, herein designated VGR GENE, is inhibition of expression of host target genes, as part of a novel viral mechanism of attacking a host. Accordingly, utilities of VGR3173 gene include diagnosis, prevention and treatment of viral infection by Ectromelia Virus. Specific functions, and accordingly utilities, of VGR3173 gene correlate with, and may be deduced from, the identity of the host target genes, which are inhibited by VGAM RNAs comprised in the 'operon-like' cluster of VGR3173 gene: VGAM2054 host target protein, VGAM2055 host target protein, VGAM2056 host target protein, VGAM2057 host target protein, VGAM2058 host target protein, VGAM2059 host target protein, VGAM2060 host target protein and VGAM2061 host target protein, herein schematically represented by VGAM1 HOST TARGET PROTEIN through VGAM3 HOST TARGET PROTEIN. The function of these host target genes is elaborated hereinabove with reference to VGAM2054, VGAM2055, VGAM2056, VGAM2057, VGAM2058, VGAM2059, VGAM2060 and VGAM2061. FIG. 9 further provides a conceptual description of novel bioinformatically detected regulatory viral gene, referred to here as Viral Genomic Record 3174(VGR3174) viral gene, which encodes an 'operon-like' cluster of novel viral micro RNA-like genes, each of which in turn modulates expression of at least one host target gene, the function and utility of which at least one host target gene is known in the art.

VGR3174 gene, herein designated VGR GENE, is a novel bioinformatically detected regulatory, non protein coding, RNA viral gene. The method by which VGR3174 gene was detected is described hereinabove with reference to FIGS. 1-9.

VGR3174 gene encodes VGR3174 precursor RNA, herein designated VGR PRECURSOR RNA, an RNA molecule, typically several hundred nucleotides long.

VGR3174 precursor RNA folds spatially, forming VGR3174 folded precursor RNA, herein designated VGR FOLDED PRECURSOR RNA. It is appreciated that VGR3174 folded precursor RNA comprises a plurality of what is known in the art as 'hairpin' structures. These 'hairpin' structures are due to the fact that the nucleotide sequence of VGR3174 precursor RNA comprises a plurality of segments, the first half of each such segment having a nucleotide sequence which is at least a partial inversed-reversed sequence of the second half thereof, as is well known in the art.

VGR3174 folded precursor RNA is naturally processed by cellular enzymatic activity into at least 6 separate VGAM precursor RNAs, VGAM2062 precursor RNA, VGAM2063 precursor RNA, VGAM2064 precursor RNA, VGAM2065 precursor RNA, VGAM2066 precursor RNA and VGAM2067 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2062 RNA, VGAM2063 RNA, VGAM2064 RNA, VGAM2065 RNA, VGAM2066 RNA and VGAM2067 RNA, herein schematically represented by VGAM1 RNA through VGAM3 RNA, each of which VGAM RNAs corresponding to VGAM RNA of FIG. 1.

VGAM2062 RNA, herein schematically represented by VGAM1 RNA through VGAM3 RNA, binds complementarily to a host target binding site located in an untranslated region of VGAM2062 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2062 host target RNA into VGAM2062 host target protein, herein schematically represented by VGAM1 HOST TARGET PROTEIN through VGAM3 HOST TARGET PROTEIN, all of FIG. 1.

VGAM2063 RNA, herein schematically represented by VGAM1 RNA through VGAM3 RNA, binds complementarily to a host target binding site located in an untranslated region of VGAM2063 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2063 host target RNA into VGAM2063 host target protein, herein schematically represented by VGAM1 HOST TARGET PROTEIN through VGAM3 HOST TARGET PROTEIN, all of FIG. 1.

VGAM2064 RNA, herein schematically represented by VGAM1 RNA through VGAM3 RNA, binds complementarily to a host target binding site located in an untranslated region of VGAM2064 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2064 host target RNA into VGAM2064 host target protein, herein schematically represented by VGAM1 HOST TARGET PROTEIN through VGAM3 HOST TARGET PROTEIN, all of FIG. 1.

VGAM2065 RNA, herein schematically represented by VGAM1 RNA through VGAM3 RNA, binds complementarily to a host target binding site located in an untranslated region of VGAM2065 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2065 host target RNA into VGAM2065 host target protein, herein schematically represented by VGAM1 HOST TARGET PROTEIN through VGAM3 HOST TARGET PROTEIN, all of FIG. 1.

VGAM2066 RNA, herein schematically represented by VGAM1 RNA through VGAM3 RNA, binds complementarily to a host target binding site located in an untranslated region of VGAM2066 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2066 host target RNA into VGAM2066 host target protein, herein schematically represented by VGAM1 HOST TARGET PROTEIN through VGAM3 HOST TARGET PROTEIN, all of FIG. 1.

VGAM2067 RNA, herein schematically represented by VGAM1 RNA through VGAM3 RNA, binds complementarily to a host target binding site located in an untranslated region of VGAM2067 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2067 host target RNA into VGAM2067 host target protein, herein schematically represented by VGAM1 HOST TARGET PROTEIN through VGAM3 HOST TARGET PROTEIN, all of FIG. 1.

It is appreciated that a function of VGR3174 gene, herein designated VGR GENE, is inhibition of expression of host target genes, as part of a novel viral mechanism of attacking a host. Accordingly, utilities of VGR3174 gene include diagnosis, prevention and treatment of viral infection by Peanut Bud Necrosis Virus. Specific functions, and accordingly utilities, of VGR3174 gene correlate with, and may be deduced from, the identity of the host target genes, which are inhibited by VGAM RNAs comprised in the 'operon-like' cluster of VGR3174 gene: VGAM2062 host target protein, VGAM2063 host target protein, VGAM2064 host target protein, VGAM2065 host target protein, VGAM2066 host target protein and VGAM2067 host target protein, herein schematically represented by VGAM1 HOST TARGET PROTEIN through VGAM3 HOST TARGET PROTEIN. The function of these host target genes is elaborated hereinabove with reference to VGAM2062, VGAM2063, VGAM2064, VGAM2065, VGAM2066 and VGAM2067. FIG. 9 further provides a conceptual description of novel bioinformatically detected regulatory viral gene, referred to here as Viral Genomic Record 3175(VGR3175) viral gene, which encodes an 'operon-like' cluster of novel viral micro RNA-like genes, each of which in turn modulates expression of at least one host target gene, the function and utility of which at least one host target gene is known in the art.

VGR3175 gene, herein designated VGR GENE, is a novel bioinformatically detected regulatory, non protein coding, RNA viral gene. The method by which VGR3175 gene was detected is described hereinabove with reference to FIGS. 1-9.

VGR3175 gene encodes VGR3175 precursor RNA, herein designated VGR PRECURSOR RNA, an RNA molecule, typically several hundred nucleotides long.

VGR3175 precursor RNA folds spatially, forming VGR3175 folded precursor RNA, herein designated VGR FOLDED PRECURSOR RNA. It is appreciated that VGR3175 folded precursor RNA comprises a plurality of what is known in the art as 'hairpin' structures. These 'hairpin' structures are due to the fact that the nucleotide sequence of VGR3175 precursor RNA comprises a plurality of segments, the first half of each such segment having a nucleotide sequence which is at least a partial inversed-reversed sequence of the second half thereof, as is well known in the art.

VGR3175 folded precursor RNA is naturally processed by cellular enzymatic activity into at least 7 separate VGAM precursor RNAs, VGAM2068 precursor RNA, VGAM2069 precursor RNA, VGAM2070 precursor RNA, VGAM2071 precursor RNA, VGAM2072 precursor RNA, VGAM2073 precursor RNA and VGAM2074 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2068 RNA, VGAM2069 RNA, VGAM2070 RNA, VGAM2071 RNA, VGAM2072 RNA, VGAM2073 RNA and VGAM2074 RNA, herein schematically represented by VGAM1 RNA through VGAM3 RNA, each of which VGAM RNAs corresponding to VGAM RNA of FIG. 1.

VGAM2068 RNA, herein schematically represented by VGAM1 RNA through VGAM3 RNA, binds complementarily to a host target binding site located in an untranslated region of VGAM2068 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2068 host target RNA into VGAM2068 host target protein, herein schematically represented by VGAM1 HOST TARGET PROTEIN through VGAM3 HOST TARGET PROTEIN, all of FIG. 1.

VGAM2069 RNA, herein schematically represented by VGAM1 RNA through VGAM3 RNA, binds complementarily to a host target binding site located in an untranslated region of VGAM2069 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2069 host target RNA into VGAM2069 host target protein, herein schematically represented by VGAM1 HOST TARGET PROTEIN through VGAM3 HOST TARGET PROTEIN, all of FIG. 1.

VGAM2070 RNA, herein schematically represented by VGAM1 RNA through VGAM3 RNA, binds complementarily to a host target binding site located in an untranslated region of VGAM2070 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2070 host target RNA into VGAM2070 host target protein, herein schematically represented by VGAM1 HOST TARGET PROTEIN through VGAM3 HOST TARGET PROTEIN, all of FIG. 1.

VGAM2071 RNA, herein schematically represented by VGAM1 RNA through VGAM3 RNA, binds complementarily to a host target binding site located in an untranslated region of VGAM2071 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2071 host target RNA into VGAM2071 host target protein, herein schematically represented by VGAM1 HOST TARGET PROTEIN through VGAM3 HOST TARGET PROTEIN, all of FIG. 1.

VGAM2072 RNA, herein schematically represented by VGAM1 RNA through VGAM3 RNA, binds complementarily to a host target binding site located in an untranslated region of VGAM2072 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2072 host target RNA into VGAM2072 host target protein, herein schematically represented by VGAM1 HOST TARGET PROTEIN through VGAM3 HOST TARGET PROTEIN, all of FIG. 1.

VGAM2073 RNA, herein schematically represented by VGAM1 RNA through VGAM3 RNA, binds complementarily to a host target binding site located in an untranslated region of VGAM2073 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2073 host target RNA into VGAM2073 host target protein, herein schematically represented by VGAM1 HOST TARGET PROTEIN through VGAM3 HOST TARGET PROTEIN, all of FIG. 1.

VGAM2074 RNA, herein schematically represented by VGAM1 RNA through VGAM3 RNA, binds complementarily to a host target binding site located in an untranslated region of VGAM2074 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2074 host target RNA into VGAM2074 host target protein, herein schematically represented by VGAM1 HOST TARGET PROTEIN through VGAM3 HOST TARGET PROTEIN, all of FIG. 1.

It is appreciated that a function of VGR3175 gene, herein designated VGR GENE, is inhibition of expression of host target genes, as part of a novel viral mechanism of attacking a host. Accordingly, utilities of VGR3175 gene include diagnosis, prevention and treatment of viral infection by Monkeypox Virus. Specific functions, and accordingly utilities, of VGR3175 gene correlate with, and may be deduced from, the identity of the host target genes, which are inhibited by VGAM RNAs comprised in the 'operon-like' cluster of VGR3175 gene: VGAM2068 host target protein, VGAM2069 host target protein, VGAM2070 host target protein, VGAM2071 host target protein, VGAM2072 host target protein, VGAM2073 host target protein and VGAM2074 host target protein, herein schematically represented by VGAM1 HOST TARGET PROTEIN through VGAM3 HOST TARGET PROTEIN. The function of these host target genes is elaborated hereinabove with reference to VGAM2068, VGAM2069, VGAM2070, VGAM2071, VGAM2072, VGAM2073 and VGAM2074. FIG. 9 further provides a conceptual description of novel bioinformatically detected regulatory viral gene, referred to here as Viral Genomic Record 3176(VGR3176) viral gene, which encodes an 'operon-like' cluster of novel viral micro RNA-like genes, each of which in turn modulates expression of at least one host target gene, the function and utility of which at least one host target gene is known in the art.

VGR3176 gene, herein designated VGR GENE, is a novel bioinformatically detected regulatory, non protein coding, RNA viral gene. The method by which VGR3176 gene was detected is described hereinabove with reference to FIGS. 1-9.

VGR3176 gene encodes VGR3176 precursor RNA, herein designated VGR PRECURSOR RNA, an RNA molecule, typically several hundred nucleotides long.

VGR3176 precursor RNA folds spatially, forming VGR3176 folded precursor RNA, herein designated VGR FOLDED PRECURSOR RNA. It is appreciated that VGR3176 folded precursor RNA comprises a plurality of what is known in the art as 'hairpin' structures. These 'hairpin' structures are due to the fact that the nucleotide sequence of VGR3176 precursor RNA comprises a plurality of segments, the first half of each such segment having a nucleotide sequence which is at least a partial inversed-reversed sequence of the second half thereof, as is well known in the art.

VGR3176 folded precursor RNA is naturally processed by cellular enzymatic activity into at least 8 separate VGAM precursor RNAs, VGAM2075 precursor RNA, VGAM2076 precursor RNA, VGAM2077 precursor RNA, VGAM2078 precursor RNA, VGAM2079 precursor RNA, VGAM2080 precursor RNA, VGAM2081 precursor RNA and VGAM2082 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2075 RNA, VGAM2076 RNA, VGAM2077 RNA, VGAM2078 RNA, VGAM2079 RNA, VGAM2080 RNA, VGAM2081 RNA and VGAM2082 RNA, herein schematically represented by VGAM1 RNA through VGAM3 RNA, each of which VGAM RNAs corresponding to VGAM RNA of FIG. 1.

VGAM2075 RNA, herein schematically represented by VGAM1 RNA through VGAM3 RNA, binds complementarily to a host target binding site located in an untranslated region of VGAM2075 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2075 host target RNA into VGAM2075 host target protein, herein schematically represented by VGAM1 HOST TARGET PROTEIN through VGAM3 HOST TARGET PROTEIN, all of FIG. 1.

VGAM2076 RNA, herein schematically represented by VGAM1 RNA through VGAM3 RNA, binds complementarily to a host target binding site located in an untranslated region of VGAM2076 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2076 host target RNA into VGAM2076 host target protein, herein schematically represented by VGAM1 HOST TARGET PROTEIN through VGAM3 HOST TARGET PROTEIN, all of FIG. 1.

VGAM2077 RNA, herein schematically represented by VGAM1 RNA through VGAM3 RNA, binds complementarily to a host target binding site located in an untranslated region of VGAM2077 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2077 host target RNA into VGAM2077 host target protein, herein schematically represented by VGAM1 HOST TARGET PROTEIN through VGAM3 HOST TARGET PROTEIN, all of FIG. 1.

VGAM2078 RNA, herein schematically represented by VGAM1 RNA through VGAM3 RNA, binds complementarily to a host target binding site located in an untranslated region of VGAM2078 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2078 host target RNA into VGAM2078 host target protein, herein schematically represented by VGAM1 HOST TARGET PROTEIN through VGAM3 HOST TARGET PROTEIN, all of FIG. 1.

VGAM2079 RNA, herein schematically represented by VGAM1 RNA through VGAM3 RNA, binds complementarily to a host target binding site located in an untranslated region of VGAM2079 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2079 host target RNA into VGAM2079 host target protein, herein schematically represented by VGAM1 HOST TARGET PROTEIN through VGAM3 HOST TARGET PROTEIN, all of FIG. 1.

VGAM2080 RNA, herein schematically represented by VGAM1 RNA through VGAM3 RNA, binds complementarily to a host target binding site located in an untranslated region of VGAM2080 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2080 host target RNA into VGAM2080 host target protein, herein schematically represented by VGAM1 HOST TARGET PROTEIN through VGAM3 HOST TARGET PROTEIN, all of FIG. 1.

VGAM2081 RNA, herein schematically represented by VGAM1 RNA through VGAM3 RNA, binds complementarily to a host target binding site located in an untranslated region of VGAM2081 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2081 host target RNA into VGAM2081 host target protein, herein schematically represented by VGAM1 HOST TARGET PROTEIN through VGAM3 HOST TARGET PROTEIN, all of FIG. 1.

VGAM2082 RNA, herein schematically represented by VGAM1 RNA through VGAM3 RNA, binds complementarily to a host target binding site located in an untranslated region of VGAM2082 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2082 host target RNA into VGAM2082 host target protein, herein schematically represented by VGAM1 HOST TARGET PROTEIN through VGAM3 HOST TARGET PROTEIN, all of FIG. 1.

It is appreciated that a function of VGR3176 gene, herein designated VGR GENE, is inhibition of expression of host target genes, as part of a novel viral mechanism of attacking a host. Accordingly, utilities of VGR3176 gene include diagnosis, prevention and treatment of viral infection by Variola Virus. Specific functions, and accordingly utilities, of VGR3176 gene correlate with, and may be deduced from, the identity of the host target genes, which are inhibited by VGAM RNAs comprised in the 'operon-like' cluster of VGR3176 gene: VGAM2075 host target protein, VGAM2076 host target protein, VGAM2077 host target protein, VGAM2078 host target protein, VGAM2079 host target protein, VGAM2080 host target protein, VGAM2081 host target protein and VGAM2082 host target protein, herein schematically represented by VGAM1 HOST TARGET PROTEIN through VGAM3 HOST TARGET PROTEIN. The function of these host target genes is elaborated hereinabove with reference to VGAM2075, VGAM2076, VGAM2077, VGAM2078, VGAM2079, VGAM2080, VGAM2081 and VGAM2082. FIG. 9 further provides a conceptual description of novel bioinformatically detected regulatory viral gene, referred to here as Viral Genomic Record 3177(VGR3177) viral gene, which encodes an 'operon-like' cluster of novel viral micro RNA-like genes, each of which in turn modulates expression of at least one host target gene, the function and utility of which at least one host target gene is known in the art.

VGR3177 gene, herein designated VGR GENE, is a novel bioinformatically detected regulatory, non protein coding, RNA viral gene. The method by which VGR3177 gene was detected is described hereinabove with reference to FIGS. 1-9.

VGR3177 gene encodes VGR3177 precursor RNA, herein designated VGR PRECURSOR RNA, an RNA molecule, typically several hundred nucleotides long.

VGR3177 precursor RNA folds spatially, forming VGR3177 folded precursor RNA, herein designated VGR FOLDED PRECURSOR RNA. It is appreciated that VGR3177 folded precursor RNA comprises a plurality of what is known in the art as 'hairpin' structures. These 'hairpin' structures are due to the fact that the nucleotide sequence of VGR3177 precursor RNA comprises a plurality of segments, the first half of each such segment having a nucleotide sequence which is at least a partial inversed-reversed sequence of the second half thereof, as is well known in the art.

VGR3177 folded precursor RNA is naturally processed by cellular enzymatic activity into at least 2 separate VGAM precursor RNAs, VGAM2083 precursor RNA and VGAM2084 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2083 RNA and VGAM2084 RNA, herein schematically represented by VGAM1 RNA through VGAM3 RNA, each of which VGAM RNAs corresponding to VGAM RNA of FIG. 1.

VGAM2083 RNA, herein schematically represented by VGAM1 RNA through VGAM3 RNA, binds complementarily to a host target binding site located in an untranslated region of VGAM2083 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2083 host target RNA into VGAM2083 host target protein, herein schematically represented by VGAM1 HOST TARGET PROTEIN through VGAM3 HOST TARGET PROTEIN, all of FIG. 1.

VGAM2084 RNA, herein schematically represented by VGAM1 RNA through VGAM3 RNA, binds complementarily to a host target binding site located in an untranslated region of VGAM2084 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2084 host target RNA into VGAM2084 host target protein, herein schematically represented by VGAM1 HOST TARGET PROTEIN through VGAM3 HOST TARGET PROTEIN, all of FIG. 1.

It is appreciated that a function of VGR3177 gene, herein designated VGR GENE, is inhibition of expression of host target genes, as part of a novel viral mechanism of attacking a host. Accordingly, utilities of VGR3177 gene include diagnosis, prevention and treatment of viral infection by Camelpox Virus. Specific functions, and accordingly utilities, of VGR3177 gene correlate with, and may be deduced from, the identity of the host target genes, which are inhibited by VGAM RNAs comprised in the 'operon-like' cluster of VGR3177 gene: VGAM2083 host target protein and VGAM2084 host target protein, herein schematically represented by VGAM1 HOST TARGET PROTEIN through VGAM3 HOST TARGET PROTEIN. The function of these host target genes is elaborated hereinabove with reference to VGAM2083 and VGAM2084. FIG. 9 further provides a conceptual description of novel bioinformatically detected regulatory viral gene, referred to here as Viral Genomic Record 3178(VGR3178) viral gene, which encodes an 'operon-like' cluster of novel viral micro RNA-like genes, each of which in turn modulates expression of at least one host target gene, the function and utility of which at least one host target gene is known in the art.

VGR3178 gene, herein designated VGR GENE, is a novel bioinformatically detected regulatory, non protein coding, RNA viral gene. The method by which VGR3178 gene was detected is described hereinabove with reference to FIGS. 1-9.

VGR3178 gene encodes VGR3178 precursor RNA, herein designated VGR PRECURSOR RNA, an RNA molecule, typically several hundred nucleotides long.

VGR3178 precursor RNA folds spatially, forming VGR3178 folded precursor RNA, herein designated VGR FOLDED PRECURSOR RNA. It is appreciated that VGR3178 folded precursor RNA comprises a plurality of what is known in the art as 'hairpin' structures. These 'hairpin' structures are due to the fact that the nucleotide sequence of VGR3178 precursor RNA comprises a plurality of segments, the first half of each such segment having a nucleotide sequence which is at least a partial inversed-reversed sequence of the second half thereof, as is well known in the art.

VGR3178 folded precursor RNA is naturally processed by cellular enzymatic activity into at least 8 separate VGAM precursor RNAs, VGAM2085 precursor RNA, VGAM2086 precursor RNA, VGAM2087 precursor RNA, VGAM2088 precursor RNA, VGAM2089 precursor RNA, VGAM2090 precursor RNA, VGAM2091 precursor RNA and VGAM2092 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2085 RNA, VGAM2086 RNA, VGAM2087 RNA, VGAM2088 RNA, VGAM2089 RNA, VGAM2090 RNA, VGAM2091 RNA and VGAM2092 RNA, herein schematically represented by VGAM1 RNA through VGAM3 RNA, each of which VGAM RNAs corresponding to VGAM RNA of FIG. 1.

VGAM2085 RNA, herein schematically represented by VGAM1 RNA through VGAM3 RNA, binds complementarily to a host target binding site located in an untranslated region of VGAM2085 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2085 host target RNA into VGAM2085 host target protein, herein schematically represented by VGAM1 HOST TARGET PROTEIN through VGAM3 HOST TARGET PROTEIN, all of FIG. 1.

VGAM2086 RNA, herein schematically represented by VGAM1 RNA through VGAM3 RNA, binds complementarily to a host target binding site located in an untranslated region of VGAM2086 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2086 host target RNA into VGAM2086 host target protein, herein schematically represented by VGAM1 HOST TARGET PROTEIN through VGAM3 HOST TARGET PROTEIN, all of FIG. 1.

VGAM2087 RNA, herein schematically represented by VGAM1 RNA through VGAM3 RNA, binds complementarily to a host target binding site located in an untranslated region of VGAM2087 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2087 host target RNA into VGAM2087 host target protein, herein schematically represented by VGAM1 HOST TARGET PROTEIN through VGAM3 HOST TARGET PROTEIN, all of FIG. 1.

VGAM2088 RNA, herein schematically represented by VGAM1 RNA through VGAM3 RNA, binds complementarily to a host target binding site located in an untranslated region of VGAM2088 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2088 host target RNA into VGAM2088 host target protein, herein schematically represented by VGAM1 HOST TARGET PROTEIN through VGAM3 HOST TARGET PROTEIN, all of FIG. 1.

VGAM2089 RNA, herein schematically represented by VGAM1 RNA through VGAM3 RNA, binds complementarily to a host target binding site located in an untranslated region of VGAM2089 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2089 host target RNA into VGAM2089 host target protein, herein schematically represented by VGAM1 HOST TARGET PROTEIN through VGAM3 HOST TARGET PROTEIN, all of FIG. 1.

VGAM2090 RNA, herein schematically represented by VGAM1 RNA through VGAM3 RNA, binds complementarily to a host target binding site located in an untranslated region of VGAM2090 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2090 host target RNA into VGAM2090 host target protein, herein schematically represented by VGAM1 HOST TARGET PROTEIN through VGAM3 HOST TARGET PROTEIN, all of FIG. 1.

VGAM2091 RNA, herein schematically represented by VGAM1 RNA through VGAM3 RNA, binds complementarily to a host target binding site located in an untranslated region of VGAM2091 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2091 host target RNA into VGAM2091 host target protein, herein schematically represented by VGAM1 HOST TARGET PROTEIN through VGAM3 HOST TARGET PROTEIN, all of FIG. 1.

VGAM2092 RNA, herein schematically represented by VGAM1 RNA through VGAM3 RNA, binds complementarily to a host target binding site located in an untranslated region of VGAM2092 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2092 host target RNA into VGAM2092 host target protein, herein schematically represented by VGAM1 HOST TARGET PROTEIN through VGAM3 HOST TARGET PROTEIN, all of FIG. 1.

It is appreciated that a function of VGR3178 gene, herein designated VGR GENE, is inhibition of expression of host target genes, as part of a novel viral mechanism of attacking a host. Accordingly, utilities of VGR3178 gene include diagnosis, prevention and treatment of viral infection by Fowlpox Virus. Specific functions, and accordingly utilities, of VGR3178 gene correlate with, and may be deduced from, the identity of the host target genes, which are inhibited by VGAM RNAs comprised in the 'operon-like' cluster of VGR3178 gene: VGAM2085 host target protein, VGAM2086 host target protein, VGAM2087 host target protein, VGAM2088 host target protein, VGAM2089 host target protein, VGAM2090 host target protein, VGAM2091 host target protein and VGAM2092 host target protein, herein schematically represented by VGAM1 HOST TARGET PROTEIN through VGAM3 HOST TARGET PROTEIN. The function of these host target genes is elaborated hereinabove with reference to VGAM2085, VGAM2086, VGAM2087, VGAM2088, VGAM2089, VGAM2090, VGAM2091 and VGAM2092. FIG. 9 further provides a conceptual description of novel bioinformatically detected regulatory viral gene, referred to here as Viral Genomic Record 3179(VGR3179) viral gene, which encodes an 'operon-like' cluster of novel viral micro RNA-like genes, each of which in turn modulates expression of at least one host target gene, the function and utility of which at least one host target gene is known in the art.

VGR3179 gene, herein designated VGR GENE, is a novel bioinformatically detected regulatory, non protein coding, RNA viral gene. The method by which VGR3179 gene was detected is described hereinabove with reference to FIGS. 1-9.

VGR3179 gene encodes VGR3179 precursor RNA, herein designated VGR PRECURSOR RNA, an RNA molecule, typically several hundred nucleotides long.

VGR3179 precursor RNA folds spatially, forming VGR3179 folded precursor RNA, herein designated VGR FOLDED PRECURSOR RNA. It is appreciated that VGR3179 folded precursor RNA comprises a plurality of what is known in the art as 'hairpin' structures. These 'hairpin' structures are due to the fact that the nucleotide sequence of VGR3179 precursor RNA comprises a plurality of segments, the first half of each such segment having a nucleotide sequence which is at least a partial inversed-reversed sequence of the second half thereof, as is well known in the art.

VGR3179 folded precursor RNA is naturally processed by cellular enzymatic activity into at least 8 separate VGAM precursor RNAs, VGAM2093 precursor RNA, VGAM2094 precursor RNA, VGAM2095 precursor RNA, VGAM2096 precursor RNA, VGAM2097 precursor RNA, VGAM2098 precursor RNA, VGAM2099 precursor RNA and VGAM2100 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2093 RNA, VGAM2094 RNA, VGAM2095 RNA, VGAM2096 RNA, VGAM2097 RNA, VGAM2098 RNA, VGAM2099 RNA and VGAM2100 RNA, herein schematically represented by VGAM1 RNA through VGAM3 RNA, each of which VGAM RNAs corresponding to VGAM RNA of FIG. 1.

VGAM2093 RNA, herein schematically represented by VGAM1 RNA through VGAM3 RNA, binds complementarily to a host target binding site located in an untranslated region of VGAM2093 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2093 host target RNA into VGAM2093 host target protein, herein schematically represented by VGAM1 HOST TARGET PROTEIN through VGAM3 HOST TARGET PROTEIN, all of FIG. 1.

VGAM2094 RNA, herein schematically represented by VGAM1 RNA through VGAM3 RNA, binds complementarily to a host target binding site located in an untranslated region of VGAM2094 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2094 host target RNA into VGAM2094 host target protein, herein schematically represented by VGAM1 HOST TARGET PROTEIN through VGAM3 HOST TARGET PROTEIN, all of FIG. 1.

VGAM2095 RNA, herein schematically represented by VGAM1 RNA through VGAM3 RNA, binds complementarily to a host target binding site located in an untranslated region of VGAM2095 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2095 host target RNA into VGAM2095 host target protein, herein schematically represented by VGAM1 HOST TARGET PROTEIN through VGAM3 HOST TARGET PROTEIN, all of FIG. 1.

VGAM2096 RNA, herein schematically represented by VGAM1 RNA through VGAM3 RNA, binds complementarily to a host target binding site located in an untranslated region of VGAM2096 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2096 host target RNA into VGAM2096 host target protein, herein schematically represented by VGAM1 HOST TARGET PROTEIN through VGAM3 HOST TARGET PROTEIN, all of FIG. 1.

VGAM2097 RNA, herein schematically represented by VGAM1 RNA through VGAM3 RNA, binds complementarily to a host target binding site located in an untranslated region of VGAM2097 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2097 host target RNA into VGAM2097 host target protein, herein schematically represented by VGAM1 HOST TARGET PROTEIN through VGAM3 HOST TARGET PROTEIN, all of FIG. 1.

VGAM2098 RNA, herein schematically represented by VGAM1 RNA through VGAM3 RNA, binds complementarily to a host target binding site located in an untranslated region of VGAM2098 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2098 host target RNA into VGAM2098 host target protein, herein schematically represented by VGAM1 HOST TARGET PROTEIN through VGAM3 HOST TARGET PROTEIN, all of FIG. 1.

VGAM2099 RNA, herein schematically represented by VGAM1 RNA through VGAM3 RNA, binds complementarily to a host target binding site located in an untranslated region of VGAM2099 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2099 host target RNA into VGAM2099 host target protein, herein schematically represented by VGAM1 HOST TARGET PROTEIN through VGAM3 HOST TARGET PROTEIN, all of FIG. 1.

VGAM2100 RNA, herein schematically represented by VGAM1 RNA through VGAM3 RNA, binds complementarily to a host target binding site located in an untranslated region of VGAM2100 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2100 host target RNA into VGAM2100 host target protein, herein schematically represented by VGAM1 HOST TARGET PROTEIN through VGAM3 HOST TARGET PROTEIN, all of FIG. 1.

It is appreciated that a function of VGR3179 gene, herein designated VGR GENE, is inhibition of expression of host target genes, as part of a novel viral mechanism of attacking a host. Accordingly, utilities of VGR3179 gene include diagnosis, prevention and treatment of viral infection by Camelpox Virus. Specific functions, and accordingly utilities, of VGR3179 gene correlate with, and may be deduced from, the identity of the host target genes, which are inhibited by VGAM RNAs comprised in the 'operon-like' cluster of VGR3179 gene: VGAM2093 host target protein, VGAM2094 host target protein, VGAM2095 host target protein, VGAM2096 host target protein, VGAM2097 host target protein, VGAM2098 host target protein, VGAM2099 host target protein and VGAM2100 host target protein, herein schematically represented by VGAM1 HOST TARGET PROTEIN through VGAM3 HOST TARGET PROTEIN. The function of these host target genes is elaborated hereinabove with reference to VGAM2093, VGAM2094, VGAM2095, VGAM2096, VGAM2097, VGAM2098, VGAM2099 and VGAM2100. FIG. 9 further provides a conceptual description of novel bioinformatically detected regulatory viral gene, referred to here as Viral Genomic Record 3180(VGR3180) viral gene, which encodes an 'operon-like' cluster of novel viral micro RNA-like genes, each of which in turn modulates expression of at least one host target gene, the function and utility of which at least one host target gene is known in the art.

VGR3180 gene, herein designated VGR GENE, is a novel bioinformatically detected regulatory, non protein coding, RNA viral gene. The method by which VGR3180 gene was detected is described hereinabove with reference to FIGS. 1-9.

VGR3180 gene encodes VGR3180 precursor RNA, herein designated VGR PRECURSOR RNA, an RNA molecule, typically several hundred nucleotides long.

VGR3180 precursor RNA folds spatially, forming VGR3180 folded precursor RNA, herein designated VGR FOLDED PRECURSOR RNA. It is appreciated that VGR3180 folded precursor RNA comprises a plurality of what is known in the art as 'hairpin' structures. These 'hairpin' structures are due to the fact that the nucleotide sequence of VGR3180 precursor RNA comprises a plurality of segments, the first half of each such segment having a nucleotide sequence which is at least a partial inversed-reversed sequence of the second half thereof, as is well known in the art.

VGR3180 folded precursor RNA is naturally processed by cellular enzymatic activity into at least 4 separate VGAM precursor RNAs, VGAM2101 precursor RNA, VGAM2102 precursor RNA, VGAM2103 precursor RNA and VGAM2104 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2101 RNA, VGAM2102 RNA, VGAM2103 RNA and VGAM2104 RNA, herein schematically represented by VGAM1 RNA through VGAM3 RNA, each of which VGAM RNAs corresponding to VGAM RNA of FIG. 1.

VGAM2101 RNA, herein schematically represented by VGAM1 RNA through VGAM3 RNA, binds complementarily to a host target binding site located in an untranslated region of VGAM2101 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2101 host target RNA into VGAM2101 host target protein, herein schematically represented by VGAM1 HOST TARGET PROTEIN through VGAM3 HOST TARGET PROTEIN, all of FIG. 1.

VGAM2102 RNA, herein schematically represented by VGAM1 RNA through VGAM3 RNA, binds complementarily to a host target binding site located in an untranslated region of VGAM2102 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2102 host target RNA into VGAM2102 host target protein, herein schematically represented by VGAM1 HOST TARGET PROTEIN through VGAM3 HOST TARGET PROTEIN, all of FIG. 1.

VGAM2103 RNA, herein schematically represented by VGAM1 RNA through VGAM3 RNA, binds complementarily to a host target binding site located in an untranslated region of VGAM2103 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2103 host target RNA into VGAM2103 host target protein, herein schematically represented by VGAM1 HOST TARGET PROTEIN through VGAM3 HOST TARGET PROTEIN, all of FIG. 1.

VGAM2104 RNA, herein schematically represented by VGAM1 RNA through VGAM3 RNA, binds complementarily to a host target binding site located in an untranslated region of VGAM2104 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2104 host target RNA into VGAM2104 host target protein, herein schematically represented by VGAM1 HOST TARGET PROTEIN through VGAM3 HOST TARGET PROTEIN, all of FIG. 1.

It is appreciated that a function of VGR3180 gene, herein designated VGR GENE, is inhibition of expression of host target genes, as part of a novel viral mechanism of attacking a host. Accordingly, utilities of VGR3180 gene include diagnosis, prevention and treatment of viral infection by Camelpox Virus. Specific functions, and accordingly utilities, of VGR3180 gene correlate with, and may be deduced from, the identity of the host target genes, which are inhibited by VGAM RNAs comprised in the 'operon-like' cluster of VGR3180 gene: VGAM2101 host target protein, VGAM2102 host target protein, VGAM2103 host target protein and VGAM2104 host target protein, herein schematically represented by VGAM1 HOST TARGET PROTEIN through VGAM3 HOST TARGET PROTEIN. The function of these host target genes is elaborated hereinabove with reference to VGAM2101, VGAM2102, VGAM2103 and VGAM2104. FIG. 9 further provides a conceptual description of novel bioinformatically detected regulatory viral gene, referred to here as Viral Genomic Record 3181(VGR3181) viral gene, which encodes an 'operon-like' cluster of novel viral micro RNA-like genes, each of which in turn modulates expression of at least one host target gene, the function and utility of which at least one host target gene is known in the art.

VGR3181 gene, herein designated VGR GENE, is a novel bioinformatically detected regulatory, non protein coding, RNA viral gene. The method by which VGR3181 gene was detected is described hereinabove with reference to FIGS. 1-9.

VGR3181 gene encodes VGR3181 precursor RNA, herein designated VGR PRECURSOR RNA, an RNA molecule, typically several hundred nucleotides long.

VGR3181 precursor RNA folds spatially, forming VGR3181 folded precursor RNA, herein designated VGR FOLDED PRECURSOR RNA. It is appreciated that VGR3181 folded precursor RNA comprises a plurality of what is known in the art as 'hairpin' structures. These 'hairpin' structures are due to the fact that the nucleotide sequence of VGR3181 precursor RNA comprises a plurality of segments, the first half of each such segment having a nucleotide sequence which is at least a partial inversed-reversed sequence of the second half thereof, as is well known in the art.

VGR3181 folded precursor RNA is naturally processed by cellular enzymatic activity into at least 7 separate VGAM precursor RNAs, VGAM2105 precursor RNA, VGAM2106 precursor RNA, VGAM2107 precursor RNA, VGAM2108 precursor RNA, VGAM2109 precursor RNA, VGAM2110 precursor RNA and VGAM2111 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2105 RNA, VGAM2106 RNA, VGAM2107 RNA, VGAM2108 RNA, VGAM2109 RNA, VGAM2110 RNA and VGAM2111 RNA, herein schematically represented by VGAM1 RNA through VGAM3 RNA, each of which VGAM RNAs corresponding to VGAM RNA of FIG. 1.

VGAM2105 RNA, herein schematically represented by VGAM1 RNA through VGAM3 RNA, binds complementarily to a host target binding site located in an untranslated region of VGAM2105 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2105 host target RNA into VGAM2105 host target protein, herein schematically represented by VGAM1 HOST TARGET PROTEIN through VGAM3 HOST TARGET PROTEIN, all of FIG. 1.

VGAM2106 RNA, herein schematically represented by VGAM1 RNA through VGAM3 RNA, binds complementarily to a host target binding site located in an untranslated region of VGAM2106 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2106 host target RNA into VGAM2106 host target protein, herein schematically represented by VGAM1 HOST TARGET PROTEIN through VGAM3 HOST TARGET PROTEIN, all of FIG. 1.

VGAM2107 RNA, herein schematically represented by VGAM1 RNA through VGAM3 RNA, binds complementarily to a host target binding site located in an untranslated region of VGAM2107 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2107 host target RNA into VGAM2107 host target protein, herein schematically represented by VGAM1 HOST TARGET PROTEIN through VGAM3 HOST TARGET PROTEIN, all of FIG. 1.

VGAM2108 RNA, herein schematically represented by VGAM1 RNA through VGAM3 RNA, binds complementarily to a host target binding site located in an untranslated region of VGAM2108 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2108 host target RNA into VGAM2108 host target protein, herein schematically represented by VGAM1 HOST TARGET PROTEIN through VGAM3 HOST TARGET PROTEIN, all of FIG. 1.

VGAM2109 RNA, herein schematically represented by VGAM1 RNA through VGAM3 RNA, binds complementarily to a host target binding site located in an untranslated region of VGAM2109 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2109 host target RNA into VGAM2109 host target protein, herein schematically represented by VGAM1 HOST TARGET PROTEIN through VGAM3 HOST TARGET PROTEIN, all of FIG. 1.

VGAM2110 RNA, herein schematically represented by VGAM1 RNA through VGAM3 RNA, binds complementarily to a host target binding site located in an untranslated region of VGAM2110 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2110 host target RNA into VGAM2110 host target protein, herein schematically represented by VGAM1 HOST TARGET PROTEIN through VGAM3 HOST TARGET PROTEIN, all of FIG. 1.

VGAM2111 RNA, herein schematically represented by VGAM1 RNA through VGAM3 RNA, binds complementarily to a host target binding site located in an untranslated region of VGAM2111 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2111 host target RNA into VGAM2111 host target protein, herein schematically represented by VGAM1 HOST TARGET PROTEIN through VGAM3 HOST TARGET PROTEIN, all of FIG. 1.

It is appreciated that a function of VGR3181 gene, herein designated VGR GENE, is inhibition of expression of host target genes, as part of a novel viral mechanism of attacking a host. Accordingly, utilities of VGR3181 gene include diagnosis, prevention and treatment of viral infection by Grapevine Chrome Mosaic Virus. Specific functions, and accordingly utilities, of VGR3181 gene correlate with, and may be deduced from, the identity of the host target genes, which are inhibited by VGAM RNAs comprised in the 'operon-like' cluster of VGR3181 gene: VGAM2105 host target protein, VGAM2106 host target protein, VGAM2107 host target protein, VGAM2108 host target protein, VGAM2109 host target protein, VGAM2110 host target protein and VGAM2111 host target protein, herein schematically represented by VGAM1 HOST TARGET PROTEIN through VGAM3 HOST TARGET PROTEIN. The function of these host target genes is elaborated hereinabove with reference to VGAM2105, VGAM2106, VGAM2107, VGAM2108, VGAM2109, VGAM2110 and VGAM2111. FIG. 9 further provides a conceptual description of novel bioinformatically detected regulatory viral gene, referred to here as Viral Genomic Record 3182(VGR3182) viral gene, which encodes an 'operon-like' cluster of novel viral micro RNA-like genes, each of which in turn modulates expression of at least one host target gene, the function and utility of which at least one host target gene is known in the art.

VGR3182 gene, herein designated VGR GENE, is a novel bioinformatically detected regulatory, non protein coding, RNA viral gene. The method by which VGR3182 gene was detected is described hereinabove with reference to FIGS. 1-9.

VGR3182 gene encodes VGR3182 precursor RNA, herein designated VGR PRECURSOR RNA, an RNA molecule, typically several hundred nucleotides long.

VGR3182 precursor RNA folds spatially, forming VGR3182 folded precursor RNA, herein designated VGR FOLDED PRECURSOR RNA. It is appreciated that VGR3182 folded precursor RNA comprises a plurality of what is known in the art as 'hairpin' structures. These 'hairpin' structures are due to the fact that the nucleotide sequence of VGR3182 precursor RNA comprises a plurality of segments, the first half of each such segment having a nucleotide sequence which is at least a partial inversed-reversed sequence of the second half thereof, as is well known in the art.

VGR3182 folded precursor RNA is naturally processed by cellular enzymatic activity into at least 2 separate VGAM precursor RNAs, VGAM2112 precursor RNA and VGAM2113 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2112 RNA and VGAM2113 RNA, herein schematically represented by VGAM1 RNA through VGAM3 RNA, each of which VGAM RNAs corresponding to VGAM RNA of FIG. 1.

VGAM2112 RNA, herein schematically represented by VGAM1 RNA through VGAM3 RNA, binds complementarily to a host target binding site located in an untranslated region of VGAM2112 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2112 host target RNA into VGAM2112 host target protein, herein schematically represented by VGAM1 HOST TARGET PROTEIN through VGAM3 HOST TARGET PROTEIN, all of FIG. 1.

VGAM2113 RNA, herein schematically represented by VGAM1 RNA through VGAM3 RNA, binds complementarily to a host target binding site located in an untranslated region of VGAM2113 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2113 host target RNA into VGAM2113 host target protein, herein schematically represented by VGAM1 HOST TARGET PROTEIN through VGAM3 HOST TARGET PROTEIN, all of FIG. 1.

It is appreciated that a function of VGR3182 gene, herein designated VGR GENE, is inhibition of expression of host target genes, as part of a novel viral mechanism of attacking a host. Accordingly, utilities of VGR3182 gene include diagnosis, prevention and treatment of viral infection by Grapevine Chrome Mosaic Virus. Specific functions, and accordingly utilities, of VGR3182 gene correlate with, and may be deduced from, the identity of the host target genes, which are inhibited by VGAM RNAs comprised in the 'operon-like' cluster of VGR3182 gene: VGAM2112 host target protein and VGAM2113 host target protein, herein schematically represented by VGAM1 HOST TARGET PROTEIN through VGAM3 HOST TARGET PROTEIN. The function of these host target genes is elaborated hereinabove with reference to VGAM2112 and VGAM2113. FIG. 9 further provides a conceptual description of novel bioinformatically detected regulatory viral gene, referred to here as Viral Genomic Record 3183(VGR3183) viral gene, which encodes an 'operon-like' cluster of novel viral micro RNA-like genes, each of which in turn modulates expression of at least one host target gene, the function and utility of which at least one host target gene is known in the art.

VGR3183 gene, herein designated VGR GENE, is a novel bioinformatically detected regulatory, non protein coding, RNA viral gene. The method by which VGR3183 gene was detected is described hereinabove with reference to FIGS. 1-9.

VGR3183 gene encodes VGR3183 precursor RNA, herein designated VGR PRECURSOR RNA, an RNA molecule, typically several hundred nucleotides long.

VGR3183 precursor RNA folds spatially, forming VGR3183 folded precursor RNA, herein designated VGR FOLDED PRECURSOR RNA. It is appreciated that VGR3183 folded precursor RNA comprises a plurality of what is known in the art as 'hairpin' structures. These 'hairpin' structures are due to the fact that the nucleotide sequence of VGR3183 precursor RNA comprises a plurality of segments, the first half of each such segment having a nucleotide sequence which is at least a partial inversed-reversed sequence of the second half thereof, as is well known in the art.

VGR3183 folded precursor RNA is naturally processed by cellular enzymatic activity into at least 8 separate VGAM precursor RNAs, VGAM2114 precursor RNA, VGAM2115 precursor RNA, VGAM2116 precursor RNA, VGAM2117 precursor RNA, VGAM2118 precursor RNA, VGAM2119 precursor RNA, VGAM2120 precursor RNA and VGAM2121 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2114 RNA, VGAM2115 RNA, VGAM2116 RNA, VGAM2117 RNA, VGAM2118 RNA, VGAM2119 RNA, VGAM2120 RNA and VGAM2121 RNA, herein schematically represented by VGAM1 RNA through VGAM3 RNA, each of which VGAM RNAs corresponding to VGAM RNA of FIG. 1.

VGAM2114 RNA, herein schematically represented by VGAM1 RNA through VGAM3 RNA, binds complementarily to a host target binding site located in an untranslated region of VGAM2114 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2114 host target RNA into VGAM2114 host target protein, herein schematically represented by VGAM1 HOST TARGET PROTEIN through VGAM3 HOST TARGET PROTEIN, all of FIG. 1.

VGAM2115 RNA, herein schematically represented by VGAM1 RNA through VGAM3 RNA, binds complementarily to a host target binding site located in an untranslated region of VGAM2115 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2115 host target RNA into VGAM2115 host target protein, herein schematically represented by VGAM1 HOST TARGET PROTEIN through VGAM3 HOST TARGET PROTEIN, all of FIG. 1.

VGAM2116 RNA, herein schematically represented by VGAM1 RNA through VGAM3 RNA, binds complementarily to a host target binding site located in an untranslated region of VGAM2116 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2116 host target RNA into VGAM2116 host target protein, herein schematically represented by VGAM1 HOST TARGET PROTEIN through VGAM3 HOST TARGET PROTEIN, all of FIG. 1.

VGAM2117 RNA, herein schematically represented by VGAM1 RNA through VGAM3 RNA, binds complementarily to a host target binding site located in an untranslated region of VGAM2117 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2117 host target RNA into VGAM2117 host target protein, herein schematically represented by VGAM1 HOST TARGET PROTEIN through VGAM3 HOST TARGET PROTEIN, all of FIG. 1.

VGAM2118 RNA, herein schematically represented by VGAM1 RNA through VGAM3 RNA, binds complementarily to a host target binding site located in an untranslated region of VGAM2118 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2118 host target RNA into VGAM2118 host target protein, herein schematically represented by VGAM1 HOST TARGET PROTEIN through VGAM3 HOST TARGET PROTEIN, all of FIG. 1.

VGAM2119 RNA, herein schematically represented by VGAM1 RNA through VGAM3 RNA, binds complementarily to a host target binding site located in an untranslated region of VGAM2119 host target RNA, herein represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2119 host target RNA into VGAM2119 host target protein, herein schematically represented by VGAM1 HOST TARGET PROTEIN through VGAM3 HOST TARGET PROTEIN, all of FIG. 1.

VGAM2120 RNA, herein schematically represented by VGAM1 RNA through VGAM3 RNA, binds complementarily to a host target binding site located in an untranslated region of VGAM2120 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2120 host target RNA into VGAM2120 host target protein, herein schematically represented by VGAM1 HOST TARGET PROTEIN through VGAM3 HOST TARGET PROTEIN, all of FIG. 1.

VGAM2121 RNA, herein schematically represented by VGAM1 RNA through VGAM3 RNA, binds complementarily to a host target binding site located in an untranslated region of VGAM2121 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2121 host target RNA into VGAM2121 host target protein, herein schematically represented by VGAM1 HOST TARGET PROTEIN through VGAM3 HOST TARGET PROTEIN, all of FIG. 1.

It is appreciated that a function of VGR3183 gene, herein designated VGR GENE, is inhibition of expression of host target genes, as part of a novel viral mechanism of attacking a host. Accordingly, utilities of VGR3183 gene include diagnosis, prevention and treatment of viral infection by Cowpox Virus. Specific functions, and accordingly utilities, of VGR3183 gene correlate with, and may be deduced from, the identity of the host target genes, which are inhibited by VGAM RNAs comprised in the 'operon-like' cluster of VGR3183 gene: VGAM2114 host target protein, VGAM2115 host target protein, VGAM2116 host target protein, VGAM2117 host target protein, VGAM2118 host target protein, VGAM2119 host target protein, VGAM2120 host target protein and VGAM2121 host target protein, herein schematically represented by VGAM1 HOST TARGET PROTEIN through VGAM3 HOST TARGET PROTEIN. The function of these host target genes is elaborated hereinabove with reference to VGAM2114, VGAM2115, VGAM2116, VGAM2117, VGAM2118, VGAM2119, VGAM2120 and VGAM2121. FIG. 9 further provides a conceptual description of novel bioinformatically detected regulatory viral gene, referred to here as Viral Genomic Record 3184(VGR3184) viral gene, which encodes an 'operon-like' cluster of novel viral micro RNA-like genes, each of which in turn modulates expression of at least one host target gene, the function and utility of which at least one host target gene is known in the art.

VGR3184 gene, herein designated VGR GENE, is a novel bioinformatically detected regulatory, non protein coding, RNA viral gene. The method by which VGR3184 gene was detected is described hereinabove with reference to FIGS. 1-9.

VGR3184 gene encodes VGR3184 precursor RNA, herein designated VGR PRECURSOR RNA, an RNA molecule, typically several hundred nucleotides long.

VGR3184 precursor RNA folds spatially, forming VGR3184 folded precursor RNA, herein designated VGR FOLDED PRECURSOR RNA. It is appreciated that VGR3184 folded precursor RNA comprises a plurality of what is known in the art as 'hairpin' structures. These 'hairpin' structures are due to the fact that the nucleotide sequence of VGR3184 precursor RNA comprises a plurality of segments, the first half of each such segment having a nucleotide sequence which is at least a partial inversed-reversed sequence of the second half thereof, as is well known in the art.

VGR3184 folded precursor RNA is naturally processed by cellular enzymatic activity into at least 3 separate VGAM precursor RNAs, VGAM2122 precursor RNA, VGAM2123 precursor RNA and VGAM2124 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2122 RNA, VGAM2123 RNA and VGAM2124 RNA, herein schematically represented by VGAM1 RNA through VGAM3 RNA, each of which VGAM RNAs corresponding to VGAM RNA of FIG. 1.

VGAM2122 RNA, herein schematically represented by VGAM1 RNA through VGAM3 RNA, binds complementarily to a host target binding site located in an untranslated region of VGAM2122 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2122 host target RNA into VGAM2122 host target protein, herein schematically represented by VGAM1 HOST TARGET PROTEIN through VGAM3 HOST TARGET PROTEIN, all of FIG. 1.

VGAM2123 RNA, herein schematically represented by VGAM1 RNA through VGAM3 RNA, binds complementarily to a host target binding site located in an untranslated region of VGAM2123 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2123 host target RNA into VGAM2123 host target protein, herein schematically represented by VGAM1 HOST TARGET PROTEIN through VGAM3 HOST TARGET PROTEIN, all of FIG. 1.

VGAM2124 RNA, herein schematically represented by VGAM1 RNA through VGAM3 RNA, binds complementarily to a host target binding site located in an untranslated region of VGAM2124 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2124 host target RNA into VGAM2124 host target protein, herein schematically represented by VGAM1 HOST TARGET PROTEIN through VGAM3 HOST TARGET PROTEIN, all of FIG. 1.

It is appreciated that a function of VGR3184 gene, herein designated VGR GENE, is inhibition of expression of host target genes, as part of a novel viral mechanism of attacking a host. Accordingly, utilities of VGR3184 gene include diagnosis, prevention and treatment of viral infection by Cowpox Virus. Specific functions, and accordingly utilities, of VGR3184 gene correlate with, and may be deduced from, the identity of the host target genes, which are inhibited by VGAM RNAs comprised in the 'operon-like' cluster of VGR3184 gene: VGAM2122 host target protein, VGAM2123 host target protein and VGAM2124 host target protein, herein schematically represented by VGAM1 HOST TARGET PROTEIN through VGAM3 HOST TARGET PROTEIN. The function of these host target genes is elaborated hereinabove with reference to VGAM2122, VGAM2123 and VGAM2124. FIG. 9 further provides a conceptual description of novel bioinformatically detected regulatory viral gene, referred to here as Viral Genomic Record 3185(VGR3185) viral gene, which encodes an 'operon-like' cluster of novel viral micro RNA-like genes, each of which in turn modulates expression of at least one host target gene, the function and utility of which at least one host target gene is known in the art.

VGR3185 gene, herein designated VGR GENE, is a novel bioinformatically detected regulatory, non protein coding, RNA viral gene. The method by which VGR3185 gene was detected is described hereinabove with reference to FIGS. 1-9.

VGR3185 gene encodes VGR3185 precursor RNA, herein designated VGR PRECURSOR RNA, an RNA molecule, typically several hundred nucleotides long.

VGR3185 precursor RNA folds spatially, forming VGR3185 folded precursor RNA, herein designated VGR FOLDED PRECURSOR RNA. It is appreciated that VGR3185 folded precursor RNA comprises a plurality of what is known in the art as 'hairpin' structures. These 'hairpin' structures are due to the fact that the nucleotide sequence of VGR3185 precursor RNA comprises a plurality of segments, the first half of each such segment having a nucleotide sequence which is at least a partial inversed-reversed sequence of the second half thereof, as is well known in the art.

VGR3185 folded precursor RNA is naturally processed by cellular enzymatic activity into at least 8 separate VGAM precursor RNAs, VGAM2125 precursor RNA, VGAM2126 precursor RNA, VGAM2127 precursor RNA, VGAM2128 precursor RNA, VGAM2129 precursor RNA, VGAM2130 precursor RNA, VGAM2131 precursor RNA and VGAM2132 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2125 RNA, VGAM2126 RNA, VGAM2127 RNA, VGAM2128 RNA, VGAM2129 RNA, VGAM2130 RNA, VGAM2131 RNA and VGAM2132 RNA, herein schematically represented by VGAM1 RNA through VGAM3 RNA, each of which VGAM RNAs corresponding to VGAM RNA of FIG. 1.

VGAM2125 RNA, herein schematically represented by VGAM1 RNA through VGAM3 RNA, binds complementarily to a host target binding site located in an untranslated region of VGAM2125 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2125 host target RNA into VGAM2125 host target protein, herein schematically represented by VGAM1 HOST TARGET PROTEIN through VGAM3 HOST TARGET PROTEIN, all of FIG. 1.

VGAM2126 RNA, herein schematically represented by VGAM1 RNA through VGAM3 RNA, binds complementarily to a host target binding site located in an untranslated region of VGAM2126 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2126 host target RNA into VGAM2126 host target protein, herein schematically represented by VGAM1 HOST TARGET PROTEIN through VGAM3 HOST TARGET PROTEIN, all of FIG. 1.

VGAM2127 RNA, herein schematically represented by VGAM1 RNA through VGAM3 RNA, binds complementarily to a host target binding site located in an untranslated region of VGAM2127 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2127 host target RNA into VGAM2127 host target protein, herein schematically represented by VGAM1 HOST TARGET PROTEIN through VGAM3 HOST TARGET PROTEIN, all of FIG. 1.

VGAM2128 RNA, herein schematically represented by VGAM1 RNA through VGAM3 RNA, binds complementarily to a host target binding site located in an untranslated region of VGAM2128 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2128 host target RNA into VGAM2128 host target protein, herein schematically represented by VGAM1 HOST TARGET PROTEIN through VGAM3 HOST TARGET PROTEIN, all of FIG. 1.

VGAM2129 RNA, herein schematically represented by VGAM1 RNA through VGAM3 RNA, binds complementarily to a host target binding site located in an untranslated region of VGAM2129 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2129 host target RNA into VGAM2129 host target protein, herein schematically represented by VGAM1 HOST TARGET PROTEIN through VGAM3 HOST TARGET PROTEIN, all of FIG. 1.

VGAM2130 RNA, herein schematically represented by VGAM1 RNA through VGAM3 RNA, binds complementarily to a host target binding site located in an untranslated region of VGAM2130 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2130 host target RNA into VGAM2130 host target protein, herein schematically represented by VGAM1 HOST TARGET PROTEIN through VGAM3 HOST TARGET PROTEIN, all of FIG. 1.

VGAM2131 RNA, herein schematically represented by VGAM1 RNA through VGAM3 RNA, binds complementarily to a host target binding site located in an untranslated region of VGAM2131 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2131 host target RNA into VGAM2131 host target protein, herein schematically represented by VGAM1 HOST TARGET PROTEIN through VGAM3 HOST TARGET PROTEIN, all of FIG. 1.

VGAM2132 RNA, herein schematically represented by VGAM1 RNA through VGAM3 RNA, binds complementarily to a host target binding site located in an untranslated region of VGAM2132 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2132 host target RNA into VGAM2132 host target protein, herein schematically represented by VGAM1 HOST TARGET PROTEIN through VGAM3 HOST TARGET PROTEIN, all of FIG. 1.

It is appreciated that a function of VGR3185 gene, herein designated VGR GENE, is inhibition of expression of host target genes, as part of a novel viral mechanism of attacking a host. Accordingly, utilities of VGR3185 gene include diagnosis, prevention and treatment of viral infection by Ateline Herpesvirus 3. Specific functions, and accordingly utilities, of VGR3185 gene correlate with, and may be deduced from, the identity of the host target genes, which are inhibited by VGAM RNAs comprised in the 'operon-like' cluster of VGR3185 gene: VGAM2125 host target protein, VGAM2126 host target protein, VGAM2127 host target protein, VGAM2128 host target protein, VGAM2129 host target protein, VGAM2130 host target protein, VGAM2131 host target protein and VGAM2132 host target protein, herein schematically represented by VGAM1 HOST TARGET PROTEIN through VGAM3 HOST TARGET PROTEIN. The function of these host target genes is elaborated hereinabove with reference to VGAM2125, VGAM2126, VGAM2127, VGAM2128, VGAM2129, VGAM2130, VGAM2131 and VGAM2132. FIG. 9 further provides a conceptual description of novel bioinformatically detected regulatory viral gene, referred to here as Viral Genomic Record 3186(VGR3186) viral gene, which encodes an 'operon-like' cluster of novel viral micro RNA-like genes, each of which in turn modulates expression of at least one host target gene, the function and utility of which at least one host target gene is known in the art.

VGR3186 gene, herein designated VGR GENE, is a novel bioinformatically detected regulatory, non protein coding, RNA viral gene. The method by which VGR3186 gene was detected is described hereinabove with reference to FIGS. 1-9.

VGR3186 gene encodes VGR3186 precursor RNA, herein designated VGR PRECURSOR RNA, an RNA molecule, typically several hundred nucleotides long.

VGR3186 precursor RNA folds spatially, forming VGR3186 folded precursor RNA, herein designated VGR FOLDED PRECURSOR RNA. It is appreciated that VGR3186 folded precursor RNA comprises a plurality of what is known in the art as 'hairpin' structures. These 'hairpin' structures are due to the fact that the nucleotide sequence of VGR3186 precursor RNA comprises a plurality of segments, the first half of each such segment having a nucleotide sequence which is at least a partial inversed-reversed sequence of the second half thereof, as is well known in the art.

VGR3186 folded precursor RNA is naturally processed by cellular enzymatic activity into at least 3 separate VGAM precursor RNAs, VGAM2133 precursor RNA, VGAM2134 precursor RNA and VGAM2135 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2133 RNA, VGAM2134 RNA and VGAM2135 RNA, herein schematically represented by VGAM1 RNA through VGAM3 RNA, each of which VGAM RNAs corresponding to VGAM RNA of FIG. 1.

VGAM2133 RNA, herein schematically represented by VGAM1 RNA through VGAM3 RNA, binds complementarily to a host target binding site located in an untranslated region of VGAM2133 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2133 host target RNA into VGAM2133 host target protein, herein schematically represented by VGAM1 HOST TARGET PROTEIN through VGAM3 HOST TARGET PROTEIN, all of FIG. 1.

VGAM2134 RNA, herein schematically represented by VGAM1 RNA through VGAM3 RNA, binds complementarily to a host target binding site located in an untranslated region of VGAM2134 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2134 host target RNA into VGAM2134 host target protein, herein schematically represented by VGAM1 HOST TARGET PROTEIN through VGAM3 HOST TARGET PROTEIN, all of FIG. 1.

VGAM2135 RNA, herein schematically represented by VGAM1 RNA through VGAM3 RNA, binds complementarily to a host target binding site located in an untranslated region of VGAM2135 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2135 host target RNA into VGAM2135 host target protein, herein schematically represented by VGAM1 HOST TARGET PROTEIN through VGAM3 HOST TARGET PROTEIN, all of FIG. 1.

It is appreciated that a function of VGR3186 gene, herein designated VGR GENE, is inhibition of expression of host target genes, as part of a novel viral mechanism of attacking a host. Accordingly, utilities of VGR3186 gene include diagnosis, prevention and treatment of viral infection by Ateline Herpesvirus 3. Specific functions, and accordingly utilities, of VGR3186 gene correlate with, and may be deduced from, the identity of the host target genes, which are inhibited by VGAM RNAs comprised in the 'operon-like' cluster of VGR3186 gene: VGAM2133 host target protein, VGAM2134 host target protein and VGAM2135 host target protein, herein schematically represented by VGAM1 HOST TARGET PROTEIN through VGAM3 HOST TARGET PROTEIN. The function of these host target genes is elaborated hereinabove with reference to VGAM2133, VGAM2134 and VGAM2135. FIG. 9 further provides a conceptual description of novel bioinformatically detected regulatory viral gene, referred to here as Viral Genomic Record 3187(VGR3187) viral gene, which encodes an 'operon-like' cluster of novel viral micro RNA-like genes, each of which in turn modulates expression of at least one host target gene, the function and utility of which at least one host target gene is known in the art.

VGR3187 gene, herein designated VGR GENE, is a novel bioinformatically detected regulatory, non protein coding, RNA viral gene. The method by which VGR3187 gene was detected is described hereinabove with reference to FIGS. 1-9.

VGR3187 gene encodes VGR3187 precursor RNA, herein designated VGR PRECURSOR RNA, an RNA molecule, typically several hundred nucleotides long.

VGR3187 precursor RNA folds spatially, forming VGR3187 folded precursor RNA, herein designated VGR FOLDED PRECURSOR RNA. It is appreciated that VGR3187 folded precursor RNA comprises a plurality of what is known in the art as 'hairpin' structures. These 'hairpin' structures are due to the fact that the nucleotide sequence of VGR3187 precursor RNA comprises a plurality of segments, the first half of each such segment having a nucleotide sequence which is at least a partial inversed-reversed sequence of the second half thereof, as is well known in the art.

VGR3187 folded precursor RNA is naturally processed by cellular enzymatic activity into at least 8 separate VGAM precursor RNAs, VGAM2136 precursor RNA, VGAM2137 precursor RNA, VGAM2138 precursor RNA, VGAM2139 precursor RNA, VGAM2140 precursor RNA, VGAM2141 precursor RNA, VGAM2142 precursor RNA and VGAM2143 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2136 RNA, VGAM2137 RNA, VGAM2138 RNA, VGAM2139 RNA, VGAM2140 RNA, VGAM2141 RNA, VGAM2142 RNA and VGAM2143 RNA, herein schematically represented by VGAM1 RNA through VGAM3 RNA, each of which VGAM RNAs corresponding to VGAM RNA of FIG. 1.

VGAM2136 RNA, herein schematically represented by VGAM1 RNA through VGAM3 RNA, binds complementarily to a host target binding site located in an untranslated region of VGAM2136 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2136 host target RNA into VGAM2136 host target protein, herein schematically represented by VGAM1 HOST TARGET PROTEIN through VGAM3 HOST TARGET PROTEIN, all of FIG. 1.

VGAM2137 RNA, herein schematically represented by VGAM1 RNA through VGAM3 RNA, binds complementarily to a host target binding site located in an untranslated region of VGAM2137 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2137 host target RNA into VGAM2137 host target protein, herein schematically represented by VGAM1 HOST TARGET PROTEIN through VGAM3 HOST TARGET PROTEIN, all of FIG. 1.

VGAM2138 RNA, herein schematically represented by VGAM1 RNA through VGAM3 RNA, binds complementarily to a host target binding site located in an untranslated region of VGAM2138 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2138 host target RNA into VGAM2138 host target protein, herein schematically represented by VGAM1 HOST TARGET PROTEIN through VGAM3 HOST TARGET PROTEIN, all of FIG. 1.

VGAM2139 RNA, herein schematically represented by VGAM1 RNA through VGAM3 RNA, binds complementarily to a host target binding site located in an untranslated region of VGAM2139 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2139 host target RNA into VGAM2139 host target protein, herein schematically represented by VGAM1 HOST TARGET PROTEIN through VGAM3 HOST TARGET PROTEIN, all of FIG. 1.

VGAM2140 RNA, herein schematically represented by VGAM1 RNA through VGAM3 RNA, binds complementarily to a host target binding site located in an untranslated region of VGAM2140 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2140 host target RNA into VGAM2140 host target protein, herein schematically represented by VGAM1 HOST TARGET PROTEIN through VGAM3 HOST TARGET PROTEIN, all of FIG. 1.

VGAM2141 RNA, herein schematically represented by VGAM1 RNA through VGAM3 RNA, binds complementarily to a host target binding site located in an untranslated region of VGAM2141 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2141 host target RNA into VGAM2141 host target protein, herein schematically represented by VGAM1 HOST TARGET PROTEIN through VGAM3 HOST TARGET PROTEIN, all of FIG. 1.

VGAM2142 RNA, herein schematically represented by VGAM1 RNA through VGAM3 RNA, binds complementarily to a host target binding site located in an untranslated region of VGAM2142 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2142 host target RNA into VGAM2142 host target protein, herein schematically represented by VGAM1 HOST TARGET PROTEIN through VGAM3 HOST TARGET PROTEIN, all of FIG. 1.

VGAM2143 RNA, herein schematically represented by VGAM1 RNA through VGAM3 RNA, binds complementarily to a host target binding site located in an untranslated region of VGAM2143 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2143 host target RNA into VGAM2143 host target protein, herein schematically represented by VGAM1 HOST TARGET PROTEIN through VGAM3 HOST TARGET PROTEIN, all of FIG. 1.

It is appreciated that a function of VGR3187 gene, herein designated VGR GENE, is inhibition of expression of host target genes, as part of a novel viral mechanism of attacking a host. Accordingly, utilities of VGR3187 gene include diagnosis, prevention and treatment of viral infection by Ectromelia Virus. Specific functions, and accordingly utilities, of VGR3187 gene correlate with, and may be deduced from, the identity of the host target genes, which are inhibited by VGAM RNAs comprised in the 'operon-like' cluster of VGR3187 gene: VGAM2136 host target protein, VGAM2137 host target protein, VGAM2138 host target protein, VGAM2139 host target protein, VGAM2140 host target protein, VGAM2141 host target protein, VGAM2142 host target protein and VGAM2143 host target protein, herein schematically represented by VGAM1 HOST TARGET PROTEIN through VGAM3 HOST TARGET PROTEIN. The function of these host target genes is elaborated hereinabove with reference to VGAM2136, VGAM2137, VGAM2138, VGAM2139, VGAM2140, VGAM2141, VGAM2142 and VGAM2143. FIG. 9 further provides a conceptual description of novel bioinformatically detected regulatory viral gene, referred to here as Viral Genomic Record 3188(VGR3188) viral gene, which encodes an 'operon-like' cluster of novel viral micro RNA-like genes, each of which in turn modulates expression of at least one host target gene, the function and utility of which at least one host target gene is known in the art.

VGR3188 gene, herein designated VGR GENE, is a novel bioinformatically detected regulatory, non protein coding, RNA viral gene. The method by which VGR3188 gene was detected is described hereinabove with reference to FIGS. 1-9.

VGR3188 gene encodes VGR3188 precursor RNA, herein designated VGR PRECURSOR RNA, an RNA molecule, typically several hundred nucleotides long.

VGR3188 precursor RNA folds spatially, forming VGR3188 folded precursor RNA, herein designated VGR FOLDED PRECURSOR RNA. It is appreciated that VGR3188 folded precursor RNA comprises a plurality of what is known in the art as 'hairpin' structures. These 'hairpin' structures are due to the fact that the nucleotide sequence of VGR3188 precursor RNA comprises a plurality of segments, the first half of each such segment having a nucleotide sequence which is at least a partial inversed-reversed sequence of the second half thereof, as is well known in the art.

VGR3188 folded precursor RNA is naturally processed by cellular enzymatic activity into at least 2 separate VGAM precursor RNAs, VGAM2144 precursor RNA and VGAM2145 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2144 RNA and VGAM2145 RNA, herein schematically represented by VGAM1 RNA through VGAM3 RNA, each of which VGAM RNAs corresponding to VGAM RNA of FIG. 1.

VGAM2144 RNA, herein schematically represented by VGAM1 RNA through VGAM3 RNA, binds complementarily to a host target binding site located in an untranslated region of VGAM2144 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2144 host target RNA into VGAM2144 host target protein, herein schematically represented by VGAM1 HOST TARGET PROTEIN through VGAM3 HOST TARGET PROTEIN, all of FIG. 1.

VGAM2145 RNA, herein schematically represented by VGAM1 RNA through VGAM3 RNA, binds complementarily to a host target binding site located in an untranslated region of VGAM2145 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2145 host target RNA into VGAM2145 host target protein, herein schematically represented by VGAM1 HOST TARGET PROTEIN through VGAM3 HOST TARGET PROTEIN, all of FIG. 1.

It is appreciated that a function of VGR3188 gene, herein designated VGR GENE, is inhibition of expression of host target genes, as part of a novel viral mechanism of attacking a host. Accordingly, utilities of VGR3188 gene include diagnosis, prevention and treatment of viral infection by Ectromelia Virus. Specific functions, and accordingly utilities, of VGR3188 gene correlate with, and may be deduced from, the identity of the host target genes, which are inhibited by VGAM RNAs comprised in the 'operon-like' cluster of VGR3188 gene: VGAM2144 host target protein and VGAM2145 host target protein, herein schematically represented by VGAM1 HOST TARGET PROTEIN through VGAM3 HOST TARGET PROTEIN. The function of these host target genes is elaborated hereinabove with reference to VGAM2144 and VGAM2145. FIG. 9 further provides a conceptual description of novel bioinformatically detected regulatory viral gene, referred to here as Viral Genomic Record 3189(VGR3189) viral gene, which encodes an 'operon-like' cluster of novel viral micro RNA-like genes, each of which in turn modulates expression of at least one host target gene, the function and utility of which at least one host target gene is known in the art.

VGR3189 gene, herein designated VGR GENE, is a novel bioinformatically detected regulatory, non protein coding, RNA viral gene. The method by which VGR3189 gene was detected is described hereinabove with reference to FIGS. 1-9.

VGR3189 gene encodes VGR3189 precursor RNA, herein designated VGR PRECURSOR RNA, an RNA molecule, typically several hundred nucleotides long.

VGR3189 precursor RNA folds spatially, forming VGR3189 folded precursor RNA, herein designated VGR FOLDED PRECURSOR RNA. It is appreciated that VGR3189 folded precursor RNA comprises a plurality of what is known in the art as 'hairpin' structures. These 'hairpin' structures are due to the fact that the nucleotide sequence of VGR3189 precursor RNA comprises a plurality of segments, the first half of each such segment having a nucleotide sequence which is at least a partial inversed-reversed sequence of the second half thereof, as is well known in the art.

VGR3189 folded precursor RNA is naturally processed by cellular enzymatic activity into at least 7 separate VGAM precursor RNAs, VGAM2146 precursor RNA, VGAM2147 precursor RNA, VGAM2148 precursor RNA, VGAM2149 precursor RNA, VGAM2150 precursor RNA, VGAM2151 precursor RNA and VGAM2152 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2146 RNA, VGAM2147 RNA, VGAM2148 RNA, VGAM2149 RNA, VGAM2150 RNA, VGAM2151 RNA and VGAM2152 RNA, herein schematically represented by VGAM1 RNA through VGAM3 RNA, each of which VGAM RNAs corresponding to VGAM RNA of FIG. 1.

VGAM2146 RNA, herein schematically represented by VGAM1 RNA through VGAM3 RNA, binds complementarily to a host target binding site located in an untranslated region of VGAM2146 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2146 host target RNA into VGAM2146 host target protein, herein schematically represented by VGAM1 HOST TARGET PROTEIN through VGAM3 HOST TARGET PROTEIN, all of FIG. 1.

VGAM2147 RNA, herein schematically represented by VGAM1 RNA through VGAM3 RNA, binds complementarily to a host target binding site located in an untranslated region of VGAM2147 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2147 host target RNA into VGAM2147 host target protein, herein schematically represented by VGAM1 HOST TARGET PROTEIN through VGAM3 HOST TARGET PROTEIN, all of FIG. 1.

VGAM2148 RNA, herein schematically represented by VGAM1 RNA through VGAM3 RNA, binds complementarily to a host target binding site located in an untranslated region of VGAM2148 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2148 host target RNA into VGAM2148 host target protein, herein schematically represented by VGAM1 HOST TARGET PROTEIN through VGAM3 HOST TARGET PROTEIN, all of FIG. 1.

VGAM2149 RNA, herein schematically represented by VGAM1 RNA through VGAM3 RNA, binds complementarily to a host target binding site located in an untranslated region of VGAM2149 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2149 host target RNA into VGAM2149 host target protein, herein schematically represented by VGAM1 HOST TARGET PROTEIN through VGAM3 HOST TARGET PROTEIN, all of FIG. 1.

VGAM2150 RNA, herein schematically represented by VGAM1 RNA through VGAM3 RNA, binds complementarily to a host target binding site located in an untranslated region of VGAM2150 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2150 host target RNA into VGAM2150 host target protein, herein schematically represented by VGAM1 HOST TARGET PROTEIN through VGAM3 HOST TARGET PROTEIN, all of FIG. 1.

VGAM2151 RNA, herein schematically represented by VGAM1 RNA through VGAM3 RNA, binds complementarily to a host target binding site located in an untranslated region of VGAM2151 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2151 host target RNA into VGAM2151 host target protein, herein schematically represented by VGAM1 HOST TARGET PROTEIN through VGAM3 HOST TARGET PROTEIN, all of FIG. 1.

VGAM2152 RNA, herein schematically represented by VGAM1 RNA through VGAM3 RNA, binds complementarily to a host target binding site located in an untranslated region of VGAM2152 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2152 host target RNA into VGAM2152 host target protein, herein schematically represented by VGAM1 HOST TARGET PROTEIN through VGAM3 HOST TARGET PROTEIN, all of FIG. 1.

It is appreciated that a function of VGR3189 gene, herein designated VGR GENE, is inhibition of expression of host target genes, as part of a novel viral mechanism of attacking a host. Accordingly, utilities of VGR3189 gene include diagnosis, prevention and treatment of viral infection by Rana Tigrina Ranavirus. Specific functions, and accordingly utilities, of VGR3189 gene correlate with, and may be deduced from, the identity of the host target genes, which are inhibited by VGAM RNAs comprised in the 'operon-like' cluster of VGR3189 gene: VGAM2146 host target protein, VGAM2147 host target protein, VGAM2148 host target protein, VGAM2149 host target protein, VGAM2150 host target protein, VGAM2151 host target protein and VGAM2152 host target protein, herein schematically represented by VGAM1 HOST TARGET PROTEIN through VGAM3 HOST TARGET PROTEIN. The function of these host target genes is elaborated hereinabove with reference to VGAM2146, VGAM2147, VGAM2148, VGAM2149, VGAM2150, VGAM2151 and VGAM2152. FIG. 9 further provides a conceptual description of novel bioinformatically detected regulatory viral gene, referred to here as Viral Genomic Record 3190(VGR3190) viral gene, which encodes an 'operon-like' cluster of novel viral micro RNA-like genes, each of which in turn modulates expression of at least one host target gene, the function and utility of which at least one host target gene is known in the art.

VGR3190 gene, herein designated VGR GENE, is a novel bioinformatically detected regulatory, non protein coding, RNA viral gene. The method by which VGR3190 gene was detected is described hereinabove with reference to FIGS. 1-9.

VGR3190 gene encodes VGR3190 precursor RNA, herein designated VGR PRECURSOR RNA, an RNA molecule, typically several hundred nucleotides long.

VGR3190 precursor RNA folds spatially, forming VGR3190 folded precursor RNA, herein designated VGR FOLDED PRECURSOR RNA. It is appreciated that VGR3190 folded precursor RNA comprises a plurality of what is known in the art as 'hairpin' structures. These 'hairpin' structures are due to the fact that the nucleotide sequence of VGR3190 precursor RNA comprises a plurality of segments, the first half of each such segment having a nucleotide sequence which is at least a partial inversed-reversed sequence of the second half thereof, as is well known in the art.

VGR3190 folded precursor RNA is naturally processed by cellular enzymatic activity into at least 2 separate VGAM precursor RNAs, VGAM2153 precursor RNA and VGAM2154 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2153 RNA and VGAM2154 RNA, herein schematically represented by VGAM1 RNA through VGAM3 RNA, each of which VGAM RNAs corresponding to VGAM RNA of FIG. 1.

VGAM2153 RNA, herein schematically represented by VGAM1 RNA through VGAM3 RNA, binds complementarily to a host target binding site located in an untranslated region of VGAM2153 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2153 host target RNA into VGAM2153 host target protein, herein schematically represented by VGAM1 HOST TARGET PROTEIN through VGAM3 HOST TARGET PROTEIN, all of FIG. 1.

VGAM2154 RNA, herein schematically represented by VGAM1 RNA through VGAM3 RNA, binds complementarily to a host target binding site located in an untranslated region of VGAM2154 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2154 host target RNA into VGAM2154 host target protein, herein schematically represented by VGAM1 HOST TARGET PROTEIN through VGAM3 HOST TARGET PROTEIN, all of FIG. 1.

It is appreciated that a function of VGR3190 gene, herein designated VGR GENE, is inhibition of expression of host target genes, as part of a novel viral mechanism of attacking a host. Accordingly, utilities of VGR3190 gene include diagnosis, prevention and treatment of viral infection by Rana Tigrina Ranavirus. Specific functions, and accordingly utilities, of VGR3190 gene correlate with, and may be deduced from, the identity of the host target genes, which are inhibited by VGAM RNAs comprised in the 'operon-like' cluster of VGR3190 gene: VGAM2153 host target protein and VGAM2154 host target protein, herein schematically represented by VGAM1 HOST TARGET PROTEIN through VGAM3 HOST TARGET PROTEIN. The function of these host target genes is elaborated hereinabove with reference to VGAM2153 and VGAM2154. FIG. 9 further provides a conceptual description of novel bioinformatically detected regulatory viral gene, referred to here as Viral Genomic Record 3191(VGR3191) viral gene, which encodes an 'operon-like' cluster of novel viral micro RNA-like genes, each of which in turn modulates expression of at least one host target gene, the function and utility of which at least one host target gene is known in the art.

VGR3191 gene, herein designated VGR GENE, is a novel bioinformatically detected regulatory, non protein coding, RNA viral gene. The method by which VGR3191 gene was detected is described hereinabove with reference to FIGS. 1-9.

VGR3191 gene encodes VGR3191 precursor RNA, herein designated VGR PRECURSOR RNA, an RNA molecule, typically several hundred nucleotides long.

VGR3191 precursor RNA folds spatially, forming VGR3191 folded precursor RNA, herein designated VGR FOLDED PRECURSOR RNA. It is appreciated that VGR3191 folded precursor RNA comprises a plurality of what is known in the art as 'hairpin' structures. These 'hairpin' structures are due to the fact that the nucleotide sequence of VGR3191 precursor RNA comprises a plurality of segments, the first half of each such segment having a nucleotide sequence which is at least a partial inversed-reversed sequence of the second half thereof, as is well known in the art.

VGR3191 folded precursor RNA is naturally processed by cellular enzymatic activity into at least 6 separate VGAM precursor RNAs, VGAM2155 precursor RNA, VGAM2156 precursor RNA, VGAM2157 precursor RNA, VGAM2158 precursor RNA, VGAM2159 precursor RNA and VGAM2160 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2155 RNA, VGAM2156 RNA, VGAM2157 RNA, VGAM2158 RNA, VGAM2159 RNA and VGAM2160 RNA, herein schematically represented by VGAM1 RNA through VGAM3 RNA, each of which VGAM RNAs corresponding to VGAM RNA of FIG. 1.

VGAM2155 RNA, herein schematically represented by VGAM1 RNA through VGAM3 RNA, binds complementarily to a host target binding site located in an untranslated region of VGAM2155 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2155 host target RNA into VGAM2155 host target protein, herein schematically represented by VGAM1 HOST TARGET PROTEIN through VGAM3 HOST TARGET PROTEIN, all of FIG. 1.

VGAM2156 RNA, herein schematically represented by VGAM1 RNA through VGAM3 RNA, binds complementarily to a host target binding site located in an untranslated region of VGAM2156 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2156 host target RNA into VGAM2156 host target protein, herein schematically represented by VGAM1 HOST TARGET PROTEIN through VGAM3 HOST TARGET PROTEIN, all of FIG. 1.

VGAM2157 RNA, herein schematically represented by VGAM1 RNA through VGAM3 RNA, binds complementarily to a host target binding site located in an untranslated region of VGAM2157 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2157 host target RNA into VGAM2157 host target protein, herein schematically represented by VGAM1 HOST TARGET PROTEIN through VGAM3 HOST TARGET PROTEIN, all of FIG. 1.

VGAM2158 RNA, herein schematically represented by VGAM1 RNA through VGAM3 RNA, binds complementarily to a host target binding site located in an untranslated region of VGAM2158 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2158 host target RNA into VGAM2158 host target protein, herein schematically represented by VGAM1 HOST TARGET PROTEIN through VGAM3 HOST TARGET PROTEIN, all of FIG. 1.

VGAM2159 RNA, herein schematically represented by VGAM1 RNA through VGAM3 RNA, binds complementarily to a host target binding site located in an untranslated region of VGAM2159 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2159 host target RNA into VGAM2159 host target protein, herein schematically represented by VGAM1 HOST TARGET PROTEIN through VGAM3 HOST TARGET PROTEIN, all of FIG. 1.

VGAM2160 RNA, herein schematically represented by VGAM1 RNA through VGAM3 RNA, binds complementarily to a host target binding site located in an untranslated region of VGAM2160 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2160 host target RNA into VGAM2160 host target protein, herein schematically represented by VGAM1 HOST TARGET PROTEIN through VGAM3 HOST TARGET PROTEIN, all of FIG. 1.

It is appreciated that a function of VGR3191 gene, herein designated VGR GENE, is inhibition of expression of host target genes, as part of a novel viral mechanism of attacking a host. Accordingly, utilities of VGR3191 gene include diagnosis, prevention and treatment of viral infection by Monkeypox Virus. Specific functions, and accordingly utilities, of VGR3191 gene correlate with, and may be deduced from, the identity of the host target genes, which are inhibited by VGAM RNAs comprised in the 'operon-like' cluster of VGR3191 gene: VGAM2155 host target protein, VGAM2156 host target protein, VGAM2157 host target protein, VGAM2158 host target protein, VGAM2159 host target protein and VGAM2160 host target protein, herein schematically represented by VGAM1 HOST TARGET PROTEIN through VGAM3 HOST TARGET PROTEIN. The function of these host target genes is elaborated hereinabove with reference to VGAM2155, VGAM2156, VGAM2157, VGAM2158, VGAM2159 and VGAM2160. FIG. 9 further provides a conceptual description of novel bioinformatically detected regulatory viral gene, referred to here as Viral Genomic Record 3192(VGR3192) viral gene, which encodes an 'operon-like' cluster of novel viral micro RNA-like genes, each of which in turn modulates expression of at least one host target gene, the function and utility of which at least one host target gene is known in the art.

VGR3192 gene, herein designated VGR GENE, is a novel bioinformatically detected regulatory, non protein coding, RNA viral gene. The method by which VGR3192 gene was detected is described hereinabove with reference to FIGS. 1-9.

VGR3192 gene encodes VGR3192 precursor RNA, herein designated VGR PRECURSOR RNA, an RNA molecule, typically several hundred nucleotides long.

VGR3192 precursor RNA folds spatially, forming VGR3192 folded precursor RNA, herein designated VGR FOLDED PRECURSOR RNA. It is appreciated that VGR3192 folded precursor RNA comprises a plurality of what is known in the art as 'hairpin' structures. These 'hairpin' structures are due to the fact that the nucleotide sequence of VGR3192 precursor RNA comprises a plurality of segments, the first half of each such segment having a nucleotide sequence which is at least a partial inversed-reversed sequence of the second half thereof, as is well known in the art.

VGR3192 folded precursor RNA is naturally processed by cellular enzymatic activity into at least 8 separate VGAM precursor RNAs, VGAM2161 precursor RNA, VGAM2162 precursor RNA, VGAM2163 precursor RNA, VGAM2164 precursor RNA, VGAM2165 precursor RNA, VGAM2166 precursor RNA, VGAM2167 precursor RNA and VGAM2168 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2161 RNA, VGAM2162 RNA, VGAM2163 RNA, VGAM2164 RNA, VGAM2165 RNA, VGAM2166 RNA, VGAM2167 RNA and VGAM2168 RNA, herein schematically represented by VGAM1 RNA through VGAM3 RNA, each of which VGAM RNAs corresponding to VGAM RNA of FIG. 1.

VGAM2161 RNA, herein schematically represented by VGAM1 RNA through VGAM3 RNA, binds complementarily to a host target binding site located in an untranslated region of VGAM2161 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2161 host target RNA into VGAM2161 host target protein, herein schematically represented by VGAM1 HOST TARGET PROTEIN through VGAM3 HOST TARGET PROTEIN, all of FIG. 1.

VGAM2162 RNA, herein schematically represented by VGAM1 RNA through VGAM3 RNA, binds complementarily to a host target binding site located in an untranslated region of VGAM2162 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2162 host target RNA into VGAM2162 host target protein, herein schematically represented by VGAM1 HOST TARGET PROTEIN through VGAM3 HOST TARGET PROTEIN, all of FIG. 1.

VGAM2163 RNA, herein schematically represented by VGAM1 RNA through VGAM3 RNA, binds complementarily to a host target binding site located in an untranslated region of VGAM2163 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2163 host target RNA into VGAM2163 host target protein, herein schematically represented by VGAM1 HOST TARGET PROTEIN through VGAM3 HOST TARGET PROTEIN, all of FIG. 1.

VGAM2164 RNA, herein schematically represented by VGAM1 RNA through VGAM3 RNA, binds complementarily to a host target binding site located in an untranslated region of VGAM2164 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2164 host target RNA into VGAM2164 host target protein, herein schematically represented by VGAM1 HOST TARGET PROTEIN through VGAM3 HOST TARGET PROTEIN, all of FIG. 1.

VGAM2165 RNA, herein schematically represented by VGAM1 RNA through VGAM3 RNA, binds complementarily to a host target binding site located in an untranslated region of VGAM2165 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2165 host target RNA into VGAM2165 host target protein, herein schematically represented by VGAM1 HOST TARGET PROTEIN through VGAM3 HOST TARGET PROTEIN, all of FIG. 1.

VGAM2166 RNA, herein schematically represented by VGAM1 RNA through VGAM3 RNA, binds complementarily to a host target binding site located in an untranslated region of VGAM2166 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2166 host target RNA into VGAM2166 host target protein, herein schematically represented by VGAM1 HOST TARGET PROTEIN through VGAM3 HOST TARGET PROTEIN, all of FIG. 1.

VGAM2167 RNA, herein schematically represented by VGAM1 RNA through VGAM3 RNA, binds complementarily to a host target binding site located in an untranslated region of VGAM2167 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2167 host target RNA into VGAM2167 host target protein, herein schematically represented by VGAM1 HOST TARGET PROTEIN through VGAM3 HOST TARGET PROTEIN, all of FIG. 1.

VGAM2168 RNA, herein schematically represented by VGAM1 RNA through VGAM3 RNA, binds complementarily to a host target binding site located in an untranslated region of VGAM2168 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2168 host target RNA into VGAM2168 host target protein, herein schematically represented by VGAM1 HOST TARGET PROTEIN through VGAM3 HOST TARGET PROTEIN, all of FIG. 1.

It is appreciated that a function of VGR3192 gene, herein designated VGR GENE, is inhibition of expression of host target genes, as part of a novel viral mechanism of attacking a host. Accordingly, utilities of VGR3192 gene include diagnosis, prevention and treatment of viral infection by Camelpox Virus. Specific functions, and accordingly utilities, of VGR3192 gene correlate with, and may be deduced from, the identity of the host target genes, which are inhibited by VGAM RNAs comprised in the 'operon-like' cluster of VGR3192 gene: VGAM2161 host target protein, VGAM2162 host target protein, VGAM2163 host target protein, VGAM2164 host target protein, VGAM2165 host target protein, VGAM2166 host target protein, VGAM2167 host target protein and VGAM2168 host target protein, herein schematically represented by VGAM1 HOST TARGET PROTEIN through VGAM3 HOST TARGET PROTEIN. The function of these host target genes is elaborated hereinabove with reference to VGAM2161, VGAM2162, VGAM2163, VGAM2164, VGAM2165, VGAM2166, VGAM2167 and VGAM2168. FIG. 9 further provides a conceptual description of novel bioinformatically detected regulatory viral gene, referred to here as Viral Genomic Record 3193(VGR3193) viral gene, which encodes an 'operon-like' cluster of novel viral micro RNA-like genes, each of which in turn modulates expression of at least one host target gene, the function and utility of which at least one host target gene is known in the art.

VGR3193 gene, herein designated VGR GENE, is a novel bioinformatically detected regulatory, non protein coding, RNA viral gene. The method by which VGR3193 gene was detected is described hereinabove with reference to FIGS. 1-9.

VGR3193 gene encodes VGR3193 precursor RNA, herein designated VGR PRECURSOR RNA, an RNA molecule, typically several hundred nucleotides long.

VGR3193 precursor RNA folds spatially, forming VGR3193 folded precursor RNA, herein designated VGR FOLDED PRECURSOR RNA. It is appreciated that VGR3193 folded precursor RNA comprises a plurality of what is known in the art as 'hairpin' structures. These 'hairpin' structures are due to the fact that the nucleotide sequence of VGR3193 precursor RNA comprises a plurality of segments, the first half of each such segment having a nucleotide sequence which is at least a partial inversed-reversed sequence of the second half thereof, as is well known in the art.

VGR3193 folded precursor RNA is naturally processed by cellular enzymatic activity into at least 5 separate VGAM precursor RNAs, VGAM2169 precursor RNA, VGAM2170 precursor RNA, VGAM2171 precursor RNA, VGAM2172 precursor RNA and VGAM2173 precursor RNA, herein schematically represented by VGAM1 FOLDED PRECUR- SOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2169 RNA, VGAM2170 RNA, VGAM2171 RNA, VGAM2172 RNA and VGAM2173 RNA, herein schematically represented by VGAM1 RNA through VGAM3 RNA, each of which VGAM RNAs corresponding to VGAM RNA of FIG. 1.

VGAM2169 RNA, herein schematically represented by VGAM1 RNA through VGAM3 RNA, binds complementarily to a host target binding site located in an untranslated region of VGAM2169 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2169 host target RNA into VGAM2169 host target protein, herein schematically represented by VGAM1 HOST TARGET PROTEIN through VGAM3 HOST TARGET PROTEIN, all of FIG. 1.

VGAM2170 RNA, herein schematically represented by VGAM1 RNA through VGAM3 RNA, binds complementarily to a host target binding site located in an untranslated region of VGAM2170 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2170 host target RNA into VGAM2170 host target protein, herein schematically represented by VGAM1 HOST TARGET PROTEIN through VGAM3 HOST TARGET PROTEIN, all of FIG. 1.

VGAM2171 RNA, herein schematically represented by VGAM1 RNA through VGAM3 RNA, binds complementarily to a host target binding site located in an untranslated region of VGAM2171 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2171 host target RNA into VGAM2171 host target protein, herein schematically represented by VGAM1 HOST TARGET PROTEIN through VGAM3 HOST TARGET PROTEIN, all of FIG. 1.

VGAM2172 RNA, herein schematically represented by VGAM1 RNA through VGAM3 RNA, binds complementarily to a host target binding site located in an untranslated region of VGAM2172 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2172 host target RNA into VGAM2172 host target protein, herein schematically represented by VGAM1 HOST TARGET PROTEIN through VGAM3 HOST TARGET PROTEIN, all of FIG. 1.

VGAM2173 RNA, herein schematically represented by VGAM1 RNA through VGAM3 RNA, binds complementarily to a host target binding site located in an untranslated region of VGAM2173 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2173 host target RNA into VGAM2173 host target protein, herein schematically represented by VGAM1 HOST TARGET PROTEIN through VGAM3 HOST TARGET PROTEIN, all of FIG. 1.

It is appreciated that a function of VGR3193 gene, herein designated VGR GENE, is inhibition of expression of host target genes, as part of a novel viral mechanism of attacking a host. Accordingly, utilities of VGR3193 gene include diagnosis, prevention and treatment of viral infection by Camelpox Virus. Specific functions, and accordingly utilities, of VGR3193 gene correlate with, and may be deduced from, the identity of the host target genes, which are inhibited by VGAM RNAs comprised in the ‘operon-like’ cluster of VGR3193 gene: VGAM2169 host target protein, VGAM2170 host target protein, VGAM2171 host target protein, VGAM2172 host target protein and VGAM2173 host target protein, herein schematically represented by VGAM1 HOST TARGET PROTEIN through VGAM3 HOST TARGET PROTEIN. The function of these host target genes is elaborated hereinabove with reference to VGAM2169, VGAM2170, VGAM2171, VGAM2172 and VGAM2173.

FIG. 9 further provides a conceptual description of novel bioinformatically detected regulatory viral gene, referred to here as Viral Genomic Record 3194(VGR3194) viral gene, which encodes an ‘operon-like’ cluster of novel viral micro RNA-like genes, each of which in turn modulates expression of at least one host target gene, the function and utility of which at least one host target gene is known in the art.

VGR3194 gene, herein designated VGR GENE, is a novel bioinformatically detected regulatory, non protein coding, RNA viral gene. The method by which VGR3194 gene was detected is described hereinabove with reference to FIGS. 1-9.

VGR3194 gene encodes VGR3194 precursor RNA, herein designated VGR PRECURSOR RNA, an RNA molecule, typically several hundred nucleotides long.

VGR3194 precursor RNA folds spatially, forming VGR3194 folded precursor RNA, herein designated VGR FOLDED PRECURSOR RNA. It is appreciated that VGR3194 folded precursor RNA comprises a plurality of what is known in the art as ‘hairpin’ structures. These ‘hairpin’ structures are due to the fact that the nucleotide sequence of VGR3194 precursor RNA comprises a plurality of segments, the first half of each such segment having a nucleotide sequence which is at least a partial inversed-reversed sequence of the second half thereof, as is well known in the art.

VGR3194 folded precursor RNA is naturally processed by cellular enzymatic activity into at least 6 separate VGAM precursor RNAs, VGAM2174 precursor RNA, VGAM2175 precursor RNA, VGAM2176 precursor RNA, VGAM2177 precursor RNA, VGAM2178 precursor RNA and VGAM2179 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are ‘diced’ by DICER COMPLEX of FIG. 1, yielding respective short RNA segments of about 22 nucleotides in length, VGAM2174 RNA, VGAM2175 RNA, VGAM2176 RNA, VGAM2177 RNA, VGAM2178 RNA and VGAM2179 RNA, herein schematically represented by VGAM1 RNA through VGAM3 RNA, each of which VGAM RNAs corresponding to VGAM RNA of FIG. 1.

VGAM2174 RNA, herein schematically represented by VGAM1 RNA through VGAM3 RNA, binds complementarily to a host target binding site located in an untranslated region of VGAM2174 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2174 host target RNA into VGAM2174 host target protein, herein schematically represented by VGAM1 HOST TARGET PROTEIN through VGAM3 HOST TARGET PROTEIN, all of FIG. 1.

VGAM2175 RNA, herein schematically represented by VGAM1 RNA through VGAM3 RNA, binds complementarily to a host target binding site located in an untranslated region of VGAM2175 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2175 host target RNA into VGAM2175 host target protein, herein schematically represented by VGAM1 HOST TARGET PROTEIN through VGAM3 HOST TARGET PROTEIN, all of FIG. 1.

VGAM2176 RNA, herein schematically represented by VGAM1 RNA through VGAM3 RNA, binds complementarily to a host target binding site located in an untranslated region of VGAM2176 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2176 host target RNA into VGAM2176 host target protein, herein schematically represented by VGAM1 HOST TARGET PROTEIN through VGAM3 HOST TARGET PROTEIN, all of FIG. 1.

VGAM2177 RNA, herein schematically represented by VGAM1 RNA through VGAM3 RNA, binds complementarily to a host target binding site located in an untranslated region of VGAM2177 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2177 host target RNA into VGAM2177 host target protein, herein schematically represented by VGAM1 HOST TARGET PROTEIN through VGAM3 HOST TARGET PROTEIN, all of FIG. 1.

VGAM2178 RNA, herein schematically represented by VGAM1 RNA through VGAM3 RNA, binds complementarily to a host target binding site located in an untranslated region of VGAM2178 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2178 host target RNA into VGAM2178 host target protein, herein schematically represented by VGAM1 HOST TARGET PROTEIN through VGAM3 HOST TARGET PROTEIN, all of FIG. 1.

VGAM2179 RNA, herein schematically represented by VGAM1 RNA through VGAM3 RNA, binds complementarily to a host target binding site located in an untranslated region of VGAM2179 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2179 host target RNA into VGAM2179 host target protein, herein schematically represented by VGAM1 HOST TARGET PROTEIN through VGAM3 HOST TARGET PROTEIN, all of FIG. 1.

It is appreciated that a function of VGR3194 gene, herein designated VGR GENE, is inhibition of expression of host target genes, as part of a novel viral mechanism of attacking a host. Accordingly, utilities of VGR3194 gene include diagnosis, prevention and treatment of viral infection by Rabbit Fibroma Virus. Specific functions, and accordingly utilities, of VGR3194 gene correlate with, and may be deduced from, the identity of the host target genes, which are inhibited by VGAM RNAs comprised in the 'operon-like' cluster of VGR3194 gene: VGAM2174 host target protein, VGAM2175 host target protein, VGAM2176 host target protein, VGAM2177 host target protein, VGAM2178 host target protein and VGAM2179 host target protein, herein schematically represented by VGAM1 HOST TARGET PROTEIN through VGAM3 HOST TARGET PROTEIN. The function of these host target genes is elaborated hereinabove with reference to VGAM2174, VGAM2175, VGAM2176, VGAM2177, VGAM2178 and VGAM2179. FIG. 9 further provides a conceptual description of novel bioinformatically detected regulatory viral gene, referred to here as Viral Genomic Record 3195(VGR3195) viral gene, which encodes an 'operon-like' cluster of novel viral micro RNA-like genes, each of which in turn modulates expression of at least one host target gene, the function and utility of which at least one host target gene is known in the art.

VGR3195 gene, herein designated VGR GENE, is a novel bioinformatically detected regulatory, non protein coding, RNA viral gene. The method by which VGR3195 gene was detected is described hereinabove with reference to FIGS. 1-9.

VGR3195 gene encodes VGR3195 precursor RNA, herein designated VGR PRECURSOR RNA, an RNA molecule, typically several hundred nucleotides long.

VGR3195 precursor RNA folds spatially, forming VGR3195 folded precursor RNA, herein designated VGR FOLDED PRECURSOR RNA. It is appreciated that VGR3195 folded precursor RNA comprises a plurality of what is known in the art as 'hairpin' structures. These 'hairpin' structures are due to the fact that the nucleotide sequence of VGR3195 precursor RNA comprises a plurality of segments, the first half of each such segment having a nucleotide sequence which is at least a partial inversed-reversed sequence of the second half thereof, as is well known in the art.

VGR3195 folded precursor RNA is naturally processed by cellular enzymatic activity into at least 4 separate VGAM precursor RNAs, VGAM2180 precursor RNA, VGAM2181 precursor RNA, VGAM2182 precursor RNA and VGAM2183 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2180 RNA, VGAM2181 RNA, VGAM2182 RNA and VGAM2183 RNA, herein schematically represented by VGAM1 RNA through VGAM3 RNA, each of which VGAM RNAs corresponding to VGAM RNA of FIG. 1.

VGAM2180 RNA, herein schematically represented by VGAM1 RNA through VGAM3 RNA, binds complementarily to a host target binding site located in an untranslated region of VGAM2180 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2180 host target RNA into VGAM2180 host target protein, herein schematically represented by VGAM1 HOST TARGET PROTEIN through VGAM3 HOST TARGET PROTEIN, all of FIG. 1.

VGAM2181 RNA, herein schematically represented by VGAM1 RNA through VGAM3 RNA, binds complementarily to a host target binding site located in an untranslated region of VGAM2181 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2181 host target RNA into VGAM2181 host target protein, herein schematically represented by VGAM1 HOST TARGET PROTEIN through VGAM3 HOST TARGET PROTEIN, all of FIG. 1.

VGAM2182 RNA, herein schematically represented by VGAM1 RNA through VGAM3 RNA, binds complementarily to a host target binding site located in an untranslated region of VGAM2182 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2182 host target RNA into VGAM2182 host target protein, herein schematically represented by VGAM1 HOST TARGET PROTEIN through VGAM3 HOST TARGET PROTEIN, all of FIG. 1.

VGAM2183 RNA, herein schematically represented by VGAM1 RNA through VGAM3 RNA, binds complementarily to a host target binding site located in an untranslated region of VGAM2183 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2183 host target RNA into VGAM2183 host target protein, herein schematically represented by VGAM1 HOST TARGET PROTEIN through VGAM3 HOST TARGET PROTEIN, all of FIG. 1.

It is appreciated that a function of VGR3195 gene, herein designated VGR GENE, is inhibition of expression of host target genes, as part of a novel viral mechanism of attacking a host. Accordingly, utilities of VGR3195 gene include diagnosis, prevention and treatment of viral infection by Yaba-like Disease Virus. Specific functions, and accordingly utilities, of VGR3195 gene correlate with, and may be deduced from, the identity of the host target genes, which are inhibited by VGAM RNAs comprised in the 'operon-like' cluster of VGR3195 gene: VGAM2180 host target protein, VGAM2181 host target protein, VGAM2182 host target protein and VGAM2183 host target protein, herein schematically represented by VGAM1 HOST TARGET PROTEIN through VGAM3 HOST TARGET PROTEIN. The function of these host target genes is elaborated hereinabove with reference to VGAM2180, VGAM2181, VGAM2182 and VGAM2183. FIG. 9 further provides a conceptual description of novel bioinformatically detected regulatory viral gene, referred to here as Viral Genomic Record 3196(VGR3196) viral gene, which encodes an 'operon-like' cluster of novel viral micro RNA-like genes, each of which in turn modulates expression of at least one host target gene, the function and utility of which at least one host target gene is known in the art.

VGR3196 gene, herein designated VGR GENE, is a novel bioinformatically detected regulatory, non protein coding, RNA viral gene. The method by which VGR3196 gene was detected is described hereinabove with reference to FIGS. 1-9.

VGR3196 gene encodes VGR3196 precursor RNA, herein designated VGR PRECURSOR RNA, an RNA molecule, typically several hundred nucleotides long.

VGR3196 precursor RNA folds spatially, forming VGR3196 folded precursor RNA, herein designated VGR FOLDED PRECURSOR RNA. It is appreciated that VGR3196 folded precursor RNA comprises a plurality of what is known in the art as 'hairpin' structures. These 'hairpin' structures are due to the fact that the nucleotide sequence of VGR3196 precursor RNA comprises a plurality of segments, the first half of each such segment having a nucleotide sequence which is at least a partial inversed-reversed sequence of the second half thereof, as is well known in the art.

VGR3196 folded precursor RNA is naturally processed by cellular enzymatic activity into at least 8 separate VGAM precursor RNAs, VGAM2184 precursor RNA, VGAM2185 precursor RNA, VGAM2186 precursor RNA, VGAM2187 precursor RNA, VGAM2188 precursor RNA, VGAM2189 precursor RNA, VGAM2190 precursor RNA and VGAM2191 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2184 RNA, VGAM2185 RNA, VGAM2186 RNA, VGAM2187 RNA, VGAM2188 RNA, VGAM2189 RNA, VGAM2190 RNA and VGAM2191 RNA, herein schematically represented by VGAM1 RNA through VGAM3 RNA, each of which VGAM RNAs corresponding to VGAM RNA of FIG. 1.

VGAM2184 RNA, herein schematically represented by VGAM1 RNA through VGAM3 RNA, binds complementarily to a host target binding site located in an untranslated region of VGAM2184 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2184 host target RNA into VGAM2184 host target protein, herein schematically represented by VGAM1 HOST TARGET PROTEIN through VGAM3 HOST TARGET PROTEIN, all of FIG. 1.

VGAM2185 RNA, herein schematically represented by VGAM1 RNA through VGAM3 RNA, binds complementarily to a host target binding site located in an untranslated region of VGAM2185 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2185 host target RNA into VGAM2185 host target protein, herein schematically represented by VGAM1 HOST TARGET PROTEIN through VGAM3 HOST TARGET PROTEIN, all of FIG. 1.

VGAM2186 RNA, herein schematically represented by VGAM1 RNA through VGAM3 RNA, binds complementarily to a host target binding site located in an untranslated region of VGAM2186 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2186 host target RNA into VGAM2186 host target protein, herein schematically represented by VGAM1 HOST TARGET PROTEIN through VGAM3 HOST TARGET PROTEIN, all of FIG. 1.

VGAM2187 RNA, herein schematically represented by VGAM1 RNA through VGAM3 RNA, binds complementarily to a host target binding site located in an untranslated region of VGAM2187 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2187 host target RNA into VGAM2187 host target protein, herein schematically represented by VGAM1 HOST TARGET PROTEIN through VGAM3 HOST TARGET PROTEIN, all of FIG. 1.

VGAM2188 RNA, herein schematically represented by VGAM1 RNA through VGAM3 RNA, binds complementarily to a host target binding site located in an untranslated region of VGAM2188 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2188 host target RNA into VGAM2188 host target protein, herein schematically represented by VGAM1 HOST TARGET PROTEIN through VGAM3 HOST TARGET PROTEIN, all of FIG. 1.

VGAM2189 RNA, herein schematically represented by VGAM1 RNA through VGAM3 RNA, binds complementarily to a host target binding site located in an untranslated region of VGAM2189 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2189 host target RNA into VGAM2189 host target protein, herein schematically represented by VGAM1 HOST TARGET PROTEIN through VGAM3 HOST TARGET PROTEIN, all of FIG. 1.

VGAM2190 RNA, herein schematically represented by VGAM1 RNA through VGAM3 RNA, binds complementarily to a host target binding site located in an untranslated region of VGAM2190 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2190 host target RNA into VGAM2190 host target protein, herein schematically represented by VGAM1 HOST TARGET PROTEIN through VGAM3 HOST TARGET PROTEIN, all of FIG. 1.

VGAM2191 RNA, herein schematically represented by VGAM1 RNA through VGAM3 RNA, binds complementarily to a host target binding site located in an untranslated region of VGAM2191 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2191 host target RNA into VGAM2191 host target protein, herein schematically represented by VGAM1 HOST TARGET PROTEIN through VGAM3 HOST TARGET PROTEIN, all of FIG. 1.

It is appreciated that a function of VGR3196 gene, herein designated VGR GENE, is inhibition of expression of host target genes, as part of a novel viral mechanism of attacking a host. Accordingly, utilities of VGR3196 gene include diagnosis, prevention and treatment of viral infection by Monkeypox Virus. Specific functions, and accordingly utilities, of VGR3196 gene correlate with, and may be deduced from, the identity of the host target genes, which are inhibited by VGAM RNAs comprised in the 'operon-like' cluster of VGR3196 gene: VGAM2184 host target protein, VGAM2185 host target protein, VGAM2186 host target protein, VGAM2187 host target protein, VGAM2188 host target protein, VGAM2189 host target protein, VGAM2190 host target protein and VGAM2191 host target protein, herein schematically represented by VGAM1 HOST TARGET PROTEIN through VGAM3 HOST TARGET PROTEIN. The function of these host target genes is elaborated hereinabove with reference to VGAM2184, VGAM2185, VGAM2186, VGAM2187, VGAM2188, VGAM2189, VGAM2190 and VGAM2191. FIG. 9 further provides a conceptual description of novel bioinformatically detected regulatory viral gene, referred to here as Viral Genomic Record 3197(VGR3197) viral gene, which encodes an 'operon-like' cluster of novel viral micro RNA-like genes, each of which in turn modulates expression of at least one host target gene, the function and utility of which at least one host target gene is known in the art.

VGR3197 gene, herein designated VGR GENE, is a novel bioinformatically detected regulatory, non protein coding, RNA viral gene. The method by which VGR3197 gene was detected is described hereinabove with reference to FIGS. 1-9.

VGR3197 gene encodes VGR3197 precursor RNA, herein designated VGR PRECURSOR RNA, an RNA molecule, typically several hundred nucleotides long.

VGR3197 precursor RNA folds spatially, forming VGR3197 folded precursor RNA, herein designated VGR FOLDED PRECURSOR RNA. It is appreciated that VGR3197 folded precursor RNA comprises a plurality of what is known in the art as 'hairpin' structures. These 'hairpin' structures are due to the fact that the nucleotide sequence of VGR3197 precursor RNA comprises a plurality of segments, the first half of each such segment having a nucleotide sequence which is at least a partial inversed-reversed sequence of the second half thereof, as is well known in the art.

VGR3197 folded precursor RNA is naturally processed by cellular enzymatic activity into at least 3 separate VGAM precursor RNAs, VGAM2192 precursor RNA, VGAM2193 precursor RNA and VGAM2194 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2192 RNA, VGAM2193 RNA and VGAM2194 RNA, herein schematically represented by VGAM1 RNA through VGAM3 RNA, each of which VGAM RNAs corresponding to VGAM RNA of FIG. 1.

VGAM2192 RNA, herein schematically represented by VGAM1 RNA through VGAM3 RNA, binds complementarily to a host target binding site located in an untranslated region of VGAM2192 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2192 host target RNA into VGAM2192 host target protein, herein schematically represented by VGAM1 HOST TARGET PROTEIN through VGAM3 HOST TARGET PROTEIN, all of FIG. 1.

VGAM2193 RNA, herein schematically represented by VGAM1 RNA through VGAM3 RNA, binds complementarily to a host target binding site located in an untranslated region of VGAM2193 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2193 host target RNA into VGAM2193 host target protein, herein schematically represented by VGAM1 HOST TARGET PROTEIN through VGAM3 HOST TARGET PROTEIN, all of FIG. 1.

VGAM2194 RNA, herein schematically represented by VGAM1 RNA through VGAM3 RNA, binds complementarily to a host target binding site located in an untranslated region of VGAM2194 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2194 host target RNA into VGAM2194 host target protein, herein schematically represented by VGAM1 HOST TARGET PROTEIN through VGAM3 HOST TARGET PROTEIN, all of FIG. 1.

It is appreciated that a function of VGR3197 gene, herein designated VGR GENE, is inhibition of expression of host target genes, as part of a novel viral mechanism of attacking a host. Accordingly, utilities of VGR3197 gene include diagnosis, prevention and treatment of viral infection by Monkeypox Virus. Specific functions, and accordingly utilities, of VGR3197 gene correlate with, and may be deduced from, the identity of the host target genes, which are inhibited by VGAM RNAs comprised in the 'operon-like' cluster of VGR3197 gene: VGAM2192 host target protein, VGAM2193 host target protein and VGAM2194 host target protein, herein schematically represented by VGAM1 HOST TARGET PROTEIN through VGAM3 HOST TARGET PROTEIN. The function of these host target genes is elaborated hereinabove with reference to VGAM2192, VGAM2193 and VGAM2194. FIG. 9 further provides a conceptual description of novel bioinformatically detected regulatory viral gene, referred to here as Viral Genomic Record 3198(VGR3198) viral gene, which encodes an 'operon-like' cluster of novel viral micro RNA-like genes, each of which in turn modulates expression of at least one host target gene, the function and utility of which at least one host target gene is known in the art.

VGR3198 gene, herein designated VGR GENE, is a novel bioinformatically detected regulatory, non protein coding, RNA viral gene. The method by which VGR3198 gene was detected is described hereinabove with reference to FIGS. 1-9.

VGR3198 gene encodes VGR3198 precursor RNA, herein designated VGR PRECURSOR RNA, an RNA molecule, typically several hundred nucleotides long.

VGR3198 precursor RNA folds spatially, forming VGR3198 folded precursor RNA, herein designated VGR FOLDED PRECURSOR RNA. It is appreciated that VGR3198 folded precursor RNA comprises a plurality of what is known in the art as 'hairpin' structures. These 'hairpin' structures are due to the fact that the nucleotide sequence of VGR3198 precursor RNA comprises a plurality of segments, the first half of each such segment having a nucleotide sequence which is at least a partial inversed-reversed sequence of the second half thereof, as is well known in the art.

VGR3198 folded precursor RNA is naturally processed by cellular enzymatic activity into at least 5 separate VGAM precursor RNAs, VGAM2195 precursor RNA, VGAM2196 precursor RNA, VGAM2197 precursor RNA, VGAM2198 precursor RNA and VGAM2199 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2195 RNA, VGAM2196 RNA, VGAM2197 RNA, VGAM2198 RNA and VGAM2199 RNA, herein schematically represented by VGAM1 RNA through VGAM3 RNA, each of which VGAM RNAs corresponding to VGAM RNA of FIG. 1.

VGAM2195 RNA, herein schematically represented by VGAM1 RNA through VGAM3 RNA, binds complementarily to a host target binding site located in an untranslated region of VGAM2195 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2195 host target RNA into VGAM2195 host target protein, herein schematically represented by VGAM1 HOST TARGET PROTEIN through VGAM3 HOST TARGET PROTEIN, all of FIG. 1.

VGAM2196 RNA, herein schematically represented by VGAM1 RNA through VGAM3 RNA, binds complementarily to a host target binding site located in an untranslated region of VGAM2196 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2196 host target RNA into VGAM2196 host target protein, herein schematically represented by VGAM1 HOST TARGET PROTEIN through VGAM3 HOST TARGET PROTEIN, all of FIG. 1.

VGAM2197 RNA, herein schematically represented by VGAM1 RNA through VGAM3 RNA, binds complementarily to a host target binding site located in an untranslated region of VGAM2197 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2197 host target RNA into VGAM2197 host target protein, herein schematically represented by VGAM1 HOST TARGET PROTEIN through VGAM3 HOST TARGET PROTEIN, all of FIG. 1.

VGAM2198 RNA, herein schematically represented by VGAM1 RNA through VGAM3 RNA, binds complementarily to a host target binding site located in an untranslated region of VGAM2198 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2198 host target RNA into VGAM2198 host target protein, herein schematically represented by VGAM1 HOST TARGET PROTEIN through VGAM3 HOST TARGET PROTEIN, all of FIG. 1.

VGAM2199 RNA, herein schematically represented by VGAM1 RNA through VGAM3 RNA, binds complementarily to a host target binding site located in an untranslated region of VGAM2199 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2199 host target RNA into VGAM2199 host target protein, herein schematically represented by VGAM1 HOST TARGET PROTEIN through VGAM3 HOST TARGET PROTEIN, all of FIG. 1.

It is appreciated that a function of VGR3198 gene, herein designated VGR GENE, is inhibition of expression of host target genes, as part of a novel viral mechanism of attacking a host. Accordingly, utilities of VGR3198 gene include diagnosis, prevention and treatment of viral infection by Yaba-like Disease Virus. Specific functions, and accordingly utilities, of VGR3198 gene correlate with, and may be deduced from, the identity of the host target genes, which are inhibited by VGAM RNAs comprised in the 'operon-like' cluster of VGR3198 gene: VGAM2195 host target protein, VGAM2196 host target protein, VGAM2197 host target protein, VGAM2198 host target protein and VGAM2199 host target protein, herein schematically represented by VGAM1 HOST TARGET PROTEIN through VGAM3 HOST TARGET PROTEIN. The function of these host target genes is elaborated hereinabove with reference to VGAM2195, VGAM2196, VGAM2197, VGAM2198 and VGAM2199. FIG. 9 further provides a conceptual description of novel bioinformatically detected regulatory viral gene, referred to here as Viral Genomic Record 3199(VGR3199) viral gene, which encodes an 'operon-like' cluster of novel viral micro RNA-like genes, each of which in turn modulates expression of at least one host target gene, the function and utility of which at least one host target gene is known in the art.

VGR3199 gene, herein designated VGR GENE, is a novel bioinformatically detected regulatory, non protein coding, RNA viral gene. The method by which VGR3199 gene was detected is described hereinabove with reference to FIGS. 1-9.

VGR3199 gene encodes VGR3199 precursor RNA, herein designated VGR PRECURSOR RNA, an RNA molecule, typically several hundred nucleotides long.

VGR3199 precursor RNA folds spatially, forming VGR3199 folded precursor RNA, herein designated VGR FOLDED PRECURSOR RNA. It is appreciated that VGR3199 folded precursor RNA comprises a plurality of what is known in the art as 'hairpin' structures. These 'hairpin' structures are due to the fact that the nucleotide sequence of VGR3199 precursor RNA comprises a plurality of segments, the first half of each such segment having a nucleotide sequence which is at least a partial inversed-reversed sequence of the second half thereof, as is well known in the art.

VGR3199 folded precursor RNA is naturally processed by cellular enzymatic activity into at least 7 separate VGAM precursor RNAs, VGAM2200 precursor RNA, VGAM2201 precursor RNA, VGAM2202 precursor RNA, VGAM2203 precursor RNA, VGAM2204 precursor RNA, VGAM2205 precursor RNA and VGAM2206 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2200 RNA, VGAM2201 RNA, VGAM2202 RNA, VGAM2203 RNA, VGAM2204 RNA, VGAM2205 RNA and VGAM2206 RNA, herein schematically represented by VGAM1 RNA through VGAM3 RNA, each of which VGAM RNAs corresponding to VGAM RNA of FIG. 1.

VGAM2200 RNA, herein schematically represented by VGAM1 RNA through VGAM3 RNA, binds complementarily to a host target binding site located in an untranslated region of VGAM2200 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2200 host target RNA into VGAM2200 host target protein, herein schematically represented by VGAM1 HOST TARGET PROTEIN through VGAM3 HOST TARGET PROTEIN, all of FIG. 1.

VGAM2201 RNA, herein schematically represented by VGAM1 RNA through VGAM3 RNA, binds complementarily to a host target binding site located in an untranslated region of VGAM2201 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2201 host target RNA into VGAM2201 host target protein, herein schematically represented by VGAM1 HOST TARGET PROTEIN through VGAM3 HOST TARGET PROTEIN, all of FIG. 1.

VGAM2202 RNA, herein schematically represented by VGAM1 RNA through VGAM3 RNA, binds complementarily to a host target binding site located in an untranslated region of VGAM2202 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2202 host target RNA into VGAM2202 host target protein, herein schematically represented by VGAM1 HOST TARGET PROTEIN through VGAM3 HOST TARGET PROTEIN, all of FIG. 1.

VGAM2203 RNA, herein schematically represented by VGAM1 RNA through VGAM3 RNA, binds complementarily to a host target binding site located in an untranslated region of VGAM2203 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2203 host target RNA into VGAM2203 host target protein, herein schematically represented by VGAM1 HOST TARGET PROTEIN through VGAM3 HOST TARGET PROTEIN, all of FIG. 1.

VGAM2204 RNA, herein schematically represented by VGAM1 RNA through VGAM3 RNA, binds complementarily to a host target binding site located in an untranslated region of VGAM2204 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2204 host target RNA into VGAM2204 host target protein, herein schematically represented by VGAM1 HOST TARGET PROTEIN through VGAM3 HOST TARGET PROTEIN, all of FIG. 1.

VGAM2205 RNA, herein schematically represented by VGAM1 RNA through VGAM3 RNA, binds complementarily to a host target binding site located in an untranslated region of VGAM2205 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2205 host target RNA into VGAM2205 host target protein, herein schematically represented by VGAM1 HOST TARGET PROTEIN through VGAM3 HOST TARGET PROTEIN, all of FIG. 1.

VGAM2206 RNA, herein schematically represented by VGAM1 RNA through VGAM3 RNA, binds complementarily to a host target binding site located in an untranslated region of VGAM2206 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2206 host target RNA into VGAM2206 host target protein, herein schematically represented by VGAM1 HOST TARGET PROTEIN through VGAM3 HOST TARGET PROTEIN, all of FIG. 1.

It is appreciated that a function of VGR3199 gene, herein designated VGR GENE, is inhibition of expression of host target genes, as part of a novel viral mechanism of attacking a host. Accordingly, utilities of VGR3199 gene include diagnosis, prevention and treatment of viral infection by Cowpox Virus. Specific functions, and accordingly utilities, of VGR3199 gene correlate with, and may be deduced from, the identity of the host target genes, which are inhibited by VGAM RNAs comprised in the 'operon-like' cluster of VGR3199 gene: VGAM2200 host target protein, VGAM2201 host target protein, VGAM2202 host target protein, VGAM2203 host target protein, VGAM2204 host target protein, VGAM2205 host target protein and VGAM2206 host target protein, herein schematically represented by VGAM1 HOST TARGET PROTEIN through VGAM3 HOST TARGET PROTEIN. The function of these host target genes is elaborated hereinabove with reference to VGAM2200, VGAM2201, VGAM2202, VGAM2203, VGAM2204, VGAM2205 and VGAM2206. FIG. 9 further provides a conceptual description of novel bioinformatically detected regulatory viral gene, referred to here as Viral Genomic Record 3200(VGR3200) viral gene, which encodes an 'operon-like' cluster of novel viral micro RNA-like genes, each of which in turn modulates expression of at least one host target gene, the function and utility of which at least one host target gene is known in the art.

VGR3200 gene, herein designated VGR GENE, is a novel bioinformatically detected regulatory, non protein coding, RNA viral gene. The method by which VGR3200 gene was detected is described hereinabove with reference to FIGS. 1-9.

VGR3200 gene encodes VGR3200 precursor RNA, herein designated VGR PRECURSOR RNA, an RNA molecule, typically several hundred nucleotides long.

VGR3200 precursor RNA folds spatially, forming VGR3200 folded precursor RNA, herein designated VGR FOLDED PRECURSOR RNA. It is appreciated that VGR3200 folded precursor RNA comprises a plurality of what is known in the art as 'hairpin' structures. These 'hairpin' structures are due to the fact that the nucleotide sequence of VGR3200 precursor RNA comprises a plurality of segments, the first half of each such segment having a nucleotide sequence which is at least a partial inversed-reversed sequence of the second half thereof, as is well known in the art.

VGR3200 folded precursor RNA is naturally processed by cellular enzymatic activity into at least 8 separate VGAM precursor RNAs, VGAM2207 precursor RNA, VGAM2208 precursor RNA, VGAM2209 precursor RNA, VGAM2210 precursor RNA, VGAM2211 precursor RNA, VGAM2212 precursor RNA, VGAM2213 precursor RNA and VGAM2214 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2207 RNA, VGAM2208 RNA, VGAM2209 RNA, VGAM2210 RNA, VGAM2211 RNA, VGAM2212 RNA, VGAM2213 RNA and VGAM2214 RNA, herein schematically represented by VGAM1 RNA through VGAM3 RNA, each of which VGAM RNAs corresponding to VGAM RNA of FIG. 1.

VGAM2207 RNA, herein schematically represented by VGAM1 RNA through VGAM3 RNA, binds complementarily to a host target binding site located in an untranslated region of VGAM2207 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2207 host target RNA into VGAM2207 host target protein, herein schematically represented by VGAM1 HOST TARGET PROTEIN through VGAM3 HOST TARGET PROTEIN, all of FIG. 1.

VGAM2208 RNA, herein schematically represented by VGAM1 RNA through VGAM3 RNA, binds complementarily to a host target binding site located in an untranslated region of VGAM2208 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2208 host target RNA into VGAM2208 host target protein, herein schematically represented by VGAM1 HOST TARGET PROTEIN through VGAM3 HOST TARGET PROTEIN, all of FIG. 1.

VGAM2209 RNA, herein schematically represented by VGAM1 RNA through VGAM3 RNA, binds complementarily to a host target binding site located in an untranslated region of VGAM2209 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2209 host target RNA into VGAM2209 host target protein, herein schematically represented by VGAM1 HOST TARGET PROTEIN through VGAM3 HOST TARGET PROTEIN, all of FIG. 1.

VGAM2210 RNA, herein schematically represented by VGAM1 RNA through VGAM3 RNA, binds complementarily to a host target binding site located in an untranslated region of VGAM2210 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2210 host target RNA into VGAM2210 host target protein, herein schematically represented by VGAM1 HOST TARGET PROTEIN through VGAM3 HOST TARGET PROTEIN, all of FIG. 1.

VGAM2211 RNA, herein schematically represented by VGAM1 RNA through VGAM3 RNA, binds complementarily to a host target binding site located in an untranslated region of VGAM2211 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2211 host target RNA into VGAM2211 host target protein, herein schematically represented by VGAM1 HOST TARGET PROTEIN through VGAM3 HOST TARGET PROTEIN, all of FIG. 1.

VGAM2212 RNA, herein schematically represented by VGAM1 RNA through VGAM3 RNA, binds complementarily to a host target binding site located in an untranslated region of VGAM2212 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2212 host target RNA into VGAM2212 host target protein, herein schematically represented by VGAM1 HOST TARGET PROTEIN through VGAM3 HOST TARGET PROTEIN, all of FIG. 1.

VGAM2213 RNA, herein schematically represented by VGAM1 RNA through VGAM3 RNA, binds complementarily to a host target binding site located in an untranslated region of VGAM2213 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2213 host target RNA into VGAM2213 host target protein, herein schematically represented by VGAM1 HOST TARGET PROTEIN through VGAM3 HOST TARGET PROTEIN, all of FIG. 1.

VGAM2214 RNA, herein schematically represented by VGAM1 RNA through VGAM3 RNA, binds complementarily to a host target binding site located in an untranslated region of VGAM2214 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2214 host target RNA into VGAM2214 host target protein, herein schematically represented by VGAM1 HOST TARGET PROTEIN through VGAM3 HOST TARGET PROTEIN, all of FIG. 1.

It is appreciated that a function of VGR3200 gene, herein designated VGR GENE, is inhibition of expression of host target genes, as part of a novel viral mechanism of attacking a host. Accordingly, utilities of VGR3200 gene include diagnosis, prevention and treatment of viral infection by Myxoma Virus. Specific functions, and accordingly utilities, of VGR3200 gene correlate with, and may be deduced from, the identity of the host target genes, which are inhibited by VGAM RNAs comprised in the 'operon-like' cluster of VGR3200 gene: VGAM2207 host target protein, VGAM2208 host target protein, VGAM2209 host target protein, VGAM2210 host target protein, VGAM2211 host target protein, VGAM2212 host target protein, VGAM2213 host target protein and VGAM2214 host target protein, herein schematically represented by VGAM1 HOST TARGET PROTEIN through VGAM3 HOST TARGET PROTEIN. The function of these host target genes is elaborated hereinabove with reference to VGAM2207, VGAM2208, VGAM2209, VGAM2210, VGAM2211, VGAM2212, VGAM2213 and VGAM2214. FIG. 9 further provides a conceptual description of novel bioinformatically detected regulatory viral gene, referred to here as Viral Genomic Record 3201 (VGR3201) viral gene, which encodes an 'operon-like' cluster of novel viral micro RNA-like genes, each of which in turn modulates expression of at least one host target gene, the function and utility of which at least one host target gene is known in the art.

VGR3201 gene, herein designated VGR GENE, is a novel bioinformatically detected regulatory, non protein coding, RNA viral gene. The method by which VGR3201 gene was detected is described hereinabove with reference to FIGS. 1-9.

VGR3201 gene encodes VGR3201 precursor RNA, herein designated VGR PRECURSOR RNA, an RNA molecule, typically several hundred nucleotides long.

VGR3201 precursor RNA folds spatially, forming VGR3201 folded precursor RNA, herein designated VGR FOLDED PRECURSOR RNA. It is appreciated that VGR3201 folded precursor RNA comprises a plurality of what is known in the art as 'hairpin' structures. These 'hairpin' structures are due to the fact that the nucleotide sequence of VGR3201 precursor RNA comprises a plurality of segments, the first half of each such segment having a nucleotide sequence which is at least a partial inversed-reversed sequence of the second half thereof, as is well known in the art.

VGR3201 folded precursor RNA is naturally processed by cellular enzymatic activity into at least 6 separate VGAM precursor RNAs, VGAM2215 precursor RNA, VGAM2216 precursor RNA, VGAM2217 precursor RNA, VGAM2218 precursor RNA, VGAM2219 precursor RNA and VGAM2220 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2215 RNA, VGAM2216 RNA, VGAM2217 RNA, VGAM2218 RNA, VGAM2219 RNA and VGAM2220 RNA, herein schematically represented by VGAM1 RNA through VGAM3 RNA, each of which VGAM RNAs corresponding to VGAM RNA of FIG. 1.

VGAM2215 RNA, herein schematically represented by VGAM1 RNA through VGAM3 RNA, binds complementarily to a host target binding site located in an untranslated region of VGAM2215 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2215 host target RNA into VGAM2215 host target protein, herein schematically represented by VGAM1 HOST TARGET PROTEIN through VGAM3 HOST TARGET PROTEIN, all of FIG. 1.

VGAM2216 RNA, herein schematically represented by VGAM1 RNA through VGAM3 RNA, binds complementarily to a host target binding site located in an untranslated region of VGAM2216 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2216 host target RNA into VGAM2216 host target protein, herein schematically represented by VGAM1 HOST TARGET PROTEIN through VGAM3 HOST TARGET PROTEIN, all of FIG. 1.

VGAM2217 RNA, herein schematically represented by VGAM1 RNA through VGAM3 RNA, binds complementarily to a host target binding site located in an untranslated region of VGAM2217 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2217 host target RNA into VGAM2217 host target protein, herein schematically represented by VGAM1 HOST TARGET PROTEIN through VGAM3 HOST TARGET PROTEIN, all of FIG. 1.

VGAM2218 RNA, herein schematically represented by VGAM1 RNA through VGAM3 RNA, binds complementarily to a host target binding site located in an untranslated region of VGAM2218 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2218 host target RNA into VGAM2218 host target protein, herein schematically represented by VGAM1 HOST TARGET PROTEIN through VGAM3 HOST TARGET PROTEIN, all of FIG. 1.

VGAM2219 RNA, herein schematically represented by VGAM1 RNA through VGAM3 RNA, binds complementarily to a host target binding site located in an untranslated region of VGAM2219 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2219 host target RNA into VGAM2219 host target protein, herein schematically represented by VGAM1 HOST TARGET PROTEIN through VGAM3 HOST TARGET PROTEIN, all of FIG. 1.

VGAM2220 RNA, herein schematically represented by VGAM1 RNA through VGAM3 RNA, binds complementarily to a host target binding site located in an untranslated region of VGAM2220 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2220 host target RNA into VGAM2220 host target protein, herein schematically represented by VGAM1 HOST TARGET PROTEIN through VGAM3 HOST TARGET PROTEIN, all of FIG. 1.

It is appreciated that a function of VGR3201 gene, herein designated VGR GENE, is inhibition of expression of host target genes, as part of a novel viral mechanism of attacking a host. Accordingly, utilities of VGR3201 gene include diagnosis, prevention and treatment of viral infection by Ectromelia Virus. Specific functions, and accordingly utilities, of VGR3201 gene correlate with, and may be deduced from, the identity of the host target genes, which are inhibited by VGAM RNAs comprised in the 'operon-like' cluster of VGR3201 gene: VGAM2215 host target protein, VGAM2216 host target protein, VGAM2217 host target protein, VGAM2218 host target protein, VGAM2219 host target protein and VGAM2220 host target protein, herein schematically represented by VGAM1 HOST TARGET PROTEIN through VGAM3 HOST TARGET PROTEIN. The function of these host target genes is elaborated hereinabove with reference to VGAM2215, VGAM2216, VGAM2217, VGAM2218, VGAM2219 and VGAM2220. FIG. 9 further provides a conceptual description of novel bioinformatically detected regulatory viral gene, referred to here as Viral Genomic Record 3202(VGR3202) viral gene, which encodes an 'operon-like' cluster of novel viral micro RNA-like genes, each of which in turn modulates expression of at least one host target gene, the function and utility of which at least one host target gene is known in the art.

VGR3202 gene, herein designated VGR GENE, is a novel bioinformatically detected regulatory, non protein coding, RNA viral gene. The method by which VGR3202 gene was detected is described hereinabove with reference to FIGS. 1-9.

VGR3202 gene encodes VGR3202 precursor RNA, herein designated VGR PRECURSOR RNA, an RNA molecule, typically several hundred nucleotides long.

VGR3202 precursor RNA folds spatially, forming VGR3202 folded precursor RNA, herein designated VGR FOLDED PRECURSOR RNA. It is appreciated that VGR3202 folded precursor RNA comprises a plurality of what is known in the art as 'hairpin' structures. These 'hairpin' structures are due to the fact that the nucleotide sequence of VGR3202 precursor RNA comprises a plurality of segments, the first half of each such segment having a nucleotide sequence which is at least a partial inversed-reversed sequence of the second half thereof, as is well known in the art.

VGR3202 folded precursor RNA is naturally processed by cellular enzymatic activity into at least 8 separate VGAM precursor RNAs, VGAM2221 precursor RNA, VGAM2222 precursor RNA, VGAM2223 precursor RNA, VGAM2224 precursor RNA, VGAM2225 precursor RNA, VGAM2226 precursor RNA, VGAM2227 precursor RNA and VGAM2228 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2221 RNA, VGAM2222 RNA, VGAM2223 RNA, VGAM2224 RNA, VGAM2225 RNA, VGAM2226 RNA, VGAM2227 RNA and VGAM2228 RNA, herein schematically represented by VGAM1 RNA through VGAM3 RNA, each of which VGAM RNAs corresponding to VGAM RNA of FIG. 1.

VGAM2221 RNA, herein schematically represented by VGAM1 RNA through VGAM3 RNA, binds complementarily to a host target binding site located in an untranslated region of VGAM2221 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2221 host target RNA into VGAM2221 host target protein, herein schematically represented by VGAM1 HOST TARGET PROTEIN through VGAM3 HOST TARGET PROTEIN, all of FIG. 1.

VGAM2222 RNA, herein schematically represented by VGAM1 RNA through VGAM3 RNA, binds complementarily to a host target binding site located in an untranslated region of VGAM2222 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2222 host target RNA into VGAM2222 host target protein, herein schematically represented by VGAM1 HOST TARGET PROTEIN through VGAM3 HOST TARGET PROTEIN, all of FIG. 1.

VGAM2223 RNA, herein schematically represented by VGAM1 RNA through VGAM3 RNA, binds complementarily to a host target binding site located in an untranslated region of VGAM2223 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2223 host target RNA into VGAM2223 host target protein, herein schematically represented by VGAM1 HOST TARGET PROTEIN through VGAM3 HOST TARGET PROTEIN, all of FIG. 1.

VGAM2224 RNA, herein schematically represented by VGAM1 RNA through VGAM3 RNA, binds complementarily to a host target binding site located in an untranslated region of VGAM2224 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2224 host target RNA into VGAM2224 host target protein, herein schematically represented by VGAM1 HOST TARGET PROTEIN through VGAM3 HOST TARGET PROTEIN, all of FIG. 1.

VGAM2225 RNA, herein schematically represented by VGAM1 RNA through VGAM3 RNA, binds complementarily to a host target binding site located in an untranslated region of VGAM2225 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2225 host target RNA into VGAM2225 host target protein, herein schematically represented by VGAM1 HOST TARGET PROTEIN through VGAM3 HOST TARGET PROTEIN, all of FIG. 1.

VGAM2226 RNA, herein schematically represented by VGAM1 RNA through VGAM3 RNA, binds complementarily to a host target binding site located in an untranslated region of VGAM2226 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2226 host target RNA into VGAM2226 host target protein, herein schematically represented by VGAM1 HOST TARGET PROTEIN through VGAM3 HOST TARGET PROTEIN, all of FIG. 1.

VGAM2227 RNA, herein schematically represented by VGAM1 RNA through VGAM3 RNA, binds complementarily to a host target binding site located in an untranslated region of VGAM2227 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2227 host target RNA into VGAM2227 host target protein, herein schematically represented by VGAM1 HOST TARGET PROTEIN through VGAM3 HOST TARGET PROTEIN, all of FIG. 1.

VGAM2228 RNA, herein schematically represented by VGAM1 RNA through VGAM3 RNA, binds complementarily to a host target binding site located in an untranslated region of VGAM2228 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2228 host target RNA into VGAM2228 host target protein, herein schematically represented by VGAM1 HOST TARGET PROTEIN through VGAM3 HOST TARGET PROTEIN, all of FIG. 1.

It is appreciated that a function of VGR3202 gene, herein designated VGR GENE, is inhibition of expression of host target genes, as part of a novel viral mechanism of attacking a host. Accordingly, utilities of VGR3202 gene include diagnosis, prevention and treatment of viral infection by Equine Herpesvirus 2. Specific functions, and accordingly utilities, of VGR3202 gene correlate with, and may be deduced from, the identity of the host target genes, which are inhibited by VGAM RNAs comprised in the 'operon-like' cluster of VGR3202 gene: VGAM2221 host target protein, VGAM2222 host target protein, VGAM2223 host target protein, VGAM2224 host target protein, VGAM2225 host target protein, VGAM2226 host target protein, VGAM2227 host target protein and VGAM2228 host target protein, herein schematically represented by VGAM1 HOST TARGET PROTEIN through VGAM3 HOST TARGET PROTEIN. The function of these host target genes is elaborated hereinabove with reference to VGAM2221, VGAM2222, VGAM2223, VGAM2224, VGAM2225, VGAM2226, VGAM2227 and VGAM2228. FIG. 9 further provides a conceptual description of novel bioinformatically detected regulatory viral gene, referred to here as Viral Genomic Record 3203(VGR3203) viral gene, which encodes an 'operon-like' cluster of novel viral micro RNA-like genes, each of which in turn modulates expression of at least one host target gene, the function and utility of which at least one host target gene is known in the art.

VGR3203 gene, herein designated VGR GENE, is a novel bioinformatically detected regulatory, non protein coding, RNA viral gene. The method by which VGR3203 gene was detected is described hereinabove with reference to FIGS. 1-9.

VGR3203 gene encodes VGR3203 precursor RNA, herein designated VGR PRECURSOR RNA, an RNA molecule, typically several hundred nucleotides long.

VGR3203 precursor RNA folds spatially, forming VGR3203 folded precursor RNA, herein designated VGR FOLDED PRECURSOR RNA. It is appreciated that VGR3203 folded precursor RNA comprises a plurality of what is known in the art as 'hairpin' structures. These 'hairpin' structures are due to the fact that the nucleotide sequence of VGR3203 precursor RNA comprises a plurality of segments, the first half of each such segment having a nucleotide sequence which is at least a partial inversed-reversed sequence of the second half thereof, as is well known in the art.

VGR3203 folded precursor RNA is naturally processed by cellular enzymatic activity into at least 3 separate VGAM precursor RNAs, VGAM2229 precursor RNA, VGAM2230 precursor RNA and VGAM2231 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2229 RNA, VGAM2230 RNA and VGAM2231 RNA, herein schematically represented by VGAM1 RNA through VGAM3 RNA, each of which VGAM RNAs corresponding to VGAM RNA of FIG. 1.

VGAM2229 RNA, herein schematically represented by VGAM1 RNA through VGAM3 RNA, binds complementarily to a host target binding site located in an untranslated region of VGAM2229 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2229 host target RNA into VGAM2229 host target protein, herein schematically represented by VGAM1 HOST TARGET PROTEIN through VGAM3 HOST TARGET PROTEIN, all of FIG. 1.

VGAM2230 RNA, herein schematically represented by VGAM1 RNA through VGAM3 RNA, binds complementarily to a host target binding site located in an untranslated region of VGAM2230 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2230 host target RNA into VGAM2230 host target protein, herein schematically represented by VGAM1 HOST TARGET PROTEIN through VGAM3 HOST TARGET PROTEIN, all of FIG. 1.

VGAM2231 RNA, herein schematically represented by VGAM1 RNA through VGAM3 RNA, binds complementarily to a host target binding site located in an untranslated region of VGAM2231 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2231 host target RNA into VGAM2231 host target protein, herein schematically represented by VGAM1 HOST TARGET PROTEIN through VGAM3 HOST TARGET PROTEIN, all of FIG. 1.

It is appreciated that a function of VGR3203 gene, herein designated VGR GENE, is inhibition of expression of host target genes, as part of a novel viral mechanism of attacking a host. Accordingly, utilities of VGR3203 gene include diagnosis, prevention and treatment of viral infection by Potato Aucuba Mosaic Virus. Specific functions, and accordingly utilities, of VGR3203 gene correlate with, and may be deduced from, the identity of the host target genes, which are inhibited by VGAM RNAs comprised in the 'operon-like' cluster of VGR3203 gene: VGAM2229 host target protein, VGAM2230 host target protein and VGAM2231 host target protein, herein schematically represented by VGAM1 HOST TARGET PROTEIN through VGAM3 HOST TARGET PROTEIN. The function of these host target genes is elaborated hereinabove with reference to VGAM2229, VGAM2230 and VGAM2231. FIG. 9 further provides a conceptual description of novel bioinformatically detected regulatory viral gene, referred to here as Viral Genomic Record 3204(VGR3204) viral gene, which encodes an 'operon-like' cluster of novel viral micro RNA-like genes, each of which in turn modulates expression of at least one host target gene, the function and utility of which at least one host target gene is known in the art.

VGR3204 gene, herein designated VGR GENE, is a novel bioinformatically detected regulatory, non protein coding, RNA viral gene. The method by which VGR3204 gene was detected is described hereinabove with reference to FIGS. 1-9.

VGR3204 gene encodes VGR3204 precursor RNA, herein designated VGR PRECURSOR RNA, an RNA molecule, typically several hundred nucleotides long.

VGR3204 precursor RNA folds spatially, forming VGR3204 folded precursor RNA, herein designated VGR FOLDED PRECURSOR RNA. It is appreciated that VGR3204 folded precursor RNA comprises a plurality of what is known in the art as 'hairpin' structures. These 'hairpin' structures are due to the fact that the nucleotide sequence of VGR3204 precursor RNA comprises a plurality of segments, the first half of each such segment having a nucleotide sequence which is at least a partial inversed-reversed sequence of the second half thereof, as is well known in the art.

VGR3204 folded precursor RNA is naturally processed by cellular enzymatic activity into at least 8 separate VGAM precursor RNAs, VGAM2232 precursor RNA, VGAM2233 precursor RNA, VGAM2234 precursor RNA, VGAM2235 precursor RNA, VGAM2236 precursor RNA, VGAM2237 precursor RNA, VGAM2238 precursor RNA and VGAM2239 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2232 RNA, VGAM2233 RNA, VGAM2234 RNA, VGAM2235 RNA, VGAM2236 RNA, VGAM2237 RNA, VGAM2238 RNA and VGAM2239 RNA, herein schematically represented by VGAM1 RNA through VGAM3 RNA, each of which VGAM RNAs corresponding to VGAM RNA of FIG. 1.

VGAM2232 RNA, herein schematically represented by VGAM1 RNA through VGAM3 RNA, binds complementarily to a host target binding site located in an untranslated region of VGAM2232 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM2232 host target RNA into VGAM2232 host target protein, herein schematically represented by VGAM1 HOST TARGET PROTEIN through VGAM3 HOST TARGET PROTEIN, all of FIG. 1.

VGAM2233 RNA, herein schematically represented by VGAM1 RNA through VGAM3 RNA, binds complementarily to a host target binding site located in an untranslated region of VGAM2233 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2233 host target RNA into VGAM2233 host target protein, herein schematically represented by VGAM1 HOST TARGET PROTEIN through VGAM3 HOST TARGET PROTEIN, all of FIG. 1.

VGAM2234 RNA, herein schematically represented by VGAM1 RNA through VGAM3 RNA, binds complementarily to a host target binding site located in an untranslated region of VGAM2234 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2234 host target RNA into VGAM2234 host target protein, herein schematically represented by VGAM1 HOST TARGET PROTEIN through VGAM3 HOST TARGET PROTEIN, all of FIG. 1.

VGAM2235 RNA, herein schematically represented by VGAM1 RNA through VGAM3 RNA, binds complementarily to a host target binding site located in an untranslated region of VGAM2235 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2235 host target RNA into VGAM2235 host target protein, herein schematically represented by VGAM1 HOST TARGET PROTEIN through VGAM3 HOST TARGET PROTEIN, all of FIG. 1.

VGAM2236 RNA, herein schematically represented by VGAM1 RNA through VGAM3 RNA, binds complementarily to a host target binding site located in an untranslated region of VGAM2236 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2236 host target RNA into VGAM2236 host target protein, herein schematically represented by VGAM1 HOST TARGET PROTEIN through VGAM3 HOST TARGET PROTEIN, all of FIG. 1.

VGAM2237 RNA, herein schematically represented by VGAM1 RNA through VGAM3 RNA, binds complementarily to a host target binding site located in an untranslated region of VGAM2237 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2237 host target RNA into VGAM2237 host target protein, herein schematically represented by VGAM1 HOST TARGET PROTEIN through VGAM3 HOST TARGET PROTEIN, all of FIG. 1.

VGAM2238 RNA, herein schematically represented by VGAM1 RNA through VGAM3 RNA, binds complementarily to a host target binding site located in an untranslated region of VGAM2238 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2238 host target RNA into VGAM2238 host target protein, herein schematically represented by VGAM1 HOST TARGET PROTEIN through VGAM3 HOST TARGET PROTEIN, all of FIG. 1.

VGAM2239 RNA, herein schematically represented by VGAM1 RNA through VGAM3 RNA, binds complementarily to a host target binding site located in an untranslated region of VGAM2239 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2239 host target RNA into VGAM2239 host target protein, herein schematically represented by VGAM1 HOST TARGET PROTEIN through VGAM3 HOST TARGET PROTEIN, all of FIG. 1.

It is appreciated that a function of VGR3204 gene, herein designated VGR GENE, is inhibition of expression of host target genes, as part of a novel viral mechanism of attacking a host. Accordingly, utilities of VGR3204 gene include diagnosis, prevention and treatment of viral infection by Porcine Epidemic Diarrhea Virus. Specific functions, and accordingly utilities, of VGR3204 gene correlate with, and may be deduced from, the identity of the host target genes, which are inhibited by VGAM RNAs comprised in the 'operon-like' cluster of VGR3204 gene: VGAM2232 host target protein, VGAM2233 host target protein, VGAM2234 host target protein, VGAM2235 host target protein, VGAM2236 host target protein, VGAM2237 host target protein, VGAM2238 host target protein and VGAM2239 host target protein, herein schematically represented by VGAM1 HOST TARGET PROTEIN through VGAM3 HOST TARGET PROTEIN. The function of these host target genes is elaborated hereinabove with reference to VGAM2232, VGAM2233, VGAM2234, VGAM2235, VGAM2236, VGAM2237, VGAM2238 and VGAM2239. FIG. 9 further provides a conceptual description of novel bioinformatically detected regulatory viral gene, referred to here as Viral Genomic Record 3205(VGR3205) viral gene, which encodes an 'operon-like' cluster of novel viral micro RNA-like genes, each of which in turn modulates expression of at least one host target gene, the function and utility of which at least one host target gene is known in the art.

VGR3205 gene, herein designated VGR GENE, is a novel bioinformatically detected regulatory, non protein coding, RNA viral gene. The method by which VGR3205 gene was detected is described hereinabove with reference to FIGS. 1-9.

VGR3205 gene encodes VGR3205 precursor RNA, herein designated VGR PRECURSOR RNA, an RNA molecule, typically several hundred nucleotides long.

VGR3205 precursor RNA folds spatially, forming VGR3205 folded precursor RNA, herein designated VGR FOLDED PRECURSOR RNA. It is appreciated that VGR3205 folded precursor RNA comprises a plurality of what is known in the art as 'hairpin' structures. These 'hairpin' structures are due to the fact that the nucleotide sequence of VGR3205 precursor RNA comprises a plurality of segments, the first half of each such segment having a nucleotide sequence which is at least a partial inversed-reversed sequence of the second half thereof, as is well known in the art.

VGR3205 folded precursor RNA is naturally processed by cellular enzymatic activity into at least 7 separate VGAM precursor RNAs, VGAM2240 precursor RNA, VGAM2241 precursor RNA, VGAM2242 precursor RNA, VGAM2243 precursor RNA, VGAM2244 precursor RNA, VGAM2245 precursor RNA and VGAM2246 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2240 RNA, VGAM2241 RNA, VGAM2242 RNA, VGAM2243 RNA, VGAM2244 RNA, VGAM2245 RNA and VGAM2246 RNA, herein schematically represented by VGAM1 RNA through VGAM3 RNA, each of which VGAM RNAs corresponding to VGAM RNA of FIG. 1.

VGAM2240 RNA, herein schematically represented by VGAM1 RNA through VGAM3 RNA, binds complementarily to a host target binding site located in an untranslated region of VGAM2240 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2240 host target RNA into VGAM2240 host target protein, herein schematically represented by VGAM1 HOST TARGET PROTEIN through VGAM3 HOST TARGET PROTEIN, all of FIG. 1.

VGAM2241 RNA, herein schematically represented by VGAM1 RNA through VGAM3 RNA, binds complementarily to a host target binding site located in an untranslated region of VGAM2241 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2241 host target RNA into VGAM2241 host target protein, herein schematically represented by VGAM1 HOST TARGET PROTEIN through VGAM3 HOST TARGET PROTEIN, all of FIG. 1.

VGAM2242 RNA, herein schematically represented by VGAM1 RNA through VGAM3 RNA, binds complementarily to a host target binding site located in an untranslated region of VGAM2242 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2242 host target RNA into VGAM2242 host target protein, herein schematically represented by VGAM1 HOST TARGET PROTEIN through VGAM3 HOST TARGET PROTEIN, all of FIG. 1.

VGAM2243 RNA, herein schematically represented by VGAM1 RNA through VGAM3 RNA, binds complementarily to a host target binding site located in an untranslated region of VGAM2243 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2243 host target RNA into VGAM2243 host target protein, herein schematically represented by VGAM1 HOST TARGET PROTEIN through VGAM3 HOST TARGET PROTEIN, all of FIG. 1.

VGAM2244 RNA, herein schematically represented by VGAM1 RNA through VGAM3 RNA, binds complementarily to a host target binding site located in an untranslated region of VGAM2244 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2244 host target RNA into VGAM2244 host target protein, herein schematically represented by VGAM1 HOST TARGET PROTEIN through VGAM3 HOST TARGET PROTEIN, all of FIG. 1.

VGAM2245 RNA, herein schematically represented by VGAM1 RNA through VGAM3 RNA, binds complementarily to a host target binding site located in an untranslated region of VGAM2245 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2245 host target RNA into VGAM2245 host target protein, herein schematically represented by VGAM1 HOST TARGET PROTEIN through VGAM3 HOST TARGET PROTEIN, all of FIG. 1.

VGAM2246 RNA, herein schematically represented by VGAM1 RNA through VGAM3 RNA, binds complementarily to a host target binding site located in an untranslated region of VGAM2246 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2246 host target RNA into VGAM2246 host target protein, herein schematically represented by VGAM1 HOST TARGET PROTEIN through VGAM3 HOST TARGET PROTEIN, all of FIG. 1.

It is appreciated that a function of VGR3205 gene, herein designated VGR GENE, is inhibition of expression of host target genes, as part of a novel viral mechanism of attacking a host. Accordingly, utilities of VGR3205 gene include diagnosis, prevention and treatment of viral infection by Porcine Epidemic Diarrhea Virus. Specific functions, and accordingly utilities, of VGR3205 gene correlate with, and may be deduced from, the identity of the host target genes, which are inhibited by VGAM RNAs comprised in the 'operon-like' cluster of VGR3205 gene: VGAM2240 host target protein, VGAM2241 host target protein, VGAM2242 host target protein, VGAM2243 host target protein, VGAM2244 host target protein, VGAM2245 host target protein and VGAM2246 host target protein, herein schematically represented by VGAM1 HOST TARGET PROTEIN through VGAM3 HOST TARGET PROTEIN. The function of these host target genes is elaborated hereinabove with reference to VGAM2240, VGAM2241, VGAM2242, VGAM2243, VGAM2244, VGAM2245 and VGAM2246. FIG. 9 further provides a conceptual description of novel bioinformatically detected regulatory viral gene, referred to here as Viral Genomic Record 3206(VGR3206) viral gene, which encodes an 'operon-like' cluster of novel viral micro RNA-like genes, each of which in turn modulates expression of at least one host target gene, the function and utility of which at least one host target gene is known in the art.

VGR3206 gene, herein designated VGR GENE, is a novel bioinformatically detected regulatory, non protein coding, RNA viral gene. The method by which VGR3206 gene was detected is described hereinabove with reference to FIGS. 1-9.

VGR3206 gene encodes VGR3206 precursor RNA, herein designated VGR PRECURSOR RNA, an RNA molecule, typically several hundred nucleotides long.

VGR3206 precursor RNA folds spatially, forming VGR3206 folded precursor RNA, herein designated VGR FOLDED PRECURSOR RNA. It is appreciated that VGR3206 folded precursor RNA comprises a plurality of what is known in the art as 'hairpin' structures. These 'hairpin' structures are due to the fact that the nucleotide sequence of VGR3206 precursor RNA comprises a plurality of segments, the first half of each such segment having a nucleotide sequence which is at least a partial inversed-reversed sequence of the second half thereof, as is well known in the art.

VGR3206 folded precursor RNA is naturally processed by cellular enzymatic activity into at least 7 separate VGAM precursor RNAs, VGAM2247 precursor RNA, VGAM2248 precursor RNA, VGAM2249 precursor RNA, VGAM2250 precursor RNA, VGAM2251 precursor RNA, VGAM2252 precursor RNA and VGAM2253 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2247 RNA, VGAM2248 RNA, VGAM2249 RNA, VGAM2250 RNA, VGAM2251 RNA, VGAM2252 RNA and VGAM2253 RNA, herein schematically represented by VGAM1 RNA through VGAM3 RNA, each of which VGAM RNAs corresponding to VGAM RNA of FIG. 1.

VGAM2247 RNA, herein schematically represented by VGAM1 RNA through VGAM3 RNA, binds complementarily to a host target binding site located in an untranslated region of VGAM2247 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2247 host target RNA into VGAM2247 host target protein, herein schematically represented by VGAM1 HOST TARGET PROTEIN through VGAM3 HOST TARGET PROTEIN, all of FIG. 1.

VGAM2248 RNA, herein schematically represented by VGAM1 RNA through VGAM3 RNA, binds complementarily to a host target binding site located in an untranslated region of VGAM2248 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2248 host target RNA into VGAM2248 host target protein, herein schematically represented by VGAM1 HOST TARGET PROTEIN through VGAM3 HOST TARGET PROTEIN, all of FIG. 1.

VGAM2249 RNA, herein schematically represented by VGAM1 RNA through VGAM3 RNA, binds complementarily to a host target binding site located in an untranslated region of VGAM2249 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2249 host target RNA into VGAM2249 host target protein, herein schematically represented by VGAM1 HOST TARGET PROTEIN through VGAM3 HOST TARGET PROTEIN, all of FIG. 1.

VGAM2250 RNA, herein schematically represented by VGAM1 RNA through VGAM3 RNA, binds complementarily to a host target binding site located in an untranslated region of VGAM2250 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2250 host target RNA into VGAM2250 host target protein, herein schematically represented by VGAM1 HOST TARGET PROTEIN through VGAM3 HOST TARGET PROTEIN, all of FIG. 1.

VGAM2251 RNA, herein schematically represented by VGAM1 RNA through VGAM3 RNA, binds complementarily to a host target binding site located in an untranslated region of VGAM2251 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2251 host target RNA into VGAM2251 host target protein, herein schematically represented by VGAM1 HOST TARGET PROTEIN through VGAM3 HOST TARGET PROTEIN, all of FIG. 1.

VGAM2252 RNA, herein schematically represented by VGAM1 RNA through VGAM3 RNA, binds complementarily to a host target binding site located in an untranslated region of VGAM2252 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2252 host target RNA into VGAM2252 host target protein, herein schematically represented by VGAM1 HOST TARGET PROTEIN through VGAM3 HOST TARGET PROTEIN, all of FIG. 1.

VGAM2253 RNA, herein schematically represented by VGAM1 RNA through VGAM3 RNA, binds complementarily to a host target binding site located in an untranslated region of VGAM2253 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2253 host target RNA into VGAM2253 host target protein, herein schematically represented by VGAM1 HOST TARGET PROTEIN through VGAM3 HOST TARGET PROTEIN, all of FIG. 1.

It is appreciated that a function of VGR3206 gene, herein designated VGR GENE, is inhibition of expression of host target genes, as part of a novel viral mechanism of attacking a host. Accordingly, utilities of VGR3206 gene include diagnosis, prevention and treatment of viral infection by Transmissible Gastroenteritis Virus. Specific functions, and accordingly utilities, of VGR3206 gene correlate with, and may be deduced from, the identity of the host target genes, which are inhibited by VGAM RNAs comprised in the 'operon-like' cluster of VGR3206 gene: VGAM2247 host target protein, VGAM2248 host target protein, VGAM2249 host target protein, VGAM2250 host target protein, VGAM2251 host target protein, VGAM2252 host target protein and VGAM2253 host target protein, herein schematically represented by VGAM1 HOST TARGET PROTEIN through VGAM3 HOST TARGET PROTEIN. The function of these host target genes is elaborated hereinabove with reference to VGAM2247, VGAM2248, VGAM2249, VGAM2250, VGAM2251, VGAM2252 and VGAM2253. FIG. 9 further provides a conceptual description of novel bioinformatically detected regulatory viral gene, referred to here as Viral Genomic Record 3207(VGR3207) viral gene, which encodes an 'operon-like' cluster of novel viral micro RNA-like genes, each of which in turn modulates expression of at least one host target gene, the function and utility of which at least one host target gene is known in the art.

VGR3207 gene, herein designated VGR GENE, is a novel bioinformatically detected regulatory, non protein coding, RNA viral gene. The method by which VGR3207 gene was detected is described hereinabove with reference to FIGS. 1-9.

VGR3207 gene encodes VGR3207 precursor RNA, herein designated VGR PRECURSOR RNA, an RNA molecule, typically several hundred nucleotides long.

VGR3207 precursor RNA folds spatially, forming VGR3207 folded precursor RNA, herein designated VGR FOLDED PRECURSOR RNA. It is appreciated that VGR3207 folded precursor RNA comprises a plurality of what is known in the art as 'hairpin' structures. These 'hairpin' structures are due to the fact that the nucleotide sequence of VGR3207 precursor RNA comprises a plurality of segments, the first half of each such segment having a nucleotide sequence which is at least a partial inversed-reversed sequence of the second half thereof, as is well known in the art.

VGR3207 folded precursor RNA is naturally processed by cellular enzymatic activity into at least 2 separate VGAM precursor RNAs, VGAM2254 precursor RNA and VGAM2255 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2254 RNA and VGAM2255 RNA, herein schematically represented by VGAM1 RNA through VGAM3 RNA, each of which VGAM RNAs corresponding to VGAM RNA of FIG. 1.

VGAM2254 RNA, herein schematically represented by VGAM1 RNA through VGAM3 RNA, binds complementarily to a host target binding site located in an untranslated region of VGAM2254 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2254 host target RNA into VGAM2254 host target protein, herein schematically represented by VGAM1 HOST TARGET PROTEIN through VGAM3 HOST TARGET PROTEIN, all of FIG. 1.

VGAM2255 RNA, herein schematically represented by VGAM1 RNA through VGAM3 RNA, binds complementarily to a host target binding site located in an untranslated region of VGAM2255 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2255 host target RNA into VGAM2255 host target protein, herein schematically represented by VGAM1 HOST TARGET PROTEIN through VGAM3 HOST TARGET PROTEIN, all of FIG. 1.

It is appreciated that a function of VGR3207 gene, herein designated VGR GENE, is inhibition of expression of host target genes, as part of a novel viral mechanism of attacking a host. Accordingly, utilities of VGR3207 gene include diagnosis, prevention and treatment of viral infection by Transmissible Gastroenteritis Virus. Specific functions, and accordingly utilities, of VGR3207 gene correlate with, and may be deduced from, the identity of the host target genes, which are inhibited by VGAM RNAs comprised in the 'operon-like' cluster of VGR3207 gene: VGAM2254 host target protein and VGAM2255 host target protein, herein schematically represented by VGAM1 HOST TARGET PROTEIN through VGAM3 HOST TARGET PROTEIN. The function of these host target genes is elaborated hereinabove with reference to VGAM2254 and VGAM2255. FIG. 9 further provides a conceptual description of novel bioinformatically detected regulatory viral gene, referred to here as Viral Genomic Record 3208(VGR3208) viral gene, which encodes an 'operon-like' cluster of novel viral micro RNA-like genes, each of which in turn modulates expression of at least one host target gene, the function and utility of which at least one host target gene is known in the art.

VGR3208 gene, herein designated VGR GENE, is a novel bioinformatically detected regulatory, non protein coding, RNA viral gene. The method by which VGR3208 gene was detected is described hereinabove with reference to FIGS. 1-9.

VGR3208 gene encodes VGR3208 precursor RNA, herein designated VGR PRECURSOR RNA, an RNA molecule, typically several hundred nucleotides long.

VGR3208 precursor RNA folds spatially, forming VGR3208 folded precursor RNA, herein designated VGR FOLDED PRECURSOR RNA. It is appreciated that VGR3208 folded precursor RNA comprises a plurality of what is known in the art as 'hairpin' structures. These 'hairpin' structures are due to the fact that the nucleotide sequence of VGR3208 precursor RNA comprises a plurality of segments, the first half of each such segment having a nucleotide sequence which is at least a partial inversed-reversed sequence of the second half thereof, as is well known in the art.

VGR3208 folded precursor RNA is naturally processed by cellular enzymatic activity into at least 3 separate VGAM precursor RNAs, VGAM2256 precursor RNA, VGAM2257 precursor RNA and VGAM2258 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2256 RNA, VGAM2257 RNA and VGAM2258 RNA, herein schematically represented by VGAM1 RNA through VGAM3 RNA, each of which VGAM RNAs corresponding to VGAM RNA of FIG. 1.

VGAM2256 RNA, herein schematically represented by VGAM1 RNA through VGAM3 RNA, binds complementarily to a host target binding site located in an untranslated region of VGAM2256 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM2256 host target RNA into VGAM2256 host target protein, herein schematically represented by VGAM1 HOST TARGET PROTEIN through VGAM3 HOST TARGET PROTEIN, all of FIG. 1.

VGAM2257 RNA, herein schematically represented by VGAM1 RNA through VGAM3 RNA, binds complementarily to a host target binding site located in an untranslated region of VGAM2257 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2257 host target RNA into VGAM2257 host target protein, herein schematically represented by VGAM1 HOST TARGET PROTEIN through VGAM3 HOST TARGET PROTEIN, all of FIG. 1.

VGAM2258 RNA, herein schematically represented by VGAM1 RNA through VGAM3 RNA, binds complementarily to a host target binding site located in an untranslated region of VGAM2258 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2258 host target RNA into VGAM2258 host target protein, herein schematically represented by VGAM1 HOST TARGET PROTEIN through VGAM3 HOST TARGET PROTEIN, all of FIG. 1.

It is appreciated that a function of VGR3208 gene, herein designated VGR GENE, is inhibition of expression of host target genes, as part of a novel viral mechanism of attacking a host. Accordingly, utilities of VGR3208 gene include diagnosis, prevention and treatment of viral infection by Oat Chlorotic Stunt Virus. Specific functions, and accordingly utilities, of VGR3208 gene correlate with, and may be deduced from, the identity of the host target genes, which are inhibited by VGAM RNAs comprised in the 'operon-like' cluster of VGR3208 gene: VGAM2256 host target protein, VGAM2257 host target protein and VGAM2258 host target protein, herein schematically represented by VGAM1 HOST TARGET PROTEIN through VGAM3 HOST TARGET PROTEIN. The function of these host target genes is elaborated hereinabove with reference to VGAM2256, VGAM2257 and VGAM2258. FIG. 9 further provides a conceptual description of novel bioinformatically detected regulatory viral gene, referred to here as Viral Genomic Record 3209(VGR3209) viral gene, which encodes an 'operon-like' cluster of novel viral micro RNA-like genes, each of which in turn modulates expression of at least one host target gene, the function and utility of which at least one host target gene is known in the art.

VGR3209 gene, herein designated VGR GENE, is a novel bioinformatically detected regulatory, non protein coding, RNA viral gene. The method by which VGR3209 gene was detected is described hereinabove with reference to FIGS. 1-9.

VGR3209 gene encodes VGR3209 precursor RNA, herein designated VGR PRECURSOR RNA, an RNA molecule, typically several hundred nucleotides long.

VGR3209 precursor RNA folds spatially, forming VGR3209 folded precursor RNA, herein designated VGR FOLDED PRECURSOR RNA. It is appreciated that VGR3209 folded precursor RNA comprises a plurality of what is known in the art as 'hairpin' structures. These 'hairpin' structures are due to the fact that the nucleotide sequence of VGR3209 precursor RNA comprises a plurality of segments, the first half of each such segment having a nucleotide sequence which is at least a partial inversed-reversed sequence of the second half thereof, as is well known in the art.

VGR3209 folded precursor RNA is naturally processed by cellular enzymatic activity into at least 8 separate VGAM precursor RNAs, VGAM2259 precursor RNA, VGAM2260 precursor RNA, VGAM2261 precursor RNA, VGAM2262 precursor RNA, VGAM2263 precursor RNA, VGAM2264 precursor RNA, VGAM2265 precursor RNA and VGAM2266 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2259 RNA, VGAM2260 RNA, VGAM2261 RNA, VGAM2262 RNA, VGAM2263 RNA, VGAM2264 RNA, VGAM2265 RNA and VGAM2266 RNA, herein schematically represented by VGAM1 RNA through VGAM3 RNA, each of which VGAM RNAs corresponding to VGAM RNA of FIG. 1.

VGAM2259 RNA, herein schematically represented by VGAM1 RNA through VGAM3 RNA, binds complementarily to a host target binding site located in an untranslated region of VGAM2259 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2259 host target RNA into VGAM2259 host target protein, herein schematically represented by VGAM1 HOST TARGET PROTEIN through VGAM3 HOST TARGET PROTEIN, all of FIG. 1.

VGAM2260 RNA, herein schematically represented by VGAM1 RNA through VGAM3 RNA, binds complementarily to a host target binding site located in an untranslated region of VGAM2260 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2260 host target RNA into VGAM2260 host target protein, herein schematically represented by VGAM1 HOST TARGET PROTEIN through VGAM3 HOST TARGET PROTEIN, all of FIG. 1.

VGAM2261 RNA, herein schematically represented by VGAM1 RNA through VGAM3 RNA, binds complementarily to a host target binding site located in an untranslated region of VGAM2261 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2261 host target RNA into VGAM2261 host target protein, herein schematically represented by VGAM1 HOST TARGET PROTEIN through VGAM3 HOST TARGET PROTEIN, all of FIG. 1.

VGAM2262 RNA, herein schematically represented by VGAM1 RNA through VGAM3 RNA, binds complementarily to a host target binding site located in an untranslated region of VGAM2262 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2262 host target RNA into VGAM2262 host target protein, herein schematically represented by VGAM1 HOST TARGET PROTEIN through VGAM3 HOST TARGET PROTEIN, all of FIG. 1.

VGAM2263 RNA, herein schematically represented by VGAM1 RNA through VGAM3 RNA, binds complementarily to a host target binding site located in an untranslated region of VGAM2263 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2263 host target RNA into VGAM2263 host target protein, herein schematically represented by VGAM1 HOST TARGET PROTEIN through VGAM3 HOST TARGET PROTEIN, all of FIG. 1.

VGAM2264 RNA, herein schematically represented by VGAM1 RNA through VGAM3 RNA, binds complementarily to a host target binding site located in an untranslated region of VGAM2264 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2264 host target RNA into VGAM2264 host target protein, herein schematically represented by VGAM1 HOST TARGET PROTEIN through VGAM3 HOST TARGET PROTEIN, all of FIG. 1.

VGAM2265 RNA, herein schematically represented by VGAM1 RNA through VGAM3 RNA, binds complementarily to a host target binding site located in an untranslated region of VGAM2265 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2265 host target RNA into VGAM2265 host target protein, herein schematically represented by VGAM1 HOST TARGET PROTEIN through VGAM3 HOST TARGET PROTEIN, all of FIG. 1.

VGAM2266 RNA, herein schematically represented by VGAM1 RNA through VGAM3 RNA, binds complementarily to a host target binding site located in an untranslated region of VGAM2266 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2266 host target RNA into VGAM2266 host target protein, herein schematically represented by VGAM1 HOST TARGET PROTEIN through VGAM3 HOST TARGET PROTEIN, all of FIG. 1.

It is appreciated that a function of VGR3209 gene, herein designated VGR GENE, is inhibition of expression of host target genes, as part of a novel viral mechanism of attacking a host. Accordingly, utilities of VGR3209 gene include diagnosis, prevention and treatment of viral infection by Alcelaphine Herpesvirus 1. Specific functions, and accordingly utilities, of VGR3209 gene correlate with, and may be deduced from, the identity of the host target genes, which are inhibited by VGAM RNAs comprised in the 'operon-like' cluster of VGR3209 gene: VGAM2259 host target protein, VGAM2260 host target protein, VGAM2261 host target protein, VGAM2262 host target protein, VGAM2263 host target protein, VGAM2264 host target protein, VGAM2265 host target protein and VGAM2266 host target protein, herein schematically represented by VGAM1 HOST TARGET PROTEIN through VGAM3 HOST TARGET PROTEIN. The function of these host target genes is elaborated hereinabove with reference to VGAM2259, VGAM2260, VGAM2261, VGAM2262, VGAM2263, VGAM2264, VGAM2265 and VGAM2266. FIG. 9 further provides a conceptual description of novel bioinformatically detected regulatory viral gene, referred to here as Viral Genomic Record 3210(VGR3210) viral gene, which encodes an 'operon-like' cluster of novel viral micro RNA-like genes, each of which in turn modulates expression of at least one host target gene, the function and utility of which at least one host target gene is known in the art.

VGR3210 gene, herein designated VGR GENE, is a novel bioinformatically detected regulatory, non protein coding, RNA viral gene. The method by which VGR3210 gene was detected is described hereinabove with reference to FIGS. 1-9.

VGR3210 gene encodes VGR3210 precursor RNA, herein designated VGR PRECURSOR RNA, an RNA molecule, typically several hundred nucleotides long.

VGR3210 precursor RNA folds spatially, forming VGR3210 folded precursor RNA, herein designated VGR FOLDED PRECURSOR RNA. It is appreciated that VGR3210 folded precursor RNA comprises a plurality of what is known in the art as 'hairpin' structures. These 'hairpin' structures are due to the fact that the nucleotide sequence of VGR3210 precursor RNA comprises a plurality of segments, the first half of each such segment having a nucleotide sequence which is at least a partial inversed-reversed sequence of the second half thereof, as is well known in the art.

VGR3210 folded precursor RNA is naturally processed by cellular enzymatic activity into at least 8 separate VGAM precursor RNAs, VGAM2267 precursor RNA, VGAM2268 precursor RNA, VGAM2269 precursor RNA, VGAM2270 precursor RNA, VGAM2271 precursor RNA, VGAM2272 precursor RNA, VGAM2273 precursor RNA and VGAM2274 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2267 RNA, VGAM2268 RNA, VGAM2269 RNA, VGAM2270 RNA, VGAM2271 RNA, VGAM2272 RNA, VGAM2273 RNA and VGAM2274 RNA, herein schematically represented by VGAM1 RNA through VGAM3 RNA, each of which VGAM RNAs corresponding to VGAM RNA of FIG. 1.

VGAM2267 RNA, herein schematically represented by VGAM1 RNA through VGAM3 RNA, binds complementarily to a host target binding site located in an untranslated region of VGAM2267 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2267 host target RNA into VGAM2267 host target protein, herein schematically represented by VGAM1 HOST TARGET PROTEIN through VGAM3 HOST TARGET PROTEIN, all of FIG. 1.

VGAM2268 RNA, herein schematically represented by VGAM1 RNA through VGAM3 RNA, binds complementarily to a host target binding site located in an untranslated region of VGAM2268 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2268 host target RNA into VGAM2268 host target protein, herein schematically represented by VGAM1 HOST TARGET PROTEIN through VGAM3 HOST TARGET PROTEIN, all of FIG. 1.

VGAM2269 RNA, herein schematically represented by VGAM1 RNA through VGAM3 RNA, binds complementarily to a host target binding site located in an untranslated region of VGAM2269 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2269 host target RNA into VGAM2269 host target protein, herein schematically represented by VGAM1 HOST TARGET PROTEIN through VGAM3 HOST TARGET PROTEIN, all of FIG. 1.

VGAM2270 RNA, herein schematically represented by VGAM1 RNA through VGAM3 RNA, binds complementarily to a host target binding site located in an untranslated region of VGAM2270 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2270 host target RNA into VGAM2270 host target protein, herein schematically represented by VGAM1 HOST TARGET PROTEIN through VGAM3 HOST TARGET PROTEIN, all of FIG. 1.

VGAM2271 RNA, herein schematically represented by VGAM1 RNA through VGAM3 RNA, binds complementarily to a host target binding site located in an untranslated region of VGAM2271 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2271 host target RNA into VGAM2271 host target protein, herein schematically represented by VGAM1 HOST TARGET PROTEIN through VGAM3 HOST TARGET PROTEIN, all of FIG. 1.

VGAM2272 RNA, herein schematically represented by VGAM1 RNA through VGAM3 RNA, binds complementarily to a host target binding site located in an untranslated region of VGAM2272 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2272 host target RNA into VGAM2272 host target protein, herein schematically represented by VGAM1 HOST TARGET PROTEIN through VGAM3 HOST TARGET PROTEIN, all of FIG. 1.

VGAM2273 RNA, herein schematically represented by VGAM1 RNA through VGAM3 RNA, binds complementarily to a host target binding site located in an untranslated region of VGAM2273 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2273 host target RNA into VGAM2273 host target protein, herein schematically represented by VGAM1 HOST TARGET PROTEIN through VGAM3 HOST TARGET PROTEIN, all of FIG. 1.

VGAM2274 RNA, herein schematically represented by VGAM1 RNA through VGAM3 RNA, binds complementarily to a host target binding site located in an untranslated region of VGAM2274 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2274 host target RNA into VGAM2274 host target protein, herein schematically represented by VGAM1 HOST TARGET PROTEIN through VGAM3 HOST TARGET PROTEIN, all of FIG. 1.

It is appreciated that a function of VGR3210 gene, herein designated VGR GENE, is inhibition of expression of host target genes, as part of a novel viral mechanism of attacking a host. Accordingly, utilities of VGR3210 gene include diagnosis, prevention and treatment of viral infection by Alcelaphine Herpesvirus 1. Specific functions, and accordingly utilities, of VGR3210 gene correlate with, and may be deduced from, the identity of the host target genes, which are inhibited by VGAM RNAs comprised in the 'operon-like' cluster of VGR3210 gene: VGAM2267 host target protein, VGAM2268 host target protein, VGAM2269 host target protein, VGAM2270 host target protein, VGAM2271 host target protein, VGAM2272 host target protein, VGAM2273 host target protein and VGAM2274 host target protein, herein schematically represented by VGAM1 HOST TARGET PROTEIN through VGAM3 HOST TARGET PROTEIN. The function of these host target genes is elaborated hereinabove with reference to VGAM2267, VGAM2268, VGAM2269, VGAM2270, VGAM2271, VGAM2272, VGAM2273 and VGAM2274. FIG. 9 further provides a conceptual description of novel bioinformatically detected regulatory viral gene, referred to here as Viral Genomic Record 3211(VGR3211) viral gene, which encodes an 'operon-like' cluster of novel viral micro RNA-like genes, each of which in turn modulates expression of at least one host target gene, the function and utility of which at least one host target gene is known in the art.

VGR3211 gene, herein designated VGR GENE, is a novel bioinformatically detected regulatory, non protein coding, RNA viral gene. The method by which VGR3211 gene was detected is described hereinabove with reference to FIGS. 1-9.

VGR3211 gene encodes VGR3211 precursor RNA, herein designated VGR PRECURSOR RNA, an RNA molecule, typically several hundred nucleotides long.

VGR3211 precursor RNA folds spatially, forming VGR3211 folded precursor RNA, herein designated VGR FOLDED PRECURSOR RNA. It is appreciated that VGR3211 folded precursor RNA comprises a plurality of what is known in the art as 'hairpin' structures. These 'hairpin' structures are due to the fact that the nucleotide sequence of VGR3211 precursor RNA comprises a plurality of segments, the first half of each such segment having a nucleotide sequence which is at least a partial inversed-reversed sequence of the second half thereof, as is well known in the art.

VGR3211 folded precursor RNA is naturally processed by cellular enzymatic activity into at least 6 separate VGAM precursor RNAs, VGAM2275 precursor RNA, VGAM2276 precursor RNA, VGAM2277 precursor RNA, VGAM2278 precursor RNA, VGAM2279 precursor RNA and VGAM2280 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2275 RNA, VGAM2276 RNA, VGAM2277 RNA, VGAM2278 RNA, VGAM2279 RNA and VGAM2280 RNA, herein schematically represented by VGAM1 RNA through VGAM3 RNA, each of which VGAM RNAs corresponding to VGAM RNA of FIG. 1.

VGAM2275 RNA, herein schematically represented by VGAM1 RNA through VGAM3 RNA, binds complementarily to a host target binding site located in an untranslated region of VGAM2275 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2275 host target RNA into VGAM2275 host target protein, herein schematically represented by VGAM1 HOST TARGET PROTEIN through VGAM3 HOST TARGET PROTEIN, all of FIG. 1.

VGAM2276 RNA, herein schematically represented by VGAM1 RNA through VGAM3 RNA, binds complementarily to a host target binding site located in an untranslated region of VGAM2276 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2276 host target RNA into VGAM2276 host target protein, herein schematically represented by VGAM1 HOST TARGET PROTEIN through VGAM3 HOST TARGET PROTEIN, all of FIG. 1.

VGAM2277 RNA, herein schematically represented by VGAM1 RNA through VGAM3 RNA, binds complementarily to a host target binding site located in an untranslated region of VGAM2277 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2277 host target RNA into VGAM2277 host target protein, herein schematically represented by VGAM1 HOST TARGET PROTEIN through VGAM3 HOST TARGET PROTEIN, all of FIG. 1.

VGAM2278 RNA, herein schematically represented by VGAM1 RNA through VGAM3 RNA, binds complementarily to a host target binding site located in an untranslated region of VGAM2278 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2278 host target RNA into VGAM2278 host target protein, herein schematically represented by VGAM1 HOST TARGET PROTEIN through VGAM3 HOST TARGET PROTEIN, all of FIG. 1.

VGAM2279 RNA, herein schematically represented by VGAM1 RNA through VGAM3 RNA, binds complementarily to a host target binding site located in an untranslated region of VGAM2279 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2279 host target RNA into VGAM2279 host target protein, herein schematically represented by VGAM1 HOST TARGET PROTEIN through VGAM3 HOST TARGET PROTEIN, all of FIG. 1.

VGAM2280 RNA, herein schematically represented by VGAM1 RNA through VGAM3 RNA, binds complementarily to a host target binding site located in an untranslated region of VGAM2280 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2280 host target RNA into VGAM2280 host target protein, herein schematically represented by VGAM1 HOST TARGET PROTEIN through VGAM3 HOST TARGET PROTEIN, all of FIG. 1.

It is appreciated that a function of VGR3211 gene, herein designated VGR GENE, is inhibition of expression of host target genes, as part of a novel viral mechanism of attacking a host. Accordingly, utilities of VGR3211 gene include diagnosis, prevention and treatment of viral infection by Alcelaphine Herpesvirus 1. Specific functions, and accordingly utilities, of VGR3211 gene correlate with, and may be deduced from, the identity of the host target genes, which are inhibited by VGAM RNAs comprised in the 'operon-like' cluster of VGR3211 gene: VGAM2275 host target protein, VGAM2276 host target protein, VGAM2277 host target protein, VGAM2278 host target protein, VGAM2279 host target protein and VGAM2280 host target protein, herein schematically represented by VGAM1 HOST TARGET PROTEIN through VGAM3 HOST TARGET PROTEIN. The function of these host target genes is elaborated hereinabove with reference to VGAM2275, VGAM2276, VGAM2277, VGAM2278, VGAM2279 and VGAM2280. FIG. 9 further provides a conceptual description of novel bioinformatically detected regulatory viral gene, referred to here as Viral Genomic Record 3212(VGR3212) viral gene, which encodes an 'operon-like' cluster of novel viral micro RNA-like genes, each of which in turn modulates expression of at least one host target gene, the function and utility of which at least one host target gene is known in the art.

VGR3212 gene, herein designated VGR GENE, is a novel bioinformatically detected regulatory, non protein coding, RNA viral gene. The method by which VGR3212 gene was detected is described hereinabove with reference to FIGS. 1-9.

VGR3212 gene encodes VGR3212 precursor RNA, herein designated VGR PRECURSOR RNA, an RNA molecule, typically several hundred nucleotides long.

VGR3212 precursor RNA folds spatially, forming VGR3212 folded precursor RNA, herein designated VGR FOLDED PRECURSOR RNA. It is appreciated that VGR3212 folded precursor RNA comprises a plurality of what is known in the art as 'hairpin' structures. These 'hairpin' structures are due to the fact that the nucleotide sequence of VGR3212 precursor RNA comprises a plurality of segments, the first half of each such segment having a nucleotide sequence which is at least a partial inversed-reversed sequence of the second half thereof, as is well known in the art.

VGR3212 folded precursor RNA is naturally processed by cellular enzymatic activity into at least 8 separate VGAM precursor RNAs, VGAM2281 precursor RNA, VGAM2282 precursor RNA, VGAM2283 precursor RNA, VGAM2284 precursor RNA, VGAM2285 precursor RNA, VGAM2286 precursor RNA, VGAM2287 precursor RNA and VGAM2288 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2281 RNA, VGAM2282 RNA, VGAM2283 RNA, VGAM2284 RNA, VGAM2285 RNA, VGAM2286 RNA, VGAM2287 RNA and VGAM2288 RNA, herein schematically represented by VGAM1 RNA through VGAM3 RNA, each of which VGAM RNAs corresponding to VGAM RNA of FIG. 1.

VGAM2281 RNA, herein schematically represented by VGAM1 RNA through VGAM3 RNA, binds complementarily to a host target binding site located in an untranslated region of VGAM2281 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2281 host target RNA into VGAM2281 host target protein, herein schematically represented by VGAM1 HOST TARGET PROTEIN through VGAM3 HOST TARGET PROTEIN, all of FIG. 1.

VGAM2282 RNA, herein schematically represented by VGAM1 RNA through VGAM3 RNA, binds complementarily to a host target binding site located in an untranslated region of VGAM2282 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2282 host target RNA into VGAM2282 host target protein, herein schematically represented by VGAM1 HOST TARGET PROTEIN through VGAM3 HOST TARGET PROTEIN, all of FIG. 1.

VGAM2283 RNA, herein schematically represented by VGAM1 RNA through VGAM3 RNA, binds complementarily to a host target binding site located in an untranslated region of VGAM2283 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2283 host target RNA into VGAM2283 host target protein, herein schematically represented by VGAM1 HOST TARGET PROTEIN through VGAM3 HOST TARGET PROTEIN, all of FIG. 1.

VGAM2284 RNA, herein schematically represented by VGAM1 RNA through VGAM3 RNA, binds complementarily to a host target binding site located in an untranslated region of VGAM2284 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2284 host target RNA into VGAM2284 host target protein, herein schematically represented by VGAM1 HOST TARGET PROTEIN through VGAM3 HOST TARGET PROTEIN, all of FIG. 1.

VGAM2285 RNA, herein schematically represented by VGAM1 RNA through VGAM3 RNA, binds complementarily to a host target binding site located in an untranslated region of VGAM2285 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2285 host target RNA into VGAM2285 host target protein, herein schematically represented by VGAM1 HOST TARGET PROTEIN through VGAM3 HOST TARGET PROTEIN, all of FIG. 1.

VGAM2286 RNA, herein schematically represented by VGAM1 RNA through VGAM3 RNA, binds complementarily to a host target binding site located in an untranslated region of VGAM2286 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2286 host target RNA into VGAM2286 host target protein, herein schematically represented by VGAM1 HOST TARGET PROTEIN through VGAM3 HOST TARGET PROTEIN, all of FIG. 1.

VGAM2287 RNA, herein schematically represented by VGAM1 RNA through VGAM3 RNA, binds complementarily to a host target binding site located in an untranslated region of VGAM2287 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2287 host target RNA into VGAM2287 host target protein, herein schematically represented by VGAM1 HOST TARGET PROTEIN through VGAM3 HOST TARGET PROTEIN, all of FIG. 1.

VGAM2288 RNA, herein schematically represented by VGAM1 RNA through VGAM3 RNA, binds complementarily to a host target binding site located in an untranslated region of VGAM2288 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2288 host target RNA into VGAM2288 host target protein, herein schematically represented by VGAM1 HOST TARGET PROTEIN through VGAM3 HOST TARGET PROTEIN, all of FIG. 1.

It is appreciated that a function of VGR3212 gene, herein designated VGR GENE, is inhibition of expression of host target genes, as part of a novel viral mechanism of attacking a host. Accordingly, utilities of VGR3212 gene include diagnosis, prevention and treatment of viral infection by Murine Hepatitis Virus. Specific functions, and accordingly utilities, of VGR3212 gene correlate with, and may be deduced from, the identity of the host target genes, which are inhibited by VGAM RNAs comprised in the 'operon-like' cluster of VGR3212 gene: VGAM2281 host target protein, VGAM2282 host target protein, VGAM2283 host target protein, VGAM2284 host target protein, VGAM2285 host target protein, VGAM2286 host target protein, VGAM2287 host target protein and VGAM2288 host target protein, herein schematically represented by VGAM1 HOST TARGET PROTEIN through VGAM3 HOST TARGET PROTEIN. The function of these host target genes is elaborated hereinabove with reference to VGAM2281, VGAM2282, VGAM2283, VGAM2284, VGAM2285, VGAM2286, VGAM2287 and VGAM2288. FIG. 9 further provides a conceptual description of novel bioinformatically detected regulatory viral gene, referred to here as Viral Genomic Record 3213(VGR3213) viral gene, which encodes an 'operon-like' cluster of novel viral micro RNA-like genes, each of which in turn modulates expression of at least one host target gene, the function and utility of which at least one host target gene is known in the art.

VGR3213 gene, herein designated VGR GENE, is a novel bioinformatically detected regulatory, non protein coding, RNA viral gene. The method by which VGR3213 gene was detected is described hereinabove with reference to FIGS. 1-9.

VGR3213 gene encodes VGR3213 precursor RNA, herein designated VGR PRECURSOR RNA, an RNA molecule, typically several hundred nucleotides long.

VGR3213 precursor RNA folds spatially, forming VGR3213 folded precursor RNA, herein designated VGR FOLDED PRECURSOR RNA. It is appreciated that VGR3213 folded precursor RNA comprises a plurality of what is known in the art as 'hairpin' structures. These 'hairpin' structures are due to the fact that the nucleotide sequence of VGR3213 precursor RNA comprises a plurality of segments, the first half of each such segment having a nucleotide sequence which is at least a partial inversed-reversed sequence of the second half thereof, as is well known in the art.

VGR3213 folded precursor RNA is naturally processed by cellular enzymatic activity into at least 6 separate VGAM precursor RNAs, VGAM2289 precursor RNA, VGAM2290 precursor RNA, VGAM2291 precursor RNA, VGAM2292 precursor RNA, VGAM2293 precursor RNA and VGAM2294 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2289 RNA, VGAM2290 RNA, VGAM2291 RNA, VGAM2292 RNA, VGAM2293 RNA and VGAM2294 RNA, herein schematically represented by VGAM1 RNA through VGAM3 RNA, each of which VGAM RNAs corresponding to VGAM RNA of FIG. 1.

VGAM2289 RNA, herein schematically represented by VGAM1 RNA through VGAM3 RNA, binds complementarily to a host target binding site located in an untranslated region of VGAM2289 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2289 host target RNA into VGAM2289 host target protein, herein schematically represented by VGAM1 HOST TARGET PROTEIN through VGAM3 HOST TARGET PROTEIN, all of FIG. 1.

VGAM2290 RNA, herein schematically represented by VGAM1 RNA through VGAM3 RNA, binds complementarily to a host target binding site located in an untranslated region of VGAM2290 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2290 host target RNA into VGAM2290 host target protein, herein schematically represented by VGAM1 HOST TARGET PROTEIN through VGAM3 HOST TARGET PROTEIN, all of FIG. 1.

VGAM2291 RNA, herein schematically represented by VGAM1 RNA through VGAM3 RNA, binds complementarily to a host target binding site located in an untranslated region of VGAM2291 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2291 host target RNA into VGAM2291 host target protein, herein schematically represented by VGAM1 HOST TARGET PROTEIN through VGAM3 HOST TARGET PROTEIN, all of FIG. 1.

VGAM2292 RNA, herein schematically represented by VGAM1 RNA through VGAM3 RNA, binds complementarily to a host target binding site located in an untranslated region of VGAM2292 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2292 host target RNA into VGAM2292 host target protein, herein schematically represented by VGAM1 HOST TARGET PROTEIN through VGAM3 HOST TARGET PROTEIN, all of FIG. 1.

VGAM2293 RNA, herein schematically represented by VGAM1 RNA through VGAM3 RNA, binds complementarily to a host target binding site located in an untranslated region of VGAM2293 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2293 host target RNA into VGAM2293 host target protein, herein schematically represented by VGAM1 HOST TARGET PROTEIN through VGAM3 HOST TARGET PROTEIN, all of FIG. 1.

VGAM2294 RNA, herein schematically represented by VGAM1 RNA through VGAM3 RNA, binds complementarily to a host target binding site located in an untranslated region of VGAM2294 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2294 host target RNA into VGAM2294 host target protein, herein schematically represented by VGAM1 HOST TARGET PROTEIN through VGAM3 HOST TARGET PROTEIN, all of FIG. 1.

It is appreciated that a function of VGR3213 gene, herein designated VGR GENE, is inhibition of expression of host target genes, as part of a novel viral mechanism of attacking a host. Accordingly, utilities of VGR3213 gene include diagnosis, prevention and treatment of viral infection by Murine Hepatitis Virus. Specific functions, and accordingly utilities, of VGR3213 gene correlate with, and may be deduced from, the identity of the host target genes, which are inhibited by VGAM RNAs comprised in the 'operon-like' cluster of VGR3213 gene: VGAM2289 host target protein, VGAM2290 host target protein, VGAM2291 host target protein, VGAM2292 host target protein, VGAM2293 host target protein and VGAM2294 host target protein, herein schematically represented by VGAM1 HOST TARGET PROTEIN through VGAM3 HOST TARGET PROTEIN. The function of these host target genes is elaborated hereinabove with reference to VGAM2289, VGAM2290, VGAM2291, VGAM2292, VGAM2293 and VGAM2294. FIG. 9 further provides a conceptual description of novel bioinformatically detected regulatory viral gene, referred to here as Viral Genomic Record 3214(VGR3214) viral gene, which encodes an 'operon-like' cluster of novel viral micro RNA-like genes, each of which in turn modulates expression of at least one host target gene, the function and utility of which at least one host target gene is known in the art.

VGR3214 gene, herein designated VGR GENE, is a novel bioinformatically detected regulatory, non protein coding, RNA viral gene. The method by which VGR3214 gene was detected is described hereinabove with reference to FIGS. 1-9.

VGR3214 gene encodes VGR3214 precursor RNA, herein designated VGR PRECURSOR RNA, an RNA molecule, typically several hundred nucleotides long.

VGR3214 precursor RNA folds spatially, forming VGR3214 folded precursor RNA, herein designated VGR FOLDED PRECURSOR RNA. It is appreciated that VGR3214 folded precursor RNA comprises a plurality of what is known in the art as 'hairpin' structures. These 'hairpin' structures are due to the fact that the nucleotide sequence of VGR3214 precursor RNA comprises a plurality of segments, the first half of each such segment having a nucleotide sequence which is at least a partial inversed-reversed sequence of the second half thereof, as is well known in the art.

VGR3214 folded precursor RNA is naturally processed by cellular enzymatic activity into at least 8 separate VGAM precursor RNAs, VGAM2295 precursor RNA, VGAM2296 precursor RNA, VGAM2297 precursor RNA, VGAM2298 precursor RNA, VGAM2299 precursor RNA, VGAM2300 precursor RNA, VGAM2301 precursor RNA and VGAM2302 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2295 RNA, VGAM2296 RNA, VGAM2297 RNA, VGAM2298 RNA, VGAM2299 RNA, VGAM2300 RNA, VGAM2301 RNA and VGAM2302 RNA, herein schematically represented by VGAM1 RNA through VGAM3 RNA, each of which VGAM RNAs corresponding to VGAM RNA of FIG. 1.

VGAM2295 RNA, herein schematically represented by VGAM1 RNA through VGAM3 RNA, binds complementarily to a host target binding site located in an untranslated region of VGAM2295 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2295 host target RNA into VGAM2295 host target protein, herein schematically represented by VGAM1 HOST TARGET PROTEIN through VGAM3 HOST TARGET PROTEIN, all of FIG. 1.

VGAM2296 RNA, herein schematically represented by VGAM1 RNA through VGAM3 RNA, binds complementarily to a host target binding site located in an untranslated region of VGAM2296 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2296 host target RNA into VGAM2296 host target protein, herein schematically represented by VGAM1 HOST TARGET PROTEIN through VGAM3 HOST TARGET PROTEIN, all of FIG. 1.

VGAM2297 RNA, herein schematically represented by VGAM1 RNA through VGAM3 RNA, binds complementarily to a host target binding site located in an untranslated region of VGAM2297 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2297 host target RNA into VGAM2297 host target protein, herein schematically represented by VGAM1 HOST TARGET PROTEIN through VGAM3 HOST TARGET PROTEIN, all of FIG. 1.

VGAM2298 RNA, herein schematically represented by VGAM1 RNA through VGAM3 RNA, binds complementarily to a host target binding site located in an untranslated region of VGAM2298 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2298 host target RNA into VGAM2298 host target protein, herein schematically represented by VGAM1 HOST TARGET PROTEIN through VGAM3 HOST TARGET PROTEIN, all of FIG. 1.

VGAM2299 RNA, herein schematically represented by VGAM1 RNA through VGAM3 RNA, binds complementarily to a host target binding site located in an untranslated region of VGAM2299 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2299 host target RNA into VGAM2299 host target protein, herein schematically represented by VGAM1 HOST TARGET PROTEIN through VGAM3 HOST TARGET PROTEIN, all of FIG. 1.

VGAM2300 RNA, herein schematically represented by VGAM1 RNA through VGAM3 RNA, binds complementarily to a host target binding site located in an untranslated region of VGAM2300 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2300 host target RNA into VGAM2300 host target protein, herein schematically represented by VGAM1 HOST TARGET PROTEIN through VGAM3 HOST TARGET PROTEIN, all of FIG. 1.

VGAM2301 RNA, herein schematically represented by VGAM1 RNA through VGAM3 RNA, binds complementarily to a host target binding site located in an untranslated region of VGAM2301 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2301 host target RNA into VGAM2301 host target protein, herein schematically represented by VGAM1 HOST TARGET PROTEIN through VGAM3 HOST TARGET PROTEIN, all of FIG. 1.

VGAM2302 RNA, herein schematically represented by VGAM1 RNA through VGAM3 RNA, binds complementarily to a host target binding site located in an untranslated region of VGAM2302 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2302 host target RNA into VGAM2302 host target protein, herein schematically represented by VGAM1 HOST TARGET PROTEIN through VGAM3 HOST TARGET PROTEIN, all of FIG. 1.

It is appreciated that a function of VGR3214 gene, herein designated VGR GENE, is inhibition of expression of host target genes, as part of a novel viral mechanism of attacking a host. Accordingly, utilities of VGR3214 gene include diagnosis, prevention and treatment of viral infection by Ectromelia Virus. Specific functions, and accordingly utilities, of VGR3214 gene correlate with, and may be deduced from, the identity of the host target genes, which are inhibited by VGAM RNAs comprised in the 'operon-like' cluster of VGR3214 gene: VGAM2295 host target protein, VGAM2296 host target protein, VGAM2297 host target protein, VGAM2298 host target protein, VGAM2299 host target protein, VGAM2300 host target protein, VGAM2301 host target protein and VGAM2302 host target protein, herein schematically represented by VGAM1 HOST TARGET PROTEIN through VGAM3 HOST TARGET PROTEIN. The function of these host target genes is elaborated hereinabove with reference to VGAM2295, VGAM2296, VGAM2297, VGAM2298, VGAM2299, VGAM2300, VGAM2301 and VGAM2302. FIG. 9 further provides a conceptual description of novel bioinformatically detected regulatory viral gene, referred to here as Viral Genomic Record 3215(VGR3215) viral gene, which encodes an 'operon-like' cluster of novel viral micro RNA-like genes, each of which in turn modulates expression of at least one host target gene, the function and utility of which at least one host target gene is known in the art.

VGR3215 gene, herein designated VGR GENE, is a novel bioinformatically detected regulatory, non protein coding, RNA viral gene. The method by which VGR3215 gene was detected is described hereinabove with reference to FIGS. 1-9.

VGR3215 gene encodes VGR3215 precursor RNA, herein designated VGR PRECURSOR RNA, an RNA molecule, typically several hundred nucleotides long.

VGR3215 precursor RNA folds spatially, forming VGR3215 folded precursor RNA, herein designated VGR FOLDED PRECURSOR RNA. It is appreciated that VGR3215 folded precursor RNA comprises a plurality of what is known in the art as 'hairpin' structures. These 'hairpin' structures are due to the fact that the nucleotide sequence of VGR3215 precursor RNA comprises a plurality of segments, the first half of each such segment having a nucleotide sequence which is at least a partial inversed-reversed sequence of the second half thereof, as is well known in the art.

VGR3215 folded precursor RNA is naturally processed by cellular enzymatic activity into at least 4 separate VGAM precursor RNAs, VGAM2303 precursor RNA, VGAM2304 precursor RNA, VGAM2305 precursor RNA and VGAM2306 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2303 RNA, VGAM2304 RNA, VGAM2305 RNA and VGAM2306 RNA, herein schematically represented by VGAM1 RNA through VGAM3 RNA, each of which VGAM RNAs corresponding to VGAM RNA of FIG. 1.

VGAM2303 RNA, herein schematically represented by VGAM1 RNA through VGAM3 RNA, binds complementarily to a host target binding site located in an untranslated region of VGAM2303 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2303 host target RNA into VGAM2303 host target protein, herein schematically represented by VGAM1 HOST TARGET PROTEIN through VGAM3 HOST TARGET PROTEIN, all of FIG. 1.

VGAM2304 RNA, herein schematically represented by VGAM1 RNA through VGAM3 RNA, binds complementarily to a host target binding site located in an untranslated region of VGAM2304 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2304 host target RNA into VGAM2304 host target protein, herein schematically represented by VGAM1 HOST TARGET PROTEIN through VGAM3 HOST TARGET PROTEIN, all of FIG. 1.

VGAM2305 RNA, herein schematically represented by VGAM1 RNA through VGAM3 RNA, binds complementarily to a host target binding site located in an untranslated region of VGAM2305 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2305 host target RNA into VGAM2305 host target protein, herein schematically represented by VGAM1 HOST TARGET PROTEIN through VGAM3 HOST TARGET PROTEIN, all of FIG. 1.

VGAM2306 RNA, herein schematically represented by VGAM1 RNA through VGAM3 RNA, binds complementarily to a host target binding site located in an untranslated region of VGAM2306 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2306 host target RNA into VGAM2306 host target protein, herein schematically represented by VGAM1 HOST TARGET PROTEIN through VGAM3 HOST TARGET PROTEIN, all of FIG. 1.

It is appreciated that a function of VGR3215 gene, herein designated VGR GENE, is inhibition of expression of host target genes, as part of a novel viral mechanism of attacking a host. Accordingly, utilities of VGR3215 gene include diagnosis, prevention and treatment of viral infection by Ectromelia Virus. Specific functions, and accordingly utilities, of VGR3215 gene correlate with, and may be deduced from, the identity of the host target genes, which are inhibited by VGAM RNAs comprised in the 'operon-like' cluster of VGR3215 gene: VGAM2303 host target protein, VGAM2304 host target protein, VGAM2305 host target protein and VGAM2306 host target protein, herein schematically represented by VGAM1 HOST TARGET PROTEIN through VGAM3 HOST TARGET PROTEIN. The function of these host target genes is elaborated hereinabove with reference to VGAM2303, VGAM2304, VGAM2305 and VGAM2306. FIG. 9 further provides a conceptual description of novel bioinformatically detected regulatory viral gene, referred to here as Viral Genomic Record 3216(VGR3216) viral gene, which encodes an 'operon-like' cluster of novel viral micro RNA-like genes, each of which in turn modulates expression of at least one host target gene, the function and utility of which at least one host target gene is known in the art.

VGR3216 gene, herein designated VGR GENE, is a novel bioinformatically detected regulatory, non protein coding, RNA viral gene. The method by which VGR3216 gene was detected is described hereinabove with reference to FIGS. 1-9.

VGR3216 gene encodes VGR3216 precursor RNA, herein designated VGR PRECURSOR RNA, an RNA molecule, typically several hundred nucleotides long.

VGR3216 precursor RNA folds spatially, forming VGR3216 folded precursor RNA, herein designated VGR FOLDED PRECURSOR RNA. It is appreciated that VGR3216 folded precursor RNA comprises a plurality of what is known in the art as 'hairpin' structures. These 'hairpin' structures are due to the fact that the nucleotide sequence of VGR3216 precursor RNA comprises a plurality of segments, the first half of each such segment having a nucleotide sequence which is at least a partial inversed-reversed sequence of the second half thereof, as is well known in the art.

VGR3216 folded precursor RNA is naturally processed by cellular enzymatic activity into at least 7 separate VGAM precursor RNAs, VGAM2307 precursor RNA, VGAM2308 precursor RNA, VGAM2309 precursor RNA, VGAM2310 precursor RNA, VGAM2311 precursor RNA, VGAM2312 precursor RNA and VGAM2313 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2307 RNA, VGAM2308 RNA, VGAM2309 RNA, VGAM2310 RNA, VGAM2311 RNA, VGAM2312 RNA and VGAM2313 RNA, herein schematically represented by VGAM1 RNA through VGAM3 RNA, each of which VGAM RNAs corresponding to VGAM RNA of FIG. 1.

VGAM2307 RNA, herein schematically represented by VGAM1 RNA through VGAM3 RNA, binds complementarily to a host target binding site located in an untranslated region of VGAM2307 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2307 host target RNA into VGAM2307 host target protein, herein schematically represented by VGAM1 HOST TARGET PROTEIN through VGAM3 HOST TARGET PROTEIN, all of FIG. 1.

VGAM2308 RNA, herein schematically represented by VGAM1 RNA through VGAM3 RNA, binds complementarily to a host target binding site located in an untranslated region of VGAM2308 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2308 host target RNA into VGAM2308 host target protein, herein schematically represented by VGAM1 HOST TARGET PROTEIN through VGAM3 HOST TARGET PROTEIN, all of FIG. 1.

VGAM2309 RNA, herein schematically represented by VGAM1 RNA through VGAM3 RNA, binds complementarily to a host target binding site located in an untranslated region of VGAM2309 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2309 host target RNA into VGAM2309 host target protein, herein schematically represented by VGAM1 HOST TARGET PROTEIN through VGAM3 HOST TARGET PROTEIN, all of FIG. 1.

VGAM2310 RNA, herein schematically represented by VGAM1 RNA through VGAM3 RNA, binds complementarily to a host target binding site located in an untranslated region of VGAM2310 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2310 host target RNA into VGAM2310 host target protein, herein schematically represented by VGAM1 HOST TARGET PROTEIN through VGAM3 HOST TARGET PROTEIN, all of FIG. 1.

VGAM2311 RNA, herein schematically represented by VGAM1 RNA through VGAM3 RNA, binds complementarily to a host target binding site located in an untranslated region of VGAM2311 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2311 host target RNA into VGAM2311 host target protein, herein schematically represented by VGAM1 HOST TARGET PROTEIN through VGAM3 HOST TARGET PROTEIN, all of FIG. 1.

VGAM2312 RNA, herein schematically represented by VGAM1 RNA through VGAM3 RNA, binds complementarily to a host target binding site located in an untranslated region of VGAM2312 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2312 host target RNA into VGAM2312 host target protein, herein schematically represented by VGAM1 HOST TARGET PROTEIN through VGAM3 HOST TARGET PROTEIN, all of FIG. 1.

VGAM2313 RNA, herein schematically represented by VGAM1 RNA through VGAM3 RNA, binds complementarily to a host target binding site located in an untranslated region of VGAM2313 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2313 host target RNA into VGAM2313 host target protein, herein schematically represented by VGAM1 HOST TARGET PROTEIN through VGAM3 HOST TARGET PROTEIN, all of FIG. 1.

It is appreciated that a function of VGR3216 gene, herein designated VGR GENE, is inhibition of expression of host target genes, as part of a novel viral mechanism of attacking a host. Accordingly, utilities of VGR3216 gene include diagnosis, prevention and treatment of viral infection by Lumpy Skin Disease Virus. Specific functions, and accordingly utilities, of VGR3216 gene correlate with, and may be deduced from, the identity of the host target genes, which are inhibited by VGAM RNAs comprised in the 'operon-like' cluster of VGR3216 gene: VGAM2307 host target protein, VGAM2308 host target protein, VGAM2309 host target protein, VGAM2310 host target protein, VGAM2311 host target protein, VGAM2312 host target protein and VGAM2313 host target protein, herein schematically represented by VGAM1 HOST TARGET PROTEIN through VGAM3 HOST TARGET PROTEIN. The function of these host target genes is elaborated hereinabove with reference to VGAM2307, VGAM2308, VGAM2309, VGAM2310, VGAM2311, VGAM2312 and VGAM2313. FIG. 9 further provides a conceptual description of novel bioinformatically detected regulatory viral gene, referred to here as Viral Genomic Record 3217(VGR3217) viral gene, which encodes an 'operon-like' cluster of novel viral micro RNA-like genes, each of which in turn modulates expression of at least one host target gene, the function and utility of which at least one host target gene is known in the art.

VGR3217 gene, herein designated VGR GENE, is a novel bioinformatically detected regulatory, non protein coding, RNA viral gene. The method by which VGR3217 gene was detected is described hereinabove with reference to FIGS. 1-9.

VGR3217 gene encodes VGR3217 precursor RNA, herein designated VGR PRECURSOR RNA, an RNA molecule, typically several hundred nucleotides long.

VGR3217 precursor RNA folds spatially, forming VGR3217 folded precursor RNA, herein designated VGR FOLDED PRECURSOR RNA. It is appreciated that VGR3217 folded precursor RNA comprises a plurality of what is known in the art as 'hairpin' structures. These 'hairpin' structures are due to the fact that the nucleotide sequence of VGR3217 precursor RNA comprises a plurality of segments, the first half of each such segment having a nucleotide sequence which is at least a partial inversed-reversed sequence of the second half thereof, as is well known in the art.

VGR3217 folded precursor RNA is naturally processed by cellular enzymatic activity into at least 2 separate VGAM precursor RNAs, VGAM2314 precursor RNA and VGAM2315 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2314 RNA and VGAM2315 RNA, herein schematically represented by VGAM1 RNA through VGAM3 RNA, each of which VGAM RNAs corresponding to VGAM RNA of FIG. 1.

VGAM2314 RNA, herein schematically represented by VGAM1 RNA through VGAM3 RNA, binds complementarily to a host target binding site located in an untranslated region of VGAM2314 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2314 host target RNA into VGAM2314 host target protein, herein schematically represented by VGAM1 HOST TARGET PROTEIN through VGAM3 HOST TARGET PROTEIN, all of FIG. 1.

VGAM2315 RNA, herein schematically represented by VGAM1 RNA through VGAM3 RNA, binds complementarily to a host target binding site located in an untranslated region of VGAM2315 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2315 host target RNA into VGAM2315 host target protein, herein schematically represented by VGAM1 HOST TARGET PROTEIN through VGAM3 HOST TARGET PROTEIN, all of FIG. 1.

It is appreciated that a function of VGR3217 gene, herein designated VGR GENE, is inhibition of expression of host target genes, as part of a novel viral mechanism of attacking a host. Accordingly, utilities of VGR3217 gene include diagnosis, prevention and treatment of viral infection by Lumpy Skin Disease Virus. Specific functions, and accordingly utilities, of VGR3217 gene correlate with, and may be deduced from, the identity of the host target genes, which are inhibited by VGAM RNAs comprised in the 'operon-like' cluster of VGR3217 gene: VGAM2314 host target protein and VGAM2315 host target protein, herein schematically represented by VGAM1 HOST TARGET PROTEIN through VGAM3 HOST TARGET PROTEIN. The function of these host target genes is elaborated hereinabove with reference to VGAM2314 and VGAM2315. FIG. 9 further provides a conceptual description of novel bioinformatically detected regulatory viral gene, referred to here as Viral Genomic Record 3218(VGR3218) viral gene, which encodes an 'operon-like' cluster of novel viral micro RNA-like genes, each of which in turn modulates expression of at least one host target gene, the function and utility of which at least one host target gene is known in the art.

VGR3218 gene, herein designated VGR GENE, is a novel bioinformatically detected regulatory, non protein coding, RNA viral gene. The method by which VGR3218 gene was detected is described hereinabove with reference to FIGS. 1-9.

VGR3218 gene encodes VGR3218 precursor RNA, herein designated VGR PRECURSOR RNA, an RNA molecule, typically several hundred nucleotides long.

VGR3218 precursor RNA folds spatially, forming VGR3218 folded precursor RNA, herein designated VGR FOLDED PRECURSOR RNA. It is appreciated that VGR3218 folded precursor RNA comprises a plurality of what is known in the art as 'hairpin' structures. These 'hairpin' structures are due to the fact that the nucleotide sequence of VGR3218 precursor RNA comprises a plurality of segments, the first half of each such segment having a nucleotide sequence which is at least a partial inversed-reversed sequence of the second half thereof, as is well known in the art.

VGR3218 folded precursor RNA is naturally processed by cellular enzymatic activity into at least 8 separate VGAM precursor RNAs, VGAM2316 precursor RNA, VGAM2317 precursor RNA, VGAM2318 precursor RNA, VGAM2319 precursor RNA, VGAM2320 precursor RNA, VGAM2321 precursor RNA, VGAM2322 precursor RNA and VGAM2323 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2316 RNA, VGAM2317 RNA, VGAM2318 RNA, VGAM2319 RNA, VGAM2320 RNA, VGAM2321 RNA, VGAM2322 RNA and VGAM2323 RNA, herein schematically represented by VGAM1 RNA through VGAM3 RNA, each of which VGAM RNAs corresponding to VGAM RNA of FIG. 1.

VGAM2316 RNA, herein schematically represented by VGAM1 RNA through VGAM3 RNA, binds complementarily to a host target binding site located in an untranslated region of VGAM2316 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2316 host target RNA into VGAM2316 host target protein, herein schematically represented by VGAM1 HOST TARGET PROTEIN through VGAM3 HOST TARGET PROTEIN, all of FIG. 1.

VGAM2317 RNA, herein schematically represented by VGAM1 RNA through VGAM3 RNA, binds complementarily to a host target binding site located in an untranslated region of VGAM2317 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2317 host target RNA into VGAM2317 host target protein, herein schematically represented by VGAM1 HOST TARGET PROTEIN through VGAM3 HOST TARGET PROTEIN, all of FIG. 1.

VGAM2318 RNA, herein schematically represented by VGAM1 RNA through VGAM3 RNA, binds complementarily to a host target binding site located in an untranslated region of VGAM2318 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2318 host target RNA into VGAM2318 host target protein, herein schematically represented by VGAM1 HOST TARGET PROTEIN through VGAM3 HOST TARGET PROTEIN, all of FIG. 1.

VGAM2319 RNA, herein schematically represented by VGAM1 RNA through VGAM3 RNA, binds complementarily to a host target binding site located in an untranslated region of VGAM2319 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2319 host target RNA into VGAM2319 host target protein, herein schematically represented by VGAM1 HOST TARGET PROTEIN through VGAM3 HOST TARGET PROTEIN, all of FIG. 1.

VGAM2320 RNA, herein schematically represented by VGAM1 RNA through VGAM3 RNA, binds complementarily to a host target binding site located in an untranslated region of VGAM2320 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2320 host target RNA into VGAM2320 host target protein, herein schematically represented by VGAM1 HOST TARGET PROTEIN through VGAM3 HOST TARGET PROTEIN, all of FIG. 1.

VGAM2321 RNA, herein schematically represented by VGAM1 RNA through VGAM3 RNA, binds complementarily to a host target binding site located in an untranslated region of VGAM2321 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2321 host target RNA into VGAM2321 host target protein, herein schematically represented by VGAM1 HOST TARGET PROTEIN through VGAM3 HOST TARGET PROTEIN, all of FIG. 1.

VGAM2322 RNA, herein schematically represented by VGAM1 RNA through VGAM3 RNA, binds complementarily to a host target binding site located in an untranslated region of VGAM2322 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2322 host target RNA into VGAM2322 host target protein, herein schematically represented by VGAM1 HOST TARGET PROTEIN through VGAM3 HOST TARGET PROTEIN, all of FIG. 1.

VGAM2323 RNA, herein schematically represented by VGAM1 RNA through VGAM3 RNA, binds complementarily to a host target binding site located in an untranslated region of VGAM2323 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2323 host target RNA into VGAM2323 host target protein, herein schematically represented by VGAM1 HOST TARGET PROTEIN through VGAM3 HOST TARGET PROTEIN, all of FIG. 1.

It is appreciated that a function of VGR3218 gene, herein designated VGR GENE, is inhibition of expression of host target genes, as part of a novel viral mechanism of attacking a host. Accordingly, utilities of VGR3218 gene include diagnosis, prevention and treatment of viral infection by Rana Tigrina Ranavirus. Specific functions, and accordingly utilities, of VGR3218 gene correlate with, and may be deduced from, the identity of the host target genes, which are inhibited by VGAM RNAs comprised in the 'operon-like' cluster of VGR3218 gene: VGAM2316 host target protein, VGAM2317 host target protein, VGAM2318 host target protein, VGAM2319 host target protein, VGAM2320 host target protein, VGAM2321 host target protein, VGAM2322 host target protein and VGAM2323 host target protein, herein schematically represented by VGAM1 HOST TARGET PROTEIN through VGAM3 HOST TARGET PROTEIN. The function of these host target genes is elaborated hereinabove with reference to VGAM2316, VGAM2317, VGAM2318, VGAM2319, VGAM2320, VGAM2321, VGAM2322 and VGAM2323. FIG. 9 further provides a conceptual description of novel bioinformatically detected regulatory viral gene, referred to here as Viral Genomic Record 3219(VGR3219) viral gene, which encodes an 'operon-like' cluster of novel viral micro RNA-like genes, each of which in turn modulates expression of at least one host target gene, the function and utility of which at least one host target gene is known in the art.

VGR3219 gene, herein designated VGR GENE, is a novel bioinformatically detected regulatory, non protein coding, RNA viral gene. The method by which VGR3219 gene was detected is described hereinabove with reference to FIGS. 1-9.

VGR3219 gene encodes VGR3219 precursor RNA, herein designated VGR PRECURSOR RNA, an RNA molecule, typically several hundred nucleotides long.

VGR3219 precursor RNA folds spatially, forming VGR3219 folded precursor RNA, herein designated VGR FOLDED PRECURSOR RNA. It is appreciated that VGR3219 folded precursor RNA comprises a plurality of what is known in the art as 'hairpin' structures. These 'hairpin' structures are due to the fact that the nucleotide sequence of VGR3219 precursor RNA comprises a plurality of segments, the first half of each such segment having a nucleotide sequence which is at least a partial inversed-reversed sequence of the second half thereof, as is well known in the art.

VGR3219 folded precursor RNA is naturally processed by cellular enzymatic activity into at least 5 separate VGAM precursor RNAs, VGAM2324 precursor RNA, VGAM2325 precursor RNA, VGAM2326 precursor RNA, VGAM2327 precursor RNA and VGAM2328 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2324 RNA, VGAM2325 RNA, VGAM2326 RNA, VGAM2327 RNA and VGAM2328 RNA, herein schematically represented by VGAM1 RNA through VGAM3 RNA, each of which VGAM RNAs corresponding to VGAM RNA of FIG. 1.

VGAM2324 RNA, herein schematically represented by VGAM1 RNA through VGAM3 RNA, binds complementarily to a host target binding site located in an untranslated region of VGAM2324 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2324 host target RNA into VGAM2324 host target protein, herein schematically represented by VGAM1 HOST TARGET PROTEIN through VGAM3 HOST TARGET PROTEIN, all of FIG. 1.

VGAM2325 RNA, herein schematically represented by VGAM1 RNA through VGAM3 RNA, binds complementarily to a host target binding site located in an untranslated region of VGAM2325 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2325 host target RNA into VGAM2325 host target protein, herein schematically represented by VGAM1 HOST TARGET PROTEIN through VGAM3 HOST TARGET PROTEIN, all of FIG. 1.

VGAM2326 RNA, herein schematically represented by VGAM1 RNA through VGAM3 RNA, binds complementarily to a host target binding site located in an untranslated region of VGAM2326 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2326 host target RNA into VGAM2326 host target protein, herein schematically represented by VGAM1 HOST TARGET PROTEIN through VGAM3 HOST TARGET PROTEIN, all of FIG. 1.

VGAM2327 RNA, herein schematically represented by VGAM1 RNA through VGAM3 RNA, binds complementarily to a host target binding site located in an untranslated region of VGAM2327 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2327 host target RNA into VGAM2327 host target protein, herein schematically represented by VGAM1 HOST TARGET PROTEIN through VGAM3 HOST TARGET PROTEIN, all of FIG. 1.

VGAM2328 RNA, herein schematically represented by VGAM1 RNA through VGAM3 RNA, binds complementarily to a host target binding site located in an untranslated region of VGAM2328 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2328 host target RNA into VGAM2328 host target protein, herein schematically represented by VGAM1 HOST TARGET PROTEIN through VGAM3 HOST TARGET PROTEIN, all of FIG. 1.

It is appreciated that a function of VGR3219 gene, herein designated VGR GENE, is inhibition of expression of host target genes, as part of a novel viral mechanism of attacking a host. Accordingly, utilities of VGR3219 gene include diagnosis, prevention and treatment of viral infection by Rana Tigrina Ranavirus. Specific functions, and accordingly utilities, of VGR3219 gene correlate with, and may be deduced from, the identity of the host target genes, which are inhibited by VGAM RNAs comprised in the 'operon-like' cluster of VGR3219 gene: VGAM2324 host target protein, VGAM2325 host target protein, VGAM2326 host target protein, VGAM2327 host target protein and VGAM2328 host target protein, herein schematically represented by VGAM1 HOST TARGET PROTEIN through VGAM3 HOST TARGET PROTEIN. The function of these host target genes is elaborated hereinabove with reference to VGAM2324, VGAM2325, VGAM2326, VGAM2327 and VGAM2328.

FIG. 9 further provides a conceptual description of novel bioinformatically detected regulatory viral gene, referred to here as Viral Genomic Record 3220(VGR3220) viral gene, which encodes an 'operon-like' cluster of novel viral micro RNA-like genes, each of which in turn modulates expression of at least one host target gene, the function and utility of which at least one host target gene is known in the art.

VGR3220 gene, herein designated VGR GENE, is a novel bioinformatically detected regulatory, non protein coding, RNA viral gene. The method by which VGR3220 gene was detected is described hereinabove with reference to FIGS. 1-9.

VGR3220 gene encodes VGR3220 precursor RNA, herein designated VGR PRECURSOR RNA, an RNA molecule, typically several hundred nucleotides long.

VGR3220 precursor RNA folds spatially, forming VGR3220 folded precursor RNA, herein designated VGR FOLDED PRECURSOR RNA. It is appreciated that VGR3220 folded precursor RNA comprises a plurality of what is known in the art as 'hairpin' structures. These 'hairpin' structures are due to the fact that the nucleotide sequence of VGR3220 precursor RNA comprises a plurality of segments, the first half of each such segment having a nucleotide sequence which is at least a partial inversed-reversed sequence of the second half thereof, as is well known in the art.

VGR3220 folded precursor RNA is naturally processed by cellular enzymatic activity into at least 8 separate VGAM precursor RNAs, VGAM2329 precursor RNA, VGAM2330 precursor RNA, VGAM2331 precursor RNA, VGAM2332 precursor RNA, VGAM2333 precursor RNA, VGAM2334 precursor RNA, VGAM2335 precursor RNA and VGAM2336 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2329 RNA, VGAM2330 RNA, VGAM2331 RNA, VGAM2332 RNA, VGAM2333 RNA, VGAM2334 RNA, VGAM2335 RNA and VGAM2336 RNA, herein schematically represented by VGAM1 RNA through VGAM3 RNA, each of which VGAM RNAs corresponding to VGAM RNA of FIG. 1.

VGAM2329 RNA, herein schematically represented by VGAM1 RNA through VGAM3 RNA, binds complementarily to a host target binding site located in an untranslated region of VGAM2329 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2329 host target RNA into VGAM2329 host target protein, herein schematically represented by VGAM1 HOST TARGET PROTEIN through VGAM3 HOST TARGET PROTEIN, all of FIG. 1.

VGAM2330 RNA, herein schematically represented by VGAM1 RNA through VGAM3 RNA, binds complementarily to a host target binding site located in an untranslated region of VGAM2330 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2330 host target RNA into VGAM2330 host target protein, herein schematically represented by VGAM1 HOST TARGET PROTEIN through VGAM3 HOST TARGET PROTEIN, all of FIG. 1.

VGAM2331 RNA, herein schematically represented by VGAM1 RNA through VGAM3 RNA, binds complementarily to a host target binding site located in an untranslated region of VGAM2331 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2331 host target RNA into VGAM2331 host target protein, herein schematically represented by VGAM1 HOST TARGET PROTEIN through VGAM3 HOST TARGET PROTEIN, all of FIG. 1.

VGAM2332 RNA, herein schematically represented by VGAM1 RNA through VGAM3 RNA, binds complementarily to a host target binding site located in an untranslated region of VGAM2332 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2332 host target RNA into VGAM2332 host target protein, herein schematically represented by VGAM1 HOST TARGET PROTEIN through VGAM3 HOST TARGET PROTEIN, all of FIG. 1.

VGAM2333 RNA, herein schematically represented by VGAM1 RNA through VGAM3 RNA, binds complementarily to a host target binding site located in an untranslated region of VGAM2333 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2333 host target RNA into VGAM2333 host target protein, herein schematically represented by VGAM1 HOST TARGET PROTEIN through VGAM3 HOST TARGET PROTEIN, all of FIG. 1.

VGAM2334 RNA, herein schematically represented by VGAM1 RNA through VGAM3 RNA, binds complementarily to a host target binding site located in an untranslated region of VGAM2334 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2334 host target RNA into VGAM2334 host target protein, herein schematically represented by VGAM1 HOST TARGET PROTEIN through VGAM3 HOST TARGET PROTEIN, all of FIG. 1.

VGAM2335 RNA, herein schematically represented by VGAM1 RNA through VGAM3 RNA, binds complementarily to a host target binding site located in an untranslated region of VGAM2335 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2335 host target RNA into VGAM2335 host target protein, herein schematically represented by VGAM1 HOST TARGET PROTEIN through VGAM3 HOST TARGET PROTEIN, all of FIG. 1.

VGAM2336 RNA, herein schematically represented by VGAM1 RNA through VGAM3 RNA, binds complementarily to a host target binding site located in an untranslated region of VGAM2336 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2336 host target RNA into VGAM2336 host target protein, herein schematically represented by VGAM1 HOST TARGET PROTEIN through VGAM3 HOST TARGET PROTEIN, all of FIG. 1.

It is appreciated that a function of VGR3220 gene, herein designated VGR GENE, is inhibition of expression of host target genes, as part of a novel viral mechanism of attacking a host. Accordingly, utilities of VGR3220 gene include diagnosis, prevention and treatment of viral infection by Equine Herpesvirus 2. Specific functions, and accordingly utilities, of VGR3220 gene correlate with, and may be deduced from, the identity of the host target genes, which are inhibited by VGAM RNAs comprised in the 'operon-like' cluster of VGR3220 gene: VGAM2329 host target protein, VGAM2330 host target protein, VGAM2331 host target protein, VGAM2332 host target protein, VGAM2333 host target protein, VGAM2334 host target protein, VGAM2335 host target protein and VGAM2336 host target protein, herein schematically represented by VGAM1 HOST TARGET PROTEIN through VGAM3 HOST TARGET PROTEIN. The function of these host target genes is elaborated hereinabove with reference to VGAM2329, VGAM2330, VGAM2331, VGAM2332, VGAM2333, VGAM2334, VGAM2335 and VGAM2336. FIG. 9 further provides a conceptual description of novel bioinformatically detected regulatory viral gene, referred to here as Viral Genomic Record 3221(VGR3221) viral gene, which encodes an 'operon-like' cluster of novel viral micro RNA-like genes, each of which in turn modulates expression of at least one host target gene, the function and utility of which at least one host target gene is known in the art.

VGR3221 gene, herein designated VGR GENE, is a novel bioinformatically detected regulatory, non protein coding, RNA viral gene. The method by which VGR3221 gene was detected is described hereinabove with reference to FIGS. 1-9.

VGR3221 gene encodes VGR3221 precursor RNA, herein designated VGR PRECURSOR RNA, an RNA molecule, typically several hundred nucleotides long.

VGR3221 precursor RNA folds spatially, forming VGR3221 folded precursor RNA, herein designated VGR FOLDED PRECURSOR RNA. It is appreciated that VGR3221 folded precursor RNA comprises a plurality of what is known in the art as 'hairpin' structures. These 'hairpin' structures are due to the fact that the nucleotide sequence of VGR3221 precursor RNA comprises a plurality of segments, the first half of each such segment having a nucleotide sequence which is at least a partial inversed-reversed sequence of the second half thereof, as is well known in the art.

VGR3221 folded precursor RNA is naturally processed by cellular enzymatic activity into at least 8 separate VGAM precursor RNAs, VGAM2337 precursor RNA, VGAM2338 precursor RNA, VGAM2339 precursor RNA, VGAM2340 precursor RNA, VGAM2341 precursor RNA, VGAM2342 precursor RNA, VGAM2343 precursor RNA and VGAM2344 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2337 RNA, VGAM2338 RNA, VGAM2339 RNA, VGAM2340 RNA, VGAM2341 RNA, VGAM2342 RNA, VGAM2343 RNA and VGAM2344 RNA, herein schematically represented by VGAM1 RNA through VGAM3 RNA, each of which VGAM RNAs corresponding to VGAM RNA of FIG. 1.

VGAM2337 RNA, herein schematically represented by VGAM1 RNA through VGAM3 RNA, binds complementarily to a host target binding site located in an untranslated region of VGAM2337 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2337 host target RNA into VGAM2337 host target protein, herein schematically represented by VGAM1 HOST TARGET PROTEIN through VGAM3 HOST TARGET PROTEIN, all of FIG. 1.

VGAM2338 RNA, herein schematically represented by VGAM1 RNA through VGAM3 RNA, binds complementarily to a host target binding site located in an untranslated region of VGAM2338 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2338 host target RNA into VGAM2338 host target protein, herein schematically represented by VGAM1 HOST TARGET PROTEIN through VGAM3 HOST TARGET PROTEIN, all of FIG. 1.

VGAM2339 RNA, herein schematically represented by VGAM1 RNA through VGAM3 RNA, binds complementarily to a host target binding site located in an untranslated region of VGAM2339 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2339 host target RNA into VGAM2339 host target protein, herein schematically represented by VGAM1 HOST TARGET PROTEIN through VGAM3 HOST TARGET PROTEIN, all of FIG. 1.

VGAM2340 RNA, herein schematically represented by VGAM1 RNA through VGAM3 RNA, binds complementarily to a host target binding site located in an untranslated region of VGAM2340 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2340 host target RNA into VGAM2340 host target protein, herein schematically represented by VGAM1 HOST TARGET PROTEIN through VGAM3 HOST TARGET PROTEIN, all of FIG. 1.

VGAM2341 RNA, herein schematically represented by VGAM1 RNA through VGAM3 RNA, binds complementarily to a host target binding site located in an untranslated region of VGAM2341 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2341 host target RNA into VGAM2341 host target protein, herein schematically represented by VGAM1 HOST TARGET PROTEIN through VGAM3 HOST TARGET PROTEIN, all of FIG. 1.

VGAM2342 RNA, herein schematically represented by VGAM1 RNA through VGAM3 RNA, binds complementarily to a host target binding site located in an untranslated region of VGAM2342 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2342 host target RNA into VGAM2342 host target protein, herein schematically represented by VGAM1 HOST TARGET PROTEIN through VGAM3 HOST TARGET PROTEIN, all of FIG. 1.

VGAM2343 RNA, herein schematically represented by VGAM1 RNA through VGAM3 RNA, binds complementarily to a host target binding site located in an untranslated region of VGAM2343 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2343 host target RNA into VGAM2343 host target protein, herein schematically represented by VGAM1 HOST TARGET PROTEIN through VGAM3 HOST TARGET PROTEIN, all of FIG. 1.

VGAM2344 RNA, herein schematically represented by VGAM1 RNA through VGAM3 RNA, binds complementarily to a host target binding site located in an untranslated region of VGAM2344 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2344 host target RNA into VGAM2344 host target protein, herein schematically represented by VGAM1 HOST TARGET PROTEIN through VGAM3 HOST TARGET PROTEIN, all of FIG. 1.

It is appreciated that a function of VGR3221 gene, herein designated VGR GENE, is inhibition of expression of host target genes, as part of a novel viral mechanism of attacking a host. Accordingly, utilities of VGR3221 gene include diagnosis, prevention and treatment of viral infection by Equine Herpesvirus 2. Specific functions, and accordingly utilities, of VGR3221 gene correlate with, and may be deduced from, the identity of the host target genes, which are inhibited by VGAM RNAs comprised in the 'operon-like' cluster of VGR3221 gene: VGAM2337 host target protein, VGAM2338 host target protein, VGAM2339 host target protein, VGAM2340 host target protein, VGAM2341 host target protein, VGAM2342 host target protein, VGAM2343 host target protein and VGAM2344 host target protein, herein schematically represented by VGAM1 HOST TARGET PROTEIN through VGAM3 HOST TARGET PROTEIN. The function of these host target genes is elaborated hereinabove with reference to VGAM2337, VGAM2338, VGAM2339, VGAM2340, VGAM2341, VGAM2342, VGAM2343 and VGAM2344. FIG. 9 further provides a conceptual description of novel bioinformatically detected regulatory viral gene, referred to here as Viral Genomic Record 3222(VGR3222) viral gene, which encodes an 'operon-like' cluster of novel viral micro RNA-like genes, each of which in turn modulates expression of at least one host target gene, the function and utility of which at least one host target gene is known in the art.

VGR3222 gene, herein designated VGR GENE, is a novel bioinformatically detected regulatory, non protein coding, RNA viral gene. The method by which VGR3222 gene was detected is described hereinabove with reference to FIGS. 1-9.

VGR3222 gene encodes VGR3222 precursor RNA, herein designated VGR PRECURSOR RNA, an RNA molecule, typically several hundred nucleotides long.

VGR3222 precursor RNA folds spatially, forming VGR3222 folded precursor RNA, herein designated VGR FOLDED PRECURSOR RNA. It is appreciated that VGR3222 folded precursor RNA comprises a plurality of what is known in the art as 'hairpin' structures. These 'hairpin' structures are due to the fact that the nucleotide sequence of VGR3222 precursor RNA comprises a plurality of segments, the first half of each such segment having a nucleotide sequence which is at least a partial inversed-reversed sequence of the second half thereof, as is well known in the art.

VGR3222 folded precursor RNA is naturally processed by cellular enzymatic activity into at least 8 separate VGAM precursor RNAs, VGAM2345 precursor RNA, VGAM2346 precursor RNA, VGAM2347 precursor RNA, VGAM2348 precursor RNA, VGAM2349 precursor RNA, VGAM2350 precursor RNA, VGAM2351 precursor RNA and VGAM2352 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2345 RNA, VGAM2346 RNA, VGAM2347 RNA, VGAM2348 RNA, VGAM2349 RNA, VGAM2350 RNA, VGAM2351 RNA and VGAM2352 RNA, herein schematically represented by VGAM1 RNA through VGAM3 RNA, each of which VGAM RNAs corresponding to VGAM RNA of FIG. 1.

VGAM2345 RNA, herein schematically represented by VGAM1 RNA through VGAM3 RNA, binds complementarily to a host target binding site located in an untranslated region of VGAM2345 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2345 host target RNA into VGAM2345 host target protein, herein schematically represented by VGAM1 HOST TARGET PROTEIN through VGAM3 HOST TARGET PROTEIN, all of FIG. 1.

VGAM2346 RNA, herein schematically represented by VGAM1 RNA through VGAM3 RNA, binds complementarily to a host target binding site located in an untranslated region of VGAM2346 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2346 host target RNA into VGAM2346 host target protein, herein schematically represented by VGAM1 HOST TARGET PROTEIN through VGAM3 HOST TARGET PROTEIN, all of FIG. 1.

VGAM2347 RNA, herein schematically represented by VGAM1 RNA through VGAM3 RNA, binds complementarily to a host target binding site located in an untranslated region of VGAM2347 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2347 host target RNA into VGAM2347 host target protein, herein schematically represented by VGAM1 HOST TARGET PROTEIN through VGAM3 HOST TARGET PROTEIN, all of FIG. 1.

VGAM2348 RNA, herein schematically represented by VGAM1 RNA through VGAM3 RNA, binds complementarily to a host target binding site located in an untranslated region of VGAM2348 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2348 host target RNA into VGAM2348 host target protein, herein schematically represented by VGAM1 HOST TARGET PROTEIN through VGAM3 HOST TARGET PROTEIN, all of FIG. 1.

VGAM2349 RNA, herein schematically represented by VGAM1 RNA through VGAM3 RNA, binds complementarily to a host target binding site located in an untranslated region of VGAM2349 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2349 host target RNA into VGAM2349 host target protein, herein schematically represented by VGAM1 HOST TARGET PROTEIN through VGAM3 HOST TARGET PROTEIN, all of FIG. 1.

VGAM2350 RNA, herein schematically represented by VGAM1 RNA through VGAM3 RNA, binds complementarily to a host target binding site located in an untranslated region of VGAM2350 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2350 host target RNA into VGAM2350 host target protein, herein schematically represented by VGAM1 HOST TARGET PROTEIN through VGAM3 HOST TARGET PROTEIN, all of FIG. 1.

VGAM2351 RNA, herein schematically represented by VGAM1 RNA through VGAM3 RNA, binds complementarily to a host target binding site located in an untranslated region of VGAM2351 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2351 host target RNA into VGAM2351 host target protein, herein schematically represented by VGAM1 HOST TARGET PROTEIN through VGAM3 HOST TARGET PROTEIN, all of FIG. 1.

VGAM2352 RNA, herein schematically represented by VGAM1 RNA through VGAM3 RNA, binds complementarily to a host target binding site located in an untranslated region of VGAM2352 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2352 host target RNA into VGAM2352 host target protein, herein schematically represented by VGAM1 HOST TARGET PROTEIN through VGAM3 HOST TARGET PROTEIN, all of FIG. 1.

It is appreciated that a function of VGR3222 gene, herein designated VGR GENE, is inhibition of expression of host target genes, as part of a novel viral mechanism of attacking a host. Accordingly, utilities of VGR3222 gene include diagnosis, prevention and treatment of viral infection by Equine Herpesvirus 2. Specific functions, and accordingly utilities, of VGR3222 gene correlate with, and may be deduced from, the identity of the host target genes, which are inhibited by VGAM RNAs comprised in the 'operon-like' cluster of VGR3222 gene: VGAM2345 host target protein, VGAM2346 host target protein, VGAM2347 host target protein, VGAM2348 host target protein, VGAM2349 host target protein, VGAM2350 host target protein, VGAM2351 host target protein and VGAM2352 host target protein, herein schematically represented by VGAM1 HOST TARGET PROTEIN through VGAM3 HOST TARGET PROTEIN. The function of these host target genes is elaborated hereinabove with reference to VGAM2345, VGAM2346, VGAM2347, VGAM2348, VGAM2349, VGAM2350, VGAM2351 and VGAM2352. FIG. 9 further provides a conceptual description of novel bioinformatically detected regulatory viral gene, referred to here as Viral Genomic Record 3223(VGR3223) viral gene, which encodes an 'operon-like' cluster of novel viral micro RNA-like genes, each of which in turn modulates expression of at least one host target gene, the function and utility of which at least one host target gene is known in the art.

VGR3223 gene, herein designated VGR GENE, is a novel bioinformatically detected regulatory, non protein coding, RNA viral gene. The method by which VGR3223 gene was detected is described hereinabove with reference to FIGS. 1-9.

VGR3223 gene encodes VGR3223 precursor RNA, herein designated VGR PRECURSOR RNA, an RNA molecule, typically several hundred nucleotides long.

VGR3223 precursor RNA folds spatially, forming VGR3223 folded precursor RNA, herein designated VGR FOLDED PRECURSOR RNA. It is appreciated that VGR3223 folded precursor RNA comprises a plurality of what is known in the art as 'hairpin' structures. These 'hairpin' structures are due to the fact that the nucleotide sequence of VGR3223 precursor RNA comprises a plurality of segments, the first half of each such segment having a nucleotide sequence which is at least a partial inversed-reversed sequence of the second half thereof, as is well known in the art.

VGR3223 folded precursor RNA is naturally processed by cellular enzymatic activity into at least 8 separate VGAM precursor RNAs, VGAM2353 precursor RNA, VGAM2354 precursor RNA, VGAM2355 precursor RNA, VGAM2356 precursor RNA, VGAM2357 precursor RNA, VGAM2358 precursor RNA, VGAM2359 precursor RNA and VGAM2360 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2353 RNA, VGAM2354 RNA, VGAM2355 RNA, VGAM2356 RNA, VGAM2357 RNA, VGAM2358 RNA, VGAM2359 RNA and VGAM2360 RNA, herein schematically represented by VGAM1 RNA through VGAM3 RNA, each of which VGAM RNAs corresponding to VGAM RNA of FIG. 1.

VGAM2353 RNA, herein schematically represented by VGAM1 RNA through VGAM3 RNA, binds complementarily to a host target binding site located in an untranslated region of VGAM2353 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2353 host target RNA into VGAM2353 host target protein, herein schematically represented by VGAM1 HOST TARGET PROTEIN through VGAM3 HOST TARGET PROTEIN, all of FIG. 1.

VGAM2354 RNA, herein schematically represented by VGAM1 RNA through VGAM3 RNA, binds complementarily to a host target binding site located in an untranslated region of VGAM2354 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2354 host target RNA into VGAM2354 host target protein, herein schematically represented by VGAM1 HOST TARGET PROTEIN through VGAM3 HOST TARGET PROTEIN, all of FIG. 1.

VGAM2355 RNA, herein schematically represented by VGAM1 RNA through VGAM3 RNA, binds complementarily to a host target binding site located in an untranslated region of VGAM2355 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2355 host target RNA into VGAM2355 host target protein, herein schematically represented by VGAM1 HOST TARGET PROTEIN through VGAM3 HOST TARGET PROTEIN, all of FIG. 1.

VGAM2356 RNA, herein schematically represented by VGAM1 RNA through VGAM3 RNA, binds complementarily to a host target binding site located in an untranslated region of VGAM2356 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2356 host target RNA into VGAM2356 host target protein, herein schematically represented by VGAM1 HOST TARGET PROTEIN through VGAM3 HOST TARGET PROTEIN, all of FIG. 1.

VGAM2357 RNA, herein schematically represented by VGAM1 RNA through VGAM3 RNA, binds complementarily to a host target binding site located in an untranslated region of VGAM2357 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2357 host target RNA into VGAM2357 host target protein, herein schematically represented by VGAM1 HOST TARGET PROTEIN through VGAM3 HOST TARGET PROTEIN, all of FIG. 1.

VGAM2358 RNA, herein schematically represented by VGAM1 RNA through VGAM3 RNA, binds complementarily to a host target binding site located in an untranslated region of VGAM2358 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2358 host target RNA into VGAM2358 host target protein, herein schematically represented by VGAM1 HOST TARGET PROTEIN through VGAM3 HOST TARGET PROTEIN, all of FIG. 1.

VGAM2359 RNA, herein schematically represented by VGAM1 RNA through VGAM3 RNA, binds complementarily to a host target binding site located in an untranslated region of VGAM2359 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2359 host target RNA into VGAM2359 host target protein, herein schematically represented by VGAM1 HOST TARGET PROTEIN through VGAM3 HOST TARGET PROTEIN, all of FIG. 1.

VGAM2360 RNA, herein schematically represented by VGAM1 RNA through VGAM3 RNA, binds complementarily to a host target binding site located in an untranslated region of VGAM2360 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2360 host target RNA into VGAM2360 host target protein, herein schematically represented by VGAM1 HOST TARGET PROTEIN through VGAM3 HOST TARGET PROTEIN, all of FIG. 1.

It is appreciated that a function of VGR3223 gene, herein designated VGR GENE, is inhibition of expression of host target genes, as part of a novel viral mechanism of attacking a host. Accordingly, utilities of VGR3223 gene include diagnosis, prevention and treatment of viral infection by Equine Herpesvirus 2. Specific functions, and accordingly utilities, of VGR3223 gene correlate with, and may be deduced from, the identity of the host target genes, which are inhibited by VGAM RNAs comprised in the 'operon-like' cluster of VGR3223 gene: VGAM2353 host target protein, VGAM2354 host target protein, VGAM2355 host target protein, VGAM2356 host target protein, VGAM2357 host target protein, VGAM2358 host target protein, VGAM2359 host target protein and VGAM2360 host target protein, herein schematically represented by VGAM1 HOST TARGET PROTEIN through VGAM3 HOST TARGET PROTEIN. The function of these host target genes is elaborated hereinabove with reference to VGAM2353, VGAM2354, VGAM2355, VGAM2356, VGAM2357, VGAM2358, VGAM2359 and VGAM2360. FIG. 9 further provides a conceptual description of novel bioinformatically detected regulatory viral gene, referred to here as Viral Genomic Record 3224(VGR3224) viral gene, which encodes an 'operon-like' cluster of novel viral micro RNA-like genes, each of which in turn modulates expression of at least one host target gene, the function and utility of which at least one host target gene is known in the art.

VGR3224 gene, herein designated VGR GENE, is a novel bioinformatically detected regulatory, non protein coding, RNA viral gene. The method by which VGR3224 gene was detected is described hereinabove with reference to FIGS. 1-9.

VGR3224 gene encodes VGR3224 precursor RNA, herein designated VGR PRECURSOR RNA, an RNA molecule, typically several hundred nucleotides long.

VGR3224 precursor RNA folds spatially, forming VGR3224 folded precursor RNA, herein designated VGR FOLDED PRECURSOR RNA. It is appreciated that VGR3224 folded precursor RNA comprises a plurality of what is known in the art as 'hairpin' structures. These 'hairpin' structures are due to the fact that the nucleotide sequence of VGR3224 precursor RNA comprises a plurality of segments, the first half of each such segment having a nucleotide sequence which is at least a partial inversed-reversed sequence of the second half thereof, as is well known in the art.

VGR3224 folded precursor RNA is naturally processed by cellular enzymatic activity into at least 4 separate VGAM precursor RNAs, VGAM2361 precursor RNA, VGAM2362 precursor RNA, VGAM2363 precursor RNA and VGAM2364 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2361 RNA, VGAM2362 RNA, VGAM2363 RNA and VGAM2364 RNA, herein schematically represented by VGAM1 RNA through VGAM3 RNA, each of which VGAM RNAs corresponding to VGAM RNA of FIG. 1.

VGAM2361 RNA, herein schematically represented by VGAM1 RNA through VGAM3 RNA, binds complementarily to a host target binding site located in an untranslated region of VGAM2361 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2361 host target RNA into VGAM2361 host target protein, herein schematically represented by VGAM1 HOST TARGET PROTEIN through VGAM3 HOST TARGET PROTEIN, all of FIG. 1.

VGAM2362 RNA, herein schematically represented by VGAM1 RNA through VGAM3 RNA, binds complementarily to a host target binding site located in an untranslated region of VGAM2362 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2362 host target RNA into VGAM2362 host target protein, herein schematically represented by VGAM1 HOST TARGET PROTEIN through VGAM3 HOST TARGET PROTEIN, all of FIG. 1.

VGAM2363 RNA, herein schematically represented by VGAM1 RNA through VGAM3 RNA, binds complementarily to a host target binding site located in an untranslated region of VGAM2363 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2363 host target RNA into VGAM2363 host target protein, herein schematically represented by VGAM1 HOST TARGET PROTEIN through VGAM3 HOST TARGET PROTEIN, all of FIG. 1.

VGAM2364 RNA, herein schematically represented by VGAM1 RNA through VGAM3 RNA, binds complementarily to a host target binding site located in an untranslated region of VGAM2364 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2364 host target RNA into VGAM2364 host target protein, herein schematically represented by VGAM1 HOST TARGET PROTEIN through VGAM3 HOST TARGET PROTEIN, all of FIG. 1.

It is appreciated that a function of VGR3224 gene, herein designated VGR GENE, is inhibition of expression of host target genes, as part of a novel viral mechanism of attacking a host. Accordingly, utilities of VGR3224 gene include diagnosis, prevention and treatment of viral infection by Equine Herpesvirus 2. Specific functions, and accordingly utilities, of VGR3224 gene correlate with, and may be deduced from, the identity of the host target genes, which are inhibited by VGAM RNAs comprised in the 'operon-like' cluster of VGR3224 gene: VGAM2361 host target protein, VGAM2362 host target protein, VGAM2363 host target protein and VGAM2364 host target protein, herein schematically represented by VGAM1 HOST TARGET PROTEIN through VGAM3 HOST TARGET PROTEIN. The function of these host target genes is elaborated hereinabove with reference to VGAM2361, VGAM2362, VGAM2363 and VGAM2364.

FIG. 9 further provides a conceptual description of novel bioinformatically detected regulatory viral gene, referred to here as Viral Genomic Record 3225(VGR3225) viral gene, which encodes an 'operon-like' cluster of novel viral micro RNA-like genes, each of which in turn modulates expression of at least one host target gene, the function and utility of which at least one host target gene is known in the art.

VGR3225 gene, herein designated VGR GENE, is a novel bioinformatically detected regulatory, non protein coding, RNA viral gene. The method by which VGR3225 gene was detected is described hereinabove with reference to FIGS. 1-9.

VGR3225 gene encodes VGR3225 precursor RNA, herein designated VGR PRECURSOR RNA, an RNA molecule, typically several hundred nucleotides long.

VGR3225 precursor RNA folds spatially, forming VGR3225 folded precursor RNA, herein designated VGR FOLDED PRECURSOR RNA. It is appreciated that VGR3225 folded precursor RNA comprises a plurality of what is known in the art as 'hairpin' structures. These 'hairpin' structures are due to the fact that the nucleotide sequence of VGR3225 precursor RNA comprises a plurality of segments, the first half of each such segment having a nucleotide sequence which is at least a partial inversed-reversed sequence of the second half thereof, as is well known in the art.

VGR3225 folded precursor RNA is naturally processed by cellular enzymatic activity into at least 8 separate VGAM precursor RNAs, VGAM2365 precursor RNA, VGAM2366 precursor RNA, VGAM2367 precursor RNA, VGAM2368 precursor RNA, VGAM2369 precursor RNA, VGAM2370 precursor RNA, VGAM2371 precursor RNA and VGAM2372 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2365 RNA, VGAM2366 RNA, VGAM2367 RNA, VGAM2368 RNA, VGAM2369 RNA, VGAM2370 RNA, VGAM2371 RNA and VGAM2372 RNA, herein schematically represented by VGAM1 RNA through VGAM3 RNA, each of which VGAM RNAs corresponding to VGAM RNA of FIG. 1.

VGAM2365 RNA, herein schematically represented by VGAM1 RNA through VGAM3 RNA, binds complementarily to a host target binding site located in an untranslated region of VGAM2365 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2365 host target RNA into VGAM2365 host target protein, herein schematically represented by VGAM1 HOST TARGET PROTEIN through VGAM3 HOST TARGET PROTEIN, all of FIG. 1.

VGAM2366 RNA, herein schematically represented by VGAM1 RNA through VGAM3 RNA, binds complementarily to a host target binding site located in an untranslated region of VGAM2366 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2366 host target RNA into VGAM2366 host target protein, herein schematically represented by VGAM1 HOST TARGET PROTEIN through VGAM3 HOST TARGET PROTEIN, all of FIG. 1.

VGAM2367 RNA, herein schematically represented by VGAM1 RNA through VGAM3 RNA, binds complementarily to a host target binding site located in an untranslated region of VGAM2367 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2367 host target RNA into VGAM2367 host target protein, herein schematically represented by VGAM1 HOST TARGET PROTEIN through VGAM3 HOST TARGET PROTEIN, all of FIG. 1.

VGAM2368 RNA, herein schematically represented by VGAM1 RNA through VGAM3 RNA, binds complementarily to a host target binding site located in an untranslated region of VGAM2368 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2368 host target RNA into VGAM2368 host target protein, herein schematically represented by VGAM1 HOST TARGET PROTEIN through VGAM3 HOST TARGET PROTEIN, all of FIG. 1.

VGAM2369 RNA, herein schematically represented by VGAM1 RNA through VGAM3 RNA, binds complementarily to a host target binding site located in an untranslated region of VGAM2369 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2369 host target RNA into VGAM2369 host target protein, herein schematically represented by VGAM1 HOST TARGET PROTEIN through VGAM3 HOST TARGET PROTEIN, all of FIG. 1.

VGAM2370 RNA, herein schematically represented by VGAM1 RNA through VGAM3 RNA, binds complementarily to a host target binding site located in an untranslated region of VGAM2370 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2370 host target RNA into VGAM2370 host target protein, herein schematically represented by VGAM1 HOST TARGET PROTEIN through VGAM3 HOST TARGET PROTEIN, all of FIG. 1.

VGAM2371 RNA, herein schematically represented by VGAM1 RNA through VGAM3 RNA, binds complementarily to a host target binding site located in an untranslated region of VGAM2371 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2371 host target RNA into VGAM2371 host target protein, herein schematically represented by VGAM1 HOST TARGET PROTEIN through VGAM3 HOST TARGET PROTEIN, all of FIG. 1.

VGAM2372 RNA, herein schematically represented by VGAM1 RNA through VGAM3 RNA, binds complementarily to a host target binding site located in an untranslated region of VGAM2372 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2372 host target RNA into VGAM2372 host target protein, herein schematically represented by VGAM1 HOST TARGET PROTEIN through VGAM3 HOST TARGET PROTEIN, all of FIG. 1.

It is appreciated that a function of VGR3225 gene, herein designated VGR GENE, is inhibition of expression of host target genes, as part of a novel viral mechanism of attacking a host. Accordingly, utilities of VGR3225 gene include diagnosis, prevention and treatment of viral infection by Rat Cytomegalovirus. Specific functions, and accordingly utilities, of VGR3225 gene correlate with, and may be deduced from, the identity of the host target genes, which are inhibited by VGAM RNAs comprised in the 'operon-like' cluster of VGR3225 gene: VGAM2365 host target protein, VGAM2366 host target protein, VGAM2367 host target protein, VGAM2368 host target protein, VGAM2369 host target protein, VGAM2370 host target protein, VGAM2371 host target protein and VGAM2372 host target protein, herein schematically represented by VGAM1 HOST TARGET PROTEIN through VGAM3 HOST TARGET PROTEIN. The function of these host target genes is elaborated hereinabove with reference to VGAM2365, VGAM2366, VGAM2367, VGAM2368, VGAM2369, VGAM2370, VGAM2371 and VGAM2372. FIG. 9 further provides a conceptual description of novel bioinformatically detected regulatory viral gene, referred to here as Viral Genomic Record 3226(VGR3226) viral gene, which encodes an 'operon-like' cluster of novel viral micro RNA-like genes, each of which in turn modulates expression of at least one host target gene, the function and utility of which at least one host target gene is known in the art.

VGR3226 gene, herein designated VGR GENE, is a novel bioinformatically detected regulatory, non protein coding, RNA viral gene. The method by which VGR3226 gene was detected is described hereinabove with reference to FIGS. 1-9.

VGR3226 gene encodes VGR3226 precursor RNA, herein designated VGR PRECURSOR RNA, an RNA molecule, typically several hundred nucleotides long.

VGR3226 precursor RNA folds spatially, forming VGR3226 folded precursor RNA, herein designated VGR FOLDED PRECURSOR RNA. It is appreciated that VGR3226 folded precursor RNA comprises a plurality of what is known in the art as 'hairpin' structures. These 'hairpin' structures are due to the fact that the nucleotide sequence of VGR3226 precursor RNA comprises a plurality of segments, the first half of each such segment having a nucleotide sequence which is at least a partial inversed-reversed sequence of the second half thereof, as is well known in the art.

VGR3226 folded precursor RNA is naturally processed by cellular enzymatic activity into at least 7 separate VGAM precursor RNAs, VGAM2373 precursor RNA, VGAM2374 precursor RNA, VGAM2375 precursor RNA, VGAM2376 precursor RNA, VGAM2377 precursor RNA, VGAM2378 precursor RNA and VGAM2379 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2373 RNA, VGAM2374 RNA, VGAM2375 RNA, VGAM2376 RNA, VGAM2377 RNA, VGAM2378 RNA and VGAM2379 RNA, herein schematically represented by VGAM1 RNA through VGAM3 RNA, each of which VGAM RNAs corresponding to VGAM RNA of FIG. 1.

VGAM2373 RNA, herein schematically represented by VGAM1 RNA through VGAM3 RNA, binds complementarily to a host target binding site located in an untranslated region of VGAM2373 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2373 host target RNA into VGAM2373 host target protein, herein schematically represented by VGAM1 HOST TARGET PROTEIN through VGAM3 HOST TARGET PROTEIN, all of FIG. 1.

VGAM2374 RNA, herein schematically represented by VGAM1 RNA through VGAM3 RNA, binds complementarily to a host target binding site located in an untranslated region of VGAM2374 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2374 host target RNA into VGAM2374 host target protein, herein schematically represented by VGAM1 HOST TARGET PROTEIN through VGAM3 HOST TARGET PROTEIN, all of FIG. 1.

VGAM2375 RNA, herein schematically represented by VGAM1 RNA through VGAM3 RNA, binds complementarily to a host target binding site located in an untranslated region of VGAM2375 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2375 host target RNA into VGAM2375 host target protein, herein schematically represented by VGAM1 HOST TARGET PROTEIN through VGAM3 HOST TARGET PROTEIN, all of FIG. 1.

VGAM2376 RNA, herein schematically represented by VGAM1 RNA through VGAM3 RNA, binds complementarily to a host target binding site located in an untranslated region of VGAM2376 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2376 host target RNA into VGAM2376 host target protein, herein schematically represented by VGAM1 HOST TARGET PROTEIN through VGAM3 HOST TARGET PROTEIN, all of FIG. 1.

VGAM2377 RNA, herein schematically represented by VGAM1 RNA through VGAM3 RNA, binds complementarily to a host target binding site located in an untranslated region of VGAM2377 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2377 host target RNA into VGAM2377 host target protein, herein schematically represented by VGAM1 HOST TARGET PROTEIN through VGAM3 HOST TARGET PROTEIN, all of FIG. 1.

VGAM2378 RNA, herein schematically represented by VGAM1 RNA through VGAM3 RNA, binds complementarily to a host target binding site located in an untranslated region of VGAM2378 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2378 host target RNA into VGAM2378 host target protein, herein schematically represented by VGAM1 HOST TARGET PROTEIN through VGAM3 HOST TARGET PROTEIN, all of FIG. 1.

VGAM2379 RNA, herein schematically represented by VGAM1 RNA through VGAM3 RNA, binds complementarily to a host target binding site located in an untranslated region of VGAM2379 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2379 host target RNA into VGAM2379 host target protein, herein schematically represented by VGAM1 HOST TARGET PROTEIN through VGAM3 HOST TARGET PROTEIN, all of FIG. 1.

It is appreciated that a function of VGR3226 gene, herein designated VGR GENE, is inhibition of expression of host target genes, as part of a novel viral mechanism of attacking a host. Accordingly, utilities of VGR3226 gene include diagnosis, prevention and treatment of viral infection by Rat Cytomegalovirus. Specific functions, and accordingly utilities, of VGR3226 gene correlate with, and may be deduced from, the identity of the host target genes, which are inhibited by VGAM RNAs comprised in the 'operon-like' cluster of VGR3226 gene: VGAM2373 host target protein, VGAM2374 host target protein, VGAM2375 host target protein, VGAM2376 host target protein, VGAM2377 host target protein, VGAM2378 host target protein and VGAM2379 host target protein, herein schematically represented by VGAM1 HOST TARGET PROTEIN through VGAM3 HOST TARGET PROTEIN. The function of these host target genes is elaborated hereinabove with reference to VGAM2373, VGAM2374, VGAM2375, VGAM2376, VGAM2377, VGAM2378 and VGAM2379. FIG. 9 further provides a conceptual description of novel bioinformatically detected regulatory viral gene, referred to here as Viral Genomic Record 3227(VGR3227) viral gene, which encodes an 'operon-like' cluster of novel viral micro RNA-like genes, each of which in turn modulates expression of at least one host target gene, the function and utility of which at least one host target gene is known in the art.

VGR3227 gene, herein designated VGR GENE, is a novel bioinformatically detected regulatory, non protein coding, RNA viral gene. The method by which VGR3227 gene was detected is described hereinabove with reference to FIGS. 1-9.

VGR3227 gene encodes VGR3227 precursor RNA, herein designated VGR PRECURSOR RNA, an RNA molecule, typically several hundred nucleotides long.

VGR3227 precursor RNA folds spatially, forming VGR3227 folded precursor RNA, herein designated VGR FOLDED PRECURSOR RNA. It is appreciated that VGR3227 folded precursor RNA comprises a plurality of what is known in the art as 'hairpin' structures. These 'hairpin' structures are due to the fact that the nucleotide sequence of VGR3227 precursor RNA comprises a plurality of segments, the first half of each such segment having a nucleotide sequence which is at least a partial inversed-reversed sequence of the second half thereof, as is well known in the art.

VGR3227 folded precursor RNA is naturally processed by cellular enzymatic activity into at least 7 separate VGAM precursor RNAs, VGAM2380 precursor RNA, VGAM2381 precursor RNA, VGAM2382 precursor RNA, VGAM2383 precursor RNA, VGAM2384 precursor RNA, VGAM2385 precursor RNA and VGAM2386 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2380 RNA, VGAM2381 RNA, VGAM2382 RNA, VGAM2383 RNA, VGAM2384 RNA, VGAM2385 RNA and VGAM2386 RNA, herein schematically represented by VGAM1 RNA through VGAM3 RNA, each of which VGAM RNAs corresponding to VGAM RNA of FIG. 1.

VGAM2380 RNA, herein schematically represented by VGAM1 RNA through VGAM3 RNA, binds complementarily to a host target binding site located in an untranslated region of VGAM2380 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2380 host target RNA into VGAM2380 host target protein, herein schematically represented by VGAM1 HOST TARGET PROTEIN through VGAM3 HOST TARGET PROTEIN, all of FIG. 1.

VGAM2381 RNA, herein schematically represented by VGAM1 RNA through VGAM3 RNA, binds complementarily to a host target binding site located in an untranslated region of VGAM2381 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2381 host target RNA into VGAM2381 host target protein, herein schematically represented by VGAM1 HOST TARGET PROTEIN through VGAM3 HOST TARGET PROTEIN, all of FIG. 1.

VGAM2382 RNA, herein schematically represented by VGAM1 RNA through VGAM3 RNA, binds complementarily to a host target binding site located in an untranslated region of VGAM2382 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2382 host target RNA into VGAM2382 host target protein, herein schematically represented by VGAM1 HOST TARGET PROTEIN through VGAM3 HOST TARGET PROTEIN, all of FIG. 1.

VGAM2383 RNA, herein schematically represented by VGAM1 RNA through VGAM3 RNA, binds complementarily to a host target binding site located in an untranslated region of VGAM2383 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2383 host target RNA into VGAM2383 host target protein, herein schematically represented by VGAM1 HOST TARGET PROTEIN through VGAM3 HOST TARGET PROTEIN, all of FIG. 1.

VGAM2384 RNA, herein schematically represented by VGAM1 RNA through VGAM3 RNA, binds complementarily to a host target binding site located in an untranslated region of VGAM2384 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2384 host target RNA into VGAM2384 host target protein, herein schematically represented by VGAM1 HOST TARGET PROTEIN through VGAM3 HOST TARGET PROTEIN, all of FIG. 1.

VGAM2385 RNA, herein schematically represented by VGAM1 RNA through VGAM3 RNA, binds complementarily to a host target binding site located in an untranslated region of VGAM2385 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2385 host target RNA into VGAM2385 host target protein, herein schematically represented by VGAM1 HOST TARGET PROTEIN through VGAM3 HOST TARGET PROTEIN, all of FIG. 1.

VGAM2386 RNA, herein schematically represented by VGAM1 RNA through VGAM3 RNA, binds complementarily to a host target binding site located in an untranslated region of VGAM2386 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2386 host target RNA into VGAM2386 host target protein, herein schematically represented by VGAM1 HOST TARGET PROTEIN through VGAM3 HOST TARGET PROTEIN, all of FIG. 1.

It is appreciated that a function of VGR3227 gene, herein designated VGR GENE, is inhibition of expression of host target genes, as part of a novel viral mechanism of attacking a host. Accordingly, utilities of VGR3227 gene include diagnosis, prevention and treatment of viral infection by Human Herpesvirus 4. Specific functions, and accordingly utilities, of VGR3227 gene correlate with, and may be deduced from, the identity of the host target genes, which are inhibited by VGAM RNAs comprised in the 'operon-like' cluster of VGR3227 gene: VGAM2380 host target protein, VGAM2381 host target protein, VGAM2382 host target protein, VGAM2383 host target protein, VGAM2384 host target protein, VGAM2385 host target protein and VGAM2386 host target protein, herein schematically represented by VGAM1 HOST TARGET PROTEIN through VGAM3 HOST TARGET PROTEIN. The function of these host target genes is elaborated hereinabove with reference to VGAM2380, VGAM2381, VGAM2382, VGAM2383, VGAM2384, VGAM2385 and VGAM2386. FIG. 9 further provides a conceptual description of novel bioinformatically detected regulatory viral gene, referred to here as Viral Genomic Record 3228(VGR3228) viral gene, which encodes an 'operon-like' cluster of novel viral micro RNA-like genes, each of which in turn modulates expression of at least one host target gene, the function and utility of which at least one host target gene is known in the art.

VGR3228 gene, herein designated VGR GENE, is a novel bioinformatically detected regulatory, non protein coding, RNA viral gene. The method by which VGR3228 gene was detected is described hereinabove with reference to FIGS. 1-9.

VGR3228 gene encodes VGR3228 precursor RNA, herein designated VGR PRECURSOR RNA, an RNA molecule, typically several hundred nucleotides long.

VGR3228 precursor RNA folds spatially, forming VGR3228 folded precursor RNA, herein designated VGR FOLDED PRECURSOR RNA. It is appreciated that VGR3228 folded precursor RNA comprises a plurality of what is known in the art as 'hairpin' structures. These 'hairpin' structures are due to the fact that the nucleotide sequence of VGR3228 precursor RNA comprises a plurality of segments, the first half of each such segment having a nucleotide sequence which is at least a partial inversed-reversed sequence of the second half thereof, as is well known in the art.

VGR3228 folded precursor RNA is naturally processed by cellular enzymatic activity into at least 2 separate VGAM precursor RNAs, VGAM2387 precursor RNA and VGAM2388 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2387 RNA and VGAM2388 RNA, herein schematically represented by VGAM1 RNA through VGAM3 RNA, each of which VGAM RNAs corresponding to VGAM RNA of FIG. 1.

VGAM2387 RNA, herein schematically represented by VGAM1 RNA through VGAM3 RNA, binds complementarily to a host target binding site located in an untranslated region of VGAM2387 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2387 host target RNA into VGAM2387 host target protein, herein schematically represented by VGAM1 HOST TARGET PROTEIN through VGAM3 HOST TARGET PROTEIN, all of FIG. 1.

VGAM2388 RNA, herein schematically represented by VGAM1 RNA through VGAM3 RNA, binds complementarily to a host target binding site located in an untranslated region of VGAM2388 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2388 host target RNA into VGAM2388 host target protein, herein schematically represented by VGAM1 HOST TARGET PROTEIN through VGAM3 HOST TARGET PROTEIN, all of FIG. 1.

It is appreciated that a function of VGR3228 gene, herein designated VGR GENE, is inhibition of expression of host target genes, as part of a novel viral mechanism of attacking a host. Accordingly, utilities of VGR3228 gene include diagnosis, prevention and treatment of viral infection by Human Herpesvirus 4. Specific functions, and accordingly utilities, of VGR3228 gene correlate with, and may be deduced from, the identity of the host target genes, which are inhibited by VGAM RNAs comprised in the 'operon-like' cluster of VGR3228 gene: VGAM2387 host target protein and VGAM2388 host target protein, herein schematically represented by VGAM1 HOST TARGET PROTEIN through VGAM3 HOST TARGET PROTEIN. The function of these host target genes is elaborated hereinabove with reference to VGAM2387 and VGAM2388. FIG. 9 further provides a conceptual description of novel bioinformatically detected regulatory viral gene, referred to here as Viral Genomic Record 3229(VGR3229) viral gene, which encodes an 'operon-like' cluster of novel viral micro RNA-like genes, each of which in turn modulates expression of at least one host target gene, the function and utility of which at least one host target gene is known in the art.

VGR3229 gene, herein designated VGR GENE, is a novel bioinformatically detected regulatory, non protein coding, RNA viral gene. The method by which VGR3229 gene was detected is described hereinabove with reference to FIGS. 1-9.

VGR3229 gene encodes VGR3229 precursor RNA, herein designated VGR PRECURSOR RNA, an RNA molecule, typically several hundred nucleotides long.

VGR3229 precursor RNA folds spatially, forming VGR3229 folded precursor RNA, herein designated VGR FOLDED PRECURSOR RNA. It is appreciated that VGR3229 folded precursor RNA comprises a plurality of what is known in the art as 'hairpin' structures. These 'hairpin' structures are due to the fact that the nucleotide sequence of VGR3229 precursor RNA comprises a plurality of segments, the first half of each such segment having a nucleotide sequence which is at least a partial inversed-reversed sequence of the second half thereof, as is well known in the art.

VGR3229 folded precursor RNA is naturally processed by cellular enzymatic activity into at least 8 separate VGAM precursor RNAs, VGAM2389 precursor RNA, VGAM2390 precursor RNA, VGAM2391 precursor RNA, VGAM2392 precursor RNA, VGAM2393 precursor RNA, VGAM2394 precursor RNA, VGAM2395 precursor RNA and VGAM2396 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2389 RNA, VGAM2390 RNA, VGAM2391 RNA, VGAM2392 RNA, VGAM2393 RNA, VGAM2394 RNA, VGAM2395 RNA and VGAM2396 RNA, herein schematically represented by VGAM1 RNA through VGAM3 RNA, each of which VGAM RNAs corresponding to VGAM RNA of FIG. 1.

VGAM2389 RNA, herein schematically represented by VGAM1 RNA through VGAM3 RNA, binds complementarily to a host target binding site located in an untranslated region of VGAM2389 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2389 host target RNA into VGAM2389 host target protein, herein schematically represented by VGAM1 HOST TARGET PROTEIN through VGAM3 HOST TARGET PROTEIN, all of FIG. 1.

VGAM2390 RNA, herein schematically represented by VGAM1 RNA through VGAM3 RNA, binds complementarily to a host target binding site located in an untranslated region of VGAM2390 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2390 host target RNA into VGAM2390 host target protein, herein schematically represented by VGAM1 HOST TARGET PROTEIN through VGAM3 HOST TARGET PROTEIN, all of FIG. 1.

VGAM2391 RNA, herein schematically represented by VGAM1 RNA through VGAM3 RNA, binds complementarily to a host target binding site located in an untranslated region of VGAM2391 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2391 host target RNA into VGAM2391 host target protein, herein schematically represented by VGAM1 HOST TARGET PROTEIN through VGAM3 HOST TARGET PROTEIN, all of FIG. 1.

VGAM2392 RNA, herein schematically represented by VGAM1 RNA through VGAM3 RNA, binds complementarily to a host target binding site located in an untranslated region of VGAM2392 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2392 host target RNA into VGAM2392 host target protein, herein schematically represented by VGAM1 HOST TARGET PROTEIN through VGAM3 HOST TARGET PROTEIN, all of FIG. 1.

VGAM2393 RNA, herein schematically represented by VGAM1 RNA through VGAM3 RNA, binds complementarily to a host target binding site located in an untranslated region of VGAM2393 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2393 host target RNA into VGAM2393 host target protein, herein schematically represented by VGAM1 HOST TARGET PROTEIN through VGAM3 HOST TARGET PROTEIN, all of FIG. 1.

VGAM2394 RNA, herein schematically represented by VGAM1 RNA through VGAM3 RNA, binds complementarily to a host target binding site located in an untranslated region of VGAM2394 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2394 host target RNA into VGAM2394 host target protein, herein schematically represented by VGAM1 HOST TARGET PROTEIN through VGAM3 HOST TARGET PROTEIN, all of FIG. 1.

VGAM2395 RNA, herein schematically represented by VGAM1 RNA through VGAM3 RNA, binds complementarily to a host target binding site located in an untranslated region of VGAM2395 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2395 host target RNA into VGAM2395 host target protein, herein schematically represented by VGAM1 HOST TARGET PROTEIN through VGAM3 HOST TARGET PROTEIN, all of FIG. 1.

VGAM2396 RNA, herein schematically represented by VGAM1 RNA through VGAM3 RNA, binds complementarily to a host target binding site located in an untranslated region of VGAM2396 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2396 host target RNA into VGAM2396 host target protein, herein schematically represented by VGAM1 HOST TARGET PROTEIN through VGAM3 HOST TARGET PROTEIN, all of FIG. 1.

It is appreciated that a function of VGR3229 gene, herein designated VGR GENE, is inhibition of expression of host target genes, as part of a novel viral mechanism of attacking a host. Accordingly, utilities of VGR3229 gene include diagnosis, prevention and treatment of viral infection by Goatpox Virus. Specific functions, and accordingly utilities, of VGR3229 gene correlate with, and may be deduced from, the identity of the host target genes, which are inhibited by VGAM RNAs comprised in the 'operon-like' cluster of VGR3229 gene: VGAM2389 host target protein, VGAM2390 host target protein, VGAM2391 host target protein, VGAM2392 host target protein, VGAM2393 host target protein, VGAM2394 host target protein, VGAM2395 host target protein and VGAM2396 host target protein, herein schematically represented by VGAM1 HOST TARGET PROTEIN through VGAM3 HOST TARGET PROTEIN. The function of these host target genes is elaborated hereinabove with reference to VGAM2389, VGAM2390, VGAM2391, VGAM2392, VGAM2393, VGAM2394, VGAM2395 and VGAM2396. FIG. 9 further provides a conceptual description of novel bioinformatically detected regulatory viral gene, referred to here as Viral Genomic Record 3230(VGR3230) viral gene, which encodes an 'operon-like' cluster of novel viral micro RNA-like genes, each of which in turn modulates expression of at least one host target gene, the function and utility of which at least one host target gene is known in the art.

VGR3230 gene, herein designated VGR GENE, is a novel bioinformatically detected regulatory, non protein coding, RNA viral gene. The method by which VGR3230 gene was detected is described hereinabove with reference to FIGS. 1-9.

VGR3230 gene encodes VGR3230 precursor RNA, herein designated VGR PRECURSOR RNA, an RNA molecule, typically several hundred nucleotides long.

VGR3230 precursor RNA folds spatially, forming VGR3230 folded precursor RNA, herein designated VGR FOLDED PRECURSOR RNA. It is appreciated that VGR3230 folded precursor RNA comprises a plurality of what is known in the art as 'hairpin' structures. These 'hairpin' structures are due to the fact that the nucleotide sequence of VGR3230 precursor RNA comprises a plurality of segments, the first half of each such segment having a nucleotide sequence which is at least a partial inversed-reversed sequence of the second half thereof, as is well known in the art.

VGR3230 folded precursor RNA is naturally processed by cellular enzymatic activity into at least 8 separate VGAM precursor RNAs, VGAM2397 precursor RNA, VGAM2398 precursor RNA, VGAM2399 precursor RNA, VGAM2400 precursor RNA, VGAM2401 precursor RNA, VGAM2402 precursor RNA, VGAM2403 precursor RNA and VGAM2404 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2397 RNA, VGAM2398 RNA, VGAM2399 RNA, VGAM2400 RNA, VGAM2401 RNA, VGAM2402 RNA, VGAM2403 RNA and VGAM2404 RNA, herein schematically represented by VGAM1 RNA through VGAM3 RNA, each of which VGAM RNAs corresponding to VGAM RNA of FIG. 1.

VGAM2397 RNA, herein schematically represented by VGAM1 RNA through VGAM3 RNA, binds complementarily to a host target binding site located in an untranslated region of VGAM2397 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2397 host target RNA into VGAM2397 host target protein, herein schematically represented by VGAM1 HOST TARGET PROTEIN through VGAM3 HOST TARGET PROTEIN, all of FIG. 1.

VGAM2398 RNA, herein schematically represented by VGAM1 RNA through VGAM3 RNA, binds complementarily to a host target binding site located in an untranslated region of VGAM2398 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2398 host target RNA into VGAM2398 host target protein, herein schematically represented by VGAM1 HOST TARGET PROTEIN through VGAM3 HOST TARGET PROTEIN, all of FIG. 1.

VGAM2399 RNA, herein schematically represented by VGAM1 RNA through VGAM3 RNA, binds complementarily to a host target binding site located in an untranslated region of VGAM2399 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2399 host target RNA into VGAM2399 host target protein, herein schematically represented by VGAM1 HOST TARGET PROTEIN through VGAM3 HOST TARGET PROTEIN, all of FIG. 1.

VGAM2400 RNA, herein schematically represented by VGAM1 RNA through VGAM3 RNA, binds complementarily to a host target binding site located in an untranslated region of VGAM2400 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2400 host target RNA into VGAM2400 host target protein, herein schematically represented by VGAM1 HOST TARGET PROTEIN through VGAM3 HOST TARGET PROTEIN, all of FIG. 1.

VGAM2401 RNA, herein schematically represented by VGAM1 RNA through VGAM3 RNA, binds complementarily to a host target binding site located in an untranslated region of VGAM2401 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2401 host target RNA into VGAM2401 host target protein, herein schematically represented by VGAM1 HOST TARGET PROTEIN through VGAM3 HOST TARGET PROTEIN, all of FIG. 1.

VGAM2402 RNA, herein schematically represented by VGAM1 RNA through VGAM3 RNA, binds complementarily to a host target binding site located in an untranslated region of VGAM2402 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2402 host target RNA into VGAM2402 host target protein, herein schematically represented by VGAM1 HOST TARGET PROTEIN through VGAM3 HOST TARGET PROTEIN, all of FIG. 1.

VGAM2403 RNA, herein schematically represented by VGAM1 RNA through VGAM3 RNA, binds complementarily to a host target binding site located in an untranslated region of VGAM2403 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2403 host target RNA into VGAM2403 host target protein, herein schematically represented by VGAM1 HOST TARGET PROTEIN through VGAM3 HOST TARGET PROTEIN, all of FIG. 1.

VGAM2404 RNA, herein schematically represented by VGAM1 RNA through VGAM3 RNA, binds complementarily to a host target binding site located in an untranslated region of VGAM2404 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2404 host target RNA into VGAM2404 host target protein, herein schematically represented by VGAM1 HOST TARGET PROTEIN through VGAM3 HOST TARGET PROTEIN, all of FIG. 1.

It is appreciated that a function of VGR3230 gene, herein designated VGR GENE, is inhibition of expression of host target genes, as part of a novel viral mechanism of attacking a host. Accordingly, utilities of VGR3230 gene include diagnosis, prevention and treatment of viral infection by Goatpox Virus. Specific functions, and accordingly utilities, of VGR3230 gene correlate with, and may be deduced from, the identity of the host target genes, which are inhibited by VGAM RNAs comprised in the 'operon-like' cluster of VGR3230 gene: VGAM2397 host target protein, VGAM2398 host target protein, VGAM2399 host target protein, VGAM2400 host target protein, VGAM2401 host target protein, VGAM2402 host target protein, VGAM2403 host target protein and VGAM2404 host target protein, herein schematically represented by VGAM1 HOST TARGET PROTEIN through VGAM3 HOST TARGET PROTEIN. The function of these host target genes is elaborated hereinabove with reference to VGAM2397, VGAM2398, VGAM2399, VGAM2400, VGAM2401, VGAM2402, VGAM2403 and VGAM2404. FIG. 9 further provides a conceptual description of novel bioinformatically detected regulatory viral gene, referred to here as Viral Genomic Record 3231(VGR3231) viral gene, which encodes an 'operon-like' cluster of novel viral micro RNA-like genes, each of which in turn modulates expression of at least one host target gene, the function and utility of which at least one host target gene is known in the art.

VGR3231 gene, herein designated VGR GENE, is a novel bioinformatically detected regulatory, non protein coding, RNA viral gene. The method by which VGR3231 gene was detected is described hereinabove with reference to FIGS. 1-9.

VGR3231 gene encodes VGR3231 precursor RNA, herein designated VGR PRECURSOR RNA, an RNA molecule, typically several hundred nucleotides long.

VGR3231 precursor RNA folds spatially, forming VGR3231 folded precursor RNA, herein designated VGR FOLDED PRECURSOR RNA. It is appreciated that VGR3231 folded precursor RNA comprises a plurality of what is known in the art as 'hairpin' structures. These 'hairpin' structures are due to the fact that the nucleotide sequence of VGR3231 precursor RNA comprises a plurality of segments, the first half of each such segment having a nucleotide sequence which is at least a partial inversed-reversed sequence of the second half thereof, as is well known in the art.

VGR3231 folded precursor RNA is naturally processed by cellular enzymatic activity into at least 8 separate VGAM precursor RNAs, VGAM2405 precursor RNA, VGAM2406 precursor RNA, VGAM2407 precursor RNA, VGAM2408 precursor RNA, VGAM2409 precursor RNA, VGAM2410 precursor RNA, VGAM2411 precursor RNA and VGAM2412 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2405 RNA, VGAM2406 RNA, VGAM2407 RNA, VGAM2408 RNA, VGAM2409 RNA, VGAM2410 RNA, VGAM2411 RNA and VGAM2412 RNA, herein schematically represented by VGAM1 RNA through VGAM3 RNA, each of which VGAM RNAs corresponding to VGAM RNA of FIG. 1.

VGAM2405 RNA, herein schematically represented by VGAM1 RNA through VGAM3 RNA, binds complementarily to a host target binding site located in an untranslated region of VGAM2405 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2405 host target RNA into VGAM2405 host target protein, herein schematically represented by VGAM1 HOST TARGET PROTEIN through VGAM3 HOST TARGET PROTEIN, all of FIG. 1.

VGAM2406 RNA, herein schematically represented by VGAM1 RNA through VGAM3 RNA, binds complementarily to a host target binding site located in an untranslated region of VGAM2406 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2406 host target RNA into VGAM2406 host target protein, herein schematically represented by VGAM1 HOST TARGET PROTEIN through VGAM3 HOST TARGET PROTEIN, all of FIG. 1.

VGAM2407 RNA, herein schematically represented by VGAM1 RNA through VGAM3 RNA, binds complementarily to a host target binding site located in an untranslated region of VGAM2407 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2407 host target RNA into VGAM2407 host target protein, herein schematically represented by VGAM1 HOST TARGET PROTEIN through VGAM3 HOST TARGET PROTEIN, all of FIG. 1.

VGAM2408 RNA, herein schematically represented by VGAM1 RNA through VGAM3 RNA, binds complementarily to a host target binding site located in an untranslated region of VGAM2408 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2408 host target RNA into VGAM2408 host target protein, herein schematically represented by VGAM1 HOST TARGET PROTEIN through VGAM3 HOST TARGET PROTEIN, all of FIG. 1.

VGAM2409 RNA, herein schematically represented by VGAM1 RNA through VGAM3 RNA, binds complementarily to a host target binding site located in an untranslated region of VGAM2409 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2409 host target RNA into VGAM2409 host target protein, herein schematically represented by VGAM1 HOST TARGET PROTEIN through VGAM3 HOST TARGET PROTEIN, all of FIG. 1.

VGAM2410 RNA, herein schematically represented by VGAM1 RNA through VGAM3 RNA, binds complementarily to a host target binding site located in an untranslated region of VGAM2410 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2410 host target RNA into VGAM2410 host target protein, herein schematically represented by VGAM1 HOST TARGET PROTEIN through VGAM3 HOST TARGET PROTEIN, all of FIG. 1.

VGAM2411 RNA, herein schematically represented by VGAM1 RNA through VGAM3 RNA, binds complementarily to a host target binding site located in an untranslated region of VGAM2411 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2411 host target RNA into VGAM2411 host target protein, herein schematically represented by VGAM1 HOST TARGET PROTEIN through VGAM3 HOST TARGET PROTEIN, all of FIG. 1.

VGAM2412 RNA, herein schematically represented by VGAM1 RNA through VGAM3 RNA, binds complementarily to a host target binding site located in an untranslated region of VGAM2412 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2412 host target RNA into VGAM2412 host target protein, herein schematically represented by VGAM1 HOST TARGET PROTEIN through VGAM3 HOST TARGET PROTEIN, all of FIG. 1.

It is appreciated that a function of VGR3231 gene, herein designated VGR GENE, is inhibition of expression of host target genes, as part of a novel viral mechanism of attacking a host. Accordingly, utilities of VGR3231 gene include diagnosis, prevention and treatment of viral infection by Goatpox Virus. Specific functions, and accordingly utilities, of VGR3231 gene correlate with, and may be deduced from, the identity of the host target genes, which are inhibited by VGAM RNAs comprised in the 'operon-like' cluster of VGR3231 gene: VGAM2405 host target protein, VGAM2406 host target protein, VGAM2407 host target protein, VGAM2408 host target protein, VGAM2409 host target protein, VGAM2410 host target protein, VGAM2411 host target protein and VGAM2412 host target protein, herein schematically represented by VGAM1 HOST TARGET PROTEIN through VGAM3 HOST TARGET PROTEIN. The function of these host target genes is elaborated hereinabove with reference to VGAM2405, VGAM2406, VGAM2407, VGAM2408, VGAM2409, VGAM2410, VGAM2411 and VGAM2412. FIG. 9 further provides a conceptual description of novel bioinformatically detected regulatory viral gene, referred to here as Viral Genomic Record 3232(VGR3232) viral gene, which encodes an 'operon-like' cluster of novel viral micro RNA-like genes, each of which in turn modulates expression of at least one host target gene, the function and utility of which at least one host target gene is known in the art.

VGR3232 gene, herein designated VGR GENE, is a novel bioinformatically detected regulatory, non protein coding, RNA viral gene. The method by which VGR3232 gene was detected is described hereinabove with reference to FIGS. 1-9.

VGR3232 gene encodes VGR3232 precursor RNA, herein designated VGR PRECURSOR RNA, an RNA molecule, typically several hundred nucleotides long.

VGR3232 precursor RNA folds spatially, forming VGR3232 folded precursor RNA, herein designated VGR FOLDED PRECURSOR RNA. It is appreciated that VGR3232 folded precursor RNA comprises a plurality of what is known in the art as 'hairpin' structures. These 'hairpin' structures are due to the fact that the nucleotide sequence of VGR3232 precursor RNA comprises a plurality of segments, the first half of each such segment having a nucleotide sequence which is at least a partial inversed-reversed sequence of the second half thereof, as is well known in the art.

VGR3232 folded precursor RNA is naturally processed by cellular enzymatic activity into at least 8 separate VGAM precursor RNAs, VGAM2413 precursor RNA, VGAM2414 precursor RNA, VGAM2415 precursor RNA, VGAM2416 precursor RNA, VGAM2417 precursor RNA, VGAM2418 precursor RNA, VGAM2419 precursor RNA and VGAM2420 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2413 RNA, VGAM2414 RNA, VGAM2415 RNA, VGAM2416 RNA, VGAM2417 RNA, VGAM2418 RNA, VGAM2419 RNA and VGAM2420 RNA, herein schematically represented by VGAM1 RNA through VGAM3 RNA, each of which VGAM RNAs corresponding to VGAM RNA of FIG. 1.

VGAM2413 RNA, herein schematically represented by VGAM1 RNA through VGAM3 RNA, binds complementarily to a host target binding site located in an untranslated region of VGAM2413 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2413 host target RNA into VGAM2413 host target protein, herein schematically represented by VGAM1 HOST TARGET PROTEIN through VGAM3 HOST TARGET PROTEIN, all of FIG. 1.

VGAM2414 RNA, herein schematically represented by VGAM1 RNA through VGAM3 RNA, binds complementarily to a host target binding site located in an untranslated region of VGAM2414 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2414 host target RNA into VGAM2414 host target protein, herein schematically represented by VGAM1 HOST TARGET PROTEIN through VGAM3 HOST TARGET PROTEIN, all of FIG. 1.

VGAM2415 RNA, herein schematically represented by VGAM1 RNA through VGAM3 RNA, binds complementarily to a host target binding site located in an untranslated region of VGAM2415 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2415 host target RNA into VGAM2415 host target protein, herein schematically represented by VGAM1 HOST TARGET PROTEIN through VGAM3 HOST TARGET PROTEIN, all of FIG. 1.

VGAM2416 RNA, herein schematically represented by VGAM1 RNA through VGAM3 RNA, binds complementarily to a host target binding site located in an untranslated region of VGAM2416 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2416 host target RNA into VGAM2416 host target protein, herein schematically represented by VGAM1 HOST TARGET PROTEIN through VGAM3 HOST TARGET PROTEIN, all of FIG. 1.

VGAM2417 RNA, herein schematically represented by VGAM1 RNA through VGAM3 RNA, binds complementarily to a host target binding site located in an untranslated region of VGAM2417 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2417 host target RNA into VGAM2417 host target protein, herein schematically represented by VGAM1 HOST TARGET PROTEIN through VGAM3 HOST TARGET PROTEIN, all of FIG. 1.

VGAM2418 RNA, herein schematically represented by VGAM1 RNA through VGAM3 RNA, binds complementarily to a host target binding site located in an untranslated region of VGAM2418 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2418 host target RNA into VGAM2418 host target protein, herein schematically represented by VGAM1 HOST TARGET PROTEIN through VGAM3 HOST TARGET PROTEIN, all of FIG. 1.

VGAM2419 RNA, herein schematically represented by VGAM1 RNA through VGAM3 RNA, binds complementarily to a host target binding site located in an untranslated region of VGAM2419 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2419 host target RNA into VGAM2419 host target protein, herein schematically represented by VGAM1 HOST TARGET PROTEIN through VGAM3 HOST TARGET PROTEIN, all of FIG. 1.

VGAM2420 RNA, herein schematically represented by VGAM1 RNA through VGAM3 RNA, binds complementarily to a host target binding site located in an untranslated region of VGAM2420 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2420 host target RNA into VGAM2420 host target protein, herein schematically represented by VGAM1 HOST TARGET PROTEIN through VGAM3 HOST TARGET PROTEIN, all of FIG. 1.

It is appreciated that a function of VGR3232 gene, herein designated VGR GENE, is inhibition of expression of host target genes, as part of a novel viral mechanism of attacking a host. Accordingly, utilities of VGR3232 gene include diagnosis, prevention and treatment of viral infection by Goatpox Virus. Specific functions, and accordingly utilities, of VGR3232 gene correlate with, and may be deduced from, the identity of the host target genes, which are inhibited by VGAM RNAs comprised in the 'operon-like' cluster of VGR3232 gene: VGAM2413 host target protein, VGAM2414 host target protein, VGAM2415 host target protein, VGAM2416 host target protein, VGAM2417 host target protein, VGAM2418 host target protein, VGAM2419 host target protein and VGAM2420 host target protein, herein schematically represented by VGAM1 HOST TARGET PROTEIN through VGAM3 HOST TARGET PROTEIN. The function of these host target genes is elaborated hereinabove with reference to VGAM2413, VGAM2414, VGAM2415, VGAM2416, VGAM2417, VGAM2418, VGAM2419 and VGAM2420. FIG. 9 further provides a conceptual description of novel bioinformatically detected regulatory viral gene, referred to here as Viral Genomic Record 3233(VGR3233) viral gene, which encodes an 'operon-like' cluster of novel viral micro RNA-like genes, each of which in turn modulates expression of at least one host target gene, the function and utility of which at least one host target gene is known in the art.

VGR3233 gene, herein designated VGR GENE, is a novel bioinformatically detected regulatory, non protein coding, RNA viral gene. The method by which VGR3233 gene was detected is described hereinabove with reference to FIGS. 1-9.

VGR3233 gene encodes VGR3233 precursor RNA, herein designated VGR PRECURSOR RNA, an RNA molecule, typically several hundred nucleotides long.

VGR3233 precursor RNA folds spatially, forming VGR3233 folded precursor RNA, herein designated VGR FOLDED PRECURSOR RNA. It is appreciated that VGR3233 folded precursor RNA comprises a plurality of what is known in the art as 'hairpin' structures. These 'hairpin' structures are due to the fact that the nucleotide sequence of VGR3233 precursor RNA comprises a plurality of segments, the first half of each such segment having a nucleotide sequence which is at least a partial inversed-reversed sequence of the second half thereof, as is well known in the art.

VGR3233 folded precursor RNA is naturally processed by cellular enzymatic activity into at least 8 separate VGAM precursor RNAs, VGAM2421 precursor RNA, VGAM2422 precursor RNA, VGAM2423 precursor RNA, VGAM2424 precursor RNA, VGAM2425 precursor RNA, VGAM2426 precursor RNA, VGAM2427 precursor RNA and VGAM2428 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2421 RNA, VGAM2422 RNA, VGAM2423 RNA, VGAM2424 RNA, VGAM2425 RNA, VGAM2426 RNA, VGAM2427 RNA and VGAM2428 RNA, herein schematically represented by VGAM1 RNA through VGAM3 RNA, each of which VGAM RNAs corresponding to VGAM RNA of FIG. 1.

VGAM2421 RNA, herein schematically represented by VGAM1 RNA through VGAM3 RNA, binds complementarily to a host target binding site located in an untranslated region of VGAM2421 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2421 host target RNA into VGAM2421 host target protein, herein schematically represented by VGAM1 HOST TARGET PROTEIN through VGAM3 HOST TARGET PROTEIN, all of FIG. 1.

VGAM2422 RNA, herein schematically represented by VGAM1 RNA through VGAM3 RNA, binds complementarily to a host target binding site located in an untranslated region of VGAM2422 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2422 host target RNA into VGAM2422 host target protein, herein schematically represented by VGAM1 HOST TARGET PROTEIN through VGAM3 HOST TARGET PROTEIN, all of FIG. 1.

VGAM2423 RNA, herein schematically represented by VGAM1 RNA through VGAM3 RNA, binds complementarily to a host target binding site located in an untranslated region of VGAM2423 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2423 host target RNA into VGAM2423 host target protein, herein schematically represented by VGAM1 HOST TARGET PROTEIN through VGAM3 HOST TARGET PROTEIN, all of FIG. 1.

VGAM2424 RNA, herein schematically represented by VGAM1 RNA through VGAM3 RNA, binds complementarily to a host target binding site located in an untranslated region of VGAM2424 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2424 host target RNA into VGAM2424 host target protein, herein schematically represented by VGAM1 HOST TARGET PROTEIN through VGAM3 HOST TARGET PROTEIN, all of FIG. 1.

VGAM2425 RNA, herein schematically represented by VGAM1 RNA through VGAM3 RNA, binds complementarily to a host target binding site located in an untranslated region of VGAM2425 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2425 host target RNA into VGAM2425 host target protein, herein schematically represented by VGAM1 HOST TARGET PROTEIN through VGAM3 HOST TARGET PROTEIN, all of FIG. 1.

VGAM2426 RNA, herein schematically represented by VGAM1 RNA through VGAM3 RNA, binds complementarily to a host target binding site located in an untranslated region of VGAM2426 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2426 host target RNA into VGAM2426 host target protein, herein schematically represented by VGAM1 HOST TARGET PROTEIN through VGAM3 HOST TARGET PROTEIN, all of FIG. 1.

VGAM2427 RNA, herein schematically represented by VGAM1 RNA through VGAM3 RNA, binds complementarily to a host target binding site located in an untranslated region of VGAM2427 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2427 host target RNA into VGAM2427 host target protein, herein schematically represented by VGAM1 HOST TARGET PROTEIN through VGAM3 HOST TARGET PROTEIN, all of FIG. 1.

VGAM2428 RNA, herein schematically represented by VGAM1 RNA through VGAM3 RNA, binds complementarily to a host target binding site located in an untranslated region of VGAM2428 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2428 host target RNA into VGAM2428 host target protein, herein schematically represented by VGAM1 HOST TARGET PROTEIN through VGAM3 HOST TARGET PROTEIN, all of FIG. 1.

It is appreciated that a function of VGR3233 gene, herein designated VGR GENE, is inhibition of expression of host target genes, as part of a novel viral mechanism of attacking a host. Accordingly, utilities of VGR3233 gene include diagnosis, prevention and treatment of viral infection by Goatpox Virus. Specific functions, and accordingly utilities, of VGR3233 gene correlate with, and may be deduced from, the identity of the host target genes, which are inhibited by VGAM RNAs comprised in the 'operon-like' cluster of VGR3233 gene: VGAM2421 host target protein, VGAM2422 host target protein, VGAM2423 host target protein, VGAM2424 host target protein, VGAM2425 host target protein, VGAM2426 host target protein, VGAM2427 host target protein and VGAM2428 host target protein, herein schematically represented by VGAM1 HOST TARGET PROTEIN through VGAM3 HOST TARGET PROTEIN. The function of these host target genes is elaborated hereinabove with reference to VGAM2421, VGAM2422, VGAM2423, VGAM2424, VGAM2425, VGAM2426, VGAM2427 and VGAM2428. FIG. 9 further provides a conceptual description of novel bioinformatically detected regulatory viral gene, referred to here as Viral Genomic Record 3234(VGR3234) viral gene, which encodes an 'operon-like' cluster of novel viral micro RNA-like genes, each of which in turn modulates expression of at least one host target gene, the function and utility of which at least one host target gene is known in the art.

VGR3234 gene, herein designated VGR GENE, is a novel bioinformatically detected regulatory, non protein coding, RNA viral gene. The method by which VGR3234 gene was detected is described hereinabove with reference to FIGS. 1-9.

VGR3234 gene encodes VGR3234 precursor RNA, herein designated VGR PRECURSOR RNA, an RNA molecule, typically several hundred nucleotides long.

VGR3234 precursor RNA folds spatially, forming VGR3234 folded precursor RNA, herein designated VGR FOLDED PRECURSOR RNA. It is appreciated that VGR3234 folded precursor RNA comprises a plurality of what is known in the art as 'hairpin' structures. These 'hairpin' structures are due to the fact that the nucleotide sequence of VGR3234 precursor RNA comprises a plurality of segments, the first half of each such segment having a nucleotide sequence which is at least a partial inversed-reversed sequence of the second half thereof, as is well known in the art.

VGR3234 folded precursor RNA is naturally processed by cellular enzymatic activity into at least 8 separate VGAM precursor RNAs, VGAM2429 precursor RNA, VGAM2430 precursor RNA, VGAM2431 precursor RNA, VGAM2432 precursor RNA, VGAM2433 precursor RNA, VGAM2434 precursor RNA, VGAM2435 precursor RNA and VGAM2436 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2429 RNA, VGAM2430 RNA, VGAM2431 RNA, VGAM2432 RNA, VGAM2433 RNA, VGAM2434 RNA, VGAM2435 RNA and VGAM2436 RNA, herein schematically represented by VGAM1 RNA through VGAM3 RNA, each of which VGAM RNAs corresponding to VGAM RNA of FIG. 1.

VGAM2429 RNA, herein schematically represented by VGAM1 RNA through VGAM3 RNA, binds complementarily to a host target binding site located in an untranslated region of VGAM2429 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2429 host target RNA into VGAM2429 host target protein, herein schematically represented by VGAM1 HOST TARGET PROTEIN through VGAM3 HOST TARGET PROTEIN, all of FIG. 1.

VGAM2430 RNA, herein schematically represented by VGAM1 RNA through VGAM3 RNA, binds complementarily to a host target binding site located in an untranslated region of VGAM2430 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2430 host target RNA into VGAM2430 host target protein, herein schematically represented by VGAM1 HOST TARGET PROTEIN through VGAM3 HOST TARGET PROTEIN, all of FIG. 1.

VGAM2431 RNA, herein schematically represented by VGAM1 RNA through VGAM3 RNA, binds complementarily to a host target binding site located in an untranslated region of VGAM2431 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2431 host target RNA into VGAM2431 host target protein, herein schematically represented by VGAM1 HOST TARGET PROTEIN through VGAM3 HOST TARGET PROTEIN, all of FIG. 1.

VGAM2432 RNA, herein schematically represented by VGAM1 RNA through VGAM3 RNA, binds complementarily to a host target binding site located in an untranslated region of VGAM2432 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2432 host target RNA into VGAM2432 host target protein, herein schematically represented by VGAM1 HOST TARGET PROTEIN through VGAM3 HOST TARGET PROTEIN, all of FIG. 1.

VGAM2433 RNA, herein schematically represented by VGAM1 RNA through VGAM3 RNA, binds complementarily to a host target binding site located in an untranslated region of VGAM2433 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2433 host target RNA into VGAM2433 host target protein, herein schematically represented by VGAM1 HOST TARGET PROTEIN through VGAM3 HOST TARGET PROTEIN, all of FIG. 1.

VGAM2434 RNA, herein schematically represented by VGAM1 RNA through VGAM3 RNA, binds complementarily to a host target binding site located in an untranslated region of VGAM2434 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2434 host target RNA into VGAM2434 host target protein, herein schematically represented by VGAM1 HOST TARGET PROTEIN through VGAM3 HOST TARGET PROTEIN, all of FIG. 1.

VGAM2435 RNA, herein schematically represented by VGAM1 RNA through VGAM3 RNA, binds complementarily to a host target binding site located in an untranslated region of VGAM2435 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2435 host target RNA into VGAM2435 host target protein, herein schematically represented by VGAM1 HOST TARGET PROTEIN through VGAM3 HOST TARGET PROTEIN, all of FIG. 1.

VGAM2436 RNA, herein schematically represented by VGAM1 RNA through VGAM3 RNA, binds complementarily to a host target binding site located in an untranslated region of VGAM2436 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2436 host target RNA into VGAM2436 host target protein, herein schematically represented by VGAM1 HOST TARGET PROTEIN through VGAM3 HOST TARGET PROTEIN, all of FIG. 1.

It is appreciated that a function of VGR3234 gene, herein designated VGR GENE, is inhibition of expression of host target genes, as part of a novel viral mechanism of attacking a host. Accordingly, utilities of VGR3234 gene include diagnosis, prevention and treatment of viral infection by Goatpox Virus. Specific functions, and accordingly utilities, of VGR3234 gene correlate with, and may be deduced from, the identity of the host target genes, which are inhibited by VGAM RNAs comprised in the 'operon-like' cluster of VGR3234 gene: VGAM2429 host target protein, VGAM2430 host target protein, VGAM2431 host target protein, VGAM2432 host target protein, VGAM2433 host target protein, VGAM2434 host target protein, VGAM2435 host target protein and VGAM2436 host target protein, herein schematically represented by VGAM1 HOST TARGET PROTEIN through VGAM3 HOST TARGET PROTEIN. The function of these host target genes is elaborated hereinabove with reference to VGAM2429, VGAM2430, VGAM2431, VGAM2432, VGAM2433, VGAM2434, VGAM2435 and VGAM2436. FIG. 9 further provides a conceptual description of novel bioinformatically detected regulatory viral gene, referred to here as Viral Genomic Record 3235(VGR3235) viral gene, which encodes an 'operon-like' cluster of novel viral micro RNA-like genes, each of which in turn modulates expression of at least one host target gene, the function and utility of which at least one host target gene is known in the art.

VGR3235 gene, herein designated VGR GENE, is a novel bioinformatically detected regulatory, non protein coding, RNA viral gene. The method by which VGR3235 gene was detected is described hereinabove with reference to FIGS. 1-9.

VGR3235 gene encodes VGR3235 precursor RNA, herein designated VGR PRECURSOR RNA, an RNA molecule, typically several hundred nucleotides long.

VGR3235 precursor RNA folds spatially, forming VGR3235 folded precursor RNA, herein designated VGR FOLDED PRECURSOR RNA. It is appreciated that VGR3235 folded precursor RNA comprises a plurality of what is known in the art as 'hairpin' structures. These 'hairpin' structures are due to the fact that the nucleotide sequence of VGR3235 precursor RNA comprises a plurality of segments, the first half of each such segment having a nucleotide sequence which is at least a partial inversed-reversed sequence of the second half thereof, as is well known in the art.

VGR3235 folded precursor RNA is naturally processed by cellular enzymatic activity into at least 6 separate VGAM precursor RNAs, VGAM2437 precursor RNA, VGAM2438 precursor RNA, VGAM2439 precursor RNA, VGAM2440 precursor RNA, VGAM2441 precursor RNA and VGAM2442 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2437 RNA, VGAM2438 RNA, VGAM2439 RNA, VGAM2440 RNA, VGAM2441 RNA and VGAM2442 RNA, herein schematically represented by VGAM1 RNA through VGAM3 RNA, each of which VGAM RNAs corresponding to VGAM RNA of FIG. 1.

VGAM2437 RNA, herein schematically represented by VGAM1 RNA through VGAM3 RNA, binds complementarily to a host target binding site located in an untranslated region of VGAM2437 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2437 host target RNA into VGAM2437 host target protein, herein schematically represented by VGAM1 HOST TARGET PROTEIN through VGAM3 HOST TARGET PROTEIN, all of FIG. 1.

VGAM2438 RNA, herein schematically represented by VGAM1 RNA through VGAM3 RNA, binds complementarily to a host target binding site located in an untranslated region of VGAM2438 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2438 host target RNA into VGAM2438 host target protein, herein schematically represented by VGAM1 HOST TARGET PROTEIN through VGAM3 HOST TARGET PROTEIN, all of FIG. 1.

VGAM2439 RNA, herein schematically represented by VGAM1 RNA through VGAM3 RNA, binds complementarily to a host target binding site located in an untranslated region of VGAM2439 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2439 host target RNA into VGAM2439 host target protein, herein schematically represented by VGAM1 HOST TARGET PROTEIN through VGAM3 HOST TARGET PROTEIN, all of FIG. 1.

VGAM2440 RNA, herein schematically represented by VGAM1 RNA through VGAM3 RNA, binds complementarily to a host target binding site located in an untranslated region of VGAM2440 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2440 host target RNA into VGAM2440 host target protein, herein schematically represented by VGAM1 HOST TARGET PROTEIN through VGAM3 HOST TARGET PROTEIN, all of FIG. 1.

VGAM2441 RNA, herein schematically represented by VGAM1 RNA through VGAM3 RNA, binds complementarily to a host target binding site located in an untranslated region of VGAM2441 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2441 host target RNA into VGAM2441 host target protein, herein schematically represented by VGAM1 HOST TARGET PROTEIN through VGAM3 HOST TARGET PROTEIN, all of FIG. 1.

VGAM2442 RNA, herein schematically represented by VGAM1 RNA through VGAM3 RNA, binds complementarily to a host target binding site located in an untranslated region of VGAM2442 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2442 host target RNA into VGAM2442 host target protein, herein schematically represented by VGAM1 HOST TARGET PROTEIN through VGAM3 HOST TARGET PROTEIN, all of FIG. 1.

It is appreciated that a function of VGR3235 gene, herein designated VGR GENE, is inhibition of expression of host target genes, as part of a novel viral mechanism of attacking a host. Accordingly, utilities of VGR3235 gene include diagnosis, prevention and treatment of viral infection by Goatpox Virus. Specific functions, and accordingly utilities, of VGR3235 gene correlate with, and may be deduced from, the identity of the host target genes, which are inhibited by VGAM RNAs comprised in the 'operon-like' cluster of VGR3235 gene: VGAM2437 host target protein, VGAM2438 host target protein, VGAM2439 host target protein, VGAM2440 host target protein, VGAM2441 host target protein and VGAM2442 host target protein, herein schematically represented by VGAM1 HOST TARGET PROTEIN through VGAM3 HOST TARGET PROTEIN. The function of these host target genes is elaborated hereinabove with reference to VGAM2437, VGAM2438, VGAM2439, VGAM2440, VGAM2441 and VGAM2442. FIG. 9 further provides a conceptual description of novel bioinformatically detected regulatory viral gene, referred to here as Viral Genomic Record 3236(VGR3236) viral gene, which encodes an 'operon-like' cluster of novel viral micro RNA-like genes, each of which in turn modulates expression of at least one host target gene, the function and utility of which at least one host target gene is known in the art.

VGR3236 gene, herein designated VGR GENE, is a novel bioinformatically detected regulatory, non protein coding, RNA viral gene. The method by which VGR3236 gene was detected is described hereinabove with reference to FIGS. 1-9.

VGR3236 gene encodes VGR3236 precursor RNA, herein designated VGR PRECURSOR RNA, an RNA molecule, typically several hundred nucleotides long.

VGR3236 precursor RNA folds spatially, forming VGR3236 folded precursor RNA, herein designated VGR FOLDED PRECURSOR RNA. It is appreciated that VGR3236 folded precursor RNA comprises a plurality of what is known in the art as 'hairpin' structures. These 'hairpin' structures are due to the fact that the nucleotide sequence of VGR3236 precursor RNA comprises a plurality of segments, the first half of each such segment having a nucleotide sequence which is at least a partial inversed-reversed sequence of the second half thereof, as is well known in the art.

VGR3236 folded precursor RNA is naturally processed by cellular enzymatic activity into at least 8 separate VGAM precursor RNAs, VGAM2443 precursor RNA, VGAM2444 precursor RNA, VGAM2445 precursor RNA, VGAM2446 precursor RNA, VGAM2447 precursor RNA, VGAM2448 precursor RNA, VGAM2449 precursor RNA and VGAM2450 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2443 RNA, VGAM2444 RNA, VGAM2445 RNA, VGAM2446 RNA, VGAM2447 RNA, VGAM2448 RNA, VGAM2449 RNA and VGAM2450 RNA, herein schematically represented by VGAM1 RNA through VGAM3 RNA, each of which VGAM RNAs corresponding to VGAM RNA of FIG. 1.

VGAM2443 RNA, herein schematically represented by VGAM1 RNA through VGAM3 RNA, binds complementarily to a host target binding site located in an untranslated region of VGAM2443 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2443 host target RNA into VGAM2443 host target protein, herein schematically represented by VGAM1 HOST TARGET PROTEIN through VGAM3 HOST TARGET PROTEIN, all of FIG. 1.

VGAM2444 RNA, herein schematically represented by VGAM1 RNA through VGAM3 RNA, binds complementarily to a host target binding site located in an untranslated region of VGAM2444 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2444 host target RNA into VGAM2444 host target protein, herein schematically represented by VGAM1 HOST TARGET PROTEIN through VGAM3 HOST TARGET PROTEIN, all of FIG. 1.

VGAM2445 RNA, herein schematically represented by VGAM1 RNA through VGAM3 RNA, binds complementarily to a host target binding site located in an untranslated region of VGAM2445 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2445 host target RNA into VGAM2445 host target protein, herein schematically represented by VGAM1 HOST TARGET PROTEIN through VGAM3 HOST TARGET PROTEIN, all of FIG. 1.

VGAM2446 RNA, herein schematically represented by VGAM1 RNA through VGAM3 RNA, binds complementarily to a host target binding site located in an untranslated region of VGAM2446 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2446 host target RNA into VGAM2446 host target protein, herein schematically represented by VGAM1 HOST TARGET PROTEIN through VGAM3 HOST TARGET PROTEIN, all of FIG. 1.

VGAM2447 RNA, herein schematically represented by VGAM1 RNA through VGAM3 RNA, binds complementarily to a host target binding site located in an untranslated region of VGAM2447 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2447 host target RNA into VGAM2447 host target protein, herein schematically represented by VGAM1 HOST TARGET PROTEIN through VGAM3 HOST TARGET PROTEIN, all of FIG. 1.

VGAM2448 RNA, herein schematically represented by VGAM1 RNA through VGAM3 RNA, binds complementarily to a host target binding site located in an untranslated region of VGAM2448 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2448 host target RNA into VGAM2448 host target protein, herein schematically represented by VGAM1 HOST TARGET PROTEIN through VGAM3 HOST TARGET PROTEIN, all of FIG. 1.

VGAM2449 RNA, herein schematically represented by VGAM1 RNA through VGAM3 RNA, binds complementarily to a host target binding site located in an untranslated region of VGAM2449 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2449 host target RNA into VGAM2449 host target protein, herein schematically represented by VGAM1 HOST TARGET PROTEIN through VGAM3 HOST TARGET PROTEIN, all of FIG. 1.

VGAM2450 RNA, herein schematically represented by VGAM1 RNA through VGAM3 RNA, binds complementarily to a host target binding site located in an untranslated region of VGAM2450 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2450 host target RNA into VGAM2450 host target protein, herein schematically represented by VGAM1 HOST TARGET PROTEIN through VGAM3 HOST TARGET PROTEIN, all of FIG. 1.

It is appreciated that a function of VGR3236 gene, herein designated VGR GENE, is inhibition of expression of host target genes, as part of a novel viral mechanism of attacking a host. Accordingly, utilities of VGR3236 gene include diagnosis, prevention and treatment of viral infection by Mouse Cytomegalovirus 1. Specific functions, and accordingly utilities, of VGR3236 gene correlate with, and may be deduced from, the identity of the host target genes, which are inhibited by VGAM RNAs comprised in the 'operon-like' cluster of VGR3236 gene: VGAM2443 host target protein, VGAM2444 host target protein, VGAM2445 host target protein, VGAM2446 host target protein, VGAM2447 host target protein, VGAM2448 host target protein, VGAM2449 host target protein and VGAM2450 host target protein, herein schematically represented by VGAM1 HOST TARGET PROTEIN through VGAM3 HOST TARGET PROTEIN. The function of these host target genes is elaborated hereinabove with reference to VGAM2443, VGAM2444, VGAM2445, VGAM2446, VGAM2447, VGAM2448, VGAM2449 and VGAM2450. FIG. 9 further provides a conceptual description of novel bioinformatically detected regulatory viral gene, referred to here as Viral Genomic Record 3237(VGR3237) viral gene, which encodes an 'operon-like' cluster of novel viral micro RNA-like genes, each of which in turn modulates expression of at least one host target gene, the function and utility of which at least one host target gene is known in the art.

VGR3237 gene, herein designated VGR GENE, is a novel bioinformatically detected regulatory, non protein coding, RNA viral gene. The method by which VGR3237 gene was detected is described hereinabove with reference to FIGS. 1-9.

VGR3237 gene encodes VGR3237 precursor RNA, herein designated VGR PRECURSOR RNA, an RNA molecule, typically several hundred nucleotides long.

VGR3237 precursor RNA folds spatially, forming VGR3237 folded precursor RNA, herein designated VGR FOLDED PRECURSOR RNA. It is appreciated that VGR3237 folded precursor RNA comprises a plurality of what is known in the art as 'hairpin' structures. These 'hairpin' structures are due to the fact that the nucleotide sequence of VGR3237 precursor RNA comprises a plurality of segments, the first half of each such segment having a nucleotide sequence which is at least a partial inversed-reversed sequence of the second half thereof, as is well known in the art.

VGR3237 folded precursor RNA is naturally processed by cellular enzymatic activity into at least 8 separate VGAM precursor RNAs, VGAM2451 precursor RNA, VGAM2452 precursor RNA, VGAM2453 precursor RNA, VGAM2454 precursor RNA, VGAM2455 precursor RNA, VGAM2456 precursor RNA, VGAM2457 precursor RNA and VGAM2458 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2451 RNA, VGAM2452 RNA, VGAM2453 RNA, VGAM2454 RNA, VGAM2455 RNA, VGAM2456 RNA, VGAM2457 RNA and VGAM2458 RNA, herein schematically represented by VGAM1 RNA through VGAM3 RNA, each of which VGAM RNAs corresponding to VGAM RNA of FIG. 1.

VGAM2451 RNA, herein schematically represented by VGAM1 RNA through VGAM3 RNA, binds complementarily to a host target binding site located in an untranslated region of VGAM2451 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2451 host target RNA into VGAM2451 host target protein, herein schematically represented by VGAM1 HOST TARGET PROTEIN through VGAM3 HOST TARGET PROTEIN, all of FIG. 1.

VGAM2452 RNA, herein schematically represented by VGAM1 RNA through VGAM3 RNA, binds complementarily to a host target binding site located in an untranslated region of VGAM2452 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2452 host target RNA into VGAM2452 host target protein, herein schematically represented by VGAM1 HOST TARGET PROTEIN through VGAM3 HOST TARGET PROTEIN, all of FIG. 1.

VGAM2453 RNA, herein schematically represented by VGAM1 RNA through VGAM3 RNA, binds complementarily to a host target binding site located in an untranslated region of VGAM2453 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2453 host target RNA into VGAM2453 host target protein, herein schematically represented by VGAM1 HOST TARGET PROTEIN through VGAM3 HOST TARGET PROTEIN, all of FIG. 1.

VGAM2454 RNA, herein schematically represented by VGAM1 RNA through VGAM3 RNA, binds complementarily to a host target binding site located in an untranslated region of VGAM2454 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2454 host target RNA into VGAM2454 host target protein, herein schematically represented by VGAM1 HOST TARGET PROTEIN through VGAM3 HOST TARGET PROTEIN, all of FIG. 1.

VGAM2455 RNA, herein schematically represented by VGAM1 RNA through VGAM3 RNA, binds complementarily to a host target binding site located in an untranslated region of VGAM2455 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2455 host target RNA into VGAM2455 host target protein, herein schematically represented by VGAM1 HOST TARGET PROTEIN through VGAM3 HOST TARGET PROTEIN, all of FIG. 1.

VGAM2456 RNA, herein schematically represented by VGAM1 RNA through VGAM3 RNA, binds complementarily to a host target binding site located in an untranslated region of VGAM2456 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2456 host target RNA into VGAM2456 host target protein, herein schematically represented by VGAM1 HOST TARGET PROTEIN through VGAM3 HOST TARGET PROTEIN, all of FIG. 1.

VGAM2457 RNA, herein schematically represented by VGAM1 RNA through VGAM3 RNA, binds complementarily to a host target binding site located in an untranslated region of VGAM2457 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2457 host target RNA into VGAM2457 host target protein, herein schematically represented by VGAM1 HOST TARGET PROTEIN through VGAM3 HOST TARGET PROTEIN, all of FIG. 1.

VGAM2458 RNA, herein schematically represented by VGAM1 RNA through VGAM3 RNA, binds complementarily to a host target binding site located in an untranslated region of VGAM2458 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2458 host target RNA into VGAM2458 host target protein, herein schematically represented by VGAM1 HOST TARGET PROTEIN through VGAM3 HOST TARGET PROTEIN, all of FIG. 1.

It is appreciated that a function of VGR3237 gene, herein designated VGR GENE, is inhibition of expression of host target genes, as part of a novel viral mechanism of attacking a host. Accordingly, utilities of VGR3237 gene include diagnosis, prevention and treatment of viral infection by Mouse Cytomegalovirus 1. Specific functions, and accordingly utilities, of VGR3237 gene correlate with, and may be deduced from, the identity of the host target genes, which are inhibited by VGAM RNAs comprised in the 'operon-like' cluster of VGR3237 gene: VGAM2451 host target protein, VGAM2452 host target protein, VGAM2453 host target protein, VGAM2454 host target protein, VGAM2455 host target protein, VGAM2456 host target protein, VGAM2457 host target protein and VGAM2458 host target protein, herein schematically represented by VGAM1 HOST TARGET PROTEIN through VGAM3 HOST TARGET PROTEIN. The function of these host target genes is elaborated hereinabove with reference to VGAM2451, VGAM2452, VGAM2453, VGAM2454, VGAM2455, VGAM2456, VGAM2457 and VGAM2458. FIG. 9 further provides a conceptual description of novel bioinformatically detected regulatory viral gene, referred to here as Viral Genomic Record 3238(VGR3238) viral gene, which encodes an 'operon-like' cluster of novel viral micro RNA-like genes, each of which in turn modulates expression of at least one host target gene, the function and utility of which at least one host target gene is known in the art.

VGR3238 gene, herein designated VGR GENE, is a novel bioinformatically detected regulatory, non protein coding, RNA viral gene. The method by which VGR3238 gene was detected is described hereinabove with reference to FIGS. 1-9.

VGR3238 gene encodes VGR3238 precursor RNA, herein designated VGR PRECURSOR RNA, an RNA molecule, typically several hundred nucleotides long.

VGR3238 precursor RNA folds spatially, forming VGR3238 folded precursor RNA, herein designated VGR FOLDED PRECURSOR RNA. It is appreciated that VGR3238 folded precursor RNA comprises a plurality of what is known in the art as 'hairpin' structures. These 'hairpin' structures are due to the fact that the nucleotide sequence of VGR3238 precursor RNA comprises a plurality of segments, the first half of each such segment having a nucleotide sequence which is at least a partial inversed-reversed sequence of the second half thereof, as is well known in the art.

VGR3238 folded precursor RNA is naturally processed by cellular enzymatic activity into at least 8 separate VGAM precursor RNAs, VGAM2459 precursor RNA, VGAM2460 precursor RNA, VGAM2461 precursor RNA, VGAM2462 precursor RNA, VGAM2463 precursor RNA, VGAM2464 precursor RNA, VGAM2465 precursor RNA and VGAM2466 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2459 RNA, VGAM2460 RNA, VGAM2461 RNA, VGAM2462 RNA, VGAM2463 RNA, VGAM2464 RNA, VGAM2465 RNA and VGAM2466 RNA, herein schematically represented by VGAM1 RNA through VGAM3 RNA, each of which VGAM RNAs corresponding to VGAM RNA of FIG. 1.

VGAM2459 RNA, herein schematically represented by VGAM1 RNA through VGAM3 RNA, binds complementarily to a host target binding site located in an untranslated region of VGAM2459 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2459 host target RNA into VGAM2459 host target protein, herein schematically represented by VGAM1 HOST TARGET PROTEIN through VGAM3 HOST TARGET PROTEIN, all of FIG. 1.

VGAM2460 RNA, herein schematically represented by VGAM1 RNA through VGAM3 RNA, binds complementarily to a host target binding site located in an untranslated region of VGAM2460 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2460 host target RNA into VGAM2460 host target protein, herein schematically represented by VGAM1 HOST TARGET PROTEIN through VGAM3 HOST TARGET PROTEIN, all of FIG. 1.

VGAM2461 RNA, herein schematically represented by VGAM1 RNA through VGAM3 RNA, binds complementarily to a host target binding site located in an untranslated region of VGAM2461 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2461 host target RNA into VGAM2461 host target protein, herein schematically represented by VGAM1 HOST TARGET PROTEIN through VGAM3 HOST TARGET PROTEIN, all of FIG. 1.

VGAM2462 RNA, herein schematically represented by VGAM1 RNA through VGAM3 RNA, binds complementarily to a host target binding site located in an untranslated region of VGAM2462 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM2462 host target RNA into VGAM2462 host target protein, herein schematically represented by VGAM1 HOST TARGET PROTEIN through VGAM3 HOST TARGET PROTEIN, all of FIG. 1.

VGAM2463 RNA, herein schematically represented by VGAM1 RNA through VGAM3 RNA, binds complementarily to a host target binding site located in an untranslated region of VGAM2463 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2463 host target RNA into VGAM2463 host target protein, herein schematically represented by VGAM1 HOST TARGET PROTEIN through VGAM3 HOST TARGET PROTEIN, all of FIG. 1.

VGAM2464 RNA, herein schematically represented by VGAM1 RNA through VGAM3 RNA, binds complementarily to a host target binding site located in an untranslated region of VGAM2464 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2464 host target RNA into VGAM2464 host target protein, herein schematically represented by VGAM1 HOST TARGET PROTEIN through VGAM3 HOST TARGET PROTEIN, all of FIG. 1.

VGAM2465 RNA, herein schematically represented by VGAM1 RNA through VGAM3 RNA, binds complementarily to a host target binding site located in an untranslated region of VGAM2465 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2465 host target RNA into VGAM2465 host target protein, herein schematically represented by VGAM1 HOST TARGET PROTEIN through VGAM3 HOST TARGET PROTEIN, all of FIG. 1.

VGAM2466 RNA, herein schematically represented by VGAM1 RNA through VGAM3 RNA, binds complementarily to a host target binding site located in an untranslated region of VGAM2466 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2466 host target RNA into VGAM2466 host target protein, herein schematically represented by VGAM1 HOST TARGET PROTEIN through VGAM3 HOST TARGET PROTEIN, all of FIG. 1.

It is appreciated that a function of VGR3238 gene, herein designated VGR GENE, is inhibition of expression of host target genes, as part of a novel viral mechanism of attacking a host. Accordingly, utilities of VGR3238 gene include diagnosis, prevention and treatment of viral infection by Mouse Cytomegalovirus 1. Specific functions, and accordingly utilities, of VGR3238 gene correlate with, and may be deduced from, the identity of the host target genes, which are inhibited by VGAM RNAs comprised in the 'operon-like' cluster of VGR3238 gene: VGAM2459 host target protein, VGAM2460 host target protein, VGAM2461 host target protein, VGAM2462 host target protein, VGAM2463 host target protein, VGAM2464 host target protein, VGAM2465 host target protein and VGAM2466 host target protein, herein schematically represented by VGAM1 HOST TARGET PROTEIN through VGAM3 HOST TARGET PROTEIN. The function of these host target genes is elaborated hereinabove with reference to VGAM2459, VGAM2460, VGAM2461, VGAM2462, VGAM2463, VGAM2464, VGAM2465 and VGAM2466. FIG. 9 further provides a conceptual description of novel bioinformatically detected regulatory viral gene, referred to here as Viral Genomic Record 3239(VGR3239) viral gene, which encodes an 'operon-like' cluster of novel viral micro RNA-like genes, each of which in turn modulates expression of at least one host target gene, the function and utility of which at least one host target gene is known in the art.

VGR3239 gene, herein designated VGR GENE, is a novel bioinformatically detected regulatory, non protein coding, RNA viral gene. The method by which VGR3239 gene was detected is described hereinabove with reference to FIGS. 1-9.

VGR3239 gene encodes VGR3239 precursor RNA, herein designated VGR PRECURSOR RNA, an RNA molecule, typically several hundred nucleotides long.

VGR3239 precursor RNA folds spatially, forming VGR3239 folded precursor RNA, herein designated VGR FOLDED PRECURSOR RNA. It is appreciated that VGR3239 folded precursor RNA comprises a plurality of what is known in the art as 'hairpin' structures. These 'hairpin' structures are due to the fact that the nucleotide sequence of VGR3239 precursor RNA comprises a plurality of segments, the first half of each such segment having a nucleotide sequence which is at least a partial inversed-reversed sequence of the second half thereof, as is well known in the art.

VGR3239 folded precursor RNA is naturally processed by cellular enzymatic activity into at least 8 separate VGAM precursor RNAs, VGAM2467 precursor RNA, VGAM2468 precursor RNA, VGAM2469 precursor RNA, VGAM2470 precursor RNA, VGAM2471 precursor RNA, VGAM2472 precursor RNA, VGAM2473 precursor RNA and VGAM2474 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2467 RNA, VGAM2468 RNA, VGAM2469 RNA, VGAM2470 RNA, VGAM2471 RNA, VGAM2472 RNA, VGAM2473 RNA and VGAM2474 RNA, herein schematically represented by VGAM1 RNA through VGAM3 RNA, each of which VGAM RNAs corresponding to VGAM RNA of FIG. 1.

VGAM2467 RNA, herein schematically represented by VGAM1 RNA through VGAM3 RNA, binds complementarily to a host target binding site located in an untranslated region of VGAM2467 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2467 host target RNA into VGAM2467 host target protein, herein schematically represented by VGAM1 HOST TARGET PROTEIN through VGAM3 HOST TARGET PROTEIN, all of FIG. 1.

VGAM2468 RNA, herein schematically represented by VGAM1 RNA through VGAM3 RNA, binds complementarily to a host target binding site located in an untranslated region of VGAM2468 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2468 host target RNA into VGAM2468 host target protein, herein schematically represented by VGAM1 HOST TARGET PROTEIN through VGAM3 HOST TARGET PROTEIN, all of FIG. 1.

VGAM2469 RNA, herein schematically represented by VGAM1 RNA through VGAM3 RNA, binds complementarily to a host target binding site located in an untranslated region of VGAM2469 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2469 host target RNA into VGAM2469 host target protein, herein schematically represented by VGAM1 HOST TARGET PROTEIN through VGAM3 HOST TARGET PROTEIN, all of FIG. 1.

VGAM2470 RNA, herein schematically represented by VGAM1 RNA through VGAM3 RNA, binds complementarily to a host target binding site located in an untranslated region of VGAM2470 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2470 host target RNA into VGAM2470 host target protein, herein schematically represented by VGAM1 HOST TARGET PROTEIN through VGAM3 HOST TARGET PROTEIN, all of FIG. 1.

VGAM2471 RNA, herein schematically represented by VGAM1 RNA through VGAM3 RNA, binds complementarily to a host target binding site located in an untranslated region of VGAM2471 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2471 host target RNA into VGAM2471 host target protein, herein schematically represented by VGAM1 HOST TARGET PROTEIN through VGAM3 HOST TARGET PROTEIN, all of FIG. 1.

VGAM2472 RNA, herein schematically represented by VGAM1 RNA through VGAM3 RNA, binds complementarily to a host target binding site located in an untranslated region of VGAM2472 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2472 host target RNA into VGAM2472 host target protein, herein schematically represented by VGAM1 HOST TARGET PROTEIN through VGAM3 HOST TARGET PROTEIN, all of FIG. 1.

VGAM2473 RNA, herein schematically represented by VGAM1 RNA through VGAM3 RNA, binds complementarily to a host target binding site located in an untranslated region of VGAM2473 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2473 host target RNA into VGAM2473 host target protein, herein schematically represented by VGAM1 HOST TARGET PROTEIN through VGAM3 HOST TARGET PROTEIN, all of FIG. 1.

VGAM2474 RNA, herein schematically represented by VGAM1 RNA through VGAM3 RNA, binds complementarily to a host target binding site located in an untranslated region of VGAM2474 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2474 host target RNA into VGAM2474 host target protein, herein schematically represented by VGAM1 HOST TARGET PROTEIN through VGAM3 HOST TARGET PROTEIN, all of FIG. 1.

It is appreciated that a function of VGR3239 gene, herein designated VGR GENE, is inhibition of expression of host target genes, as part of a novel viral mechanism of attacking a host. Accordingly, utilities of VGR3239 gene include diagnosis, prevention and treatment of viral infection by Mouse Cytomegalovirus 1. Specific functions, and accordingly utilities, of VGR3239 gene correlate with, and may be deduced from, the identity of the host target genes, which are inhibited by VGAM RNAs comprised in the 'operon-like' cluster of VGR3239 gene: VGAM2467 host target protein, VGAM2468 host target protein, VGAM2469 host target protein, VGAM2470 host target protein, VGAM2471 host target protein, VGAM2472 host target protein, VGAM2473 host target protein and VGAM2474 host target protein, herein schematically represented by VGAM1 HOST TARGET PROTEIN through VGAM3 HOST TARGET PROTEIN. The function of these host target genes is elaborated hereinabove with reference to VGAM2467, VGAM2468, VGAM2469, VGAM2470, VGAM2471, VGAM2472, VGAM2473 and VGAM2474. FIG. 9 further provides a conceptual description of novel bioinformatically detected regulatory viral gene, referred to here as Viral Genomic Record 3240(VGR3240) viral gene, which encodes an 'operon-like' cluster of novel viral micro RNA-like genes, each of which in turn modulates expression of at least one host target gene, the function and utility of which at least one host target gene is known in the art.

VGR3240 gene, herein designated VGR GENE, is a novel bioinformatically detected regulatory, non protein coding, RNA viral gene. The method by which VGR3240 gene was detected is described hereinabove with reference to FIGS. 1-9.

VGR3240 gene encodes VGR3240 precursor RNA, herein designated VGR PRECURSOR RNA, an RNA molecule, typically several hundred nucleotides long.

VGR3240 precursor RNA folds spatially, forming VGR3240 folded precursor RNA, herein designated VGR FOLDED PRECURSOR RNA. It is appreciated that VGR3240 folded precursor RNA comprises a plurality of what is known in the art as 'hairpin' structures. These 'hairpin' structures are due to the fact that the nucleotide sequence of VGR3240 precursor RNA comprises a plurality of segments, the first half of each such segment having a nucleotide sequence which is at least a partial inversed-reversed sequence of the second half thereof, as is well known in the art.

VGR3240 folded precursor RNA is naturally processed by cellular enzymatic activity into at least 8 separate VGAM precursor RNAs, VGAM2475 precursor RNA, VGAM2476 precursor RNA, VGAM2477 precursor RNA, VGAM2478 precursor RNA, VGAM2479 precursor RNA, VGAM2480 precursor RNA, VGAM2481 precursor RNA and VGAM2482 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2475 RNA, VGAM2476 RNA, VGAM2477 RNA, VGAM2478 RNA, VGAM2479 RNA, VGAM2480 RNA, VGAM2481 RNA and VGAM2482 RNA, herein schematically represented by VGAM1 RNA through VGAM3 RNA, each of which VGAM RNAs corresponding to VGAM RNA of FIG. 1.

VGAM2475 RNA, herein schematically represented by VGAM1 RNA through VGAM3 RNA, binds complementarily to a host target binding site located in an untranslated region of VGAM2475 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2475 host target RNA into VGAM2475 host target protein, herein schematically represented by VGAM1 HOST TARGET PROTEIN through VGAM3 HOST TARGET PROTEIN, all of FIG. 1.

VGAM2476 RNA, herein schematically represented by VGAM1 RNA through VGAM3 RNA, binds complementarily to a host target binding site located in an untranslated region of VGAM2476 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2476 host target RNA into VGAM2476 host target protein, herein schematically represented by VGAM1 HOST TARGET PROTEIN through VGAM3 HOST TARGET PROTEIN, all of FIG. 1.

VGAM2477 RNA, herein schematically represented by VGAM1 RNA through VGAM3 RNA, binds complementarily to a host target binding site located in an untranslated region of VGAM2477 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2477 host target RNA into VGAM2477 host target protein, herein schematically represented by VGAM1 HOST TARGET PROTEIN through VGAM3 HOST TARGET PROTEIN, all of FIG. 1.

VGAM2478 RNA, herein schematically represented by VGAM1 RNA through VGAM3 RNA, binds complementarily to a host target binding site located in an untranslated region of VGAM2478 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2478 host target RNA into VGAM2478 host target protein, herein schematically represented by VGAM1 HOST TARGET PROTEIN through VGAM3 HOST TARGET PROTEIN, all of FIG. 1.

VGAM2479 RNA, herein schematically represented by VGAM1 RNA through VGAM3 RNA, binds complementarily to a host target binding site located in an untranslated region of VGAM2479 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2479 host target RNA into VGAM2479 host target protein, herein schematically represented by VGAM1 HOST TARGET PROTEIN through VGAM3 HOST TARGET PROTEIN, all of FIG. 1.

VGAM2480 RNA, herein schematically represented by VGAM1 RNA through VGAM3 RNA, binds complementarily to a host target binding site located in an untranslated region of VGAM2480 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2480 host target RNA into VGAM2480 host target protein, herein schematically represented by VGAM1 HOST TARGET PROTEIN through VGAM3 HOST TARGET PROTEIN, all of FIG. 1.

VGAM2481 RNA, herein schematically represented by VGAM1 RNA through VGAM3 RNA, binds complementarily to a host target binding site located in an untranslated region of VGAM2481 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2481 host target RNA into VGAM2481 host target protein, herein schematically represented by VGAM1 HOST TARGET PROTEIN through VGAM3 HOST TARGET PROTEIN, all of FIG. 1.

VGAM2482 RNA, herein schematically represented by VGAM1 RNA through VGAM3 RNA, binds complementarily to a host target binding site located in an untranslated region of VGAM2482 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2482 host target RNA into VGAM2482 host target protein, herein schematically represented by VGAM1 HOST TARGET PROTEIN through VGAM3 HOST TARGET PROTEIN, all of FIG. 1.

It is appreciated that a function of VGR3240 gene, herein designated VGR GENE, is inhibition of expression of host target genes, as part of a novel viral mechanism of attacking a host. Accordingly, utilities of VGR3240 gene include diagnosis, prevention and treatment of viral infection by Mouse Cytomegalovirus 1. Specific functions, and accordingly utilities, of VGR3240 gene correlate with, and may be deduced from, the identity of the host target genes, which are inhibited by VGAM RNAs comprised in the 'operon-like' cluster of VGR3240 gene: VGAM2475 host target protein, VGAM2476 host target protein, VGAM2477 host target protein, VGAM2478 host target protein, VGAM2479 host target protein, VGAM2480 host target protein, VGAM2481 host target protein and VGAM2482 host target protein, herein schematically represented by VGAM1 HOST TARGET PROTEIN through VGAM3 HOST TARGET PROTEIN. The function of these host target genes is elaborated hereinabove with reference to VGAM2475, VGAM2476, VGAM2477, VGAM2478, VGAM2479, VGAM2480, VGAM2481 and VGAM2482. FIG. 9 further provides a conceptual description of novel bioinformatically detected regulatory viral gene, referred to here as Viral Genomic Record 3241(VGR3241) viral gene, which encodes an 'operon-like' cluster of novel viral micro RNA-like genes, each of which in turn modulates expression of at least one host target gene, the function and utility of which at least one host target gene is known in the art.

VGR3241 gene, herein designated VGR GENE, is a novel bioinformatically detected regulatory, non protein coding, RNA viral gene. The method by which VGR3241 gene was detected is described hereinabove with reference to FIGS. 1-9.

VGR3241 gene encodes VGR3241 precursor RNA, herein designated VGR PRECURSOR RNA, an RNA molecule, typically several hundred nucleotides long.

VGR3241 precursor RNA folds spatially, forming VGR3241 folded precursor RNA, herein designated VGR FOLDED PRECURSOR RNA. It is appreciated that VGR3241 folded precursor RNA comprises a plurality of what is known in the art as 'hairpin' structures. These 'hairpin' structures are due to the fact that the nucleotide sequence of VGR3241 precursor RNA comprises a plurality of segments, the first half of each such segment having a nucleotide sequence which is at least a partial inversed-reversed sequence of the second half thereof, as is well known in the art.

VGR3241 folded precursor RNA is naturally processed by cellular enzymatic activity into at least 8 separate VGAM precursor RNAs, VGAM2483 precursor RNA, VGAM2484 precursor RNA, VGAM2485 precursor RNA, VGAM2486 precursor RNA, VGAM2487 precursor RNA, VGAM2488 precursor RNA, VGAM2489 precursor RNA and VGAM2490 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2483 RNA, VGAM2484 RNA, VGAM2485 RNA, VGAM2486 RNA, VGAM2487 RNA, VGAM2488 RNA, VGAM2489 RNA and VGAM2490 RNA, herein schematically represented by VGAM1 RNA through VGAM3 RNA, each of which VGAM RNAs corresponding to VGAM RNA of FIG. 1.

VGAM2483 RNA, herein schematically represented by VGAM1 RNA through VGAM3 RNA, binds complementarily to a host target binding site located in an untranslated region of VGAM2483 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2483 host target RNA into VGAM2483 host target protein, herein schematically represented by VGAM1 HOST TARGET PROTEIN through VGAM3 HOST TARGET PROTEIN, all of FIG. 1.

VGAM2484 RNA, herein schematically represented by VGAM1 RNA through VGAM3 RNA, binds complementarily to a host target binding site located in an untranslated region of VGAM2484 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2484 host target RNA into VGAM2484 host target protein, herein schematically represented by VGAM1 HOST TARGET PROTEIN through VGAM3 HOST TARGET PROTEIN, all of FIG. 1.

VGAM2485 RNA, herein schematically represented by VGAM1 RNA through VGAM3 RNA, binds complementarily to a host target binding site located in an untranslated region of VGAM2485 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2485 host target RNA into VGAM2485 host target protein, herein schematically represented by VGAM1 HOST TARGET PROTEIN through VGAM3 HOST TARGET PROTEIN, all of FIG. 1.

VGAM2486 RNA, herein schematically represented by VGAM1 RNA through VGAM3 RNA, binds complementarily to a host target binding site located in an untranslated region of VGAM2486 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2486 host target RNA into VGAM2486 host target protein, herein schematically represented by VGAM1 HOST TARGET PROTEIN through VGAM3 HOST TARGET PROTEIN, all of FIG. 1.

VGAM2487 RNA, herein schematically represented by VGAM1 RNA through VGAM3 RNA, binds complementarily to a host target binding site located in an untranslated region of VGAM2487 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2487 host target RNA into VGAM2487 host target protein, herein schematically represented by VGAM1 HOST TARGET PROTEIN through VGAM3 HOST TARGET PROTEIN, all of FIG. 1.

VGAM2488 RNA, herein schematically represented by VGAM1 RNA through VGAM3 RNA, binds complementarily to a host target binding site located in an untranslated region of VGAM2488 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2488 host target RNA into VGAM2488 host target protein, herein schematically represented by VGAM1 HOST TARGET PROTEIN through VGAM3 HOST TARGET PROTEIN, all of FIG. 1.

VGAM2489 RNA, herein schematically represented by VGAM1 RNA through VGAM3 RNA, binds complementarily to a host target binding site located in an untranslated region of VGAM2489 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2489 host target RNA into VGAM2489 host target protein, herein schematically represented by VGAM1 HOST TARGET PROTEIN through VGAM3 HOST TARGET PROTEIN, all of FIG. 1.

VGAM2490 RNA, herein schematically represented by VGAM1 RNA through VGAM3 RNA, binds complementarily to a host target binding site located in an untranslated region of VGAM2490 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2490 host target RNA into VGAM2490 host target protein, herein schematically represented by VGAM1 HOST TARGET PROTEIN through VGAM3 HOST TARGET PROTEIN, all of FIG. 1.

It is appreciated that a function of VGR3241 gene, herein designated VGR GENE, is inhibition of expression of host target genes, as part of a novel viral mechanism of attacking a host. Accordingly, utilities of VGR3241 gene include diagnosis, prevention and treatment of viral infection by Mouse Cytomegalovirus 1. Specific functions, and accordingly utilities, of VGR3241 gene correlate with, and may be deduced from, the identity of the host target genes, which are inhibited by VGAM RNAs comprised in the 'operon-like' cluster of VGR3241 gene: VGAM2483 host target protein, VGAM2484 host target protein, VGAM2485 host target protein, VGAM2486 host target protein, VGAM2487 host target protein, VGAM2488 host target protein, VGAM2489 host target protein and VGAM2490 host target protein, herein schematically represented by VGAM1 HOST TARGET PROTEIN through VGAM3 HOST TARGET PROTEIN. The function of these host target genes is elaborated hereinabove with reference to VGAM2483, VGAM2484, VGAM2485, VGAM2486, VGAM2487, VGAM2488, VGAM2489 and VGAM2490. FIG. 9 further provides a conceptual description of novel bioinformatically detected regulatory viral gene, referred to here as Viral Genomic Record 3242(VGR3242) viral gene, which encodes an 'operon-like' cluster of novel viral micro RNA-like genes, each of which in turn modulates expression of at least one host target gene, the function and utility of which at least one host target gene is known in the art.

VGR3242 gene, herein designated VGR GENE, is a novel bioinformatically detected regulatory, non protein coding, RNA viral gene. The method by which VGR3242 gene was detected is described hereinabove with reference to FIGS. 1-9.

VGR3242 gene encodes VGR3242 precursor RNA, herein designated VGR PRECURSOR RNA, an RNA molecule, typically several hundred nucleotides long.

VGR3242 precursor RNA folds spatially, forming VGR3242 folded precursor RNA, herein designated VGR FOLDED PRECURSOR RNA. It is appreciated that VGR3242 folded precursor RNA comprises a plurality of what is known in the art as 'hairpin' structures. These 'hairpin' structures are due to the fact that the nucleotide sequence of VGR3242 precursor RNA comprises a plurality of segments, the first half of each such segment having a nucleotide sequence which is at least a partial inversed-reversed sequence of the second half thereof, as is well known in the art.

VGR3242 folded precursor RNA is naturally processed by cellular enzymatic activity into at least 8 separate VGAM precursor RNAs, VGAM2491 precursor RNA, VGAM2492 precursor RNA, VGAM2493 precursor RNA, VGAM2494 precursor RNA, VGAM2495 precursor RNA, VGAM2496 precursor RNA, VGAM2497 precursor RNA and VGAM2498 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2491 RNA, VGAM2492 RNA, VGAM2493 RNA, VGAM2494 RNA, VGAM2495 RNA, VGAM2496 RNA, VGAM2497 RNA and VGAM2498 RNA, herein schematically represented by VGAM1 RNA through VGAM3 RNA, each of which VGAM RNAs corresponding to VGAM RNA of FIG. 1.

VGAM2491 RNA, herein schematically represented by VGAM1 RNA through VGAM3 RNA, binds complementarily to a host target binding site located in an untranslated region of VGAM2491 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2491 host target RNA into VGAM2491 host target protein, herein schematically represented by VGAM1 HOST TARGET PROTEIN through VGAM3 HOST TARGET PROTEIN, all of FIG. 1.

VGAM2492 RNA, herein schematically represented by VGAM1 RNA through VGAM3 RNA, binds complementarily to a host target binding site located in an untranslated region of VGAM2492 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2492 host target RNA into VGAM2492 host target protein, herein schematically represented by VGAM1 HOST TARGET PROTEIN through VGAM3 HOST TARGET PROTEIN, all of FIG. 1.

VGAM2493 RNA, herein schematically represented by VGAM1 RNA through VGAM3 RNA, binds complementarily to a host target binding site located in an untranslated region of VGAM2493 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2493 host target RNA into VGAM2493 host target protein, herein schematically represented by VGAM1 HOST TARGET PROTEIN through VGAM3 HOST TARGET PROTEIN, all of FIG. 1.

VGAM2494 RNA, herein schematically represented by VGAM1 RNA through VGAM3 RNA, binds complementarily to a host target binding site located in an untranslated region of VGAM2494 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2494 host target RNA into VGAM2494 host target protein, herein schematically represented by VGAM1 HOST TARGET PROTEIN through VGAM3 HOST TARGET PROTEIN, all of FIG. 1.

VGAM2495 RNA, herein schematically represented by VGAM1 RNA through VGAM3 RNA, binds complementarily to a host target binding site located in an untranslated region of VGAM2495 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2495 host target RNA into VGAM2495 host target protein, herein schematically represented by VGAM1 HOST TARGET PROTEIN through VGAM3 HOST TARGET PROTEIN, all of FIG. 1.

VGAM2496 RNA, herein schematically represented by VGAM1 RNA through VGAM3 RNA, binds complementarily to a host target binding site located in an untranslated region of VGAM2496 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2496 host target RNA into VGAM2496 host target protein, herein schematically represented by VGAM1 HOST TARGET PROTEIN through VGAM3 HOST TARGET PROTEIN, all of FIG. 1.

VGAM2497 RNA, herein schematically represented by VGAM1 RNA through VGAM3 RNA, binds complementarily to a host target binding site located in an untranslated region of VGAM2497 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2497 host target RNA into VGAM2497 host target protein, herein schematically represented by VGAM1 HOST TARGET PROTEIN through VGAM3 HOST TARGET PROTEIN, all of FIG. 1.

VGAM2498 RNA, herein schematically represented by VGAM1 RNA through VGAM3 RNA, binds complementarily to a host target binding site located in an untranslated region of VGAM2498 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2498 host target RNA into VGAM2498 host target protein, herein schematically represented by VGAM1 HOST TARGET PROTEIN through VGAM3 HOST TARGET PROTEIN, all of FIG. 1.

It is appreciated that a function of VGR3242 gene, herein designated VGR GENE, is inhibition of expression of host target genes, as part of a novel viral mechanism of attacking a host. Accordingly, utilities of VGR3242 gene include diagnosis, prevention and treatment of viral infection by Mouse Cytomegalovirus 1. Specific functions, and accordingly utilities, of VGR3242 gene correlate with, and may be deduced from, the identity of the host target genes, which are inhibited by VGAM RNAs comprised in the 'operon-like' cluster of VGR3242 gene: VGAM2491 host target protein, VGAM2492 host target protein, VGAM2493 host target protein, VGAM2494 host target protein, VGAM2495 host target protein, VGAM2496 host target protein, VGAM2497 host target protein and VGAM2498 host target protein, herein schematically represented by VGAM1 HOST TARGET PROTEIN through VGAM3 HOST TARGET PROTEIN. The function of these host target genes is elaborated hereinabove with reference to VGAM2491, VGAM2492, VGAM2493, VGAM2494, VGAM2495, VGAM2496, VGAM2497 and VGAM2498. FIG. 9 further provides a conceptual description of novel bioinformatically detected regulatory viral gene, referred to here as Viral Genomic Record 3243(VGR3243) viral gene, which encodes an 'operon-like' cluster of novel viral micro RNA-like genes, each of which in turn modulates expression of at least one host target gene, the function and utility of which at least one host target gene is known in the art.

VGR3243 gene, herein designated VGR GENE, is a novel bioinformatically detected regulatory, non protein coding, RNA viral gene. The method by which VGR3243 gene was detected is described hereinabove with reference to FIGS. 1-9.

VGR3243 gene encodes VGR3243 precursor RNA, herein designated VGR PRECURSOR RNA, an RNA molecule, typically several hundred nucleotides long.

VGR3243 precursor RNA folds spatially, forming VGR3243 folded precursor RNA, herein designated VGR FOLDED PRECURSOR RNA. It is appreciated that VGR3243 folded precursor RNA comprises a plurality of what is known in the art as 'hairpin' structures. These 'hairpin' structures are due to the fact that the nucleotide sequence of VGR3243 precursor RNA comprises a plurality of segments, the first half of each such segment having a nucleotide sequence which is at least a partial inversed-reversed sequence of the second half thereof, as is well known in the art.

VGR3243 folded precursor RNA is naturally processed by cellular enzymatic activity into at least 8 separate VGAM precursor RNAs, VGAM2499 precursor RNA, VGAM2500 precursor RNA, VGAM2501 precursor RNA, VGAM2502 precursor RNA, VGAM2503 precursor RNA, VGAM2504 precursor RNA, VGAM2505 precursor RNA and VGAM2506 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2499 RNA, VGAM2500 RNA, VGAM2501 RNA, VGAM2502 RNA, VGAM2503 RNA, VGAM2504 RNA, VGAM2505 RNA and VGAM2506 RNA, herein schematically represented by VGAM1 RNA through VGAM3 RNA, each of which VGAM RNAs corresponding to VGAM RNA of FIG. 1.

VGAM2499 RNA, herein schematically represented by VGAM1 RNA through VGAM3 RNA, binds complementarily to a host target binding site located in an untranslated region of VGAM2499 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2499 host target RNA into VGAM2499 host target protein, herein schematically represented by VGAM1 HOST TARGET PROTEIN through VGAM3 HOST TARGET PROTEIN, all of FIG. 1.

VGAM2500 RNA, herein schematically represented by VGAM1 RNA through VGAM3 RNA, binds complementarily to a host target binding site located in an untranslated region of VGAM2500 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2500 host target RNA into VGAM2500 host target protein, herein schematically represented by VGAM1 HOST TARGET PROTEIN through VGAM3 HOST TARGET PROTEIN, all of FIG. 1.

VGAM2501 RNA, herein schematically represented by VGAM1 RNA through VGAM3 RNA, binds complementarily to a host target binding site located in an untranslated region of VGAM2501 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM2501 host target RNA into VGAM2501 host target protein, herein schematically represented by VGAM1 HOST TARGET PROTEIN through VGAM3 HOST TARGET PROTEIN, all of FIG. 1.

VGAM2502 RNA, herein schematically represented by VGAM1 RNA through VGAM3 RNA, binds complementarily to a host target binding site located in an untranslated region of VGAM2502 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2502 host target RNA into VGAM2502 host target protein, herein schematically represented by VGAM1 HOST TARGET PROTEIN through VGAM3 HOST TARGET PROTEIN, all of FIG. 1.

VGAM2503 RNA, herein schematically represented by VGAM1 RNA through VGAM3 RNA, binds complementarily to a host target binding site located in an untranslated region of VGAM2503 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2503 host target RNA into VGAM2503 host target protein, herein schematically represented by VGAM1 HOST TARGET PROTEIN through VGAM3 HOST TARGET PROTEIN, all of FIG. 1.

VGAM2504 RNA, herein schematically represented by VGAM1 RNA through VGAM3 RNA, binds complementarily to a host target binding site located in an untranslated region of VGAM2504 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2504 host target RNA into VGAM2504 host target protein, herein schematically represented by VGAM1 HOST TARGET PROTEIN through VGAM3 HOST TARGET PROTEIN, all of FIG. 1.

VGAM2505 RNA, herein schematically represented by VGAM1 RNA through VGAM3 RNA, binds complementarily to a host target binding site located in an untranslated region of VGAM2505 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2505 host target RNA into VGAM2505 host target protein, herein schematically represented by VGAM1 HOST TARGET PROTEIN through VGAM3 HOST TARGET PROTEIN, all of FIG. 1.

VGAM2506 RNA, herein schematically represented by VGAM1 RNA through VGAM3 RNA, binds complementarily to a host target binding site located in an untranslated region of VGAM2506 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2506 host target RNA into VGAM2506 host target protein, herein schematically represented by VGAM1 HOST TARGET PROTEIN through VGAM3 HOST TARGET PROTEIN, all of FIG. 1.

It is appreciated that a function of VGR3243 gene, herein designated VGR GENE, is inhibition of expression of host target genes, as part of a novel viral mechanism of attacking a host. Accordingly, utilities of VGR3243 gene include diagnosis, prevention and treatment of viral infection by Mouse Cytomegalovirus 1. Specific functions, and accordingly utilities, of VGR3243 gene correlate with, and may be deduced from, the identity of the host target genes, which are inhibited by VGAM RNAs comprised in the 'operon-like' cluster of VGR3243 gene: VGAM2499 host target protein, VGAM2500 host target protein, VGAM2501 host target protein, VGAM2502 host target protein, VGAM2503 host target protein, VGAM2504 host target protein, VGAM2505 host target protein and VGAM2506 host target protein, herein schematically represented by VGAM1 HOST TARGET PROTEIN through VGAM3 HOST TARGET PROTEIN. The function of these host target genes is elaborated hereinabove with reference to VGAM2499, VGAM2500, VGAM2501, VGAM2502, VGAM2503, VGAM2504, VGAM2505 and VGAM2506. FIG. 9 further provides a conceptual description of novel bioinformatically detected regulatory viral gene, referred to here as Viral Genomic Record 3244(VGR3244) viral gene, which encodes an 'operon-like' cluster of novel viral micro RNA-like genes, each of which in turn modulates expression of at least one host target gene, the function and utility of which at least one host target gene is known in the art.

VGR3244 gene, herein designated VGR GENE, is a novel bioinformatically detected regulatory, non protein coding, RNA viral gene. The method by which VGR3244 gene was detected is described hereinabove with reference to FIGS. 1-9.

VGR3244 gene encodes VGR3244 precursor RNA, herein designated VGR PRECURSOR RNA, an RNA molecule, typically several hundred nucleotides long.

VGR3244 precursor RNA folds spatially, forming VGR3244 folded precursor RNA, herein designated VGR FOLDED PRECURSOR RNA. It is appreciated that VGR3244 folded precursor RNA comprises a plurality of what is known in the art as 'hairpin' structures. These 'hairpin' structures are due to the fact that the nucleotide sequence of VGR3244 precursor RNA comprises a plurality of segments, the first half of each such segment having a nucleotide sequence which is at least a partial inversed-reversed sequence of the second half thereof, as is well known in the art.

VGR3244 folded precursor RNA is naturally processed by cellular enzymatic activity into at least 8 separate VGAM precursor RNAs, VGAM2507 precursor RNA, VGAM2508 precursor RNA, VGAM2509 precursor RNA, VGAM2510 precursor RNA, VGAM2511 precursor RNA, VGAM2512 precursor RNA, VGAM2513 precursor RNA and VGAM2514 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2507 RNA, VGAM2508 RNA, VGAM2509 RNA, VGAM2510 RNA, VGAM2511 RNA, VGAM2512 RNA, VGAM2513 RNA and VGAM2514 RNA, herein schematically represented by VGAM1 RNA through VGAM3 RNA, each of which VGAM RNAs corresponding to VGAM RNA of FIG. 1.

VGAM2507 RNA, herein schematically represented by VGAM1 RNA through VGAM3 RNA, binds complementarily to a host target binding site located in an untranslated region of VGAM2507 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2507 host target RNA into VGAM2507 host target protein, herein schematically represented by VGAM1 HOST TARGET PROTEIN through VGAM3 HOST TARGET PROTEIN, all of FIG. 1.

VGAM2508 RNA, herein schematically represented by VGAM1 RNA through VGAM3 RNA, binds complementarily to a host target binding site located in an untranslated region of VGAM2508 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2508 host target RNA into VGAM2508 host target protein, herein schematically represented by VGAM1 HOST TARGET PROTEIN through VGAM3 HOST TARGET PROTEIN, all of FIG. 1.

VGAM2509 RNA, herein schematically represented by VGAM1 RNA through VGAM3 RNA, binds complementarily to a host target binding site located in an untranslated region of VGAM2509 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2509 host target RNA into VGAM2509 host target protein, herein schematically represented by VGAM1 HOST TARGET PROTEIN through VGAM3 HOST TARGET PROTEIN, all of FIG. 1.

VGAM2510 RNA, herein schematically represented by VGAM1 RNA through VGAM3 RNA, binds complementarily to a host target binding site located in an untranslated region of VGAM2510 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2510 host target RNA into VGAM2510 host target protein, herein schematically represented by VGAM1 HOST TARGET PROTEIN through VGAM3 HOST TARGET PROTEIN, all of FIG. 1.

VGAM2511 RNA, herein schematically represented by VGAM1 RNA through VGAM3 RNA, binds complementarily to a host target binding site located in an untranslated region of VGAM2511 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2511 host target RNA into VGAM2511 host target protein, herein schematically represented by VGAM1 HOST TARGET PROTEIN through VGAM3 HOST TARGET PROTEIN, all of FIG. 1.

VGAM2512 RNA, herein schematically represented by VGAM1 RNA through VGAM3 RNA, binds complementarily to a host target binding site located in an untranslated region of VGAM2512 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2512 host target RNA into VGAM2512 host target protein, herein schematically represented by VGAM1 HOST TARGET PROTEIN through VGAM3 HOST TARGET PROTEIN, all of FIG. 1.

VGAM2513 RNA, herein schematically represented by VGAM1 RNA through VGAM3 RNA, binds complementarily to a host target binding site located in an untranslated region of VGAM2513 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2513 host target RNA into VGAM2513 host target protein, herein schematically represented by VGAM1 HOST TARGET PROTEIN through VGAM3 HOST TARGET PROTEIN, all of FIG. 1.

VGAM2514 RNA, herein schematically represented by VGAM1 RNA through VGAM3 RNA, binds complementarily to a host target binding site located in an untranslated region of VGAM2514 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2514 host target RNA into VGAM2514 host target protein, herein schematically represented by VGAM1 HOST TARGET PROTEIN through VGAM3 HOST TARGET PROTEIN, all of FIG. 1.

It is appreciated that a function of VGR3244 gene, herein designated VGR GENE, is inhibition of expression of host target genes, as part of a novel viral mechanism of attacking a host. Accordingly, utilities of VGR3244 gene include diagnosis, prevention and treatment of viral infection by Mouse Cytomegalovirus 1. Specific functions, and accordingly utilities, of VGR3244 gene correlate with, and may be deduced from, the identity of the host target genes, which are inhibited by VGAM RNAs comprised in the 'operon-like' cluster of VGR3244 gene: VGAM2507 host target protein, VGAM2508 host target protein, VGAM2509 host target protein, VGAM2510 host target protein, VGAM2511 host target protein, VGAM2512 host target protein, VGAM2513 host target protein and VGAM2514 host target protein, herein schematically represented by VGAM1 HOST TARGET PROTEIN through VGAM3 HOST TARGET PROTEIN. The function of these host target genes is elaborated hereinabove with reference to VGAM2507, VGAM2508, VGAM2509, VGAM2510, VGAM2511, VGAM2512, VGAM2513 and VGAM2514. FIG. 9 further provides a conceptual description of novel bioinformatically detected regulatory viral gene, referred to here as Viral Genomic Record 3245(VGR3245) viral gene, which encodes an 'operon-like' cluster of novel viral micro RNA-like genes, each of which in turn modulates expression of at least one host target gene, the function and utility of which at least one host target gene is known in the art.

VGR3245 gene, herein designated VGR GENE, is a novel bioinformatically detected regulatory, non protein coding, RNA viral gene. The method by which VGR3245 gene was detected is described hereinabove with reference to FIGS. 1-9.

VGR3245 gene encodes VGR3245 precursor RNA, herein designated VGR PRECURSOR RNA, an RNA molecule, typically several hundred nucleotides long.

VGR3245 precursor RNA folds spatially, forming VGR3245 folded precursor RNA, herein designated VGR FOLDED PRECURSOR RNA. It is appreciated that VGR3245 folded precursor RNA comprises a plurality of what is known in the art as 'hairpin' structures. These 'hairpin' structures are due to the fact that the nucleotide sequence of VGR3245 precursor RNA comprises a plurality of segments, the first half of each such segment having a nucleotide sequence which is at least a partial inversed-reversed sequence of the second half thereof, as is well known in the art.

VGR3245 folded precursor RNA is naturally processed by cellular enzymatic activity into at least 8 separate VGAM precursor RNAs, VGAM2515 precursor RNA, VGAM2516 precursor RNA, VGAM2517 precursor RNA, VGAM2518 precursor RNA, VGAM2519 precursor RNA, VGAM2520 precursor RNA, VGAM2521 precursor RNA and VGAM2522 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2515 RNA, VGAM2516 RNA, VGAM2517 RNA, VGAM2518 RNA, VGAM2519 RNA, VGAM2520 RNA, VGAM2521 RNA and VGAM2522 RNA, herein schematically represented by VGAM1 RNA through VGAM3 RNA, each of which VGAM RNAs corresponding to VGAM RNA of FIG. 1.

VGAM2515 RNA, herein schematically represented by VGAM1 RNA through VGAM3 RNA, binds complementarily to a host target binding site located in an untranslated region of VGAM2515 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2515 host target RNA into VGAM2515 host target protein, herein schematically represented by VGAM1 HOST TARGET PROTEIN through VGAM3 HOST TARGET PROTEIN, all of FIG. 1.

VGAM2516 RNA, herein schematically represented by VGAM1 RNA through VGAM3 RNA, binds complementarily to a host target binding site located in an untranslated region of VGAM2516 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2516 host target RNA into VGAM2516 host target protein, herein schematically represented by VGAM1 HOST TARGET PROTEIN through VGAM3 HOST TARGET PROTEIN, all of FIG. 1.

VGAM2517 RNA, herein schematically represented by VGAM1 RNA through VGAM3 RNA, binds complementarily to a host target binding site located in an untranslated region of VGAM2517 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2517 host target RNA into VGAM2517 host target protein, herein schematically represented by VGAM1 HOST TARGET PROTEIN through VGAM3 HOST TARGET PROTEIN, all of FIG. 1.

VGAM2518 RNA, herein schematically represented by VGAM1 RNA through VGAM3 RNA, binds complementarily to a host target binding site located in an untranslated region of VGAM2518 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2518 host target RNA into VGAM2518 host target protein, herein schematically represented by VGAM1 HOST TARGET PROTEIN through VGAM3 HOST TARGET PROTEIN, all of FIG. 1.

VGAM2519 RNA, herein schematically represented by VGAM1 RNA through VGAM3 RNA, binds complementarily to a host target binding site located in an untranslated region of VGAM2519 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2519 host target RNA into VGAM2519 host target protein, herein schematically represented by VGAM1 HOST TARGET PROTEIN through VGAM3 HOST TARGET PROTEIN, all of FIG. 1.

VGAM2520 RNA, herein schematically represented by VGAM1 RNA through VGAM3 RNA, binds complementarily to a host target binding site located in an untranslated region of VGAM2520 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2520 host target RNA into VGAM2520 host target protein, herein schematically represented by VGAM1 HOST TARGET PROTEIN through VGAM3 HOST TARGET PROTEIN, all of FIG. 1.

VGAM2521 RNA, herein schematically represented by VGAM1 RNA through VGAM3 RNA, binds complementarily to a host target binding site located in an untranslated region of VGAM2521 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2521 host target RNA into VGAM2521 host target protein, herein schematically represented by VGAM1 HOST TARGET PROTEIN through VGAM3 HOST TARGET PROTEIN, all of FIG. 1.

VGAM2522 RNA, herein schematically represented by VGAM1 RNA through VGAM3 RNA, binds complementarily to a host target binding site located in an untranslated region of VGAM2522 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2522 host target RNA into VGAM2522 host target protein, herein schematically represented by VGAM1 HOST TARGET PROTEIN through VGAM3 HOST TARGET PROTEIN, all of FIG. 1.

It is appreciated that a function of VGR3245 gene, herein designated VGR GENE, is inhibition of expression of host target genes, as part of a novel viral mechanism of attacking a host. Accordingly, utilities of VGR3245 gene include diagnosis, prevention and treatment of viral infection by Mouse Cytomegalovirus 1. Specific functions, and accordingly utilities, of VGR3245 gene correlate with, and may be deduced from, the identity of the host target genes, which are inhibited by VGAM RNAs comprised in the 'operon-like' cluster of VGR3245 gene: VGAM2515 host target protein, VGAM2516 host target protein, VGAM2517 host target protein, VGAM2518 host target protein, VGAM2519 host target protein, VGAM2520 host target protein, VGAM2521 host target protein and VGAM2522 host target protein, herein schematically represented by VGAM1 HOST TARGET PROTEIN through VGAM3 HOST TARGET PROTEIN. The function of these host target genes is elaborated hereinabove with reference to VGAM2515, VGAM2516, VGAM2517, VGAM2518, VGAM2519, VGAM2520, VGAM2521 and VGAM2522. FIG. 9 further provides a conceptual description of novel bioinformatically detected regulatory viral gene, referred to here as Viral Genomic Record 3246(VGR3246) viral gene, which encodes an 'operon-like' cluster of novel viral micro RNA-like genes, each of which in turn modulates expression of at least one host target gene, the function and utility of which at least one host target gene is known in the art.

VGR3246 gene, herein designated VGR GENE, is a novel bioinformatically detected regulatory, non protein coding, RNA viral gene. The method by which VGR3246 gene was detected is described hereinabove with reference to FIGS. 1-9.

VGR3246 gene encodes VGR3246 precursor RNA, herein designated VGR PRECURSOR RNA, an RNA molecule, typically several hundred nucleotides long.

VGR3246 precursor RNA folds spatially, forming VGR3246 folded precursor RNA, herein designated VGR FOLDED PRECURSOR RNA. It is appreciated that VGR3246 folded precursor RNA comprises a plurality of what is known in the art as 'hairpin' structures. These 'hairpin' structures are due to the fact that the nucleotide sequence of VGR3246 precursor RNA comprises a plurality of segments, the first half of each such segment having a nucleotide sequence which is at least a partial inversed-reversed sequence of the second half thereof, as is well known in the art.

VGR3246 folded precursor RNA is naturally processed by cellular enzymatic activity into at least 5 separate VGAM precursor RNAs, VGAM2523 precursor RNA, VGAM2524 precursor RNA, VGAM2525 precursor RNA, VGAM2526 precursor RNA and VGAM2527 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2523 RNA, VGAM2524 RNA, VGAM2525 RNA, VGAM2526 RNA and VGAM2527 RNA, herein schematically represented by VGAM1 RNA through VGAM3 RNA, each of which VGAM RNAs corresponding to VGAM RNA of FIG. 1.

VGAM2523 RNA, herein schematically represented by VGAM1 RNA through VGAM3 RNA, binds complementarily to a host target binding site located in an untranslated region of VGAM2523 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2523 host target RNA into VGAM2523 host target protein, herein schematically represented by VGAM1 HOST TARGET PROTEIN through VGAM3 HOST TARGET PROTEIN, all of FIG. 1.

VGAM2524 RNA, herein schematically represented by VGAM1 RNA through VGAM3 RNA, binds complementarily to a host target binding site located in an untranslated region of VGAM2524 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2524 host target RNA into VGAM2524 host target protein, herein schematically represented by VGAM1 HOST TARGET PROTEIN through VGAM3 HOST TARGET PROTEIN, all of FIG. 1.

VGAM2525 RNA, herein schematically represented by VGAM1 RNA through VGAM3 RNA, binds complementarily to a host target binding site located in an untranslated region of VGAM2525 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2525 host target RNA into VGAM2525 host target protein, herein schematically represented by VGAM1 HOST TARGET PROTEIN through VGAM3 HOST TARGET PROTEIN, all of FIG. 1.

VGAM2526 RNA, herein schematically represented by VGAM1 RNA through VGAM3 RNA, binds complementarily to a host target binding site located in an untranslated region of VGAM2526 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2526 host target RNA into VGAM2526 host target protein, herein schematically represented by VGAM1 HOST TARGET PROTEIN through VGAM3 HOST TARGET PROTEIN, all of FIG. 1.

VGAM2527 RNA, herein schematically represented by VGAM1 RNA through VGAM3 RNA, binds complementarily to a host target binding site located in an untranslated region of VGAM2527 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2527 host target RNA into VGAM2527 host target protein, herein schematically represented by VGAM1 HOST TARGET PROTEIN through VGAM3 HOST TARGET PROTEIN, all of FIG. 1.

It is appreciated that a function of VGR3246 gene, herein designated VGR GENE, is inhibition of expression of host target genes, as part of a novel viral mechanism of attacking a host. Accordingly, utilities of VGR3246 gene include diagnosis, prevention and treatment of viral infection by Mouse Cytomegalovirus 1. Specific functions, and accordingly utilities, of VGR3246 gene correlate with, and may be deduced from, the identity of the host target genes, which are inhibited by VGAM RNAs comprised in the 'operon-like' cluster of VGR3246 gene: VGAM2523 host target protein, VGAM2524 host target protein, VGAM2525 host target protein, VGAM2526 host target protein and VGAM2527 host target protein, herein schematically represented by VGAM1 HOST TARGET PROTEIN through VGAM3 HOST TARGET PROTEIN. The function of these host target genes is elaborated hereinabove with reference to VGAM2523, VGAM2524, VGAM2525, VGAM2526 and VGAM2527. FIG. 9 further provides a conceptual description of novel bioinformatically detected regulatory viral gene, referred to here as Viral Genomic Record 3247(VGR3247) viral gene, which encodes an 'operon-like' cluster of novel viral micro RNA-like genes, each of which in turn modulates expression of at least one host target gene, the function and utility of which at least one host target gene is known in the art.

VGR3247 gene, herein designated VGR GENE, is a novel bioinformatically detected regulatory, non protein coding, RNA viral gene. The method by which VGR3247 gene was detected is described hereinabove with reference to FIGS. 1-9.

VGR3247 gene encodes VGR3247 precursor RNA, herein designated VGR PRECURSOR RNA, an RNA molecule, typically several hundred nucleotides long.

VGR3247 precursor RNA folds spatially, forming VGR3247 folded precursor RNA, herein designated VGR FOLDED PRECURSOR RNA. It is appreciated that VGR3247 folded precursor RNA comprises a plurality of what is known in the art as 'hairpin' structures. These 'hairpin' structures are due to the fact that the nucleotide sequence of VGR3247 precursor RNA comprises a plurality of segments, the first half of each such segment having a nucleotide sequence which is at least a partial inversed-reversed sequence of the second half thereof, as is well known in the art.

VGR3247 folded precursor RNA is naturally processed by cellular enzymatic activity into at least 2 separate VGAM precursor RNAs, VGAM2530 precursor RNA and VGAM2531 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2530 RNA and VGAM2531 RNA, herein schematically represented by VGAM1 RNA through VGAM3 RNA, each of which VGAM RNAs corresponding to VGAM RNA of FIG. 1.

VGAM2530 RNA, herein schematically represented by VGAM1 RNA through VGAM3 RNA, binds complementarily to a host target binding site located in an untranslated region of VGAM2530 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2530 host target RNA into VGAM2530 host target protein, herein schematically represented by VGAM1 HOST TARGET PROTEIN through VGAM3 HOST TARGET PROTEIN, all of FIG. 1.

VGAM2531 RNA, herein schematically represented by VGAM1 RNA through VGAM3 RNA, binds complementarily to a host target binding site located in an untranslated region of VGAM2531 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2531 host target RNA into VGAM2531 host target protein, herein schematically represented by VGAM1 HOST TARGET PROTEIN through VGAM3 HOST TARGET PROTEIN, all of FIG. 1.

It is appreciated that a function of VGR3247 gene, herein designated VGR GENE, is inhibition of expression of host target genes, as part of a novel viral mechanism of attacking a host. Accordingly, utilities of VGR3247 gene include diagnosis, prevention and treatment of viral infection by Pepper Ringspot Virus. Specific functions, and accordingly utilities, of VGR3247 gene correlate with, and may be deduced from, the identity of the host target genes, which are inhibited by VGAM RNAs comprised in the 'operon-like' cluster of VGR3247 gene: VGAM2530 host target protein and VGAM2531 host target protein, herein schematically represented by VGAM1 HOST TARGET PROTEIN through VGAM3 HOST TARGET PROTEIN. The function of these host target genes is elaborated hereinabove with reference to VGAM2530 and VGAM2531. FIG. 9 further provides a conceptual description of novel bioinformatically detected regulatory viral gene, referred to here as Viral Genomic Record 3248(VGR3248) viral gene, which encodes an 'operon-like' cluster of novel viral micro RNA-like genes, each of which in turn modulates expression of at least one host target gene, the function and utility of which at least one host target gene is known in the art.

VGR3248 gene, herein designated VGR GENE, is a novel bioinformatically detected regulatory, non protein coding, RNA viral gene. The method by which VGR3248 gene was detected is described hereinabove with reference to FIGS. 1-9.

VGR3248 gene encodes VGR3248 precursor RNA, herein designated VGR PRECURSOR RNA, an RNA molecule, typically several hundred nucleotides long.

VGR3248 precursor RNA folds spatially, forming VGR3248 folded precursor RNA, herein designated VGR FOLDED PRECURSOR RNA. It is appreciated that VGR3248 folded precursor RNA comprises a plurality of what is known in the art as 'hairpin' structures. These 'hairpin' structures are due to the fact that the nucleotide sequence of VGR3248 precursor RNA comprises a plurality of segments, the first half of each such segment having a nucleotide sequence which is at least a partial inversed-reversed sequence of the second half thereof, as is well known in the art.

VGR3248 folded precursor RNA is naturally processed by cellular enzymatic activity into at least 4 separate VGAM precursor RNAs, VGAM2532 precursor RNA, VGAM2533 precursor RNA, VGAM2534 precursor RNA and VGAM2535 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2532 RNA, VGAM2533 RNA, VGAM2534 RNA and VGAM2535 RNA, herein schematically represented by VGAM1 RNA through VGAM3 RNA, each of which VGAM RNAs corresponding to VGAM RNA of FIG. 1.

VGAM2532 RNA, herein schematically represented by VGAM1 RNA through VGAM3 RNA, binds complementarily to a host target binding site located in an untranslated region of VGAM2532 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2532 host target RNA into VGAM2532 host target protein, herein schematically represented by VGAM1 HOST TARGET PROTEIN through VGAM3 HOST TARGET PROTEIN, all of FIG. 1.

VGAM2533 RNA, herein schematically represented by VGAM1 RNA through VGAM3 RNA, binds complementarily to a host target binding site located in an untranslated region of VGAM2533 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2533 host target RNA into VGAM2533 host target protein, herein schematically represented by VGAM1 HOST TARGET PROTEIN through VGAM3 HOST TARGET PROTEIN, all of FIG. 1.

VGAM2534 RNA, herein schematically represented by VGAM1 RNA through VGAM3 RNA, binds complementarily to a host target binding site located in an untranslated region of VGAM2534 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2534 host target RNA into VGAM2534 host target protein, herein schematically represented by VGAM1 HOST TARGET PROTEIN through VGAM3 HOST TARGET PROTEIN, all of FIG. 1.

VGAM2535 RNA, herein schematically represented by VGAM1 RNA through VGAM3 RNA, binds complementarily to a host target binding site located in an untranslated region of VGAM2535 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2535 host target RNA into VGAM2535 host target protein, herein schematically represented by VGAM1 HOST TARGET PROTEIN through VGAM3 HOST TARGET PROTEIN, all of FIG. 1.

It is appreciated that a function of VGR3248 gene, herein designated VGR GENE, is inhibition of expression of host target genes, as part of a novel viral mechanism of attacking a host. Accordingly, utilities of VGR3248 gene include diagnosis, prevention and treatment of viral infection by Rio Bravo Virus. Specific functions, and accordingly utilities, of VGR3248 gene correlate with, and may be deduced from, the identity of the host target genes, which are inhibited by VGAM RNAs comprised in the 'operon-like' cluster of VGR3248 gene: VGAM2532 host target protein, VGAM2533 host target protein, VGAM2534 host target protein and VGAM2535 host target protein, herein schematically represented by VGAM1 HOST TARGET PROTEIN through VGAM3 HOST TARGET PROTEIN. The function of these host target genes is elaborated hereinabove with reference to VGAM2532, VGAM2533, VGAM2534 and VGAM2535. FIG. 9 further provides a conceptual description of novel bioinformatically detected regulatory viral gene, referred to here as Viral Genomic Record 3249(VGR3249) viral gene, which encodes an 'operon-like' cluster of novel viral micro RNA-like genes, each of which in turn modulates expression of at least one host target gene, the function and utility of which at least one host target gene is known in the art.

VGR3249 gene, herein designated VGR GENE, is a novel bioinformatically detected regulatory, non protein coding, RNA viral gene. The method by which VGR3249 gene was detected is described hereinabove with reference to FIGS. 1-9.

VGR3249 gene encodes VGR3249 precursor RNA, herein designated VGR PRECURSOR RNA, an RNA molecule, typically several hundred nucleotides long.

VGR3249 precursor RNA folds spatially, forming VGR3249 folded precursor RNA, herein designated VGR FOLDED PRECURSOR RNA. It is appreciated that VGR3249 folded precursor RNA comprises a plurality of what is known in the art as 'hairpin' structures. These 'hairpin' structures are due to the fact that the nucleotide sequence of VGR3249 precursor RNA comprises a plurality of segments, the first half of each such segment having a nucleotide sequence which is at least a partial inversed-reversed sequence of the second half thereof, as is well known in the art.

VGR3249 folded precursor RNA is naturally processed by cellular enzymatic activity into at least 3 separate VGAM precursor RNAs, VGAM2536 precursor RNA, VGAM2537 precursor RNA and VGAM2538 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2536 RNA, VGAM2537 RNA and VGAM2538 RNA, herein schematically represented by VGAM1 RNA through VGAM3 RNA, each of which VGAM RNAs corresponding to VGAM RNA of FIG. 1.

VGAM2536 RNA, herein schematically represented by VGAM1 RNA through VGAM3 RNA, binds complementarily to a host target binding site located in an untranslated region of VGAM2536 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2536 host target RNA into VGAM2536 host target protein, herein schematically represented by VGAM1 HOST TARGET PROTEIN through VGAM3 HOST TARGET PROTEIN, all of FIG. 1.

VGAM2537 RNA, herein schematically represented by VGAM1 RNA through VGAM3 RNA, binds complementarily to a host target binding site located in an untranslated region of VGAM2537 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2537 host target RNA into VGAM2537 host target protein, herein schematically represented by VGAM1 HOST TARGET PROTEIN through VGAM3 HOST TARGET PROTEIN, all of FIG. 1.

VGAM2538 RNA, herein schematically represented by VGAM1 RNA through VGAM3 RNA, binds complementarily to a host target binding site located in an untranslated region of VGAM2538 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2538 host target RNA into VGAM2538 host target protein, herein schematically represented by VGAM1 HOST TARGET PROTEIN through VGAM3 HOST TARGET PROTEIN, all of FIG. 1.

It is appreciated that a function of VGR3249 gene, herein designated VGR GENE, is inhibition of expression of host target genes, as part of a novel viral mechanism of attacking a host. Accordingly, utilities of VGR3249 gene include diagnosis, prevention and treatment of viral infection by Pestivirus Reindeer-1. Specific functions, and accordingly utilities, of VGR3249 gene correlate with, and may be deduced from, the identity of the host target genes, which are inhibited by VGAM RNAs comprised in the 'operon-like' cluster of VGR3249 gene: VGAM2536 host target protein, VGAM2537 host target protein and VGAM2538 host target protein, herein schematically represented by VGAM1 HOST TARGET PROTEIN through VGAM3 HOST TARGET PROTEIN. The function of these host target genes is elaborated hereinabove with reference to VGAM2536, VGAM2537 and VGAM2538. FIG. 9 further provides a conceptual description of novel bioinformatically detected regulatory viral gene, referred to here as Viral Genomic Record 3250(VGR3250) viral gene, which encodes an 'operon-like' cluster of novel viral micro RNA-like genes, each of which in turn modulates expression of at least one host target gene, the function and utility of which at least one host target gene is known in the art.

VGR3250 gene, herein designated VGR GENE, is a novel bioinformatically detected regulatory, non protein coding, RNA viral gene. The method by which VGR3250 gene was detected is described hereinabove with reference to FIGS. 1-9.

VGR3250 gene encodes VGR3250 precursor RNA, herein designated VGR PRECURSOR RNA, an RNA molecule, typically several hundred nucleotides long.

VGR3250 precursor RNA folds spatially, forming VGR3250 folded precursor RNA, herein designated VGR FOLDED PRECURSOR RNA. It is appreciated that VGR3250 folded precursor RNA comprises a plurality of what is known in the art as 'hairpin' structures. These 'hairpin' structures are due to the fact that the nucleotide sequence of VGR3250 precursor RNA comprises a plurality of segments, the first half of each such segment having a nucleotide sequence which is at least a partial inversed-reversed sequence of the second half thereof, as is well known in the art.

VGR3250 folded precursor RNA is naturally processed by cellular enzymatic activity into at least 2 separate VGAM precursor RNAs, VGAM2539 precursor RNA and VGAM2540 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2539 RNA and VGAM2540 RNA, herein schematically represented by VGAM1 RNA through VGAM3 RNA, each of which VGAM RNAs corresponding to VGAM RNA of FIG. 1.

VGAM2539 RNA, herein schematically represented by VGAM1 RNA through VGAM3 RNA, binds complementarily to a host target binding site located in an untranslated region of VGAM2539 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2539 host target RNA into VGAM2539 host target protein, herein schematically represented by VGAM1 HOST TARGET PROTEIN through VGAM3 HOST TARGET PROTEIN, all of FIG. 1.

VGAM2540 RNA, herein schematically represented by VGAM1 RNA through VGAM3 RNA, binds complementarily to a host target binding site located in an untranslated region of VGAM2540 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2540 host target RNA into VGAM2540 host target protein, herein schematically represented by VGAM1 HOST TARGET PROTEIN through VGAM3 HOST TARGET PROTEIN, all of FIG. 1.

It is appreciated that a function of VGR3250 gene, herein designated VGR GENE, is inhibition of expression of host target genes, as part of a novel viral mechanism of attacking a host. Accordingly, utilities of VGR3250 gene include diagnosis, prevention and treatment of viral infection by Pestivirus Giraffe-1. Specific functions, and accordingly utilities, of VGR3250 gene correlate with, and may be deduced from, the identity of the host target genes, which are inhibited by VGAM RNAs comprised in the 'operon-like' cluster of VGR3250 gene: VGAM2539 host target protein and VGAM2540 host target protein, herein schematically represented by VGAM1 HOST TARGET PROTEIN through VGAM3 HOST TARGET PROTEIN. The function of these host target genes is elaborated hereinabove with reference to VGAM2539 and VGAM2540. FIG. 9 further provides a conceptual description of novel bioinformatically detected regulatory viral gene, referred to here as Viral Genomic Record 3251(VGR3251) viral gene, which encodes an 'operon-like' cluster of novel viral micro RNA-like genes, each of which in turn modulates expression of at least one host target gene, the function and utility of which at least one host target gene is known in the art.

VGR3251 gene, herein designated VGR GENE, is a novel bioinformatically detected regulatory, non protein coding, RNA viral gene. The method by which VGR3251 gene was detected is described hereinabove with reference to FIGS. 1-9.

VGR3251 gene encodes VGR3251 precursor RNA, herein designated VGR PRECURSOR RNA, an RNA molecule, typically several hundred nucleotides long.

VGR3251 precursor RNA folds spatially, forming VGR3251 folded precursor RNA, herein designated VGR FOLDED PRECURSOR RNA. It is appreciated that VGR3251 folded precursor RNA comprises a plurality of what is known in the art as 'hairpin' structures. These 'hairpin' structures are due to the fact that the nucleotide sequence of VGR3251 precursor RNA comprises a plurality of segments, the first half of each such segment having a nucleotide sequence which is at least a partial inversed-reversed sequence of the second half thereof, as is well known in the art.

VGR3251 folded precursor RNA is naturally processed by cellular enzymatic activity into at least 7 separate VGAM precursor RNAs, VGAM2541 precursor RNA, VGAM2542 precursor RNA, VGAM2543 precursor RNA, VGAM2544 precursor RNA, VGAM2545 precursor RNA, VGAM2546 precursor RNA and VGAM2547 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2541 RNA, VGAM2542 RNA, VGAM2543 RNA, VGAM2544 RNA, VGAM2545 RNA, VGAM2546 RNA and VGAM2547 RNA, herein schematically represented by VGAM1 RNA through VGAM3 RNA, each of which VGAM RNAs corresponding to VGAM RNA of FIG. 1.

VGAM2541 RNA, herein schematically represented by VGAM1 RNA through VGAM3 RNA, binds complementarily to a host target binding site located in an untranslated region of VGAM2541 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2541 host target RNA into VGAM2541 host target protein, herein schematically represented by VGAM1 HOST TARGET PROTEIN through VGAM3 HOST TARGET PROTEIN, all of FIG. 1.

VGAM2542 RNA, herein schematically represented by VGAM1 RNA through VGAM3 RNA, binds complementarily to a host target binding site located in an untranslated region of VGAM2542 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2542 host target RNA into VGAM2542 host target protein, herein schematically represented by VGAM1 HOST TARGET PROTEIN through VGAM3 HOST TARGET PROTEIN, all of FIG. 1.

VGAM2543 RNA, herein schematically represented by VGAM1 RNA through VGAM3 RNA, binds complementarily to a host target binding site located in an untranslated region of VGAM2543 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2543 host target RNA into VGAM2543 host target protein, herein schematically represented by VGAM1 HOST TARGET PROTEIN through VGAM3 HOST TARGET PROTEIN, all of FIG. 1.

VGAM2544 RNA, herein schematically represented by VGAM1 RNA through VGAM3 RNA, binds complementarily to a host target binding site located in an untranslated region of VGAM2544 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2544 host target RNA into VGAM2544 host target protein, herein schematically represented by VGAM1 HOST TARGET PROTEIN through VGAM3 HOST TARGET PROTEIN, all of FIG. 1.

VGAM2545 RNA, herein schematically represented by VGAM1 RNA through VGAM3 RNA, binds complementarily to a host target binding site located in an untranslated region of VGAM2545 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2545 host target RNA into VGAM2545 host target protein, herein schematically represented by VGAM1 HOST TARGET PROTEIN through VGAM3 HOST TARGET PROTEIN, all of FIG. 1.

VGAM2546 RNA, herein schematically represented by VGAM1 RNA through VGAM3 RNA, binds complementarily to a host target binding site located in an untranslated region of VGAM2546 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2546 host target RNA into VGAM2546 host target protein, herein schematically represented by VGAM1 HOST TARGET PROTEIN through VGAM3 HOST TARGET PROTEIN, all of FIG. 1.

VGAM2547 RNA, herein schematically represented by VGAM1 RNA through VGAM3 RNA, binds complementarily to a host target binding site located in an untranslated region of VGAM2547 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2547 host target RNA into VGAM2547 host target protein, herein schematically represented by VGAM1 HOST TARGET PROTEIN through VGAM3 HOST TARGET PROTEIN, all of FIG. 1.

It is appreciated that a function of VGR3251 gene, herein designated VGR GENE, is inhibition of expression of host target genes, as part of a novel viral mechanism of attacking a host. Accordingly, utilities of VGR3251 gene include diagnosis, prevention and treatment of viral infection by Langat Virus. Specific functions, and accordingly utilities, of VGR3251 gene correlate with, and may be deduced from, the identity of the host target genes, which are inhibited by VGAM RNAs comprised in the 'operon-like' cluster of VGR3251 gene: VGAM2541 host target protein, VGAM2542 host target protein, VGAM2543 host target protein, VGAM2544 host target protein, VGAM2545 host target protein, VGAM2546 host target protein and VGAM2547 host target protein, herein schematically represented by VGAM1 HOST TARGET PROTEIN through VGAM3 HOST TARGET PROTEIN. The function of these host target genes is elaborated hereinabove with reference to VGAM2541, VGAM2542, VGAM2543, VGAM2544, VGAM2545, VGAM2546 and VGAM2547. FIG. 9 further provides a conceptual description of novel bioinformatically detected regulatory viral gene, referred to here as Viral Genomic Record 3252(VGR3252) viral gene, which encodes an 'operon-like' cluster of novel viral micro RNA-like genes, each of which in turn modulates expression of at least one host target gene, the function and utility of which at least one host target gene is known in the art.

VGR3252 gene, herein designated VGR GENE, is a novel bioinformatically detected regulatory, non protein coding, RNA viral gene. The method by which VGR3252 gene was detected is described hereinabove with reference to FIGS. 1-9.

VGR3252 gene encodes VGR3252 precursor RNA, herein designated VGR PRECURSOR RNA, an RNA molecule, typically several hundred nucleotides long.

VGR3252 precursor RNA folds spatially, forming VGR3252 folded precursor RNA, herein designated VGR FOLDED PRECURSOR RNA. It is appreciated that VGR3252 folded precursor RNA comprises a plurality of what is known in the art as 'hairpin' structures. These 'hairpin' structures are due to the fact that the nucleotide sequence of VGR3252 precursor RNA comprises a plurality of segments, the first half of each such segment having a nucleotide sequence which is at least a partial inversed-reversed sequence of the second half thereof, as is well known in the art.

VGR3252 folded precursor RNA is naturally processed by cellular enzymatic activity into at least 3 separate VGAM precursor RNAs, VGAM2548 precursor RNA, VGAM2549 precursor RNA and VGAM2550 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2548 RNA, VGAM2549 RNA and VGAM2550 RNA, herein schematically represented by VGAM1 RNA through VGAM3 RNA, each of which VGAM RNAs corresponding to VGAM RNA of FIG. 1.

VGAM2548 RNA, herein schematically represented by VGAM1 RNA through VGAM3 RNA, binds complementarily to a host target binding site located in an untranslated region of VGAM2548 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2548 host target RNA into VGAM2548 host target protein, herein schematically represented by VGAM1 HOST TARGET PROTEIN through VGAM3 HOST TARGET PROTEIN, all of FIG. 1.

VGAM2549 RNA, herein schematically represented by VGAM1 RNA through VGAM3 RNA, binds complementarily to a host target binding site located in an untranslated region of VGAM2549 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2549 host target RNA into VGAM2549 host target protein, herein schematically represented by VGAM1 HOST TARGET PROTEIN through VGAM3 HOST TARGET PROTEIN, all of FIG. 1.

VGAM2550 RNA, herein schematically represented by VGAM1 RNA through VGAM3 RNA, binds complementarily to a host target binding site located in an untranslated region of VGAM2550 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2550 host target RNA into VGAM2550 host target protein, herein schematically represented by VGAM1 HOST TARGET PROTEIN through VGAM3 HOST TARGET PROTEIN, all of FIG. 1.

It is appreciated that a function of VGR3252 gene, herein designated VGR GENE, is inhibition of expression of host target genes, as part of a novel viral mechanism of attacking a host. Accordingly, utilities of VGR3252 gene include diagnosis, prevention and treatment of viral infection by Saccharomyces Cerevisiae Virus L-A. Specific functions, and accordingly utilities, of VGR3252 gene correlate with, and may be deduced from, the identity of the host target genes, which are inhibited by VGAM RNAs comprised in the 'operon-like' cluster of VGR3252 gene: VGAM2548 host target protein, VGAM2549 host target protein and VGAM2550 host target protein, herein schematically represented by VGAM1 HOST TARGET PROTEIN through VGAM3 HOST TARGET PROTEIN. The function of these host target genes is elaborated hereinabove with reference to VGAM2548, VGAM2549 and VGAM2550. FIG. 9 further provides a conceptual description of novel bioinformatically detected regulatory viral gene, referred to here as Viral Genomic Record 3253(VGR3253) viral gene, which encodes an 'operon-like' cluster of novel viral micro RNA-like genes, each of which in turn modulates expression of at least one host target gene, the function and utility of which at least one host target gene is known in the art.

VGR3253 gene, herein designated VGR GENE, is a novel bioinformatically detected regulatory, non protein coding, RNA viral gene. The method by which VGR3253 gene was detected is described hereinabove with reference to FIGS. 1-9.

VGR3253 gene encodes VGR3253 precursor RNA, herein designated VGR PRECURSOR RNA, an RNA molecule, typically several hundred nucleotides long.

VGR3253 precursor RNA folds spatially, forming VGR3253 folded precursor RNA, herein designated VGR FOLDED PRECURSOR RNA. It is appreciated that VGR3253 folded precursor RNA comprises a plurality of what is known in the art as 'hairpin' structures. These 'hairpin' structures are due to the fact that the nucleotide sequence of VGR3253 precursor RNA comprises a plurality of segments, the first half of each such segment having a nucleotide sequence which is at least a partial inversed-reversed sequence of the second half thereof, as is well known in the art.

VGR3253 folded precursor RNA is naturally processed by cellular enzymatic activity into at least 2 separate VGAM precursor RNAs, VGAM2552 precursor RNA and VGAM2553 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2552 RNA and VGAM2553 RNA, herein schematically represented by VGAM1 RNA through VGAM3 RNA, each of which VGAM RNAs corresponding to VGAM RNA of FIG. 1.

VGAM2552 RNA, herein schematically represented by VGAM1 RNA through VGAM3 RNA, binds complementarily to a host target binding site located in an untranslated region of VGAM2552 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2552 host target RNA into VGAM2552 host target protein, herein schematically represented by VGAM1 HOST TARGET PROTEIN through VGAM3 HOST TARGET PROTEIN, all of FIG. 1.

VGAM2553 RNA, herein schematically represented by VGAM1 RNA through VGAM3 RNA, binds complementarily to a host target binding site located in an untranslated region of VGAM2553 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2553 host target RNA into VGAM2553 host target protein, herein schematically represented by VGAM1 HOST TARGET PROTEIN through VGAM3 HOST TARGET PROTEIN, all of FIG. 1.

It is appreciated that a function of VGR3253 gene, herein designated VGR GENE, is inhibition of expression of host target genes, as part of a novel viral mechanism of attacking a host. Accordingly, utilities of VGR3253 gene include diagnosis, prevention and treatment of viral infection by Rice Ragged Stunt Virus. Specific functions, and accordingly utilities, of VGR3253 gene correlate with, and may be deduced from, the identity of the host target genes, which are inhibited by VGAM RNAs comprised in the 'operon-like' cluster of VGR3253 gene: VGAM2552 host target protein and VGAM2553 host target protein, herein schematically represented by VGAM1 HOST TARGET PROTEIN through VGAM3 HOST TARGET PROTEIN. The function of these host target genes is elaborated hereinabove with reference to VGAM2552 and VGAM2553. FIG. 9 further provides a conceptual description of novel bioinformatically detected regulatory viral gene, referred to here as Viral Genomic Record 3254(VGR3254) viral gene, which encodes an 'operon-like' cluster of novel viral micro RNA-like genes, each of which in turn modulates expression of at least one host target gene, the function and utility of which at least one host target gene is known in the art.

VGR3254 gene, herein designated VGR GENE, is a novel bioinformatically detected regulatory, non protein coding, RNA viral gene. The method by which VGR3254 gene was detected is described hereinabove with reference to FIGS. 1-9.

VGR3254 gene encodes VGR3254 precursor RNA, herein designated VGR PRECURSOR RNA, an RNA molecule, typically several hundred nucleotides long.

VGR3254 precursor RNA folds spatially, forming VGR3254 folded precursor RNA, herein designated VGR FOLDED PRECURSOR RNA. It is appreciated that VGR3254 folded precursor RNA comprises a plurality of what is known in the art as 'hairpin' structures. These 'hairpin' structures are due to the fact that the nucleotide sequence of VGR3254 precursor RNA comprises a plurality of segments, the first half of each such segment having a nucleotide sequence which is at least a partial inversed-reversed sequence of the second half thereof, as is well known in the art.

VGR3254 folded precursor RNA is naturally processed by cellular enzymatic activity into at least 3 separate VGAM precursor RNAs, VGAM2554 precursor RNA, VGAM2555 precursor RNA and VGAM2556 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2554 RNA, VGAM2555 RNA and VGAM2556 RNA, herein schematically represented by VGAM1 RNA through VGAM3 RNA, each of which VGAM RNAs corresponding to VGAM RNA of FIG. 1.

VGAM2554 RNA, herein schematically represented by VGAM1 RNA through VGAM3 RNA, binds complementarily to a host target binding site located in an untranslated region of VGAM2554 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2554 host target RNA into VGAM2554 host target protein, herein schematically represented by VGAM1 HOST TARGET PROTEIN through VGAM3 HOST TARGET PROTEIN, all of FIG. 1.

VGAM2555 RNA, herein schematically represented by VGAM1 RNA through VGAM3 RNA, binds complementarily to a host target binding site located in an untranslated region of VGAM2555 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2555 host target RNA into VGAM2555 host target protein, herein schematically represented by VGAM1 HOST TARGET PROTEIN through VGAM3 HOST TARGET PROTEIN, all of FIG. 1.

VGAM2556 RNA, herein schematically represented by VGAM1 RNA through VGAM3 RNA, binds complementarily to a host target binding site located in an untranslated region of VGAM2556 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2556 host target RNA into VGAM2556 host target protein, herein schematically represented by VGAM1 HOST TARGET PROTEIN through VGAM3 HOST TARGET PROTEIN, all of FIG. 1.

It is appreciated that a function of VGR3254 gene, herein designated VGR GENE, is inhibition of expression of host target genes, as part of a novel viral mechanism of attacking a host. Accordingly, utilities of VGR3254 gene include diagnosis, prevention and treatment of viral infection by Plautia Stali Intestine Virus. Specific functions, and accordingly utilities, of VGR3254 gene correlate with, and may be deduced from, the identity of the host target genes, which are inhibited by VGAM RNAs comprised in the 'operon-like' cluster of VGR3254 gene: VGAM2554 host target protein, VGAM2555 host target protein and VGAM2556 host target protein, herein schematically represented by VGAM1 HOST TARGET PROTEIN through VGAM3 HOST TARGET PROTEIN. The function of these host target genes is elaborated hereinabove with reference to VGAM2554, VGAM2555 and VGAM2556. FIG. 9 further provides a conceptual description of novel bioinformatically detected regulatory viral gene, referred to here as Viral Genomic Record 3255(VGR3255) viral gene, which encodes an 'operon-like' cluster of novel viral micro RNA-like genes, each of which in turn modulates expression of at least one host target gene, the function and utility of which at least one host target gene is known in the art.

VGR3255 gene, herein designated VGR GENE, is a novel bioinformatically detected regulatory, non protein coding, RNA viral gene. The method by which VGR3255 gene was detected is described hereinabove with reference to FIGS. 1-9.

VGR3255 gene encodes VGR3255 precursor RNA, herein designated VGR PRECURSOR RNA, an RNA molecule, typically several hundred nucleotides long.

VGR3255 precursor RNA folds spatially, forming VGR3255 folded precursor RNA, herein designated VGR FOLDED PRECURSOR RNA. It is appreciated that VGR3255 folded precursor RNA comprises a plurality of what is known in the art as 'hairpin' structures. These 'hairpin' structures are due to the fact that the nucleotide sequence of VGR3255 precursor RNA comprises a plurality of segments, the first half of each such segment having a nucleotide sequence which is at least a partial inversed-reversed sequence of the second half thereof, as is well known in the art.

VGR3255 folded precursor RNA is naturally processed by cellular enzymatic activity into at least 7 separate VGAM precursor RNAs, VGAM2557 precursor RNA, VGAM2558 precursor RNA, VGAM2559 precursor RNA, VGAM2560 precursor RNA, VGAM2561 precursor RNA, VGAM2562 precursor RNA and VGAM2563 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2557 RNA, VGAM2558 RNA, VGAM2559 RNA, VGAM2560 RNA, VGAM2561 RNA, VGAM2562 RNA and VGAM2563 RNA, herein schematically represented by VGAM1 RNA through VGAM3 RNA, each of which VGAM RNAs corresponding to VGAM RNA of FIG. 1.

VGAM2557 RNA, herein schematically represented by VGAM1 RNA through VGAM3 RNA, binds complementarily to a host target binding site located in an untranslated region of VGAM2557 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2557 host target RNA into VGAM2557 host target protein, herein schematically represented by VGAM1 HOST TARGET PROTEIN through VGAM3 HOST TARGET PROTEIN, all of FIG. 1.

VGAM2558 RNA, herein schematically represented by VGAM1 RNA through VGAM3 RNA, binds complementarily to a host target binding site located in an untranslated region of VGAM2558 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2558 host target RNA into VGAM2558 host target protein, herein schematically represented by VGAM1 HOST TARGET PROTEIN through VGAM3 HOST TARGET PROTEIN, all of FIG. 1.

VGAM2559 RNA, herein schematically represented by VGAM1 RNA through VGAM3 RNA, binds complementarily to a host target binding site located in an untranslated region of VGAM2559 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2559 host target RNA into VGAM2559 host target protein, herein schematically represented by VGAM1 HOST TARGET PROTEIN through VGAM3 HOST TARGET PROTEIN, all of FIG. 1.

VGAM2560 RNA, herein schematically represented by VGAM1 RNA through VGAM3 RNA, binds complementarily to a host target binding site located in an untranslated region of VGAM2560 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2560 host target RNA into VGAM2560 host target protein, herein schematically represented by VGAM1 HOST TARGET PROTEIN through VGAM3 HOST TARGET PROTEIN, all of FIG. 1.

VGAM2561 RNA, herein schematically represented by VGAM1 RNA through VGAM3 RNA, binds complementarily to a host target binding site located in an untranslated region of VGAM2561 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2561 host target RNA into VGAM2561 host target protein, herein schematically represented by VGAM1 HOST TARGET PROTEIN through VGAM3 HOST TARGET PROTEIN, all of FIG. 1.

VGAM2562 RNA, herein schematically represented by VGAM1 RNA through VGAM3 RNA, binds complementarily to a host target binding site located in an untranslated region of VGAM2562 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2562 host target RNA into VGAM2562 host target protein, herein schematically represented by VGAM1 HOST TARGET PROTEIN through VGAM3 HOST TARGET PROTEIN, all of FIG. 1.

VGAM2563 RNA, herein schematically represented by VGAM1 RNA through VGAM3 RNA, binds complementarily to a host target binding site located in an untranslated region of VGAM2563 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2563 host target RNA into VGAM2563 host target protein, herein schematically represented by VGAM1 HOST TARGET PROTEIN through VGAM3 HOST TARGET PROTEIN, all of FIG. 1.

It is appreciated that a function of VGR3255 gene, herein designated VGR GENE, is inhibition of expression of host target genes, as part of a novel viral mechanism of attacking a host. Accordingly, utilities of VGR3255 gene include diagnosis, prevention and treatment of viral infection by Himetobi P Virus. Specific functions, and accordingly utilities, of VGR3255 gene correlate with, and may be deduced from, the identity of the host target genes, which are inhibited by VGAM RNAs comprised in the 'operon-like' cluster of VGR3255 gene: VGAM2557 host target protein, VGAM2558 host target protein, VGAM2559 host target protein, VGAM2560 host target protein, VGAM2561 host target protein, VGAM2562 host target protein and VGAM2563 host target protein, herein schematically represented by VGAM1 HOST TARGET PROTEIN through VGAM3 HOST TARGET PROTEIN. The function of these host target genes is elaborated hereinabove with reference to VGAM2557, VGAM2558, VGAM2559, VGAM2560, VGAM2561, VGAM2562 and VGAM2563. FIG. 9 further provides a conceptual description of novel bioinformatically detected regulatory viral gene, referred to here as Viral Genomic Record 3256(VGR3256) viral gene, which encodes an 'operon-like' cluster of novel viral micro RNA-like genes, each of which in turn modulates expression of at least one host target gene, the function and utility of which at least one host target gene is known in the art.

VGR3256 gene, herein designated VGR GENE, is a novel bioinformatically detected regulatory, non protein coding, RNA viral gene. The method by which VGR3256 gene was detected is described hereinabove with reference to FIGS. 1-9.

VGR3256 gene encodes VGR3256 precursor RNA, herein designated VGR PRECURSOR RNA, an RNA molecule, typically several hundred nucleotides long.

VGR3256 precursor RNA folds spatially, forming VGR3256 folded precursor RNA, herein designated VGR FOLDED PRECURSOR RNA. It is appreciated that VGR3256 folded precursor RNA comprises a plurality of what is known in the art as 'hairpin' structures. These 'hairpin' structures are due to the fact that the nucleotide sequence of VGR3256 precursor RNA comprises a plurality of segments, the first half of each such segment having a nucleotide sequence which is at least a partial inversed-reversed sequence of the second half thereof, as is well known in the art.

VGR3256 folded precursor RNA is naturally processed by cellular enzymatic activity into at least 8 separate VGAM precursor RNAs, VGAM2564 precursor RNA, VGAM2565 precursor RNA, VGAM2566 precursor RNA, VGAM2567 precursor RNA, VGAM2568 precursor RNA, VGAM2569 precursor RNA, VGAM2570 precursor RNA and VGAM2571 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2564 RNA, VGAM2565 RNA, VGAM2566 RNA, VGAM2567 RNA, VGAM2568 RNA, VGAM2569 RNA, VGAM2570 RNA and VGAM2571 RNA, herein schematically represented by VGAM1 RNA through VGAM3 RNA, each of which VGAM RNAs corresponding to VGAM RNA of FIG. 1.

VGAM2564 RNA, herein schematically represented by VGAM1 RNA through VGAM3 RNA, binds complementarily to a host target binding site located in an untranslated region of VGAM2564 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2564 host target RNA into VGAM2564 host target protein, herein schematically represented by VGAM1 HOST TARGET PROTEIN through VGAM3 HOST TARGET PROTEIN, all of FIG. 1.

VGAM2565 RNA, herein schematically represented by VGAM1 RNA through VGAM3 RNA, binds complementarily to a host target binding site located in an untranslated region of VGAM2565 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2565 host target RNA into VGAM2565 host target protein, herein schematically represented by VGAM1 HOST TARGET PROTEIN through VGAM3 HOST TARGET PROTEIN, all of FIG. 1.

VGAM2566 RNA, herein schematically represented by VGAM1 RNA through VGAM3 RNA, binds complementarily to a host target binding site located in an untranslated region of VGAM2566 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2566 host target RNA into VGAM2566 host target protein, herein schematically represented by VGAM1 HOST TARGET PROTEIN through VGAM3 HOST TARGET PROTEIN, all of FIG. 1.

VGAM2567 RNA, herein schematically represented by VGAM1 RNA through VGAM3 RNA, binds complementarily to a host target binding site located in an untranslated region of VGAM2567 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2567 host target RNA into VGAM2567 host target protein, herein schematically represented by VGAM1 HOST TARGET PROTEIN through VGAM3 HOST TARGET PROTEIN, all of FIG. 1.

VGAM2568 RNA, herein schematically represented by VGAM1 RNA through VGAM3 RNA, binds complementarily to a host target binding site located in an untranslated region of VGAM2568 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2568 host target RNA into VGAM2568 host target protein, herein schematically represented by VGAM1 HOST TARGET PROTEIN through VGAM3 HOST TARGET PROTEIN, all of FIG. 1.

VGAM2569 RNA, herein schematically represented by VGAM1 RNA through VGAM3 RNA, binds complementarily to a host target binding site located in an untranslated region of VGAM2569 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2569 host target RNA into VGAM2569 host target protein, herein schematically represented by VGAM1 HOST TARGET PROTEIN through VGAM3 HOST TARGET PROTEIN, all of FIG. 1.

VGAM2570 RNA, herein schematically represented by VGAM1 RNA through VGAM3 RNA, binds complementarily to a host target binding site located in an untranslated region of VGAM2570 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2570 host target RNA into VGAM2570 host target protein, herein schematically represented by VGAM1 HOST TARGET PROTEIN through VGAM3 HOST TARGET PROTEIN, all of FIG. 1.

VGAM2571 RNA, herein schematically represented by VGAM1 RNA through VGAM3 RNA, binds complementarily to a host target binding site located in an untranslated region of VGAM2571 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2571 host target RNA into VGAM2571 host target protein, herein schematically represented by VGAM1 HOST TARGET PROTEIN through VGAM3 HOST TARGET PROTEIN, all of FIG. 1.

It is appreciated that a function of VGR3256 gene, herein designated VGR GENE, is inhibition of expression of host target genes, as part of a novel viral mechanism of attacking a host. Accordingly, utilities of VGR3256 gene include diagnosis, prevention and treatment of viral infection by Triatoma Virus. Specific functions, and accordingly utilities, of VGR3256 gene correlate with, and may be deduced from, the identity of the host target genes, which are inhibited by VGAM RNAs comprised in the 'operon-like' cluster of VGR3256 gene: VGAM2564 host target protein, VGAM2565 host target protein, VGAM2566 host target protein, VGAM2567 host target protein, VGAM2568 host target protein, VGAM2569 host target protein, VGAM2570 host target protein and VGAM2571 host target protein, herein schematically represented by VGAM1 HOST TARGET PROTEIN through VGAM3 HOST TARGET PROTEIN. The function of these host target genes is elaborated hereinabove with reference to VGAM2564, VGAM2565, VGAM2566, VGAM2567, VGAM2568, VGAM2569, VGAM2570 and VGAM2571. FIG. 9 further provides a conceptual description of novel bioinformatically detected regulatory viral gene, referred to here as Viral Genomic Record 3257(VGR3257) viral gene, which encodes an 'operon-like' cluster of novel viral micro RNA-like genes, each of which in turn modulates expression of at least one host target gene, the function and utility of which at least one host target gene is known in the art.

VGR3257 gene, herein designated VGR GENE, is a novel bioinformatically detected regulatory, non protein coding, RNA viral gene. The method by which VGR3257 gene was detected is described hereinabove with reference to FIGS. 1-9.

VGR3257 gene encodes VGR3257 precursor RNA, herein designated VGR PRECURSOR RNA, an RNA molecule, typically several hundred nucleotides long.

VGR3257 precursor RNA folds spatially, forming VGR3257 folded precursor RNA, herein designated VGR FOLDED PRECURSOR RNA. It is appreciated that VGR3257 folded precursor RNA comprises a plurality of what is known in the art as 'hairpin' structures. These 'hairpin' structures are due to the fact that the nucleotide sequence of VGR3257 precursor RNA comprises a plurality of segments, the first half of each such segment having a nucleotide sequence which is at least a partial inversed-reversed sequence of the second half thereof, as is well known in the art.

VGR3257 folded precursor RNA is naturally processed by cellular enzymatic activity into at least 7 separate VGAM precursor RNAs, VGAM2572 precursor RNA, VGAM2573 precursor RNA, VGAM2574 precursor RNA, VGAM2575 precursor RNA, VGAM2576 precursor RNA, VGAM2577 precursor RNA and VGAM2578 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2572 RNA, VGAM2573 RNA, VGAM2574 RNA, VGAM2575 RNA, VGAM2576 RNA, VGAM2577 RNA and VGAM2578 RNA, herein schematically represented by VGAM1 RNA through VGAM3 RNA, each of which VGAM RNAs corresponding to VGAM RNA of FIG. 1.

VGAM2572 RNA, herein schematically represented by VGAM1 RNA through VGAM3 RNA, binds complementarily to a host target binding site located in an untranslated region of VGAM2572 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2572 host target RNA into VGAM2572 host target protein, herein schematically represented by VGAM1 HOST TARGET PROTEIN through VGAM3 HOST TARGET PROTEIN, all of FIG. 1.

VGAM2573 RNA, herein schematically represented by VGAM1 RNA through VGAM3 RNA, binds complementarily to a host target binding site located in an untranslated region of VGAM2573 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2573 host target RNA into VGAM2573 host target protein, herein schematically represented by VGAM1 HOST TARGET PROTEIN through VGAM3 HOST TARGET PROTEIN, all of FIG. 1.

VGAM2574 RNA, herein schematically represented by VGAM1 RNA through VGAM3 RNA, binds complementarily to a host target binding site located in an untranslated region of VGAM2574 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2574 host target RNA into VGAM2574 host target protein, herein schematically represented by VGAM1 HOST TARGET PROTEIN through VGAM3 HOST TARGET PROTEIN, all of FIG. 1.

VGAM2575 RNA, herein schematically represented by VGAM1 RNA through VGAM3 RNA, binds complementarily to a host target binding site located in an untranslated region of VGAM2575 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2575 host target RNA into VGAM2575 host target protein, herein schematically represented by VGAM1 HOST TARGET PROTEIN through VGAM3 HOST TARGET PROTEIN, all of FIG. 1.

VGAM2576 RNA, herein schematically represented by VGAM1 RNA through VGAM3 RNA, binds complementarily to a host target binding site located in an untranslated region of VGAM2576 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2576 host target RNA into VGAM2576 host target protein, herein schematically represented by VGAM1 HOST TARGET PROTEIN through VGAM3 HOST TARGET PROTEIN, all of FIG. 1.

VGAM2577 RNA, herein schematically represented by VGAM1 RNA through VGAM3 RNA, binds complementarily to a host target binding site located in an untranslated region of VGAM2577 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2577 host target RNA into VGAM2577 host target protein, herein schematically represented by VGAM1 HOST TARGET PROTEIN through VGAM3 HOST TARGET PROTEIN, all of FIG. 1.

VGAM2578 RNA, herein schematically represented by VGAM1 RNA through VGAM3 RNA, binds complementarily to a host target binding site located in an untranslated region of VGAM2578 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2578 host target RNA into VGAM2578 host target protein, herein schematically represented by VGAM1 HOST TARGET PROTEIN through VGAM3 HOST TARGET PROTEIN, all of FIG. 1.

It is appreciated that a function of VGR3257 gene, herein designated VGR GENE, is inhibition of expression of host target genes, as part of a novel viral mechanism of attacking a host. Accordingly, utilities of VGR3257 gene include diagnosis, prevention and treatment of viral infection by Triatoma Virus. Specific functions, and accordingly utilities, of VGR3257 gene correlate with, and may be deduced from, the identity of the host target genes, which are inhibited by VGAM RNAs comprised in the 'operon-like' cluster of VGR3257 gene: VGAM2572 host target protein, VGAM2573 host target protein, VGAM2574 host target protein, VGAM2575 host target protein, VGAM2576 host target protein, VGAM2577 host target protein and VGAM2578 host target protein, herein schematically represented by VGAM1 HOST TARGET PROTEIN through VGAM3 HOST TARGET PROTEIN. The function of these host target genes is elaborated hereinabove with reference to VGAM2572, VGAM2573, VGAM2574, VGAM2575, VGAM2576, VGAM2577 and VGAM2578. FIG. 9 further provides a conceptual description of novel bioinformatically detected regulatory viral gene, referred to here as Viral Genomic Record 3258(VGR3258) viral gene, which encodes an 'operon-like' cluster of novel viral micro RNA-like genes, each of which in turn modulates expression of at least one host target gene, the function and utility of which at least one host target gene is known in the art.

VGR3258 gene, herein designated VGR GENE, is a novel bioinformatically detected regulatory, non protein coding, RNA viral gene. The method by which VGR3258 gene was detected is described hereinabove with reference to FIGS. 1-9.

VGR3258 gene encodes VGR3258 precursor RNA, herein designated VGR PRECURSOR RNA, an RNA molecule, typically several hundred nucleotides long.

VGR3258 precursor RNA folds spatially, forming VGR3258 folded precursor RNA, herein designated VGR FOLDED PRECURSOR RNA. It is appreciated that VGR3258 folded precursor RNA comprises a plurality of what is known in the art as 'hairpin' structures. These 'hairpin' structures are due to the fact that the nucleotide sequence of VGR3258 precursor RNA comprises a plurality of segments, the first half of each such segment having a nucleotide sequence which is at least a partial inversed-reversed sequence of the second half thereof, as is well known in the art.

VGR3258 folded precursor RNA is naturally processed by cellular enzymatic activity into at least 5 separate VGAM precursor RNAs, VGAM2579 precursor RNA, VGAM2580 precursor RNA, VGAM2581 precursor RNA, VGAM2582 precursor RNA and VGAM2583 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2579 RNA, VGAM2580 RNA, VGAM2581 RNA, VGAM2582 RNA and VGAM2583 RNA, herein schematically represented by VGAM1 RNA through VGAM3 RNA, each of which VGAM RNAs corresponding to VGAM RNA of FIG. 1.

VGAM2579 RNA, herein schematically represented by VGAM1 RNA through VGAM3 RNA, binds complementarily to a host target binding site located in an untranslated region of VGAM2579 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2579 host target RNA into VGAM2579 host target protein, herein schematically represented by VGAM1 HOST TARGET PROTEIN through VGAM3 HOST TARGET PROTEIN, all of FIG. 1.

VGAM2580 RNA, herein schematically represented by VGAM1 RNA through VGAM3 RNA, binds complementarily to a host target binding site located in an untranslated region of VGAM2580 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2580 host target RNA into VGAM2580 host target protein, herein schematically represented by VGAM1 HOST TARGET PROTEIN through VGAM3 HOST TARGET PROTEIN, all of FIG. 1.

VGAM2581 RNA, herein schematically represented by VGAM1 RNA through VGAM3 RNA, binds complementarily to a host target binding site located in an untranslated region of VGAM2581 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2581 host target RNA into VGAM2581 host target protein, herein schematically represented by VGAM1 HOST TARGET PROTEIN through VGAM3 HOST TARGET PROTEIN, all of FIG. 1.

VGAM2582 RNA, herein schematically represented by VGAM1 RNA through VGAM3 RNA, binds complementarily to a host target binding site located in an untranslated region of VGAM2582 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2582 host target RNA into VGAM2582 host target protein, herein schematically represented by VGAM1 HOST TARGET PROTEIN through VGAM3 HOST TARGET PROTEIN, all of FIG. 1.

VGAM2583 RNA, herein schematically represented by VGAM1 RNA through VGAM3 RNA, binds complementarily to a host target binding site located in an untranslated region of VGAM2583 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2583 host target RNA into VGAM2583 host target protein, herein schematically represented by VGAM1 HOST TARGET PROTEIN through VGAM3 HOST TARGET PROTEIN, all of FIG. 1.

It is appreciated that a function of VGR3258 gene, herein designated VGR GENE, is inhibition of expression of host target genes, as part of a novel viral mechanism of attacking a host. Accordingly, utilities of VGR3258 gene include diagnosis, prevention and treatment of viral infection by Triatoma Virus. Specific functions, and accordingly utilities, of VGR3258 gene correlate with, and may be deduced from, the identity of the host target genes, which are inhibited by VGAM RNAs comprised in the 'operon-like' cluster of VGR3258 gene: VGAM2579 host target protein, VGAM2580 host target protein, VGAM2581 host target protein, VGAM2582 host target protein and VGAM2583 host target protein, herein schematically represented by VGAM1 HOST TARGET PROTEIN through VGAM3 HOST TARGET PROTEIN. The function of these host target genes is elaborated hereinabove with reference to VGAM2579, VGAM2580, VGAM2581, VGAM2582 and VGAM2583.

FIG. 9 further provides a conceptual description of novel bioinformatically detected regulatory viral gene, referred to here as Viral Genomic Record 3259(VGR3259) viral gene, which encodes an 'operon-like' cluster of novel viral micro RNA-like genes, each of which in turn modulates expression of at least one host target gene, the function and utility of which at least one host target gene is known in the art.

VGR3259 gene, herein designated VGR GENE, is a novel bioinformatically detected regulatory, non protein coding, RNA viral gene. The method by which VGR3259 gene was detected is described hereinabove with reference to FIGS. 1-9.

VGR3259 gene encodes VGR3259 precursor RNA, herein designated VGR PRECURSOR RNA, an RNA molecule, typically several hundred nucleotides long.

VGR3259 precursor RNA folds spatially, forming VGR3259 folded precursor RNA, herein designated VGR FOLDED PRECURSOR RNA. It is appreciated that VGR3259 folded precursor RNA comprises a plurality of what is known in the art as 'hairpin' structures. These 'hairpin' structures are due to the fact that the nucleotide sequence of VGR3259 precursor RNA comprises a plurality of segments, the first half of each such segment having a nucleotide sequence which is at least a partial inversed-reversed sequence of the second half thereof, as is well known in the art.

VGR3259 folded precursor RNA is naturally processed by cellular enzymatic activity into at least 5 separate VGAM precursor RNAs, VGAM2584 precursor RNA, VGAM2585 precursor RNA, VGAM2586 precursor RNA, VGAM2587 precursor RNA and VGAM2588 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2584 RNA, VGAM2585 RNA, VGAM2586 RNA, VGAM2587 RNA and VGAM2588 RNA, herein schematically represented by VGAM1 RNA through VGAM3 RNA, each of which VGAM RNAs corresponding to VGAM RNA of FIG. 1.

VGAM2584 RNA, herein schematically represented by VGAM1 RNA through VGAM3 RNA, binds complementarily to a host target binding site located in an untranslated region of VGAM2584 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2584 host target RNA into VGAM2584 host target protein, herein schematically represented by VGAM1 HOST TARGET PROTEIN through VGAM3 HOST TARGET PROTEIN, all of FIG. 1.

VGAM2585 RNA, herein schematically represented by VGAM1 RNA through VGAM3 RNA, binds complementarily to a host target binding site located in an untranslated region of VGAM2585 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2585 host target RNA into VGAM2585 host target protein, herein schematically represented by VGAM1 HOST TARGET PROTEIN through VGAM3 HOST TARGET PROTEIN, all of FIG. 1.

VGAM2586 RNA, herein schematically represented by VGAM1 RNA through VGAM3 RNA, binds complementarily to a host target binding site located in an untranslated region of VGAM2586 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2586 host target RNA into VGAM2586 host target protein, herein schematically represented by VGAM1 HOST TARGET PROTEIN through VGAM3 HOST TARGET PROTEIN, all of FIG. 1.

VGAM2587 RNA, herein schematically represented by VGAM1 RNA through VGAM3 RNA, binds complementarily to a host target binding site located in an untranslated region of VGAM2587 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2587 host target RNA into VGAM2587 host target protein, herein schematically represented by VGAM1 HOST TARGET PROTEIN through VGAM3 HOST TARGET PROTEIN, all of FIG. 1.

VGAM2588 RNA, herein schematically represented by VGAM1 RNA through VGAM3 RNA, binds complementarily to a host target binding site located in an untranslated region of VGAM2588 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2588 host target RNA into VGAM2588 host target protein, herein schematically represented by VGAM1 HOST TARGET PROTEIN through VGAM3 HOST TARGET PROTEIN, all of FIG. 1.

It is appreciated that a function of VGR3259 gene, herein designated VGR GENE, is inhibition of expression of host target genes, as part of a novel viral mechanism of attacking a host. Accordingly, utilities of VGR3259 gene include diagnosis, prevention and treatment of viral infection by Satsuma Dwarf Virus. Specific functions, and accordingly utilities, of VGR3259 gene correlate with, and may be deduced from, the identity of the host target genes, which are inhibited by VGAM RNAs comprised in the 'operon-like' cluster of VGR3259 gene: VGAM2584 host target protein, VGAM2585 host target protein, VGAM2586 host target protein, VGAM2587 host target protein and VGAM2588 host target protein, herein schematically represented by VGAM1 HOST TARGET PROTEIN through VGAM3 HOST TARGET PROTEIN. The function of these host target genes is elaborated hereinabove with reference to VGAM2584, VGAM2585, VGAM2586, VGAM2587 and VGAM2588.

FIG. 9 further provides a conceptual description of novel bioinformatically detected regulatory viral gene, referred to here as Viral Genomic Record 3260(VGR3260) viral gene, which encodes an 'operon-like' cluster of novel viral micro RNA-like genes, each of which in turn modulates expression of at least one host target gene, the function and utility of which at least one host target gene is known in the art.

VGR3260 gene, herein designated VGR GENE, is a novel bioinformatically detected regulatory, non protein coding, RNA viral gene. The method by which VGR3260 gene was detected is described hereinabove with reference to FIGS. 1-9.

VGR3260 gene encodes VGR3260 precursor RNA, herein designated VGR PRECURSOR RNA, an RNA molecule, typically several hundred nucleotides long.

VGR3260 precursor RNA folds spatially, forming VGR3260 folded precursor RNA, herein designated VGR FOLDED PRECURSOR RNA. It is appreciated that VGR3260 folded precursor RNA comprises a plurality of what is known in the art as 'hairpin' structures. These 'hairpin' structures are due to the fact that the nucleotide sequence of VGR3260 precursor RNA comprises a plurality of segments, the first half of each such segment having a nucleotide sequence which is at least a partial inversed-reversed sequence of the second half thereof, as is well known in the art.

VGR3260 folded precursor RNA is naturally processed by cellular enzymatic activity into at least 7 separate VGAM precursor RNAs, VGAM2589 precursor RNA, VGAM2590 precursor RNA, VGAM2591 precursor RNA, VGAM2592 precursor RNA, VGAM2593 precursor RNA, VGAM2594 precursor RNA and VGAM2595 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2589 RNA, VGAM2590 RNA, VGAM2591 RNA, VGAM2592 RNA, VGAM2593 RNA, VGAM2594 RNA and VGAM2595 RNA, herein schematically represented by VGAM1 RNA through VGAM3 RNA, each of which VGAM RNAs corresponding to VGAM RNA of FIG. 1.

VGAM2589 RNA, herein schematically represented by VGAM1 RNA through VGAM3 RNA, binds complementarily to a host target binding site located in an untranslated region of VGAM2589 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2589 host target RNA into VGAM2589 host target protein, herein schematically represented by VGAM1 HOST TARGET PROTEIN through VGAM3 HOST TARGET PROTEIN, all of FIG. 1.

VGAM2590 RNA, herein schematically represented by VGAM1 RNA through VGAM3 RNA, binds complementarily to a host target binding site located in an untranslated region of VGAM2590 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2590 host target RNA into VGAM2590 host target protein, herein schematically represented by VGAM1 HOST TARGET PROTEIN through VGAM3 HOST TARGET PROTEIN, all of FIG. 1.

VGAM2591 RNA, herein schematically represented by VGAM1 RNA through VGAM3 RNA, binds complementarily to a host target binding site located in an untranslated region of VGAM2591 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2591 host target RNA into VGAM2591 host target protein, herein schematically represented by VGAM1 HOST TARGET PROTEIN through VGAM3 HOST TARGET PROTEIN, all of FIG. 1.

VGAM2592 RNA, herein schematically represented by VGAM1 RNA through VGAM3 RNA, binds complementarily to a host target binding site located in an untranslated region of VGAM2592 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2592 host target RNA into VGAM2592 host target protein, herein schematically represented by VGAM1 HOST TARGET PROTEIN through VGAM3 HOST TARGET PROTEIN, all of FIG. 1.

VGAM2593 RNA, herein schematically represented by VGAM1 RNA through VGAM3 RNA, binds complementarily to a host target binding site located in an untranslated region of VGAM2593 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2593 host target RNA into VGAM2593 host target protein, herein schematically represented by VGAM1 HOST TARGET PROTEIN through VGAM3 HOST TARGET PROTEIN, all of FIG. 1.

VGAM2594 RNA, herein schematically represented by VGAM1 RNA through VGAM3 RNA, binds complementarily to a host target binding site located in an untranslated region of VGAM2594 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2594 host target RNA into VGAM2594 host target protein, herein schematically represented by VGAM1 HOST TARGET PROTEIN through VGAM3 HOST TARGET PROTEIN, all of FIG. 1.

VGAM2595 RNA, herein schematically represented by VGAM1 RNA through VGAM3 RNA, binds complementarily to a host target binding site located in an untranslated region of VGAM2595 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2595 host target RNA into VGAM2595 host target protein, herein schematically represented by VGAM1 HOST TARGET PROTEIN through VGAM3 HOST TARGET PROTEIN, all of FIG. 1.

It is appreciated that a function of VGR3260 gene, herein designated VGR GENE, is inhibition of expression of host target genes, as part of a novel viral mechanism of attacking a host. Accordingly, utilities of VGR3260 gene include diagnosis, prevention and treatment of viral infection by Apple Latent Spherical Virus. Specific functions, and accordingly utilities, of VGR3260 gene correlate with, and may be deduced from, the identity of the host target genes, which are inhibited by VGAM RNAs comprised in the 'operon-like' cluster of VGR3260 gene: VGAM2589 host target protein, VGAM2590 host target protein, VGAM2591 host target protein, VGAM2592 host target protein, VGAM2593 host target protein, VGAM2594 host target protein and VGAM2595 host target protein, herein schematically represented by VGAM1 HOST TARGET PROTEIN through VGAM3 HOST TARGET PROTEIN. The function of these host target genes is elaborated hereinabove with reference to VGAM2589, VGAM2590, VGAM2591, VGAM2592, VGAM2593, VGAM2594 and VGAM2595. FIG. 9 further provides a conceptual description of novel bioinformatically detected regulatory viral gene, referred to here as Viral Genomic Record 3261(VGR3261) viral gene, which encodes an 'operon-like' cluster of novel viral micro RNA-like genes, each of which in turn modulates expression of at least one host target gene, the function and utility of which at least one host target gene is known in the art.

VGR3261 gene, herein designated VGR GENE, is a novel bioinformatically detected regulatory, non protein coding, RNA viral gene. The method by which VGR3261 gene was detected is described hereinabove with reference to FIGS. 1-9.

VGR3261 gene encodes VGR3261 precursor RNA, herein designated VGR PRECURSOR RNA, an RNA molecule, typically several hundred nucleotides long.

VGR3261 precursor RNA folds spatially, forming VGR3261 folded precursor RNA, herein designated VGR FOLDED PRECURSOR RNA. It is appreciated that VGR3261 folded precursor RNA comprises a plurality of what is known in the art as 'hairpin' structures. These 'hairpin' structures are due to the fact that the nucleotide sequence of VGR3261 precursor RNA comprises a plurality of segments, the first half of each such segment having a nucleotide sequence which is at least a partial inversed-reversed sequence of the second half thereof, as is well known in the art.

VGR3261 folded precursor RNA is naturally processed by cellular enzymatic activity into at least 3 separate VGAM precursor RNAs, VGAM2596 precursor RNA, VGAM2597 precursor RNA and VGAM2598 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2596 RNA, VGAM2597 RNA and VGAM2598 RNA, herein schematically represented by VGAM1 RNA through VGAM3 RNA, each of which VGAM RNAs corresponding to VGAM RNA of FIG. 1.

VGAM2596 RNA, herein schematically represented by VGAM1 RNA through VGAM3 RNA, binds complementarily to a host target binding site located in an untranslated region of VGAM2596 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2596 host target RNA into VGAM2596 host target protein, herein schematically represented by VGAM1 HOST TARGET PROTEIN through VGAM3 HOST TARGET PROTEIN, all of FIG. 1.

VGAM2597 RNA, herein schematically represented by VGAM1 RNA through VGAM3 RNA, binds complementarily to a host target binding site located in an untranslated region of VGAM2597 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2597 host target RNA into VGAM2597 host target protein, herein schematically represented by VGAM1 HOST TARGET PROTEIN through VGAM3 HOST TARGET PROTEIN, all of FIG. 1.

VGAM2598 RNA, herein schematically represented by VGAM1 RNA through VGAM3 RNA, binds complementarily to a host target binding site located in an untranslated region of VGAM2598 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2598 host target RNA into VGAM2598 host target protein, herein schematically represented by VGAM1 HOST TARGET PROTEIN through VGAM3 HOST TARGET PROTEIN, all of FIG. 1.

It is appreciated that a function of VGR3261 gene, herein designated VGR GENE, is inhibition of expression of host target genes, as part of a novel viral mechanism of attacking a host. Accordingly, utilities of VGR3261 gene include diagnosis, prevention and treatment of viral infection by Tobacco Rattle Virus. Specific functions, and accordingly utilities, of VGR3261 gene correlate with, and may be deduced from, the identity of the host target genes, which are inhibited by VGAM RNAs comprised in the 'operon-like' cluster of VGR3261 gene: VGAM2596 host target protein, VGAM2597 host target protein and VGAM2598 host target protein, herein schematically represented by VGAM1 HOST TARGET PROTEIN through VGAM3 HOST TARGET PROTEIN. The function of these host target genes is elaborated hereinabove with reference to VGAM2596, VGAM2597 and VGAM2598. FIG. 9 further provides a conceptual description of novel bioinformatically detected regulatory viral gene, referred to here as Viral Genomic Record 3262(VGR3262) viral gene, which encodes an 'operon-like' cluster of novel viral micro RNA-like genes, each of which in turn modulates expression of at least one host target gene, the function and utility of which at least one host target gene is known in the art.

VGR3262 gene, herein designated VGR GENE, is a novel bioinformatically detected regulatory, non protein coding, RNA viral gene. The method by which VGR3262 gene was detected is described hereinabove with reference to FIGS. 1-9.

VGR3262 gene encodes VGR3262 precursor RNA, herein designated VGR PRECURSOR RNA, an RNA molecule, typically several hundred nucleotides long.

VGR3262 precursor RNA folds spatially, forming VGR3262 folded precursor RNA, herein designated VGR FOLDED PRECURSOR RNA. It is appreciated that VGR3262 folded precursor RNA comprises a plurality of what is known in the art as 'hairpin' structures. These 'hairpin' structures are due to the fact that the nucleotide sequence of VGR3262 precursor RNA comprises a plurality of segments, the first half of each such segment having a nucleotide sequence which is at least a partial inversed-reversed sequence of the second half thereof, as is well known in the art.

VGR3262 folded precursor RNA is naturally processed by cellular enzymatic activity into at least 4 separate VGAM precursor RNAs, VGAM2599 precursor RNA, VGAM2600 precursor RNA, VGAM2601 precursor RNA and VGAM2602 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2599 RNA, VGAM2600 RNA, VGAM2601 RNA and VGAM2602 RNA, herein schematically represented by VGAM1 RNA through VGAM3 RNA, each of which VGAM RNAs corresponding to VGAM RNA of FIG. 1.

VGAM2599 RNA, herein schematically represented by VGAM1 RNA through VGAM3 RNA, binds complementarily to a host target binding site located in an untranslated region of VGAM2599 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2599 host target RNA into VGAM2599 host target protein, herein schematically represented by VGAM1 HOST TARGET PROTEIN through VGAM3 HOST TARGET PROTEIN, all of FIG. 1.

VGAM2600 RNA, herein schematically represented by VGAM1 RNA through VGAM3 RNA, binds complementarily to a host target binding site located in an untranslated region of VGAM2600 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2600 host target RNA into VGAM2600 host target protein, herein schematically represented by VGAM1 HOST TARGET PROTEIN through VGAM3 HOST TARGET PROTEIN, all of FIG. 1.

VGAM2601 RNA, herein schematically represented by VGAM1 RNA through VGAM3 RNA, binds complementarily to a host target binding site located in an untranslated region of VGAM2601 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2601 host target RNA into VGAM2601 host target protein, herein schematically represented by VGAM1 HOST TARGET PROTEIN through VGAM3 HOST TARGET PROTEIN, all of FIG. 1.

VGAM2602 RNA, herein schematically represented by VGAM1 RNA through VGAM3 RNA, binds complementarily to a host target binding site located in an untranslated region of VGAM2602 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2602 host target RNA into VGAM2602 host target protein, herein schematically represented by VGAM1 HOST TARGET PROTEIN through VGAM3 HOST TARGET PROTEIN, all of FIG. 1.

It is appreciated that a function of VGR3262 gene, herein designated VGR GENE, is inhibition of expression of host target genes, as part of a novel viral mechanism of attacking a host. Accordingly, utilities of VGR3262 gene include diagnosis, prevention and treatment of viral infection by Obuda Pepper Virus. Specific functions, and accordingly utilities, of VGR3262 gene correlate with, and may be deduced from, the identity of the host target genes, which are inhibited by VGAM RNAs comprised in the 'operon-like' cluster of VGR3262 gene: VGAM2599 host target protein, VGAM2600 host target protein, VGAM2601 host target protein and VGAM2602 host target protein, herein schematically represented by VGAM1 HOST TARGET PROTEIN through VGAM3 HOST TARGET PROTEIN. The function of these host target genes is elaborated hereinabove with reference to VGAM2599, VGAM2600, VGAM2601 and VGAM2602.

FIG. 9 further provides a conceptual description of novel bioinformatically detected regulatory viral gene, referred to here as Viral Genomic Record 3263(VGR3263) viral gene, which encodes an 'operon-like' cluster of novel viral micro RNA-like genes, each of which in turn modulates expression of at least one host target gene, the function and utility of which at least one host target gene is known in the art.

VGR3263 gene, herein designated VGR GENE, is a novel bioinformatically detected regulatory, non protein coding, RNA viral gene. The method by which VGR3263 gene was detected is described hereinabove with reference to FIGS. 1-9.

VGR3263 gene encodes VGR3263 precursor RNA, herein designated VGR PRECURSOR RNA, an RNA molecule, typically several hundred nucleotides long.

VGR3263 precursor RNA folds spatially, forming VGR3263 folded precursor RNA, herein designated VGR FOLDED PRECURSOR RNA. It is appreciated that VGR3263 folded precursor RNA comprises a plurality of what is known in the art as 'hairpin' structures. These 'hairpin' structures are due to the fact that the nucleotide sequence of VGR3263 precursor RNA comprises a plurality of segments, the first half of each such segment having a nucleotide sequence which is at least a partial inversed-reversed sequence of the second half thereof, as is well known in the art.

VGR3263 folded precursor RNA is naturally processed by cellular enzymatic activity into at least 2 separate VGAM precursor RNAs, VGAM2603 precursor RNA and VGAM2604 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2603 RNA and VGAM2604 RNA, herein schematically represented by VGAM1 RNA through VGAM3 RNA, each of which VGAM RNAs corresponding to VGAM RNA of FIG. 1.

VGAM2603 RNA, herein schematically represented by VGAM1 RNA through VGAM3 RNA, binds complementarily to a host target binding site located in an untranslated region of VGAM2603 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2603 host target RNA into VGAM2603 host target protein, herein schematically represented by VGAM1 HOST TARGET PROTEIN through VGAM3 HOST TARGET PROTEIN, all of FIG. 1.

VGAM2604 RNA, herein schematically represented by VGAM1 RNA through VGAM3 RNA, binds complementarily to a host target binding site located in an untranslated region of VGAM2604 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2604 host target RNA into VGAM2604 host target protein, herein schematically represented by VGAM1 HOST TARGET PROTEIN through VGAM3 HOST TARGET PROTEIN, all of FIG. 1.

It is appreciated that a function of VGR3263 gene, herein designated VGR GENE, is inhibition of expression of host target genes, as part of a novel viral mechanism of attacking a host. Accordingly, utilities of VGR3263 gene include diagnosis, prevention and treatment of viral infection by Sugarcane Striate Mosaic Associated Virus. Specific functions, and accordingly utilities, of VGR3263 gene correlate with, and may be deduced from, the identity of the host target genes, which are inhibited by VGAM RNAs comprised in the 'operon-like' cluster of VGR3263 gene: VGAM2603 host target protein and VGAM2604 host target protein, herein schematically represented by VGAM1 HOST TARGET PROTEIN through VGAM3 HOST TARGET PROTEIN. The function of these host target genes is elaborated hereinabove with reference to VGAM2603 and VGAM2604. FIG. 9 further provides a conceptual description of novel bioinformatically detected regulatory viral gene, referred to here as Viral Genomic Record 3264(VGR3264) viral gene, which encodes an 'operon-like' cluster of novel viral micro RNA-like genes, each of which in turn modulates expression of at least one host target gene, the function and utility of which at least one host target gene is known in the art.

VGR3264 gene, herein designated VGR GENE, is a novel bioinformatically detected regulatory, non protein coding, RNA viral gene. The method by which VGR3264 gene was detected is described hereinabove with reference to FIGS. 1-9.

VGR3264 gene encodes VGR3264 precursor RNA, herein designated VGR PRECURSOR RNA, an RNA molecule, typically several hundred nucleotides long.

VGR3264 precursor RNA folds spatially, forming VGR3264 folded precursor RNA, herein designated VGR FOLDED PRECURSOR RNA. It is appreciated that VGR3264 folded precursor RNA comprises a plurality of what is known in the art as 'hairpin' structures. These 'hairpin' structures are due to the fact that the nucleotide sequence of VGR3264 precursor RNA comprises a plurality of segments, the first half of each such segment having a nucleotide sequence which is at least a partial inversed-reversed sequence of the second half thereof, as is well known in the art.

VGR3264 folded precursor RNA is naturally processed by cellular enzymatic activity into at least 2 separate VGAM precursor RNAs, VGAM2605 precursor RNA and VGAM2606 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2605 RNA and VGAM2606 RNA, herein schematically represented by VGAM1 RNA through VGAM3 RNA, each of which VGAM RNAs corresponding to VGAM RNA of FIG. 1.

VGAM2605 RNA, herein schematically represented by VGAM1 RNA through VGAM3 RNA, binds complementarily to a host target binding site located in an untranslated region of VGAM2605 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2605 host target RNA into VGAM2605 host target protein, herein schematically represented by VGAM1 HOST TARGET PROTEIN through VGAM3 HOST TARGET PROTEIN, all of FIG. 1.

VGAM2606 RNA, herein schematically represented by VGAM1 RNA through VGAM3 RNA, binds complementarily to a host target binding site located in an untranslated region of VGAM2606 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2606 host target RNA into VGAM2606 host target protein, herein schematically represented by VGAM1 HOST TARGET PROTEIN through VGAM3 HOST TARGET PROTEIN, all of FIG. 1.

It is appreciated that a function of VGR3264 gene, herein designated VGR GENE, is inhibition of expression of host target genes, as part of a novel viral mechanism of attacking a host. Accordingly, utilities of VGR3264 gene include diagnosis, prevention and treatment of viral infection by Salmon Pancreas Disease Virus. Specific functions, and accordingly utilities, of VGR3264 gene correlate with, and may be deduced from, the identity of the host target genes, which are inhibited by VGAM RNAs comprised in the 'operon-like' cluster of VGR3264 gene: VGAM2605 host target protein and VGAM2606 host target protein, herein schematically represented by VGAM1 HOST TARGET PROTEIN through VGAM3 HOST TARGET PROTEIN. The function of these host target genes is elaborated hereinabove with reference to VGAM2605 and VGAM2606. FIG. 9 further provides a conceptual description of novel bioinformatically detected regulatory viral gene, referred to here as Viral Genomic Record 3265(VGR3265) viral gene, which encodes an 'operon-like' cluster of novel viral micro RNA-like genes, each of which in turn modulates expression of at least one host target gene, the function and utility of which at least one host target gene is known in the art.

VGR3265 gene, herein designated VGR GENE, is a novel bioinformatically detected regulatory, non protein coding, RNA viral gene. The method by which VGR3265 gene was detected is described hereinabove with reference to FIGS. 1-9.

VGR3265 gene encodes VGR3265 precursor RNA, herein designated VGR PRECURSOR RNA, an RNA molecule, typically several hundred nucleotides long.

VGR3265 precursor RNA folds spatially, forming VGR3265 folded precursor RNA, herein designated VGR FOLDED PRECURSOR RNA. It is appreciated that VGR3265 folded precursor RNA comprises a plurality of what is known in the art as 'hairpin' structures. These 'hairpin' structures are due to the fact that the nucleotide sequence of VGR3265 precursor RNA comprises a plurality of segments, the first half of each such segment having a nucleotide sequence which is at least a partial inversed-reversed sequence of the second half thereof, as is well known in the art.

VGR3265 folded precursor RNA is naturally processed by cellular enzymatic activity into at least 4 separate VGAM precursor RNAs, VGAM2607 precursor RNA, VGAM2608 precursor RNA, VGAM2609 precursor RNA and VGAM2610 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2607 RNA, VGAM2608 RNA, VGAM2609 RNA and VGAM2610 RNA, herein schematically represented by VGAM1 RNA through VGAM3 RNA, each of which VGAM RNAs corresponding to VGAM RNA of FIG. 1.

VGAM2607 RNA, herein schematically represented by VGAM1 RNA through VGAM3 RNA, binds complementarily to a host target binding site located in an untranslated region of VGAM2607 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2607 host target RNA into VGAM2607 host target protein, herein schematically represented by VGAM1 HOST TARGET PROTEIN through VGAM3 HOST TARGET PROTEIN, all of FIG. 1.

VGAM2608 RNA, herein schematically represented by VGAM1 RNA through VGAM3 RNA, binds complementarily to a host target binding site located in an untranslated region of VGAM2608 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2608 host target RNA into VGAM2608 host target protein, herein schematically represented by VGAM1 HOST TARGET PROTEIN through VGAM3 HOST TARGET PROTEIN, all of FIG. 1.

VGAM2609 RNA, herein schematically represented by VGAM1 RNA through VGAM3 RNA, binds complementarily to a host target binding site located in an untranslated region of VGAM2609 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2609 host target RNA into VGAM2609 host target protein, herein schematically represented by VGAM1 HOST TARGET PROTEIN through VGAM3 HOST TARGET PROTEIN, all of FIG. 1.

VGAM2610 RNA, herein schematically represented by VGAM1 RNA through VGAM3 RNA, binds complementarily to a host target binding site located in an untranslated region of VGAM2610 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2610 host target RNA into VGAM2610 host target protein, herein schematically represented by VGAM1 HOST TARGET PROTEIN through VGAM3 HOST TARGET PROTEIN, all of FIG. 1.

It is appreciated that a function of VGR3265 gene, herein designated VGR GENE, is inhibition of expression of host target genes, as part of a novel viral mechanism of attacking a host. Accordingly, utilities of VGR3265 gene include diagnosis, prevention and treatment of viral infection by Ljungan Virus. Specific functions, and accordingly utilities, of VGR3265 gene correlate with, and may be deduced from, the identity of the host target genes, which are inhibited by VGAM RNAs comprised in the 'operon-like' cluster of VGR3265 gene: VGAM2607 host target protein, VGAM2608 host target protein, VGAM2609 host target protein and VGAM2610 host target protein, herein schematically represented by VGAM1 HOST TARGET PROTEIN through VGAM3 HOST TARGET PROTEIN. The function of these host target genes is elaborated hereinabove with reference to VGAM2607, VGAM2608, VGAM2609 and VGAM2610.

FIG. 9 further provides a conceptual description of novel bioinformatically detected regulatory viral gene, referred to here as Viral Genomic Record 3266(VGR3266) viral gene, which encodes an 'operon-like' cluster of novel viral micro RNA-like genes, each of which in turn modulates expression of at least one host target gene, the function and utility of which at least one host target gene is known in the art.

VGR3266 gene, herein designated VGR GENE, is a novel bioinformatically detected regulatory, non protein coding, RNA viral gene. The method by which VGR3266 gene was detected is described hereinabove with reference to FIGS. 1-9.

VGR3266 gene encodes VGR3266 precursor RNA, herein designated VGR PRECURSOR RNA, an RNA molecule, typically several hundred nucleotides long.

VGR3266 precursor RNA folds spatially, forming VGR3266 folded precursor RNA, herein designated VGR FOLDED PRECURSOR RNA. It is appreciated that VGR3266 folded precursor RNA comprises a plurality of what is known in the art as 'hairpin' structures. These 'hairpin' structures are due to the fact that the nucleotide sequence of VGR3266 precursor RNA comprises a plurality of segments, the first half of each such segment having a nucleotide sequence which is at least a partial inversed-reversed sequence of the second half thereof, as is well known in the art.

VGR3266 folded precursor RNA is naturally processed by cellular enzymatic activity into at least 2 separate VGAM precursor RNAs, VGAM2611 precursor RNA and VGAM2612 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2611 RNA and VGAM2612 RNA, herein schematically represented by VGAM1 RNA through VGAM3 RNA, each of which VGAM RNAs corresponding to VGAM RNA of FIG. 1.

VGAM2611 RNA, herein schematically represented by VGAM1 RNA through VGAM3 RNA, binds complementarily to a host target binding site located in an untranslated region of VGAM2611 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2611 host target RNA into VGAM2611 host target protein, herein schematically represented by VGAM1 HOST TARGET PROTEIN through VGAM3 HOST TARGET PROTEIN, all of FIG. 1.

VGAM2612 RNA, herein schematically represented by VGAM1 RNA through VGAM3 RNA, binds complementarily to a host target binding site located in an untranslated region of VGAM2612 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2612 host target RNA into VGAM2612 host target protein, herein schematically represented by VGAM1 HOST TARGET PROTEIN through VGAM3 HOST TARGET PROTEIN, all of FIG. 1.

It is appreciated that a function of VGR3266 gene, herein designated VGR GENE, is inhibition of expression of host target genes, as part of a novel viral mechanism of attacking a host. Accordingly, utilities of VGR3266 gene include diagnosis, prevention and treatment of viral infection by Equine Rhinitis A Virus. Specific functions, and accordingly utilities, of VGR3266 gene correlate with, and may be deduced from, the identity of the host target genes, which are inhibited by VGAM RNAs comprised in the 'operon-like' cluster of VGR3266 gene: VGAM2611 host target protein and VGAM2612 host target protein, herein schematically represented by VGAM1 HOST TARGET PROTEIN through VGAM3 HOST TARGET PROTEIN. The function of these host target genes is elaborated hereinabove with reference to VGAM2611 and VGAM2612. FIG. 9 further provides a conceptual description of novel bioinformatically detected regulatory viral gene, referred to here as Viral Genomic Record 3267(VGR3267) viral gene, which encodes an 'operon-like' cluster of novel viral micro RNA-like genes, each of which in turn modulates expression of at least one host target gene, the function and utility of which at least one host target gene is known in the art.

VGR3267 gene, herein designated VGR GENE, is a novel bioinformatically detected regulatory, non protein coding, RNA viral gene. The method by which VGR3267 gene was detected is described hereinabove with reference to FIGS. 1-9.

VGR3267 gene encodes VGR3267 precursor RNA, herein designated VGR PRECURSOR RNA, an RNA molecule, typically several hundred nucleotides long.

VGR3267 precursor RNA folds spatially, forming VGR3267 folded precursor RNA, herein designated VGR FOLDED PRECURSOR RNA. It is appreciated that VGR3267 folded precursor RNA comprises a plurality of what is known in the art as 'hairpin' structures. These 'hairpin' structures are due to the fact that the nucleotide sequence of VGR3267 precursor RNA comprises a plurality of segments, the first half of each such segment having a nucleotide sequence which is at least a partial inversed-reversed sequence of the second half thereof, as is well known in the art.

VGR3267 folded precursor RNA is naturally processed by cellular enzymatic activity into at least 6 separate VGAM precursor RNAs, VGAM2614 precursor RNA, VGAM2615 precursor RNA, VGAM2616 precursor RNA, VGAM2617 precursor RNA, VGAM2618 precursor RNA and VGAM2619 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2614 RNA, VGAM2615 RNA, VGAM2616 RNA, VGAM2617 RNA, VGAM2618 RNA and VGAM2619 RNA, herein schematically represented by VGAM1 RNA through VGAM3 RNA, each of which VGAM RNAs corresponding to VGAM RNA of FIG. 1.

VGAM2614 RNA, herein schematically represented by VGAM1 RNA through VGAM3 RNA, binds complementarily to a host target binding site located in an untranslated region of VGAM2614 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2614 host target RNA into VGAM2614 host target protein, herein schematically represented by VGAM1 HOST TARGET PROTEIN through VGAM3 HOST TARGET PROTEIN, all of FIG. 1.

VGAM2615 RNA, herein schematically represented by VGAM1 RNA through VGAM3 RNA, binds complementarily to a host target binding site located in an untranslated region of VGAM2615 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2615 host target RNA into VGAM2615 host target protein, herein schematically represented by VGAM1 HOST TARGET PROTEIN through VGAM3 HOST TARGET PROTEIN, all of FIG. 1.

VGAM2616 RNA, herein schematically represented by VGAM1 RNA through VGAM3 RNA, binds complementarily to a host target binding site located in an untranslated region of VGAM2616 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2616 host target RNA into VGAM2616 host target protein, herein schematically represented by VGAM1 HOST TARGET PROTEIN through VGAM3 HOST TARGET PROTEIN, all of FIG. 1.

VGAM2617 RNA, herein schematically represented by VGAM1 RNA through VGAM3 RNA, binds complementarily to a host target binding site located in an untranslated region of VGAM2617 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2617 host target RNA into VGAM2617 host target protein, herein schematically represented by VGAM1 HOST TARGET PROTEIN through VGAM3 HOST TARGET PROTEIN, all of FIG. 1.

VGAM2618 RNA, herein schematically represented by VGAM1 RNA through VGAM3 RNA, binds complementarily to a host target binding site located in an untranslated region of VGAM2618 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2618 host target RNA into VGAM2618 host target protein, herein schematically represented by VGAM1 HOST TARGET PROTEIN through VGAM3 HOST TARGET PROTEIN, all of FIG. 1.

VGAM2619 RNA, herein schematically represented by VGAM1 RNA through VGAM3 RNA, binds complementarily to a host target binding site located in an untranslated region of VGAM2619 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2619 host target RNA into VGAM2619 host target protein, herein schematically represented by VGAM1 HOST TARGET PROTEIN through VGAM3 HOST TARGET PROTEIN, all of FIG. 1.

It is appreciated that a function of VGR3267 gene, herein designated VGR GENE, is inhibition of expression of host target genes, as part of a novel viral mechanism of attacking a host. Accordingly, utilities of VGR3267 gene include diagnosis, prevention and treatment of viral infection by Equine Rhinitis B Virus. Specific functions, and accordingly utilities, of VGR3267 gene correlate with, and may be deduced from, the identity of the host target genes, which are inhibited by VGAM RNAs comprised in the 'operon-like' cluster of VGR3267 gene: VGAM2614 host target protein, VGAM2615 host target protein, VGAM2616 host target protein, VGAM2617 host target protein, VGAM2618 host target protein and VGAM2619 host target protein, herein schematically represented by VGAM1 HOST TARGET PROTEIN through VGAM3 HOST TARGET PROTEIN. The function of these host target genes is elaborated hereinabove with reference to VGAM2614, VGAM2615, VGAM2616, VGAM2617, VGAM2618 and VGAM2619. FIG. 9 further provides a conceptual description of novel bioinformatically detected regulatory viral gene, referred to here as Viral Genomic Record 3268(VGR3268) viral gene, which encodes an 'operon-like' cluster of novel viral micro RNA-like genes, each of which in turn modulates expression of at least one host target gene, the function and utility of which at least one host target gene is known in the art.

VGR3268 gene, herein designated VGR GENE, is a novel bioinformatically detected regulatory, non protein coding, RNA viral gene. The method by which VGR3268 gene was detected is described hereinabove with reference to FIGS. 1-9.

VGR3268 gene encodes VGR3268 precursor RNA, herein designated VGR PRECURSOR RNA, an RNA molecule, typically several hundred nucleotides long.

VGR3268 precursor RNA folds spatially, forming VGR3268 folded precursor RNA, herein designated VGR FOLDED PRECURSOR RNA. It is appreciated that VGR3268 folded precursor RNA comprises a plurality of what is known in the art as 'hairpin' structures. These 'hairpin' structures are due to the fact that the nucleotide sequence of VGR3268 precursor RNA comprises a plurality of segments, the first half of each such segment having a nucleotide sequence which is at least a partial inversed-reversed sequence of the second half thereof, as is well known in the art.

VGR3268 folded precursor RNA is naturally processed by cellular enzymatic activity into at least 3 separate VGAM precursor RNAs, VGAM2620 precursor RNA, VGAM2621 precursor RNA and VGAM2622 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2620 RNA, VGAM2621 RNA and VGAM2622 RNA, herein schematically represented by VGAM1 RNA through VGAM3 RNA, each of which VGAM RNAs corresponding to VGAM RNA of FIG. 1.

VGAM2620 RNA, herein schematically represented by VGAM1 RNA through VGAM3 RNA, binds complementarily to a host target binding site located in an untranslated region of VGAM2620 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2620 host target RNA into VGAM2620 host target protein, herein schematically represented by VGAM1 HOST TARGET PROTEIN through VGAM3 HOST TARGET PROTEIN, all of FIG. 1.

VGAM2621 RNA, herein schematically represented by VGAM1 RNA through VGAM3 RNA, binds complementarily to a host target binding site located in an untranslated region of VGAM2621 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2621 host target RNA into VGAM2621 host target protein, herein schematically represented by VGAM1 HOST TARGET PROTEIN through VGAM3 HOST TARGET PROTEIN, all of FIG. 1.

VGAM2622 RNA, herein schematically represented by VGAM1 RNA through VGAM3 RNA, binds complementarily to a host target binding site located in an untranslated region of VGAM2622 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2622 host target RNA into VGAM2622 host target protein, herein schematically represented by VGAM1 HOST TARGET PROTEIN through VGAM3 HOST TARGET PROTEIN, all of FIG. 1.

It is appreciated that a function of VGR3268 gene, herein designated VGR GENE, is inhibition of expression of host target genes, as part of a novel viral mechanism of attacking a host. Accordingly, utilities of VGR3268 gene include diagnosis, prevention and treatment of viral infection by Porcine Enterovirus A (PEV8). Specific functions, and accordingly utilities, of VGR3268 gene correlate with, and may be deduced from, the identity of the host target genes, which are inhibited by VGAM RNAs comprised in the 'operon-like' cluster of VGR3268 gene: VGAM2620 host target protein, VGAM2621 host target protein and VGAM2622 host target protein, herein schematically represented by VGAM1 HOST TARGET PROTEIN through VGAM3 HOST TARGET PROTEIN. The function of these host target genes is elaborated hereinabove with reference to VGAM2620, VGAM2621 and VGAM2622. FIG. 9 further provides a conceptual description of novel bioinformatically detected regulatory viral gene, referred to here as Viral Genomic Record 3269(VGR3269) viral gene, which encodes an 'operon-like' cluster of novel viral micro RNA-like genes, each of which in turn modulates expression of at least one host target gene, the function and utility of which at least one host target gene is known in the art.

VGR3269 gene, herein designated VGR GENE, is a novel bioinformatically detected regulatory, non protein coding, RNA viral gene. The method by which VGR3269 gene was detected is described hereinabove with reference to FIGS. 1-9.

VGR3269 gene encodes VGR3269 precursor RNA, herein designated VGR PRECURSOR RNA, an RNA molecule, typically several hundred nucleotides long.

VGR3269 precursor RNA folds spatially, forming VGR3269 folded precursor RNA, herein designated VGR FOLDED PRECURSOR RNA. It is appreciated that VGR3269 folded precursor RNA comprises a plurality of what is known in the art as 'hairpin' structures. These 'hairpin' structures are due to the fact that the nucleotide sequence of VGR3269 precursor RNA comprises a plurality of segments, the first half of each such segment having a nucleotide sequence which is at least a partial inversed-reversed sequence of the second half thereof, as is well known in the art.

VGR3269 folded precursor RNA is naturally processed by cellular enzymatic activity into at least 3 separate VGAM precursor RNAs, VGAM2623 precursor RNA, VGAM2624 precursor RNA and VGAM2625 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2623 RNA, VGAM2624 RNA and VGAM2625 RNA, herein schematically represented by VGAM1 RNA through VGAM3 RNA, each of which VGAM RNAs corresponding to VGAM RNA of FIG. 1.

VGAM2623 RNA, herein schematically represented by VGAM1 RNA through VGAM3 RNA, binds complementarily to a host target binding site located in an untranslated region of VGAM2623 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2623 host target RNA into VGAM2623 host target protein, herein schematically represented by VGAM1 HOST TARGET PROTEIN through VGAM3 HOST TARGET PROTEIN, all of FIG. 1.

VGAM2624 RNA, herein schematically represented by VGAM1 RNA through VGAM3 RNA, binds complementarily to a host target binding site located in an untranslated region of VGAM2624 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2624 host target RNA into VGAM2624 host target protein, herein schematically represented by VGAM1 HOST TARGET PROTEIN through VGAM3 HOST TARGET PROTEIN, all of FIG. 1.

VGAM2625 RNA, herein schematically represented by VGAM1 RNA through VGAM3 RNA, binds complementarily to a host target binding site located in an untranslated region of VGAM2625 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2625 host target RNA into VGAM2625 host target protein, herein schematically represented by VGAM1 HOST TARGET PROTEIN through VGAM3 HOST TARGET PROTEIN, all of FIG. 1.

It is appreciated that a function of VGR3269 gene, herein designated VGR GENE, is inhibition of expression of host target genes, as part of a novel viral mechanism of attacking a host. Accordingly, utilities of VGR3269 gene include diagnosis, prevention and treatment of viral infection by A-2 Plaque Virus. Specific functions, and accordingly utilities, of VGR3269 gene correlate with, and may be deduced from, the identity of the host target genes, which are inhibited by VGAM RNAs comprised in the 'operon-like' cluster of VGR3269 gene: VGAM2623 host target protein, VGAM2624 host target protein and VGAM2625 host target protein, herein schematically represented by VGAM1 HOST TARGET PROTEIN through VGAM3 HOST TARGET PROTEIN. The function of these host target genes is elaborated hereinabove with reference to VGAM2623, VGAM2624 and VGAM2625. FIG. 9 further provides a conceptual description of novel bioinformatically detected regulatory viral gene, referred to here as Viral Genomic Record 3270(VGR3270) viral gene, which encodes an 'operon-like' cluster of novel viral micro RNA-like genes, each of which in turn modulates expression of at least one host target gene, the function and utility of which at least one host target gene is known in the art.

VGR3270 gene, herein designated VGR GENE, is a novel bioinformatically detected regulatory, non protein coding, RNA viral gene. The method by which VGR3270 gene was detected is described hereinabove with reference to FIGS. 1-9.

VGR3270 gene encodes VGR3270 precursor RNA, herein designated VGR PRECURSOR RNA, an RNA molecule, typically several hundred nucleotides long.

VGR3270 precursor RNA folds spatially, forming VGR3270 folded precursor RNA, herein designated VGR FOLDED PRECURSOR RNA. It is appreciated that VGR3270 folded precursor RNA comprises a plurality of what is known in the art as 'hairpin' structures. These 'hairpin' structures are due to the fact that the nucleotide sequence of VGR3270 precursor RNA comprises a plurality of segments, the first half of each such segment having a nucleotide sequence which is at least a partial inversed-reversed sequence of the second half thereof, as is well known in the art.

VGR3270 folded precursor RNA is naturally processed by cellular enzymatic activity into at least 4 separate VGAM precursor RNAs, VGAM2626 precursor RNA, VGAM2627 precursor RNA, VGAM2628 precursor RNA and VGAM2629 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2626 RNA, VGAM2627 RNA, VGAM2628 RNA and VGAM2629 RNA, herein schematically represented by VGAM1 RNA through VGAM3 RNA, each of which VGAM RNAs corresponding to VGAM RNA of FIG. 1.

VGAM2626 RNA, herein schematically represented by VGAM1 RNA through VGAM3 RNA, binds complementarily to a host target binding site located in an untranslated region of VGAM2626 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2626 host target RNA into VGAM2626 host target protein, herein schematically represented by VGAM1 HOST TARGET PROTEIN through VGAM3 HOST TARGET PROTEIN, all of FIG. 1.

VGAM2627 RNA, herein schematically represented by VGAM1 RNA through VGAM3 RNA, binds complementarily to a host target binding site located in an untranslated region of VGAM2627 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2627 host target RNA into VGAM2627 host target protein, herein schematically represented by VGAM1 HOST TARGET PROTEIN through VGAM3 HOST TARGET PROTEIN, all of FIG. 1.

VGAM2628 RNA, herein schematically represented by VGAM1 RNA through VGAM3 RNA, binds complementarily to a host target binding site located in an untranslated region of VGAM2628 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2628 host target RNA into VGAM2628 host target protein, herein schematically represented by VGAM1 HOST TARGET PROTEIN through VGAM3 HOST TARGET PROTEIN, all of FIG. 1.

VGAM2629 RNA, herein schematically represented by VGAM1 RNA through VGAM3 RNA, binds complementarily to a host target binding site located in an untranslated region of VGAM2629 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2629 host target RNA into VGAM2629 host target protein, herein schematically represented by VGAM1 HOST TARGET PROTEIN through VGAM3 HOST TARGET PROTEIN, all of FIG. 1.

It is appreciated that a function of VGR3270 gene, herein designated VGR GENE, is inhibition of expression of host target genes, as part of a novel viral mechanism of attacking a host. Accordingly, utilities of VGR3270 gene include diagnosis, prevention and treatment of viral infection by Avian Encephalomyelitis Virus. Specific functions, and accordingly utilities, of VGR3270 gene correlate with, and may be deduced from, the identity of the host target genes, which are inhibited by VGAM RNAs comprised in the 'operon-like' cluster of VGR3270 gene: VGAM2626 host target protein, VGAM2627 host target protein, VGAM2628 host target protein and VGAM2629 host target protein, herein schematically represented by VGAM1 HOST TARGET PROTEIN through VGAM3 HOST TARGET PROTEIN. The function of these host target genes is elaborated hereinabove with reference to VGAM2626, VGAM2627, VGAM2628 and VGAM2629.

FIG. 9 further provides a conceptual description of novel bioinformatically detected regulatory viral gene, referred to here as Viral Genomic Record 3271(VGR3271) viral gene, which encodes an 'operon-like' cluster of novel viral micro RNA-like genes, each of which in turn modulates expression of at least one host target gene, the function and utility of which at least one host target gene is known in the art.

VGR3271 gene, herein designated VGR GENE, is a novel bioinformatically detected regulatory, non protein coding, RNA viral gene. The method by which VGR3271 gene was detected is described hereinabove with reference to FIGS. 1-9.

VGR3271 gene encodes VGR3271 precursor RNA, herein designated VGR PRECURSOR RNA, an RNA molecule, typically several hundred nucleotides long.

VGR3271 precursor RNA folds spatially, forming VGR3271 folded precursor RNA, herein designated VGR FOLDED PRECURSOR RNA. It is appreciated that VGR3271 folded precursor RNA comprises a plurality of what is known in the art as 'hairpin' structures. These 'hairpin' structures are due to the fact that the nucleotide sequence of VGR3271 precursor RNA comprises a plurality of segments, the first half of each such segment having a nucleotide sequence which is at least a partial inversed-reversed sequence of the second half thereof, as is well known in the art.

VGR3271 folded precursor RNA is naturally processed by cellular enzymatic activity into at least 6 separate VGAM precursor RNAs, VGAM2630 precursor RNA, VGAM2631 precursor RNA, VGAM2632 precursor RNA, VGAM2633 precursor RNA, VGAM2634 precursor RNA and VGAM2635 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2630 RNA, VGAM2631 RNA, VGAM2632 RNA, VGAM2633 RNA, VGAM2634 RNA and VGAM2635 RNA, herein schematically represented by VGAM1 RNA through VGAM3 RNA, each of which VGAM RNAs corresponding to VGAM RNA of FIG. 1.

VGAM2630 RNA, herein schematically represented by VGAM1 RNA through VGAM3 RNA, binds complementarily to a host target binding site located in an untranslated region of VGAM2630 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2630 host target RNA into VGAM2630 host target protein, herein schematically represented by VGAM1 HOST TARGET PROTEIN through VGAM3 HOST TARGET PROTEIN, all of FIG. 1.

VGAM2631 RNA, herein schematically represented by VGAM1 RNA through VGAM3 RNA, binds complementarily to a host target binding site located in an untranslated region of VGAM2631 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2631 host target RNA into VGAM2631 host target protein, herein schematically represented by VGAM1 HOST TARGET PROTEIN through VGAM3 HOST TARGET PROTEIN, all of FIG. 1.

VGAM2632 RNA, herein schematically represented by VGAM1 RNA through VGAM3 RNA, binds complementarily to a host target binding site located in an untranslated region of VGAM2632 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2632 host target RNA into VGAM2632 host target protein, herein schematically represented by VGAM1 HOST TARGET PROTEIN through VGAM3 HOST TARGET PROTEIN, all of FIG. 1.

VGAM2633 RNA, herein schematically represented by VGAM1 RNA through VGAM3 RNA, binds complementarily to a host target binding site located in an untranslated region of VGAM2633 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2633 host target RNA into VGAM2633 host target protein, herein schematically represented by VGAM1 HOST TARGET PROTEIN through VGAM3 HOST TARGET PROTEIN, all of FIG. 1.

VGAM2634 RNA, herein schematically represented by VGAM1 RNA through VGAM3 RNA, binds complementarily to a host target binding site located in an untranslated region of VGAM2634 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2634 host target RNA into VGAM2634 host target protein, herein schematically represented by VGAM1 HOST TARGET PROTEIN through VGAM3 HOST TARGET PROTEIN, all of FIG. 1.

VGAM2635 RNA, herein schematically represented by VGAM1 RNA through VGAM3 RNA, binds complementarily to a host target binding site located in an untranslated region of VGAM2635 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2635 host target RNA into VGAM2635 host target protein, herein schematically represented by VGAM1 HOST TARGET PROTEIN through VGAM3 HOST TARGET PROTEIN, all of FIG. 1.

It is appreciated that a function of VGR3271 gene, herein designated VGR GENE, is inhibition of expression of host target genes, as part of a novel viral mechanism of attacking a host. Accordingly, utilities of VGR3271 gene include diagnosis, prevention and treatment of viral infection by Tamana Bat Virus. Specific functions, and accordingly utilities, of VGR3271 gene correlate with, and may be deduced from, the identity of the host target genes, which are inhibited by VGAM RNAs comprised in the 'operon-like' cluster of VGR3271 gene: VGAM2630 host target protein, VGAM2631 host target protein, VGAM2632 host target protein, VGAM2633 host target protein, VGAM2634 host target protein and VGAM2635 host target protein, herein schematically represented by VGAM1 HOST TARGET PROTEIN through VGAM3 HOST TARGET PROTEIN. The function of these host target genes is elaborated hereinabove with reference to VGAM2630, VGAM2631, VGAM2632, VGAM2633, VGAM2634 and VGAM2635. FIG. 9 further provides a conceptual description of novel bioinformatically detected regulatory viral gene, referred to here as Viral Genomic Record 3272(VGR3272) viral gene, which encodes an 'operon-like' cluster of novel viral micro RNA-like genes, each of which in turn modulates expression of at least one host target gene, the function and utility of which at least one host target gene is known in the art.

VGR3272 gene, herein designated VGR GENE, is a novel bioinformatically detected regulatory, non protein coding, RNA viral gene. The method by which VGR3272 gene was detected is described hereinabove with reference to FIGS. 1-9.

VGR3272 gene encodes VGR3272 precursor RNA, herein designated VGR PRECURSOR RNA, an RNA molecule, typically several hundred nucleotides long.

VGR3272 precursor RNA folds spatially, forming VGR3272 folded precursor RNA, herein designated VGR FOLDED PRECURSOR RNA. It is appreciated that VGR3272 folded precursor RNA comprises a plurality of what is known in the art as 'hairpin' structures. These 'hairpin' structures are due to the fact that the nucleotide sequence of VGR3272 precursor RNA comprises a plurality of segments, the first half of each such segment having a nucleotide sequence which is at least a partial inversed-reversed sequence of the second half thereof, as is well known in the art.

VGR3272 folded precursor RNA is naturally processed by cellular enzymatic activity into at least 2 separate VGAM precursor RNAs, VGAM2636 precursor RNA and VGAM2637 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2636 RNA and VGAM2637 RNA, herein schematically represented by VGAM1 RNA through VGAM3 RNA, each of which VGAM RNAs corresponding to VGAM RNA of FIG. 1.

VGAM2636 RNA, herein schematically represented by VGAM1 RNA through VGAM3 RNA, binds complementarily to a host target binding site located in an untranslated region of VGAM2636 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2636 host target RNA into VGAM2636 host target protein, herein schematically represented by VGAM1 HOST TARGET PROTEIN through VGAM3 HOST TARGET PROTEIN, all of FIG. 1.

VGAM2637 RNA, herein schematically represented by VGAM1 RNA through VGAM3 RNA, binds complementarily to a host target binding site located in an untranslated region of VGAM2637 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2637 host target RNA into VGAM2637 host target protein, herein schematically represented by VGAM1 HOST TARGET PROTEIN through VGAM3 HOST TARGET PROTEIN, all of FIG. 1.

It is appreciated that a function of VGR3272 gene, herein designated VGR GENE, is inhibition of expression of host target genes, as part of a novel viral mechanism of attacking a host. Accordingly, utilities of VGR3272 gene include diagnosis, prevention and treatment of viral infection by Sheeppox Virus. Specific functions, and accordingly utilities, of VGR3272 gene correlate with, and may be deduced from, the identity of the host target genes, which are inhibited by VGAM RNAs comprised in the 'operon-like' cluster of VGR3272 gene: VGAM2636 host target protein and VGAM2637 host target protein, herein schematically represented by VGAM1 HOST TARGET PROTEIN through VGAM3 HOST TARGET PROTEIN. The function of these host target genes is elaborated hereinabove with reference to VGAM2636 and VGAM2637. FIG. 9 further provides a conceptual description of novel bioinformatically detected regulatory viral gene, referred to here as Viral Genomic Record 3273(VGR3273) viral gene, which encodes an 'operon-like' cluster of novel viral micro RNA-like genes, each of which in turn modulates expression of at least one host target gene, the function and utility of which at least one host target gene is known in the art.

VGR3273 gene, herein designated VGR GENE, is a novel bioinformatically detected regulatory, non protein coding, RNA viral gene. The method by which VGR3273 gene was detected is described hereinabove with reference to FIGS. 1-9.

VGR3273 gene encodes VGR3273 precursor RNA, herein designated VGR PRECURSOR RNA, an RNA molecule, typically several hundred nucleotides long.

VGR3273 precursor RNA folds spatially, forming VGR3273 folded precursor RNA, herein designated VGR FOLDED PRECURSOR RNA. It is appreciated that VGR3273 folded precursor RNA comprises a plurality of what is known in the art as 'hairpin' structures. These 'hairpin' structures are due to the fact that the nucleotide sequence of VGR3273 precursor RNA comprises a plurality of segments, the first half of each such segment having a nucleotide sequence which is at least a partial inversed-reversed sequence of the second half thereof, as is well known in the art.

VGR3273 folded precursor RNA is naturally processed by cellular enzymatic activity into at least 5 separate VGAM precursor RNAs, VGAM2638 precursor RNA, VGAM2639 precursor RNA, VGAM2640 precursor RNA, VGAM2641 precursor RNA and VGAM2642 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2638 RNA, VGAM2639 RNA, VGAM2640 RNA, VGAM2641 RNA and VGAM2642 RNA, herein schematically represented by VGAM1 RNA through VGAM3 RNA, each of which VGAM RNAs corresponding to VGAM RNA of FIG. 1.

VGAM2638 RNA, herein schematically represented by VGAM1 RNA through VGAM3 RNA, binds complementarily to a host target binding site located in an untranslated region of VGAM2638 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2638 host target RNA into VGAM2638 host target protein, herein schematically represented by VGAM1 HOST TARGET PROTEIN through VGAM3 HOST TARGET PROTEIN, all of FIG. 1.

VGAM2639 RNA, herein schematically represented by VGAM1 RNA through VGAM3 RNA, binds complementarily to a host target binding site located in an untranslated region of VGAM2639 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2639 host target RNA into VGAM2639 host target protein, herein schematically represented by VGAM1 HOST TARGET PROTEIN through VGAM3 HOST TARGET PROTEIN, all of FIG. 1.

VGAM2640 RNA, herein schematically represented by VGAM1 RNA through VGAM3 RNA, binds complementarily to a host target binding site located in an untranslated region of VGAM2640 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2640 host target RNA into VGAM2640 host target protein, herein schematically represented by VGAM1 HOST TARGET PROTEIN through VGAM3 HOST TARGET PROTEIN, all of FIG. 1.

VGAM2641 RNA, herein schematically represented by VGAM1 RNA through VGAM3 RNA, binds complementarily to a host target binding site located in an untranslated region of VGAM2641 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2641 host target RNA into VGAM2641 host target protein, herein schematically represented by VGAM1 HOST TARGET PROTEIN through VGAM3 HOST TARGET PROTEIN, all of FIG. 1.

VGAM2642 RNA, herein schematically represented by VGAM1 RNA through VGAM3 RNA, binds complementarily to a host target binding site located in an untranslated region of VGAM2642 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2642 host target RNA into VGAM2642 host target protein, herein schematically represented by VGAM1 HOST TARGET PROTEIN through VGAM3 HOST TARGET PROTEIN, all of FIG. 1.

It is appreciated that a function of VGR3273 gene, herein designated VGR GENE, is inhibition of expression of host target genes, as part of a novel viral mechanism of attacking a host. Accordingly, utilities of VGR3273 gene include diagnosis, prevention and treatment of viral infection by Foot-and-mouth Disease Virus O. Specific functions, and accordingly utilities, of VGR3273 gene correlate with, and may be deduced from, the identity of the host target genes, which are inhibited by VGAM RNAs comprised in the 'operon-like' cluster of VGR3273 gene: VGAM2638 host target protein, VGAM2639 host target protein, VGAM2640 host target protein, VGAM2641 host target protein and VGAM2642 host target protein, herein schematically represented by VGAM1 HOST TARGET PROTEIN through VGAM3 HOST TARGET PROTEIN. The function of these host target genes is elaborated hereinabove with reference to VGAM2638, VGAM2639, VGAM2640, VGAM2641 and VGAM2642.

FIG. 9 further provides a conceptual description of novel bioinformatically detected regulatory viral gene, referred to here as Viral Genomic Record 3274(VGR3274) viral gene, which encodes an 'operon-like' cluster of novel viral micro RNA-like genes, each of which in turn modulates expression of at least one host target gene, the function and utility of which at least one host target gene is known in the art.

VGR3274 gene, herein designated VGR GENE, is a novel bioinformatically detected regulatory, non protein coding, RNA viral gene. The method by which VGR3274 gene was detected is described hereinabove with reference to FIGS. 1-9.

VGR3274 gene encodes VGR3274 precursor RNA, herein designated VGR PRECURSOR RNA, an RNA molecule, typically several hundred nucleotides long.

VGR3274 precursor RNA folds spatially, forming VGR3274 folded precursor RNA, herein designated VGR FOLDED PRECURSOR RNA. It is appreciated that VGR3274 folded precursor RNA comprises a plurality of what is known in the art as 'hairpin' structures. These 'hairpin' structures are due to the fact that the nucleotide sequence of VGR3274 precursor RNA comprises a plurality of segments, the first half of each such segment having a nucleotide sequence which is at least a partial inversed-reversed sequence of the second half thereof, as is well known in the art.

VGR3274 folded precursor RNA is naturally processed by cellular enzymatic activity into at least 7 separate VGAM precursor RNAs, VGAM2643 precursor RNA, VGAM2644 precursor RNA, VGAM2645 precursor RNA, VGAM2646 precursor RNA, VGAM2647 precursor RNA, VGAM2648 precursor RNA and VGAM2649 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2643 RNA, VGAM2644 RNA, VGAM2645 RNA, VGAM2646 RNA, VGAM2647 RNA, VGAM2648 RNA and VGAM2649 RNA, herein schematically represented by VGAM1 RNA through VGAM3 RNA, each of which VGAM RNAs corresponding to VGAM RNA of FIG. 1.

VGAM2643 RNA, herein schematically represented by VGAM1 RNA through VGAM3 RNA, binds complementarily to a host target binding site located in an untranslated region of VGAM2643 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2643 host target RNA into VGAM2643 host target protein, herein schematically represented by VGAM1 HOST TARGET PROTEIN through VGAM3 HOST TARGET PROTEIN, all of FIG. 1.

VGAM2644 RNA, herein schematically represented by VGAM1 RNA through VGAM3 RNA, binds complementarily to a host target binding site located in an untranslated region of VGAM2644 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2644 host target RNA into VGAM2644 host target protein, herein schematically represented by VGAM1 HOST TARGET PROTEIN through VGAM3 HOST TARGET PROTEIN, all of FIG. 1.

VGAM2645 RNA, herein schematically represented by VGAM1 RNA through VGAM3 RNA, binds complementarily to a host target binding site located in an untranslated region of VGAM2645 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2645 host target RNA into VGAM2645 host target protein, herein schematically represented by VGAM1 HOST TARGET PROTEIN through VGAM3 HOST TARGET PROTEIN, all of FIG. 1.

VGAM2646 RNA, herein schematically represented by VGAM1 RNA through VGAM3 RNA, binds complementarily to a host target binding site located in an untranslated region of VGAM2646 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2646 host target RNA into VGAM2646 host target protein, herein schematically represented by VGAM1 HOST TARGET PROTEIN through VGAM3 HOST TARGET PROTEIN, all of FIG. 1.

VGAM2647 RNA, herein schematically represented by VGAM1 RNA through VGAM3 RNA, binds complementarily to a host target binding site located in an untranslated region of VGAM2647 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2647 host target RNA into VGAM2647 host target protein, herein schematically represented by VGAM1 HOST TARGET PROTEIN through VGAM3 HOST TARGET PROTEIN, all of FIG. 1.

VGAM2648 RNA, herein schematically represented by VGAM1 RNA through VGAM3 RNA, binds complementarily to a host target binding site located in an untranslated region of VGAM2648 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2648 host target RNA into VGAM2648 host target protein, herein schematically represented by VGAM1 HOST TARGET PROTEIN through VGAM3 HOST TARGET PROTEIN, all of FIG. 1.

VGAM2649 RNA, herein schematically represented by VGAM1 RNA through VGAM3 RNA, binds complementarily to a host target binding site located in an untranslated region of VGAM2649 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2649 host target RNA into VGAM2649 host target protein, herein schematically represented by VGAM1 HOST TARGET PROTEIN through VGAM3 HOST TARGET PROTEIN, all of FIG. 1.

It is appreciated that a function of VGR3274 gene, herein designated VGR GENE, is inhibition of expression of host target genes, as part of a novel viral mechanism of attacking a host. Accordingly, utilities of VGR3274 gene include diagnosis, prevention and treatment of viral infection by Cowpea Aphid-borne Mosaic Virus. Specific functions, and accordingly utilities, of VGR3274 gene correlate with, and may be deduced from, the identity of the host target genes, which are inhibited by VGAM RNAs comprised in the 'operon-like' cluster of VGR3274 gene: VGAM2643 host target protein, VGAM2644 host target protein, VGAM2645 host target protein, VGAM2646 host target protein, VGAM2647 host target protein, VGAM2648 host target protein and VGAM2649 host target protein, herein schematically represented by VGAM1 HOST TARGET PROTEIN through VGAM3 HOST TARGET PROTEIN. The function of these host target genes is elaborated hereinabove with reference to VGAM2643, VGAM2644, VGAM2645, VGAM2646, VGAM2647, VGAM2648 and VGAM2649. FIG. 9 further provides a conceptual description of novel bioinformatically detected regulatory viral gene, referred to here as Viral Genomic Record 3275(VGR3275) viral gene, which encodes an 'operon-like' cluster of novel viral micro RNA-like genes, each of which in turn modulates expression of at least one host target gene, the function and utility of which at least one host target gene is known in the art.

VGR3275 gene, herein designated VGR GENE, is a novel bioinformatically detected regulatory, non protein coding, RNA viral gene. The method by which VGR3275 gene was detected is described hereinabove with reference to FIGS. 1-9.

VGR3275 gene encodes VGR3275 precursor RNA, herein designated VGR PRECURSOR RNA, an RNA molecule, typically several hundred nucleotides long.

VGR3275 precursor RNA folds spatially, forming VGR3275 folded precursor RNA, herein designated VGR FOLDED PRECURSOR RNA. It is appreciated that VGR3275 folded precursor RNA comprises a plurality of what is known in the art as 'hairpin' structures. These 'hairpin' structures are due to the fact that the nucleotide sequence of VGR3275 precursor RNA comprises a plurality of segments, the first half of each such segment having a nucleotide sequence which is at least a partial inversed-reversed sequence of the second half thereof, as is well known in the art.

VGR3275 folded precursor RNA is naturally processed by cellular enzymatic activity into at least 2 separate VGAM precursor RNAs, VGAM2650 precursor RNA and VGAM2651 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2650 RNA and VGAM2651 RNA, herein schematically represented by VGAM1 RNA through VGAM3 RNA, each of which VGAM RNAs corresponding to VGAM RNA of FIG. 1.

VGAM2650 RNA, herein schematically represented by VGAM1 RNA through VGAM3 RNA, binds complementarily to a host target binding site located in an untranslated region of VGAM2650 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2650 host target RNA into VGAM2650 host target protein, herein schematically represented by VGAM1 HOST TARGET PROTEIN through VGAM3 HOST TARGET PROTEIN, all of FIG. 1.

VGAM2651 RNA, herein schematically represented by VGAM1 RNA through VGAM3 RNA, binds complementarily to a host target binding site located in an untranslated region of VGAM2651 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2651 host target RNA into VGAM2651 host target protein, herein schematically represented by VGAM1 HOST TARGET PROTEIN through VGAM3 HOST TARGET PROTEIN, all of FIG. 1.

It is appreciated that a function of VGR3275 gene, herein designated VGR GENE, is inhibition of expression of host target genes, as part of a novel viral mechanism of attacking a host. Accordingly, utilities of VGR3275 gene include diagnosis, prevention and treatment of viral infection by Trichomonas Vaginalis Virus 3. Specific functions, and accordingly utilities, of VGR3275 gene correlate with, and may be deduced from, the identity of the host target genes, which are inhibited by VGAM RNAs comprised in the 'operon-like' cluster of VGR3275 gene: VGAM2650 host target protein and VGAM2651 host target protein, herein schematically represented by VGAM1 HOST TARGET PROTEIN through VGAM3 HOST TARGET PROTEIN. The function of these host target genes is elaborated hereinabove with reference to VGAM2650 and VGAM2651. FIG. 9 further provides a conceptual description of novel bioinformatically detected regulatory viral gene, referred to here as Viral Genomic Record 3276(VGR3276) viral gene, which encodes an 'operon-like' cluster of novel viral micro RNA-like genes, each of which in turn modulates expression of at least one host target gene, the function and utility of which at least one host target gene is known in the art.

VGR3276 gene, herein designated VGR GENE, is a novel bioinformatically detected regulatory, non protein coding, RNA viral gene. The method by which VGR3276 gene was detected is described hereinabove with reference to FIGS. 1-9.

VGR3276 gene encodes VGR3276 precursor RNA, herein designated VGR PRECURSOR RNA, an RNA molecule, typically several hundred nucleotides long.

VGR3276 precursor RNA folds spatially, forming VGR3276 folded precursor RNA, herein designated VGR FOLDED PRECURSOR RNA. It is appreciated that VGR3276 folded precursor RNA comprises a plurality of what is known in the art as 'hairpin' structures. These 'hairpin' structures are due to the fact that the nucleotide sequence of VGR3276 precursor RNA comprises a plurality of segments, the first half of each such segment having a nucleotide sequence which is at least a partial inversed-reversed sequence of the second half thereof, as is well known in the art.

VGR3276 folded precursor RNA is naturally processed by cellular enzymatic activity into at least 4 separate VGAM precursor RNAs, VGAM2652 precursor RNA, VGAM2653 precursor RNA, VGAM2654 precursor RNA and VGAM2655 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2652 RNA, VGAM2653 RNA, VGAM2654 RNA and VGAM2655 RNA, herein schematically represented by VGAM1 RNA through VGAM3 RNA, each of which VGAM RNAs corresponding to VGAM RNA of FIG. 1.

VGAM2652 RNA, herein schematically represented by VGAM1 RNA through VGAM3 RNA, binds complementarily to a host target binding site located in an untranslated region of VGAM2652 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2652 host target RNA into VGAM2652 host target protein, herein schematically represented by VGAM1 HOST TARGET PROTEIN through VGAM3 HOST TARGET PROTEIN, all of FIG. 1.

VGAM2653 RNA, herein schematically represented by VGAM1 RNA through VGAM3 RNA, binds complementarily to a host target binding site located in an untranslated region of VGAM2653 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2653 host target RNA into VGAM2653 host target protein, herein schematically represented by VGAM1 HOST TARGET PROTEIN through VGAM3 HOST TARGET PROTEIN, all of FIG. 1.

VGAM2654 RNA, herein schematically represented by VGAM1 RNA through VGAM3 RNA, binds complementarily to a host target binding site located in an untranslated region of VGAM2654 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2654 host target RNA into VGAM2654 host target protein, herein schematically represented by VGAM1 HOST TARGET PROTEIN through VGAM3 HOST TARGET PROTEIN, all of FIG. 1.

VGAM2655 RNA, herein schematically represented by VGAM1 RNA through VGAM3 RNA, binds complementarily to a host target binding site located in an untranslated region of VGAM2655 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2655 host target RNA into VGAM2655 host target protein, herein schematically represented by VGAM1 HOST TARGET PROTEIN through VGAM3 HOST TARGET PROTEIN, all of FIG. 1.

It is appreciated that a function of VGR3276 gene, herein designated VGR GENE, is inhibition of expression of host target genes, as part of a novel viral mechanism of attacking a host. Accordingly, utilities of VGR3276 gene include diagnosis, prevention and treatment of viral infection by Sorghum Mosaic Virus. Specific functions, and accordingly utilities, of VGR3276 gene correlate with, and may be deduced from, the identity of the host target genes, which are inhibited by VGAM RNAs comprised in the 'operon-like' cluster of VGR3276 gene: VGAM2652 host target protein, VGAM2653 host target protein, VGAM2654 host target protein and VGAM2655 host target protein, herein schematically represented by VGAM1 HOST TARGET PROTEIN through VGAM3 HOST TARGET PROTEIN. The function of these host target genes is elaborated hereinabove with reference to VGAM2652, VGAM2653, VGAM2654 and VGAM2655. FIG. 9 further provides a conceptual description of novel bioinformatically detected regulatory viral gene, referred to here as Viral Genomic Record 3277(VGR3277) viral gene, which encodes an 'operon-like' cluster of novel viral micro RNA-like genes, each of which in turn modulates expression of at least one host target gene, the function and utility of which at least one host target gene is known in the art.

VGR3277 gene, herein designated VGR GENE, is a novel bioinformatically detected regulatory, non protein coding, RNA viral gene. The method by which VGR3277 gene was detected is described hereinabove with reference to FIGS. 1-9.

VGR3277 gene encodes VGR3277 precursor RNA, herein designated VGR PRECURSOR RNA, an RNA molecule, typically several hundred nucleotides long.

VGR3277 precursor RNA folds spatially, forming VGR3277 folded precursor RNA, herein designated VGR FOLDED PRECURSOR RNA. It is appreciated that VGR3277 folded precursor RNA comprises a plurality of what is known in the art as 'hairpin' structures. These 'hairpin' structures are due to the fact that the nucleotide sequence of VGR3277 precursor RNA comprises a plurality of segments, the first half of each such segment having a nucleotide sequence which is at least a partial inversed-reversed sequence of the second half thereof, as is well known in the art.

VGR3277 folded precursor RNA is naturally processed by cellular enzymatic activity into at least 8 separate VGAM precursor RNAs, VGAM2656 precursor RNA, VGAM2657 precursor RNA, VGAM2658 precursor RNA, VGAM2659 precursor RNA, VGAM2660 precursor RNA, VGAM2661 precursor RNA, VGAM2662 precursor RNA and VGAM2663 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2656 RNA, VGAM2657 RNA, VGAM2658 RNA, VGAM2659 RNA, VGAM2660 RNA, VGAM2661 RNA, VGAM2662 RNA and VGAM2663 RNA, herein schematically represented by VGAM1 RNA through VGAM3 RNA, each of which VGAM RNAs corresponding to VGAM RNA of FIG. 1.

VGAM2656 RNA, herein schematically represented by VGAM1 RNA through VGAM3 RNA, binds complementarily to a host target binding site located in an untranslated region of VGAM2656 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2656 host target RNA into VGAM2656 host target protein, herein schematically represented by VGAM1 HOST TARGET PROTEIN through VGAM3 HOST TARGET PROTEIN, all of FIG. 1.

VGAM2657 RNA, herein schematically represented by VGAM1 RNA through VGAM3 RNA, binds complementarily to a host target binding site located in an untranslated region of VGAM2657 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2657 host target RNA into VGAM2657 host target protein, herein schematically represented by VGAM1 HOST TARGET PROTEIN through VGAM3 HOST TARGET PROTEIN, all of FIG. 1.

VGAM2658 RNA, herein schematically represented by VGAM1 RNA through VGAM3 RNA, binds complementarily to a host target binding site located in an untranslated region of VGAM2658 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2658 host target RNA into VGAM2658 host target protein, herein schematically represented by VGAM1 HOST TARGET PROTEIN through VGAM3 HOST TARGET PROTEIN, all of FIG. 1.

VGAM2659 RNA, herein schematically represented by VGAM1 RNA through VGAM3 RNA, binds complementarily to a host target binding site located in an untranslated region of VGAM2659 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2659 host target RNA into VGAM2659 host target protein, herein schematically represented by VGAM1 HOST TARGET PROTEIN through VGAM3 HOST TARGET PROTEIN, all of FIG. 1.

VGAM2660 RNA, herein schematically represented by VGAM1 RNA through VGAM3 RNA, binds complementarily to a host target binding site located in an untranslated region of VGAM2660 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2660 host target RNA into VGAM2660 host target protein, herein schematically represented by VGAM1 HOST TARGET PROTEIN through VGAM3 HOST TARGET PROTEIN, all of FIG. 1.

VGAM2661 RNA, herein schematically represented by VGAM1 RNA through VGAM3 RNA, binds complementarily to a host target binding site located in an untranslated region of VGAM2661 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2661 host target RNA into VGAM2661 host target protein, herein schematically represented by VGAM1 HOST TARGET PROTEIN through VGAM3 HOST TARGET PROTEIN, all of FIG. 1.

VGAM2662 RNA, herein schematically represented by VGAM1 RNA through VGAM3 RNA, binds complementarily to a host target binding site located in an untranslated region of VGAM2662 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2662 host target RNA into VGAM2662 host target protein, herein schematically represented by VGAM1 HOST TARGET PROTEIN through VGAM3 HOST TARGET PROTEIN, all of FIG. 1.

VGAM2663 RNA, herein schematically represented by VGAM1 RNA through VGAM3 RNA, binds complementarily to a host target binding site located in an untranslated region of VGAM2663 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2663 host target RNA into VGAM2663 host target protein, herein schematically represented by VGAM1 HOST TARGET PROTEIN through VGAM3 HOST TARGET PROTEIN, all of FIG. 1.

It is appreciated that a function of VGR3277 gene, herein designated VGR GENE, is inhibition of expression of host target genes, as part of a novel viral mechanism of attacking a host. Accordingly, utilities of VGR3277 gene include diagnosis, prevention and treatment of viral infection by Potato Virus A. Specific functions, and accordingly utilities, of VGR3277 gene correlate with, and may be deduced from, the identity of the host target genes, which are inhibited by VGAM RNAs comprised in the 'operon-like' cluster of VGR3277 gene: VGAM2656 host target protein, VGAM2657 host target protein, VGAM2658 host target protein, VGAM2659 host target protein, VGAM2660 host target protein, VGAM2661 host target protein, VGAM2662 host target protein and VGAM2663 host target protein, herein schematically represented by VGAM1 HOST TARGET PROTEIN through VGAM3 HOST TARGET PROTEIN. The function of these host target genes is elaborated hereinabove with reference to VGAM2656, VGAM2657, VGAM2658, VGAM2659, VGAM2660, VGAM2661, VGAM2662 and VGAM2663. FIG. 9 further provides a conceptual description of novel bioinformatically detected regulatory viral gene, referred to here as Viral Genomic Record 3278(VGR3278) viral gene, which encodes an 'operon-like' cluster of novel viral micro RNA-like genes, each of which in turn modulates expression of at least one host target gene, the function and utility of which at least one host target gene is known in the art.

VGR3278 gene, herein designated VGR GENE, is a novel bioinformatically detected regulatory, non protein coding, RNA viral gene. The method by which VGR3278 gene was detected is described hereinabove with reference to FIGS. 1-9.

VGR3278 gene encodes VGR3278 precursor RNA, herein designated VGR PRECURSOR RNA, an RNA molecule, typically several hundred nucleotides long.

VGR3278 precursor RNA folds spatially, forming VGR3278 folded precursor RNA, herein designated VGR FOLDED PRECURSOR RNA. It is appreciated that VGR3278 folded precursor RNA comprises a plurality of what is known in the art as 'hairpin' structures. These 'hairpin' structures are due to the fact that the nucleotide sequence of VGR3278 precursor RNA comprises a plurality of segments, the first half of each such segment having a nucleotide sequence which is at least a partial inversed-reversed sequence of the second half thereof, as is well known in the art.

VGR3278 folded precursor RNA is naturally processed by cellular enzymatic activity into at least 3 separate VGAM precursor RNAs, VGAM2664 precursor RNA, VGAM2665 precursor RNA and VGAM2666 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2664 RNA, VGAM2665 RNA and VGAM2666 RNA, herein schematically represented by VGAM1 RNA through VGAM3 RNA, each of which VGAM RNAs corresponding to VGAM RNA of FIG. 1.

VGAM2664 RNA, herein schematically represented by VGAM1 RNA through VGAM3 RNA, binds complementarily to a host target binding site located in an untranslated region of VGAM2664 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2664 host target RNA into VGAM2664 host target protein, herein schematically represented by VGAM1 HOST TARGET PROTEIN through VGAM3 HOST TARGET PROTEIN, all of FIG. 1.

VGAM2665 RNA, herein schematically represented by VGAM1 RNA through VGAM3 RNA, binds complementarily to a host target binding site located in an untranslated region of VGAM2665 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2665 host target RNA into VGAM2665 host target protein, herein schematically represented by VGAM1 HOST TARGET PROTEIN through VGAM3 HOST TARGET PROTEIN, all of FIG. 1.

VGAM2666 RNA, herein schematically represented by VGAM1 RNA through VGAM3 RNA, binds complementarily to a host target binding site located in an untranslated region of VGAM2666 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2666 host target RNA into VGAM2666 host target protein, herein schematically represented by VGAM1 HOST TARGET PROTEIN through VGAM3 HOST TARGET PROTEIN, all of FIG. 1.

It is appreciated that a function of VGR3278 gene, herein designated VGR GENE, is inhibition of expression of host target genes, as part of a novel viral mechanism of attacking a host. Accordingly, utilities of VGR3278 gene include diagnosis, prevention and treatment of viral infection by Cryphonectria Parasitica Mitovirus 1-NB631. Specific functions, and accordingly utilities, of VGR3278 gene correlate with, and may be deduced from, the identity of the host target genes, which are inhibited by VGAM RNAs comprised in the 'operon-like' cluster of VGR3278 gene: VGAM2664 host target protein, VGAM2665 host target protein and VGAM2666 host target protein, herein schematically represented by VGAM1 HOST TARGET PROTEIN through VGAM3 HOST TARGET PROTEIN. The function of these host target genes is elaborated hereinabove with reference to VGAM2664, VGAM2665 and VGAM2666. FIG. 9 further provides a conceptual description of novel bioinformatically detected regulatory viral gene, referred to here as Viral Genomic Record 3279(VGR3279) viral gene, which encodes an 'operon-like' cluster of novel viral micro RNA-like genes, each of which in turn modulates expression of at least one host target gene, the function and utility of which at least one host target gene is known in the art.

VGR3279 gene, herein designated VGR GENE, is a novel bioinformatically detected regulatory, non protein coding, RNA viral gene. The method by which VGR3279 gene was detected is described hereinabove with reference to FIGS. 1-9.

VGR3279 gene encodes VGR3279 precursor RNA, herein designated VGR PRECURSOR RNA, an RNA molecule, typically several hundred nucleotides long.

VGR3279 precursor RNA folds spatially, forming VGR3279 folded precursor RNA, herein designated VGR FOLDED PRECURSOR RNA. It is appreciated that VGR3279 folded precursor RNA comprises a plurality of what is known in the art as 'hairpin' structures. These 'hairpin' structures are due to the fact that the nucleotide sequence of VGR3279 precursor RNA comprises a plurality of segments, the first half of each such segment having a nucleotide sequence which is at least a partial inversed-reversed sequence of the second half thereof, as is well known in the art.

VGR3279 folded precursor RNA is naturally processed by cellular enzymatic activity into at least 4 separate VGAM precursor RNAs, VGAM2667 precursor RNA, VGAM2668 precursor RNA, VGAM2669 precursor RNA and VGAM2670 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2667 RNA, VGAM2668 RNA, VGAM2669 RNA and VGAM2670 RNA, herein schematically represented by VGAM1 RNA through VGAM3 RNA, each of which VGAM RNAs corresponding to VGAM RNA of FIG. 1.

VGAM2667 RNA, herein schematically represented by VGAM1 RNA through VGAM3 RNA, binds complementarily to a host target binding site located in an untranslated region of VGAM2667 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2667 host target RNA into VGAM2667 host target protein, herein schematically represented by VGAM1 HOST TARGET PROTEIN through VGAM3 HOST TARGET PROTEIN, all of FIG. 1.

VGAM2668 RNA, herein schematically represented by VGAM1 RNA through VGAM3 RNA, binds complementarily to a host target binding site located in an untranslated region of VGAM2668 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2668 host target RNA into VGAM2668 host target protein, herein schematically represented by VGAM1 HOST TARGET PROTEIN through VGAM3 HOST TARGET PROTEIN, all of FIG. 1.

VGAM2669 RNA, herein schematically represented by VGAM1 RNA through VGAM3 RNA, binds complementarily to a host target binding site located in an untranslated region of VGAM2669 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2669 host target RNA into VGAM2669 host target protein, herein schematically represented by VGAM1 HOST TARGET PROTEIN through VGAM3 HOST TARGET PROTEIN, all of FIG. 1.

VGAM2670 RNA, herein schematically represented by VGAM1 RNA through VGAM3 RNA, binds complementarily to a host target binding site located in an untranslated region of VGAM2670 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2670 host target RNA into VGAM2670 host target protein, herein schematically represented by VGAM1 HOST TARGET PROTEIN through VGAM3 HOST TARGET PROTEIN, all of FIG. 1.

It is appreciated that a function of VGR3279 gene, herein designated VGR GENE, is inhibition of expression of host target genes, as part of a novel viral mechanism of attacking a host. Accordingly, utilities of VGR3279 gene include diagnosis, prevention and treatment of viral infection by Bean Common Mosaic Necrosis Virus. Specific functions, and accordingly utilities, of VGR3279 gene correlate with, and may be deduced from, the identity of the host target genes, which are inhibited by VGAM RNAs comprised in the 'operon-like' cluster of VGR3279 gene: VGAM2667 host target protein, VGAM2668 host target protein, VGAM2669 host target protein and VGAM2670 host target protein, herein schematically represented by VGAM1 HOST TARGET PROTEIN through VGAM3 HOST TARGET PROTEIN. The function of these host target genes is elaborated hereinabove with reference to VGAM2667, VGAM2668, VGAM2669 and VGAM2670. FIG. 9 further provides a conceptual description of novel bioinformatically detected regulatory viral gene, referred to here as Viral Genomic Record 3280(VGR3280) viral gene, which encodes an 'operon-like' cluster of novel viral micro RNA-like genes, each of which in turn modulates expression of at least one host target gene, the function and utility of which at least one host target gene is known in the art.

VGR3280 gene, herein designated VGR GENE, is a novel bioinformatically detected regulatory, non protein coding, RNA viral gene. The method by which VGR3280 gene was detected is described hereinabove with reference to FIGS. 1-9.

VGR3280 gene encodes VGR3280 precursor RNA, herein designated VGR PRECURSOR RNA, an RNA molecule, typically several hundred nucleotides long.

VGR3280 precursor RNA folds spatially, forming VGR3280 folded precursor RNA, herein designated VGR FOLDED PRECURSOR RNA. It is appreciated that VGR3280 folded precursor RNA comprises a plurality of what is known in the art as 'hairpin' structures. These 'hairpin' structures are due to the fact that the nucleotide sequence of VGR3280 precursor RNA comprises a plurality of segments, the first half of each such segment having a nucleotide sequence which is at least a partial inversed-reversed sequence of the second half thereof, as is well known in the art.

VGR3280 folded precursor RNA is naturally processed by cellular enzymatic activity into at least 7 separate VGAM precursor RNAs, VGAM2671 precursor RNA, VGAM2672 precursor RNA, VGAM2673 precursor RNA, VGAM2674 precursor RNA, VGAM2675 precursor RNA, VGAM2676 precursor RNA and VGAM2677 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2671 RNA, VGAM2672 RNA, VGAM2673 RNA, VGAM2674 RNA, VGAM2675 RNA, VGAM2676 RNA and VGAM2677 RNA, herein schematically represented by VGAM1 RNA through VGAM3 RNA, each of which VGAM RNAs corresponding to VGAM RNA of FIG. 1.

VGAM2671 RNA, herein schematically represented by VGAM1 RNA through VGAM3 RNA, binds complementarily to a host target binding site located in an untranslated region of VGAM2671 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2671 host target RNA into VGAM2671 host target protein, herein schematically represented by VGAM1 HOST TARGET PROTEIN through VGAM3 HOST TARGET PROTEIN, all of FIG. 1.

VGAM2672 RNA, herein schematically represented by VGAM1 RNA through VGAM3 RNA, binds complementarily to a host target binding site located in an untranslated region of VGAM2672 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2672 host target RNA into VGAM2672 host target protein, herein schematically represented by VGAM1 HOST TARGET PROTEIN through VGAM3 HOST TARGET PROTEIN, all of FIG. 1.

VGAM2673 RNA, herein schematically represented by VGAM1 RNA through VGAM3 RNA, binds complementarily to a host target binding site located in an untranslated region of VGAM2673 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2673 host target RNA into VGAM2673 host target protein, herein schematically represented by VGAM1 HOST TARGET PROTEIN through VGAM3 HOST TARGET PROTEIN, all of FIG. 1.

VGAM2674 RNA, herein schematically represented by VGAM1 RNA through VGAM3 RNA, binds complementarily to a host target binding site located in an untranslated region of VGAM2674 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2674 host target RNA into VGAM2674 host target protein, herein schematically represented by VGAM1 HOST TARGET PROTEIN through VGAM3 HOST TARGET PROTEIN, all of FIG. 1.

VGAM2675 RNA, herein schematically represented by VGAM1 RNA through VGAM3 RNA, binds complementarily to a host target binding site located in an untranslated region of VGAM2675 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2675 host target RNA into VGAM2675 host target protein, herein schematically represented by VGAM1 HOST TARGET PROTEIN through VGAM3 HOST TARGET PROTEIN, all of FIG. 1.

VGAM2676 RNA, herein schematically represented by VGAM1 RNA through VGAM3 RNA, binds complementarily to a host target binding site located in an untranslated region of VGAM2676 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2676 host target RNA into VGAM2676 host target protein, herein schematically represented by VGAM1 HOST TARGET PROTEIN through VGAM3 HOST TARGET PROTEIN, all of FIG. 1.

VGAM2677 RNA, herein schematically represented by VGAM1 RNA through VGAM3 RNA, binds complementarily to a host target binding site located in an untranslated region of VGAM2677 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2677 host target RNA into VGAM2677 host target protein, herein schematically represented by VGAM1 HOST TARGET PROTEIN through VGAM3 HOST TARGET PROTEIN, all of FIG. 1.

It is appreciated that a function of VGR3280 gene, herein designated VGR GENE, is inhibition of expression of host target genes, as part of a novel viral mechanism of attacking a host. Accordingly, utilities of VGR3280 gene include diagnosis, prevention and treatment of viral infection by Ophiostoma Mitovirus 3a. Specific functions, and accordingly utilities, of VGR3280 gene correlate with, and may be deduced from, the identity of the host target genes, which are inhibited by VGAM RNAs comprised in the 'operon-like' cluster of VGR3280 gene: VGAM2671 host target protein, VGAM2672 host target protein, VGAM2673 host target protein, VGAM2674 host target protein, VGAM2675 host target protein, VGAM2676 host target protein and VGAM2677 host target protein, herein schematically represented by VGAM1 HOST TARGET PROTEIN through VGAM3 HOST TARGET PROTEIN. The function of these host target genes is elaborated hereinabove with reference to VGAM2671, VGAM2672, VGAM2673, VGAM2674, VGAM2675, VGAM2676 and VGAM2677. FIG. 9 further provides a conceptual description of novel bioinformatically detected regulatory viral gene, referred to here as Viral Genomic Record 3281(VGR3281) viral gene, which encodes an 'operon-like' cluster of novel viral micro RNA-like genes, each of which in turn modulates expression of at least one host target gene, the function and utility of which at least one host target gene is known in the art.

VGR3281 gene, herein designated VGR GENE, is a novel bioinformatically detected regulatory, non protein coding, RNA viral gene. The method by which VGR3281 gene was detected is described hereinabove with reference to FIGS. 1-9.

VGR3281 gene encodes VGR3281 precursor RNA, herein designated VGR PRECURSOR RNA, an RNA molecule, typically several hundred nucleotides long.

VGR3281 precursor RNA folds spatially, forming VGR3281 folded precursor RNA, herein designated VGR FOLDED PRECURSOR RNA. It is appreciated that VGR3281 folded precursor RNA comprises a plurality of what is known in the art as 'hairpin' structures. These 'hairpin' structures are due to the fact that the nucleotide sequence of VGR3281 precursor RNA comprises a plurality of segments, the first half of each such segment having a nucleotide sequence which is at least a partial inversed-reversed sequence of the second half thereof, as is well known in the art.

VGR3281 folded precursor RNA is naturally processed by cellular enzymatic activity into at least 6 separate VGAM precursor RNAs, VGAM2678 precursor RNA, VGAM2679 precursor RNA, VGAM2680 precursor RNA, VGAM2681 precursor RNA, VGAM2682 precursor RNA and VGAM2683 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2678 RNA, VGAM2679 RNA, VGAM2680 RNA, VGAM2681 RNA, VGAM2682 RNA and VGAM2683 RNA, herein schematically represented by VGAM1 RNA through VGAM3 RNA, each of which VGAM RNAs corresponding to VGAM RNA of FIG. 1.

VGAM2678 RNA, herein schematically represented by VGAM1 RNA through VGAM3 RNA, binds complementarily to a host target binding site located in an untranslated region of VGAM2678 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2678 host target RNA into VGAM2678 host target protein, herein schematically represented by VGAM1 HOST TARGET PROTEIN through VGAM3 HOST TARGET PROTEIN, all of FIG. 1.

VGAM2679 RNA, herein schematically represented by VGAM1 RNA through VGAM3 RNA, binds complementarily to a host target binding site located in an untranslated region of VGAM2679 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2679 host target RNA into VGAM2679 host target protein, herein schematically represented by VGAM1 HOST TARGET PROTEIN through VGAM3 HOST TARGET PROTEIN, all of FIG. 1.

VGAM2680 RNA, herein schematically represented by VGAM1 RNA through VGAM3 RNA, binds complementarily to a host target binding site located in an untranslated region of VGAM2680 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2680 host target RNA into VGAM2680 host target protein, herein schematically represented by VGAM1 HOST TARGET PROTEIN through VGAM3 HOST TARGET PROTEIN, all of FIG. 1.

VGAM2681 RNA, herein schematically represented by VGAM1 RNA through VGAM3 RNA, binds complementarily to a host target binding site located in an untranslated region of VGAM2681 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2681 host target RNA into VGAM2681 host target protein, herein schematically represented by VGAM1 HOST TARGET PROTEIN through VGAM3 HOST TARGET PROTEIN, all of FIG. 1.

VGAM2682 RNA, herein schematically represented by VGAM1 RNA through VGAM3 RNA, binds complementarily to a host target binding site located in an untranslated region of VGAM2682 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2682 host target RNA into VGAM2682 host target protein, herein schematically represented by VGAM1 HOST TARGET PROTEIN through VGAM3 HOST TARGET PROTEIN, all of FIG. 1.

VGAM2683 RNA, herein schematically represented by VGAM1 RNA through VGAM3 RNA, binds complementarily to a host target binding site located in an untranslated region of VGAM2683 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2683 host target RNA into VGAM2683 host target protein, herein schematically represented by VGAM1 HOST TARGET PROTEIN through VGAM3 HOST TARGET PROTEIN, all of FIG. 1.

It is appreciated that a function of VGR3281 gene, herein designated VGR GENE, is inhibition of expression of host target genes, as part of a novel viral mechanism of attacking a host. Accordingly, utilities of VGR3281 gene include diagnosis, prevention and treatment of viral infection by Ophiostoma Novo-ulmi Mitovirus 4-Ld. Specific functions, and accordingly utilities, of VGR3281 gene correlate with, and may be deduced from, the identity of the host target genes, which are inhibited by VGAM RNAs comprised in the 'operon-like' cluster of VGR3281 gene: VGAM2678 host target protein, VGAM2679 host target protein, VGAM2680 host target protein, VGAM2681 host target protein, VGAM2682 host target protein and VGAM2683 host target protein, herein schematically represented by VGAM1 HOST TARGET PROTEIN through VGAM3 HOST TARGET PROTEIN. The function of these host target genes is elaborated hereinabove with reference to VGAM2678, VGAM2679, VGAM2680, VGAM2681, VGAM2682 and VGAM2683. FIG. 9 further provides a conceptual description of novel bioinformatically detected regulatory viral gene, referred to here as Viral Genomic Record 3282(VGR3282) viral gene, which encodes an 'operon-like' cluster of novel viral micro RNA-like genes, each of which in turn modulates expression of at least one host target gene, the function and utility of which at least one host target gene is known in the art.

VGR3282 gene, herein designated VGR GENE, is a novel bioinformatically detected regulatory, non protein coding, RNA viral gene. The method by which VGR3282 gene was detected is described hereinabove with reference to FIGS. 1-9.

VGR3282 gene encodes VGR3282 precursor RNA, herein designated VGR PRECURSOR RNA, an RNA molecule, typically several hundred nucleotides long.

VGR3282 precursor RNA folds spatially, forming VGR3282 folded precursor RNA, herein designated VGR FOLDED PRECURSOR RNA. It is appreciated that VGR3282 folded precursor RNA comprises a plurality of what is known in the art as 'hairpin' structures. These 'hairpin' structures are due to the fact that the nucleotide sequence of VGR3282 precursor RNA comprises a plurality of segments, the first half of each such segment having a nucleotide sequence which is at least a partial inversed-reversed sequence of the second half thereof, as is well known in the art.

VGR3282 folded precursor RNA is naturally processed by cellular enzymatic activity into at least 3 separate VGAM precursor RNAs, VGAM2684 precursor RNA, VGAM2685 precursor RNA and VGAM2686 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2684 RNA, VGAM2685 RNA and VGAM2686 RNA, herein schematically represented by VGAM1 RNA through VGAM3 RNA, each of which VGAM RNAs corresponding to VGAM RNA of FIG. 1.

VGAM2684 RNA, herein schematically represented by VGAM1 RNA through VGAM3 RNA, binds complementarily to a host target binding site located in an untranslated region of VGAM2684 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2684 host target RNA into VGAM2684 host target protein, herein schematically represented by VGAM1 HOST TARGET PROTEIN through VGAM3 HOST TARGET PROTEIN, all of FIG. 1.

VGAM2685 RNA, herein schematically represented by VGAM1 RNA through VGAM3 RNA, binds complementarily to a host target binding site located in an untranslated region of VGAM2685 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2685 host target RNA into VGAM2685 host target protein, herein schematically represented by VGAM1 HOST TARGET PROTEIN through VGAM3 HOST TARGET PROTEIN, all of FIG. 1.

VGAM2686 RNA, herein schematically represented by VGAM1 RNA through VGAM3 RNA, binds complementarily to a host target binding site located in an untranslated region of VGAM2686 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2686 host target RNA into VGAM2686 host target protein, herein schematically represented by VGAM1 HOST TARGET PROTEIN through VGAM3 HOST TARGET PROTEIN, all of FIG. 1.

It is appreciated that a function of VGR3282 gene, herein designated VGR GENE, is inhibition of expression of host target genes, as part of a novel viral mechanism of attacking a host. Accordingly, utilities of VGR3282 gene include diagnosis, prevention and treatment of viral infection by Ophiostoma Novo-ulmi Mitovirus 5-Ld. Specific functions, and accordingly utilities, of VGR3282 gene correlate with, and may be deduced from, the identity of the host target genes, which are inhibited by VGAM RNAs comprised in the 'operon-like' cluster of VGR3282 gene: VGAM2684 host target protein, VGAM2685 host target protein and VGAM2686 host target protein, herein schematically represented by VGAM1 HOST TARGET PROTEIN through VGAM3 HOST TARGET PROTEIN. The function of these host target genes is elaborated hereinabove with reference to VGAM2684, VGAM2685 and VGAM2686. FIG. 9 further provides a conceptual description of novel bioinformatically detected regulatory viral gene, referred to here as Viral Genomic Record 3283(VGR3283) viral gene, which encodes an 'operon-like' cluster of novel viral micro RNA-like genes, each of which in turn modulates expression of at least one host target gene, the function and utility of which at least one host target gene is known in the art.

VGR3283 gene, herein designated VGR GENE, is a novel bioinformatically detected regulatory, non protein coding, RNA viral gene. The method by which VGR3283 gene was detected is described hereinabove with reference to FIGS. 1-9.

VGR3283 gene encodes VGR3283 precursor RNA, herein designated VGR PRECURSOR RNA, an RNA molecule, typically several hundred nucleotides long.

VGR3283 precursor RNA folds spatially, forming VGR3283 folded precursor RNA, herein designated VGR FOLDED PRECURSOR RNA. It is appreciated that VGR3283 folded precursor RNA comprises a plurality of what is known in the art as 'hairpin' structures. These 'hairpin' structures are due to the fact that the nucleotide sequence of VGR3283 precursor RNA comprises a plurality of segments, the first half of each such segment having a nucleotide sequence which is at least a partial inversed-reversed sequence of the second half thereof, as is well known in the art.

VGR3283 folded precursor RNA is naturally processed by cellular enzymatic activity into at least 3 separate VGAM precursor RNAs, VGAM2687 precursor RNA, VGAM2688 precursor RNA and VGAM2689 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2687 RNA, VGAM2688 RNA and VGAM2689 RNA, herein schematically represented by VGAM1 RNA through VGAM3 RNA, each of which VGAM RNAs corresponding to VGAM RNA of FIG. 1.

VGAM2687 RNA, herein schematically represented by VGAM1 RNA through VGAM3 RNA, binds complementarily to a host target binding site located in an untranslated region of VGAM2687 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2687 host target RNA into VGAM2687 host target protein, herein schematically represented by VGAM1 HOST TARGET PROTEIN through VGAM3 HOST TARGET PROTEIN, all of FIG. 1.

VGAM2688 RNA, herein schematically represented by VGAM1 RNA through VGAM3 RNA, binds complementarily to a host target binding site located in an untranslated region of VGAM2688 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2688 host target RNA into VGAM2688 host target protein, herein schematically represented by VGAM1 HOST TARGET PROTEIN through VGAM3 HOST TARGET PROTEIN, all of FIG. 1.

VGAM2689 RNA, herein schematically represented by VGAM1 RNA through VGAM3 RNA, binds complementarily to a host target binding site located in an untranslated region of VGAM2689 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2689 host target RNA into VGAM2689 host target protein, herein schematically represented by VGAM1 HOST TARGET PROTEIN through VGAM3 HOST TARGET PROTEIN, all of FIG. 1.

It is appreciated that a function of VGR3283 gene, herein designated VGR GENE, is inhibition of expression of host target genes, as part of a novel viral mechanism of attacking a host. Accordingly, utilities of VGR3283 gene include diagnosis, prevention and treatment of viral infection by Southern Bean Mosaic Virus. Specific functions, and accordingly utilities, of VGR3283 gene correlate with, and may be deduced from, the identity of the host target genes, which are inhibited by VGAM RNAs comprised in the 'operon-like' cluster of VGR3283 gene: VGAM2687 host target protein, VGAM2688 host target protein and VGAM2689 host target protein, herein schematically represented by VGAM1 HOST TARGET PROTEIN through VGAM3 HOST TARGET PROTEIN. The function of these host target genes is elaborated hereinabove with reference to VGAM2687, VGAM2688 and VGAM2689. FIG. 9 further provides a conceptual description of novel bioinformatically detected regulatory viral gene, referred to here as Viral Genomic Record 3284(VGR3284) viral gene, which encodes an 'operon-like' cluster of novel viral micro RNA-like genes, each of which in turn modulates expression of at least one host target gene, the function and utility of which at least one host target gene is known in the art.

VGR3284 gene, herein designated VGR GENE, is a novel bioinformatically detected regulatory, non protein coding, RNA viral gene. The method by which VGR3284 gene was detected is described hereinabove with reference to FIGS. 1-9.

VGR3284 gene encodes VGR3284 precursor RNA, herein designated VGR PRECURSOR RNA, an RNA molecule, typically several hundred nucleotides long.

VGR3284 precursor RNA folds spatially, forming VGR3284 folded precursor RNA, herein designated VGR FOLDED PRECURSOR RNA. It is appreciated that VGR3284 folded precursor RNA comprises a plurality of what is known in the art as 'hairpin' structures. These 'hairpin' structures are due to the fact that the nucleotide sequence of VGR3284 precursor RNA comprises a plurality of segments, the first half of each such segment having a nucleotide sequence which is at least a partial inversed-reversed sequence of the second half thereof, as is well known in the art.

VGR3284 folded precursor RNA is naturally processed by cellular enzymatic activity into at least 5 separate VGAM precursor RNAs, VGAM2690 precursor RNA, VGAM2691 precursor RNA, VGAM2692 precursor RNA, VGAM2693 precursor RNA and VGAM2694 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2690 RNA, VGAM2691 RNA, VGAM2692 RNA, VGAM2693 RNA and VGAM2694 RNA, herein schematically represented by VGAM1 RNA through VGAM3 RNA, each of which VGAM RNAs corresponding to VGAM RNA of FIG. 1.

VGAM2690 RNA, herein schematically represented by VGAM1 RNA through VGAM3 RNA, binds complementarily to a host target binding site located in an untranslated region of VGAM2690 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2690 host target RNA into VGAM2690 host target protein, herein schematically represented by VGAM1 HOST TARGET PROTEIN through VGAM3 HOST TARGET PROTEIN, all of FIG. 1.

VGAM2691 RNA, herein schematically represented by VGAM1 RNA through VGAM3 RNA, binds complementarily to a host target binding site located in an untranslated region of VGAM2691 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2691 host target RNA into VGAM2691 host target protein, herein schematically represented by VGAM1 HOST TARGET PROTEIN through VGAM3 HOST TARGET PROTEIN, all of FIG. 1.

VGAM2692 RNA, herein schematically represented by VGAM1 RNA through VGAM3 RNA, binds complementarily to a host target binding site located in an untranslated region of VGAM2692 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2692 host target RNA into VGAM2692 host target protein, herein schematically represented by VGAM1 HOST TARGET PROTEIN through VGAM3 HOST TARGET PROTEIN, all of FIG. 1.

VGAM2693 RNA, herein schematically represented by VGAM1 RNA through VGAM3 RNA, binds complementarily to a host target binding site located in an untranslated region of VGAM2693 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2693 host target RNA into VGAM2693 host target protein, herein schematically represented by VGAM1 HOST TARGET PROTEIN through VGAM3 HOST TARGET PROTEIN, all of FIG. 1.

VGAM2694 RNA, herein schematically represented by VGAM1 RNA through VGAM3 RNA, binds complementarily to a host target binding site located in an untranslated region of VGAM2694 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2694 host target RNA into VGAM2694 host target protein, herein schematically represented by VGAM1 HOST TARGET PROTEIN through VGAM3 HOST TARGET PROTEIN, all of FIG. 1.

It is appreciated that a function of VGR3284 gene, herein designated VGR GENE, is inhibition of expression of host target genes, as part of a novel viral mechanism of attacking a host. Accordingly, utilities of VGR3284 gene include diagnosis, prevention and treatment of viral infection by Phthorimaea Operculella Granulovirus. Specific functions, and accordingly utilities, of VGR3284 gene correlate with, and may be deduced from, the identity of the host target genes, which are inhibited by VGAM RNAs comprised in the 'operon-like' cluster of VGR3284 gene: VGAM2690 host target protein, VGAM2691 host target protein, VGAM2692 host target protein, VGAM2693 host target protein and VGAM2694 host target protein, herein schematically represented by VGAM1 HOST TARGET PROTEIN through VGAM3 HOST TARGET PROTEIN. The function of these host target genes is elaborated hereinabove with reference to VGAM2690, VGAM2691, VGAM2692, VGAM2693 and VGAM2694. FIG. 9 further provides a conceptual description of novel bioinformatically detected regulatory viral gene, referred to here as Viral Genomic Record 3285(VGR3285) viral gene, which encodes an 'operon-like' cluster of novel viral micro RNA-like genes, each of which in turn modulates expression of at least one host target gene, the function and utility of which at least one host target gene is known in the art.

VGR3285 gene, herein designated VGR GENE, is a novel bioinformatically detected regulatory, non protein coding, RNA viral gene. The method by which VGR3285 gene was detected is described hereinabove with reference to FIGS. 1-9.

VGR3285 gene encodes VGR3285 precursor RNA, herein designated VGR PRECURSOR RNA, an RNA molecule, typically several hundred nucleotides long.

VGR3285 precursor RNA folds spatially, forming VGR3285 folded precursor RNA, herein designated VGR FOLDED PRECURSOR RNA. It is appreciated that VGR3285 folded precursor RNA comprises a plurality of what is known in the art as 'hairpin' structures. These 'hairpin' structures are due to the fact that the nucleotide sequence of VGR3285 precursor RNA comprises a plurality of segments, the first half of each such segment having a nucleotide sequence which is at least a partial inversed-reversed sequence of the second half thereof, as is well known in the art.

VGR3285 folded precursor RNA is naturally processed by cellular enzymatic activity into at least 4 separate VGAM precursor RNAs, VGAM2696 precursor RNA, VGAM2697 precursor RNA, VGAM2698 precursor RNA and VGAM2699 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2696 RNA, VGAM2697 RNA, VGAM2698 RNA and VGAM2699 RNA, herein schematically represented by VGAM1 RNA through VGAM3 RNA, each of which VGAM RNAs corresponding to VGAM RNA of FIG. 1.

VGAM2696 RNA, herein schematically represented by VGAM1 RNA through VGAM3 RNA, binds complementarily to a host target binding site located in an untranslated region of VGAM2696 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2696 host target RNA into VGAM2696 host target protein, herein schematically represented by VGAM1 HOST TARGET PROTEIN through VGAM3 HOST TARGET PROTEIN, all of FIG. 1.

VGAM2697 RNA, herein schematically represented by VGAM1 RNA through VGAM3 RNA, binds complementarily to a host target binding site located in an untranslated region of VGAM2697 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2697 host target RNA into VGAM2697 host target protein, herein schematically represented by VGAM1 HOST TARGET PROTEIN through VGAM3 HOST TARGET PROTEIN, all of FIG. 1.

VGAM2698 RNA, herein schematically represented by VGAM1 RNA through VGAM3 RNA, binds complementarily to a host target binding site located in an untranslated region of VGAM2698 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2698 host target RNA into VGAM2698 host target protein, herein schematically represented by VGAM1 HOST TARGET PROTEIN through VGAM3 HOST TARGET PROTEIN, all of FIG. 1.

VGAM2699 RNA, herein schematically represented by VGAM1 RNA through VGAM3 RNA, binds complementarily to a host target binding site located in an untranslated region of VGAM2699 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2699 host target RNA into VGAM2699 host target protein, herein schematically represented by VGAM1 HOST TARGET PROTEIN through VGAM3 HOST TARGET PROTEIN, all of FIG. 1.

It is appreciated that a function of VGR3285 gene, herein designated VGR GENE, is inhibition of expression of host target genes, as part of a novel viral mechanism of attacking a host. Accordingly, utilities of VGR3285 gene include diagnosis, prevention and treatment of viral infection by Paprika Mild Mottle Virus. Specific functions, and accordingly utilities, of VGR3285 gene correlate with, and may be deduced from, the identity of the host target genes, which are inhibited by VGAM RNAs comprised in the 'operon-like' cluster of VGR3285 gene: VGAM2696 host target protein, VGAM2697 host target protein, VGAM2698 host target protein and VGAM2699 host target protein, herein schematically represented by VGAM1 HOST TARGET PROTEIN through VGAM3 HOST TARGET PROTEIN. The function of these host target genes is elaborated hereinabove with reference to VGAM2696, VGAM2697, VGAM2698 and VGAM2699.

FIG. 9 further provides a conceptual description of novel bioinformatically detected regulatory viral gene, referred to here as Viral Genomic Record 3286(VGR3286) viral gene, which encodes an 'operon-like' cluster of novel viral micro RNA-like genes, each of which in turn modulates expression of at least one host target gene, the function and utility of which at least one host target gene is known in the art.

VGR3286 gene, herein designated VGR GENE, is a novel bioinformatically detected regulatory, non protein coding, RNA viral gene. The method by which VGR3286 gene was detected is described hereinabove with reference to FIGS. 1-9.

VGR3286 gene encodes VGR3286 precursor RNA, herein designated VGR PRECURSOR RNA, an RNA molecule, typically several hundred nucleotides long.

VGR3286 precursor RNA folds spatially, forming VGR3286 folded precursor RNA, herein designated VGR FOLDED PRECURSOR RNA. It is appreciated that VGR3286 folded precursor RNA comprises a plurality of what is known in the art as 'hairpin' structures. These 'hairpin' structures are due to the fact that the nucleotide sequence of VGR3286 precursor RNA comprises a plurality of segments, the first half of each such segment having a nucleotide sequence which is at least a partial inversed-reversed sequence of the second half thereof, as is well known in the art.

VGR3286 folded precursor RNA is naturally processed by cellular enzymatic activity into at least 3 separate VGAM precursor RNAs, VGAM2700 precursor RNA, VGAM2701 precursor RNA and VGAM2702 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2700 RNA, VGAM2701 RNA and VGAM2702 RNA, herein schematically represented by VGAM1 RNA through VGAM3 RNA, each of which VGAM RNAs corresponding to VGAM RNA of FIG. 1.

VGAM2700 RNA, herein schematically represented by VGAM1 RNA through VGAM3 RNA, binds complementarily to a host target binding site located in an untranslated region of VGAM2700 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2700 host target RNA into VGAM2700 host target protein, herein schematically represented by VGAM1 HOST TARGET PROTEIN through VGAM3 HOST TARGET PROTEIN, all of FIG. 1.

VGAM2701 RNA, herein schematically represented by VGAM1 RNA through VGAM3 RNA, binds complementarily to a host target binding site located in an untranslated region of VGAM2701 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2701 host target RNA into VGAM2701 host target protein, herein schematically represented by VGAM1 HOST TARGET PROTEIN through VGAM3 HOST TARGET PROTEIN, all of FIG. 1.

VGAM2702 RNA, herein schematically represented by VGAM1 RNA through VGAM3 RNA, binds complementarily to a host target binding site located in an untranslated region of VGAM2702 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2702 host target RNA into VGAM2702 host target protein, herein schematically represented by VGAM1 HOST TARGET PROTEIN through VGAM3 HOST TARGET PROTEIN, all of FIG. 1.

It is appreciated that a function of VGR3286 gene, herein designated VGR GENE, is inhibition of expression of host target genes, as part of a novel viral mechanism of attacking a host. Accordingly, utilities of VGR3286 gene include diagnosis, prevention and treatment of viral infection by La Crosse Virus. Specific functions, and accordingly utilities, of VGR3286 gene correlate with, and may be deduced from, the identity of the host target genes, which are inhibited by VGAM RNAs comprised in the 'operon-like' cluster of VGR3286 gene: VGAM2700 host target protein, VGAM2701 host target protein and VGAM2702 host target protein, herein schematically represented by VGAM1 HOST TARGET PROTEIN through VGAM3 HOST TARGET PROTEIN. The function of these host target genes is elaborated hereinabove with reference to VGAM2700, VGAM2701 and VGAM2702. FIG. 9 further provides a conceptual description of novel bioinformatically detected regulatory viral gene, referred to here as Viral Genomic Record 3287(VGR3287) viral gene, which encodes an 'operon-like' cluster of novel viral micro RNA-like genes, each of which in turn modulates expression of at least one host target gene, the function and utility of which at least one host target gene is known in the art.

VGR3287 gene, herein designated VGR GENE, is a novel bioinformatically detected regulatory, non protein coding, RNA viral gene. The method by which VGR3287 gene was detected is described hereinabove with reference to FIGS. 1-9.

VGR3287 gene encodes VGR3287 precursor RNA, herein designated VGR PRECURSOR RNA, an RNA molecule, typically several hundred nucleotides long.

VGR3287 precursor RNA folds spatially, forming VGR3287 folded precursor RNA, herein designated VGR FOLDED PRECURSOR RNA. It is appreciated that VGR3287 folded precursor RNA comprises a plurality of what is known in the art as 'hairpin' structures. These 'hairpin' structures are due to the fact that the nucleotide sequence of VGR3287 precursor RNA comprises a plurality of segments, the first half of each such segment having a nucleotide sequence which is at least a partial inversed-reversed sequence of the second half thereof, as is well known in the art.

VGR3287 folded precursor RNA is naturally processed by cellular enzymatic activity into at least 2 separate VGAM precursor RNAs, VGAM2703 precursor RNA and VGAM2704 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2703 RNA and VGAM2704 RNA, herein schematically represented by VGAM1 RNA through VGAM3 RNA, each of which VGAM RNAs corresponding to VGAM RNA of FIG. 1.

VGAM2703 RNA, herein schematically represented by VGAM1 RNA through VGAM3 RNA, binds complementarily to a host target binding site located in an untranslated region of VGAM2703 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2703 host target RNA into VGAM2703 host target protein, herein schematically represented by VGAM1 HOST TARGET PROTEIN through VGAM3 HOST TARGET PROTEIN, all of FIG. 1.

VGAM2704 RNA, herein schematically represented by VGAM1 RNA through VGAM3 RNA, binds complementarily to a host target binding site located in an untranslated region of VGAM2704 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2704 host target RNA into VGAM2704 host target protein, herein schematically represented by VGAM1 HOST TARGET PROTEIN through VGAM3 HOST TARGET PROTEIN, all of FIG. 1.

It is appreciated that a function of VGR3287 gene, herein designated VGR GENE, is inhibition of expression of host target genes, as part of a novel viral mechanism of attacking a host. Accordingly, utilities of VGR3287 gene include diagnosis, prevention and treatment of viral infection by Mamestra Configurata Nucleopolyhedrovirus B. Specific functions, and accordingly utilities, of VGR3287 gene correlate with, and may be deduced from, the identity of the host target genes, which are inhibited by VGAM RNAs comprised in the 'operon-like' cluster of VGR3287 gene: VGAM2703 host target protein and VGAM2704 host target protein, herein schematically represented by VGAM1 HOST TARGET PROTEIN through VGAM3 HOST TARGET PROTEIN. The function of these host target genes is elaborated hereinabove with reference to VGAM2703 and VGAM2704. FIG. 9 further provides a conceptual description of novel bioinformatically detected regulatory viral gene, referred to here as Viral Genomic Record 3288(VGR3288) viral gene, which encodes an 'operon-like' cluster of novel viral micro RNA-like genes, each of which in turn modulates expression of at least one host target gene, the function and utility of which at least one host target gene is known in the art.

VGR3288 gene, herein designated VGR GENE, is a novel bioinformatically detected regulatory, non protein coding, RNA viral gene. The method by which VGR3288 gene was detected is described hereinabove with reference to FIGS. 1-9.

VGR3288 gene encodes VGR3288 precursor RNA, herein designated VGR PRECURSOR RNA, an RNA molecule, typically several hundred nucleotides long.

VGR3288 precursor RNA folds spatially, forming VGR3288 folded precursor RNA, herein designated VGR FOLDED PRECURSOR RNA. It is appreciated that VGR3288 folded precursor RNA comprises a plurality of what is known in the art as 'hairpin' structures. These 'hairpin' structures are due to the fact that the nucleotide sequence of VGR3288 precursor RNA comprises a plurality of segments, the first half of each such segment having a nucleotide sequence which is at least a partial inversed-reversed sequence of the second half thereof, as is well known in the art.

VGR3288 folded precursor RNA is naturally processed by cellular enzymatic activity into at least 2 separate VGAM precursor RNAs, VGAM2706 precursor RNA and VGAM2707 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2706 RNA and VGAM2707 RNA, herein schematically represented by VGAM1 RNA through VGAM3 RNA, each of which VGAM RNAs corresponding to VGAM RNA of FIG. 1.

VGAM2706 RNA, herein schematically represented by VGAM1 RNA through VGAM3 RNA, binds complementarily to a host target binding site located in an untranslated region of VGAM2706 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2706 host target RNA into VGAM2706 host target protein, herein schematically represented by VGAM1 HOST TARGET PROTEIN through VGAM3 HOST TARGET PROTEIN, all of FIG. 1.

VGAM2707 RNA, herein schematically represented by VGAM1 RNA through VGAM3 RNA, binds complementarily to a host target binding site located in an untranslated region of VGAM2707 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2707 host target RNA into VGAM2707 host target protein, herein schematically represented by VGAM1 HOST TARGET PROTEIN through VGAM3 HOST TARGET PROTEIN, all of FIG. 1.

It is appreciated that a function of VGR3288 gene, herein designated VGR GENE, is inhibition of expression of host target genes, as part of a novel viral mechanism of attacking a host. Accordingly, utilities of VGR3288 gene include diagnosis, prevention and treatment of viral infection by Heliothis Zea Virus 1 (HZV-1). Specific functions, and accordingly utilities, of VGR3288 gene correlate with, and may be deduced from, the identity of the host target genes, which are inhibited by VGAM RNAs comprised in the 'operon-like' cluster of VGR3288 gene: VGAM2706 host target protein and VGAM2707 host target protein, herein schematically represented by VGAM1 HOST TARGET PROTEIN through VGAM3 HOST TARGET PROTEIN. The function of these host target genes is elaborated hereinabove with reference to VGAM2706 and VGAM2707. FIG. 9 further provides a conceptual description of novel bioinformatically detected regulatory viral gene, referred to here as Viral Genomic Record 3289(VGR3289) viral gene, which encodes an 'operon-like' cluster of novel viral micro RNA-like genes, each of which in turn modulates expression of at least one host target gene, the function and utility of which at least one host target gene is known in the art.

VGR3289 gene, herein designated VGR GENE, is a novel bioinformatically detected regulatory, non protein coding, RNA viral gene. The method by which VGR3289 gene was detected is described hereinabove with reference to FIGS. 1-9.

VGR3289 gene encodes VGR3289 precursor RNA, herein designated VGR PRECURSOR RNA, an RNA molecule, typically several hundred nucleotides long.

VGR3289 precursor RNA folds spatially, forming VGR3289 folded precursor RNA, herein designated VGR FOLDED PRECURSOR RNA. It is appreciated that VGR3289 folded precursor RNA comprises a plurality of what is known in the art as 'hairpin' structures. These 'hairpin' structures are due to the fact that the nucleotide sequence of VGR3289 precursor RNA comprises a plurality of segments, the first half of each such segment having a nucleotide sequence which is at least a partial inversed-reversed sequence of the second half thereof, as is well known in the art.

VGR3289 folded precursor RNA is naturally processed by cellular enzymatic activity into at least 2 separate VGAM precursor RNAs, VGAM2708 precursor RNA and VGAM2709 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2708 RNA and VGAM2709 RNA, herein schematically represented by VGAM1 RNA through VGAM3 RNA, each of which VGAM RNAs corresponding to VGAM RNA of FIG. 1.

VGAM2708 RNA, herein schematically represented by VGAM1 RNA through VGAM3 RNA, binds complementarily to a host target binding site located in an untranslated region of VGAM2708 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2708 host target RNA into VGAM2708 host target protein, herein schematically represented by VGAM1 HOST TARGET PROTEIN through VGAM3 HOST TARGET PROTEIN, all of FIG. 1.

VGAM2709 RNA, herein schematically represented by VGAM1 RNA through VGAM3 RNA, binds complementarily to a host target binding site located in an untranslated region of VGAM2709 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2709 host target RNA into VGAM2709 host target protein, herein schematically represented by VGAM1 HOST TARGET PROTEIN through VGAM3 HOST TARGET PROTEIN, all of FIG. 1.

It is appreciated that a function of VGR3289 gene, herein designated VGR GENE, is inhibition of expression of host target genes, as part of a novel viral mechanism of attacking a host. Accordingly, utilities of VGR3289 gene include diagnosis, prevention and treatment of viral infection by Heliothis Zea Virus 1 (HZV-1). Specific functions, and accordingly utilities, of VGR3289 gene correlate with, and may be deduced from, the identity of the host target genes, which are inhibited by VGAM RNAs comprised in the 'operon-like' cluster of VGR3289 gene: VGAM2708 host target protein and VGAM2709 host target protein, herein schematically represented by VGAM1 HOST TARGET PROTEIN through VGAM3 HOST TARGET PROTEIN. The function of these host target genes is elaborated hereinabove with reference to VGAM2708 and VGAM2709. FIG. 9 further provides a conceptual description of novel bioinformatically detected regulatory viral gene, referred to here as Viral Genomic Record 3290(VGR3290) viral gene, which encodes an 'operon-like' cluster of novel viral micro RNA-like genes, each of which in turn modulates expression of at least one host target gene, the function and utility of which at least one host target gene is known in the art.

VGR3290 gene, herein designated VGR GENE, is a novel bioinformatically detected regulatory, non protein coding, RNA viral gene. The method by which VGR3290 gene was detected is described hereinabove with reference to FIGS. 1-9.

VGR3290 gene encodes VGR3290 precursor RNA, herein designated VGR PRECURSOR RNA, an RNA molecule, typically several hundred nucleotides long.

VGR3290 precursor RNA folds spatially, forming VGR3290 folded precursor RNA, herein designated VGR FOLDED PRECURSOR RNA. It is appreciated that VGR3290 folded precursor RNA comprises a plurality of what is known in the art as 'hairpin' structures. These 'hairpin' structures are due to the fact that the nucleotide sequence of VGR3290 precursor RNA comprises a plurality of segments, the first half of each such segment having a nucleotide sequence which is at least a partial inversed-reversed sequence of the second half thereof, as is well known in the art.

VGR3290 folded precursor RNA is naturally processed by cellular enzymatic activity into at least 2 separate VGAM precursor RNAs, VGAM2711 precursor RNA and VGAM2712 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2711 RNA and VGAM2712 RNA, herein schematically represented by VGAM1 RNA through VGAM3 RNA, each of which VGAM RNAs corresponding to VGAM RNA of FIG. 1.

VGAM2711 RNA, herein schematically represented by VGAM1 RNA through VGAM3 RNA, binds complementarily to a host target binding site located in an untranslated region of VGAM2711 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2711 host target RNA into VGAM2711 host target protein, herein schematically represented by VGAM1 HOST TARGET PROTEIN through VGAM3 HOST TARGET PROTEIN, all of FIG. 1.

VGAM2712 RNA, herein schematically represented by VGAM1 RNA through VGAM3 RNA, binds complementarily to a host target binding site located in an untranslated region of VGAM2712 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2712 host target RNA into VGAM2712 host target protein, herein schematically represented by VGAM1 HOST TARGET PROTEIN through VGAM3 HOST TARGET PROTEIN, all of FIG. 1.

It is appreciated that a function of VGR3290 gene, herein designated VGR GENE, is inhibition of expression of host target genes, as part of a novel viral mechanism of attacking a host. Accordingly, utilities of VGR3290 gene include diagnosis, prevention and treatment of viral infection by Chikungunya Virus. Specific functions, and accordingly utilities, of VGR3290 gene correlate with, and may be deduced from, the identity of the host target genes, which are inhibited by VGAM RNAs comprised in the 'operon-like' cluster of VGR3290 gene: VGAM2711 host target protein and VGAM2712 host target protein, herein schematically represented by VGAM1 HOST TARGET PROTEIN through VGAM3 HOST TARGET PROTEIN. The function of these host target genes is elaborated hereinabove with reference to VGAM2711 and VGAM2712. FIG. 9 further provides a conceptual description of novel bioinformatically detected regulatory viral gene, referred to here as Viral Genomic Record 3291(VGR3291) viral gene, which encodes an 'operon-like' cluster of novel viral micro RNA-like genes, each of which in turn modulates expression of at least one host target gene, the function and utility of which at least one host target gene is known in the art.

VGR3291 gene, herein designated VGR GENE, is a novel bioinformatically detected regulatory, non protein coding, RNA viral gene. The method by which VGR3291 gene was detected is described hereinabove with reference to FIGS. 1-9.

VGR3291 gene encodes VGR3291 precursor RNA, herein designated VGR PRECURSOR RNA, an RNA molecule, typically several hundred nucleotides long.

VGR3291 precursor RNA folds spatially, forming VGR3291 folded precursor RNA, herein designated VGR FOLDED PRECURSOR RNA. It is appreciated that VGR3291 folded precursor RNA comprises a plurality of what is known in the art as 'hairpin' structures. These 'hairpin' structures are due to the fact that the nucleotide sequence of VGR3291 precursor RNA comprises a plurality of segments, the first half of each such segment having a nucleotide sequence which is at least a partial inversed-reversed sequence of the second half thereof, as is well known in the art.

VGR3291 folded precursor RNA is naturally processed by cellular enzymatic activity into at least 3 separate VGAM precursor RNAs, VGAM2713 precursor RNA, VGAM2714 precursor RNA and VGAM2715 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2713 RNA, VGAM2714 RNA and VGAM2715 RNA, herein schematically represented by VGAM1 RNA through VGAM3 RNA, each of which VGAM RNAs corresponding to VGAM RNA of FIG. 1.

VGAM2713 RNA, herein schematically represented by VGAM1 RNA through VGAM3 RNA, binds complementarily to a host target binding site located in an untranslated region of VGAM2713 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM2713 host target RNA into VGAM2713 host target protein, herein schematically represented by VGAM1 HOST TARGET PROTEIN through VGAM3 HOST TARGET PROTEIN, all of FIG. 1.

VGAM2714 RNA, herein schematically represented by VGAM1 RNA through VGAM3 RNA, binds complementarily to a host target binding site located in an untranslated region of VGAM2714 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2714 host target RNA into VGAM2714 host target protein, herein schematically represented by VGAM1 HOST TARGET PROTEIN through VGAM3 HOST TARGET PROTEIN, all of FIG. 1.

VGAM2715 RNA, herein schematically represented by VGAM1 RNA through VGAM3 RNA, binds complementarily to a host target binding site located in an untranslated region of VGAM2715 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2715 host target RNA into VGAM2715 host target protein, herein schematically represented by VGAM1 HOST TARGET PROTEIN through VGAM3 HOST TARGET PROTEIN, all of FIG. 1.

It is appreciated that a function of VGR3291 gene, herein designated VGR GENE, is inhibition of expression of host target genes, as part of a novel viral mechanism of attacking a host. Accordingly, utilities of VGR3291 gene include diagnosis, prevention and treatment of viral infection by Mammalian Orthoreovirus 2. Specific functions, and accordingly utilities, of VGR3291 gene correlate with, and may be deduced from, the identity of the host target genes, which are inhibited by VGAM RNAs comprised in the 'operon-like' cluster of VGR3291 gene: VGAM2713 host target protein, VGAM2714 host target protein and VGAM2715 host target protein, herein schematically represented by VGAM1 HOST TARGET PROTEIN through VGAM3 HOST TARGET PROTEIN. The function of these host target genes is elaborated hereinabove with reference to VGAM2713, VGAM2714 and VGAM2715. FIG. 9 further provides a conceptual description of novel bioinformatically detected regulatory viral gene, referred to here as Viral Genomic Record 3292(VGR3292) viral gene, which encodes an 'operon-like' cluster of novel viral micro RNA-like genes, each of which in turn modulates expression of at least one host target gene, the function and utility of which at least one host target gene is known in the art.

VGR3292 gene, herein designated VGR GENE, is a novel bioinformatically detected regulatory, non protein coding, RNA viral gene. The method by which VGR3292 gene was detected is described hereinabove with reference to FIGS. 1-9.

VGR3292 gene encodes VGR3292 precursor RNA, herein designated VGR PRECURSOR RNA, an RNA molecule, typically several hundred nucleotides long.

VGR3292 precursor RNA folds spatially, forming VGR3292 folded precursor RNA, herein designated VGR FOLDED PRECURSOR RNA. It is appreciated that VGR3292 folded precursor RNA comprises a plurality of what is known in the art as 'hairpin' structures. These 'hairpin' structures are due to the fact that the nucleotide sequence of VGR3292 precursor RNA comprises a plurality of segments, the first half of each such segment having a nucleotide sequence which is at least a partial inversed-reversed sequence of the second half thereof, as is well known in the art.

VGR3292 folded precursor RNA is naturally processed by cellular enzymatic activity into at least 2 separate VGAM precursor RNAs, VGAM2717 precursor RNA and VGAM2718 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2717 RNA and VGAM2718 RNA, herein schematically represented by VGAM1 RNA through VGAM3 RNA, each of which VGAM RNAs corresponding to VGAM RNA of FIG. 1.

VGAM2717 RNA, herein schematically represented by VGAM1 RNA through VGAM3 RNA, binds complementarily to a host target binding site located in an untranslated region of VGAM2717 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2717 host target RNA into VGAM2717 host target protein, herein schematically represented by VGAM1 HOST TARGET PROTEIN through VGAM3 HOST TARGET PROTEIN, all of FIG. 1.

VGAM2718 RNA, herein schematically represented by VGAM1 RNA through VGAM3 RNA, binds complementarily to a host target binding site located in an untranslated region of VGAM2718 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2718 host target RNA into VGAM2718 host target protein, herein schematically represented by VGAM1 HOST TARGET PROTEIN through VGAM3 HOST TARGET PROTEIN, all of FIG. 1.

It is appreciated that a function of VGR3292 gene, herein designated VGR GENE, is inhibition of expression of host target genes, as part of a novel viral mechanism of attacking a host. Accordingly, utilities of VGR3292 gene include diagnosis, prevention and treatment of viral infection by Rachiplusia Ou Multiple Nucleopolyhedrovirus. Specific functions, and accordingly utilities, of VGR3292 gene correlate with, and may be deduced from, the identity of the host target genes, which are inhibited by VGAM RNAs comprised in the 'operon-like' cluster of VGR3292 gene: VGAM2717 host target protein and VGAM2718 host target protein, herein schematically represented by VGAM1 HOST TARGET PROTEIN through VGAM3 HOST TARGET PROTEIN. The function of these host target genes is elaborated hereinabove with reference to VGAM2717 and VGAM2718. FIG. 9 further provides a conceptual description of novel bioinformatically detected regulatory viral gene, referred to here as Viral Genomic Record 3293(VGR3293) viral gene, which encodes an 'operon-like' cluster of novel viral micro RNA-like genes, each of which in turn modulates expression of at least one host target gene, the function and utility of which at least one host target gene is known in the art.

VGR3293 gene, herein designated VGR GENE, is a novel bioinformatically detected regulatory, non protein coding, RNA viral gene. The method by which VGR3293 gene was detected is described hereinabove with reference to FIGS. 1-9.

VGR3293 gene encodes VGR3293 precursor RNA, herein designated VGR PRECURSOR RNA, an RNA molecule, typically several hundred nucleotides long.

VGR3293 precursor RNA folds spatially, forming VGR3293 folded precursor RNA, herein designated VGR FOLDED PRECURSOR RNA. It is appreciated that VGR3293 folded precursor RNA comprises a plurality of what is known in the art as 'hairpin' structures. These 'hairpin' structures are due to the fact that the nucleotide sequence of VGR3293 precursor RNA comprises a plurality of segments, the first half of each such segment having a nucleotide sequence which is at least a partial inversed-reversed sequence of the second half thereof, as is well known in the art.

VGR3293 folded precursor RNA is naturally processed by cellular enzymatic activity into at least 7 separate VGAM precursor RNAs, VGAM2719 precursor RNA, VGAM2720 precursor RNA, VGAM2721 precursor RNA, VGAM2722 precursor RNA, VGAM2723 precursor RNA, VGAM2724 precursor RNA and VGAM2725 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2719 RNA, VGAM2720 RNA, VGAM2721 RNA, VGAM2722 RNA, VGAM2723 RNA, VGAM2724 RNA and VGAM2725 RNA, herein schematically represented by VGAM1 RNA through VGAM3 RNA, each of which VGAM RNAs corresponding to VGAM RNA of FIG. 1.

VGAM2719 RNA, herein schematically represented by VGAM1 RNA through VGAM3 RNA, binds complementarily to a host target binding site located in an untranslated region of VGAM2719 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2719 host target RNA into VGAM2719 host target protein, herein schematically represented by VGAM1 HOST TARGET PROTEIN through VGAM3 HOST TARGET PROTEIN, all of FIG. 1.

VGAM2720 RNA, herein schematically represented by VGAM1 RNA through VGAM3 RNA, binds complementarily to a host target binding site located in an untranslated region of VGAM2720 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2720 host target RNA into VGAM2720 host target protein, herein schematically represented by VGAM1 HOST TARGET PROTEIN through VGAM3 HOST TARGET PROTEIN, all of FIG. 1.

VGAM2721 RNA, herein schematically represented by VGAM1 RNA through VGAM3 RNA, binds complementarily to a host target binding site located in an untranslated region of VGAM2721 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2721 host target RNA into VGAM2721 host target protein, herein schematically represented by VGAM1 HOST TARGET PROTEIN through VGAM3 HOST TARGET PROTEIN, all of FIG. 1.

VGAM2722 RNA, herein schematically represented by VGAM1 RNA through VGAM3 RNA, binds complementarily to a host target binding site located in an untranslated region of VGAM2722 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2722 host target RNA into VGAM2722 host target protein, herein schematically represented by VGAM1 HOST TARGET PROTEIN through VGAM3 HOST TARGET PROTEIN, all of FIG. 1.

VGAM2723 RNA, herein schematically represented by VGAM1 RNA through VGAM3 RNA, binds complementarily to a host target binding site located in an untranslated region of VGAM2723 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2723 host target RNA into VGAM2723 host target protein, herein schematically represented by VGAM1 HOST TARGET PROTEIN through VGAM3 HOST TARGET PROTEIN, all of FIG. 1.

VGAM2724 RNA, herein schematically represented by VGAM1 RNA through VGAM3 RNA, binds complementarily to a host target binding site located in an untranslated region of VGAM2724 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2724 host target RNA into VGAM2724 host target protein, herein schematically represented by VGAM1 HOST TARGET PROTEIN through VGAM3 HOST TARGET PROTEIN, all of FIG. 1.

VGAM2725 RNA, herein schematically represented by VGAM1 RNA through VGAM3 RNA, binds complementarily to a host target binding site located in an untranslated region of VGAM2725 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2725 host target RNA into VGAM2725 host target protein, herein schematically represented by VGAM1 HOST TARGET PROTEIN through VGAM3 HOST TARGET PROTEIN, all of FIG. 1.

It is appreciated that a function of VGR3293 gene, herein designated VGR GENE, is inhibition of expression of host target genes, as part of a novel viral mechanism of attacking a host. Accordingly, utilities of VGR3293 gene include diagnosis, prevention and treatment of viral infection by Aphid Lethal Paralysis Virus. Specific functions, and accordingly utilities, of VGR3293 gene correlate with, and may be deduced from, the identity of the host target genes, which are inhibited by VGAM RNAs comprised in the 'operon-like' cluster of VGR3293 gene: VGAM2719 host target protein, VGAM2720 host target protein, VGAM2721 host target protein, VGAM2722 host target protein, VGAM2723 host target protein, VGAM2724 host target protein and VGAM2725 host target protein, herein schematically represented by VGAM1

HOST TARGET PROTEIN through VGAM3 HOST TARGET PROTEIN. The function of these host target genes is elaborated hereinabove with reference to VGAM2719, VGAM2720, VGAM2721, VGAM2722, VGAM2723, VGAM2724 and VGAM2725. FIG. 9 further provides a conceptual description of novel bioinformatically detected regulatory viral gene, referred to here as Viral Genomic Record 3294(VGR3294) viral gene, which encodes an 'operon-like' cluster of novel viral micro RNA-like genes, each of which in turn modulates expression of at least one host target gene, the function and utility of which at least one host target gene is known in the art.

VGR3294 gene, herein designated VGR GENE, is a novel bioinformatically detected regulatory, non protein coding, RNA viral gene. The method by which VGR3294 gene was detected is described hereinabove with reference to FIGS. 1-9.

VGR3294 gene encodes VGR3294 precursor RNA, herein designated VGR PRECURSOR RNA, an RNA molecule, typically several hundred nucleotides long.

VGR3294 precursor RNA folds spatially, forming VGR3294 folded precursor RNA, herein designated VGR FOLDED PRECURSOR RNA. It is appreciated that VGR3294 folded precursor RNA comprises a plurality of what is known in the art as 'hairpin' structures. These 'hairpin' structures are due to the fact that the nucleotide sequence of VGR3294 precursor RNA comprises a plurality of segments, the first half of each such segment having a nucleotide sequence which is at least a partial inversed-reversed sequence of the second half thereof, as is well known in the art.

VGR3294 folded precursor RNA is naturally processed by cellular enzymatic activity into at least 2 separate VGAM precursor RNAs, VGAM2726 precursor RNA and VGAM2727 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2726 RNA and VGAM2727 RNA, herein schematically represented by VGAM1 RNA through VGAM3 RNA, each of which VGAM RNAs corresponding to VGAM RNA of FIG. 1.

VGAM2726 RNA, herein schematically represented by VGAM1 RNA through VGAM3 RNA, binds complementarily to a host target binding site located in an untranslated region of VGAM2726 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2726 host target RNA into VGAM2726 host target protein, herein schematically represented by VGAM1 HOST TARGET PROTEIN through VGAM3 HOST TARGET PROTEIN, all of FIG. 1.

VGAM2727 RNA, herein schematically represented by VGAM1 RNA through VGAM3 RNA, binds complementarily to a host target binding site located in an untranslated region of VGAM2727 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2727 host target RNA into VGAM2727 host target protein, herein schematically represented by VGAM1 HOST TARGET PROTEIN through VGAM3 HOST TARGET PROTEIN, all of FIG. 1.

It is appreciated that a function of VGR3294 gene, herein designated VGR GENE, is inhibition of expression of host target genes, as part of a novel viral mechanism of attacking a host. Accordingly, utilities of VGR3294 gene include diagnosis, prevention and treatment of viral infection by Aphid Lethal Paralysis Virus. Specific functions, and accordingly utilities, of VGR3294 gene correlate with, and may be deduced from, the identity of the host target genes, which are inhibited by VGAM RNAs comprised in the 'operon-like' cluster of VGR3294 gene: VGAM2726 host target protein and VGAM2727 host target protein, herein schematically represented by VGAM1 HOST TARGET PROTEIN through VGAM3 HOST TARGET PROTEIN. The function of these host target genes is elaborated hereinabove with reference to VGAM2726 and VGAM2727. FIG. 9 further provides a conceptual description of novel bioinformatically detected regulatory viral gene, referred to here as Viral Genomic Record 3295(VGR3295) viral gene, which encodes an 'operon-like' cluster of novel viral micro RNA-like genes, each of which in turn modulates expression of at least one host target gene, the function and utility of which at least one host target gene is known in the art.

VGR3295 gene, herein designated VGR GENE, is a novel bioinformatically detected regulatory, non protein coding, RNA viral gene. The method by which VGR3295 gene was detected is described hereinabove with reference to FIGS. 1-9.

VGR3295 gene encodes VGR3295 precursor RNA, herein designated VGR PRECURSOR RNA, an RNA molecule, typically several hundred nucleotides long.

VGR3295 precursor RNA folds spatially, forming VGR3295 folded precursor RNA, herein designated VGR FOLDED PRECURSOR RNA. It is appreciated that VGR3295 folded precursor RNA comprises a plurality of what is known in the art as 'hairpin' structures. These 'hairpin' structures are due to the fact that the nucleotide sequence of VGR3295 precursor RNA comprises a plurality of segments, the first half of each such segment having a nucleotide sequence which is at least a partial inversed-reversed sequence of the second half thereof, as is well known in the art.

VGR3295 folded precursor RNA is naturally processed by cellular enzymatic activity into at least 2 separate VGAM precursor RNAs, VGAM2728 precursor RNA and VGAM2729 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2728 RNA and VGAM2729 RNA, herein schematically represented by VGAM1 RNA through VGAM3 RNA, each of which VGAM RNAs corresponding to VGAM RNA of FIG. 1.

VGAM2728 RNA, herein schematically represented by VGAM1 RNA through VGAM3 RNA, binds complementarily to a host target binding site located in an untranslated region of VGAM2728 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2728 host target RNA into VGAM2728 host target protein, herein schematically represented by VGAM1 HOST TARGET PROTEIN through VGAM3 HOST TARGET PROTEIN, all of FIG. 1.

VGAM2729 RNA, herein schematically represented by VGAM1 RNA through VGAM3 RNA, binds complementarily to a host target binding site located in an untranslated region of VGAM2729 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2729 host target RNA into VGAM2729 host target protein, herein schematically represented by VGAM1 HOST TARGET PROTEIN through VGAM3 HOST TARGET PROTEIN, all of FIG. 1.

It is appreciated that a function of VGR3295 gene, herein designated VGR GENE, is inhibition of expression of host target genes, as part of a novel viral mechanism of attacking a host. Accordingly, utilities of VGR3295 gene include diagnosis, prevention and treatment of viral infection by Aphid Lethal Paralysis Virus. Specific functions, and accordingly utilities, of VGR3295 gene correlate with, and may be deduced from, the identity of the host target genes, which are inhibited by VGAM RNAs comprised in the 'operon-like' cluster of VGR3295 gene: VGAM2728 host target protein and VGAM2729 host target protein, herein schematically represented by VGAM1 HOST TARGET PROTEIN through VGAM3 HOST TARGET PROTEIN. The function of these host target genes is elaborated hereinabove with reference to VGAM2728 and VGAM2729. FIG. 9 further provides a conceptual description of novel bioinformatically detected regulatory viral gene, referred to here as Viral Genomic Record 3296(VGR3296) viral gene, which encodes an 'operon-like' cluster of novel viral micro RNA-like genes, each of which in turn modulates expression of at least one host target gene, the function and utility of which at least one host target gene is known in the art.

VGR3296 gene, herein designated VGR GENE, is a novel bioinformatically detected regulatory, non protein coding, RNA viral gene. The method by which VGR3296 gene was detected is described hereinabove with reference to FIGS. 1-9.

VGR3296 gene encodes VGR3296 precursor RNA, herein designated VGR PRECURSOR RNA, an RNA molecule, typically several hundred nucleotides long.

VGR3296 precursor RNA folds spatially, forming VGR3296 folded precursor RNA, herein designated VGR FOLDED PRECURSOR RNA. It is appreciated that VGR3296 folded precursor RNA comprises a plurality of what is known in the art as 'hairpin' structures. These 'hairpin' structures are due to the fact that the nucleotide sequence of VGR3296 precursor RNA comprises a plurality of segments, the first half of each such segment having a nucleotide sequence which is at least a partial inversed-reversed sequence of the second half thereof, as is well known in the art.

VGR3296 folded precursor RNA is naturally processed by cellular enzymatic activity into at least 2 separate VGAM precursor RNAs, VGAM2730 precursor RNA and VGAM2731 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2730 RNA and VGAM2731 RNA, herein schematically represented by VGAM1 RNA through VGAM3 RNA, each of which VGAM RNAs corresponding to VGAM RNA of FIG. 1.

VGAM2730 RNA, herein schematically represented by VGAM1 RNA through VGAM3 RNA, binds complementarily to a host target binding site located in an untranslated region of VGAM2730 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2730 host target RNA into VGAM2730 host target protein, herein schematically represented by VGAM1 HOST TARGET PROTEIN through VGAM3 HOST TARGET PROTEIN, all of FIG. 1.

VGAM2731 RNA, herein schematically represented by VGAM1 RNA through VGAM3 RNA, binds complementarily to a host target binding site located in an untranslated region of VGAM2731 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2731 host target RNA into VGAM2731 host target protein, herein schematically represented by VGAM1 HOST TARGET PROTEIN through VGAM3 HOST TARGET PROTEIN, all of FIG. 1.

It is appreciated that a function of VGR3296 gene, herein designated VGR GENE, is inhibition of expression of host target genes, as part of a novel viral mechanism of attacking a host. Accordingly, utilities of VGR3296 gene include diagnosis, prevention and treatment of viral infection by Callitrichine Herpesvirus 3. Specific functions, and accordingly utilities, of VGR3296 gene correlate with, and may be deduced from, the identity of the host target genes, which are inhibited by VGAM RNAs comprised in the 'operon-like' cluster of VGR3296 gene: VGAM2730 host target protein and VGAM2731 host target protein, herein schematically represented by VGAM1 HOST TARGET PROTEIN through VGAM3 HOST TARGET PROTEIN. The function of these host target genes is elaborated hereinabove with reference to VGAM2730 and VGAM2731. FIG. 9 further provides a conceptual description of novel bioinformatically detected regulatory viral gene, referred to here as Viral Genomic Record 3297(VGR3297) viral gene, which encodes an 'operon-like' cluster of novel viral micro RNA-like genes, each of which in turn modulates expression of at least one host target gene, the function and utility of which at least one host target gene is known in the art.

VGR3297 gene, herein designated VGR GENE, is a novel bioinformatically detected regulatory, non protein coding, RNA viral gene. The method by which VGR3297 gene was detected is described hereinabove with reference to FIGS. 1-9.

VGR3297 gene encodes VGR3297 precursor RNA, herein designated VGR PRECURSOR RNA, an RNA molecule, typically several hundred nucleotides long.

VGR3297 precursor RNA folds spatially, forming VGR3297 folded precursor RNA, herein designated VGR FOLDED PRECURSOR RNA. It is appreciated that VGR3297 folded precursor RNA comprises a plurality of what is known in the art as 'hairpin' structures. These 'hairpin' structures are due to the fact that the nucleotide sequence of VGR3297 precursor RNA comprises a plurality of segments, the first half of each such segment having a nucleotide sequence which is at least a partial inversed-reversed sequence of the second half thereof, as is well known in the art.

VGR3297 folded precursor RNA is naturally processed by cellular enzymatic activity into at least 6 separate VGAM precursor RNAs, VGAM2733 precursor RNA, VGAM2734 precursor RNA, VGAM2735 precursor RNA, VGAM2736 precursor RNA, VGAM2737 precursor RNA and VGAM2738 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2733 RNA, VGAM2734 RNA, VGAM2735 RNA, VGAM2736 RNA, VGAM2737 RNA and VGAM2738 RNA, herein schematically represented by VGAM1 RNA through VGAM3 RNA, each of which VGAM RNAs corresponding to VGAM RNA of FIG. 1.

VGAM2733 RNA, herein schematically represented by VGAM1 RNA through VGAM3 RNA, binds complementarily to a host target binding site located in an untranslated region of VGAM2733 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2733 host target RNA into VGAM2733 host target protein, herein schematically represented by VGAM1 HOST TARGET PROTEIN through VGAM3 HOST TARGET PROTEIN, all of FIG. 1.

VGAM2734 RNA, herein schematically represented by VGAM1 RNA through VGAM3 RNA, binds complementarily to a host target binding site located in an untranslated region of VGAM2734 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2734 host target RNA into VGAM2734 host target protein, herein schematically represented by VGAM1 HOST TARGET PROTEIN through VGAM3 HOST TARGET PROTEIN, all of FIG. 1.

VGAM2735 RNA, herein schematically represented by VGAM1 RNA through VGAM3 RNA, binds complementarily to a host target binding site located in an untranslated region of VGAM2735 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2735 host target RNA into VGAM2735 host target protein, herein schematically represented by VGAM1 HOST TARGET PROTEIN through VGAM3 HOST TARGET PROTEIN, all of FIG. 1.

VGAM2736 RNA, herein schematically represented by VGAM1 RNA through VGAM3 RNA, binds complementarily to a host target binding site located in an untranslated region of VGAM2736 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2736 host target RNA into VGAM2736 host target protein, herein schematically represented by VGAM1 HOST TARGET PROTEIN through VGAM3 HOST TARGET PROTEIN, all of FIG. 1.

VGAM2737 RNA, herein schematically represented by VGAM1 RNA through VGAM3 RNA, binds complementarily to a host target binding site located in an untranslated region of VGAM2737 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2737 host target RNA into VGAM2737 host target protein, herein schematically represented by VGAM1 HOST TARGET PROTEIN through VGAM3 HOST TARGET PROTEIN, all of FIG. 1.

VGAM2738 RNA, herein schematically represented by VGAM1 RNA through VGAM3 RNA, binds complementarily to a host target binding site located in an untranslated region of VGAM2738 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2738 host target RNA into VGAM2738 host target protein, herein schematically represented by VGAM1 HOST TARGET PROTEIN through VGAM3 HOST TARGET PROTEIN, all of FIG. 1.

It is appreciated that a function of VGR3297 gene, herein designated VGR GENE, is inhibition of expression of host target genes, as part of a novel viral mechanism of attacking a host. Accordingly, utilities of VGR3297 gene include diagnosis, prevention and treatment of viral infection by Broad Bean Necrosis Virus. Specific functions, and accordingly utilities, of VGR3297 gene correlate with, and may be deduced from, the identity of the host target genes, which are inhibited by VGAM RNAs comprised in the 'operon-like' cluster of VGR3297 gene: VGAM2733 host target protein, VGAM2734 host target protein, VGAM2735 host target protein, VGAM2736 host target protein, VGAM2737 host target protein and VGAM2738 host target protein, herein schematically represented by VGAM1 HOST TARGET PROTEIN through VGAM3 HOST TARGET PROTEIN. The function of these host target genes is elaborated hereinabove with reference to VGAM2733, VGAM2734, VGAM2735, VGAM2736, VGAM2737 and VGAM2738. FIG. 1 further provides a conceptual description of a novel bioinformatically detected viral gene of the present invention, referred to here as Viral Genomic Address Messenger 15 (VGAM15) viral gene, which modulates expression of respective host target genes thereof, the function and utility of which host target genes is known in the art.

VGAM15 is a novel bioinformatically detected regulatory, non protein coding, viral micro RNA (miRNA) gene. The method by which VGAM15 was detected is described hereinabove with reference to FIGS. 1-8.

VGAM15 gene, herein designated VGAM GENE, is a viral gene contained in the genome of Human Herpesvirus 7. VGAM15 host target gene, herein designated VGAM HOST TARGET GENE, is a human gene contained in the human genome.

VGAM15 gene encodes a VGAM15 precursor RNA, herein designated VGAM PRECURSOR RNA. Similar to other miRNA genes, and unlike most ordinary genes, VGAM15 precursor RNA does not encode a protein. A nucleotide sequence identical or highly similar to the nucleotide sequence of VGAM15 precursor RNA is designated SEQ ID:1, and is provided hereinbelow with reference to the sequence listing part. Nucleotide sequence SEQ ID:1 is located at position 94429 relative to the genome of Human Herpesvirus 7.

VGAM15 precursor RNA folds onto itself, forming VGAM15 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM15 folded precursor RNA into VGAM15 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM15 RNA is designated SEQ ID:2726, and is provided hereinbelow with reference to the sequence listing part.

VGAM15 host target gene, herein designated VGAM HOST TARGET GENE, encodes a corresponding messenger RNA, VGAM15 host target RNA, herein designated VGAM HOST TARGET RNA. VGAM15 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM15 RNA, herein designated VGAM RNA, binds complementarily to one or more host target binding sites located in untranslated regions of VGAM15 host target RNA, herein designated VGAM HOST TARGET RNA. This complementary binding is due to the fact that the nucleotide sequence of VGAM15 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM15 RNA, herein designated VGAM RNA, may have a different number of host target binding sites in untranslated regions of a VGAM15 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM15 RNA, herein designated VGAM RNA, to host target binding sites on VGAM15 host target RNA, herein designated VGAM HOST TARGET RNA, such as BINDING SITE I, BINDING SITE II and BINDING SITE III, inhibits translation of VGAM15 host target RNA into VGAM15 host target protein, herein designated VGAM HOST TARGET PROTEIN. VGAM host target protein is therefore outlined by a broken line.

It is appreciated that VGAM15 host target gene, herein designated VGAM HOST TARGET GENE, in fact represents a plurality of VGAM15 host target genes. The mRNA of each one of this plurality of VGAM15 host target genes comprises one or more host target binding sites, each having a nucleotide sequence which is at least partly complementary to VGAM15 RNA, herein designated VGAM RNA, and which when bound by VGAM15 RNA causes inhibition of translation of respective one or more VGAM15 host target proteins.

It is further appreciated by one skilled in the art that the mode of translational inhibition illustrated by FIG. 1 with specific reference to translational inhibition exerted by VGAM15 gene, herein designated VGAM GENE, on one or more VGAM15 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM15 is inhibition of expression of host target genes, as part of a novel viral mechanism of attacking a host. Accordingly, utilities of VGAM15 include diagnosis, prevention and treatment of viral infection by Human Herpesvirus 7. Specific functions, and accordingly utilities, of VGAM15 correlate with, and may be deduced from, the identity of the host target genes which VGAM15 binds and inhibits, and the function of these host target genes, as elaborated hereinbelow.

Nucleotide sequences of the VGAM15 precursor RNA, herein designated VGAM PRECURSOR RNA, and of the 'diced' VGAM15 RNA, herein designated VGAM RNA, and a schematic representation of the secondary folding of VGAM15 folded precursor RNA, herein designated VGAM FOLDED PRECURSOR RNA, of VGAM15 are further described hereinbelow with reference to Table 1.

Nucleotide sequences of host target binding sites, such as BINDING SITE-I, BINDING SITE-II and BINDING SITE-III of FIG. 1, found on VGAM15 host target RNA, and schematic representation of the complementarity of each of these host target binding sites to VGAM15 RNA, herein designated VGAM RNA, are described hereinbelow with reference to Table 2.

As mentioned hereinabove with reference to FIG. 1, a function of VGAM15 gene, herein designated VGAM is inhibition of expression of VGAM15 target genes. It is appreciated that specific functions, and accordingly utilities, of VGAM15 correlate with, and may be deduced from, the identity of the target genes which VGAM15 binds and inhibits, and the function of these target genes, as elaborated hereinbelow.

DKFZp761D221 (Accession NM_032291) is a VGAM15 host target gene. DKFZp761D221 BINDING SITE is HOST TARGET binding site found in the 3' untranslated region of mRNA encoded by DKFZp761D221, corresponding to a HOST TARGET binding site such as BINDING SITE I, BINDING SITE II or BINDING SITE III. Table 2 illustrates the complementarity of the nucleotide sequences of DKFZp761D221 BINDING SITE, designated SEQ ID:26056, to the nucleotide sequence of VGAM15 RNA, herein designated VGAM RNA, also designated SEQ ID:2726.

A function of VGAM15 is therefore inhibition of DKFZp761D221 (Accession NM_032291). Accordingly, utilities of VGAM15 include diagnosis, prevention and treatment of diseases and clinical conditions associated with DKFZp761D221. KIAA0217 (Accession XM_040265) is another VGAM15 host target gene. KIAA0217 BINDING SITE is HOST TARGET binding site found in the 3' untranslated region of mRNA encoded by KIAA0217, corresponding to a HOST TARGET binding site such as BINDING SITE I, BINDING SITE II or BINDING SITE III. Table 2 illustrates the complementarity of the nucleotide sequences of KIAA0217 BINDING SITE, designated SEQ ID:33284, to the nucleotide sequence of VGAM15 RNA, herein designated VGAM RNA, also designated SEQ ID:2726.

Another function of VGAM15 is therefore inhibition of KIAA0217 (Accession XM_040265). Accordingly, utilities of VGAM15 include diagnosis, prevention and treatment of diseases and clinical conditions associated with KIAA0217. SFRS Protein Kinase 2 (SRPK2, Accession NM_003138) is another VGAM15 host target gene. SRPK2 BINDING SITE is HOST TARGET binding site found in the 3' untranslated region of mRNA encoded by SRPK2, corresponding to a HOST TARGET binding site such as BINDING SITE I, BINDING SITE II or BINDING SITE III. Table 2 illustrates the complementarity of the nucleotide sequences of SRPK2 BINDING SITE, designated SEQ ID:9111, to the nucleotide sequence of VGAM15 RNA, herein designated VGAM RNA, also designated SEQ ID:2726.

Another function of VGAM15 is therefore inhibition of SFRS Protein Kinase 2 (SRPK2, Accession NM_003138). Accordingly, utilities of VGAM15 include diagnosis, prevention and treatment of diseases and clinical conditions associated with SRPK2. T-cell Leukemia/lymphoma 6 (TCL6, Accession NM_012468) is another VGAM15 host target gene. TCL6 BINDING SITE1 and TCL6 BINDING SITE2 are HOST TARGET binding sites found in untranslated regions of mRNA encoded by TCL6, corresponding to HOST TARGET binding sites such as BINDING SITE I, BINDING SITE II or BINDING SITE III. Table 2 illustrates the complementarity of the nucleotide sequences of TCL6 BINDING SITE1 and TCL6 BINDING SITE2, designated SEQ ID:14839 and SEQ ID:21756 respectively, to the nucleotide sequence of VGAM15 RNA, herein designated VGAM RNA, also designated SEQ ID:2726.

Another function of VGAM15 is therefore inhibition of T-cell Leukemia/lymphoma 6 (TCL6, Accession NM_012468). Accordingly, utilities of VGAM15 include diagnosis, prevention and treatment of diseases and clinical conditions associated with TCL6. LOC220776 (Accession XM_043388) is another VGAM15 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33933, to the nucleotide sequence of VGAM15 RNA, herein designated VGAM RNA, also designated SEQ ID:2726.

Another function of VGAM15 is therefore inhibition of LOC220776 (Accession XM_043388). Accordingly, utilities of VGAM15 include diagnosis, prevention and treatment of diseases and clinical conditions associated with LOC220776. FIG. 1 further provides a conceptual description of a novel bioinformatically detected viral gene of the present invention, referred to here as Viral Genomic Address Messenger 16 (VGAM16) viral gene, which modulates expression of respective host target genes thereof, the function and utility of which host target genes is known in the art.

VGAM16 is a novel bioinformatically detected regulatory, non protein coding, viral micro RNA (miRNA) gene. The method by which VGAM16 was detected is described hereinabove with reference to FIGS. 1-8.

VGAM16 gene, herein designated VGAM GENE, is a viral gene contained in the genome of Human Herpesvirus 7. VGAM16 host target gene, herein designated VGAM HOST TARGET GENE, is a human gene contained in the human genome.

VGAM16 gene encodes a VGAM16 precursor RNA, herein designated VGAM PRECURSOR RNA. Similar to other miRNA genes, and unlike most ordinary genes, VGAM16 precursor RNA does not encode a protein. A nucleotide sequence identical or highly similar to the nucleotide sequence of VGAM16 precursor RNA is designated SEQ ID:2, and is provided hereinbelow with reference to the sequence listing part. Nucleotide sequence SEQ ID:2 is located at position 93652 relative to the genome of Human Herpesvirus 7.

VGAM16 precursor RNA folds onto itself, forming VGAM16 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM16 folded precursor RNA into VGAM16 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM16 RNA is designated SEQ ID:2727, and is provided hereinbelow with reference to the sequence listing part.

VGAM16 host target gene, herein designated VGAM HOST TARGET GENE, encodes a corresponding messenger RNA, VGAM16 host target RNA, herein designated VGAM HOST TARGET RNA. VGAM16 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM16 RNA, herein designated VGAM RNA, binds complementarily to one or more host target binding sites located in untranslated regions of VGAM16 host target RNA, herein designated VGAM HOST TARGET RNA. This complementary binding is due to the fact that the nucleotide sequence of VGAM16 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM16 RNA, herein designated VGAM RNA, may have a different number of host target binding sites in untranslated regions of a VGAM16 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM16 RNA, herein designated VGAM RNA, to host target binding sites on VGAM16 host target RNA, herein designated VGAM HOST TARGET RNA, such as BINDING SITE I, BINDING SITE II and BINDING SITE III, inhibits translation of VGAM16 host target RNA into VGAM16 host target protein, herein designated VGAM HOST TARGET PROTEIN. VGAM host target protein is therefore outlined by a broken line.

It is appreciated that VGAM16 host target gene, herein designated VGAM HOST TARGET GENE, in fact represents a plurality of VGAM16 host target genes. The mRNA of each one of this plurality of VGAM16 host target genes comprises one or more host target binding sites, each having a nucleotide sequence which is at least partly complementary to VGAM16 RNA, herein designated VGAM RNA, and which when bound by VGAM16 RNA causes inhibition of translation of respective one or more VGAM16 host target proteins.

It is further appreciated by one skilled in the art that the mode of translational inhibition illustrated by FIG. 1 with specific reference to translational inhibition exerted by VGAM16 gene, herein designated VGAM GENE, on one or more VGAM16 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM16 is inhibition of expression of host target genes, as part of a novel viral mechanism of attacking a host. Accordingly, utilities of VGAM16 include diagnosis, prevention and treatment of viral infection by Human Herpesvirus 7. Specific functions, and accordingly utilities, of VGAM16 correlate with, and may be deduced from, the identity of the host target genes which VGAM16 binds and inhibits, and the function of these host target genes, as elaborated hereinbelow.

Nucleotide sequences of the VGAM16 precursor RNA, herein designated VGAM PRECURSOR RNA, and of the 'diced' VGAM16 RNA, herein designated VGAM RNA, and a schematic representation of the secondary folding of VGAM16 folded precursor RNA, herein designated VGAM FOLDED PRECURSOR RNA, of VGAM16 are further described hereinbelow with reference to Table 1.

Nucleotide sequences of host target binding sites, such as BINDING SITE-I, BINDING SITE-II and BINDING SITE-III of FIG. 1, found on VGAM16 host target RNA, and schematic representation of the complementarity of each of these host target binding sites to VGAM16 RNA, herein designated VGAM RNA, are described hereinbelow with reference to Table 2.

As mentioned hereinabove with reference to FIG. 1, a function of VGAM16 gene, herein designated VGAM is inhibition of expression of VGAM16 target genes. It is appreciated that specific functions, and accordingly utilities, of VGAM16 correlate with, and may be deduced from, the identity of the target genes which VGAM16 binds and inhibits, and the function of these target genes, as elaborated hereinbelow.

Protein Kinase, CGMP-dependent, Type II (PRKG2, Accession NM_006259) is a VGAM16 host target gene. PRKG2 BINDING SITE is HOST TARGET binding site found in the 3' untranslated region of mRNA encoded by PRKG2, corresponding to a HOST TARGET binding site such as BINDING SITE I, BINDING SITE II or BINDING SITE III. Table 2 illustrates the complementarity of the nucleotide sequences of PRKG2 BINDING SITE, designated SEQ ID:12940, to the nucleotide sequence of VGAM16 RNA, herein designated VGAM RNA, also designated SEQ ID:2727.

A function of VGAM16 is therefore inhibition of Protein Kinase, CGMP-dependent, Type II (PRKG2, Accession NM_006259), a gene which regulate a great variety of functions, including smooth muscle relaxation, neuronal excitability, and epithelial electrolyte transport. Accordingly, utilities of VGAM16 include diagnosis, prevention and treatment of diseases and clinical conditions associated with PRKG2. The function of PRKG2 has been established by previous studies. Nitric oxide (NO) and a broad spectrum of hormones, drugs, and toxins raise intracellular cGMP concentrations and thereby regulate a great variety of functions, including smooth muscle relaxation, neuronal excitability, and epithelial electrolyte transport. Pfeifer et al. (1996) noted that depending on the tissue, the increase in cGMP concentrations leads to the activation of different receptors, such as cyclic nucleotide phosphodiesterases. The identification of the physiologic mediator of cGMP is complicated by the existence of 2 forms of cGMP-dependent protein kinase (cGK), types I (see OMIM Ref. No. 176894) and II, which are encoded by distinct genes. Smooth muscle, platelets, and cerebellum contain high concentrations of cGK-I, whereas cGK-II is highly concentrated in brain, lung, and intestinal mucosa. The function of cGK-II is not well understood, although there is evidence that it mediates intestinal secretion of water and electrolytes induced by the E. coli toxin STa and the intestinal peptide guanylin (OMIM Ref. No. 139392). To investigate the physiologic roles of cGK-II, Pfeifer et al. (1996) engineered a homozygous null mutation of the gene in mice by gene targeting. Mice deficient in cGK-II were resistant to E. coli STa and developed dwarfism that was caused by a severe defect in endochondral ossification at the growth plates. Membranous ossification was unaffected. Immunohistochemical staining showed a predominant expression of cGK-II in the late proliferative and early hypertrophic chondrocytes of the growth plate. Pfeifer et al. (1996) performed experiments with explanted bones from mutant and normal mice showing that the growth defect was intrinsic to the bone and not due to a general metabolic disturbance. The results indicated to the authors the central role played by cGK-II in diverse physiologic processes. Pfeifer et al. (1996) stated that identification of the pathway that mediates intestinal fluid secretion by E. coli STa has potential medical implications because STa causes traveler's diarrhea and about 50% of infant mortality in developing countries. Orstavik et al. (1996) cloned a human cDNA encoding type II cGK by using the mouse type II cGK cDNA to probe a cerebellum cDNA library. The 762-amino acid human type II cGK protein is 96% identical to the mouse and rat type II cGK proteins. Human type II cGK is expressed as a 6-kb mRNA in prostate, small intestine, and colon and as a 4.4-kb mRNA in thymus and prostate. By PCR and Southern blotting of somatic cell hybrid panels, the authors mapped the human type II cGK gene to 4q13.1-q21.1.

Full details of the abovementioned studies are described in the following publications, the disclosure of which are hereby incorporated by reference:

Orstavik, S.; Solberg, R.; Tasken, K.; Nordahl, M.; Altherr, M. R.; Hansson, V.; Jahnsen, T.; Sandberg, M.: Molecular cloning, cDNA structure, and chromosomal localization of the human type II cGMP-dependent protein kinase. Biochem. Biophys. Res. Commun. 220:759-765, 1996; and Pfeifer, A.; Aszodi, A.; Seidler, U.; Ruth, P.; Hofmann, F.; Fassler, R.: Intestinal secretory defects and dwarfism in mice lacking cGMP-dependent protein kinase II. Science 274:2082.

Further studies establishing the function and utilities of PRKG2 are found in John Hopkins OMIM database record ID 601591, and in sited publications numbered 1284-1285 listed in the bibliography section hereinbelow, which are also hereby incorporated by reference. DKFZp761P1010 (Accession NM_018423) is another VGAM16 host target gene. DKFZp761P1010 BINDING SITE is HOST TARGET binding site found in the 3' untranslated region of mRNA encoded by DKFZp761P1010, corresponding to a HOST TARGET binding site such as BINDING SITE I, BINDING SITE II or BINDING SITE III. Table 2 illustrates the complementarity of the nucleotide sequences of DKFZp761P1010 BINDING SITE, designated SEQ ID:20478, to the nucleotide sequence of VGAM16 RNA, herein designated VGAM RNA, also designated SEQ ID:2727.

Another function of VGAM16 is therefore inhibition of DKFZp761P1010 (Accession NM_018423). Accordingly, utilities of VGAM16 include diagnosis, prevention and treatment of diseases and clinical conditions associated with DKFZp761P1010. FLJ11996 (Accession NM_024976) is another VGAM16 host target gene. FLJ11996 BINDING SITE is HOST TARGET binding site found in the 3' untranslated region of mRNA encoded by FLJ11996, corresponding to a HOST TARGET binding site such as BINDING SITE I, BINDING SITE II or BINDING SITE III. Table 2 illustrates the complementarity of the nucleotide sequences of FLJ11996 BINDING SITE, designated SEQ ID:24534, to the nucleotide sequence of VGAM16 RNA, herein designated VGAM RNA, also designated SEQ ID:2727.

Another function of VGAM16 is therefore inhibition of FLJ11996 (Accession NM_024976). Accordingly, utilities of VGAM16 include diagnosis, prevention and treatment of diseases and clinical conditions associated with FLJ11996. LOC200269 (Accession XM_114175) is another VGAM16 host target gene. LOC200269 BINDING SITE is HOST TARGET binding site found in the 3' untranslated region of mRNA encoded by LOC200269, corresponding to a HOST TARGET binding site such as BINDING SITE I, BINDING SITE II or BINDING SITE III. Table 2 illustrates the complementarity of the nucleotide sequences of LOC200269 BINDING SITE, designated SEQ ID:42761, to the nucleotide sequence of VGAM16 RNA, herein designated VGAM RNA, also designated SEQ ID:2727.

Another function of VGAM16 is therefore inhibition of LOC200269 (Accession XM_114175). Accordingly, utilities of VGAM16 include diagnosis, prevention and treatment of diseases and clinical conditions associated with LOC200269. FIG. 1 further provides a conceptual description of a novel bioinformatically detected viral gene of the present invention, referred to here as Viral Genomic Address Messenger 17 (VGAM17) viral gene, which modulates expression of respective host target genes thereof, the function and utility of which host target genes is known in the art.

VGAM17 is a novel bioinformatically detected regulatory, non protein coding, viral micro RNA (miRNA) gene. The method by which VGAM17 was detected is described hereinabove with reference to FIGS. 1-8.

VGAM17 gene, herein designated VGAM GENE, is a viral gene contained in the genome of Ictalurid Herpesvirus 1. VGAM17 host target gene, herein designated VGAM HOST TARGET GENE, is a human gene contained in the human genome.

VGAM17 gene encodes a VGAM17 precursor RNA, herein designated VGAM PRECURSOR RNA. Similar to other miRNA genes, and unlike most ordinary genes, VGAM17 precursor RNA does not encode a protein. A nucleotide sequence identical or highly similar to the nucleotide sequence of VGAM17 precursor RNA is designated SEQ ID:3, and is provided hereinbelow with reference to the sequence listing part. Nucleotide sequence SEQ ID:3 is located at position 86456 relative to the genome of Ictalurid Herpesvirus 1.

VGAM17 precursor RNA folds onto itself, forming VGAM17 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM17 folded precursor RNA into VGAM17 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM17 RNA is designated SEQ ID:2728, and is provided hereinbelow with reference to the sequence listing part.

VGAM17 host target gene, herein designated VGAM HOST TARGET GENE, encodes a corresponding messenger RNA, VGAM17 host target RNA, herein designated VGAM HOST TARGET RNA. VGAM17 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM17 RNA, herein designated VGAM RNA, binds complementarily to one or more host target binding sites located in untranslated regions of VGAM17 host target RNA, herein designated VGAM HOST TARGET RNA. This complementary binding is due to the fact that the nucleotide sequence of VGAM17 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM17 RNA, herein designated VGAM RNA, may have a different number of host target binding sites in untranslated regions of a VGAM17 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM17 RNA, herein designated VGAM RNA, to host target binding sites on VGAM17 host target RNA, herein designated VGAM HOST TARGET RNA, such as BINDING SITE I, BINDING SITE II and BINDING SITE III, inhibits translation of VGAM17 host target RNA into VGAM17 host target protein, herein designated VGAM HOST TARGET PROTEIN. VGAM host target protein is therefore outlined by a broken line.

It is appreciated that VGAM17 host target gene, herein designated VGAM HOST TARGET GENE, in fact represents a plurality of VGAM17 host target genes. The mRNA of each one of this plurality of VGAM17 host target genes comprises one or more host target binding sites, each having a nucleotide sequence which is at least partly complementary to VGAM17 RNA, herein designated VGAM RNA, and which when bound by VGAM17 RNA causes inhibition of translation of respective one or more VGAM17 host target proteins.

It is further appreciated by one skilled in the art that the mode of translational inhibition illustrated by FIG. 1 with specific reference to translational inhibition exerted by VGAM17 gene, herein designated VGAM GENE, on one or more VGAM17 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM17 is inhibition of expression of host target genes, as part of a novel viral mechanism of attacking a host. Accordingly, utilities of VGAM17 include diagnosis, prevention and treatment of viral infection by Ictalurid Herpesvirus 1. Specific functions, and accordingly utilities, of VGAM17 correlate with, and may be deduced from, the identity of the host target genes which VGAM17 binds and inhibits, and the function of these host target genes, as elaborated hereinbelow.

Nucleotide sequences of the VGAM17 precursor RNA, herein designated VGAM PRECURSOR RNA, and of the 'diced' VGAM17 RNA, herein designated VGAM RNA, and a schematic representation of the secondary folding of VGAM17 folded precursor RNA, herein designated VGAM FOLDED PRECURSOR RNA, of VGAM17 are further described hereinbelow with reference to Table 1.

Nucleotide sequences of host target binding sites, such as BINDING SITE-I, BINDING SITE-II and BINDING SITE-III of FIG. 1, found on VGAM17 host target RNA, and schematic representation of the complementarity of each of these host target binding sites to VGAM17 RNA, herein designated VGAM RNA, are described hereinbelow with reference to Table 2.

As mentioned hereinabove with reference to FIG. 1, a function of VGAM17 gene, herein designated VGAM is inhibition of expression of VGAM17 target genes. It is appreciated that specific functions, and accordingly utilities, of VGAM17 correlate with, and may be deduced from, the identity of the target genes which VGAM17 binds and inhibits, and the function of these target genes, as elaborated hereinbelow.

A Kinase (PRKA) Anchor Protein 13 (AKAP13, Accession XM_116974) is a VGAM17 host target gene. AKAP13 BINDING SITE is HOST TARGET binding site found in the 3' untranslated region of mRNA encoded by AKAP13, corresponding to a HOST TARGET binding site such as BINDING SITE I, BINDING SITE II or BINDING SITE III. Table 2 illustrates the complementarity of the nucleotide sequences of AKAP13 BINDING SITE, designated SEQ ID:43174, to the nucleotide sequence of VGAM17 RNA, herein designated VGAM RNA, also designated SEQ ID:2728.

A function of VGAM17 is therefore inhibition of A Kinase (PRKA) Anchor Protein 13 (AKAP13, Accession XM_116974), a gene which regulates subcellular localization of type II cAMP-dependent PKA. Accordingly, utilities of VGAM17 include diagnosis, prevention and treatment of diseases and clinical conditions associated with AKAP13. The function of AKAP13 has been established by previous studies. Gene map locus 15q24-q25 A-kinase anchor proteins (AKAPs; OMIM Ref. No. 602449), such as AKAP13, direct the activity of protein kinase A (PKA; OMIM Ref. No. 176911) by tethering the enzyme near its physiologic substrates. AKAP13 is also known as LBC. Catalytic GDP-GTP exchange factors (GEFs), such as LBC, play an important role in regulating the Rho/Rac GTPase cycle. The Rho/Rac family of small GTPases mediates cytoskeletal reorganization, gene transcription, and cell cycle progression through unique signal transduction pathways. By probing a breast cancer expression library using an interaction cloning strategy for proteins that bind RXR (see OMIM Ref. No. 180245), Rubino et al. (1998) obtained a full-length cDNA encoding LBC, which they called BRX (breast cancer cDNA-encoded nuclear receptor-binding auxiliary protein). The deduced 1,428-amino acid BRX protein contains a region of identity to the LBC sequence identified by Toksoz and Williams (1994) that is preceded by 3 novel regions. A fifth, C-terminal region binds the estrogen receptor (ESR1; 133430). In addition to the tissues detected by Toksoz and Williams (1994), Northern blot analysis by Rubino et al. (1998) revealed BRX mRNA expression in reproductive tissues (ovary and placenta), and a 5.3-kb BRX transcript was detected in breast cancer cell lines, normal breast, and testis. Western blot and immunohistochemic analysis showed that BRX is expressed as a 170-kD protein in mammary epithelial cell lobules and terminal ducts. Binding analysis determined that BRX binds to ESR1, RXR, PPAR (OMIM Ref. No. 170998), and THR (see OMIM Ref. No. 190120). Regions 4 and 5 of BRX were shown to bind independently to the ligand-binding domain near the C terminus of ESR1 without the requirement of other bridging proteins. Overexpression of BRX in the presence of estrogen augmented the activity of an estrogen response element. ESR activation by BRX could be inhibited by a dominant-negative mutant of CDC42 (OMIM Ref. No. 116952). By genomic sequence and somatic cell hybrid analyses, Sterpetti et al. (1999) determined that proto-LBC and onco-LBC both contain N-terminal DH and PH domains; however, proto-LBC has a distinct C terminus absent in the oncoprotein. FISH with onco-LBC probes localized the LBC gene to 15q24-q25 and showed that onco-LBC represents a chimera derived from fusion with an unrelated sequence on 7q36. Northern blot analysis detected variably sized LBC transcripts and extended the known tissue distribution to spleen and a number of cancer cell lines. Immunoblot and thin-layer chromatography analysis showed that both proto- and onco-LBC can promote the formation of GTP-bound RHOA (ARHA; 165390). Mutation analysis indicated that the transforming activity of proto-LBC is increased by truncation of the C terminus, and that the DH and PH domains, but not the chromosome 7 sequence, are required for transformation. Immunoblot analysis determined that the proto-LBC form is in the membrane fraction, while the majority of the onco-LBC product is cytosolic, indicating that the C terminus may play a major role in the subcellular localization and regulation of LBC. Using FISH with onco-LBC probes, Sterpetti et al. (1999) localized the LBC gene to 15q24-q25 and showed that onco-LBC represents a chimera derived from fusion with an unrelated sequence on 7q36.

Full details of the abovementioned studies are described in the following publications, the disclosure of which are hereby incorporated by reference:

Rubino, D.; Driggers, P.; Arbit, D.; Kemp, L.; Miller, B.; Coso, O.; Pagliai, K.; Gray, K.; Gutkind, S.; Segars, J.: Characterization of Brx, a novel Dbl family member that modulates estrogen receptor action. Oncogene 16:2513-2526, 1998; and Sterpetti, P.; Hack, A. A.; Bashar, M. P.; Park, B.; Cheng, S.-D.; Knoll, J. H. M.; Urano, T.; Feig, L. A.; Toksoz, D.: Activation of the Lbc Rho exchange factor proto-oncogene by trunc.

Further studies establishing the function and utilities of AKAP13 are found in John Hopkins OMIM database record ID 604686, and in sited publications numbered 4378-4382 listed in the bibliography section hereinbelow, which are also hereby incorporated by reference. DKFZP434N014 (Accession XM_027012) is another VGAM17 host target gene. DKFZP434N014 BINDING SITE is HOST TARGET binding site found in the 3' untranslated region of mRNA encoded by DKFZP434N014, corresponding to a HOST TARGET binding site such as BINDING SITE I, BINDING SITE II or BINDING SITE III. Table 2 illustrates the complementarity of the nucleotide sequences of DKFZP434N014 BINDING SITE, designated SEQ ID:30388, to the nucleotide sequence of VGAM17 RNA, herein designated VGAM RNA, also designated SEQ ID:2728.

Another function of VGAM17 is therefore inhibition of DKFZP434N014 (Accession XM_027012). Accordingly, utilities of VGAM17 include diagnosis, prevention and treatment of diseases and clinical conditions associated with DKFZP434N014. FLJ23598 (Accession NM_024783) is another VGAM17 host target gene. FLJ23598 BINDING SITE is HOST TARGET binding site found in the 3' untranslated region of mRNA encoded by FLJ23598, corresponding to a HOST TARGET binding site such as BINDING SITE I, BINDING SITE II or BINDING SITE III. Table 2 illustrates the complementarity of the nucleotide sequences of FLJ23598 BINDING SITE, designated SEQ ID:24152, to the nucleotide sequence of VGAM17 RNA, herein designated VGAM RNA, also designated SEQ ID:2728.

Another function of VGAM17 is therefore inhibition of FLJ23598 (Accession NM_024783). Accordingly, utilities of VGAM17 include diagnosis, prevention and treatment of diseases and clinical conditions associated with FLJ23598. LOC149086 (Accession XM_097580) is another VGAM17 host target gene. LOC149086 BINDING SITE is HOST TARGET binding site found in the 3' untranslated region of mRNA encoded by LOC149086, corresponding to a HOST TARGET binding site such as BINDING SITE I, BINDING SITE II or BINDING SITE III. Table 2 illustrates the complementarity of the nucleotide sequences of LOC149086 BINDING SITE, designated SEQ ID:40945, to the nucleotide sequence of VGAM17 RNA, herein designated VGAM RNA, also designated SEQ ID:2728.

Another function of VGAM17 is therefore inhibition of LOC149086 (Accession XM_097580). Accordingly, utilities of VGAM17 include diagnosis, prevention and treatment of diseases and clinical conditions associated with LOC149086. LOC92568 (Accession XM_045852) is another VGAM17 host target gene. LOC92568 BINDING SITE is HOST TARGET binding site found in the 3' untranslated region of mRNA encoded by LOC92568, corresponding to a HOST TARGET binding site such as BINDING SITE I, BINDING SITE II or BINDING SITE III. Table 2 illustrates the complementarity of the nucleotide sequences of LOC92568 BINDING SITE, designated SEQ ID:34572, to the nucleotide sequence of VGAM17 RNA, herein designated VGAM RNA, also designated SEQ ID:2728.

Another function of VGAM17 is therefore inhibition of LOC92568 (Accession XM_045852). Accordingly, utilities of VGAM17 include diagnosis, prevention and treatment of diseases and clinical conditions associated with LOC92568. FIG. 1 further provides a conceptual description of a novel bioinformatically detected viral gene of the present invention, referred to here as Viral Genomic Address Messenger 18 (VGAM18) viral gene, which modulates expression of respective host target genes thereof, the function and utility of which host target genes is known in the art.

VGAM18 is a novel bioinformatically detected regulatory, non protein coding, viral micro RNA (miRNA) gene. The method by which VGAM18 was detected is described hereinabove with reference to FIGS. 1-8.

VGAM18 gene, herein designated VGAM GENE, is a viral gene contained in the genome of Invertebrate Iridescent Virus 6. VGAM18 host target gene, herein designated VGAM HOST TARGET GENE, is a human gene contained in the human genome.

VGAM18 gene encodes a VGAM18 precursor RNA, herein designated VGAM PRECURSOR RNA. Similar to other miRNA genes, and unlike most ordinary genes, VGAM18 precursor RNA does not encode a protein. A nucleotide sequence identical or highly similar to the nucleotide sequence of VGAM18 precursor RNA is designated SEQ ID:4, and is provided hereinbelow with reference to the sequence listing part. Nucleotide sequence SEQ ID:4 is located at position 79665 relative to the genome of Invertebrate Iridescent Virus 6.

VGAM18 precursor RNA folds onto itself, forming VGAM18 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM18 folded precursor RNA into VGAM18 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM18 RNA is designated SEQ ID:2729, and is provided hereinbelow with reference to the sequence listing part.

VGAM18 host target gene, herein designated VGAM HOST TARGET GENE, encodes a corresponding messenger RNA, VGAM18 host target RNA, herein designated VGAM HOST TARGET RNA. VGAM18 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM18 RNA, herein designated VGAM RNA, binds complementarily to one or more host target binding sites located in untranslated regions of VGAM18 host target RNA, herein designated VGAM HOST TARGET RNA. This complementary binding is due to the fact that the nucleotide sequence of VGAM18 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM18 RNA, herein designated VGAM RNA, may have a different number of host target binding sites in untranslated regions of a VGAM18 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM18 RNA, herein designated VGAM RNA, to host target binding sites on VGAM18 host target RNA, herein designated VGAM HOST TARGET RNA, such as BINDING SITE I, BINDING SITE II and BINDING SITE III, inhibits translation of VGAM18 host target RNA into VGAM18 host target protein, herein designated VGAM HOST TARGET PROTEIN. VGAM host target protein is therefore outlined by a broken line.

It is appreciated that VGAM18 host target gene, herein designated VGAM HOST TARGET GENE, in fact represents a plurality of VGAM18 host target genes. The mRNA of each one of this plurality of VGAM18 host target genes comprises one or more host target binding sites, each having a nucleotide sequence which is at least partly complementary to VGAM18 RNA, herein designated VGAM RNA, and which when bound by VGAM18 RNA causes inhibition of translation of respective one or more VGAM18 host target proteins.

It is further appreciated by one skilled in the art that the mode of translational inhibition illustrated by FIG. 1 with specific reference to translational inhibition exerted by VGAM18 gene, herein designated VGAM GENE, on one or more VGAM18 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM18 is inhibition of expression of host target genes, as part of a novel viral mechanism of attacking a host. Accordingly, utilities of VGAM18 include diagnosis, prevention and treatment of viral infection by Invertebrate Iridescent Virus 6. Specific functions, and accordingly utilities, of VGAM18 correlate with, and may be deduced from, the identity of the host target genes which VGAM18 binds and inhibits, and the function of these target genes, as elaborated hereinbelow.

Nucleotide sequences of the VGAM18 precursor RNA, herein designated VGAM PRECURSOR RNA, and of the 'diced' VGAM18 RNA, herein designated VGAM RNA, and a schematic representation of the secondary folding of VGAM18 folded precursor RNA, herein designated VGAM FOLDED PRECURSOR RNA, of VGAM18 are further described hereinbelow with reference to Table 1.

Nucleotide sequences of host target binding sites, such as BINDING SITE-I, BINDING SITE-II and BINDING SITE-III of FIG. 1, found on VGAM18 host target RNA, and schematic representation of the complementarity of each of these host target binding sites to VGAM18 RNA, herein designated VGAM RNA, are described hereinbelow with reference to Table 2.

As mentioned hereinabove with reference to FIG. 1, a function of VGAM18 gene, herein designated VGAM is inhibition of expression of VGAM18 target genes. It is appreciated that specific functions, and accordingly utilities, of VGAM18 correlate with, and may be deduced from, the identity of the target genes which VGAM18 binds and inhibits, and the function of these target genes, as elaborated hereinbelow.

A Kinase (PRKA) Anchor Protein 2 (AKAP2, Accession NM_007203) is a VGAM18 host target gene. AKAP2 BINDING SITE is HOST TARGET binding site found in the 3' untranslated region of mRNA encoded by AKAP2, corresponding to a HOST TARGET binding site such as BINDING SITE I, BINDING SITE II or BINDING SITE III. Table 2 illustrates the complementarity of the nucleotide sequences of AKAP2 BINDING SITE, designated SEQ ID:14063, to the nucleotide sequence of VGAM18 RNA, herein designated VGAM RNA, also designated SEQ ID:2729.

A function of VGAM18 is therefore inhibition of A Kinase (PRKA) Anchor Protein 2 (AKAP2, Accession NM_007203), a gene which binds to regulatory subunit (rii) of protein kinase a. Accordingly, utilities of VGAM18 include diagnosis, prevention and treatment of diseases and clinical conditions associated with AKAP2. The function of AKAP2 has been established by previous studies. Gene map locus Chr.9 Protein kinase A (PKA; OMIM Ref. No. 176911) mediates actions of hormones and neurotransmitters that activate adenylate cyclase (see OMIM Ref. No. 103070). Signals carried by cAMP are often directed at discrete intracellular sites. A nonuniform distribution of PKA type II molecules occurs when they are attached to the cytoskeleton by 'A-kinase anchor proteins' (see OMIM Ref. No. AKAP1, 602449). Such anchored molecules may be essential for dissemination of cAMP signals in highly polarized epithelium such as lung and kidney. Using yeast 2-hybrid screening, Dong et al. (1998) isolated cDNAs encoding 6 isoforms of a full-length 885-kD mouse protein which they termed AKAP-KL because of its expression in epithelial cells of kidney and lung. Sequence analysis showed that the isoforms are generated by alternative splicing and by utilization of either of 2 translation start codons. Using affinity chromatography and Western blot analysis, the authors showed that AKAP-KL binds PKA type II in intact cells. By immunoblot analysis of tissue fractions, Dong et al. (1998) found that AKAP-KL is abundantly expressed in lung, moderately expressed in thymus and cerebellum, but absent in heart, cerebral cortex, and liver. Confocal immunofluorescence microscopy revealed that AKAP-KL accumulates in regions of the cortical cytoskeleton in association with F-actin (see OMIM Ref. No. 102610) in human embryonic kidney cells. By radiation hybrid analysis, Nagase et al. (1999) mapped the human AKAP gene, which they called KIAA0920, to chromosome 9.

Full details of the abovementioned studies are described in the following publications, the disclosure of which are hereby incorporated by reference:

Dong, F.; Feldmesser, M.; Casadevall, A.; Rubin, C. S.: Molecular characterization of a cDNA that encodes six isoforms of a novel murine A kinase anchor protein. J. Biol. Chem. 273:6533-6541, 1998; and Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human ge.

Further studies establishing the function and utilities of AKAP2 are found in John Hopkins OMIM database record ID 604582, and in sited publications numbered 494 and 8593 listed in the bibliography section hereinbelow, which are also hereby incorporated by reference. Cysteine-rich Motor Neuron 1 (CRIM1, Accession NM_016441) is another VGAM18 host target gene. CRIM1 BINDING SITE is HOST TARGET binding site found in the 3' untranslated region of mRNA encoded by CRIM1, corresponding to a HOST TARGET binding site such as BINDING SITE I, BINDING SITE II or BINDING SITE III. Table 2 illustrates the complementarity of the nucleotide sequences of CRIM1 BINDING SITE, designated SEQ ID:18561, to the nucleotide sequence of VGAM18 RNA, herein designated VGAM RNA, also designated SEQ ID:2729.

Another function of VGAM18 is therefore inhibition of Cysteine-rich Motor Neuron 1 (CRIM1, Accession NM_016441). Accordingly, utilities of VGAM18 include diagnosis, prevention and treatment of diseases and clinical conditions associated with CRIM1. Cytochrome P450, Subfamily XXVIIB (25-hydroxyvitamin D-1-alpha-hydroxylase), Polypeptide 1 (CYP27B1, Accession NM_000785) is another VGAM18 host target gene. CYP27B1 BINDING SITE is HOST TARGET binding site found in the 3' untranslated region of mRNA encoded by CYP27B1, corresponding to a HOST TARGET binding site such as BINDING SITE I, BINDING SITE II or BINDING SITE III. Table 2 illustrates the complementarity of the nucleotide sequences of CYP27B1 BINDING SITE, designated SEQ ID:6433, to the nucleotide sequence of VGAM18 RNA, herein designated VGAM RNA, also designated SEQ ID:2729.

Another function of VGAM18 is therefore inhibition of Cytochrome P450, Subfamily XXVIIB (25-hydroxyvitamin D-1-alpha-hydroxylase), Polypeptide 1 (CYP27B1, Accession NM_000785). Accordingly, utilities of VGAM18 include diagnosis, prevention and treatment of diseases and clinical conditions associated with CYP27B1. Inducible T-cell Co-stimulator (ICOS, Accession NM_012092) is another VGAM18 host target gene. ICOS BINDING SITE is HOST TARGET binding site found in the 3" untranslated region of mRNA encoded by ICOS, corresponding to a HOST TARGET binding site such as BINDING SITE I, BINDING SITE II or BINDING SITE III. Table 2 illustrates the complementarity of the nucleotide sequences of ICOS BINDING SITE, designated SEQ ID:14383, to the nucleotide sequence of VGAM18 RNA, herein designated VGAM RNA, also designated SEQ ID:2729.

Another function of VGAM18 is therefore inhibition of Inducible T-cell Co-stimulator (ICOS, Accession NM_012092), a gene which forms homodimers and functions as an inducible T-cell co-stimulator. Accordingly, utilities of VGAM18 include diagnosis, prevention and treatment of diseases and clinical conditions associated with ICOS. The function of ICOS has been established by previous studies. The T cell-specific cell surface receptors CD28 (OMIM Ref. No. 186760) and CTLA4 (OMIM Ref. No. 123890) are important regulators of the immune system. CD28 potently enhances those T-cell functions essential for an effective antigen-specific immune response, and CTLA4 counterbalances the CD28-mediated signals and thus prevents an otherwise fatal overstimulation of the lymphoid system. By generating monoclonal antibodies against activated human T cells, Hutloff et al. (1999) identified another member of this family of molecules, 'inducible costimulator,' symbolized ICOS. The ICOS-specific monoclonal antibody did not react with resting human peripheral blood T cells, but stained CD4+ and CD8+ T lymphocytes that had been activated by stimulation of the T-cell antigen receptor complex. Immunoprecipitations defined the ICOS antigen as a disulfide-linked dimer with an apparent relative molecular mass of 55 to 60 kD. Protein purification by SDS-PAGE indicated that ICOS is expressed on the cell surface as a homodimeric protein, with the 2 chains differing only in their posttranslational modification. The full-length ICOS cDNA of 2,641 basepairs was cloned from a MOLT-4V T lymphoblast cDNA library. Northern analysis revealed a single ICOS mRNA species of approximately 2.8 kb in activated human T cells. The open reading frame of ICOS mRNA encodes a protein of 199 amino acids. The ICOS amino acid sequence shares 24% and 17% identity, respectively, with CD28 and CTLA4. The predicted mature ICOS is a type I transmembrane molecule that consists of a single immunoglobulin V-like domain, stabilized by conserved cysteine residues at positions 42 and 109; a transmembrane region of approximately 23 amino acids; and a cytoplasmic tail of 35 amino acids. It shows close structural resemblance to CD28 and CTLA4. The cysteine residue located at position 141 of CD28, also found in CTLA4, is apparently involved in forming the disulfide bridge between the homodimeric chains of these proteins, and is also found in ICOS at position 136. ICOS matches CD28 in potency and enhances all basic T-cell responses to a foreign antigen, namely proliferation, secretion of lymphokines, upregulation of molecules that mediate cell-cell interaction, and effective help for antibody secretion by B cells. Unlike the constitutively expressed CD28, ICOS has to be de novo induced on the T-cell surface and does not upregulate the production of interleukin-2 (IL2; 147680), but superinduces the synthesis of interleukin-10 (IL10; 124092), a B-cell differentiation factor. In vivo, ICOS is highly expressed on tonsillar T cells, which are closely associated with B cells in the apical light zone of germinal centers, the site of terminal B-cell maturation. Yoshinaga et al. (1999) cloned the mouse homolog of ICOS, which they called Crp1 for 'CD28-related protein-1.' Crp1 shares 69% amino acid identity with ICOS. The sequence of ICOS, also known as 'activation-inducible lymphocyte immunomediatory molecule,' or AILIM, has been deposited in GenBank (AB023135). Coyle et al. (2000) showed that ICOS, rather than CD28, plays an important role in the production of both type 1 and type 2 cytokines by recently activated T cells. Akbari et al. (2002) noted that Th1 cells secreting IFNG (OMIM Ref. No. 147570) regulate Th2 cells and may be involved in downregulating Th2-driven airway hyperreactivity and asthma. However, IFNG may also contribute to the severity of disease by exacerbating pulmonary inflammation. After exposure of mice to allergen by the respiratory route, regulatory CD4+ T cells (Tr) developed, producing high levels of IL10, typically considered a Th2 cytokine. The Tr cells downmodulated allergen-induced airway hyperreactivity in previously sensitized mice. Both development and function of the Tr depend on the presence of IL10 and interaction with ICOS expressed on dendritic cells. These dendritic cells also express B7-1 (CD80; 112203) and B7-2 (CD86; 601020). Akbari et al. (2002) suggested that IL10 may initially be involved in the polarization of Th2 responses but plays a regulatory role late in immune responses to attenuate Th2-driven inflammatory activity. Animal model experiments lend further support to the function of ICOS. Tafuri et al. (2001) found that reduced T-cell proliferation in cells from Icos-deficient mice was associated with a marked decrease in expression of CD40LG (OMIM Ref. No. 300386), CD25 (IL2RA; 147730), and CD69 (OMIM Ref. No. 107273). B-cell activation and T cell-independent antibody responses were unimpaired in Icos knockout mice. In contrast to the findings of McAdam et al. (2001), Tafuri et al. (2001) found that only basal levels of IgG1 were significantly reduced in Icos -/- mice; however, they concurred that serum IgG1 and IgG2a levels were reduced, and IgE levels were undetectable after immunization. ELISA assays showed that this class-switching impairment was associated with reduced IL4 production but not with IFNG production. Immunohistochemistry analysis determined that germinal center formation was also reduced in Icos knockout mice, as it is in mice deficient in Cd40lg or Cd28

It is appreciated that the abovementioned animal model for ICOS is acknowledged by those skilled in the art as a scientifically valid animal model, as can be further appreciated from the publications sited hereinbelow.

Full details of the abovementioned studies are described in the following publications, the disclosure of which are hereby incorporated by reference:

Haimila, K. E.; Partanen, J. A.; Holopainen, P. M.: Genetic polymorphism of the human ICOS gene. Immunogenetics 53:1028-1032, 2002; and Tafuri, A.; Shahinian, A.; Bladt, F.; Yoshinaga, S. K.; Jordana, M.; Wakeham, A.; Boucher, L.-M.; Bouchard, D.; Chan, V. S. F.; Duncan, G.; Odermatt, B.; Ho, A.; Itie, A.; Horan, T.; Wh.

Further studies establishing the function and utilities of ICOS are found in John Hopkins OMIM database record ID 604558, and in sited publications numbered 3683, 7380-738 and 2871-2872 listed in the bibliography section hereinbelow, which are also hereby incorporated by reference. Myotubularin Related Protein 2 (MTMR2, Accession NM_016156) is another VGAM18 host target gene. MTMR2 BINDING SITE is HOST TARGET binding site found in the 3' untranslated region of mRNA encoded by MTMR2, corresponding to a HOST TARGET binding site such as BINDING SITE I, BINDING SITE II or BINDING SITE III. Table 2 illustrates the complementarity of the nucleotide sequences of MTMR2 BINDING SITE, designated SEQ ID:18243, to the nucleotide sequence of VGAM18 RNA, herein designated VGAM RNA, also designated SEQ ID:2729.

Another function of VGAM18 is therefore inhibition of Myotubularin Related Protein 2 (MTMR2, Accession NM_016156). Accordingly, utilities of VGAM18 include diagnosis, prevention and treatment of diseases and clinical conditions associated with MTMR2. Myeloid Differentiation Primary Response Gene (88) (MYD88, Accession NM_002468) is another VGAM18 host target gene. MYD88 BINDING SITE is HOST TARGET binding site found in the 3' untranslated region of mRNA encoded by MYD88, corresponding to a HOST TARGET binding site such as BINDING SITE I, BINDING SITE II or BINDING SITE III. Table 2 illustrates the complementarity of the nucleotide sequences of MYD88 BINDING SITE, designated SEQ ID:8296, to the nucleotide sequence of VGAM18 RNA, herein designated VGAM RNA, also designated SEQ ID:2729.

Another function of VGAM18 is therefore inhibition of Myeloid Differentiation Primary Response Gene (88) (MYD88, Accession NM_002468), a gene which is involved in the toll-like receptor and il-1 receptor signaling pathway in the innate immune response. Accordingly, utilities of VGAM18 include diagnosis, prevention and treatment of diseases and clinical conditions associated with MYD88. The function of MYD88 has been established by previous studies. The myeloid differentiation (MyD) marker MyD88 was first characterized during a study of the early genetic responses of murine myeloid cells to various differentiation and growth inhibitory stimuli (Lord et al., 1990). Myeloid differentiation primary response genes are activated in M1 myeloleukemic cells in response to interleukin-6 (IL6; 147620), which induces both growth arrest and terminal differentiation. Hardiman et al. (1997) described the cloning and gene structure of the mouse MyD88 gene. The complete coding sequence spans 5 exons, with the first exon encoding a complete 'death domain' similar to the intracellular segment of TNF receptor-1 (OMIM Ref. No. 191190). Zoo blot analysis demonstrated that it is an evolutionarily conserved gene. Northern blot analysis revealed widespread expression of the gene in many adult mouse tissues, and RT-PCR detected MyD88 mRNA in T- and B-cell lines and differentiating embryonic stem cells. The broad expression pattern demonstrated that mouse Myd88 expression is not restricted to cells of myeloid lineage as was originally believed. Animal model experiments lend further support to the function of MYD88. Adachi et al. (1998) observed that mice with a targeted disruption of the Myd88 gene were unable to respond to IL1 (e.g., 147760), as determined by defective T-cell proliferation and the production of cytokines. Likewise, Myd88-deficient mice were unable to produce gamma-interferon (IFNG; 147570) and mediate natural killer cell activity in response to IL18 (OMIM Ref. No. 600953). NFKB activation in response to IL1 or IL18 was also impaired. These results indicated that MYD88 is a critical component in the IL1R and IL18R (OMIM Ref. No. 604494) signaling cascades. Kawai et al. (1999) extended these studies to show that responses to lipopolysaccharide, mediated by TLR4 and CD14 (OMIM Ref. No. 158120), were lost or delayed in Myd88-deficient mice, establishing that MYD88 is part of the TLR signaling cascade as well, acting just upstream of IRAK.

It is appreciated that the abovementioned animal model for MYD88 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Adachi, O.; Kawai, T.; Takeda, K.; Matsumoto, M.; Tsutsui, H.; Sakagami, M.; Nakanishi, K.; Akira, S.: Targeted disruption of the MyD88 gene results in loss of IL-1- and IL-18-mediated function. Immunity 143-150, 1998; and Hardiman, G.; Jenkins, N. A.; Copeland, N. G.; Gilbert, D. J.; Garcia, D. K.; Naylor, S. L.; Kastelein, R. A.; Bazan, J. F.: Genetic structure and chromosomal mapping of MyD88. Genomics.

Further studies establishing the function and utilities of MYD88 are found in John Hopkins OMIM database record ID 602170, and in sited publications numbered 6349-6352, 12731-635 and 5992-5993 listed in the bibliography section hereinbelow, which are also hereby incorporated by reference. Pyruvate Dehydrogenase Kinase, Isoenzyme 4 (PDK4, Accession XM_173198) is another VGAM18 host target gene. PDK4 BINDING SITE is HOST TARGET binding site found in the 3' untranslated region of mRNA encoded by PDK4, corresponding to a HOST TARGET binding site such as BINDING SITE I, BINDING SITE II or BINDING SITE III. Table 2 illustrates the complementarity of the nucleotide sequences of PDK4 BINDING SITE, designated SEQ ID:46442, to the nucleotide sequence of VGAM18 RNA, herein designated VGAM RNA, also designated SEQ ID:2729.

Another function of VGAM18 is therefore inhibition of Pyruvate Dehydrogenase Kinase, Isoenzyme 4 (PDK4, Accession XM_173198). Accordingly, utilities of VGAM18 include diagnosis, prevention and treatment of diseases and clinical conditions associated with PDK4. RB1-inducible Coiled-coil 1 (RB1CC1, Accession NM_014781) is another VGAM18 host target gene. RB1CC1 BINDING SITE is HOST TARGET binding site found in the 3' untranslated region of mRNA encoded by RB1CC1, corresponding to a HOST TARGET binding site such as BINDING SITE I, BINDING SITE II or BINDING SITE III. Table 2 illustrates the complementarity of the nucleotide sequences of RB1CC1 BINDING SITE, designated SEQ ID:16629, to the nucleotide sequence of VGAM18 RNA, herein designated VGAM RNA, also designated SEQ ID:2729.

Another function of VGAM18 is therefore inhibition of RB1-inducible Coiled-coil 1 (RB1CC1, Accession NM_014781), a gene which is likely to participate in nuclear architecture by connecting chromatin with the nuclear matrix or envelope. Accordingly, utilities of VGAM18 include diagnosis, prevention and treatment of diseases and clinical conditions associated with RB1CC1. The function of RB1CC1 has been established by previous studies. By semiquantitative RT-PCR, Chano et al. (2002) found close correlation between expression of RB1CC1 and expression of the retinoblastoma gene (RB1; 180200) in a panel of cancer cell lines. In addition, they found that exogenous expression of RB1CC1 in 2 leukemia cell lines produced a marked increase in RB1 expression, with no detectable change in MDR1 levels. This induction was found to be due to activation of the RB1 promoter by RB1CC1. The RB1CC1 protein is a key regulator of the tumor suppressor gene RB1. It is localized in the nucleus and has been proposed to be a transcription factor because of its nuclear localization signal, leucine zipper motif, and coiled-coil structure (1,2:Chano et al., 2002, 2002). Chano et al. (2002) found that 7 of 35 (20%) primary breast cancers examined contained mutations in RB1CC1, including 9 large interstitial deletions predicted to yield markedly truncated RB1CC1 proteins. In all 7 cases, the RB1CC1 gene in the germline was wildtype; all deletions represented somatic mutations. Wildtype RB1CC1 and RB1 were absent or significantly less abundant than normal in the 7 cancers with mutations in RB1CC1, but were abundant in cancers without such mutations. In all 7 cancers, both RB1CC1 alleles were inactivated; 2 showed compound heterozygous deletions. Thus, RB1CC1 is frequently mutated in breast cancer and shows characteristics of a classic tumor suppressor gene.

Full details of the abovementioned studies are described in the following publications, the disclosure of which are hereby incorporated by reference:

Chano, T.; Ikegawa, S.; Kontani, K.; Okabe, H.; Baldini, N.; Saeki, Y.: Identification of RB1CC1, a novel human gene that can induce RB1 in various human cells. Oncogene 21:1295-1298, 2002; and Chano, T.; Kontani, K.; Teramoto, K.; Okabe, H.; Ikegawa, S.: Truncating mutations of RB1CC1 in human breast cancers. Nature Genet. 31:285-288, 2002.

Further studies establishing the function and utilities of RB1CC1 are found in John Hopkins OMIM database record ID 606837, and in sited publications numbered 557 and 5580 listed in the bibliography section hereinbelow, which are also hereby incorporated by reference. Solute Carrier Family 18 (vesicular monoamine), Member 1 (SLC18A1, Accession NM_003053) is another VGAM18 host target gene. SLC18A1 BINDING SITE is HOST TARGET binding site found in the 3' untranslated region of mRNA encoded by SLC18A1, corresponding to a HOST TARGET binding site such as BINDING SITE I, BINDING SITE II or BINDING SITE III. Table 2 illustrates the complementarity of the nucleotide sequences of SLC18A1 BINDING SITE, designated SEQ ID:9016, to the nucleotide sequence of VGAM18 RNA, herein designated VGAM RNA, also designated SEQ ID:2729.

Another function of VGAM18 is therefore inhibition of Solute Carrier Family 18 (vesicular monoamine), Member 1 (SLC18A1, Accession NM_003053), a gene which is involved in the vesicular transport of biogenic amines. Accordingly, utilities of VGAM18 include diagnosis, prevention and treatment of diseases and clinical conditions associated with SLC18A1. The function of SLC18A1 has been established by previous studies. The physiologic and behavioral effects of pharmacologic agents that interfere with the transport of monoamine neurotransmitters into vesicles suggest that vesicular amine transport may contribute to human neuropsychiatric disease. Biogenic amines have been implicated in a wide range of clinical disorders and physiologic states such as consciousness, motivation, organizational thought, mood, and motor control, sensory perception, and autonomic phenomena such as heart rate, vascular tone, and blood pressure. Peter et al. (1993) isolated a human cDNA for the brain vesicular amine transporter. They found that the brain synaptic vesicle amine transporter (SVAT) showed conservation with the corresponding gene in the rat in the regions that diverge extensively between rat SVAT and the rat adrenal chromaffin granule amine transporter (CGAT). Using the cloned sequences with a panel of mouse/human hybrids and in situ hybridization, Peter et al. (1993) mapped the adrenal CGAT gene (VMAT1) to 8p21.3 and the brain SVAT gene (OMIM Ref. No. 193001) to 10q25. This gene is also symbolized as SLC18A1. Roghani et al. (1996) showed that the mouse Slc18a1 gene maps to mouse chromosome 8 by linkage analysis.

Full details of the abovementioned studies are described in the following publications, the disclosure of which are hereby incorporated by reference:

Peter, D.; Finn, J. P.; Klisak, I.; Liu, Y.; Kojis, T.; Heinzmann, C.; Roghani, A.; Sparkes, R. S.; Edwards, R. H.: Chromosomal localization of the human vesicular amine transporter genes. Genomics 18:720-723, 1993; and Roghani, A.; Welch, C.; Xia, Y.-R.; Liu, Y.; Peter, D.; Finn, J. P.; Edwards, R. H.; Lusis, A. J.: Assignment of the mouse vesicular monoamine transporter genes, Slc18a1 and Slc18a2, t.

Further studies establishing the function and utilities of SLC18A1 are found in John Hopkins OMIM database record ID 193002, and in sited publications numbered 10548-10549 listed in the bibliography section hereinbelow, which are also hereby incorporated by reference. Angiotensin II Receptor-like 2 (AGTRL2, Accession NM_005162) is another VGAM18 host target gene. AGTRL2 BINDING SITE is HOST TARGET binding site found in the 5' untranslated region of mRNA encoded by AGTRL2, corresponding to a HOST TARGET binding site such as BINDING SITE I, BINDING SITE II or BINDING SITE III. Table 2 illustrates the complementarity of the nucleotide sequences of AGTRL2 BINDING SITE, designated SEQ ID:11644, to the nucleotide sequence of VGAM18 RNA, herein designated VGAM RNA, also designated SEQ ID:2729.

Another function of VGAM18 is therefore inhibition of Angiotensin II Receptor-like 2 (AGTRL2, Accession NM_005162). Accordingly, utilities of VGAM18 include diagnosis, prevention and treatment of diseases and clinical conditions associated with AGTRL2. BCL2-associated Athanogene 5 (BAG5, Accession NM_004873) is another VGAM18 host target gene. BAG5 BINDING SITE is HOST TARGET binding site found in the 3' untranslated region of mRNA encoded by BAG5, corresponding to a HOST TARGET binding site such as BINDING SITE I, BINDING SITE II or BINDING SITE III. Table 2 illustrates the complementarity of the nucleotide sequences of BAG5 BINDING SITE, designated SEQ ID:11306, to the nucleotide sequence of VGAM18 RNA, herein designated VGAM RNA, also designated SEQ ID:2729.

Another function of VGAM18 is therefore inhibition of BCL2-associated Athanogene 5 (BAG5, Accession NM_004873). Accordingly, utilities of VGAM18 include diagnosis, prevention and treatment of diseases and clinical conditions associated with BAG5. DKFZP564I122 (Accession XM_032397) is another VGAM18 host target gene. DKFZP564I122 BINDING SITE is HOST TARGET binding site found in the 3' untranslated region of mRNA encoded by DKFZP564I122, corresponding to a HOST TARGET binding site such as BINDING SITE I, BINDING SITE II or BINDING SITE III. Table 2 illustrates the complementarity of the nucleotide sequences of DKFZP564I122 BINDING SITE, designated SEQ ID:31645, to the nucleotide sequence of VGAM18 RNA, herein designated VGAM RNA, also designated SEQ ID:2729.

Another function of VGAM18 is therefore inhibition of DKFZP564I122 (Accession XM_032397). Accordingly, utilities of VGAM18 include diagnosis, prevention and treatment of diseases and clinical conditions associated with DKFZP564I122. FLJ20511 (Accession NM_017853) is another VGAM18 host target gene. FLJ20511 BINDING SITE is HOST TARGET binding site found in the 3' untranslated region of mRNA encoded by FLJ20511, corresponding to a HOST TARGET binding site such as BINDING SITE I, BINDING SITE II or BINDING SITE III. Table 2 illustrates the complementarity of the nucleotide sequences of FLJ20511 BINDING SITE, designated SEQ ID:19529, to the nucleotide sequence of VGAM18 RNA, herein designated VGAM RNA, also designated SEQ ID:2729.

Another function of VGAM18 is therefore inhibition of FLJ20511 (Accession NM_017853). Accordingly, utilities of VGAM18 include diagnosis, prevention and treatment of diseases and clinical conditions associated with FLJ20511. FLJ20813 (Accession NM_017961) is another VGAM18 host target gene. FLJ20813 BINDING SITE is HOST TARGET binding site found in the 3' untranslated region of mRNA encoded by FLJ20813, corresponding to a HOST TARGET binding site such as BINDING SITE I, BINDING SITE II or BINDING SITE III. Table 2 illustrates the complementarity of the nucleotide sequences of FLJ20813 BINDING SITE, designated SEQ ID:19678, to the nucleotide sequence of VGAM18 RNA, herein designated VGAM RNA, also designated SEQ ID:2729.

Another function of VGAM18 is therefore inhibition of FLJ20813 (Accession NM_017961). Accordingly, utilities of VGAM18 include diagnosis, prevention and treatment of diseases and clinical conditions associated with FLJ20813. FLJ21140 (Accession NM_024776) is another VGAM18 host target gene. FLJ21140 BINDING SITE is HOST TARGET binding site found in the 3' untranslated region of mRNA encoded by FLJ21140, corresponding to a HOST TARGET binding site such as BINDING SITE I, BINDING SITE II or BINDING SITE III. Table 2 illustrates the complementarity of the nucleotide sequences of FLJ21140 BINDING SITE, designated SEQ ID:24139, to the nucleotide sequence of VGAM18 RNA, herein designated VGAM RNA, also designated SEQ ID:2729.

Another function of VGAM18 is therefore inhibition of FLJ21140 (Accession NM_024776). Accordingly, utilities of VGAM18 include diagnosis, prevention and treatment of diseases and clinical conditions associated with FLJ21140. Potassium Channel, Subfamily V, Member 1 (KCNV1, Accession NM_014379) is another VGAM18 host target gene. KCNV1 BINDING SITE is HOST TARGET binding site found in the 3' untranslated region of mRNA encoded by KCNV1, corresponding to a HOST TARGET binding site such as BINDING SITE I, BINDING SITE II or BINDING SITE III. Table 2 illustrates the complementarity of the nucleotide sequences of KCNV1 BINDING SITE, designated SEQ ID:15709, to the nucleotide sequence of VGAM18 RNA, herein designated VGAM RNA, also designated SEQ ID:2729.

Another function of VGAM18 is therefore inhibition of Potassium Channel, Subfamily V, Member 1 (KCNV1, Accession NM_014379). Accordingly, utilities of VGAM18 include diagnosis, prevention and treatment of diseases and clinical conditions associated with KCNV1. KIAA0022 (Accession NM_014880) is another VGAM18 host target gene. KIAA0022 BINDING SITE is HOST TARGET binding site found in the 3' untranslated region of mRNA encoded by KIAA0022, corresponding to a HOST TARGET binding site such as BINDING SITE I, BINDING SITE II or BINDING SITE III. Table 2 illustrates the complementarity of the nucleotide sequences of KIAA0022 BINDING SITE, designated SEQ ID:17026, to the nucleotide sequence of VGAM18 RNA, herein designated VGAM RNA, also designated SEQ ID:2729.

Another function of VGAM18 is therefore inhibition of KIAA0022 (Accession NM_014880). Accordingly, utilities of VGAM18 include diagnosis, prevention and treatment of diseases and clinical conditions associated with KIAA0022. KIAA0161 (Accession NM_014746) is another VGAM18 host target gene. KIAA0161 BINDING SITE is HOST TARGET binding site found in the 3' untranslated region of mRNA encoded by KIAA0161, corresponding to a HOST TARGET binding site such as BINDING SITE I, BINDING SITE II or BINDING SITE III. Table 2 illustrates the complementarity of the nucleotide sequences of KIAA0161 BINDING SITE, designated SEQ ID:16432, to the nucleotide sequence of VGAM18 RNA, herein designated VGAM RNA, also designated SEQ ID:2729.

Another function of VGAM18 is therefore inhibition of KIAA0161 (Accession NM_014746). Accordingly, utilities of VGAM18 include diagnosis, prevention and treatment of diseases and clinical conditions associated with KIAA0161. KIAA0410 (Accession NM_014778) is another VGAM18 host target gene. KIAA0410 BINDING SITE is HOST TARGET binding site found in the 3' untranslated region of mRNA encoded by KIAA0410, corresponding to a HOST TARGET binding site such as BINDING SITE I, BINDING SITE II or BINDING SITE III. Table 2 illustrates the complementarity of the nucleotide sequences of KIAA0410 BINDING SITE, designated SEQ ID:16614, to the nucleotide sequence of VGAM18 RNA, herein designated VGAM RNA, also designated SEQ ID:2729.

Another function of VGAM18 is therefore inhibition of KIAA0410 (Accession NM_014778). Accordingly, utilities of VGAM18 include diagnosis, prevention and treatment of diseases and clinical conditions associated with KIAA0410. KIAA1443 (Accession XM_033392) is another VGAM18 host target gene. KIAA1443 BINDING SITE is HOST TARGET binding site found in the 3' untranslated region of mRNA encoded by KIAA1443, corresponding to a HOST TARGET binding site such as BINDING SITE I, BINDING SITE II or BINDING SITE III. Table 2 illustrates the complementarity of the nucleotide sequences of KIAA1443 BINDING SITE, designated SEQ ID:31930, to the nucleotide sequence of VGAM18 RNA, herein designated VGAM RNA, also designated SEQ ID:2729.

Another function of VGAM18 is therefore inhibition of KIAA1443 (Accession XM_033392). Accordingly, utilities of VGAM18 include diagnosis, prevention and treatment of diseases and clinical conditions associated with KIAA1443. KIAA1737 (Accession XM_041115) is another VGAM18 host target gene. KIAA1737 BINDING SITE is HOST TARGET binding site found in the 3' untranslated region of mRNA encoded by KIAA1737, corresponding to a HOST TARGET binding site such as BINDING SITE I, BINDING SITE II or BINDING SITE III. Table 2 illustrates the complementarity of the nucleotide sequences of KIAA1737 BINDING SITE, designated SEQ ID:33447, to the nucleotide sequence of VGAM18 RNA, herein designated VGAM RNA, also designated SEQ ID:2729.

Another function of VGAM18 is therefore inhibition of KIAA1737 (Accession XM_041115). Accordingly, utilities of VGAM18 include diagnosis, prevention and treatment of diseases and clinical conditions associated with KIAA1737. Leucine Zipper and CTNNBIP1 Domain Containing (LZIC, Accession NM_032368) is another VGAM18 host target gene. LZIC BINDING SITE is HOST TARGET binding site found in the 5' untranslated region of mRNA encoded by LZIC, corresponding to a HOST TARGET binding site such as BINDING SITE I, BINDING SITE II or BINDING SITE III. Table 2 illustrates the complementarity of the nucleotide sequences of LZIC BINDING SITE, designated SEQ ID:26156, to the nucleotide sequence of VGAM18 RNA, herein designated VGAM RNA, also designated SEQ ID:2729.

Another function of VGAM18 is therefore inhibition of Leucine Zipper and CTNNBIP1 Domain Containing (LZIC, Accession NM_032368). Accordingly, utilities of VGAM18 include diagnosis, prevention and treatment of diseases and clinical conditions associated with LZIC. MGC2452 (Accession NM_032644) is another VGAM18 host target gene. MGC2452 BINDING SITE is HOST TARGET binding site found in the 5' untranslated region of mRNA encoded by MGC2452, corresponding to a HOST TARGET binding site such as BINDING SITE I, BINDING SITE II or BINDING SITE III. Table 2 illustrates the complementarity of the nucleotide sequences of MGC2452 BINDING SITE, designated SEQ ID:26373, to the nucleotide sequence of VGAM18 RNA, herein designated VGAM RNA, also designated SEQ ID:2729.

Another function of VGAM18 is therefore inhibition of MGC2452 (Accession NM_032644). Accordingly, utilities of VGAM18 include diagnosis, prevention and treatment of diseases and clinical conditions associated with MGC2452. OS4 (Accession NM_005730) is another VGAM18 host target gene. OS4 BINDING SITE is HOST TARGET binding site found in the 3' untranslated region of mRNA encoded by OS4, corresponding to a HOST TARGET binding site such as BINDING SITE I, BINDING SITE II or BINDING SITE III. Table 2 illustrates the complementarity of the nucleotide sequences of OS4 BINDING SITE, designated SEQ ID:12290, to the nucleotide sequence of VGAM18 RNA, herein designated VGAM RNA, also designated SEQ ID:2729.

Another function of VGAM18 is therefore inhibition of OS4 (Accession NM_005730). Accordingly, utilities of VGAM18 include diagnosis, prevention and treatment of diseases and clinical conditions associated with OS4. Protocadherin 19 (PCDH19, Accession XM_033173) is another VGAM18 host target gene. PCDH19 BINDING SITE is HOST TARGET binding site found in the 3' untranslated region of mRNA encoded by PCDH19, corresponding to a HOST TARGET binding site such as BINDING SITE I, BINDING SITE II or BINDING SITE III. Table 2 illustrates the complementarity of the nucleotide sequences of PCDH19 BINDING SITE, designated SEQ ID:31859, to the nucleotide sequence of VGAM18 RNA, herein designated VGAM RNA, also designated SEQ ID:2729.

Another function of VGAM18 is therefore inhibition of Protocadherin 19 (PCDH19, Accession XM_033173). Accordingly, utilities of VGAM18 include diagnosis, prevention and treatment of diseases and clinical conditions associated with PCDH19. PRO0456 (Accession NM_014127) is another VGAM18 host target gene. PRO0456 BINDING SITE is HOST TARGET binding site found in the 5' untranslated region of mRNA encoded by PRO0456, corresponding to a HOST TARGET binding site such as BINDING SITE I, BINDING SITE II or BINDING SITE III. Table 2 illustrates the complementarity of the nucleotide sequences of PRO0456 BINDING SITE, designated SEQ ID:15392, to the nucleotide sequence of VGAM18 RNA, herein designated VGAM RNA, also designated SEQ ID:2729.

Another function of VGAM18 is therefore inhibition of PRO0456 (Accession NM_014127). Accordingly, utilities of VGAM18 include diagnosis, prevention and treatment of diseases and clinical conditions associated with PRO0456. PRSC (Accession NM_006587) is another VGAM18 host target gene. PRSC BINDING SITE is HOST TARGET binding site found in the 3" untranslated region of mRNA encoded by PRSC, corresponding to a HOST TARGET binding site such as BINDING SITE I, BINDING SITE II or BINDING SITE III. Table 2 illustrates the complementarity of the nucleotide sequences of PRSC BINDING SITE, designated SEQ ID:13347, to the nucleotide sequence of VGAM18 RNA, herein designated VGAM RNA, also designated SEQ ID:2729.

Another function of VGAM18 is therefore inhibition of PRSC (Accession NM_006587). Accordingly, utilities of VGAM18 include diagnosis, prevention and treatment of diseases and clinical conditions associated with PRSC. LOC148758 (Accession XM_086301) is another VGAM18 host target gene. LOC148758 BINDING SITE is HOST TARGET binding site found in the 5" untranslated region of mRNA encoded by LOC148758, corresponding to a HOST TARGET binding site such as BINDING SITE I, BINDING SITE II or BINDING SITE III. Table 2 illustrates the complementarity of the nucleotide sequences of LOC148758 BINDING SITE, designated SEQ ID:38587, to the nucleotide sequence of VGAM18 RNA, herein designated VGAM RNA, also designated SEQ ID:2729.

Another function of VGAM18 is therefore inhibition of LOC148758 (Accession XM_086301). Accordingly, utilities of VGAM18 include diagnosis, prevention and treatment of diseases and clinical conditions associated with LOC148758. LOC154007 (Accession XM_087824) is another VGAM18 host target gene. LOC154007 BINDING SITE is HOST TARGET binding site found in the 3' untranslated region of mRNA encoded by LOC154007, corresponding to a HOST TARGET binding site such as BINDING SITE I, BINDING SITE II or BINDING SITE III. Table 2 illustrates the complementarity of the nucleotide sequences of LOC154007 BINDING SITE, designated SEQ ID:39451, to the nucleotide sequence of VGAM18 RNA, herein designated VGAM RNA, also designated SEQ ID:2729.

Another function of VGAM18 is therefore inhibition of LOC154007 (Accession XM_087824). Accordingly, utilities of VGAM18 include diagnosis, prevention and treatment of diseases and clinical conditions associated with LOC154007. LOC90494 (Accession XM_032161) is another VGAM18 host target gene. LOC90494 BINDING SITE is HOST TARGET binding site found in the 5' untranslated region of mRNA encoded by LOC90494, corresponding to a HOST TARGET binding site such as BINDING SITE I, BINDING SITE II or BINDING SITE III. Table 2 illustrates the complementarity of the nucleotide sequences of LOC90494 BIND- ING SITE, designated SEQ ID:31575, to the nucleotide sequence of VGAM18 RNA, herein designated VGAM RNA, also designated SEQ ID:2729.

Another function of VGAM18 is therefore inhibition of LOC90494 (Accession XM_032161). Accordingly, utilities of VGAM18 include diagnosis, prevention and treatment of diseases and clinical conditions associated with LOC90494. LOC92379 (Accession XM_044712) is another VGAM18 host target gene. LOC92379 BINDING SITE is HOST TARGET binding site found in the 3' untranslated region of mRNA encoded by LOC92379, corresponding to a HOST TARGET binding site such as BINDING SITE I, BINDING SITE II or BINDING SITE III. Table 2 illustrates the complementarity of the nucleotide sequences of LOC92379 BINDING SITE, designated SEQ ID:34268, to the nucleotide sequence of VGAM18 RNA, herein designated VGAM RNA, also designated SEQ ID:2729.

Another function of VGAM18 is therefore inhibition of LOC92379 (Accession XM_044712). Accordingly, utilities of VGAM18 include diagnosis, prevention and treatment of diseases and clinical conditions associated with LOC92379. FIG. 1 further provides a conceptual description of a novel bioinformatically detected viral gene of the present invention, referred to here as Viral Genomic Address Messenger 19 (VGAM19) viral gene, which modulates expression of respective host target genes thereof, the function and utility of which host target genes is known in the art.

VGAM19 is a novel bioinformatically detected regulatory, non protein coding, viral micro RNA (miRNA) gene. The method by which VGAM19 was detected is described hereinabove with reference to FIGS. 1-8.

VGAM19 gene, herein designated VGAM GENE, is a viral gene contained in the genome of Invertebrate Iridescent Virus 6. VGAM19 host target gene, herein designated VGAM HOST TARGET GENE, is a human gene contained in the human genome.

VGAM19 gene encodes a VGAM19 precursor RNA, herein designated VGAM PRECURSOR RNA. Similar to other miRNA genes, and unlike most ordinary genes, VGAM19 precursor RNA does not encode a protein. A nucleotide sequence identical or highly similar to the nucleotide sequence of VGAM19 precursor RNA is designated SEQ ID:5, and is provided hereinbelow with reference to the sequence listing part. Nucleotide sequence SEQ ID:5 is located at position 63067 relative to the genome of Invertebrate Iridescent Virus 6.

VGAM19 precursor RNA folds onto itself, forming VGAM19 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM19 folded precursor RNA into VGAM19 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM19 RNA is designated SEQ ID:2730, and is provided hereinbelow with reference to the sequence listing part.

VGAM19 host target gene, herein designated VGAM HOST TARGET GENE, encodes a corresponding messenger RNA, VGAM19 host target RNA, herein designated VGAM HOST TARGET RNA. VGAM19 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM19 RNA, herein designated VGAM RNA, binds complementarily to one or more host target binding sites located in untranslated regions of VGAM19 host target RNA, herein designated VGAM HOST TARGET RNA. This complementary binding is due to the fact that the nucleotide sequence of VGAM19 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM19 RNA, herein designated VGAM RNA, may have a different number of host target binding sites in untranslated regions of a VGAM19 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM19 RNA, herein designated VGAM RNA, to host target binding sites on VGAM19 host target RNA, herein designated VGAM HOST TARGET RNA, such as BINDING SITE I, BINDING SITE II and BINDING SITE III, inhibits translation of VGAM19 host target RNA into VGAM19 host target protein, herein designated VGAM HOST TARGET PROTEIN. VGAM host target protein is therefore outlined by a broken line.

It is appreciated that VGAM19 host target gene, herein designated VGAM HOST TARGET GENE, in fact represents a plurality of VGAM19 host target genes. The mRNA of each one of this plurality of VGAM19 host target genes comprises one or more host target binding sites, each having a nucleotide sequence which is at least partly complementary to VGAM19 RNA, herein designated VGAM RNA, and which when bound by VGAM19 RNA causes inhibition of translation of respective one or more VGAM19 host target proteins.

It is further appreciated by one skilled in the art that the mode of translational inhibition illustrated by FIG. 1 with specific reference to translational inhibition exerted by VGAM19 gene, herein designated VGAM GENE, on one or more VGAM19 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM19 is inhibition of expression of host target genes, as part of a novel viral mechanism of attacking a host. Accordingly, utilities of VGAM19 include diagnosis, prevention and treatment of viral infection by Invertebrate Iridescent Virus 6. Specific functions, and accordingly utilities, of VGAM19 correlate with, and may be deduced from, the identity of the host target genes which VGAM19 binds and inhibits, and the function of these host target genes, as elaborated hereinbelow.

Nucleotide sequences of the VGAM19 precursor RNA, herein designated VGAM PRECURSOR RNA, and of the 'diced' VGAM19 RNA, herein designated VGAM RNA, and a schematic representation of the secondary folding of VGAM19 folded precursor RNA, herein designated VGAM FOLDED PRECURSOR RNA, of VGAM19 are further described hereinbelow with reference to Table 1.

Nucleotide sequences of host target binding sites, such as BINDING SITE-I, BINDING SITE-II and BINDING SITE-III of FIG. 1, found on VGAM19 host target RNA, and schematic representation of the complementarity of each of these host target binding sites to VGAM19 RNA, herein designated VGAM RNA, are described hereinbelow with reference to Table 2.

As mentioned hereinabove with reference to FIG. 1, a function of VGAM19 gene, herein designated VGAM is inhibition of expression of VGAM19 target genes. It is appreciated that specific functions, and accordingly utilities, of VGAM19 correlate with, and may be deduced from, the identity of the target genes which VGAM19 binds and inhibits, and the function of these target genes, as elaborated hereinbelow.

Collagen, Type XIX, Alpha 1 (COL19A1, Accession NM_001858) is a VGAM19 host target gene. COL19A1 BINDING SITE is HOST TARGET binding site found in the 3' untranslated region of mRNA encoded by COL19A1, corresponding to a HOST TARGET binding site such as BINDING SITE I, BINDING SITE II or BINDING SITE III. Table 2 illustrates the complementarity of the nucleotide sequences of COL19A1 BINDING SITE, designated SEQ ID:7599, to the nucleotide sequence of VGAM19 RNA, herein designated VGAM RNA, also designated SEQ ID:2730.

A function of VGAM19 is therefore inhibition of Collagen, Type XIX, Alpha 1 (COL19A1, Accession NM_001858), a gene which may act as a cross-bridge between fibrils and other extracellular matrix molecules. Accordingly, utilities of VGAM19 include diagnosis, prevention and treatment of diseases and clinical conditions associated with COL19A1. The function of COL19A1 has been established by previous studies. The collagens are a large superfamily of genes that include a number of subgroups. One such group is composed of fibrillar associated collagens with interrupted triple helices (FACIT) and includes collagen types IX (e.g., 120210), XII (e.g., 120320), XIV (e.g., 120324), and XVI (e.g., 120326). Members of this group have common structural features, including short stretches of collagenous domains interrupted by non-collagenous regions. These, in turn, form functional units that serve to produce adhesion to the fibrils, provide a rigid arm that projects from the fibril and provide a point of interaction with other matrix components Yoshioka et al. (1992) mapped the COL19A1 gene to 6q12-q14, where the COL9A1 gene (OMIM Ref. No. 120210) has been mapped. Myers et al. (1993) mapped the COL19A1 gene to chromosome 6 by analysis of a panel of somatic cell hybrids. By FISH, Gerecke et al. (1997) mapped the COL19A1 gene to 6q12-q13. Khaleduzzaman et al. (1997) showed that the mouse Col19a1 gene is located on chromosome 1A3, where Col9a1 had also been mapped. They suggested that COL19A1 and COL9A1, and their murine counterparts, were duplicated from the same ancestral gene of the FACIT family Full details of the abovementioned studies are described in the following publications, the disclosure of which are hereby incorporated by reference:

Yoshioka, H.; Zhang, H.; Ramirez, F.; Mattei, M.-G.; Moradi-Ameli, M.; van der Rest, M.; Gordon, M. K.: Synteny between the loci for a novel FACIT-like collagen (D6S228E) and alpha 1(IX) collagen (COL9A1) on 6q12-q14 in human S. Genomics 13:884-886, 1992; and Yoshioka, H.; Zhang, H.; Ramirez, F.; Mattei, M.-G.; Moradi-Ameli, M.; van der Rest, M.; Gordon, M. K.: Synteny between the loci for a novel FACIT-like collagen (D6S228E) and alpha 1(IX.

Further studies establishing the function and utilities of COL19A1 are found in John Hopkins OMIM database record ID 120165, and in sited publications numbered 3565-3564 listed in the bibliography section hereinbelow, which are also hereby incorporated by reference. Solute Carrier Family 26, Member 4 (SLC26A4, Accession NM_000441) is another VGAM19 host target gene. SLC26A4 BINDING SITE is HOST TARGET binding site found in the 3' untranslated region of mRNA encoded by SLC26A4, corresponding to a HOST TARGET binding site such as BINDING SITE I, BINDING SITE II or BINDING SITE III. Table 2 illustrates the complementarity of the nucleotide sequences of SLC26A4 BINDING SITE, designated SEQ ID:6026, to the nucleotide sequence of VGAM19 RNA, herein designated VGAM RNA, also designated SEQ ID:2730.

Another function of VGAM19 is therefore inhibition of Solute Carrier Family 26, Member 4 (SLC26A4, Accession NM_000441). Accordingly, utilities of VGAM19 include diagnosis, prevention and treatment of diseases and clinical conditions associated with SLC26A4. Cofactor Required For Sp1 Transcriptional Activation, Subunit 3, 130 kDa (CRSP3, Accession XM_027112) is another VGAM19 host target gene. CRSP3 BINDING SITE is HOST TARGET binding site found in the 3' untranslated region of mRNA encoded by CRSP3, corresponding to a HOST TARGET binding site such as BINDING SITE I, BINDING SITE II or BINDING SITE III. Table 2 illustrates the complementarity of the nucleotide sequences of CRSP3 BINDING SITE, designated SEQ ID:30412, to the nucleotide sequence of VGAM19 RNA, herein designated VGAM RNA, also designated SEQ ID:2730.

Another function of VGAM19 is therefore inhibition of Cofactor Required For Sp1 Transcriptional Activation, Subunit 3, 130 kDa (CRSP3, Accession XM_027112). Accordingly, utilities of VGAM19 include diagnosis, prevention and treatment of diseases and clinical conditions associated with CRSP3. FLJ11320 (Accession NM_018389) is another VGAM19 host target gene. FLJ11320 BINDING SITE is HOST TARGET binding site found in the 3' untranslated region of mRNA encoded by FLJ11320, corresponding to a HOST TARGET binding site such as BINDING SITE I, BINDING SITE II or BINDING SITE III. Table 2 illustrates the complementarity of the nucleotide sequences of FLJ11320 BINDING SITE, designated SEQ ID:20423, to the nucleotide sequence of VGAM19 RNA, herein designated VGAM RNA, also designated SEQ ID:2730.

Another function of VGAM19 is therefore inhibition of FLJ11320 (Accession NM_018389). Accordingly, utilities of VGAM19 include diagnosis, prevention and treatment of diseases and clinical conditions associated with FLJ11320. FLJ20045 (Accession NM_017638) is another VGAM19 host target gene. FLJ20045 BINDING SITE is HOST TARGET binding site found in the 3' untranslated region of mRNA encoded by FLJ20045, corresponding to a HOST TARGET binding site such as BINDING SITE I, BINDING SITE II or BINDING SITE III. Table 2 illustrates the complementarity of the nucleotide sequences of FLJ20045 BINDING SITE, designated SEQ ID:19144, to the nucleotide sequence of VGAM19 RNA, herein designated VGAM RNA, also designated SEQ ID:2730.

Another function of VGAM19 is therefore inhibition of FLJ20045 (Accession NM_017638). Accordingly, utilities of VGAM19 include diagnosis, prevention and treatment of diseases and clinical conditions associated with FLJ20045. KIAA0410 (Accession NM_014778) is another VGAM19 host target gene. KIAA0410 BINDING SITE is HOST TARGET binding site found in the 3' untranslated region of mRNA encoded by KIAA0410, corresponding to a HOST TARGET binding site such as BINDING SITE I, BINDING SITE II or BINDING SITE III. Table 2 illustrates the complementarity of the nucleotide sequences of KIAA0410 BINDING SITE, designated SEQ ID:16622, to the nucleotide sequence of VGAM19 RNA, herein designated VGAM RNA, also designated SEQ ID:2730.

Another function of VGAM19 is therefore inhibition of KIAA0410 (Accession NM_014778). Accordingly, utilities of VGAM19 include diagnosis, prevention and treatment of diseases and clinical conditions associated with KIAA0410. poly (A) Binding Protein, Cytoplasmic 5 (PABPC5, Accession NM_080832) is another VGAM19 host target gene. PABPC5 BINDING SITE is HOST TARGET binding site found in the 3' untranslated region of mRNA encoded by PABPC5, corresponding to a HOST TARGET binding site such as BINDING SITE I, BINDING SITE II or BINDING SITE III. Table 2 illustrates the complementarity of the nucleotide sequences of PABPC5 BINDING SITE, designated SEQ ID:28098, to the nucleotide sequence of VGAM19 RNA, herein designated VGAM RNA, also designated SEQ ID:2730.

Another function of VGAM19 is therefore inhibition of poly (A) Binding Protein, Cytoplasmic 5 (PABPC5, Accession NM_080832). Accordingly, utilities of VGAM19 include diagnosis, prevention and treatment of diseases and clinical conditions associated with PABPC5. LOC157292 (Accession XM_098740) is another VGAM19 host target gene. LOC157292 BINDING SITE is HOST TARGET binding site found in the 3' untranslated region of mRNA encoded by LOC157292, corresponding to a HOST TARGET binding site such as BINDING SITE I, BINDING SITE II or BINDING SITE III. Table 2 illustrates the complementarity of the nucleotide sequences of LOC157292 BINDING SITE, designated SEQ ID:41774, to the nucleotide sequence of VGAM19 RNA, herein designated VGAM RNA, also designated SEQ ID:2730.

Another function of VGAM19 is therefore inhibition of LOC157292 (Accession XM_098740). Accordingly, utilities of VGAM19 include diagnosis, prevention and treatment of diseases and clinical conditions associated with LOC157292. LOC202460 (Accession XM_114493) is another VGAM19 host target gene. LOC202460 BINDING SITE is HOST TARGET binding site found in the 5' untranslated region of mRNA encoded by LOC202460, corresponding to a HOST TARGET binding site such as BINDING SITE I, BINDING SITE II or BINDING SITE III. Table 2 illustrates the complementarity of the nucleotide sequences of LOC202460 BINDING SITE, designated SEQ ID:42985, to the nucleotide sequence of VGAM19 RNA, herein designated VGAM RNA, also designated SEQ ID:2730.

Another function of VGAM19 is therefore inhibition of LOC202460 (Accession XM_114493). Accordingly, utilities of VGAM19 include diagnosis, prevention and treatment of diseases and clinical conditions associated with LOC202460. FIG. 1 further provides a conceptual description of a novel bioinformatically detected viral gene of the present invention, referred to here as Viral Genomic Address Messenger 20 (VGAM20) viral gene, which modulates expression of respective host target genes thereof, the function and utility of which host target genes is known in the art.

VGAM20 is a novel bioinformatically detected regulatory, non protein coding, viral micro RNA (miRNA) gene. The method by which VGAM20 was detected is described hereinabove with reference to FIGS. 1-8.

VGAM20 gene, herein designated VGAM GENE, is a viral gene contained in the genome of Invertebrate Iridescent Virus 6. VGAM20 host target gene, herein designated VGAM HOST TARGET GENE, is a human gene contained in the human genome.

VGAM20 gene encodes a VGAM20 precursor RNA, herein designated VGAM PRECURSOR RNA. Similar to other miRNA genes, and unlike most ordinary genes, VGAM20 precursor RNA does not encode a protein. A nucleotide sequence identical or highly similar to the nucleotide sequence of VGAM20 precursor RNA is designated SEQ ID:6, and is provided hereinbelow with reference to the sequence listing part. Nucleotide sequence SEQ ID:6 is located at position 44959 relative to the genome of Invertebrate Iridescent Virus 6.

VGAM20 precursor RNA folds onto itself, forming VGAM20 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM20 folded precursor RNA into VGAM20 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM20 RNA is designated SEQ ID:2731, and is provided hereinbelow with reference to the sequence listing part.

VGAM20 host target gene, herein designated VGAM HOST TARGET GENE, encodes a corresponding messenger RNA, VGAM20 host target RNA, herein designated VGAM HOST TARGET RNA. VGAM20 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM20 RNA, herein designated VGAM RNA, binds complementarily to one or more host target binding sites located in untranslated regions of VGAM20 host target RNA, herein designated VGAM HOST TARGET RNA. This complementary binding is due to the fact that the nucleotide sequence of VGAM20 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM20 RNA, herein designated VGAM RNA, may have a different number of host target binding sites in untranslated regions of a VGAM20 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM20 RNA, herein designated VGAM RNA, to host target binding sites on VGAM20 host target RNA, herein designated VGAM HOST TARGET RNA, such as BINDING SITE I, BINDING SITE II and BINDING SITE III, inhibits translation of VGAM20 host target RNA into VGAM20 host target protein, herein designated VGAM HOST TARGET PROTEIN. VGAM host target protein is therefore outlined by a broken line.

It is appreciated that VGAM20 host target gene, herein designated VGAM HOST TARGET GENE, in fact represents a plurality of VGAM20 host target genes. The mRNA of each one of this plurality of VGAM20 host target genes comprises one or more host target binding sites, each having a nucleotide sequence which is at least partly complementary to VGAM20 RNA, herein designated VGAM RNA, and which when bound by VGAM20 RNA causes inhibition of translation of respective one or more VGAM20 host target proteins.

It is further appreciated by one skilled in the art that the mode of translational inhibition illustrated by FIG. 1 with specific reference to translational inhibition exerted by VGAM20 gene, herein designated VGAM GENE, on one or more VGAM20 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM20 is inhibition of expression of host target genes, as part of a novel viral mechanism of attacking a host. Accordingly, utilities of VGAM20 include diagnosis, prevention and treatment of viral infection by Invertebrate Iridescent Virus 6. Specific functions, and accordingly utilities, of VGAM20 correlate with, and may be deduced from, the identity of the host target genes which VGAM20 binds and inhibits, and the function of these host target genes, as elaborated hereinbelow.

Nucleotide sequences of the VGAM20 precursor RNA, herein designated VGAM PRECURSOR RNA, and of the 'diced' VGAM20 RNA, herein designated VGAM RNA, and a schematic representation of the secondary folding of VGAM20 folded precursor RNA, herein designated VGAM FOLDED PRECURSOR RNA, of VGAM20 are further described hereinbelow with reference to Table 1.

Nucleotide sequences of host target binding sites, such as BINDING SITE-I, BINDING SITE-II and BINDING SITE-III of FIG. 1, found on VGAM20 host target RNA, and schematic representation of the complementarity of each of these host target binding sites to VGAM20 RNA, herein designated VGAM RNA, are described hereinbelow with reference to Table 2.

As mentioned hereinabove with reference to FIG. 1, a function of VGAM20 gene, herein designated VGAM is inhibition of expression of VGAM20 target genes. It is appreciated that specific functions, and accordingly utilities, of VGAM20 correlate with, and may be deduced from, the identity of the target genes which VGAM20 binds and inhibits, and the function of these target genes, as elaborated hereinbelow.

Integrin, Alpha V (vitronectin receptor, alpha polypeptide, antigen CD51) (ITGAV, Accession NM_002210) is a VGAM20 host target gene. ITGAV BINDING SITE is HOST TARGET binding site found in the 3' untranslated region of mRNA encoded by ITGAV, corresponding to a HOST TARGET binding site such as BINDING SITE I, BINDING SITE II or BINDING SITE III. Table 2 illustrates the complementarity of the nucleotide sequences of ITGAV BINDING SITE, designated SEQ ID:7974, to the nucleotide sequence of VGAM20 RNA, herein designated VGAM RNA, also designated SEQ ID:2731.

A function of VGAM20 is therefore inhibition of Integrin, Alpha V (vitronectin receptor, alpha polypeptide, antigen CD51) (ITGAV, Accession NM_002210), a gene which is a member of the integrin family of cell-surface proteins. Accordingly, utilities of VGAM20 include diagnosis, prevention and treatment of diseases and clinical conditions associated with ITGAV. The function of ITGAV has been established by previous studies. A major surface antigen family on human leukocytes includes complement receptor type 3 (CR3A; also called integrin alpha-M, Mac1 or Mo1), lymphocyte function-associated antigen type 1 (LFA-1; 153370), and p150,95 (Leu M5; 151510). These antigens share a common beta chain (OMIM Ref. No. 116920) of 94 kD, linked noncovalently to 1 of 3 alpha chains distinctive to each. They promote adhesion of granulocytes to each other and to endothelial cell monolayers. The apparent molecular weight of the Mo1 alpha chain is 155 to 165 kD, that of the LFA1 alpha subunit is 180 kD, and that of the Leu M5 subunit is 130 to 150 kD. Pierce et al. (1986) purified human Mo1 to homogeneity from normal granulocytes by affinity chromatography and high performance liquid chromatography (HPLC) and determined the N-terminal amino acid sequence of its alpha subunit. The obtained sequence was identical, except for 2 conservative substitutions, to that of the alpha subunit of Mac1 antigen (Springer et al., 1985). Furthermore, Pierce et al. (1986) found that the N-terminal amino acid sequence of the alpha subunit of Mo1 was homologous to the alpha subunit of IIb/IIIa, a glycoprotein that serves similar adhesive functions on platelets and is deficient or defective in Glanzmann thrombasthenia (OMIM Ref. No. 273800). Patients with a history of recurrent bacterial infections and an inherited deficiency of all 3 leukocyte membrane surface antigens are thought to have reduced or absent synthesis of the common beta subunit of the antigen family; see 116920. Inflammation plays an essential role in the initiation and progression of atherosclerosis. Simon et al. (2000) presented evidence that it also has a role in vascular repair after mechanical arterial injury (i.e., percutaneous transluminal coronary angioplasty, or PTCA). In animal models of vascular injury, leukocytes are recruited as a precursor to intimal thickening. Markers of leukocyte activation, in particular, increased expression of Mac1, which is responsible for firm leukocyte adhesion to platelets and fibrinogen on denuded vessels, predict restenosis after PTCA. To determine whether Mac1-mediated leukocyte recruitment is causally related to neointimal formation, Simon et al. (2000) subjected Mac1 knockout mice to a mechanical carotid artery dilation and complete endothelial denudation. They found that the selective absence of Mac1 impaired transplatelet leukocyte migration into the vessel wall, reducing leukocyte accumulation. Diminished medial leukocyte accumulation was accompanied by markedly reduced neointimal thickening after vascular injury. These data established a role for inflammation in neointimal thickening and suggested that leukocyte recruitment to mechanically injured arteries may prevent restenosis Full details of the abovementioned studies are described in the following publications, the disclosure of which are hereby incorporated by reference:

Pierce, M. W.; Remold-O'Donnell, E.; Todd, R. F., III; Arnaout, M. A.: N-terminal sequence of human leukocyte glycoprotein Mo1: conservation across species and homology to platelet IIb/IIIa. Biochim. Biophys. Acta 874:368-371, 1986; and Simon, D. I.; Chen, Z.; Seifert, P.; Edelman, E. R.; Ballantyne, C. M.; Rogers, C. : Decreased neointimal formation in Mac-1 -/- mice reveals a role for inflammation in vascular repair a.

Further studies establishing the function and utilities of ITGAV are found in John Hopkins OMIM database record ID 193210, and in sited publications numbered 518-519, 3336, 3338-3339, 52 and 12455-12456 listed in the bibliography section hereinbelow, which are also hereby incorporated by reference. Thrombospondin 1 (THBS1, Accession NM_003246) is another VGAM20 host target gene. THBS1 BINDING SITE is HOST TARGET binding site found in the 3' untranslated region of mRNA encoded by THBS1, corresponding to a HOST TARGET binding site such as BINDING SITE I, BINDING SITE II or BINDING SITE III. Table 2 illustrates the complementarity of the nucleotide sequences of THBS1 BINDING SITE, designated SEQ ID:9257, to the nucleotide sequence of VGAM20 RNA, herein designated VGAM RNA, also designated SEQ ID:2731.

Another function of VGAM20 is therefore inhibition of Thrombospondin 1 (THBS1, Accession NM_003246), a gene which is a member of a family of adhesive molecules, involves in blood clotting and in angiogenesis. Accordingly, utilities of VGAM20 include diagnosis, prevention and treatment of diseases and clinical conditions associated with THBS1. The function of THBS1 has been established by previous studies. Natural inhibitors of angiogenesis are able to block pathologic neovascularization without harming the preexisting vasculature. Volpert et al. (2002) demonstrated that 2 such inhibitors, thrombospondin I and pigment epithelium-derived factor (OMIM Ref. No. 172860), derive specificity for remodeling vessels from their dependence on Fas/Fas ligand (134637; 134638)-mediated apoptosis to block angiogenesis. Both inhibitors upregulated FasL on endothelial cells. Expression of the essential partner of FasL, Fas receptor, was low on quiescent endothelial cells and vessels but greatly enhanced by inducers of angiogenesis, thereby specifically sensitizing the stimulated cells to apoptosis by inhibitor-generated FasL. The antiangiogenic activity of thrombospondin I and pigment epithelium-derived factor both in vitro and in vivo was dependent on this dual induction of Fas and FasL and the resulting apoptosis. Volpert et al. (2002) concluded that this example of cooperation between pro- and antiangiogenic factors in the inhibition of angiogenesis provides one explanation for the ability of inhibitors to select remodeling capillaries for destruction. Animal model experiments lend further support to the function of THBS1. To explore the function of thrombospondin I in vivo, Lawler et al. (1998) disrupted the Thbs1 gene by homologous recombination in the mouse genome. Platelets from these mice were completely deficient in Thbs1 protein; however, thrombin-induced platelet aggregation was not diminished. The deficient mice displayed a mild and variable lordotic curvature of the spine that was apparent from birth. They also displayed an increase in the number of circulating white blood cells, with monocytes and eosinophils having the largest percent increases. Although other major organs showed no abnormalities consistent with high levels of expression of Thbs1 in lung, Lawler et al. (1998) observed abnormalities in the lungs of the mice lacking Thbs1. Extensive acute and organizing pneumonia with neutrophils and macrophages developed by 4 weeks of age. The macrophages stained for hemosiderin, indicating that diffuse alveolar hemorrhage was occurring. Later, the number of neutrophils decreased and a striking increase in the number of hemosiderin-containing macrophages was observed associated with multiple-lineage epithelial hyperplasia and the deposition of collagen and elastin. The results indicated that THBS1 is involved in normal lung homeostasis.

It is appreciated that the abovementioned animal model for THBS1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lawler, J.; Sunday, M.; Thibert, V.; Duquette, M.; George, E. L.; Rayburn, H.; Hynes, R. O.: Thrombospondin-1 is required for normal murine pulmonary homeostasis and its absence causes pneumonia. J. Clin. Invest. 101:982-992, 1998; and Volpert, O. V.; Zaichuk, T.; Zhou, W.; Reiher, F.; Ferguson, T. A.; Stuart, P. M.; Amin, M.; Bouck, N. P.: Inducer-stimulated Fas targets activated endothelium for destruction by anti-a.

Further studies establishing the function and utilities of THBS1 are found in John Hopkins OMIM database record ID 188060, and in sited publications numbered 10515-10521, 37 and 10522 listed in the bibliography section hereinbelow, which are also hereby incorporated by reference. DKFZP564O123 (Accession XM_002810) is another VGAM20 host target gene. DKFZP564O123 BINDING SITE is HOST TARGET binding site found in the 3' untranslated region of mRNA encoded by DKFZP564O123, corresponding to a HOST TARGET binding site such as BINDING SITE I, BINDING SITE II or BINDING SITE III. Table 2 illustrates the complementarity of the nucleotide sequences of DKFZP564O123 BINDING SITE, designated SEQ ID:29905, to the nucleotide sequence of VGAM20 RNA, herein designated VGAM RNA, also designated SEQ ID:2731.

Another function of VGAM20 is therefore inhibition of DKFZP564O123 (Accession XM_002810). Accordingly, utilities of VGAM20 include diagnosis, prevention and treatment of diseases and clinical conditions associated with DKFZP564O123. KIAA0336 (Accession NM_014635) is another VGAM20 host target gene. KIAA0336 BINDING SITE is HOST TARGET binding site found in the 3' untranslated region of mRNA encoded by KIAA0336, corresponding to a HOST TARGET binding site such as BINDING SITE I, BINDING SITE II or BINDING SITE III. Table 2 illustrates the complementarity of the nucleotide sequences of KIAA0336 BINDING SITE, designated SEQ ID:16010, to the nucleotide sequence of VGAM20 RNA, herein designated VGAM RNA, also designated SEQ ID:2731.

Another function of VGAM20 is therefore inhibition of KIAA0336 (Accession NM_014635). Accordingly, utilities of VGAM20 include diagnosis, prevention and treatment of diseases and clinical conditions associated with KIAA0336. KIAA1494 (Accession XM_043561) is another VGAM20 host target gene. KIAA1494 BINDING SITE is HOST TARGET binding site found in the 5' untranslated region of mRNA encoded by KIAA1494, corresponding to a HOST TARGET binding site such as BINDING SITE I, BINDING SITE II or BINDING SITE III. Table 2 illustrates the complementarity of the nucleotide sequences of KIAA1494 BIND- ING SITE, designated SEQ ID:33961, to the nucleotide sequence of VGAM20 RNA, herein designated VGAM RNA, also designated SEQ ID:2731.

Another function of VGAM20 is therefore inhibition of KIAA1494 (Accession XM_043561). Accordingly, utilities of VGAM20 include diagnosis, prevention and treatment of diseases and clinical conditions associated with KIAA1494. RYK Receptor-like Tyrosine Kinase (RYK, Accession XM_093692) is another VGAM20 host target gene. RYK BINDING SITE is HOST TARGET binding site found in the 3' untranslated region of mRNA encoded by RYK, corresponding to a HOST TARGET binding site such as BINDING SITE I, BINDING SITE II or BINDING SITE III. Table 2 illustrates the complementarity of the nucleotide sequences of RYK BINDING SITE, designated SEQ ID:40204, to the nucleotide sequence of VGAM20 RNA, herein designated VGAM RNA, also designated SEQ ID:2731.

Another function of VGAM20 is therefore inhibition of RYK Receptor-like Tyrosine Kinase (RYK, Accession XM_093692). Accordingly, utilities of VGAM20 include diagnosis, prevention and treatment of diseases and clinical conditions associated with RYK. LOC123047 (Accession XM_063456) is another VGAM20 host target gene. LOC123047 BINDING SITE is HOST TARGET binding site found in the 5' untranslated region of mRNA encoded by LOC123047, corresponding to a HOST TARGET binding site such as BINDING SITE I, BINDING SITE II or BINDING SITE III. Table 2 illustrates the complementarity of the nucleotide sequences of LOC123047 BINDING SITE, designated SEQ ID:37237, to the nucleotide sequence of VGAM20 RNA, herein designated VGAM RNA, also designated SEQ ID:2731.

Another function of VGAM20 is therefore inhibition of LOC123047 (Accession XM_063456). Accordingly, utilities of VGAM20 include diagnosis, prevention and treatment of diseases and clinical conditions associated with LOC123047. FIG. 1 further provides a conceptual description of a novel bioinformatically detected viral gene of the present invention, referred to here as Viral Genomic Address Messenger 21 (VGAM21) viral gene, which modulates expression of respective host target genes thereof, the function and utility of which host target genes is known in the art.

VGAM21 is a novel bioinformatically detected regulatory, non protein coding, viral micro RNA (miRNA) gene. The method by which VGAM21 was detected is described hereinabove with reference to FIGS. 1-8.

VGAM21 gene, herein designated VGAM GENE, is a viral gene contained in the genome of Invertebrate Iridescent Virus 6. VGAM21 host target gene, herein designated VGAM HOST TARGET GENE, is a human gene contained in the human genome.

VGAM21 gene encodes a VGAM21 precursor RNA, herein designated VGAM PRECURSOR RNA. Similar to other miRNA genes, and unlike most ordinary genes, VGAM21 precursor RNA does not encode a protein. A nucleotide sequence identical or highly similar to the nucleotide sequence of VGAM21 precursor RNA is designated SEQ ID:7, and is provided hereinbelow with reference to the sequence listing part. Nucleotide sequence SEQ ID:7 is located at position 5472 relative to the genome of Invertebrate Iridescent Virus 6.

VGAM21 precursor RNA folds onto itself, forming VGAM21 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM21 folded precursor RNA into VGAM21 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM21 RNA is designated SEQ ID:2732, and is provided hereinbelow with reference to the sequence listing part.

VGAM21 host target gene, herein designated VGAM HOST TARGET GENE, encodes a corresponding messenger RNA, VGAM21 host target RNA, herein designated VGAM HOST TARGET RNA. VGAM21 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM21 RNA, herein designated VGAM RNA, binds complementarily to one or more host target binding sites located in untranslated regions of VGAM21 host target RNA, herein designated VGAM HOST TARGET RNA. This complementary binding is due to the fact that the nucleotide sequence of VGAM21 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM21 RNA, herein designated VGAM RNA, may have a different number of host target binding sites in untranslated regions of a VGAM21 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM21 RNA, herein designated VGAM RNA, to host target binding sites on VGAM21 host target RNA, herein designated VGAM HOST TARGET RNA, such as BINDING SITE I, BINDING SITE II and BINDING SITE III, inhibits translation of VGAM21 host target RNA into VGAM21 host target protein, herein designated VGAM HOST TARGET PROTEIN. VGAM host target protein is therefore outlined by a broken line.

It is appreciated that VGAM21 host target gene, herein designated VGAM HOST TARGET GENE, in fact represents a plurality of VGAM21 host target genes. The mRNA of each one of this plurality of VGAM21 host target genes comprises one or more host target binding sites, each having a nucleotide sequence which is at least partly complementary to VGAM21 RNA, herein designated VGAM RNA, and which when bound by VGAM21 RNA causes inhibition of translation of respective one or more VGAM21 host target proteins.

It is further appreciated by one skilled in the art that the mode of translational inhibition illustrated by FIG. 1 with specific reference to translational inhibition exerted by VGAM21 gene, herein designated VGAM GENE, on one or more VGAM21 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM21 is inhibition of expression of host target genes, as part of a novel viral mechanism of attacking a host. Accordingly, utilities of VGAM21 include diagnosis, prevention and treatment of viral infection by Invertebrate Iridescent Virus 6. Specific functions, and accordingly utilities, of VGAM21 correlate with, and may be deduced from, the identity of the host target genes which VGAM21 binds and inhibits, and the function of these host target genes, as elaborated hereinbelow.

Nucleotide sequences of the VGAM21 precursor RNA, herein designated VGAM PRECURSOR RNA, and of the 'diced' VGAM21 RNA, herein designated VGAM RNA, and a schematic representation of the secondary folding of VGAM21 folded precursor RNA, herein designated VGAM FOLDED PRECURSOR RNA, of VGAM21 are further described hereinbelow with reference to Table 1.

Nucleotide sequences of host target binding sites, such as BINDING SITE-I, BINDING SITE-II and BINDING SITE-III of FIG. 1, found on VGAM21 host target RNA, and schematic representation of the complementarity of each of these host target binding sites to VGAM21 RNA, herein designated VGAM RNA, are described hereinbelow with reference to Table 2.

As mentioned hereinabove with reference to FIG. 1, a function of VGAM21 gene, herein designated VGAM is inhibition of expression of VGAM21 target genes. It is appreciated that specific functions, and accordingly utilities, of VGAM21 correlate with, and may be deduced from, the identity of the target genes which VGAM21 binds and inhibits, and the function of these target genes, as elaborated hereinbelow.

XT3 (Accession NM_020208) is a VGAM21 host target gene. XT3 BINDING SITE is HOST TARGET binding site found in the 3' untranslated region of mRNA encoded by XT3, corresponding to a HOST TARGET binding site such as BINDING SITE I, BINDING SITE II or BINDING SITE III. Table 2 illustrates the complementarity of the nucleotide sequences of XT3 BINDING SITE, designated SEQ ID:21443, to the nucleotide sequence of VGAM21 RNA, herein designated VGAM RNA, also designated SEQ ID:2732.

A function of VGAM21 is therefore inhibition of XT3 (Accession NM_020208), a gene which is a Kidney-specific orphan transporter. Accordingly, utilities of VGAM21 include diagnosis, prevention and treatment of diseases and clinical conditions associated with XT3. The function of XT3 has been established by previous studies. Na (+) and Cl (-)-coupled transporter proteins mediate transit of structurally related small hydrophilic substances across plasma membranes. These transporters are structurally related to a small subgroup of proteins with no known substrates. By screening a mouse kidney cDNA library, Nash et al. (1998) obtained cDNAs encoding 2 members of this subgroup, Xt2 and Xt3. Using mouse Xt3 to screen a human kidney cDNA library, they obtained a partial sequence encoding human XT3. Sequence analysis predicted that the mouse sequence, approximately 88% identical to human XT3 and rat B21a, contains 12 potential transmembrane domains. Northern blot analysis detected 3.2- and 4.0-kb XT3 transcripts in human kidney and small intestine, with no expression detected in other tissues. Expression was slightly higher in kidney, where an 8.5-kb transcript was also detected. Immunofluorescence microscopy demonstrated expression on the plasma membrane of transfected cells. Nash et al. (1998) tested numerous substrates but failed to identify a compound transported by Xt3. Nash et al. (1998) mapped the mouse Xt3 gene to chromosome 9, near the telomere. Scott (2001) mapped the human XT3 gene to chromosome 3 based on sequence similarity between the XT3 sequence (GenBank AF075260) and a chromosome 3 clone (GenBank AC005669).

Full details of the abovementioned studies are described in the following publications, the disclosure of which are hereby incorporated by reference:

Nash, S. R.; Giros, B.; Kingsmore, S. F.; Kim, K. M.; El-Mestikawy, S.; Dong, Q.; Fumagalli, F.; Seldin, M. F.; Caron, M. G.: Cloning, gene structure and genomic localization of an orphan transporter from mouse kidney with six alternatively-spliced isoforms. Receptors Channels 6:113-128, 1998; and Scott, A. F.: Personal Communication. Baltimore, Md., Feb. 5, 2001.

Further studies establishing the function and utilities of XT3 are found in John Hopkins OMIM database record ID 605616, and in sited publications numbered 6777-6778 listed in the bibliography section hereinbelow, which are also hereby incorporated by reference. COE2 (Accession XM_034639) is another VGAM21 host target gene. COE2 BINDING SITE is HOST TARGET binding site found in the 3' untranslated region of mRNA encoded by COE2, corresponding to a HOST TARGET binding site such as BINDING SITE I, BINDING SITE II or BINDING SITE III. Table 2 illustrates the complementarity of the nucleotide sequences of COE2 BINDING SITE, designated SEQ ID:32131, to the nucleotide sequence of VGAM21 RNA, herein designated VGAM RNA, also designated SEQ ID:2732.

Another function of VGAM21 is therefore inhibition of COE2 (Accession XM_034639). Accordingly, utilities of VGAM21 include diagnosis, prevention and treatment of diseases and clinical conditions associated with COE2. POLD3 (Accession XM_166243) is another VGAM21 host target gene. POLD3 BINDING SITE is HOST TARGET binding site found in the 3' untranslated region of mRNA encoded by POLD3, corresponding to a HOST TARGET binding site such as BINDING SITE I, BINDING SITE II or BINDING SITE III. Table 2 illustrates the complementarity of the nucleotide sequences of POLD3 BINDING SITE, designated SEQ ID:44052, to the nucleotide sequence of VGAM21 RNA, herein designated VGAM RNA, also designated SEQ ID:2732.

Another function of VGAM21 is therefore inhibition of POLD3 (Accession XM_166243). Accordingly, utilities of VGAM21 include diagnosis, prevention and treatment of diseases and clinical conditions associated with POLD3. RI58 (Accession NM_012420) is another VGAM21 host target gene. RI58 BINDING SITE is HOST TARGET binding site found in the 3' untranslated region of mRNA encoded by RI58, corresponding to a HOST TARGET binding site such as BINDING SITE I, BINDING SITE II or BINDING SITE III. Table 2 illustrates the complementarity of the nucleotide sequences of RI58 BINDING SITE, designated SEQ ID:14794, to the nucleotide sequence of VGAM21 RNA, herein designated VGAM RNA, also designated SEQ ID:2732.

Another function of VGAM21 is therefore inhibition of RI58 (Accession NM_012420). Accordingly, utilities of VGAM21 include diagnosis, prevention and treatment of diseases and clinical conditions associated with RI58. FIG. 1 further provides a conceptual description of a novel bioinformatically detected viral gene of the present invention, referred to here as Viral Genomic Address Messenger 22 (VGAM22) viral gene, which modulates expression of respective host target genes thereof, the function and utility of which host target genes is known in the art.

VGAM22 is a novel bioinformatically detected regulatory, non protein coding, viral micro RNA (miRNA) gene. The method by which VGAM22 was detected is described hereinabove with reference to FIGS. 1-8.

VGAM22 gene, herein designated VGAM GENE, is a viral gene contained in the genome of Invertebrate Iridescent Virus 6. VGAM22 host target gene, herein designated VGAM HOST TARGET GENE, is a human gene contained in the human genome.

VGAM22 gene encodes a VGAM22 precursor RNA, herein designated VGAM PRECURSOR RNA. Similar to other miRNA genes, and unlike most ordinary genes, VGAM22 precursor RNA does not encode a protein. A nucleotide sequence identical or highly similar to the nucleotide sequence of VGAM22 precursor RNA is designated SEQ ID:8, and is provided hereinbelow with reference to the sequence listing part. Nucleotide sequence SEQ ID:8 is located at position 22721 relative to the genome of Invertebrate Iridescent Virus 6.

VGAM22 precursor RNA folds onto itself, forming VGAM22 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM22 folded precursor RNA into VGAM22 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM22 RNA is designated SEQ ID:2733, and is provided hereinbelow with reference to the sequence listing part.

VGAM22 host target gene, herein designated VGAM HOST TARGET GENE, encodes a corresponding messenger RNA, VGAM22 host target RNA, herein designated VGAM HOST TARGET RNA. VGAM22 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM22 RNA, herein designated VGAM RNA, binds complementarily to one or more host target binding sites located in untranslated regions of VGAM22 host target RNA, herein designated VGAM HOST TARGET RNA. This complementary binding is due to the fact that the nucleotide sequence of VGAM22 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM22 RNA, herein designated VGAM RNA, may have a different number of host target binding sites in untranslated regions of a VGAM22 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM22 RNA, herein designated VGAM RNA, to host target binding sites on VGAM22 host target RNA, herein designated VGAM HOST TARGET RNA, such as BINDING SITE I, BINDING SITE II and BINDING SITE III, inhibits translation of VGAM22 host target RNA into VGAM22 host target protein, herein designated VGAM HOST TARGET PROTEIN. VGAM host target protein is therefore outlined by a broken line.

It is appreciated that VGAM22 host target gene, herein designated VGAM HOST TARGET GENE, in fact represents a plurality of VGAM22 host target genes. The mRNA of each one of this plurality of VGAM22 host target genes comprises one or more host target binding sites, each having a nucleotide sequence which is at least partly complementary to VGAM22 RNA, herein designated VGAM RNA, and which when bound by VGAM22 RNA causes inhibition of translation of respective one or more VGAM22 host target proteins.

It is further appreciated by one skilled in the art that the mode of translational inhibition illustrated by FIG. 1 with specific reference to translational inhibition exerted by VGAM22 gene, herein designated VGAM GENE, on one or more VGAM22 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM22 is inhibition of expression of host target genes, as part of a novel viral mechanism of attacking a host. Accordingly, utilities of VGAM22 include diagnosis, prevention and treatment of viral infection by Invertebrate Iridescent Virus 6. Specific functions, and accordingly utilities, of VGAM22 correlate with, and may be deduced from, the identity of the host target genes which VGAM22 binds and inhibits, and the function of these host target genes, as elaborated hereinbelow.

Nucleotide sequences of the VGAM22 precursor RNA, herein designated VGAM PRECURSOR RNA, and of the 'diced' VGAM22 RNA, herein designated VGAM RNA, and a schematic representation of the secondary folding of VGAM22 folded precursor RNA, herein designated VGAM FOLDED PRECURSOR RNA, of VGAM22 are further described hereinbelow with reference to Table 1.

Nucleotide sequences of host target binding sites, such as BINDING SITE-I, BINDING SITE-II and BINDING SITE-III of FIG. 1, found on VGAM22 host target RNA, and schematic representation of the complementarity of each of these host target binding sites to VGAM22 RNA, herein designated VGAM RNA, are described hereinbelow with reference to Table 2.

As mentioned hereinabove with reference to FIG. 1, a function of VGAM22 gene, herein designated VGAM is inhibition of expression of VGAM22 target genes. It is appreciated that specific functions, and accordingly utilities, of VGAM22 correlate with, and may be deduced from, the identity of the target genes which VGAM22 binds and inhibits, and the function of these target genes, as elaborated hereinbelow.

Adenylate Cyclase 6 (ADCY6, Accession NM_015270) is a VGAM22 host target gene. ADCY6 BINDING SITE1 and ADCY6 BINDING SITE2 are HOST TARGET binding sites found in untranslated regions of mRNA encoded by ADCY6, corresponding to HOST TARGET binding sites such as BINDING SITE I, BINDING SITE II or BINDING SITE III. Table 2 illustrates the complementarity of the nucleotide sequences of ADCY6 BINDING SITE1 and ADCY6 BINDING SITE2, designated SEQ ID:17589 and SEQ ID:21977 respectively, to the nucleotide sequence of VGAM22 RNA, herein designated VGAM RNA, also designated SEQ ID:2733.

A function of VGAM22 is therefore inhibition of Adenylate Cyclase 6 (ADCY6, Accession NM_015270), a gene which this a membrane-bound, ca (2+)-inhibitable adenylyl cyclase (by similarity). Accordingly, utilities of VGAM22 include diagnosis, prevention and treatment of diseases and clinical conditions associated with ADCY6. The function of ADCY6 has been established by previous studies. By Southern blot analysis of somatic cell hybrid DNAs, Gaudin et al. (1994) mapped the ADCY6 gene to chromosome 12. Using isotopic in situ hybridization, Haber et al. (1994) mapped the ADCY6 gene to 12q12-q13. By fluorescence in situ hybridization, Edelhoff et al. (1995) confirmed the assignment of ADCY6 to 12q13 and demonstrated that the homologous mouse gene is located on chromosome 15 in the F region.

Full details of the abovementioned studies are described in the following publications, the disclosure of which are hereby incorporated by reference:

Edelhoff, S.; Villacres, E. C.; Storm, D. R.; Disteche, C. M.: Mapping of adenylyl cyclase genes type I, II, III, IV, V, and VI in mouse. Mammalian Genome 6:111-113, 1995; and Gaudin, C.; Homcy, C. J.; Ishikawa, Y.: Mammalian adenylyl cyclase family members are randomly located on different chromosomes. Hum. Genet. 94:527-529, 1994.

Further studies establishing the function and utilities of ADCY6 are found in John Hopkins OMIM database record ID 600294, and in sited publications numbered 494-49 and 10136 listed in the bibliography section hereinbelow, which are also hereby incorporated by reference. MORF (Accession NM_012330) is another VGAM22 host target gene. MORF BINDING SITE is HOST TARGET binding site found in the 5' untranslated region of mRNA encoded by MORF, corresponding to a HOST TARGET binding site such as BINDING SITE I, BINDING SITE II or BINDING SITE III. Table 2 illustrates the complementarity of the nucleotide sequences of MORF BINDING SITE, designated SEQ ID:14720, to the nucleotide sequence of VGAM22 RNA, herein designated VGAM RNA, also designated SEQ ID:2733.

Another function of VGAM22 is therefore inhibition of MORF (Accession NM_012330). Accordingly, utilities of VGAM22 include diagnosis, prevention and treatment of diseases and clinical conditions associated with MORF. FLJ13111 (Accession NM_025082) is another VGAM22 host target gene. FLJ13111 BINDING SITE is HOST TARGET binding site found in the 3' untranslated region of mRNA encoded by FLJ13111, corresponding to a HOST TARGET binding site such as BINDING SITE I, BINDING SITE II or BINDING SITE III. Table 2 illustrates the complementarity of the nucleotide sequences of FLJ13111 BINDING SITE, designated SEQ ID:24685, to the nucleotide sequence of VGAM22 RNA, herein designated VGAM RNA, also designated SEQ ID:2733.

Another function of VGAM22 is therefore inhibition of FLJ13111 (Accession NM_025082). Accordingly, utilities of VGAM22 include diagnosis, prevention and treatment of diseases and clinical conditions associated with FLJ13111. KIAA0495 (Accession XM_031397) is another VGAM22 host target gene. KIAA0495 BINDING SITE is HOST TARGET binding site found in the 3' untranslated region of mRNA encoded by KIAA0495, corresponding to a HOST TARGET binding site such as BINDING SITE I, BINDING SITE II or BINDING SITE III. Table 2 illustrates the complementarity of the nucleotide sequences of KIAA0495 BINDING SITE, designated SEQ ID:31366, to the nucleotide sequence of VGAM22 RNA, herein designated VGAM RNA, also designated SEQ ID:2733.

Another function of VGAM22 is therefore inhibition of KIAA0495 (Accession XM_031397). Accordingly, utilities of VGAM22 include diagnosis, prevention and treatment of diseases and clinical conditions associated with KIAA0495. LOC145988 (Accession XM_085290) is another VGAM22 host target gene. LOC145988 BINDING SITE is HOST TARGET binding site found in the 5' untranslated region of mRNA encoded by LOC145988, corresponding to a HOST TARGET binding site such as BINDING SITE I, BINDING SITE II or BINDING SITE III. Table 2 illustrates the complementarity of the nucleotide sequences of LOC145988 BINDING SITE, designated SEQ ID:38034, to the nucleotide sequence of VGAM22 RNA, herein designated VGAM RNA, also designated SEQ ID:2733.

Another function of VGAM22 is therefore inhibition of LOC145988 (Accession XM_085290). Accordingly, utilities of VGAM22 include diagnosis, prevention and treatment of diseases and clinical conditions associated with LOC145988. FIG. 1 further provides a conceptual description of a novel bioinformatically detected viral gene of the present invention, referred to here as Viral Genomic Address Messenger 23 (VGAM23) viral gene, which modulates expression of respective host target genes thereof, the function and utility of which host target genes is known in the art.

VGAM23 is a novel bioinformatically detected regulatory, non protein coding, viral micro RNA (miRNA) gene. The method by which VGAM23 was detected is described hereinabove with reference to FIGS. 1-8.

VGAM23 gene, herein designated VGAM GENE, is a viral gene contained in the genome of Invertebrate Iridescent Virus 6. VGAM23 host target gene, herein designated VGAM HOST TARGET GENE, is a human gene contained in the human genome.

VGAM23 gene encodes a VGAM23 precursor RNA, herein designated VGAM PRECURSOR RNA. Similar to other miRNA genes, and unlike most ordinary genes, VGAM23 precursor RNA does not encode a protein. A nucleotide sequence identical or highly similar to the nucleotide sequence of VGAM23 precursor RNA is designated SEQ ID:9, and is provided hereinbelow with reference to the sequence listing part. Nucleotide sequence SEQ ID:9 is located at position 56871 relative to the genome of Invertebrate Iridescent Virus 6.

VGAM23 precursor RNA folds onto itself, forming VGAM23 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM23 folded precursor RNA into VGAM23 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM23 RNA is designated SEQ ID:2734, and is provided hereinbelow with reference to the sequence listing part.

VGAM23 host target gene, herein designated VGAM HOST TARGET GENE, encodes a corresponding messenger RNA, VGAM23 host target RNA, herein designated VGAM HOST TARGET RNA. VGAM23 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM23 RNA, herein designated VGAM RNA, binds complementarily to one or more host target binding sites located in untranslated regions of VGAM23 host target RNA, herein designated VGAM HOST TARGET RNA. This complementary binding is due to the fact that the nucleotide sequence of VGAM23 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM23 RNA, herein designated VGAM RNA, may have a different number of host target binding sites in untranslated regions of a VGAM23 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM23 RNA, herein designated VGAM RNA, to host target binding sites on VGAM23 host target RNA, herein designated VGAM HOST TARGET RNA, such as BINDING SITE I, BINDING SITE II and BINDING SITE III, inhibits translation of VGAM23 host target RNA into VGAM23 host target protein, herein designated VGAM HOST TARGET PROTEIN. VGAM host target protein is therefore outlined by a broken line.

It is appreciated that VGAM23 host target gene, herein designated VGAM HOST TARGET GENE, in fact represents a plurality of VGAM23 host target genes. The mRNA of each one of this plurality of VGAM23 host target genes comprises one or more host target binding sites, each having a nucleotide sequence which is at least partly complementary to VGAM23 RNA, herein designated VGAM RNA, and which when bound by VGAM23 RNA causes inhibition of translation of respective one or more VGAM23 host target proteins.

It is further appreciated by one skilled in the art that the mode of translational inhibition illustrated by FIG. 1 with specific reference to translational inhibition exerted by VGAM23 gene, herein designated VGAM GENE, on one or more VGAM23 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM23 is inhibition of expression of host target genes, as part of a novel viral mechanism of attacking a host. Accordingly, utilities of VGAM23 include diagnosis, prevention and treatment of viral infection by Invertebrate Iridescent Virus 6. Specific functions, and accordingly utilities, of VGAM23 correlate with, and may be deduced from, the identity of the host target genes which VGAM23 binds and inhibits, and the function of these host target genes, as elaborated hereinbelow.

Nucleotide sequences of the VGAM23 precursor RNA, herein designated VGAM PRECURSOR RNA, and of the 'diced' VGAM23 RNA, herein designated VGAM RNA, and a schematic representation of the secondary folding of VGAM23 folded precursor RNA, herein designated VGAM FOLDED PRECURSOR RNA, of VGAM23 are further described hereinbelow with reference to Table 1.

Nucleotide sequences of host target binding sites, such as BINDING SITE-I, BINDING SITE-II and BINDING SITE-III of FIG. 1, found on VGAM23 host target RNA, and schematic representation of the complementarity of each of these host target binding sites to VGAM23 RNA, herein designated VGAM RNA, are described hereinbelow with reference to Table 2.

As mentioned hereinabove with reference to FIG. 1, a function of VGAM23 gene, herein designated VGAM is inhibition of expression of VGAM23 target genes. It is appreciated that specific functions, and accordingly utilities, of VGAM23 correlate with, and may be deduced from, the identity of the target genes which VGAM23 binds and inhibits, and the function of these target genes, as elaborated hereinbelow.

Ectodermal Dysplasia 1, Anhidrotic (ED1, Accession NM_001399) is a VGAM23 host target gene. ED1 BINDING SITE is HOST TARGET binding site found in the 3' untranslated region of mRNA encoded by ED1, corresponding to a HOST TARGET binding site such as BINDING SITE I, BINDING SITE II or BINDING SITE III. Table 2 illustrates the complementarity of the nucleotide sequences of ED1 BINDING SITE, designated SEQ ID:7099, to the nucleotide sequence of VGAM23 RNA, herein designated VGAM RNA, also designated SEQ ID:2734.

A function of VGAM23 is therefore inhibition of Ectodermal Dysplasia 1, Anhidrotic (ED1, Accession NM_001399). Accordingly, utilities of VGAM23 include diagnosis, prevention and treatment of diseases and clinical conditions associated with ED1. Ephrin-B2 (EFNB2, Accession NM_004093) is another VGAM23 host target gene. EFNB2 BINDING SITE is HOST TARGET binding site found in the 3' untranslated region of mRNA encoded by EFNB2, corresponding to a HOST TARGET binding site such as BINDING SITE I, BINDING SITE II or BINDING SITE III. Table 2 illustrates the complementarity of the nucleotide sequences of EFNB2 BINDING SITE, designated SEQ ID:10296, to the nucleotide sequence of VGAM23 RNA, herein designated VGAM RNA, also designated SEQ ID:2734.

Another function of VGAM23 is therefore inhibition of Ephrin-B2 (EFNB2, Accession NM_004093). Accordingly, utilities of VGAM23 include diagnosis, prevention and treatment of diseases and clinical conditions associated with EFNB2. Protocadherin Gamma Subfamily A, 1 (PCDHGA1, Accession NM_018912) is another VGAM23 host target gene. PCDHGA1 BINDING SITE is HOST TARGET binding site found in the 3' untranslated region of mRNA encoded by PCDHGA1, corresponding to a HOST TARGET binding site such as BINDING SITE I, BINDING SITE II or BINDING SITE III. Table 2 illustrates the complementarity of the nucleotide sequences of PCDHGA1 BINDING SITE, designated SEQ ID:20981, to the nucleotide sequence of VGAM23 RNA, herein designated VGAM RNA, also designated SEQ ID:2734.

Another function of VGAM23 is therefore inhibition of Protocadherin Gamma Subfamily A, 1 (PCDHGA1, Accession NM_018912). Accordingly, utilities of VGAM23 include diagnosis, prevention and treatment of diseases and clinical conditions associated with PCDHGA1. Protocadherin Gamma Subfamily A, 10 (PCDHGA10, Accession NM_018913) is another VGAM23 host target gene. PCDHGA10 BINDING SITE is HOST TARGET binding site found in the 3' untranslated region of mRNA encoded by PCDHGA10, corresponding to a HOST TARGET binding site such as BINDING SITE I, BINDING SITE II or BINDING SITE III. Table 2 illustrates the complementarity of the nucleotide sequences of PCDHGA10 BINDING SITE, designated SEQ ID:20982, to the nucleotide sequence of VGAM23 RNA, herein designated VGAM RNA, also designated SEQ ID:2734.

Another function of VGAM23 is therefore inhibition of Protocadherin Gamma Subfamily A, 10 (PCDHGA10, Accession NM_018913). Accordingly, utilities of VGAM23 include diagnosis, prevention and treatment of diseases and clinical conditions associated with PCDHGA10. Protocadherin Gamma Subfamily A, 11 (PCDHGA11, Accession NM_018914) is another VGAM23 host target gene. PCDHGA11 BINDING SITE1 and PCDHGA11 BINDING SITE2 are HOST TARGET binding sites found in untranslated regions of mRNA encoded by PCDHGA11, corresponding to HOST TARGET binding sites such as BINDING SITE I, BINDING SITE II or BINDING SITE III. Table 2 illustrates the complementarity of the nucleotide sequences of PCDHGA11 BINDING SITE1 and PCDHGA11 BINDING SITE2, designated SEQ ID:20984 and SEQ ID:25790 respectively, to the nucleotide sequence of VGAM23 RNA, herein designated VGAM RNA, also designated SEQ ID:2734.

Another function of VGAM23 is therefore inhibition of Protocadherin Gamma Subfamily A, 11 (PCDHGA11, Accession NM_018914). Accordingly, utilities of VGAM23 include diagnosis, prevention and treatment of diseases and clinical conditions associated with PCDHGA11. Protocadherin Gamma Subfamily A, 2 (PCDHGA2, Accession NM_018915) is another VGAM23 host target gene. PCDHGA2 BINDING SITE is HOST TARGET binding site found in the 3' untranslated region of mRNA encoded by PCDHGA2, corresponding to a HOST TARGET binding site such as BINDING SITE I, BINDING SITE II or BINDING SITE III. Table 2 illustrates the complementarity of the nucleotide sequences of PCDHGA2 BINDING SITE, designated SEQ ID:20985, to the nucleotide sequence of VGAM23 RNA, herein designated VGAM RNA, also designated SEQ ID:2734.

Another function of VGAM23 is therefore inhibition of Protocadherin Gamma Subfamily A, 2 (PCDHGA2, Accession NM_018915). Accordingly, utilities of VGAM23 include diagnosis, prevention and treatment of diseases and clinical conditions associated with PCDHGA2. Protocadherin Gamma Subfamily A, 3 (PCDHGA3, Accession NM_018916) is another VGAM23 host target gene. PCDHGA3 BINDING SITE is HOST TARGET binding site found in the 3' untranslated region of mRNA encoded by PCDHGA3, corresponding to a HOST TARGET binding site such as BINDING SITE I, BINDING SITE II or BINDING SITE III. Table 2 illustrates the complementarity of the nucleotide sequences of PCDHGA3 BINDING SITE, designated SEQ ID:20986, to the nucleotide sequence of VGAM23 RNA, herein designated VGAM RNA, also designated SEQ ID:2734.

Another function of VGAM23 is therefore inhibition of Protocadherin Gamma Subfamily A, 3 (PCDHGA3, Accession NM_018916), a gene which is a potential calcium-dependent cell-adhesion protein. Accordingly, utilities of VGAM23 include diagnosis, prevention and treatment of diseases and clinical conditions associated with PCDHGA3. The function of PCDHGA3 has been established by previous studies. Cadherins are calcium-dependent cell-cell adhesion molecules that mediate neural cell-cell interactions. Protocadherins constitute a subfamily of nonclassic cadherins. PCDHGA3 is a member of subfamily A of the gamma cluster of protocadherin genes on 5q31. For specific information on the PCDHG genes, see 604968. Using PCR on a brain cDNA library, Wu and Maniatis (1999) obtained cDNAs encoding 2 isoforms of PCDHGA3. Sequence analysis predicted that the long isoform of PCDHGA3 contains 932 amino acids (GenBank AAD43717) and is 48% identical to PCDHGC4 (OMIM Ref. No. 606305). The C-terminal 134 amino acids of PCDHGA3 and PCDHGC4 are identical and have a lysine-rich motif. PCDHGA3 has a signal peptide, 4 putative N-linked glycosylation sites, and 6 cadherin ectodomains.

Full details of the abovementioned studies are described in the following publications, the disclosure of which are hereby incorporated by reference:

Wu, Q.; Maniatis, T.: A striking organization of a large family of human neural cadherin like cell adhesion genes. Cell 97:779-790, 1999; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse a.

Further studies establishing the function and utilities of PCDHGA3 are found in John Hopkins OMIM database record ID 606290, and in sited publications numbered 675 and 9535 listed in the bibliography section hereinbelow, which are also hereby incorporated by reference. Protocadherin Gamma Subfamily A, 4 (PCDHGA4, Accession NM_018917) is another VGAM23 host target gene. PCDHGA4 BINDING SITE is HOST TARGET binding site found in the 3' untranslated region of mRNA encoded by PCDHGA4, corresponding to a HOST TARGET binding site such as BINDING SITE I, BINDING SITE II or BINDING SITE III. Table 2 illustrates the complementarity of the nucleotide sequences of PCDHGA4 BINDING SITE, designated SEQ ID:20987, to the nucleotide sequence of VGAM23 RNA, herein designated VGAM RNA, also designated SEQ ID:2734.

Another function of VGAM23 is therefore inhibition of Protocadherin Gamma Subfamily A, 4 (PCDHGA4, Accession NM_018917). Accordingly, utilities of VGAM23 include diagnosis, prevention and treatment of diseases and clinical conditions associated with PCDHGA4. Protocadherin Gamma Subfamily A, 5 (PCDHGA5, Accession NM_018918) is another VGAM23 host target gene. PCDHGA5 BINDING SITE is HOST TARGET binding site found in the 3' untranslated region of mRNA encoded by PCDHGA5, corresponding to a HOST TARGET binding site such as BINDING SITE I, BINDING SITE II or BINDING SITE III. Table 2 illustrates the complementarity of the nucleotide sequences of PCDHGA5 BINDING SITE, designated SEQ ID:20988, to the nucleotide sequence of VGAM23 RNA, herein designated VGAM RNA, also designated SEQ ID:2734.

Another function of VGAM23 is therefore inhibition of Protocadherin Gamma Subfamily A, 5 (PCDHGA5, Accession NM_018918), a gene which is a potential calcium-dependent cell-adhesion protein. Accordingly, utilities of VGAM23 include diagnosis, prevention and treatment of diseases and clinical conditions associated with PCDHGA5. The function of PCDHGA5 has been established by previous studies. Cadherins are calcium-dependent cell-cell adhesion molecules that mediate neural cell-cell interactions. Protocadherins constitute a subfamily of nonclassic cadherins. PCDHGA5 is a member of subfamily A of the gamma cluster of protocadherin genes on 5q31. For specific information on the PCDHG genes, see 604968. Using PCR with degenerate primers to screen melanoma cell lines, Matsuyoshi et al. (1997) obtained a cDNA fragment encoding part of PCDHGA5, which they termed ME3. RT-PCR analysis detected expression of ME3 in 1 of 2 melanoma cell lines but not in normal melanocytes.

Full details of the abovementioned studies are described in the following publications, the disclosure of which are hereby incorporated by reference:

Matsuyoshi, N.; Tanaka, T.; Toda, K.; Imamura, S.: Identification of novel cadherins expressed in human melanoma cells. J. Invest. Derm. 108:908-913, 1997; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse an.

Further studies establishing the function and utilities of PCDHGA5 are found in John Hopkins OMIM database record ID 606292, and in sited publications numbered 451 and 9535 listed in the bibliography section hereinbelow, which are also hereby incorporated by reference. Protocadherin Gamma Subfamily A, 6 (PCDHGA6, Accession NM_018919) is another VGAM23 host target gene. PCDHGA6 BINDING SITE is HOST TARGET binding site found in the 3' untranslated region of mRNA encoded by PCDHGA6, corresponding to a HOST TARGET binding site such as BINDING SITE I, BINDING SITE II or BINDING SITE III. Table 2 illustrates the complementarity of the nucleotide sequences of PCDHGA6 BINDING SITE, designated SEQ ID:20989, to the nucleotide sequence of VGAM23 RNA, herein designated VGAM RNA, also designated SEQ ID:2734.

Another function of VGAM23 is therefore inhibition of Protocadherin Gamma Subfamily A, 6 (PCDHGA6, Accession NM_018919). Accordingly, utilities of VGAM23 include diagnosis, prevention and treatment of diseases and clinical conditions associated with PCDHGA6. Protocadherin Gamma Subfamily A, 7 (PCDHGA7, Accession NM_018920) is another VGAM23 host target gene. PCDHGA7 BINDING SITE is HOST TARGET binding site found in the 3' untranslated region of mRNA encoded by PCDHGA7, corresponding to a HOST TARGET binding site such as BINDING SITE I, BINDING SITE II or BINDING SITE III. Table 2 illustrates the complementarity of the nucleotide sequences of PCDHGA7 BINDING SITE, designated SEQ ID:20990, to the nucleotide sequence of VGAM23 RNA, herein designated VGAM RNA, also designated SEQ ID:2734.

Another function of VGAM23 is therefore inhibition of Protocadherin Gamma Subfamily A, 7 (PCDHGA7, Accession NM_018920). Accordingly, utilities of VGAM23 include diagnosis, prevention and treatment of diseases and clinical conditions associated with PCDHGA7. Protocadherin Gamma Subfamily A, 8 (PCDHGA8, Accession NM_032088) is another VGAM23 host target gene. PCDHGA8 BINDING SITE is HOST TARGET binding site found in the 3' untranslated region of mRNA encoded by PCDHGA8, corresponding to a HOST TARGET binding site such as BINDING SITE I, BINDING SITE II or BINDING SITE III. Table 2 illustrates the complementarity of the nucleotide sequences of PCDHGA8 BINDING SITE, designated SEQ ID:25787, to the nucleotide sequence of VGAM23 RNA, herein designated VGAM RNA, also designated SEQ ID:2734.

Another function of VGAM23 is therefore inhibition of Protocadherin Gamma Subfamily A, 8 (PCDHGA8, Accession NM_032088), a gene which is a potential calcium-dependent cell-adhesion protein. Accordingly, utilities of VGAM23 include diagnosis, prevention and treatment of diseases and clinical conditions associated with PCDHGA8. The function of PCDHGA8 has been established by previous studies. Cadherins are calcium-dependent cell-cell adhesion molecules that mediate neural cell-cell interactions. Protocadherins constitute a subfamily of nonclassic cadherins. PCDHGA8 is a member of subfamily A of the gamma cluster of protocadherin genes on 5q31. For specific information on the PCDHG genes, see 604968. By screening a brain cDNA library for genes with the potential to encode large proteins, Nagase et al. (1997) identified a cDNA encoding PCDHGA8, which they termed KIAA0327. The 820-amino acid protein was predicted to be involved in cell signaling. RT-PCR analysis detected weak expression in placenta and kidney.

Full details of the abovementioned studies are described in the following publications, the disclosure of which are hereby incorporated by reference:

Nagase, T.; Ishikawa, K.; Nakajima, D.; Ohira, M.; Seki, N.; Miyajima, N.; Tanaka, A.; Kotani, H.; Nomura, N.; Ohara, O.: Prediction of the coding sequences of unidentified human genes. VII. The complete sequences of 100 new cDNA clones from brain which can code for large proteins in vitro. DNA Res. 4:141-150, 1997; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse an.

Further studies establishing the function and utilities of PCDHGA8 are found in John Hopkins OMIM database record ID 606295, and in sited publications numbered 95 and 9535 listed in the bibliography section hereinbelow, which are also hereby incorporated by reference. Protocadherin Gamma Subfamily A, 9 (PCDHGA9, Accession NM_018921) is another VGAM23 host target gene. PCDHGA9 BINDING SITE is HOST TARGET binding site found in the 3' untranslated region of mRNA encoded by PCDHGA9, corresponding to a HOST TARGET binding site such as BINDING SITE I, BINDING SITE II or BINDING SITE III. Table 2 illustrates the complementarity of the nucleotide sequences of PCDHGA9 BINDING SITE, designated SEQ ID:20991, to the nucleotide sequence of VGAM23 RNA, herein designated VGAM RNA, also designated SEQ ID:2734.

Another function of VGAM23 is therefore inhibition of Protocadherin Gamma Subfamily A, 9 (PCDHGA9, Accession NM_018921). Accordingly, utilities of VGAM23 include diagnosis, prevention and treatment of diseases and clinical conditions associated with PCDHGA9. Protocadherin Gamma Subfamily B, 1 (PCDHGB1, Accession NM_018922) is another VGAM23 host target gene. PCDHGB1 BINDING SITE is HOST TARGET binding site found in the 3' untranslated region of mRNA encoded by PCDHGB1, corresponding to a HOST TARGET binding site such as BINDING SITE I, BINDING SITE II or BINDING SITE III. Table 2 illustrates the complementarity of the nucleotide sequences of PCDHGB1 BINDING SITE, designated SEQ ID:20992, to the nucleotide sequence of VGAM23 RNA, herein designated VGAM RNA, also designated SEQ ID:2734.

Another function of VGAM23 is therefore inhibition of Protocadherin Gamma Subfamily B, 1 (PCDHGB1, Accession NM_018922). Accordingly, utilities of VGAM23 include diagnosis, prevention and treatment of diseases and clinical conditions associated with PCDHGB1. Protocadherin Gamma Subfamily B, 2 (PCDHGB2, Accession NM_018923) is another VGAM23 host target gene. PCDHGB2 BINDING SITE is HOST TARGET binding site found in the 3' untranslated region of mRNA encoded by PCDHGB2, corresponding to a HOST TARGET binding site such as BINDING SITE I, BINDING SITE II or BINDING SITE III. Table 2 illustrates the complementarity of the nucleotide sequences of PCDHGB2 BINDING SITE, designated SEQ ID:20993, to the nucleotide sequence of VGAM23 RNA, herein designated VGAM RNA, also designated SEQ ID:2734.

Another function of VGAM23 is therefore inhibition of Protocadherin Gamma Subfamily B, 2 (PCDHGB2, Accession NM_018923). Accordingly, utilities of VGAM23 include diagnosis, prevention and treatment of diseases and clinical conditions associated with PCDHGB2. Protocadherin Gamma Subfamily B, 3 (PCDHGB3, Accession NM_018924) is another VGAM23 host target gene. PCDHGB3 BINDING SITE is HOST TARGET binding site found in the 3' untranslated region of mRNA encoded by PCDHGB3, corresponding to a HOST TARGET binding site such as BINDING SITE I, BINDING SITE II or BINDING SITE III. Table 2 illustrates the complementarity of the nucleotide sequences of PCDHGB3 BINDING SITE, designated SEQ ID:20994, to the nucleotide sequence of VGAM23 RNA, herein designated VGAM RNA, also designated SEQ ID:2734.

Another function of VGAM23 is therefore inhibition of Protocadherin Gamma Subfamily B, 3 (PCDHGB3, Accession NM_018924). Accordingly, utilities of VGAM23 include diagnosis, prevention and treatment of diseases and clinical conditions associated with PCDHGB3. Protocadherin Gamma Subfamily B, 4 (PCDHGB4, Accession NM_003736) is another VGAM23 host target gene. PCDHGB4 BINDING SITE is HOST TARGET binding site found in the 3' untranslated region of mRNA encoded by PCDHGB4, corresponding to a HOST TARGET binding site such as BINDING SITE I, BINDING SITE II or BINDING SITE III. Table 2 illustrates the complementarity of the nucleotide sequences of PCDHGB4 BINDING SITE, designated SEQ ID:9827, to the nucleotide sequence of VGAM23 RNA, herein designated VGAM RNA, also designated SEQ ID:2734.

Another function of VGAM23 is therefore inhibition of Protocadherin Gamma Subfamily B, 4 (PCDHGB4, Accession NM_003736), a gene which is a potential calcium-dependent cell-adhesion protein. Accordingly, utilities of VGAM23 include diagnosis, prevention and treatment of diseases and clinical conditions associated with PCDHGB4. The function of PCDHGB4 has been established by previous studies. Cadherins are calcium-dependent cell-cell adhesion molecules that mediate neural cell-cell interactions. Protocadherins constitute a subfamily of nonclassic cadherins. PCDHGB4 is a member of subfamily B of the gamma cluster of protocadherin genes on 5q31. For specific information on the PCDHG genes, see 604968. To elucidate the molecular basis of fibroblast cell-cell adhesion, Matsuyoshi and Imamura (1997) investigated cadherin expression in human fibroblasts by RT-PCR using degenerate primers based on well-conserved amino acid sequences of cadherins. They isolated a partial cDNA encoding PCDHGB4, which they called FIB2. RT-PCR analysis revealed that FIB2 is expressed in fibroblasts but not in melanocytes or keratinocytes.

Full details of the abovementioned studies are described in the following publications, the disclosure of which are hereby incorporated by reference:

Matsuyoshi, N.; Imamura, S.: Multiple cadherins are expressed in human fibroblasts. Biochem. Biophys. Res. Commun. 235:355-358, 1997; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse an.

Further studies establishing the function and utilities of PCDHGB4 are found in John Hopkins OMIM database record ID 603058, and in sited publications numbered 848 and 9535 listed in the bibliography section hereinbelow, which are also hereby incorporated by reference. Protocadherin Gamma Subfamily B, 5 (PCDHGB5, Accession NM_018925) is another VGAM23 host target gene. PCDHGB5 BINDING SITE is HOST TARGET binding site found in the 3' untranslated region of mRNA encoded by PCDHGB5, corresponding to a HOST TARGET binding site such as BINDING SITE I, BINDING SITE II or BINDING SITE III. Table 2 illustrates the complementarity of the nucleotide sequences of PCDHGB5 BINDING SITE, designated SEQ ID:20995, to the nucleotide sequence of VGAM23 RNA, herein designated VGAM RNA, also designated SEQ ID:2734.

Another function of VGAM23 is therefore inhibition of Protocadherin Gamma Subfamily B, 5 (PCDHGB5, Accession NM_018925). Accordingly, utilities of VGAM23 include diagnosis, prevention and treatment of diseases and clinical conditions associated with PCDHGB5. Protocadherin Gamma Subfamily B, 6 (PCDHGB6, Accession NM_018926) is another VGAM23 host target gene. PCDHGB6 BINDING SITE is HOST TARGET binding site found in the 3' untranslated region of mRNA encoded by PCDHGB6, corresponding to a HOST TARGET binding site such as BINDING SITE I, BINDING SITE II or BINDING SITE III. Table 2 illustrates the complementarity of the nucleotide sequences of PCDHGB6 BINDING SITE, designated SEQ ID:20996, to the nucleotide sequence of VGAM23 RNA, herein designated VGAM RNA, also designated SEQ ID:2734.

Another function of VGAM23 is therefore inhibition of Protocadherin Gamma Subfamily B, 6 (PCDHGB6, Accession NM_018926). Accordingly, utilities of VGAM23 include diagnosis, prevention and treatment of diseases and clinical conditions associated with PCDHGB6. Protocadherin Gamma Subfamily B, 7 (PCDHGB7, Accession NM_018927) is another VGAM23 host target gene. PCDHGB7 BINDING SITE is HOST TARGET binding site found in the 3' untranslated region of mRNA encoded by PCDHGB7, corresponding to a HOST TARGET binding site such as BINDING SITE I, BINDING SITE II or BINDING SITE III. Table 2 illustrates the complementarity of the nucleotide sequences of PCDHGB7 BINDING SITE, designated SEQ ID:20997, to the nucleotide sequence of VGAM23 RNA, herein designated VGAM RNA, also designated SEQ ID:2734.

Another function of VGAM23 is therefore inhibition of Protocadherin Gamma Subfamily B, 7 (PCDHGB7, Accession NM_018927), a gene which is a potential calcium-dependent cell-adhesion protein. Accordingly, utilities of VGAM23 include diagnosis, prevention and treatment of diseases and clinical conditions associated with PCDHGB7. The function of PCDHGB7 has been established by previous studies. Cadherins are calcium-dependent cell-cell adhesion molecules that mediate neural cell-cell interactions. Protocadherins constitute a subfamily of nonclassic cadherins. PCDHGB7 is a member of subfamily B of the gamma cluster of protocadherin genes on 5q31. For specific information on the PCDHG genes, see 604968. Using PCR with degenerate primers to screen melanoma cell lines, Matsuyoshi et al. (1997) obtained a cDNA fragment encoding part of PCDHGB7, which they termed ME6. RT-PCR analysis detected expression of ME6 in 2 melanoma cell lines, a squamous cell carcinoma cell line, and normal fibroblasts and melanocytes.

Full details of the abovementioned studies are described in the following publications, the disclosure of which are hereby incorporated by reference:

Matsuyoshi, N.; Tanaka, T.; Toda, K.; Imamura, S.: Identification of novel cadherins expressed in human melanoma cells. J. Invest. Derm. 108:908-913, 1997; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse an.

Further studies establishing the function and utilities of PCDHGB7 are found in John Hopkins OMIM database record ID 606304, and in sited publications numbered 451 and 9535 listed in the bibliography section hereinbelow, which are also hereby incorporated by reference. Protocadherin Gamma Subfamily C, 3 (PCDHGC3, Accession NM_032403) is another VGAM23 host target gene. PCDHGC3 BINDING SITE1 and PCDHGC3 BINDING SITE2 are HOST TARGET binding sites found in untranslated regions of mRNA encoded by PCDHGC3, corresponding to HOST TARGET binding sites such as BINDING SITE I, BINDING SITE II or BINDING SITE III. Table 2 illustrates the complementarity of the nucleotide sequences of PCDHGC3 BINDING SITE1 and PCDHGC3 BINDING SITE2, designated SEQ ID:26188 and SEQ ID:8450 respectively, to the nucleotide sequence of VGAM23 RNA, herein designated VGAM RNA, also designated SEQ ID:2734.

Another function of VGAM23 is therefore inhibition of Protocadherin Gamma Subfamily C, 3 (PCDHGC3, Accession NM_032403), a gene which is a potential calcium-dependent cell-adhesion protein. Accordingly, utilities of VGAM23 include diagnosis, prevention and treatment of diseases and clinical conditions associated with PCDHGC3. The function of PCDHGC3 has been established by previous studies. Cadherins are calcium-dependent cell-cell adhesion molecules that mediate neural cell-cell interactions. Protocadherins constitute a subfamily of nonclassic cadherins. PCDHGC3 is a member of subfamily C of the gamma cluster of protocadherin genes on 5q31. For specific information on the PCDHG genes, see 604968. Sano et al. (1993) isolated cDNAs encoding PCDHGC3, which they termed pc43, and other protocadherins from several organisms. Like pc42 (OMIM Ref. No. 603626), human pc43 contains an N-terminal extracellular domain, a transmembrane domain, and a C-terminal cytoplasmic region. On Western blots of extracts of a human neuroblastoma cell line, pc43 migrated at 150 kD. Immunofluorescence microscopy localized pc43 to the periphery of cells, primarily in cell-cell contact sites. Cells expressing pc43 showed cell aggregation activity.

Full details of the abovementioned studies are described in the following publications, the disclosure of which are hereby incorporated by reference:

Sano, K.; Tanihara, H.; Heimark, R. L.; Obata, S.; Davidson, M.; St. John, T.; Taketani, S.; Suzuki, S.: Protocadherins: a large family of cadherin-related molecules in central nervous system. EMBO J. 12:2249-2256, 1993; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse and.

Further studies establishing the function and utilities of PCDHGC3 are found in John Hopkins OMIM database record ID 603627, and in sited publications numbered 6861, 762 and 9535 listed in the bibliography section hereinbelow, which are also hereby incorporated by reference. Protocadherin Gamma Subfamily C, 5 (PCDHGC5, Accession NM_018929) is another VGAM23 host target gene. PCDHGC5 BINDING SITE is HOST TARGET binding site found in the 3' untranslated region of mRNA encoded by PCDHGC5, corresponding to a HOST TARGET binding site such as BINDING SITE I, BINDING SITE II or BINDING SITE III. Table 2 illustrates the complementarity of the nucleotide sequences of PCDHGC5 BINDING SITE, designated SEQ ID:20999, to the nucleotide sequence of VGAM23 RNA, herein designated VGAM RNA, also designated SEQ ID:2734.

Another function of VGAM23 is therefore inhibition of Protocadherin Gamma Subfamily C, 5 (PCDHGC5, Accession NM_018929). Accordingly, utilities of VGAM23 include diagnosis, prevention and treatment of diseases and clinical conditions associated with PCDHGC5. Transforming, Acidic Coiled-coil Containing Protein 1 (TACC1, Accession NM_006283) is another VGAM23 host target gene. TACC1 BINDING SITE is HOST TARGET binding site found in the 3' untranslated region of mRNA encoded by TACC1, corresponding to a HOST TARGET binding site such as BINDING SITE I, BINDING SITE II or BINDING SITE III. Table 2 illustrates the complementarity of the nucleotide sequences of TACC1 BINDING SITE, designated SEQ ID:12963, to the nucleotide sequence of VGAM23 RNA, herein designated VGAM RNA, also designated SEQ ID:2734.

Another function of VGAM23 is therefore inhibition of Transforming, Acidic Coiled-coil Containing Protein 1 (TACC1, Accession NM_006283). Accordingly, utilities of VGAM23 include diagnosis, prevention and treatment of diseases and clinical conditions associated with TACC1. TEM7 (Accession NM_020405) is another VGAM23 host target gene. TEM7 BINDING SITE is HOST TARGET binding site found in the 3' untranslated region of mRNA encoded by TEM7, corresponding to a HOST TARGET binding site such as BINDING SITE I, BINDING SITE II or BINDING SITE III. Table 2 illustrates the complementarity of the nucleotide sequences of TEM7 BINDING SITE, designated SEQ ID:21674, to the nucleotide sequence of VGAM23 RNA, herein designated VGAM RNA, also designated SEQ ID:2734.

Another function of VGAM23 is therefore inhibition of TEM7 (Accession NM_020405), a gene which involves in angiogenesis. Accordingly, utilities of VGAM23 include diagnosis, prevention and treatment of diseases and clinical conditions associated with TEM7. The function of TEM7 has been established by previous studies. Using serial analysis of gene expression (SAGE), St Croix et al. (2000) identified partial cDNAs corresponding to several tumor endothelial markers (TEMs) that displayed elevated expression during tumor angiogenesis. Among the genes they identified was TEM7. Using database searches and 5-prime RACE, Carson-Walter et al. (2001) derived sequences covering the entire TEM7 coding region, which encodes a 500-amino acid type I transmembrane protein containing a plexin-like domain. An alternate transcript of the TEM7 gene had been designated TEM3 by St Croix et al. (2000). TEM3 and TEM7 differ in the use of alternative polyadenylation sites but result in the same predicted protein. The mouse ortholog of TEM7 shares 81% amino acid identity with the human protein. In situ hybridization analysis of human colorectal cancer by Carson-Walter et al. (2001) demonstrated that TEM7 was expressed clearly in the endothelial cells of the tumor stroma but not in the endothelial cells of normal colonic tissue. Using in situ hybridization to assay expression in various normal adult mouse tissues, they observed that Tem7 was largely undetectable in mouse tissues or tumors, but was abundantly expressed in mouse brain. Carson-Walter et al. (2001) localized Tem7 expression to Purkinje cells of the cerebellum and some neuronal cells.

Full details of the abovementioned studies are described in the following publications, the disclosure of which are hereby incorporated by reference:

Carson-Walter, E. B.; Watkins, D. N.; Nanda, A.; Vogelstein, B.; Kinzler, K. W.; St. Croix, B.: Cell surface tumor endothelial markers are conserved in mice and human S. Cancer Res. 61:6649-6655, 2001; and St. Croix, B.; Rago, C.; Velculescu, V.; Traverso, G.; Romans, K. E.; Montgomery, E.; Lal, A.; Riggins, G. J.; Lengauer, C.; Vogelstein, B.; Kinzler, K. W.: Genes expressed in human tu.

Further studies establishing the function and utilities of TEM7 are found in John Hopkins OMIM database record ID 606826, and in sited publications numbered 689 and 6907 listed in the bibliography section hereinbelow, which are also hereby incorporated by reference. Eukaryotic Translation Initiation Factor 4B (EIF4B, Accession XM_071605) is another VGAM23 host target gene. EIF4B BINDING SITE is HOST TARGET binding site found in the 3" untranslated region of mRNA encoded by EIF4B, corresponding to a HOST TARGET binding site such as BINDING SITE I, BINDING SITE II or BINDING SITE III. Table 2 illustrates the complementarity of the nucleotide sequences of EIF4B BINDING SITE, designated SEQ ID:37402, to the nucleotide sequence of VGAM23 RNA, herein designated VGAM RNA, also designated SEQ ID:2734.

Another function of VGAM23 is therefore inhibition of Eukaryotic Translation Initiation Factor 4B (EIF4B, Accession XM_071605). Accordingly, utilities of VGAM23 include diagnosis, prevention and treatment of diseases and clinical conditions associated with EIF4B. FLJ13150 (Accession NM_024813) is another VGAM23 host target gene. FLJ13150 BINDING SITE is HOST TARGET binding site found in the 3" untranslated region of mRNA encoded by FLJ13150, corresponding to a HOST TARGET binding site such as BINDING SITE I, BINDING SITE II or BINDING SITE III. Table 2 illustrates the complementarity of the nucleotide sequences of FLJ13150 BINDING SITE, designated SEQ ID:24201, to the nucleotide sequence of VGAM23 RNA, herein designated VGAM RNA, also designated SEQ ID:2734.

Another function of VGAM23 is therefore inhibition of FLJ13150 (Accession NM_024813). Accordingly, utilities of VGAM23 include diagnosis, prevention and treatment of diseases and clinical conditions associated with FLJ13150.

FLJ14327 (Accession NM_024912) is another VGAM23 host target gene. FLJ14327 BINDING SITE is HOST TARGET binding site found in the 3' untranslated region of mRNA encoded by FLJ14327, corresponding to a HOST TARGET binding site such as BINDING SITE I, BINDING SITE II or BINDING SITE III. Table 2 illustrates the complementarity of the nucleotide sequences of FLJ14327 BINDING SITE, designated SEQ ID:24425, to the nucleotide sequence of VGAM23 RNA, herein designated VGAM RNA, also designated SEQ ID:2734.

Another function of VGAM23 is therefore inhibition of FLJ14327 (Accession NM_024912). Accordingly, utilities of VGAM23 include diagnosis, prevention and treatment of diseases and clinical conditions associated with FLJ14327. FYVE and Coiled-coil Domain Containing 1 (FYCO1, Accession NM_024513) is another VGAM23 host target gene. FYCO1 BINDING SITE is HOST TARGET binding site found in the 3' untranslated region of mRNA encoded by FYCO1, corresponding to a HOST TARGET binding site such as BINDING SITE I, BINDING SITE II or BINDING SITE III. Table 2 illustrates the complementarity of the nucleotide sequences of FYCO1 BINDING SITE, designated SEQ ID:23708, to the nucleotide sequence of VGAM23 RNA, herein designated VGAM RNA, also designated SEQ ID:2734.

Another function of VGAM23 is therefore inhibition of FYVE and Coiled-coil Domain Containing 1 (FYCO1, Accession NM_024513). Accordingly, utilities of VGAM23 include diagnosis, prevention and treatment of diseases and clinical conditions associated with FYCO1. KIAA0125 (Accession XM_018203) is another VGAM23 host target gene. KIAA0125 BINDING SITE is HOST TARGET binding site found in the 3' untranslated region of mRNA encoded by KIAA0125, corresponding to a HOST TARGET binding site such as BINDING SITE I, BINDING SITE II or BINDING SITE III. Table 2 illustrates the complementarity of the nucleotide sequences of KIAA0125 BINDING SITE, designated SEQ ID:30346, to the nucleotide sequence of VGAM23 RNA, herein designated VGAM RNA, also designated SEQ ID:2734.

Another function of VGAM23 is therefore inhibition of KIAA0125 (Accession XM_018203). Accordingly, utilities of VGAM23 include diagnosis, prevention and treatment of diseases and clinical conditions associated with KIAA0125. KIAA0202 (Accession XM_034872) is another VGAM23 host target gene. KIAA0202 BINDING SITE is HOST TARGET binding site found in the 3' untranslated region of mRNA encoded by KIAA0202, corresponding to a HOST TARGET binding site such as BINDING SITE I, BINDING SITE II or BINDING SITE III. Table 2 illustrates the complementarity of the nucleotide sequences of KIAA0202 BINDING SITE, designated SEQ ID:32180, to the nucleotide sequence of VGAM23 RNA, herein designated VGAM RNA, also designated SEQ ID:2734.

Another function of VGAM23 is therefore inhibition of KIAA0202 (Accession XM_034872). Accordingly, utilities of VGAM23 include diagnosis, prevention and treatment of diseases and clinical conditions associated with KIAA0202. KIAA0748 (Accession NM_014796) is another VGAM23 host target gene. KIAA0748 BINDING SITE is HOST TARGET binding site found in the 3' untranslated region of mRNA encoded by KIAA0748, corresponding to a HOST TARGET binding site such as BINDING SITE I, BINDING SITE II or BINDING SITE III. Table 2 illustrates the complementarity of the nucleotide sequences of KIAA0748 BINDING SITE, designated SEQ ID:16703, to the nucleotide sequence of VGAM23 RNA, herein designated VGAM RNA, also designated SEQ ID:2734.

Another function of VGAM23 is therefore inhibition of KIAA0748 (Accession NM_014796). Accordingly, utilities of VGAM23 include diagnosis, prevention and treatment of diseases and clinical conditions associated with KIAA0748. N4BP3 (Accession XM_038920) is another VGAM23 host target gene. N4BP3 BINDING SITE is HOST TARGET binding site found in the 3' untranslated region of mRNA encoded by N4BP3, corresponding to a HOST TARGET binding site such as BINDING SITE I, BINDING SITE II or BINDING SITE III. Table 2 illustrates the complementarity of the nucleotide sequences of N4BP3 BINDING SITE, designated SEQ ID:32939, to the nucleotide sequence of VGAM23 RNA, herein designated VGAM RNA, also designated SEQ ID:2734.

Another function of VGAM23 is therefore inhibition of N4BP3 (Accession XM_038920). Accordingly, utilities of VGAM23 include diagnosis, prevention and treatment of diseases and clinical conditions associated with N4BP3. PRO1770 (Accession NM_014100) is another VGAM23 host target gene. PRO1770 BINDING SITE is HOST TARGET binding site found in the 3' untranslated region of mRNA encoded by PRO1770, corresponding to a HOST TARGET binding site such as BINDING SITE I, BINDING SITE II or BINDING SITE III. Table 2 illustrates the complementarity of the nucleotide sequences of PRO1770 BINDING SITE, designated SEQ ID:15325, to the nucleotide sequence of VGAM23 RNA, herein designated VGAM RNA, also designated SEQ ID:2734.

Another function of VGAM23 is therefore inhibition of PRO1770 (Accession NM_014100). Accordingly, utilities of VGAM23 include diagnosis, prevention and treatment of diseases and clinical conditions associated with PRO1770. Ubiquitin-conjugating Enzyme E2G 1 (UBC7 homolog, C. elegans) (UBE2G1, Accession NM_003342) is another VGAM23 host target gene. UBE2G1 BINDING SITE is HOST TARGET binding site found in the 3' untranslated region of mRNA encoded by UBE2G1, corresponding to a HOST TARGET binding site such as BINDING SITE I, BINDING SITE II or BINDING SITE III. Table 2 illustrates the complementarity of the nucleotide sequences of UBE2G1 BINDING SITE, designated SEQ ID:9347, to the nucleotide sequence of VGAM23 RNA, herein designated VGAM RNA, also designated SEQ ID:2734.

Another function of VGAM23 is therefore inhibition of Ubiquitin-conjugating Enzyme E2G 1 (UBC7 homolog, C. elegans) (UBE2G1, Accession NM_003342). Accordingly, utilities of VGAM23 include diagnosis, prevention and treatment of diseases and clinical conditions associated with UBE2G1. Unc-5 Homolog D (C. elegans) (UNC5D, Accession NM_080872) is another VGAM23 host target gene. UNC5D BINDING SITE is HOST TARGET binding site found in the 3' untranslated region of mRNA encoded by UNC5D, corresponding to a HOST TARGET binding site such as BINDING SITE I, BINDING SITE II or BINDING SITE III. Table 2 illustrates the complementarity of the nucleotide sequences of UNC5D BINDING SITE, designated SEQ ID:28117, to the nucleotide sequence of VGAM23 RNA, herein designated VGAM RNA, also designated SEQ ID:2734.

Another function of VGAM23 is therefore inhibition of Unc-5 Homolog D (C. elegans) (UNC5D, Accession NM_080872). Accordingly, utilities of VGAM23 include diagnosis, prevention and treatment of diseases and clinical conditions associated with UNC5D. Voltage-dependent Anion Channel 3 (VDAC3, Accession NM_005662) is another VGAM23 host target gene. VDAC3 BINDING SITE is HOST TARGET binding site found in the 3' untranslated region of mRNA encoded by VDAC3, corresponding to a HOST TARGET binding site such as BINDING SITE I, BINDING SITE II or BINDING SITE III. Table 2 illustrates the complementarity of the nucleotide sequences of VDAC3 BINDING SITE, designated SEQ ID:12204, to the nucleotide sequence of VGAM23 RNA, herein designated VGAM RNA, also designated SEQ ID:2734.

Another function of VGAM23 is therefore inhibition of Voltage-dependent Anion Channel 3 (VDAC3, Accession NM_005662). Accordingly, utilities of VGAM23 include diagnosis, prevention and treatment of diseases and clinical conditions associated with VDAC3. LOC145980 (Accession XM_096914) is another VGAM23 host target gene. LOC145980 BINDING SITE is HOST TARGET binding site found in the 5' untranslated region of mRNA encoded by LOC145980, corresponding to a HOST TARGET binding site such as BINDING SITE I, BINDING SITE II or BINDING SITE III. Table 2 illustrates the complementarity of the nucleotide sequences of LOC145980 BINDING SITE, designated SEQ ID:40651, to the nucleotide sequence of VGAM23 RNA, herein designated VGAM RNA, also designated SEQ ID:2734.

Another function of VGAM23 is therefore inhibition of LOC145980 (Accession XM_096914). Accordingly, utilities of VGAM23 include diagnosis, prevention and treatment of diseases and clinical conditions associated with LOC145980. LOC150372 (Accession XM_086893) is another VGAM23 host target gene. LOC150372 BINDING SITE is HOST TARGET binding site found in the 3' untranslated region of mRNA encoded by LOC150372, corresponding to a HOST TARGET binding site such as BINDING SITE I, BINDING SITE II or BINDING SITE III. Table 2 illustrates the complementarity of the nucleotide sequences of LOC150372 BINDING SITE, designated SEQ ID:38939, to the nucleotide sequence of VGAM23 RNA, herein designated VGAM RNA, also designated SEQ ID:2734.

Another function of VGAM23 is therefore inhibition of LOC150372 (Accession XM_086893). Accordingly, utilities of VGAM23 include diagnosis, prevention and treatment of diseases and clinical conditions associated with LOC150372. LOC157860 (Accession XM_098832) is another VGAM23 host target gene. LOC157860 BINDING SITE is HOST TARGET binding site found in the 3' untranslated region of mRNA encoded by LOC157860, corresponding to a HOST TARGET binding site such as BINDING SITE I, BINDING SITE II or BINDING SITE III. Table 2 illustrates the complementarity of the nucleotide sequences of LOC157860 BINDING SITE, designated SEQ ID:41862, to the nucleotide sequence of VGAM23 RNA, herein designated VGAM RNA, also designated SEQ ID:2734.

Another function of VGAM23 is therefore inhibition of LOC157860 (Accession XM_098832). Accordingly, utilities of VGAM23 include diagnosis, prevention and treatment of diseases and clinical conditions associated with LOC157860. LOC167147 (Accession XM_094310) is another VGAM23 host target gene. LOC167147 BINDING SITE is HOST TARGET binding site found in the 5' untranslated region of mRNA encoded by LOC167147, corresponding to a HOST TARGET binding site such as BINDING SITE I, BINDING SITE II or BINDING SITE III. Table 2 illustrates the complementarity of the nucleotide sequences of LOC167147 BINDING SITE, designated SEQ ID:40228, to the nucleotide sequence of VGAM23 RNA, herein designated VGAM RNA, also designated SEQ ID:2734.

Another function of VGAM23 is therefore inhibition of LOC167147 (Accession XM_094310). Accordingly, utilities of VGAM23 include diagnosis, prevention and treatment of diseases and clinical conditions associated with LOC167147. LOC201626 (Accession XM_114349) is another VGAM23 host target gene. LOC201626 BINDING SITE is HOST TARGET binding site found in the 5' untranslated region of mRNA encoded by LOC201626, corresponding to a HOST TARGET binding site such as BINDING SITE I, BINDING SITE II or BINDING SITE III. Table 2 illustrates the complementarity of the nucleotide sequences of LOC201626 BINDING SITE, designated SEQ ID:42891, to the nucleotide sequence of VGAM23 RNA, herein designated VGAM RNA, also designated SEQ ID:2734.

Another function of VGAM23 is therefore inhibition of LOC201626 (Accession XM_114349). Accordingly, utilities of VGAM23 include diagnosis, prevention and treatment of diseases and clinical conditions associated with LOC201626. LOC90249 (Accession XM_030300) is another VGAM23 host target gene. LOC90249 BINDING SITE is HOST TARGET binding site found in the 3' untranslated region of mRNA encoded by LOC90249, corresponding to a HOST TARGET binding site such as BINDING SITE I, BINDING SITE II or BINDING SITE III. Table 2 illustrates the complementarity of the nucleotide sequences of LOC90249 BINDING SITE, designated SEQ ID:31010, to the nucleotide sequence of VGAM23 RNA, herein designated VGAM RNA, also designated SEQ ID:2734.

Another function of VGAM23 is therefore inhibition of LOC90249 (Accession XM_030300). Accordingly, utilities of VGAM23 include diagnosis, prevention and treatment of diseases and clinical conditions associated with LOC90249. FIG. 1 further provides a conceptual description of a novel bioinformatically detected viral gene of the present invention, referred to here as Viral Genomic Address Messenger 24 (VGAM24) viral gene, which modulates expression of respective host target genes thereof, the function and utility of which host target genes is known in the art.

VGAM24 is a novel bioinformatically detected regulatory, non protein coding, viral micro RNA (miRNA) gene. The method by which VGAM24 was detected is described hereinabove with reference to FIGS. 1-8.

VGAM24 gene, herein designated VGAM GENE, is a viral gene contained in the genome of Invertebrate Iridescent Virus 6. VGAM24 host target gene, herein designated VGAM HOST TARGET GENE, is a human gene contained in the human genome.

VGAM24 gene encodes a VGAM24 precursor RNA, herein designated VGAM PRECURSOR RNA. Similar to other miRNA genes, and unlike most ordinary genes, VGAM24 precursor RNA does not encode a protein. A nucleotide sequence identical or highly similar to the nucleotide sequence of VGAM24 precursor RNA is designated SEQ ID:10, and is provided hereinbelow with reference to the sequence listing part. Nucleotide sequence SEQ ID:10 is located at position 107686 relative to the genome of Invertebrate Iridescent Virus 6.

VGAM24 precursor RNA folds onto itself, forming VGAM24 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM24 folded precursor RNA into VGAM24 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 44%) nucleotide sequence of VGAM24 RNA is designated SEQ ID:2735, and is provided hereinbelow with reference to the sequence listing part.

VGAM24 host target gene, herein designated VGAM HOST TARGET GENE, encodes a corresponding messenger RNA, VGAM24 host target RNA, herein designated VGAM HOST TARGET RNA. VGAM24 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM24 RNA, herein designated VGAM RNA, binds complementarily to one or more host target binding sites located in untranslated regions of VGAM24 host target RNA, herein designated VGAM HOST TARGET RNA. This complementary binding is due to the fact that the nucleotide sequence of VGAM24 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM24 RNA, herein designated VGAM RNA, may have a different number of host target binding sites in untranslated regions of a VGAM24 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM24 RNA, herein designated VGAM RNA, to host target binding sites on VGAM24 host target RNA, herein designated VGAM HOST TARGET RNA, such as BINDING SITE I, BINDING SITE II and BINDING SITE III, inhibits translation of VGAM24 host target RNA into VGAM24 host target protein, herein designated VGAM HOST TARGET PROTEIN. VGAM host target protein is therefore outlined by a broken line.

It is appreciated that VGAM24 host target gene, herein designated VGAM HOST TARGET GENE, in fact represents a plurality of VGAM24 host target genes. The mRNA of each one of this plurality of VGAM24 host target genes comprises one or more host target binding sites, each having a nucleotide sequence which is at least partly complementary to VGAM24 RNA, herein designated VGAM RNA, and which when bound by VGAM24 RNA causes inhibition of translation of respective one or more VGAM24 host target proteins.

It is further appreciated by one skilled in the art that the mode of translational inhibition illustrated by FIG. 1 with specific reference to translational inhibition exerted by VGAM24 gene, herein designated VGAM GENE, on one or more VGAM24 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM24 is inhibition of expression of host target genes, as part of a novel viral mechanism of attacking a host. Accordingly, utilities of VGAM24 include diagnosis, prevention and treatment of viral infection by Invertebrate Iridescent Virus 6. Specific functions, and accordingly utilities, of VGAM24 correlate with, and may be deduced from, the identity of the host target genes which VGAM24 binds and inhibits, and the function of these host target genes, as elaborated hereinbelow.

Nucleotide sequences of the VGAM24 precursor RNA, herein designated VGAM PRECURSOR RNA, and of the 'diced' VGAM24 RNA, herein designated VGAM RNA, and a schematic representation of the secondary folding of VGAM24 folded precursor RNA, herein designated VGAM FOLDED PRECURSOR RNA, of VGAM24 are further described hereinbelow with reference to Table 1.

Nucleotide sequences of host target binding sites, such as BINDING SITE-I, BINDING SITE-II and BINDING SITE-III of FIG. 1, found on VGAM24 host target RNA, and schematic representation of the complementarity of each of these host target binding sites to VGAM24 RNA, herein designated VGAM RNA, are described hereinbelow with reference to Table 2.

As mentioned hereinabove with reference to FIG. 1, a function of VGAM24 gene, herein designated VGAM is inhibition of expression of VGAM24 target genes. It is appreciated that specific functions, and accordingly utilities, of VGAM24 correlate with, and may be deduced from, the identity of the target genes which VGAM24 binds and inhibits, and the function of these target genes, as elaborated hereinbelow.

Dihydropyrimidinase-like 3 (DPYSL3, Accession NM_001387) is a VGAM24 host target gene. DPYSL3 BINDING SITE is HOST TARGET binding site found in the 3' untranslated region of mRNA encoded by DPYSL3, corresponding to a HOST TARGET binding site such as BINDING SITE I, BINDING SITE II or BINDING SITE III. Table 2 illustrates the complementarity of the nucleotide sequences of DPYSL3 BINDING SITE, designated SEQ ID:7070, to the nucleotide sequence of VGAM24 RNA, herein designated VGAM RNA, also designated SEQ ID:2735.

A function of VGAM24 is therefore inhibition of Dihydropyrimidinase-like 3 (DPYSL3, Accession NM_001387), a gene which is a member of the dihydropyrimidinase family. Accordingly, utilities of VGAM24 include diagnosis, prevention and treatment of diseases and clinical conditions associated with DPYSL3. The function of DPYSL3 has been established by previous studies. Hamajima et al. (1996) isolated a cDNA encoding dihydropyrimidinase-like 3 (OMIM Ref. No. DPYSL3), called DRP3 by them, from a fetal brain cDNA library (see OMIM Ref. No. 222748). By Northern blot analysis of adult human tissues, they detected a 5.8-kb DPYSL3 transcript at high levels in heart and skeletal muscle and at low levels in brain and lung. Gaetano et al. (1997) isolated a human ULIP cDNA from retinoic acid-differentiated neuroblastoma cells. In contrast to Hamajima et al. (1996), they found that the gene is expressed strongly in human fetal brain and spinal cord but is not detectably expressed in adult brain and nonneuronal tissues. The 5.5-kb full-length cDNA contains a 1,710-bp open reading frame predicting a 570-amino acid protein. The human gene shares 98% identity with mouse Ulip. The authors speculated that the human ULIP gene mediates signals involved in axonal growth.

Full details of the abovementioned studies are described in the following publications, the disclosure of which are hereby incorporated by reference:

Hamajima, N.; Matsuda, K.; Sakata, S.; Tamaki, N.; Sasaki, M.; Nonaka, M.: A novel gene family defined by human dihydropyrimidinase and three related proteins with differential tissue distribution. Gene 180:157-163, 1996; and Gaetano, C; Matsuo, T.; Thiele, C. J.: Identification and characterization of a retinoic acid-regulated human homologue of the unc-33-like phosphoprotein gene (hUlip) from neuroblastom.

Further studies establishing the function and utilities of DPYSL3 are found in John Hopkins OMIM database record ID 601168, and in sited publications numbered 9303, 930 and 9308 listed in the bibliography section hereinbelow, which are also hereby incorporated by reference. Fibroblast Growth Factor 23 (FGF23, Accession NM_020638) is another VGAM24 host target gene. FGF23 BINDING SITE is HOST TARGET binding site found in the 3' untranslated region of mRNA encoded by FGF23, corresponding to a HOST TARGET binding site such as BINDING SITE I, BINDING SITE II or BINDING SITE III. Table 2 illustrates the complementarity of the nucleotide sequences of FGF23 BINDING SITE, designated SEQ ID:21796, to the nucleotide sequence of VGAM24 RNA, herein designated VGAM RNA, also designated SEQ ID:2735.

Another function of VGAM24 is therefore inhibition of Fibroblast Growth Factor 23 (FGF23, Accession NM_020638), a gene which a member of the fibroblast growth factor family. Accordingly, utilities of VGAM24 include diagnosis, prevention and treatment of diseases and clinical conditions associated with FGF23. The function of FGF23 has been established by previous studies. The FGF23 gene encodes a member of the fibroblast growth factor family that is mutant in autosomal dominant hypophosphatemic rickets (OMIM Ref. No. 193100). Using the mouse Fgf23 sequence as query, Yamashita et al. (2000) identified FGF23 in a genomic database. They cloned the full-length cDNA from a placenta library. The deduced 251-amino acid protein contains an N-terminal 24-amino acid signal sequence. FGF23 shares 72% sequence identity with mouse Fgf23, and 24% and 22% identity with human FGF21 and FGF19, respectively. By quantitative PCR, Yamashita et al. (2000) found highest expression of Fgf23 in mouse brain and lower expression in thymus. In situ hybridization of mouse brain revealed discrete specific labeling only in the ventrolateral thalamic nucleus. Autosomal dominant hypophosphatemic rickets (ADHR; 193100) is characterized by low serum phosphorus concentrations, rickets, osteomalacia, leg deformities, short stature, bone pain, and dental abscesses. The ADHR Consortium (2000) described a positional cloning approach used to identify the gene mutated in ADHR. They identified mutations in the FGF23 gene in affected members of families segregating ADHR. The ADHR Consortium (2000) found that the FGF23 gene lies 54 kb telomeric of FGF6 (OMIM Ref. No. 134921) on 12p13.

Full details of the abovementioned studies are described in the following publications, the disclosure of which are hereby incorporated by reference:

Yamashita, T.; Yoshioka, M.; Itoh, N.: Identification of a novel fibroblast growth factor, FGF-23, preferentially expressed in the ventrolateral thalamic nucleus of the brain. Biochem. Biophys. Res. Commun. 277:494-498, 2000; and ADHR Consortium: Autosomal dominant hypophosphataemic rickets is associated with mutations in FGF23. Nature Genet. 26:345-348, 2000.

Further studies establishing the function and utilities of FGF23 are found in John Hopkins OMIM database record ID 605380, and in sited publications numbered 1 and 6989-6993 listed in the bibliography section hereinbelow, which are also hereby incorporated by reference. Glycine Amidinotransferase (L-arginine:glycine amidinotransferase) (GATM, Accession NM_001482) is another VGAM24 host target gene. GATM BINDING SITE is HOST TARGET binding site found in the 3' untranslated region of mRNA encoded by GATM, corresponding to a HOST TARGET binding site such as BINDING SITE I, BINDING SITE II or BINDING SITE III. Table 2 illustrates the complementarity of the nucleotide sequences of GATM BINDING SITE, designated SEQ ID:7224, to the nucleotide sequence of VGAM24 RNA, herein designated VGAM RNA, also designated SEQ ID:2735.

Another function of VGAM24 is therefore inhibition of Glycine Amidinotransferase (L-arginine:glycine amidinotransferase) (GATM, Accession NM_001482), a gene which glycine amidinotransferase; component of the creatine biosynthetic pathway. Accordingly, utilities of VGAM24 include diagnosis, prevention and treatment of diseases and clinical conditions associated with GATM. The function of GATM has been established by previous studies. Creatine and phosphocreatine play important roles in the energy metabolism of muscle and nerve tissues. The enzyme L-arginine:glycine amidinotransferase (AGAT; EC 2.1.4.1) catalyzes the transfer of a guanido group from arginine to glycine, forming guanidinoacetic acid, the immediate precursor of creatine. One of the major sites of creatine biosynthesis is the kidney. Humm et al. (1994) isolated and sequenced AGAT from pig kidney mitochondria. Sequence data from the pig AGAT polypeptide allowed them to isolate cDNA clones encoding the human enzyme from a kidney carcinoma cDNA library. The largest human cDNA sequence encodes a 423-amino acid polypeptide including a 37-amino acid signal sequence. The mature porcine and human proteins are 94% identical to each other and 36% identical to bacterial L-arginine:inosamine phosphate amidinotransferase. Humm et al. (1997) noted that mitochondrial and cytosolic forms of AGAT are believed to derive from the same gene by alternative splicing. They expressed human AGAT in E. coli and identified its active-site cysteine residue (OMIM Ref. No. cys407). Item et al. (2001) described AGAT deficiency in 2 sisters, aged 4 and 6 years, with mental retardation and severe creatine deficiency in the brain, reported by Bianchi et al. (2000). The brain creatine deficiency in the sibs was reversible by means of oral creatine supplementation. Urinary guanidinoacetate concentrations were low. Item et al. (2001) found a homozygous G-to-A transition at nucleotide position 9297, converting a tryptophan codon (TGG) to a stop codon (TAG) at residue 149 (T149X; 602360.0001), and resulting in undetectable cDNA, as investigated by RT-PCR, as well as in undetectable AGAT activity, as investigated radiochemically in cultivated skin fibroblasts and in virus-transformed lymphoblasts of the patients. The parents were heterozygous for the mutant allele, with intermediate residual AGAT activities.

Full details of the abovementioned studies are described in the following publications, the disclosure of which are hereby incorporated by reference:

Humm, A.; Fritsche, E.; Mann, K.; Gohl, M.; Huber, R.: Recombinant expression and isolation of human L-arginine:glycine amidinotransferase and identification of its active-site cysteine residue. Biochem. J. 322:771-776, 1997. ; and Item, C. B.; Stockler-Ipsiroglu, S.; Stromberger, C.; Muhl, A.; Alessandri, M. G.; Bianchi, M. C.; Tosetti, M.; Fornai, F.; Cioni, G.: Arginine:glycine amidinotransferase deficiency: th.

Further studies establishing the function and utilities of GATM are found in John Hopkins OMIM database record ID 602360, and in sited publications numbered 8534-8537 listed in the bibliography section hereinbelow, which are also hereby incorporated by reference. IPT (Accession NM_017646) is another VGAM24 host target gene. IPT BINDING SITE is HOST TARGET binding site found in the 3' untranslated region of mRNA encoded by IPT, corresponding to a HOST TARGET binding site such as BINDING SITE I, BINDING SITE II or BINDING SITE III. Table 2 illustrates the complementarity of the nucleotide sequences of IPT BINDING SITE, designated SEQ ID:19152, to the nucleotide sequence of VGAM24 RNA, herein designated VGAM RNA, also designated SEQ ID:2735.

Another function of VGAM24 is therefore inhibition of IPT (Accession NM_017646). Accordingly, utilities of VGAM24 include diagnosis, prevention and treatment of diseases and clinical conditions associated with IPT. ShrmL (Accession NM_020859) is another VGAM24 host target gene. ShrmL BINDING SITE is HOST TARGET binding site found in the 3' untranslated region of mRNA encoded by ShrmL, corresponding to a HOST TARGET binding site such as BINDING SITE I, BINDING SITE II or BINDING SITE III. Table 2 illustrates the complementarity of the nucleotide sequences of ShrmL BINDING SITE, designated SEQ ID:21912, to the nucleotide sequence of VGAM24 RNA, herein designated VGAM RNA, also designated SEQ ID:2735.

Another function of VGAM24 is therefore inhibition of ShrmL (Accession NM_020859). Accordingly, utilities of VGAM24 include diagnosis, prevention and treatment of diseases and clinical conditions associated with ShrmL. FIG. 1 further provides a conceptual description of a novel bioinformatically detected viral gene of the present invention, referred to here as Viral Genomic Address Messenger 25 (VGAM25) viral gene, which modulates expression of respective host target genes thereof, the function and utility of which host target genes is known in the art.

VGAM25 is a novel bioinformatically detected regulatory, non protein coding, viral micro RNA (miRNA) gene. The method by which VGAM25 was detected is described hereinabove with reference to FIGS. 1-8.

VGAM25 gene, herein designated VGAM GENE, is a viral gene contained in the genome of Invertebrate Iridescent Virus 6. VGAM25 host target gene, herein designated VGAM HOST TARGET GENE, is a human gene contained in the human genome.

VGAM25 gene encodes a VGAM25 precursor RNA, herein designated VGAM PRECURSOR RNA. Similar to other miRNA genes, and unlike most ordinary genes, VGAM25 precursor RNA does not encode a protein. A nucleotide sequence identical or highly similar to the nucleotide sequence of VGAM25 precursor RNA is designated SEQ ID:11, and is provided hereinbelow with reference to the sequence listing part. Nucleotide sequence SEQ ID:11 is located at position 11733 relative to the genome of Invertebrate Iridescent Virus 6.

VGAM25 precursor RNA folds onto itself, forming VGAM25 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM25 folded precursor RNA into VGAM25 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM25 RNA is designated SEQ ID:2736, and is provided hereinbelow with reference to the sequence listing part.

VGAM25 host target gene, herein designated VGAM HOST TARGET GENE, encodes a corresponding messenger RNA, VGAM25 host target RNA, herein designated VGAM HOST TARGET RNA. VGAM25 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM25 RNA, herein designated VGAM RNA, binds complementarily to one or more host target binding sites located in untranslated regions of VGAM25 host target RNA, herein designated VGAM HOST TARGET RNA. This complementary binding is due to the fact that the nucleotide sequence of VGAM25 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM25 RNA, herein designated VGAM RNA, may have a different number of host target binding sites in untranslated regions of a VGAM25 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM25 RNA, herein designated VGAM RNA, to host target binding sites on VGAM25 host target RNA, herein designated VGAM HOST TARGET RNA, such as BINDING SITE I, BINDING SITE II and BINDING SITE III, inhibits translation of VGAM25 host target RNA into VGAM25 host target protein, herein designated VGAM HOST TARGET PROTEIN. VGAM host target protein is therefore outlined by a broken line.

It is appreciated that VGAM25 host target gene, herein designated VGAM HOST TARGET GENE, in fact represents a plurality of VGAM25 host target genes. The mRNA of each one of this plurality of VGAM25 host target genes comprises one or more host target binding sites, each having a nucleotide sequence which is at least partly complementary to VGAM25 RNA, herein designated VGAM RNA, and which when bound by VGAM25 RNA causes inhibition of translation of respective one or more VGAM25 host target proteins.

It is further appreciated by one skilled in the art that the mode of translational inhibition illustrated by FIG. 1 with specific reference to translational inhibition exerted by VGAM25 gene, herein designated VGAM GENE, on one or more VGAM25 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM25 is inhibition of expression of host target genes, as part of a novel viral mechanism of attacking a host. Accordingly, utilities of VGAM25 include diagnosis, prevention and treatment of viral infection by Invertebrate Iridescent Virus 6. Specific functions, and accordingly utilities, of VGAM25 correlate with, and may be deduced from, the identity of the host target genes which VGAM25 binds and inhibits, and the function of these host target genes, as elaborated hereinbelow.

Nucleotide sequences of the VGAM25 precursor RNA, herein designated VGAM PRECURSOR RNA, and of the 'diced' VGAM25 RNA, herein designated VGAM RNA, and a schematic representation of the secondary folding of VGAM25 folded precursor RNA, herein designated VGAM FOLDED PRECURSOR RNA, of VGAM25 are further described hereinbelow with reference to Table 1.

Nucleotide sequences of host target binding sites, such as BINDING SITE-I, BINDING SITE-II and BINDING SITE-III of FIG. 1, found on VGAM25 host target RNA, and schematic representation of the complementarity of each of these host target binding sites to VGAM25 RNA, herein designated VGAM RNA, are described hereinbelow with reference to Table 2.

As mentioned hereinabove with reference to FIG. 1, a function of VGAM25 gene, herein designated VGAM is inhibition of expression of VGAM25 target genes. It is appreciated that specific functions, and accordingly utilities, of VGAM25 correlate with, and may be deduced from, the identity of the target genes which VGAM25 binds and inhibits, and the function of these target genes, as elaborated hereinbelow.

Chemokine (C-X3-C motif) Receptor 1 (CX3CR1, Accession XM_047502) is a VGAM25 host target gene. CX3CR1 BINDING SITE is HOST TARGET binding site found in the 3' untranslated region of mRNA encoded by CX3CR1, corresponding to a HOST TARGET binding site such as BINDING SITE I, BINDING SITE II or BINDING SITE III. Table 2 illustrates the complementarity of the nucleotide sequences of CX3CR1 BINDING SITE, designated SEQ ID:34979, to the nucleotide sequence of VGAM25 RNA, herein designated VGAM RNA, also designated SEQ ID:2736.

A function of VGAM25 is therefore inhibition of Chemokine (C-X3-C motif) Receptor 1 (CX3CR1, Accession XM_047502), a gene which mediates both the adhesive and migratory functions of fractalkine. Accordingly, utilities of VGAM25 include diagnosis, prevention and treatment of diseases and clinical conditions associated with CX3CR1. The function of CX3CR1 has been established by previous studies. Leukocyte trafficking at the endothelium requires both cellular adhesion molecules and chemotactic factors. Fractalkine (OMIM Ref. No. 601880), a transmembrane molecule with a CX3C-motif chemokine domain atop a mucin stalk, induces both adhesion and migration of leukocytes. Imai et al. (1997) identified a 7-transmembrane high-affinity receptor for fractalkine and showed that it mediates both the adhesive and migratory functions of fractalkine. The receptor, which the authors termed CX3CR1, requires pertussis toxin-sensitive G protein signaling to induce migration but not to support adhesion, which also occurs without other adhesion molecules but requires the architecture of a chemokine domain atop the mucin stalk. Natural killer cells predominantly express CX3CR1 and respond to fractalkine in both migration and adhesion. Imai et al. (1997) concluded that fractalkine and CX3CR1 represent new types of leukocyte trafficking regulators, performing both adhesive and chemotactic functions. CX3CR1 is an HIV coreceptor as well as a leukocyte chemotactic/adhesion receptor for fractalkine. Faure et al. (2000) identified 2 single nucleotide polymorphisms in the CX3CR1 gene in Caucasians and demonstrated that HIV-infected patients homozygous for I249/M280 (601470.0001) progressed to AIDS more rapidly than those with other haplotypes (relative risk = 2.13, P=0.039). Functional CX3CR1 analysis showed that fractalkine binding is reduced among patients homozygous for this particular haplotype. Thus, Faure et al. (2000) concluded that CX3CR1-I249/M280 is a recessive genetic risk factor for HIV/AIDS. Tripp et al. (2001) showed that the G glycoprotein of respiratory syncytial virus (RSV) shares a heparin-binding domain and a CX3C chemokine motif with CX3CL1. Binding analysis indicated that RSV can use CX3CR1 as a receptor. G glycoprotein binding mimics fractalkine binding and induces leukocyte chemotaxis. Tripp et al. (2001) concluded that RSV G glycoprotein uses its similarities with CX3C to facilitate infection and to modify the immune response.

Full details of the abovementioned studies are described in the following publications, the disclosure of which are hereby incorporated by reference:

Faure, S.; Meyer, L.; Costagliola, D.; Vaneensberghe, C.; Genin, E.; Autran, B.; French ALT and IMMUNOCO Study Groups; Delfraisay, J.-F.; SEROCO Study Group; McDermott, D. H.; Murphy, P. M.; Debre, P.; Theodorou, I.; Cambadiere, C.: Rapid progression to AIDS in HIV+ individuals with a structural variant of the chemokine receptor CX(3) CR1. Science 287:2274-2277, 2000; and Moatti, D.; Faure, S.; Fumeron, F.; Amara, M. E. W.; Seknadji, P.; McDermott, D. H.; Debre, P.; Aumont, M. C.; Murphy, P. M.; de Prost, D.; Combadiere, C.: Polymorphism in the fractalk.

Further studies establishing the function and utilities of CX3CR1 are found in John Hopkins OMIM database record ID 601470, and in sited publications numbered 6694-669 and 8093-6698 listed in the bibliography section hereinbelow, which are also hereby incorporated by reference. F-box and WD-40 Domain Protein 1B (FBXW1B, Accession NM_033644) is another VGAM25 host target gene. FBXW1B BINDING SITE1 through FBXW1B BINDING SITE3 are HOST TARGET binding sites found in untranslated regions of mRNA encoded by FBXW1B, corresponding to HOST TARGET binding sites such as BINDING SITE I, BINDING SITE II or BINDING SITE III. Table 2 illustrates the complementarity of the nucleotide sequences of FBXW1B BINDING SITE1 through FBXW1B BINDING SITE3, designated SEQ ID:27370, SEQ ID:27380 and SEQ ID:14668 respectively, to the nucleotide sequence of VGAM25 RNA, herein designated VGAM RNA, also designated SEQ ID:2736.

Another function of VGAM25 is therefore inhibition of F-box and WD-40 Domain Protein 1B (FBXW1B, Accession NM_033644), a gene which somehow is involved in the process of neuronal cell differentiation or brain development. Accordingly, utilities of VGAM25 include diagnosis, prevention and treatment of diseases and clinical conditions associated with FBXW1B. The function of FBXW1B has been established by previous studies. Using a yeast 2-hybrid screen with SKP1 as bait, followed by searching sequence databases, Winston et al. (1999) and Cenciarelli et al. (1999) identified 33 mammalian and 26 human F-box proteins, respectively. These contained C termini with leucine-rich repeats (FBXLs, e.g., SKP2 (OMIM Ref. No. 601436)), WD40 domains (FBXWs, e.g., BTRCP (OMIM Ref. No. 603482)), or no recognizable motifs (FBXOs, e.g., CCNF). By searching an EST database for homologs of BTRCP, followed by RT-PCR on gastric cancer cell lines and screening fetal brain and fetal lung cDNA libraries, Koike et al. (2000) obtained cDNAs encoding 3 isoforms of FBXW1B, which they termed BTRCP2A, BTRCP2B, and BTRCP2C. Sequence analysis predicted that the 3 isoforms share the same N-terminal 15 amino acids, F box, and 7 C-terminal WD repeats. The 525-amino acid BTRCP2B protein has a 21-amino acid insert after met15 of the 508-amino acid BTRCP2A protein, and BTRCP2C has a 34-amino acid insert after met15 of BTRCP2A. BTRCP2A is 86% identical to BTRCP. BTRCP2C is nearly identical to the KIAA0696 protein identified by Ishikawa et al. (1998). By genomic sequence analysis, Koike et al. (2000) determined that the FBXW1B gene contains at least 14 exons, with BTRCP2A lacking exons 2 and 3, BTRCP2B lacking exon 2, and BTRCP2C lacking exon 3. Northern blot analysis revealed near ubiquitous expression of a 4.5-kb transcript. By RT-PCR analysis, Ishikawa et al. (1998) detected expression in all tissues tested except spleen.

Full details of the abovementioned studies are described in the following publications, the disclosure of which are hereby incorporated by reference:

Ishikawa, K.; Nagase, T.; Suyama, M.; Miyajima, N.; Tanaka, A.; Kotani, H.; Nomura, N.; Ohara, O.: Prediction of the coding sequences of unidentified human genes. X. The complete sequences of 100 new cDNA clones from brain which can code for large proteins in vitro. DNA Res. 5:169-176, 1998; and Koike, J.; Sagara, N.; Kirikoshi, H.; Takagi, A.; Miwa, T.; Hirai, M.; Katoh, M.: Molecular cloning and genomic structure of the beta-TRCP2 gene on chromosome 5q35.1. Biochem. Biophys.

Further studies establishing the function and utilities of FBXW1B are found in John Hopkins OMIM database record ID 605651, and in sited publications numbered 40 and 9440 listed in the bibliography section hereinbelow, which are also hereby incorporated by reference. Transient Receptor Potential Cation Channel, Subfamily C, Member 6 (TRPC6, Accession NM_004621) is another VGAM25 host target gene. TRPC6 BINDING SITE is HOST TARGET binding site found in the 3' untranslated region of mRNA encoded by TRPC6, corresponding to a HOST TARGET binding site such as BINDING SITE I, BINDING SITE II or BINDING SITE III. Table 2 illustrates the complementarity of the nucleotide sequences of TRPC6 BINDING SITE, designated SEQ ID:10978, to the nucleotide sequence of VGAM25 RNA, herein designated VGAM RNA, also designated SEQ ID:2736.

Another function of VGAM25 is therefore inhibition of Transient Receptor Potential Cation Channel, Subfamily C, Member 6 (TRPC6, Accession NM_004621), a gene which has calcium channel activity. Accordingly, utilities of VGAM25 include diagnosis, prevention and treatment of diseases and clinical conditions associated with TRPC6. The function of TRPC6 has been established by previous studies. TRPCs, mammalian homologs of the Drosophila transient receptor potential (trp) protein, are ion channels that are thought to mediate capacitative calcium entry into the cell. Using a PCR-based strategy, Hofmann et al. (1999) isolated cDNAs encoding TRPC6, a novel member of the TRPC family. The predicted 931-amino acid protein shares 93% identity with mouse Trpc6. The authors found that TRPC6 is a nonselective cation channel that is activated by diacylglycerol (DAG) in a membrane-delimited fashion, independently of protein kinase C. Although TRPC3 (OMIM Ref. No. 602345), the closest structural relative of TRPC6, is activated in the same manner, human TRPC1 and mouse Trpc4 (OMIM Ref. No. 603651) and Trpc5 (OMIM Ref. No. 300334) were unresponsive to DAG. The authors suggested that TRPC3 and TRPC6 represent the first members of a new functional family of second-messenger-operated cation channels that are activated by DAG. Northern blot analysis revealed that TRPC6 is expressed primarily in placenta, lung, spleen, ovary, and small intestine. By FISH, d'Esposito et al. (1998) mapped the TRPC6 gene to chromosome 11q21-q22.

Full details of the abovementioned studies are described in the following publications, the disclosure of which are hereby incorporated by reference:

Hofmann, T.; Obukhov, A. G.; Schaefer, M.; Harteneck, C.; Gudermann, T.; Schultz, G.: Direct activation of human TRPC6 and TRPC3 channels by diacylglycerol. Nature 397: 259-263, 1999; and D'Esposito, M.; Strazzullo, M.; Cuccurese, M.; Spalluto, C.; Rocchi, M.; d'urso, M.; Ciccodicola, A.: Identification and assignment of the human transient receptor potential channel 6 gene.

Further studies establishing the function and utilities of TRPC6 are found in John Hopkins OMIM database record ID 603652, and in sited publications numbered 5857-5858 listed in the bibliography section hereinbelow, which are also hereby incorporated by reference. Zinc Finger Protein 135 (clone pHZ-17) (ZNF135, Accession NM_003436) is another VGAM25 host target gene. ZNF135 BINDING SITE is HOST TARGET binding site found in the 3' untranslated region of mRNA encoded by ZNF135, corresponding to a HOST TARGET binding site such as BINDING SITE I, BINDING SITE II or BINDING SITE III. Table 2 illustrates the complementarity of the nucleotide sequences of ZNF135 BINDING SITE, designated SEQ ID:9490, to the nucleotide sequence of VGAM25 RNA, herein designated VGAM RNA, also designated SEQ ID:2736.

Another function of VGAM25 is therefore inhibition of Zinc Finger Protein 135 (clone pHZ-17) (ZNF135, Accession NM_003436). Accordingly, utilities of VGAM25 include diagnosis, prevention and treatment of diseases and clinical conditions associated with ZNF135. BCL2-associated Athanogene 2 (BAG2, Accession XM_165779) is another VGAM25 host target gene. BAG2 BINDING SITE is HOST TARGET binding site found in the 3' untranslated region of mRNA encoded by BAG2, corresponding to a HOST TARGET binding site such as BINDING SITE I, BINDING SITE II or BINDING SITE III. Table 2 illustrates the complementarity of the nucleotide sequences of BAG2 BINDING SITE, designated SEQ ID:43753, to the nucleotide sequence of VGAM25 RNA, herein designated VGAM RNA, also designated SEQ ID:2736.

Another function of VGAM25 is therefore inhibition of BCL2-associated Athanogene 2 (BAG2, Accession XM_165779). Accordingly, utilities of VGAM25 include diagnosis, prevention and treatment of diseases and clinical conditions associated with BAG2. FLJ12649 (Accession NM_024597) is another VGAM25 host target gene. FLJ12649 BINDING SITE is HOST TARGET binding site found in the 3' untranslated region of mRNA encoded by FLJ12649, corresponding to a HOST TARGET binding site such as BINDING SITE I, BINDING SITE II or BINDING SITE III. Table 2 illustrates the complementarity of the nucleotide sequences of FLJ12649 BINDING SITE, designated SEQ ID:23835, to the nucleotide sequence of VGAM25 RNA, herein designated VGAM RNA, also designated SEQ ID:2736.

Another function of VGAM25 is therefore inhibition of FLJ12649 (Accession NM_024597). Accordingly, utilities of VGAM25 include diagnosis, prevention and treatment of diseases and clinical conditions associated with FLJ12649. GFR (Accession NM_012294) is another VGAM25 host target gene. GFR BINDING SITE is HOST TARGET binding site found in the 3' untranslated region of mRNA encoded by GFR, corresponding to a HOST TARGET binding site such as BINDING SITE I, BINDING SITE II or BINDING SITE III. Table 2 illustrates the complementarity of the nucleotide sequences of GFR BINDING SITE, designated SEQ ID:14642, to the nucleotide sequence of VGAM25 RNA, herein designated VGAM RNA, also designated SEQ ID:2736.

Another function of VGAM25 is therefore inhibition of GFR (Accession NM_012294). Accordingly, utilities of VGAM25 include diagnosis, prevention and treatment of diseases and clinical conditions associated with GFR. KIAA0626 (Accession NM_021647) is another VGAM25 host target gene. KIAA0626 BINDING SITE is HOST TARGET binding site found in the 3" untranslated region of mRNA encoded by KIAA0626, corresponding to a HOST TARGET binding site such as BINDING SITE I, BINDING SITE II or BINDING SITE III. Table 2 illustrates the complementarity of the nucleotide sequences of KIAA0626 BINDING SITE, designated SEQ ID:22313, to the nucleotide sequence of VGAM25 RNA, herein designated VGAM RNA, also designated SEQ ID:2736.

Another function of VGAM25 is therefore inhibition of KIAA0626 (Accession NM_021647). Accordingly, utilities of VGAM25 include diagnosis, prevention and treatment of diseases and clinical conditions associated with KIAA0626. PRO0902 (Accession NM_053057) is another VGAM25 host target gene. PRO0902 BINDING SITE is HOST TARGET binding site found in the 5' untranslated region of mRNA encoded by PRO0902, corresponding to a HOST TARGET binding site such as BINDING SITE I, BINDING SITE II or BINDING SITE III. Table 2 illustrates the complementarity of the nucleotide sequences of PRO0902 BINDING SITE, designated SEQ ID:27608, to the nucleotide sequence of VGAM25 RNA, herein designated VGAM RNA, also designated SEQ ID:2736.

Another function of VGAM25 is therefore inhibition of PRO0902 (Accession NM_053057). Accordingly, utilities of VGAM25 include diagnosis, prevention and treatment of diseases and clinical conditions associated with PRO0902. Syntaxin 12 (STX12, Accession XM_039018) is another VGAM25 host target gene. STX12 BINDING SITE is HOST TARGET binding site found in the 3' untranslated region of mRNA encoded by STX12, corresponding to a HOST TARGET binding site such as BINDING SITE I, BINDING SITE II or BINDING SITE III. Table 2 illustrates the complementarity of the nucleotide sequences of STX12 BINDING SITE, designated SEQ ID:32983, to the nucleotide sequence of VGAM25 RNA, herein designated VGAM RNA, also designated SEQ ID:2736.

Another function of VGAM25 is therefore inhibition of Syntaxin 12 (STX12, Accession XM_039018). Accordingly, utilities of VGAM25 include diagnosis, prevention and treatment of diseases and clinical conditions associated with STX12. SZF1 (Accession NM_016089) is another VGAM25 host target gene. SZF1 BINDING SITE is HOST TARGET binding site found in the 3' untranslated region of mRNA encoded by SZF1, corresponding to a HOST TARGET binding site such as BINDING SITE I, BINDING SITE II or BINDING SITE III. Table 2 illustrates the complementarity of the nucleotide sequences of SZF1 BINDING SITE, designated SEQ ID:18173, to the nucleotide sequence of VGAM25 RNA, herein designated VGAM RNA, also designated SEQ ID:2736.

Another function of VGAM25 is therefore inhibition of SZF1 (Accession NM_016089). Accordingly, utilities of VGAM25 include diagnosis, prevention and treatment of diseases and clinical conditions associated with SZF1. LOC143879 (Accession XM_084666) is another VGAM25 host target gene. LOC143879 BINDING SITE is HOST TARGET binding site found in the 3' untranslated region of mRNA encoded by LOC143879, corresponding to a HOST TARGET binding site such as BINDING SITE I, BINDING SITE II or BINDING SITE III. Table 2 illustrates the complementarity of the nucleotide sequences of LOC143879 BINDING SITE, designated SEQ ID:37662, to the nucleotide sequence of VGAM25 RNA, herein designated VGAM RNA, also designated SEQ ID:2736.

Another function of VGAM25 is therefore inhibition of LOC143879 (Accession XM_084666). Accordingly, utilities of VGAM25 include diagnosis, prevention and treatment of diseases and clinical conditions associated with LOC143879. LOC158954 (Accession XM_017340) is another VGAM25 host target gene. LOC158954 BINDING SITE is HOST TARGET binding site found in the 3' untranslated region of mRNA encoded by LOC158954, corresponding to a HOST TARGET binding site such as BINDING SITE I, BINDING SITE II or BINDING SITE III. Table 2 illustrates the complementarity of the nucleotide sequences of LOC158954 BINDING SITE, designated SEQ ID:30313, to the nucleotide sequence of VGAM25 RNA, herein designated VGAM RNA, also designated SEQ ID:2736.

Another function of VGAM25 is therefore inhibition of LOC158954 (Accession XM_017340). Accordingly, utilities of VGAM25 include diagnosis, prevention and treatment of diseases and clinical conditions associated with LOC158954. LOC200609 (Accession XM_117256) is another VGAM25 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43333, to the nucleotide sequence of VGAM25 RNA, herein designated VGAM RNA, also designated SEQ ID:2736.

Another function of VGAM25 is therefore inhibition of LOC200609 (Accession XM_117256). Accordingly, utilities of VGAM25 include diagnosis, prevention and treatment of diseases and clinical conditions associated with LOC200609. LOC50999 (Accession NM_016040) is another VGAM25 host target gene. LOC50999 BINDING SITE is HOST TARGET binding site found in the 3' untranslated region of mRNA encoded by LOC50999, corresponding to a HOST TARGET binding site such as BINDING SITE I, BINDING SITE II or BINDING SITE III. Table 2 illustrates the complementarity of the nucleotide sequences of LOC50999 BINDING SITE, designated SEQ ID:18118, to the nucleotide sequence of VGAM25 RNA, herein designated VGAM RNA, also designated SEQ ID:2736.

Another function of VGAM25 is therefore inhibition of LOC50999 (Accession NM_016040). Accordingly, utilities of VGAM25 include diagnosis, prevention and treatment of diseases and clinical conditions associated with LOC50999. FIG. 1 further provides a conceptual description of a novel bioinformatically detected viral gene of the present invention, referred to here as Viral Genomic Address Messenger 26 (VGAM26) viral gene, which modulates expression of respective host target genes thereof, the function and utility of which host target genes is known in the art.

VGAM26 is a novel bioinformatically detected regulatory, non protein coding, viral micro RNA (miRNA) gene. The method by which VGAM26 was detected is described hereinabove with reference to FIGS. 1-8.

VGAM26 gene, herein designated VGAM GENE, is a viral gene contained in the genome of Invertebrate Iridescent Virus 6. VGAM26 host target gene, herein designated VGAM HOST TARGET GENE, is a human gene contained in the human genome.

VGAM26 gene encodes a VGAM26 precursor RNA, herein designated VGAM PRECURSOR RNA. Similar to other miRNA genes, and unlike most ordinary genes, VGAM26 precursor RNA does not encode a protein. A nucleotide sequence identical or highly similar to the nucleotide sequence of VGAM26 precursor RNA is designated SEQ ID:12, and is provided hereinbelow with reference to the sequence listing part. Nucleotide sequence SEQ ID:12 is located at position 77256 relative to the genome of Invertebrate Iridescent Virus 6.

VGAM26 precursor RNA folds onto itself, forming VGAM26 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM26 folded precursor RNA into VGAM26 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM26 RNA is designated SEQ ID:2737, and is provided hereinbelow with reference to the sequence listing part.

VGAM26 host target gene, herein designated VGAM HOST TARGET GENE, encodes a corresponding messenger RNA, VGAM26 host target RNA, herein designated VGAM HOST TARGET RNA. VGAM26 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM26 RNA, herein designated VGAM RNA, binds complementarily to one or more host target binding sites located in untranslated regions of VGAM26 host target RNA, herein designated VGAM HOST TARGET RNA. This complementary binding is due to the fact that the nucleotide sequence of VGAM26 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM26 RNA, herein designated VGAM RNA, may have a different number of host target binding sites in untranslated regions of a VGAM26 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM26 RNA, herein designated VGAM RNA, to host target binding sites on VGAM26 host target RNA, herein designated VGAM HOST TARGET RNA, such as BINDING SITE I, BINDING SITE II and BINDING SITE III, inhibits translation of VGAM26 host target RNA into VGAM26 host target protein, herein designated VGAM HOST TARGET PROTEIN. VGAM host target protein is therefore outlined by a broken line.

It is appreciated that VGAM26 host target gene, herein designated VGAM HOST TARGET GENE, in fact represents a plurality of VGAM26 host target genes. The mRNA of each one of this plurality of VGAM26 host target genes comprises one or more host target binding sites, each having a nucleotide sequence which is at least partly complementary to VGAM26 RNA, herein designated VGAM RNA, and which when bound by VGAM26 RNA causes inhibition of translation of respective one or more VGAM26 host target proteins.

It is further appreciated by one skilled in the art that the mode of translational inhibition illustrated by FIG. 1 with specific reference to translational inhibition exerted by VGAM26 gene, herein designated VGAM GENE, on one or more VGAM26 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM26 is inhibition of expression of host target genes, as part of a novel viral mechanism of attacking a host. Accordingly, utilities of VGAM26 include diagnosis, prevention and treatment of viral infection by Invertebrate Iridescent Virus 6. Specific functions, and accordingly utilities, of VGAM26 correlate with, and may be deduced from, the identity of the host target genes which VGAM26 binds and inhibits, and the function of these host target genes, as elaborated hereinbelow.

Nucleotide sequences of the VGAM26 precursor RNA, herein designated VGAM PRECURSOR RNA, and of the 'diced' VGAM26 RNA, herein designated VGAM RNA, and a schematic representation of the secondary folding of VGAM26 folded precursor RNA, herein designated VGAM FOLDED PRECURSOR RNA, of VGAM26 are further described hereinbelow with reference to Table 1.

Nucleotide sequences of host target binding sites, such as BINDING SITE-I, BINDING SITE-II and BINDING SITE-III of FIG. 1, found on VGAM26 host target RNA, and schematic representation of the complementarity of each of these host target binding sites to VGAM26 RNA, herein designated VGAM RNA, are described hereinbelow with reference to Table 2.

As mentioned hereinabove with reference to FIG. 1, a function of VGAM26 gene, herein designated VGAM is inhibition of expression of VGAM26 target genes. It is appreciated that specific functions, and accordingly utilities, of VGAM26 correlate with, and may be deduced from, the identity of the target genes which VGAM26 binds and inhibits, and the function of these target genes, as elaborated hereinbelow.

CRACC (Accession NM_021181) is a VGAM26 host target gene. CRACC BINDING SITE is HOST TARGET binding site found in the 3' untranslated region of mRNA encoded by CRACC, corresponding to a HOST TARGET binding site such as BINDING SITE I, BINDING SITE II or BINDING SITE III. Table 2 illustrates the complementarity of the nucleotide sequences of CRACC BINDING SITE, designated SEQ ID:22154, to the nucleotide sequence of VGAM26 RNA, herein designated VGAM RNA, also designated SEQ ID:2737.

A function of VGAM26 is therefore inhibition of CRACC (Accession NM_021181), a gene which may participate in adhesion reactions between t lymphocytes and accessory cells. Accordingly, utilities of VGAM26 include diagnosis, prevention and treatment of diseases and clinical conditions associated with CRACC. The function of CRACC has been established by previous studies. Natural killer (NK)-cell function is regulated by a balance between signaling through inhibitory (e.g., KIR2DL1; 604936) and activating receptors. Some members of the CD2 (OMIM Ref. No. 186990) family of activating receptors (e.g., CD244; 605554) stimulate cytotoxicity through the SLAM (OMIM Ref. No. 603492)-associated protein (SAP; 308240). Mutations in the SH2 domain of SAP cause deficiencies in other CD2 family proteins that transduce signals through SAP, and these deficiencies lead to uncontrolled Epstein-Barr virus (EBV) infections and, ultimately, to X-linked lymphoproliferative disease (XLPD; 308240 Bouchon et al. (2001) also cloned CS1, which they termed CRACC. They noted the presence of 2 CD2-like Ig folds in the extracellular domain of CRACC. RT-PCR analysis detected CRACC expression in NK and CD8 (see OMIM Ref. No. 186910)-positive cytotoxic cells. Flow cytometric analysis demonstrated expression of CRACC on nearly all NK cells, a large subset of CD8 cells, and few CD4 (OMIM Ref. No. 186940) cells and B cells. Expression on B cells was upregulated upon CD40 (OMIM Ref. No. 109535) activation, and expression on dendritic cells was upregulated by influenza virus, lipopolysaccharide, and CD40L (OMIM Ref. No. 300386). Immunoprecipitation and SDS-PAGE analyses showed expression of a 66-kD protein and, after deglycosylation, a 37-kD protein. Functional analysis indicated that CRACC mediates lysis that is in addition to that mediated by NKP46 (OMIM Ref. No. 604530) or CD16 (OMIM Ref. No. 146740). Further analysis determined that, unlike CD244, cytotoxicity mediated by CRACC or NKP46 is SAP-independent and that CRACC triggers ERK (see OMIM Ref. No. 601335) activation. Immunoblot analysis showed that CRACC is tyrosine phosphorylated in activated NK cells and is associated with 19- and 39-kD proteins. Bouchon et al. (2001) proposed that CRACC may be particularly important in controlling pathogens other than EBV Full details of the abovementioned studies are described in the following publications, the disclosure of which are hereby incorporated by reference:

Bouchon, A.; Cella, M.; Grierson, H. L.; Cohen, J. I.; Colonna, M.: Cutting edge: activation of NK cell-mediated cytotoxicity by a SAP-independent receptor of the CD2 family. J. Immun. 167:5517-5521, 2001; and Boles, K. S.; Mathew, P. A.: Molecular cloning of CS1, a novel human natural killer cell receptor belonging to the CD2 subset of the immunoglobulin superfamily. Immunogenetics 52:302.

Further studies establishing the function and utilities of CRACC are found in John Hopkins OMIM database record ID 606625, and in sited publications numbered 4520-4521 listed in the bibliography section hereinbelow, which are also hereby incorporated by reference. FLJ14351 (Accession NM_024732) is another VGAM26 host target gene. FLJ14351 BINDING SITE is HOST TARGET binding site found in the 5' untranslated region of mRNA encoded by FLJ14351, corresponding to a HOST TARGET binding site such as BINDING SITE I, BINDING SITE II or BINDING SITE III. Table 2 illustrates the complementarity of the nucleotide sequences of FLJ14351 BINDING SITE, designated SEQ ID:24073, to the nucleotide sequence of VGAM26 RNA, herein designated VGAM RNA, also designated SEQ ID:2737.

Another function of VGAM26 is therefore inhibition of FLJ14351 (Accession NM_024732). Accordingly, utilities of VGAM26 include diagnosis, prevention and treatment of diseases and clinical conditions associated with FLJ14351. KIAA0102 (Accession NM_014752) is another VGAM26 host target gene. KIAA0102 BINDING SITE is HOST TARGET binding site found in the 3' untranslated region of mRNA encoded by KIAA0102, corresponding to a HOST TARGET binding site such as BINDING SITE I, BINDING SITE II or BINDING SITE III. Table 2 illustrates the complementarity of the nucleotide sequences of KIAA0102 BINDING SITE, designated SEQ ID:16477, to the nucleotide sequence of VGAM26 RNA, herein designated VGAM RNA, also designated SEQ ID:2737.

Another function of VGAM26 is therefore inhibition of KIAA0102 (Accession NM_014752). Accordingly, utilities of VGAM26 include diagnosis, prevention and treatment of diseases and clinical conditions associated with KIAA0102. Obscurin, Cytoskeletal Calmodulin and Titin-interacting RhoGEF (OBSCN, Accession XM_047536) is another VGAM26 host target gene. OBSCN BINDING SITE is HOST TARGET binding site found in the 3' untranslated region of mRNA encoded by OBSCN, corresponding to a HOST TARGET binding site such as BINDING SITE I, BINDING SITE II or BINDING SITE III. Table 2 illustrates the complementarity of the nucleotide sequences of OBSCN BINDING SITE, designated SEQ ID:34987, to the nucleotide sequence of VGAM26 RNA, herein designated VGAM RNA, also designated SEQ ID:2737.

Another function of VGAM26 is therefore inhibition of Obscurin, Cytoskeletal Calmodulin and Titin-interacting RhoGEF (OBSCN, Accession XM_047536). Accordingly, utilities of VGAM26 include diagnosis, prevention and treatment of diseases and clinical conditions associated with OBSCN. FIG. 1 further provides a conceptual description of a novel bioinformatically detected viral gene of the present invention, referred to here as Viral Genomic Address Messenger 27 (VGAM27) viral gene, which modulates expression of respective host target genes thereof, the function and utility of which host target genes is known in the art.

VGAM27 is a novel bioinformatically detected regulatory, non protein coding, viral micro RNA (miRNA) gene. The method by which VGAM27 was detected is described hereinabove with reference to FIGS. 1-8.

VGAM27 gene, herein designated VGAM GENE, is a viral gene contained in the genome of Invertebrate Iridescent Virus 6. VGAM27 host target gene, herein designated VGAM HOST TARGET GENE, is a human gene contained in the human genome.

VGAM27 gene encodes a VGAM27 precursor RNA, herein designated VGAM PRECURSOR RNA. Similar to other miRNA genes, and unlike most ordinary genes, VGAM27 precursor RNA does not encode a protein. A nucleotide sequence identical or highly similar to the nucleotide sequence of VGAM27 precursor RNA is designated SEQ ID:13, and is provided hereinbelow with reference to the sequence listing part. Nucleotide sequence SEQ ID:13 is located at position 12904 relative to the genome of Invertebrate Iridescent Virus 6.

VGAM27 precursor RNA folds onto itself, forming VGAM27 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM27 folded precursor RNA into VGAM27 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM27 RNA is designated SEQ ID:2738, and is provided hereinbelow with reference to the sequence listing part.

VGAM27 host target gene, herein designated VGAM HOST TARGET GENE, encodes a corresponding messenger RNA, VGAM27 host target RNA, herein designated VGAM HOST TARGET RNA. VGAM27 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM27 RNA, herein designated VGAM RNA, binds complementarily to one or more host target binding sites located in untranslated regions of VGAM27 host target RNA, herein designated VGAM HOST TARGET RNA. This complementary binding is due to the fact that the nucleotide sequence of VGAM27 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM27 RNA, herein designated VGAM RNA, may have a different number of host target binding sites in untranslated regions of a VGAM27 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM27 RNA, herein designated VGAM RNA, to host target binding sites on VGAM27 host target RNA, herein designated VGAM HOST TARGET RNA, such as BINDING SITE I, BINDING SITE II and BINDING SITE III, inhibits translation of VGAM27 host target RNA into VGAM27 host target protein, herein designated VGAM HOST TARGET PROTEIN. VGAM host target protein is therefore outlined by a broken line.

It is appreciated that VGAM27 host target gene, herein designated VGAM HOST TARGET GENE, in fact represents a plurality of VGAM27 host target genes. The mRNA of each one of this plurality of VGAM27 host target genes comprises one or more host target binding sites, each having a nucleotide sequence which is at least partly complementary to VGAM27 RNA, herein designated VGAM RNA, and which when bound by VGAM27 RNA causes inhibition of translation of respective one or more VGAM27 host target proteins.

It is further appreciated by one skilled in the art that the mode of translational inhibition illustrated by FIG. 1 with specific reference to translational inhibition exerted by VGAM27 gene, herein designated VGAM GENE, on one or more VGAM27 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM27 is inhibition of expression of host target genes, as part of a novel viral mechanism of attacking a host. Accordingly, utilities of VGAM27 include diagnosis, prevention and treatment of viral infection by Invertebrate Iridescent Virus 6. Specific functions, and accordingly utilities, of VGAM27 correlate with, and may be deduced from, the identity of the host target genes which VGAM27 binds and inhibits, and the function of these host target genes, as elaborated hereinbelow.

Nucleotide sequences of the VGAM27 precursor RNA, herein designated VGAM PRECURSOR RNA, and of the 'diced' VGAM27 RNA, herein designated VGAM RNA, and a schematic representation of the secondary folding of VGAM27 folded precursor RNA, herein designated VGAM FOLDED PRECURSOR RNA, of VGAM27 are further described hereinbelow with reference to Table 1.

Nucleotide sequences of host target binding sites, such as BINDING SITE-I, BINDING SITE-II and BINDING SITE-III of FIG. 1, found on VGAM27 host target RNA, and schematic representation of the complementarity of each of these host target binding sites to VGAM27 RNA, herein designated VGAM RNA, are described hereinbelow with reference to Table 2.

As mentioned hereinabove with reference to FIG. 1, a function of VGAM27 gene, herein designated VGAM is inhibition of expression of VGAM27 target genes. It is appreciated that specific functions, and accordingly utilities, of VGAM27 correlate with, and may be deduced from, the identity of the target genes which VGAM27 binds and inhibits, and the function of these target genes, as elaborated hereinbelow.

FLJ14600 (Accession NM_032810) is a VGAM27 host target gene. FLJ14600 BINDING SITE is HOST TARGET binding site found in the 3' untranslated region of mRNA encoded by FLJ14600, corresponding to a HOST TARGET binding site such as BINDING SITE I, BINDING SITE II or BINDING SITE III. Table 2 illustrates the complementarity of the nucleotide sequences of FLJ14600 BINDING SITE, designated SEQ ID:26573, to the nucleotide sequence of VGAM27 RNA, herein designated VGAM RNA, also designated SEQ ID:2738.

A function of VGAM27 is therefore inhibition of FLJ14600 (Accession NM_032810). Accordingly, utilities of VGAM27 include diagnosis, prevention and treatment of diseases and clinical conditions associated with FLJ14600. KIAA0215 (Accession NM_014735) is another VGAM27 host target gene. KIAA0215 BINDING SITE is HOST TARGET binding site found in the 3' untranslated region of mRNA encoded by KIAA0215, corresponding to a HOST TARGET binding site such as BINDING SITE I, BINDING SITE II or BINDING SITE III. Table 2 illustrates the complementarity of the nucleotide sequences of KIAA0215 BINDING SITE, designated SEQ ID:16385,to the nucleotide sequence of VGAM27 RNA, herein designated VGAM RNA, also designated SEQ ID:2738.

Another function of VGAM27 is therefore inhibition of KIAA0215 (Accession NM_014735). Accordingly, utilities of VGAM27 include diagnosis, prevention and treatment of diseases and clinical conditions associated with KIAA0215. NFASC (Accession XM_046808) is another VGAM27 host target gene. NFASC BINDING SITE is HOST TARGET binding site found in the 3" untranslated region of mRNA encoded by NFASC, corresponding to a HOST TARGET binding site such as BINDING SITE I, BINDING SITE II or BINDING SITE III. Table 2 illustrates the complementarity of the nucleotide sequences of NFASC BINDING SITE, designated SEQ ID:34833, to the nucleotide sequence of VGAM27 RNA, herein designated VGAM RNA, also designated SEQ ID:2738.

Another function of VGAM27 is therefore inhibition of NFASC (Accession XM_046808). Accordingly, utilities of VGAM27 include diagnosis, prevention and treatment of diseases and clinical conditions associated with NFASC. Phosphodiesterase 10A (PDE10A, Accession NM_006661) is another VGAM27 host target gene. PDE10A BINDING SITE is HOST TARGET binding site found in the 3' untranslated region of mRNA encoded by PDE10A, corresponding to a HOST TARGET binding site such as BINDING SITE I, BINDING SITE II or BINDING SITE III. Table 2 illustrates the complementarity of the nucleotide sequences of PDE10A BINDING SITE, designated SEQ ID:13464, to the nucleotide sequence of VGAM27 RNA, herein designated VGAM RNA, also designated SEQ ID:2738.

Another function of VGAM27 is therefore inhibition of Phosphodiesterase 10A (PDE10A, Accession NM_006661). Accordingly, utilities of VGAM27 include diagnosis, prevention and treatment of diseases and clinical conditions associated with PDE10A. FIG. 1 further provides a conceptual description of a novel bioinformatically detected viral gene of the present invention, referred to here as Viral Genomic Address Messenger 28 (VGAM28) viral gene, which modulates expression of respective host target genes thereof, the function and utility of which host target genes is known in the art.

VGAM28 is a novel bioinformatically detected regulatory, non protein coding, viral micro RNA (miRNA) gene. The method by which VGAM28 was detected is described hereinabove with reference to FIGS. 1-8.

VGAM28 gene, herein designated VGAM GENE, is a viral gene contained in the genome of Invertebrate Iridescent Virus 6. VGAM28 host target gene, herein designated VGAM HOST TARGET GENE, is a human gene contained in the human genome.

VGAM28 gene encodes a VGAM28 precursor RNA, herein designated VGAM PRECURSOR RNA. Similar to other miRNA genes, and unlike most ordinary genes, VGAM28 precursor RNA does not encode a protein. A nucleotide sequence identical or highly similar to the nucleotide sequence of VGAM28 precursor RNA is designated SEQ ID:14, and is provided hereinbelow with reference to the sequence listing part. Nucleotide sequence SEQ ID:14 is located at position 90871 relative to the genome of Invertebrate Iridescent Virus 6.

VGAM28 precursor RNA folds onto itself, forming VGAM28 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM28 folded precursor RNA into VGAM28 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM28 RNA is designated SEQ ID:2739, and is provided hereinbelow with reference to the sequence listing part.

VGAM28 host target gene, herein designated VGAM HOST TARGET GENE, encodes a corresponding messenger RNA, VGAM28 host target RNA, herein designated VGAM HOST TARGET RNA. VGAM28 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM28 RNA, herein designated VGAM RNA, binds complementarily to one or more host target binding sites located in untranslated regions of VGAM28 host target RNA, herein designated VGAM HOST TARGET RNA. This complementary binding is due to the fact that the nucleotide sequence of VGAM28 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM28 RNA, herein designated VGAM RNA, may have a different number of host target binding sites in untranslated regions of a VGAM28 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM28 RNA, herein designated VGAM RNA, to host target binding sites on VGAM28 host target RNA, herein designated VGAM HOST TARGET RNA, such as BINDING SITE I, BINDING SITE II and BINDING SITE III, inhibits translation of VGAM28 host target RNA into VGAM28 host target protein, herein designated VGAM HOST TARGET PROTEIN. VGAM host target protein is therefore outlined by a broken line.

It is appreciated that VGAM28 host target gene, herein designated VGAM HOST TARGET GENE, in fact represents a plurality of VGAM28 host target genes. The mRNA of each one of this plurality of VGAM28 host target genes comprises one or more host target binding sites, each having a nucleotide sequence which is at least partly complementary to VGAM28 RNA, herein designated VGAM RNA, and which when bound by VGAM28 RNA causes inhibition of translation of respective one or more VGAM28 host target proteins.

It is further appreciated by one skilled in the art that the mode of translational inhibition illustrated by FIG. 1 with specific reference to translational inhibition exerted by VGAM28 gene, herein designated VGAM GENE, on one or more VGAM28 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM28 is inhibition of expression of host target genes, as part of a novel viral mechanism of attacking a host. Accordingly, utilities of VGAM28 include diagnosis, prevention and treatment of viral infection by Invertebrate Iridescent Virus 6. Specific functions, and accordingly utilities, of VGAM28 correlate with, and may be deduced from, the identity of the host target genes which VGAM28 binds and inhibits, and the function of these host target genes, as elaborated hereinbelow.

Nucleotide sequences of the VGAM28 precursor RNA, herein designated VGAM PRECURSOR RNA, and of the 'diced' VGAM28 RNA, herein designated VGAM RNA, and a schematic representation of the secondary folding of VGAM28 folded precursor RNA, herein designated VGAM FOLDED PRECURSOR RNA, of VGAM28 are further described hereinbelow with reference to Table 1.

Nucleotide sequences of host target binding sites, such as BINDING SITE-I, BINDING SITE-II and BINDING SITE-III of FIG. 1, found on VGAM28 host target RNA, and schematic representation of the complementarity of each of these host target binding sites to VGAM28 RNA, herein designated VGAM RNA, are described hereinbelow with reference to Table 2.

As mentioned hereinabove with reference to FIG. 1, a function of VGAM28 gene, herein designated VGAM is inhibition of expression of VGAM28 target genes. It is appreciated that specific functions, and accordingly utilities, of VGAM28 correlate with, and may be deduced from, the identity of the target genes which VGAM28 binds and inhibits, and the function of these target genes, as elaborated hereinbelow.

Cysteine Knot Superfamily 1, BMP Antagonist 1 (CKTSF1B1, Accession NM_013372) is a VGAM28 host target gene. CKTSF1B1 BINDING SITE is HOST TARGET binding site found in the 3' untranslated region of mRNA encoded by CKTSF1B1, corresponding to a HOST TARGET binding site such as BINDING SITE I, BINDING SITE II or BINDING SITE III. Table 2 illustrates the complementarity of the nucleotide sequences of CKTSF1B1 BINDING SITE, designated SEQ ID:15022, to the nucleotide sequence of VGAM28 RNA, herein designated VGAM RNA, also designated SEQ ID:2739.

A function of VGAM28 is therefore inhibition of Cysteine Knot Superfamily 1, BMP Antagonist 1 (CKTSF1B1, Accession NM_013372), a gene which blocks signaling of bone morphogenetic protein (BMP). Accordingly, utilities of VGAM28 include diagnosis, prevention and treatment of diseases and clinical conditions associated with CKTSF1B1. The function of CKTSF1B1 has been established by previous studies. Using a Xenopus expression-cloning screen, Hsu et al. (1998) isolated Gremlin, an antagonist of bone morphogenetic protein (BMP) signaling that is expressed in the neural crest. Gremlin belongs to a novel gene family that includes the head-inducing factor Cerberus (OMIM Ref. No. 603777) and the tumor suppressor DAN (OMIM Ref. No. 600613). Hsu et al. (1998) showed that all family members are secreted proteins and that they act as BMP antagonists in embryonic explants. They also provided support for the model that Gremlin, Cerberus, and DAN block BMP signaling by binding BMPs, preventing them from interacting with their receptors. They proposed that Gremlin, Cerberus, and DAN control diverse processes in growth and development by selectively antagonizing the activities of different subsets of the transforming growth factor (TGF)-beta ligands. By homology searches, Hsu et al. (1998) cloned the human homolog of Xenopus Gremlin. The human gremlin cDNA encodes a predicted 184-amino acid protein. Zuniga et al. (1999) reported that the secreted BMP antagonist Gremlin relays the sonic hedgehog (SHH; 600725) signal from the polarizing region to the apical ectodermal ridge. Mesenchymal Gremlin expression is lost in limb buds of mouse embryos homozygous for the 'limb deformity' (ld) mutation, which disrupts establishment of the Shh/Fgf4 (OMIM Ref. No. 164980) feedback loop. Grafting Gremlin-expressing cells into ld mutant limb buds rescued Fgf4 expression and restored the Shh/Fgf4 feedback loop. Analysis of Shh-null mutant embryos revealed that Shh signaling is required for maintenance of Gremlin and Formin (OMIM Ref. No. 136535), the gene disrupted by the ld mutations. In contrast, Formin, Gremlin, and Fgf4 activation were independent of Shh signaling. Zuniga et al. (1999) concluded that the study uncovered the cascade by which the SHH signal is relayed from the posterior mesenchyme to the apical ectodermal ridge and established that Formin-dependent activation of the BMP antagonist Gremlin is sufficient to induce Fgf4 and establish the SHH/Fgf4 feedback loop.

Full details of the abovementioned studies are described in the following publications, the disclosure of which are hereby incorporated by reference:

Hsu, D. R.; Economides, A. N.; Wang, X,; Eimon, P. M.; Harland, R. M.: The Xenopus dorsalizing factor gremlin identifies a novel family of secreted proteins that antagonize BMP activities. Molec. Cell 1:673-683, 1998; and Zuniga, A.; Haramis, A.-P. G.; McMahon, A. P.; Zeller, R.: Signal relay by BMP antagonism controls the SHH/FGF4 feedback loop in vertebrate limb buds. Nature 401:598-602, 1999.

Further studies establishing the function and utilities of CKTSF1B1 are found in John Hopkins OMIM database record ID 603054, and in sited publications numbered 8017-801 and 2130 listed in the bibliography section hereinbelow, which are also hereby incorporated by reference. Copine III (CPNE3, Accession NM_003909) is another VGAM28 host target gene. CPNE3 BINDING SITE is HOST TARGET binding site found in the 3' untranslated region of mRNA encoded by CPNE3, corresponding to a HOST TARGET binding site such as BINDING SITE I, BINDING SITE II or BINDING SITE III. Table 2 illustrates the complementarity of the nucleotide sequences of CPNE3 BINDING SITE, designated SEQ ID:9992, to the nucleotide sequence of VGAM28 RNA, herein designated VGAM RNA, also designated SEQ ID:2739.

Another function of VGAM28 is therefore inhibition of Copine III (CPNE3, Accession NM_003909), a gene which may function in membrane traffiking. Accordingly, utilities of VGAM28 include diagnosis, prevention and treatment of diseases and clinical conditions associated with CPNE3. The function of CPNE3 has been established by previous studies. By screening human brain cDNAs for the potential to encode proteins larger than 50 kD, Ishikawa et al. (1998) identified a CPNE3 cDNA, which they called KIAA0636. The deduced 537-amino acid CPNE3 protein is 65.7% identical to CPNE1. By SDS-PAGE, the in vitro transcribed/translated product of the CPNE3 cDNA had a molecular mass of 65 kD. RT-PCR detected CPNE3 expression in all human tissues examined By immunoprecipitation and kinase assays, Caudell et al. (2000) serendipitously identified a 60-kD protein identical to CPNE3. CPNE3 contains 2 N-terminal C2 domains, like CPNE1, CPNE6 (OMIM Ref. No. 605688), and CPNE7 (OMIM Ref. No. 605689), but these 4 copines have divergent C termini. CPNE3 is 63%, 52%, and 47% identical to CPNE1, CPNE6, and CPNE7, respectively. Northern blot analysis revealed ubiquitous expression of a 5.0-kb transcript. Biochemical analysis showed that CPNE3 appears to possess endogenous kinase activity, although it lacks a classic kinase domain. CPNE3 is phosphorylated on both serine and threonine residues but not on tyrosine residues.

Full details of the abovementioned studies are described in the following publications, the disclosure of which are hereby incorporated by reference:

Creutz, C. E.; Tomsig, J. L.; Snyder, S. L.; Gautier, M.-C.; Skouri, F.; Beisson, J.; Cohen, J.: The copines, a novel class of C2 domain-containing, calcium-dependent, phospholipid-binding proteins conserved from Paramecium to human S. J. Biol. Chem. 273:1393-1402, 1998; and Caudell, E. G.; Caudell, J. J.; Tang, C.-H.; Yu, T.-K.; Frederick, M. J.; Grimm, E. A.: Characterization of human copine III as a phosphoprotein with associated kinase activity. Biochem.

Further studies establishing the function and utilities of CPNE3 are found in John Hopkins OMIM database record ID 604207, and in sited publications numbered 475 and 9440 listed in the bibliography section hereinbelow, which are also hereby incorporated by reference. Myosin X (MYO10, Accession NM_012334) is another VGAM28 host target gene. MYO10 BINDING SITE is HOST TARGET binding site found in the 3' untranslated region of mRNA encoded by MYO10, corresponding to a HOST TARGET binding site such as BINDING SITE I, BINDING SITE II or BINDING SITE III. Table 2 illustrates the complementarity of the nucleotide sequences of MYO10 BINDING SITE, designated SEQ ID:14730, to the nucleotide sequence of VGAM28 RNA, herein designated VGAM RNA, also designated SEQ ID:2739.

Another function of VGAM28 is therefore inhibition of Myosin X (MYO10, Accession NM_012334), a gene which is an unconventional myosin. Accordingly, utilities of VGAM28 include diagnosis, prevention and treatment of diseases and clinical conditions associated with MYO10. The function of MYO10 has been established by previous studies. See MYO1A (OMIM Ref. No. 601478). By PCR amplification of RNA from porcine and human cell lines and human liver, Bement et al. (1994) identified 8-11 putative myosins representing 6 distinct myosin classes. Among the identified myosins was a cDNA encoding a myosin designated MYO10. Using interspecific backcross mapping, Hasson et al. (1996) mapped the Myo10 gene to mouse chromosome 15 in a region that predicted a location of the human homolog on either 5p14-p12 or 8q22-q23. They showed by fluorescence in situ hybridization that human MYO10 maps to 5p15.1-p14.3.

Full details of the abovementioned studies are described in the following publications, the disclosure of which are hereby incorporated by reference:

Bement, W. M.; Hasson, T.; Wirth, J. A.; Cheney, R. E.; Mooseker, M. S.: Identification and overlapping expression of multiple unconventional myosin genes in vertebrate cell types. Proc. Nat. Acad. Sci. 91:6549-6553, 1994. Erratum: Proc. Nat. Acad. Sci. 91:11767, 1994; and Hasson, T.; Skowron, J. F.; Gilbert, D. J.; Avraham, K. B.; Perry, W. L.; Bement, W. M.; Anderson, B. L.; Sherr, E. H.;

Chen, Z.-Y.; Greene, L. A.; Ward, D. C.; Corey, D. P.; Mooseker.

Further studies establishing the function and utilities of MYO10 are found in John Hopkins OMIM database record ID 601481, and in sited publications numbered 651 and 7027 listed in the bibliography section hereinbelow, which are also hereby incorporated by reference. Protein Kinase C, Nu (PRKCN, Accession NM_005813) is another VGAM28 host target gene. PRKCN BINDING SITE is HOST TARGET binding site found in the 3' untranslated region of mRNA encoded by PRKCN, corresponding to a HOST TARGET binding site such as BINDING SITE I, BINDING SITE II or BINDING SITE III. Table 2 illustrates the complementarity of the nucleotide sequences of PRKCN BINDING SITE, designated SEQ ID:12396, to the nucleotide sequence of VGAM28 RNA, herein designated VGAM RNA, also designated SEQ ID:2739.

Another function of VGAM28 is therefore inhibition of Protein Kinase C, Nu (PRKCN, Accession NM_005813). Accordingly, utilities of VGAM28 include diagnosis, prevention and treatment of diseases and clinical conditions associated with PRKCN. Eukaryotic Translation Initiation Factor 2C, 2 (EIF2C2, Accession XM_050334) is another VGAM28 host target gene. EIF2C2 BINDING SITE is HOST TARGET binding site found in the 3' untranslated region of mRNA encoded by EIF2C2, corresponding to a HOST TARGET binding site such as BINDING SITE I, BINDING SITE II or BINDING SITE III. Table 2 illustrates the complementarity of the nucleotide sequences of EIF2C2 BINDING SITE, designated SEQ ID:35613, to the nucleotide sequence of VGAM28 RNA, herein designated VGAM RNA, also designated SEQ ID:2739.

Another function of VGAM28 is therefore inhibition of Eukaryotic Translation Initiation Factor 2C, 2 (EIF2C2, Accession XM_050334). Accordingly, utilities of VGAM28 include diagnosis, prevention and treatment of diseases and clinical conditions associated with EIF2C2. FLJ12934 (Accession NM_022899) is another VGAM28 host target gene. FLJ12934 BINDING SITE is HOST TARGET binding site found in the 3" untranslated region of mRNA encoded by FLJ12934, corresponding to a HOST TARGET binding site such as BINDING SITE I, BINDING SITE II or BINDING SITE III. Table 2 illustrates the complementarity of the nucleotide sequences of FLJ12934 BINDING SITE, designated SEQ ID:23174, to the nucleotide sequence of VGAM28 RNA, herein designated VGAM RNA, also designated SEQ ID:2739.

Another function of VGAM28 is therefore inhibition of FLJ12934 (Accession NM_022899). Accordingly, utilities of VGAM28 include diagnosis, prevention and treatment of diseases and clinical conditions associated with FLJ12934. KIAA1701 (Accession XM_042087) is another VGAM28 host target gene. KIAA1701 BINDING SITE is HOST TARGET binding site found in the 3' untranslated region of mRNA encoded by KIAA1701, corresponding to a HOST TARGET binding site such as BINDING SITE I, BINDING SITE II or BINDING SITE III. Table 2 illustrates the complementarity of the nucleotide sequences of KIAA1701 BINDING SITE, designated SEQ ID:33683, to the nucleotide sequence of VGAM28 RNA, herein designated VGAM RNA, also designated SEQ ID:2739.

Another function of VGAM28 is therefore inhibition of KIAA1701 (Accession XM_042087). Accordingly, utilities of VGAM28 include diagnosis, prevention and treatment of diseases and clinical conditions associated with KIAA1701. Oxysterol Binding Protein-like 10 (OSBPL10, Accession NM_017784) is another VGAM28 host target gene. OSBPL10 BINDING SITE is HOST TARGET binding site found in the 3' untranslated region of mRNA encoded by OSBPL10, corresponding to a HOST TARGET binding site such as BINDING SITE I, BINDING SITE II or BINDING SITE III. Table 2 illustrates the complementarity of the nucleotide sequences of OSBPL10 BINDING SITE, designated SEQ ID:19414, to the nucleotide sequence of VGAM28 RNA, herein designated VGAM RNA, also designated SEQ ID:2739.

Another function of VGAM28 is therefore inhibition of Oxysterol Binding Protein-like 10 (OSBPL10, Accession NM_017784). Accordingly, utilities of VGAM28 include diagnosis, prevention and treatment of diseases and clinical conditions associated with OSBPL10. Synaptophysin-like Protein (SYPL, Accession XM_167511) is another VGAM28 host target gene. SYPL BINDING SITE is HOST TARGET binding site found in the 3' untranslated region of mRNA encoded by SYPL, corresponding to a HOST TARGET binding site such as BINDING SITE I, BINDING SITE II or BINDING SITE III. Table 2 illustrates the complementarity of the nucleotide sequences of SYPL BINDING SITE, designated SEQ ID:44643, to the nucleotide sequence of VGAM28 RNA, herein designated VGAM RNA, also designated SEQ ID:2739.

Another function of VGAM28 is therefore inhibition of Synaptophysin-like Protein (SYPL, Accession XM_167511). Accordingly, utilities of VGAM28 include diagnosis, prevention and treatment of diseases and clinical conditions associated with SYPL. LOC120114 (Accession XM_061871) is another VGAM28 host target gene. LOC120114 BINDING SITE is HOST TARGET binding site found in the 3' untranslated region of mRNA encoded by LOC120114, corresponding to a HOST TARGET binding site such as BINDING SITE I, BINDING SITE II or BINDING SITE III. Table 2 illustrates the complementarity of the nucleotide sequences of LOC120114 BINDING SITE, designated SEQ ID:37210, to the nucleotide sequence of VGAM28 RNA, herein designated VGAM RNA, also designated SEQ ID:2739.

Another function of VGAM28 is therefore inhibition of LOC120114 (Accession XM_061871). Accordingly, utilities of VGAM28 include diagnosis, prevention and treatment of diseases and clinical conditions associated with LOC120114. LOC150848 (Accession XM_097959) is another VGAM28 host target gene. LOC150848 BINDING SITE is HOST TARGET binding site found in the 5' untranslated region of mRNA encoded by LOC150848, corresponding to a HOST TARGET binding site such as BINDING SITE I, BINDING SITE II or BINDING SITE III. Table 2 illustrates the complementarity of the nucleotide sequences of LOC150848 BINDING SITE, designated SEQ ID:41251, to the nucleotide sequence of VGAM28 RNA, herein designated VGAM RNA, also designated SEQ ID:2739.

Another function of VGAM28 is therefore inhibition of LOC150848 (Accession XM_097959). Accordingly, utilities of VGAM28 include diagnosis, prevention and treatment of diseases and clinical conditions associated with LOC150848. LOC202454 (Accession XM_117400) is another VGAM28 host target gene. LOC202454 BINDING SITE is HOST TARGET binding site found in the 5' untranslated region of mRNA encoded by LOC202454, corresponding to a HOST TARGET binding site such as BINDING SITE I, BINDING SITE II or BINDING SITE III. Table 2 illustrates the complementarity of the nucleotide sequences of LOC202454 BINDING SITE, designated SEQ ID:43433, to the nucleotide sequence of VGAM28 RNA, herein designated VGAM RNA, also designated SEQ ID:2739.

Another function of VGAM28 is therefore inhibition of LOC202454 (Accession XM_117400). Accordingly, utilities of VGAM28 include diagnosis, prevention and treatment of diseases and clinical conditions associated with LOC202454.

FIG. 1 further provides a conceptual description of a novel bioinformatically detected viral gene of the present invention, referred to here as Viral Genomic Address Messenger 29 (VGAM29) viral gene, which modulates expression of respective host target genes thereof, the function and utility of which host target genes is known in the art.

VGAM29 is a novel bioinformatically detected regulatory, non protein coding, viral micro RNA (miRNA) gene. The method by which VGAM29 was detected is described hereinabove with reference to FIGS. 1-8.

VGAM29 gene, herein designated VGAM GENE, is a viral gene contained in the genome of Invertebrate Iridescent Virus 6. VGAM29 host target gene, herein designated VGAM HOST TARGET GENE, is a human gene contained in the human genome.

VGAM29 gene encodes a VGAM29 precursor RNA, herein designated VGAM PRECURSOR RNA. Similar to other miRNA genes, and unlike most ordinary genes, VGAM29 precursor RNA does not encode a protein. A nucleotide sequence identical or highly similar to the nucleotide sequence of VGAM29 precursor RNA is designated SEQ ID:15, and is provided hereinbelow with reference to the sequence listing part. Nucleotide sequence SEQ ID:15 is located at position 3700 relative to the genome of Invertebrate Iridescent Virus 6.

VGAM29 precursor RNA folds onto itself, forming VGAM29 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM29 folded precursor RNA into VGAM29 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM29 RNA is designated SEQ ID:2740, and is provided hereinbelow with reference to the sequence listing part.

VGAM29 host target gene, herein designated VGAM HOST TARGET GENE, encodes a corresponding messenger RNA, VGAM29 host target RNA, herein designated VGAM HOST TARGET RNA. VGAM29 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM29 RNA, herein designated VGAM RNA, binds complementarily to one or more host target binding sites located in untranslated regions of VGAM29 host target RNA, herein designated VGAM HOST TARGET RNA. This complementary binding is due to the fact that the nucleotide sequence of VGAM29 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM29 RNA, herein designated VGAM RNA, may have a different number of host target binding sites in untranslated regions of a VGAM29 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM29 RNA, herein designated VGAM RNA, to host target binding sites on VGAM29 host target RNA, herein designated VGAM HOST TARGET RNA, such as BINDING SITE I, BINDING SITE II and BINDING SITE III, inhibits translation of VGAM29 host target RNA into VGAM29 host target protein, herein designated VGAM HOST TARGET PROTEIN. VGAM host target protein is therefore outlined by a broken line.

It is appreciated that VGAM29 host target gene, herein designated VGAM HOST TARGET GENE, in fact represents a plurality of VGAM29 host target genes. The mRNA of each one of this plurality of VGAM29 host target genes comprises one or more host target binding sites, each having a nucleotide sequence which is at least partly complementary to VGAM29 RNA, herein designated VGAM RNA, and which when bound by VGAM29 RNA causes inhibition of translation of respective one or more VGAM29 host target proteins.

It is further appreciated by one skilled in the art that the mode of translational inhibition illustrated by FIG. 1 with specific reference to translational inhibition exerted by VGAM29 gene, herein designated VGAM GENE, on one or more VGAM29 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM29 is inhibition of expression of host target genes, as part of a novel viral mechanism of attacking a host. Accordingly, utilities of VGAM29 include diagnosis, prevention and treatment of viral infection by Invertebrate Iridescent Virus 6. Specific functions, and accordingly utilities, of VGAM29 correlate with, and may be deduced from, the identity of the host target genes which VGAM29 binds and inhibits, and the function of these host target genes, as elaborated hereinbelow.

Nucleotide sequences of the VGAM29 precursor RNA, herein designated VGAM PRECURSOR RNA, and of the 'diced' VGAM29 RNA, herein designated VGAM RNA, and a schematic representation of the secondary folding of VGAM29 folded precursor RNA, herein designated VGAM FOLDED PRECURSOR RNA, of VGAM29 are further described hereinbelow with reference to Table 1.

Nucleotide sequences of host target binding sites, such as BINDING SITE-I, BINDING SITE-II and BINDING SITE-III of FIG. 1, found on VGAM29 host target RNA, and schematic representation of the complementarity of each of these host target binding sites to VGAM29 RNA, herein designated VGAM RNA, are described hereinbelow with reference to Table 2.

As mentioned hereinabove with reference to FIG. 1, a function of VGAM29 gene, herein designated VGAM is inhibition of expression of VGAM29 target genes. It is appreciated that specific functions, and accordingly utilities, of VGAM29 correlate with, and may be deduced from, the identity of the target genes which VGAM29 binds and inhibits, and the function of these target genes, as elaborated hereinbelow.

Polycystic Kidney and Hepatic Disease 1 (autosomal recessive) (PKHD1, Accession NM_138694) is a VGAM29 host target gene. PKHD1 BINDING SITE is HOST TARGET binding site found in the 3' untranslated region of mRNA encoded by PKHD1, corresponding to a HOST TARGET binding site such as BINDING SITE I, BINDING SITE II or BINDING SITE III. Table 2 illustrates the complementarity of the nucleotide sequences of PKHD1 BINDING SITE, designated SEQ ID:28938, to the nucleotide sequence of VGAM29 RNA, herein designated VGAM RNA, also designated SEQ ID:2740.

A function of VGAM29 is therefore inhibition of Polycystic Kidney and Hepatic Disease 1 (autosomal recessive) (PKHD1, Accession NM_138694). Accordingly, utilities of VGAM29 include diagnosis, prevention and treatment of diseases and clinical conditions associated with PKHD1. Pleiomorphic Adenoma Gene 1 (PLAG1, Accession NM_002655) is another VGAM29 host target gene. PLAG1 BINDING SITE is HOST TARGET binding site found in the 3' untranslated region of mRNA encoded by PLAG1, corresponding to a HOST TARGET binding site such as BINDING SITE I, BINDING SITE II or BINDING SITE III. Table 2 illustrates the complementarity of the nucleotide sequences of PLAG1 BINDING SITE, designated SEQ ID:8515, to the nucleotide sequence of VGAM29 RNA, herein designated VGAM RNA, also designated SEQ ID:2740.

Another function of VGAM29 is therefore inhibition of Pleiomorphic Adenoma Gene 1 (PLAG1, Accession NM_002655), a gene which contains a zinc finger domain. Accordingly, utilities of VGAM29 include diagnosis, prevention and treatment of diseases and clinical conditions associated with PLAG1. The function of PLAG1 has been established by previous studies. Pleomorphic adenomas are benign epithelial tumors originating from the major and minor salivary glands (see OMIM Ref. No. 181030). They are characterized by recurrent chromosome translocations; the most common abnormalities involve chromosome 8, with consistent breakpoints at band q12. Kas et al. (1997) described the construction of 2 nonoverlapping YAC contigs covering about 75% of human chromosome band 8q12, which spans approximately 9 Mb of genomic DNA and includes a number of known genes such as MOS (OMIM Ref. No. 190060) and LYN (OMIM Ref. No. 165120), as well as novel genes and expressed sequence tags (ESTs). By fluorescence in situ hybridization, the authors determined that the majority of pleomorphic adenoma 8q12 breakpoints clustered within a 2-Mb contig that was mapped to the centromeric region of 8q12 and that was covered by 34 overlapping YAC clones, and tagged by 31 markers with an average spacing of 65 kb. Nine of 11 primary adenomas with 8q12 abnormalities had breakpoints mapping within a 300-kb interval. By searching sequence databases with sequence tagged sites (STSs) located within the 300-kb region, Kas et al. (1997) identified an EST with sequence identity to one of the STSs. Northern blot analysis using this EST detected a 7.5-kb transcript representing pleomorphic adenoma gene-1 (PLAG1). The authors cloned human fetal kidney PLAG1 cDNAs and found that the PLAG1 gene contains 5 exons. Southern blot analysis of DNA from pleomorphic adenomas with t (3;8) detected rearrangements in the 5-prime noncoding region of the PLAG1 gene. Using 5-prime RACE or RT-PCR, the authors generated hybrid transcripts consisting of PLAG1 and beta-1-catenin (CTNNB1; 116806) from every primary tumor analyzed. Northern blot analysis of 3 pleomorphic adenomas with t (3;8) and 1 adenoma with a variant t (8;15) revealed that PLAG1 expression was activated by the translocations in all 4 tumors. Kas et al. (1997) detected the 7.5-kb PLAG1 transcript in normal human fetal lung, fetal liver, and fetal kidney, but not in the corresponding adult tissues, adult salivary gland, or fetal brain; CTNNB1 appeared to be ubiquitously expressed. The deduced PLAG1 protein has 2 potential nuclear localization signals in the N-terminal region, 7 zinc finger domains, and a serine-rich C terminus. Astrom et al. (1999) found overexpression of PLAG1 in 23 of 47 primary benign and malignant pleomorphic adenomas of the salivary glands. In 5 adenomas with a normal karyotype, fusion transcripts were found in 3; PLAG1 and CTNNB1 were fused in 1 case, and in 2 others PLAG1 was fused with the gene encoding transcription elongation factor SII (OMIM Ref. No. 601425). The fusions occurred in the 5-prime noncoding region of PLAG1, leading to exchange of regulatory control elements and, as a consequence, activation of PLAG1 gene expression. Because all of the cases had grossly normal karyotypes, the rearrangements must result from cryptic rearrangements.

Full details of the abovementioned studies are described in the following publications, the disclosure of which are hereby incorporated by reference:

Astrom, A.-K.; Voz, M. L.; Kas, K.; Roijer, E.; Wedell, B.; Mandahl, N.; Van de Ven, W.; Mark, J.; Stenman, G.: Conserved mechanism of PLAG1 activation in salivary gland tumors with and without chromosome 8q12 abnormalities: identification of SII as a new fusion partner gene. Cancer Res. 59:918-923, 1999; and Kas, K.; Roijer, E.; Voz, M.; Meyen, E.; Stenman, G.; Van de Ven, W. J. M.: A 2-Mb YAC contig and physical map covering the chromosome 8q12 breakpoint cluster region in pleomorphic ad.

Further studies establishing the function and utilities of PLAG1 are found in John Hopkins OMIM database record ID 603026, and in sited publications numbered 546 and 5786-5787 listed in the bibliography section hereinbelow, which are also hereby incorporated by reference. DKFZP434O125 (Accession XM_036284) is another VGAM29 host target gene. DKFZP434O125 BINDING SITE is HOST TARGET binding site found in the 3' untranslated region of mRNA encoded by DKFZP434O125, corresponding to a HOST TARGET binding site such as BINDING SITE I, BINDING SITE II or BINDING SITE III. Table 2 illustrates the complementarity of the nucleotide sequences of DKFZP434O125 BINDING SITE, designated SEQ ID:32406, to the nucleotide sequence of VGAM29 RNA, herein designated VGAM RNA, also designated SEQ ID:2740.

Another function of VGAM29 is therefore inhibition of DKFZP434O125 (Accession XM_036284). Accordingly, utilities of VGAM29 include diagnosis, prevention and treatment of diseases and clinical conditions associated with DKFZP434O125. KIAA0419 (Accession NM_014711) is another VGAM29 host target gene. KIAA0419 BINDING SITE is HOST TARGET binding site found in the 3' untranslated region of mRNA encoded by KIAA0419, corresponding to a HOST TARGET binding site such as BINDING SITE I, BINDING SITE II or BINDING SITE III. Table 2 illustrates the complementarity of the nucleotide sequences of KIAA0419 BINDING SITE, designated SEQ ID:16258, to the nucleotide sequence of VGAM29 RNA, herein designated VGAM RNA, also designated SEQ ID:2740.

Another function of VGAM29 is therefore inhibition of KIAA0419 (Accession NM_014711). Accordingly, utilities of VGAM29 include diagnosis, prevention and treatment of diseases and clinical conditions associated with KIAA0419. KIAA0940 (Accession NM_014912) is another VGAM29 host target gene. KIAA0940 BINDING SITE is HOST TARGET binding site found in the 3' untranslated region of mRNA encoded by KIAA0940, corresponding to a HOST TARGET binding site such as BINDING SITE I, BINDING SITE II or BINDING SITE III. Table 2 illustrates the complementarity of the nucleotide sequences of KIAA0940 BINDING SITE, designated SEQ ID:17146, to the nucleotide sequence of VGAM29 RNA, herein designated VGAM RNA, also designated SEQ ID:2740.

Another function of VGAM29 is therefore inhibition of KIAA0940 (Accession NM_014912). Accordingly, utilities of VGAM29 include diagnosis, prevention and treatment of diseases and clinical conditions associated with KIAA0940. MGC12217 (Accession NM_032771) is another VGAM29 host target gene. MGC12217 BINDING SITE is HOST TARGET binding site found in the 3' untranslated region of mRNA encoded by MGC12217, corresponding to a HOST TARGET binding site such as BINDING SITE I, BINDING SITE II or BINDING SITE III. Table 2 illustrates the complementarity of the nucleotide sequences of MGC12217 BINDING SITE, designated SEQ ID:26515, to the nucleotide sequence of VGAM29 RNA, herein designated VGAM RNA, also designated SEQ ID:2740.

Another function of VGAM29 is therefore inhibition of MGC12217 (Accession NM_032771). Accordingly, utilities of VGAM29 include diagnosis, prevention and treatment of diseases and clinical conditions associated with MGC12217. Oxysterol Binding Protein-like 3 (OSBPL3, Accession NM_015550) is another VGAM29 host target gene. OSBPL3 BINDING SITE is HOST TARGET binding site found in the 3' untranslated region of mRNA encoded by OSBPL3, corresponding to a HOST TARGET binding site such as BINDING SITE I, BINDING SITE II or BINDING SITE III. Table 2 illustrates the complementarity of the nucleotide sequences of OSBPL3 BINDING SITE, designated SEQ ID:17813, to the nucleotide sequence of VGAM29 RNA, herein designated VGAM RNA, also designated SEQ ID:2740.

Another function of VGAM29 is therefore inhibition of Oxysterol Binding Protein-like 3 (OSBPL3, Accession NM_015550). Accordingly, utilities of VGAM29 include diagnosis, prevention and treatment of diseases and clinical conditions associated with OSBPL3. FIG. 1 further provides a conceptual description of a novel bioinformatically detected viral gene of the present invention, referred to here as Viral Genomic Address Messenger 30 (VGAM30) viral gene, which modulates expression of respective host target genes thereof, the function and utility of which host target genes is known in the art.

VGAM30 is a novel bioinformatically detected regulatory, non protein coding, viral micro RNA (miRNA) gene. The method by which VGAM30 was detected is described hereinabove with reference to FIGS. 1-8.

VGAM30 gene, herein designated VGAM GENE, is a viral gene contained in the genome of Invertebrate Iridescent Virus 6. VGAM30 host target gene, herein designated VGAM HOST TARGET GENE, is a human gene contained in the human genome.

VGAM30 gene encodes a VGAM30 precursor RNA, herein designated VGAM PRECURSOR RNA. Similar to other miRNA genes, and unlike most ordinary genes, VGAM30 precursor RNA does not encode a protein. A nucleotide sequence identical or highly similar to the nucleotide sequence of VGAM30 precursor RNA is designated SEQ ID:16, and is provided hereinbelow with reference to the sequence listing part. Nucleotide sequence SEQ ID:16 is located at position 128860 relative to the genome of Invertebrate Iridescent Virus 6.

VGAM30 precursor RNA folds onto itself, forming VGAM30 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM30 folded precursor RNA into VGAM30 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM30 RNA is designated SEQ ID:2741, and is provided hereinbelow with reference to the sequence listing part.

VGAM30 host target gene, herein designated VGAM HOST TARGET GENE, encodes a corresponding messenger RNA, VGAM30 host target RNA, herein designated VGAM HOST TARGET RNA. VGAM30 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM30 RNA, herein designated VGAM RNA, binds complementarily to one or more host target binding sites located in untranslated regions of VGAM30 host target RNA, herein designated VGAM HOST TARGET RNA. This complementary binding is due to the fact that the nucleotide sequence of VGAM30 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM30 RNA, herein designated VGAM RNA, may have a different number of host target binding sites in untranslated regions of a VGAM30 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM30 RNA, herein designated VGAM RNA, to host target binding sites on VGAM30 host target RNA, herein designated VGAM HOST TARGET RNA, such as BINDING SITE I, BINDING SITE II and BINDING SITE III, inhibits translation of VGAM30 host target RNA into VGAM30 host target protein, herein designated VGAM HOST TARGET PROTEIN. VGAM host target protein is therefore outlined by a broken line.

It is appreciated that VGAM30 host target gene, herein designated VGAM HOST TARGET GENE, in fact represents a plurality of VGAM30 host target genes. The mRNA of each one of this plurality of VGAM30 host target genes comprises one or more host target binding sites, each having a nucleotide sequence which is at least partly complementary to VGAM30 RNA, herein designated VGAM RNA, and which when bound by VGAM30 RNA causes inhibition of translation of respective one or more VGAM30 host target proteins.

It is further appreciated by one skilled in the art that the mode of translational inhibition illustrated by FIG. 1 with specific reference to translational inhibition exerted by VGAM30 gene, herein designated VGAM GENE, on one or more VGAM30 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM30 is inhibition of expression of host target genes, as part of a novel viral mechanism of attacking a host. Accordingly, utilities of VGAM30 include diagnosis, prevention and treatment of viral infection by Invertebrate Iridescent Virus 6. Specific functions, and accordingly utilities, of VGAM30 correlate with, and may be deduced from, the identity of the host target genes which VGAM30 binds and inhibits, and the function of these host target genes, as elaborated hereinbelow.

Nucleotide sequences of the VGAM30 precursor RNA, herein designated VGAM PRECURSOR RNA, and of the 'diced' VGAM30 RNA, herein designated VGAM RNA, and a schematic representation of the secondary folding of VGAM30 folded precursor RNA, herein designated VGAM FOLDED PRECURSOR RNA, of VGAM30 are further described hereinbelow with reference to Table 1.

Nucleotide sequences of host target binding sites, such as BINDING SITE-I, BINDING SITE-II and BINDING SITE-III of FIG. 1, found on VGAM30 host target RNA, and schematic representation of the complementarity of each of these host target binding sites to VGAM30 RNA, herein designated VGAM RNA, are described hereinbelow with reference to Table 2.

As mentioned hereinabove with reference to FIG. 1, a function of VGAM30 gene, herein designated VGAM is inhibition of expression of VGAM30 target genes. It is appreciated that specific functions, and accordingly utilities, of VGAM30 correlate with, and may be deduced from, the identity of the target genes which VGAM30 binds and inhibits, and the function of these target genes, as elaborated hereinbelow.

Fukuyama Type Congenital Muscular Dystrophy (fukutin) (FCMD, Accession NM_006731) is a VGAM30 host target gene. FCMD BINDING SITE is HOST TARGET binding site found in the 3' untranslated region of mRNA encoded by FCMD, corresponding to a HOST TARGET binding site such as BINDING SITE I, BINDING SITE II or BINDING SITE III. Table 2 illustrates the complementarity of the nucleotide sequences of FCMD BINDING SITE, designated SEQ ID:13574, to the nucleotide sequence of VGAM30 RNA, herein designated VGAM RNA, also designated SEQ ID:2741.

A function of VGAM30 is therefore inhibition of Fukuyama Type Congenital Muscular Dystrophy (fukutin) (FCMD, Accession NM_006731). Accordingly, utilities of VGAM30 include diagnosis, prevention and treatment of diseases and clinical conditions associated with FCMD. P3 (Accession NM_019848) is another VGAM30 host target gene. P3 BINDING SITE is HOST TARGET binding site found in the 5' untranslated region of mRNA encoded by P3, corresponding to a HOST TARGET binding site such as BINDING SITE I, BINDING SITE II or BINDING SITE III. Table 2 illustrates the complementarity of the nucleotide sequences of P3 BINDING SITE, designated SEQ ID:21254, to the nucleotide sequence of VGAM30 RNA, herein designated VGAM RNA, also designated SEQ ID:2741.

Another function of VGAM30 is therefore inhibition of P3 (Accession NM_019848). Accordingly, utilities of VGAM30 include diagnosis, prevention and treatment of diseases and clinical conditions associated with P3. FLJ14146 (Accession NM_024709) is another VGAM30 host target gene. FLJ14146 BINDING SITE is HOST TARGET binding site found in the 3' untranslated region of mRNA encoded by FLJ14146, corresponding to a HOST TARGET binding site such as BINDING SITE I, BINDING SITE II or BINDING SITE III. Table 2 illustrates the complementarity of the nucleotide sequences of FLJ14146 BINDING SITE, designated SEQ ID:24032, to the nucleotide sequence of VGAM30 RNA, herein designated VGAM RNA, also designated SEQ ID:2741.

Another function of VGAM30 is therefore inhibition of FLJ14146 (Accession NM_024709). Accordingly, utilities of VGAM30 include diagnosis, prevention and treatment of diseases and clinical conditions associated with FLJ14146. KIAA0935 (Accession XM_052620) is another VGAM30 host target gene. KIAA0935 BINDING SITE is HOST TARGET binding site found in the 3' untranslated region of mRNA encoded by KIAA0935, corresponding to a HOST TARGET binding site such as BINDING SITE I, BINDING SITE II or BINDING SITE III. Table 2 illustrates the complementarity of the nucleotide sequences of KIAA0935 BINDING SITE, designated SEQ ID:36011, to the nucleotide sequence of VGAM30 RNA, herein designated VGAM RNA, also designated SEQ ID:2741.

Another function of VGAM30 is therefore inhibition of KIAA0935 (Accession XM_052620). Accordingly, utilities of VGAM30 include diagnosis, prevention and treatment of diseases and clinical conditions associated with KIAA0935. P15-2 (Accession NM_018698) is another VGAM30 host target gene. P15-2 BINDING SITE is HOST TARGET binding site found in the 3' untranslated region of mRNA encoded by P15-2, corresponding to a HOST TARGET binding site such as BINDING SITE I, BINDING SITE II or BINDING SITE III. Table 2 illustrates the complementarity of the nucleotide sequences of P15-2 BINDING SITE, designated SEQ ID:20782, to the nucleotide sequence of VGAM30 RNA, herein designated VGAM RNA, also designated SEQ ID:2741.

Another function of VGAM30 is therefore inhibition of P15-2 (Accession NM_018698). Accordingly, utilities of VGAM30 include diagnosis, prevention and treatment of diseases and clinical conditions associated with P15-2. Torsin Family 2, Member A (TOR2A, Accession NM_130459) is another VGAM30 host target gene. TOR2A BINDING SITE is HOST TARGET binding site found in the 3' untranslated region of mRNA encoded by TOR2A, corresponding to a HOST TARGET binding site such as BINDING SITE I, BINDING SITE II or BINDING SITE III. Table 2 illustrates the complementarity of the nucleotide sequences of TOR2A BINDING SITE, designated SEQ ID:28216, to the nucleotide sequence of VGAM30 RNA, herein designated VGAM RNA, also designated SEQ ID:2741.

Another function of VGAM30 is therefore inhibition of Torsin Family 2, Member A (TOR2A, Accession NM_130459). Accordingly, utilities of VGAM30 include diagnosis, prevention and treatment of diseases and clinical conditions associated with TOR2A. LOC144848 (Accession XM_056770) is another VGAM30 host target gene. LOC144848 BINDING SITE is HOST TARGET binding site found in the 3' untranslated region of mRNA encoded by LOC144848, corresponding to a HOST TARGET binding site such as BINDING SITE I, BINDING SITE II or BINDING SITE III. Table 2 illustrates the complementarity of the nucleotide sequences of LOC144848 BINDING SITE, designated SEQ ID:36419, to the nucleotide sequence of VGAM30 RNA, herein designated VGAM RNA, also designated SEQ ID:2741.

Another function of VGAM30 is therefore inhibition of LOC144848 (Accession XM_056770). Accordingly, utilities of VGAM30 include diagnosis, prevention and treatment of diseases and clinical conditions associated with LOC144848. LOC150372 (Accession XM_086893) is another VGAM30 host target gene. LOC150372 BINDING SITE is HOST TARGET binding site found in the 5' untranslated region of mRNA encoded by LOC150372, corresponding to a HOST TARGET binding site such as BINDING SITE I, BINDING SITE II or BINDING SITE III. Table 2 illustrates the complementarity of the nucleotide sequences of LOC150372 BINDING SITE, designated SEQ ID:38940, to the nucleotide sequence of VGAM30 RNA, herein designated VGAM RNA, also designated SEQ ID:2741.

Another function of VGAM30 is therefore inhibition of LOC150372 (Accession XM_086893). Accordingly, utilities of VGAM30 include diagnosis, prevention and treatment of diseases and clinical conditions associated with LOC150372. LOC163682 (Accession XM_099402) is another VGAM30 host target gene. LOC163682 BINDING SITE is HOST TARGET binding site found in the 5' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42087, to the nucleotide sequence of VGAM30 RNA, herein designated VGAM RNA, also designated SEQ ID:2741.

Another function of VGAM30 is therefore inhibition of LOC163682 (Accession XM_099402). Accordingly, utilities of VGAM30 include diagnosis, prevention and treatment of diseases and clinical conditions associated with LOC163682. FIG. 1 further provides a conceptual description of a novel bioinformatically detected viral gene of the present invention, referred to here as Viral Genomic Address Messenger 31 (VGAM31) viral gene, which modulates expression of respective host target genes thereof, the function and utility of which host target genes is known in the art.

VGAM31 is a novel bioinformatically detected regulatory, non protein coding, viral micro RNA (miRNA) gene. The method by which VGAM31 was detected is described hereinabove with reference to FIGS. 1-8.

VGAM31 gene, herein designated VGAM GENE, is a viral gene contained in the genome of Invertebrate Iridescent Virus 6. VGAM31 host target gene, herein designated VGAM HOST TARGET GENE, is a human gene contained in the human genome.

VGAM31 gene encodes a VGAM31 precursor RNA, herein designated VGAM PRECURSOR RNA. Similar to other miRNA genes, and unlike most ordinary genes, VGAM31 precursor RNA does not encode a protein. A nucleotide sequence identical or highly similar to the nucleotide sequence of VGAM31 precursor RNA is designated SEQ ID:17, and is provided hereinbelow with reference to the sequence listing part. Nucleotide sequence SEQ ID:17 is located at position 192106 relative to the genome of Invertebrate Iridescent Virus 6.

VGAM31 precursor RNA folds onto itself, forming VGAM31 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM31 folded precursor RNA into VGAM31 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM31 RNA is designated SEQ ID:2742, and is provided hereinbelow with reference to the sequence listing part.

VGAM31 host target gene, herein designated VGAM HOST TARGET GENE, encodes a corresponding messenger RNA, VGAM31 host target RNA, herein designated VGAM HOST TARGET RNA. VGAM31 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM31 RNA, herein designated VGAM RNA, binds complementarily to one or more host target binding sites located in untranslated regions of VGAM31 host target RNA, herein designated VGAM HOST TARGET RNA. This complementary binding is due to the fact that the nucleotide sequence of VGAM31 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM31 RNA, herein designated VGAM RNA, may have a different number of host target binding sites in untranslated regions of a VGAM31 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM31 RNA, herein designated VGAM RNA, to host target binding sites on VGAM31 host target RNA, herein designated VGAM HOST TARGET RNA, such as BINDING SITE I, BINDING SITE II and BINDING SITE III, inhibits translation of VGAM31 host target RNA into VGAM31 host target protein, herein designated VGAM HOST TARGET PROTEIN. VGAM host target protein is therefore outlined by a broken line.

It is appreciated that VGAM31 host target gene, herein designated VGAM HOST TARGET GENE, in fact represents a plurality of VGAM31 host target genes. The mRNA of each one of this plurality of VGAM31 host target genes comprises one or more host target binding sites, each having a nucleotide sequence which is at least partly complementary to VGAM31

RNA, herein designated VGAM RNA, and which when bound by VGAM31 RNA causes inhibition of translation of respective one or more VGAM31 host target proteins.

It is further appreciated by one skilled in the art that the mode of translational inhibition illustrated by FIG. 1 with specific reference to translational inhibition exerted by VGAM31 gene, herein designated VGAM GENE, on one or more VGAM31 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM31 is inhibition of expression of host target genes, as part of a novel viral mechanism of attacking a host. Accordingly, utilities of VGAM31 include diagnosis, prevention and treatment of viral infection by Invertebrate Iridescent Virus 6. Specific functions, and accordingly utilities, of VGAM31 correlate with, and may be deduced from, the identity of the host target genes which VGAM31 binds and inhibits, and the function of these host target genes, as elaborated hereinbelow.

Nucleotide sequences of the VGAM31 precursor RNA, herein designated VGAM PRECURSOR RNA, and of the 'diced' VGAM31 RNA, herein designated VGAM RNA, and a schematic representation of the secondary folding of VGAM31 folded precursor RNA, herein designated VGAM FOLDED PRECURSOR RNA, of VGAM31 are further described hereinbelow with reference to Table 1.

Nucleotide sequences of host target binding sites, such as BINDING SITE-I, BINDING SITE-II and BINDING SITE-III of FIG. 1, found on VGAM31 host target RNA, and schematic representation of the complementarity of each of these host target binding sites to VGAM31 RNA, herein designated VGAM RNA, are described hereinbelow with reference to Table 2.

As mentioned hereinabove with reference to FIG. 1, a function of VGAM31 gene, herein designated VGAM is inhibition of expression of VGAM31 target genes. It is appreciated that specific functions, and accordingly utilities, of VGAM31 correlate with, and may be deduced from, the identity of the target genes which VGAM31 binds and inhibits, and the function of these target genes, as elaborated hereinbelow.

FLJ20209 (Accession XM_098142) is a VGAM31 host target gene. FLJ20209 BINDING SITE is HOST TARGET binding site found in the 3' untranslated region of mRNA encoded by FLJ20209, corresponding to a HOST TARGET binding site such as BINDING SITE I, BINDING SITE II or BINDING SITE III. Table 2 illustrates the complementarity of the nucleotide sequences of FLJ20209 BINDING SITE, designated SEQ ID:41400, to the nucleotide sequence of VGAM31 RNA, herein designated VGAM RNA, also designated SEQ ID:2742.

A function of VGAM31 is therefore inhibition of FLJ20209 (Accession XM_098142). Accordingly, utilities of VGAM31 include diagnosis, prevention and treatment of diseases and clinical conditions associated with FLJ20209. Monocyte to Macrophage Differentiation-associated (MMD, Accession XM_008269) is another VGAM31 host target gene. MMD BINDING SITE is HOST TARGET binding site found in the 3' untranslated region of mRNA encoded by MMD, corresponding to a HOST TARGET binding site such as BINDING SITE I, BINDING SITE II or BINDING SITE III. Table 2 illustrates the complementarity of the nucleotide sequences of MMD BINDING SITE, designated SEQ ID:30074, to the nucleotide sequence of VGAM31 RNA, herein designated VGAM RNA, also designated SEQ ID:2742.

Another function of VGAM31 is therefore inhibition of Monocyte to Macrophage Differentiation-associated (MMD, Accession XM_008269). Accordingly, utilities of VGAM31 include diagnosis, prevention and treatment of diseases and clinical conditions associated with MMD. LOC143920 (Accession XM_084658) is another VGAM31 host target gene. LOC143920 BINDING SITE is HOST TARGET binding site found in the 3' untranslated region of mRNA encoded by LOC143920, corresponding to a HOST TARGET binding site such as BINDING SITE I, BINDING SITE II or BINDING SITE III. Table 2 illustrates the complementarity of the nucleotide sequences of LOC143920 BINDING SITE, designated SEQ ID:37641, to the nucleotide sequence of VGAM31 RNA, herein designated VGAM RNA, also designated SEQ ID:2742.

Another function of VGAM31 is therefore inhibition of LOC143920 (Accession XM_084658). Accordingly, utilities of VGAM31 include diagnosis, prevention and treatment of diseases and clinical conditions associated with LOC143920. LOC145858 (Accession XM_085258) is another VGAM31 host target gene. LOC145858 BINDING SITE is HOST TARGET binding site found in the 3' untranslated region of mRNA encoded by LOC145858, corresponding to a HOST TARGET binding site such as BINDING SITE I, BINDING SITE II or BINDING SITE III. Table 2 illustrates the complementarity of the nucleotide sequences of LOC145858 BINDING SITE, designated SEQ ID:38002, to the nucleotide sequence of VGAM31 RNA, herein designated VGAM RNA, also designated SEQ ID:2742.

Another function of VGAM31 is therefore inhibition of LOC145858 (Accession XM_085258). Accordingly, utilities of VGAM31 include diagnosis, prevention and treatment of diseases and clinical conditions associated with LOC145858. FIG. 1 further provides a conceptual description of a novel bioinformatically detected viral gene of the present invention, referred to here as Viral Genomic Address Messenger 32 (VGAM32) viral gene, which modulates expression of respective host target genes thereof, the function and utility of which host target genes is known in the art.

VGAM32 is a novel bioinformatically detected regulatory, non protein coding, viral micro RNA (miRNA) gene. The method by which VGAM32 was detected is described hereinabove with reference to FIGS. 1-8.

VGAM32 gene, herein designated VGAM GENE, is a viral gene contained in the genome of Invertebrate Iridescent Virus 6. VGAM32 host target gene, herein designated VGAM HOST TARGET GENE, is a human gene contained in the human genome.

VGAM32 gene encodes a VGAM32 precursor RNA, herein designated VGAM PRECURSOR RNA. Similar to other miRNA genes, and unlike most ordinary genes, VGAM32 precursor RNA does not encode a protein. A nucleotide sequence identical or highly similar to the nucleotide sequence of VGAM32 precursor RNA is designated SEQ ID:18, and is provided hereinbelow with reference to the sequence listing part. Nucleotide sequence SEQ ID:18 is located at position 102904 relative to the genome of Invertebrate Iridescent Virus 6.

VGAM32 precursor RNA folds onto itself, forming VGAM32 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM32 folded precursor RNA into VGAM32 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 91%) nucleotide sequence of VGAM32 RNA is designated SEQ ID:2743, and is provided hereinbelow with reference to the sequence listing part.

VGAM32 host target gene, herein designated VGAM HOST TARGET GENE, encodes a corresponding messenger RNA, VGAM32 host target RNA, herein designated VGAM HOST TARGET RNA. VGAM32 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM32 RNA, herein designated VGAM RNA, binds complementarily to one or more host target binding sites located in untranslated regions of VGAM32 host target RNA, herein designated VGAM HOST TARGET RNA. This complementary binding is due to the fact that the nucleotide sequence of VGAM32 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM32 RNA, herein designated VGAM RNA, may have a different number of host target binding sites in untranslated regions of a VGAM32 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM32 RNA, herein designated VGAM RNA, to host target binding sites on VGAM32 host target RNA, herein designated VGAM HOST TARGET RNA, such as BINDING SITE I, BINDING SITE II and BINDING SITE III, inhibits translation of VGAM32 host target RNA into VGAM32 host target protein, herein designated VGAM HOST TARGET PROTEIN. VGAM host target protein is therefore outlined by a broken line.

It is appreciated that VGAM32 host target gene, herein designated VGAM HOST TARGET GENE, in fact represents a plurality of VGAM32 host target genes. The mRNA of each one of this plurality of VGAM32 host target genes comprises one or more host target binding sites, each having a nucleotide sequence which is at least partly complementary to VGAM32 RNA, herein designated VGAM RNA, and which when bound by VGAM32 RNA causes inhibition of translation of respective one or more VGAM32 host target proteins.

It is further appreciated by one skilled in the art that the mode of translational inhibition illustrated by FIG. 1 with specific reference to translational inhibition exerted by VGAM32 gene, herein designated VGAM GENE, on one or more VGAM32 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM32 is inhibition of expression of host target genes, as part of a novel viral mechanism of attacking a host. Accordingly, utilities of VGAM32 include diagnosis, prevention and treatment of viral infection by Invertebrate Iridescent Virus 6. Specific functions, and accordingly utilities, of VGAM32 correlate with, and may be deduced from, the identity of the host target genes which VGAM32 binds and inhibits, and the function of these host target genes, as elaborated hereinbelow.

Nucleotide sequences of the VGAM32 precursor RNA, herein designated VGAM PRECURSOR RNA, and of the 'diced' VGAM32 RNA, herein designated VGAM RNA, and a schematic representation of the secondary folding of VGAM32 folded precursor RNA, herein designated VGAM FOLDED PRECURSOR RNA, of VGAM32 are further described hereinbelow with reference to Table 1.

Nucleotide sequences of host target binding sites, such as BINDING SITE-I, BINDING SITE-II and BINDING SITE-III of FIG. 1, found on VGAM32 host target RNA, and schematic representation of the complementarity of each of these host target binding sites to VGAM32 RNA, herein designated VGAM RNA, are described hereinbelow with reference to Table 2.

As mentioned hereinabove with reference to FIG. 1, a function of VGAM32 gene, herein designated VGAM is inhibition of expression of VGAM32 target genes. It is appreciated that specific functions, and accordingly utilities, of VGAM32 correlate with, and may be deduced from, the identity of the target genes which VGAM32 binds and inhibits, and the function of these target genes, as elaborated hereinbelow.

Mitogen-activated Protein Kinase Kinase Kinase 8 (MAP3K8, Accession NM_005204) is a VGAM32 host target gene. MAP3K8 BINDING SITE is HOST TARGET binding site found in the 3' untranslated region of mRNA encoded by MAP3K8, corresponding to a HOST TARGET binding site such as BINDING SITE I, BINDING SITE II or BINDING SITE III. Table 2 illustrates the complementarity of the nucleotide sequences of MAP3K8 BINDING SITE, designated SEQ ID:11704, to the nucleotide sequence of VGAM32 RNA, herein designated VGAM RNA, also designated SEQ ID:2743.

A function of VGAM32 is therefore inhibition of Mitogen-activated Protein Kinase Kinase Kinase 8 (MAP3K8, Accession NM_005204), a gene which is able to activate nf-kappa-b 1 by stimulating proteasome- mediated p. Accordingly, utilities of VGAM32 include diagnosis, prevention and treatment of diseases and clinical conditions associated with MAP3K8. The function of MAP3K8 has been established by previous studies. By transfecting the hamster embryonic cell line SHOK with DNA extracted from a human thyroid carcinoma cell line, Miyoshi et al. (1991) identified the transforming oncogene 'cancer Osaka thyroid' (COT).

Sequence analysis revealed that COT is a serine-threonine protein kinase. The authors compared genomic clones of COT from transformed SHOK cells and from human placenta cells and found that the COT oncogene had undergone a rearrangement within the last coding exon, an event which probably occurred during the initial transfection experiment. The COT proto-oncogene contains 8 exons. Aoki et al. (1993) reported that the predicted normal COT protein has 467 amino acids. In the COT oncoprotein, the C-terminal 70 amino acids of normal COT are replaced by 18 novel residues. Cell fractionation and immunoprecipitation studies demonstrated that the COT proto-oncogene encodes 58- and 52-kD proteins that are located in the cytosol. Both proteins have serine/threonine kinase activity. The 2 COT isoforms appear to result from the use of alternative translation initiation sites. The 58-kD isoform had stronger transforming activity than the 52-kD protein, although this activity was much weaker than that of the oncoprotein. Aoki et al. (1993) suggested that the N-terminal domain of COT may be necessary for cellular transformation, whereas the C-terminal domain may negatively regulate the transforming activity. Chan et al. (1993) isolated a Ewing sarcoma cell line cDNA that transformed NIH3T3 cells. They designated the gene EST for 'Ewing sarcoma transformant' and identified it as COT. Since the EST cDNA encodes the normal form of the COT protein, the authors concluded that the COT gene can be activated as an oncogene by overexpression as well as by gene rearrangement. Northern blot analysis revealed that COT is expressed as a 3.2-kb mRNA in human fibroblasts and epithelial cells. Treatment of a lung fibroblast cell line with the tumor promoter okadaic acid induced COT expression Full details of the abovementioned studies are described in the following publications, the disclosure of which are hereby incorporated by reference:

Aoki, M.; Hamada, F.; Sugimoto, T.; Sumida, S.; Akiyama, T.; Toyoshima, K.: The human cot proto-oncogene encodes two protein serine/threonine kinases with different transforming activities by alternative initiation of translation. J. Biol. Chem. 268:22723-22732, 1993; and Chan, A. M.-L.; Chedid, M.; McGovern, E. S.; Popescu, N. C.; Miki, T.; Aaronson, S. A.: Expression cDNA cloning of a serine kinase transforming gene. Oncogene 8:1329-1333, 1993.

Further studies establishing the function and utilities of MAP3K8 are found in John Hopkins OMIM database record ID 603259, and in sited publications numbered 850 and 9052-8738 listed in the bibliography section hereinbelow, which are also hereby incorporated by reference. KIAA1795 (Accession XM_050988) is another VGAM32 host target gene. KIAA1795 BINDING SITE is HOST TARGET binding site found in the 3' untranslated region of mRNA encoded by KIAA1795, corresponding to a HOST TARGET binding site such as BINDING SITE I, BINDING SITE II or BINDING SITE III. Table 2 illustrates the complementarity of the nucleotide sequences of KIAA1795 BINDING SITE, designated SEQ ID:35698, to the nucleotide sequence of VGAM32 RNA, herein designated VGAM RNA, also designated SEQ ID:2743.

Another function of VGAM32 is therefore inhibition of KIAA1795 (Accession XM_050988). Accordingly, utilities of VGAM32 include diagnosis, prevention and treatment of diseases and clinical conditions associated with KIAA1795. LOC143666 (Accession XM_096465) is another VGAM32 host target gene. LOC143666 BINDING SITE is HOST TARGET binding site found in the 3' untranslated region of mRNA encoded by LOC143666, corresponding to a HOST TARGET binding site such as BINDING SITE I, BINDING SITE II or BINDING SITE III. Table 2 illustrates the complementarity of the nucleotide sequences of LOC143666 BINDING SITE, designated SEQ ID:40368, to the nucleotide sequence of VGAM32 RNA, herein designated VGAM RNA, also designated SEQ ID:2743.

Another function of VGAM32 is therefore inhibition of LOC143666 (Accession XM_096465). Accordingly, utilities of VGAM32 include diagnosis, prevention and treatment of diseases and clinical conditions associated with LOC143666. LOC253258 (Accession XM_172870) is another VGAM32 host target gene. LOC253258 BINDING SITE is HOST TARGET binding site found in the 3' untranslated region of mRNA encoded by LOC253258, corresponding to a HOST TARGET binding site such as BINDING SITE I, BINDING SITE II or BINDING SITE III. Table 2 illustrates the complementarity of the nucleotide sequences of LOC253258 BINDING SITE, designated SEQ ID:46146, to the nucleotide sequence of VGAM32 RNA, herein designated VGAM RNA, also designated SEQ ID:2743.

Another function of VGAM32 is therefore inhibition of LOC253258 (Accession XM_172870). Accordingly, utilities of VGAM32 include diagnosis, prevention and treatment of diseases and clinical conditions associated with LOC253258. LOC96573 (Accession XM_032391) is another VGAM32 host target gene. LOC96573 BINDING SITE is HOST TARGET binding site found in the 3' untranslated region of mRNA encoded by LOC96573, corresponding to a HOST TARGET binding site such as BINDING SITE I, BINDING SITE II or BINDING SITE III. Table 2 illustrates the complementarity of the nucleotide sequences of LOC96573 BINDING SITE, designated SEQ ID:31642, to the nucleotide sequence of VGAM32 RNA, herein designated VGAM RNA, also designated SEQ ID:2743.

Another function of VGAM32 is therefore inhibition of LOC96573 (Accession XM_032391). Accordingly, utilities of VGAM32 include diagnosis, prevention and treatment of diseases and clinical conditions associated with LOC96573. FIG. 1 further provides a conceptual description of a novel bioinformatically detected viral gene of the present invention, referred to here as Viral Genomic Address Messenger 33 (VGAM33) viral gene, which modulates expression of respective host target genes thereof, the function and utility of which host target genes is known in the art.

VGAM33 is a novel bioinformatically detected regulatory, non protein coding, viral micro RNA (miRNA) gene. The method by which VGAM33 was detected is described hereinabove with reference to FIGS. 1-8.

VGAM33 gene, herein designated VGAM GENE, is a viral gene contained in the genome of Invertebrate Iridescent Virus 6. VGAM33 host target gene, herein designated VGAM HOST TARGET GENE, is a human gene contained in the human genome.

VGAM33 gene encodes a VGAM33 precursor RNA, herein designated VGAM PRECURSOR RNA. Similar to other miRNA genes, and unlike most ordinary genes, VGAM33 precursor RNA does not encode a protein. A nucleotide sequence identical or highly similar to the nucleotide sequence of VGAM33 precursor RNA is designated SEQ ID:19, and is provided hereinbelow with reference to the sequence listing part. Nucleotide sequence SEQ ID:19 is located at position 72913 relative to the genome of Invertebrate Iridescent Virus 6.

VGAM33 precursor RNA folds onto itself, forming VGAM33 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM33 folded precursor RNA into VGAM33 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM33 RNA is designated SEQ ID:2744, and is provided hereinbelow with reference to the sequence listing part.

VGAM33 host target gene, herein designated VGAM HOST TARGET GENE, encodes a corresponding messenger RNA, VGAM33 host target RNA, herein designated VGAM HOST TARGET RNA. VGAM33 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM33 RNA, herein designated VGAM RNA, binds complementarily to one or more host target binding sites located in untranslated regions of VGAM33 host target RNA, herein designated VGAM HOST TARGET RNA. This complementary binding is due to the fact that the nucleotide sequence of VGAM33 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM33 RNA, herein designated VGAM RNA, may have a different number of host target binding sites in untranslated regions of a VGAM33 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM33 RNA, herein designated VGAM RNA, to host target binding sites on VGAM33 host target RNA, herein designated VGAM HOST TARGET RNA, such as BINDING SITE I, BINDING SITE II and BINDING SITE III, inhibits translation of VGAM33 host target RNA into VGAM33 host target protein, herein designated VGAM HOST TARGET PROTEIN. VGAM host target protein is therefore outlined by a broken line.

It is appreciated that VGAM33 host target gene, herein designated VGAM HOST TARGET GENE, in fact represents a plurality of VGAM33 host target genes. The mRNA of each one of this plurality of VGAM33 host target genes comprises one or more host target binding sites, each having a nucleotide sequence which is at least partly complementary to VGAM33 RNA, herein designated VGAM RNA, and which when bound by VGAM33 RNA causes inhibition of translation of respective one or more VGAM33 host target proteins.

It is further appreciated by one skilled in the art that the mode of translational inhibition illustrated by FIG. 1 with specific reference to translational inhibition exerted by VGAM33 gene, herein designated VGAM GENE, on one or more VGAM33 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM33 is inhibition of expression of host target genes, as part of a novel viral mechanism of attacking a host. Accordingly, utilities of VGAM33 include diagnosis, prevention and treatment of viral infection by Invertebrate Iridescent Virus 6. Specific functions, and accordingly utilities, of VGAM33 correlate with, and may be deduced from, the identity of the host target genes which VGAM33 binds and inhibits, and the function of these host target genes, as elaborated hereinbelow.

Nucleotide sequences of the VGAM33 precursor RNA, herein designated VGAM PRECURSOR RNA, and of the 'diced' VGAM33 RNA, herein designated VGAM RNA, and a schematic representation of the secondary folding of VGAM33 folded precursor RNA, herein designated VGAM FOLDED PRECURSOR RNA, of VGAM33 are further described hereinbelow with reference to Table 1.

Nucleotide sequences of host target binding sites, such as BINDING SITE-I, BINDING SITE-II and BINDING SITE-III of FIG. 1, found on VGAM33 host target RNA, and schematic representation of the complementarity of each of these host target binding sites to VGAM33 RNA, herein designated VGAM RNA, are described hereinbelow with reference to Table 2.

As mentioned hereinabove with reference to FIG. 1, a function of VGAM33 gene, herein designated VGAM is inhibition of expression of VGAM33 target genes. It is appreciated that specific functions, and accordingly utilities, of VGAM33 correlate with, and may be deduced from, the identity of the target genes which VGAM33 binds and inhibits, and the function of these target genes, as elaborated hereinbelow.

Protocadherin 10 (PCDH10, Accession NM_020815) is a VGAM33 host target gene. PCDH10 BINDING SITE1 and PCDH10 BINDING SITE2 are HOST TARGET binding sites found in untranslated regions of mRNA encoded by PCDH10, corresponding to HOST TARGET binding sites such as BINDING SITE I, BINDING SITE II or BINDING SITE III. Table 2 illustrates the complementarity of the nucleotide sequences of PCDH10 BINDING SITE1 and PCDH10 BINDING SITE2, designated SEQ ID:21881 and SEQ ID:26765 respectively, to the nucleotide sequence of VGAM33 RNA, herein designated VGAM RNA, also designated SEQ ID:2744.

A function of VGAM33 is therefore inhibition of Protocadherin 10 (PCDH10, Accession NM_020815). Accordingly, utilities of VGAM33 include diagnosis, prevention and treatment of diseases and clinical conditions associated with PCDH10. FIG. 1 further provides a conceptual description of a novel bioinformatically detected viral gene of the present invention, referred to here as Viral Genomic Address Messenger 34 (VGAM34) viral gene, which modulates expression of respective host target genes thereof, the function and utility of which host target genes is known in the art.

VGAM34 is a novel bioinformatically detected regulatory, non protein coding, viral micro RNA (miRNA) gene. The method by which VGAM34 was detected is described hereinabove with reference to FIGS. 1-8.

VGAM34 gene, herein designated VGAM GENE, is a viral gene contained in the genome of Invertebrate Iridescent Virus 6. VGAM34 host target gene, herein designated VGAM HOST TARGET GENE, is a human gene contained in the human genome.

VGAM34 gene encodes a VGAM34 precursor RNA, herein designated VGAM PRECURSOR RNA. Similar to other miRNA genes, and unlike most ordinary genes, VGAM34 precursor RNA does not encode a protein. A nucleotide sequence identical or highly similar to the nucleotide sequence of VGAM34 precursor RNA is designated SEQ ID:20, and is provided hereinbelow with reference to the sequence listing part. Nucleotide sequence SEQ ID:20 is located at position 157322 relative to the genome of Invertebrate Iridescent Virus 6.

VGAM34 precursor RNA folds onto itself, forming VGAM34 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM34 folded precursor RNA into VGAM34 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 43%) nucleotide sequence of VGAM34 RNA is designated SEQ ID:2745, and is provided hereinbelow with reference to the sequence listing part.

VGAM34 host target gene, herein designated VGAM HOST TARGET GENE, encodes a corresponding messenger RNA, VGAM34 host target RNA, herein designated VGAM HOST TARGET RNA. VGAM34 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM34 RNA, herein designated VGAM RNA, binds complementarily to one or more host target binding sites located in untranslated regions of VGAM34 host target RNA, herein designated VGAM HOST TARGET RNA. This complementary binding is due to the fact that the nucleotide sequence of VGAM34 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM34 RNA, herein designated VGAM RNA, may have a different number of host target binding sites in untranslated regions of a VGAM34 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM34 RNA, herein designated VGAM RNA, to host target binding sites on VGAM34 host target RNA, herein designated VGAM HOST TARGET RNA, such as BINDING SITE I, BINDING SITE II and BINDING SITE III, inhibits translation of VGAM34 host target RNA into VGAM34 host target protein, herein designated VGAM HOST TARGET PROTEIN. VGAM host target protein is therefore outlined by a broken line.

It is appreciated that VGAM34 host target gene, herein designated VGAM HOST TARGET GENE, in fact represents a plurality of VGAM34 host target genes. The mRNA of each one of this plurality of VGAM34 host target genes comprises one or more host target binding sites, each having a nucleotide sequence which is at least partly complementary to VGAM34 RNA, herein designated VGAM RNA, and which when bound by VGAM34 RNA causes inhibition of translation of respective one or more VGAM34 host target proteins.

It is further appreciated by one skilled in the art that the mode of translational inhibition illustrated by FIG. 1 with specific reference to translational inhibition exerted by VGAM34 gene, herein designated VGAM GENE, on one or more VGAM34 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM34 is inhibition of expression of host target genes, as part of a novel viral mechanism of attacking a host. Accordingly, utilities of VGAM34 include diagnosis, prevention and treatment of viral infection by Invertebrate Iridescent Virus 6. Specific functions, and accordingly utilities, of VGAM34 correlate with, and may be deduced from, the identity of the host target genes which VGAM34 binds and inhibits, and the function of these host target genes, as elaborated hereinbelow.

Nucleotide sequences of the VGAM34 precursor RNA, herein designated VGAM PRECURSOR RNA, and of the ‘diced’ VGAM34 RNA, herein designated VGAM RNA, and a schematic representation of the secondary folding of VGAM34 folded precursor RNA, herein designated VGAM FOLDED PRECURSOR RNA, of VGAM34 are further described hereinbelow with reference to Table 1.

Nucleotide sequences of host target binding sites, such as BINDING SITE-I, BINDING SITE-II and BINDING SITE-III of FIG. 1, found on VGAM34 host target RNA, and schematic representation of the complementarity of each of these host target binding sites to VGAM34 RNA, herein designated VGAM RNA, are described hereinbelow with reference to Table 2.

As mentioned hereinabove with reference to FIG. 1, a function of VGAM34 gene, herein designated VGAM is inhibition of expression of VGAM34 target genes. It is appreciated that specific functions, and accordingly utilities, of VGAM34 correlate with, and may be deduced from, the identity of the target genes which VGAM34 binds and inhibits, and the function of these target genes, as elaborated hereinbelow.

Chromosome 22 Open Reading Frame 19 (C22orf19, Accession NM_003678) is a VGAM34 host target gene. C22orf19 BINDING SITE is HOST TARGET binding site found in the 3' untranslated region of mRNA encoded by C22orf19, corresponding to a HOST TARGET binding site such as BINDING SITE I, BINDING SITE II or BINDING SITE III. Table 2 illustrates the complementarity of the nucleotide sequences of C22orf19 BINDING SITE, designated SEQ ID:9777, to the nucleotide sequence of VGAM34 RNA, herein designated VGAM RNA, also designated SEQ ID:2745.

A function of VGAM34 is therefore inhibition of Chromosome 22 Open Reading Frame 19 (C22orf19, Accession NM_003678). Accordingly, utilities of VGAM34 include diagnosis, prevention and treatment of diseases and clinical conditions associated with C22orf19. FLJ10545 (Accession NM_018132) is another VGAM34 host target gene. FLJ10545 BINDING SITE is HOST TARGET binding site found in the 3' untranslated region of mRNA encoded by FLJ10545, corresponding to a HOST TARGET binding site such as BINDING SITE I, BINDING SITE II or BINDING SITE III. Table 2 illustrates the complementarity of the nucleotide sequences of FLJ10545 BINDING SITE, designated SEQ ID:19930, to the nucleotide sequence of VGAM34 RNA, herein designated VGAM RNA, also designated SEQ ID:2745.

Another function of VGAM34 is therefore inhibition of FLJ10545 (Accession NM_018132). Accordingly, utilities of VGAM34 include diagnosis, prevention and treatment of diseases and clinical conditions associated with FLJ10545. Protocadherin 20 (PCDH20, Accession NM_022843) is another VGAM34 host target gene. PCDH20 BINDING SITE is HOST TARGET binding site found in the 3' untranslated region of mRNA encoded by PCDH20, corresponding to a HOST TARGET binding site such as BINDING SITE I, BINDING SITE II or BINDING SITE III. Table 2 illustrates the complementarity of the nucleotide sequences of PCDH20 BINDING SITE, designated SEQ ID:23138, to the nucleotide sequence of VGAM34 RNA, herein designated VGAM RNA, also designated SEQ ID:2745.

Another function of VGAM34 is therefore inhibition of Protocadherin 20 (PCDH20, Accession NM_022843). Accordingly, utilities of VGAM34 include diagnosis, prevention and treatment of diseases and clinical conditions associated with PCDH20. LOC144866 (Accession XM_096699) is another VGAM34 host target gene. LOC144866 BINDING SITE is HOST TARGET binding site found in the 5' untranslated region of mRNA encoded by LOC144866, corresponding to a HOST TARGET binding site such as BINDING SITE I, BINDING SITE II or BINDING SITE III. Table 2 illustrates the complementarity of the nucleotide sequences of LOC144866 BINDING SITE, designated SEQ ID:40480, to the nucleotide sequence of VGAM34 RNA, herein designated VGAM RNA, also designated SEQ ID:2745.

Another function of VGAM34 is therefore inhibition of LOC144866 (Accession XM_096699). Accordingly, utilities of VGAM34 include diagnosis, prevention and treatment of diseases and clinical conditions associated with LOC144866. FIG. 1 further provides a conceptual description of a novel bioinformatically detected viral gene of the present invention, referred to here as Viral Genomic Address Messenger 35 (VGAM35) viral gene, which modulates expression of respective host target genes thereof, the function and utility of which host target genes is known in the art.

VGAM35 is a novel bioinformatically detected regulatory, non protein coding, viral micro RNA (miRNA) gene. The method by which VGAM35 was detected is described hereinabove with reference to FIGS. 1-8.

VGAM35 gene, herein designated VGAM GENE, is a viral gene contained in the genome of Invertebrate Iridescent Virus 6. VGAM35 host target gene, herein designated VGAM HOST TARGET GENE, is a human gene contained in the human genome.

VGAM35 gene encodes a VGAM35 precursor RNA, herein designated VGAM PRECURSOR RNA. Similar to other miRNA genes, and unlike most ordinary genes, VGAM35 precursor RNA does not encode a protein. A nucleotide sequence identical or highly similar to the nucleotide sequence of VGAM35 precursor RNA is designated SEQ ID:21, and is provided hereinbelow with reference to the sequence listing part. Nucleotide sequence SEQ ID:21 is located at position 109599 relative to the genome of Invertebrate Iridescent Virus 6.

VGAM35 precursor RNA folds onto itself, forming VGAM35 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM35 folded precursor RNA into VGAM35 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM35 RNA is designated SEQ ID:2746, and is provided hereinbelow with reference to the sequence listing part.

VGAM35 host target gene, herein designated VGAM HOST TARGET GENE, encodes a corresponding messenger RNA, VGAM35 host target RNA, herein designated VGAM HOST TARGET RNA. VGAM35 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM35 RNA, herein designated VGAM RNA, binds complementarily to one or more host target binding sites located in untranslated regions of VGAM35 host target RNA, herein designated VGAM HOST TARGET RNA. This complementary binding is due to the fact that the nucleotide sequence of VGAM35 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM35 RNA, herein designated VGAM RNA, may have a different number of host target binding sites in untranslated regions of a VGAM35 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM35 RNA, herein designated VGAM RNA, to host target binding sites on VGAM35 host target RNA, herein designated VGAM HOST TARGET RNA, such as BINDING SITE I, BINDING SITE II and BINDING SITE III, inhibits translation of VGAM35 host target RNA into VGAM35 host target protein, herein designated VGAM HOST TARGET PROTEIN. VGAM host target protein is therefore outlined by a broken line.

It is appreciated that VGAM35 host target gene, herein designated VGAM HOST TARGET GENE, in fact represents a plurality of VGAM35 host target genes. The mRNA of each one of this plurality of VGAM35 host target genes comprises one or more host target binding sites, each having a nucleotide sequence which is at least partly complementary to VGAM35 RNA, herein designated VGAM RNA, and which when bound by VGAM35 RNA causes inhibition of translation of respective one or more VGAM35 host target proteins.

It is further appreciated by one skilled in the art that the mode of translational inhibition illustrated by FIG. 1 with specific reference to translational inhibition exerted by VGAM35 gene, herein designated VGAM GENE, on one or more VGAM35 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM35 is inhibition of expression of host target genes, as part of a novel viral mechanism of attacking a host. Accordingly, utilities of VGAM35 include diagnosis, prevention and treatment of viral infection by Invertebrate Iridescent Virus 6. Specific functions, and accordingly utilities, of VGAM35 correlate with, and may be deduced from, the identity of the host target genes which VGAM35 binds and inhibits, and the function of these host target genes, as elaborated hereinbelow.

Nucleotide sequences of the VGAM35 precursor RNA, herein designated VGAM PRECURSOR RNA, and of the 'diced' VGAM35 RNA, herein designated VGAM RNA, and a schematic representation of the secondary folding of VGAM35 folded precursor RNA, herein designated VGAM FOLDED PRECURSOR RNA, of VGAM35 are further described hereinbelow with reference to Table 1.

Nucleotide sequences of host target binding sites, such as BINDING SITE-I, BINDING SITE-II and BINDING SITE-III of FIG. 1, found on VGAM35 host target RNA, and schematic representation of the complementarity of each of these host target binding sites to VGAM35 RNA, herein designated VGAM RNA, are described hereinbelow with reference to Table 2.

As mentioned hereinabove with reference to FIG. 1, a function of VGAM35 gene, herein designated VGAM is inhibition of expression of VGAM35 target genes. It is appreciated that specific functions, and accordingly utilities, of VGAM35 correlate with, and may be deduced from, the identity of the target genes which VGAM35 binds and inhibits, and the function of these target genes, as elaborated hereinbelow.

A Disintegrin-like and Metalloprotease (reprolysin type) with Thrombospondin Type 1 Motif, 5 (aggrecanase-2) (ADAMTS5, Accession NM_007038) is a VGAM35 host target gene. ADAMTS5 BINDING SITE is HOST TARGET binding site found in the 3' untranslated region of mRNA encoded by ADAMTS5, corresponding to a HOST TARGET binding site such as BINDING SITE I, BINDING SITE II or BINDING SITE III. Table 2 illustrates the complementarity of the nucleotide sequences of ADAMTS5 BINDING SITE, designated SEQ ID:13919, to the nucleotide sequence of VGAM35 RNA, herein designated VGAM RNA, also designated SEQ ID:2746.

A function of VGAM35 is therefore inhibition of A Disintegrin-like and Metalloprotease (reprolysin type) with Thrombospondin Type 1 Motif, 5 (aggrecanase-2) (ADAMTS5, Accession NM_007038), a gene which cleaves aggrecan, a cartilage proteoglycan, and may be involved in its turnover. Accordingly, utilities of VGAM35 include diagnosis, prevention and treatment of diseases and clinical conditions associated with ADAMTS5. The function of ADAMTS5 has been established by previous studies. Proteolysis of the extracellular matrix plays a critical role in establishing tissue architecture during development and in tissue degradation in diseases such as cancer, arthritis, Alzheimer disease, and a variety of inflammatory conditions. The proteolytic enzymes responsible include members of diverse protease families and they may work in concert or in cascades to degrade or process molecules. Two groups of zinc metalloproteinases in particular, ADAMs and MMPs (e.g., 600754), appear broadly relevant to extracellular proteolysis. Most ADAM family members are quite similar in domain organization, bearing, from amino to carboxyl termini, a signal peptide, a proregion, a zinc metalloprotease catalytic domain with the typical reprolysin signature motif, a disintegrin domain, a cysteine-rich domain, an EGF-like domain, and, in many cases, a membrane-spanning region and a cytoplasmic domain with signaling potential. Members of the ADAMTS family differ substantially from the prototypic ADAM structure in that they lack the EGF-like domain, do not have a canonical disintegrin sequence, and possess modules with similar thrombospondin type 1 repeats. By searching an EST database using the protein sequences of human ADAMTS1 to ADAMTS4 and a C. elegans ADAMTS as queries, Hurskainen et al. (1999) identified ADAMTS5, ADAMTS6 (OMIM Ref. No. 605008), and ADAMTS7 (OMIM Ref. No. 605009). They determined a partial human ADAMTS5 cDNA sequence that lacked 5-prime coding sequence. The predicted partial ADAMTS5 protein has the domain structure characteristic of ADAMTSs, beginning with a partial metalloproteinase domain. Northern blot analysis of several human tissues detected an approximately 10-kb ADAMTS5 transcript that was expressed at a low level in placenta and at barely detectable levels in a number of other tissues. Northern blot analysis showed that mouse Adamts5 was specifically expressed in a 7-day mouse embryo, and at low or undetectable levels thereafter. In situ hybridization of an 8.5-day mouse embryo showed uniform Adamts5 expression throughout the embryo. In addition, Adamts5 expression was found in trophoblastic cells lining the uterine cavity, in the developing placenta, and in the decidual reaction within the uterus. In a 10.5-day mouse embryo, Adamts5 expression was widespread, but at a lower level than in the 8.5-day embryo. Expression was found in mesenchyme and somites, as well as in the neural tube and developing hindgut. Abbaszade et al. (1999) demonstrated that recombinant ADAMTS5 expressed in insect cells cleaves aggrecan at the glu373-ala374 site, with the cleavage pattern and inhibitor profile indistinguishable from that observed with native aggrecanase. Northern blot analysis of several human tissues showed highest ADAMTS5 expression in placenta, with much lower expression in heart and brain. Major transcripts of 12.4, 10.7, 8.6, and 6.6 kb were detected. Real time PCR of a number of normal human tissues detected ADAMTS5 expression in placenta, cervix, uterus, bladder, and esophagus. Expression was also found in rib cartilage, chondroblastoma, and fibrous tissue and joint capsule samples from an arthritic patient.

Full details of the abovementioned studies are described in the following publications, the disclosure of which are hereby incorporated by reference:

Abbaszade, I.; Liu, R.-Q.; Yang, F.; Rosenfeld, S. A.; Ross, O. H.; Link, J. R.; Ellis, D. M.; Tortorella, M. D.; Pratta, M. A.; Hollis, J. M.; Wynn, R.; Duke, J. L.; and 15 others: Cloning and characterization of ADAMTS11, an aggrecanase from the ADAMTS family. J. Biol. Chem. 274:23443-23450, 1999; and Hurskainen, T. L.; Hirohata, S.; Seldin, M. F.; Apte, S. S.: ADAM-TS5, ADAM-TS6, and ADAM-TS7, novel members of a new family of zinc metalloproteases: general features and genomic dis.

Further studies establishing the function and utilities of ADAMTS5 are found in John Hopkins OMIM database record ID 605007, and in sited publications numbered 291 and 7604 listed in the bibliography section hereinbelow, which are also hereby incorporated by reference. Hephaestin (HEPH, Accession NM_014799) is another VGAM35 host target gene. HEPH BINDING SITE is HOST TARGET binding site found in the 5' untranslated region of mRNA encoded by HEPH, corresponding to a HOST TARGET binding site such as BINDING SITE I, BINDING SITE II or BINDING SITE III. Table 2 illustrates the complementarity of the nucleotide sequences of HEPH BINDING SITE, designated SEQ ID:16717, to the nucleotide sequence of VGAM35 RNA, herein designated VGAM RNA, also designated SEQ ID:2746.

Another function of VGAM35 is therefore inhibition of Hephaestin (HEPH, Accession NM_014799), a gene which is thought to be a membrane-bound protein responsible for transport of dietary iron from epithelial cells of the intestinal lumen into the circulatory system. Accordingly, utilities of VGAM35 include diagnosis, prevention and treatment of diseases and clinical conditions associated with HEPH. The function of HEPH has been established by previous studies. Vulpe et al. (1999) found that Heph expression contrasts that of Cp, which is highly expressed in liver and expressed to a lesser extent in other tissues, including brain and lung, but is not expressed in intestine, where the highest expression of Heph is found. In situ hybridization studies indicated that intestinal expression of Heph is limited to villi, with almost no signal observed in crypt cells. Iron absorption occurs in villi. Vulpe et al. (1999) found that sla mice have a deletion of 582 nucleotides from the Heph gene, predicting an in-frame omission of 194 amino acids in the gene product. On the basis of its homology with ceruloplasmin, Vulpe et al. (1999) proposed that hephaestin is a ferroxidase necessary for iron release from intestinal epithelial cells. Since it contains only 1 putative membrane-spanning domain, it is unlikely to be a transmembrane iron carrier itself; hephaestin may interact with an iron-transport protein to facilitate the movement of iron across the membrane. Hephaestin represents a link between copper and iron metabolism in mammals and offers a basis for the iron-deficiency anemia associated with copper deficiency. Copper deficiency results in the decreased absorption of dietary iron, which enters intestinal epithelium normally but cannot exit into the circulation. Indeed, intestinal iron accumulation in copper-deficient swine is similar to the iron accumulation seen in sla mice (Lee et al., 1968). The administration of copper, but not iron, to copper-deficient pigs alleviates the anemia and facilitates the egress of iron from tissues, including intestine.

Full details of the abovementioned studies are described in the following publications, the disclosure of which are hereby incorporated by reference:

Vulpe, C. D.; Kuo, Y.-M.; Murphy, T. L.; Cowley, L.; Askwith, C.; Libina, N.; Gitschier, J.; Anderson, G. J.: Hephaestin, a ceruloplasmin homologue implicated in intestinal iron transport, is defective in the sla mouse. Nature Genet. 21: 195-199, 1999; and Lee, G. R.; Nacht, S.; Lukens, J. N.; Cartwright, G. E.: Iron metabolism in copper-deficient swine. J. Clin. Invest. 47:2058-2069, 1968.

Further studies establishing the function and utilities of HEPH are found in John Hopkins OMIM database record ID 300167, and in sited publications numbered 7244-7250 listed in the bibliography section hereinbelow, which are also hereby incorporated by reference. Lipin 1 (LPIN1, Accession XM_041136) is another VGAM35 host target gene. LPIN1 BINDING SITE is HOST TARGET binding site found in the 3' untranslated region of mRNA encoded by LPIN1, corresponding to a HOST TARGET binding site such as BINDING SITE I, BINDING SITE II or BINDING SITE III. Table 2 illustrates the complementarity of the nucleotide sequences of LPIN1 BINDING SITE, designated SEQ ID:33471, to the nucleotide sequence of VGAM35 RNA, herein designated VGAM RNA, also designated SEQ ID:2746.

Another function of VGAM35 is therefore inhibition of Lipin 1 (LPIN1, Accession XM_041136), a gene which is involved in adipocyte differenciation (by similarity). Accordingly, utilities of VGAM35 include diagnosis, prevention and treatment of diseases and clinical conditions associated with LPIN1. The function of LPIN1 has been established by previous studies. Mice carrying mutations in the fatty liver dystrophy (fld) gene have features of human lipodystrophy (Reue et al., 2000). In the human, lipodystrophy is a heterogeneous group of disorders characterized by loss of body fat, fatty liver, hypertriglyceridemia, and insulin resistance. Through positional cloning, Peterfy et al. (2001) isolated the gene responsible for fatty liver dystrophy in mice and characterized 2 independent mutant alleles of the fld gene. They designated the gene Lpin1 and named the novel nuclear protein which it encodes lipin. Through database searches, Peterfy et al. (2001) identified several mouse and human EST and genomic sequences with similarities to Lpin1. These included 2 Lpin1-related mouse genes (Lpin2 and Lpin3) and 3 human homologs (LPIN1, LPIN2 (OMIM Ref. No. 605519), and LPIN3 (OMIM Ref. No. 605520)). LPIN1 is identical to the KIAA0188 gene identified by Nagase et al. (1996). Consistent with the observed reduction of adipose tissue mass in fld mice, wildtype Lpin1 mRNA was expressed at high levels in adipose tissue and was induced during differentiation of 3T3-L1 preadipocytes. The results indicated that lipin is required for normal adipose tissue development, and provided a candidate gene for human lipodystrophy Cao and Hegele (2002) sequenced the 21 exons of the LPIN1 gene in lipodystrophy patients who had no mutations in known lipodystrophy genes, and also in normal control subjects. They found no rare LPIN1 coding sequence variants that were exclusive to patients with lipodystrophy. However, they found 4 single nucleotide polymorphisms (SNPs).

Full details of the abovementioned studies are described in the following publications, the disclosure of which are hereby incorporated by reference:

Reue, K.; Xu, P.; Wang, X.-P.; Slavin, B. G.: Adipose tissue deficiency, glucose intolerance, and increased atherosclerosis result from mutation in the mouse fatty liver dystrophy (fld) gene. J. Lipid Res. 41:1067-1076, 2000; and Cao, H.; Hegele, R. A.: Identification of single-nucleotide polymorphisms in the human LPIN1 gene. J. Hum. Genet. 47:370-372, 2002.

Further studies establishing the function and utilities of LPIN1 are found in John Hopkins OMIM database record ID 605518, and in sited publications numbered 645 and 11385-6461 listed in the bibliography section hereinbelow, which are also hereby incorporated by reference. RAB7, Member RAS Oncogene Family (RAB7, Accession NM_004637) is another VGAM35 host target gene. RAB7 BINDING SITE is HOST TARGET binding site found in the 5' untranslated region of mRNA encoded by RAB7, corresponding to a HOST TARGET binding site such as BINDING SITE I, BINDING SITE II or BINDING SITE III. Table 2 illustrates the complementarity of the nucleotide sequences of RAB7 BINDING SITE, designated SEQ ID:11013, to the nucleotide sequence of VGAM35 RNA, herein designated VGAM RNA, also designated SEQ ID:2746.

Another function of VGAM35 is therefore inhibition of RAB7, Member RAS Oncogene Family (RAB7, Accession NM_004637), a gene which is an important regulator of vesicular transport in the late endocytic pathway. Accordingly, utilities of VGAM35 include diagnosis, prevention and treatment of diseases and clinical conditions associated with RAB7. The function of RAB7 has been established by previous studies. Members of the RAB family of RAS-related GTP-binding proteins are important regulators of vesicular transport and are located in specific intracellular compartments. RAB7 has been localized to late endosomes and shown to be important in the late endocytic pathway. In addition, it has been shown to have a fundamental role in the cellular vacuolation induced by the cytotoxin VacA of Helicobacter pylori. Vitelli et al. (1996) cloned a RAB7 cDNA by screening a human placenta cDNA library with a rat Rab7 cDNA. The RAB7 cDNA encodes a 207-amino acid protein whose sequence is 99% identical to those of mouse, rat, and dog Rab7 and 61% identical to that of yeast Rab7. Using Northern blot analysis, Vitelli et al. (1996) found that RAB7 was expressed as 1.7- and 2.5-kb transcripts in all cell lines examined but that there was a large difference in the total amount of RAB7 mRNA among the cell lines. In studies using antisense RNA, Davies et al. (1997) found that down regulation of RAB7 gene expression in HeLa cells using antisense RNA induces severe cell vacuolation that resembles the phenotype seen in fibroblasts from patients with Chediak-Higashi syndrome (OMIM Ref. No. 214500). Davies et al. (1997) mapped the RAB7 gene to chromosome 3 by PCR analysis of somatic cell hybrid DNAs. Barbosa et al. (1995) mapped the mouse Rab7 gene to chromosome 9 by intersubspecific backcross analysis. Using fluorescence in situ hybridization and somatic cell hybrid analysis, Kashuba et al. (1997) mapped the RAB7 gene to 3q21.

Full details of the abovementioned studies are described in the following publications, the disclosure of which are hereby incorporated by reference:

Davies, J. P.; Cotter, P. D.; Ioannou, Y. A.: Cloning and mapping of human Rab7 and Rab9 cDNA sequences and identification of a Rab9 pseudogene. Genomics 41:131-134, 1997; and Davies, J. P.; Cotter, P. D.; Ioannou, Y. A.: Cloning and mapping of human Rab7 and Rab9 cDNA sequences and identification of a Rab9 pseudogene. Genomics 41:131-134, 1997.

Further studies establishing the function and utilities of RAB7 are found in John Hopkins OMIM database record ID 602298, and in sited publications numbered 544 and 10997 listed in the bibliography section hereinbelow, which are hereby incorporated by reference. Reelin (RELN, Accession XM_168628) is another VGAM35 host target gene. RELN BINDING SITE is HOST TARGET binding site found in the 3' untranslated region of mRNA encoded by RELN, corresponding to a HOST TARGET binding site such as BINDING SITE I, BINDING SITE II or BINDING SITE III. Table 2 illustrates the complementarity of the nucleotide sequences of RELN BINDING SITE, designated SEQ ID:45284, to the nucleotide sequence of VGAM35 RNA, herein designated VGAM RNA, also designated SEQ ID:2746.

Another function of VGAM35 is therefore inhibition of Reelin (RELN, Accession XM_168628), a gene which regulates microtubule function in neurons and neuronal migration. Accordingly, utilities of VGAM35 include diagnosis, prevention and treatment of diseases and clinical conditions associated with RELN. The function of RELN has been established by previous studies. Normal development of the cerebral cortex requires long-range migration of cortical neurons from proliferative regions deep in the brain. Lissencephaly ('smooth brain,' from 'lissos,' meaning 'smooth,' and 'encephalos,' meaning 'brain') is a severe developmental disorder in which neuronal migration is impaired, leading to a thickened cerebral cortex whose normally folded contour is simplified and smooth. X-linked lissencephaly (OMIM Ref. No. 300067) is caused by mutation in the gene encoding doublecortin (DCX; 300121). Deletion of or mutation in the LIS1 gene (OMIM Ref. No. 601545), located on 17p, causes isolated lissencephaly sequence (ILS), and haploinsufficiency of this and other neighboring genes is responsible for the Miller-Dieker lissencephaly syndrome (OMIM Ref. No. 247200), a contiguous gene deletion syndrome. Lissencephaly is a feature of a number of syndromes, such as the Walker-Warburg syndrome (OMIM Ref. No. 236670). Hong et al. (2000) studied an autosomal recessive form of lissencephaly associated with severe abnormalities of the cerebellum, hippocampus, and brainstem; see lissencephaly syndrome, Norman-Roberts type (OMIM Ref. No. 257320). They tested for linkage to markers near RELN on chromosome 7 and DAB1 on 1p32-p31, because mutations in the mouse homologs of these 2 genes cause brain defects in mice that resemble lissencephaly, including hypoplasia of the cerebellum, brainstem abnormalities, and a neuronal migration disorder of the neocortex and hippocampus. In 2 unrelated pedigrees, they found substantial regions of homozygosity in affected children near the RELN locus on 7q22. In these 2 families, they demonstrated different splice site mutations in the RELN gene. The study of these human patients pointed to several previously unsuspected functions of reelin in and outside of the brain. Although abnormalities of RELN mRNA had been reported in postmortem brains of schizophrenic human S (Impagnatiello et al., 1998), no evidence of schizophrenia was found in individuals with heterozygous or homozygous RELN mutations. On the other hand, one of the lissencephaly patients studied with a muscle biopsy showed evidence of abnormal neuromuscular connectivity (Hourihane et al., 1993). Moreover, at least 3 patients had persistent lymphedema neonatally, and one showed accumulation of chlyous (i.e., fatty) ascites fluid that required peritoneal shunting (Hourihane et al., 1993). The apparent role for reelin in serum homeostasis may reflect reelin interactions with LDL superfamily receptors outside the brain, as well as in the brain. Animal model experiments lend further support to the function of RELN. To investigate Reln function, Magdaleno et al. (2002) generated transgenic mice using the nestin (NES; 600915) promoter to drive ectopic expression of Reln in the ventricular zone during early brain development. Ectopic Reln expression in transgenic reelin mice, which lack endogenous Reln expression, induced tryosine phosphorylation of Dab1 in the ventricular zone. The transgene also rescued some, but not all, of the neuroanatomic and behavioral abnormalities characteristic of the reeler phenotype, including ataxia and the migration of Purkinje cells. Magdaleno et al. (2002) hypothesized that Reln functions in concert with other positional cues to promote cell-cell interactions that are required for layer formation during development.

It is appreciated that the abovementioned animal model for RELN is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hong, S. E.; Shugart, Y. Y.; Huang, D. T.; Al Shahwan, S.; Grant, P. E.; Hourihane, J. O.; Martin, N. D. T.; Walsh, C. A.: Autosomal recessive lissencephaly with cerebellar hypoplasia is associated with human RELN mutations. Nature Genet. 26:93-96, 2000. Note: Erratum: Nature Genet. 27:225 only, 2001; and Magdaleno, S.; Keshvara, L.; Curran, T.: Rescue of ataxia and preplate splitting by ectopic expression of reelin in reeler mice. Neuron 33:573-586, 2002.

Further studies establishing the function and utilities of RELN are found in John Hopkins OMIM database record ID 600514, and in sited publications numbered 7209-7214, 10019-722 and 10024 listed in the bibliography section hereinbelow, which are also hereby incorporated by reference. Solute Carrier Family 10 (sodium/bile acid cotransporter family), Member 2 (SLC10A2, Accession NM_000452) is another VGAM35 host target gene. SLC10A2 BINDING SITE is HOST TARGET binding site found in the 3' untranslated region of mRNA encoded by SLC10A2, corresponding to a HOST TARGET binding site such as BINDING SITE I, BINDING SITE II or BINDING SITE III. Table 2 illustrates the complementarity of the nucleotide sequences of SLC10A2 BINDING SITE, designated SEQ ID:6067, to the nucleotide sequence of VGAM35 RNA, herein designated VGAM RNA, also designated SEQ ID:2746.

Another function of VGAM35 is therefore inhibition of Solute Carrier Family 10 (sodium/bile acid cotransporter family), Member 2 (SLC10A2, Accession NM_000452). Accordingly, utilities of VGAM35 include diagnosis, prevention and treatment of diseases and clinical conditions associated with SLC10A2. Coactosin-like 1 (Dictyostelium) (COTL1, Accession XM_113840) is another VGAM35 host target gene. COTL1 BINDING SITE is HOST TARGET binding site found in the 3' untranslated region of mRNA encoded by COTL1, corresponding to a HOST TARGET binding site such as BINDING SITE I, BINDING SITE II or BINDING SITE III. Table 2 illustrates the complementarity of the nucleotide sequences of COTL1 BINDING SITE, designated SEQ ID:42469, to the nucleotide sequence of VGAM35 RNA, herein designated VGAM RNA, also designated SEQ ID:2746.

Another function of VGAM35 is therefore inhibition of Coactosin-like 1 (Dictyostelium) (COTL1, Accession XM_113840). Accordingly, utilities of VGAM35 include diagnosis, prevention and treatment of diseases and clinical conditions associated with COTL1. KIAA0326 (Accession XM_034819) is another VGAM35 host target gene. KIAA0326 BINDING SITE is HOST TARGET binding site found in the 3' untranslated region of mRNA encoded by KIAA0326, corresponding to a HOST TARGET binding site such as BINDING SITE I, BINDING SITE II or BINDING SITE III. Table 2 illustrates the complementarity of the nucleotide sequences of KIAA0326 BINDING SITE, designated SEQ ID:32156, to the nucleotide sequence of VGAM35 RNA, herein designated VGAM RNA, also designated SEQ ID:2746.

Another function of VGAM35 is therefore inhibition of KIAA0326 (Accession XM_034819). Accordingly, utilities of VGAM35 include diagnosis, prevention and treatment of diseases and clinical conditions associated with KIAA0326. LOC255328 (Accession XM_172920) is another VGAM35 host target gene. LOC255328 BINDING SITE is HOST TARGET binding site found in the 3' untranslated region of mRNA encoded by LOC255328, corresponding to a HOST TARGET binding site such as BINDING SITE I, BINDING SITE II or BINDING SITE III. Table 2 illustrates the complementarity of the nucleotide sequences of LOC255328 BINDING SITE, designated SEQ ID:46182, to the nucleotide sequence of VGAM35 RNA, herein designated VGAM RNA, also designated SEQ ID:2746.

Another function of VGAM35 is therefore inhibition of LOC255328 (Accession XM_172920). Accordingly, utilities of VGAM35 include diagnosis, prevention and treatment of diseases and clinical conditions associated with LOC255328. FIG. 1 further provides a conceptual description of a novel bioinformatically detected viral gene of the present invention, referred to here as Viral Genomic Address Messenger 36 (VGAM36) viral gene, which modulates expression of respective host target genes thereof, the function and utility of which host target genes is known in the art.

VGAM36 is a novel bioinformatically detected regulatory, non protein coding, viral micro RNA (miRNA) gene. The method by which VGAM36 was detected is described hereinabove with reference to FIGS. 1-8.

VGAM36 gene, herein designated VGAM GENE, is a viral gene contained in the genome of Invertebrate Iridescent Virus 6. VGAM36 host target gene, herein designated VGAM HOST TARGET GENE, is a human gene contained in the human genome.

VGAM36 gene encodes a VGAM36 precursor RNA, herein designated VGAM PRECURSOR RNA. Similar to other miRNA genes, and unlike most ordinary genes, VGAM36 precursor RNA does not encode a protein. A nucleotide sequence identical or highly similar to the nucleotide sequence of VGAM36 precursor RNA is designated SEQ ID:22, and is provided hereinbelow with reference to the sequence listing part. Nucleotide sequence SEQ ID:22 is located at position 14270 relative to the genome of Invertebrate Iridescent Virus 6.

VGAM36 precursor RNA folds onto itself, forming VGAM36 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM36 folded precursor RNA into VGAM36 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 92%) nucleotide sequence of VGAM36 RNA is designated SEQ ID:2747, and is provided hereinbelow with reference to the sequence listing part.

VGAM36 host target gene, herein designated VGAM HOST TARGET GENE, encodes a corresponding messenger RNA, VGAM36 host target RNA, herein designated VGAM HOST TARGET RNA. VGAM36 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM36 RNA, herein designated VGAM RNA, binds complementarily to one or more host target binding sites located in untranslated regions of VGAM36 host target RNA, herein designated VGAM HOST TARGET RNA. This complementary binding is due to the fact that the nucleotide sequence of VGAM36 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM36 RNA, herein designated VGAM RNA, may have a different number of host target binding sites in untranslated regions of a VGAM36 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM36 RNA, herein designated VGAM RNA, to host target binding sites on VGAM36 host target RNA, herein designated VGAM HOST TARGET RNA, such as BINDING SITE I, BINDING SITE II and BINDING SITE III, inhibits translation of VGAM36 host target RNA into VGAM36 host target protein, herein designated VGAM HOST TARGET PROTEIN. VGAM host target protein is therefore outlined by a broken line.

It is appreciated that VGAM36 host target gene, herein designated VGAM HOST TARGET GENE, in fact represents a plurality of VGAM36 host target genes. The mRNA of each one of this plurality of VGAM36 host target genes comprises one or more host target binding sites, each having a nucleotide sequence which is at least partly complementary to VGAM36 RNA, herein designated VGAM RNA, and which when bound by VGAM36 RNA causes inhibition of translation of respective one or more VGAM36 host target proteins.

It is further appreciated by one skilled in the art that the mode of translational inhibition illustrated by FIG. 1 with specific reference to translational inhibition exerted by VGAM36 gene, herein designated VGAM GENE, on one or more VGAM36 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM36 is inhibition of expression of host target genes, as part of a novel viral mechanism of attacking a host. Accordingly, utilities of VGAM36 include diagnosis, prevention and treatment of viral infection by Invertebrate Iridescent Virus 6. Specific functions, and accordingly utilities, of VGAM36 correlate with, and may be deduced from, the identity of the host target genes which VGAM36 binds and inhibits, and the function of these host target genes, as elaborated hereinbelow.

Nucleotide sequences of the VGAM36 precursor RNA, herein designated VGAM PRECURSOR RNA, and of the 'diced' VGAM36 RNA, herein designated VGAM RNA, and a schematic representation of the secondary folding of VGAM36 folded precursor RNA, herein designated VGAM FOLDED PRECURSOR RNA, of VGAM36 are further described hereinbelow with reference to Table 1.

Nucleotide sequences of host target binding sites, such as BINDING SITE-I, BINDING SITE-II and BINDING SITE-III of FIG. 1, found on VGAM36 host target RNA, and schematic representation of the complementarity of each of these host target binding sites to VGAM36 RNA, herein designated VGAM RNA, are described hereinbelow with reference to Table 2.

As mentioned hereinabove with reference to FIG. 1, a function of VGAM36 gene, herein designated VGAM is inhibition of expression of VGAM36 target genes. It is appreciated that specific functions, and accordingly utilities, of VGAM36 correlate with, and may be deduced from, the identity of the target genes which VGAM36 binds and inhibits, and the function of these target genes, as elaborated hereinbelow.

Solute Carrier Family 6 (neurotransmitter transporter, taurine), Member 6 (SLC6A6, Accession NM_003043) is a VGAM36 host target gene. SLC6A6 BINDING SITE is HOST TARGET binding site found in the 3' untranslated region of mRNA encoded by SLC6A6, corresponding to a HOST TARGET binding site such as BINDING SITE I, BINDING SITE II or BINDING SITE III. Table 2 illustrates the complementarity of the nucleotide sequences of SLC6A6 BINDING SITE, designated SEQ ID:9004, to the nucleotide sequence of VGAM36 RNA, herein designated VGAM RNA, also designated SEQ ID:2747.

A function of VGAM36 is therefore inhibition of Solute Carrier Family 6 (neurotransmitter transporter, taurine), Member 6 (SLC6A6, Accession NM_003043), a gene which transports taurine and other beta-amino acids like beta-alanine. Accordingly, utilities of VGAM36 include diagnosis, prevention and treatment of diseases and clinical conditions associated with SLC6A6. The function of SLC6A6 has been established by previous studies. Taurine (2-aminoethanesulfonic acid) is a major intracellular amino acid in mammals. It is involved in a number of important physiologic processes, including bile acid conjugation in hepatocytes, modulation of calcium flux and neural excitability, osmoregulation, detoxification, and membrane stabilization. The cells of most organisms respond to hypertonicity by the intracellular accumulation of high concentrations of small organic solutes (osmolytes) that, in contrast to high concentrations of electrolytes, do not perturb the function of macromolecules. The renal medulla is normally the only tissue in mammals that undergoes wide shifts in tonicity. Its hypertonicity when the kidney is excreting a concentrated urine is fundamental to water conservation. The taurine content of the renal medulla of rats infused with 5% NaCl is higher than that in controls, suggesting that taurine behaves as an osmolyte in the renal medulla. Indeed, taurine functions as an osmolyte in Madin-Darby canine kidney (MDCK) cells. When MDCK cells cultured in isotonic medium are switched to hypertonic medium, their content of taurine doubles through the taking up of taurine from the medium. Taurine transport in these cells is dependent on sodium and chloride ions and is localized primarily in the basolateral plasma membrane. Uchida et al. (1992) cloned the cDNA for the taurine transporter in MDCK cells. The sequence of the cDNA indicated that the taurine transporter has considerable amino acid sequence similarity to previously cloned Na (+)- and Cl (-)-dependent transporters. Northern hybridization indicated that the quantity of mRNA for the taurine transporter in MDCK cells is regulated by hypertonicity. Furthermore, the Northern hybridizations indicated that the taurine transporter is present also in ileal mucosa, brain, liver, and heart.

Full details of the abovementioned studies are described in the following publications, the disclosure of which are hereby incorporated by reference:

Ramamoorthy, S.; Leibach, F. H.; Mahesh, V. B.; Han, H.; Yang-Feng, T.; Blakely, R. D.; Ganapathy, V.: Functional characterization and chromosomal localization of a cloned taurine transporter from human placenta. Biochem. J. 300: 893-900, 1994; and Uchida, S.; Kwon, H. M.; Yamauchi, A.; Preston, A. S.; Marumo, F.; Handler, J. S.: Molecular cloning of the cDNA for an MDCK cell Na (+)- and Cl (-)-dependent taurine transporter that is r.

Further studies establishing the function and utilities of SLC6A6 are found in John Hopkins OMIM database record ID 186854, and in sited publications numbered 5710-571 and 5776 listed in the bibliography section hereinbelow, which are also hereby incorporated by reference. SMURF1 (Accession XM_166483) is another VGAM36 host target gene. SMURF1 BINDING SITE is HOST TARGET binding site found in the 3' untranslated region of mRNA encoded by SMURF1, corresponding to a HOST TARGET binding site such as BINDING SITE I, BINDING SITE II or BINDING SITE III. Table 2 illustrates the complementarity of the nucleotide sequences of SMURF1 BINDING SITE, designated SEQ ID:44410, to the nucleotide sequence of VGAM36 RNA, herein designated VGAM RNA, also designated SEQ ID:2747.

Another function of VGAM36 is therefore inhibition of SMURF1 (Accession XM_166483). Accordingly, utilities of VGAM36 include diagnosis, prevention and treatment of diseases and clinical conditions associated with SMURF1. TEM7 (Accession NM_020405) is another VGAM36 host target gene. TEM7 BINDING SITE is HOST TARGET binding site found in the 3' untranslated region of mRNA encoded by TEM7, corresponding to a HOST TARGET binding site such as BINDING SITE I, BINDING SITE II or BINDING SITE III. Table 2 illustrates the complementarity of the nucleotide sequences of TEM7 BINDING SITE, designated SEQ ID:21668, to the nucleotide sequence of VGAM36 RNA, herein designated VGAM RNA, also designated SEQ ID:2747.

Another function of VGAM36 is therefore inhibition of TEM7 (Accession NM_020405), a gene which involves in angiogenesis. Accordingly, utilities of VGAM36 include diagnosis, prevention and treatment of diseases and clinical conditions associated with TEM7. The function of TEM7 and its association with various diseases and clinical conditions, has been established by previous studies, as described hereinabove with reference to VGAM23. Zinc Finger Protein 10 (KOX 1) (ZNF10, Accession NM_015394) is another VGAM36 host target gene. ZNF10 BINDING SITE is HOST TARGET binding site found in the 3' untranslated region of mRNA encoded by ZNF10, corresponding to a HOST TARGET binding site such as BINDING SITE I, BINDING SITE II or BINDING SITE III. Table 2 illustrates the complementarity of the nucleotide sequences of ZNF10 BINDING SITE, designated SEQ ID:17693, to the nucleotide sequence of VGAM36 RNA, herein designated VGAM RNA, also designated SEQ ID:2747.

Another function of VGAM36 is therefore inhibition of Zinc Finger Protein 10 (KOX 1) (ZNF10, Accession NM_015394), a gene which may function as a transcriptional regulator. Accordingly, utilities of VGAM36 include diagnosis, prevention and treatment of diseases and clinical conditions associated with ZNF10. The function of ZNF10 has been established by previous studies. In the course of mapping 27 nonoverlapping zinc finger cDNAs from human T cells by analysis of somatic cell hybrids, Huebner et al. (1991) mapped zinc finger protein-10 (KOX1) to 12q13-qter, probably clustered with zinc finger protein-26 (OMIM Ref. No. 194537). Rousseau-Merck et al. (1993) also mapped the KOX1 (ZNF10) gene to 12q24.33 and demonstrated that it and KOX20 (ZNF26) are located within a pulsed field gel electrophoresis fragment less than 300 kb long. The mapping was done by a combination of somatic cell hybridization and in situ hybridization. Since ZNF26 has been mapped to 12q24.33 by in situ hybridization, this also must be the localization of ZNF10.

Full details of the abovementioned studies are described in the following publications, the disclosure of which are hereby incorporated by reference:

Huebner, K.; Druck, T.; Croce, C. M.; Thiesen, H. J.: Twenty-seven nonoverlapping zinc finger cDNAs from human T cells map to nine different chromosomes with apparent clustering. Am. J. Hum. Genet. 48:726-740, 1991; and Rousseau-Merck, M.-F.; Hillion, J.; Jonveaux, P.; Couillin, P.; Seite, P.; Thiesen, H.-J.; Berger, R.: Chromosomal localization of 9 KOX zinc finger genes: physical linkages suggest cluste.

Further studies establishing the function and utilities of ZNF10 are found in John Hopkins OMIM database record ID 194538, and in sited publications numbered 10025-10026 listed in the bibliography section hereinbelow, which are also hereby incorporated by reference. DKFZp547H025 (Accession NM_020161) is another VGAM36 host target gene. DKFZp547H025 BINDING SITE is HOST TARGET binding site found in the 3' untranslated region of mRNA encoded by DKFZp547H025, corresponding to a HOST TARGET binding site such as BINDING SITE I, BINDING SITE II or BINDING SITE III. Table 2 illustrates the complementarity of the nucleotide sequences of DKFZp547H025 BINDING SITE, designated SEQ ID:21371, to the nucleotide sequence of VGAM36 RNA, herein designated VGAM RNA, also designated SEQ ID:2747.

Another function of VGAM36 is therefore inhibition of DKFZp547H025 (Accession NM_020161). Accordingly, utilities of VGAM36 include diagnosis, prevention and treatment of diseases and clinical conditions associated with DKFZp547H025. FLJ12704 (Accession NM_024998) is another VGAM36 host target gene. FLJ12704 BINDING SITE is HOST TARGET binding site found in the 3' untranslated region of mRNA encoded by FLJ12704, corresponding to a HOST TARGET binding site such as BINDING SITE I, BINDING SITE II or BINDING SITE III. Table 2 illustrates the complementarity of the nucleotide sequences of FLJ12704 BINDING SITE, designated SEQ ID:24561, to the nucleotide sequence of VGAM36 RNA, herein designated VGAM RNA, also designated SEQ ID:2747.

Another function of VGAM36 is therefore inhibition of FLJ12704 (Accession NM_024998). Accordingly, utilities of VGAM36 include diagnosis, prevention and treatment of diseases and clinical conditions associated with FLJ12704. KDEL (Lys-Asp-Glu-Leu) Endoplasmic Reticulum Protein Retention Receptor 3 (KDELR3, Accession NM_006855) is another VGAM36 host target gene. KDELR3 BINDING SITE is HOST TARGET binding site found in the 3' untranslated region of mRNA encoded by KDELR3, corresponding to a HOST TARGET binding site such as BINDING SITE I, BINDING SITE II or BINDING SITE III. Table 2 illustrates the complementarity of the nucleotide sequences of KDELR3 BINDING SITE, designated SEQ ID:13723, to the nucleotide sequence of VGAM36 RNA, herein designated VGAM RNA, also designated SEQ ID:2747.

Another function of VGAM36 is therefore inhibition of KDEL (Lys-Asp-Glu-Leu) Endoplasmic Reticulum Protein Retention Receptor 3 (KDELR3, Accession NM_006855). Accordingly, utilities of VGAM36 include diagnosis, prevention and treatment of diseases and clinical conditions associated with KDELR3. KIAA1817 (Accession XM_042978) is another VGAM36 host target gene. KIAA1817 BINDING SITE is HOST TARGET binding site found in the 3' untranslated region of mRNA encoded by KIAA1817, corresponding to a HOST TARGET binding site such as BINDING SITE I, BINDING SITE II or BINDING SITE III. Table 2 illustrates the complementarity of the nucleotide sequences of KIAA1817 BINDING SITE, designated SEQ ID:33859, to the nucleotide sequence of VGAM36 RNA, herein designated VGAM RNA, also designated SEQ ID:2747.

Another function of VGAM36 is therefore inhibition of KIAA1817 (Accession XM_042978). Accordingly, utilities of VGAM36 include diagnosis, prevention and treatment of diseases and clinical conditions associated with KIAA1817. LOC153727 (Accession XM_098422) is another VGAM36 host target gene. LOC153727 BINDING SITE is HOST TARGET binding site found in the 5' untranslated region of mRNA encoded by LOC153727, corresponding to a HOST TARGET binding site such as BINDING SITE I, BINDING SITE II or BINDING SITE III. Table 2 illustrates the complementarity of the nucleotide sequences of LOC153727 BINDING SITE, designated SEQ ID:41679, to the nucleotide sequence of VGAM36 RNA, herein designated VGAM RNA, also designated SEQ ID:2747.

Another function of VGAM36 is therefore inhibition of LOC153727 (Accession XM_098422). Accordingly, utilities of VGAM36 include diagnosis, prevention and treatment of diseases and clinical conditions associated with LOC153727. LOC158382 (Accession XM_098931) is another VGAM36 host target gene. LOC158382 BINDING SITE is HOST TARGET binding site found in the 5' untranslated region of mRNA encoded by LOC158382, corresponding to a HOST TARGET binding site such as BINDING SITE I, BINDING SITE II or BINDING SITE III. Table 2 illustrates the complementarity of the nucleotide sequences of LOC158382 BINDING SITE, designated SEQ ID:41962, to the nucleotide sequence of VGAM36 RNA, herein designated VGAM RNA, also designated SEQ ID:2747.

Another function of VGAM36 is therefore inhibition of LOC158382 (Accession XM_098931). Accordingly, utilities of VGAM36 include diagnosis, prevention and treatment of diseases and clinical conditions associated with LOC158382. LOC196264 (Accession XM_113683) is another VGAM36 host target gene. LOC196264 BINDING SITE is HOST TARGET binding site found in the 3' untranslated region of mRNA encoded by LOC196264, corresponding to a HOST TARGET binding site such as BINDING SITE I, BINDING SITE II or BINDING SITE III. Table 2 illustrates the complementarity of the nucleotide sequences of LOC196264 BINDING SITE, designated SEQ ID:42336, to the nucleotide sequence of VGAM36 RNA, herein designated VGAM RNA, also designated SEQ ID:2747.

Another function of VGAM36 is therefore inhibition of LOC196264 (Accession XM_113683). Accordingly, utilities of VGAM36 include diagnosis, prevention and treatment of diseases and clinical conditions associated with LOC196264. FIG. 1 further provides a conceptual description of a novel bioinformatically detected viral gene of the present invention, referred to here as Viral Genomic Address Messenger 37 (VGAM37) viral gene, which modulates expression of respective host target genes thereof, the function and utility of which host target genes is known in the art.

VGAM37 is a novel bioinformatically detected regulatory, non protein coding, viral micro RNA (miRNA) gene. The method by which VGAM37 was detected is described hereinabove with reference to FIGS. 1-8.

VGAM37 gene, herein designated VGAM GENE, is a viral gene contained in the genome of Invertebrate Iridescent Virus 6. VGAM37 host target gene, herein designated VGAM HOST TARGET GENE, is a human gene contained in the human genome.

VGAM37 gene encodes a VGAM37 precursor RNA, herein designated VGAM PRECURSOR RNA. Similar to other miRNA genes, and unlike most ordinary genes, VGAM37 precursor RNA does not encode a protein. A nucleotide sequence identical or highly similar to the nucleotide sequence of VGAM37 precursor RNA is designated SEQ ID:23, and is provided hereinbelow with reference to the sequence listing part. Nucleotide sequence SEQ ID:23 is located at position 141488 relative to the genome of Invertebrate Iridescent Virus 6.

VGAM37 precursor RNA folds onto itself, forming VGAM37 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM37 folded precursor RNA into VGAM37 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM37 RNA is designated SEQ ID:2748, and is provided hereinbelow with reference to the sequence listing part.

VGAM37 host target gene, herein designated VGAM HOST TARGET GENE, encodes a corresponding messenger RNA, VGAM37 host target RNA, herein designated VGAM HOST TARGET RNA. VGAM37 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM37 RNA, herein designated VGAM RNA, binds complementarily to one or more host target binding sites located in untranslated regions of VGAM37 host target RNA, herein designated VGAM HOST TARGET RNA. This complementary binding is due to the fact that the nucleotide sequence of VGAM37 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM37 RNA, herein designated VGAM RNA, may have a different number of host target binding sites in untranslated regions of a VGAM37 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM37 RNA, herein designated VGAM RNA, to host target binding sites on VGAM37 host target RNA, herein designated VGAM HOST TARGET RNA, such as BINDING SITE I, BINDING SITE II and BINDING SITE III, inhibits translation of VGAM37 host target RNA into VGAM37 host target protein, herein designated VGAM HOST TARGET PROTEIN. VGAM host target protein is therefore outlined by a broken line.

It is appreciated that VGAM37 host target gene, herein designated VGAM HOST TARGET GENE, in fact represents a plurality of VGAM37 host target genes. The mRNA of each one of this plurality of VGAM37 host target genes comprises one or more host target binding sites, each having a nucleotide sequence which is at least partly complementary to VGAM37 RNA, herein designated VGAM RNA, and which when bound by VGAM37 RNA causes inhibition of translation of respective one or more VGAM37 host target proteins.

It is further appreciated by one skilled in the art that the mode of translational inhibition illustrated by FIG. 1 with specific reference to translational inhibition exerted by VGAM37 gene, herein designated VGAM GENE, on one or more VGAM37 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM37 is inhibition of expression of host target genes, as part of a novel viral mechanism of attacking a host. Accordingly, utilities of VGAM37 include diagnosis, prevention and treatment of viral infection by Invertebrate Iridescent Virus 6. Specific functions, and accordingly utilities, of VGAM37 correlate with, and may be deduced from, the identity of the host target genes which VGAM37 binds and inhibits, and the function of these host target genes, as elaborated hereinbelow.

Nucleotide sequences of the VGAM37 precursor RNA, herein designated VGAM PRECURSOR RNA, and of the 'diced' VGAM37 RNA, herein designated VGAM RNA, and a schematic representation of the secondary folding of VGAM37 folded precursor RNA, herein designated VGAM FOLDED PRECURSOR RNA, of VGAM37 are further described hereinbelow with reference to Table 1.

Nucleotide sequences of host target binding sites, such as BINDING SITE-I, BINDING SITE-II and BINDING SITE-III of FIG. 1, found on VGAM37 host target RNA, and schematic representation of the complementarity of each of these host target binding sites to VGAM37 RNA, herein designated VGAM RNA, are described hereinbelow with reference to Table 2.

As mentioned hereinabove with reference to FIG. 1, a function of VGAM37 gene, herein designated VGAM is inhibition of expression of VGAM37 target genes. It is appreciated that specific functions, and accordingly utilities, of VGAM37 correlate with, and may be deduced from, the identity of the target genes which VGAM37 binds and inhibits, and the function of these target genes, as elaborated hereinbelow.

Eukaryotic Translation Initiation Factor 5A2 (EIF5A2, Accession NM_020390) is a VGAM37 host target gene. EIF5A2 BINDING SITE is HOST TARGET binding site found in the 3' untranslated region of mRNA encoded by EIF5A2, corresponding to a HOST TARGET binding site such as BINDING SITE I, BINDING SITE II or BINDING SITE III. Table 2 illustrates the complementarity of the nucleotide sequences of EIF5A2 BINDING SITE, designated SEQ ID:21661, to the nucleotide sequence of VGAM37 RNA, herein designated VGAM RNA, also designated SEQ ID:2748.

A function of VGAM37 is therefore inhibition of Eukaryotic Translation Initiation Factor 5A2 (EIF5A2, Accession NM_020390). Accordingly, utilities of VGAM37 include diagnosis, prevention and treatment of diseases and clinical conditions associated with EIF5A2. Fasciculation and Elongation Protein Zeta 1 (zygin I) (FEZ1, Accession NM_022549) is another VGAM37 host target gene. FEZ1 BINDING SITE is HOST TARGET binding site found in the 3' untranslated region of mRNA encoded by FEZ1, corresponding to a HOST TARGET binding site such as BINDING SITE I, BINDING SITE II or BINDING SITE III. Table 2 illustrates the complementarity of the nucleotide sequences of FEZ1 BINDING SITE, designated SEQ ID:22875, to the nucleotide sequence of VGAM37 RNA, herein designated VGAM RNA, also designated SEQ ID:2748.

Another function of VGAM37 is therefore inhibition of Fasciculation and Elongation Protein Zeta 1 (zygin I) (FEZ1, Accession NM_022549), a gene which Zygin 1; may have a role in axonal outgrowth; has similarity to C. elegans UNC-76. Accordingly, utilities of VGAM37 include diagnosis, prevention and treatment of diseases and clinical conditions associated with FEZ1. The function of FEZ1 has been established by previous studies. Ishii et al. (1999) positionally cloned and characterized the FEZ1/LZTS1 (leucine zipper, putative tumor suppressor-1) gene at 8p22, a region that is lost in many tumors, including prostate, breast, head and neck, esophageal, and urinary bladder carcinomas. The predicted FEZ1 protein contained a leucine-zipper region with similarity to the DNA-binding domain of the cAMP-responsive activating transcription factor-5 (OMIM Ref. No. 606398). Northern blot analysis revealed that FEZ2 is expressed almost ubiquitously in normal tissues, although expression is most abundant in testes. FEZ1 expression was undetectable in more than 60% of epithelial tumors, but FEZ1 mutations were found in primary esophageal cancers and in a prostate cancer cell line. Transcript analysis from several FEZ1-expressing tumors revealed truncated mRNAs, including a frameshift. Alteration and inactivation of the FEZ1 gene may play a role in various human tumors. Ishii et al. (2001) showed that introduction of FEZ1/LZTS1 into FEZ1/LZTS1-negative cancer cells resulted in suppression of tumorigenicity and reduced cell growth with accumulation of cells at late S-G2/M stage of the cell cycle. Their data showed that FEZ1/LZTS1 inhibits cancer cell growth through regulation of mitosis, and that its alterations result in abnormal cell growth. Ishii et al. (1999) analyzed the nucleotide sequence of the FEZ1 gene open reading frame in 194 cancers, including 72 primary esophageal cancers. They found a point mutation in 2 primary esophageal cancers and in a prostate cancer cell line.

Full details of the abovementioned studies are described in the following publications, the disclosure of which are hereby incorporated by reference:

Ishii, H.; Baffa, R.; Numata, S.-I.; Murakumo, Y.; Rattan, S.; Inoue, H.; Mori, M.; Fidanza, V.; Alder, H.; Croce, C. M.: The FEZ1 gene at chromosome 8p22 encodes a leucine-zipper protein, and its expression is altered in multiple human tumors. Proc. Nat. Acad. Sci. 96:3928-3933, 1999; and Ishii, H.; Vecchione, A.; Murakumo, Y.; Baldassarre, G.; Numata, S.; Trapasso, F.; Alder, H.; Baffa, R.; Croce, C. M.: FEZ1/LZTS1 gene at 8p22 suppresses cancer cell growth and regula.

Further studies establishing the function and utilities of FEZ1 are found in John Hopkins OMIM database record ID 606551, and in sited publications numbered 4650 listed in the bibliography section hereinbelow, which are also hereby incorporated by reference. Interleukin 18 Receptor 1 (IL18R1, Accession NM_003855) is another VGAM37 host target gene. IL18R1 BINDING SITE is HOST TARGET binding site found in the 3' untranslated region of mRNA encoded by IL18R1, corresponding to a HOST TARGET binding site such as BINDING SITE I, BINDING SITE II or BINDING SITE III. Table 2 illustrates the complementarity of the nucleotide sequences of IL18R1 BINDING SITE, designated SEQ ID:9951, to the nucleotide sequence of VGAM37 RNA, herein designated VGAM RNA, also designated SEQ ID:2748.

Another function of VGAM37 is therefore inhibition of Interleukin 18 Receptor 1 (IL18R1, Accession NM_003855), a gene which is required for dorsal-ventral embryonic polarity and promotes heterophilic cellular adhesion. Accordingly, utilities of VGAM37 include diagnosis, prevention and treatment of diseases and clinical conditions associated with IL18R1. The function of IL18R1 has been established by previous studies. Using a YAC template known to contain IL1R1 (OMIM Ref. No. 147810), Parnet et al. (1996) cloned by PCR with degenerate primers what was thought to be a member of the interleukin-1 receptor family, which they called IL1 receptor-related protein (OMIM Ref. No. IL1RRP). The gene encodes a 541-amino acid protein. Although the sequence was similar to that of IL1Rs, the extracellular portion failed to bind IL1A (OMIM Ref. No. 147760), IL1B (OMIM Ref. No. 147720), or IL1RN (OMIM Ref. No. 147679). When the cytoplasmic domain was fused to mouse IL1 extracellular and transmembrane portions, it activated NF-kappa-B (OMIM Ref. No. 164011) in response to IL1. Northern blot analysis revealed that IL1RRP is expressed in lung, leukocytes, spleen, liver, thymus, prostate, small intestine, colon, placenta, and heart, and is absent from brain, skeletal muscle, pancreas, and kidney. Torigoe et al. (1997) purified human IL18R, symbolized IL18R1, by selecting a Hodgkin disease cell line, L428, that was the best binder in IL18 (OMIM Ref. No. 600953) binding assays. The binding of radiolabeled IL18 was inhibited by IL18 but not by IL1B, with which it has 15% amino acid homology but no functional resemblance. The authors raised a monoclonal antibody against L428 cells and used it to purify IL18R from solubilized cells after wheat germ lectin chromatography. They found that the internal amino acid sequence matched that of IL1RRP. When expressed in COS-1 cells, the cDNA of IL1RRP conferred IL18 binding properties and the ability to activate NF-kappa-B in response to IL18 but not IL1B.

Full details of the abovementioned studies are described in the following publications, the disclosure of which are hereby incorporated by reference:

Dale, M.; Nicklin, M. J.: Interleukin-1 receptor cluster: gene organization of IL1R2, IL1R1, IL1RL2 (IL-1Rrp2), IL1RL1 (T1/ST2), and IL18R1 (IL-1Rrp) on human chromosome 2q. Genomics 57:177-179, 1999; and Parnet, P.; Garka, K. E.; Bonnert, T. P.; Dower, S. K.; Sims, J. E.: IL-1Rrp is a novel receptor-like molecule similar to the type I interleukin-1 receptor and its homologues T1/ST2 an.

Further studies establishing the function and utilities of IL18R1 are found in John Hopkins OMIM database record ID 604494, and in sited publications numbered 304 and 5305-5306 listed in the bibliography section hereinbelow, which are also hereby incorporated by reference. Roundabout, Axon Guidance Receptor, Homolog 1 (Drosophila) (ROBO1, Accession NM_133631) is another VGAM37 host target gene. ROBO1 BINDING SITE1 and ROBO1 BINDING SITE2 are HOST TARGET binding sites found in untranslated regions of mRNA encoded by ROBO1, corresponding to HOST TARGET binding sites such as BINDING SITE I, BINDING SITE II or BINDING SITE III. Table 2 illustrates the complementarity of the nucleotide sequences of ROBO1 BINDING SITE1 and ROBO1 BINDING SITE2, designated SEQ ID:28589 and SEQ ID:8852 respectively, to the nucleotide sequence of VGAM37 RNA, herein designated VGAM RNA, also designated SEQ ID:2748.

Another function of VGAM37 is therefore inhibition of Roundabout, Axon Guidance Receptor, Homolog 1 (Drosophila) (ROBO1, Accession NM_133631), a gene which is an axon guidance receptor. Accordingly, utilities of VGAM37 include diagnosis, prevention and treatment of diseases and clinical conditions associated with ROBO1. The function of ROBO1 has been established by previous studies. Using in situ hybridization analysis, Bagri et al. (2002) detected expression of Robo1 and Robo2 in the developing cortex and thalamus of mouse embryos. They detected a complementary pattern of expression of Robo and Slit genes (see OMIM Ref. No. Slit1; 603742) in the developing mouse forebrain and concluded that these molecules may play a role in the guidance of corticofugal and thalamocortical projections Zallen et al. (1998) cloned a C. elegans gene, termed sax3, that is homologous to ROBO1. Mutations in sax3 lead to repeated midline crossing by ventral cord axons that normally do not cross the midline after they join the ventral cord, a phenotype similar to that of Drosophila robo mutants. Sax3 is also required for the guidance of some axons to the ventral cord, implicating this gene in 2 different types of guidance events. A sax3/GFP fusion gene is expressed in developing neurons during axon outgrowth, and sax-3 function is required at the time of axon guidance. Zallen et al. (1998) concluded that in C. elegans this gene mediates cell interactions during guidance decisions.

Full details of the abovementioned studies are described in the following publications, the disclosure of which are hereby incorporated by reference:

Bagri, A.; Marin, O.; Plump, A. S.; Mak, J.; Pleasure, S. J.; Rubenstein, J. L. R.; Tessier-Lavigne, M.: Slit proteins prevent midline crossing and determine the dorsoventral position of major axonal pathways in the mammalian forebrain. Neuron 33:233-248, 2002; and Zallen, J. A.; Yi, B. A.; Bargmann, C. I.: The conserved immunoglobulin superfamily member SAX-3/Robo directs multiple aspects of axon guidance in C. elegans. Cell 92:217-227, 1998.

Further studies establishing the function and utilities of ROBO1 are found in John Hopkins OMIM database record ID 602430, and in sited publications numbered 8916-891 and 9113-8920 listed in the bibliography section hereinbelow, which are also hereby incorporated by reference. KIAA0923 (Accession NM_014021) is another VGAM37 host target gene. KIAA0923 BINDING SITE is HOST TARGET binding site found in the 3' untranslated region of mRNA encoded by KIAA0923, corresponding to a HOST TARGET binding site such as BINDING SITE I, BINDING SITE II or BINDING SITE III. Table 2 illustrates the complementarity of the nucleotide sequences of KIAA0923 BINDING SITE, designated SEQ ID:15246, to the nucleotide sequence of VGAM37 RNA, herein designated VGAM RNA, also designated SEQ ID:2748.

Another function of VGAM37 is therefore inhibition of KIAA0923 (Accession NM_014021). Accordingly, utilities of VGAM37 include diagnosis, prevention and treatment of diseases and clinical conditions associated with KIAA0923. KIAA1432 (Accession XM_039698) is another VGAM37 host target gene. KIAA1432 BINDING SITE is HOST TARGET binding site found in the 3' untranslated region of mRNA encoded by KIAA1432, corresponding to a HOST TARGET binding site such as BINDING SITE I, BINDING SITE II or BINDING SITE III. Table 2 illustrates the complementarity of the nucleotide sequences of KIAA1432 BINDING SITE, designated SEQ ID:33155, to the nucleotide sequence of VGAM37 RNA, herein designated VGAM RNA, also designated SEQ ID:2748.

Another function of VGAM37 is therefore inhibition of KIAA1432 (Accession XM_039698). Accordingly, utilities of VGAM37 include diagnosis, prevention and treatment of diseases and clinical conditions associated with KIAA1432. LOC152559 (Accession XM_087487) is another VGAM37 host target gene. LOC152559 BINDING SITE is HOST TARGET binding site found in the 3' untranslated region of mRNA encoded by LOC152559, corresponding to a HOST TARGET binding site such as BINDING SITE I, BINDING SITE II or BINDING SITE III. Table 2 illustrates the complementarity of the nucleotide sequences of LOC152559 BINDING SITE, designated SEQ ID:39285, to the nucleotide sequence of VGAM37 RNA, herein designated VGAM RNA, also designated SEQ ID:2748.

Another function of VGAM37 is therefore inhibition of LOC152559 (Accession XM_087487). Accordingly, utilities of VGAM37 include diagnosis, prevention and treatment of diseases and clinical conditions associated with LOC152559. LOC197131 (Accession XM_113823) is another VGAM37 host target gene. LOC197131 BINDING SITE is HOST TARGET binding site found in the 3' untranslated region of mRNA encoded by LOC197131, corresponding to a HOST TARGET binding site such as BINDING SITE I, BINDING SITE II or BINDING SITE III. Table 2 illustrates the complementarity of the nucleotide sequences of LOC197131 BINDING SITE, designated SEQ ID:42445, to the nucleotide sequence of VGAM37 RNA, herein designated VGAM RNA, also designated SEQ ID:2748.

Another function of VGAM37 is therefore inhibition of LOC197131 (Accession XM_113823). Accordingly, utilities of VGAM37 include diagnosis, prevention and treatment of diseases and clinical conditions associated with LOC197131. FIG. 1 further provides a conceptual description of a novel bioinformatically detected viral gene of the present invention, referred to here as Viral Genomic Address Messenger 38 (VGAM38) viral gene, which modulates expression of respective host target genes thereof, the function and utility of which host target genes is known in the art.

VGAM38 is a novel bioinformatically detected regulatory, non protein coding, viral micro RNA (miRNA) gene. The method by which VGAM38 was detected is described hereinabove with reference to FIGS. 1-8.

VGAM38 gene, herein designated VGAM GENE, is a viral gene contained in the genome of Invertebrate Iridescent Virus 6. VGAM38 host target gene, herein designated VGAM HOST TARGET GENE, is a human gene contained in the human genome.

VGAM38 gene encodes a VGAM38 precursor RNA, herein designated VGAM PRECURSOR RNA. Similar to other miRNA genes, and unlike most ordinary genes, VGAM38 precursor RNA does not encode a protein. A nucleotide sequence identical or highly similar to the nucleotide sequence of VGAM38 precursor RNA is designated SEQ ID:24, and is provided hereinbelow with reference to the sequence listing part. Nucleotide sequence SEQ ID:24 is located at position 79915 relative to the genome of Invertebrate Iridescent Virus 6.

VGAM38 precursor RNA folds onto itself, forming VGAM38 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM38 folded precursor RNA into VGAM38 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM38 RNA is designated SEQ ID:2749, and is provided hereinbelow with reference to the sequence listing part.

VGAM38 host target gene, herein designated VGAM HOST TARGET GENE, encodes a corresponding messenger RNA, VGAM38 host target RNA, herein designated VGAM HOST TARGET RNA. VGAM38 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM38 RNA, herein designated VGAM RNA, binds complementarily to one or more host target binding sites located in untranslated regions of VGAM38 host target RNA, herein designated VGAM HOST TARGET RNA. This complementary binding is due to the fact that the nucleotide sequence of VGAM38 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM38 RNA, herein designated VGAM RNA, may have a different number of host target binding sites in untranslated regions of a VGAM38 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM38 RNA, herein designated VGAM RNA, to host target binding sites on VGAM38 host target RNA, herein designated VGAM HOST TARGET RNA, such as BINDING SITE I, BINDING SITE II and BINDING SITE III, inhibits translation of VGAM38 host target RNA into VGAM38 host target protein, herein designated VGAM HOST TARGET PROTEIN. VGAM host target protein is therefore outlined by a broken line.

It is appreciated that VGAM38 host target gene, herein designated VGAM HOST TARGET GENE, in fact represents a plurality of VGAM38 host target genes. The mRNA of each one of this plurality of VGAM38 host target genes comprises one or more host target binding sites, each having a nucleotide sequence which is at least partly complementary to VGAM38 RNA, herein designated VGAM RNA, and which when bound by VGAM38 RNA causes inhibition of translation of respective one or more VGAM38 host target proteins.

It is further appreciated by one skilled in the art that the mode of translational inhibition illustrated by FIG. 1 with specific reference to translational inhibition exerted by VGAM38 gene, herein designated VGAM GENE, on one or more VGAM38 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM38 is inhibition of expression of host target genes, as part of a novel viral mechanism of attacking a host. Accordingly, utilities of VGAM38 include diagnosis, prevention and treatment of viral infection by Invertebrate Iridescent Virus 6. Specific functions, and accordingly utilities, of VGAM38 correlate with, and may be deduced from, the identity of the host target genes which VGAM38 binds and inhibits, and the function of these host target genes, as elaborated hereinbelow.

Nucleotide sequences of the VGAM38 precursor RNA, herein designated VGAM PRECURSOR RNA, and of the 'diced' VGAM38 RNA, herein designated VGAM RNA, and a schematic representation of the secondary folding of VGAM38 folded precursor RNA, herein designated VGAM FOLDED PRECURSOR RNA, of VGAM38 are further described hereinbelow with reference to Table 1.

Nucleotide sequences of host target binding sites, such as BINDING SITE-I, BINDING SITE-II and BINDING SITE-III of FIG. 1, found on VGAM38 host target RNA, and schematic representation of the complementarity of each of these host target binding sites to VGAM38 RNA, herein designated VGAM RNA, are described hereinbelow with reference to Table 2.

As mentioned hereinabove with reference to FIG. 1, a function of VGAM38 gene, herein designated VGAM is inhibition of expression of VGAM38 target genes. It is appreciated that specific functions, and accordingly utilities, of VGAM38 correlate with, and may be deduced from, the identity of the target genes which VGAM38 binds and inhibits, and the function of these target genes, as elaborated hereinbelow.

CLIPR-59 (Accession NM_015526) is a VGAM38 host target gene. CLIPR-59 BINDING SITE is HOST TARGET binding site found in the 3' untranslated region of mRNA encoded by CLIPR-59, corresponding to a HOST TARGET binding site such as BINDING SITE I, BINDING SITE II or BINDING SITE III. Table 2 illustrates the complementarity of the nucleotide sequences of CLIPR-59 BINDING SITE, designated SEQ ID:17791, to the nucleotide sequence of VGAM38 RNA, herein designated VGAM RNA, also designated SEQ ID:2749.

A function of VGAM38 is therefore inhibition of CLIPR-59 (Accession NM_015526). Accordingly, utilities of VGAM38 include diagnosis, prevention and treatment of diseases and clinical conditions associated with CLIPR-59. DKFZp547I014 (Accession NM_020217) is another VGAM38 host target gene. DKFZp547I014 BINDING SITE is HOST TARGET binding site found in the 5' untranslated region of mRNA encoded by DKFZp547I014, corresponding to a HOST TARGET binding site such as BINDING SITE I, BINDING SITE II or BINDING SITE III. Table 2 illustrates the complementarity of the nucleotide sequences of DKFZp547I014 BINDING SITE, designated SEQ ID:21468, to the nucleotide sequence of VGAM38 RNA, herein designated VGAM RNA, also designated SEQ ID:2749.

Another function of VGAM38 is therefore inhibition of DKFZp547I014 (Accession NM_020217). Accordingly, utilities of VGAM38 include diagnosis, prevention and treatment of diseases and clinical conditions associated with DKFZp547I014. FLJ11184 (Accession NM_018352) is another VGAM38 host target gene. FLJ11184 BINDING SITE is HOST TARGET binding site found in the 3' untranslated region of mRNA encoded by FLJ11184, corresponding to a HOST TARGET binding site such as BINDING SITE I, BINDING SITE II or BINDING SITE III. Table 2 illustrates the complementarity of the nucleotide sequences of FLJ11184 BINDING SITE, designated SEQ ID:20366, to the nucleotide sequence of VGAM38 RNA, herein designated VGAM RNA, also designated SEQ ID:2749.

Another function of VGAM38 is therefore inhibition of FLJ11184 (Accession NM_018352). Accordingly, utilities of VGAM38 include diagnosis, prevention and treatment of diseases and clinical conditions associated with FLJ11184. KIAA0426 (Accession NM_014724) is another VGAM38 host target gene. KIAA0426 BINDING SITE is HOST TARGET binding site found in the 3' untranslated region of mRNA encoded by KIAA0426, corresponding to a HOST TARGET binding site such as BINDING SITE I, BINDING SITE II or BINDING SITE III. Table 2 illustrates the complementarity of the nucleotide sequences of KIAA0426 BINDING SITE, designated SEQ ID:16307, to the nucleotide sequence of VGAM38 RNA, herein designated VGAM RNA, also designated SEQ ID:2749.

Another function of VGAM38 is therefore inhibition of KIAA0426 (Accession NM_014724). Accordingly, utilities of VGAM38 include diagnosis, prevention and treatment of diseases and clinical conditions associated with KIAA0426. KIAA1354 (Accession XM_027604) is another VGAM38 host target gene. KIAA1354 BINDING SITE is HOST TARGET binding site found in the 3' untranslated region of mRNA encoded by KIAA1354, corresponding to a HOST TARGET binding site such as BINDING SITE I, BINDING SITE II or BINDING SITE III. Table 2 illustrates the complementarity of the nucleotide sequences of KIAA1354 BINDING SITE, designated SEQ ID:30541, to the nucleotide sequence of VGAM38 RNA, herein designated VGAM RNA, also designated SEQ ID:2749.

Another function of VGAM38 is therefore inhibition of KIAA1354 (Accession XM_027604). Accordingly, utilities of VGAM38 include diagnosis, prevention and treatment of diseases and clinical conditions associated with KIAA1354. LOC257058 (Accession XM_173738) is another VGAM38 host target gene. LOC257058 BINDING SITE is HOST TARGET binding site found in the 5' untranslated region of mRNA encoded by LOC257058, corresponding to a HOST TARGET binding site such as BINDING SITE I, BINDING SITE II or BINDING SITE III. Table 2 illustrates the complementarity of the nucleotide sequences of LOC257058 BINDING SITE, designated SEQ ID:46560, to the nucleotide sequence of VGAM38 RNA, herein designated VGAM RNA, also designated SEQ ID:2749.

Another function of VGAM38 is therefore inhibition of LOC257058 (Accession XM_173738). Accordingly, utilities of VGAM38 include diagnosis, prevention and treatment of diseases and clinical conditions associated with LOC257058. FIG. 1 further provides a conceptual description of a novel bioinformatically detected viral gene of the present invention, referred to here as Viral Genomic Address Messenger 39 (VGAM39) viral gene, which modulates expression of respective host target genes thereof, the function and utility of which host target genes is known in the art.

VGAM39 is a novel bioinformatically detected regulatory, non protein coding, viral micro RNA (miRNA) gene. The method by which VGAM39 was detected is described hereinabove with reference to FIGS. 1-8.

VGAM39 gene, herein designated VGAM GENE, is a viral gene contained in the genome of Invertebrate Iridescent Virus 6. VGAM39 host target gene, herein designated VGAM HOST TARGET GENE, is a human gene contained in the human genome.

VGAM39 gene encodes a VGAM39 precursor RNA, herein designated VGAM PRECURSOR RNA. Similar to other miRNA genes, and unlike most ordinary genes, VGAM39 precursor RNA does not encode a protein. A nucleotide sequence identical or highly similar to the nucleotide sequence of VGAM39 precursor RNA is designated SEQ ID:25, and is provided hereinbelow with reference to the sequence listing part. Nucleotide sequence SEQ ID:25 is located at position 163620 relative to the genome of Invertebrate Iridescent Virus 6.

VGAM39 precursor RNA folds onto itself, forming VGAM39 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM39 folded precursor RNA into VGAM39 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 68%) nucleotide sequence of VGAM39 RNA is designated SEQ ID:2750, and is provided hereinbelow with reference to the sequence listing part.

VGAM39 host target gene, herein designated VGAM HOST TARGET GENE, encodes a corresponding messenger RNA, VGAM39 host target RNA, herein designated VGAM HOST TARGET RNA. VGAM39 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM39 RNA, herein designated VGAM RNA, binds complementarily to one or more host target binding sites located in untranslated regions of VGAM39 host target RNA, herein designated VGAM HOST TARGET RNA. This complementary binding is due to the fact that the nucleotide sequence of VGAM39 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM39 RNA, herein designated VGAM RNA, may have a different number of host target binding sites in untranslated regions of a VGAM39 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM39 RNA, herein designated VGAM RNA, to host target binding sites on VGAM39 host target RNA, herein designated VGAM HOST TARGET RNA, such as BINDING SITE I, BINDING SITE II and BINDING SITE III, inhibits translation of VGAM39 host target RNA into VGAM39 host target protein, herein designated VGAM HOST TARGET PROTEIN. VGAM host target protein is therefore outlined by a broken line.

It is appreciated that VGAM39 host target gene, herein designated VGAM HOST TARGET GENE, in fact represents a plurality of VGAM39 host target genes. The mRNA of each one of this plurality of VGAM39 host target genes comprises one or more host target binding sites, each having a nucleotide sequence which is at least partly complementary to VGAM39 RNA, herein designated VGAM RNA, and which when bound by VGAM39 RNA causes inhibition of translation of respective one or more VGAM39 host target proteins.

It is further appreciated by one skilled in the art that the mode of translational inhibition illustrated by FIG. 1 with specific reference to translational inhibition exerted by VGAM39 gene, herein designated VGAM GENE, on one or more VGAM39 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM39 is inhibition of expression of host target genes, as part of a novel viral mechanism of attacking a host. Accordingly, utilities of VGAM39 include diagnosis, prevention and treatment of viral infection by Invertebrate Iridescent Virus 6. Specific functions, and accordingly utilities, of VGAM39 correlate with, and may be deduced from, the identity of the host target genes which VGAM39 binds and inhibits, and the function of these host target genes, as elaborated hereinbelow.

Nucleotide sequences of the VGAM39 precursor RNA, herein designated VGAM PRECURSOR RNA, and of the 'diced' VGAM39 RNA, herein designated VGAM RNA, and a schematic representation of the secondary folding of VGAM39 folded precursor RNA, herein designated VGAM FOLDED PRECURSOR RNA, of VGAM39 are further described hereinbelow with reference to Table 1.

Nucleotide sequences of host target binding sites, such as BINDING SITE-I, BINDING SITE-II and BINDING SITE- III of FIG. 1, found on VGAM39 host target RNA, and schematic representation of the complementarity of each of these host target binding sites to VGAM39 RNA, herein designated VGAM RNA, are described hereinbelow with reference to Table 2.

As mentioned hereinabove with reference to FIG. 1, a function of VGAM39 gene, herein designated VGAM is inhibition of expression of VGAM39 target genes. It is appreciated that specific functions, and accordingly utilities, of VGAM39 correlate with, and may be deduced from, the identity of the target genes which VGAM39 binds and inhibits, and the function of these target genes, as elaborated hereinbelow.

Fibromodulin (FMOD, Accession NM_002023) is a VGAM39 host target gene. FMOD BINDING SITE is HOST TARGET binding site found in the 3' untranslated region of mRNA encoded by FMOD, corresponding to a HOST TARGET binding site such as BINDING SITE I, BINDING SITE II or BINDING SITE III. Table 2 illustrates the complementarity of the nucleotide sequences of FMOD BINDING SITE, designated SEQ ID:7769, to the nucleotide sequence of VGAM39 RNA, herein designated VGAM RNA, also designated SEQ ID:2750.

A function of VGAM39 is therefore inhibition of Fibromodulin (FMOD, Accession NM_002023), a gene which affects the rate of fibrils formation. Accordingly, utilities of VGAM39 include diagnosis, prevention and treatment of diseases and clinical conditions associated with FMOD. The function of FMOD has been established by previous studies. Fibromodulin is a member of a family of small interstitial proteoglycans that also includes decorin (DCN; 125255), biglycan (BGN; 301870), and lumican (LDC; 600616). The core proteins of these proteoglycans are structurally related, consisting of a central region composed of leucine-rich repeats flanked by disulfide-bonded terminal domains, with that for fibromodulin possessing up to 4 keratan sulfate chains within its leucine-rich domain. Fibromodulin exhibits a wide tissue distribution, with the highest abundance observed in articular cartilage, tendon, and ligament. It has been suggested that fibromodulin participates in the assembly of the extracellular matrix by virtue of its ability to interact with type I and type II collagen fibrils and to inhibit fibrillogenesis in vitro. Sztrolovics et al. (1994) cloned the 3-prime untranslated region of the fibromodulin cDNA. By fluorescence in situ hybridization, Sztrolovics et al. (1994) mapped the FMOD gene to 1q32. Secondary signals were detected at 9q34.1; however, PCR analysis of somatic cell hybrids confirmed the localization to chromosome 1. Animal model experiments lend further support to the function of FMOD. Lumican (OMIM Ref. No. 600616) and fibromodulin regulate the assembly of collagens into higher-order fibrils in connective tissues. Jepsen et al. (2002) found that mice in which the genes encoding both of these proteoglycans had been knocked out manifest several clinical features of Ehlers-Danlos syndrome (see OMIM Ref. No. 130000).

It is appreciated that the abovementioned animal model for FMOD is acknowledged by those skilled in the art as a scientifically valid animal model, as can be further appreciated from the publications sited hereinbelow.

Full details of the abovementioned studies are described in the following publications, the disclosure of which are hereby incorporated by reference:

Jepsen, K. J.; Wu, F.; Peragallo, J. H.; Paul, J.; Roberts, L.; Ezura, Y.; Oldberg, A.; Birk, D. E.; Chakravarti, S.: A syndrome of joint laxity and impaired tendon integrity in lumican- and fibromodulin-deficient mice. J. Biol. Chem. 277: 35532-35540, 2002; and Sztrolovics, R.; Chen, X.-N.; Grover, J.; Roughley, P. J.; Korenberg, J. R.: Localization of the human fibromodulin gene (FMOD) to chromosome 1q32 and completion of the cDNA sequence.

Further studies establishing the function and utilities of FMOD are found in John Hopkins OMIM database record ID 600245, and in sited publications numbered 7916-7917 listed in the bibliography section hereinbelow, which are also hereby incorporated by reference. Kallmann Syndrome 1 Sequence (KAL1, Accession NM_000216) is another VGAM39 host target gene. KAL1 BINDING SITE is HOST TARGET binding site found in the 3' untranslated region of mRNA encoded by KAL1, corresponding to a HOST TARGET binding site such as BINDING SITE I, BINDING SITE II or BINDING SITE III. Table 2 illustrates the complementarity of the nucleotide sequences of KAL1 BINDING SITE, designated SEQ ID:5715, to the nucleotide sequence of VGAM39 RNA, herein designated VGAM RNA, also designated SEQ ID:2750.

Another function of VGAM39 is therefore inhibition of Kallmann Syndrome 1 Sequence (KAL1, Accession NM_000216). Accordingly, utilities of VGAM39 include diagnosis, prevention and treatment of diseases and clinical conditions associated with KAL1. Mab-21-like 1 (C. elegans) (MAB21L1, Accession NM_005584) is another VGAM39 host target gene. MAB21L1 BINDING SITE is HOST TARGET binding site found in the 5' untranslated region of mRNA encoded by MAB21L1, corresponding to a HOST TARGET binding site such as BINDING SITE I, BINDING SITE II or BINDING SITE III. Table 2 illustrates the complementarity of the nucleotide sequences of MAB21L1 BINDING SITE, designated SEQ ID:12111, to the nucleotide sequence of VGAM39 RNA, herein designated VGAM RNA, also designated SEQ ID:2750.

Another function of VGAM39 is therefore inhibition of Mab-21-like 1 (C. elegans) (MAB21L1, Accession NM_005584), a gene which may control cerebellum and eye development; very strongly similar to murine Mm.10798. Accordingly, utilities of VGAM39 include diagnosis, prevention and treatment of diseases and clinical conditions associated with MAB21L1. The function of MAB21L1 has been established by previous studies. Margolis et al. (1996) cloned the CAGR1 gene from a retinal cDNA library. The gene encodes a 359-amino acid protein that is homologous to the C. elegans cell fate-determining protein mab-21 (56% identical and 81% conserved amino acids). Northern blot analysis revealed that CAGR1 is expressed in a number of tissues, with highest expression in the brain, particularly in the cerebellum. A CAG trinucleotide repeat occurs in the 5-prime untranslated region of CAGR1. This repeat is highly polymorphic, with alleles ranging from 6 to 31 repeats. Margolis et al. (1996) reported that an individual with an idiopathic movement disorder and affective disorder had an allele that contained 46 repeats Potter (1997) analyzed 928 chromosomes from controls and patients with a variety of neurologic diseases. He found a normal CAG repeat size range of 9 to 29 repeats. One individual with developmental delay and mental retardation had 50 repeats; however, 3 other family members with alleles of similar size were apparently normal. Analysis of other family members showed meiotic stability for repeats of normal length and meiotic instability for alleles with 45 or more repeats. Margolis et al. (1999) reported a second pedigree with an expanded and unstably transmitted MAB21L1 CAG repeat. One individual from this pedigree was included in the report of Margolis et al. (1996). The expansion size ranged up to 51 repeats. The repeat length tended to increase in subsequent generations, but the expanded allele was not associated with a phenotypic abnormality. The pedigree, however, was complex, with a number of individuals affected with neurologic and psychiatric disorders. Repeat length did not influence the level of MAB21L1 protein in lymphoblasts from 2 family members with an expanded MAB21L1 repeat. Margolis et al. (1999) hypothesized that the CAG repeat in MAB21L1 may behave as a premutation, and that longer expansions may be associated with a clinical phenotype.

Full details of the abovementioned studies are described in the following publications, the disclosure of which are hereby incorporated by reference:

Margolis, R. L.; Stine, O. C.; Ward, C. M.; Franz, M. L.; Rosenblatt, A.; Callahan, C.; Sherr, M.; Ross, C. A.; Potter, N. T.: Unstable expansion of the CAG trinucleotide repeat in MAB21L1: report of a second pedigree and effect on protein expression. J. Med. Genet. 36:62-64, 1999; and Margolis, R. L.; Stine, O. C.; McInnis, M. G.; Ranen, N. G.; Rubinsztein, D. C.; Leggo, J.; Brando, L. V. J.; Kidwai, A. S.; Loev, S. J.; Breschel, T. S.; Callahan, C.; Simpson, S. G.; and.

Further studies establishing the function and utilities of MAB21L1 are found in John Hopkins OMIM database record ID 601280, and in sited publications numbered 1329-1328 listed in the bibliography section hereinbelow, which are also hereby incorporated by reference. Matrix Metalloproteinase 14 (membrane-inserted) (MMP14, Accession NM_004995) is another VGAM39 host target gene. MMP14 BINDING SITE is HOST TARGET binding site found in the 5' untranslated region of mRNA encoded by MMP14, corresponding to a HOST TARGET binding site such as BINDING SITE I, BINDING SITE II or BINDING SITE III. Table 2 illustrates the complementarity of the nucleotide sequences of MMP14 BINDING SITE, designated SEQ ID:11434, to the nucleotide sequence of VGAM39 RNA, herein designated VGAM RNA, also designated SEQ ID:2750.

Another function of VGAM39 is therefore inhibition of Matrix Metalloproteinase 14 (membrane-inserted) (MMP14, Accession NM_004995). Accordingly, utilities of VGAM39 include diagnosis, prevention and treatment of diseases and clinical conditions associated with MMP14. Optic Atrophy 1 (autosomal dominant) (OPA1, Accession NM_130833) is another VGAM39 host target gene. OPA1 BINDING SITE1 through OPA1 BINDING SITE5 are HOST TARGET binding sites found in untranslated regions of mRNA encoded by OPA1, corresponding to HOST TARGET binding sites such as BINDING SITE I, BINDING SITE II or BINDING SITE III. Table 2 illustrates the complementarity of the nucleotide sequences of OPA1 BINDING SITE1 through OPA1 BINDING SITE5, designated SEQ ID:28321, SEQ ID:28329, SEQ ID:28337, SEQ ID:28345 and SEQ ID:28353 respectively, to the nucleotide sequence of VGAM39 RNA, herein designated VGAM RNA, also designated SEQ ID:2750.

Another function of VGAM39 is therefore inhibition of Optic Atrophy 1 (autosomal dominant) (OPA1, Accession NM_130833). Accordingly, utilities of VGAM39 include diagnosis, prevention and treatment of diseases and clinical conditions associated with OPA1. Zinc Finger Protein 192 (ZNF192, Accession NM_006298) is another VGAM39 host target gene. ZNF192 BINDING SITE is HOST TARGET binding site found in the 3' untranslated region of mRNA encoded by ZNF192, corresponding to a HOST TARGET binding site such as BINDING SITE I, BINDING SITE II or BINDING SITE III. Table 2 illustrates the complementarity of the nucleotide sequences of ZNF192 BINDING SITE, designated SEQ ID:12986, to the nucleotide sequence of VGAM39 RNA, herein designated VGAM RNA, also designated SEQ ID:2750.

Another function of VGAM39 is therefore inhibition of Zinc Finger Protein 192 (ZNF192, Accession NM_006298). Accordingly, utilities of VGAM39 include diagnosis, prevention and treatment of diseases and clinical conditions associated with ZNF192. Amyotrophic Lateral Sclerosis 2 (juvenile) Chromosome Region, Candidate 3 (ALS2CR3, Accession NM_015049) is another VGAM39 host target gene. ALS2CR3 BINDING SITE is HOST TARGET binding site found in the 3' untranslated region of mRNA encoded by ALS2CR3, corresponding to a HOST TARGET binding site such as BINDING SITE I, BINDING SITE II or BINDING SITE III. Table 2 illustrates the complementarity of the nucleotide sequences of ALS2CR3 BINDING SITE, designated SEQ ID:17410, to the nucleotide sequence of VGAM39 RNA, herein designated VGAM RNA, also designated SEQ ID:2750.

Another function of VGAM39 is therefore inhibition of Amyotrophic Lateral Sclerosis 2 (juvenile) Chromosome Region, Candidate 3 (ALS2CR3, Accession NM_015049). Accordingly, utilities of VGAM39 include diagnosis, prevention and treatment of diseases and clinical conditions associated with ALS2CR3. C3IP1 (Accession NM_021633) is another VGAM39 host target gene. C3IP1 BINDING SITE is HOST TARGET binding site found in the 3' untranslated region of mRNA encoded by C3IP1, corresponding to a HOST TARGET binding site such as BINDING SITE I, BINDING SITE II or BINDING SITE III. Table 2 illustrates the complementarity of the nucleotide sequences of C3IP1 BINDING SITE, designated SEQ ID:22273, to the nucleotide sequence of VGAM39 RNA, herein designated VGAM RNA, also designated SEQ ID:2750.

Another function of VGAM39 is therefore inhibition of C3IP1 (Accession NM_021633). Accordingly, utilities of VGAM39 include diagnosis, prevention and treatment of diseases and clinical conditions associated with C3IP1. DKFZp761J139 (Accession NM_032280) is another VGAM39 host target gene. DKFZp761J139 BINDING SITE is HOST TARGET binding site found in the 3' untranslated region of mRNA encoded by DKFZp761J139, corresponding to a HOST TARGET binding site such as BINDING SITE I, BINDING SITE II or BINDING SITE III. Table 2 illustrates the complementarity of the nucleotide sequences of DKFZp761J139 BINDING SITE, designated SEQ ID:26035, to the nucleotide sequence of VGAM39 RNA, herein designated VGAM RNA, also designated SEQ ID:2750.

Another function of VGAM39 is therefore inhibition of DKFZp761J139 (Accession NM_032280). Accordingly, utilities of VGAM39 include diagnosis, prevention and treatment of diseases and clinical conditions associated with DKFZp761J139. FLJ10468 (Accession NM_018101) is another VGAM39 host target gene. FLJ10468 BINDING SITE is HOST TARGET binding site found in the 3' untranslated region of mRNA encoded by FLJ10468, corresponding to a HOST TARGET binding site such as BINDING SITE I, BINDING SITE II or BINDING SITE III. Table 2 illustrates the complementarity of the nucleotide sequences of FLJ10468 BINDING SITE, designated SEQ ID:19873, to the nucleotide sequence of VGAM39 RNA, herein designated VGAM RNA, also designated SEQ ID:2750.

Another function of VGAM39 is therefore inhibition of FLJ10468 (Accession NM_018101). Accordingly, utilities of VGAM39 include diagnosis, prevention and treatment of diseases and clinical conditions associated with FLJ10468. FLJ10781 (Accession NM_018215) is another VGAM39 host target gene. FLJ10781 BINDING SITE is HOST TARGET binding site found in the 3' untranslated region of mRNA encoded by FLJ10781, corresponding to a HOST TARGET binding site such as BINDING SITE I, BINDING SITE II or BINDING SITE III. Table 2 illustrates the complementarity of the nucleotide sequences of FLJ10781 BINDING SITE, designated SEQ ID:20133, to the nucleotide sequence of VGAM39 RNA, herein designated VGAM RNA, also designated SEQ ID:2750.

Another function of VGAM39 is therefore inhibition of FLJ10781 (Accession NM_018215). Accordingly, utilities of VGAM39 include diagnosis, prevention and treatment of diseases and clinical conditions associated with FLJ10781. FLJ11175 (Accession NM_018349) is another VGAM39 host target gene. FLJ11175 BINDING SITE is HOST TARGET binding site found in the 3' untranslated region of mRNA encoded by FLJ11175, corresponding to a HOST TARGET binding site such as BINDING SITE I, BINDING SITE II or BINDING SITE III. Table 2 illustrates the complementarity of the nucleotide sequences of FLJ11175 BINDING SITE, designated SEQ ID:20361, to the nucleotide sequence of VGAM39 RNA, herein designated VGAM RNA, also designated SEQ ID:2750.

Another function of VGAM39 is therefore inhibition of FLJ11175 (Accession NM_018349). Accordingly, utilities of VGAM39 include diagnosis, prevention and treatment of diseases and clinical conditions associated with FLJ11175. FLJ20972 (Accession NM_025030) is another VGAM39 host target gene. FLJ20972 BINDING SITE is HOST TARGET binding site found in the 3' untranslated region of mRNA encoded by FLJ20972, corresponding to a HOST TARGET binding site such as BINDING SITE I, BINDING SITE II or BINDING SITE III. Table 2 illustrates the complementarity of the nucleotide sequences of FLJ20972 BINDING SITE, designated SEQ ID:24625, to the nucleotide sequence of VGAM39 RNA, herein designated VGAM RNA, also designated SEQ ID:2750.

Another function of VGAM39 is therefore inhibition of FLJ20972 (Accession NM_025030). Accordingly, utilities of VGAM39 include diagnosis, prevention and treatment of diseases and clinical conditions associated with FLJ20972. FLJ23233 (Accession NM_024691) is another VGAM39 host target gene. FLJ23233 BINDING SITE is HOST TARGET binding site found in the 3' untranslated region of mRNA encoded by FLJ23233, corresponding to a HOST TARGET binding site such as BINDING SITE I, BINDING SITE II or BINDING SITE III. Table 2 illustrates the complementarity of the nucleotide sequences of FLJ23233 BINDING SITE, designated SEQ ID:23999, to the nucleotide sequence of VGAM39 RNA, herein designated VGAM RNA, also designated SEQ ID:2750.

Another function of VGAM39 is therefore inhibition of FLJ23233 (Accession NM_024691). Accordingly, utilities of VGAM39 include diagnosis, prevention and treatment of diseases and clinical conditions associated with FLJ23233. HRIHFB2122 (Accession NM_007032) is another VGAM39 host target gene. HRIHFB2122 BINDING SITE is HOST TARGET binding site found in the 3' untranslated region of mRNA encoded by HRIHFB2122, corresponding to a HOST TARGET binding site such as BINDING SITE I, BINDING SITE II or BINDING SITE III. Table 2 illustrates the complementarity of the nucleotide sequences of HRIHFB2122 BINDING SITE, designated SEQ ID:13897, to the nucleotide sequence of VGAM39 RNA, herein designated VGAM RNA, also designated SEQ ID:2750.

Another function of VGAM39 is therefore inhibition of HRIHFB2122 (Accession NM_007032). Accordingly, utilities of VGAM39 include diagnosis, prevention and treatment of diseases and clinical conditions associated with HRIHFB2122. KIAA0016 (Accession NM_014765) is another VGAM39 host target gene. KIAA0016 BINDING SITE is HOST TARGET binding site found in the 3' untranslated region of mRNA encoded by KIAA0016, corresponding to a HOST TARGET binding site such as BINDING SITE I, BINDING SITE II or BINDING SITE III. Table 2 illustrates the complementarity of the nucleotide sequences of KIAA0016 BINDING SITE, designated SEQ ID:16529, to the nucleotide sequence of VGAM39 RNA, herein designated VGAM RNA, also designated SEQ ID:2750.

Another function of VGAM39 is therefore inhibition of KIAA0016 (Accession NM_014765). Accordingly, utilities of VGAM39 include diagnosis, prevention and treatment of diseases and clinical conditions associated with KIAA0016. KIAA0459 (Accession XM_027862) is another VGAM39 host target gene. KIAA0459 BINDING SITE is HOST TARGET binding site found in the 3' untranslated region of mRNA encoded by KIAA0459, corresponding to a HOST TARGET binding site such as BINDING SITE I, BINDING SITE II or BINDING SITE III. Table 2 illustrates the complementarity of the nucleotide sequences of KIAA0459 BINDING SITE, designated SEQ ID:30572, to the nucleotide sequence of VGAM39 RNA, herein designated VGAM RNA, also designated SEQ ID:2750.

Another function of VGAM39 is therefore inhibition of KIAA0459 (Accession XM_027862). Accordingly, utilities of VGAM39 include diagnosis, prevention and treatment of diseases and clinical conditions associated with KIAA0459. KIAA0712 (Accession NM_014715) is another VGAM39 host target gene. KIAA0712 BINDING SITE is HOST TARGET binding site found in the 3' untranslated region of mRNA encoded by KIAA0712, corresponding to a HOST TARGET binding site such as BINDING SITE I, BINDING SITE II or BINDING SITE III. Table 2 illustrates the complementarity of the nucleotide sequences of KIAA0712 BINDING SITE, designated SEQ ID:16263, to the nucleotide sequence of VGAM39 RNA, herein designated VGAM RNA, also designated SEQ ID:2750.

Another function of VGAM39 is therefore inhibition of KIAA0712 (Accession NM_014715). Accordingly, utilities of VGAM39 include diagnosis, prevention and treatment of diseases and clinical conditions associated with KIAA0712. KIAA0773 (Accession NM_014690) is another VGAM39 host target gene. KIAA0773 BINDING SITE is HOST TARGET binding site found in the 3' untranslated region of mRNA encoded by KIAA0773, corresponding to a HOST TARGET binding site such as BINDING SITE I, BINDING SITE II or BINDING SITE III. Table 2 illustrates the complementarity of the nucleotide sequences of KIAA0773 BINDING SITE, designated SEQ ID:16194, to the nucleotide sequence of VGAM39 RNA, herein designated VGAM RNA, also designated SEQ ID:2750.

Another function of VGAM39 is therefore inhibition of KIAA0773 (Accession NM_014690). Accordingly, utilities of VGAM39 include diagnosis, prevention and treatment of diseases and clinical conditions associated with KIAA0773. KIAA0930 (Accession XM_047214) is another VGAM39 host target gene. KIAA0930 BINDING SITE is HOST TARGET binding site found in the 3' untranslated region of mRNA encoded by KIAA0930, corresponding to a HOST TARGET binding site such as BINDING SITE I, BINDING SITE II or BINDING SITE III. Table 2 illustrates the complementarity of the nucleotide sequences of KIAA0930 BINDING SITE, designated SEQ ID:34912, to the nucleotide sequence of VGAM39 RNA, herein designated VGAM RNA, also designated SEQ ID:2750.

Another function of VGAM39 is therefore inhibition of KIAA0930 (Accession XM_047214). Accordingly, utilities of VGAM39 include diagnosis, prevention and treatment of diseases and clinical conditions associated with KIAA0930. KIAA0976 (Accession NM_014917) is another VGAM39 host target gene. KIAA0976 BINDING SITE is HOST TARGET binding site found in the 3' untranslated region of mRNA encoded by KIAA0976, corresponding to a HOST TARGET binding site such as BINDING SITE I, BINDING SITE II or BINDING SITE III. Table 2 illustrates the complementarity of the nucleotide sequences of KIAA0976 BINDING SITE, designated SEQ ID:17164, to the nucleotide sequence of VGAM39 RNA, herein designated VGAM RNA, also designated SEQ ID:2750.

Another function of VGAM39 is therefore inhibition of KIAA0976 (Accession NM_014917). Accordingly, utilities of VGAM39 include diagnosis, prevention and treatment of diseases and clinical conditions associated with KIAA0976. KIAA1046 (Accession NM_014928) is another VGAM39 host target gene. KIAA1046 BINDING SITE is HOST TARGET binding site found in the 3' untranslated region of mRNA encoded by KIAA1046, corresponding to a HOST TARGET binding site such as BINDING SITE I, BINDING SITE II or BINDING SITE III. Table 2 illustrates the complementarity of the nucleotide sequences of KIAA1046 BINDING SITE, designated SEQ ID:17219, to the nucleotide sequence of VGAM39 RNA, herein designated VGAM RNA, also designated SEQ ID:2750.

Another function of VGAM39 is therefore inhibition of KIAA1046 (Accession NM_014928). Accordingly, utilities of VGAM39 include diagnosis, prevention and treatment of diseases and clinical conditions associated with KIAA1046. KIAA1143 (Accession XM_044014) is another VGAM39 host target gene. KIAA1143 BINDING SITE is HOST TARGET binding site found in the 3' untranslated region of mRNA encoded by KIAA1143, corresponding to a HOST TARGET binding site such as BINDING SITE I, BINDING SITE II or BINDING SITE III. Table 2 illustrates the complementarity of the nucleotide sequences of KIAA1143 BINDING SITE, designated SEQ ID:34072, to the nucleotide sequence of VGAM39 RNA, herein designated VGAM RNA, also designated SEQ ID:2750.

Another function of VGAM39 is therefore inhibition of KIAA1143 (Accession XM_044014). Accordingly, utilities of VGAM39 include diagnosis, prevention and treatment of diseases and clinical conditions associated with KIAA1143. KIAA1580 (Accession XM_045271) is another VGAM39 host target gene. KIAA1580 BINDING SITE is HOST TARGET binding site found in the 5' untranslated region of mRNA encoded by KIAA1580, corresponding to a HOST TARGET binding site such as BINDING SITE I, BINDING SITE II or BINDING SITE III. Table 2 illustrates the complementarity of the nucleotide sequences of KIAA1580 BINDING SITE, designated SEQ ID:34410, to the nucleotide sequence of VGAM39 RNA, herein designated VGAM RNA, also designated SEQ ID:2750.

Another function of VGAM39 is therefore inhibition of KIAA1580 (Accession XM_045271). Accordingly, utilities of VGAM39 include diagnosis, prevention and treatment of diseases and clinical conditions associated with KIAA1580. KIAA1715 (Accession XM_042834) is another VGAM39 host target gene. KIAA1715 BINDING SITE is HOST TARGET binding site found in the 3' untranslated region of mRNA encoded by KIAA1715, corresponding to a HOST TARGET binding site such as BINDING SITE I, BINDING SITE II or BINDING SITE III. Table 2 illustrates the complementarity of the nucleotide sequences of KIAA1715 BINDING SITE, designated SEQ ID:33788, to the nucleotide sequence of VGAM39 RNA, herein designated VGAM RNA, also designated SEQ ID:2750.

Another function of VGAM39 is therefore inhibition of KIAA1715 (Accession XM_042834). Accordingly, utilities of VGAM39 include diagnosis, prevention and treatment of diseases and clinical conditions associated with KIAA1715. Phospholipid Scramblase 4 (PLSCR4, Accession NM_020353) is another VGAM39 host target gene. PLSCR4 BINDING SITE is HOST TARGET binding site found in the 3' untranslated region of mRNA encoded by PLSCR4, corresponding to a HOST TARGET binding site such as BINDING SITE I, BINDING SITE II or BINDING SITE III. Table 2 illustrates the complementarity of the nucleotide sequences of PLSCR4 BINDING SITE, designated SEQ ID:21621, to the nucleotide sequence of VGAM39 RNA, herein designated VGAM RNA, also designated SEQ ID:2750.

Another function of VGAM39 is therefore inhibition of Phospholipid Scramblase 4 (PLSCR4, Accession NM_020353). Accordingly, utilities of VGAM39 include diagnosis, prevention and treatment of diseases and clinical conditions associated with PLSCR4. Proline-serine-threonine Phosphatase Interacting Protein 2 (PSTPIP2, Accession NM_024430) is another VGAM39 host target gene. PSTPIP2 BINDING SITE is HOST TARGET binding site found in the 3' untranslated region of mRNA encoded by PSTPIP2, corresponding to a HOST TARGET binding site such as BINDING SITE I, BINDING SITE II or BINDING SITE III. Table 2 illustrates the complementarity of the nucleotide sequences of PSTPIP2 BINDING SITE, designated SEQ ID:23679, to the nucleotide sequence of VGAM39 RNA, herein designated VGAM RNA, also designated SEQ ID:2750.

Another function of VGAM39 is therefore inhibition of Proline-serine-threonine Phosphatase Interacting Protein 2 (PSTPIP2, Accession NM_024430). Accordingly, utilities of VGAM39 include diagnosis, prevention and treatment of diseases and clinical conditions associated with PSTPIP2. Retinoic Acid Induced 15 (RAI15, Accession XM_039548) is another VGAM39 host target gene. RAI15 BINDING SITE is HOST TARGET binding site found in the 3' untranslated region of mRNA encoded by RAI15, corresponding to a HOST TARGET binding site such as BINDING SITE I, BINDING SITE II or BINDING SITE III. Table 2 illustrates the complementarity of the nucleotide sequences of RAI15 BINDING SITE, designated SEQ ID:33116, to the nucleotide sequence of VGAM39 RNA, herein designated VGAM RNA, also designated SEQ ID:2750.

Another function of VGAM39 is therefore inhibition of Retinoic Acid Induced 15 (RAI15, Accession XM_039548). Accordingly, utilities of VGAM39 include diagnosis, prevention and treatment of diseases and clinical conditions associated with RAI15. RNAH (Accession XM_030392) is another VGAM39 host target gene. RNAH BINDING SITE is HOST TARGET binding site found in the 3' untranslated region of mRNA encoded by RNAH, corresponding to a HOST TARGET binding site such as BINDING SITE I, BINDING SITE II or BINDING SITE III. Table 2 illustrates the complementarity of the nucleotide sequences of RNAH BINDING SITE, designated SEQ ID:31037, to the nucleotide sequence of VGAM39 RNA, herein designated VGAM RNA, also designated SEQ ID:2750.

Another function of VGAM39 is therefore inhibition of RNAH (Accession XM_030392). Accordingly, utilities of VGAM39 include diagnosis, prevention and treatment of diseases and clinical conditions associated with RNAH. SSH1 (Accession NM_018984) is another VGAM39 host target gene. SSH1 BINDING SITE is HOST TARGET binding site found in the 3' untranslated region of mRNA encoded by SSH1, corresponding to a HOST TARGET binding site such as BINDING SITE I, BINDING SITE II or BINDING SITE III. Table 2 illustrates the complementarity of the nucleotide sequences of SSH1 BINDING SITE, designated SEQ ID:21054, to the nucleotide sequence of VGAM39 RNA, herein designated VGAM RNA, also designated SEQ ID:2750.

Another function of VGAM39 is therefore inhibition of SSH1 (Accession NM_018984). Accordingly, utilities of VGAM39 include diagnosis, prevention and treatment of diseases and clinical conditions associated with SSH1. TUBB5 (Accession NM_006087) is another VGAM39 host target gene. TUBB5 BINDING SITE is HOST TARGET binding site found in the 3' untranslated region of mRNA encoded by TUBB5, corresponding to a HOST TARGET binding site such as BINDING SITE I, BINDING SITE II or BINDING SITE III. Table 2 illustrates the complementarity of the nucleotide sequences of TUBB5 BINDING SITE, designated SEQ ID:12728, to the nucleotide sequence of VGAM39 RNA, herein designated VGAM RNA, also designated SEQ ID:2750.

Another function of VGAM39 is therefore inhibition of TUBB5 (Accession NM_006087). Accordingly, utilities of VGAM39 include diagnosis, prevention and treatment of diseases and clinical conditions associated with TUBB5. LOC112687 (Accession XM_053145) is another VGAM39 host target gene. LOC112687 BINDING SITE is HOST TARGET binding site found in the 3' untranslated region of mRNA encoded by LOC112687, corresponding to a HOST TARGET binding site such as BINDING SITE I, BINDING SITE II or BINDING SITE III. Table 2 illustrates the complementarity of the nucleotide sequences of LOC112687 BINDING SITE, designated SEQ ID:36065, to the nucleotide sequence of VGAM39 RNA, herein designated VGAM RNA, also designated SEQ ID:2750.

Another function of VGAM39 is therefore inhibition of LOC112687 (Accession XM_053145). Accordingly, utilities of VGAM39 include diagnosis, prevention and treatment of diseases and clinical conditions associated with LOC112687. LOC127602 (Accession XM_059166) is another VGAM39 host target gene. LOC127602 BINDING SITE is HOST TARGET binding site found in the 5' untranslated region of mRNA encoded by LOC127602, corresponding to a HOST TARGET binding site such as BINDING SITE I, BINDING SITE II or BINDING SITE III. Table 2 illustrates the complementarity of the nucleotide sequences of LOC127602 BINDING SITE, designated SEQ ID:36903, to the nucleotide sequence of VGAM39 RNA, herein designated VGAM RNA, also designated SEQ ID:2750.

Another function of VGAM39 is therefore inhibition of LOC127602 (Accession XM_059166). Accordingly, utilities of VGAM39 include diagnosis, prevention and treatment of diseases and clinical conditions associated with LOC127602. LOC143425 (Accession XM_113695) is another VGAM39 host target gene. LOC143425 BINDING SITE is HOST TARGET binding site found in the 3' untranslated region of mRNA encoded by LOC143425, corresponding to a HOST TARGET binding site such as BINDING SITE I, BINDING SITE II or BINDING SITE III. Table 2 illustrates the complementarity of the nucleotide sequences of LOC143425 BINDING SITE, designated SEQ ID:42350, to the nucleotide sequence of VGAM39 RNA, herein designated VGAM RNA, also designated SEQ ID:2750.

Another function of VGAM39 is therefore inhibition of LOC143425 (Accession XM_113695). Accordingly, utilities of VGAM39 include diagnosis, prevention and treatment of diseases and clinical conditions associated with LOC143425. LOC145725 (Accession XM_085211) is another VGAM39 host target gene. LOC145725 BINDING SITE is HOST TARGET binding site found in the 5' untranslated region of mRNA encoded by LOC145725, corresponding to a HOST TARGET binding site such as BINDING SITE I, BINDING SITE II or BINDING SITE III. Table 2 illustrates the complementarity of the nucleotide sequences of LOC145725 BINDING SITE, designated SEQ ID:37946, to the nucleotide sequence of VGAM39 RNA, herein designated VGAM RNA, also designated SEQ ID:2750.

Another function of VGAM39 is therefore inhibition of LOC145725 (Accession XM_085211). Accordingly, utilities of VGAM39 include diagnosis, prevention and treatment of diseases and clinical conditions associated with LOC145725. LOC145732 (Accession XM_085218) is another VGAM39 host target gene. LOC145732 BINDING SITE is HOST TARGET binding site found in the 5' untranslated region of mRNA encoded by LOC145732, corresponding to a HOST TARGET binding site such as BINDING SITE I, BINDING SITE II or BINDING SITE III. Table 2 illustrates the complementarity of the nucleotide sequences of LOC145732 BINDING SITE, designated SEQ ID:37955, to the nucleotide sequence of VGAM39 RNA, herein designated VGAM RNA, also designated SEQ ID:2750.

Another function of VGAM39 is therefore inhibition of LOC145732 (Accession XM_085218). Accordingly, utilities of VGAM39 include diagnosis, prevention and treatment of diseases and clinical conditions associated with LOC145732. LOC151623 (Accession XM_098096) is another VGAM39 host target gene. LOC151623 BINDING SITE is HOST TARGET binding site found in the 5' untranslated region of mRNA encoded by LOC151623, corresponding to a HOST TARGET binding site such as BINDING SITE I, BINDING SITE II or BINDING SITE III. Table 2 illustrates the complementarity of the nucleotide sequences of LOC151623 BINDING SITE, designated SEQ ID:41378, to the nucleotide sequence of VGAM39 RNA, herein designated VGAM RNA, also designated SEQ ID:2750.

Another function of VGAM39 is therefore inhibition of LOC151623 (Accession XM_098096). Accordingly, utilities of VGAM39 include diagnosis, prevention and treatment of diseases and clinical conditions associated with LOC151623. LOC196957 (Accession XM_113789) is another VGAM39 host target gene. LOC196957 BINDING SITE is HOST TARGET binding site found in the 5' untranslated region of mRNA encoded by LOC196957, corresponding to a HOST TARGET binding site such as BINDING SITE I, BINDING SITE II or BINDING SITE III. Table 2 illustrates the complementarity of the nucleotide sequences of LOC196957 BINDING SITE, designated SEQ ID:42428, to the nucleotide sequence of VGAM39 RNA, herein designated VGAM RNA, also designated SEQ ID:2750.

Another function of VGAM39 is therefore inhibition of LOC196957 (Accession XM_113789). Accordingly, utilities of VGAM39 include diagnosis, prevention and treatment of diseases and clinical conditions associated with LOC196957. LOC196961 (Accession XM_113790) is another VGAM39 host target gene. LOC196961 BINDING SITE is HOST TARGET binding site found in the 5' untranslated region of mRNA encoded by LOC196961, corresponding to a HOST TARGET binding site such as BINDING SITE I, BINDING SITE II or BINDING SITE III. Table 2 illustrates the complementarity of the nucleotide sequences of LOC196961 BINDING SITE, designated SEQ ID:42437, to the nucleotide sequence of VGAM39 RNA, herein designated VGAM RNA, also designated SEQ ID:2750.

Another function of VGAM39 is therefore inhibition of LOC196961 (Accession XM_113790). Accordingly, utilities of VGAM39 include diagnosis, prevention and treatment of diseases and clinical conditions associated with LOC196961.

LOC197138 (Accession XM_113829) is another VGAM39 host target gene. LOC197138 BINDING SITE is HOST TARGET binding site found in the 5' untranslated region of mRNA encoded by LOC197138, corresponding to a HOST TARGET binding site such as BINDING SITE I, BINDING SITE II or BINDING SITE III. Table 2 illustrates the complementarity of the nucleotide sequences of LOC197138 BINDING SITE, designated SEQ ID:42455, to the nucleotide sequence of VGAM39 RNA, herein designated VGAM RNA, also designated SEQ ID:2750.

Another function of VGAM39 is therefore inhibition of LOC197138 (Accession XM_113829). Accordingly, utilities of VGAM39 include diagnosis, prevention and treatment of diseases and clinical conditions associated with LOC197138.

LOC197414 (Accession XM_113880) is another VGAM39 host target gene. LOC197414 BINDING SITE is HOST TARGET binding site found in the 3' untranslated region of mRNA encoded by LOC197414, corresponding to a HOST TARGET binding site such as BINDING SITE I, BINDING SITE II or BINDING SITE III. Table 2 illustrates the complementarity of the nucleotide sequences of LOC197414 BINDING SITE, designated SEQ ID:42513, to the nucleotide sequence of VGAM39 RNA, herein designated VGAM RNA, also designated SEQ ID:2750.

Another function of VGAM39 is therefore inhibition of LOC197414 (Accession XM_113880). Accordingly, utilities of VGAM39 include diagnosis, prevention and treatment of diseases and clinical conditions associated with LOC197414.

LOC219406 (Accession XM_167976) is another VGAM39 host target gene. LOC219406 BINDING SITE is HOST TARGET binding site found in the 5' untranslated region of mRNA encoded by LOC219406, corresponding to a HOST TARGET binding site such as BINDING SITE I, BINDING SITE II or BINDING SITE III. Table 2 illustrates the complementarity of the nucleotide sequences of LOC219406 BINDING SITE, designated SEQ ID:44939, to the nucleotide sequence of VGAM39 RNA, herein designated VGAM RNA, also designated SEQ ID:2750.

Another function of VGAM39 is therefore inhibition of LOC219406 (Accession XM_167976). Accordingly, utilities of VGAM39 include diagnosis, prevention and treatment of diseases and clinical conditions associated with LOC219406.

LOC222486 (Accession XM_169432) is another VGAM39 host target gene. LOC222486 BINDING SITE is HOST TARGET binding site found in the 5' untranslated region of mRNA encoded by LOC222486, corresponding to a HOST TARGET binding site such as BINDING SITE I, BINDING SITE II or BINDING SITE III. Table 2 illustrates the complementarity of the nucleotide sequences of LOC222486 BINDING SITE, designated SEQ ID:45299, to the nucleotide sequence of VGAM39 RNA, herein designated VGAM RNA, also designated SEQ ID:2750.

Another function of VGAM39 is therefore inhibition of LOC222486 (Accession XM_169432). Accordingly, utilities of VGAM39 include diagnosis, prevention and treatment of diseases and clinical conditions associated with LOC222486.

LOC253731 (Accession XM_173777) is another VGAM39 host target gene. LOC253731 BINDING SITE is HOST TARGET binding site found in the 5' untranslated region of mRNA encoded by LOC253731, corresponding to a HOST TARGET binding site such as BINDING SITE I, BINDING SITE II or BINDING SITE III. Table 2 illustrates the complementarity of the nucleotide sequences of LOC253731 BINDING SITE, designated SEQ ID:46562, to the nucleotide sequence of VGAM39 RNA, herein designated VGAM RNA, also designated SEQ ID:2750.

Another function of VGAM39 is therefore inhibition of LOC253731 (Accession XM_173777). Accordingly, utilities of VGAM39 include diagnosis, prevention and treatment of diseases and clinical conditions associated with LOC253731.

LOC255461 (Accession XM_173207) is another VGAM39 host target gene. LOC255461 BINDING SITE is HOST TARGET binding site found in the 5' untranslated region of mRNA encoded by LOC255461, corresponding to a HOST TARGET binding site such as BINDING SITE I, BINDING SITE II or BINDING SITE III. Table 2 illustrates the complementarity of the nucleotide sequences of LOC255461 BINDING SITE, designated SEQ ID:46464, to the nucleotide sequence of VGAM39 RNA, herein designated VGAM RNA, also designated SEQ ID:2750.

Another function of VGAM39 is therefore inhibition of LOC255461 (Accession XM_173207). Accordingly, utilities of VGAM39 include diagnosis, prevention and treatment of diseases and clinical conditions associated with LOC255461.

LOC255516 (Accession XM_173212) is another VGAM39 host target gene. LOC255516 BINDING SITE is HOST TARGET binding site found in the 5' untranslated region of mRNA encoded by LOC255516, corresponding to a HOST TARGET binding site such as BINDING SITE I, BINDING SITE II or BINDING SITE III. Table 2 illustrates the complementarity of the nucleotide sequences of LOC255516 BINDING SITE, designated SEQ ID:46470, to the nucleotide sequence of VGAM39 RNA, herein designated VGAM RNA, also designated SEQ ID:2750.

Another function of VGAM39 is therefore inhibition of LOC255516 (Accession XM_173212). Accordingly, utilities of VGAM39 include diagnosis, prevention and treatment of diseases and clinical conditions associated with LOC255516.

LOC92095 (Accession XM_042811) is another VGAM39 host target gene. LOC92095 BINDING SITE is HOST TARGET binding site found in the 3' untranslated region of mRNA encoded by LOC92095, corresponding to a HOST TARGET binding site such as BINDING SITE I, BINDING SITE II or BINDING SITE III. Table 2 illustrates the complementarity of the nucleotide sequences of LOC92095 BINDING SITE, designated SEQ ID:33773, to the nucleotide sequence of VGAM39 RNA, herein designated VGAM RNA, also designated SEQ ID:2750.

Another function of VGAM39 is therefore inhibition of LOC92095 (Accession XM_042811). Accordingly, utilities of VGAM39 include diagnosis, prevention and treatment of diseases and clinical conditions associated with LOC92095.

LOC92096 (Accession XM_042812) is another VGAM39 host target gene. LOC92096 BINDING SITE is HOST TARGET binding site found in the 3' untranslated region of mRNA encoded by LOC92096, corresponding to a HOST TARGET binding site such as BINDING SITE I, BINDING SITE II or BINDING SITE III. Table 2 illustrates the complementarity of the nucleotide sequences of LOC92096 BINDING SITE, designated SEQ ID:33776, to the nucleotide sequence of VGAM39 RNA, herein designated VGAM RNA, also designated SEQ ID:2750.

Another function of VGAM39 is therefore inhibition of LOC92096 (Accession XM_042812). Accordingly, utilities of VGAM39 include diagnosis, prevention and treatment of diseases and clinical conditions associated with LOC92096.

FIG. 1 further provides a conceptual description of a novel bioinformatically detected viral gene of the present invention, referred to here as Viral Genomic Address Messenger 40 (VGAM40) viral gene, which modulates expression of respective host target genes thereof, the function and utility of which host target genes is known in the art.

VGAM40 is a novel bioinformatically detected regulatory, non protein coding, viral micro RNA (miRNA) gene. The method by which VGAM40 was detected is described hereinabove with reference to FIGS. 1-8.

VGAM40 gene, herein designated VGAM GENE, is a viral gene contained in the genome of Invertebrate Iridescent Virus 6. VGAM40 host target gene, herein designated VGAM HOST TARGET GENE, is a human gene contained in the human genome.

VGAM40 gene encodes a VGAM40 precursor RNA, herein designated VGAM PRECURSOR RNA. Similar to other miRNA genes, and unlike most ordinary genes, VGAM40 precursor RNA does not encode a protein. A nucleotide sequence identical or highly similar to the nucleotide sequence of VGAM40 precursor RNA is designated SEQ ID:26, and is provided hereinbelow with reference to the sequence listing part. Nucleotide sequence SEQ ID:26 is located at position 36563 relative to the genome of Invertebrate Iridescent Virus 6.

VGAM40 precursor RNA folds onto itself, forming VGAM40 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM40 folded precursor RNA into VGAM40 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM40 RNA is designated SEQ ID:2751, and is provided hereinbelow with reference to the sequence listing part.

VGAM40 host target gene, herein designated VGAM HOST TARGET GENE, encodes a corresponding messenger RNA, VGAM40 host target RNA, herein designated VGAM HOST TARGET RNA. VGAM40 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM40 RNA, herein designated VGAM RNA, binds complementarily to one or more host target binding sites located in untranslated regions of VGAM40 host target RNA, herein designated VGAM HOST TARGET RNA. This complementary binding is due to the fact that the nucleotide sequence of VGAM40 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM40 RNA, herein designated VGAM RNA, may have a different number of host target binding sites in untranslated regions of a VGAM40 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM40 RNA, herein designated VGAM RNA, to host target binding sites on VGAM40 host target RNA, herein designated VGAM HOST TARGET RNA, such as BINDING SITE I, BINDING SITE II and BINDING SITE III, inhibits translation of VGAM40 host target RNA into VGAM40 host target protein, herein designated VGAM HOST TARGET PROTEIN. VGAM host target protein is therefore outlined by a broken line.

It is appreciated that VGAM40 host target gene, herein designated VGAM HOST TARGET GENE, in fact represents a plurality of VGAM40 host target genes. The mRNA of each one of this plurality of VGAM40 host target genes comprises one or more host target binding sites, each having a nucleotide sequence which is at least partly complementary to VGAM40 RNA, herein designated VGAM RNA, and which when bound by VGAM40 RNA causes inhibition of translation of respective one or more VGAM40 host target proteins.

It is further appreciated by one skilled in the art that the mode of translational inhibition illustrated by FIG. 1 with specific reference to translational inhibition exerted by VGAM40 gene, herein designated VGAM GENE, on one or more VGAM40 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM40 is inhibition of expression of host target genes, as part of a novel viral mechanism of attacking a host. Accordingly, utilities of VGAM40 include diagnosis, prevention and treatment of viral infection by Invertebrate Iridescent Virus 6. Specific functions, and accordingly utilities, of VGAM40 correlate with, and may be deduced from, the identity of the host target genes which VGAM40 binds and inhibits, and the function of these host target genes, as elaborated hereinbelow.

Nucleotide sequences of the VGAM40 precursor RNA, herein designated VGAM PRECURSOR RNA, and of the 'diced' VGAM40 RNA, herein designated VGAM RNA, and a schematic representation of the secondary folding of VGAM40 folded precursor RNA, herein designated VGAM FOLDED PRECURSOR RNA, of VGAM40 are further described hereinbelow with reference to Table 1.

Nucleotide sequences of host target binding sites, such as BINDING SITE-I, BINDING SITE-II and BINDING SITE-III of FIG. 1, found on VGAM40 host target RNA, and schematic representation of the complementarity of each of these host target binding sites to VGAM40 RNA, herein designated VGAM RNA, are described hereinbelow with reference to Table 2.

As mentioned hereinabove with reference to FIG. 1, a function of VGAM40 gene, herein designated VGAM is inhibition of expression of VGAM40 target genes. It is appreciated that specific functions, and accordingly utilities, of VGAM40 correlate with, and may be deduced from, the identity of the target genes which VGAM40 binds and inhibits, and the function of these target genes, as elaborated hereinbelow.

Aldehyde Dehydrogenase 1 Family, Member B1 (ALDH1B1, Accession NM_000692) is a VGAM40 host target gene. ALDH1B1 BINDING SITE is HOST TARGET binding site found in the 3' untranslated region of mRNA encoded by ALDH1B1, corresponding to a HOST TARGET binding site such as BINDING SITE I, BINDING SITE II or BINDING SITE III. Table 2 illustrates the complementarity of the nucleotide sequences of ALDH1B1 BINDING SITE, designated SEQ ID:6348, to the nucleotide sequence of VGAM40 RNA, herein designated VGAM RNA, also designated SEQ ID:2751.

A function of VGAM40 is therefore inhibition of Aldehyde Dehydrogenase 1 Family, Member B1 (ALDH1B1, Accession NM_000692). Accordingly, utilities of VGAM40 include diagnosis, prevention and treatment of diseases and clinical conditions associated with ALDH1B1. Mel Transforming Oncogene (derived from cell line NK14)- RAB8 Homolog (MEL, Accession NM_005370) is another VGAM40 host target gene. MEL BINDING SITE is HOST TARGET binding site found in the 3' untranslated region of mRNA encoded by MEL, corresponding to a HOST TARGET binding site such as BINDING SITE I, BINDING SITE II or BINDING SITE III. Table 2 illustrates the complementarity of the nucleotide sequences of MEL BINDING SITE, designated SEQ ID:11842, to the nucleotide sequence of VGAM40 RNA, herein designated VGAM RNA, also designated SEQ ID:2751.

Another function of VGAM40 is therefore inhibition of Mel Transforming Oncogene (derived from cell line NK14)- RAB8 Homolog (MEL, Accession NM_005370), a gene which may be involved in vesicular trafficking and neurotransmitter release. Accordingly, utilities of VGAM40 include diagnosis, prevention and treatment of diseases and clinical conditions associated with MEL. The function of MEL has been established by previous studies. Members of the RAS superfamily are small GTP/GDP-binding proteins with an average size of 200 amino acids. The RAS-related proteins of the RAB/YPT family may play a role in the transport of proteins from the endoplasmic reticulum to the Golgi and the plasma membrane. See RAB5 (OMIM Ref. No. 179512). Using DNA transfection into NIH 3T3 cells, Padua et al. (1984) demonstrated that the human malignant melanoma cell line NK14 contains a novel transforming gene. Nimmo et al. (1991) isolated human MEL genomic clones and cDNAs, as well as a cDNA encoding the mouse MEL homolog. The predicted 206-amino acid human MEL protein shares 97%, 96%, and 51% identity with the dog RAB8, mouse MEL, and mouse YPT1 (RAB1; 179508) proteins, respectively. MEL contains the 4 GTP/GDP-binding sites that are present in all the RAS proteins. The putative effector-binding site of MEL is similar to that of the RAB/YPT proteins. However, MEL contains a C-terminal CAAX motif that is characteristic of many RAS superfamily members but which is not found in YPT1 and the majority of RAB proteins. Although MEL was isolated as a transforming gene from a melanoma cell line, no linkage between MEL and malignant melanoma (OMIM Ref. No. 155600) was demonstrable (Nimmo et al., 1989). As a result of studies of human-mouse and human-hamster somatic cell hybrids, Spurr et al. (1986) demonstrated that the MEL oncogene is located in the segment 19p13.2-q13.2. By linkage analysis using an NcoI RFLP, Nimmo et al. (1989, 1989) mapped the MEL gene to the region of LDLR (OMIM Ref. No. 606945), i.e., 19p13.2-cen. Nimmo et al. (1991) noted that the human RAB3A (OMIM Ref. No. 179490) gene has been localized to 19p13.2. Bahler et al. (1997) performed cosmid contig mapping indicating that the MEL locus was 800 kb distal to MY09B (OMIM Ref. No. 602129) on chromosome 19p13.1.

Full details of the abovementioned studies are described in the following publications, the disclosure of which are hereby incorporated by reference:

Padua, R. A.; Barrass, N.; Currie, G. A.: A novel transforming gene in a human malignant melanoma cell line. Nature 311:671-673, 1984; and Nimmo, E. R.; Sanders, P. G.; Padua, R. A.; Hughes, D.; Williamson, R.; Johnson, K. J.: The MEL gene: a new member of the RAB/YPT class of RAS-related genes. Oncogene 6:1347-1351, 1991.

Further studies establishing the function and utilities of MEL are found in John Hopkins OMIM database record ID 165040, and in sited publications numbered 402 and 11533-11537 listed in the bibliography section hereinbelow, which are also hereby incorporated by reference. Ubiquitination Factor E4B (UFD2 homolog, yeast) (UBE4B, Accession NM_006048) is another VGAM40 host target gene. UBE4B BINDING SITE is HOST TARGET binding site found in the 3' untranslated region of mRNA encoded by UBE4B, corresponding to a HOST TARGET binding site such as BINDING SITE I, BINDING SITE II or BINDING SITE III. Table 2 illustrates the complementarity of the nucleotide sequences of UBE4B BINDING SITE, designated SEQ ID:12681, to the nucleotide sequence of VGAM40 RNA, herein designated VGAM RNA, also designated SEQ ID:2751.

Another function of VGAM40 is therefore inhibition of Ubiquitination Factor E4B (UFD2 homolog, yeast) (UBE4B, Accession NM_006048). Accordingly, utilities of VGAM40 include diagnosis, prevention and treatment of diseases and clinical conditions associated with UBE4B. LOC146517 (Accession XM_085491) is another VGAM40 host target gene. LOC146517 BINDING SITE is HOST TARGET binding site found in the 3' untranslated region of mRNA encoded by LOC146517, corresponding to a HOST TARGET binding site such as BINDING SITE I, BINDING SITE II or BINDING SITE III. Table 2 illustrates the complementarity of the nucleotide sequences of LOC146517 BINDING SITE, designated SEQ ID:38181, to the nucleotide sequence of VGAM40 RNA, herein designated VGAM RNA, also designated SEQ ID:2751.

Another function of VGAM40 is therefore inhibition of LOC146517 (Accession XM_085491). Accordingly, utilities of VGAM40 include diagnosis, prevention and treatment of diseases and clinical conditions associated with LOC146517. LOC158230 (Accession XM_088517) is another VGAM40 host target gene. LOC158230 BINDING SITE is HOST TARGET binding site found in the 3' untranslated region of mRNA encoded by LOC158230, corresponding to a HOST TARGET binding site such as BINDING SITE I, BINDING SITE II or BINDING SITE III. Table 2 illustrates the complementarity of the nucleotide sequences of LOC158230 BINDING SITE, designated SEQ ID:39765, to the nucleotide sequence of VGAM40 RNA, herein designated VGAM RNA, also designated SEQ ID:2751.

Another function of VGAM40 is therefore inhibition of LOC158230 (Accession XM_088517). Accordingly, utilities of VGAM40 include diagnosis, prevention and treatment of diseases and clinical conditions associated with LOC158230. LOC204970 (Accession XM_114795) is another VGAM40 host target gene. LOC204970 BINDING SITE is HOST TARGET binding site found in the 5' untranslated region of mRNA encoded by LOC204970, corresponding to a HOST TARGET binding site such as BINDING SITE I, BINDING SITE II or BINDING SITE III. Table 2 illustrates the complementarity of the nucleotide sequences of LOC204970 BIND- ING SITE, designated SEQ ID:43067, to the nucleotide sequence of VGAM40 RNA, herein designated VGAM RNA, also designated SEQ ID:2751.

Another function of VGAM40 is therefore inhibition of LOC204970 (Accession XM_114795). Accordingly, utilities of VGAM40 include diagnosis, prevention and treatment of diseases and clinical conditions associated with LOC204970. LOC254065 (Accession XM_173239) is another VGAM40 host target gene. LOC254065 BINDING SITE is HOST TARGET binding site found in the 5' untranslated region of mRNA encoded by LOC254065, corresponding to a HOST TARGET binding site such as BINDING SITE I, BINDING SITE II or BINDING SITE III. Table 2 illustrates the complementarity of the nucleotide sequences of LOC254065 BINDING SITE, designated SEQ ID:46521, to the nucleotide sequence of VGAM40 RNA, herein designated VGAM RNA, also designated SEQ ID:2751.

Another function of VGAM40 is therefore inhibition of LOC254065 (Accession XM_173239). Accordingly, utilities of VGAM40 include diagnosis, prevention and treatment of diseases and clinical conditions associated with LOC254065.

FIG. 1 further provides a conceptual description of a novel bioinformatically detected viral gene of the present invention, referred to here as Viral Genomic Address Messenger 41 (VGAM41) viral gene, which modulates expression of respective host target genes thereof, the function and utility of which host target genes is known in the art.

VGAM41 is a novel bioinformatically detected regulatory, non protein coding, viral micro RNA (miRNA) gene. The method by which VGAM41 was detected is described hereinabove with reference to FIGS. 1-8.

VGAM41 gene, herein designated VGAM GENE, is a viral gene contained in the genome of Invertebrate Iridescent Virus 6. VGAM41 host target gene, herein designated VGAM HOST TARGET GENE, is a human gene contained in the human genome.

VGAM41 gene encodes a VGAM41 precursor RNA, herein designated VGAM PRECURSOR RNA. Similar to other miRNA genes, and unlike most ordinary genes, VGAM41 precursor RNA does not encode a protein. A nucleotide sequence identical or highly similar to the nucleotide sequence of VGAM41 precursor RNA is designated SEQ ID:27, and is provided hereinbelow with reference to the sequence listing part. Nucleotide sequence SEQ ID:27 is located at position 108544 relative to the genome of Invertebrate Iridescent Virus 6.

VGAM41 precursor RNA folds onto itself, forming VGAM41 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM41 folded precursor RNA into VGAM41 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM41 RNA is designated SEQ ID:2752, and is provided hereinbelow with reference to the sequence listing part.

VGAM41 host target gene, herein designated VGAM HOST TARGET GENE, encodes a corresponding messenger RNA, VGAM41 host target RNA, herein designated VGAM HOST TARGET RNA. VGAM41 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM41 RNA, herein designated VGAM RNA, binds complementarily to one or more host target binding sites located in untranslated regions of VGAM41 host target RNA, herein designated VGAM HOST TARGET RNA. This complementary binding is due to the fact that the nucleotide sequence of VGAM41 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM41 RNA, herein designated VGAM RNA, may have a different number of host target binding sites in untranslated regions of a VGAM41 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM41 RNA, herein designated VGAM RNA, to host target binding sites on VGAM41 host target RNA, herein designated VGAM HOST TARGET RNA, such as BINDING SITE I, BINDING SITE II and BINDING SITE III, inhibits translation of VGAM41 host target RNA into VGAM41 host target protein, herein designated VGAM HOST TARGET PROTEIN. VGAM host target protein is therefore outlined by a broken line.

It is appreciated that VGAM41 host target gene, herein designated VGAM HOST TARGET GENE, in fact represents a plurality of VGAM41 host target genes. The mRNA of each one of this plurality of VGAM41 host target genes comprises one or more host target binding sites, each having a nucleotide sequence which is at least partly complementary to VGAM41 RNA, herein designated VGAM RNA, and which when bound by VGAM41 RNA causes inhibition of translation of respective one or more VGAM41 host target proteins.

It is further appreciated by one skilled in the art that the mode of translational inhibition illustrated by FIG. 1 with specific reference to translational inhibition exerted by VGAM41 gene, herein designated VGAM GENE, on one or more VGAM41 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM41 is inhibition of expression of host target genes, as part of a novel viral mechanism of attacking a host. Accordingly, utilities of VGAM41 include diagnosis, prevention and treatment of viral infection by Invertebrate Iridescent Virus 6. Specific functions, and accordingly utilities, of VGAM41 correlate with, and may be deduced from, the identity of the host target genes which VGAM41 binds and inhibits, and the function of these host target genes, as elaborated hereinbelow.

Nucleotide sequences of the VGAM41 precursor RNA, herein designated VGAM PRECURSOR RNA, and of the 'diced' VGAM41 RNA, herein designated VGAM RNA, and a schematic representation of the secondary folding of VGAM41 folded precursor RNA, herein designated VGAM FOLDED PRECURSOR RNA, of VGAM41 are further described hereinbelow with reference to Table 1.

Nucleotide sequences of host target binding sites, such as BINDING SITE-I, BINDING SITE-II and BINDING SITE-III of FIG. 1, found on VGAM41 host target RNA, and schematic representation of the complementarity of each of these host target binding sites to VGAM41 RNA, herein designated VGAM RNA, are described hereinbelow with reference to Table 2.

As mentioned hereinabove with reference to FIG. 1, a function of VGAM41 gene, herein designated VGAM is inhibition of expression of VGAM41 target genes. It is appreciated that specific functions, and accordingly utilities, of VGAM41 correlate with, and may be deduced from, the identity of the target genes which VGAM41 binds and inhibits, and the function of these target genes, as elaborated hereinbelow.

Erythroblast Membrane-associated Protein (ERMAP, Accession NM_018538) is a VGAM41 host target gene. ERMAP BINDING SITE is HOST TARGET binding site found in the 3' untranslated region of mRNA encoded by ERMAP, corresponding to a HOST TARGET binding site such as BINDING SITE I, BINDING SITE II or BINDING SITE III. Table 2 illustrates the complementarity of the nucleotide sequences of ERMAP BINDING SITE, designated SEQ ID:20607, to the nucleotide sequence of VGAM41 RNA, herein designated VGAM RNA, also designated SEQ ID:2752.

A function of VGAM41 is therefore inhibition of Erythroblast Membrane-associated Protein (ERMAP, Accession NM_018538). Accordingly, utilities of VGAM41 include diagnosis, prevention and treatment of diseases and clinical conditions associated with ERMAP. Rab11-FIP3 (Accession NM_014700) is another VGAM41 host target gene. Rab11-FIP3 BINDING SITE is HOST TARGET binding site found in the 3' untranslated region of mRNA encoded by Rab11-FIP3, corresponding to a HOST TARGET binding site such as BINDING SITE I, BINDING SITE II or BINDING SITE III. Table 2 illustrates the complementarity of the nucleotide sequences of Rab11-FIP3 BINDING SITE, designated SEQ ID:16226, to the nucleotide sequence of VGAM41 RNA, herein designated VGAM RNA, also designated SEQ ID:2752.

Another function of VGAM41 is therefore inhibition of Rab11-FIP3 (Accession NM_014700). Accordingly, utilities of VGAM41 include diagnosis, prevention and treatment of diseases and clinical conditions associated with Rab11-FIP3. LOC85028 (Accession NM_053040) is another VGAM41 host target gene. LOC85028 BINDING SITE is HOST TARGET binding site found in the 5' untranslated region of mRNA encoded by LOC85028, corresponding to a HOST TARGET binding site such as BINDING SITE I, BINDING SITE II or BINDING SITE III. Table 2 illustrates the complementarity of the nucleotide sequences of LOC85028 BINDING SITE, designated SEQ ID:27584, to the nucleotide sequence of VGAM41 RNA, herein designated VGAM RNA, also designated SEQ ID:2752.

Another function of VGAM41 is therefore inhibition of LOC85028 (Accession NM_053040). Accordingly, utilities of VGAM41 include diagnosis, prevention and treatment of diseases and clinical conditions associated with LOC85028. FIG. 1 further provides a conceptual description of a novel bioinformatically detected viral gene of the present invention, referred to here as Viral Genomic Address Messenger 42 (VGAM42) viral gene, which modulates expression of respective host target genes thereof, the function and utility of which host target genes is known in the art.

VGAM42 is a novel bioinformatically detected regulatory, non protein coding, viral micro RNA (miRNA) gene. The method by which VGAM42 was detected is described hereinabove with reference to FIGS. 1-8.

VGAM42 gene, herein designated VGAM GENE, is a viral gene contained in the genome of Invertebrate Iridescent Virus 6. VGAM42 host target gene, herein designated VGAM HOST TARGET GENE, is a human gene contained in the human genome.

VGAM42 gene encodes a VGAM42 precursor RNA, herein designated VGAM PRECURSOR RNA. Similar to other miRNA genes, and unlike most ordinary genes, VGAM42 precursor RNA does not encode a protein. A nucleotide sequence identical or highly similar to the nucleotide sequence of VGAM42 precursor RNA is designated SEQ ID:28, and is provided hereinbelow with reference to the sequence listing part. Nucleotide sequence SEQ ID:28 is located at position 82865 relative to the genome of Invertebrate Iridescent Virus 6.

VGAM42 precursor RNA folds onto itself, forming VGAM42 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM42 folded precursor RNA into VGAM42 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM42 RNA is designated SEQ ID:2753, and is provided hereinbelow with reference to the sequence listing part.

VGAM42 host target gene, herein designated VGAM HOST TARGET GENE, encodes a corresponding messenger RNA, VGAM42 host target RNA, herein designated VGAM HOST TARGET RNA. VGAM42 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM42 RNA, herein designated VGAM RNA, binds complementarily to one or more host target binding sites located in untranslated regions of VGAM42 host target RNA, herein designated VGAM HOST TARGET RNA. This complementary binding is due to the fact that the nucleotide sequence of VGAM42 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM42 RNA, herein designated VGAM RNA, may have a different number of host target binding sites in untranslated regions of a VGAM42 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM42 RNA, herein designated VGAM RNA, to host target binding sites on VGAM42 host target RNA, herein designated VGAM HOST TARGET RNA, such as BINDING SITE I, BINDING SITE II and BINDING SITE III, inhibits translation of VGAM42 host target RNA into VGAM42 host target protein, herein designated VGAM HOST TARGET PROTEIN. VGAM host target protein is therefore outlined by a broken line.

It is appreciated that VGAM42 host target gene, herein designated VGAM HOST TARGET GENE, in fact represents a plurality of VGAM42 host target genes. The mRNA of each one of this plurality of VGAM42 host target genes comprises one or more host target binding sites, each having a nucleotide sequence which is at least partly complementary to VGAM42 RNA, herein designated VGAM RNA, and which when bound by VGAM42 RNA causes inhibition of translation of respective one or more VGAM42 host target proteins.

It is further appreciated by one skilled in the art that the mode of translational inhibition illustrated by FIG. 1 with specific reference to translational inhibition exerted by VGAM42 gene, herein designated VGAM GENE, on one or more VGAM42 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM42 is inhibition of expression of host target genes, as part of a novel viral mechanism of attacking a host. Accordingly, utilities of VGAM42 include diagnosis, prevention and treatment of viral infection by Invertebrate Iridescent Virus 6. Specific functions, and accordingly utilities, of VGAM42 correlate with, and may be deduced from, the identity of the host target genes which VGAM42 binds and inhibits, and the function of these host target genes, as elaborated hereinbelow.

Nucleotide sequences of the VGAM42 precursor RNA, herein designated VGAM PRECURSOR RNA, and of the 'diced' VGAM42 RNA, herein designated VGAM RNA, and a schematic representation of the secondary folding of VGAM42 folded precursor RNA, herein designated VGAM FOLDED PRECURSOR RNA, of VGAM42 are further described hereinbelow with reference to Table 1.

Nucleotide sequences of host target binding sites, such as BINDING SITE-I, BINDING SITE-II and BINDING SITE-III of FIG. 1, found on VGAM42 host target RNA, and schematic representation of the complementarity of each of these host target binding sites to VGAM42 RNA, herein designated VGAM RNA, are described hereinbelow with reference to Table 2.

As mentioned hereinabove with reference to FIG. 1, a function of VGAM42 gene, herein designated VGAM is inhibition of expression of VGAM42 target genes. It is appreciated that specific functions, and accordingly utilities, of VGAM42 correlate with, and may be deduced from, the identity of the target genes which VGAM42 binds and inhibits, and the function of these target genes, as elaborated hereinbelow.

Clathrin, Heavy Polypeptide-like 1 (CLTCL1, Accession XM_033096) is a VGAM42 host target gene. CLTCL1 BINDING SITE is HOST TARGET binding site found in the 3' untranslated region of mRNA encoded by CLTCL1, corresponding to a HOST TARGET binding site such as BINDING SITE I, BINDING SITE II or BINDING SITE III. Table 2 illustrates the complementarity of the nucleotide sequences of CLTCL1 BINDING SITE, designated SEQ ID:31835, to the nucleotide sequence of VGAM42 RNA, herein designated VGAM RNA, also designated SEQ ID:2753.

A function of VGAM42 is therefore inhibition of Clathrin, Heavy Polypeptide-like 1 (CLTCL1, Accession XM_033096), a gene which is involved in vesicle budding. Accordingly, utilities of VGAM42 include diagnosis, prevention and treatment of diseases and clinical conditions associated with CLTCL1. The function of CLTCL1 has been established by previous studies. Clathrin is the main structural component of the lattice covering the cytoplasmic face of the coated pits and coated vesicles in which specific macromolecules are entrapped in the process of receptor-mediated endocytosis. Clathrin is a large, soluble protein composed of heavy chains (molecular size, about 192 kD) and light chains (molecular size, about 32-38 kD). Two major classes of clathrin light chains, referred to as LCA and LCB, have been identified. (The gene is also symbolized CLTA.) The structure of these light chains was studied by Kirchhausen et al. (1987). The clathrin unit that assembles into coats had 3 extended legs, 500 angstroms in length, splayed out in a pinwheel-like structure (triskelion). Each of the legs is built from a single heavy chain, with a light chain bound to each proximal segment. At least 4 distinct forms of clathrin light chains are found in mammalian cells. This molecular variability derives from tissue-specific patterns of expression of LCA and LCB genes (Jackson et al., 1987). Brodsky et al. (1987) identified that part of the light-chain sequence that mediates heavy-chain binding and is the region of strongest homology with intermediate filament proteins. Sequence analysis shows an overall homology of 60% between LCA and LCB and the presence of brain-specific insertion sequences. LCA and LCB (OMIM Ref. No. 118970) are coded by distinct genes. Jackson and Parham (1988) compared cDNAs encoding the brain and nonbrain forms of human LCA and LCB with their homologs in cow and rat. The significant differences that distinguish LCA from LCB and the brain from the nonbrain forms show remarkable preservation in all 3 species. Each clathrin triskelion consists of 3 heavy chains and 3 light chains. In the brain, tissue-specific mRNA splicing yields larger forms of LCA and LCB, containing additional insertion sequences of 30 and 18 amino acids, respectively By Southern blot analysis on genomic DNA extracted from a panel of mouse-human somatic cell hybrids and by isotopic in situ hybridization, Ponnambalam et al. (1994) assigned the CLTA gene to human 12q23-q24

Full details of the abovementioned studies are described in the following publications, the disclosure of which are hereby incorporated by reference:

Sirotkin, H.; Morrow, B.; DasGupta, R.; Goldberg, R.; Patanjali, S. R.; Shi, G.; Cannizzaro, L.; Shprintzen, R.; Weissman, S. M.; Kucherlapati, R.: Isolation of a new clathrin heavy chain gene with muscle-specific expression from the region commonly deleted in velo-cardio-facial syndrome. Hum. Molec. Genet. 5:617-624, 1996; and Long, K. R.; Trofatter, J. A.; Ramesh, V.; McCormick, M. K.; Buckler, A. J.: Cloning and characterization of a novel human clathrin heavy chain gene (CLTCL). Genomics 35:466-472, 1996.

Further studies establishing the function and utilities of CLTCL1 are found in John Hopkins OMIM database record ID 601273, and in sited publications numbered 9859-986 and 4066 listed in the bibliography section hereinbelow, which are also hereby incorporated by reference. Dual-specificity tyrosine-(Y)-phosphorylation Regulated Kinase 1A (DYRK1A, Accession NM_130436) is another VGAM42 host target gene. DYRK1A BINDING SITE is HOST TARGET binding site found in the 5' untranslated region of mRNA encoded by DYRK1A, corresponding to a HOST TARGET binding site such as BINDING SITE I, BINDING SITE II or BINDING SITE III. Table 2 illustrates the complementarity of the nucleotide sequences of DYRK1A BINDING SITE, designated SEQ ID:28188, to the nucleotide sequence of VGAM42 RNA, herein designated VGAM RNA, also designated SEQ ID:2753.

Another function of VGAM42 is therefore inhibition of Dual-specificity tyrosine-(Y)-phosphorylation Regulated Kinase 1A (DYRK1A, Accession NM_130436), a gene which regulates cell proliferation and may be involved in brain development. Accordingly, utilities of VGAM42 include diagnosis, prevention and treatment of diseases and clinical conditions associated with DYRK1A. The function of DYRK1A has been established by previous studies. Shindoh et al. (1996) performed exon trapping to find exons within YAC clones spanning the 2-Mb 'Down syndrome critical region' (OMIM Ref. No. 190685) of human chromosome 21. Of more than 160 exons isolated, they found 6 that had significant identity at the amino acid level to the Drosophila 'minibrain' gene. Using 1 of these exons as a probe, they cloned the full-length human cDNA from a human fetal brain cDNA library. Sequence analysis of this cDNA revealed an open reading frame encoding a polypeptide of 754 amino acids. Shindoh et al. (1996) stated that this gene, termed MNB by them, represents the human homolog of the Drosophila mnb gene and of the rat Dyrk gene. The rat Dyrk gene differs from it by only 4 amino acids. Northern blot analysis of MNB revealed 2 transcripts of 6.0 and 7.5 kb. The 6.0-kb transcript was found to be present in all tissues examined, with highest levels of expression in skeletal muscle, testis, fetal lung, and fetal kidney. The 7.5-kb transcript was found to be expressed at a relatively lower level and was found only in adult heart, placenta, spleen, and testis. Shindoh et al. (1996) concluded that the human MNB protein may play a significant role in a signaling pathway regulating cell proliferation and may be involved in normal brain development and in the pathogenesis of Down syndrome. Animal model experiments lend further support to the function of DYRK1A. Using Down syndrome as a model for complex trait analysis, Smith et al. (1997) sought to identify loci from 21q22.2 which, when present in an extra dose, contribute to learning abnormalities. They generated low-copy number transgenic mice, containing 4 different YACs that together cover approximately 2 Mb of contiguous DNA from 21q22.2. They subjected independent mouse lines derived from each of these YAC transgenes to a series of behavioral and learning assays. Two of the 4 YACs caused defects in learning and memory in the transgenic animals, while the other 2 YACs had no effect. The most severe defects were caused by a 570-kb YAC; the interval responsible for these defects was narrowed to a 180-kb critical region as a consequence of YAC fragmentation. This region was found to contain the human homolog of the Drosophila 'minibrain' gene, and strongly implicated it in learning defects associated with Down syndrome.

It is appreciated that the abovementioned animal model for DYRK1A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shindoh, N.; Kudoh, J.; Maeda, H.; Yamaki, A.; Minoshima, S.; Shimizu, Y.; Shimizu, N.: Cloning of a human homolog of the Drosophila minibrain/rat Dyrk gene from 'the Down syndrome critical region' of chromosome 21. Biochem. Biophys. Res. Commun. 225:92-99, 1996; and Smith, D. J.; Stevens, M. E.; Sudanagunta, S. P.; Bronson, R. T.; Makhinson, M.; Watabe, A. M.; O'Dell, T. J.; Fung, J.; Weier, H.-U. G.; Cheng, J.-F.; Rubin, E. M.: Functional screeni.

Further studies establishing the function and utilities of DYRK1A are found in John Hopkins OMIM database record ID 600855, and in sited publications numbered 774, 10065-10067, 1007 and 10071 listed in the bibliography section hereinbelow, which are also hereby incorporated by reference. Lipin 2 (LPIN2, Accession NM_014646) is another VGAM42 host target gene. LPIN2 BINDING SITE is HOST TARGET binding site found in the 3' untranslated region of mRNA encoded by LPIN2, corresponding to a HOST TARGET binding site such as BINDING SITE I, BINDING SITE II or BINDING SITE III. Table 2 illustrates the complementarity of the nucleotide sequences of LPIN2 BINDING SITE, designated SEQ ID:16063, to the nucleotide sequence of VGAM42 RNA, herein designated VGAM RNA, also designated SEQ ID:2753.

Another function of VGAM42 is therefore inhibition of Lipin 2 (LPIN2, Accession NM_014646). Accordingly, utilities of VGAM42 include diagnosis, prevention and treatment of diseases and clinical conditions associated with LPIN2. Osteomodulin (OMD, Accession NM_005014) is another VGAM42 host target gene. OMD BINDING SITE is HOST TARGET binding site found in the 3' untranslated region of mRNA encoded by OMD, corresponding to a HOST TARGET binding site such as BINDING SITE I, BINDING SITE II or BINDING SITE III. Table 2 illustrates the complementarity of the nucleotide sequences of OMD BINDING SITE, designated SEQ ID:11455, to the nucleotide sequence of VGAM42 RNA, herein designated VGAM RNA, also designated SEQ ID:2753.

Another function of VGAM42 is therefore inhibition of Osteomodulin (OMD, Accession NM_005014). Accordingly, utilities of VGAM42 include diagnosis, prevention and treatment of diseases and clinical conditions associated with OMD. Zinc Finger Protein 304 (ZNF304, Accession NM_020657) is another VGAM42 host target gene. ZNF304 BINDING SITE is HOST TARGET binding site found in the 3' untranslated region of mRNA encoded by ZNF304, corresponding to a HOST TARGET binding site such as BINDING SITE I, BINDING SITE II or BINDING SITE III. Table 2 illustrates the complementarity of the nucleotide sequences of ZNF304 BINDING SITE, designated SEQ ID:21828, to the nucleotide sequence of VGAM42 RNA, herein designated VGAM RNA, also designated SEQ ID:2753.

Another function of VGAM42 is therefore inhibition of Zinc Finger Protein 304 (ZNF304, Accession NM_020657). Accordingly, utilities of VGAM42 include diagnosis, prevention and treatment of diseases and clinical conditions associated with ZNF304. LOC150622 (Accession XM_086960) is another VGAM42 host target gene. LOC150622 BINDING SITE is HOST TARGET binding site found in the 5' untranslated region of mRNA encoded by LOC150622, corresponding to a HOST TARGET binding site such as BINDING SITE I, BINDING SITE II or BINDING SITE III. Table 2 illustrates the complementarity of the nucleotide sequences of LOC150622 BINDING SITE, designated SEQ ID:38998, to the nucleotide sequence of VGAM42 RNA, herein designated VGAM RNA, also designated SEQ ID:2753.

Another function of VGAM42 is therefore inhibition of LOC150622 (Accession XM_086960). Accordingly, utilities of VGAM42 include diagnosis, prevention and treatment of diseases and clinical conditions associated with LOC150622. LOC152925 (Accession XM_087559) is another VGAM42 host target gene. LOC152925 BINDING SITE is HOST TARGET binding site found in the 3' untranslated region of mRNA encoded by LOC152925, corresponding to a HOST TARGET binding site such as BINDING SITE I, BINDING SITE II or BINDING SITE III. Table 2 illustrates the complementarity of the nucleotide sequences of LOC152925 BINDING SITE, designated SEQ ID:39330, to the nucleotide sequence of VGAM42 RNA, herein designated VGAM RNA, also designated SEQ ID:2753.

Another function of VGAM42 is therefore inhibition of LOC152925 (Accession XM_087559). Accordingly, utilities of VGAM42 include diagnosis, prevention and treatment of diseases and clinical conditions associated with LOC152925. LOC205355 (Accession XM_119694) is another VGAM42 host target gene. LOC205355 BINDING SITE is HOST TARGET binding site found in the 5' untranslated region of mRNA encoded by LOC205355, corresponding to a HOST TARGET binding site such as BINDING SITE I, BINDING SITE II or BINDING SITE III. Table 2 illustrates the complementarity of the nucleotide sequences of LOC205355 BINDING SITE, designated SEQ ID:43596, to the nucleotide sequence of VGAM42 RNA, herein designated VGAM RNA, also designated SEQ ID:2753.

Another function of VGAM42 is therefore inhibition of LOC205355 (Accession XM_119694). Accordingly, utilities of VGAM42 include diagnosis, prevention and treatment of diseases and clinical conditions associated with LOC205355. LOC220766 (Accession XM_165471) is another VGAM42 host target gene. LOC220766 BINDING SITE is HOST TARGET binding site found in the 5' untranslated region of mRNA encoded by LOC220766, corresponding to a HOST TARGET binding site such as BINDING SITE I, BINDING SITE II or BINDING SITE III. Table 2 illustrates the complementarity of the nucleotide sequences of LOC220766 BINDING SITE, designated SEQ ID:43648, to the nucleotide sequence of VGAM42 RNA, herein designated VGAM RNA, also designated SEQ ID:2753.

Another function of VGAM42 is therefore inhibition of LOC220766 (Accession XM_165471). Accordingly, utilities of VGAM42 include diagnosis, prevention and treatment of diseases and clinical conditions associated with LOC220766. LOC92270 (Accession XM_043989) is another VGAM42 host target gene. LOC92270 BINDING SITE is HOST TARGET binding site found in the 5' untranslated region of mRNA encoded by LOC92270, corresponding to a HOST TARGET binding site such as BINDING SITE I, BINDING SITE II or BINDING SITE III. Table 2 illustrates the complementarity of the nucleotide sequences of LOC92270 BINDING SITE, designated SEQ ID:34062, to the nucleotide sequence of VGAM42 RNA, herein designated VGAM RNA, also designated SEQ ID:2753.

Another function of VGAM42 is therefore inhibition of LOC92270 (Accession XM_043989). Accordingly, utilities of VGAM42 include diagnosis, prevention and treatment of diseases and clinical conditions associated with LOC92270.

FIG. 1 further provides a conceptual description of a novel bioinformatically detected viral gene of the present invention, referred to here as Viral Genomic Address Messenger 43 (VGAM43) viral gene, which modulates expression of respective host target genes thereof, the function and utility of which host target genes is known in the art.

VGAM43 is a novel bioinformatically detected regulatory, non protein coding, viral micro RNA (miRNA) gene. The method by which VGAM43 was detected is described hereinabove with reference to FIGS. 1-8.

VGAM43 gene, herein designated VGAM GENE, is a viral gene contained in the genome of Invertebrate Iridescent Virus 6. VGAM43 host target gene, herein designated VGAM HOST TARGET GENE, is a human gene contained in the human genome.

VGAM43 gene encodes a VGAM43 precursor RNA, herein designated VGAM PRECURSOR RNA. Similar to other miRNA genes, and unlike most ordinary genes, VGAM43 precursor RNA does not encode a protein. A nucleotide sequence identical or highly similar to the nucleotide sequence of VGAM43 precursor RNA is designated SEQ ID:29, and is provided hereinbelow with reference to the sequence listing part. Nucleotide sequence SEQ ID:29 is located at position 189040 relative to the genome of Invertebrate Iridescent Virus 6.

VGAM43 precursor RNA folds onto itself, forming VGAM43 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM43 folded precursor RNA into VGAM43 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM43 RNA is designated SEQ ID:2754, and is provided hereinbelow with reference to the sequence listing part.

VGAM43 host target gene, herein designated VGAM HOST TARGET GENE, encodes a corresponding messenger RNA, VGAM43 host target RNA, herein designated VGAM HOST TARGET RNA. VGAM43 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM43 RNA, herein designated VGAM RNA, binds complementarily to one or more host target binding sites located in untranslated regions of VGAM43 host target RNA, herein designated VGAM HOST TARGET RNA. This complementary binding is due to the fact that the nucleotide sequence of VGAM43 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM43 RNA, herein designated VGAM RNA, may have a different number of host target binding sites in untranslated regions of a VGAM43 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM43 RNA, herein designated VGAM RNA, to host target binding sites on VGAM43 host target RNA, herein designated VGAM HOST TARGET RNA, such as BINDING SITE I, BINDING SITE II and BINDING SITE III, inhibits translation of VGAM43 host target RNA into VGAM43 host target protein, herein designated VGAM HOST TARGET PROTEIN. VGAM host target protein is therefore outlined by a broken line.

It is appreciated that VGAM43 host target gene, herein designated VGAM HOST TARGET GENE, in fact represents a plurality of VGAM43 host target genes. The mRNA of each one of this plurality of VGAM43 host target genes comprises one or more host target binding sites, each having a nucleotide sequence which is at least partly complementary to VGAM43 RNA, herein designated VGAM RNA, and which when bound by VGAM43 RNA causes inhibition of translation of respective one or more VGAM43 host target proteins.

It is further appreciated by one skilled in the art that the mode of translational inhibition illustrated by FIG. 1 with specific reference to translational inhibition exerted by VGAM43 gene, herein designated VGAM GENE, on one or more VGAM43 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM43 is inhibition of expression of host target genes, as part of a novel viral mechanism of attacking a host. Accordingly, utilities of VGAM43 include diagnosis, prevention and treatment of viral infection by Invertebrate Iridescent Virus 6. Specific functions, and accordingly utilities, of VGAM43 correlate with, and may be deduced from, the identity of the host target genes which VGAM43 binds and inhibits, and the function of these host target genes, as elaborated hereinbelow.

Nucleotide sequences of the VGAM43 precursor RNA, herein designated VGAM PRECURSOR RNA, and of the 'diced' VGAM43 RNA, herein designated VGAM RNA, and a schematic representation of the secondary folding of VGAM43 folded precursor RNA, herein designated VGAM FOLDED PRECURSOR RNA, of VGAM43 are further described hereinbelow with reference to Table 1.

Nucleotide sequences of host target binding sites, such as BINDING SITE-I, BINDING SITE-II and BINDING SITE-III of FIG. 1, found on VGAM43 host target RNA, and schematic representation of the complementarity of each of these host target binding sites to VGAM43 RNA, herein designated VGAM RNA, are described hereinbelow with reference to Table 2.

As mentioned hereinabove with reference to FIG. 1, a function of VGAM43 gene, herein designated VGAM is inhibition of expression of VGAM43 target genes. It is appreciated that specific functions, and accordingly utilities, of VGAM43 correlate with, and may be deduced from, the identity of the target genes which VGAM43 binds and inhibits, and the function of these target genes, as elaborated hereinbelow.

Mannosyl (alpha-1,6-)-glycoprotein Beta-1,6-N-acetyl-glucosaminyltransferase (MGAT5, Accession NM_002410) is a VGAM43 host target gene. MGAT5 BINDING SITE is HOST TARGET binding site found in the 5' untranslated region of mRNA encoded by MGAT5, corresponding to a HOST TARGET binding site such as BINDING SITE I, BINDING SITE II or BINDING SITE III. Table 2 illustrates the complementarity of the nucleotide sequences of MGAT5 BINDING SITE, designated SEQ ID:8237, to the nucleotide sequence of VGAM43 RNA, herein designated VGAM RNA, also designated SEQ ID:2754.

A function of VGAM43 is therefore inhibition of Mannosyl (alpha-1,6-)-glycoprotein Beta-1,6-N-acetyl-glucosaminyltransferase (MGAT5, Accession NM_002410). Accordingly, utilities of VGAM43 include diagnosis, prevention and treatment of diseases and clinical conditions associated with MGAT5. Tyrosine 3-monooxygenase/tryptophan 5-monooxygenase Activation Protein, Zeta Polypeptide (YWHAZ, Accession NM_003406) is another VGAM43 host target gene. YWHAZ BINDING SITE is HOST TARGET binding site found in the 3' untranslated region of mRNA encoded by YWHAZ, corresponding to a HOST TARGET binding site such as BINDING SITE I, BINDING SITE II or BINDING SITE III. Table 2 illustrates the complementarity of the nucleotide sequences of YWHAZ BINDING SITE, designated SEQ ID:9443, to the nucleotide sequence of VGAM43 RNA, herein designated VGAM RNA, also designated SEQ ID:2754.

Another function of VGAM43 is therefore inhibition of Tyrosine 3-monooxygenase/tryptophan 5-monooxygenase Activation Protein, Zeta Polypeptide (YWHAZ, Accession NM_003406), a gene which mediates signal transduction by binding to phosphorylated serine residues on a variety of signaling molecules. Accordingly, utilities of VGAM43 include diagnosis, prevention and treatment of diseases and clinical conditions associated with YWHAZ. The function of YWHAZ has been established by previous studies. The binding of insulin (OMIM Ref. No. 176730) to its receptor induces the phosphorylation of the cytosolic substrates IRS1 (OMIM Ref. No. 147545) and IRS2 (OMIM Ref. No. 600797), which associate with several Src homology-2 (SH2) domain-containing proteins. To identify unique IRS1-binding proteins, Ogihara et al. (1997) screened a human heart cDNA expression library with recombinant IRS1. They obtained 2 isoforms of the 14-3-3 protein family, 14-3-3-zeta and -epsilon (YWHAE; 605066). 14-3-3 protein has been shown to associate with IRS1 in L6 myotubes, HepG2 hepatoma cells, Chinese hamster ovary cells, and bovine brain tissue. The amount of 14-3-3 protein associated with IRS1 was not affected by insulin stimulation but was increased significantly by treatment with okadaic acid, a potent serine/threonine phosphatase inhibitor. The authors identified a putative 14-3-3 protein-binding site within the phosphotyrosine-binding (PTB) domain of IRS1. Ogihara et al. (1997) suggested that the association with 14-3-3 protein may play a role in the regulation of insulin sensitivity by interrupting the association between the insulin receptor and IRS1. Using in vitro pull-down assays, Powell et al. (2002) showed that recombinant 14-3-3-zeta interacted directly with both recombinant and endogenous protein kinase B (PKB, or AKT1; 164730) within embryonic kidney cell lysates. They found that recombinant PKB phosphorylated 14-3-3-zeta in an in vitro kinase assay, and transfection of active PKB into embryonic kidney cells resulted in phosphorylation of 14-3-3-zeta. By mutation analysis, Powell et al. (2002) determined that the phosphate acceptor was serine-58. They also showed that phosphorylation did not result in 14-3-3-zeta dimerization.

Full details of the abovementioned studies are described in the following publications, the disclosure of which are hereby incorporated by reference:

Ogihara, T.; Isobe, T.; Ichimura, T.; Taoka, M.; Funaki, M.; Sakoda, H.; Onishi, Y.; Inukai, K.; Anai, M.; Fukushima, Y.; Kikuchi, M.; Yazaki, Y.; Oka, Y.; Asano, T.: 14-3-3 protein binds to insulin receptor substrate-1, one of the binding sites of which is in the phosphotyrosine binding domain. J. Biol. Chem. 272:25267-25274, 1997; and Powell, D. W.; Rane, M. J.; Chen, Q.; Singh, S.; McLeish, K. R.: Identification of 14-3-3-zeta as a protein kinase B/Akt substrate. J. Biol. Chem. 277:21639-21642, 2002.

Further studies establishing the function and utilities of YWHAZ are found in John Hopkins OMIM database record ID 601288, and in sited publications numbered 6379-6380, 4469, 1122 and 4192 listed in the bibliography section hereinbelow, which are also hereby incorporated by reference. Leucine-rich Repeat Protein, Neuronal 3 (LRRN3, Accession XM_045261) is another VGAM43 host target gene. LRRN3 BINDING SITE is HOST TARGET binding site found in the 5' untranslated region of mRNA encoded by LRRN3, corresponding to a HOST TARGET binding site such as BINDING SITE I, BINDING SITE II or BINDING SITE III. Table 2 illustrates the complementarity of the nucleotide sequences of LRRN3 BINDING SITE, designated SEQ ID:34399, to the nucleotide sequence of VGAM43 RNA, herein designated VGAM RNA, also designated SEQ ID:2754.

Another function of VGAM43 is therefore inhibition of Leucine-rich Repeat Protein, Neuronal 3 (LRRN3, Accession XM_045261). Accordingly, utilities of VGAM43 include diagnosis, prevention and treatment of diseases and clinical conditions associated with LRRN3. SCDGF-B (Accession NM_025208) is another VGAM43 host target gene. SCDGF-B BINDING SITE1 and SCDGF-B BINDING SITE2 are HOST TARGET binding sites found in untranslated regions of mRNA encoded by SCDGF-B, corresponding to HOST TARGET binding sites such as BINDING SITE I, BINDING SITE II or BINDING SITE III. Table 2 illustrates the complementarity of the nucleotide sequences of SCDGF-B BINDING SITE1 and SCDGF-B BINDING SITE2, designated SEQ ID:24881 and SEQ ID:26983 respectively, to the nucleotide sequence of VGAM43 RNA, herein designated VGAM RNA, also designated SEQ ID:2754.

Another function of VGAM43 is therefore inhibition of SCDGF-B (Accession NM_025208). Accordingly, utilities of VGAM43 include diagnosis, prevention and treatment of diseases and clinical conditions associated with SCDGF-B. FIG. 1 further provides a conceptual description of a novel bioinformatically detected viral gene of the present invention, referred to here as Viral Genomic Address Messenger 44 (VGAM44) viral gene, which modulates expression of respective host target genes thereof, the function and utility of which host target genes is known in the art.

VGAM44 is a novel bioinformatically detected regulatory, non protein coding, viral micro RNA (miRNA) gene. The method by which VGAM44 was detected is described hereinabove with reference to FIGS. 1-8.

VGAM44 gene, herein designated VGAM GENE, is a viral gene contained in the genome of Invertebrate Iridescent Virus 6. VGAM44 host target gene, herein designated VGAM HOST TARGET GENE, is a human gene contained in the human genome.

VGAM44 gene encodes a VGAM44 precursor RNA, herein designated VGAM PRECURSOR RNA. Similar to other miRNA genes, and unlike most ordinary genes, VGAM44 precursor RNA does not encode a protein. A nucleotide sequence identical or highly similar to the nucleotide sequence of VGAM44 precursor RNA is designated SEQ ID:30, and is provided hereinbelow with reference to the sequence listing part. Nucleotide sequence SEQ ID:30 is located at position 117574 relative to the genome of Invertebrate Iridescent Virus 6.

VGAM44 precursor RNA folds onto itself, forming VGAM44 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM44 folded precursor RNA into VGAM44 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM44 RNA is designated SEQ ID:2755, and is provided hereinbelow with reference to the sequence listing part.

VGAM44 host target gene, herein designated VGAM HOST TARGET GENE, encodes a corresponding messenger RNA, VGAM44 host target RNA, herein designated VGAM HOST TARGET RNA. VGAM44 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM44 RNA, herein designated VGAM RNA, binds complementarily to one or more host target binding sites located in untranslated regions of VGAM44 host target RNA, herein designated VGAM HOST TARGET RNA. This complementary binding is due to the fact that the nucleotide sequence of VGAM44 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM44 RNA, herein designated VGAM RNA, may have a different number of host target binding sites in untranslated regions of a VGAM44 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM44 RNA, herein designated VGAM RNA, to host target binding sites on VGAM44 host target RNA, herein designated VGAM HOST TARGET RNA, such as BINDING SITE I, BINDING SITE II and BINDING SITE III, inhibits translation of VGAM44 host target RNA into VGAM44 host target protein, herein designated VGAM HOST TARGET PROTEIN. VGAM host target protein is therefore outlined by a broken line.

It is appreciated that VGAM44 host target gene, herein designated VGAM HOST TARGET GENE, in fact represents a plurality of VGAM44 host target genes. The mRNA of each one of this plurality of VGAM44 host target genes comprises one or more host target binding sites, each having a nucleotide sequence which is at least partly complementary to VGAM44 RNA, herein designated VGAM RNA, and which when bound by VGAM44 RNA causes inhibition of translation of respective one or more VGAM44 host target proteins.

It is further appreciated by one skilled in the art that the mode of translational inhibition illustrated by FIG. 1 with specific reference to translational inhibition exerted by VGAM44 gene, herein designated VGAM GENE, on one or more VGAM44 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM44 is inhibition of expression of host target genes, as part of a novel viral mechanism of attacking a host. Accordingly, utilities of VGAM44 include diagnosis, prevention and treatment of viral infection by Invertebrate Iridescent Virus 6. Specific functions, and accordingly utilities, of VGAM44 correlate with, and may be deduced from, the identity of the host target genes which VGAM44 binds and inhibits, and the function of these host target genes, as elaborated hereinbelow.

Nucleotide sequences of the VGAM44 precursor RNA, herein designated VGAM PRECURSOR RNA, and of the ‘diced’ VGAM44 RNA, herein designated VGAM RNA, and a schematic representation of the secondary folding of VGAM44 folded precursor RNA, herein designated VGAM FOLDED PRECURSOR RNA, of VGAM44 are further described hereinbelow with reference to Table 1.

Nucleotide sequences of host target binding sites, such as BINDING SITE-I, BINDING SITE-II and BINDING SITE-III of FIG. 1, found on VGAM44 host target RNA, and schematic representation of the complementarity of each of these host target binding sites to VGAM44 RNA, herein designated VGAM RNA, are described hereinbelow with reference to Table 2.

As mentioned hereinabove with reference to FIG. 1, a function of VGAM44 gene, herein designated VGAM is inhibition of expression of VGAM44 target genes. It is appreciated that specific functions, and accordingly utilities, of VGAM44 correlate with, and may be deduced from, the identity of the target genes which VGAM44 binds and inhibits, and the function of these target genes, as elaborated hereinbelow.

LOC132671 (Accession NM_145263) is a VGAM44 host target gene. LOC132671 BINDING SITE is HOST TARGET binding site found in the 3' untranslated region of mRNA encoded by LOC132671, corresponding to a HOST TARGET binding site such as BINDING SITE I, BINDING SITE II or BINDING SITE III. Table 2 illustrates the complementarity of the nucleotide sequences of LOC132671 BINDING SITE, designated SEQ ID:29778, to the nucleotide sequence of VGAM44 RNA, herein designated VGAM RNA, also designated SEQ ID:2755.

A function of VGAM44 is therefore inhibition of LOC132671 (Accession NM_145263). Accordingly, utilities of VGAM44 include diagnosis, prevention and treatment of diseases and clinical conditions associated with LOC132671.

FIG. 1 further provides a conceptual description of a novel bioinformatically detected viral gene of the present invention, referred to here as Viral Genomic Address Messenger 45 (VGAM45) viral gene, which modulates expression of respective host target genes thereof, the function and utility of which host target genes is known in the art.

VGAM45 is a novel bioinformatically detected regulatory, non protein coding, viral micro RNA (miRNA) gene. The method by which VGAM45 was detected is described hereinabove with reference to FIGS. 1-8.

VGAM45 gene, herein designated VGAM GENE, is a viral gene contained in the genome of Invertebrate Iridescent Virus 6. VGAM45 host target gene, herein designated VGAM HOST TARGET GENE, is a human gene contained in the human genome.

VGAM45 gene encodes a VGAM45 precursor RNA, herein designated VGAM PRECURSOR RNA. Similar to other miRNA genes, and unlike most ordinary genes, VGAM45 precursor RNA does not encode a protein. A nucleotide sequence identical or highly similar to the nucleotide sequence of VGAM45 precursor RNA is designated SEQ ID:31, and is provided hereinbelow with reference to the sequence listing part. Nucleotide sequence SEQ ID:31 is located at position 169711 relative to the genome of Invertebrate Iridescent Virus 6.

VGAM45 precursor RNA folds onto itself, forming VGAM45 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM45 folded precursor RNA into VGAM45 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 50%) nucleotide sequence of VGAM45 RNA is designated SEQ ID:2756, and is provided hereinbelow with reference to the sequence listing part.

VGAM45 host target gene, herein designated VGAM HOST TARGET GENE, encodes a corresponding messenger RNA, VGAM45 host target RNA, herein designated VGAM HOST TARGET RNA. VGAM45 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM45 RNA, herein designated VGAM RNA, binds complementarily to one or more host target binding sites located in untranslated regions of VGAM45 host target RNA, herein designated VGAM HOST TARGET RNA. This complementary binding is due to the fact that the nucleotide sequence of VGAM45 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM45 RNA, herein designated VGAM RNA, may have a different number of host target binding sites in untranslated regions of a VGAM45 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM45 RNA, herein designated VGAM RNA, to host target binding sites on VGAM45 host target RNA, herein designated VGAM HOST TARGET RNA, such as BINDING SITE I, BINDING SITE II and BINDING SITE III, inhibits translation of VGAM45 host target RNA into VGAM45 host target protein, herein designated VGAM HOST TARGET PROTEIN. VGAM host target protein is therefore outlined by a broken line.

It is appreciated that VGAM45 host target gene, herein designated VGAM HOST TARGET GENE, in fact represents a plurality of VGAM45 host target genes. The mRNA of each one of this plurality of VGAM45 host target genes comprises one or more host target binding sites, each having a nucleotide sequence which is at least partly complementary to VGAM45 RNA, herein designated VGAM RNA, and which when bound by VGAM45 RNA causes inhibition of translation of respective one or more VGAM45 host target proteins.

It is further appreciated by one skilled in the art that the mode of translational inhibition illustrated by FIG. 1 with specific reference to translational inhibition exerted by VGAM45 gene, herein designated VGAM GENE, on one or more VGAM45 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM45 is inhibition of expression of host target genes, as part of a novel viral mechanism of attacking a host. Accordingly, utilities of VGAM45 include diagnosis, prevention and treatment of viral infection by Invertebrate Iridescent Virus 6. Specific functions, and accordingly utilities, of VGAM45 correlate with, and may be deduced from, the identity of the host target genes which VGAM45 binds and inhibits, and the function of these target genes, as elaborated hereinbelow.

Nucleotide sequences of the VGAM45 precursor RNA, herein designated VGAM PRECURSOR RNA, and of the 'diced' VGAM45 RNA, herein designated VGAM RNA, and a schematic representation of the secondary folding of VGAM45 folded precursor RNA, herein designated VGAM FOLDED PRECURSOR RNA, of VGAM45 are further described hereinbelow with reference to Table 1.

Nucleotide sequences of host target binding sites, such as BINDING SITE-I, BINDING SITE-II and BINDING SITE-III of FIG. 1, found on VGAM45 host target RNA, and schematic representation of the complementarity of each of these host target binding sites to VGAM45 RNA, herein designated VGAM RNA, are described hereinbelow with reference to Table 2.

As mentioned hereinabove with reference to FIG. 1, a function of VGAM45 gene, herein designated VGAM is inhibition of expression of VGAM45 target genes. It is appreciated that specific functions, and accordingly utilities, of VGAM45 correlate with, and may be deduced from, the identity of the target genes which VGAM45 binds and inhibits, and the function of these target genes, as elaborated hereinbelow.

Guanine Nucleotide Binding Protein (G protein), Alpha Inhibiting Activity Polypeptide 3 (GNAI3, Accession NM_006496) is a VGAM45 host target gene. GNAI3 BINDING SITE is HOST TARGET binding site found in the 3' untranslated region of mRNA encoded by GNAI3, corresponding to a HOST TARGET binding site such as BINDING SITE I, BINDING SITE II or BINDING SITE III. Table 2 illustrates the complementarity of the nucleotide sequences of GNAI3 BINDING SITE, designated SEQ ID:13237, to the nucleotide sequence of VGAM45 RNA, herein designated VGAM RNA, also designated SEQ ID:2756.

A function of VGAM45 is therefore inhibition of Guanine Nucleotide Binding Protein (G protein), Alpha Inhibiting Activity Polypeptide 3 (GNAI3, Accession NM_006496), a gene which stimulates receptor regulated K+-channels. Accordingly, utilities of VGAM45 include diagnosis, prevention and treatment of diseases and clinical conditions associated with GNAI3. The function of GNAI3 has been established by previous studies. Using a cDNA probe against a mouse/human somatic cell hybrid panel, Sparkes et al. (1987) mapped the alpha inhibiting polypeptide-3 of G protein to chromosome 1. See also Blatt et al. (1988). Alpha-3 cDNA codes for a protein of 340 amino acids (relative molecular weight 40,522), of which the sequence is closely related to but distinct from that of alpha-2 (Itoh et al., 1988). By in situ hybridization, Wilkie et al. (1992) assigned the gene to 1p13. They assigned the corresponding gene to mouse chromosome 3 by study of restriction fragment length variation in an interspecific backcross. Baron et al. (1994) demonstrated that the Gnai3 gene in the hamster is less than 60 kb from the Ampd2 gene (OMIM Ref. No. 102771) with which it is coamplified in coformycin-resistant cells. The hamster Gnai3 gene did not contain sequences corresponding to the combined U6 snRNA and E protein pseudogene, previously identified within intron 7 of the human gene.

Full details of the abovementioned studies are described in the following publications, the disclosure of which are hereby incorporated by reference:

Baron, B.; Fernandez, M. A.; Toledo, F.; Le Roscouet, D.; Mayau, V.; Martin, N.; Buttin, G.; Debatisse, M.: The highly conserved Chinese hamster GNAI3 gene maps less than 60 kb from the AMPD2 gene and lacks the intronic U6 snRNA present in its human counterpart. Genomics 24:288-294, 1994; and Sparkes, R. S.; Cohn, V. H.; Mohandas, T.; Zollman, S.; Cire-Eversole, P.; Amatruda, T. T.; Reed, R. R.; Lochrie, M. A.; Simon, M. I.: Mapping of genes encoding the subunits of guanine.

Further studies establishing the function and utilities of GNAI3 are found in John Hopkins OMIM database record ID 139370, and in sited publications numbered 3182, 474 and 2186 listed in the bibliography section hereinbelow, which are also hereby incorporated by reference. A Kinase (PRKA) Anchor Protein 6 (AKAP6, Accession NM_004274) is another VGAM45 host target gene. AKAP6 BINDING SITE is HOST TARGET binding site found in the 3' untranslated region of mRNA encoded by AKAP6, corresponding to a HOST TARGET binding site such as BINDING SITE I, BINDING SITE II or BINDING SITE III. Table 2 illustrates the complementarity of the nucleotide sequences of AKAP6 BINDING SITE, designated SEQ ID:10490, to the nucleotide sequence of VGAM45 RNA, herein designated VGAM RNA, also designated SEQ ID:2756.

Another function of VGAM45 is therefore inhibition of A Kinase (PRKA) Anchor Protein 6 (AKAP6, Accession NM_004274). Accordingly, utilities of VGAM45 include diagnosis, prevention and treatment of diseases and clinical conditions associated with AKAP6. ARGBP2 (Accession NM_003603) is another VGAM45 host target gene. ARGBP2 BINDING SITE1 and ARGBP2 BINDING SITE2 are HOST TARGET binding sites found in untranslated regions of mRNA encoded by ARGBP2, corresponding to HOST TARGET binding sites such as BINDING SITE I, BINDING SITE II or BINDING SITE III. Table 2 illustrates the complementarity of the nucleotide sequences of ARGBP2 BINDING SITE1 and ARGBP2 BINDING SITE2, designated SEQ ID:9658 and SEQ ID:22042 respectively, to the nucleotide sequence of VGAM45 RNA, herein designated VGAM RNA, also designated SEQ ID:2756.

Another function of VGAM45 is therefore inhibition of ARGBP2 (Accession NM_003603). Accordingly, utilities of VGAM45 include diagnosis, prevention and treatment of diseases and clinical conditions associated with ARGBP2. FLJ20666 (Accession NM_017922) is another VGAM45 host target gene. FLJ20666 BINDING SITE is HOST TARGET binding site found in the 3' untranslated region of mRNA encoded by FLJ20666, corresponding to a HOST TARGET binding site such as BINDING SITE I, BINDING SITE II or BINDING SITE III. Table 2 illustrates the complementarity of the nucleotide sequences of FLJ20666 BINDING SITE, designated SEQ ID:19580, to the nucleotide sequence of VGAM45 RNA, herein designated VGAM RNA, also designated SEQ ID:2756.

Another function of VGAM45 is therefore inhibition of FLJ20666 (Accession NM_017922). Accordingly, utilities of VGAM45 include diagnosis, prevention and treatment of diseases and clinical conditions associated with FLJ20666. HMT1 HnRNP Methyltransferase-like 3 (S. cerevisiae) (HRMT1L3, Accession NM_019854) is another VGAM45 host target gene. HRMT1L3 BINDING SITE is HOST TARGET binding site found in the 5' untranslated region of mRNA encoded by HRMT1L3, corresponding to a HOST TARGET binding site such as BINDING SITE I, BINDING SITE II or BINDING SITE III. Table 2 illustrates the complementarity of the nucleotide sequences of HRMT1L3 BINDING SITE, designated SEQ ID:21259, to the nucleotide sequence of VGAM45 RNA, herein designated VGAM RNA, also designated SEQ ID:2756.

Another function of VGAM45 is therefore inhibition of HMT1 HnRNP Methyltransferase-like 3 (S. cerevisiae) (HRMT1L3, Accession NM_019854). Accordingly, utilities of VGAM45 include diagnosis, prevention and treatment of diseases and clinical conditions associated with HRMT1L3. KIAA0373 (Accession NM_014684) is another VGAM45 host target gene. KIAA0373 BINDING SITE is HOST TARGET binding site found in the 5' untranslated region of mRNA encoded by KIAA0373, corresponding to a HOST TARGET binding site such as BINDING SITE I, BINDING SITE II or BINDING SITE III. Table 2 illustrates the complementarity of the nucleotide sequences of KIAA0373 BINDING SITE, designated SEQ ID:16185, to the nucleotide sequence of VGAM45 RNA, herein designated VGAM RNA, also designated SEQ ID:2756.

Another function of VGAM45 is therefore inhibition of KIAA0373 (Accession NM_014684). Accordingly, utilities of VGAM45 include diagnosis, prevention and treatment of diseases and clinical conditions associated with KIAA0373. Zinc Finger RNA Binding Protein (ZFR, Accession NM_016107) is another VGAM45 host target gene. ZFR BINDING SITE is HOST TARGET binding site found in the 3' untranslated region of mRNA encoded by ZFR, corresponding to a HOST TARGET binding site such as BINDING SITE I, BINDING SITE II or BINDING SITE III. Table 2 illustrates the complementarity of the nucleotide sequences of ZFR BINDING SITE, designated SEQ ID:18186, to the nucleotide sequence of VGAM45 RNA, herein designated VGAM RNA, also designated SEQ ID:2756.

Another function of VGAM45 is therefore inhibition of Zinc Finger RNA Binding Protein (ZFR, Accession NM_016107). Accordingly, utilities of VGAM45 include diagnosis, prevention and treatment of diseases and clinical conditions associated with ZFR. LOC221271 (Accession XM_166307) is another VGAM45 host target gene. LOC221271 BINDING SITE is HOST TARGET binding site found in the 3' untranslated region of mRNA encoded by LOC221271, corresponding to a HOST TARGET binding site such as BINDING SITE I, BINDING SITE II or BINDING SITE III. Table 2 illustrates the complementarity of the nucleotide sequences of LOC221271 BINDING SITE, designated SEQ ID:44122, to the nucleotide sequence of VGAM45 RNA, herein designated VGAM RNA, also designated SEQ ID:2756.

Another function of VGAM45 is therefore inhibition of LOC221271 (Accession XM_166307). Accordingly, utilities of VGAM45 include diagnosis, prevention and treatment of diseases and clinical conditions associated with LOC221271. LOC221876 (Accession XM_168220) is another VGAM45 host target gene. LOC221876 BINDING SITE is HOST TARGET binding site found in the 5' untranslated region of mRNA encoded by LOC221876, corresponding to a HOST TARGET binding site such as BINDING SITE I, BINDING SITE II or BINDING SITE III. Table 2 illustrates the complementarity of the nucleotide sequences of LOC221876 BINDING SITE, designated SEQ ID:45079, to the nucleotide sequence of VGAM45 RNA, herein designated VGAM RNA, also designated SEQ ID:2756.

Another function of VGAM45 is therefore inhibition of LOC221876 (Accession XM_168220). Accordingly, utilities of VGAM45 include diagnosis, prevention and treatment of diseases and clinical conditions associated with LOC221876. FIG. 1 further provides a conceptual description of a novel bioinformatically detected viral gene of the present invention, referred to here as Viral Genomic Address Messenger 46 (VGAM46) viral gene, which modulates expression of respective host target genes thereof, the function and utility of which host target genes is known in the art.

VGAM46 is a novel bioinformatically detected regulatory, non protein coding, viral micro RNA (miRNA) gene. The method by which VGAM46 was detected is described hereinabove with reference to FIGS. 1-8.

VGAM46 gene, herein designated VGAM GENE, is a viral gene contained in the genome of Invertebrate Iridescent Virus 6. VGAM46 host target gene, herein designated VGAM HOST TARGET GENE, is a human gene contained in the human genome.

VGAM46 gene encodes a VGAM46 precursor RNA, herein designated VGAM PRECURSOR RNA. Similar to other miRNA genes, and unlike most ordinary genes, VGAM46 precursor RNA does not encode a protein. A nucleotide sequence identical or highly similar to the nucleotide sequence of VGAM46 precursor RNA is designated SEQ ID:32, and is provided hereinbelow with reference to the sequence listing part. Nucleotide sequence SEQ ID:32 is located at position 190087 relative to the genome of Invertebrate Iridescent Virus 6.

VGAM46 precursor RNA folds onto itself, forming VGAM46 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM46 folded precursor RNA into VGAM46 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM46 RNA is designated SEQ ID:2757, and is provided hereinbelow with reference to the sequence listing part.

VGAM46 host target gene, herein designated VGAM HOST TARGET GENE, encodes a corresponding messenger RNA, VGAM46 host target RNA, herein designated VGAM HOST TARGET RNA. VGAM46 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM46 RNA, herein designated VGAM RNA, binds complementarily to one or more host target binding sites located in untranslated regions of VGAM46 host target RNA, herein designated VGAM HOST TARGET RNA. This complementary binding is due to the fact that the nucleotide sequence of VGAM46 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM46 RNA, herein designated VGAM RNA, may have a different number of host target binding sites in untranslated regions of a VGAM46 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM46 RNA, herein designated VGAM RNA, to host target binding sites on VGAM46 host target RNA, herein designated VGAM HOST TARGET RNA, such as BINDING SITE I, BINDING SITE II and BINDING SITE III, inhibits translation of VGAM46 host target RNA into VGAM46 host target protein, herein designated VGAM HOST TARGET PROTEIN. VGAM host target protein is therefore outlined by a broken line.

It is appreciated that VGAM46 host target gene, herein designated VGAM HOST TARGET GENE, in fact represents a plurality of VGAM46 host target genes. The mRNA of each one of this plurality of VGAM46 host target genes comprises one or more host target binding sites, each having a nucleotide sequence which is at least partly complementary to VGAM46 RNA, herein designated VGAM RNA, and which when bound by VGAM46 RNA causes inhibition of translation of respective one or more VGAM46 host target proteins.

It is further appreciated by one skilled in the art that the mode of translational inhibition illustrated by FIG. 1 with specific reference to translational inhibition exerted by VGAM46 gene, herein designated VGAM GENE, on one or more VGAM46 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM46 is inhibition of expression of host target genes, as part of a novel viral mechanism of attacking a host. Accordingly, utilities of VGAM46 include diagnosis, prevention and treatment of viral infection by Invertebrate Iridescent Virus 6. Specific functions, and accordingly utilities, of VGAM46 correlate with, and may be deduced from, the identity of the host target genes which VGAM46 binds and inhibits, and the function of these host target genes, as elaborated hereinbelow.

Nucleotide sequences of the VGAM46 precursor RNA, herein designated VGAM PRECURSOR RNA, and of the 'diced' VGAM46 RNA, herein designated VGAM RNA, and a schematic representation of the secondary folding of VGAM46 folded precursor RNA, herein designated VGAM FOLDED PRECURSOR RNA, of VGAM46 are further described hereinbelow with reference to Table 1.

Nucleotide sequences of host target binding sites, such as BINDING SITE-I, BINDING SITE-II and BINDING SITE-III of FIG. 1, found on VGAM46 host target RNA, and schematic representation of the complementarity of each of these host target binding sites to VGAM46 RNA, herein designated VGAM RNA, are described hereinbelow with reference to Table 2.

As mentioned hereinabove with reference to FIG. 1, a function of VGAM46 gene, herein designated VGAM is inhibition of expression of VGAM46 target genes. It is appreciated that specific functions, and accordingly utilities, of VGAM46 correlate with, and may be deduced from, the identity of the target genes which VGAM46 binds and inhibits, and the function of these target genes, as elaborated hereinbelow.

COX15 Homolog, Cytochrome C Oxidase Assembly Protein (yeast) (COX15, Accession NM_004376) is a VGAM46 host target gene. COX15 BINDING SITE is HOST TARGET binding site found in the 3' untranslated region of mRNA encoded by COX15, corresponding to a HOST TARGET binding site such as BINDING SITE I, BINDING SITE II or BINDING SITE III. Table 2 illustrates the complementarity of the nucleotide sequences of COX15 BINDING SITE, designated SEQ ID:10600, to the nucleotide sequence of VGAM46 RNA, herein designated VGAM RNA, also designated SEQ ID:2757.

A function of VGAM46 is therefore inhibition of COX15 Homolog, Cytochrome C Oxidase Assembly Protein (yeast) (COX15, Accession NM_004376). Accordingly, utilities of VGAM46 include diagnosis, prevention and treatment of diseases and clinical conditions associated with COX15. Chemokine (C-X-C motif) Ligand 6 (granulocyte chemotactic protein 2) (CXCL6, Accession NM_002993) is another VGAM46 host target gene. CXCL6 BINDING SITE is HOST TARGET binding site found in the 3' untranslated region of mRNA encoded by CXCL6, corresponding to a HOST TARGET binding site such as BINDING SITE I, BINDING SITE II or BINDING SITE III. Table 2 illustrates the complementarity of the nucleotide sequences of CXCL6 BINDING SITE, designated SEQ ID:8884, to the nucleotide sequence of VGAM46 RNA, herein designated VGAM RNA, also designated SEQ ID:2757.

Another function of VGAM46 is therefore inhibition of Chemokine (C-X-C motif) Ligand 6 (granulocyte chemotactic protein 2) (CXCL6, Accession NM_002993), a gene which is chemotactic for neutrophil granulocytes. Accordingly, utilities of VGAM46 include diagnosis, prevention and treatment of diseases and clinical conditions associated with CXCL6. The function of CXCL6 has been established by previous studies. Rovai et al. (1997) cloned the human GCP2 gene, as well as epithelial cell-derived neutrophil-activating peptide-78 (ENA78, or SCYB5; 600324). Both coding and noncoding portions of the GCP2 gene share very high nucleotide similarity to ENA78, except for the occurrence of a long interspersed sequence 5-prime of the GCP2 gene. The GCP2 gene encodes a propeptide of 114 amino acids. Despite 85% identity of the first 270 nucleotides 5-prime of the transcription start sites, GCP2 and the other CXC chemokine gene ENA78 showed cell-specific differences in regulation. Wuyts et al. (1997) synthesized and purified a human GCP2 protein of 75 amino acids. In vitro, synthetic GCP2 was an equally active chemoattractant for neutrophilic granulocytes as was natural 75-amino acid GCP2. Synthetic GCP2 did not stimulate eosinophil, monocyte, or lymphocyte chemotaxis. The authors showed that GCP2 binds to the chemokine receptors CXCR1 and CXCR2. In vivo studies in rabbit demonstrated that GCP2 is a potent inflammatory mediator.

Full details of the abovementioned studies are described in the following publications, the disclosure of which are hereby incorporated by reference:

Rovai, L. E.; Herschman, H. R.; Smith, J. B.: Cloning and characterization of the human granulocyte chemotactic protein-2 gene. J. Immun. 158:5257-5266, 1997; and Wuyts, A.; van Osselaer, N.; Haelens, A.; Samson, I.; Herdewijn, P.; Ben-Baruch, A.; Oppenheim, J. J.; Proost, P.; van Damme, J.: Characterization of synthetic human granulocyte chemot.

Further studies establishing the function and utilities of CXCL6 are found in John Hopkins OMIM database record ID 138965, and in sited publications numbered 16 and 11961-165 listed in the bibliography section hereinbelow, which are also hereby incorporated by reference. Ephrin-B2 (EFNB2, Accession NM_004093) is another VGAM46 host target gene. EFNB2 BINDING SITE is HOST TARGET binding site found in the 3' untranslated region of mRNA encoded by EFNB2, corresponding to a HOST TARGET binding site such as BINDING SITE I, BINDING SITE II or BINDING SITE III. Table 2 illustrates the complementarity of the nucleotide sequences of EFNB2 BINDING SITE, designated SEQ ID:10298, to the nucleotide sequence of VGAM46 RNA, herein designated VGAM RNA, also designated SEQ ID:2757.

Another function of VGAM46 is therefore inhibition of Ephrin-B2 (EFNB2, Accession NM_004093). Accordingly, utilities of VGAM46 include diagnosis, prevention and treatment of diseases and clinical conditions associated with EFNB2. Guanylate Binding Protein 1, Interferon-inducible, 67 kDa (GBP1, Accession NM_002053) is another VGAM46 host target gene. GBP1 BINDING SITE is HOST TARGET binding site found in the 3' untranslated region of mRNA encoded by GBP1, corresponding to a HOST TARGET binding site such as BINDING SITE I, BINDING SITE II or BINDING SITE III. Table 2 illustrates the complementarity of the nucleotide sequences of GBP1 BINDING SITE, designated SEQ ID:7810, to the nucleotide sequence of VGAM46 RNA, herein designated VGAM RNA, also designated SEQ ID:2757.

Another function of VGAM46 is therefore inhibition of Guanylate Binding Protein 1, Interferon-inducible, 67 kDa (GBP1, Accession NM_002053), a gene which specifically binds guanylate nucleotides (GMP, GDP and GTP). Accordingly, utilities of VGAM46 include diagnosis, prevention and treatment of diseases and clinical conditions associated with GBP1. The function of GBP1 has been established by previous studies. Interferons are cytokines that have antiviral effects and inhibit tumor cell proliferation. They induce a large number of genes in their target cells, including those coding for the guanylate-binding proteins (GBPs). GBPs are characterized by their ability to specifically bind guanine nucleotides (GMP, GDP, and GTP) and are distinguished from the GTP-binding proteins by the presence of 2 binding motifs rather than 3. Cheng et al. (1991) cloned the cDNAs for GBP1 (a 67-kD protein) and GBP2 (partial cDNA; 600412). Strehlow et al. (1994) identified the human GBP1 gene and showed that it contains 11 exons. By use of somatic cell hybrid DNAS, they mapped the gene to human chromosome 1. A mouse homolog of GBP1 has been mapped to the distal region of mouse chromosome 3 (Prochazka et al., 1985). Strehlow et al. (1994) also identified and partially characterized a third novel member of the family (GBP3; 600413) which shows significant sequence similarity to both GBP1 and GBP2. The putative window of embryo implantation in the human opens between days 19 to 24 of the menstrual cycle. A major challenge in the study of human reproduction is to identify the molecular signals that participate in the establishment of this critical receptive phase in the context of the natural cycle. Toward this goal, Kumar et al. (2001) analyzed human endometrial biopsies at various days of the menstrual cycle by mRNA differential display. They isolated several cDNAs representing genes that are either up- or downregulated within the putative window of implantation. They identified one of these genes as GBP1, which possesses GTPase activity. Analysis of endometrial biopsies by Northern blot and RT-PCR demonstrated that GBP1 mRNA is specifically induced at the midsecretory phase of the menstrual cycle. In situ hybridization analysis revealed that GBP1 mRNA expression is localized in the glandular epithelial cells as well as in the stroma in the immediate vicinity of the glands. The authors concluded that its unique expression overlapping the putative window of implantation suggests that GBP1 may serve as a useful marker of uterine receptivity in the human.

Full details of the abovementioned studies are described in the following publications, the disclosure of which are hereby incorporated by reference:

Cheng, Y.-S. E.; Patterson, C. E.; Staeheli, P.: Interferon-induced guanylate-binding proteins lack an N(T)KXD consensus motif and bind GMP in addition to GDP and GTP. Molec. Cell. Biol. 11:4717-4725, 1991; and Kumar, S.; Li, Q.; Dua, A.; Ying, Y.-K.; Bagchi, M. K.; Bagchi, I. C.: Messenger ribonucleic acid encoding interferon-inducible guanylate binding protein 1 is induced in human endometri.

Further studies establishing the function and utilities of GBP1 are found in John Hopkins OMIM database record ID 600411, and in sited publications numbered 9865-9868 listed in the bibliography section hereinbelow, which are also hereby incorporated by reference. MADS Box Transcription Enhancer Factor 2, Polypeptide A (myocyte enhancer factor 2A) (MEF2A, Accession NM_005587) is another VGAM46 host target gene. MEF2A BINDING SITE is HOST TARGET binding site found in the 5' untranslated region of mRNA encoded by MEF2A, corresponding to a HOST TARGET binding site such as BINDING SITE I, BINDING SITE II or BINDING SITE III. Table 2 illustrates the complementarity of the nucleotide sequences of MEF2A BINDING SITE, designated SEQ ID:12119, to the nucleotide sequence of VGAM46 RNA, herein designated VGAM RNA, also designated SEQ ID:2757.

Another function of VGAM46 is therefore inhibition of MADS Box Transcription Enhancer Factor 2, Polypeptide A (myocyte enhancer factor 2A) (MEF2A, Accession NM_005587), a gene which binds a consensus sequence that regulates transcription. Accordingly, utilities of VGAM46 include diagnosis, prevention and treatment of diseases and clinical conditions associated with MEF2A. The function of MEF2A has been established by previous studies. The process of differentiation from mesodermal precursor cells to myoblasts has led to the discovery of a variety of tissue-specific factors that regulate muscle gene expression. The myogenic basic helix-loop-helix proteins, including myoD (OMIM Ref. No. 159970), myogenin (OMIM Ref. No. 159980), MYF5 (OMIM Ref. No. 159990), and MRF4 (OMIM Ref. No. 159991) are 1 class of identified factors. A second family of DNA binding regulatory proteins is the myocyte-specific enhancer factor-2 (MEF2) family. Each of these proteins binds to the MEF2 target DNA sequence present in the regulatory regions of many, if not all, muscle-specific genes. The MEF2 genes are members of the MADS gene family (named for the yeast mating type-specific transcription factor MCM1, the plant homeotic genes 'agamous' and 'deficiens' and the human serum response factor SRF (OMIM Ref. No. 600589)), a family that also includes several homeotic genes and other transcription factors, all of which share a conserved DNA-binding domain. Pollock and Treisman (1991) cloned a cDNA for MEF2A, which they designated as a member of the RSRF (related to serum response factor) family. They also described the protein's DNA binding properties and its potential role in regulation of growth factor-inducible and muscle specific sequences. MEF2A cDNAs were also obtained by Yu et al. (1992), who screened an expression library of primary human skeletal myocytes from vastus lateralis with a DNA probe containing multiple copies of the MEF2 binding sequence. The mRNA is ubiquitously expressed, with highest levels found in skeletal muscle, heart, and brain. Several alternative splice variants of MEF2A were identified that were predicted to encode different protein products. Using immunofluorescence, MEF2A protein was detected in the nuclei of skeletal and cardiac muscle cells. Hobson et al. (1995) mapped the MEF2A gene using somatic cell hybrid panel DNAs including deletion or derivative chromosome cell lines and regionalized it to 15q26 by fluorescence in situ hybridization (FISH) with a YAC shown to contain MEF2A. Mouse Mef2A was mapped by Martin et al. (1994) to chromosome 7. Suzuki et al. (1996) mapped the MEF2A gene to 15q26 by FISH. They isolated and mapped a partially processed pseudogene (OMIM Ref. No. MEF2AP) to 1q24-q25 by FISH. Animal model experiments lend further support to the function of MEF2A. Naya et al. (2002) generated mice deficient in Mef2a, the predominant Mef2 gene expressed in postnatal cardiac muscle. Most mice lacking Mef2a died suddenly within the first week of life and exhibited pronounced dilation of the right ventricle, myofibrillar fragmentation, mitochondrial disorganization, and activation of a fetal cardiac gene program. The few Mef2a null mice that survived to adulthood also showed a deficiency of cardiac mitochondria and susceptibility to sudden death.

It is appreciated that the abovementioned animal model for MEF2A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pollock, R.; Treisman, R.: Human SRF-related proteins: DNA-binding properties and potential regulatory targets. Genes Dev. 5:2327-2341, 1991.; and Suzuki, E.; Lowry, J.; Sonoda, G.; Testa, J. R.; Walsh, K.: Structures and chromosome locations of the human MEF2A gene and a pseudogene MEF2AP. Cytogenet. Cell Genet. 73:244-249, 1996.

Further studies establishing the function and utilities of MEF2A are found in John Hopkins OMIM database record ID 600660, and in sited publications numbered 8293-8301 listed in the bibliography section hereinbelow, which are also hereby incorporated by reference. Protein Phosphatase 1, Catalytic Subunit, Beta Isoform (PPP1CB, Accession NM_002709) is another VGAM46 host target gene. PPP1CB BINDING SITE is HOST TARGET binding site found in the 3' untranslated region of mRNA encoded by PPP1CB, corresponding to a HOST TARGET binding site such as BINDING SITE I, BINDING SITE II or BINDING SITE III. Table 2 illustrates the complementarity of the nucleotide sequences of PPP1CB BINDING SITE, designated SEQ ID:8559, to the nucleotide sequence of VGAM46 RNA, herein designated VGAM RNA, also designated SEQ ID:2757.

Another function of VGAM46 is therefore inhibition of Protein Phosphatase 1, Catalytic Subunit, Beta Isoform (PPP1CB, Accession NM_002709), a gene which is the catalytic subunit of protein phosphatase 1. Accordingly, utilities of VGAM46 include diagnosis, prevention and treatment of diseases and clinical conditions associated with PPP1CB. The function of PPP1CB has been established by previous studies. Protein phosphatase 1 (PP1) is one of 4 major serine/threonine-specific protein phosphatases involved in the dephosphorylation of a variety of proteins. These enzymes work in opposition to the protein kinases to control the level of phosphorylation. PP1 has 3 catalytic subunits, designated alpha (OMIM Ref. No. 176875), beta, and gamma. Barker et al. (1994) isolated a cDNA for PP1 beta (symbolized PPP1CB) from a teratocarcinoma library. Three different PPP1CB mRNAs were seen on Northern blots corresponding to alternate splicing variants. The 3-prime noncoding region of PPP1CB was approximately 90% conserved between man and rodents, suggesting that this region may have functional importance. Barker et al. (1994) assigned the gene for human PPP1CB to chromosome 2 using somatic cell hybrid DNAs and further localized it to 2p23 by fluorescence in situ hybridization. Saadat et al. (1994) confirmed the human map position as 2p23 and showed that rodent homologs mapped to rat 6q21-q23 and mouse 12D Full details of the abovementioned studies are described in the following publications, the disclosure of which are hereby incorporated by reference:

Barker, H. M.; Brewis, N. D.; Street, A. J.; Spurr, N. K.; Cohen, P. T. W.: Three genes for protein phosphatase 1 map to different human chromosomes: sequence, expression and gene localisation of protein serine/threonine phosphatase 1 beta (PPP1CB). Biochim. Biophys. Acta 1220:212-218, 1994; and Saadat, M.; Kakinoki, Y.; Mizuno, Y.; Kikuchi, K.; Yoshida, M. C.: Chromosomal localization of human, rat, and mouse protein phosphatase type 1 beta catalytic subunit genes (PPP1CB) by.

Further studies establishing the function and utilities of PPP1CB are found in John Hopkins OMIM database record ID 600590, and in sited publications numbered 10217-10218 listed in the bibliography section hereinbelow, which are also hereby incorporated by reference. Basic, Immunoglobulin-like Variable Motif Containing (BIVM, Accession NM_017693) is another VGAM46 host target gene. BIVM BINDING SITE is HOST TARGET binding site found in the 3' untranslated region of mRNA encoded by BIVM, corresponding to a HOST TARGET binding site such as BINDING SITE I, BINDING SITE II or BINDING SITE III. Table 2 illustrates the complementarity of the nucleotide sequences of BIVM BINDING SITE, designated SEQ ID:19256, to the nucleotide sequence of VGAM46 RNA, herein designated VGAM RNA, also designated SEQ ID:2757.

Another function of VGAM46 is therefore inhibition of Basic, Immunoglobulin-like Variable Motif Containing (BIVM, Accession NM_017693). Accordingly, utilities of VGAM46 include diagnosis, prevention and treatment of diseases and clinical conditions associated with BIVM. Cadherin-like 26 (CDH26, Accession NM_021810) is another VGAM46 host target gene. CDH26 BINDING SITE is HOST TARGET binding site found in the 3' untranslated region of mRNA encoded by CDH26, corresponding to a HOST TARGET binding site such as BINDING SITE I, BINDING SITE II or BINDING SITE III. Table 2 illustrates the complementarity of the nucleotide sequences of CDH26 BINDING SITE, designated SEQ ID:22373, to the nucleotide sequence of VGAM46 RNA, herein designated VGAM RNA, also designated SEQ ID:2757.

Another function of VGAM46 is therefore inhibition of Cadherin-like 26 (CDH26, Accession NM_021810). Accordingly, utilities of VGAM46 include diagnosis, prevention and treatment of diseases and clinical conditions associated with CDH26. FLJ10961 (Accession XM_032826) is another VGAM46 host target gene. FLJ10961 BINDING SITE is HOST TARGET binding site found in the 3' untranslated region of mRNA encoded by FLJ10961, corresponding to a HOST TARGET binding site such as BINDING SITE I, BINDING SITE II or BINDING SITE III. Table 2 illustrates the complementarity of the nucleotide sequences of FLJ10961 BINDING SITE, designated SEQ ID:31777, to the nucleotide sequence of VGAM46 RNA, herein designated VGAM RNA, also designated SEQ ID:2757.

Another function of VGAM46 is therefore inhibition of FLJ10961 (Accession XM_032826). Accordingly, utilities of VGAM46 include diagnosis, prevention and treatment of diseases and clinical conditions associated with FLJ10961. HTMP10 (Accession NM_033207) is another VGAM46 host target gene. HTMP10 BINDING SITE is HOST TARGET binding site found in the 3' untranslated region of mRNA encoded by HTMP10, corresponding to a HOST TARGET binding site such as BINDING SITE I, BINDING SITE II or BINDING SITE III. Table 2 illustrates the complementarity of the nucleotide sequences of HTMP10 BINDING SITE, designated SEQ ID:27051, to the nucleotide sequence of VGAM46 RNA, herein designated VGAM RNA, also designated SEQ ID:2757.

Another function of VGAM46 is therefore inhibition of HTMP10 (Accession NM_033207). Accordingly, utilities of VGAM46 include diagnosis, prevention and treatment of diseases and clinical conditions associated with HTMP10. KIAA0471 (Accession NM_014857) is another VGAM46 host target gene. KIAA0471 BINDING SITE is HOST TARGET binding site found in the 5' untranslated region of mRNA encoded by KIAA0471, corresponding to a HOST TARGET binding site such as BINDING SITE I, BINDING SITE II or BINDING SITE III. Table 2 illustrates the complementarity of the nucleotide sequences of KIAA0471 BINDING SITE, designated SEQ ID:16916, to the nucleotide sequence of VGAM46 RNA, herein designated VGAM RNA, also designated SEQ ID:2757.

Another function of VGAM46 is therefore inhibition of KIAA0471 (Accession NM_014857). Accordingly, utilities of VGAM46 include diagnosis, prevention and treatment of diseases and clinical conditions associated with KIAA0471. KIAA1493 (Accession XM_034415) is another VGAM46 host target gene. KIAA1493 BINDING SITE is HOST TARGET binding site found in the 3' untranslated region of mRNA encoded by KIAA1493, corresponding to a HOST TARGET binding site such as BINDING SITE I, BINDING SITE II or BINDING SITE III. Table 2 illustrates the complementarity of the nucleotide sequences of KIAA1493 BINDING SITE, designated SEQ ID:32090, to the nucleotide sequence of VGAM46 RNA, herein designated VGAM RNA, also designated SEQ ID:2757.

Another function of VGAM46 is therefore inhibition of KIAA1493 (Accession XM_034415). Accordingly, utilities of VGAM46 include diagnosis, prevention and treatment of diseases and clinical conditions associated with KIAA1493. KIAA1634 (Accession XM_032749) is another VGAM46 host target gene. KIAA1634 BINDING SITE is HOST TARGET binding site found in the 3' untranslated region of mRNA encoded by KIAA1634, corresponding to a HOST TARGET binding site such as BINDING SITE I, BINDING SITE II or BINDING SITE III. Table 2 illustrates the complementarity of the nucleotide sequences of KIAA1634 BINDING SITE, designated SEQ ID:31749, to the nucleotide sequence of VGAM46 RNA, herein designated VGAM RNA, also designated SEQ ID:2757.

Another function of VGAM46 is therefore inhibition of KIAA1634 (Accession XM_032749). Accordingly, utilities of VGAM46 include diagnosis, prevention and treatment of diseases and clinical conditions associated with KIAA1634. KIAA1877 (Accession XM_038616) is another VGAM46 host target gene. KIAA1877 BINDING SITE is HOST TARGET binding site found in the 3' untranslated region of mRNA encoded by KIAA1877, corresponding to a HOST TARGET binding site such as BINDING SITE I, BINDING SITE II or BINDING SITE III. Table 2 illustrates the complementarity of the nucleotide sequences of KIAA1877 BINDING SITE, designated SEQ ID:32888, to the nucleotide sequence of VGAM46 RNA, herein designated VGAM RNA, also designated SEQ ID:2757.

Another function of VGAM46 is therefore inhibition of KIAA1877 (Accession XM_038616). Accordingly, utilities of VGAM46 include diagnosis, prevention and treatment of diseases and clinical conditions associated with KIAA1877. Mal, T-cell Differentiation Protein 2 (MAL2, Accession NM_052886) is another VGAM46 host target gene. MAL2 BINDING SITE is HOST TARGET binding site found in the 3' untranslated region of mRNA encoded by MAL2, corresponding to a HOST TARGET binding site such as BINDING SITE I, BINDING SITE II or BINDING SITE III. Table 2 illustrates the complementarity of the nucleotide sequences of MAL2 BINDING SITE, designated SEQ ID:27470, to the nucleotide sequence of VGAM46 RNA, herein designated VGAM RNA, also designated SEQ ID:2757.

Another function of VGAM46 is therefore inhibition of Mal, T-cell Differentiation Protein 2 (MAL2, Accession NM_052886). Accordingly, utilities of VGAM46 include diagnosis, prevention and treatment of diseases and clinical conditions associated with MAL2. SB52 (Accession NM_138335) is another VGAM46 host target gene. SB52 BINDING SITE is HOST TARGET binding site found in the 3' untranslated region of mRNA encoded by SB52, corresponding to a HOST TARGET binding site such as BINDING SITE I, BINDING SITE II or BINDING SITE III. Table 2 illustrates the complementarity of the nucleotide sequences of SB52 BINDING SITE, designated SEQ ID:28735, to the nucleotide sequence of VGAM46 RNA, herein designated VGAM RNA, also designated SEQ ID:2757.

Another function of VGAM46 is therefore inhibition of SB52 (Accession NM_138335). Accordingly, utilities of VGAM46 include diagnosis, prevention and treatment of diseases and clinical conditions associated with SB52. LOC150848 (Accession XM_097959) is another VGAM46 host target gene. LOC150848 BINDING SITE is HOST TARGET binding site found in the 5' untranslated region of mRNA encoded by LOC150848, corresponding to a HOST TARGET binding site such as BINDING SITE I, BINDING SITE II or BINDING SITE III. Table 2 illustrates the complementarity of the nucleotide sequences of LOC150848 BINDING SITE, designated SEQ ID:41262, to the nucleotide sequence of VGAM46 RNA, herein designated VGAM RNA, also designated SEQ ID:2757.

Another function of VGAM46 is therefore inhibition of LOC150848 (Accession XM_097959). Accordingly, utilities of VGAM46 include diagnosis, prevention and treatment of diseases and clinical conditions associated with LOC150848. FIG. 1 further provides a conceptual description of a novel bioinformatically detected viral gene of the present invention, referred to here as Viral Genomic Address Messenger 47 (VGAM47) viral gene, which modulates expression of respective host target genes thereof, the function and utility of which host target genes is known in the art.

VGAM47 is a novel bioinformatically detected regulatory, non protein coding, viral micro RNA (miRNA) gene. The method by which VGAM47 was detected is described hereinabove with reference to FIGS. 1-8.

VGAM47 gene, herein designated VGAM GENE, is a viral gene contained in the genome of Invertebrate Iridescent Virus 6. VGAM47 host target gene, herein designated VGAM HOST TARGET GENE, is a human gene contained in the human genome.

VGAM47 gene encodes a VGAM47 precursor RNA, herein designated VGAM PRECURSOR RNA. Similar to other miRNA genes, and unlike most ordinary genes, VGAM47 precursor RNA does not encode a protein. A nucleotide sequence identical or highly similar to the nucleotide sequence of VGAM47 precursor RNA is designated SEQ ID:33, and is provided hereinbelow with reference to the sequence listing part. Nucleotide sequence SEQ ID:33 is located at position 25939 relative to the genome of Invertebrate Iridescent Virus 6.

VGAM47 precursor RNA folds onto itself, forming VGAM47 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM47 folded precursor RNA into VGAM47 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM47 RNA is designated SEQ ID:2758, and is provided hereinbelow with reference to the sequence listing part.

VGAM47 host target gene, herein designated VGAM HOST TARGET GENE, encodes a corresponding messenger RNA, VGAM47 host target RNA, herein designated VGAM HOST TARGET RNA. VGAM47 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM47 RNA, herein designated VGAM RNA, binds complementarily to one or more host target binding sites located in untranslated regions of VGAM47 host target RNA, herein designated VGAM HOST TARGET RNA. This complementary binding is due to the fact that the nucleotide sequence of VGAM47 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM47 RNA, herein designated VGAM RNA, may have a different number of host target binding sites in untranslated regions of a VGAM47 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM47 RNA, herein designated VGAM RNA, to host target binding sites on VGAM47 host target RNA, herein designated VGAM HOST TARGET RNA, such as BINDING SITE I, BINDING SITE II and BINDING SITE III, inhibits translation of VGAM47 host target RNA into VGAM47 host target protein, herein designated VGAM HOST TARGET PROTEIN. VGAM host target protein is therefore outlined by a broken line.

It is appreciated that VGAM47 host target gene, herein designated VGAM HOST TARGET GENE, in fact represents a plurality of VGAM47 host target genes. The mRNA of each one of this plurality of VGAM47 host target genes comprises one or more host target binding sites, each having a nucleotide sequence which is at least partly complementary to VGAM47 RNA, herein designated VGAM RNA, and which when bound by VGAM47 RNA causes inhibition of translation of respective one or more VGAM47 host target proteins.

It is further appreciated by one skilled in the art that the mode of translational inhibition illustrated by FIG. 1 with specific reference to translational inhibition exerted by VGAM47 gene, herein designated VGAM GENE, on one or more VGAM47 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM47 is inhibition of expression of host target genes, as part of a novel viral mechanism of attacking a host. Accordingly, utilities of VGAM47 include diagnosis, prevention and treatment of viral infection by Invertebrate Iridescent Virus 6. Specific functions, and accordingly utilities, of VGAM47 correlate with, and may be deduced from, the identity of the host target genes which VGAM47 binds and inhibits, and the function of these host target genes, as elaborated hereinbelow.

Nucleotide sequences of the VGAM47 precursor RNA, herein designated VGAM PRECURSOR RNA, and of the 'diced' VGAM47 RNA, herein designated VGAM RNA, and a schematic representation of the secondary folding of VGAM47 folded precursor RNA, herein designated VGAM FOLDED PRECURSOR RNA, of VGAM47 are further described hereinbelow with reference to Table 1.

Nucleotide sequences of host target binding sites, such as BINDING SITE-I, BINDING SITE-II and BINDING SITE-III of FIG. 1, found on VGAM47 host target RNA, and schematic representation of the complementarity of each of these host target binding sites to VGAM47 RNA, herein designated VGAM RNA, are described hereinbelow with reference to Table 2.

As mentioned hereinabove with reference to FIG. 1, a function of VGAM47 gene, herein designated VGAM is inhibition of expression of VGAM47 target genes. It is appreciated that specific functions, and accordingly utilities, of VGAM47 correlate with, and may be deduced from, the identity of the target genes which VGAM47 binds and inhibits, and the function of these target genes, as elaborated hereinbelow.

Aspartate Beta-hydroxylase (ASPH, Accession NM_032466) is a VGAM47 host target gene. ASPH BINDING SITE is HOST TARGET binding site found in the 3' untranslated region of mRNA encoded by ASPH, corresponding to a HOST TARGET binding site such as BINDING SITE I, BINDING SITE II or BINDING SITE III. Table 2 illustrates the complementarity of the nucleotide sequences of ASPH BINDING SITE, designated SEQ ID:26223, to the nucleotide sequence of VGAM47 RNA, herein designated VGAM RNA, also designated SEQ ID:2758.

A function of VGAM47 is therefore inhibition of Aspartate Beta-hydroxylase (ASPH, Accession NM_032466), a gene which specifically hydroxylates the beta carbon of aspartic acid or asparagine residues in certain epidermal growth factor (EGF)-like domains of a number of proteins. Accordingly, utilities of VGAM47 include diagnosis, prevention and treatment of diseases and clinical conditions associated with ASPH. The function of ASPH has been established by previous studies. In hepatocellular carcinoma (HCC; 114550), one of the most prevalent tumors in the world which occurs with especially high frequency in sub-Saharan Africa and the Far East, a specific antigen is highly expressed; it is highly expressed also in cholangiocarcinomas. Lavaissiere et al. (1996) reported cDNA cloning of the human gene encoding this antigen, aspartyl (asparaginyl)-beta-hydroxylase (symbolized HAAH by them), and demonstrated that in these tumor lines it is expressed in an enzymatically active form. The gene encodes a deduced 744-amino acid polypeptide with high homology (81%) to the bovine gene (Jia et al., 1992). Lavaissiere et al. (1996) found that their cDNA human sequence was 99% homologous to the sequence for ASPH reported by Korioth et al. (1994), differing only at amino acid residues 565 (tyr to ile), 575 (trp-trp-thr to cys-gly), 585 (asp to gln), and 709 (arg to lys). They noted also a silent TCG-to-TCA transition at peptide residue 161. Lavaissiere et al. (1996) speculated about the possible relationship of the malignant phenotype of regulated aspartyl/asparaginyl-beta-hydroxylation in EGF-like domains of proteins such as the mammalian Notch homologs (e.g., 190198, 600275, and 600276), which are known to be involved in cell differentiation and whose cytoplasmic domains have been shown to be oncogenic. By screening a heart cDNA library, followed by RT-PCR, Lim et al. (2000) isolated cDNAs encoding the 225-amino acid junctin protein and a 210-amino acid isoform. The authors noted that a 73-residue stretch in junctin has a completely matched region in the ASPH protein. Southern blot analysis indicated that junctin and ASPH exist as a single-copy gene. Northern blot analysis revealed expression of 3.0- and 4.2-kb transcripts in cardiac and skeletal muscle; expression was higher in skeletal muscle. SDS-PAGE analysis of the translated cDNAs showed expression of 26- and 28-kD proteins. By screening a skeletal muscle cDNA library with a dog junctin probe, Treves et al. (2000) identified cDNAs encoding human junctin and junctate. Sequence analysis predicted that junctate, a 299-amino acid protein, shares the first 93 amino acids of the long isoform of junctin (and, partially, of ASPH), whereas its 64 C-terminal residues are identical to the central region of ASPH. Northern blot analysis detected a 2.6-kb transcript in heart, brain, pancreas, placenta, lung, liver, kidney, and skeletal muscle; highest levels were in heart, brain, and pancreas, and lowest levels were in skeletal muscle. In contrast, junctin was expressed only in cardiac and skeletal muscle. Southern blot and PCR analyses indicated that ASPH, junctin, and junctate are splice variants of the same gene; ASPH uses exons 1, 3, 5, and 8 through 16, whereas junctin uses exons 2, 3, 5, and 6, and junctate uses exons 2 through 5 and 8 through 16. Fluorescence microscopy showed junctate expression in sarco (endo) plasmic reticulum membranes. Immunoblot analysis indicated that junctate is expressed as a 32-kD protein in kidney microsomes. Binding analysis determined that junctate binds calcium with high capacity and moderate affinity.

Full details of the abovementioned studies are described in the following publications, the disclosure of which are hereby incorporated by reference:

Lavaissiere, L.; Jia, S.; Nishiyama, M.; de la Monte, S.; Stern, A. M.; Wands, J. R.; Friedman, P. A.: Overexpression of human aspartyl (asparaginyl)-beta-hydroxylase in hepatocellular carcinoma and cholangiocarcinoma. J. Clin. Invest. 98:1313-1323, 1996; and Treves, S.; Feriotto, G.; Moccagatta, L.; Gambari, R.; Zorzato, F.: Molecular cloning, expression, functional characterization, chromosomal localization, and gene structure of junctate.

Further studies establishing the function and utilities of ASPH are found in John Hopkins OMIM database record ID 600582, and in sited publications numbered 10187-10193 listed in the bibliography section hereinbelow, which are also hereby incorporated by reference. Eukaryotic Translation Initiation Factor 5A2 (EIF5A2, Accession NM_020390) is another VGAM47 host target gene. EIF5A2 BINDING SITE is HOST TARGET binding site found in the 3' untranslated region of mRNA encoded by EIF5A2, corresponding to a HOST TARGET binding site such as BINDING SITE I, BINDING SITE II or BINDING SITE III. Table 2 illustrates the complementarity of the nucleotide sequences of EIF5A2 BINDING SITE, designated SEQ ID:21659, to the nucleotide sequence of VGAM47 RNA, herein designated VGAM RNA, also designated SEQ ID:2758.

Another function of VGAM47 is therefore inhibition of Eukaryotic Translation Initiation Factor 5A2 (EIF5A2, Accession NM_020390). Accordingly, utilities of VGAM47 include diagnosis, prevention and treatment of diseases and clinical conditions associated with EIF5A2. RP42 (Accession NM_020640) is another VGAM47 host target gene. RP42 BINDING SITE is HOST TARGET binding site found in the 3' untranslated region of mRNA encoded by RP42, corresponding to a HOST TARGET binding site such as BINDING SITE I, BINDING SITE II or BINDING SITE III. Table 2 illustrates the complementarity of the nucleotide sequences of RP42 BINDING SITE, designated SEQ ID:21801, to the nucleotide sequence of VGAM47 RNA, herein designated VGAM RNA, also designated SEQ ID:2758.

Another function of VGAM47 is therefore inhibition of RP42 (Accession NM_020640), a gene which not clear yet. Accordingly, utilities of VGAM47 include diagnosis, prevention and treatment of diseases and clinical conditions associated with RP42. The function of RP42 has been established by previous studies. In a systematic search for genes expressed in proliferating neuroblasts whose human orthologs map to susceptibility loci for autism (OMIM Ref. No. 209850), Mas et al. (2000) isolated a novel mouse gene, which they designated RP42. They obtained the human homolog by combining contigs of human ESTs and RT-PCR of human embryonic mRNAs. The deduced human and mouse RP42 proteins contain 259 amino acids and differ by only 2 residues. They show 30 to 36% overall sequence identity to an S. pombe and a C. elegans protein, suggesting that the RP42 protein has an important cellular function. Northern blot analysis in the mouse embryo demonstrated expression of 2 transcripts, with the larger transcript reaching peak expression from E11 to E15, and the smaller transcript showing high expression from E7 to E15, indicating developmentally regulated expression, which was found particularly in proliferating neuroblasts. In mouse adult tissues, 3 transcripts were expressed in testis, kidney, liver, skeletal muscle, and heart, with weaker expression in brain. Northern blot analysis of adult human tissues detected 2 RP42 transcripts of approximately 3.7 and 2.7 kb at lower levels of expression than in mouse. RT-PCR showed that RP42 is expressed in the human embryo telencephalon Mas et al. (2000) identified the human RP42 sequence in a cluster of embryonic neuronally expressed genes on a PAC mapping to 6q16, making it a candidate gene for the susceptibility autism locus previously assigned to this region Full details of the abovementioned studies are described in the following publications, the disclosure of which are hereby incorporated by reference:

Mas, C.; Bourgeois, F.; Bulfone, A.; Levacher, B.; Mugnier, C.; Simonneau, M.: Cloning and expression analysis of a novel gene, RP42, mapping to an autism susceptibility locus on 6q16. Genomics 65:70-74, 2000; and Mas, C.; Bourgeois, F.; Bulfone, A.; Levacher, B.; Mugnier, C.; Simonneau, M.: Cloning and expression analysis of a novel gene, RP42, mapping to an autism susceptibility locus on 6q16. Ge.

Further studies establishing the function and utilities of RP42 are found in John Hopkins OMIM database record ID 605905, and in sited publications numbered 739 listed in the bibliography section hereinbelow, which are also hereby incorporated by reference. Splicing Factor, Arginine/serine-rich 2 (SFRS2, Accession XM_036785) is another VGAM47 host target gene. SFRS2 BINDING SITE is HOST TARGET binding site found in the 3' untranslated region of mRNA encoded by SFRS2, corresponding to a HOST TARGET binding site such as BINDING SITE I, BINDING SITE II or BINDING SITE III. Table 2 illustrates the complementarity of the nucleotide sequences of SFRS2 BINDING SITE, designated SEQ ID:32504, to the nucleotide sequence of VGAM47 RNA, herein designated VGAM RNA, also designated SEQ ID:2758.

Another function of VGAM47 is therefore inhibition of Splicing Factor, Arginine/serine-rich 2 (SFRS2, Accession XM_036785), a gene which is necessary for the splicing of pre-mrna. Accordingly, utilities of VGAM47 include diagnosis, prevention and treatment of diseases and clinical conditions associated with SFRS2. The function of SFRS2 has been established by previous studies. Fu and Maniatis (1992) isolated a human cDNA termed pre-mRNA splicing factor SC35, or SFRS2, that is required for spliceosome assembly. The predicted protein contains a ribonucleoprotein (RNP)-type RNA-binding motif and a carboxyl-terminal serine/arginine-rich (SR) domain. Wang et al. (2001) reported that Cre-mediated conditional deletion of the prototypical SR protein Sc35 in mouse thymus caused a defect in T-cell maturation. Deletion of Sc35 altered alternative splicing of CD45 (OMIM Ref. No. 151460), a receptor tyrosine phosphatase regulated by differential splicing during thymocyte development and activation.

Full details of the abovementioned studies are described in the following publications, the disclosure of which are hereby incorporated by reference:

Fu, X.-D.; Maniatis, T.: Isolation of a complementary DNA that encodes the mammalian splicing factor SC35. Science 256:535-538, 1992; and Wang, H.-Y.; Xu, X.; Ding, J.-H.; Bermingham, J. R., Jr.; Fu, X.-D.: SC35 plays a role in T cell development and alternative splicing of CD45. Molec. Cell 7:331-342, 2001.

Further studies establishing the function and utilities of SFRS2 are found in John Hopkins OMIM database record ID 600813, and in sited publications numbered 713 and 7140-7142 listed in the bibliography section hereinbelow, which are also hereby incorporated by reference. TSG (Accession NM_020648) is another VGAM47 host target gene. TSG BINDING SITE is HOST TARGET binding site found in the 3' untranslated region of mRNA encoded by TSG, corresponding to a HOST TARGET binding site such as BINDING SITE I, BINDING SITE II or BINDING SITE III. Table 2 illustrates the complementarity of the nucleotide sequences of TSG BINDING SITE, designated SEQ ID:21811, to the nucleotide sequence of VGAM47 RNA, herein designated VGAM RNA, also designated SEQ ID:2758.

Another function of VGAM47 is therefore inhibition of TSG (Accession NM_020648). Accordingly, utilities of VGAM47 include diagnosis, prevention and treatment of diseases and clinical conditions associated with TSG. KIAA1332 (Accession XM_048774) is another VGAM47 host target gene. KIAA1332 BINDING SITE is HOST TARGET binding site found in the 3" untranslated region of mRNA encoded by KIAA1332, corresponding to a HOST TARGET binding site such as BINDING SITE I, BINDING SITE II or BINDING SITE III. Table 2 illustrates the complementarity of the nucleotide sequences of KIAA1332 BINDING SITE, designated SEQ ID:35258, to the nucleotide sequence of VGAM47 RNA, herein designated VGAM RNA, also designated SEQ ID:2758.

Another function of VGAM47 is therefore inhibition of KIAA1332 (Accession XM_048774). Accordingly, utilities of VGAM47 include diagnosis, prevention and treatment of diseases and clinical conditions associated with KIAA1332. KIAA1912 (Accession XM_055636) is another VGAM47 host target gene. KIAA1912 BINDING SITE is HOST TARGET binding site found in the 3' untranslated region of mRNA encoded by KIAA1912, corresponding to a HOST TARGET binding site such as BINDING SITE I, BINDING SITE II or BINDING SITE III. Table 2 illustrates the complementarity of the nucleotide sequences of KIAA1912 BINDING SITE, designated SEQ ID:36313, to the nucleotide sequence of VGAM47 RNA, herein designated VGAM RNA, also designated SEQ ID:2758.

Another function of VGAM47 is therefore inhibition of KIAA1912 (Accession XM_055636). Accordingly, utilities of VGAM47 include diagnosis, prevention and treatment of diseases and clinical conditions associated with KIAA1912. LOC127534 (Accession XM_060532) is another VGAM47 host target gene. LOC127534 BINDING SITE is HOST TARGET binding site found in the 3' untranslated region of mRNA encoded by LOC127534, corresponding to a HOST TARGET binding site such as BINDING SITE I, BINDING SITE II or BINDING SITE III. Table 2 illustrates the complementarity of the nucleotide sequences of LOC127534 BINDING SITE, designated SEQ ID:37172, to the nucleotide sequence of VGAM47 RNA, herein designated VGAM RNA, also designated SEQ ID:2758.

Another function of VGAM47 is therefore inhibition of LOC127534 (Accession XM_060532). Accordingly, utilities of VGAM47 include diagnosis, prevention and treatment of diseases and clinical conditions associated with LOC127534. LOC146880 (Accession XM_085627) is another VGAM47 host target gene. LOC146880 BINDING SITE is HOST TARGET binding site found in the 3' untranslated region of mRNA encoded by LOC146880, corresponding to a HOST TARGET binding site such as BINDING SITE I, BINDING SITE II or BINDING SITE III. Table 2 illustrates the complementarity of the nucleotide sequences of LOC146880 BINDING SITE, designated SEQ ID:38259, to the nucleotide sequence of VGAM47 RNA, herein designated VGAM RNA, also designated SEQ ID:2758.

Another function of VGAM47 is therefore inhibition of LOC146880 (Accession XM_085627). Accordingly, utilities of VGAM47 include diagnosis, prevention and treatment of diseases and clinical conditions associated with LOC146880. LOC221656 (Accession XM_166418) is another VGAM47 host target gene. LOC221656 BINDING SITE is HOST TARGET binding site found in the 3' untranslated region of mRNA encoded by LOC221656, corresponding to a HOST TARGET binding site such as BINDING SITE I, BINDING SITE II or BINDING SITE III. Table 2 illustrates the complementarity of the nucleotide sequences of LOC221656 BINDING SITE, designated SEQ ID:44294, to the nucleotide sequence of VGAM47 RNA, herein designated VGAM RNA, also designated SEQ ID:2758.

Another function of VGAM47 is therefore inhibition of LOC221656 (Accession XM_166418). Accordingly, utilities of VGAM47 include diagnosis, prevention and treatment of diseases and clinical conditions associated with LOC221656. FIG. 1 further provides a conceptual description of a novel bioinformatically detected viral gene of the present invention, referred to here as Viral Genomic Address Messenger 48 (VGAM48) viral gene, which modulates expression of respective host target genes thereof, the function and utility of which host target genes is known in the art.

VGAM48 is a novel bioinformatically detected regulatory, non protein coding, viral micro RNA (miRNA) gene. The method by which VGAM48 was detected is described hereinabove with reference to FIGS. 1-8.

VGAM48 gene, herein designated VGAM GENE, is a viral gene contained in the genome of Invertebrate Iridescent Virus 6. VGAM48 host target gene, herein designated VGAM HOST TARGET GENE, is a human gene contained in the human genome.

VGAM48 gene encodes a VGAM48 precursor RNA, herein designated VGAM PRECURSOR RNA. Similar to other miRNA genes, and unlike most ordinary genes, VGAM48 precursor RNA does not encode a protein. A nucleotide sequence identical or highly similar to the nucleotide sequence of VGAM48 precursor RNA is designated SEQ ID:34, and is provided hereinbelow with reference to the sequence listing part. Nucleotide sequence SEQ ID:34 is located at position 168080 relative to the genome of Invertebrate Iridescent Virus 6.

VGAM48 precursor RNA folds onto itself, forming VGAM48 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM48 folded precursor RNA into VGAM48 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM48 RNA is designated SEQ ID:2759, and is provided hereinbelow with reference to the sequence listing part.

VGAM48 host target gene, herein designated VGAM HOST TARGET GENE, encodes a corresponding messenger RNA, VGAM48 host target RNA, herein designated VGAM HOST TARGET RNA. VGAM48 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM48 RNA, herein designated VGAM RNA, binds complementarily to one or more host target binding sites located in untranslated regions of VGAM48 host target RNA, herein designated VGAM HOST TARGET RNA. This complementary binding is due to the fact that the nucleotide sequence of VGAM48 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM48 RNA, herein designated VGAM RNA, may have a different number of host target binding sites in untranslated regions of a VGAM48 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM48 RNA, herein designated VGAM RNA, to host target binding sites on VGAM48 host target RNA, herein designated VGAM HOST TARGET RNA, such as BINDING SITE I, BINDING SITE II and BINDING SITE III, inhibits translation of VGAM48 host target RNA into VGAM48 host target protein, herein designated VGAM HOST TARGET PROTEIN. VGAM host target protein is therefore outlined by a broken line.

It is appreciated that VGAM48 host target gene, herein designated VGAM HOST TARGET GENE, in fact represents a plurality of VGAM48 host target genes. The mRNA of each one of this plurality of VGAM48 host target genes comprises one or more host target binding sites, each having a nucleotide sequence which is at least partly complementary to VGAM48 RNA, herein designated VGAM RNA, and which when bound by VGAM48 RNA causes inhibition of translation of respective one or more VGAM48 host target proteins.

It is further appreciated by one skilled in the art that the mode of translational inhibition illustrated by FIG. 1 with specific reference to translational inhibition exerted by VGAM48 gene, herein designated VGAM GENE, on one or more VGAM48 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM48 is inhibition of expression of host target genes, as part of a novel viral mechanism of attacking a host. Accordingly, utilities of VGAM48 include diagnosis, prevention and treatment of viral infection by Invertebrate Iridescent Virus 6. Specific functions, and accordingly utilities, of VGAM48 correlate with, and may be deduced from, the identity of the host target genes which VGAM48 binds and inhibits, and the function of these host target genes, as elaborated hereinbelow.

Nucleotide sequences of the VGAM48 precursor RNA, herein designated VGAM PRECURSOR RNA, and of the 'diced' VGAM48 RNA, herein designated VGAM RNA, and a schematic representation of the secondary folding of VGAM48 folded precursor RNA, herein designated VGAM FOLDED PRECURSOR RNA, of VGAM48 are further described hereinbelow with reference to Table 1.

Nucleotide sequences of host target binding sites, such as BINDING SITE-I, BINDING SITE-II and BINDING SITE-III of FIG. 1, found on VGAM48 host target RNA, and schematic representation of the complementarity of each of these host target binding sites to VGAM48 RNA, herein designated VGAM RNA, are described hereinbelow with reference to Table 2.

As mentioned hereinabove with reference to FIG. 1, a function of VGAM48 gene, herein designated VGAM is inhibition of expression of VGAM48 target genes. It is appreciated that specific functions, and accordingly utilities, of VGAM48 correlate with, and may be deduced from, the identity of the target genes which VGAM48 binds and inhibits, and the function of these target genes, as elaborated hereinbelow.

Chloride Channel 5 (nephrolithiasis 2, X-linked, Dent disease) (CLCN5, Accession NM_000084) is a VGAM48 host target gene. CLCN5 BINDING SITE is HOST TARGET binding site found in the 5' untranslated region of mRNA encoded by CLCN5, corresponding to a HOST TARGET binding site such as BINDING SITE I, BINDING SITE II or BINDING SITE III. Table 2 illustrates the complementarity of the nucleotide sequences of CLCN5 BINDING SITE, designated SEQ ID:5535, to the nucleotide sequence of VGAM48 RNA, herein designated VGAM RNA, also designated SEQ ID:2759.

A function of VGAM48 is therefore inhibition of Chloride Channel 5 (nephrolithiasis 2, X-linked, Dent disease) (CLCN5, Accession NM_000084), a gene which may interenes in renal tubular function. Accordingly, utilities of VGAM48 include diagnosis, prevention and treatment of diseases and clinical conditions associated with CLCN5. The function of CLCN5 has been established by previous studies. Lloyd et al. (1996) found mutations in the CLCN5 gene in each of 11 kindreds with different renal tubular disorders complicated by kidney stone formation (nephrolithiasis): Dent disease, X-linked recessive nephrolithiasis (OMIM Ref. No. 310468), and X-linked recessive hypophosphatemic rickets (OMIM Ref. No. 307800). There are clearly 2 or more forms of X-linked recessive hypophosphatemia, because one form has already been identified as due to mutations in the gene variously symbolized HYP or PEX, an X-linked phosphate regulating gene with homologies to endopeptidases (see, OMIM Ref. No., for example, 307800.0001). Lloyd et al. (1996) found that heterologous expression of wildtype CLCN5 in Xenopus oocytes yielded outwardly rectifying chloride currents, which were either abolished or markedly reduced by the mutations they found in the gene in these families. Lloyd et al. (1996) found Dent disease associated with the mutations W279X (300008.0001), R648X (300008.0002), L200R (300008.0003), S529P (300008.0004), 2 microdeletions, and 2 donor splice site mutations; X-linked nephrolithiasis was associated with R704X (300008.0005) and G506E (300008.0006); and X-linked hypophosphatemia was associated with S244L (300008.0007). All the disease-causing missense mutations were confined to the predicted transmembrane domains. In addition, the R648X and R704X mutations, which predicted a loss of 142 amino acids from the cytoplasmic C-terminus, had deleted domain D13, which is conserved in all eukaryotic chloride channel proteins. The donor splice site mutations, which were associated with a loss of exon 5, led to an in-frame deletion of the predicted transmembrane domain D2. An annual urinary screening program of Japanese children above 3 years of age identified a progressive proximal renal tubular disorder characterized by low molecular weight proteinuria, hypercalciuria, and nephrocalcinosis (Igarashi et al., 1995). Some children additionally demonstrated hematuria, glycosuria, aminoaciduria, impaired urinary concentrating ability, and mild decrease in creatinine clearance. The disease occurred predominantly in males and had been reported to be familial. Although the disorder was similar to Dent disease, notable differences were the lack of rickets or renal failure in the Japanese children. Lloyd et al. (1997) investigated 4 unrelated Japanese kindreds with this tubulopathy and identified 4 different CLCN5 mutations (2 OMIM Ref. No. 300008.0008). Mutational screening of CLCN5 by SSCP analysis was predicted to help supplement the clinical evaluation of the annual urinary screening program for this disorder. Animal model experiments lend further support to the function of CLCN5. Piwon et al. (2000) created an animal model of Dent disease by targeted disruption of the Clcn5 gene in mice. Clcn5 -/- mice had proteinuria due to strong reduction of apical proximal tubular endocytosis. Both receptor-mediated and fluid-phase endocytosis were affected, and the internalization of the apical transporters NaPi2 and NHE3 (OMIM Ref. No. 182307) was slowed. At steady state, however, both proteins were redistributed from the plasma membrane to intracellular vesicles. Piwon et al. (2000) postulated that this may have been caused by an increased stimulation of luminal parathyroid hormone (PTH; 168450) receptors (see OMIM Ref. No. 168468) owing to the observed decreased tubular endocytosis of PTH. The rise in luminal PTH concentration should also stimulate the hydroxylation of 25-hydroxy vitamin D3 to the active hormone. However, this would be counteracted by a urinary loss of the precursor 25-hydroxy vitamin D3. The balance between these opposing effects, both of which are secondary to the defect in proximal tubular endocytosis, probably determines whether there will be hypercalciuria and kidney stones. Piwon et al. (2000) showed that CLC5 is crucial for efficient endocytosis in the proximal tubule. CLC5 was the first intracellular chloride channel for which a role in vesicle trafficking was established. Piwon et al. (2000) argued that their mouse model strongly suggests that alterations in hormones involved in calcium homeostasis, and hyperphosphaturia and hypocalciuria, are indirect effects of defective apical endocytosis of PTH and 25-hydroxy D3; this may explain how a defect in a chloride channel could lead to kidney stones.

It is appreciated that the abovementioned animal model for CLCN5 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Igarashi, T.; Hayakawa, H.; Shiraga, H.; Kawato, H.; Yan, K.; Kawaguchi, H.; Yamanake, T.; Tsuchida, S.; Akagi, K.: Hypercalciuria and nephrocalcinosis in patients with idiopathic low molecular weight proteinuria in Japan: is the disease identical to Dent's disease in the United Kingdom? Nephron. 69:242-247, 1995; and Lloyd, S. E.; Gunther, W.; Pearce, S. H. S.; Thomson, A.; Bianchi, M. L.; Bosio, M.; Craig, I. W.; Fisher, S. E.; Scheinman, S. J.; Wrong, O.; Jentsch, T. J.; Thakker, R. V.: Characte.

Further studies establishing the function and utilities of CLCN5 are found in John Hopkins OMIM database record ID 300008, and in sited publications numbered 6569-6583 listed in the bibliography section hereinbelow, which are also hereby incorporated by reference. ATPase, Class II, Type 9A (ATP9A, Accession XM_030577) is another VGAM48 host target gene. ATP9A BINDING SITE is HOST TARGET binding site found in the 3' untranslated region of mRNA encoded by ATP9A, corresponding to a HOST TARGET binding site such as BINDING SITE I, BINDING SITE II or BINDING SITE III. Table 2 illustrates the complementarity of the nucleotide sequences of ATP9A BINDING SITE, designated SEQ ID:31079, to the nucleotide sequence of VGAM48 RNA, herein designated VGAM RNA, also designated SEQ ID:2759.

Another function of VGAM48 is therefore inhibition of ATPase, Class II, Type 9A (ATP9A, Accession XM_030577). Accordingly, utilities of VGAM48 include diagnosis, prevention and treatment of diseases and clinical conditions associated with ATP9A. KIAA1383 (Accession XM_045859) is another VGAM48 host target gene. KIAA1383 BINDING SITE is HOST TARGET binding site found in the 3' untranslated region of mRNA encoded by KIAA1383, corresponding to a HOST TARGET binding site such as BINDING SITE I, BINDING SITE II or BINDING SITE III. Table 2 illustrates the complementarity of the nucleotide sequences of KIAA1383 BINDING SITE, designated SEQ ID:34583, to the nucleotide sequence of VGAM48 RNA, herein designated VGAM RNA, also designated SEQ ID:2759.

Another function of VGAM48 is therefore inhibition of KIAA1383 (Accession XM_045859). Accordingly, utilities of VGAM48 include diagnosis, prevention and treatment of diseases and clinical conditions associated with KIAA1383. LOC219722 (Accession XM_167593) is another VGAM48 host target gene. LOC219722 BINDING SITE is HOST TARGET binding site found in the 3' untranslated region of mRNA encoded by LOC219722, corresponding to a HOST TARGET binding site such as BINDING SITE I, BINDING SITE II or BINDING SITE III. Table 2 illustrates the complementarity of the nucleotide sequences of LOC219722 BINDING SITE, designated SEQ ID:44708, to the nucleotide sequence of VGAM48 RNA, herein designated VGAM RNA, also designated SEQ ID:2759.

Another function of VGAM48 is therefore inhibition of LOC219722 (Accession XM_167593). Accordingly, utilities of VGAM48 include diagnosis, prevention and treatment of diseases and clinical conditions associated with LOC219722. FIG. 1 further provides a conceptual description of a novel bioinformatically detected viral gene of the present invention, referred to here as Viral Genomic Address Messenger 49 (VGAM49) viral gene, which modulates expression of respective host target genes thereof, the function and utility of which host target genes is known in the art.

VGAM49 is a novel bioinformatically detected regulatory, non protein coding, viral micro RNA (miRNA) gene. The method by which VGAM49 was detected is described hereinabove with reference to FIGS. 1-8.

VGAM49 gene, herein designated VGAM GENE, is a viral gene contained in the genome of Invertebrate Iridescent Virus 6. VGAM49 host target gene, herein designated VGAM HOST TARGET GENE, is a human gene contained in the human genome.

VGAM49 gene encodes a VGAM49 precursor RNA, herein designated VGAM PRECURSOR RNA. Similar to other miRNA genes, and unlike most ordinary genes, VGAM49 precursor RNA does not encode a protein. A nucleotide sequence identical or highly similar to the nucleotide sequence of VGAM49 precursor RNA is designated SEQ ID:35, and is provided hereinbelow with reference to the sequence listing part. Nucleotide sequence SEQ ID:35 is located at position 104443 relative to the genome of Invertebrate Iridescent Virus 6.

VGAM49 precursor RNA folds onto itself, forming VGAM49 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM49 folded precursor RNA into VGAM49 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM49 RNA is designated SEQ ID:2760, and is provided hereinbelow with reference to the sequence listing part.

VGAM49 host target gene, herein designated VGAM HOST TARGET GENE, encodes a corresponding messenger RNA, VGAM49 host target RNA, herein designated VGAM HOST TARGET RNA. VGAM49 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM49 RNA, herein designated VGAM RNA, binds complementarily to one or more host target binding sites located in untranslated regions of VGAM49 host target RNA, herein designated VGAM HOST TARGET RNA. This complementary binding is due to the fact that the nucleotide sequence of VGAM49 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM49 RNA, herein designated VGAM RNA, may have a different number of host target binding sites in untranslated regions of a VGAM49 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM49 RNA, herein designated VGAM RNA, to host target binding sites on VGAM49 host target RNA, herein designated VGAM HOST TARGET RNA, such as BINDING SITE I, BINDING SITE II and BINDING SITE III, inhibits translation of VGAM49 host target RNA into VGAM49 host target protein, herein designated VGAM HOST TARGET PROTEIN. VGAM host target protein is therefore outlined by a broken line.

It is appreciated that VGAM49 host target gene, herein designated VGAM HOST TARGET GENE, in fact represents a plurality of VGAM49 host target genes. The mRNA of each one of this plurality of VGAM49 host target genes comprises one or more host target binding sites, each having a nucleotide sequence which is at least partly complementary to VGAM49 RNA, herein designated VGAM RNA, and which when bound by VGAM49 RNA causes inhibition of translation of respective one or more VGAM49 host target proteins.

It is further appreciated by one skilled in the art that the mode of translational inhibition illustrated by FIG. 1 with specific reference to translational inhibition exerted by VGAM49 gene, herein designated VGAM GENE, on one or more VGAM49 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM49 is inhibition of expression of host target genes, as part of a novel viral mechanism of attacking a host. Accordingly, utilities of VGAM49 include diagnosis, prevention and treatment of viral infection by Invertebrate Iridescent Virus 6. Specific functions, and accordingly utilities, of VGAM49 correlate with, and may be deduced from, the identity of the host target genes which VGAM49 binds and inhibits, and the function of these host target genes, as elaborated hereinbelow.

Nucleotide sequences of the VGAM49 precursor RNA, herein designated VGAM PRECURSOR RNA, and of the 'diced' VGAM49 RNA, herein designated VGAM RNA, and a schematic representation of the secondary folding of VGAM49 folded precursor RNA, herein designated VGAM FOLDED PRECURSOR RNA, of VGAM49 are further described hereinbelow with reference to Table 1.

Nucleotide sequences of host target binding sites, such as BINDING SITE-I, BINDING SITE-II and BINDING SITE-III of FIG. 1, found on VGAM49 host target RNA, and schematic representation of the complementarity of each of these host target binding sites to VGAM49 RNA, herein designated VGAM RNA, are described hereinbelow with reference to Table 2.

As mentioned hereinabove with reference to FIG. 1, a function of VGAM49 gene, herein designated VGAM is inhibition of expression of VGAM49 target genes. It is appreciated that specific functions, and accordingly utilities, of VGAM49 correlate with, and may be deduced from, the identity of the target genes which VGAM49 binds and inhibits, and the function of these target genes, as elaborated hereinbelow.

Immunoglobulin J Polypeptide, Linker Protein For Immunoglobulin Alpha and Mu Polypeptides (IGJ, Accession NM_144646) is a VGAM49 host target gene. IGJ BINDING SITE is HOST TARGET binding site found in the 3' untranslated region of mRNA encoded by IGJ, corresponding to a HOST TARGET binding site such as BINDING SITE I, BINDING SITE II or BINDING SITE III. Table 2 illustrates the complementarity of the nucleotide sequences of IGJ BINDING SITE, designated SEQ ID:29472, to the nucleotide sequence of VGAM49 RNA, herein designated VGAM RNA, also designated SEQ ID:2760.

A function of VGAM49 is therefore inhibition of Immunoglobulin J Polypeptide, Linker Protein For Immunoglobulin Alpha and Mu Polypeptides (IGJ, Accession NM_144646), a gene which serves to link two monomer units of either igm or iga and also helps to bind these immunoglobulins to secretory components. Accordingly, utilities of VGAM49 include diagnosis, prevention and treatment of diseases and clinical conditions associated with IGJ. The function of IGJ has been established by previous studies. J chain is a 137-amino acid protein that is synthesized in B lymphocytes and serves 2 known functions: linking immunoglobulin monomers (IgM to pentamers, IgA to dimers) and binding these immunoglobulins to secretory component (Koshland, 1985). Using probes from J chain clones, Max et al. (1986) assigned the J chain gene to 4q21 by Southern analysis of somatic cell hybrids and by in situ hybridization. This band is the site of translocations with chromosome 11 in some acute lymphocytic leukemias. In the mouse, JCH maps to chromosome 5 which carries 4 other genes that are also on human no. 4 (PGM2, PEPS, ALB, and AFP). Max et al. (1986) also discovered genetic variation in the number of repeats of a 27-bp sequence that is tandemly reduplicated 5-prime of the human J chain gene. They suggested that this polymorphism may be 'useful in genetic linkage studies in a region of chromosome 4 heretofore relatively barren of markers definitively localized to a particular subband.' (The OMIM Ref. No. 146970, 147010, 147230 for the J region genes of kappa, heavy and lambda chains, respectively.)

Full details of the abovementioned studies are described in the following publications, the disclosure of which are hereby incorporated by reference:

Koshland, M. E.: The coming of age of the immunoglobulin J chain. Annu. Rev. Immun. 3:425-453, 1985; and Max, E. E.; McBride, O. W.; Morton, C. C.; Robinson, M. A.: Human J chain gene: chromosomal localization and associated restriction fragment length polymorphisms. Proc. Nat. Acad. Sci.

Further studies establishing the function and utilities of IGJ are found in John Hopkins OMIM database record ID 147790, and in sited publications numbered 11593-11594 listed in the bibliography section hereinbelow, which are also hereby incorporated by reference. ATP6M8-9 (Accession NM_005765) is another VGAM49 host target gene.

ATP6M8-9 BINDING SITE is HOST TARGET binding site found in the 3' untranslated region of mRNA encoded by ATP6M8-9, corresponding to a HOST TARGET binding site such as BINDING SITE I, BINDING SITE II or BINDING SITE III. Table 2 illustrates the complementarity of the nucleotide sequences of ATP6M8-9 BINDING SITE, designated SEQ ID:12327, to the nucleotide sequence of VGAM49 RNA, herein designated VGAM RNA, also designated SEQ ID:2760.

Another function of VGAM49 is therefore inhibition of ATP6M8-9 (Accession NM_005765). Accordingly, utilities of VGAM49 include diagnosis, prevention and treatment of diseases and clinical conditions associated with ATP6M8-9. KIAA0447 (Accession XM_049733) is another VGAM49 host target gene. KIAA0447 BINDING SITE is HOST TARGET binding site found in the 3' untranslated region of mRNA encoded by KIAA0447, corresponding to a HOST TARGET binding site such as BINDING SITE I, BINDING SITE II or BINDING SITE III. Table 2 illustrates the complementarity of the nucleotide sequences of KIAA0447 BINDING SITE, designated SEQ ID:35490, to the nucleotide sequence of VGAM49 RNA, herein designated VGAM RNA, also designated SEQ ID:2760.

Another function of VGAM49 is therefore inhibition of KIAA0447 (Accession XM_049733). Accordingly, utilities of VGAM49 include diagnosis, prevention and treatment of diseases and clinical conditions associated with KIAA0447. MGC11352 (Accession XM_035941) is another VGAM49 host target gene. MGC11352 BINDING SITE is HOST TARGET binding site found in the 3' untranslated region of mRNA encoded by MGC11352, corresponding to a HOST TARGET binding site such as BINDING SITE I, BINDING SITE II or BINDING SITE III. Table 2 illustrates the complementarity of the nucleotide sequences of MGC11352 BINDING SITE, designated SEQ ID:32356, to the nucleotide sequence of VGAM49 RNA, herein designated VGAM RNA, also designated SEQ ID:2760.

Another function of VGAM49 is therefore inhibition of MGC11352 (Accession XM_035941). Accordingly, utilities of VGAM49 include diagnosis, prevention and treatment of diseases and clinical conditions associated with MGC11352. LOC136015 (Accession XM_072440) is another VGAM49 host target gene. LOC136015 BINDING SITE is HOST TARGET binding site found in the 3' untranslated region of mRNA encoded by LOC136015, corresponding to a HOST TARGET binding site such as BINDING SITE I, BINDING SITE II or BINDING SITE III. Table 2 illustrates the complementarity of the nucleotide sequences of LOC136015 BINDING SITE, designated SEQ ID:37500, to the nucleotide sequence of VGAM49 RNA, herein designated VGAM RNA, also designated SEQ ID:2760.

Another function of VGAM49 is therefore inhibition of LOC136015 (Accession XM_072440). Accordingly, utilities of VGAM49 include diagnosis, prevention and treatment of diseases and clinical conditions associated with LOC136015. LOC154788 (Accession XM_098607) is another VGAM49 host target gene. LOC154788 BINDING SITE is HOST TARGET binding site found in the 3' untranslated region of mRNA encoded by LOC154788, corresponding to a HOST TARGET binding site such as BINDING SITE I, BINDING SITE II or BINDING SITE III. Table 2 illustrates the complementarity of the nucleotide sequences of LOC154788 BINDING SITE, designated SEQ ID:41725, to the nucleotide sequence of VGAM49 RNA, herein designated VGAM RNA, also designated SEQ ID:2760.

Another function of VGAM49 is therefore inhibition of LOC154788 (Accession XM_098607). Accordingly, utilities of VGAM49 include diagnosis, prevention and treatment of diseases and clinical conditions associated with LOC154788. FIG. 1 further provides a conceptual description of a novel bioinformatically detected viral gene of the present invention, referred to here as Viral Genomic Address Messenger 50 (VGAM50) viral gene, which modulates expression of respective host target genes thereof, the function and utility of which host target genes is known in the art.

VGAM50 is a novel bioinformatically detected regulatory, non protein coding, viral micro RNA (miRNA) gene. The method by which VGAM50 was detected is described hereinabove with reference to FIGS. 1-8.

VGAM50 gene, herein designated VGAM GENE, is a viral gene contained in the genome of Invertebrate Iridescent Virus 6. VGAM50 host target gene, herein designated VGAM HOST TARGET GENE, is a human gene contained in the human genome.

VGAM50 gene encodes a VGAM50 precursor RNA, herein designated VGAM PRECURSOR RNA. Similar to other miRNA genes, and unlike most ordinary genes, VGAM50 precursor RNA does not encode a protein. A nucleotide sequence identical or highly similar to the nucleotide sequence of VGAM50 precursor RNA is designated SEQ ID:36, and is provided hereinbelow with reference to the sequence listing part. Nucleotide sequence SEQ ID:36 is located at position 92898 relative to the genome of Invertebrate Iridescent Virus 6.

VGAM50 precursor RNA folds onto itself, forming VGAM50 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM50 folded precursor RNA into VGAM50 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM50 RNA is designated SEQ ID:2761, and is provided hereinbelow with reference to the sequence listing part.

VGAM50 host target gene, herein designated VGAM HOST TARGET GENE, encodes a corresponding messenger RNA, VGAM50 host target RNA, herein designated VGAM HOST TARGET RNA. VGAM50 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM50 RNA, herein designated VGAM RNA, binds complementarily to one or more host target binding sites located in untranslated regions of VGAM50 host target RNA, herein designated VGAM HOST TARGET RNA. This complementary binding is due to the fact that the nucleotide sequence of VGAM50 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM50 RNA, herein designated VGAM RNA, may have a different number of host target binding sites in untranslated regions of a VGAM50 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM50 RNA, herein designated VGAM RNA, to host target binding sites on VGAM50 host target RNA, herein designated VGAM HOST TARGET RNA, such as BINDING SITE I, BINDING SITE II and BINDING SITE III, inhibits translation of VGAM50 host target RNA into VGAM50 host target protein, herein designated VGAM HOST TARGET PROTEIN. VGAM host target protein is therefore outlined by a broken line.

It is appreciated that VGAM50 host target gene, herein designated VGAM HOST TARGET GENE, in fact represents a plurality of VGAM50 host target genes. The mRNA of each one of this plurality of VGAM50 host target genes comprises one or more host target binding sites, each having a nucleotide sequence which is at least partly complementary to VGAM50 RNA, herein designated VGAM RNA, and which when bound by VGAM50 RNA causes inhibition of translation of respective one or more VGAM50 host target proteins.

It is further appreciated by one skilled in the art that the mode of translational inhibition illustrated by FIG. 1 with specific reference to translational inhibition exerted by VGAM50 gene, herein designated VGAM GENE, on one or more VGAM50 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM50 is inhibition of expression of host target genes, as part of a novel viral mechanism of attacking a host. Accordingly, utilities of VGAM50 include diagnosis, prevention and treatment of viral infection by Invertebrate Iridescent Virus 6. Specific functions, and accordingly utilities, of VGAM50 correlate with, and may be deduced from, the identity of the host target genes which VGAM50 binds and inhibits, and the function of these host target genes, as elaborated hereinbelow.

Nucleotide sequences of the VGAM50 precursor RNA, herein designated VGAM PRECURSOR RNA, and of the 'diced' VGAM50 RNA, herein designated VGAM RNA, and a schematic representation of the secondary folding of VGAM50 folded precursor RNA, herein designated VGAM FOLDED PRECURSOR RNA, of VGAM50 are further described hereinbelow with reference to Table 1.

Nucleotide sequences of host target binding sites, such as BINDING SITE-I, BINDING SITE-II and BINDING SITE-III of FIG. 1, found on VGAM50 host target RNA, and schematic representation of the complementarity of each of these host target binding sites to VGAM50 RNA, herein designated VGAM RNA, are described hereinbelow with reference to Table 2.

As mentioned hereinabove with reference to FIG. 1, a function of VGAM50 gene, herein designated VGAM is inhibition of expression of VGAM50 target genes. It is appreciated that specific functions, and accordingly utilities, of VGAM50 correlate with, and may be deduced from, the identity of the target genes which VGAM50 binds and inhibits, and the function of these target genes, as elaborated hereinbelow.

Inositol Polyphosphate-5-phosphatase, 75 kDa (INPP5B, Accession XM_170949) is a VGAM50 host target gene. INPP5B BINDING SITE is HOST TARGET binding site found in the 3' untranslated region of mRNA encoded by INPP5B, corresponding to a HOST TARGET binding site such as BINDING SITE I, BINDING SITE II or BINDING SITE III. Table 2 illustrates the complementarity of the nucleotide sequences of INPP5B BINDING SITE, designated SEQ ID:45733, to the nucleotide sequence of VGAM50 RNA, herein designated VGAM RNA, also designated SEQ ID:2761.

A function of VGAM50 is therefore inhibition of Inositol Polyphosphate-5-phosphatase, 75 kDa (INPP5B, Accession XM_170949), a gene which hydrolyzes the calcium-mobilizing second messenger ins (1,4,5) p3. Accordingly, utilities of VGAM50 include diagnosis, prevention and treatment of diseases and clinical conditions associated with INPP5B. The function of INPP5B has been established by previous studies. The 75-kD inositol polyphosphate-5-phosphatase enzyme was originally isolated from human platelets and cloned from human megakaryocytic and placental cDNA libraries (Ross et al., 1991). It is 1 of at least 3 enzymes known to catalyze the conversion of inositol-1,4,5-triphosphate (IP3) to inositol-1, 4-biphosphate (IP2). Three enzymes with this activity were identified: a 45-kD polypeptide, a 75-kD polypeptide, and a 120-kD polypeptide. By fluorescence in situ hybridization, Janne et al. (1994) found that the gene for the 75-kD enzyme (OMIM Ref. No. INPP5B) is located on band 1p34. The result was corroborated by Southern blot analysis of rodent/human hybrids containing portions of chromosome 1. Janne et al. (1995) determined that the mouse Inpp5b gene is located on distal mouse chromosome 4 within the conserved linkage group corresponding to human 1p. The gene is in the vicinity of the mouse developmental mutation 'dysgenetic lens' (dyl); however, using a genetic approach, Janne et al. (1995) showed that Inpp5b maps distal to dyl on mouse chromosome 4.

Full details of the abovementioned studies are described in the following publications, the disclosure of which are hereby incorporated by reference:

Janne, P. A.; Dutra, A. S.; Dracopoli, N. C.; Charnas, L. R.; Puck, J. M.; Nussbaum, R. L.: Localization of the 75-kDa inositol polyphosphate-5-phosphatase (INPP5B) to human chromosome band 1p34. Cytogenet. Cell Genet. 66:164-166, 1994; and Janne, P. A.; Rochelle, J. M.; Martin-DeLeon, P. A.; Stambolian, D.; Seldin, M. F.; Nussbaum, R. L.: Mapping of the 75-kDa inositol polyphosphate-5-phosphatase (Inpp5b) to distal mouse.

Further studies establishing the function and utilities of INPP5B are found in John Hopkins OMIM database record ID 147264, and in sited publications numbered 4973-4975 listed in the bibliography section hereinbelow, which are also hereby incorporated by reference. Zinc Finger Protein 18 (KOX 11) (ZNF18, Accession XM_085596) is another VGAM50 host target gene. ZNF18 BINDING SITE is HOST TARGET binding site found in the 3' untranslated region of mRNA encoded by ZNF18, corresponding to a HOST TARGET binding site such as BINDING SITE I, BINDING SITE II or BINDING SITE III. Table 2 illustrates the complementarity of the nucleotide sequences of ZNF18 BINDING SITE, designated SEQ ID:38249, to the nucleotide sequence of VGAM50 RNA, herein designated VGAM RNA, also designated SEQ ID:2761.

Another function of VGAM50 is therefore inhibition of Zinc Finger Protein 18 (KOX 11) (ZNF18, Accession XM_085596). Accordingly, utilities of VGAM50 include diagnosis, prevention and treatment of diseases and clinical conditions associated with ZNF18. Calcium/calmodulin-dependent Protein Kinase Kinase 2, Beta (CAMKK2, Accession NM_006549) is another VGAM50 host target gene. CAMKK2 BINDING SITE is HOST TARGET binding site found in the 3' untranslated region of mRNA encoded by CAMKK2, corresponding to a HOST TARGET binding site such as BINDING SITE I, BINDING SITE II or BINDING SITE III. Table 2 illustrates the complementarity of the nucleotide sequences of CAMKK2 BINDING SITE, designated SEQ ID:13310, to the nucleotide sequence of VGAM50 RNA, herein designated VGAM RNA, also designated SEQ ID:2761.

Another function of VGAM50 is therefore inhibition of Calcium/calmodulin-dependent Protein Kinase Kinase 2, Beta (CAMKK2, Accession NM_006549). Accordingly, utilities of VGAM50 include diagnosis, prevention and treatment of diseases and clinical conditions associated with CAMKK2. DKFZp547H025 (Accession NM_020161) is another VGAM50 host target gene. DKFZp547H025 BINDING SITE is HOST TARGET binding site found in the 3' untranslated region of mRNA encoded by DKFZp547H025, corresponding to a HOST TARGET binding site such as BINDING SITE I, BINDING SITE II or BINDING SITE III. Table 2 illustrates the complementarity of the nucleotide sequences of DKFZp547H025 BINDING SITE, designated SEQ ID:21368, to the nucleotide sequence of VGAM50 RNA, herein designated VGAM RNA, also designated SEQ ID:2761.

Another function of VGAM50 is therefore inhibition of DKFZp547H025 (Accession NM_020161). Accordingly, utilities of VGAM50 include diagnosis, prevention and treatment of diseases and clinical conditions associated with DKFZp547H025. FIG. 1 further provides a conceptual description of a novel bioinformatically detected viral gene of the present invention, referred to here as Viral Genomic Address Messenger 51 (VGAM51) viral gene, which modulates expression of respective host target genes thereof, the function and utility of which host target genes is known in the art.

VGAM51 is a novel bioinformatically detected regulatory, non protein coding, viral micro RNA (miRNA) gene. The method by which VGAM51 was detected is described hereinabove with reference to FIGS. 1-8.

VGAM51 gene, herein designated VGAM GENE, is a viral gene contained in the genome of Invertebrate Iridescent Virus 6. VGAM51 host target gene, herein designated VGAM HOST TARGET GENE, is a human gene contained in the human genome.

VGAM51 gene encodes a VGAM51 precursor RNA, herein designated VGAM PRECURSOR RNA. Similar to other miRNA genes, and unlike most ordinary genes, VGAM51 precursor RNA does not encode a protein. A nucleotide sequence identical or highly similar to the nucleotide sequence of VGAM51 precursor RNA is designated SEQ ID:37, and is provided hereinbelow with reference to the sequence listing part. Nucleotide sequence SEQ ID:37 is located at position 57805 relative to the genome of Invertebrate Iridescent Virus 6.

VGAM51 precursor RNA folds onto itself, forming VGAM51 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM51 folded precursor RNA into VGAM51 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM51 RNA is designated SEQ ID:2762, and is provided hereinbelow with reference to the sequence listing part.

VGAM51 host target gene, herein designated VGAM HOST TARGET GENE, encodes a corresponding messenger RNA, VGAM51 host target RNA, herein designated VGAM HOST TARGET RNA. VGAM51 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM51 RNA, herein designated VGAM RNA, binds complementarily to one or more host target binding sites located in untranslated regions of VGAM51 host target RNA, herein designated VGAM HOST TARGET RNA. This complementary binding is due to the fact that the nucleotide sequence of VGAM51 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM51 RNA, herein designated VGAM RNA, may have a different number of host target binding sites in untranslated regions of a VGAM51 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM51 RNA, herein designated VGAM RNA, to host target binding sites on VGAM51 host target RNA, herein designated VGAM HOST TARGET RNA, such as BINDING SITE I, BINDING SITE II and BINDING SITE III, inhibits translation of VGAM51 host target RNA into VGAM51 host target protein, herein designated VGAM HOST TARGET PROTEIN. VGAM host target protein is therefore outlined by a broken line.

It is appreciated that VGAM51 host target gene, herein designated VGAM HOST TARGET GENE, in fact represents a plurality of VGAM51 host target genes. The mRNA of each one of this plurality of VGAM51 host target genes comprises one or more host target binding sites, each having a nucleotide sequence which is at least partly complementary to VGAM51 RNA, herein designated VGAM RNA, and which when bound by VGAM51 RNA causes inhibition of translation of respective one or more VGAM51 host target proteins.

It is further appreciated by one skilled in the art that the mode of translational inhibition illustrated by FIG. 1 with specific reference to translational inhibition exerted by VGAM51 gene, herein designated VGAM GENE, on one or more VGAM51 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM51 is inhibition of expression of host target genes, as part of a novel viral mechanism of attacking a host. Accordingly, utilities of VGAM51 include diagnosis, prevention and treatment of viral infection by Invertebrate Iridescent Virus 6. Specific functions, and accordingly utilities, of VGAM51 correlate with, and may be deduced from, the identity of the host target genes which VGAM51 binds and inhibits, and the function of these host target genes, as elaborated hereinbelow.

Nucleotide sequences of the VGAM51 precursor RNA, herein designated VGAM PRECURSOR RNA, and of the 'diced' VGAM51 RNA, herein designated VGAM RNA, and a schematic representation of the secondary folding of VGAM51 folded precursor RNA, herein designated VGAM FOLDED PRECURSOR RNA, of VGAM51 are further described hereinbelow with reference to Table 1.

Nucleotide sequences of host target binding sites, such as BINDING SITE-I, BINDING SITE-II and BINDING SITE-III of FIG. 1, found on VGAM51 host target RNA, and schematic representation of the complementarity of each of these host target binding sites to VGAM51 RNA, herein designated VGAM RNA, are described hereinbelow with reference to Table 2.

As mentioned hereinabove with reference to FIG. 1, a function of VGAM51 gene, herein designated VGAM is inhibition of expression of VGAM51 target genes. It is appreciated that specific functions, and accordingly utilities, of VGAM51 correlate with, and may be deduced from, the identity of the target genes which VGAM51 binds and inhibits, and the function of these target genes, as elaborated hereinbelow.

Desmin (DES, Accession XM_050962) is a VGAM51 host target gene. DES BINDING SITE is HOST TARGET binding site found in the 3' untranslated region of mRNA encoded by DES, corresponding to a HOST TARGET binding site such as BINDING SITE I, BINDING SITE II or BINDING SITE III. Table 2 illustrates the complementarity of the nucleotide sequences of DES BINDING SITE, designated SEQ ID:35692, to the nucleotide sequence of VGAM51 RNA, herein designated VGAM RNA, also designated SEQ ID:2762.

A function of VGAM51 is therefore inhibition of Desmin (DES, Accession XM_050962). Accordingly, utilities of VGAM51 include diagnosis, prevention and treatment of diseases and clinical conditions associated with DES. Fibroblast Growth Factor 2 (basic) (FGF2, Accession NM_002006) is another VGAM51 host target gene. FGF2 BINDING SITE is HOST TARGET binding site found in the 3' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7741, to the nucleotide sequence of VGAM51 RNA, herein designated VGAM RNA, also designated SEQ ID:2762.

Another function of VGAM51 is therefore inhibition of Fibroblast Growth Factor 2 (basic) (FGF2, Accession NM_002006), a gene which probably involved in nervous system development and function. Accordingly, utilities of VGAM51 include diagnosis, prevention and treatment of diseases and clinical conditions associated with FGF2. The function of FGF2 has been established by previous studies. See fibroblast growth factor-12 (FGF12; 601513). By Southern blot hybridization of genomic DNA from rodent/human hybrid cell lines carrying individual human chromosomes, Smallwood et al. (1996) mapped the FHF2 gene (also symbolized FGF13) to the X chromosome. By using an interspecific backcross mapping panel, they demonstrated that the mouse gene, Fhf2, shows no recombination with the gene for CD40 antigen ligand (OMIM Ref. No. 300386). Thus the human gene is probably located at Xq26. By use of isotopic in situ hybridization, Lovec et al. (1997) assigned the FHF2 gene to Xq21. Gecz et al. (1999), however, provided evidence that the FHF2 gene is located in Xq26.3. They identified a male patient with features of Borjeson-Forssman-Lehmann syndrome (BFLS; 301900) and a duplication of the Xq26-q28 region. By FISH using YAC clones from Xq26, they localized the duplication breakpoint to an interval of approximately 400 kb in the Xq26.3 region between DXS155 and DXS294/DXS730. Database searches and an analysis of available genomic sequence from the region showed that the FHF2 gene is located within the duplication breakpoint interval. Gecz et al. (1999) determined the structure of the FHF2 gene and identified 2 new exons, including a new 5-prime end exon, designated 1B. FHF2 is a large gene, extending over approximately 200 kb in Xq26.3, and contains at least 7 exons. It shows tissue-specific alternative splicing and alternative transcription starts. Northern blot hybridization showed highest expression in brain and skeletal muscle. The localization and tissue-specific expression pattern of FHF2 made it a possible candidate gene for familial cases of BFLS and for other syndromal and nonspecific forms of X-linked mental retardation mapping to that region. Animal model experiments lend further support to the function of FGF2.

It is appreciated that the abovementioned animal model for FGF2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gecz, J.; Baker, E.; Donnelly, A.; Ming, J. E.; McDonald-McGinn, D. M.; Spinner, N. B.; Zackai, E. H.; Sutherland, G. R.; Mulley, J. C.: Fibroblast growth factor homologous factor 2 (FHF2): gene structure, expression and mapping to the Borjeson-Forssman-Lehmann syndrome region in Xq26 delineated by a duplication breakpoint in a BFLS-like patient. Hum. Genet. 104:56-63, 1999; and Lovec, H.; Hartung, H.; Verdier, A.-S.; Mattei, M.-G.; Birnbaum, D.; Goldfarb, M.; Coulier, F.: Assignment of FGF13 to human chromosome band Xq21 by in situ hybridization. Cytogenet.

Further studies establishing the function and utilities of FGF2 are found in John Hopkins OMIM database record ID 300070, and in sited publications numbered 9084-9086 listed in the bibliography section hereinbelow, which are also hereby incorporated by reference. Phosphodiesterase 4B, CAMP-specific (phosphodiesterase E4 dunce homolog, Drosophila) (PDE4B, Accession NM_002600) is another VGAM51 host target gene. PDE4B BINDING SITE is HOST TARGET binding site found in the 3' untranslated region of mRNA encoded by PDE4B, corresponding to a HOST TAR- GET binding site such as BINDING SITE I, BINDING SITE II or BINDING SITE III. Table 2 illustrates the complementarity of the nucleotide sequences of PDE4B BINDING SITE, designated SEQ ID:8467, to the nucleotide sequence of VGAM51 RNA, herein designated VGAM RNA, also designated SEQ ID:2762.

Another function of VGAM51 is therefore inhibition of Phosphodiesterase 4B, CAMP-specific (phosphodiesterase E4 dunce homolog, Drosophila) (PDE4B, Accession NM_002600), a gene which may be involved in mediating central nervous system effects of therapeutic agents ranging from antidepressants to antiasthmatic and anti-inflammatory agents. Accordingly, utilities of VGAM51 include diagnosis, prevention and treatment of diseases and clinical conditions associated with PDE4B. The function of PDE4B has been established by previous studies. Huston et al. (1997) cloned a novel human (plus its cognate rat) PDE4B splice variant and compared its activities to the 2 other splice variants from this locus. Alternative splicing of mRNA generated from both the human and rat PDE4B genes produced long and short splice variants that had unique N-terminal regions. It was suggested that these alternatively spliced regions determined changes in the maximal catalytic activity of the isoforms, their susceptibility to inhibition by rolipram, and mode of interaction with particulate fractions. Milatovich et al. (1994) mapped the PDE4B gene to human 1p31 by a combination of Southern analysis of somatic cell hybrid lines and fluorescence in situ hybridization (FISH); they assigned the mouse homolog to chromosome 4 by Southern analysis of recombinant inbred (RI) mouse strains. Through the use of somatic cell hybrids segregating either human or rat chromosomes, Szpirer et al. (1995) mapped the PDE4B gene to human chromosome 1 and rat chromosome 5.

Full details of the abovementioned studies are described in the following publications, the disclosure of which are hereby incorporated by reference:

Huston, E.; Lumb, S.; Russell, A.; Catterall, C.; Ross, A. H.; Steele, M. R.; Bolger, G. B.; Perry, M. J.; Owens, R. J.; Houslay, M. D.: Molecular cloning and transient expression in COS7 cells of a novel human PDE4B cAMP-specific phosphodiesterase, HSPDE4B3. Biochem. J. 328:549-558, 1997; and Milatovich, A.; Bolger, G.; Michaeli, T.; Francke, U.: Chromosome localizations of genes for five cAMP-specific phosphodiesterases in man and mouse. Somat. Cell Molec. Genet. 20:75-86.

Further studies establishing the function and utilities of PDE4B are found in John Hopkins OMIM database record ID 600127, and in sited publications numbered 1345, 1244 and 1346-1347 listed in the bibliography section hereinbelow, which are also hereby incorporated by reference. Arginine-glutamic Acid Dipeptide (RE) Repeats (RERE, Accession NM_012102) is another VGAM51 host target gene. RERE BINDING SITE is HOST TARGET binding site found in the 3' untranslated region of mRNA encoded by RERE, corresponding to a HOST TARGET binding site such as BINDING SITE I, BINDING SITE II or BINDING SITE III. Table 2 illustrates the complementarity of the nucleotide sequences of RERE BINDING SITE, designated SEQ ID:14407, to the nucleotide sequence of VGAM51 RNA, herein designated VGAM RNA, also designated SEQ ID:2762.

Another function of VGAM51 is therefore inhibition of Arginine-glutamic Acid Dipeptide (RE) Repeats (RERE, Accession NM_012102), a gene which binds DRPLA and locates in the nucleus. Accordingly, utilities of VGAM51 include diagnosis, prevention and treatment of diseases and clinical conditions associated with RERE. The function of RERE has been established by previous studies. Northern blot analysis detected 2 RERE transcripts: one of 9 kb, expressed exclusively in pancreas and testis; and one of 7 kb, expressed most strongly in skeletal muscle with weaker expression in other tissues tested, including brain. The RERE protein migrated at an apparent molecular weight of 212 kD in SDS-PAGE. An RERE fusion protein localized predominantly in the nucleus. Immunoprecipitation and in vitro binding assays demonstrated that the DRPLA and RERE proteins bind each other, which is facilitated by one of the RE repeats, and that extension of the DRPLA polyglutamine tract enhances the binding. Moreover, when RERE is overexpressed, the distribution of endogenous DRPLA protein alters from a diffuse to a speckled pattern in the nucleus so as to colocalize with RERE. More RERE protein is recruited into nuclear aggregates of the DRPLA protein with extended polyglutamine than into those of pure polyglutamine. The authors suggested a function for the DRPLA protein in the nucleus and the RE repeat in the protein-protein interaction. By study of a YAC spanning a translocation/duplication breakpoint within the minimally defined loss of heterozygosity region at 1p36.2-p36.1 in a neuroblastoma cell line, Amler et al. (2000) identified the RERE gene, which they designated DNB1/ARP (deleted in neuroblastoma-1/atrophin-related protein).

Full details of the abovementioned studies are described in the following publications, the disclosure of which are hereby incorporated by reference:

Amler, L. C.; Bauer, A.; Corvi, R.; Dihlmann, S.; Praml, C.; Cavenee, W. K.; Schwab, M.; Hampton, G. M.: Identification and characterization of novel genes located at the t (1;15) (p36.2; q24) translocation breakpoint in the neuroblastoma cell line NGP. Genomics 64:195-202, 2000; and Yanagisawa, H.; Bundo, M.; Miyashita, T.; Okamura-Oho, Y.; Tadokoro, K.; Tokunaga, K.; Yamada, M.: Protein binding of a DRPLA family through arginine-glutamic acid dipeptide repeats is.

Further studies establishing the function and utilities of RERE are found in John Hopkins OMIM database record ID 605226, and in sited publications numbered 7304-7305 listed in the bibliography section hereinbelow, which are also hereby incorporated by reference. ARG99 (Accession NM_031920) is another VGAM51 host target gene. ARG99 BINDING SITE is HOST TARGET binding site found in the 3' untranslated region of mRNA encoded by ARG99, corresponding to a HOST TARGET binding site such as BINDING SITE I, BINDING SITE II or BINDING SITE III. Table 2 illustrates the complementarity of the nucleotide sequences of ARG99 BINDING SITE, designated SEQ ID:25670, to the nucleotide sequence of VGAM51 RNA, herein designated VGAM RNA, also designated SEQ ID:2762.

Another function of VGAM51 is therefore inhibition of ARG99 (Accession NM_031920). Accordingly, utilities of VGAM51 include diagnosis, prevention and treatment of diseases and clinical conditions associated with ARG99. FLJ12592 (Accession NM_032169) is another VGAM51 host target gene. FLJ12592 BINDING SITE is HOST TARGET binding site found in the 3' untranslated region of mRNA encoded by FLJ12592, corresponding to a HOST TARGET binding site such as BINDING SITE I, BINDING SITE II or BINDING SITE III. Table 2 illustrates the complementarity of the nucleotide sequences of FLJ12592 BINDING SITE, designated SEQ ID:25872, to the nucleotide sequence of VGAM51 RNA, herein designated VGAM RNA, also designated SEQ ID:2762.

Another function of VGAM51 is therefore inhibition of FLJ12592 (Accession NM_032169). Accordingly, utilities of VGAM51 include diagnosis, prevention and treatment of diseases and clinical conditions associated with FLJ12592.

KIAA0266 (Accession NM_021645) is another VGAM51 host target gene. KIAA0266 BINDING SITE is HOST TARGET binding site found in the 3' untranslated region of mRNA encoded by KIAA0266, corresponding to a HOST TARGET binding site such as BINDING SITE I, BINDING SITE II or BINDING SITE III. Table 2 illustrates the complementarity of the nucleotide sequences of KIAA0266 BINDING SITE, designated SEQ ID:22312, to the nucleotide sequence of VGAM51 RNA, herein designated VGAM RNA, also designated SEQ ID:2762.

Another function of VGAM51 is therefore inhibition of KIAA0266 (Accession NM_021645). Accordingly, utilities of VGAM51 include diagnosis, prevention and treatment of diseases and clinical conditions associated with KIAA0266. KIAA0478 (Accession NM_014870) is another VGAM51 host target gene. KIAA0478 BINDING SITE is HOST TARGET binding site found in the 3' untranslated region of mRNA encoded by KIAA0478, corresponding to a HOST TARGET binding site such as BINDING SITE I, BINDING SITE II or BINDING SITE III. Table 2 illustrates the complementarity of the nucleotide sequences of KIAA0478 BINDING SITE, designated SEQ ID:16979, to the nucleotide sequence of VGAM51 RNA, herein designated VGAM RNA, also designated SEQ ID:2762.

Another function of VGAM51 is therefore inhibition of KIAA0478 (Accession NM_014870). Accordingly, utilities of VGAM51 include diagnosis, prevention and treatment of diseases and clinical conditions associated with KIAA0478. KIAA0493 (Accession XM_034717) is another VGAM51 host target gene. KIAA0493 BINDING SITE is HOST TARGET binding site found in the 5' untranslated region of mRNA encoded by KIAA0493, corresponding to a HOST TARGET binding site such as BINDING SITE I, BINDING SITE II or BINDING SITE III. Table 2 illustrates the complementarity of the nucleotide sequences of KIAA0493 BINDING SITE, designated SEQ ID:32143, to the nucleotide sequence of VGAM51 RNA, herein designated VGAM RNA, also designated SEQ ID:2762.

Another function of VGAM51 is therefore inhibition of KIAA0493 (Accession XM_034717). Accordingly, utilities of VGAM51 include diagnosis, prevention and treatment of diseases and clinical conditions associated with KIAA0493. LOC127428 (Accession XM_059144) is another VGAM51 host target gene. LOC127428 BINDING SITE is HOST TARGET binding site found in the 3' untranslated region of mRNA encoded by LOC127428, corresponding to a HOST TARGET binding site such as BINDING SITE I, BINDING SITE II or BINDING SITE III. Table 2 illustrates the complementarity of the nucleotide sequences of LOC127428 BINDING SITE, designated SEQ ID:36900, to the nucleotide sequence of VGAM51 RNA, herein designated VGAM RNA, also designated SEQ ID:2762.

Another function of VGAM51 is therefore inhibition of LOC127428 (Accession XM_059144). Accordingly, utilities of VGAM51 include diagnosis, prevention and treatment of diseases and clinical conditions associated with LOC127428. LOC152313 (Accession XM_098190) is another VGAM51 host target gene. LOC152313 BINDING SITE is HOST TARGET binding site found in the 3' untranslated region of mRNA encoded by LOC152313, corresponding to a HOST TARGET binding site such as BINDING SITE I, BINDING SITE II or BINDING SITE III. Table 2 illustrates the complementarity of the nucleotide sequences of LOC152313 BINDING SITE, designated SEQ ID:41470, to the nucleotide sequence of VGAM51 RNA, herein designated VGAM RNA, also designated SEQ ID:2762.

Another function of VGAM51 is therefore inhibition of LOC152313 (Accession XM_098190). Accordingly, utilities of VGAM51 include diagnosis, prevention and treatment of diseases and clinical conditions associated with LOC152313. LOC201952 (Accession XM_117345) is another VGAM51 host target gene. LOC201952 BINDING SITE is HOST TARGET binding site found in the 5' untranslated region of mRNA encoded by LOC201952, corresponding to a HOST TARGET binding site such as BINDING SITE I, BINDING SITE II or BINDING SITE III. Table 2 illustrates the complementarity of the nucleotide sequences of LOC201952 BINDING SITE, designated SEQ ID:43397, to the nucleotide sequence of VGAM51 RNA, herein designated VGAM RNA, also designated SEQ ID:2762.

Another function of VGAM51 is therefore inhibition of LOC201952 (Accession XM_117345). Accordingly, utilities of VGAM51 include diagnosis, prevention and treatment of diseases and clinical conditions associated with LOC201952. LOC220672 (Accession XM_017177) is another VGAM51 host target gene. LOC220672 BINDING SITE is HOST TARGET binding site found in the 3' untranslated region of mRNA encoded by LOC220672, corresponding to a HOST TARGET binding site such as BINDING SITE I, BINDING SITE II or BINDING SITE III. Table 2 illustrates the complementarity of the nucleotide sequences of LOC220672 BINDING SITE, designated SEQ ID:30308, to the nucleotide sequence of VGAM51 RNA, herein designated VGAM RNA, also designated SEQ ID:2762.

Another function of VGAM51 is therefore inhibition of LOC220672 (Accession XM_017177). Accordingly, utilities of VGAM51 include diagnosis, prevention and treatment of diseases and clinical conditions associated with LOC220672. LOC221395 (Accession XM_166354) is another VGAM51 host target gene. LOC221395 BINDING SITE is HOST TARGET binding site found in the 3' untranslated region of mRNA encoded by LOC221395, corresponding to a HOST TARGET binding site such as BINDING SITE I, BINDING SITE II or BINDING SITE III. Table 2 illustrates the complementarity of the nucleotide sequences of LOC221395 BINDING SITE, designated SEQ ID:44184, to the nucleotide sequence of VGAM51 RNA, herein designated VGAM RNA, also designated SEQ ID:2762.

Another function of VGAM51 is therefore inhibition of LOC221395 (Accession XM_166354). Accordingly, utilities of VGAM51 include diagnosis, prevention and treatment of diseases and clinical conditions associated with LOC221395. LOC256529 (Accession XM_174314) is another VGAM51 host target gene. LOC256529 BINDING SITE is HOST TARGET binding site found in the 5' untranslated region of mRNA encoded by LOC256529, corresponding to a HOST TARGET binding site such as BINDING SITE I, BINDING SITE II or BINDING SITE III. Table 2 illustrates the complementarity of the nucleotide sequences of LOC256529 BINDING SITE, designated SEQ ID:46588, to the nucleotide sequence of VGAM51 RNA, herein designated VGAM RNA, also designated SEQ ID:2762.

Another function of VGAM51 is therefore inhibition of LOC256529 (Accession XM_174314). Accordingly, utilities of VGAM51 include diagnosis, prevention and treatment of diseases and clinical conditions associated with LOC256529. FIG. 1 further provides a conceptual description of a novel bioinformatically detected viral gene of the present invention, referred to here as Viral Genomic Address Messenger 52 (VGAM52) viral gene, which modulates expression of respective host target genes thereof, the function and utility of which host target genes is known in the art.

VGAM52 is a novel bioinformatically detected regulatory, non protein coding, viral micro RNA (miRNA) gene. The method by which VGAM52 was detected is described hereinabove with reference to FIGS. 1-8.

VGAM52 gene, herein designated VGAM GENE, is a viral gene contained in the genome of Invertebrate Iridescent Virus 6. VGAM52 host target gene, herein designated VGAM HOST TARGET GENE, is a human gene contained in the human genome.

VGAM52 gene encodes a VGAM52 precursor RNA, herein designated VGAM PRECURSOR RNA. Similar to other miRNA genes, and unlike most ordinary genes, VGAM52 precursor RNA does not encode a protein. A nucleotide sequence identical or highly similar to the nucleotide sequence of VGAM52 precursor RNA is designated SEQ ID:38, and is provided hereinbelow with reference to the sequence listing part. Nucleotide sequence SEQ ID:38 is located at position 109776 relative to the genome of Invertebrate Iridescent Virus 6.

VGAM52 precursor RNA folds onto itself, forming VGAM52 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM52 folded precursor RNA into VGAM52 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM52 RNA is designated SEQ ID:2763, and is provided hereinbelow with reference to the sequence listing part.

VGAM52 host target gene, herein designated VGAM HOST TARGET GENE, encodes a corresponding messenger RNA, VGAM52 host target RNA, herein designated VGAM HOST TARGET RNA. VGAM52 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM52 RNA, herein designated VGAM RNA, binds complementarily to one or more host target binding sites located in untranslated regions of VGAM52 host target RNA, herein designated VGAM HOST TARGET RNA. This complementary binding is due to the fact that the nucleotide sequence of VGAM52 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM52 RNA, herein designated VGAM RNA, may have a different number of host target binding sites in untranslated regions of a VGAM52 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM52 RNA, herein designated VGAM RNA, to host target binding sites on VGAM52 host target RNA, herein designated VGAM HOST TARGET RNA, such as BINDING SITE I, BINDING SITE II and BINDING SITE III, inhibits translation of VGAM52 host target RNA into VGAM52 host target protein, herein designated VGAM HOST TARGET PROTEIN. VGAM host target protein is therefore outlined by a broken line.

It is appreciated that VGAM52 host target gene, herein designated VGAM HOST TARGET GENE, in fact represents a plurality of VGAM52 host target genes. The mRNA of each one of this plurality of VGAM52 host target genes comprises one or more host target binding sites, each having a nucleotide sequence which is at least partly complementary to VGAM52 RNA, herein designated VGAM RNA, and which when bound by VGAM52 RNA causes inhibition of translation of respective one or more VGAM52 host target proteins.

It is further appreciated by one skilled in the art that the mode of translational inhibition illustrated by FIG. 1 with specific reference to translational inhibition exerted by VGAM52 gene, herein designated VGAM GENE, on one or more VGAM52 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM52 is inhibition of expression of host target genes, as part of a novel viral mechanism of attacking a host. Accordingly, utilities of VGAM52 include diagnosis, prevention and treatment of viral infection by Invertebrate Iridescent Virus 6. Specific functions, and accordingly utilities, of VGAM52 correlate with, and may be deduced from, the identity of the host target genes which VGAM52 binds and inhibits, and the function of these host target genes, as elaborated hereinbelow.

Nucleotide sequences of the VGAM52 precursor RNA, herein designated VGAM PRECURSOR RNA, and of the 'diced' VGAM52 RNA, herein designated VGAM RNA, and a schematic representation of the secondary folding of VGAM52 folded precursor RNA, herein designated VGAM FOLDED PRECURSOR RNA, of VGAM52 are further described hereinbelow with reference to Table 1.

Nucleotide sequences of host target binding sites, such as BINDING SITE-I, BINDING SITE-II and BINDING SITE-III of FIG. 1, found on VGAM52 host target RNA, and schematic representation of the complementarity of each of these host target binding sites to VGAM52 RNA, herein designated VGAM RNA, are described hereinbelow with reference to Table 2.

As mentioned hereinabove with reference to FIG. 1, a function of VGAM52 gene, herein designated VGAM is inhibition of expression of VGAM52 target genes. It is appreciated that specific functions, and accordingly utilities, of VGAM52 correlate with, and may be deduced from, the identity of the target genes which VGAM52 binds and inhibits, and the function of these target genes, as elaborated hereinbelow.

KIAA0205 (Accession NM_014873) is a VGAM52 host target gene. KIAA0205 BINDING SITE is HOST TARGET binding site found in the 3' untranslated region of mRNA encoded by KIAA0205, corresponding to a HOST TARGET binding site such as BINDING SITE I, BINDING SITE II or BINDING SITE III. Table 2 illustrates the complementarity of the nucleotide sequences of KIAA0205 BINDING SITE, designated SEQ ID:17002, to the nucleotide sequence of VGAM52 RNA, herein designated VGAM RNA, also designated SEQ ID:2763.

A function of VGAM52 is therefore inhibition of KIAA0205 (Accession NM_014873). Accordingly, utilities of VGAM52 include diagnosis, prevention and treatment of diseases and clinical conditions associated with KIAA0205. Solute Carrier Family 5 (choline transporter), Member 7 (SLC5A7, Accession NM_021815) is another VGAM52 host target gene. SLC5A7 BINDING SITE is HOST TARGET binding site found in the 3' untranslated region of mRNA encoded by SLC5A7, corresponding to a HOST TARGET binding site such as BINDING SITE I, BINDING SITE II or BINDING SITE III. Table 2 illustrates the complementarity of the nucleotide sequences of SLC5A7 BINDING SITE, designated SEQ ID:22389, to the nucleotide sequence of VGAM52 RNA, herein designated VGAM RNA, also designated SEQ ID:2763.

Another function of VGAM52 is therefore inhibition of Solute Carrier Family 5 (choline transporter), Member 7 (SLC5A7, Accession NM_021815). Accordingly, utilities of VGAM52 include diagnosis, prevention and treatment of diseases and clinical conditions associated with SLC5A7. FIG. 1 further provides a conceptual description of a novel bioinformatically detected viral gene of the present invention, referred to here as Viral Genomic Address Messenger 53 (VGAM53) viral gene, which modulates expression of respective host target genes thereof, the function and utility of which host target genes is known in the art.

VGAM53 is a novel bioinformatically detected regulatory, non protein coding, viral micro RNA (miRNA) gene. The method by which VGAM53 was detected is described hereinabove with reference to FIGS. 1-8.

VGAM53 gene, herein designated VGAM GENE, is a viral gene contained in the genome of Invertebrate Iridescent Virus 6. VGAM53 host target gene, herein designated VGAM HOST TARGET GENE, is a human gene contained in the human genome.

VGAM53 gene encodes a VGAM53 precursor RNA, herein designated VGAM PRECURSOR RNA. Similar to other miRNA genes, and unlike most ordinary genes, VGAM53 precursor RNA does not encode a protein. A nucleotide sequence identical or highly similar to the nucleotide sequence of VGAM53 precursor RNA is designated SEQ ID:39, and is provided hereinbelow with reference to the sequence listing part. Nucleotide sequence SEQ ID:39 is located at position 157900 relative to the genome of Invertebrate Iridescent Virus 6.

VGAM53 precursor RNA folds onto itself, forming VGAM53 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM53 folded precursor RNA into VGAM53 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM53 RNA is designated SEQ ID:2764, and is provided hereinbelow with reference to the sequence listing part.

VGAM53 host target gene, herein designated VGAM HOST TARGET GENE, encodes a corresponding messenger RNA, VGAM53 host target RNA, herein designated VGAM HOST TARGET RNA. VGAM53 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM53 RNA, herein designated VGAM RNA, binds complementarily to one or more host target binding sites located in untranslated regions of VGAM53 host target RNA, herein designated VGAM HOST TARGET RNA. This complementary binding is due to the fact that the nucleotide sequence of VGAM53 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM53 RNA, herein designated VGAM RNA, may have a different number of host target binding sites in untranslated regions of a VGAM53 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM53 RNA, herein designated VGAM RNA, to host target binding sites on VGAM53 host target RNA, herein designated VGAM HOST TARGET RNA, such as BINDING SITE I, BINDING SITE II and BINDING SITE III, inhibits translation of VGAM53 host target RNA into VGAM53 host target protein, herein designated VGAM HOST TARGET PROTEIN. VGAM host target protein is therefore outlined by a broken line.

It is appreciated that VGAM53 host target gene, herein designated VGAM HOST TARGET GENE, in fact represents a plurality of VGAM53 host target genes. The mRNA of each one of this plurality of VGAM53 host target genes comprises one or more host target binding sites, each having a nucleotide sequence which is at least partly complementary to VGAM53 RNA, herein designated VGAM RNA, and which when bound by VGAM53 RNA causes inhibition of translation of respective one or more VGAM53 host target proteins.

It is further appreciated by one skilled in the art that the mode of translational inhibition illustrated by FIG. 1 with specific reference to translational inhibition exerted by VGAM53 gene, herein designated VGAM GENE, on one or more VGAM53 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM53 is inhibition of expression of host target genes, as part of a novel viral mechanism of attacking a host. Accordingly, utilities of VGAM53 include diagnosis, prevention and treatment of viral infection by Invertebrate Iridescent Virus 6. Specific functions, and accordingly utilities, of VGAM53 correlate with, and may be deduced from, the identity of the host target genes which VGAM53 binds and inhibits, and the function of these host target genes, as elaborated hereinbelow.

Nucleotide sequences of the VGAM53 precursor RNA, herein designated VGAM PRECURSOR RNA, and of the 'diced' VGAM53 RNA, herein designated VGAM RNA, and a schematic representation of the secondary folding of VGAM53 folded precursor RNA, herein designated VGAM FOLDED PRECURSOR RNA, of VGAM53 are further described hereinbelow with reference to Table 1.

Nucleotide sequences of host target binding sites, such as BINDING SITE-I, BINDING SITE-II and BINDING SITE-III of FIG. 1, found on VGAM53 host target RNA, and schematic representation of the complementarity of each of these host target binding sites to VGAM53 RNA, herein designated VGAM RNA, are described hereinbelow with reference to Table 2.

As mentioned hereinabove with reference to FIG. 1, a function of VGAM53 gene, herein designated VGAM is inhibition of expression of VGAM53 target genes. It is appreciated that specific functions, and accordingly utilities, of VGAM53 correlate with, and may be deduced from, the identity of the target genes which VGAM53 binds and inhibits, and the function of these target genes, as elaborated hereinbelow.

Aconitase 1, Soluble (ACO1, Accession NM_002197) is a VGAM53 host target gene. ACO1 BINDING SITE is HOST TARGET binding site found in the 3' untranslated region of mRNA encoded by ACO1, corresponding to a HOST TARGET binding site such as BINDING SITE I, BINDING SITE II or BINDING SITE III. Table 2 illustrates the complementarity of the nucleotide sequences of ACO1 BINDING SITE, designated SEQ ID:7954, to the nucleotide sequence of VGAM53 RNA, herein designated VGAM RNA, also designated SEQ ID:2764.

A function of VGAM53 is therefore inhibition of Aconitase 1, Soluble (ACO1, Accession NM_002197), a gene which an iron-dependent enzyme; catalyzes conversion of citrate to cis-aconitate in the TCA cycle. Accordingly, utilities of VGAM53 include diagnosis, prevention and treatment of diseases and clinical conditions associated with ACO1. The function of ACO1 has been established by previous studies. Slaughter et al. (1975) reported that an electrophoretic survey had demonstrated 7 alleles at this locus. Among the populations studied, Nigerians showed polymorphism for ACON-S. Aconitase catalyzes the conversion of cis-aconitate to isocitrate. In studies of man-Chinese hamster somatic cell hybrids, Westerveld et al. (1975) showed that human gal-1-p uridyl transferase (GALT; 606999) and aconitase are syntenic. Eisenstein (2000) reviewed of the role of the iron regulatory proteins, IRP1 and IRP2 (OMIM Ref. No. 147582), and the molecular control of mammalian iron metabolism. IRP1 is a bifunctional protein with mutually exclusive functions as an IRE RNA-binding protein or as the cytoplasmic isoform of aconitase. Aconitases are iron-sulfur proteins and a 4Fe-4S cluster is required for their enzymatic activity.

Full details of the abovementioned studies are described in the following publications, the disclosure of which are hereby incorporated by reference:

Slaughter, C. A.; Hopkinson, D. A.; Harris, H.: Aconitase polymorphism in man. Ann. Hum. Genet. 39:193-202, 1975; and Eisenstein, R. S.: Iron regulatory proteins and the molecular control of mammalian iron metabolism. Annu. Rev. Nutr. 20:627-662, 2000.

Further studies establishing the function and utilities of ACO1 are found in John Hopkins OMIM database record ID 100880, and in sited publications numbered 181, 11582-183, 11882-805, 184, 806, 3401, 3780-186, 18 and 3864 listed in the bibliography section hereinbelow, which are also hereby incorporated by reference. Attractin (ATRN, Accession NM_139321) is another VGAM53 host target gene. ATRN BINDING SITE is HOST TARGET binding site found in the 3' untranslated region of mRNA encoded by ATRN, corresponding to a HOST TARGET binding site such as BINDING SITE I, BINDING SITE II or BINDING SITE III. Table 2 illustrates the complementarity of the nucleotide sequences of ATRN BINDING SITE, designated SEQ ID:29300, to the nucleotide sequence of VGAM53 RNA, herein designated VGAM RNA, also designated SEQ ID:2764.

Another function of VGAM53 is therefore inhibition of Attractin (ATRN, Accession NM_139321), a gene which is involved in the initial immune cell clustering during inflammatory response. Accordingly, utilities of VGAM53 include diagnosis, prevention and treatment of diseases and clinical conditions associated with ATRN. The function of ATRN has been established by previous studies. Attractin is a human serum glycoprotein that is rapidly expressed on activated T cells and released extracellularly after 48 to 72 hours. Duke-Cohan et al. (1998) cloned attractin and found that, as in its natural serum form, it mediates the spreading of monocytes that becomes the focus for the clustering of nonproliferating T lymphocytes. There are 2 mRNA species with hematopoietic tissue-specific expression that code for a 134-kD protein with a putative serine protease catalytic serine, 4 EGF-like motifs, a CUB domain, a C-type lectin domain, and a domain homologous with the ligand-binding region of the common gamma cytokine chain. Except for the last 2 domains, the overall structure shares high homology with a protein of Caenorhabditis elegans, suggesting that attractin has evolved new domains and functions in parallel with the development of cell-mediated immunity. When attractin was identified as the product of the murine 'mahogany' gene with connections to control of pigmentation and energy metabolism, and the 'mahogany' product was identified and shown to be a transmembrane protein, the possibility of a human membrane attractin in addition to the secreted form was raised. Tang et al. (2000) described the complete genomic sequence of attractin, focusing in particular on the exons coding for the 3-prime region, and showed how both human membrane and secreted attractin arise as a result of alternate splicing of the same gene. They found that soluble attractin arises from transcription of 25 sequential exons on 20p13, where the 3-prime terminal exon contains sequence from a long interspersed nuclear element-1 (OMIM Ref. No. LINE-1) retrotransposon insertion that includes a stop codon and a polyadenylation signal. The mRNA isoform for membrane attraction splices over the LINE-1 exon and includes 5 exons encoding transmembrane and cytoplasmic domains with organization and coding potential almost identical to that of the mouse gene. The relative abundance of soluble and transmembrane isoforms measured by RT-PCR is differentially regulated in lymphoid tissues. Because activation of peripheral blood leukocytes with phytohemagglutinin induces strong expression of cell surface attractin followed by release of soluble attractin, these results suggested to Tang et al.

(2000) that LINE-1 insertion, a genomic event unique to mammals, provided an evolutionarily mechanism for regulating cell interactions during an inflammatory reaction.

Full details of the abovementioned studies are described in the following publications, the disclosure of which are hereby incorporated by reference:

Duke-Cohan, J. S.; Gu, J.; McLaughlin, D. F.; Xu, Y.; Freeman, G. J.; Schlossman, S. F.: Attractin (DPPT-L), a member of the CUB family of cell adhesion and guidance proteins, is secreted by activated human T lymphocytes and modulates immune cell interactions. Proc. Nat. Acad. Sci. 95:11336-11341, 1998; and Tang, W.; Gunn, T. M.; McLaughlin, D. F.; Barsh, G. S.; Schlossman, S. F.; Duke-Cohan, J. S.: Secreted and membrane attractin result from alternative splicing of the human ATRN gene. Pr.

Further studies establishing the function and utilities of ATRN are found in John Hopkins OMIM database record ID 603130, and in sited publications numbered 648-65 and 5172 listed in the bibliography section hereinbelow, which are also hereby incorporated by reference. Deltex Homolog 1 (Drosophila) (DTX1, Accession NM_004416) is another VGAM53 host target gene. DTX1 BINDING SITE is HOST TARGET binding site found in the 5' untranslated region of mRNA encoded by DTX1, corresponding to a HOST TARGET binding site such as BINDING SITE I, BINDING SITE II or BINDING SITE III. Table 2 illustrates the complementarity of the nucleotide sequences of DTX1 BINDING SITE, designated SEQ ID:10679, to the nucleotide sequence of VGAM53 RNA, herein designated VGAM RNA, also designated SEQ ID:2764.

Another function of VGAM53 is therefore inhibition of Deltex Homolog 1 (Drosophila) (DTX1, Accession NM_004416), a gene which modulates Notch signalling and bHLH transcription factor activity. Accordingly, utilities of VGAM53 include diagnosis, prevention and treatment of diseases and clinical conditions associated with DTX1. The function of DTX1 has been established by previous studies. Using the yeast interaction trap system, Matsuno et al. (1998) found that Drosophila and human deltex bind to the human SH3-domain containing protein GRB2 (OMIM Ref. No. 108355). Results from 2 different reporter assays allowed them for the first time to associate deltex with Notch-dependent transcriptional events. They presented evidence linking deltex to the modulation of basic helix-loop-helix (bHLH) transcription factor activity. After confirming that DTX1 is expressed in T lymphocytes at all stages of development, Izon et al. (2002) showed by RT-PCR analysis that murine Dtx1 is also expressed in hemopoietic stem cells and in B lymphocytes in all stages of development, whereas Notch1 expression is low in these cells. The authors transduced hemopoietic progenitor cells with Dtx1 expressing green fluorescent protein and found that mice with these cells had a marked decrease in T cells in the thymus, peripheral blood, and spleen. Instead, the thymus in these mice and in organ culture displayed B-cell development resembling the phenotype of mice deficient in Notch1. Expression of DTX1 partially inhibited transactivation of a CSL (RBPSUH; 147183)-dependent luciferase reporter by activated intracellular NOTCH1 (ICN1) in human and mouse cells. The N terminus of DTX1, which directly interacts with the NOTCH1 ankyrin repeats, inhibited transactivation by ICN1 possessing the ankyrin repeats, probably by inhibiting recruitment of coactivators to the C-terminal transactivation domain of NOTCH1. Izon et al. (2002) concluded that DTX1 is an inhibitor of NOTCH1 activity, a conclusion earlier suggested by the studies of Sestan et al. (1999) on dendritic outgrowth from human neurons.

Full details of the abovementioned studies are described in the following publications, the disclosure of which are hereby incorporated by reference:

Izon, D. J.; Aster, J. C.; He, Y.; Weng, A.; Karnell, F. G.; Patriub, V.; Xu, L.; Bakkour, S.; Rodriguez, C.; Allman, D.; Pear, W. S.: Deltex1 redirects lymphoid progenitors to the B cell lineage by antagonizing Notch1. Immunity 16:231-243, 2002; and Matsuno, K.; Eastman, D.; Mitsiades, T.; Quinn, A. M.; Carcanciu, M. L.; Ordentlich, P.; Kadesch, T.; Artavanis-Tsakonas, S.: Human deltex is a conserved regulator of Notch signalling.

Further studies establishing the function and utilities of DTX1 are found in John Hopkins OMIM database record ID 602582, and in sited publications numbered 5735, 9040-904 and 12352 listed in the bibliography section hereinbelow, which are also hereby incorporated by reference. F-box and WD-40 Domain Protein 1B (FBXW1B, Accession NM_012300) is another VGAM53 host target gene. FBXW1B BINDING SITE1 through FBXW1B BINDING SITE3 are HOST TARGET binding sites found in untranslated regions of mRNA encoded by FBXW1B, corresponding to HOST TARGET binding sites such as BINDING SITE I, BINDING SITE II or BINDING SITE III. Table 2 illustrates the complementarity of the nucleotide sequences of FBXW1B BINDING SITE1 through FBXW1B BINDING SITE3, designated SEQ ID:14664, SEQ ID:27366 and SEQ ID:27376 respectively, to the nucleotide sequence of VGAM53 RNA, herein designated VGAM RNA, also designated SEQ ID:2764.

Another function of VGAM53 is therefore inhibition of F-box and WD-40 Domain Protein 1B (FBXW1B, Accession NM_012300), a gene which somehow is involved in the process of neuronal cell differentiation or brain development. Accordingly, utilities of VGAM53 include diagnosis, prevention and treatment of diseases and clinical conditions associated with FBXW1B. The function of FBXW1B and its association with various diseases and clinical conditions, has been established by previous studies, as described hereinabove with reference to VGAM25. GRB2-associated Binding Protein 2 (GAB2, Accession NM_080491) is another VGAM53 host target gene. GAB2 BINDING SITE1 and GAB2 BINDING SITE2 are HOST TARGET binding sites found in untranslated regions of mRNA encoded by GAB2, corresponding to HOST TARGET binding sites such as BINDING SITE I, BINDING SITE II or BINDING SITE III. Table 2 illustrates the complementarity of the nucleotide sequences of GAB2 BINDING SITE1 and GAB2 BINDING SITE2, designated SEQ ID:27846 and SEQ ID:34445 respectively, to the nucleotide sequence of VGAM53 RNA, herein designated VGAM RNA, also designated SEQ ID:2764.

Another function of VGAM53 is therefore inhibition of GRB2-associated Binding Protein 2 (GAB2, Accession NM_080491), a gene which act as adapters for transmitting various signals. Accordingly, utilities of VGAM53 include diagnosis, prevention and treatment of diseases and clinical conditions associated with GAB2. The function of GAB2 has been established by previous studies. The GAB2 gene encodes a 100-kd adapter molecule that is the principal activator of phosphatidylinositol-3 kinase (PIK3; OMIM Ref. No. 171833) in response to activation of the high affinity IgE receptor (see OMIM Ref. No. 147140). Zhao et al. (1999) demonstrated that upon tyrosine phosphorylation, GAB2 physically interacts with SHP2 tyrosine phosphatase and GRB2 adapter protein (OMIM Ref. No. 604330). GAB2 has an inhibitory effect on the activation of ELK1 (OMIM Ref. No. 311040)-dependent transcription triggered by a dominant active Ras (OMIM Ref. No. 190020) mutant or under growth factor stimulation, whereas GAB1 acts to potentiate slightly the ELK1 activity in the same system. In contrast to the reciprocal effects of GAB1 and GAB2 in mediating ELK1 induction, these 2 molecules have a similar function in extracellular signal-regulated kinase activation induced by either oncogenic Ras or growth factor stimulation. Zhao et al. (1999) concluded that GAB1 and GAB2 may have distinct roles in coupling cytoplasmic-nuclear signal transduction. Animal model experiments lend further support to the function of GAB2. Gu et al. (2001) generated mice deficient in Gab2 by homologous recombination. Gab2 -/- mice were viable and generally healthy; however, the response of Gab2 -/- mast cells to stimulation of the high affinity IgE receptor Fc-epsilon-RI (see OMIM Ref. No. 147140) was defective. Accordingly, allergic reactions, such as passive cutaneous and systemic anaphylaxis, were markedly impaired in Gab -/- mice. Biochemical analyses revealed that signaling pathways dependent on phosphatidylinositol-3 hydroxykinase (PI3K), a critical component of the Fc-epsilon-RI signaling, were defective in Gab2 -/- mast cells. Gu et al. (2001) concluded that GAB2 is the principal activator of PI3K in response to Fc-epsilon-RI activation, thereby providing genetic evidence that Dos/Gab family scaffolds regulate the PI3K pathway in vivo.

It is appreciated that the abovementioned animal model for GAB2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gu, H.; Saito, K.; Klaman, L. D.; Shen, J.; Fleming, T.; Wang, Y.-P.; Pratt, J. C.; Lin, G.; Lim, B.; Kinet, J.-P.; Neel, B. G.: Essential role for Gab2 in the allergic response. Nature 412:186-190, 2001; and Zhao, C.; Yu, D.-H.; Shen, R.; Feng, G.-S.: Gab2, a new pleckstrin homology domain-containing adapter protein, acts to uncouple signaling from ERK kinase to Elk-1. J. Biol. Chem. 274.

Further studies establishing the function and utilities of GAB2 are found in John Hopkins OMIM database record ID 606203, and in sited publications numbered 907, 673 and 7940 listed in the bibliography section hereinbelow, which are also hereby incorporated by reference. SH3-domain Binding Protein 2 (SH3BP2, Accession NM_003023) is another VGAM53 host target gene. SH3BP2 BINDING SITE is HOST TARGET binding site found in the 3' untranslated region of mRNA encoded by SH3BP2, corresponding to a HOST TARGET binding site such as BINDING SITE I, BINDING SITE II or BINDING SITE III. Table 2 illustrates the complementarity of the nucleotide sequences of SH3BP2 BINDING SITE, designated SEQ ID:8949, to the nucleotide sequence of VGAM53 RNA, herein designated VGAM RNA, also designated SEQ ID:2764.

Another function of VGAM53 is therefore inhibition of SH3-domain Binding Protein 2 (SH3BP2, Accession NM_003023). Accordingly, utilities of VGAM53 include diagnosis, prevention and treatment of diseases and clinical conditions associated with SH3BP2. SHC (Src homology 2 domain containing) Transforming Protein 1 (SHC1, Accession NM_003029) is another VGAM53 host target gene. SHC1 BINDING SITE is HOST TARGET binding site found in the 3' untranslated region of mRNA encoded by SHC1, corresponding to a HOST TARGET binding site such as BINDING SITE I, BINDING SITE II or BINDING SITE III. Table 2 illustrates the complementarity of the nucleotide sequences of SHC1 BINDING SITE, designated SEQ ID:8971, to the nucleotide sequence of VGAM53 RNA, herein designated VGAM RNA, also designated SEQ ID:2764.

Another function of VGAM53 is therefore inhibition of SHC (Src homology 2 domain containing) Transforming Protein 1 (SHC1, Accession NM_003029), a gene which couples activated growth factor receptors to a signaling pathway. Accordingly, utilities of VGAM53 include diagnosis, prevention and treatment of diseases and clinical conditions associated with SHC1. The function of SHC1 has been established by previous studies. Nemoto and Finkel (2002) observed that exposure to intracellular reactive oxygen species (ROS) induced an increase in phosphorylated Fkhrl1 (OMIM Ref. No. 602681) and a shift from a nuclear to a cytosolic localization. They found that serum starvation, a stimulus that increases oxidative stress, resulted in lower levels of hydrogen peroxide in Shc1 -/- cells or in cells expressing a ser36-to-ala (S36A) Shc1 mutant compared with wildtype cells. Serum starvation also increased Fkhrl1-dependent transcriptional activity, which was further augmented in the Shc1-deficient cells. Increased ROS exposure failed to induce increased Fkhrl1 phosphorylation in the mutant cells. Promoter analysis of the catalase (CAT; 115500) gene established the presence of FKHRL1-binding sequences. Reporter assays showed FKHRL1 transactivates CAT, suggesting a capacity to augment antioxidant scavenging. Nemoto and Finkel (2002) concluded that there is an important functional relationship between forkhead proteins (e.g., FKHRL1), SHC1, and intracellular oxidants, all of which are thought to be involved in the aging process in worms and mammals Animal model experiments lend further support to the function of SHC1. Using transgenic Cre-lox-p-mediated inducible expression of a phosphorylation-defective Shc mutant and, alternatively, conditional deletion of the Shc gene in mouse thymocytes, Zhang et al. (2002) showed that both expression and tyrosine phosphorylation of Shc have essential roles in thymic T-cell development. They also provided a concise summary of SHC biology.

It is appreciated that the abovementioned animal model for SHC1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Nemoto, S.; Finkel, T.: Redox regulation of forkhead proteins through a p66shc-dependent signaling pathway. Science 295:2450-2452, 2002; and Zhang, L.; Camerini, V.; Bender, T. P.; Ravichandran, K. S.: A nonredundant role for the adapter protein Shc in thymic T cell development. Nature Immun. 3:749-755, 2002.

Further studies establishing the function and utilities of SHC1 are found in John Hopkins OMIM database record ID 600560, and in sited publications numbered 8158-8159, 50 and 8160-8165 listed in the bibliography section hereinbelow, which are also hereby incorporated by reference. Solute Carrier Family 19 (folate transporter), Member 1 (SLC19A1, Accession NM_003056) is another VGAM53 host target gene. SLC19A1 BINDING SITE is HOST TARGET binding site found in the 3' untranslated region of mRNA encoded by SLC19A1, corresponding to a HOST TARGET binding site such as BINDING SITE I, BINDING SITE II or BINDING SITE III. Table 2 illustrates the complementarity of the nucleotide sequences of SLC19A1 BINDING SITE, designated SEQ ID:9022, to the nucleotide sequence of VGAM53 RNA, herein designated VGAM RNA, also designated SEQ ID:2764.

Another function of VGAM53 is therefore inhibition of Solute Carrier Family 19 (folate transporter), Member 1 (SLC19A1, Accession NM_003056). Accordingly, utilities of VGAM53 include diagnosis, prevention and treatment of diseases and clinical conditions associated with SLC19A1. ABLIM (Accession NM_002313) is another VGAM53 host target gene. ABLIM BINDING SITE1 and ABLIM BINDING SITE2 are HOST TARGET binding sites found in untranslated regions of mRNA encoded by ABLIM, corresponding to HOST TARGET binding sites such as BINDING SITE I, BINDING SITE II or BINDING SITE III. Table 2 illustrates the complementarity of the nucleotide sequences of ABLIM BINDING SITE1 and ABLIM BINDING SITE2, designated SEQ ID:8116 and SEQ ID:13549 respectively, to the nucleotide sequence of VGAM53 RNA, herein designated VGAM RNA, also designated SEQ ID:2764.

Another function of VGAM53 is therefore inhibition of ABLIM (Accession NM_002313). Accordingly, utilities of VGAM53 include diagnosis, prevention and treatment of diseases and clinical conditions associated with ABLIM. BICD2 (Accession XM_046863) is another VGAM53 host target gene. BICD2 BINDING SITE is HOST TARGET binding site found in the 3' untranslated region of mRNA encoded by BICD2, corresponding to a HOST TARGET binding site such as BINDING SITE I, BINDING SITE II or BINDING SITE III. Table 2 illustrates the complementarity of the nucleotide sequences of BICD2 BINDING SITE, designated SEQ ID:34852, to the nucleotide sequence of VGAM53 RNA, herein designated VGAM RNA, also designated SEQ ID:2764.

Another function of VGAM53 is therefore inhibition of BICD2 (Accession XM_046863). Accordingly, utilities of VGAM53 include diagnosis, prevention and treatment of diseases and clinical conditions associated with BICD2. Carbohydrate (N-acetylglucosamine 6-O) Sulfotransferase 4 (CHST4, Accession NM_005769) is another VGAM53 host target gene. CHST4 BINDING SITE is HOST TARGET binding site found in the 3' untranslated region of mRNA encoded by CHST4, corresponding to a HOST TARGET binding site such as BINDING SITE I, BINDING SITE II or BINDING SITE III. Table 2 illustrates the complementarity of the nucleotide sequences of CHST4 BINDING SITE, designated SEQ ID:12337, to the nucleotide sequence of VGAM53 RNA, herein designated VGAM RNA, also designated SEQ ID:2764.

Another function of VGAM53 is therefore inhibition of Carbohydrate (N-acetylglucosamine 6-O) Sulfotransferase 4 (CHST4, Accession NM_005769). Accordingly, utilities of VGAM53 include diagnosis, prevention and treatment of diseases and clinical conditions associated with CHST4. DKFZP434I0714 (Accession XM_098247) is another VGAM53 host target gene. DKFZP434I0714 BINDING SITE is HOST TARGET binding site found in the 5' untranslated region of mRNA encoded by DKFZP434I0714, corresponding to a HOST TARGET binding site such as BINDING SITE I, BINDING SITE II or BINDING SITE III. Table 2 illustrates the complementarity of the nucleotide sequences of DKFZP434I0714 BINDING SITE, designated SEQ ID:41530, to the nucleotide sequence of VGAM53 RNA, herein designated VGAM RNA, also designated SEQ ID:2764.

Another function of VGAM53 is therefore inhibition of DKFZP434I0714 (Accession XM_098247). Accordingly, utilities of VGAM53 include diagnosis, prevention and treatment of diseases and clinical conditions associated with DKFZP434I0714. Eukaryotic Translation Initiation Factor 5 (EIF5, Accession NM_001969) is another VGAM53 host target gene. EIF5 BINDING SITE is HOST TARGET binding site found in the 3' untranslated region of mRNA encoded by EIF5, corresponding to a HOST TARGET binding site such as BINDING SITE I, BINDING SITE II or BINDING SITE III. Table 2 illustrates the complementarity of the nucleotide sequences of EIF5 BINDING SITE, designated SEQ ID:7701, to the nucleotide sequence of VGAM53 RNA, herein designated VGAM RNA, also designated SEQ ID:2764.

Another function of VGAM53 is therefore inhibition of Eukaryotic Translation Initiation Factor 5 (EIF5, Accession NM_001969). Accordingly, utilities of VGAM53 include diagnosis, prevention and treatment of diseases and clinical conditions associated with EIF5. FLJ00001 (Accession XM_088525) is another VGAM53 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39783, to the nucleotide sequence of VGAM53 RNA, herein designated VGAM RNA, also designated SEQ ID:2764.

Another function of VGAM53 is therefore inhibition of FLJ00001 (Accession XM_088525). Accordingly, utilities of VGAM53 include diagnosis, prevention and treatment of diseases and clinical conditions associated with FLJ00001. FLJ10101 (Accession NM_024718) is another VGAM53 host target gene. FLJ10101 BINDING SITE is HOST TARGET binding site found in the 3' untranslated region of mRNA encoded by FLJ10101, corresponding to a HOST TARGET binding site such as BINDING SITE I, BINDING SITE II or BINDING SITE III. Table 2 illustrates the complementarity of the nucleotide sequences of FLJ10101 BINDING SITE, designated SEQ ID:24048, to the nucleotide sequence of VGAM53 RNA, herein designated VGAM RNA, also designated SEQ ID:2764.

Another function of VGAM53 is therefore inhibition of FLJ10101 (Accession NM_024718). Accordingly, utilities of VGAM53 include diagnosis, prevention and treatment of diseases and clinical conditions associated with FLJ10101. FLJ10209 (Accession NM_018026) is another VGAM53 host target gene. FLJ10209 BINDING SITE is HOST TARGET binding site found in the 5' untranslated region of mRNA encoded by FLJ10209, corresponding to a HOST TARGET binding site such as BINDING SITE I, BINDING SITE II or BINDING SITE III. Table 2 illustrates the complementarity of the nucleotide sequences of FLJ10209 BINDING SITE, designated SEQ ID:19769, to the nucleotide sequence of VGAM53 RNA, herein designated VGAM RNA, also designated SEQ ID:2764.

Another function of VGAM53 is therefore inhibition of FLJ10209 (Accession NM_018026). Accordingly, utilities of VGAM53 include diagnosis, prevention and treatment of diseases and clinical conditions associated with FLJ10209. FLJ20344 (Accession NM_017776) is another VGAM53 host target gene. FLJ20344 BINDING SITE is HOST TARGET binding site found in the 3' untranslated region of mRNA encoded by FLJ20344, corresponding to a HOST TARGET binding site such as BINDING SITE I, BINDING SITE II or BINDING SITE III. Table 2 illustrates the complementarity of the nucleotide sequences of FLJ20344 BINDING SITE, designated SEQ ID:19404, to the nucleotide sequence of VGAM53 RNA, herein designated VGAM RNA, also designated SEQ ID:2764.

Another function of VGAM53 is therefore inhibition of FLJ20344 (Accession NM_017776). Accordingly, utilities of VGAM53 include diagnosis, prevention and treatment of diseases and clinical conditions associated with FLJ20344. G Protein-coupled Receptor Kinase-interactor 2 (GIT2, Accession NM_057169) is another VGAM53 host target gene. GIT2 BINDING SITE1 through GIT2 BINDING SITE3 are HOST TARGET binding sites found in untranslated regions of mRNA encoded by GIT2, corresponding to HOST TARGET binding sites such as BINDING SITE I, BINDING SITE II or BINDING SITE III. Table 2 illustrates the complementarity of the nucleotide sequences of GIT2 BINDING SITE1 through GIT2 BINDING SITE3, designated SEQ ID:27687, SEQ ID:27700 and SEQ ID:16605 respectively, to the nucleotide sequence of VGAM53 RNA, herein designated VGAM RNA, also designated SEQ ID:2764.

Another function of VGAM53 is therefore inhibition of G Protein-coupled Receptor Kinase-interactor 2 (GIT2, Accession NM_057169). Accordingly, utilities of VGAM53 include diagnosis, prevention and treatment of diseases and clinical conditions associated with GIT2. KIAA0174 (Accession XM_085981) is another VGAM53 host target gene. KIAA0174 BINDING SITE is HOST TARGET binding site found in the 3' untranslated region of mRNA encoded by KIAA0174, corresponding to a HOST TARGET binding site such as BINDING SITE I, BINDING SITE II or BINDING SITE III. Table 2 illustrates the complementarity of the nucleotide sequences of KIAA0174 BINDING SITE, designated SEQ ID:38432, to the nucleotide sequence of VGAM53 RNA, herein designated VGAM RNA, also designated SEQ ID:2764.

Another function of VGAM53 is therefore inhibition of KIAA0174 (Accession XM_085981). Accordingly, utilities of VGAM53 include diagnosis, prevention and treatment of diseases and clinical conditions associated with KIAA0174. KIAA0562 (Accession NM_014704) is another VGAM53 host target gene. KIAA0562 BINDING SITE is HOST TARGET binding site found in the 3' untranslated region of mRNA encoded by KIAA0562, corresponding to a HOST TARGET binding site such as BINDING SITE I, BINDING SITE II or BINDING SITE III. Table 2 illustrates the complementarity of the nucleotide sequences of KIAA0562 BINDING SITE, designated SEQ ID:16243, to the nucleotide sequence of VGAM53 RNA, herein designated VGAM RNA, also designated SEQ ID:2764.

Another function of VGAM53 is therefore inhibition of KIAA0562 (Accession NM_014704). Accordingly, utilities of VGAM53 include diagnosis, prevention and treatment of diseases and clinical conditions associated with KIAA0562. KIAA0652 (Accession NM_014741) is another VGAM53 host target gene. KIAA0652 BINDING SITE is HOST TARGET binding site found in the 3' untranslated region of mRNA encoded by KIAA0652, corresponding to a HOST TARGET binding site such as BINDING SITE I, BINDING SITE II or BINDING SITE III. Table 2 illustrates the complementarity of the nucleotide sequences of KIAA0652 BINDING SITE, designated SEQ ID:16409, to the nucleotide sequence of VGAM53 RNA, herein designated VGAM RNA, also designated SEQ ID:2764.

Another function of VGAM53 is therefore inhibition of KIAA0652 (Accession NM_014741). Accordingly, utilities of VGAM53 include diagnosis, prevention and treatment of diseases and clinical conditions associated with KIAA0652. KIAA0876 (Accession XM_035625) is another VGAM53 host target gene. KIAA0876 BINDING SITE is HOST TARGET binding site found in the 3' untranslated region of mRNA encoded by KIAA0876, corresponding to a HOST TARGET binding site such as BINDING SITE I, BINDING SITE II or BINDING SITE III. Table 2 illustrates the complementarity of the nucleotide sequences of KIAA0876 BINDING SITE, designated SEQ ID:32299, to the nucleotide sequence of VGAM53 RNA, herein designated VGAM RNA, also designated SEQ ID:2764.

Another function of VGAM53 is therefore inhibition of KIAA0876 (Accession XM_035625). Accordingly, utilities of VGAM53 include diagnosis, prevention and treatment of diseases and clinical conditions associated with KIAA0876. KIAA0960 (Accession XM_166543) is another VGAM53 host target gene. KIAA0960 BINDING SITE is HOST TARGET binding site found in the 5' untranslated region of mRNA encoded by KIAA0960, corresponding to a HOST TARGET binding site such as BINDING SITE I, BINDING SITE II or BINDING SITE III. Table 2 illustrates the complementarity of the nucleotide sequences of KIAA0960 BINDING SITE, designated SEQ ID:44520, to the nucleotide sequence of VGAM53 RNA, herein designated VGAM RNA, also designated SEQ ID:2764.

Another function of VGAM53 is therefore inhibition of KIAA0960 (Accession XM_166543). Accordingly, utilities of VGAM53 include diagnosis, prevention and treatment of diseases and clinical conditions associated with KIAA0960. KIAA1303 (Accession XM_038376) is another VGAM53 host target gene. KIAA1303 BINDING SITE is HOST TARGET binding site found in the 3' untranslated region of mRNA encoded by KIAA1303, corresponding to a HOST TARGET binding site such as BINDING SITE I, BINDING SITE II or BINDING SITE III. Table 2 illustrates the complementarity of the nucleotide sequences of KIAA1303 BINDING SITE, designated SEQ ID:32834, to the nucleotide sequence of VGAM53 RNA, herein designated VGAM RNA, also designated SEQ ID:2764.

Another function of VGAM53 is therefore inhibition of KIAA1303 (Accession XM_038376). Accordingly, utilities of VGAM53 include diagnosis, prevention and treatment of diseases and clinical conditions associated with KIAA1303. KIAA1423 (Accession XM_029703) is another VGAM53 host target gene. KIAA1423 BINDING SITE is HOST TARGET binding site found in the 3' untranslated region of mRNA encoded by KIAA1423, corresponding to a HOST TARGET binding site such as BINDING SITE I, BINDING SITE II or BINDING SITE III. Table 2 illustrates the complementarity of the nucleotide sequences of KIAA1423 BINDING SITE, designated SEQ ID:30920, to the nucleotide sequence of VGAM53 RNA, herein designated VGAM RNA, also designated SEQ ID:2764.

Another function of VGAM53 is therefore inhibition of KIAA1423 (Accession XM_029703). Accordingly, utilities of VGAM53 include diagnosis, prevention and treatment of diseases and clinical conditions associated with KIAA1423. KIAA1701 (Accession XM_042087) is another VGAM53 host target gene. KIAA1701 BINDING SITE is HOST TARGET binding site found in the 3' untranslated region of mRNA encoded by KIAA1701, corresponding to a HOST TARGET binding site such as BINDING SITE I, BINDING SITE II or BINDING SITE III. Table 2 illustrates the complementarity of the nucleotide sequences of KIAA1701 BINDING SITE, designated SEQ ID:33685, to the nucleotide sequence of VGAM53 RNA, herein designated VGAM RNA, also designated SEQ ID:2764.

Another function of VGAM53 is therefore inhibition of KIAA1701 (Accession XM_042087). Accordingly, utilities of VGAM53 include diagnosis, prevention and treatment of diseases and clinical conditions associated with KIAA1701. MGC16179 (Accession NM_032766) is another VGAM53 host target gene. MGC16179 BINDING SITE is HOST TARGET binding site found in the 3' untranslated region of mRNA encoded by MGC16179, corresponding to a HOST TARGET binding site such as BINDING SITE I, BINDING SITE II or BINDING SITE III. Table 2 illustrates the complementarity of the nucleotide sequences of MGC16179 BINDING SITE, designated SEQ ID:26514, to the nucleotide sequence of VGAM53 RNA, herein designated VGAM RNA, also designated SEQ ID:2764.

Another function of VGAM53 is therefore inhibition of MGC16179 (Accession NM_032766). Accordingly, utilities of VGAM53 include diagnosis, prevention and treatment of diseases and clinical conditions associated with MGC16179. MKP-7 (Accession XM_039106) is another VGAM53 host target gene. MKP-7 BINDING SITE is HOST TARGET binding site found in the 3' untranslated region of mRNA encoded by MKP-7, corresponding to a HOST TARGET binding site such as BINDING SITE I, BINDING SITE II or BINDING SITE III. Table 2 illustrates the complementarity of the nucleotide sequences of MKP-7 BINDING SITE, designated SEQ ID:33008, to the nucleotide sequence of VGAM53 RNA, herein designated VGAM RNA, also designated SEQ ID:2764.

Another function of VGAM53 is therefore inhibition of MKP-7 (Accession XM_039106). Accordingly, utilities of VGAM53 include diagnosis, prevention and treatment of diseases and clinical conditions associated with MKP-7. PRO1770 (Accession NM_014100) is another VGAM53 host target gene. PRO1770 BINDING SITE is HOST TARGET binding site found in the 3' untranslated region of mRNA encoded by PRO1770, corresponding to a HOST TARGET binding site such as BINDING SITE I, BINDING SITE II or BINDING SITE III. Table 2 illustrates the complementarity of the nucleotide sequences of PRO1770 BINDING SITE, designated SEQ ID:15326, to the nucleotide sequence of VGAM53 RNA, herein designated VGAM RNA, also designated SEQ ID:2764.

Another function of VGAM53 is therefore inhibition of PRO1770 (Accession NM_014100). Accordingly, utilities of VGAM53 include diagnosis, prevention and treatment of diseases and clinical conditions associated with PRO1770. Rab11-FIP2 (Accession NM_014904) is another VGAM53 host target gene. Rab11-FIP2 BINDING SITE is HOST TARGET binding site found in the 3' untranslated region of mRNA encoded by Rab11-FIP2, corresponding to a HOST TARGET binding site such as BINDING SITE I, BINDING SITE II or BINDING SITE III. Table 2 illustrates the complementarity of the nucleotide sequences of Rab11-FIP2 BINDING SITE, designated SEQ ID:17097, to the nucleotide sequence of VGAM53 RNA, herein designated VGAM RNA, also designated SEQ ID:2764.

Another function of VGAM53 is therefore inhibition of Rab11-FIP2 (Accession NM_014904). Accordingly, utilities of VGAM53 include diagnosis, prevention and treatment of diseases and clinical conditions associated with Rab11-FIP2. UBX Domain Containing 2 (UBXD2, Accession XM_043196) is another VGAM53 host target gene. UBXD2 BINDING SITE is HOST TARGET binding site found in the 3' untranslated region of mRNA encoded by UBXD2, corresponding to a HOST TARGET binding site such as BINDING SITE I, BINDING SITE II or BINDING SITE III. Table 2 illustrates the complementarity of the nucleotide sequences of UBXD2 BINDING SITE, designated SEQ ID:33913, to the nucleotide sequence of VGAM53 RNA, herein designated VGAM RNA, also designated SEQ ID:2764.

Another function of VGAM53 is therefore inhibition of UBX Domain Containing 2 (UBXD2, Accession XM_043196). Accordingly, utilities of VGAM53 include diagnosis, prevention and treatment of diseases and clinical conditions associated with UBXD2. LOC147054 (Accession XM_097172) is another VGAM53 host target gene. LOC147054 BINDING SITE is HOST TARGET binding site found in the 5' untranslated region of mRNA encoded by LOC147054, corresponding to a HOST TARGET binding site such as BINDING SITE I, BINDING SITE II or BINDING SITE III. Table 2 illustrates the complementarity of the nucleotide sequences of LOC147054 BINDING SITE, designated SEQ ID:40792, to the nucleotide sequence of VGAM53 RNA, herein designated VGAM RNA, also designated SEQ ID:2764.

Another function of VGAM53 is therefore inhibition of LOC147054 (Accession XM_097172). Accordingly, utilities of VGAM53 include diagnosis, prevention and treatment of diseases and clinical conditions associated with LOC147054. LOC154881 (Accession XM_088063) is another VGAM53 host target gene. LOC154881 BINDING SITE is HOST TARGET binding site found in the 3' untranslated region of mRNA encoded by LOC154881, corresponding to a HOST TARGET binding site such as BINDING SITE I, BINDING SITE II or BINDING SITE III. Table 2 illustrates the complementarity of the nucleotide sequences of LOC154881 BINDING SITE, designated SEQ ID:39497, to the nucleotide sequence of VGAM53 RNA, herein designated VGAM RNA, also designated SEQ ID:2764.

Another function of VGAM53 is therefore inhibition of LOC154881 (Accession XM_088063). Accordingly, utilities of VGAM53 include diagnosis, prevention and treatment of diseases and clinical conditions associated with LOC154881. LOC157858 (Accession XM_098833) is another VGAM53 host target gene. LOC157858 BINDING SITE is HOST TARGET binding site found in the 5' untranslated region of mRNA encoded by LOC157858, corresponding to a HOST TARGET binding site such as BINDING SITE I, BINDING SITE II or BINDING SITE III. Table 2 illustrates the complementarity of the nucleotide sequences of LOC157858 BINDING SITE, designated SEQ ID:41867, to the nucleotide sequence of VGAM53 RNA, herein designated VGAM RNA, also designated SEQ ID:2764.

Another function of VGAM53 is therefore inhibition of LOC157858 (Accession XM_098833). Accordingly, utilities of VGAM53 include diagnosis, prevention and treatment of diseases and clinical conditions associated with LOC157858. LOC196047 (Accession XM_116883) is another VGAM53 host target gene. LOC196047 BINDING SITE is HOST TARGET binding site found in the 5' untranslated region of mRNA encoded by LOC196047, corresponding to a HOST TARGET binding site such as BINDING SITE I, BINDING SITE II or BINDING SITE III. Table 2 illustrates the complementarity of the nucleotide sequences of LOC196047 BINDING SITE, designated SEQ ID:43146, to the nucleotide sequence of VGAM53 RNA, herein designated VGAM RNA, also designated SEQ ID:2764.

Another function of VGAM53 is therefore inhibition of LOC196047 (Accession XM_116883). Accordingly, utilities of VGAM53 include diagnosis, prevention and treatment of diseases and clinical conditions associated with LOC196047. LOC253286 (Accession XM_174256) is another VGAM53 host target gene. LOC253286 BINDING SITE is HOST TARGET binding site found in the 5' untranslated region of mRNA encoded by LOC253286, corresponding to a HOST TARGET binding site such as BINDING SITE I, BINDING SITE II or BINDING SITE III. Table 2 illustrates the complementarity of the nucleotide sequences of LOC253286 BIND-ING SITE, designated SEQ ID:46585, to the nucleotide sequence of VGAM53 RNA, herein designated VGAM RNA, also designated SEQ ID:2764.

Another function of VGAM53 is therefore inhibition of LOC253286 (Accession XM_174256). Accordingly, utilities of VGAM53 include diagnosis, prevention and treatment of diseases and clinical conditions associated with LOC253286. FIG. 1 further provides a conceptual description of a novel bioinformatically detected viral gene of the present invention, referred to here as Viral Genomic Address Messenger 54 (VGAM54) viral gene, which modulates expression of respective host target genes thereof, the function and utility of which host target genes is known in the art.

VGAM54 is a novel bioinformatically detected regulatory, non protein coding, viral micro RNA (miRNA) gene. The method by which VGAM54 was detected is described hereinabove with reference to FIGS. 1-8.

VGAM54 gene, herein designated VGAM GENE, is a viral gene contained in the genome of Invertebrate Iridescent Virus 6. VGAM54 host target gene, herein designated VGAM HOST TARGET GENE, is a human gene contained in the human genome.

VGAM54 gene encodes a VGAM54 precursor RNA, herein designated VGAM PRECURSOR RNA. Similar to other miRNA genes, and unlike most ordinary genes, VGAM54 precursor RNA does not encode a protein. A nucleotide sequence identical or highly similar to the nucleotide sequence of VGAM54 precursor RNA is designated SEQ ID:40, and is provided hereinbelow with reference to the sequence listing part. Nucleotide sequence SEQ ID:40 is located at position 169568 relative to the genome of Invertebrate Iridescent Virus 6.

VGAM54 precursor RNA folds onto itself, forming VGAM54 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM54 folded precursor RNA into VGAM54 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM54 RNA is designated SEQ ID:2765, and is provided hereinbelow with reference to the sequence listing part.

VGAM54 host target gene, herein designated VGAM HOST TARGET GENE, encodes a corresponding messenger RNA, VGAM54 host target RNA, herein designated VGAM HOST TARGET RNA. VGAM54 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM54 RNA, herein designated VGAM RNA, binds complementarily to one or more host target binding sites located in untranslated regions of VGAM54 host target RNA, herein designated VGAM HOST TARGET RNA. This complementary binding is due to the fact that the nucleotide sequence of VGAM54 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM54 RNA, herein designated VGAM RNA, may have a different number of host target binding sites in untranslated regions of a VGAM54 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM54 RNA, herein designated VGAM RNA, to host target binding sites on VGAM54 host target RNA, herein designated VGAM HOST TARGET RNA, such as BINDING SITE I, BINDING SITE II and BINDING SITE III, inhibits translation of VGAM54 host target RNA into VGAM54 host target protein, herein designated VGAM HOST TARGET PROTEIN. VGAM host target protein is therefore outlined by a broken line.

It is appreciated that VGAM54 host target gene, herein designated VGAM HOST TARGET GENE, in fact represents a plurality of VGAM54 host target genes. The mRNA of each one of this plurality of VGAM54 host target genes comprises one or more host target binding sites, each having a nucleotide sequence which is at least partly complementary to VGAM54 RNA, herein designated VGAM RNA, and which when bound by VGAM54 RNA causes inhibition of translation of respective one or more VGAM54 host target proteins.

It is further appreciated by one skilled in the art that the mode of translational inhibition illustrated by FIG. 1 with specific reference to translational inhibition exerted by VGAM54 gene, herein designated VGAM GENE, on one or more VGAM54 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM54 is inhibition of expression of host target genes, as part of a novel viral mechanism of attacking a host. Accordingly, utilities of VGAM54 include diagnosis, prevention and treatment of viral infection by Invertebrate Iridescent Virus 6. Specific functions, and accordingly utilities, of VGAM54 correlate with, and may be deduced from, the identity of the host target genes which VGAM54 binds and inhibits, and the function of these host target genes, as elaborated hereinbelow.

Nucleotide sequences of the VGAM54 precursor RNA, herein designated VGAM PRECURSOR RNA, and of the 'diced' VGAM54 RNA, herein designated VGAM RNA, and a schematic representation of the secondary folding of VGAM54 folded precursor RNA, herein designated VGAM FOLDED PRECURSOR RNA, of VGAM54 are further described hereinbelow with reference to Table 1.

Nucleotide sequences of host target binding sites, such as BINDING SITE-I, BINDING SITE-II and BINDING SITE-III of FIG. 1, found on VGAM54 host target RNA, and schematic representation of the complementarity of each of these host target binding sites to VGAM54 RNA, herein designated VGAM RNA, are described hereinbelow with reference to Table 2.

As mentioned hereinabove with reference to FIG. 1, a function of VGAM54 gene, herein designated VGAM is inhibition of expression of VGAM54 target genes. It is appreciated that specific functions, and accordingly utilities, of VGAM54 correlate with, and may be deduced from, the identity of the target genes which VGAM54 binds and inhibits, and the function of these target genes, as elaborated hereinbelow.

Proline-rich Gla (G-carboxyglutamic acid) Polypeptide 1 (PRRG1, Accession NM_000950) is a VGAM54 host target gene. PRRG1 BINDING SITE is HOST TARGET binding site found in the 3' untranslated region of mRNA encoded by PRRG1, corresponding to a HOST TARGET binding site such as BINDING SITE I, BINDING SITE II or BINDING SITE III. Table 2 illustrates the complementarity of the nucleotide sequences of PRRG1 BINDING SITE, designated SEQ ID:6653, to the nucleotide sequence of VGAM54 RNA, herein designated VGAM RNA, also designated SEQ ID:2765.

A function of VGAM54 is therefore inhibition of Proline-rich Gla (G-carboxyglutamic acid) Polypeptide 1 (PRRG1, Accession NM_000950). Accordingly, utilities of VGAM54 include diagnosis, prevention and treatment of diseases and clinical conditions associated with PRRG1. FIG. 1 further provides a conceptual description of a novel bioinformatically detected viral gene of the present invention, referred to here as Viral Genomic Address Messenger 55 (VGAM55) viral gene, which modulates expression of respective host target genes thereof, the function and utility of which host target genes is known in the art.

VGAM55 is a novel bioinformatically detected regulatory, non protein coding, viral micro RNA (miRNA) gene. The method by which VGAM55 was detected is described hereinabove with reference to FIGS. 1-8.

VGAM55 gene, herein designated VGAM GENE, is a viral gene contained in the genome of Invertebrate Iridescent Virus 6. VGAM55 host target gene, herein designated VGAM HOST TARGET GENE, is a human gene contained in the human genome.

VGAM55 gene encodes a VGAM55 precursor RNA, herein designated VGAM PRECURSOR RNA. Similar to other miRNA genes, and unlike most ordinary genes, VGAM55 precursor RNA does not encode a protein. A nucleotide sequence identical or highly similar to the nucleotide sequence of VGAM55 precursor RNA is designated SEQ ID:41, and is provided hereinbelow with reference to the sequence listing part. Nucleotide sequence SEQ ID:41 is located at position 37014 relative to the genome of Invertebrate Iridescent Virus 6.

VGAM55 precursor RNA folds onto itself, forming VGAM55 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM55 folded precursor RNA into VGAM55 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM55 RNA is designated SEQ ID:2766, and is provided hereinbelow with reference to the sequence listing part.

VGAM55 host target gene, herein designated VGAM HOST TARGET GENE, encodes a corresponding messenger RNA, VGAM55 host target RNA, herein designated VGAM HOST TARGET RNA. VGAM55 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM55 RNA, herein designated VGAM RNA, binds complementarily to one or more host target binding sites located in untranslated regions of VGAM55 host target RNA, herein designated VGAM HOST TARGET RNA. This complementary binding is due to the fact that the nucleotide sequence of VGAM55 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM55 RNA, herein designated VGAM RNA, may have a different number of host target binding sites in untranslated regions of a VGAM55 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM55 RNA, herein designated VGAM RNA, to host target binding sites on VGAM55 host target RNA, herein designated VGAM HOST TARGET RNA, such as BINDING SITE I, BINDING SITE II and BINDING SITE III, inhibits translation of VGAM55 host target RNA into VGAM55 host target protein, herein designated VGAM HOST TARGET PROTEIN. VGAM host target protein is therefore outlined by a broken line.

It is appreciated that VGAM55 host target gene, herein designated VGAM HOST TARGET GENE, in fact represents a plurality of VGAM55 host target genes. The mRNA of each one of this plurality of VGAM55 host target genes comprises one or more host target binding sites, each having a nucleotide sequence which is at least partly complementary to VGAM55 RNA, herein designated VGAM RNA, and which when bound by VGAM55 RNA causes inhibition of translation of respective one or more VGAM55 host target proteins.

It is further appreciated by one skilled in the art that the mode of translational inhibition illustrated by FIG. 1 with specific reference to translational inhibition exerted by VGAM55 gene, herein designated VGAM GENE, on one or more VGAM55 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM55 is inhibition of expression of host target genes, as part of a novel viral mechanism of attacking a host. Accordingly, utilities of VGAM55 include diagnosis, prevention and treatment of viral infection by Invertebrate Iridescent Virus 6. Specific functions, and accordingly utilities, of VGAM55 correlate with, and may be deduced from, the identity of the host target genes which VGAM55 binds and inhibits, and the function of these host target genes, as elaborated hereinbelow.

Nucleotide sequences of the VGAM55 precursor RNA, herein designated VGAM PRECURSOR RNA, and of the 'diced' VGAM55 RNA, herein designated VGAM RNA, and a schematic representation of the secondary folding of VGAM55 folded precursor RNA, herein designated VGAM FOLDED PRECURSOR RNA, of VGAM55 are further described hereinbelow with reference to Table 1.

Nucleotide sequences of host target binding sites, such as BINDING SITE-I, BINDING SITE-II and BINDING SITE-III of FIG. 1, found on VGAM55 host target RNA, and schematic representation of the complementarity of each of these host target binding sites to VGAM55 RNA, herein designated VGAM RNA, are described hereinbelow with reference to Table 2.

As mentioned hereinabove with reference to FIG. 1, a function of VGAM55 gene, herein designated VGAM is inhibition of expression of VGAM55 target genes. It is appreciated that specific functions, and accordingly utilities, of VGAM55 correlate with, and may be deduced from, the identity of the target genes which VGAM55 binds and inhibits, and the function of these target genes, as elaborated hereinbelow.

Aristaless-like Homeobox 3 (ALX3, Accession NM_006492) is a VGAM55 host target gene. ALX3 BINDING SITE is HOST TARGET binding site found in the 3' untranslated region of mRNA encoded by ALX3, corresponding to a HOST TARGET binding site such as BINDING SITE I, BINDING SITE II or BINDING SITE III. Table 2 illustrates the complementarity of the nucleotide sequences of ALX3 BINDING SITE, designated SEQ ID:13221, to the nucleotide sequence of VGAM55 RNA, herein designated VGAM RNA, also designated SEQ ID:2766.

A function of VGAM55 is therefore inhibition of Aristaless-like Homeobox 3 (ALX3, Accession NM_006492), a gene which is involved in cell-type differentiation and development. Accordingly, utilities of VGAM55 include diagnosis, prevention and treatment of diseases and clinical conditions associated with ALX3. The function of ALX3 has been established by previous studies. Homeo box genes encode transcriptional regulators involved in cell-type differentiation and development. To identify beta-cell homeodomain proteins, Rudnick et al. (1994) designed primers based on the sequences of the beta-cell homeo box genes cdx3 (OMIM Ref. No. 600297), lmx1 (OMIM Ref. No. 600298), and the Drosophila homeodomain protein Antennapedia to amplify inserts by PCR from a hamster insulinoma cDNA library (HIT). One of the genes identified showed homology to the Drosophila gene aristaless and was designated Alx3. Alx3 encodes a paired (prd) class homeodomain protein that shares high sequence homology with another member of this subclass, cart1 (OMIM Ref. No. 601527), not only in the homeodomain but also in the region between the homeodomain and the C terminus. In addition to HIT cells, Alx3 was expressed in a mouse pancreatic exocrine cell line and was abundant in pancreatic exocrine cells. Ten Berge et al. (1998) cloned a full-length mouse Alx3 cDNA encoding a 343-amino acid protein. Alx3 belongs to the large class of genes that encode a prd/Q50 homeodomain, denoting moderate similarity to the prd homeodomain but the presence of a glutamine at position 50. The authors found that Alx3 was expressed in mouse embryos from 8 days of gestation onward in a characteristic pattern, predominantly in neural crest-derived mesenchyme and in lateral plate mesoderm. Prominent expression was seen in the frontonasal head mesenchyme and in the first and second pharyngeal arches and some of their derivatives. High expression was also seen in the tail and in many derivatives of the lateral plate mesoderm including the limbs, the body wall, and the genital tubercle. By interspecific backcross analysis, ten Berge et al. (1998) mapped the mouse Alx3 gene to chromosome 3 in close proximity to the droopy-ear mutation (de). The International Radiation Hybrid Mapping Consortium mapped the human ALX3 gene to chromosome 1p21-p13 (stSG24507

Full details of the abovementioned studies are described in the following publications, the disclosure of which are hereby incorporated by reference:

Rudnick, A.; Ling, T. Y.; Odagiri, H.; Rutter, W. J.; German, M. S.: Pancreatic beta cells express a diverse set of homeobox genes. Proc. Nat. Acad. Sci. 91:12203-12207, 1994; and ten Berge, D.; Brouwer, A.; El Bahi, S.; Guenet, J.-L.; Robert, B.; Meijlink, F.: Mouse Alx3: an aristaless-like homeobox gene expressed during embryogenesis in ectomesenchyme and late.

Further studies establishing the function and utilities of ALX3 are found in John Hopkins OMIM database record ID 606014, and in sited publications numbered 6336-6337 listed in the bibliography section hereinbelow, which are also hereby incorporated by reference. Rho GTPase Activating Protein 6 (ARHGAP6, Accession NM_001174) is another VGAM55 host target gene. ARHGAP6 BINDING SITE is HOST TARGET binding site found in the 5' untranslated region of mRNA encoded by ARHGAP6, corresponding to a HOST TARGET binding site such as BINDING SITE I, BINDING SITE II or BINDING SITE III. Table 2 illustrates the complementarity of the nucleotide sequences of ARHGAP6 BINDING SITE, designated SEQ ID:6848, to the nucleotide sequence of VGAM55 RNA, herein designated VGAM RNA, also designated SEQ ID:2766.

Another function of VGAM55 is therefore inhibition of Rho GTPase Activating Protein 6 (ARHGAP6, Accession NM_001174), a gene which activates the rho-type GTPases by converting them to an inactive GTP-bound state. Accordingly, utilities of VGAM55 include diagnosis, prevention and treatment of diseases and clinical conditions associated with ARHGAP6. The function of ARHGAP6 has been established by previous studies. In a search for the genetic defect in microphthalmia with linear skin defects syndrome (MLS; 309801), Schaefer et al. (1997) trapped exons from 14 overlapping cosmids from the 500-kb MLS critical region in Xp22.3. Using exon connection followed by cDNA library screening, they identified a 2.4-kb contig of cDNA clones spanning 170 kb of genomic sequence in the MLS deletion region. Northern analysis of this cDNA detected a prominent transcript of approximately 4.2 kb and a less abundant transcript of approximately 6 kb in all tissues examined, with additional transcripts in skeletal muscle. Sequence analysis revealed a coding region of 601 amino acids contained in 12 exons, with a splice variant isoform of 495 amino acids. The predicted protein sequence of the gene, symbolized ARHGAP6, contains homology to the GTPase-activating (GAP) domain of the Rho-GAP family of proteins (e.g., 300023), which has been implicated in the regulation of actin polymerization at the plasma membrane in several cellular processes. Schaefer et al. (1997) discussed reasons for thinking that a defect in the Rho pathway may play a role in the pathogenesis of MLS syndrome. Prakash et al. (2000) investigated the function of ARHGAP6 by generating Arhgap6 null mice and also by in vitro expression studies. Surprisingly, loss of the rhoGAP function of Arhgap6 did not cause any detectable phenotypic or behavioral abnormalities in the mutant mice. Transfected mammalian cells expressing ARHGAP6 lost their actin stress fibers, retracted from the growth surface, and extended thin, branching processes resembling filopodia. The ARHGAP6 protein colocalized with actin filaments through an N-terminal domain and recruited filamentous actin into the growing processes. Mutation of a conserved arginine residue in the rhoGAP domain prevented the loss of stress fibers but had little effect on process outgrowth. The authors concluded that ARHGAP6 has 2 independent functions: one as a GAP with specificity for RhoA and the other as a cytoskeletal protein that promotes actin remodeling.

Full details of the abovementioned studies are described in the following publications, the disclosure of which are hereby incorporated by reference:

Prakash, S. K.; Paylor, R.; Jenna, S.; Lamarche-Vane, N.; Armstrong, D. L.; Xu, B.; Mancini, M. A.; Zoghbi, H. Y.: Functional analysis of ARHGAP6, a novel GTPase-activating protein for RhoA. Hum. Molec. Genet. 9:477-488, 2000; and Schaefer, L.; Prakash, S.; Zoghbi, H. Y.: Cloning and characterization of a novel rho-type GTPase-activating protein gene (ARHGAP6) from the critical region for microphthalmia with li.

Further studies establishing the function and utilities of ARHGAP6 are found in John Hopkins OMIM database record ID 300118, and in sited publications numbered 10628-10629 listed in the bibliography section hereinbelow, which are also hereby incorporated by reference. Rac/Cdc42 Guanine Nucleotide Exchange Factor (GEF) 6 (ARHGEF6, Accession XM_042963) is another VGAM55 host target gene. ARHGEF6 BINDING SITE is HOST TARGET binding site found in the 3' untranslated region of mRNA encoded by ARHGEF6, corresponding to a HOST TARGET binding site such as BINDING SITE I, BINDING SITE II or BINDING SITE III. Table 2 illustrates the complementarity of the nucleotide sequences of ARHGEF6 BINDING SITE, designated SEQ ID:33842, to the nucleotide sequence of VGAM55 RNA, herein designated VGAM RNA, also designated SEQ ID:2766.

Another function of VGAM55 is therefore inhibition of Rac/Cdc42 Guanine Nucleotide Exchange Factor (GEF) 6 (ARHGEF6, Accession XM_042963). Accordingly, utilities of VGAM55 include diagnosis, prevention and treatment of diseases and clinical conditions associated with ARHGEF6. Activating Transcription Factor 7 (ATF7, Accession NM_006856) is another VGAM55 host target gene. ATF7 BINDING SITE is HOST TARGET binding site found in the 3' untranslated region of mRNA encoded by ATF7, corresponding to a HOST TARGET binding site such as BINDING SITE I, BINDING SITE II or BINDING SITE III. Table 2 illustrates the complementarity of the nucleotide sequences of ATF7 BINDING SITE, designated SEQ ID:13726, to the nucleotide sequence of VGAM55 RNA, herein designated VGAM RNA, also designated SEQ ID:2766.

Another function of VGAM55 is therefore inhibition of Activating Transcription Factor 7 (ATF7, Accession NM_006856). Accordingly, utilities of VGAM55 include diagnosis, prevention and treatment of diseases and clinical conditions associated with ATF7. HLA-B Associated Transcript 1 (BAT1, Accession NM_004640) is another VGAM55 host target gene. BAT1 BINDING SITE is HOST TARGET binding site found in the 5' untranslated region of mRNA encoded by BAT1, corresponding to a HOST TARGET binding site such as BINDING SITE I, BINDING SITE II or BINDING SITE III. Table 2 illustrates the complementarity of the nucleotide sequences of BAT1 BINDING SITE, designated SEQ ID:11015, to the nucleotide sequence of VGAM55 RNA, herein designated VGAM RNA, also designated SEQ ID:2766.

Another function of VGAM55 is therefore inhibition of HLA-B Associated Transcript 1 (BAT1, Accession NM_004640), a gene which associates with the major histocompatibility complex, a negative regulator of inflammation. Accordingly, utilities of VGAM55 include diagnosis, prevention and treatment of diseases and clinical conditions associated with BAT1. The function of BAT1 has been established by previous studies. Peelman et al. (1995) sequenced both human and pig BAT1 and showed that the genes are members of the DEAD-box family of ATP-dependent RNA helicases, members of which are involved in a number of cellular functions including initiation of translation, RNA splicing, and ribosome assembly. Proteins of this family have 9 conserved amino acid motifs but differ at their amino and carboxyl ends. From studies of other family members, the first block is involved in ATP binding, the fifth block may be an ATPase, the sixth block is needed for RNA helicase activity, and the ninth block is involved with ATP hydrolysis-independent RNA interactions during unwinding. The gene contains 10 exons spanning about 10 kb of genomic DNA and encodes a 428-amino acid protein. Peelman et al. (1995) detected 3 different length mRNAs (4.1, 17, and 0.9 kb) in all tissues analyzed, although at different relative levels. The protein is highly conserved, with 98% identity to the p47 rat liver nuclear protein and 99% identity to the pig BAT1 homolog. Furthermore, the location of BAT1 at the telomeric end of the class III region is conserved in both human S and pig. Peelman et al. (1995) showed that a recombinant epitope-tagged BAT1 construct was expressed in COS cells and showed localization of the protein to the nucleus. Allcock et al. (2001) used antisense DNA corresponding to exons 2 through 5 of the BAT1 gene and showed that after antigenic stimulation, monocytic and T-cell lines produced higher levels of the acute phase cytokines TNF, interleukin-1 (IL1; OMIM Ref. No. 147760), and IL6 (OMIM Ref. No. 147620) than cells containing the transfecting vector alone. These results suggested that BAT1 is a negative regulator of inflammation.

Full details of the abovementioned studies are described in the following publications, the disclosure of which are hereby incorporated by reference:

Peelman, L. J.; Chardon, P.; Nunes, M.; Renard, C.; Geffrotin, C.; Vaiman, M.; Van Zeveren, A.; Coppieters, W.; van de Weghe, A.; Bouquet, Y.; Choy, W. W.; Strominger, J. L.; Spies, T.: The BAT1 gene in the MHC encodes an evolutionarily conserved putative nuclear RNA helicase of the DEAD family. Genomics 26:210-218, 1995; and Allcock, R. J. N.; Williams, J. H.; Price, P.: The central MHC gene, BAT1, may encode a protein that down-regulates cytokine production. Genes Cells 6: 487-494, 2001.

Further studies establishing the function and utilities of BAT1 are found in John Hopkins OMIM database record ID 142560, and in sited publications numbered 3541-3545 listed in the bibliography section hereinbelow, which are also hereby incorporated by reference. CD34 Antigen (CD34, Accession NM_001773) is another VGAM55 host target gene. CD34 BINDING SITE is HOST TARGET binding site found in the 3' untranslated region of mRNA encoded by CD34, corresponding to a HOST TARGET binding site such as BINDING SITE I, BINDING SITE II or BINDING SITE III. Table 2 illustrates the complementarity of the nucleotide sequences of CD34 BINDING SITE, designated SEQ ID:7532, to the nucleotide sequence of VGAM55 RNA, herein designated VGAM RNA, also designated SEQ ID:2766.

Another function of VGAM55 is therefore inhibition of CD34 Antigen (CD34, Accession NM_001773), a gene which is a monomeric cell surface antigen that is selectively expressed on human hematopoietic progenitor cells. Accordingly, utilities of VGAM55 include diagnosis, prevention and treatment of diseases and clinical conditions associated with CD34. The function of CD34 has been established by previous studies. CD34 is a monomeric cell surface antigen with a molecular mass of approximately 110 kD that is selectively expressed on human hematopoietic progenitor cells. In the hands of Sutherland et al. (1988), partial amino acid analysis of highly purified CD34 antigen revealed no significant sequence similarity with any previously described structures. Sequential immunoprecipitation and Western blot analysis indicated that this antigen is not a member of the leukosialin/sialophorin family, despite the fact that these molecules share several structural similarities. Animal model experiments lend further support to the function of CD34. To analyze the involvement of CD34 in hematopoiesis, Cheng et al. (1996) produced both embryonic stem (ES) cells in mice null for the expression of this mucin. Analysis of yolk sac-like hematopoietic development in embryoid bodies derived from CD34-null ES cells showed a significant delay in both erythroid and myeloid differentiation that could be reversed by transfection of the mutant ES cells with CD34 constructs expressing either a complete or truncated cytoplasmic domain. In spite of these diminished embryonic hematopoietic progenitor numbers, the CD34-null mice developed normally, and the hematopoietic profile of adult blood appeared typical. However, the colony-forming activity of hematopoietic progenitors derived from both bone marrow and spleen was significantly reduced in adult CD34-deficient animals.

It is appreciated that the abovementioned animal model for CD34 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Cheng, J.; Baumhueter, S.; Cacalano, G.; Carver-Moore, K.; Thibodeaux, H.; Thomas, R.; Broxmeyer, H. E.; Cooper, S.; Hague, N.; Moore, M.; Lasky, L. A.: Hematopoietic defects in mice lacking the sialomucin CD34. Blood 87:479-490, 1996; and Sutherland, D. R.; Watt, S. M.; Dowden, G.; Karhi, K.; Baker, M. A.; Greaves, M. F.; Smart, J. E.: Structural and partial amino acid sequence analysis of the human hemopoietic progenito.

Further studies establishing the function and utilities of CD34 are found in John Hopkins OMIM database record ID 142230, and in sited publications numbered 2673-2681 listed in the bibliography section hereinbelow, which are also hereby incorporated by reference. Dual-specificity tyrosine-(Y)-phosphorylation Regulated Kinase 2 (DYRK2, Accession NM_006482) is another VGAM55 host target gene. DYRK2 BINDING SITE1 and DYRK2 BINDING SITE2 are HOST TARGET binding sites found in untranslated regions of mRNA encoded by DYRK2, corresponding to HOST TARGET binding sites such as BINDING SITE I, BINDING SITE II or BINDING SITE III. Table 2 illustrates the complementarity of the nucleotide sequences of DYRK2 BINDING SITE1 and DYRK2 BINDING SITE2, designated SEQ ID:13210 and SEQ ID:9635 respectively, to the nucleotide sequence of VGAM55 RNA, herein designated VGAM RNA, also designated SEQ ID:2766.

Another function of VGAM55 is therefore inhibition of Dual-specificity tyrosine-(Y)-phosphorylation Regulated Kinase 2 (DYRK2, Accession NM_006482). Accordingly, utilities of VGAM55 include diagnosis, prevention and treatment of diseases and clinical conditions associated with DYRK2. Forkhead Box E1 (thyroid transcription factor 2) (FOXE1, Accession NM_004473) is another VGAM55 host target gene. FOXE1 BINDING SITE is HOST TARGET binding site found in the 3' untranslated region of mRNA encoded by FOXE1, corresponding to a HOST TARGET binding site such as BINDING SITE I, BINDING SITE II or BINDING SITE III. Table 2 illustrates the complementarity of the nucleotide sequences of FOXE1 BINDING SITE, designated SEQ ID:10785, to the nucleotide sequence of VGAM55 RNA, herein designated VGAM RNA, also designated SEQ ID:2766.

Another function of VGAM55 is therefore inhibition of Forkhead Box E1 (thyroid transcription factor 2) (FOXE1, Accession NM_004473). Accordingly, utilities of VGAM55 include diagnosis, prevention and treatment of diseases and clinical conditions associated with FOXE1. Glutamate Receptor, Ionotropic, N-methyl D-aspartate-like 1A (GRINL1A, Accession XM_045376) is another VGAM55 host target gene. GRINL1A BINDING SITE is HOST TARGET binding site found in the 3' untranslated region of mRNA encoded by GRINL1A, corresponding to a HOST TARGET binding site such as BINDING SITE I, BINDING SITE II or BINDING SITE III. Table 2 illustrates the complementarity of the nucleotide sequences of GRINL1A BINDING SITE, designated SEQ ID:34446, to the nucleotide sequence of VGAM55 RNA, herein designated VGAM RNA, also designated SEQ ID:2766.

Another function of VGAM55 is therefore inhibition of Glutamate Receptor, Ionotropic, N-methyl D-aspartate-like 1A (GRINL1A, Accession XM_045376), a gene which plays a role in the development and function of the mammalian brain. Accordingly, utilities of VGAM55 include diagnosis, prevention and treatment of diseases and clinical conditions associated with GRINL1A. The function of GRINL1A and its association with various diseases and clinical conditions, has been established by previous studies, as described hereinabove with reference to VGAM53. Glucocorticoid Receptor DNA Binding Factor 1 (GRLF1, Accession XM_085943) is another VGAM55 host target gene. GRLF1 BINDING SITE is HOST TARGET binding site found in the 3' untranslated region of mRNA encoded by GRLF1, corresponding to a HOST TARGET binding site such as BINDING SITE I, BINDING SITE II or BINDING SITE III. Table 2 illustrates the complementarity of the nucleotide sequences of GRLF1 BINDING SITE, designated SEQ ID:38416, to the nucleotide sequence of VGAM55 RNA, herein designated VGAM RNA, also designated SEQ ID:2766.

Another function of VGAM55 is therefore inhibition of Glucocorticoid Receptor DNA Binding Factor 1 (GRLF1, Accession XM_085943), a gene which inhibits transcription of the glucocorticoid receptor gene. Accordingly, utilities of VGAM55 include diagnosis, prevention and treatment of diseases and clinical conditions associated with GRLF1. The function of GRLF1 has been established by previous studies. Using polyclonal antibodies against purified GRLF1, LeClerc et al. (1991) isolated a partial GRLF1 cDNA encoding a deduced 835-amino acid protein. The protein contains 3 possible zinc finger structures and a leucine zipper motif that contains 1 cysteine. Western blot analysis detected expression of a 94-kD GRLF1 protein. By sequence comparisons with rat p190A, database searching, and RT-PCR analysis, Tikoo et al. (2000) obtained a full-length cDNA sequence encoding GRLF1, the human homolog of p190A. The deduced 1,514-amino acid protein is 97% identical to the rat sequence. The first 1,287 residues, including the GTPase and middle domains, are encoded by the 3.7-kb exon 1, similar to the structure observed in p190B (ARHGAP5; 602680).

Full details of the abovementioned studies are described in the following publications, the disclosure of which are hereby incorporated by reference:

LeClerc, S.; Palaniswami, R.; Xie, B.; Govdan, M. V.: Molecular cloning and characterization of a factor that binds the human glucocorticoid receptor gene and represses its expression. J. Biol. Chem. 266:17333-17340, 1991; and Tikoo, A.; Czekay, S.; Viars, C.; White, S.; Heath, J. K.; Arden, K.; Maruta, H.: p190-A, a human tumor suppressor gene, maps to the chromosomal region 19q13.3 that is reportedly delet.

Further studies establishing the function and utilities of GRLF1 are found in John Hopkins OMIM database record ID 605277, and in sited publications numbered 6613-6614 listed in the bibliography section hereinbelow, which are also hereby incorporated by reference. Lipoprotein Lipase (LPL, Accession NM_000237) is another VGAM55 host target gene. LPL BINDING SITE is HOST TARGET binding site found in the 3' untranslated region of mRNA encoded by LPL, corresponding to a HOST TARGET binding site such as BINDING SITE I, BINDING SITE II or BINDING SITE III. Table 2 illustrates the complementarity of the nucleotide sequences of LPL BINDING SITE, designated SEQ ID:5752, to the nucleotide sequence of VGAM55 RNA, herein designated VGAM RNA, also designated SEQ ID:2766.

Another function of VGAM55 is therefore inhibition of Lipoprotein Lipase (LPL, Accession NM_000237), a gene which is the hydrolysis of triglycerides of circulating chylomicrons and very low density lipoproteins (vldl). the enzyme functions in the presence of apolipoprotein c-2 on the luminal surface of vascular. Accordingly, utilities of VGAM55 include diagnosis, prevention and treatment of diseases and clinical conditions associated with LPL. The function of LPL has been established by previous studies. Holt et al. (1939) first reported the familial occurrence of this syndrome. Boggs et al. (1957) described 3 affected sibs from a first-cousin mating. Massive hyperchylomicronemia occurs when the patient is on a normal diet and disappears completely in a few days on fat-free feeding. On a normal diet alpha and beta lipoproteins are low. A defect in removal of chylomicrons (fat induction) and of other triglyceride-rich lipoproteins (carbohydrate induction) is present. Decreased plasma postheparin lipolytic activity (PHLA) is demonstrated. Low tissue activity of lipoprotein lipase was suspected. The full-blown disease, manifested by attacks of abdominal pain, hepatosplenomegaly, eruptive xanthomas, and lactescence of the plasma, is a recessive. Heterozygotes may show slight hyperlipemia and reduced PHLA. Precocious atherosclerosis does not seem to be a feature. Havel and Gordon (1960) first recognized deficiency of lipoprotein lipase (triacylglycerol acylhydrolase; EC 3.1.1.3) as the basic defect in type I hyperlipoproteinemia. The type I hyperlipoproteinemia phenotype can also result from deficiency of the activator of lipoprotein lipase, apolipoprotein C-II (Breckenridge et al., 1978)--see 207750. This condition was called fat-induced hypertriglyceridemia by Nevin and Slack (1968). Adipose tissue in heterozygotes shows intermediate levels of lipoprotein lipase. Berger (1987) reported a case of variant lipoprotein lipase deficiency in which muscle lipoprotein lipase was essentially normal although the enzyme in adipose tissue was markedly reduced. Schreibman et al. (1973) studied a family with 2 clinically typical sibs whose lipoprotein lipase showed abnormal substrate specificity and kinetics. Hoeg et al. (1983) reported an extraordinary patient in whom the diagnosis was first made at the age of 75. Absolute abstinence from alcohol and a self-imposed low-fat diet may have been responsible for the long survival. Since childhood, he had had recurrent abdominal pain, nausea and vomiting, diagnosed as 'gall bladder attacks,' until age 48 when he was first hospitalized. During the next 15 years he had 1 to 3 episodes of abdominal pain per year necessitating hospitalization. These episodes were diagnosed as acute pancreatitis and were sometimes associated with an evanescent papular rash. Jaundice that developed rapidly at age 64 was found to be due to bile duct stenosis, which was surgically relieved. He had, at age 73, ischemic heart disease and a femoral bruit Animal model experiments lend further support to the function of LPL. To study the effects of increased free fatty acid (FFA) uptake in muscle tissue, Levak-Frank et al. (1995) generated transgenic mice carrying a human LPL minigene driven by the promoter of the muscle creatine kinase gene (OMIM Ref. No. 123310). In these mice, human LPL was expressed in skeletal muscle and cardiac muscle, but not in other tissues. In 3 independent transgenic mouse lines, the authors detected decreased plasma triglyceride levels, elevated FFA uptake by muscle tissue, weight loss, and premature death in proportion to the level of LPL overexpression. The animals developed severe myopathy characterized by muscle fiber degeneration, fiber atrophy, glycogen storage, and extensive proliferation of mitochondria and peroxisomes. The extensive proliferation suggested to Levak-Frank et al. (1995) that FFA plays an important role in the biogenesis of these organelles. The experiments indicated that LPL is rate-limiting for the supply of muscle tissue with triglyceride-derived FFA. The authors concluded that improper regulation of muscle LPL can lead to major pathologic changes and may be important in the pathogenesis of some human myopathies It is appreciated that the abovementioned animal model for LPL is acknowledged by those skilled in the art as a scientifically valid animal model, as can be further appreciated from the publications sited hereinbelow.

Full details of the abovementioned studies are described in the following publications, the disclosure of which are hereby incorporated by reference:

Berger, G. M. B.: An incomplete form of familial lipoprotein lipase deficiency presenting with type I hyperlipoproteinemia. Am. J. Clin. Path. 88:369-373, 1987; and Levak-Frank, S.; Radner, H.; Walsh, A.; Stollberger, R.; Knipping, G.; Hoefler, G.; Sattler, W.; Weinstock, P. H.; Breslow, J. L.; Zechner, R.: Muscle-specific overexpression of lipoprot.

Further studies establishing the function and utilities of LPL are found in John Hopkins OMIM database record ID 238600, and in sited publications numbered 3301-3304, 3473-3320, 1866, 11733-11735, 11661, 11736-11741, 3300, 11742-11757, 3321-3323, 4211, 8952-8954, 8958-8956, 8959, 8960-8969, 9234-8971, 9236-8974, 9235, 9408, 9416-9419, 11382-943 and 36 listed in the bibliography section hereinbelow, which are also hereby incorporated by reference. Melanoma Antigen, Family B, 4 (MAGEB4, Accession NM_002367) is another VGAM55 host target gene. MAGEB4 BINDING SITE is HOST TARGET binding site found in the 3' untranslated region of mRNA encoded by MAGEB4, corresponding to a HOST TARGET binding site such as BINDING SITE I, BINDING SITE II or BINDING SITE III. Table 2 illustrates the complementarity of the nucleotide sequences of MAGEB4 BINDING SITE, designated SEQ ID:8175, to the nucleotide sequence of VGAM55 RNA, herein designated VGAM RNA, also designated SEQ ID:2766.

Another function of VGAM55 is therefore inhibition of Melanoma Antigen, Family B, 4 (MAGEB4, Accession NM_002367). Accordingly, utilities of VGAM55 include diagnosis, prevention and treatment of diseases and clinical conditions associated with MAGEB4. Mitogen-activated Protein Kinase Kinase Kinase 14 (MAP3K14, Accession NM_003954) is another VGAM55 host target gene. MAP3K14 BINDING SITE is HOST TARGET binding site found in the 3' untranslated region of mRNA encoded by MAP3K14, corresponding to a HOST TARGET binding site such as BINDING SITE I, BINDING SITE II or BINDING SITE III. Table 2 illustrates the complementarity of the nucleotide sequences of MAP3K14 BINDING SITE, designated SEQ ID:10090, to the nucleotide sequence of VGAM55 RNA, herein designated VGAM RNA, also designated SEQ ID:2766.

Another function of VGAM55 is therefore inhibition of Mitogen-activated Protein Kinase Kinase Kinase 14 (MAP3K14, Accession NM_003954), a gene which is involved in the activation of nf-kappa-b and its transcriptional activity. induces the processing of nf-kappa-b 2/p100. could act in a receptor-selective manner (by similarity). Accordingly, utilities of VGAM55 include diagnosis, prevention and treatment of diseases and clinical conditions associated with MAP3K14. The function of MAP3K14 has been established by previous studies. By functional analysis of NIK and a kinase-deficient NIK expressed in primary human cells and in inflamed rheumatoid arthritis tissue, Smith et al. (2001) showed that NIK has a selective role in signaling by the lymphotoxin-beta receptor (LTBR; 600979). They determined that NIK is not required for signaling in response to lipopolysaccharide, IL1, and TNFA and is not a generic IKK kinase Animal model experiments lend further support to the function of MAP3K14. The alymphoplasia (aly) mutation of mouse is autosomal recessive and characterized by the systemic absence of lymph nodes and Peyer patches and disorganized splenic and thymic structures with immunodeficiency. Shinkura et al. (1999) cloned the mouse Nik gene and determined that a G-to-A transition leads to a gly855-to-arg substitution in the C terminus of the protein, causing alymphoplasia in aly/aly mice It is appreciated that the abovementioned animal model for MAP3K14 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shinkura, R.; Kitada, K.; Matsuda, F.; Tashiro, K.; Ikuta, K.; Suzuki, M.; Kogishi, K.; Serikawa, T.; Honjo, T.: Alymphoplasia is caused by a point mutation in the mouse gene encoding Nf-kappa-b-inducing kinase. Nature Genet. 22:74-77, 1999; and Smith, C.; Andreakos, E.; Crawley, J. B.; Brennan, F. M.; Feldmann, M.; Foxwell, B. M. J.: NF-kappa-B-inducing kinase is dispensable for activation of NF-kappa-B in inflammatory setting.

Further studies establishing the function and utilities of MAP3K14 are found in John Hopkins OMIM database record ID 604655, and in sited publications numbered 7279, 1274 and 8178-7283 listed in the bibliography section hereinbelow, which are also hereby incorporated by reference.

Membrane Protein, Palmitoylated 2 (MAGUK p55 subfamily member 2) (MPP2, Accession XM_008355) is another VGAM55 host target gene. MPP2 BINDING SITE is HOST TARGET binding site found in the 3' untranslated region of mRNA encoded by MPP2, corresponding to a HOST TARGET binding site such as BINDING SITE I, BINDING SITE II or BINDING SITE III. Table 2 illustrates the complementarity of the nucleotide sequences of MPP2 BINDING SITE, designated SEQ ID:30081, to the nucleotide sequence of VGAM55 RNA, herein designated VGAM RNA, also designated SEQ ID:2766.

Another function of VGAM55 is therefore inhibition of Membrane Protein, Palmitoylated 2 (MAGUK p55 subfamily member 2) (MPP2, Accession XM_008355). Accordingly, utilities of VGAM55 include diagnosis, prevention and treatment of diseases and clinical conditions associated with MPP2. Mucin 3B (MUC3B, Accession XM_168578) is another VGAM55 host target gene. MUC3B BINDING SITE is HOST TARGET binding site found in the 3' untranslated region of mRNA encoded by MUC3B, corresponding to a HOST TARGET binding site such as BINDING SITE I, BINDING SITE II or BINDING SITE III. Table 2 illustrates the complementarity of the nucleotide sequences of MUC3B BINDING SITE, designated SEQ ID:45258, to the nucleotide sequence of VGAM55 RNA, herein designated VGAM RNA, also designated SEQ ID:2766.

Another function of VGAM55 is therefore inhibition of Mucin 3B (MUC3B, Accession XM_168578), a gene which provides a protective, lubricating barrier against particles and infectious agents at mucosal surfaces. Accordingly, utilities of VGAM55 include diagnosis, prevention and treatment of diseases and clinical conditions associated with MUC3B. The function of MUC3B has been established by previous studies. The MUC3A gene (OMIM Ref. No. 158371), originally designated MUC3, encodes a transmembrane mucin-type glycoprotein. A number of consistent single nucleotide changes were observed in different MUC3 cDNAs from a single individual, suggesting the presence of at least 3 different transcripts. Pratt et al. (2000) presented evidence that this transcript heterogeneity is due to the existence of allelic changes and to tandem duplication of the MUC3 gene. Pratt et al. (2000) determined that the second gene, which they designated MUC3B, has the same C-terminal domain and intron-exon structure as that previously described for MUC3. The tandem repeat domain has the same amino acid consensus sequence but shows more substitutions. RT-PCR detected expression of MUC3B in fetal and adult small intestine, fetal and adult colon, and Caco-2 cells. Kyo et al. (2001) also determined that 'MUC3' consists of 2 genes, MUC3A and MUC3B, both of which encode membrane-bound mucins with 2 epidermal growth factor-like motifs and a putative transmembrane region. Fox et al. (1992) mapped the MUC3 gene (now MUC3A and MUC3B) to chromosome 7q22 by in situ hybridization.

Full details of the abovementioned studies are described in the following publications, the disclosure of which are hereby incorporated by reference:

Fox, M. F.; Lahbib, F.; Pratt, W.; Attwood, J.; Gum, J.; Kim, Y.; Swallow, D. M.: Regional localization of the intestinal mucin gene MUC3 to chromosome 7q22. Ann. Hum. Genet. 56:281-287, 1992; and Kyo, K.; Muto, T.; Nagawa, H.; Lathrop, G. M.; Nakamura, Y.: Associations of distinct variants of the intestinal mucin gene MUC3A with ulcerative colitis and Crohn's disease. J. Hum. G.

Further studies establishing the function and utilities of MUC3B are found in John Hopkins OMIM database record ID 605633, and in sited publications numbered 5195-519 and 4502 listed in the bibliography section hereinbelow, which are also hereby incorporated by reference. Nucleoporin 98 kDa (NUP98, Accession NM_016320) is another VGAM55 host target gene. NUP98 BINDING SITE is HOST TARGET binding site found in the 3' untranslated region of mRNA encoded by NUP98, corresponding to a HOST TARGET binding site such as BINDING SITE I, BINDING SITE II or BINDING SITE III. Table 2 illustrates the complementarity of the nucleotide sequences of NUP98 BINDING SITE, designated SEQ ID:18441, to the nucleotide sequence of VGAM55 RNA, herein designated VGAM RNA, also designated SEQ ID:2766.

Another function of VGAM55 is therefore inhibition of Nucleoporin 98kDa (NUP98, Accession NM_016320), a gene which functions in the nuclear transport of protein and RNA. Accordingly, utilities of VGAM55 include diagnosis, prevention and treatment of diseases and clinical conditions associated with NUP98. The function of NUP98 has been established by previous studies. Nucleoporins are proteins that function in the nuclear transport of protein and RNA. Nakamura et al. (1996) showed that in 3 patients with t (7;11), the chromosome rearrangement created a genomic fusion between the HOXA9 gene (OMIM Ref. No. 142956) and the nucleoporin gene NUP98 on 11p15. Expression of Hoxa7 and Hoxa9 is activated by proviral integration in BXH2 murine myeloid leukemias; this result, combined with the mapping of the HOXA cluster to 7p15, suggested that one of the HOXA genes may be involved in the human t (7;11)(p15; p15) translocation found in some myeloid leukemia patients. The translocation produced an invariant chimeric NUP98/HOXA9 transcript containing the amino terminal half of NUP98 fused in-frame to HOXA9. These studies identified HOXA9 as an important human myeloid leukemia gene and suggested an important role for nucleoporins in human myeloid leukemia, given that a second nucleoporin, NUP214 (OMIM Ref. No. 114350), had also been implicated in human myeloid leukemia. The 11p15 gene was identified by exon trapping experiments. Borrow et al. (1996) likewise identified the HOXA9 and NUP98 genes as the parents of the fusion in t (7;11)(p15; p15) in acute myeloid leukemia of the FABM2 and M4 types. Borrow et al. (1996) suggested that the predicted NUP98/HOXA9 fusion protein may promote leukemogenesis through inhibition of HOXA9-mediated terminal differentiation and/or aberrant nucleocytoplasmic transport.

Full details of the abovementioned studies are described in the following publications, the disclosure of which are hereby incorporated by reference:

Borrow, J.; Shearman, A. M.; Stanton, V. P., Jr.; Becher, R.; Collins, T.; Williams, A. J.; Dube, I.; Katz, F.; Kwong, Y. L.; Morris, C.; Ohyashiki, K.; Toyama, K.; Rowley, J.; Housman, D. E.: The t (7;11)(p15; p15) translocation in acute myeloid leukaemia fuses the genes for nucleoporin NUP98 and class I homeoprotein HOXA9. Nature Genet. 12:159-167, 1996; and Nakamura, T.; Largaespada, D. A.; Lee, M. P.; Johnson, L. A.; Ohyashiki, K.; Toyama, K.; Chen, S. J.; Willman, C. L.; Chen, I.-M.; Feinberg, A. P.; Jenkins, N. A.; Copeland, N. G.; Shau.

Further studies establishing the function and utilities of NUP98 are found in John Hopkins OMIM database record ID 601021, and in sited publications numbered 3689, 9642, 9643-9646, 2723, 9647-965 and 10957-9653 listed in the bibliography section hereinbelow, which are also hereby incorporated by reference. Platelet-activating Factor Acetylhydrolase, Isoform Ib, Alpha Subunit 45 kDa (PAFAH1B1, Accession NM_000430) is another VGAM55 host target gene. PAFAH1B1 BINDING SITE is HOST TARGET binding site found in the 3' untranslated region of mRNA encoded by PAFAH1B1, corresponding to a HOST TARGET binding site such as BINDING SITE I, BINDING SITE II or BINDING SITE III. Table 2 illustrates the complementarity of the nucleotide sequences of PAFAH1B1 BINDING SITE, designated SEQ ID:6009, to the nucleotide sequence of VGAM55 RNA, herein designated VGAM RNA, also designated SEQ ID:2766.

Another function of VGAM55 is therefore inhibition of Platelet-activating Factor Acetylhydrolase, Isoform Ib, Alpha Subunit 45 kDa (PAFAH1B1, Accession NM_000430). Accordingly, utilities of VGAM55 include diagnosis, prevention and treatment of diseases and clinical conditions associated with PAFAH1B1. Peripheral Myelin Protein 2 (PMP2, Accession NM_002677) is another VGAM55 host target gene. PMP2 BINDING SITE is HOST TARGET binding site found in the 3' untranslated region of mRNA encoded by PMP2, corresponding to a HOST TARGET binding site such as BINDING SITE I, BINDING SITE II or BINDING SITE III. Table 2 illustrates the complementarity of the nucleotide sequences of PMP2 BINDING SITE, designated SEQ ID:8544, to the nucleotide sequence of VGAM55 RNA, herein designated VGAM RNA, also designated SEQ ID:2766.

Another function of VGAM55 is therefore inhibition of Peripheral Myelin Protein 2 (PMP2, Accession NM_002677), a gene which is a lipid transport protein in schwann cells. Accordingly, utilities of VGAM55 include diagnosis, prevention and treatment of diseases and clinical conditions associated with PMP2. The function of PMP2 has been established by previous studies. Myelin is a multilamellar compacted membrane structure that surrounds and insulates axons, facilitating the conduction of nerve impulses. It is composed predominantly of lipids, with proteins accounting for about 30% of its net weight. Schwann cells are responsible for myelin formation in the peripheral nervous system. Peripheral myelin protein-2 (PMP2), a small basic protein, is one of the major proteins of peripheral myelin and appears to be related to the transport of fatty acids or the metabolism of myelin lipids. Hayasaka et al. (1991) noted that PMP2 (which they also called myelin P2 protein, MP2) was shown to have lipid-binding activity. Thus, MP2 protein may have an important role in the organization of compact myelin. Hayasaka et al. (1991) isolated a full-length cDNA of MP2 protein of peripheral myelin from a cDNA library of human fetus spinal cord. It was found to contain a 393-bp open reading frame encoding a polypeptide of 131 residues. The deduced amino acid sequence is highly homologous to myelin P2 protein from other species. Hayasaka et al. (1993) cloned the genomic PMP2 sequence, which is about 8 kb long and consists of 4 exons. All exon-intron junction sequences conform to the GT/AG rule. The 5-prime flanking region of the gene has a TA-rich element (TATA-like box) and a single defined transcription initiation site as detected by the primer extension method. By spot-blot hybridization (FISH) of flow-sorted human chromosomes and fluorescence in situ hybridization, Hayasaka et al. (1993) mapped the PMP2 gene to 8q21.3-q22.1. This is the same region as that in which the autosomal recessive form of Charcot-Marie-Tooth peroneal muscular atrophy (CMT4A; 214400) has been mapped. Thus, the PMP2 gene was a prime candidate for the site of the mutation in that disorder.

Full details of the abovementioned studies are described in the following publications, the disclosure of which are hereby incorporated by reference:

Hayasaka, K.; Nanao, K.; Tahara, M.; Sato, W.; Takada, G.; Miura, M.; Uyemura, K.: Isolation and sequence determination of cDNA encoding P2 protein of human peripheral myelin. Biochem. Biophys. Res. Commun. 181:204-207, 1991; and Hayasaka, K.; Himoro, M.; Takada, G.; Takahashi, E.; Minoshima, S.; Shimizu, N.: Structure and localization of the gene encoding human peripheral myelin protein 2 (PMP2). Genomics 18:244.

Further studies establishing the function and utilities of PMP2 are found in John Hopkins OMIM database record ID 170715, and in sited publications numbered 10814-10817 listed in the bibliography section hereinbelow, which are also hereby incorporated by reference. Regulatory Factor X, 5 (influences HLA class II expression) (RFX5, Accession NM_000449) is another VGAM55 host target gene. RFX5 BINDING SITE is HOST TARGET binding site found in the 3' untranslated region of mRNA encoded by RFX5, corresponding to a HOST TARGET binding site such as BINDING SITE I, BINDING SITE II or BINDING SITE III. Table 2 illustrates the complementarity of the nucleotide sequences of RFX5 BINDING SITE, designated SEQ ID:6046, to the nucleotide sequence of VGAM55 RNA, herein designated VGAM RNA, also designated SEQ ID:2766.

Another function of VGAM55 is therefore inhibition of Regulatory Factor X, 5 (influences HLA class II expression) (RFX5, Accession NM_000449), a gene which activates transcription from class ii mhc promoters. Accordingly, utilities of VGAM55 include diagnosis, prevention and treatment of diseases and clinical conditions associated with RFX5. The function of RFX5 has been established by previous studies. Major histocompatibility complex (MHC) class II molecules are heterodimeric transmembrane glycoproteins consisting of alpha and beta chains. In man, there are 3 MHC class II isotypes: HLA-DR, -DP, and -DQ. MHC class II molecules play a key role in the immune system. They present exogenous antigenic peptides to the receptor of CD4+ T-helper lymphocytes, thereby triggering the antigen-specific T-cell activation events required for the initiation and sustenance of immune responses. Durand et al. (1997) noted that the crucial role in the control of the immune response is exemplified by the finding that ectopic or aberrantly high levels of MHC class II expression is associated with autoimmune diseases, while a lack of MHC class II expression results in a severe immunodeficiency syndrome called MHC class II deficiency, or the bare lymphocyte syndrome type II (BLS; 209920). At least 4 complementation groups have been identified in B-cell lines established from patients with BLS. The molecular defect responsible for complementation group A resides in the gene encoding CIITA (MHC2TA; 600005). CIITA is a non-DNA-binding transactivator that functions as a molecular switch controlling both cell-type-specific and inducible MHC class II gene transcription. In contrast, the defects in complementation groups B, C, and D all lead to a deficiency in RFX, a nuclear protein complex that binds to the X box of MHC class II promoters (see OMIM Ref. No. RFX2; 142765). The lack of RFX binding activity in complementation group C results from mutations in the gene encoding the 75-kD subunit of RFX (Steimle et al., 1995). This gene was called RFX5 because it is the fifth member of the growing family of DNA-binding proteins sharing a novel and highly characteristic DNA-binding domain called the RFX motif. Nekrep et al. (2000) demonstrated a direct interaction between the C terminus of RFXAP (OMIM Ref. No. 601861) and RFXANK (OMIM Ref. No. 603200); mutant RFXAP or RFXANK proteins failed to bind. The authors found that RFX5 binds only to the RFXANK-RFXAP scaffold and not to either protein alone. However, neither the scaffold nor RFX5 alone can bind DNA. Nekrep et al. (2000) concluded that the binding of the RFXANK-RFXAP scaffold to RFX5 leads to a conformational change in the latter that exposes the DNA-binding domain of RFX5. The DNA-binding domain of RFX5 anchors the RFX complex to MHC class II X and S promoter boxes. Another part of the RFX5 protein interacts with MHC2TA. The authors pointed out that mutation of either protein in complementation group B or group D of BLS patients prevents its binding to the other protein, explaining why MHC class II promoters are bare in the bare lymphocyte syndrome.

Full details of the abovementioned studies are described in the following publications, the disclosure of which are hereby incorporated by reference:

Durand, B.; Sperisen, P.; Emery, P.; Barras, E.; Zufferey, M.; Mach, B.; Reith, W.: RFXAP, a novel subunit of the RFX DNA binding complex is mutated in MHC class II deficiency. EMBO J. 16:1045-1055, 1997; and Nekrep, N.; Jabrane-Ferrat, N.; Peterlin, B. M.: Mutations in the bare lymphocyte syndrome define critical steps in the assembly of the regulatory factor X complex. Molec. Cell Biol. 2.

Further studies establishing the function and utilities of RFX5 are found in John Hopkins OMIM database record ID 601863, and in sited publications numbered 753, 5800, 8320, 5807, 8319, 626 and 12618 listed in the bibliography section hereinbelow, which are also hereby incorporated by reference. Ring Finger Protein 4 (RNF4, Accession NM_002938) is another VGAM55 host target gene. RNF4 BINDING SITE is HOST TARGET binding site found in the 3' untranslated region of mRNA encoded by RNF4, corresponding to a HOST TARGET binding site such as BINDING SITE I, BINDING SITE II or BINDING SITE III. Table 2 illustrates the complementarity of the nucleotide sequences of RNF4 BINDING SITE, designated SEQ ID:8839, to the nucleotide sequence of VGAM55 RNA, herein designated VGAM RNA, also designated SEQ ID:2766.

Another function of VGAM55 is therefore inhibition of Ring Finger Protein 4 (RNF4, Accession NM_002938). Accordingly, utilities of VGAM55 include diagnosis, prevention and treatment of diseases and clinical conditions associated with RNF4. Sal-like 1 (Drosophila) (SALL1, Accession NM_002968) is another VGAM55 host target gene. SALL1 BINDING SITE is HOST TARGET binding site found in the 3' untranslated region of mRNA encoded by SALL1, corresponding to a HOST TARGET binding site such as BINDING SITE I, BINDING SITE II or BINDING SITE III. Table 2 illustrates the complementarity of the nucleotide sequences of SALL1 BINDING SITE, designated SEQ ID:8878, to the nucleotide sequence of VGAM55 RNA, herein designated VGAM RNA, also designated SEQ ID:2766.

Another function of VGAM55 is therefore inhibition of Sal-like 1 (Drosophila) (SALL1, Accession NM_002968). Accordingly, utilities of VGAM55 include diagnosis, prevention and treatment of diseases and clinical conditions associated with SALL1. Transporter 2, ATP-binding Cassette, Sub-family B (MDR/TAP) (TAP2, Accession NM_000544) is another VGAM55 host target gene. TAP2 BINDING SITE is HOST TARGET binding site found in the 3' untranslated region of mRNA encoded by TAP2, corresponding to a HOST TARGET binding site such as BINDING SITE I, BINDING SITE II or BINDING SITE III. Table 2 illustrates the complementarity of the nucleotide sequences of TAP2 BINDING SITE, designated SEQ ID:6142, to the nucleotide sequence of VGAM55 RNA, herein designated VGAM RNA, also designated SEQ ID:2766.

Another function of VGAM55 is therefore inhibition of Transporter 2, ATP-binding Cassette, Sub-family B (MDR/

TAP) (TAP2, Accession NM_000544), a gene which is involved in the transport of antigens from the cytoplasm to a membrane-bound compartment for association with mhc class i molecules. Accordingly, utilities of VGAM55 include diagnosis, prevention and treatment of diseases and clinical conditions associated with TAP2. The function of TAP2 has been established by previous studies. Various studies have identified genes within the major histocompatibility complex (MHC) that play a role in presentation of antigenic peptides to T cells. RING4 (TAP1), a gene within the human MHC class II region, was found to have sequence homology with members of the ABC (ATP-binding cassette) transporter superfamily. Powis et al. (1992) reported the nucleotide sequence of RING11, a second ABC transporter gene located approximately 7 kb telomeric to RING4. RING11, or TAP2, was found to be gamma-interferon (OMIM Ref. No. 147570) inducible, a property shared with other genes involved in antigen presentation. A comparison between the predicted amino acid sequences of RING11 and RING4 showed strong homology. Powis et al. (1992) proposed that the 2 gene products form a heterodimer that transports peptides from the cytoplasm into the endoplasmic reticulum. They identified 2 RING11 alleles that differ in the length of their derived protein sequence by 17 amino acids. The more common of these alleles had a frequency of 79% in a Caucasoid population. Both TAP1 and TAP2 polypeptides possess a nucleotide-binding domain (NBD). Karttunen et al. (2001) presented biochemical and functional evidence that the NBDs of TAP1 and TAP2 are nonequivalent. Photolabeling experiments with 8-azido-ATP demonstrated a cooperative interaction between the 2 NBDs that can be stimulated by peptide. The substitution of key lysine residues in the Walker A motifs of TAP1 and TAP2 suggested that TAP1-mediated ATP hydrolysis is not essential for peptide translocation but that TAP2-mediated ATP hydrolysis is critical, not only for translocation, but for peptide binding.

Full details of the abovementioned studies are described in the following publications, the disclosure of which are hereby incorporated by reference:

Karttunen, J. T.; Lehner, P. J.; Gupta, S. S.; Hewitt, E. W.; Cresswell, P.: Distinct functions and cooperative interaction of the subunits of the transporter associated with antigen processing (TAP). Proc. Nat. Acad. Sci. 98:7431-7436, 2001; and Powis, S. H.; Mockridge, I.; Kelly, A.; Kerr, L.-A.; Glynne, R.; Gileadi, U.; Beck, S.; Trowsdale, J.: Polymorphism in a second ABC transporter gene located within the class II region.

Further studies establishing the function and utilities of TAP2 are found in John Hopkins OMIM database record ID 170261, and in sited publications numbered 1945, 1948-1951, 194 and 1952 listed in the bibliography section hereinbelow, which are also hereby incorporated by reference. Usher Syndrome 3A (USH3A, Accession NM_052995) is another VGAM55 host target gene. USH3A BINDING SITE is HOST TARGET binding site found in the 3' untranslated region of mRNA encoded by USH3A, corresponding to a HOST TARGET binding site such as BINDING SITE I, BINDING SITE II or BINDING SITE III. Table 2 illustrates the complementarity of the nucleotide sequences of USH3A BINDING SITE, designated SEQ ID:27560, to the nucleotide sequence of VGAM55 RNA, herein designated VGAM RNA, also designated SEQ ID:2766.

Another function of VGAM55 is therefore inhibition of Usher Syndrome 3A (USH3A, Accession NM_052995). Accordingly, utilities of VGAM55 include diagnosis, prevention and treatment of diseases and clinical conditions associated with USH3A. 24432 (Accession NM_022914) is another VGAM55 host target gene. 24432 BINDING SITE is HOST TARGET binding site found in the 5' untranslated region of mRNA encoded by 24432, corresponding to a HOST TARGET binding site such as BINDING SITE I, BINDING SITE II or BINDING SITE III. Table 2 illustrates the complementarity of the nucleotide sequences of 24432 BINDING SITE, designated SEQ ID:23225, to the nucleotide sequence of VGAM55 RNA, herein designated VGAM RNA, also designated SEQ ID:2766.

Another function of VGAM55 is therefore inhibition of 24432 (Accession NM_022914). Accordingly, utilities of VGAM55 include diagnosis, prevention and treatment of diseases and clinical conditions associated with 24432. BOP (Accession XM_097915) is another VGAM55 host target gene. BOP BINDING SITE is HOST TARGET binding site found in the 5' untranslated region of mRNA encoded by BOP, corresponding to a HOST TARGET binding site such as BINDING SITE I, BINDING SITE II or BINDING SITE III. Table 2 illustrates the complementarity of the nucleotide sequences of BOP BINDING SITE, designated SEQ ID:41210, to the nucleotide sequence of VGAM55 RNA, herein designated VGAM RNA, also designated SEQ ID:2766.

Another function of VGAM55 is therefore inhibition of BOP (Accession XM_097915). Accordingly, utilities of VGAM55 include diagnosis, prevention and treatment of diseases and clinical conditions associated with BOP. Chromosome 5 Open Reading Frame 7 (C5orf7, Accession XM_033576) is another VGAM55 host target gene. C5orf7 BINDING SITE is HOST TARGET binding site found in the 3' untranslated region of mRNA encoded by C5orf7, corresponding to a HOST TARGET binding site such as BINDING SITE I, BINDING SITE II or BINDING SITE III. Table 2 illustrates the complementarity of the nucleotide sequences of C5orf7 BINDING SITE, designated SEQ ID:31942, to the nucleotide sequence of VGAM55 RNA, herein designated VGAM RNA, also designated SEQ ID:2766.

Another function of VGAM55 is therefore inhibition of Chromosome 5 Open Reading Frame 7 (C5orf7, Accession XM_033576). Accordingly, utilities of VGAM55 include diagnosis, prevention and treatment of diseases and clinical conditions associated with C5orf7. Chromosome 6 Open Reading Frame 26 (C6orf26, Accession NM_025259) is another VGAM55 host target gene. C6orf26 BINDING SITE is HOST TARGET binding site found in the 3' untranslated region of mRNA encoded by C6orf26, corresponding to a HOST TARGET binding site such as BINDING SITE I, BINDING SITE II or BINDING SITE III. Table 2 illustrates the complementarity of the nucleotide sequences of C6orf26 BINDING SITE, designated SEQ ID:24928, to the nucleotide sequence of VGAM55 RNA, herein designated VGAM RNA, also designated SEQ ID:2766.

Another function of VGAM55 is therefore inhibition of Chromosome 6 Open Reading Frame 26 (C6orf26, Accession NM_025259). Accordingly, utilities of VGAM55 include diagnosis, prevention and treatment of diseases and clinical conditions associated with C6orf26. Chromatin Accessibility Complex 1 (CHRAC1, Accession NM_017444) is another VGAM55 host target gene. CHRAC1 BINDING SITE1 and CHRAC1 BINDING SITE2 are HOST TARGET binding sites found in untranslated regions of mRNA encoded by CHRAC1, corresponding to HOST TARGET binding sites such as BINDING SITE I, BINDING SITE II or BINDING SITE III. Table 2 illustrates the complementarity of the nucleotide sequences of CHRAC1 BINDING SITE1 and CHRAC1 BINDING SITE2, designated SEQ ID:18902 and SEQ ID:18903 respectively, to the nucleotide sequence of VGAM55 RNA, herein designated VGAM RNA, also designated SEQ ID:2766.

Another function of VGAM55 is therefore inhibition of Chromatin Accessibility Complex 1 (CHRAC1, Accession NM_017444). Accordingly, utilities of VGAM55 include diagnosis, prevention and treatment of diseases and clinical conditions associated with CHRAC1. DT1P1A10 (Accession XM_029187) is another VGAM55 host target gene. DT1P1A10 BINDING SITE is HOST TARGET binding site found in the 3" untranslated region of mRNA encoded by DT1P1A10, corresponding to a HOST TARGET binding site such as BINDING SITE I, BINDING SITE II or BINDING SITE III. Table 2 illustrates the complementarity of the nucleotide sequences of DT1P1A10 BINDING SITE, designated SEQ ID:30859, to the nucleotide sequence of VGAM55 RNA, herein designated VGAM RNA, also designated SEQ ID:2766.

Another function of VGAM55 is therefore inhibition of DT1P1A10 (Accession XM_029187). Accordingly, utilities of VGAM55 include diagnosis, prevention and treatment of diseases and clinical conditions associated with DT1P1A10. FK506 Binding Protein 4, 59 kDa (FKBP4, Accession NM_002014) is another VGAM55 host target gene. FKBP4 BINDING SITE is HOST TARGET binding site found in the 3' untranslated region of mRNA encoded by FKBP4, corresponding to a HOST TARGET binding site such as BINDING SITE I, BINDING SITE II or BINDING SITE III. Table 2 illustrates the complementarity of the nucleotide sequences of FKBP4 BINDING SITE, designated SEQ ID:7754, to the nucleotide sequence of VGAM55 RNA, herein designated VGAM RNA, also designated SEQ ID:2766.

Another function of VGAM55 is therefore inhibition of FK506 Binding Protein 4, 59 kDa (FKBP4, Accession NM_002014). Accordingly, utilities of VGAM55 include diagnosis, prevention and treatment of diseases and clinical conditions associated with FKBP4. FLJ11539 (Accession NM_024748) is another VGAM55 host target gene. FLJ11539 BINDING SITE is HOST TARGET binding site found in the 3' untranslated region of mRNA encoded by FLJ11539, corresponding to a HOST TARGET binding site such as BINDING SITE I, BINDING SITE II or BINDING SITE III. Table 2 illustrates the complementarity of the nucleotide sequences of FLJ11539 BINDING SITE, designated SEQ ID:24086, to the nucleotide sequence of VGAM55 RNA, herein designated VGAM RNA, also designated SEQ ID:2766.

Another function of VGAM55 is therefore inhibition of FLJ11539 (Accession NM_024748). Accordingly, utilities of VGAM55 include diagnosis, prevention and treatment of diseases and clinical conditions associated with FLJ11539. FLJ14735 (Accession NM_032832) is another VGAM55 host target gene. FLJ14735 BINDING SITE is HOST TARGET binding site found in the 3' untranslated region of mRNA encoded by FLJ14735, corresponding to a HOST TARGET binding site such as BINDING SITE I, BINDING SITE II or BINDING SITE III. Table 2 illustrates the complementarity of the nucleotide sequences of FLJ14735 BINDING SITE, designated SEQ ID:26607, to the nucleotide sequence of VGAM55 RNA, herein designated VGAM RNA, also designated SEQ ID:2766.

Another function of VGAM55 is therefore inhibition of FLJ14735 (Accession NM_032832). Accordingly, utilities of VGAM55 include diagnosis, prevention and treatment of diseases and clinical conditions associated with FLJ14735. FLJ14950 (Accession NM_032865) is another VGAM55 host target gene. FLJ14950 BINDING SITE is HOST TARGET binding site found in the 3' untranslated region of mRNA encoded by FLJ14950, corresponding to a HOST TARGET binding site such as BINDING SITE I, BINDING SITE II or BINDING SITE III. Table 2 illustrates the complementarity of the nucleotide sequences of FLJ14950 BINDING SITE, designated SEQ ID:26677, to the nucleotide sequence of VGAM55 RNA, herein designated VGAM RNA, also designated SEQ ID:2766.

Another function of VGAM55 is therefore inhibition of FLJ14950 (Accession NM_032865). Accordingly, utilities of VGAM55 include diagnosis, prevention and treatment of diseases and clinical conditions associated with FLJ14950. FLJ20079 (Accession NM_017656) is another VGAM55 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19177, to the nucleotide sequence of VGAM55 RNA, herein designated VGAM RNA, also designated SEQ ID:2766.

Another function of VGAM55 is therefore inhibition of FLJ20079 (Accession NM_017656). Accordingly, utilities of VGAM55 include diagnosis, prevention and treatment of diseases and clinical conditions associated with FLJ20079. FLJ21596 (Accession NM_024823) is another VGAM55 host target gene. FLJ21596 BINDING SITE is HOST TARGET binding site found in the 3' untranslated region of mRNA encoded by FLJ21596, corresponding to a HOST TARGET binding site such as BINDING SITE I, BINDING SITE II or BINDING SITE III. Table 2 illustrates the complementarity of the nucleotide sequences of FLJ21596 BINDING SITE, designated SEQ ID:24214, to the nucleotide sequence of VGAM55 RNA, herein designated VGAM RNA, also designated SEQ ID:2766.

Another function of VGAM55 is therefore inhibition of FLJ21596 (Accession NM_024823). Accordingly, utilities of VGAM55 include diagnosis, prevention and treatment of diseases and clinical conditions associated with FLJ21596. FLJ22195 (Accession NM_022758) is another VGAM55 host target gene. FLJ22195 BINDING SITE is HOST TARGET binding site found in the 3' untranslated region of mRNA encoded by FLJ22195, corresponding to a HOST TARGET binding site such as BINDING SITE I, BINDING SITE II or BINDING SITE III. Table 2 illustrates the complementarity of the nucleotide sequences of FLJ22195 BINDING SITE, designated SEQ ID:22997, to the nucleotide sequence of VGAM55 RNA, herein designated VGAM RNA, also designated SEQ ID:2766.

Another function of VGAM55 is therefore inhibition of FLJ22195 (Accession NM_022758). Accordingly, utilities of VGAM55 include diagnosis, prevention and treatment of diseases and clinical conditions associated with FLJ22195. Golgi Phosphoprotein 3 (coat-protein) (GOLPH3, Accession NM_022130) is another VGAM55 host target gene. GOLPH3 BINDING SITE is HOST TARGET binding site found in the 3' untranslated region of mRNA encoded by GOLPH3, corresponding to a HOST TARGET binding site such as BINDING SITE I, BINDING SITE II or BINDING SITE III. Table 2 illustrates the complementarity of the nucleotide sequences of GOLPH3 BINDING SITE, designated SEQ ID:22689, to the nucleotide sequence of VGAM55 RNA, herein designated VGAM RNA, also designated SEQ ID:2766.

Another function of VGAM55 is therefore inhibition of Golgi Phosphoprotein 3 (coat-protein) (GOLPH3, Accession NM_022130). Accordingly, utilities of VGAM55 include diagnosis, prevention and treatment of diseases and clinical conditions associated with GOLPH3. KIAA0295 (Accession XM_042833) is another VGAM55 host target gene. KIAA0295 BINDING SITE is HOST TARGET binding site found in the 3' untranslated region of mRNA encoded by KIAA0295, corresponding to a HOST TARGET binding site such as BINDING SITE I, BINDING SITE II or BINDING SITE III. Table 2 illustrates the complementarity of the nucleotide sequences of KIAA0295 BINDING SITE, designated SEQ ID:33779, to the nucleotide sequence of VGAM55 RNA, herein designated VGAM RNA, also designated SEQ ID:2766.

Another function of VGAM55 is therefore inhibition of KIAA0295 (Accession XM_042833). Accordingly, utilities of VGAM55 include diagnosis, prevention and treatment of diseases and clinical conditions associated with KIAA0295. KIAA0599 (Accession XM_085127) is another VGAM55 host target gene. KIAA0599 BINDING SITE is HOST TARGET binding site found in the 3' untranslated region of mRNA encoded by KIAA0599, corresponding to a HOST TARGET binding site such as BINDING SITE I, BINDING SITE II or BINDING SITE III. Table 2 illustrates the complementarity of the nucleotide sequences of KIAA0599 BINDING SITE, designated SEQ ID:37855, to the nucleotide sequence of VGAM55 RNA, herein designated VGAM RNA, also designated SEQ ID:2766.

Another function of VGAM55 is therefore inhibition of KIAA0599 (Accession XM_085127). Accordingly, utilities of VGAM55 include diagnosis, prevention and treatment of diseases and clinical conditions associated with KIAA0599. KIAA0825 (Accession XM_027906) is another VGAM55 host target gene. KIAA0825 BINDING SITE is HOST TARGET binding site found in the 3' untranslated region of mRNA encoded by KIAA0825, corresponding to a HOST TARGET binding site such as BINDING SITE I, BINDING SITE II or BINDING SITE III. Table 2 illustrates the complementarity of the nucleotide sequences of KIAA0825 BINDING SITE, designated SEQ ID:30594, to the nucleotide sequence of VGAM55 RNA, herein designated VGAM RNA, also designated SEQ ID:2766.

Another function of VGAM55 is therefore inhibition of KIAA0825 (Accession XM_027906). Accordingly, utilities of VGAM55 include diagnosis, prevention and treatment of diseases and clinical conditions associated with KIAA0825. KIAA1030 (Accession XM_167789) is another VGAM55 host target gene. KIAA1030 BINDING SITE is HOST TARGET binding site found in the 3' untranslated region of mRNA encoded by KIAA1030, corresponding to a HOST TARGET binding site such as BINDING SITE I, BINDING SITE II or BINDING SITE III. Table 2 illustrates the complementarity of the nucleotide sequences of KIAA1030 BINDING SITE, designated SEQ ID:44822, to the nucleotide sequence of VGAM55 RNA, herein designated VGAM RNA, also designated SEQ ID:2766.

Another function of VGAM55 is therefore inhibition of KIAA1030 (Accession XM_167789). Accordingly, utilities of VGAM55 include diagnosis, prevention and treatment of diseases and clinical conditions associated with KIAA1030. KIAA1126 (Accession XM_050325) is another VGAM55 host target gene. KIAA1126 BINDING SITE is HOST TARGET binding site found in the 3' untranslated region of mRNA encoded by KIAA1126, corresponding to a HOST TARGET binding site such as BINDING SITE I, BINDING SITE II or BINDING SITE III. Table 2 illustrates the complementarity of the nucleotide sequences of KIAA1126 BINDING SITE, designated SEQ ID:35610, to the nucleotide sequence of VGAM55 RNA, herein designated VGAM RNA, also designated SEQ ID:2766.

Another function of VGAM55 is therefore inhibition of KIAA1126 (Accession XM_050325). Accordingly, utilities of VGAM55 include diagnosis, prevention and treatment of diseases and clinical conditions associated with KIAA1126. KIAA1464 (Accession XM_043069) is another VGAM55 host target gene. KIAA1464 BINDING SITE is HOST TARGET binding site found in the 3' untranslated region of mRNA encoded by KIAA1464, corresponding to a HOST TARGET binding site such as BINDING SITE I, BINDING SITE II or BINDING SITE III. Table 2 illustrates the complementarity of the nucleotide sequences of KIAA1464 BINDING SITE, designated SEQ ID:33887, to the nucleotide sequence of VGAM55 RNA, herein designated VGAM RNA, also designated SEQ ID:2766.

Another function of VGAM55 is therefore inhibition of KIAA1464 (Accession XM_043069). Accordingly, utilities of VGAM55 include diagnosis, prevention and treatment of diseases and clinical conditions associated with KIAA1464. KIAA1535 (Accession XM_086565) is another VGAM55 host target gene. KIAA1535 BINDING SITE is HOST TARGET binding site found in the 3' untranslated region of mRNA encoded by KIAA1535, corresponding to a HOST TARGET binding site such as BINDING SITE I, BINDING SITE II or BINDING SITE III. Table 2 illustrates the complementarity of the nucleotide sequences of KIAA1535 BINDING SITE, designated SEQ ID:38767, to the nucleotide sequence of VGAM55 RNA, herein designated VGAM RNA, also designated SEQ ID:2766.

Another function of VGAM55 is therefore inhibition of KIAA1535 (Accession XM_086565). Accordingly, utilities of VGAM55 include diagnosis, prevention and treatment of diseases and clinical conditions associated with KIAA1535. KIAA1536 (Accession NM_020898) is another VGAM55 host target gene. KIAA1536 BINDING SITE is HOST TARGET binding site found in the 3' untranslated region of mRNA encoded by KIAA1536, corresponding to a HOST TARGET binding site such as BINDING SITE I, BINDING SITE II or BINDING SITE III. Table 2 illustrates the complementarity of the nucleotide sequences of KIAA1536 BINDING SITE, designated SEQ ID:21923, to the nucleotide sequence of VGAM55 RNA, herein designated VGAM RNA, also designated SEQ ID:2766.

Another function of VGAM55 is therefore inhibition of KIAA1536 (Accession NM_020898). Accordingly, utilities of VGAM55 include diagnosis, prevention and treatment of diseases and clinical conditions associated with KIAA1536. KIAA1655 (Accession XM_039442) is another VGAM55 host target gene. KIAA1655 BINDING SITE is HOST TARGET binding site found in the 5' untranslated region of mRNA encoded by KIAA1655, corresponding to a HOST TARGET binding site such as BINDING SITE I, BINDING SITE II or BINDING SITE III. Table 2 illustrates the complementarity of the nucleotide sequences of KIAA1655 BINDING SITE, designated SEQ ID:33084, to the nucleotide sequence of VGAM55 RNA, herein designated VGAM RNA, also designated SEQ ID:2766.

Another function of VGAM55 is therefore inhibition of KIAA1655 (Accession XM_039442). Accordingly, utilities of VGAM55 include diagnosis, prevention and treatment of diseases and clinical conditions associated with KIAA1655. KIAA1805 (Accession XM_086976) is another VGAM55 host target gene. KIAA1805 BINDING SITE is HOST TARGET binding site found in the 3' untranslated region of mRNA encoded by KIAA1805, corresponding to a HOST TARGET binding site such as BINDING SITE I, BINDING SITE II or BINDING SITE III. Table 2 illustrates the complementarity of the nucleotide sequences of KIAA1805 BINDING SITE, designated SEQ ID:38999, to the nucleotide sequence of VGAM55 RNA, herein designated VGAM RNA, also designated SEQ ID:2766.

Another function of VGAM55 is therefore inhibition of KIAA1805 (Accession XM_086976). Accordingly, utilities of VGAM55 include diagnosis, prevention and treatment of diseases and clinical conditions associated with KIAA1805. Mitogen-activated Protein Kinase Kinase 6 (MAP2K6, Accession NM_031988) is another VGAM55 host target gene. MAP2K6 BINDING SITE1 and MAP2K6 BINDING SITE2 are HOST TARGET binding sites found in untranslated regions of mRNA encoded by MAP2K6, corresponding to HOST TARGET binding sites such as BINDING SITE I, BINDING SITE II or BINDING SITE III. Table 2 illustrates the complementarity of the nucleotide sequences of MAP2K6 BINDING SITE1 and MAP2K6 BINDING SITE2, designated SEQ ID:25701 and SEQ ID:8642 respectively, to the nucleotide sequence of VGAM55 RNA, herein designated VGAM RNA, also designated SEQ ID:2766.

Another function of VGAM55 is therefore inhibition of Mitogen-activated Protein Kinase Kinase 6 (MAP2K6, Accession NM_031988). Accordingly, utilities of VGAM55 include diagnosis, prevention and treatment of diseases and clinical conditions associated with MAP2K6. Nuclear Receptor Coactivator 2 (NCOA2, Accession NM_006540) is another VGAM55 host target gene. NCOA2 BINDING SITE is HOST TARGET binding site found in the 3' untranslated region of mRNA encoded by NCOA2, corresponding to a HOST TARGET binding site such as BINDING SITE I, BINDING SITE II or BINDING SITE III. Table 2 illustrates the complementarity of the nucleotide sequences of NCOA2 BINDING SITE, designated SEQ ID:13294, to the nucleotide sequence of VGAM55 RNA, herein designated VGAM RNA, also designated SEQ ID:2766.

Another function of VGAM55 is therefore inhibition of Nuclear Receptor Coactivator 2 (NCOA2, Accession NM_006540). Accordingly, utilities of VGAM55 include diagnosis, prevention and treatment of diseases and clinical conditions associated with NCOA2. Solute Carrier Family 38, Member 5 (SLC38A5, Accession NM_033518) is another VGAM55 host target gene. SLC38A5 BINDING SITE is HOST TARGET binding site found in the 5' untranslated region of mRNA encoded by SLC38A5, corresponding to a HOST TARGET binding site such as BINDING SITE I, BINDING SITE II or BINDING SITE III. Table 2 illustrates the complementarity of the nucleotide sequences of SLC38A5 BINDING SITE, designated SEQ ID:27296, to the nucleotide sequence of VGAM55 RNA, herein designated VGAM RNA, also designated SEQ ID:2766.

Another function of VGAM55 is therefore inhibition of Solute Carrier Family 38, Member 5 (SLC38A5, Accession NM_033518). Accordingly, utilities of VGAM55 include diagnosis, prevention and treatment of diseases and clinical conditions associated with SLC38A5. Target of Myb1 (chicken) (TOM1, Accession NM_005488) is another VGAM55 host target gene. TOM1 BINDING SITE is HOST TARGET binding site found in the 3' untranslated region of mRNA encoded by TOM1, corresponding to a HOST TARGET binding site such as BINDING SITE I, BINDING SITE II or BINDING SITE III. Table 2 illustrates the complementarity of the nucleotide sequences of TOM1 BINDING SITE, designated SEQ ID:11985, to the nucleotide sequence of VGAM55 RNA, herein designated VGAM RNA, also designated SEQ ID:2766.

Another function of VGAM55 is therefore inhibition of Target of Myb1 (chicken) (TOM1, Accession NM_005488). Accordingly, utilities of VGAM55 include diagnosis, prevention and treatment of diseases and clinical conditions associated with TOM1. Tweety Homolog 2 (Drosophila) (TTYH2, Accession NM_032646) is another VGAM55 host target gene. TTYH2 BINDING SITE is HOST TARGET binding site found in the 3' untranslated region of mRNA encoded by TTYH2, corresponding to a HOST TARGET binding site such as BINDING SITE I, BINDING SITE II or BINDING SITE III. Table 2 illustrates the complementarity of the nucleotide sequences of TTYH2 BINDING SITE, designated SEQ ID:26379, to the nucleotide sequence of VGAM55 RNA, herein designated VGAM RNA, also designated SEQ ID:2766.

Another function of VGAM55 is therefore inhibition of Tweety Homolog 2 (Drosophila) (TTYH2, Accession NM_032646). Accordingly, utilities of VGAM55 include diagnosis, prevention and treatment of diseases and clinical conditions associated with TTYH2. UDP Glycosyltransferase 2 Family, Polypeptide B10 (UGT2B10, Accession NM_001075) is another VGAM55 host target gene. UGT2B10 BINDING SITE is HOST TARGET binding site found in the 3' untranslated region of mRNA encoded by UGT2B10, corresponding to a HOST TARGET binding site such as BINDING SITE I, BINDING SITE II or BINDING SITE III. Table 2 illustrates the complementarity of the nucleotide sequences of UGT2B10 BINDING SITE, designated SEQ ID:6736, to the nucleotide sequence of VGAM55 RNA, herein designated VGAM RNA, also designated SEQ ID:2766.

Another function of VGAM55 is therefore inhibition of UDP Glycosyltransferase 2 Family, Polypeptide B10 (UGT2B10, Accession NM_001075). Accordingly, utilities of VGAM55 include diagnosis, prevention and treatment of diseases and clinical conditions associated with UGT2B10. Zinc Finger Protein 238 (ZNF238, Accession NM_006352) is another VGAM55 host target gene. ZNF238 BINDING SITE is HOST TARGET binding site found in the 3' untranslated region of mRNA encoded by ZNF238, corresponding to a HOST TARGET binding site such as BINDING SITE I, BINDING SITE II or BINDING SITE III. Table 2 illustrates the complementarity of the nucleotide sequences of ZNF238 BINDING SITE, designated SEQ ID:13043, to the nucleotide sequence of VGAM55 RNA, herein designated VGAM RNA, also designated SEQ ID:2766.

Another function of VGAM55 is therefore inhibition of Zinc Finger Protein 238 (ZNF238, Accession NM_006352). Accordingly, utilities of VGAM55 include diagnosis, prevention and treatment of diseases and clinical conditions associated with ZNF238. LOC144893 (Accession XM_096687) is another VGAM55 host target gene. LOC144893 BINDING SITE is HOST TARGET binding site found in the 3' untranslated region of mRNA encoded by LOC144893, corresponding to a HOST TARGET binding site such as BINDING SITE I, BINDING SITE II or BINDING SITE III. Table 2 illustrates the complementarity of the nucleotide sequences of LOC144893 BINDING SITE, designated SEQ ID:40462, to the nucleotide sequence of VGAM55 RNA, herein designated VGAM RNA, also designated SEQ ID:2766.

Another function of VGAM55 is therefore inhibition of LOC144893 (Accession XM_096687). Accordingly, utilities of VGAM55 include diagnosis, prevention and treatment of diseases and clinical conditions associated with LOC144893. LOC147042 (Accession XM_097167) is another VGAM55 host target gene. LOC147042 BINDING SITE is HOST TARGET binding site found in the 3' untranslated region of mRNA encoded by LOC147042, corresponding to a HOST TARGET binding site such as BINDING SITE I, BINDING SITE II or BINDING SITE III. Table 2 illustrates the complementarity of the nucleotide sequences of LOC147042 BINDING SITE, designated SEQ ID:40787, to the nucleotide sequence of VGAM55 RNA, herein designated VGAM RNA, also designated SEQ ID:2766.

Another function of VGAM55 is therefore inhibition of LOC147042 (Accession XM_097167). Accordingly, utilities of VGAM55 include diagnosis, prevention and treatment of diseases and clinical conditions associated with LOC147042. LOC147093 (Accession XM_097184) is another VGAM55 host target gene. LOC147093 BINDING SITE is HOST TARGET binding site found in the 5' untranslated region of mRNA encoded by LOC147093, corresponding to a HOST TARGET binding site such as BINDING SITE I, BINDING SITE II or BINDING SITE III. Table 2 illustrates the complementarity of the nucleotide sequences of LOC147093 BINDING SITE, designated SEQ ID:40805, to the nucleotide sequence of VGAM55 RNA, herein designated VGAM RNA, also designated SEQ ID:2766.

Another function of VGAM55 is therefore inhibition of LOC147093 (Accession XM_097184). Accordingly, utilities of VGAM55 include diagnosis, prevention and treatment of diseases and clinical conditions associated with LOC147093. LOC147645 (Accession XM_085831) is another VGAM55 host target gene. LOC147645 BINDING SITE is HOST TARGET binding site found in the 3' untranslated region of mRNA encoded by LOC147645, corresponding to a HOST TARGET binding site such as BINDING SITE I, BINDING SITE II or BINDING SITE III. Table 2 illustrates the complementarity of the nucleotide sequences of LOC147645 BINDING SITE, designated SEQ ID:38360, to the nucleotide sequence of VGAM55 RNA, herein designated VGAM RNA, also designated SEQ ID:2766.

Another function of VGAM55 is therefore inhibition of LOC147645 (Accession XM_085831). Accordingly, utilities of VGAM55 include diagnosis, prevention and treatment of diseases and clinical conditions associated with LOC147645. LOC150299 (Accession XM_097869) is another VGAM55 host target gene. LOC150299 BINDING SITE is HOST TARGET binding site found in the 3' untranslated region of mRNA encoded by LOC150299, corresponding to a HOST TARGET binding site such as BINDING SITE I, BINDING SITE II or BINDING SITE III. Table 2 illustrates the complementarity of the nucleotide sequences of LOC150299 BINDING SITE, designated SEQ ID:41181, to the nucleotide sequence of VGAM55 RNA, herein designated VGAM RNA, also designated SEQ ID:2766.

Another function of VGAM55 is therefore inhibition of LOC150299 (Accession XM_097869). Accordingly, utilities of VGAM55 include diagnosis, prevention and treatment of diseases and clinical conditions associated with LOC150299. LOC151647 (Accession XM_087261) is another VGAM55 host target gene. LOC151647 BINDING SITE is HOST TARGET binding site found in the 3' untranslated region of mRNA encoded by LOC151647, corresponding to a HOST TARGET binding site such as BINDING SITE I, BINDING SITE II or BINDING SITE III. Table 2 illustrates the complementarity of the nucleotide sequences of LOC151647 BINDING SITE, designated SEQ ID:39157, to the nucleotide sequence of VGAM55 RNA, herein designated VGAM RNA, also designated SEQ ID:2766.

Another function of VGAM55 is therefore inhibition of LOC151647 (Accession XM_087261). Accordingly, utilities of VGAM55 include diagnosis, prevention and treatment of diseases and clinical conditions associated with LOC151647.

LOC152274 (Accession XM_087418) is another VGAM55 host target gene. LOC152274 BINDING SITE is HOST TARGET binding site found in the 3' untranslated region of mRNA encoded by LOC152274, corresponding to a HOST TARGET binding site such as BINDING SITE I, BINDING SITE II or BINDING SITE III. Table 2 illustrates the complementarity of the nucleotide sequences of LOC152274 BINDING SITE, designated SEQ ID:39236, to the nucleotide sequence of VGAM55 RNA, herein designated VGAM RNA, also designated SEQ ID:2766.

Another function of VGAM55 is therefore inhibition of LOC152274 (Accession XM_087418). Accordingly, utilities of VGAM55 include diagnosis, prevention and treatment of diseases and clinical conditions associated with LOC152274. LOC152275 (Accession XM_098186) is another VGAM55 host target gene. LOC152275 BINDING SITE is HOST TARGET binding site found in the 3' untranslated region of mRNA encoded by LOC152275, corresponding to a HOST TARGET binding site such as BINDING SITE I, BINDING SITE II or BINDING SITE III. Table 2 illustrates the complementarity of the nucleotide sequences of LOC152275 BINDING SITE, designated SEQ ID:41459, to the nucleotide sequence of VGAM55 RNA, herein designated VGAM RNA, also designated SEQ ID:2766.

Another function of VGAM55 is therefore inhibition of LOC152275 (Accession XM_098186). Accordingly, utilities of VGAM55 include diagnosis, prevention and treatment of diseases and clinical conditions associated with LOC152275. LOC152313 (Accession XM_098190) is another VGAM55 host target gene. LOC152313 BINDING SITE is HOST TARGET binding site found in the 5' untranslated region of mRNA encoded by LOC152313, corresponding to a HOST TARGET binding site such as BINDING SITE I, BINDING SITE II or BINDING SITE III. Table 2 illustrates the complementarity of the nucleotide sequences of LOC152313 BINDING SITE, designated SEQ ID:41473, to the nucleotide sequence of VGAM55 RNA, herein designated VGAM RNA, also designated SEQ ID:2766.

Another function of VGAM55 is therefore inhibition of LOC152313 (Accession XM_098190). Accordingly, utilities of VGAM55 include diagnosis, prevention and treatment of diseases and clinical conditions associated with LOC152313. LOC153196 (Accession XM_098323) is another VGAM55 host target gene. LOC153196 BINDING SITE is HOST TARGET binding site found in the 5' untranslated region of mRNA encoded by LOC153196, corresponding to a HOST TARGET binding site such as BINDING SITE I, BINDING SITE II or BINDING SITE III. Table 2 illustrates the complementarity of the nucleotide sequences of LOC153196 BINDING SITE, designated SEQ ID:41592, to the nucleotide sequence of VGAM55 RNA, herein designated VGAM RNA, also designated SEQ ID:2766.

Another function of VGAM55 is therefore inhibition of LOC153196 (Accession XM_098323). Accordingly, utilities of VGAM55 include diagnosis, prevention and treatment of diseases and clinical conditions associated with LOC153196. LOC157909 (Accession XM_088419) is another VGAM55 host target gene. LOC157909 BINDING SITE is HOST TARGET binding site found in the 5' untranslated region of mRNA encoded by LOC157909, corresponding to a HOST TARGET binding site such as BINDING SITE I, BINDING SITE II or BINDING SITE III. Table 2 illustrates the complementarity of the nucleotide sequences of LOC157909 BINDING SITE, designated SEQ ID:39679, to the nucleotide sequence of VGAM55 RNA, herein designated VGAM RNA, also designated SEQ ID:2766.

Another function of VGAM55 is therefore inhibition of LOC157909 (Accession XM_088419). Accordingly, utilities of VGAM55 include diagnosis, prevention and treatment of diseases and clinical conditions associated with LOC157909.

LOC158450 (Accession XM_088580) is another VGAM55 host target gene. LOC158450 BINDING SITE is HOST TARGET binding site found in the 5' untranslated region of mRNA encoded by LOC158450, corresponding to a HOST TARGET binding site such as BINDING SITE I, BINDING SITE II or BINDING SITE III. Table 2 illustrates the complementarity of the nucleotide sequences of LOC158450 BINDING SITE, designated SEQ ID:39844, to the nucleotide sequence of VGAM55 RNA, herein designated VGAM RNA, also designated SEQ ID:2766.

Another function of VGAM55 is therefore inhibition of LOC158450 (Accession XM_088580). Accordingly, utilities of VGAM55 include diagnosis, prevention and treatment of diseases and clinical conditions associated with LOC158450.

LOC158504 (Accession XM_088591) is another VGAM55 host target gene. LOC158504 BINDING SITE is HOST TARGET binding site found in the 5' untranslated region of mRNA encoded by LOC158504, corresponding to a HOST TARGET binding site such as BINDING SITE I, BINDING SITE II or BINDING SITE III. Table 2 illustrates the complementarity of the nucleotide sequences of LOC158504 BINDING SITE, designated SEQ ID:39855, to the nucleotide sequence of VGAM55 RNA, herein designated VGAM RNA, also designated SEQ ID:2766.

Another function of VGAM55 is therefore inhibition of LOC158504 (Accession XM_088591). Accordingly, utilities of VGAM55 include diagnosis, prevention and treatment of diseases and clinical conditions associated with LOC158504.

LOC200205 (Accession XM_114152) is another VGAM55 host target gene. LOC200205 BINDING SITE is HOST TARGET binding site found in the 3' untranslated region of mRNA encoded by LOC200205, corresponding to a HOST TARGET binding site such as BINDING SITE I, BINDING SITE II or BINDING SITE III. Table 2 illustrates the complementarity of the nucleotide sequences of LOC200205 BINDING SITE, designated SEQ ID:42735, to the nucleotide sequence of VGAM55 RNA, herein designated VGAM RNA, also designated SEQ ID:2766.

Another function of VGAM55 is therefore inhibition of LOC200205 (Accession XM_114152). Accordingly, utilities of VGAM55 include diagnosis, prevention and treatment of diseases and clinical conditions associated with LOC200205.

LOC200261 (Accession XM_114172) is another VGAM55 host target gene. LOC200261 BINDING SITE is HOST TARGET binding site found in the 3' untranslated region of mRNA encoded by LOC200261, corresponding to a HOST TARGET binding site such as BINDING SITE I, BINDING SITE II or BINDING SITE III. Table 2 illustrates the complementarity of the nucleotide sequences of LOC200261 BINDING SITE, designated SEQ ID:42749, to the nucleotide sequence of VGAM55 RNA, herein designated VGAM RNA, also designated SEQ ID:2766.

Another function of VGAM55 is therefore inhibition of LOC200261 (Accession XM_114172). Accordingly, utilities of VGAM55 include diagnosis, prevention and treatment of diseases and clinical conditions associated with LOC200261.

LOC222662 (Accession XM_167086) is another VGAM55 host target gene. LOC222662 BINDING SITE is HOST TARGET binding site found in the 3' untranslated region of mRNA encoded by LOC222662, corresponding to a HOST TARGET binding site such as BINDING SITE I, BINDING SITE II or BINDING SITE III. Table 2 illustrates the complementarity of the nucleotide sequences of LOC222662 BINDING SITE, designated SEQ ID:44602, to the nucleotide sequence of VGAM55 RNA, herein designated VGAM RNA, also designated SEQ ID:2766.

Another function of VGAM55 is therefore inhibition of LOC222662 (Accession XM_167086). Accordingly, utilities of VGAM55 include diagnosis, prevention and treatment of diseases and clinical conditions associated with LOC222662.

LOC254556 (Accession XM_170588) is another VGAM55 host target gene. LOC254556 BINDING SITE is HOST TARGET binding site found in the 3' untranslated region of mRNA encoded by LOC254556, corresponding to a HOST TARGET binding site such as BINDING SITE I, BINDING SITE II or BINDING SITE III. Table 2 illustrates the complementarity of the nucleotide sequences of LOC254556 BINDING SITE, designated SEQ ID:45392, to the nucleotide sequence of VGAM55 RNA, herein designated VGAM RNA, also designated SEQ ID:2766.

Another function of VGAM55 is therefore inhibition of LOC254556 (Accession XM_170588). Accordingly, utilities of VGAM55 include diagnosis, prevention and treatment of diseases and clinical conditions associated with LOC254556.

LOC254707 (Accession XM_173687) is another VGAM55 host target gene. LOC254707 BINDING SITE is HOST TARGET binding site found in the 5' untranslated region of mRNA encoded by LOC254707, corresponding to a HOST TARGET binding site such as BINDING SITE I, BINDING SITE II or BINDING SITE III. Table 2 illustrates the complementarity of the nucleotide sequences of LOC254707 BINDING SITE, designated SEQ ID:46554, to the nucleotide sequence of VGAM55 RNA, herein designated VGAM RNA, also designated SEQ ID:2766.

Another function of VGAM55 is therefore inhibition of LOC254707 (Accession XM_173687). Accordingly, utilities of VGAM55 include diagnosis, prevention and treatment of diseases and clinical conditions associated with LOC254707.

LOC257612 (Accession XM_175270) is another VGAM55 host target gene. LOC257612 BINDING SITE is HOST TARGET binding site found in the 5' untranslated region of mRNA encoded by LOC257612, corresponding to a HOST TARGET binding site such as BINDING SITE I, BINDING SITE II or BINDING SITE III. Table 2 illustrates the complementarity of the nucleotide sequences of LOC257612 BINDING SITE, designated SEQ ID:46740, to the nucleotide sequence of VGAM55 RNA, herein designated VGAM RNA, also designated SEQ ID:2766.

Another function of VGAM55 is therefore inhibition of LOC257612 (Accession XM_175270). Accordingly, utilities of VGAM55 include diagnosis, prevention and treatment of diseases and clinical conditions associated with LOC257612.

LOC51652 (Accession NM_016079) is another VGAM55 host target gene. LOC51652 BINDING SITE is HOST TARGET binding site found in the 3' untranslated region of mRNA encoded by LOC51652, corresponding to a HOST TARGET binding site such as BINDING SITE I, BINDING SITE II or BINDING SITE III. Table 2 illustrates the complementarity of the nucleotide sequences of LOC51652 BINDING SITE, designated SEQ ID:18152, to the nucleotide sequence of VGAM55 RNA, herein designated VGAM RNA, also designated SEQ ID:2766.

Another function of VGAM55 is therefore inhibition of LOC51652 (Accession NM_016079). Accordingly, utilities of VGAM55 include diagnosis, prevention and treatment of diseases and clinical conditions associated with LOC51652.

LOC90520 (Accession XM_032277) is another VGAM55 host target gene. LOC90520 BINDING SITE is HOST TARGET binding site found in the 3' untranslated region of mRNA encoded by LOC90520, corresponding to a HOST TARGET binding site such as BINDING SITE I, BINDING SITE II or BINDING SITE III. Table 2 illustrates the complementarity of the nucleotide sequences of LOC90520 BINDING SITE, designated SEQ ID:31631, to the nucleotide sequence of VGAM55 RNA, herein designated VGAM RNA, also designated SEQ ID:2766.

Another function of VGAM55 is therefore inhibition of LOC90520 (Accession XM_032277). Accordingly, utilities of VGAM55 include diagnosis, prevention and treatment of diseases and clinical conditions associated with LOC90520. LOC91050 (Accession XM_035703) is another VGAM55 host target gene. LOC91050 BINDING SITE is HOST TARGET binding site found in the 3' untranslated region of mRNA encoded by LOC91050, corresponding to a HOST TARGET binding site such as BINDING SITE I, BINDING SITE II or BINDING SITE III. Table 2 illustrates the complementarity of the nucleotide sequences of LOC91050 BINDING SITE, designated SEQ ID:32339, to the nucleotide sequence of VGAM55 RNA, herein designated VGAM RNA, also designated SEQ ID:2766.

Another function of VGAM55 is therefore inhibition of LOC91050 (Accession XM_035703). Accordingly, utilities of VGAM55 include diagnosis, prevention and treatment of diseases and clinical conditions associated with LOC91050. FIG. 1 further provides a conceptual description of a novel bioinformatically detected viral gene of the present invention, referred to here as Viral Genomic Address Messenger 56 (VGAM56) viral gene, which modulates expression of respective host target genes thereof, the function and utility of which host target genes is known in the art.

VGAM56 is a novel bioinformatically detected regulatory, non protein coding, viral micro RNA (miRNA) gene. The method by which VGAM56 was detected is described hereinabove with reference to FIGS. 1-8.

VGAM56 gene, herein designated VGAM GENE, is a viral gene contained in the genome of Invertebrate Iridescent Virus 6. VGAM56 host target gene, herein designated VGAM HOST TARGET GENE, is a human gene contained in the human genome.

VGAM56 gene encodes a VGAM56 precursor RNA, herein designated VGAM PRECURSOR RNA. Similar to other miRNA genes, and unlike most ordinary genes, VGAM56 precursor RNA does not encode a protein. A nucleotide sequence identical or highly similar to the nucleotide sequence of VGAM56 precursor RNA is designated SEQ ID:42, and is provided hereinbelow with reference to the sequence listing part. Nucleotide sequence SEQ ID:42 is located at position 116893 relative to the genome of Invertebrate Iridescent Virus 6.

VGAM56 precursor RNA folds onto itself, forming VGAM56 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM56 folded precursor RNA into VGAM56 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM56 RNA is designated SEQ ID:2767, and is provided hereinbelow with reference to the sequence listing part.

VGAM56 host target gene, herein designated VGAM HOST TARGET GENE, encodes a corresponding messenger RNA, VGAM56 host target RNA, herein designated VGAM HOST TARGET RNA. VGAM56 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM56 RNA, herein designated VGAM RNA, binds complementarily to one or more host target binding sites located in untranslated regions of VGAM56 host target RNA, herein designated VGAM HOST TARGET RNA. This complementary binding is due to the fact that the nucleotide sequence of VGAM56 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM56 RNA, herein designated VGAM RNA, may have a different number of host target binding sites in untranslated regions of a VGAM56 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM56 RNA, herein designated VGAM RNA, to host target binding sites on VGAM56 host target RNA, herein designated VGAM HOST TARGET RNA, such as BINDING SITE I, BINDING SITE II and BINDING SITE III, inhibits translation of VGAM56 host target RNA into VGAM56 host target protein, herein designated VGAM HOST TARGET PROTEIN. VGAM host target protein is therefore outlined by a broken line.

It is appreciated that VGAM56 host target gene, herein designated VGAM HOST TARGET GENE, in fact represents a plurality of VGAM56 host target genes. The mRNA of each one of this plurality of VGAM56 host target genes comprises one or more host target binding sites, each having a nucleotide sequence which is at least partly complementary to VGAM56 RNA, herein designated VGAM RNA, and which when bound by VGAM56 RNA causes inhibition of translation of respective one or more VGAM56 host target proteins.

It is further appreciated by one skilled in the art that the mode of translational inhibition illustrated by FIG. 1 with specific reference to translational inhibition exerted by VGAM56 gene, herein designated VGAM GENE, on one or more VGAM56 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM56 is inhibition of expression of host target genes, as part of a novel viral mechanism of attacking a host. Accordingly, utilities of VGAM56 include diagnosis, prevention and treatment of viral infection by Invertebrate Iridescent Virus 6. Specific functions, and accordingly utilities, of VGAM56 correlate with, and may be deduced from, the identity of the host target genes which VGAM56 binds and inhibits, and the function of these host target genes, as elaborated hereinbelow.

Nucleotide sequences of the VGAM56 precursor RNA, herein designated VGAM PRECURSOR RNA, and of the 'diced' VGAM56 RNA, herein designated VGAM RNA, and a schematic representation of the secondary folding of VGAM56 folded precursor RNA, herein designated VGAM FOLDED PRECURSOR RNA, of VGAM56 are further described hereinbelow with reference to Table 1.

Nucleotide sequences of host target binding sites, such as BINDING SITE-I, BINDING SITE-II and BINDING SITE-III of FIG. 1, found on VGAM56 host target RNA, and schematic representation of the complementarity of each of these host target binding sites to VGAM56 RNA, herein designated VGAM RNA, are described hereinbelow with reference to Table 2.

As mentioned hereinabove with reference to FIG. 1, a function of VGAM56 gene, herein designated VGAM is inhibition of expression of VGAM56 target genes. It is appreciated that specific functions, and accordingly utilities, of VGAM56 correlate with, and may be deduced from, the identity of the target genes which VGAM56 binds and inhibits, and the function of these target genes, as elaborated hereinbelow.

Chromosome 9 Open Reading Frame 14 (C9orf14, Accession XM_098859) is a VGAM56 host target gene. C9orf14 BINDING SITE is HOST TARGET binding site found in the 5' untranslated region of mRNA encoded by C9orf14, corresponding to a HOST TARGET binding site such as BINDING SITE I, BINDING SITE II or BINDING SITE III. Table 2 illustrates the complementarity of the nucleotide sequences of C9orf14 BINDING SITE, designated SEQ ID:41908, to the nucleotide sequence of VGAM56 RNA, herein designated VGAM RNA, also designated SEQ ID:2767.

A function of VGAM56 is therefore inhibition of Chromosome 9 Open Reading Frame 14 (C9orf14, Accession XM_098859). Accordingly, utilities of VGAM56 include diagnosis, prevention and treatment of diseases and clinical conditions associated with C9orf14. LOC143187 (Accession NM_145206) is another VGAM56 host target gene. LOC143187 BINDING SITE is HOST TARGET binding site found in the 3' untranslated region of mRNA encoded by LOC143187, corresponding to a HOST TARGET binding site such as BINDING SITE I, BINDING SITE II or BINDING SITE III. Table 2 illustrates the complementarity of the nucleotide sequences of LOC143187 BINDING SITE, designated SEQ ID:29745, to the nucleotide sequence of VGAM56 RNA, herein designated VGAM RNA, also designated SEQ ID:2767.

Another function of VGAM56 is therefore inhibition of LOC143187 (Accession NM_145206). Accordingly, utilities of VGAM56 include diagnosis, prevention and treatment of diseases and clinical conditions associated with LOC143187. LOC158332 (Accession XM_088554) is another VGAM56 host target gene. LOC158332 BINDING SITE is HOST TARGET binding site found in the 3' untranslated region of mRNA encoded by LOC158332, corresponding to a HOST TARGET binding site such as BINDING SITE I, BINDING SITE II or BINDING SITE III. Table 2 illustrates the complementarity of the nucleotide sequences of LOC158332 BINDING SITE, designated SEQ ID:39824, to the nucleotide sequence of VGAM56 RNA, herein designated VGAM RNA, also designated SEQ ID:2767.

Another function of VGAM56 is therefore inhibition of LOC158332 (Accession XM_088554). Accordingly, utilities of VGAM56 include diagnosis, prevention and treatment of diseases and clinical conditions associated with LOC158332. FIG. 1 further provides a conceptual description of a novel bioinformatically detected viral gene of the present invention, referred to here as Viral Genomic Address Messenger 57 (VGAM57) viral gene, which modulates expression of respective host target genes thereof, the function and utility of which host target genes is known in the art.

VGAM57 is a novel bioinformatically detected regulatory, non protein coding, viral micro RNA (miRNA) gene. The method by which VGAM57 was detected is described hereinabove with reference to FIGS. 1-8.

VGAM57 gene, herein designated VGAM GENE, is a viral gene contained in the genome of Invertebrate Iridescent Virus 6. VGAM57 host target gene, herein designated VGAM HOST TARGET GENE, is a human gene contained in the human genome.

VGAM57 gene encodes a VGAM57 precursor RNA, herein designated VGAM PRECURSOR RNA. Similar to other miRNA genes, and unlike most ordinary genes, VGAM57 precursor RNA does not encode a protein. A nucleotide sequence identical or highly similar to the nucleotide sequence of VGAM57 precursor RNA is designated SEQ ID:43, and is provided hereinbelow with reference to the sequence listing part. Nucleotide sequence SEQ ID:43 is located at position 14382 relative to the genome of Invertebrate Iridescent Virus 6.

VGAM57 precursor RNA folds onto itself, forming VGAM57 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM57 folded precursor RNA into VGAM57 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM57 RNA is designated SEQ ID:2768, and is provided hereinbelow with reference to the sequence listing part.

VGAM57 host target gene, herein designated VGAM HOST TARGET GENE, encodes a corresponding messenger RNA, VGAM57 host target RNA, herein designated VGAM HOST TARGET RNA. VGAM57 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM57 RNA, herein designated VGAM RNA, binds complementarily to one or more host target binding sites located in untranslated regions of VGAM57 host target RNA, herein designated VGAM HOST TARGET RNA. This complementary binding is due to the fact that the nucleotide sequence of VGAM57 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM57 RNA, herein designated VGAM RNA, may have a different number of host target binding sites in untranslated regions of a VGAM57 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM57 RNA, herein designated VGAM RNA, to host target binding sites on VGAM57 host target RNA, herein designated VGAM HOST TARGET RNA, such as BINDING SITE I, BINDING SITE II and BINDING SITE III, inhibits translation of VGAM57 host target RNA into VGAM57 host target protein, herein designated VGAM HOST TARGET PROTEIN. VGAM host target protein is therefore outlined by a broken line.

It is appreciated that VGAM57 host target gene, herein designated VGAM HOST TARGET GENE, in fact represents a plurality of VGAM57 host target genes. The mRNA of each one of this plurality of VGAM57 host target genes comprises one or more host target binding sites, each having a nucleotide sequence which is at least partly complementary to VGAM57 RNA, herein designated VGAM RNA, and which when bound by VGAM57 RNA causes inhibition of translation of respective one or more VGAM57 host target proteins.

It is further appreciated by one skilled in the art that the mode of translational inhibition illustrated by FIG. 1 with specific reference to translational inhibition exerted by VGAM57 gene, herein designated VGAM GENE, on one or more VGAM57 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM57 is inhibition of expression of host target genes, as part of a novel viral mechanism of attacking a host. Accordingly, utilities of VGAM57 include diagnosis, prevention and treatment of viral infection by Invertebrate Iridescent Virus 6. Specific functions, and accordingly utilities, of VGAM57 correlate with, and may be deduced from, the identity of the host target genes which VGAM57 binds and inhibits, and the function of these host target genes, as elaborated hereinbelow.

Nucleotide sequences of the VGAM57 precursor RNA, herein designated VGAM PRECURSOR RNA, and of the 'diced' VGAM57 RNA, herein designated VGAM RNA, and a schematic representation of the secondary folding of VGAM57 folded precursor RNA, herein designated VGAM FOLDED PRECURSOR RNA, of VGAM57 are further described hereinbelow with reference to Table 1.

Nucleotide sequences of host target binding sites, such as BINDING SITE-I, BINDING SITE-II and BINDING SITE-III of FIG. 1, found on VGAM57 host target RNA, and schematic representation of the complementarity of each of these host target binding sites to VGAM57 RNA, herein designated VGAM RNA, are described hereinbelow with reference to Table 2.

As mentioned hereinabove with reference to FIG. 1, a function of VGAM57 gene, herein designated VGAM is inhibition of expression of VGAM57 target genes. It is appreciated that specific functions, and accordingly utilities, of VGAM57 correlate with, and may be deduced from, the identity of the target genes which VGAM57 binds and inhibits, and the function of these target genes, as elaborated hereinbelow.

Cockayne Syndrome 1 (classical) (CKN1, Accession NM_000082) is a VGAM57 host target gene. CKN1 BINDING SITE is HOST TARGET binding site found in the 3' untranslated region of mRNA encoded by CKN1, corresponding to a HOST TARGET binding site such as BINDING SITE I, BINDING SITE II or BINDING SITE III. Table 2 illustrates the complementarity of the nucleotide sequences of CKN1 BINDING SITE, designated SEQ ID:5533, to the nucleotide sequence of VGAM57 RNA, herein designated VGAM RNA, also designated SEQ ID:2768.

A function of VGAM57 is therefore inhibition of Cockayne Syndrome 1 (classical) (CKN1, Accession NM_000082). Accordingly, utilities of VGAM57 include diagnosis, prevention and treatment of diseases and clinical conditions associated with CKN1. Dishevelled, Dsh Homolog 3 (Drosophila) (DVL3, Accession NM_004423) is another VGAM57 host target gene. DVL3 BINDING SITE is HOST TARGET binding site found in the 3' untranslated region of mRNA encoded by DVL3, corresponding to a HOST TARGET binding site such as BINDING SITE I, BINDING SITE II or BINDING SITE III. Table 2 illustrates the complementarity of the nucleotide sequences of DVL3 BINDING SITE, designated SEQ ID:10699, to the nucleotide sequence of VGAM57 RNA, herein designated VGAM RNA, also designated SEQ ID:2768.

Another function of VGAM57 is therefore inhibition of Dishevelled, Dsh Homolog 3 (Drosophila) (DVL3, Accession NM_004423), a gene which regulates cell proliferation. Accordingly, utilities of VGAM57 include diagnosis, prevention and treatment of diseases and clinical conditions associated with DVL3. The function of DVL3 has been established by previous studies. The Drosophila dishevelled gene (dsh) encodes a cytoplasmic phosphoprotein (Klingensmith et al., 1994) that regulates cell proliferation, acting as a transducer molecule for developmental processes, including segmentation and neuroblast specification. Pizzuti et al. (1996) noted that dsh is required for the function of the wingless gene product wg, a segment polarity gene homologous to the mammalian proto-oncogene WNT1 (OMIM Ref. No. 164820). Pizzuti et al. (1996) reported the isolation and chromosomal mapping of 2 human dsh homologs, designated DVL1 (OMIM Ref. No. 601365) and DVL3 by them. The human dsh homologs were isolated from a fetal brain cDNA library. DVL3 encodes a predicted 716-amino acid polypeptide that shows 74% nucleotide homology with human DVL1 and 71% homology with the mouse Dvl1 gene. DVL1 and DVL3 share 64% amino acid identity. Pizzuti et al. (1996) reported that homology is particularly high in the N-terminal region and that there is more divergence in the C-terminal regions. PCR carried out using DNA from rodent human somatic cell hybrids and DVL3 specific primers led to the assignment of DVL3 to human chromosome 3. Pizzuti et al. (1996) regionally assigned DVL3 to band 3q27 using fluorescence in situ hybridization. Hybridization of poly (A) mRNA with the DVL3 cDNA revealed a 2.9-kb transcript with abundant expression in skeletal muscle, pancreas and heart. They also detected 5.9-kb and 5.0-kb transcripts in skeletal muscle, adult liver, adult heart, pancreas, and placenta. The 5.9-kb form was abundant in fetal tissues but the 5.0-kb form was absent from these tissues. Pizzuti et al. (1996) noted that Charcot-Marie-Tooth type 2B (OMIM Ref. No. 600882) maps to chromosome 3q. Bui et al. (1997) also isolated human DVL3, which shares 98% amino acid identity with mouse Dvl3 and 49% with Drosophila dsh. The authors confirmed the chromosomal localization at 3p27. Semenov and Snyder (1997) isolated 3 human genes encoding proteins homologous to Drosophila dsh. The cDNA sequence of DVL3 reported by Semenov and Snyder (1997) differs from the previously reported sequences deposited in GenBank. Bui et al. (1997) detected expression of DVL3 mRNA in B cells, breast, kidney, bladder, endometrium, and 2 primary endometrial cultures. It was detected equally in normal human breast tissues and tumors and in colorectal samples of normal tissues, polyps, and tumors.

Full details of the abovementioned studies are described in the following publications, the disclosure of which are hereby incorporated by reference:

Pizzuti, A.; Amati, F.; Calabrese, G.; Mari, A.; Colosimo, A; Silani, V.; Giardino, L.; Ratti, A.; Penso, D.; Calza, L.; Palka, G.; Scarlato, G.; Novelli, G.; Dallapicolla, B.: cDNA characterization and chromosomal mapping of two human homologs of the Drosophila dishevelled polarity gene. Hum. Molec. Genet. 5:953-958, 1996; and Semenov, M. V.; Snyder, M.: Human dishevelled genes constitute a DHR-containing multigene family. Genomics 42:302-310, 1997.

Further studies establishing the function and utilities of DVL3 are found in John Hopkins OMIM database record ID 601368, and in sited publications numbered 9864-6902 listed in the bibliography section hereinbelow, which are also hereby incorporated by reference. Epidermal Growth Factor (beta-urogastrone) (EGF, Accession NM_001963) is another VGAM57 host target gene. EGF BINDING SITE is HOST TARGET binding site found in the 3' untranslated region of mRNA encoded by EGF, corresponding to a HOST TARGET binding site such as BINDING SITE I, BINDING SITE II or BINDING SITE III. Table 2 illustrates the complementarity of the nucleotide sequences of EGF BINDING SITE, designated SEQ ID:7688, to the nucleotide sequence of VGAM57 RNA, herein designated VGAM RNA, also designated SEQ ID:2768.

Another function of VGAM57 is therefore inhibition of Epidermal Growth Factor (beta-urogastrone) (EGF, Accession NM_001963), a gene which stimulates the growth of epidermal and epithelial tissues and of some fibroblasts in cell culture. Accordingly, utilities of VGAM57 include diagnosis, prevention and treatment of diseases and clinical conditions associated with EGF. The function of EGF has been established by previous studies. During the immediate-early response of mammalian cells to mitogens, histone H3 (see OMIM Ref. No. 601128) is rapidly and transiently phosphorylated by one or more kinases. Sassone-Corsi et al. (1999) demonstrated that EGF-stimulated phosphorylation of H3 requires RSK2 (OMIM Ref. No. 300075), a member of the pp90(RSK) family of kinases implicated in growth control. Looking for the genetic factors that mediate susceptibility to, and outcome of, sporadic malignant melanoma, Shahbazi et al. (2002) focused on epidermal growth factor because of its role in mitogenesis. They tested for genetic polymorphisms in EGF in 135 white European patients with malignant melanoma and in 99 healthy white European controls. They identified a single-nucleotide substitution, G to A, at position 61 of the EGF gene. Frequencies of the A and G alleles of EGF were 56% and 44%, respectively, in controls. Cells from individuals homozygous for the 61A allele produced significantly less EGF than cells from 61G homozygotes or A/G heterozygotes. Compared with the A/A genotype, G/G was significantly associated with risk of malignant melanoma (odds ratio 4.9, p less than 0.0001).

Full details of the abovementioned studies are described in the following publications, the disclosure of which are hereby incorporated by reference:

Sassone-Corsi, P.; Mizzen, C. A.; Cheung, P.; Crosjo, C.; Monaco, L.; Jacquot, S.; Hanauer, A.; Allis, C. D.: Requirement of Rsk-2 for epidermal growth factor-activated phosphorylation of histone H3. Science 285:886-891, 1999; and Shahbazi, M.; Pravica, V.; Nasreen, N.; Fakhoury, H.; Fryer, A. A.; Strange, R. C.; Hutchinson, P. E.; Osborne, J. E.; Lear, J. T.; Smith, A. G.; Hutchinson, I. V.: Association between.

Further studies establishing the function and utilities of EGF are found in John Hopkins OMIM database record ID 131530, and in sited publications numbered 4631-4644 listed in the bibliography section hereinbelow, which are also hereby incorporated by reference. Ellis Van Creveld Syndrome (EVC, Accession NM_014556) is another VGAM57 host target gene. EVC BINDING SITE is HOST TARGET binding site found in the 3' untranslated region of mRNA encoded by EVC, corresponding to a HOST TARGET binding site such as BINDING SITE I, BINDING SITE II or BINDING SITE III. Table 2 illustrates the complementarity of the nucleotide sequences of EVC BINDING SITE, designated SEQ ID:15885, to the nucleotide sequence of VGAM57 RNA, herein designated VGAM RNA, also designated SEQ ID:2768.

Another function of VGAM57 is therefore inhibition of Ellis Van Creveld Syndrome (EVC, Accession NM_014556). Accordingly, utilities of VGAM57 include diagnosis, prevention and treatment of diseases and clinical conditions associated with EVC. Eve, Even-skipped Homeo Box Homolog 1 (Drosophila) (EVX1, Accession NM_001989) is another VGAM57 host target gene. EVX1 BINDING SITE is HOST TARGET binding site found in the 5' untranslated region of mRNA encoded by EVX1, corresponding to a HOST TARGET binding site such as BINDING SITE I, BINDING SITE II or BINDING SITE III. Table 2 illustrates the complementarity of the nucleotide sequences of EVX1 BINDING SITE, designated SEQ ID:7713, to the nucleotide sequence of VGAM57 RNA, herein designated VGAM RNA, also designated SEQ ID:2768.

Another function of VGAM57 is therefore inhibition of Eve, Even-skipped Homeo Box Homolog 1 (Drosophila) (EVX1, Accession NM_001989). Accordingly, utilities of VGAM57 include diagnosis, prevention and treatment of diseases and clinical conditions associated with EVX1. Fanconi Anemia, Complementation Group E (FANCE, Accession NM_021922) is another VGAM57 host target gene. FANCE BINDING SITE is HOST TARGET binding site found in the 3' untranslated region of mRNA encoded by FANCE, corresponding to a HOST TARGET binding site such as BINDING SITE I, BINDING SITE II or BINDING SITE III. Table 2 illustrates the complementarity of the nucleotide sequences of FANCE BINDING SITE, designated SEQ ID:22447, to the nucleotide sequence of VGAM57 RNA, herein designated VGAM RNA, also designated SEQ ID:2768.

Another function of VGAM57 is therefore inhibition of Fanconi Anemia, Complementation Group E (FANCE, Accession NM_021922), a gene which is a possible regulator of lymphocyte and platelet function. Accordingly, utilities of VGAM57 include diagnosis, prevention and treatment of diseases and clinical conditions associated with FANCE. The function of FANCE has been established by previous studies. A number sign (#) is used with this entry because Fanconi anemia is caused by mutation in 1 of the Fanconi anemia complementation group genes: FANCA (OMIM Ref. No. 607139), FANCB (OMIM Ref. No. 227660), FANCC (OMIM Ref. No. 227645), FANCD1 (OMIM Ref. No. 605724), FANCD2 (OMIM Ref. No. 227646), FANCE (OMIM Ref. No. 600901), FANCF (OMIM Ref. No. 603467), FANCG (OMIM Ref. No. 602956). The previously designated FANCH complementation group (Joenje et al., 1997) was found by Joenje et al. (2000) to be the same as FANCA. Joenje et al. (1995) presented evidence for a fifth subtype of Fanconi anemia, designated group E. Buchwald (1995) stated that 6 of 31 patients (12.7%) could be classified as group E. The FACE group is defined as being different from groups A (OMIM Ref. No. 227650), B (OMIM Ref. No. 227660), C (OMIM Ref. No. 227645), and D (OMIM Ref. No. 227646) and may itself be heterogeneous.

Full details of the abovementioned studies are described in the following publications, the disclosure of which are hereby incorporated by reference:

Joenje, H.; Lo Ten Foe, J. R.; Oostra, A. B.; van Berkel, C. G. M.; Rooimans, M. A.; Schroeder-Kurth, T.; Wegner, R.-D.; Gille, J. J. P.; Buchwald, M.; Arwert, F.: Classification of Fanconi anemia patients by complementation analysis: evidence for a fifth genetic subtype. Blood 86:2156-2160, 1995; and Buchwald, M.: Complementation groups: one or more per gene? Nature Genet. 11:228-230, 1995.

Further studies establishing the function and utilities of FANCE are found in John Hopkins OMIM database record ID 600901, and in sited publications numbered 9588, 9367, 9368, 943 and 9605-9606 listed in the bibliography section hereinbelow, which are also hereby incorporated by reference. FK506 Binding Protein 1A, 12 kDa (FKBP1A, Accession NM_000801) is another VGAM57 host target gene. FKBP1A BINDING SITE is HOST TARGET binding site found in the 3' untranslated region of mRNA encoded by FKBP1A, corresponding to a HOST TARGET binding site such as BINDING SITE I, BINDING SITE II or BINDING SITE III. Table 2 illustrates the complementarity of the nucleotide sequences of FKBP1A BINDING SITE, designated SEQ ID:6472, to the nucleotide sequence of VGAM57 RNA, herein designated VGAM RNA, also designated SEQ ID:2768.

Another function of VGAM57 is therefore inhibition of FK506 Binding Protein 1A, 12 kDa (FKBP1A, Accession NM_000801), a gene which FK506-binding protein 1A. Accordingly, utilities of VGAM57 include diagnosis, prevention and treatment of diseases and clinical conditions associated with FKBP1A. The function of FKBP1A has been established by previous studies. FK506, a macrolide, is a powerful immunosuppressant like cyclosporin A (CsA). CsA and FK506 are chemically distinct but have remarkably similar immunosuppressive action, although FK506 is many times more potent than CsA. The action of CsA may be mediated through cyclophilin (OMIM Ref. No. 123840), which is identical to peptidyl-prolyl cis-trans isomerase (OMIM Ref. No. PPIase), and the immunosuppressive action of CsA in T cells may be mediated through inhibition of this enzyme activity. FK506-binding protein (FKBP) also has peptidyl-prolyl cis-trans isomerase enzymatic activity; however, whereas cyclophilin binds to, and is inhibited by, CsA but does not recognize FK506, the converse holds for FKBP. Since the 2 drugs have essentially equivalent action on T lymphocytes, it may be that they act through distinct pathways but their mode of action converges on PPIase activities. Maki et al. (1990) isolated and sequenced DNA coding for FKBP from human peripheral blood T lymphocytes by using mixed 20-mer oligonucleotide probes synthesized on the basis of the sequence of bovine FKBP. They found an open reading frame encoding 108 amino acid residues, the first 40 of which were identical to those of the bovine sequence. Analysis showed no significant sequence similarity to any other known protein, including cyclophilin. Southern blot analysis of human genomic DNA digested with different restriction enzymes suggested the existence of only a few copies of the FKBP gene. This is in contrast to the results indicating as many as 20 copies of the cyclophilin gene as well as possible pseudogenes in the mammalian genome. Standaert et al. (1990) likewise isolated a cDNA for FKBP and reported the derived amino acid sequence. The human FKBP cDNA sequence showed significant similarity to an open reading frame in the genome of Neisseria meningitidis. Wang et al. (1994) reported that in a yeast genetic screen, FKBP1 interacted with various type I receptors, including the TGF-beta type I receptor (OMIM Ref. No. 190181). Deletion, point mutation, and co-immunoprecipitation studies demonstrated the specificity of this interaction, and competitive binding assays indicated that the type I receptor may be a natural ligand for FKBP1. Wang et al. (1994) concluded that FKBP1 may play a role in type I receptor-mediated signaling. Peattie et al. (1994) identified 3 distinct mRNAs for FKBP12, designated A, B, and C, that result from differential splicing or polyadenylation. All 3 encode the same protein sequence. The ryanodine receptor on the sarcoplasmic reticulum is the major source of calcium required for cardiac muscle excitation-contraction coupling. The channel is a tetramer comprised of 4 RYR2 (OMIM Ref. No. 180902) polypeptides and 4 FK506-binding proteins (OMIM Ref. No. FKBP1A). Marx et al. (2000) showed that protein kinase A (PKA; OMIM Ref. No. 176911) phosphorylation of RYR2 dissociates FKBP1A and regulates the channel open probability. Using cosedimentation and coimmunoprecipitation, the authors defined a macromolecular complex comprised of RYR2, FKBP1A, PKA, the protein phosphatases PP1 (see OMIM Ref. No. 603771) and PP2A (see OMIM Ref. No. 603113), and an anchoring protein, AKAP6 (OMIM Ref. No. 604691). In failing human hearts, Marx et al. (2000) showed that RYR2 is PKA hyperphosphorylated, resulting in defective channel function due to increased sensitivity to calcium-induced activation. To define the functions of FKBP12 in vivo, Shou et al. (1998) generated mutant mice deficient in FKBP12 using embryonic stem (ES) cell technology. FKBP12-deficient mice had normal skeletal muscle but had severe dilated cardiomyopathy and ventricular septal defects that mimicked a human congenital heart disorder, namely noncompaction of left ventricular myocardium (see OMIM Ref. No. 300183 for an X-linked form of myocardial noncompaction). About 9% of the mutants exhibited exencephaly secondary to a defect in neural tube closure. Physiologic studies demonstrated that FKBP12 is dispensable for TGF-beta-mediated signaling, but modulates the calcium release activity of both skeletal and cardiac ryanodine receptors.

Full details of the abovementioned studies are described in the following publications, the disclosure of which are hereby incorporated by reference:

Standaert, R. F.; Galat, A.; Verdine, G. L.; Schreiber, S. L.: Molecular cloning and overexpression of the human FK506-binding protein FKBP. Nature 346:671-674, 1990; and Shou, W.; Aghdasi, B.; Armstrong, D. L.; Guo, Q.; Bao, S.; Charng, M.-J.; Mathews, L. M.; Schneider, M. D.; Hamilton, S. L.; Matzuk, M. M.: Cardiac defects and altered ryanodine recepto.

Further studies establishing the function and utilities of FKBP1A are found in John Hopkins OMIM database record ID 186945, and in sited publications numbered 10032-1003 and 10271-10040 listed in the bibliography section hereinbelow, which are also hereby incorporated by reference. Guanine Nucleotide Binding Protein (G protein), Alpha Inhibiting Activity Polypeptide 1 (GNAI1, Accession NM_002069) is another VGAM57 host target gene. GNAI1 BINDING SITE is HOST TARGET binding site found in the 3' untranslated region of mRNA encoded by GNAI1, corresponding to a HOST TARGET binding site such as BINDING SITE I, BINDING SITE II or BINDING SITE III. Table 2 illustrates the complementarity of the nucleotide sequences of GNAI1 BINDING SITE, designated SEQ ID:7843, to the nucleotide sequence of VGAM57 RNA, herein designated VGAM RNA, also designated SEQ ID:2768.

Another function of VGAM57 is therefore inhibition of Guanine Nucleotide Binding Protein (G protein), Alpha Inhibiting Activity Polypeptide 1 (GNAI1, Accession NM_002069), a gene which is involved as modulators or transducers in various transmembrane signaling systems. Accordingly, utilities of VGAM57 include diagnosis, prevention and treatment of diseases and clinical conditions associated with GNAI1. The function of GNAI1 has been established by previous studies. The G proteins that mediate hormone responses can be divided into 2 broad categories according to their interaction with the bacterial toxins from Vibrio cholera and Bordetella pertussis. Those G proteins whose primary function is to stimulate adenylate kinase are substrates for ATP-ribosylation by cholera toxin, whereas those involved in hormonal inhibition of adenylate kinase and in regulation of other plasma membrane enzymes are substrates for pertussis toxin. The G protein family of signal transducers includes 5 heterotrimers, which are most clearly distinguished by their different alpha chains; they have virtually identical beta chains and similar gamma chains. The 5 heterotrimers are Gs (OMIM Ref. No. 139320) and Gi, the stimulatory and inhibitory GTP-binding regulators of adenylate cyclase; Go, a protein abundant in brain (see OMIM Ref. No. 139311); and transducin 1 (OMIM Ref. No. 139330) and transducin 2, proteins involved in phototransduction in retinal rods and cones, respectively. Sullivan et al. (1986) used a cDNA encoding bovine alpha chain of transducin 1 to isolate and sequence murine cDNAs for alpha (s) and alpha (i). Homologies and differences among the deduced amino acid sequences of the G protein and transducin alpha chains pointed to specific regions that may interact with guanine nucleotides, receptors, effector enzymes, and the G protein beta-gamma complex. Studying cDNA clones, Bray et al. (1987) concluded that there are at least 2 classes of alpha (i) mRNA, one represented by brain tissue and another represented by monocytes. Suki et al. (1987) concluded that the human genome contains at least 3 nonallelic genes for alpha-i-type subunits of G protein. Neer et al. (1987) cloned and characterized cDNA encoding the predominant alpha (i) of brain, together with a very similar cDNA that encodes another putative G protein, alpha (h). The former gene was found to be located on human chromosome 7 by Southern blot analysis of DNA from mouse-human hybrid cell lines. Bloch et al. (1988) mapped the GNAI1 gene to 7q21 by in situ hybridization. They confirmed the regional location by studying human/mouse somatic cell hybrid lines containing portions of human chromosome 7. This location is near that of cystic fibrosis (CF; 219700), a disorder that is accompanied by hyporesponsiveness to beta-adrenergic medications. Bloch et al. (1988) excluded the GNAI1 locus as a 'candidate gene' for CF by showing that the GNAI1 gene is located closer to the centromere of chromosome 7 than are 2 marker loci that flank the CF locus. The relative position of these loci was determined by Southern analysis of hybrid cells containing various portions of chromosome 7. By screening human genomic libraries with rat cDNAs for Gi-alpha as probes, Itoh et al. (1988) isolated 3 genes for the alpha subunit. The second and third are composed of 8 coding exons and 7 introns and possess completely identical exon-intron organization. Southern blot analysis indicated that a single copy of each of the 3 genes is present in the haploid human genome. Blatt et al. (1988) mapped GNAI1 to chromosome 7 by hybridization of cDNA clones with DNA from human-mouse somatic cell hybrids. By the study of restriction fragment length variation (RFLV) in an interspecific backcross between C57BL/6J and Mus spretus mice, Wilkie et al. (1992) demonstrated that the corresponding gene is located on mouse chromosome 5.

Full details of the abovementioned studies are described in the following publications, the disclosure of which are hereby incorporated by reference:

Bloch, D. B.; Bloch, K. D.; Iannuzzi, M.; Collins, F. S.; Neer, E. J.; Seidman, J. G.; Morton, C. C.: The gene for the alpha-i-1 subunit of human guanine nucleotide binding protein maps near the cystic fibrosis locus. Am. J. Hum. Genet. 42:884-888, 1988; and Wilkie, T. M.; Gilbert, D. J.; Olsen, A. S.; Chen, X.-N.; Amatruda, T. T.; Korenberg, J. R.; Trask, B. J.; de Jong, P.; Reed, R. R.; Simon, M. I.; Jenkins, N. A.; Copeland, N. G.: Evolu.

Further studies establishing the function and utilities of GNAI1 are found in John Hopkins OMIM database record ID 139310, and in sited publications numbered 4744-3603, 2187, 3604-360 and 2186 listed in the bibliography section hereinbelow, which are also hereby incorporated by reference. Golgi Complex Associated Protein 1, 60 kDa (GOCAP1, Accession NM_022735) is another VGAM57 host target gene. GOCAP1 BINDING SITE is HOST TARGET binding site found in the 3' untranslated region of mRNA encoded by GOCAP1, corresponding to a HOST TARGET binding site such as BINDING SITE I, BINDING SITE II or BINDING SITE III. Table 2 illustrates the complementarity of the nucleotide sequences of GOCAP1 BINDING SITE, designated SEQ ID:22938, to the nucleotide sequence of VGAM57 RNA, herein designated VGAM RNA, also designated SEQ ID:2768.

Another function of VGAM57 is therefore inhibition of Golgi Complex Associated Protein 1, 60 kDa (GOCAP1, Accession NM_022735). Accordingly, utilities of VGAM57 include diagnosis, prevention and treatment of diseases and clinical conditions associated with GOCAP1. Myeloid/lymphoid Or Mixed-lineage Leukemia (trithorax homolog, Drosophila); Translocated To, 2 (MLLT2, Accession NM_005935) is another VGAM57 host target gene. MLLT2 BINDING SITE is HOST TARGET binding site found in the 3' untranslated region of mRNA encoded by MLLT2, corresponding to a HOST TARGET binding site such as BINDING SITE I, BINDING SITE II or BINDING SITE III. Table 2 illustrates the complementarity of the nucleotide sequences of MLLT2 BINDING SITE, designated SEQ ID:12568, to the nucleotide sequence of VGAM57 RNA, herein designated VGAM RNA, also designated SEQ ID:2768.

Another function of VGAM57 is therefore inhibition of Myeloid/lymphoid Or Mixed-lineage Leukemia (trithorax homolog, Drosophila); Translocated To, 2 (MLLT2, Accession NM_005935), a gene which is a Putative transcription factor. Accordingly, utilities of VGAM57 include diagnosis, prevention and treatment of diseases and clinical conditions associated with MLLT2. The function of MLLT2 has been established by previous studies. Nakamura et al. (1993) found that the gene on chromosome 4q21 that is fused with the ALL1 gene in patients with acute lymphoblastic leukemia and translocation t (4;11)(q21; q23) and the gene on chromosome 9 that is fused with the ALL1 gene on chromosome 11 in patients with leukemia and the t (9;11)(p22; q23) show high sequence homology with the ENL gene on chromosome 19 which is fused to the ALL1 gene in patients with leukemia and the translocation t (11;19)(q23; p13). They found further that the protein products of the AF4, AF9 (MLLT3), and ENL (MLLT1) genes contained nuclear targeting sequences as well as serine-rich and proline-rich regions. Stretches abundant in basic amino acids were also present in the 3 proteins. These results indicated that the different proteins fused to ALL1 polypeptides in leukemia provide similar functional domains. Uckun et al. (1998) analyzed bone marrow leukemic cells of 17 infants and 127 children with newly diagnosed acute lymphatic leukemia (ALL), as well as fetal liver and bone marrow and normal infant bone marrow samples for the presence of a t (4;11) translocation, using standard cytogenetic techniques and expression of an MLL-AF4 fusion transcript by standard RT-PCR assays as well as nested RT-PCR that is 100-fold more sensitive than the standard RT-PCR. Overall, 9 of the 17 infants and 17 of 127 noninfant pediatric ALL patients were positive for expression of MLL-AF4 fusion transcripts. None of the MLL-AF4(+) cases were positive for E2A-PBX1 (147141; 176310) or BCR-ABL (151410; 189980) fusion transcript expression. Although 8 of 9 MLL-AF4(+) infants had cytogenetically detectable t (4;11) translocation, 15 of the 17 MLL-AF4(+) noninfants were t (4;11) negative. Infants with MLL-AF4(+) ALL had poor outcomes, whereas noninfant fusion-gene-positive, translocation-negative patients has favorable outcomes similar to MLL-AF4(-) patients. Notably, MLL-AF4 transcripts also were detected by nested RT-PCR in 4 of 16 fetal bone marrows, 5 of 13 fetal livers, and 1 of 6 normal infant bone marrows, but not in any of the 44 remission bone marrow specimens from pediatric ALL patients. These results represented unprecedented evidence that MLL-AF4 fusion transcripts can be present in normal hematopoietic cells, indicating that their expression is insufficient for leukemic transformation of normal lymphocyte precursors.

Full details of the abovementioned studies are described in the following publications, the disclosure of which are hereby incorporated by reference:

Nakamura, T.; Alder, H.; Gu, Y.; Prasad, R.; Canaani, O.; Kamada, N.; Gale, R. P.; Lange, B.; Crist, W. M.; Nowell, P. C.; Croce, C. M.; Canaani, E.: Genes on chromosomes 4, 9, and 19 involved in 11q23 abnormalities in acute leukemia share sequence homology and/or common motifs. Proc. Nat. Acad. Sci. 90:4631-4635, 1993; and Uckun, F. M.; Herman-Hatten, K.; Crotty, M.-L.; Sensel, M. G.; Sather, H. N.; Tuel-Ahlgren, L.; Sarquis, M. B.; Bostrom, B.; Nachman, J. B.; Steinherz, P. G.; Gaynon, P. S.; Heerema, N.

Further studies establishing the function and utilities of MLLT2 are found in John Hopkins OMIM database record ID 159557, and in sited publications numbered 3275-3276, 1843-184 and 3277 listed in the bibliography section hereinbelow, which are also hereby incorporated by reference. Nidogen (enactin) (NID, Accession NM_002508) is another VGAM57 host target gene. NID BINDING SITE is HOST TARGET binding site found in the 3' untranslated region of mRNA encoded by NID, corresponding to a HOST TARGET binding site such as BINDING SITE I, BINDING SITE II or BINDING SITE III. Table 2 illustrates the complementarity of the nucleotide sequences of NID BINDING SITE, designated SEQ ID:8340, to the nucleotide sequence of VGAM57 RNA, herein designated VGAM RNA, also designated SEQ ID:2768.

Another function of VGAM57 is therefore inhibition of Nidogen (enactin) (NID, Accession NM_002508). Accordingly, utilities of VGAM57 include diagnosis, prevention and treatment of diseases and clinical conditions associated with NID. 5'-nucleotidase, Ecto (CD73) (NT5E, Accession NM_002526) is another VGAM57 host target gene. NT5E BINDING SITE is HOST TARGET binding site found in the 3' untranslated region of mRNA encoded by NT5E, corresponding to a HOST TARGET binding site such as BINDING SITE I, BINDING SITE II or BINDING SITE III. Table 2 illustrates the complementarity of the nucleotide sequences of NT5E BINDING SITE, designated SEQ ID:8364, to the nucleotide sequence of VGAM57 RNA, herein designated VGAM RNA, also designated SEQ ID:2768.

Another function of VGAM57 is therefore inhibition of 5'-nucleotidase, Ecto (CD73) (NT5E, Accession NM_002526). Accordingly, utilities of VGAM57 include diagnosis, prevention and treatment of diseases and clinical conditions associated with NT5E. SWI/SNF Related, Matrix Associated, Actin Dependent Regulator of Chromatin, Subfamily C, Member 1 (SMARCC1, Accession NM_003074) is another VGAM57 host target gene. SMARCC1 BINDING SITE is HOST TARGET binding site found in the 3' untranslated region of mRNA encoded by SMARCC1, corresponding to a HOST TARGET binding site such as BINDING SITE I, BINDING SITE II or BINDING SITE III. Table 2 illustrates the complementarity of the nucleotide sequences of SMARCC1 BINDING SITE, designated SEQ ID:9041, to the nucleotide sequence of VGAM57 RNA, herein designated VGAM RNA, also designated SEQ ID:2768.

Another function of VGAM57 is therefore inhibition of SWI/SNF Related, Matrix Associated, Actin Dependent Regulator of Chromatin, Subfamily C, Member 1 (SMARCC1, Accession NM_003074), a gene which is involved in chromatin remodeling. Accordingly, utilities of VGAM57 include diagnosis, prevention and treatment of diseases and clinical conditions associated with SMARCC1. The function of SMARCC1 has been established by previous studies. Chromatin is actively remodeled during development. Chromatin remodeling of certain genes appears to precede their transcriptional activation. In yeast, the multisubunit SWI/SNF complex is thought to be responsible for chromatin remodeling. Wang et al. (1996) isolated an analogous SWI/SNF complex from human YT cells. They found that the resultant complexes are composed of 9 to 12 polypeptides, which they termed BAFs (for BRG1-associated factors). Wang et al. (1996) isolated BAF155 from a human Jurkat T-cell cDNA library. This gene encodes a polypeptide of 1,104 amino acids, and is homologous both to the yeast SWI3 gene and to BAF170, another of the proteins in this chromatin remodeling complex (OMIM Ref. No. 601734). SWI3, BAF155, and BAF170 all contain a predicted leucine zipper region (a dimerization motif for a variety of transcription factors) and a myb-like tryptophan-repeat domain. Western blot analysis and EST database analysis revealed that BAF155 is expressed in many tissues Full details of the abovementioned studies are described in the following publications, the disclosure of which are hereby incorporated by reference:

Ring, H. Z.; Vameghi-Meyers, V.; Wang, W.; Crabtree, G. R.; Francke, U.: Five SWI/SNF-related, matrix-associated, actin-dependent regulator of chromatin (SMARC) genes are dispersed in the human genome. Genomics 51:140-143, 1998; and Wang, W.; Xue, Y.; Zhou, S.; Kuo, A.; Cairns, B. R.; Crabtree, G. R.: Diversity and specialization of mammalian SWI/SNF complexes. Genes Dev. 10:2117-2130, 1996.

Further studies establishing the function and utilities of SMARCC1 are found in John Hopkins OMIM database record ID 601732, and in sited publications numbered 9322-9323 listed in the bibliography section hereinbelow, which are also hereby incorporated by reference. Suppressor of Fused Homolog (Drosophila) (SUFU, Accession NM_016169) is another VGAM57 host target gene. SUFU BINDING SITE is HOST TARGET binding site found in the 3' untranslated region of mRNA encoded by SUFU, corresponding to a HOST TARGET binding site such as BINDING SITE I, BINDING SITE II or BINDING SITE III. Table 2 illustrates the complementarity of the nucleotide sequences of SUFU BINDING SITE, designated SEQ ID:18256, to the nucleotide sequence of VGAM57 RNA, herein designated VGAM RNA, also designated SEQ ID:2768.

Another function of VGAM57 is therefore inhibition of Suppressor of Fused Homolog (Drosophila) (SUFU, Accession NM_016169). Accordingly, utilities of VGAM57 include diagnosis, prevention and treatment of diseases and clinical conditions associated with SUFU. ATPase, (Na+)/K+ Transporting, Beta 4 Polypeptide (ATP1B4, Accession NM_012069) is another VGAM57 host target gene. ATP1B4 BINDING SITE is HOST TARGET binding site found in the 3' untranslated region of mRNA encoded by ATP1B4, corresponding to a HOST TARGET binding site such as BINDING SITE I, BINDING SITE II or BINDING SITE III. Table 2 illustrates the complementarity of the nucleotide sequences of ATP1B4 BINDING SITE, designated SEQ ID:14325, to the nucleotide sequence of VGAM57 RNA, herein designated VGAM RNA, also designated SEQ ID:2768.

Another function of VGAM57 is therefore inhibition of ATPase, (Na+)/K+ Transporting, Beta 4 Polypeptide (ATP1B4, Accession NM_012069). Accordingly, utilities of VGAM57 include diagnosis, prevention and treatment of diseases and clinical conditions associated with ATP1B4. COE2 (Accession XM_034639) is another VGAM57 host target gene. COE2 BINDING SITE is HOST TARGET binding site found in the 3' untranslated region of mRNA encoded by COE2, corresponding to a HOST TARGET binding site such as BINDING SITE I, BINDING SITE II or BINDING SITE III. Table 2 illustrates the complementarity of the nucleotide sequences of COE2 BINDING SITE, designated SEQ ID:32128, to the nucleotide sequence of VGAM57 RNA, herein designated VGAM RNA, also designated SEQ ID:2768.

Another function of VGAM57 is therefore inhibition of COE2 (Accession XM_034639). Accordingly, utilities of VGAM57 include diagnosis, prevention and treatment of diseases and clinical conditions associated with COE2. DKFZP564O0423 (Accession XM_166254) is another VGAM57 host target gene. DKFZP564O0423 BINDING SITE is HOST TARGET binding site found in the 3' untranslated region of mRNA encoded by DKFZP564O0423, corresponding to a HOST TARGET binding site such as BINDING SITE I, BINDING SITE II or BINDING SITE III. Table 2 illustrates the complementarity of the nucleotide sequences of DKFZP564O0423 BINDING SITE, designated SEQ ID:44066, to the nucleotide sequence of VGAM57 RNA, herein designated VGAM RNA, also designated SEQ ID:2768.

Another function of VGAM57 is therefore inhibition of DKFZP564O0423 (Accession XM_166254). Accordingly, utilities of VGAM57 include diagnosis, prevention and treatment of diseases and clinical conditions associated with DKFZP564O0423. FLJ10420 (Accession NM_018090) is another VGAM57 host target gene. FLJ10420 BINDING SITE is HOST TARGET binding site found in the 3' untranslated region of mRNA encoded by FLJ10420, corresponding to a HOST TARGET binding site such as BINDING SITE I, BINDING SITE II or BINDING SITE III. Table 2 illustrates the complementarity of the nucleotide sequences of FLJ10420 BINDING SITE, designated SEQ ID:19856, to the nucleotide sequence of VGAM57 RNA, herein designated VGAM RNA, also designated SEQ ID:2768.

Another function of VGAM57 is therefore inhibition of FLJ10420 (Accession NM_018090). Accordingly, utilities of VGAM57 include diagnosis, prevention and treatment of diseases and clinical conditions associated with FLJ10420. FLJ11117 (Accession NM_018329) is another VGAM57 host target gene. FLJ11117 BINDING SITE is HOST TARGET binding site found in the 3' untranslated region of mRNA encoded by FLJ11117, corresponding to a HOST TARGET binding site such as BINDING SITE I, BINDING SITE II or BINDING SITE III. Table 2 illustrates the complementarity of the nucleotide sequences of FLJ11117 BINDING SITE, designated SEQ ID:20327, to the nucleotide sequence of VGAM57 RNA, herein designated VGAM RNA, also designated SEQ ID:2768.

Another function of VGAM57 is therefore inhibition of FLJ11117 (Accession NM_018329). Accordingly, utilities of VGAM57 include diagnosis, prevention and treatment of diseases and clinical conditions associated with FLJ11117. FLJ14457 (Accession NM_032788) is another VGAM57 host target gene. FLJ14457 BINDING SITE is HOST TARGET binding site found in the 3' untranslated region of mRNA encoded by FLJ14457, corresponding to a HOST TARGET binding site such as BINDING SITE I, BINDING SITE II or BINDING SITE III. Table 2 illustrates the complementarity of the nucleotide sequences of FLJ14457 BINDING SITE, designated SEQ ID:26542, to the nucleotide sequence of VGAM57 RNA, herein designated VGAM RNA, also designated SEQ ID:2768.

Another function of VGAM57 is therefore inhibition of FLJ14457 (Accession NM_032788). Accordingly, utilities of VGAM57 include diagnosis, prevention and treatment of diseases and clinical conditions associated with FLJ14457. FLJ23231 (Accession NM_025079) is another VGAM57 host target gene. FLJ23231 BINDING SITE is HOST TARGET binding site found in the 3' untranslated region of mRNA encoded by FLJ23231, corresponding to a HOST TARGET binding site such as BINDING SITE I, BINDING SITE II or BINDING SITE III. Table 2 illustrates the complementarity of the nucleotide sequences of FLJ23231 BINDING SITE, designated SEQ ID:24679, to the nucleotide sequence of VGAM57 RNA, herein designated VGAM RNA, also designated SEQ ID:2768.

Another function of VGAM57 is therefore inhibition of FLJ23231 (Accession NM_025079). Accordingly, utilities of VGAM57 include diagnosis, prevention and treatment of diseases and clinical conditions associated with FLJ23231. FLJ31978 (Accession NM_144669) is another VGAM57 host target gene. FLJ31978 BINDING SITE is HOST TARGET binding site found in the 3' untranslated region of mRNA encoded by FLJ31978, corresponding to a HOST TARGET binding site such as BINDING SITE I, BINDING SITE II or BINDING SITE III. Table 2 illustrates the complementarity of the nucleotide sequences of FLJ31978 BINDING SITE, designated SEQ ID:29490, to the nucleotide sequence of VGAM57 RNA, herein designated VGAM RNA, also designated SEQ ID:2768.

Another function of VGAM57 is therefore inhibition of FLJ31978 (Accession NM_144669). Accordingly, utilities of VGAM57 include diagnosis, prevention and treatment of diseases and clinical conditions associated with FLJ31978. FLJ32334 (Accession NM_144565) is another VGAM57 host target gene. FLJ32334 BINDING SITE is HOST TARGET binding site found in the 3' untranslated region of mRNA encoded by FLJ32334, corresponding to a HOST TARGET binding site such as BINDING SITE I, BINDING SITE II or BINDING SITE III. Table 2 illustrates the complementarity of the nucleotide sequences of FLJ32334 BINDING SITE, designated SEQ ID:29367, to the nucleotide sequence of VGAM57 RNA, herein designated VGAM RNA, also designated SEQ ID:2768.

Another function of VGAM57 is therefore inhibition of FLJ32334 (Accession NM_144565). Accordingly, utilities of VGAM57 include diagnosis, prevention and treatment of diseases and clinical conditions associated with FLJ32334. GBTS1 (Accession NM_145173) is another VGAM57 host target gene. GBTS1 BINDING SITE is HOST TARGET binding site found in the 3' untranslated region of mRNA encoded by GBTS1, corresponding to a HOST TARGET binding site such as BINDING SITE I, BINDING SITE II or BINDING SITE III. Table 2 illustrates the complementarity of the nucleotide sequences of GBTS1 BINDING SITE, designated SEQ ID:29729, to the nucleotide sequence of VGAM57 RNA, herein designated VGAM RNA, also designated SEQ ID:2768.

Another function of VGAM57 is therefore inhibition of GBTS1 (Accession NM_145173). Accordingly, utilities of VGAM57 include diagnosis, prevention and treatment of diseases and clinical conditions associated with GBTS1. ITM3 (Accession NM_030926) is another VGAM57 host target gene. ITM3 BINDING SITE is HOST TARGET binding site found in the 3' untranslated region of mRNA encoded by ITM3, corresponding to a HOST TARGET binding site such as BINDING SITE I, BINDING SITE II or BINDING SITE III. Table 2 illustrates the complementarity of the nucleotide sequences of ITM3 BINDING SITE, designated SEQ ID:25195, to the nucleotide sequence of VGAM57 RNA, herein designated VGAM RNA, also designated SEQ ID:2768.

Another function of VGAM57 is therefore inhibition of ITM3 (Accession NM_030926). Accordingly, utilities of VGAM57 include diagnosis, prevention and treatment of diseases and clinical conditions associated with ITM3. KIAA0350 (Accession XM_028332) is another VGAM57 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30671, to the nucleotide sequence of VGAM57 RNA, herein designated VGAM RNA, also designated SEQ ID:2768.

Another function of VGAM57 is therefore inhibition of KIAA0350 (Accession XM_028332). Accordingly, utilities of VGAM57 include diagnosis, prevention and treatment of diseases and clinical conditions associated with KIAA0350. KIAA0663 (Accession NM_014827) is another VGAM57 host target gene. KIAA0663 BINDING SITE is HOST TARGET binding site found in the 3' untranslated region of mRNA encoded by KIAA0663, corresponding to a HOST TARGET binding site such as BINDING SITE I, BINDING SITE II or BINDING SITE III. Table 2 illustrates the complementarity of the nucleotide sequences of KIAA0663 BINDING SITE, designated SEQ ID:16811, to the nucleotide sequence of VGAM57 RNA, herein designated VGAM RNA, also designated SEQ ID:2768.

Another function of VGAM57 is therefore inhibition of KIAA0663 (Accession NM_014827). Accordingly, utilities of VGAM57 include diagnosis, prevention and treatment of diseases and clinical conditions associated with KIAA0663. KIAA0795 (Accession NM_025010) is another VGAM57 host target gene. KIAA0795 BINDING SITE is HOST TARGET binding site found in the 3' untranslated region of mRNA encoded by KIAA0795, corresponding to a HOST TARGET binding site such as BINDING SITE I, BINDING SITE II or BINDING SITE III. Table 2 illustrates the complementarity of the nucleotide sequences of KIAA0795 BINDING SITE, designated SEQ ID:24585, to the nucleotide sequence of VGAM57 RNA, herein designated VGAM RNA, also designated SEQ ID:2768.

Another function of VGAM57 is therefore inhibition of KIAA0795 (Accession NM_025010). Accordingly, utilities of VGAM57 include diagnosis, prevention and treatment of diseases and clinical conditions associated with KIAA0795. KIAA1010 (Accession XM_050742) is another VGAM57 host target gene. KIAA1010 BINDING SITE is HOST TARGET binding site found in the 3' untranslated region of mRNA encoded by KIAA1010, corresponding to a HOST TARGET binding site such as BINDING SITE I, BINDING SITE II or BINDING SITE III. Table 2 illustrates the complementarity of the nucleotide sequences of KIAA1010 BINDING SITE, designated SEQ ID:35668, to the nucleotide sequence of VGAM57 RNA, herein designated VGAM RNA, also designated SEQ ID:2768.

Another function of VGAM57 is therefore inhibition of KIAA1010 (Accession XM_050742). Accordingly, utilities of VGAM57 include diagnosis, prevention and treatment of diseases and clinical conditions associated with KIAA1010. KIAA1210 (Accession XM_172801) is another VGAM57 host target gene. KIAA1210 BINDING SITE1 and KIAA1210 BINDING SITE2 are HOST TARGET binding sites found in untranslated regions of mRNA encoded by KIAA1210, corresponding to HOST TARGET binding sites such as BINDING SITE I, BINDING SITE II or BINDING SITE III. Table 2 illustrates the complementarity of the nucleotide sequences of KIAA1210 BINDING SITE1 and KIAA1210 BINDING SITE2, designated SEQ ID:46085 and SEQ ID:46086 respectively, to the nucleotide sequence of VGAM57 RNA, herein designated VGAM RNA, also designated SEQ ID:2768.

Another function of VGAM57 is therefore inhibition of KIAA1210 (Accession XM_172801). Accordingly, utilities of VGAM57 include diagnosis, prevention and treatment of diseases and clinical conditions associated with KIAA1210. KIAA1775 (Accession NM_033100) is another VGAM57 host target gene. KIAA1775 BINDING SITE is HOST TARGET binding site found in the 3' untranslated region of mRNA encoded by KIAA1775, corresponding to a HOST TARGET binding site such as BINDING SITE I, BINDING SITE II or BINDING SITE III. Table 2 illustrates the complementarity of the nucleotide sequences of KIAA1775 BINDING SITE, designated SEQ ID:26941, to the nucleotide sequence of VGAM57 RNA, herein designated VGAM RNA, also designated SEQ ID:2768.

Another function of VGAM57 is therefore inhibition of KIAA1775 (Accession NM_033100). Accordingly, utilities of VGAM57 include diagnosis, prevention and treatment of diseases and clinical conditions associated with KIAA1775. KIAA1829 (Accession XM_030378) is another VGAM57 host target gene. KIAA1829 BINDING SITE is HOST TAR- GET binding site found in the 3' untranslated region of mRNA encoded by KIAA1829, corresponding to a HOST TARGET binding site such as BINDING SITE I, BINDING SITE II or BINDING SITE III. Table 2 illustrates the complementarity of the nucleotide sequences of KIAA1829 BINDING SITE, designated SEQ ID:31029, to the nucleotide sequence of VGAM57 RNA, herein designated VGAM RNA, also designated SEQ ID:2768.

Another function of VGAM57 is therefore inhibition of KIAA1829 (Accession XM_030378). Accordingly, utilities of VGAM57 include diagnosis, prevention and treatment of diseases and clinical conditions associated with KIAA1829. Protocadherin 10 (PCDH10, Accession NM_032961) is another VGAM57 host target gene. PCDH10 BINDING SITE is HOST TARGET binding site found in the 3' untranslated region of mRNA encoded by PCDH10, corresponding to a HOST TARGET binding site such as BINDING SITE I, BINDING SITE II or BINDING SITE III. Table 2 illustrates the complementarity of the nucleotide sequences of PCDH10 BINDING SITE, designated SEQ ID:26769, to the nucleotide sequence of VGAM57 RNA, herein designated VGAM RNA, also designated SEQ ID:2768.

Another function of VGAM57 is therefore inhibition of Protocadherin 10 (PCDH10, Accession NM_032961). Accordingly, utilities of VGAM57 include diagnosis, prevention and treatment of diseases and clinical conditions associated with PCDH10. TRIP-Br2 (Accession NM_014755) is another VGAM57 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16491, to the nucleotide sequence of VGAM57 RNA, herein designated VGAM RNA, also designated SEQ ID:2768.

Another function of VGAM57 is therefore inhibition of TRIP-Br2 (Accession NM_014755). Accordingly, utilities of VGAM57 include diagnosis, prevention and treatment of diseases and clinical conditions associated with TRIP-Br2. LOC115073 (Accession XM_055193) is another VGAM57 host target gene. LOC115073 BINDING SITE is HOST TARGET binding site found in the 3' untranslated region of mRNA encoded by LOC115073, corresponding to a HOST TARGET binding site such as BINDING SITE I, BINDING SITE II or BINDING SITE III. Table 2 illustrates the complementarity of the nucleotide sequences of LOC115073 BINDING SITE, designated SEQ ID:36236, to the nucleotide sequence of VGAM57 RNA, herein designated VGAM RNA, also designated SEQ ID:2768.

Another function of VGAM57 is therefore inhibition of LOC115073 (Accession XM_055193). Accordingly, utilities of VGAM57 include diagnosis, prevention and treatment of diseases and clinical conditions associated with LOC115073. LOC128344 (Accession XM_059234) is another VGAM57 host target gene. LOC128344 BINDING SITE is HOST TARGET binding site found in the 3' untranslated region of mRNA encoded by LOC128344, corresponding to a HOST TARGET binding site such as BINDING SITE I, BINDING SITE II or BINDING SITE III. Table 2 illustrates the complementarity of the nucleotide sequences of LOC128344 BINDING SITE, designated SEQ ID:36922, to the nucleotide sequence of VGAM57 RNA, herein designated VGAM RNA, also designated SEQ ID:2768.

Another function of VGAM57 is therefore inhibition of LOC128344 (Accession XM_059234). Accordingly, utilities of VGAM57 include diagnosis, prevention and treatment of diseases and clinical conditions associated with LOC128344. LOC143452 (Accession XM_084522) is another VGAM57 host target gene. LOC143452 BINDING SITE is HOST TARGET binding site found in the 5' untranslated region of mRNA encoded by LOC143452, corresponding to a HOST TARGET binding site such as BINDING SITE I, BINDING SITE II or BINDING SITE III. Table 2 illustrates the complementarity of the nucleotide sequences of LOC143452 BINDING SITE, designated SEQ ID:37622, to the nucleotide sequence of VGAM57 RNA, herein designated VGAM RNA, also designated SEQ ID:2768.

Another function of VGAM57 is therefore inhibition of LOC143452 (Accession XM_084522). Accordingly, utilities of VGAM57 include diagnosis, prevention and treatment of diseases and clinical conditions associated with LOC143452. LOC144308 (Accession XM_096575) is another VGAM57 host target gene. LOC144308 BINDING SITE is HOST TARGET binding site found in the 3' untranslated region of mRNA encoded by LOC144308, corresponding to a HOST TARGET binding site such as BINDING SITE I, BINDING SITE II or BINDING SITE III. Table 2 illustrates the complementarity of the nucleotide sequences of LOC144308 BINDING SITE, designated SEQ ID:40407, to the nucleotide sequence of VGAM57 RNA, herein designated VGAM RNA, also designated SEQ ID:2768.

Another function of VGAM57 is therefore inhibition of LOC144308 (Accession XM_096575). Accordingly, utilities of VGAM57 include diagnosis, prevention and treatment of diseases and clinical conditions associated with LOC144308. LOC152573 (Accession XM_087488) is another VGAM57 host target gene. LOC152573 BINDING SITE is HOST TARGET binding site found in the 3' untranslated region of mRNA encoded by LOC152573, corresponding to a HOST TARGET binding site such as BINDING SITE I, BINDING SITE II or BINDING SITE III. Table 2 illustrates the complementarity of the nucleotide sequences of LOC152573 BINDING SITE, designated SEQ ID:39288, to the nucleotide sequence of VGAM57 RNA, herein designated VGAM RNA, also designated SEQ ID:2768.

Another function of VGAM57 is therefore inhibition of LOC152573 (Accession XM_087488). Accordingly, utilities of VGAM57 include diagnosis, prevention and treatment of diseases and clinical conditions associated with LOC152573. LOC201194 (Accession XM_117061) is another VGAM57 host target gene. LOC201194 BINDING SITE is HOST TARGET binding site found in the 3' untranslated region of mRNA encoded by LOC201194, corresponding to a HOST TARGET binding site such as BINDING SITE I, BINDING SITE II or BINDING SITE III. Table 2 illustrates the complementarity of the nucleotide sequences of LOC201194 BINDING SITE, designated SEQ ID:43217, to the nucleotide sequence of VGAM57 RNA, herein designated VGAM RNA, also designated SEQ ID:2768.

Another function of VGAM57 is therefore inhibition of LOC201194 (Accession XM_117061). Accordingly, utilities of VGAM57 include diagnosis, prevention and treatment of diseases and clinical conditions associated with LOC201194. LOC219899 (Accession XM_166173) is another VGAM57 host target gene. LOC219899 BINDING SITE is HOST TARGET binding site found in the 3' untranslated region of mRNA encoded by LOC219899, corresponding to a HOST TARGET binding site such as BINDING SITE I, BINDING SITE II or BINDING SITE III. Table 2 illustrates the complementarity of the nucleotide sequences of LOC219899 BINDING SITE, designated SEQ ID:43993, to the nucleotide sequence of VGAM57 RNA, herein designated VGAM RNA, also designated SEQ ID:2768.

Another function of VGAM57 is therefore inhibition of LOC219899 (Accession XM_166173). Accordingly, utilities of VGAM57 include diagnosis, prevention and treatment of diseases and clinical conditions associated with LOC219899. LOC253019 (Accession XM_170907) is another VGAM57 host target gene. LOC253019 BINDING SITE is HOST TARGET binding site found in the 3' untranslated region of mRNA encoded by LOC253019, corresponding to a HOST TARGET binding site such as BINDING SITE I, BINDING SITE II or BINDING SITE III. Table 2 illustrates the complementarity of the nucleotide sequences of LOC253019 BINDING SITE, designated SEQ ID:45666, to the nucleotide sequence of VGAM57 RNA, herein designated VGAM RNA, also designated SEQ ID:2768.

Another function of VGAM57 is therefore inhibition of LOC253019 (Accession XM_170907). Accordingly, utilities of VGAM57 include diagnosis, prevention and treatment of diseases and clinical conditions associated with LOC253019. LOC253975 (Accession XM_171130) is another VGAM57 host target gene. LOC253975 BINDING SITE is HOST TARGET binding site found in the 3' untranslated region of mRNA encoded by LOC253975, corresponding to a HOST TARGET binding site such as BINDING SITE I, BINDING SITE II or BINDING SITE III. Table 2 illustrates the complementarity of the nucleotide sequences of LOC253975 BINDING SITE, designated SEQ ID:45933, to the nucleotide sequence of VGAM57 RNA, herein designated VGAM RNA, also designated SEQ ID:2768.

Another function of VGAM57 is therefore inhibition of LOC253975 (Accession XM_171130). Accordingly, utilities of VGAM57 include diagnosis, prevention and treatment of diseases and clinical conditions associated with LOC253975. LOC257486 (Accession XM_045029) is another VGAM57 host target gene. LOC257486 BINDING SITE1 and LOC257486 BINDING SITE2 are HOST TARGET binding sites found in untranslated regions of mRNA encoded by LOC257486, corresponding to HOST TARGET binding sites such as BINDING SITE I, BINDING SITE II or BINDING SITE III. Table 2 illustrates the complementarity of the nucleotide sequences of LOC257486 BINDING SITE1 and LOC257486 BINDING SITE2, designated SEQ ID:34323 and SEQ ID:34324 respectively, to the nucleotide sequence of VGAM57 RNA, herein designated VGAM RNA, also designated SEQ ID:2768.

Another function of VGAM57 is therefore inhibition of LOC257486 (Accession XM_045029). Accordingly, utilities of VGAM57 include diagnosis, prevention and treatment of diseases and clinical conditions associated with LOC257486. LOC90170 (Accession XM_029589) is another VGAM57 host target gene. LOC90170 BINDING SITE is HOST TARGET binding site found in the 5' untranslated region of mRNA encoded by LOC90170, corresponding to a HOST TARGET binding site such as BINDING SITE I, BINDING SITE II or BINDING SITE III. Table 2 illustrates the complementarity of the nucleotide sequences of LOC90170 BINDING SITE, designated SEQ ID:30909, to the nucleotide sequence of VGAM57 RNA, herein designated VGAM RNA, also designated SEQ ID:2768.

Another function of VGAM57 is therefore inhibition of LOC90170 (Accession XM_029589). Accordingly, utilities of VGAM57 include diagnosis, prevention and treatment of diseases and clinical conditions associated with LOC90170. LOC91208 (Accession XM_036935) is another VGAM57 host target gene. LOC91208 BINDING SITE is HOST TARGET binding site found in the 5' untranslated region of mRNA encoded by LOC91208, corresponding to a HOST TARGET binding site such as BINDING SITE I, BINDING SITE II or BINDING SITE III. Table 2 illustrates the complementarity of the nucleotide sequences of LOC91208 BINDING SITE, designated SEQ ID:32521, to the nucleotide sequence of VGAM57 RNA, herein designated VGAM RNA, also designated SEQ ID:2768.

Another function of VGAM57 is therefore inhibition of LOC91208 (Accession XM_036935). Accordingly, utilities of VGAM57 include diagnosis, prevention and treatment of diseases and clinical conditions associated with LOC91208.

FIG. 1 further provides a conceptual description of a novel bioinformatically detected viral gene of the present invention, referred to here as Viral Genomic Address Messenger 58 (VGAM58) viral gene, which modulates expression of respective host target genes thereof, the function and utility of which host target genes is known in the art.

VGAM58 is a novel bioinformatically detected regulatory, non protein coding, viral micro RNA (miRNA) gene. The method by which VGAM58 was detected is described hereinabove with reference to FIGS. 1-8.

VGAM58 gene, herein designated VGAM GENE, is a viral gene contained in the genome of Invertebrate Iridescent Virus 6. VGAM58 host target gene, herein designated VGAM HOST TARGET GENE, is a human gene contained in the human genome.

VGAM58 gene encodes a VGAM58 precursor RNA, herein designated VGAM PRECURSOR RNA. Similar to other miRNA genes, and unlike most ordinary genes, VGAM58 precursor RNA does not encode a protein. A nucleotide sequence identical or highly similar to the nucleotide sequence of VGAM58 precursor RNA is designated SEQ ID:44, and is provided hereinbelow with reference to the sequence listing part. Nucleotide sequence SEQ ID:44 is located at position 76117 relative to the genome of Invertebrate Iridescent Virus 6.

VGAM58 precursor RNA folds onto itself, forming VGAM58 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM58 folded precursor RNA into VGAM58 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM58 RNA is designated SEQ ID:2769, and is provided hereinbelow with reference to the sequence listing part.

VGAM58 host target gene, herein designated VGAM HOST TARGET GENE, encodes a corresponding messenger RNA, VGAM58 host target RNA, herein designated VGAM HOST TARGET RNA. VGAM58 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM58 RNA, herein designated VGAM RNA, binds complementarily to one or more host target binding sites located in untranslated regions of VGAM58 host target RNA, herein designated VGAM HOST TARGET RNA. This complementary binding is due to the fact that the nucleotide sequence of VGAM58 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM58 RNA, herein designated VGAM RNA, may have a different number of host target binding sites in untranslated regions of a VGAM58 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM58 RNA, herein designated VGAM RNA, to host target binding sites on VGAM58 host target RNA, herein designated VGAM HOST TARGET RNA, such as BINDING SITE I, BINDING SITE II and BINDING SITE III, inhibits translation of VGAM58 host target RNA into VGAM58 host target protein, herein designated VGAM HOST TARGET PROTEIN. VGAM host target protein is therefore outlined by a broken line.

It is appreciated that VGAM58 host target gene, herein designated VGAM HOST TARGET GENE, in fact represents a plurality of VGAM58 host target genes. The mRNA of each one of this plurality of VGAM58 host target genes comprises one or more host target binding sites, each having a nucleotide sequence which is at least partly complementary to VGAM58 RNA, herein designated VGAM RNA, and which when bound by VGAM58 RNA causes inhibition of translation of respective one or more VGAM58 host target proteins.

It is further appreciated by one skilled in the art that the mode of translational inhibition illustrated by FIG. 1 with specific reference to translational inhibition exerted by VGAM58 gene, herein designated VGAM GENE, on one or more VGAM58 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM58 is inhibition of expression of host target genes, as part of a novel viral mechanism of attacking a host. Accordingly, utilities of VGAM58 include diagnosis, prevention and treatment of viral infection by Invertebrate Iridescent Virus 6. Specific functions, and accordingly utilities, of VGAM58 correlate with, and may be deduced from, the identity of the host target genes which VGAM58 binds and inhibits, and the function of these host target genes, as elaborated hereinbelow.

Nucleotide sequences of the VGAM58 precursor RNA, herein designated VGAM PRECURSOR RNA, and of the 'diced' VGAM58 RNA, herein designated VGAM RNA, and a schematic representation of the secondary folding of VGAM58 folded precursor RNA, herein designated VGAM FOLDED PRECURSOR RNA, of VGAM58 are further described hereinbelow with reference to Table 1.

Nucleotide sequences of host target binding sites, such as BINDING SITE-I, BINDING SITE-II and BINDING SITE-III of FIG. 1, found on VGAM58 host target RNA, and schematic representation of the complementarity of each of these host target binding sites to VGAM58 RNA, herein designated VGAM RNA, are described hereinbelow with reference to Table 2.

As mentioned hereinabove with reference to FIG. 1, a function of VGAM58 gene, herein designated VGAM is inhibition of expression of VGAM58 target genes. It is appreciated that specific functions, and accordingly utilities, of VGAM58 correlate with, and may be deduced from, the identity of the target genes which VGAM58 binds and inhibits, and the function of these target genes, as elaborated hereinbelow.

ETR101 (Accession XM_051364) is a VGAM58 host target gene. ETR101 BINDING SITE is HOST TARGET binding site found in the 3' untranslated region of mRNA encoded by ETR101, corresponding to a HOST TARGET binding site such as BINDING SITE I, BINDING SITE II or BINDING SITE III. Table 2 illustrates the complementarity of the nucleotide sequences of ETR101 BINDING SITE, designated SEQ ID:35829, to the nucleotide sequence of VGAM58 RNA, herein designated VGAM RNA, also designated SEQ ID:2769.

A function of VGAM58 is therefore inhibition of ETR101 (Accession XM_051364). Accordingly, utilities of VGAM58 include diagnosis, prevention and treatment of diseases and clinical conditions associated with ETR101. FIG. 1 further provides a conceptual description of a novel bioinformatically detected viral gene of the present invention, referred to here as Viral Genomic Address Messenger 59 (VGAM59) viral gene, which modulates expression of respective host target genes thereof, the function and utility of which host target genes is known in the art.

VGAM59 is a novel bioinformatically detected regulatory, non protein coding, viral micro RNA (miRNA) gene. The method by which VGAM59 was detected is described hereinabove with reference to FIGS. 1-8.

VGAM59 gene, herein designated VGAM GENE, is a viral gene contained in the genome of Invertebrate Iridescent Virus 6. VGAM59 host target gene, herein designated VGAM HOST TARGET GENE, is a human gene contained in the human genome.

VGAM59 gene encodes a VGAM59 precursor RNA, herein designated VGAM PRECURSOR RNA. Similar to other miRNA genes, and unlike most ordinary genes, VGAM59 precursor RNA does not encode a protein. A nucleotide sequence identical or highly similar to the nucleotide sequence of VGAM59 precursor RNA is designated SEQ ID:45, and is provided hereinbelow with reference to the sequence listing part. Nucleotide sequence SEQ ID:45 is located at position 64386 relative to the genome of Invertebrate Iridescent Virus 6.

VGAM59 precursor RNA folds onto itself, forming VGAM59 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM59 folded precursor RNA into VGAM59 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM59 RNA is designated SEQ ID:2770, and is provided hereinbelow with reference to the sequence listing part.

VGAM59 host target gene, herein designated VGAM HOST TARGET GENE, encodes a corresponding messenger RNA, VGAM59 host target RNA, herein designated VGAM HOST TARGET RNA. VGAM59 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM59 RNA, herein designated VGAM RNA, binds complementarily to one or more host target binding sites located in untranslated regions of VGAM59 host target RNA, herein designated VGAM HOST TARGET RNA. This complementary binding is due to the fact that the nucleotide sequence of VGAM59 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM59 RNA, herein designated VGAM RNA, may have a different number of host target binding sites in untranslated regions of a VGAM59 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM59 RNA, herein designated VGAM RNA, to host target binding sites on VGAM59 host target RNA, herein designated VGAM HOST TARGET RNA, such as BINDING SITE I, BINDING SITE II and BINDING SITE III, inhibits translation of VGAM59 host target RNA into VGAM59 host target protein, herein designated VGAM HOST TARGET PROTEIN. VGAM host target protein is therefore outlined by a broken line.

It is appreciated that VGAM59 host target gene, herein designated VGAM HOST TARGET GENE, in fact represents a plurality of VGAM59 host target genes. The mRNA of each one of this plurality of VGAM59 host target genes comprises one or more host target binding sites, each having a nucleotide sequence which is at least partly complementary to VGAM59 RNA, herein designated VGAM RNA, and which when bound by VGAM59 RNA causes inhibition of translation of respective one or more VGAM59 host target proteins.

It is further appreciated by one skilled in the art that the mode of translational inhibition illustrated by FIG. 1 with specific reference to translational inhibition exerted by VGAM59 gene, herein designated VGAM GENE, on one or more VGAM59 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM59 is inhibition of expression of host target genes, as part of a novel viral mechanism of attacking a host. Accordingly, utilities of VGAM59 include diagnosis, prevention and treatment of viral infection by Invertebrate Iridescent Virus 6. Specific functions, and accordingly utilities, of VGAM59 correlate with, and may be deduced from, the identity of the host target genes which VGAM59 binds and inhibits, and the function of these host target genes, as elaborated hereinbelow.

Nucleotide sequences of the VGAM59 precursor RNA, herein designated VGAM PRECURSOR RNA, and of the 'diced' VGAM59 RNA, herein designated VGAM RNA, and a schematic representation of the secondary folding of VGAM59 folded precursor RNA, herein designated VGAM FOLDED PRECURSOR RNA, of VGAM59 are further described hereinbelow with reference to Table 1.

Nucleotide sequences of host target binding sites, such as BINDING SITE-I, BINDING SITE-II and BINDING SITE-III of FIG. 1, found on VGAM59 host target RNA, and schematic representation of the complementarity of each of these host target binding sites to VGAM59 RNA, herein designated VGAM RNA, are described hereinbelow with reference to Table 2.

As mentioned hereinabove with reference to FIG. 1, a function of VGAM59 gene, herein designated VGAM is inhibition of expression of VGAM59 target genes. It is appreciated that specific functions, and accordingly utilities, of VGAM59 correlate with, and may be deduced from, the identity of the target genes which VGAM59 binds and inhibits, and the function of these target genes, as elaborated hereinbelow.

Doublesex and Mab-3 Related Transcription Factor 1 (DMRT1, Accession NM_021951) is a VGAM59 host target gene. DMRT1 BINDING SITE is HOST TARGET binding site found in the 3' untranslated region of mRNA encoded by DMRT1, corresponding to a HOST TARGET binding site such as BINDING SITE I, BINDING SITE II or BINDING SITE III. Table 2 illustrates the complementarity of the nucleotide sequences of DMRT1 BINDING SITE, designated SEQ ID:22481, to the nucleotide sequence of VGAM59 RNA, herein designated VGAM RNA, also designated SEQ ID:2770.

A function of VGAM59 is therefore inhibition of Doublesex and Mab-3 Related Transcription Factor 1 (DMRT1, Accession NM_021951), a gene which May be involved in male sexual development. Accordingly, utilities of VGAM59 include diagnosis, prevention and treatment of diseases and clinical conditions associated with DMRT1. The function of DMRT1 has been established by previous studies. Shan et al. (2000) reviewed the accumulating evidence that haploinsufficiency of a dosage-sensitive gene (s) in 9p24.3 is responsible for the failure of testicular development and feminization in XY patients with monosomy for 9p. They used molecular cytogenetic methods to characterize the sex-reversing 9p deletions in 2 XY females. FISH with YACs from the critical 9p region containing the DMRT1 gene proved to be a fast and reliable assay for patient screening. Comparative YAC mapping on great ape and Old and New World monkey chromosomes demonstrated that the critical region was moved from an interstitial position on the ancestral primate chromosome to a very subtelomeric position in chimpanzee and human S by a pericentric inversion (s). Pathologic 9p rearrangements may be the consequence of an evolutionary chromosome breakpoint in close proximity to the sex-reversal region. Muroya et al. (2000) reported clinical and molecular findings in 5 karyotypic males (cases 1-5) and 1 karyotypic female (OMIM Ref. No. case 6) with distal 9p monosomy. Cases 1-3 and 6 had female external genitalia, case 4 showed ambiguous external genitalia, and case 5 exhibited male external genitalia with left cryptorchidism and right intrascrotal testis. Gonadal explorations at gonadectomy in case 3 and 4 revealed that case 3 had left streak gonad and right agonadism, and case 4 had bilateral hypoplastic testes. Endocrine studies in cases 1-4 and 6 showed that cases 1, 3, and 6 had definite primary hypogonadism, with basal FSH (see OMIM Ref. No. 118850) levels of 54, 39, and 41 IU/L, respectively, whereas case 2 with severe malnutrition was unremarkable for the baseline values, and case 4 had fairly good testicular function. FISH and microsatellite analyses demonstrated that all cases had hemizygosity of the 9p sex-determining region distal to D9S1779, with loss of DMRT1 and DMRT2 from the abnormal chromosome 9. Sequence analysis in cases 1-4 and 6 showed that they had normal sequences of each exon of DMRT1 and the DM domain of DMRT2 on the normal chromosome 9, and that cases 1-4 had normal SRY sequences. The authors concluded that the results provide further support for the presence of a sex-determining gene (s) on distal 9p and favor the possibility of DMRT1 and/or DMRT2 being the sex-determining gene (s). They inferred that haploinsufficiency of the 9p sex-determining gene (s) primarily hinders the formation of indifferent gonad, leading to various degrees of defective testis formation in karyotypic males and impaired ovary function in karyotypic females.

Full details of the abovementioned studies are described in the following publications, the disclosure of which are hereby incorporated by reference:

Muroya, K.; Okuyama, T.; Goishi, K.; Ogiso, Y.; Fukuda, S.; Kameyama, J.; Sato, H.; Suzuki, Y.; Terasaki, H.; Gomyo, H.; Wakui, K.; Fukushima, Y.; Ogata, T.: Sex-determining gene (s) on distal 9p: clinical and molecular studies in six cases. J. Clin. Endocr. Metab. 85:3094-3100, 2000; and Shan, Z.; Zabel, B.; Trautmann, U.; Hillig, U.; Ottolenghi, C.; Wang, Y.; Haaf, T. : FISH mapping of the sex-reversal region on human chromosome 9p in two XY females and in primates. Eu.

Further studies establishing the function and utilities of DMRT1 are found in John Hopkins OMIM database record ID 602424, and in sited publications numbered 122 and 8908-8914 listed in the bibliography section hereinbelow, which are also hereby incorporated by reference. Calpain 6 (CAPN6, Accession NM_014289) is another VGAM59 host target gene. CAPN6 BINDING SITE is HOST TARGET binding site found in the 3' untranslated region of mRNA encoded by CAPN6, corresponding to a HOST TARGET binding site such as BINDING SITE I, BINDING SITE II or BINDING SITE III. Table 2 illustrates the complementarity of the nucleotide sequences of CAPN6 BINDING SITE, designated SEQ ID:15567, to the nucleotide sequence of VGAM59 RNA, herein designated VGAM RNA, also designated SEQ ID:2770.

Another function of VGAM59 is therefore inhibition of Calpain 6 (CAPN6, Accession NM_014289). Accordingly, utilities of VGAM59 include diagnosis, prevention and treatment of diseases and clinical conditions associated with CAPN6. FLJ13769 (Accession NM_025012) is another VGAM59 host target gene. FLJ13769 BINDING SITE is HOST TARGET binding site found in the 3' untranslated region of mRNA encoded by FLJ13769, corresponding to a HOST TARGET binding site such as BINDING SITE I, BINDING SITE II or BINDING SITE III. Table 2 illustrates the complementarity of the nucleotide sequences of FLJ13769 BINDING SITE, designated SEQ ID:24592, to the nucleotide sequence of VGAM59 RNA, herein designated VGAM RNA, also designated SEQ ID:2770.

Another function of VGAM59 is therefore inhibition of FLJ13769 (Accession NM_025012). Accordingly, utilities of VGAM59 include diagnosis, prevention and treatment of diseases and clinical conditions associated with FLJ13769. FLJ22167 (Accession NM_024533) is another VGAM59 host target gene. FLJ22167 BINDING SITE is HOST TARGET binding site found in the 5' untranslated region of mRNA encoded by FLJ22167, corresponding to a HOST TARGET binding site such as BINDING SITE I, BINDING SITE II or BINDING SITE III. Table 2 illustrates the complementarity of the nucleotide sequences of FLJ22167 BINDING SITE, designated SEQ ID:23740, to the nucleotide sequence of VGAM59 RNA, herein designated VGAM RNA, also designated SEQ ID:2770.

Another function of VGAM59 is therefore inhibition of FLJ22167 (Accession NM_024533). Accordingly, utilities of VGAM59 include diagnosis, prevention and treatment of diseases and clinical conditions associated with FLJ22167. H-plk (Accession NM_015852) is another VGAM59 host target gene. H-plk BINDING SITE is HOST TARGET binding site found in the 5" untranslated region of mRNA encoded by H-plk, corresponding to a HOST TARGET binding site such as BINDING SITE I, BINDING SITE II or BINDING SITE III. Table 2 illustrates the complementarity of the nucleotide sequences of H-plk BINDING SITE, designated SEQ ID:17983, to the nucleotide sequence of VGAM59 RNA, herein designated VGAM RNA, also designated SEQ ID:2770.

Another function of VGAM59 is therefore inhibition of H-plk (Accession NM_015852). Accordingly, utilities of VGAM59 include diagnosis, prevention and treatment of diseases and clinical conditions associated with H-plk. FIG. 1 further provides a conceptual description of a novel bioinformatically detected viral gene of the present invention, referred to here as Viral Genomic Address Messenger 60 (VGAM60) viral gene, which modulates expression of respective host target genes thereof, the function and utility of which host target genes is known in the art.

VGAM60 is a novel bioinformatically detected regulatory, non protein coding, viral micro RNA (miRNA) gene. The method by which VGAM60 was detected is described hereinabove with reference to FIGS. 1-8.

VGAM60 gene, herein designated VGAM GENE, is a viral gene contained in the genome of Invertebrate Iridescent Virus 6. VGAM60 host target gene, herein designated VGAM HOST TARGET GENE, is a human gene contained in the human genome.

VGAM60 gene encodes a VGAM60 precursor RNA, herein designated VGAM PRECURSOR RNA. Similar to other miRNA genes, and unlike most ordinary genes, VGAM60 precursor RNA does not encode a protein. A nucleotide sequence identical or highly similar to the nucleotide sequence of VGAM60 precursor RNA is designated SEQ ID:46, and is provided hereinbelow with reference to the sequence listing part. Nucleotide sequence SEQ ID:46 is located at position 157538 relative to the genome of Invertebrate Iridescent Virus 6.

VGAM60 precursor RNA folds onto itself, forming VGAM60 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM60 folded precursor RNA into VGAM60 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM60 RNA is designated SEQ ID:2771, and is provided hereinbelow with reference to the sequence listing part.

VGAM60 host target gene, herein designated VGAM HOST TARGET GENE, encodes a corresponding messenger RNA, VGAM60 host target RNA, herein designated VGAM HOST TARGET RNA. VGAM60 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM60 RNA, herein designated VGAM RNA, binds complementarily to one or more host target binding sites located in untranslated regions of VGAM60 host target RNA, herein designated VGAM HOST TARGET RNA. This complementary binding is due to the fact that the nucleotide sequence of VGAM60 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM60 RNA, herein designated VGAM RNA, may have a different number of host target binding sites in untranslated regions of a VGAM60 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM60 RNA, herein designated VGAM RNA, to host target binding sites on VGAM60 host target RNA, herein designated VGAM HOST TARGET RNA, such as BINDING SITE I, BINDING SITE II and BINDING SITE III, inhibits translation of VGAM60 host target RNA into VGAM60 host target protein, herein designated VGAM HOST TARGET PROTEIN. VGAM host target protein is therefore outlined by a broken line.

It is appreciated that VGAM60 host target gene, herein designated VGAM HOST TARGET GENE, in fact represents a plurality of VGAM60 host target genes. The mRNA of each one of this plurality of VGAM60 host target genes comprises one or more host target binding sites, each having a nucleotide sequence which is at least partly complementary to VGAM60 RNA, herein designated VGAM RNA, and which when bound by VGAM60 RNA causes inhibition of translation of respective one or more VGAM60 host target proteins.

It is further appreciated by one skilled in the art that the mode of translational inhibition illustrated by FIG. 1 with specific reference to translational inhibition exerted by VGAM60 gene, herein designated VGAM GENE, on one or more VGAM60 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM60 is inhibition of expression of host target genes, as part of a novel viral mechanism of attacking a host. Accordingly, utilities of VGAM60 include diagnosis, prevention and treatment of viral infection by Invertebrate Iridescent Virus 6. Specific functions, and accordingly utilities, of VGAM60 correlate with, and may be deduced from, the identity of the host target genes which VGAM60 binds and inhibits, and the function of these host target genes, as elaborated hereinbelow.

Nucleotide sequences of the VGAM60 precursor RNA, herein designated VGAM PRECURSOR RNA, and of the 'diced' VGAM60 RNA, herein designated VGAM RNA, and a schematic representation of the secondary folding of VGAM60 folded precursor RNA, herein designated VGAM FOLDED PRECURSOR RNA, of VGAM60 are further described hereinbelow with reference to Table 1.

Nucleotide sequences of host target binding sites, such as BINDING SITE-I, BINDING SITE-II and BINDING SITE-III of FIG. 1, found on VGAM60 host target RNA, and schematic representation of the complementarity of each of these host target binding sites to VGAM60 RNA, herein designated VGAM RNA, are described hereinbelow with reference to Table 2.

As mentioned hereinabove with reference to FIG. 1, a function of VGAM60 gene, herein designated VGAM is inhibition of expression of VGAM60 target genes. It is appreciated that specific functions, and accordingly utilities, of VGAM60 correlate with, and may be deduced from, the identity of the target genes which VGAM60 binds and inhibits, and the function of these target genes, as elaborated hereinbelow.

Cadherin 6, Type 2, K-cadherin (fetal kidney) (CDH6, Accession NM_004932) is a VGAM60 host target gene. CDH6 BINDING SITE is HOST TARGET binding site found in the 3' untranslated region of mRNA encoded by CDH6, corresponding to a HOST TARGET binding site such as BINDING SITE I, BINDING SITE II or BINDING SITE III. Table 2 illustrates the complementarity of the nucleotide sequences of CDH6 BINDING SITE, designated SEQ ID:11373, to the nucleotide sequence of VGAM60 RNA, herein designated VGAM RNA, also designated SEQ ID:2771.

A function of VGAM60 is therefore inhibition of Cadherin 6, Type 2, K-cadherin (fetal kidney) (CDH6, Accession NM_004932), a gene which is a calcium dependent cell adhesion protein. Accordingly, utilities of VGAM60 include diagnosis, prevention and treatment of diseases and clinical conditions associated with CDH6. The function of CDH6 has been established by previous studies. Cadherins are calcium-dependent cell-cell adhesion molecules that mediate cell-cell binding in a homophilic manner. They play key roles in morphogenesis and in the maintenance of orderly structures such as epithelium, and may be involved in the metastasis and invasion of cancer. Mature cadherin proteins are composed of a large N-terminal extracellular domain, a single membrane-spanning domain, and a small C-terminal cytoplasmic domain. The extracellular domain consists of 5 subdomains, each containing a cadherin motif, and appears to determine the specificity of the homophilic cell adhesion activity of the cadherin; the amino acid sequence of the cytoplasmic domain is highly conserved among cadherins. CLONING By PCR using degenerate oligonucleotides based on highly conserved sequences of the cadherin cytoplasmic domain, followed by screening of a human fetal brain cDNA library, Suzuki et al. (1991) isolated a partial cDNA encoding CDH6. Using this partial CDH6 cDNA to screen a human hepatocellular carcinoma cell cDNA library, Shimoyama et al. (1995) cloned a full-length CDH6 cDNA. The deduced 790-amino acid CDH6 protein contains a signal sequence, prosequence, extracellular domain, transmembrane sequence, and cytoplasmic domain. The predicted 737-amino acid mature CDH6 protein has 97% amino acid similarity with rat K-cadherin, 64% with human CDH12 (OMIM Ref. No. 600562), and 60% with human CDH8 (OMIM Ref. No. 603008) and CDH11 (OMIM Ref. No. 600023). Northern blot analysis detected multiple CDH6 transcripts in a variety of normal human tissues, with highest levels in kidney, brain, and cerebellum; no expression was found in liver, heart, or colonic mucosa. Four of 6 hepatocellular carcinoma cell lines and 3 of 4 renal carcinoma cell lines showed strong expression of CDH6 transcripts. Among small cell lung carcinoma lines, all 11 CDH6-positive lines were of the classic type, whereas all 4 CDH6-negative lines were of the variant type.

Full details of the abovementioned studies are described in the following publications, the disclosure of which are hereby incorporated by reference:

Shimoyama, Y.; Gotoh, M.; Terasaki, T.; Kitajima, M.; Hirohashi, S.: Isolation and sequence analysis of human cadherin-6 complementary DNA for the full coding sequence and its expression in human carcinoma cells. Cancer Res. 55:2206-2211, 1995; and Suzuki, S.; Sano, K.; Tanihara, H.: Diversity of the cadherin family: evidence for eight new cadherins in nervous tissue. Cell Regul. 2:261-270, 1991.

Further studies establishing the function and utilities of CDH6 are found in John Hopkins OMIM database record ID 603007, and in sited publications numbered 587 and 5878 listed in the bibliography section hereinbelow, which are also hereby incorporated by reference. Pro-melanin-concentrating Hormone-like 1 (PMCHL1, Accession NM_031887) is another VGAM60 host target gene. PMCHL1 BINDING SITE is HOST TARGET binding site found in the 3' untranslated region of mRNA encoded by PMCHL1, corresponding to a HOST TARGET binding site such as BINDING SITE I, BINDING SITE II or BINDING SITE III. Table 2 illustrates the complementarity of the nucleotide sequences of PMCHL1 BINDING SITE, designated SEQ ID:25632, to the nucleotide sequence of VGAM60 RNA, herein designated VGAM RNA, also designated SEQ ID:2771.

Another function of VGAM60 is therefore inhibition of Pro-melanin-concentrating Hormone-like 1 (PMCHL1, Accession NM_031887). Accordingly, utilities of VGAM60 include diagnosis, prevention and treatment of diseases and clinical conditions associated with PMCHL1. Serine (or cysteine) Proteinase Inhibitor, Clade B (ovalbumin), Member 9 (SERPINB9, Accession NM_004155) is another VGAM60 host target gene. SERPINB9 BINDING SITE is HOST TARGET binding site found in the 3' untranslated region of mRNA encoded by SERPINB9, corresponding to a HOST TARGET binding site such as BINDING SITE I, BINDING SITE II or BINDING SITE III. Table 2 illustrates the complementarity of the nucleotide sequences of SERPINB9 BINDING SITE, designated SEQ ID:10368, to the nucleotide sequence of VGAM60 RNA, herein designated VGAM RNA, also designated SEQ ID:2771.

Another function of VGAM60 is therefore inhibition of Serine (or cysteine) Proteinase Inhibitor, Clade B (ovalbumin), Member 9 (SERPINB9, Accession NM_004155), a gene which may be a serpin serine protease inhibitor that interacts with granzyme B (GZMB). Accordingly, utilities of VGAM60 include diagnosis, prevention and treatment of diseases and clinical conditions associated with SERPINB9. The function of SERPINB9 has been established by previous studies. Serine proteinase inhibitors (serpins) are a large superfamily of proteins which bind to and inactivate serine proteinases. These interactions are involved in many cellular processes including coagulation, fibrinolysis, complement fixation, matrix remodeling, and apoptosis. Sprecher et al. (1995) isolated PI8 (OMIM Ref. No. 601697) and PI9 cDNAs from a human placenta cDNA library. The authors found that PI9 encodes a 374-amino acid polypeptide with over 60% identity with PI6. Northern blot analysis by Sprecher et al. (1995) demonstrated that PI9 is expressed as 2 transcripts of 3.4 and 4.4 kb which were detected in greatest abundance in lung and placenta. In searching for serpins related to PI6, Sun et al. (1996) isolated and cloned PI9 from human bone marrow mRNA using a PCR cloning strategy. They confirmed that the sequence of PI9 is closely related to PI6 (OMIM Ref. No. 173321) and the viral serpin CrmA. Sun et al. (1996) showed that PI9 forms an SDS-resistant complex with granzyme B (OMIM Ref. No. 123910), suggesting that these 2 proteins may form a physiologically significant serpin-serine proteinase interaction. Sun et al. (1996) also observed that PI9 was expressed in immune tissue, including lymphocytes, natural killer cell leukemia cell lines, and peripheral blood mononuclear cells. Sun et al. (1996) used fractionation experiments to show that PI9 is localized to the cytosol, in a separate subcellular compartment from granzyme B. PI9 was identified as an endogenous inhibitor of caspase-1 (OMIM Ref. No. 147678). Krieg et al. (2001) reported that PI9 mRNA and protein are rapidly and directly induced by estrogen in human liver cells. Using transient transfections to assay PI9 promoter truncations and mutations, they showed that this strong estrogen induction is mediated by a unique downstream estrogen responsive unit (ERU) approximately 200 nucleotides downstream of the transcription start site. They also demonstrated estrogen-dependent binding of ER to the cellular PI9 promoter. The ERU consists of an imperfect estrogen response element (ERE) palindrome immediately adjacent to a direct repeat containing two consensus ERE half-sites separated by 13 nucleotides (DR13). In transient transfections, all 4 of the ERE half-sites in the imperfect ERE and in the DR13 were important for estrogen inducibility. They concluded that a direct repeat can function with an imperfect ERE palindrome to confer estrogen inducibility on a native gene, which extends the repertoire of DNA sequences able to function as EREs.

Full details of the abovementioned studies are described in the following publications, the disclosure of which are hereby incorporated by reference:

Sun, J.; Bird, C. H.; Sutton, V.; McDonald, L.; Coughlin, P. B.; De Jong, T. A.; Trapani, J. A.; Bird, P. I.: A cytosolic granzyme B inhibitor related to the viral apoptotic regulator cytokine response modifier A is present in cytotoxic lymphocytes. J. Biol. Chem. 271:27802-27809, 1996; and Krieg, S. A.; Krieg, A. J.; Shapiro, D. J.: A unique downstream estrogen responsive unit mediates estrogen induction of proteinase inhibitor-9, a cellular inhibitor of IL-1-beta-conver.

Further studies establishing the function and utilities of SERPINB9 are found in John Hopkins OMIM database record ID 601799, and in sited publications numbered 6248-625 and 6708 listed in the bibliography section hereinbelow, which are also hereby incorporated by reference. Smcx Homolog, X Chromosome (mouse) (SMCX, Accession NM_004187) is another VGAM60 host target gene. SMCX BINDING SITE is HOST TARGET binding site found in the 3' untranslated region of mRNA encoded by SMCX, corresponding to a HOST TARGET binding site such as BINDING SITE I, BINDING SITE II or BINDING SITE III. Table 2 illustrates the complementarity of the nucleotide sequences of SMCX BINDING SITE, designated SEQ ID:10397, to the nucleotide sequence of VGAM60 RNA, herein designated VGAM RNA, also designated SEQ ID:2771.

Another function of VGAM60 is therefore inhibition of Smcx Homolog, X Chromosome (mouse) (SMCX, Accession NM_004187), a gene which escapes X inactivation. Accordingly, utilities of VGAM60 include diagnosis, prevention and treatment of diseases and clinical conditions associated with SMCX. The function of SMCX has been established by previous studies. Agulnik et al. (1994) cloned a gene, designated Smcx, from the mouse X chromosome by its homology to the Y-located gene Smcy. Using direct in situ hybridization, Smcx was mapped to the distal end of the mouse X chromosome (XF2-XF4) and its human homolog, SMCX, was mapped to proximal Xp (Xp11.2-p11.1). Meiotic mapping in the mouse placed Smcx in the interval between Plp and Pdha1. Agulnik et al. (1994) showed that the Smcx gene escapes X inactivation; in hamster/human hybrids, it was expressed when either an active or an inactive human X chromosome was present. Furthermore, 2 alleles of Smcx were found to be expressed in t (16; X)16H female mice despite the intact X chromosome being inactive in all cells. Thus, Smcx is also not subject to X inactivation. Agulnik et al. (1994) stated that this was the first example in the mouse of a gene that escapes X inactivation. Brown et al. (1995) demonstrated that the DXS423E gene (OMIM Ref. No. 300040), which is also located on Xp11.22-p11.21, likewise escapes X chromosome inactivation. Thus, the DXS423E and XE169 genes define a new region in the proximal short arm of the X chromosome that is not subject to X chromosome inactivation. Lingenfelter et al. (1998) showed that Smcx is susceptible to complete X inactivation in a portion of mouse embryonic cells. Furthermore, Smcx inactivation persists in some cells at least until 13.5 days postcoitum. A highly variable Smcx expression found during mouse development progressively disappears in adult tissues where nearly equal expression between alleles is observed Full details of the abovementioned studies are described in the following publications, the disclosure of which are hereby incorporated by reference:

Agulnik, A. I.; Mitchell, M. J.; Mattei, M.-G.; Borsani, G.; Avner, P. A.; Lerner, J. L.; Bishop, C. E.: A novel X gene with a widely transcribed Y-linked homologue escapes X-inactivation in mouse and human. Hum. Molec. Genet. 3:879-884, 1994; and Lingenfelter, P. A.; Adler, D. A.; Poslinski, D.; Thomas, S.; Elliott, R. W.; Chapman, V. M.; Disteche, C. M.: Escape from X inactivation of Smcx is preceded by silencing during mouse deve.

Further studies establishing the function and utilities of SMCX are found in John Hopkins OMIM database record ID 314690, and in sited publications numbered 2925-292 and 7316-2929 listed in the bibliography section hereinbelow, which are also hereby incorporated by reference. Ubiquitination Factor E4A (UFD2 homolog, yeast) (UBE4A, Accession NM_004788) is another VGAM60 host target gene. UBE4A BINDING SITE is HOST TARGET binding site found in the 3' untranslated region of mRNA encoded by UBE4A, corresponding to a HOST TARGET binding site such as BINDING SITE I, BINDING SITE II or BINDING SITE III. Table 2 illustrates the complementarity of the nucleotide sequences of UBE4A BINDING SITE, designated SEQ ID:11193, to the nucleotide sequence of VGAM60 RNA, herein designated VGAM RNA, also designated SEQ ID:2771.

Another function of VGAM60 is therefore inhibition of Ubiquitination Factor E4A (UFD2 homolog, yeast) (UBE4A, Accession NM_004788), a gene which binds to the ubiquitin moieties of preformed conjugates and catalyzes ubiquitin chain assembly in conjunction with E1, E2, and E3. Accordingly, utilities of VGAM60 include diagnosis, prevention and treatment of diseases and clinical conditions associated with UBE4A. The function of UBE4A has been established by previous studies. Ubiquitination involves a ubiquitin-activating enzyme, or E1 (see OMIM Ref. No. UBE1, 314370), a ubiquitin-conjugating enzyme, or E2 (see OMIM Ref. No. UBE2D1, 602961), and often a substrate-specific ubiquitin-protein ligase, or E3 (see OMIM Ref. No. UBE3A, 601623). Koegl et al. (1999) showed that efficient multiubiquitination necessary for proteasomal targeting of a model substrate requires an additional conjugation factor, which they referred to as E4. This protein, previously known as UFD2 in yeast, binds to the ubiquitin moieties of preformed conjugates and catalyzes ubiquitin chain assembly in conjunction with E1, E2, and E3. Protein E4 defines a novel protein family that includes the human protein KIAA0126 (first described by Nagase et al. (1995)) and the regulatory protein NOSA from Dictyostelium. Human protein KIAA0126 contains 1,073 predicted amino acid residues. In yeast, E4 activity is linked to cell survival under stress conditions, indicating that eukaryotes utilize E4-dependent proteolysis pathways for multiple cellular functions. By analysis of a human/rodent hybrid cell panel, Nagase et al. (1995) mapped the gene encoding protein KIAA0126 to chromosome 11.

Full details of the abovementioned studies are described in the following publications, the disclosure of which are hereby incorporated by reference:

Koegl, M.; Hoppe, T.; Schlenker, S.; Ulrich, H. D.; Mayer, T. U.; Jentsch, S.: A novel ubiquitination factor, E4, is involved in multiubiquitin chain assembly. Cell 96:635-644, 1999; and Nagase, T.; Seki, N.; Tanaka, A.; Ishikawa, K.; Nomura, N.: Prediction of the coding sequences of unidentified human genes. IV. The coding sequences of 40 new genes (KIAA0121-KIAA0160.

Further studies establishing the function and utilities of UBE4A are found in John Hopkins OMIM database record ID 603753, and in sited publications numbered 759 and 10969 listed in the bibliography section hereinbelow, which are also hereby incorporated by reference. Zinc Finger Protein 141 (clone pHZ-44) (ZNF141, Accession NM_003441) is another VGAM60 host target gene. ZNF141 BINDING SITE is HOST TARGET binding site found in the 3' untranslated region of mRNA encoded by ZNF141, corresponding to a HOST TARGET binding site such as BINDING SITE I, BINDING SITE II or BINDING SITE III. Table 2 illustrates the complementarity of the nucleotide sequences of ZNF141 BINDING SITE, designated SEQ ID:9497, to the nucleotide sequence of VGAM60 RNA, herein designated VGAM RNA, also designated SEQ ID:2771.

Another function of VGAM60 is therefore inhibition of Zinc Finger Protein 141 (clone pHZ-44) (ZNF141, Accession NM_003441). Accordingly, utilities of VGAM60 include diagnosis, prevention and treatment of diseases and clinical conditions associated with ZNF141. ATP-binding Cassette, Sub-family A (ABC1), Member 9 (ABCA9, Accession NM_080283) is another VGAM60 host target gene. ABCA9 BINDING SITE is HOST TARGET binding site found in the 3' untranslated region of mRNA encoded by ABCA9, corresponding to a HOST TARGET binding site such as BIND- ING SITE I, BINDING SITE II or BINDING SITE III. Table 2 illustrates the complementarity of the nucleotide sequences of ABCA9 BINDING SITE, designated SEQ ID:27828, to the nucleotide sequence of VGAM60 RNA, herein designated VGAM RNA, also designated SEQ ID:2771.

Another function of VGAM60 is therefore inhibition of ATP-binding Cassette, Sub-family A (ABC1), Member 9 (ABCA9, Accession NM_080283). Accordingly, utilities of VGAM60 include diagnosis, prevention and treatment of diseases and clinical conditions associated with ABCA9. KIAA0534 (Accession XM_049349) is another VGAM60 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35382, to the nucleotide sequence of VGAM60 RNA, herein designated VGAM RNA, also designated SEQ ID:2771.

Another function of VGAM60 is therefore inhibition of KIAA0534 (Accession XM_049349). Accordingly, utilities of VGAM60 include diagnosis, prevention and treatment of diseases and clinical conditions associated with KIAA0534. KIAA1229 (Accession XM_030665) is another VGAM60 host target gene. KIAA1229 BINDING SITE is HOST TARGET binding site found in the 3' untranslated region of mRNA encoded by KIAA1229, corresponding to a HOST TARGET binding site such as BINDING SITE I, BINDING SITE II or BINDING SITE III. Table 2 illustrates the complementarity of the nucleotide sequences of KIAA1229 BINDING SITE, designated SEQ ID:31102, to the nucleotide sequence of VGAM60 RNA, herein designated VGAM RNA, also designated SEQ ID:2771.

Another function of VGAM60 is therefore inhibition of KIAA1229 (Accession XM_030665). Accordingly, utilities of VGAM60 include diagnosis, prevention and treatment of diseases and clinical conditions associated with KIAA1229. LOC129831 (Accession XM_059376) is another VGAM60 host target gene. LOC129831 BINDING SITE is HOST TARGET binding site found in the 3' untranslated region of mRNA encoded by LOC129831, corresponding to a HOST TARGET binding site such as BINDING SITE I, BINDING SITE II or BINDING SITE III. Table 2 illustrates the complementarity of the nucleotide sequences of LOC129831 BINDING SITE, designated SEQ ID:36982, to the nucleotide sequence of VGAM60 RNA, herein designated VGAM RNA, also designated SEQ ID:2771.

Another function of VGAM60 is therefore inhibition of LOC129831 (Accession XM_059376). Accordingly, utilities of VGAM60 include diagnosis, prevention and treatment of diseases and clinical conditions associated with LOC129831. LOC151040 (Accession XM_087082) is another VGAM60 host target gene. LOC151040 BINDING SITE is HOST TARGET binding site found in the 3' untranslated region of mRNA encoded by LOC151040, corresponding to a HOST TARGET binding site such as BINDING SITE I, BINDING SITE II or BINDING SITE III. Table 2 illustrates the complementarity of the nucleotide sequences of LOC151040 BINDING SITE, designated SEQ ID:39045, to the nucleotide sequence of VGAM60 RNA, herein designated VGAM RNA, also designated SEQ ID:2771.

Another function of VGAM60 is therefore inhibition of LOC151040 (Accession XM_087082). Accordingly, utilities of VGAM60 include diagnosis, prevention and treatment of diseases and clinical conditions associated with LOC151040. LOC254672 (Accession XM_170619) is another VGAM60 host target gene. LOC254672 BINDING SITE is HOST TARGET binding site found in the 3' untranslated region of mRNA encoded by LOC254672, corresponding to a HOST TARGET binding site such as BINDING SITE I, BINDING SITE II or BINDING SITE III. Table 2 illustrates the complementarity of the nucleotide sequences of LOC254672 BINDING SITE, designated SEQ ID:45399, to the nucleotide sequence of VGAM60 RNA, herein designated VGAM RNA, also designated SEQ ID:2771.

Another function of VGAM60 is therefore inhibition of LOC254672 (Accession XM_170619). Accordingly, utilities of VGAM60 include diagnosis, prevention and treatment of diseases and clinical conditions associated with LOC254672. LOC90843 (Accession XM_034430) is another VGAM60 host target gene. LOC90843 BINDING SITE is HOST TARGET binding site found in the 3' untranslated region of mRNA encoded by LOC90843, corresponding to a HOST TARGET binding site such as BINDING SITE I, BINDING SITE II or BINDING SITE III. Table 2 illustrates the complementarity of the nucleotide sequences of LOC90843 BINDING SITE, designated SEQ ID:32116, to the nucleotide sequence of VGAM60 RNA, herein designated VGAM RNA, also designated SEQ ID:2771.

Another function of VGAM60 is therefore inhibition of LOC90843 (Accession XM_034430). Accordingly, utilities of VGAM60 include diagnosis, prevention and treatment of diseases and clinical conditions associated with LOC90843. LOC92568 (Accession XM_045852) is another VGAM60 host target gene. LOC92568 BINDING SITE is HOST TARGET binding site found in the 3' untranslated region of mRNA encoded by LOC92568, corresponding to a HOST TARGET binding site such as BINDING SITE I, BINDING SITE II or BINDING SITE III. Table 2 illustrates the complementarity of the nucleotide sequences of LOC92568 BINDING SITE, designated SEQ ID:34582, to the nucleotide sequence of VGAM60 RNA, herein designated VGAM RNA, also designated SEQ ID:2771.

Another function of VGAM60 is therefore inhibition of LOC92568 (Accession XM_045852). Accordingly, utilities of VGAM60 include diagnosis, prevention and treatment of diseases and clinical conditions associated with LOC92568. FIG. 1 further provides a conceptual description of a novel bioinformatically detected viral gene of the present invention, referred to here as Viral Genomic Address Messenger 61 (VGAM61) viral gene, which modulates expression of respective host target genes thereof, the function and utility of which host target genes is known in the art.

VGAM61 is a novel bioinformatically detected regulatory, non protein coding, viral micro RNA (miRNA) gene. The method by which VGAM61 was detected is described hereinabove with reference to FIGS. 1-8.

VGAM61 gene, herein designated VGAM GENE, is a viral gene contained in the genome of Invertebrate Iridescent Virus 6. VGAM61 host target gene, herein designated VGAM HOST TARGET GENE, is a human gene contained in the human genome.

VGAM61 gene encodes a VGAM61 precursor RNA, herein designated VGAM PRECURSOR RNA. Similar to other miRNA genes, and unlike most ordinary genes, VGAM61 precursor RNA does not encode a protein. A nucleotide sequence identical or highly similar to the nucleotide sequence of VGAM61 precursor RNA is designated SEQ ID:47, and is provided hereinbelow with reference to the sequence listing part. Nucleotide sequence SEQ ID:47 is located at position 133573 relative to the genome of Invertebrate Iridescent Virus 6.

VGAM61 precursor RNA folds onto itself, forming VGAM61 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM61 folded precursor RNA into VGAM61 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM61 RNA is designated SEQ ID:2772, and is provided hereinbelow with reference to the sequence listing part.

VGAM61 host target gene, herein designated VGAM HOST TARGET GENE, encodes a corresponding messenger RNA, VGAM61 host target RNA, herein designated VGAM HOST TARGET RNA. VGAM61 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM61 RNA, herein designated VGAM RNA, binds complementarily to one or more host target binding sites located in untranslated regions of VGAM61 host target RNA, herein designated VGAM HOST TARGET RNA. This complementary binding is due to the fact that the nucleotide sequence of VGAM61 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM61 RNA, herein designated VGAM RNA, may have a different number of host target binding sites in untranslated regions of a VGAM61 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM61 RNA, herein designated VGAM RNA, to host target binding sites on VGAM61 host target RNA, herein designated VGAM HOST TARGET RNA, such as BINDING SITE I, BINDING SITE II and BINDING SITE III, inhibits translation of VGAM61 host target RNA into VGAM61 host target protein, herein designated VGAM HOST TARGET PROTEIN. VGAM host target protein is therefore outlined by a broken line.

It is appreciated that VGAM61 host target gene, herein designated VGAM HOST TARGET GENE, in fact represents a plurality of VGAM61 host target genes. The mRNA of each one of this plurality of VGAM61 host target genes comprises one or more host target binding sites, each having a nucleotide sequence which is at least partly complementary to VGAM61 RNA, herein designated VGAM RNA, and which when bound by VGAM61 RNA causes inhibition of translation of respective one or more VGAM61 host target proteins.

It is further appreciated by one skilled in the art that the mode of translational inhibition illustrated by FIG. 1 with specific reference to translational inhibition exerted by VGAM61 gene, herein designated VGAM GENE, on one or more VGAM61 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM61 is inhibition of expression of host target genes, as part of a novel viral mechanism of attacking a host. Accordingly, utilities of VGAM61 include diagnosis, prevention and treatment of viral infection by Invertebrate Iridescent Virus 6. Specific functions, and accordingly utilities, of VGAM61 correlate with, and may be deduced from, the identity of the host target genes which VGAM61 binds and inhibits, and the function of these host target genes, as elaborated hereinbelow.

Nucleotide sequences of the VGAM61 precursor RNA, herein designated VGAM PRECURSOR RNA, and of the 'diced' VGAM61 RNA, herein designated VGAM RNA, and a schematic representation of the secondary folding of VGAM61 folded precursor RNA, herein designated VGAM FOLDED PRECURSOR RNA, of VGAM61 are further described hereinbelow with reference to Table 1.

Nucleotide sequences of host target binding sites, such as BINDING SITE-I, BINDING SITE-II and BINDING SITE-III of FIG. 1, found on VGAM61 host target RNA, and schematic representation of the complementarity of each of these host target binding sites to VGAM61 RNA, herein designated VGAM RNA, are described hereinbelow with reference to Table 2.

As mentioned hereinabove with reference to FIG. 1, a function of VGAM61 gene, herein designated VGAM is inhibition of expression of VGAM61 target genes. It is appreciated that specific functions, and accordingly utilities, of VGAM61 correlate with, and may be deduced from, the identity of the target genes which VGAM61 binds and inhibits, and the function of these target genes, as elaborated hereinbelow.

F-box and Leucine-rich Repeat Protein 5 (FBXL5, Accession NM_033535) is a VGAM61 host target gene. FBXL5 BINDING SITE is HOST TARGET binding site found in the 5' untranslated region of mRNA encoded by FBXL5, corresponding to a HOST TARGET binding site such as BINDING SITE I, BINDING SITE II or BINDING SITE III. Table 2 illustrates the complementarity of the nucleotide sequences of FBXL5 BINDING SITE, designated SEQ ID:27305, to the nucleotide sequence of VGAM61 RNA, herein designated VGAM RNA, also designated SEQ ID:2772.

A function of VGAM61 is therefore inhibition of F-box and Leucine-rich Repeat Protein 5 (FBXL5, Accession NM_033535), a gene which is a putative SCF ubiquitin ligase subunit involved in protein degradation. Accordingly, utilities of VGAM61 include diagnosis, prevention and treatment of diseases and clinical conditions associated with FBXL5. The function of FBXL5 has been established by previous studies. The F box, named after cyclin F (CCNF; 600227), in which it was originally observed, is an approximately 40-amino acid motif that binds SKP1 (OMIM Ref. No. 601434). F-box proteins are components of modular E3 ubiquitin protein ligases called SCFs (SKP1, OMIM Ref. No. 603134), F-box proteins), which function in phosphorylation-dependent ubiquitination. Using a yeast 2-hybrid screen with SKP1 as bait, followed by searching sequence databases, Winston et al. (1999) and Cenciarelli et al. (1999) identified 33 mammalian and 26 human F-box proteins, respectively. These contained C termini with leucine-rich repeats (FBXLs, e.g., SKP2 (OMIM Ref. No. 601436)), WD40 domains (FBXWs, e.g., BTRCP (OMIM Ref. No. 603482)), or no recognizable motifs (FBXOs, e.g., CCNF). Winston et al. (1999) predicted the presence of 6 leucine-rich repeats (LRRs) in FBXL5. RT-PCR analysis detected expression in all tissues tested, with highest levels in heart and pancreas.

Full details of the abovementioned studies are described in the following publications, the disclosure of which are hereby incorporated by reference:

Ilyin, G. P.; Rialland, M.; Pigeon, C.; Guguen-Guillouzo, C.: cDNA cloning and expression analysis of new members of the mammalian F-box protein family. Genomics 67:40-47, 2000; and Winston, J. T.; Koepp, D. M.; Zhu, C.; Elledge, S. J.; Harper, J. W.: A family of mammalian F-box proteins. Curr. Biol. 9:1180-1182, 1999.

Further studies establishing the function and utilities of FBXL5 are found in John Hopkins OMIM database record ID 605655, and in sited publications numbered 40 and 8278 listed in the bibliography section hereinbelow, which are also hereby incorporated by reference. Guanine Nucleotide Binding Protein (G protein), Alpha Inhibiting Activity Polypeptide 1 (GNAI1, Accession NM_002069) is another VGAM61 host target gene. GNAI1 BINDING SITE is HOST TARGET binding site found in the 3' untranslated region of mRNA encoded by GNAI1, corresponding to a HOST TARGET binding site such as BINDING SITE I, BINDING SITE II or BINDING SITE III. Table 2 illustrates the complementarity of the nucleotide sequences of GNAI1 BINDING SITE, designated SEQ ID:7841, to the nucleotide sequence of VGAM61 RNA, herein designated VGAM RNA, also designated SEQ ID:2772.

Another function of VGAM61 is therefore inhibition of Guanine Nucleotide Binding Protein (G protein), Alpha Inhibiting Activity Polypeptide 1 (GNAI1, Accession NM_002069), a gene which is involved as modulators or transducers in various transmembrane signaling systems. Accordingly, utilities of VGAM61 include diagnosis, prevention and treatment of diseases and clinical conditions associated with GNAI1. The function of GNAI1 and its association with various diseases and clinical conditions, has been established by previous studies, as described hereinabove with reference to VGAM57. General Transcription Factor IIF, Polypeptide 1, 74 kDa (GTF2F1, Accession NM_002096) is another VGAM61 host target gene. GTF2F1 BINDING SITE is HOST TARGET binding site found in the 3' untranslated region of mRNA encoded by GTF2F1, corresponding to a HOST TARGET binding site such as BINDING SITE I, BINDING SITE II or BINDING SITE III. Table 2 illustrates the complementarity of the nucleotide sequences of GTF2F1 BINDING SITE, designated SEQ ID:7885, to the nucleotide sequence of VGAM61 RNA, herein designated VGAM RNA, also designated SEQ ID:2772.

Another function of VGAM61 is therefore inhibition of General Transcription Factor IIF, Polypeptide 1, 74 kDa (GTF2F1, Accession NM_002096), a gene which helps to recruit it to the initiation complex in collaboration with tfiib. it promotes transcription elongation. Accordingly, utilities of VGAM61 include diagnosis, prevention and treatment of diseases and clinical conditions associated with GTF2F1. The function of GTF2F1 has been established by previous studies.

At least 6 chromatographically resolvable general transcription factors may participate in accurate initiation by RNA polymerase II in HeLa cell-derived systems. TFIIF can bind directly to RNA polymerase II in solution and decrease the affinity of RNA polymerase II for nonspecific DNA. TFIIF is known to act at an intermediate stage in initiation complex formation. It acts after TFIID (OMIM Ref. No. 313650) firmly associates with DNA, but coincidentally with or immediately after RNA polymerase II binding to DNA, and before the recruitment of factor TFIIE (189962, 189964). The small subunit (RAP30; 189969) of TFIIF was cloned by Sopta et al. (1989) and shown to have some amino acid sequence homology to bacterial sigma factors. Aso et al. (1992) partially sequenced the RAP74 protein from purified HeLa cells, cloned its cDNA, and showed that its translation product can interact with RAP30 in vitro as well as in vivo. The cDNA predicted an amino acid sequence that lacks obvious DNA or RNA helicase motifs. Finkelstein et al. (1992) likewise isolated a cDNA encoding RAP74 and showed that both RAP30 and RAP74 produced in Escherichia coli could be used in place of natural human RAP30/74 to direct accurate transcription initiation by RNA polymerase II in vitro.

Full details of the abovementioned studies are described in the following publications, the disclosure of which are hereby incorporated by reference:

Sopta, M.; Burton, Z. F.; Greenblatt, J.: Structure and associated DNA-helicase activity of a general transcription initiation factor that binds to RNA polymerase II. Nature 341:410-414, 1989; and Finkelstein, A.; Kostrub, C. F.; Li, J.; Chavez, D. P.; Wang, B. Q.; Fang, S. M.; Greenblatt, J.; Burton, Z. F.: A cDNA encoding RAP74, a general initiation factor for transcription by.

Further studies establishing the function and utilities of GTF2F1 are found in John Hopkins OMIM database record ID 189968, and in sited publications numbered 9701-9705 listed in the bibliography section hereinbelow, which are also hereby incorporated by reference. KIAA0527 (Accession XM_171054) is another VGAM61 host target gene. KIAA0527 BINDING SITE is HOST TARGET binding site found in the 3' untranslated region of mRNA encoded by KIAA0527, corresponding to a HOST TARGET binding site such as BINDING SITE I, BINDING SITE II or BINDING SITE III. Table 2 illustrates the complementarity of the nucleotide sequences of KIAA0527 BINDING SITE, designated SEQ ID:45851, to the nucleotide sequence of VGAM61 RNA, herein designated VGAM RNA, also designated SEQ ID:2772.

Another function of VGAM61 is therefore inhibition of KIAA0527 (Accession XM_171054). Accordingly, utilities of VGAM61 include diagnosis, prevention and treatment of diseases and clinical conditions associated with KIAA0527. Synaptophysin-like Protein (SYPL, Accession XM_167511) is another VGAM61 host target gene. SYPL BINDING SITE is HOST TARGET binding site found in the 3' untranslated region of mRNA encoded by SYPL, corresponding to a HOST TARGET binding site such as BINDING SITE I, BINDING SITE II or BINDING SITE III. Table 2 illustrates the complementarity of the nucleotide sequences of SYPL BINDING SITE, designated SEQ ID:44644, to the nucleotide sequence of VGAM61 RNA, herein designated VGAM RNA, also designated SEQ ID:2772.

Another function of VGAM61 is therefore inhibition of Synaptophysin-like Protein (SYPL, Accession XM_167511). Accordingly, utilities of VGAM61 include diagnosis, prevention and treatment of diseases and clinical conditions associated with SYPL. LOC145820 (Accession XM_085246) is another VGAM61 host target gene. LOC145820 BINDING SITE is HOST TARGET binding site found in the 3' untranslated region of mRNA encoded by LOC145820, corresponding to a HOST TARGET binding site such as BINDING SITE I, BINDING SITE II or BINDING SITE III. Table 2 illustrates the complementarity of the nucleotide sequences of LOC145820 BINDING SITE, designated SEQ ID:37989, to the nucleotide sequence of VGAM61 RNA, herein designated VGAM RNA, also designated SEQ ID:2772.

Another function of VGAM61 is therefore inhibition of LOC145820 (Accession XM_085246). Accordingly, utilities of VGAM61 include diagnosis, prevention and treatment of diseases and clinical conditions associated with LOC145820. LOC201627 (Accession XM_114353) is another VGAM61 host target gene. LOC201627 BINDING SITE is HOST TARGET binding site found in the 3' untranslated region of mRNA encoded by LOC201627, corresponding to a HOST TARGET binding site such as BINDING SITE I, BINDING SITE II or BINDING SITE III. Table 2 illustrates the complementarity of the nucleotide sequences of LOC201627 BINDING SITE, designated SEQ ID:42898, to the nucleotide sequence of VGAM61 RNA, herein designated VGAM RNA, also designated SEQ ID:2772.

Another function of VGAM61 is therefore inhibition of LOC201627 (Accession XM_114353). Accordingly, utilities of VGAM61 include diagnosis, prevention and treatment of diseases and clinical conditions associated with LOC201627. FIG. 1 further provides a conceptual description of a novel bioinformatically detected viral gene of the present invention, referred to here as Viral Genomic Address Messenger 62 (VGAM62) viral gene, which modulates expression of respective host target genes thereof, the function and utility of which host target genes is known in the art.

VGAM62 is a novel bioinformatically detected regulatory, non protein coding, viral micro RNA (miRNA) gene. The method by which VGAM62 was detected is described hereinabove with reference to FIGS. 1-8.

VGAM62 gene, herein designated VGAM GENE, is a viral gene contained in the genome of Invertebrate Iridescent Virus 6. VGAM62 host target gene, herein designated VGAM HOST TARGET GENE, is a human gene contained in the human genome.

VGAM62 gene encodes a VGAM62 precursor RNA, herein designated VGAM PRECURSOR RNA. Similar to other miRNA genes, and unlike most ordinary genes, VGAM62 precursor RNA does not encode a protein. A nucleotide sequence identical or highly similar to the nucleotide sequence of VGAM62 precursor RNA is designated SEQ ID:48, and is provided hereinbelow with reference to the sequence listing part. Nucleotide sequence SEQ ID:48 is located at position 134360 relative to the genome of Invertebrate Iridescent Virus 6.

VGAM62 precursor RNA folds onto itself, forming VGAM62 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM62 folded precursor RNA into VGAM62 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 62%) nucleotide sequence of VGAM62 RNA is designated SEQ ID:2773, and is provided hereinbelow with reference to the sequence listing part.

VGAM62 host target gene, herein designated VGAM HOST TARGET GENE, encodes a corresponding messenger RNA, VGAM62 host target RNA, herein designated VGAM HOST TARGET RNA. VGAM62 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM62 RNA, herein designated VGAM RNA, binds complementarily to one or more host target binding sites located in untranslated regions of VGAM62 host target RNA, herein designated VGAM HOST TARGET RNA. This complementary binding is due to the fact that the nucleotide sequence of VGAM62 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM62 RNA, herein designated VGAM RNA, may have a different number of host target binding sites in untranslated regions of a VGAM62 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM62 RNA, herein designated VGAM RNA, to host target binding sites on VGAM62 host target RNA, herein designated VGAM HOST TARGET RNA, such as BINDING SITE I, BINDING SITE II and BINDING SITE III, inhibits translation of VGAM62 host target RNA into VGAM62 host target protein, herein designated VGAM HOST TARGET PROTEIN. VGAM host target protein is therefore outlined by a broken line.

It is appreciated that VGAM62 host target gene, herein designated VGAM HOST TARGET GENE, in fact represents a plurality of VGAM62 host target genes. The mRNA of each one of this plurality of VGAM62 host target genes comprises one or more host target binding sites, each having a nucleotide sequence which is at least partly complementary to VGAM62 RNA, herein designated VGAM RNA, and which when bound by VGAM62 RNA causes inhibition of translation of respective one or more VGAM62 host target proteins.

It is further appreciated by one skilled in the art that the mode of translational inhibition illustrated by FIG. 1 with specific reference to translational inhibition exerted by VGAM62 gene, herein designated VGAM GENE, on one or more VGAM62 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM62 is inhibition of expression of host target genes, as part of a novel viral mechanism of attacking a host. Accordingly, utilities of VGAM62 include diagnosis, prevention and treatment of viral infection by Invertebrate Iridescent Virus 6. Specific functions, and accordingly utilities, of VGAM62 correlate with, and may be deduced from, the identity of the host target genes which VGAM62 binds and inhibits, and the function of these host target genes, as elaborated hereinbelow.

Nucleotide sequences of the VGAM62 precursor RNA, herein designated VGAM PRECURSOR RNA, and of the 'diced' VGAM62 RNA, herein designated VGAM RNA, and a schematic representation of the secondary folding of VGAM62 folded precursor RNA, herein designated VGAM FOLDED PRECURSOR RNA, of VGAM62 are further described hereinbelow with reference to Table 1.

Nucleotide sequences of host target binding sites, such as BINDING SITE-I, BINDING SITE-II and BINDING SITE-III of FIG. 1, found on VGAM62 host target RNA, and schematic representation of the complementarity of each of these host target binding sites to VGAM62 RNA, herein designated VGAM RNA, are described hereinbelow with reference to Table 2.

As mentioned hereinabove with reference to FIG. 1, a function of VGAM62 gene, herein designated VGAM is inhibition of expression of VGAM62 target genes. It is appreciated that specific functions, and accordingly utilities, of VGAM62 correlate with, and may be deduced from, the identity of the target genes which VGAM62 binds and inhibits, and the function of these target genes, as elaborated hereinbelow.

Eyes Absent Homolog 1 (Drosophila) (EYA1, Accession NM_000503) is a VGAM62 host target gene. EYA1 BINDING SITE is HOST TARGET binding site found in the 3' untranslated region of mRNA encoded by EYA1, corresponding to a HOST TARGET binding site such as BINDING SITE I, BINDING SITE II or BINDING SITE III. Table 2 illustrates the complementarity of the nucleotide sequences of EYA1 BINDING SITE, designated SEQ ID:6117, to the nucleotide sequence of VGAM62 RNA, herein designated VGAM RNA, also designated SEQ ID:2773.

A function of VGAM62 is therefore inhibition of Eyes Absent Homolog 1 (Drosophila) (EYA1, Accession NM_000503). Accordingly, utilities of VGAM62 include diagnosis, prevention and treatment of diseases and clinical conditions associated with EYA1. Leucine-zipper-like Transcriptional Regulator, 1 (LZTR1, Accession NM_006767) is another VGAM62 host target gene. LZTR1 BINDING SITE is HOST TARGET binding site found in the 5' untranslated region of mRNA encoded by LZTR1, corresponding to a HOST TARGET binding site such as BINDING SITE I, BINDING SITE II or BINDING SITE III. Table 2 illustrates the complementarity of the nucleotide sequences of LZTR1 BINDING SITE, designated SEQ ID:13633, to the nucleotide sequence of VGAM62 RNA, herein designated VGAM RNA, also designated SEQ ID:2773.

Another function of VGAM62 is therefore inhibition of Leucine-zipper-like Transcriptional Regulator, 1 (LZTR1, Accession NM_006767). Accordingly, utilities of VGAM62 include diagnosis, prevention and treatment of diseases and clinical conditions associated with LZTR1. ERAP140 (Accession XM_059748) is another VGAM62 host target gene. ERAP140 BINDING SITE is HOST TARGET binding site found in the 3' untranslated region of mRNA encoded by ERAP140, corresponding to a HOST TARGET binding site such as BINDING SITE I, BINDING SITE II or BINDING SITE III. Table 2 illustrates the complementarity of the nucleotide sequences of ERAP140 BINDING SITE, designated SEQ ID:37089, to the nucleotide sequence of VGAM62 RNA, herein designated VGAM RNA, also designated SEQ ID:2773.

Another function of VGAM62 is therefore inhibition of ERAP140 (Accession XM_059748). Accordingly, utilities of VGAM62 include diagnosis, prevention and treatment of diseases and clinical conditions associated with ERAP140. KIAA1557 (Accession XM_028289) is another VGAM62 host target gene. KIAA1557 BINDING SITE is HOST TARGET binding site found in the 3' untranslated region of mRNA encoded by KIAA1557, corresponding to a HOST TARGET binding site such as BINDING SITE I, BINDING SITE II or BINDING SITE III. Table 2 illustrates the complementarity of the nucleotide sequences of KIAA1557 BINDING SITE, designated SEQ ID:30639, to the nucleotide sequence of VGAM62 RNA, herein designated VGAM RNA, also designated SEQ ID:2773.

Another function of VGAM62 is therefore inhibition of KIAA1557 (Accession XM_028289). Accordingly, utilities of VGAM62 include diagnosis, prevention and treatment of diseases and clinical conditions associated with KIAA1557. PR Domain Containing 10 (PRDM10, Accession NM_020228) is another VGAM62 host target gene. PRDM10 BINDING SITE is HOST TARGET binding site found in the 5' untranslated region of mRNA encoded by PRDM10, corresponding to a HOST TARGET binding site such as BINDING SITE I, BINDING SITE II or BINDING SITE III. Table 2 illustrates the complementarity of the nucleotide sequences of PRDM10 BINDING SITE, designated SEQ ID:21499, to the nucleotide sequence of VGAM62 RNA, herein designated VGAM RNA, also designated SEQ ID:2773.

Another function of VGAM62 is therefore inhibition of PR Domain Containing 10 (PRDM10, Accession NM_020228). Accordingly, utilities of VGAM62 include diagnosis, prevention and treatment of diseases and clinical conditions associated with PRDM10. Serum Response Factor (c-fos serum response element-binding transcription factor) (SRF, Accession NM_003131) is another VGAM62 host target gene. SRF BINDING SITE is HOST TARGET binding site found in the 3' untranslated region of mRNA encoded by SRF, corresponding to a HOST TARGET binding site such as BINDING SITE I, BINDING SITE II or BINDING SITE III. Table 2 illustrates the complementarity of the nucleotide sequences of SRF BINDING SITE, designated SEQ ID:9097, to the nucleotide sequence of VGAM62 RNA, herein designated VGAM RNA, also designated SEQ ID:2773.

Another function of VGAM62 is therefore inhibition of Serum Response Factor (c-fos serum response element-binding transcription factor) (SRF, Accession NM_003131). Accordingly, utilities of VGAM62 include diagnosis, prevention and treatment of diseases and clinical conditions associated with SRF. LOC148709 (Accession XM_086281) is another VGAM62 host target gene. LOC148709 BINDING SITE is HOST TARGET binding site found in the 5' untranslated region of mRNA encoded by LOC148709, corresponding to a HOST TARGET binding site such as BINDING SITE I, BINDING SITE II or BINDING SITE III. Table 2 illustrates the complementarity of the nucleotide sequences of LOC148709 BINDING SITE, designated SEQ ID:38580, to the nucleotide sequence of VGAM62 RNA, herein designated VGAM RNA, also designated SEQ ID:2773.

Another function of VGAM62 is therefore inhibition of LOC148709 (Accession XM_086281). Accordingly, utilities of VGAM62 include diagnosis, prevention and treatment of diseases and clinical conditions associated with LOC148709.

LOC164295 (Accession XM_092767) is another VGAM62 host target gene. LOC164295 BINDING SITE is HOST TARGET binding site found in the 5' untranslated region of mRNA encoded by LOC164295, corresponding to a HOST TARGET binding site such as BINDING SITE I, BINDING SITE II or BINDING SITE III. Table 2 illustrates the complementarity of the nucleotide sequences of LOC164295 BINDING SITE, designated SEQ ID:40143, to the nucleotide sequence of VGAM62 RNA, herein designated VGAM RNA, also designated SEQ ID:2773.

Another function of VGAM62 is therefore inhibition of LOC164295 (Accession XM_092767). Accordingly, utilities of VGAM62 include diagnosis, prevention and treatment of diseases and clinical conditions associated with LOC164295. FIG. 1 further provides a conceptual description of a novel bioinformatically detected viral gene of the present invention, referred to here as Viral Genomic Address Messenger 63 (VGAM63) viral gene, which modulates expression of respective host target genes thereof, the function and utility of which host target genes is known in the art.

VGAM63 is a novel bioinformatically detected regulatory, non protein coding, viral micro RNA (miRNA) gene. The method by which VGAM63 was detected is described hereinabove with reference to FIGS. 1-8.

VGAM63 gene, herein designated VGAM GENE, is a viral gene contained in the genome of Invertebrate Iridescent Virus 6. VGAM63 host target gene, herein designated VGAM HOST TARGET GENE, is a human gene contained in the human genome.

VGAM63 gene encodes a VGAM63 precursor RNA, herein designated VGAM PRECURSOR RNA. Similar to other miRNA genes, and unlike most ordinary genes, VGAM63 precursor RNA does not encode a protein. A nucleotide sequence identical or highly similar to the nucleotide sequence of VGAM63 precursor RNA is designated SEQ ID:49, and is provided hereinbelow with reference to the sequence listing part. Nucleotide sequence SEQ ID:49 is located at position 98449 relative to the genome of Invertebrate Iridescent Virus 6.

VGAM63 precursor RNA folds onto itself, forming VGAM63 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM63 folded precursor RNA into VGAM63 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM63 RNA is designated SEQ ID:2774, and is provided hereinbelow with reference to the sequence listing part.

VGAM63 host target gene, herein designated VGAM HOST TARGET GENE, encodes a corresponding messenger RNA, VGAM63 host target RNA, herein designated VGAM HOST TARGET RNA. VGAM63 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM63 RNA, herein designated VGAM RNA, binds complementarily to one or more host target binding sites located in untranslated regions of VGAM63 host target RNA, herein designated VGAM HOST TARGET RNA. This complementary binding is due to the fact that the nucleotide sequence of VGAM63 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM63 RNA, herein designated VGAM RNA, may have a different number of host target binding sites in untranslated regions of a VGAM63 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM63 RNA, herein designated VGAM RNA, to host target binding sites on VGAM63 host target RNA, herein designated VGAM HOST TARGET RNA, such as BINDING SITE I, BINDING SITE II and BINDING SITE III, inhibits translation of VGAM63 host target RNA into VGAM63 host target protein, herein designated VGAM HOST TARGET PROTEIN. VGAM host target protein is therefore outlined by a broken line.

It is appreciated that VGAM63 host target gene, herein designated VGAM HOST TARGET GENE, in fact represents a plurality of VGAM63 host target genes. The mRNA of each one of this plurality of VGAM63 host target genes comprises one or more host target binding sites, each having a nucleotide sequence which is at least partly complementary to VGAM63 RNA, herein designated VGAM RNA, and which when bound by VGAM63 RNA causes inhibition of translation of respective one or more VGAM63 host target proteins.

It is further appreciated by one skilled in the art that the mode of translational inhibition illustrated by FIG. 1 with specific reference to translational inhibition exerted by VGAM63 gene, herein designated VGAM GENE, on one or more VGAM63 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM63 is inhibition of expression of host target genes, as part of a novel viral mechanism of attacking a host. Accordingly, utilities of VGAM63 include diagnosis, prevention and treatment of viral infection by Invertebrate Iridescent Virus 6. Specific functions, and accordingly utilities, of VGAM63 correlate with, and may be deduced from, the identity of the host target genes which VGAM63 binds and inhibits, and the function of these host target genes, as elaborated hereinbelow.

Nucleotide sequences of the VGAM63 precursor RNA, herein designated VGAM PRECURSOR RNA, and of the 'diced' VGAM63 RNA, herein designated VGAM RNA, and a schematic representation of the secondary folding of VGAM63 folded precursor RNA, herein designated VGAM FOLDED PRECURSOR RNA, of VGAM63 are further described hereinbelow with reference to Table 1.

Nucleotide sequences of host target binding sites, such as BINDING SITE-I, BINDING SITE-II and BINDING SITE-III of FIG. 1, found on VGAM63 host target RNA, and schematic representation of the complementarity of each of these host target binding sites to VGAM63 RNA, herein designated VGAM RNA, are described hereinbelow with reference to Table 2.

As mentioned hereinabove with reference to FIG. 1, a function of VGAM63 gene, herein designated VGAM is inhibition of expression of VGAM63 target genes. It is appreciated that specific functions, and accordingly utilities, of VGAM63 correlate with, and may be deduced from, the identity of the target genes which VGAM63 binds and inhibits, and the function of these target genes, as elaborated hereinbelow.

KIAA0061 (Accession XM_043094) is a VGAM63 host target gene. KIAA0061 BINDING SITE is HOST TARGET binding site found in the 3' untranslated region of mRNA encoded by KIAA0061, corresponding to a HOST TARGET binding site such as BINDING SITE I, BINDING SITE II or BINDING SITE III. Table 2 illustrates the complementarity of the nucleotide sequences of KIAA0061 BINDING SITE, designated SEQ ID:33890, to the nucleotide sequence of VGAM63 RNA, herein designated VGAM RNA, also designated SEQ ID:2774.

A function of VGAM63 is therefore inhibition of KIAA0061 (Accession XM_043094). Accordingly, utilities of VGAM63 include diagnosis, prevention and treatment of diseases and clinical conditions associated with KIAA0061. FIG. 1 further provides a conceptual description of a novel bioinformatically detected viral gene of the present invention, referred to here as Viral Genomic Address Messenger 64 (VGAM64) viral gene, which modulates expression of respective host target genes thereof, the function and utility of which host target genes is known in the art.

VGAM64 is a novel bioinformatically detected regulatory, non protein coding, viral micro RNA (miRNA) gene. The method by which VGAM64 was detected is described hereinabove with reference to FIGS. 1-8.

VGAM64 gene, herein designated VGAM GENE, is a viral gene contained in the genome of Invertebrate Iridescent Virus 6. VGAM64 host target gene, herein designated VGAM HOST TARGET GENE, is a human gene contained in the human genome.

VGAM64 gene encodes a VGAM64 precursor RNA, herein designated VGAM PRECURSOR RNA. Similar to other miRNA genes, and unlike most ordinary genes, VGAM64 precursor RNA does not encode a protein. A nucleotide sequence identical or highly similar to the nucleotide sequence of VGAM64 precursor RNA is designated SEQ ID:50, and is provided hereinbelow with reference to the sequence listing part. Nucleotide sequence SEQ ID:50 is located at position 146673 relative to the genome of Invertebrate Iridescent Virus 6.

VGAM64 precursor RNA folds onto itself, forming VGAM64 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM64 folded precursor RNA into VGAM64 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM64 RNA is designated SEQ ID:2775, and is provided hereinbelow with reference to the sequence listing part.

VGAM64 host target gene, herein designated VGAM HOST TARGET GENE, encodes a corresponding messenger RNA, VGAM64 host target RNA, herein designated VGAM HOST TARGET RNA. VGAM64 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM64 RNA, herein designated VGAM RNA, binds complementarily to one or more host target binding sites located in untranslated regions of VGAM64 host target RNA, herein designated VGAM HOST TARGET RNA. This complementary binding is due to the fact that the nucleotide sequence of VGAM64 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM64 RNA, herein designated VGAM RNA, may have a different number of host target binding sites in untranslated regions of a VGAM64 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM64 RNA, herein designated VGAM RNA, to host target binding sites on VGAM64 host target RNA, herein designated VGAM HOST TARGET RNA, such as BINDING SITE I, BINDING SITE II and BINDING SITE III, inhibits translation of VGAM64 host target RNA into VGAM64 host target protein, herein designated VGAM HOST TARGET PROTEIN. VGAM host target protein is therefore outlined by a broken line.

It is appreciated that VGAM64 host target gene, herein designated VGAM HOST TARGET GENE, in fact represents a plurality of VGAM64 host target genes. The mRNA of each one of this plurality of VGAM64 host target genes comprises one or more host target binding sites, each having a nucleotide sequence which is at least partly complementary to VGAM64 RNA, herein designated VGAM RNA, and which when bound by VGAM64 RNA causes inhibition of translation of respective one or more VGAM64 host target proteins.

It is further appreciated by one skilled in the art that the mode of translational inhibition illustrated by FIG. 1 with specific reference to translational inhibition exerted by VGAM64 gene, herein designated VGAM GENE, on one or more VGAM64 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM64 is inhibition of expression of host target genes, as part of a novel viral mechanism of attacking a host. Accordingly, utilities of VGAM64 include diagnosis, prevention and treatment of viral infection by Invertebrate Iridescent Virus 6. Specific functions, and accordingly utilities, of VGAM64 correlate with, and may be deduced from, the identity of the host target genes which VGAM64 binds and inhibits, and the function of these host target genes, as elaborated hereinbelow.

Nucleotide sequences of the VGAM64 precursor RNA, herein designated VGAM PRECURSOR RNA, and of the 'diced' VGAM64 RNA, herein designated VGAM RNA, and a schematic representation of the secondary folding of VGAM64 folded precursor RNA, herein designated VGAM FOLDED PRECURSOR RNA, of VGAM64 are further described hereinbelow with reference to Table 1.

Nucleotide sequences of host target binding sites, such as BINDING SITE-I, BINDING SITE-II and BINDING SITE-III of FIG. 1, found on VGAM64 host target RNA, and schematic representation of the complementarity of each of these host target binding sites to VGAM64 RNA, herein designated VGAM RNA, are described hereinbelow with reference to Table 2.

As mentioned hereinabove with reference to FIG. 1, a function of VGAM64 gene, herein designated VGAM is inhibition of expression of VGAM64 target genes. It is appreciated that specific functions, and accordingly utilities, of VGAM64 correlate with, and may be deduced from, the identity of the target genes which VGAM64 binds and inhibits, and the function of these target genes, as elaborated hereinbelow.

Ankyrin 1, Erythrocytic (ANK1, Accession XM_016774) is a VGAM64 host target gene. ANK1 BINDING SITE is HOST TARGET binding site found in the 3' untranslated region of mRNA encoded by ANK1, corresponding to a HOST TARGET binding site such as BINDING SITE I, BINDING SITE II or BINDING SITE III. Table 2 illustrates the complementarity of the nucleotide sequences of ANK1 BINDING SITE, designated SEQ ID:30284, to the nucleotide sequence of VGAM64 RNA, herein designated VGAM RNA, also designated SEQ ID:2775.

A function of VGAM64 is therefore inhibition of Ankyrin 1, Erythrocytic (ANK1, Accession XM_016774). Accordingly, utilities of VGAM64 include diagnosis, prevention and treatment of diseases and clinical conditions associated with ANK1. ATPase, Class I, Type 8B, Member 2 (ATP8B2, Accession XM_036933) is another VGAM64 host target gene. ATP8B2 BINDING SITE is HOST TARGET binding site found in the 3' untranslated region of mRNA encoded by ATP8B2, corresponding to a HOST TARGET binding site such as BINDING SITE I, BINDING SITE II or BINDING SITE III. Table 2 illustrates the complementarity of the nucleotide sequences of ATP8B2 BINDING SITE, designated SEQ ID:32511, to the nucleotide sequence of VGAM64 RNA, herein designated VGAM RNA, also designated SEQ ID:2775.

Another function of VGAM64 is therefore inhibition of ATPase, Class I, Type 8B, Member 2 (ATP8B2, Accession XM_036933). Accordingly, utilities of VGAM64 include diagnosis, prevention and treatment of diseases and clinical conditions associated with ATP8B2. BLAME (Accession NM_020125) is another VGAM64 host target gene. BLAME BINDING SITE is HOST TARGET binding site found in the 3' untranslated region of mRNA encoded by BLAME, corresponding to a HOST TARGET binding site such as BINDING SITE I, BINDING SITE II or BINDING SITE III. Table 2 illustrates the complementarity of the nucleotide sequences of BLAME BINDING SITE, designated SEQ ID:21306, to the nucleotide sequence of VGAM64 RNA, herein designated VGAM RNA, also designated SEQ ID:2775.

Another function of VGAM64 is therefore inhibition of BLAME (Accession NM_020125). Accordingly, utilities of VGAM64 include diagnosis, prevention and treatment of diseases and clinical conditions associated with BLAME. Caudal Type Homeo Box Transcription Factor 1 (CDX1, Accession NM_001804) is another VGAM64 host target gene. CDX1 BINDING SITE is HOST TARGET binding site found in the 3' untranslated region of mRNA encoded by CDX1, corresponding to a HOST TARGET binding site such as BINDING SITE I, BINDING SITE II or BINDING SITE III. Table 2 illustrates the complementarity of the nucleotide sequences of CDX1 BINDING SITE, designated SEQ ID:7557, to the nucleotide sequence of VGAM64 RNA, herein designated VGAM RNA, also designated SEQ ID:2775.

Another function of VGAM64 is therefore inhibition of Caudal Type Homeo Box Transcription Factor 1 (CDX1, Accession NM_001804), a gene which could play a role in the terminal differentiation of the intestine. Accordingly, utilities of VGAM64 include diagnosis, prevention and treatment of diseases and clinical conditions associated with CDX1. The function of CDX1 has been established by previous studies. CDX1 is a member of the caudal-type homeo box family of genes. These are cognates of the Drosophila 'caudal' gene, which is required for anterior-posterior regional identity. Homologous genes have been found in mouse, rat, chicken, and Xenopus. CDX3 (OMIM Ref. No. 600297) is the human caudal-type homeo box gene located on chromosome 13. The caudal-type homeo box genes are members of the hexapeptide (HEX) superclass, containing a conserved hexapeptide motif upstream of the homeodomain, usually separated from the homeodomain by an intron. Bonner et al. (1995) isolated the human CDX1 gene from a small intestine cDNA library using a murine Cdx1 cDNA probe. The nucleotide sequence of CDX1 was 81% identical to murine Cdx1 and predicted a 265-amino acid protein with 85% identity to the mouse protein (or 98% identity when the conservative amino acid changes were included). The murine Cdx1 gene maps to mouse chromosome 18, near Csfmr and Pdgfrb, in a region of conserved synteny with human 5q31-q33. Bonner et al. (1995) demonstrated that the human cognate of Cdx1 maps to a cosmid contig from 5q31-q33, placing CDX1 approximately 100 kb distal to CSF1R (OMIM Ref. No. 164770). (CSF1R had been mapped to 5q33.2-q33.3.) Northern analysis indicated that expression of CDX1 in adults appears to be limited to the intestine and colon, suggesting a possible role in the terminal differentiation of the intestine. In the mouse, Cdx1 is expressed along the embryonic axis from day 7.5 postcoitum until day 12, by which time the anterior limit of expression has regressed from the hindbrain level to the forelimb bud region. To assign a functional role for Cdx1 in murine embryonic development, Subramanian et al. (1995) inactivated the gene via homologous recombination. Viable fertile homozygous mutant mice were obtained that showed anterior homeotic transformations of vertebrae. These abnormalities were concomitant with posterior shifts of Hox gene expression domains in the somitic mesoderm. The authors stated that the presence of putative Cdx1-binding sites in Hox gene control regions as well as in vitro transactivation of Hoxa7 indicates a direct regulation.

Full details of the abovementioned studies are described in the following publications, the disclosure of which are hereby incorporated by reference:

Subramanian, V.; Meyer, B. I.; Gruss, P.: Disruption of the murine homeobox gene Cdx1 affects axial skeletal identities by altering the mesodermal expression domains of Hox genes. Cell 83:641-653, 1995; and Treacher Collins Syndrome Collaborative Group : Positional cloning of a gene involved in the pathogenesis of Treacher Collins syndrome. Nature Genet. 12:130-136, 1996.

Further studies establishing the function and utilities of CDX1 are found in John Hopkins OMIM database record ID 600746, and in sited publications numbered 7584-758 and 3538 listed in the bibliography section hereinbelow, which are also hereby incorporated by reference. Diacylglycerol O-acyltransferase Homolog 2 (mouse) (DGAT2, Accession NM_032564) is another VGAM64 host target gene. DGAT2 BINDING SITE is HOST TARGET binding site found in the 3' untranslated region of mRNA encoded by DGAT2, corresponding to a HOST TARGET binding site such as BINDING SITE I, BINDING SITE II or BINDING SITE III. Table 2 illustrates the complementarity of the nucleotide sequences of DGAT2 BINDING SITE, designated SEQ ID:26290, to the nucleotide sequence of VGAM64 RNA, herein designated VGAM RNA, also designated SEQ ID:2775.

Another function of VGAM64 is therefore inhibition of Diacylglycerol O-acyltransferase Homolog 2 (mouse) (DGAT2, Accession NM_032564). Accordingly, utilities of VGAM64 include diagnosis, prevention and treatment of diseases and clinical conditions associated with DGAT2. Fucosyltransferase 3 (galactoside 3(4)-L-fucosyltransferase, Lewis Blood Group Included) (FUT3, Accession NM_000149) is another VGAM64 host target gene. FUT3 BINDING SITE is HOST TARGET binding site found in the 5' untranslated region of mRNA encoded by FUT3, corresponding to a HOST TARGET binding site such as BINDING SITE I, BINDING SITE II or BINDING SITE III. Table 2 illustrates the complementarity of the nucleotide sequences of FUT3 BINDING SITE, designated SEQ ID:5647, to the nucleotide sequence of VGAM64 RNA, herein designated VGAM RNA, also designated SEQ ID:2775.

Another function of VGAM64 is therefore inhibition of Fucosyltransferase 3 (galactoside 3(4)-L-fucosyltransferase, Lewis Blood Group Included) (FUT3, Accession NM_000149), a gene which may catalyze alpha-1,3 and alpha-1,4 glycosidic linkages involved in the expression of vim-2, lewis a, lewis b, sialyl lewis x and lewis x/ssea-1 antigens. Accordingly, utilities of VGAM64 include diagnosis, prevention and treatment of diseases and clinical conditions associated with FUT3. The function of FUT3 has been established by previous studies. The Lewis system involves genetically variable antigens in the body fluids and only secondarily are the antigens absorbed to red cells. Grollman et al. (1969) showed that Lewis-negative women lack a specific fucosyltransferase which is present in the milk of Lewis-positive women. The enzyme is apparently required for synthesis of the structural determinants of both Lewis (a) and Lewis (b) specificity. The same enzyme is involved in the synthesis of milk oligosaccharides, because 2 oligosaccharides containing the relevant linkage were absent from the milk of Lewis-negative women. Grubb (1953) provided the ingenious interpretation of the interactions between the Les locus determining presence/absence of Lewis substance in the saliva and on red cells and the Se locus (OMIM Ref. No. 182100) determining secretion of ABH blood group substances in the saliva and Le (a) or Le (b) expression in red cells. In transfusion medicine, it has been found that some individuals who type as Lewis-positive on erythrocytes can change their erythrocyte phenotype to Lewis-negative during diseases or during pregnancy. Orntoft et al. (1996) noted that these patients have been named non-genuine Lewis-negative individuals as they have alpha-1-4 fucosyltransferase activity in saliva. Due to this phenomenon, the Lewis-negative phenotype is more common among cancer patients (approximately 20%) than among healthy individuals (approximately 8%). Orntoft et al. (1996) examined the mutational spectrum of the Lewis gene in Denmark and found 6 different mutations. Five, 59T-G (L20R; 111100.0001), 202T-C (W68R), 314C-T (T105M), 508G-A (G170S; 111100.0001), and 1067T-A (I356K), were frequent, and 1, 445C-A (L146M), was only detected in 1 of 40 individuals. The authors demonstrated that the nucleotide 202 and 314 mutations were located on the same allele. COS-7 cells transfected with an allele having the 202/314 mutations lacked enzyme activity. Lewis-negative patients, whose erythrocytes converted from Lewis-positive to Lewis-negative during their disease, showed FUT3 heterozygosity significantly more often than did others (p less than 0.05). Pang et al. (1998) identified 5 novel missense mutations in the FUT3 gene in African (Xhosa) and Caucasian subjects in South Africa.

Full details of the abovementioned studies are described in the following publications, the disclosure of which are hereby incorporated by reference:

Grollman, E. F.; Kobata, A.; Ginsburg, V.: An enzymatic basis for Lewis blood types in man. J. Clin. Invest. 48:1489-1494, 1969; and Orntoft, T. F.; Vestergaard, E. M.; Holmes, E.; Jakobsen, J. S.; Grunnet, N.; Mortensen, M.; Johnson, P.; Bross, P.; Gregersen, N.; Skorstengaard, K.; Jensen, U. B.; Bolund, L.; Wolf, H.

Further studies establishing the function and utilities of FUT3 are found in John Hopkins OMIM database record ID 111100, and in sited publications numbered 10702, 10703-24 and 3780-244 listed in the bibliography section hereinbelow, which are also hereby incorporated by reference. Fucosyltransferase 8 (alpha (1,6) Fucosyltransferase) (FUT8, Accession NM_004480) is another VGAM64 host target gene. FUT8 BINDING SITE is HOST TARGET binding site found in the 3' untranslated region of mRNA encoded by FUT8, corresponding to a HOST TARGET binding site such as BINDING SITE I, BINDING SITE II or BINDING SITE III. Table 2 illustrates the complementarity of the nucleotide sequences of FUT8 BINDING SITE, designated SEQ ID:10796, to the nucleotide sequence of VGAM64 RNA, herein designated VGAM RNA, also designated SEQ ID:2775.

Another function of VGAM64 is therefore inhibition of Fucosyltransferase 8 (alpha (1,6) Fucosyltransferase) (FUT8, Accession NM_004480), a gene which transfers fucose to N-linked type complex glycopeptides from GDP-Fuc; functions in asparagine-linked glycoprotein oligosaccharide synthesis. Accordingly, utilities of VGAM64 include diagnosis, prevention and treatment of diseases and clinical conditions associated with FUT8. The function of FUT8 has been established by previous studies. Alpha-1,6-fucosyltransferase catalyzes the transfer of fucose to N-linked glycopeptides. Yanagidani et al. (1997) purified a 60-kD alpha-1,6-fucosyltransferase from a human gastric cancer cell line and used peptide sequences to clone the FUT8 cDNA. The gene encodes a 575-amino acid polypeptide that has little sequence homology to other human fucosyltransferases. Costache et al. (1997) analyzed FUT sequences in the GenBank expressed sequence tag (EST) database and noted that FUT8 is represented more frequently, possibly indicating that it has a higher level of expression than other FUT genes. They also identified a slightly longer alternatively spliced variant of FUT8 from retina cDNA libraries. Costache et al. (1997) reviewed the evolutionary relationships among known fucosyltransferase genes. The phylogenetic branch point for FUT8 was the oldest.

Full details of the abovementioned studies are described in the following publications, the disclosure of which are hereby incorporated by reference:

Costache, M.; Apoil, P.-A.; Cailleau, A.; Elmgren, A.; Larson, G.; Henry, S.; Blancher, A.; Iordachescu, D.; Oriol, R.; Mollicone, R.: Evolution of fucosyltransferase genes in vertebrates. J. Biol. Chem. 272:29721-29728, 1997; and Yanagidani, S.; Uozumi, N.; Ihara, Y.; Miyoshi, E.; Yamaguchi, N.; Taniguchi, N.: Purification and cDNA cloning of GDP-L-Fuc:N-acetyl-beta-D-glucosaminide:alpha-1-6 fucosyltransferase.

Further studies establishing the function and utilities of FUT8 are found in John Hopkins OMIM database record ID 602589, and in sited publications numbered 8635-8636 listed in the bibliography section hereinbelow, which are also hereby incorporated by reference. Gap Junction Protein, Alpha 5, 40 kDa (connexin 40) (GJA5, Accession XM_059147) is another VGAM64 host target gene. GJA5 BINDING SITE is HOST TARGET binding site found in the 5' untranslated region of mRNA encoded by GJA5, corresponding to a HOST TARGET binding site such as BINDING SITE I, BINDING SITE II or BINDING SITE III. Table 2 illustrates the complementarity of the nucleotide sequences of GJA5 BINDING SITE, designated SEQ ID:36902, to the nucleotide sequence of VGAM64 RNA, herein designated VGAM RNA, also designated SEQ ID:2775.

Another function of VGAM64 is therefore inhibition of Gap Junction Protein, Alpha 5, 40 kDa (connexin 40) (GJA5, Accession XM_059147), a gene which may facilitate cardiac impulse conduction. Accordingly, utilities of VGAM64 include diagnosis, prevention and treatment of diseases and clinical conditions associated with GJA5. The function of GJA5 has been established by previous studies. See 121011 for a general discussion of the connexin gene family. Kanter et al. (1992) demonstrated that canine ventricular myocytes express 3 distinct gap junction proteins, Cx40, Cx43 (GJA1; 121013), and Cx45. Kanter et al. (1994) used PCR with primers based on rat and dog Cx40 to clone human CX40. The CX40 gene has a 5-prime untranslated exon and 1 coding exon, and encodes a predicted 358-amino acid protein whose sequence is 82% identical to that of the rat and mouse CX40 protein. Northern blot analysis showed that CX40 mRNA is expressed as an approximately 3.3-kb transcript in ventricular myocardium. In immunofluorescence studies, CX40 localized to intercalated disc regions of the left ventricle, which join cardiac myocytes and contain gap junctions. The migration of lymphocytes from the circulation into tissues involves a number of adhesion molecules and the expression of new molecules. Gap junctions facilitate cell-to-cell adhesion and provide pathways for direct intercellular communication. Oviedo-Orta et al. (2000) noted that GJA1 is expressed in a number of lymphoid organs. By RT-PCR, Western blot, and flow cytometric analyses, they showed that lymphocytes express GJA1 and GJA5, but not GJB2 (OMIM Ref. No. 121011), GJB1 (OMIM Ref. No. 304040), GJA4 (OMIM Ref. No. 121012), or GJA7; GJA5 expression was restricted to tonsillar T and B lymphocytes. Flow cytometric analysis showed that GJA1 and GJA5 expression increases after mitogenic stimulation. Extracellular connexin mimetic peptide blocked dye transfer between lymphocyte subpopulations, and gap junction inhibitors decreased the production of IgM in cocultured T and B lymphocytes. The results identified gap junction proteins as important cell surface components that modulate immune responses.

Full details of the abovementioned studies are described in the following publications, the disclosure of which are hereby incorporated by reference:

Kanter, H. L.; Saffitz, J. E.; Beyer, E. C.: Cardiac myocytes express multiple gap junction proteins. Circ. Res. 70:438-444, 1992; and Oviedo-Orta, E.; Hoy, T.; Evans, W. H.: Intercellular communication in the immune system: differential expression of connexin 40 and 43, and perturbation of gap junction channel function.

Further studies establishing the function and utilities of GJA5 are found in John Hopkins OMIM database record ID 121013, and in sited publications numbered 11840-1184 and 11839 listed in the bibliography section hereinbelow, which are also hereby incorporated by reference. Inositol Polyphosphate-5-phosphatase, 145 kDa (INPP5D, Accession XM_096169) is another VGAM64 host target gene. INPP5D BINDING SITE is HOST TARGET binding site found in the 3' untranslated region of mRNA encoded by INPP5D, corresponding to a HOST TARGET binding site such as BINDING SITE I, BINDING SITE II or BINDING SITE III. Table 2 illustrates the complementarity of the nucleotide sequences of INPP5D BINDING SITE, designated SEQ ID:40306, to the nucleotide sequence of VGAM64 RNA, herein designated VGAM RNA, also designated SEQ ID:2775.

Another function of VGAM64 is therefore inhibition of Inositol Polyphosphate-5-phosphatase, 145 kDa (INPP5D, Accession XM_096169), a gene which hydrolyzes Ins (1,3,4,5)P4 and PtdIns (3,4,5)P3; contains an SH2-domain. Accordingly, utilities of VGAM64 include diagnosis, prevention and treatment of diseases and clinical conditions associated with INPP5D. The function of INPP5D has been established by previous studies. The phosphatidylinositols serve as precursors for a number of different messenger molecules. Agonist stimulation of cells results in phosphatidylinositol turnover and the generation of inositol 1,4,5-triphosphate (Ins (1,4,5)P3), which mobilizes intracellular calcium. The inositol-polyphosphate 5-phosphatase (INPP5) enzymes hydrolyze Ins (1,4,5)P3 in a signal-terminating reaction. Known INPP5s include the 40-kD INPP5A (OMIM Ref. No. 600106), the 75-kD INPP5B (OMIM Ref. No. 147264), and the enzyme associated with Lowe oculocerebrorenal syndrome (OMIM Ref. No. 309000). Damen et al. (1996) cloned and sequenced a cDNA encoding a 145-kD protein from a mouse hematopoietic cell line; the protein became tyrosine phosphorylated and associated with SHC (OMIM Ref. No. 600560) after cytokine stimulation. Based on its domains and enzymatic activity, Damen et al. (1996) named this protein SHIP for 'SH2-containing inositol phosphatase Liu et al. (1998) studied the expression of the Ship gene during mouse development. They found that the gene is expressed in late primitive-streak stage embryos (7.5 days post coitum), when hematopoiesis is thought to begin, and the expression is restricted to the hematopoietic lineage. In adult mice, Ship expression continues in most cells of hematopoietic origin, including granulocytes, monocytes, and lymphocytes, and is also found in the spermatids of the testis. Furthermore, the level of Ship expression is developmentally regulated during T-cell maturation. These results suggested a possible role for Ship in the differentiation and maintenance of the hematopoietic lineages and in spermatogenesis Animal model experiments lend further support to the function of INPP5D.

Because Ship -/- mice contain increased numbers of osteoclast precursors, i.e., macrophages, Takeshita et al. (2002) examined bones from these animals and found that osteoclast number was increased 2-fold. The increased number was the result of prolonged lifespan of these cells and hypersensitivity of precursors to macrophage colony-stimulating factor (MCSF; 120420) and receptor activator of nuclear factor-kappa-B ligand (RANKL; 602642). Similar to the osteoclasts of Paget disease of bone (OMIM Ref. No. 602080), Ship -/- osteoclasts were enlarged, containing upwards of 100 nuclei, and exhibited enhanced resorptive activity. Moreover, as in Paget disease, serum levels of interleukin-6 (OMIM Ref. No. 147620) were markedly increased in Ship -/- mice. Consistent with accelerated resorptive activity, a 22% loss of bone-mineral density and a 49% decrease in fracture energy were observed. Thus, SHIP negatively regulates osteoclast formation and function, and the absence of this enzyme results in severe osteoporosis It is appreciated that the abovementioned animal model for INPP5D is acknowledged by those skilled in the art as a scientifically valid animal model, as can be further appreciated from the publications sited hereinbelow.

Full details of the abovementioned studies are described in the following publications, the disclosure of which are hereby incorporated by reference:

Liu, Q.; Shalaby, F.; Jones, J.; Bouchard, D.; Dumont, D. J.: The SH2-containing inositol polyphosphate 5-phosphatase, Ship, is expressed during hematopoiesis and spermatogenesis. Blood 91:2753-2759, 1998. ; and Takeshita, S.; Namba, N.; Zhao, J. J.; Jiang, Y.; Genant, H. K.; Silva, M. J.; Brodt, M. D.; Helgason, C. D.; Kalesnikoff, J.; Rauh, M. J.; Humphries, R. K.; Krystal, G.; Teitelbaum, S.

Further studies establishing the function and utilities of INPP5D are found in John Hopkins OMIM database record ID 601582, and in sited publications numbered 6540-6550 listed in the bibliography section hereinbelow, which are also hereby incorporated by reference. Phosphorylase, Glycogen; Brain (PYGB, Accession NM_002862) is another VGAM64 host target gene. PYGB BINDING SITE is HOST TARGET binding site found in the 3' untranslated region of mRNA encoded by PYGB, corresponding to a HOST TARGET binding site such as BINDING SITE I, BINDING SITE II or BINDING SITE III. Table 2 illustrates the complementarity of the nucleotide sequences of PYGB BINDING SITE, designated SEQ ID:8768, to the nucleotide sequence of VGAM64 RNA, herein designated VGAM RNA, also designated SEQ ID:2775.

Another function of VGAM64 is therefore inhibition of Phosphorylase, Glycogen; Brain (PYGB, Accession NM_002862). Accordingly, utilities of VGAM64 include diagnosis, prevention and treatment of diseases and clinical conditions associated with PYGB. Syntrophin, Beta 2 (dystrophin-associated protein A1, 59 kDa, basic component 2) (SNTB2, Accession NM_130845) is another VGAM64 host target gene. SNTB2 BINDING SITE is HOST TARGET binding site found in the 3' untranslated region of mRNA encoded by SNTB2, corresponding to a HOST TARGET binding site such as BINDING SITE I, BINDING SITE II or BINDING SITE III. Table 2 illustrates the complementarity of the nucleotide sequences of SNTB2 BINDING SITE, designated SEQ ID:28378, to the nucleotide sequence of VGAM64 RNA, herein designated VGAM RNA, also designated SEQ ID:2775.

Another function of VGAM64 is therefore inhibition of Syntrophin, Beta 2 (dystrophin-associated protein A1, 59 kDa, basic component 2) (SNTB2, Accession NM_130845). Accordingly, utilities of VGAM64 include diagnosis, prevention and treatment of diseases and clinical conditions associated with SNTB2. Tissue Inhibitor of Metalloproteinase 3 (Sorsby fundus dystrophy, pseudoinflammatory) (TIMP3, Accession NM_000362) is another VGAM64 host target gene. TIMP3 BINDING SITE is HOST TARGET binding site found in the 3' untranslated region of mRNA encoded by TIMP3, corresponding to a HOST TARGET binding site such as BINDING SITE I, BINDING SITE II or BINDING SITE III. Table 2 illustrates the complementarity of the nucleotide sequences of TIMP3 BINDING SITE, designated SEQ ID:5933, to the nucleotide sequence of VGAM64 RNA, herein designated VGAM RNA, also designated SEQ ID:2775.

Another function of VGAM64 is therefore inhibition of Tissue Inhibitor of Metalloproteinase 3 (Sorsby fundus dystrophy, pseudoinflammatory) (TIMP3, Accession NM_000362). Accordingly, utilities of VGAM64 include diagnosis, prevention and treatment of diseases and clinical conditions associated with TIMP3. Adaptor-related Protein Complex 3, Delta 1 Subunit (AP3D1, Accession NM_003938) is another VGAM64 host target gene. AP3D1 BINDING SITE is HOST TARGET binding site found in the 5' untranslated region of mRNA encoded by AP3D1, corresponding to a HOST TARGET binding site such as BINDING SITE I, BINDING SITE II or BINDING SITE III. Table 2 illustrates the complementarity of the nucleotide sequences of AP3D1 BINDING SITE, designated SEQ ID:10049, to the nucleotide sequence of VGAM64 RNA, herein designated VGAM RNA, also designated SEQ ID:2775.

Another function of VGAM64 is therefore inhibition of Adaptor-related Protein Complex 3, Delta 1 Subunit (AP3D1, Accession NM_003938). Accordingly, utilities of VGAM64 include diagnosis, prevention and treatment of diseases and clinical conditions associated with AP3D1. Bromodomain Containing 2 (BRD2, Accession NM_005104) is another VGAM64 host target gene. BRD2 BINDING SITE is HOST TARGET binding site found in the 5' untranslated region of mRNA encoded by BRD2, corresponding to a HOST TARGET binding site such as BINDING SITE I, BINDING SITE II or BINDING SITE III. Table 2 illustrates the complementarity of the nucleotide sequences of BRD2 BINDING SITE, designated SEQ ID:11574, to the nucleotide sequence of VGAM64 RNA, herein designated VGAM RNA, also designated SEQ ID:2775.

Another function of VGAM64 is therefore inhibition of Bromodomain Containing 2 (BRD2, Accession NM_005104). Accordingly, utilities of VGAM64 include diagnosis, prevention and treatment of diseases and clinical conditions associated with BRD2. Chromosome 17 Open Reading Frame 31 (C17orf31, Accession NM_017575) is another VGAM64 host target gene. C17orf31 BINDING SITE is HOST TARGET binding site found in the 3' untranslated region of mRNA encoded by C17orf31, corresponding to a HOST TARGET binding site such as BINDING SITE I, BINDING SITE II or BINDING SITE III. Table 2 illustrates the complementarity of the nucleotide sequences of C17orf31 BINDING SITE, designated SEQ ID:19001, to the nucleotide sequence of VGAM64 RNA, herein designated VGAM RNA, also designated SEQ ID:2775.

Another function of VGAM64 is therefore inhibition of Chromosome 17 Open Reading Frame 31 (C17orf31, Accession NM_017575). Accordingly, utilities of VGAM64 include diagnosis, prevention and treatment of diseases and clinical conditions associated with C17orf31. CG018 (Accession NM_052818) is another VGAM64 host target gene. CG018 BINDING SITE is HOST TARGET binding site found in the 5' untranslated region of mRNA encoded by CG018, corresponding to a HOST TARGET binding site such as BINDING SITE I, BINDING SITE II or BINDING SITE III. Table 2 illustrates the complementarity of the nucleotide sequences of CG018 BINDING SITE, designated SEQ ID:27403, to the nucleotide sequence of VGAM64 RNA, herein designated VGAM RNA, also designated SEQ ID:2775.

Another function of VGAM64 is therefore inhibition of CG018 (Accession NM_052818). Accordingly, utilities of VGAM64 include diagnosis, prevention and treatment of diseases and clinical conditions associated with CG018. DKFZp434F142 (Accession NM_032254) is another VGAM64 host target gene. DKFZp434F142 BINDING SITE is HOST TARGET binding site found in the 3' untranslated region of mRNA encoded by DKFZp434F142, corresponding to a HOST TARGET binding site such as BINDING SITE I, BINDING SITE II or BINDING SITE III. Table 2 illustrates the complementarity of the nucleotide sequences of DKFZp434F142 BINDING SITE, designated SEQ ID:25994, to the nucleotide sequence of VGAM64 RNA, herein designated VGAM RNA, also designated SEQ ID:2775.

Another function of VGAM64 is therefore inhibition of DKFZp434F142 (Accession NM_032254). Accordingly, utilities of VGAM64 include diagnosis, prevention and treatment of diseases and clinical conditions associated with DKFZp434F142. DnaJ (Hsp40) Homolog, Subfamily C, Member 5 (DNAJC5, Accession XM_028966) is another VGAM64 host target gene. DNAJC5 BINDING SITE is HOST TARGET binding site found in the 3' untranslated region of mRNA encoded by DNAJC5, corresponding to a HOST TARGET binding site such as BINDING SITE I, BINDING SITE II or BINDING SITE III. Table 2 illustrates the complementarity of the nucleotide sequences of DNAJC5 BINDING SITE, designated SEQ ID:30812, to the nucleotide sequence of VGAM64 RNA, herein designated VGAM RNA, also designated SEQ ID:2775.

Another function of VGAM64 is therefore inhibition of DnaJ (Hsp40) Homolog, Subfamily C, Member 5 (DNAJC5, Accession XM_028966). Accordingly, utilities of VGAM64 include diagnosis, prevention and treatment of diseases and clinical conditions associated with DNAJC5. FLJ11506 (Accession NM_024666) is another VGAM64 host target gene. FLJ11506 BINDING SITE is HOST TARGET binding site found in the 3' untranslated region of mRNA encoded by FLJ11506, corresponding to a HOST TARGET binding site such as BINDING SITE I, BINDING SITE II or BINDING SITE III. Table 2 illustrates the complementarity of the nucleotide sequences of FLJ11506 BINDING SITE, designated SEQ ID:23967, to the nucleotide sequence of VGAM64 RNA, herein designated VGAM RNA, also designated SEQ ID:2775.

Another function of VGAM64 is therefore inhibition of FLJ11506 (Accession NM_024666). Accordingly, utilities of VGAM64 include diagnosis, prevention and treatment of diseases and clinical conditions associated with FLJ11506. FLJ12190 (Accession NM_025071) is another VGAM64 host target gene. FLJ12190 BINDING SITE is HOST TARGET binding site found in the 3' untranslated region of mRNA encoded by FLJ12190, corresponding to a HOST TARGET binding site such as BINDING SITE I, BINDING SITE II or BINDING SITE III. Table 2 illustrates the complementarity of the nucleotide sequences of FLJ12190 BINDING SITE, designated SEQ ID:24667, to the nucleotide sequence of VGAM64 RNA, herein designated VGAM RNA, also designated SEQ ID:2775.

Another function of VGAM64 is therefore inhibition of FLJ12190 (Accession NM_025071). Accordingly, utilities of VGAM64 include diagnosis, prevention and treatment of diseases and clinical conditions associated with FLJ12190. FLJ14816 (Accession NM_032845) is another VGAM64 host target gene. FLJ14816 BINDING SITE is HOST TARGET binding site found in the 3' untranslated region of mRNA encoded by FLJ14816, corresponding to a HOST TARGET binding site such as BINDING SITE I, BINDING SITE II or BINDING SITE III. Table 2 illustrates the complementarity of the nucleotide sequences of FLJ14816 BINDING SITE, designated SEQ ID:26638, to the nucleotide sequence of VGAM64 RNA, herein designated VGAM RNA, also designated SEQ ID:2775.

Another function of VGAM64 is therefore inhibition of FLJ14816 (Accession NM_032845). Accordingly, utilities of VGAM64 include diagnosis, prevention and treatment of diseases and clinical conditions associated with FLJ14816. Interleukin 14 (IL14, Accession XM_170924) is another VGAM64 host target gene. IL14 BINDING SITE is HOST TARGET binding site found in the 5' untranslated region of mRNA encoded by IL14, corresponding to a HOST TARGET binding site such as BINDING SITE I, BINDING SITE II or BINDING SITE III. Table 2 illustrates the complementarity of the nucleotide sequences of IL14 BINDING SITE, designated SEQ ID:45704, to the nucleotide sequence of VGAM64 RNA, herein designated VGAM RNA, also designated SEQ ID:2775.

Another function of VGAM64 is therefore inhibition of Interleukin 14 (IL14, Accession XM_170924). Accordingly, utilities of VGAM64 include diagnosis, prevention and treatment of diseases and clinical conditions associated with IL14. KIAA0265 (Accession XM_045954) is another VGAM64 host target gene. KIAA0265 BINDING SITE is HOST TARGET binding site found in the 3' untranslated region of mRNA encoded by KIAA0265, corresponding to a HOST TARGET binding site such as BINDING SITE I, BINDING SITE II or BINDING SITE III. Table 2 illustrates the complementarity of the nucleotide sequences of KIAA0265 BINDING SITE, designated SEQ ID:34628, to the nucleotide sequence of VGAM64 RNA, herein designated VGAM RNA, also designated SEQ ID:2775.

Another function of VGAM64 is therefore inhibition of KIAA0265 (Accession XM_045954). Accordingly, utilities of VGAM64 include diagnosis, prevention and treatment of diseases and clinical conditions associated with KIAA0265. KIAA0495 (Accession XM_031397) is another VGAM64 host target gene. KIAA0495 BINDING SITE is HOST TARGET binding site found in the 5' untranslated region of mRNA encoded by KIAA0495, corresponding to a HOST TARGET binding site such as BINDING SITE I, BINDING SITE II or BINDING SITE III. Table 2 illustrates the complementarity of the nucleotide sequences of KIAA0495 BINDING SITE, designated SEQ ID:31363, to the nucleotide sequence of VGAM64 RNA, herein designated VGAM RNA, also designated SEQ ID:2775.

Another function of VGAM64 is therefore inhibition of KIAA0495 (Accession XM_031397). Accordingly, utilities of VGAM64 include diagnosis, prevention and treatment of diseases and clinical conditions associated with KIAA0495. KIAA1045 (Accession XM_048592) is another VGAM64 host target gene. KIAA1045 BINDING SITE is HOST TARGET binding site found in the 3' untranslated region of mRNA encoded by KIAA1045, corresponding to a HOST TARGET binding site such as BINDING SITE I, BINDING SITE II or BINDING SITE III. Table 2 illustrates the complementarity of the nucleotide sequences of KIAA1045 BIND- ING SITE, designated SEQ ID:35200, to the nucleotide sequence of VGAM64 RNA, herein designated VGAM RNA, also designated SEQ ID:2775.

Another function of VGAM64 is therefore inhibition of KIAA1045 (Accession XM_048592). Accordingly, utilities of VGAM64 include diagnosis, prevention and treatment of diseases and clinical conditions associated with KIAA1045. KIAA1529 (Accession XM_047336) is another VGAM64 host target gene. KIAA1529 BINDING SITE is HOST TARGET binding site found in the 5' untranslated region of mRNA encoded by KIAA1529, corresponding to a HOST TARGET binding site such as BINDING SITE I, BINDING SITE II or BINDING SITE III. Table 2 illustrates the complementarity of the nucleotide sequences of KIAA1529 BINDING SITE, designated SEQ ID:34948, to the nucleotide sequence of VGAM64 RNA, herein designated VGAM RNA, also designated SEQ ID:2775.

Another function of VGAM64 is therefore inhibition of KIAA1529 (Accession XM_047336). Accordingly, utilities of VGAM64 include diagnosis, prevention and treatment of diseases and clinical conditions associated with KIAA1529. KIAA1719 (Accession XM_042936) is another VGAM64 host target gene. KIAA1719 BINDING SITE is HOST TARGET binding site found in the 5' untranslated region of mRNA encoded by KIAA1719, corresponding to a HOST TARGET binding site such as BINDING SITE I, BINDING SITE II or BINDING SITE III. Table 2 illustrates the complementarity of the nucleotide sequences of KIAA1719 BINDING SITE, designated SEQ ID:33819, to the nucleotide sequence of VGAM64 RNA, herein designated VGAM RNA, also designated SEQ ID:2775.

Another function of VGAM64 is therefore inhibition of KIAA1719 (Accession XM_042936). Accordingly, utilities of VGAM64 include diagnosis, prevention and treatment of diseases and clinical conditions associated with KIAA1719. LRG (Accession NM_052972) is another VGAM64 host target gene. LRG BINDING SITE is HOST TARGET binding site found in the 3' untranslated region of mRNA encoded by LRG, corresponding to a HOST TARGET binding site such as BINDING SITE I, BINDING SITE II or BINDING SITE III. Table 2 illustrates the complementarity of the nucleotide sequences of LRG BINDING SITE, designated SEQ ID:27547, to the nucleotide sequence of VGAM64 RNA, herein designated VGAM RNA, also designated SEQ ID:2775.

Another function of VGAM64 is therefore inhibition of LRG (Accession NM_052972). Accordingly, utilities of VGAM64 include diagnosis, prevention and treatment of diseases and clinical conditions associated with LRG. MGC23980 (Accession NM_145005) is another VGAM64 host target gene. MGC23980 BINDING SITE is HOST TARGET binding site found in the 3" untranslated region of mRNA encoded by MGC23980, corresponding to a HOST TARGET binding site such as BINDING SITE I, BINDING SITE II or BINDING SITE III. Table 2 illustrates the complementarity of the nucleotide sequences of MGC23980 BINDING SITE, designated SEQ ID:29607, to the nucleotide sequence of VGAM64 RNA, herein designated VGAM RNA, also designated SEQ ID:2775.

Another function of VGAM64 is therefore inhibition of MGC23980 (Accession NM_145005). Accordingly, utilities of VGAM64 include diagnosis, prevention and treatment of diseases and clinical conditions associated with MGC23980. Mitochondrial Ribosomal Protein S10 (MRPS10, Accession NM_018141) is another VGAM64 host target gene. MRPS10 BINDING SITE is HOST TARGET binding site found in the 3' untranslated region of mRNA encoded by MRPS10, corresponding to a HOST TARGET binding site such as BINDING SITE I, BINDING SITE II or BINDING SITE III. Table 2 illustrates the complementarity of the nucleotide sequences of MRPS10 BINDING SITE, designated SEQ ID:19939, to the nucleotide sequence of VGAM64 RNA, herein designated VGAM RNA, also designated SEQ ID:2775.

Another function of VGAM64 is therefore inhibition of Mitochondrial Ribosomal Protein S10 (MRPS10, Accession NM_018141). Accordingly, utilities of VGAM64 include diagnosis, prevention and treatment of diseases and clinical conditions associated with MRPS10. Nei Like 2 (E. coli) (NEIL2, Accession NM_145043) is another VGAM64 host target gene. NEIL2 BINDING SITE is HOST TARGET binding site found in the 3' untranslated region of mRNA encoded by NEIL2, corresponding to a HOST TARGET binding site such as BINDING SITE I, BINDING SITE II or BINDING SITE III. Table 2 illustrates the complementarity of the nucleotide sequences of NEIL2 BINDING SITE, designated SEQ ID:29673, to the nucleotide sequence of VGAM64 RNA, herein designated VGAM RNA, also designated SEQ ID:2775.

Another function of VGAM64 is therefore inhibition of Nei Like 2 (E. coli) (NEIL2, Accession NM_145043). Accordingly, utilities of VGAM64 include diagnosis, prevention and treatment of diseases and clinical conditions associated with NEIL2. Protein Kinase C and Casein Kinase Substrate In Neurons 2 (PACSIN2, Accession NM_007229) is another VGAM64 host target gene. PACSIN2 BINDING SITE is HOST TARGET binding site found in the 3' untranslated region of mRNA encoded by PACSIN2, corresponding to a HOST TARGET binding site such as BINDING SITE I, BINDING SITE II or BINDING SITE III. Table 2 illustrates the complementarity of the nucleotide sequences of PACSIN2 BINDING SITE, designated SEQ ID:14096, to the nucleotide sequence of VGAM64 RNA, herein designated VGAM RNA, also designated SEQ ID:2775.

Another function of VGAM64 is therefore inhibition of Protein Kinase C and Casein Kinase Substrate In Neurons 2 (PACSIN2, Accession NM_007229). Accordingly, utilities of VGAM64 include diagnosis, prevention and treatment of diseases and clinical conditions associated with PACSIN2. PTK6 Protein Tyrosine Kinase 6 (PTK6, Accession NM_005975) is another VGAM64 host target gene. PTK6 BINDING SITE is HOST TARGET binding site found in the 3' untranslated region of mRNA encoded by PTK6, corresponding to a HOST TARGET binding site such as BINDING SITE I, BINDING SITE II or BINDING SITE III. Table 2 illustrates the complementarity of the nucleotide sequences of PTK6 BINDING SITE, designated SEQ ID:12599, to the nucleotide sequence of VGAM64 RNA, herein designated VGAM RNA, also designated SEQ ID:2775.

Another function of VGAM64 is therefore inhibition of PTK6 Protein Tyrosine Kinase 6 (PTK6, Accession NM_005975). Accordingly, utilities of VGAM64 include diagnosis, prevention and treatment of diseases and clinical conditions associated with PTK6. TAO1 (Accession NM_004783) is another VGAM64 host target gene. TAO1 BINDING SITE is HOST TARGET binding site found in the 3' untranslated region of mRNA encoded by TAO1, corresponding to a HOST TARGET binding site such as BINDING SITE I, BINDING SITE II or BINDING SITE III. Table 2 illustrates the complementarity of the nucleotide sequences of TAO1 BINDING SITE, designated SEQ ID:11190, to the nucleotide sequence of VGAM64 RNA, herein designated VGAM RNA, also designated SEQ ID:2775.

Another function of VGAM64 is therefore inhibition of TAO1 (Accession NM_004783). Accordingly, utilities of VGAM64 include diagnosis, prevention and treatment of diseases and clinical conditions associated with TAO1. LOC123591 (Accession XM_063741) is another VGAM64 host target gene. LOC123591 BINDING SITE is HOST TARGET binding site found in the 3' untranslated region of mRNA encoded by LOC123591, corresponding to a HOST TARGET binding site such as BINDING SITE I, BINDING SITE II or BINDING SITE III. Table 2 illustrates the complementarity of the nucleotide sequences of LOC123591 BINDING SITE, designated SEQ ID:37251, to the nucleotide sequence of VGAM64 RNA, herein designated VGAM RNA, also designated SEQ ID:2775.

Another function of VGAM64 is therefore inhibition of LOC123591 (Accession XM_063741). Accordingly, utilities of VGAM64 include diagnosis, prevention and treatment of diseases and clinical conditions associated with LOC123591. LOC143286 (Accession XM_096412) is another VGAM64 host target gene. LOC143286 BINDING SITE is HOST TARGET binding site found in the 5' untranslated region of mRNA encoded by LOC143286, corresponding to a HOST TARGET binding site such as BINDING SITE I, BINDING SITE II or BINDING SITE III. Table 2 illustrates the complementarity of the nucleotide sequences of LOC143286 BINDING SITE, designated SEQ ID:40356, to the nucleotide sequence of VGAM64 RNA, herein designated VGAM RNA, also designated SEQ ID:2775.

Another function of VGAM64 is therefore inhibition of LOC143286 (Accession XM_096412). Accordingly, utilities of VGAM64 include diagnosis, prevention and treatment of diseases and clinical conditions associated with LOC143286. LOC150271 (Accession XM_097859) is another VGAM64 host target gene. LOC150271 BINDING SITE is HOST TARGET binding site found in the 5' untranslated region of mRNA encoded by LOC150271, corresponding to a HOST TARGET binding site such as BINDING SITE I, BINDING SITE II or BINDING SITE III. Table 2 illustrates the complementarity of the nucleotide sequences of LOC150271 BINDING SITE, designated SEQ ID:41175, to the nucleotide sequence of VGAM64 RNA, herein designated VGAM RNA, also designated SEQ ID:2775.

Another function of VGAM64 is therefore inhibition of LOC150271 (Accession XM_097859). Accordingly, utilities of VGAM64 include diagnosis, prevention and treatment of diseases and clinical conditions associated with LOC150271. LOC151176 (Accession XM_098016) is another VGAM64 host target gene. LOC151176 BINDING SITE is HOST TARGET binding site found in the 5' untranslated region of mRNA encoded by LOC151176, corresponding to a HOST TARGET binding site such as BINDING SITE I, BINDING SITE II or BINDING SITE III. Table 2 illustrates the complementarity of the nucleotide sequences of LOC151176 BINDING SITE, designated SEQ ID:41315, to the nucleotide sequence of VGAM64 RNA, herein designated VGAM RNA, also designated SEQ ID:2775.

Another function of VGAM64 is therefore inhibition of LOC151176 (Accession XM_098016). Accordingly, utilities of VGAM64 include diagnosis, prevention and treatment of diseases and clinical conditions associated with LOC151176. LOC196478 (Accession XM_113729) is another VGAM64 host target gene. LOC196478 BINDING SITE is HOST TARGET binding site found in the 5' untranslated region of mRNA encoded by LOC196478, corresponding to a HOST TARGET binding site such as BINDING SITE I, BINDING SITE II or BINDING SITE III. Table 2 illustrates the complementarity of the nucleotide sequences of LOC196478 BINDING SITE, designated SEQ ID:42379, to the nucleotide sequence of VGAM64 RNA, herein designated VGAM RNA, also designated SEQ ID:2775.

Another function of VGAM64 is therefore inhibition of LOC196478 (Accession XM_113729). Accordingly, utilities of VGAM64 include diagnosis, prevention and treatment of diseases and clinical conditions associated with LOC196478. LOC254268 (Accession XM_170913) is another VGAM64 host target gene. LOC254268 BINDING SITE is HOST TARGET binding site found in the 3' untranslated region of mRNA encoded by LOC254268, corresponding to a HOST TARGET binding site such as BINDING SITE I, BINDING SITE II or BINDING SITE III. Table 2 illustrates the complementarity of the nucleotide sequences of LOC254268 BINDING SITE, designated SEQ ID:45692, to the nucleotide sequence of VGAM64 RNA, herein designated VGAM RNA, also designated SEQ ID:2775.

Another function of VGAM64 is therefore inhibition of LOC254268 (Accession XM_170913). Accordingly, utilities of VGAM64 include diagnosis, prevention and treatment of diseases and clinical conditions associated with LOC254268. LOC56912 (Accession NM_020153) is another VGAM64 host target gene. LOC56912 BINDING SITE is HOST TARGET binding site found in the 5' untranslated region of mRNA encoded by LOC56912, corresponding to a HOST TARGET binding site such as BINDING SITE I, BINDING SITE II or BINDING SITE III. Table 2 illustrates the complementarity of the nucleotide sequences of LOC56912 BINDING SITE, designated SEQ ID:21364, to the nucleotide sequence of VGAM64 RNA, herein designated VGAM RNA, also designated SEQ ID:2775.

Another function of VGAM64 is therefore inhibition of LOC56912 (Accession NM_020153). Accordingly, utilities of VGAM64 include diagnosis, prevention and treatment of diseases and clinical conditions associated with LOC56912. LOC92710 (Accession XM_046811) is another VGAM64 host target gene. LOC92710 BINDING SITE is HOST TARGET binding site found in the 3' untranslated region of mRNA encoded by LOC92710, corresponding to a HOST TARGET binding site such as BINDING SITE I, BINDING SITE II or BINDING SITE III. Table 2 illustrates the complementarity of the nucleotide sequences of LOC92710 BINDING SITE, designated SEQ ID:34834, to the nucleotide sequence of VGAM64 RNA, herein designated VGAM RNA, also designated SEQ ID:2775.

Another function of VGAM64 is therefore inhibition of LOC92710 (Accession XM_046811). Accordingly, utilities of VGAM64 include diagnosis, prevention and treatment of diseases and clinical conditions associated with LOC92710. LOC93190 (Accession XM_049705) is another VGAM64 host target gene. LOC93190 BINDING SITE is HOST TARGET binding site found in the 5' untranslated region of mRNA encoded by LOC93190, corresponding to a HOST TARGET binding site such as BINDING SITE I, BINDING SITE II or BINDING SITE III. Table 2 illustrates the complementarity of the nucleotide sequences of LOC93190 BINDING SITE, designated SEQ ID:35488, to the nucleotide sequence of VGAM64 RNA, herein designated VGAM RNA, also designated SEQ ID:2775.

Another function of VGAM64 is therefore inhibition of LOC93190 (Accession XM_049705). Accordingly, utilities of VGAM64 include diagnosis, prevention and treatment of diseases and clinical conditions associated with LOC93190. FIG. 1 further provides a conceptual description of a novel bioinformatically detected viral gene of the present invention, referred to here as Viral Genomic Address Messenger 65 (VGAM65) viral gene, which modulates expression of respective host target genes thereof, the function and utility of which host target genes is known in the art.

VGAM65 is a novel bioinformatically detected regulatory, non protein coding, viral micro RNA (miRNA) gene. The method by which VGAM65 was detected is described hereinabove with reference to FIGS. 1-8.

VGAM65 gene, herein designated VGAM GENE, is a viral gene contained in the genome of Invertebrate Iridescent Virus 6. VGAM65 host target gene, herein designated VGAM HOST TARGET GENE, is a human gene contained in the human genome.

VGAM65 gene encodes a VGAM65 precursor RNA, herein designated VGAM PRECURSOR RNA. Similar to other miRNA genes, and unlike most ordinary genes, VGAM65 precursor RNA does not encode a protein. A nucleotide sequence identical or highly similar to the nucleotide sequence of VGAM65 precursor RNA is designated SEQ ID:51, and is provided hereinbelow with reference to the sequence listing part. Nucleotide sequence SEQ ID:51 is located at position 84924 relative to the genome of Invertebrate Iridescent Virus 6.

VGAM65 precursor RNA folds onto itself, forming VGAM65 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM65 folded precursor RNA into VGAM65 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM65 RNA is designated SEQ ID:2776, and is provided hereinbelow with reference to the sequence listing part.

VGAM65 host target gene, herein designated VGAM HOST TARGET GENE, encodes a corresponding messenger RNA, VGAM65 host target RNA, herein designated VGAM HOST TARGET RNA. VGAM65 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM65 RNA, herein designated VGAM RNA, binds complementarily to one or more host target binding sites located in untranslated regions of VGAM65 host target RNA, herein designated VGAM HOST TARGET RNA. This complementary binding is due to the fact that the nucleotide sequence of VGAM65 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM65 RNA, herein designated VGAM RNA, may have a different number of host target binding sites in untranslated regions of a VGAM65 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM65 RNA, herein designated VGAM RNA, to host target binding sites on VGAM65 host target RNA, herein designated VGAM HOST TARGET RNA, such as BINDING SITE I, BINDING SITE II and BINDING SITE III, inhibits translation of VGAM65 host target RNA into VGAM65 host target protein, herein designated VGAM HOST TARGET PROTEIN. VGAM host target protein is therefore outlined by a broken line.

It is appreciated that VGAM65 host target gene, herein designated VGAM HOST TARGET GENE, in fact represents a plurality of VGAM65 host target genes. The mRNA of each one of this plurality of VGAM65 host target genes comprises one or more host target binding sites, each having a nucleotide sequence which is at least partly complementary to VGAM65 RNA, herein designated VGAM RNA, and which when bound by VGAM65 RNA causes inhibition of translation of respective one or more VGAM65 host target proteins.

It is further appreciated by one skilled in the art that the mode of translational inhibition illustrated by FIG. 1 with specific reference to translational inhibition exerted by VGAM65 gene, herein designated VGAM GENE, on one or more VGAM65 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM65 is inhibition of expression of host target genes, as part of a novel viral mechanism of attacking a host. Accordingly, utilities of VGAM65 include diagnosis, prevention and treatment of viral infection by Invertebrate Iridescent Virus 6. Specific functions, and accordingly utilities, of VGAM65 correlate with, and may be deduced from, the identity of the host target genes which VGAM65 binds and inhibits, and the function of these host target genes, as elaborated hereinbelow.

Nucleotide sequences of the VGAM65 precursor RNA, herein designated VGAM PRECURSOR RNA, and of the 'diced' VGAM65 RNA, herein designated VGAM RNA, and a schematic representation of the secondary folding of VGAM65 folded precursor RNA, herein designated VGAM FOLDED PRECURSOR RNA, of VGAM65 are further described hereinbelow with reference to Table 1.

Nucleotide sequences of host target binding sites, such as BINDING SITE-I, BINDING SITE-II and BINDING SITE-III of FIG. 1, found on VGAM65 host target RNA, and schematic representation of the complementarity of each of these host target binding sites to VGAM65 RNA, herein designated VGAM RNA, are described hereinbelow with reference to Table 2.

As mentioned hereinabove with reference to FIG. 1, a function of VGAM65 gene, herein designated VGAM is inhibition of expression of VGAM65 target genes. It is appreciated that specific functions, and accordingly utilities, of VGAM65 correlate with, and may be deduced from, the identity of the target genes which VGAM65 binds and inhibits, and the function of these target genes, as elaborated hereinbelow.

UDP-GlcNAc:betaGal Beta-1,3-N-acetylglucosaminyltransferase 3 (B3GNT3, Accession NM_014256) is a VGAM65 host target gene. B3GNT3 BINDING SITE is HOST TARGET binding site found in the 3' untranslated region of mRNA encoded by B3GNT3, corresponding to a HOST TARGET binding site such as BINDING SITE I, BINDING SITE II or BINDING SITE III. Table 2 illustrates the complementarity of the nucleotide sequences of B3GNT3 BINDING SITE, designated SEQ ID:15534, to the nucleotide sequence of VGAM65 RNA, herein designated VGAM RNA, also designated SEQ ID:2776.

A function of VGAM65 is therefore inhibition of UDP-GlcNAc:betaGal Beta-1,3-N-acetylglucosaminyltransferase 3 (B3GNT3, Accession NM_014256). Accordingly, utilities of VGAM65 include diagnosis, prevention and treatment of diseases and clinical conditions associated with B3GNT3. 5-hydroxytryptamine (serotonin) Receptor 4 (HTR4, Accession NM_000870) is another VGAM65 host target gene. HTR4 BINDING SITE is HOST TARGET binding site found in the 3' untranslated region of mRNA encoded by HTR4, corresponding to a HOST TARGET binding site such as BINDING SITE I, BINDING SITE II or BINDING SITE III. Table 2 illustrates the complementarity of the nucleotide sequences of HTR4 BINDING SITE, designated SEQ ID:6546, to the nucleotide sequence of VGAM65 RNA, herein designated VGAM RNA, also designated SEQ ID:2776.

Another function of VGAM65 is therefore inhibition of 5-hydroxytryptamine (serotonin) Receptor 4 (HTR4, Accession NM_000870), a gene which mediates calcium channel currents. Accordingly, utilities of VGAM65 include diagnosis, prevention and treatment of diseases and clinical conditions associated with HTR4. The function of HTR4 has been established by previous studies. The 5-hydroxytryptamine-4 receptor was first characterized by Dumuis et al. (1988) in mouse colliculi neurons. Subsequently, Eglen et al. (1995) showed that 5-HTR4 mediates widespread effects in central and peripheral nervous systems. Serotonin acts as a stimulant to atrial cardiac cells in only a few mammalian species including human, monkey, and pig but not rodents. Cells from human atrium respond to 5-HT stimulation by producing an L-type calcium current. Blondel et al. (1997) used PCR, based on primers to the central region of rat 5-HT4 receptor, to clone a human 5-HT4 receptor, which they called 5-HT4A. Sequence analysis showed that this cDNA encodes a 387-amino acid polypeptide with 7 putative transmembrane domains and several potential regulatory sites. Blondel et al. (1997) found that 5-HT4A is the same length and 93% identical to the shorter of the 2 alternately spliced forms of the rat 5-HT4 receptor. RT-PCR analysis showed that the 5-HT4A mRNA is expressed in human ileum, brain, and atrium, but not in the ventricle. COS-7 cells expressing the 5-HT4 receptor respond to serotonin stimulation with pharmacologic profiles similar to those seen in human atrial myocytes, suggesting to Blondel et al. (1997) that 5-HT4A is the protein responsible for the serotonin responsiveness of the human atrium.

Full details of the abovementioned studies are described in the following publications, the disclosure of which are hereby incorporated by reference:

Claeysen, S.; Faye, P.; Sebben, M.; Lemaire, S.; Bockaert, J.; Dumuis, A.; Taviaux, S.: Assignment of 5-hydroxytryptamine receptor (HTR4) to human chromosome 5 bands q31-to-q33 by in situ hybridization. Cytogenet. Cell Genet. 78:133-134, 1997; and Dumuis, A.; Bouhelal, R.; Sebben, M.; Cory, R.; Bockaert, J.: A nonclassical 5-hydroxytryptamine receptor positively coupled with adenylate cyclase in the central nervous system. Molec.

Further studies establishing the function and utilities of HTR4 are found in John Hopkins OMIM database record ID 602164, and in sited publications numbered 6342-6345 listed in the bibliography section hereinbelow, which are also hereby incorporated by reference. PSA (Accession NM_021154) is another VGAM65 host target gene. PSA BINDING SITE1 and PSA BINDING SITE2 are HOST TARGET binding sites found in untranslated regions of mRNA encoded by PSA, corresponding to HOST TARGET binding sites such as BINDING SITE I, BINDING SITE II or BINDING SITE III. Table 2 illustrates the complementarity of the nucleotide sequences of PSA BINDING SITE1 and PSA BINDING SITE2, designated SEQ ID:22129 and SEQ ID:27738 respectively, to the nucleotide sequence of VGAM65 RNA, herein designated VGAM RNA, also designated SEQ ID:2776.

Another function of VGAM65 is therefore inhibition of PSA (Accession NM_021154), a gene which is puromycin-sensitive aminopeptidase and has metallopeptidase activity. Accordingly, utilities of VGAM65 include diagnosis, prevention and treatment of diseases and clinical conditions associated with PSA. The function of PSA has been established by previous studies. Tobler et al. (1997) cloned PSA from a human fetal brain cDNA library using the mouse PSA cDNA as probe. They established that translation is initiated at the second of 2 possible start codons, resulting in a deduced 875-amino acid protein with a molecular mass of 99 kD by SDS-PAGE. PSA contains a zinc-binding motif conserved among gluzincin aminopeptidases and shares 98% sequence identity with the mouse protein. Northern blot analysis detected ubiquitous expression of a 4.8-kb transcript, with highest expression in brain. By in situ hybridization of adult human brain sections, expression was localized to the perikaryon of neurons of the cortex and cerebellum. Using immunofluorescence localization of transfected HeLa cells, Tobler et al. (1997) found that PSA localizes to the perinuclear cytoplasm and shows a filamentous staining pattern. Bauer et al. (2001) cloned PSA cDNA from a human skeletal muscle library. Northern blot analysis detected major and minor transcripts of 4.8 and 4.2 kb, respectively. Huber et al. (1999) determined that PSA is identical to the matalloprotease MP100 that was originally isolated as a beta-secretase candidate from human brain by Schonlein et al. (1994). Huber et al. (1999) were able to colocalize and coimmunoprecipitate PSA with beta-amyloid precursor protein (OMIM Ref. No. 104760); however, PSA did not increase production of the amyloid-beta peptide in cotransfected cells. By RT-PCR, but not by Northern blot analysis, Bauer et al. (2001) found that PSA was upregulated in human leukemic cells following vitamin D stimulation.

Full details of the abovementioned studies are described in the following publications, the disclosure of which are hereby incorporated by reference:

Huber, G.; Thompson, A.; Gruninger, F.; Mechler, H.; Hochstrasser, R.; Hauri, H.-P.; Malherbe, P.: cDNA cloning and molecular characterization of human brain metalloprotease MP100: a beta-secretase candidate? J. Neurochem. 72:1215-1223, 1999; and Tobler, A. R.; Constam, D. B.; Schmitt-Graff, A.; Malipiero, U.; Schlapbach, R.; Fontana, A.: Cloning of the human puromycin-sensitive aminopeptidase and evidence for expression in neu.

Further studies establishing the function and utilities of PSA are found in John Hopkins OMIM database record ID 606793, and in sited publications numbered 5485-5490 listed in the bibliography section hereinbelow, which are also hereby incorporated by reference. DKFZp761B0514 (Accession NM_032289) is another VGAM65 host target gene. DKFZp761B0514 BINDING SITE is HOST TARGET binding site found in the 3' untranslated region of mRNA encoded by DKFZp761B0514, corresponding to a HOST TARGET binding site such as BINDING SITE I, BINDING SITE II or BINDING SITE III. Table 2 illustrates the complementarity of the nucleotide sequences of DKFZp761B0514 BINDING SITE, designated SEQ ID:26052, to the nucleotide sequence of VGAM65 RNA, herein designated VGAM RNA, also designated SEQ ID:2776.

Another function of VGAM65 is therefore inhibition of DKFZp761B0514 (Accession NM_032289). Accordingly, utilities of VGAM65 include diagnosis, prevention and treatment of diseases and clinical conditions associated with DKFZp761B0514. FLJ10290 (Accession NM_018047) is another VGAM65 host target gene. FLJ10290 BINDING SITE is HOST TARGET binding site found in the 3' untranslated region of mRNA encoded by FLJ10290, corresponding to a HOST TARGET binding site such as BINDING SITE I, BINDING SITE II or BINDING SITE III. Table 2 illustrates the complementarity of the nucleotide sequences of FLJ10290 BINDING SITE, designated SEQ ID:19798, to the nucleotide sequence of VGAM65 RNA, herein designated VGAM RNA, also designated SEQ ID:2776.

Another function of VGAM65 is therefore inhibition of FLJ10290 (Accession NM_018047). Accordingly, utilities of VGAM65 include diagnosis, prevention and treatment of diseases and clinical conditions associated with FLJ10290. KIAA1841 (Accession XM_087056) is another VGAM65 host target gene. KIAA1841 BINDING SITE is HOST TARGET binding site found in the 3' untranslated region of mRNA encoded by KIAA1841, corresponding to a HOST TARGET binding site such as BINDING SITE I, BINDING SITE II or BINDING SITE III. Table 2 illustrates the complementarity of the nucleotide sequences of KIAA1841 BINDING SITE, designated SEQ ID:39028, to the nucleotide sequence of VGAM65 RNA, herein designated VGAM RNA, also designated SEQ ID:2776.

Another function of VGAM65 is therefore inhibition of KIAA1841 (Accession XM_087056). Accordingly, utilities of VGAM65 include diagnosis, prevention and treatment of diseases and clinical conditions associated with KIAA1841. UQCR (Accession NM_006830) is another VGAM65 host target gene. UQCR BINDING SITE is HOST TARGET binding site found in the 3" untranslated region of mRNA encoded by UQCR, corresponding to a HOST TARGET binding site such as BINDING SITE I, BINDING SITE II or BINDING SITE III. Table 2 illustrates the complementarity of the nucleotide sequences of UQCR BINDING SITE, designated SEQ ID:13710, to the nucleotide sequence of VGAM65 RNA, herein designated VGAM RNA, also designated SEQ ID:2776.

Another function of VGAM65 is therefore inhibition of UQCR (Accession NM_006830). Accordingly, utilities of VGAM65 include diagnosis, prevention and treatment of diseases and clinical conditions associated with UQCR. Zinc Finger, Imprinted 3 (ZIM3, Accession NM_052882) is another VGAM65 host target gene. ZIM3 BINDING SITE is HOST TARGET binding site found in the 3' untranslated region of mRNA encoded by ZIM3, corresponding to a HOST TARGET binding site such as BINDING SITE I, BINDING SITE II or BINDING SITE III. Table 2 illustrates the complementarity of the nucleotide sequences of ZIM3 BINDING SITE, designated SEQ ID:27462, to the nucleotide sequence of VGAM65 RNA, herein designated VGAM RNA, also designated SEQ ID:2776.

Another function of VGAM65 is therefore inhibition of Zinc Finger, Imprinted 3 (ZIM3, Accession NM_052882). Accordingly, utilities of VGAM65 include diagnosis, prevention and treatment of diseases and clinical conditions associated with ZIM3. LOC113523 (Accession XM_054378) is another VGAM65 host target gene. LOC113523 BINDING SITE is HOST TARGET binding site found in the 3' untranslated region of mRNA encoded by LOC113523, corresponding to a HOST TARGET binding site such as BINDING SITE I, BINDING SITE II or BINDING SITE III. Table 2 illustrates the complementarity of the nucleotide sequences of LOC113523 BINDING SITE, designated SEQ ID:36156, to the nucleotide sequence of VGAM65 RNA, herein designated VGAM RNA, also designated SEQ ID:2776.

Another function of VGAM65 is therefore inhibition of LOC113523 (Accession XM_054378). Accordingly, utilities of VGAM65 include diagnosis, prevention and treatment of diseases and clinical conditions associated with LOC113523. LOC143465 (Accession XM_096430) is another VGAM65 host target gene. LOC143465 BINDING SITE is HOST TARGET binding site found in the 3' untranslated region of mRNA encoded by LOC143465, corresponding to a HOST TARGET binding site such as BINDING SITE I, BINDING SITE II or BINDING SITE III. Table 2 illustrates the complementarity of the nucleotide sequences of LOC143465 BINDING SITE, designated SEQ ID:40366, to the nucleotide sequence of VGAM65 RNA, herein designated VGAM RNA, also designated SEQ ID:2776.

Another function of VGAM65 is therefore inhibition of LOC143465 (Accession XM_096430). Accordingly, utilities of VGAM65 include diagnosis, prevention and treatment of diseases and clinical conditions associated with LOC143465. LOC92539 (Accession XM_045632) is another VGAM65 host target gene. LOC92539 BINDING SITE is HOST TARGET binding site found in the 5' untranslated region of mRNA encoded by LOC92539, corresponding to a HOST TARGET binding site such as BINDING SITE I, BINDING SITE II or BINDING SITE III. Table 2 illustrates the complementarity of the nucleotide sequences of LOC92539 BINDING SITE, designated SEQ ID:34505, to the nucleotide sequence of VGAM65 RNA, herein designated VGAM RNA, also designated SEQ ID:2776.

Another function of VGAM65 is therefore inhibition of LOC92539 (Accession XM_045632). Accordingly, utilities of VGAM65 include diagnosis, prevention and treatment of diseases and clinical conditions associated with LOC92539. FIG. 1 further provides a conceptual description of a novel bioinformatically detected viral gene of the present invention, referred to here as Viral Genomic Address Messenger 66 (VGAM66) viral gene, which modulates expression of respective host target genes thereof, the function and utility of which host target genes is known in the art.

VGAM66 is a novel bioinformatically detected regulatory, non protein coding, viral micro RNA (miRNA) gene. The method by which VGAM66 was detected is described hereinabove with reference to FIGS. 1-8.

VGAM66 gene, herein designated VGAM GENE, is a viral gene contained in the genome of Invertebrate Iridescent Virus 6. VGAM66 host target gene, herein designated VGAM HOST TARGET GENE, is a human gene contained in the human genome.

VGAM66 gene encodes a VGAM66 precursor RNA, herein designated VGAM PRECURSOR RNA. Similar to other miRNA genes, and unlike most ordinary genes, VGAM66 precursor RNA does not encode a protein. A nucleotide sequence identical or highly similar to the nucleotide sequence of VGAM66 precursor RNA is designated SEQ ID:52, and is provided hereinbelow with reference to the sequence listing part. Nucleotide sequence SEQ ID:52 is located at position 112517 relative to the genome of Invertebrate Iridescent Virus 6.

VGAM66 precursor RNA folds onto itself, forming VGAM66 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM66 folded precursor RNA into VGAM66 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM66 RNA is designated SEQ ID:2777, and is provided hereinbelow with reference to the sequence listing part.

VGAM66 host target gene, herein designated VGAM HOST TARGET GENE, encodes a corresponding messenger RNA, VGAM66 host target RNA, herein designated VGAM HOST TARGET RNA. VGAM66 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM66 RNA, herein designated VGAM RNA, binds complementarily to one or more host target binding sites located in untranslated regions of VGAM66 host target RNA, herein designated VGAM HOST TARGET RNA. This complementary binding is due to the fact that the nucleotide sequence of VGAM66 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM66 RNA, herein designated VGAM RNA, may have a different number of host target binding sites in untranslated regions of a VGAM66 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM66 RNA, herein designated VGAM RNA, to host target binding sites on VGAM66 host target RNA, herein designated VGAM HOST TARGET RNA, such as BINDING SITE I, BINDING SITE II and BINDING SITE III, inhibits translation of VGAM66 host target RNA into VGAM66 host target protein, herein designated VGAM HOST TARGET PROTEIN. VGAM host target protein is therefore outlined by a broken line.

It is appreciated that VGAM66 host target gene, herein designated VGAM HOST TARGET GENE, in fact represents a plurality of VGAM66 host target genes. The mRNA of each one of this plurality of VGAM66 host target genes comprises one or more host target binding sites, each having a nucleotide sequence which is at least partly complementary to VGAM66 RNA, herein designated VGAM RNA, and which when bound by VGAM66 RNA causes inhibition of translation of respective one or more VGAM66 host target proteins.

It is further appreciated by one skilled in the art that the mode of translational inhibition illustrated by FIG. 1 with specific reference to translational inhibition exerted by VGAM66 gene, herein designated VGAM GENE, on one or more VGAM66 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM66 is inhibition of expression of host target genes, as part of a novel viral mechanism of attacking a host. Accordingly, utilities of VGAM66 include diagnosis, prevention and treatment of viral infection by Invertebrate Iridescent Virus 6. Specific functions, and accordingly utilities, of VGAM66 correlate with, and may be deduced from, the identity of the host target genes which VGAM66 binds and inhibits, and the function of these host target genes, as elaborated hereinbelow.

Nucleotide sequences of the VGAM66 precursor RNA, herein designated VGAM PRECURSOR RNA, and of the 'diced' VGAM66 RNA, herein designated VGAM RNA, and a schematic representation of the secondary folding of VGAM66 folded precursor RNA, herein designated VGAM FOLDED PRECURSOR RNA, of VGAM66 are further described hereinbelow with reference to Table 1.

Nucleotide sequences of host target binding sites, such as BINDING SITE-I, BINDING SITE-II and BINDING SITE-III of FIG. 1, found on VGAM66 host target RNA, and schematic representation of the complementarity of each of these host target binding sites to VGAM66 RNA, herein designated VGAM RNA, are described hereinbelow with reference to Table 2.

As mentioned hereinabove with reference to FIG. 1, a function of VGAM66 gene, herein designated VGAM is inhibition of expression of VGAM66 target genes. It is appreciated that specific functions, and accordingly utilities, of VGAM66 correlate with, and may be deduced from, the identity of the target genes which VGAM66 binds and inhibits, and the function of these target genes, as elaborated hereinbelow.

Guanine Nucleotide Binding Protein (G protein), Beta Polypeptide 1 (GNB1, Accession NM_002074) is a VGAM66 host target gene. GNB1 BINDING SITE is HOST TARGET binding site found in the 3' untranslated region of mRNA encoded by GNB1, corresponding to a HOST TARGET binding site such as BINDING SITE I, BINDING SITE II or BINDING SITE III. Table 2 illustrates the complementarity of the nucleotide sequences of GNB1 BINDING SITE, designated SEQ ID:7852, to the nucleotide sequence of VGAM66 RNA, herein designated VGAM RNA, also designated SEQ ID:2777.

A function of VGAM66 is therefore inhibition of Guanine Nucleotide Binding Protein (G protein), Beta Polypeptide 1 (GNB1, Accession NM_002074). Accordingly, utilities of VGAM66 include diagnosis, prevention and treatment of diseases and clinical conditions associated with GNB1. Lecithin Retinol Acyltransferase (phosphatidylcholine--retinol O-acyltransferase) (LRAT, Accession XM_011181) is another VGAM66 host target gene. LRAT BINDING SITE is HOST TARGET binding site found in the 3' untranslated region of mRNA encoded by LRAT, corresponding to a HOST TARGET binding site such as BINDING SITE I, BINDING SITE II or BINDING SITE III. Table 2 illustrates the complementarity of the nucleotide sequences of LRAT BINDING SITE, designated SEQ ID:30184, to the nucleotide sequence of VGAM66 RNA, herein designated VGAM RNA, also designated SEQ ID:2777.

Another function of VGAM66 is therefore inhibition of Lecithin Retinol Acyltransferase (phosphatidylcholine--retinol O-acyltransferase) (LRAT, Accession XM_011181). Accordingly, utilities of VGAM66 include diagnosis, prevention and treatment of diseases and clinical conditions associated with LRAT. Retinal Pigment Epithelium-specific Protein 65 kDa (RPE65, Accession NM_000329) is another VGAM66 host target gene. RPE65 BINDING SITE is HOST TARGET binding site found in the 3' untranslated region of mRNA encoded by RPE65, corresponding to a HOST TARGET binding site such as BINDING SITE I, BINDING SITE II or BINDING SITE III. Table 2 illustrates the complementarity of the nucleotide sequences of RPE65 BINDING SITE, designated SEQ ID:5871, to the nucleotide sequence of VGAM66 RNA, herein designated VGAM RNA, also designated SEQ ID:2777.

Another function of VGAM66 is therefore inhibition of Retinal Pigment Epithelium-specific Protein 65 kDa (RPE65, Accession NM_000329), a gene which May play a role in vitamin-A metabolism of the retina. Accordingly, utilities of VGAM66 include diagnosis, prevention and treatment of diseases and clinical conditions associated with RPE65. The function of RPE65 has been established by previous studies. The retinal pigment epithelium (RPE) is a monolayer simple epithelium apposed to the outer surface of the retinal photoreceptor cells. It is involved in many aspects of outer retinal metabolism that are essential to the continued maintenance of the photoreceptor cells, including many RPE-specific functions such as the retinoid visual cycle and photoreceptor outer segment disk phagocytosis and recycling. Hamel et al. (1993) characterized and cloned a unique RPE-specific microsomal protein, RPE65, that is conserved in vertebrates and was a candidate for the site of mutation in hereditary retinal disorders implicating the RPE. Using a human/hamster hybrid panel, Hamel et al. (1994) mapped the human RPE65 gene to chromosome 1 and, by fluorescence in situ hybridization, refined the localization to 1p31. Using interspecific backcross analysis, they mapped the mouse Rpe65 gene to the distal portion of chromosome 3 Animal model experiments lend further support to the function of RPE65. Aguirre et al. (1998) described a 4-bp deletion in the RPE65 gene in a form of retinal dystrophy in dogs of the Swedish Briard breed. The disorder was initially described by Narfstrom et al. (1989) as a stationary disorder analogous to human congenital stationary night blindness (CSNB). The disorder was later described as having a progressive component and was termed hereditary retinal dystrophy (Wrigstad et al., 1994). Aguirre et al. (1998) studied 10 Briard dogs affected with what has been called CSNB in the U. S. The dogs originated from stock in the U. S., Canada, and France. Identification of the same mutation (a homozygous 4-bp deletion resulting in frameshift and a premature stop codon that truncates the protein) suggested a founder effect It is appreciated that the abovementioned animal model for RPE65 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hamel, C. P.; Jenkins, N. A.; Gilbert, D. J.; Copeland, N. G.; Redmond, T. M.: The gene for the retinal pigment epithelium-specific protein RPE65 is localized to human 1p31 and mouse 3. Genomics 20:509-512, 1994; and Aguirre, G. D.; Baldwin, V.; Pearce-Kelling, S.; Narfstrom, K.; Ray, K.; Acland, G. M.: Congenital stationary night blindness in the dog: common mutation in the RPE65 gene indicates found.

Further studies establishing the function and utilities of RPE65 are found in John Hopkins OMIM database record ID 180069, and in sited publications numbered 10465-1047 and 10072-10076 listed in the bibliography section hereinbelow, which are also hereby incorporated by reference. Solute Carrier Family 4, Sodium Bicarbonate Cotransporter, Member 7 (SLC4A7, Accession NM_003615) is another VGAM66 host target gene. SLC4A7 BINDING SITE is HOST TARGET binding site found in the 3' untranslated region of mRNA encoded by SLC4A7, corresponding to a HOST TARGET binding site such as BINDING SITE I, BINDING SITE II or BINDING SITE III. Table 2 illustrates the complementarity of the nucleotide sequences of SLC4A7 BINDING SITE, designated SEQ ID:9674, to the nucleotide sequence of VGAM66 RNA, herein designated VGAM RNA, also designated SEQ ID:2777.

Another function of VGAM66 is therefore inhibition of Solute Carrier Family 4, Sodium Bicarbonate Cotransporter, Member 7 (SLC4A7, Accession NM_003615), a gene which mediates the coupled movement of sodium and bicarbonate ions across the plasma membrane. Accordingly, utilities of VGAM66 include diagnosis, prevention and treatment of diseases and clinical conditions associated with SLC4A7. The function of SLC4A7 has been established by previous studies. By searching an EST database for sequences related to the pNBC variant of NBC1 (OMIM Ref. No. SLC4A4), Pushkin et al. (1999) identified ESTs encoding SLC4A7, which they called NBC3. They isolated human muscle cDNAs representing a full-length NBC3 coding sequence. The predicted 1,214-amino acid muscle NBC3 variant, which the authors referred to as mNBC3, contains 12 putative transmembrane domains, with cytoplasmic N and C termini. mNBC3 has 1 putative stilbene-binding motif, numerous potential intracellular phosphorylation sites, potential sites for myristylation and amidation, and potential N-linked glycosylation sites in the exofacial loops between transmembrane domains 1 and 2, and 5 and 6. mNBC3 shares 78% amino acid sequence homology with the NBC2 variant (Ishibashi et al., 1998) of SLC4A7, 46% homology with the kNBC variant of NBC1, 39% homology with the pNBC variant of NBC1, and 29% homology with AE3 (SLC4A3; 106195). Expression of mNBC3 in Xenopus oocytes demonstrated that it is a stilbene-insensitive 5-(N-ethyl-N-isopropyl)-amiloride (EIPA)-inhibitable NBC. The SLC4A7 gene spans approximately 80 kb and contains 25 exons. Northern blot analysis of a number of human tissues detected an approximately 7.8-kb mNBC3 transcript only in skeletal muscle and heart. Burnham et al. (2000) stated that the NBC2 (Ishibashi et al., 1998) and mNBC3 (Pushkin et al., 1999) cDNAs share several kb of identical sequence. Although the deduced protein sequences differ in their N and C termini and each protein contains an interior region not present in the other, the corresponding blocks share more than 99% identity. Thus, Burnham et al. (2000) suggested that NBC2 and mNBC3 are encoded by the same gene. Burnham et al. (2000) isolated a human melanoma cell cDNA that encodes a protein containing elements previously thought to be characteristic of each of the variants NBC2 and mNBC3. Northern blot analysis of several human tissues using a probe specific to NBC2 detected expression mainly in lymph node and brain. Northern blot analysis using a probe specific to mNBC3 showed highest expression in skeletal muscle and heart and lower expression in lymph node, whole brain, adrenal gland, trachea, thyroid, stomach, pancreas, kidney, liver, lung, and placenta. Burnham et al. (2000) concluded that the melanoma cell, NBC2, and mNBC3 cDNAs represent 3 alternate transcripts of the SLC4A7 gene, which they called NBC2

Full details of the abovementioned studies are described in the following publications, the disclosure of which are hereby incorporated by reference:

Pushkin, A.; Abuladze, N.; Lee, I.; Newman, D.; Hwang, J.; Kurtz, I.: Mapping of the human NBC3 (SLC4A7) gene to chromosome 3p22. Genomics 57:321-322, 1999. Note: Correction: Genomics 58:216 and 321-322, 1999; and Soleimani, M.; Burnham, C. E.: Physiologic and molecular aspects of the Na (+):HCO(3-) cotransporter in health and disease processes. Kidney Int. 57:371-384, 2000.

Further studies establishing the function and utilities of SLC4A7 are found in John Hopkins OMIM database record ID 603353, and in sited publications numbered 1083-108 and 7959 listed in the bibliography section hereinbelow, which are also hereby incorporated by reference. Angiomotin Like 2 (AMOTL2, Accession NM_016201) is another VGAM66 host target gene. AMOTL2 BINDING SITE is HOST TARGET binding site found in the 3' untranslated region of mRNA encoded by AMOTL2, corresponding to a HOST TARGET binding site such as BINDING SITE I, BINDING SITE II or BINDING SITE III. Table 2 illustrates the complementarity of the nucleotide sequences of AMOTL2 BINDING SITE, designated SEQ ID:18295, to the nucleotide sequence of VGAM66 RNA, herein designated VGAM RNA, also designated SEQ ID:2777.

Another function of VGAM66 is therefore inhibition of Angiomotin Like 2 (AMOTL2, Accession NM_016201). Accordingly, utilities of VGAM66 include diagnosis, prevention and treatment of diseases and clinical conditions associated with AMOTL2. CG018 (Accession NM_052818) is another VGAM66 host target gene. CG018 BINDING SITE is HOST TARGET binding site found in the 3' untranslated region of mRNA encoded by CG018, corresponding to a HOST TARGET binding site such as BINDING SITE I, BINDING SITE II or BINDING SITE III. Table 2 illustrates the complementarity of the nucleotide sequences of CG018 BINDING SITE, designated SEQ ID:27406, to the nucleotide sequence of VGAM66 RNA, herein designated VGAM RNA, also designated SEQ ID:2777.

Another function of VGAM66 is therefore inhibition of CG018 (Accession NM_052818). Accordingly, utilities of VGAM66 include diagnosis, prevention and treatment of diseases and clinical conditions associated with CG018. KIAA0441 (Accession NM_014797) is another VGAM66 host target gene. KIAA0441 BINDING SITE is HOST TARGET binding site found in the 3' untranslated region of mRNA encoded by KIAA0441, corresponding to a HOST TARGET binding site such as BINDING SITE I, BINDING SITE II or BINDING SITE III. Table 2 illustrates the complementarity of the nucleotide sequences of KIAA0441 BINDING SITE, designated SEQ ID:16714, to the nucleotide sequence of VGAM66 RNA, herein designated VGAM RNA, also designated SEQ ID:2777.

Another function of VGAM66 is therefore inhibition of KIAA0441 (Accession NM_014797). Accordingly, utilities of VGAM66 include diagnosis, prevention and treatment of diseases and clinical conditions associated with KIAA0441. KIAA0470 (Accession NM_014812) is another VGAM66 host target gene. KIAA0470 BINDING SITE is HOST TARGET binding site found in the 3' untranslated region of mRNA encoded by KIAA0470, corresponding to a HOST TARGET binding site such as BINDING SITE I, BINDING SITE II or BINDING SITE III. Table 2 illustrates the complementarity of the nucleotide sequences of KIAA0470 BINDING SITE, designated SEQ ID:16778, to the nucleotide sequence of VGAM66 RNA, herein designated VGAM RNA, also designated SEQ ID:2777.

Another function of VGAM66 is therefore inhibition of KIAA0470 (Accession NM_014812). Accordingly, utilities of VGAM66 include diagnosis, prevention and treatment of diseases and clinical conditions associated with KIAA0470. KIAA1712 (Accession XM_041497) is another VGAM66 host target gene. KIAA1712 BINDING SITE is HOST TARGET binding site found in the 3' untranslated region of mRNA encoded by KIAA1712, corresponding to a HOST TARGET binding site such as BINDING SITE I, BINDING SITE II or BINDING SITE III. Table 2 illustrates the complementarity of the nucleotide sequences of KIAA1712 BINDING SITE, designated SEQ ID:33541, to the nucleotide sequence of VGAM66 RNA, herein designated VGAM RNA, also designated SEQ ID:2777.

Another function of VGAM66 is therefore inhibition of KIAA1712 (Accession XM_041497). Accordingly, utilities of VGAM66 include diagnosis, prevention and treatment of diseases and clinical conditions associated with KIAA1712. NET-6 (Accession NM_014399) is another VGAM66 host target gene. NET-6 BINDING SITE is HOST TARGET binding site found in the 3' untranslated region of mRNA encoded by NET-6, corresponding to a HOST TARGET binding site such as BINDING SITE I, BINDING SITE II or BINDING SITE III. Table 2 illustrates the complementarity of the nucleotide sequences of NET-6 BINDING SITE, designated SEQ ID:15742, to the nucleotide sequence of VGAM66 RNA, herein designated VGAM RNA, also designated SEQ ID:2777.

Another function of VGAM66 is therefore inhibition of NET-6 (Accession NM_014399). Accordingly, utilities of VGAM66 include diagnosis, prevention and treatment of diseases and clinical conditions associated with NET-6. RCD-8 (Accession NM_014329) is another VGAM66 host target gene. RCD-8 BINDING SITE is HOST TARGET binding site found in the 3' untranslated region of mRNA encoded by RCD-8, corresponding to a HOST TARGET binding site such as BINDING SITE I, BINDING SITE II or BINDING SITE III. Table 2 illustrates the complementarity of the nucleotide sequences of RCD-8 BINDING SITE, designated SEQ ID:15639, to the nucleotide sequence of VGAM66 RNA, herein designated VGAM RNA, also designated SEQ ID:2777.

Another function of VGAM66 is therefore inhibition of RCD-8 (Accession NM_014329). Accordingly, utilities of VGAM66 include diagnosis, prevention and treatment of diseases and clinical conditions associated with RCD-8. LOC127281 (Accession XM_059128) is another VGAM66 host target gene. LOC127281 BINDING SITE is HOST TARGET binding site found in the 3' untranslated region of mRNA encoded by LOC127281, corresponding to a HOST TARGET binding site such as BINDING SITE I, BINDING SITE II or BINDING SITE III. Table 2 illustrates the complementarity of the nucleotide sequences of LOC127281 BIND- ING SITE, designated SEQ ID:36891, to the nucleotide sequence of VGAM66 RNA, herein designated VGAM RNA, also designated SEQ ID:2777.

Another function of VGAM66 is therefore inhibition of LOC127281 (Accession XM_059128). Accordingly, utilities of VGAM66 include diagnosis, prevention and treatment of diseases and clinical conditions associated with LOC127281. FIG. 1 further provides a conceptual description of a novel bioinformatically detected viral gene of the present invention, referred to here as Viral Genomic Address Messenger 67 (VGAM67) viral gene, which modulates expression of respective host target genes thereof, the function and utility of which host target genes is known in the art.

VGAM67 is a novel bioinformatically detected regulatory, non protein coding, viral micro RNA (miRNA) gene. The method by which VGAM67 was detected is described hereinabove with reference to FIGS. 1-8.

VGAM67 gene, herein designated VGAM GENE, is a viral gene contained in the genome of Invertebrate Iridescent Virus 6. VGAM67 host target gene, herein designated VGAM HOST TARGET GENE, is a human gene contained in the human genome.

VGAM67 gene encodes a VGAM67 precursor RNA, herein designated VGAM PRECURSOR RNA. Similar to other miRNA genes, and unlike most ordinary genes, VGAM67 precursor RNA does not encode a protein. A nucleotide sequence identical or highly similar to the nucleotide sequence of VGAM67 precursor RNA is designated SEQ ID:53, and is provided hereinbelow with reference to the sequence listing part. Nucleotide sequence SEQ ID:53 is located at position 58356 relative to the genome of Invertebrate Iridescent Virus 6.

VGAM67 precursor RNA folds onto itself, forming VGAM67 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM67 folded precursor RNA into VGAM67 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM67 RNA is designated SEQ ID:2778, and is provided hereinbelow with reference to the sequence listing part.

VGAM67 host target gene, herein designated VGAM HOST TARGET GENE, encodes a corresponding messenger RNA, VGAM67 host target RNA, herein designated VGAM HOST TARGET RNA. VGAM67 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM67 RNA, herein designated VGAM RNA, binds complementarily to one or more host target binding sites located in untranslated regions of VGAM67 host target RNA, herein designated VGAM HOST TARGET RNA. This complementary binding is due to the fact that the nucleotide sequence of VGAM67 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM67 RNA, herein designated VGAM RNA, may have a different number of host target binding sites in untranslated regions of a VGAM67 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM67 RNA, herein designated VGAM RNA, to host target binding sites on VGAM67 host target RNA, herein designated VGAM HOST TARGET RNA, such as BINDING SITE I, BINDING SITE II and BINDING SITE III, inhibits translation of VGAM67 host target RNA into VGAM67 host target protein, herein designated VGAM HOST TARGET PROTEIN. VGAM host target protein is therefore outlined by a broken line.

It is appreciated that VGAM67 host target gene, herein designated VGAM HOST TARGET GENE, in fact represents a plurality of VGAM67 host target genes. The mRNA of each one of this plurality of VGAM67 host target genes comprises one or more host target binding sites, each having a nucleotide sequence which is at least partly complementary to VGAM67 RNA, herein designated VGAM RNA, and which when bound by VGAM67 RNA causes inhibition of translation of respective one or more VGAM67 host target proteins.

It is further appreciated by one skilled in the art that the mode of translational inhibition illustrated by FIG. 1 with specific reference to translational inhibition exerted by VGAM67 gene, herein designated VGAM GENE, on one or more VGAM67 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM67 is inhibition of expression of host target genes, as part of a novel viral mechanism of attacking a host. Accordingly, utilities of VGAM67 include diagnosis, prevention and treatment of viral infection by Invertebrate Iridescent Virus 6. Specific functions, and accordingly utilities, of VGAM67 correlate with, and may be deduced from, the identity of the host target genes which VGAM67 binds and inhibits, and the function of these host target genes, as elaborated hereinbelow.

Nucleotide sequences of the VGAM67 precursor RNA, herein designated VGAM PRECURSOR RNA, and of the 'diced' VGAM67 RNA, herein designated VGAM RNA, and a schematic representation of the secondary folding of VGAM67 folded precursor RNA, herein designated VGAM FOLDED PRECURSOR RNA, of VGAM67 are further described hereinbelow with reference to Table 1.

Nucleotide sequences of host target binding sites, such as BINDING SITE-I, BINDING SITE-II and BINDING SITE-III of FIG. 1, found on VGAM67 host target RNA, and schematic representation of the complementarity of each of these host target binding sites to VGAM67 RNA, herein designated VGAM RNA, are described hereinbelow with reference to Table 2.

As mentioned hereinabove with reference to FIG. 1, a function of VGAM67 gene, herein designated VGAM is inhibition of expression of VGAM67 target genes. It is appreciated that specific functions, and accordingly utilities, of VGAM67 correlate with, and may be deduced from, the identity of the target genes which VGAM67 binds and inhibits, and the function of these target genes, as elaborated hereinbelow.

Myeloid/lymphoid Or Mixed-lineage Leukemia (trithorax homolog, Drosophila); Translocated To, 3 (MLLT3, Accession NM_004529) is a VGAM67 host target gene. MLLT3 BINDING SITE is HOST TARGET binding site found in the 3' untranslated region of mRNA encoded by MLLT3, corresponding to a HOST TARGET binding site such as BINDING SITE I, BINDING SITE II or BINDING SITE III. Table 2 illustrates the complementarity of the nucleotide sequences of MLLT3 BINDING SITE, designated SEQ ID:10869, to the nucleotide sequence of VGAM67 RNA, herein designated VGAM RNA, also designated SEQ ID:2778.

A function of VGAM67 is therefore inhibition of Myeloid/lymphoid Or Mixed-lineage Leukemia (trithorax homolog, Drosophila); Translocated To, 3 (MLLT3, Accession NM_004529), a gene which is Serine and proline rich protein. Accordingly, utilities of VGAM67 include diagnosis, prevention and treatment of diseases and clinical conditions associated with MLLT3. The function of MLLT3 has been established by previous studies. Nakamura et al. (1993) found that the AF4 gene on chromosome 4q21 (OMIM Ref. No. 159557) that is fused with the ALL1 gene (OMIM Ref. No. 159555) in patients with acute lymphoblastic leukemia and translocation t (4;11)(q21; q23) and the gene on chromosome 9 that is fused with the ALL1 gene on chromosome 11 in patients with leukemia and the t (9;11)(p22; q23) show high sequence homology with the ENL gene (OMIM Ref. No. 159556) on chromosome 19 which is fused to the ALL1 gene in patients with leukemia and the translocation t (11;19)(q23; p13). They found further that the protein products of the AF4, AF9, and ENL genes contained nuclear targeting sequences as well as serine-rich and proline-rich regions. Stretches abundant in basic amino acids were also present in the 3 proteins. These results indicated that the different proteins fused to ALL1 polypeptides in leukemia provide similar functional domains. This gene is also symbolized MLLT3. The human AF9 gene is one of the most common fusion partner genes with the ALL1 gene at 11q23 (also called MLL), resulting in the t (9;11)(p22; q23). The AF9 gene is more than 100 kb, and 2 patient breakpoint cluster regions (BCRs) have been identified; BCR1 is within intron 4, previously called site A, whereas BCR2 or site B spans introns 7 and 8. Strissel et al. (2000) defined the exon-intron boundaries and identified several different structural elements in AF9, including a colocalizing in vivo DNA topo II cleavage site and an in vitro DNase I hypersensitive (DNase 1 HS) site in intron 7 in BCR2. Reversibility experiments demonstrated a religation of the topo II cleavage sites. In addition, 2 scaffold associated regions (SARs) are located centromeric to the topo II and DNase I HS cleavage sites and border breakpoint regions in 2 leukemic cells lines: SAR1 is located in intron 4, whereas SAR2 encompasses parts of exons 5-7. The authors thus demonstrated that the patient breakpoint regions of AF9 share the same structural elements as the MLL BCR, and they proposed a DNA breakage and repair model for nonhomologous recombination between MLL and its partner genes, particularly AF9.

Full details of the abovementioned studies are described in the following publications, the disclosure of which are hereby incorporated by reference:

Nakamura, T.; Alder, H.; Gu, Y.; Prasad, R.; Canaani, O.; Kamada, N.; Gale, R. P.; Lange, B.; Crist, W. M.; Nowell, P. C.; Croce, C. M.; Canaani, E.: Genes on chromosomes 4, 9, and 19 involved in 11q23 abnormalities in acute leukemia share sequence homology and/or common motifs. Proc. Nat. Acad. Sci. 90:4631-4635, 1993; and Strissel, P. L.; Strick, R.; Tomek, R. J.; Roe, B. A.; Rowley, J. D.; Zeleznik-Le, N. J.: DNA structural properties of AF9 are similar to MLL and could act as recombination hot spots r.

Further studies establishing the function and utilities of MLLT3 are found in John Hopkins OMIM database record ID 159558, and in sited publications numbered 3277 listed in the bibliography section hereinbelow, which are also hereby incorporated by reference. Meningioma (disrupted in balanced translocation) 1 (MN1, Accession NM_002430) is another VGAM67 host target gene. MN1 BINDING SITE is HOST TARGET binding site found in the 3' untranslated region of mRNA encoded by MN1, corresponding to a HOST TARGET binding site such as BINDING SITE I, BINDING SITE II or BINDING SITE III. Table 2 illustrates the complementarity of the nucleotide sequences of MN1 BINDING SITE, designated SEQ ID:8271, to the nucleotide sequence of VGAM67 RNA, herein designated VGAM RNA, also designated SEQ ID:2778.

Another function of VGAM67 is therefore inhibition of Meningioma (disrupted in balanced translocation) 1 (MN1, Accession NM_002430). Accordingly, utilities of VGAM67 include diagnosis, prevention and treatment of diseases and clinical conditions associated with MN1. A Kinase (PRKA) Anchor Protein 6 (AKAP6, Accession NM_004274) is another VGAM67 host target gene. AKAP6 BINDING SITE is HOST TARGET binding site found in the 3' untranslated region of mRNA encoded by AKAP6, corresponding to a HOST TARGET binding site such as BINDING SITE I, BINDING SITE II or BINDING SITE III. Table 2 illustrates the complementarity of the nucleotide sequences of AKAP6 BINDING SITE, designated SEQ ID:10492, to the nucleotide sequence of VGAM67 RNA, herein designated VGAM RNA, also designated SEQ ID:2778.

Another function of VGAM67 is therefore inhibition of A Kinase (PRKA) Anchor Protein 6 (AKAP6, Accession NM_004274). Accordingly, utilities of VGAM67 include diagnosis, prevention and treatment of diseases and clinical conditions associated with AKAP6. DJ37E16.5 (Accession NM_020315) is another VGAM67 host target gene. DJ37E16.5 BINDING SITE is HOST TARGET binding site found in the 3' untranslated region of mRNA encoded by DJ37E16.5, corresponding to a HOST TARGET binding site such as BINDING SITE I, BINDING SITE II or BINDING SITE III. Table 2 illustrates the complementarity of the nucleotide sequences of DJ37E16.5 BINDING SITE, designated SEQ ID:21579, to the nucleotide sequence of VGAM67 RNA, herein designated VGAM RNA, also designated SEQ ID:2778.

Another function of VGAM67 is therefore inhibition of DJ37E16.5 (Accession NM_020315). Accordingly, utilities of VGAM67 include diagnosis, prevention and treatment of diseases and clinical conditions associated with DJ37E16.5. FLJ20694 (Accession NM_017928) is another VGAM67 host target gene. FLJ20694 BINDING SITE is HOST TARGET binding site found in the 3' untranslated region of mRNA encoded by FLJ20694, corresponding to a HOST TARGET binding site such as BINDING SITE I, BINDING SITE II or BINDING SITE III. Table 2 illustrates the complementarity of the nucleotide sequences of FLJ20694 BINDING SITE, designated SEQ ID:19603, to the nucleotide sequence of VGAM67 RNA, herein designated VGAM RNA, also designated SEQ ID:2778.

Another function of VGAM67 is therefore inhibition of FLJ20694 (Accession NM_017928). Accordingly, utilities of VGAM67 include diagnosis, prevention and treatment of diseases and clinical conditions associated with FLJ20694. KIAA0276 (Accession XM_048199) is another VGAM67 host target gene. KIAA0276 BINDING SITE is HOST TARGET binding site found in the 3' untranslated region of mRNA encoded by KIAA0276, corresponding to a HOST TARGET binding site such as BINDING SITE I, BINDING SITE II or BINDING SITE III. Table 2 illustrates the complementarity of the nucleotide sequences of KIAA0276 BINDING SITE, designated SEQ ID:35138, to the nucleotide sequence of VGAM67 RNA, herein designated VGAM RNA, also designated SEQ ID:2778.

Another function of VGAM67 is therefore inhibition of KIAA0276 (Accession XM_048199). Accordingly, utilities of VGAM67 include diagnosis, prevention and treatment of diseases and clinical conditions associated with KIAA0276. KIAA0993 (Accession XM_034413) is another VGAM67 host target gene. KIAA0993 BINDING SITE is HOST TARGET binding site found in the 3' untranslated region of mRNA encoded by KIAA0993, corresponding to a HOST TARGET binding site such as BINDING SITE I, BINDING SITE II or BINDING SITE III. Table 2 illustrates the complementarity of the nucleotide sequences of KIAA0993 BINDING SITE, designated SEQ ID:32082, to the nucleotide sequence of VGAM67 RNA, herein designated VGAM RNA, also designated SEQ ID:2778.

Another function of VGAM67 is therefore inhibition of KIAA0993 (Accession XM_034413). Accordingly, utilities of VGAM67 include diagnosis, prevention and treatment of diseases and clinical conditions associated with KIAA0993. KIAA1056 (Accession NM_014894) is another VGAM67 host target gene. KIAA1056 BINDING SITE is HOST TARGET binding site found in the 3' untranslated region of mRNA encoded by KIAA1056, corresponding to a HOST TARGET binding site such as BINDING SITE I, BINDING SITE II or BINDING SITE III. Table 2 illustrates the complementarity of the nucleotide sequences of KIAA1056 BINDING SITE, designated SEQ ID:17045, to the nucleotide sequence of VGAM67 RNA, herein designated VGAM RNA, also designated SEQ ID:2778.

Another function of VGAM67 is therefore inhibition of KIAA1056 (Accession NM_014894). Accordingly, utilities of VGAM67 include diagnosis, prevention and treatment of diseases and clinical conditions associated with KIAA1056. LOC257354 (Accession XM_170810) is another VGAM67 host target gene. LOC257354 BINDING SITE is HOST TARGET binding site found in the 3' untranslated region of mRNA encoded by LOC257354, corresponding to a HOST TARGET binding site such as BINDING SITE I, BINDING SITE II or BINDING SITE III. Table 2 illustrates the complementarity of the nucleotide sequences of LOC257354 BINDING SITE, designated SEQ ID:45573, to the nucleotide sequence of VGAM67 RNA, herein designated VGAM RNA, also designated SEQ ID:2778.

Another function of VGAM67 is therefore inhibition of LOC257354 (Accession XM_170810). Accordingly, utilities of VGAM67 include diagnosis, prevention and treatment of diseases and clinical conditions associated with LOC257354. LOC90198 (Accession XM_029882) is another VGAM67 host target gene. LOC90198 BINDING SITE is HOST TARGET binding site found in the 5' untranslated region of mRNA encoded by LOC90198, corresponding to a HOST TARGET binding site such as BINDING SITE I, BINDING SITE II or BINDING SITE III. Table 2 illustrates the complementarity of the nucleotide sequences of LOC90198 BINDING SITE, designated SEQ ID:30957, to the nucleotide sequence of VGAM67 RNA, herein designated VGAM RNA, also designated SEQ ID:2778.

Another function of VGAM67 is therefore inhibition of LOC90198 (Accession XM_029882). Accordingly, utilities of VGAM67 include diagnosis, prevention and treatment of diseases and clinical conditions associated with LOC90198. LOC91380 (Accession XM_038134) is another VGAM67 host target gene. LOC91380 BINDING SITE is HOST TARGET binding site found in the 5' untranslated region of mRNA encoded by LOC91380, corresponding to a HOST TARGET binding site such as BINDING SITE I, BINDING SITE II or BINDING SITE III. Table 2 illustrates the complementarity of the nucleotide sequences of LOC91380 BINDING SITE, designated SEQ ID:32761, to the nucleotide sequence of VGAM67 RNA, herein designated VGAM RNA, also designated SEQ ID:2778.

Another function of VGAM67 is therefore inhibition of LOC91380 (Accession XM_038134). Accordingly, utilities of VGAM67 include diagnosis, prevention and treatment of diseases and clinical conditions associated with LOC91380. FIG. 1 further provides a conceptual description of a novel bioinformatically detected viral gene of the present invention, referred to here as Viral Genomic Address Messenger 68 (VGAM68) viral gene, which modulates expression of respective host target genes thereof, the function and utility of which host target genes is known in the art.

VGAM68 is a novel bioinformatically detected regulatory, non protein coding, viral micro RNA (miRNA) gene. The method by which VGAM68 was detected is described hereinabove with reference to FIGS. 1-8.

VGAM68 gene, herein designated VGAM GENE, is a viral gene contained in the genome of Invertebrate Iridescent Virus 6. VGAM68 host target gene, herein designated VGAM HOST TARGET GENE, is a human gene contained in the human genome.

VGAM68 gene encodes a VGAM68 precursor RNA, herein designated VGAM PRECURSOR RNA. Similar to other miRNA genes, and unlike most ordinary genes, VGAM68 precursor RNA does not encode a protein. A nucleotide sequence identical or highly similar to the nucleotide sequence of VGAM68 precursor RNA is designated SEQ ID:54, and is provided hereinbelow with reference to the sequence listing part. Nucleotide sequence SEQ ID:54 is located at position 27881 relative to the genome of Invertebrate Iridescent Virus 6.

VGAM68 precursor RNA folds onto itself, forming VGAM68 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM68 folded precursor RNA into VGAM68 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM68 RNA is designated SEQ ID:2779, and is provided hereinbelow with reference to the sequence listing part.

VGAM68 host target gene, herein designated VGAM HOST TARGET GENE, encodes a corresponding messenger RNA, VGAM68 host target RNA, herein designated VGAM HOST TARGET RNA. VGAM68 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM68 RNA, herein designated VGAM RNA, binds complementarily to one or more host target binding sites located in untranslated regions of VGAM68 host target RNA, herein designated VGAM HOST TARGET RNA. This complementary binding is due to the fact that the nucleotide sequence of VGAM68 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM68 RNA, herein designated VGAM RNA, may have a different number of host target binding sites in untranslated regions of a VGAM68 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM68 RNA, herein designated VGAM RNA, to host target binding sites on VGAM68 host target RNA, herein designated VGAM HOST TARGET RNA, such as BINDING SITE I, BINDING SITE II and BINDING SITE III, inhibits translation of VGAM68 host target RNA into VGAM68 host target protein, herein designated VGAM HOST TARGET PROTEIN. VGAM host target protein is therefore outlined by a broken line.

It is appreciated that VGAM68 host target gene, herein designated VGAM HOST TARGET GENE, in fact represents a plurality of VGAM68 host target genes. The mRNA of each one of this plurality of VGAM68 host target genes comprises one or more host target binding sites, each having a nucleotide sequence which is at least partly complementary to VGAM68 RNA, herein designated VGAM RNA, and which when bound by VGAM68 RNA causes inhibition of translation of respective one or more VGAM68 host target proteins.

It is further appreciated by one skilled in the art that the mode of translational inhibition illustrated by FIG. 1 with specific reference to translational inhibition exerted by VGAM68 gene, herein designated VGAM GENE, on one or more VGAM68 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM68 is inhibition of expression of host target genes, as part of a novel viral mechanism of attacking a host. Accordingly, utilities of VGAM68 include diagnosis, prevention and treatment of viral infection by Invertebrate Iridescent Virus 6. Specific functions, and accordingly utilities, of VGAM68 correlate with, and may be deduced from, the identity of the host target genes which VGAM68 binds and inhibits, and the function of these host target genes, as elaborated hereinbelow.

Nucleotide sequences of the VGAM68 precursor RNA, herein designated VGAM PRECURSOR RNA, and of the 'diced' VGAM68 RNA, herein designated VGAM RNA, and a schematic representation of the secondary folding of VGAM68 folded precursor RNA, herein designated VGAM FOLDED PRECURSOR RNA, of VGAM68 are further described hereinbelow with reference to Table 1.

Nucleotide sequences of host target binding sites, such as BINDING SITE-I, BINDING SITE-II and BINDING SITE-III of FIG. 1, found on VGAM68 host target RNA, and schematic representation of the complementarity of each of these host target binding sites to VGAM68 RNA, herein designated VGAM RNA, are described hereinbelow with reference to Table 2.

As mentioned hereinabove with reference to FIG. 1, a function of VGAM68 gene, herein designated VGAM is inhibition of expression of VGAM68 target genes. It is appreciated that specific functions, and accordingly utilities, of VGAM68 correlate with, and may be deduced from, the identity of the target genes which VGAM68 binds and inhibits, and the function of these target genes, as elaborated hereinbelow.

Acyl-Coenzyme A Dehydrogenase, Short/branched Chain (ACADSB, Accession NM_001609) is a VGAM68 host target gene. ACADSB BINDING SITE is HOST TARGET binding site found in the 3' untranslated region of mRNA encoded by ACADSB, corresponding to a HOST TARGET binding site such as BINDING SITE I, BINDING SITE II or BINDING SITE III. Table 2 illustrates the complementarity of the nucleotide sequences of ACADSB BINDING SITE, designated SEQ ID:7314, to the nucleotide sequence of VGAM68 RNA, herein designated VGAM RNA, also designated SEQ ID:2779.

A function of VGAM68 is therefore inhibition of Acyl-Coenzyme A Dehydrogenase, Short/branched Chain (ACADSB, Accession NM_001609). Accordingly, utilities of VGAM68 include diagnosis, prevention and treatment of diseases and clinical conditions associated with ACADSB. Myeloid/lymphoid Or Mixed-lineage Leukemia (trithorax homolog, Drosophila); Translocated To, 3 (MLLT3, Accession NM_004529) is another VGAM68 host target gene. MLLT3 BINDING SITE is HOST TARGET binding site found in the 3' untranslated region of mRNA encoded by MLLT3, corresponding to a HOST TARGET binding site such as BINDING SITE I, BINDING SITE II or BINDING SITE III. Table 2 illustrates the complementarity of the nucleotide sequences of MLLT3 BINDING SITE, designated SEQ ID:10870, to the nucleotide sequence of VGAM68 RNA, herein designated VGAM RNA, also designated SEQ ID:2779.

Another function of VGAM68 is therefore inhibition of Myeloid/lymphoid Or Mixed-lineage Leukemia (trithorax homolog, Drosophila); Translocated To, 3 (MLLT3, Accession NM_004529), a gene which is Serine and proline rich protein. Accordingly, utilities of VGAM68 include diagnosis, prevention and treatment of diseases and clinical conditions associated with MLLT3. The function of MLLT3 and its association with various diseases and clinical conditions, has been established by previous studies, as described hereinabove with reference to VGAM67. Methylthioadenosine Phosphorylase (MTAP, Accession NM_002451) is another VGAM68 host target gene. MTAP BINDING SITE is HOST TARGET binding site found in the 3' untranslated region of mRNA encoded by MTAP, corresponding to a HOST TARGET binding site such as BINDING SITE I, BINDING SITE II or BINDING SITE III. Table 2 illustrates the complementarity of the nucleotide sequences of MTAP BINDING SITE, designated SEQ ID:8287, to the nucleotide sequence of VGAM68 RNA, herein designated VGAM RNA, also designated SEQ ID:2779.

Another function of VGAM68 is therefore inhibition of Methylthioadenosine Phosphorylase (MTAP, Accession NM_002451), a gene which plays a major role in polyamine metabolism. Accordingly, utilities of VGAM68 include diagnosis, prevention and treatment of diseases and clinical conditions associated with MTAP. The function of MTAP has been established by previous studies. Methylthioadenosine phosphorylase (EC 24.2.28) plays a major role in polyamine metabolism and is important for the salvage of both adenine and methionine. For example, as much as 97% of the endogenous adenine produced by human lymphoblasts in culture is formed by catabolism of methylthioadenosine (OMIM Ref. No. MeSAdo) by the phosphorylase. MeSAdo, a by-product of the synthesis of the polyamines spermidine and spermine, potently inhibits polyamine aminopropyltransferase reactions if not removed by the above phosphorylase reaction. MeSAdo phosphorylase is abundant in normal cells and tissues but lacking from many human and murine malignant cell lines and from some human leukemias in vivo. Carrera et al. (1984) studied hybrids between MeSAdo phosphorylase-deficient mouse L cells and human fibroblasts to show that the structural gene (symbolized MSAP or MTAP) is located in the 9pter-q12 segment. This enzyme is missing in malignant cells in cases of lymphomatous acute lymphoblastic leukemia (OMIM Ref. No. 247640); many of these cases have abnormality of 9p22-p21 (Chilcote et al., 1985). As indicated by the findings of Olopade et al. (1992), the MTAP locus is centromeric to the cluster of interferon genes (e.g., 147640). Thus, the likely location of MTAP is 9p21. Nobori et al. (1996) cloned the MTAP gene and constructed a topologic map of the 9p21 region using YAC clones, pulsed-field gel electrophoresis, and sequence tagged-site PCR. The MTAP gene consists of 8 exons and 7 introns. Of 23 malignant cell lines deficient in MTAP protein, all but 1 had complete or partial deletions. Partial or total deletions of the MTAP gene were found in primary T-cell acute lymphoblastic leukemias. Within intron 4 they found a deletion breakpoint of partial deletions present in malignant cell lines and primary T-cell acute lymphoblastic leukemias. Starting from the centromeric end, the gene order on chromosome 9p21 was found to be p15 (OMIM Ref. No. 600431)--p16--MTAP--IFNA (OMIM Ref. No. 147660)--IFNB. These results indicated to Nobori et al. (1996) that MTAP deficiency in cancer is primarily due to codeletion of the MTAP and p16 genes.

Full details of the abovementioned studies are described in the following publications, the disclosure of which are hereby incorporated by reference:

Carrera, C. J.; Eddy, R. L.; Shows, T. B.; Carson, D. A.: Assignment of the gene for methylthioadenosine phosphorylase to human chromosome 9 by mouse-human somatic cell hybridization. Proc. Nat. Acad. Sci. 81:2665-2668, 1984; and Nobori, T.; Takabayashi, K.; Tran, P.; Orvis, L.; Batova, A.; Yu, A. L.; Carson, D. A.: Genomic cloning of methylthioadenosine phosphorylase: a purine metabolic enzyme deficient in mult.

Further studies establishing the function and utilities of MTAP are found in John Hopkins OMIM database record ID 156540, and in sited publications numbered 12712-12718 listed in the bibliography section hereinbelow, which are also hereby incorporated by reference. Tryptophanyl-tRNA Synthetase (WARS, Accession XM_041014) is another VGAM68 host target gene. WARS BINDING SITE is HOST TARGET binding site found in the 3' untranslated region of mRNA encoded by WARS, corresponding to a HOST TARGET binding site such as BINDING SITE I, BINDING SITE II or BINDING SITE III. Table 2 illustrates the complementarity of the nucleotide sequences of WARS BINDING SITE, designated SEQ ID:33413, to the nucleotide sequence of VGAM68 RNA, herein designated VGAM RNA, also designated SEQ ID:2779.

Another function of VGAM68 is therefore inhibition of Tryptophanyl-tRNA Synthetase (WARS, Accession XM_041014), a gene which is a tryptophanyl-tRNA synthetase. Accordingly, utilities of VGAM68 include diagnosis, prevention and treatment of diseases and clinical conditions associated with WARS. The function of WARS has been established by previous studies. Otani et al. (2002) showed that a recombinant form of a COOH-terminal fragment of tryptophanyl-tRNA synthetase is a potent antagonist of vascular endothelial growth factor (VEGF; 192240)-induced angiogenesis in a mouse model and of naturally occurring retinal angiogenesis in the neonatal mouse. Angiostatic activity was dose-dependent in both systems. The full-length protein was inactive as an antagonist of angiogenesis. The results suggested that fragments of tryptophanyl-tRNA synthetase, as naturally occurring and potentially nonimmunogenic anti-angiogenics, can be used for the treatment of neovascular eye diseases. In normal cells, human tryptophanyl-tRNA synthetase exists in 2 forms. The major form is the full-length protein, and the other is a truncated form in which most of the extra-NH2-terminal domain is deleted because of alternative splicing of the pre-mRNA (Tolstrup et al., 1995; Turpaev et al., 1996), with met48 being deduced as the NH2-terminal residue of the truncated form. The expression of the short form of WARS is highly stimulated in human cells by the addition of interferon-gamma (IFNG; 147570).

Full details of the abovementioned studies are described in the following publications, the disclosure of which are hereby incorporated by reference:

Otani, A.; Slike, B. M.; Dorrell, M. I.; Hood, J.; Kinder, K.; Ewalt, K. L.; Cheresh, D.; Schimmel, P.; Friedlander, M.: A fragment of human TrpRS as a potent antagonist of ocular angiogenesis. Proc. Nat. Acad. Sci. 99:178-183, 2002; and Turpaev, K. T.; Zakhariev, V. M.; Sokolova, I. V.; Narovlyansky, A. N.; Amchenkova, A. M.; Justesen, J.; Frolova, L. Y.: Alternative processing of the tryptophanyl-tRNA synthetase mRNA f.

Further studies establishing the function and utilities of WARS are found in John Hopkins OMIM database record ID 191050, and in sited publications numbered 10493-10495, 974 and 9765-9771 listed in the bibliography section hereinbelow, which are also hereby incorporated by reference. Di-Ras2 (Accession NM_017594) is another VGAM68 host target gene. Di-Ras2 BINDING SITE is HOST TARGET binding site found in the 3' untranslated region of mRNA encoded by Di-Ras2, corresponding to a HOST TARGET binding site such as BINDING SITE I, BINDING SITE II or BINDING SITE III. Table 2 illustrates the complementarity of the nucleotide sequences of Di-Ras2 BINDING SITE, designated SEQ ID:19046, to the nucleotide sequence of VGAM68 RNA, herein designated VGAM RNA, also designated SEQ ID:2779.

Another function of VGAM68 is therefore inhibition of Di-Ras2 (Accession NM_017594). Accordingly, utilities of VGAM68 include diagnosis, prevention and treatment of diseases and clinical conditions associated with Di-Ras2. RAB39, Member RAS Oncogene Family (RAB39, Accession XM_084662) is another VGAM68 host target gene. RAB39 BINDING SITE is HOST TARGET binding site found in the 3' untranslated region of mRNA encoded by RAB39, corresponding to a HOST TARGET binding site such as BINDING SITE I, BINDING SITE II or BINDING SITE III. Table 2 illustrates the complementarity of the nucleotide sequences of RAB39 BINDING SITE, designated SEQ ID:37646, to the nucleotide sequence of VGAM68 RNA, herein designated VGAM RNA, also designated SEQ ID:2779.

Another function of VGAM68 is therefore inhibition of RAB39, Member RAS Oncogene Family (RAB39, Accession XM_084662). Accordingly, utilities of VGAM68 include diagnosis, prevention and treatment of diseases and clinical conditions associated with RAB39. LOC158292 (Accession XM_098914) is another VGAM68 host target gene. LOC158292 BINDING SITE is HOST TARGET binding site found in the 5' untranslated region of mRNA encoded by LOC158292, corresponding to a HOST TARGET binding site such as BINDING SITE I, BINDING SITE II or BINDING SITE III. Table 2 illustrates the complementarity of the nucleotide sequences of LOC158292 BINDING SITE, designated SEQ ID:41931, to the nucleotide sequence of VGAM68 RNA, herein designated VGAM RNA, also designated SEQ ID:2779.

Another function of VGAM68 is therefore inhibition of LOC158292 (Accession XM_098914). Accordingly, utilities of VGAM68 include diagnosis, prevention and treatment of diseases and clinical conditions associated with LOC158292. LOC93380 (Accession XM_051020) is another VGAM68 host target gene. LOC93380 BINDING SITE is HOST TARGET binding site found in the 3' untranslated region of mRNA encoded by LOC93380, corresponding to a HOST TARGET binding site such as BINDING SITE I, BINDING SITE II or BINDING SITE III. Table 2 illustrates the complementarity of the nucleotide sequences of LOC93380 BINDING SITE, designated SEQ ID:35727, to the nucleotide sequence of VGAM68 RNA, herein designated VGAM RNA, also designated SEQ ID:2779.

Another function of VGAM68 is therefore inhibition of LOC93380 (Accession XM_051020). Accordingly, utilities of VGAM68 include diagnosis, prevention and treatment of diseases and clinical conditions associated with LOC93380. FIG. 1 further provides a conceptual description of a novel bioinformatically detected viral gene of the present invention, referred to here as Viral Genomic Address Messenger 69 (VGAM69) viral gene, which modulates expression of respective host target genes thereof, the function and utility of which host target genes is known in the art.

VGAM69 is a novel bioinformatically detected regulatory, non protein coding, viral micro RNA (miRNA) gene. The method by which VGAM69 was detected is described hereinabove with reference to FIGS. 1-8.

VGAM69 gene, herein designated VGAM GENE, is a viral gene contained in the genome of Invertebrate Iridescent Virus 6. VGAM69 host target gene, herein designated VGAM HOST TARGET GENE, is a human gene contained in the human genome.

VGAM69 gene encodes a VGAM69 precursor RNA, herein designated VGAM PRECURSOR RNA. Similar to other miRNA genes, and unlike most ordinary genes, VGAM69 precursor RNA does not encode a protein. A nucleotide sequence identical or highly similar to the nucleotide sequence of VGAM69 precursor RNA is designated SEQ ID:55, and is provided hereinbelow with reference to the sequence listing part. Nucleotide sequence SEQ ID:55 is located at position 108748 relative to the genome of Invertebrate Iridescent Virus 6.

VGAM69 precursor RNA folds onto itself, forming VGAM69 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM69 folded precursor RNA into VGAM69 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM69 RNA is designated SEQ ID:2780, and is provided hereinbelow with reference to the sequence listing part.

VGAM69 host target gene, herein designated VGAM HOST TARGET GENE, encodes a corresponding messenger RNA, VGAM69 host target RNA, herein designated VGAM HOST TARGET RNA. VGAM69 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM69 RNA, herein designated VGAM RNA, binds complementarily to one or more host target binding sites located in untranslated regions of VGAM69 host target RNA, herein designated VGAM HOST TARGET RNA. This complementary binding is due to the fact that the nucleotide sequence of VGAM69 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM69 RNA, herein designated VGAM RNA, may have a different number of host target binding sites in untranslated regions of a VGAM69 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM69 RNA, herein designated VGAM RNA, to host target binding sites on VGAM69 host target RNA, herein designated VGAM HOST TARGET RNA, such as BINDING SITE I, BINDING SITE II and BINDING SITE III, inhibits translation of VGAM69 host target RNA into VGAM69 host target protein, herein designated VGAM HOST TARGET PROTEIN. VGAM host target protein is therefore outlined by a broken line.

It is appreciated that VGAM69 host target gene, herein designated VGAM HOST TARGET GENE, in fact represents a plurality of VGAM69 host target genes. The mRNA of each one of this plurality of VGAM69 host target genes comprises one or more host target binding sites, each having a nucleotide sequence which is at least partly complementary to VGAM69 RNA, herein designated VGAM RNA, and which when bound by VGAM69 RNA causes inhibition of translation of respective one or more VGAM69 host target proteins.

It is further appreciated by one skilled in the art that the mode of translational inhibition illustrated by FIG. 1 with specific reference to translational inhibition exerted by VGAM69 gene, herein designated VGAM GENE, on one or more VGAM69 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM69 is inhibition of expression of host target genes, as part of a novel viral mechanism of attacking a host. Accordingly, utilities of VGAM69 include diagnosis, prevention and treatment of viral infection by Invertebrate Iridescent Virus 6. Specific functions, and accordingly utilities, of VGAM69 correlate with, and may be deduced from, the identity of the host target genes which VGAM69 binds and inhibits, and the function of these host target genes, as elaborated hereinbelow.

Nucleotide sequences of the VGAM69 precursor RNA, herein designated VGAM PRECURSOR RNA, and of the 'diced' VGAM69 RNA, herein designated VGAM RNA, and a schematic representation of the secondary folding of VGAM69 folded precursor RNA, herein designated VGAM FOLDED PRECURSOR RNA, of VGAM69 are further described hereinbelow with reference to Table 1.

Nucleotide sequences of host target binding sites, such as BINDING SITE-I, BINDING SITE-II and BINDING SITE-III of FIG. 1, found on VGAM69 host target RNA, and schematic representation of the complementarity of each of these host target binding sites to VGAM69 RNA, herein designated VGAM RNA, are described hereinbelow with reference to Table 2.

As mentioned hereinabove with reference to FIG. 1, a function of VGAM69 gene, herein designated VGAM is inhibition of expression of VGAM69 target genes. It is appreciated that specific functions, and accordingly utilities, of VGAM69 correlate with, and may be deduced from, the identity of the target genes which VGAM69 binds and inhibits, and the function of these target genes, as elaborated hereinbelow.

DNA Cross-link Repair 1A (PSO2 homolog, S. cerevisiae) (DCLRE1A, Accession XM_044815) is a VGAM69 host target gene. DCLRE1A BINDING SITE is HOST TARGET binding site found in the 5' untranslated region of mRNA encoded by DCLRE1A, corresponding to a HOST TARGET binding site such as BINDING SITE I, BINDING SITE II or BINDING SITE III. Table 2 illustrates the complementarity of the nucleotide sequences of DCLRE1A BINDING SITE, designated SEQ ID:34280, to the nucleotide sequence of VGAM69 RNA, herein designated VGAM RNA, also designated SEQ ID:2780.

A function of VGAM69 is therefore inhibition of DNA Cross-link Repair 1A (PSO2 homolog, S. cerevisiae) (DCLRE1A, Accession XM_044815). Accordingly, utilities of VGAM69 include diagnosis, prevention and treatment of diseases and clinical conditions associated with DCLRE1A. Leucine-rich Repeat Protein, Neuronal 3 (LRRN3, Accession XM_045261) is another VGAM69 host target gene. LRRN3 BINDING SITE is HOST TARGET binding site found in the 5' untranslated region of mRNA encoded by LRRN3, corresponding to a HOST TARGET binding site such as BINDING SITE I, BINDING SITE II or BINDING SITE III. Table 2 illustrates the complementarity of the nucleotide sequences of LRRN3 BINDING SITE, designated SEQ ID:34398, to the nucleotide sequence of VGAM69 RNA, herein designated VGAM RNA, also designated SEQ ID:2780.

Another function of VGAM69 is therefore inhibition of Leucine-rich Repeat Protein, Neuronal 3 (LRRN3, Accession XM_045261). Accordingly, utilities of VGAM69 include diagnosis, prevention and treatment of diseases and clinical conditions associated with LRRN3. Phosphatidylserine Decarboxylase (PISD, Accession NM_014338) is another VGAM69 host target gene. PISD BINDING SITE is HOST TARGET binding site found in the 3" untranslated region of mRNA encoded by PISD, corresponding to a HOST TARGET binding site such as BINDING SITE I, BINDING SITE II or BINDING SITE III. Table 2 illustrates the complementarity of the nucleotide sequences of PISD BINDING SITE, designated SEQ ID:15652, to the nucleotide sequence of VGAM69 RNA, herein designated VGAM RNA, also designated SEQ ID:2780.

Another function of VGAM69 is therefore inhibition of Phosphatidylserine Decarboxylase (PISD, Accession NM_014338). Accordingly, utilities of VGAM69 include diagnosis, prevention and treatment of diseases and clinical conditions associated with PISD. RGPR (Accession NM_033127) is another VGAM69 host target gene. RGPR BINDING SITE is HOST TARGET binding site found in the 3' untranslated region of mRNA encoded by RGPR, corresponding to a HOST TARGET binding site such as BINDING SITE I, BINDING SITE II or BINDING SITE III. Table 2 illustrates the complementarity of the nucleotide sequences of RGPR BINDING SITE, designated SEQ ID:26970, to the nucleotide sequence of VGAM69 RNA, herein designated VGAM RNA, also designated SEQ ID:2780.

Another function of VGAM69 is therefore inhibition of RGPR (Accession NM_033127). Accordingly, utilities of VGAM69 include diagnosis, prevention and treatment of diseases and clinical conditions associated with RGPR. Solute Carrier Family 38, Member 1 (SLC38A1, Accession NM_030674) is another VGAM69 host target gene. SLC38A1 BINDING SITE is HOST TARGET binding site found in the 3' untranslated region of mRNA encoded by SLC38A1, corresponding to a HOST TARGET binding site such as BINDING SITE I, BINDING SITE II or BINDING SITE III. Table 2 illustrates the complementarity of the nucleotide sequences of SLC38A1 BINDING SITE, designated SEQ ID:25036, to the nucleotide sequence of VGAM69 RNA, herein designated VGAM RNA, also designated SEQ ID:2780.

Another function of VGAM69 is therefore inhibition of Solute Carrier Family 38, Member 1 (SLC38A1, Accession NM_030674). Accordingly, utilities of VGAM69 include diagnosis, prevention and treatment of diseases and clinical conditions associated with SLC38A1. FIG. 1 further provides a conceptual description of a novel bioinformatically detected viral gene of the present invention, referred to here as Viral Genomic Address Messenger 70 (VGAM70) viral gene, which modulates expression of respective host target genes thereof, the function and utility of which host target genes is known in the art.

VGAM70 is a novel bioinformatically detected regulatory, non protein coding, viral micro RNA (miRNA) gene. The method by which VGAM70 was detected is described hereinabove with reference to FIGS. 1-8.

VGAM70 gene, herein designated VGAM GENE, is a viral gene contained in the genome of Invertebrate Iridescent Virus 6. VGAM70 host target gene, herein designated VGAM HOST TARGET GENE, is a human gene contained in the human genome.

VGAM70 gene encodes a VGAM70 precursor RNA, herein designated VGAM PRECURSOR RNA. Similar to other miRNA genes, and unlike most ordinary genes, VGAM70 precursor RNA does not encode a protein. A nucleotide sequence identical or highly similar to the nucleotide sequence of VGAM70 precursor RNA is designated SEQ ID:56, and is provided hereinbelow with reference to the sequence listing part. Nucleotide sequence SEQ ID:56 is located at position 20882 relative to the genome of Invertebrate Iridescent Virus 6.

VGAM70 precursor RNA folds onto itself, forming VGAM70 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM70 folded precursor RNA into VGAM70 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM70 RNA is designated SEQ ID:2781, and is provided hereinbelow with reference to the sequence listing part.

VGAM70 host target gene, herein designated VGAM HOST TARGET GENE, encodes a corresponding messenger RNA, VGAM70 host target RNA, herein designated VGAM HOST TARGET RNA. VGAM70 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM70 RNA, herein designated VGAM RNA, binds complementarily to one or more host target binding sites located in untranslated regions of VGAM70 host target RNA, herein designated VGAM HOST TARGET RNA. This complementary binding is due to the fact that the nucleotide sequence of VGAM70 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM70 RNA, herein designated VGAM RNA, may have a different number of host target binding sites in untranslated regions of a VGAM70 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM70 RNA, herein designated VGAM RNA, to host target binding sites on VGAM70 host target RNA, herein designated VGAM HOST TARGET RNA, such as BINDING SITE I, BINDING SITE II and BINDING SITE III, inhibits translation of VGAM70 host target RNA into VGAM70 host target protein, herein designated VGAM HOST TARGET PROTEIN. VGAM host target protein is therefore outlined by a broken line.

It is appreciated that VGAM70 host target gene, herein designated VGAM HOST TARGET GENE, in fact represents a plurality of VGAM70 host target genes. The mRNA of each one of this plurality of VGAM70 host target genes comprises one or more host target binding sites, each having a nucleotide sequence which is at least partly complementary to VGAM70 RNA, herein designated VGAM RNA, and which when bound by VGAM70 RNA causes inhibition of translation of respective one or more VGAM70 host target proteins.

It is further appreciated by one skilled in the art that the mode of translational inhibition illustrated by FIG. 1 with specific reference to translational inhibition exerted by VGAM70 gene, herein designated VGAM GENE, on one or more VGAM70 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM70 is inhibition of expression of host target genes, as part of a novel viral mechanism of attacking a host. Accordingly, utilities of VGAM70 include diagnosis, prevention and treatment of viral infection by Invertebrate Iridescent Virus 6. Specific functions, and accordingly utilities, of VGAM70 correlate with, and may be deduced from, the identity of the host target genes which VGAM70 binds and inhibits, and the function of these host target genes, as elaborated hereinbelow.

Nucleotide sequences of the VGAM70 precursor RNA, herein designated VGAM PRECURSOR RNA, and of the 'diced' VGAM70 RNA, herein designated VGAM RNA, and a schematic representation of the secondary folding of VGAM70 folded precursor RNA, herein designated VGAM FOLDED PRECURSOR RNA, of VGAM70 are further described hereinbelow with reference to Table 1.

Nucleotide sequences of host target binding sites, such as BINDING SITE-I, BINDING SITE-II and BINDING SITE-III of FIG. 1, found on VGAM70 host target RNA, and schematic representation of the complementarity of each of these host target binding sites to VGAM70 RNA, herein designated VGAM RNA, are described hereinbelow with reference to Table 2.

As mentioned hereinabove with reference to FIG. 1, a function of VGAM70 gene, herein designated VGAM is inhibition of expression of VGAM70 target genes. It is appreciated that specific functions, and accordingly utilities, of VGAM70 correlate with, and may be deduced from, the identity of the target genes which VGAM70 binds and inhibits, and the function of these target genes, as elaborated hereinbelow.

Chromosome 8 Open Reading Frame 1 (C8orf1, Accession NM_004337) is a VGAM70 host target gene. C8orf1 BINDING SITE is HOST TARGET binding site found in the 3' untranslated region of mRNA encoded by C8orf1, corresponding to a HOST TARGET binding site such as BINDING SITE I, BINDING SITE II or BINDING SITE III. Table 2 illustrates the complementarity of the nucleotide sequences of C8orf1 BINDING SITE, designated SEQ ID:10532, to the nucleotide sequence of VGAM70 RNA, herein designated VGAM RNA, also designated SEQ ID:2781.

A function of VGAM70 is therefore inhibition of Chromosome 8 Open Reading Frame 1 (C8orf1, Accession NM_004337). Accordingly, utilities of VGAM70 include diagnosis, prevention and treatment of diseases and clinical conditions associated with C8orf1. Carnitine O-octanoyltransferase (CROT, Accession NM_021151) is another VGAM70 host target gene. CROT BINDING SITE is HOST TARGET binding site found in the 3' untranslated region of mRNA encoded by CROT, corresponding to a HOST TARGET binding site such as BINDING SITE I, BINDING SITE II or BINDING SITE III. Table 2 illustrates the complementarity of the nucleotide sequences of CROT BINDING SITE, designated SEQ ID:22126, to the nucleotide sequence of VGAM70 RNA, herein designated VGAM RNA, also designated SEQ ID:2781.

Another function of VGAM70 is therefore inhibition of Carnitine O-octanoyltransferase (CROT, Accession NM_021151), a gene which CROT plays a crucial role in the beta-oxidation of branched-chain fatty acids including pristanic acid. Accordingly, utilities of VGAM70 include diagnosis, prevention and treatment of diseases and clinical conditions associated with CROT. The function of CROT has been established by previous studies. Carnitine octanoyltransferase (EC 2.3.1.137) is a carnitine acyltransferase that catalyzes the reversible transfer of fatty acyl groups between CoA and carnitine. This provides a crucial step in the transport of medium- and long-chain acyl-CoA out of the mammalian peroxisome to the cytosol and mitochondria. See also CRAT (OMIM Ref. No. 600184). Van der Leij et al. (2000) reviewed the function, structural features, and phylogenetics of human carnitine acyltransferase genes, including CROT Using enzyme activity measurements of CROT expressed in a carnitine acetyltransferase-deficient yeast strain, Ferdinandusse et al. (1999) demonstrated that CROT efficiently converts a branched-chain fatty acyl-CoA (4,8-dimethylnonanoyl-CoA) to its corresponding carnitine ester. They hypothesized that CROT plays a crucial role in the beta-oxidation of branched-chain fatty acids including pristanic acid Full details of the abovementioned studies are described in the following publications, the disclosure of which are hereby incorporated by reference:

Ferdinandusse, S.; Mulders, J.; IJlst, L.; Denis, S.; Dacremont, G.; Waterham, H. R.; Wanders, R. J. A.: Molecular cloning and expression of human carnitine octanoyltransferase: evidence for its role in the peroxisomal beta-oxidation of branched-chain fatty acids. Biochem. Biophys. Res. Commun. 263:213-218, 1999; and van der Leij, F. R.; Huijkman, N. C. A.; Boomsma, C.; Kuipers, J. R. G.; Bartelds, B.: Genomics of the human carnitine acyltransferase genes. Molec. Genet. Metab. 71:139-153, 2000.

Further studies establishing the function and utilities of CROT are found in John Hopkins OMIM database record ID 606090, and in sited publications numbered 612 and 7746 listed in the bibliography section hereinbelow, which are also hereby incorporated by reference. PB1 (Accession NM_018165) is another VGAM70 host target gene. PB1 BINDING SITE is HOST TARGET binding site found in the 3' untranslated region of mRNA encoded by PB1, corresponding to a HOST TARGET binding site such as BINDING SITE I, BINDING SITE II or BINDING SITE III. Table 2 illustrates the complementarity of the nucleotide sequences of PB1 BINDING SITE, designated SEQ ID:19984, to the nucleotide sequence of VGAM70 RNA, herein designated VGAM RNA, also designated SEQ ID:2781.

Another function of VGAM70 is therefore inhibition of PB1 (Accession NM_018165). Accordingly, utilities of VGAM70 include diagnosis, prevention and treatment of diseases and clinical conditions associated with PB1. Pleiomorphic Adenoma Gene-like 2 (PLAGL2, Accession XM_047007) is another VGAM70 host target gene. PLAGL2 BINDING SITE is HOST TARGET binding site found in the 3' untranslated region of mRNA encoded by PLAGL2, corresponding to a HOST TARGET binding site such as BINDING SITE I, BINDING SITE II or BINDING SITE III. Table 2 illustrates the complementarity of the nucleotide sequences of PLAGL2 BINDING SITE, designated SEQ ID:34882, to the nucleotide sequence of VGAM70 RNA, herein designated VGAM RNA, also designated SEQ ID:2781.

Another function of VGAM70 is therefore inhibition of Pleiomorphic Adenoma Gene-like 2 (PLAGL2, Accession XM_047007). Accordingly, utilities of VGAM70 include diagnosis, prevention and treatment of diseases and clinical conditions associated with PLAGL2. FIG. 1 further provides a conceptual description of a novel bioinformatically detected viral gene of the present invention, referred to here as Viral Genomic Address Messenger 71 (VGAM71) viral gene, which modulates expression of respective host target genes thereof, the function and utility of which host target genes is known in the art.

VGAM71 is a novel bioinformatically detected regulatory, non protein coding, viral micro RNA (miRNA) gene. The method by which VGAM71 was detected is described hereinabove with reference to FIGS. 1-8.

VGAM71 gene, herein designated VGAM GENE, is a viral gene contained in the genome of Invertebrate Iridescent Virus 6. VGAM71 host target gene, herein designated VGAM HOST TARGET GENE, is a human gene contained in the human genome.

VGAM71 gene encodes a VGAM71 precursor RNA, herein designated VGAM PRECURSOR RNA. Similar to other miRNA genes, and unlike most ordinary genes, VGAM71 precursor RNA does not encode a protein. A nucleotide sequence identical or highly similar to the nucleotide sequence of VGAM71 precursor RNA is designated SEQ ID:57, and is provided hereinbelow with reference to the sequence listing part. Nucleotide sequence SEQ ID:57 is located at position 34908 relative to the genome of Invertebrate Iridescent Virus 6.

VGAM71 precursor RNA folds onto itself, forming VGAM71 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM71 folded precursor RNA into VGAM71 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM71 RNA is designated SEQ ID:2782, and is provided hereinbelow with reference to the sequence listing part.

VGAM71 host target gene, herein designated VGAM HOST TARGET GENE, encodes a corresponding messenger RNA, VGAM71 host target RNA, herein designated VGAM HOST TARGET RNA. VGAM71 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM71 RNA, herein designated VGAM RNA, binds complementarily to one or more host target binding sites located in untranslated regions of VGAM71 host target RNA, herein designated VGAM HOST TARGET RNA. This complementary binding is due to the fact that the nucleotide sequence of VGAM71 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM71 RNA, herein designated VGAM RNA, may have a different number of host target binding sites in untranslated regions of a VGAM71 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM71 RNA, herein designated VGAM RNA, to host target binding sites on VGAM71 host target RNA, herein designated VGAM HOST TARGET RNA, such as BINDING SITE I, BINDING SITE II and BINDING SITE III, inhibits translation of VGAM71 host target RNA into VGAM71 host target protein, herein designated VGAM HOST TARGET PROTEIN. VGAM host target protein is therefore outlined by a broken line.

It is appreciated that VGAM71 host target gene, herein designated VGAM HOST TARGET GENE, in fact represents a plurality of VGAM71 host target genes. The mRNA of each one of this plurality of VGAM71 host target genes comprises one or more host target binding sites, each having a nucleotide sequence which is at least partly complementary to VGAM71 RNA, herein designated VGAM RNA, and which when bound by VGAM71 RNA causes inhibition of translation of respective one or more VGAM71 host target proteins.

It is further appreciated by one skilled in the art that the mode of translational inhibition illustrated by FIG. 1 with specific reference to translational inhibition exerted by VGAM71 gene, herein designated VGAM GENE, on one or more VGAM71 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM71 is inhibition of expression of host target genes, as part of a novel viral mechanism of attacking a host. Accordingly, utilities of VGAM71 include diagnosis, prevention and treatment of viral infection by Invertebrate Iridescent Virus 6. Specific functions, and accordingly utilities, of VGAM71 correlate with, and may be deduced from, the identity of the host target genes which VGAM71 binds and inhibits, and the function of these host target genes, as elaborated hereinbelow.

Nucleotide sequences of the VGAM71 precursor RNA, herein designated VGAM PRECURSOR RNA, and of the 'diced' VGAM71 RNA, herein designated VGAM RNA, and a schematic representation of the secondary folding of VGAM71 folded precursor RNA, herein designated VGAM FOLDED PRECURSOR RNA, of VGAM71 are further described hereinbelow with reference to Table 1.

Nucleotide sequences of host target binding sites, such as BINDING SITE-I, BINDING SITE-II and BINDING SITE-III of FIG. 1, found on VGAM71 host target RNA, and schematic representation of the complementarity of each of these host target binding sites to VGAM71 RNA, herein designated VGAM RNA, are described hereinbelow with reference to Table 2.

As mentioned hereinabove with reference to FIG. 1, a function of VGAM71 gene, herein designated VGAM is inhibition of expression of VGAM71 target genes. It is appreciated that specific functions, and accordingly utilities, of VGAM71 correlate with, and may be deduced from, the identity of the target genes which VGAM71 binds and inhibits, and the function of these target genes, as elaborated hereinbelow.

Cardiotrophin 1 (CTF1, Accession NM_001330) is a VGAM71 host target gene. CTF1 BINDING SITE is HOST TARGET binding site found in the 3' untranslated region of mRNA encoded by CTF1, corresponding to a HOST TARGET binding site such as BINDING SITE I, BINDING SITE II or BINDING SITE III. Table 2 illustrates the complementarity of the nucleotide sequences of CTF1 BINDING SITE, designated SEQ ID:7012, to the nucleotide sequence of VGAM71 RNA, herein designated VGAM RNA, also designated SEQ ID:2782.

A function of VGAM71 is therefore inhibition of Cardiotrophin 1 (CTF1, Accession NM_001330), a gene which may play a role in cardiac hypertrophy. Accordingly, utilities of VGAM71 include diagnosis, prevention and treatment of diseases and clinical conditions associated with CTF1. The function of CTF1 has been established by previous studies. Heart failure is a leading cause of mortality worldwide. A hallmark of the disease is dilated cardiac hypertrophy, which is accompanied by a reactivation of genes expressed in fetal heart development. Reasoning that fetal or embryonic growth factors may mediate the onset of cardiac hypertrophy, Pennica et al. (1995) coupled expression cloning with an embryonic stem cell-based model of cardiogenesis to isolate a 21.5-kD protein, cardiotrophin 1, that potently induces cardiac myocyte hypertrophy in vitro. Amino acid similarity data indicated that CT1 is a member of the family of cytokines that includes leukemia inhibitory factor (LIF; 159540), ciliary neurotrophic factor (CNTF; 118945), oncostatin M (OSM; 165095), interleukin 6 (IL6; 147620), and interleukin 11 (IL11; 147681). Several members of this family that are known to signal through the transmembrane protein gp130 (OMIM Ref. No. 162820) stimulate cardiac myocyte hypertrophy, like cardiotrophin 1, suggesting that the gp130 signaling pathway may play a role in cardiac hypertrophy. The 1.4-kb CT1 mRNA is present in the heart and several other mouse tissues Amyotrophic lateral sclerosis (ALS; 105400) is mainly a sporadic neurodegenerative disorder characterized by loss of cortical and spinal motoneurons. Some familial ALS (FALS) cases have been linked to dominant mutations in the gene encoding Cu/Zn superoxide dismutase (SOD1; 147450). Transgenic mice overexpressing a mutated form of human SOD1 with a gly93-to-ala substitution (147450.0008) develop progressive muscle wasting and paralysis as a result of spinal motoneuron loss and die at 5 to 6 months. Bordet et al. (2001) investigated the effects of neurotrophic factor gene delivery in this FALS model. Intramuscular injection of an adenoviral vector encoding CTF1 in SOD1(G93A) newborn mice delayed the onset of motor impairment as assessed in the rotarod test. By CTF1 treatment, axonal degeneration was slowed, skeletal muscle atrophy was largely reduced, and the time-course of motor impairment was significantly decreased Full details of the abovementioned studies are described in the following publications, the disclosure of which are hereby incorporated by reference:

Pennica, D.; King, K. L.; Shaw, K. J.; Luis, E.; Rullamas, J.; Luoh, S.-M.; Darbonne, W. C.; Knutzon, D. S.; Yen, R.; Chien, K. R.; Baker, J. B.; Wood, W. I.: Expression cloning of cardiotrophin 1, a cytokine that induces cardiac myocyte hypertrophy. Proc. Nat. Acad. Sci. 92:1142-1146, 1995; and Bordet, T.; Lesbordes, J.-C.; Rouhani, S.; Castelnau-Ptakhine, L.; Schmalbruch, H.; Haase, G.; Kahn, A.: Protective effects of cardiotrophin-1 adenoviral gene transfer on neuromuscular.

Further studies establishing the function and utilities of CTF1 are found in John Hopkins OMIM database record ID 600435, and in sited publications numbered 12309-776 and 7677 listed in the bibliography section hereinbelow, which are also hereby incorporated by reference. NEBL (Accession NM_006393) is another VGAM71 host target gene. NEBL BINDING SITE is HOST TARGET binding site found in the 5' untranslated region of mRNA encoded by NEBL, corresponding to a HOST TARGET binding site such as BINDING SITE I, BINDING SITE II or BINDING SITE III. Table 2 illustrates the complementarity of the nucleotide sequences of NEBL BINDING SITE, designated SEQ ID:13102, to the nucleotide sequence of VGAM71 RNA, herein designated VGAM RNA, also designated SEQ ID:2782.

Another function of VGAM71 is therefore inhibition of NEBL (Accession NM_006393). Accordingly, utilities of VGAM71 include diagnosis, prevention and treatment of diseases and clinical conditions associated with NEBL. Opioid Binding Protein/cell Adhesion Molecule-like (OPCML, Accession NM_002545) is another VGAM71 host target gene. OPCML BINDING SITE is HOST TARGET binding site found in the 3' untranslated region of mRNA encoded by OPCML, corresponding to a HOST TARGET binding site such as BINDING SITE I, BINDING SITE II or BINDING SITE III. Table 2 illustrates the complementarity of the nucleotide sequences of OPCML BINDING SITE, designated SEQ ID:8397, to the nucleotide sequence of VGAM71 RNA, herein designated VGAM RNA, also designated SEQ ID:2782.

Another function of VGAM71 is therefore inhibition of Opioid Binding Protein/cell Adhesion Molecule-like (OPCML, Accession NM_002545), a gene which may function as a GPI-anchored neural cell adhesion molecule. Accordingly, utilities of VGAM71 include diagnosis, prevention and treatment of diseases and clinical conditions associated with OPCML. The function of OPCML has been established by previous studies. OBCAM, also designated OPCML, is a protein that binds opioid alkaloids in the presence of acidic lipids, exhibiting selectivity for mu ligands. It shares structural homology with members of the immunoglobulin protein superfamily, most notably with cell-adhesion molecules. Analysis of the amino acid sequence indicates that it is an extracellularly located molecule, and the presence of a hydrophobic C terminus suggests that it may be inserted into the cell membrane through phosphatidylinositol linkage. Shark and Lee (1995) stated that, due to the lack of transmembrane domains necessary for signal transduction, it is improbable that OBCAM acts independently as an opioid receptor; more likely, it plays an important accessory role in opioid receptor function. OBCAM was first purified from bovine brain by Cho et al. (1986). The gene was mapped to mouse chromosome 9, and from linkage homology data it was predicted that its human counterpart would lie on either 19p or 11q22-qter (Chakraborti et al., 1993). Shark and Lee (1995) used DNA primers derived from rat OBCAM cDNA to PCR-amplify a 403-bp fragment from a human brain cDNA library. The fragment was cloned, sequenced, and used as a hybridization probe to screen the library to obtain a cDNA fragment, including a complete open reading frame of 1,038 bp. Sequence analysis of the ORF revealed 93% identity to the rat OBCAM cDNA at the nucleotide level and 98% identity at the deduced amino acid sequence level. By hybridization to a somatic cell hybrid panel, they mapped the gene to chromosome 11. They noted that the gene for neural cell adhesion molecule (NCAM; 116930) and other proteins of similar structure that are expressed in the nervous system also map to 11q22-q23.

Full details of the abovementioned studies are described in the following publications, the disclosure of which are hereby incorporated by reference:

Chakraborti, A.; Lippman, D. L.; Loh, H. H.; Kozak, C. A.; Lee, N. M.: Genetic mapping of opioid binding protein gene (s) to mouse chromosome 9. Mammalian Genome 4:179-182, 1993; and Shark, K. B.; Lee, N. M.: Cloning, sequencing and localization to chromosome 11 of a cDNA encoding a human opioid-binding cell adhesion molecule (OBCAM). Gene 155: 213-217, 1995.

Further studies establishing the function and utilities of OPCML are found in John Hopkins OMIM database record ID 600632, and in sited publications numbered 6836-6838 listed in the bibliography section hereinbelow, which are also hereby incorporated by reference. Protocadherin Alpha 9 (PCDHA9, Accession NM_014005) is another VGAM71 host target gene. PCDHA9 BINDING SITE1 and PCDHA9 BINDING SITE2 are HOST TARGET binding sites found in untranslated regions of mRNA encoded by PCDHA9, corresponding to HOST TARGET binding sites such as BINDING SITE I, BINDING SITE II or BINDING SITE III. Table 2 illustrates the complementarity of the nucleotide sequences of PCDHA9 BINDING SITE1 and PCDHA9 BINDING SITE2, designated SEQ ID:15215 and SEQ ID:25607 respectively, to the nucleotide sequence of VGAM71 RNA, herein designated VGAM RNA, also designated SEQ ID:2782.

Another function of VGAM71 is therefore inhibition of Protocadherin Alpha 9 (PCDHA9, Accession NM_014005), a gene which is a calcium-dependent cell-adhesion protein. Accordingly, utilities of VGAM71 include diagnosis, prevention and treatment of diseases and clinical conditions associated with PCDHA9. The function of PCDHA9 has been established by previous studies. Cadherins are calcium-dependent cell-cell adhesion molecules that mediate neural cell-cell interactions. Protocadherins constitute a subfamily of nonclassic cadherins. PCDHA9 is a member of the alpha cluster of protocadherin genes on 5q31. By screening a brain cDNA library for sequences with the potential to encode large proteins, Nagase et al. (1997) identified a cDNA encoding PCDHA9, which they termed KIAA0345. The deduced protein has 842 amino acids. RT-PCR analysis detected strongest expression of KIAA0345 in kidney and testis, followed by brain, lung, pancreas, and ovary.

Full details of the abovementioned studies are described in the following publications, the disclosure of which are hereby incorporated by reference:

Nagase, T.; Ishikawa, I.; Nakajima, D.; Ohira, M.; Seki, N.; Miyajima, N.; Tanaka, A.; Kotani, H.; Nomura, N.; O'Hara, O.: Prediction of the coding sequences of unidentified human genes. VII. The complete sequences of 100 new cDNA clones from brain which can code for large proteins in vitro. DNA Res. 4:141-150, 1997; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse and.

Further studies establishing the function and utilities of PCDHA9 are found in John Hopkins OMIM database record ID 606315, and in sited publications numbered 730 and 9535 listed in the bibliography section hereinbelow, which are also hereby incorporated by reference. RAB4A, Member RAS Oncogene Family (RAB4A, Accession NM_004578) is another VGAM71 host target gene. RAB4A BINDING SITE is HOST TARGET binding site found in the 3' untranslated region of mRNA encoded by RAB4A, corresponding to a HOST TARGET binding site such as BINDING SITE I, BINDING SITE II or BINDING SITE III. Table 2 illustrates the complementarity of the nucleotide sequences of RAB4A BINDING SITE, designated SEQ ID:10926, to the nucleotide sequence of VGAM71 RNA, herein designated VGAM RNA, also designated SEQ ID:2782.

Another function of VGAM71 is therefore inhibition of RAB4A, Member RAS Oncogene Family (RAB4A, Accession NM_004578), a gene which is involved in protein transport. Accordingly, utilities of VGAM71 include diagnosis, prevention and treatment of diseases and clinical conditions associated with RAB4A. The function of RAB4A has been established by previous studies. The mammalian RAB proteins show striking similarities to the S. cerevisiae YPT1 and SEC4 proteins, Ras-related GTP-binding proteins involved in the regulation of secretion. Zahraoui et al. (1989) isolated cDNAs encoding RAB4 and several other human RAB proteins. See RAB5A (OMIM Ref. No. 179512). The predicted 213-amino acid human RAB4 protein shares 98% and 50% identity with rat Rab4 and human RAB2, respectively. Northern blot analysis revealed that the RAB4 gene was expressed weakly as 1.8-, 3.1-, and 3.6-kb mRNAs in a human fibroblast cell line. By in situ hybridization, Rousseau-Merck et al. (1991) assigned the RAB4 gene to 1q42-q43. Barbosa et al. (1995) referred to this locus as RAV4A and mapped the mouse homolog by interspecific backcross analysis to the distal end of mouse chromosome 8. The authors mapped Rab4b to proximal mouse chromosome 7. They also reported that 4 additional members of the mouse Rab gene family exist on mouse chromosomes 2, 9, 12, and 13.

Full details of the abovementioned studies are described in the following publications, the disclosure of which are hereby incorporated by reference:

Barbosa, M. D. F. S.; Johnson, S. A.; Achey, K.; Gutierrez, M.; Wakeland, E. K.; Zerial, M.; Kingsmore, S. F.: The Rab protein family: genetic mapping of six Rab genes in the mouse. Genomics 30:439-444, 1995; and Zahraoui, A.; Touchot, N.; Chardin, P.; Tavitian, A.: The human rab genes encode a family of GTP-binding proteins related to yeast YPT1 and SEC4 products involved in secretion. J. Biol.

Further studies establishing the function and utilities of RAB4A are found in John Hopkins OMIM database record ID 179511, and in sited publications numbered 2540-254 and 2722 listed in the bibliography section hereinbelow, which are also hereby incorporated by reference. ADP-ribosylation Factor GTPase Activating Protein 3 (ARFGAP3, Accession NM_014570) is another VGAM71 host target gene. ARFGAP3 BINDING SITE is HOST TARGET binding site found in the 3' untranslated region of mRNA encoded by ARFGAP3, corresponding to a HOST TARGET binding site such as BINDING SITE I, BINDING SITE II or BINDING SITE III. Table 2 illustrates the complementarity of the nucleotide sequences of ARFGAP3 BINDING SITE, designated SEQ ID:15926, to the nucleotide sequence of VGAM71 RNA, herein designated VGAM RNA, also designated SEQ ID:2782.

Another function of VGAM71 is therefore inhibition of ADP-ribosylation Factor GTPase Activating Protein 3 (ARFGAP3, Accession NM_014570). Accordingly, utilities of VGAM71 include diagnosis, prevention and treatment of diseases and clinical conditions associated with ARFGAP3. BOP (Accession XM_097915) is another VGAM71 host target gene. BOP BINDING SITE is HOST TARGET binding site found in the 5' untranslated region of mRNA encoded by BOP, corresponding to a HOST TARGET binding site such as BINDING SITE I, BINDING SITE II or BINDING SITE III. Table 2 illustrates the complementarity of the nucleotide sequences of BOP BINDING SITE, designated SEQ ID:41211, to the nucleotide sequence of VGAM71 RNA, herein designated VGAM RNA, also designated SEQ ID:2782.

Another function of VGAM71 is therefore inhibition of BOP (Accession XM_097915). Accordingly, utilities of VGAM71 include diagnosis, prevention and treatment of diseases and clinical conditions associated with BOP. Chemokine (C-C motif) Receptor 1 (CCR1, Accession NM_001295) is another VGAM71 host target gene. CCR1 BINDING SITE is HOST TARGET binding site found in the 3' untranslated region of mRNA encoded by CCR1, corresponding to a HOST TARGET binding site such as BINDING SITE I, BINDING SITE II or BINDING SITE III. Table 2 illustrates the complementarity of the nucleotide sequences of CCR1 BINDING SITE, designated SEQ ID:6976, to the nucleotide sequence of VGAM71 RNA, herein designated VGAM RNA, also designated SEQ ID:2782.

Another function of VGAM71 is therefore inhibition of Chemokine (C-C motif) Receptor 1 (CCR1, Accession NM_001295). Accordingly, utilities of VGAM71 include diagnosis, prevention and treatment of diseases and clinical conditions associated with CCR1. DKFZP434F1735 (Accession NM_015590) is another VGAM71 host target gene. DKFZP434F1735 BINDING SITE is HOST TARGET binding site found in the 5' untranslated region of mRNA encoded by DKFZP434F1735, corresponding to a HOST TARGET binding site such as BINDING SITE I, BINDING SITE II or BINDING SITE III. Table 2 illustrates the complementarity of the nucleotide sequences of DKFZP434F1735 BINDING SITE, designated SEQ ID:17856, to the nucleotide sequence of VGAM71 RNA, herein designated VGAM RNA, also designated SEQ ID:2782.

Another function of VGAM71 is therefore inhibition of DKFZP434F1735 (Accession NM_015590). Accordingly, utilities of VGAM71 include diagnosis, prevention and treatment of diseases and clinical conditions associated with DKFZP434F1735. DKFZP434P211 (Accession NM_014549) is another VGAM71 host target gene. DKFZP434P211 BINDING SITE is HOST TARGET binding site found in the 3' untranslated region of mRNA encoded by DKFZP434P211, corresponding to a HOST TARGET binding site such as BINDING SITE I, BINDING SITE II or BINDING SITE III. Table 2 illustrates the complementarity of the nucleotide sequences of DKFZP434P211 BINDING SITE, designated SEQ ID:15871, to the nucleotide sequence of VGAM71 RNA, herein designated VGAM RNA, also designated SEQ ID:2782.

Another function of VGAM71 is therefore inhibition of DKFZP434P211 (Accession NM_014549). Accordingly, utilities of VGAM71 include diagnosis, prevention and treatment of diseases and clinical conditions associated with DKFZP434P211. EKI1 (Accession NM_018638) is another VGAM71 host target gene. EKI1 BINDING SITE is HOST TARGET binding site found in the 3' untranslated region of mRNA encoded by EKI1, corresponding to a HOST TARGET binding site such as BINDING SITE I, BINDING SITE II or BINDING SITE III. Table 2 illustrates the complementarity of the nucleotide sequences of EKI1 BINDING SITE, designated SEQ ID:20709, to the nucleotide sequence of VGAM71 RNA, herein designated VGAM RNA, also designated SEQ ID:2782.

Another function of VGAM71 is therefore inhibition of EKI1 (Accession NM_018638). Accordingly, utilities of VGAM71 include diagnosis, prevention and treatment of diseases and clinical conditions associated with EKI1. Potassium Channel, Subfamily T, Member 1 (KCNT1, Accession XM_029962) is another VGAM71 host target gene. KCNT1 BINDING SITE is HOST TARGET binding site found in the 3' untranslated region of mRNA encoded by KCNT1, corresponding to a HOST TARGET binding site such as BINDING SITE I, BINDING SITE II or BINDING SITE III. Table 2 illustrates the complementarity of the nucleotide sequences of KCNT1 BINDING SITE, designated SEQ ID:30979, to the nucleotide sequence of VGAM71 RNA, herein designated VGAM RNA, also designated SEQ ID:2782.

Another function of VGAM71 is therefore inhibition of Potassium Channel, Subfamily T, Member 1 (KCNT1, Accession XM_029962). Accordingly, utilities of VGAM71 include diagnosis, prevention and treatment of diseases and clinical conditions associated with KCNT1. KIAA1046 (Accession NM_014928) is another VGAM71 host target gene. KIAA1046 BINDING SITE is HOST TARGET binding site found in the 3' untranslated region of mRNA encoded by KIAA1046, corresponding to a HOST TARGET binding site such as BINDING SITE I, BINDING SITE II or BINDING SITE III. Table 2 illustrates the complementarity of the nucleotide sequences of KIAA1046 BINDING SITE, designated SEQ ID:17222, to the nucleotide sequence of VGAM71 RNA, herein designated VGAM RNA, also designated SEQ ID:2782.

Another function of VGAM71 is therefore inhibition of KIAA1046 (Accession NM_014928). Accordingly, utilities of VGAM71 include diagnosis, prevention and treatment of diseases and clinical conditions associated with KIAA1046. KIAA1719 (Accession XM_042936) is another VGAM71 host target gene. KIAA1719 BINDING SITE is HOST TARGET binding site found in the 3' untranslated region of mRNA encoded by KIAA1719, corresponding to a HOST TARGET binding site such as BINDING SITE I, BINDING SITE II or BINDING SITE III. Table 2 illustrates the complementarity of the nucleotide sequences of KIAA1719 BINDING SITE, designated SEQ ID:33826, to the nucleotide sequence of VGAM71 RNA, herein designated VGAM RNA, also designated SEQ ID:2782.

Another function of VGAM71 is therefore inhibition of KIAA1719 (Accession XM_042936). Accordingly, utilities of VGAM71 include diagnosis, prevention and treatment of diseases and clinical conditions associated with KIAA1719. MGC20253 (Accession NM_144583) is another VGAM71 host target gene. MGC20253 BINDING SITE is HOST TARGET binding site found in the 3' untranslated region of mRNA encoded by MGC20253, corresponding to a HOST TARGET binding site such as BINDING SITE I, BINDING SITE II or BINDING SITE III. Table 2 illustrates the complementarity of the nucleotide sequences of MGC20253 BINDING SITE, designated SEQ ID:29400, to the nucleotide sequence of VGAM71 RNA, herein designated VGAM RNA, also designated SEQ ID:2782.

Another function of VGAM71 is therefore inhibition of MGC20253 (Accession NM_144583). Accordingly, utilities of VGAM71 include diagnosis, prevention and treatment of diseases and clinical conditions associated with MGC20253. MGC5566 (Accession NM_024049) is another VGAM71 host target gene. MGC5566 BINDING SITE is HOST TARGET binding site found in the 3' untranslated region of mRNA encoded by MGC5566, corresponding to a HOST TARGET binding site such as BINDING SITE I, BINDING SITE II or BINDING SITE III. Table 2 illustrates the complementarity of the nucleotide sequences of MGC5566 BINDING SITE, designated SEQ ID:23487, to the nucleotide sequence of VGAM71 RNA, herein designated VGAM RNA, also designated SEQ ID:2782.

Another function of VGAM71 is therefore inhibition of MGC5566 (Accession NM_024049). Accordingly, utilities of VGAM71 include diagnosis, prevention and treatment of diseases and clinical conditions associated with MGC5566. SDF1 (Accession XM_165565) is another VGAM71 host target gene. SDF1 BINDING SITE is HOST TARGET binding site found in the 3' untranslated region of mRNA encoded by SDF1, corresponding to a HOST TARGET binding site such as BINDING SITE I, BINDING SITE II or BINDING SITE III. Table 2 illustrates the complementarity of the nucleotide sequences of SDF1 BINDING SITE, designated SEQ ID:43692, to the nucleotide sequence of VGAM71 RNA, herein designated VGAM RNA, also designated SEQ ID:2782.

Another function of VGAM71 is therefore inhibition of SDF1 (Accession XM_165565). Accordingly, utilities of VGAM71 include diagnosis, prevention and treatment of diseases and clinical conditions associated with SDF1. Serum Response Factor (c-fos serum response element-binding transcription factor) (SRF, Accession NM_003131) is another VGAM71 host target gene. SRF BINDING SITE is HOST TARGET binding site found in the 3' untranslated region of mRNA encoded by SRF, corresponding to a HOST TARGET binding site such as BINDING SITE I, BINDING SITE II or BINDING SITE III. Table 2 illustrates the complementarity of the nucleotide sequences of SRF BINDING SITE, designated SEQ ID:9106, to the nucleotide sequence of VGAM71 RNA, herein designated VGAM RNA, also designated SEQ ID:2782.

Another function of VGAM71 is therefore inhibition of Serum Response Factor (c-fos serum response element-binding transcription factor) (SRF, Accession NM_003131). Accordingly, utilities of VGAM71 include diagnosis, prevention and treatment of diseases and clinical conditions associated with SRF. Tripartite Motif-containing 26 (TRIM26, Accession NM_003449) is another VGAM71 host target gene. TRIM26 BINDING SITE is HOST TARGET binding site found in the 3' untranslated region of mRNA encoded by TRIM26, corresponding to a HOST TARGET binding site such as BINDING SITE I, BINDING SITE II or BINDING SITE III. Table 2 illustrates the complementarity of the nucleotide sequences of TRIM26 BINDING SITE, designated SEQ ID:9502, to the nucleotide sequence of VGAM71 RNA, herein designated VGAM RNA, also designated SEQ ID:2782.

Another function of VGAM71 is therefore inhibition of Tripartite Motif-containing 26 (TRIM26, Accession NM_003449). Accordingly, utilities of VGAM71 include diagnosis, prevention and treatment of diseases and clinical conditions associated with TRIM26. LOC114971 (Accession XM_054936) is another VGAM71 host target gene. LOC114971 BINDING SITE is HOST TARGET binding site found in the 3' untranslated region of mRNA encoded by LOC114971, corresponding to a HOST TARGET binding site such as BINDING SITE I, BINDING SITE II or BINDING SITE III. Table 2 illustrates the complementarity of the nucleotide sequences of LOC114971 BINDING SITE, designated SEQ ID:36211, to the nucleotide sequence of VGAM71 RNA, herein designated VGAM RNA, also designated SEQ ID:2782.

Another function of VGAM71 is therefore inhibition of LOC114971 (Accession XM_054936). Accordingly, utilities of VGAM71 include diagnosis, prevention and treatment of diseases and clinical conditions associated with LOC114971. LOC148189 (Accession XM_086087) is another VGAM71 host target gene. LOC148189 BINDING SITE is HOST TARGET binding site found in the 3' untranslated region of mRNA encoded by LOC148189, corresponding to a HOST TARGET binding site such as BINDING SITE I, BINDING SITE II or BINDING SITE III. Table 2 illustrates the complementarity of the nucleotide sequences of LOC148189 BINDING SITE, designated SEQ ID:38488, to the nucleotide sequence of VGAM71 RNA, herein designated VGAM RNA, also designated SEQ ID:2782.

Another function of VGAM71 is therefore inhibition of LOC148189 (Accession XM_086087). Accordingly, utilities of VGAM71 include diagnosis, prevention and treatment of diseases and clinical conditions associated with LOC148189. LOC151121 (Accession XM_087102) is another VGAM71 host target gene. LOC151121 BINDING SITE is HOST TARGET binding site found in the 5' untranslated region of mRNA encoded by LOC151121, corresponding to a HOST TARGET binding site such as BINDING SITE I, BINDING SITE II or BINDING SITE III. Table 2 illustrates the complementarity of the nucleotide sequences of LOC151121 BINDING SITE, designated SEQ ID:39054, to the nucleotide sequence of VGAM71 RNA, herein designated VGAM RNA, also designated SEQ ID:2782.

Another function of VGAM71 is therefore inhibition of LOC151121 (Accession XM_087102). Accordingly, utilities of VGAM71 include diagnosis, prevention and treatment of diseases and clinical conditions associated with LOC151121. LOC151473 (Accession XM_087215) is another VGAM71 host target gene. LOC151473 BINDING SITE is HOST TARGET binding site found in the 3' untranslated region of mRNA encoded by LOC151473, corresponding to a HOST TARGET binding site such as BINDING SITE I, BINDING SITE II or BINDING SITE III. Table 2 illustrates the complementarity of the nucleotide sequences of LOC151473 BINDING SITE, designated SEQ ID:39124, to the nucleotide sequence of VGAM71 RNA, herein designated VGAM RNA, also designated SEQ ID:2782.

Another function of VGAM71 is therefore inhibition of LOC151473 (Accession XM_087215). Accordingly, utilities of VGAM71 include diagnosis, prevention and treatment of diseases and clinical conditions associated with LOC151473. LOC200734 (Accession XM_114286) is another VGAM71 host target gene. LOC200734 BINDING SITE is HOST TARGET binding site found in the 3' untranslated region of mRNA encoded by LOC200734, corresponding to a HOST TARGET binding site such as BINDING SITE I, BINDING SITE II or BINDING SITE III. Table 2 illustrates the complementarity of the nucleotide sequences of LOC200734 BINDING SITE, designated SEQ ID:42845, to the nucleotide sequence of VGAM71 RNA, herein designated VGAM RNA, also designated SEQ ID:2782.

Another function of VGAM71 is therefore inhibition of LOC200734 (Accession XM_114286). Accordingly, utilities of VGAM71 include diagnosis, prevention and treatment of diseases and clinical conditions associated with LOC200734. LOC221943 (Accession XM_168343) is another VGAM71 host target gene. LOC221943 BINDING SITE is HOST TARGET binding site found in the 5' untranslated region of mRNA encoded by LOC221943, corresponding to a HOST TARGET binding site such as BINDING SITE I, BINDING SITE II or BINDING SITE III. Table 2 illustrates the complementarity of the nucleotide sequences of LOC221943 BINDING SITE, designated SEQ ID:45117, to the nucleotide sequence of VGAM71 RNA, herein designated VGAM RNA, also designated SEQ ID:2782.

Another function of VGAM71 is therefore inhibition of LOC221943 (Accession XM_168343). Accordingly, utilities of VGAM71 include diagnosis, prevention and treatment of diseases and clinical conditions associated with LOC221943. LOC257494 (Accession XM_175212) is another VGAM71 host target gene. LOC257494 BINDING SITE is HOST TARGET binding site found in the 3' untranslated region of mRNA encoded by LOC257494, corresponding to a HOST TARGET binding site such as BINDING SITE I, BINDING SITE II or BINDING SITE III. Table 2 illustrates the complementarity of the nucleotide sequences of LOC257494 BINDING SITE, designated SEQ ID:46689, to the nucleotide sequence of VGAM71 RNA, herein designated VGAM RNA, also designated SEQ ID:2782.

Another function of VGAM71 is therefore inhibition of LOC257494 (Accession XM_175212). Accordingly, utilities of VGAM71 include diagnosis, prevention and treatment of diseases and clinical conditions associated with LOC257494. LOC91522 (Accession XM_038953) is another VGAM71 host target gene. LOC91522 BINDING SITE is HOST TARGET binding site found in the 3' untranslated region of mRNA encoded by LOC91522, corresponding to a HOST TARGET binding site such as BINDING SITE I, BINDING SITE II or BINDING SITE III. Table 2 illustrates the complementarity of the nucleotide sequences of LOC91522 BINDING SITE, designated SEQ ID:32963, to the nucleotide sequence of VGAM71 RNA, herein designated VGAM RNA, also designated SEQ ID:2782.

Another function of VGAM71 is therefore inhibition of LOC91522 (Accession XM_038953). Accordingly, utilities of VGAM71 include diagnosis, prevention and treatment of diseases and clinical conditions associated with LOC91522. FIG. 1 further provides a conceptual description of a novel bioinformatically detected viral gene of the present invention, referred to here as Viral Genomic Address Messenger 72 (VGAM72) viral gene, which modulates expression of respective host target genes thereof, the function and utility of which host target genes is known in the art.

VGAM72 is a novel bioinformatically detected regulatory, non protein coding, viral micro RNA (miRNA) gene. The method by which VGAM72 was detected is described hereinabove with reference to FIGS. 1-8.

VGAM72 gene, herein designated VGAM GENE, is a viral gene contained in the genome of Invertebrate Iridescent Virus 6. VGAM72 host target gene, herein designated VGAM HOST TARGET GENE, is a human gene contained in the human genome.

VGAM72 gene encodes a VGAM72 precursor RNA, herein designated VGAM PRECURSOR RNA. Similar to other miRNA genes, and unlike most ordinary genes, VGAM72 precursor RNA does not encode a protein. A nucleotide sequence identical or highly similar to the nucleotide sequence of VGAM72 precursor RNA is designated SEQ ID:58, and is provided hereinbelow with reference to the sequence listing part. Nucleotide sequence SEQ ID:58 is located at position 19212 relative to the genome of Invertebrate Iridescent Virus 6.

VGAM72 precursor RNA folds onto itself, forming VGAM72 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM72 folded precursor RNA into VGAM72 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM72 RNA is designated SEQ ID:2783, and is provided hereinbelow with reference to the sequence listing part.

VGAM72 host target gene, herein designated VGAM HOST TARGET GENE, encodes a corresponding messenger RNA, VGAM72 host target RNA, herein designated VGAM HOST TARGET RNA. VGAM72 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM72 RNA, herein designated VGAM RNA, binds complementarily to one or more host target binding sites located in untranslated regions of VGAM72 host target RNA, herein designated VGAM HOST TARGET RNA. This complementary binding is due to the fact that the nucleotide sequence of VGAM72 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM72 RNA, herein designated VGAM RNA, may have a different number of host target binding sites in untranslated regions of a VGAM72 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM72 RNA, herein designated VGAM RNA, to host target binding sites on VGAM72 host target RNA, herein designated VGAM HOST TARGET RNA, such as BINDING SITE I, BINDING SITE II and BINDING SITE III, inhibits translation of VGAM72 host target RNA into VGAM72 host target protein, herein designated VGAM HOST TARGET PROTEIN. VGAM host target protein is therefore outlined by a broken line.

It is appreciated that VGAM72 host target gene, herein designated VGAM HOST TARGET GENE, in fact represents a plurality of VGAM72 host target genes. The mRNA of each one of this plurality of VGAM72 host target genes comprises one or more host target binding sites, each having a nucleotide sequence which is at least partly complementary to VGAM72 RNA, herein designated VGAM RNA, and which when bound by VGAM72 RNA causes inhibition of translation of respective one or more VGAM72 host target proteins.

It is further appreciated by one skilled in the art that the mode of translational inhibition illustrated by FIG. 1 with specific reference to translational inhibition exerted by VGAM72 gene, herein designated VGAM GENE, on one or more VGAM72 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM72 is inhibition of expression of host target genes, as part of a novel viral mechanism of attacking a host. Accordingly, utilities of VGAM72 include diagnosis, prevention and treatment of viral infection by Invertebrate Iridescent Virus 6. Specific functions, and accordingly utilities, of VGAM72 correlate with, and may be deduced from, the identity of the host target genes which VGAM72 binds and inhibits, and the function of these host target genes, as elaborated hereinbelow.

Nucleotide sequences of the VGAM72 precursor RNA, herein designated VGAM PRECURSOR RNA, and of the 'diced' VGAM72 RNA, herein designated VGAM RNA, and a schematic representation of the secondary folding of VGAM72 folded precursor RNA, herein designated VGAM FOLDED PRECURSOR RNA, of VGAM72 are further described hereinbelow with reference to Table 1.

Nucleotide sequences of host target binding sites, such as BINDING SITE-I, BINDING SITE-II and BINDING SITE-III of FIG. 1, found on VGAM72 host target RNA, and schematic representation of the complementarity of each of these host target binding sites to VGAM72 RNA, herein designated VGAM RNA, are described hereinbelow with reference to Table 2.

As mentioned hereinabove with reference to FIG. 1, a function of VGAM72 gene, herein designated VGAM is inhibition of expression of VGAM72 target genes. It is appreciated that specific functions, and accordingly utilities, of VGAM72 correlate with, and may be deduced from, the identity of the target genes which VGAM72 binds and inhibits, and the function of these target genes, as elaborated hereinbelow.

SRY (sex determining region Y)-box 12 (SOX12, Accession NM_006943) is a VGAM72 host target gene. SOX12 BINDING SITE is HOST TARGET binding site found in the 3' untranslated region of mRNA encoded by SOX12, corresponding to a HOST TARGET binding site such as BINDING SITE I, BINDING SITE II or BINDING SITE III. Table 2 illustrates the complementarity of the nucleotide sequences of SOX12 BINDING SITE, designated SEQ ID:13832, to the nucleotide sequence of VGAM72 RNA, herein designated VGAM RNA, also designated SEQ ID:2783.

A function of VGAM72 is therefore inhibition of SRY (sex determining region Y)-box 12 (SOX12, Accession NM_006943). Accordingly, utilities of VGAM72 include diagnosis, prevention and treatment of diseases and clinical conditions associated with SOX12. Chromosome 21 Open Reading Frame 55 (C21orf55, Accession NM_017833) is another VGAM72 host target gene. C21orf55 BINDING SITE is HOST TARGET binding site found in the 5' untranslated region of mRNA encoded by C21orf55, corresponding to a HOST TARGET binding site such as BINDING SITE I, BINDING SITE II or BINDING SITE III. Table 2 illustrates the complementarity of the nucleotide sequences of C21orf55 BINDING SITE, designated SEQ ID:19499, to the nucleotide sequence of VGAM72 RNA, herein designated VGAM RNA, also designated SEQ ID:2783.

Another function of VGAM72 is therefore inhibition of Chromosome 21 Open Reading Frame 55 (C21orf55, Accession NM_017833). Accordingly, utilities of VGAM72 include diagnosis, prevention and treatment of diseases and clinical conditions associated with C21orf55. MGC2452 (Accession NM_032644) is another VGAM72 host target gene. MGC2452 BINDING SITE is HOST TARGET binding site found in the 5" untranslated region of mRNA encoded by MGC2452, corresponding to a HOST TARGET binding site such as BINDING SITE I, BINDING SITE II or BINDING SITE III. Table 2 illustrates the complementarity of the nucleotide sequences of MGC2452 BINDING SITE, designated SEQ ID:26370, to the nucleotide sequence of VGAM72 RNA, herein designated VGAM RNA, also designated SEQ ID:2783.

Another function of VGAM72 is therefore inhibition of MGC2452 (Accession NM_032644). Accordingly, utilities of VGAM72 include diagnosis, prevention and treatment of diseases and clinical conditions associated with MGC2452. Purinergic Receptor P2X-like 1, Orphan Receptor (P2RXL1, Accession NM_005446) is another VGAM72 host target gene. P2RXL1 BINDING SITE is HOST TARGET binding site found in the 3' untranslated region of mRNA encoded by P2RXL1, corresponding to a HOST TARGET binding site such as BINDING SITE I, BINDING SITE II or BINDING SITE III. Table 2 illustrates the complementarity of the nucleotide sequences of P2RXL1 BINDING SITE, designated SEQ ID:11926, to the nucleotide sequence of VGAM72 RNA, herein designated VGAM RNA, also designated SEQ ID:2783.

Another function of VGAM72 is therefore inhibition of Purinergic Receptor P2X-like 1, Orphan Receptor (P2RXL1, Accession NM_005446). Accordingly, utilities of VGAM72 include diagnosis, prevention and treatment of diseases and clinical conditions associated with P2RXL1. Protein Phosphatase 1, Regulatory (inhibitor) Subunit 16B (PPP1R16B, Accession XM_028840) is another VGAM72 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30764, to the nucleotide sequence of VGAM72 RNA, herein designated VGAM RNA, also designated SEQ ID:2783.

Another function of VGAM72 is therefore inhibition of Protein Phosphatase 1, Regulatory (inhibitor) Subunit 16B (PPP1R16B, Accession XM_028840). Accordingly, utilities of VGAM72 include diagnosis, prevention and treatment of diseases and clinical conditions associated with PPP1R16B. LOC255328 (Accession XM_172920) is another VGAM72 host target gene. LOC255328 BINDING SITE is HOST TARGET binding site found in the 3' untranslated region of mRNA encoded by LOC255328, corresponding to a HOST TARGET binding site such as BINDING SITE I, BINDING SITE II or BINDING SITE III. Table 2 illustrates the complementarity of the nucleotide sequences of LOC255328 BINDING SITE, designated SEQ ID:46178, to the nucleotide sequence of VGAM72 RNA, herein designated VGAM RNA, also designated SEQ ID:2783.

Another function of VGAM72 is therefore inhibition of LOC255328 (Accession XM_172920). Accordingly, utilities of VGAM72 include diagnosis, prevention and treatment of diseases and clinical conditions associated with LOC255328. LOC90509 (Accession XM_032209) is another VGAM72 host target gene. LOC90509 BINDING SITE is HOST TARGET binding site found in the 3' untranslated region of mRNA encoded by LOC90509, corresponding to a HOST TARGET binding site such as BINDING SITE I, BINDING SITE II or BINDING SITE III. Table 2 illustrates the complementarity of the nucleotide sequences of LOC90509 BINDING SITE, designated SEQ ID:31611, to the nucleotide sequence of VGAM72 RNA, herein designated VGAM RNA, also designated SEQ ID:2783.

Another function of VGAM72 is therefore inhibition of LOC90509 (Accession XM_032209). Accordingly, utilities of VGAM72 include diagnosis, prevention and treatment of diseases and clinical conditions associated with LOC90509. FIG. 1 further provides a conceptual description of a novel bioinformatically detected viral gene of the present invention, referred to here as Viral Genomic Address Messenger 73 (VGAM73) viral gene, which modulates expression of respective host target genes thereof, the function and utility of which host target genes is known in the art.

VGAM73 is a novel bioinformatically detected regulatory, non protein coding, viral micro RNA (miRNA) gene. The method by which VGAM73 was detected is described hereinabove with reference to FIGS. 1-8.

VGAM73 gene, herein designated VGAM GENE, is a viral gene contained in the genome of Invertebrate Iridescent Virus 6. VGAM73 host target gene, herein designated VGAM HOST TARGET GENE, is a human gene contained in the human genome.

VGAM73 gene encodes a VGAM73 precursor RNA, herein designated VGAM PRECURSOR RNA. Similar to other miRNA genes, and unlike most ordinary genes, VGAM73 precursor RNA does not encode a protein. A nucleotide sequence identical or highly similar to the nucleotide sequence of VGAM73 precursor RNA is designated SEQ ID:59, and is provided hereinbelow with reference to the sequence listing part. Nucleotide sequence SEQ ID:59 is located at position 155229 relative to the genome of Invertebrate Iridescent Virus 6.

VGAM73 precursor RNA folds onto itself, forming VGAM73 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM73 folded precursor RNA into VGAM73 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM73 RNA is designated SEQ ID:2784, and is provided hereinbelow with reference to the sequence listing part.

VGAM73 host target gene, herein designated VGAM HOST TARGET GENE, encodes a corresponding messenger RNA, VGAM73 host target RNA, herein designated VGAM HOST TARGET RNA. VGAM73 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM73 RNA, herein designated VGAM RNA, binds complementarily to one or more host target binding sites located in untranslated regions of VGAM73 host target RNA, herein designated VGAM HOST TARGET RNA. This complementary binding is due to the fact that the nucleotide sequence of VGAM73 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM73 RNA, herein designated VGAM RNA, may have a different number of host target binding sites in untranslated regions of a VGAM73 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM73 RNA, herein designated VGAM RNA, to host target binding sites on VGAM73 host target RNA, herein designated VGAM HOST TARGET RNA, such as BINDING SITE I, BINDING SITE II and BINDING SITE III, inhibits translation of VGAM73 host target RNA into VGAM73 host target protein, herein designated VGAM HOST TARGET PROTEIN. VGAM host target protein is therefore outlined by a broken line.

It is appreciated that VGAM73 host target gene, herein designated VGAM HOST TARGET GENE, in fact represents a plurality of VGAM73 host target genes. The mRNA of each one of this plurality of VGAM73 host target genes comprises one or more host target binding sites, each having a nucleotide sequence which is at least partly complementary to VGAM73 RNA, herein designated VGAM RNA, and which when bound by VGAM73 RNA causes inhibition of translation of respective one or more VGAM73 host target proteins.

It is further appreciated by one skilled in the art that the mode of translational inhibition illustrated by FIG. 1 with specific reference to translational inhibition exerted by VGAM73 gene, herein designated VGAM GENE, on one or more VGAM73 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM73 is inhibition of expression of host target genes, as part of a novel viral mechanism of attacking a host. Accordingly, utilities of VGAM73 include diagnosis, prevention and treatment of viral infection by Invertebrate Iridescent Virus 6. Specific functions, and accordingly utilities, of VGAM73 correlate with, and may be deduced from, the identity of the host target genes which VGAM73 binds and inhibits, and the function of these host target genes, as elaborated hereinbelow.

Nucleotide sequences of the VGAM73 precursor RNA, herein designated VGAM PRECURSOR RNA, and of the 'diced' VGAM73 RNA, herein designated VGAM RNA, and a schematic representation of the secondary folding of VGAM73 folded precursor RNA, herein designated VGAM FOLDED PRECURSOR RNA, of VGAM73 are further described hereinbelow with reference to Table 1.

Nucleotide sequences of host target binding sites, such as BINDING SITE-I, BINDING SITE-II and BINDING SITE-III of FIG. 1, found on VGAM73 host target RNA, and schematic representation of the complementarity of each of these host target binding sites to VGAM73 RNA, herein designated VGAM RNA, are described hereinbelow with reference to Table 2.

As mentioned hereinabove with reference to FIG. 1, a function of VGAM73 gene, herein designated VGAM is inhibition of expression of VGAM73 target genes. It is appreciated that specific functions, and accordingly utilities, of VGAM73 correlate with, and may be deduced from, the identity of the target genes which VGAM73 binds and inhibits, and the function of these target genes, as elaborated hereinbelow.

Collagen, Type XIX, Alpha 1 (COL19A1, Accession NM_001858) is a VGAM73 host target gene. COL19A1 BINDING SITE is HOST TARGET binding site found in the 3' untranslated region of mRNA encoded by COL19A1, corresponding to a HOST TARGET binding site such as BINDING SITE I, BINDING SITE II or BINDING SITE III. Table 2 illustrates the complementarity of the nucleotide sequences of COL19A1 BINDING SITE, designated SEQ ID:7592, to the nucleotide sequence of VGAM73 RNA, herein designated VGAM RNA, also designated SEQ ID:2784.

A function of VGAM73 is therefore inhibition of Collagen, Type XIX, Alpha 1 (COL19A1, Accession NM_001858), a gene which may act as a cross-bridge between fibrils and other extracellular matrix molecules. Accordingly, utilities of VGAM73 include diagnosis, prevention and treatment of diseases and clinical conditions associated with COL19A1. The function of COL19A1 and its association with various diseases and clinical conditions, has been established by previous studies, as described hereinabove with reference to VGAM19. Dynein, Cytoplasmic, Intermediate Polypeptide 1 (DNCI1, Accession XM_165838) is another VGAM73 host target gene. DNCI1 BINDING SITE is HOST TARGET binding site found in the 3' untranslated region of mRNA encoded by DNCI1, corresponding to a HOST TARGET binding site such as BINDING SITE I, BINDING SITE II or BINDING SITE III. Table 2 illustrates the complementarity of the nucleotide sequences of DNCI1 BINDING SITE, designated SEQ ID:43776, to the nucleotide sequence of VGAM73 RNA, herein designated VGAM RNA, also designated SEQ ID:2784.

Another function of VGAM73 is therefore inhibition of Dynein, Cytoplasmic, Intermediate Polypeptide 1 (DNCI1, Accession XM_165838). Accordingly, utilities of VGAM73 include diagnosis, prevention and treatment of diseases and clinical conditions associated with DNCI1. HSPC031 (Accession NM_016101) is another VGAM73 host target gene. HSPC031 BINDING SITE is HOST TARGET binding site found in the 3' untranslated region of mRNA encoded by HSPC031, corresponding to a HOST TARGET binding site such as BINDING SITE I, BINDING SITE II or BINDING SITE III. Table 2 illustrates the complementarity of the nucleotide sequences of HSPC031 BINDING SITE, designated SEQ ID:18185, to the nucleotide sequence of VGAM73 RNA, herein designated VGAM RNA, also designated SEQ ID:2784.

Another function of VGAM73 is therefore inhibition of HSPC031 (Accession NM_016101). Accordingly, utilities of VGAM73 include diagnosis, prevention and treatment of diseases and clinical conditions associated with HSPC031. FIG. 1 further provides a conceptual description of a novel bioinformatically detected viral gene of the present invention, referred to here as Viral Genomic Address Messenger 74 (VGAM74) viral gene, which modulates expression of respective host target genes thereof, the function and utility of which host target genes is known in the art.

VGAM74 is a novel bioinformatically detected regulatory, non protein coding, viral micro RNA (miRNA) gene. The method by which VGAM74 was detected is described hereinabove with reference to FIGS. 1-8.

VGAM74 gene, herein designated VGAM GENE, is a viral gene contained in the genome of Invertebrate Iridescent Virus 6. VGAM74 host target gene, herein designated VGAM HOST TARGET GENE, is a human gene contained in the human genome.

VGAM74 gene encodes a VGAM74 precursor RNA, herein designated VGAM PRECURSOR RNA. Similar to other miRNA genes, and unlike most ordinary genes, VGAM74 precursor RNA does not encode a protein. A nucleotide sequence identical or highly similar to the nucleotide sequence of VGAM74 precursor RNA is designated SEQ ID:60, and is provided hereinbelow with reference to the sequence listing part. Nucleotide sequence SEQ ID:60 is located at position 202596 relative to the genome of Invertebrate Iridescent Virus 6.

VGAM74 precursor RNA folds onto itself, forming VGAM74 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM74 folded precursor RNA into VGAM74 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM74 RNA is designated SEQ ID:2785, and is provided hereinbelow with reference to the sequence listing part.

VGAM74 host target gene, herein designated VGAM HOST TARGET GENE, encodes a corresponding messenger RNA, VGAM74 host target RNA, herein designated VGAM HOST TARGET RNA. VGAM74 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM74 RNA, herein designated VGAM RNA, binds complementarily to one or more host target binding sites located in untranslated regions of VGAM74 host target RNA, herein designated VGAM HOST TARGET RNA. This complementary binding is due to the fact that the nucleotide sequence of VGAM74 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM74 RNA, herein designated VGAM RNA, may have a different number of host target binding sites in untranslated regions of a VGAM74 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM74 RNA, herein designated VGAM RNA, to host target binding sites on VGAM74 host target RNA, herein designated VGAM HOST TARGET RNA, such as BINDING SITE I, BINDING SITE II and BINDING SITE III, inhibits translation of VGAM74 host target RNA into VGAM74 host target protein, herein designated VGAM HOST TARGET PROTEIN. VGAM host target protein is therefore outlined by a broken line.

It is appreciated that VGAM74 host target gene, herein designated VGAM HOST TARGET GENE, in fact represents a plurality of VGAM74 host target genes. The mRNA of each one of this plurality of VGAM74 host target genes comprises one or more host target binding sites, each having a nucleotide sequence which is at least partly complementary to VGAM74 RNA, herein designated VGAM RNA, and which when bound by VGAM74 RNA causes inhibition of translation of respective one or more VGAM74 host target proteins.

It is further appreciated by one skilled in the art that the mode of translational inhibition illustrated by FIG. 1 with specific reference to translational inhibition exerted by VGAM74 gene, herein designated VGAM GENE, on one or more VGAM74 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM74 is inhibition of expression of host target genes, as part of a novel viral mechanism of attacking a host. Accordingly, utilities of VGAM74 include diagnosis, prevention and treatment of viral infection by Invertebrate Iridescent Virus 6. Specific functions, and accordingly utilities, of VGAM74 correlate with, and may be deduced from, the identity of the host target genes which VGAM74 binds and inhibits, and the function of these host target genes, as elaborated hereinbelow.

Nucleotide sequences of the VGAM74 precursor RNA, herein designated VGAM PRECURSOR RNA, and of the 'diced' VGAM74 RNA, herein designated VGAM RNA, and a schematic representation of the secondary folding of VGAM74 folded precursor RNA, herein designated VGAM FOLDED PRECURSOR RNA, of VGAM74 are further described hereinbelow with reference to Table 1.

Nucleotide sequences of host target binding sites, such as BINDING SITE-I, BINDING SITE-II and BINDING SITE-III of FIG. 1, found on VGAM74 host target RNA, and schematic representation of the complementarity of each of these host target binding sites to VGAM74 RNA, herein designated VGAM RNA, are described hereinbelow with reference to Table 2.

As mentioned hereinabove with reference to FIG. 1, a function of VGAM74 gene, herein designated VGAM is inhibition of expression of VGAM74 target genes. It is appreciated that specific functions, and accordingly utilities, of VGAM74 correlate with, and may be deduced from, the identity of the target genes which VGAM74 binds and inhibits, and the function of these target genes, as elaborated hereinbelow.

APPL (Accession NM_012096) is a VGAM74 host target gene. APPL BINDING SITE is HOST TARGET binding site found in the 3' untranslated region of mRNA encoded by APPL, corresponding to a HOST TARGET binding site such as BINDING SITE I, BINDING SITE II or BINDING SITE III. Table 2 illustrates the complementarity of the nucleotide sequences of APPL BINDING SITE, designated SEQ ID:14400, to the nucleotide sequence of VGAM74 RNA, herein designated VGAM RNA, also designated SEQ ID:2785.

A function of VGAM74 is therefore inhibition of APPL (Accession NM_012096). Accordingly, utilities of VGAM74 include diagnosis, prevention and treatment of diseases and clinical conditions associated with APPL. B-cell CLL/lymphoma 9 (BCL9, Accession NM_004326) is another VGAM74 host target gene. BCL9 BINDING SITE is HOST TARGET binding site found in the 5' untranslated region of mRNA encoded by BCL9, corresponding to a HOST TARGET binding site such as BINDING SITE I, BINDING SITE II or BINDING SITE III. Table 2 illustrates the complementarity of the nucleotide sequences of BCL9 BINDING SITE, designated SEQ ID:10522, to the nucleotide sequence of VGAM74 RNA, herein designated VGAM RNA, also designated SEQ ID:2785.

Another function of VGAM74 is therefore inhibition of B-cell CLL/lymphoma 9 (BCL9, Accession NM_004326), a gene which recruits of PYGO to the nuclear beta-catenin-TCF complex in Wnt/Wingless signaling. Accordingly, utilities of VGAM74 include diagnosis, prevention and treatment of diseases and clinical conditions associated with BCL9. The function of BCL9 has been established by previous studies. WNT (see OMIM Ref. No. 602863) signaling controls many fundamental processes during animal development. WNT transduction is mediated by the association of beta-catenin (OMIM Ref. No. 116806) with nuclear TCF (e.g., LEF1; 153245) DNA-binding factors. Kramps et al. (2002) identified 2 segment polarity genes in Drosophila, legless (Lgs), and pygopus (Pygo), and showed that their products are required for WNT signal transduction at the level of nuclear beta-catenin. Lgs encodes the homolog of human BCL9, and the authors provided genetic and molecular evidence that these proteins exert their function by physically linking Pygo to beta-catenin. Kramps et al. (2002) identified 2 human homologs of the Drosophila Pygo gene, PYGO1 (OMIM Ref. No. 606902) and PYGO2 (OMIM Ref. No. 606903), that possess a highly conserved PHD finger that interacts with homology domain-1 (HD1) of BCL9. The findings suggested that the recruitment of PYGO permits beta-catenin to transcriptionally activate WNT target genes and raised the possibility that a deregulation of these events may play a causal role in the development of B-cell malignancies. Studying a cell line (OMIM Ref. No. CEMO-1) from a patient with precursor-B-cell acute lymphoblastic leukemia with a t (1;14) (q21; q32), Willis et al. (1998) identified a fusion partner of the IGHJ gene (OMIM Ref. No. 147010) on 14q. One allele showed novel sequences upstream of JH5 with no homology to either IGH or any other sequence in databases. Using a single-copy restriction fragment immediately 5-prime of JH5, PAC clones were isolated and mapped to 1q21 on normal metaphases by fluorescence in situ hybridization, confirming that this allele represented the translocation breakpoint. Sequence analysis of the 1q21 restriction fragment showed identity with an expressed sequenced tag, and this probe was therefore used to probe Northern blots.

Full details of the abovementioned studies are described in the following publications, the disclosure of which are hereby incorporated by reference:

Kramps, T.; Peter, O.; Brunner, E.; Nellen, D.; Froesch, B.; Chatterjee, S.; Murone, M.; Zullig, S.; Basler, K.: Wnt/Wingless signaling requires BCL9/legless-mediated recruitment of pygopus to the nuclear beta-catenin-TCF complex. Cell 109:47-60, 2002; and Willis, T. G.; Zalcberg, I. R.; Coignet, L. J. A.; Wlodarska, M.; Stul, D. M.; Jadayel, D. M.; Bastard, C.; Treleaven, J. G.; Catovsky, D.; Silva, M. L. M.; Dyer, M. J. S.: Molecular c.

Further studies establishing the function and utilities of BCL9 are found in John Hopkins OMIM database record ID 602597, and in sited publications numbered 8254-8255 listed in the bibliography section hereinbelow, which are also hereby incorporated by reference. Cytochrome P450, Subfamily I (aromatic compound-inducible), Polypeptide 2 (CYP1A2, Accession NM_000761) is another VGAM74 host target gene. CYP1A2 BINDING SITE1 and CYP1A2 BINDING SITE2 are HOST TARGET binding sites found in untranslated regions of mRNA encoded by CYP1A2, corresponding to HOST TARGET binding sites such as BINDING SITE I, BINDING SITE II or BINDING SITE III. Table 2 illustrates the complementarity of the nucleotide sequences of CYP1A2 BINDING SITE1 and CYP1A2 BINDING SITE2, designated SEQ ID:6412 and SEQ ID:34256 respectively, to the nucleotide sequence of VGAM74 RNA, herein designated VGAM RNA, also designated SEQ ID:2785.

Another function of VGAM74 is therefore inhibition of Cytochrome P450, Subfamily I (aromatic compound-inducible), Polypeptide 2 (CYP1A2, Accession NM_000761), a gene which intervenes in an NADPH-dependent electron transport pathway. Accordingly, utilities of VGAM74 include diagnosis, prevention and treatment of diseases and clinical conditions associated with CYP1A2. The function of CYP1A2 has been established by previous studies. P1-450 (CYP1A1; 108330) and P3-450 are 2 members of the dioxin-inducible P450 gene family. Jaiswal et al. (1987) determined the cDNA (3,064 bp) and protein (515 residues; M(r)=58, 294) sequences of P3-450. They showed by study of somatic cell hybrids that both the P3-450 and the P1-450 loci reside on human chromosome 15. In the mouse and hamster, the 2 genes are located near the equivalent of the mannosephosphate isomerase (MPI) locus (OMIM Ref. No. 154550). The same may be true in man; MPI is located in the region 15q22-qter. The 2 CYP1 genes are within 25 kb of each other and probably are not separated by other genes (Nebert, 1988). The enzyme involved in O-deethylation of phenacetin is 1 of 9 forms of cytochrome P-450 that have been purified to electrophoretic homogeneity from human liver microsomes (Guengerich et al., 1986). Phenacetin O-deethylase differs from another cytochrome P-450 enzyme that shows genetic polymorphism, debrisoquine 4-hydroxylase (OMIM Ref. No. 124030), in molecular mass, amino acid composition, catalytic activity, and immunochemical properties. Butler et al. (1989) reviewed the evidence that phenacetin O-deethylase, otherwise known as P450(PA), is the product of the CYP1A2 gene. Devonshire et al. (1983) demonstrated a genetic polymorphism for phenacetin O-deethylation, with 5 to 10% of the population deficient in this activity. Cigarette smoking has been shown to increase microsomal phenacetin O-deethylase activity (Sesardic et al., 1988). Butler et al. (1989) reported that human hepatic microsomal caffeine 3-demethylation, the initial major step in caffeine biotransformation in human S, is selectively catalyzed by this cytochrome P-450. Estimation of caffeine 3-demethylation activity in human S may be useful in the characterization of arylamine N-oxidation phenotypes and in the assessment of whether or not the hepatic levels of this cytochrome, as affected by environmental or genetic factors, contribute to interindividual differences in susceptibility to arylamine-induced cancers. Smokers have been demonstrated to have increased rates of caffeine disposition, with plasma half lives one-half that of nonsmokers. Furthermore, rates of caffeine metabolism vary between individuals, as caffeine half-life values ranging from 1.5 to 9.5 hours have been reported. Buters et al. (1996) showed that in mice the clearance of caffeine is determined primarily by CYP1A2.

Full details of the abovementioned studies are described in the following publications, the disclosure of which are hereby incorporated by reference:

Butler, M. A.; Iwasaki, M.; Guengerich, F. P.; Kadlubar, F. F.: Human cytochrome P-450(PA) (P-450IA2), the phenacetin O-deethylase, is primarily responsible for the hepatic 3-demethylation of caffeine and N-oxidation of carcinogenic arylamines. Proc. Nat. Acad. Sci. 86:7696-7700, 1989; and Christiansen, L.; Bygum, A.; Jensen, A.; Thomsen, K.; Brandrup, F.; Horder, M.; Petersen, N. E.: Association between CYP1A2 polymorphism and susceptibility to porphyria cutanea tarda.

Further studies establishing the function and utilities of CYP1A2 are found in John Hopkins OMIM database record ID 124060, and in sited publications numbered 11772-11775, 3682, 11776-1177 and 12761-11782 listed in the bibliography section hereinbelow, which are also hereby incorporated by reference. Disrupted In Schizophrenia 1 (DISC1, Accession NM_018662) is another VGAM74 host target gene. DISC1 BINDING SITE is HOST TARGET binding site found in the 3' untranslated region of mRNA encoded by DISC1, corresponding to a HOST TARGET binding site such as BINDING SITE I, BINDING SITE II or BINDING SITE III. Table 2 illustrates the complementarity of the nucleotide sequences of DISC1 BINDING SITE, designated SEQ ID:20736, to the nucleotide sequence of VGAM74 RNA, herein designated VGAM RNA, also designated SEQ ID:2785.

Another function of VGAM74 is therefore inhibition of Disrupted In Schizophrenia 1 (DISC1, Accession NM_018662), a gene which has globular N-terminal domain (s) and a helical C-terminal domain. Accordingly, utilities of VGAM74 include diagnosis, prevention and treatment of diseases and clinical conditions associated with DISC1. The function of DISC1 has been established by previous studies. Millar et al. (2000) isolated and sequenced the breakpoints on chromosomes 1 and 11 in the Scottish family carrying the translocation, and by sequence analysis concluded that no genes were within the region surrounding the chromosome 11 breakpoint. The authors found that, by contrast, the corresponding region on chromosome 1 was gene-dense and that not 1, but 2, novel genes were directly disrupted by the translocation. They named these genes 'disrupted in schizophrenia' 1 and 2 (DISC1 and DISC2, 606271). The major DISC1 transcript is approximately 7.5 kb, contains an open reading frame encoding 854 amino acids, and is ubiquitously expressed. The protein is predicted to consist of a globular N-terminal domain (s) and helical C-terminal domain that has the potential to form a coiled-coil by interaction with another protein (s). Similar structures are thought to be present in a variety of unrelated proteins that are known to function in the nervous system. The putative structure of the protein encoded by DISC1 is therefore compatible with a role in the nervous system. DISC2 apparently specifies a single exon thought to be a noncoding RNA molecule that is antisense to DISC1, an arrangement that has been observed at other loci where the antisense RNA may regulate expression of the sense gene. The authors concluded that DISC1 and DISC2 should be considered formal candidate genes for susceptibility to psychiatric illness. The family studied by St. Clair et al. (1990) and Millar et al. (2000) was originally ascertained by Jacobs et al. (1970), who reported the translocation in the propositus, who had adolescent conduct disorder, and in members of 4 generations of the extended family. Blackwood et al. (2001) provided a follow-up. Of the 87 members of the family who were karyotyped, 37 carried the translocation. A psychiatric diagnosis was reached in 29 carriers, 38 noncarriers, and the 2 founders (who were not karyotyped). The range of symptoms in this family crossed traditional diagnostic boundaries, and the locus identified by the breakpoint on 1q42 appeared to be implicated in either schizophrenia or bipolar disorder. Furthermore, Blackwood (2000) reported abnormalities in the auditory P300 event-related potential, which showed prolonged latency and reduced amplitude in affected members of the family.

Full details of the abovementioned studies are described in the following publications, the disclosure of which are hereby incorporated by reference:

Blackwood, D. H. R.; Fordyce, A.; Walker, M. T.; St. Clair, D. M.; Porteous, D. J.; Muir, W. J.: Schizophrenia and affective disorders--cosegretation with a translocation at chromosome 1q42 that directly disrupts brain-expressed genes: clinical and P300 findings in a family. Am. J. Hum. Genet. 69:428-433, 2001; and Ekelund, J.; Hovatta, I.; Parker, A.; Paunio, T.; Varilo, T.; Martin, R.; Suhonen, J.; Ellonen, P.; Chan, G.; Sinsheimer, J. S.; Sobel, E.; Juvonen, H.; Arajarvi, R.; Partonen, T.; Suv.

Further studies establishing the function and utilities of DISC1 are found in John Hopkins OMIM database record ID 605210, and in sited publications numbered 6819-6821, 407 and 6822-6823 listed in the bibliography section hereinbelow, which are also hereby incorporated by reference. Down Syndrome Critical Region Gene 3 (DSCR3, Accession NM_006052) is another VGAM74 host target gene. DSCR3 BINDING SITE is HOST TARGET binding site found in the 3' untranslated region of mRNA encoded by DSCR3, corresponding to a HOST TARGET binding site such as BINDING SITE I, BINDING SITE II or BINDING SITE III. Table 2 illustrates the complementarity of the nucleotide sequences of DSCR3 BINDING SITE, designated SEQ ID:12685, to the nucleotide sequence of VGAM74 RNA, herein designated VGAM RNA, also designated SEQ ID:2785.

Another function of VGAM74 is therefore inhibition of Down Syndrome Critical Region Gene 3 (DSCR3, Accession NM_006052). Accordingly, utilities of VGAM74 include diagnosis, prevention and treatment of diseases and clinical conditions associated with DSCR3. FCRH1 (Accession NM_052938) is another VGAM74 host target gene. FCRH1 BINDING SITE is HOST TARGET binding site found in the 3' untranslated region of mRNA encoded by FCRH1, corresponding to a HOST TARGET binding site such as BINDING SITE I, BINDING SITE II or BINDING SITE III. Table 2 illustrates the complementarity of the nucleotide sequences of FCRH1 BINDING SITE, designated SEQ ID:27499, to the nucleotide sequence of VGAM74 RNA, herein designated VGAM RNA, also designated SEQ ID:2785.

Another function of VGAM74 is therefore inhibition of FCRH1 (Accession NM_052938). Accordingly, utilities of VGAM74 include diagnosis, prevention and treatment of diseases and clinical conditions associated with FCRH1. Fasciculation and Elongation Protein Zeta 1 (zygin I) (FEZ1, Accession NM_022549) is another VGAM74 host target gene. FEZ1 BINDING SITE is HOST TARGET binding site found in the 3' untranslated region of mRNA encoded by FEZ1, corresponding to a HOST TARGET binding site such as BINDING SITE I, BINDING SITE II or BINDING SITE III. Table 2 illustrates the complementarity of the nucleotide sequences of FEZ1 BINDING SITE, designated SEQ ID:22877, to the nucleotide sequence of VGAM74 RNA, herein designated VGAM RNA, also designated SEQ ID:2785.

Another function of VGAM74 is therefore inhibition of Fasciculation and Elongation Protein Zeta 1 (zygin I) (FEZ1, Accession NM_022549), a gene which Zygin 1; may have a role in axonal outgrowth; has similarity to C. elegans UNC-76. Accordingly, utilities of VGAM74 include diagnosis, prevention and treatment of diseases and clinical conditions associated with FEZ1. The function of FEZ1 and its association with various diseases and clinical conditions, has been established by previous studies, as described hereinabove with reference to VGAM37. Growth Hormone Receptor (GHR, Accession NM_000163) is another VGAM74 host target gene. GHR BINDING SITE is HOST TARGET binding site found in the 3' untranslated region of mRNA encoded by GHR, corresponding to a HOST TARGET binding site such as BINDING SITE I, BINDING SITE II or BINDING SITE III. Table 2 illustrates the complementarity of the nucleotide sequences of GHR BINDING SITE, designated SEQ ID:5673, to the nucleotide sequence of VGAM74 RNA, herein designated VGAM RNA, also designated SEQ ID:2785.

Another function of VGAM74 is therefore inhibition of Growth Hormone Receptor (GHR, Accession NM_000163). Accordingly, utilities of VGAM74 include diagnosis, prevention and treatment of diseases and clinical conditions associated with GHR. Mediterranean Fever (MEFV, Accession NM_000243) is another VGAM74 host target gene. MEFV BINDING SITE1 and MEFV BINDING SITE2 are HOST TARGET binding sites found in untranslated regions of mRNA encoded by MEFV, corresponding to HOST TARGET binding sites such as BINDING SITE I, BINDING SITE II or BINDING SITE III. Table 2 illustrates the complementarity of the nucleotide sequences of MEFV BINDING SITE1 and MEFV BINDING SITE2, designated SEQ ID:5769 and SEQ ID:5770 respectively, to the nucleotide sequence of VGAM74 RNA, herein designated VGAM RNA, also designated SEQ ID:2785.

Another function of VGAM74 is therefore inhibition of Mediterranean Fever (MEFV, Accession NM_000243). Accordingly, utilities of VGAM74 include diagnosis, prevention and treatment of diseases and clinical conditions associated with MEFV. Protocadherin Beta 9 (PCDHB9, Accession NM_019119) is another VGAM74 host target gene. PCDHB9 BINDING SITE is HOST TARGET binding site found in the 3' untranslated region of mRNA encoded by PCDHB9, corresponding to a HOST TARGET binding site such as BINDING SITE I, BINDING SITE II or BINDING SITE III. Table 2 illustrates the complementarity of the nucleotide sequences of PCDHB9 BINDING SITE, designated SEQ ID:21205, to the nucleotide sequence of VGAM74 RNA, herein designated VGAM RNA, also designated SEQ ID:2785.

Another function of VGAM74 is therefore inhibition of Protocadherin Beta 9 (PCDHB9, Accession NM_019119), a gene which is a potential calcium-dependent cell-adhesion protein. Accordingly, utilities of VGAM74 include diagnosis, prevention and treatment of diseases and clinical conditions associated with PCDHB9. The function of PCDHB9 has been established by previous studies. Cadherins are calcium-dependent cell-cell adhesion molecules that mediate neural cell-cell interactions. Protocadherins constitute a subfamily of nonclassic cadherins. PCDHB9 is a member of the beta cluster of protocadherin genes on 5q31. For specific information on the PCDHB genes, see 604967. Vanhalst et al. (2001) determined that unlike most PCDHB proteins, PCDHB9 has not 1 but 2 PXXP motifs, putative SH3 protein-binding sites, at the end of the conserved region of its cytoplasmic domain.

Full details of the abovementioned studies are described in the following publications, the disclosure of which are hereby incorporated by reference:

Vanhalst, K.; Kools, P.; Eynde, E. V.; van Roy, F.: The human and murine protocadherin-beta one-exon gene families show high evolutionary conservation, despite the difference in gene number. FEBS Lett. 495:120-125, 2001; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse a.

Further studies establishing the function and utilities of PCDHB9 are found in John Hopkins OMIM database record ID 606335, and in sited publications numbered 674 and 9535 listed in the bibliography section hereinbelow, which are also hereby incorporated by reference. Phosphodiesterase 6B, CGMP-specific, Rod, Beta (congenital stationary night blindness 3, autosomal dominant) (PDE6B, Accession NM_000283) is another VGAM74 host target gene. PDE6B BINDING SITE is HOST TARGET binding site found in the 3' untranslated region of mRNA encoded by PDE6B, corresponding to a HOST TARGET binding site such as BINDING SITE I, BINDING SITE II or BINDING SITE III. Table 2 illustrates the complementarity of the nucleotide sequences of PDE6B BINDING SITE, designated SEQ ID:5828, to the nucleotide sequence of VGAM74 RNA, herein designated VGAM RNA, also designated SEQ ID:2785.

Another function of VGAM74 is therefore inhibition of Phosphodiesterase 6B, CGMP-specific, Rod, Beta (congenital stationary night blindness 3, autosomal dominant) (PDE6B, Accession NM_000283). Accordingly, utilities of VGAM74 include diagnosis, prevention and treatment of diseases and clinical conditions associated with PDE6B. Period Homolog 2 (Drosophila) (PER2, Accession NM_022817) is another VGAM74 host target gene. PER2 BINDING SITE is HOST TARGET binding site found in the 3' untranslated region of mRNA encoded by PER2, corresponding to a HOST TARGET binding site such as BINDING SITE I, BINDING SITE II or BINDING SITE III. Table 2 illustrates the complementarity of the nucleotide sequences of PER2 BINDING SITE, designated SEQ ID:23091, to the nucleotide sequence of VGAM74 RNA, herein designated VGAM RNA, also designated SEQ ID:2785.

Another function of VGAM74 is therefore inhibition of Period Homolog 2 (Drosophila) (PER2, Accession NM_022817), a gene which Period homolog 2; putative circadian clock protein; has a PAS dimerization domain. Accordingly, utilities of VGAM74 include diagnosis, prevention and treatment of diseases and clinical conditions associated with PER2. The function of PER2 has been established by previous studies. To investigate the biologic role of NPAS2 (OMIM Ref. No. 603347), Reick et al. (2001) prepared a neuroblastoma cell line capable of conditional induction of the NPAS2:BMAL1 (OMIM Ref. No. 602550) heterodimer and identified putative target genes by representational difference analysis, DNA microarrays, and Northern blotting. Coinduction of NPAS2 and BMAL1 activated transcription of the endogenous Per1, Per2, and Cry1 (OMIM Ref. No. 601933) genes, which encode negatively activating components of the circadian regulatory apparatus, and repressed transcription of the endogenous BMAL1 gene. Analysis of the frontal cortex of wildtype mice kept in a 24-hour light-dark cycle revealed that Per1, Per2, and Cry1 mRNA levels were elevated during darkness and reduced during light, whereas BMAL1 mRNA displayed the opposite pattern. In situ hybridization assays of mice kept in constant darkness revealed that Per2 mRNA abundance did not oscillate as a function of circadian cycle in NPAS2-deficient mice. Thus, NPAS2 likely functions as part of a molecular clock operative in the mammalian forebrain. Animal model experiments lend further support to the function of PER2. Shearman et al. (2000) demonstrated that in the mouse, the core mechanism for the master circadian clock consists of interacting positive and negative transcription and translation feedback loops. Analysis of Clock/Clock (OMIM Ref. No. 601851) mutant mice, homozygous Per2 mutants, and Cry-deficient mice revealed substantially altered Bmal1 (OMIM Ref. No. 602550) rhythms, consistent with a dominant role of Per2 in the positive regulation of the Bmal1 loop. In vitro analysis of Cry inhibition of Clock:Bmal1-mediated transcription shows that the inhibition is through direct protein-protein interactions, independent of the Per and Tim (OMIM Ref. No. 603887) proteins. Per2 is a positive regulator of the Bmal1 loop, and Cry1 and Cry2 are the negative regulators of the Period and Cryptochrome cycles.

It is appreciated that the abovementioned animal model for PER2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shearman, L. P.; Sriram, S.; Weaver, D. R.; Maywood, E. S.; Chaves, I.; Zheng, B.; Kume, K.; Lee, C. C.; van der Horst, G. T. J.; Hastings, M. H.; Reppert, S. M.: Interacting molecular loops in the mammalian circadian clock. Science 288: 1013-1019, 2000; and Shearman, L. P.; Zylka, M. J.; Weaver, D. R.; Kolakowski, L. F., Jr.; Reppert, S. M.: Two period homologs: circadian expression and photic regulation in the suprachiasmatic nuclei. Neu.

Further studies establishing the function and utilities of PER2 are found in John Hopkins OMIM database record ID 603426, and in sited publications numbered 933, 957, 6264-6265, 1256, 8191-819 and 8673 listed in the bibliography section hereinbelow, which are also hereby incorporated by reference. Phospholipase A2, Group IID (PLA2G2D, Accession NM_012400) is another VGAM74 host target gene. PLA2G2D BINDING SITE is HOST TARGET binding site found in the 3' untranslated region of mRNA encoded by PLA2G2D, corresponding to a HOST TARGET binding site such as BINDING SITE I, BINDING SITE II or BINDING SITE III. Table 2 illustrates the complementarity of the nucleotide sequences of PLA2G2D BINDING SITE, designated SEQ ID:14767, to the nucleotide sequence of VGAM74 RNA, herein designated VGAM RNA, also designated SEQ ID:2785.

Another function of VGAM74 is therefore inhibition of Phospholipase A2, Group IID (PLA2G2D, Accession NM_012400), a gene which is involved in phospholipid digestion, remodeling of cell membranes, and host defense, as well as pathophysiologic processes. Accordingly, utilities of VGAM74 include diagnosis, prevention and treatment of diseases and clinical conditions associated with PLA2G2D. The function of PLA2G2D has been established by previous studies. Phospholipase A2 (PLA2) family members (e.g., PLA2G2A; 172411) are lipolytic enzymes that hydrolyze the sn-2 fatty acid ester bond of glycerophospholipids to produce free fatty acid and lysophospholipids. PLA2s are involved in phospholipid digestion, remodeling of cell membranes, and host defense, as well as pathophysiologic processes involving the production prostaglandins, leukotrienes, thromboxanes, and platelet-activating factor. By searching an EST database using the catalytically essential residues of secretory PLA2s as the probe, followed by PCR of mouse and human spleen cDNA, Ishizaki et al. (1999) obtained cDNAs encoding mouse and human PLA2G2D. Sequence analysis predicted that the 145-amino acid human secretory protein, 48% identical PLA2G2A, contains a 20-residue signal peptide, a potential N-linked glycosylation site, 14 cys residues, and conserved his48 and asp49 sites. Analysis of enzymatic activity detected most activity in culture supernatant and determined that PLA2G2D preferentially hydrolyzes phosphatidylglycerol and phosphatidylethanolamine, followed by phosphatidylcholine, but does not hydrolyze phosphatidylserine or phosphatidic acid. Northern blot analysis revealed variable expression of 2.0- and 1.0-kb transcripts, with highest expression in pancreas and spleen. In a rat model, expression in thymus increased dramatically after lipopolysaccharide injection. By subtractive cDNA cloning using spleens from wildtype and tumor necrosis factor (Tnf; 191160)/lymphotoxin-alpha (Lta; 153440) double-knockout mice, followed by probing a spleen cDNA library, Shakhov et al. (2000) isolated a cDNA encoding mouse Pla2g2d, which they designated Splash (secretory-type PLA, stroma-associated homolog). Splash was expressed 6-fold less in mutant than wildtype mice. By screening a human cDNA library, they isolated cDNAs encoding human PLA2G2D. Shakhov et al. (2000) noted that the human and mouse protein sequences are 73% identical and 81% homologous. Northern blot analysis detected mouse Pla2g2d expression in adult but not embryonic spleen. By radiation hybrid mapping, Ishizaki et al. (1999) mapped the PLA2G2D gene to 1p36.12. Also using radiation hybrid analysis, Shakhov et al. (2000) mapped the PLA2G2D gene to 1p36.1-p35, near the PLA2G2A gene and a region known for frequent loss of heterozygosity in human tumors. Shakhov et al. (2000) mapped the mouse gene to chromosome 4.

Full details of the abovementioned studies are described in the following publications, the disclosure of which are hereby incorporated by reference:

Ishizaki, J.; Suzuki, N.; Higashino, K.; Yokota, Y.; Ono, T.; Kawamoto, K.; Fujii, N.; Arita, H.; Hanasaki, K.: Cloning and characterization of novel mouse and human secretory phospholipase A(2) s. J. Biol. Chem. 274:24973-24979, 1999; and Shakhov, A. N.; Rubtsov, A. V.; Lyakhov, I. G.; Tumanov, A. V.; Nedospasov, S. A.: SPLASH (PLA(2)IID), a novel member of phospholipase A2 family, is associated with lymphotoxin-defici.

Further studies establishing the function and utilities of PLA2G2D are found in John Hopkins OMIM database record ID 605630, and in sited publications numbered 6963 listed in the bibliography section hereinbelow, which are also hereby incorporated by reference. Rhesus Blood Group, D Antigen (RHD, Accession NM_016124) is another VGAM74 host target gene. RHD BINDING SITE1 and RHD BINDING SITE2 are HOST TARGET binding sites found in untranslated regions of mRNA encoded by RHD, corresponding to HOST TARGET binding sites such as BINDING SITE I, BINDING SITE II or BINDING SITE III. Table 2 illustrates the complementarity of the nucleotide sequences of RHD BINDING SITE1 and RHD BINDING SITE2, designated SEQ ID:18217 and SEQ ID:18337 respectively, to the nucleotide sequence of VGAM74 RNA, herein designated VGAM RNA, also designated SEQ ID:2785.

Another function of VGAM74 is therefore inhibition of Rhesus Blood Group, D Antigen (RHD, Accession NM_016124), a gene which Major antigen of the RH system. Accordingly, utilities of VGAM74 include diagnosis, prevention and treatment of diseases and clinical conditions associated with RHD. The function of RHD has been established by previous studies. Bennett et al. (1993) demonstrated that DNA testing can be used to determine RhD type in chorionic villus samples or amniotic cells. An RhD-negative woman whose partner is heterozygous may have preexisting anti-RhD antibodies that may or may not affect a subsequent fetus, depending on whether it is heterozygous. A safe method of determining fetal RhD type early in pregnancy would eliminate the risks to an RhD-negative fetus of fetal blood sampling or serial amniocenteses. Levine et al. (1941) showed that hemolytic disease of the fetus occurs in an RhD-positive fetus carried by an RhD-negative woman who has been immunized by transplacental passage of RhD-positive red cells during a previous pregnancy. When the father of the fetus being carried by a sensitized RhD-negative woman is heterozygous for RhD, as more than 50% of people are, half the fetuses will be RhD-negative and therefore require no treatment to avoid erythroblastosis fetalis. The others will be RhD-positive and require sophisticated investigative measures and treatments. Lo et al. (1998) described a noninvasive method of determining fetal RhD status by analyzing maternal plasma. Using a fluorescent-based PCR assay that was sensitive enough to detect the amount of RhD DNA found in a single cell, they determined the RhD status of singleton fetuses from 57 RhD-negative women whose partners were heterozygous for the RhD gene. This method correctly identified the RhD status of 10 of 12 fetuses whose mothers were in their first trimester of pregnancy, that of all 30 fetuses whose mothers were in their second trimester, and that of all 15 fetuses whose mothers were in their third trimester. The method they described was rapid, providing results within 1 day, and represented a major advance in RhD genotyping.

Full details of the abovementioned studies are described in the following publications, the disclosure of which are hereby incorporated by reference:

Bennett, P. R.; Le Van Kim, C.; Colin, Y.; Warwick, R. M.; Cherif-Zahar, B.; Fisk, N. M.; Cartron, J.-P.: Prenatal determination of fetal RhD type by DNA amplification. New Eng. J. Med. 329:607-610, 1993; and Lo, Y. M. D.; Hjelm, N. M.; Fidler, C.; Sargent, I. L.; Murphy, M. F.; Chamberlain, P. F.; Poon, P. M. K.; Redman, C. W. G.; Wainscoat, J. S.: Prenatal diagnosis of fetal RhD status by mol.

Further studies establishing the function and utilities of RHD are found in John Hopkins OMIM database record ID 111680, and in sited publications numbered 3747-3776 listed in the bibliography section hereinbelow, which are also hereby incorporated by reference. Selenoprotein N, 1 (SEPN1, Accession XM_039033) is another VGAM74 host target gene. SEPN1 BINDING SITE is HOST TARGET binding site found in the 3' untranslated region of mRNA encoded by SEPN1, corresponding to a HOST TARGET binding site such as BINDING SITE I, BINDING SITE II or BINDING SITE III. Table 2 illustrates the complementarity of the nucleotide sequences of SEPN1 BINDING SITE, designated SEQ ID:32989, to the nucleotide sequence of VGAM74 RNA, herein designated VGAM RNA, also designated SEQ ID:2785.

Another function of VGAM74 is therefore inhibition of Selenoprotein N, 1 (SEPN1, Accession XM_039033). Accordingly, utilities of VGAM74 include diagnosis, prevention and treatment of diseases and clinical conditions associated with SEPN1. Solute Carrier Family 13 (sodium/sulfate symporters), Member 1 (SLC13A1, Accession NM_022444) is another VGAM74 host target gene. SLC13A1 BINDING SITE is HOST TARGET binding site found in the 3' untranslated region of mRNA encoded by SLC13A1, corresponding to a HOST TARGET binding site such as BINDING SITE I, BINDING SITE II or BINDING SITE III. Table 2 illustrates the complementarity of the nucleotide sequences of SLC13A1 BINDING SITE, designated SEQ ID:22775, to the nucleotide sequence of VGAM74 RNA, herein designated VGAM RNA, also designated SEQ ID:2785.

Another function of VGAM74 is therefore inhibition of Solute Carrier Family 13 (sodium/sulfate symporters), Member 1 (SLC13A1, Accession NM_022444). Accordingly, utilities of VGAM74 include diagnosis, prevention and treatment of diseases and clinical conditions associated with SLC13A1. Solute Carrier Family 14 (urea transporter), Member 2 (SLC14A2, Accession NM_007163) is another VGAM74 host target gene. SLC14A2 BINDING SITE is HOST TARGET binding site found in the 5' untranslated region of mRNA encoded by SLC14A2, corresponding to a HOST TARGET binding site such as BINDING SITE I, BINDING SITE II or BINDING SITE III. Table 2 illustrates the complementarity of the nucleotide sequences of SLC14A2 BINDING SITE, designated SEQ ID:14009, to the nucleotide sequence of VGAM74 RNA, herein designated VGAM RNA, also designated SEQ ID:2785.

Another function of VGAM74 is therefore inhibition of Solute Carrier Family 14 (urea transporter), Member 2 (SLC14A2, Accession NM_007163), a gene which is a renal urea transporter 2. Accordingly, utilities of VGAM74 include diagnosis, prevention and treatment of diseases and clinical conditions associated with SLC14A2. The function of SLC14A2 has been established by previous studies. Genetic variation in proteins that determine sodium reabsorption and excretion significantly influences blood pressure. Ranade et al. (2001) investigated whether nucleotide variation in human UT2 could be associated with variation in blood pressure. Seven single-nucleotide polymorphisms (SNPs) were identified, including val227 to ile and ala357 to thr. Over 1,000 hypertensive and low-normotensive individuals of Chinese origin were genotyped. The ile227 and ala357 alleles were associated with low diastolic blood pressure in men but not women, with odds ratios 2.1 (95% confidence interval 1.5-2.7, P less than 0.001) and 1.5 (95% confidence interval 1.2-1.8, P less than 0.001), respectively. There was a similar trend for systolic blood pressure, and odds ratios for the ile227 and ala357 alleles were 1.7 (95% confidence interval 1.2-2.3, P=0.002) and 1.3 (95% confidence interval 1.1-1.6, P=0.007), respectively, in men. DeStefano et al. (1998) identified a locus for orthostatic hypotension (OHDS; 143850) on chromosome 18q, with a peak lod score of 3.92 at D18S1367 in 2 linked families. The proximity of human UT2 makes it a potential candidate gene for this autosomal dominant disorder.

Full details of the abovementioned studies are described in the following publications, the disclosure of which are hereby incorporated by reference:

Ranade, K.; Wu, K.-W.; Hwu, C.-M.; Ting, C.-T.; Pei, D.; Pesich, R.; Hebert, J.; Chen, Y.-D. I.; Pratt, R.; Olshen, R.; Masaki, K.; Risch, N.; Cox, D. R.; Botstein, D.: Genetic variation in the human urea transporter-2 is associated with variation in blood pressure. Hum. Molec. Genet. 10:2157-2164, 2001; and DeStefano, A. L.; Baldwin, C. T.; Burzstyn, M.; Gavras, I.; Handy, D. E.; Joost, O.; Martel, T.; Nicolaou, M.; Schwartz, F.; Streeten, D. H. P.; Farrer, L. A.; Gavras, H.: Autosomal domin.

Further studies establishing the function and utilities of SLC14A2 are found in John Hopkins OMIM database record ID 601611, and in sited publications numbered 12144-9111 listed in the bibliography section hereinbelow, which are also hereby incorporated by reference. Solute Carrier Family 15 (oligopeptide transporter), Member 1 (SLC15A1, Accession NM_005073) is another VGAM74 host target gene. SLC15A1 BINDING SITE is HOST TARGET binding site found in the 3' untranslated region of mRNA encoded by SLC15A1, corresponding to a HOST TARGET binding site such as BINDING SITE I, BINDING SITE II or BINDING SITE III. Table 2 illustrates the complementarity of the nucleotide sequences of SLC15A1 BINDING SITE, designated SEQ ID:11521, to the nucleotide sequence of VGAM74 RNA, herein designated VGAM RNA, also designated SEQ ID:2785.

Another function of VGAM74 is therefore inhibition of Solute Carrier Family 15 (oligopeptide transporter), Member 1 (SLC15A1, Accession NM_005073), a gene which is a H(+)-coupled peptide transporter. Accordingly, utilities of VGAM74 include diagnosis, prevention and treatment of diseases and clinical conditions associated with SLC15A1. The function of SLC15A1 has been established by previous studies. In mammalian small intestine, the proton-coupled peptide transporter is responsible for the absorption of small peptides arising from digestion of dietary proteins. Fei et al. (1994) isolated a cDNA clone encoding a hydrogen ion/peptide cotransporter from a rabbit intestinal cDNA library. Liang et al. (1995) screened a human intestinal cDNA library with a probe derived from the rabbit cotransporter cDNA and identified a cDNA which, when expressed in HeLa cells or in Xenopus laevis oocytes, induced proton-dependent peptide transport activity. The predicted protein consisted of 708 amino acids with 12 membrane-spanning domains and 2 putative sites for protein kinase C-dependent phosphorylation. The cDNA-induced transport process accepted dipeptides, tripeptides, and amino beta-lactam antibiotics as substrates, but could not transport free amino acids. The human cotransporter showed 81% identity and 92% similarity to the rabbit cotransporter, but showed only a weak homology to the proton-coupled peptide transport proteins present in bacteria and yeast. By analysis of somatic cell hybrids and by isotopic in situ hybridization, Liang et al. (1995) mapped the human gene to 13q33-q34. Adibi (1997) reviewed the biology and function of the human intestinal oligopeptide transporter, which he symbolized PEPT1. Studies indicated that it transports dipeptides and tripeptides but not free amino acids or peptides with more than 3 amino acid residues and that its driving force for uphill transport requires proton binding and presence of an inside-negative membrane potential. A membrane protein, HTP1, which appeared to be associated with the oligopeptide transporter, had also been cloned. Adibi (1997) pointed out the importance of the transporter in nutritional and pharmacologic therapies; for example, it has allowed the use of oligopeptides as a source of nitrogen for enteral feeding and the use of the oral route for delivery of peptidomimetic drugs such as beta-lactam antibiotics.

Full details of the abovementioned studies are described in the following publications, the disclosure of which are hereby incorporated by reference:

Liang, R.; Fei, Y.-J.; Prasad, P. D.; Ramamoorthy, S.; Han, H.; Yang-Feng, T. L.; Hediger, M. A.; Ganapathy, V.; Leibach, F. H.: Human intestinal H(+)/peptide cotransporter: cloning, functional expression, and chromosomal localization. J. Biol. Chem. 270:6456-6463, 1995; and Adibi, S. A.: The oligopeptide transporter (Pept-1) in human intestine: biology and function. Gastroenterology 113:332-340, 1997.

Further studies establishing the function and utilities of SLC15A1 are found in John Hopkins OMIM database record ID 600544, and in sited publications numbered 7871-7873 listed in the bibliography section hereinbelow, which are also hereby incorporated by reference. SMAC (Accession NM_138930) is another VGAM74 host target gene. SMAC BINDING SITE is HOST TARGET binding site found in the 5' untranslated region of mRNA encoded by SMAC, corresponding to a HOST TARGET binding site such as BINDING SITE I, BINDING SITE II or BINDING SITE III. Table 2 illustrates the complementarity of the nucleotide sequences of SMAC BINDING SITE, designated SEQ ID:29051, to the nucleotide sequence of VGAM74 RNA, herein designated VGAM RNA, also designated SEQ ID:2785.

Another function of VGAM74 is therefore inhibition of SMAC (Accession NM_138930), a gene which promotes apoptosis via caspase activation. Accordingly, utilities of VGAM74 include diagnosis, prevention and treatment of diseases and clinical conditions associated with SMAC. The function of SMAC has been established by previous studies. Verhagen et al. (2000) identified the murine homolog of SMAC, which they called DIABLO (direct IAP-binding protein with low pI). They showed that DIABLO can bind mammalian IAP homolog A (MIHA, or API3) and can also interact with MIHB (API1; 601712), MIHC (API2; 601721), and OpIAP, the baculoviral IAP. Immunoprecipitation and Western blot analysis indicated that the N-terminally processed, IAP-interacting form of DIABLO is concentrated in membrane fractions in healthy cells but is released into the MIHA-containing cytosolic fractions upon ultraviolet (UV) irradiation. Since transfection of cells with DIABLO was able to counter the protection afforded by MIHA against UV irradiation, the authors suggested that DIABLO may promote apoptosis by binding to IAPs and preventing them from inhibiting caspases. Chai et al. (2000) showed that SMAC/DIABLO promotes not only the proteolytic activation of procaspase-3, but also the enzymatic activity of mature caspase-3, both of which depend upon its ability to interact physically with IAPs. Animal model experiments lend further support to the function of SMAC. Okada et al. (2002) generated Diablo-deficient mice by homologous recombination. Western blot analysis confirmed the null mutation. The mice were fertile and appeared grossly normal at more than 1 year of age, and histologic analysis failed to detect any abnormalities. In vitro analysis indicated an inhibition of procaspase-3 (CASP3; 600636) cleavage in Diablo -/- cell lysates, but all types of Diablo -/- cells tested responded normally to a number of apoptotic stimuli. Fas (OMIM Ref. No. 134637)-mediated apoptosis in liver was also normal in vivo in these mice. The authors concluded that a redundant molecule, possibly Omi (PRSS25; 606441), or molecules are capable of compensating for the loss of Diablo function. Alternatively, they suggested that Diablo may only regulate programmed cell death in specific situations or tissues not yet identified.

It is appreciated that the abovementioned animal model for SMAC is acknowledged by those skilled in the art as a scientifically valid animal model, as can be further appreciated from the publications sited hereinbelow.

Full details of the abovementioned studies are described in the following publications, the disclosure of which are hereby incorporated by reference:

Okada, H.; Suh, W.-K.; Jin, J.; Woo, M.; Du, C.; Elia, A.; Duncan, G. S.; Wakeham, A.; Itie, A.; Lowe, S. W.; Wang, X.; Mak, T. W.: Generation and characterization of Smac/DIABLO-deficient mice. Molec. Cell. Biol. 22:3509-3517, 2002; and Verhagen, A. M.; Ekert, P. G.; Pakusch, M.; Silke, J.; Connolly, L. M.; Reid, G. E.; Moritz, R. L.; Simpson, R. J.; Vaux, D. L.: Identification of DIABLO, a mammalian protein that promote.

Further studies establishing the function and utilities of SMAC are found in John Hopkins OMIM database record ID 605219, and in sited publications numbered 6969-6970, 9213-6972, 921 and 8837 listed in the bibliography section hereinbelow, which are also hereby incorporated by reference. Sorting Nexin 15 (SNX15, Accession XM_057307) is another VGAM74 host target gene. SNX15 BINDING SITE is HOST TARGET binding site found in the 3' untranslated region of mRNA encoded by SNX15, corresponding to a HOST TARGET binding site such as BINDING SITE I, BINDING SITE II or BINDING SITE III. Table 2 illustrates the complementarity of the nucleotide sequences of SNX15 BINDING SITE, designated SEQ ID:36505, to the nucleotide sequence of VGAM74 RNA, herein designated VGAM RNA, also designated SEQ ID:2785.

Another function of VGAM74 is therefore inhibition of Sorting Nexin 15 (SNX15, Accession XM_057307). Accordingly, utilities of VGAM74 include diagnosis, prevention and treatment of diseases and clinical conditions associated with SNX15. Synovial Sarcoma Translocation, Chromosome 18 (SS18, Accession NM_005637) is another VGAM74 host target gene. SS18 BINDING SITE is HOST TARGET binding site found in the 3' untranslated region of mRNA encoded by SS18, corresponding to a HOST TARGET binding site such as BINDING SITE I, BINDING SITE II or BINDING SITE III. Table 2 illustrates the complementarity of the nucleotide sequences of SS18 BINDING SITE, designated SEQ ID:12164, to the nucleotide sequence of VGAM74 RNA, herein designated VGAM RNA, also designated SEQ ID:2785.

Another function of VGAM74 is therefore inhibition of Synovial Sarcoma Translocation, Chromosome 18 (SS18, Accession NM_005637), a gene which is a putative transcriptional activator. Accordingly, utilities of VGAM74 include diagnosis, prevention and treatment of diseases and clinical conditions associated with SS18. The function of SS18 has been established by previous studies. Human synovial sarcomas contain a recurrent and specific chromosomal translocation t (X;18)(p11.2; q11.2). By screening a synovial sarcoma cDNA library with a YAC spanning the X chromosome breakpoint, Clark et al. (1994) identified a hybrid transcript that contained 5-prime sequences mapping to chromosome 18 and 3-prime sequences mapping to the X chromosome (see OMIM Ref. No. SSX1; 312820). A probe from the chromosome 18 gene sequence, symbolized SS18, detected genomic rearrangements in 10 of 13 synovial sarcomas. The chromosome 18 gene was symbolized SYT by Clark et al. (1994), but that symbol had already been used for synaptotagmin (OMIM Ref. No. 185605). Sequencing of cDNA clones showed that the normal SS18 gene encodes a protein rich in glutamine, proline, and glycine, and that in synovial sarcoma, rearrangement of the SS18 gene results in the formation of a fusion protein. Both the chromosome 18 and the X chromosome components failed to exhibit significant homology to known gene sequences. The SYT protein appears to act as a transcriptional coactivator and the SSX proteins as corepressors. Thaete et al. (1999) investigated the functional domains of the proteins. The SYT protein was found to contain a novel conserved 54-amino acid domain at the N terminus of the protein (the SNH domain) that is found in proteins from a wide variety of species, and a C-terminal domain, rich in glutamine, proline, glycine, and tyrosine (the QPGY domain), which contains the transcriptional activator sequences. Deletion of the SNH domain resulted in a more active transcriptional activator, suggesting that this domain acts as an inhibitor of the activation domain. The C-terminal SSX domain present in the SYT-SSX translocation protein contributes a transcriptional repressor domain to the protein. Thus, the fusion protein has transcriptional activating and repressing domains. Thaete et al. (1999) demonstrated that the human homolog of the SNF2/Brahma protein BRM (SMARCA2; 600014) colocalizes with SYT and SYT-SSX in nuclear speckles, and also interacts with SYT and SYT-SSX proteins in vitro. They suggested that this interaction may provide an explanation of how the SYT protein activates gene transcription.

Full details of the abovementioned studies are described in the following publications, the disclosure of which are hereby incorporated by reference:

Clark, J.; Rocques, P. J.; Crew, A. J.; Gill, S.; Shipley, J.; Chan, A. M.-L.; Gusterson, B. A.; Cooper, C. S.: Identification of novel genes, SYT and SSX, involved in the t (X;18) (p11.2; q11.2) translocation found in human synovial sarcoma. Nature Genet. 7:502-508, 1994; and Thaete, C.; Brett, D.; Monaghan, P.; Whitehouse, S.; Rennie, G.; Rayner, E.; Cooper, C. S.; Goodwin, G.: Functional domains of the SYT and SYT-SSX synovial sarcoma translocation prote.

Further studies establishing the function and utilities of SS18 are found in John Hopkins OMIM database record ID 600192, and in sited publications numbered 10626, 11390-10117, 9147-914 and 10118 listed in the bibliography section hereinbelow, which are also hereby incorporated by reference. Tripartite Motif-containing 9 (TRIM9, Accession NM_015163) is another VGAM74 host target gene. TRIM9 BINDING SITE is HOST TARGET binding site found in the 5' untranslated region of mRNA encoded by TRIM9, corresponding to a HOST TARGET binding site such as BINDING SITE I, BINDING SITE II or BINDING SITE III. Table 2 illustrates the complementarity of the nucleotide sequences of TRIM9 BINDING SITE, designated SEQ ID:17515, to the nucleotide sequence of VGAM74 RNA, herein designated VGAM RNA, also designated SEQ ID:2785.

Another function of VGAM74 is therefore inhibition of Tripartite Motif-containing 9 (TRIM9, Accession NM_015163), a gene which may function as a positive regulator for mannosylphosphate transferase and is required to mediate mannosylphosphate transfer in both the core and outer chain portions of n-linked. oligosaccharides. Accordingly, utilities of VGAM74 include diagnosis, prevention and treatment of diseases and clinical conditions associated with TRIM9. The function of TRIM9 has been established by previous studies. TRIM proteins are composed of 3 zinc-binding domains, a RING, a B-box type 1, and a B-box type 2, followed by a coiled-coil region. They are involved in development and cell growth. By EST database searching for B-box-containing proteins, Reymond et al. (2001) identified 37 TRIM members, including 3 isoforms of TRIM9. Northern blot analysis revealed high expression of a 4.4-kb TRIM9 transcript in brain. Fluorescence microscopy demonstrated expression of TRIM9 in cytoplasmic speckles. Interaction mating analysis indicated that TRIM9 can form a homodimer.

Full details of the abovementioned studies are described in the following publications, the disclosure of which are hereby incorporated by reference:

Li, Y.; Chin, L.-S.; Weigel, C.; Li, L.: Spring, a novel RING finger protein that regulates synaptic vesicle exocytosis. J. Biol. Chem. 276:40824-40833, 2001; and Reymond, A.; Meroni, G.; Fantozzi, A.; Merla, G.; Cairo, S.; Luzi, L.; Riganelli, D.; Zanaria, E.; Messali, S.; Cainarca, S.; Guffanti, A.; Minucci, S.; Pelicci, P. G.; Ballabio, A..

Further studies establishing the function and utilities of TRIM9 are found in John Hopkins OMIM database record ID 606555, and in sited publications numbered 4517-4518 listed in the bibliography section hereinbelow, which are also hereby incorporated by reference. UDP-glucose Dehydrogenase (UGDH, Accession NM_003359) is another VGAM74 host target gene. UGDH BINDING SITE is HOST TARGET binding site found in the 3' untranslated region of mRNA encoded by UGDH, corresponding to a HOST TARGET binding site such as BINDING SITE I, BINDING SITE II or BINDING SITE III. Table 2 illustrates the complementarity of the nucleotide sequences of UGDH BINDING SITE, designated SEQ ID:9388, to the nucleotide sequence of VGAM74 RNA, herein designated VGAM RNA, also designated SEQ ID:2785.

Another function of VGAM74 is therefore inhibition of UDP-glucose Dehydrogenase (UGDH, Accession NM_003359), a gene which is an UDP-glucose dehydrogenase. Accordingly, utilities of VGAM74 include diagnosis, prevention and treatment of diseases and clinical conditions associated with UGDH. The function of UGDH has been established by previous studies. Spicer et al. (1998) conducted expression studies that indicated that treatment of human fibroblasts with proinflammatory cytokines, such as interleukin-1-beta (OMIM Ref. No. 147720), under conditions that dramatically increase hyaluronan synthesis, also led to a substantial but transient increase in the expression of UGDH. The authors suggested that glycosaminoglycan biosynthesis may be partly regulated by the availability of activated UDP-glucuronate, as determined by relative Udpgdh expression. Animal model experiments lend further support to the function of UGDH. Zebrafish 'jekyll' mutants are deficient in the initiation of heart valve formation. Walsh and Stainier (2001) identified the jekyll mutation as a T-to-A change at basepair 992, resulting in an isoleucine-to-aspartic acid substitution at residue 331 in the zebrafish UDP-glucose dehydrogenase gene. The isoleucine at position 331 is conserved in Drosophila, human, and zebrafish Ugdh and is situated in a pocket of nonpolar amino acids in the 'hinge' of the omega loop gate that allows UDP-glucose access to the active site of the enzyme. While other mutations that affect heparan sulfate proteoglycans in vertebrates result in defects during gastrulation, jekyll exhibits no manifestations until organogenesis. Walsh and Stainier (2001) suggested one explanation for this incongruity is that zebrafish Udgh mRNA is provided maternally. The atrioventricular border cells do not differentiate from their neighbors in jekyll mutants, suggesting that jekyll is required in a cell signaling event that establishes a boundary between the atrium and the ventricle. Walsh and Stainier (2001) demonstrated that jekyll functions early in the process of atrioventricular valve formation and is required specifically in patterning the myocardium and endocardium at the atrioventricular boundary. The myocardial patterning defects seen in jekyll mutants are likely direct effects of the loss of jekyll function because they are the first molecular defects to be observed, whereas the later endocardial defects may be secondary to the lack of Bmp4 (OMIM Ref. No. 112262) restriction in the myocardium.

It is appreciated that the abovementioned animal model for UGDH is acknowledged by those skilled in the art as a scientifically valid animal model, as can be further appreciated from the publications sited hereinbelow.

Full details of the abovementioned studies are described in the following publications, the disclosure of which are hereby incorporated by reference:

Spicer, A. P.; Kaback, L. A.; Smith, T. J.; Seldin, M. F.: Molecular cloning and characterization of the human and mouse UDP-glucose dehydrogenase genes. J. Biol. Chem. 273:25117-25124, 1998; and Walsh, E. C.; Stainier, D. Y. R.: UDP-glucose dehydrogenase required for cardiac valve formation in zebrafish. Science 293:1670-1674, 2001.

Further studies establishing the function and utilities of UGDH are found in John Hopkins OMIM database record ID 603370, and in sited publications numbered 8512-8516 listed in the bibliography section hereinbelow, which are also hereby incorporated by reference. V-yes-1 Yamaguchi Sarcoma Viral Oncogene Homolog 1 (YES1, Accession NM_005433) is another VGAM74 host target gene. YES1 BINDING SITE is HOST TARGET binding site found in the 3' untranslated region of mRNA encoded by YES1, corresponding to a HOST TARGET binding site such as BINDING SITE I, BINDING SITE II or BINDING SITE III. Table 2 illustrates the complementarity of the nucleotide sequences of YES1 BINDING SITE, designated SEQ ID:11914, to the nucleotide sequence of VGAM74 RNA, herein designated VGAM RNA, also designated SEQ ID:2785.

Another function of VGAM74 is therefore inhibition of V-yes-1 Yamaguchi Sarcoma Viral Oncogene Homolog 1 (YES1, Accession NM_005433), a gene which is a putative protein-tyrosine kinase. Accordingly, utilities of VGAM74 include diagnosis, prevention and treatment of diseases and clinical conditions associated with YES1. The function of YES1 has been established by previous studies. The YES oncogene is homologous to the gene of the Yamaguchi sarcoma virus. The product of the gene is associated with tyrosine-specific protein kinase activity and its amino acid sequence shows a high degree of homology with that of the SRC gene product of Rous sarcoma virus. Semba et al. (1985) found in DNA from human embryo fibroblasts 10 EcoRI fragments that hybridized with the Yamaguchi sarcoma virus oncogene. Four of these (designated YES1) were assigned to chromosome 18 and 1 (designated YES2) was assigned to chromosome 6 by a study of human-mouse cell hybrids. (YES2 was later found (Semba et al., 1988) to be a pseudogene of YES1 and to be located at 22q11.2. Semba et al. (1988) stated: 'The failure of proper mapping in our earlier experiment might have been caused by instability of hybrid cell clones.') The other 5 fragments could not be mapped either because hybridization signals were too weak or differentiation from mouse YES fragments was impossible. There was evidence for multiple copies of YES-related genes in the human genome, but only a single RNA species, 4.8 kb long, was found. At least 3 of the human YES gene copies had both introns and exons and 1 gene copy appeared to be a pseudogene. By isotopic in situ hybridization, Yoshida et al. (1985) mapped the YES1 gene to 18q21.3. These workers suggested that the localization is consistent with a role in the pathogenesis of follicular lymphoma, which is frequently associated with a 14;18 translocation with the breakpoint at 18q21 (Fukuhara et al., 1979); see 151430. Ohno et al. (1987) found that although it is in the same chromosome region as BCL2 (OMIM Ref. No. 151430), the YES gene is intact in cases of follicular lymphoma. Using yeast artificial chromosomes (YACs) containing the YES1 gene as probes and fluorescence in situ hybridization, Silverman et al. (1993) detected a strong signal in the region corresponding to 18p11.3. These YACs were found to contain another 18p11.32 gene, thymidylate synthase (OMIM Ref. No. 188350); the genes were less than 50 kb apart. Overhauser et al. (1993) identified a sequence tagged site (STS) in the YES1 gene and used it in studies of somatic cell hybrids with deletion of various segments of chromosome 18 to map the gene to 18pter-p11.21.

Full details of the abovementioned studies are described in the following publications, the disclosure of which are hereby incorporated by reference:

Semba, K.; Yamanashi, Y.; Nishizawa, M.; Sukegawa, J.; Yoshida, M.; Sasaki, M.; Yamamoto, T.; Toyoshima, K.: Location of the c-yes gene on the human chromosome and its expression in various tissues. Science 227:1038-1040, 1985; and Overhauser, J.; Mewar, R.; Rojas, K.; Lia, K.; Kline, A. D.; Silverman, G. A.: STS map of genes and anonymous DNA fragments on human chromosome 18 using a panel of somatic cell hybrids.

Further studies establishing the function and utilities of YES1 are found in John Hopkins OMIM database record ID 164880, and in sited publications numbered 3148-3149, 11918-315 and 1694 listed in the bibliography section hereinbelow, which are also hereby incorporated by reference. Zinc Finger Protein 36, C3H Type-like 1 (ZFP36L1, Accession NM_004926) is another VGAM74 host target gene. ZFP36L1 BINDING SITE is HOST TARGET binding site found in the 3' untranslated region of mRNA encoded by ZFP36L1, corresponding to a HOST TARGET binding site such as BINDING SITE I, BINDING SITE II or BINDING SITE III. Table 2 illustrates the complementarity of the nucleotide sequences of ZFP36L1 BINDING SITE, designated SEQ ID:11362, to the nucleotide sequence of VGAM74 RNA, herein designated VGAM RNA, also designated SEQ ID:2785.

Another function of VGAM74 is therefore inhibition of Zinc Finger Protein 36, C3H Type-like 1 (ZFP36L1, Accession NM_004926), a gene which is a regulatory protein involved in regulating the response to growth factors. Accordingly, utilities of VGAM74 include diagnosis, prevention and treatment of diseases and clinical conditions associated with ZFP36L1. The function of ZFP36L1 has been established by previous studies. Bustin et al. (1994) cloned and characterized the ZFP36L1 gene, which they called ERF1, which is a member of the Tis11 family of early-response genes (see OMIM Ref. No. ZFP36; 190700). Members of this gene family contain a distinguishing putative zinc finger domain with a repeating cys-his motif and are induced by various agonists such as the phorbol ester TPA and the polypeptide mitogen EGF (OMIM Ref. No. 131530). The human gene was cloned using a rat homolog as a probe. The rat and human genes have conserved 5-prime and 3-prime UTRs and their promoters contain motifs seen in other early-response genes. The predicted rat and human proteins are 99% identical. Bustin et al. (1994) determined that the ZFP36L1 gene contains 2 exons and spans about 6 kb of genomic DNA including the promoter and UTRs. Ning et al. (1996) also cloned ZFP36L1, which they termed BERG36 (B-cell early response gene encoding a 36-kD protein). The deduced 338-amino acid BERG36 protein could be induced by treatment with calcium ionophore, and the induction could be blocked by treatment with interleukin-4 (IL4; 147780) but not by CD40 (TNFRSF5; 109535) ligation. Treatment of the Epstein-Barr virus-negative human Burkitt lymphoma cell line Ramos, which phenotypically resembles germinal center B cells, with BERG36-antisense or with IL4 or CD40 ligation protected the cells from ionophore-induced apoptosis. CD40 ligation also protected Ramos cells from apoptosis induced by inhibitors of macromolecular synthesis. Ning et al. (1996) concluded that BERG36 is a target of IL4 signaling for B-cell survival.

Full details of the abovementioned studies are described in the following publications, the disclosure of which are hereby incorporated by reference:

Bustin, S. A.; Xiao-Feng, N.; Barnard, R. C.; Kumar, V.; Pascall, J. C.; Brown, K. D.; Leigh, I. M.; Williams, N. S.; McKay, I. A.: Cloning and characterisation of ERF1, a human member of the Tis11 family of early-response genes. DNA Cell Biol. 13:449-459, 1994; and Ning, Z.-Q.; Norton, J. D.; Li, J.; Murphy, J. J.: Distinct mechanisms for rescue from apoptosis in Ramos human B cells by signaling through CD40 and interleukin-4 receptor: a role for.

Further studies establishing the function and utilities of ZFP36L1 are found in John Hopkins OMIM database record ID 601064, and in sited publications numbered 7811-7814 listed in the bibliography section hereinbelow, which are also hereby incorporated by reference. BCL2-associated Athanogene 5 (BAG5, Accession NM_004873) is another VGAM74 host target gene. BAG5 BINDING SITE is HOST TARGET binding site found in the 3' untranslated region of mRNA encoded by BAG5, corresponding to a HOST TARGET binding site such as BINDING SITE I, BINDING SITE II or BINDING SITE III. Table 2 illustrates the complementarity of the nucleotide sequences of BAG5 BINDING SITE, designated SEQ ID:11303, to the nucleotide sequence of VGAM74 RNA, herein designated VGAM RNA, also designated SEQ ID:2785.

Another function of VGAM74 is therefore inhibition of BCL2-associated Athanogene 5 (BAG5, Accession NM_004873). Accordingly, utilities of VGAM74 include diagnosis, prevention and treatment of diseases and clinical conditions associated with BAG5. Chromosome 9 Open Reading Frame 9 (C9orf9, Accession NM_018956) is another VGAM74 host target gene. C9orf9 BINDING SITE is HOST TARGET binding site found in the 3' untranslated region of mRNA encoded by C9orf9, corresponding to a HOST TARGET binding site such as BINDING SITE I, BINDING SITE II or BINDING SITE III. Table 2 illustrates the complementarity of the nucleotide sequences of C9orf9 BINDING SITE, designated SEQ ID:21028, to the nucleotide sequence of VGAM74 RNA, herein designated VGAM RNA, also designated SEQ ID:2785.

Another function of VGAM74 is therefore inhibition of Chromosome 9 Open Reading Frame 9 (C9orf9, Accession NM_018956). Accordingly, utilities of VGAM74 include diagnosis, prevention and treatment of diseases and clinical conditions associated with C9orf9. Chromatin Accessibility Complex 1 (CHRAC1, Accession NM_017444) is another VGAM74 host target gene. CHRAC1 BINDING SITE is HOST TARGET binding site found in the 3' untranslated region of mRNA encoded by CHRAC1, corresponding to a HOST TARGET binding site such as BINDING SITE I, BINDING SITE II or BINDING SITE III. Table 2 illustrates the complementarity of the nucleotide sequences of CHRAC1 BINDING SITE, designated SEQ ID:18904, to the nucleotide sequence of VGAM74 RNA, herein designated VGAM RNA, also designated SEQ ID:2785.

Another function of VGAM74 is therefore inhibition of Chromatin Accessibility Complex 1 (CHRAC1, Accession NM_017444). Accordingly, utilities of VGAM74 include diagnosis, prevention and treatment of diseases and clinical conditions associated with CHRAC1. DKFZP564I122 (Accession XM_032397) is another VGAM74 host target gene. DKFZP564I122 BINDING SITE is HOST TARGET binding site found in the 3' untranslated region of mRNA encoded by DKFZP564I122, corresponding to a HOST TARGET binding site such as BINDING SITE I, BINDING SITE II or BINDING SITE III. Table 2 illustrates the complementarity of the nucleotide sequences of DKFZP564I122 BINDING SITE, designated SEQ ID:31644, to the nucleotide sequence of VGAM74 RNA, herein designated VGAM RNA, also designated SEQ ID:2785.

Another function of VGAM74 is therefore inhibition of DKFZP564I122 (Accession XM_032397). Accordingly, utilities of VGAM74 include diagnosis, prevention and treatment of diseases and clinical conditions associated with DKFZP564I122. FLJ00024 (Accession XM_033361) is another VGAM74 host target gene. FLJ00024 BINDING SITE is HOST TARGET binding site found in the 5' untranslated region of mRNA encoded by FLJ00024, corresponding to a HOST TARGET binding site such as BINDING SITE I, BINDING SITE II or BINDING SITE III. Table 2 illustrates the complementarity of the nucleotide sequences of FLJ00024 BINDING SITE, designated SEQ ID:31892, to the nucleotide sequence of VGAM74 RNA, herein designated VGAM RNA, also designated SEQ ID:2785.

Another function of VGAM74 is therefore inhibition of FLJ00024 (Accession XM_033361). Accordingly, utilities of VGAM74 include diagnosis, prevention and treatment of diseases and clinical conditions associated with FLJ00024. FLJ10346 (Accession NM_018065) is another VGAM74 host target gene. FLJ10346 BINDING SITE is HOST TARGET binding site found in the 5' untranslated region of mRNA encoded by FLJ10346, corresponding to a HOST TARGET binding site such as BINDING SITE I, BINDING SITE II or BINDING SITE III. Table 2 illustrates the complementarity of the nucleotide sequences of FLJ10346 BINDING SITE, designated SEQ ID:19837, to the nucleotide sequence of VGAM74 RNA, herein designated VGAM RNA, also designated SEQ ID:2785.

Another function of VGAM74 is therefore inhibition of FLJ10346 (Accession NM_018065). Accordingly, utilities of VGAM74 include diagnosis, prevention and treatment of diseases and clinical conditions associated with FLJ10346. FLJ10535 (Accession NM_018129) is another VGAM74 host target gene. FLJ10535 BINDING SITE is HOST TARGET binding site found in the 3' untranslated region of mRNA encoded by FLJ10535, corresponding to a HOST TARGET binding site such as BINDING SITE I, BINDING SITE II or BINDING SITE III. Table 2 illustrates the complementarity of the nucleotide sequences of FLJ10535 BINDING SITE, designated SEQ ID:19919, to the nucleotide sequence of VGAM74 RNA, herein designated VGAM RNA, also designated SEQ ID:2785.

Another function of VGAM74 is therefore inhibition of FLJ10535 (Accession NM_018129). Accordingly, utilities of VGAM74 include diagnosis, prevention and treatment of diseases and clinical conditions associated with FLJ10535. FLJ10846 (Accession NM_018241) is another VGAM74 host target gene. FLJ10846 BINDING SITE is HOST TARGET binding site found in the 3' untranslated region of mRNA encoded by FLJ10846, corresponding to a HOST TARGET binding site such as BINDING SITE I, BINDING SITE II or BINDING SITE III. Table 2 illustrates the complementarity of the nucleotide sequences of FLJ10846 BINDING SITE, designated SEQ ID:20199, to the nucleotide sequence of VGAM74 RNA, herein designated VGAM RNA, also designated SEQ ID:2785.

Another function of VGAM74 is therefore inhibition of FLJ10846 (Accession NM_018241). Accordingly, utilities of VGAM74 include diagnosis, prevention and treatment of diseases and clinical conditions associated with FLJ10846. FLJ12572 (Accession NM_022905) is another VGAM74 host target gene. FLJ12572 BINDING SITE is HOST TARGET binding site found in the 5' untranslated region of mRNA encoded by FLJ12572, corresponding to a HOST TARGET binding site such as BINDING SITE I, BINDING SITE II or BINDING SITE III. Table 2 illustrates the complementarity of the nucleotide sequences of FLJ12572 BINDING SITE, designated SEQ ID:23198, to the nucleotide sequence of VGAM74 RNA, herein designated VGAM RNA, also designated SEQ ID:2785.

Another function of VGAM74 is therefore inhibition of FLJ12572 (Accession NM_022905). Accordingly, utilities of VGAM74 include diagnosis, prevention and treatment of diseases and clinical conditions associated with FLJ12572. FLJ14950 (Accession NM_032865) is another VGAM74 host target gene. FLJ14950 BINDING SITE is HOST TARGET binding site found in the 3' untranslated region of mRNA encoded by FLJ14950, corresponding to a HOST TARGET binding site such as BINDING SITE I, BINDING SITE II or BINDING SITE III. Table 2 illustrates the complementarity of the nucleotide sequences of FLJ14950 BINDING SITE, designated SEQ ID:26673, to the nucleotide sequence of VGAM74 RNA, herein designated VGAM RNA, also designated SEQ ID:2785.

Another function of VGAM74 is therefore inhibition of FLJ14950 (Accession NM_032865). Accordingly, utilities of VGAM74 include diagnosis, prevention and treatment of diseases and clinical conditions associated with FLJ14950. FLJ22002 (Accession NM_024838) is another VGAM74 host target gene. FLJ22002 BINDING SITE is HOST TARGET binding site found in the 3' untranslated region of mRNA encoded by FLJ22002, corresponding to a HOST TARGET binding site such as BINDING SITE I, BINDING SITE II or BINDING SITE III. Table 2 illustrates the complementarity of the nucleotide sequences of FLJ22002 BINDING SITE, designated SEQ ID:24246, to the nucleotide sequence of VGAM74 RNA, herein designated VGAM RNA, also designated SEQ ID:2785.

Another function of VGAM74 is therefore inhibition of FLJ22002 (Accession NM_024838). Accordingly, utilities of VGAM74 include diagnosis, prevention and treatment of diseases and clinical conditions associated with FLJ22002. FLJ22531 (Accession NM_024650) is another VGAM74 host target gene. FLJ22531 BINDING SITE is HOST TARGET binding site found in the 5' untranslated region of mRNA encoded by FLJ22531, corresponding to a HOST TARGET binding site such as BINDING SITE I, BINDING SITE II or BINDING SITE III. Table 2 illustrates the complementarity of the nucleotide sequences of FLJ22531 BINDING SITE, designated SEQ ID:23945, to the nucleotide sequence of VGAM74 RNA, herein designated VGAM RNA, also designated SEQ ID:2785.

Another function of VGAM74 is therefore inhibition of FLJ22531 (Accession NM_024650). Accordingly, utilities of VGAM74 include diagnosis, prevention and treatment of diseases and clinical conditions associated with FLJ22531. FLJ22794 (Accession XM_166220) is another VGAM74 host target gene. FLJ22794 BINDING SITE is HOST TARGET binding site found in the 3' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44028, to the nucleotide sequence of VGAM74 RNA, herein designated VGAM RNA, also designated SEQ ID:2785.

Another function of VGAM74 is therefore inhibition of FLJ22794 (Accession XM_166220). Accordingly, utilities of VGAM74 include diagnosis, prevention and treatment of diseases and clinical conditions associated with FLJ22794. FLJ23053 (Accession NM_022907) is another VGAM74 host target gene. FLJ23053 BINDING SITE is HOST TARGET binding site found in the 3' untranslated region of mRNA encoded by FLJ23053, corresponding to a HOST TARGET binding site such as BINDING SITE I, BINDING SITE II or BINDING SITE III. Table 2 illustrates the complementarity of the nucleotide sequences of FLJ23053 BINDING SITE, designated SEQ ID:23206, to the nucleotide sequence of VGAM74 RNA, herein designated VGAM RNA, also designated SEQ ID:2785.

Another function of VGAM74 is therefore inhibition of FLJ23053 (Accession NM_022907). Accordingly, utilities of VGAM74 include diagnosis, prevention and treatment of diseases and clinical conditions associated with FLJ23053. FLJ23392 (Accession NM_024784) is another VGAM74 host target gene. FLJ23392 BINDING SITE is HOST TARGET binding site found in the 3' untranslated region of mRNA encoded by FLJ23392, corresponding to a HOST TARGET binding site such as BINDING SITE I, BINDING SITE II or BINDING SITE III. Table 2 illustrates the complementarity of the nucleotide sequences of FLJ23392 BINDING SITE, designated SEQ ID:24161, to the nucleotide sequence of VGAM74 RNA, herein designated VGAM RNA, also designated SEQ ID:2785.

Another function of VGAM74 is therefore inhibition of FLJ23392 (Accession NM_024784). Accordingly, utilities of VGAM74 include diagnosis, prevention and treatment of diseases and clinical conditions associated with FLJ23392. FLJ23519 (Accession NM_032240) is another VGAM74 host target gene. FLJ23519 BINDING SITE is HOST TARGET binding site found in the 3' untranslated region of mRNA encoded by FLJ23519, corresponding to a HOST TARGET binding site such as BINDING SITE I, BINDING SITE II or BINDING SITE III. Table 2 illustrates the complementarity of the nucleotide sequences of FLJ23519 BINDING SITE, designated SEQ ID:25976, to the nucleotide sequence of VGAM74 RNA, herein designated VGAM RNA, also designated SEQ ID:2785.

Another function of VGAM74 is therefore inhibition of FLJ23519 (Accession NM_032240). Accordingly, utilities of VGAM74 include diagnosis, prevention and treatment of diseases and clinical conditions associated with FLJ23519. FLJ23563 (Accession XM_041701) is another VGAM74 host target gene. FLJ23563 BINDING SITE is HOST TARGET binding site found in the 3' untranslated region of mRNA encoded by FLJ23563, corresponding to a HOST TARGET binding site such as BINDING SITE I, BINDING SITE II or BINDING SITE III. Table 2 illustrates the complementarity of the nucleotide sequences of FLJ23563 BINDING SITE, designated SEQ ID:33563, to the nucleotide sequence of VGAM74 RNA, herein designated VGAM RNA, also designated SEQ ID:2785.

Another function of VGAM74 is therefore inhibition of FLJ23563 (Accession XM_041701). Accordingly, utilities of VGAM74 include diagnosis, prevention and treatment of diseases and clinical conditions associated with FLJ23563. FLJ25416 (Accession NM_145018) is another VGAM74 host target gene. FLJ25416 BINDING SITE is HOST TARGET binding site found in the 3' untranslated region of mRNA encoded by FLJ25416, corresponding to a HOST TARGET binding site such as BINDING SITE I, BINDING SITE II or BINDING SITE III. Table 2 illustrates the complementarity of the nucleotide sequences of FLJ25416 BINDING SITE, designated SEQ ID:29625, to the nucleotide sequence of VGAM74 RNA, herein designated VGAM RNA, also designated SEQ ID:2785.

Another function of VGAM74 is therefore inhibition of FLJ25416 (Accession NM_145018). Accordingly, utilities of VGAM74 include diagnosis, prevention and treatment of diseases and clinical conditions associated with FLJ25416. GAL3ST-4 (Accession NM_024637) is another VGAM74 host target gene. GAL3ST-4 BINDING SITE is HOST TARGET binding site found in the 3' untranslated region of mRNA encoded by GAL3ST-4, corresponding to a HOST TARGET binding site such as BINDING SITE I, BINDING SITE II or BINDING SITE III. Table 2 illustrates the complementarity of the nucleotide sequences of GAL3ST-4 BINDING SITE, designated SEQ ID:23911, to the nucleotide sequence of VGAM74 RNA, herein designated VGAM RNA, also designated SEQ ID:2785.

Another function of VGAM74 is therefore inhibition of GAL3ST-4 (Accession NM_024637). Accordingly, utilities of VGAM74 include diagnosis, prevention and treatment of diseases and clinical conditions associated with GAL3ST-4. Golgi Autoantigen, Golgin Subfamily A, 3 (GOLGA3, Accession NM_005895) is another VGAM74 host target gene. GOLGA3 BINDING SITE is HOST TARGET binding site found in the 3' untranslated region of mRNA encoded by GOLGA3, corresponding to a HOST TARGET binding site such as BINDING SITE I, BINDING SITE II or BINDING SITE III. Table 2 illustrates the complementarity of the nucleotide sequences of GOLGA3 BINDING SITE, designated SEQ ID:12514, to the nucleotide sequence of VGAM74 RNA, herein designated VGAM RNA, also designated SEQ ID:2785.

Another function of VGAM74 is therefore inhibition of Golgi Autoantigen, Golgin Subfamily A, 3 (GOLGA3, Accession NM_005895). Accordingly, utilities of VGAM74 include diagnosis, prevention and treatment of diseases and clinical conditions associated with GOLGA3. H-plk (Accession NM_015852) is another VGAM74 host target gene. H-plk BINDING SITE is HOST TARGET binding site found in the 5' untranslated region of mRNA encoded by H-plk, corresponding to a HOST TARGET binding site such as BINDING SITE I, BINDING SITE II or BINDING SITE III. Table 2 illustrates the complementarity of the nucleotide sequences of H-plk BINDING SITE, designated SEQ ID:17985, to the nucleotide sequence of VGAM74 RNA, herein designated VGAM RNA, also designated SEQ ID:2785.

Another function of VGAM74 is therefore inhibition of H-plk (Accession NM_015852). Accordingly, utilities of VGAM74 include diagnosis, prevention and treatment of diseases and clinical conditions associated with H-plk. KIAA0426 (Accession NM_014724) is another VGAM74 host target gene. KIAA0426 BINDING SITE is HOST TARGET binding site found in the 3' untranslated region of mRNA encoded by KIAA0426, corresponding to a HOST TARGET binding site such as BINDING SITE I, BINDING SITE II or BINDING SITE III. Table 2 illustrates the complementarity of the nucleotide sequences of KIAA0426 BIND- ING SITE, designated SEQ ID:16310, to the nucleotide sequence of VGAM74 RNA, herein designated VGAM RNA, also designated SEQ ID:2785.

Another function of VGAM74 is therefore inhibition of KIAA0426 (Accession NM_014724). Accordingly, utilities of VGAM74 include diagnosis, prevention and treatment of diseases and clinical conditions associated with KIAA0426. KIAA0469 (Accession NM_014851) is another VGAM74 host target gene. KIAA0469 BINDING SITE is HOST TARGET binding site found in the 3' untranslated region of mRNA encoded by KIAA0469, corresponding to a HOST TARGET binding site such as BINDING SITE I, BINDING SITE II or BINDING SITE III. Table 2 illustrates the complementarity of the nucleotide sequences of KIAA0469 BINDING SITE, designated SEQ ID:16891, to the nucleotide sequence of VGAM74 RNA, herein designated VGAM RNA, also designated SEQ ID:2785.

Another function of VGAM74 is therefore inhibition of KIAA0469 (Accession NM_014851). Accordingly, utilities of VGAM74 include diagnosis, prevention and treatment of diseases and clinical conditions associated with KIAA0469. KIAA0527 (Accession XM_171054) is another VGAM74 host target gene. KIAA0527 BINDING SITE is HOST TARGET binding site found in the 3' untranslated region of mRNA encoded by KIAA0527, corresponding to a HOST TARGET binding site such as BINDING SITE I, BINDING SITE II or BINDING SITE III. Table 2 illustrates the complementarity of the nucleotide sequences of KIAA0527 BINDING SITE, designated SEQ ID:45846, to the nucleotide sequence of VGAM74 RNA, herein designated VGAM RNA, also designated SEQ ID:2785.

Another function of VGAM74 is therefore inhibition of KIAA0527 (Accession XM_171054). Accordingly, utilities of VGAM74 include diagnosis, prevention and treatment of diseases and clinical conditions associated with KIAA0527. KIAA0561 (Accession XM_038150) is another VGAM74 host target gene. KIAA0561 BINDING SITE is HOST TARGET binding site found in the 3' untranslated region of mRNA encoded by KIAA0561, corresponding to a HOST TARGET binding site such as BINDING SITE I, BINDING SITE II or BINDING SITE III. Table 2 illustrates the complementarity of the nucleotide sequences of KIAA0561 BINDING SITE, designated SEQ ID:32764, to the nucleotide sequence of VGAM74 RNA, herein designated VGAM RNA, also designated SEQ ID:2785.

Another function of VGAM74 is therefore inhibition of KIAA0561 (Accession XM_038150). Accordingly, utilities of VGAM74 include diagnosis, prevention and treatment of diseases and clinical conditions associated with KIAA0561. KIAA0599 (Accession XM_085127) is another VGAM74 host target gene. KIAA0599 BINDING SITE is HOST TARGET binding site found in the 3' untranslated region of mRNA encoded by KIAA0599, corresponding to a HOST TARGET binding site such as BINDING SITE I, BINDING SITE II or BINDING SITE III. Table 2 illustrates the complementarity of the nucleotide sequences of KIAA0599 BINDING SITE, designated SEQ ID:37856, to the nucleotide sequence of VGAM74 RNA, herein designated VGAM RNA, also designated SEQ ID:2785.

Another function of VGAM74 is therefore inhibition of KIAA0599 (Accession XM_085127). Accordingly, utilities of VGAM74 include diagnosis, prevention and treatment of diseases and clinical conditions associated with KIAA0599. KIAA0841 (Accession XM_049237) is another VGAM74 host target gene. KIAA0841 BINDING SITE is HOST TARGET binding site found in the 3' untranslated region of mRNA encoded by KIAA0841, corresponding to a HOST TARGET binding site such as BINDING SITE I, BINDING SITE II or BINDING SITE III. Table 2 illustrates the complementarity of the nucleotide sequences of KIAA0841 BINDING SITE, designated SEQ ID:35361, to the nucleotide sequence of VGAM74 RNA, herein designated VGAM RNA, also designated SEQ ID:2785.

Another function of VGAM74 is therefore inhibition of KIAA0841 (Accession XM_049237). Accordingly, utilities of VGAM74 include diagnosis, prevention and treatment of diseases and clinical conditions associated with KIAA0841. KIAA1054 (Accession XM_043493) is another VGAM74 host target gene. KIAA1054 BINDING SITE is HOST TARGET binding site found in the 3' untranslated region of mRNA encoded by KIAA1054, corresponding to a HOST TARGET binding site such as BINDING SITE I, BINDING SITE II or BINDING SITE III. Table 2 illustrates the complementarity of the nucleotide sequences of KIAA1054 BINDING SITE, designated SEQ ID:33953, to the nucleotide sequence of VGAM74 RNA, herein designated VGAM RNA, also designated SEQ ID:2785.

Another function of VGAM74 is therefore inhibition of KIAA1054 (Accession XM_043493). Accordingly, utilities of VGAM74 include diagnosis, prevention and treatment of diseases and clinical conditions associated with KIAA1054. KIAA1198 (Accession XM_032674) is another VGAM74 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31708, to the nucleotide sequence of VGAM74 RNA, herein designated VGAM RNA, also designated SEQ ID:2785.

Another function of VGAM74 is therefore inhibition of KIAA1198 (Accession XM_032674). Accordingly, utilities of VGAM74 include diagnosis, prevention and treatment of diseases and clinical conditions associated with KIAA1198. KIAA1373 (Accession XM_048195) is another VGAM74 host target gene. KIAA1373 BINDING SITE is HOST TARGET binding site found in the 3' untranslated region of mRNA encoded by KIAA1373, corresponding to a HOST TARGET binding site such as BINDING SITE I, BINDING SITE II or BINDING SITE III. Table 2 illustrates the complementarity of the nucleotide sequences of KIAA1373 BINDING SITE, designated SEQ ID:35127, to the nucleotide sequence of VGAM74 RNA, herein designated VGAM RNA, also designated SEQ ID:2785.

Another function of VGAM74 is therefore inhibition of KIAA1373 (Accession XM_048195). Accordingly, utilities of VGAM74 include diagnosis, prevention and treatment of diseases and clinical conditions associated with KIAA1373. KIAA1443 (Accession XM_033392) is another VGAM74 host target gene. KIAA1443 BINDING SITE is HOST TARGET binding site found in the 3' untranslated region of mRNA encoded by KIAA1443, corresponding to a HOST TARGET binding site such as BINDING SITE I, BINDING SITE II or BINDING SITE III. Table 2 illustrates the complementarity of the nucleotide sequences of KIAA1443 BINDING SITE, designated SEQ ID:31931, to the nucleotide sequence of VGAM74 RNA, herein designated VGAM RNA, also designated SEQ ID:2785.

Another function of VGAM74 is therefore inhibition of KIAA1443 (Accession XM_033392). Accordingly, utilities of VGAM74 include diagnosis, prevention and treatment of diseases and clinical conditions associated with KIAA1443. KIAA1497 (Accession XM_041431) is another VGAM74 host target gene. KIAA1497 BINDING SITE is HOST TARGET binding site found in the 5' untranslated region of mRNA encoded by KIAA1497, corresponding to a HOST TARGET binding site such as BINDING SITE I, BINDING SITE II or BINDING SITE III. Table 2 illustrates the complementarity of the nucleotide sequences of KIAA1497 BINDING SITE, designated SEQ ID:33528, to the nucleotide sequence of VGAM74 RNA, herein designated VGAM RNA, also designated SEQ ID:2785.

Another function of VGAM74 is therefore inhibition of KIAA1497 (Accession XM_041431). Accordingly, utilities of VGAM74 include diagnosis, prevention and treatment of diseases and clinical conditions associated with KIAA1497. KIAA1615 (Accession XM_044021) is another VGAM74 host target gene. KIAA1615 BINDING SITE is HOST TARGET binding site found in the 3' untranslated region of mRNA encoded by KIAA1615, corresponding to a HOST TARGET binding site such as BINDING SITE I, BINDING SITE II or BINDING SITE III. Table 2 illustrates the complementarity of the nucleotide sequences of KIAA1615 BINDING SITE, designated SEQ ID:34084, to the nucleotide sequence of VGAM74 RNA, herein designated VGAM RNA, also designated SEQ ID:2785.

Another function of VGAM74 is therefore inhibition of KIAA1615 (Accession XM_044021). Accordingly, utilities of VGAM74 include diagnosis, prevention and treatment of diseases and clinical conditions associated with KIAA1615. KIAA1922 (Accession XM_057040) is another VGAM74 host target gene. KIAA1922 BINDING SITE is HOST TARGET binding site found in the 5' untranslated region of mRNA encoded by KIAA1922, corresponding to a HOST TARGET binding site such as BINDING SITE I, BINDING SITE II or BINDING SITE III. Table 2 illustrates the complementarity of the nucleotide sequences of KIAA1922 BINDING SITE, designated SEQ ID:36455, to the nucleotide sequence of VGAM74 RNA, herein designated VGAM RNA, also designated SEQ ID:2785.

Another function of VGAM74 is therefore inhibition of KIAA1922 (Accession XM_057040). Accordingly, utilities of VGAM74 include diagnosis, prevention and treatment of diseases and clinical conditions associated with KIAA1922. KIAA1924 (Accession XM_057091) is another VGAM74 host target gene. KIAA1924 BINDING SITE is HOST TARGET binding site found in the 3' untranslated region of mRNA encoded by KIAA1924, corresponding to a HOST TARGET binding site such as BINDING SITE I, BINDING SITE II or BINDING SITE III. Table 2 illustrates the complementarity of the nucleotide sequences of KIAA1924 BINDING SITE, designated SEQ ID:36475, to the nucleotide sequence of VGAM74 RNA, herein designated VGAM RNA, also designated SEQ ID:2785.

Another function of VGAM74 is therefore inhibition of KIAA1924 (Accession XM_057091). Accordingly, utilities of VGAM74 include diagnosis, prevention and treatment of diseases and clinical conditions associated with KIAA1924. KIAA1971 (Accession XM_058720) is another VGAM74 host target gene. KIAA1971 BINDING SITE1 and KIAA1971 BINDING SITE2 are HOST TARGET binding sites found in untranslated regions of mRNA encoded by KIAA1971, corresponding to HOST TARGET binding sites such as BINDING SITE I, BINDING SITE II or BINDING SITE III. Table 2 illustrates the complementarity of the nucleotide sequences of KIAA1971 BINDING SITE1 and KIAA1971 BINDING SITE2, designated SEQ ID:36729 and SEQ ID:36730 respectively, to the nucleotide sequence of VGAM74 RNA, herein designated VGAM RNA, also designated SEQ ID:2785.

Another function of VGAM74 is therefore inhibition of KIAA1971 (Accession XM_058720). Accordingly, utilities of VGAM74 include diagnosis, prevention and treatment of diseases and clinical conditions associated with KIAA1971. Lymphocyte Antigen 75 (LY75, Accession NM_002349) is another VGAM74 host target gene. LY75 BINDING SITE is HOST TARGET binding site found in the 3' untranslated region of mRNA encoded by LY75, corresponding to a HOST TARGET binding site such as BINDING SITE I, BINDING SITE II or BINDING SITE III. Table 2 illustrates the complementarity of the nucleotide sequences of LY75 BINDING SITE, designated SEQ ID:8148, to the nucleotide sequence of VGAM74 RNA, herein designated VGAM RNA, also designated SEQ ID:2785.

Another function of VGAM74 is therefore inhibition of Lymphocyte Antigen 75 (LY75, Accession NM_002349). Accordingly, utilities of VGAM74 include diagnosis, prevention and treatment of diseases and clinical conditions associated with LY75. Mannosidase, Alpha, Class 1C, Member 1 (MAN1C1, Accession NM_020379) is another VGAM74 host target gene. MAN1C1 BINDING SITE is HOST TARGET binding site found in the 3' untranslated region of mRNA encoded by MAN1C1, corresponding to a HOST TARGET binding site such as BINDING SITE I, BINDING SITE II or BINDING SITE III. Table 2 illustrates the complementarity of the nucleotide sequences of MAN1C1 BINDING SITE, designated SEQ ID:21645, to the nucleotide sequence of VGAM74 RNA, herein designated VGAM RNA, also designated SEQ ID:2785.

Another function of VGAM74 is therefore inhibition of Mannosidase, Alpha, Class 1C, Member 1 (MAN1C1, Accession NM_020379). Accordingly, utilities of VGAM74 include diagnosis, prevention and treatment of diseases and clinical conditions associated with MAN1C1. MCLC (Accession NM_015127) is another VGAM74 host target gene. MCLC BINDING SITE is HOST TARGET binding site found in the 3' untranslated region of mRNA encoded by MCLC, corresponding to a HOST TARGET binding site such as BINDING SITE I, BINDING SITE II or BINDING SITE III. Table 2 illustrates the complementarity of the nucleotide sequences of MCLC BINDING SITE, designated SEQ ID:17491, to the nucleotide sequence of VGAM74 RNA, herein designated VGAM RNA, also designated SEQ ID:2785.

Another function of VGAM74 is therefore inhibition of MCLC (Accession NM_015127). Accordingly, utilities of VGAM74 include diagnosis, prevention and treatment of diseases and clinical conditions associated with MCLC. MGC11115 (Accession NM_032310) is another VGAM74 host target gene. MGC11115 BINDING SITE is HOST TARGET binding site found in the 3" untranslated region of mRNA encoded by MGC11115, corresponding to a HOST TARGET binding site such as BINDING SITE I, BINDING SITE II or BINDING SITE III. Table 2 illustrates the complementarity of the nucleotide sequences of MGC11115 BINDING SITE, designated SEQ ID:26091, to the nucleotide sequence of VGAM74 RNA, herein designated VGAM RNA, also designated SEQ ID:2785.

Another function of VGAM74 is therefore inhibition of MGC11115 (Accession NM_032310). Accordingly, utilities of VGAM74 include diagnosis, prevention and treatment of diseases and clinical conditions associated with MGC11115. MGC15631 (Accession NM_032753) is another VGAM74 host target gene. MGC15631 BINDING SITE is HOST TARGET binding site found in the 3' untranslated region of mRNA encoded by MGC15631, corresponding to a HOST TARGET binding site such as BINDING SITE I, BINDING SITE II or BINDING SITE III. Table 2 illustrates the complementarity of the nucleotide sequences of MGC15631 BINDING SITE, designated SEQ ID:26489, to the nucleotide sequence of VGAM74 RNA, herein designated VGAM RNA, also designated SEQ ID:2785.

Another function of VGAM74 is therefore inhibition of MGC15631 (Accession NM_032753). Accordingly, utilities of VGAM74 include diagnosis, prevention and treatment of diseases and clinical conditions associated with MGC15631. MGC35558 (Accession NM_145013) is another VGAM74 host target gene. MGC35558 BINDING SITE is HOST TARGET binding site found in the 3' untranslated region of mRNA encoded by MGC35558, corresponding to a HOST TARGET binding site such as BINDING SITE I, BINDING SITE II or BINDING SITE III. Table 2 illustrates the complementarity of the nucleotide sequences of MGC35558 BINDING SITE, designated SEQ ID:29611, to the nucleotide sequence of VGAM74 RNA, herein designated VGAM RNA, also designated SEQ ID:2785.

Another function of VGAM74 is therefore inhibition of MGC35558 (Accession NM_145013). Accordingly, utilities of VGAM74 include diagnosis, prevention and treatment of diseases and clinical conditions associated with MGC35558. MGC5149 (Accession XM_051200) is another VGAM74 host target gene. MGC5149 BINDING SITE is HOST TARGET binding site found in the 3' untranslated region of mRNA encoded by MGC5149, corresponding to a HOST TARGET binding site such as BINDING SITE I, BINDING SITE II or BINDING SITE III. Table 2 illustrates the complementarity of the nucleotide sequences of MGC5149 BINDING SITE, designated SEQ ID:35784, to the nucleotide sequence of VGAM74 RNA, herein designated VGAM RNA, also designated SEQ ID:2785.

Another function of VGAM74 is therefore inhibition of MGC5149 (Accession XM_051200). Accordingly, utilities of VGAM74 include diagnosis, prevention and treatment of diseases and clinical conditions associated with MGC5149. moblak (Accession NM_130807) is another VGAM74 host target gene. moblak BINDING SITE is HOST TARGET binding site found in the 3" untranslated region of mRNA encoded by moblak, corresponding to a HOST TARGET binding site such as BINDING SITE I, BINDING SITE II or BINDING SITE III. Table 2 illustrates the complementarity of the nucleotide sequences of moblak BINDING SITE, designated SEQ ID:28308, to the nucleotide sequence of VGAM74 RNA, herein designated VGAM RNA, also designated SEQ ID:2785.

Another function of VGAM74 is therefore inhibition of moblak (Accession NM_130807). Accordingly, utilities of VGAM74 include diagnosis, prevention and treatment of diseases and clinical conditions associated with moblak. Molybdenum Cofactor Synthesis 3 (MOCS3, Accession NM_014484) is another VGAM74 host target gene. MOCS3 BINDING SITE is HOST TARGET binding site found in the 3' untranslated region of mRNA encoded by MOCS3, corresponding to a HOST TARGET binding site such as BINDING SITE I, BINDING SITE II or BINDING SITE III. Table 2 illustrates the complementarity of the nucleotide sequences of MOCS3 BINDING SITE, designated SEQ ID:15830, to the nucleotide sequence of VGAM74 RNA, herein designated VGAM RNA, also designated SEQ ID:2785.

Another function of VGAM74 is therefore inhibition of Molybdenum Cofactor Synthesis 3 (MOCS3, Accession NM_014484). Accordingly, utilities of VGAM74 include diagnosis, prevention and treatment of diseases and clinical conditions associated with MOCS3. Phosphoserine Phosphatase (PSPH, Accession NM_004577) is another VGAM74 host target gene. PSPH BINDING SITE is HOST TARGET binding site found in the 3' untranslated region of mRNA encoded by PSPH, corresponding to a HOST TARGET binding site such as BINDING SITE I, BINDING SITE II or BINDING SITE III. Table 2 illustrates the complementarity of the nucleotide sequences of PSPH BINDING SITE, designated SEQ ID:10924, to the nucleotide sequence of VGAM74 RNA, herein designated VGAM RNA, also designated SEQ ID:2785.

Another function of VGAM74 is therefore inhibition of Phosphoserine Phosphatase (PSPH, Accession NM_004577). Accordingly, utilities of VGAM74 include diagnosis, prevention and treatment of diseases and clinical conditions associated with PSPH. RAB21, Member RAS Oncogene Family (RAB21, Accession NM_014999) is another VGAM74 host target gene. RAB21 BINDING SITE is HOST TARGET binding site found in the 3' untranslated region of mRNA encoded by RAB21, corresponding to a HOST TARGET binding site such as BINDING SITE I, BINDING SITE II or BINDING SITE III. Table 2 illustrates the complementarity of the nucleotide sequences of RAB21 BINDING SITE, designated SEQ ID:17367, to the nucleotide sequence of VGAM74 RNA, herein designated VGAM RNA, also designated SEQ ID:2785.

Another function of VGAM74 is therefore inhibition of RAB21, Member RAS Oncogene Family (RAB21, Accession NM_014999). Accordingly, utilities of VGAM74 include diagnosis, prevention and treatment of diseases and clinical conditions associated with RAB21. RAB33B, Member RAS Oncogene Family (RAB33B, Accession NM_031296) is another VGAM74 host target gene. RAB33B BINDING SITE is HOST TARGET binding site found in the 3' untranslated region of mRNA encoded by RAB33B, corresponding to a HOST TARGET binding site such as BINDING SITE I, BINDING SITE II or BINDING SITE III. Table 2 illustrates the complementarity of the nucleotide sequences of RAB33B BINDING SITE, designated SEQ ID:25329, to the nucleotide sequence of VGAM74 RNA, herein designated VGAM RNA, also designated SEQ ID:2785.

Another function of VGAM74 is therefore inhibition of RAB33B, Member RAS Oncogene Family (RAB33B, Accession NM_031296). Accordingly, utilities of VGAM74 include diagnosis, prevention and treatment of diseases and clinical conditions associated with RAB33B. RAP140 (Accession NM_015224) is another VGAM74 host target gene. RAP140 BINDING SITE is HOST TARGET binding site found in the 3' untranslated region of mRNA encoded by RAP140, corresponding to a HOST TARGET binding site such as BINDING SITE I, BINDING SITE II or BINDING SITE III. Table 2 illustrates the complementarity of the nucleotide sequences of RAP140 BINDING SITE, designated SEQ ID:17557, to the nucleotide sequence of VGAM74 RNA, herein designated VGAM RNA, also designated SEQ ID:2785.

Another function of VGAM74 is therefore inhibition of RAP140 (Accession NM_015224). Accordingly, utilities of VGAM74 include diagnosis, prevention and treatment of diseases and clinical conditions associated with RAP140. RNF9 (Accession NM_052828) is another VGAM74 host target gene. RNF9 BINDING SITE is HOST TARGET binding site found in the 3' untranslated region of mRNA encoded by RNF9, corresponding to a HOST TARGET binding site such as BINDING SITE I, BINDING SITE II or BINDING SITE III. Table 2 illustrates the complementarity of the nucleotide sequences of RNF9 BINDING SITE, designated SEQ ID:27409, to the nucleotide sequence of VGAM74 RNA, herein designated VGAM RNA, also designated SEQ ID:2785.

Another function of VGAM74 is therefore inhibition of RNF9 (Accession NM_052828). Accordingly, utilities of VGAM74 include diagnosis, prevention and treatment of diseases and clinical conditions associated with RNF9. STAF65 (gamma) (Accession NM_014860) is another VGAM74 host target gene. STAF65(gamma) BINDING SITE is HOST TARGET binding site found in the 3' untranslated region of mRNA encoded by STAF65(gamma), corresponding to a HOST TARGET binding site such as BINDING SITE I, BINDING SITE II or BINDING SITE III. Table 2 illustrates the complementarity of the nucleotide sequences of STAF65 (gamma) BINDING SITE, designated SEQ ID:16924, to the nucleotide sequence of VGAM74 RNA, herein designated VGAM RNA, also designated SEQ ID:2785.

Another function of VGAM74 is therefore inhibition of STAF65(gamma) (Accession NM_014860). Accordingly, utilities of VGAM74 include diagnosis, prevention and treatment of diseases and clinical conditions associated with STAF65(gamma). Synaptotagmin XIII (SYT13, Accession XM_167880) is another VGAM74 host target gene. SYT13 BINDING SITE is HOST TARGET binding site found in the 3' untranslated region of mRNA encoded by SYT13, corresponding to a HOST TARGET binding site such as BINDING SITE I, BINDING SITE II or BINDING SITE III. Table 2 illustrates the complementarity of the nucleotide sequences of SYT13 BINDING SITE, designated SEQ ID:44889, to the nucleotide sequence of VGAM74 RNA, herein designated VGAM RNA, also designated SEQ ID:2785.

Another function of VGAM74 is therefore inhibition of Synaptotagmin XIII (SYT13, Accession XM_167880). Accordingly, utilities of VGAM74 include diagnosis, prevention and treatment of diseases and clinical conditions associated with SYT13. TADA3L (Accession NM_133480) is another VGAM74 host target gene. TADA3L BINDING SITE is HOST TARGET binding site found in the 3' untranslated region of mRNA encoded by TADA3L, corresponding to a HOST TARGET binding site such as BINDING SITE I, BINDING SITE II or BINDING SITE III. Table 2 illustrates the complementarity of the nucleotide sequences of TADA3L BINDING SITE, designated SEQ ID:28547, to the nucleotide sequence of VGAM74 RNA, herein designated VGAM RNA, also designated SEQ ID:2785.

Another function of VGAM74 is therefore inhibition of TADA3L (Accession NM_133480). Accordingly, utilities of VGAM74 include diagnosis, prevention and treatment of diseases and clinical conditions associated with TADA3L. UBF-fl (Accession NM_032828) is another VGAM74 host target gene. UBF-fl BINDING SITE is HOST TARGET binding site found in the 3' untranslated region of mRNA encoded by UBF-fl, corresponding to a HOST TARGET binding site such as BINDING SITE I, BINDING SITE II or BINDING SITE III. Table 2 illustrates the complementarity of the nucleotide sequences of UBF-fl BINDING SITE, designated SEQ ID:26602, to the nucleotide sequence of VGAM74 RNA, herein designated VGAM RNA, also designated SEQ ID:2785.

Another function of VGAM74 is therefore inhibition of UBF-fl (Accession NM_032828). Accordingly, utilities of VGAM74 include diagnosis, prevention and treatment of diseases and clinical conditions associated with UBF-fl. LOC126661 (Accession XM_059061) is another VGAM74 host target gene. LOC126661 BINDING SITE is HOST TARGET binding site found in the 3' untranslated region of mRNA encoded by LOC126661, corresponding to a HOST TARGET binding site such as BINDING SITE I, BINDING SITE II or BINDING SITE III. Table 2 illustrates the complementarity of the nucleotide sequences of LOC126661 BINDING SITE, designated SEQ ID:36851, to the nucleotide sequence of VGAM74 RNA, herein designated VGAM RNA, also designated SEQ ID:2785.

Another function of VGAM74 is therefore inhibition of LOC126661 (Accession XM_059061). Accordingly, utilities of VGAM74 include diagnosis, prevention and treatment of diseases and clinical conditions associated with LOC126661. LOC128989 (Accession XM_059310) is another VGAM74 host target gene. LOC128989 BINDING SITE is HOST TARGET binding site found in the 3' untranslated region of mRNA encoded by LOC128989, corresponding to a HOST TARGET binding site such as BINDING SITE I, BINDING SITE II or BINDING SITE III. Table 2 illustrates the complementarity of the nucleotide sequences of LOC128989 BINDING SITE, designated SEQ ID:36943, to the nucleotide sequence of VGAM74 RNA, herein designated VGAM RNA, also designated SEQ ID:2785.

Another function of VGAM74 is therefore inhibition of LOC128989 (Accession XM_059310). Accordingly, utilities of VGAM74 include diagnosis, prevention and treatment of diseases and clinical conditions associated with LOC128989. LOC135293 (Accession XM_072402) is another VGAM74 host target gene. LOC135293 BINDING SITE is HOST TARGET binding site found in the 3' untranslated region of mRNA encoded by LOC135293, corresponding to a HOST TARGET binding site such as BINDING SITE I, BINDING SITE II or BINDING SITE III. Table 2 illustrates the complementarity of the nucleotide sequences of LOC135293 BINDING SITE, designated SEQ ID:37493, to the nucleotide sequence of VGAM74 RNA, herein designated VGAM RNA, also designated SEQ ID:2785.

Another function of VGAM74 is therefore inhibition of LOC135293 (Accession XM_072402). Accordingly, utilities of VGAM74 include diagnosis, prevention and treatment of diseases and clinical conditions associated with LOC135293. LOC146784 (Accession XM_085588) is another VGAM74 host target gene. LOC146784 BINDING SITE is HOST TARGET binding site found in the 5' untranslated region of mRNA encoded by LOC146784, corresponding to a HOST TARGET binding site such as BINDING SITE I, BINDING SITE II or BINDING SITE III. Table 2 illustrates the complementarity of the nucleotide sequences of LOC146784 BINDING SITE, designated SEQ ID:38238, to the nucleotide sequence of VGAM74 RNA, herein designated VGAM RNA, also designated SEQ ID:2785.

Another function of VGAM74 is therefore inhibition of LOC146784 (Accession XM_085588). Accordingly, utilities of VGAM74 include diagnosis, prevention and treatment of diseases and clinical conditions associated with LOC146784. LOC146909 (Accession XM_085634) is another VGAM74 host target gene. LOC146909 BINDING SITE is HOST TARGET binding site found in the 3' untranslated region of mRNA encoded by LOC146909, corresponding to a HOST TARGET binding site such as BINDING SITE I, BINDING SITE II or BINDING SITE III. Table 2 illustrates the complementarity of the nucleotide sequences of LOC146909 BINDING SITE, designated SEQ ID:38266, to the nucleotide sequence of VGAM74 RNA, herein designated VGAM RNA, also designated SEQ ID:2785.

Another function of VGAM74 is therefore inhibition of LOC146909 (Accession XM_085634). Accordingly, utilities of VGAM74 include diagnosis, prevention and treatment of diseases and clinical conditions associated with LOC146909. LOC146952 (Accession XM_097138) is another VGAM74 host target gene. LOC146952 BINDING SITE is HOST TARGET binding site found in the 5' untranslated region of mRNA encoded by LOC146952, corresponding to a HOST TARGET binding site such as BINDING SITE I, BINDING SITE II or BINDING SITE III. Table 2 illustrates the complementarity of the nucleotide sequences of LOC146952 BINDING SITE, designated SEQ ID:40767, to the nucleotide sequence of VGAM74 RNA, herein designated VGAM RNA, also designated SEQ ID:2785.

Another function of VGAM74 is therefore inhibition of LOC146952 (Accession XM_097138). Accordingly, utilities of VGAM74 include diagnosis, prevention and treatment of diseases and clinical conditions associated with LOC146952. LOC147071 (Accession XM_054031) is another VGAM74 host target gene. LOC147071 BINDING SITE is HOST TARGET binding site found in the 5' untranslated region of mRNA encoded by LOC147071, corresponding to a HOST TARGET binding site such as BINDING SITE I, BINDING SITE II or BINDING SITE III. Table 2 illustrates the complementarity of the nucleotide sequences of LOC147071 BINDING SITE, designated SEQ ID:36136, to the nucleotide sequence of VGAM74 RNA, herein designated VGAM RNA, also designated SEQ ID:2785.

Another function of VGAM74 is therefore inhibition of LOC147071 (Accession XM_054031). Accordingly, utilities of VGAM74 include diagnosis, prevention and treatment of diseases and clinical conditions associated with LOC147071. LOC147694 (Accession XM_085843) is another VGAM74 host target gene. LOC147694 BINDING SITE is HOST TARGET binding site found in the 3' untranslated region of mRNA encoded by LOC147694, corresponding to a HOST TARGET binding site such as BINDING SITE I, BINDING SITE II or BINDING SITE III. Table 2 illustrates the complementarity of the nucleotide sequences of LOC147694 BINDING SITE, designated SEQ ID:38372, to the nucleotide sequence of VGAM74 RNA, herein designated VGAM RNA, also designated SEQ ID:2785.

Another function of VGAM74 is therefore inhibition of LOC147694 (Accession XM_085843). Accordingly, utilities of VGAM74 include diagnosis, prevention and treatment of diseases and clinical conditions associated with LOC147694. LOC147817 (Accession XM_085903) is another VGAM74 host target gene. LOC147817 BINDING SITE is HOST TARGET binding site found in the 3' untranslated region of mRNA encoded by LOC147817, corresponding to a HOST TARGET binding site such as BINDING SITE I, BINDING SITE II or BINDING SITE III. Table 2 illustrates the complementarity of the nucleotide sequences of LOC147817 BINDING SITE, designated SEQ ID:38385, to the nucleotide sequence of VGAM74 RNA, herein designated VGAM RNA, also designated SEQ ID:2785.

Another function of VGAM74 is therefore inhibition of LOC147817 (Accession XM_085903). Accordingly, utilities of VGAM74 include diagnosis, prevention and treatment of diseases and clinical conditions associated with LOC147817. LOC149821 (Accession XM_097751) is another VGAM74 host target gene. LOC149821 BINDING SITE is HOST TARGET binding site found in the 5' untranslated region of mRNA encoded by LOC149821, corresponding to a HOST TARGET binding site such as BINDING SITE I, BINDING SITE II or BINDING SITE III. Table 2 illustrates the complementarity of the nucleotide sequences of LOC149821 BINDING SITE, designated SEQ ID:41109, to the nucleotide sequence of VGAM74 RNA, herein designated VGAM RNA, also designated SEQ ID:2785.

Another function of VGAM74 is therefore inhibition of LOC149821 (Accession XM_097751). Accordingly, utilities of VGAM74 include diagnosis, prevention and treatment of diseases and clinical conditions associated with LOC149821. LOC151475 (Accession XM_098063) is another VGAM74 host target gene. LOC151475 BINDING SITE is HOST TARGET binding site found in the 5' untranslated region of mRNA encoded by LOC151475, corresponding to a HOST TARGET binding site such as BINDING SITE I, BINDING SITE II or BINDING SITE III. Table 2 illustrates the complementarity of the nucleotide sequences of LOC151475 BINDING SITE, designated SEQ ID:41356, to the nucleotide sequence of VGAM74 RNA, herein designated VGAM RNA, also designated SEQ ID:2785.

Another function of VGAM74 is therefore inhibition of LOC151475 (Accession XM_098063). Accordingly, utilities of VGAM74 include diagnosis, prevention and treatment of diseases and clinical conditions associated with LOC151475. LOC152300 (Accession XM_087432) is another VGAM74 host target gene. LOC152300 BINDING SITE is HOST TARGET binding site found in the 3' untranslated region of mRNA encoded by LOC152300, corresponding to a HOST TARGET binding site such as BINDING SITE I, BINDING SITE II or BINDING SITE III. Table 2 illustrates the complementarity of the nucleotide sequences of LOC152300 BINDING SITE, designated SEQ ID:39251, to the nucleotide sequence of VGAM74 RNA, herein designated VGAM RNA, also designated SEQ ID:2785.

Another function of VGAM74 is therefore inhibition of LOC152300 (Accession XM_087432). Accordingly, utilities of VGAM74 include diagnosis, prevention and treatment of diseases and clinical conditions associated with LOC152300. LOC152794 (Accession XM_087525) is another VGAM74 host target gene. LOC152794 BINDING SITE is HOST TARGET binding site found in the 5' untranslated region of mRNA encoded by LOC152794, corresponding to a HOST TARGET binding site such as BINDING SITE I, BINDING SITE II or BINDING SITE III. Table 2 illustrates the complementarity of the nucleotide sequences of LOC152794 BINDING SITE, designated SEQ ID:39320, to the nucleotide sequence of VGAM74 RNA, herein designated VGAM RNA, also designated SEQ ID:2785.

Another function of VGAM74 is therefore inhibition of LOC152794 (Accession XM_087525). Accordingly, utilities of VGAM74 include diagnosis, prevention and treatment of diseases and clinical conditions associated with LOC152794. LOC153579 (Accession XM_087714) is another VGAM74 host target gene. LOC153579 BINDING SITE is HOST TARGET binding site found in the 5' untranslated region of mRNA encoded by LOC153579, corresponding to a HOST TARGET binding site such as BINDING SITE I, BINDING SITE II or BINDING SITE III. Table 2 illustrates the complementarity of the nucleotide sequences of LOC153579 BINDING SITE, designated SEQ ID:39404, to the nucleotide sequence of VGAM74 RNA, herein designated VGAM RNA, also designated SEQ ID:2785.

Another function of VGAM74 is therefore inhibition of LOC153579 (Accession XM_087714). Accordingly, utilities of VGAM74 include diagnosis, prevention and treatment of diseases and clinical conditions associated with LOC153579. LOC153811 (Accession XM_087779) is another VGAM74 host target gene. LOC153811 BINDING SITE is HOST TARGET binding site found in the 3' untranslated region of mRNA encoded by LOC153811, corresponding to a HOST TARGET binding site such as BINDING SITE I, BINDING SITE II or BINDING SITE III. Table 2 illustrates the complementarity of the nucleotide sequences of LOC153811 BINDING SITE, designated SEQ ID:39416, to the nucleotide sequence of VGAM74 RNA, herein designated VGAM RNA, also designated SEQ ID:2785.

Another function of VGAM74 is therefore inhibition of LOC153811 (Accession XM_087779). Accordingly, utilities of VGAM74 include diagnosis, prevention and treatment of diseases and clinical conditions associated with LOC153811.

LOC154282 (Accession XM_098505) is another VGAM74 host target gene. LOC154282 BINDING SITE is HOST TARGET binding site found in the 5' untranslated region of mRNA encoded by LOC154282, corresponding to a HOST TARGET binding site such as BINDING SITE I, BINDING SITE II or BINDING SITE III. Table 2 illustrates the complementarity of the nucleotide sequences of LOC154282 BINDING SITE, designated SEQ ID:41699, to the nucleotide sequence of VGAM74 RNA, herein designated VGAM RNA, also designated SEQ ID:2785.

Another function of VGAM74 is therefore inhibition of LOC154282 (Accession XM_098505). Accordingly, utilities of VGAM74 include diagnosis, prevention and treatment of diseases and clinical conditions associated with LOC154282.

LOC157798 (Accession XM_098827) is another VGAM74 host target gene. LOC157798 BINDING SITE is HOST TARGET binding site found in the 5' untranslated region of mRNA encoded by LOC157798, corresponding to a HOST TARGET binding site such as BINDING SITE I, BINDING SITE II or BINDING SITE III. Table 2 illustrates the complementarity of the nucleotide sequences of LOC157798 BINDING SITE, designated SEQ ID:41848, to the nucleotide sequence of VGAM74 RNA, herein designated VGAM RNA, also designated SEQ ID:2785.

Another function of VGAM74 is therefore inhibition of LOC157798 (Accession XM_098827). Accordingly, utilities of VGAM74 include diagnosis, prevention and treatment of diseases and clinical conditions associated with LOC157798.

LOC196047 (Accession XM_116883) is another VGAM74 host target gene. LOC196047 BINDING SITE is HOST TARGET binding site found in the 5' untranslated region of mRNA encoded by LOC196047, corresponding to a HOST TARGET binding site such as BINDING SITE I, BINDING SITE II or BINDING SITE III. Table 2 illustrates the complementarity of the nucleotide sequences of LOC196047 BINDING SITE, designated SEQ ID:43144, to the nucleotide sequence of VGAM74 RNA, herein designated VGAM RNA, also designated SEQ ID:2785.

Another function of VGAM74 is therefore inhibition of LOC196047 (Accession XM_116883). Accordingly, utilities of VGAM74 include diagnosis, prevention and treatment of diseases and clinical conditions associated with LOC196047.

LOC200339 (Accession XM_117226) is another VGAM74 host target gene. LOC200339 BINDING SITE is HOST TARGET binding site found in the 3' untranslated region of mRNA encoded by LOC200339, corresponding to a HOST TARGET binding site such as BINDING SITE I, BINDING SITE II or BINDING SITE III. Table 2 illustrates the complementarity of the nucleotide sequences of LOC200339 BINDING SITE, designated SEQ ID:43298, to the nucleotide sequence of VGAM74 RNA, herein designated VGAM RNA, also designated SEQ ID:2785.

Another function of VGAM74 is therefore inhibition of LOC200339 (Accession XM_117226). Accordingly, utilities of VGAM74 include diagnosis, prevention and treatment of diseases and clinical conditions associated with LOC200339.

LOC200860 (Accession XM_117289) is another VGAM74 host target gene. LOC200860 BINDING SITE is HOST TARGET binding site found in the 3' untranslated region of mRNA encoded by LOC200860, corresponding to a HOST TARGET binding site such as BINDING SITE I, BINDING SITE II or BINDING SITE III. Table 2 illustrates the complementarity of the nucleotide sequences of LOC200860 BINDING SITE, designated SEQ ID:43354, to the nucleotide sequence of VGAM74 RNA, herein designated VGAM RNA, also designated SEQ ID:2785.

Another function of VGAM74 is therefore inhibition of LOC200860 (Accession XM_117289). Accordingly, utilities of VGAM74 include diagnosis, prevention and treatment of diseases and clinical conditions associated with LOC200860.

LOC201173 (Accession XM_113312) is another VGAM74 host target gene. LOC201173 BINDING SITE is HOST TARGET binding site found in the 5' untranslated region of mRNA encoded by LOC201173, corresponding to a HOST TARGET binding site such as BINDING SITE I, BINDING SITE II or BINDING SITE III. Table 2 illustrates the complementarity of the nucleotide sequences of LOC201173 BINDING SITE, designated SEQ ID:42215, to the nucleotide sequence of VGAM74 RNA, herein designated VGAM RNA, also designated SEQ ID:2785.

Another function of VGAM74 is therefore inhibition of LOC201173 (Accession XM_113312). Accordingly, utilities of VGAM74 include diagnosis, prevention and treatment of diseases and clinical conditions associated with LOC201173.

LOC201220 (Accession XM_113321) is another VGAM74 host target gene. LOC201220 BINDING SITE is HOST TARGET binding site found in the 5' untranslated region of mRNA encoded by LOC201220, corresponding to a HOST TARGET binding site such as BINDING SITE I, BINDING SITE II or BINDING SITE III. Table 2 illustrates the complementarity of the nucleotide sequences of LOC201220 BINDING SITE, designated SEQ ID:42222, to the nucleotide sequence of VGAM74 RNA, herein designated VGAM RNA, also designated SEQ ID:2785.

Another function of VGAM74 is therefore inhibition of LOC201220 (Accession XM_113321). Accordingly, utilities of VGAM74 include diagnosis, prevention and treatment of diseases and clinical conditions associated with LOC201220.

LOC201411 (Accession XM_031946) is another VGAM74 host target gene. LOC201411 BINDING SITE is HOST TARGET binding site found in the 3' untranslated region of mRNA encoded by LOC201411, corresponding to a HOST TARGET binding site such as BINDING SITE I, BINDING SITE II or BINDING SITE III. Table 2 illustrates the complementarity of the nucleotide sequences of LOC201411 BINDING SITE, designated SEQ ID:31528, to the nucleotide sequence of VGAM74 RNA, herein designated VGAM RNA, also designated SEQ ID:2785.

Another function of VGAM74 is therefore inhibition of LOC201411 (Accession XM_031946). Accordingly, utilities of VGAM74 include diagnosis, prevention and treatment of diseases and clinical conditions associated with LOC201411.

LOC202025 (Accession XM_117353) is another VGAM74 host target gene. LOC202025 BINDING SITE is HOST TARGET binding site found in the 3' untranslated region of mRNA encoded by LOC202025, corresponding to a HOST TARGET binding site such as BINDING SITE I, BINDING SITE II or BINDING SITE III. Table 2 illustrates the complementarity of the nucleotide sequences of LOC202025 BINDING SITE, designated SEQ ID:43402, to the nucleotide sequence of VGAM74 RNA, herein designated VGAM RNA, also designated SEQ ID:2785.

Another function of VGAM74 is therefore inhibition of LOC202025 (Accession XM_117353). Accordingly, utilities of VGAM74 include diagnosis, prevention and treatment of diseases and clinical conditions associated with LOC202025.

LOC203297 (Accession XM_059986) is another VGAM74 host target gene. LOC203297 BINDING SITE is HOST TARGET binding site found in the 5' untranslated region of mRNA encoded by LOC203297, corresponding to a HOST TARGET binding site such as BINDING SITE I, BINDING SITE II or BINDING SITE III. Table 2 illustrates the complementarity of the nucleotide sequences of LOC203297 BINDING SITE, designated SEQ ID:37136, to the nucleotide sequence of VGAM74 RNA, herein designated VGAM RNA, also designated SEQ ID:2785.

Another function of VGAM74 is therefore inhibition of LOC203297 (Accession XM_059986). Accordingly, utilities of VGAM74 include diagnosis, prevention and treatment of diseases and clinical conditions associated with LOC203297. LOC203350 (Accession XM_117536) is another VGAM74 host target gene. LOC203350 BINDING SITE is HOST TARGET binding site found in the 3' untranslated region of mRNA encoded by LOC203350, corresponding to a HOST TARGET binding site such as BINDING SITE I, BINDING SITE II or BINDING SITE III. Table 2 illustrates the complementarity of the nucleotide sequences of LOC203350 BINDING SITE, designated SEQ ID:43534, to the nucleotide sequence of VGAM74 RNA, herein designated VGAM RNA, also designated SEQ ID:2785.

Another function of VGAM74 is therefore inhibition of LOC203350 (Accession XM_117536). Accordingly, utilities of VGAM74 include diagnosis, prevention and treatment of diseases and clinical conditions associated with LOC203350. LOC219735 (Accession XM_167601) is another VGAM74 host target gene. LOC219735 BINDING SITE is HOST TARGET binding site found in the 3' untranslated region of mRNA encoded by LOC219735, corresponding to a HOST TARGET binding site such as BINDING SITE I, BINDING SITE II or BINDING SITE III. Table 2 illustrates the complementarity of the nucleotide sequences of LOC219735 BINDING SITE, designated SEQ ID:44720, to the nucleotide sequence of VGAM74 RNA, herein designated VGAM RNA, also designated SEQ ID:2785.

Another function of VGAM74 is therefore inhibition of LOC219735 (Accession XM_167601). Accordingly, utilities of VGAM74 include diagnosis, prevention and treatment of diseases and clinical conditions associated with LOC219735. LOC221463 (Accession XM_166374) is another VGAM74 host target gene. LOC221463 BINDING SITE is HOST TARGET binding site found in the 3' untranslated region of mRNA encoded by LOC221463, corresponding to a HOST TARGET binding site such as BINDING SITE I, BINDING SITE II or BINDING SITE III. Table 2 illustrates the complementarity of the nucleotide sequences of LOC221463 BINDING SITE, designated SEQ ID:44203, to the nucleotide sequence of VGAM74 RNA, herein designated VGAM RNA, also designated SEQ ID:2785.

Another function of VGAM74 is therefore inhibition of LOC221463 (Accession XM_166374). Accordingly, utilities of VGAM74 include diagnosis, prevention and treatment of diseases and clinical conditions associated with LOC221463. LOC222070 (Accession XM_168433) is another VGAM74 host target gene. LOC222070 BINDING SITE is HOST TARGET binding site found in the 5' untranslated region of mRNA encoded by LOC222070, corresponding to a HOST TARGET binding site such as BINDING SITE I, BINDING SITE II or BINDING SITE III. Table 2 illustrates the complementarity of the nucleotide sequences of LOC222070 BINDING SITE, designated SEQ ID:45181, to the nucleotide sequence of VGAM74 RNA, herein designated VGAM RNA, also designated SEQ ID:2785.

Another function of VGAM74 is therefore inhibition of LOC222070 (Accession XM_168433). Accordingly, utilities of VGAM74 include diagnosis, prevention and treatment of diseases and clinical conditions associated with LOC222070. LOC253666 (Accession XM_170799) is another VGAM74 host target gene. LOC253666 BINDING SITE is HOST TARGET binding site found in the 5' untranslated region of mRNA encoded by LOC253666, corresponding to a HOST TARGET binding site such as BINDING SITE I, BINDING SITE II or BINDING SITE III. Table 2 illustrates the complementarity of the nucleotide sequences of LOC253666 BINDING SITE, designated SEQ ID:45568, to the nucleotide sequence of VGAM74 RNA, herein designated VGAM RNA, also designated SEQ ID:2785.

Another function of VGAM74 is therefore inhibition of LOC253666 (Accession XM_170799). Accordingly, utilities of VGAM74 include diagnosis, prevention and treatment of diseases and clinical conditions associated with LOC253666. LOC256360 (Accession XM_172918) is another VGAM74 host target gene. LOC256360 BINDING SITE is HOST TARGET binding site found in the 5' untranslated region of mRNA encoded by LOC256360, corresponding to a HOST TARGET binding site such as BINDING SITE I, BINDING SITE II or BINDING SITE III. Table 2 illustrates the complementarity of the nucleotide sequences of LOC256360 BINDING SITE, designated SEQ ID:46175, to the nucleotide sequence of VGAM74 RNA, herein designated VGAM RNA, also designated SEQ ID:2785.

Another function of VGAM74 is therefore inhibition of LOC256360 (Accession XM_172918). Accordingly, utilities of VGAM74 include diagnosis, prevention and treatment of diseases and clinical conditions associated with LOC256360. LOC90371 (Accession XM_031261) is another VGAM74 host target gene. LOC90371 BINDING SITE is HOST TARGET binding site found in the 5' untranslated region of mRNA encoded by LOC90371, corresponding to a HOST TARGET binding site such as BINDING SITE I, BINDING SITE II or BINDING SITE III. Table 2 illustrates the complementarity of the nucleotide sequences of LOC90371 BINDING SITE, designated SEQ ID:31321, to the nucleotide sequence of VGAM74 RNA, herein designated VGAM RNA, also designated SEQ ID:2785.

Another function of VGAM74 is therefore inhibition of LOC90371 (Accession XM_031261). Accordingly, utilities of VGAM74 include diagnosis, prevention and treatment of diseases and clinical conditions associated with LOC90371. LOC91115 (Accession XM_036218) is another VGAM74 host target gene. LOC91115 BINDING SITE1 and LOC91115 BINDING SITE2 are HOST TARGET binding sites found in untranslated regions of mRNA encoded by LOC91115, corresponding to HOST TARGET binding sites such as BINDING SITE I, BINDING SITE II or BINDING SITE III. Table 2 illustrates the complementarity of the nucleotide sequences of LOC91115 BINDING SITE1 and LOC91115 BINDING SITE2, designated SEQ ID:32396 and SEQ ID:32395 respectively, to the nucleotide sequence of VGAM74 RNA, herein designated VGAM RNA, also designated SEQ ID:2785.

Another function of VGAM74 is therefore inhibition of LOC91115 (Accession XM_036218). Accordingly, utilities of VGAM74 include diagnosis, prevention and treatment of diseases and clinical conditions associated with LOC91115. CD164 Antigen, Sialomucin (CD164, Accession NM_006016) is another VGAM75 host target gene. CD164 BINDING SITE is HOST TARGET binding site found in the 3' untranslated region of mRNA encoded by CD164, corresponding to a HOST TARGET binding site such as BINDING SITE I, BINDING SITE II or BINDING SITE III. Table 2 illustrates the complementarity of the nucleotide sequences of CD164 BINDING SITE, designated SEQ ID:12631, to the nucleotide sequence of VGAM75 RNA, herein designated VGAM RNA, also designated SEQ ID:2786.

Another function of VGAM75 is therefore inhibition of CD164 Antigen, Sialomucin (CD164, Accession NM_006016), a gene which plays a role in hematopoiesis by facilitating the adhesion of CD34+ cells to bone marrow stroma and negatively regulates CD34+ hematopoietic progenitor cell growth. Accordingly, utilities of VGAM75 include diagnosis, prevention and treatment of diseases and clinical conditions associated with CD164. The function of CD164 has been established by previous studies. The sialomucins appear to play 2 key but opposing roles in vivo: the first as cytoprotective or antiadhesive agents, and the second as adhesion receptors. Despite their common functions, these mucins encompass a heterogeneous group of secreted or membrane-associated proteins. Using 2 monoclonal antibodies and a retroviral expression cloning strategy, Zannettino et al. (1998) isolated a cDNA encoding a novel transmembrane isoform of the mucin-like glycoprotein MGC-24, which they designated CD164. The mature CD164 protein contains 178 amino acids, has a molecular mass of 80 to 90 kD, and is extremely rich in serine and threonine. CD164 is expressed by human CD34+ (OMIM Ref. No. 142230) hematopoietic progenitor cells. Zannettino et al. (1998) found that the CD164 receptor appears to play a role in hematopoiesis by facilitating the adhesion of CD34+ cells to bone marrow stroma and by negatively regulating CD34+ hematopoietic progenitor cell growth. They found that these functional effects are mediated by at least 2 spatially distinct epitopes, defined by specific monoclonal antibodies. Watt et al. (1998) showed that these and other CD164 monoclonal antibodies show distinct patterns of reactivity when analyzed on hematopoietic cells from normal human bone marrow, umbilical cord blood, and peripheral blood. Expression of the CD164 epitope was found on developing myelomonocytic cells in bone marrow, being downregulated on mature neutrophils but maintained on monocytes in the peripheral blood. Watt et al. (1998) extended these studies further to identify PAC clones containing the CD164 gene and used the clone to localize the CD164 gene specifically to 6q21 by fluorescence in situ hybridization.

Full details of the abovementioned studies are described in the following publications, the disclosure of which are hereby incorporated by reference:

Watt, S. M.; Buhring, H.-J.; Rappold, I.; Chan, J. Y.-H.; Lee-Prudhoe, J.; Jones, T.; Zannettino, A. C. W.; Simmons, P. J.; Doyonnas, R.; Sheer, D.; Butler, L. H.: CD164, a novel sialomucin on CD34+ and erythroid subsets, is located on human chromosome 6q21. Blood 92:849-866, 1998; and Zannettino, A. C. W.; Buhring, H.-J.; Niutta, S.; Watt, S. M.; Benton, M. A.; Simmons, P. J.: The sialomucin CD164 (MGC-24v) is an adhesive glycoprotein expressed by human hematopoieti.

Further studies establishing the function and utilities of CD164 are found in John Hopkins OMIM database record ID 603356, and in sited publications numbered 1090-1091 listed in the bibliography section hereinbelow, which are also hereby incorporated by reference. PCTAIRE Protein Kinase 1 (PCTK1, Accession NM_033018) is another VGAM75 host target gene. PCTK1 BINDING SITE is HOST TARGET binding site found in the 5' untranslated region of mRNA encoded by PCTK1, corresponding to a HOST TARGET binding site such as BINDING SITE I, BINDING SITE II or BINDING SITE III. Table 2 illustrates the complementarity of the nucleotide sequences of PCTK1 BINDING SITE, designated SEQ ID:26909, to the nucleotide sequence of VGAM75 RNA, herein designated VGAM RNA, also designated SEQ ID:2786.

Another function of VGAM75 is therefore inhibition of PCTAIRE Protein Kinase 1 (PCTK1, Accession NM_033018), a gene which may play a role in signal transduction cascades in terminally differentiated cells. Accordingly, utilities of VGAM75 include diagnosis, prevention and treatment of diseases and clinical conditions associated with PCTK1. The function of PCTK1 has been established by previous studies. The mechanisms that govern the progression through the eukaryotic cell cycle consist of multiple regulatory processes that control discrete transition points, such as the G0/G1 and G1/S transitions and the entry into mitosis. One of the key components regulating the initiation and passage through mitosis is the serine/threonine-specific protein kinase, p34(cdc2/CDC28); see 116953. There exists an extended gene family encoding a large number of different cdc2-related serine/threonine-specific protein kinases. The PCTAIRE protein kinases comprise a distinct subfamily of these kinases and are so named for the presence of a cysteine-for-serine substitution in the conserved PSTAIRE amino acid motif found in prototypic cdc2 kinases. Three members of this kinase subfamily, PCTAIRE 1-3, were identified in human S (Meyerson et al., 1992), whereas only 2 members were identified in mice, PCTAIRE1 and -3 (Okuda et al., 1992). The 3 PCTAIRE kinases are 65% identical to one another (80% within the catalytic domain). PCTAIRE1 is ubiquitously expressed with the highest levels detected in the brain and testis. Human PCTAIRE cDNAs do not complement yeast cdc28 mutants and show other differences, suggesting that PCTAIRE kinases have different cellular functions from those described for CDC2 (OMIM Ref. No. 116940). By screening a human genomic library with murine PCTAIRE cDNA probes, Okuda et al. (1994) isolated human cosmid clones for the PCTK1 and PCTK3 genes. Using these as probes for fluorescence in situ hybridization analyses, they showed that PCTK1 and PCTK3 are located on bands Xp11 and 1q31-q32, respectively. Knight et al. (1995) found that PCTK1 maps distal to the t (X;18) synovial sarcoma breakpoint in Xp11.23. A 420-kb YAC clone positive for PCTK1 also contained the gene coding for ubiquitin-activating enzyme UBE1 (OMIM Ref. No. 314370), previously mapped to Xp11.3.

Full details of the abovementioned studies are described in the following publications, the disclosure of which are hereby incorporated by reference:

Okuda, T.; Cleveland, J. L.; Downing, J. R.: PCTAIRE-1 and PCTAIRE-3, two members of a novel cdc2/CDC28-related protein kinase gene family. Oncogene 7:2249-2258, 1992; and Okuda, T.; Valentine, V. A.; Shapiro, D. N.; Downing, J. R.: Cloning of genomic loci and chromosomal localization of the human PCTAIRE-1 and -3 protein kinase genes. Genomics 21:217-22.

Further studies establishing the function and utilities of PCTK1 are found in John Hopkins OMIM database record ID 311550, and in sited publications numbered 1064 and 3501-3502 listed in the bibliography section hereinbelow, which are also hereby incorporated by reference. Reversion-inducing-cysteine-rich Protein with Kazal Motifs (RECK, Accession NM_021111) is another VGAM75 host target gene. RECK BINDING SITE is HOST TARGET binding site found in the 3' untranslated region of mRNA encoded by RECK, corresponding to a HOST TARGET binding site such as BINDING SITE I, BINDING SITE II or BINDING SITE III. Table 2 illustrates the complementarity of the nucleotide sequences of RECK BINDING SITE, designated SEQ ID:22090, to the nucleotide sequence of VGAM75 RNA, herein designated VGAM RNA, also designated SEQ ID:2786.

Another function of VGAM75 is therefore inhibition of Reversion-inducing-cysteine-rich Protein with Kazal Motifs (RECK, Accession NM_021111), a gene which plays a role in regulation of cancer progression and tumor angiogenesis. Accordingly, utilities of VGAM75 include diagnosis, prevention and treatment of diseases and clinical conditions associated with RECK. The function of RECK has been established by previous studies. Transformed malignant cell lines frequently lose a flat morphology and acquire a round morphology. Genes that induce flat reversion may be useful in the control of cancer. By screening a fibroblast expression library for reversion-inducing cDNAs, Takahashi et al. (1998) isolated a cDNA encoding RECK (reversion-inducing, cysteine-rich protein with Kazal motifs). Sequence analysis predicted that the 971-amino acid RECK protein, which shares 93% amino acid identity with mouse Reck, is 9% cysteine and contains an N-terminal signal sequence; 5 putative cysteine knot motifs; 5 potential N-glycosylation sites; 3 central serine protease inhibitor domains with either complete or incomplete Kazal-type, 4-cys motifs; 2 regions with weak homology to EGF-like repeats; and a C-terminal hydrophobic glycosylphosphatidylinositol-anchoring signal. Immunoblot analysis showed that RECK is expressed as a 110-kD protein that is reduced to approximately 100 kD after deglycosylation. Northern blot analysis detected a 4.6-kb RECK transcript in a wide variety of tissues and normal cell lines, but no expression was detected in tumor cell lines. Restoration of RECK expression in tumor cell lines did not affect growth but did significantly suppress matrix invasion and metastatic activity. SDS-PAGE and gelatin zymography analysis demonstrated that due to a posttranscriptional event (s), secretion of MMP9 (OMIM Ref. No. 120361), a key enzyme in tumor invasion and metastasis, is decreased in cells expressing RECK. An RECK mutant lacking the C-terminal 23 residues retained the ability to suppress tumor cell invasion and MMP9 proteolytic activity but lost the ability to inhibit MMP9 release. Animal model experiments lend further support to the function of RECK. Oh et al. (2001) showed that in addition to MMP9, RECK also regulates MMP2 (OMIM Ref. No. 120360) and MT1-MMP (MMP14; 600754), which are known to be involved in cancer progression. Mice lacking a functional Reck gene died around embryonic day 10.5 with defects in collagen fibrils, the basal lamina, and vascular development; this phenotype could be partially suppressed by Mmp2 null mutation. Vascular sprouting was dramatically suppressed in tumors derived from Reck-expressing fibrosarcoma cells grown in nude mice. These results supported a role for RECK in the regulation of MMP2 in vivo and implicated RECK down regulation in tumor angiogenesis.

It is appreciated that the abovementioned animal model for RECK is acknowledged by those skilled in the art as a scientifically valid animal model, as can be further appreciated from the publications sited hereinbelow.

Full details of the abovementioned studies are described in the following publications, the disclosure of which are hereby incorporated by reference:

Takahashi, C.; Sheng, Z.; Horan, T. P.; Kitayama, H.; Maki, M.; Hitomi, K.; Kitaura, Y.; Takai, S.; Sasahara, R. M.; Horimoto, A.; Ikawa, Y.; Ratzkin, B. J.; Arakawa, T.; Noda, M.: Regulation of matrix metalloproteinase-9 and inhibition of tumor invasion by the membrane-anchored glycoprotein RECK. Proc. Nat. Acad. Sci. 95:13221-13226, 1998; and Oh, J.; Takahashi, R.; Kondo, S.; Mizoguchi, A.; Adachi, E.; Sasahara, R. M.; Nishimura, S.; Imamura, Y.; Kitayama, H.; Alexander, D. B.; Ide, C.; Horan, T. P.; Arakawa, T.; Yoshida, H.

Further studies establishing the function and utilities of RECK are found in John Hopkins OMIM database record ID 605227, and in sited publications numbered 7306-7307 listed in the bibliography section hereinbelow, which are also hereby incorporated by reference. Tryptophan Rich Basic Protein (WRB, Accession NM_004627) is another VGAM75 host target gene. WRB BINDING SITE is HOST TARGET binding site found in the 3' untranslated region of mRNA encoded by WRB, corresponding to a HOST TARGET binding site such as BINDING SITE I, BINDING SITE II or BINDING SITE III. Table 2 illustrates the complementarity of the nucleotide sequences of WRB BINDING SITE, designated SEQ ID:10998, to the nucleotide sequence of VGAM75 RNA, herein designated VGAM RNA, also designated SEQ ID:2786.

Another function of VGAM75 is therefore inhibition of Tryptophan Rich Basic Protein (WRB, Accession NM_004627). Accordingly, utilities of VGAM75 include diagnosis, prevention and treatment of diseases and clinical conditions associated with WRB. ATPase, H+ Transporting, Lysosomal 34 kDa, V1 Subunit D (ATP6V1D, Accession NM_015994) is another VGAM75 host target gene. ATP6V1D BINDING SITE is HOST TARGET binding site found in the 3' untranslated region of mRNA encoded by ATP6V1D, corresponding to a HOST TARGET binding site such as BINDING SITE I, BINDING SITE II or BINDING SITE III. Table 2 illustrates the complementarity of the nucleotide sequences of ATP6V1D BINDING SITE, designated SEQ ID:18087, to the nucleotide sequence of VGAM75 RNA, herein designated VGAM RNA, also designated SEQ ID:2786.

Another function of VGAM75 is therefore inhibition of ATPase, H+ Transporting, Lysosomal 34 kDa, V1 Subunit D (ATP6V1D, Accession NM_015994). Accordingly, utilities of VGAM75 include diagnosis, prevention and treatment of diseases and clinical conditions associated with ATP6V1D. DNAM-1 (Accession NM_006566) is another VGAM75 host target gene. DNAM-1 BINDING SITE is HOST TARGET binding site found in the 3' untranslated region of mRNA encoded by DNAM-1, corresponding to a HOST TARGET binding site such as BINDING SITE I, BINDING SITE II or BINDING SITE III. Table 2 illustrates the complementarity of the nucleotide sequences of DNAM-1 BINDING SITE, designated SEQ ID:13337, to the nucleotide sequence of VGAM75 RNA, herein designated VGAM RNA, also designated SEQ ID:2786.

Another function of VGAM75 is therefore inhibition of DNAM-1 (Accession NM_006566). Accordingly, utilities of VGAM75 include diagnosis, prevention and treatment of diseases and clinical conditions associated with DNAM-1. FLJ20281 (Accession XM_165663) is another VGAM75 host target gene. FLJ20281 BINDING SITE is HOST TARGET binding site found in the 5' untranslated region of mRNA encoded by FLJ20281, corresponding to a HOST TARGET binding site such as BINDING SITE I, BINDING SITE II or BINDING SITE III. Table 2 illustrates the complementarity of the nucleotide sequences of FLJ20281 BINDING SITE, designated SEQ ID:43727, to the nucleotide sequence of VGAM75 RNA, herein designated VGAM RNA, also designated SEQ ID:2786.

Another function of VGAM75 is therefore inhibition of FLJ20281 (Accession XM_165663). Accordingly, utilities of VGAM75 include diagnosis, prevention and treatment of diseases and clinical conditions associated with FLJ20281. Golgi Associated, Gamma Adaptin Ear Containing, ARF Binding Protein 2 (GGA2, Accession NM_138640) is another VGAM75 host target gene. GGA2 BINDING SITE is HOST TARGET binding site found in the 3' untranslated region of mRNA encoded by GGA2, corresponding to a HOST TARGET binding site such as BINDING SITE I, BINDING SITE II or BINDING SITE III. Table 2 illustrates the complementarity of the nucleotide sequences of GGA2 BINDING SITE, designated SEQ ID:28919, to the nucleotide sequence of VGAM75 RNA, herein designated VGAM RNA, also designated SEQ ID:2786.

Another function of VGAM75 is therefore inhibition of Golgi Associated, Gamma Adaptin Ear Containing, ARF Binding Protein 2 (GGA2, Accession NM_138640). Accordingly, utilities of VGAM75 include diagnosis, prevention and treatment of diseases and clinical conditions associated with GGA2. KIAA1388 (Accession XM_168030) is another VGAM75 host target gene. KIAA1388 BINDING SITE is HOST TARGET binding site found in the 5" untranslated region of mRNA encoded by KIAA1388, corresponding to a HOST TARGET binding site such as BINDING SITE I, BINDING SITE II or BINDING SITE III. Table 2 illustrates the complementarity of the nucleotide sequences of KIAA1388 BINDING SITE, designated SEQ ID:44950, to the nucleotide sequence of VGAM75 RNA, herein designated VGAM RNA, also designated SEQ ID:2786.

Another function of VGAM75 is therefore inhibition of KIAA1388 (Accession XM_168030). Accordingly, utilities of VGAM75 include diagnosis, prevention and treatment of diseases and clinical conditions associated with KIAA1388. Protocadherin 20 (PCDH20, Accession NM_022843) is another VGAM75 host target gene. PCDH20 BINDING SITE is HOST TARGET binding site found in the 3' untranslated region of mRNA encoded by PCDH20, corresponding to a HOST TARGET binding site such as BINDING SITE I, BINDING SITE II or BINDING SITE III. Table 2 illustrates the complementarity of the nucleotide sequences of PCDH20 BINDING SITE, designated SEQ ID:23136, to the nucleotide sequence of VGAM75 RNA, herein designated VGAM RNA, also designated SEQ ID:2786.

Another function of VGAM75 is therefore inhibition of Protocadherin 20 (PCDH20, Accession NM_022843). Accordingly, utilities of VGAM75 include diagnosis, prevention and treatment of diseases and clinical conditions associated with PCDH20. Serine/threonine Kinase 38 Like (STK38L, Accession XM_044823) is another VGAM75 host target gene. STK38L BINDING SITE is HOST TARGET binding site found in the 3' untranslated region of mRNA encoded by STK38L, corresponding to a HOST TARGET binding site such as BINDING SITE I, BINDING SITE II or BINDING SITE III. Table 2 illustrates the complementarity of the nucleotide sequences of STK38L BINDING SITE, designated SEQ ID:34294, to the nucleotide sequence of VGAM75 RNA, herein designated VGAM RNA, also designated SEQ ID:2786.

Another function of VGAM75 is therefore inhibition of Serine/threonine Kinase 38 Like (STK38L, Accession XM_044823). Accordingly, utilities of VGAM75 include diagnosis, prevention and treatment of diseases and clinical conditions associated with STK38L. ZER6 (Accession XM_032742) is another VGAM75 host target gene. ZER6 BINDING SITE is HOST TARGET binding site found in the 3' untranslated region of mRNA encoded by ZER6, corresponding to a HOST TARGET binding site such as BINDING SITE I, BINDING SITE II or BINDING SITE III. Table 2 illustrates the complementarity of the nucleotide sequences of ZER6 BINDING SITE, designated SEQ ID:31748, to the nucleotide sequence of VGAM75 RNA, herein designated VGAM RNA, also designated SEQ ID:2786.

Another function of VGAM75 is therefore inhibition of ZER6 (Accession XM_032742). Accordingly, utilities of VGAM75 include diagnosis, prevention and treatment of diseases and clinical conditions associated with ZER6. LOC144893 (Accession XM_096687) is another VGAM75 host target gene. LOC144893 BINDING SITE is HOST TARGET binding site found in the 3' untranslated region of mRNA encoded by LOC144893, corresponding to a HOST TARGET binding site such as BINDING SITE I, BINDING SITE II or BINDING SITE III. Table 2 illustrates the complementarity of the nucleotide sequences of LOC144893 BINDING SITE, designated SEQ ID:40456, to the nucleotide sequence of VGAM75 RNA, herein designated VGAM RNA, also designated SEQ ID:2786.

Another function of VGAM75 is therefore inhibition of LOC144893 (Accession XM_096687). Accordingly, utilities of VGAM75 include diagnosis, prevention and treatment of diseases and clinical conditions associated with LOC144893. LOC146515 (Accession XM_085493) is another VGAM75 host target gene. LOC146515 BINDING SITE is HOST TARGET binding site found in the 3' untranslated region of mRNA encoded by LOC146515, corresponding to a HOST TARGET binding site such as BINDING SITE I, BINDING SITE II or BINDING SITE III. Table 2 illustrates the complementarity of the nucleotide sequences of LOC146515 BINDING SITE, designated SEQ ID:38193, to the nucleotide sequence of VGAM75 RNA, herein designated VGAM RNA, also designated SEQ ID:2786.

Another function of VGAM75 is therefore inhibition of LOC146515 (Accession XM_085493). Accordingly, utilities of VGAM75 include diagnosis, prevention and treatment of diseases and clinical conditions associated with LOC146515. LOC151877 (Accession XM_098132) is another VGAM75 host target gene. LOC151877 BINDING SITE is HOST TARGET binding site found in the 3' untranslated region of mRNA encoded by LOC151877, corresponding to a HOST TARGET binding site such as BINDING SITE I, BINDING SITE II or BINDING SITE III. Table 2 illustrates the complementarity of the nucleotide sequences of LOC151877 BINDING SITE, designated SEQ ID:41395, to the nucleotide sequence of VGAM75 RNA, herein designated VGAM RNA, also designated SEQ ID:2786.

Another function of VGAM75 is therefore inhibition of LOC151877 (Accession XM_098132). Accordingly, utilities of VGAM75 include diagnosis, prevention and treatment of diseases and clinical conditions associated with LOC151877. LOC56899 (Accession NM_020140) is another VGAM75 host target gene. LOC56899 BINDING SITE is HOST TARGET binding site found in the 5' untranslated region of mRNA encoded by LOC56899, corresponding to a HOST TARGET binding site such as BINDING SITE I, BINDING SITE II or BINDING SITE III. Table 2 illustrates the complementarity of the nucleotide sequences of LOC56899 BINDING SITE, designated SEQ ID:21335, to the nucleotide sequence of VGAM75 RNA, herein designated VGAM RNA, also designated SEQ ID:2786.

Another function of VGAM75 is therefore inhibition of LOC56899 (Accession NM_020140). Accordingly, utilities of VGAM75 include diagnosis, prevention and treatment of diseases and clinical conditions associated with LOC56899. LOC90161 (Accession XM_029551) is another VGAM75 host target gene. LOC90161 BINDING SITE is HOST TARGET binding site found in the 3' untranslated region of mRNA encoded by LOC90161, corresponding to a HOST TARGET binding site such as BINDING SITE I, BINDING SITE II or BINDING SITE III. Table 2 illustrates the complementarity of the nucleotide sequences of LOC90161 BINDING SITE, designated SEQ ID:30902, to the nucleotide sequence of VGAM75 RNA, herein designated VGAM RNA, also designated SEQ ID:2786.

Another function of VGAM75 is therefore inhibition of LOC90161 (Accession XM_029551). Accordingly, utilities of VGAM75 include diagnosis, prevention and treatment of diseases and clinical conditions associated with LOC90161. LOC90538 (Accession XM_032401) is another VGAM75 host target gene. LOC90538 BINDING SITE is HOST TARGET binding site found in the 3' untranslated region of mRNA encoded by LOC90538, corresponding to a HOST TARGET binding site such as BINDING SITE I, BINDING SITE II or BINDING SITE III. Table 2 illustrates the complementarity of the nucleotide sequences of LOC90538 BINDING SITE, designated SEQ ID:31655, to the nucleotide sequence of VGAM75 RNA, herein designated VGAM RNA, also designated SEQ ID:2786.

Another function of VGAM75 is therefore inhibition of LOC90538 (Accession XM_032401). Accordingly, utilities of VGAM75 include diagnosis, prevention and treatment of diseases and clinical conditions associated with LOC90538. FIG. 1 further provides a conceptual description of a novel bioinformatically detected viral gene of the present invention, referred to here as Viral Genomic Address Messenger 76 (VGAM76) viral gene, which modulates expression of respective host target genes thereof, the function and utility of which host target genes is known in the art.

VGAM76 is a novel bioinformatically detected regulatory, non protein coding, viral micro RNA (miRNA) gene. The method by which VGAM76 was detected is described hereinabove with reference to FIGS. 1-8.

VGAM76 gene, herein designated VGAM GENE, is a viral gene contained in the genome of Murine Adenovirus A. VGAM76 host target gene, herein designated VGAM HOST TARGET GENE, is a human gene contained in the human genome.

VGAM76 gene encodes a VGAM76 precursor RNA, herein designated VGAM PRECURSOR RNA. Similar to other miRNA genes, and unlike most ordinary genes, VGAM76 precursor RNA does not encode a protein. A nucleotide sequence identical or highly similar to the nucleotide sequence of VGAM76 precursor RNA is designated SEQ ID:62, and is provided hereinbelow with reference to the sequence listing part. Nucleotide sequence SEQ ID:62 is located at position 2296 relative to the genome of Murine Adenovirus A.

VGAM76 precursor RNA folds onto itself, forming VGAM76 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM76 folded precursor RNA into VGAM76 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM76 RNA is designated SEQ ID:2787, and is provided hereinbelow with reference to the sequence listing part.

VGAM76 host target gene, herein designated VGAM HOST TARGET GENE, encodes a corresponding messenger RNA, VGAM76 host target RNA, herein designated VGAM HOST TARGET RNA. VGAM76 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM76 RNA, herein designated VGAM RNA, binds complementarily to one or more host target binding sites located in untranslated regions of VGAM76 host target RNA, herein designated VGAM HOST TARGET RNA. This complementary binding is due to the fact that the nucleotide sequence of VGAM76 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM76 RNA, herein designated VGAM RNA, may have a different number of host target binding sites in untranslated regions of a VGAM76 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM76 RNA, herein designated VGAM RNA, to host target binding sites on VGAM76 host target RNA, herein designated VGAM HOST TARGET RNA, such as BINDING SITE I, BINDING SITE II and BINDING SITE III, inhibits translation of VGAM76 host target RNA into VGAM76 host target protein, herein designated VGAM HOST TARGET PROTEIN. VGAM host target protein is therefore outlined by a broken line.

It is appreciated that VGAM76 host target gene, herein designated VGAM HOST TARGET GENE, in fact represents a plurality of VGAM76 host target genes. The mRNA of each one of this plurality of VGAM76 host target genes comprises one or more host target binding sites, each having a nucleotide sequence which is at least partly complementary to VGAM76 RNA, herein designated VGAM RNA, and which when bound by VGAM76 RNA causes inhibition of translation of respective one or more VGAM76 host target proteins.

It is further appreciated by one skilled in the art that the mode of translational inhibition illustrated by FIG. 1 with specific reference to translational inhibition exerted by VGAM76 gene, herein designated VGAM GENE, on one or more VGAM76 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM76 is inhibition of expression of host target genes, as part of a novel viral mechanism of attacking a host. Accordingly, utilities of VGAM76 include diagnosis, prevention and treatment of viral infection by Murine Adenovirus A. Specific functions, and accordingly utilities, of VGAM76 correlate with, and may be deduced from, the identity of the host target genes which VGAM76 binds and inhibits, and the function of these host target genes, as elaborated hereinbelow.

Nucleotide sequences of the VGAM76 precursor RNA, herein designated VGAM PRECURSOR RNA, and of the 'diced' VGAM76 RNA, herein designated VGAM RNA, and a schematic representation of the secondary folding of VGAM76 folded precursor RNA, herein designated VGAM FOLDED PRECURSOR RNA, of VGAM76 are further described hereinbelow with reference to Table 1.

Nucleotide sequences of host target binding sites, such as BINDING SITE-I, BINDING SITE-II and BINDING SITE-III of FIG. 1, found on VGAM76 host target RNA, and schematic representation of the complementarity of each of these host target binding sites to VGAM76 RNA, herein designated VGAM RNA, are described hereinbelow with reference to Table 2.

As mentioned hereinabove with reference to FIG. 1, a function of VGAM76 gene, herein designated VGAM is inhibition of expression of VGAM76 target genes. It is appreciated that specific functions, and accordingly utilities, of VGAM76 correlate with, and may be deduced from, the identity of the target genes which VGAM76 binds and inhibits, and the function of these target genes, as elaborated hereinbelow.

Inositol 1,4,5-triphosphate Receptor, Type 2 (ITPR2, Accession NM_002223) is a VGAM76 host target gene. ITPR2 BINDING SITE is HOST TARGET binding site found in the 3' untranslated region of mRNA encoded by ITPR2, corresponding to a HOST TARGET binding site such as BINDING SITE I, BINDING SITE II or BINDING SITE III. Table 2 illustrates the complementarity of the nucleotide sequences of ITPR2 BINDING SITE, designated SEQ ID:7989, to the nucleotide sequence of VGAM76 RNA, herein designated VGAM RNA, also designated SEQ ID:2787.

A function of VGAM76 is therefore inhibition of Inositol 1,4,5-triphosphate Receptor, Type 2 (ITPR2, Accession NM_002223). Accordingly, utilities of VGAM76 include diagnosis, prevention and treatment of diseases and clinical conditions associated with ITPR2. TNF Receptor-associated Factor 5 (TRAF5, Accession NM_004619) is another VGAM76 host target gene. TRAF5 BINDING SITE is HOST TARGET binding site found in the 3' untranslated region of mRNA encoded by TRAF5, corresponding to a HOST TARGET binding site such as BINDING SITE I, BINDING SITE II or BINDING SITE III. Table 2 illustrates the complementarity of the nucleotide sequences of TRAF5 BINDING SITE, designated SEQ ID:10964, to the nucleotide sequence of VGAM76 RNA, herein designated VGAM RNA, also designated SEQ ID:2787.

Another function of VGAM76 is therefore inhibition of TNF Receptor-associated Factor 5 (TRAF5, Accession NM_004619), a gene which Member of a family of proteins that interact with TNF receptors; binds the lymphotoxin beta receptor (LTBR). Accordingly, utilities of VGAM76 include diagnosis, prevention and treatment of diseases and clinical conditions associated with TRAF5. The function of TRAF5 has been established by previous studies. Tumor necrosis factor (TNF; 191160) receptor-associated factors (TRAFs) are signal transducers for members of the TNF receptor superfamily (see OMIM Ref. No. 191190). TRAF proteins are composed of an N-terminal cysteine/histidine-rich region containing zinc RING and/or zinc finger motifs, a coiled coil (leucine zipper) motif, and a homologous region in the C terminus that defines the TRAF family, the TRAF domain. The TRAF domain is involved in self-association and receptor binding. By degenerative oligonucleotide PCR amplification, Nakano et al. (1996) identified TRAF5 in the mouse and showed that its specifically interacts with the lymphotoxin-beta receptor (OMIM Ref. No. 600979) and activates the transcription factor NF-kappa-B (see OMIM Ref. No. 164011). Nakano et al. (1997) cloned the human TRAF homolog by cross hybridization with mouse TRAF5 cDNA. Their human cDNA of 2,894 bp has a 557-amino acid open reading frame that exhibits 77.5 and 80% identity to mouse TRAF5 at the nucleotide and amino acid levels, respectively. Northern blot analysis revealed that human TRAF5 mRNA is expressed in all visceral organs. Western blotting revealed that the human protein is abundantly expressed in a human follicular dendritic cell line, and to a lesser degree in several tumor cell lines. By in vitro binding, immunoprecipitation, immunoblot, and yeast 2-hybrid analyses, Aizawa et al. (1997) showed that TRAF2 (OMIM Ref. No. 601895) and TRAF5 interact with overlapping but distinct sequences in the C-terminal region of CD30 (OMIM Ref. No. 153243) and mediate the activation of NFKB. By interspecific backcross mapping, Nakano et al. (1997) showed that Traf5 is located in the distal region of mouse chromosome 1, which shares homology with human 1q. Fluorescence in situ hybridization confirmed the regional localization of human TRAF5 to chromosome 1q32. To investigate the functional role of Traf5 in vivo, Nakano et al. (1999) generated Traf5-deficient mice by gene targeting. They found that Traf5 -/- B lymphocytes show defects in proliferation and upregulation of various surface molecules, including CD23 (OMIM Ref. No. 151445), CD54 (OMIM Ref. No. 147840), CD80 (OMIM Ref. No. 112203), CD86 (OMIM Ref. No. 601020), and FAS (OMIM Ref. No. 134637) in response to CD40 (OMIM Ref. No. 109535) stimulation. Moreover, in vitro Ig production by Traf5 -/- T lymphocytes stimulated with anti-CD40 plus IL4 (OMIM Ref. No. 147780) was reduced substantially. CD27-mediated costimulatory signal also was impaired in Traf5 -/- T lymphocytes. Collectively, these results demonstrated that Traf5 is involved in CD40- and CD27-mediated signaling.

Full details of the abovementioned studies are described in the following publications, the disclosure of which are hereby incorporated by reference:

Nakano, H.; Sakon, S.; Koseki, H.; Takemori, T.; Tada, K.; Matsumoto, M.; Munechika, E.; Sakai, T.; Shirasawa, T.; Akiba, H; Kobata, T.; Santee, S. M.; Ware, C. F.; Renner, P. D.; Taniguchi, M.; Yagita, H.; Okumura, K.: Targeted disruption of Traf5 gene causes defects in CD40- and CD27-mediated lymphocyte activation. Proc. Nat. Acad. Sci. 96:9803-9808, 1999; and Nakano, H.; Shindo, M.; Yamada, K.; Yoshida, M. C.; Santee, S. M.; Ware, C. F.; Jenkins, N. A.; Gilbert, D. J.; Yagita, H.; Copeland, N. G.; Okumura, K.: Human TNF receptor-associated.

Further studies establishing the function and utilities of TRAF5 are found in John Hopkins OMIM database record ID 602356, and in sited publications numbered 11509-9025 listed in the bibliography section hereinbelow, which are also hereby incorporated by reference. FLJ20296 (Accession NM_017750) is another VGAM76 host target gene. FLJ20296 BINDING SITE is HOST TARGET binding site found in the 3' untranslated region of mRNA encoded by FLJ20296, corresponding to a HOST TARGET binding site such as BINDING SITE I, BINDING SITE II or BINDING SITE III. Table 2 illustrates the complementarity of the nucleotide sequences of FLJ20296 BINDING SITE, designated SEQ ID:19356, to the nucleotide sequence of VGAM76

RNA, herein designated VGAM RNA, also designated SEQ ID:2787.

Another function of VGAM76 is therefore inhibition of FLJ20296 (Accession NM_017750). Accordingly, utilities of VGAM76 include diagnosis, prevention and treatment of diseases and clinical conditions associated with FLJ20296. KIAA0574 (Accession XM_045076) is another VGAM76 host target gene. KIAA0574 BINDING SITE is HOST TARGET binding site found in the 3' untranslated region of mRNA encoded by KIAA0574, corresponding to a HOST TARGET binding site such as BINDING SITE I, BINDING SITE II or BINDING SITE III. Table 2 illustrates the complementarity of the nucleotide sequences of KIAA0574 BINDING SITE, designated SEQ ID:34347, to the nucleotide sequence of VGAM76 RNA, herein designated VGAM RNA, also designated SEQ ID:2787.

Another function of VGAM76 is therefore inhibition of KIAA0574 (Accession XM_045076). Accordingly, utilities of VGAM76 include diagnosis, prevention and treatment of diseases and clinical conditions associated with KIAA0574. LOC145719 (Accession XM_096848) is another VGAM76 host target gene. LOC145719 BINDING SITE is HOST TARGET binding site found in the 3' untranslated region of mRNA encoded by LOC145719, corresponding to a HOST TARGET binding site such as BINDING SITE I, BINDING SITE II or BINDING SITE III. Table 2 illustrates the complementarity of the nucleotide sequences of LOC145719 BINDING SITE, designated SEQ ID:40578, to the nucleotide sequence of VGAM76 RNA, herein designated VGAM RNA, also designated SEQ ID:2787.

Another function of VGAM76 is therefore inhibition of LOC145719 (Accession XM_096848). Accordingly, utilities of VGAM76 include diagnosis, prevention and treatment of diseases and clinical conditions associated with LOC145719. LOC145720 (Accession XM_096846) is another VGAM76 host target gene. LOC145720 BINDING SITE is HOST TARGET binding site found in the 3' untranslated region of mRNA encoded by LOC145720, corresponding to a HOST TARGET binding site such as BINDING SITE I, BINDING SITE II or BINDING SITE III. Table 2 illustrates the complementarity of the nucleotide sequences of LOC145720 BINDING SITE, designated SEQ ID:40567, to the nucleotide sequence of VGAM76 RNA, herein designated VGAM RNA, also designated SEQ ID:2787.

Another function of VGAM76 is therefore inhibition of LOC145720 (Accession XM_096846). Accordingly, utilities of VGAM76 include diagnosis, prevention and treatment of diseases and clinical conditions associated with LOC145720. LOC197114 (Accession XM_116987) is another VGAM76 host target gene. LOC197114 BINDING SITE is HOST TARGET binding site found in the 3' untranslated region of mRNA encoded by LOC197114, corresponding to a HOST TARGET binding site such as BINDING SITE I, BINDING SITE II or BINDING SITE III. Table 2 illustrates the complementarity of the nucleotide sequences of LOC197114 BINDING SITE, designated SEQ ID:43190, to the nucleotide sequence of VGAM76 RNA, herein designated VGAM RNA, also designated SEQ ID:2787.

Another function of VGAM76 is therefore inhibition of LOC197114 (Accession XM_116987). Accordingly, utilities of VGAM76 include diagnosis, prevention and treatment of diseases and clinical conditions associated with LOC197114. LOC197117 (Accession XM_116989) is another VGAM76 host target gene. LOC197117 BINDING SITE is HOST TARGET binding site found in the 3' untranslated region of mRNA encoded by LOC197117, corresponding to a HOST TARGET binding site such as BINDING SITE I, BINDING SITE II or BINDING SITE III. Table 2 illustrates the complementarity of the nucleotide sequences of LOC197117 BINDING SITE, designated SEQ ID:43197, to the nucleotide sequence of VGAM76 RNA, herein designated VGAM RNA, also designated SEQ ID:2787.

Another function of VGAM76 is therefore inhibition of LOC197117 (Accession XM_116989). Accordingly, utilities of VGAM76 include diagnosis, prevention and treatment of diseases and clinical conditions associated with LOC197117. FIG. 1 further provides a conceptual description of a novel bioinformatically detected viral gene of the present invention, referred to here as Viral Genomic Address Messenger 77 (VGAM77) viral gene, which modulates expression of respective host target genes thereof, the function and utility of which host target genes is known in the art.

VGAM77 is a novel bioinformatically detected regulatory, non protein coding, viral micro RNA (miRNA) gene. The method by which VGAM77 was detected is described hereinabove with reference to FIGS. 1-8.

VGAM77 gene, herein designated VGAM GENE, is a viral gene contained in the genome of Murine Adenovirus A. VGAM77 host target gene, herein designated VGAM HOST TARGET GENE, is a human gene contained in the human genome.

VGAM77 gene encodes a VGAM77 precursor RNA, herein designated VGAM PRECURSOR RNA. Similar to other miRNA genes, and unlike most ordinary genes, VGAM77 precursor RNA does not encode a protein. A nucleotide sequence identical or highly similar to the nucleotide sequence of VGAM77 precursor RNA is designated SEQ ID:63, and is provided hereinbelow with reference to the sequence listing part. Nucleotide sequence SEQ ID:63 is located at position 1609 relative to the genome of Murine Adenovirus A.

VGAM77 precursor RNA folds onto itself, forming VGAM77 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM77 folded precursor RNA into VGAM77 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM77 RNA is designated SEQ ID:2788, and is provided hereinbelow with reference to the sequence listing part.

VGAM77 host target gene, herein designated VGAM HOST TARGET GENE, encodes a corresponding messenger RNA, VGAM77 host target RNA, herein designated VGAM HOST TARGET RNA. VGAM77 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM77 RNA, herein designated VGAM RNA, binds complementarily to one or more host target binding sites located in untranslated regions of VGAM77 host target RNA, herein designated VGAM HOST TARGET RNA. This complementary binding is due to the fact that the nucleotide sequence of VGAM77 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM77 RNA, herein designated VGAM RNA, may have a different number of host target binding sites in untranslated regions of a VGAM77 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM77 RNA, herein designated VGAM RNA, to host target binding sites on VGAM77 host target RNA, herein designated VGAM HOST TARGET RNA, such as BINDING SITE I, BINDING SITE II and BINDING SITE III, inhibits translation of VGAM77 host target RNA into VGAM77 host target protein, herein designated VGAM HOST TARGET PROTEIN. VGAM host target protein is therefore outlined by a broken line.

It is appreciated that VGAM77 host target gene, herein designated VGAM HOST TARGET GENE, in fact represents a plurality of VGAM77 host target genes. The mRNA of each one of this plurality of VGAM77 host target genes comprises one or more host target binding sites, each having a nucleotide sequence which is at least partly complementary to VGAM77 RNA, herein designated VGAM RNA, and which when bound by VGAM77 RNA causes inhibition of translation of respective one or more VGAM77 host target proteins.

It is further appreciated by one skilled in the art that the mode of translational inhibition illustrated by FIG. 1 with specific reference to translational inhibition exerted by VGAM77 gene, herein designated VGAM GENE, on one or more VGAM77 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM77 is inhibition of expression of host target genes, as part of a novel viral mechanism of attacking a host. Accordingly, utilities of VGAM77 include diagnosis, prevention and treatment of viral infection by Murine Adenovirus A. Specific functions, and accordingly utilities, of VGAM77 correlate with, and may be deduced from, the identity of the host target genes which VGAM77 binds and inhibits, and the function of these host target genes, as elaborated hereinbelow.

Nucleotide sequences of the VGAM77 precursor RNA, herein designated VGAM PRECURSOR RNA, and of the 'diced' VGAM77 RNA, herein designated VGAM RNA, and a schematic representation of the secondary folding of VGAM77 folded precursor RNA, herein designated VGAM FOLDED PRECURSOR RNA, of VGAM77 are further described hereinbelow with reference to Table 1.

Nucleotide sequences of host target binding sites, such as BINDING SITE-I, BINDING SITE-II and BINDING SITE-III of FIG. 1, found on VGAM77 host target RNA, and schematic representation of the complementarity of each of these host target binding sites to VGAM77 RNA, herein designated VGAM RNA, are described hereinbelow with reference to Table 2.

As mentioned hereinabove with reference to FIG. 1, a function of VGAM77 gene, herein designated VGAM is inhibition of expression of VGAM77 target genes. It is appreciated that specific functions, and accordingly utilities, of VGAM77 correlate with, and may be deduced from, the identity of the target genes which VGAM77 binds and inhibits, and the function of these target genes, as elaborated hereinbelow.

Polymerase (DNA directed), Epsilon 3 (p17 subunit) (POLE3, Accession NM_017443) is a VGAM77 host target gene. POLE3 BINDING SITE is HOST TARGET binding site found in the 3' untranslated region of mRNA encoded by POLE3, corresponding to a HOST TARGET binding site such as BINDING SITE I, BINDING SITE II or BINDING SITE III. Table 2 illustrates the complementarity of the nucleotide sequences of POLE3 BINDING SITE, designated SEQ ID:18900, to the nucleotide sequence of VGAM77 RNA, herein designated VGAM RNA, also designated SEQ ID:2788.

A function of VGAM77 is therefore inhibition of Polymerase (DNA directed), Epsilon 3 (p17 subunit) (POLE3, Accession NM_017443). Accordingly, utilities of VGAM77 include diagnosis, prevention and treatment of diseases and clinical conditions associated with POLE3. Solute Carrier Family 5 (choline transporter), Member 7 (SLC5A7, Accession NM_021815) is another VGAM77 host target gene. SLC5A7 BINDING SITE is HOST TARGET binding site found in the 3' untranslated region of mRNA encoded by SLC5A7, corresponding to a HOST TARGET binding site such as BINDING SITE I, BINDING SITE II or BINDING SITE III. Table 2 illustrates the complementarity of the nucleotide sequences of SLC5A7 BINDING SITE, designated SEQ ID:22390, to the nucleotide sequence of VGAM77 RNA, herein designated VGAM RNA, also designated SEQ ID:2788.

Another function of VGAM77 is therefore inhibition of Solute Carrier Family 5 (choline transporter), Member 7 (SLC5A7, Accession NM_021815). Accordingly, utilities of VGAM77 include diagnosis, prevention and treatment of diseases and clinical conditions associated with SLC5A7. LOC120939 (Accession XM_073688) is another VGAM77 host target gene. LOC120939 BINDING SITE is HOST TARGET binding site found in the 3' untranslated region of mRNA encoded by LOC120939, corresponding to a HOST TARGET binding site such as BINDING SITE I, BINDING SITE II or BINDING SITE III. Table 2 illustrates the complementarity of the nucleotide sequences of LOC120939 BINDING SITE, designated SEQ ID:37511, to the nucleotide sequence of VGAM77 RNA, herein designated VGAM RNA, also designated SEQ ID:2788.

Another function of VGAM77 is therefore inhibition of LOC120939 (Accession XM_073688). Accordingly, utilities of VGAM77 include diagnosis, prevention and treatment of diseases and clinical conditions associated with LOC120939. FIG. 1 further provides a conceptual description of a novel bioinformatically detected viral gene of the present invention, referred to here as Viral Genomic Address Messenger 78 (VGAM78) viral gene, which modulates expression of respective host target genes thereof, the function and utility of which host target genes is known in the art.

VGAM78 is a novel bioinformatically detected regulatory, non protein coding, viral micro RNA (miRNA) gene. The method by which VGAM78 was detected is described hereinabove with reference to FIGS. 1-8.

VGAM78 gene, herein designated VGAM GENE, is a viral gene contained in the genome of Plutella Xylostella Granulovirus. VGAM78 host target gene, herein designated VGAM HOST TARGET GENE, is a human gene contained in the human genome.

VGAM78 gene encodes a VGAM78 precursor RNA, herein designated VGAM PRECURSOR RNA. Similar to other miRNA genes, and unlike most ordinary genes, VGAM78 precursor RNA does not encode a protein. A nucleotide sequence identical or highly similar to the nucleotide sequence of VGAM78 precursor RNA is designated SEQ ID:64, and is provided hereinbelow with reference to the sequence listing part. Nucleotide sequence SEQ ID:64 is located at position 14370 relative to the genome of Plutella Xylostella Granulovirus.

VGAM78 precursor RNA folds onto itself, forming VGAM78 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM78 folded precursor RNA into VGAM78 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM78 RNA is designated SEQ ID:2789, and is provided hereinbelow with reference to the sequence listing part.

VGAM78 host target gene, herein designated VGAM HOST TARGET GENE, encodes a corresponding messenger RNA, VGAM78 host target RNA, herein designated VGAM HOST TARGET RNA. VGAM78 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM78 RNA, herein designated VGAM RNA, binds complementarily to one or more host target binding sites located in untranslated regions of VGAM78 host target RNA, herein designated VGAM HOST TARGET RNA. This complementary binding is due to the fact that the nucleotide sequence of VGAM78 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM78 RNA, herein designated VGAM RNA, may have a different number of host target binding sites in untranslated regions of a VGAM78 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM78 RNA, herein designated VGAM RNA, to host target binding sites on VGAM78 host target RNA, herein designated VGAM HOST TARGET RNA, such as BINDING SITE I, BINDING SITE II and BINDING SITE III, inhibits translation of VGAM78 host target RNA into VGAM78 host target protein, herein designated VGAM HOST TARGET PROTEIN. VGAM host target protein is therefore outlined by a broken line.

It is appreciated that VGAM78 host target gene, herein designated VGAM HOST TARGET GENE, in fact represents a plurality of VGAM78 host target genes. The mRNA of each one of this plurality of VGAM78 host target genes comprises one or more host target binding sites, each having a nucleotide sequence which is at least partly complementary to VGAM78 RNA, herein designated VGAM RNA, and which when bound by VGAM78 RNA causes inhibition of translation of respective one or more VGAM78 host target proteins.

It is further appreciated by one skilled in the art that the mode of translational inhibition illustrated by FIG. 1 with specific reference to translational inhibition exerted by VGAM78 gene, herein designated VGAM GENE, on one or more VGAM78 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM78 is inhibition of expression of host target genes, as part of a novel viral mechanism of attacking a host. Accordingly, utilities of VGAM78 include diagnosis, prevention and treatment of viral infection by Plutella Xylostella Granulovirus. Specific functions, and accordingly utilities, of VGAM78 correlate with, and may be deduced from, the identity of the host target genes which VGAM78 binds and inhibits, and the function of these host target genes, as elaborated hereinbelow.

Nucleotide sequences of the VGAM78 precursor RNA, herein designated VGAM PRECURSOR RNA, and of the 'diced' VGAM78 RNA, herein designated VGAM RNA, and a schematic representation of the secondary folding of VGAM78 folded precursor RNA, herein designated VGAM FOLDED PRECURSOR RNA, of VGAM78 are further described hereinbelow with reference to Table 1.

Nucleotide sequences of host target binding sites, such as BINDING SITE-I, BINDING SITE-II and BINDING SITE-III of FIG. 1, found on VGAM78 host target RNA, and schematic representation of the complementarity of each of these host target binding sites to VGAM78 RNA, herein designated VGAM RNA, are described hereinbelow with reference to Table 2.

As mentioned hereinabove with reference to FIG. 1, a function of VGAM78 gene, herein designated VGAM is inhibition of expression of VGAM78 target genes. It is appreciated that specific functions, and accordingly utilities, of VGAM78 correlate with, and may be deduced from, the identity of the target genes which VGAM78 binds and inhibits, and the function of these target genes, as elaborated hereinbelow.

C1D (Accession NM_006333) is a VGAM78 host target gene. C1D BINDING SITE is HOST TARGET binding site found in the 3' untranslated region of mRNA encoded by C1D, corresponding to a HOST TARGET binding site such as BINDING SITE I, BINDING SITE II or BINDING SITE III.

Table 2 illustrates the complementarity of the nucleotide sequences of C1D BINDING SITE, designated SEQ ID:13032, to the nucleotide sequence of VGAM78 RNA, herein designated VGAM RNA, also designated SEQ ID:2789.

A function of VGAM78 is therefore inhibition of C1D (Accession NM_006333), a gene which is similar to murine C1D and may be a component of nuclear hormone receptor complexes. Accordingly, utilities of VGAM78 include diagnosis, prevention and treatment of diseases and clinical conditions associated with C1D. The function of C1D has been established by previous studies. Using RevErb (see OMIM Ref. No. 602408) as bait in a yeast 2-hybrid screen to identify nuclear hormone receptor corepressors, Zamir et al. (1997) cloned mouse C1d, which they called Sun-Cor, from a 17-day mouse embryo library. Sun-Cor encodes a highly basic 141-amino acid protein with a molecular mass of 16 kD. Northern blot analysis revealed expression of a 1.2-kb transcript in all 9 mouse tissues tested. Immunolocalization of Sun-Cor within transfected human kidney cells revealed a nuclear distribution. Zamir et al. (1997) determined that Sun-Cor potentiates transcriptional repression by thyroid hormone receptor and RevErb in vivo, represses transcription when fused to a heterologous DNA-binding domain, and interacts with RevErb as well as with the thyroid hormone receptor in vitro. Sun-Cor also interacts with N-Cor (OMIM Ref. No. 600849) and Smrt (OMIM Ref. No. 500848) in vitro and with endogenous N-Cor in cultured cells. Zamir et al. (1997) also determined that Sun-Cor message and protein levels increase with differentiation of preadipocytes and myocytes in culture. Through mutation analysis, transfection, and expression of truncated message, they mapped the repression domain to the N-terminus. By cotransfection of RevErb and Sun-Cor followed by immunoprecipitation, direct interaction between these proteins was established. Similarly, they established direct interaction between Sun-Cor and N-Cor.

Full details of the abovementioned studies are described in the following publications, the disclosure of which are hereby incorporated by reference:

Zamir, I.; Dawson, J.; Lavinsky, R. M.; Glass, C. K.; Rosenfeld, M. G.; Lazar, M. A.: Cloning and characterization of a corepressor and potential component of the nuclear hormone receptor repression complex. Proc. Nat. Acad. Sci. 94:14400-14405, 1997; and Nehls, P.; Keck, T.; Greferath, R.; Spiess, E.; Glaser, T.; Rothbarth, K.; Stammer, H.; Werner, D.: cDNA cloning, recombinant expression and characterization of polypeptides with except.

Further studies establishing the function and utilities of C1D are found in John Hopkins OMIM database record ID 606997, and in sited publications numbered 5161-5164 listed in the bibliography section hereinbelow, which are also hereby incorporated by reference. Chromosome 20 Open Reading Frame 142 (C20orf142, Accession XM_059257) is another VGAM78 host target gene. C20orf142 BINDING SITE is HOST TARGET binding site found in the 3' untranslated region of mRNA encoded by C20orf142, corresponding to a HOST TARGET binding site such as BINDING SITE I, BINDING SITE II or BINDING SITE III. Table 2 illustrates the complementarity of the nucleotide sequences of C20orf142 BINDING SITE, designated SEQ ID:36932, to the nucleotide sequence of VGAM78 RNA, herein designated VGAM RNA, also designated SEQ ID:2789.

Another function of VGAM78 is therefore inhibition of Chromosome 20 Open Reading Frame 142 (C20orf142, Accession XM_059257). Accordingly, utilities of VGAM78 include diagnosis, prevention and treatment of diseases and clinical conditions associated with C20orf142. RI58 (Accession NM_012420) is another VGAM78 host target gene. RI58 BINDING SITE is HOST TARGET binding site found in the 3' untranslated region of mRNA encoded by RI58, corresponding to a HOST TARGET binding site such as BINDING SITE I, BINDING SITE II or BINDING SITE III. Table 2 illustrates the complementarity of the nucleotide sequences of RI58 BINDING SITE, designated SEQ ID:14797, to the nucleotide sequence of VGAM78 RNA, herein designated VGAM RNA, also designated SEQ ID:2789.

Another function of VGAM78 is therefore inhibition of RI58 (Accession NM_012420). Accordingly, utilities of VGAM78 include diagnosis, prevention and treatment of diseases and clinical conditions associated with RI58. Trinucleotide Repeat Containing 9 (TNRC9, Accession XM_049037) is another VGAM78 host target gene. TNRC9 BINDING SITE is HOST TARGET binding site found in the 3' untranslated region of mRNA encoded by TNRC9, corresponding to a HOST TARGET binding site such as BINDING SITE I, BINDING SITE II or BINDING SITE III. Table 2 illustrates the complementarity of the nucleotide sequences of TNRC9 BINDING SITE, designated SEQ ID:35322, to the nucleotide sequence of VGAM78 RNA, herein designated VGAM RNA, also designated SEQ ID:2789.

Another function of VGAM78 is therefore inhibition of Trinucleotide Repeat Containing 9 (TNRC9, Accession XM_049037). Accordingly, utilities of VGAM78 include diagnosis, prevention and treatment of diseases and clinical conditions associated with TNRC9. LOC135293 (Accession XM_072402) is another VGAM78 host target gene. LOC135293 BINDING SITE is HOST TARGET binding site found in the 3' untranslated region of mRNA encoded by LOC135293, corresponding to a HOST TARGET binding site such as BINDING SITE I, BINDING SITE II or BINDING SITE III. Table 2 illustrates the complementarity of the nucleotide sequences of LOC135293 BINDING SITE, designated SEQ ID:37494, to the nucleotide sequence of VGAM78 RNA, herein designated VGAM RNA, also designated SEQ ID:2789.

Another function of VGAM78 is therefore inhibition of LOC135293 (Accession XM_072402). Accordingly, utilities of VGAM78 include diagnosis, prevention and treatment of diseases and clinical conditions associated with LOC135293. FIG. 1 further provides a conceptual description of a novel bioinformatically detected viral gene of the present invention, referred to here as Viral Genomic Address Messenger 79 (VGAM79) viral gene, which modulates expression of respective host target genes thereof, the function and utility of which host target genes is known in the art.

VGAM79 is a novel bioinformatically detected regulatory, non protein coding, viral micro RNA (miRNA) gene. The method by which VGAM79 was detected is described hereinabove with reference to FIGS. 1-8.

VGAM79 gene, herein designated VGAM GENE, is a viral gene contained in the genome of Plutella Xylostella Granulovirus. VGAM79 host target gene, herein designated VGAM HOST TARGET GENE, is a human gene contained in the human genome.

VGAM79 gene encodes a VGAM79 precursor RNA, herein designated VGAM PRECURSOR RNA. Similar to other miRNA genes, and unlike most ordinary genes, VGAM79 precursor RNA does not encode a protein. A nucleotide sequence identical or highly similar to the nucleotide sequence of VGAM79 precursor RNA is designated SEQ ID:65, and is provided hereinbelow with reference to the sequence listing part. Nucleotide sequence SEQ ID:65 is located at position 44246 relative to the genome of Plutella Xylostella Granulovirus.

VGAM79 precursor RNA folds onto itself, forming VGAM79 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM79 folded precursor RNA into VGAM79 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM79 RNA is designated SEQ ID:2790, and is provided hereinbelow with reference to the sequence listing part.

VGAM79 host target gene, herein designated VGAM HOST TARGET GENE, encodes a corresponding messenger RNA, VGAM79 host target RNA, herein designated VGAM HOST TARGET RNA. VGAM79 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM79 RNA, herein designated VGAM RNA, binds complementarily to one or more host target binding sites located in untranslated regions of VGAM79 host target RNA, herein designated VGAM HOST TARGET RNA. This complementary binding is due to the fact that the nucleotide sequence of VGAM79 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM79 RNA, herein designated VGAM RNA, may have a different number of host target binding sites in untranslated regions of a VGAM79 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM79 RNA, herein designated VGAM RNA, to host target binding sites on VGAM79 host target RNA, herein designated VGAM HOST TARGET RNA, such as BINDING SITE I, BINDING SITE II and BINDING SITE III, inhibits translation of VGAM79 host target RNA into VGAM79 host target protein, herein designated VGAM HOST TARGET PROTEIN. VGAM host target protein is therefore outlined by a broken line.

It is appreciated that VGAM79 host target gene, herein designated VGAM HOST TARGET GENE, in fact represents a plurality of VGAM79 host target genes. The mRNA of each one of this plurality of VGAM79 host target genes comprises one or more host target binding sites, each having a nucleotide sequence which is at least partly complementary to VGAM79 RNA, herein designated VGAM RNA, and which when bound by VGAM79 RNA causes inhibition of translation of respective one or more VGAM79 host target proteins.

It is further appreciated by one skilled in the art that the mode of translational inhibition illustrated by FIG. 1 with specific reference to translational inhibition exerted by VGAM79 gene, herein designated VGAM GENE, on one or more VGAM79 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM79 is inhibition of expression of host target genes, as part of a novel viral mechanism of attacking a host. Accordingly, utilities of VGAM79 include diagnosis, prevention and treatment of viral infection by Plutella Xylostella Granulovirus. Specific functions, and accordingly utilities, of VGAM79 correlate with, and may be deduced from, the identity of the host target genes which VGAM79 binds and inhibits, and the function of these host target genes, as elaborated hereinbelow.

Nucleotide sequences of the VGAM79 precursor RNA, herein designated VGAM PRECURSOR RNA, and of the 'diced' VGAM79 RNA, herein designated VGAM RNA, and a schematic representation of the secondary folding of VGAM79 folded precursor RNA, herein designated VGAM FOLDED PRECURSOR RNA, of VGAM79 are further described hereinbelow with reference to Table 1.

Nucleotide sequences of host target binding sites, such as BINDING SITE-I, BINDING SITE-II and BINDING SITE-III of FIG. 1, found on VGAM79 host target RNA, and schematic representation of the complementarity of each of these host target binding sites to VGAM79 RNA, herein designated VGAM RNA, are described hereinbelow with reference to Table 2.

As mentioned hereinabove with reference to FIG. 1, a function of VGAM79 gene, herein designated VGAM is inhibition of expression of VGAM79 target genes. It is appreciated that specific functions, and accordingly utilities, of VGAM79 correlate with, and may be deduced from, the identity of the target genes which VGAM79 binds and inhibits, and the function of these target genes, as elaborated hereinbelow.

FLJ20208 (Accession NM_017712) is a VGAM79 host target gene. FLJ20208 BINDING SITE is HOST TARGET binding site found in the 3' untranslated region of mRNA encoded by FLJ20208, corresponding to a HOST TARGET binding site such as BINDING SITE I, BINDING SITE II or BINDING SITE III. Table 2 illustrates the complementarity of the nucleotide sequences of FLJ20208 BINDING SITE, designated SEQ ID:19293, to the nucleotide sequence of VGAM79 RNA, herein designated VGAM RNA, also designated SEQ ID:2790.

A function of VGAM79 is therefore inhibition of FLJ20208 (Accession NM_017712). Accordingly, utilities of VGAM79 include diagnosis, prevention and treatment of diseases and clinical conditions associated with FLJ20208. FIG. 1 further provides a conceptual description of a novel bioinformatically detected viral gene of the present invention, referred to here as Viral Genomic Address Messenger 80 (VGAM80) viral gene, which modulates expression of respective host target genes thereof, the function and utility of which host target genes is known in the art.

VGAM80 is a novel bioinformatically detected regulatory, non protein coding, viral micro RNA (miRNA) gene. The method by which VGAM80 was detected is described hereinabove with reference to FIGS. 1-8.

VGAM80 gene, herein designated VGAM GENE, is a viral gene contained in the genome of Plutella Xylostella Granulovirus. VGAM80 host target gene, herein designated VGAM HOST TARGET GENE, is a human gene contained in the human genome.

VGAM80 gene encodes a VGAM80 precursor RNA, herein designated VGAM PRECURSOR RNA. Similar to other miRNA genes, and unlike most ordinary genes, VGAM80 precursor RNA does not encode a protein. A nucleotide sequence identical or highly similar to the nucleotide sequence of VGAM80 precursor RNA is designated SEQ ID:66, and is provided hereinbelow with reference to the sequence listing part. Nucleotide sequence SEQ ID:66 is located at position 88821 relative to the genome of Plutella Xylostella Granulovirus.

VGAM80 precursor RNA folds onto itself, forming VGAM80 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM80 folded precursor RNA into VGAM80 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM80 RNA is designated SEQ ID:2791, and is provided hereinbelow with reference to the sequence listing part.

VGAM80 host target gene, herein designated VGAM HOST TARGET GENE, encodes a corresponding messenger RNA, VGAM80 host target RNA, herein designated VGAM HOST TARGET RNA. VGAM80 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM80 RNA, herein designated VGAM RNA, binds complementarily to one or more host target binding sites located in untranslated regions of VGAM80 host target RNA, herein designated VGAM HOST TARGET RNA. This complementary binding is due to the fact that the nucleotide sequence of VGAM80 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM80 RNA, herein designated VGAM RNA, may have a different number of host target binding sites in untranslated regions of a VGAM80 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM80 RNA, herein designated VGAM RNA, to host target binding sites on VGAM80 host target RNA, herein designated VGAM HOST TARGET RNA, such as BINDING SITE I, BINDING SITE II and BINDING SITE III, inhibits translation of VGAM80 host target RNA into VGAM80 host target protein, herein designated VGAM HOST TARGET PROTEIN. VGAM host target protein is therefore outlined by a broken line.

It is appreciated that VGAM80 host target gene, herein designated VGAM HOST TARGET GENE, in fact represents a plurality of VGAM80 host target genes. The mRNA of each one of this plurality of VGAM80 host target genes comprises one or more host target binding sites, each having a nucleotide sequence which is at least partly complementary to VGAM80 RNA, herein designated VGAM RNA, and which when bound by VGAM80 RNA causes inhibition of translation of respective one or more VGAM80 host target proteins.

It is further appreciated by one skilled in the art that the mode of translational inhibition illustrated by FIG. 1 with specific reference to translational inhibition exerted by VGAM80 gene, herein designated VGAM GENE, on one or more VGAM80 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM80 is inhibition of expression of host target genes, as part of a novel viral mechanism of attacking a host. Accordingly, utilities of VGAM80 include diagnosis, prevention and treatment of viral infection by Plutella Xylostella Granulovirus. Specific functions, and accordingly utilities, of VGAM80 correlate with, and may be deduced from, the identity of the host target genes which VGAM80 binds and inhibits, and the function of these host target genes, as elaborated hereinbelow.

Nucleotide sequences of the VGAM80 precursor RNA, herein designated VGAM PRECURSOR RNA, and of the 'diced' VGAM80 RNA, herein designated VGAM RNA, and a schematic representation of the secondary folding of VGAM80 folded precursor RNA, herein designated VGAM FOLDED PRECURSOR RNA, of VGAM80 are further described hereinbelow with reference to Table 1.

Nucleotide sequences of host target binding sites, such as BINDING SITE-I, BINDING SITE-II and BINDING SITE-III of FIG. 1, found on VGAM80 host target RNA, and schematic representation of the complementarity of each of these host target binding sites to VGAM80 RNA, herein designated VGAM RNA, are described hereinbelow with reference to Table 2.

As mentioned hereinabove with reference to FIG. 1, a function of VGAM80 gene, herein designated VGAM is inhibition of expression of VGAM80 target genes. It is appreciated that specific functions, and accordingly utilities, of VGAM80 correlate with, and may be deduced from, the identity of the target genes which VGAM80 binds and inhibits, and the function of these target genes, as elaborated hereinbelow.

Latent Transforming Growth Factor Beta Binding Protein 1 (LTBP1, Accession NM_000627) is a VGAM80 host target gene. LTBP1 BINDING SITE is HOST TARGET binding site found in the 3' untranslated region of mRNA encoded by LTBP1, corresponding to a HOST TARGET binding site such as BINDING SITE I, BINDING SITE II or BINDING SITE III. Table 2 illustrates the complementarity of the nucleotide sequences of LTBP1 BINDING SITE, designated SEQ ID:6242, to the nucleotide sequence of VGAM80 RNA, herein designated VGAM RNA, also designated SEQ ID:2791.

A function of VGAM80 is therefore inhibition of Latent Transforming Growth Factor Beta Binding Protein 1 (LTBP1, Accession NM_000627), a gene which is involved in assembly and secretion of latent TGF-beta. Accordingly, utilities of VGAM80 include diagnosis, prevention and treatment of diseases and clinical conditions associated with LTBP1. The function of LTBP1 has been established by previous studies. Transforming growth factor beta molecules (e.g., TGFB1; 190180) are synthesized and secreted as latent, inactive complexes. In platelets, the latent form of human TGFB1 includes 3 components: TGFB1, the N-terminal peptide of the TGFB1 precursor, and a novel protein called the latent TGFB1-binding protein (LTBP1 Using a cDNA clone for LTBP1, Stenman et al. (1994) assigned the gene to chromosome 2 by study of a panel of well-defined human/rodent somatic cell hybrid lines and further localized the gene to 2p12-q22 by study of 3 hybrid lines containing partially overlapping fragments of chromosome 2.

Full details of the abovementioned studies are described in the following publications, the disclosure of which are hereby incorporated by reference:

Oklu, R.; Hesketh, R.: The latent transforming growth factor beta binding protein (LTBP) family. Biochem. J. 352: 601-610, 2000; and Stenman, G.; Sahlin, P.; Olofsson, A.; Geurts van Kessel, A.; Miyazono, K.: Assignment of the gene encoding the latent TGF-beta-1-binding protein (LTBP1) to human chromosome 2, region p12.

Further studies establishing the function and utilities of LTBP1 are found in John Hopkins OMIM database record ID 150390, and in sited publications numbered 12463-12465 listed in the bibliography section hereinbelow, which are also hereby incorporated by reference. Prolactin Receptor (PRLR, Accession NM_000949) is another VGAM80 host target gene. PRLR BINDING SITE is HOST TARGET binding site found in the 5' untranslated region of mRNA encoded by PRLR, corresponding to a HOST TARGET binding site such as BINDING SITE I, BINDING SITE II or BINDING SITE III. Table 2 illustrates the complementarity of the nucleotide sequences of PRLR BINDING SITE, designated SEQ ID:6649, to the nucleotide sequence of VGAM80 RNA, herein designated VGAM RNA, also designated SEQ ID:2791.

Another function of VGAM80 is therefore inhibition of Prolactin Receptor (PRLR, Accession NM_000949), a gene which is a receptor for the anterior pituitary hormone prolactin. Accordingly, utilities of VGAM80 include diagnosis, prevention and treatment of diseases and clinical conditions associated with PRLR. The function of PRLR has been established by previous studies. Owerbach et al. (1981) did Southern blot analyses of DNA from human-mouse cell hybrids to show that the prolactin gene is located on chromosome 6 (Owerbach et al., 1981). It bears homology to the genes for growth hormone (OMIM Ref. No. 139250) and chorionic somatomammotropin (OMIM Ref. No. 150200), which are on chromosome 17, but not as close homology as these two bear to each other (Cooke et al., 1981). Only 16% sequence homology of the growth hormone and prolactin gene has been found (Shome and Parlow, 1977). The regional assignment of prolactin is of interest because of possible association between prolactin-secreting adenomas and specific HLA alleles (Farid et al., 1980). Larrea et al. (1987) presented the results of family studies suggesting that there is a familial factor determining the occurrence of the 'big-big' form as the predominant immunoreactive PRL species in blood. By somatic cell hybridization, Taggart et al. (1987) narrowed the assignment of the PRL gene to 6pter-p21.1. Evans et al. (1988, 1989) mapped the prolactin gene in a series of overlapping deletions of chromosome 6 produced by gamma-irradiation of a human lymphoblastoid cell line followed by selection for HLA antigen-loss mutants As pointed out by DiMattia (1998), the PRL gene possesses alternative tissue-specific promoters that are located 5,563 basepairs apart. The 5-prime promoter is specific for expression of prolactin in the decidualized human endometrium and in lymphoblastoid cells such as the human cell line IM-9-P3; the downstream promoter is specific for expression in the pituitary lactotrope and is under the control of the POU-homeodomain transcription factor PIT1 (OMIM Ref. No. 173110). Transcriptional control of the nonpituitary start site is linked to the differentiation of the endometrial stromal cell into the decidual cell during the secretory phase of the ovulatory cycle (DiMattia et al., 1990, Gellersen et al., 1994). By deletion analysis of the human PRL promoter in endometrial stromal cells decidualized in vitro, Watanabe et al. (2001) demonstrated a 536-bp enhancer located between nucleotides -2040 and -1505 in the 5-prime-flanking region. DNase I footprint analysis of decidualized endometrial stromal cells revealed 3 protected regions, FP1-FP3. Transfection of overlapping 100-bp fragments of the 536-bp enhancer indicated that FP1 and FP3 each conferred enhancer activity. Gel shift assays indicated that both FP1 and FP3 bind AP1 (OMIM Ref. No. 165160), and that JUND (OMIM Ref. No. 165162) and FOSL2 (OMIM Ref. No. 601575) are components of the AP1 complex in decidual fibroblasts. Mutation of the AP1 binding site in either FP1 or FP3 decreased enhancer activity by approximately 50%, while mutation of both sites almost completely abolished activity Full details of the abovementioned studies are described in the following publications, the disclosure of which are hereby incorporated by reference:

Watanabe, K.; Kessler, C. A.; Bachurski, C. J.; Kanda, Y.; Richardson, B. D.; Stanek, J.; Handwerger, S.; Brar, A. K.: Identification of a decidua-specific enhancer on the human prolactin gene with two critical activator protein 1 (AP-1) binding sites. Molec. Endocr. 15:638-653, 2001; and DiMattia, G. E.; Gellersen, B.; Duckworth, M. L.; Friesen, H. G.: Human prolactin gene expression: the use of an alternative noncoding exon in decidua and the IM-9-P3 lymphoblast cell.

Further studies establishing the function and utilities of PRLR are found in John Hopkins OMIM database record ID 176761, and in sited publications numbered 9717-9724 listed in the bibliography section hereinbelow, which are also hereby incorporated by reference. Dedicator of Cyto-kinesis 3 (DOCK3, Accession XM_039259) is another VGAM80 host target gene. DOCK3 BINDING SITE is HOST TARGET binding site found in the 3' untranslated region of mRNA encoded by DOCK3, corresponding to a HOST TARGET binding site such as BINDING SITE I, BINDING SITE II or BINDING SITE III. Table 2 illustrates the complementarity of the nucleotide sequences of DOCK3 BINDING SITE, designated SEQ ID:33033, to the nucleotide sequence of VGAM80 RNA, herein designated VGAM RNA, also designated SEQ ID:2791.

Another function of VGAM80 is therefore inhibition of Dedicator of Cyto-kinesis 3 (DOCK3, Accession XM_039259). Accordingly, utilities of VGAM80 include diagnosis, prevention and treatment of diseases and clinical conditions associated with DOCK3. KIAA1483 (Accession XM_045920) is another VGAM80 host target gene. KIAA1483 BINDING SITE is HOST TARGET binding site found in the 3' untranslated region of mRNA encoded by KIAA1483, corresponding to a HOST TARGET binding site such as BINDING SITE I, BINDING SITE II or BINDING SITE III. Table 2 illustrates the complementarity of the nucleotide sequences of KIAA1483 BINDING SITE, designated SEQ ID:34615, to the nucleotide sequence of VGAM80 RNA, herein designated VGAM RNA, also designated SEQ ID:2791.

Another function of VGAM80 is therefore inhibition of KIAA1483 (Accession XM_045920). Accordingly, utilities of VGAM80 include diagnosis, prevention and treatment of diseases and clinical conditions associated with KIAA1483. SARM (Accession NM_015077) is another VGAM80 host target gene. SARM BINDING SITE is HOST TARGET binding site found in the 3" untranslated region of mRNA encoded by SARM, corresponding to a HOST TARGET binding site such as BINDING SITE I, BINDING SITE II or BINDING SITE III. Table 2 illustrates the complementarity of the nucleotide sequences of SARM BINDING SITE, designated SEQ ID:17457, to the nucleotide sequence of VGAM80 RNA, herein designated VGAM RNA, also designated SEQ ID:2791.

Another function of VGAM80 is therefore inhibition of SARM (Accession NM_015077). Accordingly, utilities of VGAM80 include diagnosis, prevention and treatment of diseases and clinical conditions associated with SARM. WD Repeat Domain 7 (WDR7, Accession NM_015285) is another VGAM80 host target gene. WDR7 BINDING SITE is HOST TARGET binding site found in the 3' untranslated region of mRNA encoded by WDR7, corresponding to a HOST TARGET binding site such as BINDING SITE I, BINDING SITE II or BINDING SITE III. Table 2 illustrates the complementarity of the nucleotide sequences of WDR7 BINDING SITE, designated SEQ ID:17609, to the nucleotide sequence of VGAM80 RNA, herein designated VGAM RNA, also designated SEQ ID:2791.

Another function of VGAM80 is therefore inhibition of WD Repeat Domain 7 (WDR7, Accession NM_015285). Accordingly, utilities of VGAM80 include diagnosis, prevention and treatment of diseases and clinical conditions associated with WDR7. FIG. 1 further provides a conceptual description of a novel bioinformatically detected viral gene of the present invention, referred to here as Viral Genomic Address Messenger 81 (VGAM81) viral gene, which modulates expression of respective host target genes thereof, the function and utility of which host target genes is known in the art.

VGAM81 is a novel bioinformatically detected regulatory, non protein coding, viral micro RNA (miRNA) gene. The method by which VGAM81 was detected is described hereinabove with reference to FIGS. 1-8.

VGAM81 gene, herein designated VGAM GENE, is a viral gene contained in the genome of Plutella Xylostella Granulovirus. VGAM81 host target gene, herein designated VGAM HOST TARGET GENE, is a human gene contained in the human genome.

VGAM81 gene encodes a VGAM81 precursor RNA, herein designated VGAM PRECURSOR RNA. Similar to other miRNA genes, and unlike most ordinary genes, VGAM81 precursor RNA does not encode a protein. A nucleotide sequence identical or highly similar to the nucleotide sequence of VGAM81 precursor RNA is designated SEQ ID:67, and is provided hereinbelow with reference to the sequence listing part. Nucleotide sequence SEQ ID:67 is located at position 95845 relative to the genome of Plutella Xylostella Granulovirus.

VGAM81 precursor RNA folds onto itself, forming VGAM81 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM81 folded precursor RNA into VGAM81 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM81 RNA is designated SEQ ID:2792, and is provided hereinbelow with reference to the sequence listing part.

VGAM81 host target gene, herein designated VGAM HOST TARGET GENE, encodes a corresponding messenger RNA, VGAM81 host target RNA, herein designated VGAM HOST TARGET RNA. VGAM81 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM81 RNA, herein designated VGAM RNA, binds complementarily to one or more host target binding sites located in untranslated regions of VGAM81 host target RNA, herein designated VGAM HOST TARGET RNA. This complementary binding is due to the fact that the nucleotide sequence of VGAM81 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM81 RNA, herein designated VGAM RNA, may have a different number of host target binding sites in untranslated regions of a VGAM81 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM81 RNA, herein designated VGAM RNA, to host target binding sites on VGAM81 host target RNA, herein designated VGAM HOST TARGET RNA, such as BINDING SITE I, BINDING SITE II and BINDING SITE III, inhibits translation of VGAM81 host target RNA into VGAM81 host target protein, herein designated VGAM HOST TARGET PROTEIN. VGAM host target protein is therefore outlined by a broken line.

It is appreciated that VGAM81 host target gene, herein designated VGAM HOST TARGET GENE, in fact represents a plurality of VGAM81 host target genes. The mRNA of each one of this plurality of VGAM81 host target genes comprises one or more host target binding sites, each having a nucleotide sequence which is at least partly complementary to VGAM81 RNA, herein designated VGAM RNA, and which when bound by VGAM81 RNA causes inhibition of translation of respective one or more VGAM81 host target proteins.

It is further appreciated by one skilled in the art that the mode of translational inhibition illustrated by FIG. 1 with specific reference to translational inhibition exerted by VGAM81 gene, herein designated VGAM GENE, on one or more VGAM81 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM81 is inhibition of expression of host target genes, as part of a novel viral mechanism of attacking a host. Accordingly, utilities of VGAM81 include diagnosis, prevention and treatment of viral infection by Plutella Xylostella Granulovirus. Specific functions, and accordingly utilities, of VGAM81 correlate with, and may be deduced from, the identity of the host target genes which VGAM81 binds and inhibits, and the function of these host target genes, as elaborated hereinbelow.

Nucleotide sequences of the VGAM81 precursor RNA, herein designated VGAM PRECURSOR RNA, and of the 'diced' VGAM81 RNA, herein designated VGAM RNA, and a schematic representation of the secondary folding of VGAM81 folded precursor RNA, herein designated VGAM FOLDED PRECURSOR RNA, of VGAM81 are further described hereinbelow with reference to Table 1.

Nucleotide sequences of host target binding sites, such as BINDING SITE-I, BINDING SITE-II and BINDING SITE-III of FIG. 1, found on VGAM81 host target RNA, and schematic representation of the complementarity of each of these host target binding sites to VGAM81 RNA, herein designated VGAM RNA, are described hereinbelow with reference to Table 2.

As mentioned hereinabove with reference to FIG. 1, a function of VGAM81 gene, herein designated VGAM is inhibition of expression of VGAM81 target genes. It is appreciated that specific functions, and accordingly utilities, of VGAM81 correlate with, and may be deduced from, the identity of the target genes which VGAM81 binds and inhibits, and the function of these target genes, as elaborated hereinbelow.

A Disintegrin and Metalloproteinase Domain 22 (ADAM22, Accession NM_021722) is a VGAM81 host target gene. ADAM22 BINDING SITE1 and ADAM22 BINDING SITE2 are HOST TARGET binding sites found in untranslated regions of mRNA encoded by ADAM22, corresponding to HOST TARGET binding sites such as BINDING SITE I, BINDING SITE II or BINDING SITE III. Table 2 illustrates the complementarity of the nucleotide sequences of ADAM22 BINDING SITE1 and ADAM22 BINDING SITE2, designated SEQ ID:22324 and SEQ ID:22326 respectively, to the nucleotide sequence of VGAM81 RNA, herein designated VGAM RNA, also designated SEQ ID:2792.

A function of VGAM81 is therefore inhibition of A Disintegrin and Metalloproteinase Domain 22 (ADAM22, Accession NM_021722), a gene which Member of ADAM family of zinc metalloproteases. Accordingly, utilities of VGAM81 include diagnosis, prevention and treatment of diseases and clinical conditions associated with ADAM22. The function of ADAM22 has been established by previous studies. The cellular disintegrins, also known as ADAM (a disintegrin and metalloproteinase) and MDC (metalloproteinase-like, disintegrin-like, and cysteine-rich) proteins, are potential regulators of cell-cell and cell-matrix interactions. They contain multiple regions, including pro-, metalloproteinase-like, disintegrin-like, cysteine-rich, epidermal growth factor-like, transmembrane, and cytoplasmic domains. By radiation hybrid analysis, Poindexter et al. (1999) mapped the ADAM22 gene to chromosome 7q21.

Full details of the abovementioned studies are described in the following publications, the disclosure of which are hereby incorporated by reference:

Poindexter, K.; Nelson, N.; DuBose, R. F.; Black, R. A.; Cerretti, D. P.: The identification of seven metalloproteinase-disintegrin (ADAM) genes from genomic libraries. Gene 237:61-70, 1999; and Sagane, K.; Ohya, Y.; Hasegawa, Y.; Tanaka, I.: Metalloproteinase-like, disintegrin-like, cysteine-rich proteins MDC2 and MDC3: novel human cellular disintegrins highly expressed in t.

Further studies establishing the function and utilities of ADAM22 are found in John Hopkins OMIM database record ID 603709, and in sited publications numbered 528 and 11444 listed in the bibliography section hereinbelow, which are also hereby incorporated by reference. KIAA0650 (Accession XM_113962) is another VGAM81 host target gene. KIAA0650 BINDING SITE is HOST TARGET binding site found in the 3' untranslated region of mRNA encoded by KIAA0650, corresponding to a HOST TARGET binding site such as BINDING SITE I, BINDING SITE II or BINDING SITE III. Table 2 illustrates the complementarity of the nucleotide sequences of KIAA0650 BINDING SITE, designated SEQ ID:42572, to the nucleotide sequence of VGAM81 RNA, herein designated VGAM RNA, also designated SEQ ID:2792.

Another function of VGAM81 is therefore inhibition of KIAA0650 (Accession XM_113962). Accordingly, utilities of VGAM81 include diagnosis, prevention and treatment of diseases and clinical conditions associated with KIAA0650. KIAA1155 (Accession XM_030864) is another VGAM81 host target gene. KIAA1155 BINDING SITE is HOST TARGET binding site found in the 3' untranslated region of mRNA encoded by KIAA1155, corresponding to a HOST TARGET binding site such as BINDING SITE I, BINDING SITE II or BINDING SITE III. Table 2 illustrates the complementarity of the nucleotide sequences of KIAA1155 BINDING SITE, designated SEQ ID:31194, to the nucleotide sequence of VGAM81 RNA, herein designated VGAM RNA, also designated SEQ ID:2792.

Another function of VGAM81 is therefore inhibition of KIAA1155 (Accession XM_030864). Accordingly, utilities of VGAM81 include diagnosis, prevention and treatment of diseases and clinical conditions associated with KIAA1155. NXP-2 (Accession XM_048706) is another VGAM81 host target gene. NXP-2 BINDING SITE is HOST TARGET binding site found in the 3' untranslated region of mRNA encoded by NXP-2, corresponding to a HOST TARGET binding site such as BINDING SITE I, BINDING SITE II or BINDING SITE III. Table 2 illustrates the complementarity of the nucleotide sequences of NXP-2 BINDING SITE, designated SEQ ID:35229, to the nucleotide sequence of VGAM81 RNA, herein designated VGAM RNA, also designated SEQ ID:2792.

Another function of VGAM81 is therefore inhibition of NXP-2 (Accession XM_048706). Accordingly, utilities of VGAM81 include diagnosis, prevention and treatment of diseases and clinical conditions associated with NXP-2. SBBI31 (Accession NM_014035) is another VGAM81 host target gene. SBBI31 BINDING SITE is HOST TARGET binding site found in the 3' untranslated region of mRNA encoded by SBBI31, corresponding to a HOST TARGET binding site such as BINDING SITE I, BINDING SITE II or BINDING SITE III. Table 2 illustrates the complementarity of the nucleotide sequences of SBBI31 BINDING SITE, designated SEQ ID:15265, to the nucleotide sequence of VGAM81 RNA, herein designated VGAM RNA, also designated SEQ ID:2792.

Another function of VGAM81 is therefore inhibition of SBBI31 (Accession NM_014035). Accordingly, utilities of VGAM81 include diagnosis, prevention and treatment of diseases and clinical conditions associated with SBBI31. LOC151248 (Accession XM_087143) is another VGAM81 host target gene. LOC151248 BINDING SITE is HOST TARGET binding site found in the 5' untranslated region of mRNA encoded by LOC151248, corresponding to a HOST TARGET binding site such as BINDING SITE I, BINDING SITE II or BINDING SITE III. Table 2 illustrates the complementarity of the nucleotide sequences of LOC151248 BINDING SITE, designated SEQ ID:39085, to the nucleotide sequence of VGAM81 RNA, herein designated VGAM RNA, also designated SEQ ID:2792.

Another function of VGAM81 is therefore inhibition of LOC151248 (Accession XM_087143). Accordingly, utilities of VGAM81 include diagnosis, prevention and treatment of diseases and clinical conditions associated with LOC151248.

FIG. 1 further provides a conceptual description of a novel bioinformatically detected viral gene of the present invention, referred to here as Viral Genomic Address Messenger 82 (VGAM82) viral gene, which modulates expression of respective host target genes thereof, the function and utility of which host target genes is known in the art.

VGAM82 is a novel bioinformatically detected regulatory, non protein coding, viral micro RNA (miRNA) gene. The method by which VGAM82 was detected is described hereinabove with reference to FIGS. 1-8.

VGAM82 gene, herein designated VGAM GENE, is a viral gene contained in the genome of Plutella Xylostella Granulovirus. VGAM82 host target gene, herein designated VGAM HOST TARGET GENE, is a human gene contained in the human genome.

VGAM82 gene encodes a VGAM82 precursor RNA, herein designated VGAM PRECURSOR RNA. Similar to other miRNA genes, and unlike most ordinary genes, VGAM82 precursor RNA does not encode a protein. A nucleotide sequence identical or highly similar to the nucleotide sequence of VGAM82 precursor RNA is designated SEQ ID:68, and is provided hereinbelow with reference to the sequence listing part. Nucleotide sequence SEQ ID:68 is located at position 37903 relative to the genome of Plutella Xylostella Granulovirus.

VGAM82 precursor RNA folds onto itself, forming VGAM82 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM82 folded precursor RNA into VGAM82 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM82 RNA is designated SEQ ID:2793, and is provided hereinbelow with reference to the sequence listing part.

VGAM82 host target gene, herein designated VGAM HOST TARGET GENE, encodes a corresponding messenger RNA, VGAM82 host target RNA, herein designated VGAM HOST TARGET RNA. VGAM82 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM82 RNA, herein designated VGAM RNA, binds complementarily to one or more host target binding sites located in untranslated regions of VGAM82 host target RNA, herein designated VGAM HOST TARGET RNA. This complementary binding is due to the fact that the nucleotide sequence of VGAM82 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM82 RNA, herein designated VGAM RNA, may have a different number of host target binding sites in untranslated regions of a VGAM82 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM82 RNA, herein designated VGAM RNA, to host target binding sites on VGAM82 host target RNA, herein designated VGAM HOST TARGET RNA, such as BINDING SITE I, BINDING SITE II and BINDING SITE III, inhibits translation of VGAM82 host target RNA into VGAM82 host target protein, herein designated VGAM HOST TARGET PROTEIN. VGAM host target protein is therefore outlined by a broken line.

It is appreciated that VGAM82 host target gene, herein designated VGAM HOST TARGET GENE, in fact represents a plurality of VGAM82 host target genes. The mRNA of each one of this plurality of VGAM82 host target genes comprises one or more host target binding sites, each having a nucleotide sequence which is at least partly complementary to VGAM82 RNA, herein designated VGAM RNA, and which when bound by VGAM82 RNA causes inhibition of translation of respective one or more VGAM82 host target proteins.

It is further appreciated by one skilled in the art that the mode of translational inhibition illustrated by FIG. 1 with specific reference to translational inhibition exerted by VGAM82 gene, herein designated VGAM GENE, on one or more VGAM82 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM82 is inhibition of expression of host target genes, as part of a novel viral mechanism of attacking a host. Accordingly, utilities of VGAM82 include diagnosis, prevention and treatment of viral infection by Plutella Xylostella Granulovirus. Specific functions, and accordingly utilities, of VGAM82 correlate with, and may be deduced from, the identity of the host target genes which VGAM82 binds and inhibits, and the function of these host target genes, as elaborated hereinbelow.

Nucleotide sequences of the VGAM82 precursor RNA, herein designated VGAM PRECURSOR RNA, and of the 'diced' VGAM82 RNA, herein designated VGAM RNA, and a schematic representation of the secondary folding of VGAM82 folded precursor RNA, herein designated VGAM FOLDED PRECURSOR RNA, of VGAM82 are further described hereinbelow with reference to Table 1.

Nucleotide sequences of host target binding sites, such as BINDING SITE-I, BINDING SITE-II and BINDING SITE-III of FIG. 1, found on VGAM82 host target RNA, and schematic representation of the complementarity of each of these host target binding sites to VGAM82 RNA, herein designated VGAM RNA, are described hereinbelow with reference to Table 2.

As mentioned hereinabove with reference to FIG. 1, a function of VGAM82 gene, herein designated VGAM is inhibition of expression of VGAM82 target genes. It is appreciated that specific functions, and accordingly utilities, of VGAM82 correlate with, and may be deduced from, the identity of the target genes which VGAM82 binds and inhibits, and the function of these target genes, as elaborated hereinbelow.

LOC145761 (Accession XM_096855) is a VGAM82 host target gene. LOC145761 BINDING SITE is HOST TARGET binding site found in the 5' untranslated region of mRNA encoded by LOC145761, corresponding to a HOST TARGET binding site such as BINDING SITE I, BINDING SITE II or BINDING SITE III. Table 2 illustrates the complementarity of the nucleotide sequences of LOC145761 BINDING SITE, designated SEQ ID:40581, to the nucleotide sequence of VGAM82 RNA, herein designated VGAM RNA, also designated SEQ ID:2793.

A function of VGAM82 is therefore inhibition of LOC145761 (Accession XM_096855). Accordingly, utilities of VGAM82 include diagnosis, prevention and treatment of diseases and clinical conditions associated with LOC145761. FIG. 1 further provides a conceptual description of a novel bioinformatically detected viral gene of the present invention, referred to here as Viral Genomic Address Messenger 83 (VGAM83) viral gene, which modulates expression of respective host target genes thereof, the function and utility of which host target genes is known in the art.

VGAM83 is a novel bioinformatically detected regulatory, non protein coding, viral micro RNA (miRNA) gene. The method by which VGAM83 was detected is described hereinabove with reference to FIGS. 1-8.

VGAM83 gene, herein designated VGAM GENE, is a viral gene contained in the genome of Plutella Xylostella Granulovirus. VGAM83 host target gene, herein designated VGAM HOST TARGET GENE, is a human gene contained in the human genome.

VGAM83 gene encodes a VGAM83 precursor RNA, herein designated VGAM PRECURSOR RNA. Similar to other miRNA genes, and unlike most ordinary genes, VGAM83 precursor RNA does not encode a protein. A nucleotide sequence identical or highly similar to the nucleotide sequence of VGAM83 precursor RNA is designated SEQ ID:69, and is provided hereinbelow with reference to the sequence listing part. Nucleotide sequence SEQ ID:69 is located at position 58052 relative to the genome of Plutella Xylostella Granulovirus.

VGAM83 precursor RNA folds onto itself, forming VGAM83 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM83 folded precursor RNA into VGAM83 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM83 RNA is designated SEQ ID:2794, and is provided hereinbelow with reference to the sequence listing part.

VGAM83 host target gene, herein designated VGAM HOST TARGET GENE, encodes a corresponding messenger RNA, VGAM83 host target RNA, herein designated VGAM HOST TARGET RNA. VGAM83 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM83 RNA, herein designated VGAM RNA, binds complementarily to one or more host target binding sites located in untranslated regions of VGAM83 host target RNA, herein designated VGAM HOST TARGET RNA. This complementary binding is due to the fact that the nucleotide sequence of VGAM83 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM83 RNA, herein designated VGAM RNA, may have a different number of host target binding sites in untranslated regions of a VGAM83 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM83 RNA, herein designated VGAM RNA, to host target binding sites on VGAM83 host target RNA, herein designated VGAM HOST TARGET RNA, such as BINDING SITE I, BINDING SITE II and BINDING SITE III, inhibits translation of VGAM83 host target RNA into VGAM83 host target protein, herein designated VGAM HOST TARGET PROTEIN. VGAM host target protein is therefore outlined by a broken line.

It is appreciated that VGAM83 host target gene, herein designated VGAM HOST TARGET GENE, in fact represents a plurality of VGAM83 host target genes. The mRNA of each one of this plurality of VGAM83 host target genes comprises one or more host target binding sites, each having a nucleotide sequence which is at least partly complementary to VGAM83 RNA, herein designated VGAM RNA, and which when bound by VGAM83 RNA causes inhibition of translation of respective one or more VGAM83 host target proteins.

It is further appreciated by one skilled in the art that the mode of translational inhibition illustrated by FIG. 1 with specific reference to translational inhibition exerted by VGAM83 gene, herein designated VGAM GENE, on one or more VGAM83 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM83 is inhibition of expression of host target genes, as part of a novel viral mechanism of attacking a host. Accordingly, utilities of VGAM83 include diagnosis, prevention and treatment of viral infection by Plutella Xylostella Granulovirus. Specific functions, and accordingly utilities, of VGAM83 correlate with, and may be deduced from, the identity of the host target genes which VGAM83 binds and inhibits, and the function of these host target genes, as elaborated hereinbelow.

Nucleotide sequences of the VGAM83 precursor RNA, herein designated VGAM PRECURSOR RNA, and of the 'diced' VGAM83 RNA, herein designated VGAM RNA, and a schematic representation of the secondary folding of VGAM83 folded precursor RNA, herein designated VGAM FOLDED PRECURSOR RNA, of VGAM83 are further described hereinbelow with reference to Table 1.

Nucleotide sequences of host target binding sites, such as BINDING SITE-I, BINDING SITE-II and BINDING SITE-III of FIG. 1, found on VGAM83 host target RNA, and schematic representation of the complementarity of each of these host target binding sites to VGAM83 RNA, herein designated VGAM RNA, are described hereinbelow with reference to Table 2.

As mentioned hereinabove with reference to FIG. 1, a function of VGAM83 gene, herein designated VGAM is inhibition of expression of VGAM83 target genes. It is appreciated that specific functions, and accordingly utilities, of VGAM83 correlate with, and may be deduced from, the identity of the target genes which VGAM83 binds and inhibits, and the function of these target genes, as elaborated hereinbelow.

Aminopeptidase Puromycin Sensitive (NPEPPS, Accession NM_006310) is a VGAM83 host target gene. NPEPPS BINDING SITE is HOST TARGET binding site found in the 3' untranslated region of mRNA encoded by NPEPPS, corresponding to a HOST TARGET binding site such as BINDING SITE I, BINDING SITE II or BINDING SITE III. Table 2 illustrates the complementarity of the nucleotide sequences of NPEPPS BINDING SITE, designated SEQ ID:12995, to the nucleotide sequence of VGAM83 RNA, herein designated VGAM RNA, also designated SEQ ID:2794.

A function of VGAM83 is therefore inhibition of Aminopeptidase Puromycin Sensitive (NPEPPS, Accession NM_006310), a gene which is puromycin-sensitive aminopeptidase and has metallopeptidase activity. Accordingly, utilities of VGAM83 include diagnosis, prevention and treatment of diseases and clinical conditions associated with NPEPPS. The function of NPEPPS has been established by previous studies. Tobler et al. (1997) cloned PSA from a human fetal brain cDNA library using the mouse PSA cDNA as probe. They established that translation is initiated at the second of 2 possible start codons, resulting in a deduced 875-amino acid protein with a molecular mass of 99 kD by SDS-PAGE. PSA contains a zinc-binding motif conserved among gluzincin aminopeptidases and shares 98% sequence identity with the mouse protein. Northern blot analysis detected ubiquitous expression of a 4.8-kb transcript, with highest expression in brain. By in situ hybridization of adult human brain sections, expression was localized to the perikaryon of neurons of the cortex and cerebellum. Using immunofluorescence localization of transfected HeLa cells, Tobler et al. (1997) found that PSA localizes to the perinuclear cytoplasm and shows a filamentous staining pattern. Bauer et al. (2001) cloned PSA cDNA from a human skeletal muscle library. Northern blot analysis detected major and minor transcripts of 4.8 and 4.2 kb, respectively. Huber et al. (1999) determined that PSA is identical to the matalloprotease MP100 that was originally isolated as a beta-secretase candidate from human brain by Schonlein et al. (1994). Huber et al. (1999) were able to colocalize and coimmunoprecipitate PSA with beta-amyloid precursor protein (OMIM Ref. No. 104760); however, PSA did not increase production of the amyloid-beta peptide in cotransfected cells. By RT-PCR, but not by Northern blot analysis, Bauer et al. (2001) found that PSA was upregulated in human leukemic cells following vitamin D stimulation.

Full details of the abovementioned studies are described in the following publications, the disclosure of which are hereby incorporated by reference:

Huber, G.; Thompson, A.; Gruninger, F.; Mechler, H.; Hochstrasser, R.; Hauri, H.-P.; Malherbe, P.: cDNA cloning and molecular characterization of human brain metalloprotease MP100: a beta-secretase candidate? J. Neurochem. 72:1215-1223, 1999; and Tobler, A. R.; Constam, D. B.; Schmitt-Graff, A.; Malipiero, U.; Schlapbach, R.; Fontana, A.: Cloning of the human puromycin-sensitive aminopeptidase and evidence for expression in neu.

Further studies establishing the function and utilities of NPEPPS are found in John Hopkins OMIM database record ID 606793, and in sited publications numbered 5485-5490 listed in the bibliography section hereinbelow, which are also hereby incorporated by reference. Protein Kinase (cAMP-dependent, catalytic) Inhibitor Alpha (PKIA, Accession NM_006823) is another VGAM83 host target gene. PKIA BINDING SITE is HOST TARGET binding site found in the 3' untranslated region of mRNA encoded by PKIA, corresponding to a HOST TARGET binding site such as BINDING SITE I, BINDING SITE II or BINDING SITE III. Table 2 illustrates the complementarity of the nucleotide sequences of PKIA BINDING SITE, designated SEQ ID:13697, to the nucleotide sequence of VGAM83 RNA, herein designated VGAM RNA, also designated SEQ ID:2794.

Another function of VGAM83 is therefore inhibition of Protein Kinase (cAMP-dependent, catalytic) Inhibitor Alpha (PKIA, Accession NM_006823). Accordingly, utilities of VGAM83 include diagnosis, prevention and treatment of diseases and clinical conditions associated with PKIA. Solute Carrier Family 21 (prostaglandin transporter), Member 2 (SLC21A2, Accession NM_005630) is another VGAM83 host target gene. SLC21A2 BINDING SITE is HOST TARGET binding site found in the 3' untranslated region of mRNA encoded by SLC21A2, corresponding to a HOST TARGET binding site such as BINDING SITE I, BINDING SITE II or BINDING SITE III. Table 2 illustrates the complementarity of the nucleotide sequences of SLC21A2 BINDING SITE, designated SEQ ID:12155, to the nucleotide sequence of VGAM83 RNA, herein designated VGAM RNA, also designated SEQ ID:2794.

Another function of VGAM83 is therefore inhibition of Solute Carrier Family 21 (prostaglandin transporter), Member 2 (SLC21A2, Accession NM_005630), a gene which is a Prostaglandin transporter. Accordingly, utilities of VGAM83 include diagnosis, prevention and treatment of diseases and clinical conditions associated with SLC21A2. The function of SLC21A2 has been established by previous studies. At physiologic pH, prostaglandins (PGs) traverse biologic membranes poorly. Accordingly, PG transport is carrier-mediated in many tissues, including the lung, choroid plexus, liver, anterior chamber of the eye, vagina and uterus, and placenta. Kanai et al. (1995) cloned the rat prostaglandin transporter (symbolized PGT by them) and postulated 3 possible roles for the transporter. First, PGT might mediate the efflux of newly synthesized PGs from cells. Second, PGT might mediate epithelial PG transport. A third possible role of PGT is that of mediating PG clearance and degradation. Lu et al. (1996) favored the clearance role for PGT. Using a rat PGT probe on Northern blots of human kidney mRNA, they found evidence for the presence of a human PGT homolog. They screened a human kidney cDNA library and isolated human PGT. The gene encodes a 643-amino acid polypeptide with 82% identity to the rat protein. They expressed a full-length human cDNA clone in cultured cells and reported that both rat and human PGT transport PGD2, as well as PGE1, PGE2, and PGF2a. Although human PGT has cDNA and deduced amino acid sequences similar to those of the rat, the tissue distribution of mRNA transcripts is substantially broader in human. Additionally, the diversity of human PGT transcripts is greater and the affinity for thromboxane-2 is greater. Lu et al. (1996) found strong PGT mRNA expression in the human fetus. By PCR-based monochromosomal somatic cell hybrid mapping and fluorescence in situ hybridization, Lu and Schuster (1998) mapped the PGT gene to 3q21.

Full details of the abovementioned studies are described in the following publications, the disclosure of which are hereby incorporated by reference:

Kanai, N.; Lu, R.; Satriano, J. A.; Bao, Y.; Wolkoff, A. W.; Schuster, V. L.: Identification and characterization of a prostaglandin transporter. Science 268:866-869, 1995; and Lu, R.; Kanai, N.; Bao, Y.; Schuster, V. L.: Cloning, in vitro expression, and tissue distribution of a human prostaglandin transporter cDNA (hPGT). J. Clin. Invest. 98:1142-1149, 1996.

Further studies establishing the function and utilities of SLC21A2 are found in John Hopkins OMIM database record ID 601460, and in sited publications numbered 2867-2869 listed in the bibliography section hereinbelow, which are also hereby incorporated by reference. DKFZp547M072 (Accession XM_028067) is another VGAM83 host target gene. DKFZp547M072 BINDING SITE is HOST TARGET binding site found in the 3' untranslated region of mRNA encoded by DKFZp547M072, corresponding to a HOST TARGET binding site such as BINDING SITE I, BINDING SITE II or BINDING SITE III. Table 2 illustrates the complementarity of the nucleotide sequences of DKFZp547M072 BINDING SITE, designated SEQ ID:30613, to the nucleotide sequence of VGAM83 RNA, herein designated VGAM RNA, also designated SEQ ID:2794.

Another function of VGAM83 is therefore inhibition of DKFZp547M072 (Accession XM_028067). Accordingly, utilities of VGAM83 include diagnosis, prevention and treatment of diseases and clinical conditions associated with DKFZp547M072. FLJ10761 (Accession NM_018208) is another VGAM83 host target gene. FLJ10761 BINDING SITE is HOST TARGET binding site found in the 3' untranslated region of mRNA encoded by FLJ10761, corresponding to a HOST TARGET binding site such as BINDING SITE I, BINDING SITE II or BINDING SITE III. Table 2 illustrates the complementarity of the nucleotide sequences of FLJ10761 BINDING SITE, designated SEQ ID:20104, to the nucleotide sequence of VGAM83 RNA, herein designated VGAM RNA, also designated SEQ ID:2794.

Another function of VGAM83 is therefore inhibition of FLJ10761 (Accession NM_018208). Accordingly, utilities of VGAM83 include diagnosis, prevention and treatment of diseases and clinical conditions associated with FLJ10761. P17.3 (Accession NM_019056) is another VGAM83 host target gene. P17.3 BINDING SITE is HOST TARGET binding site found in the 5' untranslated region of mRNA encoded by P17.3, corresponding to a HOST TARGET binding site such as BINDING SITE I, BINDING SITE II or BINDING SITE III. Table 2 illustrates the complementarity of the nucleotide sequences of P17.3 BINDING SITE, designated SEQ ID:21137, to the nucleotide sequence of VGAM83 RNA, herein designated VGAM RNA, also designated SEQ ID:2794.

Another function of VGAM83 is therefore inhibition of P17.3 (Accession NM_019056). Accordingly, utilities of VGAM83 include diagnosis, prevention and treatment of diseases and clinical conditions associated with P17.3. FIG. 1 further provides a conceptual description of a novel bioinformatically detected viral gene of the present invention, referred to here as Viral Genomic Address Messenger 84 (VGAM84) viral gene, which modulates expression of respective host target genes thereof, the function and utility of which host target genes is known in the art.

VGAM84 is a novel bioinformatically detected regulatory, non protein coding, viral micro RNA (miRNA) gene. The method by which VGAM84 was detected is described hereinabove with reference to FIGS. 1-8.

VGAM84 gene, herein designated VGAM GENE, is a viral gene contained in the genome of Plutella Xylostella Granulovirus. VGAM84 host target gene, herein designated VGAM HOST TARGET GENE, is a human gene contained in the human genome.

VGAM84 gene encodes a VGAM84 precursor RNA, herein designated VGAM PRECURSOR RNA. Similar to other miRNA genes, and unlike most ordinary genes, VGAM84 precursor RNA does not encode a protein. A nucleotide sequence identical or highly similar to the nucleotide sequence of VGAM84 precursor RNA is designated SEQ ID:70, and is provided hereinbelow with reference to the sequence listing part. Nucleotide sequence SEQ ID:70 is located at position 12458 relative to the genome of Plutella Xylostella Granulovirus.

VGAM84 precursor RNA folds onto itself, forming VGAM84 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM84 folded precursor RNA into VGAM84 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM84 RNA is designated SEQ ID:2795, and is provided hereinbelow with reference to the sequence listing part.

VGAM84 host target gene, herein designated VGAM HOST TARGET GENE, encodes a corresponding messenger RNA, VGAM84 host target RNA, herein designated VGAM HOST TARGET RNA. VGAM84 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM84 RNA, herein designated VGAM RNA, binds complementarily to one or more host target binding sites located in untranslated regions of VGAM84 host target RNA, herein designated VGAM HOST TARGET RNA. This complementary binding is due to the fact that the nucleotide sequence of VGAM84 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM84 RNA, herein designated VGAM RNA, may have a different number of host target binding sites in untranslated regions of a VGAM84 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM84 RNA, herein designated VGAM RNA, to host target binding sites on VGAM84 host target RNA, herein designated VGAM HOST TARGET RNA, such as BINDING SITE I, BINDING SITE II and BINDING SITE III, inhibits translation of VGAM84 host target RNA into VGAM84 host target protein, herein designated VGAM HOST TARGET PROTEIN. VGAM host target protein is therefore outlined by a broken line.

It is appreciated that VGAM84 host target gene, herein designated VGAM HOST TARGET GENE, in fact represents a plurality of VGAM84 host target genes. The mRNA of each one of this plurality of VGAM84 host target genes comprises one or more host target binding sites, each having a nucleotide sequence which is at least partly complementary to VGAM84 RNA, herein designated VGAM RNA, and which when bound by VGAM84 RNA causes inhibition of translation of respective one or more VGAM84 host target proteins.

It is further appreciated by one skilled in the art that the mode of translational inhibition illustrated by FIG. 1 with specific reference to translational inhibition exerted by VGAM84 gene, herein designated VGAM GENE, on one or more VGAM84 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM84 is inhibition of expression of host target genes, as part of a novel viral mechanism of attacking a host. Accordingly, utilities of VGAM84 include diagnosis, prevention and treatment of viral infection by Plutella Xylostella Granulovirus. Specific functions, and accordingly utilities, of VGAM84 correlate with, and may be deduced from, the identity of the host target genes which VGAM84 binds and inhibits, and the function of these host target genes, as elaborated hereinbelow.

Nucleotide sequences of the VGAM84 precursor RNA, herein designated VGAM PRECURSOR RNA, and of the 'diced' VGAM84 RNA, herein designated VGAM RNA, and a schematic representation of the secondary folding of VGAM84 folded precursor RNA, herein designated VGAM FOLDED PRECURSOR RNA, of VGAM84 are further described hereinbelow with reference to Table 1.

Nucleotide sequences of host target binding sites, such as BINDING SITE-I, BINDING SITE-II and BINDING SITE-III of FIG. 1, found on VGAM84 host target RNA, and schematic representation of the complementarity of each of these host target binding sites to VGAM84 RNA, herein designated VGAM RNA, are described hereinbelow with reference to Table 2.

As mentioned hereinabove with reference to FIG. 1, a function of VGAM84 gene, herein designated VGAM is inhibition of expression of VGAM84 target genes. It is appreciated that specific functions, and accordingly utilities, of VGAM84 correlate with, and may be deduced from, the identity of the target genes which VGAM84 binds and inhibits, and the function of these target genes, as elaborated hereinbelow.

Transmembrane 4 Superfamily Member 6 (TM4SF6, Accession NM_003270) is a VGAM84 host target gene. TM4SF6 BINDING SITE is HOST TARGET binding site found in the 3' untranslated region of mRNA encoded by TM4SF6, corresponding to a HOST TARGET binding site such as BINDING SITE I, BINDING SITE II or BINDING SITE III. Table 2 illustrates the complementarity of the nucleotide sequences of TM4SF6 BINDING SITE, designated SEQ ID:9282, to the nucleotide sequence of VGAM84 RNA, herein designated VGAM RNA, also designated SEQ ID:2795.

A function of VGAM84 is therefore inhibition of Transmembrane 4 Superfamily Member 6 (TM4SF6, Accession NM_003270), a gene which plays a role in the regulation of cell development, activation, growth and motility. Accordingly, utilities of VGAM84 include diagnosis, prevention and treatment of diseases and clinical conditions associated with TM4SF6. The function of TM4SF6 has been established by previous studies. Members of the transmembrane 4 (or tetraspanin) superfamily (TM4SF) contain 4 hydrophobic, presumably membrane-spanning sequences and a major presumed extracellular loop between the third and fourth hydrophobic domains. Several TM4SF proteins have been shown to stimulate or modulate cell growth, and some may associate with integrin and control cell adhesion and movement. Maeda et al. (1998) isolated a human glioma cDNA that has sequence similarity to the TM4SF member TM4SF2 (OMIM Ref. No. 300096). By screening a human fetal lung cDNA library with a probe corresponding to the combined sequences of this cDNA and of an overlapping EST, they isolated cDNAs with an open reading frame encoding a deduced 245-amino acid protein termed TM4SF6. The TM4SF6 protein contains 4 putative transmembrane domains, several short cysteine motifs characteristic of TM4SF proteins, and a potential N-glycosylation site. The TM4SF6 and TM4SF2 proteins are 58% homologous. TM4SF6 was expressed as 1.9- and 1.3-kb transcripts in all human tissues examined.

Full details of the abovementioned studies are described in the following publications, the disclosure of which are hereby incorporated by reference:

Maeda, K.; Matsuhashi, S.; Hori, K.; Xin, Z.; Mukai, T.; Tabuchi, K.; Egashira, M.; Niikawa, N.: Cloning and characterization of a novel human gene, TM4SF6, encoding a protein belonging to the transmembrane 4 superfamily, and mapped to Xq22. Genomics 52:240-242, 1998; and Todd, S. C.; Doctor, V. S.; Levy, S.: Sequences and expression of six new members of the tetraspanin/TM4SF family. Biochim. Biophys. Acta 1399:101-104, 1998.

Further studies establishing the function and utilities of TM4SF6 are found in John Hopkins OMIM database record ID 300191, and in sited publications numbered 11388-11389 listed in the bibliography section hereinbelow, which are also hereby incorporated by reference. KIAA1239 (Accession XM_049078) is another VGAM84 host target gene. KIAA1239 BINDING SITE is HOST TARGET binding site found in the 3' untranslated region of mRNA encoded by KIAA1239, corresponding to a HOST TARGET binding site such as BINDING SITE I, BINDING SITE II or BINDING SITE III. Table 2 illustrates the complementarity of the nucleotide sequences of KIAA1239 BINDING SITE, designated SEQ ID:35340, to the nucleotide sequence of VGAM84 RNA, herein designated VGAM RNA, also designated SEQ ID:2795.

Another function of VGAM84 is therefore inhibition of KIAA1239 (Accession XM_049078). Accordingly, utilities of VGAM84 include diagnosis, prevention and treatment of diseases and clinical conditions associated with KIAA1239. KIAA1423 (Accession XM_029703) is another VGAM84 host target gene. KIAA1423 BINDING SITE is HOST TARGET binding site found in the 3' untranslated region of mRNA encoded by KIAA1423, corresponding to a HOST TARGET binding site such as BINDING SITE I, BINDING SITE II or BINDING SITE III. Table 2 illustrates the complementarity of the nucleotide sequences of KIAA1423 BINDING SITE, designated SEQ ID:30918, to the nucleotide sequence of VGAM84 RNA, herein designated VGAM RNA, also designated SEQ ID:2795.

Another function of VGAM84 is therefore inhibition of KIAA1423 (Accession XM_029703). Accordingly, utilities of VGAM84 include diagnosis, prevention and treatment of diseases and clinical conditions associated with KIAA1423. MGC23980 (Accession NM_145005) is another VGAM84 host target gene. MGC23980 BINDING SITE is HOST TARGET binding site found in the 3' untranslated region of mRNA encoded by MGC23980, corresponding to a HOST TARGET binding site such as BINDING SITE I, BINDING SITE II or BINDING SITE III. Table 2 illustrates the complementarity of the nucleotide sequences of MGC23980 BINDING SITE, designated SEQ ID:29604, to the nucleotide sequence of VGAM84 RNA, herein designated VGAM RNA, also designated SEQ ID:2795.

Another function of VGAM84 is therefore inhibition of MGC23980 (Accession NM_145005). Accordingly, utilities of VGAM84 include diagnosis, prevention and treatment of diseases and clinical conditions associated with MGC23980. FIG. 1 further provides a conceptual description of a novel bioinformatically detected viral gene of the present invention, referred to here as Viral Genomic Address Messenger 85 (VGAM85) viral gene, which modulates expression of respective host target genes thereof, the function and utility of which host target genes is known in the art.

VGAM85 is a novel bioinformatically detected regulatory, non protein coding, viral micro RNA (miRNA) gene. The method by which VGAM85 was detected is described hereinabove with reference to FIGS. 1-8.

VGAM85 gene, herein designated VGAM GENE, is a viral gene contained in the genome of Plutella Xylostella Granulovirus. VGAM85 host target gene, herein designated VGAM HOST TARGET GENE, is a human gene contained in the human genome.

VGAM85 gene encodes a VGAM85 precursor RNA, herein designated VGAM PRECURSOR RNA. Similar to other miRNA genes, and unlike most ordinary genes, VGAM85 precursor RNA does not encode a protein. A nucleotide sequence identical or highly similar to the nucleotide sequence of VGAM85 precursor RNA is designated SEQ ID:71, and is provided hereinbelow with reference to the sequence listing part. Nucleotide sequence SEQ ID:71 is located at position 61916 relative to the genome of Plutella Xylostella Granulovirus.

VGAM85 precursor RNA folds onto itself, forming VGAM85 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM85 folded precursor RNA into VGAM85 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM85 RNA is designated SEQ ID:2796, and is provided hereinbelow with reference to the sequence listing part.

VGAM85 host target gene, herein designated VGAM HOST TARGET GENE, encodes a corresponding messenger RNA, VGAM85 host target RNA, herein designated VGAM HOST TARGET RNA. VGAM85 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM85 RNA, herein designated VGAM RNA, binds complementarily to one or more host target binding sites located in untranslated regions of VGAM85 host target RNA, herein designated VGAM HOST TARGET RNA. This complementary binding is due to the fact that the nucleotide sequence of VGAM85 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM85 RNA, herein designated VGAM RNA, may have a different number of host target binding sites in untranslated regions of a VGAM85 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM85 RNA, herein designated VGAM RNA, to host target binding sites on VGAM85 host target RNA, herein designated VGAM HOST TARGET RNA, such as BINDING SITE I, BINDING SITE II and BINDING SITE III, inhibits translation of VGAM85 host target RNA into VGAM85 host target protein, herein designated VGAM HOST TARGET PROTEIN. VGAM host target protein is therefore outlined by a broken line.

It is appreciated that VGAM85 host target gene, herein designated VGAM HOST TARGET GENE, in fact represents a plurality of VGAM85 host target genes. The mRNA of each one of this plurality of VGAM85 host target genes comprises one or more host target binding sites, each having a nucleotide sequence which is at least partly complementary to VGAM85 RNA, herein designated VGAM RNA, and which when bound by VGAM85 RNA causes inhibition of translation of respective one or more VGAM85 host target proteins.

It is further appreciated by one skilled in the art that the mode of translational inhibition illustrated by FIG. 1 with specific reference to translational inhibition exerted by VGAM85 gene, herein designated VGAM GENE, on one or more VGAM85 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM85 is inhibition of expression of host target genes, as part of a novel viral mechanism of attacking a host. Accordingly, utilities of VGAM85 include diagnosis, prevention and treatment of viral infection by Plutella Xylostella Granulovirus. Specific functions, and accordingly utilities, of VGAM85 correlate with, and may be deduced from, the identity of the host target genes which VGAM85 binds and inhibits, and the function of these host target genes, as elaborated hereinbelow.

Nucleotide sequences of the VGAM85 precursor RNA, herein designated VGAM PRECURSOR RNA, and of the 'diced' VGAM85 RNA, herein designated VGAM RNA, and a schematic representation of the secondary folding of VGAM85 folded precursor RNA, herein designated VGAM FOLDED PRECURSOR RNA, of VGAM85 are further described hereinbelow with reference to Table 1.

Nucleotide sequences of host target binding sites, such as BINDING SITE-I, BINDING SITE-II and BINDING SITE-III of FIG. 1, found on VGAM85 host target RNA, and schematic representation of the complementarity of each of these host target binding sites to VGAM85 RNA, herein designated VGAM RNA, are described hereinbelow with reference to Table 2.

As mentioned hereinabove with reference to FIG. 1, a function of VGAM85 gene, herein designated VGAM is inhibition of expression of VGAM85 target genes. It is appreciated that specific functions, and accordingly utilities, of VGAM85 correlate with, and may be deduced from, the identity of the target genes which VGAM85 binds and inhibits, and the function of these target genes, as elaborated hereinbelow.

Contactin Associated Protein-like 2 (CNTNAP2, Accession NM_014141) is a VGAM85 host target gene. CNTNAP2 BINDING SITE is HOST TARGET binding site found in the 3' untranslated region of mRNA encoded by CNTNAP2, corresponding to a HOST TARGET binding site such as BINDING SITE I, BINDING SITE II or BINDING SITE III. Table 2 illustrates the complementarity of the nucleotide sequences of CNTNAP2 BINDING SITE, designated SEQ ID:15420, to the nucleotide sequence of VGAM85 RNA, herein designated VGAM RNA, also designated SEQ ID:2796.

A function of VGAM85 is therefore inhibition of Contactin Associated Protein-like 2 (CNTNAP2, Accession NM_014141). Accordingly, utilities of VGAM85 include diagnosis, prevention and treatment of diseases and clinical conditions associated with CNTNAP2. Glucocorticoid Receptor DNA Binding Factor 1 (GRLF1, Accession XM_085943) is another VGAM85 host target gene. GRLF1 BINDING SITE is HOST TARGET binding site found in the 3' untranslated region of mRNA encoded by GRLF1, corresponding to a HOST TARGET binding site such as BINDING SITE I, BINDING SITE II or BINDING SITE III. Table 2 illustrates the complementarity of the nucleotide sequences of GRLF1 BINDING SITE, designated SEQ ID:38415, to the nucleotide sequence of VGAM85 RNA, herein designated VGAM RNA, also designated SEQ ID:2796.

Another function of VGAM85 is therefore inhibition of Glucocorticoid Receptor DNA Binding Factor 1 (GRLF1, Accession XM_085943), a gene which inhibits transcription of the glucocorticoid receptor gene. Accordingly, utilities of VGAM85 include diagnosis, prevention and treatment of diseases and clinical conditions associated with GRLF1. The function of GRLF1 and its association with various diseases and clinical conditions, has been established by previous studies, as described hereinabove with reference to VGAM55. Lipin 2 (LPIN2, Accession NM_014646) is another VGAM85 host target gene. LPIN2 BINDING SITE is HOST TARGET binding site found in the 3' untranslated region of mRNA encoded by LPIN2, corresponding to a HOST TARGET binding site such as BINDING SITE I, BINDING SITE II or BINDING SITE III. Table 2 illustrates the complementarity of the nucleotide sequences of LPIN2 BINDING SITE, designated SEQ ID:16060, to the nucleotide sequence of VGAM85 RNA, herein designated VGAM RNA, also designated SEQ ID:2796.

Another function of VGAM85 is therefore inhibition of Lipin 2 (LPIN2, Accession NM_014646). Accordingly, utilities of VGAM85 include diagnosis, prevention and treatment of diseases and clinical conditions associated with LPIN2. POU Domain, Class 3, Transcription Factor 1 (POU3F1, Accession XM_001334) is another VGAM85 host target gene. POU3F1 BINDING SITE is HOST TARGET binding site found in the 3' untranslated region of mRNA encoded by POU3F1, corresponding to a HOST TARGET binding site such as BINDING SITE I, BINDING SITE II or BINDING SITE III. Table 2 illustrates the complementarity of the nucleotide sequences of POU3F1 BINDING SITE, designated SEQ ID:29831, to the nucleotide sequence of VGAM85 RNA, herein designated VGAM RNA, also designated SEQ ID:2796.

Another function of VGAM85 is therefore inhibition of POU Domain, Class 3, Transcription Factor 1 (POU3F1, Accession XM_001334), a gene which involves in early embryogenesis and neurogenesis. Accordingly, utilities of VGAM85 include diagnosis, prevention and treatment of diseases and clinical conditions associated with POU3F1. The function of POU3F1 has been established by previous studies. The vertebrate class III POU transcription factors consist of 4 members: POU3F1 (Oct-6), POU3F2 (OMIM Ref. No. 600494), POU3F3 (Brain-1), and POU3F4 (Brain-4; 300039). The chromosomal locations of the murine class III POU genes were determined by interspecific backcross analysis (Avraham et al., 1993; Xia et al., 1993). On the basis of mouse-human chromosomal homologies, human POU3F1 and POU3F3 were expected to map to 1p and 2q, respectively. Sumiyama et al. (1998) found that the location of POU3F1 was consistent with this position, mapping to 1p34.1 by FISH. Contrary to the prediction, however, POU3F3 was mapped to 3p14.2 by the same method. The human POU3F2 and POU3F4 genes map to 6q16 and Xq21.1, respectively. Thus, the 4 human class III POU genes map to different chromosomes. A phylogenetic tree of these 4 genes shows that they emerged in a common ancestor of vertebrates. Studies of the genome structure of vertebrates suggest that genome duplication occurred at least twice in the early stage of vertebrate evolution; 4 homologous complexes such as Hox and MHC are interspersed in the mammalian genome. The findings with the 4 class III POU genes are consistent with the idea of 2 genome duplications. Xia et al. (1993) mapped the mouse homolog of the POU3F1 gene, called Tst1 by them, to chromosome 4. Most mice homozygous for a mutant Pou3f1 die soon after birth (Bermingham et al., 1996; Jaegle et al., 1996).

Full details of the abovementioned studies are described in the following publications, the disclosure of which are hereby incorporated by reference:

Sumiyama, K.; Washio-Watanabe, K.; Ono, T.; Yoshida, M. C.; Hayakawa, T.; Ueda, S.: Human class III POU genes, POU3F1 and POU3F3, map to chromosomes 1p34.1 and 3p14.1. Mammalian Genome 9:180-181, 1998; and Xia, Y.-R.; Andersen, B.; Mehrabian, M.; Diep, A. T.; Warden, C. H.; Mohandas, T.; McEvilly, R. J.; Rosenfeld, M. G.; Lusis, A. J.: Chromosomal organization of mammalian POU domain facto.

Further studies establishing the function and utilities of POU3F1 are found in John Hopkins OMIM database record ID 602479, and in sited publications numbered 7963, 8632-863 and 10196 listed in the bibliography section hereinbelow, which are also hereby incorporated by reference. Angiomotin Like 1 (AMOTL1, Accession XM_057045) is another VGAM85 host target gene. AMOTL1 BINDING SITE is HOST TARGET binding site found in the 3' untranslated region of mRNA encoded by AMOTL1, corresponding to a HOST TARGET binding site such as BINDING SITE I, BINDING SITE II or BINDING SITE III. Table 2 illustrates the complementarity of the nucleotide sequences of AMOTL1 BINDING SITE, designated SEQ ID:36467, to the nucleotide sequence of VGAM85 RNA, herein designated VGAM RNA, also designated SEQ ID:2796.

Another function of VGAM85 is therefore inhibition of Angiomotin Like 1 (AMOTL1, Accession XM_057045). Accordingly, utilities of VGAM85 include diagnosis, prevention and treatment of diseases and clinical conditions associated with AMOTL1. CSRP2 Binding Protein (CSRP2BP, Accession XM_046520) is another VGAM85 host target gene. CSRP2BP BINDING SITE is HOST TARGET binding site found in the 5' untranslated region of mRNA encoded by CSRP2BP, corresponding to a HOST TARGET binding site such as BINDING SITE I, BINDING SITE II or BINDING SITE III. Table 2 illustrates the complementarity of the nucleotide sequences of CSRP2BP BINDING SITE, designated SEQ ID:34736, to the nucleotide sequence of VGAM85 RNA, herein designated VGAM RNA, also designated SEQ ID:2796.

Another function of VGAM85 is therefore inhibition of CSRP2 Binding Protein (CSRP2BP, Accession XM_046520). Accordingly, utilities of VGAM85 include diagnosis, prevention and treatment of diseases and clinical conditions associated with CSRP2BP. DKFZP564O0463 (Accession NM_014156) is another VGAM85 host target gene. DKFZP564O0463 BINDING SITE is HOST TARGET binding site found in the 3' untranslated region of mRNA encoded by DKFZP564O0463, corresponding to a HOST TARGET binding site such as BINDING SITE I, BINDING SITE II or BINDING SITE III. Table 2 illustrates the complementarity of the nucleotide sequences of DKFZP564O0463 BINDING SITE, designated SEQ ID:15443, to the nucleotide sequence of VGAM85 RNA, herein designated VGAM RNA, also designated SEQ ID:2796.

Another function of VGAM85 is therefore inhibition of DKFZP564O0463 (Accession NM_014156). Accordingly, utilities of VGAM85 include diagnosis, prevention and treatment of diseases and clinical conditions associated with DKFZP564O0463. KIAA0227 (Accession XM_027236) is another VGAM85 host target gene. KIAA0227 BINDING SITE is HOST TARGET binding site found in the 3' untranslated region of mRNA encoded by KIAA0227, corresponding to a HOST TARGET binding site such as BINDING SITE I, BINDING SITE II or BINDING SITE III. Table 2 illustrates the complementarity of the nucleotide sequences of KIAA0227 BINDING SITE, designated SEQ ID:30448, to the nucleotide sequence of VGAM85 RNA, herein designated VGAM RNA, also designated SEQ ID:2796.

Another function of VGAM85 is therefore inhibition of KIAA0227 (Accession XM_027236). Accordingly, utilities of VGAM85 include diagnosis, prevention and treatment of diseases and clinical conditions associated with KIAA0227. KIAA0618 (Accession NM_014833) is another VGAM85 host target gene. KIAA0618 BINDING SITE is HOST TARGET binding site found in the 3' untranslated region of mRNA encoded by KIAA0618, corresponding to a HOST TARGET binding site such as BINDING SITE I, BINDING SITE II or BINDING SITE III. Table 2 illustrates the complementarity of the nucleotide sequences of KIAA0618 BINDING SITE, designated SEQ ID:16835, to the nucleotide sequence of VGAM85 RNA, herein designated VGAM RNA, also designated SEQ ID:2796.

Another function of VGAM85 is therefore inhibition of KIAA0618 (Accession NM_014833). Accordingly, utilities of VGAM85 include diagnosis, prevention and treatment of diseases and clinical conditions associated with KIAA0618. KIAA0711 (Accession NM_014867) is another VGAM85 host target gene. KIAA0711 BINDING SITE is HOST TARGET binding site found in the 3' untranslated region of mRNA encoded by KIAA0711, corresponding to a HOST TARGET binding site such as BINDING SITE I, BINDING SITE II or BINDING SITE III. Table 2 illustrates the complementarity of the nucleotide sequences of KIAA0711 BINDING SITE, designated SEQ ID:16955, to the nucleotide sequence of VGAM85 RNA, herein designated VGAM RNA, also designated SEQ ID:2796.

Another function of VGAM85 is therefore inhibition of KIAA0711 (Accession NM_014867). Accordingly, utilities of VGAM85 include diagnosis and treatment of diseases and clinical conditions associated with KIAA0711. KIAA1046 (Accession NM_014928) is another VGAM85 host target gene. KIAA1046 BINDING SITE is HOST TARGET binding site found in the 3' untranslated region of mRNA encoded by KIAA1046, corresponding to a HOST TARGET binding site such as BINDING SITE I, BINDING SITE II or BINDING SITE III. Table 2 illustrates the complementarity of the nucleotide sequences of KIAA1046 BINDING SITE, designated SEQ ID:17220, to the nucleotide sequence of VGAM85 RNA, herein designated VGAM RNA, also designated SEQ ID:2796.

Another function of VGAM85 is therefore inhibition of KIAA1046 (Accession NM_014928). Accordingly, utilities of VGAM85 include diagnosis, prevention and treatment of diseases and clinical conditions associated with KIAA1046. Zinc Finger Protein 387 (ZNF387, Accession NM_014682) is another VGAM85 host target gene. ZNF387 BINDING SITE is HOST TARGET binding site found in the 3' untranslated region of mRNA encoded by ZNF387, corresponding to a HOST TARGET binding site such as BINDING SITE I, BINDING SITE II or BINDING SITE III. Table 2 illustrates the complementarity of the nucleotide sequences of ZNF387 BINDING SITE, designated SEQ ID:16174, to the nucleotide sequence of VGAM85 RNA, herein designated VGAM RNA, also designated SEQ ID:2796.

Another function of VGAM85 is therefore inhibition of Zinc Finger Protein 387 (ZNF387, Accession NM_014682). Accordingly, utilities of VGAM85 include diagnosis, prevention and treatment of diseases and clinical conditions associated with ZNF387. LOC199990 (Accession XM_114083) is another VGAM85 host target gene. LOC199990 BINDING SITE is HOST TARGET binding site found in the 3' untranslated region of mRNA encoded by LOC199990, corresponding to a HOST TARGET binding site such as BINDING SITE I, BINDING SITE II or BINDING SITE III. Table 2 illustrates the complementarity of the nucleotide sequences of LOC199990 BINDING SITE, designated SEQ ID:42681, to the nucleotide sequence of VGAM85 RNA, herein designated VGAM RNA, also designated SEQ ID:2796.

Another function of VGAM85 is therefore inhibition of LOC199990 (Accession XM_114083). Accordingly, utilities of VGAM85 include diagnosis, prevention and treatment of diseases and clinical conditions associated with LOC199990. LOC91170 (Accession XM_036612) is another VGAM85 host target gene. LOC91170 BINDING SITE is HOST TARGET binding site found in the 3' untranslated region of mRNA encoded by LOC91170, corresponding to a HOST TARGET binding site such as BINDING SITE I, BINDING SITE II or BINDING SITE III. Table 2 illustrates the complementarity of the nucleotide sequences of LOC91170 BINDING SITE, designated SEQ ID:32480, to the nucleotide sequence of VGAM85 RNA, herein designated VGAM RNA, also designated SEQ ID:2796.

Another function of VGAM85 is therefore inhibition of LOC91170 (Accession XM_036612). Accordingly, utilities of VGAM85 include diagnosis, prevention and treatment of diseases and clinical conditions associated with LOC91170. FIG. 1 further provides a conceptual description of a novel bioinformatically detected viral gene of the present invention, referred to here as Viral Genomic Address Messenger 86 (VGAM86) viral gene, which modulates expression of respective host target genes thereof, the function and utility of which host target genes is known in the art.

VGAM86 is a novel bioinformatically detected regulatory, non protein coding, viral micro RNA (miRNA) gene. The method by which VGAM86 was detected is described hereinabove with reference to FIGS. 1-8.

VGAM86 gene, herein designated VGAM GENE, is a viral gene contained in the genome of Plutella Xylostella Granulovirus. VGAM86 host target gene, herein designated VGAM HOST TARGET GENE, is a human gene contained in the human genome.

VGAM86 gene encodes a VGAM86 precursor RNA, herein designated VGAM PRECURSOR RNA. Similar to other miRNA genes, and unlike most ordinary genes, VGAM86 precursor RNA does not encode a protein. A nucleotide sequence identical or highly similar to the nucleotide sequence of VGAM86 precursor RNA is designated SEQ ID:72, and is provided hereinbelow with reference to the sequence listing part. Nucleotide sequence SEQ ID:72 is located at position 28852 relative to the genome of Plutella Xylostella Granulovirus.

VGAM86 precursor RNA folds onto itself, forming VGAM86 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM86 folded precursor RNA into VGAM86 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM86 RNA is designated SEQ ID:2797, and is provided hereinbelow with reference to the sequence listing part.

VGAM86 host target gene, herein designated VGAM HOST TARGET GENE, encodes a corresponding messenger RNA, VGAM86 host target RNA, herein designated VGAM HOST TARGET RNA. VGAM86 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM86 RNA, herein designated VGAM RNA, binds complementarily to one or more host target binding sites located in untranslated regions of VGAM86 host target RNA, herein designated VGAM HOST TARGET RNA. This complementary binding is due to the fact that the nucleotide sequence of VGAM86 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM86 RNA, herein designated VGAM RNA, may have a different number of host target binding sites in untranslated regions of a VGAM86 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM86 RNA, herein designated VGAM RNA, to host target binding sites on VGAM86 host target RNA, herein designated VGAM HOST TARGET RNA, such as BINDING SITE I, BINDING SITE II and BINDING SITE III, inhibits translation of VGAM86 host target RNA into VGAM86 host target protein, herein designated VGAM HOST TARGET PROTEIN. VGAM host target protein is therefore outlined by a broken line.

It is appreciated that VGAM86 host target gene, herein designated VGAM HOST TARGET GENE, in fact represents a plurality of VGAM86 host target genes. The mRNA of each one of this plurality of VGAM86 host target genes comprises one or more host target binding sites, each having a nucleotide sequence which is at least partly complementary to VGAM86 RNA, herein designated VGAM RNA, and which when bound by VGAM86 RNA causes inhibition of translation of respective one or more VGAM86 host target proteins.

It is further appreciated by one skilled in the art that the mode of translational inhibition illustrated by FIG. 1 with specific reference to translational inhibition exerted by VGAM86 gene, herein designated VGAM GENE, on one or more VGAM86 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM86 is inhibition of expression of host target genes, as part of a novel viral mechanism of attacking a host. Accordingly, utilities of VGAM86 include diagnosis, prevention and treatment of viral infection by Plutella Xylostella Granulovirus. Specific functions, and accordingly utilities, of VGAM86 correlate with, and may be deduced from, the identity of the host target genes which VGAM86 binds and inhibits, and the function of these host target genes, as elaborated hereinbelow.

Nucleotide sequences of the VGAM86 precursor RNA, herein designated VGAM PRECURSOR RNA, and of the 'diced' VGAM86 RNA, herein designated VGAM RNA, and a schematic representation of the secondary folding of VGAM86 folded precursor RNA, herein designated VGAM FOLDED PRECURSOR RNA, of VGAM86 are further described hereinbelow with reference to Table 1.

Nucleotide sequences of host target binding sites, such as BINDING SITE-I, BINDING SITE-II and BINDING SITE-III of FIG. 1, found on VGAM86 host target RNA, and schematic representation of the complementarity of each of these host target binding sites to VGAM86 RNA, herein designated VGAM RNA, are described hereinbelow with reference to Table 2.

As mentioned hereinabove with reference to FIG. 1, a function of VGAM86 gene, herein designated VGAM is inhibition of expression of VGAM86 target genes. It is appreciated that specific functions, and accordingly utilities, of VGAM86 correlate with, and may be deduced from, the identity of the target genes which VGAM86 binds and inhibits, and the function of these target genes, as elaborated hereinbelow.

HCGIV.9 (Accession NM_018985) is a VGAM86 host target gene. HCGIV.9 BINDING SITE is HOST TARGET binding site found in the 5' untranslated region of mRNA encoded by HCGIV.9, corresponding to a HOST TARGET binding site such as BINDING SITE I, BINDING SITE II or BINDING SITE III. Table 2 illustrates the complementarity of the nucleotide sequences of HCGIV.9 BINDING SITE, designated SEQ ID:21056, to the nucleotide sequence of VGAM86 RNA, herein designated VGAM RNA, also designated SEQ ID:2797.

A function of VGAM86 is therefore inhibition of HCGIV.9 (Accession NM_018985). Accordingly, utilities of VGAM86 include diagnosis, prevention and treatment of diseases and clinical conditions associated with HCGIV.9. LOC127534 (Accession XM_060532) is another VGAM86 host target gene. LOC127534 BINDING SITE is HOST TARGET binding site found in the 3' untranslated region of mRNA encoded by LOC127534, corresponding to a HOST TARGET binding site such as BINDING SITE I, BINDING SITE II or BINDING SITE III. Table 2 illustrates the complementarity of the nucleotide sequences of LOC127534 BINDING SITE, designated SEQ ID:37162, to the nucleotide sequence of VGAM86 RNA, herein designated VGAM RNA, also designated SEQ ID:2797.

Another function of VGAM86 is therefore inhibition of LOC127534 (Accession XM_060532). Accordingly, utilities of VGAM86 include diagnosis, prevention and treatment of diseases and clinical conditions associated with LOC127534. LOC222171 (Accession XM_166586) is another VGAM86 host target gene. LOC222171 BINDING SITE is HOST TARGET binding site found in the 5' untranslated region of mRNA encoded by LOC222171, corresponding to a HOST TARGET binding site such as BINDING SITE I, BINDING SITE II or BINDING SITE III. Table 2 illustrates the complementarity of the nucleotide sequences of LOC222171 BINDING SITE, designated SEQ ID:44557, to the nucleotide sequence of VGAM86 RNA, herein designated VGAM RNA, also designated SEQ ID:2797.

Another function of VGAM86 is therefore inhibition of LOC222171 (Accession XM_166586). Accordingly, utilities of VGAM86 include diagnosis, prevention and treatment of diseases and clinical conditions associated with LOC222171. FIG. 1 further provides a conceptual description of a novel bioinformatically detected viral gene of the present invention, referred to here as Viral Genomic Address Messenger 87 (VGAM87) viral gene, which modulates expression of respective host target genes thereof, the function and utility of which host target genes is known in the art.

VGAM87 is a novel bioinformatically detected regulatory, non protein coding, viral micro RNA (miRNA) gene. The method by which VGAM87 was detected is described hereinabove with reference to FIGS. 1-8.

VGAM87 gene, herein designated VGAM GENE, is a viral gene contained in the genome of Plutella Xylostella Granulovirus. VGAM87 host target gene, herein designated VGAM HOST TARGET GENE, is a human gene contained in the human genome.

VGAM87 gene encodes a VGAM87 precursor RNA, herein designated VGAM PRECURSOR RNA. Similar to other miRNA genes, and unlike most ordinary genes, VGAM87 precursor RNA does not encode a protein. A nucleotide sequence identical or highly similar to the nucleotide sequence of VGAM87 precursor RNA is designated SEQ ID:73, and is provided hereinbelow with reference to the sequence listing part. Nucleotide sequence SEQ ID:73 is located at position 79962 relative to the genome of Plutella Xylostella Granulovirus.

VGAM87 precursor RNA folds onto itself, forming VGAM87 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM87 folded precursor RNA into VGAM87 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 78%) nucleotide sequence of VGAM87 RNA is designated SEQ ID:2798, and is provided hereinbelow with reference to the sequence listing part.

VGAM87 host target gene, herein designated VGAM HOST TARGET GENE, encodes a corresponding messenger RNA, VGAM87 host target RNA, herein designated VGAM HOST TARGET RNA. VGAM87 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM87 RNA, herein designated VGAM RNA, binds complementarily to one or more host target binding sites located in untranslated regions of VGAM87 host target RNA, herein designated VGAM HOST TARGET RNA. This complementary binding is due to the fact that the nucleotide sequence of VGAM87 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM87 RNA, herein designated VGAM RNA, may have a different number of host target binding sites in untranslated regions of a VGAM87 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM87 RNA, herein designated VGAM RNA, to host target binding sites on VGAM87 host target RNA, herein designated VGAM HOST TARGET RNA, such as BINDING SITE I, BINDING SITE II and BINDING SITE III, inhibits translation of VGAM87 host target RNA into VGAM87 host target protein, herein designated VGAM HOST TARGET PROTEIN. VGAM host target protein is therefore outlined by a broken line.

It is appreciated that VGAM87 host target gene, herein designated VGAM HOST TARGET GENE, in fact represents a plurality of VGAM87 host target genes. The mRNA of each one of this plurality of VGAM87 host target genes comprises one or more host target binding sites, each having a nucleotide sequence which is at least partly complementary to VGAM87 RNA, herein designated VGAM RNA, and which when bound by VGAM87 RNA causes inhibition of translation of respective one or more VGAM87 host target proteins.

It is further appreciated by one skilled in the art that the mode of translational inhibition illustrated by FIG. 1 with specific reference to translational inhibition exerted by VGAM87 gene, herein designated VGAM GENE, on one or more VGAM87 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM87 is inhibition of expression of host target genes, as part of a novel viral mechanism of attacking a host. Accordingly, utilities of VGAM87 include diagnosis, prevention and treatment of viral infection by Plutella Xylostella Granulovirus. Specific functions, and accordingly utilities, of VGAM87 correlate with, and may be deduced from, the identity of the host target genes which VGAM87 binds and inhibits, and the function of these host target genes, as elaborated hereinbelow.

Nucleotide sequences of the VGAM87 precursor RNA, herein designated VGAM PRECURSOR RNA, and of the 'diced' VGAM87 RNA, herein designated VGAM RNA, and a schematic representation of the secondary folding of VGAM87 folded precursor RNA, herein designated VGAM FOLDED PRECURSOR RNA, of VGAM87 are further described hereinbelow with reference to Table 1.

Nucleotide sequences of host target binding sites, such as BINDING SITE-I, BINDING SITE-II and BINDING SITE-III of FIG. 1, found on VGAM87 host target RNA, and schematic representation of the complementarity of each of these host target binding sites to VGAM87 RNA, herein designated VGAM RNA, are described hereinbelow with reference to Table 2.

As mentioned hereinabove with reference to FIG. 1, a function of VGAM87 gene, herein designated VGAM is inhibition of expression of VGAM87 target genes. It is appreciated that specific functions, and accordingly utilities, of VGAM87 correlate with, and may be deduced from, the identity of the target genes which VGAM87 binds and inhibits, and the function of these target genes, as elaborated hereinbelow.

Plexin B2 (PLXNB2, Accession NM_012401) is a VGAM87 host target gene. PLXNB2 BINDING SITE is HOST TARGET binding site found in the 3' untranslated region of mRNA encoded by PLXNB2, corresponding to a HOST TARGET binding site such as BINDING SITE I, BINDING SITE II or BINDING SITE III. Table 2 illustrates the complementarity of the nucleotide sequences of PLXNB2 BINDING SITE, designated SEQ ID:14778, to the nucleotide sequence of VGAM87 RNA, herein designated VGAM RNA, also designated SEQ ID:2798.

A function of VGAM87 is therefore inhibition of Plexin B2 (PLXNB2, Accession NM_012401), a gene which is a novel member of the plexin family. Accordingly, utilities of VGAM87 include diagnosis, prevention and treatment of diseases and clinical conditions associated with PLXNB2. The function of PLXNB2 has been established by previous studies. Using the technique of differential display, Shinoura et al. (1995) identified a cDNA fragment that was differentially expressed in malignant vs benign brain tumors. By screening a human fetal brain cDNA library with this fragment, they isolated a novel cDNA, which they termed MM1. MM1 was expressed almost 8-fold higher in glioblastomas compared to low-grade astrocytomas and slightly higher in malignant menangiomas than in benign menangiomas. By screening human brain cDNAs for those encoding proteins larger than 60 kD, Nagase et al. (1997) identified the MM1 gene, which they called KIAA0315. By RT-PCR amplification starting from the partial cDNA sequences of clones MM1 and KIAA0315, Tamagnone et al. (1999) identified the cDNA sequence of a novel member of the plexin gene family and named the gene plexin B2. Using a radiation hybrid mapping panel, Nagase et al. (1997) mapped the PLXNB2 gene to chromosome 22. By sequence analysis, Tamagnone et al. (1999) showed that the PLXNB2 gene maps to 22q13.31-q13.33 in the BAC clone (GenBank AL022328) containing the MAPK12 (OMIM Ref. No. 602399) and MAPK11 (OMIM Ref. No. 602898) genes.

Full details of the abovementioned studies are described in the following publications, the disclosure of which are hereby incorporated by reference:

Shinoura, N.; Shamraj, O. I.; Hugenholz, H.; Zhu, J. G.; McBlack, P.; Warnick, R.; Tew, J. J.; Wani, M. A.; Menon, A. G.: Identification and partial sequence of a cDNA that is differentially expressed in human brain tumors. Cancer Lett. 89:215-221, 1995; and Tamagnone, L.; Artigiani, S.; Chen, H.; He, Z.; Ming, G.; Song, H.; Chedotal, A.; Winberg, M. L.; Goodman, C. S.; Poo, M.; Tessier-Lavigne, M.; Comoglio, P. M.: Plexins are a large fam.

Further studies establishing the function and utilities of PLXNB2 are found in John Hopkins OMIM database record ID 604293, and in sited publications numbered 957, 707 and 7272 listed in the bibliography section hereinbelow, which are also hereby incorporated by reference. Solute Carrier Family 7 (cationic amino acid transporter, y+ system), Member 6 (SLC7A6, Accession NM_003983) is another VGAM87 host target gene. SLC7A6 BINDING SITE is HOST TARGET binding site found in the 3' untranslated region of mRNA encoded by SLC7A6, corresponding to a HOST TARGET binding site such as BINDING SITE I, BINDING SITE II or BINDING SITE III. Table 2 illustrates the complementarity of the nucleotide sequences of SLC7A6 BINDING SITE, designated SEQ ID:10128, to the nucleotide sequence of VGAM87 RNA, herein designated VGAM RNA, also designated SEQ ID:2798.

Another function of VGAM87 is therefore inhibition of Solute Carrier Family 7 (cationic amino acid transporter, y+ system), Member 6 (SLC7A6, Accession NM_003983), a gene which is involved in mediating amino acid transport. Accordingly, utilities of VGAM87 include diagnosis, prevention and treatment of diseases and clinical conditions associated with SLC7A6. The function of SLC7A6 has been established by previous studies. Using RT-PCR with degenerate primers to screen for amino acid transporters in opossum kidney, followed by searching EST databases, Torrents et al. (1998) obtained a cDNA encoding SLC7A6, which they called y (+)LAT2. SLC7A6 is identical to the KIAA0245 gene reported by Nagase et al. (1996). Sequence analysis predicted that SLC7A6 is a 515-amino acid, typical organic solute transporter protein with 12 transmembrane domains, 3 potential phosphorylation sites, and N- and C-terminal cytoplasmic segments. SLC7A6 shares 75% amino acid identity with the opossum sequence and y (+)LAT1 (SLC7A7; 603593). By RT-PCR analysis, Nagase et al. (1996) detected SLC7A6 expression in all tissues tested except liver; expression was weak in pancreas and highest in thymus.

Full details of the abovementioned studies are described in the following publications, the disclosure of which are hereby incorporated by reference:

Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human genes. VI. The coding sequences of 80 new genes (KIAA0201-KIAA0280) deduced by analysis of cDNA clones from cell line KG-1 and brain. DNA Res. 3:321-329, 1996; and Torrents, D.; Estevez, R.; Pineda, M.; Fernandez, E.; Lloberas, J.; Shi, Y.-B.; Zorzano, A.; Palacin, M.: Identification and characterization of a membrane protein (y (+)L amino acid tr.

Further studies establishing the function and utilities of SLC7A6 are found in John Hopkins OMIM database record ID 605641, and in sited publications numbered 9379 listed in the bibliography section hereinbelow, which are also hereby incorporated by reference. Ubiquitin Fusion Degradation 1-like (UFD1L, Accession XM_055490) is another VGAM87 host target gene. UFD1L BINDING SITE is HOST TARGET binding site found in the 3' untranslated region of mRNA encoded by UFD1L, corresponding to a HOST TARGET binding site such as BINDING SITE I, BINDING SITE II or BINDING SITE III. Table 2 illustrates the complementarity of the nucleotide sequences of UFD1L BINDING SITE, designated SEQ ID:36275, to the nucleotide sequence of VGAM87 RNA, herein designated VGAM RNA, also designated SEQ ID:2798.

Another function of VGAM87 is therefore inhibition of Ubiquitin Fusion Degradation 1-like (UFD1L, Accession XM_055490), a gene which is essential component of the ubiquitin-dependent proteolytic pathway. Accordingly, utilities of VGAM87 include diagnosis, prevention and treatment of diseases and clinical conditions associated with UFD1L. The function of UFD1L has been established by previous studies. In a search for genes in the 22q11.2 region possibly implicated in the DiGeorge syndrome (OMIM Ref. No. 188400), Pizutti et al. (1997) identified a gene whose functional features and tissue-specific expression suggested a distinct role in embryogenesis. Symbolized UFD1L by them (for ubiquitin fusion degradation 1-like), the gene encodes the human homolog of the yeast ubiquitin fusion degradation 1 (UFD1) protein that is involved in the degradation of ubiquitin fusion proteins (see OMIM Ref. No. 191320). Cloning and characterization of the murine homolog (Ufd1l) showed it to be expressed during embryogenesis in the eyes and in the inner ear primordia. These findings suggested to Pizutti et al. (1997) that the proteolytic pathway recognizing ubiquitin fusion proteins for degradation is conserved in vertebrates and that UFD1L gene hemizygosity may be the cause of some of the CATCH22-associated developmental defects. The basic helix-loop-helix transcription factor dHAND (HAND2; 602407) is required for survival of cells in the neural crest-derived branchial and aortic arch arteries and the right ventricle. Mice lacking endothelin-1 (EDN1; 131240) have cardiac and cranial neural crest defects typical of the 22q11 deletion syndrome and display down regulation of dHAND, suggesting that a molecular pathway involving dHAND may be disrupted in that syndrome. The HAND2, EDN1, and ET1 receptor (EDNRA; 131243) genes do not map to 22q11, the DiGeorge syndrome critical region, in human S. In a screen for mouse genes dependent on dHAND, Yamagishi et al. (1999) identified Ufd1, which maps to human 22q11 and encodes a protein involved in degradation of ubiquitinated proteins. Mouse Ufd1 was specifically expressed in most tissues affected in patients with the DiGeorge (22q11 deletion) syndrome. Yamagishi et al. (1999) found, furthermore, that the human UFD1L gene was deleted in all 182 patients studied with the 22q11 deletion, and a smaller deletion of approximately 20 kb that removed exons 1 to 3 of UFD1L was found in 1 individual with features typical of 22q11 deletion syndrome. In the individual with the smaller deletion, patient J. F., Yamagishi et al. (1999) found that the CDC45L gene (OMIM Ref. No. 603465), which is immediately telomeric of UFD1L, was the site of the deletion in the region between exons 5 and 6 of the 5-prime breakpoint. They considered that the deletion in CDC45L may act as a modifier of the phenotype in patient J. F. UFD1L and CDC45L are transcribed in opposite directions. The deletion left exons 4 to 12 of UFD1L intact; the first 5 exons of CDC45L were deleted. Patient J. F. had nearly all of the features commonly associated with the 2-Mb 22q11 deletion. Four days after birth the patient was diagnosed with interrupted aortic arch, persistent truncus arteriosus, cleft palate, small mouth, low-set ears, broad nasal bridge, neonatal hypocalcemia, T-lymphocyte deficiency, and syndactyly of her toes. The deletion was not present in her parents or in 100 control subjects.

Full details of the abovementioned studies are described in the following publications, the disclosure of which are hereby incorporated by reference:

Pizutti, A.; Novelli, G.; Ratti, A.; Amati, F.; Mari, A.; Calabrese, G.; Nicolis, S.; Silani, V.; Marino, B.; Scarlato, G.; Ottolenghi, S.; Dallapiccola, B.: UFD1L, a developmentally expressed ubiquitination gene, is deleted in CATCH 22 syndrome. Hum. Molec. Genet. 6:259-265, 1997; and Yamagishi, H.; Garg, V.; Matsuoka, R.; Thomas, T.; Srivastava, D.: A molecular pathway revealing a genetic basis for human cardiac and craniofacial defects. Science 283:1158-1161, 199.

Further studies establishing the function and utilities of UFD1L are found in John Hopkins OMIM database record ID 601754, and in sited publications numbered 6233-6234 listed in the bibliography section hereinbelow, which are also hereby incorporated by reference. BANP (Accession XM_038696) is another VGAM87 host target gene. BANP BINDING SITE is HOST TARGET binding site found in the 5' untranslated region of mRNA encoded by BANP, corresponding to a HOST TARGET binding site such as BINDING SITE I, BINDING SITE II or BINDING SITE III. Table 2 illustrates the complementarity of the nucleotide sequences of BANP BINDING SITE, designated SEQ ID:32911, to the nucleotide sequence of VGAM87 RNA, herein designated VGAM RNA, also designated SEQ ID:2798.

Another function of VGAM87 is therefore inhibition of BANP (Accession XM_038696). Accordingly, utilities of VGAM87 include diagnosis, prevention and treatment of diseases and clinical conditions associated with BANP. Chromosome 20 Open Reading Frame 59 (C20orf59, Accession NM_022082) is another VGAM87 host target gene. C20orf59 BINDING SITE is HOST TARGET binding site found in the 3' untranslated region of mRNA encoded by C20orf59, corresponding to a HOST TARGET binding site such as BINDING SITE I, BINDING SITE II or BINDING SITE III. Table 2 illustrates the complementarity of the nucleotide sequences of C20orf59 BINDING SITE, designated SEQ ID:22624, to the nucleotide sequence of VGAM87 RNA, herein designated VGAM RNA, also designated SEQ ID:2798.

Another function of VGAM87 is therefore inhibition of Chromosome 20 Open Reading Frame 59 (C20orf59, Accession NM_022082). Accordingly, utilities of VGAM87 include diagnosis, prevention and treatment of diseases and clinical conditions associated with C20orf59. CLIPR-59 (Accession NM_015526) is another VGAM87 host target gene. CLIPR-59 BINDING SITE is HOST TARGET binding site found in the 3' untranslated region of mRNA encoded by CLIPR-59, corresponding to a HOST TARGET binding site such as BINDING SITE I, BINDING SITE II or BINDING SITE III. Table 2 illustrates the complementarity of the nucleotide sequences of CLIPR-59 BINDING SITE, designated SEQ ID:17786, to the nucleotide sequence of VGAM87 RNA, herein designated VGAM RNA, also designated SEQ ID:2798.

Another function of VGAM87 is therefore inhibition of CLIPR-59 (Accession NM_015526). Accordingly, utilities of VGAM87 include diagnosis, prevention and treatment of diseases and clinical conditions associated with CLIPR-59. FLJ10898 (Accession XM_002486) is another VGAM87 host target gene. FLJ10898 BINDING SITE is HOST TARGET binding site found in the 5' untranslated region of mRNA encoded by FLJ10898, corresponding to a HOST TARGET binding site such as BINDING SITE I, BINDING SITE II or BINDING SITE III. Table 2 illustrates the complementarity of the nucleotide sequences of FLJ10898 BINDING SITE, designated SEQ ID:29890, to the nucleotide sequence of VGAM87 RNA, herein designated VGAM RNA, also designated SEQ ID:2798.

Another function of VGAM87 is therefore inhibition of FLJ10898 (Accession XM_002486). Accordingly, utilities of VGAM87 include diagnosis, prevention and treatment of diseases and clinical conditions associated with FLJ10898. KIAA0350 (Accession XM_028332) is another VGAM87 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30664, to the nucleotide sequence of VGAM87 RNA, herein designated VGAM RNA, also designated SEQ ID:2798.

Another function of VGAM87 is therefore inhibition of KIAA0350 (Accession XM_028332). Accordingly, utilities of VGAM87 include diagnosis, prevention and treatment of diseases and clinical conditions associated with KIAA0350. FIG. 1 further provides a conceptual description of a novel bioinformatically detected viral gene of the present invention, referred to here as Viral Genomic Address Messenger 88 (VGAM88) viral gene, which modulates expression of respective host target genes thereof, the function and utility of which host target genes is known in the art.

VGAM88 is a novel bioinformatically detected regulatory, non protein coding, viral micro RNA (miRNA) gene. The method by which VGAM88 was detected is described hereinabove with reference to FIGS. 1-8.

VGAM88 gene, herein designated VGAM GENE, is a viral gene contained in the genome of Plutella Xylostella Granulovirus. VGAM88 host target gene, herein designated VGAM HOST TARGET GENE, is a human gene contained in the human genome.

VGAM88 gene encodes a VGAM88 precursor RNA, herein designated VGAM PRECURSOR RNA. Similar to other miRNA genes, and unlike most ordinary genes, VGAM88 precursor RNA does not encode a protein. A nucleotide sequence identical or highly similar to the nucleotide sequence of VGAM88 precursor RNA is designated SEQ ID:74, and is provided hereinbelow with reference to the sequence listing part. Nucleotide sequence SEQ ID:74 is located at position 66710 relative to the genome of Plutella Xylostella Granulovirus.

VGAM88 precursor RNA folds onto itself, forming VGAM88 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM88 folded precursor RNA into VGAM88 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM88 RNA is designated SEQ ID:2799, and is provided hereinbelow with reference to the sequence listing part.

VGAM88 host target gene, herein designated VGAM HOST TARGET GENE, encodes a corresponding messenger RNA, VGAM88 host target RNA, herein designated VGAM HOST TARGET RNA. VGAM88 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM88 RNA, herein designated VGAM RNA, binds complementarily to one or more host target binding sites located in untranslated regions of VGAM88 host target RNA, herein designated VGAM HOST TARGET RNA. This complementary binding is due to the fact that the nucleotide sequence of VGAM88 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM88 RNA, herein designated VGAM RNA, may have a different number of host target binding sites in untranslated regions of a VGAM88 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM88 RNA, herein designated VGAM RNA, to host target binding sites on VGAM88 host target RNA, herein designated VGAM HOST TARGET RNA, such as BINDING SITE I, BINDING SITE II and BINDING SITE III, inhibits translation of VGAM88 host target RNA into VGAM88 host target protein, herein designated VGAM HOST TARGET PROTEIN. VGAM host target protein is therefore outlined by a broken line.

It is appreciated that VGAM88 host target gene, herein designated VGAM HOST TARGET GENE, in fact represents a plurality of VGAM88 host target genes. The mRNA of each one of this plurality of VGAM88 host target genes comprises one or more host target binding sites, each having a nucleotide sequence which is at least partly complementary to VGAM88 RNA, herein designated VGAM RNA, and which when bound by VGAM88 RNA causes inhibition of translation of respective one or more VGAM88 host target proteins.

It is further appreciated by one skilled in the art that the mode of translational inhibition illustrated by FIG. 1 with specific reference to translational inhibition exerted by VGAM88 gene, herein designated VGAM GENE, on one or more VGAM88 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM88 is inhibition of expression of host target genes, as part of a novel viral mechanism of attacking a host. Accordingly, utilities of VGAM88 include diagnosis, prevention and treatment of viral infection by Plutella Xylostella Granulovirus. Specific functions, and accordingly utilities, of VGAM88 correlate with, and may be deduced from, the identity of the host target genes which VGAM88 binds and inhibits, and the function of these host target genes, as elaborated hereinbelow.

Nucleotide sequences of the VGAM88 precursor RNA, herein designated VGAM PRECURSOR RNA, and of the 'diced' VGAM88 RNA, herein designated VGAM RNA, and a schematic representation of the secondary folding of VGAM88 folded precursor RNA, herein designated VGAM FOLDED PRECURSOR RNA, of VGAM88 are further described hereinbelow with reference to Table 1.

Nucleotide sequences of host target binding sites, such as BINDING SITE-I, BINDING SITE-II and BINDING SITE-III of FIG. 1, found on VGAM88 host target RNA, and schematic representation of the complementarity of each of these host target binding sites to VGAM88 RNA, herein designated VGAM RNA, are described hereinbelow with reference to Table 2.

As mentioned hereinabove with reference to FIG. 1, a function of VGAM88 gene, herein designated VGAM is inhibition of expression of VGAM88 target genes. It is appreciated that specific functions, and accordingly utilities, of VGAM88 correlate with, and may be deduced from, the identity of the target genes which VGAM88 binds and inhibits, and the function of these target genes, as elaborated hereinbelow.

Actinin, Alpha 2 (ACTN2, Accession NM_001103) is a VGAM88 host target gene. ACTN2 BINDING SITE is HOST TARGET binding site found in the 3' untranslated region of mRNA encoded by ACTN2, corresponding to a HOST TARGET binding site such as BINDING SITE I, BINDING SITE II or BINDING SITE III. Table 2 illustrates the complementarity of the nucleotide sequences of ACTN2 BINDING SITE, designated SEQ ID:6759, to the nucleotide sequence of VGAM88 RNA, herein designated VGAM RNA, also designated SEQ ID:2799.

A function of VGAM88 is therefore inhibition of Actinin, Alpha 2 (ACTN2, Accession NM_001103), a gene which an actin-binding protein with multiple roles in different cell types. Accordingly, utilities of VGAM88 include diagnosis, prevention and treatment of diseases and clinical conditions associated with ACTN2. The function of ACTN2 has been established by previous studies. Alpha-actinin is an actin-binding protein with multiple roles in different cell types. In nonmuscle cells, the cytoskeletal isoform is found along microfilament bundles and adherens-type junctions, where it is involved in binding actin to the membrane (see OMIM Ref. No. ACTN1; 102575). In contrast, skeletal, cardiac, and smooth muscle isoforms are localized to the Z-disc and analogous dense bodies, where they help anchor the myofibrillar actin filaments. Beggs et al. (1992) characterized 2 human muscle-specific alpha-actinin genes, ACTN2 and ACTN3 (OMIM Ref. No. 102574). Using somatic cell hybrids, Beggs et al. (1992) mapped the ACTN2 and ACTN3 genes to chromosomes 1 and 11, respectively. In situ hybridization placed the ACTN2 locus at 1q42-q43. Beggs et al. (1992) identified a polymorphic (CA) n repeat within the ACTN2 gene and used it to position the ACTN2 gene on the CEPH linkage map of chromosome 1.

Full details of the abovementioned studies are described in the following publications, the disclosure of which are hereby incorporated by reference:

Beggs, A. H.; Byers, T. J.; Knoll, J. H. M.; Boyce, F. M.; Bruns, G. A. P.; Kunkel, L. M.: Cloning and characterization of two human skeletal muscle alpha-actinin genes located on chromosomes 1 and 11. J. Biol. Chem. 267:9281-9288, 1992; and Beggs, A. H.; Phillips, H. A.; Kozman, H.; Mulley, J. C.; Wilton, S. D.; Kunkel, L. M.; Laing, N. G.: A (CA) n repeat polymorphism for the human skeletal muscle alpha-actinin gene ACTN2.

Further studies establishing the function and utilities of ACTN2 are found in John Hopkins OMIM database record ID 102573, and in sited publications numbered 4264-4266 listed in the bibliography section hereinbelow, which are also hereby incorporated by reference. Chromosome 1 Open Reading Frame 22 (C1orf22, Accession NM_025191) is another VGAM88 host target gene. C1orf22 BINDING SITE is HOST TARGET binding site found in the 3' untranslated region of mRNA encoded by C1orf22, corresponding to a HOST TARGET binding site such as BINDING SITE I, BINDING SITE II or BINDING SITE III. Table 2 illustrates the complementarity of the nucleotide sequences of C1orf22 BINDING SITE, designated SEQ ID:24840, to the nucleotide sequence of VGAM88 RNA, herein designated VGAM RNA, also designated SEQ ID:2799.

Another function of VGAM88 is therefore inhibition of Chromosome 1 Open Reading Frame 22 (C1orf22, Accession NM_025191). Accordingly, utilities of VGAM88 include diagnosis, prevention and treatment of diseases and clinical conditions associated with C1orf22. LOC114932 (Accession XM_052614) is another VGAM88 host target gene. LOC114932 BINDING SITE is HOST TARGET binding site found in the 3' untranslated region of mRNA encoded by LOC114932, corresponding to a HOST TARGET binding site such as BINDING SITE I, BINDING SITE II or BINDING SITE III. Table 2 illustrates the complementarity of the nucleotide sequences of LOC114932 BINDING SITE, designated SEQ ID:36004, to the nucleotide sequence of VGAM88 RNA, herein designated VGAM RNA, also designated SEQ ID:2799.

Another function of VGAM88 is therefore inhibition of LOC114932 (Accession XM_052614). Accordingly, utilities of VGAM88 include diagnosis, prevention and treatment of diseases and clinical conditions associated with LOC114932. LOC119369 (Accession XM_061434) is another VGAM88 host target gene. LOC119369 BINDING SITE is HOST TARGET binding site found in the 3' untranslated region of mRNA encoded by LOC119369, corresponding to a HOST TARGET binding site such as BINDING SITE I, BINDING SITE II or BINDING SITE III. Table 2 illustrates the complementarity of the nucleotide sequences of LOC119369 BINDING SITE, designated SEQ ID:37206, to the nucleotide sequence of VGAM88 RNA, herein designated VGAM RNA, also designated SEQ ID:2799.

Another function of VGAM88 is therefore inhibition of LOC119369 (Accession XM_061434). Accordingly, utilities of VGAM88 include diagnosis, prevention and treatment of diseases and clinical conditions associated with LOC119369. LOC255533 (Accession XM_173073) is another VGAM88 host target gene. LOC255533 BINDING SITE is HOST TARGET binding site found in the 5' untranslated region of mRNA encoded by LOC255533, corresponding to a HOST TARGET binding site such as BINDING SITE I, BINDING SITE II or BINDING SITE III. Table 2 illustrates the complementarity of the nucleotide sequences of LOC255533 BINDING SITE, designated SEQ ID:46330, to the nucleotide sequence of VGAM88 RNA, herein designated VGAM RNA, also designated SEQ ID:2799.

Another function of VGAM88 is therefore inhibition of LOC255533 (Accession XM_173073). Accordingly, utilities of VGAM88 include diagnosis, prevention and treatment of diseases and clinical conditions associated with LOC255533. FIG. 1 further provides a conceptual description of a novel bioinformatically detected viral gene of the present invention, referred to here as Viral Genomic Address Messenger 89 (VGAM89) viral gene, which modulates expression of respective host target genes thereof, the function and utility of which host target genes is known in the art.

VGAM89 is a novel bioinformatically detected regulatory, non protein coding, viral micro RNA (miRNA) gene. The method by which VGAM89 was detected is described hereinabove with reference to FIGS. 1-8.

VGAM89 gene, herein designated VGAM GENE, is a viral gene contained in the genome of Plutella Xylostella Granulovirus. VGAM89 host target gene, herein designated VGAM HOST TARGET GENE, is a human gene contained in the human genome.

VGAM89 gene encodes a VGAM89 precursor RNA, herein designated VGAM PRECURSOR RNA. Similar to other miRNA genes, and unlike most ordinary genes, VGAM89 precursor RNA does not encode a protein. A nucleotide sequence identical or highly similar to the nucleotide sequence of VGAM89 precursor RNA is designated SEQ ID:75, and is provided hereinbelow with reference to the sequence listing part. Nucleotide sequence SEQ ID:75 is located at position 9283 relative to the genome of Plutella Xylostella Granulovirus.

VGAM89 precursor RNA folds onto itself, forming VGAM89 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM89 folded precursor RNA into VGAM89 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM89 RNA is designated SEQ ID:2800, and is provided hereinbelow with reference to the sequence listing part.

VGAM89 host target gene, herein designated VGAM HOST TARGET GENE, encodes a corresponding messenger RNA, VGAM89 host target RNA, herein designated VGAM HOST TARGET RNA. VGAM89 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM89 RNA, herein designated VGAM RNA, binds complementarily to one or more host target binding sites located in untranslated regions of VGAM89 host target RNA, herein designated VGAM HOST TARGET RNA. This complementary binding is due to the fact that the nucleotide sequence of VGAM89 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM89 RNA, herein designated VGAM RNA, may have a different number of host target binding sites in untranslated regions of a VGAM89 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM89 RNA, herein designated VGAM RNA, to host target binding sites on VGAM89 host target RNA, herein designated VGAM HOST TARGET RNA, such as BINDING SITE I, BINDING SITE II and BINDING SITE III, inhibits translation of VGAM89 host target RNA into VGAM89 host target protein, herein designated VGAM HOST TARGET PROTEIN. VGAM host target protein is therefore outlined by a broken line.

It is appreciated that VGAM89 host target gene, herein designated VGAM HOST TARGET GENE, in fact represents a plurality of VGAM89 host target genes. The mRNA of each one of this plurality of VGAM89 host target genes comprises one or more host target binding sites, each having a nucleotide sequence which is at least partly complementary to VGAM89 RNA, herein designated VGAM RNA, and which when bound by VGAM89 RNA causes inhibition of translation of respective one or more VGAM89 host target proteins.

It is further appreciated by one skilled in the art that the mode of translational inhibition illustrated by FIG. 1 with specific reference to translational inhibition exerted by VGAM89 gene, herein designated VGAM GENE, on one or more VGAM89 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM89 is inhibition of expression of host target genes, as part of a novel viral mechanism of attacking a host. Accordingly, utilities of VGAM89 include diagnosis, prevention and treatment of viral infection by Plutella Xylostella Granulovirus. Specific functions, and accordingly utilities, of VGAM89 correlate with, and may be deduced from, the identity of the host target genes which VGAM89 binds and inhibits, and the function of these host target genes, as elaborated hereinbelow.

Nucleotide sequences of the VGAM89 precursor RNA, herein designated VGAM PRECURSOR RNA, and of the 'diced' VGAM89 RNA, herein designated VGAM RNA, and a schematic representation of the secondary folding of VGAM89 folded precursor RNA, herein designated VGAM FOLDED PRECURSOR RNA, of VGAM89 are further described hereinbelow with reference to Table 1.

Nucleotide sequences of host target binding sites, such as BINDING SITE-I, BINDING SITE-II and BINDING SITE-III of FIG. 1, found on VGAM89 host target RNA, and schematic representation of the complementarity of each of these host target binding sites to VGAM89 RNA, herein designated VGAM RNA, are described hereinbelow with reference to Table 2.

As mentioned hereinabove with reference to FIG. 1, a function of VGAM89 gene, herein designated VGAM is inhibition of expression of VGAM89 target genes. It is appreciated that specific functions, and accordingly utilities, of VGAM89 correlate with, and may be deduced from, the identity of the target genes which VGAM89 binds and inhibits, and the function of these target genes, as elaborated hereinbelow.

Inhibin, Beta C (INHBC, Accession NM_005538) is a VGAM89 host target gene. INHBC BINDING SITE is HOST TARGET binding site found in the 3" untranslated region of mRNA encoded by INHBC, corresponding to a HOST TARGET binding site such as BINDING SITE I, BINDING SITE II or BINDING SITE III. Table 2 illustrates the complementarity of the nucleotide sequences of INHBC BINDING SITE, designated SEQ ID:12064, to the nucleotide sequence of VGAM89 RNA, herein designated VGAM RNA, also designated SEQ ID:2800.

A function of VGAM89 is therefore inhibition of Inhibin, Beta C (INHBC, Accession NM_005538), a gene which inhibits the secretion of follitropin by the pituitary gland. Accordingly, utilities of VGAM89 include diagnosis, prevention and treatment of diseases and clinical conditions associated with INHBC. The function of INHBC has been established by previous studies. Activins are homo- or heterodimers of related beta subunits (see OMIM Ref. No. 147290) while inhibins are dimers composed of an alpha subunit (OMIM Ref. No. 147380) and an activin beta subunit (summarized in Schmitt et al., 1996). These proteins belong to the TGF-beta superfamily (see OMIM Ref. No. 190180), the members of which have important roles in cell determination, differentiation, and growth. Members of the inhibin/activin subgroup were originally identified by their opposing roles in the control of follicle-stimulating hormone (OMIM Ref. No. 118850) release by cultured pituitary cells (Ling et al., 1986). Activin ligands act as growth and differentiation factors in many cells and tissues. Mellor et al. (2000) examined the localization of and dimerization among activin subunits. The results demonstrated that activin beta-C can form dimers with activin beta-A and beta-B in vitro, but not with the inhibin alpha subunit. Using a specific antibody, activin beta-C protein was localized to human liver and prostate and colocalized with beta-A and beta-B subunits to specific cell types in benign and malignant prostate tissues. The capacity to form novel activin heterodimers (but not inhibin C) appears to reside in the human liver and prostate. The authors concluded that formation of activin AC or BC heterodimers may have significant implications in the regulation of levels and/or biologic activity of other activins in these tissues.

Full details of the abovementioned studies are described in the following publications, the disclosure of which are hereby incorporated by reference:

Schmitt, J.; Hotten, G.; Jenkins, N. A.; Gilbert, D. J.; Copeland, N. G.; Pohl, J.; Schrewe, H.: Structure, chromosomal localization, and expression analysis of the mouse inhibin/activin betaC (Inhbc) gene. Genomics 32:358-366, 1996; and Mellor, S. L.; Cranfield, M.; Ries, R.; Pedersen, J.; Cancilla, B.; de Kretser, D.; Groome, N. P.; Mason, A. J.; Risbridger, G. P.: Localization of activin beta (A)-, beta (B)-, and beta (.

Further studies establishing the function and utilities of INHBC are found in John Hopkins OMIM database record ID 601233, and in sited publications numbered 2834-283 and 5243 listed in the bibliography section hereinbelow, which are also hereby incorporated by reference. Pleiomorphic Adenoma Gene-like 1 (PLAGL1, Accession NM_002656) is another VGAM89 host target gene. PLAGL1 BINDING SITE is HOST TARGET binding site found in the 3' untranslated region of mRNA encoded by PLAGL1, corresponding to a HOST TARGET binding site such as BINDING SITE I, BINDING SITE II or BINDING SITE III. Table 2 illustrates the complementarity of the nucleotide sequences of PLAGL1 BINDING SITE, designated SEQ ID:8530, to the nucleotide sequence of VGAM89 RNA, herein designated VGAM RNA, also designated SEQ ID:2800.

Another function of VGAM89 is therefore inhibition of Pleiomorphic Adenoma Gene-like 1 (PLAGL1, Accession NM_002656), a gene which regulates apoptosis and cell cycle arrest. Accordingly, utilities of VGAM89 include diagnosis, prevention and treatment of diseases and clinical conditions associated with PLAGL1. The function of PLAGL1 has been established by previous studies. Cell proliferation is regulated through connected molecular pathways controlling cell division, differentiation, growth arrest, and apoptosis. A tight control of these events is necessary to the maintenance of homeostasis from development to senescence and involves multiple genes. Dysregulation of some of these genes can lead to pathologic situations such as neurodegenerative disorders, immunodeficiency syndromes, and cancer. Early studies on tumor development focused on oncogenes, the genes whose gain of function leads to enhanced cell growth. The inactivation of a tumor suppressor gene, in contrast, can contribute to the growth deregulation of a tumor cell. This tumor suppressor gene inactivation can occur through a loss-of-function mutation accompanied by a loss of heterozygosity, homozygous deletion, or epigenetic mechanisms. Several lines of evidence suggest a tumor suppressor function to a candidate gene: involvement in familial predisposition to cancer, inactivation in human tumors, tumor formation in null-mutant mice, and functional properties compatible with a role in cell proliferation or development. The candidates in which all of these criteria had been fulfilled include p53 (OMIM Ref. No. 191170), RB (OMIM Ref. No. 180200), p16 (OMIM Ref. No. 600160), and VHL (OMIM Ref. No. 193300). Spengler et al. (1997) isolated a novel mouse gene, designated Zac, which encodes a protein with 7 zinc fingers of the C2H2 type that is only distantly related to previously isolated zinc finger proteins and that inhibits tumor cell proliferation in vitro and in vivo in nude mice. They showed that these antiproliferative properties ensued from the regulation of 2 pathways critical to the activity of p53, i.e., cell cycle progression and apoptosis. Thus, mouse Zac was the first gene unrelated to p53 that was found to regulate these 2 fundamental genetic programs. The authors hypothesized that Zac also could share with p53 its tumor suppressor activity and isolated the human homolog of Zac to investigate its putative tumor suppressor function. They found that human ZAC is a widely expressed zinc finger protein that shows transactivation and DNA-binding activities. Furthermore, like its mouse counterpart and p53, ZAC inhibits tumor cell proliferation through the induction of both apoptosis and cell cycle arrest. Kamiya et al. (2000) described a screen for new imprinted human genes, and in this way identified the ZAC/PLAGL1 gene as a strong candidate for transient neonatal diabetes mellitus (TNDM; 601410). To screen for imprinted genes, they compared parthenogenetic DNA from a chimeric patient FD and androgenetic DNA from hydatidiform mole, using restriction landmark genome scanning for methylation. This resulted in identification of 2 novel imprinted loci, one of which (NV149) mapped to the TNDM region of 6q24. From analysis of the corresponding genomic region, it was determined that NV149 lies approximately 60 kb upstream of the ZAC/PLAGL1 gene. RT-PCR analysis was used to confirm that the ZAC/PLAGL1 gene is expressed only from the paternal allele in a variety of tissues. TNDM is known to result from upregulation of a paternally expressed gene on 6q24. Kamiya et al. (2000) pointed to the paternal expression, map position, and known biologic properties of ZAC/PLAGL1 as making it highly likely that it is the TNDM gene. In particular, ZAC/PLAGL1 is a transcriptional regulator of the type 1 receptor for pituitary adenylate cyclase-activating polypeptide (OMIM Ref. No. 102981), which is the most potent known insulin secretagogue and an important mediator of autocrine control of insulin secretion in the pancreatic islet.

Full details of the abovementioned studies are described in the following publications, the disclosure of which are hereby incorporated by reference:

Spengler, D.; Villalba, M.; Hoffmann, A.; Pantaloni, C.; Houssami, S.; Bockaert, J.; Journot, L.: Regulation of apoptosis and cell cycle arrest by Zac1, a novel zinc finger protein expressed in the pituitary gland and the brain. EMBO J. 16: 2814-2825, 1997; and Kamiya, M.; Judson, H.; Okazaki, Y.; Kusakabe, M.; Muramatsu, M.; Takada, S.; Takagi, N.; Arima, T.; Wake, N.; Kamimura, K.; Satomura, K.; Hermann, R.; Bonthron, D. T.; Hayashizaki, Y..

Further studies establishing the function and utilities of PLAGL1 are found in John Hopkins OMIM database record ID 603044, and in sited publications numbered 8651-8652, 7188, 8653-8647, 684 and 8648-8649 listed in the bibliography section hereinbelow, which are also hereby incorporated by reference. DKFZP434G1411 (Accession XM_166383) is another VGAM89 host target gene. DKFZP434G1411 BINDING SITE is HOST TARGET binding site found in the 3' untranslated region of mRNA encoded by DKFZP434G1411, corresponding to a HOST TARGET binding site such as BINDING SITE I, BINDING SITE II or BINDING SITE III. Table 2 illustrates the complementarity of the nucleotide sequences of DKFZP434G1411 BINDING SITE, designated SEQ ID:44232, to the nucleotide sequence of VGAM89 RNA, herein designated VGAM RNA, also designated SEQ ID:2800.

Another function of VGAM89 is therefore inhibition of DKFZP434G1411 (Accession XM_166383). Accordingly, utilities of VGAM89 include diagnosis, prevention and treatment of diseases and clinical conditions associated with DKFZP434G1411. LOC91409 (Accession XM_038298) is another VGAM89 host target gene. LOC91409 BINDING SITE is HOST TARGET binding site found in the 3' untranslated region of mRNA encoded by LOC91409, corresponding to a HOST TARGET binding site such as BINDING SITE I, BINDING SITE II or BINDING SITE III. Table 2 illustrates the complementarity of the nucleotide sequences of LOC91409 BINDING SITE, designated SEQ ID:32804, to the nucleotide sequence of VGAM89 RNA, herein designated VGAM RNA, also designated SEQ ID:2800.

Another function of VGAM89 is therefore inhibition of LOC91409 (Accession XM_038298). Accordingly, utilities of VGAM89 include diagnosis, prevention and treatment of diseases and clinical conditions associated with LOC91409. FIG. 1 further provides a conceptual description of a novel bioinformatically detected viral gene of the present invention, referred to here as Viral Genomic Address Messenger 90 (VGAM90) viral gene, which modulates expression of respective host target genes thereof, the function and utility of which host target genes is known in the art.

VGAM90 is a novel bioinformatically detected regulatory, non protein coding, viral micro RNA (miRNA) gene. The method by which VGAM90 was detected is described hereinabove with reference to FIGS. 1-8.

VGAM90 gene, herein designated VGAM GENE, is a viral gene contained in the genome of Plutella Xylostella Granulovirus. VGAM90 host target gene, herein designated VGAM HOST TARGET GENE, is a human gene contained in the human genome.

VGAM90 gene encodes a VGAM90 precursor RNA, herein designated VGAM PRECURSOR RNA. Similar to other miRNA genes, and unlike most ordinary genes, VGAM90 precursor RNA does not encode a protein. A nucleotide sequence identical or highly similar to the nucleotide sequence of VGAM90 precursor RNA is designated SEQ ID:76, and is provided hereinbelow with reference to the sequence listing part. Nucleotide sequence SEQ ID:76 is located at position 15285 relative to the genome of Plutella Xylostella Granulovirus.

VGAM90 precursor RNA folds onto itself, forming VGAM90 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM90 folded precursor RNA into VGAM90 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM90 RNA is designated SEQ ID:2801, and is provided hereinbelow with reference to the sequence listing part.

VGAM90 host target gene, herein designated VGAM HOST TARGET GENE, encodes a corresponding messenger RNA, VGAM90 host target RNA, herein designated VGAM HOST TARGET RNA. VGAM90 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM90 RNA, herein designated VGAM RNA, binds complementarily to one or more host target binding sites located in untranslated regions of VGAM90 host target RNA, herein designated VGAM HOST TARGET RNA. This complementary binding is due to the fact that the nucleotide sequence of VGAM90 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM90 RNA, herein designated VGAM RNA, may have a different number of host target binding sites in untranslated regions of a VGAM90 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM90 RNA, herein designated VGAM RNA, to host target binding sites on VGAM90 host target RNA, herein designated VGAM HOST TARGET RNA, such as BINDING SITE I, BINDING SITE II and BINDING SITE III, inhibits translation of VGAM90 host target RNA into VGAM90 host target protein, herein designated VGAM HOST TARGET PROTEIN. VGAM host target protein is therefore outlined by a broken line.

It is appreciated that VGAM90 host target gene, herein designated VGAM HOST TARGET GENE, in fact represents a plurality of VGAM90 host target genes. The mRNA of each one of this plurality of VGAM90 host target genes comprises one or more host target binding sites, each having a nucleotide sequence which is at least partly complementary to VGAM90 RNA, herein designated VGAM RNA, and which when bound by VGAM90 RNA causes inhibition of translation of respective one or more VGAM90 host target proteins.

It is further appreciated by one skilled in the art that the mode of translational inhibition illustrated by FIG. 1 with specific reference to translational inhibition exerted by VGAM90 gene, herein designated VGAM GENE, on one or more VGAM90 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM90 is inhibition of expression of host target genes, as part of a novel viral mechanism of attacking a host. Accordingly, utilities of VGAM90 include diagnosis, prevention and treatment of viral infection by Plutella Xylostella Granulovirus. Specific functions, and accordingly utilities, of VGAM90 correlate with, and may be deduced from, the identity of the host target genes which VGAM90 binds and inhibits, and the function of these host target genes, as elaborated hereinbelow.

Nucleotide sequences of the VGAM90 precursor RNA, herein designated VGAM PRECURSOR RNA, and of the 'diced' VGAM90 RNA, herein designated VGAM RNA, and a schematic representation of the secondary folding of VGAM90 folded precursor RNA, herein designated VGAM FOLDED PRECURSOR RNA, of VGAM90 are further described hereinbelow with reference to Table 1.

Nucleotide sequences of host target binding sites, such as BINDING SITE-I, BINDING SITE-II and BINDING SITE-III of FIG. 1, found on VGAM90 host target RNA, and schematic representation of the complementarity of each of these host target binding sites to VGAM90 RNA, herein designated VGAM RNA, are described hereinbelow with reference to Table 2.

As mentioned hereinabove with reference to FIG. 1, a function of VGAM90 gene, herein designated VGAM is inhibition of expression of VGAM90 target genes. It is appreciated that specific functions, and accordingly utilities, of VGAM90 correlate with, and may be deduced from, the identity of the target genes which VGAM90 binds and inhibits, and the function of these target genes, as elaborated hereinbelow.

Aldehyde Dehydrogenase 3 Family, Member A2 (ALDH3A2, Accession XM_045060) is a VGAM90 host target gene. ALDH3A2 BINDING SITE is HOST TARGET binding site found in the 3' untranslated region of mRNA encoded by ALDH3A2, corresponding to a HOST TARGET binding site such as BINDING SITE I, BINDING SITE II or BINDING SITE III. Table 2 illustrates the complementarity of the nucleotide sequences of ALDH3A2 BINDING SITE, designated SEQ ID:34337, to the nucleotide sequence of VGAM90 RNA, herein designated VGAM RNA, also designated SEQ ID:2801.

A function of VGAM90 is therefore inhibition of Aldehyde Dehydrogenase 3 Family, Member A2 (ALDH3A2, Accession XM_045060). Accordingly, utilities of VGAM90 include diagnosis, prevention and treatment of diseases and clinical conditions associated with ALDH3A2. Bone Morphogenetic Protein Receptor, Type IA (BMPR1A, Accession NM_004329) is another VGAM90 host target gene. BMPR1A BINDING SITE is HOST TARGET binding site found in the 5' untranslated region of mRNA encoded by BMPR1A, corresponding to a HOST TARGET binding site such as BINDING SITE I, BINDING SITE II or BINDING SITE III. Table 2 illustrates the complementarity of the nucleotide sequences of BMPR1A BINDING SITE, designated SEQ ID:10528, to the nucleotide sequence of VGAM90 RNA, herein designated VGAM RNA, also designated SEQ ID:2801.

Another function of VGAM90 is therefore inhibition of Bone Morphogenetic Protein Receptor, Type IA (BMPR1A, Accession NM_004329). Accordingly, utilities of VGAM90 include diagnosis, prevention and treatment of diseases and clinical conditions associated with BMPR1A. Endothelial Cell-specific Molecule 1 (ESM1, Accession NM_007036) is another VGAM90 host target gene. ESM1 BINDING SITE is HOST TARGET binding site found in the 3' untranslated region of mRNA encoded by ESM1, corresponding to a HOST TARGET binding site such as BINDING SITE I, BINDING SITE II or BINDING SITE III. Table 2 illustrates the complementarity of the nucleotide sequences of ESM1 BINDING SITE, designated SEQ ID:13911, to the nucleotide sequence of VGAM90 RNA, herein designated VGAM RNA, also designated SEQ ID:2801.

Another function of VGAM90 is therefore inhibition of Endothelial Cell-specific Molecule 1 (ESM1, Accession NM_007036). Accordingly, utilities of VGAM90 include diagnosis, prevention and treatment of diseases and clinical conditions associated with ESM1. KIAA0408 (Accession NM_014702) is another VGAM90 host target gene. KIAA0408 BINDING SITE is HOST TARGET binding site found in the 3' untranslated region of mRNA encoded by KIAA0408, corresponding to a HOST TARGET binding site such as BINDING SITE I, BINDING SITE II or BINDING SITE III. Table 2 illustrates the complementarity of the nucleotide sequences of KIAA0408 BINDING SITE, designated SEQ ID:16234, to the nucleotide sequence of VGAM90 RNA, herein designated VGAM RNA, also designated SEQ ID:2801.

Another function of VGAM90 is therefore inhibition of KIAA0408 (Accession NM_014702). Accordingly, utilities of VGAM90 include diagnosis, prevention and treatment of diseases and clinical conditions associated with KIAA0408. LOC57117 (Accession NM_020395) is another VGAM90 host target gene. LOC57117 BINDING SITE is HOST TARGET binding site found in the 5' untranslated region of mRNA encoded by LOC57117, corresponding to a HOST TARGET binding site such as BINDING SITE I, BINDING SITE II or BINDING SITE III. Table 2 illustrates the complementarity of the nucleotide sequences of LOC57117 BINDING SITE, designated SEQ ID:21664, to the nucleotide sequence of VGAM90 RNA, herein designated VGAM RNA, also designated SEQ ID:2801.

Another function of VGAM90 is therefore inhibition of LOC57117 (Accession NM_020395). Accordingly, utilities of VGAM90 include diagnosis, prevention and treatment of diseases and clinical conditions associated with LOC57117. LOC91585 (Accession XM_039395) is another VGAM90 host target gene. LOC91585 BINDING SITE is HOST TARGET binding site found in the 5' untranslated region of mRNA encoded by LOC91585, corresponding to a HOST TARGET binding site such as BINDING SITE I, BINDING SITE II or BINDING SITE III. Table 2 illustrates the complementarity of the nucleotide sequences of LOC91585 BINDING SITE, designated SEQ ID:33075, to the nucleotide sequence of VGAM90 RNA, herein designated VGAM RNA, also designated SEQ ID:2801.

Another function of VGAM90 is therefore inhibition of LOC91585 (Accession XM_039395). Accordingly, utilities of VGAM90 include diagnosis, prevention and treatment of diseases and clinical conditions associated with LOC91585. FIG. 1 further provides a conceptual description of a novel bioinformatically detected viral gene of the present invention, referred to here as Viral Genomic Address Messenger 91 (VGAM91) viral gene, which modulates expression of respective host target genes thereof, the function and utility of which host target genes is known in the art.

VGAM91 is a novel bioinformatically detected regulatory, non protein coding, viral micro RNA (miRNA) gene. The method by which VGAM91 was detected is described hereinabove with reference to FIGS. 1-8.

VGAM91 gene, herein designated VGAM GENE, is a viral gene contained in the genome of Plutella Xylostella Granulovirus. VGAM91 host target gene, herein designated VGAM HOST TARGET GENE, is a human gene contained in the human genome.

VGAM91 gene encodes a VGAM91 precursor RNA, herein designated VGAM PRECURSOR RNA. Similar to other miRNA genes, and unlike most ordinary genes, VGAM91 precursor RNA does not encode a protein. A nucleotide sequence identical or highly similar to the nucleotide sequence of VGAM91 precursor RNA is designated SEQ ID:77, and is provided hereinbelow with reference to the sequence listing part. Nucleotide sequence SEQ ID:77 is located at position 20007 relative to the genome of Plutella Xylostella Granulovirus.

VGAM91 precursor RNA folds onto itself, forming VGAM91 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM91 folded precursor RNA into VGAM91 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM91 RNA is designated SEQ ID:2802, and is provided hereinbelow with reference to the sequence listing part.

VGAM91 host target gene, herein designated VGAM HOST TARGET GENE, encodes a corresponding messenger RNA, VGAM91 host target RNA, herein designated VGAM HOST TARGET RNA. VGAM91 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM91 RNA, herein designated VGAM RNA, binds complementarily to one or more host target binding sites located in untranslated regions of VGAM91 host target RNA, herein designated VGAM HOST TARGET RNA. This complementary binding is due to the fact that the nucleotide sequence of VGAM91 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM91 RNA, herein designated VGAM RNA, may have a different number of host target binding sites in untranslated regions of a VGAM91 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM91 RNA, herein designated VGAM RNA, to host target binding sites on VGAM91 host target RNA, herein designated VGAM HOST TARGET RNA, such as BINDING SITE I, BINDING SITE II and BINDING SITE III, inhibits translation of VGAM91 host target RNA into VGAM91 host target protein, herein designated VGAM HOST TARGET PROTEIN. VGAM host target protein is therefore outlined by a broken line.

It is appreciated that VGAM91 host target gene, herein designated VGAM HOST TARGET GENE, in fact represents a plurality of VGAM91 host target genes. The mRNA of each one of this plurality of VGAM91 host target genes comprises one or more host target binding sites, each having a nucleotide sequence which is at least partly complementary to VGAM91 RNA, herein designated VGAM RNA, and which when bound by VGAM91 RNA causes inhibition of translation of respective one or more VGAM91 host target proteins.

It is further appreciated by one skilled in the art that the mode of translational inhibition illustrated by FIG. 1 with specific reference to translational inhibition exerted by VGAM91 gene, herein designated VGAM GENE, on one or more VGAM91 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM91 is inhibition of expression of host target genes, as part of a novel viral mechanism of attacking a host. Accordingly, utilities of VGAM91 include diagnosis, prevention and treatment of viral infection by Plutella Xylostella Granulovirus. Specific functions, and accordingly utilities, of VGAM91 correlate with, and may be deduced from, the identity of the host target genes which VGAM91 binds and inhibits, and the function of these host target genes, as elaborated hereinbelow.

Nucleotide sequences of the VGAM91 precursor RNA, herein designated VGAM PRECURSOR RNA, and of the 'diced' VGAM91 RNA, herein designated VGAM RNA, and a schematic representation of the secondary folding of VGAM91 folded precursor RNA, herein designated VGAM FOLDED PRECURSOR RNA, of VGAM91 are further described hereinbelow with reference to Table 1.

Nucleotide sequences of host target binding sites, such as BINDING SITE-I, BINDING SITE-II and BINDING SITE-III of FIG. 1, found on VGAM91 host target RNA, and schematic representation of the complementarity of each of these host target binding sites to VGAM91 RNA, herein designated VGAM RNA, are described hereinbelow with reference to Table 2.

As mentioned hereinabove with reference to FIG. 1, a function of VGAM91 gene, herein designated VGAM is inhibition of expression of VGAM91 target genes. It is appreciated that specific functions, and accordingly utilities, of VGAM91 correlate with, and may be deduced from, the identity of the target genes which VGAM91 binds and inhibits, and the function of these target genes, as elaborated hereinbelow.

Succinate Dehydrogenase Complex, Subunit D, Integral Membrane Protein (SDHD, Accession NM_003002) is a VGAM91 host target gene. SDHD BINDING SITE is HOST TARGET binding site found in the 3' untranslated region of mRNA encoded by SDHD, corresponding to a HOST TARGET binding site such as BINDING SITE I, BINDING SITE II or BINDING SITE III. Table 2 illustrates the complementarity of the nucleotide sequences of SDHD BINDING SITE, designated SEQ ID:8898, to the nucleotide sequence of VGAM91 RNA, herein designated VGAM RNA, also designated SEQ ID:2802.

A function of VGAM91 is therefore inhibition of Succinate Dehydrogenase Complex, Subunit D, Integral Membrane Protein (SDHD, Accession NM_003002). Accordingly, utilities of VGAM91 include diagnosis, prevention and treatment of diseases and clinical conditions associated with SDHD. FLJ10324 (Accession NM_018059) is another VGAM91 host target gene. FLJ10324 BINDING SITE is HOST TARGET binding site found in the 5' untranslated region of mRNA encoded by FLJ10324, corresponding to a HOST TARGET binding site such as BINDING SITE I, BINDING SITE II or BINDING SITE III. Table 2 illustrates the complementarity of the nucleotide sequences of FLJ10324 BINDING SITE, designated SEQ ID:19828, to the nucleotide sequence of VGAM91 RNA, herein designated VGAM RNA, also designated SEQ ID:2802.

Another function of VGAM91 is therefore inhibition of FLJ10324 (Accession NM_018059). Accordingly, utilities of VGAM91 include diagnosis, prevention and treatment of diseases and clinical conditions associated with FLJ10324. LOC152876 (Accession XM_098279) is another VGAM91 host target gene. LOC152876 BINDING SITE is HOST TARGET binding site found in the 5' untranslated region of mRNA encoded by LOC152876, corresponding to a HOST TARGET binding site such as BINDING SITE I, BINDING SITE II or BINDING SITE III. Table 2 illustrates the complementarity of the nucleotide sequences of LOC152876 BINDING SITE, designated SEQ ID:41560, to the nucleotide sequence of VGAM91 RNA, herein designated VGAM RNA, also designated SEQ ID:2802.

Another function of VGAM91 is therefore inhibition of LOC152876 (Accession XM_098279). Accordingly, utilities of VGAM91 include diagnosis, prevention and treatment of diseases and clinical conditions associated with LOC152876. LOC221749 (Accession XM_166341) is another VGAM91 host target gene. LOC221749 BINDING SITE is HOST TARGET binding site found in the 3' untranslated region of mRNA encoded by LOC221749, corresponding to a HOST TARGET binding site such as BINDING SITE I, BINDING SITE II or BINDING SITE III. Table 2 illustrates the complementarity of the nucleotide sequences of LOC221749 BINDING SITE, designated SEQ ID:44178, to the nucleotide sequence of VGAM91 RNA, herein designated VGAM RNA, also designated SEQ ID:2802.

Another function of VGAM91 is therefore inhibition of LOC221749 (Accession XM_166341). Accordingly, utilities of VGAM91 include diagnosis, prevention and treatment of diseases and clinical conditions associated with LOC221749. FIG. 1 further provides a conceptual description of a novel bioinformatically detected viral gene of the present invention, referred to here as Viral Genomic Address Messenger 92 (VGAM92) viral gene, which modulates expression of respective host target genes thereof, the function and utility of which host target genes is known in the art.

VGAM92 is a novel bioinformatically detected regulatory, non protein coding, viral micro RNA (miRNA) gene. The method by which VGAM92 was detected is described hereinabove with reference to FIGS. 1-8.

VGAM92 gene, herein designated VGAM GENE, is a viral gene contained in the genome of Plutella Xylostella Granulovirus. VGAM92 host target gene, herein designated VGAM HOST TARGET GENE, is a human gene contained in the human genome.

VGAM92 gene encodes a VGAM92 precursor RNA, herein designated VGAM PRECURSOR RNA. Similar to other miRNA genes, and unlike most ordinary genes, VGAM92 precursor RNA does not encode a protein. A nucleotide sequence identical or highly similar to the nucleotide sequence of VGAM92 precursor RNA is designated SEQ ID:78, and is provided hereinbelow with reference to the sequence listing part. Nucleotide sequence SEQ ID:78 is located at position 54360 relative to the genome of Plutella Xylostella Granulovirus.

VGAM92 precursor RNA folds onto itself, forming VGAM92 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM92 folded precursor RNA into VGAM92 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM92 RNA is designated SEQ ID:2803, and is provided hereinbelow with reference to the sequence listing part.

VGAM92 host target gene, herein designated VGAM HOST TARGET GENE, encodes a corresponding messenger RNA, VGAM92 host target RNA, herein designated VGAM HOST TARGET RNA. VGAM92 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM92 RNA, herein designated VGAM RNA, binds complementarily to one or more host target binding sites located in untranslated regions of VGAM92 host target RNA, herein designated VGAM HOST TARGET RNA. This complementary binding is due to the fact that the nucleotide sequence of VGAM92 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM92 RNA, herein designated VGAM RNA, may have a different number of host target binding sites in untranslated regions of a VGAM92 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM92 RNA, herein designated VGAM RNA, to host target binding sites on VGAM92 host target RNA, herein designated VGAM HOST TARGET RNA, such as BINDING SITE I, BINDING SITE II and BINDING SITE III, inhibits translation of VGAM92 host target RNA into VGAM92 host target protein, herein designated VGAM HOST TARGET PROTEIN. VGAM host target protein is therefore outlined by a broken line.

It is appreciated that VGAM92 host target gene, herein designated VGAM HOST TARGET GENE, in fact represents a plurality of VGAM92 host target genes. The mRNA of each one of this plurality of VGAM92 host target genes comprises one or more host target binding sites, each having a nucleotide sequence which is at least partly complementary to VGAM92 RNA, herein designated VGAM RNA, and which when bound by VGAM92 RNA causes inhibition of translation of respective one or more VGAM92 host target proteins.

It is further appreciated by one skilled in the art that the mode of translational inhibition illustrated by FIG. 1 with specific reference to translational inhibition exerted by VGAM92 gene, herein designated VGAM GENE, on one or more VGAM92 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM92 is inhibition of expression of host target genes, as part of a novel viral mechanism of attacking a host. Accordingly, utilities of VGAM92 include diagnosis, prevention and treatment of viral infection by Plutella Xylostella Granulovirus. Specific functions, and accordingly utilities, of VGAM92 correlate with, and may be deduced from, the identity of the host target genes which VGAM92 binds and inhibits, and the function of these host target genes, as elaborated hereinbelow.

Nucleotide sequences of the VGAM92 precursor RNA, herein designated VGAM PRECURSOR RNA, and of the 'diced' VGAM92 RNA, herein designated VGAM RNA, and a schematic representation of the secondary folding of

1445

VGAM92 folded precursor RNA, herein designated VGAM FOLDED PRECURSOR RNA, of VGAM92 are further described hereinbelow with reference to Table 1.

Nucleotide sequences of host target binding sites, such as BINDING SITE-I, BINDING SITE-II and BINDING SITE-III of FIG. 1, found on VGAM92 host target RNA, and schematic representation of the complementarity of each of these host target binding sites to VGAM92 RNA, herein designated VGAM RNA, are described hereinbelow with reference to Table 2.

As mentioned hereinabove with reference to FIG. 1, a function of VGAM92 gene, herein designated VGAM is inhibition of expression of VGAM92 target genes. It is appreciated that specific functions, and accordingly utilities, of VGAM92 correlate with, and may be deduced from, the identity of the target genes which VGAM92 binds and inhibits, and the function of these target genes, as elaborated hereinbelow.

KIAA1045 (Accession XM_048592) is a VGAM92 host target gene. KIAA1045 BINDING SITE is HOST TARGET binding site found in the 3' untranslated region of mRNA encoded by KIAA1045, corresponding to a HOST TARGET binding site such as BINDING SITE I, BINDING SITE II or BINDING SITE III. Table 2 illustrates the complementarity of the nucleotide sequences of KIAA1045 BINDING SITE, designated SEQ ID:35193, to the nucleotide sequence of VGAM92 RNA, herein designated VGAM RNA, also designated SEQ ID:2803.

A function of VGAM92 is therefore inhibition of KIAA1045 (Accession XM_048592). Accordingly, utilities of VGAM92 include diagnosis, prevention and treatment of diseases and clinical conditions associated with KIAA1045. FIG. 1 further provides a conceptual description of a novel bioinformatically detected viral gene of the present invention, referred to here as Viral Genomic Address Messenger 93 (VGAM93) viral gene, which modulates expression of respective host target genes thereof, the function and utility of which host target genes is known in the art.

VGAM93 is a novel bioinformatically detected regulatory, non protein coding, viral micro RNA (miRNA) gene. The method by which VGAM93 was detected is described hereinabove with reference to FIGS. 1-8.

VGAM93 gene, herein designated VGAM GENE, is a viral gene contained in the genome of Plutella Xylostella Granulovirus. VGAM93 host target gene, herein designated VGAM HOST TARGET GENE, is a human gene contained in the human genome.

VGAM93 gene encodes a VGAM93 precursor RNA, herein designated VGAM PRECURSOR RNA. Similar to other miRNA genes, and unlike most ordinary genes, VGAM93 precursor RNA does not encode a protein. A nucleotide sequence identical or highly similar to the nucleotide sequence of VGAM93 precursor RNA is designated SEQ ID:79, and is provided hereinbelow with reference to the sequence listing part. Nucleotide sequence SEQ ID:79 is located at position 88464 relative to the genome of Plutella Xylostella Granulovirus.

VGAM93 precursor RNA folds onto itself, forming VGAM93 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

1446

An enzyme complex designated DICER COMPLEX, 'dices' the VGAM93 folded precursor RNA into VGAM93 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM93 RNA is designated SEQ ID:2804, and is provided hereinbelow with reference to the sequence listing part.

VGAM93 host target gene, herein designated VGAM HOST TARGET GENE, encodes a corresponding messenger RNA, VGAM93 host target RNA, herein designated VGAM HOST TARGET RNA. VGAM93 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM93 RNA, herein designated VGAM RNA, binds complementarily to one or more host target binding sites located in untranslated regions of VGAM93 host target RNA, herein designated VGAM HOST TARGET RNA. This complementary binding is due to the fact that the nucleotide sequence of VGAM93 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM93 RNA, herein designated VGAM RNA, may have a different number of host target binding sites in untranslated regions of a VGAM93 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM93 RNA, herein designated VGAM RNA, to host target binding sites on VGAM93 host target RNA, herein designated VGAM HOST TARGET RNA, such as BINDING SITE I, BINDING SITE II and BINDING SITE III, inhibits translation of VGAM93 host target RNA into VGAM93 host target protein, herein designated VGAM HOST TARGET PROTEIN. VGAM host target protein is therefore outlined by a broken line.

It is appreciated that VGAM93 host target gene, herein designated VGAM HOST TARGET GENE, in fact represents a plurality of VGAM93 host target genes. The mRNA of each one of this plurality of VGAM93 host target genes comprises one or more host target binding sites, each having a nucleotide sequence which is at least partly complementary to VGAM93 RNA, herein designated VGAM RNA, and which when bound by VGAM93 RNA causes inhibition of translation of respective one or more VGAM93 host target proteins.

It is further appreciated by one skilled in the art that the mode of translational inhibition illustrated by FIG. 1 with specific reference to translational inhibition exerted by VGAM93 gene, herein designated VGAM GENE, on one or more VGAM93 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM93 is inhibition of expression of host target genes, as part of a novel viral mechanism of attacking a host. Accordingly, utilities of VGAM93 include diagnosis, prevention and treatment of viral infection by Plutella Xylostella Granulovirus. Specific functions, and accordingly utilities, of VGAM93 correlate with, and may be deduced from, the identity of the host target genes which VGAM93 binds and inhibits, and the function of these host target genes, as elaborated hereinbelow.

Nucleotide sequences of the VGAM93 precursor RNA, herein designated VGAM PRECURSOR RNA, and of the 'diced' VGAM93 RNA, herein designated VGAM RNA, and a schematic representation of the secondary folding of VGAM93 folded precursor RNA, herein designated VGAM FOLDED PRECURSOR RNA, of VGAM93 are further described hereinbelow with reference to Table 1.

Nucleotide sequences of host target binding sites, such as BINDING SITE-I, BINDING SITE-II and BINDING SITE-III of FIG. 1, found on VGAM93 host target RNA, and schematic representation of the complementarity of each of these host target binding sites to VGAM93 RNA, herein designated VGAM RNA, are described hereinbelow with reference to Table 2.

As mentioned hereinabove with reference to FIG. 1, a function of VGAM93 gene, herein designated VGAM is inhibition of expression of VGAM93 target genes. It is appreciated that specific functions, and accordingly utilities, of VGAM93 correlate with, and may be deduced from, the identity of the target genes which VGAM93 binds and inhibits, and the function of these target genes, as elaborated hereinbelow.

Carcinoembryonic Antigen-related Cell Adhesion Molecule 1 (biliary glycoprotein) (CEACAM1, Accession NM_001712) is a VGAM93 host target gene. CEACAM1 BINDING SITE is HOST TARGET binding site found in the 3' untranslated region of mRNA encoded by CEACAM1, corresponding to a HOST TARGET binding site such as BINDING SITE I, BINDING SITE II or BINDING SITE III. Table 2 illustrates the complementarity of the nucleotide sequences of CEACAM1 BINDING SITE, designated SEQ ID:7440, to the nucleotide sequence of VGAM93 RNA, herein designated VGAM RNA, also designated SEQ ID:2804.

A function of VGAM93 is therefore inhibition of Carcinoembryonic Antigen-related Cell Adhesion Molecule 1 (biliary glycoprotein) (CEACAM1, Accession NM_001712), a gene which is a major effector of VEGF and may be a target for the inhibition of tumor angiogenesis. Accordingly, utilities of VGAM93 include diagnosis, prevention and treatment of diseases and clinical conditions associated with CEACAM1. The function of CEACAM1 has been established by previous studies. Ergun et al. (2000) showed that CEACAM1 exhibits angiogenic properties in in vitro and in vivo angiogenesis assays. CEACAM1 purified from granulocytes and endothelial cell media as well as recombinant CEACAM1 expressed in HEK293 cells stimulated proliferation, chemotaxis, and capillary-like tube formation of human microvascular endothelial cells. They increased vascularization of chick chorioallantoic membrane and potentiated the effects of VEGF165 (OMIM Ref. No. 192240). VEGF165 increased CEACAM1 expression at both the mRNA and the protein level. VEGF165-induced endothelial tube formation was blocked by a monoclonal CEACAM1 antibody. These data suggested that CEACAM1 is a major effector of VEGF in the early microvessel formation. Since CEACAM1 is expressed in tumor microvessels but not in large blood vessels, CEACAM1 may be a target for the inhibition of tumor angiogenesis. Following infection with Neisseria gonorrhea, there is a transient decline in circulating CD4 (OMIM Ref. No. 186940)-positive T lymphocytes that resolves after bacterial clearance. The gonococcus adheres to and is taken up by host cells through opacity-associated (Opa) proteins. Some Opa variants bind to heparan sulfate proteoglycans (HSPGs, e.g., SDC2; 142460), while others are specific for members of the CEACAM1/CD66 receptor family. CEACAM1 is the only member of this family that is expressed by lymphocytes and that contains a cytoplasmic ITIM (immunoreceptor tyrosine-based inhibitory motif). Using flow cytometry, Boulton and Gray-Owen (2002) demonstrated that CEACAM1 expression is upregulated after lymphocyte activation. Exposure to gonococci expressing the HSPG-specific Opa50 protein increased and exposure to CEACAM1-specific Opa52 gonococci or to anti-CEACAM1 antibody inhibited expression of the CD69 (OMIM Ref. No. 107273) activation marker on and proliferation by lymphocytes stimulated in vitro. The reduction in lymphocyte proliferation was not due to an increase in cell death. CEACAM1 associated with Opa52 also interacted with SHP1 (OMIM Ref. No. 176883) and SHP2 (OMIM Ref. No. 176876), presumably through its cytoplasmic ITIM. Boulton and Gray-Owen (2002) suggested that Opa52 engagement of the CEACAM1 coinhibitory receptor induces immunosuppression and may explain the failure of the host to develop a memory humoral response to N. gonorrhea infection due to a lack of T-cell help for B-cell activation. Animal model experiments lend further support to the function of CEACAM1. Poy et al. (2002) hypothesized that insulin stimulates phosphorylation of CEACAM1 which in turn leads to upregulation of receptor-mediated insulin endocytosis and degradation in the hepatocyte. To test the hypothesis, they generated transgenic mice overexpressing in liver a dominant-negative phosphorylation-defective CEACAM1 mutant, S503A. Supporting their hypothesis, they found that S503A-CEACAM1 transgenic mice developed hyperinsulinemia resulting from impaired insulin clearance. The hyperinsulinemia caused secondary insulin resistance with impaired glucose tolerance and random, but not fasting, hyperglycemia. Transgenic mice developed visceral adiposity with increased amounts of plasma free fatty acids and plasma and hepatic triglycerides. These findings suggested a mechanism through which insulin signaling regulates insulin sensitivity by modulating hepatic insulin clearance.

It is appreciated that the abovementioned animal model for CEACAM1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ergun, S.; Kilic, N.; Ziegeler, G.; Hansen, A.; Nollau, P.; Gotze, J.; Wurmbach, J.-H.; Horst, A.; Weil, J.; Fernando, M.; Wagener, C.: CEA-related cell adhesion molecule 1: a potent angiogenic factor and a major effector of vascular endothelial growth factor. Molec. Cell 5:311-320, 2000; and Boulton, I. C.; Gray-Owen, S. D.: Neisserial binding to CEACAM1 arrests the activation and proliferation of CD4+ T lymphocytes. Nature Immun. 3:229-236, 2002.

Further studies establishing the function and utilities of CEACAM1 are found in John Hopkins OMIM database record ID 109770, and in sited publications numbered 12145, 12146, 12147-12149, 10742, 12150-12151, 221, 10739-10740, 10743, 1215 and 10744 listed in the bibliography section hereinbelow, which are also hereby incorporated by reference. Endometrial Bleeding Associated Factor (left-right determination, factor A; transforming growth factor beta superfamily) (EBAF, Accession XM_037302) is another VGAM93 host target gene. EBAF BINDING SITE is HOST TARGET binding site found in the 3' untranslated region of mRNA encoded by EBAF, corresponding to a HOST TARGET binding site such as BINDING SITE I, BINDING SITE II or BINDING SITE III. Table 2 illustrates the complementarity of the nucleotide sequences of EBAF BINDING SITE, designated SEQ ID:32607, to the nucleotide sequence of VGAM93 RNA, herein designated VGAM RNA, also designated SEQ ID:2804.

Another function of VGAM93 is therefore inhibition of Endometrial Bleeding Associated Factor (left-right determination, factor A; transforming growth factor beta superfamily) (EBAF, Accession XM_037302), a gene which LEFT-RIGHT AXIS MALFORMATIONS. Accordingly, utilities of VGAM93 include diagnosis, prevention and treatment of diseases and clinical conditions associated with EBAF. The function of EBAF has been established by previous studies. Because of the possibility that Lefty mutations may be associated with human L-R axis malformations, Kosaki et al. (1999) characterized 2 human homologs, LEFTY A and LEFTY B (OMIM Ref. No. 603037). PCR screening of a PAC genomic library identified a clone that contained both LEFTY A and LEFTY B genes. Restriction mapping showed that the genes are separated by approximately 50 kb and are oriented in tandem. The 2 genes were localized by FISH to 1q42, a region syntenic to the location to which the mouse Lefty genes have been mapped at 1H5 (Meno et al., 1997). Both LEFTY A and LEFTY B contain 4 exons which are spliced at identical positions, and both genes encode proteins with 366 amino acids. LEFTY A was found to be identical to EBAF, the cDNA previously identified by Kothapalli et al. (1997). The deduced amino acid sequences of LEFTY A and LEFTY B are more similar to each other than to Lefty-1 or Lefty-2 of the mouse. Analysis of 126 human cases of L-R axis malformation showed 1 nonsense and 1 missense mutation in the LEFTY A gene. Both mutations lay in the cysteine-knot region of the LEFTY A protein, and the phenotype of affected individuals was very similar to that typically seen in Lefty-1 -/- mice with L-R axis malformations. Because of the possibility that Lefty mutations may be associated with human L-R axis malformations, Kosaki et al. (1999) characterized 2 human homologs, LEFTY A and LEFTY B (OMIM Ref. No. 603037). PCR screening of a PAC genomic library identified a clone that contained both LEFTY A and LEFTY B genes. Restriction mapping showed that the genes are separated by approximately 50 kb and are oriented in tandem. The 2 genes were localized by FISH to 1q42, a region syntenic to the location to which the mouse Lefty genes have been mapped at 1H5 (Meno et al., 1997). Both LEFTY A and LEFTY B contain 4 exons which are spliced at identical positions, and both genes encode proteins with 366 amino acids. LEFTY A was found to be identical to EBAF, the cDNA previously identified by Kothapalli et al. (1997). The deduced amino acid sequences of LEFTY A and LEFTY B are more similar to each other than to Lefty-1 or Lefty-2 of the mouse. Analysis of 126 human cases of L-R axis malformation showed 1 nonsense and 1 missense mutation in the LEFTY A gene. Both mutations lay in the cysteine-knot region of the LEFTY A protein, and the phenotype of affected individuals was very similar to that typically seen in Lefty-1 -/- mice with L-R axis malformations. Animal model experiments lend further support to the function of EBAF. Lefty-1, lefty-2, and nodal (OMIM Ref. No. 601265) are expressed on the left side of developing mouse embryos and are implicated in L-R determination. Meno et al. (1998) examined the role of lefty-1 by analyzing mutant mice lacking this gene. The lefty-1-deficient mice showed a variety of L-R positional defects in visceral organs. The most common feature of lefty-1 -/- mice was thoracic left isomerism (rather than right isomerism). The lack of lefty-1 resulted in bilateral expression of nodal, lefty-2, and Pitx2 (OMIM Ref. No. 601542), a homeo box gene normally expressed on the left side. These observations suggested that the role of lefty-1 is to restrict the expression of lefty-2 and nodal to the left side, and that lefty-2 or nodal encode a signal for 'leftness.'

It is appreciated that the abovementioned animal model for EBAF is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kosaki, K.; Bassi, M. T.; Kosaki, R.; Lewin, M.; Belmont, J.; Schauer, G.; Casey, B.: Characterization and mutation analysis of human LEFTY A and LEFTY B, homologues of murine genes implicated in left-right axis development. Am. J. Hum. Genet. 64:712-721, 1999; and Meno, C.; Shimono, A.; Saijoh, Y.; Yashiro, K.; Mochida, K.; Ohishi, S.; Noji, S.; Kondoh, H.; Hamada, H.: Lefty-1 is required for left-right determination as a regulator of lefty-2 an.

Further studies establishing the function and utilities of EBAF are found in John Hopkins OMIM database record ID 601877, and in sited publications numbered 11847-1299 listed in the bibliography section hereinbelow, which are also hereby incorporated by reference. Notch Homolog 2 (Drosophila) (NOTCH2, Accession NM_024408) is another VGAM93 host target gene. NOTCH2 BINDING SITE is HOST TARGET binding site found in the 3' untranslated region of mRNA encoded by NOTCH2, corresponding to a HOST TARGET binding site such as BINDING SITE I, BINDING SITE II or BINDING SITE III. Table 2 illustrates the complementarity of the nucleotide sequences of NOTCH2 BINDING SITE, designated SEQ ID:23648, to the nucleotide sequence of VGAM93 RNA, herein designated VGAM RNA, also designated SEQ ID:2804.

Another function of VGAM93 is therefore inhibition of Notch Homolog 2 (Drosophila) (NOTCH2, Accession NM_024408), a gene which is moderately similar to a region of murine Notch1 and contains an ankyrin repeat. Accordingly, utilities of VGAM93 include diagnosis, prevention and treatment of diseases and clinical conditions associated with NOTCH2. The function of NOTCH2 has been established by previous studies. In Drosophila, the 'Notch' gene controls differentiation to various cell fates in many tissues. Three mammalian 'Notch' homologs have been identified. All 3 are very highly conserved relative to the Drosophila gene, which suggests that they are important for cell differentiation in mammals. This notion is supported by the previous finding of a truncated, translocated form of the human NOTCH1 (OMIM Ref. No. 190198) gene (formerly TAN1) in 3 cases of leukemia. Larsson et al. (1994) identified cosmid clones for all 3 human NOTCH genes. Using these clones as probes in fluorescence in situ hybridization to human metaphase chromosomes, they obtained results which, combined with data from somatic cell hybrid panels, demonstrated that NOTCH2 is located on 1p13-p11 and NOTCH3 on 19p13.2-p13.1, which are regions of neoplasia-associated translocation. As part of a study of a triplication of several Mb occurring on chromosomes 1, 6, and 9, Katsanis et al. (1996) confirmed the presence of a NOTCH locus on chromosome 1. Gao et al. (1998) mapped the mouse Notch2 gene to chromosome 3.

Full details of the abovementioned studies are described in the following publications, the disclosure of which are hereby incorporated by reference:

Katsanis, N.; Fitzgibbon, J.; Fisher, E. M. C.: Paralogy mapping: identification of a region in the human MHC triplicated onto human chromosomes 1 and 9 allows the prediction and isolation of novel PBX and NOTCH loci. Genomics 35:101-108, 1996; and Larsson, C.; Lardelli, M.; White, I.; Lendahl, U.: The human NOTCH1, 2, and 3 genes are located at chromosome positions 9q34, 1p13-p11, and 19p13.2-p13.1 in regions of neoplasia-associa.

Further studies establishing the function and utilities of NOTCH2 are found in John Hopkins OMIM database record ID 600275, and in sited publications numbered 841 and 10369 listed in the bibliography section hereinbelow, which are also hereby incorporated by reference. KIAA0232 (Accession XM_052627) is another VGAM93 host target gene. KIAA0232 BINDING SITE is HOST TARGET binding site found in the 3' untranslated region of mRNA encoded by KIAA0232, corresponding to a HOST TARGET binding site such as BINDING SITE I, BINDING SITE II or BINDING SITE III. Table 2 illustrates the complementarity of the nucleotide sequences of KIAA0232 BINDING SITE, designated SEQ ID:36034, to the nucleotide sequence of VGAM93 RNA, herein designated VGAM RNA, also designated SEQ ID:2804.

Another function of VGAM93 is therefore inhibition of KIAA0232 (Accession XM_052627). Accordingly, utilities of VGAM93 include diagnosis, prevention and treatment of diseases and clinical conditions associated with KIAA0232. TU12B1-TY (Accession NM_016575) is another VGAM93 host target gene. TU12B1-TY BINDING SITE is HOST TARGET binding site found in the 3' untranslated region of mRNA encoded by TU12B1-TY, corresponding to a HOST TARGET binding site such as BINDING SITE I, BINDING SITE II or BINDING SITE III. Table 2 illustrates the complementarity of the nucleotide sequences of TU12B1-TY BINDING SITE, designated SEQ ID:18645, to the nucleotide sequence of VGAM93 RNA, herein designated VGAM RNA, also designated SEQ ID:2804.

Another function of VGAM93 is therefore inhibition of TU12B1-TY (Accession NM_016575). Accordingly, utilities of VGAM93 include diagnosis, prevention and treatment of diseases and clinical conditions associated with TU12B1-TY. LOC90786 (Accession XM_034127) is another VGAM93 host target gene. LOC90786 BINDING SITE is HOST TARGET binding site found in the 5' untranslated region of mRNA encoded by LOC90786, corresponding to a HOST TARGET binding site such as BINDING SITE I, BINDING SITE II or BINDING SITE III. Table 2 illustrates the complementarity of the nucleotide sequences of LOC90786 BINDING SITE, designated SEQ ID:32012, to the nucleotide sequence of VGAM93 RNA, herein designated VGAM RNA, also designated SEQ ID:2804.

Another function of VGAM93 is therefore inhibition of LOC90786 (Accession XM_034127). Accordingly, utilities of VGAM93 include diagnosis, prevention and treatment of diseases and clinical conditions associated with LOC90786.

FIG. 1 further provides a conceptual description of a novel bioinformatically detected viral gene of the present invention, referred to here as Viral Genomic Address Messenger 94 (VGAM94) viral gene, which modulates expression of respective host target genes thereof, the function and utility of which host target genes is known in the art.

VGAM94 is a novel bioinformatically detected regulatory, non protein coding, viral micro RNA (miRNA) gene. The method by which VGAM94 was detected is described hereinabove with reference to FIGS. 1-8.

VGAM94 gene, herein designated VGAM GENE, is a viral gene contained in the genome of Plutella Xylostella Granulovirus. VGAM94 host target gene, herein designated VGAM HOST TARGET GENE, is a human gene contained in the human genome.

VGAM94 gene encodes a VGAM94 precursor RNA, herein designated VGAM PRECURSOR RNA. Similar to other miRNA genes, and unlike most ordinary genes, VGAM94 precursor RNA does not encode a protein. A nucleotide sequence identical or highly similar to the nucleotide sequence of VGAM94 precursor RNA is designated SEQ ID:80, and is provided hereinbelow with reference to the sequence listing part. Nucleotide sequence SEQ ID:80 is located at position 54184 relative to the genome of Plutella Xylostella Granulovirus.

VGAM94 precursor RNA folds onto itself, forming VGAM94 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM94 folded precursor RNA into VGAM94 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 41%) nucleotide sequence of VGAM94 RNA is designated SEQ ID:2805, and is provided hereinbelow with reference to the sequence listing part.

VGAM94 host target gene, herein designated VGAM HOST TARGET GENE, encodes a corresponding messenger RNA, VGAM94 host target RNA, herein designated VGAM HOST TARGET RNA. VGAM94 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM94 RNA, herein designated VGAM RNA, binds complementarily to one or more host target binding sites located in untranslated regions of VGAM94 host target RNA, herein designated VGAM HOST TARGET RNA. This complementary binding is due to the fact that the nucleotide sequence of VGAM94 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM94 RNA, herein designated VGAM RNA, may have a different number of host target binding sites in untranslated regions of a VGAM94 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM94 RNA, herein designated VGAM RNA, to host target binding sites on VGAM94 host target RNA, herein designated VGAM HOST TARGET RNA, such as BINDING SITE I, BINDING SITE II and BINDING SITE III, inhibits translation of VGAM94 host target RNA into VGAM94 host target protein, herein designated VGAM HOST TARGET PROTEIN. VGAM host target protein is therefore outlined by a broken line.

It is appreciated that VGAM94 host target gene, herein designated VGAM HOST TARGET GENE, in fact represents a plurality of VGAM94 host target genes. The mRNA of each one of this plurality of VGAM94 host target genes comprises one or more host target binding sites, each having a nucleotide sequence which is at least partly complementary to VGAM94 RNA, herein designated VGAM RNA, and which when bound by VGAM94 RNA causes inhibition of translation of respective one or more VGAM94 host target proteins.

It is further appreciated by one skilled in the art that the mode of translational inhibition illustrated by FIG. 1 with specific reference to translational inhibition exerted by VGAM94 gene, herein designated VGAM GENE, on one or more VGAM94 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM94 is inhibition of expression of host target genes, as part of a novel viral mechanism of attacking a host. Accordingly, utilities of VGAM94 include diagnosis, prevention and treatment of viral infection by Plutella Xylostella Granulovirus. Specific functions, and accordingly utilities, of VGAM94 correlate with, and may be deduced from, the identity of the host target genes which VGAM94 binds and inhibits, and the function of these host target genes, as elaborated hereinbelow.

Nucleotide sequences of the VGAM94 precursor RNA, herein designated VGAM PRECURSOR RNA, and of the 'diced' VGAM94 RNA, herein designated VGAM RNA, and a schematic representation of the secondary folding of VGAM94 folded precursor RNA, herein designated VGAM FOLDED PRECURSOR RNA, of VGAM94 are further described hereinbelow with reference to Table 1.

Nucleotide sequences of host target binding sites, such as BINDING SITE-I, BINDING SITE-II and BINDING SITE-III of FIG. 1, found on VGAM94 host target RNA, and schematic representation of the complementarity of each of these host target binding sites to VGAM94 RNA, herein designated VGAM RNA, are described hereinbelow with reference to Table 2.

As mentioned hereinabove with reference to FIG. 1, a function of VGAM94 gene, herein designated VGAM is inhibition of expression of VGAM94 target genes. It is appreciated that specific functions, and accordingly utilities, of VGAM94 correlate with, and may be deduced from, the identity of the target genes which VGAM94 binds and inhibits, and the function of these target genes, as elaborated hereinbelow.

BLAME (Accession NM_020125) is a VGAM94 host target gene. BLAME BINDING SITE is HOST TARGET binding site found in the 3' untranslated region of mRNA encoded by BLAME, corresponding to a HOST TARGET binding site such as BINDING SITE I, BINDING SITE II or BINDING SITE III. Table 2 illustrates the complementarity of the nucleotide sequences of BLAME BINDING SITE, designated SEQ ID:21309, to the nucleotide sequence of VGAM94 RNA, herein designated VGAM RNA, also designated SEQ ID:2805.

A function of VGAM94 is therefore inhibition of BLAME (Accession NM_020125). Accordingly, utilities of VGAM94 include diagnosis, prevention and treatment of diseases and clinical conditions associated with BLAME. Chromosome 10 Open Reading Frame 2 (C10orf2, Accession NM_021830) is another VGAM94 host target gene. C10orf2 BINDING SITE is HOST TARGET binding site found in the 3' untranslated region of mRNA encoded by C10orf2, corresponding to a HOST TARGET binding site such as BINDING SITE I, BINDING SITE II or BINDING SITE III. Table 2 illustrates the complementarity of the nucleotide sequences of C10orf2 BINDING SITE, designated SEQ ID:22403, to the nucleotide sequence of VGAM94 RNA, herein designated VGAM RNA, also designated SEQ ID:2805.

Another function of VGAM94 is therefore inhibition of Chromosome 10 Open Reading Frame 2 (C10orf2, Accession NM_021830). Accordingly, utilities of VGAM94 include diagnosis, prevention and treatment of diseases and clinical conditions associated with C10orf2. Calcitonin Receptor (CALCR, Accession NM_001742) is another VGAM94 host target gene. CALCR BINDING SITE is HOST TARGET binding site found in the 3' untranslated region of mRNA encoded by CALCR, corresponding to a HOST TARGET binding site such as BINDING SITE I, BINDING SITE II or BINDING SITE III. Table 2 illustrates the complementarity of the nucleotide sequences of CALCR BINDING SITE, designated SEQ ID:7478, to the nucleotide sequence of VGAM94 RNA, herein designated VGAM RNA, also designated SEQ ID:2805.

Another function of VGAM94 is therefore inhibition of Calcitonin Receptor (CALCR, Accession NM_001742), a gene which is a receptor for calcitonin, is mediated by g proteins which activate adenylyl cyclase, and thought to couple to the heterotrimeric guanosine triphosphate-binding protein that is sensitive to cholera toxin. Accordingly, utilities of VGAM94 include diagnosis, prevention and treatment of diseases and clinical conditions associated with CALCR. The function of CALCR has been established by previous studies. Taboulet et al. (1996) had reported the point mutation polymorphism (OMIM Ref. No. T to C) in the 3-prime region of the CALCR gene which induced a pro447-to-leu amino acid change in the third intracellular domain of the protein. This was the same mutation as that subsequently identified by Nakamura et al. (1997) and Masi et al. (1998) and referred to as pro463 to leu; the difference in numbering depended on whether isoform 1 or isoform 2 of the calcitonin receptor, with or without the 16-amino acid insert, was referred to (de Vernejoul, 1999). Taboulet et al. (1998) studied the distribution of these alleles in a cohort of 123 women with no osteoporotic fractures and 92 women who presented with one or more osteoporotic fractures of wrist or vertebrae. They found that bone mineral density of the femoral neck was significantly higher in heterozygous subjects compared with the homozygous leucine and homozygous proline genotypes. Also, a decreased fracture risk was observed in heterozygote subjects. In conclusion, they suggested that polymorphism of CALCR is associated with osteoporotic factors and bone mineral density in a population of postmenopausal women. The heterozygous advantage of the pro/leu subjects could explain their protection against osteoporosis. The distribution of the CALCR alleles in the French population studied by Taboulet et al. (1998) was quite different from that observed by Nakamura et al. (1997) in the Japanese population. In Japan, the proline homozygote was the most frequent genotype (70%), Gorn et al. (1992) cloned a human calcitonin receptor cDNA from a eukaryotic expression library prepared from an ovarian small cell carcinoma cell line. A cell line had been shown to respond to calcitonin (CT, or CALCA; 114130) with increases in content of cellular cAMP. Transfection of this cDNA into COS cells resulted in expression of receptors with high affinity for salmon and human calcitonin. The expressed CALCR was coupled to adenylate cyclase. Northern analysis indicated a single transcript of about 4.2 kb. The cloned cDNA encoded a putative peptide of 490 amino acids with 7 potential transmembrane domains. The amino acid sequence was 73% identical to porcine CALCR, although the human CALCR contained an inset of 16 amino acids between transmembrane domains I and II. CALCR is closely related to the parathyroid hormone receptor (OMIM Ref. No. 168468) and the secretin receptor (OMIM Ref. No. 182098); these receptors comprise a distinct family of G protein-coupled 7-transmembrane domain receptors. A comparison of the human CALCR sequence to protein sequences in databases suggested that the receptor for calcitonin is evolutionarily related to the chemoattractant receptor of the primitive eukaryote Dictyostelium discoideum.

Full details of the abovementioned studies are described in the following publications, the disclosure of which are hereby incorporated by reference:

Gorn, A. H.; Lin, H. Y.; Yamin, M.; Auron, P. E.; Flannery, M. R.; Tapp, D. R.; Manning, C. A.; Lodish, H. F.; Krane, S. M.; Goldring, S. R.: Cloning, characterization, and expression of a human calcitonin receptor from an ovarian carcinoma cell line. J. Clin. Invest. 90:1726-1735, 1992; and Taboulet, J.; Frenkian, M.; Frendo, J. L.; Feingold, N.; Jullienne, A.; de Vernejoul, M. C.: Calcitonin receptor polymorphism is associated with a decreased fracture risk in post-menop.

Further studies establishing the function and utilities of CALCR are found in John Hopkins OMIM database record ID 114131, and in sited publications numbered 2336-2338, 3 and 12565-12570 listed in the bibliography section hereinbelow, which are also hereby incorporated by reference. Cytoplasmic Linker 2 (CYLN2, Accession NM_003388) is another VGAM94 host target gene. CYLN2 BINDING SITE is HOST TARGET binding site found in the 3' untranslated region of mRNA encoded by CYLN2, corresponding to a HOST TARGET binding site such as BINDING SITE I, BINDING SITE II or BINDING SITE III. Table 2 illustrates the complementarity of the nucleotide sequences of CYLN2 BINDING SITE, designated SEQ ID:9421, to the nucleotide sequence of VGAM94 RNA, herein designated VGAM RNA, also designated SEQ ID:2805.

Another function of VGAM94 is therefore inhibition of Cytoplasmic Linker 2 (CYLN2, Accession NM_003388), a gene which associates with microtubules and dendritic lamellar bodies. Accordingly, utilities of VGAM94 include diagnosis, prevention and treatment of diseases and clinical conditions associated with CYLN2. The function of CYLN2 has been established by previous studies. Cytoplasmic linker proteins have been proposed to mediate the interaction between specific membranous organelles and microtubules. Hoogenraad et al. (1998) isolated and characterized overlapping murine and human cosmids respectively containing the complete mouse Cyln2 gene, which encodes cytoplasmic linker protein-115 (Clip-115), and the partial human CYLN2 gene. Based on nucleotide sequence comparisons and hybridization data, they concluded that the human CYLN2 gene includes the incomplete WBSCR4 and WBSCR3 transcription units identified by Osborne et al. (1996). Hoogenraad et al. (1998) found that the human CYLN2 gene spans at least 140 kb of DNA. The deduced partial human CYLN2 protein contains an N-terminal globular region with 2 microtubule-binding domains, followed by a potential alpha-helical coiled-coils region. Northern blot analysis with a rat Cyln2 cDNA probe detected a 5.5-kb CYLN2 message in human adult brain. Using a gene targeting approach, Hoogenraad et al. (2002) provided evidence that mice with haploinsufficiency for Cyln2 have features reminiscent of WBS, including mild growth deficiency, brain abnormalities, hippocampal dysfunction, and particular deficits in motor coordination. Absence of CLIP115 also leads to increased levels of CLIP170 (OMIM Ref. No. 179830), a closely related cytoplasmic linker protein, and dynactin (DCTN1; 601143) at the tips of growing microtubules. This protein redistribution may affect dynein motor regulation and, together with the loss of CLIP115-specific functions, underlie neurologic alterations in WBS.

Full details of the abovementioned studies are described in the following publications, the disclosure of which are hereby incorporated by reference:

Hoogenraad, C. C.; Koekkoek, B.; Akhmanova, A.; Krugers, H.; Dortland, B.; Miedema, M.; van Alphen, A.; Kistler, W. M.; Jaegle, M.; Koutsourakis, M.; Van Camp, N.; Verhoye, M.; van der Linden, A.; Kaverina, I.; Grosveld, F.; De Zeeuw, C. I.; Galjart, N.: Targeted mutation of Cyln2 in the Williams syndrome critical region links CLIP-115 haploinsufficiency to neurodevelopmental abnormalities in mice. Nature Genet. 32:116-127, 2002. Note: Erratum: Nature Genet. 32:331 only, 2002; and Osborne, L. R.; Martindale, D.; Scherer, S. W.; Shi, X.-M.; Huizenga, J.; Heng, H. H. Q.; Costa, T.; Pober, B.; Lew, L.; Brinkman, J.; Rommens, J.; Koop, B.; Tsui, L.-C.: Identificati.

Further studies establishing the function and utilities of CYLN2 are found in John Hopkins OMIM database record ID 603432, and in sited publications numbered 5347, 998 and 10456 listed in the bibliography section hereinbelow, which are also hereby incorporated by reference. Eukaryotic Translation Initiation Factor 5A2 (EIF5A2, Accession NM_020390) is another VGAM94 host target gene. EIF5A2 BINDING SITE is HOST TARGET binding site found in the 3' untranslated region of mRNA encoded by EIF5A2, corresponding to a HOST TARGET binding site such as BINDING SITE I, BINDING SITE II or BINDING SITE III. Table 2 illustrates the complementarity of the nucleotide sequences of EIF5A2 BINDING SITE, designated SEQ ID:21660, to the nucleotide sequence of VGAM94 RNA, herein designated VGAM RNA, also designated SEQ ID:2805.

Another function of VGAM94 is therefore inhibition of Eukaryotic Translation Initiation Factor 5A2 (EIF5A2, Accession NM_020390). Accordingly, utilities of VGAM94 include diagnosis, prevention and treatment of diseases and clinical conditions associated with EIF5A2. Zuotin Related Factor 1 (ZRF1, Accession XM_168590) is another VGAM94 host target gene. ZRF1 BINDING SITE is HOST TARGET binding site found in the 5' untranslated region of mRNA encoded by ZRF1, corresponding to a HOST TARGET binding site such as BINDING SITE I, BINDING SITE II or BINDING SITE III. Table 2 illustrates the complementarity of the nucleotide sequences of ZRF1 BINDING SITE, designated SEQ ID:45267, to the nucleotide sequence of VGAM94 RNA, herein designated VGAM RNA, also designated SEQ ID:2805.

Another function of VGAM94 is therefore inhibition of Zuotin Related Factor 1 (ZRF1, Accession XM_168590). Accordingly, utilities of VGAM94 include diagnosis, prevention and treatment of diseases and clinical conditions associated with ZRF1. Ras Homolog Gene Family, Member F (in filopodia) (ARHF, Accession NM_019034) is another VGAM94 host target gene. ARHF BINDING SITE is HOST TARGET binding site found in the 3' untranslated region of mRNA encoded by ARHF, corresponding to a HOST TARGET binding site such as BINDING SITE I, BINDING SITE II or BINDING SITE III. Table 2 illustrates the complementarity of the nucleotide sequences of ARHF BINDING SITE, designated SEQ ID:21121, to the nucleotide sequence of VGAM94 RNA, herein designated VGAM RNA, also designated SEQ ID:2805.

Another function of VGAM94 is therefore inhibition of Ras Homolog Gene Family, Member F (in filopodia) (ARHF, Accession NM_019034). Accordingly, utilities of VGAM94 include diagnosis, prevention and treatment of diseases and clinical conditions associated with ARHF. FLJ13110 (Accession NM_022912) is another VGAM94 host target gene. FLJ13110 BINDING SITE is HOST TARGET binding site found in the 3' untranslated region of mRNA encoded by FLJ13110, corresponding to a HOST TARGET binding site such as BINDING SITE I, BINDING SITE II or BINDING SITE III. Table 2 illustrates the complementarity of the nucleotide sequences of FLJ13110 BINDING SITE, designated SEQ ID:23220, to the nucleotide sequence of VGAM94 RNA, herein designated VGAM RNA, also designated SEQ ID:2805.

Another function of VGAM94 is therefore inhibition of FLJ13110 (Accession NM_022912). Accordingly, utilities of VGAM94 include diagnosis, prevention and treatment of diseases and clinical conditions associated with FLJ13110. FLJ14146 (Accession NM_024709) is another VGAM94 host target gene. FLJ14146 BINDING SITE is HOST TARGET binding site found in the 3' untranslated region of mRNA encoded by FLJ14146, corresponding to a HOST TARGET binding site such as BINDING SITE I, BINDING SITE II or BINDING SITE III. Table 2 illustrates the complementarity of the nucleotide sequences of FLJ14146 BINDING SITE, designated SEQ ID:24034, to the nucleotide sequence of VGAM94 RNA, herein designated VGAM RNA, also designated SEQ ID:2805.

Another function of VGAM94 is therefore inhibition of FLJ14146 (Accession NM_024709). Accordingly, utilities of VGAM94 include diagnosis, prevention and treatment of diseases and clinical conditions associated with FLJ14146. KIAA0169 (Accession XM_052725) is another VGAM94 host target gene. KIAA0169 BINDING SITE is HOST TARGET binding site found in the 5' untranslated region of mRNA encoded by KIAA0169, corresponding to a HOST TARGET binding site such as BINDING SITE I, BINDING SITE II or BINDING SITE III. Table 2 illustrates the complementarity of the nucleotide sequences of KIAA0169 BINDING SITE, designated SEQ ID:36053, to the nucleotide sequence of VGAM94 RNA, herein designated VGAM RNA, also designated SEQ ID:2805.

Another function of VGAM94 is therefore inhibition of KIAA0169 (Accession XM_052725). Accordingly, utilities of VGAM94 include diagnosis, prevention and treatment of diseases and clinical conditions associated with KIAA0169. KIAA0864 (Accession XM_032630) is another VGAM94 host target gene. KIAA0864 BINDING SITE is HOST TARGET binding site found in the 5' untranslated region of mRNA encoded by KIAA0864, corresponding to a HOST TARGET binding site such as BINDING SITE I, BINDING SITE II or BINDING SITE III. Table 2 illustrates the complementarity of the nucleotide sequences of KIAA0864 BINDING SITE, designated SEQ ID:31684, to the nucleotide sequence of VGAM94 RNA, herein designated VGAM RNA, also designated SEQ ID:2805.

Another function of VGAM94 is therefore inhibition of KIAA0864 (Accession XM_032630). Accordingly, utilities of VGAM94 include diagnosis, prevention and treatment of diseases and clinical conditions associated with KIAA0864. MGC15705 (Accession NM_032757) is another VGAM94 host target gene. MGC15705 BINDING SITE is HOST TARGET binding site found in the 5' untranslated region of mRNA encoded by MGC15705, corresponding to a HOST TARGET binding site such as BINDING SITE I, BINDING SITE II or BINDING SITE III. Table 2 illustrates the complementarity of the nucleotide sequences of MGC15705 BINDING SITE, designated SEQ ID:26500, to the nucleotide sequence of VGAM94 RNA, herein designated VGAM RNA, also designated SEQ ID:2805.

Another function of VGAM94 is therefore inhibition of MGC15705 (Accession NM_032757). Accordingly, utilities of VGAM94 include diagnosis, prevention and treatment of diseases and clinical conditions associated with MGC15705. p25 (Accession NM_007030) is another VGAM94 host target gene. p25 BINDING SITE is HOST TARGET binding site found in the 3' untranslated region of mRNA encoded by p25, corresponding to a HOST TARGET binding site such as BINDING SITE I, BINDING SITE II or BINDING SITE III. Table 2 illustrates the complementarity of the nucleotide sequences of p25 BINDING SITE, designated SEQ ID:13892, to the nucleotide sequence of VGAM94 RNA, herein designated VGAM RNA, also designated SEQ ID:2805.

Another function of VGAM94 is therefore inhibition of p25 (Accession NM_007030). Accordingly, utilities of VGAM94 include diagnosis, prevention and treatment of diseases and clinical conditions associated with p25. Phytoceramidase, Alkaline (PHCA, Accession NM_018367) is another VGAM94 host target gene. PHCA BINDING SITE is HOST TARGET binding site found in the 3' untranslated region of mRNA encoded by PHCA, corresponding to a HOST TARGET binding site such as BINDING SITE I, BINDING SITE II or BINDING SITE III. Table 2 illustrates the complementarity of the nucleotide sequences of PHCA BINDING SITE, designated SEQ ID:20376, to the nucleotide sequence of VGAM94 RNA, herein designated VGAM RNA, also designated SEQ ID:2805.

Another function of VGAM94 is therefore inhibition of Phytoceramidase, Alkaline (PHCA, Accession NM_018367). Accordingly, utilities of VGAM94 include diagnosis, prevention and treatment of diseases and clinical conditions associated with PHCA. Protein-O-mannosyltransferase 1 (POMT1, Accession NM_007171) is another VGAM94 host target gene. POMT1 BINDING SITE is HOST TARGET binding site found in the 3' untranslated region of mRNA encoded by POMT1, corresponding to a HOST TARGET binding site such as BINDING SITE I, BINDING SITE II or BINDING SITE III. Table 2 illustrates the complementarity of the nucleotide sequences of POMT1 BINDING SITE, designated SEQ ID:14018, to the nucleotide sequence of VGAM94 RNA, herein designated VGAM RNA, also designated SEQ ID:2805.

Another function of VGAM94 is therefore inhibition of Protein-O-mannosyltransferase 1 (POMT1, Accession NM_007171). Accordingly, utilities of VGAM94 include diagnosis, prevention and treatment of diseases and clinical conditions associated with POMT1. LOC152925 (Accession XM_087559) is another VGAM94 host target gene. LOC152925 BINDING SITE is HOST TARGET binding site found in the 3' untranslated region of mRNA encoded by LOC152925, corresponding to a HOST TARGET binding site such as BINDING SITE I, BINDING SITE II or BINDING SITE III. Table 2 illustrates the complementarity of the nucleotide sequences of LOC152925 BINDING SITE, designated SEQ ID:39335, to the nucleotide sequence of VGAM94 RNA, herein designated VGAM RNA, also designated SEQ ID:2805.

Another function of VGAM94 is therefore inhibition of LOC152925 (Accession XM_087559). Accordingly, utilities of VGAM94 include diagnosis, prevention and treatment of diseases and clinical conditions associated with LOC152925. LOC221463 (Accession XM_166374) is another VGAM94 host target gene. LOC221463 BINDING SITE is HOST TARGET binding site found in the 5' untranslated region of mRNA encoded by LOC221463, corresponding to a HOST TARGET binding site such as BINDING SITE I, BINDING SITE II or BINDING SITE III. Table 2 illustrates the complementarity of the nucleotide sequences of LOC221463 BINDING SITE, designated SEQ ID:44201, to the nucleotide sequence of VGAM94 RNA, herein designated VGAM RNA, also designated SEQ ID:2805.

Another function of VGAM94 is therefore inhibition of LOC221463 (Accession XM_166374). Accordingly, utilities of VGAM94 include diagnosis, prevention and treatment of diseases and clinical conditions associated with LOC221463. LOC254266 (Accession XM_173221) is another VGAM94 host target gene. LOC254266 BINDING SITE is HOST TARGET binding site found in the 3' untranslated region of mRNA encoded by LOC254266, corresponding to a HOST TARGET binding site such as BINDING SITE I, BINDING SITE II or BINDING SITE III. Table 2 illustrates the complementarity of the nucleotide sequences of LOC254266 BINDING SITE, designated SEQ ID:46481, to the nucleotide sequence of VGAM94 RNA, herein designated VGAM RNA, also designated SEQ ID:2805.

Another function of VGAM94 is therefore inhibition of LOC254266 (Accession XM_173221). Accordingly, utilities of VGAM94 include diagnosis, prevention and treatment of diseases and clinical conditions associated with LOC254266. FIG. 1 further provides a conceptual description of a novel bioinformatically detected viral gene of the present invention, referred to here as Viral Genomic Address Messenger 95 (VGAM95) viral gene, which modulates expression of respective host target genes thereof, the function and utility of which host target genes is known in the art.

VGAM95 is a novel bioinformatically detected regulatory, non protein coding, viral micro RNA (miRNA) gene. The method by which VGAM95 was detected is described hereinabove with reference to FIGS. 1-8.

VGAM95 gene, herein designated VGAM GENE, is a viral gene contained in the genome of Plutella Xylostella Granulovirus. VGAM95 host target gene, herein designated VGAM HOST TARGET GENE, is a human gene contained in the human genome.

VGAM95 gene encodes a VGAM95 precursor RNA, herein designated VGAM PRECURSOR RNA. Similar to other miRNA genes, and unlike most ordinary genes, VGAM95 precursor RNA does not encode a protein. A nucleotide sequence identical or highly similar to the nucleotide sequence of VGAM95 precursor RNA is designated SEQ ID:81, and is provided hereinbelow with reference to the sequence listing part. Nucleotide sequence SEQ ID:81 is located at position 13652 relative to the genome of Plutella Xylostella Granulovirus.

VGAM95 precursor RNA folds onto itself, forming VGAM95 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM95 folded precursor RNA into VGAM95 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM95 RNA is designated SEQ ID:2806, and is provided hereinbelow with reference to the sequence listing part.

VGAM95 host target gene, herein designated VGAM HOST TARGET GENE, encodes a corresponding messenger RNA, VGAM95 host target RNA, herein designated VGAM HOST TARGET RNA. VGAM95 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM95 RNA, herein designated VGAM RNA, binds complementarily to one or more host target binding sites located in untranslated regions of VGAM95 host target RNA, herein designated VGAM HOST TARGET RNA. This complementary binding is due to the fact that the nucleotide sequence of VGAM95 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM95 RNA, herein designated VGAM RNA, may have a different number of host target binding sites in untranslated regions of a VGAM95 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM95 RNA, herein designated VGAM RNA, to host target binding sites on VGAM95 host target RNA, herein designated VGAM HOST TARGET RNA, such as BINDING SITE I, BINDING SITE II and BINDING SITE III, inhibits translation of VGAM95 host target RNA into VGAM95 host target protein, herein designated VGAM HOST TARGET PROTEIN. VGAM host target protein is therefore outlined by a broken line.

It is appreciated that VGAM95 host target gene, herein designated VGAM HOST TARGET GENE, in fact represents a plurality of VGAM95 host target genes. The mRNA of each one of this plurality of VGAM95 host target genes comprises one or more host target binding sites, each having a nucleotide sequence which is at least partly complementary to VGAM95 RNA, herein designated VGAM RNA, and which when bound by VGAM95 RNA causes inhibition of translation of respective one or more VGAM95 host target proteins.

It is further appreciated by one skilled in the art that the mode of translational inhibition illustrated by FIG. 1 with specific reference to translational inhibition exerted by VGAM95 gene, herein designated VGAM GENE, on one or more VGAM95 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM95 is inhibition of expression of host target genes, as part of a novel viral mechanism of attacking a host. Accordingly, utilities of VGAM95 include diagnosis, prevention and treatment of viral infection by Plutella Xylostella Granulovirus. Specific functions, and accordingly utilities, of VGAM95 correlate with, and may be deduced from, the identity of the host target genes which VGAM95 binds and inhibits, and the function of these host target genes, as elaborated hereinbelow.

Nucleotide sequences of the VGAM95 precursor RNA, herein designated VGAM PRECURSOR RNA, and of the 'diced' VGAM95 RNA, herein designated VGAM RNA, and a schematic representation of the secondary folding of VGAM95 folded precursor RNA, herein designated VGAM FOLDED PRECURSOR RNA, of VGAM95 are further described hereinbelow with reference to Table 1.

Nucleotide sequences of host target binding sites, such as BINDING SITE-I, BINDING SITE-II and BINDING SITE-III of FIG. 1, found on VGAM95 host target RNA, and schematic representation of the complementarity of each of these host target binding sites to VGAM95 RNA, herein designated VGAM RNA, are described hereinbelow with reference to Table 2.

As mentioned hereinabove with reference to FIG. 1, a function of VGAM95 gene, herein designated VGAM is inhibition of expression of VGAM95 target genes. It is appreciated that specific functions, and accordingly utilities, of VGAM95 correlate with, and may be deduced from, the identity of the target genes which VGAM95 binds and inhibits, and the function of these target genes, as elaborated hereinbelow.

Calcium Channel, Voltage-dependent, Beta 2 Subunit (CACNB2, Accession NM_000724) is a VGAM95 host target gene. CACNB2 BINDING SITE is HOST TARGET binding site found in the 5' untranslated region of mRNA encoded by CACNB2, corresponding to a HOST TARGET binding site such as BINDING SITE I, BINDING SITE II or BINDING SITE III. Table 2 illustrates the complementarity of the nucleotide sequences of CACNB2 BINDING SITE, designated SEQ ID:6388, to the nucleotide sequence of VGAM95 RNA, herein designated VGAM RNA, also designated SEQ ID:2806.

A function of VGAM95 is therefore inhibition of Calcium Channel, Voltage-dependent, Beta 2 Subunit (CACNB2, Accession NM_000724). Accordingly, utilities of VGAM95 include diagnosis, prevention and treatment of diseases and clinical conditions associated with CACNB2. CD2-associated Protein (CD2AP, Accession NM_012120) is another VGAM95 host target gene. CD2AP BINDING SITE is HOST TARGET binding site found in the 3' untranslated region of mRNA encoded by CD2AP, corresponding to a HOST TARGET binding site such as BINDING SITE I, BINDING SITE II or BINDING SITE III. Table 2 illustrates the complementarity of the nucleotide sequences of CD2AP BINDING SITE, designated SEQ ID:14434, to the nucleotide sequence of VGAM95 RNA, herein designated VGAM RNA, also designated SEQ ID:2806.

Another function of VGAM95 is therefore inhibition of CD2-associated Protein (CD2AP, Accession NM_012120), a gene which binds CAS ligand and may therefor involves in its growth regulatory pathway. Accordingly, utilities of VGAM95 include diagnosis, prevention and treatment of diseases and clinical conditions associated with CD2AP. The function of CD2AP has been established by previous studies. P130(Cas) (OMIM Ref. No. 602941) is a docking protein that is tyrosine-phosphorylated in response to a variety of extracellular stimuli, such as growth factors, cell-cell interaction, and cell-matrix interaction, and appears to play a critical role in the integrin-linked formation of focal complexes. To understand the growth regulatory pathway of p130(Cas), Kirsch et al. (1999) used the yeast 2-hybrid system to search for interacting molecules. They identified a human protein, which they called CMS for p130(Cas) ligand with multiple SH3 domains, as a direct binding protein of p130(Cas). CMS is a multifunctional adapter-type molecule, which is localized in the cytoplasm, membrane ruffles, and leading edges of cells. Its structure and colocalization with F-actin (see OMIM Ref. No. 102610) and p130(Cas) suggested a function as a scaffolding protein involved in the dynamic regulation of the actin cytoskeleton. The cDNA corresponding to CMS encodes a protein of 639 amino acids with a deduced molecular mass of approximately 70 kD. Amino acid analysis revealed that CMS contains in its N terminus 3 SH3 domains followed by a proline-rich region containing binding sites for SH3 domains. Putative actin-binding sites and a coiled-coil domain are located at the C terminus of the protein, which also contains a putative leucine zipper motif. CMS mRNA is ubiquitously expressed in adult and fetal human tissues as an approximately 5.4-kb transcript, as detected by Northern blot analysis. CMS induces vesicle formation and colocalizes with p130(Cas) and F-actin to membrane ruffles. It also associates with and is phosphorylated by tyrosine kinases. Kirsch et al. (1999) demonstrated that CMS is able to homodimerize through the coiled-coil domain located in its C terminus. There was no evidence for intermolecular or intramolecular binding via the SH3 domains and PXXP binding. Animal model experiments lend further support to the function of CD2AP. Shih et al. (1999) generated mice lacking CD2AP by targeted disruption. In CD2AP-deficient mice, immune function was compromised, but the mice died from renal failure at 6 to 7 weeks of age. In the kidney, CD2AP was expressed primarily in glomerular epithelial cells. Knockout mice exhibited defects in epithelial cell foot processes, accompanied by mesangial cell hyperplasia and extracellular matrix deposition. CD2AP associated with nephrin (OMIM Ref. No. 602716), which is the primary component of the slit diaphragm. This observation supports a role for CD2AP in this specialized cell junction.

It is appreciated that the abovementioned animal model for CD2AP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kirsch, K. H.; Georgescu, M.-M.; Ishimaru, S.; Hanafusa, H.: CMS: an adapter molecule involved in cytoskeletal rearrangements. Proc. Nat. Acad. Sci. 96: 6211-6216, 1999; and Shih, N.-Y.; Li, J.; Karpitskii, V.; Nguyen, A.; Dustin, M. L.; Kanagawa, O.; Miner, J. H.; Shaw, A. S.: Congenital nephrotic syndrome in mice lacking CD2-associated protein. Science 2.

Further studies establishing the function and utilities of CD2AP are found in John Hopkins OMIM database record ID 604241, and in sited publications numbered 5273-5275 listed in the bibliography section hereinbelow, which are also hereby incorporated by reference. Exostoses (multiple)-like 3 (EXTL3, Accession NM_001440) is another VGAM95 host target gene. EXTL3 BINDING SITE is HOST TARGET binding site found in the 3' untranslated region of mRNA encoded by EXTL3, corresponding to a HOST TARGET binding site such as BINDING SITE I, BINDING SITE II or BINDING SITE III. Table 2 illustrates the complementarity of the nucleotide sequences of EXTL3 BINDING SITE, designated SEQ ID:7168, to the nucleotide sequence of VGAM95 RNA, herein designated VGAM RNA, also designated SEQ ID:2806.

Another function of VGAM95 is therefore inhibition of Exostoses (multiple)-like 3 (EXTL3, Accession NM_001440), a gene which a member of the multiple exostoses gene family. Accordingly, utilities of VGAM95 include diagnosis, prevention and treatment of diseases and clinical conditions associated with EXTL3. The function of EXTL3 has been established by previous studies. By EST database searching with the sequences of EXT1 (OMIM Ref. No. 133700), EXT2 (OMIM Ref. No. 133701), and EXTL1 (OMIM Ref. No. 601738), followed by 5-prime and 3-prime RACE, Saito et al. (1998) cloned full-length cDNAs for 2 new members of the EXT family, EXTL2 (OMIM Ref. No. 602411) and EXTL3, which they called EXTR2 and EXTR1, respectively. The deduced 919-amino acid EXTL3 protein contains a highly conserved region in the C terminus common to other EXT proteins. Northern blot analysis detected expression of 6.2- and 4.7-kb EXTR1 transcripts in all tissues tested except ovary. The larger transcript was predominant in brain, skeletal muscle, and testis, and the shorter transcript in heart, liver, thymus, and prostate. Kobayashi et al. (2000) isolated a cDNA for a REG protein (see OMIM Ref. No. 167770) receptor from a rat islet cDNA library. Cells into which the cDNA had been introduced bound REG protein with high affinity. When the cDNA was introduced into a pancreatic beta-cell line that showed REG-dependent growth, the transformants exhibited a significant increase in the incorporation of 5-prime-bromo-2-prime-deoxyuridine as well as in the cell numbers in response to REG protein. A homology search revealed that the rat REG protein receptor cDNA is a homolog of EXTL3. The rat and human proteins share 97% sequence identity. Kobayashi et al. (2000) found that REG receptor mRNA in the rat is detectable in liver, kidney, stomach, small intestine, colon, adrenal gland, pituitary gland, and brain, but not in heart, suggesting the possible involvement of the REG-REG protein receptor signal system in a variety of cell types other than pancreatic beta cells. By somatic cell hybrid and radiation hybrid analyses, Saito et al. (1998) mapped the human EXTL3 gene to chromosome 8p21. By FISH, radiation hybrid analysis, and inclusion within a mapped contig, Van Hul et al. (1998) mapped the gene to 8p21-p12.

Full details of the abovementioned studies are described in the following publications, the disclosure of which are hereby incorporated by reference:

Saito, T.; Seki, N.; Yamauchi, M.; Tsuji, S.; Hayashi, A.; Kozuma, S.; Hori, T.: Structure, chromosomal location, and expression profile of EXTR1 and EXTR2, new members of the multiple exostoses gene family. Biochem. Biophys. Res. Commun. 243:61-66, 1998; and Van Hul, W.; Wuyts, W.; Hendrickx, J.; Speleman, F.; Wauters, J.; De Boulle, K.; Van Roy, N.; Bossuyt, P.; Willems, P. J.: Identification of a third EXT-like gene (EXTL3) belonging to.

Further studies establishing the function and utilities of EXTL3 are found in John Hopkins OMIM database record ID 605744, and in sited publications numbered 450 and 6016 listed in the bibliography section hereinbelow, which are also hereby incorporated by reference. Muscleblind-like (Drosophila) (MBNL, Accession NM_021038) is another VGAM95 host target gene. MBNL BINDING SITE is HOST TARGET binding site found in the 3' untranslated region of mRNA encoded by MBNL, corresponding to a HOST TARGET binding site such as BINDING SITE I, BINDING SITE II or BINDING SITE III. Table 2 illustrates the complementarity of the nucleotide sequences of MBNL BINDING SITE, designated SEQ ID:22029, to the nucleotide sequence of VGAM95 RNA, herein designated VGAM RNA, also designated SEQ ID:2806.

Another function of VGAM95 is therefore inhibition of Muscleblind-like (Drosophila) (MBNL, Accession NM_021038), a gene which binds to cug triplet repeat expansion dsrna (by similarity). Accordingly, utilities of VGAM95 include diagnosis, prevention and treatment of diseases and clinical conditions associated with MBNL. The function of MBNL has been established by previous studies. By screening for cDNAs with the potential to encode large proteins expressed in brain, Ishikawa et al. (1997) identified a cDNA encoding MBNL, which they designated KIAA0428. KIAA0428 encodes a deduced 370-amino acid protein. RT-PCR analysis detected highest expression of KIAA0428 in skeletal muscle, followed by prostate, lung, heart, small intestine, ovary, and placenta. Triplet repeat expansion disorders (e.g., myotonic dystrophy; 160900) are characterized by genetic anticipation in which disease severity is proportional and age-of-onset is inversely proportional to the size of the expansion mutation. By biochemical purification of HeLa cell proteins binding to dystrophia myotonica (DM1) protein kinase (DMPK; 605377) RNAs with variable numbers of CUG repeats, followed by peptide sequence analysis and PCR, Miller et al. (2000) isolated cDNAs encoding isoforms of MBNL, which they termed EXP. The 42- and 40-kD isoforms, EXP42 and EXP40, are identical to a previously identified 388-amino acid MBNL protein (GenBank CAA74155) and KIAA0428, respectively, while the 35-kD isoform, EXP35, is a novel 305-amino acid protein. Northern blot analysis revealed 6.5- and 5.3-kb EXP transcripts that were highly expressed in cardiac and skeletal muscle. Western blot analysis showed high expression of EXP42 in HeLa and lymphoblastoid cell lines. Immunofluorescence microscopy demonstrated nuclear and cytoplasmic expression of EXP42 in normal myoblasts, while nuclear foci were enriched in DM1 myoblasts. FISH and immunofluorescence analyses suggested that DMPK mutant RNAs recruit and sequester EXP dsRNA-binding proteins. Miller et al. (2000) proposed that the DM1 mutation produces a competing dsRNA-binding substrate that recruits the EXP proteins and sequesters them away from their normal RNA-binding sites during cell differentiation. By radiation hybrid analysis, Ishikawa et al. (1997) mapped the MBNL gene to chromosome 3. Miller et al. (2000) mapped the MBNL gene to 3q25, distal to the DM2

(OMIM Ref. No. 602668) and PROMM (OMIM Ref. No. 600109) loci on 3q21.

Full details of the abovementioned studies are described in the following publications, the disclosure of which are hereby incorporated by reference:

Miller, J. W.; Urbinati, C. R.; Teng-umnuay, P.; Stenberg, M. G.; Byrne, B. J.; Thornton, C. A.; Swanson, M. S.: Recruitment of human muscleblind proteins to (CUG) n expansions associated with myotonic dystrophy. EMBO J. 19:4439-4448, 2000; and Ishikawa, K.; Nagase, T.; Nakajima, D.; Seki, N.; Ohira, M.; Miyajima, N.; Tanaka, A.; Kotani, H.; Nomura, N.; Ohara, O.: Prediction of the coding sequences of unidentified human genes.

Further studies establishing the function and utilities of MBNL are found in John Hopkins OMIM database record ID 606516, and in sited publications numbered 627 and 8760 listed in the bibliography section hereinbelow, which are also hereby incorporated by reference. Mannosyl (alpha-1,3-)-glycoprotein Beta-1,4-N-acetylglucosaminyltransferase, Isoenzyme B (MGAT4B, Accession NM_054013) is another VGAM95 host target gene. MGAT4B BINDING SITE is HOST TARGET binding site found in the 5' untranslated region of mRNA encoded by MGAT4B, corresponding to a HOST TARGET binding site such as BINDING SITE I, BINDING SITE II or BINDING SITE III. Table 2 illustrates the complementarity of the nucleotide sequences of MGAT4B BINDING SITE, designated SEQ ID:27621, to the nucleotide sequence of VGAM95 RNA, herein designated VGAM RNA, also designated SEQ ID:2806.

Another function of VGAM95 is therefore inhibition of Mannosyl (alpha-1,3-)-glycoprotein Beta-1,4-N-acetylglucosaminyltransferase, Isoenzyme B (MGAT4B, Accession NM_054013). Accordingly, utilities of VGAM95 include diagnosis, prevention and treatment of diseases and clinical conditions associated with MGAT4B. Non-POU Domain Containing, Octamer-binding (NONO, Accession XM_088688) is another VGAM95 host target gene. NONO BINDING SITE is HOST TARGET binding site found in the 3' untranslated region of mRNA encoded by NONO, corresponding to a HOST TARGET binding site such as BINDING SITE I, BINDING SITE II or BINDING SITE III. Table 2 illustrates the complementarity of the nucleotide sequences of NONO BINDING SITE, designated SEQ ID:39900, to the nucleotide sequence of VGAM95 RNA, herein designated VGAM RNA, also designated SEQ ID:2806.

Another function of VGAM95 is therefore inhibition of Non-POU Domain Containing, Octamer-binding (NONO, Accession XM_088688), a gene which is a nuclear protein which contains RNA recognition motifs. Accordingly, utilities of VGAM95 include diagnosis, prevention and treatment of diseases and clinical conditions associated with NONO. The function of NONO has been established by previous studies. Dong et al. (1993) purified and cloned the cDNA of HeLa cell p54nrb, a nuclear protein with 2 RNA recognition motifs and extensive homology to human splicing factor PSF and Drosophila NONA/BJ6. Brown et al. (1997) examined the expression of 33 X-linked genes in 8 mouse/human somatic cell hybrids that contained either the human active (3 hybrids) or inactive (5 hybrids) X chromosome. They found that the p54nrb gene was expressed only in those hybrids with the active human X. Using a megabase scale from pter to qter devised by Nelson et al. (1995), they noted that the approximate physical position of the gene was 70 Mb from pter. Brown et al. (1997) placed it in almost exactly the same position as the CCG1 gene (TAF2A; 313650), which had been mapped to Xq13-q27, and approximately 2 Mb proximal to PHKA1 (OMIM Ref. No. 311870), which had been mapped to Xq13. Thus, Xq13 is the likely location. The AFX1 gene (OMIM Ref. No. 300033) and the NRB54 gene map to a yeast artificial chromosome (YAC) contig of Xq13.1 that harbors the X-linked dystonia-parkinsonism locus DYT3 (OMIM Ref. No. 314250). Peters et al. (1997) found that the AFX1 gene is composed of 3 exons with most of exon 3 being untranslated. The NRB54 gene is made up of 12 exons ranging in size from 40 to 1,227 bp. The start codon is in exon 3 and the stop codon in exon 12. Both genes are expressed in the brain, among other tissues. Peters et al. (1997) excluded both genes as candidates of DYT3 by sequencing of the exons and the flanking intronic sequences in a patient and a control, and by Northern blot analysis.

Full details of the abovementioned studies are described in the following publications, the disclosure of which are hereby incorporated by reference:

Brown, C. J.; Carrel, L.; Willard, H. F.: Expression of genes from the human active and inactive X chromosomes. Am. J. Hum. Genet. 60:1333-1343, 1997; and Peters, U.; Haberhausen, G.; Kostrzewa, M.; Nolte, D.; Muller, U.: AFX1 and p54(nrb): fine mapping, genomic structure, and exclusion as candidate genes of X-linked dystonia parkinsonism.

Further studies establishing the function and utilities of NONO are found in John Hopkins OMIM database record ID 300084, and in sited publications numbered 10974-1097 and 8709 listed in the bibliography section hereinbelow, which are also hereby incorporated by reference. Pim-1 Oncogene (PIM1, Accession XM_165800) is another VGAM95 host target gene. PIM1 BINDING SITE is HOST TARGET binding site found in the 3' untranslated region of mRNA encoded by PIM1, corresponding to a HOST TARGET binding site such as BINDING SITE I, BINDING SITE II or BINDING SITE III. Table 2 illustrates the complementarity of the nucleotide sequences of PIM1 BINDING SITE, designated SEQ ID:43756, to the nucleotide sequence of VGAM95 RNA, herein designated VGAM RNA, also designated SEQ ID:2806.

Another function of VGAM95 is therefore inhibition of Pim-1 Oncogene (PIM1, Accession XM_165800), a gene which is a proto-oncogene. Accordingly, utilities of VGAM95 include diagnosis, prevention and treatment of diseases and clinical conditions associated with PIM1. The function of PIM1 has been established by previous studies. Amson et al. (1989) showed that the 33-kD product of the PIM gene is highly expressed in the liver and spleen during fetal hematopoiesis. In contrast, it is only slightly expressed in circulating granulocytes in adults. It was overexpressed in hematopoietic malignancies, particularly in myeloid and lymphoid acute leukemias. The results implied a physiologic role of the PIM1 oncogene during hematopoietic development and a deregulation of the gene in various leukemias Animal model experiments lend further support to the function of PIM1. To understand the function of Pim1 and its role in hematopoietic development, Laird et al. (1993) generated mice deficient in Pim1 function. Pim1-deficient mice were ostensibly normal, healthy, and fertile; however, detailed analysis demonstrated a correlation of Pim1 deficiency with erythrocyte microcytosis, whereas overexpression of Pim1 in transgenic mice resulted in erythrocyte macrocytosis It is appreciated that the abovementioned animal model for PIM1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Laird, P. W.; van der Lugt, N. M. T.; Clarke, A.; Domen, J.; Linders, K.; McWhir, J.; Berns, A.; Hooper, M.: In vivo analysis of Pim-1 deficiency. Nucleic Acids Res. 21:4750-4755, 1993; and Amson, R.; Sigaux, F.; Przedborski, S.; Flandrin, G.; Givol, D.; Telerman, A.: The human proto-oncogene product p33pim is expressed during fetal hematopoiesis and in diverse leukemias. Proc.

Further studies establishing the function and utilities of PIM1 are found in John Hopkins OMIM database record ID 164960, and in sited publications numbered 10810-10812, 1156 and 11115-11114 listed in the bibliography section hereinbelow, which are also hereby incorporated by reference. Plasminogen Activator, Tissue (PLAT, Accession NM_000930) is another VGAM95 host target gene. PLAT BINDING SITE1 and PLAT BINDING SITE2 are HOST TARGET binding sites found in untranslated regions of mRNA encoded by PLAT, corresponding to HOST TARGET binding sites such as BINDING SITE I, BINDING SITE II or BINDING SITE III. Table 2 illustrates the complementarity of the nucleotide sequences of PLAT BINDING SITE1 and PLAT BINDING SITE2, designated SEQ ID:6638 and SEQ ID:26897 respectively, to the nucleotide sequence of VGAM95 RNA, herein designated VGAM RNA, also designated SEQ ID:2806.

Another function of VGAM95 is therefore inhibition of Plasminogen Activator, Tissue (PLAT, Accession NM_000930). Accordingly, utilities of VGAM95 include diagnosis, prevention and treatment of diseases and clinical conditions associated with PLAT. Reticulocalbin 2, EF-hand Calcium Binding Domain (RCN2, Accession NM_002902) is another VGAM95 host target gene. RCN2 BINDING SITE is HOST TARGET binding site found in the 3' untranslated region of mRNA encoded by RCN2, corresponding to a HOST TARGET binding site such as BINDING SITE I, BINDING SITE II or BINDING SITE III. Table 2 illustrates the complementarity of the nucleotide sequences of RCN2 BINDING SITE, designated SEQ ID:8805, to the nucleotide sequence of VGAM95 RNA, herein designated VGAM RNA, also designated SEQ ID:2806.

Another function of VGAM95 is therefore inhibition of Reticulocalbin 2, EF-hand Calcium Binding Domain (RCN2, Accession NM_002902), a gene which binds calcium and interacts with papillomavirus E6 oncoprotein. Accordingly, utilities of VGAM95 include diagnosis, prevention and treatment of diseases and clinical conditions associated with RCN2. The function of RCN2 has been established by previous studies. One major class of calcium-binding proteins is the EF-hand proteins, which includes calmodulin (see OMIM Ref. No. CALM1; 114180). Members of this family contain a helix-loop-helix motif, called the EF-hand, that coordinates calcium with high specificity. The endoplasmic reticulum (ER) is the major calcium storage compartment in nonmuscle eukaryotic cells. By screening a HeLa cell cDNA expression library with autoimmune serum from a patient, Weis et al. (1994) cloned a human cDNA encoding an EF-hand protein, named RCN2. The predicted 317-amino acid RCN2 protein contains an N-terminal signal sequence, 6 copies of the EF-hand motif, and a C-terminal His-Asp-Glu-Leu (HDEL) sequence, which was originally defined as an ER retention motif in yeast proteins. Immunocytolocalization and cell fractionation studies demonstrated that RCN2 is a resident ER protein; the HDEL motif is required for its ER retention. RCN2 was detected by antibodies in all cell lines tested. It binds calcium in vitro. By Western blotting, in vitro translated RCN2 protein has a molecular mass of 55 kD, leading the authors to designate it the 'endoplasmic reticulum calcium-binding protein of 55 kD' (ERC55). The RCN2 gene was assigned by a radiation hybrid panel to human chromosome 15, between D15S215 and D15S206 by Genethon, and between D15S114 and D15S1041 by the Stanford Human Genome Center (Schuler et al., 1996). By fluorescence in situ hybridization, Wang et al. (1997) mapped the RCN2 gene to 15q23. Because type 4 Bardet-Biedl syndrome (OMIM Ref. No. 600374) maps to this region, RCN2 may be implicated in the causation of that disorder.

Full details of the abovementioned studies are described in the following publications, the disclosure of which are hereby incorporated by reference:

Weis, K.; Griffiths, G.; Lamond, A. I.: The endoplasmic reticulum calcium-binding protein of 55 kDa is a novel EF-hand protein retained in the endoplasmic reticulum by a carboxyl-terminal His-Asp-Glu-Leu motif. J. Biol. Chem. 269: 19142-19150, 1994; and Wang, J. Y.; Zhen, D. K.; Bianchi, D. W.; Androphy, E. J.; Chen, J. J.: Assignment of the gene for ERC-55 (RCN2) to human chromosome band 15q22.33-q24.1 by in situ hybridization. Cytog.

Further studies establishing the function and utilities of RCN2 are found in John Hopkins OMIM database record ID 602584, and in sited publications numbered 9044-904 and 12708-9047 listed in the bibliography section hereinbelow, which are also hereby incorporated by reference. TAR (HIV) RNA Binding Protein 2 (TARBP2, Accession NM_134324) is another VGAM95 host target gene. TARBP2 BINDING SITE is HOST TARGET binding site found in the 3' untranslated region of mRNA encoded by TARBP2, corresponding to a HOST TARGET binding site such as BINDING SITE I, BINDING SITE II or BINDING SITE III. Table 2 illustrates the complementarity of the nucleotide sequences of TARBP2 BINDING SITE, designated SEQ ID:28629, to the nucleotide sequence of VGAM95 RNA, herein designated VGAM RNA, also designated SEQ ID:2806.

Another function of VGAM95 is therefore inhibition of TAR (HIV) RNA Binding Protein 2 (TARBP2, Accession NM_134324), a gene which is involved in the regulation of HIV replication. Accordingly, utilities of VGAM95 include diagnosis, prevention and treatment of diseases and clinical conditions associated with TARBP2. The function of TARBP2 has been established by previous studies. By screening a HeLa cell cDNA library with a TAR RNA probe, Gatignol et al. (1991) purified a cDNA, TARBP2, encoding a 345-amino acid protein termed TRBP by the authors. Mutation analysis showed that the TARBP2 protein binds to the helix between the bulge and the loop of the TAR RNA. Functional analysis demonstrated that TARBP2 enhanced expression of the HIV-1 LTR 20- to 60-fold and that the transactivation required an intact TAR RNA structure. By sequence analysis, Kozak et al. (1995) determined that human and mouse TARBP2 genes are expressed as 1.6-kb transcripts. However, immunoblot analysis revealed that TARBP2 encodes 90- and 37-kD proteins in mouse cells, a 37-kD protein in hamster cells, and a 55-kD protein in monkey and human cells.

Full details of the abovementioned studies are described in the following publications, the disclosure of which are hereby incorporated by reference:

Gatignol, A.; Buckler-White, A.; Berkhout, B.; Jeang, K. T.: Characterization of a human TAR RNA-binding protein that activates the HIV-1 LTR. Science 251:1597-1600, 1991; and Kozak, C. A.; Gatignol, A.; Graham, K.; Jeang, K. T.; McBride, O. W.: Genetic mapping in human and mouse of the locus encoding TRBP, a protein that binds the TAR region of the human i.

Further studies establishing the function and utilities of TARBP2 are found in John Hopkins OMIM database record ID 605053, and in sited publications numbered 5027-5029 listed in the bibliography section hereinbelow, which are also hereby incorporated by reference. Tight Junction Protein 1 (zona occludens 1) (TJP1, Accession NM_003257) is another VGAM95 host target gene. TJP1 BINDING SITE is HOST TARGET binding site found in the 3' untranslated region of mRNA encoded by TJP1, corresponding to a HOST TARGET binding site such as BINDING SITE I, BINDING SITE II or BINDING SITE III. Table 2 illustrates the complementarity of the nucleotide sequences of TJP1 BINDING SITE, designated SEQ ID:9268, to the nucleotide sequence of VGAM95 RNA, herein designated VGAM RNA, also designated SEQ ID:2806.

Another function of VGAM95 is therefore inhibition of Tight Junction Protein 1 (zona occludens 1) (TJP1, Accession NM_003257), a gene which colocalizes and interacts with cadherins in cells lacking tight junctions. Accordingly, utilities of VGAM95 include diagnosis, prevention and treatment of diseases and clinical conditions associated with TJP1. The function of TJP1 has been established by previous studies. Tight junction (zonula occludens) protein 1 (TJP1), also referred to as ZO-1, is a 200-kD protein located on a cytoplasmic membrane surface of vertebrate intercellular tight junctions. Willott et al. (1993) isolated a full-length cDNA sequence for human TJP1. Although the function of TJP1 is unknown, the cDNA sequence predicted a multi-domain signaling protein homologous to the product of the 'discs large-1' tumor suppressor gene of Drosophila (OMIM Ref. No. 601014) and several other membrane-associated proteins in mammals. By fluorescence in situ hybridization using a cDNA probe, Mohandas et al. (1995) mapped TJP1 to 15q13. The Jackson Laboratory backcross DNA panel derived from interspecies crosses was used to map Tjp1 to mouse chromosome 7 in a region with conserved homology to 15q13. Fluorescence in situ hybridization studies on metaphases from patients with the Prader-Willi syndrome (OMIM Ref. No. 176270) and/or the Angelman syndrome (OMIM Ref. No. 105830) showed that TJP1 maps close but distal to the PWS/AS chromosome region.

Full details of the abovementioned studies are described in the following publications, the disclosure of which are hereby incorporated by reference:

Mohandas, T. K.; Chen, X.-N.; Rowe, L. B.; Birkenmeier, E. H.; Fanning, A. S.; Anderson, J. M.; Korenberg, J. R.: Localization of the tight junction protein gene TJP1 to human chromosome 15q13, distal to the Prader-Willi/Angelman region, and to mouse chromosome 7. Genomics 30:594-597, 1995; and Willott, E.; Balda, M. S.; Fanning, A. S.; Jameson, B.; Van Itallie, C.; Anderson, J. M.: The tight junction protein ZO-1 is homologous to the Drosophila discs-large tumor suppressor pr.

Further studies establishing the function and utilities of TJP1 are found in John Hopkins OMIM database record ID 601009, and in sited publications numbered 9454-9455 listed in the bibliography section hereinbelow, which are also hereby incorporated by reference. Cdc42 Guanine Nucleotide Exchange Factor (GEF) 9 (ARHGEF9, Accession NM_015185) is another VGAM95 host target gene. ARHGEF9 BINDING SITE is HOST TARGET binding site found in the 3' untranslated region of mRNA encoded by ARHGEF9, corresponding to a HOST TARGET binding site such as BINDING SITE I, BINDING SITE II or BINDING SITE III. Table 2 illustrates the complementarity of the nucleotide sequences of ARHGEF9 BINDING SITE, designated SEQ ID:17542, to the nucleotide sequence of VGAM95 RNA, herein designated VGAM RNA, also designated SEQ ID:2806.

Another function of VGAM95 is therefore inhibition of Cdc42 Guanine Nucleotide Exchange Factor (GEF) 9 (ARHGEF9, Accession NM_015185). Accordingly, utilities of VGAM95 include diagnosis, prevention and treatment of diseases and clinical conditions associated with ARHGEF9. BCMP1 (Accession NM_031442) is another VGAM95 host target gene. BCMP1 BINDING SITE is HOST TARGET binding site found in the 3' untranslated region of mRNA encoded by BCMP1, corresponding to a HOST TARGET binding site such as BINDING SITE I, BINDING SITE II or BINDING SITE III. Table 2 illustrates the complementarity of the nucleotide sequences of BCMP1 BINDING SITE, designated SEQ ID:25457, to the nucleotide sequence of VGAM95 RNA, herein designated VGAM RNA, also designated SEQ ID:2806.

Another function of VGAM95 is therefore inhibition of BCMP1 (Accession NM_031442). Accordingly, utilities of VGAM95 include diagnosis, prevention and treatment of diseases and clinical conditions associated with BCMP1. Calmegin (CLGN, Accession NM_004362) is another VGAM95 host target gene. CLGN BINDING SITE is HOST TARGET binding site found in the 3' untranslated region of mRNA encoded by CLGN, corresponding to a HOST TARGET binding site such as BINDING SITE I, BINDING SITE II or BINDING SITE III. Table 2 illustrates the complementarity of the nucleotide sequences of CLGN BINDING SITE, designated SEQ ID:10570, to the nucleotide sequence of VGAM95 RNA, herein designated VGAM RNA, also designated SEQ ID:2806.

Another function of VGAM95 is therefore inhibition of Calmegin (CLGN, Accession NM_004362). Accordingly, utilities of VGAM95 include diagnosis, prevention and treatment of diseases and clinical conditions associated with CLGN. CMG2 (Accession NM_058172) is another VGAM95 host target gene. CMG2 BINDING SITE is HOST TARGET binding site found in the 3' untranslated region of mRNA encoded by CMG2, corresponding to a HOST TARGET binding site such as BINDING SITE I, BINDING SITE II or BINDING SITE III. Table 2 illustrates the complementarity of the nucleotide sequences of CMG2 BINDING SITE, designated SEQ ID:27722, to the nucleotide sequence of VGAM95 RNA, herein designated VGAM RNA, also designated SEQ ID:2806.

Another function of VGAM95 is therefore inhibition of CMG2 (Accession NM_058172). Accordingly, utilities of VGAM95 include diagnosis, prevention and treatment of diseases and clinical conditions associated with CMG2. DKFZP434E2318 (Accession NM_032138) is another VGAM95 host target gene. DKFZP434E2318 BINDING SITE is HOST TARGET binding site found in the 3' untranslated region of mRNA encoded by DKFZP434E2318, corresponding to a HOST TARGET binding site such as BINDING SITE I, BINDING SITE II or BINDING SITE III. Table 2 illustrates the complementarity of the nucleotide sequences of DKFZP434E2318 BINDING SITE, designated SEQ ID:25817, to the nucleotide sequence of VGAM95 RNA, herein designated VGAM RNA, also designated SEQ ID:2806.

Another function of VGAM95 is therefore inhibition of DKFZP434E2318 (Accession NM_032138). Accordingly, utilities of VGAM95 include diagnosis, prevention and treatment of diseases and clinical conditions associated with DKFZP434E2318. DKFZp761D112 (Accession NM_032297) is another VGAM95 host target gene. DKFZp761D112 BINDING SITE is HOST TARGET binding site found in the 3' untranslated region of mRNA encoded by DKFZp761D112, corresponding to a HOST TARGET binding site such as BINDING SITE I, BINDING SITE II or BINDING SITE III. Table 2 illustrates the complementarity of the nucleotide sequences of DKFZp761D112 BINDING SITE, designated SEQ ID:26078, to the nucleotide sequence of VGAM95 RNA, herein designated VGAM RNA, also designated SEQ ID:2806.

Another function of VGAM95 is therefore inhibition of DKFZp761D112 (Accession NM_032297). Accordingly, utilities of VGAM95 include diagnosis, prevention and treatment of diseases and clinical conditions associated with DKFZp761D112. FHR5 (Accession NM_030787) is another VGAM95 host target gene. FHR5 BINDING SITE is HOST TARGET binding site found in the 3' untranslated region of mRNA encoded by FHR5, corresponding to a HOST TARGET binding site such as BINDING SITE I, BINDING SITE II or BINDING SITE III. Table 2 illustrates the complementarity of the nucleotide sequences of FHR5 BINDING SITE, designated SEQ ID:25086, to the nucleotide sequence of VGAM95 RNA, herein designated VGAM RNA, also designated SEQ ID:2806.

Another function of VGAM95 is therefore inhibition of FHR5 (Accession NM_030787). Accordingly, utilities of VGAM95 include diagnosis, prevention and treatment of diseases and clinical conditions associated with FHR5. FLJ22390 (Accession NM_022746) is another VGAM95 host target gene. FLJ22390 BINDING SITE is HOST TARGET binding site found in the 5' untranslated region of mRNA encoded by FLJ22390, corresponding to a HOST TARGET binding site such as BINDING SITE I, BINDING SITE II or BINDING SITE III. Table 2 illustrates the complementarity of the nucleotide sequences of FLJ22390 BINDING SITE, designated SEQ ID:22959, to the nucleotide sequence of VGAM95 RNA, herein designated VGAM RNA, also designated SEQ ID:2806.

Another function of VGAM95 is therefore inhibition of FLJ22390 (Accession NM_022746). Accordingly, utilities of VGAM95 include diagnosis, prevention and treatment of diseases and clinical conditions associated with FLJ22390. FLJ31153 (Accession NM_144600) is another VGAM95 host target gene. FLJ31153 BINDING SITE is HOST TARGET binding site found in the 3' untranslated region of mRNA encoded by FLJ31153, corresponding to a HOST TARGET binding site such as BINDING SITE I, BINDING SITE II or BINDING SITE III. Table 2 illustrates the complementarity of the nucleotide sequences of FLJ31153 BINDING SITE, designated SEQ ID:29416, to the nucleotide sequence of VGAM95 RNA, herein designated VGAM RNA, also designated SEQ ID:2806.

Another function of VGAM95 is therefore inhibition of FLJ31153 (Accession NM_144600). Accordingly, utilities of VGAM95 include diagnosis, prevention and treatment of diseases and clinical conditions associated with FLJ31153. Far Upstream Element (FUSE) Binding Protein 3 (FUBP3, Accession XM_033327) is another VGAM95 host target gene. FUBP3 BINDING SITE is HOST TARGET binding site found in the 3' untranslated region of mRNA encoded by FUBP3, corresponding to a HOST TARGET binding site such as BINDING SITE I, BINDING SITE II or BINDING SITE III. Table 2 illustrates the complementarity of the nucleotide sequences of FUBP3 BINDING SITE, designated SEQ ID:31875, to the nucleotide sequence of VGAM95 RNA, herein designated VGAM RNA, also designated SEQ ID:2806.

Another function of VGAM95 is therefore inhibition of Far Upstream Element (FUSE) Binding Protein 3 (FUBP3, Accession XM_033327). Accordingly, utilities of VGAM95 include diagnosis, prevention and treatment of diseases and clinical conditions associated with FUBP3. GTP Binding Protein 1 (GTPBP1, Accession NM_004286) is another VGAM95 host target gene. GTPBP1 BINDING SITE is HOST TARGET binding site found in the 5' untranslated region of mRNA encoded by GTPBP1, corresponding to a HOST TARGET binding site such as BINDING SITE I, BINDING SITE II or BINDING SITE III. Table 2 illustrates the complementarity of the nucleotide sequences of GTPBP1 BINDING SITE, designated SEQ ID:10498, to the nucleotide sequence of VGAM95 RNA, herein designated VGAM RNA, also designated SEQ ID:2806.

Another function of VGAM95 is therefore inhibition of GTP Binding Protein 1 (GTPBP1, Accession NM_004286). Accordingly, utilities of VGAM95 include diagnosis, prevention and treatment of diseases and clinical conditions associated with GTPBP1. KIAA0237 (Accession NM_014747) is another VGAM95 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16452, to the nucleotide sequence of VGAM95 RNA, herein designated VGAM RNA, also designated SEQ ID:2806.

Another function of VGAM95 is therefore inhibition of KIAA0237 (Accession NM_014747). Accordingly, utilities of VGAM95 include diagnosis, prevention and treatment of diseases and clinical conditions associated with KIAA0237. KIAA0420 (Accession XM_032693) is another VGAM95 host target gene. KIAA0420 BINDING SITE is HOST TARGET binding site found in the 3' untranslated region of mRNA encoded by KIAA0420, corresponding to a HOST TARGET binding site such as BINDING SITE I, BINDING SITE II or BINDING SITE III. Table 2 illustrates the complementarity of the nucleotide sequences of KIAA0420 BINDING SITE, designated SEQ ID:31727, to the nucleotide sequence of VGAM95 RNA, herein designated VGAM RNA, also designated SEQ ID:2806.

Another function of VGAM95 is therefore inhibition of KIAA0420 (Accession XM_032693). Accordingly, utilities of VGAM95 include diagnosis, prevention and treatment of diseases and clinical conditions associated with KIAA0420. KIAA0483 (Accession NM_015176) is another VGAM95 host target gene. KIAA0483 BINDING SITE is HOST TARGET binding site found in the 3' untranslated region of mRNA encoded by KIAA0483, corresponding to a HOST TARGET binding site such as BINDING SITE I, BINDING SITE II or BINDING SITE III. Table 2 illustrates the complementarity of the nucleotide sequences of KIAA0483 BINDING SITE, designated SEQ ID:17530, to the nucleotide sequence of VGAM95 RNA, herein designated VGAM RNA, also designated SEQ ID:2806.

Another function of VGAM95 is therefore inhibition of KIAA0483 (Accession NM_015176). Accordingly, utilities of VGAM95 include diagnosis, prevention and treatment of diseases and clinical conditions associated with KIAA0483. KIAA0515 (Accession XM_033380) is another VGAM95 host target gene. KIAA0515 BINDING SITE is HOST TARGET binding site found in the 5' untranslated region of mRNA encoded by KIAA0515, corresponding to a HOST TARGET binding site such as BINDING SITE I, BINDING SITE II or BINDING SITE III. Table 2 illustrates the complementarity of the nucleotide sequences of KIAA0515 BINDING SITE, designated SEQ ID:31927, to the nucleotide sequence of VGAM95 RNA, herein designated VGAM RNA, also designated SEQ ID:2806.

Another function of VGAM95 is therefore inhibition of KIAA0515 (Accession XM_033380). Accordingly, utilities of VGAM95 include diagnosis, prevention and treatment of diseases and clinical conditions associated with KIAA0515.

KIAA0759 (Accession XM_041090) is another VGAM95 host target gene. KIAA0759 BINDING SITE is HOST TARGET binding site found in the 3' untranslated region of mRNA encoded by KIAA0759, corresponding to a HOST TARGET binding site such as BINDING SITE I, BINDING SITE II or BINDING SITE III. Table 2 illustrates the complementarity of the nucleotide sequences of KIAA0759 BINDING SITE, designated SEQ ID:33443, to the nucleotide sequence of VGAM95 RNA, herein designated VGAM RNA, also designated SEQ ID:2806.

Another function of VGAM95 is therefore inhibition of KIAA0759 (Accession XM_041090). Accordingly, utilities of VGAM95 include diagnosis, prevention and treatment of diseases and clinical conditions associated with KIAA0759.

KIAA1155 (Accession XM_030864) is another VGAM95 host target gene. KIAA1155 BINDING SITE is HOST TARGET binding site found in the 3' untranslated region of mRNA encoded by KIAA1155, corresponding to a HOST TARGET binding site such as BINDING SITE I, BINDING SITE II or BINDING SITE III. Table 2 illustrates the complementarity of the nucleotide sequences of KIAA1155 BINDING SITE, designated SEQ ID:31196, to the nucleotide sequence of VGAM95 RNA, herein designated VGAM RNA, also designated SEQ ID:2806.

Another function of VGAM95 is therefore inhibition of KIAA1155 (Accession XM_030864). Accordingly, utilities of VGAM95 include diagnosis, prevention and treatment of diseases and clinical conditions associated with KIAA1155.

KIAA1449 (Accession NM_020839) is another VGAM95 host target gene. KIAA1449 BINDING SITE is HOST TARGET binding site found in the 3' untranslated region of mRNA encoded by KIAA1449, corresponding to a HOST TARGET binding site such as BINDING SITE I, BINDING SITE II or BINDING SITE III. Table 2 illustrates the complementarity of the nucleotide sequences of KIAA1449 BINDING SITE, designated SEQ ID:21900, to the nucleotide sequence of VGAM95 RNA, herein designated VGAM RNA, also designated SEQ ID:2806.

Another function of VGAM95 is therefore inhibition of KIAA1449 (Accession NM_020839). Accordingly, utilities of VGAM95 include diagnosis, prevention and treatment of diseases and clinical conditions associated with KIAA1449.

KIAA1656 (Accession XM_038022) is another VGAM95 host target gene. KIAA1656 BINDING SITE is HOST TARGET binding site found in the 3' untranslated region of mRNA encoded by KIAA1656, corresponding to a HOST TARGET binding site such as BINDING SITE I, BINDING SITE II or BINDING SITE III. Table 2 illustrates the complementarity of the nucleotide sequences of KIAA1656 BINDING SITE, designated SEQ ID:32735, to the nucleotide sequence of VGAM95 RNA, herein designated VGAM RNA, also designated SEQ ID:2806.

Another function of VGAM95 is therefore inhibition of KIAA1656 (Accession XM_038022). Accordingly, utilities of VGAM95 include diagnosis, prevention and treatment of diseases and clinical conditions associated with KIAA1656.

KIAA1735 (Accession XM_113686) is another VGAM95 host target gene. KIAA1735 BINDING SITE is HOST TARGET binding site found in the 3' untranslated region of mRNA encoded by KIAA1735, corresponding to a HOST TARGET binding site such as BINDING SITE I, BINDING SITE II or BINDING SITE III. Table 2 illustrates the complementarity of the nucleotide sequences of KIAA1735 BINDING SITE, designated SEQ ID:42346, to the nucleotide sequence of VGAM95 RNA, herein designated VGAM RNA, also designated SEQ ID:2806.

Another function of VGAM95 is therefore inhibition of KIAA1735 (Accession XM_113686). Accordingly, utilities of VGAM95 include diagnosis, prevention and treatment of diseases and clinical conditions associated with KIAA1735.

KIAA1932 (Accession XM_055900) is another VGAM95 host target gene. KIAA1932 BINDING SITE is HOST TARGET binding site found in the 3' untranslated region of mRNA encoded by KIAA1932, corresponding to a HOST TARGET binding site such as BINDING SITE I, BINDING SITE II or BINDING SITE III. Table 2 illustrates the complementarity of the nucleotide sequences of KIAA1932 BINDING SITE, designated SEQ ID:36349, to the nucleotide sequence of VGAM95 RNA, herein designated VGAM RNA, also designated SEQ ID:2806.

Another function of VGAM95 is therefore inhibition of KIAA1932 (Accession XM_055900). Accordingly, utilities of VGAM95 include diagnosis, prevention and treatment of diseases and clinical conditions associated with KIAA1932.

MAN1 (Accession NM_014319) is another VGAM95 host target gene. MAN1 BINDING SITE is HOST TARGET binding site found in the 3' untranslated region of mRNA encoded by MAN1, corresponding to a HOST TARGET binding site such as BINDING SITE I, BINDING SITE II or BINDING SITE III. Table 2 illustrates the complementarity of the nucleotide sequences of MAN1 BINDING SITE, designated SEQ ID:15618, to the nucleotide sequence of VGAM95 RNA, herein designated VGAM RNA, also designated SEQ ID:2806.

Another function of VGAM95 is therefore inhibition of MAN1 (Accession NM_014319). Accordingly, utilities of VGAM95 include diagnosis, prevention and treatment of diseases and clinical conditions associated with MAN1.

MGC12966 (Accession NM_032706) is another VGAM95 host target gene. MGC12966 BINDING SITE is HOST TARGET binding site found in the 3' untranslated region of mRNA encoded by MGC12966, corresponding to a HOST TARGET binding site such as BINDING SITE I, BINDING SITE II or BINDING SITE III. Table 2 illustrates the complementarity of the nucleotide sequences of MGC12966 BINDING SITE, designated SEQ ID:26421, to the nucleotide sequence of VGAM95 RNA, herein designated VGAM RNA, also designated SEQ ID:2806.

Another function of VGAM95 is therefore inhibition of MGC12966 (Accession NM_032706). Accordingly, utilities of VGAM95 include diagnosis, prevention and treatment of diseases and clinical conditions associated with MGC12966.

MGC16063 (Accession NM_053047) is another VGAM95 host target gene. MGC16063 BINDING SITE is HOST TARGET binding site found in the 3' untranslated region of mRNA encoded by MGC16063, corresponding to a HOST TARGET binding site such as BINDING SITE I, BINDING SITE II or BINDING SITE III. Table 2 illustrates the complementarity of the nucleotide sequences of MGC16063 BINDING SITE, designated SEQ ID:27592, to the nucleotide sequence of VGAM95 RNA, herein designated VGAM RNA, also designated SEQ ID:2806.

Another function of VGAM95 is therefore inhibition of MGC16063 (Accession NM_053047). Accordingly, utilities of VGAM95 include diagnosis, prevention and treatment of diseases and clinical conditions associated with MGC16063. Makorin, Ring Finger Protein, 2 (MKRN2, Accession XM_051580) is another VGAM95 host target gene. MKRN2 BINDING SITE is HOST TARGET binding site found in the 3' untranslated region of mRNA encoded by MKRN2, corresponding to a HOST TARGET binding site such as BINDING SITE I, BINDING SITE II or BINDING SITE III. Table 2 illustrates the complementarity of the nucleotide sequences of MKRN2 BINDING SITE, designated SEQ ID:35858, to the nucleotide sequence of VGAM95 RNA, herein designated VGAM RNA, also designated SEQ ID:2806.

Another function of VGAM95 is therefore inhibition of Makorin, Ring Finger Protein, 2 (MKRN2, Accession XM_051580). Accordingly, utilities of VGAM95 include diagnosis, prevention and treatment of diseases and clinical conditions associated with MKRN2. Phosphodiesterase 10A (PDE10A, Accession NM_006661) is another VGAM95 host target gene. PDE10A BINDING SITE is HOST TARGET binding site found in the 3' untranslated region of mRNA encoded by PDE10A, corresponding to a HOST TARGET binding site such as BINDING SITE I, BINDING SITE II or BINDING SITE III. Table 2 illustrates the complementarity of the nucleotide sequences of PDE10A BINDING SITE, designated SEQ ID:13462, to the nucleotide sequence of VGAM95 RNA, herein designated VGAM RNA, also designated SEQ ID:2806.

Another function of VGAM95 is therefore inhibition of Phosphodiesterase 10A (PDE10A, Accession NM_006661). Accordingly, utilities of VGAM95 include diagnosis, prevention and treatment of diseases and clinical conditions associated with PDE10A. Phosphodiesterase 7B (PDE7B, Accession NM_018945) is another VGAM95 host target gene. PDE7B BINDING SITE is HOST TARGET binding site found in the 5' untranslated region of mRNA encoded by PDE7B, corresponding to a HOST TARGET binding site such as BINDING SITE I, BINDING SITE II or BINDING SITE III. Table 2 illustrates the complementarity of the nucleotide sequences of PDE7B BINDING SITE, designated SEQ ID:21012, to the nucleotide sequence of VGAM95 RNA, herein designated VGAM RNA, also designated SEQ ID:2806.

Another function of VGAM95 is therefore inhibition of Phosphodiesterase 7B (PDE7B, Accession NM_018945). Accordingly, utilities of VGAM95 include diagnosis, prevention and treatment of diseases and clinical conditions associated with PDE7B. Proline Rich 2 (PROL2, Accession NM_006813) is another VGAM95 host target gene. PROL2 BINDING SITE is HOST TARGET binding site found in the 3' untranslated region of mRNA encoded by PROL2, corresponding to a HOST TARGET binding site such as BINDING SITE I, BINDING SITE II or BINDING SITE III. Table 2 illustrates the complementarity of the nucleotide sequences of PROL2 BINDING SITE, designated SEQ ID:13685, to the nucleotide sequence of VGAM95 RNA, herein designated VGAM RNA, also designated SEQ ID:2806.

Another function of VGAM95 is therefore inhibition of Proline Rich 2 (PROL2, Accession NM_006813). Accordingly, utilities of VGAM95 include diagnosis, prevention and treatment of diseases and clinical conditions associated with PROL2. SSH2 (Accession XM_030846) is another VGAM95 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31185, to the nucleotide sequence of VGAM95 RNA, herein designated VGAM RNA, also designated SEQ ID:2806.

Another function of VGAM95 is therefore inhibition of SSH2 (Accession XM_030846). Accordingly, utilities of VGAM95 include diagnosis, prevention and treatment of diseases and clinical conditions associated with SSH2. LOC122704 (Accession XM_058647) is another VGAM95 host target gene. LOC122704 BINDING SITE is HOST TARGET binding site found in the 3' untranslated region of mRNA encoded by LOC122704, corresponding to a HOST TARGET binding site such as BINDING SITE I, BINDING SITE II or BINDING SITE III. Table 2 illustrates the complementarity of the nucleotide sequences of LOC122704 BINDING SITE, designated SEQ ID:36693, to the nucleotide sequence of VGAM95 RNA, herein designated VGAM RNA, also designated SEQ ID:2806.

Another function of VGAM95 is therefore inhibition of LOC122704 (Accession XM_058647). Accordingly, utilities of VGAM95 include diagnosis, prevention and treatment of diseases and clinical conditions associated with LOC122704. LOC124944 (Accession XM_058876) is another VGAM95 host target gene. LOC124944 BINDING SITE is HOST TARGET binding site found in the 5' untranslated region of mRNA encoded by LOC124944, corresponding to a HOST TARGET binding site such as BINDING SITE I, BINDING SITE II or BINDING SITE III. Table 2 illustrates the complementarity of the nucleotide sequences of LOC124944 BINDING SITE, designated SEQ ID:36777, to the nucleotide sequence of VGAM95 RNA, herein designated VGAM RNA, also designated SEQ ID:2806.

Another function of VGAM95 is therefore inhibition of LOC124944 (Accession XM_058876). Accordingly, utilities of VGAM95 include diagnosis, prevention and treatment of diseases and clinical conditions associated with LOC124944. LOC143153 (Accession XM_084440) is another VGAM95 host target gene. LOC143153 BINDING SITE is HOST TARGET binding site found in the 3' untranslated region of mRNA encoded by LOC143153, corresponding to a HOST TARGET binding site such as BINDING SITE I, BINDING SITE II or BINDING SITE III. Table 2 illustrates the complementarity of the nucleotide sequences of LOC143153 BINDING SITE, designated SEQ ID:37580, to the nucleotide sequence of VGAM95 RNA, herein designated VGAM RNA, also designated SEQ ID:2806.

Another function of VGAM95 is therefore inhibition of LOC143153 (Accession XM_084440). Accordingly, utilities of VGAM95 include diagnosis, prevention and treatment of diseases and clinical conditions associated with LOC143153. LOC143154 (Accession XM_084441) is another VGAM95 host target gene. LOC143154 BINDING SITE is HOST TARGET binding site found in the 3' untranslated region of mRNA encoded by LOC143154, corresponding to a HOST TARGET binding site such as BINDING SITE I, BINDING SITE II or BINDING SITE III. Table 2 illustrates the complementarity of the nucleotide sequences of LOC143154 BINDING SITE, designated SEQ ID:37587, to the nucleotide sequence of VGAM95 RNA, herein designated VGAM RNA, also designated SEQ ID:2806.

Another function of VGAM95 is therefore inhibition of LOC143154 (Accession XM_084441). Accordingly, utilities of VGAM95 include diagnosis, prevention and treatment of diseases and clinical conditions associated with LOC143154. LOC144747 (Accession XM_084954) is another VGAM95 host target gene. LOC144747 BINDING SITE is HOST TARGET binding site found in the 5' untranslated region of mRNA encoded by LOC144747, corresponding to a HOST TARGET binding site such as BINDING SITE I, BINDING SITE II or BINDING SITE III. Table 2 illustrates the complementarity of the nucleotide sequences of LOC144747 BINDING SITE, designated SEQ ID:37784, to the nucleotide sequence of VGAM95 RNA, herein designated VGAM RNA, also designated SEQ ID:2806.

Another function of VGAM95 is therefore inhibition of LOC144747 (Accession XM_084954). Accordingly, utilities of VGAM95 include diagnosis, prevention and treatment of diseases and clinical conditions associated with LOC144747. LOC146515 (Accession XM_085493) is another VGAM95 host target gene. LOC146515 BINDING SITE is HOST TARGET binding site found in the 3' untranslated region of mRNA encoded by LOC146515, corresponding to a HOST TARGET binding site such as BINDING SITE I, BINDING SITE II or BINDING SITE III. Table 2 illustrates the complementarity of the nucleotide sequences of LOC146515 BINDING SITE, designated SEQ ID:38194, to the nucleotide sequence of VGAM95 RNA, herein designated VGAM RNA, also designated SEQ ID:2806.

Another function of VGAM95 is therefore inhibition of LOC146515 (Accession XM_085493). Accordingly, utilities of VGAM95 include diagnosis, prevention and treatment of diseases and clinical conditions associated with LOC146515. LOC147658 (Accession XM_085827) is another VGAM95 host target gene. LOC147658 BINDING SITE is HOST TARGET binding site found in the 3' untranslated region of mRNA encoded by LOC147658, corresponding to a HOST TARGET binding site such as BINDING SITE I, BINDING SITE II or BINDING SITE III. Table 2 illustrates the complementarity of the nucleotide sequences of LOC147658 BINDING SITE, designated SEQ ID:38354, to the nucleotide sequence of VGAM95 RNA, herein designated VGAM RNA, also designated SEQ ID:2806.

Another function of VGAM95 is therefore inhibition of LOC147658 (Accession XM_085827). Accordingly, utilities of VGAM95 include diagnosis, prevention and treatment of diseases and clinical conditions associated with LOC147658. LOC149175 (Accession XM_086445) is another VGAM95 host target gene. LOC149175 BINDING SITE is HOST TARGET binding site found in the 3' untranslated region of mRNA encoded by LOC149175, corresponding to a HOST TARGET binding site such as BINDING SITE I, BINDING SITE II or BINDING SITE III. Table 2 illustrates the complementarity of the nucleotide sequences of LOC149175 BINDING SITE, designated SEQ ID:38662, to the nucleotide sequence of VGAM95 RNA, herein designated VGAM RNA, also designated SEQ ID:2806.

Another function of VGAM95 is therefore inhibition of LOC149175 (Accession XM_086445). Accordingly, utilities of VGAM95 include diagnosis, prevention and treatment of diseases and clinical conditions associated with LOC149175. LOC151178 (Accession XM_087117) is another VGAM95 host target gene. LOC151178 BINDING SITE is HOST TARGET binding site found in the 5' untranslated region of mRNA encoded by LOC151178, corresponding to a HOST TARGET binding site such as BINDING SITE I, BINDING SITE II or BINDING SITE III. Table 2 illustrates the complementarity of the nucleotide sequences of LOC151178 BINDING SITE, designated SEQ ID:39072, to the nucleotide sequence of VGAM95 RNA, herein designated VGAM RNA, also designated SEQ ID:2806.

Another function of VGAM95 is therefore inhibition of LOC151178 (Accession XM_087117). Accordingly, utilities of VGAM95 include diagnosis, prevention and treatment of diseases and clinical conditions associated with LOC151178. LOC158156 (Accession XM_088496) is another VGAM95 host target gene. LOC158156 BINDING SITE is HOST TARGET binding site found in the 3' untranslated region of mRNA encoded by LOC158156, corresponding to a HOST TARGET binding site such as BINDING SITE I, BINDING SITE II or BINDING SITE III. Table 2 illustrates the complementarity of the nucleotide sequences of LOC158156 BINDING SITE, designated SEQ ID:39743, to the nucleotide sequence of VGAM95 RNA, herein designated VGAM RNA, also designated SEQ ID:2806.

Another function of VGAM95 is therefore inhibition of LOC158156 (Accession XM_088496). Accordingly, utilities of VGAM95 include diagnosis, prevention and treatment of diseases and clinical conditions associated with LOC158156. LOC158527 (Accession XM_088594) is another VGAM95 host target gene. LOC158527 BINDING SITE is HOST TARGET binding site found in the 5' untranslated region of mRNA encoded by LOC158527, corresponding to a HOST TARGET binding site such as BINDING SITE I, BINDING SITE II or BINDING SITE III. Table 2 illustrates the complementarity of the nucleotide sequences of LOC158527 BINDING SITE, designated SEQ ID:39863, to the nucleotide sequence of VGAM95 RNA, herein designated VGAM RNA, also designated SEQ ID:2806.

Another function of VGAM95 is therefore inhibition of LOC158527 (Accession XM_088594). Accordingly, utilities of VGAM95 include diagnosis, prevention and treatment of diseases and clinical conditions associated with LOC158527. LOC165693 (Accession XM_093373) is another VGAM95 host target gene. LOC165693 BINDING SITE is HOST TARGET binding site found in the 3' untranslated region of mRNA encoded by LOC165693, corresponding to a HOST TARGET binding site such as BINDING SITE I, BINDING SITE II or BINDING SITE III. Table 2 illustrates the complementarity of the nucleotide sequences of LOC165693 BINDING SITE, designated SEQ ID:40188, to the nucleotide sequence of VGAM95 RNA, herein designated VGAM RNA, also designated SEQ ID:2806.

Another function of VGAM95 is therefore inhibition of LOC165693 (Accession XM_093373). Accordingly, utilities of VGAM95 include diagnosis, prevention and treatment of diseases and clinical conditions associated with LOC165693. LOC168576 (Accession XM_095191) is another VGAM95 host target gene. LOC168576 BINDING SITE is HOST TARGET binding site found in the 5' untranslated region of mRNA encoded by LOC168576, corresponding to a HOST TARGET binding site such as BINDING SITE I, BINDING SITE II or BINDING SITE III. Table 2 illustrates the complementarity of the nucleotide sequences of LOC168576 BINDING SITE, designated SEQ ID:40255, to the nucleotide sequence of VGAM95 RNA, herein designated VGAM RNA, also designated SEQ ID:2806.

Another function of VGAM95 is therefore inhibition of LOC168576 (Accession XM_095191). Accordingly, utilities of VGAM95 include diagnosis, prevention and treatment of diseases and clinical conditions associated with LOC168576. LOC200301 (Accession XM_114197) is another VGAM95 host target gene. LOC200301 BINDING SITE is HOST TARGET binding site found in the 5' untranslated region of mRNA encoded by LOC200301, corresponding to a HOST TARGET binding site such as BINDING SITE I, BINDING SITE II or BINDING SITE III. Table 2 illustrates the complementarity of the nucleotide sequences of LOC200301 BINDING SITE, designated SEQ ID:42782, to the nucleotide sequence of VGAM95 RNA, herein designated VGAM RNA, also designated SEQ ID:2806.

Another function of VGAM95 is therefore inhibition of LOC200301 (Accession XM_114197). Accordingly, utilities of VGAM95 include diagnosis, prevention and treatment of diseases and clinical conditions associated with LOC200301.

LOC203429 (Accession XM_114701) is another VGAM95 host target gene. LOC203429 BINDING SITE is HOST TARGET binding site found in the 3' untranslated region of mRNA encoded by LOC203429, corresponding to a HOST TARGET binding site such as BINDING SITE I, BINDING SITE II or BINDING SITE III. Table 2 illustrates the complementarity of the nucleotide sequences of LOC203429 BINDING SITE, designated SEQ ID:43051, to the nucleotide sequence of VGAM95 RNA, herein designated VGAM RNA, also designated SEQ ID:2806.

Another function of VGAM95 is therefore inhibition of LOC203429 (Accession XM_114701). Accordingly, utilities of VGAM95 include diagnosis, prevention and treatment of diseases and clinical conditions associated with LOC203429.

LOC219294 (Accession XM_167566) is another VGAM95 host target gene. LOC219294 BINDING SITE is HOST TARGET binding site found in the 3' untranslated region of mRNA encoded by LOC219294, corresponding to a HOST TARGET binding site such as BINDING SITE I, BINDING SITE II or BINDING SITE III. Table 2 illustrates the complementarity of the nucleotide sequences of LOC219294 BINDING SITE, designated SEQ ID:44688, to the nucleotide sequence of VGAM95 RNA, herein designated VGAM RNA, also designated SEQ ID:2806.

Another function of VGAM95 is therefore inhibition of LOC219294 (Accession XM_167566). Accordingly, utilities of VGAM95 include diagnosis, prevention and treatment of diseases and clinical conditions associated with LOC219294.

LOC219295 (Accession XM_167565) is another VGAM95 host target gene. LOC219295 BINDING SITE is HOST TARGET binding site found in the 3' untranslated region of mRNA encoded by LOC219295, corresponding to a HOST TARGET binding site such as BINDING SITE I, BINDING SITE II or BINDING SITE III. Table 2 illustrates the complementarity of the nucleotide sequences of LOC219295 BINDING SITE, designated SEQ ID:44682, to the nucleotide sequence of VGAM95 RNA, herein designated VGAM RNA, also designated SEQ ID:2806.

Another function of VGAM95 is therefore inhibition of LOC219295 (Accession XM_167565). Accordingly, utilities of VGAM95 include diagnosis, prevention and treatment of diseases and clinical conditions associated with LOC219295.

LOC219401 (Accession XM_166706) is another VGAM95 host target gene. LOC219401 BINDING SITE is HOST TARGET binding site found in the 3' untranslated region of mRNA encoded by LOC219401, corresponding to a HOST TARGET binding site such as BINDING SITE I, BINDING SITE II or BINDING SITE III. Table 2 illustrates the complementarity of the nucleotide sequences of LOC219401 BINDING SITE, designated SEQ ID:44593, to the nucleotide sequence of VGAM95 RNA, herein designated VGAM RNA, also designated SEQ ID:2806.

Another function of VGAM95 is therefore inhibition of LOC219401 (Accession XM_166706). Accordingly, utilities of VGAM95 include diagnosis, prevention and treatment of diseases and clinical conditions associated with LOC219401.

LOC220705 (Accession XM_166000) is another VGAM95 host target gene. LOC220705 BINDING SITE is HOST TARGET binding site found in the 3' untranslated region of mRNA encoded by LOC220705, corresponding to a HOST TARGET binding site such as BINDING SITE I, BINDING SITE II or BINDING SITE III. Table 2 illustrates the complementarity of the nucleotide sequences of LOC220705 BINDING SITE, designated SEQ ID:43835, to the nucleotide sequence of VGAM95 RNA, herein designated VGAM RNA, also designated SEQ ID:2806.

Another function of VGAM95 is therefore inhibition of LOC220705 (Accession XM_166000). Accordingly, utilities of VGAM95 include diagnosis, prevention and treatment of diseases and clinical conditions associated with LOC220705.

LOC221540 (Accession XM_168133) is another VGAM95 host target gene. LOC221540 BINDING SITE is HOST TARGET binding site found in the 3' untranslated region of mRNA encoded by LOC221540, corresponding to a HOST TARGET binding site such as BINDING SITE I, BINDING SITE II or BINDING SITE III. Table 2 illustrates the complementarity of the nucleotide sequences of LOC221540 BINDING SITE, designated SEQ ID:45045, to the nucleotide sequence of VGAM95 RNA, herein designated VGAM RNA, also designated SEQ ID:2806.

Another function of VGAM95 is therefore inhibition of LOC221540 (Accession XM_168133). Accordingly, utilities of VGAM95 include diagnosis, prevention and treatment of diseases and clinical conditions associated with LOC221540.

LOC221833 (Accession XM_166519) is another VGAM95 host target gene. LOC221833 BINDING SITE is HOST TARGET binding site found in the 3' untranslated region of mRNA encoded by LOC221833, corresponding to a HOST TARGET binding site such as BINDING SITE I, BINDING SITE II or BINDING SITE III. Table 2 illustrates the complementarity of the nucleotide sequences of LOC221833 BINDING SITE, designated SEQ ID:44457, to the nucleotide sequence of VGAM95 RNA, herein designated VGAM RNA, also designated SEQ ID:2806.

Another function of VGAM95 is therefore inhibition of LOC221833 (Accession XM_166519). Accordingly, utilities of VGAM95 include diagnosis, prevention and treatment of diseases and clinical conditions associated with LOC221833.

LOC257354 (Accession XM_170810) is another VGAM95 host target gene. LOC257354 BINDING SITE is HOST TARGET binding site found in the 3' untranslated region of mRNA encoded by LOC257354, corresponding to a HOST TARGET binding site such as BINDING SITE I, BINDING SITE II or BINDING SITE III. Table 2 illustrates the complementarity of the nucleotide sequences of LOC257354 BINDING SITE, designated SEQ ID:45580, to the nucleotide sequence of VGAM95 RNA, herein designated VGAM RNA, also designated SEQ ID:2806.

Another function of VGAM95 is therefore inhibition of LOC257354 (Accession XM_170810). Accordingly, utilities of VGAM95 include diagnosis, prevention and treatment of diseases and clinical conditions associated with LOC257354.

LOC257545 (Accession XM_175217) is another VGAM95 host target gene. LOC257545 BINDING SITE is HOST TARGET binding site found in the 3' untranslated region of mRNA encoded by LOC257545, corresponding to a HOST TARGET binding site such as BINDING SITE I, BINDING SITE II or BINDING SITE III. Table 2 illustrates the complementarity of the nucleotide sequences of LOC257545 BINDING SITE, designated SEQ ID:46693, to the nucleotide sequence of VGAM95 RNA, herein designated VGAM RNA, also designated SEQ ID:2806.

Another function of VGAM95 is therefore inhibition of LOC257545 (Accession XM_175217). Accordingly, utilities of VGAM95 include diagnosis, prevention and treatment of diseases and clinical conditions associated with LOC257545.

LOC257598 (Accession XM_175295) is another VGAM95 host target gene. LOC257598 BINDING SITE is HOST TARGET binding site found in the 3' untranslated region of mRNA encoded by LOC257598, corresponding to a HOST TARGET binding site such as BINDING SITE I, BINDING SITE II or BINDING SITE III. Table 2 illustrates the complementarity of the nucleotide sequences of LOC257598 BINDING SITE, designated SEQ ID:46750, to the nucleotide sequence of VGAM95 RNA, herein designated VGAM RNA, also designated SEQ ID:2806.

Another function of VGAM95 is therefore inhibition of LOC257598 (Accession XM_175295). Accordingly, utilities of VGAM95 include diagnosis, prevention and treatment of diseases and clinical conditions associated with LOC257598. LOC51580 (Accession NM_015874) is another VGAM95 host target gene. LOC51580 BINDING SITE is HOST TARGET binding site found in the 3' untranslated region of mRNA encoded by LOC51580, corresponding to a HOST TARGET binding site such as BINDING SITE I, BINDING SITE II or BINDING SITE III. Table 2 illustrates the complementarity of the nucleotide sequences of LOC51580 BINDING SITE, designated SEQ ID:18017, to the nucleotide sequence of VGAM95 RNA, herein designated VGAM RNA, also designated SEQ ID:2806.

Another function of VGAM95 is therefore inhibition of LOC51580 (Accession NM_015874). Accordingly, utilities of VGAM95 include diagnosis, prevention and treatment of diseases and clinical conditions associated with LOC51580. LOC90092 (Accession XM_028862) is another VGAM95 host target gene. LOC90092 BINDING SITE is HOST TARGET binding site found in the 3' untranslated region of mRNA encoded by LOC90092, corresponding to a HOST TARGET binding site such as BINDING SITE I, BINDING SITE II or BINDING SITE III. Table 2 illustrates the complementarity of the nucleotide sequences of LOC90092 BINDING SITE, designated SEQ ID:30791, to the nucleotide sequence of VGAM95 RNA, herein designated VGAM RNA, also designated SEQ ID:2806.

Another function of VGAM95 is therefore inhibition of LOC90092 (Accession XM_028862). Accordingly, utilities of VGAM95 include diagnosis, prevention and treatment of diseases and clinical conditions associated with LOC90092. LOC90133 (Accession XM_029323) is another VGAM95 host target gene. LOC90133 BINDING SITE is HOST TARGET binding site found in the 3' untranslated region of mRNA encoded by LOC90133, corresponding to a HOST TARGET binding site such as BINDING SITE I, BINDING SITE II or BINDING SITE III. Table 2 illustrates the complementarity of the nucleotide sequences of LOC90133 BINDING SITE, designated SEQ ID:30870, to the nucleotide sequence of VGAM95 RNA, herein designated VGAM RNA, also designated SEQ ID:2806.

Another function of VGAM95 is therefore inhibition of LOC90133 (Accession XM_029323). Accordingly, utilities of VGAM95 include diagnosis, prevention and treatment of diseases and clinical conditions associated with LOC90133. FIG. 1 further provides a conceptual description of a novel bioinformatically detected viral gene of the present invention, referred to here as Viral Genomic Address Messenger 96 (VGAM96) viral gene, which modulates expression of respective host target genes thereof, the function and utility of which host target genes is known in the art.

VGAM96 is a novel bioinformatically detected regulatory, non protein coding, viral micro RNA (miRNA) gene. The method by which VGAM96 was detected is described hereinabove with reference to FIGS. 1-8.

VGAM96 gene, herein designated VGAM GENE, is a viral gene contained in the genome of Plutella Xylostella Granulovirus. VGAM96 host target gene, herein designated VGAM HOST TARGET GENE, is a human gene contained in the human genome.

VGAM96 gene encodes a VGAM96 precursor RNA, herein designated VGAM PRECURSOR RNA. Similar to other miRNA genes, and unlike most ordinary genes, VGAM96 precursor RNA does not encode a protein. A nucleotide sequence identical or highly similar to the nucleotide sequence of VGAM96 precursor RNA is designated SEQ ID:82, and is provided hereinbelow with reference to the sequence listing part. Nucleotide sequence SEQ ID:82 is located at position 9897 relative to the genome of Plutella Xylostella Granulovirus.

VGAM96 precursor RNA folds onto itself, forming VGAM96 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM96 folded precursor RNA into VGAM96 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM96 RNA is designated SEQ ID:2807, and is provided hereinbelow with reference to the sequence listing part.

VGAM96 host target gene, herein designated VGAM HOST TARGET GENE, encodes a corresponding messenger RNA, VGAM96 host target RNA, herein designated VGAM HOST TARGET RNA. VGAM96 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM96 RNA, herein designated VGAM RNA, binds complementarily to one or more host target binding sites located in untranslated regions of VGAM96 host target RNA, herein designated VGAM HOST TARGET RNA. This complementary binding is due to the fact that the nucleotide sequence of VGAM96 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM96 RNA, herein designated VGAM RNA, may have a different number of host target binding sites in untranslated regions of a VGAM96 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM96 RNA, herein designated VGAM RNA, to host target binding sites on VGAM96 host target RNA, herein designated VGAM HOST TARGET RNA, such as BINDING SITE I, BINDING SITE II and BINDING SITE III, inhibits translation of VGAM96 host target RNA into VGAM96 host target protein, herein designated VGAM HOST TARGET PROTEIN. VGAM host target protein is therefore outlined by a broken line.

It is appreciated that VGAM96 host target gene, herein designated VGAM HOST TARGET GENE, in fact represents a plurality of VGAM96 host target genes. The mRNA of each one of this plurality of VGAM96 host target genes comprises one or more host target binding sites, each having a nucleotide sequence which is at least partly complementary to VGAM96 RNA, herein designated VGAM RNA, and which when bound by VGAM96 RNA causes inhibition of translation of respective one or more VGAM96 host target proteins.

It is further appreciated by one skilled in the art that the mode of translational inhibition illustrated by FIG. 1 with specific reference to translational inhibition exerted by VGAM96 gene, herein designated VGAM GENE, on one or more VGAM96 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM96 is inhibition of expression of host target genes, as part of a novel viral mechanism of attacking a host. Accordingly, utilities of VGAM96 include diagnosis, prevention and treatment of viral infection by Plutella Xylostella Granulovirus. Specific functions, and accordingly utilities, of VGAM96 correlate with, and may be deduced from, the identity of the host target genes which VGAM96 binds and inhibits, and the function of these host target genes, as elaborated hereinbelow.

Nucleotide sequences of the VGAM96 precursor RNA, herein designated VGAM PRECURSOR RNA, and of the 'diced' VGAM96 RNA, herein designated VGAM RNA, and a schematic representation of the secondary folding of VGAM96 folded precursor RNA, herein designated VGAM FOLDED PRECURSOR RNA, of VGAM96 are further described hereinbelow with reference to Table 1.

Nucleotide sequences of host target binding sites, such as BINDING SITE-I, BINDING SITE-II and BINDING SITE-III of FIG. 1, found on VGAM96 host target RNA, and schematic representation of the complementarity of each of these host target binding sites to VGAM96 RNA, herein designated VGAM RNA, are described hereinbelow with reference to Table 2.

As mentioned hereinabove with reference to FIG. 1, a function of VGAM96 gene, herein designated VGAM is inhibition of expression of VGAM96 target genes. It is appreciated that specific functions, and accordingly utilities, of VGAM96 correlate with, and may be deduced from, the identity of the target genes which VGAM96 binds and inhibits, and the function of these target genes, as elaborated hereinbelow.

Angiotensin II Receptor, Type 1 (AGTR1, Accession NM_031850) is a VGAM96 host target gene. AGTR1 BINDING SITE1 through AGTR1 BINDING SITE5 are HOST TARGET binding sites found in untranslated regions of mRNA encoded by AGTR1, corresponding to HOST TARGET binding sites such as BINDING SITE I, BINDING SITE II or BINDING SITE III. Table 2 illustrates the complementarity of the nucleotide sequences of AGTR1 BINDING SITE1 through AGTR1 BINDING SITE5, designated SEQ ID:25593, SEQ ID:6341, SEQ ID:11242, SEQ ID:14308 and SEQ ID:25768 respectively, to the nucleotide sequence of VGAM96 RNA, herein designated VGAM RNA, also designated SEQ ID:2807.

A function of VGAM96 is therefore inhibition of Angiotensin II Receptor, Type 1 (AGTR1, Accession NM_031850), a gene which is an important effector controlling blood pressure and volume in the cardiovascular system. Accordingly, utilities of VGAM96 include diagnosis, prevention and treatment of diseases and clinical conditions associated with AGTR1. The function of AGTR1 has been established by previous studies. Angiotensin II (see OMIM Ref. No. 106150) is an important effector controlling blood pressure and volume in the cardiovascular system. Its importance is reflected by the efficacy of angiotensin-converting enzyme inhibitors in the treatment of hypertension and congestive heart failure. Angiotensin II interacts with 2 pharmacologically distinct subtypes of cell surface receptors, types 1 and 2 (AGTR2; 600350). Type 1 receptors seem to mediate the major cardiovascular effects of angiotensin II. By expression cloning, Murphy et al. (1991) isolated a cDNA encoding the type 1 receptor. Hydropathic modeling of the deduced protein suggested that it shares the 7-transmembrane-region motif with the G protein-coupled receptor superfamily. Sasaki et al. (1991) isolated the corresponding bovine gene. Takayanagi et al. (1992) cloned and sequenced a cDNA encoding this receptor in the human, and by Northern blot analysis they demonstrated its expression in human liver, lung, adrenal, and adrenocortical adenomas, but not in pheochromocytomas. Bergsma et al. (1992) and Mauzy et al. (1992) also cloned and characterized a human AGTR1 cDNA. Furuta et al. (1992) studied the genomic sequence and demonstrated that the coding region is contained in a single exon. By comparing genomic DNA and cDNA sequences, Guo et al. (1994) demonstrated that the AGTR1 gene consists of at least 5 exons and spans more than 55 kb of genomic DNA. The size of the exons ranges from 59 to 2,014 bp. Four of the exons encode 5-prime untranslated sequences. Multiple transcription initiation sites were observed by primer extension experiments. Pharmacologic agents that either block the formation of angiotensin II or interrupt its action by antagonizing the AGT1-receptor are highly successful in the treatment of angiotensin II-dependent hypertension. Most notable among these agents is losartan, an AGT1-receptor antagonist that has been found to be an effective anti-hypertension drug without the usual side effects. This, coupled with the demonstration that polymorphism in the AGTR1 gene is associated with hypertension (Bonnardeaux et al., 1994), further supports the notion that the AGT1 receptor is an important target for the control of angiotensin II-dependent hypertension. In spite of the availability of excellent drugs for the control of hypertension, Iyer et al. (1996) explored the possibility that gene therapy could be used. They demonstrated that the delivery of angiotensin type 1 receptor antisense by a retrovirally-mediated delivery system resulted in a selective attenuation of the cellular actions of angiotensin II in the neurons of the spontaneously hypertensive (SH) rat model. A single injection normalized blood pressure in the SH rat on a long-term basis. The use of this approach in patients was proposed. Animal model experiments lend further support to the function of AGTR1. Oliverio et al. (1998) generated mice lacking AT1B (Agtr1b -/-) and other mice lacking both AT1A and AT1B receptors. Agtr1b -/- mice were healthy, without an abnormal phenotype. In contrast, mice who were homozygous for disruptions of both Agtr1a and Agtr1b had diminished growth, vascular thickening within the kidney, and atrophy of the inner renal medulla. This phenotype was virtually identical to that seen in angiotensinogen-deficient mice (see OMIM Ref. No. 106150) and in mice deficient in angiotensin-converting enzyme (OMIM Ref. No. 106180). The double knockout mice had no systemic pressor response to infusions of angiotensin II, but they responded normally to another vasoconstrictor, epinephrine. Blood pressure was reduced substantially in the double knockout mice, and following administration of an angiotensin-converting enzyme inhibitor, their blood pressure increased paradoxically.

It is appreciated that the abovementioned animal model for AGTR1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Oliverio, M. I.; Kim, H-S.; Ito, M.; Le, T.; Audoly, L.; Best, C. F.; Hiller, S.; Kluckman, K.; Maeda, N.; Smithies, O.; Coffman, T. M.: Reduced growth, abnormal kidney structure, and type 2 (AT2) angiotensin receptor-mediated blood pressure regulation in mice lacking both AT1A and AT1B receptors for angiotensin II. Proc. Nat. Acad. Sci. 95:15496-15501, 1998; and Iyer, S. N.; Lu, D.; Katovich, M. J.; Raizada, M. K.: Chronic control of high blood pressure in the spontaneously hypertensive rat by delivery of angiotensin type 1 receptor antisense.

Further studies establishing the function and utilities of AGTR1 are found in John Hopkins OMIM database record ID 106165, and in sited publications numbered 4238-4255, 4258-4257, 4259-426 and 4315-4317 listed in the bibliography section hereinbelow, which are also hereby incorporated by reference. FLJ10853 (Accession NM_018246) is another VGAM96 host target gene. FLJ10853 BINDING SITE is HOST TARGET binding site found in the 3' untranslated region of mRNA encoded by FLJ10853, corresponding to a HOST TARGET binding site such as BINDING SITE I, BINDING SITE II or BINDING SITE III. Table 2 illustrates the complementarity of the nucleotide sequences of FLJ10853 BINDING SITE, designated SEQ ID:20210, to the nucleotide sequence of VGAM96 RNA, herein designated VGAM RNA, also designated SEQ ID:2807.

Another function of VGAM96 is therefore inhibition of FLJ10853 (Accession NM_018246). Accordingly, utilities of VGAM96 include diagnosis, prevention and treatment of diseases and clinical conditions associated with FLJ10853. KIAA0189 (Accession NM_014725) is another VGAM96 host target gene. KIAA0189 BINDING SITE is HOST TARGET binding site found in the 5' untranslated region of mRNA encoded by KIAA0189, corresponding to a HOST TARGET binding site such as BINDING SITE I, BINDING SITE II or BINDING SITE III. Table 2 illustrates the complementarity of the nucleotide sequences of KIAA0189 BINDING SITE, designated SEQ ID:16316, to the nucleotide sequence of VGAM96 RNA, herein designated VGAM RNA, also designated SEQ ID:2807.

Another function of VGAM96 is therefore inhibition of KIAA0189 (Accession NM_014725). Accordingly, utilities of VGAM96 include diagnosis, prevention and treatment of diseases and clinical conditions associated with KIAA0189. KIAA1100 (Accession NM_014901) is another VGAM96 host target gene. KIAA1100 BINDING SITE is HOST TARGET binding site found in the 3' untranslated region of mRNA encoded by KIAA1100, corresponding to a HOST TARGET binding site such as BINDING SITE I, BINDING SITE II or BINDING SITE III. Table 2 illustrates the complementarity of the nucleotide sequences of KIAA1100 BINDING SITE, designated SEQ ID:17085, to the nucleotide sequence of VGAM96 RNA, herein designated VGAM RNA, also designated SEQ ID:2807.

Another function of VGAM96 is therefore inhibition of KIAA1100 (Accession NM_014901). Accordingly, utilities of VGAM96 include diagnosis, prevention and treatment of diseases and clinical conditions associated with KIAA1100. Phosphodiesterase 8A (PDE8A, Accession XM_031443) is another VGAM96 host target gene. PDE8A BINDING SITE is HOST TARGET binding site found in the 3' untranslated region of mRNA encoded by PDE8A, corresponding to a HOST TARGET binding site such as BINDING SITE I, BINDING SITE II or BINDING SITE III. Table 2 illustrates the complementarity of the nucleotide sequences of PDE8A BINDING SITE, designated SEQ ID:31378, to the nucleotide sequence of VGAM96 RNA, herein designated VGAM RNA, also designated SEQ ID:2807.

Another function of VGAM96 is therefore inhibition of Phosphodiesterase 8A (PDE8A, Accession XM_031443). Accordingly, utilities of VGAM96 include diagnosis, prevention and treatment of diseases and clinical conditions associated with PDE8A. LOC149832 (Accession XM_097733) is another VGAM96 host target gene. LOC149832 BINDING SITE is HOST TARGET binding site found in the 5' untranslated region of mRNA encoded by LOC149832, corresponding to a HOST TARGET binding site such as BINDING SITE I, BINDING SITE II or BINDING SITE III. Table 2 illustrates the complementarity of the nucleotide sequences of LOC149832 BINDING SITE, designated SEQ ID:41077, to the nucleotide sequence of VGAM96 RNA, herein designated VGAM RNA, also designated SEQ ID:2807.

Another function of VGAM96 is therefore inhibition of LOC149832 (Accession XM_097733). Accordingly, utilities of VGAM96 include diagnosis, prevention and treatment of diseases and clinical conditions associated with LOC149832. FIG. 1 further provides a conceptual description of a novel bioinformatically detected viral gene of the present invention, referred to here as Viral Genomic Address Messenger 97 (VGAM97) viral gene, which modulates expression of respective host target genes thereof, the function and utility of which host target genes is known in the art.

VGAM97 is a novel bioinformatically detected regulatory, non protein coding, viral micro RNA (miRNA) gene. The method by which VGAM97 was detected is described hereinabove with reference to FIGS. 1-8.

VGAM97 gene, herein designated VGAM GENE, is a viral gene contained in the genome of Plutella Xylostella Granulovirus. VGAM97 host target gene, herein designated VGAM HOST TARGET GENE, is a human gene contained in the human genome.

VGAM97 gene encodes a VGAM97 precursor RNA, herein designated VGAM PRECURSOR RNA. Similar to other miRNA genes, and unlike most ordinary genes, VGAM97 precursor RNA does not encode a protein. A nucleotide sequence identical or highly similar to the nucleotide sequence of VGAM97 precursor RNA is designated SEQ ID:83, and is provided hereinbelow with reference to the sequence listing part. Nucleotide sequence SEQ ID:83 is located at position 1601 relative to the genome of Plutella Xylostella Granulovirus.

VGAM97 precursor RNA folds onto itself, forming VGAM97 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM97 folded precursor RNA into VGAM97 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM97 RNA is designated SEQ ID:2808, and is provided hereinbelow with reference to the sequence listing part.

VGAM97 host target gene, herein designated VGAM HOST TARGET GENE, encodes a corresponding messenger RNA, VGAM97 host target RNA, herein designated VGAM HOST TARGET RNA. VGAM97 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM97 RNA, herein designated VGAM RNA, binds complementarily to one or more host target binding sites located in untranslated regions of VGAM97 host target RNA, herein designated VGAM HOST TARGET RNA. This complementary binding is due to the fact that the nucleotide sequence of VGAM97 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM97 RNA, herein designated VGAM RNA, may have a different number of host target binding sites in untranslated regions of a VGAM97 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM97 RNA, herein designated VGAM RNA, to host target binding sites on VGAM97 host target RNA, herein designated VGAM HOST TARGET RNA, such as BINDING SITE I, BINDING SITE II and BINDING SITE III, inhibits translation of VGAM97 host target RNA into VGAM97 host target protein, herein designated VGAM HOST TARGET PROTEIN. VGAM host target protein is therefore outlined by a broken line.

It is appreciated that VGAM97 host target gene, herein designated VGAM HOST TARGET GENE, in fact represents a plurality of VGAM97 host target genes. The mRNA of each one of this plurality of VGAM97 host target genes comprises one or more host target binding sites, each having a nucleotide sequence which is at least partly complementary to VGAM97 RNA, herein designated VGAM RNA, and which when bound by VGAM97 RNA causes inhibition of translation of respective one or more VGAM97 host target proteins.

It is further appreciated by one skilled in the art that the mode of translational inhibition illustrated by FIG. 1 with specific reference to translational inhibition exerted by VGAM97 gene, herein designated VGAM GENE, on one or more VGAM97 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM97 is inhibition of expression of host target genes, as part of a novel viral mechanism of attacking a host. Accordingly, utilities of VGAM97 include diagnosis, prevention and treatment of viral infection by Plutella Xylostella Granulovirus. Specific functions, and accordingly utilities, of VGAM97 correlate with, and may be deduced from, the identity of the host target genes which VGAM97 binds and inhibits, and the function of these host target genes, as elaborated hereinbelow.

Nucleotide sequences of the VGAM97 precursor RNA, herein designated VGAM PRECURSOR RNA, and of the 'diced' VGAM97 RNA, herein designated VGAM RNA, and a schematic representation of the secondary folding of VGAM97 folded precursor RNA, herein designated VGAM FOLDED PRECURSOR RNA, of VGAM97 are further described hereinbelow with reference to Table 1.

Nucleotide sequences of host target binding sites, such as BINDING SITE-I, BINDING SITE-II and BINDING SITE-III of FIG. 1, found on VGAM97 host target RNA, and schematic representation of the complementarity of each of these host target binding sites to VGAM97 RNA, herein designated VGAM RNA, are described hereinbelow with reference to Table 2.

As mentioned hereinabove with reference to FIG. 1, a function of VGAM97 gene, herein designated VGAM is inhibition of expression of VGAM97 target genes. It is appreciated that specific functions, and accordingly utilities, of VGAM97 correlate with, and may be deduced from, the identity of the target genes which VGAM97 binds and inhibits, and the function of these target genes, as elaborated hereinbelow.

FLJ11618 (Accession NM_022452) is a VGAM97 host target gene. FLJ11618 BINDING SITE is HOST TARGET binding site found in the 3' untranslated region of mRNA encoded by FLJ11618, corresponding to a HOST TARGET binding site such as BINDING SITE I, BINDING SITE II or BINDING SITE III. Table 2 illustrates the complementarity of the nucleotide sequences of FLJ11618 BINDING SITE, designated SEQ ID:22793, to the nucleotide sequence of VGAM97 RNA, herein designated VGAM RNA, also designated SEQ ID:2808.

A function of VGAM97 is therefore inhibition of FLJ11618 (Accession NM_022452). Accordingly, utilities of VGAM97 include diagnosis, prevention and treatment of diseases and clinical conditions associated with FLJ11618. FIG. 1 further provides a conceptual description of a novel bioinformatically detected viral gene of the present invention, referred to here as Viral Genomic Address Messenger 98 (VGAM98) viral gene, which modulates expression of respective host target genes thereof, the function and utility of which host target genes is known in the art.

VGAM98 is a novel bioinformatically detected regulatory, non protein coding, viral micro RNA (miRNA) gene. The method by which VGAM98 was detected is described hereinabove with reference to FIGS. 1-8.

VGAM98 gene, herein designated VGAM GENE, is a viral gene contained in the genome of Plutella Xylostella Granulovirus. VGAM98 host target gene, herein designated VGAM HOST TARGET GENE, is a human gene contained in the human genome.

VGAM98 gene encodes a VGAM98 precursor RNA, herein designated VGAM PRECURSOR RNA. Similar to other miRNA genes, and unlike most ordinary genes, VGAM98 precursor RNA does not encode a protein. A nucleotide sequence identical or highly similar to the nucleotide sequence of VGAM98 precursor RNA is designated SEQ ID:84, and is provided hereinbelow with reference to the sequence listing part. Nucleotide sequence SEQ ID:84 is located at position 52717 relative to the genome of Plutella Xylostella Granulovirus.

VGAM98 precursor RNA folds onto itself, forming VGAM98 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM98 folded precursor RNA into VGAM98 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM98 RNA is designated SEQ ID:2809, and is provided hereinbelow with reference to the sequence listing part.

VGAM98 host target gene, herein designated VGAM HOST TARGET GENE, encodes a corresponding messenger RNA, VGAM98 host target RNA, herein designated VGAM HOST TARGET RNA. VGAM98 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM98 RNA, herein designated VGAM RNA, binds complementarily to one or more host target binding sites located in untranslated regions of VGAM98 host target RNA, herein designated VGAM HOST TARGET RNA. This complementary binding is due to the fact that the nucleotide sequence of VGAM98 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM98 RNA, herein designated VGAM RNA, may have a different number of host target binding sites in untranslated regions of a VGAM98 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM98 RNA, herein designated VGAM RNA, to host target binding sites on VGAM98 host target RNA, herein designated VGAM HOST TARGET RNA, such as BINDING SITE I, BINDING SITE II and BINDING SITE III, inhibits translation of VGAM98 host target RNA into VGAM98 host target protein, herein designated VGAM HOST TARGET PROTEIN. VGAM host target protein is therefore outlined by a broken line.

It is appreciated that VGAM98 host target gene, herein designated VGAM HOST TARGET GENE, in fact represents a plurality of VGAM98 host target genes. The mRNA of each one of this plurality of VGAM98 host target genes comprises one or more host target binding sites, each having a nucleotide sequence which is at least partly complementary to VGAM98 RNA, herein designated VGAM RNA, and which when bound by VGAM98 RNA causes inhibition of translation of respective one or more VGAM98 host target proteins.

It is further appreciated by one skilled in the art that the mode of translational inhibition illustrated by FIG. 1 with specific reference to translational inhibition exerted by VGAM98 gene, herein designated VGAM GENE, on one or more VGAM98 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM98 is inhibition of expression of host target genes, as part of a novel viral mechanism of attacking a host. Accordingly, utilities of VGAM98 include diagnosis, prevention and treatment of viral infection by Plutella Xylostella Granulovirus. Specific functions, and accordingly utilities, of VGAM98 correlate with, and may be deduced from, the identity of the host target genes which VGAM98 binds and inhibits, and the function of these host target genes, as elaborated hereinbelow.

Nucleotide sequences of the VGAM98 precursor RNA, herein designated VGAM PRECURSOR RNA, and of the 'diced' VGAM98 RNA, herein designated VGAM RNA, and a schematic representation of the secondary folding of VGAM98 folded precursor RNA, herein designated VGAM FOLDED PRECURSOR RNA, of VGAM98 are further described hereinbelow with reference to Table 1.

Nucleotide sequences of host target binding sites, such as BINDING SITE-I, BINDING SITE-II and BINDING SITE-III of FIG. 1, found on VGAM98 host target RNA, and schematic representation of the complementarity of each of these host target binding sites to VGAM98 RNA, herein designated VGAM RNA, are described hereinbelow with reference to Table 2.

As mentioned hereinabove with reference to FIG. 1, a function of VGAM98 gene, herein designated VGAM is inhibition of expression of VGAM98 target genes. It is appreciated that specific functions, and accordingly utilities, of VGAM98 correlate with, and may be deduced from, the identity of the target genes which VGAM98 binds and inhibits, and the function of these target genes, as elaborated hereinbelow.

Core-binding Factor, Beta Subunit (CBFB, Accession NM_001755) is a VGAM98 host target gene. CBFB BINDING SITE1 and CBFB BINDING SITE2 are HOST TARGET binding sites found in untranslated regions of mRNA encoded by CBFB, corresponding to HOST TARGET binding sites such as BINDING SITE I, BINDING SITE II or BINDING SITE III. Table 2 illustrates the complementarity of the nucleotide sequences of CBFB BINDING SITE1 and CBFB BINDING SITE2, designated SEQ ID:7505 and SEQ ID:23146 respectively, to the nucleotide sequence of VGAM98 RNA, herein designated VGAM RNA, also designated SEQ ID:2809.

A function of VGAM98 is therefore inhibition of Core-binding Factor, Beta Subunit (CBFB, Accession NM_001755), a gene which is beta subunit of the transcription factor CBF which causes leukemia. Accordingly, utilities of VGAM98 include diagnosis, prevention and treatment of diseases and clinical conditions associated with CBFB. The function of CBFB has been established by previous studies. Liu et al. (1995) provided a review of leukemia pathogenesis related to CBFB. They suggested that it will be interesting to see whether variant fusions between CBFB and another gene exist as a result of translocation between 16q and another chromosome. The study of such variants might shed light on the mechanism of genesis by the inversion 16 fusion gene. Whether the abnormal eosinophils in the circulation in patients with inv (16) are part of the malignant cell population or a result of a secondary response could not be determined. Although the distribution of breakpoints in the introns of the 2 participating genes was heterogeneous, a surprisingly high incidence of breaks was observed in a small (OMIM Ref. No. 370 bp) intron of the MYH11 gene. CBFB and AML1 encode the 2 subunits of the transcription factor CBF, and alterations of either one are associated with acute myeloid leukemia. CBFB is a transcription factor that does not bind DNA directly but interacts with the AML1 DNA-binding transcription factor (AML1) to increase its ability to bind DNA and regulate transcription. AML1 is one of the most frequently mutated genes in human leukemia. It is disrupted by the t (8;21), t (3;21), and t (16;21) in acute myeloid leukemia and by the t (12;21) in childhood B-cell acute lymphocytic leukemia (ALL). By disrupting CBFB, the inv (16) also disrupts AML1 functions. Together, these chromosomal rearrangements account for nearly one-quarter of all AML cases and one-fifth of all childhood B cell ALL-containing discernible chromosomal abnormalities. Lutterbach et al. (1999) showed that the inv (16) fusion protein cooperates with the largest form of AML1, termed AML-1B, to repress transcription. This cooperativity requires the ability of the translocation fusion protein to bind to AML-1B. Mutation analysis and cell fractionation experiments indicated that the inv (16) fusion protein acts in the nucleus and that repression occurs when the complex is bound to DNA. They demonstrated that the C-terminal portion of the inv (16) fusion protein contains a repression domain, suggesting a molecular mechanism for AML1-mediated repression.

Full details of the abovementioned studies are described in the following publications, the disclosure of which are hereby incorporated by reference:

Liu, P.; Tarle, S. A.; Hajra, A.; Claxton, D. F.; Marlton, P.; Freedman, M.; Siciliano, M. J.; Collins, F. S.: Fusion between transcription factor CBF-beta/PEBP2-beta and a myosin heavy chain in acute myeloid leukemia. Science 261:1041-1044, 1993; and Lutterbach, B.; Hou, Y.; Durst, K. L.; Hiebert, S. W.: The inv (16) encodes an acute myeloid leukemia 1 transcriptional corepressor. Proc. Nat. Acad. Sci. 96:12822-12827, 1999.

Further studies establishing the function and utilities of CBFB are found in John Hopkins OMIM database record ID 121360, and in sited publications numbered 3402-3408 listed in the bibliography section hereinbelow, which are also hereby incorporated by reference. Sorting Nexin 9 (SNX9, Accession NM_016224) is another VGAM98 host target gene. SNX9 BINDING SITE is HOST TARGET binding site found in the 3' untranslated region of mRNA encoded by SNX9, corresponding to a HOST TARGET binding site such as BINDING SITE I, BINDING SITE II or BINDING SITE III. Table 2 illustrates the complementarity of the nucleotide sequences of SNX9 BINDING SITE, designated SEQ ID:18329, to the nucleotide sequence of VGAM98 RNA, herein designated VGAM RNA, also designated SEQ ID:2809.

Another function of VGAM98 is therefore inhibition of Sorting Nexin 9 (SNX9, Accession NM_016224). Accordingly, utilities of VGAM98 include diagnosis, prevention and treatment of diseases and clinical conditions associated with SNX9. T-complex-associated-testis-expressed 1-like (TCTE1L, Accession XM_048205) is another VGAM98 host target gene. TCTE1L BINDING SITE is HOST TARGET binding site found in the 3' untranslated region of mRNA encoded by TCTE1L, corresponding to a HOST TARGET binding site such as BINDING SITE I, BINDING SITE II or BINDING SITE III. Table 2 illustrates the complementarity of the nucleotide sequences of TCTE1L BINDING SITE, designated SEQ ID:35142, to the nucleotide sequence of VGAM98 RNA, herein designated VGAM RNA, also designated SEQ ID:2809.

Another function of VGAM98 is therefore inhibition of T-complex-associated-testis-expressed 1-like (TCTE1L, Accession XM_048205). Accordingly, utilities of VGAM98 include diagnosis, prevention and treatment of diseases and clinical conditions associated with TCTE1L. Translin (TSN, Accession NM_004622) is another VGAM98 host target gene. TSN BINDING SITE is HOST TARGET binding site found in the 3' untranslated region of mRNA encoded by TSN, corresponding to a HOST TARGET binding site such as BINDING SITE I, BINDING SITE II or BINDING SITE III. Table 2 illustrates the complementarity of the nucleotide sequences of TSN BINDING SITE, designated SEQ ID:10984, to the nucleotide sequence of VGAM98 RNA, herein designated VGAM RNA, also designated SEQ ID:2809.

Another function of VGAM98 is therefore inhibition of Translin (TSN, Accession NM_004622), a gene which is a DNA binding protein and involved in DNA repair, replication, or recombination. Accordingly, utilities of VGAM98 include diagnosis, prevention and treatment of diseases and clinical conditions associated with TSN. The function of TSN has been established by previous studies. Kasai et al. (1994) identified a protein they termed recombination hotspot-associated factor (RcHF1), which specifically binds to the signal-like sequences at the breakpoint junction of 8q24 and 1p32 in acute lymphoblastic leukemia (ALL) patients carrying t (8;14)(q24; q11) and t (1;14)(p32; q11) translocations involving the TCR delta-chain locus (TCRD; 186810). Aoki et al. (1994) showed that an analogous protein, which they designated BCLF1, specifically binds to a target sequence within the clustered breakpoint region of the BCL2 oncogene (OMIM Ref. No. 151430) in follicular lymphoma patients carrying t (14;18)(q32; q21) translocations. It was proposed that these binding activities at recombination hotspot regions may play a crucial role in chromosomal translocations in lymphoid neoplasms. Aoki et al. (1995) purified the BCLF1 protein to homogeneity and determined that it is identical to RcHF1. Molecular gene cloning experiments revealed that the purified protein, which they named translin (TSN), is a previously undescribed DNA-binding protein with no significant similarity to known proteins. (The designation 'translin' came from selected letters in 'translocation.') In addition, Aoki et al. (1995) found that nuclear localization of translin was limited to lymphoid cell lines with rearranged Ig and processes such as DNA repair, replication, or recombination. In their native form, translin polypeptides form a multimeric structure that is responsible for its DNA binding activity. Aoki et al. (1997) found that the human and mouse translin genes have identical genomic structures consisting of 6 exons, 5 introns, and a GC-rich upstream region. By in situ hybridization and analysis of somatic cell hybrids, Aoki et al. (1997) mapped the human TSN gene to 2q21.1. Badge et al. (2000) studied a subtelomeric region at 16p13.3 that displays a 300-fold increase in crossovers compared to the genomic average rate. Segregation analysis of CEPH and other pedigrees yielded 6 paternal crossover breakpoints in the approximately 85-kb interval between the minisatellite loci D16S309 (MS205) and D16S83 (OMIM Ref. No. EKMDA2). Three crossovers were mapped to within the same small (less than 3 kb) interval, which did not colocalize with any tandem repeat array or expressed sequence. Sequence analysis revealed the presence of recombination-associated motifs and binding sites for translin. The authors concluded that this locus represents an intense male-specific recombination hotspot. Hosaka et al. (2000) demonstrated that the presence of the translin binding motif may be one of the important determinants for the location of breakpoints in the TLS (OMIM Ref. No. 137070) and CHOP (OMIM Ref. No. 126337) genes which are fused by translocation t (12;16) in liposarcomas.

Full details of the abovementioned studies are described in the following publications, the disclosure of which are hereby incorporated by reference:

Badge, R. M.; Yardley, J.; Jeffreys, A. J.; Armour, J. A. L.: Crossover breakpoint mapping identifies a subtelomeric hotspot for male meiotic recombination. Hum. Molec. Genet. 9:1239-1244, 2000; and Hosaka, T.; Kanoe, H.; Nakayama, T.; Murakami, H.; Yamamoto, H.; Nakamata, T.; Tsuboyama, T.; Oka, M.; Kasai, M.; Sasaki, M. S.; Nakamura, T.; Toguchida, J.: Translin binds to the sequ.

Further studies establishing the function and utilities of TSN are found in John Hopkins OMIM database record ID 600575, and in sited publications numbered 9536-953 and 9914-9917 listed in the bibliography section hereinbelow, which are also hereby incorporated by reference. NTT73 (Accession NM_018057) is another VGAM98 host target gene. NTT73 BINDING SITE is HOST TARGET binding site found in the 3' untranslated region of mRNA encoded by NTT73, corresponding to a HOST TARGET binding site such as BINDING SITE I, BINDING SITE II or BINDING SITE III. Table 2 illustrates the complementarity of the nucleotide sequences of NTT73 BINDING SITE, designated SEQ ID:19823, to the nucleotide sequence of VGAM98 RNA, herein designated VGAM RNA, also designated SEQ ID:2809.

Another function of VGAM98 is therefore inhibition of NTT73 (Accession NM_018057). Accordingly, utilities of VGAM98 include diagnosis, prevention and treatment of diseases and clinical conditions associated with NTT73. Nudix (nucleoside diphosphate linked moiety X)-type Motif 11 (NUDT11, Accession XM_010230) is another VGAM98 host target gene. NUDT11 BINDING SITE is HOST TARGET binding site found in the 3' untranslated region of mRNA encoded by NUDT11, corresponding to a HOST TARGET binding site such as BINDING SITE I, BINDING SITE II or BINDING SITE III. Table 2 illustrates the complementarity of the nucleotide sequences of NUDT11 BINDING SITE, designated SEQ ID:30145, to the nucleotide sequence of VGAM98 RNA, herein designated VGAM RNA, also designated SEQ ID:2809.

Another function of VGAM98 is therefore inhibition of Nudix (nucleoside diphosphate linked moiety X)-type Motif 11 (NUDT11, Accession XM_010230). Accordingly, utilities of VGAM98 include diagnosis, prevention and treatment of diseases and clinical conditions associated with NUDT11. POPX1 (Accession NM_014906) is another VGAM98 host target gene. POPX1 BINDING SITE is HOST TARGET binding site found in the 3' untranslated region of mRNA encoded by POPX1, corresponding to a HOST TARGET binding site such as BINDING SITE I, BINDING SITE II or BINDING SITE III. Table 2 illustrates the complementarity of the nucleotide sequences of POPX1 BINDING SITE, designated SEQ ID:17118, to the nucleotide sequence of VGAM98 RNA, herein designated VGAM RNA, also designated SEQ ID:2809.

Another function of VGAM98 is therefore inhibition of POPX1 (Accession NM_014906). Accordingly, utilities of VGAM98 include diagnosis, prevention and treatment of diseases and clinical conditions associated with POPX1. Tripartite Motif-containing 2 (TRIM2, Accession NM_015271) is another VGAM98 host target gene. TRIM2 BINDING SITE is HOST TARGET binding site found in the 3' untranslated region of mRNA encoded by TRIM2, corresponding to a HOST TARGET binding site such as BINDING SITE I, BINDING SITE II or BINDING SITE III. Table 2 illustrates the complementarity of the nucleotide sequences of TRIM2 BINDING SITE, designated SEQ ID:17598, to the nucleotide sequence of VGAM98 RNA, herein designated VGAM RNA, also designated SEQ ID:2809.

Another function of VGAM98 is therefore inhibition of Tripartite Motif-containing 2 (TRIM2, Accession NM_015271). Accordingly, utilities of VGAM98 include diagnosis, prevention and treatment of diseases and clinical conditions associated with TRIM2. FIG. 1 further provides a conceptual description of a novel bioinformatically detected viral gene of the present invention, referred to here as Viral Genomic Address Messenger 99 (VGAM99) viral gene, which modulates expression of respective host target genes thereof, the function and utility of which host target genes is known in the art.

VGAM99 is a novel bioinformatically detected regulatory, non protein coding, viral micro RNA (miRNA) gene. The method by which VGAM99 was detected is described hereinabove with reference to FIGS. 1-8.

VGAM99 gene, herein designated VGAM GENE, is a viral gene contained in the genome of Plutella Xylostella Granulovirus. VGAM99 host target gene, herein designated VGAM HOST TARGET GENE, is a human gene contained in the human genome.

VGAM99 gene encodes a VGAM99 precursor RNA, herein designated VGAM PRECURSOR RNA. Similar to other miRNA genes, and unlike most ordinary genes, VGAM99 precursor RNA does not encode a protein. A nucleotide sequence identical or highly similar to the nucleotide sequence of VGAM99 precursor RNA is designated SEQ ID:85, and is provided hereinbelow with reference to the sequence listing part. Nucleotide sequence SEQ ID:85 is located at position 37560 relative to the genome of Plutella Xylostella Granulovirus.

VGAM99 precursor RNA folds onto itself, forming VGAM99 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM99 folded precursor RNA into VGAM99 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM99 RNA is designated SEQ ID:2810, and is provided hereinbelow with reference to the sequence listing part.

VGAM99 host target gene, herein designated VGAM HOST TARGET GENE, encodes a corresponding messenger RNA, VGAM99 host target RNA, herein designated VGAM HOST TARGET RNA. VGAM99 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM99 RNA, herein designated VGAM RNA, binds complementarily to one or more host target binding sites located in untranslated regions of VGAM99 host target RNA, herein designated VGAM HOST TARGET RNA. This complementary binding is due to the fact that the nucleotide sequence of VGAM99 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM99 RNA, herein designated VGAM RNA, may have a different number of host target binding sites in untranslated regions of a VGAM99 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM99 RNA, herein designated VGAM RNA, to host target binding sites on VGAM99 host target RNA, herein designated VGAM HOST TARGET RNA, such as BINDING SITE I, BINDING SITE II and BINDING SITE III, inhibits translation of VGAM99 host target RNA into VGAM99 host target protein, herein designated VGAM HOST TARGET PROTEIN. VGAM host target protein is therefore outlined by a broken line.

It is appreciated that VGAM99 host target gene, herein designated VGAM HOST TARGET GENE, in fact represents a plurality of VGAM99 host target genes. The mRNA of each one of this plurality of VGAM99 host target genes comprises one or more host target binding sites, each having a nucleotide sequence which is at least partly complementary to VGAM99 RNA, herein designated VGAM RNA, and which when bound by VGAM99 RNA causes inhibition of translation of respective one or more VGAM99 host target proteins.

It is further appreciated by one skilled in the art that the mode of translational inhibition illustrated by FIG. 1 with specific reference to translational inhibition exerted by VGAM99 gene, herein designated VGAM GENE, on one or more VGAM99 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM99 is inhibition of expression of host target genes, as part of a novel viral mechanism of attacking a host. Accordingly, utilities of VGAM99 include diagnosis, prevention and treatment of viral infection by Plutella Xylostella Granulovirus. Specific functions, and accordingly utilities, of VGAM99 correlate with, and may be deduced from, the identity of the host target genes which VGAM99 binds and inhibits, and the function of these host target genes, as elaborated hereinbelow.

Nucleotide sequences of the VGAM99 precursor RNA, herein designated VGAM PRECURSOR RNA, and of the 'diced' VGAM99 RNA, herein designated VGAM RNA, and a schematic representation of the secondary folding of VGAM99 folded precursor RNA, herein designated VGAM FOLDED PRECURSOR RNA, of VGAM99 are further described hereinbelow with reference to Table 1.

Nucleotide sequences of host target binding sites, such as BINDING SITE-I, BINDING SITE-II and BINDING SITE-III of FIG. 1, found on VGAM99 host target RNA, and schematic representation of the complementarity of each of these host target binding sites to VGAM99 RNA, herein designated VGAM RNA, are described hereinbelow with reference to Table 2.

As mentioned hereinabove with reference to FIG. 1, a function of VGAM99 gene, herein designated VGAM is inhibition of expression of VGAM99 target genes. It is appreciated that specific functions, and accordingly utilities, of VGAM99 correlate with, and may be deduced from, the identity of the target genes which VGAM99 binds and inhibits, and the function of these target genes, as elaborated hereinbelow.

Translin (TSN, Accession NM_004622) is a VGAM99 host target gene. TSN BINDING SITE is HOST TARGET binding site found in the 3' untranslated region of mRNA encoded by TSN, corresponding to a HOST TARGET binding site such as BINDING SITE I, BINDING SITE II or BINDING SITE III. Table 2 illustrates the complementarity of the nucleotide sequences of TSN BINDING SITE, designated SEQ ID:10985, to the nucleotide sequence of VGAM99 RNA, herein designated VGAM RNA, also designated SEQ ID:2810.

A function of VGAM99 is therefore inhibition of Translin (TSN, Accession NM_004622), a gene which is a DNA binding protein and involved in DNA repair, replication, or recombination. Accordingly, utilities of VGAM99 include diagnosis, prevention and treatment of diseases and clinical conditions associated with TSN. The function of TSN and its association with various diseases and clinical conditions, has been established by previous studies, as described hereinabove with reference to VGAM98. KIAA1535 (Accession XM_086565) is another VGAM99 host target gene. KIAA1535 BINDING SITE is HOST TARGET binding site found in the 3' untranslated region of mRNA encoded by KIAA1535, corresponding to a HOST TARGET binding site such as BINDING SITE I, BINDING SITE II or BINDING SITE III. Table 2 illustrates the complementarity of the nucleotide sequences of KIAA1535 BINDING SITE, designated SEQ ID:38764, to the nucleotide sequence of VGAM99 RNA, herein designated VGAM RNA, also designated SEQ ID:2810.

Another function of VGAM99 is therefore inhibition of KIAA1535 (Accession XM_086565). Accordingly, utilities of VGAM99 include diagnosis, prevention and treatment of diseases and clinical conditions associated with KIAA1535. NECL1 (Accession NM_021189) is another VGAM99 host target gene. NECL1 BINDING SITE is HOST TARGET binding site found in the 3' untranslated region of mRNA encoded by NECL1, corresponding to a HOST TARGET binding site such as BINDING SITE I, BINDING SITE II or BINDING SITE III. Table 2 illustrates the complementarity of the nucleotide sequences of NECL1 BINDING SITE, designated SEQ ID:22163, to the nucleotide sequence of VGAM99 RNA, herein designated VGAM RNA, also designated SEQ ID:2810.

Another function of VGAM99 is therefore inhibition of NECL1 (Accession NM_021189). Accordingly, utilities of VGAM99 include diagnosis, prevention and treatment of diseases and clinical conditions associated with NECL1. FIG. 1 further provides a conceptual description of a novel bioinformatically detected viral gene of the present invention, referred to here as Viral Genomic Address Messenger 100 (VGAM100) viral gene, which modulates expression of respective host target genes thereof, the function and utility of which host target genes is known in the art.

VGAM100 is a novel bioinformatically detected regulatory, non protein coding, viral micro RNA (miRNA) gene. The method by which VGAM100 was detected is described hereinabove with reference to FIGS. 1-8.

VGAM100 gene, herein designated VGAM GENE, is a viral gene contained in the genome of Plutella Xylostella Granulovirus. VGAM100 host target gene, herein designated VGAM HOST TARGET GENE, is a human gene contained in the human genome.

VGAM100 gene encodes a VGAM100 precursor RNA, herein designated VGAM PRECURSOR RNA. Similar to other miRNA genes, and unlike most ordinary genes, VGAM100 precursor RNA does not encode a protein. A nucleotide sequence identical or highly similar to the nucleotide sequence of VGAM100 precursor RNA is designated SEQ ID:86, and is provided hereinbelow with reference to the sequence listing part. Nucleotide sequence SEQ ID:86 is located at position 61363 relative to the genome of Plutella Xylostella Granulovirus.

VGAM100 precursor RNA folds onto itself, forming VGAM100 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or a partial inversed-reversed sequence of the nucleotide sequence of the second half thereof.

An enzyme complex designated DICER COMPLEX, 'dices' the VGAM100 folded precursor RNA into VGAM100 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM100 RNA is designated SEQ ID:2811, and is provided hereinbelow with reference to the sequence listing part.

VGAM100 host target gene, herein designated VGAM HOST TARGET GENE, encodes a corresponding messenger RNA, VGAM100 host target RNA, herein designated VGAM HOST TARGET RNA. VGAM100 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM100 RNA, herein designated VGAM RNA, binds complementarily to one or more host target binding sites located in untranslated regions of VGAM100 host target RNA, herein designated VGAM HOST TARGET RNA. This complementary binding is due to the fact that the nucleotide sequence of VGAM100 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM100 RNA, herein designated VGAM RNA, may have a different number of host target binding sites in untranslated regions of a VGAM100 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM100 RNA, herein designated VGAM RNA, to host target binding sites on VGAM100 host target RNA, herein designated VGAM HOST TARGET RNA, such as BINDING SITE I, BINDING SITE II and BINDING SITE III, inhibits translation of VGAM100 host target RNA into VGAM100 host target protein, herein designated VGAM HOST TARGET PROTEIN. VGAM host target protein is therefore outlined by a broken line.

It is appreciated that VGAM100 host target gene, herein designated VGAM HOST TARGET GENE, in fact represents a plurality of VGAM100 host target genes. The mRNA of each one of this plurality of VGAM100 host target genes comprises one or more host target binding sites, each having a nucleotide sequence which is at least partly complementary to VGAM100 RNA, herein designated VGAM RNA, and which when bound by VGAM100 RNA causes inhibition of translation of respective one or more VGAM100 host target proteins.

It is further appreciated by one skilled in the art that the mode of translational inhibition illustrated by FIG. 1 with specific reference to translational inhibition exerted by VGAM100 gene, herein designated VGAM GENE, on one or more VGAM100 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM100 is inhibition of expression of host target genes, as part of a novel viral mechanism of attacking a host. Accordingly, utilities of VGAM100 include diagnosis, prevention and treatment of viral infection by Plutella Xylostella Granulovirus. Specific functions, and accordingly utilities, of VGAM100 correlate with, and may be deduced from, the identity of the host target genes which VGAM100 binds and inhibits, and the function of these host target genes, as elaborated hereinbelow.

Nucleotide sequences of the VGAM100 precursor RNA, herein designated VGAM PRECURSOR RNA, and of the 'diced' VGAM100 RNA, herein designated VGAM RNA, and a schematic representation of the secondary folding of

1499

VGAM100 folded precursor RNA, herein designated VGAM FOLDED PRECURSOR RNA, of VGAM100 are further described hereinbelow with reference to Table 1.

Nucleotide sequences of host target binding sites, such as BINDING SITE-I, BINDING SITE-II and BINDING SITE-III of FIG. 1, found on VGAM100 host target RNA, and schematic representation of the complementarity of each of these host target binding sites to VGAM100 RNA, herein designated VGAM RNA, are described hereinbelow with reference to Table 2.

As mentioned hereinabove with reference to FIG. 1, a function of VGAM100 gene, herein designated VGAM is inhibition of expression of VGAM100 target genes. It is appreciated that specific functions, and accordingly utilities, of VGAM100 correlate with, and may be deduced from, the identity of the target genes which VGAM100 binds and inhibits, and the function of these target genes, as elaborated hereinbelow.

Nuclear Factor I/B (NFIB, Accession NM_005596) is a VGAM100 host target gene. NFIB BINDING SITE is HOST TARGET binding site found in the 3" untranslated region of mRNA encoded by NFIB, corresponding to a HOST TARGET binding site such as BINDING SITE I, BINDING SITE II or BINDING SITE III. Table 2 illustrates the complementarity of the nucleotide sequences of NFIB BINDING SITE, designated SEQ ID:12120, to the nucleotide sequence of VGAM100 RNA, herein designated VGAM RNA, also designated SEQ ID:2811.

A function of VGAM100 is therefore inhibition of Nuclear Factor I/B (NFIB, Accession NM_005596), a gene which recognizes and binds the palindromic sequence 5'- ttg-gcnnnnngccaa-3' present in viral and cellular promoters. Accordingly, utilities of VGAM100 include diagnosis, prevention and treatment of diseases and clinical conditions associated with NFIB. The function of NFIB has been established by previous studies. See nuclear factor I/A (NFIA; 600727). Qian et al. (1995) mapped the NFIB gene to chromosome 9p24.1 by fluorescence in situ hybridization. Approximately 12% of all pleomorphic adenomas of the salivary glands are characterized by chromosome aberrations involving 12q13-q15. Several chromosomes have been found as translocation partners of chromosome 12, and some of these are recurrent. The target gene on 12q13-q15 involved in the translocation is HMGIC (OMIM Ref. No. 600698). Fusion partner genes include LPP (OMIM Ref. No. 600700) on 3q, ALDH2 (OMIM Ref. No. 100650) on 12q24.1, and FHIT (OMIM Ref. No. 601153) on 3p. Using 3-prime-RACE analysis of a primary adenoma with an apparently normal karyotype, Geurts et al. (1998) found an HMGIC fusion transcript containing ectopic sequences derived from the NFIB gene. In a second adenoma with an ins (9;12)(p23;q12q15) as the sole anomaly, they also found an HMGIC/NFIB hybrid transcript. Nucleotide sequence analysis of the fusion transcripts indicated that the genetic aberration in both tumors resulted in the replacement of a carboxy-terminal segment of HMGIC by the last 5 amino acids of NFIB Full details of the abovementioned studies are described in the following publications, the disclosure of which are hereby incorporated by reference:

Geurts, J. M. W.; Schoenmakers, E. F. P. M.; Roijer, E.; Astrom, A.-K.; Stenman, G.; van de Ven, W. J. M.: Identification of NFIB as recurrent translocation partner gene of HMGIC in pleomorphic adenomas. Oncogene 16:865-872, 1998; and Qian, F.; Kruse, U.; Lichter, P.; Sippel, A. E.: Chromosomal localization of the four genes (NFIA, B, C, and X) for the human transcription factor nuclear factor I by FISH. Genomics 28.

Further studies establishing the function and utilities of NFIB are found in John Hopkins OMIM database record ID 600728, and in sited publications numbered 7133 listed in the bibliography section hereinbelow, which are also hereby incorporated by reference. DKFZp434J0617 (Accession NM_032246) is another VGAM100 host target gene. DKFZp434J0617 BINDING SITE is HOST TARGET binding site found in the 3' untranslated region of mRNA encoded by DKFZp434J0617, corresponding to a HOST TARGET binding site such as BINDING SITE I, BINDING SITE II or BINDING SITE III. Table 2 illustrates the complementarity of the nucleotide sequences of DKFZp434J0617 BINDING SITE, designated SEQ ID:25980, to the nucleotide sequence of VGAM100 RNA, herein designated VGAM RNA, also designated SEQ ID:2811.

Another function of VGAM100 is therefore inhibition of DKFZp434J0617 (Accession NM_032246). Accordingly, utilities of VGAM100 include diagnosis, prevention and treatment of diseases and clinical conditions associated with DKFZp434J0617. LCE (Accession NM_024090) is another VGAM100 host target gene. LCE BINDING SITE is HOST TARGET binding site found in the 3' untranslated region of mRNA encoded by LCE, corresponding to a HOST TARGET binding site such as BINDING SITE I, BINDING SITE II or BINDING SITE III. Table 2 illustrates the complementarity of the nucleotide sequences of LCE BINDING SITE, designated SEQ ID:23532, to the nucleotide sequence of VGAM100 RNA, herein designated VGAM RNA, also designated SEQ ID:2811.

Another function of VGAM100 is therefore inhibition of LCE (Accession NM_024090). Accordingly, utilities of VGAM100 include diagnosis, prevention and treatment of diseases and clinical conditions associated with LCE. mPA-PLA1 (Accession NM_139248) is another VGAM100 host target gene. mPA-PLA1 BINDING SITE is HOST TARGET binding site found in the 3' untranslated region of mRNA encoded by mPA-PLA1, corresponding to a HOST TARGET binding site such as BINDING SITE I, BINDING SITE II or BINDING SITE III. Table 2 illustrates the complementarity of the nucleotide sequences of mPA-PLA1 BINDING SITE, designated SEQ ID:29249, to the nucleotide sequence of VGAM100 RNA, herein designated VGAM RNA, also designated SEQ ID:2811.

Another function of VGAM100 is therefore inhibition of mPA-PLA1 (Accession NM_139248). Accordingly, utilities of VGAM100 include diagnosis, prevention and treatment of diseases and clinical conditions associated with mPA-PLA1. LOC158629 (Accession XM_098972) is another VGAM100 host target gene. LOC158629 BINDING SITE is HOST TARGET binding site found in the 5' untranslated region of mRNA encoded by LOC158629, corresponding to a HOST TARGET binding site such as BINDING SITE I, BINDING SITE II or BINDING SITE III. Table 2 illustrates the complementarity of the nucleotide sequences of LOC158629 BINDING SITE, designated SEQ ID:42018, to the nucleotide sequence of VGAM100 RNA, herein designated VGAM RNA, also designated SEQ ID:2811.

Another function of VGAM100 is therefore inhibition of LOC158629 (Accession XM_098972). Accordingly, utilities of VGAM100 include diagnosis, prevention and treatment of diseases and clinical conditions associated with LOC158629. FIG. 1 further provides a conceptual description of a novel bioinformatically detected viral gene of the present invention, referred to here as Viral Genomic Address Messenger 101 (VGAM101) viral gene, which modulates expression of respective host target genes thereof, the function and utility of which host target genes is known in the art.

VGAM101 is a novel bioinformatically detected regulatory, non protein coding, viral micro RNA (miRNA) gene. The method by which VGAM101 was detected is described hereinabove with reference to FIGS. 1-8.

VGAM101 gene, herein designated VGAM GENE, is a viral gene contained in the genome of Plutella Xylostella Granulovirus. VGAM101 host target gene, herein designated VGAM HOST TARGET GENE, is a human gene contained in the human genome.

VGAM101 gene encodes a VGAM101 precursor RNA, herein designated VGAM PRECURSOR RNA. Similar to other miRNA genes, and unlike most ordinary genes, VGAM101 precursor RNA does not encode a protein. A nucleotide sequence identical or highly similar to the nucleotide sequence of VGAM101 precursor RNA is designated SEQ ID:87, and is provided hereinbelow with reference to the sequence listing part. Nucleotide sequence SEQ ID:87 is located at position 22037 relative to the genome of Plutella Xylostella Granulovirus.

VGAM101 precursor RNA folds onto itself, forming VGAM101 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM101 folded precursor RNA into VGAM101 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM101 RNA is designated SEQ ID:2812, and is provided hereinbelow with reference to the sequence listing part.

VGAM101 host target gene, herein designated VGAM HOST TARGET GENE, encodes a corresponding messenger RNA, VGAM101 host target RNA, herein designated VGAM HOST TARGET RNA. VGAM101 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM101 RNA, herein designated VGAM RNA, binds complementarily to one or more host target binding sites located in untranslated regions of VGAM101 host target RNA, herein designated VGAM HOST TARGET RNA. This complementary binding is due to the fact that the nucleotide sequence of VGAM101 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM101 RNA, herein designated VGAM RNA, may have a different number of host target binding sites in untranslated regions of a VGAM101 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM101 RNA, herein designated VGAM RNA, to host target binding sites on VGAM101 host target RNA, herein designated VGAM HOST TARGET RNA, such as BINDING SITE I, BINDING SITE II and BINDING SITE III, inhibits translation of VGAM101 host target RNA into VGAM101 host target protein, herein designated VGAM HOST TARGET PROTEIN. VGAM host target protein is therefore outlined by a broken line.

It is appreciated that VGAM101 host target gene, herein designated VGAM HOST TARGET GENE, in fact represents a plurality of VGAM101 host target genes. The mRNA of each one of this plurality of VGAM101 host target genes comprises one or more host target binding sites, each having a nucleotide sequence which is at least partly complementary to VGAM101 RNA, herein designated VGAM RNA, and which when bound by VGAM101 RNA causes inhibition of translation of respective one or more VGAM101 host target proteins.

It is further appreciated by one skilled in the art that the mode of translational inhibition illustrated by FIG. 1 with specific reference to translational inhibition exerted by VGAM101 gene, herein designated VGAM GENE, on one or more VGAM101 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM101 is inhibition of expression of host target genes, as part of a novel viral mechanism of attacking a host. Accordingly, utilities of VGAM101 include diagnosis, prevention and treatment of viral infection by Plutella Xylostella Granulovirus. Specific functions, and accordingly utilities, of VGAM101 correlate with, and may be deduced from, the identity of the host target genes which VGAM101 binds and inhibits, and the function of these host target genes, as elaborated hereinbelow.

Nucleotide sequences of the VGAM101 precursor RNA, herein designated VGAM PRECURSOR RNA, and of the 'diced' VGAM101 RNA, herein designated VGAM RNA, and a schematic representation of the secondary folding of VGAM101 folded precursor RNA, herein designated VGAM FOLDED PRECURSOR RNA, of VGAM101 are further described hereinbelow with reference to Table 1.

Nucleotide sequences of host target binding sites, such as BINDING SITE-I, BINDING SITE-II and BINDING SITE-III of FIG. 1, found on VGAM101 host target RNA, and schematic representation of the complementarity of each of these host target binding sites to VGAM101 RNA, herein designated VGAM RNA, are described hereinbelow with reference to Table 2.

As mentioned hereinabove with reference to FIG. 1, a function of VGAM101 gene, herein designated VGAM is inhibition of expression of VGAM101 target genes. It is appreciated that specific functions, and accordingly utilities, of VGAM101 correlate with, and may be deduced from, the identity of the target genes which VGAM101 binds and inhibits, and the function of these target genes, as elaborated hereinbelow.

Ferrochelatase (protoporphyria) (FECH, Accession NM_000140) is a VGAM101 host target gene. FECH BINDING SITE is HOST TARGET binding site found in the 3' untranslated region of mRNA encoded by FECH, corresponding to a HOST TARGET binding site such as BINDING SITE I, BINDING SITE II or BINDING SITE III. Table 2 illustrates the complementarity of the nucleotide sequences of FECH BINDING SITE, designated SEQ ID:5636, to the nucleotide sequence of VGAM101 RNA, herein designated VGAM RNA, also designated SEQ ID:2812.

A function of VGAM101 is therefore inhibition of Ferrochelatase (protoporphyria) (FECH, Accession NM_000140). Accordingly, utilities of VGAM101 include diagnosis, prevention and treatment of diseases and clinical conditions associated with FECH. Heparan Sulfate (glucosamine) 3-O-sulfotransferase 2 (HS3ST2, Accession NM_006043) is another VGAM101 host target gene. HS3ST2 BINDING SITE is HOST TARGET binding site found in the 3' untranslated region of mRNA encoded by HS3ST2, corresponding to a HOST TARGET binding site such as BINDING SITE I, BINDING SITE II or BINDING SITE III. Table 2 illustrates the complementarity of the nucleotide sequences of HS3ST2 BINDING SITE, designated SEQ ID:12680, to the nucleotide sequence of VGAM101 RNA, herein designated VGAM RNA, also designated SEQ ID:2812.

Another function of VGAM101 is therefore inhibition of Heparan Sulfate (glucosamine) 3-O-sulfotransferase 2 (HS3ST2, Accession NM_006043), a gene which plays a role in the generation of heparan sulfate proteoglycan. Accordingly, utilities of VGAM101 include diagnosis, prevention and treatment of diseases and clinical conditions associated with HS3ST2. The function of HS3ST2 has been established by previous studies. By searching an EST database for sequences related to the sulfotransferase domain of 3OST1, Shworak et al. (1999) identified partial cDNAs from the 3OST2, 3OST3A1 (OMIM Ref. No. 604057), and 3OST4 (OMIM Ref. No. 604059) genes. They used the partial cDNAs as probes and recovered additional clones corresponding to these genes and to 3OST3B1 (OMIM Ref. No. 604058). The 3OST2 gene encodes a predicted 367-amino acid protein that, like 3OST3A1 and 3OST3B1, is a predicted type II integral membrane protein. These 3 enzymes contain a positively charged N-terminal domain, a transmembrane domain, a region termed the SPLAG domain because it is rich in serine, proline, leucine, alanine, and glycine, and a C-terminal putative sulfotransferase domain. Although they share a similar regional structure, the only significant sequence homology between these 3OST proteins occurs in the sulfotransferase domains. Northern blot analysis revealed that the 3OST2 and 3OST4 genes were expressed predominantly in brain, while the 3OST3 gene exhibited more widespread expression. In a companion paper, Liu et al. (1999) demonstrated that the 3OST1, 3OST2, and 3OST3 isoforms each generate unique 3-O-sulfated structures. Shworak et al. (1999) stated that the isoforms with different sulfotransferase domains differentially place the rare 3-O-sulfate group in distinct sequence contexts, presumably to regulate discrete biologic activities. This capacity of the sulfotransferase domain to generate distinct sequences may in turn be modulated by the unique N-terminal domains of the proteins. By inclusion within mapped clones, Shworak et al. (1999) mapped the 3OST2 gene to 16p12, near the 3OST4 gene at 16p11.2. Using interspecific backcross analysis, they mapped the mouse 3Ost2 and 3Ost4 genes to the distal region of chromosome 7, in a region sharing homology of synteny with human chromosome 16p.

Full details of the abovementioned studies are described in the following publications, the disclosure of which are hereby incorporated by reference:

Liu, J.; Shworak, N. W.; Sinay, P.; Schwartz, J. J.; Zhang, L.; Fritze, L. M.; Rosenberg, R. D.: Expression of heparan sulfate D-glucosaminyl 3-O-sulfotransferase isoforms reveals novel substrate specificities. J. Biol. Chem. 274:5185-5192, 1999; and Shworak, N. W.; Liu, J.; Petros, L. M.; Zhang, L.; Kobayashi, M.; Copeland, N. G.; Jenkins, N. A.; Rosenberg, R. D.: Multiple isoforms of heparan sulfate D-glucosaminyl 3-O-sulfotransf.

Further studies establishing the function and utilities of HS3ST2 are found in John Hopkins OMIM database record ID 604056, and in sited publications numbered 5054-5055 listed in the bibliography section hereinbelow, which are also hereby incorporated by reference.5'-nucleotidase, Cytosolic II (NT5C2, Accession NM_012229) is another VGAM101 host target gene. NT5C2 BINDING SITE is HOST TARGET binding site found in the 3' untranslated region of mRNA encoded by NT5C2, corresponding to a HOST TARGET binding site such as BINDING SITE I, BINDING SITE II or BINDING SITE III. Table 2 illustrates the complementarity of the nucleotide sequences of NT5C2 BINDING SITE, designated SEQ ID:14524, to the nucleotide sequence of VGAM101 RNA, herein designated VGAM RNA, also designated SEQ ID:2812.

Another function of VGAM101 is therefore inhibition of 5'-nucleotidase, Cytosolic II (NT5C2, Accession NM_012229). Accordingly, utilities of VGAM101 include diagnosis, prevention and treatment of diseases and clinical conditions associated with NT5C2. Nuclear RNA Export Factor 5 (NXF5, Accession NM_033153) is another VGAM101 host target gene. NXF5 BINDING SITE1 and NXF5 BINDING SITE2 are HOST TARGET binding sites found in untranslated regions of mRNA encoded by NXF5, corresponding to HOST TARGET binding sites such as BINDING SITE I, BINDING SITE II or BINDING SITE III. Table 2 illustrates the complementarity of the nucleotide sequences of NXF5 BINDING SITE1 and NXF5 BINDING SITE2, designated SEQ ID:27006 and SEQ ID:27007 respectively, to the nucleotide sequence of VGAM101 RNA, herein designated VGAM RNA, also designated SEQ ID:2812.

Another function of VGAM101 is therefore inhibition of Nuclear RNA Export Factor 5 (NXF5, Accession NM_033153). Accordingly, utilities of VGAM101 include diagnosis, prevention and treatment of diseases and clinical conditions associated with NXF5. Protein Phosphatase 1, Regulatory (inhibitor) Subunit 8 (PPP1R8, Accession NM_002713) is another VGAM101 host target gene. PPP1R8 BINDING SITE1 through PPP1R8 BINDING SITE3 are HOST TARGET binding sites found in untranslated regions of mRNA encoded by PPP1R8, corresponding to HOST TARGET binding sites such as BINDING SITE I, BINDING SITE II or BINDING SITE III. Table 2 illustrates the complementarity of the nucleotide sequences of PPP1R8 BINDING SITE1 through PPP1R8 BINDING SITE3, designated SEQ ID:8570, SEQ ID:15340 and SEQ ID:28856 respectively, to the nucleotide sequence of VGAM101 RNA, herein designated VGAM RNA, also designated SEQ ID:2812.

Another function of VGAM101 is therefore inhibition of Protein Phosphatase 1, Regulatory (inhibitor) Subunit 8 (PPP1R8, Accession NM_002713), a gene which is an inhibitor subunit of the major nuclear protein phosphatase-1 (pp-1).

Accordingly, utilities of VGAM101 include diagnosis, prevention and treatment of diseases and clinical conditions associated with PPP1R8. The function of PPP1R8 has been established by previous studies. In Escherichia coli, the rne gene encodes RNase E, a protein involved in RNA degradation. Wang and Cohen (1994) cloned a human gene, which they called ARD1 for 'activator of RNA decay,' that is able to complement mutations in the E. coli rne gene. The human ARD1 gene encodes a proline-rich 127-amino acid protein with a predicted mass of 13.3 kD. Wang and Cohen (1994) showed that human ARD1 protein is able to produce RNase E-specific cleavages in E. coli. Van Eynde et al. (1995) cloned the bovine NIPP1 gene. The 351-amino acid NIPP1 protein is a specific inhibitor of type 1 serine/threonine protein phosphatases. The human ARD1 amino acid sequence is virtually identical to the carboxy terminus of the bovine NIPP1 amino acid sequence. Because the homology also extends into noncoding regions, the authors asserted that the NIPP1 and ARD1 proteins are alternately spliced products of the same gene. Claverie-Martin et al. (1997) purified human ARD1 protein and found that its apparent size was 19 kD. They attributed the observed retarded mobility on SDS-PAGE to the highly charged residues at the ends of the protein. Enzyme assays showed that ARD1, like RNase E, is Mg2+ dependent and that ARD1 and RNase E cleave RNA at the same sites in A+U-rich regions. Wang (1995) showed that the common 3-prime untranslated region of ARD1 and NIPP1 maps to human chromosome Full details of the abovementioned studies are described in the following publications, the disclosure of which are hereby incorporated by reference:

Claverie-Martin, F.; Wang, M.; Cohen, S. N.: ARD-1 cDNA from human cells encodes a site-specific single-strand endoribonuclease that functionally resembles Escherichia coli RNase E. J. Biol. Chem. 272:13823-13828, 1997; and Van Eynde, A.; Wera, S.; Beullens, M.; Torrekens, S.; Van Leuven, F.; Stalmans, W.; Bollen, M.: Molecular cloning of NIPP-1, a nuclear inhibitor of protein phosphatase-1, reveals homolo.

Further studies establishing the function and utilities of PPP1R8 are found in John Hopkins OMIM database record ID 602636, and in sited publications numbered 8753-875 and 8941-8942 listed in the bibliography section hereinbelow, which are also hereby incorporated by reference. FLJ10178 (Accession NM_018015) is another VGAM101 host target gene. FLJ10178 BINDING SITE is HOST TARGET binding site found in the 3' untranslated region of mRNA encoded by FLJ10178, corresponding to a HOST TARGET binding site such as BINDING SITE I, BINDING SITE II or BINDING SITE III. Table 2 illustrates the complementarity of the nucleotide sequences of FLJ10178 BINDING SITE, designated SEQ ID:19754, to the nucleotide sequence of VGAM101 RNA, herein designated VGAM RNA, also designated SEQ ID:2812.

Another function of VGAM101 is therefore inhibition of FLJ10178 (Accession NM_018015). Accordingly, utilities of VGAM101 include diagnosis, prevention and treatment of diseases and clinical conditions associated with FLJ10178. Hairy/enhancer-of-split Related with YRPW Motif-like (HEYL, Accession NM_014571) is another VGAM101 host target gene. HEYL BINDING SITE is HOST TARGET binding site found in the 3' untranslated region of mRNA encoded by HEYL, corresponding to a HOST TARGET binding site such as BINDING SITE I, BINDING SITE II or BINDING SITE III. Table 2 illustrates the complementarity of the nucleotide sequences of HEYL BINDING SITE, designated SEQ ID:15932, to the nucleotide sequence of VGAM101 RNA, herein designated VGAM RNA, also designated SEQ ID:2812.

Another function of VGAM101 is therefore inhibition of Hairy/enhancer-of-split Related with YRPW Motif-like (HEYL, Accession NM_014571). Accordingly, utilities of VGAM101 include diagnosis, prevention and treatment of diseases and clinical conditions associated with HEYL. KIAA0173 (Accession NM_014640) is another VGAM101 host target gene. KIAA0173 BINDING SITE is HOST TARGET binding site found in the 3' untranslated region of mRNA encoded by KIAA0173, corresponding to a HOST TARGET binding site such as BINDING SITE I, BINDING SITE II or BINDING SITE III. Table 2 illustrates the complementarity of the nucleotide sequences of KIAA0173 BINDING SITE, designated SEQ ID:16042, to the nucleotide sequence of VGAM101 RNA, herein designated VGAM RNA, also designated SEQ ID:2812.

Another function of VGAM101 is therefore inhibition of KIAA0173 (Accession NM_014640). Accordingly, utilities of VGAM101 include diagnosis, prevention and treatment of diseases and clinical conditions associated with KIAA0173. Nucleosomal Binding Protein 1 (NSBP1, Accession NM_030763) is another VGAM101 host target gene. NSBP1 BINDING SITE is HOST TARGET binding site found in the 3' untranslated region of mRNA encoded by NSBP1, corresponding to a HOST TARGET binding site such as BINDING SITE I, BINDING SITE II or BINDING SITE III. Table 2 illustrates the complementarity of the nucleotide sequences of NSBP1 BINDING SITE, designated SEQ ID:25045, to the nucleotide sequence of VGAM101 RNA, herein designated VGAM RNA, also designated SEQ ID:2812.

Another function of VGAM101 is therefore inhibition of Nucleosomal Binding Protein 1 (NSBP1, Accession NM_030763). Accordingly, utilities of VGAM101 include diagnosis, prevention and treatment of diseases and clinical conditions associated with NSBP1. PRO1257 (Accession NM_018578) is another VGAM101 host target gene. PRO1257 BINDING SITE is HOST TARGET binding site found in the 3' untranslated region of mRNA encoded by PRO1257, corresponding to a HOST TARGET binding site such as BINDING SITE I, BINDING SITE II or BINDING SITE III. Table 2 illustrates the complementarity of the nucleotide sequences of PRO1257 BINDING SITE, designated SEQ ID:20657, to the nucleotide sequence of VGAM101 RNA, herein designated VGAM RNA, also designated SEQ ID:2812.

Another function of VGAM101 is therefore inhibition of PRO1257 (Accession NM_018578). Accordingly, utilities of VGAM101 include diagnosis, prevention and treatment of diseases and clinical conditions associated with PRO1257. Zinc Finger, DHHC Domain Containing 2 (ZDHHC2, Accession NM_016353) is another VGAM101 host target gene. ZDHHC2 BINDING SITE is HOST TARGET binding site found in the 3' untranslated region of mRNA encoded by ZDHHC2, corresponding to a HOST TARGET binding site such as BINDING SITE I, BINDING SITE II or BINDING SITE III. Table 2 illustrates the complementarity of the nucleotide sequences of ZDHHC2 BINDING SITE, designated SEQ ID:18492, to the nucleotide sequence of VGAM101 RNA, herein designated VGAM RNA, also designated SEQ ID:2812.

Another function of VGAM101 is therefore inhibition of Zinc Finger, DHHC Domain Containing 2 (ZDHHC2, Accession NM_016353). Accordingly, utilities of VGAM101 include diagnosis, prevention and treatment of diseases and clinical conditions associated with ZDHHC2. LOC118851 (Accession XM_061180) is another VGAM101 host target gene. LOC118851 BINDING SITE is HOST TARGET binding site found in the 3' untranslated region of mRNA encoded by LOC118851, corresponding to a HOST TARGET binding site such as BINDING SITE I, BINDING SITE II or BINDING SITE III. Table 2 illustrates the complementarity of the nucleotide sequences of LOC118851 BINDING SITE, designated SEQ ID:37204, to the nucleotide sequence of VGAM101 RNA, herein designated VGAM RNA, also designated SEQ ID:2812.

Another function of VGAM101 is therefore inhibition of LOC118851 (Accession XM_061180). Accordingly, utilities of VGAM101 include diagnosis, prevention and treatment of diseases and clinical conditions associated with LOC118851. LOC145813 (Accession XM_096873) is another VGAM101 host target gene. LOC145813 BINDING SITE is HOST TARGET binding site found in the 3' untranslated region of mRNA encoded by LOC145813, corresponding to a HOST TARGET binding site such as BINDING SITE I, BINDING SITE II or BINDING SITE III. Table 2 illustrates the complementarity of the nucleotide sequences of LOC145813 BINDING SITE, designated SEQ ID:40597, to the nucleotide sequence of VGAM101 RNA, herein designated VGAM RNA, also designated SEQ ID:2812.

Another function of VGAM101 is therefore inhibition of LOC145813 (Accession XM_096873). Accordingly, utilities of VGAM101 include diagnosis, prevention and treatment of diseases and clinical conditions associated with LOC145813. LOC220565 (Accession XM_165417) is another VGAM101 host target gene. LOC220565 BINDING SITE is HOST TARGET binding site found in the 3' untranslated region of mRNA encoded by LOC220565, corresponding to a HOST TARGET binding site such as BINDING SITE I, BINDING SITE II or BINDING SITE III. Table 2 illustrates the complementarity of the nucleotide sequences of LOC220565 BINDING SITE, designated SEQ ID:43630, to the nucleotide sequence of VGAM101 RNA, herein designated VGAM RNA, also designated SEQ ID:2812.

Another function of VGAM101 is therefore inhibition of LOC220565 (Accession XM_165417). Accordingly, utilities of VGAM101 include diagnosis, prevention and treatment of diseases and clinical conditions associated with LOC220565. LOC85414 (Accession NM_033102) is another VGAM101 host target gene. LOC85414 BINDING SITE is HOST TARGET binding site found in the 3' untranslated region of mRNA encoded by LOC85414, corresponding to a HOST TARGET binding site such as BINDING SITE I, BINDING SITE II or BINDING SITE III. Table 2 illustrates the complementarity of the nucleotide sequences of LOC85414 BINDING SITE, designated SEQ ID:26953, to the nucleotide sequence of VGAM101 RNA, herein designated VGAM RNA, also designated SEQ ID:2812.

Another function of VGAM101 is therefore inhibition of LOC85414 (Accession NM_033102). Accordingly, utilities of VGAM101 include diagnosis, prevention and treatment of diseases and clinical conditions associated with LOC85414. LOC90141 (Accession XM_029373) is another VGAM101 host target gene. LOC90141 BINDING SITE is HOST TARGET binding site found in the 3' untranslated region of mRNA encoded by LOC90141, corresponding to a HOST TARGET binding site such as BINDING SITE I, BINDING SITE II or BINDING SITE III. Table 2 illustrates the complementarity of the nucleotide sequences of LOC90141 BINDING SITE, designated SEQ ID:30882, to the nucleotide sequence of VGAM101 RNA, herein designated VGAM RNA, also designated SEQ ID:2812.

Another function of VGAM101 is therefore inhibition of LOC90141 (Accession XM_029373). Accordingly, utilities of VGAM101 include diagnosis, prevention and treatment of diseases and clinical conditions associated with LOC90141. FIG. 1 further provides a conceptual description of a novel bioinformatically detected viral gene of the present invention, referred to here as Viral Genomic Address Messenger 102 (VGAM102) viral gene, which modulates expression of respective host target genes thereof, the function and utility of which host target genes is known in the art.

VGAM102 is a novel bioinformatically detected regulatory, non protein coding, viral micro RNA (miRNA) gene. The method by which VGAM102 was detected is described hereinabove with reference to FIGS. 1-8.

VGAM102 gene, herein designated VGAM GENE, is a viral gene contained in the genome of Plutella Xylostella Granulovirus. VGAM102 host target gene, herein designated VGAM HOST TARGET GENE, is a human gene contained in the human genome.

VGAM102 gene encodes a VGAM102 precursor RNA, herein designated VGAM PRECURSOR RNA. Similar to other miRNA genes, and unlike most ordinary genes, VGAM102 precursor RNA does not encode a protein. A nucleotide sequence identical or highly similar to the nucleotide sequence of VGAM102 precursor RNA is designated SEQ ID:88, and is provided hereinbelow with reference to the sequence listing part. Nucleotide sequence SEQ ID:88 is located at position 99184 relative to the genome of Plutella Xylostella Granulovirus.

VGAM102 precursor RNA folds onto itself, forming VGAM102 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM102 folded precursor RNA into VGAM102 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM102 RNA is designated SEQ ID:2813, and is provided hereinbelow with reference to the sequence listing part.

VGAM102 host target gene, herein designated VGAM HOST TARGET GENE, encodes a corresponding messenger RNA, VGAM102 host target RNA, herein designated VGAM HOST TARGET RNA. VGAM102 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM102 RNA, herein designated VGAM RNA, binds complementarily to one or more host target binding sites located in untranslated regions of VGAM102 host target RNA, herein designated VGAM HOST TARGET RNA. This complementary binding is due to the fact that the nucleotide sequence of VGAM102 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM102 RNA, herein designated VGAM RNA, may have a different number of host target binding sites in untranslated regions of a VGAM102 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM102 RNA, herein designated VGAM RNA, to host target binding sites on VGAM102 host target RNA, herein designated VGAM HOST TARGET RNA, such as BINDING SITE I, BINDING SITE II and BINDING SITE III, inhibits translation of VGAM102 host target RNA into VGAM102 host target protein, herein designated VGAM HOST TARGET PROTEIN. VGAM host target protein is therefore outlined by a broken line.

It is appreciated that VGAM102 host target gene, herein designated VGAM HOST TARGET GENE, in fact represents a plurality of VGAM102 host target genes. The mRNA of each one of this plurality of VGAM102 host target genes comprises one or more host target binding sites, each having a nucleotide sequence which is at least partly complementary to VGAM102 RNA, herein designated VGAM RNA, and which when bound by VGAM102 RNA causes inhibition of translation of respective one or more VGAM102 host target proteins.

It is further appreciated by one skilled in the art that the mode of translational inhibition illustrated by FIG. 1 with specific reference to translational inhibition exerted by VGAM102 gene, herein designated VGAM GENE, on one or more VGAM102 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM102 is inhibition of expression of host target genes, as part of a novel viral mechanism of attacking a host. Accordingly, utilities of VGAM102 include diagnosis, prevention and treatment of viral infection by Plutella Xylostella Granulovirus. Specific functions, and accordingly utilities, of VGAM102 correlate with, and may be deduced from, the identity of the host target genes which VGAM102 binds and inhibits, and the function of these target genes, as elaborated hereinbelow.

Nucleotide sequences of the VGAM102 precursor RNA, herein designated VGAM PRECURSOR RNA, and of the 'diced' VGAM102 RNA, herein designated VGAM RNA, and a schematic representation of the secondary folding of VGAM102 folded precursor RNA, herein designated VGAM FOLDED PRECURSOR RNA, of VGAM102 are further described hereinbelow with reference to Table 1.

Nucleotide sequences of host target binding sites, such as BINDING SITE-I, BINDING SITE-II and BINDING SITE-III of FIG. 1, found on VGAM102 host target RNA, and schematic representation of the complementarity of each of these host target binding sites to VGAM102 RNA, herein designated VGAM RNA, are described hereinbelow with reference to Table 2.

As mentioned hereinabove with reference to FIG. 1, a function of VGAM102 gene, herein designated VGAM is inhibition of expression of VGAM102 target genes. It is appreciated that specific functions, and accordingly utilities, of VGAM102 correlate with, and may be deduced from, the identity of the target genes which VGAM102 binds and inhibits, and the function of these target genes, as elaborated hereinbelow.

Chromosome 8 Open Reading Frame 2 (C8orf2, Accession NM_007175) is a VGAM102 host target gene. C8orf2 BINDING SITE is HOST TARGET binding site found in the 3' untranslated region of mRNA encoded by C8orf2, corresponding to a HOST TARGET binding site such as BINDING SITE I, BINDING SITE II or BINDING SITE III. Table 2 illustrates the complementarity of the nucleotide sequences of C8orf2 BINDING SITE, designated SEQ ID:14020, to the nucleotide sequence of VGAM102 RNA, herein designated VGAM RNA, also designated SEQ ID:2813.

A function of VGAM102 is therefore inhibition of Chromosome 8 Open Reading Frame 2 (C8orf2, Accession NM_007175). Accordingly, utilities of VGAM102 include diagnosis, prevention and treatment of diseases and clinical conditions associated with C8orf2. Potassium Channel, Subfamily K, Member 13 (KCNK13, Accession NM_022054) is another VGAM102 host target gene. KCNK13 BINDING SITE is HOST TARGET binding site found in the 3' untranslated region of mRNA encoded by KCNK13, corresponding to a HOST TARGET binding site such as BINDING SITE I, BINDING SITE II or BINDING SITE III. Table 2 illustrates the complementarity of the nucleotide sequences of KCNK13 BINDING SITE, designated SEQ ID:22592, to the nucleotide sequence of VGAM102 RNA, herein designated VGAM RNA, also designated SEQ ID:2813.

Another function of VGAM102 is therefore inhibition of Potassium Channel, Subfamily K, Member 13 (KCNK13, Accession NM_022054). Accordingly, utilities of VGAM102 include diagnosis, prevention and treatment of diseases and clinical conditions associated with KCNK13. START Domain Containing 7 (STARD7, Accession NM_020151) is another VGAM102 host target gene. STARD7 BINDING SITE1 and STARD7 BINDING SITE2 are HOST TARGET binding sites found in untranslated regions of mRNA encoded by STARD7, corresponding to HOST TARGET binding sites such as BINDING SITE I, BINDING SITE II or BINDING SITE III. Table 2 illustrates the complementarity of the nucleotide sequences of STARD7 BINDING SITE1 and STARD7 BINDING SITE2, designated SEQ ID:21355 and SEQ ID:29259 respectively, to the nucleotide sequence of VGAM102 RNA, herein designated VGAM RNA, also designated SEQ ID:2813.

Another function of VGAM102 is therefore inhibition of START Domain Containing 7 (STARD7, Accession NM_020151). Accordingly, utilities of VGAM102 include diagnosis, prevention and treatment of diseases and clinical conditions associated with STARD7. LOC57107 (Accession NM_020381) is another VGAM102 host target gene. LOC57107 BINDING SITE is HOST TARGET binding site found in the 3' untranslated region of mRNA encoded by LOC57107, corresponding to a HOST TARGET binding site such as BINDING SITE I, BINDING SITE II or BINDING SITE III. Table 2 illustrates the complementarity of the nucleotide sequences of LOC57107 BINDING SITE, designated SEQ ID:21648, to the nucleotide sequence of VGAM102 RNA, herein designated VGAM RNA, also designated SEQ ID:2813.

Another function of VGAM102 is therefore inhibition of LOC57107 (Accession NM_020381). Accordingly, utilities of VGAM102 include diagnosis, prevention and treatment of diseases and clinical conditions associated with LOC57107. LOC90643 (Accession XM_033145) is another VGAM102 host target gene. LOC90643 BINDING SITE is HOST TARGET binding site found in the 3' untranslated region of mRNA encoded by LOC90643, corresponding to a HOST TARGET binding site such as BINDING SITE I, BINDING SITE II or BINDING SITE III. Table 2 illustrates the complementarity of the nucleotide sequences of LOC90643 BINDING SITE, designated SEQ ID:31852, to the nucleotide sequence of VGAM102 RNA, herein designated VGAM RNA, also designated SEQ ID:2813.

Another function of VGAM102 is therefore inhibition of LOC90643 (Accession XM_033145). Accordingly, utilities of VGAM102 include diagnosis, prevention and treatment of diseases and clinical conditions associated with LOC90643. FIG. 1 further provides a conceptual description of a novel bioinformatically detected viral gene of the present invention, referred to here as Viral Genomic Address Messenger 103 (VGAM103) viral gene, which modulates expression of respective host target genes thereof, the function and utility of which host target genes is known in the art.

VGAM103 is a novel bioinformatically detected regulatory, non protein coding, viral micro RNA (miRNA) gene. The method by which VGAM103 was detected is described hereinabove with reference to FIGS. 1-8.

VGAM103 gene, herein designated VGAM GENE, is a viral gene contained in the genome of Plutella Xylostella Granulovirus. VGAM103 host target gene, herein designated VGAM HOST TARGET GENE, is a human gene contained in the human genome.

VGAM103 gene encodes a VGAM103 precursor RNA, herein designated VGAM PRECURSOR RNA. Similar to other miRNA genes, and unlike most ordinary genes, VGAM103 precursor RNA does not encode a protein. A nucleotide sequence identical or highly similar to the nucleotide sequence of VGAM103 precursor RNA is designated SEQ ID:89, and is provided hereinbelow with reference to the sequence listing part. Nucleotide sequence SEQ ID:89 is located at position 49030 relative to the genome of Plutella Xylostella Granulovirus.

VGAM103 precursor RNA folds onto itself, forming VGAM103 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM103 folded precursor RNA into VGAM103 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM103 RNA is designated SEQ ID:2814, and is provided hereinbelow with reference to the sequence listing part.

VGAM103 host target gene, herein designated VGAM HOST TARGET GENE, encodes a corresponding messenger RNA, VGAM103 host target RNA, herein designated VGAM HOST TARGET RNA. VGAM103 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM103 RNA, herein designated VGAM RNA, binds complementarily to one or more host target binding sites located in untranslated regions of VGAM103 host target RNA, herein designated VGAM HOST TARGET RNA. This complementary binding is due to the fact that the nucleotide sequence of VGAM103 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM103 RNA, herein designated VGAM RNA, may have a different number of host target binding sites in untranslated regions of a VGAM103 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM103 RNA, herein designated VGAM RNA, to host target binding sites on VGAM103 host target RNA, herein designated VGAM HOST TARGET RNA, such as BINDING SITE I, BINDING SITE II and BINDING SITE III, inhibits translation of VGAM103 host target RNA into VGAM103 host target protein, herein designated VGAM HOST TARGET PROTEIN. VGAM host target protein is therefore outlined by a broken line.

It is appreciated that VGAM103 host target gene, herein designated VGAM HOST TARGET GENE, in fact represents a plurality of VGAM103 host target genes. The mRNA of each one of this plurality of VGAM103 host target genes comprises one or more host target binding sites, each having a nucleotide sequence which is at least partly complementary to VGAM103 RNA, herein designated VGAM RNA, and which when bound by VGAM103 RNA causes inhibition of translation of respective one or more VGAM103 host target proteins.

It is further appreciated by one skilled in the art that the mode of translational inhibition illustrated by FIG. 1 with specific reference to translational inhibition exerted by VGAM103 gene, herein designated VGAM GENE, on one or more VGAM103 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM103 is inhibition of expression of host target genes, as part of a novel viral mechanism of attacking a host. Accordingly, utilities of VGAM103 include diagnosis, prevention and treatment of viral infection by Plutella Xylostella Granulovirus. Specific functions, and accordingly utilities, of VGAM103 correlate with, and may be deduced from, the identity of the host target genes which VGAM103 binds and inhibits, and the function of these host target genes, as elaborated hereinbelow.

Nucleotide sequences of the VGAM103 precursor RNA, herein designated VGAM PRECURSOR RNA, and of the 'diced' VGAM103 RNA, herein designated VGAM RNA, and a schematic representation of the secondary folding of VGAM103 folded precursor RNA, herein designated VGAM FOLDED PRECURSOR RNA, of VGAM103 are further described hereinbelow with reference to Table 1.

Nucleotide sequences of host target binding sites, such as BINDING SITE-I, BINDING SITE-II and BINDING SITE-III of FIG. 1, found on VGAM103 host target RNA, and schematic representation of the complementarity of each of these host target binding sites to VGAM103 RNA, herein designated VGAM RNA, are described hereinbelow with reference to Table 2.

As mentioned hereinabove with reference to FIG. 1, a function of VGAM103 gene, herein designated VGAM is inhibition of expression of VGAM103 target genes. It is appreciated that specific functions, and accordingly utilities, of VGAM103 correlate with, and may be deduced from, the identity of the target genes which VGAM103 binds and inhibits, and the function of these target genes, as elaborated hereinbelow.

ATPase, Aminophospholipid Transporter-like, Class I, Type 8A, Member 2 (ATP8A2, Accession XM_167916) is a VGAM103 host target gene. ATP8A2 BINDING SITE is HOST TARGET binding site found in the 3' untranslated region of mRNA encoded by ATP8A2, corresponding to a HOST TARGET binding site such as BINDING SITE I, BINDING SITE II or BINDING SITE III. Table 2 illustrates the complementarity of the nucleotide sequences of ATP8A2 BINDING SITE, designated SEQ ID:44918, to the nucleotide sequence of VGAM103 RNA, herein designated VGAM RNA, also designated SEQ ID:2814.

A function of VGAM103 is therefore inhibition of ATPase, Aminophospholipid Transporter-like, Class I, Type 8A, Member 2 (ATP8A2, Accession XM_167916). Accordingly, utilities of VGAM103 include diagnosis, prevention and treatment of diseases and clinical conditions associated with ATP8A2. Glucosaminyl (N-acetyl) Transferase 3, Mucin Type (GCNT3, Accession NM_004751) is another VGAM103 host target gene. GCNT3 BINDING SITE is HOST TARGET binding site found in the 5' untranslated region of mRNA encoded by GCNT3, corresponding to a HOST TARGET binding site such as BINDING SITE I, BINDING SITE II or BINDING SITE III. Table 2 illustrates the complementarity of the nucleotide sequences of GCNT3 BINDING SITE, designated SEQ ID:11140, to the nucleotide sequence of VGAM103 RNA, herein designated VGAM RNA, also designated SEQ ID:2814.

Another function of VGAM103 is therefore inhibition of Glucosaminyl (N-acetyl) Transferase 3, Mucin Type (GCNT3, Accession NM_004751), a gene which catalyzes O-glycan branch synthesis of the core 2 and core 4 type in mucins and controls expression of core 2 branched oligosaccharides and I antigens on the cell surface. Accordingly, utilities of VGAM103 include diagnosis, prevention and treatment of diseases and clinical conditions associated with GCNT3. The function of GCNT3 has been established by previous studies. Mucin-type glycoproteins are unique in that they have clusters of O-glycans containing N-acetylgalactosamine residues at reducing ends, which are linked to serine or threonine. O-glycans are classified according to the core structures, which can be converted in the presence of an N-acetylglucosaminyltransferase, such as GCNT3.

Full details of the abovementioned studies are described in the following publications, the disclosure of which are hereby incorporated by reference:

Schwientek, T.; Nomoto, M.; Levery, S. B.; Merkx, G.; van Kessel, A. G.; Bennett, E. P.; Hollingsworth, M. A.; Clausen, H.: Control of O-glycan branch formation: molecular cloning of human cDNA encoding a novel beta-1,6-N-acetylglucosaminyltransferase forming core 2 and core 4. J. Biol. Chem. 274:4504-4512, 1999; and Yeh, J.-C.; Ong, E.; Fukuda, M.: Molecular cloning and expression of a novel beta-1,6-N-acetylglucosaminyltransferase that forms core 2, core 4, and I branches. J. Biol. Chem. 274:321.

Further studies establishing the function and utilities of GCNT3 are found in John Hopkins OMIM database record ID 606836, and in sited publications numbered 557 and 12157 listed in the bibliography section hereinbelow, which are also hereby incorporated by reference. Synaptogyrin 3 (SYNGR3, Accession NM_004209) is another VGAM103 host target gene. SYNGR3 BINDING SITE is HOST TARGET binding site found in the 3' untranslated region of mRNA encoded by SYNGR3, corresponding to a HOST TARGET binding site such as BINDING SITE I, BINDING SITE II or BINDING SITE III. Table 2 illustrates the complementarity of the nucleotide sequences of SYNGR3 BINDING SITE, designated SEQ ID:10409, to the nucleotide sequence of VGAM103 RNA, herein designated VGAM RNA, also designated SEQ ID:2814.

Another function of VGAM103 is therefore inhibition of Synaptogyrin 3 (SYNGR3, Accession NM_004209). Accordingly, utilities of VGAM103 include diagnosis, prevention and treatment of diseases and clinical conditions associated with SYNGR3. Very Low Density Lipoprotein Receptor (VLDLR, Accession XM_045386) is another VGAM103 host target gene. VLDLR BINDING SITE is HOST TARGET binding site found in the 3' untranslated region of mRNA encoded by VLDLR, corresponding to a HOST TARGET binding site such as BINDING SITE I, BINDING SITE II or BINDING SITE III. Table 2 illustrates the complementarity of the nucleotide sequences of VLDLR BINDING SITE, designated SEQ ID:34450, to the nucleotide sequence of VGAM103 RNA, herein designated VGAM RNA, also designated SEQ ID:2814.

Another function of VGAM103 is therefore inhibition of Very Low Density Lipoprotein Receptor (VLDLR, Accession XM_045386), a gene which may play a crucial role in triglyceride metabolism. Accordingly, utilities of VGAM103 include diagnosis, prevention and treatment of diseases and clinical conditions associated with VLDLR. The function of VLDLR has been established by previous studies. A specific isoform of apolipoprotein E (OMIM Ref. No. 107741), encoded by the APOE4 allele, is associated with the accelerated rate of disease expression of sporadic Alzheimer disease (AD) and late-onset familial AD. Okuizumi et al. (1995) noted that, in patients who carry the APOE4 allele, an earlier age of onset has also been demonstrated in patients who also have mutations in the amyloid precursor protein gene (OMIM Ref. No. 104760) involving codon 717 (104760.0002) and codons 670 and 671 (104760.0008). On the other hand, the presence of the APOE4 allele makes no difference in familial AD patients with APP692 (104760.0005) or APP693 mutations, nor does it make a difference in chromosome 14-linked familial AD patients (OMIM Ref. No. 104311). Hypothesizing that receptors for APOE-containing lipoproteins act as a potential risk factor for AD, Okuizumi et al. (1995) performed an association study using a polymorphic triplet (CGG) repeat in the VLDLR gene. The frequency of the 5-repeat allele was significantly higher in all Japanese sporadic AD patients (P less than 0.02) than in Japanese controls. Moreover, the odds ratio was significantly increased in the AD patients homozygous for the 5-repeat allele; OR=2.1, 95% confidence interval=1.1-4.2. Multiple logistic regression analysis showed that the relative risk conferred by the presence of 2 copies of the 5-repeat allele and at least 1 copy of the APOE4 allele is 8.7; 95% CI=2.9-25.8. Okuizumi et al. (1995) concluded that VLDLR is a susceptibility gene for AD. Animal model experiments lend further support to the function of VLDLR. Layering of neurons in the cerebral cortex and cerebellum requires reelin (RELN; 600514), an extracellular matrix protein, and mammalian disabled (DAB1; 603448), a cytosolic protein that activates tyrosine kinases. By targeted disruption experiments in mice, Trommsdorff et al. (1999) showed that 2 cell surface receptors, VLDLR and apolipoprotein E receptor-2 (APOER2; 602600), are also required. Both receptors bound Dab1 on their cytoplasmic tails and were expressed in cortical and cerebellar layers adjacent to layers expressing Reln. Dab1 expression was upregulated in knockout mice lacking both the Vldlr and Apoer2 genes. Inversion of cortical layers, absence of cerebellar foliation, and the migration of Purkinje cells in these animals precisely mimicked the phenotype of mice lacking Reln or Dab1. These findings established novel signaling functions for the LDL receptor gene family and suggested that VLDLR and APOER2 participate in transmitting the extracellular RELN signal to intracellular signaling processes initiated by DAB1.

It is appreciated that the abovementioned animal model for VLDLR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Okuizumi, K.; Onodera, O.; Namba, Y.; Ikeda, K.; Yamamoto, T.; Seki, K.; Ueki, A.; Nanko, S.; Tanaka, H.; Takahashi, H.; Oyanagi, K.; Mizusawa, H.; Kanazawa, I.; Tsuji, S.: Genetic association of the very low density lipoprotein (VLDL) receptor gene with sporadic Alzheimer's disease. Nature Genet. 11:207-209, 1995; and Trommsdorff, M.; Gotthardt, M.; Hiesberger, T.; Shelton, J.; Stockinger, W.; Nimpf, J.; Hammer, R. E.; Richardson, J. A.; Herz, J.: Reeler/Disabled-like disruption of neuronal migration.

Further studies establishing the function and utilities of VLDLR are found in John Hopkins OMIM database record ID 192977, and in sited publications numbered 10022, 10020-10021, 80 and 10023-10024 listed in the bibliography section hereinbelow, which are also hereby incorporated by reference. Adaptor-related Protein Complex 1, Sigma 2 Subunit (AP1S2, Accession NM_003916) is another VGAM103 host target gene. AP1S2 BINDING SITE is HOST TARGET binding site found in the 3' untranslated region of mRNA encoded by AP1S2, corresponding to a HOST TARGET binding site such as BINDING SITE I, BINDING SITE II or BINDING SITE III. Table 2 illustrates the complementarity of the nucleotide sequences of AP1S2 BINDING SITE, designated SEQ ID:10000, to the nucleotide sequence of VGAM103 RNA, herein designated VGAM RNA, also designated SEQ ID:2814.

Another function of VGAM103 is therefore inhibition of Adaptor-related Protein Complex 1, Sigma 2 Subunit (AP1S2, Accession NM_003916). Accordingly, utilities of VGAM103 include diagnosis, prevention and treatment of diseases and clinical conditions associated with AP1S2. BTB (POZ) Domain Containing 3 (BTBD3, Accession NM_014962) is another VGAM103 host target gene. BTBD3 BINDING SITE is HOST TARGET binding site found in the 3' untranslated region of mRNA encoded by BTBD3, corresponding to a HOST TARGET binding site such as BINDING SITE I, BINDING SITE II or BINDING SITE III. Table 2 illustrates the complementarity of the nucleotide sequences of BTBD3 BINDING SITE, designated SEQ ID:17336, to the nucleotide sequence of VGAM103 RNA, herein designated VGAM RNA, also designated SEQ ID:2814.

Another function of VGAM103 is therefore inhibition of BTB (POZ) Domain Containing 3 (BTBD3, Accession NM_014962). Accordingly, utilities of VGAM103 include diagnosis, prevention and treatment of diseases and clinical conditions associated with BTBD3. FLJ10290 (Accession NM_018047) is another VGAM103 host target gene. FLJ10290 BINDING SITE is HOST TARGET binding site found in the 3' untranslated region of mRNA encoded by FLJ10290, corresponding to a HOST TARGET binding site such as BINDING SITE I, BINDING SITE II or BINDING SITE III. Table 2 illustrates the complementarity of the nucleotide sequences of FLJ10290 BINDING SITE, designated SEQ ID:19796, to the nucleotide sequence of VGAM103 RNA, herein designated VGAM RNA, also designated SEQ ID:2814.

Another function of VGAM103 is therefore inhibition of FLJ10290 (Accession NM_018047). Accordingly, utilities of VGAM103 include diagnosis, prevention and treatment of diseases and clinical conditions associated with FLJ10290. FLJ20079 (Accession NM_017656) is another VGAM103 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19178, to the nucleotide sequence of VGAM103 RNA, herein designated VGAM RNA, also designated SEQ ID:2814.

Another function of VGAM103 is therefore inhibition of FLJ20079 (Accession NM_017656). Accordingly, utilities of VGAM103 include diagnosis, prevention and treatment of diseases and clinical conditions associated with FLJ20079. FLJ20695 (Accession NM_017929) is another VGAM103 host target gene. FLJ20695 BINDING SITE is HOST TARGET binding site found in the 3' untranslated region of mRNA encoded by FLJ20695, corresponding to a HOST TARGET binding site such as BINDING SITE I, BINDING SITE II or BINDING SITE III. Table 2 illustrates the complementarity of the nucleotide sequences of FLJ20695 BINDING SITE, designated SEQ ID:19612, to the nucleotide sequence of VGAM103 RNA, herein designated VGAM RNA, also designated SEQ ID:2814.

Another function of VGAM103 is therefore inhibition of FLJ20695 (Accession NM_017929). Accordingly, utilities of VGAM103 include diagnosis, prevention and treatment of diseases and clinical conditions associated with FLJ20695. HOMER-2B (Accession NM_004839) is another VGAM103 host target gene. HOMER-2B BINDING SITE is HOST TARGET binding site found in the 3' untranslated region of mRNA encoded by HOMER-2B, corresponding to a HOST TARGET binding site such as BINDING SITE I, BINDING SITE II or BINDING SITE III. Table 2 illustrates the complementarity of the nucleotide sequences of HOMER-2B BINDING SITE, designated SEQ ID:11246, to the nucleotide sequence of VGAM103 RNA, herein designated VGAM RNA, also designated SEQ ID:2814.

Another function of VGAM103 is therefore inhibition of HOMER-2B (Accession NM_004839). Accordingly, utilities of VGAM103 include diagnosis, prevention and treatment of diseases and clinical conditions associated with HOMER-2B. KIAA1871 (Accession XM_028409) is another VGAM103 host target gene. KIAA1871 BINDING SITE is HOST TARGET binding site found in the 3' untranslated region of mRNA encoded by KIAA1871, corresponding to a HOST TARGET binding site such as BINDING SITE I, BINDING SITE II or BINDING SITE III. Table 2 illustrates the complementarity of the nucleotide sequences of KIAA1871 BINDING SITE, designated SEQ ID:30708, to the nucleotide sequence of VGAM103 RNA, herein designated VGAM RNA, also designated SEQ ID:2814.

Another function of VGAM103 is therefore inhibition of KIAA1871 (Accession XM_028409). Accordingly, utilities of VGAM103 include diagnosis, prevention and treatment of diseases and clinical conditions associated with KIAA1871. Yes-associated Protein 1, 65 kDa (YAP1, Accession NM_006106) is another VGAM103 host target gene. YAP1 BINDING SITE is HOST TARGET binding site found in the 3' untranslated region of mRNA encoded by YAP1, corresponding to a HOST TARGET binding site such as BINDING SITE I, BINDING SITE II or BINDING SITE III. Table 2 illustrates the complementarity of the nucleotide sequences of YAP1 BINDING SITE, designated SEQ ID:12754, to the nucleotide sequence of VGAM103 RNA, herein designated VGAM RNA, also designated SEQ ID:2814.

Another function of VGAM103 is therefore inhibition of Yes-associated Protein 1, 65 kDa (YAP1, Accession NM_006106). Accordingly, utilities of VGAM103 include diagnosis, prevention and treatment of diseases and clinical conditions associated with YAP1. LOC221477 (Accession XM_166397) is another VGAM103 host target gene. LOC221477 BINDING SITE is HOST TARGET binding site found in the 3' untranslated region of mRNA encoded by LOC221477, corresponding to a HOST TARGET binding site such as BINDING SITE I, BINDING SITE II or BINDING SITE III. Table 2 illustrates the complementarity of the nucleotide sequences of LOC221477 BINDING SITE, designated SEQ ID:44251, to the nucleotide sequence of VGAM103 RNA, herein designated VGAM RNA, also designated SEQ ID:2814.

Another function of VGAM103 is therefore inhibition of LOC221477 (Accession XM_166397). Accordingly, utilities of VGAM103 include diagnosis, prevention and treatment of diseases and clinical conditions associated with LOC221477. FIG. 1 further provides a conceptual description of a novel bioinformatically detected viral gene of the present invention, referred to here as Viral Genomic Address Messenger 104 (VGAM104) viral gene, which modulates expression of respective host target genes thereof, the function and utility of which host target genes is known in the art.

VGAM104 is a novel bioinformatically detected regulatory, non protein coding, viral micro RNA (miRNA) gene. The method by which VGAM104 was detected is described hereinabove with reference to FIGS. 1-8.

VGAM104 gene, herein designated VGAM GENE, is a viral gene contained in the genome of Plutella Xylostella Granulovirus. VGAM104 host target gene, herein designated VGAM HOST TARGET GENE, is a human gene contained in the human genome.

VGAM104 gene encodes a VGAM104 precursor RNA, herein designated VGAM PRECURSOR RNA. Similar to other miRNA genes, and unlike most ordinary genes, VGAM104 precursor RNA does not encode a protein. A nucleotide sequence identical or highly similar to the nucleotide sequence of VGAM104 precursor RNA is designated SEQ ID:90, and is provided hereinbelow with reference to the sequence listing part. Nucleotide sequence SEQ ID:90 is located at position 67576 relative to the genome of Plutella Xylostella Granulovirus.

VGAM104 precursor RNA folds onto itself, forming VGAM104 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM104 folded precursor RNA into VGAM104 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM104 RNA is designated SEQ ID:2815, and is provided hereinbelow with reference to the sequence listing part.

VGAM104 host target gene, herein designated VGAM HOST TARGET GENE, encodes a corresponding messenger RNA, VGAM104 host target RNA, herein designated VGAM HOST TARGET RNA. VGAM104 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM104 RNA, herein designated VGAM RNA, binds complementarily to one or more host target binding sites located in untranslated regions of VGAM104 host target RNA, herein designated VGAM HOST TARGET RNA. This complementary binding is due to the fact that the nucleotide sequence of VGAM104 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM104 RNA, herein designated VGAM RNA, may have a different number of host target binding sites in untranslated regions of a VGAM104 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM104 RNA, herein designated VGAM RNA, to host target binding sites on VGAM104 host target RNA, herein designated VGAM HOST TARGET RNA, such as BINDING SITE I, BINDING SITE II and BINDING SITE III, inhibits translation of VGAM104 host target RNA into VGAM104 host target protein, herein designated VGAM HOST TARGET PROTEIN. VGAM host target protein is therefore outlined by a broken line.

It is appreciated that VGAM104 host target gene, herein designated VGAM HOST TARGET GENE, in fact represents a plurality of VGAM104 host target genes. The mRNA of each one of this plurality of VGAM104 host target genes comprises one or more host target binding sites, each having a nucleotide sequence which is at least partly complementary to VGAM104 RNA, herein designated VGAM RNA, and which when bound by VGAM104 RNA causes inhibition of translation of respective one or more VGAM104 host target proteins.

It is further appreciated by one skilled in the art that the mode of translational inhibition illustrated by FIG. 1 with specific reference to translational inhibition exerted by VGAM104 gene, herein designated VGAM GENE, on one or more VGAM104 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM104 is inhibition of expression of host target genes, as part of a novel viral mechanism of attacking a host. Accordingly, utilities of VGAM104 include diagnosis, prevention and treatment of viral infection by Plutella Xylostella Granulovirus. Specific functions, and accordingly utilities, of VGAM104 correlate with, and may be deduced from, the identity of the host target genes which VGAM104 binds and inhibits, and the function of these host target genes, as elaborated hereinbelow.

Nucleotide sequences of the VGAM104 precursor RNA, herein designated VGAM PRECURSOR RNA, and of the 'diced' VGAM104 RNA, herein designated VGAM RNA, and a schematic representation of the secondary folding of VGAM104 folded precursor RNA, herein designated VGAM FOLDED PRECURSOR RNA, of VGAM104 are further described hereinbelow with reference to Table 1.

Nucleotide sequences of host target binding sites, such as BINDING SITE-I, BINDING SITE-II and BINDING SITE-III of FIG. 1, found on VGAM104 host target RNA, and schematic representation of the complementarity of each of these host target binding sites to VGAM104 RNA, herein designated VGAM RNA, are described hereinbelow with reference to Table 2.

As mentioned hereinabove with reference to FIG. 1, a function of VGAM104 gene, herein designated VGAM is inhibition of expression of VGAM104 target genes. It is appreciated that specific functions, and accordingly utilities, of VGAM104 correlate with, and may be deduced from, the identity of the target genes which VGAM104 binds and inhibits, and the function of these target genes, as elaborated hereinbelow.

Chromosome 11 Open Reading Frame 25 (C11orf25, Accession NM_031418) is a VGAM104 host target gene. C11orf25 BINDING SITE is HOST TARGET binding site found in the 5' untranslated region of mRNA encoded by C11orf25, corresponding to a HOST TARGET binding site such as BINDING SITE I, BINDING SITE II or BINDING SITE III. Table 2 illustrates the complementarity of the nucleotide sequences of C11orf25 BINDING SITE, designated SEQ ID:25397, to the nucleotide sequence of VGAM104 RNA, herein designated VGAM RNA, also designated SEQ ID:2815.

A function of VGAM104 is therefore inhibition of Chromosome 11 Open Reading Frame 25 (C11orf25, Accession NM_031418). Accordingly, utilities of VGAM104 include diagnosis, prevention and treatment of diseases and clinical conditions associated with C11orf25. LOC150142 (Accession XM_086791) is another VGAM104 host target gene. LOC150142 BINDING SITE is HOST TARGET binding site found in the 5' untranslated region of mRNA encoded by LOC150142, corresponding to a HOST TARGET binding site such as BINDING SITE I, BINDING SITE II or BINDING SITE III. Table 2 illustrates the complementarity of the nucleotide sequences of LOC150142 BINDING SITE, designated SEQ ID:38847, to the nucleotide sequence of VGAM104 RNA, herein designated VGAM RNA, also designated SEQ ID:2815.

Another function of VGAM104 is therefore inhibition of LOC150142 (Accession XM_086791). Accordingly, utilities of VGAM104 include diagnosis, prevention and treatment of diseases and clinical conditions associated with LOC150142. LOC200982 (Accession XM_117305) is another VGAM104 host target gene. LOC200982 BINDING SITE is HOST TARGET binding site found in the 3' untranslated region of mRNA encoded by LOC200982, corresponding to a HOST TARGET binding site such as BINDING SITE I, BINDING SITE II or BINDING SITE III. Table 2 illustrates the complementarity of the nucleotide sequences of LOC200982 BINDING SITE, designated SEQ ID:43371, to the nucleotide sequence of VGAM104 RNA, herein designated VGAM RNA, also designated SEQ ID:2815.

Another function of VGAM104 is therefore inhibition of LOC200982 (Accession XM_117305). Accordingly, utilities of VGAM104 include diagnosis, prevention and treatment of diseases and clinical conditions associated with LOC200982. FIG. 1 further provides a conceptual description of a novel bioinformatically detected viral gene of the present invention, referred to here as Viral Genomic Address Messenger 105 (VGAM105) viral gene, which modulates expression of respective host target genes thereof, the function and utility of which host target genes is known in the art.

VGAM105 is a novel bioinformatically detected regulatory, non protein coding, viral micro RNA (miRNA) gene. The method by which VGAM105 was detected is described hereinabove with reference to FIGS. 1-8.

VGAM105 gene, herein designated VGAM GENE, is a viral gene contained in the genome of Plutella Xylostella Granulovirus. VGAM105 host target gene, herein designated VGAM HOST TARGET GENE, is a human gene contained in the human genome.

VGAM105 gene encodes a VGAM105 precursor RNA, herein designated VGAM PRECURSOR RNA. Similar to other miRNA genes, and unlike most ordinary genes, VGAM105 precursor RNA does not encode a protein. A nucleotide sequence identical or highly similar to the nucleotide sequence of VGAM105 precursor RNA is designated SEQ ID:91, and is provided hereinbelow with reference to the sequence listing part. Nucleotide sequence SEQ ID:91 is located at position 89565 relative to the genome of Plutella Xylostella Granulovirus.

VGAM105 precursor RNA folds onto itself, forming VGAM105 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM105 folded precursor RNA into VGAM105 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM105 RNA is designated SEQ ID:2816, and is provided hereinbelow with reference to the sequence listing part.

VGAM105 host target gene, herein designated VGAM HOST TARGET GENE, encodes a corresponding messenger RNA, VGAM105 host target RNA, herein designated VGAM HOST TARGET RNA. VGAM105 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM105 RNA, herein designated VGAM RNA, binds complementarily to one or more host target binding sites located in untranslated regions of VGAM105 host target RNA, herein designated VGAM HOST TARGET RNA. This complementary binding is due to the fact that the nucleotide sequence of VGAM105 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM105 RNA, herein designated VGAM RNA, may have a different number of host target binding sites in untranslated regions of a VGAM105 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM105 RNA, herein designated VGAM RNA, to host target binding sites on VGAM105 host target RNA, herein designated VGAM HOST TARGET RNA, such as BINDING SITE I, BINDING SITE II and BINDING SITE III, inhibits translation of VGAM105 host target RNA into VGAM105 host target protein, herein designated VGAM HOST TARGET PROTEIN. VGAM host target protein is therefore outlined by a broken line.

It is appreciated that VGAM105 host target gene, herein designated VGAM HOST TARGET GENE, in fact represents a plurality of VGAM105 host target genes. The mRNA of each one of this plurality of VGAM105 host target genes comprises one or more host target binding sites, each having a nucleotide sequence which is at least partly complementary to VGAM105 RNA, herein designated VGAM RNA, and which when bound by VGAM105 RNA causes inhibition of translation of respective one or more VGAM105 host target proteins.

It is further appreciated by one skilled in the art that the mode of translational inhibition illustrated by FIG. 1 with specific reference to translational inhibition exerted by VGAM105 gene, herein designated VGAM GENE, on one or more VGAM105 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM105 is inhibition of expression of host target genes, as part of a novel viral mechanism of attacking a host. Accordingly, utilities of VGAM105 include diagnosis, prevention and treatment of viral infection by Plutella Xylostella Granulovirus. Specific functions, and accordingly utilities, of VGAM105 correlate with, and may be deduced from, the identity of the host target genes which VGAM105 binds and inhibits, and the function of these host target genes, as elaborated hereinbelow.

Nucleotide sequences of the VGAM105 precursor RNA, herein designated VGAM PRECURSOR RNA, and of the 'diced' VGAM105 RNA, herein designated VGAM RNA, and a schematic representation of the secondary folding of VGAM105 folded precursor RNA, herein designated VGAM FOLDED PRECURSOR RNA, of VGAM105 are further described hereinbelow with reference to Table 1.

Nucleotide sequences of host target binding sites, such as BINDING SITE-I, BINDING SITE-II and BINDING SITE-III of FIG. 1, found on VGAM105 host target RNA, and schematic representation of the complementarity of each of these host target binding sites to VGAM105 RNA, herein designated VGAM RNA, are described hereinbelow with reference to Table 2.

As mentioned hereinabove with reference to FIG. 1, a function of VGAM105 gene, herein designated VGAM is inhibition of expression of VGAM105 target genes. It is appreciated that specific functions, and accordingly utilities, of VGAM105 correlate with, and may be deduced from, the identity of the target genes which VGAM105 binds and inhibits, and the function of these target genes, as elaborated hereinbelow.

FLJ10292 (Accession NM_018048) is a VGAM105 host target gene. FLJ10292 BINDING SITE is HOST TARGET binding site found in the 3' untranslated region of mRNA encoded by FLJ10292, corresponding to a HOST TARGET binding site such as BINDING SITE I, BINDING SITE II or BINDING SITE III. Table 2 illustrates the complementarity of the nucleotide sequences of FLJ10292 BINDING SITE, designated SEQ ID:19801, to the nucleotide sequence of VGAM105 RNA, herein designated VGAM RNA, also designated SEQ ID:2816.

A function of VGAM105 is therefore inhibition of FLJ10292 (Accession NM_018048). Accordingly, utilities of VGAM105 include diagnosis, prevention and treatment of diseases and clinical conditions associated with FLJ10292.

FIG. 1 further provides a conceptual description of a novel bioinformatically detected viral gene of the present invention, referred to here as Viral Genomic Address Messenger 106 (VGAM106) viral gene, which modulates expression of respective host target genes thereof, the function and utility of which host target genes is known in the art.

VGAM106 is a novel bioinformatically detected regulatory, non protein coding, viral micro RNA (miRNA) gene. The method by which VGAM106 was detected is described hereinabove with reference to FIGS. 1-8.

VGAM106 gene, herein designated VGAM GENE, is a viral gene contained in the genome of Saimiriine Herpesvirus 2. VGAM106 host target gene, herein designated VGAM HOST TARGET GENE, is a human gene contained in the human genome.

VGAM106 gene encodes a VGAM106 precursor RNA, herein designated VGAM PRECURSOR RNA. Similar to other miRNA genes, and unlike most ordinary genes, VGAM106 precursor RNA does not encode a protein. A nucleotide sequence identical or highly similar to the nucleotide sequence of VGAM106 precursor RNA is designated SEQ ID:92, and is provided hereinbelow with reference to the sequence listing part. Nucleotide sequence SEQ ID:92 is located at position 49997 relative to the genome of Saimiriine Herpesvirus 2.

VGAM106 precursor RNA folds onto itself, forming VGAM106 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM106 folded precursor RNA into VGAM106 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM106 RNA is designated SEQ ID:2817, and is provided hereinbelow with reference to the sequence listing part.

VGAM106 host target gene, herein designated VGAM HOST TARGET GENE, encodes a corresponding messenger RNA, VGAM106 host target RNA, herein designated VGAM HOST TARGET RNA. VGAM106 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM106 RNA, herein designated VGAM RNA, binds complementarily to one or more host target binding sites located in untranslated regions of VGAM106 host target RNA, herein designated VGAM HOST TARGET RNA. This complementary binding is due to the fact that the nucleotide sequence of VGAM106 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM106 RNA, herein designated VGAM RNA, may have a different number of host target binding sites in untranslated regions of a VGAM106 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM106 RNA, herein designated VGAM RNA, to host target binding sites on VGAM106 host target RNA, herein designated VGAM HOST TARGET RNA, such as BINDING SITE I, BINDING SITE II and BINDING SITE III, inhibits translation of VGAM106 host target RNA into VGAM106 host target protein, herein designated VGAM HOST TARGET PROTEIN. VGAM host target protein is therefore outlined by a broken line.

It is appreciated that VGAM106 host target gene, herein designated VGAM HOST TARGET GENE, in fact represents a plurality of VGAM106 host target genes. The mRNA of each one of this plurality of VGAM106 host target genes comprises one or more host target binding sites, each having a nucleotide sequence which is at least partly complementary to VGAM106 RNA, herein designated VGAM RNA, and which when bound by VGAM106 RNA causes inhibition of translation of respective one or more VGAM106 host target proteins.

It is further appreciated by one skilled in the art that the mode of translational inhibition illustrated by FIG. 1 with specific reference to translational inhibition exerted by VGAM106 gene, herein designated VGAM GENE, on one or more VGAM106 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM106 is inhibition of expression of host target genes, as part of a novel viral mechanism of attacking a host. Accordingly, utilities of VGAM106 include diagnosis, prevention and treatment of viral infection by Saimiriine Herpesvirus 2. Specific functions, and accordingly utilities, of VGAM106 correlate with, and may be deduced from, the identity of the host target genes which VGAM106 binds and inhibits, and the function of these host target genes, as elaborated hereinbelow.

Nucleotide sequences of the VGAM106 precursor RNA, herein designated VGAM PRECURSOR RNA, and of the 'diced' VGAM106 RNA, herein designated VGAM RNA, and a schematic representation of the secondary folding of VGAM106 folded precursor RNA, herein designated VGAM FOLDED PRECURSOR RNA, of VGAM106 are further described hereinbelow with reference to Table 1.

Nucleotide sequences of host target binding sites, such as BINDING SITE-I, BINDING SITE-II and BINDING SITE-III of FIG. 1, found on VGAM106 host target RNA, and schematic representation of the complementarity of each of these host target binding sites to VGAM106 RNA, herein designated VGAM RNA, are described hereinbelow with reference to Table 2.

As mentioned hereinabove with reference to FIG. 1, a function of VGAM106 gene, herein designated VGAM is inhibition of expression of VGAM106 target genes. It is appreciated that specific functions, and accordingly utilities, of VGAM106 correlate with, and may be deduced from, the identity of the target genes which VGAM106 binds and inhibits, and the function of these target genes, as elaborated hereinbelow.

Inositol 1,4,5-triphosphate Receptor, Type 1 (ITPR1, Accession NM_002222) is a VGAM106 host target gene. ITPR1 BINDING SITE is HOST TARGET binding site found in the 3' untranslated region of mRNA encoded by ITPR1, corresponding to a HOST TARGET binding site such as BINDING SITE I, BINDING SITE II or BINDING SITE III. Table 2 illustrates the complementarity of the nucleotide sequences of ITPR1 BINDING SITE, designated SEQ ID:7986, to the nucleotide sequence of VGAM106 RNA, herein designated VGAM RNA, also designated SEQ ID:2817.

A function of VGAM106 is therefore inhibition of Inositol 1,4,5-triphosphate Receptor, Type 1 (ITPR1, Accession NM_002222), a gene which couples cell membrane receptors to Ca2+ signal transduction pathways. Accordingly, utilities of VGAM106 include diagnosis, prevention and treatment of diseases and clinical conditions associated with ITPR1. The function of ITPR1 has been established by previous studies. Inositol 1,4,5-triphosphate is an intracellular second messenger produced by phospholipase C through a G protein-dependent mechanism. It releases calcium from endoplasmic reticulum by binding to specific receptors that are coupled to calcium channels. These receptors are abundant in neuronal and nonneuronal tissues. The neuronal form of the receptor is abundant in the cerebellum, particularly the perikaryon of the Purkinje cells. Matsumoto et al. (1996) noted that the product of the ITPR1 gene is predominantly enriched in cerebellar Purkinje cells but is also concentrated in neurons in the hippocampal CA1 region, caudate-putamen, and cerebral cortex. The inositol triphosphate receptor shares sequence and functional homology with the ryanodine receptor (OMIM Ref. No. 180901); they both trigger the release of calcium from intracellular stores. The primary structure of the inositol triphosphate receptor contains 3 domains: an inositol triphosphate binding domain near the N terminus, a coupling domain in the middle of the molecule, and a transmembrane spanning domain near the C terminus. In addition, there are at least 2 consensus protein kinase A phosphorylation sites and at least 1 consensus ATP-binding site (Nucifora et al., 1995). Matsumoto et al. (1996) found that most ITPR1-deficient mice generated by gene targeting die in utero, and that most animals that are born alive have severe ataxia and tonic or tonic-clonic seizures and die by the weaning period. Electroencephalograms showed that they suffer from epilepsy, indicating that ITPR1 is essential for proper brain function. However, observation by light microscope of the hematoxylin-eosin staining of the brain and peripheral tissues of deficient mice showed no abnormality and the unique electrophysiologic properties of the cerebellar Purkinje cells of deficient mice were not severely impaired. In the mouse the Intp3r locus is closely situated to the ‘opisthotonus’ mutant locus (opt), and Opt homozygous mutant mice exhibit phenotypes similar to those described for the knockout mice. The opt locus is on mouse chromosome 6

Full details of the abovementioned studies are described in the following publications, the disclosure of which are hereby incorporated by reference:

Matsumoto, M.; Nakagawa, T.; Inoue, T.; Nagata, E.; Tanaka, K.; Takano, H.; Minowa, O.; Kuno, J.; Sakakibara, S.; Yamada, M.; Yoneshima, H.; Miyawaki, A; Fukuichi, T.; Furuichi, T.; Okano, H.; Mikoshiba, K.; Noda, T.: Ataxia and epileptic seizures in mice lacking type 1 inositol 1,4,5-triphosphate receptor. Nature 379:168-171, 1996; and Nucifora, F. C., Jr.; Li, S.-H.; Danoff, S.; Ullrich, A.; Ross, C. A.: Molecular cloning of a cDNA for the human inositol 1,4,5-trisphosphate receptor type 1, and the identification of.

Further studies establishing the function and utilities of ITPR1 are found in John Hopkins OMIM database record ID 147265, and in sited publications numbered 4976-4977, 481 and 4820 listed in the bibliography section hereinbelow, which are also hereby incorporated by reference. Matrix Metalloproteinase 19 (MMP19, Accession NM_002429) is another VGAM106 host target gene. MMP19 BINDING SITE1 and MMP19 BINDING SITE2 are HOST TARGET binding sites found in untranslated regions of mRNA encoded by MMP19, corresponding to HOST TARGET binding sites such as BINDING SITE I, BINDING SITE II or BINDING SITE III. Table 2 illustrates the complementarity of the nucleotide sequences of MMP19 BINDING SITE1 and MMP19 BINDING SITE2, designated SEQ ID:8267 and SEQ ID:23074 respectively, to the nucleotide sequence of VGAM106 RNA, herein designated VGAM RNA, also designated SEQ ID:2817.

Another function of VGAM106 is therefore inhibition of Matrix Metalloproteinase 19 (MMP19, Accession NM_002429). Accordingly, utilities of VGAM106 include diagnosis, prevention and treatment of diseases and clinical conditions associated with MMP19. Chromosome 9 Open Reading Frame 5 (C9orf5, Accession NM_032012) is another VGAM106 host target gene. C9orf5 BINDING SITE is HOST TARGET binding site found in the 3' untranslated region of mRNA encoded by C9orf5, corresponding to a HOST TARGET binding site such as BINDING SITE I, BINDING SITE II or BINDING SITE III. Table 2 illustrates the complementarity of the nucleotide sequences of C9orf5 BINDING SITE, designated SEQ ID:25717, to the nucleotide sequence of VGAM106 RNA, herein designated VGAM RNA, also designated SEQ ID:2817.

Another function of VGAM106 is therefore inhibition of Chromosome 9 Open Reading Frame 5 (C9orf5, Accession NM_032012). Accordingly, utilities of VGAM106 include diagnosis, prevention and treatment of diseases and clinical conditions associated with C9orf5. Di-Ras2 (Accession NM_017594) is another VGAM106 host target gene. Di-Ras2 BINDING SITE is HOST TARGET binding site found in the 3' untranslated region of mRNA encoded by Di-Ras2, corresponding to a HOST TARGET binding site such as BINDING SITE I, BINDING SITE II or BINDING SITE III. Table 2 illustrates the complementarity of the nucleotide sequences of Di-Ras2 BINDING SITE, designated SEQ ID:19042, to the nucleotide sequence of VGAM106 RNA, herein designated VGAM RNA, also designated SEQ ID:2817.

Another function of VGAM106 is therefore inhibition of Di-Ras2 (Accession NM_017594). Accordingly, utilities of VGAM106 include diagnosis, prevention and treatment of diseases and clinical conditions associated with Di-Ras2. DKFZP434P211 (Accession NM_014549) is another VGAM106 host target gene. DKFZP434P211 BINDING SITE is HOST TARGET binding site found in the 3' untranslated region of mRNA encoded by DKFZP434P211, corresponding to a HOST TARGET binding site such as BINDING SITE I, BINDING SITE II or BINDING SITE III. Table 2 illustrates the complementarity of the nucleotide sequences of DKFZP434P211 BINDING SITE, designated SEQ ID:15865, to the nucleotide sequence of VGAM106 RNA, herein designated VGAM RNA, also designated SEQ ID:2817.

Another function of VGAM106 is therefore inhibition of DKFZP434P211 (Accession NM_014549). Accordingly, utilities of VGAM106 include diagnosis, prevention and treatment of diseases and clinical conditions associated with DKFZP434P211. FLJ23017 (Accession NM_022840) is another VGAM106 host target gene. FLJ23017 BINDING SITE is HOST TARGET binding site found in the 3' untranslated region of mRNA encoded by FLJ23017, corresponding to a HOST TARGET binding site such as BINDING SITE I, BINDING SITE II or BINDING SITE III. Table 2 illustrates the complementarity of the nucleotide sequences of FLJ23017 BINDING SITE, designated SEQ ID:23128, to the nucleotide sequence of VGAM106 RNA, herein designated VGAM RNA, also designated SEQ ID:2817.

Another function of VGAM106 is therefore inhibition of FLJ23017 (Accession NM_022840). Accordingly, utilities of VGAM106 include diagnosis, prevention and treatment of diseases and clinical conditions associated with FLJ23017. KIAA0523 (Accession XM_041964) is another VGAM106 host target gene. KIAA0523 BINDING SITE is HOST TARGET binding site found in the 3' untranslated region of mRNA encoded by KIAA0523, corresponding to a HOST TARGET binding site such as BINDING SITE I, BINDING SITE II or BINDING SITE III. Table 2 illustrates the complementarity of the nucleotide sequences of KIAA0523 BINDING SITE, designated SEQ ID:33644, to the nucleotide sequence of VGAM106 RNA, herein designated VGAM RNA, also designated SEQ ID:2817.

Another function of VGAM106 is therefore inhibition of KIAA0523 (Accession XM_041964). Accordingly, utilities of VGAM106 include diagnosis, prevention and treatment of diseases and clinical conditions associated with KIAA0523. KIAA1046 (Accession NM_014928) is another VGAM106 host target gene. KIAA1046 BINDING SITE is HOST TARGET binding site found in the 3' untranslated region of mRNA encoded by KIAA1046, corresponding to a HOST TARGET binding site such as BINDING SITE I, BINDING SITE II or BINDING SITE III. Table 2 illustrates the complementarity of the nucleotide sequences of KIAA1046 BINDING SITE, designated SEQ ID:17221, to the nucleotide sequence of VGAM106 RNA, herein designated VGAM RNA, also designated SEQ ID:2817.

Another function of VGAM106 is therefore inhibition of KIAA1046 (Accession NM_014928). Accordingly, utilities of VGAM106 include diagnosis, prevention and treatment of diseases and clinical conditions associated with KIAA1046. Protein Phosphatase 1, Regulatory Subunit 10 (PPP1R10, Accession NM_002714) is another VGAM106 host target gene. PPP1R10 BINDING SITE is HOST TARGET binding site found in the 3' untranslated region of mRNA encoded by PPP1R10, corresponding to a HOST TARGET binding site such as BINDING SITE I, BINDING SITE II or BINDING SITE III. Table 2 illustrates the complementarity of the nucleotide sequences of PPP1R10 BINDING SITE, designated SEQ ID:8578, to the nucleotide sequence of VGAM106 RNA, herein designated VGAM RNA, also designated SEQ ID:2817.

Another function of VGAM106 is therefore inhibition of Protein Phosphatase 1, Regulatory Subunit 10 (PPP1R10, Accession NM_002714). Accordingly, utilities of VGAM106 include diagnosis, prevention and treatment of diseases and clinical conditions associated with PPP1R10. SEC15B (Accession XM_039570) is another VGAM106 host target gene. SEC15B BINDING SITE is HOST TARGET binding site found in the 3" untranslated region of mRNA encoded by SEC15B, corresponding to a HOST TARGET binding site such as BINDING SITE I, BINDING SITE II or BINDING SITE III. Table 2 illustrates the complementarity of the nucleotide sequences of SEC15B BINDING SITE, designated SEQ ID:33126, to the nucleotide sequence of VGAM106 RNA, herein designated VGAM RNA, also designated SEQ ID:2817.

Another function of VGAM106 is therefore inhibition of SEC15B (Accession XM_039570). Accordingly, utilities of VGAM106 include diagnosis, prevention and treatment of diseases and clinical conditions associated with SEC15B. Translocase of Inner Mitochondrial Membrane 9 Homolog (yeast) (TIMM9, Accession NM_012460) is another VGAM106 host target gene. TIMM9 BINDING SITE is HOST TARGET binding site found in the 5' untranslated region of mRNA encoded by TIMM9, corresponding to a HOST TARGET binding site such as BINDING SITE I, BINDING SITE II or BINDING SITE III. Table 2 illustrates the complementarity of the nucleotide sequences of TIMM9 BINDING SITE, designated SEQ ID:14831, to the nucleotide sequence of VGAM106 RNA, herein designated VGAM RNA, also designated SEQ ID:2817.

Another function of VGAM106 is therefore inhibition of Translocase of Inner Mitochondrial Membrane 9 Homolog (yeast) (TIMM9, Accession NM_012460). Accordingly, utilities of VGAM106 include diagnosis, prevention and treatment of diseases and clinical conditions associated with TIMM9. LOC150174 (Accession XM_086802) is another VGAM106 host target gene. LOC150174 BINDING SITE is HOST TARGET binding site found in the 3' untranslated region of mRNA encoded by LOC150174, corresponding to a HOST TARGET binding site such as BINDING SITE I, BINDING SITE II or BINDING SITE III. Table 2 illustrates the complementarity of the nucleotide sequences of LOC150174 BINDING SITE, designated SEQ ID:38872, to the nucleotide sequence of VGAM106 RNA, herein designated VGAM RNA, also designated SEQ ID:2817.

Another function of VGAM106 is therefore inhibition of LOC150174 (Accession XM_086802). Accordingly, utilities of VGAM106 include diagnosis, prevention and treatment of diseases and clinical conditions associated with LOC150174. LOC150213 (Accession XM_059324) is another VGAM106 host target gene. LOC150213 BINDING SITE is HOST TARGET binding site found in the 3' untranslated region of mRNA encoded by LOC150213, corresponding to a HOST TARGET binding site such as BINDING SITE I, BINDING SITE II or BINDING SITE III. Table 2 illustrates the complementarity of the nucleotide sequences of LOC150213 BINDING SITE, designated SEQ ID:36956, to the nucleotide sequence of VGAM106 RNA, herein designated VGAM RNA, also designated SEQ ID:2817.

Another function of VGAM106 is therefore inhibition of LOC150213 (Accession XM_059324). Accordingly, utilities of VGAM106 include diagnosis, prevention and treatment of diseases and clinical conditions associated with LOC150213. LOC152313 (Accession XM_098190) is another VGAM106 host target gene. LOC152313 BINDING SITE is HOST TARGET binding site found in the 5' untranslated region of mRNA encoded by LOC152313, corresponding to a HOST TARGET binding site such as BINDING SITE I, BINDING SITE II or BINDING SITE III. Table 2 illustrates the complementarity of the nucleotide sequences of LOC152313 BINDING SITE, designated SEQ ID:41472, to the nucleotide sequence of VGAM106 RNA, herein designated VGAM RNA, also designated SEQ ID:2817.

Another function of VGAM106 is therefore inhibition of LOC152313 (Accession XM_098190). Accordingly, utilities of VGAM106 include diagnosis, prevention and treatment of diseases and clinical conditions associated with LOC152313. LOC201965 (Accession XM_114412) is another VGAM106 host target gene. LOC201965 BINDING SITE is HOST TARGET binding site found in the 3' untranslated region of mRNA encoded by LOC201965, corresponding to a HOST TARGET binding site such as BINDING SITE I, BINDING SITE II or BINDING SITE III. Table 2 illustrates the complementarity of the nucleotide sequences of LOC201965 BINDING SITE, designated SEQ ID:42934, to the nucleotide sequence of VGAM106 RNA, herein designated VGAM RNA, also designated SEQ ID:2817.

Another function of VGAM106 is therefore inhibition of LOC201965 (Accession XM_114412). Accordingly, utilities of VGAM106 include diagnosis, prevention and treatment of diseases and clinical conditions associated with LOC201965. FIG. 1 further provides a conceptual description of a novel bioinformatically detected viral gene of the present invention, referred to here as Viral Genomic Address Messenger 107 (VGAM107) viral gene, which modulates expression of respective host target genes thereof, the function and utility of which host target genes is known in the art.

VGAM107 is a novel bioinformatically detected regulatory, non protein coding, viral micro RNA (miRNA) gene.

The method by which VGAM107 was detected is described hereinabove with reference to FIGS. 1-8.

VGAM107 gene, herein designated VGAM GENE, is a viral gene contained in the genome of Saimiriine Herpesvirus 2. VGAM107 host target gene, herein designated VGAM HOST TARGET GENE, is a human gene contained in the human genome.

VGAM107 gene encodes a VGAM107 precursor RNA, herein designated VGAM PRECURSOR RNA. Similar to other miRNA genes, and unlike most ordinary genes, VGAM107 precursor RNA does not encode a protein. A nucleotide sequence identical or highly similar to the nucleotide sequence of VGAM107 precursor RNA is designated SEQ ID:93, and is provided hereinbelow with reference to the sequence listing part. Nucleotide sequence SEQ ID:93 is located at position 50521 relative to the genome of Saimiriine Herpesvirus 2.

VGAM107 precursor RNA folds onto itself, forming VGAM107 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM107 folded precursor RNA into VGAM107 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM107 RNA is designated SEQ ID:2818, and is provided hereinbelow with reference to the sequence listing part.

VGAM107 host target gene, herein designated VGAM HOST TARGET GENE, encodes a corresponding messenger RNA, VGAM107 host target RNA, herein designated VGAM HOST TARGET RNA. VGAM107 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM107 RNA, herein designated VGAM RNA, binds complementarily to one or more host target binding sites located in untranslated regions of VGAM107 host target RNA, herein designated VGAM HOST TARGET RNA. This complementary binding is due to the fact that the nucleotide sequence of VGAM107 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM107 RNA, herein designated VGAM RNA, may have a different number of host target binding sites in untranslated regions of a VGAM107 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM107 RNA, herein designated VGAM RNA, to host target binding sites on VGAM107 host target RNA, herein designated VGAM HOST TARGET RNA, such as BINDING SITE I, BINDING SITE II and BINDING SITE III, inhibits translation of VGAM107 host target RNA into VGAM107 host target protein, herein designated VGAM HOST TARGET PROTEIN. VGAM host target protein is therefore outlined by a broken line.

It is appreciated that VGAM107 host target gene, herein designated VGAM HOST TARGET GENE, in fact represents a plurality of VGAM107 host target genes. The mRNA of each one of this plurality of VGAM107 host target genes comprises one or more host target binding sites, each having a nucleotide sequence which is at least partly complementary to VGAM107 RNA, herein designated VGAM RNA, and which when bound by VGAM107 RNA causes inhibition of translation of respective one or more VGAM107 host target proteins.

It is further appreciated by one skilled in the art that the mode of translational inhibition illustrated by FIG. 1 with specific reference to translational inhibition exerted by VGAM107 gene, herein designated VGAM GENE, on one or more VGAM107 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM107 is inhibition of expression of host target genes, as part of a novel viral mechanism of attacking a host. Accordingly, utilities of VGAM107 include diagnosis, prevention and treatment of viral infection by Saimiriine Herpesvirus 2. Specific functions, and accordingly utilities, of VGAM107 correlate with, and may be deduced from, the identity of the host target genes which VGAM107 binds and inhibits, and the function of these host target genes, as elaborated hereinbelow.

Nucleotide sequences of the VGAM107 precursor RNA, herein designated VGAM PRECURSOR RNA, and of the 'diced' VGAM107 RNA, herein designated VGAM RNA, and a schematic representation of the secondary folding of VGAM107 folded precursor RNA, herein designated VGAM FOLDED PRECURSOR RNA, of VGAM107 are further described hereinbelow with reference to Table 1.

Nucleotide sequences of host target binding sites, such as BINDING SITE-I, BINDING SITE-II and BINDING SITE-III of FIG. 1, found on VGAM107 host target RNA, and schematic representation of the complementarity of each of these host target binding sites to VGAM107 RNA, herein designated VGAM RNA, are described hereinbelow with reference to Table 2.

As mentioned hereinabove with reference to FIG. 1, a function of VGAM107 gene, herein designated VGAM is inhibition of expression of VGAM107 target genes. It is appreciated that specific functions, and accordingly utilities, of VGAM107 correlate with, and may be deduced from, the identity of the target genes which VGAM107 binds and inhibits, and the function of these target genes, as elaborated hereinbelow.

Epithelial Membrane Protein 1 (EMP1, Accession NM_001423) is a VGAM107 host target gene. EMP1 BINDING SITE is HOST TARGET binding site found in the 3' untranslated region of mRNA encoded by EMP1, corresponding to a HOST TARGET binding site such as BINDING SITE I, BINDING SITE II or BINDING SITE III. Table 2 illustrates the complementarity of the nucleotide sequences of EMP1 BINDING SITE, designated SEQ ID:7134, to the nucleotide sequence of VGAM107 RNA, herein designated VGAM RNA, also designated SEQ ID:2818.

A function of VGAM107 is therefore inhibition of Epithelial Membrane Protein 1 (EMP1, Accession NM_001423), a gene which plays a role in squamous cell differentiation; member of the PMP22/EMP/MP20 family of membrane glycoproteins. Accordingly, utilities of VGAM107 include diagnosis, prevention and treatment of diseases and clinical conditions associated with EMP1. The function of EMP1 has been established by previous studies. Ben-Porath and Benvenisty (1996) cloned a cDNA encoding epithelial membrane protein-1 (EMP1), named TMP by them, using RT-PCR on human embryo kidney RNA. Ruegg et al. (1996) independently isolated a cDNA encoding EMP1, termed B4B by them, using differential display PCR. The predicted 157-amino acid EMP1 protein contains 4 transmembrane domains and 2 potential N-linked glycosylation sites in the first extracellular loop. Chen et al. (1997) found that EMP1, named CL-20 by them, shares 39% amino acid identity with peripheral myelin protein-22 (PMP22; 601097); the conserved amino acids are located predominantly within the membrane-spanning domains. Due to the high amino acid sequence homology among PMP22, EMP1, EMP2 (OMIM Ref. No. 602334), and EMP3 (OMIM Ref. No. 602335), Ben-Porath and Benvenisty (1996) proposed that these proteins are members of a novel family. Based on the suggested functions of PMP22, they proposed that EMP1 is involved in cell-cell interactions and the control of cell proliferation. Chen et al. (1997) found that the EMP1 gene contains 5 exons and 4 introns, and they noted that the exon/intron junctions are located at the same positions as those of PMP22, suggesting that EMP1 and PMP22 arose by duplication of a common ancestral gene. Using Northern blot analysis, they detected a 2.8-kb EMP1 transcript in most of the adult tissues examined, but not in brain, liver, pancreas, or peripheral blood leukocytes. Using RT-PCR, Ben-Porath and Benvenisty (1996) detected EMP1 expression in embryonic kidney, brain, and gut, but not in liver and thymus. Marvin et al. (1995) localized the EMP1 gene to chromosome 12 using a somatic cell hybrid panel. By fluorescence in situ hybridization, Chen et al. (1997) and Ruegg et al. (1996) mapped the EMP1 gene to 12p12 and 20q12-q13.1, respectively. By FISH, somatic cell hybridization, and radiation hybrid analysis, Liehr et al. (1999) confirmed assignment of the EMP1 gene to chromosome 12p12.3. Ben Porath et al. (1998) mapped the homologous gene in the mouse to chromosome 6.

Full details of the abovementioned studies are described in the following publications, the disclosure of which are hereby incorporated by reference:

Ben Porath, I.; Kozak, C. A.; Benvenisty, N.: Chromosomal mapping of Tmp (Emp1), Xmp (Emp2), and Ymp (Emp3), genes encoding membrane proteins related to Pmp22. Genomics 49:443-447, 1998; and Chen, Y.; Medvedev, A.; Ruzanov, P.; Marvin, K. W.; Jetten, A. M.: cDNA cloning, genomic structure, and chromosome mapping of the human epithelial membrane protein CL-20 gene (EMP1), a.

Further studies establishing the function and utilities of EMP1 are found in John Hopkins OMIM database record ID 602333, and in sited publications numbered 9305-6011 listed in the bibliography section hereinbelow, which are also hereby incorporated by reference. Mitogen-activated Protein Kinase 14 (MAPK14, Accession NM_001315) is another VGAM107 host target gene. MAPK14 BINDING SITE1 through MAPK14 BINDING SITE3 are HOST TARGET binding sites found in untranslated regions of mRNA encoded by MAPK14, corresponding to HOST TARGET binding sites such as BINDING SITE I, BINDING SITE II or BINDING SITE III. Table 2 illustrates the complementarity of the nucleotide sequences of MAPK14 BINDING SITE1 through MAPK14 BINDING SITE3, designated SEQ ID:7000, SEQ ID:29111 and SEQ ID:29104 respectively, to the nucleotide sequence of VGAM107 RNA, herein designated VGAM RNA, also designated SEQ ID:2818.

Another function of VGAM107 is therefore inhibition of Mitogen-activated Protein Kinase 14 (MAPK14, Accession NM_001315), a gene which is important for cytokine production; responds to changes in extracellular osmolarity. Accordingly, utilities of VGAM107 include diagnosis, prevention and treatment of diseases and clinical conditions associated with MAPK14. The function of MAPK14 has been established by previous studies. Tamura et al. (2000) investigated a role for Mapk14 in mouse development and physiology by targeted disruption of the Mapk14 gene. Whereas some Mapk14 -/- embryos died between embryonic days 11.5 and 12.5, those that developed past this stage had normal morphology but were anemic, owing to failed definitive erythropoiesis caused by diminished expression of the erythropoietin gene (EPO; 133170). Since Mapk14-deficient hematopoietic stem cells reconstituted lethally irradiated hosts, Mapk14 function is not required downstream of the Epo receptor (EPOR; 133171). Inhibition of MAPK14 activity also interfered with stabilization of EPO mRNA in human hepatoma cells undergoing hypoxic stress. The authors concluded that MAPK14 plays a critical role linking developmental and stress-induced erythropoiesis through regulation of EPO expression. Using a yeast 2-hybrid screen of gastrointestinal tract tissue with p38-alpha as the bait, Ge et al. (2002) isolated multiple clones encoding TAB1 (OMIM Ref. No. 602615). Immunoprecipitation and GST pull-down analyses indicated that TAB1 interacts with p38-alpha, but not with other MAPKs, with or without treatment with TNF. Immunoblot analysis showed that coexpression of TAB1 and p38-alpha enhanced autophosphorylation of p38-alpha even in the presence of dominant-negative forms of MAP2Ks (e.g., MAP2K3; 602315) and TAK1 (MAP3K7; 602614). The amino acids between positions 373 and 418 of TAB1 were found to be required for phosphorylation of p38-alpha. Expression of TLR2 (OMIM Ref. No. 603028) caused p38-alpha phosphorylation in the presence or absence of inhibitors, whereas p38-alpha phosphorylation after stimulation of TLR4 (OMIM Ref. No. 603030) could be inhibited by mutant TAB1, suggesting that activation of p38-alpha can be TAB1 dependent or independent. Immunoblot analysis detected the formation of TRAF6 (OMIM Ref. No. 602355)-TAB1-p38-alpha complexes. Formation of these complexes could be enhanced by stimulation with lipopolysaccharide. Ge et al. (2002) concluded that activation of p38-alpha by a nonenzymatic adaptor protein such as TAB1 may be an important alternative activation pathway operating in parallel with kinase cascades in regulating intracellular signaling Full details of the abovementioned studies are described in the following publications, the disclosure of which are hereby incorporated by reference:

Tamura, K.; Sudo, T.; Senftleben, U.; Dadak, A. M.; Johnson, R.; Karin, M.: Requirement for p38-alpha in erythropoietin expression: a role for stress kinases in erythropoiesis. Cell 102:221-231, 2000; and Ge, B.; Gram, H.; Di Padova, F.; Huang, B.; New, L.; Ulevitch, R. J.; Luo, Y.; Han, J.: MAPKK-independent activation of p38-alpha mediated by TAB1-dependent autophosphorylation of p38-alp.

Further studies establishing the function and utilities of MAPK14 are found in John Hopkins OMIM database record ID 600289, and in sited publications numbered 10123, 10124, 10125-1013 and 11101 listed in the bibliography section hereinbelow, which are also hereby incorporated by reference. Synaptogyrin 1 (SYNGR1, Accession NM_004711) is another VGAM107 host target gene. SYNGR1 BINDING SITE is HOST TARGET binding site found in the 3' untranslated region of mRNA encoded by SYNGR1, corresponding to a HOST TARGET binding site such as BINDING SITE I, BINDING SITE II or BINDING SITE III. Table 2 illustrates the complementarity of the nucleotide sequences of SYNGR1 BINDING SITE, designated SEQ ID:11058, to the nucleotide sequence of VGAM107 RNA, herein designated VGAM RNA, also designated SEQ ID:2818.

Another function of VGAM107 is therefore inhibition of Synaptogyrin 1 (SYNGR1, Accession NM_004711), a gene which belongs to transmembrane synaptic vesicle protein and may function in membrane recycling. Accordingly, utilities of VGAM107 include diagnosis, prevention and treatment of diseases and clinical conditions associated with SYNGR1. The function of SYNGR1 has been established by previous studies. Rat synaptogyrin, or RATSYNGR1, is an integral membrane protein associated with presynaptic vesicles in neuronal cells. See SYNGR2 (OMIM Ref. No. 603926). As part of an effort to sequence the long arm of human chromosome 22, Kedra et al. (1998) identified the human homolog of RATSYNGR1, synaptogyrin-1 (OMIM Ref. No. SYNGR1). By a combination of EST database searching and library screening, the authors isolated cDNAs corresponding to 3 alternatively spliced transcripts, which they designated SYNGR1a-c. The predicted 1a, 1b, and 1c proteins contain 234, 191, and 192 amino acids, respectively. Northern blot analysis revealed that the 4.5-kb SYNGR1a mRNA is expressed at high levels in brain. The other transcript forms are expressed at low levels in nonneuronal tissues. In situ hybridization to embryonic and adult mouse tissues confirmed that SYNGR1a, the most abundant transcript form, shows predominantly neuronal expression. Kedra et al. (1998) also identified cDNAs encoding the related human proteins SYNGR2 and SYNGR3 (OMIM Ref. No. 603927) and mouse Syngr1b. Like RATSYNGR1, the mouse and human synaptogyrin family members contain 4 membrane-spanning domains. The conserved central portion of SYNGR1a shares 54%, 61%, and 92% identity with that of SYNGR2, SYNGR3, and RATSYNGR1, respectively. Animal model experiments lend further support to the function of SYNGR1. Using gene targeting, Janz et al. (1999) generated mice lacking Syngr1. They bred these Syngr1 knockout mice against Syp (OMIM Ref. No. 313475) knockout mice generated by McMahon et al. (1996) to create double knockout mice deficient in both Syp and Syngr1. Both single and double knockout mice were viable and fertile. Morphologic and biochemical analysis showed that the architecture and composition of synapses were unaltered in the brains of Syngr1 single knockout and Syngr1/Syp double knockout mutant mice. Electrophysiologic recordings in the hippocampal CA1 region revealed that short- and long-term synaptic plasticity was severely reduced in the Syngr1/Syp double knockout mice without changes in the fundamental release apparatus, vesicle cycling, or release probability. Janz et al. (1999) concluded that Syngr1 and Syp perform essential and redundant functions in synaptic plasticity without being required for synaptic transmission as such.

It is appreciated that the abovementioned animal model for SYNGR1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Janz, R.; Sudhof, T. C.; Hammer, R. E.; Unni, V.; Siegelbaum, S. A.; Bolshakov, V. Y.: Essential roles in synaptic plasticity for synaptogyrin I and synaptophysin I. Neuron 24:687-700, 1999; and Kedra, D.; Pan, H.-Q.; Seroussi, E.; Fransson, I.; Guilbaud, C.; Collins, J. E.; Dunham, I.; Blennow, E.; Roe, B. A.; Piehl, F.; Dumanski, J. P.: Characterization of the human synapto.

Further studies establishing the function and utilities of SYNGR1 are found in John Hopkins OMIM database record ID 603925, and in sited publications numbered 815 and 8157 listed in the bibliography section hereinbelow, which are also hereby incorporated by reference. Rho/rac Guanine Nucleotide Exchange Factor (GEF) 2 (ARHGEF2, Accession NM_004723) is another VGAM107 host target gene. ARHGEF2 BINDING SITE is HOST TARGET binding site found in the 3' untranslated region of mRNA encoded by ARHGEF2, corresponding to a HOST TARGET binding site such as BINDING SITE I, BINDING SITE II or BINDING SITE III. Table 2 illustrates the complementarity of the nucleotide sequences of ARHGEF2 BINDING SITE, designated SEQ ID:11092, to the nucleotide sequence of VGAM107 RNA, herein designated VGAM RNA, also designated SEQ ID:2818.

Another function of VGAM107 is therefore inhibition of Rho/rac Guanine Nucleotide Exchange Factor (GEF) 2 (ARHGEF2, Accession NM_004723). Accordingly, utilities of VGAM107 include diagnosis, prevention and treatment of diseases and clinical conditions associated with ARHGEF2. Bladder Cancer Associated Protein (BLCAP, Accession NM_006698) is another VGAM107 host target gene. BLCAP BINDING SITE is HOST TARGET binding site found in the 3' untranslated region of mRNA encoded by BLCAP, corresponding to a HOST TARGET binding site such as BINDING SITE I, BINDING SITE II or BINDING SITE III. Table 2 illustrates the complementarity of the nucleotide sequences of BLCAP BINDING SITE, designated SEQ ID:13520, to the nucleotide sequence of VGAM107 RNA, herein designated VGAM RNA, also designated SEQ ID:2818.

Another function of VGAM107 is therefore inhibition of Bladder Cancer Associated Protein (BLCAP, Accession NM_006698). Accordingly, utilities of VGAM107 include diagnosis, prevention and treatment of diseases and clinical conditions associated with BLCAP. FLJ14800 (Accession NM_032840) is another VGAM107 host target gene. FLJ14800 BINDING SITE is HOST TARGET binding site found in the 3' untranslated region of mRNA encoded by FLJ14800, corresponding to a HOST TARGET binding site such as BINDING SITE I, BINDING SITE II or BINDING SITE III. Table 2 illustrates the complementarity of the nucleotide sequences of FLJ14800 BINDING SITE, designated SEQ ID:26622, to the nucleotide sequence of VGAM107 RNA, herein designated VGAM RNA, also designated SEQ ID:2818.

Another function of VGAM107 is therefore inhibition of FLJ14800 (Accession NM_032840). Accordingly, utilities of VGAM107 include diagnosis, prevention and treatment of diseases and clinical conditions associated with FLJ14800. HSPC019 (Accession NM_014028) is another VGAM107 host target gene. HSPC019 BINDING SITE is HOST TARGET binding site found in the 3' untranslated region of mRNA encoded by HSPC019, corresponding to a HOST TARGET binding site such as BINDING SITE I, BINDING SITE II or BINDING SITE III. Table 2 illustrates the complementarity of the nucleotide sequences of HSPC019 BINDING SITE, designated SEQ ID:15251, to the nucleotide sequence of VGAM107 RNA, herein designated VGAM RNA, also designated SEQ ID:2818.

Another function of VGAM107 is therefore inhibition of HSPC019 (Accession NM_014028). Accordingly, utilities of VGAM107 include diagnosis, prevention and treatment of diseases and clinical conditions associated with HSPC019. KIAA1729 (Accession XM_114418) is another VGAM107 host target gene. KIAA1729 BINDING SITE is HOST TARGET binding site found in the 5' untranslated region of mRNA encoded by KIAA1729, corresponding to a HOST TARGET binding site such as BINDING SITE I, BINDING SITE II or BINDING SITE III. Table 2 illustrates the complementarity of the nucleotide sequences of KIAA1729 BINDING SITE, designated SEQ ID:42947, to the nucleotide sequence of VGAM107 RNA, herein designated VGAM RNA, also designated SEQ ID:2818.

Another function of VGAM107 is therefore inhibition of KIAA1729 (Accession XM_114418). Accordingly, utilities of VGAM107 include diagnosis, prevention and treatment of diseases and clinical conditions associated with KIAA1729. Olfactomedin 3 (OLFM3, Accession XM_088951) is another VGAM107 host target gene. OLFM3 BINDING SITE is HOST TARGET binding site found in the 3' untranslated region of mRNA encoded by OLFM3, corresponding to a HOST TARGET binding site such as BINDING SITE I, BINDING SITE II or BINDING SITE III. Table 2 illustrates the complementarity of the nucleotide sequences of OLFM3 BINDING SITE, designated SEQ ID:39959, to the nucleotide sequence of VGAM107 RNA, herein designated VGAM RNA, also designated SEQ ID:2818.

Another function of VGAM107 is therefore inhibition of Olfactomedin 3 (OLFM3, Accession XM_088951). Accordingly, utilities of VGAM107 include diagnosis, prevention and treatment of diseases and clinical conditions associated with OLFM3. PAS Domain Containing Serine/threonine Kinase (PASK, Accession NM_015148) is another VGAM107 host target gene. PASK BINDING SITE is HOST TARGET binding site found in the 5' untranslated region of mRNA encoded by PASK, corresponding to a HOST TARGET binding site such as BINDING SITE I, BINDING SITE II or BINDING SITE III. Table 2 illustrates the complementarity of the nucleotide sequences of PASK BINDING SITE, designated SEQ ID:17501, to the nucleotide sequence of VGAM107 RNA, herein designated VGAM RNA, also designated SEQ ID:2818.

Another function of VGAM107 is therefore inhibition of PAS Domain Containing Serine/threonine Kinase (PASK, Accession NM_015148). Accordingly, utilities of VGAM107 include diagnosis, prevention and treatment of diseases and clinical conditions associated with PASK. LOC253613 (Accession XM_171225) is another VGAM107 host target gene. LOC253613 BINDING SITE is HOST TARGET binding site found in the 3' untranslated region of mRNA encoded by LOC253613, corresponding to a HOST TARGET binding site such as BINDING SITE I, BINDING SITE II or BINDING SITE III. Table 2 illustrates the complementarity of the nucleotide sequences of LOC253613 BINDING SITE, designated SEQ ID:46007, to the nucleotide sequence of VGAM107 RNA, herein designated VGAM RNA, also designated SEQ ID:2818.

Another function of VGAM107 is therefore inhibition of LOC253613 (Accession XM_171225). Accordingly, utilities of VGAM107 include diagnosis, prevention and treatment of diseases and clinical conditions associated with LOC253613. LOC90092 (Accession XM_028862) is another VGAM107 host target gene. LOC90092 BINDING SITE is HOST TARGET binding site found in the 5' untranslated region of mRNA encoded by LOC90092, corresponding to a HOST TARGET binding site such as BINDING SITE I, BINDING SITE II or BINDING SITE III. Table 2 illustrates the complementarity of the nucleotide sequences of LOC90092 BINDING SITE, designated SEQ ID:30789, to the nucleotide sequence of VGAM107 RNA, herein designated VGAM RNA, also designated SEQ ID:2818.

Another function of VGAM107 is therefore inhibition of LOC90092 (Accession XM_028862). Accordingly, utilities of VGAM107 include diagnosis, prevention and treatment of diseases and clinical conditions associated with LOC90092. LOC91748 (Accession XM_040343) is another VGAM107 host target gene. LOC91748 BINDING SITE is HOST TARGET binding site found in the 3' untranslated region of mRNA encoded by LOC91748, corresponding to a HOST TARGET binding site such as BINDING SITE I, BINDING SITE II or BINDING SITE III. Table 2 illustrates the complementarity of the nucleotide sequences of LOC91748 BINDING SITE, designated SEQ ID:33287, to the nucleotide sequence of VGAM107 RNA, herein designated VGAM RNA, also designated SEQ ID:2818.

Another function of VGAM107 is therefore inhibition of LOC91748 (Accession XM_040343). Accordingly, utilities of VGAM107 include diagnosis, prevention and treatment of diseases and clinical conditions associated with LOC91748. LOC92249 (Accession XM_043814) is another VGAM107 host target gene. LOC92249 BINDING SITE is HOST TARGET binding site found in the 5' untranslated region of mRNA encoded by LOC92249, corresponding to a HOST TARGET binding site such as BINDING SITE I, BINDING SITE II or BINDING SITE III. Table 2 illustrates the complementarity of the nucleotide sequences of LOC92249 BINDING SITE, designated SEQ ID:34019, to the nucleotide sequence of VGAM107 RNA, herein designated VGAM RNA, also designated SEQ ID:2818.

Another function of VGAM107 is therefore inhibition of LOC92249 (Accession XM_043814). Accordingly, utilities of VGAM107 include diagnosis, prevention and treatment of diseases and clinical conditions associated with LOC92249. FIG. 1 further provides a conceptual description of a novel bioinformatically detected viral gene of the present invention, referred to here as Viral Genomic Address Messenger 108 (VGAM108) viral gene, which modulates expression of respective host target genes thereof, the function and utility of which host target genes is known in the art.

VGAM108 is a novel bioinformatically detected regulatory, non protein coding, viral micro RNA (miRNA) gene. The method by which VGAM108 was detected is described hereinabove with reference to FIGS. 1-8.

VGAM108 gene, herein designated VGAM GENE, is a viral gene contained in the genome of Saimiriine Herpesvirus 2. VGAM108 host target gene, herein designated VGAM HOST TARGET GENE, is a human gene contained in the human genome.

VGAM108 gene encodes a VGAM108 precursor RNA, herein designated VGAM PRECURSOR RNA. Similar to other miRNA genes, and unlike most ordinary genes, VGAM108 precursor RNA does not encode a protein. A nucleotide sequence identical or highly similar to the nucleotide sequence of VGAM108 precursor RNA is designated SEQ ID:94, and is provided hereinbelow with reference to the sequence listing part. Nucleotide sequence SEQ ID:94 is located at position 50791 relative to the genome of Saimiriine Herpesvirus 2.

VGAM108 precursor RNA folds onto itself, forming VGAM108 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM108 folded precursor RNA into VGAM108 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM108 RNA is designated SEQ ID:2819, and is provided hereinbelow with reference to the sequence listing part.

VGAM108 host target gene, herein designated VGAM HOST TARGET GENE, encodes a corresponding messenger RNA, VGAM108 host target RNA, herein designated VGAM HOST TARGET RNA. VGAM108 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM108 RNA, herein designated VGAM RNA, binds complementarily to one or more host target binding sites located in untranslated regions of VGAM108 host target RNA, herein designated VGAM HOST TARGET RNA. This complementary binding is due to the fact that the nucleotide sequence of VGAM108 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM108 RNA, herein designated VGAM RNA, may have a different number of host target binding sites in untranslated regions of a VGAM108 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM108 RNA, herein designated VGAM RNA, to host target binding sites on VGAM108 host target RNA, herein designated VGAM HOST TARGET RNA, such as BINDING SITE I, BINDING SITE II and BINDING SITE III, inhibits translation of VGAM108 host target RNA into VGAM108 host target protein, herein designated VGAM HOST TARGET PROTEIN. VGAM host target protein is therefore outlined by a broken line.

It is appreciated that VGAM108 host target gene, herein designated VGAM HOST TARGET GENE, in fact represents a plurality of VGAM108 host target genes. The mRNA of each one of this plurality of VGAM108 host target genes comprises one or more host target binding sites, each having a nucleotide sequence which is at least partly complementary to VGAM108 RNA, herein designated VGAM RNA, and which when bound by VGAM108 RNA causes inhibition of translation of respective one or more VGAM108 host target proteins.

It is further appreciated by one skilled in the art that the mode of translational inhibition illustrated by FIG. 1 with specific reference to translational inhibition exerted by VGAM108 gene, herein designated VGAM GENE, on one or more VGAM108 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM108 is inhibition of expression of host target genes, as part of a novel viral mechanism of attacking a host. Accordingly, utilities of VGAM108 include diagnosis, prevention and treatment of viral infection by Saimiriine Herpesvirus 2. Specific functions, and accordingly utilities, of VGAM108 correlate with, and may be deduced from, the identity of the host target genes which VGAM108 binds and inhibits, and the function of these host target genes, as elaborated hereinbelow.

Nucleotide sequences of the VGAM108 precursor RNA, herein designated VGAM PRECURSOR RNA, and of the 'diced' VGAM108 RNA, herein designated VGAM RNA, and a schematic representation of the secondary folding of VGAM108 folded precursor RNA, herein designated VGAM FOLDED PRECURSOR RNA, of VGAM108 are further described hereinbelow with reference to Table 1.

Nucleotide sequences of host target binding sites, such as BINDING SITE-I, BINDING SITE-II and BINDING SITE-III of FIG. 1, found on VGAM108 host target RNA, and schematic representation of the complementarity of each of these host target binding sites to VGAM108 RNA, herein designated VGAM RNA, are described hereinbelow with reference to Table 2.

As mentioned hereinabove with reference to FIG. 1, a function of VGAM108 gene, herein designated VGAM is inhibition of expression of VGAM108 target genes. It is appreciated that specific functions, and accordingly utilities, of VGAM108 correlate with, and may be deduced from, the identity of the target genes which VGAM108 binds and inhibits, and the function of these target genes, as elaborated hereinbelow.

Adenylate Cyclase 7 (ADCY7, Accession NM_001114) is a VGAM108 host target gene. ADCY7 BINDING SITE is HOST TARGET binding site found in the 3' untranslated region of mRNA encoded by ADCY7, corresponding to a HOST TARGET binding site such as BINDING SITE I, BINDING SITE II or BINDING SITE III. Table 2 illustrates the complementarity of the nucleotide sequences of ADCY7 BINDING SITE, designated SEQ ID:6782, to the nucleotide sequence of VGAM108 RNA, herein designated VGAM RNA, also designated SEQ ID:2819.

A function of VGAM108 is therefore inhibition of Adenylate Cyclase 7 (ADCY7, Accession NM_001114), a gene which this a membrane-bound, ca (2+)-inhibitable adenylyl cyclase. Accordingly, utilities of VGAM108 include diagnosis, prevention and treatment of diseases and clinical conditions associated with ADCY7. The function of ADCY7 has been established by previous studies. Hellevuo et al. (1993) identified a novel form of human adenylyl cyclase (ADCY7) in the human erythroleukemia cell line HEL. It appeared that ADCY7 is the major form of adenylyl cyclase in human platelets. Hellevuo et al. (1995) used PCR techniques in the study of human/rodent somatic hybrid panels and a YAC library to demonstrate that the ADCY7 gene is located on 16q12-q13. The adenylyl cyclase enzyme family is characterized by the presence of 12 membrane-spanning domains in its sequences, and this region of the genome is known to contain other genes encoding proteins characterized by 12 membrane-spanning domains: norepinephrine transporter protein-1 (NET1; 163970), located at 16q12.2, and renal sodium-glucose transporter-2 (SGLT2; 182381), located at 16p11.2.

Full details of the abovementioned studies are described in the following publications, the disclosure of which are hereby incorporated by reference:

Hellevuo, K.; Berry, R.; Sikela, J. M.; Tabakoff, B.: Localization of the gene for a novel human adenylyl cyclase (ADCY7) to chromosome 16. Hum. Genet. 95:197-200, 1995; and Hellevuo, K.; Yoshimura, M.; Kao, M.; Hoffman, P. L.; Cooper, D. M. F.; Tabakoff, B.: A novel adenylyl cyclase sequence cloned from the human erythroleukemia cell line. Biochem. Biophy.

Further studies establishing the function and utilities of ADCY7 are found in John Hopkins OMIM database record ID 600385, and in sited publications numbered 10690-10691 listed in the bibliography section hereinbelow, which are also hereby incorporated by reference. RAB4A, Member RAS Oncogene Family (RAB4A, Accession NM_004578) is another VGAM108 host target gene. RAB4A BINDING SITE is HOST TARGET binding site found in the 3' untranslated region of mRNA encoded by RAB4A, corresponding to a HOST TARGET binding site such as BINDING SITE I, BINDING SITE II or BINDING SITE III. Table 2 illustrates the complementarity of the nucleotide sequences of RAB4A BINDING SITE, designated SEQ ID:10925, to the nucleotide sequence of VGAM108 RNA, herein designated VGAM RNA, also designated SEQ ID:2819.

Another function of VGAM108 is therefore inhibition of RAB4A, Member RAS Oncogene Family (RAB4A, Accession NM_004578), a gene which is involved in protein transport. Accordingly, utilities of VGAM108 include diagnosis, prevention and treatment of diseases and clinical conditions associated with RAB4A. The function of RAB4A and its association with various diseases and clinical conditions, has been established by previous studies, as described hereinabove with reference to VGAM71. Transcriptional Intermediary Factor 1 (TIF1, Accession XM_016701) is another VGAM108 host target gene. TIF1 BINDING SITE is HOST TARGET binding site found in the 3' untranslated region of mRNA encoded by TIF1, corresponding to a HOST TARGET binding site such as BINDING SITE I, BINDING SITE II or BINDING SITE III. Table 2 illustrates the complementarity of the nucleotide sequences of TIF1 BINDING SITE, designated SEQ ID:30276, to the nucleotide sequence of VGAM108 RNA, herein designated VGAM RNA, also designated SEQ ID:2819.

Another function of VGAM108 is therefore inhibition of Transcriptional Intermediary Factor 1 (TIF1, Accession XM_016701), a gene which mediates the activation function (AF-2) of nuclear estrogen receptor. Accordingly, utilities of VGAM108 include diagnosis, prevention and treatment of diseases and clinical conditions associated with TIF1. The function of TIF1 has been established by previous studies.

Hormonal regulation of gene activity is mediated by nuclear receptors acting as ligand-activated transcription factors. The activity of the ligand-dependent activation function, or AF2, of the receptors requires intermediary factors that interact with the AF2-activating domain, a C-terminal region that is highly conserved in the nuclear receptor family. Thenot et al. (1997) isolated human breast cancer cell cDNAs that encode transcription intermediary factor-1 (TIF1), a protein that is able to bind to the AF2-activating domain of the estrogen receptor (ESR; e.g., 133430). The deduced 1,013-amino acid TIF1 protein, which is more than 92% conserved with mouse Tif1, contains several domains: a RING finger, B-box fingers, a coiled-coil domain, a PHD homeodomain finger, and a bromodomain. A 26-amino acid region of TIF1 is sufficient for its hormone-dependent binding to the ESR. Thenot et al. (1997) demonstrated that the AF2-activating domain of ESR is required but not sufficient for the binding of TIF1, that TIF1 association with DNA-bound ESR requires the presence of estradiol, and that TIF1 interacts selectively with different nuclear receptors. The authors identified a cDNA variant that encodes a TIF1 isoform containing a 34-amino acid insertion. Northern blot analysis detected a major 4.5-kb transcript in MCF7 breast cancer cells. Fusion of PML (OMIM Ref. No. 102578) and TIF1A to RARA (OMIM Ref. No. 180240) and BRAF (OMIM Ref. No. 164757), respectively, results in the production of PML-RAR-alpha and TIF1-alpha-B-RAF (T18) oncoproteins. Zhong et al. (1999) showed that PML, TIF1-alpha, and RXR-alpha (OMIM Ref. No. 180245)/RAR-alpha function together in a retinoic acid-dependent transcription complex. Zhong et al. (1999) found that PML acts as a ligand-dependent coactivator of RXR-alpha/RARA-alpha. PML interacts with TIF1-alpha and CREB-binding protein (CBP; 600140). In PML -/- cells, the retinoic acid-dependent induction of genes such as RARB2 and the ability of TIF1-alpha and CBP to act as transcriptional coactivators on retinoic acid are impaired. Zhong et al. (1999) showed that both PML and TIF1-alpha are growth suppressors required for the growth-inhibitory activity of retinoic acid. T18, similar to PML-RAR-alpha, disrupts the retinoic acid-dependent activity of this complex in a dominant-negative manner, resulting in a growth advantage. PML-RAR-alpha was the first example of an oncoprotein generated by the fusion of 2 molecules participating in the same pathway, specifically the fusion of a transcription factor to one of its own cofactors. Since the PML and RAR-alpha pathways converge at the transcriptional level, there is no need for a double-dominant-negative product to explain the pathogenesis of acute promyelocytic leukemia, or APL. Beckstead et al. (2001) found that the Drosophila 'bonus' (bon) gene encodes a homolog of the vertebrate TIF1 transcriptional cofactors. Bon is required for male viability, molting, and numerous events in metamorphosis, including leg elongation, bristle development, and pigmentation. Most of these processes are associated with genes that are implicated in the ecdysone pathway, a nuclear hormone receptor pathway required throughout Drosophila development. Bon is associated with sites on the polytene chromosomes and can interact with numerous Drosophila nuclear receptor proteins. In vivo, bon behaves as a transcriptional inhibitor.

Full details of the abovementioned studies are described in the following publications, the disclosure of which are hereby incorporated by reference:

Zhong, S.; Delva, L.; Rachez, C.; Cenciarelli, C.; Gandini, D.; Zhang, H.; Kalantry, S.; Freedman, L. P.; Pandolfi, P. P.: A RA-dependent, tumour-growth suppressive transcription complex is the target of the PML-RAR-alpha and T18 oncoproteins. Nature Genet. 23:287-295, 1999; and Beckstead, R.; Ortiz, J. A.; Sanchez, C.; Prokopenko, S. N.; Chambon, P.; Losson, R.; Bellen, H. J.: Bonus, a Drosophila homolog of TIF1 proteins, interacts with nuclear receptors and.

Further studies establishing the function and utilities of TIF1 are found in John Hopkins OMIM database record ID 603406, and in sited publications numbered 5297, 5298-5299, 620 and 11302 listed in the bibliography section hereinbelow, which are also hereby incorporated by reference. FLJ14855 (Accession NM_033210) is another VGAM108 host target gene. FLJ14855 BINDING SITE is HOST TARGET binding site found in the 3" untranslated region of mRNA encoded by FLJ14855, corresponding to a HOST TARGET binding site such as BINDING SITE I, BINDING SITE II or BINDING SITE III. Table 2 illustrates the complementarity of the nucleotide sequences of FLJ14855 BINDING SITE, designated SEQ ID:27058, to the nucleotide sequence of VGAM108 RNA, herein designated VGAM RNA, also designated SEQ ID:2819.

Another function of VGAM108 is therefore inhibition of FLJ14855 (Accession NM_033210). Accordingly, utilities of VGAM108 include diagnosis, prevention and treatment of diseases and clinical conditions associated with FLJ14855. FLJ23462 (Accession NM_024843) is another VGAM108 host target gene. FLJ23462 BINDING SITE is HOST TARGET binding site found in the 3' untranslated region of mRNA encoded by FLJ23462, corresponding to a HOST TARGET binding site such as BINDING SITE I, BINDING SITE II or BINDING SITE III. Table 2 illustrates the complementarity of the nucleotide sequences of FLJ23462 BINDING SITE, designated SEQ ID:24263, to the nucleotide sequence of VGAM108 RNA, herein designated VGAM RNA, also designated SEQ ID:2819.

Another function of VGAM108 is therefore inhibition of FLJ23462 (Accession NM_024843). Accordingly, utilities of VGAM108 include diagnosis, prevention and treatment of diseases and clinical conditions associated with FLJ23462. Golgi Phosphoprotein 3 (coat-protein) (GOLPH3, Accession NM_022130) is another VGAM108 host target gene. GOLPH3 BINDING SITE is HOST TARGET binding site found in the 3' untranslated region of mRNA encoded by GOLPH3, corresponding to a HOST TARGET binding site such as BINDING SITE I, BINDING SITE II or BINDING SITE III. Table 2 illustrates the complementarity of the nucleotide sequences of GOLPH3 BINDING SITE, designated SEQ ID:22685, to the nucleotide sequence of VGAM108 RNA, herein designated VGAM RNA, also designated SEQ ID:2819.

Another function of VGAM108 is therefore inhibition of Golgi Phosphoprotein 3 (coat-protein) (GOLPH3, Accession NM_022130). Accordingly, utilities of VGAM108 include diagnosis, prevention and treatment of diseases and clinical conditions associated with GOLPH3. LOC145368 (Accession XM_085112) is another VGAM108 host target gene. LOC145368 BINDING SITE is HOST TARGET binding site found in the 3' untranslated region of mRNA encoded by LOC145368, corresponding to a HOST TARGET binding site such as BINDING SITE I, BINDING SITE II or BINDING SITE III. Table 2 illustrates the complementarity of the nucleotide sequences of LOC145368 BINDING SITE, designated SEQ ID:37826, to the nucleotide sequence of VGAM108 RNA, herein designated VGAM RNA, also designated SEQ ID:2819.

Another function of VGAM108 is therefore inhibition of LOC145368 (Accession XM_085112). Accordingly, utilities of VGAM108 include diagnosis, prevention and treatment of diseases and clinical conditions associated with LOC145368.

FIG. 1 further provides a conceptual description of a novel bioinformatically detected viral gene of the present invention, referred to here as Viral Genomic Address Messenger 109 (VGAM109) viral gene, which modulates expression of respective host target genes thereof, the function and utility of which host target genes is known in the art.

VGAM109 is a novel bioinformatically detected regulatory, non protein coding, viral micro RNA (miRNA) gene. The method by which VGAM109 was detected is described hereinabove with reference to FIGS. 1-8.

VGAM109 gene, herein designated VGAM GENE, is a viral gene contained in the genome of Saimiriine Herpesvirus 2. VGAM109 host target gene, herein designated VGAM HOST TARGET GENE, is a human gene contained in the human genome.

VGAM109 gene encodes a VGAM109 precursor RNA, herein designated VGAM PRECURSOR RNA. Similar to other miRNA genes, and unlike most ordinary genes, VGAM109 precursor RNA does not encode a protein. A nucleotide sequence identical or highly similar to the nucleotide sequence of VGAM109 precursor RNA is designated SEQ ID:95, and is provided hereinbelow with reference to the sequence listing part. Nucleotide sequence SEQ ID:95 is located at position 52022 relative to the genome of Saimiriine Herpesvirus 2.

VGAM109 precursor RNA folds onto itself, forming VGAM109 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM109 folded precursor RNA into VGAM109 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM109 RNA is designated SEQ ID:2820, and is provided hereinbelow with reference to the sequence listing part.

VGAM109 host target gene, herein designated VGAM HOST TARGET GENE, encodes a corresponding messenger RNA, VGAM109 host target RNA, herein designated VGAM HOST TARGET RNA. VGAM109 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM109 RNA, herein designated VGAM RNA, binds complementarily to one or more host target binding sites located in untranslated regions of VGAM109 host target RNA, herein designated VGAM HOST TARGET RNA. This complementary binding is due to the fact that the nucleotide sequence of VGAM109 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM109 RNA, herein designated VGAM RNA, may have a different number of host target binding sites in untranslated regions of a VGAM109 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM109 RNA, herein designated VGAM RNA, to host target binding sites on VGAM109 host target RNA, herein designated VGAM HOST TARGET RNA, such as BINDING SITE I, BINDING SITE II and BINDING SITE III, inhibits translation of VGAM109 host target RNA into VGAM109 host target protein, herein designated VGAM HOST TARGET PROTEIN. VGAM host target protein is therefore outlined by a broken line.

It is appreciated that VGAM109 host target gene, herein designated VGAM HOST TARGET GENE, in fact represents a plurality of VGAM109 host target genes. The mRNA of each one of this plurality of VGAM109 host target genes comprises one or more host target binding sites, each having a nucleotide sequence which is at least partly complementary to VGAM109 RNA, herein designated VGAM RNA, and which when bound by VGAM109 RNA causes inhibition of translation of respective one or more VGAM109 host target proteins.

It is further appreciated by one skilled in the art that the mode of translational inhibition illustrated by FIG. 1 with specific reference to translational inhibition exerted by VGAM109 gene, herein designated VGAM GENE, on one or more VGAM109 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM109 is inhibition of expression of host target genes, as part of a novel viral mechanism of attacking a host. Accordingly, utilities of VGAM109 include diagnosis, prevention and treatment of viral infection by Saimiriine Herpesvirus 2. Specific functions, and accordingly utilities, of VGAM109 correlate with, and may be deduced from, the identity of the host target genes which VGAM109 binds and inhibits, and the function of these host target genes, as elaborated hereinbelow.

Nucleotide sequences of the VGAM109 precursor RNA, herein designated VGAM PRECURSOR RNA, and of the 'diced' VGAM109 RNA, herein designated VGAM RNA, and a schematic representation of the secondary folding of VGAM109 folded precursor RNA, herein designated VGAM FOLDED PRECURSOR RNA, of VGAM109 are further described hereinbelow with reference to Table 1.

Nucleotide sequences of host target binding sites, such as BINDING SITE-I, BINDING SITE-II and BINDING SITE-III of FIG. 1, found on VGAM109 host target RNA, and schematic representation of the complementarity of each of these host target binding sites to VGAM109 RNA, herein designated VGAM RNA, are described hereinbelow with reference to Table 2.

As mentioned hereinabove with reference to FIG. 1, a function of VGAM109 gene, herein designated VGAM is inhibition of expression of VGAM109 target genes. It is appreciated that specific functions, and accordingly utilities, of VGAM109 correlate with, and may be deduced from, the identity of the target genes which VGAM109 binds and inhibits, and the function of these target genes, as elaborated hereinbelow.

DKFZp547I094 (Accession NM_032155) is a VGAM109 host target gene. DKFZp547I094 BINDING SITE is HOST TARGET binding site found in the 3' untranslated region of mRNA encoded by DKFZp547I094, corresponding to a HOST TARGET binding site such as BINDING SITE I, BINDING SITE II or BINDING SITE III. Table 2 illustrates the complementarity of the nucleotide sequences of DKFZp547I094 BINDING SITE, designated SEQ ID:25858, to the nucleotide sequence of VGAM109 RNA, herein designated VGAM RNA, also designated SEQ ID:2820.

A function of VGAM109 is therefore inhibition of DKFZp547I094 (Accession NM_032155). Accordingly, utilities of VGAM109 include diagnosis, prevention and treatment of diseases and clinical conditions associated with DKFZp547I094. FLJ11996 (Accession NM_024976) is another VGAM109 host target gene. FLJ11996 BINDING SITE is HOST TARGET binding site found in the 5' untranslated region of mRNA encoded by FLJ11996, corresponding to a HOST TARGET binding site such as BINDING SITE I, BINDING SITE II or BINDING SITE III. Table 2 illustrates the complementarity of the nucleotide sequences of FLJ11996 BINDING SITE, designated SEQ ID:24532, to the nucleotide sequence of VGAM109 RNA, herein designated VGAM RNA, also designated SEQ ID:2820.

Another function of VGAM109 is therefore inhibition of FLJ11996 (Accession NM_024976). Accordingly, utilities of VGAM109 include diagnosis, prevention and treatment of diseases and clinical conditions associated with FLJ11996. FLJ32334 (Accession NM_144565) is another VGAM109 host target gene. FLJ32334 BINDING SITE is HOST TARGET binding site found in the 3' untranslated region of mRNA encoded by FLJ32334, corresponding to a HOST TARGET binding site such as BINDING SITE I, BINDING SITE II or BINDING SITE III. Table 2 illustrates the complementarity of the nucleotide sequences of FLJ32334 BINDING SITE, designated SEQ ID:29366, to the nucleotide sequence of VGAM109 RNA, herein designated VGAM RNA, also designated SEQ ID:2820.

Another function of VGAM109 is therefore inhibition of FLJ32334 (Accession NM_144565). Accordingly, utilities of VGAM109 include diagnosis, prevention and treatment of diseases and clinical conditions associated with FLJ32334. HBP1 (Accession NM_012257) is another VGAM109 host target gene. HBP1 BINDING SITE is HOST TARGET binding site found in the 3' untranslated region of mRNA encoded by HBP1, corresponding to a HOST TARGET binding site such as BINDING SITE I, BINDING SITE II or BINDING SITE III. Table 2 illustrates the complementarity of the nucleotide sequences of HBP1 BINDING SITE, designated SEQ ID:14561, to the nucleotide sequence of VGAM109 RNA, herein designated VGAM RNA, also designated SEQ ID:2820.

Another function of VGAM109 is therefore inhibition of HBP1 (Accession NM_012257). Accordingly, utilities of VGAM109 include diagnosis, prevention and treatment of diseases and clinical conditions associated with HBP1. KIAA0063 (Accession NM_014876) is another VGAM109 host target gene. KIAA0063 BINDING SITE is HOST TARGET binding site found in the 3' untranslated region of mRNA encoded by KIAA0063, corresponding to a HOST TARGET binding site such as BINDING SITE I, BINDING SITE II or BINDING SITE III. Table 2 illustrates the complementarity of the nucleotide sequences of KIAA0063 BINDING SITE, designated SEQ ID:17018, to the nucleotide sequence of VGAM109 RNA, herein designated VGAM RNA, also designated SEQ ID:2820.

Another function of VGAM109 is therefore inhibition of KIAA0063 (Accession NM_014876). Accordingly, utilities of VGAM109 include diagnosis, prevention and treatment of diseases and clinical conditions associated with KIAA0063. LOC221296 (Accession XM_166325) is another VGAM109 host target gene. LOC221296 BINDING SITE is HOST TARGET binding site found in the 3' untranslated region of mRNA encoded by LOC221296, corresponding to a HOST TARGET binding site such as BINDING SITE I, BINDING SITE II or BINDING SITE III. Table 2 illustrates the complementarity of the nucleotide sequences of LOC221296 BINDING SITE, designated SEQ ID:44172, to the nucleotide sequence of VGAM109 RNA, herein designated VGAM RNA, also designated SEQ ID:2820.

Another function of VGAM109 is therefore inhibition of LOC221296 (Accession XM_166325). Accordingly, utilities of VGAM109 include diagnosis, prevention and treatment of diseases and clinical conditions associated with LOC221296. FIG. 1 further provides a conceptual description of a novel bioinformatically detected viral gene of the present invention, referred to here as Viral Genomic Address Messenger 110 (VGAM110) viral gene, which modulates expression of respective host target genes thereof, the function and utility of which host target genes is known in the art.

VGAM110 is a novel bioinformatically detected regulatory, non protein coding, viral micro RNA (miRNA) gene. The method by which VGAM110 was detected is described hereinabove with reference to FIGS. 1-8.

VGAM110 gene, herein designated VGAM GENE, is a viral gene contained in the genome of Shrimp White Spot Syndrome Virus (white spot bacilliform virus). VGAM110 host target gene, herein designated VGAM HOST TARGET GENE, is a human gene contained in the human genome.

VGAM110 gene encodes a VGAM110 precursor RNA, herein designated VGAM PRECURSOR RNA. Similar to other miRNA genes, and unlike most ordinary genes, VGAM110 precursor RNA does not encode a protein. A nucleotide sequence identical or highly similar to the nucleotide sequence of VGAM110 precursor RNA is designated SEQ ID:96, and is provided hereinbelow with reference to the sequence listing part. Nucleotide sequence SEQ ID:96 is located at position 161841 relative to the genome of Shrimp White Spot Syndrome Virus (white spot bacilliform virus).

VGAM110 precursor RNA folds onto itself, forming VGAM110 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM110 folded precursor RNA into VGAM110 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM110 RNA is designated SEQ ID:2821, and is provided hereinbelow with reference to the sequence listing part.

VGAM110 host target gene, herein designated VGAM HOST TARGET GENE, encodes a corresponding messenger RNA, VGAM110 host target RNA, herein designated VGAM HOST TARGET RNA. VGAM110 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM110 RNA, herein designated VGAM RNA, binds complementarily to one or more host target binding sites located in untranslated regions of VGAM110 host target RNA, herein designated VGAM HOST TARGET RNA. This complementary binding is due to the fact that the nucleotide sequence of VGAM110 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM110 RNA, herein designated VGAM RNA, may have a different number of host target binding sites in untranslated regions of a VGAM110 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM110 RNA, herein designated VGAM RNA, to host target binding sites on VGAM110 host target RNA, herein designated VGAM HOST TARGET RNA, such as BINDING SITE I, BINDING SITE II and BINDING SITE III, inhibits translation of VGAM110 host target RNA into VGAM110 host target protein, herein designated VGAM HOST TARGET PROTEIN. VGAM host target protein is therefore outlined by a broken line.

It is appreciated that VGAM110 host target gene, herein designated VGAM HOST TARGET GENE, in fact represents a plurality of VGAM110 host target genes. The mRNA of each one of this plurality of VGAM110 host target genes comprises one or more host target binding sites, each having a nucleotide sequence which is at least partly complementary to VGAM110 RNA, herein designated VGAM RNA, and which when bound by VGAM110 RNA causes inhibition of translation of respective one or more VGAM110 host target proteins.

It is further appreciated by one skilled in the art that the mode of translational inhibition illustrated by FIG. 1 with specific reference to translational inhibition exerted by VGAM110 gene, herein designated VGAM GENE, on one or more VGAM110 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM110 is inhibition of expression of host target genes, as part of a novel viral mechanism of attacking a host. Accordingly, utilities of VGAM110 include diagnosis, prevention and treatment of viral infection by Shrimp White Spot Syndrome Virus (white spot baciliform virus). Specific functions, and accordingly utilities, of VGAM110 correlate with, and may be deduced from, the identity of the host target genes which VGAM110 binds and inhibits, and the function of these host target genes, as elaborated hereinbelow.

Nucleotide sequences of the VGAM110 precursor RNA, herein designated VGAM PRECURSOR RNA, and of the 'diced' VGAM110 RNA, herein designated VGAM RNA, and a schematic representation of the secondary folding of VGAM110 folded precursor RNA, herein designated VGAM FOLDED PRECURSOR RNA, of VGAM110 are further described hereinbelow with reference to Table 1.

Nucleotide sequences of host target binding sites, such as BINDING SITE-I, BINDING SITE-II and BINDING SITE-III of FIG. 1, found on VGAM110 host target RNA, and schematic representation of the complementarity of each of these host target binding sites to VGAM110 RNA, herein designated VGAM RNA, are described hereinbelow with reference to Table 2.

As mentioned hereinabove with reference to FIG. 1, a function of VGAM110 gene, herein designated VGAM is inhibition of expression of VGAM110 target genes. It is appreciated that specific functions, and accordingly utilities, of VGAM110 correlate with, and may be deduced from, the identity of the target genes which VGAM110 binds and inhibits, and the function of these target genes, as elaborated hereinbelow.

Dual Specificity Phosphatase 4 (DUSP4, Accession NM_001394) is a VGAM110 host target gene. DUSP4 BINDING SITE1 and DUSP4 BINDING SITE2 are HOST TARGET binding sites found in untranslated regions of mRNA encoded by DUSP4, corresponding to HOST TARGET binding sites such as BINDING SITE I, BINDING SITE II or BINDING SITE III. Table 2 illustrates the complementarity of the nucleotide sequences of DUSP4 BINDING SITE1 and DUSP4 BINDING SITE2, designated SEQ ID:7089 and SEQ ID:27664 respectively, to the nucleotide sequence of VGAM110 RNA, herein designated VGAM RNA, also designated SEQ ID:2821.

A function of VGAM110 is therefore inhibition of Dual Specificity Phosphatase 4 (DUSP4, Accession NM_001394), a gene which regulates mitogenic signal transduction. Accordingly, utilities of VGAM110 include diagnosis, prevention and treatment of diseases and clinical conditions associated with DUSP4. The function of DUSP4 has been established by previous studies. The VH1 phosphatase encoded by the vaccinia virus is a dual-specificity protein phosphatase that can dephosphorylate both serine/threonine and tyrosine residues. Cellular proteins homologous to VH1 are thought to regulate mitogen-activated protein (MAP) kinases. By screening a placenta library with a DUSP1 (OMIM Ref. No. 600714) cDNA, Guan and Butch (1995) identified cDNAs encoding DUSP4, which they called HVH2. Northern blot analysis revealed that DUSP4 is expressed as 2.5- and 6-kb mRNAs in placenta and, at lower levels, in pancreas. The sequence of the predicted 394-amino acid DUSP4 protein was 62% and 55% identical to those of DUSP1 and PAC1, respectively. Like DUSP1 and DUSP6 (OMIM Ref. No. 602748), the N-terminal region of DUSP4 shares significant identity with CDC25 (OMIM Ref. No. 157680). By immunofluorescence of mammalian cells expressing epitope-tagged protein, Guan and Butch (1995) found that DUSP4 was localized within the nucleus. Purified recombinant DUSP4 specifically hydrolyzed the phosphothreonine and phosphotyrosine residues of the activated MAP kinases ERK1 (OMIM Ref. No. 601795) and ERK2 (OMIM Ref. No. 176948). Expression of DUSP4 in mammalian cells blocked activation of a MAP kinase-regulated reporter gene. These results led Guan and Butch (1995) to suggest that DUSP4 plays a role in the MAP kinase signal transduction pathway. By fluorescence in situ hybridization, Smith et al. (1997) mapped the DUSP4 gene to 8p12-p11.

Full details of the abovementioned studies are described in the following publications, the disclosure of which are hereby incorporated by reference:

Guan, K.-L.; Butch, E.: Isolation and characterization of a novel dual specific phosphatase, HVH2, which selectively dephosphorylates the mitogen-activated protein kinase. J. Biol. Chem. 270:7197-7203, 1995; and Smith, A.; Price, C.; Cullen, M.; Muda, M.; King, A.; Ozanne, B.; Arkinstall, S.; Ashworth, A.: Chromosomal localization of three human dual specificity phosphatase genes (DUSP4, DUSP6.

Further studies establishing the function and utilities of DUSP4 are found in John Hopkins OMIM database record ID 602747, and in sited publications numbered 2408-2409 listed in the bibliography section hereinbelow, which are also hereby incorporated by reference. Fibroblast Growth Factor 13 (FGF13, Accession NM_033642) is another VGAM110 host target gene. FGF13 BINDING SITE is HOST TARGET binding site found in the 3' untranslated region of mRNA encoded by FGF13, corresponding to a HOST TARGET binding site such as BINDING SITE I, BINDING SITE II or BINDING SITE III. Table 2 illustrates the complementarity of the nucleotide sequences of FGF13 BINDING SITE, designated SEQ ID:27361, to the nucleotide sequence of VGAM110 RNA, herein designated VGAM RNA, also designated SEQ ID:2821.

Another function of VGAM110 is therefore inhibition of Fibroblast Growth Factor 13 (FGF13, Accession NM_033642), a gene which probably involved in nervous system development and function. Accordingly, utilities of VGAM110 include diagnosis, prevention and treatment of diseases and clinical conditions associated with FGF13. The function of FGF13 has been established by previous studies. See fibroblast growth factor-12 (FGF12; 601513). By Southern blot hybridization of genomic DNA from rodent/human hybrid cell lines carrying individual human chromosomes, Smallwood et al. (1996) mapped the FHF2 gene (also symbolized FGF13) to the X chromosome. By using an interspecific backcross mapping panel, they demonstrated that the mouse gene, Fhf2, shows no recombination with the gene for CD40 antigen ligand (OMIM Ref. No. 300386). Thus the human gene is probably located at Xq26. By use of isotopic in situ hybridization, Lovec et al. (1997) assigned the FHF2 gene to Xq21. Gecz et al. (1999), however, provided evidence that the FHF2 gene is located in Xq26.3. They identified a male patient with features of Borjeson-Forssman-Lehmann syndrome (BFLS; 301900) and a duplication of the Xq26-q28 region. By FISH using YAC clones from Xq26, they localized the duplication breakpoint to an interval of approximately 400 kb in the Xq26.3 region between DXS155 and DXS294/DXS730. Database searches and an analysis of available genomic sequence from the region showed that the FHF2 gene is located within the duplication breakpoint interval. Gecz et al. (1999) determined the structure of the FHF2 gene and identified 2 new exons, including a new 5-prime end exon, designated 1B. FHF2 is a large gene, extending over approximately 200 kb in Xq26.3, and contains at least 7 exons. It shows tissue-specific alternative splicing and alternative transcription starts. Northern blot hybridization showed highest expression in brain and skeletal muscle. The localization and tissue-specific expression pattern of FHF2 made it a possible candidate gene for familial cases of BFLS and for other syndromal and nonspecific forms of X-linked mental retardation mapping to that region.

Full details of the abovementioned studies are described in the following publications, the disclosure of which are hereby incorporated by reference:

Gecz, J.; Baker, E.; Donnelly, A.; Ming, J. E.; McDonald-McGinn, D. M.; Spinner, N. B.; Zackai, E. H.; Sutherland, G. R.; Mulley, J. C.: Fibroblast growth factor homologous factor 2 (FHF2): gene structure, expression and mapping to the Borjeson-Forssman-Lehmann syndrome region in Xq26 delineated by a duplication breakpoint in a BFLS-like patient. Hum. Genet. 104:56-63, 1999; and Lovec, H.; Hartung, H.; Verdier, A.-S.; Mattei, M.-G.; Birnbaum, D.; Goldfarb, M.; Coulier, F.: Assignment of FGF13 to human chromosome band Xq21 by in situ hybridization. Cytogenet.

Further studies establishing the function and utilities of FGF13 are found in John Hopkins OMIM database record ID 300070, and in sited publications numbered 9084-9086 listed in the bibliography section hereinbelow, which are also hereby incorporated by reference. IQ Motif Containing GTPase Activating Protein 2 (IQGAP2, Accession NM_006633) is another VGAM110 host target gene. IQGAP2 BINDING SITE is HOST TARGET binding site found in the 3' untranslated region of mRNA encoded by IQGAP2, corresponding to a HOST TARGET binding site such as BINDING SITE I, BINDING SITE II or BINDING SITE III. Table 2 illustrates the complementarity of the nucleotide sequences of IQGAP2 BINDING SITE, designated SEQ ID:13427, to the nucleotide sequence of VGAM110 RNA, herein designated VGAM RNA, also designated SEQ ID:2821.

Another function of VGAM110 is therefore inhibition of IQ Motif Containing GTPase Activating Protein 2 (IQGAP2, Accession NM_006633), a gene which Inhibits GTPase activity of Cdc42 and Rac1. Accordingly, utilities of VGAM110 include diagnosis, prevention and treatment of diseases and clinical conditions associated with IQGAP2. The function of IQGAP2 has been established by previous studies. Sugimoto et al. (2001) demonstrated that IQGAP1, a negative regulator of cell-cell adhesion, is upregulated by gene amplification at 15q26 in 2 gastric cancer cell lines. Amplification at 15q26 had been found in various malignancies, including breast cancers, and FES (OMIM Ref. No. 190030) and/or IGF1R (OMIM Ref. No. 147370) had been identified as targets for gene amplification in breast cancer, melanoma, and pancreatic adenocarcinoma. In contrast, Sugimoto et al. (2001) found that both genes are located telomeric to the amplicon at 15q26 in the 2 gastric cancer cell lines they studied. Fukata et al. (2002) found that IQGAP1, an effector of RAC1 (OMIM Ref. No. 602048) and CDC42, interacts with CLIP170 (RSN; 179838). In Vero fibroblasts, IQGAP1 localized at the polarized leading edge. Expression of a C-terminal fragment of IQGAP1 that included the CLIP170-binding region delocalized GFP-CLIP170 from the tips of microtubules and altered the microtubule array. The authors found that activated RAC1/CDC42, IQGAP1, and CLIP170 form a tripartite complex. Furthermore, expression of an IQGAP1 mutant defective in RAC1/CDC42 binding induced multiple leading edges. These results indicated that RAC1/CDC42 marks special cortical spots where the IQGAP1 and CLIP170 complex is targeted, leading to a polarized microtubule array and cell polarization.

Full details of the abovementioned studies are described in the following publications, the disclosure of which are hereby incorporated by reference:

Sugimoto, N.; Imoto, I.; Fukuda, Y.; Kurihara, N.; Kuroda, S.; Tanigami, A.; Kaibuchi, K.; Kamiyama, R.; Inazawa, J.: IQGAP1, a negative regulator of cell-cell adhesion, is upregulated by gene amplification at 15q26 in gastric cancer cell lines HSC39 and 40A. J. Hum. Genet. 46:21-25, 2001; and Fukata, M.; Watanabe, T.; Noritake, J.; Nakagawa, M.; Yamaga, M.; Kuroda, S.; Matsuura, Y.; Iwamatsu, A.; Perez, F.; Kaibuchi, K.: Rac1 and Cdc42 capture microtubules through IQGAP1 an.

Further studies establishing the function and utilities of IQGAP2 are found in John Hopkins OMIM database record ID 605401, and in sited publications numbered 7315 listed in the bibliography section hereinbelow, which are also hereby incorporated by reference. Interleukin-1 Receptor-associated Kinase 1 (IRAK1, Accession NM_001569) is another VGAM110 host target gene. IRAK1 BINDING SITE is HOST TARGET binding site found in the 3' untranslated region of mRNA encoded by IRAK1, corresponding to a HOST TARGET binding site such as BINDING SITE I, BINDING SITE II or BINDING SITE III. Table 2 illustrates the complementarity of the nucleotide sequences of IRAK1 BINDING SITE, designated SEQ ID:7297, to the nucleotide sequence of VGAM110 RNA, herein designated VGAM RNA, also designated SEQ ID:2821.

Another function of VGAM110 is therefore inhibition of Interleukin-1 Receptor-associated Kinase 1 (IRAK1, Accession NM_001569). Accordingly, utilities of VGAM110 include diagnosis, prevention and treatment of diseases and clinical conditions associated with IRAK1. Kelch-like 2, Mayven (Drosophila) (KLHL2, Accession NM_007246) is another VGAM110 host target gene. KLHL2 BINDING SITE is HOST TARGET binding site found in the 3' untranslated region of mRNA encoded by KLHL2, corresponding to a HOST TARGET binding site such as BINDING SITE I, BINDING SITE II or BINDING SITE III. Table 2 illustrates the complementarity of the nucleotide sequences of KLHL2 BINDING SITE, designated SEQ ID:14111, to the nucleotide sequence of VGAM110 RNA, herein designated VGAM RNA, also designated SEQ ID:2821.

Another function of VGAM110 is therefore inhibition of Kelch-like 2, Mayven (Drosophila) (KLHL2, Accession NM_007246). Accordingly, utilities of VGAM110 include diagnosis, prevention and treatment of diseases and clinical conditions associated with KLHL2. Oligophrenin 1 (OPHN1, Accession NM_002547) is another VGAM110 host target gene. OPHN1 BINDING SITE is HOST TARGET binding site found in the 3' untranslated region of mRNA encoded by OPHN1, corresponding to a HOST TARGET binding site such as BINDING SITE I, BINDING SITE II or BINDING SITE III. Table 2 illustrates the complementarity of the nucleotide sequences of OPHN1 BINDING SITE, designated SEQ ID:8399, to the nucleotide sequence of VGAM110 RNA, herein designated VGAM RNA, also designated SEQ ID:2821.

Another function of VGAM110 is therefore inhibition of Oligophrenin 1 (OPHN1, Accession NM_002547). Accordingly, utilities of VGAM110 include diagnosis, prevention and treatment of diseases and clinical conditions associated with OPHN1. Williams-Beuren Syndrome Chromosome Region 1 (WBSCR1, Accession NM_022170) is another VGAM110 host target gene. WBSCR1 BINDING SITE1 and WBSCR1 BINDING SITE2 are HOST TARGET binding sites found in untranslated regions of mRNA encoded by WBSCR1, corresponding to HOST TARGET binding sites such as BINDING SITE I, BINDING SITE II or BINDING SITE III. Table 2 illustrates the complementarity of the nucleotide sequences of WBSCR1 BINDING SITE1 and WBSCR1 BINDING SITE2, designated SEQ ID:22725 and SEQ ID:25708 respectively, to the nucleotide sequence of VGAM110 RNA, herein designated VGAM RNA, also designated SEQ ID:2821.

Another function of VGAM110 is therefore inhibition of Williams-Beuren Syndrome Chromosome Region 1 (WBSCR1, Accession NM_022170), a gene which stimulates protein translation. Accordingly, utilities of VGAM110 include diagnosis, prevention and treatment of diseases and clinical conditions associated with WBSCR1. The function of WBSCR1 has been established by previous studies. Williams-Beuren syndrome (WBS; 194050) is a multisystem developmental disorder caused by the deletion of contiguous genes at 7q11.23. Osborne et al. (1996) characterized a 500-kb region in 7q11.23 that was deleted in a collection of 30 WBS patients. They constructed a detailed physical map of the region consisting of cosmids, P1 artificial chromosomes, and yeast artificial chromosomes. They identified 9 transcription units from the area, including the previously characterized genes ELN (OMIM Ref. No. 130160), LIMK1 (OMIM Ref. No. 601329), and RFC2 (OMIM Ref. No. 600404), and the novel genes WSCR1 and WSCR4 (OMIM Ref. No. 603432). The WSCR1 gene has 6 exons which contain an open reading frame encoding 232 amino acids, including an RNA-binding domain consensus sequence. Northern blot analysis detected a 2.5-kb WBSCR1 transcript in all human cell lines analyzed. Richter-Cook et al. (1998) identified the eukaryotic initiation factor (EIF) 4H protein from rabbit reticulocyte lysate on the basis of its ability to stimulate translation in an in vitro globin synthesis assay deficient in EIF4B (OMIM Ref. No. 603928) and EIF4F. Amino acid sequence analysis of 3 EIF4H tryptic fragments revealed 100% sequence identity to the human WBSCR1 protein. The authors demonstrated that the 25-kD rabbit EIF4H protein stimulates the in vitro activities of EIF4B and EIF4F in globin synthesis, as well as the in vitro RNA-dependent ATPase activities of EIF4A (e.g., 601102), EIF4B, and EIF4F.

Full details of the abovementioned studies are described in the following publications, the disclosure of which are hereby incorporated by reference:

Osborne, L. R.; Martindale, D.; Scherer, S. W.; Shi, X.-M.; Huizenga, J.; Heng, H. H. Q.; Costa, T.; Pober, B.; Lew, L.; Brinkman, J.; Rommens, J.; Koop, B.; Tsui, L.-C.: Identification of genes from a 500-kb region at 7q11.23 that is commonly deleted in Williams syndrome patients. Genomics 36:328-336, 1996; and Richter-Cook, N. J.; Dever, T. E.; Hensold, J. O.; Merrick, W. C.: Purification and characterization of a new eukaryotic protein translation factor: eukaryotic initiation factor 4H. J.

Further studies establishing the function and utilities of WBSCR1 are found in John Hopkins OMIM database record ID 603431, and in sited publications numbered 10456 listed in the bibliography section hereinbelow, which are also hereby incorporated by reference. UDP-GlcNAc:betaGal Beta-1,3-N-acetylglucosaminyltransferase 5 (B3GNT5, Accession NM_032047) is another VGAM110 host target gene. B3GNT5 BINDING SITE is HOST TARGET binding site found in the 3' untranslated region of mRNA encoded by B3GNT5, corresponding to a HOST TARGET binding site such as BINDING SITE I, BINDING SITE II or BINDING SITE III. Table 2 illustrates the complementarity of the nucleotide sequences of B3GNT5 BINDING SITE, designated SEQ ID:25763, to the nucleotide sequence of VGAM110 RNA, herein designated VGAM RNA, also designated SEQ ID:2821.

Another function of VGAM110 is therefore inhibition of UDP-GlcNAc:betaGal Beta-1,3-N-acetylglucosaminyltransferase 5 (B3GNT5, Accession NM_032047). Accordingly, utilities of VGAM110 include diagnosis, prevention and treatment of diseases and clinical conditions associated with B3GNT5. FEM-2 (Accession NM_014634) is another VGAM110 host target gene. FEM-2 BINDING SITE is HOST TARGET binding site found in the 3' untranslated region of mRNA encoded by FEM-2, corresponding to a HOST TARGET binding site such as BINDING SITE I, BINDING SITE II or BINDING SITE III. Table 2 illustrates the complementarity of the nucleotide sequences of FEM-2 BINDING SITE, designated SEQ ID:16005, to the nucleotide sequence of VGAM110 RNA, herein designated VGAM RNA, also designated SEQ ID:2821.

Another function of VGAM110 is therefore inhibition of FEM-2 (Accession NM_014634). Accordingly, utilities of VGAM110 include diagnosis, prevention and treatment of diseases and clinical conditions associated with FEM-2. FLJ11259 (Accession NM_018370) is another VGAM110 host target gene. FLJ11259 BINDING SITE is HOST TARGET binding site found in the 3' untranslated region of mRNA encoded by FLJ11259, corresponding to a HOST TARGET binding site such as BINDING SITE I, BINDING SITE II or BINDING SITE III. Table 2 illustrates the complementarity of the nucleotide sequences of FLJ11259 BINDING SITE, designated SEQ ID:20380, to the nucleotide sequence of VGAM110 RNA, herein designated VGAM RNA, also designated SEQ ID:2821.

Another function of VGAM110 is therefore inhibition of FLJ11259 (Accession NM_018370). Accordingly, utilities of VGAM110 include diagnosis, prevention and treatment of diseases and clinical conditions associated with FLJ11259. FLJ14437 (Accession NM_032578) is another VGAM110 host target gene. FLJ14437 BINDING SITE is HOST TARGET binding site found in the 3' untranslated region of mRNA encoded by FLJ14437, corresponding to a HOST TARGET binding site such as BINDING SITE I, BINDING SITE II or BINDING SITE III. Table 2 illustrates the complementarity of the nucleotide sequences of FLJ14437 BINDING SITE, designated SEQ ID:26305, to the nucleotide sequence of VGAM110 RNA, herein designated VGAM RNA, also designated SEQ ID:2821.

Another function of VGAM110 is therefore inhibition of FLJ14437 (Accession NM_032578). Accordingly, utilities of VGAM110 include diagnosis, prevention and treatment of diseases and clinical conditions associated with FLJ14437. KIAA0459 (Accession XM_027862) is another VGAM110 host target gene. KIAA0459 BINDING SITE is HOST TARGET binding site found in the 3' untranslated region of mRNA encoded by KIAA0459, corresponding to a HOST TARGET binding site such as BINDING SITE I, BINDING SITE II or BINDING SITE III. Table 2 illustrates the complementarity of the nucleotide sequences of KIAA0459 BINDING SITE, designated SEQ ID:30570, to the nucleotide sequence of VGAM110 RNA, herein designated VGAM RNA, also designated SEQ ID:2821.

Another function of VGAM110 is therefore inhibition of KIAA0459 (Accession XM_027862). Accordingly, utilities of VGAM110 include diagnosis, prevention and treatment of diseases and clinical conditions associated with KIAA0459. KIAA0547 (Accession NM_014793) is another VGAM110 host target gene. KIAA0547 BINDING SITE is HOST TARGET binding site found in the 3' untranslated region of mRNA encoded by KIAA0547, corresponding to a HOST TARGET binding site such as BINDING SITE I, BINDING SITE II or BINDING SITE III. Table 2 illustrates the complementarity of the nucleotide sequences of KIAA0547 BINDING SITE, designated SEQ ID:16697, to the nucleotide sequence of VGAM110 RNA, herein designated VGAM RNA, also designated SEQ ID:2821.

Another function of VGAM110 is therefore inhibition of KIAA0547 (Accession NM_014793). Accordingly, utilities of VGAM110 include diagnosis, prevention and treatment of diseases and clinical conditions associated with KIAA0547. KIAA1762 (Accession XM_033370) is another VGAM110 host target gene. KIAA1762 BINDING SITE is HOST TARGET binding site found in the 3' untranslated region of mRNA encoded by KIAA1762, corresponding to a HOST TARGET binding site such as BINDING SITE I, BINDING SITE II or BINDING SITE III. Table 2 illustrates the complementarity of the nucleotide sequences of KIAA1762 BINDING SITE, designated SEQ ID:31908, to the nucleotide sequence of VGAM110 RNA, herein designated VGAM RNA, also designated SEQ ID:2821.

Another function of VGAM110 is therefore inhibition of KIAA1762 (Accession XM_033370). Accordingly, utilities of VGAM110 include diagnosis, prevention and treatment of diseases and clinical conditions associated with KIAA1762. KIAA1951 (Accession XM_057401) is another VGAM110 host target gene. KIAA1951 BINDING SITE is HOST TARGET binding site found in the 3' untranslated region of mRNA encoded by KIAA1951, corresponding to a HOST TARGET binding site such as BINDING SITE I, BINDING SITE II or BINDING SITE III. Table 2 illustrates the complementarity of the nucleotide sequences of KIAA1951 BINDING SITE, designated SEQ ID:36511, to the nucleotide sequence of VGAM110 RNA, herein designated VGAM RNA, also designated SEQ ID:2821.

Another function of VGAM110 is therefore inhibition of KIAA1951 (Accession XM_057401). Accordingly, utilities of VGAM110 include diagnosis, prevention and treatment of diseases and clinical conditions associated with KIAA1951. LOC145900 (Accession XM_085276) is another VGAM110 host target gene. LOC145900 BINDING SITE is HOST TARGET binding site found in the 3' untranslated region of mRNA encoded by LOC145900, corresponding to a HOST TARGET binding site such as BINDING SITE I, BINDING SITE II or BINDING SITE III. Table 2 illustrates the complementarity of the nucleotide sequences of LOC145900 BINDING SITE, designated SEQ ID:38010, to the nucleotide sequence of VGAM110 RNA, herein designated VGAM RNA, also designated SEQ ID:2821.

Another function of VGAM110 is therefore inhibition of LOC145900 (Accession XM_085276). Accordingly, utilities of VGAM110 include diagnosis, prevention and treatment of diseases and clinical conditions associated with LOC145900. LOC150933 (Accession XM_097971) is another VGAM110 host target gene. LOC150933 BINDING SITE is HOST TARGET binding site found in the 3' untranslated region of mRNA encoded by LOC150933, corresponding to a HOST TARGET binding site such as BINDING SITE I, BINDING SITE II or BINDING SITE III. Table 2 illustrates the complementarity of the nucleotide sequences of LOC150933 BINDING SITE, designated SEQ ID:41269, to the nucleotide sequence of VGAM110 RNA, herein designated VGAM RNA, also designated SEQ ID:2821.

Another function of VGAM110 is therefore inhibition of LOC150933 (Accession XM_097971). Accordingly, utilities of VGAM110 include diagnosis, prevention and treatment of diseases and clinical conditions associated with LOC150933. LOC152876 (Accession XM_098279) is another VGAM110 host target gene. LOC152876 BINDING SITE is HOST TARGET binding site found in the 5' untranslated region of mRNA encoded by LOC152876, corresponding to a HOST TARGET binding site such as BINDING SITE I, BINDING SITE II or BINDING SITE III. Table 2 illustrates the complementarity of the nucleotide sequences of LOC152876 BINDING SITE, designated SEQ ID:41559, to the nucleotide sequence of VGAM110 RNA, herein designated VGAM RNA, also designated SEQ ID:2821.

Another function of VGAM110 is therefore inhibition of LOC152876 (Accession XM_098279). Accordingly, utilities of VGAM110 include diagnosis, prevention and treatment of diseases and clinical conditions associated with LOC152876. LOC254936 (Accession XM_170770) is another VGAM110 host target gene. LOC254936 BINDING SITE is HOST TARGET binding site found in the 3' untranslated region of mRNA encoded by LOC254936, corresponding to a HOST TARGET binding site such as BINDING SITE I, BINDING SITE II or BINDING SITE III. Table 2 illustrates the complementarity of the nucleotide sequences of LOC254936 BINDING SITE, designated SEQ ID:45525, to the nucleotide sequence of VGAM110 RNA, herein designated VGAM RNA, also designated SEQ ID:2821.

Another function of VGAM110 is therefore inhibition of LOC254936 (Accession XM_170770). Accordingly, utilities of VGAM110 include diagnosis, prevention and treatment of diseases and clinical conditions associated with LOC254936. LOC256867 (Accession XM_170694) is another VGAM110 host target gene. LOC256867 BINDING SITE is HOST TARGET binding site found in the 5' untranslated region of mRNA encoded by LOC256867, corresponding to a HOST TARGET binding site such as BINDING SITE I, BINDING SITE II or BINDING SITE III. Table 2 illustrates the complementarity of the nucleotide sequences of LOC256867 BINDING SITE, designated SEQ ID:45469, to the nucleotide sequence of VGAM110 RNA, herein designated VGAM RNA, also designated SEQ ID:2821.

Another function of VGAM110 is therefore inhibition of LOC256867 (Accession XM_170694). Accordingly, utilities of VGAM110 include diagnosis, prevention and treatment of diseases and clinical conditions associated with LOC256867. LOC90190 (Accession XM_029758) is another VGAM110 host target gene. LOC90190 BINDING SITE is HOST TARGET binding site found in the 3' untranslated region of mRNA encoded by LOC90190, corresponding to a HOST TARGET binding site such as BINDING SITE I, BINDING SITE II or BINDING SITE III. Table 2 illustrates the complementarity of the nucleotide sequences of LOC90190 BINDING SITE, designated SEQ ID:30944, to the nucleotide sequence of VGAM110 RNA, herein designated VGAM RNA, also designated SEQ ID:2821.

Another function of VGAM110 is therefore inhibition of LOC90190 (Accession XM_029758). Accordingly, utilities of VGAM110 include diagnosis, prevention and treatment of diseases and clinical conditions associated with LOC90190. LOC90639 (Accession XM_033092) is another VGAM110 host target gene. LOC90639 BINDING SITE is HOST TARGET binding site found in the 5' untranslated region of mRNA encoded by LOC90639, corresponding to a HOST TARGET binding site such as BINDING SITE I, BINDING SITE II or BINDING SITE III. Table 2 illustrates the complementarity of the nucleotide sequences of LOC90639 BINDING SITE, designated SEQ ID:31831, to the nucleotide sequence of VGAM110 RNA, herein designated VGAM RNA, also designated SEQ ID:2821.

Another function of VGAM110 is therefore inhibition of LOC90639 (Accession XM_033092). Accordingly, utilities of VGAM110 include diagnosis, prevention and treatment of diseases and clinical conditions associated with LOC90639.

FIG. 1 further provides a conceptual description of a novel bioinformatically detected viral gene of the present invention, referred to here as Viral Genomic Address Messenger 111 (VGAM111) viral gene, which modulates expression of respective host target genes thereof, the function and utility of which host target genes is known in the art.

VGAM111 is a novel bioinformatically detected regulatory, non protein coding, viral micro RNA (miRNA) gene. The method by which VGAM111 was detected is described hereinabove with reference to FIGS. 1-8.

VGAM111 gene, herein designated VGAM GENE, is a viral gene contained in the genome of Shrimp White Spot Syndrome Virus (white spot bacilliform virus). VGAM111 host target gene, herein designated VGAM HOST TARGET GENE, is a human gene contained in the human genome.

VGAM111 gene encodes a VGAM111 precursor RNA, herein designated VGAM PRECURSOR RNA. Similar to other miRNA genes, and unlike most ordinary genes, VGAM111 precursor RNA does not encode a protein. A nucleotide sequence identical or highly similar to the nucleotide sequence of VGAM111 precursor RNA is designated SEQ ID:97, and is provided hereinbelow with reference to the sequence listing part. Nucleotide sequence SEQ ID:97 is located at position 193387 relative to the genome of Shrimp White Spot Syndrome Virus (white spot bacilliform virus).

VGAM111 precursor RNA folds onto itself, forming VGAM111 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM111 folded precursor RNA into VGAM111 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM111 RNA is designated SEQ ID:2822, and is provided hereinbelow with reference to the sequence listing part.

VGAM111 host target gene, herein designated VGAM HOST TARGET GENE, encodes a corresponding messenger RNA, VGAM111 host target RNA, herein designated VGAM HOST TARGET RNA. VGAM111 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM111 RNA, herein designated VGAM RNA, binds complementarily to one or more host target binding sites located in untranslated regions of VGAM111 host target RNA, herein designated VGAM HOST TARGET RNA. This complementary binding is due to the fact that the nucleotide sequence of VGAM111 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM111 RNA, herein designated VGAM RNA, may have a different number of host target binding sites in untranslated regions of a VGAM111 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM111 RNA, herein designated VGAM RNA, to host target binding sites on VGAM111 host target RNA, herein designated VGAM HOST TARGET RNA, such as BINDING SITE I, BINDING SITE II and BINDING SITE III, inhibits translation of VGAM111 host target RNA into VGAM111 host target protein, herein designated VGAM HOST TARGET PROTEIN. VGAM host target protein is therefore outlined by a broken line.

It is appreciated that VGAM111 host target gene, herein designated VGAM HOST TARGET GENE, in fact represents a plurality of VGAM111 host target genes. The mRNA of each one of this plurality of VGAM111 host target genes comprises one or more host target binding sites, each having a nucleotide sequence which is at least partly complementary to VGAM111 RNA, herein designated VGAM RNA, and which when bound by VGAM111 RNA causes inhibition of translation of respective one or more VGAM111 host target proteins.

It is further appreciated by one skilled in the art that the mode of translational inhibition illustrated by FIG. 1 with specific reference to translational inhibition exerted by VGAM111 gene, herein designated VGAM GENE, on one or more VGAM111 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM111 is inhibition of expression of host target genes, as part of a novel viral mechanism of attacking a host. Accordingly, utilities of VGAM111 include diagnosis, prevention and treatment of viral infection by Shrimp White Spot Syndrome Virus (white spot bacilliform virus). Specific functions, and accordingly utilities, of VGAM111 correlate with, and may be deduced from, the identity of the host target genes which VGAM111 binds and inhibits, and the function of these host target genes, as elaborated hereinbelow.

Nucleotide sequences of the VGAM111 precursor RNA, herein designated VGAM PRECURSOR RNA, and of the 'diced' VGAM111 RNA, herein designated VGAM RNA, and a schematic representation of the secondary folding of VGAM111 folded precursor RNA, herein designated VGAM FOLDED PRECURSOR RNA, of VGAM111 are further described hereinbelow with reference to Table 1.

Nucleotide sequences of host target binding sites, such as BINDING SITE-I, BINDING SITE-II and BINDING SITE-III of FIG. 1, found on VGAM111 host target RNA, and schematic representation of the complementarity of each of these host target binding sites to VGAM111 RNA, herein designated VGAM RNA, are described hereinbelow with reference to Table 2.

As mentioned hereinabove with reference to FIG. 1, a function of VGAM111 gene, herein designated VGAM is inhibition of expression of VGAM111 target genes. It is appreciated that specific functions, and accordingly utilities, of VGAM111 correlate with, and may be deduced from, the identity of the target genes which VGAM111 binds and inhibits, and the function of these target genes, as elaborated hereinbelow.

Glutamate Receptor, Ionotropic, N-methyl D-aspartate 2B (GRIN2B, Accession NM_000834) is a VGAM111 host target gene. GRIN2B BINDING SITE is HOST TARGET binding site found in the 5' untranslated region of mRNA encoded by GRIN2B, corresponding to a HOST TARGET binding site such as BINDING SITE I, BINDING SITE II or BINDING SITE III. Table 2 illustrates the complementarity of the nucleotide sequences of GRIN2B BINDING SITE, designated SEQ ID:6492, to the nucleotide sequence of VGAM111 RNA, herein designated VGAM RNA, also designated SEQ ID:2822.

A function of VGAM111 is therefore inhibition of Glutamate Receptor, Ionotropic, N-methyl D-aspartate 2B (GRIN2B, Accession NM_000834). Accordingly, utilities of VGAM111 include diagnosis, prevention and treatment of diseases and clinical conditions associated with GRIN2B. Potassium Large Conductance Calcium-activated Channel, Subfamily M Beta Member 3 (KCNMB3, Accession NM_014407) is another VGAM111 host target gene. KCNMB3 BINDING SITE is HOST TARGET binding site found in the 5' untranslated region of mRNA encoded by KCNMB3, corresponding to a HOST TARGET binding site such as BINDING SITE I, BINDING SITE II or BINDING SITE III. Table 2 illustrates the complementarity of the nucleotide sequences of KCNMB3 BINDING SITE, designated SEQ ID:15748, to the nucleotide sequence of VGAM111 RNA, herein designated VGAM RNA, also designated SEQ ID:2822.

Another function of VGAM111 is therefore inhibition of Potassium Large Conductance Calcium-activated Channel, Subfamily M Beta Member 3 (KCNMB3, Accession NM_014407), a gene which is similar to a regulatory subunit of Ca-activated potassium channel. Accordingly, utilities of VGAM111 include diagnosis, prevention and treatment of diseases and clinical conditions associated with KCNMB3. The function of KCNMB3 has been established by previous studies. The large conductance, calcium-activated potassium (BK) channel is a member of the Shaker-related 6-transmembrane domain potassium channel superfamily that is sensitive to voltage and calcium. BK channels are composed of a pore-forming alpha subunit (KCNMA1, or HSLO; 600150) and, in some tissues, a beta subunit. The beta-1 subunit (KCNMB1; 603951) is expressed predominantly in smooth muscle cells, whereas the beta-2 subunit (KCNMB2; 605214) is expressed in endocrine tissue, such as adrenal chromaffin cells Uebele et al. (2000) determined that KCNMB3 is a family of 4 related subunits, KCNMB3a (277 amino acids), KCNMB3b (257 amino acids), KCNMB3c (275 amino acids), and KCNMB3d (279 amino acids), that arise from alternative splicing. The subunits vary only in their cytoplasmic N-terminal sequences and share 256 C-terminal amino acids. Genomic sequence analysis determined that the KCNMB3 gene contains 6 exons, 3 of which (1a, 1b, and 1c/d) encode sequences unique to each of the splice variants. RT-PCR analysis showed that KCNMB3a has a relatively restricted distribution (spleen, placenta, pancreas, kidney, and heart), while the other variants are more widely expressed. KCNMB3c was notably abundant in pancreas. In situ hybridization analysis demonstrated that KCNMB3c expression is restricted to pancreatic beta cells. Coexpression of KCNMB3a, -b, and -c with KCNMA1 resulted in partial inactivation of activating currents; KCNMB3d did not induce detectable inactivation. By FISH and somatic cell hybrid analysis, Riazi et al. (1999) mapped the KCNMB3 gene to 3q26.3-q27. Uebele et al. (2000) also mapped the KCNMB3 gene to 3q26.3-q27.1, in close proximity to KCNMB2, by radiation hybrid and FISH analysis Full details of the abovementioned studies are described in the following publications, the disclosure of which are hereby incorporated by reference:

Behrens, R.; Nolting, A.; Reimann, F.; Schwarz, M.; Waldschutz, R.; Pongs, O.: hKCNMB3 and hKCNMB4, cloning and characterization of two members of the large-conductance calcium-activated potassium channel beta subunit family. FEBS Lett. 474:99-106, 2000; and Brenner, R.; Jegla, T. J.; Wickenden, A.; Liu, Y.; Aldrich, R. W.: Cloning and functional characterization of novel large conductance calcium-activated potassium channel beta subunits.

Further studies establishing the function and utilities of KCNMB3 are found in John Hopkins OMIM database record ID 605222, and in sited publications numbered 6974-697 and 6965 listed in the bibliography section hereinbelow, which are also hereby incorporated by reference. Membrane-spanning 4-domains, Subfamily A, Member 3 (hematopoietic cell-specific) (MS4A3, Accession NM_006138) is another VGAM111 host target gene. MS4A3 BINDING SITE is HOST TARGET binding site found in the 3' untranslated region of mRNA encoded by MS4A3, corresponding to a HOST TARGET binding site such as BINDING SITE I, BINDING SITE II or BINDING SITE III. Table 2 illustrates the complementarity of the nucleotide sequences of MS4A3 BINDING SITE, designated SEQ ID:12779, to the nucleotide sequence of VGAM111 RNA, herein designated VGAM RNA, also designated SEQ ID:2822.

Another function of VGAM111 is therefore inhibition of Membrane-spanning 4-domains, Subfamily A, Member 3 (hematopoietic cell-specific) (MS4A3, Accession NM_006138). Accordingly, utilities of VGAM111 include diagnosis, prevention and treatment of diseases and clinical conditions associated with MS4A3. Neuronal Pentraxin I (NPTX1, Accession NM_002522) is another VGAM111 host target gene. NPTX1 BINDING SITE is HOST TARGET binding site found in the 3' untranslated region of mRNA encoded by NPTX1, corresponding to a HOST TARGET binding site such as BINDING SITE I, BINDING SITE II or BINDING SITE III. Table 2 illustrates the complementarity of the nucleotide sequences of NPTX1 BINDING SITE, designated SEQ ID:8353, to the nucleotide sequence of VGAM111 RNA, herein designated VGAM RNA, also designated SEQ ID:2822.

Another function of VGAM111 is therefore inhibition of Neuronal Pentraxin I (NPTX1, Accession NM_002522), a gene which may be involved in synaptic uptake of extracellular material and is very strongly similar to rat NP1. Accordingly, utilities of VGAM111 include diagnosis, prevention and treatment of diseases and clinical conditions associated with NPTX1. The function of NPTX1 has been established by previous studies. See 600750. Neuronal pentraxin I (NP1) was identified in the rat as a binding protein for the snake venom toxin taipoxin (Schlimgen et al., 1995). Omeis et al. (1996) cloned the human NP1 homolog by screening a human cerebellar cDNA library with the rat NP1 gene as a probe. The gene, designated NPTX1, encodes a predicted 430-amino acid protein that is 95% identical to rat NP1. Northern blot analysis showed that the approximately 6-kb NPTX1 mRNA is expressed only in the brain. Omeis et al. (1996) used fluorescence in situ hybridization to map the NPTX1 gene to human chromosome 17q25.1-q25.2 and mouse chromosome 11e2-e1.3.

Full details of the abovementioned studies are described in the following publications, the disclosure of which are hereby incorporated by reference:

Omeis, I. A.; Hsu, Y.-C.; Perin, M. S.: Mouse and human neuronal pentraxin 1 (NPXT1): conservation, genomic structure, and chromosomal localization. Genomics 36:543-545, 1996; and Schlimgen, A. K.; Helms, J. A.; Vogel, H.; Perin, M. S.: Neuronal pentraxin, a secreted protein with homology to acute phase proteins of the immune system. Neuron 14:519-526, 1995.

Further studies establishing the function and utilities of NPTX1 are found in John Hopkins OMIM database record ID 602367, and in sited publications numbered 8933 listed in the bibliography section hereinbelow, which are also hereby incorporated by reference. Pyruvate Dehydrogenase Kinase, Isoenzyme 4 (PDK4, Accession XM_173198) is another VGAM111 host target gene. PDK4 BINDING SITE is HOST TARGET binding site found in the 3' untranslated region of mRNA encoded by PDK4, corresponding to a HOST TARGET binding site such as BINDING SITE I, BINDING SITE II or BINDING SITE III. Table 2 illustrates the complementarity of the nucleotide sequences of PDK4 BINDING SITE, designated SEQ ID:46441, to the nucleotide sequence of VGAM111 RNA, herein designated VGAM RNA, also designated SEQ ID:2822.

Another function of VGAM111 is therefore inhibition of Pyruvate Dehydrogenase Kinase, Isoenzyme 4 (PDK4, Accession XM_173198). Accordingly, utilities of VGAM111 include diagnosis, prevention and treatment of diseases and clinical conditions associated with PDK4. Selectin P (granule membrane protein 140 kDa, antigen CD62) (SELP, Accession NM_003005) is another VGAM111 host target gene. SELP BINDING SITE is HOST TARGET binding site found in the 3' untranslated region of mRNA encoded by SELP, corresponding to a HOST TARGET binding site such as BINDING SITE I, BINDING SITE II or BINDING SITE III. Table 2 illustrates the complementarity of the nucleotide sequences of SELP BINDING SITE, designated SEQ ID:8913, to the nucleotide sequence of VGAM111 RNA, herein designated VGAM RNA, also designated SEQ ID:2822.

Another function of VGAM111 is therefore inhibition of Selectin P (granule membrane protein 140 kDa, antigen CD62) (SELP, Accession NM_003005), a gene which mediates the interaction of activated endothelial cells or platelets with leukocytes. Accordingly, utilities of VGAM111 include diagnosis, prevention and treatment of diseases and clinical conditions associated with SELP. The function of SELP has been established by previous studies. P-selectin, also called GMP-140, CD62, or selectin P, is a 140-kD adhesion molecule, expressed at the surface of activated cells, that mediates the interaction of activated endothelial cells or platelets with leukocytes. McEver et al. (1989) used an immunoperoxidase procedure to examine the distribution of GMP-140 in human tissues. The protein was detected in megakaryocytes and platelets, as well as in vascular endothelial cells, but was not found in a variety of other cell types examined. In endothelial cells, the protein was localized to the membranes of Weibel-Palade bodies, the intracellular storage granules for von Willebrand factor. The gene for GMP-140 was cloned by Johnston et al. (1989). Johnston et al. (1990) found that the GMP140 gene spans over 50 kb and contains 17 exons. CD24 is a ligand for P-selectin; see 600074. Animal model experiments lend further support to the function of SELP. Mayadas et al. (1993) generated P-selectin-deficient mice by gene targeting in embryonic stem cells and found that they exhibited a number of defects in leukocyte behavior, including elevated numbers of circulating neutrophils, virtually total absence of leukocyte rolling in mesenteric venules, and delayed recruitment of neutrophils to the peritoneal cavity upon experimentally induced inflammation.

It is appreciated that the abovementioned animal model for SELP is acknowledged by those skilled in the art as a scientifically valid animal model, as can be further appreciated from the publications sited hereinbelow.

Full details of the abovementioned studies are described in the following publications, the disclosure of which are hereby incorporated by reference:

McEver, R. P.; Beckstead, J. H.; Moore, K. L.; Marshall-Carlson, L.; Bainton, D. F.: GMP-140, a platelet alpha-granule membrane protein, is also synthesized by vascular endothelial cells and is localized in Weibel-Palade bodies. J. Clin. Invest. 84:92-99, 1989; and Herrmann, S.-M.; Ricard, S.; Nicaud, V.; Mallet, C.; Evans, A.; Ruidavets, J.-B.; Arveiler, D.; Luc, G.; Cambien, F.: The P-selectin gene is highly polymorphic: reduced frequency of the.

Further studies establishing the function and utilities of SELP are found in John Hopkins OMIM database record ID 173610, and in sited publications numbered 11805-1710, 2123, 1150 and 11810 listed in the bibliography section hereinbelow, which are also hereby incorporated by reference. Vang-like 2 (van gogh, Drosophila) (VANGL2, Accession XM_049695) is another VGAM111 host target gene. VANGL2 BINDING SITE is HOST TARGET binding site found in the 3' untranslated region of mRNA encoded by VANGL2, corresponding to a HOST TARGET binding site such as BINDING SITE I, BINDING SITE II or BINDING SITE III. Table 2 illustrates the complementarity of the nucleotide sequences of VANGL2 BINDING SITE, designated SEQ ID:35481, to the nucleotide sequence of VGAM111 RNA, herein designated VGAM RNA, also designated SEQ ID:2822.

Another function of VGAM111 is therefore inhibition of Vang-like 2 (van gogh, Drosophila) (VANGL2, Accession XM_049695), a gene which may take part in defining the lateral boundary of floorplate differentiation. Accordingly, utilities of VGAM111 include diagnosis, prevention and treatment of diseases and clinical conditions associated with VANGL2. The function of VANGL2 has been established by previous studies. Murdoch et al. (2001) independently cloned the causative gene for craniorachischisis in Lp mice, which they named Lpp1. A single base transition, 1841G-A, resulted in a ser464-to-asn substitution. Lpp1 is expressed in the ventral part of the developing neural tube, but is excluded from the floorplate where Sonic hedgehog (Shh; 600725) is expressed. Embryos lacking Shh express Lpp1 throughout the ventral neural tube, suggesting negative regulation of Lpp1 by Shh. The authors suggested that the mutual interaction between Lpp1 and Shh may define the lateral boundary of floorplate differentiation. They hypothesized that loss of Lpp1 function may disrupt neurulation by permitting more extensive floorplate induction by Shh, thereby inhibiting midline bending of the neural plate during initiation of neurulation. The human ortholog of Lpp1, which maps to chromosome 1, shares 89% identity with the mouse gene at the nucleotide level and 99% identity at the amino acid level. Animal model experiments lend further support to the function of VANGL2. 'Loop-tail' (Lp) is a semidominant mouse mutation that, in homozygous mutants, causes a severe form of neural tube defect called craniorachischisis. Heterozygous mice exhibit a characteristic looped tail, and homozygous embryos show a completely open neural tube in the hindbrain and spinal region. Kibar et al. (2001) used a positional cloning approach to identify the Lp gene. By an in silico search, the authors identified a mouse EST within the Lp interval homologous to a partial human cDNA clone KIAA1215. Based on its relationship to the mouse disorder, Kibar et al. (2001) used the temporary designation 'loop-tail-associated protein' (Ltap). The Ltap gene encodes a homolog of Drosophila 'strabismus/Van Gogh' (Stbm/Vang), a component of the frizzled-disheveled tissue polarity pathway. Ltap is expressed broadly in the neuroectoderm throughout early neurogenesis. This and the fact that the gene was altered in 2 independent Lp alleles identified it as the likely basis for loop-tail. The authors suggested that the human Ltap homolog is worthy of search for mutations that may be associated with sporadic or familial cases of neural tube defects in human S.

It is appreciated that the abovementioned animal model for VANGL2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Murdoch, J. N.; Doudney, K.; Paternotte, C.; Copp, A. J.; Stanier, P.: Severe neural tube defects in the loop-tail mouse result from mutation of Lpp1, a novel gene involved in floor plate specification. Hum. Molec. Genet. 10:2593-2601, 2001; and Kibar, Z.; Vogan, K. J.; Groulx, N.; Justice, M. J.; Underhill, D. A.; Gros, P.: Ltap, a mammalian homolog of Drosophila Strabismus/Van Gogh, is altered in the mouse neural tube mutant lo.

Further studies establishing the function and utilities of VANGL2 are found in John Hopkins OMIM database record ID 600533, and in sited publications numbered 7767-7771 listed in the bibliography section hereinbelow, which are also hereby incorporated by reference. ADMP (Accession NM_145035) is another VGAM111 host target gene. ADMP BINDING SITE is HOST TARGET binding site found in the 5' untranslated region of mRNA encoded by ADMP, corresponding to a HOST TARGET binding site such as BINDING SITE I, BINDING SITE II or BINDING SITE III. Table 2 illustrates the complementarity of the nucleotide sequences of ADMP BINDING SITE, designated SEQ ID:29656, to the nucleotide sequence of VGAM111 RNA, herein designated VGAM RNA, also designated SEQ ID:2822.

Another function of VGAM111 is therefore inhibition of ADMP (Accession NM_145035). Accordingly, utilities of VGAM111 include diagnosis, prevention and treatment of diseases and clinical conditions associated with ADMP. V-akt Murine Thymoma Viral Oncogene Homolog 3 (protein kinase B, gamma) (AKT3, Accession NM_005465) is another VGAM111 host target gene. AKT3 BINDING SITE is HOST TARGET binding site found in the 3' untranslated region of mRNA encoded by AKT3, corresponding to a HOST TARGET binding site such as BINDING SITE I, BINDING SITE II or BINDING SITE III. Table 2 illustrates the complementarity of the nucleotide sequences of AKT3 BINDING SITE, designated SEQ ID:11958, to the nucleotide sequence of VGAM111 RNA, herein designated VGAM RNA, also designated SEQ ID:2822.

Another function of VGAM111 is therefore inhibition of V-akt Murine Thymoma Viral Oncogene Homolog 3 (protein kinase B, gamma) (AKT3, Accession NM_005465). Accordingly, utilities of VGAM111 include diagnosis, prevention and treatment of diseases and clinical conditions associated with AKT3. Aquaporin 9 (AQP9, Accession NM_020980) is another VGAM111 host target gene. AQP9 BINDING SITE is HOST TARGET binding site found in the 3' untranslated region of mRNA encoded by AQP9, corresponding to a HOST TARGET binding site such as BINDING SITE I, BINDING SITE II or BINDING SITE III. Table 2 illustrates the complementarity of the nucleotide sequences of AQP9 BINDING SITE, designated SEQ ID:21967, to the nucleotide sequence of VGAM111 RNA, herein designated VGAM RNA, also designated SEQ ID:2822.

Another function of VGAM111 is therefore inhibition of Aquaporin 9 (AQP9, Accession NM_020980). Accordingly, utilities of VGAM111 include diagnosis, prevention and treatment of diseases and clinical conditions associated with AQP9. ATPase, Class II, Type 9A (ATP9A, Accession XM_030577) is another VGAM111 host target gene. ATP9A BINDING SITE is HOST TARGET binding site found in the 3' untranslated region of mRNA encoded by ATP9A, corresponding to a HOST TARGET binding site such as BINDING SITE I, BINDING SITE II or BINDING SITE III. Table 2 illustrates the complementarity of the nucleotide sequences of ATP9A BINDING SITE, designated SEQ ID:31084, to the nucleotide sequence of VGAM111 RNA, herein designated VGAM RNA, also designated SEQ ID:2822.

Another function of VGAM111 is therefore inhibition of ATPase, Class II, Type 9A (ATP9A, Accession XM_030577). Accordingly, utilities of VGAM111 include diagnosis, prevention and treatment of diseases and clinical conditions associated with ATP9A. Chromosome 5 Open Reading Frame 6 (C5orf6, Accession NM_016605) is another VGAM111 host target gene. C5orf6 BINDING SITE is HOST TARGET binding site found in the 3' untranslated region of mRNA encoded by C5orf6, corresponding to a HOST TARGET binding site such as BINDING SITE I, BINDING SITE II or BINDING SITE III. Table 2 illustrates the complementarity of the nucleotide sequences of C5orf6 BINDING SITE, designated SEQ ID:18703, to the nucleotide sequence of VGAM111 RNA, herein designated VGAM RNA, also designated SEQ ID:2822.

Another function of VGAM111 is therefore inhibition of Chromosome 5 Open Reading Frame 6 (C5orf6, Accession NM_016605). Accordingly, utilities of VGAM111 include diagnosis, prevention and treatment of diseases and clinical conditions associated with C5orf6. FLJ10769 (Accession NM_018210) is another VGAM111 host target gene. FLJ10769 BINDING SITE is HOST TARGET binding site found in the 3' untranslated region of mRNA encoded by FLJ10769, corresponding to a HOST TARGET binding site such as BINDING SITE I, BINDING SITE II or BINDING SITE III. Table 2 illustrates the complementarity of the nucleotide sequences of FLJ10769 BINDING SITE, designated SEQ ID:20114, to the nucleotide sequence of VGAM111 RNA, herein designated VGAM RNA, also designated SEQ ID:2822.

Another function of VGAM111 is therefore inhibition of FLJ10769 (Accession NM_018210). Accordingly, utilities of VGAM111 include diagnosis, prevention and treatment of diseases and clinical conditions associated with FLJ10769. FLJ12572 (Accession NM_022905) is another VGAM111 host target gene. FLJ12572 BINDING SITE is HOST TARGET binding site found in the 3' untranslated region of mRNA encoded by FLJ12572, corresponding to a HOST TARGET binding site such as BINDING SITE I, BINDING SITE II or BINDING SITE III. Table 2 illustrates the complementarity of the nucleotide sequences of FLJ12572 BINDING SITE, designated SEQ ID:23199, to the nucleotide sequence of VGAM111 RNA, herein designated VGAM RNA, also designated SEQ ID:2822.

Another function of VGAM111 is therefore inhibition of FLJ12572 (Accession NM_022905). Accordingly, utilities of VGAM111 include diagnosis, prevention and treatment of diseases and clinical conditions associated with FLJ12572. FLJ14624 (Accession XM_049060) is another VGAM111 host target gene. FLJ14624 BINDING SITE is HOST TARGET binding site found in the 3' untranslated region of mRNA encoded by FLJ14624, corresponding to a HOST TARGET binding site such as BINDING SITE I, BINDING SITE II or BINDING SITE III. Table 2 illustrates the complementarity of the nucleotide sequences of FLJ14624 BINDING SITE, designated SEQ ID:35337, to the nucleotide sequence of VGAM111 RNA, herein designated VGAM RNA, also designated SEQ ID:2822.

Another function of VGAM111 is therefore inhibition of FLJ14624 (Accession XM_049060). Accordingly, utilities of VGAM111 include diagnosis, prevention and treatment of diseases and clinical conditions associated with FLJ14624. Formin Binding Protein 3 (FNBP3, Accession XM_087118) is another VGAM111 host target gene. FNBP3 BINDING SITE is HOST TARGET binding site found in the 3' untranslated region of mRNA encoded by FNBP3, corresponding to a HOST TARGET binding site such as BINDING SITE I, BINDING SITE II or BINDING SITE III. Table 2 illustrates the complementarity of the nucleotide sequences of FNBP3 BINDING SITE, designated SEQ ID:39073, to the nucleotide sequence of VGAM111 RNA, herein designated VGAM RNA, also designated SEQ ID:2822.

Another function of VGAM111 is therefore inhibition of Formin Binding Protein 3 (FNBP3, Accession XM_087118). Accordingly, utilities of VGAM111 include diagnosis, prevention and treatment of diseases and clinical conditions associated with FNBP3. KIAA0087 (Accession NM_014769) is another VGAM111 host target gene. KIAA0087 BINDING SITE is HOST TARGET binding site found in the 3' untranslated region of mRNA encoded by KIAA0087, corresponding to a HOST TARGET binding site such as BINDING SITE I, BINDING SITE II or BINDING SITE III. Table 2 illustrates the complementarity of the nucleotide sequences of KIAA0087 BINDING SITE, designated SEQ ID:16558, to the nucleotide sequence of VGAM111 RNA, herein designated VGAM RNA, also designated SEQ ID:2822.

Another function of VGAM111 is therefore inhibition of KIAA0087 (Accession NM_014769). Accordingly, utilities of VGAM111 include diagnosis, prevention and treatment of diseases and clinical conditions associated with KIAA0087. KIAA0335 (Accession NM_014803) is another VGAM111 host target gene. KIAA0335 BINDING SITE is HOST TARGET binding site found in the 5' untranslated region of mRNA encoded by KIAA0335, corresponding to a HOST TARGET binding site such as BINDING SITE I, BINDING SITE II or BINDING SITE III. Table 2 illustrates the complementarity of the nucleotide sequences of KIAA0335 BINDING SITE, designated SEQ ID:16727, to the nucleotide sequence of VGAM111 RNA, herein designated VGAM RNA, also designated SEQ ID:2822.

Another function of VGAM111 is therefore inhibition of KIAA0335 (Accession NM_014803). Accordingly, utilities of VGAM111 include diagnosis, prevention and treatment of diseases and clinical conditions associated with KIAA0335. KIAA1671 (Accession XM_037809) is another VGAM111 host target gene. KIAA1671 BINDING SITE is HOST TARGET binding site found in the 3' untranslated region of mRNA encoded by KIAA1671, corresponding to a HOST TARGET binding site such as BINDING SITE I, BINDING SITE II or BINDING SITE III. Table 2 illustrates the complementarity of the nucleotide sequences of KIAA1671 BINDING SITE, designated SEQ ID:32693, to the nucleotide sequence of VGAM111 RNA, herein designated VGAM RNA, also designated SEQ ID:2822.

Another function of VGAM111 is therefore inhibition of KIAA1671 (Accession XM_037809). Accordingly, utilities of VGAM111 include diagnosis, prevention and treatment of diseases and clinical conditions associated with KIAA1671. MGC14836 (Accession NM_033412) is another VGAM111 host target gene. MGC14836 BINDING SITE is HOST TARGET binding site found in the 5' untranslated region of mRNA encoded by MGC14836, corresponding to a HOST TARGET binding site such as BINDING SITE I, BINDING SITE II or BINDING SITE III. Table 2 illustrates the complementarity of the nucleotide sequences of MGC14836 BINDING SITE, designated SEQ ID:27235, to the nucleotide sequence of VGAM111 RNA, herein designated VGAM RNA, also designated SEQ ID:2822.

Another function of VGAM111 is therefore inhibition of MGC14836 (Accession NM_033412). Accordingly, utilities of VGAM111 include diagnosis, prevention and treatment of diseases and clinical conditions associated with MGC14836. MGC16385 (Accession NM_145039) is another VGAM111 host target gene. MGC16385 BINDING SITE is HOST TARGET binding site found in the 5' untranslated region of mRNA encoded by MGC16385, corresponding to a HOST TARGET binding site such as BINDING SITE I, BINDING SITE II or BINDING SITE III. Table 2 illustrates the complementarity of the nucleotide sequences of MGC16385 BINDING SITE, designated SEQ ID:29662, to the nucleotide sequence of VGAM111 RNA, herein designated VGAM RNA, also designated SEQ ID:2822.

Another function of VGAM111 is therefore inhibition of MGC16385 (Accession NM_145039). Accordingly, utilities of VGAM111 include diagnosis, prevention and treatment of diseases and clinical conditions associated with MGC16385. MGC20235 (Accession NM_145041) is another VGAM111 host target gene. MGC20235 BINDING SITE is HOST TARGET binding site found in the 3' untranslated region of mRNA encoded by MGC20235, corresponding to a HOST TARGET binding site such as BINDING SITE I, BINDING SITE II or BINDING SITE III. Table 2 illustrates the complementarity of the nucleotide sequences of MGC20235 BINDING SITE, designated SEQ ID:29666, to the nucleotide sequence of VGAM111 RNA, herein designated VGAM RNA, also designated SEQ ID:2822.

Another function of VGAM111 is therefore inhibition of MGC20235 (Accession NM_145041). Accordingly, utilities of VGAM111 include diagnosis, prevention and treatment of diseases and clinical conditions associated with MGC20235. p21(CDKN1A)-activated Kinase 6 (PAK6, Accession NM_020168) is another VGAM111 host target gene. PAK6 BINDING SITE is HOST TARGET binding site found in the 3' untranslated region of mRNA encoded by PAK6, corresponding to a HOST TARGET binding site such as BINDING SITE I, BINDING SITE II or BINDING SITE III. Table 2 illustrates the complementarity of the nucleotide sequences of PAK6 BINDING SITE, designated SEQ ID:21386, to the nucleotide sequence of VGAM111 RNA, herein designated VGAM RNA, also designated SEQ ID:2822.

Another function of VGAM111 is therefore inhibition of p21(CDKN1A)-activated Kinase 6 (PAK6, Accession NM_020168). Accordingly, utilities of VGAM111 include diagnosis, prevention and treatment of diseases and clinical conditions associated with PAK6. PDZ-GEF1 (Accession NM_014247) is another VGAM111 host target gene. PDZ-GEF1 BINDING SITE is HOST TARGET binding site found in the 3' untranslated region of mRNA encoded by PDZ-GEF1, corresponding to a HOST TARGET binding site such as BINDING SITE I, BINDING SITE II or BINDING SITE III. Table 2 illustrates the complementarity of the nucleotide sequences of PDZ-GEF1 BINDING SITE, designated SEQ ID:15522, to the nucleotide sequence of VGAM111 RNA, herein designated VGAM RNA, also designated SEQ ID:2822.

Another function of VGAM111 is therefore inhibition of PDZ-GEF1 (Accession NM_014247). Accordingly, utilities of VGAM111 include diagnosis, prevention and treatment of diseases and clinical conditions associated with PDZ-GEF1. PRO0641 (Accession NM_014135) is another VGAM111 host target gene. PRO0641 BINDING SITE is HOST TARGET binding site found in the 3' untranslated region of mRNA encoded by PRO0641, corresponding to a HOST TARGET binding site such as BINDING SITE I, BINDING SITE II or BINDING SITE III. Table 2 illustrates the complementarity of the nucleotide sequences of PRO0641 BINDING SITE, designated SEQ ID:15400, to the nucleotide sequence of VGAM111 RNA, herein designated VGAM RNA, also designated SEQ ID:2822.

Another function of VGAM111 is therefore inhibition of PRO0641 (Accession NM_014135). Accordingly, utilities of VGAM111 include diagnosis, prevention and treatment of diseases and clinical conditions associated with PRO0641. PRO1430 (Accession NM_018599) is another VGAM111 host target gene. PRO1430 BINDING SITE is HOST TARGET binding site found in the 5' untranslated region of mRNA encoded by PRO1430, corresponding to a HOST TARGET binding site such as BINDING SITE I, BINDING SITE II or BINDING SITE III. Table 2 illustrates the complementarity of the nucleotide sequences of PRO1430 BINDING SITE, designated SEQ ID:20674, to the nucleotide sequence of VGAM111 RNA, herein designated VGAM RNA, also designated SEQ ID:2822.

Another function of VGAM111 is therefore inhibition of PRO1430 (Accession NM_018599). Accordingly, utilities of VGAM111 include diagnosis, prevention and treatment of diseases and clinical conditions associated with PRO1430. Regulator of G-protein Signalling 20 (RGS20, Accession NM_003702) is another VGAM111 host target gene. RGS20 BINDING SITE is HOST TARGET binding site found in the 3' untranslated region of mRNA encoded by RGS20, corresponding to a HOST TARGET binding site such as BINDING SITE I, BINDING SITE II or BINDING SITE III. Table 2 illustrates the complementarity of the nucleotide sequences of RGS20 BINDING SITE, designated SEQ ID:9802, to the nucleotide sequence of VGAM111 RNA, herein designated VGAM RNA, also designated SEQ ID:2822.

Another function of VGAM111 is therefore inhibition of Regulator of G-protein Signalling 20 (RGS20, Accession NM_003702). Accordingly, utilities of VGAM111 include diagnosis, prevention and treatment of diseases and clinical conditions associated with RGS20. SKI-like (SKIL, Accession NM_005414) is another VGAM111 host target gene. SKIL BINDING SITE is HOST TARGET binding site found in the 5' untranslated region of mRNA encoded by SKIL, corresponding to a HOST TARGET binding site such as BINDING SITE I, BINDING SITE II or BINDING SITE III. Table 2 illustrates the complementarity of the nucleotide sequences of SKIL BINDING SITE, designated SEQ ID:11883, to the nucleotide sequence of VGAM111 RNA, herein designated VGAM RNA, also designated SEQ ID:2822.

Another function of VGAM111 is therefore inhibition of SKI-like (SKIL, Accession NM_005414). Accordingly, utilities of VGAM111 include diagnosis, prevention and treatment of diseases and clinical conditions associated with SKIL. Solute Carrier Family 2 (facilitated glucose transporter), Member 10 (SLC2A10, Accession NM_030777) is another VGAM111 host target gene. SLC2A10 BINDING SITE is HOST TARGET binding site found in the 3' untranslated region of mRNA encoded by SLC2A10, corresponding to a HOST TARGET binding site such as BINDING SITE I, BINDING SITE II or BINDING SITE III. Table 2 illustrates the complementarity of the nucleotide sequences of SLC2A10 BINDING SITE, designated SEQ ID:25063, to the nucleotide sequence of VGAM111 RNA, herein designated VGAM RNA, also designated SEQ ID:2822.

Another function of VGAM111 is therefore inhibition of Solute Carrier Family 2 (facilitated glucose transporter), Member 10 (SLC2A10, Accession NM_030777). Accordingly, utilities of VGAM111 include diagnosis, prevention and treatment of diseases and clinical conditions associated with SLC2A10. LOC149134 (Accession XM_097594) is another VGAM111 host target gene. LOC149134 BINDING SITE is HOST TARGET binding site found in the 5' untranslated region of mRNA encoded by LOC149134, corresponding to a HOST TARGET binding site such as BINDING SITE I, BINDING SITE II or BINDING SITE III. Table 2 illustrates the complementarity of the nucleotide sequences of LOC149134 BINDING SITE, designated SEQ ID:40959, to the nucleotide sequence of VGAM111 RNA, herein designated VGAM RNA, also designated SEQ ID:2822.

Another function of VGAM111 is therefore inhibition of LOC149134 (Accession XM_097594). Accordingly, utilities of VGAM111 include diagnosis, prevention and treatment of diseases and clinical conditions associated with LOC149134. LOC91549 (Accession XM_039115) is another VGAM111 host target gene. LOC91549 BINDING SITE is HOST TARGET binding site found in the 3' untranslated region of mRNA encoded by LOC91549, corresponding to a HOST TARGET binding site such as BINDING SITE I, BINDING SITE II or BINDING SITE III. Table 2 illustrates the complementarity of the nucleotide sequences of LOC91549 BINDING SITE, designated SEQ ID:33013, to the nucleotide sequence of VGAM111 RNA, herein designated VGAM RNA, also designated SEQ ID:2822.

Another function of VGAM111 is therefore inhibition of LOC91549 (Accession XM_039115). Accordingly, utilities of VGAM111 include diagnosis, prevention and treatment of diseases and clinical conditions associated with LOC91549. FIG. 1 further provides a conceptual description of a novel bioinformatically detected viral gene of the present invention, referred to here as Viral Genomic Address Messenger 112 (VGAM112) viral gene, which modulates expression of respective host target genes thereof, the function and utility of which host target genes is known in the art.

VGAM112 is a novel bioinformatically detected regulatory, non protein coding, viral micro RNA (miRNA) gene. The method by which VGAM112 was detected is described hereinabove with reference to FIGS. 1-8.

VGAM112 gene, herein designated VGAM GENE, is a viral gene contained in the genome of Shrimp White Spot Syndrome Virus (white spot baciliform virus). VGAM112 host target gene, herein designated VGAM HOST TARGET GENE, is a human gene contained in the human genome.

VGAM112 gene encodes a VGAM112 precursor RNA, herein designated VGAM PRECURSOR RNA. Similar to other miRNA genes, and unlike most ordinary genes, VGAM112 precursor RNA does not encode a protein. A nucleotide sequence identical or highly similar to the nucleotide sequence of VGAM112 precursor RNA is designated SEQ ID:98, and is provided hereinbelow with reference to the sequence listing part. Nucleotide sequence SEQ ID:98 is located at position 52615 relative to the genome of Shrimp White Spot Syndrome Virus (white spot bacilliform virus).

VGAM112 precursor RNA folds onto itself, forming VGAM112 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM112 folded precursor RNA into VGAM112 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM112 RNA is designated SEQ ID:2823, and is provided hereinbelow with reference to the sequence listing part.

VGAM112 host target gene, herein designated VGAM HOST TARGET GENE, encodes a corresponding messenger RNA, VGAM112 host target RNA, herein designated VGAM HOST TARGET RNA. VGAM112 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM112 RNA, herein designated VGAM RNA, binds complementarily to one or more host target binding sites located in untranslated regions of VGAM112 host target RNA, herein designated VGAM HOST TARGET RNA. This complementary binding is due to the fact that the nucleotide sequence of VGAM112 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM112 RNA, herein designated VGAM RNA, may have a different number of host target binding sites in untranslated regions of a VGAM112 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM112 RNA, herein designated VGAM RNA, to host target binding sites on VGAM112 host target RNA, herein designated VGAM HOST TARGET RNA, such as BINDING SITE I, BINDING SITE II and BINDING SITE III, inhibits translation of VGAM112 host target RNA into VGAM112 host target protein, herein designated VGAM HOST TARGET PROTEIN. VGAM host target protein is therefore outlined by a broken line.

It is appreciated that VGAM112 host target gene, herein designated VGAM HOST TARGET GENE, in fact represents a plurality of VGAM112 host target genes. The mRNA of each one of this plurality of VGAM112 host target genes comprises one or more host target binding sites, each having a nucleotide sequence which is at least partly complementary to VGAM112 RNA, herein designated VGAM RNA, and which when bound by VGAM112 RNA causes inhibition of translation of respective one or more VGAM112 host target proteins.

It is further appreciated by one skilled in the art that the mode of translational inhibition illustrated by FIG. 1 with specific reference to translational inhibition exerted by VGAM112 gene, herein designated VGAM GENE, on one or more VGAM112 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM112 is inhibition of expression of host target genes, as part of a novel viral mechanism of attacking a host. Accordingly, utilities of VGAM112 include diagnosis, prevention and treatment of viral infection by Shrimp White Spot Syndrome Virus (white spot bacilliform virus). Specific functions, and accordingly utilities, of VGAM112 correlate with, and may be deduced from, the identity of the host target genes which VGAM112 binds and inhibits, and the function of these host target genes, as elaborated hereinbelow.

Nucleotide sequences of the VGAM112 precursor RNA, herein designated VGAM PRECURSOR RNA, and of the 'diced' VGAM112 RNA, herein designated VGAM RNA, and a schematic representation of the secondary folding of VGAM112 folded precursor RNA, herein designated VGAM FOLDED PRECURSOR RNA, of VGAM112 are further described hereinbelow with reference to Table 1.

Nucleotide sequences of host target binding sites, such as BINDING SITE-I, BINDING SITE-II and BINDING SITE-III of FIG. 1, found on VGAM112 host target RNA, and schematic representation of the complementarity of each of these host target binding sites to VGAM112 RNA, herein designated VGAM RNA, are described hereinbelow with reference to Table 2.

As mentioned hereinabove with reference to FIG. 1, a function of VGAM112 gene, herein designated VGAM is inhibition of expression of VGAM112 target genes. It is appreciated that specific functions, and accordingly utilities, of VGAM112 correlate with, and may be deduced from, the identity of the target genes which VGAM112 binds and inhibits, and the function of these target genes, as elaborated hereinbelow.

Homeo Box A3 (HOXA3, Accession NM_030661) is a VGAM112 host target gene. HOXA3 BINDING SITE is HOST TARGET binding site found in the 3' untranslated region of mRNA encoded by HOXA3, corresponding to a HOST TARGET binding site such as BINDING SITE I, BINDING SITE II or BINDING SITE III. Table 2 illustrates the complementarity of the nucleotide sequences of HOXA3 BINDING SITE, designated SEQ ID:24992, to the nucleotide sequence of VGAM112 RNA, herein designated VGAM RNA, also designated SEQ ID:2823.

A function of VGAM112 is therefore inhibition of Homeo Box A3 (HOXA3, Accession NM_030661). Accordingly, utilities of VGAM112 include diagnosis, prevention and treatment of diseases and clinical conditions associated with HOXA3. Peripheral Myelin Protein 22 (PMP22, Accession NM_000304) is another VGAM112 host target gene. PMP22 BINDING SITE is HOST TARGET binding site found in the 3' untranslated region of mRNA encoded by PMP22, corresponding to a HOST TARGET binding site such as BINDING SITE I, BINDING SITE II or BINDING SITE III. Table 2 illustrates the complementarity of the nucleotide sequences of PMP22 BINDING SITE, designated SEQ ID:5846, to the nucleotide sequence of VGAM112 RNA, herein designated VGAM RNA, also designated SEQ ID:2823.

Another function of VGAM112 is therefore inhibition of Peripheral Myelin Protein 22 (PMP22, Accession NM_000304). Accordingly, utilities of VGAM112 include diagnosis, prevention and treatment of diseases and clinical conditions associated with PMP22. Cyclin-dependent Kinase-like 2 (CDC2-related kinase) (CDKL2, Accession NM_003948) is another VGAM112 host target gene. CDKL2 BINDING SITE is HOST TARGET binding site found in the 5' untranslated region of mRNA encoded by CDKL2, corresponding to a HOST TARGET binding site such as BINDING SITE I, BINDING SITE II or BINDING SITE III. Table 2 illustrates the complementarity of the nucleotide sequences of CDKL2 BINDING SITE, designated SEQ ID:10070, to the nucleotide sequence of VGAM112 RNA, herein designated VGAM RNA, also designated SEQ ID:2823.

Another function of VGAM112 is therefore inhibition of Cyclin-dependent Kinase-like 2 (CDC2-related kinase) (CDKL2, Accession NM_003948). Accordingly, utilities of VGAM112 include diagnosis, prevention and treatment of diseases and clinical conditions associated with CDKL2. FLJ21290 (Accession NM_025034) is another VGAM112 host target gene. FLJ21290 BINDING SITE is HOST TARGET binding site found in the 3' untranslated region of mRNA encoded by FLJ21290, corresponding to a HOST TARGET binding site such as BINDING SITE I, BINDING SITE II or BINDING SITE III. Table 2 illustrates the complementarity of the nucleotide sequences of FLJ21290 BINDING SITE, designated SEQ ID:24633, to the nucleotide sequence of VGAM112 RNA, herein designated VGAM RNA, also designated SEQ ID:2823.

Another function of VGAM112 is therefore inhibition of FLJ21290 (Accession NM_025034). Accordingly, utilities of VGAM112 include diagnosis, prevention and treatment of diseases and clinical conditions associated with FLJ21290. HSPC065 (Accession NM_014157) is another VGAM112 host target gene. HSPC065 BINDING SITE is HOST TARGET binding site found in the 3' untranslated region of mRNA encoded by HSPC065, corresponding to a HOST TARGET binding site such as BINDING SITE I, BINDING SITE II or BINDING SITE III. Table 2 illustrates the complementarity of the nucleotide sequences of HSPC065 BINDING SITE, designated SEQ ID:15453, to the nucleotide sequence of VGAM112 RNA, herein designated VGAM RNA, also designated SEQ ID:2823.

Another function of VGAM112 is therefore inhibition of HSPC065 (Accession NM_014157). Accordingly, utilities of VGAM112 include diagnosis, prevention and treatment of diseases and clinical conditions associated with HSPC065. KIAA1796 (Accession XM_166146) is another VGAM112 host target gene. KIAA1796 BINDING SITE is HOST TARGET binding site found in the 3' untranslated region of mRNA encoded by KIAA1796, corresponding to a HOST TARGET binding site such as BINDING SITE I, BINDING SITE II or BINDING SITE III. Table 2 illustrates the complementarity of the nucleotide sequences of KIAA1796 BINDING SITE, designated SEQ ID:43963, to the nucleotide sequence of VGAM112 RNA, herein designated VGAM RNA, also designated SEQ ID:2823.

Another function of VGAM112 is therefore inhibition of KIAA1796 (Accession XM_166146). Accordingly, utilities of VGAM112 include diagnosis, prevention and treatment of diseases and clinical conditions associated with KIAA1796. Serine Palmitoyltransferase, Long Chain Base Subunit 2 (SPTLC2, Accession NM_004863) is another VGAM112 host target gene. SPTLC2 BINDING SITE is HOST TARGET binding site found in the 3' untranslated region of mRNA encoded by SPTLC2, corresponding to a HOST TARGET binding site such as BINDING SITE I, BINDING SITE II or BINDING SITE III. Table 2 illustrates the complementarity of the nucleotide sequences of SPTLC2 BINDING SITE, designated SEQ ID:11271, to the nucleotide sequence of VGAM112 RNA, herein designated VGAM RNA, also designated SEQ ID:2823.

Another function of VGAM112 is therefore inhibition of Serine Palmitoyltransferase, Long Chain Base Subunit 2 (SPTLC2, Accession NM_004863). Accordingly, utilities of VGAM112 include diagnosis, prevention and treatment of diseases and clinical conditions associated with SPTLC2. ZFD25 (Accession NM_016220) is another VGAM112 host target gene. ZFD25 BINDING SITE is HOST TARGET binding site found in the 3' untranslated region of mRNA encoded by ZFD25, corresponding to a HOST TARGET binding site such as BINDING SITE I, BINDING SITE II or BINDING SITE III. Table 2 illustrates the complementarity of the nucleotide sequences of ZFD25 BINDING SITE, designated SEQ ID:18320, to the nucleotide sequence of VGAM112 RNA, herein designated VGAM RNA, also designated SEQ ID:2823.

Another function of VGAM112 is therefore inhibition of ZFD25 (Accession NM_016220). Accordingly, utilities of VGAM112 include diagnosis, prevention and treatment of diseases and clinical conditions associated with ZFD25. LOC146435 (Accession XM_085465) is another VGAM112 host target gene. LOC146435 BINDING SITE is HOST TARGET binding site found in the 3' untranslated region of mRNA encoded by LOC146435, corresponding to a HOST TARGET binding site such as BINDING SITE I, BINDING SITE II or BINDING SITE III. Table 2 illustrates the complementarity of the nucleotide sequences of LOC146435 BINDING SITE, designated SEQ ID:38152, to the nucleotide sequence of VGAM112 RNA, herein designated VGAM RNA, also designated SEQ ID:2823.

Another function of VGAM112 is therefore inhibition of LOC146435 (Accession XM_085465). Accordingly, utilities of VGAM112 include diagnosis, prevention and treatment of diseases and clinical conditions associated with LOC146435. LOC148709 (Accession XM_086281) is another VGAM112 host target gene. LOC148709 BINDING SITE is HOST TARGET binding site found in the 3' untranslated region of mRNA encoded by LOC148709, corresponding to a HOST TARGET binding site such as BINDING SITE I, BINDING SITE II or BINDING SITE III. Table 2 illustrates the complementarity of the nucleotide sequences of LOC148709 BINDING SITE, designated SEQ ID:38581, to the nucleotide sequence of VGAM112 RNA, herein designated VGAM RNA, also designated SEQ ID:2823.

Another function of VGAM112 is therefore inhibition of LOC148709 (Accession XM_086281). Accordingly, utilities of VGAM112 include diagnosis, prevention and treatment of diseases and clinical conditions associated with LOC148709.

LOC164955 (Accession XM_092265) is another VGAM112 host target gene. LOC164955 BINDING SITE is HOST TARGET binding site found in the 3' untranslated region of mRNA encoded by LOC164955, corresponding to a HOST TARGET binding site such as BINDING SITE I, BINDING SITE II or BINDING SITE III. Table 2 illustrates the complementarity of the nucleotide sequences of LOC164955 BINDING SITE, designated SEQ ID:40111, to the nucleotide sequence of VGAM112 RNA, herein designated VGAM RNA, also designated SEQ ID:2823.

Another function of VGAM112 is therefore inhibition of LOC164955 (Accession XM_092265). Accordingly, utilities of VGAM112 include diagnosis, prevention and treatment of diseases and clinical conditions associated with LOC164955. LOC219627 (Accession XM_166402) is another VGAM112 host target gene. LOC219627 BINDING SITE is HOST TARGET binding site found in the 3' untranslated region of mRNA encoded by LOC219627, corresponding to a HOST TARGET binding site such as BINDING SITE I, BINDING SITE II or BINDING SITE III. Table 2 illustrates the complementarity of the nucleotide sequences of LOC219627 BINDING SITE, designated SEQ ID:44273, to the nucleotide sequence of VGAM112 RNA, herein designated VGAM RNA, also designated SEQ ID:2823.

Another function of VGAM112 is therefore inhibition of LOC219627 (Accession XM_166402). Accordingly, utilities of VGAM112 include diagnosis, prevention and treatment of diseases and clinical conditions associated with LOC219627. LOC220906 (Accession XM_166133) is another VGAM112 host target gene. LOC220906 BINDING SITE is HOST TARGET binding site found in the 3' untranslated region of mRNA encoded by LOC220906, corresponding to a HOST TARGET binding site such as BINDING SITE I, BINDING SITE II or BINDING SITE III. Table 2 illustrates the complementarity of the nucleotide sequences of LOC220906 BINDING SITE, designated SEQ ID:43925, to the nucleotide sequence of VGAM112 RNA, herein designated VGAM RNA, also designated SEQ ID:2823.

Another function of VGAM112 is therefore inhibition of LOC220906 (Accession XM_166133). Accordingly, utilities of VGAM112 include diagnosis, prevention and treatment of diseases and clinical conditions associated with LOC220906. LOC221312 (Accession XM_166314) is another VGAM112 host target gene. LOC221312 BINDING SITE is HOST TARGET binding site found in the 3' untranslated region of mRNA encoded by LOC221312, corresponding to a HOST TARGET binding site such as BINDING SITE I, BINDING SITE II or BINDING SITE III. Table 2 illustrates the complementarity of the nucleotide sequences of LOC221312 BINDING SITE, designated SEQ ID:44137, to the nucleotide sequence of VGAM112 RNA, herein designated VGAM RNA, also designated SEQ ID:2823.

Another function of VGAM112 is therefore inhibition of LOC221312 (Accession XM_166314). Accordingly, utilities of VGAM112 include diagnosis, prevention and treatment of diseases and clinical conditions associated with LOC221312.

FIG. 1 further provides a conceptual description of a novel bioinformatically detected viral gene of the present invention, referred to here as Viral Genomic Address Messenger 113 (VGAM113) viral gene, which modulates expression of respective host target genes thereof, the function and utility of which host target genes is known in the art.

VGAM113 is a novel bioinformatically detected regulatory, non protein coding, viral micro RNA (miRNA) gene. The method by which VGAM113 was detected is described hereinabove with reference to FIGS. 1-8.

VGAM113 gene, herein designated VGAM GENE, is a viral gene contained in the genome of Shrimp White Spot Syndrome Virus (white spot baciliform virus). VGAM113 host target gene, herein designated VGAM HOST TARGET GENE, is a human gene contained in the human genome.

VGAM113 gene encodes a VGAM113 precursor RNA, herein designated VGAM PRECURSOR RNA. Similar to other miRNA genes, and unlike most ordinary genes, VGAM113 precursor RNA does not encode a protein. A nucleotide sequence identical or highly similar to the nucleotide sequence of VGAM113 precursor RNA is designated SEQ ID:99, and is provided hereinbelow with reference to the sequence listing part. Nucleotide sequence SEQ ID:99 is located at position 142719 relative to the genome of Shrimp White Spot Syndrome Virus (white spot baciliform virus).

VGAM113 precursor RNA folds onto itself, forming VGAM113 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM113 folded precursor RNA into VGAM113 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM113 RNA is designated SEQ ID:2824, and is provided hereinbelow with reference to the sequence listing part.

VGAM113 host target gene, herein designated VGAM HOST TARGET GENE, encodes a corresponding messenger RNA, VGAM113 host target RNA, herein designated VGAM HOST TARGET RNA. VGAM113 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM113 RNA, herein designated VGAM RNA, binds complementarily to one or more host target binding sites located in untranslated regions of VGAM113 host target RNA, herein designated VGAM HOST TARGET RNA. This complementary binding is due to the fact that the nucleotide sequence of VGAM113 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM113 RNA, herein designated VGAM RNA, may have a different number of host target binding sites in untranslated regions of a VGAM113 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM113 RNA, herein designated VGAM RNA, to host target binding sites on VGAM113 host target RNA, herein designated VGAM HOST TARGET RNA, such as BINDING SITE I, BINDING SITE II and BINDING SITE III, inhibits translation of VGAM113 host target RNA into VGAM113 host target protein, herein designated VGAM HOST TARGET PROTEIN. VGAM host target protein is therefore outlined by a broken line.

It is appreciated that VGAM113 host target gene, herein designated VGAM HOST TARGET GENE, in fact represents a plurality of VGAM113 host target genes. The mRNA of each one of this plurality of VGAM113 host target genes comprises one or more host target binding sites, each having a nucleotide sequence which is at least partly complementary to VGAM113 RNA, herein designated VGAM RNA, and which when bound by VGAM113 RNA causes inhibition of translation of respective one or more VGAM113 host target proteins.

It is further appreciated by one skilled in the art that the mode of translational inhibition illustrated by FIG. 1 with specific reference to translational inhibition exerted by VGAM113 gene, herein designated VGAM GENE, on one or more VGAM113 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM113 is inhibition of expression of host target genes, as part of a novel viral mechanism of attacking a host. Accordingly, utilities of VGAM113 include diagnosis, prevention and treatment of viral infection by Shrimp White Spot Syndrome Virus (white spot bacilliform virus). Specific functions, and accordingly utilities, of VGAM113 correlate with, and may be deduced from, the identity of the host target genes which VGAM113 binds and inhibits, and the function of these host target genes, as elaborated hereinbelow.

Nucleotide sequences of the VGAM113 precursor RNA, herein designated VGAM PRECURSOR RNA, and of the 'diced' VGAM113 RNA, herein designated VGAM RNA, and a schematic representation of the secondary folding of VGAM113 folded precursor RNA, herein designated VGAM FOLDED PRECURSOR RNA, of VGAM113 are further described hereinbelow with reference to Table 1.

Nucleotide sequences of host target binding sites, such as BINDING SITE-I, BINDING SITE-II and BINDING SITE-III of FIG. 1, found on VGAM113 host target RNA, and schematic representation of the complementarity of each of these host target binding sites to VGAM113 RNA, herein designated VGAM RNA, are described hereinbelow with reference to Table 2.

As mentioned hereinabove with reference to FIG. 1, a function of VGAM113 gene, herein designated VGAM is inhibition of expression of VGAM113 target genes. It is appreciated that specific functions, and accordingly utilities, of VGAM113 correlate with, and may be deduced from, the identity of the target genes which VGAM113 binds and inhibits, and the function of these target genes, as elaborated hereinbelow.

Core-binding Factor, Runt Domain, Alpha Subunit 2; Translocated To, 1; Cyclin D-related (CBFA2T1, Accession NM_004349) is a VGAM113 host target gene. CBFA2T1 BINDING SITE is HOST TARGET binding site found in the 3' untranslated region of mRNA encoded by CBFA2T1, corresponding to a HOST TARGET binding site such as BINDING SITE I, BINDING SITE II or BINDING SITE III. Table 2 illustrates the complementarity of the nucleotide sequences of CBFA2T1 BINDING SITE, designated SEQ ID:10545, to the nucleotide sequence of VGAM113 RNA, herein designated VGAM RNA, also designated SEQ ID:2824.

A function of VGAM113 is therefore inhibition of Core-binding Factor, Runt Domain, Alpha Subunit 2; Translocated To, 1; Cyclin D-related (CBFA2T1, Accession NM_004349), a gene which produces a chimeric gene made up of the 5-prime region of the AML1 gene fused to the 3-prime region of the ETO gene through translocation. Accordingly, utilities of VGAM113 include diagnosis, prevention and treatment of diseases and clinical conditions associated with CBFA2T1. The function of CBFA2T1 has been established by previous studies. Wolford and Prochazka (1998) reported that the MTG8 gene contains 13 exons spanning over 87 kb of DNA. They identified cDNAs representing alternatively spliced MTG8 transcripts in which a 155-bp exon (9a) is present. Inclusion of this exon changes the reading frame, resulting in the introduction of a premature stop codon. The encoded truncated proteins lack 177 C-terminal residues, which is the region containing 2 putative zinc finger motifs, the last P/S/T-rich domain, and a putative alpha-helical coiled-coil structure. Northern blot analysis of human tissues detected an approximately 5.5-kb MTG8 transcript in heart, brain, placenta, lung, skeletal muscle, and pancreas but not in liver or kidney. RT-PCR analysis of a number of human tissues showed highest levels of MTG8 expression in fetal brain, followed by adult brain and heart. Relatively abundant mRNA levels were also found in lung, pituitary, and placenta. When first identified as a partner with AML1 in acute myeloid leukemia (Erickson et al., 1992; Miyoshi et al., 1993), the gene was referred to as MTG8 for 'myeloid translocation gene on 8q22.' Wolford et al. (1998) found that MTG8 mRNAs are expressed at relatively high levels in human adipose tissue. They therefore investigated MTG8 as a candidate gene in obesity, studying the relationship between a highly polymorphic marker in the 3-prime untranslated region of the MTG8 gene and obesity in Pima Indians of Arizona, a population with one of the highest reported rates of obesity. They detected a male-specific association with age-adjusted percentage body fat (p=0.0002), body mass index (p=0.01), waist circumference (p=0.008), and thigh circumference (p=0.02). Comparative analysis of all 13 MTG8 exons in 30 Pimas did not reveal any genetic variants that could explain the association with obesity in males.

Full details of the abovementioned studies are described in the following publications, the disclosure of which are hereby incorporated by reference:

Wolford, J. K.; Prochazka, M.: Structure and expression of the human MTG8/ETO gene. Gene 212:103-109, 1998; and Miyoshi, H.; Kozu, T.; Shimizu, K.; Enomoto, K.; Maseki, N.; Kaneko, Y.; Kamada, N.; Ohki, M.: The t (8;21) translocation in acute myeloid leukemia results in production of an AML1-MTG8.

Further studies establishing the function and utilities of CBFA2T1 are found in John Hopkins OMIM database record ID 133435, and in sited publications numbered 3447-3448, 3452-3453, 3449-345 and 3454-3459 listed in the bibliography section hereinbelow, which are also hereby incorporated by reference. Glycyl-tRNA Synthetase (GARS, Accession NM_002047) is another VGAM113 host target gene. GARS BINDING SITE is HOST TARGET binding site found in the 5' untranslated region of mRNA encoded by GARS, corresponding to a HOST TARGET binding site such as BIND- ING SITE I, BINDING SITE II or BINDING SITE III. Table 2 illustrates the complementarity of the nucleotide sequences of GARS BINDING SITE, designated SEQ ID:7798, to the nucleotide sequence of VGAM113 RNA, herein designated VGAM RNA, also designated SEQ ID:2824.

Another function of VGAM113 is therefore inhibition of Glycyl-tRNA Synthetase (GARS, Accession NM_002047), a gene which functions in protein biosynthesis. Accordingly, utilities of VGAM113 include diagnosis, prevention and treatment of diseases and clinical conditions associated with GARS. The function of GARS has been established by previous studies. Aminoacyl-tRNA synthetases perform an essential function in protein synthesis by catalyzing the esterification of an amino acid to its cognate tRNA. These enzymes are necessarily present in each cell and must properly recognize the tRNA and the amino acid in order to maintain fidelity of translation. From the primary structures, 2 distinct classes of synthetases have been recognized, with similarity of certain structural features, amino acid attachment sites, and other properties between members of a class. Certain aminoacyl-tRNA synthetases are autoantigens in patients with the idiopathic inflammatory myopathies, polymyositis, and dermatomyositis. Autoantibodies reactive with synthetases are found almost exclusively in these conditions, with individuals usually having autoantibodies to only a single synthetase. Most commonly they are directed at histidyl-tRNA synthetase (OMIM Ref. No. 142810), labeled 'anti-Jo-1' autoantibodies. Ge et al. (1994) used a cDNA encoding the human form of glycyl-tRNA synthetase for isolation of corresponding cDNAs. Shiba et al. (1994) likewise cloned a class II human glycyl-tRNA synthetase and compared its structure with that of the bacterial counterpart from which it was found to diverge widely. Williams et al. (1995) also cloned the human GARS cDNA. The predicted 685-amino acid protein showed approximately 45% identity to the yeast protein. The recombinantly expressed protein was immunoprecipitated with human serum containing autoantibodies to glycyl-tRNA synthetase and was shown to catalyze the aminoacylation of tRNA.

Full details of the abovementioned studies are described in the following publications, the disclosure of which are hereby incorporated by reference:

Ge, Q.; Trieu, E. P.; Targoff, I. N.: Primary structure and functional expression of human glycyl-tRNA synthetase, an autoantigen in myositis. J. Biol. Chem. 269:28790-28797, 1994; and Nichols, R. C.; Pai, S. I.; Ge, Q.; Targoff, I. N.; Plotz, P. H.; Liu, P.: Localization of two human autoantigen genes by PCR screening and in situ hybridization--Glycyl-tRNA synthetase.

Further studies establishing the function and utilities of GARS are found in John Hopkins OMIM database record ID 600287, and in sited publications numbered 10119-10122 listed in the bibliography section hereinbelow, which are also hereby incorporated by reference. Norrie Disease (pseudoglioma) (NDP, Accession NM_000266) is another VGAM113 host target gene. NDP BINDING SITE is HOST TARGET binding site found in the 3' untranslated region of mRNA encoded by NDP, corresponding to a HOST TARGET binding site such as BINDING SITE I, BINDING SITE II or BINDING SITE III. Table 2 illustrates the complementarity of the nucleotide sequences of NDP BINDING SITE, designated SEQ ID:5811, to the nucleotide sequence of VGAM113 RNA, herein designated VGAM RNA, also designated SEQ ID:2824.

Another function of VGAM113 is therefore inhibition of Norrie Disease (pseudoglioma) (NDP, Accession NM_000266), a gene which may be involved in a pathway that regulates neural cell differentiation and proliferation. Accordingly, utilities of VGAM113 include diagnosis, prevention and treatment of diseases and clinical conditions associated with NDP. The function of NDP has been established by previous studies. Moreira-Filho and Neustein (1979) described 6 brothers with what they viewed as a variant of ND, because microcephaly was present in all. (In some ways the patients resembled those reported by Goldberg and McKusick as discussed in entry 309800.) The pedigree was informative for linkage with Xg; negative lod scores were obtained. Warburg et al. (1965) had demonstrated no linkage with the Xg blood groups. Johnston et al. (1982) described 2 families with 8 affected males--the first families reported from Ireland. Harendra de Silva and de Silva (1988) described an extensively affected family in Sri Lanka. Gal et al. (1985) found close linkage of Norrie disease to the L1.28/TaqI RFLP, DXS7 (maximum lod=3.50 at theta=0.00). Thus, ND may be in or slightly proximal to band Xp11.3 and near the retinitis pigmentosa locus (OMIM Ref. No. 312600), which is also linked to DXS7. Gal et al. (1985) found a peak lod score of 4.1 at theta 0.00 for linkage with DXS7; no recombination was found. DXS7 has been localized to Xp11.3 (or Xp11.3-p11.2). See Bleeker-Wagemakers et al. (1985) for the full data. Gal et al. (1985, 1986) also described a 14-year-old boy with a complex syndrome dominated by Norrie disease who appeared to have a small deletion involving DXS7 as well; seemingly, the deletion had been transmitted through 3 generations. Other features of the complex were severe mental retardation, hypogonadism, growth disturbances, and increased susceptibility to infections. De la Chapelle et al. (1985) found a deletion defined by DXS7 in 4 affected members of a family. Using probe L1.28 in the study of a chorion villus sample, they could show that the male fetus of a carrier woman was unaffected. Kivlin et al. (1987) presented further linkage data. They stated that no recombination had been identified between ND and the DNA marker L1.28; with their data, the total lod score became 5.42. Ohba and Yamashita (1986) presented evidence suggesting that the Norrie disease locus may be on Xp at band Xp11. A female infant with typical clinical and histopathologic features of vitreoretinal dysplasia was found to have a reciprocal translocation at t (X;10)(p11; p14). Her parents and sibs had normal karyotypes. Donnai et al. (1988) found that the DXS7 locus was deleted in 2 affected brothers; DXS7 is located in Xp11.3. OTC (OMIM Ref. No. 311250), located at Xp21.1, and DXS84, also located at Xp21.1, were intact. Ngo et al. (1988) and Katayama et al. (1988) found the first recombinant between Norrie disease and the DXS7 locus. The addition of their family brought a total of published informative families to 7, with a maximum lod score of 7.58 at a recombination fraction of 0.038. They stated the assignment of the DXS7 locus (defined by probe L1.28) as Xp11.3-p11.2. Ngo et al. (1989) pointed out that a single recombination event had been reported twice (Ngo et al., 1988; Katayama et al., 1988); otherwise, a distorted impression of the distance between the marker and Norrie disease might be given. Gal et al. (1988) described prenatal exclusion with flanking DNA markers. In an addendum, they stated that 3 families with Norrie disease and DXS7 deletion had been reported, bringing the compiled lod score for NDP vs DXS7 linkage to 11.18 at theta=0.00. Using a RFLP detected by the ornithine amino transferase (OAT)-related DNA sequences that map to Xp (see OMIM Ref. No. 258870), Ngo et al. (1989) found a suggestion of linkage to the Norrie disease locus. In 3 generations of a family with 4 affected males in 3 sibships of 2 generations, Zhu et al. (1989) demonstrated deletion of 2 loci, DXS7 and DXS77. DNA studies of chorion villus biopsy material from the fetus of an obligatory carrier indicated that the fetus had inherited the normal allele from the carrier mother. This prediction was confirmed on eye examination at age 5 months. Deletions at the DXS7 locus have been detected in 3 other families (de la Chapelle et al., 1985; Gal et al., 1985; Donnai et al., 1988). Diergaarde et al. (1989) further refined the localization of the deletion in a Dutch case of ND. Sims et al. (1989) demonstrated that the Norrie disease gene is distinct from the monoamine oxidase genes, although some males with atypical Norrie disease who have a submicroscopic deletion in the region of the DXS7 locus have been shown to have disruption of the MAOA (OMIM Ref. No. 309850) and MAOB (OMIM Ref. No. 309860) genes. The authors studied genomic DNA from 19 males in 9 families affected with Norrie disease. No deletions or rearrangements in the region of DSX7 or MAOA were observed in the DNA of these patients. Linkage analysis between the NDP gene and the DSX7 or MAOA loci showed no recombination, with a lod score of 2.80 and 2.58 at a theta of 0.0 for MAOA and DSX7, respectively. MAO activities in fibroblasts and platelets were normal. Although the MAO and NDP loci appear to be distinct, the high level of polymorphism at the MAO locus should prove useful in the molecular diagnosis of the disease. Collins et al. (1992) reported a male with Norrie disease and 2 obligate heterozygous females who were shown to have a submicroscopic deletion involving the Norrie disease locus and the loci for MAOA and MAOB. The propositus was a profoundly retarded, blind male; he also had neurologic abnormalities including myoclonus and stereotypy-habit disorder (persistent stereotypic and self-injurious behavior with a deleterious effect on the patient's adaptation to home and school environments). Both obligate carriers had a normal IQ. In the propositus, MAO activity was undetectable; in the female heterozygotes, the levels were reduced to the range observed in patients receiving MAO-inhibiting antidepressants. One of the carriers, the mother of the propositus, met diagnostic criteria for 'chronic hypomania and schizotypal features.' Lindsay et al. (1992) did linkage studies using a highly informative microsatellite marker, DXS426, which maps proximal to DXS7 in the interval Xp11.4-p11.23. A multiply informative crossover localized the NDP gene proximal to DXS7. In conjunction with information from 2 NDP patients who had a deletion for DXS7 but not for DXS426, their data indicated that the NDP gene is between DXS7 and DXS426 on proximal Xp. Wolff et al. (1992) restudied the family with Episkopi blindness originally studied by Taylor et al. (1959). DNA studies revealed no deletion of any of the probes from proximal Xq. Linkage analysis yielded positive lod scores for all informative markers; e.g., with DXS255, maximum lod=6.54 at theta=0.0. The findings confirmed that Episkopi blindness and Norrie disease are the same entity. Although Berger et al. (1992) and Chen et al. (1992) could identify no strong homologies with the candidate gene they identified, by studying the number and spacing of cysteine residues, Meindl et al. (1992) later detected homologies between the Norrie disease gene product and a C-terminal domain that is common to a group of proteins including mucins. Furthermore, they characterized 3 missense mutations, replacing evolutionarily conserved cysteines or creating new cysteine codons, emphasizing the functional importance of these sites. These findings and the clinical features of Norrie disease suggested a possible role for the NDP gene in a neuroectodermal cell-cell interaction. Only exons 2 and 3 of the NDP gene are translated. Exon 2 contains the first 58 codons of the open reading frame. The intron that follows it is roughly 14.5 kb. Exon 3 is the largest exon and contains residues 59-133 of the open reading frame and a 917-bp untranslated 3-prime-region. Chen et al. (1993) isolated genomic DNA clones encompassing the NDP gene which they found spans 28 kb and consists of 3 exons, the first of which is entirely contained within the 5-prime untranslated region. By PCR analysis, they found that expression of the NDP gene is not confined to the eye or to the brain. They found homology with cysteine-rich protein-binding domains of intermediate-early genes implicated in the regulation of cell proliferation. This led them to propose that the NDP molecule likewise may be involved in the pathway that regulates neural cell differentiation and proliferation. Meitinger et al. (1993) reported that sequence pattern searches and 3-dimensional modeling suggested that the Norrie disease protein (NDP) has a tertiary structure similar to that of a transforming growth factor beta (e.g., 190180). The model identified NDP as a member of an emerging family of growth factors containing a cystine knot motif, with direct implications for the physiologic role of NDP.

Full details of the abovementioned studies are described in the following publications, the disclosure of which are hereby incorporated by reference:

de la Chapelle, A.; Sankila, E.-M.; Lindlof, M.; Aula, P.; Norio, R.: Norrie disease caused by a gene deletion allowing carrier detection and prenatal diagnosis. Clin. Genet. 28:317-320, 1985; and Meitinger, T.; Meindl, A.; Bork, P.; Rost, B.; Sander, C.; Haasemann, M.; Murken, J.: Molecular modeling of the Norrie disease protein predicts a cystine knot growth factor tertiary st.

Further studies establishing the function and utilities of NDP are found in John Hopkins OMIM database record ID 310600, and in sited publications numbered 8614-8617, 2931, 8800, 10615-2936, 1867, 2937, 2945, 9179-2940, 10616-2944, 2946-2949, 10697, 8125, 8127-8145, 1469, 8146-8151, 9180-8155, 8363, 8372-837 and 8807-8381 listed in the bibliography section hereinbelow, which are also hereby incorporated by reference. FLJ11101 (Accession NM_018322) is another VGAM113 host target gene. FLJ11101 BINDING SITE is HOST TARGET binding site found in the 3' untranslated region of mRNA encoded by FLJ11101, corresponding to a HOST TARGET binding site such as BINDING SITE I, BINDING SITE II or BINDING SITE III. Table 2 illustrates the complementarity of the nucleotide sequences of FLJ11101 BINDING SITE, designated SEQ ID:20315, to the nucleotide sequence of VGAM113 RNA, herein designated VGAM RNA, also designated SEQ ID:2824.

Another function of VGAM113 is therefore inhibition of FLJ11101 (Accession NM_018322). Accordingly, utilities of VGAM113 include diagnosis, prevention and treatment of diseases and clinical conditions associated with FLJ11101. FLJ13072 (Accession XM_117117) is another VGAM113 host target gene. FLJ13072 BINDING SITE is HOST TARGET binding site found in the 5' untranslated region of mRNA encoded by FLJ13072, corresponding to a HOST TARGET binding site such as BINDING SITE I, BINDING SITE II or BINDING SITE III. Table 2 illustrates the complementarity of the nucleotide sequences of FLJ13072 BINDING SITE, designated SEQ ID:43236, to the nucleotide sequence of VGAM113 RNA, herein designated VGAM RNA, also designated SEQ ID:2824.

Another function of VGAM113 is therefore inhibition of FLJ13072 (Accession XM_117117). Accordingly, utilities of VGAM113 include diagnosis, prevention and treatment of diseases and clinical conditions associated with FLJ13072. FLJ20729 (Accession NM_017953) is another VGAM113 host target gene. FLJ20729 BINDING SITE is HOST TARGET binding site found in the 3' untranslated region of mRNA encoded by FLJ20729, corresponding to a HOST TARGET binding site such as BINDING SITE I, BINDING SITE II or BINDING SITE III. Table 2 illustrates the complementarity of the nucleotide sequences of FLJ20729 BINDING SITE, designated SEQ ID:19658, to the nucleotide sequence of VGAM113 RNA, herein designated VGAM RNA, also designated SEQ ID:2824.

Another function of VGAM113 is therefore inhibition of FLJ20729 (Accession NM_017953). Accordingly, utilities of VGAM113 include diagnosis, prevention and treatment of diseases and clinical conditions associated with FLJ20729. FLJ20802 (Accession NM_017959) is another VGAM113 host target gene. FLJ20802 BINDING SITE is HOST TARGET binding site found in the 5' untranslated region of mRNA encoded by FLJ20802, corresponding to a HOST TARGET binding site such as BINDING SITE I, BINDING SITE II or BINDING SITE III. Table 2 illustrates the complementarity of the nucleotide sequences of FLJ20802 BINDING SITE, designated SEQ ID:19674, to the nucleotide sequence of VGAM113 RNA, herein designated VGAM RNA, also designated SEQ ID:2824.

Another function of VGAM113 is therefore inhibition of FLJ20802 (Accession NM_017959). Accordingly, utilities of VGAM113 include diagnosis, prevention and treatment of diseases and clinical conditions associated with FLJ20802. FLJ22169 (Accession NM_024085) is another VGAM113 host target gene. FLJ22169 BINDING SITE is HOST TARGET binding site found in the 3' untranslated region of mRNA encoded by FLJ22169, corresponding to a HOST TARGET binding site such as BINDING SITE I, BINDING SITE II or BINDING SITE III. Table 2 illustrates the complementarity of the nucleotide sequences of FLJ22169 BINDING SITE, designated SEQ ID:23523, to the nucleotide sequence of VGAM113 RNA, herein designated VGAM RNA, also designated SEQ ID:2824.

Another function of VGAM113 is therefore inhibition of FLJ22169 (Accession NM_024085). Accordingly, utilities of VGAM113 include diagnosis, prevention and treatment of diseases and clinical conditions associated with FLJ22169. Golgi Autoantigen, Golgin Subfamily A, 1 (GOLGA1, Accession NM_002077) is another VGAM113 host target gene. GOLGA1 BINDING SITE is HOST TARGET binding site found in the 3' untranslated region of mRNA encoded by GOLGA1, corresponding to a HOST TARGET binding site such as BINDING SITE I, BINDING SITE II or BINDING SITE III. Table 2 illustrates the complementarity of the nucleotide sequences of GOLGA1 BINDING SITE, designated SEQ ID:7863, to the nucleotide sequence of VGAM113 RNA, herein designated VGAM RNA, also designated SEQ ID:2824.

Another function of VGAM113 is therefore inhibition of Golgi Autoantigen, Golgin Subfamily A, 1 (GOLGA1, Accession NM_002077). Accordingly, utilities of VGAM113 include diagnosis, prevention and treatment of diseases and clinical conditions associated with GOLGA1. KIAA0014 (Accession NM_014665) is another VGAM113 host target gene. KIAA0014 BINDING SITE is HOST TARGET binding site found in the 3' untranslated region of mRNA encoded by KIAA0014, corresponding to a HOST TARGET binding site such as BINDING SITE I, BINDING SITE II or BINDING SITE III. Table 2 illustrates the complementarity of the nucleotide sequences of KIAA0014 BINDING SITE, designated SEQ ID:16118, to the nucleotide sequence of VGAM113 RNA, herein designated VGAM RNA, also designated SEQ ID:2824.

Another function of VGAM113 is therefore inhibition of KIAA0014 (Accession NM_014665). Accordingly, utilities of VGAM113 include diagnosis, prevention and treatment of diseases and clinical conditions associated with KIAA0014. KIAA0494 (Accession NM_014774) is another VGAM113 host target gene. KIAA0494 BINDING SITE is HOST TARGET binding site found in the 3' untranslated region of mRNA encoded by KIAA0494, corresponding to a HOST TARGET binding site such as BINDING SITE I, BINDING SITE II or BINDING SITE III. Table 2 illustrates the complementarity of the nucleotide sequences of KIAA0494 BINDING SITE, designated SEQ ID:16593, to the nucleotide sequence of VGAM113 RNA, herein designated VGAM RNA, also designated SEQ ID:2824.

Another function of VGAM113 is therefore inhibition of KIAA0494 (Accession NM_014774). Accordingly, utilities of VGAM113 include diagnosis, prevention and treatment of diseases and clinical conditions associated with KIAA0494. MAP (Accession NM_022818) is another VGAM113 host target gene. MAP BINDING SITE is HOST TARGET binding site found in the 3" untranslated region of mRNA encoded by MAP, corresponding to a HOST TARGET binding site such as BINDING SITE I, BINDING SITE II or BINDING SITE III. Table 2 illustrates the complementarity of the nucleotide sequences of MAP BINDING SITE, designated SEQ ID:23096, to the nucleotide sequence of VGAM113 RNA, herein designated VGAM RNA, also designated SEQ ID:2824.

Another function of VGAM113 is therefore inhibition of MAP (Accession NM_022818). Accordingly, utilities of VGAM113 include diagnosis, prevention and treatment of diseases and clinical conditions associated with MAP. NIR3 (Accession XM_038799) is another VGAM113 host target gene. NIR3 BINDING SITE is HOST TARGET binding site found in the 3' untranslated region of mRNA encoded by NIR3, corresponding to a HOST TARGET binding site such as BINDING SITE I, BINDING SITE II or BINDING SITE III. Table 2 illustrates the complementarity of the nucleotide sequences of NIR3 BINDING SITE, designated SEQ ID:32927, to the nucleotide sequence of VGAM113 RNA, herein designated VGAM RNA, also designated SEQ ID:2824.

Another function of VGAM113 is therefore inhibition of NIR3 (Accession XM_038799). Accordingly, utilities of VGAM113 include diagnosis, prevention and treatment of diseases and clinical conditions associated with NIR3. LOC160156 (Accession XM_090047) is another VGAM113 host target gene. LOC160156 BINDING SITE is HOST TARGET binding site found in the 5' untranslated region of mRNA encoded by LOC160156, corresponding to a HOST TARGET binding site such as BINDING SITE I, BINDING SITE II or BINDING SITE III. Table 2 illustrates the complementarity of the nucleotide sequences of LOC160156 BINDING SITE, designated SEQ ID:39992, to the nucleotide sequence of VGAM113 RNA, herein designated VGAM RNA, also designated SEQ ID:2824.

Another function of VGAM113 is therefore inhibition of LOC160156 (Accession XM_090047). Accordingly, utilities of VGAM113 include diagnosis, prevention and treatment of diseases and clinical conditions associated with LOC160156. LOC220477 (Accession XM_071675) is another VGAM113 host target gene. LOC220477 BINDING SITE is HOST TARGET binding site found in the 5' untranslated region of mRNA encoded by LOC220477, corresponding to a HOST TARGET binding site such as BINDING SITE I, BINDING SITE II or BINDING SITE III. Table 2 illustrates the complementarity of the nucleotide sequences of LOC220477 BIND- ING SITE, designated SEQ ID:37408, to the nucleotide sequence of VGAM113 RNA, herein designated VGAM RNA, also designated SEQ ID:2824.

Another function of VGAM113 is therefore inhibition of LOC220477 (Accession XM_071675). Accordingly, utilities of VGAM113 include diagnosis, prevention and treatment of diseases and clinical conditions associated with LOC220477. FIG. 1 further provides a conceptual description of a novel bioinformatically detected viral gene of the present invention, referred to here as Viral Genomic Address Messenger 114 (VGAM114) viral gene, which modulates expression of respective host target genes thereof, the function and utility of which host target genes is known in the art.

VGAM114 is a novel bioinformatically detected regulatory, non protein coding, viral micro RNA (miRNA) gene. The method by which VGAM114 was detected is described hereinabove with reference to FIGS. 1-8.

VGAM114 gene, herein designated VGAM GENE, is a viral gene contained in the genome of Shrimp White Spot Syndrome Virus (white spot bacilliform virus). VGAM114 host target gene, herein designated VGAM HOST TARGET GENE, is a human gene contained in the human genome.

VGAM114 gene encodes a VGAM114 precursor RNA, herein designated VGAM PRECURSOR RNA. Similar to other miRNA genes, and unlike most ordinary genes, VGAM114 precursor RNA does not encode a protein. A nucleotide sequence identical or highly similar to the nucleotide sequence of VGAM114 precursor RNA is designated SEQ ID:100, and is provided hereinbelow with reference to the sequence listing part. Nucleotide sequence SEQ ID:100 is located at position 41311 relative to the genome of Shrimp White Spot Syndrome Virus (white spot bacilliform virus).

VGAM114 precursor RNA folds onto itself, forming VGAM114 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM114 folded precursor RNA into VGAM114 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM114 RNA is designated SEQ ID:2825, and is provided hereinbelow with reference to the sequence listing part.

VGAM114 host target gene, herein designated VGAM HOST TARGET GENE, encodes a corresponding messenger RNA, VGAM114 host target RNA, herein designated VGAM HOST TARGET RNA. VGAM114 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM114 RNA, herein designated VGAM RNA, binds complementarily to one or more host target binding sites located in untranslated regions of VGAM114 host target RNA, herein designated VGAM HOST TARGET RNA. This complementary binding is due to the fact that the nucleotide sequence of VGAM114 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM114 RNA, herein designated VGAM RNA, may have a different number of host target binding sites in untranslated regions of a VGAM114 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM114 RNA, herein designated VGAM RNA, to host target binding sites on VGAM114 host target RNA, herein designated VGAM HOST TARGET RNA, such as BINDING SITE I, BINDING SITE II and BINDING SITE III, inhibits translation of VGAM114 host target RNA into VGAM114 host target protein, herein designated VGAM HOST TARGET PROTEIN. VGAM host target protein is therefore outlined by a broken line.

It is appreciated that VGAM114 host target gene, herein designated VGAM HOST TARGET GENE, in fact represents a plurality of VGAM114 host target genes. The mRNA of each one of this plurality of VGAM114 host target genes comprises one or more host target binding sites, each having a nucleotide sequence which is at least partly complementary to VGAM114 RNA, herein designated VGAM RNA, and which when bound by VGAM114 RNA causes inhibition of translation of respective one or more VGAM114 host target proteins.

It is further appreciated by one skilled in the art that the mode of translational inhibition illustrated by FIG. 1 with specific reference to translational inhibition exerted by VGAM114 gene, herein designated VGAM GENE, on one or more VGAM114 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM114 is inhibition of expression of host target genes, as part of a novel viral mechanism of attacking a host. Accordingly, utilities of VGAM114 include diagnosis, prevention and treatment of viral infection by Shrimp White Spot Syndrome Virus (white spot bacilliform virus). Specific functions, and accordingly utilities, of VGAM114 correlate with, and may be deduced from, the identity of the host target genes which VGAM114 binds and inhibits, and the function of these host target genes, as elaborated hereinbelow.

Nucleotide sequences of the VGAM114 precursor RNA, herein designated VGAM PRECURSOR RNA, and of the 'diced' VGAM114 RNA, herein designated VGAM RNA, and a schematic representation of the secondary folding of VGAM114 folded precursor RNA, herein designated VGAM FOLDED PRECURSOR RNA, of VGAM114 are further described hereinbelow with reference to Table 1.

Nucleotide sequences of host target binding sites, such as BINDING SITE-I, BINDING SITE-II and BINDING SITE- III of FIG. 1, found on VGAM114 host target RNA, and schematic representation of the complementarity of each of these host target binding sites to VGAM114 RNA, herein designated VGAM RNA, are described hereinbelow with reference to Table 2.

As mentioned hereinabove with reference to FIG. 1, a function of VGAM114 gene, herein designated VGAM is inhibition of expression of VGAM114 target genes. It is appreciated that specific functions, and accordingly utilities, of VGAM114 correlate with, and may be deduced from, the identity of the target genes which VGAM114 binds and inhibits, and the function of these target genes, as elaborated hereinbelow.

Adenylate Cyclase 7 (ADCY7, Accession NM_001114) is a VGAM114 host target gene. ADCY7 BINDING SITE is HOST TARGET binding site found in the 5' untranslated region of mRNA encoded by ADCY7, corresponding to a HOST TARGET binding site such as BINDING SITE I, BINDING SITE II or BINDING SITE III. Table 2 illustrates the complementarity of the nucleotide sequences of ADCY7 BINDING SITE, designated SEQ ID:6783, to the nucleotide sequence of VGAM114 RNA, herein designated VGAM RNA, also designated SEQ ID:2825.

A function of VGAM114 is therefore inhibition of Adenylate Cyclase 7 (ADCY7, Accession NM_001114), a gene which this a membrane-bound, ca (2+)-inhibitable adenylyl cyclase. Accordingly, utilities of VGAM114 include diagnosis, prevention and treatment of diseases and clinical conditions associated with ADCY7. The function of ADCY7 and its association with various diseases and clinical conditions, has been established by previous studies, as described hereinabove with reference to VGAM108. Calcium Channel, Voltage-dependent, Beta 1 Subunit (CACNB1, Accession NM_000723) is another VGAM114 host target gene. CACNB1 BINDING SITE is HOST TARGET binding site found in the 3' untranslated region of mRNA encoded by CACNB1, corresponding to a HOST TARGET binding site such as BINDING SITE I, BINDING SITE II or BINDING SITE III. Table 2 illustrates the complementarity of the nucleotide sequences of CACNB1 BINDING SITE, designated SEQ ID:6385, to the nucleotide sequence of VGAM114 RNA, herein designated VGAM RNA, also designated SEQ ID:2825.

Another function of VGAM114 is therefore inhibition of Calcium Channel, Voltage-dependent, Beta 1 Subunit (CACNB1, Accession NM_000723), a gene which may not only play an important role in the transport/insertion of the alpha-1S subunit into the membrane. Accordingly, utilities of VGAM114 include diagnosis, prevention and treatment of diseases and clinical conditions associated with CACNB1. The function of CACNB1 has been established by previous studies. Pragnell et al. (1991) isolated a cDNA clone encoding a protein with high homology to the beta subunit of the rabbit skeletal muscle dihydropyridine-sensitive calcium channel from a rat brain cDNA library. This rat brain beta-subunit cDNA hybridized to a 3.4-kb message that was expressed in high levels in the cerebral hemispheres and hippocampus and much lower levels in cerebellum. The open reading frame encodes 597 amino acids with a predicted mass of 65,679 Da which is 82% homologous with the skeletal muscle beta subunit. The corresponding human beta-subunit gene was localized to chromosome 17 by analysis of somatic cell hybrids. Pragnell et al. (1991) suggested that the encoded brain beta subunit, which has a primary structure highly similar to its isoform in skeletal muscle, may have a comparable role as an integral regulatory component of a neuronal calcium channel. To determine the role of the beta-1 subunit in channel activity and excitation-contraction coupling, Gregg et al. (1996) used gene targeting to inactivate the beta-1 subunit in mice. Homozygous mutant fetuses had a phenotype very similar to that seen in mice with mutations in either the alpha-1S subunit ('muscular dysgenic') or in the ryanodine receptor-1 (OMIM Ref. No. 180901), 'skrr.' All 3 mutants lacked excitation-contraction coupling. Beta-1-null mice died at birth from asphyxia. Electrical stimulation of beta-1-muscle failed to induce twitches; however, contractures were induced by caffeine. In isolated beta-1-null myotubes, action potentials were normal but failed to elicit calcium ion transient. Immunohistochemistry of cultured myotubes showed that not only was the beta-1 subunit absent, but the amount of alpha-1S in the membrane was also undetectable. In contrast, the beta-1 subunit was appropriately localized in alpha-1S-null cells. Therefore, Gregg et al. (1996) concluded that the beta-1 subunit may not only play an important role in the transport/insertion of the alpha-1S subunit into the membrane, but may also be vital for the targeting of the muscle dihydropyridine receptor complex to the transverse tubule/sarcoplasmic reticulum junction.

Full details of the abovementioned studies are described in the following publications, the disclosure of which are hereby incorporated by reference:

Pragnell, M.; Sakamoto, J.; Jay, S. D.; Campbell, K. P.: Cloning and tissue-specific expression of the brain calcium channel beta-subunit. FEBS Lett. 291:253-258, 1991; and Gregg, R. G.; Messing, A.; Strube, C.; Beurg, M.; Moss, R.; Behan, M.; Sukhareva, M.; Haynes, S.; Powell, J. A.; Coronado, R.; Powers, P. A.: Absence of the beta subunit (cchb1) of the.

Further studies establishing the function and utilities of CACNB1 are found in John Hopkins OMIM database record ID 114207, and in sited publications numbered 4852-4853, 485 and 4854 listed in the bibliography section hereinbelow, which are also hereby incorporated by reference. DEC1 (Accession NM_017418) is another VGAM114 host target gene. DEC1 BINDING SITE is HOST TARGET binding site found in the 5' untranslated region of mRNA encoded by DEC1, corresponding to a HOST TARGET binding site such as BINDING SITE I, BINDING SITE II or BINDING SITE III. Table 2 illustrates the complementarity of the nucleotide sequences of DEC1 BINDING SITE, designated SEQ ID:18875, to the nucleotide sequence of VGAM114 RNA, herein designated VGAM RNA, also designated SEQ ID:2825.

Another function of VGAM114 is therefore inhibition of DEC1 (Accession NM_017418), a gene which acts as a tumor suppressor associated with esophageal cancer. Accordingly, utilities of VGAM114 include diagnosis, prevention and treatment of diseases and clinical conditions associated with DEC1. The function of DEC1 has been established by previous studies. Loss of heterozygosity (LOH) is often shown at 9q31 in esophageal squamous cell carcinomas (OMIM Ref. No. 133239) as well as in squamous cell carcinomas of developmentally related tissues such as bladder (OMIM Ref. No. 109800), lung (OMIM Ref. No. 211980), and head and neck. Miura et al. (1996) delineated a region commonly deleted in esophageal squamous cell carcinomas to a 200-kb segment at 9q32. Nishiwaki et al. (2000) sequenced overlapping clones in this commonly deleted region and identified a possible candidate gene, which they named 'deleted in esophageal cancer-1' (DEC1). The DEC1 gene encodes a deduced 70-amino acid protein. Northern blot analysis detected a 1.4-kb DEC1 transcript in all tissues tested, with highest expression in prostate and testis. DEC1 expression was lower than normal and often absent in more than half of the esophageal carcinomas examined. Furthermore, DEC1 cDNA was able to exert growth suppressive activity in vitro. Although expression was reduced, no genetic alteration was detected in the DEC1 gene in any of the cancers examined.

Full details of the abovementioned studies are described in the following publications, the disclosure of which are hereby incorporated by reference:

Miura, K.; Suzuki, K.; Tokino, T.; Isomura, M.; Inazawa, J.; Matsuno, S.; Nakamura, Y.: Detailed deletion mapping in squamous cell carcinomas of the esophagus narrows a region containing a putative tumor suppressor gene to about 200 kilobases on distal chromosome 9q. Cancer Res. 56:1629-1634, 1996. ; and Nishiwaki, T.; Daigo, Y.; Kawasoe, T.; Nakamura, Y.: Isolation and mutational analysis of a novel human cDNA, DEC1 (deleted in esophageal cancer 1), derived from the tumor suppressor 1.

Further studies establishing the function and utilities of DEC1 are found in John Hopkins OMIM database record ID 604767, and in sited publications numbered 7291-7292 listed in the bibliography section hereinbelow, which are also hereby incorporated by reference. Hippocalcin (HPCA, Accession NM_002143) is another VGAM114 host target gene. HPCA BINDING SITE is HOST TARGET binding site found in the 3' untranslated region of mRNA encoded by HPCA, corresponding to a HOST TARGET binding site such as BINDING SITE I, BINDING SITE II or BINDING SITE III. Table 2 illustrates the complementarity of the nucleotide sequences of HPCA BINDING SITE, designated SEQ ID:7919, to the nucleotide sequence of VGAM114 RNA, herein designated VGAM RNA, also designated SEQ ID:2825.

Another function of VGAM114 is therefore inhibition of Hippocalcin (HPCA, Accession NM_002143), a gene which may be an hippocampal calcium-binding protein. Accordingly, utilities of VGAM114 include diagnosis, prevention and treatment of diseases and clinical conditions associated with HPCA. The function of HPCA has been established by previous studies. Hippocalcin is a member of a family of neuron-specific Ca (2+)-binding proteins found in the retina and brain. Hippocalcin is a 23-kD Ca (2+)-binding protein first identified in the rat hippocampus (Kobayashi et al., 1992). The primary structure of rat hippocalcin comprises 193 amino acid residues and shows striking sequence similarities to proteins located in the photoreceptor cells that regulate photosignal transduction in a Ca (2+)-sensitive manner. Hippocalcin is associated with the plasma membrane. Takamatsu et al. (1994) isolated a cDNA clone encoding human hippocalcin from a human hippocampus cDNA library. The human sequence showed 100% amino acid identity with the rat sequence and 92% nucleotide identity. Northern blot analysis detected a single 2.0-kb HPCA transcript only in brain.

Full details of the abovementioned studies are described in the following publications, the disclosure of which are hereby incorporated by reference:

Kobayashi, M.; Takamatsu, K.; Saitoh, S.; Miura, M.; Noguchi, T.: Molecular cloning of hippocalcin, a novel calcium-binding protein of the recoverin family exclusively expressed in hippocampus. Biochem. Biophys. Res. Commun. 189:511-517, 1992; and Takamatsu, K.; Kobayashi, M.; Saitoh, S.; Fujishiro, M.; Noguchi, T.: Molecular cloning of human hippocalcin cDNA and chromosomal mapping of its gene. Biochem. Biophys. Res. Commun. 20.

Further studies establishing the function and utilities of HPCA are found in John Hopkins OMIM database record ID 142622, and in sited publications numbered 3893-3894 listed in the bibliography section hereinbelow, which are also hereby incorporated by reference. Kell Blood Group Precursor (McLeod phenotype) (XK, Accession NM_021083) is another VGAM114 host target gene. XK BINDING SITE is HOST TARGET binding site found in the 3' untranslated region of mRNA encoded by XK, corresponding to a HOST TARGET binding site such as BINDING SITE I, BINDING SITE II or BINDING SITE III. Table 2 illustrates the complementarity of the nucleotide sequences of XK BINDING SITE, designated SEQ ID:22057, to the nucleotide sequence of VGAM114 RNA, herein designated VGAM RNA, also designated SEQ ID:2825.

Another function of VGAM114 is therefore inhibition of Kell Blood Group Precursor (McLeod phenotype) (XK, Accession NM_021083). Accordingly, utilities of VGAM114 include diagnosis, prevention and treatment of diseases and clinical conditions associated with XK. DKFZp547I224 (Accession NM_020221) is another VGAM114 host target gene. DKFZp547I224 BINDING SITE is HOST TARGET binding site found in the 5' untranslated region of mRNA encoded by DKFZp547I224, corresponding to a HOST TARGET binding site such as BINDING SITE I, BINDING SITE II or BINDING SITE III. Table 2 illustrates the complementarity of the nucleotide sequences of DKFZp547I224 BINDING SITE, designated SEQ ID:21480, to the nucleotide sequence of VGAM114 RNA, herein designated VGAM RNA, also designated SEQ ID:2825.

Another function of VGAM114 is therefore inhibition of DKFZp547I224 (Accession NM_020221). Accordingly, utilities of VGAM114 include diagnosis, prevention and treatment of diseases and clinical conditions associated with DKFZp547I224. DKFZP564D0478 (Accession NM_032125) is another VGAM114 host target gene. DKFZP564D0478 BINDING SITE is HOST TARGET binding site found in the 3' untranslated region of mRNA encoded by DKFZP564D0478, corresponding to a HOST TARGET binding site such as BINDING SITE I, BINDING SITE II or BINDING SITE III. Table 2 illustrates the complementarity of the nucleotide sequences of DKFZP564D0478 BINDING SITE, designated SEQ ID:25810, to the nucleotide sequence of VGAM114 RNA, herein designated VGAM RNA, also designated SEQ ID:2825.

Another function of VGAM114 is therefore inhibition of DKFZP564D0478 (Accession NM_032125). Accordingly, utilities of VGAM114 include diagnosis, prevention and treatment of diseases and clinical conditions associated with DKFZP564D0478. FLJ12572 (Accession NM_022905) is another VGAM114 host target gene. FLJ12572 BINDING SITE is HOST TARGET binding site found in the 3' untranslated region of mRNA encoded by FLJ12572, corresponding to a HOST TARGET binding site such as BINDING SITE I, BINDING SITE II or BINDING SITE III. Table 2 illustrates the complementarity of the nucleotide sequences of FLJ12572 BINDING SITE, designated SEQ ID:23201, to the nucleotide sequence of VGAM114 RNA, herein designated VGAM RNA, also designated SEQ ID:2825.

Another function of VGAM114 is therefore inhibition of FLJ12572 (Accession NM_022905). Accordingly, utilities of VGAM114 include diagnosis, prevention and treatment of diseases and clinical conditions associated with FLJ12572. Hypermethylated In Cancer 2 (HIC2, Accession XM_036937) is another VGAM114 host target gene. HIC2 BINDING SITE is HOST TARGET binding site found in the 3' untranslated region of mRNA encoded by HIC2, corresponding to a HOST TARGET binding site such as BIND- ING SITE I, BINDING SITE II or BINDING SITE III. Table 2 illustrates the complementarity of the nucleotide sequences of HIC2 BINDING SITE, designated SEQ ID:32525, to the nucleotide sequence of VGAM114 RNA, herein designated VGAM RNA, also designated SEQ ID:2825.

Another function of VGAM114 is therefore inhibition of Hypermethylated In Cancer 2 (HIC2, Accession XM_036937). Accordingly, utilities of VGAM114 include diagnosis, prevention and treatment of diseases and clinical conditions associated with HIC2. HSA243666 (Accession NM_017582) is another VGAM114 host target gene. HSA243666 BINDING SITE is HOST TARGET binding site found in the 3' untranslated region of mRNA encoded by HSA243666, corresponding to a HOST TARGET binding site such as BINDING SITE I, BINDING SITE II or BINDING SITE III. Table 2 illustrates the complementarity of the nucleotide sequences of HSA243666 BINDING SITE, designated SEQ ID:19022, to the nucleotide sequence of VGAM114 RNA, herein designated VGAM RNA, also designated SEQ ID:2825.

Another function of VGAM114 is therefore inhibition of HSA243666 (Accession NM_017582). Accordingly, utilities of VGAM114 include diagnosis, prevention and treatment of diseases and clinical conditions associated with HSA243666. KIAA0296 (Accession NM_014699) is another VGAM114 host target gene. KIAA0296 BINDING SITE is HOST TARGET binding site found in the 3' untranslated region of mRNA encoded by KIAA0296, corresponding to a HOST TARGET binding site such as BINDING SITE I, BINDING SITE II or BINDING SITE III. Table 2 illustrates the complementarity of the nucleotide sequences of KIAA0296 BINDING SITE, designated SEQ ID:16218, to the nucleotide sequence of VGAM114 RNA, herein designated VGAM RNA, also designated SEQ ID:2825.

Another function of VGAM114 is therefore inhibition of KIAA0296 (Accession NM_014699). Accordingly, utilities of VGAM114 include diagnosis, prevention and treatment of diseases and clinical conditions associated with KIAA0296. LEAP-2 (Accession NM_052971) is another VGAM114 host target gene. LEAP-2 BINDING SITE is HOST TARGET binding site found in the 5' untranslated region of mRNA encoded by LEAP-2, corresponding to a HOST TARGET binding site such as BINDING SITE I, BINDING SITE II or BINDING SITE III. Table 2 illustrates the complementarity of the nucleotide sequences of LEAP-2 BINDING SITE, designated SEQ ID:27545, to the nucleotide sequence of VGAM114 RNA, herein designated VGAM RNA, also designated SEQ ID:2825.

Another function of VGAM114 is therefore inhibition of LEAP-2 (Accession NM_052971). Accordingly, utilities of VGAM114 include diagnosis, prevention and treatment of diseases and clinical conditions associated with LEAP-2. MGC10715 (Accession NM_024325) is another VGAM114 host target gene. MGC10715 BINDING SITE is HOST TARGET binding site found in the 3' untranslated region of mRNA encoded by MGC10715, corresponding to a HOST TARGET binding site such as BINDING SITE I, BINDING SITE II or BINDING SITE III. Table 2 illustrates the complementarity of the nucleotide sequences of MGC10715 BINDING SITE, designated SEQ ID:23613, to the nucleotide sequence of VGAM114 RNA, herein designated VGAM RNA, also designated SEQ ID:2825.

Another function of VGAM114 is therefore inhibition of MGC10715 (Accession NM_024325). Accordingly, utilities of VGAM114 include diagnosis, prevention and treatment of diseases and clinical conditions associated with MGC10715. SARM (Accession NM_015077) is another VGAM114 host target gene. SARM BINDING SITE is HOST TARGET binding site found in the 3" untranslated region of mRNA encoded by SARM, corresponding to a HOST TARGET binding site such as BINDING SITE I, BINDING SITE II or BINDING SITE III. Table 2 illustrates the complementarity of the nucleotide sequences of SARM BINDING SITE, designated SEQ ID:17455, to the nucleotide sequence of VGAM114 RNA, herein designated VGAM RNA, also designated SEQ ID:2825.

Another function of VGAM114 is therefore inhibition of SARM (Accession NM_015077). Accordingly, utilities of VGAM114 include diagnosis, prevention and treatment of diseases and clinical conditions associated with SARM. LOC143287 (Accession XM_096410) is another VGAM114 host target gene. LOC143287 BINDING SITE is HOST TARGET binding site found in the 3' untranslated region of mRNA encoded by LOC143287, corresponding to a HOST TARGET binding site such as BINDING SITE I, BINDING SITE II or BINDING SITE III. Table 2 illustrates the complementarity of the nucleotide sequences of LOC143287 BINDING SITE, designated SEQ ID:40344, to the nucleotide sequence of VGAM114 RNA, herein designated VGAM RNA, also designated SEQ ID:2825.

Another function of VGAM114 is therefore inhibition of LOC143287 (Accession XM_096410). Accordingly, utilities of VGAM114 include diagnosis, prevention and treatment of diseases and clinical conditions associated with LOC143287. LOC150967 (Accession XM_087060) is another VGAM114 host target gene. LOC150967 BINDING SITE is HOST TARGET binding site found in the 5' untranslated region of mRNA encoded by LOC150967, corresponding to a HOST TARGET binding site such as BINDING SITE I, BINDING SITE II or BINDING SITE III. Table 2 illustrates the complementarity of the nucleotide sequences of LOC150967 BINDING SITE, designated SEQ ID:39036, to the nucleotide sequence of VGAM114 RNA, herein designated VGAM RNA, also designated SEQ ID:2825.

Another function of VGAM114 is therefore inhibition of LOC150967 (Accession XM_087060). Accordingly, utilities of VGAM114 include diagnosis, prevention and treatment of diseases and clinical conditions associated with LOC150967. LOC154877 (Accession XM_098626) is another VGAM114 host target gene. LOC154877 BINDING SITE is HOST TARGET binding site found in the 3' untranslated region of mRNA encoded by LOC154877, corresponding to a HOST TARGET binding site such as BINDING SITE I, BINDING SITE II or BINDING SITE III. Table 2 illustrates the complementarity of the nucleotide sequences of LOC154877 BINDING SITE, designated SEQ ID:41745, to the nucleotide sequence of VGAM114 RNA, herein designated VGAM RNA, also designated SEQ ID:2825.

Another function of VGAM114 is therefore inhibition of LOC154877 (Accession XM_098626). Accordingly, utilities of VGAM114 include diagnosis, prevention and treatment of diseases and clinical conditions associated with LOC154877. LOC165904 (Accession XM_093522) is another VGAM114 host target gene. LOC165904 BINDING SITE is HOST TARGET binding site found in the 3' untranslated region of mRNA encoded by LOC165904, corresponding to a HOST TARGET binding site such as BINDING SITE I, BINDING SITE II or BINDING SITE III. Table 2 illustrates the complementarity of the nucleotide sequences of LOC165904 BINDING SITE, designated SEQ ID:40193, to the nucleotide sequence of VGAM114 RNA, herein designated VGAM RNA, also designated SEQ ID:2825.

Another function of VGAM114 is therefore inhibition of LOC165904 (Accession XM_093522). Accordingly, utilities of VGAM114 include diagnosis, prevention and treatment of diseases and clinical conditions associated with LOC165904.

LOC200325 (Accession XM_117223) is another VGAM114 host target gene. LOC200325 BINDING SITE is HOST TARGET binding site found in the 5' untranslated region of mRNA encoded by LOC200325, corresponding to a HOST TARGET binding site such as BINDING SITE I, BINDING SITE II or BINDING SITE III. Table 2 illustrates the complementarity of the nucleotide sequences of LOC200325 BINDING SITE, designated SEQ ID:43288, to the nucleotide sequence of VGAM114 RNA, herein designated VGAM RNA, also designated SEQ ID:2825.

Another function of VGAM114 is therefore inhibition of LOC200325 (Accession XM_117223). Accordingly, utilities of VGAM114 include diagnosis, prevention and treatment of diseases and clinical conditions associated with LOC200325.

LOC206463 (Accession XM_116523) is another VGAM114 host target gene. LOC206463 BINDING SITE is HOST TARGET binding site found in the 5' untranslated region of mRNA encoded by LOC206463, corresponding to a HOST TARGET binding site such as BINDING SITE I, BINDING SITE II or BINDING SITE III. Table 2 illustrates the complementarity of the nucleotide sequences of LOC206463 BINDING SITE, designated SEQ ID:43122, to the nucleotide sequence of VGAM114 RNA, herein designated VGAM RNA, also designated SEQ ID:2825.

Another function of VGAM114 is therefore inhibition of LOC206463 (Accession XM_116523). Accordingly, utilities of VGAM114 include diagnosis, prevention and treatment of diseases and clinical conditions associated with LOC206463.

LOC220469 (Accession XM_084334) is another VGAM114 host target gene. LOC220469 BINDING SITE is HOST TARGET binding site found in the 3' untranslated region of mRNA encoded by LOC220469, corresponding to a HOST TARGET binding site such as BINDING SITE I, BINDING SITE II or BINDING SITE III. Table 2 illustrates the complementarity of the nucleotide sequences of LOC220469 BINDING SITE, designated SEQ ID:37555, to the nucleotide sequence of VGAM114 RNA, herein designated VGAM RNA, also designated SEQ ID:2825.

Another function of VGAM114 is therefore inhibition of LOC220469 (Accession XM_084334). Accordingly, utilities of VGAM114 include diagnosis, prevention and treatment of diseases and clinical conditions associated with LOC220469.

LOC245806 (Accession XM_166309) is another VGAM114 host target gene. LOC245806 BINDING SITE is HOST TARGET binding site found in the 3' untranslated region of mRNA encoded by LOC245806, corresponding to a HOST TARGET binding site such as BINDING SITE I, BINDING SITE II or BINDING SITE III. Table 2 illustrates the complementarity of the nucleotide sequences of LOC245806 BINDING SITE, designated SEQ ID:44130, to the nucleotide sequence of VGAM114 RNA, herein designated VGAM RNA, also designated SEQ ID:2825.

Another function of VGAM114 is therefore inhibition of LOC245806 (Accession XM_166309). Accordingly, utilities of VGAM114 include diagnosis, prevention and treatment of diseases and clinical conditions associated with LOC245806.

FIG. 1 further provides a conceptual description of a novel bioinformatically detected viral gene of the present invention, referred to here as Viral Genomic Address Messenger 115 (VGAM115) viral gene, which modulates expression of respective host target genes thereof, the function and utility of which host target genes is known in the art.

VGAM115 is a novel bioinformatically detected regulatory, non protein coding, viral micro RNA (miRNA) gene. The method by which VGAM115 was detected is described hereinabove with reference to FIGS. 1-8.

VGAM115 gene, herein designated VGAM GENE, is a viral gene contained in the genome of Shrimp White Spot Syndrome Virus (white spot bacilliform virus). VGAM115 host target gene, herein designated VGAM HOST TARGET GENE, is a human gene contained in the human genome.

VGAM115 gene encodes a VGAM115 precursor RNA, herein designated VGAM PRECURSOR RNA. Similar to other miRNA genes, and unlike most ordinary genes, VGAM115 precursor RNA does not encode a protein. A nucleotide sequence identical or highly similar to the nucleotide sequence of VGAM115 precursor RNA is designated SEQ ID:101, and is provided hereinbelow with reference to the sequence listing part. Nucleotide sequence SEQ ID:101 is located at position 125173 relative to the genome of Shrimp White Spot Syndrome Virus (white spot bacilliform virus).

VGAM115 precursor RNA folds onto itself, forming VGAM115 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM115 folded precursor RNA into VGAM115 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM115 RNA is designated SEQ ID:2826, and is provided hereinbelow with reference to the sequence listing part.

VGAM115 host target gene, herein designated VGAM HOST TARGET GENE, encodes a corresponding messenger RNA, VGAM115 host target RNA, herein designated VGAM HOST TARGET RNA. VGAM115 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM115 RNA, herein designated VGAM RNA, binds complementarily to one or more host target binding sites located in untranslated regions of VGAM115 host target RNA, herein designated VGAM HOST TARGET RNA. This complementary binding is due to the fact that the nucleotide sequence of VGAM115 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM115 RNA, herein designated VGAM RNA, may have a different number of host target binding sites in untranslated regions of a VGAM115 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM115 RNA, herein designated VGAM RNA, to host target binding sites on VGAM115 host target RNA, herein designated VGAM HOST TARGET RNA, such as BINDING SITE I, BINDING SITE II and BINDING SITE III, inhibits translation of VGAM115 host target RNA into VGAM115 host target protein, herein designated VGAM HOST TARGET PROTEIN. VGAM host target protein is therefore outlined by a broken line.

It is appreciated that VGAM115 host target gene, herein designated VGAM HOST TARGET GENE, in fact represents a plurality of VGAM115 host target genes. The mRNA of each one of this plurality of VGAM115 host target genes comprises one or more host target binding sites, each having a nucleotide sequence which is at least partly complementary to VGAM115 RNA, herein designated VGAM RNA, and which when bound by VGAM115 RNA causes inhibition of translation of respective one or more VGAM115 host target proteins.

It is further appreciated by one skilled in the art that the mode of translational inhibition illustrated by FIG. 1 with specific reference to translational inhibition exerted by VGAM115 gene, herein designated VGAM GENE, on one or more VGAM115 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM115 is inhibition of expression of host target genes, as part of a novel viral mechanism of attacking a host. Accordingly, utilities of VGAM115 include diagnosis, prevention and treatment of viral infection by Shrimp White Spot Syndrome Virus (white spot bacilliform virus). Specific functions, and accordingly utilities, of VGAM115 correlate with, and may be deduced from, the identity of the host target genes which VGAM115 binds and inhibits, and the function of these host target genes, as elaborated hereinbelow.

Nucleotide sequences of the VGAM115 precursor RNA, herein designated VGAM PRECURSOR RNA, and of the 'diced' VGAM115 RNA, herein designated VGAM RNA, and a schematic representation of the secondary folding of VGAM115 folded precursor RNA, herein designated VGAM FOLDED PRECURSOR RNA, of VGAM115 are further described hereinbelow with reference to Table 1.

Nucleotide sequences of host target binding sites, such as BINDING SITE-I, BINDING SITE-II and BINDING SITE-III of FIG. 1, found on VGAM115 host target RNA, and schematic representation of the complementarity of each of these host target binding sites to VGAM115 RNA, herein designated VGAM RNA, are described hereinbelow with reference to Table 2.

As mentioned hereinabove with reference to FIG. 1, a function of VGAM115 gene, herein designated VGAM is inhibition of expression of VGAM115 target genes. It is appreciated that specific functions, and accordingly utilities, of VGAM115 correlate with, and may be deduced from, the identity of the target genes which VGAM115 binds and inhibits, and the function of these target genes, as elaborated hereinbelow.

General Transcription Factor II, I (GTF2I, Accession NM_032999) is a VGAM115 host target gene. GTF2I BINDING SITE1 and GTF2I BINDING SITE2 are HOST TARGET binding sites found in untranslated regions of mRNA encoded by GTF2I, corresponding to HOST TARGET binding sites such as BINDING SITE I, BINDING SITE II or BINDING SITE III. Table 2 illustrates the complementarity of the nucleotide sequences of GTF2I BINDING SITE1 and GTF2I BINDING SITE2, designated SEQ ID:26883 and SEQ ID:26887 respectively, to the nucleotide sequence of VGAM115 RNA, herein designated VGAM RNA, also designated SEQ ID:2826.

A function of VGAM115 is therefore inhibition of General Transcription Factor II, I (GTF2I, Accession NM_032999), a gene which interacts with the basal transcription machinery by coordinating the formation of a multiprotein complex at the c-fos promoter, and linking specific signal responsive activator complexes. Accordingly, utilities of VGAM115 include diagnosis, prevention and treatment of diseases and clinical conditions associated with GTF2I. The function of GTF2I has been established by previous studies. Through transfection experiments, Roy et al. (1997) found that GTF2I is capable of binding to both a pyrimidine-rich initiator (Inr) and an E-box for upstream stimulatory factor-1 (USF1; 191523). GTF2I and USF1 can also act synergistically to activate transcription through both Inr and the E-box elements of the adenovirus major late promoter. By in vitro cotranslation followed by coimmunoprecipitation studies, Roy et al. (1997) confirmed direct protein interaction between GTF2I and USF1. Williams-Beuren syndrome (WBS; 194050) is a neurodevelopmental disorder with multisystemic manifestations caused by heterozygosity for a partial deletion of 7q11.23. The breakpoints cluster within regions located approximately 1 cM at either side of the elastin locus (ELN; 130160). Perez Jurado et al. (1998) characterized a duplicated region near the common deletion breakpoints, which includes a transcribed gene. The centromeric (C) and telomeric (T) copies are almost identical in the duplicated 3-prime portions but diverge at the 5-prime ends. C-specific 4.3-kb mRNA and T-specific 5.4-kb mRNA are widely expressed in embryonic and adult tissues. The telomeric gene gives rise to several tandemly spliced forms and is deleted in all WBS individuals who have documented ELN deletions. Database searches showed that this gene encodes BAP135, a protein phosphorylated by BTK in B cells, as well as the multifunctional transcription factor TFII-I; hence, the gene name GTF2I. The centromeric gene is not deleted in WBS and appears to be a partially truncated expressed pseudogene (GTF2IP1) with no protein product. Both loci map to different genomic clone contigs that also contain other deleted and nondeleted loci. The duplicated region containing GTF2I and GTF2IP1, respectively, is located close to the deletion breakpoints and may predispose to unequal meiotic recombination between chromosome 7 homologs and/or to intrachromosomal rearrangements. Hemizygosity for GTF2I may also contribute to the WBS phenotype.

Full details of the abovementioned studies are described in the following publications, the disclosure of which are hereby incorporated by reference:

Perez Jurado, L. A.; Wang, Y.-K.; Peoples, R.; Coloma, A.; Cruces, J.; Francke, U.: A duplicated gene in the breakpoint regions of the 7q11.23 Williams-Beuren syndrome deletion encodes the initiator binding protein TFII-I and BAP-135, a phosphorylation target of BTK. Hum. Molec. Genet. 7:325-334, 1998; and Roy, A. L.; Du, H.; Gregor, P. D.; Novina, C. D.; Martinez, E.; Roeder, R. G.: Cloning of an Inr- and E-box binding protein, TFII-I, that interacts physically and functionally with USF1.

Further studies establishing the function and utilities of GTF2I are found in John Hopkins OMIM database record ID 601679, and in sited publications numbered 619 and 12616 listed in the bibliography section hereinbelow, which are also hereby incorporated by reference. Solute Carrier Family 18 (vesicular monoamine), Member 1 (SLC18A1, Accession NM_003053) is another VGAM115 host target gene. SLC18A1 BINDING SITE is HOST TARGET binding site found in the 3' untranslated region of mRNA encoded by SLC18A1, corresponding to a HOST TARGET binding site such as BINDING SITE I, BINDING SITE II or BINDING SITE III. Table 2 illustrates the complementarity of the nucleotide sequences of SLC18A1 BINDING SITE, designated SEQ ID:9017, to the nucleotide sequence of VGAM115 RNA, herein designated VGAM RNA, also designated SEQ ID:2826.

Another function of VGAM115 is therefore inhibition of Solute Carrier Family 18 (vesicular monoamine), Member 1 (SLC18A1, Accession NM_003053), a gene which is involved in the vesicular transport of biogenic amines. Accordingly, utilities of VGAM115 include diagnosis, prevention and treatment of diseases and clinical conditions associated with SLC18A1. The function of SLC18A1 and its association with various diseases and clinical conditions, has been established by previous studies, as described hereinabove with reference to VGAM18. FLJ23563 (Accession XM_041701) is another VGAM115 host target gene. FLJ23563 BINDING SITE is HOST TARGET binding site found in the 3' untranslated region of mRNA encoded by FLJ23563, corresponding to a HOST TARGET binding site such as BINDING SITE I, BINDING SITE II or BINDING SITE III. Table 2 illustrates the complementarity of the nucleotide sequences of FLJ23563 BINDING SITE, designated SEQ ID:33560, to the nucleotide sequence of VGAM115 RNA, herein designated VGAM RNA, also designated SEQ ID:2826.

Another function of VGAM115 is therefore inhibition of FLJ23563 (Accession XM_041701). Accordingly, utilities of VGAM115 include diagnosis, prevention and treatment of diseases and clinical conditions associated with FLJ23563. KIAA0408 (Accession NM_014702) is another VGAM115 host target gene. KIAA0408 BINDING SITE is HOST TARGET binding site found in the 5' untranslated region of mRNA encoded by KIAA0408, corresponding to a HOST TARGET binding site such as BINDING SITE I, BINDING SITE II or BINDING SITE III. Table 2 illustrates the complementarity of the nucleotide sequences of KIAA0408 BINDING SITE, designated SEQ ID:16232, to the nucleotide sequence of VGAM115 RNA, herein designated VGAM RNA, also designated SEQ ID:2826.

Another function of VGAM115 is therefore inhibition of KIAA0408 (Accession NM_014702). Accordingly, utilities of VGAM115 include diagnosis, prevention and treatment of diseases and clinical conditions associated with KIAA0408. KIAA0527 (Accession XM_171054) is another VGAM115 host target gene. KIAA0527 BINDING SITE is HOST TARGET binding site found in the 3' untranslated region of mRNA encoded by KIAA0527, corresponding to a HOST TARGET binding site such as BINDING SITE I, BINDING SITE II or BINDING SITE III. Table 2 illustrates the complementarity of the nucleotide sequences of KIAA0527 BINDING SITE, designated SEQ ID:45844, to the nucleotide sequence of VGAM115 RNA, herein designated VGAM RNA, also designated SEQ ID:2826.

Another function of VGAM115 is therefore inhibition of KIAA0527 (Accession XM_171054). Accordingly, utilities of VGAM115 include diagnosis, prevention and treatment of diseases and clinical conditions associated with KIAA0527. KIAA1535 (Accession XM_086565) is another VGAM115 host target gene. KIAA1535 BINDING SITE is HOST TARGET binding site found in the 3' untranslated region of mRNA encoded by KIAA1535, corresponding to a HOST TARGET binding site such as BINDING SITE I, BINDING SITE II or BINDING SITE III. Table 2 illustrates the complementarity of the nucleotide sequences of KIAA1535 BINDING SITE, designated SEQ ID:38765, to the nucleotide sequence of VGAM115 RNA, herein designated VGAM RNA, also designated SEQ ID:2826.

Another function of VGAM115 is therefore inhibition of KIAA1535 (Accession XM_086565). Accordingly, utilities of VGAM115 include diagnosis, prevention and treatment of diseases and clinical conditions associated with KIAA1535. MGC13007 (Accession NM_032320) is another VGAM115 host target gene. MGC13007 BINDING SITE is HOST TARGET binding site found in the 5' untranslated region of mRNA encoded by MGC13007, corresponding to a HOST TARGET binding site such as BINDING SITE I, BINDING SITE II or BINDING SITE III. Table 2 illustrates the complementarity of the nucleotide sequences of MGC13007 BINDING SITE, designated SEQ ID:26120, to the nucleotide sequence of VGAM115 RNA, herein designated VGAM RNA, also designated SEQ ID:2826.

Another function of VGAM115 is therefore inhibition of MGC13007 (Accession NM_032320). Accordingly, utilities of VGAM115 include diagnosis, prevention and treatment of diseases and clinical conditions associated with MGC13007. RNA Binding Motif Protein 14 (RBM14, Accession NM_006328) is another VGAM115 host target gene. RBM14 BINDING SITE is HOST TARGET binding site found in the 3' untranslated region of mRNA encoded by RBM14, corresponding to a HOST TARGET binding site such as BINDING SITE I, BINDING SITE II or BINDING SITE III. Table 2 illustrates the complementarity of the nucleotide sequences of RBM14 BINDING SITE, designated SEQ ID:13020, to the nucleotide sequence of VGAM115 RNA, herein designated VGAM RNA, also designated SEQ ID:2826.

Another function of VGAM115 is therefore inhibition of RNA Binding Motif Protein 14 (RBM14, Accession NM_006328). Accordingly, utilities of VGAM115 include diagnosis, prevention and treatment of diseases and clinical conditions associated with RBM14. LOC147343 (Accession XM_097225) is another VGAM115 host target gene. LOC147343 BINDING SITE is HOST TARGET binding site found in the 5' untranslated region of mRNA encoded by LOC147343, corresponding to a HOST TARGET binding site such as BINDING SITE I, BINDING SITE II or BINDING SITE III. Table 2 illustrates the complementarity of the nucleotide sequences of LOC147343 BINDING SITE, designated SEQ ID:40831, to the nucleotide sequence of VGAM115 RNA, herein designated VGAM RNA, also designated SEQ ID:2826.

Another function of VGAM115 is therefore inhibition of LOC147343 (Accession XM_097225). Accordingly, utilities of VGAM115 include diagnosis, prevention and treatment of diseases and clinical conditions associated with LOC147343. LOC149301 (Accession XM_086480) is another VGAM115 host target gene. LOC149301 BINDING SITE is HOST TARGET binding site found in the 3' untranslated region of mRNA encoded by LOC149301, corresponding to a HOST TARGET binding site such as BINDING SITE I, BINDING SITE II or BINDING SITE III. Table 2 illustrates the complementarity of the nucleotide sequences of LOC149301 BINDING SITE, designated SEQ ID:38690, to the nucleotide sequence of VGAM115 RNA, herein designated VGAM RNA, also designated SEQ ID:2826.

Another function of VGAM115 is therefore inhibition of LOC149301 (Accession XM_086480). Accordingly, utilities of VGAM115 include diagnosis, prevention and treatment of diseases and clinical conditions associated with LOC149301. LOC257319 (Accession XM_171049) is another VGAM115 host target gene. LOC257319 BINDING SITE is HOST TARGET binding site found in the 3' untranslated region of mRNA encoded by LOC257319, corresponding to a HOST TARGET binding site such as BINDING SITE I, BINDING SITE II or BINDING SITE III. Table 2 illustrates the complementarity of the nucleotide sequences of LOC257319 BINDING SITE, designated SEQ ID:45831, to the nucleotide sequence of VGAM115 RNA, herein designated VGAM RNA, also designated SEQ ID:2826.

Another function of VGAM115 is therefore inhibition of LOC257319 (Accession XM_171049). Accordingly, utilities of VGAM115 include diagnosis, prevention and treatment of diseases and clinical conditions associated with LOC257319. FIG. 1 further provides a conceptual description of a novel bioinformatically detected viral gene of the present invention, referred to here as Viral Genomic Address Messenger 116 (VGAM116) viral gene, which modulates expression of respective host target genes thereof, the function and utility of which host target genes is known in the art.

VGAM116 is a novel bioinformatically detected regulatory, non protein coding, viral micro RNA (miRNA) gene. The method by which VGAM116 was detected is described hereinabove with reference to FIGS. 1-8.

VGAM116 gene, herein designated VGAM GENE, is a viral gene contained in the genome of Shrimp White Spot Syndrome Virus (white spot bacilliform virus). VGAM116 host target gene, herein designated VGAM HOST TARGET GENE, is a human gene contained in the human genome.

VGAM116 gene encodes a VGAM116 precursor RNA, herein designated VGAM PRECURSOR RNA. Similar to other miRNA genes, and unlike most ordinary genes, VGAM116 precursor RNA does not encode a protein. A nucleotide sequence identical or highly similar to the nucleotide sequence of VGAM116 precursor RNA is designated SEQ ID:102, and is provided hereinbelow with reference to the sequence listing part. Nucleotide sequence SEQ ID:102 is located at position 284651 relative to the genome of Shrimp White Spot Syndrome Virus (white spot bacilliform virus).

VGAM116 precursor RNA folds onto itself, forming VGAM116 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM116 folded precursor RNA into VGAM116 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM116 RNA is designated SEQ ID:2827, and is provided hereinbelow with reference to the sequence listing part.

VGAM116 host target gene, herein designated VGAM HOST TARGET GENE, encodes a corresponding messenger RNA, VGAM116 host target RNA, herein designated VGAM HOST TARGET RNA. VGAM116 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM116 RNA, herein designated VGAM RNA, binds complementarily to one or more host target binding sites located in untranslated regions of VGAM116 host target RNA, herein designated VGAM HOST TARGET RNA. This complementary binding is due to the fact that the nucleotide sequence of VGAM116 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM116 RNA, herein designated VGAM RNA, may have a different number of host target binding sites in untranslated regions of a VGAM116 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM116 RNA, herein designated VGAM RNA, to host target binding sites on VGAM116 host target RNA, herein designated VGAM HOST TARGET RNA, such as BINDING SITE I, BINDING SITE II and BINDING SITE III, inhibits translation of VGAM116 host target RNA into VGAM116 host target protein, herein designated VGAM HOST TARGET PROTEIN. VGAM host target protein is therefore outlined by a broken line.

It is appreciated that VGAM116 host target gene, herein designated VGAM HOST TARGET GENE, in fact represents a plurality of VGAM116 host target genes. The mRNA of each one of this plurality of VGAM116 host target genes comprises one or more host target binding sites, each having a nucleotide sequence which is at least partly complementary to VGAM116 RNA, herein designated VGAM RNA, and which when bound by VGAM116 RNA causes inhibition of translation of respective one or more VGAM116 host target proteins.

It is further appreciated by one skilled in the art that the mode of translational inhibition illustrated by FIG. 1 with specific reference to translational inhibition exerted by VGAM116 gene, herein designated VGAM GENE, on one or more VGAM116 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM116 is inhibition of expression of host target genes, as part of a novel viral mechanism of attacking a host. Accordingly, utilities of VGAM116 include diagnosis, prevention and treatment of viral infection by Shrimp White Spot Syndrome Virus (white spot bacilliform virus). Specific functions, and accordingly utilities, of VGAM116 correlate with, and may be deduced from, the identity of the host target genes which VGAM116 binds and inhibits, and the function of these host target genes, as elaborated hereinbelow.

Nucleotide sequences of the VGAM116 precursor RNA, herein designated VGAM PRECURSOR RNA, and of the 'diced' VGAM116 RNA, herein designated VGAM RNA, and a schematic representation of the secondary folding of VGAM116 folded precursor RNA, herein designated VGAM FOLDED PRECURSOR RNA, of VGAM116 are further described hereinbelow with reference to Table 1.

Nucleotide sequences of host target binding sites, such as BINDING SITE-I, BINDING SITE-II and BINDING SITE-III of FIG. 1, found on VGAM116 host target RNA, and schematic representation of the complementarity of each of these host target binding sites to VGAM116 RNA, herein designated VGAM RNA, are described hereinbelow with reference to Table 2.

As mentioned hereinabove with reference to FIG. 1, a function of VGAM116 gene, herein designated VGAM is inhibition of expression of VGAM116 target genes. It is appreciated that specific functions, and accordingly utilities, of VGAM116 correlate with, and may be deduced from, the identity of the target genes which VGAM116 binds and inhibits, and the function of these target genes, as elaborated hereinbelow.

Calnexin (CANX, Accession XM_113469) is a VGAM116 host target gene. CANX BINDING SITE is HOST TARGET binding site found in the 3' untranslated region of mRNA encoded by CANX, corresponding to a HOST TARGET binding site such as BINDING SITE I, BINDING SITE II or BINDING SITE III. Table 2 illustrates the complementarity of the nucleotide sequences of CANX BINDING SITE, designated SEQ ID:42278, to the nucleotide sequence of VGAM116 RNA, herein designated VGAM RNA, also designated SEQ ID:2827.

A function of VGAM116 is therefore inhibition of Calnexin (CANX, Accession XM_113469), a gene which may function as a chaperone in the endoplasmic reticulum, involved in the secretion of proteins from the ER to the outer cellular membrane. Accordingly, utilities of VGAM116 include diagnosis, prevention and treatment of diseases and clinical conditions associated with CANX. The function of CANX has been established by previous studies. Calnexin is a 90-kilodalton integral membrane protein of the endoplasmic reticulum (ER). It exhibits high affinity for the binding of calcium ions, which was the means by which it was first identified. Calcium ions are known to play a central role in the regulation of cellular metabolism, including signal transduction events and the transport of proteins through the ER. Calnexin has been shown to be associated with several cell surface proteins during translocation through the ER and has been isolated as a complex with other ER proteins involved in calcium ion-dependent retention of proteins. It may function as a chaperone to regulate the transit of proteins through the ER. Tjoelker et al. (1994) isolated cDNA clones of the human, mouse, and rat calnexins. Comparisons of the sequences demonstrated a high level of conservation of sequence identity, suggesting that calnexin performs important cellular functions. Schwann cell-derived peripheral myelin protein-22 (PMP22; 601097), when mutated or overexpressed, causes heritable neuropathies with a 'gain-of-function' endoplasmic reticulum (ER) phenotype. PMP22 associates in a specific and transient manner with CANX in wildtype sciatic nerves. In the sciatic nerves of the Trembler (TrJ) mouse carrying the same mutation in the PMP22 gene that causes Charcot-Marie-Tooth disease (CMT) in the human, Dickson et al. (2002) found prolonged association of mutant PMP22 with CANX. In cultured cells expressing the TrJ mutant PMP22, CANX and PMP22 colocalized in large intracellular structures identified at the electron microscopy level as myelin-like figures, with CANX localization in the structures dependent on PMP22 glucosylation. Similar intracellular myelin-like figures were also present in Schwann cells of sciatic nerves from homozygous TrJ mice. Sequestration of CANX in intracellular myelin-like figures may be relevant to the pathogenesis of autosomal dominant CMT-related neuropathies.

Full details of the abovementioned studies are described in the following publications, the disclosure of which are hereby incorporated by reference:

Tjoelker, L. W.; Seyfried, C. E.; Eddy, R. L., Jr.; Byers, M. G.; Shows, T. B.; Calderon, J.; Schreiber, R. B.; Gray, P. W.: Human, mouse, and rat calnexin cDNA cloning: identification of potential calcium binding motifs and gene localization to human chromosome 5. Biochemistry 33:3229-3236, 1994; and Dickson, K. M.; Bergeron, J. J. M.; Shames, I.; Colby, J.; Nguyen, D. T.; Chevet, E.; Thomas, D. Y.; Snipes, G. J.: Association of calnexin with mutant peripheral myelin protein-22 ex v.

Further studies establishing the function and utilities of CANX are found in John Hopkins OMIM database record ID 114217, and in sited publications numbered 4032-4035 listed in the bibliography section hereinbelow, which are also hereby incorporated by reference. DKFZP564C196 (Accession XM_046405) is another VGAM116 host target gene. DKFZP564C196 BINDING SITE is HOST TARGET binding site found in the 3' untranslated region of mRNA encoded by DKFZP564C196, corresponding to a HOST TARGET binding site such as BINDING SITE I, BINDING SITE II or BINDING SITE III. Table 2 illustrates the complementarity of the nucleotide sequences of DKFZP564C196 BINDING SITE, designated SEQ ID:34714, to the nucleotide sequence of VGAM116 RNA, herein designated VGAM RNA, also designated SEQ ID:2827.

Another function of VGAM116 is therefore inhibition of DKFZP564C196 (Accession XM_046405). Accordingly, utilities of VGAM116 include diagnosis, prevention and treatment of diseases and clinical conditions associated with DKFZP564C196. FIG. 1 further provides a conceptual description of a novel bioinformatically detected viral gene of the present invention, referred to here as Viral Genomic Address Messenger 117 (VGAM117) viral gene, which modulates expression of respective host target genes thereof, the function and utility of which host target genes is known in the art.

VGAM117 is a novel bioinformatically detected regulatory, non protein coding, viral micro RNA (miRNA) gene. The method by which VGAM117 was detected is described hereinabove with reference to FIGS. 1-8.

VGAM117 gene, herein designated VGAM GENE, is a viral gene contained in the genome of Shrimp White Spot Syndrome Virus (white spot bacilliform virus). VGAM117 host target gene, herein designated VGAM HOST TARGET GENE, is a human gene contained in the human genome.

VGAM117 gene encodes a VGAM117 precursor RNA, herein designated VGAM PRECURSOR RNA. Similar to other miRNA genes, and unlike most ordinary genes, VGAM117 precursor RNA does not encode a protein. A nucleotide sequence identical or highly similar to the nucleotide sequence of VGAM117 precursor RNA is designated SEQ ID:103, and is provided hereinbelow with reference to the sequence listing part. Nucleotide sequence SEQ ID:103 is located at position 80462 relative to the genome of Shrimp White Spot Syndrome Virus (white spot bacilliform virus).

VGAM117 precursor RNA folds onto itself, forming VGAM117 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM117 folded precursor RNA into VGAM117 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM117 RNA is designated SEQ ID:2828, and is provided hereinbelow with reference to the sequence listing part.

VGAM117 host target gene, herein designated VGAM HOST TARGET GENE, encodes a corresponding messenger RNA, VGAM117 host target RNA, herein designated VGAM HOST TARGET RNA. VGAM117 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM117 RNA, herein designated VGAM RNA, binds complementarily to one or more host target binding sites located in untranslated regions of VGAM117 host target RNA, herein designated VGAM HOST TARGET RNA. This complementary binding is due to the fact that the nucleotide sequence of VGAM117 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM117 RNA, herein designated VGAM RNA, may have a different number of host target binding sites in untranslated regions of a VGAM117 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM117 RNA, herein designated VGAM RNA, to host target binding sites on VGAM117 host target RNA, herein designated VGAM HOST TARGET RNA, such as BINDING SITE I, BINDING SITE II and BINDING SITE III, inhibits translation of VGAM117 host target RNA into VGAM117 host target protein, herein designated VGAM HOST TARGET PROTEIN. VGAM host target protein is therefore outlined by a broken line.

It is appreciated that VGAM117 host target gene, herein designated VGAM HOST TARGET GENE, in fact represents a plurality of VGAM117 host target genes. The mRNA of each one of this plurality of VGAM117 host target genes comprises one or more host target binding sites, each having a nucleotide sequence which is at least partly complementary to VGAM117 RNA, herein designated VGAM RNA, and which when bound by VGAM117 RNA causes inhibition of translation of respective one or more VGAM117 host target proteins.

It is further appreciated by one skilled in the art that the mode of translational inhibition illustrated by FIG. 1 with specific reference to translational inhibition exerted by VGAM117 gene, herein designated VGAM GENE, on one or more VGAM117 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM117 is inhibition of expression of host target genes, as part of a novel viral mechanism of attacking a host. Accordingly, utilities of VGAM117 include diagnosis, prevention and treatment of viral infection by Shrimp White Spot Syndrome Virus (white spot bacilliform virus). Specific functions, and accordingly utilities, of VGAM117 correlate with, and may be deduced from, the identity of the host target genes which VGAM117 binds and inhibits, and the function of these host target genes, as elaborated hereinbelow.

Nucleotide sequences of the VGAM117 precursor RNA, herein designated VGAM PRECURSOR RNA, and of the 'diced' VGAM117 RNA, herein designated VGAM RNA, and a schematic representation of the secondary folding of VGAM117 folded precursor RNA, herein designated VGAM FOLDED PRECURSOR RNA, of VGAM117 are further described hereinbelow with reference to Table 1.

Nucleotide sequences of host target binding sites, such as BINDING SITE-I, BINDING SITE-II and BINDING SITE-III of FIG. 1, found on VGAM117 host target RNA, and schematic representation of the complementarity of each of these host target binding sites to VGAM117 RNA, herein designated VGAM RNA, are described hereinbelow with reference to Table 2.

As mentioned hereinabove with reference to FIG. 1, a function of VGAM117 gene, herein designated VGAM is inhibition of expression of VGAM117 target genes. It is appreciated that specific functions, and accordingly utilities, of VGAM117 correlate with, and may be deduced from, the identity of the target genes which VGAM117 binds and inhibits, and the function of these target genes, as elaborated hereinbelow.

Platelet-derived Growth Factor Receptor, Alpha Polypeptide (PDGFRA, Accession NM_006206) is a VGAM117 host target gene. PDGFRA BINDING SITE is HOST TARGET binding site found in the 3' untranslated region of mRNA encoded by PDGFRA, corresponding to a HOST TARGET binding site such as BINDING SITE I, BINDING SITE II or BINDING SITE III. Table 2 illustrates the complementarity of the nucleotide sequences of PDGFRA BINDING SITE, designated SEQ ID:12879, to the nucleotide sequence of VGAM117 RNA, herein designated VGAM RNA, also designated SEQ ID:2828.

A function of VGAM117 is therefore inhibition of Platelet-derived Growth Factor Receptor, Alpha Polypeptide (PDGFRA, Accession NM_006206), a gene which this receptor binds platelet-derived growth factor and has a tyrosine-protein kinase activity. Accordingly, utilities of VGAM117 include diagnosis, prevention and treatment of diseases and clinical conditions associated with PDGFRA. The function of PDGFRA has been established by previous studies. Considerable insight into the role of the sonic hedgehog (OMIM Ref. No. 600725) pathway in vertebrate development and human cancers came from the discovery that mutations in 'patched' (PTCH; 601309) are associated with basal cell nevus syndrome (BCNS; 109400), an autosomal dominant disorder combining developmental anomalies and tumors, particularly basal cell carcinomas (BCCs). Sporadic BCCs, the most common human cancer, consistently have abnormalities in the hedgehog pathway, and often mutations in PTCH. In addition, somatic mutations in 'smoothened' (SMOH; 601500), another protein in the hedgehog pathway, occur in sporadic BCCs. The downstream molecule GLI1 (OMIM Ref. No. 165220) is known to mediate the biologic effect of the hedgehog pathway and is itself upregulated in all BCCs. Gli1 can drive the production of BCCs in the mouse when overexpressed in the epidermis. Xie et al. (2001) showed that GLI1 can activate PDGFR-alpha and that functional upregulation of PDGFR-alpha by GLI1 is accompanied by activation of the Ras-ERK pathway, which is associated with cell proliferation. The relevance of this mechanism in vivo is supported by a high level of expression of PDGFR-alpha in BCCs in mice and human S. From these and other observations, Xie et al. (2001) concluded that increased expression of the PDGFR-alpha gene may be an important mechanism by which mutations in the hedgehog pathway cause BCCs. Animal model experiments lend further support to the function of PDGFRA. Klinghoffer et al. (2001) created 2 complementary lines of knockin mice in which the intracellular signaling domains of one PDGFR had been removed and replaced by those of the other PDGFR. While both lines demonstrated substantial rescue of normal development, substitution of the Pdgfrb signaling domains with those of Pdgfra resulted in varying degrees of vascular disease.

It is appreciated that the abovementioned animal model for PDGFRA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Xie, J.; Aszterbaum, M.; Zhang, X.; Bonifas, J. M.; Zachary, C.; Epstein, E.; McCormick, F.: A role of PDGFR-alpha in basal cell carcinoma proliferation. Proc. Nat. Acad. Sci. 98:9255-9259, 2001; and Klinghoffer, R. A.; Mueting-Nelsen, P. F.; Faerman, A.; Shani, M.; Soriano, P.: The two PDGF receptors maintain conserved signaling in vivo despite divergent embryological functions.

Further studies establishing the function and utilities of PDGFRA are found in John Hopkins OMIM database record ID 173490, and in sited publications numbered 12457-12458, 10725, 12459-12462, 12641, 353 and 3535-1207 listed in the bibliography section hereinbelow, which are also hereby incorporated by reference. KIAA0222 (Accession NM_014643) is another VGAM117 host target gene. KIAA0222 BINDING SITE is HOST TARGET binding site found in the 3' untranslated region of mRNA encoded by KIAA0222, corresponding to a HOST TARGET binding site such as BINDING SITE I, BINDING SITE II or BINDING SITE III. Table 2 illustrates the complementarity of the nucleotide sequences of KIAA0222 BINDING SITE, designated SEQ ID:16047, to the nucleotide sequence of VGAM117 RNA, herein designated VGAM RNA, also designated SEQ ID:2828.

Another function of VGAM117 is therefore inhibition of KIAA0222 (Accession NM_014643). Accordingly, utilities of VGAM117 include diagnosis, prevention and treatment of diseases and clinical conditions associated with KIAA0222. PRO1600 (Accession NM_014095) is another VGAM117 host target gene. PRO1600 BINDING SITE is HOST TARGET binding site found in the 5' untranslated region of mRNA encoded by PRO1600, corresponding to a HOST TARGET binding site such as BINDING SITE I, BINDING SITE II or BINDING SITE III. Table 2 illustrates the complementarity of the nucleotide sequences of PRO1600 BINDING SITE, designated SEQ ID:15315, to the nucleotide sequence of VGAM117 RNA, herein designated VGAM RNA, also designated SEQ ID:2828.

Another function of VGAM117 is therefore inhibition of PRO1600 (Accession NM_014095). Accordingly, utilities of VGAM117 include diagnosis, prevention and treatment of diseases and clinical conditions associated with PRO1600. TEB4 (Accession XM_027156) is another VGAM117 host target gene. TEB4 BINDING SITE is HOST TARGET binding site found in the 3' untranslated region of mRNA encoded by TEB4, corresponding to a HOST TARGET binding site such as BINDING SITE I, BINDING SITE II or BINDING SITE III. Table 2 illustrates the complementarity of the nucleotide sequences of TEB4 BINDING SITE, designated SEQ ID:30429, to the nucleotide sequence of VGAM117 RNA, herein designated VGAM RNA, also designated SEQ ID:2828.

Another function of VGAM117 is therefore inhibition of TEB4 (Accession XM_027156). Accordingly, utilities of VGAM117 include diagnosis, prevention and treatment of diseases and clinical conditions associated with TEB4. LOC125268 (Accession XM_071960) is another VGAM117 host target gene. LOC125268 BINDING SITE is HOST TARGET binding site found in the 3' untranslated region of mRNA encoded by LOC125268, corresponding to a HOST TARGET binding site such as BINDING SITE I, BINDING SITE II or BINDING SITE III. Table 2 illustrates the complementarity of the nucleotide sequences of LOC125268 BINDING SITE, designated SEQ ID:37452, to the nucleotide sequence of VGAM117 RNA, herein designated VGAM RNA, also designated SEQ ID:2828.

Another function of VGAM117 is therefore inhibition of LOC125268 (Accession XM_071960). Accordingly, utilities of VGAM117 include diagnosis, prevention and treatment of diseases and clinical conditions associated with LOC125268. LOC220469 (Accession XM_084334) is another VGAM117 host target gene. LOC220469 BINDING SITE is HOST TARGET binding site found in the 3' untranslated region of mRNA encoded by LOC220469, corresponding to a HOST TARGET binding site such as BINDING SITE I, BINDING SITE II or BINDING SITE III. Table 2 illustrates the complementarity of the nucleotide sequences of LOC220469 BINDING SITE, designated SEQ ID:37556, to the nucleotide sequence of VGAM117 RNA, herein designated VGAM RNA, also designated SEQ ID:2828.

Another function of VGAM117 is therefore inhibition of LOC220469 (Accession XM_084334). Accordingly, utilities of VGAM117 include diagnosis, prevention and treatment of diseases and clinical conditions associated with LOC220469. FIG. 1 further provides a conceptual description of a novel bioinformatically detected viral gene of the present invention, referred to here as Viral Genomic Address Messenger 118 (VGAM118) viral gene, which modulates expression of respective host target genes thereof, the function and utility of which host target genes is known in the art.

VGAM118 is a novel bioinformatically detected regulatory, non protein coding, viral micro RNA (miRNA) gene. The method by which VGAM118 was detected is described hereinabove with reference to FIGS. 1-8.

VGAM118 gene, herein designated VGAM GENE, is a viral gene contained in the genome of Shrimp White Spot Syndrome Virus (white spot bacilliform virus). VGAM118 host target gene, herein designated VGAM HOST TARGET GENE, is a human gene contained in the human genome.

VGAM118 gene encodes a VGAM118 precursor RNA, herein designated VGAM PRECURSOR RNA. Similar to other miRNA genes, and unlike most ordinary genes, VGAM118 precursor RNA does not encode a protein. A nucleotide sequence identical or highly similar to the nucleotide sequence of VGAM118 precursor RNA is designated SEQ ID:104, and is provided hereinbelow with reference to the sequence listing part. Nucleotide sequence SEQ ID:104 is located at position 178358 relative to the genome of Shrimp White Spot Syndrome Virus (white spot bacilliform virus).

VGAM118 precursor RNA folds onto itself, forming VGAM118 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM118 folded precursor RNA into VGAM118 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM118 RNA is designated SEQ ID:2829, and is provided hereinbelow with reference to the sequence listing part.

VGAM118 host target gene, herein designated VGAM HOST TARGET GENE, encodes a corresponding messenger RNA, VGAM118 host target RNA, herein designated VGAM HOST TARGET RNA. VGAM118 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM118 RNA, herein designated VGAM RNA, binds complementarily to one or more host target binding sites located in untranslated regions of VGAM118 host target RNA, herein designated VGAM HOST TARGET RNA. This complementary binding is due to the fact that the nucleotide sequence of VGAM118 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM118 RNA, herein designated VGAM RNA, may have a different number of host target binding sites in untranslated regions of a VGAM118 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM118 RNA, herein designated VGAM RNA, to host target binding sites on VGAM118 host target RNA, herein designated VGAM HOST TARGET RNA, such as BINDING SITE I, BINDING SITE II and BINDING SITE III, inhibits translation of VGAM118 host target RNA into VGAM118 host target protein, herein designated VGAM HOST TARGET PROTEIN. VGAM host target protein is therefore outlined by a broken line.

It is appreciated that VGAM118 host target gene, herein designated VGAM HOST TARGET GENE, in fact represents a plurality of VGAM118 host target genes. The mRNA of each one of this plurality of VGAM118 host target genes comprises one or more host target binding sites, each having a nucleotide sequence which is at least partly complementary to VGAM118 RNA, herein designated VGAM RNA, and which when bound by VGAM118 RNA causes inhibition of translation of respective one or more VGAM118 host target proteins.

It is further appreciated by one skilled in the art that the mode of translational inhibition illustrated by FIG. 1 with specific reference to translational inhibition exerted by VGAM118 gene, herein designated VGAM GENE, on one or more VGAM118 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM118 is inhibition of expression of host target genes, as part of a novel viral mechanism of attacking a host. Accordingly, utilities of VGAM118 include diagnosis, prevention and treatment of viral infection by Shrimp White Spot Syndrome Virus (white spot bacilliform virus). Specific functions, and accordingly utilities, of VGAM118 correlate with, and may be deduced from, the identity of the host target genes which VGAM118 binds and inhibits, and the function of these host target genes, as elaborated hereinbelow.

Nucleotide sequences of the VGAM118 precursor RNA, herein designated VGAM PRECURSOR RNA, and of the 'diced' VGAM118 RNA, herein designated VGAM RNA, and a schematic representation of the secondary folding of VGAM118 folded precursor RNA, herein designated VGAM FOLDED PRECURSOR RNA, of VGAM118 are further described hereinbelow with reference to Table 1.

Nucleotide sequences of host target binding sites, such as BINDING SITE-I, BINDING SITE-II and BINDING SITE-III of FIG. 1, found on VGAM118 host target RNA, and schematic representation of the complementarity of each of these host target binding sites to VGAM118 RNA, herein designated VGAM RNA, are described hereinbelow with reference to Table 2.

As mentioned hereinabove with reference to FIG. 1, a function of VGAM118 gene, herein designated VGAM is inhibition of expression of VGAM118 target genes. It is appreciated that specific functions, and accordingly utilities, of VGAM118 correlate with, and may be deduced from, the identity of the target genes which VGAM118 binds and inhibits, and the function of these target genes, as elaborated hereinbelow.

Eukaryotic Translation Initiation Factor 2C, 1 (EIF2C1, Accession NM_012199) is a VGAM118 host target gene. EIF2C1 BINDING SITE is HOST TARGET binding site found in the 3' untranslated region of mRNA encoded by EIF2C1, corresponding to a HOST TARGET binding site such as BINDING SITE I, BINDING SITE II or BINDING SITE III. Table 2 illustrates the complementarity of the nucleotide sequences of EIF2C1 BINDING SITE, designated SEQ ID:14507, to the nucleotide sequence of VGAM118 RNA, herein designated VGAM RNA, also designated SEQ ID:2829.

A function of VGAM118 is therefore inhibition of Eukaryotic Translation Initiation Factor 2C, 1 (EIF2C1, Accession NM_012199), a gene which plays an important role in the eukaryotic peptide chain initiation process. Accordingly, utilities of VGAM118 include diagnosis, prevention and treatment of diseases and clinical conditions associated with EIF2C1. The function of EIF2C1 has been established by previous studies. Koesters et al. (1999) isolated a EIF2C1 cDNA from a human fetal kidney cDNA library. To obtain genomic sequence information, they isolated a P1 genomic clone containing the EIF2C1 locus. The human EIF2C1 gene encodes a protein of 857 amino acids. The 2,571-bp open reading frame is flanked by 238 bp of 5-prime sequence and an extremely large 3-prime untranslated region with multiple short repeated segments composed of mono-, tri-, or quatro-nucleotides interspersed throughout. Northern blot analysis demonstrated that the human EIF2C1 gene is ubiquitously expressed at low to medium levels. Differential polyadenylation and splicing resulted in a complex transcriptional pattern. Martinez et al. (2002) demonstrated that a single-stranded small interfering RNA (siRNA) resides in the human RNA-induced silencing complex (RISC) together with the EIF2C1 and/or EIF2C2 (OMIM Ref. No. 606229) proteins. RISC could be rapidly formed in HeLa cell cytoplasmic extract supplemented with 21-nucleotide siRNA duplexes, but also by adding single-stranded antisense RNAs, which range in size between 19 and 29 nucleotides.

Full details of the abovementioned studies are described in the following publications, the disclosure of which are hereby incorporated by reference:

Koesters, R.; Adams, V.; Betts, D.; Moos, R.; Schmid, M.; Siermann, A.; Hassam, S.; Weitz, S.; Lichter, P.; Heitz, P. U.; von Knebel Doeberitz, M.; Briner, J.: Human eukaryotic initiation factor EIF2C1 gene: cDNA sequence, genomic organization, localization to chromosomal bands 1q34-p35, and expression. Genomics 61:210-218, 1999; and Martinez, J.; Patkaniowska, A.; Urlaub, H.; Luhrmann, R.; Tuschl, T.: Single-stranded antisense siRNAs guide target RNA cleavage in RNAi. Cell 110: 563-574, 2002.

Further studies establishing the function and utilities of EIF2C1 are found in John Hopkins OMIM database record ID 606228, and in sited publications numbered 6591-6592 listed in the bibliography section hereinbelow, which are also hereby incorporated by reference. Transcription Factor 2, Hepatic; LF-B3; Variant Hepatic Nuclear Factor (TCF2, Accession NM_000458) is another VGAM118 host target gene. TCF2 BINDING SITE is HOST TARGET binding site found in the 3' untranslated region of mRNA encoded by TCF2, corresponding to a HOST TARGET binding site such as BINDING SITE I, BINDING SITE II or BINDING SITE III. Table 2 illustrates the complementarity of the nucleotide sequences of TCF2 BINDING SITE, designated SEQ ID:6075, to the nucleotide sequence of VGAM118 RNA, herein designated VGAM RNA, also designated SEQ ID:2829.

Another function of VGAM118 is therefore inhibition of Transcription Factor 2, Hepatic; LF-B3; Variant Hepatic Nuclear Factor (TCF2, Accession NM_000458), a gene which probably binds to the inverted palindrome 5'-gttaatnat-taac-3'. Accordingly, utilities of VGAM118 include diagnosis, prevention and treatment of diseases and clinical conditions associated with TCF2. The function of TCF2 has been established by previous studies. Abbott et al. (1990) isolated and partially sequenced a human clone corresponding to the gene for liver-specific transcription factor LFB3. Furthermore, they designed oligonucleotide primers for TCF2 (also called HNF1B) and used them to amplify specifically the human gene in human/rodent somatic cell hybrids by the polymerase chain reaction. They showed that TCF2 maps to 17q between the centromere and the breakpoint of acute promyelocytic leukemia, i.e., proximal to 17q22. Hepatocyte nuclear factor-1 (HNF1A, or TCF1; 142410) is a homeodomain-containing transcriptional activator required for the liver-specific expression of a variety of genes. Bach et al. (1991) isolated a cDNA clone from a human liver library encoding a protein, designated HNF1B, that is highly homologous to HNF1A (also called TCF1) in 3 regions, including the homeo domain and the dimerization domain. They showed that this protein can heterodimerize with human HNF1A in vitro. Sequence comparison with a rat variant HNF1A identified the cDNA as the human homolog. HNF1B is a nuclear protein recognizing the same binding site as HNF1A. By Northern blot analysis, Bach et al. (1991) showed that the HNF1B transcripts are present in differentiated human HepG2 hepatoma cells as well as in rat liver and that this transcript level is 10- to 20-fold lower than that of HNF1A. They assigned the HNF1B gene to human chromosome 17 and mouse chromosome 11. The HNF1A gene maps to human chromosome 12 and mouse chromosome 5.

Full details of the abovementioned studies are described in the following publications, the disclosure of which are hereby incorporated by reference:

Abbott, C.; Piaggio, G.; Ammendola, R.; Solomon, E.; Povey, S.; Gounari, F.; De Simone, V.; Cortese, R.: Mapping of the gene TCF2 for the transcription factor LFB3 to human chromosome 17 by polymerase chain reaction. Genomics 8:165-167, 1990; and Bach, I.; Mattei, M.-G.; Cereghini, S.; Yaniv, M.: Two members of an HNF1 homeoprotein family are expressed in human liver. Nucleic Acids Res. 19:3553-3559, 1991.

Further studies establishing the function and utilities of TCF2 are found in John Hopkins OMIM database record ID 189907, and in sited publications numbered 12603-12604, 2181, 12605-12606, 2182, 2529, 12607-12608, 218 and 12609 listed in the bibliography section hereinbelow, which are also hereby incorporated by reference. Cyclin M4 (CNNM4, Accession NM_020184) is another VGAM118 host target gene. CNNM4 BINDING SITE is HOST TARGET binding site found in the 3' untranslated region of mRNA encoded by CNNM4, corresponding to a HOST TARGET binding site such as BINDING SITE I, BINDING SITE II or BINDING SITE III. Table 2 illustrates the complementarity of the nucleotide sequences of CNNM4 BINDING SITE, designated SEQ ID:21425, to the nucleotide sequence of VGAM118 RNA, herein designated VGAM RNA, also designated SEQ ID:2829.

Another function of VGAM118 is therefore inhibition of Cyclin M4 (CNNM4, Accession NM_020184). Accordingly, utilities of VGAM118 include diagnosis, prevention and treatment of diseases and clinical conditions associated with CNNM4. Histamine Receptor H4 (HRH4, Accession NM_021624) is another VGAM118 host target gene. HRH4

BINDING SITE is HOST TARGET binding site found in the 3' untranslated region of mRNA encoded by HRH4, corresponding to a HOST TARGET binding site such as BINDING SITE I, BINDING SITE II or BINDING SITE III. Table 2 illustrates the complementarity of the nucleotide sequences of HRH4 BINDING SITE, designated SEQ ID:22261, to the nucleotide sequence of VGAM118 RNA, herein designated VGAM RNA, also designated SEQ ID:2829.

Another function of VGAM118 is therefore inhibition of Histamine Receptor H4 (HRH4, Accession NM_021624). Accordingly, utilities of VGAM118 include diagnosis, prevention and treatment of diseases and clinical conditions associated with HRH4. KIAA1449 (Accession NM_020839) is another VGAM118 host target gene. KIAA1449 BINDING SITE is HOST TARGET binding site found in the 3' untranslated region of mRNA encoded by KIAA1449, corresponding to a HOST TARGET binding site such as BINDING SITE I, BINDING SITE II or BINDING SITE III. Table 2 illustrates the complementarity of the nucleotide sequences of KIAA1449 BINDING SITE, designated SEQ ID:21897, to the nucleotide sequence of VGAM118 RNA, herein designated VGAM RNA, also designated SEQ ID:2829.

Another function of VGAM118 is therefore inhibition of KIAA1449 (Accession NM_020839). Accordingly, utilities of VGAM118 include diagnosis, prevention and treatment of diseases and clinical conditions associated with KIAA1449. KIAA1981 (Accession XM_114000) is another VGAM118 host target gene. KIAA1981 BINDING SITE is HOST TARGET binding site found in the 3' untranslated region of mRNA encoded by KIAA1981, corresponding to a HOST TARGET binding site such as BINDING SITE I, BINDING SITE II or BINDING SITE III. Table 2 illustrates the complementarity of the nucleotide sequences of KIAA1981 BINDING SITE, designated SEQ ID:42609, to the nucleotide sequence of VGAM118 RNA, herein designated VGAM RNA, also designated SEQ ID:2829.

Another function of VGAM118 is therefore inhibition of KIAA1981 (Accession XM_114000). Accordingly, utilities of VGAM118 include diagnosis, prevention and treatment of diseases and clinical conditions associated with KIAA1981. Rho-related BTB Domain Containing 3 (RHOBTB3, Accession NM_014899) is another VGAM118 host target gene. RHOBTB3 BINDING SITE is HOST TARGET binding site found in the 3' untranslated region of mRNA encoded by RHOBTB3, corresponding to a HOST TARGET binding site such as BINDING SITE I, BINDING SITE II or BINDING SITE III. Table 2 illustrates the complementarity of the nucleotide sequences of RHOBTB3 BINDING SITE, designated SEQ ID:17078, to the nucleotide sequence of VGAM118 RNA, herein designated VGAM RNA, also designated SEQ ID:2829.

Another function of VGAM118 is therefore inhibition of Rho-related BTB Domain Containing 3 (RHOBTB3, Accession NM_014899). Accordingly, utilities of VGAM118 include diagnosis, prevention and treatment of diseases and clinical conditions associated with RHOBTB3. LOC149076 (Accession XM_086415) is another VGAM118 host target gene. LOC149076 BINDING SITE is HOST TARGET binding site found in the 5' untranslated region of mRNA encoded by LOC149076, corresponding to a HOST TARGET binding site such as BINDING SITE I, BINDING SITE II or BINDING SITE III. Table 2 illustrates the complementarity of the nucleotide sequences of LOC149076 BINDING SITE, designated SEQ ID:38639, to the nucleotide sequence of VGAM118 RNA, herein designated VGAM RNA, also designated SEQ ID:2829.

Another function of VGAM118 is therefore inhibition of LOC149076 (Accession XM_086415). Accordingly, utilities of VGAM118 include diagnosis, prevention and treatment of diseases and clinical conditions associated with LOC149076. FIG. 1 further provides a conceptual description of a novel bioinformatically detected viral gene of the present invention, referred to here as Viral Genomic Address Messenger 119 (VGAM119) viral gene, which modulates expression of respective host target genes thereof, the function and utility of which host target genes is known in the art.

VGAM119 is a novel bioinformatically detected regulatory, non protein coding, viral micro RNA (miRNA) gene. The method by which VGAM119 was detected is described hereinabove with reference to FIGS. 1-8.

VGAM119 gene, herein designated VGAM GENE, is a viral gene contained in the genome of Shrimp White Spot Syndrome Virus (white spot bacilliform virus). VGAM119 host target gene, herein designated VGAM HOST TARGET GENE, is a human gene contained in the human genome.

VGAM119 gene encodes a VGAM119 precursor RNA, herein designated VGAM PRECURSOR RNA. Similar to other miRNA genes, and unlike most ordinary genes, VGAM119 precursor RNA does not encode a protein. A nucleotide sequence identical or highly similar to the nucleotide sequence of VGAM119 precursor RNA is designated SEQ ID:105, and is provided hereinbelow with reference to the sequence listing part. Nucleotide sequence SEQ ID:105 is located at position 278814 relative to the genome of Shrimp White Spot Syndrome Virus (white spot bacilliform virus).

VGAM119 precursor RNA folds onto itself, forming VGAM119 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM119 folded precursor RNA into VGAM119 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM119 RNA is designated SEQ ID:2830, and is provided hereinbelow with reference to the sequence listing part.

VGAM119 host target gene, herein designated VGAM HOST TARGET GENE, encodes a corresponding messenger RNA, VGAM119 host target RNA, herein designated VGAM HOST TARGET RNA. VGAM119 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM119 RNA, herein designated VGAM RNA, binds complementarily to one or more host target binding sites located in untranslated regions of VGAM119 host target RNA, herein designated VGAM HOST TARGET RNA. This complementary binding is due to the fact that the nucleotide sequence of VGAM119 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM119 RNA, herein designated VGAM RNA, may have a different number of host target binding sites in untranslated regions of a VGAM119 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM119 RNA, herein designated VGAM RNA, to host target binding sites on VGAM119 host target RNA, herein designated VGAM HOST TARGET RNA, such as BINDING SITE I, BINDING SITE II and BINDING SITE III, inhibits translation of VGAM119 host target RNA into VGAM119 host target protein, herein designated VGAM HOST TARGET PROTEIN. VGAM host target protein is therefore outlined by a broken line.

It is appreciated that VGAM119 host target gene, herein designated VGAM HOST TARGET GENE, in fact represents a plurality of VGAM119 host target genes. The mRNA of each one of this plurality of VGAM119 host target genes comprises one or more host target binding sites, each having a nucleotide sequence which is at least partly complementary to VGAM119 RNA, herein designated VGAM RNA, and which when bound by VGAM119 RNA causes inhibition of translation of respective one or more VGAM119 host target proteins.

It is further appreciated by one skilled in the art that the mode of translational inhibition illustrated by FIG. 1 with specific reference to translational inhibition exerted by VGAM119 gene, herein designated VGAM GENE, on one or more VGAM119 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM119 is inhibition of expression of host target genes, as part of a novel viral mechanism of attacking a host. Accordingly, utilities of VGAM119 include diagnosis, prevention and treatment of viral infection by Shrimp White Spot Syndrome Virus (white spot bacilliform virus). Specific functions, and accordingly utilities, of VGAM119 correlate with, and may be deduced from, the identity of the host target genes which VGAM119 binds and inhibits, and the function of these host target genes, as elaborated hereinbelow.

Nucleotide sequences of the VGAM119 precursor RNA, herein designated VGAM PRECURSOR RNA, and of the 'diced' VGAM119 RNA, herein designated VGAM RNA, and a schematic representation of the secondary folding of VGAM119 folded precursor RNA, herein designated VGAM FOLDED PRECURSOR RNA, of VGAM119 are further described hereinbelow with reference to Table 1.

Nucleotide sequences of host target binding sites, such as BINDING SITE-I, BINDING SITE-II and BINDING SITE-III of FIG. 1, found on VGAM119 host target RNA, and schematic representation of the complementarity of each of these host target binding sites to VGAM119 RNA, herein designated VGAM RNA, are described hereinbelow with reference to Table 2.

As mentioned hereinabove with reference to FIG. 1, a function of VGAM119 gene, herein designated VGAM is inhibition of expression of VGAM119 target genes. It is appreciated that specific functions, and accordingly utilities, of VGAM119 correlate with, and may be deduced from, the identity of the target genes which VGAM119 binds and inhibits, and the function of these target genes, as elaborated hereinbelow.

Phospholamban (PLN, Accession NM_002667) is a VGAM119 host target gene. PLN BINDING SITE is HOST TARGET binding site found in the 3' untranslated region of mRNA encoded by PLN, corresponding to a HOST TARGET binding site such as BINDING SITE I, BINDING SITE II or BINDING SITE III. Table 2 illustrates the complementarity of the nucleotide sequences of PLN BINDING SITE, designated SEQ ID:8538, to the nucleotide sequence of VGAM119 RNA, herein designated VGAM RNA, also designated SEQ ID:2830.

A function of VGAM119 is therefore inhibition of Phospholamban (PLN, Accession NM_002667), a gene which regulates the activity of the calcium pump of cardiac sarcoplasmic reticulum. Accordingly, utilities of VGAM119 include diagnosis, prevention and treatment of diseases and clinical conditions associated with PLN. The function of PLN has been established by previous studies. Fujii et al. (1991) isolated and characterized genomic DNA clones encoding rabbit phospholamban. The phospholamban gene of 13.2 kb contained only one 10.5-kb intron which separated exonic sequences located in the 5-prime untranslated region. Phospholamban, through modulation of sarcoplasmic reticulum calcium-ATPase activity, is a key regulator of cardiac diastolic function. Alterations in phospholamban expression may define parameters of muscle relaxation. McTiernan et al. (1999) observed that human ventricle and quadriceps displayed high levels of phospholamban transcripts and proteins, with markedly lower expression observed in smooth muscles, while the right atrium also expressed low levels of phospholamban. The structure of the human phospholamban gene closely resembles that reported for chicken, rabbit, rat, and mouse. Comparison of the human to other mammalian phospholamban genes indicated a marked conservation of sequence for at least 217 bp upstream of the transcription start site.

Full details of the abovementioned studies are described in the following publications, the disclosure of which are hereby incorporated by reference:

Fujii, J.; Zarain-Herzberg, A.; Willard, H. F.; Tada, M.; MacLennan, D. H.: Structure of the rabbit phospholamban gene, cloning of the human cDNA, and assignment of the gene to human chromosome 6. J. Biol. Chem. 266:11669-11675, 1991; and McTiernan, C. F.; Frye, C. S.; Lemster, B. H.; Kinder, E. A.; Ogletree-Hughes, M. L.; Moravec, C. S.; Feldman, A. M.: The human phospholamban gene: structure and expression. J. Molec. Cell.

Further studies establishing the function and utilities of PLN are found in John Hopkins OMIM database record ID 172405, and in sited publications numbered 10832-10834 listed in the bibliography section hereinbelow, which are also hereby incorporated by reference. SMT3 Suppressor of Mif Two 3 Homolog 1 (yeast) (SMT3H1, Accession XM_009805) is another VGAM119 host target gene. SMT3H1 BINDING SITE is HOST TARGET binding site found in the 3' untranslated region of mRNA encoded by SMT3H1, corresponding to a HOST TARGET binding site such as BINDING SITE I, BINDING SITE II or BINDING SITE III. Table 2 illustrates the complementarity of the nucleotide sequences of SMT3H1 BINDING SITE, designated SEQ ID:30125, to the nucleotide sequence of VGAM119 RNA, herein designated VGAM RNA, also designated SEQ ID:2830.

Another function of VGAM119 is therefore inhibition of SMT3 Suppressor of Mif Two 3 Homolog 1 (yeast) (SMT3H1, Accession XM_009805), a gene which is involved in the function and/or structure of the eukaryotic kinetochore. Accordingly, utilities of VGAM119 include diagnosis, prevention and treatment of diseases and clinical conditions associated with SMT3H1. The function of SMT3H1 has been established by previous studies. TEXT Lapenta et al. (1997) used cDNA selection to isolate coding sequences from cosmids mapping to the gene-rich telomeric region of human chromosome 21q. A cDNA, which the authors termed SMT3A, was isolated and mapped between the loci PFKL and D21S171 on 21q22.3, about 2.2 Mb proximal to the telomere. The predicted protein of 103 amino acids was found to be a homolog of the S. cerevisiae SMT3 protein, whose gene was previously isolated as a suppressor of mutations in the MIF2 gene (Meluh and Koshland, 1995). The yeast MIF2 gene encodes an essential centromeric protein and shows homology to mammalian CENPC (see OMIM Ref. No. 117141), an integral component of active kinetochores (Meluh and Koshland, 1995). The proposed role of yeast SMT3 as a centromeric protein and the strong evolutionary conservation of the human SMT3A gene suggested to Lapenta et al. (1997) that the encoded protein is involved in the function and/or structure of the eukaryotic kinetochore. SMT3A is also highly homologous to ubiquitin (OMIM Ref. No. 191320). Lapenta et al. (1997) identified 2 additional human SMT3-like sequences, named SMT3B (OMIM Ref. No. 603042) and SMT3C (OMIM Ref. No. 601912), as expressed sequence tags; SMT3A shares 87% amino acid identity with SMT3B and 47% identity with SMT3C.

Full details of the abovementioned studies are described in the following publications, the disclosure of which are hereby incorporated by reference:

Lapenta, V.; Chiurazzi, P.; van der Spek, P.; Pizzuti, A.; Hanaoka, F.; Brahe, C.: SMT3A, a human homologue of the S. cerevisiae SMT3 gene, maps to chromosome 21qter and defines a novel gene family. Genomics 40:362-366, 1997; and Meluh, P. B.; Koshland, D.: Suppressors of MIF2, a putative centromere protein gene in Saccharomyces cerevisiae. (Abstract) Molec. Biol. Cell 6 (supp.):360a only, 1995.

Further studies establishing the function and utilities of SMT3H1 are found in John Hopkins OMIM database record ID 602231, and in sited publications numbered 9136-6288 listed in the bibliography section hereinbelow, which are also hereby incorporated by reference. EZFIT (Accession NM_021216) is another VGAM119 host target gene. EZFIT BINDING SITE is HOST TARGET binding site found in the 3' untranslated region of mRNA encoded by EZFIT, corresponding to a HOST TARGET binding site such as BINDING SITE I, BINDING SITE II or BINDING SITE III. Table 2 illustrates the complementarity of the nucleotide sequences of EZFIT BINDING SITE, designated SEQ ID:22195, to the nucleotide sequence of VGAM119 RNA, herein designated VGAM RNA, also designated SEQ ID:2830.

Another function of VGAM119 is therefore inhibition of EZFIT (Accession NM_021216). Accordingly, utilities of VGAM119 include diagnosis, prevention and treatment of diseases and clinical conditions associated with EZFIT. FLJ13110 (Accession NM_022912) is another VGAM119 host target gene. FLJ13110 BINDING SITE is HOST TARGET binding site found in the 3" untranslated region of mRNA encoded by FLJ13110, corresponding to a HOST TARGET binding site such as BINDING SITE I, BINDING SITE II or BINDING SITE III. Table 2 illustrates the complementarity of the nucleotide sequences of FLJ13110 BINDING SITE, designated SEQ ID:23223, to the nucleotide sequence of VGAM119 RNA, herein designated VGAM RNA, also designated SEQ ID:2830.

Another function of VGAM119 is therefore inhibition of FLJ13110 (Accession NM_022912). Accordingly, utilities of VGAM119 include diagnosis, prevention and treatment of diseases and clinical conditions associated with FLJ13110. KIAA0429 (Accession NM_014751) is another VGAM119 host target gene. KIAA0429 BINDING SITE is HOST TARGET binding site found in the 3' untranslated region of mRNA encoded by KIAA0429, corresponding to a HOST TARGET binding site such as BINDING SITE I, BINDING SITE II or BINDING SITE III. Table 2 illustrates the complementarity of the nucleotide sequences of KIAA0429 BINDING SITE, designated SEQ ID:16475, to the nucleotide sequence of VGAM119 RNA, herein designated VGAM RNA, also designated SEQ ID:2830.

Another function of VGAM119 is therefore inhibition of KIAA0429 (Accession NM_014751). Accordingly, utilities of VGAM119 include diagnosis, prevention and treatment of diseases and clinical conditions associated with KIAA0429. KIAA0662 (Accession XM_088539) is another VGAM119 host target gene. KIAA0662 BINDING SITE is HOST TARGET binding site found in the 3' untranslated region of mRNA encoded by KIAA0662, corresponding to a HOST TARGET binding site such as BINDING SITE I, BINDING SITE II or BINDING SITE III. Table 2 illustrates the complementarity of the nucleotide sequences of KIAA0662 BINDING SITE, designated SEQ ID:39802, to the nucleotide sequence of VGAM119 RNA, herein designated VGAM RNA, also designated SEQ ID:2830.

Another function of VGAM119 is therefore inhibition of KIAA0662 (Accession XM_088539). Accordingly, utilities of VGAM119 include diagnosis, prevention and treatment of diseases and clinical conditions associated with KIAA0662. KIAA1371 (Accession XM_114371) is another VGAM119 host target gene. KIAA1371 BINDING SITE is HOST TARGET binding site found in the 3' untranslated region of mRNA encoded by KIAA1371, corresponding to a HOST TARGET binding site such as BINDING SITE I, BINDING SITE II or BINDING SITE III. Table 2 illustrates the complementarity of the nucleotide sequences of KIAA1371 BINDING SITE, designated SEQ ID:42907, to the nucleotide sequence of VGAM119 RNA, herein designated VGAM RNA, also designated SEQ ID:2830.

Another function of VGAM119 is therefore inhibition of KIAA1371 (Accession XM_114371). Accordingly, utilities of VGAM119 include diagnosis, prevention and treatment of diseases and clinical conditions associated with KIAA1371. KIAA1508 (Accession XM_030209) is another VGAM119 host target gene. KIAA1508 BINDING SITE is HOST TARGET binding site found in the 5' untranslated region of mRNA encoded by KIAA1508, corresponding to a HOST TARGET binding site such as BINDING SITE I, BINDING SITE II or BINDING SITE III. Table 2 illustrates the complementarity of the nucleotide sequences of KIAA1508 BINDING SITE, designated SEQ ID:30993, to the nucleotide sequence of VGAM119 RNA, herein designated VGAM RNA, also designated SEQ ID:2830.

Another function of VGAM119 is therefore inhibition of KIAA1508 (Accession XM_030209). Accordingly, utilities of VGAM119 include diagnosis, prevention and treatment of diseases and clinical conditions associated with KIAA1508. moblak (Accession NM_130807) is another VGAM119 host target gene. moblak BINDING SITE is HOST TARGET binding site found in the 5' untranslated region of mRNA encoded by moblak, corresponding to a HOST TARGET binding site such as BINDING SITE I, BINDING SITE II or BINDING SITE III. Table 2 illustrates the complementarity of the nucleotide sequences of moblak BINDING SITE, designated SEQ ID:28310, to the nucleotide sequence of VGAM119 RNA, herein designated VGAM RNA, also designated SEQ ID:2830.

Another function of VGAM119 is therefore inhibition of moblak (Accession NM_130807). Accordingly, utilities of VGAM119 include diagnosis, prevention and treatment of diseases and clinical conditions associated with moblak. RAB6C, Member RAS Oncogene Family (RAB6C, Accession NM_032144) is another VGAM119 host target gene. RAB6C BINDING SITE is HOST TARGET binding site found in the 3' untranslated region of mRNA encoded by RAB6C, corresponding to a HOST TARGET binding site such as BINDING SITE I, BINDING SITE II or BINDING SITE III. Table 2 illustrates the complementarity of the nucleotide sequences of RAB6C BINDING SITE, designated SEQ ID:25836, to the nucleotide sequence of VGAM119 RNA, herein designated VGAM RNA, also designated SEQ ID:2830.

Another function of VGAM119 is therefore inhibition of RAB6C, Member RAS Oncogene Family (RAB6C, Accession NM_032144). Accordingly, utilities of VGAM119 include diagnosis, prevention and treatment of diseases and clinical conditions associated with RAB6C. LOC219899 (Accession XM_166173) is another VGAM119 host target gene. LOC219899 BINDING SITE is HOST TARGET binding site found in the 3' untranslated region of mRNA encoded by LOC219899, corresponding to a HOST TARGET binding site such as BINDING SITE I, BINDING SITE II or BINDING SITE III. Table 2 illustrates the complementarity of the nucleotide sequences of LOC219899 BINDING SITE, designated SEQ ID:43990, to the nucleotide sequence of VGAM119 RNA, herein designated VGAM RNA, also designated SEQ ID:2830.

Another function of VGAM119 is therefore inhibition of LOC219899 (Accession XM_166173). Accordingly, utilities of VGAM119 include diagnosis, prevention and treatment of diseases and clinical conditions associated with LOC219899. LOC221773 (Accession XM_165802) is another VGAM119 host target gene. LOC221773 BINDING SITE is HOST TARGET binding site found in the 3' untranslated region of mRNA encoded by LOC221773, corresponding to a HOST TARGET binding site such as BINDING SITE I, BINDING SITE II or BINDING SITE III. Table 2 illustrates the complementarity of the nucleotide sequences of LOC221773 BINDING SITE, designated SEQ ID:43762, to the nucleotide sequence of VGAM119 RNA, herein designated VGAM RNA, also designated SEQ ID:2830.

Another function of VGAM119 is therefore inhibition of LOC221773 (Accession XM_165802). Accordingly, utilities of VGAM119 include diagnosis, prevention and treatment of diseases and clinical conditions associated with LOC221773.

FIG. 1 further provides a conceptual description of a novel bioinformatically detected viral gene of the present invention, referred to here as Viral Genomic Address Messenger 120 (VGAM120) viral gene, which modulates expression of respective host target genes thereof, the function and utility of which host target genes is known in the art.

VGAM120 is a novel bioinformatically detected regulatory, non protein coding, viral micro RNA (miRNA) gene. The method by which VGAM120 was detected is described hereinabove with reference to FIGS. 1-8.

VGAM120 gene, herein designated VGAM GENE, is a viral gene contained in the genome of Shrimp White Spot Syndrome Virus (white spot bacilliform virus). VGAM120 host target gene, herein designated VGAM HOST TARGET GENE, is a human gene contained in the human genome.

VGAM120 gene encodes a VGAM120 precursor RNA, herein designated VGAM PRECURSOR RNA. Similar to other miRNA genes, and unlike most ordinary genes, VGAM120 precursor RNA does not encode a protein. A nucleotide sequence identical or highly similar to the nucleotide sequence of VGAM120 precursor RNA is designated SEQ ID:106, and is provided hereinbelow with reference to the sequence listing part. Nucleotide sequence SEQ ID:106 is located at position 277493 relative to the genome of Shrimp White Spot Syndrome Virus (white spot bacilliform virus).

VGAM120 precursor RNA folds onto itself, forming VGAM120 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM120 folded precursor RNA into VGAM120 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM120 RNA is designated SEQ ID:2831, and is provided hereinbelow with reference to the sequence listing part.

VGAM120 host target gene, herein designated VGAM HOST TARGET GENE, encodes a corresponding messenger RNA, VGAM120 host target RNA, herein designated VGAM HOST TARGET RNA. VGAM120 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM120 RNA, herein designated VGAM RNA, binds complementarily to one or more host target binding sites located in untranslated regions of VGAM120 host target RNA, herein designated VGAM HOST TARGET RNA. This complementary binding is due to the fact that the nucleotide sequence of VGAM120 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM120 RNA, herein designated VGAM RNA, may have a different number of host target binding sites in untranslated regions of a VGAM120 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM120 RNA, herein designated VGAM RNA, to host target binding sites on VGAM120 host target RNA, herein designated VGAM HOST TARGET RNA, such as BINDING SITE I, BINDING SITE II and BINDING SITE III, inhibits translation of VGAM120 host target RNA into VGAM120 host target protein, herein designated VGAM HOST TARGET PROTEIN. VGAM host target protein is therefore outlined by a broken line.

It is appreciated that VGAM120 host target gene, herein designated VGAM HOST TARGET GENE, in fact represents a plurality of VGAM120 host target genes. The mRNA of each one of this plurality of VGAM120 host target genes comprises one or more host target binding sites, each having a nucleotide sequence which is at least partly complementary to VGAM120 RNA, herein designated VGAM RNA, and which when bound by VGAM120 RNA causes inhibition of translation of respective one or more VGAM120 host target proteins.

It is further appreciated by one skilled in the art that the mode of translational inhibition illustrated by FIG. 1 with specific reference to translational inhibition exerted by VGAM120 gene, herein designated VGAM GENE, on one or more VGAM120 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM120 is inhibition of expression of host target genes, as part of a novel viral mechanism of attacking a host. Accordingly, utilities of VGAM120 include diagnosis, prevention and treatment of viral infection by Shrimp White Spot Syndrome Virus (white spot bacilliform virus). Specific functions, and accordingly utilities, of VGAM120 correlate with, and may be deduced from, the identity of the host target genes which VGAM120 binds and inhibits, and the function of these host target genes, as elaborated hereinbelow.

Nucleotide sequences of the VGAM120 precursor RNA, herein designated VGAM PRECURSOR RNA, and of the 'diced' VGAM120 RNA, herein designated VGAM RNA, and a schematic representation of the secondary folding of VGAM120 folded precursor RNA, herein designated VGAM FOLDED PRECURSOR RNA, of VGAM120 are further described hereinbelow with reference to Table 1.

Nucleotide sequences of host target binding sites, such as BINDING SITE-I, BINDING SITE-II and BINDING SITE-III of FIG. 1, found on VGAM120 host target RNA, and schematic representation of the complementarity of each of these host target binding sites to VGAM120 RNA, herein designated VGAM RNA, are described hereinbelow with reference to Table 2.

As mentioned hereinabove with reference to FIG. 1, a function of VGAM120 gene, herein designated VGAM is inhibition of expression of VGAM120 target genes. It is appreciated that specific functions, and accordingly utilities, of VGAM120 correlate with, and may be deduced from, the identity of the target genes which VGAM120 binds and inhibits, and the function of these target genes, as elaborated hereinbelow.

Adenylate Cyclase 2 (brain) (ADCY2, Accession XM_036383) is a VGAM120 host target gene. ADCY2 BINDING SITE is HOST TARGET binding site found in the 3' untranslated region of mRNA encoded by ADCY2, corresponding to a HOST TARGET binding site such as BINDING SITE I, BINDING SITE II or BINDING SITE III. Table 2 illustrates the complementarity of the nucleotide sequences of ADCY2 BINDING SITE, designated SEQ ID:32436, to the nucleotide sequence of VGAM120 RNA, herein designated VGAM RNA, also designated SEQ ID:2831.

A function of VGAM120 is therefore inhibition of Adenylate Cyclase 2 (brain) (ADCY2, Accession XM_036383), a gene which Adenylate cyclase (type 2), an ATP-pyrophosphate lyase; converts ATP to cAMP. Accordingly, utilities of VGAM120 include diagnosis, prevention and treatment of diseases and clinical conditions associated with ADCY2. The function of ADCY2 has been established by previous studies. Stengel et al. (1992) identified a brain cDNA corresponding to a gene that encodes a human brain adenylyl cyclase, which they symbolized HBAC2. The amino acid sequence of ADCY2 displayed significant homology with ADCY8 (OMIM Ref. No. 103070) in the highly conserved adenylyl cyclase domain (250 amino acids) found in the 3-prime cytoplasmic portion of all mammalian adenylyl cyclases. However, outside this domain, the homology was extremely low. By in situ hybridization to metaphase chromosomal spreads using a human brain cDNA probe, they demonstrated that the ADCY2 gene maps to 5p15.3. There was no cross-reactivity with the site on 8q24.2 where ADCY8 was found to map. Using Southern blot analysis of somatic cell hybrid DNAs, Gaudin et al. (1994) likewise mapped type II adenylyl cyclase to chromosome 5. Furthermore, they determined the chromosomal location of 4 other isoforms: type III on chromosome 2, type IV on chromosome 14, type V on chromosome 3, and type VI on chromosome 12. By fluorescence in situ hybridization, Edelhoff et al. (1995) mapped the mouse homolog to chromosome 13 in the C1 region. Wong et al. (2000) identified the presence of adenylyl cyclases 2, 3 (OMIM Ref. No. 600291), and 4 (OMIM Ref. No. 600292) in olfactory cilia.

Full details of the abovementioned studies are described in the following publications, the disclosure of which are hereby incorporated by reference:

Edelhoff, S.; Villacres, E. C.; Storm, D. R.; Disteche, C. M.: Mapping of adenylyl cyclase genes type I, II, III, IV, V, and VI in mouse. Mammalian Genome 6:111-113, 1995; and Wong, S. T.; Trinh, K.; Hacker, B.; Chan, G. C. K.; Lowe, G.; Gaggar, A.; Xia, Z.; Gold, G. H.; Storm, D. R.: Disruption of the type III adenylyl cyclase gene leads to peripheral and be.

Further studies establishing the function and utilities of ADCY2 are found in John Hopkins OMIM database record ID 103071, and in sited publications numbered 494-495, 49 and 496 listed in the bibliography section hereinbelow, which are also hereby incorporated by reference. Alpha-methylacyl-CoA Racemase (AMACR, Accession XM_043771) is another VGAM120 host target gene. AMACR BINDING SITE is HOST TARGET binding site found in the 3' untranslated region of mRNA encoded by AMACR, corresponding to a HOST TARGET binding site such as BINDING SITE I, BINDING SITE II or BINDING SITE III. Table 2 illustrates the complementarity of the nucleotide sequences of AMACR BINDING SITE, designated SEQ ID:34015, to the nucleotide sequence of VGAM120 RNA, herein designated VGAM RNA, also designated SEQ ID:2831.

Another function of VGAM120 is therefore inhibition of Alpha-methylacyl-CoA Racemase (AMACR, Accession XM_043771). Accordingly, utilities of VGAM120 include diagnosis, prevention and treatment of diseases and clinical conditions associated with AMACR. Caspase 6, Apoptosis-related Cysteine Protease (CASP6, Accession NM_032992) is another VGAM120 host target gene. CASP6 BINDING SITE1 and CASP6 BINDING SITE2 are HOST TARGET binding sites found in untranslated regions of mRNA encoded by CASP6, corresponding to HOST TARGET binding sites such as BINDING SITE I, BINDING SITE II or BINDING SITE III. Table 2 illustrates the complementarity of the nucleotide sequences of CASP6 BINDING SITE1 and CASP6 BINDING SITE2, designated SEQ ID:26873 and SEQ ID:6894 respectively, to the nucleotide sequence of VGAM120 RNA, herein designated VGAM RNA, also designated SEQ ID:2831.

Another function of VGAM120 is therefore inhibition of Caspase 6, Apoptosis-related Cysteine Protease (CASP6, Accession NM_032992), a gene which involves in the activation cascade of caspases responsible for apoptosis execution. Accordingly, utilities of VGAM120 include diagnosis, prevention and treatment of diseases and clinical conditions associated with CASP6. The function of CASP6 has been established by previous studies. Fernandes-Alnemri et al. (1995) isolated MCH2, a member of the ced-3 subfamily of apoptotic proteases, by performing PCR on human Jurkat T lymphocytes using degenerate oligonucleotides corresponding to conserved peptides in known apoptotic cysteine proteases. The gene, also symbolized CASP6, encodes a 34-kD protein that is highly homologous to human CPP32 (OMIM Ref. No. 600636), C. elegans ced-3, mammalian Ich1/Nedd2 (OMIM Ref. No. 600639), and mammalian interleukin-1-beta converting enzyme (OMIM Ref. No. 147678). Fernandes-Alnemri et al. (1995) observed 1.7-kb (alpha) and 1.4-kb (beta) transcripts expressed in Jurkat lymphocytes and other cell lines. The authors suggested that these transcripts are alternate splicing variants and found that the alpha, but not the beta, MCH2 protein has protease activity. They also found that MCH2-alpha protein can cleave poly (ADP-ribose) polymerase (OMIM Ref. No. 173870) in vitro and that its overexpression induces apoptosis in insect Sf9 cells, suggesting that MCH2 is a mediator of apoptosis in mammalian cells. Using protease assays and immunoblotting experiments, Orth et al. (1996) showed that MCH2, like CPP32 and MCH3, functions downstream of the mammalian cell death inhibitors Bcl2 (OMIM Ref. No. 151430) and BclXL and of the viral serpin CrmA. Further, they found that granzyme B can functionally activate MCH2, supporting the idea that granzyme B kills cells by activating downstream components of the CED-3/ICE apoptotic pathway. Orth et al. (1996) also showed that MCH2, unlike CPP32 and MCH3, can cleave lamin A to its signature apoptotic fragment.

Full details of the abovementioned studies are described in the following publications, the disclosure of which are hereby incorporated by reference:

Fernandes-Alnemri, T.; Litwack, G.; Alnemri, E. S.: Mch2, a new member of the apoptotic Ced-3/Ice cysteine protease gene family. Cancer Res. 55:2737-2742, 1995; and Orth, K.; Chinnaiyan, A. M.; Garg, M.; Froelich, C. J.; Dixit, V. M.: The CED-3/ICE-like protease Mch2 is activated during apoptosis and cleaves the death substrate lamin A. J. Biol. Ch.

Further studies establishing the function and utilities of CASP6 are found in John Hopkins OMIM database record ID 601532, and in sited publications numbered 7200, 720 and 7202 listed in the bibliography section hereinbelow, which are also hereby incorporated by reference. UDP-N-acetyl-alpha-D-galactosamine:polypeptide N-acetylgalactosaminyltransferase 1 (GalNAc-T1) (GALNT1, Accession NM_020474) is another VGAM120 host target gene. GALNT1 BINDING SITE is HOST TARGET binding site found in the 3' untranslated region of mRNA encoded by GALNT1, corresponding to a HOST TARGET binding site such as BINDING SITE I, BINDING SITE II or BINDING SITE III. Table 2 illustrates the complementarity of the nucleotide sequences of GALNT1 BINDING SITE, designated SEQ ID:21724, to the nucleotide sequence of VGAM120 RNA, herein designated VGAM RNA, also designated SEQ ID:2831.

Another function of VGAM120 is therefore inhibition of UDP-N-acetyl-alpha-D-galactosamine:polypeptide N-acetylgalactosaminyltransferase 1 (GalNAc-T1) (GALNT1, Accession NM_020474), a gene which transfers an N-acetyl galactosamine (GalNAc) to a serine or threonine residue in the first step of O-linked oligosaccharide biosynthesis. Accordingly, utilities of VGAM120 include diagnosis, prevention and treatment of diseases and clinical conditions associated with GALNT1. The function of GALNT1 has been established by previous studies. UDP-N-acetyl-alpha-D-galactosamine:polypeptide N-acetylgalactosaminyltransferase (GalNAc-T; EC 2.4.1.41) transfers an N-acetyl galactosamine (OMIM Ref. No. GalNAc) to a serine or threonine residue in the first step of O-linked oligosaccharide biosynthesis. Takai et al. (1997) cloned the GALNT1 gene, termed GalNAc-T1 by them, from human colon tissue, using a reverse transcriptase polymerase chain reaction (OMIM Ref. No. RT-PCR) with oligonucleotide primers based on the nucleotide sequence of bovine GalNAc-T1 cDNA. The predicted GALNT1 protein is 559 amino acids long and has 99.6% sequence similarity with the bovine protein. White et al. (1995) isolated cDNAs encoding human GalNAc-T1 and GalNAc-T2 (GALNT2; 602274). Bennett et al. (1998) found that the GALNT1, GALNT2, and GALNT3 (OMIM Ref. No. 601756) genes contain 11, 16, and 10 exons, respectively. Several intron/exon boundaries were conserved within the 3 genes. By fluorescence in situ hybridization, Takai et al. (1997) mapped the GALNT1 gene to chromosome 18q12.1. By the same method, Bennett et al. (1998) mapped the gene to 18q12-q21.

Full details of the abovementioned studies are described in the following publications, the disclosure of which are hereby incorporated by reference:

Bennett, E. P.; Weghuis, D. O.; Merkx, G.; Geurts van Kessel, A.; Eiberg, H.; Clausen, H.: Genomic organization and chromosomal localization of three members of the UDP-N-acetylgalactosamine:polypeptide N-acetylgalactosaminyltransferase family. Glycobiology 8:547-555, 1998; and Takai, S.; Hinoda, Y.; Adachi, T.; Imai, K.; Oshima, M.: A human UPD (sic)-GalNAc: polypeptide, N-acetylgalactosaminyltransferase type 1 gene is located at the chromosomal region 18q12.

Further studies establishing the function and utilities of GALNT1 are found in John Hopkins OMIM database record ID 602273, and in sited publications numbered 2824-2798 listed in the bibliography section hereinbelow, which are also hereby incorporated by reference. Kelch-like 3 (Drosophila) (KLHL3, Accession XM_113450) is another VGAM120 host target gene. KLHL3 BINDING SITE is HOST TARGET binding site found in the 3' untranslated region of mRNA encoded by KLHL3, corresponding to a HOST TARGET binding site such as BINDING SITE I, BINDING SITE II or BINDING SITE III. Table 2 illustrates the complementarity of the nucleotide sequences of KLHL3 BINDING SITE, designated SEQ ID:42272, to the nucleotide sequence of VGAM120 RNA, herein designated VGAM RNA, also designated SEQ ID:2831.

Another function of VGAM120 is therefore inhibition of Kelch-like 3 (Drosophila) (KLHL3, Accession XM_113450). Accordingly, utilities of VGAM120 include diagnosis, prevention and treatment of diseases and clinical conditions associated with KLHL3. Polycystic Kidney and Hepatic Disease 1 (autosomal recessive) (PKHD1, Accession NM_138694) is another VGAM120 host target gene. PKHD1 BINDING SITE is HOST TARGET binding site found in the 3' untranslated region of mRNA encoded by PKHD1, corresponding to a HOST TARGET binding site such as BINDING SITE I, BINDING SITE II or BINDING SITE III. Table 2 illustrates the complementarity of the nucleotide sequences of PKHD1 BINDING SITE, designated SEQ ID:28944, to the nucleotide sequence of VGAM120 RNA, herein designated VGAM RNA, also designated SEQ ID:2831.

Another function of VGAM120 is therefore inhibition of Polycystic Kidney and Hepatic Disease 1 (autosomal recessive) (PKHD1, Accession NM_138694). Accordingly, utilities of VGAM120 include diagnosis, prevention and treatment of diseases and clinical conditions associated with PKHD1. Pinin, Desmosome Associated Protein (PNN, Accession XM_048719) is another VGAM120 host target gene. PNN BINDING SITE is HOST TARGET binding site found in the 3' untranslated region of mRNA encoded by PNN, corresponding to a HOST TARGET binding site such as BINDING SITE I, BINDING SITE II or BINDING SITE III. Table 2 illustrates the complementarity of the nucleotide sequences of PNN BINDING SITE, designated SEQ ID:35234, to the nucleotide sequence of VGAM120 RNA, herein designated VGAM RNA, also designated SEQ ID:2831.

Another function of VGAM120 is therefore inhibition of Pinin, Desmosome Associated Protein (PNN, Accession XM_048719), a gene which reinforces the intermediate filament-desmosome complex. Accordingly, utilities of VGAM120 include diagnosis, prevention and treatment of diseases and clinical conditions associated with PNN. The function of PNN has been established by previous studies. Desmosomes are intimately involved in the structural and functional integration of adjacent epithelial cells. They serve as reinforcement sites of cell-cell adhesion, as well as points for lateral anchorage of the intermediate scaffold of the epithelial cell. A number of proteins associated with desmosomes have been identified, including desmoplakin (OMIM Ref. No. 125647), plakoglobin (OMIM Ref. No. 173325), desmogleins (e.g., 125670), and desmocollins (e.g., 125643). Ouyang and Sugrue (1996) identified a novel phosphoprotein, called pinin, that associates with mature desmosomes. By screening a human placenta cDNA library with a canine pinin cDNA cloned by them, they isolated cDNAs encoding PNN. The deduced 743-amino acid PNN protein contains a serine-rich domain; a glutamine-proline, glutamine-leucine repeat domain; an acidic domain rich in glutamic acid; and numerous potential kinase recognition motifs. Recombinant PNN migrated as a 140-kD protein by Western blot analysis. Ouyang and Sugrue (1996) found that recombinant pinin was expressed along the lateral borders of human embryonic kidney-derived 293 cells, in association with desmoplakin; they noted striking changes in cell/tissue morphology. Northern blot analysis detected ubiquitous expression of PNN in human tissues, including those lacking desmosomes. PNN is expressed as 4.1-, 3.7-, and 3.2-kb transcripts that show tissue-specific expression patterns. Southern blot analysis demonstrated the existence of a single pinin gene in the human genome. Since the 3-prime end of the PNN coding sequence is nearly identical to a partial cDNA identified in a pig neutrophil cDNA library, and since leukocytes, which do not react with antibodies against pinin, express an mRNA that hybridizes with a pinin cDNA, the authors speculated that there may be a pinin-related gene. By screening a keratinocyte cDNA library, Brandner et al. (1997) and Brandner et al. (1998) isolated a cDNA encoding a protein, which they called DRS (domain rich in serine), that is essentially identical to the PNN protein described by Ouyang and Sugrue (1996). However, cell fractionation and immunofluorescence microscopy analysis localized DRS strictly to the nucleus and not to desmosomes. Sequence analysis predicted that the 717-amino acid DRS protein contains an N-terminal nuclear localization signal and a C-terminal stretch of approximately 80 amino acids, 73% of which are serine. The 80-amino acid C-terminal domain and a subsequent 79-amino acid domain also contain numerous ser-arg and arg-ser dipeptides.

Full details of the abovementioned studies are described in the following publications, the disclosure of which are hereby incorporated by reference:

Ouyang, P.; Sugrue, S. P.: Characterization of pinin, a novel protein associated with the desmosome-intermediate filament complex. J. Cell Biol. 135:1027-1042, 1996; and Brandner, J. M.; Reidenbach, S.; Kuhn, C.; Franke, W. W.: Identification and characterization of a novel kind of nuclear protein occurring free in nucleoplasm and in ribonucleoprotein st.

Further studies establishing the function and utilities of PNN are found in John Hopkins OMIM database record ID 603154, and in sited publications numbered 2423-2426 listed in the bibliography section hereinbelow, which are also hereby incorporated by reference. Palmitoyl-protein Thioesterase 2 (PPT2, Accession NM_138717) is another VGAM120 host target gene. PPT2 BINDING SITE1 and PPT2 BINDING SITE2 are HOST TARGET binding sites found in untranslated regions of mRNA encoded by PPT2, corresponding to HOST TARGET binding sites such as BINDING SITE I, BINDING SITE II or BINDING SITE III. Table 2 illustrates the complementarity of the nucleotide sequences of PPT2 BINDING SITE1 and PPT2 BINDING SITE2, designated SEQ ID:28964 and SEQ ID:11633 respectively, to the nucleotide sequence of VGAM120 RNA, herein designated VGAM RNA, also designated SEQ ID:2831.

Another function of VGAM120 is therefore inhibition of Palmitoyl-protein Thioesterase 2 (PPT2, Accession NM_138717), a gene which is a palmitoyl-protein thioesterase 2 which possesses a different substrate specificity than PPT1. Accordingly, utilities of VGAM120 include diagnosis, prevention and treatment of diseases and clinical conditions associated with PPT2. The function of PPT2 has been established by previous studies. Palmitoyl-protein thioesterase-1 (PPT1; 600722) is a lysosomal hydrolase that removes long-chain fatty acyl groups from modified cysteine residues in proteins. Mutations in PPT1 have been found to cause the infantile form of neuronal ceroid lipofuscinosis (INCL; 256730). By searching sequence databases for homologs of PPT1, Soyombo and Hofmann (1997) identified cDNAs encoding PPT2. The deduced PPT2 protein contains 302 amino acids, including a 27-amino acid leader peptide, a sequence motif characteristic of many thioesterases and lipases, and 5 potential N-linked glycosylation sites. PPT2 shares 18% amino acid identity with PPT1. Northern blot analysis detected a predominant 2.0-kb PPT2 transcript in the human tissues examined, with the highest expression in skeletal muscle; variable amounts of 2.8- and 7.0-kb transcripts were also observed. Immunoblot analysis of recombinant PPT2 expressed in mammalian cells showed 6 PPT2 proteins ranging in size from 31 to 42 kD. Treatment that removes asparagine-linked oligosaccharides resulted in a single major protein of 31 kD and a minor protein of 33 kD. The authors demonstrated that recombinant PPT2, like PPT1, possesses thioesterase activity and localizes to the lysosome. Since PPT2 could not substitute for PPT1 in correcting the metabolic defect in INCL cells and was unable to remove palmitate groups from palmitoylated proteins that are routinely used as substrates for PPT1, Soyombo and Hofmann (1997) suggested that PPT2 possesses a different substrate specificity than PPT1. Animal model experiments lend further support to the function of PPT2. Gupta et al. (2001) engineered disruptions in the Ppt1 and Ppt2 genes to create knockout mice that were deficient in either enzyme. Both lines of mice were viable and fertile; however, both lines developed spasticity (a 'clasping' phenotype) at a median age of 21 weeks and 29 weeks, respectively. Motor abnormalities progressed in the Ppt1 knockout mice, leading to death by 10 months of age. In contrast, most Ppt2 mice were alive at 12 months. Myoclonic jerking and seizures were prominent in the Ppt1 mice. Autofluorescent storage material was striking throughout the brains of both strains of mice. Neuronal loss and apoptosis were particularly prominent in Ppt1-deficient brains. These studies provided a mouse model for infantile neuronal ceroid lipofuscinosis and further suggested that PPT2 serves a role in the brain that is not carried out by PPT1.

It is appreciated that the abovementioned animal model for PPT2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gupta, P.; Soyombo, A. A.; Atashband, A.; Wisniewski, K. E.; Shelton, J. M.; Richardson, J. A.; Hammer, R. E.; Hofmann, S. L.: Disruption of PPT1 or PPT2 causes neuronal ceroid lipofuscinosis in knockout mice. Proc. Nat. Acad. Sci. 98:13566-13571, 2001; and Soyombo, A. A.; Hofmann, S. L.: Molecular cloning and expression of palmitoyl-protein thioesterase 2 (PPT2), a homolog of lysosomal palmitoyl-protein thioesterase with a distinct subs.

Further studies establishing the function and utilities of PPT2 are found in John Hopkins OMIM database record ID 603298, and in sited publications numbered 6567 listed in the bibliography section hereinbelow, which are also hereby incorporated by reference. Protein Kinase, CAMP-dependent, Regulatory, Type II, Beta (PRKAR2B, Accession NM_002736) is another VGAM120 host target gene. PRKAR2B BINDING SITE is HOST TARGET binding site found in the 3' untranslated region of mRNA encoded by PRKAR2B, corresponding to a HOST TARGET binding site such as BINDING SITE I, BINDING SITE II or BINDING SITE III. Table 2 illustrates the complementarity of the nucleotide sequences of PRKAR2B BINDING SITE, designated SEQ ID:8611, to the nucleotide sequence of VGAM120 RNA, herein designated VGAM RNA, also designated SEQ ID:2831.

Another function of VGAM120 is therefore inhibition of Protein Kinase, CAMP-dependent, Regulatory, Type II, Beta (PRKAR2B, Accession NM_002736), a gene which type ii regulatory chains mediate membrane association by binding to anchoring proteins, including the map2 kinase. Accordingly, utilities of VGAM120 include diagnosis, prevention and treatment of diseases and clinical conditions associated with PRKAR2B. The function of PRKAR2B has been established by previous studies. Using both a rat skeletal muscle clone and a human clone of type II regulatory subunit of cyclic AMP-dependent protein kinase, Scambler et al. (1987) demonstrated that the human gene is located on chromosome 7, close to but separate from the cystic fibrosis locus (OMIM Ref. No. 219700). These conclusions were based on Southern blot analysis of DNA from hybrid cell lines containing only chromosome 7 or parts thereof, as well as human/mouse hybrid cell lines established by means of chromosome-mediated gene transfer (CMGT) using MET (OMIM Ref. No. 164860) as a dominant selectable marker. Independence of PKR2 from CF was also indicated by family linkage studies using a RFLP of the PKR2 probe. Wainwright et al. (1987) showed that PKR2 is linked to several markers on 7q. The closest and strongest linkage was to TCRB (OMIM Ref. No. 186930), which showed a maximum lod score of 3.01 at theta=0.00. Using RFLPs in the CEPH panel of 40 families, Solberg et al. (1992) mapped the regulatory subunit RII-beta of cAMP-dependent protein kinase to 7q. They constructed a 7-point framework map including PRKAR2B and demonstrated the following order: cen--D7S371--(COL1A2, D7S79)--PRKAR2B--MET--D7S87--TCRB--qter. Furthermore, by in situ hybridization to metaphase chromosomes, Solberg et al. (1992) physically mapped PRKAR2B to 7q22. Cummings et al. (1996) generated knockout mice for the cyclic AMP dependent protein kinase regulatory subunit type II-beta (designated RII-beta by them). They reported that the mutants appeared healthy but had markedly diminished white adipose tissue despite normal food intake and were protected against developing diet-induced obesity and fatty livers. In the mutant mice, brown adipose tissue demonstrated a compensatory increase in RI-alpha (OMIM Ref. No. 188830). Cummings et al. (1996) reported that RII-beta mutants exhibited markedly reduced leptin (OMIM Ref. No. 164160) mRNA and plasma levels; however, only mild hyperphagia was present Full details of the abovementioned studies are described in the following publications, the disclosure of which are hereby incorporated by reference:

Cummings, D. E.; Brandon, E. P.; Planas, J. V.; Motamed, K.; Idzerda, R. L.; McKnight, G. S.: Genetically lean mice result from targeted disruption of the RII-beta subunit of protein kinase A. Nature 382:622-626, 1996; and Scambler, P.; Oyen, O.; Wainwright, B.; Farrall, M.; Law, H.-Y.; Estivill, X.; Sandberg, M.; Williamson, R.; Jahnsen, T.: Exclusion of catalytic and regulatory subunits of cAMP-dependen.

Further studies establishing the function and utilities of PRKAR2B are found in John Hopkins OMIM database record ID 176912, and in sited publications numbered 1157-1158, 115 and 1159 listed in the bibliography section hereinbelow, which are also hereby incorporated by reference. RAB18, Member RAS Oncogene Family (RAB18, Accession NM_021252) is another VGAM120 host target gene. RAB18 BINDING SITE is HOST TARGET binding site found in the 3' untranslated region of mRNA encoded by RAB18, corresponding to a HOST TARGET binding site such as BINDING SITE I, BINDING SITE II or BINDING SITE III. Table 2 illustrates the complementarity of the nucleotide sequences of RAB18 BINDING SITE, designated SEQ ID:22222, to the nucleotide sequence of VGAM120 RNA, herein designated VGAM RNA, also designated SEQ ID:2831.

Another function of VGAM120 is therefore inhibition of RAB18, Member RAS Oncogene Family (RAB18, Accession NM_021252), a gene which plays a role in apical endocytosis/recycling. Accordingly, utilities of VGAM120 include diagnosis, prevention and treatment of diseases and clinical conditions associated with RAB18. The function of RAB18 has been established by previous studies. Rab proteins are members of a family of Ras-related small GTPases that regulate membrane trafficking in organelles and transport vesicles. By stimulating umbilical vein endothelial cells (HUVEC) with histamine and differential display gene expression analysis, Schafer et al. (2000) isolated a cDNA encoding RAB18. The deduced 206-amino acid protein shares 98%, 92%, and 85% identity with the mouse, snail, and worm sequences, respectively. RAB18 contains totally conserved phosphate/Mg (2+)-binding motifs and guanine-binding motifs as well as somewhat variable organelle-targeting regions. Northern blot analysis detected 2.5- and 1.0-kb transcripts in endothelial cells but not in smooth muscle cells or leukocytes. RT-PCR analysis suggested ubiquitous expression, which HPLC analysis determined to be strongest in heart, kidney, pancreas, lung, and liver, with weak expression in brain, placenta, and skeletal muscle. Stimulation of polarized HUVEC or nonpolarized mononuclear cells with histamine showed a significant time- and dose-dependent increase of RAB18 transcript in both cell types, suggesting a possible role for Rab proteins in inflammation. McMurtrie et al. (1997) mapped the mouse Rab18 gene to chromosome 18. They predicted that a human Rab18 homolog would map to 18q11-q12 or 10p11.

Full details of the abovementioned studies are described in the following publications, the disclosure of which are hereby incorporated by reference:

McMurtrie, E. B.; Barbosa, M. D. F. S.; Zerial, M.; Kingsmore, S. F.: Rab17 and Rab18, small GTPases with specificity for polarized epithelial cells: genetic mapping in the mouse. Genomics 45:623-625, 1997; and Schafer, U.; Seibold, S.; Schneider, A.; Neugebauer, E.: Isolation and characterisation of the human rab18 gene after stimulation of endothelial cells with histamine. FEBS Lett. 466:1.

Further studies establishing the function and utilities of RAB18 are found in John Hopkins OMIM database record ID 602207, and in sited publications numbered 8841-8842 listed in the bibliography section hereinbelow, which are also hereby incorporated by reference. RecQ Protein-like 5 (RECQL5, Accession NM_004259) is another VGAM120 host target gene. RECQL5 BINDING SITE is HOST TARGET binding site found in the 3' untranslated region of mRNA encoded by RECQL5, corresponding to a HOST TARGET binding site such as BINDING SITE I, BINDING SITE II or BINDING SITE III. Table 2 illustrates the complementarity of the nucleotide sequences of RECQL5 BINDING SITE, designated SEQ ID:10451, to the nucleotide sequence of VGAM120 RNA, herein designated VGAM RNA, also designated SEQ ID:2831.

Another function of VGAM120 is therefore inhibition of RecQ Protein-like 5 (RECQL5, Accession NM_004259). Accordingly, utilities of VGAM120 include diagnosis, prevention and treatment of diseases and clinical conditions associated with RECQL5. Splicing Factor, Arginine/serine-rich 2 (SFRS2, Accession XM_036785) is another VGAM120 host target gene. SFRS2 BINDING SITE is HOST TARGET binding site found in the 3' untranslated region of mRNA encoded by SFRS2, corresponding to a HOST TARGET binding site such as BINDING SITE I, BINDING SITE II or BINDING SITE III. Table 2 illustrates the complementarity of the nucleotide sequences of SFRS2 BINDING SITE, designated SEQ ID:32505, to the nucleotide sequence of VGAM120 RNA, herein designated VGAM RNA, also designated SEQ ID:2831.

Another function of VGAM120 is therefore inhibition of Splicing Factor, Arginine/serine-rich 2 (SFRS2, Accession XM_036785), a gene which is necessary for the splicing of pre-mrna. Accordingly, utilities of VGAM120 include diagnosis, prevention and treatment of diseases and clinical conditions associated with SFRS2. The function of SFRS2 and its association with various diseases and clinical conditions, has been established by previous studies, as described hereinabove with reference to VGAM47. Tripartite Motif-containing 34 (TRIM34, Accession NM_021616) is another VGAM120 host target gene. TRIM34 BINDING SITE1 and TRIM34 BINDING SITE2 are HOST TARGET binding sites found in untranslated regions of mRNA encoded by TRIM34, corresponding to HOST TARGET binding sites such as BINDING SITE I, BINDING SITE II or BINDING SITE III. Table 2 illustrates the complementarity of the nucleotide sequences of TRIM34 BINDING SITE1 and TRIM34 BINDING SITE2, designated SEQ ID:22253 and SEQ ID:28177 respectively, to the nucleotide sequence of VGAM120 RNA, herein designated VGAM RNA, also designated SEQ ID:2831.

Another function of VGAM120 is therefore inhibition of Tripartite Motif-containing 34 (TRIM34, Accession NM_021616). Accordingly, utilities of VGAM120 include diagnosis, prevention and treatment of diseases and clinical conditions associated with TRIM34. CSE-C (Accession XM_166163) is another VGAM120 host target gene. CSE-C BINDING SITE is HOST TARGET binding site found in the 3' untranslated region of mRNA encoded by CSE-C, corresponding to a HOST TARGET binding site such as BINDING SITE I, BINDING SITE II or BINDING SITE III. Table 2 illustrates the complementarity of the nucleotide sequences of CSE-C BINDING SITE, designated SEQ ID:43980, to the nucleotide sequence of VGAM120 RNA, herein designated VGAM RNA, also designated SEQ ID:2831.

Another function of VGAM120 is therefore inhibition of CSE-C (Accession XM_166163). Accordingly, utilities of VGAM120 include diagnosis, prevention and treatment of diseases and clinical conditions associated with CSE-C. FLJ10482 (Accession NM_018107) is another VGAM120 host target gene. FLJ10482 BINDING SITE is HOST TARGET binding site found in the 3" untranslated region of mRNA encoded by FLJ10482, corresponding to a HOST TARGET binding site such as BINDING SITE I, BINDING SITE II or BINDING SITE III. Table 2 illustrates the complementarity of the nucleotide sequences of FLJ10482 BINDING SITE, designated SEQ ID:19876, to the nucleotide sequence of VGAM120 RNA, herein designated VGAM RNA, also designated SEQ ID:2831.

Another function of VGAM120 is therefore inhibition of FLJ10482 (Accession NM_018107). Accordingly, utilities of VGAM120 include diagnosis, prevention and treatment of diseases and clinical conditions associated with FLJ10482. FLJ11149 (Accession NM_018339) is another VGAM120 host target gene. FLJ11149 BINDING SITE is HOST TARGET binding site found in the 3' untranslated region of mRNA encoded by FLJ11149, corresponding to a HOST TARGET binding site such as BINDING SITE I, BINDING SITE II or BINDING SITE III. Table 2 illustrates the complementarity of the nucleotide sequences of FLJ11149 BINDING SITE, designated SEQ ID:20346, to the nucleotide sequence of VGAM120 RNA, herein designated VGAM RNA, also designated SEQ ID:2831.

Another function of VGAM120 is therefore inhibition of FLJ11149 (Accession NM_018339). Accordingly, utilities of VGAM120 include diagnosis, prevention and treatment of diseases and clinical conditions associated with FLJ11149. FLJ11275 (Accession NM_018376) is another VGAM120 host target gene. FLJ11275 BINDING SITE is HOST TARGET binding site found in the 3' untranslated region of mRNA encoded by FLJ11275, corresponding to a HOST TARGET binding site such as BINDING SITE I, BINDING SITE II or BINDING SITE III. Table 2 illustrates the complementarity of the nucleotide sequences of FLJ11275 BINDING SITE, designated SEQ ID:20404, to the nucleotide sequence of VGAM120 RNA, herein designated VGAM RNA, also designated SEQ ID:2831.

Another function of VGAM120 is therefore inhibition of FLJ11275 (Accession NM_018376). Accordingly, utilities of VGAM120 include diagnosis, prevention and treatment of diseases and clinical conditions associated with FLJ11275. FLJ14326 (Accession NM_032191) is another VGAM120 host target gene. FLJ14326 BINDING SITE is HOST TARGET binding site found in the 5' untranslated region of mRNA encoded by FLJ14326, corresponding to a HOST TARGET binding site such as BINDING SITE I, BINDING SITE II or BINDING SITE III. Table 2 illustrates the complementarity of the nucleotide sequences of FLJ14326 BINDING SITE, designated SEQ ID:25904, to the nucleotide sequence of VGAM120 RNA, herein designated VGAM RNA, also designated SEQ ID:2831.

Another function of VGAM120 is therefore inhibition of FLJ14326 (Accession NM_032191). Accordingly, utilities of VGAM120 include diagnosis, prevention and treatment of diseases and clinical conditions associated with FLJ14326. FLJ20527 (Accession NM_017863) is another VGAM120 host target gene. FLJ20527 BINDING SITE is HOST TARGET binding site found in the 3' untranslated region of mRNA encoded by FLJ20527, corresponding to a HOST TARGET binding site such as BINDING SITE I, BINDING SITE II or BINDING SITE III. Table 2 illustrates the complementarity of the nucleotide sequences of FLJ20527 BINDING SITE, designated SEQ ID:19540, to the nucleotide sequence of VGAM120 RNA, herein designated VGAM RNA, also designated SEQ ID:2831.

Another function of VGAM120 is therefore inhibition of FLJ20527 (Accession NM_017863). Accordingly, utilities of VGAM120 include diagnosis, prevention and treatment of diseases and clinical conditions associated with FLJ20527. KIAA1464 (Accession XM_043069) is another VGAM120 host target gene. KIAA1464 BINDING SITE is HOST TARGET binding site found in the 3' untranslated region of mRNA encoded by KIAA1464, corresponding to a HOST TARGET binding site such as BINDING SITE I, BINDING SITE II or BINDING SITE III. Table 2 illustrates the complementarity of the nucleotide sequences of KIAA1464 BINDING SITE, designated SEQ ID:33883, to the nucleotide sequence of VGAM120 RNA, herein designated VGAM RNA, also designated SEQ ID:2831.

Another function of VGAM120 is therefore inhibition of KIAA1464 (Accession XM_043069). Accordingly, utilities of VGAM120 include diagnosis, prevention and treatment of diseases and clinical conditions associated with KIAA1464. MGC13183 (Accession NM_032358) is another VGAM120 host target gene. MGC13183 BINDING SITE is HOST TARGET binding site found in the 3' untranslated region of mRNA encoded by MGC13183, corresponding to a HOST TARGET binding site such as BINDING SITE I, BINDING SITE II or BINDING SITE III. Table 2 illustrates the complementarity of the nucleotide sequences of MGC13183 BINDING SITE, designated SEQ ID:26146, to the nucleotide sequence of VGAM120 RNA, herein designated VGAM RNA, also designated SEQ ID:2831.

Another function of VGAM120 is therefore inhibition of MGC13183 (Accession NM_032358). Accordingly, utilities of VGAM120 include diagnosis, prevention and treatment of diseases and clinical conditions associated with MGC13183. MGC16142 (Accession NM_032763) is another VGAM120 host target gene. MGC16142 BINDING SITE is HOST TARGET binding site found in the 3' untranslated region of mRNA encoded by MGC16142, corresponding to a HOST TARGET binding site such as BINDING SITE I, BINDING SITE II or BINDING SITE III. Table 2 illustrates the complementarity of the nucleotide sequences of MGC16142 BINDING SITE, designated SEQ ID:26507, to the nucleotide sequence of VGAM120 RNA, herein designated VGAM RNA, also designated SEQ ID:2831.

Another function of VGAM120 is therefore inhibition of MGC16142 (Accession NM_032763). Accordingly, utilities of VGAM120 include diagnosis, prevention and treatment of diseases and clinical conditions associated with MGC16142. Wingless-type MMTV Integration Site Family, Member 2B (WNT2B, Accession NM_024494) is another VGAM120 host target gene. WNT2B BINDING SITE1 and WNT2B BINDING SITE2 are HOST TARGET binding sites found in untranslated regions of mRNA encoded by WNT2B, corresponding to HOST TARGET binding sites such as BINDING SITE I, BINDING SITE II or BINDING SITE III. Table 2 illustrates the complementarity of the nucleotide sequences of WNT2B BINDING SITE1 and WNT2B BINDING SITE2, designated SEQ ID:23694 and SEQ ID:10393 respectively, to the nucleotide sequence of VGAM120 RNA, herein designated VGAM RNA, also designated SEQ ID:2831.

Another function of VGAM120 is therefore inhibition of Wingless-type MMTV Integration Site Family, Member 2B (WNT2B, Accession NM_024494). Accordingly, utilities of VGAM120 include diagnosis, prevention and treatment of diseases and clinical conditions associated with WNT2B. LOC147622 (Accession XM_097255) is another VGAM120 host target gene. LOC147622 BINDING SITE is HOST TARGET binding site found in the 3' untranslated region of mRNA encoded by LOC147622, corresponding to a HOST TARGET binding site such as BINDING SITE I, BINDING SITE II or BINDING SITE III. Table 2 illustrates the complementarity of the nucleotide sequences of LOC147622 BINDING SITE, designated SEQ ID:40851, to the nucleotide sequence of VGAM120 RNA, herein designated VGAM RNA, also designated SEQ ID:2831.

Another function of VGAM120 is therefore inhibition of LOC147622 (Accession XM_097255). Accordingly, utilities of VGAM120 include diagnosis, prevention and treatment of diseases and clinical conditions associated with LOC147622. LOC150630 (Accession XM_097931) is another VGAM120 host target gene. LOC150630 BINDING SITE is HOST TARGET binding site found in the 5' untranslated region of mRNA encoded by LOC150630, corresponding to a HOST TARGET binding site such as BINDING SITE I, BINDING SITE II or BINDING SITE III. Table 2 illustrates the complementarity of the nucleotide sequences of LOC150630 BINDING SITE, designated SEQ ID:41243, to the nucleotide sequence of VGAM120 RNA, herein designated VGAM RNA, also designated SEQ ID:2831.

Another function of VGAM120 is therefore inhibition of LOC150630 (Accession XM_097931). Accordingly, utilities of VGAM120 include diagnosis, prevention and treatment of diseases and clinical conditions associated with LOC150630. LOC155081 (Accession XM_088145) is another VGAM120 host target gene. LOC155081 BINDING SITE is HOST TARGET binding site found in the 3' untranslated region of mRNA encoded by LOC155081, corresponding to a HOST TARGET binding site such as BINDING SITE I, BINDING SITE II or BINDING SITE III. Table 2 illustrates the complementarity of the nucleotide sequences of LOC155081 BINDING SITE, designated SEQ ID:39546, to the nucleotide sequence of VGAM120 RNA, herein designated VGAM RNA, also designated SEQ ID:2831.

Another function of VGAM120 is therefore inhibition of LOC155081 (Accession XM_088145). Accordingly, utilities of VGAM120 include diagnosis, prevention and treatment of diseases and clinical conditions associated with LOC155081.

LOC196812 (Accession XM_116868) is another VGAM120 host target gene. LOC196812 BINDING SITE is HOST TARGET binding site found in the 3' untranslated region of mRNA encoded by LOC196812, corresponding to a HOST TARGET binding site such as BINDING SITE I, BINDING SITE II or BINDING SITE III. Table 2 illustrates the complementarity of the nucleotide sequences of LOC196812 BINDING SITE, designated SEQ ID:43135, to the nucleotide sequence of VGAM120 RNA, herein designated VGAM RNA, also designated SEQ ID:2831.

Another function of VGAM120 is therefore inhibition of LOC196812 (Accession XM_116868). Accordingly, utilities of VGAM120 include diagnosis, prevention and treatment of diseases and clinical conditions associated with LOC196812.

LOC221421 (Accession XM_166428) is another VGAM120 host target gene. LOC221421 BINDING SITE is HOST TARGET binding site found in the 3' untranslated region of mRNA encoded by LOC221421, corresponding to a HOST TARGET binding site such as BINDING SITE I, BINDING SITE II or BINDING SITE III. Table 2 illustrates the complementarity of the nucleotide sequences of LOC221421 BINDING SITE, designated SEQ ID:44326, to the nucleotide sequence of VGAM120 RNA, herein designated VGAM RNA, also designated SEQ ID:2831.

Another function of VGAM120 is therefore inhibition of LOC221421 (Accession XM_166428). Accordingly, utilities of VGAM120 include diagnosis, prevention and treatment of diseases and clinical conditions associated with LOC221421.

LOC222228 (Accession XM_168627) is another VGAM120 host target gene. LOC222228 BINDING SITE is HOST TARGET binding site found in the 3' untranslated region of mRNA encoded by LOC222228, corresponding to a HOST TARGET binding site such as BINDING SITE I, BINDING SITE II or BINDING SITE III. Table 2 illustrates the complementarity of the nucleotide sequences of LOC222228 BINDING SITE, designated SEQ ID:45277, to the nucleotide sequence of VGAM120 RNA, herein designated VGAM RNA, also designated SEQ ID:2831.

Another function of VGAM120 is therefore inhibition of LOC222228 (Accession XM_168627). Accordingly, utilities of VGAM120 include diagnosis, prevention and treatment of diseases and clinical conditions associated with LOC222228.

LOC222233 (Accession XM_168560) is another VGAM120 host target gene. LOC222233 BINDING SITE is HOST TARGET binding site found in the 3' untranslated region of mRNA encoded by LOC222233, corresponding to a HOST TARGET binding site such as BINDING SITE I, BINDING SITE II or BINDING SITE III. Table 2 illustrates the complementarity of the nucleotide sequences of LOC222233 BINDING SITE, designated SEQ ID:45246, to the nucleotide sequence of VGAM120 RNA, herein designated VGAM RNA, also designated SEQ ID:2831.

Another function of VGAM120 is therefore inhibition of LOC222233 (Accession XM_168560). Accordingly, utilities of VGAM120 include diagnosis, prevention and treatment of diseases and clinical conditions associated with LOC222233.

LOC90906 (Accession XM_034809) is another VGAM120 host target gene. LOC90906 BINDING SITE is HOST TARGET binding site found in the 3' untranslated region of mRNA encoded by LOC90906, corresponding to a HOST TARGET binding site such as BINDING SITE I, BINDING SITE II or BINDING SITE III. Table 2 illustrates the complementarity of the nucleotide sequences of LOC90906 BINDING SITE, designated SEQ ID:32152, to the nucleotide sequence of VGAM120 RNA, herein designated VGAM RNA, also designated SEQ ID:2831.

Another function of VGAM120 is therefore inhibition of LOC90906 (Accession XM_034809). Accordingly, utilities of VGAM120 include diagnosis, prevention and treatment of diseases and clinical conditions associated with LOC90906.

FIG. 1 further provides a conceptual description of a novel bioinformatically detected viral gene of the present invention, referred to here as Viral Genomic Address Messenger 121 (VGAM121) viral gene, which modulates expression of respective host target genes thereof, the function and utility of which host target genes is known in the art.

VGAM121 is a novel bioinformatically detected regulatory, non protein coding, viral micro RNA (miRNA) gene. The method by which VGAM121 was detected is described hereinabove with reference to FIGS. 1-8.

VGAM121 gene, herein designated VGAM GENE, is a viral gene contained in the genome of Shrimp White Spot Syndrome Virus (white spot bacilliform virus). VGAM121 host target gene, herein designated VGAM HOST TARGET GENE, is a human gene contained in the human genome.

VGAM121 gene encodes a VGAM121 precursor RNA, herein designated VGAM PRECURSOR RNA. Similar to other miRNA genes, and unlike most ordinary genes, VGAM121 precursor RNA does not encode a protein. A nucleotide sequence identical or highly similar to the nucleotide sequence of VGAM121 precursor RNA is designated SEQ ID:107, and is provided hereinbelow with reference to the sequence listing part. Nucleotide sequence SEQ ID:107 is located at position 104845 relative to the genome of Shrimp White Spot Syndrome Virus (white spot bacilliform virus).

VGAM121 precursor RNA folds onto itself, forming VGAM121 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM121 folded precursor RNA into VGAM121 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM121 RNA is designated SEQ ID:2832, and is provided hereinbelow with reference to the sequence listing part.

VGAM121 host target gene, herein designated VGAM HOST TARGET GENE, encodes a corresponding messenger RNA, VGAM121 host target RNA, herein designated VGAM HOST TARGET RNA. VGAM121 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM121 RNA, herein designated VGAM RNA, binds complementarily to one or more host target binding sites located in untranslated regions of VGAM121 host target RNA, herein designated VGAM HOST TARGET RNA. This complementary binding is due to the fact that the nucleotide sequence of VGAM121 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM121 RNA, herein designated VGAM RNA, may have a different number of host target binding sites in untranslated regions of a VGAM121 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM121 RNA, herein designated VGAM RNA, to host target binding sites on VGAM121 host target RNA, herein designated VGAM HOST TARGET RNA, such as BINDING SITE I, BINDING SITE II and BINDING SITE III, inhibits translation of VGAM121 host target RNA into VGAM121 host target protein, herein designated VGAM HOST TARGET PROTEIN. VGAM host target protein is therefore outlined by a broken line.

It is appreciated that VGAM121 host target gene, herein designated VGAM HOST TARGET GENE, in fact represents a plurality of VGAM121 host target genes. The mRNA of each one of this plurality of VGAM121 host target genes comprises one or more host target binding sites, each having a nucleotide sequence which is at least partly complementary to VGAM121 RNA, herein designated VGAM RNA, and which when bound by VGAM121 RNA causes inhibition of translation of respective one or more VGAM121 host target proteins.

It is further appreciated by one skilled in the art that the mode of translational inhibition illustrated by FIG. 1 with specific reference to translational inhibition exerted by VGAM121 gene, herein designated VGAM GENE, on one or more VGAM121 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM121 is inhibition of expression of host target genes, as part of a novel viral mechanism of attacking a host. Accordingly, utilities of VGAM121 include diagnosis, prevention and treatment of viral infection by Shrimp White Spot Syndrome Virus (white spot bacilliform virus). Specific functions, and accordingly utilities, of VGAM121 correlate with, and may be deduced from, the identity of the host target genes which VGAM121 binds and inhibits, and the function of these host target genes, as elaborated hereinbelow.

Nucleotide sequences of the VGAM121 precursor RNA, herein designated VGAM PRECURSOR RNA, and of the 'diced' VGAM121 RNA, herein designated VGAM RNA, and a schematic representation of the secondary folding of VGAM121 folded precursor RNA, herein designated VGAM FOLDED PRECURSOR RNA, of VGAM121 are further described hereinbelow with reference to Table 1.

Nucleotide sequences of host target binding sites, such as BINDING SITE-I, BINDING SITE-II and BINDING SITE-III of FIG. 1, found on VGAM121 host target RNA, and schematic representation of the complementarity of each of these host target binding sites to VGAM121 RNA, herein designated VGAM RNA, are described hereinbelow with reference to Table 2.

As mentioned hereinabove with reference to FIG. 1, a function of VGAM121 gene, herein designated VGAM is inhibition of expression of VGAM121 target genes. It is appreciated that specific functions, and accordingly utilities, of VGAM121 correlate with, and may be deduced from, the identity of the target genes which VGAM121 binds and inhibits, and the function of these target genes, as elaborated hereinbelow.

C-type (calcium dependent, carbohydrate-recognition domain) Lectin, Superfamily Member 12 (CLECSF12, Accession XM_084768) is a VGAM121 host target gene. CLECSF12 BINDING SITE is HOST TARGET binding site found in the 5' untranslated region of mRNA encoded by CLECSF12, corresponding to a HOST TARGET binding site such as BINDING SITE I, BINDING SITE II or BINDING SITE III. Table 2 illustrates the complementarity of the nucleotide sequences of CLECSF12 BINDING SITE, designated SEQ ID:37685, to the nucleotide sequence of VGAM121 RNA, herein designated VGAM RNA, also designated SEQ ID:2832.

A function of VGAM121 is therefore inhibition of C-type (calcium dependent, carbohydrate-recognition domain) Lectin, Superfamily Member 12 (CLECSF12, Accession XM_084768), a gene which is a pattern-recognition receptor . Accordingly, utilities of VGAM121 include diagnosis, prevention and treatment of diseases and clinical conditions associated with CLECSF12. The function of CLECSF12 has been established by previous studies. Yokota et al. (2001) cloned human dectin-1 using degenerative PCR amplification of mRNA isolated from dendritic cells and subsequent cDNA cloning. The human dectin-1 gene encodes a polypeptide of 247 amino acids, 3 amino acids longer than the mouse protein. Dectin-1 contains an immunoreceptor tyrosine-based activation motif within the cytoplasmic domain. Human dectin-1 mRNA is expressed predominantly in peripheral blood leukocytes and preferentially by dendritic cells. The mRNA encodes a 33-kD glycoprotein. In human epidermis, the protein is expressed selectively by Langerhans cells, which are an epidermal subset of dendritic cells. A truncated form of dectin-1 RNA encodes a polypeptide lacking almost the entire neck domain, which is required for accessibility of the carbohydrate recognition domain to ligands. Truncated dectin is produced by alternative splicing. Brown and Gordon (2001) identified dectin-1 as a beta-glucan receptor present on macrophages. In contrast to its reported specificity for dendritic cells (Yokota et al. (2001), Brown and Gordon (2001)) found that dectin-1 was expressed in every macrophage population examined and in more tissues than was previously reported with the highest expression being in the liver, lung, and thymus. Brown and Gordon (2001) found that dectin-1 is a pattern-recognition receptor that recognizes a variety of beta-1,3-linked and beta-1,6-linked glucans from fungi and plants. Dectin-1 did not recognize monosaccharides or carbohydrates with different linkages. Laminarin and glucan phosphate, a structurally defined immunologically active beta-glucan, were the most effective inhibitors; both bind to the beta-glucan receptor on monocytes and macrophages. Soluble recombinant dectin-1 stimulates the proliferation of T lymphocytes (Ariizumi et al. (2000)). In a whole-cell binding assay, binding of T cells to NIH 3T3 cells expressing dectin-1 was not inhibited by beta-glucans. Therefore, Brown and Gordon (2001) concluded that dectin-1 has 2 ligand binding sites: one that recognizes an endogenous ligand on T cells, and another for exogenous carbohydrates.

Full details of the abovementioned studies are described in the following publications, the disclosure of which are hereby incorporated by reference:

Ariizumi, K.; Shen, G.-L.; Shikano, S.; Xu, S.; Ritter, R., III; Kumamoto, T.; Edelbaum, D.; Morita, A.; Bergstresser, P. R.; Takashima, A.: Identification of a novel, dendritic cell-associated molecule, dectin-1, by subtractive cDNA cloning. J. Biol. Chem. 275:20157-20167, 2000; and Brown, G. D.; Gordon, S.: A new receptor for beta-glucans. Nature 413: 36-37, 2001.

Further studies establishing the function and utilities of CLECSF12 are found in John Hopkins OMIM database record ID 606264, and in sited publications numbered 910-913 listed in the bibliography section hereinbelow, which are also hereby incorporated by reference. Deoxyguanosine Kinase (DGUOK, Accession NM_080915) is another VGAM121 host target gene. DGUOK BINDING SITE1 and DGUOK BINDING SITE2 are HOST TARGET binding sites found in untranslated regions of mRNA encoded by DGUOK, corresponding to HOST TARGET binding sites such as BINDING SITE I, BINDING SITE II or BINDING SITE III. Table 2 illustrates the complementarity of the nucleotide sequences of DGUOK BINDING SITE1 and DGUOK BINDING SITE2, designated SEQ ID:28134 and SEQ ID:28138 respectively, to the nucleotide sequence of VGAM121 RNA, herein designated VGAM RNA, also designated SEQ ID:2832.

Another function of VGAM121 is therefore inhibition of Deoxyguanosine Kinase (DGUOK, Accession NM_080915), a gene which is deoxyguanosine kinase and mediates phosphorylation of several deoxyribonucleosides. Accordingly, utilities of VGAM121 include diagnosis, prevention and treatment of diseases and clinical conditions associated with DGUOK. The function of DGUOK has been established by previous studies. Mitochondrial DNA depletion syndromes (OMIM Ref. No. 251880) are phenotypically heterogeneous, autosomal recessive disorders characterized by tissue-specific reduction in mtDNA copy number. Affected individuals with the hepatocerebral form of mtDNA depletion syndrome have early progressive liver failure and neurologic abnormalities, hypoglycemia, and increased lactate in body fluids. Affected tissues show both decreased activity of the mtDNA-encoded respiratory chain complexes (I, III, IV, and V) and mtDNA depletion. Mandel et al. (2001) used homozygosity mapping in 3 kindreds of Druze origin to map the hepatocerebral mtDNA depletion syndrome locus to a region of 6.1 cM on chromosome 2p13. This interval encompasses the DGUOK gene. They identified a 1-bp deletion (601465.0001) within the DGUOK gene that segregated with the disease in the 3 kindreds studied. Western blot analysis failed to detect DGK protein in the liver of affected persons. The main supply of deoxyribonucleotides (dNTPs) for mtDNA synthesis comes from the salvage pathway initiated by DGK and thymidine kinase-2 (TK2; 188250). The association of mtDNA depletion with mutated DGUOK suggested that the salvage pathway enzymes are involved in the maintenance of balanced mitochondrial dNTP pools. In 2 German brothers with the hepatocerebral form of mitochondrial DNA-depletion syndrome (OMIM Ref. No. 251880) characterized by lactic acidosis, hepatomegaly, hypoglycemia, jaundice, and encephalopathy with hypotonia, hyperreflexia, and nystagmus, Taanman et al. (2002) identified a homozygous nonsense mutation in exon 3 of the DGUOK gene, 313C-T, resulting in a 173-amino acid truncation at the C terminus of the protein product. The unaffected parents were heterozygous for the mutation.

Full details of the abovementioned studies are described in the following publications, the disclosure of which are hereby incorporated by reference:

Mandel, H.; Szargel, R.; Labay, V.; Elpeleg, O.; Saada, A.; Shalata, A.; Anbinder, Y.; Berkowitz, D.; Hartman, C.; Barak, M.; Eriksson, S.; Cohen, N.: The deoxyguanosine kinase gene is mutated in individuals with depleted hepatocerebral mitochondrial DNA. Nature Genet. 29:337-341, 2001. Note: Erratum: Nature Genet. 29:491 only, 2001; and Taanman, J.-W.; Kateeb, I.; Muntau, A. C.; Jaksch, M.; Cohen, N.; Mandel, H.: A novel mutation in the deoxyguanosine kinase gene causing depletion of mitochondrial DNA. Ann. Neurol. 5.

Further studies establishing the function and utilities of DGUOK are found in John Hopkins OMIM database record ID 601465, and in sited publications numbered 275 and 10086 listed in the bibliography section hereinbelow, which are also hereby incorporated by reference. Sperm Associated Antigen 6 (SPAG6, Accession NM_012443) is another VGAM121 host target gene. SPAG6 BINDING SITE is HOST TARGET binding site found in the 3' untranslated region of mRNA encoded by SPAG6, corresponding to a HOST TARGET binding site such as BINDING SITE I, BINDING SITE II or BINDING SITE III. Table 2 illustrates the complementarity of the nucleotide sequences of SPAG6 BINDING SITE, designated SEQ ID:14817, to the nucleotide sequence of VGAM121 RNA, herein designated VGAM RNA, also designated SEQ ID:2832.

Another function of VGAM121 is therefore inhibition of Sperm Associated Antigen 6 (SPAG6, Accession NM_012443). Accordingly, utilities of VGAM121 include diagnosis, prevention and treatment of diseases and clinical conditions associated with SPAG6. Tensin (TNS, Accession NM_022648) is another VGAM121 host target gene. TNS BINDING SITE is HOST TARGET binding site found in the 3' untranslated region of mRNA encoded by TNS, corresponding to a HOST TARGET binding site such as BINDING SITE I, BINDING SITE II or BINDING SITE III. Table 2 illustrates the complementarity of the nucleotide sequences of TNS BINDING SITE, designated SEQ ID:22901, to the nucleotide sequence of VGAM121 RNA, herein designated VGAM RNA, also designated SEQ ID:2832.

Another function of VGAM121 is therefore inhibition of Tensin (TNS, Accession NM_022648). Accordingly, utilities of VGAM121 include diagnosis, prevention and treatment of diseases and clinical conditions associated with TNS. FLJ10759 (Accession NM_018207) is another VGAM121 host target gene. FLJ10759 BINDING SITE is HOST TARGET binding site found in the 3" untranslated region of mRNA encoded by FLJ10759, corresponding to a HOST TARGET binding site such as BINDING SITE I, BINDING SITE II or BINDING SITE III. Table 2 illustrates the complementarity of the nucleotide sequences of FLJ10759 BINDING SITE, designated SEQ ID:20099, to the nucleotide sequence of VGAM121 RNA, herein designated VGAM RNA, also designated SEQ ID:2832.

Another function of VGAM121 is therefore inhibition of FLJ10759 (Accession NM_018207). Accordingly, utilities of VGAM121 include diagnosis, prevention and treatment of diseases and clinical conditions associated with FLJ10759. FLJ10815 (Accession NM_018231) is another VGAM121 host target gene. FLJ10815 BINDING SITE is HOST TARGET binding site found in the 3' untranslated region of mRNA encoded by FLJ10815, corresponding to a HOST TARGET binding site such as BINDING SITE I, BINDING SITE II or BINDING SITE III. Table 2 illustrates the complementarity of the nucleotide sequences of FLJ10815 BINDING SITE, designated SEQ ID:20172, to the nucleotide sequence of VGAM121 RNA, herein designated VGAM RNA, also designated SEQ ID:2832.

Another function of VGAM121 is therefore inhibition of FLJ10815 (Accession NM_018231). Accordingly, utilities of VGAM121 include diagnosis, prevention and treatment of diseases and clinical conditions associated with FLJ10815. FLJ11259 (Accession NM_018370) is another VGAM121 host target gene. FLJ11259 BINDING SITE is HOST TARGET binding site found in the 3' untranslated region of mRNA encoded by FLJ11259, corresponding to a HOST TARGET binding site such as BINDING SITE I, BINDING SITE II or BINDING SITE III. Table 2 illustrates the complementarity of the nucleotide sequences of FLJ11259 BINDING SITE, designated SEQ ID:20381, to the nucleotide sequence of VGAM121 RNA, herein designated VGAM RNA, also designated SEQ ID:2832.

Another function of VGAM121 is therefore inhibition of FLJ11259 (Accession NM_018370). Accordingly, utilities of VGAM121 include diagnosis, prevention and treatment of diseases and clinical conditions associated with FLJ11259. FLJ30567 (Accession NM_145022) is another VGAM121 host target gene. FLJ30567 BINDING SITE is HOST TARGET binding site found in the 3' untranslated region of mRNA encoded by FLJ30567, corresponding to a HOST TARGET binding site such as BINDING SITE I, BINDING SITE II or BINDING SITE III. Table 2 illustrates the complementarity of the nucleotide sequences of FLJ30567 BINDING SITE, designated SEQ ID:29632, to the nucleotide sequence of VGAM121 RNA, herein designated VGAM RNA, also designated SEQ ID:2832.

Another function of VGAM121 is therefore inhibition of FLJ30567 (Accession NM_145022). Accordingly, utilities of VGAM121 include diagnosis, prevention and treatment of diseases and clinical conditions associated with FLJ30567. KIAA1361 (Accession XM_030845) is another VGAM121 host target gene. KIAA1361 BINDING SITE is HOST TARGET binding site found in the 3' untranslated region of mRNA encoded by KIAA1361, corresponding to a HOST TARGET binding site such as BINDING SITE I, BINDING SITE II or BINDING SITE III. Table 2 illustrates the complementarity of the nucleotide sequences of KIAA1361 BINDING SITE, designated SEQ ID:31164, to the nucleotide sequence of VGAM121 RNA, herein designated VGAM RNA, also designated SEQ ID:2832.

Another function of VGAM121 is therefore inhibition of KIAA1361 (Accession XM_030845). Accordingly, utilities of VGAM121 include diagnosis, prevention and treatment of diseases and clinical conditions associated with KIAA1361. LEAP-2 (Accession NM_052971) is another VGAM121 host target gene. LEAP-2 BINDING SITE is HOST TARGET binding site found in the 5' untranslated region of mRNA encoded by LEAP-2, corresponding to a HOST TARGET binding site such as BINDING SITE I, BINDING SITE II or BINDING SITE III. Table 2 illustrates the complementarity of the nucleotide sequences of LEAP-2 BINDING SITE, designated SEQ ID:27544, to the nucleotide sequence of VGAM121 RNA, herein designated VGAM RNA, also designated SEQ ID:2832.

Another function of VGAM121 is therefore inhibition of LEAP-2 (Accession NM_052971). Accordingly, utilities of VGAM121 include diagnosis, prevention and treatment of diseases and clinical conditions associated with LEAP-2. P1P373C6 (Accession NM_019110) is another VGAM121 host target gene. P1P373C6 BINDING SITE is HOST TARGET binding site found in the 5' untranslated region of mRNA encoded by P1P373C6, corresponding to a HOST TARGET binding site such as BINDING SITE I, BINDING SITE II or BINDING SITE III. Table 2 illustrates the complementarity of the nucleotide sequences of P1P373C6 BINDING SITE, designated SEQ ID:21187, to the nucleotide sequence of VGAM121 RNA, herein designated VGAM RNA, also designated SEQ ID:2832.

Another function of VGAM121 is therefore inhibition of P1P373C6 (Accession NM_019110). Accordingly, utilities of VGAM121 include diagnosis, prevention and treatment of diseases and clinical conditions associated with P1P373C6. Protein Tyrosine Phosphatase Type IVA, Member 1 (PTP4A1, Accession NM_003463) is another VGAM121 host target gene. PTP4A1 BINDING SITE is HOST TARGET binding site found in the 3' untranslated region of mRNA encoded by PTP4A1, corresponding to a HOST TARGET binding site such as BINDING SITE I, BINDING SITE II or BINDING SITE III. Table 2 illustrates the complementarity of the nucleotide sequences of PTP4A1 BINDING SITE, designated SEQ ID:9531, to the nucleotide sequence of VGAM121 RNA, herein designated VGAM RNA, also designated SEQ ID:2832.

Another function of VGAM121 is therefore inhibition of Protein Tyrosine Phosphatase Type IVA, Member 1 (PTP4A1, Accession NM_003463). Accordingly, utilities of VGAM121 include diagnosis, prevention and treatment of diseases and clinical conditions associated with PTP4A1. Unc-5 Homolog D (C. elegans) (UNC5D, Accession NM_080872) is another VGAM121 host target gene. UNC5D BINDING SITE is HOST TARGET binding site found in the 3' untranslated region of mRNA encoded by UNC5D, corresponding to a HOST TARGET binding site such as BINDING SITE I, BINDING SITE II or BINDING SITE III. Table 2 illustrates the complementarity of the nucleotide sequences of UNC5D BINDING SITE, designated SEQ ID:28113, to the nucleotide sequence of VGAM121 RNA, herein designated VGAM RNA, also designated SEQ ID:2832.

Another function of VGAM121 is therefore inhibition of Unc-5 Homolog D (C. elegans) (UNC5D, Accession NM_080872). Accordingly, utilities of VGAM121 include diagnosis, prevention and treatment of diseases and clinical conditions associated with UNC5D. LOC143287 (Accession XM_096410) is another VGAM121 host target gene. LOC143287 BINDING SITE is HOST TARGET binding site found in the 3' untranslated region of mRNA encoded by LOC143287, corresponding to a HOST TARGET binding site such as BINDING SITE I, BINDING SITE II or BINDING SITE III. Table 2 illustrates the complementarity of the nucleotide sequences of LOC143287 BINDING SITE, designated SEQ ID:40343, to the nucleotide sequence of VGAM121 RNA, herein designated VGAM RNA, also designated SEQ ID:2832.

Another function of VGAM121 is therefore inhibition of LOC143287 (Accession XM_096410). Accordingly, utilities of VGAM121 include diagnosis, prevention and treatment of diseases and clinical conditions associated with LOC143287. LOC145678 (Accession XM_096832) is another VGAM121 host target gene. LOC145678 BINDING SITE is HOST TARGET binding site found in the 5' untranslated region of mRNA encoded by LOC145678, corresponding to a HOST TARGET binding site such as BINDING SITE I, BINDING SITE II or BINDING SITE III. Table 2 illustrates the complementarity of the nucleotide sequences of LOC145678 BINDING SITE, designated SEQ ID:40553, to the nucleotide sequence of VGAM121 RNA, herein designated VGAM RNA, also designated SEQ ID:2832.

Another function of VGAM121 is therefore inhibition of LOC145678 (Accession XM_096832). Accordingly, utilities of VGAM121 include diagnosis, prevention and treatment of diseases and clinical conditions associated with LOC145678. LOC149506 (Accession XM_097661) is another VGAM121 host target gene. LOC149506 BINDING SITE is HOST TARGET binding site found in the 5' untranslated region of mRNA encoded by LOC149506, corresponding to a HOST TARGET binding site such as BINDING SITE I, BINDING SITE II or BINDING SITE III. Table 2 illustrates the complementarity of the nucleotide sequences of LOC149506 BINDING SITE, designated SEQ ID:41003, to the nucleotide sequence of VGAM121 RNA, herein designated VGAM RNA, also designated SEQ ID:2832.

Another function of VGAM121 is therefore inhibition of LOC149506 (Accession XM_097661). Accordingly, utilities of VGAM121 include diagnosis, prevention and treatment of diseases and clinical conditions associated with LOC149506. LOC153020 (Accession XM_087578) is another VGAM121 host target gene. LOC153020 BINDING SITE is HOST TARGET binding site found in the 3' untranslated region of mRNA encoded by LOC153020, corresponding to a HOST TARGET binding site such as BINDING SITE I, BINDING SITE II or BINDING SITE III. Table 2 illustrates the complementarity of the nucleotide sequences of LOC153020 BINDING SITE, designated SEQ ID:39352, to the nucleotide sequence of VGAM121 RNA, herein designated VGAM RNA, also designated SEQ ID:2832.

Another function of VGAM121 is therefore inhibition of LOC153020 (Accession XM_087578). Accordingly, utilities of VGAM121 include diagnosis, prevention and treatment of diseases and clinical conditions associated with LOC153020. LOC255394 (Accession XM_170710) is another VGAM121 host target gene. LOC255394 BINDING SITE is HOST TARGET binding site found in the 5' untranslated region of mRNA encoded by LOC255394, corresponding to a HOST TARGET binding site such as BINDING SITE I, BINDING SITE II or BINDING SITE III. Table 2 illustrates the complementarity of the nucleotide sequences of LOC255394 BINDING SITE, designated SEQ ID:45480, to the nucleotide sequence of VGAM121 RNA, herein designated VGAM RNA, also designated SEQ ID:2832.

Another function of VGAM121 is therefore inhibition of LOC255394 (Accession XM_170710). Accordingly, utilities of VGAM121 include diagnosis, prevention and treatment of diseases and clinical conditions associated with LOC255394. LOC84549 (Accession NM_032509) is another VGAM121 host target gene. LOC84549 BINDING SITE is HOST TARGET binding site found in the 3' untranslated region of mRNA encoded by LOC84549, corresponding to a HOST TARGET binding site such as BINDING SITE I, BINDING SITE II or BINDING SITE III. Table 2 illustrates the complementarity of the nucleotide sequences of LOC84549 BINDING SITE, designated SEQ ID:26257, to the nucleotide sequence of VGAM121 RNA, herein designated VGAM RNA, also designated SEQ ID:2832.

Another function of VGAM121 is therefore inhibition of LOC84549 (Accession NM_032509). Accordingly, utilities of VGAM121 include diagnosis, prevention and treatment of diseases and clinical conditions associated with LOC84549. LOC92391 (Accession XM_044793) is another VGAM121 host target gene. LOC92391 BINDING SITE is HOST TARGET binding site found in the 3' untranslated region of mRNA encoded by LOC92391, corresponding to a HOST TARGET binding site such as BINDING SITE I, BINDING SITE II or BINDING SITE III. Table 2 illustrates the complementarity of the nucleotide sequences of LOC92391 BINDING SITE, designated SEQ ID:34272, to the nucleotide sequence of VGAM121 RNA, herein designated VGAM RNA, also designated SEQ ID:2832.

Another function of VGAM121 is therefore inhibition of LOC92391 (Accession XM_044793). Accordingly, utilities of VGAM121 include diagnosis, prevention and treatment of diseases and clinical conditions associated with LOC92391. FIG. 1 further provides a conceptual description of a novel bioinformatically detected viral gene of the present invention, referred to here as Viral Genomic Address Messenger 122 (VGAM122) viral gene, which modulates expression of respective host target genes thereof, the function and utility of which host target genes is known in the art.

VGAM122 is a novel bioinformatically detected regulatory, non protein coding, viral micro RNA (miRNA) gene. The method by which VGAM122 was detected is described hereinabove with reference to FIGS. 1-8.

VGAM122 gene, herein designated VGAM GENE, is a viral gene contained in the genome of Shrimp White Spot Syndrome Virus (white spot bacilliform virus). VGAM122 host target gene, herein designated VGAM HOST TARGET GENE, is a human gene contained in the human genome.

VGAM122 gene encodes a VGAM122 precursor RNA, herein designated VGAM PRECURSOR RNA. Similar to other miRNA genes, and unlike most ordinary genes, VGAM122 precursor RNA does not encode a protein. A nucleotide sequence identical or highly similar to the nucleotide sequence of VGAM122 precursor RNA is designated SEQ ID:108, and is provided hereinbelow with reference to the sequence listing part. Nucleotide sequence SEQ ID:108 is located at position 205407 relative to the genome of Shrimp White Spot Syndrome Virus (white spot bacilliform virus).

VGAM122 precursor RNA folds onto itself, forming VGAM122 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM122 folded precursor RNA into VGAM122 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM122 RNA is designated SEQ ID:2833, and is provided hereinbelow with reference to the sequence listing part.

VGAM122 host target gene, herein designated VGAM HOST TARGET GENE, encodes a corresponding messenger RNA, VGAM122 host target RNA, herein designated VGAM HOST TARGET RNA. VGAM122 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM122 RNA, herein designated VGAM RNA, binds complementarily to one or more host target binding sites located in untranslated regions of VGAM122 host target RNA, herein designated VGAM HOST TARGET RNA. This complementary binding is due to the fact that the nucleotide sequence of VGAM122 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM122 RNA, herein designated VGAM RNA, may have a different number of host target binding sites in untranslated regions of a VGAM122 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM122 RNA, herein designated VGAM RNA, to host target binding sites on VGAM122 host target RNA, herein designated VGAM HOST TARGET RNA, such as BINDING SITE I, BINDING SITE II and BINDING SITE III, inhibits translation of VGAM122 host target RNA into VGAM122 host target protein, herein designated VGAM HOST TARGET PROTEIN. VGAM host target protein is therefore outlined by a broken line.

It is appreciated that VGAM122 host target gene, herein designated VGAM HOST TARGET GENE, in fact represents a plurality of VGAM122 host target genes. The mRNA of each one of this plurality of VGAM122 host target genes comprises one or more host target binding sites, each having a nucleotide sequence which is at least partly complementary to VGAM122 RNA, herein designated VGAM RNA, and which when bound by VGAM122 RNA causes inhibition of translation of respective one or more VGAM122 host target proteins.

It is further appreciated by one skilled in the art that the mode of translational inhibition illustrated by FIG. 1 with specific reference to translational inhibition exerted by VGAM122 gene, herein designated VGAM GENE, on one or more VGAM122 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM122 is inhibition of expression of host target genes, as part of a novel viral mechanism of attacking a host. Accordingly, utilities of VGAM122 include diagnosis, prevention and treatment of viral infection by Shrimp White Spot Syndrome Virus (white spot bacilliform virus). Specific functions, and accordingly utilities, of VGAM122 correlate with, and may be deduced from, the identity of the host target genes which VGAM122 binds and inhibits, and the function of these host target genes, as elaborated hereinbelow.

Nucleotide sequences of the VGAM122 precursor RNA, herein designated VGAM PRECURSOR RNA, and of the 'diced' VGAM122 RNA, herein designated VGAM RNA, and a schematic representation of the secondary folding of VGAM122 folded precursor RNA, herein designated VGAM FOLDED PRECURSOR RNA, of VGAM122 are further described hereinbelow with reference to Table 1.

Nucleotide sequences of host target binding sites, such as BINDING SITE-I, BINDING SITE-II and BINDING SITE-III of FIG. 1, found on VGAM122 host target RNA, and schematic representation of the complementarity of each of these host target binding sites to VGAM122 RNA, herein designated VGAM RNA, are described hereinbelow with reference to Table 2.

As mentioned hereinabove with reference to FIG. 1, a function of VGAM122 gene, herein designated VGAM is inhibition of expression of VGAM122 target genes. It is appreciated that specific functions, and accordingly utilities, of VGAM122 correlate with, and may be deduced from, the identity of the target genes which VGAM122 binds and inhibits, and the function of these target genes, as elaborated hereinbelow.

CREBBP/EP300 Inhibitory Protein 1 (CRI1, Accession NM_014335) is a VGAM122 host target gene. CRI1 BINDING SITE is HOST TARGET binding site found in the 3' untranslated region of mRNA encoded by CRI1, corresponding to a HOST TARGET binding site such as BINDING SITE I, BINDING SITE II or BINDING SITE III. Table 2 illustrates the complementarity of the nucleotide sequences of CRI1 BINDING SITE, designated SEQ ID:15647, to the nucleotide sequence of VGAM122 RNA, herein designated VGAM RNA, also designated SEQ ID:2833.

A function of VGAM122 is therefore inhibition of CREBBP/EP300 Inhibitory Protein 1 (CRI1, Accession NM_014335), a gene which regulates cell cycle as well as tissue-specific transcription and differentiation. Accordingly, utilities of VGAM122 include diagnosis, prevention and treatment of diseases and clinical conditions associated with CRI1. The function of CRI1 has been established by previous studies. Miyake et al. (2000) and MacLellan et al. (2000) simultaneously reported isolating cDNAs encoding CRI1, which both groups designated EID1, using yeast 2-hybrid screens with various RB1 fragments as bait. Sequence analysis predicted that the 187-amino acid protein contains 2 acid patches and a C-terminal RB1-binding motif (LXCXE). Northern blot analysis detected ubiquitous expression of CRI1, with strongest expression in heart, skeletal muscle, and brain. Binding analysis showed that the acid patches and C terminus of CRI1 interacted with RB1 in transfected cells. Overexpression of CRI1 in a skeletal muscle cell line inhibited cell differentiation without reversing the expression of myogenic phenotype markers. Luciferase reporter analysis showed that CRI1 expression inhibits MYOD (OMIM Ref. No. 159970)-dependent transcription through multiple domains and its interaction with EP300 and CREBBP, but CRI1 expression does not affect cell cycle reentry. Miyake et al. (2000) determined that CRI1 interacts with MDM2 (OMIM Ref. No. 164785), leading to the ubiquitination and destruction of CRI1 and thereby coupling cell cycle exit to the execution of a differentiation program.

Full details of the abovementioned studies are described in the following publications, the disclosure of which are hereby incorporated by reference:

Miyake, S.; Sellers, W. R.; Safran, M.; Li, X.; Zhao, W.; Grossman, S. R.; Gan, J.; DeCaprio, J. A.; Adams, P. D.; Kaelin, W. G., JR.: Cells degrade a novel inhibitor of differentiation with E1A-like properties upon exiting the cell cycle. Molec. Cell. Biol. 20:8889-8902, 2000; and MacLellan, W. R.; Xiao, G.; Abdellatif, M.; Schneider, M. D.: A novel Rb- and p300-binding protein inhibits transactivation by MyoD. Molec. Cell. Biol. 20: 8903-8915, 2000.

Further studies establishing the function and utilities of CRI1 are found in John Hopkins OMIM database record ID 605894, and in sited publications numbered 4766-4768 listed in the bibliography section hereinbelow, which are also hereby incorporated by reference. TAP Binding Protein (tapasin) (TAPBP, Accession NM_003190) is another VGAM122 host target gene. TAPBP BINDING SITE is HOST TARGET binding site found in the 3' untranslated region of mRNA encoded by TAPBP, corresponding to a HOST TARGET binding site such as BINDING SITE I, BINDING SITE II or BINDING SITE III. Table 2 illustrates the complementarity of the nucleotide sequences of TAPBP BINDING SITE, designated SEQ ID:9182, to the nucleotide sequence of VGAM122 RNA, herein designated VGAM RNA, also designated SEQ ID:2833.

Another function of VGAM122 is therefore inhibition of TAP Binding Protein (tapasin) (TAPBP, Accession NM_003190), a gene which is involved in MHC class I-restricted antigen processing. Accordingly, utilities of VGAM122 include diagnosis, prevention and treatment of diseases and clinical conditions associated with TAPBP. The function of TAPBP has been established by previous studies. Newly assembled major histocompatibility complex (MHC) class I molecules (see OMIM Ref. No. 142800), together with the endoplasmic reticulum (ER) chaperone calreticulin (OMIM Ref. No. 109091), interact with the transporter associated with antigen processing (TAP1; 170260) through a molecule called tapasin (Sadasivan et al., 1996). By molecular cloning of tapasin, Ortmann et al. (1997) found it to be a type I transmembrane glycoprotein encoded by an MHC-linked gene. The mature protein has 428 amino acids with a single N-linked glycosylation site at position 233. It is a member of the immunoglobulin superfamily with a probable cytoplasmic ER retention signal. Up to 4 MHC class I/tapasin complexes were found to bind to each TAP molecule in Daudi and L001 cells. Expression of tapasin in a negative mutant human cell line restored class I/TAP association and normal class I cell surface expression. Tapasin expression also corrected the defective recognition of virus-infected cells of the same line by class I-restricted cytotoxic T cells, thus establishing a critical functional role for tapasin in MHC class I-restricted antigen processing. Herberg et al. (1998) identified an EST encoding the mouse tapasin homolog. Mayer and Klein (2001) proposed that tapasin is in reality an MHC class I molecule with a different function from that currently executed by conventional class I molecules. They based this proposal on the amino acid sequence similarity between tapasin and conventional class I molecules, on similarity of predicted tertiary structure and domain organization of the molecules, on similarity of exon/intron organization of the encoding genes, and on the mapping of the class IA and tapasin genes into the same chromosomal region in all jawed vertebrates that had been tested to that time (Michalova et al., 2000).

Full details of the abovementioned studies are described in the following publications, the disclosure of which are hereby incorporated by reference:

Mayer, W. E.; Klein, J.: Is tapasin a modified Mhc class I molecule? Immunogenetics 53:719-723, 2001; and Ortmann, B.; Copeman, J.; Lehner, P. J.; Sadasivan, B.; Herberg, J. A.; Grandea, A. G.; Riddell, S. R.; Tampe, R.; Spies, T.; Trowsdale, J.; Cresswell, P.: A critical role for tapasin.

Further studies establishing the function and utilities of TAPBP are found in John Hopkins OMIM database record ID 601962, and in sited publications numbered 5822-5828 listed in the bibliography section hereinbelow, which are also hereby incorporated by reference. X-ray Repair Complementing Defective Repair In Chinese Hamster Cells 5 (double-strand-break rejoining; Ku autoantigen, 80 kDa) (XRCC5, Accession NM_021141) is another VGAM122 host target gene. XRCC5 BINDING SITE is HOST TARGET binding site found in the 3' untranslated region of mRNA encoded by XRCC5, corresponding to a HOST TARGET binding site such as BINDING SITE I, BINDING SITE II or BINDING SITE III. Table 2 illustrates the complementarity of the nucleotide sequences of XRCC5 BINDING SITE, designated SEQ ID:22114, to the nucleotide sequence of VGAM122 RNA, herein designated VGAM RNA, also designated SEQ ID:2833.

Another function of VGAM122 is therefore inhibition of X-ray Repair Complementing Defective Repair In Chinese Hamster Cells 5 (double-strand-break rejoining; Ku autoantigen, 80 kDa) (XRCC5, Accession NM_021141), a gene which is one subunit of the Ku protein complex, which binds to DNA ends and regulates DNA-dependent protein kinase. Accordingly, utilities of VGAM122 include diagnosis, prevention and treatment of diseases and clinical conditions associated with XRCC5. The function of XRCC5 has been established by previous studies. The human XRCC5 DNA repair gene complements the radiosensitive mutant xrs-6, derived from Chinese hamster ovary cells which are defective in DNA double-strand break repair and in ability to undergo V(D)J recombination. The XRCC5 gene encodes the 80-kD subunit of the Ku autoantigen, a heterodimer which contributes to genomic integrity through its ability to bind DNA double-strand breaks and facilitate repair by the nonhomologous end-joining pathway. Tuteja et al. (1994) purified from HeLa cells an enzyme they called DNA helicase II, an ATP-dependent DNA unwinding enzyme. They showed that it is a heterodimer of 72 and 87 kD polypeptides. Sequencing showed that it is identical to the Ku autoantigen. The exclusively nuclear location of this particular DNA helicase II/Ku antigen, its highly specific affinity for double-stranded DNA, its abundance, and its exclusive DNA-duplex unwinding activity pointed to additional roles for this molecule in DNA metabolism. Animal model experiments lend further support to the function of XRCC5. Difilippantonio et al. (2000) demonstrated that mouse cells deficient for Ku80 display a marked increase in chromosomal aberrations, including breakage, translocations, and aneuploidy. Despite the observed chromosome instabilities, Ku80 -/- mice have only a slightly earlier onset of cancer. Loss of p53 (OMIM Ref. No. 191170) synergizes with Ku80 to promote tumorigenesis such that all Ku80 -/-/p53 -/- mice succumb to disseminated pro-B-cell lymphoma before 3 months of age. Tumors result from a specific set of chromosomal translocations and gene amplifications involving IgH and c-Myc, reminiscent of Burkitt lymphoma (OMIM Ref. No. 113970). Difilippantonio et al. (2000) concluded that Ku80 is a caretaker gene that maintains the integrity of the genome by a mechanism involving suppression of chromosomal rearrangements.

It is appreciated that the abovementioned animal model for XRCC5 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Difilippantonio, M. J.; Zhu, J.; Chen, H. T.; Meffre, E.; Nussenzweig, M. C.; Max, E. E.; Ried, T.; Nussenzweig, A.: DNA repair protein Ku80 suppresses chromosomal aberrations and malignant transformation. Nature 404:510-514, 2000; and Tuteja, N.; Tuteja, R.; Ochem, A.; Taneja, P.; Huang, N. W.; Simoncsits, A.; Susic, S.; Rahman, K.; Marusic, L.; Chen, J.;

Zhang, J.; Wang, S.; Pongor, S.; Falaschi, A. : Human DNA heli.

Further studies establishing the function and utilities of XRCC5 are found in John Hopkins OMIM database record ID 194364, and in sited publications numbered 6048, 6051, 6054-6056, 183 and 6057-1840 listed in the bibliography section hereinbelow, which are also hereby incorporated by reference. HDAC9-PENDING (Accession NM_014707) is another VGAM122 host target gene. HDAC9-PENDING BINDING SITE is HOST TARGET binding site found in the 3' untranslated region of mRNA encoded by HDAC9-PENDING, corresponding to a HOST TARGET binding site such as BINDING SITE I, BINDING SITE II or BINDING SITE III. Table 2 illustrates the complementarity of the nucleotide sequences of HDAC9-PENDING BINDING SITE, designated SEQ ID:16250, to the nucleotide sequence of VGAM122 RNA, herein designated VGAM RNA, also designated SEQ ID:2833.

Another function of VGAM122 is therefore inhibition of HDAC9-PENDING (Accession NM_014707). Accordingly, utilities of VGAM122 include diagnosis, prevention and treatment of diseases and clinical conditions associated with HDAC9-PENDING. KIAA0121 (Accession XM_052386) is another VGAM122 host target gene. KIAA0121 BINDING SITE is HOST TARGET binding site found in the 3' untranslated region of mRNA encoded by KIAA0121, corresponding to a HOST TARGET binding site such as BINDING SITE I, BINDING SITE II or BINDING SITE III. Table 2 illustrates the complementarity of the nucleotide sequences of KIAA0121 BINDING SITE, designated SEQ ID:35967, to the nucleotide sequence of VGAM122 RNA, herein designated VGAM RNA, also designated SEQ ID:2833.

Another function of VGAM122 is therefore inhibition of KIAA0121 (Accession XM_052386). Accordingly, utilities of VGAM122 include diagnosis, prevention and treatment of diseases and clinical conditions associated with KIAA0121. KIAA0620 (Accession XM_030707) is another VGAM122 host target gene. KIAA0620 BINDING SITE is HOST TARGET binding site found in the 3' untranslated region of mRNA encoded by KIAA0620, corresponding to a HOST TARGET binding site such as BINDING SITE I, BINDING SITE II or BINDING SITE III. Table 2 illustrates the complementarity of the nucleotide sequences of KIAA0620 BINDING SITE, designated SEQ ID:31123, to the nucleotide sequence of VGAM122 RNA, herein designated VGAM RNA, also designated SEQ ID:2833.

Another function of VGAM122 is therefore inhibition of KIAA0620 (Accession XM_030707). Accordingly, utilities of VGAM122 include diagnosis, prevention and treatment of diseases and clinical conditions associated with KIAA0620. KIAA1550 (Accession XM_039393) is another VGAM122 host target gene. KIAA1550 BINDING SITE is HOST TARGET binding site found in the 3' untranslated region of mRNA encoded by KIAA1550, corresponding to a HOST TARGET binding site such as BINDING SITE I, BINDING SITE II or BINDING SITE III. Table 2 illustrates the complementarity of the nucleotide sequences of KIAA1550 BINDING SITE, designated SEQ ID:33073, to the nucleotide sequence of VGAM122 RNA, herein designated VGAM RNA, also designated SEQ ID:2833.

Another function of VGAM122 is therefore inhibition of KIAA1550 (Accession XM_039393). Accordingly, utilities of VGAM122 include diagnosis, prevention and treatment of diseases and clinical conditions associated with KIAA1550. PRO0461 (Accession NM_031268) is another VGAM122 host target gene. PRO0461 BINDING SITE is HOST TARGET binding site found in the 5' untranslated region of mRNA encoded by PRO0461, corresponding to a HOST TARGET binding site such as BINDING SITE I, BINDING SITE II or BINDING SITE III. Table 2 illustrates the complementarity of the nucleotide sequences of PRO0461 BINDING SITE, designated SEQ ID:25285, to the nucleotide sequence of VGAM122 RNA, herein designated VGAM RNA, also designated SEQ ID:2833.

Another function of VGAM122 is therefore inhibition of PRO0461 (Accession NM_031268). Accordingly, utilities of VGAM122 include diagnosis, prevention and treatment of diseases and clinical conditions associated with PRO0461. LOC118738 (Accession XM_061125) is another VGAM122 host target gene. LOC118738 BINDING SITE is HOST TARGET binding site found in the 3' untranslated region of mRNA encoded by LOC118738, corresponding to a HOST TARGET binding site such as BINDING SITE I, BINDING SITE II or BINDING SITE III. Table 2 illustrates the complementarity of the nucleotide sequences of LOC118738 BINDING SITE, designated SEQ ID:37193, to the nucleotide sequence of VGAM122 RNA, herein designated VGAM RNA, also designated SEQ ID:2833.

Another function of VGAM122 is therefore inhibition of LOC118738 (Accession XM_061125). Accordingly, utilities of VGAM122 include diagnosis, prevention and treatment of diseases and clinical conditions associated with LOC118738. LOC203536 (Accession XM_114716) is another VGAM122 host target gene. LOC203536 BINDING SITE is HOST TARGET binding site found in the 3' untranslated region of mRNA encoded by LOC203536, corresponding to a HOST TARGET binding site such as BINDING SITE I, BINDING SITE II or BINDING SITE III. Table 2 illustrates the complementarity of the nucleotide sequences of LOC203536 BINDING SITE, designated SEQ ID:43055, to the nucleotide sequence of VGAM122 RNA, herein designated VGAM RNA, also designated SEQ ID:2833.

Another function of VGAM122 is therefore inhibition of LOC203536 (Accession XM_114716). Accordingly, utilities of VGAM122 include diagnosis, prevention and treatment of diseases and clinical conditions associated with LOC203536. FIG. 1 further provides a conceptual description of a novel bioinformatically detected viral gene of the present invention, referred to here as Viral Genomic Address Messenger 123 (VGAM123) viral gene, which modulates expression of respective host target genes thereof, the function and utility of which host target genes is known in the art.

VGAM123 is a novel bioinformatically detected regulatory, non protein coding, viral micro RNA (miRNA) gene. The method by which VGAM123 was detected is described hereinabove with reference to FIGS. 1-8.

VGAM123 gene, herein designated VGAM GENE, is a viral gene contained in the genome of Shrimp White Spot Syndrome Virus (white spot baciliform virus). VGAM123 host target gene, herein designated VGAM HOST TARGET GENE, is a human gene contained in the human genome.

VGAM123 gene encodes a VGAM123 precursor RNA, herein designated VGAM PRECURSOR RNA. Similar to other miRNA genes, and unlike most ordinary genes, VGAM123 precursor RNA does not encode a protein. A nucleotide sequence identical or highly similar to the nucleotide sequence of VGAM123 precursor RNA is designated SEQ ID:109, and is provided hereinbelow with reference to the sequence listing part. Nucleotide sequence SEQ ID:109 is located at position 246206 relative to the genome of Shrimp White Spot Syndrome Virus (white spot baciliform virus).

VGAM123 precursor RNA folds onto itself, forming VGAM123 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM123 folded precursor RNA into VGAM123 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM123 RNA is designated SEQ ID:2834, and is provided hereinbelow with reference to the sequence listing part.

VGAM123 host target gene, herein designated VGAM HOST TARGET GENE, encodes a corresponding messenger RNA, VGAM123 host target RNA, herein designated VGAM HOST TARGET RNA. VGAM123 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM123 RNA, herein designated VGAM RNA, binds complementarily to one or more host target binding sites located in untranslated regions of VGAM123 host target RNA, herein designated VGAM HOST TARGET RNA. This complementary binding is due to the fact that the nucleotide sequence of VGAM123 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM123 RNA, herein designated VGAM RNA, may have a different number of host target binding sites in untranslated regions of a VGAM123 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM123 RNA, herein designated VGAM RNA, to host target binding sites on VGAM123 host target RNA, herein designated VGAM HOST TARGET RNA, such as BINDING SITE I, BINDING SITE II and BINDING SITE III, inhibits translation of VGAM123 host target RNA into VGAM123 host target protein, herein designated VGAM HOST TARGET PROTEIN. VGAM host target protein is therefore outlined by a broken line.

It is appreciated that VGAM123 host target gene, herein designated VGAM HOST TARGET GENE, in fact represents a plurality of VGAM123 host target genes. The mRNA of each one of this plurality of VGAM123 host target genes comprises one or more host target binding sites, each having a nucleotide sequence which is at least partly complementary to VGAM123 RNA, herein designated VGAM RNA, and which when bound by VGAM123 RNA causes inhibition of translation of respective one or more VGAM123 host target proteins.

It is further appreciated by one skilled in the art that the mode of translational inhibition illustrated by FIG. 1 with specific reference to translational inhibition exerted by VGAM123 gene, herein designated VGAM GENE, on one or more VGAM123 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM123 is inhibition of expression of host target genes, as part of a novel viral mechanism of attacking a host. Accordingly, utilities of VGAM123 include diagnosis, prevention and treatment of viral infection by Shrimp White Spot Syndrome Virus (white spot bacilliform virus). Specific functions, and accordingly utilities, of VGAM123 correlate with, and may be deduced from, the identity of the host target genes which VGAM123 binds and inhibits, and the function of these host target genes, as elaborated hereinbelow.

Nucleotide sequences of the VGAM123 precursor RNA, herein designated VGAM PRECURSOR RNA, and of the 'diced' VGAM123 RNA, herein designated VGAM RNA, and a schematic representation of the secondary folding of VGAM123 folded precursor RNA, herein designated VGAM FOLDED PRECURSOR RNA, of VGAM123 are further described hereinbelow with reference to Table 1.

Nucleotide sequences of host target binding sites, such as BINDING SITE-I, BINDING SITE-II and BINDING SITE-III of FIG. 1, found on VGAM123 host target RNA, and schematic representation of the complementarity of each of these host target binding sites to VGAM123 RNA, herein designated VGAM RNA, are described hereinbelow with reference to Table 2.

As mentioned hereinabove with reference to FIG. 1, a function of VGAM123 gene, herein designated VGAM is inhibition of expression of VGAM123 target genes. It is appreciated that specific functions, and accordingly utilities, of VGAM123 correlate with, and may be deduced from, the identity of the target genes which VGAM123 binds and inhibits, and the function of these target genes, as elaborated hereinbelow.

Nuclear Factor of Activated T-cells, Cytoplasmic, Calcineurin-dependent 1 (NFATC1, Accession NM_006162) is a VGAM123 host target gene. NFATC1 BINDING SITE is HOST TARGET binding site found in the 3' untranslated region of mRNA encoded by NFATC1, corresponding to a HOST TARGET binding site such as BINDING SITE I, BINDING SITE II or BINDING SITE III. Table 2 illustrates the complementarity of the nucleotide sequences of NFATC1 BINDING SITE, designated SEQ ID:12813, to the nucleotide sequence of VGAM123 RNA, herein designated VGAM RNA, also designated SEQ ID:2834.

A function of VGAM123 is therefore inhibition of Nuclear Factor of Activated T-cells, Cytoplasmic, Calcineurin-dependent 1 (NFATC1, Accession NM_006162), a gene which regulates he activation, proliferation, differentiation and programmed death of ymphoid and nonlymphoid cells. Accordingly, utilities of VGAM123 include diagnosis, prevention and treatment of diseases and clinical conditions associated with NFATC1. The function of NFATC1 has been established by previous studies. Jauliac et al. (2002) found that both NFATC1 and NFAT5 (OMIM Ref. No. 604708) were expressed in invasive human ductal breast carcinomas. Using cell lines derived from breast and colon carcinomas, they found that these NFATs promoted carcinoma invasion and that their activity correlated with expression of alpha-6 (OMIM Ref. No. 147556)/beta-4 (OMIM Ref. No. 147557) integrin. Animal model experiments lend further support to the function of NFATC1. Whereas Nfatc1-deficient mice have impaired proliferative and Th2-like responses, Nfatc2-deficient mice have modestly enhanced responses with Th2-like characteristics. By fetal liver chimerization in Rag2 (OMIM Ref. No. 179616)-deficient hosts, Peng et al. (2001) generated mice whose lymphocytes were deficient in both transcription factors. Functional analysis showed that the double knockout (DKO) mice had reasonable proliferative responses and expression of activation markers but were incapable of producing a wide range of cytokines, with the exception of weak production of IL5 (OMIM Ref. No. 147850), and of expressing CD40 ligand (CD40LG; 300386) and CD95 ligand (CD95L; 134638) or allogeneic cytotoxicity. Analysis of serum immunoglobulins revealed significantly elevated amounts of IgG1 and IgE, isotypes typically associated with Th2-like immune responses, in DKO mice. The results suggested that NFATC1 and NFATC2 are essential for the maintenance of B-cell homeostasis and differentiation, but are dispensable for T-cell inflammatory activity, as measured by lymphoproliferation and activation marker expression It is appreciated that the abovementioned animal model for NFATC1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Peng, S. L.; Gerth, A. J.; Ranger, A. M.; Glimcher, L. H.: NFATc1 and NFATc2 together control both T and B cell activation and differentiation. Immunity 14:13-20, 2001; and Jauliac, S.; Lopez-Rodriguez, C.; Shaw, L. M.; Brown, L. F.; Rao, A.; Toker, A.: The role of NFAT transcription factors in integrin-mediated carcinoma invasion. Nature Cell Biol. 4:540-5.

Further studies establishing the function and utilities of NFATC1 are found in John Hopkins OMIM database record ID 600489, and in sited publications numbered 9903-9908, 11673-991 and 11674 listed in the bibliography section hereinbelow, which are also hereby incorporated by reference. Nidogen (enactin) (NID, Accession NM_002508) is another VGAM123 host target gene. NID BINDING SITE is HOST TARGET binding site found in the 3' untranslated region of mRNA encoded by NID, corresponding to a HOST TARGET binding site such as BINDING SITE I, BINDING SITE II or BINDING SITE III. Table 2 illustrates the complementarity of the nucleotide sequences of NID BINDING SITE, designated SEQ ID:8338, to the nucleotide sequence of VGAM123 RNA, herein designated VGAM RNA, also designated SEQ ID:2834.

Another function of VGAM123 is therefore inhibition of Nidogen (enactin) (NID, Accession NM_002508). Accordingly, utilities of VGAM123 include diagnosis, prevention and treatment of diseases and clinical conditions associated with NID. Solute Carrier Family 19, Member 3 (SLC19A3, Accession NM_025243) is another VGAM123 host target gene. SLC19A3 BINDING SITE is HOST TARGET binding site found in the 3" untranslated region of mRNA encoded by SLC19A3, corresponding to a HOST TARGET binding site such as BINDING SITE I, BINDING SITE II or BINDING SITE III. Table 2 illustrates the complementarity of the nucleotide sequences of SLC19A3 BINDING SITE, designated SEQ ID:24924, to the nucleotide sequence of VGAM123 RNA, herein designated VGAM RNA, also designated SEQ ID:2834.

Another function of VGAM123 is therefore inhibition of Solute Carrier Family 19, Member 3 (SLC19A3, Accession NM_025243). Accordingly, utilities of VGAM123 include diagnosis, prevention and treatment of diseases and clinical conditions associated with SLC19A3. FIG. 1 further provides a conceptual description of a novel bioinformatically detected viral gene of the present invention, referred to here as Viral Genomic Address Messenger 124 (VGAM124) viral gene, which modulates expression of respective host target genes thereof, the function and utility of which host target genes is known in the art.

VGAM124 is a novel bioinformatically detected regulatory, non protein coding, viral micro RNA (miRNA) gene. The method by which VGAM124 was detected is described hereinabove with reference to FIGS. 1-8.

VGAM124 gene, herein designated VGAM GENE, is a viral gene contained in the genome of Shrimp White Spot Syndrome Virus (white spot bacilliform virus). VGAM124 host target gene, herein designated VGAM HOST TARGET GENE, is a human gene contained in the human genome.

VGAM124 gene encodes a VGAM124 precursor RNA, herein designated VGAM PRECURSOR RNA. Similar to other miRNA genes, and unlike most ordinary genes, VGAM124 precursor RNA does not encode a protein. A nucleotide sequence identical or highly similar to the nucleotide sequence of VGAM124 precursor RNA is designated SEQ ID:110, and is provided hereinbelow with reference to the sequence listing part. Nucleotide sequence SEQ ID:110 is located at position 232082 relative to the genome of Shrimp White Spot Syndrome Virus (white spot bacilliform virus).

VGAM124 precursor RNA folds onto itself, forming VGAM124 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM124 folded precursor RNA into VGAM124 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM124 RNA is designated SEQ ID:2835, and is provided hereinbelow with reference to the sequence listing part.

VGAM124 host target gene, herein designated VGAM HOST TARGET GENE, encodes a corresponding messenger RNA, VGAM124 host target RNA, herein designated VGAM HOST TARGET RNA. VGAM124 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM124 RNA, herein designated VGAM RNA, binds complementarily to one or more host target binding sites located in untranslated regions of VGAM124 host target RNA, herein designated VGAM HOST TARGET RNA. This complementary binding is due to the fact that the nucleotide sequence of VGAM124 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM124 RNA, herein designated VGAM RNA, may have a different number of host target binding sites in untranslated regions of a VGAM124 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM124 RNA, herein designated VGAM RNA, to host target binding sites on VGAM124 host target RNA, herein designated VGAM HOST TARGET RNA, such as BINDING SITE I, BINDING SITE II and BINDING SITE III, inhibits translation of VGAM124 host target RNA into VGAM124 host target protein, herein designated VGAM HOST TARGET PROTEIN. VGAM host target protein is therefore outlined by a broken line.

It is appreciated that VGAM124 host target gene, herein designated VGAM HOST TARGET GENE, in fact represents a plurality of VGAM124 host target genes. The mRNA of each one of this plurality of VGAM124 host target genes comprises one or more host target binding sites, each having a nucleotide sequence which is at least partly complementary to VGAM124 RNA, herein designated VGAM RNA, and which when bound by VGAM124 RNA causes inhibition of translation of respective one or more VGAM124 host target proteins.

It is further appreciated by one skilled in the art that the mode of translational inhibition illustrated by FIG. 1 with specific reference to translational inhibition exerted by VGAM124 gene, herein designated VGAM GENE, on one or more VGAM124 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM124 is inhibition of expression of host target genes, as part of a novel viral mechanism of attacking a host. Accordingly, utilities of VGAM124 include diagnosis, prevention and treatment of viral infection by Shrimp White Spot Syndrome Virus (white spot bacilliform virus). Specific functions, and accordingly utilities, of VGAM124 correlate with, and may be deduced from, the identity of the host target genes which VGAM124 binds and inhibits, and the function of these host target genes, as elaborated hereinbelow.

Nucleotide sequences of the VGAM124 precursor RNA, herein designated VGAM PRECURSOR RNA, and of the 'diced' VGAM124 RNA, herein designated VGAM RNA, and a schematic representation of the secondary folding of VGAM124 folded precursor RNA, herein designated VGAM FOLDED PRECURSOR RNA, of VGAM124 are further described hereinbelow with reference to Table 1.

Nucleotide sequences of host target binding sites, such as BINDING SITE-I, BINDING SITE-II and BINDING SITE-III of FIG. 1, found on VGAM124 host target RNA, and schematic representation of the complementarity of each of these host target binding sites to VGAM124 RNA, herein designated VGAM RNA, are described hereinbelow with reference to Table 2.

As mentioned hereinabove with reference to FIG. 1, a function of VGAM124 gene, herein designated VGAM is inhibition of expression of VGAM124 target genes. It is appreciated that specific functions, and accordingly utilities, of VGAM124 correlate with, and may be deduced from, the identity of the target genes which VGAM124 binds and inhibits, and the function of these target genes, as elaborated hereinbelow.

Glucosamine-6-phosphate Isomerase (GNPI, Accession NM_005471) is a VGAM124 host target gene. GNPI BINDING SITE is HOST TARGET binding site found in the 3' untranslated region of mRNA encoded by GNPI, corresponding to a HOST TARGET binding site such as BINDING SITE I, BINDING SITE II or BINDING SITE III. Table 2 illustrates the complementarity of the nucleotide sequences of GNPI BINDING SITE, designated SEQ ID:11965, to the nucleotide sequence of VGAM124 RNA, herein designated VGAM RNA, also designated SEQ ID:2835.

A function of VGAM124 is therefore inhibition of Glucosamine-6-phosphate Isomerase (GNPI, Accession NM_005471), a gene which converts glucosamine-6-phosphate to fructose-6-phosphate. Accordingly, utilities of VGAM124 include diagnosis, prevention and treatment of diseases and clinical conditions associated with GNPI. The function of GNPI has been established by previous studies. In the course of investigating hexosamine catabolism in the human malaria parasite, Plasmodium falciparum, Weidanz et al. (1995) became aware of deficiencies in understanding the relevant enzymatic reactions in the host erythrocyte. For that reason, they undertook studies of human glucosamine 6-phosphate deaminase using a newly developed sensitive radiometric assay. They characterized biochemically the erythrocyte enzyme and reported data on its kinetics, temperature stability, and chromatographic purification. Weidanz et al. (1995) noted that the nucleotide sequence of the nagB gene, encoding the deaminase in E. coli K12, has been determined (Rogers et al. (1988)) but information about the primary structure of the mammalian enzyme was not available. The hamster sperm oscillin protein is responsible for oocyte calcium oscillations. By screening a testis cDNA library for a homolog of hamster oscillin, Shevchenko et al. (1998) obtained a cDNA encoding GNPI. The deduced 289-amino acid protein is 96% identical to the hamster sequence. SDS-PAGE and Western blot analysis indicated that GNPI is expressed as a 33-kD cytosolic protein in various cell lines. Functional analysis showed that GNPI has glucosamine 6-phosphate deaminase activity but does not induce calcium oscillations in mammalian eggs. Genomic sequence analysis determined that the single-copy GNPI gene contains 8 exons.

Full details of the abovementioned studies are described in the following publications, the disclosure of which are hereby incorporated by reference:

Shevchenko, V.; Hogben, M.; Ekong, R.; Parrington, J.; Lai, F. A.: The human glucosamine-6-phosphate deaminase gene: cDNA cloning and expression, genomic organization and chromosomal localization. Gene 216:31-38, 1998; and Weidanz, J. A.; Campbell, P.; DeLucas, L. J.; Jin, J.; Moore, D.; Roden, L.; Yu, H.; Heilmann, E.; Vezza, A. C.: Glucosamine 6-phosphate deaminase in normal human erythrocytes. Brit. J.

Further studies establishing the function and utilities of GNPI are found in John Hopkins OMIM database record ID 601798, and in sited publications numbered 6244-6247 listed in the bibliography section hereinbelow, which are also hereby incorporated by reference. G Protein-coupled Receptor 65 (GPR65, Accession XM_007392) is another VGAM124 host target gene. GPR65 BINDING SITE is HOST TARGET binding site found in the 5' untranslated region of mRNA encoded by GPR65, corresponding to a HOST TARGET binding site such as BINDING SITE I, BINDING SITE II or BINDING SITE III. Table 2 illustrates the complementarity of the nucleotide sequences of GPR65 BINDING SITE, designated SEQ ID:30050, to the nucleotide sequence of VGAM124 RNA, herein designated VGAM RNA, also designated SEQ ID:2835.

Another function of VGAM124 is therefore inhibition of G Protein-coupled Receptor 65 (GPR65, Accession XM_007392). Accordingly, utilities of VGAM124 include diagnosis, prevention and treatment of diseases and clinical conditions associated with GPR65. Mannose-binding Lectin (protein C) 2, Soluble (opsonic defect) (MBL2, Accession NM_000242) is another VGAM124 host target gene. MBL2 BINDING SITE is HOST TARGET binding site found in the 3' untranslated region of mRNA encoded by MBL2, corresponding to a HOST TARGET binding site such as BINDING SITE I, BINDING SITE II or BINDING SITE III. Table 2 illustrates the complementarity of the nucleotide sequences of MBL2 BINDING SITE, designated SEQ ID:5761, to the nucleotide sequence of VGAM124 RNA, herein designated VGAM RNA, also designated SEQ ID:2835.

Another function of VGAM124 is therefore inhibition of Mannose-binding Lectin (protein C) 2, Soluble (opsonic defect) (MBL2, Accession NM_000242). Accordingly, utilities of VGAM124 include diagnosis, prevention and treatment of diseases and clinical conditions associated with MBL2. Pleiomorphic Adenoma Gene 1 (PLAG1, Accession NM_002655) is another VGAM124 host target gene. PLAG1 BINDING SITE is HOST TARGET binding site found in the 3' untranslated region of mRNA encoded by PLAG1, corresponding to a HOST TARGET binding site such as BINDING SITE I, BINDING SITE II or BINDING SITE III. Table 2 illustrates the complementarity of the nucleotide sequences of PLAG1 BINDING SITE, designated SEQ ID:8521, to the nucleotide sequence of VGAM124 RNA, herein designated VGAM RNA, also designated SEQ ID:2835.

Another function of VGAM124 is therefore inhibition of Pleiomorphic Adenoma Gene 1 (PLAG1, Accession NM_002655), a gene which contains a zinc finger domain. Accordingly, utilities of VGAM124 include diagnosis, prevention and treatment of diseases and clinical conditions associated with PLAG1. The function of PLAG1 and its association with various diseases and clinical conditions, has been established by previous studies, as described hereinabove with reference to VGAM29. Sodium Channel, Voltage-gated, Type III, Alpha Polypeptide (SCN3A, Accession NM_006922) is another VGAM124 host target gene. SCN3A BINDING SITE is HOST TARGET binding site found in the 3" untranslated region of mRNA encoded by SCN3A, corresponding to a HOST TARGET binding site such as BINDING SITE I, BINDING SITE II or BINDING SITE III. Table 2 illustrates the complementarity of the nucleotide sequences of SCN3A BINDING SITE, designated SEQ ID:13796, to the nucleotide sequence of VGAM124 RNA, herein designated VGAM RNA, also designated SEQ ID:2835.

Another function of VGAM124 is therefore inhibition of Sodium Channel, Voltage-gated, Type III, Alpha Polypeptide (SCN3A, Accession NM_006922), a gene which may be important for maintaining neural membrane excitability. Accordingly, utilities of VGAM124 include diagnosis, prevention and treatment of diseases and clinical conditions associated with SCN3A. The function of SCN3A has been established by previous studies. On physical mapping by pulsed field gel electrophoresis in the mouse, Malo et al. (1991) demonstrated that the Scn2a (OMIM Ref. No. 182390) and Scn3a genes encoding type II and type III sodium channel alpha-subunit isoforms, respectively, are physically linked and are separated by a maximum distance of 600 kb. The gene for type II maps to chromosome 2 in both mouse and man; hence, SCN3A in the human must be located on chromosome 2. Ahmed et al. (1992) isolated 2 cDNAs from a human cerebral cortex library by screening for the presence of sodium channel alpha-subunit-specific clones. One of the clones showed greatest homology to rat brain sodium channel II. The second clone encoded a different subtype sodium channel, probably a type III channel. Both of the genes were mapped to human chromosome 2 by study of human-hamster somatic cell hybrids; PCR with primers derived from the second cDNA was used for localizing the gene, which presumably was SCN3A. By in situ hybridization, both of the genes mapped to 2q23-q24.3. Malo et al. (1994) mapped the SCN3A gene to chromosome 2 with 100% concordance using PCR on human/rodent somatic cell hybrid panels. By fluorescence in situ hybridization, they mapped the gene to 2q24-q31.

Full details of the abovementioned studies are described in the following publications, the disclosure of which are hereby incorporated by reference:

Malo, D.; Schurr, E.; Dorfman, J.; Canfield, V.; Levenson, R.; Gros, P.: Three brain sodium channel alpha-subunit genes are clustered on the proximal segment of mouse chromosome 2. Genomics 10:666-672, 1991; and Malo, M. S.; Srivastava, K.; Andresen, J. M.; Chen, X.-N.; Korenberg, J. R.; Ingram, V. M.: Targeted gene walking by low stringency polymerase chain reaction: assignment of a putative.

Further studies establishing the function and utilities of SCN3A are found in John Hopkins OMIM database record ID 182391, and in sited publications numbered 75 and 885-886 listed in the bibliography section hereinbelow, which are also hereby incorporated by reference. TEM7 (Accession NM_020405) is another VGAM124 host target gene. TEM7 BINDING SITE is HOST TARGET binding site found in the 3' untranslated region of mRNA encoded by TEM7, corresponding to a HOST TARGET binding site such as BINDING SITE I, BINDING SITE II or BINDING SITE III. Table 2 illustrates the complementarity of the nucleotide sequences of TEM7 BINDING SITE, designated SEQ ID:21672, to the nucleotide sequence of VGAM124 RNA, herein designated VGAM RNA, also designated SEQ ID:2835.

Another function of VGAM124 is therefore inhibition of TEM7 (Accession NM_020405), a gene which involves in angiogenesis. Accordingly, utilities of VGAM124 include diagnosis, prevention and treatment of diseases and clinical conditions associated with TEM7. The function of TEM7 and its association with various diseases and clinical conditions, has been established by previous studies, as described hereinabove with reference to VGAM23. Tryptase, Alpha (TPS1, Accession XM_018104) is another VGAM124 host target gene. TPS1 BINDING SITE is HOST TARGET binding site found in the 3' untranslated region of mRNA encoded by TPS1, corresponding to a HOST TARGET binding site such as BINDING SITE I, BINDING SITE II or BINDING SITE III. Table 2 illustrates the complementarity of the nucleotide sequences of TPS1 BINDING SITE, designated SEQ ID:30336, to the nucleotide sequence of VGAM124 RNA, herein designated VGAM RNA, also designated SEQ ID:2835.

Another function of VGAM124 is therefore inhibition of Tryptase, Alpha (TPS1, Accession XM_018104), a gene which Alpha tryptase; mast cell-specific serine protease. Accordingly, utilities of VGAM124 include diagnosis, prevention and treatment of diseases and clinical conditions associated with TPS1. The function of TPS1 has been established by previous studies. Tryptase is a serine protease that is selectively concentrated in the secretory granules of mast cells and is secreted during the coupled activation-degranulation response of these cells. Its exclusive presence in mast cells permits its use as a specific clinical indicator of mast cell activation by measurement of its level in biologic fluids and as a selective marker of intact mast cells using immunohistochemical techniques with antitryptase antibodies. The enzyme is a tetramer with 4 subunits of 31,000-33,000 Da. Miller et al. (1989) cloned and sequenced human tryptase cDNA. Based on nucleic acid sequence, human tryptase consists of a 244-amino acid catalytic portion of 27,423 Da with 2 putative N-linked carbohydrate-binding sites and a 30-amino acid leader sequence of 3,048 Da. Vanderslice et al. (1990) demonstrated the existence of multiple tryptases. In this respect, mast cell tryptase is like other serine proteases such as glandular kallikrein (OMIM Ref. No. 147960) and trypsin (OMIM Ref. No. 276000), which are also members of multigene families. Miller et al. (1990) mapped both alpha-tryptase and beta-tryptase (OMIM Ref. No. 191081) to human chromosome 16 by PCR analysis of DNA from human/hamster somatic cell hybrids.

Full details of the abovementioned studies are described in the following publications, the disclosure of which are hereby incorporated by reference:

Miller, J. S.; Westin, E. H.; Schwartz, L. B.: Cloning and characterization of complementary DNA for human tryptase. J. Clin. Invest. 84:1188-1195, 1989; and Vanderslice, P.; Ballinger, S. M.; Tam, E. K.; Goldstein, S. M.; Craik, C. S.; Caughey, G. H.: Human mast cell tryptase: multiple cDNAs and genes reveal a multigene serine protease fami.

Further studies establishing the function and utilities of TPS1 are found in John Hopkins OMIM database record ID 191080, and in sited publications numbered 9772-9774 listed in the bibliography section hereinbelow, which are also hereby incorporated by reference. CSR1 (Accession NM_016240) is another VGAM124 host target gene. CSR1 BINDING SITE is HOST TARGET binding site found in the 3' untranslated region of mRNA encoded by CSR1, corresponding to a HOST TARGET binding site such as BINDING SITE I, BINDING SITE II or BINDING SITE III. Table 2 illustrates the complementarity of the nucleotide sequences of CSR1 BINDING SITE, designated SEQ ID:18355, to the nucleotide sequence of VGAM124 RNA, herein designated VGAM RNA, also designated SEQ ID:2835.

Another function of VGAM124 is therefore inhibition of CSR1 (Accession NM_016240). Accordingly, utilities of VGAM124 include diagnosis, prevention and treatment of diseases and clinical conditions associated with CSR1. DKFZP564F013 (Accession XM_168479) is another VGAM124 host target gene. DKFZP564F013 BINDING SITE is HOST TARGET binding site found in the 3' untranslated region of mRNA encoded by DKFZP564F013, corresponding to a HOST TARGET binding site such as BINDING SITE I, BINDING SITE II or BINDING SITE III. Table 2 illustrates the complementarity of the nucleotide sequences of DKFZP564F013 BINDING SITE, designated SEQ ID:45202, to the nucleotide sequence of VGAM124 RNA, herein designated VGAM RNA, also designated SEQ ID:2835.

Another function of VGAM124 is therefore inhibition of DKFZP564F013 (Accession XM_168479). Accordingly, utilities of VGAM124 include diagnosis, prevention and treatment of diseases and clinical conditions associated with DKFZP564F013. FLJ13072 (Accession XM_117117) is another VGAM124 host target gene. FLJ13072 BINDING SITE is HOST TARGET binding site found in the 5' untranslated region of mRNA encoded by FLJ13072, corresponding to a HOST TARGET binding site such as BINDING SITE I, BINDING SITE II or BINDING SITE III. Table 2 illustrates the complementarity of the nucleotide sequences of FLJ13072 BINDING SITE, designated SEQ ID:43235, to the nucleotide sequence of VGAM124 RNA, herein designated VGAM RNA, also designated SEQ ID:2835.

Another function of VGAM124 is therefore inhibition of FLJ13072 (Accession XM_117117). Accordingly, utilities of VGAM124 include diagnosis, prevention and treatment of diseases and clinical conditions associated with FLJ13072. KIAA1238 (Accession XM_048675) is another VGAM124 host target gene. KIAA1238 BINDING SITE is HOST TARGET binding site found in the 3' untranslated region of mRNA encoded by KIAA1238, corresponding to a HOST TARGET binding site such as BINDING SITE I, BINDING SITE II or BINDING SITE III. Table 2 illustrates the complementarity of the nucleotide sequences of KIAA1238 BINDING SITE, designated SEQ ID:35213, to the nucleotide sequence of VGAM124 RNA, herein designated VGAM RNA, also designated SEQ ID:2835.

Another function of VGAM124 is therefore inhibition of KIAA1238 (Accession XM_048675). Accordingly, utilities of VGAM124 include diagnosis, prevention and treatment of diseases and clinical conditions associated with KIAA1238. NYD-SP11 (Accession NM_031951) is another VGAM124 host target gene. NYD-SP11 BINDING SITE is HOST TARGET binding site found in the 5' untranslated region of mRNA encoded by NYD-SP11, corresponding to a HOST TARGET binding site such as BINDING SITE I, BINDING SITE II or BINDING SITE III. Table 2 illustrates the complementarity of the nucleotide sequences of NYD-SP11 BINDING SITE, designated SEQ ID:25690, to the nucleotide sequence of VGAM124 RNA, herein designated VGAM RNA, also designated SEQ ID:2835.

Another function of VGAM124 is therefore inhibition of NYD-SP11 (Accession NM_031951). Accordingly, utilities of VGAM124 include diagnosis, prevention and treatment of diseases and clinical conditions associated with NYD-SP11. RP4-622L5 (Accession NM_019118) is another VGAM124 host target gene. RP4-622L5 BINDING SITE is HOST TARGET binding site found in the 3' untranslated region of mRNA encoded by RP4-622L5, corresponding to a HOST TARGET binding site such as BINDING SITE I, BINDING SITE II or BINDING SITE III. Table 2 illustrates the complementarity of the nucleotide sequences of RP4-622L5 BINDING SITE, designated SEQ ID:21199, to the nucleotide sequence of VGAM124 RNA, herein designated VGAM RNA, also designated SEQ ID:2835.

Another function of VGAM124 is therefore inhibition of RP4-622L5 (Accession NM_019118). Accordingly, utilities of VGAM124 include diagnosis, prevention and treatment of diseases and clinical conditions associated with RP4-622L5. Solute Carrier Family 11 (proton-coupled divalent metal ion transporters), Member 2 (SLC11A2, Accession NM_000617) is another VGAM124 host target gene. SLC11A2 BINDING SITE is HOST TARGET binding site found in the 3" untranslated region of mRNA encoded by SLC11A2, corresponding to a HOST TARGET binding site such as BINDING SITE I, BINDING SITE II or BINDING SITE III. Table 2 illustrates the complementarity of the nucleotide sequences of SLC11A2 BINDING SITE, designated SEQ ID:6221, to the nucleotide sequence of VGAM124 RNA, herein designated VGAM RNA, also designated SEQ ID:2835.

Another function of VGAM124 is therefore inhibition of Solute Carrier Family 11 (proton-coupled divalent metal ion transporters), Member 2 (SLC11A2, Accession NM_000617). Accordingly, utilities of VGAM124 include diagnosis, prevention and treatment of diseases and clinical conditions associated with SLC11A2. UQCR (Accession NM_006830) is another VGAM124 host target gene. UQCR BINDING SITE is HOST TARGET binding site found in the 3' untranslated region of mRNA encoded by UQCR, corresponding to a HOST TARGET binding site such as BINDING SITE I, BINDING SITE II or BINDING SITE III. Table 2 illustrates the complementarity of the nucleotide sequences of UQCR BINDING SITE, designated SEQ ID:13709, to the nucleotide sequence of VGAM124 RNA, herein designated VGAM RNA, also designated SEQ ID:2835.

Another function of VGAM124 is therefore inhibition of UQCR (Accession NM_006830). Accordingly, utilities of VGAM124 include diagnosis, prevention and treatment of diseases and clinical conditions associated with UQCR. LOC146958 (Accession XM_097142) is another VGAM124 host target gene. LOC146958 BINDING SITE is HOST TARGET binding site found in the 5' untranslated region of mRNA encoded by LOC146958, corresponding to a HOST TARGET binding site such as BINDING SITE I, BINDING SITE II or BINDING SITE III. Table 2 illustrates the complementarity of the nucleotide sequences of LOC146958 BINDING SITE, designated SEQ ID:40772, to the nucleotide sequence of VGAM124 RNA, herein designated VGAM RNA, also designated SEQ ID:2835.

Another function of VGAM124 is therefore inhibition of LOC146958 (Accession XM_097142). Accordingly, utilities of VGAM124 include diagnosis, prevention and treatment of diseases and clinical conditions associated with LOC146958. LOC147004 (Accession XM_097155) is another VGAM124 host target gene. LOC147004 BINDING SITE is HOST TARGET binding site found in the 3' untranslated region of mRNA encoded by LOC147004, corresponding to a HOST TARGET binding site such as BINDING SITE I, BINDING SITE II or BINDING SITE III. Table 2 illustrates the complementarity of the nucleotide sequences of LOC147004 BINDING SITE, designated SEQ ID:40780, to the nucleotide sequence of VGAM124 RNA, herein designated VGAM RNA, also designated SEQ ID:2835.

Another function of VGAM124 is therefore inhibition of LOC147004 (Accession XM_097155). Accordingly, utilities of VGAM124 include diagnosis, prevention and treatment of diseases and clinical conditions associated with LOC147004. LOC153592 (Accession XM_098396) is another VGAM124 host target gene. LOC153592 BINDING SITE is HOST TARGET binding site found in the 3' untranslated region of mRNA encoded by LOC153592, corresponding to a HOST TARGET binding site such as BINDING SITE I, BINDING SITE II or BINDING SITE III. Table 2 illustrates the complementarity of the nucleotide sequences of LOC153592 BINDING SITE, designated SEQ ID:41648, to the nucleotide sequence of VGAM124 RNA, herein designated VGAM RNA, also designated SEQ ID:2835.

Another function of VGAM124 is therefore inhibition of LOC153592 (Accession XM_098396). Accordingly, utilities of VGAM124 include diagnosis, prevention and treatment of diseases and clinical conditions associated with LOC153592. LOC220776 (Accession XM_043388) is another VGAM124 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33929, to the nucleotide sequence of VGAM124 RNA, herein designated VGAM RNA, also designated SEQ ID:2835.

Another function of VGAM124 is therefore inhibition of LOC220776 (Accession XM_043388). Accordingly, utilities of VGAM124 include diagnosis, prevention and treatment of diseases and clinical conditions associated with LOC220776. LOC220827 (Accession XM_166052) is another VGAM124 host target gene. LOC220827 BINDING SITE is HOST TARGET binding site found in the 3' untranslated region of mRNA encoded by LOC220827, corresponding to a HOST TARGET binding site such as BINDING SITE I, BINDING SITE II or BINDING SITE III. Table 2 illustrates the complementarity of the nucleotide sequences of LOC220827 BINDING SITE, designated SEQ ID:43845, to the nucleotide sequence of VGAM124 RNA, herein designated VGAM RNA, also designated SEQ ID:2835.

Another function of VGAM124 is therefore inhibition of LOC220827 (Accession XM_166052). Accordingly, utilities of VGAM124 include diagnosis, prevention and treatment of diseases and clinical conditions associated with LOC220827. LOC221814 (Accession XM_168226) is another VGAM124 host target gene. LOC221814 BINDING SITE is HOST TARGET binding site found in the 5' untranslated region of mRNA encoded by LOC221814, corresponding to a HOST TARGET binding site such as BINDING SITE I, BINDING SITE II or BINDING SITE III. Table 2 illustrates the complementarity of the nucleotide sequences of LOC221814 BINDING SITE, designated SEQ ID:45096, to the nucleotide sequence of VGAM124 RNA, herein designated VGAM RNA, also designated SEQ ID:2835.

Another function of VGAM124 is therefore inhibition of LOC221814 (Accession XM_168226). Accordingly, utilities of VGAM124 include diagnosis, prevention and treatment of diseases and clinical conditions associated with LOC221814. FIG. 1 further provides a conceptual description of a novel bioinformatically detected viral gene of the present invention, referred to here as Viral Genomic Address Messenger 125 (VGAM125) viral gene, which modulates expression of respective host target genes thereof, the function and utility of which host target genes is known in the art.

VGAM125 is a novel bioinformatically detected regulatory, non protein coding, viral micro RNA (miRNA) gene. The method by which VGAM125 was detected is described hereinabove with reference to FIGS. 1-8.

VGAM125 gene, herein designated VGAM GENE, is a viral gene contained in the genome of Shrimp White Spot Syndrome Virus (white spot bacilliform virus). VGAM125 host target gene, herein designated VGAM HOST TARGET GENE, is a human gene contained in the human genome.

VGAM125 gene encodes a VGAM125 precursor RNA, herein designated VGAM PRECURSOR RNA. Similar to other miRNA genes, and unlike most ordinary genes, VGAM125 precursor RNA does not encode a protein. A nucleotide sequence identical or highly similar to the nucleotide sequence of VGAM125 precursor RNA is designated SEQ ID:111, and is provided hereinbelow with reference to the sequence listing part. Nucleotide sequence SEQ ID:111 is located at position 36670 relative to the genome of Shrimp White Spot Syndrome Virus (white spot bacilliform virus).

VGAM125 precursor RNA folds onto itself, forming VGAM125 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM125 folded precursor RNA into VGAM125 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM125 RNA is designated SEQ ID:2836, and is provided hereinbelow with reference to the sequence listing part.

VGAM125 host target gene, herein designated VGAM HOST TARGET GENE, encodes a corresponding messenger RNA, VGAM125 host target RNA, herein designated VGAM HOST TARGET RNA. VGAM125 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM125 RNA, herein designated VGAM RNA, binds complementarily to one or more host target binding sites located in untranslated regions of VGAM125 host target RNA, herein designated VGAM HOST TARGET RNA. This complementary binding is due to the fact that the nucleotide sequence of VGAM125 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM125 RNA, herein designated VGAM RNA, may have a different number of host target binding sites in untranslated regions of a VGAM125 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM125 RNA, herein designated VGAM RNA, to host target binding sites on VGAM125 host target RNA, herein designated VGAM HOST TARGET RNA, such as BINDING SITE I, BINDING SITE II and BINDING SITE III, inhibits translation of VGAM125 host target RNA into VGAM125 host target protein, herein designated VGAM HOST TARGET PROTEIN. VGAM host target protein is therefore outlined by a broken line.

It is appreciated that VGAM125 host target gene, herein designated VGAM HOST TARGET GENE, in fact represents a plurality of VGAM125 host target genes. The mRNA of each one of this plurality of VGAM125 host target genes comprises one or more host target binding sites, each having a nucleotide sequence which is at least partly complementary to VGAM125 RNA, herein designated VGAM RNA, and which when bound by VGAM125 RNA causes inhibition of translation of respective one or more VGAM125 host target proteins.

It is further appreciated by one skilled in the art that the mode of translational inhibition illustrated by FIG. 1 with specific reference to translational inhibition exerted by VGAM125 gene, herein designated VGAM GENE, on one or more VGAM125 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM125 is inhibition of expression of host target genes, as part of a novel viral mechanism of attacking a host. Accordingly, utilities of VGAM125 include diagnosis, prevention and treatment of viral infection by Shrimp White Spot Syndrome Virus (white spot bacilliform virus). Specific functions, and accordingly utilities, of VGAM125 correlate with, and may be deduced from, the identity of the host target genes which VGAM125 binds and inhibits, and the function of these host target genes, as elaborated hereinbelow.

Nucleotide sequences of the VGAM125 precursor RNA, herein designated VGAM PRECURSOR RNA, and of the 'diced' VGAM125 RNA, herein designated VGAM RNA, and a schematic representation of the secondary folding of VGAM125 folded precursor RNA, herein designated VGAM FOLDED PRECURSOR RNA, of VGAM125 are further described hereinbelow with reference to Table 1.

Nucleotide sequences of host target binding sites, such as BINDING SITE-I, BINDING SITE-II and BINDING SITE-III of FIG. 1, found on VGAM125 host target RNA, and schematic representation of the complementarity of each of these host target binding sites to VGAM125 RNA, herein designated VGAM RNA, are described hereinbelow with reference to Table 2.

As mentioned hereinabove with reference to FIG. 1, a function of VGAM125 gene, herein designated VGAM is inhibition of expression of VGAM125 target genes. It is appreciated that specific functions, and accordingly utilities, of VGAM125 correlate with, and may be deduced from, the identity of the target genes which VGAM125 binds and inhibits, and the function of these target genes, as elaborated hereinbelow.

Endometrial Bleeding Associated Factor (left-right determination, factor A; transforming growth factor beta superfamily) (EBAF, Accession XM_037302) is a VGAM125 host target gene. EBAF BINDING SITE is HOST TARGET binding site found in the 3' untranslated region of mRNA encoded by EBAF, corresponding to a HOST TARGET binding site such as BINDING SITE I, BINDING SITE II or BINDING SITE III. Table 2 illustrates the complementarity of the nucleotide sequences of EBAF BINDING SITE, designated SEQ ID:32608, to the nucleotide sequence of VGAM125 RNA, herein designated VGAM RNA, also designated SEQ ID:2836.

A function of VGAM125 is therefore inhibition of Endometrial Bleeding Associated Factor (left-right determination, factor A; transforming growth factor beta superfamily) (EBAF, Accession XM_037302), a gene which LEFT-RIGHT AXIS MALFORMATIONS. Accordingly, utilities of VGAM125 include diagnosis, prevention and treatment of diseases and clinical conditions associated with EBAF. The function of EBAF and its association with various diseases and clinical conditions, has been established by previous studies, as described hereinabove with reference to VGAM93. Glypican 1 (GPC1, Accession NM_002081) is another VGAM125 host target gene. GPC1 BINDING SITE is HOST TARGET binding site found in the 3' untranslated region of mRNA encoded by GPC1, corresponding to a HOST TARGET binding site such as BINDING SITE I, BINDING SITE II or BINDING SITE III. Table 2 illustrates the complementarity of the nucleotide sequences of GPC1 BINDING SITE, designated SEQ ID:7874, to the nucleotide sequence of VGAM125 RNA, herein designated VGAM RNA, also designated SEQ ID:2836.

Another function of VGAM125 is therefore inhibition of Glypican 1 (GPC1, Accession NM_002081), a gene which may play a role in growth control and differentation. Accordingly, utilities of VGAM125 include diagnosis, prevention and treatment of diseases and clinical conditions associated with GPC1. The function of GPC1 has been established by previous studies. Cell surface heparan sulfate proteoglycans are composed of a membrane-associated protein core substituted with a variable number of heparan sulfate chains. Two different cell surface heparan sulfate proteoglycan families can be distinguished: (1) the syndecan-like integral membrane proteoglycans (SLIPS), with a core protein spanning the cytoplasmic membrane, and (2) the glypican-related integral membrane proteoglycans (GRIPS), with a core protein anchored to the cytoplasmic membrane via a glycosyl phosphatidylinositol. Vermeesch et al. (1995) mapped the gene encoding glypican, the only human glypiated heparan sulfate proteoglycan that had so far been identified by cloning. By fluorescence in situ hybridization, they assigned the gene to 2q35-q37. Endostatin (OMIM Ref. No. 120328), a collagen XVIII fragment, is a potent antiangiogenic protein. Karumanchi et al. (2001) showed that alkaline phosphatase-tagged endostatin bound endothelial cells, revealing 2 binding affinities. Expression cloning identified glypican, specifically glypican-1 or glypican-4 (OMIM Ref. No. 300168), as the lower-affinity receptor. Biochemical and genetic studies indicated that the heparan sulfate glycosaminoglycans of glypican were critical for endostatin binding. Furthermore, endostatin selected a specific octasulfated hexasaccharide from a sequence in heparin. Karumanchi et al. (2001) also demonstrated a role for endostatin in renal tubular cell branching morphogenesis and showed that glypicans serve as low-affinity receptors for endostatin in these cells, as in endothelial cells. Antisense experiments suggested the critical importance of glypicans in mediating endostatin activities.

Full details of the abovementioned studies are described in the following publications, the disclosure of which are hereby incorporated by reference:

Karumanchi, S. A.; Jha, V.; Ramchandran, R.; Karihaloo, A.; Tsiokas, L.; Chan, B.; Dhanabal, M.; Hanai, J.; Venkataraman, G.; Shriver, Z.; Keiser, N.; Kalluri, R.; and 9 others: Cell surface glypicans are low-affinity endostatin receptors. Molec. Cell 7:811-822, 2001; and Vermeesch, J. R.; Mertens, G.; David, G.; Marynen, P.: Assignment of the human glypican gene (GPC1) to 2q35-q37 by fluorescence in situ hybridization. Genomics 25:327-329, 1995.

Further studies establishing the function and utilities of GPC1 are found in John Hopkins OMIM database record ID 600395, and in sited publications numbered 7251 listed in the bibliography section hereinbelow, which are also hereby incorporated by reference. Glutamate Receptor, Ionotropic, N-methyl D-aspartate 2A (GRIN2A, Accession NM_000833) is another VGAM125 host target gene. GRIN2A BINDING SITE is HOST TARGET binding site found in the 3" untranslated region of mRNA encoded by GRIN2A, corresponding to a HOST TARGET binding site such as BINDING SITE I, BINDING SITE II or BINDING SITE III. Table 2 illustrates the complementarity of the nucleotide sequences of GRIN2A BINDING SITE, designated SEQ ID:6488, to the nucleotide sequence of VGAM125 RNA, herein designated VGAM RNA, also designated SEQ ID:2836.

Another function of VGAM125 is therefore inhibition of Glutamate Receptor, Ionotropic, N-methyl D-aspartate 2A (GRIN2A, Accession NM_000833), a gene which modulates the efficiency of synaptic plasticity. Accordingly, utilities of VGAM125 include diagnosis, prevention and treatment of diseases and clinical conditions associated with GRIN2A. The function of GRIN2A has been established by previous studies. Molecular cloning and expression of cDNAs demonstrate that the epsilon and zeta subfamilies of the mouse glutamate receptor channel subunits constitute NMDA (N-methyl-D-aspartate) receptor channels (see OMIM Ref. No. GRIN2D; 602717). Four members of the epsilon subfamily, the E1, E2 (GRIN2B; 138252), E3 (GRIN2C; 138254), and E4 (OMIM Ref. No. GRIN2D) subunits, are distinct in distribution, functional properties, and regulation. Thus, the molecular diversity of the epsilon subunit family probably underlies the functional heterogeneity of the NMDA receptor channel. Rat counterparts of the mouse E1, E2, E3, E4, and zeta-1 (Z1; GRIN1, 138249) subunits were also isolated and designated as Nr2a, Nr2b, Nr2c, Nr2d, and Nmdar1, respectively (Monyer et al., 1992; Ishii et al., 1993). Animal model experiments lend further support to the function of GRIN2A. Sakimura et al. (1995) showed that targeted disruption of the mouse Nmdar2a gene produced mice that were viable, although impaired hippocampal plasticity was observed in homozygous -/- mice. By gene targeting, Sprengel et al. (1998) generated mutant mice expressing the Nmdar2a gene without the large intracellular C-terminal domain. These mice were viable but exhibited impaired synaptic plasticity and contextual memory. The authors concluded that the observed phenotypes appear to reflect defective intracellular signaling.

It is appreciated that the abovementioned animal model for GRIN2A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Monyer, H.; Sprengel, R.; Schoepfer, R.; Herb, A.; Higuchi, M.; Lomeli, H.; Burnashev, N.; Sakmann, B.; Seeburg, P. H.: Heteromeric NMDA receptors: molecular and functional distinction of subtypes. Science 256:1217-1221, 1992; and Sakimura, K.; Kutsuwada, T.; Ito, I.; Manabe, T.; Takayama, C.; Kushiya, E.; Yagi, T.; Aizawa, S.; Inoue, Y.; Sugiyama, H.; Mishina, M.: Reduced hippocampal LTP and spatial learning in.

Further studies establishing the function and utilities of GRIN2A are found in John Hopkins OMIM database record ID 138253, and in sited publications numbered 3598, 1457-1460, 145 and 3599 listed in the bibliography section hereinbelow, which are also hereby incorporated by reference. Heterogeneous Nuclear Ribonucleoprotein K (HNRPK, Accession NM_002140) is another VGAM125 host target gene. HNRPK BINDING SITE1 and HNRPK BINDING SITE2 are HOST TARGET binding sites found in untranslated regions of mRNA encoded by HNRPK, corresponding to HOST TARGET binding sites such as BINDING SITE I, BINDING SITE II or BINDING SITE III. Table 2 illustrates the complementarity of the nucleotide sequences of HNRPK BINDING SITE1 and HNRPK BINDING SITE2, designated SEQ ID:7915 and SEQ ID:25279 respectively, to the nucleotide sequence of VGAM125 RNA, herein designated VGAM RNA, also designated SEQ ID:2836.

Another function of VGAM125 is therefore inhibition of Heterogeneous Nuclear Ribonucleoprotein K (HNRPK, Accession NM_002140), a gene which play a role in the nuclear metabolism of hnrnas, particularly for pre-mrnas that contain cytidine-rich sequence. Accordingly, utilities of VGAM125 include diagnosis, prevention and treatment of diseases and clinical conditions associated with HNRPK. The function of HNRPK has been established by previous studies. The hnRNP-K family of acidic nuclear proteins have been identified using a monoclonal antibody that distinguishes between quiescent and proliferating human keratinocytes. The family, which is composed of at least 4 major proteins (e.g.:164017, 600124, 164020, and HNRPD) and their modified forms, is present in similar overall levels in quiescent and proliferating normal keratinocytes, although clear differences were observed in levels of some of the individual variants. Using a monoclonal antibody as a probe, Dejgaard et al. (1994) cloned a cDNA coding for type B hnRNP-K, and this was used to screen for additional family members. Sequencing of positive clones revealed 4 alternative splicing variants of a gene that mapped to chromosome 9 (by Southern blot analysis of human/rodent somatic cell hybrids). The hnRNP-K protein has been implicated in pre-mRNA metabolism of transcripts containing cytidine-rich sequences, and the results of Dejgaard et al. (1994) point toward a role in cell cycle progression. Tommerup and Leffers (1996) mapped HNRNPK to 9q21.32-q21.33 by fluorescence in situ hybridization.

Full details of the abovementioned studies are described in the following publications, the disclosure of which are hereby incorporated by reference:

Dejgaard, K.; Leffers, H.; Rasmussen, H. H.; Madsen, P.; Kruse, T. A.; Gesser, B.; Nielsen, H.; Celis, J. E.: Identification, molecular cloning, expression and chromosome mapping of a family of transformation upregulated hnRNP-K proteins derived by alternative splicing. J. Molec. Biol. 236: 33-48, 1994; and Tommerup, N.; Leffers, H.: Assignment of human KH-box-containing genes by in situ hybridization: HNRNPK maps to 9q21.32-q21.33, PCBP1 to 2p12-p13, and PCBP2 to 12q13.12-q13.13, distal to F.

Further studies establishing the function and utilities of HNRPK are found in John Hopkins OMIM database record ID 600712, and in sited publications numbered 10049-10050 listed in the bibliography section hereinbelow, which are also hereby incorporated by reference. MAX Binding Protein (MNT, Accession NM_020310) is another VGAM125 host target gene. MNT BINDING SITE is HOST TARGET binding site found in the 3' untranslated region of mRNA encoded by MNT, corresponding to a HOST TARGET binding site such as BINDING SITE I, BINDING SITE II or BINDING SITE III. Table 2 illustrates the complementarity of the nucleotide sequences of MNT BINDING SITE, designated SEQ ID:21564, to the nucleotide sequence of VGAM125 RNA, herein designated VGAM RNA, also designated SEQ ID:2836.

Another function of VGAM125 is therefore inhibition of MAX Binding Protein (MNT, Accession NM_020310). Accordingly, utilities of VGAM125 include diagnosis, prevention and treatment of diseases and clinical conditions associated with MNT. Platelet-derived Growth Factor Receptor, Beta Polypeptide (PDGFRB, Accession XM_038350) is another VGAM125 host target gene. PDGFRB BINDING SITE is HOST TARGET binding site found in the 3' untranslated region of mRNA encoded by PDGFRB, corresponding to a HOST TARGET binding site such as BINDING SITE I, BINDING SITE II or BINDING SITE III. Table 2 illustrates the complementarity of the nucleotide sequences of PDGFRB BINDING SITE, designated SEQ ID:32815, to the nucleotide sequence of VGAM125 RNA, herein designated VGAM RNA, also designated SEQ ID:2836.

Another function of VGAM125 is therefore inhibition of Platelet-derived Growth Factor Receptor, Beta Polypeptide (PDGFRB, Accession XM_038350), a gene which Platelet-derived growth factor receptor beta chain; tyrosine kinase receptor. Accordingly, utilities of VGAM125 include diagnosis, prevention and treatment of diseases and clinical conditions associated with PDGFRB. The function of PDGFRB has been established by previous studies. Steer and Cross (2002) reviewed the acquired reciprocal chromosomal translocations that involve 5q31-q33 and are associated with a significant minority of patients with BCR-ABL-negative chronic myeloid leukemias. The most common of these fuses the ETV6 gene to the PDGFRB gene, but at the time of the review 4 additional partner genes were known: H4 (D10S170), HIP1, CEV14 (OMIM Ref. No. TRIP11), and rabaptin-5. Clinically, most patients present with a myeloproliferative disorder with eosinophilia, eosinophilic leukemia, or chronic myelomonocytic leukemia and thus fall into the broad category of myeloproliferative disorders/myelodysplastic syndromes (MPD/MDS). With the advent of targeted signal transduction therapy, patients with rearrangement of PDGFRB might be better classified as a distinct subgroup of MPD/MDS. Animal model experiments lend further support to the function of PDGFRB. Klinghoffer et al. (2001) created 2 complementary lines of knockin mice in which the intracellular signaling domains of one PDGFR had been removed and replaced by those of the other PDGFR. While both lines demonstrated substantial rescue of normal development, substitution of the Pdgfrb signaling domains with those of Pdgfra resulted in varying degrees of vascular disease.

It is appreciated that the abovementioned animal model for PDGFRB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Klinghoffer, R. A.; Mueting-Nelsen, P. F.; Faerman, A.; Shani, M.; Soriano, P.: The two PDGF receptors maintain conserved signaling in vivo despite divergent embryological functions. Molec. Cell 7:343-354, 2001; and Steer, E. J.; Cross, N. C. P.: Myeloproliferative disorders with translocations of chromosome 5q31-35: role of the platelet-derived growth factor receptor beta. Acta Haemat. 107:113.

Further studies establishing the function and utilities of PDGFRB are found in John Hopkins OMIM database record ID 173410, and in sited publications numbered 3526, 4606-3529, 11281, 5108-3535, 3822-353 and 3826 listed in the bibliography section hereinbelow, which are also hereby incorporated by reference. Phosphatidylinositol Glycan, Class K (PIGK, Accession XM_039644) is another VGAM125 host target gene. PIGK BINDING SITE is HOST TARGET binding site found in the 3' untranslated region of mRNA encoded by PIGK, corresponding to a HOST TARGET binding site such as BINDING SITE I, BINDING SITE II or BINDING SITE III. Table 2 illustrates the complementarity of the nucleotide sequences of PIGK BINDING SITE, designated SEQ ID:33135, to the nucleotide sequence of VGAM125 RNA, herein designated VGAM RNA, also designated SEQ ID:2836.

Another function of VGAM125 is therefore inhibition of Phosphatidylinositol Glycan, Class K (PIGK, Accession XM_039644), a gene which catalyzes the transfer of fully assembled GPI units to proteins. Accordingly, utilities of VGAM125 include diagnosis, prevention and treatment of diseases and clinical conditions associated with PIGK. The function of PIGK has been established by previous studies. Glycosylphosphatidylinositol (GPI) anchors are synthesized in the endoplasmic reticulum and posttranslationally added to N-terminally processed proteins, replacing C-terminal sequences at a specific upstream omega site. This final step consists of a transamidation reaction. By searching an EST database for sequences similar to yeast Gpi8, Benghezal et al. (1996) identified a cDNA encoding PIGK, which they called GPI8. Sequence analysis predicted that the 396-amino acid PIGK protein shares 43% amino acid identity with yeast Gpi8. Yu et al. (1997) identified a mutant cell line that fails to incorporate GPI anchors into nascent N-terminally processed proproteins due to a defect in transamidation. By PCR analysis using the PIGK sequence reported by Benghezal et al. (1996), Yu et al. (1997) identified additional upstream sequences, including an ATG initiation codon. Expression of this PIGK cDNA in the mutant cell line restored GPI anchor assembly. Northern blot analysis detected major 1.6- and 1.9-kb PIGK transcripts in HeLa and K562 cell lines. Southern blot analysis of genomic DNA indicated that PIGK is a single gene spanning 20 to 25 kb. By somatic cell hybrid analysis, Yu et al. (1997) mapped the PIGK gene to chromosome 1.

Full details of the abovementioned studies are described in the following publications, the disclosure of which are hereby incorporated by reference:

Benghezal, M.; Benachour, A.; Rusconi, S.; Aebi, M.; Conzelmann, A.: Yeast Gpi8p is essential for GPI anchor attachment onto proteins. EMBO J. 15:6575-6583, 1996; and Yu, J.; Nagarajan, S.; Knez, J. J.; Udenfriend, S.; Chen, R.; Medof, M. E.: The affected gene underlying the class K glycosylphosphatidylinositol (GPI) surface protein defect codes for.

Further studies establishing the function and utilities of PIGK are found in John Hopkins OMIM database record ID 605087, and in sited publications numbered 6605-6606 listed in the bibliography section hereinbelow, which are also hereby incorporated by reference. Prostaglandin F2 Receptor Negative Regulator (PTGFRN, Accession XM_040709) is another VGAM125 host target gene. PTGFRN BINDING SITE is HOST TARGET binding site found in the 3' untranslated region of mRNA encoded by PTGFRN, corresponding to a HOST TARGET binding site such as BINDING SITE I, BINDING SITE II or BINDING SITE III. Table 2 illustrates the complementarity of the nucleotide sequences of PTGFRN BINDING SITE, designated SEQ ID:33365, to the nucleotide sequence of VGAM125 RNA, herein designated VGAM RNA, also designated SEQ ID:2836.

Another function of VGAM125 is therefore inhibition of Prostaglandin F2 Receptor Negative Regulator (PTGFRN, Accession XM_040709), a gene which inhibits the binding of prostaglandin f2-alpha (pgf2-alpha) to its specific fp receptor. Accordingly, utilities of VGAM125 include diagnosis, prevention and treatment of diseases and clinical conditions associated with PTGFRN. The function of PTGFRN has been established by previous studies. Orlicky et al. (1996) isolated a protein that copurifies with bovine prostaglandin F-2-alpha receptor (FP) and cloned the corresponding rat cDNA. Transfection experiments suggested that this protein inhibits binding of PGF-2-alpha to FP. Histologically, this protein (called FP regulatory protein, or FPRP, by them) shows a distribution coinciding well with those cells and tissues that respond to PGF-2-alpha.

Full details of the abovementioned studies are described in the following publications, the disclosure of which are hereby incorporated by reference:

Nagase, T.; Kikuno, R.; Ishikawa, K.; Hirosawa, M.; Ohara, O.: Prediction of the coding sequences of unidentified human genes. XVI. The complete sequences of 150 new cDNA clones from brain which code for large proteins in vitro. DNA Res. 7:65-73, 2000; and Stipp et al. (2001) used moderately stringent Brij96/97 detergent extraction to show that FPRP associates specifically with CD81 and CD9 but not with other tetraspanin molecules, such as C.

Further studies establishing the function and utilities of PTGFRN are found in John Hopkins OMIM database record ID 601204, and in sited publications numbered 6370-6373 listed in the bibliography section hereinbelow, which are also hereby incorporated by reference. TR2 (Accession XM_051264) is another VGAM125 host target gene. TR2 BINDING SITE is HOST TARGET binding site found in the 3' untranslated region of mRNA encoded by TR2, corresponding to a HOST TARGET binding site such as BINDING SITE I, BINDING SITE II or BINDING SITE III. Table 2 illustrates the complementarity of the nucleotide sequences of TR2 BINDING SITE, designated SEQ ID:35795, to the nucleotide sequence of VGAM125 RNA, herein designated VGAM RNA, also designated SEQ ID:2836.

Another function of VGAM125 is therefore inhibition of TR2 (Accession XM_051264), a gene which maintains high levels of reduced glutathione in the cytosol (by similarity). Accordingly, utilities of VGAM125 include diagnosis, prevention and treatment of diseases and clinical conditions associated with TR2. The function of TR2 has been established by previous studies. Members of the tumor necrosis factor receptor (TNFR) family play a key role in regulating the immune response to infection (see OMIM Ref. No. TNFR1, 191190). By screening for genes that mediate the entry of herpes simplex virus (HSV) into Chinese hamster ovary (CHO) cells, Montgomery et al. (1996) identified cDNAs encoding a member of the TNFR family. They designated the gene HVEM (herpesvirus entry mediator). The predicted 283-amino acid protein had characteristics of a type I membrane glycoprotein, with an N-terminal signal peptide, 2 potential sites for addition of N-linked glycans, and a putative membrane-spanning domain. Sequence analysis revealed that HVEM contained a cysteine-rich repeat region characteristic of TNFR family members, and shared 17 to 25% amino acid identity with other TNFRs. Montgomery et al. (1996) suggested that HVEM plays an important role in HSV pathogenesis because it enhanced the entry of several wildtype HSV strains of both serotypes into CHO cells, and mediated HSV entry into activated human T cells. Independently, Kwon et al. (1997) cloned cDNAs encoding HVEM, which they designated TR2. Northern blot analysis revealed that HVEM is expressed as a 1.7-kb mRNA in several tissues, with the highest expression in lung, spleen, and thymus. Several additional larger mRNAs were observed in some tissues and several of the cDNAs contained insertions in the coding region, leading Kwon et al. (1997) to suggest that HVEM is regulated at the level of mRNA maturation. These authors reported that the in vitro translation product was 32 kD by SDS-PAGE. Marsters et al. (1997) also identified HVEM as a novel member of the TNFR family. The authors attributed differences between their predicted amino acid sequence and that of Montgomery et al. (1996) to polymorphism. Using epitope-tagged HVEM, Marsters et al. (1997) found that HVEM interacted in vivo with several TNFR-associated factor (TRAF) proteins, including TRAF1 (OMIM Ref. No. 601711), TRAF2 (OMIM Ref. No. 601895), TRAF3 (OMIM Ref. No. 601896), and TRAF5 (OMIM Ref. No. 602356). Expression of HVEM activated JNK1 (OMIM Ref. No. 601158), NF-kappa-B (see OMIM Ref. No. 164011), and AP1 (OMIM Ref. No. 165160), which control expression of multiple genes in response to infection or cellular stress. Marsters et al. (1997) concluded that HVEM is linked via TRAFs to signal transduction pathways that activate the immune response. Hsu et al. (1997) cloned cDNAs for the mouse HVEM homolog, which they designated ATAR (another TRAF-associated receptor). The predicted 276-amino acid mouse protein shares only 45% protein sequence identity with human HVEM. By flow cytometric and RT-PCR analysis, Morel et al. (2000) showed that the expression of the HVEM ligand, LIGHT (TNFSF14; 604520), is upregulated, whereas HVEM expression is downregulated, after T-cell activation, particularly CD8-positive T-cell activation. HSV infection requires binding of the viral envelope glycoprotein D (gD) to cell surface receptors. Carfi et al. (2001) reported the x-ray structures of a soluble, truncated ectodomain of gD both alone and in complex with the ectodomain of its cellular receptor, TNFRSF14, which they called HVEA. Two bound anions suggested possible binding sites for another gD receptor, a 3-O-sulfonated heparan sulfate. The structures revealed a V-like immunoglobulin fold at the core of gD that is closely related to cellular adhesion molecules and flanked by large N- and C-terminal extensions. The receptor-binding segment of gD, an N-terminal hairpin, appeared conformationally flexible, suggesting that a conformational change accompanying binding might be part of the viral entry mechanism. By fluorescence in situ hybridization, Kwon et al. (1997) mapped the HVEM gene to 1p36.3-p36.2. This region also contains the TNFR genes CD30 (OMIM Ref. No. 153243), ILA (OMIM Ref. No. 602250), TXGP1L (OMIM Ref. No. 600315), and TNFR2 (OMIM Ref. No. 191191), suggesting that HVEM evolved through a localized gene duplication event.

Full details of the abovementioned studies are described in the following publications, the disclosure of which are hereby incorporated by reference:

Carfi, A.; Willis, S. H.; Whitbeck, J. C.; Krummenacher, C.; Cohen, G. H.; Eisenberg, R. J.; Wiley, D. C.: Herpes simplex virus glycoprotein D bound to the human receptor HveA. Molec. Cell 8:169-179, 2001; and Morel, Y.; Schiano de Colella, J.-M.; Harrop, J.; Deen, K. C.; Holmes, S. D.; Wattam, T. A.; Khandekar, S. S.; Truneh, A.; Sweet, R. W.; Gastaut, J.-A.; Olive, D.; Costello, R. T.: Rec.

Further studies establishing the function and utilities of TR2 are found in John Hopkins OMIM database record ID 602746, and in sited publications numbered 2402-2403, 2406-240 and 2407 listed in the bibliography section hereinbelow, which are also hereby incorporated by reference. BCL2-associated Athanogene 5 (BAG5, Accession NM_004873) is another VGAM125 host target gene. BAG5 BINDING SITE is HOST TARGET binding site found in the 3' untranslated region of mRNA encoded by BAG5, corresponding to a HOST TARGET binding site such as BINDING SITE I, BINDING SITE II or BINDING SITE III. Table 2 illustrates the complementarity of the nucleotide sequences of BAG5 BINDING SITE, designated SEQ ID:11307, to the nucleotide sequence of VGAM125 RNA, herein designated VGAM RNA, also designated SEQ ID:2836.

Another function of VGAM125 is therefore inhibition of BCL2-associated Athanogene 5 (BAG5, Accession NM_004873). Accordingly, utilities of VGAM125 include diagnosis, prevention and treatment of diseases and clinical conditions associated with BAG5. BM-002 (Accession NM_016617) is another VGAM125 host target gene. BM-002 BINDING SITE is HOST TARGET binding site found in the 3' untranslated region of mRNA encoded by BM-002, corresponding to a HOST TARGET binding site such as BINDING SITE I, BINDING SITE II or BINDING SITE III. Table 2 illustrates the complementarity of the nucleotide sequences of BM-002 BINDING SITE, designated SEQ ID:18724, to the nucleotide sequence of VGAM125 RNA, herein designated VGAM RNA, also designated SEQ ID:2836.

Another function of VGAM125 is therefore inhibition of BM-002 (Accession NM_016617). Accordingly, utilities of VGAM125 include diagnosis, prevention and treatment of diseases and clinical conditions associated with BM-002. Chromosome 8 Open Reading Frame 4 (C8orf4, Accession NM_020130) is another VGAM125 host target gene. C8orf4 BINDING SITE is HOST TARGET binding site found in the 3' untranslated region of mRNA encoded by C8orf4, corresponding to a HOST TARGET binding site such as BINDING SITE I, BINDING SITE II or BINDING SITE III. Table 2 illustrates the complementarity of the nucleotide sequences of C8orf4 BINDING SITE, designated SEQ ID:21325, to the nucleotide sequence of VGAM125 RNA, herein designated VGAM RNA, also designated SEQ ID:2836.

Another function of VGAM125 is therefore inhibition of Chromosome 8 Open Reading Frame 4 (C8orf4, Accession NM_020130). Accordingly, utilities of VGAM125 include diagnosis, prevention and treatment of diseases and clinical conditions associated with C8orf4. CDW92 (Accession NM_080546) is another VGAM125 host target gene. CDW92 BINDING SITE is HOST TARGET binding site found in the 3' untranslated region of mRNA encoded by CDW92, corresponding to a HOST TARGET binding site such as BINDING SITE I, BINDING SITE II or BINDING SITE III. Table 2 illustrates the complementarity of the nucleotide sequences of CDW92 BINDING SITE, designated SEQ ID:27866, to the nucleotide sequence of VGAM125 RNA, herein designated VGAM RNA, also designated SEQ ID:2836.

Another function of VGAM125 is therefore inhibition of CDW92 (Accession NM_080546). Accordingly, utilities of VGAM125 include diagnosis, prevention and treatment of diseases and clinical conditions associated with CDW92. DKFZP564I1171 (Accession XM_049568) is another VGAM125 host target gene. DKFZP564I1171 BINDING SITE is HOST TARGET binding site found in the 3' untranslated region of mRNA encoded by DKFZP564I1171, corresponding to a HOST TARGET binding site such as BINDING SITE I, BINDING SITE II or BINDING SITE III. Table 2 illustrates the complementarity of the nucleotide sequences of DKFZP564I1171 BINDING SITE, designated SEQ ID:35445, to the nucleotide sequence of VGAM125 RNA, herein designated VGAM RNA, also designated SEQ ID:2836.

Another function of VGAM125 is therefore inhibition of DKFZP564I1171 (Accession XM_049568). Accordingly, utilities of VGAM125 include diagnosis, prevention and treatment of diseases and clinical conditions associated with DKFZP564I1171. DKFZp761J1523 (Accession NM_032293) is another VGAM125 host target gene. DKFZp761J1523 BINDING SITE is HOST TARGET binding site found in the 3' untranslated region of mRNA encoded by DKFZp761J1523, corresponding to a HOST TARGET binding site such as BINDING SITE I, BINDING SITE II or BINDING SITE III. Table 2 illustrates the complementarity of the nucleotide sequences of DKFZp761J1523 BINDING SITE, designated SEQ ID:26061, to the nucleotide sequence of VGAM125 RNA, herein designated VGAM RNA, also designated SEQ ID:2836.

Another function of VGAM125 is therefore inhibition of DKFZp761J1523 (Accession NM_032293). Accordingly, utilities of VGAM125 include diagnosis, prevention and treatment of diseases and clinical conditions associated with DKFZp761J1523. FLJ11155 (Accession NM_018342) is another VGAM125 host target gene. FLJ11155 BINDING SITE is HOST TARGET binding site found in the 3' untranslated region of mRNA encoded by FLJ11155, corresponding to a HOST TARGET binding site such as BINDING SITE I, BINDING SITE II or BINDING SITE III. Table 2 illustrates the complementarity of the nucleotide sequences of FLJ11155 BINDING SITE, designated SEQ ID:20347, to the nucleotide sequence of VGAM125 RNA, herein designated VGAM RNA, also designated SEQ ID:2836.

Another function of VGAM125 is therefore inhibition of FLJ11155 (Accession NM_018342). Accordingly, utilities of VGAM125 include diagnosis, prevention and treatment of diseases and clinical conditions associated with FLJ11155. KIAA1237 (Accession XM_087386) is another VGAM125 host target gene. KIAA1237 BINDING SITE is HOST TARGET binding site found in the 3' untranslated region of mRNA encoded by KIAA1237, corresponding to a HOST TARGET binding site such as BINDING SITE I, BINDING SITE II or BINDING SITE III. Table 2 illustrates the complementarity of the nucleotide sequences of KIAA1237 BINDING SITE, designated SEQ ID:39220, to the nucleotide sequence of VGAM125 RNA, herein designated VGAM RNA, also designated SEQ ID:2836.

Another function of VGAM125 is therefore inhibition of KIAA1237 (Accession XM_087386). Accordingly, utilities of VGAM125 include diagnosis, prevention and treatment of diseases and clinical conditions associated with KIAA1237. KIAA1376 (Accession XM_033042) is another VGAM125 host target gene. KIAA1376 BINDING SITE is HOST TARGET binding site found in the 3' untranslated region of mRNA encoded by KIAA1376, corresponding to a HOST TARGET binding site such as BINDING SITE I, BINDING SITE II or BINDING SITE III. Table 2 illustrates the complementarity of the nucleotide sequences of KIAA1376 BINDING SITE, designated SEQ ID:31821, to the nucleotide sequence of VGAM125 RNA, herein designated VGAM RNA, also designated SEQ ID:2836.

Another function of VGAM125 is therefore inhibition of KIAA1376 (Accession XM_033042). Accordingly, utilities of VGAM125 include diagnosis, prevention and treatment of diseases and clinical conditions associated with KIAA1376. KIAA1416 (Accession XM_098762) is another VGAM125 host target gene. KIAA1416 BINDING SITE is HOST TARGET binding site found in the 5' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41810, to the nucleotide sequence of VGAM125 RNA, herein designated VGAM RNA, also designated SEQ ID:2836.

Another function of VGAM125 is therefore inhibition of KIAA1416 (Accession XM_098762). Accordingly, utilities of VGAM125 include diagnosis, prevention and treatment of diseases and clinical conditions associated with KIAA1416. KIAA1913 (Accession XM_058167) is another VGAM125 host target gene. KIAA1913 BINDING SITE is HOST TARGET binding site found in the 5' untranslated region of mRNA encoded by KIAA1913, corresponding to a HOST TARGET binding site such as BINDING SITE I, BINDING SITE II or BINDING SITE III. Table 2 illustrates the complementarity of the nucleotide sequences of KIAA1913 BINDING SITE, designated SEQ ID:36576, to the nucleotide sequence of VGAM125 RNA, herein designated VGAM RNA, also designated SEQ ID:2836.

Another function of VGAM125 is therefore inhibition of KIAA1913 (Accession XM_058167). Accordingly, utilities of VGAM125 include diagnosis, prevention and treatment of diseases and clinical conditions associated with KIAA1913. MGC19556 (Accession NM_033551) is another VGAM125 host target gene. MGC19556 BINDING SITE is HOST TARGET binding site found in the 3' untranslated region of mRNA encoded by MGC19556, corresponding to a HOST TARGET binding site such as BINDING SITE I, BINDING SITE II or BINDING SITE III. Table 2 illustrates the complementarity of the nucleotide sequences of MGC19556 BINDING SITE, designated SEQ ID:27317, to the nucleotide sequence of VGAM125 RNA, herein designated VGAM RNA, also designated SEQ ID:2836.

Another function of VGAM125 is therefore inhibition of MGC19556 (Accession NM_033551). Accordingly, utilities of VGAM125 include diagnosis, prevention and treatment of diseases and clinical conditions associated with MGC19556. MGC8407 (Accession NM_024046) is another VGAM125 host target gene. MGC8407 BINDING SITE is HOST TARGET binding site found in the 3' untranslated region of mRNA encoded by MGC8407, corresponding to a HOST TARGET binding site such as BINDING SITE I, BINDING SITE II or BINDING SITE III. Table 2 illustrates the complementarity of the nucleotide sequences of MGC8407 BINDING SITE, designated SEQ ID:23479, to the nucleotide sequence of VGAM125 RNA, herein designated VGAM RNA, also designated SEQ ID:2836.

Another function of VGAM125 is therefore inhibition of MGC8407 (Accession NM_024046). Accordingly, utilities of VGAM125 include diagnosis, prevention and treatment of diseases and clinical conditions associated with MGC8407. MORF4 (Accession XM_165470) is another VGAM125 host target gene. MORF4 BINDING SITE is HOST TARGET binding site found in the 5' untranslated region of mRNA encoded by MORF4, corresponding to a HOST TARGET binding site such as BINDING SITE I, BINDING SITE II or BINDING SITE III. Table 2 illustrates the complementarity of the nucleotide sequences of MORF4 BINDING SITE, designated SEQ ID:43643, to the nucleotide sequence of VGAM125 RNA, herein designated VGAM RNA, also designated SEQ ID:2836.

Another function of VGAM125 is therefore inhibition of MORF4 (Accession XM_165470). Accordingly, utilities of VGAM125 include diagnosis, prevention and treatment of diseases and clinical conditions associated with MORF4. Protein Phosphatase 1A (formerly 2C), Magnesium-dependent, Alpha Isoform (PPM1A, Accession NM_021003) is another VGAM125 host target gene. PPM1A BINDING SITE is HOST TARGET binding site found in the 3' untranslated region of mRNA encoded by PPM1A, corresponding to a HOST TARGET binding site such as BINDING SITE I, BINDING SITE II or BINDING SITE III. Table 2 illustrates the complementarity of the nucleotide sequences of PPM1A BINDING SITE, designated SEQ ID:21997, to the nucleotide sequence of VGAM125 RNA, herein designated VGAM RNA, also designated SEQ ID:2836.

Another function of VGAM125 is therefore inhibition of Protein Phosphatase 1A (formerly 2C), Magnesium-dependent, Alpha Isoform (PPM1A, Accession NM_021003). Accordingly, utilities of VGAM125 include diagnosis, prevention and treatment of diseases and clinical conditions associated with PPM1A. PRO1430 (Accession NM_018599) is another VGAM125 host target gene. PRO1430 BINDING SITE is HOST TARGET binding site found in the 5' untranslated region of mRNA encoded by PRO1430, corresponding to a HOST TARGET binding site such as BINDING SITE I, BINDING SITE II or BINDING SITE III. Table 2 illustrates the complementarity of the nucleotide sequences of PRO1430 BINDING SITE, designated SEQ ID:20675, to the nucleotide sequence of VGAM125 RNA, herein designated VGAM RNA, also designated SEQ ID:2836.

Another function of VGAM125 is therefore inhibition of PRO1430 (Accession NM_018599). Accordingly, utilities of VGAM125 include diagnosis, prevention and treatment of diseases and clinical conditions associated with PRO1430. LOC119369 (Accession XM_061434) is another VGAM125 host target gene. LOC119369 BINDING SITE is HOST TARGET binding site found in the 3' untranslated region of mRNA encoded by LOC119369, corresponding to a HOST TARGET binding site such as BINDING SITE I, BINDING SITE II or BINDING SITE III. Table 2 illustrates the complementarity of the nucleotide sequences of LOC119369 BINDING SITE, designated SEQ ID:37207, to the nucleotide sequence of VGAM125 RNA, herein designated VGAM RNA, also designated SEQ ID:2836.

Another function of VGAM125 is therefore inhibition of LOC119369 (Accession XM_061434). Accordingly, utilities of VGAM125 include diagnosis, prevention and treatment of diseases and clinical conditions associated with LOC119369. LOC126302 (Accession XM_059020) is another VGAM125 host target gene. LOC126302 BINDING SITE is HOST TARGET binding site found in the 3' untranslated region of mRNA encoded by LOC126302, corresponding to a HOST TARGET binding site such as BINDING SITE I, BINDING SITE II or BINDING SITE III. Table 2 illustrates the complementarity of the nucleotide sequences of LOC126302 BINDING SITE, designated SEQ ID:36824, to the nucleotide sequence of VGAM125 RNA, herein designated VGAM RNA, also designated SEQ ID:2836.

Another function of VGAM125 is therefore inhibition of LOC126302 (Accession XM_059020). Accordingly, utilities of VGAM125 include diagnosis, prevention and treatment of diseases and clinical conditions associated with LOC126302. LOC129676 (Accession XM_065341) is another VGAM125 host target gene. LOC129676 BINDING SITE is HOST TARGET binding site found in the 5' untranslated region of mRNA encoded by LOC129676, corresponding to a HOST TARGET binding site such as BINDING SITE I, BINDING SITE II or BINDING SITE III. Table 2 illustrates the complementarity of the nucleotide sequences of LOC129676 BINDING SITE, designated SEQ ID:37284, to the nucleotide sequence of VGAM125 RNA, herein designated VGAM RNA, also designated SEQ ID:2836.

Another function of VGAM125 is therefore inhibition of LOC129676 (Accession XM_065341). Accordingly, utilities of VGAM125 include diagnosis, prevention and treatment of diseases and clinical conditions associated with LOC129676. LOC144667 (Accession XM_096648) is another VGAM125 host target gene. LOC144667 BINDING SITE is HOST TARGET binding site found in the 3' untranslated region of mRNA encoded by LOC144667, corresponding to a HOST TARGET binding site such as BINDING SITE I, BINDING SITE II or BINDING SITE III. Table 2 illustrates the complementarity of the nucleotide sequences of LOC144667 BINDING SITE, designated SEQ ID:40450, to the nucleotide sequence of VGAM125 RNA, herein designated VGAM RNA, also designated SEQ ID:2836.

Another function of VGAM125 is therefore inhibition of LOC144667 (Accession XM_096648). Accordingly, utilities of VGAM125 include diagnosis, prevention and treatment of diseases and clinical conditions associated with LOC144667. LOC146756 (Accession XM_097085) is another VGAM125 host target gene. LOC146756 BINDING SITE is HOST TARGET binding site found in the 3' untranslated region of mRNA encoded by LOC146756, corresponding to a HOST TARGET binding site such as BINDING SITE I, BINDING SITE II or BINDING SITE III. Table 2 illustrates the complementarity of the nucleotide sequences of LOC146756 BINDING SITE, designated SEQ ID:40739, to the nucleotide sequence of VGAM125 RNA, herein designated VGAM RNA, also designated SEQ ID:2836.

Another function of VGAM125 is therefore inhibition of LOC146756 (Accession XM_097085). Accordingly, utilities of VGAM125 include diagnosis, prevention and treatment of diseases and clinical conditions associated with LOC146756. LOC152275 (Accession XM_098186) is another VGAM125 host target gene. LOC152275 BINDING SITE is HOST TARGET binding site found in the 3' untranslated region of mRNA encoded by LOC152275, corresponding to a HOST TARGET binding site such as BINDING SITE I, BINDING SITE II or BINDING SITE III. Table 2 illustrates the complementarity of the nucleotide sequences of LOC152275 BINDING SITE, designated SEQ ID:41458, to the nucleotide sequence of VGAM125 RNA, herein designated VGAM RNA, also designated SEQ ID:2836.

Another function of VGAM125 is therefore inhibition of LOC152275 (Accession XM_098186). Accordingly, utilities of VGAM125 include diagnosis, prevention and treatment of diseases and clinical conditions associated with LOC152275. LOC162083 (Accession XM_091339) is another VGAM125 host target gene. LOC162083 BINDING SITE is HOST TARGET binding site found in the 5' untranslated region of mRNA encoded by LOC162083, corresponding to a HOST TARGET binding site such as BINDING SITE I, BINDING SITE II or BINDING SITE III. Table 2 illustrates the complementarity of the nucleotide sequences of LOC162083 BINDING SITE, designated SEQ ID:40047, to the nucleotide sequence of VGAM125 RNA, herein designated VGAM RNA, also designated SEQ ID:2836.

Another function of VGAM125 is therefore inhibition of LOC162083 (Accession XM_091339). Accordingly, utilities of VGAM125 include diagnosis, prevention and treatment of diseases and clinical conditions associated with LOC162083. LOC200982 (Accession XM_117305) is another VGAM125 host target gene. LOC200982 BINDING SITE is HOST TARGET binding site found in the 3' untranslated region of mRNA encoded by LOC200982, corresponding to a HOST TARGET binding site such as BINDING SITE I, BINDING SITE II or BINDING SITE III. Table 2 illustrates the complementarity of the nucleotide sequences of LOC200982 BINDING SITE, designated SEQ ID:43375, to the nucleotide sequence of VGAM125 RNA, herein designated VGAM RNA, also designated SEQ ID:2836.

Another function of VGAM125 is therefore inhibition of LOC200982 (Accession XM_117305). Accordingly, utilities of VGAM125 include diagnosis, prevention and treatment of diseases and clinical conditions associated with LOC200982. LOC245728 (Accession XM_165922) is another VGAM125 host target gene. LOC245728 BINDING SITE is HOST TARGET binding site found in the 5' untranslated region of mRNA encoded by LOC245728, corresponding to a HOST TARGET binding site such as BINDING SITE I, BINDING SITE II or BINDING SITE III. Table 2 illustrates the complementarity of the nucleotide sequences of LOC245728 BINDING SITE, designated SEQ ID:43800, to the nucleotide sequence of VGAM125 RNA, herein designated VGAM RNA, also designated SEQ ID:2836.

Another function of VGAM125 is therefore inhibition of LOC245728 (Accession XM_165922). Accordingly, utilities of VGAM125 include diagnosis, prevention and treatment of diseases and clinical conditions associated with LOC245728. LOC254015 (Accession XM_172977) is another VGAM125 host target gene. LOC254015 BINDING SITE is HOST TARGET binding site found in the 3' untranslated region of mRNA encoded by LOC254015, corresponding to a HOST TARGET binding site such as BINDING SITE I, BINDING SITE II or BINDING SITE III. Table 2 illustrates the complementarity of the nucleotide sequences of LOC254015 BINDING SITE, designated SEQ ID:46246, to the nucleotide sequence of VGAM125 RNA, herein designated VGAM RNA, also designated SEQ ID:2836.

Another function of VGAM125 is therefore inhibition of LOC254015 (Accession XM_172977). Accordingly, utilities of VGAM125 include diagnosis, prevention and treatment of diseases and clinical conditions associated with LOC254015. LOC257106 (Accession XM_170910) is another VGAM125 host target gene. LOC257106 BINDING SITE is HOST TARGET binding site found in the 3' untranslated region of mRNA encoded by LOC257106, corresponding to a HOST TARGET binding site such as BINDING SITE I, BINDING SITE II or BINDING SITE III. Table 2 illustrates the complementarity of the nucleotide sequences of LOC257106 BINDING SITE, designated SEQ ID:45678, to the nucleotide sequence of VGAM125 RNA, herein designated VGAM RNA, also designated SEQ ID:2836.

Another function of VGAM125 is therefore inhibition of LOC257106 (Accession XM_170910). Accordingly, utilities of VGAM125 include diagnosis, prevention and treatment of diseases and clinical conditions associated with LOC257106. LOC57109 (Accession NM_020385) is another VGAM125 host target gene. LOC57109 BINDING SITE is HOST TARGET binding site found in the 3' untranslated region of mRNA encoded by LOC57109, corresponding to a HOST TARGET binding site such as BINDING SITE I, BINDING SITE II or BINDING SITE III. Table 2 illustrates the complementarity of the nucleotide sequences of LOC57109 BINDING SITE, designated SEQ ID:21656, to the nucleotide sequence of VGAM125 RNA, herein designated VGAM RNA, also designated SEQ ID:2836.

Another function of VGAM125 is therefore inhibition of LOC57109 (Accession NM_020385). Accordingly, utilities of VGAM125 include diagnosis, prevention and treatment of diseases and clinical conditions associated with LOC57109. FIG. 1 further provides a conceptual description of a novel bioinformatically detected viral gene of the present invention, referred to here as Viral Genomic Address Messenger 126 (VGAM126) viral gene, which modulates expression of respective host target genes thereof, the function and utility of which host target genes is known in the art.

VGAM126 is a novel bioinformatically detected regulatory, non protein coding, viral micro RNA (miRNA) gene. The method by which VGAM126 was detected is described hereinabove with reference to FIGS. 1-8.

VGAM126 gene, herein designated VGAM GENE, is a viral gene contained in the genome of Shrimp White Spot Syndrome Virus (white spot bacilliform virus). VGAM126 host target gene, herein designated VGAM HOST TARGET GENE, is a human gene contained in the human genome.

VGAM126 gene encodes a VGAM126 precursor RNA, herein designated VGAM PRECURSOR RNA. Similar to other miRNA genes, and unlike most ordinary genes, VGAM126 precursor RNA does not encode a protein. A nucleotide sequence identical or highly similar to the nucleotide sequence of VGAM126 precursor RNA is designated SEQ ID:112, and is provided hereinbelow with reference to the sequence listing part. Nucleotide sequence SEQ ID:112 is located at position 47516 relative to the genome of Shrimp White Spot Syndrome Virus (white spot bacilliform virus).

VGAM126 precursor RNA folds onto itself, forming VGAM126 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM126 folded precursor RNA into VGAM126 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM126 RNA is designated SEQ ID:2837, and is provided hereinbelow with reference to the sequence listing part.

VGAM126 host target gene, herein designated VGAM HOST TARGET GENE, encodes a corresponding messenger RNA, VGAM126 host target RNA, herein designated VGAM HOST TARGET RNA. VGAM126 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM126 RNA, herein designated VGAM RNA, binds complementarily to one or more host target binding sites located in untranslated regions of VGAM126 host target RNA, herein designated VGAM HOST TARGET RNA. This complementary binding is due to the fact that the nucleotide sequence of VGAM126 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM126 RNA, herein designated VGAM RNA, may have a different number of host target binding sites in untranslated regions of a VGAM126 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM126 RNA, herein designated VGAM RNA, to host target binding sites on VGAM126 host target RNA, herein designated VGAM HOST TARGET RNA, such as BINDING SITE I, BINDING SITE II and BINDING SITE III, inhibits translation of VGAM126 host target RNA into VGAM126 host target protein, herein designated VGAM HOST TARGET PROTEIN. VGAM host target protein is therefore outlined by a broken line.

It is appreciated that VGAM126 host target gene, herein designated VGAM HOST TARGET GENE, in fact represents a plurality of VGAM126 host target genes. The mRNA of each one of this plurality of VGAM126 host target genes comprises one or more host target binding sites, each having a nucleotide sequence which is at least partly complementary to VGAM126 RNA, herein designated VGAM RNA, and which when bound by VGAM126 RNA causes inhibition of translation of respective one or more VGAM126 host target proteins.

It is further appreciated by one skilled in the art that the mode of translational inhibition illustrated by FIG. 1 with specific reference to translational inhibition exerted by VGAM126 gene, herein designated VGAM GENE, on one or more VGAM126 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM126 is inhibition of expression of host target genes, as part of a novel viral mechanism of attacking a host. Accordingly, utilities of VGAM126 include diagnosis, prevention and treatment of viral infection by Shrimp White Spot Syndrome Virus (white spot bacilliform virus). Specific functions, and accordingly utilities, of VGAM126 correlate with, and may be deduced from, the identity of the host target genes which VGAM126 binds and inhibits, and the function of these host target genes, as elaborated hereinbelow.

Nucleotide sequences of the VGAM126 precursor RNA, herein designated VGAM PRECURSOR RNA, and of the 'diced' VGAM126 RNA, herein designated VGAM RNA, and a schematic representation of the secondary folding of VGAM126 folded precursor RNA, herein designated VGAM FOLDED PRECURSOR RNA, of VGAM126 are further described hereinbelow with reference to Table 1.

Nucleotide sequences of host target binding sites, such as BINDING SITE-I, BINDING SITE-II and BINDING SITE-III of FIG. 1, found on VGAM126 host target RNA, and schematic representation of the complementarity of each of these host target binding sites to VGAM126 RNA, herein designated VGAM RNA, are described hereinbelow with reference to Table 2.

As mentioned hereinabove with reference to FIG. 1, a function of VGAM126 gene, herein designated VGAM is inhibition of expression of VGAM126 target genes. It is appreciated that specific functions, and accordingly utilities, of VGAM126 correlate with, and may be deduced from, the identity of the target genes which VGAM126 binds and inhibits, and the function of these target genes, as elaborated hereinbelow.

UDP-Gal:betaGlcNAc Beta 1,3-galactosyltransferase, Polypeptide 5 (B3GALT5, Accession NM_006057) is a VGAM126 host target gene. B3GALT5 BINDING SITE1 through B3GALT5 BINDING SITE5 are HOST TARGET binding sites found in untranslated regions of mRNA encoded by B3GALT5, corresponding to HOST TARGET binding sites such as BINDING SITE I, BINDING SITE II or BINDING SITE III. Table 2 illustrates the complementarity of the nucleotide sequences of B3GALT5 BINDING SITE1 through B3GALT5 BINDING SITE5, designated SEQ ID:12701, SEQ ID:27029, SEQ ID:27034, SEQ ID:27039 and SEQ ID:27024 respectively, to the nucleotide sequence of VGAM126 RNA, herein designated VGAM RNA, also designated SEQ ID:2837.

A function of VGAM126 is therefore inhibition of UDP-Gal:betaGlcNAc Beta 1,3-galactosyltransferase, Polypeptide 5 (B3GALT5, Accession NM_006057). Accordingly, utilities of VGAM126 include diagnosis, prevention and treatment of diseases and clinical conditions associated with B3GALT5. GATA Binding Protein 2 (GATA2, Accession NM_002050) is another VGAM126 host target gene. GATA2 BINDING SITE is HOST TARGET binding site found in the 3' untranslated region of mRNA encoded by GATA2, corresponding to a HOST TARGET binding site such as BINDING SITE I, BINDING SITE II or BINDING SITE III. Table 2 illustrates the complementarity of the nucleotide sequences of GATA2 BINDING SITE, designated SEQ ID:7800, to the nucleotide sequence of VGAM126 RNA, herein designated VGAM RNA, also designated SEQ ID:2837.

Another function of VGAM126 is therefore inhibition of GATA Binding Protein 2 (GATA2, Accession NM_002050). Accordingly, utilities of VGAM126 include diagnosis, prevention and treatment of diseases and clinical conditions associated with GATA2. Huntingtin-associated Protein 1 (neuroan 1) (HAP1, Accession NM_003949) is another VGAM126 host target gene. HAP1 BINDING SITE is HOST TARGET binding site found in the 3' untranslated region of mRNA encoded by HAP1, corresponding to a HOST TARGET binding site such as BINDING SITE I, BINDING SITE II or BINDING SITE III. Table 2 illustrates the complementarity of the nucleotide sequences of HAP1 BINDING SITE, designated SEQ ID:10072, to the nucleotide sequence of VGAM126 RNA, herein designated VGAM RNA, also designated SEQ ID:2837.

Another function of VGAM126 is therefore inhibition of Huntingtin-associated Protein 1 (neuroan 1) (HAP1, Accession NM_003949), a gene which functions as an adaptor protein using coiled coils to mediate interactions among cytoskeletal, vascular, and motor proteins. Accordingly, utilities of VGAM126 include diagnosis, prevention and treatment of diseases and clinical conditions associated with HAP1. The function of HAP1 has been established by previous studies. Several neurodegenerative disorders are known to involve trinucleotide expansions of the CAG codon for glutamine, including Huntington disease (HD; 143100), spinocerebellar ataxia type 1 (OMIM Ref. No. 164400), Machado-Joseph disease (OMIM Ref. No. 109150), and spinobulbar muscular atrophy (313700.0014). Li et al. (1995) identified a cDNA for a rat brain protein that binds to the mutant HD protein by using the latter as bait in a 2-hybrid yeast screening assay. The protein, which they designated HAP1 (huntingtin-associated protein-1), was found to bind to huntingtin in proportion to the number of glutamines present in the glutamine repeat region. Two HAP1 cDNAs were found that differ at the C terminus, probably as a result of alternative splicing. The predicted 599- and 629-amino acid proteins are highly hydrophilic, rich in charged amino acids, and have no homology to known proteins. Two human PCR products, termed HAP1 and HLP (HAP-like protein), were obtained. The human HAP1 cDNA encoded a protein 96% identical to the rat HAP1 protein. Northern blots showed a 4.0-kb HAP1 transcript in rat brains and RT-PCR demonstrated expression in human brain, especially in the caudate and cortex, regions affected in Huntington disease. Coimmunoprecipitation experiments with rat brain tissue and HAP1-transfected cells confirmed that HAP1 binds to huntingtin in vivo, though they had not yet clearly shown the same in human brain tissue. Li et al. (1995) speculated that the ability of HAP1 to bind to glutamine repeats in huntingtin is influenced by adjacent amino acids, since in their yeast 2-hybrid assays there was no binding of HAP1 to atrophin-1, even though their atrophin-1 construct contained essentially the same number of glutamine repeats (21) as did their huntingtin construct (23). Animal model experiments lend further support to the function of HAP1. Bertaux et al. (1998) cloned mouse Hap1 cDNA and demonstrated that expression is not enriched in areas specifically affected in Huntington disease. Bertaux et al. (1998) used the yeast 2-hybrid system to demonstrate that amino acids 171-230 of the huntingtin-associated protein are necessary for hap1-huntingtin binding and that Hap1 does not interact with the transgene exon 1 protein in a transgenic model of HD.

It is appreciated that the abovementioned animal model for HAP1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Li, X.-J.; Li, S.-H.; Sharp, A. H.; Nucifora, F. C., Jr.; Schilling, G.; Lanahan, A.; Worley, P.; Snyder, S. H.; Ross, C. A.: A huntingtin-associated protein enriched in brain with implications for pathology. Nature 378:398-402, 1995; and Bertaux, F.; Sharp, A. H.; Ross, C. A.; Lehrach, H.; Bates, G. P.; Wanker, E.: HAP1-huntingtin interactions do not contribute to the molecular pathology in Huntington's disease transgen.

Further studies establishing the function and utilities of HAP1 are found in John Hopkins OMIM database record ID 600947, and in sited publications numbered 9614-9619 listed in the bibliography section hereinbelow, which are also hereby incorporated by reference. Potassium Voltage-gated Channel, Shaker-related Subfamily, Member 7 (KCNA7, Accession NM_031886) is another VGAM126 host target gene. KCNA7 BINDING SITE is HOST TARGET binding site found in the 3' untranslated region of mRNA encoded by KCNA7, corresponding to a HOST TARGET binding site such as BINDING SITE I, BINDING SITE II or BINDING SITE III. Table 2 illustrates the complementarity of the nucleotide sequences of KCNA7 BINDING SITE, designated SEQ ID:25626, to the nucleotide sequence of VGAM126 RNA, herein designated VGAM RNA, also designated SEQ ID:2837.

Another function of VGAM126 is therefore inhibition of Potassium Voltage-gated Channel, Shaker-related Subfamily, Member 7 (KCNA7, Accession NM_031886), a gene which allows nerve cells to efficiently repolarize following an action potential. Accordingly, utilities of VGAM126 include diagnosis, prevention and treatment of diseases and clinical conditions associated with KCNA7. The function of KCNA7 has been established by previous studies. See 176260 for a general discussion of potassium voltage-gated ion channels. Using a probe from the mouse in the study of somatic cell hybrids, McPherson et al. (1991) found that a seventh member of the Shaker-related potassium voltage-gated channel is encoded by a gene on chromosome 19. Kalman et al. (1998) reported the isolation of the mouse voltage-gated Shaker-related potassium channel gene, Kv1.7 (Kcna7). Unlike other known Kv1 family genes that have intronless coding regions, the protein-coding region of Kv1.7 was interrupted by a 1.9-kb intron. The gene was mapped to mouse chromosome 7 and human chromosome 19q13.3. The mouse Kv1.7 channel was voltage-dependent and exhibited cumulative inactivation. Northern blot analysis revealed transcripts of approximately 3 kb in mouse heart and skeletal muscle. Bardien-Kruger et al. (2002) deduced the coding region of KCNA7 by aligning the mouse cDNA sequence with a human BAC clone and mouse EST sequences. The region encodes a protein of 456 amino acid residues containing cytoplasmic N- and C-termini, a central core domain composed of 6 transmembrane segments and the characteristic pore-loop. The human intron was 1153 bp in length and smaller than that of mouse (1929 bp). Using the deduced amino acid sequences, the potassium-channels of the 2 species were highly conserved (greater than 95%). The expression of KCNA7 in human adult heart was confirmed by RT-PCR studies. Bardien-Kruger et al. (2002) refined the location of the KCNA7 gene within chromosome 19q13.3 by bioinformatic in silico mapping and implicated it as a positional candidate gene for progressive familial heart block type I (OMIM Ref. No. 604559), an autosomal dominant cardiac conduction disorder mapped to 19q13.3. In affected individuals, Bardien-Kruger et al. (2002) screened the coding region of KCNA7 by PCR-SSCP analysis and direct DNA sequencing, which did not reveal any pathogenic sequence changes Full details of the abovementioned studies are described in the following publications, the disclosure of which are hereby incorporated by reference:

Bardien-Kruger, S.; Wulff, H.; Arieff, Z.; Brink, P.; Chandy, K. G.; Corfield, V.: Characterisation of the human voltage-gated potassium channel gene, KCNA7, a candidate gene for inherited cardiac disorders, and its exclusion as cause of progressive familial heart block I (PFHBI). Europ. J. Hum. Genet. 10:36-43, 2002; and Kalman, K.; Nguyen, A.; Tseng-Crank, J.; Dukes, I. D.; Chandy, G.; Hustad, C. M.; Copeland, N. G.; Jenkins, N. A.; Mohrenweiser, H.; Brandriff, B.; Cahalan, M.; Gutman, G. A.; Chandy, K.

Further studies establishing the function and utilities of KCNA7 are found in John Hopkins OMIM database record ID 176268, and in sited publications numbered 1094 and 10928 listed in the bibliography section hereinbelow, which are also hereby incorporated by reference. Myosin ID (MYO1D, Accession XM_050041) is another VGAM126 host target gene. MYO1D BINDING SITE is HOST TARGET binding site found in the 3' untranslated region of mRNA encoded by MYO1D, corresponding to a HOST TARGET binding site such as BINDING SITE I, BINDING SITE II or BINDING SITE III. Table 2 illustrates the complementarity of the nucleotide sequences of MYO1D BINDING SITE, designated SEQ ID:35547, to the nucleotide sequence of VGAM126 RNA, herein designated VGAM RNA, also designated SEQ ID:2837.

Another function of VGAM126 is therefore inhibition of Myosin ID (MYO1D, Accession XM_050041), a gene which is an unconventional myosin. Accordingly, utilities of VGAM126 include diagnosis, prevention and treatment of diseases and clinical conditions associated with MYO1D. The function of MYO1D has been established by previous studies. Myosins are molecular motors that, upon interaction with actin filaments, utilize energy from ATP hydrolysis to generate mechanical force. For further background information on myosins, see MYO1A (OMIM Ref. No. 601478). By screening for cDNAs with the potential to encode large proteins expressed in brain, Nagase et al. (1998) identified a cDNA encoding MYO1D, which they called KIAA0727. The deduced 674-amino acid protein is 98% identical to rat Myr4. RT-PCR analysis detected expression of KIAA0727 in all tissues tested, with highest levels in brain, followed by lung and ovary; expression was lowest in spleen.

Full details of the abovementioned studies are described in the following publications, the disclosure of which are hereby incorporated by reference:

Hasson, T.; Skowron, J. F.; Gilbert, D. J.; Avraham, K. B.; Perry, W. L.; Bement, W. M.; Anderson, B. L.; Sherr, E. H.; Chen, Z.-Y.; Greene, L. A.; Ward, D. C.; Corey, D. P.; Mooseker, M. S.; Copeland, N. G.; Jenkins, N. A.: Mapping of unconventional myosins in mouse and human. Genomics 36:431-439, 1996; and Nagase, T.; Ishikawa, K.; Suyama, M.; Kikuno, R.; Miyajima, N.; Tanaka, A.; Kotani, H.; Nomura, N.; Ohara, O.: Prediction of the coding sequences of unidentified human genes. XI. The c.

Further studies establishing the function and utilities of MYO1D are found in John Hopkins OMIM database record ID 606539, and in sited publications numbered 702 and 7048 listed in the bibliography section hereinbelow, which are also hereby incorporated by reference. ERG-1 (Accession NM_022034) is another VGAM126 host target gene. ERG-1 BINDING SITE is HOST TARGET binding site found in the 5' untranslated region of mRNA encoded by ERG-1, corresponding to a HOST TARGET binding site such as BINDING SITE I, BINDING SITE II or BINDING SITE III. Table 2 illustrates the complementarity of the nucleotide sequences of ERG-1 BINDING SITE, designated SEQ ID:22555, to the nucleotide sequence of VGAM126 RNA, herein designated VGAM RNA, also designated SEQ ID:2837.

Another function of VGAM126 is therefore inhibition of ERG-1 (Accession NM_022034). Accordingly, utilities of VGAM126 include diagnosis, prevention and treatment of diseases and clinical conditions associated with ERG-1. FLJ10748 (Accession NM_018203) is another VGAM126 host target gene. FLJ10748 BINDING SITE is HOST TARGET binding site found in the 3' untranslated region of mRNA encoded by FLJ10748, corresponding to a HOST TARGET binding site such as BINDING SITE I, BINDING SITE II or BINDING SITE III. Table 2 illustrates the complementarity of the nucleotide sequences of FLJ10748 BINDING SITE, designated SEQ ID:20084, to the nucleotide sequence of VGAM126 RNA, herein designated VGAM RNA, also designated SEQ ID:2837.

Another function of VGAM126 is therefore inhibition of FLJ10748 (Accession NM_018203). Accordingly, utilities of VGAM126 include diagnosis, prevention and treatment of diseases and clinical conditions associated with FLJ10748. KIAA0319 (Accession NM_014809) is another VGAM126 host target gene. KIAA0319 BINDING SITE is HOST TARGET binding site found in the 3' untranslated region of mRNA encoded by KIAA0319, corresponding to a HOST TARGET binding site such as BINDING SITE I, BINDING SITE II or BINDING SITE III. Table 2 illustrates the complementarity of the nucleotide sequences of KIAA0319 BINDING SITE, designated SEQ ID:16757, to the nucleotide sequence of VGAM126 RNA, herein designated VGAM RNA, also designated SEQ ID:2837.

Another function of VGAM126 is therefore inhibition of KIAA0319 (Accession NM_014809). Accordingly, utilities of VGAM126 include diagnosis, prevention and treatment of diseases and clinical conditions associated with KIAA0319. MGC2306 (Accession NM_032638) is another VGAM126 host target gene. MGC2306 BINDING SITE is HOST TARGET binding site found in the 3' untranslated region of mRNA encoded by MGC2306, corresponding to a HOST TARGET binding site such as BINDING SITE I, BINDING SITE II or BINDING SITE III. Table 2 illustrates the complementarity of the nucleotide sequences of MGC2306 BINDING SITE, designated SEQ ID:26349, to the nucleotide sequence of VGAM126 RNA, herein designated VGAM RNA, also designated SEQ ID:2837.

Another function of VGAM126 is therefore inhibition of MGC2306 (Accession NM_032638). Accordingly, utilities of VGAM126 include diagnosis, prevention and treatment of diseases and clinical conditions associated with MGC2306. MGC2705 (Accession NM_032701) is another VGAM126 host target gene. MGC2705 BINDING SITE is HOST TARGET binding site found in the 3' untranslated region of mRNA encoded by MGC2705, corresponding to a HOST TARGET binding site such as BINDING SITE I, BINDING SITE II or BINDING SITE III. Table 2 illustrates the complementarity of the nucleotide sequences of MGC2705 BINDING SITE, designated SEQ ID:26416, to the nucleotide sequence of VGAM126 RNA, herein designated VGAM RNA, also designated SEQ ID:2837.

Another function of VGAM126 is therefore inhibition of MGC2705 (Accession NM_032701). Accordingly, utilities of VGAM126 include diagnosis, prevention and treatment of diseases and clinical conditions associated with MGC2705. X123 (Accession XM_046023) is another VGAM126 host target gene. X123 BINDING SITE is HOST TARGET binding site found in the 3' untranslated region of mRNA encoded by X123, corresponding to a HOST TARGET binding site such as BINDING SITE I, BINDING SITE II or BINDING SITE III. Table 2 illustrates the complementarity of the nucleotide sequences of X123 BINDING SITE, designated SEQ ID:34650, to the nucleotide sequence of VGAM126 RNA, herein designated VGAM RNA, also designated SEQ ID:2837.

Another function of VGAM126 is therefore inhibition of X123 (Accession XM_046023). Accordingly, utilities of VGAM126 include diagnosis, prevention and treatment of diseases and clinical conditions associated with X123. LOC144453 (Accession XM_084869) is another VGAM126 host target gene. LOC144453 BINDING SITE is HOST TARGET binding site found in the 3' untranslated region of mRNA encoded by LOC144453, corresponding to a HOST TARGET binding site such as BINDING SITE I, BINDING SITE II or BINDING SITE III. Table 2 illustrates the complementarity of the nucleotide sequences of LOC144453 BINDING SITE, designated SEQ ID:37744, to the nucleotide sequence of VGAM126 RNA, herein designated VGAM RNA, also designated SEQ ID:2837.

Another function of VGAM126 is therefore inhibition of LOC144453 (Accession XM_084869). Accordingly, utilities of VGAM126 include diagnosis, prevention and treatment of diseases and clinical conditions associated with LOC144453. LOC149670 (Accession XM_086647) is another VGAM126 host target gene. LOC149670 BINDING SITE is HOST TARGET binding site found in the 5' untranslated region of mRNA encoded by LOC149670, corresponding to a HOST TARGET binding site such as BINDING SITE I, BINDING SITE II or BINDING SITE III. Table 2 illustrates the complementarity of the nucleotide sequences of LOC149670 BINDING SITE, designated SEQ ID:38804, to the nucleotide sequence of VGAM126 RNA, herein designated VGAM RNA, also designated SEQ ID:2837.

Another function of VGAM126 is therefore inhibition of LOC149670 (Accession XM_086647). Accordingly, utilities of VGAM126 include diagnosis, prevention and treatment of diseases and clinical conditions associated with LOC149670.

LOC157247 (Accession XM_088275) is another VGAM126 host target gene. LOC157247 BINDING SITE is HOST TARGET binding site found in the 5' untranslated region of mRNA encoded by LOC157247, corresponding to a HOST TARGET binding site such as BINDING SITE I, BINDING SITE II or BINDING SITE III. Table 2 illustrates the complementarity of the nucleotide sequences of LOC157247 BINDING SITE, designated SEQ ID:39575, to the nucleotide sequence of VGAM126 RNA, herein designated VGAM RNA, also designated SEQ ID:2837.

Another function of VGAM126 is therefore inhibition of LOC157247 (Accession XM_088275). Accordingly, utilities of VGAM126 include diagnosis, prevention and treatment of diseases and clinical conditions associated with LOC157247. LOC203197 (Accession XM_114645) is another VGAM126 host target gene. LOC203197 BINDING SITE is HOST TARGET binding site found in the 3' untranslated region of mRNA encoded by LOC203197, corresponding to a HOST TARGET binding site such as BINDING SITE I, BINDING SITE II or BINDING SITE III. Table 2 illustrates the complementarity of the nucleotide sequences of LOC203197 BINDING SITE, designated SEQ ID:43007, to the nucleotide sequence of VGAM126 RNA, herein designated VGAM RNA, also designated SEQ ID:2837.

Another function of VGAM126 is therefore inhibition of LOC203197 (Accession XM_114645). Accordingly, utilities of VGAM126 include diagnosis, prevention and treatment of diseases and clinical conditions associated with LOC203197. LOC254559 (Accession XM_172931) is another VGAM126 host target gene. LOC254559 BINDING SITE is HOST TARGET binding site found in the 5' untranslated region of mRNA encoded by LOC254559, corresponding to a HOST TARGET binding site such as BINDING SITE I, BINDING SITE II or BINDING SITE III. Table 2 illustrates the complementarity of the nucleotide sequences of LOC254559 BINDING SITE, designated SEQ ID:46198, to the nucleotide sequence of VGAM126 RNA, herein designated VGAM RNA, also designated SEQ ID:2837.

Another function of VGAM126 is therefore inhibition of LOC254559 (Accession XM_172931). Accordingly, utilities of VGAM126 include diagnosis, prevention and treatment of diseases and clinical conditions associated with LOC254559. LOC92661 (Accession XM_046465) is another VGAM126 host target gene. LOC92661 BINDING SITE is HOST TARGET binding site found in the 3' untranslated region of mRNA encoded by LOC92661, corresponding to a HOST TARGET binding site such as BINDING SITE I, BINDING SITE II or BINDING SITE III. Table 2 illustrates the complementarity of the nucleotide sequences of LOC92661 BINDING SITE, designated SEQ ID:34721, to the nucleotide sequence of VGAM126 RNA, herein designated VGAM RNA, also designated SEQ ID:2837.

Another function of VGAM126 is therefore inhibition of LOC92661 (Accession XM_046465). Accordingly, utilities of VGAM126 include diagnosis, prevention and treatment of diseases and clinical conditions associated with LOC92661. FIG. 1 further provides a conceptual description of a novel bioinformatically detected viral gene of the present invention, referred to here as Viral Genomic Address Messenger 127 (VGAM127) viral gene, which modulates expression of respective host target genes thereof, the function and utility of which host target genes is known in the art.

VGAM127 is a novel bioinformatically detected regulatory, non protein coding, viral micro RNA (miRNA) gene. The method by which VGAM127 was detected is described hereinabove with reference to FIGS. 1-8.

VGAM127 gene, herein designated VGAM GENE, is a viral gene contained in the genome of Shrimp White Spot Syndrome Virus (white spot baculiform virus). VGAM127 host target gene, herein designated VGAM HOST TARGET GENE, is a human gene contained in the human genome.

VGAM127 gene encodes a VGAM127 precursor RNA, herein designated VGAM PRECURSOR RNA. Similar to other miRNA genes, and unlike most ordinary genes, VGAM127 precursor RNA does not encode a protein. A nucleotide sequence identical or highly similar to the nucleotide sequence of VGAM127 precursor RNA is designated SEQ ID:113, and is provided hereinbelow with reference to the sequence listing part. Nucleotide sequence SEQ ID:113 is located at position 126505 relative to the genome of Shrimp White Spot Syndrome Virus (white spot baculiform virus).

VGAM127 precursor RNA folds onto itself, forming VGAM127 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM127 folded precursor RNA into VGAM127 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM127 RNA is designated SEQ ID:2838, and is provided hereinbelow with reference to the sequence listing part.

VGAM127 host target gene, herein designated VGAM HOST TARGET GENE, encodes a corresponding messenger RNA, VGAM127 host target RNA, herein designated VGAM HOST TARGET RNA. VGAM127 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM127 RNA, herein designated VGAM RNA, binds complementarily to one or more host target binding sites located in untranslated regions of VGAM127 host target RNA, herein designated VGAM HOST TARGET RNA. This complementary binding is due to the fact that the nucleotide sequence of VGAM127 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM127 RNA, herein designated VGAM RNA, may have a different number of host target binding sites in untranslated regions of a VGAM127 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM127 RNA, herein designated VGAM RNA, to host target binding sites on VGAM127 host target RNA, herein designated VGAM HOST TARGET RNA, such as BINDING SITE I, BINDING SITE II and BINDING SITE III, inhibits translation of VGAM127 host target RNA into VGAM127 host target protein, herein designated VGAM HOST TARGET PROTEIN. VGAM host target protein is therefore outlined by a broken line.

It is appreciated that VGAM127 host target gene, herein designated VGAM HOST TARGET GENE, in fact represents a plurality of VGAM127 host target genes. The mRNA of each one of this plurality of VGAM127 host target genes comprises one or more host target binding sites, each having a nucleotide sequence which is at least partly complementary to VGAM127 RNA, herein designated VGAM RNA, and which when bound by VGAM127 RNA causes inhibition of translation of respective one or more VGAM127 host target proteins.

It is further appreciated by one skilled in the art that the mode of translational inhibition illustrated by FIG. 1 with specific reference to translational inhibition exerted by VGAM127 gene, herein designated VGAM GENE, on one or more VGAM127 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM127 is inhibition of expression of host target genes, as part of a novel viral mechanism of attacking a host. Accordingly, utilities of VGAM127 include diagnosis, prevention and treatment of viral infection by Shrimp White Spot Syndrome Virus (white spot bacilliform virus). Specific functions, and accordingly utilities, of VGAM127 correlate with, and may be deduced from, the identity of the host target genes which VGAM127 binds and inhibits, and the function of these host target genes, as elaborated hereinbelow.

Nucleotide sequences of the VGAM127 precursor RNA, herein designated VGAM PRECURSOR RNA, and of the 'diced' VGAM127 RNA, herein designated VGAM RNA, and a schematic representation of the secondary folding of VGAM127 folded precursor RNA, herein designated VGAM FOLDED PRECURSOR RNA, of VGAM127 are further described hereinbelow with reference to Table 1.

Nucleotide sequences of host target binding sites, such as BINDING SITE-I, BINDING SITE-II and BINDING SITE-III of FIG. 1, found on VGAM127 host target RNA, and schematic representation of the complementarity of each of these host target binding sites to VGAM127 RNA, herein designated VGAM RNA, are described hereinbelow with reference to Table 2.

As mentioned hereinabove with reference to FIG. 1, a function of VGAM127 gene, herein designated VGAM is inhibition of expression of VGAM127 target genes. It is appreciated that specific functions, and accordingly utilities, of VGAM127 correlate with, and may be deduced from, the identity of the target genes which VGAM127 binds and inhibits, and the function of these target genes, as elaborated hereinbelow.

Multiple Endocrine Neoplasia I (MEN1, Accession NM_130803) is a VGAM127 host target gene. MEN1 BINDING SITE1 and MEN1 BINDING SITE2 are HOST TARGET binding sites found in untranslated regions of mRNA encoded by MEN1, corresponding to HOST TARGET binding sites such as BINDING SITE I, BINDING SITE II or BINDING SITE III. Table 2 illustrates the complementarity of the nucleotide sequences of MEN1 BINDING SITE1 and MEN1 BINDING SITE2, designated SEQ ID:28299 and SEQ ID:28303 respectively, to the nucleotide sequence of VGAM127 RNA, herein designated VGAM RNA, also designated SEQ ID:2838.

A function of VGAM127 is therefore inhibition of Multiple Endocrine Neoplasia I (MEN1, Accession NM_130803). Accordingly, utilities of VGAM127 include diagnosis, prevention and treatment of diseases and clinical conditions associated with MEN1. SMP1 (Accession NM_014313) is another VGAM127 host target gene. SMP1 BINDING SITE is HOST TARGET binding site found in the 3' untranslated region of mRNA encoded by SMP1, corresponding to a HOST TARGET binding site such as BINDING SITE I, BINDING SITE II or BINDING SITE III. Table 2 illustrates the complementarity of the nucleotide sequences of SMP1 BINDING SITE, designated SEQ ID:15611, to the nucleotide sequence of VGAM127 RNA, herein designated VGAM RNA, also designated SEQ ID:2838.

Another function of VGAM127 is therefore inhibition of SMP1 (Accession NM_014313), a gene which is a potential integral membrane protein. Accordingly, utilities of VGAM127 include diagnosis, prevention and treatment of diseases and clinical conditions associated with SMP1. The function of SMP1 has been established by previous studies. Wagner and Flegel (2000) found that the RH cluster on chromosome 1p contains 3 genes: RHD (OMIM Ref. No. 111680), RHCE (OMIM Ref. No. 111700), and SMP1. They noted that the nucleotide sequence of SMP1 had been deposited in GenBank (AF091282) as encoding a putative 157-amino acid member of an 18-kD small membrane protein family and that the gene shows homology to an open reading frame on chromosome 21 (Reboul et al., 1999). The position of the gene between both RH genes implies that any polymorphism of the SMP1 gene would be tightly linked to a specific RH haplotype. The authors suggested that functionally relevant mutations of the SMP1 gene may cause selection pressure for or against specific RH haplotypes. Such factors might explain some previously unresolved issues of RH haplotype distribution, such as the high frequency of RH-negativity in the European population.

Full details of the abovementioned studies are described in the following publications, the disclosure of which are hereby incorporated by reference:

Reboul, J.; Gardiner, K.; Monneron, D.; Uze, G.; Lutfalla, G.: Comparative genomic analysis of the interferon/interleukin-10 receptor gene cluster. Genome Res. 9:242-250, 1999; and Wagner, F. F.; Flegel, W. A.: RHD gene deletion occurred in the Rhesus box. Blood 95:3662-3668, 2000.

Further studies establishing the function and utilities of SMP1 are found in John Hopkins OMIM database record ID 605348, and in sited publications numbered 6179 listed in the bibliography section hereinbelow, which are also hereby incorporated by reference. Xylulokinase Homolog (H. influenzae) (XYLB, Accession NM_005108) is another VGAM127 host target gene. XYLB BINDING SITE is HOST TARGET binding site found in the 3' untranslated region of mRNA encoded by XYLB, corresponding to a HOST TARGET binding site such as BINDING SITE I, BINDING SITE II or BINDING SITE III. Table 2 illustrates the complementarity of the nucleotide sequences of XYLB BINDING SITE, designated SEQ ID:11583, to the nucleotide sequence of VGAM127 RNA, herein designated VGAM RNA, also designated SEQ ID:2838.

Another function of VGAM127 is therefore inhibition of Xylulokinase Homolog (H. influenzae) (XYLB, Accession NM_005108), a gene which is similar to Haemophilus influenzae xylulokinase and may play a role in energy metabolism. Accordingly, utilities of VGAM127 include diagnosis, prevention and treatment of diseases and clinical conditions associated with XYLB. The function of XYLB has been established by previous studies. The 3p22-p21.3 chromosomal region is one of 3 regions of 3p that is commonly deleted in various carcinomas. By analysis of a cloned segment from this region, Tamari et al. (1998) identified a novel gene, which they designated XYLB because the predicted 528-amino acid protein shares 22% identity with Hemophilus influenzae xylulokinase (Xyl). The XYLB gene contains 18 exons and spans approximately 28 kb. Northern blot analysis revealed that XYLB was expressed as a 2.3-kb major transcript in all tissues tested. A less abundant 1.8-kb mRNA was detected in heart and skeletal muscle. Daigo et al. (1999) reported that the XYLB gene is located between the OCTL2 (OMIM Ref. No. 604048) and ActRIIB (OMIM Ref. No. 602730) genes on 3p22-p21.3.

Full details of the abovementioned studies are described in the following publications, the disclosure of which are hereby incorporated by reference:

Daigo, Y.; Isomura, M.; Nishiwaki, T.; Tamari, M.; Ishikawa, S.; Kai, M.; Murata, Y.; Takeuchi, K.; Yamane, Y.; Hayashi, R.; Minami, M.; Fujino, M. A.; Hojo, Y.; Uchiyama, I.; Takagi, T.; Nakamura, Y.: Characterization of a 1200-kb genomic segment of chromosome 3p22-p21.3. DNA Res. 6:37-44, 1999; and Tamari, M.; Daigo, Y.; Ishikawa, S.; Nakamura, Y.: Genomic structure of a novel human gene (XYLB) on chromosome 3p22-p21.3 encoding a xylulokinase-like protein. Cytogenet. Cell Genet.

Further studies establishing the function and utilities of XYLB are found in John Hopkins OMIM database record ID 604049, and in sited publications numbered 9037 listed in the bibliography section hereinbelow, which are also hereby incorporated by reference. Heterogeneous Nuclear Ribonucleoprotein C (C1/C2) (HNRPC, Accession NM_031314) is another VGAM127 host target gene. HNRPC BINDING SITE is HOST TARGET binding site found in the 3' untranslated region of mRNA encoded by HNRPC, corresponding to a HOST TARGET binding site such as BINDING SITE I, BINDING SITE II or BINDING SITE III. Table 2 illustrates the complementarity of the nucleotide sequences of HNRPC BINDING SITE, designated SEQ ID:25350, to the nucleotide sequence of VGAM127 RNA, herein designated VGAM RNA, also designated SEQ ID:2838.

Another function of VGAM127 is therefore inhibition of Heterogeneous Nuclear Ribonucleoprotein C (C1/C2) (HNRPC, Accession NM_031314). Accordingly, utilities of VGAM127 include diagnosis, prevention and treatment of diseases and clinical conditions associated with HNRPC. KIAA1364 (Accession XM_032997) is another VGAM127 host target gene. KIAA1364 BINDING SITE is HOST TARGET binding site found in the 3' untranslated region of mRNA encoded by KIAA1364, corresponding to a HOST TARGET binding site such as BINDING SITE I, BINDING SITE II or BINDING SITE III. Table 2 illustrates the complementarity of the nucleotide sequences of KIAA1364 BINDING SITE, designated SEQ ID:31815, to the nucleotide sequence of VGAM127 RNA, herein designated VGAM RNA, also designated SEQ ID:2838.

Another function of VGAM127 is therefore inhibition of KIAA1364 (Accession XM_032997). Accordingly, utilities of VGAM127 include diagnosis, prevention and treatment of diseases and clinical conditions associated with KIAA1364. KR18 (Accession NM_033288) is another VGAM127 host target gene. KR18 BINDING SITE is HOST TARGET binding site found in the 3' untranslated region of mRNA encoded by KR18, corresponding to a HOST TARGET binding site such as BINDING SITE I, BINDING SITE II or BINDING SITE III. Table 2 illustrates the complementarity of the nucleotide sequences of KR18 BINDING SITE, designated SEQ ID:27122, to the nucleotide sequence of VGAM127 RNA, herein designated VGAM RNA, also designated SEQ ID:2838.

Another function of VGAM127 is therefore inhibition of KR18 (Accession NM_033288). Accordingly, utilities of VGAM127 include diagnosis, prevention and treatment of diseases and clinical conditions associated with KR18. LOC221103 (Accession XM_167758) is another VGAM127 host target gene. LOC221103 BINDING SITE is HOST TARGET binding site found in the 5' untranslated region of mRNA encoded by LOC221103, corresponding to a HOST TARGET binding site such as BINDING SITE I, BINDING SITE II or BINDING SITE III. Table 2 illustrates the complementarity of the nucleotide sequences of LOC221103 BINDING SITE, designated SEQ ID:44777, to the nucleotide sequence of VGAM127 RNA, herein designated VGAM RNA, also designated SEQ ID:2838.

Another function of VGAM127 is therefore inhibition of LOC221103 (Accession XM_167758). Accordingly, utilities of VGAM127 include diagnosis, prevention and treatment of diseases and clinical conditions associated with LOC221103. LOC90333 (Accession XM_030958) is another VGAM127 host target gene. LOC90333 BINDING SITE is HOST TARGET binding site found in the 3' untranslated region of mRNA encoded by LOC90333, corresponding to a HOST TARGET binding site such as BINDING SITE I, BINDING SITE II or BINDING SITE III. Table 2 illustrates the complementarity of the nucleotide sequences of LOC90333 BINDING SITE, designated SEQ ID:31228, to the nucleotide sequence of VGAM127 RNA, herein designated VGAM RNA, also designated SEQ ID:2838.

Another function of VGAM127 is therefore inhibition of LOC90333 (Accession XM_030958). Accordingly, utilities of VGAM127 include diagnosis, prevention and treatment of diseases and clinical conditions associated with LOC90333. FIG. 1 further provides a conceptual description of a novel bioinformatically detected viral gene of the present invention, referred to here as Viral Genomic Address Messenger 128 (VGAM128) viral gene, which modulates expression of respective host target genes thereof, the function and utility of which host target genes is known in the art.

VGAM128 is a novel bioinformatically detected regulatory, non protein coding, viral micro RNA (miRNA) gene. The method by which VGAM128 was detected is described hereinabove with reference to FIGS. 1-8.

VGAM128 gene, herein designated VGAM GENE, is a viral gene contained in the genome of Shrimp White Spot Syndrome Virus (white spot bacilliform virus). VGAM128 host target gene, herein designated VGAM HOST TARGET GENE, is a human gene contained in the human genome.

VGAM128 gene encodes a VGAM128 precursor RNA, herein designated VGAM PRECURSOR RNA. Similar to other miRNA genes, and unlike most ordinary genes, VGAM128 precursor RNA does not encode a protein. A nucleotide sequence identical or highly similar to the nucleotide sequence of VGAM128 precursor RNA is designated SEQ ID:114, and is provided hereinbelow with reference to the sequence listing part. Nucleotide sequence SEQ ID:114 is located at position 46000 relative to the genome of Shrimp White Spot Syndrome Virus (white spot bacilliform virus).

VGAM128 precursor RNA folds onto itself, forming VGAM128 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM128 folded precursor RNA into VGAM128 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM128 RNA is designated SEQ ID:2839, and is provided hereinbelow with reference to the sequence listing part.

VGAM128 host target gene, herein designated VGAM HOST TARGET GENE, encodes a corresponding messenger RNA, VGAM128 host target RNA, herein designated VGAM HOST TARGET RNA. VGAM128 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM128 RNA, herein designated VGAM RNA, binds complementarily to one or more host target binding sites located in untranslated regions of VGAM128 host target RNA, herein designated VGAM HOST TARGET RNA. This complementary binding is due to the fact that the nucleotide sequence of VGAM128 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM128 RNA, herein designated VGAM RNA, may have a different number of host target binding sites in untranslated regions of a VGAM128 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM128 RNA, herein designated VGAM RNA, to host target binding sites on VGAM128 host target RNA, herein designated VGAM HOST TARGET RNA, such as BINDING SITE I, BINDING SITE II and BINDING SITE III, inhibits translation of VGAM128 host target RNA into VGAM128 host target protein, herein designated VGAM HOST TARGET PROTEIN. VGAM host target protein is therefore outlined by a broken line.

It is appreciated that VGAM128 host target gene, herein designated VGAM HOST TARGET GENE, in fact represents a plurality of VGAM128 host target genes. The mRNA of each one of this plurality of VGAM128 host target genes comprises one or more host target binding sites, each having a nucleotide sequence which is at least partly complementary to VGAM128 RNA, herein designated VGAM RNA, and which when bound by VGAM128 RNA causes inhibition of translation of respective one or more VGAM128 host target proteins.

It is further appreciated by one skilled in the art that the mode of translational inhibition illustrated by FIG. 1 with specific reference to translational inhibition exerted by VGAM128 gene, herein designated VGAM GENE, on one or more VGAM128 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM128 is inhibition of expression of host target genes, as part of a novel viral mechanism of attacking a host. Accordingly, utilities of VGAM128 include diagnosis, prevention and treatment of viral infection by Shrimp White Spot Syndrome Virus (white spot bacilliform virus). Specific functions, and accordingly utilities, of VGAM128 correlate with, and may be deduced from, the identity of the host target genes which VGAM128 binds and inhibits, and the function of these host target genes, as elaborated hereinbelow.

Nucleotide sequences of the VGAM128 precursor RNA, herein designated VGAM PRECURSOR RNA, and of the 'diced' VGAM128 RNA, herein designated VGAM RNA, and a schematic representation of the secondary folding of VGAM128 folded precursor RNA, herein designated VGAM FOLDED PRECURSOR RNA, of VGAM128 are further described hereinbelow with reference to Table 1.

Nucleotide sequences of host target binding sites, such as BINDING SITE-I, BINDING SITE-II and BINDING SITE-III of FIG. 1, found on VGAM128 host target RNA, and schematic representation of the complementarity of each of these host target binding sites to VGAM128 RNA, herein designated VGAM RNA, are described hereinbelow with reference to Table 2.

As mentioned hereinabove with reference to FIG. 1, a function of VGAM128 gene, herein designated VGAM is inhibition of expression of VGAM128 target genes. It is appreciated that specific functions, and accordingly utilities, of VGAM128 correlate with, and may be deduced from, the identity of the target genes which VGAM128 binds and inhibits, and the function of these target genes, as elaborated hereinbelow.

Cyclin D2 (CCND2, Accession NM_001759) is a VGAM128 host target gene. CCND2 BINDING SITE is HOST TARGET binding site found in the 3' untranslated region of mRNA encoded by CCND2, corresponding to a HOST TARGET binding site such as BINDING SITE I, BINDING SITE II or BINDING SITE III. Table 2 illustrates the complementarity of the nucleotide sequences of CCND2 BINDING SITE, designated SEQ ID:7520, to the nucleotide sequence of VGAM128 RNA, herein designated VGAM RNA, also designated SEQ ID:2839.

A function of VGAM128 is therefore inhibition of Cyclin D2 (CCND2, Accession NM_001759), a gene which is essential for the control of the cell cycle at the g1/s (start) transition. Accordingly, utilities of VGAM128 include diagnosis, prevention and treatment of diseases and clinical conditions associated with CCND2. The function of CCND2 has been established by previous studies. Inaba et al. (1992) used murine cDNA clones for 3 cyclin D genes that are normally expressed during the G1 phase of the cell cycle to clone the cognate human genes. By analysis of somatic cell hybrids containing different human chromosomes and by fluorescence in situ hybridization, they assigned the gene for cyclin D2 (CCND2) to 12p13. (Since the CCND1 gene (OMIM Ref. No. 168461) is on 11q13, this may be another bit of evidence of the homology of chromosomes 11 and 12.) Xiong et al. (1992) reported the cloning of the CCND2 gene and its assignment to 12p13 by fluorescence in situ hybridization. A pseudogene of CCND2 was mapped to 11q13 by Inaba et al. (1992). Kim et al. (2000) used Ccnd1- and Ccnd2-deficient mice to investigate the role of cyclins in Schwann cell growth. They concluded that neither Ccnd1 nor Ccnd2 is specifically required for the initial growth and maturation of Schwann cells during mouse development (see OMIM Ref. No. CCND1; 168461).

Full details of the abovementioned studies are described in the following publications, the disclosure of which are hereby incorporated by reference:

Inaba, T.; Matsushime, H.; Valentine, M.; Roussel, M. F.; Sherr, C. J.; Look, A. T.: Genomic organization, chromosomal localization, and independent expression of human cyclin D genes. Genomics 13:565-574, 1992; and Kim, H. A.; Pomeroy, S. L.; Whoriskey, W.; Pawlitzky, I.; Benowitz, L. I.; Sicinski, P.; Stiles, C. D.; Roberts, T. M.: A developmentally regulated switch directs regenerative growth o.

Further studies establishing the function and utilities of CCND2 are found in John Hopkins OMIM database record ID 123833, and in sited publications numbered 4343-4345 listed in the bibliography section hereinbelow, which are also hereby incorporated by reference. Cerebellar Degeneration-related Protein 2, 62 kDa (CDR2, Accession XM_071866) is another VGAM128 host target gene. CDR2 BINDING SITE is HOST TARGET binding site found in the 5' untranslated region of mRNA encoded by CDR2, corresponding to a HOST TARGET binding site such as BINDING SITE I, BINDING SITE II or BINDING SITE III. Table 2 illustrates the complementarity of the nucleotide sequences of CDR2 BINDING SITE, designated SEQ ID:37427, to the nucleotide sequence of VGAM128 RNA, herein designated VGAM RNA, also designated SEQ ID:2839.

Another function of VGAM128 is therefore inhibition of Cerebellar Degeneration-related Protein 2, 62 kDa (CDR2, Accession XM_071866), a gene which plays a role in cytokinesis, cell shape, and functions such as secretion and capping. Accordingly, utilities of VGAM128 include diagnosis, prevention and treatment of diseases and clinical conditions associated with CDR2. The function of CDR2 has been established by previous studies. Paraneoplastic cerebellar degeneration is an autoimmune disorder associated with neoplasms of lung, ovary, breast, or Hodgkin disease. Patients with paraneoplastic cerebellar degeneration carry a characteristic antibody called anti-Yo. On Western blot analysis of Purkinje cells and tumor tissue, the anti-Yo sera react with at least 2 antigens, a major species of 62 kD called CDR62 and a minor species of 34 kD called CDR34, where CDR means cerebellar degeneration-related. CDR34 is encoded by a gene on the X chromosome (CDR1; 302650). Furneaux et al. (1990) cloned and characterized the gene encoding CDR62, a leucine-zipper DNA-binding protein; see Fathallah-Shaykh et al. (1991). By a combination of study of rodent/human somatic cell hybrids and in situ hybridization, Gress et al. (1991, 1992) assigned the CDR2 gene to 16p13.1-p12. The gene is positioned in an interval that contains 2 rare heritable fragile sites. Fletcher et al. (1997) determined the mouse chromosomal locations of 9 genes that encode ‘onconeuronal antigens,’ i.e., antigens that are expressed by systemic tumors and elicit an immune response that may develop into an autoimmune neuronal degeneration. One of these genes was the Cdr2 gene, which they mapped to mouse chromosome 7 in a region of homology to 16p13.1-p12.

Full details of the abovementioned studies are described in the following publications, the disclosure of which are hereby incorporated by reference:

Fathallah-Shaykh, H.; Wolf, S.; Wong, E.; Posner, J. B.: Cloning of a leucine-zipper protein recognized by the sera of patients with antibody-associated paraneoplastic cerebellar degeneration. Proc. Nat. Acad. Sci. 88:3451-3454, 1991; and Furneaux, H. M.; Rosenblum, M. K.; Dalmau, J.; Wong, E.; Woodruff, P.; Graus, F.; Posner, J. B.: Selective expression of Purkinje-cell antigens in tumor tissue from patients with parane.

Further studies establishing the function and utilities of CDR2 are found in John Hopkins OMIM database record ID 117340, and in sited publications numbered 12686, 10638-1063 and 12687-12688 listed in the bibliography section hereinbelow, which are also hereby incorporated by reference. MAX Interacting Protein 1 (MXI1, Accession NM_005962) is another VGAM128 host target gene. MXI1 BINDING SITE1 and MXI1 BINDING SITE2 are HOST TARGET binding sites found in untranslated regions of mRNA encoded by MXI1, corresponding to HOST TARGET binding sites such as BINDING SITE I, BINDING SITE II or BINDING SITE III. Table 2 illustrates the complementarity of the nucleotide sequences of MXI1 BINDING SITE1 and MXI1 BINDING SITE2, designated SEQ ID:12586 and SEQ ID:28196 respectively, to the nucleotide sequence of VGAM128 RNA, herein designated VGAM RNA, also designated SEQ ID:2839.

Another function of VGAM128 is therefore inhibition of MAX Interacting Protein 1 (MXI1, Accession NM_005962), a gene which acts as a tumor suppressor in vivo, engages the MYC network in a functionally relevant manner. Accordingly, utilities of VGAM128 include diagnosis, prevention and treatment of diseases and clinical conditions associated with MXI1. The function of MXI1 has been established by previous studies. One of the most common chromosomal abnormalities in prostate cancer involves loss of 10q22-qter. Rarely, a smaller deletion, involving 10q24-q25 has been observed, suggesting the presence of a tumor suppressor gene at that site. Prochownik et al. (1998) prospectively evaluated prostate tumors for loss of MXI1 by FISH and cytogenetic techniques. Of 40 tumors, 21 (53%) demonstrated loss of a single MXI1 allele, as determined by FISH. In 10 cases with cytogenetically normal long arms of chromosome 10, but with FISH-documented deletion of MXI1, 8 mutations of MXI1 were identified. Five of the mutant proteins were incapable of binding DNA in association with MAX. Prochownik et al. (1998) concluded that MXI1 gene loss in prostate cancer is common and most frequently involves a cytogenetically undetectable deletion. Animal model experiments lend further support to the function of MXI1. MXI1 belongs to the family of proteins that function as potent antagonists of MYC oncoproteins. This antagonism relates to their ability to compete with MYC for the protein MAX and for consensus DNA binding sites and to recruit Sin3 proteins and their associated corepressors. Schreiber-Agus et al. (1998) disrupted the Mxi1 open reading frame in transgenic mice by eliminating an exon required for the production of the 2 mouse Mxi1 isoforms. They showed that the mice lacking Mxi1 exhibit progressive multisystem abnormalities. The mice also showed increased susceptibility to tumorigenesis either following carcinogen treatment or when also deficient in INK4A (OMIM Ref. No. 600160). This cancer-prone phenotype may correspond with the enhanced ability of several MXI1-deficient cell types, including prostatic epithelium, to proliferate. The results show that MXI1 is involved in the homeostasis of differentiated organ systems, acts as a tumor suppressor in vivo, and engages the MYC network in a functionally relevant manner. In histologic studies of the mice, Schreiber-Agus et al. (1998) focused particularly on organs that normally express high or sustained levels of Mxi1, e.g., brain, spleen, kidney, and liver, and on tissue types that are susceptible to tumorigenesis when a putative tumor suppressor is lost from the 10q24-q26 region; for example, the spleen and thymus are susceptible to T-cell leukemia, the prostatic epithelium to prostate cancer, and the brain to glioblastoma multiforme when the 10q24-q26 region is mutated.

It is appreciated that the abovementioned animal model for MXI1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Prochownik, E. V.; Grove, L. E.; Deubler, D.; Zhu, X. L.; Stephenson, R. A.; Rohr, L. R.; Yin, X.; Brothman, A. R.: Commonly occurring loss and mutation of the MXI1 gene in prostate cancer. Genes Chromosomes Cancer 22:295-304, 1998; and Schreiber-Agus, N.; Meng, Y.; Hoang, T.; Hou, H., Jr.; Chen, K.; Greenberg, R.; Cordon-Cardo, C.; Lee, H.-W.; DePinho, R. A.: Role of Mxi1 in ageing organ systems and the regulation of.

Further studies establishing the function and utilities of MXI1 are found in John Hopkins OMIM database record ID 600020, and in sited publications numbered 8791, 8230, 8326-832 and 12617-8332 listed in the bibliography section hereinbelow, which are also hereby incorporated by reference. Staufen, RNA Binding Protein, Homolog 2 (Drosophila) (STAU2, Accession NM_014393) is another VGAM128 host target gene. STAU2 BINDING SITE is HOST TARGET binding site found in the 3' untranslated region of mRNA encoded by STAU2, corresponding to a HOST TARGET binding site such as BINDING SITE I, BINDING SITE II or BINDING SITE III. Table 2 illustrates the complementarity of the nucleotide sequences of STAU2 BINDING SITE, designated SEQ ID:15721, to the nucleotide sequence of VGAM128 RNA, herein designated VGAM RNA, also designated SEQ ID:2839.

Another function of VGAM128 is therefore inhibition of Staufen, RNA Binding Protein, Homolog 2 (Drosophila) (STAU2, Accession NM_014393). Accordingly, utilities of VGAM128 include diagnosis, prevention and treatment of diseases and clinical conditions associated with STAU2. ALDH9 (Accession NM_000696) is another VGAM128 host target gene. ALDH9 BINDING SITE is HOST TARGET binding site found in the 5' untranslated region of mRNA encoded by ALDH9, corresponding to a HOST TARGET binding site such as BINDING SITE I, BINDING SITE II or BINDING SITE III. Table 2 illustrates the complementarity of the nucleotide sequences of ALDH9 BINDING SITE, designated SEQ ID:6361, to the nucleotide sequence of VGAM128 RNA, herein designated VGAM RNA, also designated SEQ ID:2839.

Another function of VGAM128 is therefore inhibition of ALDH9 (Accession NM_000696). Accordingly, utilities of VGAM128 include diagnosis, prevention and treatment of diseases and clinical conditions associated with ALDH9. FKSG44 (Accession NM_031904) is another VGAM128 host target gene. FKSG44 BINDING SITE is HOST TARGET binding site found in the 3' untranslated region of mRNA encoded by FKSG44, corresponding to a HOST TARGET binding site such as BINDING SITE I, BINDING SITE II or BINDING SITE III. Table 2 illustrates the complementarity of the nucleotide sequences of FKSG44 BINDING SITE, designated SEQ ID:25649, to the nucleotide sequence of VGAM128 RNA, herein designated VGAM RNA, also designated SEQ ID:2839.

Another function of VGAM128 is therefore inhibition of FKSG44 (Accession NM_031904). Accordingly, utilities of VGAM128 include diagnosis, prevention and treatment of diseases and clinical conditions associated with FKSG44. FLJ20232 (Accession NM_019008) is another VGAM128 host target gene. FLJ20232 BINDING SITE is HOST TARGET binding site found in the 3' untranslated region of mRNA encoded by FLJ20232, corresponding to a HOST TARGET binding site such as BINDING SITE I, BINDING SITE II or BINDING SITE III. Table 2 illustrates the complementarity of the nucleotide sequences of FLJ20232 BINDING SITE, designated SEQ ID:21086, to the nucleotide sequence of VGAM128 RNA, herein designated VGAM RNA, also designated SEQ ID:2839.

Another function of VGAM128 is therefore inhibition of FLJ20232 (Accession NM_019008). Accordingly, utilities of VGAM128 include diagnosis, prevention and treatment of diseases and clinical conditions associated with FLJ20232. GAPCENA (Accession NM_012197) is another VGAM128 host target gene. GAPCENA BINDING SITE is HOST TARGET binding site found in the 3' untranslated region of mRNA encoded by GAPCENA, corresponding to a HOST TARGET binding site such as BINDING SITE I, BINDING SITE II or BINDING SITE III. Table 2 illustrates the complementarity of the nucleotide sequences of GAPCENA BINDING SITE, designated SEQ ID:14492, to the nucleotide sequence of VGAM128 RNA, herein designated VGAM RNA, also designated SEQ ID:2839.

Another function of VGAM128 is therefore inhibition of GAPCENA (Accession NM_012197). Accordingly, utilities of VGAM128 include diagnosis, prevention and treatment of diseases and clinical conditions associated with GAPCENA. KIAA1040 (Accession XM_051091) is another VGAM128 host target gene. KIAA1040 BINDING SITE is HOST TARGET binding site found in the 3' untranslated region of mRNA encoded by KIAA1040, corresponding to a HOST TARGET binding site such as BINDING SITE I, BINDING SITE II or BINDING SITE III. Table 2 illustrates the complementarity of the nucleotide sequences of KIAA1040 BINDING SITE, designated SEQ ID:35737, to the nucleotide sequence of VGAM128 RNA, herein designated VGAM RNA, also designated SEQ ID:2839.

Another function of VGAM128 is therefore inhibition of KIAA1040 (Accession XM_051091). Accordingly, utilities of VGAM128 include diagnosis, prevention and treatment of diseases and clinical conditions associated with KIAA1040. KIAA1165 (Accession XM_041162) is another VGAM128 host target gene. KIAA1165 BINDING SITE is HOST TARGET binding site found in the 3' untranslated region of mRNA encoded by KIAA1165, corresponding to a HOST TARGET binding site such as BINDING SITE I, BINDING SITE II or BINDING SITE III. Table 2 illustrates the complementarity of the nucleotide sequences of KIAA1165 BINDING SITE, designated SEQ ID:33473, to the nucleotide sequence of VGAM128 RNA, herein designated VGAM RNA, also designated SEQ ID:2839.

Another function of VGAM128 is therefore inhibition of KIAA1165 (Accession XM_041162). Accordingly, utilities of VGAM128 include diagnosis, prevention and treatment of diseases and clinical conditions associated with KIAA1165. KIAA1913 (Accession XM_058167) is another VGAM128 host target gene. KIAA1913 BINDING SITE is HOST TARGET binding site found in the 5' untranslated region of mRNA encoded by KIAA1913, corresponding to a HOST TARGET binding site such as BINDING SITE I, BINDING SITE II or BINDING SITE III. Table 2 illustrates the complementarity of the nucleotide sequences of KIAA1913 BINDING SITE, designated SEQ ID:36577, to the nucleotide sequence of VGAM128 RNA, herein designated VGAM RNA, also designated SEQ ID:2839.

Another function of VGAM128 is therefore inhibition of KIAA1913 (Accession XM_058167). Accordingly, utilities of VGAM128 include diagnosis, prevention and treatment of diseases and clinical conditions associated with KIAA1913. Mitochondrial Ribosomal Protein L35 (MRPL35, Accession NM_016622) is another VGAM128 host target gene. MRPL35 BINDING SITE is HOST TARGET binding site found in the 3' untranslated region of mRNA encoded by MRPL35, corresponding to a HOST TARGET binding site such as BINDING SITE I, BINDING SITE II or BINDING SITE III. Table 2 illustrates the complementarity of the nucleotide sequences of MRPL35 BINDING SITE, designated SEQ ID:18738, to the nucleotide sequence of VGAM128 RNA, herein designated VGAM RNA, also designated SEQ ID:2839.

Another function of VGAM128 is therefore inhibition of Mitochondrial Ribosomal Protein L35 (MRPL35, Accession NM_016622). Accordingly, utilities of VGAM128 include diagnosis, prevention and treatment of diseases and clinical conditions associated with MRPL35. Oxysterol Binding Protein-like 7 (OSBPL7, Accession NM_017731) is another VGAM128 host target gene. OSBPL7 BINDING SITE is HOST TARGET binding site found in the 5' untranslated region of mRNA encoded by OSBPL7, corresponding to a HOST TARGET binding site such as BINDING SITE I, BINDING SITE II or BINDING SITE III. Table 2 illustrates the complementarity of the nucleotide sequences of OSBPL7 BINDING SITE, designated SEQ ID:19318, to the nucleotide sequence of VGAM128 RNA, herein designated VGAM RNA, also designated SEQ ID:2839.

Another function of VGAM128 is therefore inhibition of Oxysterol Binding Protein-like 7 (OSBPL7, Accession NM_017731). Accordingly, utilities of VGAM128 include diagnosis, prevention and treatment of diseases and clinical conditions associated with OSBPL7. Sep.in 3 (SEPT3, Accession NM_019106) is another VGAM128 host target gene. SEPT3 BINDING SITE is HOST TARGET binding site found in the 3' untranslated region of mRNA encoded by SEPT3, corresponding to a HOST TARGET binding site such as BINDING SITE I, BINDING SITE II or BINDING SITE III. Table 2 illustrates the complementarity of the nucleotide sequences of SEPT3 BINDING SITE, designated SEQ ID:21185, to the nucleotide sequence of VGAM128 RNA, herein designated VGAM RNA, also designated SEQ ID:2839.

Another function of VGAM128 is therefore inhibition of Sep.in 3 (SEPT3, Accession NM_019106). Accordingly, utilities of VGAM128 include diagnosis, prevention and treatment of diseases and clinical conditions associated with SEPT3. Solute Carrier Family 12 (potassium/chloride transporters), Member 8 (SLC12A8, Accession NM_024628) is another VGAM128 host target gene. SLC12A8 BINDING SITE is HOST TARGET binding site found in the 5' untranslated region of mRNA encoded by SLC12A8, corresponding to a HOST TARGET binding site such as BINDING SITE I, BINDING SITE II or BINDING SITE III. Table 2 illustrates the complementarity of the nucleotide sequences of SLC12A8 BINDING SITE, designated SEQ ID:23894, to the nucleotide sequence of VGAM128 RNA, herein designated VGAM RNA, also designated SEQ ID:2839.

Another function of VGAM128 is therefore inhibition of Solute Carrier Family 12 (potassium/chloride transporters), Member 8 (SLC12A8, Accession NM_024628). Accordingly, utilities of VGAM128 include diagnosis, prevention and treatment of diseases and clinical conditions associated with SLC12A8. LOC115123 (Accession XM_055276) is another VGAM128 host target gene. LOC115123 BINDING SITE is HOST TARGET binding site found in the 3' untranslated region of mRNA encoded by LOC115123, corresponding to a HOST TARGET binding site such as BINDING SITE I, BINDING SITE II or BINDING SITE III. Table 2 illustrates the complementarity of the nucleotide sequences of LOC115123 BINDING SITE, designated SEQ ID:36248, to the nucleotide sequence of VGAM128 RNA, herein designated VGAM RNA, also designated SEQ ID:2839.

Another function of VGAM128 is therefore inhibition of LOC115123 (Accession XM_055276). Accordingly, utilities of VGAM128 include diagnosis, prevention and treatment of diseases and clinical conditions associated with LOC115123. LOC116028 (Accession XM_057225) is another VGAM128 host target gene. LOC116028 BINDING SITE is HOST TARGET binding site found in the 3' untranslated region of mRNA encoded by LOC116028, corresponding to a HOST TARGET binding site such as BINDING SITE I, BINDING SITE II or BINDING SITE III. Table 2 illustrates the complementarity of the nucleotide sequences of LOC116028 BINDING SITE, designated SEQ ID:36493, to the nucleotide sequence of VGAM128 RNA, herein designated VGAM RNA, also designated SEQ ID:2839.

Another function of VGAM128 is therefore inhibition of LOC116028 (Accession XM_057225). Accordingly, utilities of VGAM128 include diagnosis, prevention and treatment of diseases and clinical conditions associated with LOC116028. LOC122553 (Accession XM_058630) is another VGAM128 host target gene. LOC122553 BINDING SITE is HOST TARGET binding site found in the 3' untranslated region of mRNA encoded by LOC122553, corresponding to a HOST TARGET binding site such as BINDING SITE I, BINDING SITE II or BINDING SITE III. Table 2 illustrates the complementarity of the nucleotide sequences of LOC122553 BINDING SITE, designated SEQ ID:36685, to the nucleotide sequence of VGAM128 RNA, herein designated VGAM RNA, also designated SEQ ID:2839.

Another function of VGAM128 is therefore inhibition of LOC122553 (Accession XM_058630). Accordingly, utilities of VGAM128 include diagnosis, prevention and treatment of diseases and clinical conditions associated with LOC122553. LOC145082 (Accession XM_096719) is another VGAM128 host target gene. LOC145082 BINDING SITE is HOST TARGET binding site found in the 5' untranslated region of mRNA encoded by LOC145082, corresponding to a HOST TARGET binding site such as BINDING SITE I, BINDING SITE II or BINDING SITE III. Table 2 illustrates the complementarity of the nucleotide sequences of LOC145082 BINDING SITE, designated SEQ ID:40494, to the nucleotide sequence of VGAM128 RNA, herein designated VGAM RNA, also designated SEQ ID:2839.

Another function of VGAM128 is therefore inhibition of LOC145082 (Accession XM_096719). Accordingly, utilities of VGAM128 include diagnosis, prevention and treatment of diseases and clinical conditions associated with LOC145082.

LOC145773 (Accession XM_085237) is another VGAM128 host target gene. LOC145773 BINDING SITE is HOST TARGET binding site found in the 3' untranslated region of mRNA encoded by LOC145773, corresponding to a HOST TARGET binding site such as BINDING SITE I, BINDING SITE II or BINDING SITE III. Table 2 illustrates the complementarity of the nucleotide sequences of LOC145773 BINDING SITE, designated SEQ ID:37985, to the nucleotide sequence of VGAM128 RNA, herein designated VGAM RNA, also designated SEQ ID:2839.

Another function of VGAM128 is therefore inhibition of LOC145773 (Accession XM_085237). Accordingly, utilities of VGAM128 include diagnosis, prevention and treatment of diseases and clinical conditions associated with LOC145773. LOC146237 (Accession XM_096954) is another VGAM128 host target gene. LOC146237 BINDING SITE is HOST TARGET binding site found in the 3' untranslated region of mRNA encoded by LOC146237, corresponding to a HOST TARGET binding site such as BINDING SITE I, BINDING SITE II or BINDING SITE III. Table 2 illustrates the complementarity of the nucleotide sequences of LOC146237 BINDING SITE, designated SEQ ID:40672, to the nucleotide sequence of VGAM128 RNA, herein designated VGAM RNA, also designated SEQ ID:2839.

Another function of VGAM128 is therefore inhibition of LOC146237 (Accession XM_096954). Accordingly, utilities of VGAM128 include diagnosis, prevention and treatment of diseases and clinical conditions associated with LOC146237. LOC150319 (Accession XM_086816) is another VGAM128 host target gene. LOC150319 BINDING SITE is HOST TARGET binding site found in the 3' untranslated region of mRNA encoded by LOC150319, corresponding to a HOST TARGET binding site such as BINDING SITE I, BINDING SITE II or BINDING SITE III. Table 2 illustrates the complementarity of the nucleotide sequences of LOC150319 BINDING SITE, designated SEQ ID:38894, to the nucleotide sequence of VGAM128 RNA, herein designated VGAM RNA, also designated SEQ ID:2839.

Another function of VGAM128 is therefore inhibition of LOC150319 (Accession XM_086816). Accordingly, utilities of VGAM128 include diagnosis, prevention and treatment of diseases and clinical conditions associated with LOC150319. LOC152348 (Accession XM_098204) is another VGAM128 host target gene. LOC152348 BINDING SITE is HOST TARGET binding site found in the 5' untranslated region of mRNA encoded by LOC152348, corresponding to a HOST TARGET binding site such as BINDING SITE I, BINDING SITE II or BINDING SITE III. Table 2 illustrates the complementarity of the nucleotide sequences of LOC152348 BINDING SITE, designated SEQ ID:41488, to the nucleotide sequence of VGAM128 RNA, herein designated VGAM RNA, also designated SEQ ID:2839.

Another function of VGAM128 is therefore inhibition of LOC152348 (Accession XM_098204). Accordingly, utilities of VGAM128 include diagnosis, prevention and treatment of diseases and clinical conditions associated with LOC152348. LOC201283 (Accession XM_017132) is another VGAM128 host target gene. LOC201283 BINDING SITE is HOST TARGET binding site found in the 3' untranslated region of mRNA encoded by LOC201283, corresponding to a HOST TARGET binding site such as BINDING SITE I, BINDING SITE II or BINDING SITE III. Table 2 illustrates the complementarity of the nucleotide sequences of LOC201283 BINDING SITE, designated SEQ ID:30303, to the nucleotide sequence of VGAM128 RNA, herein designated VGAM RNA, also designated SEQ ID:2839.

Another function of VGAM128 is therefore inhibition of LOC201283 (Accession XM_017132). Accordingly, utilities of VGAM128 include diagnosis, prevention and treatment of diseases and clinical conditions associated with LOC201283. LOC91397 (Accession XM_038219) is another VGAM128 host target gene. LOC91397 BINDING SITE is HOST TARGET binding site found in the 5' untranslated region of mRNA encoded by LOC91397, corresponding to a HOST TARGET binding site such as BINDING SITE I, BINDING SITE II or BINDING SITE III. Table 2 illustrates the complementarity of the nucleotide sequences of LOC91397 BINDING SITE, designated SEQ ID:32784, to the nucleotide sequence of VGAM128 RNA, herein designated VGAM RNA, also designated SEQ ID:2839.

Another function of VGAM128 is therefore inhibition of LOC91397 (Accession XM_038219). Accordingly, utilities of VGAM128 include diagnosis, prevention and treatment of diseases and clinical conditions associated with LOC91397. FIG. 1 further provides a conceptual description of a novel bioinformatically detected viral gene of the present invention, referred to here as Viral Genomic Address Messenger 129 (VGAM129) viral gene, which modulates expression of respective host target genes thereof, the function and utility of which host target genes is known in the art.

VGAM129 is a novel bioinformatically detected regulatory, non protein coding, viral micro RNA (miRNA) gene. The method by which VGAM129 was detected is described hereinabove with reference to FIGS. 1-8.

VGAM129 gene, herein designated VGAM GENE, is a viral gene contained in the genome of Shrimp White Spot Syndrome Virus (white spot bacilliform virus). VGAM129 host target gene, herein designated VGAM HOST TARGET GENE, is a human gene contained in the human genome.

VGAM129 gene encodes a VGAM129 precursor RNA, herein designated VGAM PRECURSOR RNA. Similar to other miRNA genes, and unlike most ordinary genes, VGAM129 precursor RNA does not encode a protein. A nucleotide sequence identical or highly similar to the nucleotide sequence of VGAM129 precursor RNA is designated SEQ ID:115, and is provided hereinbelow with reference to the sequence listing part. Nucleotide sequence SEQ ID:115 is located at position 285590 relative to the genome of Shrimp White Spot Syndrome Virus (white spot bacilliform virus).

VGAM129 precursor RNA folds onto itself, forming VGAM129 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM129 folded precursor RNA into VGAM129 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM129 RNA is designated SEQ ID:2840, and is provided hereinbelow with reference to the sequence listing part.

VGAM129 host target gene, herein designated VGAM HOST TARGET GENE, encodes a corresponding messenger RNA, VGAM129 host target RNA, herein designated VGAM HOST TARGET RNA. VGAM129 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM129 RNA, herein designated VGAM RNA, binds complementarily to one or more host target binding sites located in untranslated regions of VGAM129 host target RNA, herein designated VGAM HOST TARGET RNA. This complementary binding is due to the fact that the nucleotide sequence of VGAM129 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM129 RNA, herein designated VGAM RNA, may have a different number of host target binding sites in untranslated regions of a VGAM129 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM129 RNA, herein designated VGAM RNA, to host target binding sites on VGAM129 host target RNA, herein designated VGAM HOST TARGET RNA, such as BINDING SITE I, BINDING SITE II and BINDING SITE III, inhibits translation of VGAM129 host target RNA into VGAM129 host target protein, herein designated VGAM HOST TARGET PROTEIN. VGAM host target protein is therefore outlined by a broken line.

It is appreciated that VGAM129 host target gene, herein designated VGAM HOST TARGET GENE, in fact represents a plurality of VGAM129 host target genes. The mRNA of each one of this plurality of VGAM129 host target genes comprises one or more host target binding sites, each having a nucleotide sequence which is at least partly complementary to VGAM129 RNA, herein designated VGAM RNA, and which when bound by VGAM129 RNA causes inhibition of translation of respective one or more VGAM129 host target proteins.

It is further appreciated by one skilled in the art that the mode of translational inhibition illustrated by FIG. 1 with specific reference to translational inhibition exerted by VGAM129 gene, herein designated VGAM GENE, on one or more VGAM129 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM129 is inhibition of expression of host target genes, as part of a novel viral mechanism of attacking a host. Accordingly, utilities of VGAM129 include diagnosis, prevention and treatment of viral infection by Shrimp White Spot Syndrome Virus (white spot bacilliform virus). Specific functions, and accordingly utilities, of VGAM129 correlate with, and may be deduced from, the identity of the host target genes which VGAM129 binds and inhibits, and the function of these host target genes, as elaborated hereinbelow.

Nucleotide sequences of the VGAM129 precursor RNA, herein designated VGAM PRECURSOR RNA, and of the 'diced' VGAM129 RNA, herein designated VGAM RNA, and a schematic representation of the secondary folding of VGAM129 folded precursor RNA, herein designated VGAM FOLDED PRECURSOR RNA, of VGAM129 are further described hereinbelow with reference to Table 1.

Nucleotide sequences of host target binding sites, such as BINDING SITE-I, BINDING SITE-II and BINDING SITE-III of FIG. 1, found on VGAM129 host target RNA, and schematic representation of the complementarity of each of these host target binding sites to VGAM129 RNA, herein designated VGAM RNA, are described hereinbelow with reference to Table 2.

As mentioned hereinabove with reference to FIG. 1, a function of VGAM129 gene, herein designated VGAM is inhibition of expression of VGAM129 target genes. It is appreciated that specific functions, and accordingly utilities, of VGAM129 correlate with, and may be deduced from, the identity of the target genes which VGAM129 binds and inhibits, and the function of these target genes, as elaborated hereinbelow.

Diaphanous Homolog 2 (Drosophila) (DIAPH2, Accession NM_006729) is a VGAM129 host target gene. DIAPH2 BINDING SITE is HOST TARGET binding site found in the 3' untranslated region of mRNA encoded by DIAPH2, corresponding to a HOST TARGET binding site such as BINDING SITE I, BINDING SITE II or BINDING SITE III. Table 2 illustrates the complementarity of the nucleotide sequences of DIAPH2 BINDING SITE, designated SEQ ID:13560, to the nucleotide sequence of VGAM129 RNA, herein designated VGAM RNA, also designated SEQ ID:2840.

A function of VGAM129 is therefore inhibition of Diaphanous Homolog 2 (Drosophila) (DIAPH2, Accession NM_006729), a gene which may affect in oogenesis. Accordingly, utilities of VGAM129 include diagnosis, prevention and treatment of diseases and clinical conditions associated with DIAPH2. The function of DIAPH2 has been established by previous studies. Mutant alleles of Drosophila dia affect spermatogenesis or oogenesis and lead to sterility. Bione et al. (1998) characterized a human homolog of 'diaphanous' and demonstrated that this gene, designated DIA, is interrupted by a breakpoint in a patient with familial premature ovarian failure (POF; 311360). A human EST, DRES25, which showed significant homology with the Drosophila gene, was mapped to Xq22 by fluorescence in situ hybridization. Bione et al. (1998) found that the human DIA open reading frame encodes a 1,101-amino acid protein approximately 39% identical to the Drosophila protein. Northern blot analysis of human adult and fetal tissues detected 4 transcripts, 3 of which are expressed ubiquitously and the fourth exclusively in adult testis. Bione et al. (1998) showed that the DIA gene is expressed in developing ovaries and testis of the mouse, as well as in all other tissues, from the E16 stage. Banfi et al. (1997) had indicated that a human homolog of 'diaphanous' maps to Xq22. Lynch et al. (1997) noted that a nonsyndromic form of X-linked deafness, DFN2 (OMIM Ref. No. 304500), also maps to Xq22, making this homologous gene a candidate for DFN2 hearing loss. In the family of patient BC studied by Sala et al. (1997), a balanced X;12 translocation, t (X;12) (q21; p1.3), was associated with premature ovarian failure (OMIM Ref. No. 311360). Patient BC had secondary amenorrhea, with no other associated features, at the age of 17 years. Her mother, who carried the same chromosomal rearrangement, was diagnosed with premature menopause at the age of 32 years. At diagnosis, both mother and daughter had high gonadotropin levels and inactivation of the normal X chromosome (Philippe et al., 1993). The breakpoint was mapped, by FISH, to a specific YAC. The translocation breakpoint was found to be in the last 200-kb intron of the gene.

Full details of the abovementioned studies are described in the following publications, the disclosure of which are hereby incorporated by reference:

Bione, S.; Sala, C.; Manzini, C.; Arrigo, G.; Zuffardi, O.; Banfi, S.; Borsani, G.; Jonveaux, P.; Philippe, C.; Zuccotti, M.; Ballabio, A.; Toniolo, D.: A human homologue of the Drosophila melanogaster diaphanous gene is disrupted in a patient with premature ovarian failure: evidence for conserved function in oogenesis and implications for human sterility. Am. J. Hum. Genet. 62:533-541, 1998; and Philippe, C.; Cremers, F. P. M.; Chery, M.; Bach, I.; Abbadi, N.; Ropers, H. H.; Gilgenkrantz, S.: Physical mapping of DNA markers in the q13-q22 region of the human X chromosome. Genom.

Further studies establishing the function and utilities of DIAPH2 are found in John Hopkins OMIM database record ID 300108, and in sited publications numbered 9063, 9066, 906 and 9067 listed in the bibliography section hereinbelow, which are also hereby incorporated by reference. RAB36, Member RAS Oncogene Family (RAB36, Accession NM_004914) is another VGAM129 host target gene. RAB36 BINDING SITE is HOST TARGET binding site found in the 3' untranslated region of mRNA encoded by RAB36, corresponding to a HOST TARGET binding site such as BINDING SITE I, BINDING SITE II or BINDING SITE III. Table 2 illustrates the complementarity of the nucleotide sequences of RAB36 BINDING SITE, designated SEQ ID:11349, to the nucleotide sequence of VGAM129 RNA, herein designated VGAM RNA, also designated SEQ ID:2840.

Another function of VGAM129 is therefore inhibition of RAB36, Member RAS Oncogene Family (RAB36, Accession NM_004914), a gene which is involved in protein transport. Accordingly, utilities of VGAM129 include diagnosis, prevention and treatment of diseases and clinical conditions associated with RAB36. The function of RAB36 has been established by previous studies. Homozygous deletions at chromosome 22q11.2 are a recurrent cytogenetic characteristic of malignant rhabdoid tumors (MRTs), suggesting the presence of a tumor suppressor gene in this region. Mori et al. (1999) constructed a deletion map of the relevant part of 22q11.2 from a panel of 7 MRT cell lines, and isolated a novel gene from the center of the region. The gene, designated RAB36, spans approximately 19 kb of genomic DNA and contains 11 exons. It encodes a deduced 333-amino acid protein that contains 3 phosphate/magnesium-binding motifs, 3 guanine-binding motifs, a tyrosine kinase phosphorylation site, and a C-terminal isoprenylation signal. It shares high amino acid sequence identity with mouse Rab23 (OMIM Ref. No. 606144) and human RAB13 (OMIM Ref. No. 602672). Northern blot analysis revealed 4.0- and 2.2-kb mRNAs in all human tissues examined. The larger transcript contains a longer 3-prime noncoding sequence. RT-PCR analysis revealed expression of RAB36 mRNAs in 1 MRT cell line and overexpression in 2 others. Direct sequencing of cDNA from these 3 cell lines showed neither nonsense nor frameshift mutations. Moreover, a colony-formation assay indicated that RAB36 is not concerned with cell proliferation or cell death. The authors thus concluded that RAB36 does not have a tumor suppressor function. Immunofluorescence studies localized RAB36 at the Golgi body, suggesting that RAB36, like some other Rab family proteins, is involved in vesicular transport around the Golgi apparatus. By use of exon trapping and large-scale genomic sequence analysis of 2 BAC clones, Zhou et al. (2000) also isolated RAB36, as well as another gene, RTDR1 (OMIM Ref. No. 605663), in the 22q11.2 region. They determined that RAB36 contains 11 exons. They also found no RAB36 mutations in rhabdoid tumor samples.

Full details of the abovementioned studies are described in the following publications, the disclosure of which are hereby incorporated by reference:

Mori, T.; Fukuda, Y.; Kuroda, H.; Matsumura, T.; Ota, S.; Sugimoto, T.; Nakamura, Y.; Inazawa, J.: Cloning and characterization of a novel Rab-family gene, Rab36, within the region at 22q11.2 that is homozygously deleted in malignant rhabdoid tumors. Biochem. Biophys. Res. Commun. 254: 594-600, 1999; and Zhou, J.-Y.; Fogelgren, B.; Wang, Z.; Roe, B. A.; Biegel, J. A.: Isolation of genes from the rhabdoid tumor deletion region in chromosome band 22q11.2. Gene 241:133-141, 2000.

Further studies establishing the function and utilities of RAB36 are found in John Hopkins OMIM database record ID 605662, and in sited publications numbered 6412-6413 listed in the bibliography section hereinbelow, which are also hereby incorporated by reference. Sperm Associated Antigen 8 (SPAG8, Accession NM_012436) is another VGAM129 host target gene. SPAG8 BINDING SITE is HOST TARGET binding site found in the 3' untranslated region of mRNA encoded by SPAG8, corresponding to a HOST TARGET binding site such as BINDING SITE I, BINDING SITE II or BINDING SITE III. Table 2 illustrates the complementarity of the nucleotide sequences of SPAG8 BINDING SITE, designated SEQ ID:14815, to the nucleotide sequence of VGAM129 RNA, herein designated VGAM RNA, also designated SEQ ID:2840.

Another function of VGAM129 is therefore inhibition of Sperm Associated Antigen 8 (SPAG8, Accession NM_012436), a gene which is a Sperm plasma membrane antigens are attractive antifertility vaccine targets. Accordingly, utilities of VGAM129 include diagnosis, prevention and treatment of diseases and clinical conditions associated with SPAG8. The function of SPAG8 has been established by previous studies. Liu et al. (1996) obtained a full-length cDNA encoding SPAG8, which they termed SMP1. Sequence analysis predicted that the 523-amino acid type II transmembrane protein lacks a signal peptide but contains hydrophobic regions near the N and C termini that may function as transmembrane domains. Northern blot analysis detected a 2.45-kb transcript in testis. RT-PCR analysis revealed expression in testis but not in liver or kidney. Western blot analysis showed expression of a 55.5-kD protein, which is very similar to the predicted size. Immunofluorescence microscopy demonstrated expression in the acrosome of the sperm head. Using immunocytochemistry, Miao et al. (1995) found expression of SPAG8, which they called BS84 (84-kD Beijing sperm), in testis but not in brain, liver, or kidney. RNA dot blot hybridization analysis detected expression in testis but not in heart, brain, lung, or kidney. Autoradiographic analysis detected transcripts in spermatogonia, spermatocytes, and spermatid of seminiferous epithelium Full details of the abovementioned studies are described in the following publications, the disclosure of which are hereby incorporated by reference:

Liu, Q.-Y.; Wang, L. F.; Miao, S. Y.; Catterall, J. F.: Expression and characterization of a novel human sperm membrane protein. Biol. Reprod. 54: 323-330, 1996; and Miao, S.; Yan, Y.; Li, Y.; Bai, Y.; Wei, S.; Zong, C.; Zhao, M.; Zong, S.; Wang, L.: cDNA encoding a human sperm membrane protein BS-84. Prog. Natural Sci. 5:119-122, 1995.

Further studies establishing the function and utilities of SPAG8 are found in John Hopkins OMIM database record ID 605731, and in sited publications numbered 6915-6917 listed in the bibliography section hereinbelow, which are also hereby incorporated by reference. ZER6 (Accession XM_032742) is another VGAM129 host target gene. ZER6 BINDING SITE is HOST TARGET binding site found in the 3' untranslated region of mRNA encoded by ZER6, corresponding to a HOST TARGET binding site such as BINDING SITE I, BINDING SITE II or BINDING SITE III. Table 2 illustrates the complementarity of the nucleotide sequences of ZER6 BINDING SITE, designated SEQ ID:31740, to the nucleotide sequence of VGAM129 RNA, herein designated VGAM RNA, also designated SEQ ID:2840.

Another function of VGAM129 is therefore inhibition of ZER6 (Accession XM_032742). Accordingly, utilities of VGAM129 include diagnosis, prevention and treatment of diseases and clinical conditions associated with ZER6. LOC205795 (Accession XM_120472) is another VGAM129 host target gene. LOC205795 BINDING SITE is HOST TARGET binding site found in the 5' untranslated region of mRNA encoded by LOC205795, corresponding to a HOST TARGET binding site such as BINDING SITE I, BINDING SITE II or BINDING SITE III. Table 2 illustrates the complementarity of the nucleotide sequences of LOC205795 BINDING SITE, designated SEQ ID:43610, to the nucleotide sequence of VGAM129 RNA, herein designated VGAM RNA, also designated SEQ ID:2840.

Another function of VGAM129 is therefore inhibition of LOC205795 (Accession XM_120472). Accordingly, utilities of VGAM129 include diagnosis, prevention and treatment of diseases and clinical conditions associated with LOC205795. FIG. 1 further provides a conceptual description of a novel bioinformatically detected viral gene of the present invention, referred to here as Viral Genomic Address Messenger 130 (VGAM130) viral gene, which modulates expression of respective host target genes thereof, the function and utility of which host target genes is known in the art.

VGAM130 is a novel bioinformatically detected regulatory, non protein coding, viral micro RNA (miRNA) gene. The method by which VGAM130 was detected is described hereinabove with reference to FIGS. 1-8.

VGAM130 gene, herein designated VGAM GENE, is a viral gene contained in the genome of Shrimp White Spot Syndrome Virus (white spot baciliform virus). VGAM130 host target gene, herein designated VGAM HOST TARGET GENE, is a human gene contained in the human genome.

VGAM130 gene encodes a VGAM130 precursor RNA, herein designated VGAM PRECURSOR RNA. Similar to other miRNA genes, and unlike most ordinary genes, VGAM130 precursor RNA does not encode a protein. A nucleotide sequence identical or highly similar to the nucleotide sequence of VGAM130 precursor RNA is designated SEQ ID:116, and is provided hereinbelow with reference to the sequence listing part. Nucleotide sequence SEQ ID:116 is located at position 99873 relative to the genome of Shrimp White Spot Syndrome Virus (white spot baciliform virus).

VGAM130 precursor RNA folds onto itself, forming VGAM130 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM130 folded precursor RNA into VGAM130 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM130 RNA is designated SEQ ID:2841, and is provided hereinbelow with reference to the sequence listing part.

VGAM130 host target gene, herein designated VGAM HOST TARGET GENE, encodes a corresponding messenger RNA, VGAM130 host target RNA, herein designated VGAM HOST TARGET RNA. VGAM130 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM130 RNA, herein designated VGAM RNA, binds complementarily to one or more host target binding sites located in untranslated regions of VGAM130 host target RNA, herein designated VGAM HOST TARGET RNA. This complementary binding is due to the fact that the nucleotide sequence of VGAM130 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM130 RNA, herein designated VGAM RNA, may have a different number of host target binding sites in untranslated regions of a VGAM130 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM130 RNA, herein designated VGAM RNA, to host target binding sites on VGAM130 host target RNA, herein designated VGAM HOST TARGET RNA, such as BINDING SITE I, BINDING SITE II and BINDING SITE III, inhibits translation of VGAM130 host target RNA into VGAM130 host target protein, herein designated VGAM HOST TARGET PROTEIN. VGAM host target protein is therefore outlined by a broken line.

It is appreciated that VGAM130 host target gene, herein designated VGAM HOST TARGET GENE, in fact represents a plurality of VGAM130 host target genes. The mRNA of each one of this plurality of VGAM130 host target genes comprises one or more host target binding sites, each having a nucleotide sequence which is at least partly complementary to VGAM130 RNA, herein designated VGAM RNA, and which when bound by VGAM130 RNA causes inhibition of translation of respective one or more VGAM130 host target proteins.

It is further appreciated by one skilled in the art that the mode of translational inhibition illustrated by FIG. 1 with specific reference to translational inhibition exerted by VGAM130 gene, herein designated VGAM GENE, on one or more VGAM130 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM130 is inhibition of expression of host target genes, as part of a novel viral mechanism of attacking a host. Accordingly, utilities of VGAM130 include diagnosis, prevention and treatment of viral infection by Shrimp White Spot Syndrome Virus (white spot bacilliform virus). Specific functions, and accordingly utilities, of VGAM130 correlate with, and may be deduced from, the identity of the host target genes which VGAM130 binds and inhibits, and the function of these host target genes, as elaborated hereinbelow.

Nucleotide sequences of the VGAM130 precursor RNA, herein designated VGAM PRECURSOR RNA, and of the 'diced' VGAM130 RNA, herein designated VGAM RNA, and a schematic representation of the secondary folding of VGAM130 folded precursor RNA, herein designated VGAM FOLDED PRECURSOR RNA, of VGAM130 are further described hereinbelow with reference to Table 1.

Nucleotide sequences of host target binding sites, such as BINDING SITE-I, BINDING SITE-II and BINDING SITE-III of FIG. 1, found on VGAM130 host target RNA, and schematic representation of the complementarity of each of these host target binding sites to VGAM130 RNA, herein designated VGAM RNA, are described hereinbelow with reference to Table 2.

As mentioned hereinabove with reference to FIG. 1, a function of VGAM130 gene, herein designated VGAM is inhibition of expression of VGAM130 target genes. It is appreciated that specific functions, and accordingly utilities, of VGAM130 correlate with, and may be deduced from, the identity of the target genes which VGAM130 binds and inhibits, and the function of these target genes, as elaborated hereinbelow.

Fibroblast Growth Factor Receptor 1 (fms-related tyrosine kinase 2, Pfeiffer syndrome) (FGFR1, Accession NM_023107) is a VGAM130 host target gene. FGFR1 BINDING SITE1 and FGFR1 BINDING SITE2 are HOST TARGET binding sites found in untranslated regions of mRNA encoded by FGFR1, corresponding to HOST TARGET binding sites such as BINDING SITE I, BINDING SITE II or BINDING SITE III. Table 2 illustrates the complementarity of the nucleotide sequences of FGFR1 BINDING SITE1 and FGFR1 BINDING SITE2, designated SEQ ID:23364 and SEQ ID:23368 respectively, to the nucleotide sequence of VGAM130 RNA, herein designated VGAM RNA, also designated SEQ ID:2841.

A function of VGAM130 is therefore inhibition of Fibroblast Growth Factor Receptor 1 (fms-related tyrosine kinase 2, Pfeiffer syndrome) (FGFR1, Accession NM_023107). Accordingly, utilities of VGAM130 include diagnosis, prevention and treatment of diseases and clinical conditions associated with FGFR1. AOP2 (Accession NM_004905) is another VGAM130 host target gene. AOP2 BINDING SITE is HOST TARGET binding site found in the 3' untranslated region of mRNA encoded by AOP2, corresponding to a HOST TARGET binding site such as BINDING SITE I, BINDING SITE II or BINDING SITE III. Table 2 illustrates the complementarity of the nucleotide sequences of AOP2 BINDING SITE, designated SEQ ID:11340, to the nucleotide sequence of VGAM130 RNA, herein designated VGAM RNA, also designated SEQ ID:2841.

Another function of VGAM130 is therefore inhibition of AOP2 (Accession NM_004905). Accordingly, utilities of VGAM130 include diagnosis, prevention and treatment of diseases and clinical conditions associated with AOP2. Chromosome 20 Open Reading Frame 110 (C20orf110, Accession XM_086728) is another VGAM130 host target gene. C20orf110 BINDING SITE is HOST TARGET binding site found in the 3" untranslated region of mRNA encoded by C20orf110, corresponding to a HOST TARGET binding site such as BINDING SITE I, BINDING SITE II or BINDING SITE III. Table 2 illustrates the complementarity of the nucleotide sequences of C20orf110 BINDING SITE, designated SEQ ID:38832, to the nucleotide sequence of VGAM130 RNA, herein designated VGAM RNA, also designated SEQ ID:2841.

Another function of VGAM130 is therefore inhibition of Chromosome 20 Open Reading Frame 110 (C20orf110, Accession XM_086728). Accordingly, utilities of VGAM130 include diagnosis, prevention and treatment of diseases and clinical conditions associated with C20orf110. SERP1 (Accession NM_014445) is another VGAM130 host target gene. SERP1 BINDING SITE is HOST TARGET binding site found in the 3' untranslated region of mRNA encoded by SERP1, corresponding to a HOST TARGET binding site such as BINDING SITE I, BINDING SITE II or BINDING SITE III. Table 2 illustrates the complementarity of the nucleotide sequences of SERP1 BINDING SITE, designated SEQ ID:15798, to the nucleotide sequence of VGAM130 RNA, herein designated VGAM RNA, also designated SEQ ID:2841.

Another function of VGAM130 is therefore inhibition of SERP1 (Accession NM_014445). Accordingly, utilities of VGAM130 include diagnosis, prevention and treatment of diseases and clinical conditions associated with SERP1. Zinc Finger Protein 337 (ZNF337, Accession XM_042807) is another VGAM130 host target gene. ZNF337 BINDING SITE is HOST TARGET binding site found in the 3' untranslated region of mRNA encoded by ZNF337, corresponding to a HOST TARGET binding site such as BINDING SITE I, BINDING SITE II or BINDING SITE III. Table 2 illustrates the complementarity of the nucleotide sequences of ZNF337 BINDING SITE, designated SEQ ID:33771, to the nucleotide sequence of VGAM130 RNA, herein designated VGAM RNA, also designated SEQ ID:2841.

Another function of VGAM130 is therefore inhibition of Zinc Finger Protein 337 (ZNF337, Accession XM_042807). Accordingly, utilities of VGAM130 include diagnosis, prevention and treatment of diseases and clinical conditions associated with ZNF337. LOC147077 (Accession XM_085699) is another VGAM130 host target gene. LOC147077 BINDING SITE is HOST TARGET binding site found in the 3' untranslated region of mRNA encoded by LOC147077, corresponding to a HOST TARGET binding site such as BINDING SITE I, BINDING SITE II or BINDING SITE III. Table 2 illustrates the complementarity of the nucleotide sequences of LOC147077 BINDING SITE, designated SEQ ID:38294, to the nucleotide sequence of VGAM130 RNA, herein designated VGAM RNA, also designated SEQ ID:2841.

Another function of VGAM130 is therefore inhibition of LOC147077 (Accession XM_085699). Accordingly, utilities of VGAM130 include diagnosis, prevention and treatment of diseases and clinical conditions associated with LOC147077.

LOC200197 (Accession XM_114148) is another VGAM130 host target gene. LOC200197 BINDING SITE is HOST TARGET binding site found in the 3' untranslated region of mRNA encoded by LOC200197, corresponding to a HOST TARGET binding site such as BINDING SITE I, BINDING SITE II or BINDING SITE III. Table 2 illustrates the complementarity of the nucleotide sequences of LOC200197 BINDING SITE, designated SEQ ID:42733, to the nucleotide sequence of VGAM130 RNA, herein designated VGAM RNA, also designated SEQ ID:2841.

Another function of VGAM130 is therefore inhibition of LOC200197 (Accession XM_114148). Accordingly, utilities of VGAM130 include diagnosis, prevention and treatment of diseases and clinical conditions associated with LOC200197.

LOC253747 (Accession XM_173619) is another VGAM130 host target gene. LOC253747 BINDING SITE is HOST TARGET binding site found in the 5' untranslated region of mRNA encoded by LOC253747, corresponding to a HOST TARGET binding site such as BINDING SITE I, BINDING SITE II or BINDING SITE III. Table 2 illustrates the complementarity of the nucleotide sequences of LOC253747 BINDING SITE, designated SEQ ID:46552, to the nucleotide sequence of VGAM130 RNA, herein designated VGAM RNA, also designated SEQ ID:2841.

Another function of VGAM130 is therefore inhibition of LOC253747 (Accession XM_173619). Accordingly, utilities of VGAM130 include diagnosis, prevention and treatment of diseases and clinical conditions associated with LOC253747.

LOC86651 (Accession XM_044052) is another VGAM130 host target gene. LOC86651 BINDING SITE is HOST TARGET binding site found in the 3' untranslated region of mRNA encoded by LOC86651, corresponding to a HOST TARGET binding site such as BINDING SITE I, BINDING SITE II or BINDING SITE III. Table 2 illustrates the complementarity of the nucleotide sequences of LOC86651 BINDING SITE, designated SEQ ID:34100, to the nucleotide sequence of VGAM130 RNA, herein designated VGAM RNA, also designated SEQ ID:2841.

Another function of VGAM130 is therefore inhibition of LOC86651 (Accession XM_044052). Accordingly, utilities of VGAM130 include diagnosis, prevention and treatment of diseases and clinical conditions associated with LOC86651.

FIG. 1 further provides a conceptual description of a novel bioinformatically detected viral gene of the present invention, referred to here as Viral Genomic Address Messenger 131 (VGAM131) viral gene, which modulates expression of respective host target genes thereof, the function and utility of which host target genes is known in the art.

VGAM131 is a novel bioinformatically detected regulatory, non protein coding, viral micro RNA (miRNA) gene. The method by which VGAM131 was detected is described hereinabove with reference to FIGS. 1-8.

VGAM131 gene, herein designated VGAM GENE, is a viral gene contained in the genome of Shrimp White Spot Syndrome Virus (white spot bacilliform virus). VGAM131 host target gene, herein designated VGAM HOST TARGET GENE, is a human gene contained in the human genome.

VGAM131 gene encodes a VGAM131 precursor RNA, herein designated VGAM PRECURSOR RNA. Similar to other miRNA genes, and unlike most ordinary genes, VGAM131 precursor RNA does not encode a protein. A nucleotide sequence identical or highly similar to the nucleotide sequence of VGAM131 precursor RNA is designated SEQ ID:117, and is provided hereinbelow with reference to the sequence listing part. Nucleotide sequence SEQ ID:117 is located at position 224021 relative to the genome of Shrimp White Spot Syndrome Virus (white spot bacilliform virus).

VGAM131 precursor RNA folds onto itself, forming VGAM131 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM131 folded precursor RNA into VGAM131 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 68%) nucleotide sequence of VGAM131 RNA is designated SEQ ID:2842, and is provided hereinbelow with reference to the sequence listing part.

VGAM131 host target gene, herein designated VGAM HOST TARGET GENE, encodes a corresponding messenger RNA, VGAM131 host target RNA, herein designated VGAM HOST TARGET RNA. VGAM131 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM131 RNA, herein designated VGAM RNA, binds complementarily to one or more host target binding sites located in untranslated regions of VGAM131 host target RNA, herein designated VGAM HOST TARGET RNA. This complementary binding is due to the fact that the nucleotide sequence of VGAM131 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM131 RNA, herein designated VGAM RNA, may have a different number of host target binding sites in untranslated regions of a VGAM131 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM131 RNA, herein designated VGAM RNA, to host target binding sites on VGAM131 host target RNA, herein designated VGAM HOST TARGET RNA, such as BINDING SITE I, BINDING SITE II and BINDING SITE III, inhibits translation of VGAM131 host target RNA into VGAM131 host target protein, herein designated VGAM HOST TARGET PROTEIN. VGAM host target protein is therefore outlined by a broken line.

It is appreciated that VGAM131 host target gene, herein designated VGAM HOST TARGET GENE, in fact represents a plurality of VGAM131 host target genes. The mRNA of each one of this plurality of VGAM131 host target genes comprises one or more host target binding sites, each having a nucleotide sequence which is at least partly complementary to VGAM131 RNA, herein designated VGAM RNA, and which when bound by VGAM131 RNA causes inhibition of translation of respective one or more VGAM131 host target proteins.

It is further appreciated by one skilled in the art that the mode of translational inhibition illustrated by FIG. 1 with specific reference to translational inhibition exerted by VGAM131 gene, herein designated VGAM GENE, on one or more VGAM131 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM131 is inhibition of expression of host target genes, as part of a novel viral mechanism of attacking a host. Accordingly, utilities of VGAM131 include diagnosis, prevention and treatment of viral infection by Shrimp White Spot Syndrome Virus (white spot bacilliform virus). Specific functions, and accordingly utilities, of VGAM131 correlate with, and may be deduced from, the identity of the host target genes which VGAM131 binds and inhibits, and the function of these host target genes, as elaborated hereinbelow.

Nucleotide sequences of the VGAM131 precursor RNA, herein designated VGAM PRECURSOR RNA, and of the 'diced' VGAM131 RNA, herein designated VGAM RNA, and a schematic representation of the secondary folding of VGAM131 folded precursor RNA, herein designated VGAM FOLDED PRECURSOR RNA, of VGAM131 are further described hereinbelow with reference to Table 1.

Nucleotide sequences of host target binding sites, such as BINDING SITE-I, BINDING SITE-II and BINDING SITE-III of FIG. 1, found on VGAM131 host target RNA, and schematic representation of the complementarity of each of these host target binding sites to VGAM131 RNA, herein designated VGAM RNA, are described hereinbelow with reference to Table 2.

As mentioned hereinabove with reference to FIG. 1, a function of VGAM131 gene, herein designated VGAM is inhibition of expression of VGAM131 target genes. It is appreciated that specific functions, and accordingly utilities, of VGAM131 correlate with, and may be deduced from, the identity of the target genes which VGAM131 binds and inhibits, and the function of these target genes, as elaborated hereinbelow.

A Disintegrin-like and Metalloprotease (reprolysin type) with Thrombospondin Type 1 Motif, 13 (ADAMTS13, Accession NM_139025) is a VGAM131 host target gene. ADAMTS13 BINDING SITE1 through ADAMTS13 BINDING SITE3 are HOST TARGET binding sites found in untranslated regions of mRNA encoded by ADAMTS13, corresponding to HOST TARGET binding sites such as BINDING SITE I, BINDING SITE II or BINDING SITE III. Table 2 illustrates the complementarity of the nucleotide sequences of ADAMTS13 BINDING SITE1 through ADAMTS13 BINDING SITE3, designated SEQ ID:29124, SEQ ID:29126 and SEQ ID:29128 respectively, to the nucleotide sequence of VGAM131 RNA, herein designated VGAM RNA, also designated SEQ ID:2842.

A function of VGAM131 is therefore inhibition of A Disintegrin-like and Metalloprotease (reprolysin type) with Thrombospondin Type 1 Motif, 13 (ADAMTS13, Accession NM_139025), a gene which cleaves aggrecan, a cartilage proteoglycan, and may be involved in its turnover. Accordingly, utilities of VGAM131 include diagnosis, prevention and treatment of diseases and clinical conditions associated with ADAMTS13. The function of ADAMTS13 has been established by previous studies. Furlan et al. (1996) and Tsai (1996) independently reported that a metal-containing proteolytic enzyme (metalloprotease) in normal plasma cleaves the peptide bond between tyrosine at position 842 and methionine at position 843 in monomeric subunits of von Willebrand factor (VWF; 193400), thereby degrading the large multimers. This von Willebrand factor-cleaving protease was found by Furlan et al. (1997) to be deficient in 4 patients with chronic relapsing thrombotic thrombocytopenic purpura (OMIM Ref. No. 274150), 2 of whom were brothers. Because no inhibitor of the enzyme was detected in plasma, the deficiency was ascribed to an abnormality in the production, survival, or function of the protease. Furlan et al. (1998) studied plasma samples from 30 patients with thrombotic thrombocytopenic purpura and 23 patients with the hemolytic-uremic syndrome (HUS; 235400). Of 24 patients with nonfamilial thrombocytopenic purpura, 20 had severe and 4 had moderate protease deficiency during an acute event. An inhibitor of VWF found in 20 of the 24 patients (in all 5 plasma samples tested) was shown to be IgG, i.e., an antibody. Furlan et al. (1998) found that 6 patients with familial thrombocytopenic purpura lacked von Willebrand factor-cleaving protease activity but had no inhibitor, whereas all 10 patients with familial hemolytic-uremic syndrome had normal protease activity. In vitro proteolytic degradation of von Willebrand factor by the protease was studied in 5 patients with familial and 7 patients with nonfamilial hemolytic-uremic syndrome and was found to function normally in all 12 patients. In 2 Japanese families with Upshaw-Schulman syndrome (OMIM Ref. No. 276850), characterized by congenital TTP with neonatal onset and frequent relapses, Kokame et al. (2002) reported 4 novel mutations, 3 missense and 1 nonsense. Comparison of individual ADAMTS13 genotypes and plasma VWFCP activities indicated that 3 of the mutations, arg268 to pro (R268P; 604134.0014), gln449 to ter (Q449X; 604134.0013), and cys508 to tyr (C508Y; 604134.0015), abrogated activity of the enzyme, whereas the fourth, pro475 to ser (P475S; 604134.0016), retained low but significant activity. The effects of these mutations were further confirmed by expression analysis in HeLa cells. Recombinant VWFCP containing either of the mutations R268P or C508Y was not secreted from cells; in contrast, VWFCP containing either Q449X or P475S was normally secreted but demonstrated minimal activity. Genotype analysis of 364 Japanese subjects revealed that the P475S mutation was heterozygous in 9.6% of individuals, suggesting that approximately 10% of the Japanese population possesses reduced VWFCP activity. Thus, the mutation represents an SNP associated with alterations in VWFCP activity that may be a risk factor for thrombotic disorders.

Full details of the abovementioned studies are described in the following publications, the disclosure of which are hereby incorporated by reference:

Furlan, M.; Robles, R.; Galbusera, M.; Remuzzi, G.; Kyrle, P. A.; Brenner, B.; Krause, M.; Scharrer, I.; Aumann, V.; Mittler, U.; Solenthaler, M.; Lammle, B.: Von Willebrand factor-cleaving protease in thrombotic thrombocytopenic purpura and the hemolytic-uremic syndrome. New Eng. J. Med. 339:1578-1584, 1998; and Kokame, K.; Matsumoto, M.; Soejima, K.; Yagi, H.; Ishizashi, H.; Funato, M.; Tamai, H.; Konno, M.; Kamide, K.;

Kawano, Y.; Miyata, T.; Fujimura, Y.: Mutations and common polymorphisms i.

Further studies establishing the function and utilities of ADAMTS13 are found in John Hopkins OMIM database record ID 604134, and in sited publications numbered 7412-7413, 9060-9061, 7414-741 and 6027-956 listed in the bibliography section hereinbelow, which are also hereby incorporated by reference. Huntingtin (Huntington disease) (HD, Accession NM_002111) is another VGAM131 host target gene. HD BINDING SITE is HOST TARGET binding site found in the 3' untranslated region of mRNA encoded by HD, corresponding to a HOST TARGET binding site such as BINDING SITE I, BINDING SITE II or BINDING SITE III. Table 2 illustrates the complementarity of the nucleotide sequences of HD BINDING SITE, designated SEQ ID:7891, to the nucleotide sequence of VGAM131 RNA, herein designated VGAM RNA, also designated SEQ ID:2842.

Another function of VGAM131 is therefore inhibition of Huntingtin (Huntington disease) (HD, Accession NM_002111). Accordingly, utilities of VGAM131 include diagnosis, prevention and treatment of diseases and clinical conditions associated with HD. LIM Domain Only 7 (LMO7, Accession NM_005358) is another VGAM131 host target gene. LMO7 BINDING SITE is HOST TARGET binding site found in the 3' untranslated region of mRNA encoded by LMO7, corresponding to a HOST TARGET binding site such as BINDING SITE I, BINDING SITE II or BINDING SITE III. Table 2 illustrates the complementarity of the nucleotide sequences of LMO7 BINDING SITE, designated SEQ ID:11826, to the nucleotide sequence of VGAM131 RNA, herein designated VGAM RNA, also designated SEQ ID:2842.

Another function of VGAM131 is therefore inhibition of LIM Domain Only 7 (LMO7, Accession NM_005358). Accordingly, utilities of VGAM131 include diagnosis, prevention and treatment of diseases and clinical conditions associated with LMO7. Membrane Component, Chromosome 11, Surface Marker 1 (M11S1, Accession NM_005898) is another VGAM131 host target gene. M11S1 BINDING SITE is HOST TARGET binding site found in the 3' untranslated region of mRNA encoded by M11S1, corresponding to a HOST TARGET binding site such as BINDING SITE I, BINDING SITE II or BINDING SITE III. Table 2 illustrates the complementarity of the nucleotide sequences of M11S1 BINDING SITE, designated SEQ ID:12517, to the nucleotide sequence of VGAM131 RNA, herein designated VGAM RNA, also designated SEQ ID:2842.

Another function of VGAM131 is therefore inhibition of Membrane Component, Chromosome 11, Surface Marker 1 (M11S1, Accession NM_005898), a gene which may play a role in transporting nutrients from the gut lumen across the gutlining epithelial cell layer. Accordingly, utilities of VGAM131 include diagnosis, prevention and treatment of diseases and clinical conditions associated with M11S1. The function of M11S1 has been established by previous studies. The apical and basolateral borders of epithelial cells are distinguished by their different protein and lipid components. The sorting of newly synthesized membrane constituents to the appropriate region of the cell is accomplished either in the trans-Golgi network or by transcytosis, the selected transport of proteins to the appropriate surface. Transcytosis also is involved in the internalization of proteins and ligands at one surface and their transport to another. Ellis and Luzio (1995) identified a protein which undergoes this process by raising antibodies against apical and basolateral membrane fractions prepared from the human intestinal cell line Caco-2 and treated with phosphatidylinositol-specific phospholipase C, an enzyme that cleaves glycosylphosphatidylinositol (GPI) linkages. The antibodies were then used to isolate cDNAs from a human colon carcinoma expression vector library. A composite cDNA sequence was determined that predicts a protein of 649 amino acids which migrates as a 137 kD homodimer; Ellis and Luzio (1995) designated the protein p137(GPI). The protein contains 3 distinct domains. The amino-terminal 275 residues contain several potential alpha helices, the middle region contains proline and glutamine-rich repeats, and residues 469-601 contain a potential GPI anchor site. Northern blots showed 3.4- and 2.7-kb transcripts in all tissues examined except for the testis, where 5.3- and 2.0-kb mRNAs were also observed. Ellis and Luzio (1995) showed that the protein was present at nearly equal amounts in both the apical and basolateral membranes of Caco-2 cells and that the protein appeared first at the basolateral side. Gessler et al. (1996) mapped the gene, designated M11S1, to 11p13 by virtue of their studies of CpG islands in contigs from the region. The gene, which is adjacent to a CpG island, maps about 300 kb telomeric of CAT (OMIM Ref. No. 115500) and 200 kb centromeric to the LIM-domain only 2 gene (OMIM Ref. No. 180385). The order of transcription is telomere to centromere. Gessler et al. (1996) reported that mouse cDNA clones corresponding to the amino-terminal end of the protein showed that the human and mouse genes share greater than 97% sequence identity.

Full details of the abovementioned studies are described in the following publications, the disclosure of which are hereby incorporated by reference:

Ellis, J. A.; Luzio, J. P.: Identification and characterization of a novel protein (p137) which transcytoses bidirectionally in Caco-2 cells. J. Biol. Chem. 270:20717-20723, 1995; and Gessler, M.; Klamt, B.; Tsaoussidou, S.; Ellis, J. A.; Luzio, J. P.: The gene encoding the GPI-anchored membrane protein p137(GPI) (M11S1) maps to human chromosome 11p13 and is highly cons.

Further studies establishing the function and utilities of M11S1 are found in John Hopkins OMIM database record ID 601178, and in sited publications numbered 9318-9319 listed in the bibliography section hereinbelow, which are also hereby incorporated by reference. Phosphodiesterase 1A, Calmodulin-dependent (PDE1A, Accession NM_005019) is another VGAM131 host target gene. PDE1A BINDING SITE is HOST TARGET binding site found in the 5' untranslated region of mRNA encoded by PDE1A, corresponding to a HOST TARGET binding site such as BINDING SITE I, BINDING SITE II or BINDING SITE III. Table 2 illustrates the complementarity of the nucleotide sequences of PDE1A BINDING SITE, designated SEQ ID:11457, to the nucleotide sequence of VGAM131 RNA, herein designated VGAM RNA, also designated SEQ ID:2842.

Another function of VGAM131 is therefore inhibition of Phosphodiesterase 1A, Calmodulin-dependent (PDE1A, Accession NM_005019), a gene which is a Ca2+-calmodulin dependent cyclic nucleotide phosphodiesterase and has a higher affinity for cgmp than for camp. Accordingly, utilities of VGAM131 include diagnosis, prevention and treatment of diseases and clinical conditions associated with PDE1A. The function of PDE1A has been established by previous studies. Phosphodiesterase 1 is a membrane-bound exonuclease that hydrolyzes phosphodiester bonds. See 171885. Wilson and McKenna (1988) examined the segregation of the gene for human phosphodiesterase 1A in human-rodent somatic cell hybrids. Electrophoretic analysis of phosphodiesterase 1A in hybrids suggested that the enzyme is a monomer. The PDE1A gene segregated concordantly with human chromosome 4 in all but 1 of 26 hybrids examined and showed 4 or more instances of discordance with all other chromosomes. By screening a hippocampus library with a bovine 61-kD CaM PDE cDNA, Loughney et al. (1996) isolated cDNAs encoding PDE1A (HCAM1) and PDE1C (HCAM3; 602987). The sequence of the predicted 535-amino acid protein is 94% identical to that of the bovine 61-kD CaM PDE when 2 short regions unique to PDE1A are excluded from comparison. Northern blot analysis revealed tissue-specific expression of 4.8-, 2.4-, and 2.6-kb PDE1A mRNAs, with transcripts most abundant in brain, heart, kidney, and skeletal muscle. Although expression of full-length PDE1A in S. cerevisiae did not result in PDE activity, an amino-truncated protein gave measurable PDE activity with higher affinity for cGMP than for cAMP.

Full details of the abovementioned studies are described in the following publications, the disclosure of which are hereby incorporated by reference:

Loughney, K.; Martins, T. J.; Harris, E. A. S.; Sadhu, K.; Hicks, J. B.; Sonnenburg, W. K.; Beavo, J. A.; Ferguson, K.: Isolation and characterization of cDNAs corresponding to two human calcium, calmodulin-regulated, 3-prime,5-prime-cyclic nucleotide phosphodiesterases. J. Biol. Chem. 271: 796-806, 1996; and Wilson, D. E.; McKenna, L.: Assignment of the human gene for phosphodiesterase 1A to chromosome 4. (Abstract) Am. J. Hum. Genet. 43: A162 only, 1988.

Further studies establishing the function and utilities of PDE1A are found in John Hopkins OMIM database record ID 171890, and in sited publications numbered 12446-12447 listed in the bibliography section hereinbelow, which are also hereby incorporated by reference. Pituitary Tumor-transforming 1 Interacting Protein (PTTG1IP, Accession NM_004339) is another VGAM131 host target gene. PTTG1IP BINDING SITE is HOST TARGET binding site found in the 3' untranslated region of mRNA encoded by PTTG1IP, corresponding to a HOST TARGET binding site such as BINDING SITE I, BINDING SITE II or BINDING SITE III. Table 2 illustrates the complementarity of the nucleotide sequences of PTTG1IP BINDING SITE, designated SEQ ID:10535, to the nucleotide sequence of VGAM131 RNA, herein designated VGAM RNA, also designated SEQ ID:2842.

Another function of VGAM131 is therefore inhibition of Pituitary Tumor-transforming 1 Interacting Protein (PTTG1IP, Accession NM_004339), a gene which facilitates the translocation of PTTG to the nucleus. Accordingly, utilities of VGAM131 include diagnosis, prevention and treatment of diseases and clinical conditions associated with PTTG1IP. The function of PTTG1IP has been established by previous studies. In the course of constructing a transcript map for chromosome 21, Yaspo et al. (1995) isolated numerous coding segments from 21q22.3, including transcription unit TU6. Yaspo et al. (1998) cloned cDNAs corresponding to TU6 by screening a human fetal thymus cDNA library with a partial cDNA and trapped exon from TU6. Homology searches of sequence databases using the translated sequence did not detect similarities to known proteins, and the authors named the novel gene C21ORF3. The predicted 180-amino acid C21ORF3 protein has features of a type Ia integral membrane protein and contains the tetrapeptide YXRF, a motif observed in proteins internalized via coated pit-mediated endocytosis. Northern blot analysis detected a 2.69-kb C21ORF3 mRNA in all tissues examined. Using a yeast 2-hybrid screen on a human testis cDNA library with rat pituitary tumor-transforming gene (PTTG; 604147) as bait, Chien and Pei (2000) isolated a cDNA encoding PTTG1IP, which they called PBF (PTTG-binding factor). Sequence analysis predicted that the 179-amino acid PBF protein, which is 92% identical to C21ORF3, contains multiple phosphorylation sites, 5 potential N- and O-glycosylation sites, a potential N-terminal sorting signal, and a C-terminal nuclear localization signal (NLS). Northern and dot blot analysis detected a 2.8-kb PBF transcript in all tissues tested, with highest expression in placenta. Pull-down and coimmunoprecipitation analyses showed that PBF and PTTG interact specifically via their C-terminal regions. Western blot analysis and immunofluorescence microscopy showed that whereas PTTG is expressed primarily in the cytoplasm, PBF is expressed in both the cytoplasm and nucleus. The authors demonstrated that PBF, via its NLS, facilitates the translocation of PTTG to the nucleus. Reporter assay analysis indicated that coexpression of PBF and PTTG induces transcription of basic fibroblast growth factor (FGF2; 134920).

Full details of the abovementioned studies are described in the following publications, the disclosure of which are hereby incorporated by reference:

Yaspo, M.-L.; Aaltonen, J.; Horelli-Kuitunen, N.; Peltonen, L.; Lehrach, H.: Cloning of a novel human putative type Ia integral membrane protein mapping to 21q22.3. Genomics 49:133-136, 1998; and Yaspo, M.-L.; Gellen, L.; Mott, R.; Korn, B.; Nizetic, D.; Poustka, A. M.; Lehrach, H.: Model for a transcript map of human chromosome 21: isolation of new coding sequences from exon an.

Further studies establishing the function and utilities of PTTG1IP are found in John Hopkins OMIM database record ID 603784, and in sited publications numbered 8194-8196 listed in the bibliography section hereinbelow, which are also hereby incorporated by reference. RAB36, Member RAS Oncogene Family (RAB36, Accession NM_004914) is another VGAM131 host target gene. RAB36 BINDING SITE is HOST TARGET binding site found in the 3' untranslated region of mRNA encoded by RAB36, corresponding to a HOST TARGET binding site such as BINDING SITE I, BINDING SITE II or BINDING SITE III. Table 2 illustrates the complementarity of the nucleotide sequences of RAB36 BINDING SITE, designated SEQ ID:11348, to the nucleotide sequence of VGAM131 RNA, herein designated VGAM RNA, also designated SEQ ID:2842.

Another function of VGAM131 is therefore inhibition of RAB36, Member RAS Oncogene Family (RAB36, Accession NM_004914), a gene which is involved in protein transport. Accordingly, utilities of VGAM131 include diagnosis, prevention and treatment of diseases and clinical conditions associated with RAB36. The function of RAB36 and its association with various diseases and clinical conditions, has been established by previous studies, as described hereinabove with reference to VGAM129. Transforming Growth Factor, Beta Receptor II (70/80 kDa) (TGFBR2, Accession NM_003242) is another VGAM131 host target gene. TGFBR2 BINDING SITE is HOST TARGET binding site found in the 3' untranslated region of mRNA encoded by TGFBR2, corresponding to a HOST TARGET binding site such as BINDING SITE I, BINDING SITE II or BINDING SITE III. Table 2 illustrates the complementarity of the nucleotide sequences of TGFBR2 BINDING SITE, designated SEQ ID:9238, to the nucleotide sequence of VGAM131 RNA, herein designated VGAM RNA, also designated SEQ ID:2842.

Another function of VGAM131 is therefore inhibition of Transforming Growth Factor, Beta Receptor II (70/80 kDa) (TGFBR2, Accession NM_003242). Accordingly, utilities of VGAM131 include diagnosis, prevention and treatment of diseases and clinical conditions associated with TGFBR2.

7h3 (Accession NM_033025) is another VGAM131 host target gene. 7h3 BINDING SITE is HOST TARGET binding site found in the 3" untranslated region of mRNA encoded by 7h3, corresponding to a HOST TARGET binding site such as BINDING SITE I, BINDING SITE II or BINDING SITE III. Table 2 illustrates the complementarity of the nucleotide sequences of 7h3 BINDING SITE, designated SEQ ID:26915, to the nucleotide sequence of VGAM131 RNA, herein designated VGAM RNA, also designated SEQ ID:2842.

Another function of VGAM131 is therefore inhibition of 7h3 (Accession NM_033025). Accordingly, utilities of VGAM131 include diagnosis, prevention and treatment of diseases and clinical conditions associated with 7h3. DKFZp547C176 (Accession XM_040799) is another VGAM131 host target gene. DKFZp547C176 BINDING SITE is HOST TARGET binding site found in the 3' untranslated region of mRNA encoded by DKFZp547C176, corresponding to a HOST TARGET binding site such as BINDING SITE I, BINDING SITE II or BINDING SITE III. Table 2 illustrates the complementarity of the nucleotide sequences of DKFZp547C176 BINDING SITE, designated SEQ ID:33381, to the nucleotide sequence of VGAM131 RNA, herein designated VGAM RNA, also designated SEQ ID:2842.

Another function of VGAM131 is therefore inhibition of DKFZp547C176 (Accession XM_040799). Accordingly, utilities of VGAM131 include diagnosis, prevention and treatment of diseases and clinical conditions associated with DKFZp547C176. DKFZp586I021 (Accession NM_032271) is another VGAM131 host target gene. DKFZp586I021 BINDING SITE is HOST TARGET binding site found in the 3' untranslated region of mRNA encoded by DKFZp586I021, corresponding to a HOST TARGET binding site such as BINDING SITE I, BINDING SITE II or BINDING SITE III. Table 2 illustrates the complementarity of the nucleotide sequences of DKFZp586I021 BINDING SITE, designated SEQ ID:26019, to the nucleotide sequence of VGAM131 RNA, herein designated VGAM RNA, also designated SEQ ID:2842.

Another function of VGAM131 is therefore inhibition of DKFZp586I021 (Accession NM_032271). Accordingly, utilities of VGAM131 include diagnosis, prevention and treatment of diseases and clinical conditions associated with DKFZp586I021. Erythrocyte Membrane Protein Band 4.1-like 1 (EPB41L1, Accession XM_047295) is another VGAM131 host target gene. EPB41L1 BINDING SITE is HOST TARGET binding site found in the 3' untranslated region of mRNA encoded by EPB41L1, corresponding to a HOST TARGET binding site such as BINDING SITE I, BINDING SITE II or BINDING SITE III. Table 2 illustrates the complementarity of the nucleotide sequences of EPB41L1 BINDING SITE, designated SEQ ID:34936, to the nucleotide sequence of VGAM131 RNA, herein designated VGAM RNA, also designated SEQ ID:2842.

Another function of VGAM131 is therefore inhibition of Erythrocyte Membrane Protein Band 4.1-like 1 (EPB41L1, Accession XM_047295). Accordingly, utilities of VGAM131 include diagnosis, prevention and treatment of diseases and clinical conditions associated with EPB41L1. FLJ10540 (Accession NM_018131) is another VGAM131 host target gene. FLJ10540 BINDING SITE is HOST TARGET binding site found in the 3' untranslated region of mRNA encoded by FLJ10540, corresponding to a HOST TARGET binding site such as BINDING SITE I, BINDING SITE II or BINDING SITE III. Table 2 illustrates the complementarity of the nucleotide sequences of FLJ10540 BINDING SITE, designated SEQ ID:19927, to the nucleotide sequence of VGAM131 RNA, herein designated VGAM RNA, also designated SEQ ID:2842.

Another function of VGAM131 is therefore inhibition of FLJ10540 (Accession NM_018131). Accordingly, utilities of VGAM131 include diagnosis, prevention and treatment of diseases and clinical conditions associated with FLJ10540. H11 (Accession NM_014365) is another VGAM131 host target gene. H11 BINDING SITE is HOST TARGET binding site found in the 3' untranslated region of mRNA encoded by H11, corresponding to a HOST TARGET binding site such as BINDING SITE I, BINDING SITE II or BINDING SITE III. Table 2 illustrates the complementarity of the nucleotide sequences of H11 BINDING SITE, designated SEQ ID:15691, to the nucleotide sequence of VGAM131 RNA, herein designated VGAM RNA, also designated SEQ ID:2842.

Another function of VGAM131 is therefore inhibition of H11 (Accession NM_014365). Accordingly, utilities of VGAM131 include diagnosis, prevention and treatment of diseases and clinical conditions associated with H11. HYA22 (Accession NM_005808) is another VGAM131 host target gene. HYA22 BINDING SITE is HOST TARGET binding site found in the 3' untranslated region of mRNA encoded by HYA22, corresponding to a HOST TARGET binding site such as BINDING SITE I, BINDING SITE II or BINDING SITE III. Table 2 illustrates the complementarity of the nucleotide sequences of HYA22 BINDING SITE, designated SEQ ID:12387, to the nucleotide sequence of VGAM131 RNA, herein designated VGAM RNA, also designated SEQ ID:2842.

Another function of VGAM131 is therefore inhibition of HYA22 (Accession NM_005808). Accordingly, utilities of VGAM131 include diagnosis, prevention and treatment of diseases and clinical conditions associated with HYA22. KIAA0553 (Accession XM_045981) is another VGAM131 host target gene. KIAA0553 BINDING SITE is HOST TARGET binding site found in the 3' untranslated region of mRNA encoded by KIAA0553, corresponding to a HOST TARGET binding site such as BINDING SITE I, BINDING SITE II or BINDING SITE III. Table 2 illustrates the complementarity of the nucleotide sequences of KIAA0553 BINDING SITE, designated SEQ ID:34634, to the nucleotide sequence of VGAM131 RNA, herein designated VGAM RNA, also designated SEQ ID:2842.

Another function of VGAM131 is therefore inhibition of KIAA0553 (Accession XM_045981). Accordingly, utilities of VGAM131 include diagnosis, prevention and treatment of diseases and clinical conditions associated with KIAA0553. KIAA0828 (Accession XM_088105) is another VGAM131 host target gene. KIAA0828 BINDING SITE is HOST TARGET binding site found in the 3' untranslated region of mRNA encoded by KIAA0828, corresponding to a HOST TARGET binding site such as BINDING SITE I, BINDING SITE II or BINDING SITE III. Table 2 illustrates the complementarity of the nucleotide sequences of KIAA0828 BINDING SITE, designated SEQ ID:39510, to the nucleotide sequence of VGAM131 RNA, herein designated VGAM RNA, also designated SEQ ID:2842.

Another function of VGAM131 is therefore inhibition of KIAA0828 (Accession XM_088105). Accordingly, utilities of VGAM131 include diagnosis, prevention and treatment of diseases and clinical conditions associated with KIAA0828. KIAA1522 (Accession XM_036299) is another VGAM131 host target gene. KIAA1522 BINDING SITE is HOST TARGET binding site found in the 3' untranslated region of mRNA encoded by KIAA1522, corresponding to a HOST TARGET binding site such as BINDING SITE I, BINDING SITE II or BINDING SITE III. Table 2 illustrates the complementarity of the nucleotide sequences of KIAA1522 BINDING SITE, designated SEQ ID:32418, to the nucleotide sequence of VGAM131 RNA, herein designated VGAM RNA, also designated SEQ ID:2842.

Another function of VGAM131 is therefore inhibition of KIAA1522 (Accession XM_036299). Accordingly, utilities of VGAM131 include diagnosis, prevention and treatment of diseases and clinical conditions associated with KIAA1522. KIAA1560 (Accession XM_034422) is another VGAM131 host target gene. KIAA1560 BINDING SITE is HOST TARGET binding site found in the 3' untranslated region of mRNA encoded by KIAA1560, corresponding to a HOST TARGET binding site such as BINDING SITE I, BINDING SITE II or BINDING SITE III. Table 2 illustrates the complementarity of the nucleotide sequences of KIAA1560 BINDING SITE, designated SEQ ID:32100, to the nucleotide sequence of VGAM131 RNA, herein designated VGAM RNA, also designated SEQ ID:2842.

Another function of VGAM131 is therefore inhibition of KIAA1560 (Accession XM_034422). Accordingly, utilities of VGAM131 include diagnosis, prevention and treatment of diseases and clinical conditions associated with KIAA1560. MGC13105 (Accession XM_049394) is another VGAM131 host target gene. MGC13105 BINDING SITE is HOST TARGET binding site found in the 3' untranslated region of mRNA encoded by MGC13105, corresponding to a HOST TARGET binding site such as BINDING SITE I, BINDING SITE II or BINDING SITE III. Table 2 illustrates the complementarity of the nucleotide sequences of MGC13105 BINDING SITE, designated SEQ ID:35406, to the nucleotide sequence of VGAM131 RNA, herein designated VGAM RNA, also designated SEQ ID:2842.

Another function of VGAM131 is therefore inhibition of MGC13105 (Accession XM_049394). Accordingly, utilities of VGAM131 include diagnosis, prevention and treatment of diseases and clinical conditions associated with MGC13105. MGC32043 (Accession NM_144582) is another VGAM131 host target gene. MGC32043 BINDING SITE is HOST TARGET binding site found in the 3' untranslated region of mRNA encoded by MGC32043, corresponding to a HOST TARGET binding site such as BINDING SITE I, BINDING SITE II or BINDING SITE III. Table 2 illustrates the complementarity of the nucleotide sequences of MGC32043 BINDING SITE, designated SEQ ID:29392, to the nucleotide sequence of VGAM131 RNA, herein designated VGAM RNA, also designated SEQ ID:2842.

Another function of VGAM131 is therefore inhibition of MGC32043 (Accession NM_144582). Accordingly, utilities of VGAM131 include diagnosis, prevention and treatment of diseases and clinical conditions associated with MGC32043. Neuronal Pentraxin Receptor (NPTXR, Accession NM_058178) is another VGAM131 host target gene. NPTXR BINDING SITE1 and NPTXR BINDING SITE2 are HOST TARGET binding sites found in untranslated regions of mRNA encoded by NPTXR, corresponding to HOST TARGET binding sites such as BINDING SITE I, BINDING SITE II or BINDING SITE III. Table 2 illustrates the complementarity of the nucleotide sequences of NPTXR BINDING SITE1 and NPTXR BINDING SITE2, designated SEQ ID:27736 and SEQ ID:15588 respectively, to the nucleotide sequence of VGAM131 RNA, herein designated VGAM RNA, also designated SEQ ID:2842.

Another function of VGAM131 is therefore inhibition of Neuronal Pentraxin Receptor (NPTXR, Accession NM_058178). Accordingly, utilities of VGAM131 include diagnosis, prevention and treatment of diseases and clinical conditions associated with NPTXR. LOC149837 (Accession XM_097747) is another VGAM131 host target gene. LOC149837 BINDING SITE is HOST TARGET binding site found in the 3' untranslated region of mRNA encoded by LOC149837, corresponding to a HOST TARGET binding site such as BINDING SITE I, BINDING SITE II or BINDING SITE III. Table 2 illustrates the complementarity of the nucleotide sequences of LOC149837 BINDING SITE, designated SEQ ID:41097, to the nucleotide sequence of VGAM131 RNA, herein designated VGAM RNA, also designated SEQ ID:2842.

Another function of VGAM131 is therefore inhibition of LOC149837 (Accession XM_097747). Accordingly, utilities of VGAM131 include diagnosis, prevention and treatment of diseases and clinical conditions associated with LOC149837. LOC150605 (Accession XM_097927) is another VGAM131 host target gene. LOC150605 BINDING SITE is HOST TARGET binding site found in the 5' untranslated region of mRNA encoded by LOC150605, corresponding to a HOST TARGET binding site such as BINDING SITE I, BINDING SITE II or BINDING SITE III. Table 2 illustrates the complementarity of the nucleotide sequences of LOC150605 BINDING SITE, designated SEQ ID:41231, to the nucleotide sequence of VGAM131 RNA, herein designated VGAM RNA, also designated SEQ ID:2842.

Another function of VGAM131 is therefore inhibition of LOC150605 (Accession XM_097927). Accordingly, utilities of VGAM131 include diagnosis, prevention and treatment of diseases and clinical conditions associated with LOC150605. LOC155064 (Accession XM_088128) is another VGAM131 host target gene. LOC155064 BINDING SITE is HOST TARGET binding site found in the 3' untranslated region of mRNA encoded by LOC155064, corresponding to a HOST TARGET binding site such as BINDING SITE I, BINDING SITE II or BINDING SITE III. Table 2 illustrates the complementarity of the nucleotide sequences of LOC155064 BINDING SITE, designated SEQ ID:39531, to the nucleotide sequence of VGAM131 RNA, herein designated VGAM RNA, also designated SEQ ID:2842.

Another function of VGAM131 is therefore inhibition of LOC155064 (Accession XM_088128). Accordingly, utilities of VGAM131 include diagnosis, prevention and treatment of diseases and clinical conditions associated with LOC155064. LOC160156 (Accession XM_090047) is another VGAM131 host target gene. LOC160156 BINDING SITE is HOST TARGET binding site found in the 5' untranslated region of mRNA encoded by LOC160156, corresponding to a HOST TARGET binding site such as BINDING SITE I, BINDING SITE II or BINDING SITE III. Table 2 illustrates the complementarity of the nucleotide sequences of LOC160156 BINDING SITE, designated SEQ ID:39990, to the nucleotide sequence of VGAM131 RNA, herein designated VGAM RNA, also designated SEQ ID:2842.

Another function of VGAM131 is therefore inhibition of LOC160156 (Accession XM_090047). Accordingly, utilities of VGAM131 include diagnosis, prevention and treatment of diseases and clinical conditions associated with LOC160156. LOC197201 (Accession XM_113839) is another VGAM131 host target gene. LOC197201 BINDING SITE is HOST TARGET binding site found in the 3' untranslated region of mRNA encoded by LOC197201, corresponding to a HOST TARGET binding site such as BINDING SITE I, BINDING SITE II or BINDING SITE III. Table 2 illustrates the complementarity of the nucleotide sequences of LOC197201 BINDING SITE, designated SEQ ID:42463, to the nucleotide sequence of VGAM131 RNA, herein designated VGAM RNA, also designated SEQ ID:2842.

Another function of VGAM131 is therefore inhibition of LOC197201 (Accession XM_113839). Accordingly, utilities of VGAM131 include diagnosis, prevention and treatment of diseases and clinical conditions associated with LOC197201. LOC91960 (Accession XM_041872) is another VGAM131 host target gene. LOC91960 BINDING SITE is HOST TARGET binding site found in the 3' untranslated region of mRNA encoded by LOC91960, corresponding to a HOST TARGET binding site such as BINDING SITE I, BINDING SITE II or BINDING SITE III. Table 2 illustrates the complementarity of the nucleotide sequences of LOC91960 BINDING SITE, designated SEQ ID:33608, to the nucleotide sequence of VGAM131 RNA, herein designated VGAM RNA, also designated SEQ ID:2842.

Another function of VGAM131 is therefore inhibition of LOC91960 (Accession XM_041872). Accordingly, utilities of VGAM131 include diagnosis, prevention and treatment of diseases and clinical conditions associated with LOC91960. FIG. 1 further provides a conceptual description of a novel bioinformatically detected viral gene of the present invention, referred to here as Viral Genomic Address Messenger 132 (VGAM132) viral gene, which modulates expression of respective host target genes thereof, the function and utility of which host target genes is known in the art.

VGAM132 is a novel bioinformatically detected regulatory, non protein coding, viral micro RNA (miRNA) gene. The method by which VGAM132 was detected is described hereinabove with reference to FIGS. 1-8.

VGAM132 gene, herein designated VGAM GENE, is a viral gene contained in the genome of Shrimp White Spot Syndrome Virus (white spot bacilliform virus). VGAM132 host target gene, herein designated VGAM HOST TARGET GENE, is a human gene contained in the human genome.

VGAM132 gene encodes a VGAM132 precursor RNA, herein designated VGAM PRECURSOR RNA. Similar to other miRNA genes, and unlike most ordinary genes, VGAM132 precursor RNA does not encode a protein. A nucleotide sequence identical or highly similar to the nucleotide sequence of VGAM132 precursor RNA is designated SEQ ID:118, and is provided hereinbelow with reference to the sequence listing part. Nucleotide sequence SEQ ID:118 is located at position 44993 relative to the genome of Shrimp White Spot Syndrome Virus (white spot bacilliform virus).

VGAM132 precursor RNA folds onto itself, forming VGAM132 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM132 folded precursor RNA into VGAM132 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM132 RNA is designated SEQ ID:2843, and is provided hereinbelow with reference to the sequence listing part.

VGAM132 host target gene, herein designated VGAM HOST TARGET GENE, encodes a corresponding messenger RNA, VGAM132 host target RNA, herein designated VGAM HOST TARGET RNA. VGAM132 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM132 RNA, herein designated VGAM RNA, binds complementarily to one or more host target binding sites located in untranslated regions of VGAM132 host target RNA, herein designated VGAM HOST TARGET RNA. This complementary binding is due to the fact that the nucleotide sequence of VGAM132 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM132 RNA, herein designated VGAM RNA, may have a different number of host target binding sites in untranslated regions of a VGAM132 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM132 RNA, herein designated VGAM RNA, to host target binding sites on VGAM132 host target RNA, herein designated VGAM HOST TARGET RNA, such as BINDING SITE I, BINDING SITE II and BINDING SITE III, inhibits translation of VGAM132 host target RNA into VGAM132 host target protein, herein designated VGAM HOST TARGET PROTEIN. VGAM host target protein is therefore outlined by a broken line.

It is appreciated that VGAM132 host target gene, herein designated VGAM HOST TARGET GENE, in fact represents a plurality of VGAM132 host target genes. The mRNA of each one of this plurality of VGAM132 host target genes comprises one or more host target binding sites, each having a nucleotide sequence which is at least partly complementary to VGAM132 RNA, herein designated VGAM RNA, and which when bound by VGAM132 RNA causes inhibition of translation of respective one or more VGAM132 host target proteins.

It is further appreciated by one skilled in the art that the mode of translational inhibition illustrated by FIG. 1 with specific reference to translational inhibition exerted by VGAM132 gene, herein designated VGAM GENE, on one or more VGAM132 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM132 is inhibition of expression of host target genes, as part of a novel viral mechanism of attacking a host. Accordingly, utilities of VGAM132 include diagnosis, prevention and treatment of viral infection by Shrimp White Spot Syndrome Virus (white spot bacilliform virus). Specific functions, and accordingly utilities, of VGAM132 correlate with, and may be deduced from, the identity of the host target genes which VGAM132 binds and inhibits, and the function of these host target genes, as elaborated hereinbelow.

Nucleotide sequences of the VGAM132 precursor RNA, herein designated VGAM PRECURSOR RNA, and of the 'diced' VGAM132 RNA, herein designated VGAM RNA, and a schematic representation of the secondary folding of VGAM132 folded precursor RNA, herein designated VGAM FOLDED PRECURSOR RNA, of VGAM132 are further described hereinbelow with reference to Table 1.

Nucleotide sequences of host target binding sites, such as BINDING SITE-I, BINDING SITE-II and BINDING SITE-III of FIG. 1, found on VGAM132 host target RNA, and schematic representation of the complementarity of each of these host target binding sites to VGAM132 RNA, herein designated VGAM RNA, are described hereinbelow with reference to Table 2.

As mentioned hereinabove with reference to FIG. 1, a function of VGAM132 gene, herein designated VGAM is inhibition of expression of VGAM132 target genes. It is appreciated that specific functions, and accordingly utilities, of VGAM132 correlate with, and may be deduced from, the identity of the target genes which VGAM132 binds and inhibits, and the function of these target genes, as elaborated hereinbelow.

G Protein-coupled Receptor 81 (GPR81, Accession NM_032554) is a VGAM132 host target gene. GPR81 BINDING SITE is HOST TARGET binding site found in the 3' untranslated region of mRNA encoded by GPR81, corresponding to a HOST TARGET binding site such as BINDING SITE I, BINDING SITE II or BINDING SITE III. Table 2 illustrates the complementarity of the nucleotide sequences of GPR81 BINDING SITE, designated SEQ ID:26280, to the nucleotide sequence of VGAM132 RNA, herein designated VGAM RNA, also designated SEQ ID:2843.

A function of VGAM132 is therefore inhibition of G Protein-coupled Receptor 81 (GPR81, Accession NM_032554). Accordingly, utilities of VGAM132 include diagnosis, prevention and treatment of diseases and clinical conditions associated with GPR81. Major Histocompatibility Complex, Class II, DQ Alpha 1 (HLA-DQA1, Accession XM_175260) is another VGAM132 host target gene. HLA-DQA1 BINDING SITE is HOST TARGET binding site found in the 3' untranslated region of mRNA encoded by HLA-DQA1, corresponding to a HOST TARGET binding site such as BINDING SITE I, BINDING SITE II or BINDING SITE III. Table 2 illustrates the complementarity of the nucleotide sequences of HLA-DQA1 BINDING SITE, designated SEQ ID:46724, to the nucleotide sequence of VGAM132 RNA, herein designated VGAM RNA, also designated SEQ ID:2843.

Another function of VGAM132 is therefore inhibition of Major Histocompatibility Complex, Class II, DQ Alpha 1 (HLA-DQA1, Accession XM_175260), a gene which is alpha 1 chain of HLA-DQ1 class II molecule (Ia antigen) which binds peptides and presents them to CD4+ T lymphocytes. Accordingly, utilities of VGAM132 include diagnosis, prevention and treatment of diseases and clinical conditions associated with HLA-DQA1. The function of HLA-DQA1 has been established by previous studies. In multiple sclerosis patients, it showed the same frequency as in the normal population. Todd et al. (1987) presented a map of the class II loci. They suggested that the structure of the DQ molecule, in particular residue 57 of the beta-chain, specifies the autoimmune response against insulin-producing islet cells that leads to insulin-dependent diabetes mellitus (IDDM; 222100). Of the approximately 14 class II HLA genes within the HLA-D region, the DQ3.2-beta gene accounts for the well-documented association of HLA-DR4 with insulin-dependent diabetes mellitus and is the single allele most highly correlated with this disease. Kwok et al. (1989) found that amino acid 45 was critical for generating serologic epitopes characterizing the DQ3.2-beta gene and its nondiabetic allele, DQ3.1-beta. Todd et al. (1990) found that in Japanese, IDDM was more strongly associated with HLA-DQ than with HLA-DR; that the A3 allele at the DQA1 locus was most strongly associated with disease; that the DQw8 allele of the DQB1 locus, which is associated with susceptibility to type I diabetes in Caucasians and Blacks, was not increased in frequency in Japanese patients; and that asp57-encoding DQB1 alleles, which are associated with reduced susceptibility to type I diabetes in Caucasians, was present in all except 1 of 49 Japanese patients and in all of 31 controls, in at least heterozygous state. Forty percent of patients were homozygous for asp57-encoding DQB1 alleles versus 35% of controls. The high frequency of asp57-encoding DQB1 alleles in Japanese may account for the rarity of type I diabetes in Japan. Animal model experiments lend further support to the function of HLA-DQA1. Studies supporting a role for HLA-DQ polymorphism in human rheumatoid arthritis were supported by Nabozny et al. (1996) and Bradley et al. (1997). Nabozny et al. (1996) demonstrated that mice transgenic for HLA-DQ8, a DQ allele associated with susceptibility to RA, developed severe arthritis after type II collagen immunization. Bradley et al. (1997) generated mice transgenic for HLA-DQ6, an allele associated with a nonsusceptible haplotype, and found that the DQ6 mice were resistant to collagen-induced arthritis. They also assessed the combined effect of an RA-susceptible and an RA-nonassociated DQ allele by producing double-transgenic mice expressing both DQ6 and DQ8 molecules, representing the more prevalent condition found in human S where heterozygosity at the DQ allele is common. The double-transgenic mice developed moderate collagen-induced arthritis when immunized with type II collagen as compared with the severe arthritis observed in DQ8 transgenic mice, much like RA patients bearing both susceptible and nonsusceptible HLA haplotypes.

It is appreciated that the abovementioned animal model for HLA-DQA1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Todd, J. A.; Fukui, Y.; Kitagawa, T.; Sasazuki, T.: The A3 allele of the HLA-DQA1 locus is associated with susceptibility to type 1 diabetes in Japanese. Proc. Nat. Acad. Sci. 87:1094-1098, 1990; and Bradley, D. S.; Nabozny, G. H.; Cheng, S.; Zhou, P.; Griffiths, M. M.; Luthra, H. S.; David, C. S.: HLA-DQB1 polymorphism determines incidence, onset, and severity of collagen-induced a.

Further studies establishing the function and utilities of HLA-DQA1 are found in John Hopkins OMIM database record ID 146880, and in sited publications numbered 4206-113, 3296-126, 1144 and 288-293 listed in the bibliography section hereinbelow, which are also hereby incorporated by reference. Mitogen-activated Protein Kinase Kinase Kinase 7 Interacting Protein 1 (MAP3K7IP1, Accession NM_006116) is another VGAM132 host target gene. MAP3K7IP1 BINDING SITE is HOST TARGET binding site found in the 3' untranslated region of mRNA encoded by MAP3K7IP1, corresponding to a HOST TARGET binding site such as BINDING SITE I, BINDING SITE II or BINDING SITE III. Table 2 illustrates the complementarity of the nucleotide sequences of MAP3K7IP1 BINDING SITE, designated SEQ ID:12762, to the nucleotide sequence of VGAM132 RNA, herein designated VGAM RNA, also designated SEQ ID:2843.

Another function of VGAM132 is therefore inhibition of Mitogen-activated Protein Kinase Kinase Kinase 7 Interacting Protein 1 (MAP3K7IP1, Accession NM_006116), a gene which may be an important signaling intermediate between tgfb receptors and map3k7/tak1. Accordingly, utilities of VGAM132 include diagnosis, prevention and treatment of diseases and clinical conditions associated with MAP3K7IP1. The function of MAP3K7IP1 has been established by previous studies. Shibuya et al. (1996) used the yeast 2-hybrid system to identify brain cDNAs encoding proteins that interacted with TAK1 (OMIM Ref. No. 602614). They recovered a gene encoding a predicted 504-amino acid protein that they named TAB1 (TAK1-binding protein-1). On Northern blots, TAB1 was expressed as a 3.5-kb mRNA in all tissues tested Shibuya et al. (1996) found that in both yeast and mammalian cells, TAB1 activated the kinase activity of TAK1 by direct interaction. They showed that the C-terminal 68 amino acids of TAB1 are sufficient for binding and activation of TAK1 in mammalian cells, while the N-terminal 418 amino acids act as a dominant-negative inhibitor of transforming growth factor-beta (TGFB; 190180)-induced gene expression. Since TAK1 functions as an MAPKKK in the TGFB signaling pathway, Shibuya et al. (1996) suggested that TAB1 may be an important signaling intermediate between TGFB receptors and TAK1

Full details of the abovementioned studies are described in the following publications, the disclosure of which are hereby incorporated by reference:

Shibuya, H.; Yamaguchi, K.; Shirakabe, K.; Tonegawa, A.; Gotoh, Y.; Ueno, N.; Irie, K.; Nishida, E.; Matsumoto, K.: TAB1: an activator of the TAK1 MAPKKK in TGF-beta signal transduction. Science 272:1179-1182, 1996; and Shibuya, H.; Yamaguchi, K.; Shirakabe, K.; Tonegawa, A.; Gotoh, Y.; Ueno, N.; Irie, K.; Nishida, E.; Matsumoto, K.: TAB1: an activator of the TAK1 MAPKKK in TGF-beta signal transduction. S.

Further studies establishing the function and utilities of MAP3K7IP1 are found in John Hopkins OMIM database record ID 602615, and in sited publications numbered 10124 listed in the bibliography section hereinbelow, which are also hereby incorporated by reference. Nuclear Factor Related to Kappa B Binding Protein (NFRKB, Accession NM_006165) is another VGAM132 host target gene. NFRKB BINDING SITE is HOST TARGET binding site found in the 5' untranslated region of mRNA encoded by NFRKB, corresponding to a HOST TARGET binding site such as BINDING SITE I, BINDING SITE II or BINDING SITE III. Table 2 illustrates the complementarity of the nucleotide sequences of NFRKB BINDING SITE, designated SEQ ID:12819, to the nucleotide sequence of VGAM132 RNA, herein designated VGAM RNA, also designated SEQ ID:2843.

Another function of VGAM132 is therefore inhibition of Nuclear Factor Related to Kappa B Binding Protein (NFRKB, Accession NM_006165). Accordingly, utilities of VGAM132 include diagnosis, prevention and treatment of diseases and clinical conditions associated with NFRKB. PCTAIRE Protein Kinase 3 (PCTK3, Accession XM_053746) is another VGAM132 host target gene. PCTK3 BINDING SITE is HOST TARGET binding site found in the 3' untranslated region of mRNA encoded by PCTK3, corresponding to a HOST TARGET binding site such as BINDING SITE I, BINDING SITE II or BINDING SITE III. Table 2 illustrates the complementarity of the nucleotide sequences of PCTK3 BINDING SITE, designated SEQ ID:36123, to the nucleotide sequence of VGAM132 RNA, herein designated VGAM RNA, also designated SEQ ID:2843.

Another function of VGAM132 is therefore inhibition of PCTAIRE Protein Kinase 3 (PCTK3, Accession XM_053746), a gene which may play a role in signal transduction cascades in terminally differentiated cells. Accordingly, utilities of VGAM132 include diagnosis, prevention and treatment of diseases and clinical conditions associated with PCTK3. The function of PCTK3 has been established by previous studies. The PCTAIRE protein kinases comprise a distinct subfamily of the CDC2 (OMIM Ref. No. 116940)-related serine/threonine-specific protein kinases. See PCTK1 (OMIM Ref. No. 311550). Meyerson et al. (1992) isolated a partial cDNA encoding PCTAIRE3. Like other members of the PCTAIRE subfamily, the predicted PCTAIRE3 protein contains an N-terminal extension relative to CDC2. The CDC2-related region of PCTAIRE3, excluding the N-terminal extension, shares 51%, 79%, and 80% protein sequence identity with CDC2, PCTK1, and PCTK2 (OMIM Ref. No. 603440), respectively. Northern blot analysis revealed that PCTAIRE3 is expressed in a variety of human cell lines and tissues. Okuda et al. (1992) identified the mouse homolog of PCTK3. By fluorescence in situ hybridization, Okuda et al. (1994) mapped the PCTK3 gene to 1q31-q32.

Full details of the abovementioned studies are described in the following publications, the disclosure of which are hereby incorporated by reference:

Meyerson, M.; Enders, G. H.; Wu, C.-L.; Su, L.-K.; Gorka, C.; Nelson, C.; Harlow, E.; Tsai, L.-H.: A family of human cdc2-related protein kinases. EMBO J. 11:2909-2917, 1992; and Okuda, T.; Cleveland, J. L.; Downing, J. R.: PCTAIRE-1 and PCTAIRE-3, two members of a novel cdc2/CDC28-related protein kinase gene family. Oncogene 7:2249-2258, 1992.

Further studies establishing the function and utilities of PCTK3 are found in John Hopkins OMIM database record ID 169190, and in sited publications numbered 15 and 3501-3502 listed in the bibliography section hereinbelow, which are also hereby incorporated by reference. Paxillin (PXN, Accession NM_002859) is another VGAM132 host target gene. PXN BINDING SITE is HOST TARGET binding site found in the 3' untranslated region of mRNA encoded by PXN, corresponding to a HOST TARGET binding site such as BINDING SITE I, BINDING SITE II or BINDING SITE III. Table 2 illustrates the complementarity of the nucleotide sequences of PXN BINDING SITE, designated SEQ ID:8755, to the nucleotide sequence of VGAM132 RNA, herein designated VGAM RNA, also designated SEQ ID:2843.

Another function of VGAM132 is therefore inhibition of Paxillin (PXN, Accession NM_002859), a gene which may be involved in p53-dependent apoptosis. Accordingly, utilities of VGAM132 include diagnosis, prevention and treatment of diseases and clinical conditions associated with PXN. The function of PXN has been established by previous studies. Drosophila peroxidasin is an extracellular matrix-associated peroxidase. It is expressed exclusively in hemocytes derived from head mesoderm at a very early stage of differentiation. Peroxidasin exists as a homotrimer with a unique hybrid structure that combines an enzymatically functional peroxidase domain with motifs that are typically found in extracellular matrix-associated proteins. It is a secreted protein that contains a secretory recognition sequence at its N terminus. Peroxidasin catalyzes hydrogen peroxide-driven radioiodination, oxidations, and the formation of dityrosine in vitro. It is also thought to function in extracellular matrix consolidation, phagocytosis, and defense. By sequencing random cDNAs corresponding to relatively long transcripts from the human immature myeloid cell line KG-1, Nagase et al. (1996) identified a cDNA, which they called KIAA0230, that encodes PRG2. The cDNA represents at least 90% of the full-length PRG2 transcript; however, since it lacks an inframe stop codon upstream of the first ATG, it may be missing 5-prime coding sequence. The 1,496-amino acid PRG2 protein deduced from the cDNA sequence contains predicted transmembrane domains. PRG2 shares 38% amino acid sequence identity with Drosophila peroxidasin across 1,412 amino acids. Northern blot analysis of human tissues showed PRG2 expression at higher levels in heart, lung, ovary, and placenta, and lower levels in liver, small intestine, colon, pancreas, spleen, kidney, thymus, skeletal muscle, testis, and prostate; PRG2 expression was not detected in brain or peripheral blood leukocytes.

Full details of the abovementioned studies are described in the following publications, the disclosure of which are hereby incorporated by reference:

Horikoshi, N.; Cong, J.; Kley, N.; Shenk, T.: Isolation of differentially expressed cDNAs from p53-dependent apoptotic cells: activation of the human homologue of the Drosophila peroxidasin gene. Biochem. Biophys. Res. Commun. 261:864-869, 1999; and Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human g.

Further studies establishing the function and utilities of PXN are found in John Hopkins OMIM database record ID 605158, and in sited publications numbered 439 and 9379 listed in the bibliography section hereinbelow, which are also hereby incorporated by reference. RAD50 Homolog (S. cerevisiae) (RAD50, Accession NM_005732) is another VGAM132 host target gene. RAD50 BINDING SITE1 and RAD50 BINDING SITE2 are HOST TARGET binding sites found in untranslated regions of mRNA encoded by RAD50, corresponding to HOST TARGET binding sites such as BINDING SITE I, BINDING SITE II or BINDING SITE III. Table 2 illustrates the complementarity of the nucleotide sequences of RAD50 BINDING SITE1 and RAD50 BINDING SITE2, designated SEQ ID:12294 and SEQ ID:28551 respectively, to the nucleotide sequence of VGAM132 RNA, herein designated VGAM RNA, also designated SEQ ID:2843.

Another function of VGAM132 is therefore inhibition of RAD50 Homolog (S. cerevisiae) (RAD50, Accession NM_005732), a gene which is involved in dna double-strand break repair (dsbr). Accordingly, utilities of VGAM132 include diagnosis, prevention and treatment of diseases and clinical conditions associated with RAD50. The function of RAD50 has been established by previous studies. The S. cerevisiae Rad50 gene encodes a protein that is essential for double-stranded DNA break repair by nonhomologous DNA end joining and chromosomal integration. The yeast Rad50, Mre11 (OMIM Ref. No. 600814), and Xrs2 proteins appear to act in a multiprotein complex, consistent with the observation that mutations in these genes confer nearly identical phenotypes of no meiotic recombination and elevated rates of homologous mitotic recombination. By direct selection of cDNAs from the 5q23-q31 chromosomal interval, Dolganov et al. (1996) isolated a cDNA encoding a human Rad50 homolog. The human RAD50 gene spans 100 to 130 kb. Northern blot analysis revealed that the RAD50 gene was expressed as a 5.5-kb mRNA predominantly in testis. A faint 7-kb transcript, which the authors considered to be an mRNA with an alternatively processed 3-prime end, was also detected. Yeast Rad50 and the predicted 1,312-amino acid human RAD50 protein share more than 50% identity in their N- and C-termini. The central heptad repeat domains of the proteins have relatively divergent primary sequences but are predicted to adopt very similar coiled-coil structures. Using immunoprecipitation, Dolganov et al. (1996) demonstrated that the 153-kD RAD50 is stably associated with MRE11 in a protein complex, which may also include proteins of 95 kD, 200 kD, and 350 kD. By inclusion within mapped clones and by analysis of somatic cell hybrids, Dolganov et al. (1996) mapped the RAD50 gene to 5q31. They suggested that a recombinational DNA repair deficiency may be associated with the development of myeloid leukemia, since this chromosomal region is frequently altered in acute myeloid leukemia and myelodysplastic disease.

Full details of the abovementioned studies are described in the following publications, the disclosure of which are hereby incorporated by reference:

Dolganov, G. M.; Maser, R. S.; Novikov, A.; Tosto, L.; Chong, S.; Bressan, D. A.; Petrini, J. H. J.: Human Rad50 is physically associated with human Mre11: identification of a conserved multiprotein complex implicated in recombinational DNA repair. Molec. Cell Biol. 16:4832-4841, 1996; and Hopfner, K.-P.; Craig, L.; Moncalian, G.; Zinkel, R. A.; Usui, T.; Owen, B. A. L.; Karcher, A.; Henderson, B.; Bodmer, J.-L.; McMurray, C. T.; Carney, J. P.; Petrini, J. H. J.; Tainer.

Further studies establishing the function and utilities of RAD50 are found in John Hopkins OMIM database record ID 604040, and in sited publications numbered 9233-8204, 7143, 8205, 820 and 7145-7146 listed in the bibliography section hereinbelow, which are also hereby incorporated by reference. CXYorf1 (Accession XM_088704) is another VGAM132 host target gene. CXYorf1 BINDING SITE is HOST TARGET binding site found in the 5' untranslated region of mRNA encoded by CXYorf1, corresponding to a HOST TARGET binding site such as BINDING SITE I, BINDING SITE II or BINDING SITE III. Table 2 illustrates the complementarity of the nucleotide sequences of CXYorf1 BINDING SITE, designated SEQ ID:39904, to the nucleotide sequence of VGAM132 RNA, herein designated VGAM RNA, also designated SEQ ID:2843.

Another function of VGAM132 is therefore inhibition of CXYorf1 (Accession XM_088704). Accordingly, utilities of VGAM132 include diagnosis, prevention and treatment of diseases and clinical conditions associated with CXYorf1. FLJ00060 (Accession XM_028154) is another VGAM132 host target gene. FLJ00060 BINDING SITE is HOST TARGET binding site found in the 3' untranslated region of mRNA encoded by FLJ00060, corresponding to a HOST TARGET binding site such as BINDING SITE I, BINDING SITE II or BINDING SITE III. Table 2 illustrates the complementarity of the nucleotide sequences of FLJ00060 BINDING SITE, designated SEQ ID:30628, to the nucleotide sequence of VGAM132 RNA, herein designated VGAM RNA, also designated SEQ ID:2843.

Another function of VGAM132 is therefore inhibition of FLJ00060 (Accession XM_028154). Accordingly, utilities of VGAM132 include diagnosis, prevention and treatment of diseases and clinical conditions associated with FLJ00060. FLJ10244 (Accession NM_018037) is another VGAM132 host target gene. FLJ10244 BINDING SITE is HOST TARGET binding site found in the 5' untranslated region of mRNA encoded by FLJ10244, corresponding to a HOST TARGET binding site such as BINDING SITE I, BINDING SITE II or BINDING SITE III. Table 2 illustrates the complementarity of the nucleotide sequences of FLJ10244 BINDING SITE, designated SEQ ID:19779, to the nucleotide sequence of VGAM132 RNA, herein designated VGAM RNA, also designated SEQ ID:2843.

Another function of VGAM132 is therefore inhibition of FLJ10244 (Accession NM_018037). Accordingly, utilities of VGAM132 include diagnosis, prevention and treatment of diseases and clinical conditions associated with FLJ10244. FLJ20257 (Accession NM_019606) is another VGAM132 host target gene. FLJ20257 BINDING SITE is HOST TARGET binding site found in the 5' untranslated region of mRNA encoded by FLJ20257, corresponding to a HOST TARGET binding site such as BINDING SITE I, BINDING SITE II or BINDING SITE III. Table 2 illustrates the complementarity of the nucleotide sequences of FLJ20257 BINDING SITE, designated SEQ ID:21220, to the nucleotide sequence of VGAM132 RNA, herein designated VGAM RNA, also designated SEQ ID:2843.

Another function of VGAM132 is therefore inhibition of FLJ20257 (Accession NM_019606). Accordingly, utilities of VGAM132 include diagnosis, prevention and treatment of diseases and clinical conditions associated with FLJ20257. FLJ31951 (Accession NM_144726) is another VGAM132 host target gene. FLJ31951 BINDING SITE is HOST TARGET binding site found in the 3' untranslated region of mRNA encoded by FLJ31951, corresponding to a HOST TARGET binding site such as BINDING SITE I, BINDING SITE II or BINDING SITE III. Table 2 illustrates the complementarity of the nucleotide sequences of FLJ31951 BINDING SITE, designated SEQ ID:29550, to the nucleotide sequence of VGAM132 RNA, herein designated VGAM RNA, also designated SEQ ID:2843.

Another function of VGAM132 is therefore inhibition of FLJ31951 (Accession NM_144726). Accordingly, utilities of VGAM132 include diagnosis, prevention and treatment of diseases and clinical conditions associated with FLJ31951. KIAA1001 (Accession NM_014960) is another VGAM132 host target gene. KIAA1001 BINDING SITE is HOST TARGET binding site found in the 3' untranslated region of mRNA encoded by KIAA1001, corresponding to a HOST TARGET binding site such as BINDING SITE I, BINDING SITE II or BINDING SITE III. Table 2 illustrates the complementarity of the nucleotide sequences of KIAA1001 BINDING SITE, designated SEQ ID:17325, to the nucleotide sequence of VGAM132 RNA, herein designated VGAM RNA, also designated SEQ ID:2843.

Another function of VGAM132 is therefore inhibition of KIAA1001 (Accession NM_014960). Accordingly, utilities of VGAM132 include diagnosis, prevention and treatment of diseases and clinical conditions associated with KIAA1001. KIAA1321 (Accession XM_030856) is another VGAM132 host target gene. KIAA1321 BINDING SITE is HOST TARGET binding site found in the 3' untranslated region of mRNA encoded by KIAA1321, corresponding to a HOST TARGET binding site such as BINDING SITE I, BINDING SITE II or BINDING SITE III. Table 2 illustrates the complementarity of the nucleotide sequences of KIAA1321 BINDING SITE, designated SEQ ID:31192, to the nucleotide sequence of VGAM132 RNA, herein designated VGAM RNA, also designated SEQ ID:2843.

Another function of VGAM132 is therefore inhibition of KIAA1321 (Accession XM_030856). Accordingly, utilities of VGAM132 include diagnosis, prevention and treatment of diseases and clinical conditions associated with KIAA1321. PRO2435 (Accession NM_018527) is another VGAM132 host target gene. PRO2435 BINDING SITE is HOST TARGET binding site found in the 5' untranslated region of mRNA encoded by PRO2435, corresponding to a HOST TARGET binding site such as BINDING SITE I, BINDING SITE II or BINDING SITE III. Table 2 illustrates the complementarity of the nucleotide sequences of PRO2435 BINDING SITE, designated SEQ ID:20600, to the nucleotide sequence of VGAM132 RNA, herein designated VGAM RNA, also designated SEQ ID:2843.

Another function of VGAM132 is therefore inhibition of PRO2435 (Accession NM_018527). Accordingly, utilities of VGAM132 include diagnosis, prevention and treatment of diseases and clinical conditions associated with PRO2435. Proline Rich 2 (PROL2, Accession NM_006813) is another VGAM132 host target gene. PROL2 BINDING SITE is HOST TARGET binding site found in the 3' untranslated region of mRNA encoded by PROL2, corresponding to a HOST TARGET binding site such as BINDING SITE I, BINDING SITE II or BINDING SITE III. Table 2 illustrates the complementarity of the nucleotide sequences of PROL2 BINDING SITE, designated SEQ ID:13684, to the nucleotide sequence of VGAM132 RNA, herein designated VGAM RNA, also designated SEQ ID:2843.

Another function of VGAM132 is therefore inhibition of Proline Rich 2 (PROL2, Accession NM_006813). Accordingly, utilities of VGAM132 include diagnosis, prevention and treatment of diseases and clinical conditions associated with PROL2. Trans-golgi Network Protein 2 (TGOLN2, Accession XM_034215) is another VGAM132 host target gene. TGOLN2 BINDING SITE is HOST TARGET binding site found in the 3' untranslated region of mRNA encoded by TGOLN2, corresponding to a HOST TARGET binding site such as BINDING SITE I, BINDING SITE II or BINDING SITE III. Table 2 illustrates the complementarity of the nucleotide sequences of TGOLN2 BINDING SITE, designated SEQ ID:32022, to the nucleotide sequence of VGAM132 RNA, herein designated VGAM RNA, also designated SEQ ID:2843.

Another function of VGAM132 is therefore inhibition of Trans-golgi Network Protein 2 (TGOLN2, Accession XM_034215). Accordingly, utilities of VGAM132 include diagnosis, prevention and treatment of diseases and clinical conditions associated with TGOLN2. LOC126917 (Accession XM_059091) is another VGAM132 host target gene. LOC126917 BINDING SITE is HOST TARGET binding site found in the 3' untranslated region of mRNA encoded by LOC126917, corresponding to a HOST TARGET binding site such as BINDING SITE I, BINDING SITE II or BINDING SITE III. Table 2 illustrates the complementarity of the nucleotide sequences of LOC126917 BINDING SITE, designated SEQ ID:36867, to the nucleotide sequence of VGAM132 RNA, herein designated VGAM RNA, also designated SEQ ID:2843.

Another function of VGAM132 is therefore inhibition of LOC126917 (Accession XM_059091). Accordingly, utilities of VGAM132 include diagnosis, prevention and treatment of diseases and clinical conditions associated with LOC126917. LOC144866 (Accession XM_096699) is another VGAM132 host target gene. LOC144866 BINDING SITE is HOST TARGET binding site found in the 5' untranslated region of mRNA encoded by LOC144866, corresponding to a HOST TARGET binding site such as BINDING SITE I, BINDING SITE II or BINDING SITE III. Table 2 illustrates the complementarity of the nucleotide sequences of LOC144866 BINDING SITE, designated SEQ ID:40479, to the nucleotide sequence of VGAM132 RNA, herein designated VGAM RNA, also designated SEQ ID:2843.

Another function of VGAM132 is therefore inhibition of LOC144866 (Accession XM_096699). Accordingly, utilities of VGAM132 include diagnosis, prevention and treatment of diseases and clinical conditions associated with LOC144866.

LOC145739 (Accession XM_085222) is another VGAM132 host target gene. LOC145739 BINDING SITE is HOST TARGET binding site found in the 3' untranslated region of mRNA encoded by LOC145739, corresponding to a HOST TARGET binding site such as BINDING SITE I, BINDING SITE II or BINDING SITE III. Table 2 illustrates the complementarity of the nucleotide sequences of LOC145739 BINDING SITE, designated SEQ ID:37962, to the nucleotide sequence of VGAM132 RNA, herein designated VGAM RNA, also designated SEQ ID:2843.

Another function of VGAM132 is therefore inhibition of LOC145739 (Accession XM_085222). Accordingly, utilities of VGAM132 include diagnosis, prevention and treatment of diseases and clinical conditions associated with LOC145739.

LOC146287 (Accession XM_096967) is another VGAM132 host target gene. LOC146287 BINDING SITE is HOST TARGET binding site found in the 5' untranslated region of mRNA encoded by LOC146287, corresponding to a HOST TARGET binding site such as BINDING SITE I, BINDING SITE II or BINDING SITE III. Table 2 illustrates the complementarity of the nucleotide sequences of LOC146287 BINDING SITE, designated SEQ ID:40691, to the nucleotide sequence of VGAM132 RNA, herein designated VGAM RNA, also designated SEQ ID:2843.

Another function of VGAM132 is therefore inhibition of LOC146287 (Accession XM_096967). Accordingly, utilities of VGAM132 include diagnosis, prevention and treatment of diseases and clinical conditions associated with LOC146287.

LOC149842 (Accession XM_097745) is another VGAM132 host target gene. LOC149842 BINDING SITE is HOST TARGET binding site found in the 3' untranslated region of mRNA encoded by LOC149842, corresponding to a HOST TARGET binding site such as BINDING SITE I, BINDING SITE II or BINDING SITE III. Table 2 illustrates the complementarity of the nucleotide sequences of LOC149842 BINDING SITE, designated SEQ ID:41090, to the nucleotide sequence of VGAM132 RNA, herein designated VGAM RNA, also designated SEQ ID:2843.

Another function of VGAM132 is therefore inhibition of LOC149842 (Accession XM_097745). Accordingly, utilities of VGAM132 include diagnosis, prevention and treatment of diseases and clinical conditions associated with LOC149842.

LOC150951 (Accession XM_097975) is another VGAM132 host target gene. LOC150951 BINDING SITE is HOST TARGET binding site found in the 5' untranslated region of mRNA encoded by LOC150951, corresponding to a HOST TARGET binding site such as BINDING SITE I, BINDING SITE II or BINDING SITE III. Table 2 illustrates the complementarity of the nucleotide sequences of LOC150951 BINDING SITE, designated SEQ ID:41277, to the nucleotide sequence of VGAM132 RNA, herein designated VGAM RNA, also designated SEQ ID:2843.

Another function of VGAM132 is therefore inhibition of LOC150951 (Accession XM_097975). Accordingly, utilities of VGAM132 include diagnosis, prevention and treatment of diseases and clinical conditions associated with LOC150951.

LOC153277 (Accession XM_098346) is another VGAM132 host target gene. LOC153277 BINDING SITE is HOST TARGET binding site found in the 3' untranslated region of mRNA encoded by LOC153277, corresponding to a HOST TARGET binding site such as BINDING SITE I, BINDING SITE II or BINDING SITE III. Table 2 illustrates the complementarity of the nucleotide sequences of LOC153277 BINDING SITE, designated SEQ ID:41604, to the nucleotide sequence of VGAM132 RNA, herein designated VGAM RNA, also designated SEQ ID:2843.

Another function of VGAM132 is therefore inhibition of LOC153277 (Accession XM_098346). Accordingly, utilities of VGAM132 include diagnosis, prevention and treatment of diseases and clinical conditions associated with LOC153277.

LOC153727 (Accession XM_098422) is another VGAM132 host target gene. LOC153727 BINDING SITE is HOST TARGET binding site found in the 5' untranslated region of mRNA encoded by LOC153727, corresponding to a HOST TARGET binding site such as BINDING SITE I, BINDING SITE II or BINDING SITE III. Table 2 illustrates the complementarity of the nucleotide sequences of LOC153727 BINDING SITE, designated SEQ ID:41680, to the nucleotide sequence of VGAM132 RNA, herein designated VGAM RNA, also designated SEQ ID:2843.

Another function of VGAM132 is therefore inhibition of LOC153727 (Accession XM_098422). Accordingly, utilities of VGAM132 include diagnosis, prevention and treatment of diseases and clinical conditions associated with LOC153727.

LOC220883 (Accession XM_166076) is another VGAM132 host target gene. LOC220883 BINDING SITE is HOST TARGET binding site found in the 3' untranslated region of mRNA encoded by LOC220883, corresponding to a HOST TARGET binding site such as BINDING SITE I, BINDING SITE II or BINDING SITE III. Table 2 illustrates the complementarity of the nucleotide sequences of LOC220883 BINDING SITE, designated SEQ ID:43849, to the nucleotide sequence of VGAM132 RNA, herein designated VGAM RNA, also designated SEQ ID:2843.

Another function of VGAM132 is therefore inhibition of LOC220883 (Accession XM_166076). Accordingly, utilities of VGAM132 include diagnosis, prevention and treatment of diseases and clinical conditions associated with LOC220883.

LOC221662 (Accession XM_166466) is another VGAM132 host target gene. LOC221662 BINDING SITE is HOST TARGET binding site found in the 3' untranslated region of mRNA encoded by LOC221662, corresponding to a HOST TARGET binding site such as BINDING SITE I, BINDING SITE II or BINDING SITE III. Table 2 illustrates the complementarity of the nucleotide sequences of LOC221662 BINDING SITE, designated SEQ ID:44387, to the nucleotide sequence of VGAM132 RNA, herein designated VGAM RNA, also designated SEQ ID:2843.

Another function of VGAM132 is therefore inhibition of LOC221662 (Accession XM_166466). Accordingly, utilities of VGAM132 include diagnosis, prevention and treatment of diseases and clinical conditions associated with LOC221662.

LOC257484 (Accession XM_114232) is another VGAM132 host target gene. LOC257484 BINDING SITE is HOST TARGET binding site found in the 5' untranslated region of mRNA encoded by LOC257484, corresponding to a HOST TARGET binding site such as BINDING SITE I, BINDING SITE II or BINDING SITE III. Table 2 illustrates the complementarity of the nucleotide sequences of LOC257484 BINDING SITE, designated SEQ ID:42813, to the nucleotide sequence of VGAM132 RNA, herein designated VGAM RNA, also designated SEQ ID:2843.

Another function of VGAM132 is therefore inhibition of LOC257484 (Accession XM_114232). Accordingly, utilities of VGAM132 include diagnosis, prevention and treatment of diseases and clinical conditions associated with LOC257484.

LOC92539 (Accession XM_045632) is another VGAM132 host target gene. LOC92539 BINDING SITE is HOST TARGET binding site found in the 5' untranslated region of mRNA encoded by LOC92539, corresponding to a HOST TARGET binding site such as BINDING SITE I, BINDING SITE II or BINDING SITE III. Table 2 illustrates the complementarity of the nucleotide sequences of LOC92539 BINDING SITE, designated SEQ ID:34499, to the nucleotide sequence of VGAM132 RNA, herein designated VGAM RNA, also designated SEQ ID:2843.

Another function of VGAM132 is therefore inhibition of LOC92539 (Accession XM_045632). Accordingly, utilities of VGAM132 include diagnosis, prevention and treatment of diseases and clinical conditions associated with LOC92539. LOC92719 (Accession XM_046853) is another VGAM132 host target gene. LOC92719 BINDING SITE is HOST TARGET binding site found in the 3' untranslated region of mRNA encoded by LOC92719, corresponding to a HOST TARGET binding site such as BINDING SITE I, BINDING SITE II or BINDING SITE III. Table 2 illustrates the complementarity of the nucleotide sequences of LOC92719 BINDING SITE, designated SEQ ID:34848, to the nucleotide sequence of VGAM132 RNA, herein designated VGAM RNA, also designated SEQ ID:2843.

Another function of VGAM132 is therefore inhibition of LOC92719 (Accession XM_046853). Accordingly, utilities of VGAM132 include diagnosis, prevention and treatment of diseases and clinical conditions associated with LOC92719. FIG. 1 further provides a conceptual description of a novel bioinformatically detected viral gene of the present invention, referred to here as Viral Genomic Address Messenger 133 (VGAM133) viral gene, which modulates expression of respective host target genes thereof, the function and utility of which host target genes is known in the art.

VGAM133 is a novel bioinformatically detected regulatory, non protein coding, viral micro RNA (miRNA) gene. The method by which VGAM133 was detected is described hereinabove with reference to FIGS. 1-8.

VGAM133 gene, herein designated VGAM GENE, is a viral gene contained in the genome of Shrimp White Spot Syndrome Virus (white spot bacilliform virus). VGAM133 host target gene, herein designated VGAM HOST TARGET GENE, is a human gene contained in the human genome.

VGAM133 gene encodes a VGAM133 precursor RNA, herein designated VGAM PRECURSOR RNA. Similar to other miRNA genes, and unlike most ordinary genes, VGAM133 precursor RNA does not encode a protein. A nucleotide sequence identical or highly similar to the nucleotide sequence of VGAM133 precursor RNA is designated SEQ ID:119, and is provided hereinbelow with reference to the sequence listing part. Nucleotide sequence SEQ ID:119 is located at position 95821 relative to the genome of Shrimp White Spot Syndrome Virus (white spot bacilliform virus).

VGAM133 precursor RNA folds onto itself, forming VGAM133 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM133 folded precursor RNA into VGAM133 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM133 RNA is designated SEQ ID:2844, and is provided hereinbelow with reference to the sequence listing part.

VGAM133 host target gene, herein designated VGAM HOST TARGET GENE, encodes a corresponding messenger RNA, VGAM133 host target RNA, herein designated VGAM HOST TARGET RNA. VGAM133 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM133 RNA, herein designated VGAM RNA, binds complementarily to one or more host target binding sites located in untranslated regions of VGAM133 host target RNA, herein designated VGAM HOST TARGET RNA. This complementary binding is due to the fact that the nucleotide sequence of VGAM133 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM133 RNA, herein designated VGAM RNA, may have a different number of host target binding sites in untranslated regions of a VGAM133 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM133 RNA, herein designated VGAM RNA, to host target binding sites on VGAM133 host target RNA, herein designated VGAM HOST TARGET RNA, such as BINDING SITE I, BINDING SITE II and BINDING SITE III, inhibits translation of VGAM133 host target RNA into VGAM133 host target protein, herein designated VGAM HOST TARGET PROTEIN. VGAM host target protein is therefore outlined by a broken line.

It is appreciated that VGAM133 host target gene, herein designated VGAM HOST TARGET GENE, in fact represents a plurality of VGAM133 host target genes. The mRNA of each one of this plurality of VGAM133 host target genes comprises one or more host target binding sites, each having a nucleotide sequence which is at least partly complementary to VGAM133 RNA, herein designated VGAM RNA, and which when bound by VGAM133 RNA causes inhibition of translation of respective one or more VGAM133 host target proteins.

It is further appreciated by one skilled in the art that the mode of translational inhibition illustrated by FIG. 1 with specific reference to translational inhibition exerted by VGAM133 gene, herein designated VGAM GENE, on one or more VGAM133 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM133 is inhibition of expression of host target genes, as part of a novel viral mechanism of attacking a host. Accordingly, utilities of VGAM133 include diagnosis, prevention and treatment of viral infection by Shrimp White Spot Syndrome Virus (white spot bacilliform virus). Specific functions, and accordingly utilities, of VGAM133 correlate with, and may be deduced from, the identity of the host target genes which VGAM133 binds and inhibits, and the function of these host target genes, as elaborated hereinbelow.

Nucleotide sequences of the VGAM133 precursor RNA, herein designated VGAM PRECURSOR RNA, and of the 'diced' VGAM133 RNA, herein designated VGAM RNA, and a schematic representation of the secondary folding of VGAM133 folded precursor RNA, herein designated VGAM FOLDED PRECURSOR RNA, of VGAM133 are further described hereinbelow with reference to Table 1.

Nucleotide sequences of host target binding sites, such as BINDING SITE-I, BINDING SITE-II and BINDING SITE-III of FIG. 1, found on VGAM133 host target RNA, and schematic representation of the complementarity of each of these host target binding sites to VGAM133 RNA, herein designated VGAM RNA, are described hereinbelow with reference to Table 2.

As mentioned hereinabove with reference to FIG. 1, a function of VGAM133 gene, herein designated VGAM is inhibition of expression of VGAM133 target genes. It is appreciated that specific functions, and accordingly utilities, of VGAM133 correlate with, and may be deduced from, the identity of the target genes which VGAM133 binds and inhibits, and the function of these target genes, as elaborated hereinbelow.

Dishevelled, Dsh Homolog 3 (Drosophila) (DVL3, Accession NM_004423) is a VGAM133 host target gene. DVL3 BINDING SITE is HOST TARGET binding site found in the 3' untranslated region of mRNA encoded by DVL3, corresponding to a HOST TARGET binding site such as BINDING SITE I, BINDING SITE II or BINDING SITE III. Table 2 illustrates the complementarity of the nucleotide sequences of DVL3 BINDING SITE, designated SEQ ID:10690, to the nucleotide sequence of VGAM133 RNA, herein designated VGAM RNA, also designated SEQ ID:2844.

A function of VGAM133 is therefore inhibition of Dishevelled, Dsh Homolog 3 (Drosophila) (DVL3, Accession NM_004423), a gene which regulates cell proliferation. Accordingly, utilities of VGAM133 include diagnosis, prevention and treatment of diseases and clinical conditions associated with DVL3. The function of DVL3 and its association with various diseases and clinical conditions, has been established by previous studies, as described hereinabove with reference to VGAM57. Natural Killer-tumor Recognition Sequence (NKTR, Accession NM_005385) is another VGAM133 host target gene. NKTR BINDING SITE is HOST TARGET binding site found in the 3' untranslated region of mRNA encoded by NKTR, corresponding to a HOST TARGET binding site such as BINDING SITE I, BINDING SITE II or BINDING SITE III. Table 2 illustrates the complementarity of the nucleotide sequences of NKTR BINDING SITE, designated SEQ ID:11862, to the nucleotide sequence of VGAM133 RNA, herein designated VGAM RNA, also designated SEQ ID:2844.

Another function of VGAM133 is therefore inhibition of Natural Killer-tumor Recognition Sequence (NKTR, Accession NM_005385), a gene which is involved in the function of nk cells. Accordingly, utilities of VGAM133 include diagnosis, prevention and treatment of diseases and clinical conditions associated with NKTR. The function of NKTR has been established by previous studies. The natural killer triggering receptor (NKTR) is involved in the recognition of tumor cells by large granular lymphocytes (LGLs) (Frey et al., 1991; Anderson et al., 1993). LGLs are a subpopulation of white blood cells that have the ability to kill target tumor cells by an MHC-independent mechanism. The protein product of the NKTR gene is present on the surface of LGLs and facilitates their binding to tumor targets. The gene codes for a protein of 150,000 Da, with a unique amino acid structure consisting of a 58-amino acid hydrophobic amino terminus followed by a cyclophilin-related domain. No other known mammalian receptor gene has been found to contain this strong identity to the cyclophilin protein in an external domain. By somatic cell hybrid analysis, Young et al. (1993) assigned the NKTR gene to 3p23-p21. Interspecific backcross analysis demonstrated that the murine homolog maps to the distal end of mouse chromosome 9 and is closely linked to the locus coding for cholecystokinin (Cck). This region of mouse 9 shares a region of homology with human 3p. Hybridization to DNA from a variety of species including the monkey, cat, and dog was observed, indicating that this gene is highly conserved among mammalian species. Rinfret and Anderson (1993) observed 2 alternative splicing events in the 5-prime region of the NKTR mRNA in human and mouse. One uses an alternative exon 6 that disrupts the NKTR coding region and produces an mRNA encoding a truncated protein. The other splicing event generates a deletion by use of an alternative splice acceptor within exon 9. Rinfret and Anderson (1993) observed all 4 possible combinations of these events in cDNAs. Activation of natural killer cells by IL2 (OMIM Ref. No. 147680) changes the pattern of splicing, resulting in increased production of full-length protein. Simons-Evelyn et al. (1997) characterized the first 8 exons and 5-prime region of mouse Nktr. They found that mouse intron 5 also contains the alternative exon that disrupts the open reading frame.

Full details of the abovementioned studies are described in the following publications, the disclosure of which are hereby incorporated by reference:

Anderson, S. K.; Gallinger, S.; Roder, J.; Frey, J.; Young, H. A.; Ortaldo, J. R.: A cyclophilin-related protein involved in the function of natural killer cells. Proc. Nat. Acad. Sci. 90:542-546, 1993; and Rinfret, A.; Anderson, S. K.: IL-2 regulates the expression of the NK-TR gene via an alternate RNA splicing mechanism. Molec. Immun. 30:1307-1313, 1993.

Further studies establishing the function and utilities of NKTR are found in John Hopkins OMIM database record ID 161565, and in sited publications numbered 12732-12736 listed in the bibliography section hereinbelow, which are also hereby incorporated by reference. Prostaglandin E Receptor 2 (subtype EP2), 53 kDa (PTGER2, Accession NM_000956) is another VGAM133 host target gene. PTGER2 BINDING SITE is HOST TARGET binding site found in the 3' untranslated region of mRNA encoded by PTGER2, corresponding to a HOST TARGET binding site such as BINDING SITE I, BINDING SITE II or BINDING SITE III. Table 2 illustrates the complementarity of the nucleotide sequences of PTGER2 BINDING SITE, designated SEQ ID:6659, to the nucleotide sequence of VGAM133 RNA, herein designated VGAM RNA, also designated SEQ ID:2844.

Another function of VGAM133 is therefore inhibition of Prostaglandin E Receptor 2 (subtype EP2), 53 kDa (PTGER2, Accession NM_000956), a gene which is a receptor for prostaglandin e2 mediating by g-s proteins that stimulates adenylate cyclase. Accordingly, utilities of VGAM133 include diagnosis, prevention and treatment of diseases and clinical conditions associated with PTGER2. The function of PTGER2 has been established by previous studies. Epithelial tumors may be regulated by cyclooxygenase (COX) enzyme products. To determine if COX2 (OMIM Ref. No. 600262) expression and PGE2 synthesis are upregulated in cervical cancers, Sales et al. (2001) used real-time quantitative PCR and Western blot analysis to confirm COX2 RNA and protein expression in squamous cell carcinomas and adenocarcinomas. In contrast, minimal expression of COX2 was detected in histologically normal cervix. Immunohistochemical analyses localized COX2 expression and PGE2 synthesis to neoplastic epithelial cells of all squamous cell carcinomas and adenocarcinomas studied. Immunoreactive COX2 and PGE2 were also colocalized to endothelial cells lining the microvasculature. To establish whether PGE2 has an autocrine/paracrine effect in cervical carcinomas, the authors investigated the expression of 2 subtypes of PGE2 receptors, namely EP2 and EP4 by real-time quantitative PCR. Expression of EP2 and EP4 receptors was significantly higher in carcinoma tissue than in histologically normal cervix. The authors concluded that COX2, EP2, and EP4 expression and PGE2 synthesis are upregulated in cervical cancer tissue and that PGE2 may regulate neoplastic cell function in cervical carcinoma in an autocrine/paracrine manner via the EP2/EP4 receptors. Animal model experiments lend further support to the function of PTGER2. Using mice deficient in the prostaglandin EP2 receptor, Tilley et al. (1999) showed that Ep2 -/- females are infertile secondary to failure of the released ovum to become fertilized in vivo. Ep2 -/- ova could be fertilized in vitro, suggesting that in addition to previously defined roles, prostaglandins may contribute to the microenvironment in which fertilization takes place. Besides its effects on reproduction, PGE2 regulates regional blood flow in various vascular beds. Mice deficient in the EP2 PGE2 receptor displayed resting systolic blood pressure that was significantly lower than that in wildtype controls. Blood pressure increased in these animals when they were placed on a high salt diet, suggesting that the EP2 receptor may be involved in sodium handling by the kidney.

It is appreciated that the abovementioned animal model for PTGER2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Tilley, S. L.; Audoly, L. P.; Hicks, E. H.; Kim, H.-S.; Flannery, P. J.; Coffman, T. M.; Koller, B. H.: Reproductive failure and reduced blood pressure in mice lacking the EP2 prostaglandin E-2 receptor. J. Clin. Invest. 103:1539-1545, 1999; and Sales, K. J.; Katz, A. A.; Davis, M.; Hinz, S.; Soeters, R. P.; Hofmeyr, M. D.; Millar, R. P.; Jabbour, H. N.: Cyclooxygenase-2 expression and prostaglandin E2 synthesis are up-regulat.

Further studies establishing the function and utilities of PTGER2 are found in John Hopkins OMIM database record ID 176804, and in sited publications numbered 1083 and 10841-10844 listed in the bibliography section hereinbelow, which are also hereby incorporated by reference. Apoptosis Inhibitor 5 (API5, Accession NM_006595) is another VGAM133 host target gene. API5 BINDING SITE is HOST TARGET binding site found in the 3' untranslated region of mRNA encoded by API5, corresponding to a HOST TARGET binding site such as BINDING SITE I, BINDING SITE II or BINDING SITE III. Table 2 illustrates the complementarity of the nucleotide sequences of API5 BINDING SITE, designated SEQ ID:13361, to the nucleotide sequence of VGAM133 RNA, herein designated VGAM RNA, also designated SEQ ID:2844.

Another function of VGAM133 is therefore inhibition of Apoptosis Inhibitor 5 (API5, Accession NM_006595). Accordingly, utilities of VGAM133 include diagnosis, prevention and treatment of diseases and clinical conditions associated with API5. FLJ12800 (Accession NM_022903) is another VGAM133 host target gene. FLJ12800 BINDING SITE is HOST TARGET binding site found in the 3' untranslated region of mRNA encoded by FLJ12800, corresponding to a HOST TARGET binding site such as BINDING SITE I, BINDING SITE II or BINDING SITE III. Table 2 illustrates the complementarity of the nucleotide sequences of FLJ12800 BINDING SITE, designated SEQ ID:23189, to the nucleotide sequence of VGAM133 RNA, herein designated VGAM RNA, also designated SEQ ID:2844.

Another function of VGAM133 is therefore inhibition of FLJ12800 (Accession NM_022903). Accordingly, utilities of VGAM133 include diagnosis, prevention and treatment of diseases and clinical conditions associated with FLJ12800. FLJ14600 (Accession NM_032810) is another VGAM133 host target gene. FLJ14600 BINDING SITE is HOST TARGET binding site found in the 3' untranslated region of mRNA encoded by FLJ14600, corresponding to a HOST TARGET binding site such as BINDING SITE I, BINDING SITE II or BINDING SITE III. Table 2 illustrates the complementarity of the nucleotide sequences of FLJ14600 BINDING SITE, designated SEQ ID:26574, to the nucleotide sequence of VGAM133 RNA, herein designated VGAM RNA, also designated SEQ ID:2844.

Another function of VGAM133 is therefore inhibition of FLJ14600 (Accession NM_032810). Accordingly, utilities of VGAM133 include diagnosis, prevention and treatment of diseases and clinical conditions associated with FLJ14600. HERV-H LTR-associating 2 (HHLA2, Accession NM_007072) is another VGAM133 host target gene. HHLA2 BINDING SITE is HOST TARGET binding site found in the 3' untranslated region of mRNA encoded by HHLA2, corresponding to a HOST TARGET binding site such as BINDING SITE I, BINDING SITE II or BINDING SITE III. Table 2 illustrates the complementarity of the nucleotide sequences of HHLA2 BINDING SITE, designated SEQ ID:13937, to the nucleotide sequence of VGAM133 RNA, herein designated VGAM RNA, also designated SEQ ID:2844.

Another function of VGAM133 is therefore inhibition of HERV-H LTR-associating 2 (HHLA2, Accession NM_007072). Accordingly, utilities of VGAM133 include diagnosis, prevention and treatment of diseases and clinical conditions associated with HHLA2. LOC146227 (Accession XM_085374) is another VGAM133 host target gene. LOC146227 BINDING SITE is HOST TARGET binding site found in the 3' untranslated region of mRNA encoded by LOC146227, corresponding to a HOST TARGET binding site such as BINDING SITE I, BINDING SITE II or BINDING SITE III. Table 2 illustrates the complementarity of the nucleotide sequences of LOC146227 BINDING SITE, designated SEQ ID:38082, to the nucleotide sequence of VGAM133 RNA, herein designated VGAM RNA, also designated SEQ ID:2844.

Another function of VGAM133 is therefore inhibition of LOC146227 (Accession XM_085374). Accordingly, utilities of VGAM133 include diagnosis, prevention and treatment of diseases and clinical conditions associated with LOC146227. LOC170063 (Accession XM_104820) is another VGAM133 host target gene. LOC170063 BINDING SITE is HOST TARGET binding site found in the 3' untranslated region of mRNA encoded by LOC170063, corresponding to a HOST TARGET binding site such as BINDING SITE I, BINDING SITE II or BINDING SITE III. Table 2 illustrates the complementarity of the nucleotide sequences of LOC170063 BINDING SITE, designated SEQ ID:42186, to the nucleotide sequence of VGAM133 RNA, herein designated VGAM RNA, also designated SEQ ID:2844.

Another function of VGAM133 is therefore inhibition of LOC170063 (Accession XM_104820). Accordingly, utilities of VGAM133 include diagnosis, prevention and treatment of diseases and clinical conditions associated with LOC170063. FIG. 1 further provides a conceptual description of a novel bioinformatically detected viral gene of the present invention, referred to here as Viral Genomic Address Messenger 134 (VGAM134) viral gene, which modulates expression of respective host target genes thereof, the function and utility of which host target genes is known in the art.

VGAM134 is a novel bioinformatically detected regulatory, non protein coding, viral micro RNA (miRNA) gene. The method by which VGAM134 was detected is described hereinabove with reference to FIGS. 1-8.

VGAM134 gene, herein designated VGAM GENE, is a viral gene contained in the genome of Shrimp White Spot Syndrome Virus (white spot bacilliform virus). VGAM134 host target gene, herein designated VGAM HOST TARGET GENE, is a human gene contained in the human genome.

VGAM134 gene encodes a VGAM134 precursor RNA, herein designated VGAM PRECURSOR RNA. Similar to other miRNA genes, and unlike most ordinary genes, VGAM134 precursor RNA does not encode a protein. A nucleotide sequence identical or highly similar to the nucleotide sequence of VGAM134 precursor RNA is designated SEQ ID:120, and is provided hereinbelow with reference to the sequence listing part. Nucleotide sequence SEQ ID:120 is located at position 80787 relative to the genome of Shrimp White Spot Syndrome Virus (white spot bacilliform virus).

VGAM134 precursor RNA folds onto itself, forming VGAM134 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM134 folded precursor RNA into VGAM134 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM134 RNA is designated SEQ ID:2845, and is provided hereinbelow with reference to the sequence listing part.

VGAM134 host target gene, herein designated VGAM HOST TARGET GENE, encodes a corresponding messenger RNA, VGAM134 host target RNA, herein designated VGAM HOST TARGET RNA. VGAM134 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM134 RNA, herein designated VGAM RNA, binds complementarily to one or more host target binding sites located in untranslated regions of VGAM134 host target RNA, herein designated VGAM HOST TARGET RNA. This complementary binding is due to the fact that the nucleotide sequence of VGAM134 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM134 RNA, herein designated VGAM RNA, may have a different number of host target binding sites in untranslated regions of a VGAM134 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM134 RNA, herein designated VGAM RNA, to host target binding sites on VGAM134 host target RNA, herein designated VGAM HOST TARGET RNA, such as BINDING SITE I, BINDING SITE II and BINDING SITE III, inhibits translation of VGAM134 host target RNA into VGAM134 host target protein, herein designated VGAM HOST TARGET PROTEIN. VGAM host target protein is therefore outlined by a broken line.

It is appreciated that VGAM134 host target gene, herein designated VGAM HOST TARGET GENE, in fact represents a plurality of VGAM134 host target genes. The mRNA of each one of this plurality of VGAM134 host target genes comprises one or more host target binding sites, each having a nucleotide sequence which is at least partly complementary to VGAM134 RNA, herein designated VGAM RNA, and which when bound by VGAM134 RNA causes inhibition of translation of respective one or more VGAM134 host target proteins.

It is further appreciated by one skilled in the art that the mode of translational inhibition illustrated by FIG. 1 with specific reference to translational inhibition exerted by VGAM134 gene, herein designated VGAM GENE, on one or more VGAM134 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM134 is inhibition of expression of host target genes, as part of a novel viral mechanism of attacking a host. Accordingly, utilities of VGAM134 include diagnosis, prevention and treatment of viral infection by Shrimp White Spot Syndrome Virus (white spot bacilliform virus). Specific functions, and accordingly utilities, of VGAM134 correlate with, and may be deduced from, the identity of the host target genes which VGAM134 binds and inhibits, and the function of these host target genes, as elaborated hereinbelow.

Nucleotide sequences of the VGAM134 precursor RNA, herein designated VGAM PRECURSOR RNA, and of the 'diced' VGAM134 RNA, herein designated VGAM RNA, and a schematic representation of the secondary folding of VGAM134 folded precursor RNA, herein designated VGAM FOLDED PRECURSOR RNA, of VGAM134 are further described hereinbelow with reference to Table 1.

Nucleotide sequences of host target binding sites, such as BINDING SITE-I, BINDING SITE-II and BINDING SITE-III of FIG. 1, found on VGAM134 host target RNA, and schematic representation of the complementarity of each of these host target binding sites to VGAM134 RNA, herein designated VGAM RNA, are described hereinbelow with reference to Table 2.

As mentioned hereinabove with reference to FIG. 1, a function of VGAM134 gene, herein designated VGAM is inhibition of expression of VGAM134 target genes. It is appreciated that specific functions, and accordingly utilities, of VGAM134 correlate with, and may be deduced from, the identity of the target genes which VGAM134 binds and inhibits, and the function of these target genes, as elaborated hereinbelow.

Interleukin 10 Receptor, Alpha (IL10RA, Accession XM_006447) is a VGAM134 host target gene. IL10RA BINDING SITE is HOST TARGET binding site found in the 3' untranslated region of mRNA encoded by IL10RA, corresponding to a HOST TARGET binding site such as BINDING SITE I, BINDING SITE II or BINDING SITE III. Table 2 illustrates the complementarity of the nucleotide sequences of IL10RA BINDING SITE, designated SEQ ID:29998, to the nucleotide sequence of VGAM134 RNA, herein designated VGAM RNA, also designated SEQ ID:2845.

A function of VGAM134 is therefore inhibition of Interleukin 10 Receptor, Alpha (IL10RA, Accession XM_006447), a gene which is a receptor for il-10. Accordingly, utilities of VGAM134 include diagnosis, prevention and treatment of diseases and clinical conditions associated with IL10RA. The function of IL10RA has been established by previous studies. Interleukin-10 (OMIM Ref. No. 124092) is a cytokine produced by B cells, T helper cells, and cells of the monocyte/macrophage lineage that exhibits diverse activities on different cell lines. Tan et al. (1993) showed that the protein can be enzymatically iodinated to high specific radioactivity with retention of biologic activity. The radiolabeled ligand was found to bind specifically to its receptor in several mouse and human cell lines. For both mouse and human cell lines examined, there appeared to be at most only a few hundred IL10 receptors per cell. Mouse IL10 was capable of blocking binding of human IL10 to mouse but not human cells. Ho et al. (1993) found that mouse il-10r is structurally related to interferon receptors. Since IL-10 inhibits macrophage activation by interferon-gamma, a possible implication of this relationship is interaction of IL-10R and IFN-gamma-R or their signaling pathways. Liu et al. (1994) assigned the IL10R gene to chromosome 11 by analysis of DNAs from human/hamster hybrid cell lines. Taniyama et al. (1995) regionalized the assignment to 11q23.3 by fluorescence in situ hybridization.

Full details of the abovementioned studies are described in the following publications, the disclosure of which are hereby incorporated by reference:

Ho, A. S. Y.; Liu, Y.; Khan, T. A.; Hsu, D.-H.; Bazan, J. F.; Moore, K. W.: A receptor for interleukin 10 is related to interferon receptors. Proc. Nat. Acad. Sci. 90:11267-11271, 1993; and Liu, Y.; Wei, S. H.-Y.; Ho, A. S.-Y.; de Waal Malefyt, R.; Moore, K. W.: Expression cloning and characterization of a human Il-10 receptor. J. Immun. 152:1821-1829, 1994.

Further studies establishing the function and utilities of IL10RA are found in John Hopkins OMIM database record ID 146933, and in sited publications numbered 12525-12526, 88 and 2732 listed in the bibliography section hereinbelow, which are also hereby incorporated by reference.inositol (myo)-1(or 4)-monophosphatase 1 (IMPA1, Accession NM_005536) is another VGAM134 host target gene. IMPA1 BINDING SITE is HOST TARGET binding site found in the 3' untranslated region of mRNA encoded by IMPA1, corresponding to a HOST TARGET binding site such as BINDING SITE I, BINDING SITE II or BINDING SITE III. Table 2 illustrates the complementarity of the nucleotide sequences of IMPA1 BINDING SITE, designated SEQ ID:12056, to the nucleotide sequence of VGAM134 RNA, herein designated VGAM RNA, also designated SEQ ID:2845.

Another function of VGAM134 is therefore inhibition of inositol (myo)-1(or 4)-monophosphatase 1 (IMPA1, Accession NM_005536), a gene which is responsible for the provision of inositol required for synthesis of phosphatidylinositol and polyphosphoinositides. Accordingly, utilities of VGAM134 include diagnosis, prevention and treatment of diseases and clinical conditions associated with IMPA1. The function of IMPA1 has been established by previous studies. Manic depressive illness (OMIM Ref. No. 125480) is a serious psychiatric disorder that in many, but far from all, patients can be treated with lithium. The main causes for discontinuation of lithium therapy are unpleasant or serious side effects and lack of response. The reason for the striking variation in clinical efficacy of lithium treatment among bipolar patients is not known. The enzyme myo-inositol monophosphatase (OMIM Ref. No. IMPase) has been postulated as a target for the mood-stabilizing effects of lithium. The gene encoding human IMPase (IMPA1) was cloned by McAllister et al. (1992); variation in the 277-codon coding region of IMPA1 has not been observed in manic-depressive patients (Steen et al., 1996). It is nevertheless conceivable that polymorphisms or mutations in the noncoding regions of this gene could influence the lithium response in psychiatric patients. As a first step in investigating this possibility, Sjoholt et al. (1997) determined the genomic structure of the human IMPA1 gene. They found that it is composed of at least 9 exons and covers more than 20 kb of sequence on 8q21.13-q21.3. The chromosomal mapping was performed by PCR analysis of both CEPH megabase-insert YAC DNA pools and human/rodent somatic cell hybrid DNAs. In the 3-prime untranslated part of the gene, they observed a polymorphism (a G to A transition) and also 2 short sequences similar to the inositol/cholin-responsive element consensus. They postulated that 2 additional IMPA-like transcripts originate from the human genome, one from a position close to IMPA1 itself on chromosome 8 and the other from 18p Full details of the abovementioned studies are described in the following publications, the disclosure of which are hereby incorporated by reference:

Sjoholt, G.; Molven, A.; Lovlie, R.; Wilcox, A.; Sikela, J. M.; Steen, V. M.: Genomic structure and chromosomal localization of a human myo-inositol monophosphatase gene (IMPA). Genomics 45:113-122, 1997; and Steen, V. M.; Gulbrandsen, A. K.; Eiken, H. G.; Berle, J. O.: Lack of genetic variation in the coding region of the myo-inositol monophosphatase gene in lithium-treated patients with ma.

Further studies establishing the function and utilities of IMPA1 are found in John Hopkins OMIM database record ID 602064, and in sited publications numbered 8905-8907 listed in the bibliography section hereinbelow, which are also hereby incorporated by reference. Ribosomal Protein L17 (RPL17, Accession NM_000985) is another VGAM134 host target gene. RPL17 BINDING SITE is HOST TARGET binding site found in the 5' untranslated region of mRNA encoded by RPL17, corresponding to a HOST TARGET binding site such as BINDING SITE I, BINDING SITE II or BINDING SITE III. Table 2 illustrates the complementarity of the nucleotide sequences of RPL17 BINDING SITE, designated SEQ ID:6696, to the nucleotide sequence of VGAM134 RNA, herein designated VGAM RNA, also designated SEQ ID:2845.

Another function of VGAM134 is therefore inhibition of Ribosomal Protein L17 (RPL17, Accession NM_000985). Accordingly, utilities of VGAM134 include diagnosis, prevention and treatment of diseases and clinical conditions associated with RPL17. Src Family Associated Phosphoprotein 2 (SCAP2, Accession NM_003930) is another VGAM134 host target gene. SCAP2 BINDING SITE is HOST TARGET binding site found in the 3' untranslated region of mRNA encoded by SCAP2, corresponding to a HOST TARGET binding site such as BINDING SITE I, BINDING SITE II or BINDING SITE III. Table 2 illustrates the complementarity of the nucleotide sequences of SCAP2 BINDING SITE, designated SEQ ID:10028, to the nucleotide sequence of VGAM134 RNA, herein designated VGAM RNA, also designated SEQ ID:2845.

Another function of VGAM134 is therefore inhibition of Src Family Associated Phosphoprotein 2 (SCAP2, Accession NM_003930), a gene which interacts with Src family protein tyrosine kinases and SLAP/FYB (SLA). Accordingly, utilities of VGAM134 include diagnosis, prevention and treatment of diseases and clinical conditions associated with SCAP2. The function of SCAP2 has been established by previous studies. Src family kinases (e.g., FYN; 137025) are involved in signal transduction of tyrosine and nontyrosine kinase receptors in a variety of cells. The Src kinase-associated phosphoprotein SKAP55 (OMIM Ref. No. 604969) is a constitutively tyrosine-phosphorylated, 55-kD protein that interacts with FYN and FYB (OMIM Ref. No. 602731) in T lymphocytes. Marie-Cardine et al. (1998) identified a cDNA encoding SKAP55R, which they called SKAP-HOM (SKAP55 homolog). Western blot and 2-dimensional isoelectric-focusing (IEF)/SDS-PAGE analysis showed that SKAP55R is more basic and migrates more slowly than SKAP55. In contrast to SKAP55, which is preferentially expressed in T cells, Northern blot analysis detected nearly ubiquitous expression of a 4.2-kb SKAP55R transcript as well as testis-specific 1.3- and 2.2-kb transcripts. Immunoblot analysis demonstrated that unlike SKAP55, SKAP55R is not constitutively phosphorylated in T cells. The authors found that FYN but not LCK (OMIM Ref. No. 153390) or ZAP70 (OMIM Ref. No. 176947) phosphorylates both SKAP55 and SKAP55R.

Full details of the abovementioned studies are described in the following publications, the disclosure of which are hereby incorporated by reference:

Liu, J.; Kang, H.; Raab, M.; da Silva, A. J.; Kraeft, S.-K.; Rudd, C. E.: FYB (FYN binding protein) serves as a binding partner for lymphoid protein and FYN kinase substrate SKAP55 and a SKAP55-related protein in T cells. Proc. Nat. Acad. Sci. 95:8779-8784, 1998; and Marie-Cardine, A.; Verhagen, A. M.; Eckerskorn, C.; Schraven, B.: SKAP-HOM, a novel adaptor protein homologous to the FYN-associated protein SKAP55. FEBS Lett. 435:55-60, 1998.

Further studies establishing the function and utilities of SCAP2 are found in John Hopkins OMIM database record ID 605215, and in sited publications numbered 6966-6968 listed in the bibliography section hereinbelow, which are also hereby incorporated by reference. Chromosome 15 Open Reading Frame 5 (C15orf5, Accession NM_030944) is another VGAM134 host target gene. C15orf5 BINDING SITE is HOST TARGET binding site found in the 3' untranslated region of mRNA encoded by C15orf5, corresponding to a HOST TARGET binding site such as BINDING SITE I, BINDING SITE II or BINDING SITE III. Table 2 illustrates the complementarity of the nucleotide sequences of C15orf5 BINDING SITE, designated SEQ ID:25213, to the nucleotide sequence of VGAM134 RNA, herein designated VGAM RNA, also designated SEQ ID:2845.

Another function of VGAM134 is therefore inhibition of Chromosome 15 Open Reading Frame 5 (C15orf5, Accession NM_030944). Accordingly, utilities of VGAM134 include diagnosis, prevention and treatment of diseases and clinical conditions associated with C15orf5. FLJ13105 (Accession NM_025001) is another VGAM134 host target gene. FLJ13105 BINDING SITE is HOST TARGET binding site found in the 3' untranslated region of mRNA encoded by FLJ13105, corresponding to a HOST TARGET binding site such as BINDING SITE I, BINDING SITE II or BINDING SITE III. Table 2 illustrates the complementarity of the nucleotide sequences of FLJ13105 BINDING SITE, designated SEQ ID:24571, to the nucleotide sequence of VGAM134 RNA, herein designated VGAM RNA, also designated SEQ ID:2845.

Another function of VGAM134 is therefore inhibition of FLJ13105 (Accession NM_025001). Accordingly, utilities of VGAM134 include diagnosis, prevention and treatment of diseases and clinical conditions associated with FLJ13105. KIAA1198 (Accession XM_032674) is another VGAM134 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31710, to the nucleotide sequence of VGAM134 RNA, herein designated VGAM RNA, also designated SEQ ID:2845.

Another function of VGAM134 is therefore inhibition of KIAA1198 (Accession XM_032674). Accordingly, utilities of VGAM134 include diagnosis, prevention and treatment of diseases and clinical conditions associated with KIAA1198. KIAA1795 (Accession XM_050988) is another VGAM134 host target gene. KIAA1795 BINDING SITE is HOST TARGET binding site found in the 3' untranslated region of mRNA encoded by KIAA1795, corresponding to a HOST TARGET binding site such as BINDING SITE I, BINDING SITE II or BINDING SITE III. Table 2 illustrates the complementarity of the nucleotide sequences of KIAA1795 BINDING SITE, designated SEQ ID:35701, to the nucleotide sequence of VGAM134 RNA, herein designated VGAM RNA, also designated SEQ ID:2845.

Another function of VGAM134 is therefore inhibition of KIAA1795 (Accession XM_050988). Accordingly, utilities of VGAM134 include diagnosis, prevention and treatment of diseases and clinical conditions associated with KIAA1795. KIAA1915 (Accession XM_055481) is another VGAM134 host target gene. KIAA1915 BINDING SITE is HOST TARGET binding site found in the 3' untranslated region of mRNA encoded by KIAA1915, corresponding to a HOST TARGET binding site such as BINDING SITE I, BINDING SITE II or BINDING SITE III. Table 2 illustrates the complementarity of the nucleotide sequences of KIAA1915 BINDING SITE, designated SEQ ID:36269, to the nucleotide sequence of VGAM134 RNA, herein designated VGAM RNA, also designated SEQ ID:2845.

Another function of VGAM134 is therefore inhibition of KIAA1915 (Accession XM_055481). Accordingly, utilities of VGAM134 include diagnosis, prevention and treatment of diseases and clinical conditions associated with KIAA1915.

LOC158798 (Accession XM_088671) is another VGAM134 host target gene. LOC158798 BINDING SITE is HOST TARGET binding site found in the 5' untranslated region of mRNA encoded by LOC158798, corresponding to a HOST TARGET binding site such as BINDING SITE I, BINDING SITE II or BINDING SITE III. Table 2 illustrates the complementarity of the nucleotide sequences of LOC158798 BINDING SITE, designated SEQ ID:39892, to the nucleotide sequence of VGAM134 RNA, herein designated VGAM RNA, also designated SEQ ID:2845.

Another function of VGAM134 is therefore inhibition of LOC158798 (Accession XM_088671). Accordingly, utilities of VGAM134 include diagnosis, prevention and treatment of diseases and clinical conditions associated with LOC158798. LOC221486 (Accession XM_165760) is another VGAM134 host target gene. LOC221486 BINDING SITE is HOST TARGET binding site found in the 3' untranslated region of mRNA encoded by LOC221486, corresponding to a HOST TARGET binding site such as BINDING SITE I, BINDING SITE II or BINDING SITE III. Table 2 illustrates the complementarity of the nucleotide sequences of LOC221486 BINDING SITE, designated SEQ ID:43744, to the nucleotide sequence of VGAM134 RNA, herein designated VGAM RNA, also designated SEQ ID:2845.

Another function of VGAM134 is therefore inhibition of LOC221486 (Accession XM_165760). Accordingly, utilities of VGAM134 include diagnosis, prevention and treatment of diseases and clinical conditions associated with LOC221486. LOC51605 (Accession NM_015939) is another VGAM134 host target gene. LOC51605 BINDING SITE is HOST TARGET binding site found in the 3' untranslated region of mRNA encoded by LOC51605, corresponding to a HOST TARGET binding site such as BINDING SITE I, BINDING SITE II or BINDING SITE III. Table 2 illustrates the complementarity of the nucleotide sequences of LOC51605 BINDING SITE, designated SEQ ID:18061, to the nucleotide sequence of VGAM134 RNA, herein designated VGAM RNA, also designated SEQ ID:2845.

Another function of VGAM134 is therefore inhibition of LOC51605 (Accession NM_015939). Accordingly, utilities of VGAM134 include diagnosis, prevention and treatment of diseases and clinical conditions associated with LOC51605.

FIG. 1 further provides a conceptual description of a novel bioinformatically detected viral gene of the present invention, referred to here as Viral Genomic Address Messenger 135 (VGAM135) viral gene, which modulates expression of respective host target genes thereof, the function and utility of which host target genes is known in the art.

VGAM135 is a novel bioinformatically detected regulatory, non protein coding, viral micro RNA (miRNA) gene. The method by which VGAM135 was detected is described hereinabove with reference to FIGS. 1-8.

VGAM135 gene, herein designated VGAM GENE, is a viral gene contained in the genome of Shrimp White Spot Syndrome Virus (white spot bacilliform virus). VGAM135 host target gene, herein designated VGAM HOST TARGET GENE, is a human gene contained in the human genome.

VGAM135 gene encodes a VGAM135 precursor RNA, herein designated VGAM PRECURSOR RNA. Similar to other miRNA genes, and unlike most ordinary genes, VGAM135 precursor RNA does not encode a protein. A nucleotide sequence identical or highly similar to the nucleotide sequence of VGAM135 precursor RNA is designated SEQ ID:121, and is provided hereinbelow with reference to the sequence listing part. Nucleotide sequence SEQ ID:121 is located at position 145555 relative to the genome of Shrimp White Spot Syndrome Virus (white spot bacilliform virus).

VGAM135 precursor RNA folds onto itself, forming VGAM135 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM135 folded precursor RNA into VGAM135 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM135 RNA is designated SEQ ID:2846, and is provided hereinbelow with reference to the sequence listing part.

VGAM135 host target gene, herein designated VGAM HOST TARGET GENE, encodes a corresponding messenger RNA, VGAM135 host target RNA, herein designated VGAM HOST TARGET RNA. VGAM135 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM135 RNA, herein designated VGAM RNA, binds complementarily to one or more host target binding sites located in untranslated regions of VGAM135 host target RNA, herein designated VGAM HOST TARGET RNA. This complementary binding is due to the fact that the nucleotide sequence of VGAM135 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM135 RNA, herein designated VGAM RNA, may have a different number of host target binding sites in untranslated regions of a VGAM135 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM135 RNA, herein designated VGAM RNA, to host target binding sites on VGAM135 host target RNA, herein designated VGAM HOST TARGET RNA, such as BINDING SITE I, BINDING SITE II and BINDING SITE III, inhibits translation of VGAM135 host target RNA into VGAM135 host target protein, herein designated VGAM HOST TARGET PROTEIN. VGAM host target protein is therefore outlined by a broken line.

It is appreciated that VGAM135 host target gene, herein designated VGAM HOST TARGET GENE, in fact represents a plurality of VGAM135 host target genes. The mRNA of each one of this plurality of VGAM135 host target genes comprises one or more host target binding sites, each having a nucleotide sequence which is at least partly complementary to VGAM135 RNA, herein designated VGAM RNA, and which when bound by VGAM135 RNA causes inhibition of translation of respective one or more VGAM135 host target proteins.

It is further appreciated by one skilled in the art that the mode of translational inhibition illustrated by FIG. 1 with specific reference to translational inhibition exerted by VGAM135 gene, herein designated VGAM GENE, on one or more VGAM135 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM135 is inhibition of expression of host target genes, as part of a novel viral mechanism of attacking a host. Accordingly, utilities of VGAM135 include diagnosis, prevention and treatment of viral infection by Shrimp White Spot Syndrome Virus (white spot bacilliform virus). Specific functions, and accordingly utilities, of VGAM135 correlate with, and may be deduced from, the identity of the host target genes which VGAM135 binds and inhibits, and the function of these host target genes, as elaborated hereinbelow.

Nucleotide sequences of the VGAM135 precursor RNA, herein designated VGAM PRECURSOR RNA, and of the 'diced' VGAM135 RNA, herein designated VGAM RNA, and a schematic representation of the secondary folding of VGAM135 folded precursor RNA, herein designated VGAM FOLDED PRECURSOR RNA, of VGAM135 are further described hereinbelow with reference to Table 1.

Nucleotide sequences of host target binding sites, such as BINDING SITE-I, BINDING SITE-II and BINDING SITE-III of FIG. 1, found on VGAM135 host target RNA, and schematic representation of the complementarity of each of these host target binding sites to VGAM135 RNA, herein designated VGAM RNA, are described hereinbelow with reference to Table 2.

As mentioned hereinabove with reference to FIG. 1, a function of VGAM135 gene, herein designated VGAM is inhibition of expression of VGAM135 target genes. It is appreciated that specific functions, and accordingly utilities, of VGAM135 correlate with, and may be deduced from, the identity of the target genes which VGAM135 binds and inhibits, and the function of these target genes, as elaborated hereinbelow.

Adenylate Kinase 3 (AK3, Accession NM_013410) is a VGAM135 host target gene. AK3 BINDING SITE is HOST TARGET binding site found in the 3' untranslated region of mRNA encoded by AK3, corresponding to a HOST TARGET binding site such as BINDING SITE I, BINDING SITE II or BINDING SITE III. Table 2 illustrates the complementarity of the nucleotide sequences of AK3 BINDING SITE, designated SEQ ID:15073, to the nucleotide sequence of VGAM135 RNA, herein designated VGAM RNA, also designated SEQ ID:2846.

A function of VGAM135 is therefore inhibition of Adenylate Kinase 3 (AK3, Accession NM_013410), a gene which Adenylate kinase 3; strongly similar to murine Ak4. Accordingly, utilities of VGAM135 include diagnosis, prevention and treatment of diseases and clinical conditions associated with AK3. The function of AK3 has been established by previous studies. The adenylate kinases are a family of structurally and functionally related enzymes that catalyze a similar reaction, MgNTP+AMP=MgNDP+ADP (N=A or G). The AK enzymes are important for maintenance of homeostasis of the adenine and guanine nucleotide pools. AK1 (OMIM Ref. No. 103000) is a cytosolic enzyme for which ATP is the substrate. AK2 (OMIM Ref. No. 103020) catalyzes the same reaction as AK1, but it is localized in the mitochondrial intermembrane space. AK3 is present in the mitochondrial matrix and prefers GTP over ATP as the substrate. Wilson et al. (1976) pointed out that AK3 is nucleosidetriphosphate-adenylate kinase. In the course of their efforts to identify the gene causing neurofibromatosis (NF1; 162200), Viskochil et al. (1990) found a gene first designated HB15, which Xu et al. (1992) subsequently concluded is probably a processed pseudogene of AK3. It is intronless and contains a polyadenylate tract, but retains coding potential because the open reading frame was not impaired by any observed base substitutions. One presumed processed pseudogene of AK3 is located within an intron of the NF1 gene. Xu et al. (1992) also characterized cDNA clones for the authentic AK3. By study of somatic cell hybrids, Povey et al. (1976) assigned AK3 to chromosome 9. The SRO (smallest region of overlap) for AK3 was estimated to be 9p24-p13 (Robson and Meera Khan, 1982). By interspecific backcross linkage analysis, Pilz et al. (1995) mapped the Ak3 gene to mouse chromosome 4. Gene map locus 9p24-p13

Full details of the abovementioned studies are described in the following publications, the disclosure of which are hereby incorporated by reference:

Xu, G.; O'Connell, P.; Stevens, J.; White, R.: Characterization of human adenylate kinase 3 (AK3) cDNA and mapping of the AK3 pseudogene to an intron of the NF1 gene. Genomics 13:537-542, 1992; and Pilz, A.; Woodward, K.; Povey, S.; Abbott, C.: Comparative mapping of 50 human chromosome 9 loci in the laboratory mouse. Genomics 25:139-149, 1995.

Further studies establishing the function and utilities of AK3 are found in John Hopkins OMIM database record ID 103030, and in sited publications numbered 802-810 listed in the bibliography section hereinbelow, which are also hereby incorporated by reference. FLJ11210 (Accession XM_005298) is another VGAM135 host target gene. FLJ11210 BINDING SITE is HOST TARGET binding site found in the 3' untranslated region of mRNA encoded by FLJ11210, corresponding to a HOST TARGET binding site such as BINDING SITE I, BINDING SITE II or BINDING SITE III. Table 2 illustrates the complementarity of the nucleotide sequences of FLJ11210 BINDING SITE, designated SEQ ID:29975, to the nucleotide sequence of VGAM135 RNA, herein designated VGAM RNA, also designated SEQ ID:2846.

Another function of VGAM135 is therefore inhibition of FLJ11210 (Accession XM_005298). Accordingly, utilities of VGAM135 include diagnosis, prevention and treatment of diseases and clinical conditions associated with FLJ11210. KIAA1145 (Accession XM_037790) is another VGAM135 host target gene. KIAA1145 BINDING SITE is HOST TARGET binding site found in the 3' untranslated region of mRNA encoded by KIAA1145, corresponding to a HOST TARGET binding site such as BINDING SITE I, BINDING SITE II or BINDING SITE III. Table 2 illustrates the complementarity of the nucleotide sequences of KIAA1145 BINDING SITE, designated SEQ ID:32682, to the nucleotide sequence of VGAM135 RNA, herein designated VGAM RNA, also designated SEQ ID:2846.

Another function of VGAM135 is therefore inhibition of KIAA1145 (Accession XM_037790). Accordingly, utilities of VGAM135 include diagnosis, prevention and treatment of diseases and clinical conditions associated with KIAA1145.

MGC13105 (Accession XM_049394) is another VGAM135 host target gene. MGC13105 BINDING SITE is HOST TARGET binding site found in the 3' untranslated region of mRNA encoded by MGC13105, corresponding to a HOST TARGET binding site such as BINDING SITE I, BINDING SITE II or BINDING SITE III. Table 2 illustrates the complementarity of the nucleotide sequences of MGC13105 BINDING SITE, designated SEQ ID:35408, to the nucleotide sequence of VGAM135 RNA, herein designated VGAM RNA, also designated SEQ ID:2846.

Another function of VGAM135 is therefore inhibition of MGC13105 (Accession XM_049394). Accordingly, utilities of VGAM135 include diagnosis, prevention and treatment of diseases and clinical conditions associated with MGC13105. LOC200014 (Accession XM_114087) is another VGAM135 host target gene. LOC200014 BINDING SITE is HOST TARGET binding site found in the 3' untranslated region of mRNA encoded by LOC200014, corresponding to a HOST TARGET binding site such as BINDING SITE I, BINDING SITE II or BINDING SITE III. Table 2 illustrates the complementarity of the nucleotide sequences of LOC200014 BINDING SITE, designated SEQ ID:42690, to the nucleotide sequence of VGAM135 RNA, herein designated VGAM RNA, also designated SEQ ID:2846.

Another function of VGAM135 is therefore inhibition of LOC200014 (Accession XM_114087). Accordingly, utilities of VGAM135 include diagnosis, prevention and treatment of diseases and clinical conditions associated with LOC200014. LOC202934 (Accession XM_117486) is another VGAM135 host target gene. LOC202934 BINDING SITE is HOST TARGET binding site found in the 3' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43467, to the nucleotide sequence of VGAM135 RNA, herein designated VGAM RNA, also designated SEQ ID:2846.

Another function of VGAM135 is therefore inhibition of LOC202934 (Accession XM_117486). Accordingly, utilities of VGAM135 include diagnosis, prevention and treatment of diseases and clinical conditions associated with LOC202934. LOC255465 (Accession XM_173206) is another VGAM135 host target gene. LOC255465 BINDING SITE is HOST TARGET binding site found in the 3' untranslated region of mRNA encoded by LOC255465, corresponding to a HOST TARGET binding site such as BINDING SITE I, BINDING SITE II or BINDING SITE III. Table 2 illustrates the complementarity of the nucleotide sequences of LOC255465 BINDING SITE, designated SEQ ID:46459, to the nucleotide sequence of VGAM135 RNA, herein designated VGAM RNA, also designated SEQ ID:2846.

Another function of VGAM135 is therefore inhibition of LOC255465 (Accession XM_173206). Accordingly, utilities of VGAM135 include diagnosis, prevention and treatment of diseases and clinical conditions associated with LOC255465. LOC257319 (Accession XM_171049) is another VGAM135 host target gene. LOC257319 BINDING SITE is HOST TARGET binding site found in the 3' untranslated region of mRNA encoded by LOC257319, corresponding to a HOST TARGET binding site such as BINDING SITE I, BINDING SITE II or BINDING SITE III. Table 2 illustrates the complementarity of the nucleotide sequences of LOC257319 BINDING SITE, designated SEQ ID:45835, to the nucleotide sequence of VGAM135 RNA, herein designated VGAM RNA, also designated SEQ ID:2846.

Another function of VGAM135 is therefore inhibition of LOC257319 (Accession XM_171049). Accordingly, utilities of VGAM135 include diagnosis, prevention and treatment of diseases and clinical conditions associated with LOC257319. FIG. 1 further provides a conceptual description of a novel bioinformatically detected viral gene of the present invention, referred to here as Viral Genomic Address Messenger 136 (VGAM136) viral gene, which modulates expression of respective host target genes thereof, the function and utility of which host target genes is known in the art.

VGAM136 is a novel bioinformatically detected regulatory, non protein coding, viral micro RNA (miRNA) gene. The method by which VGAM136 was detected is described hereinabove with reference to FIGS. 1-8.

VGAM136 gene, herein designated VGAM GENE, is a viral gene contained in the genome of Shrimp White Spot Syndrome Virus (white spot baciliform virus). VGAM136 host target gene, herein designated VGAM HOST TARGET GENE, is a human gene contained in the human genome.

VGAM136 gene encodes a VGAM136 precursor RNA, herein designated VGAM PRECURSOR RNA. Similar to other miRNA genes, and unlike most ordinary genes, VGAM136 precursor RNA does not encode a protein. A nucleotide sequence identical or highly similar to the nucleotide sequence of VGAM136 precursor RNA is designated SEQ ID:122, and is provided hereinbelow with reference to the sequence listing part. Nucleotide sequence SEQ ID:122 is located at position 91976 relative to the genome of Shrimp White Spot Syndrome Virus (white spot baciliform virus).

VGAM136 precursor RNA folds onto itself, forming VGAM136 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM136 folded precursor RNA into VGAM136 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM136 RNA is designated SEQ ID:2847, and is provided hereinbelow with reference to the sequence listing part.

VGAM136 host target gene, herein designated VGAM HOST TARGET GENE, encodes a corresponding messenger RNA, VGAM136 host target RNA, herein designated VGAM HOST TARGET RNA. VGAM136 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM136 RNA, herein designated VGAM RNA, binds complementarily to one or more host target binding sites located in untranslated regions of VGAM136 host target RNA, herein designated VGAM HOST TARGET RNA. This complementary binding is due to the fact that the nucleotide sequence of VGAM136 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM136 RNA, herein designated VGAM RNA, may have a different number of host target binding sites in untranslated regions of a VGAM136 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM136 RNA, herein designated VGAM RNA, to host target binding sites on VGAM136 host target RNA, herein designated VGAM HOST TARGET RNA, such as BINDING SITE I, BINDING SITE II and BINDING SITE III, inhibits translation of VGAM136 host target RNA into VGAM136 host target protein, herein designated VGAM HOST TARGET PROTEIN. VGAM host target protein is therefore outlined by a broken line.

It is appreciated that VGAM136 host target gene, herein designated VGAM HOST TARGET GENE, in fact represents a plurality of VGAM136 host target genes. The mRNA of each one of this plurality of VGAM136 host target genes comprises one or more host target binding sites, each having a nucleotide sequence which is at least partly complementary to VGAM136 RNA, herein designated VGAM RNA, and which when bound by VGAM136 RNA causes inhibition of translation of respective one or more VGAM136 host target proteins.

It is further appreciated by one skilled in the art that the mode of translational inhibition illustrated by FIG. 1 with specific reference to translational inhibition exerted by VGAM136 gene, herein designated VGAM GENE, on one or more VGAM136 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM136 is inhibition of expression of host target genes, as part of a novel viral mechanism of attacking a host. Accordingly, utilities of VGAM136 include diagnosis, prevention and treatment of viral infection by Shrimp White Spot Syndrome Virus (white spot bacilliform virus). Specific functions, and accordingly utilities, of VGAM136 correlate with, and may be deduced from, the identity of the host target genes which VGAM136 binds and inhibits, and the function of these host target genes, as elaborated hereinbelow.

Nucleotide sequences of the VGAM136 precursor RNA, herein designated VGAM PRECURSOR RNA, and of the 'diced' VGAM136 RNA, herein designated VGAM RNA, and a schematic representation of the secondary folding of VGAM136 folded precursor RNA, herein designated VGAM FOLDED PRECURSOR RNA, of VGAM136 are further described hereinbelow with reference to Table 1.

Nucleotide sequences of host target binding sites, such as BINDING SITE-I, BINDING SITE-II and BINDING SITE-III of FIG. 1, found on VGAM136 host target RNA, and schematic representation of the complementarity of each of these host target binding sites to VGAM136 RNA, herein designated VGAM RNA, are described hereinbelow with reference to Table 2.

As mentioned hereinabove with reference to FIG. 1, a function of VGAM136 gene, herein designated VGAM is inhibition of expression of VGAM136 target genes. It is appreciated that specific functions, and accordingly utilities, of VGAM136 correlate with, and may be deduced from, the identity of the target genes which VGAM136 binds and inhibits, and the function of these target genes, as elaborated hereinbelow.

Jagged 2 (JAG2, Accession NM_002226) is a VGAM136 host target gene. JAG2 BINDING SITE is HOST TARGET binding site found in the 3' untranslated region of mRNA encoded by JAG2, corresponding to a HOST TARGET binding site such as BINDING SITE I, BINDING SITE II or BINDING SITE III. Table 2 illustrates the complementarity of the nucleotide sequences of JAG2 BINDING SITE, designated SEQ ID:8006, to the nucleotide sequence of VGAM136 RNA, herein designated VGAM RNA, also designated SEQ ID:2847.

A function of VGAM136 is therefore inhibition of Jagged 2 (JAG2, Accession NM_002226), a gene which is a putative notch ligand involved in the mediation of notch signaling. Accordingly, utilities of VGAM136 include diagnosis, prevention and treatment of diseases and clinical conditions associated with JAG2. The function of JAG2 has been established by previous studies. The Notch signaling pathway is a conserved intercellular signaling mechanism that is essential for proper embryonic development in numerous metazoan organisms. Members of the Notch gene family (see OMIM Ref. No. NOTCH1; 190198) encode transmembrane receptors that are critical for various cell fate decisions. Multiple ligands that activate Notch and related receptors have been identified, including Serrate and Delta in Drosophila and JAG1 (OMIM Ref. No. 601920) in vertebrates. By searching for human brain expressed sequence tags (ESTs) homologous to Serrate and Delta, Luo et al. (1997) identified a cDNA which they called Jagged-2 (JAG2). The predicted 1,238-amino acid JAG2 protein has several recognizable motifs, including a signal peptide, 16 EGF-like repeats, a transmembrane domain, and a short cytoplasmic domain. The amino acid sequence of human JAG2 is 89% identical to that of rat Jag2. Northern blot analysis and in situ hybridization showed expression of Jag2 in various murine tissues. Immunohistochemistry revealed coexpression of Jag2 and Notch1 within murine fetal thymus and other murine fetal tissues. Coculture of fibroblasts expressing human JAG2 with murine C2C12 myoblasts inhibited myogenic differentiation. This effect was simulated by expression of constitutively active Notch1, suggesting that JAG2 engages the Notch1 pathway of signal transduction. Gray et al. (1999) also cloned JAG2, which they called HJ2. Northern blot analysis revealed expression of a 5.3-kb JAG2 transcript in heart and skeletal muscle, with weaker expression in pancreas. In situ hybridization analysis indicated upregulated expression of JAG2 in squamous cell carcinoma Animal model experiments lend further support to the function of JAG2. Jiang et al. (1998) examined the in vivo role of the Jag2 gene by making a targeted mutation that removed a domain of the Jagged-2 protein required for receptor interaction. Mice homozygous for this deletion died perinatally because of defects in craniofacial morphogenesis. The mutant homozygotes exhibited cleft palate and fusion of the tongue with the palatal shelves. They also exhibited syndactyly of the fore- and hindlimbs. The apical ectodermal ridge (AER) of the limb buds of the mutant homozygotes was hyperplastic, and Jiang et al. (1998) observed an expanded domain of Fgf8 (OMIM Ref. No. 600483) expression in the AER. In the foot plates of the mutant homozygotes, both Bmp2 (OMIM Ref. No. 112261) and Bmp7 (OMIM Ref. No. 112267) expression and apoptotic interdigital cell death were reduced. Mutant homozygotes also displayed defects in thymic development, exhibiting altered thymic morphology and impaired differentiation of T cells of the gamma/delta lineage. These results demonstrated that Notch signaling mediated by Jag2 plays an essential role during limb, craniofacial, and thymic development in mice.

It is appreciated that the abovementioned animal model for JAG2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lanford, P. J.; Lan, Y.; Jiang, R.; Lindsell, C.; Weinmaster, G.; Gridley, T.; Kelley, M. W.: Notch signalling pathway mediates hair cell development in mammalian cochlea. Nature Genet. 21:289-292, 1999; and Gray, G. E.; Mann, R. S.; Mitsiadis, E.; Henrique, D.; Carcangiu, M.-L.; Banks, A.; Leiman, J.; Ward, D.; Ish-Horowitz, D.; Artavanis-Tsakonas, S.: Human ligands of the Notch receptor.

Further studies establishing the function and utilities of JAG2 are found in John Hopkins OMIM database record ID 602570, and in sited publications numbered 126 and 6218-6221 listed in the bibliography section hereinbelow, which are also hereby incorporated by reference. Synaptobrevin-like 1 (SYBL1, Accession NM_005638) is another VGAM136 host target gene. SYBL1 BINDING SITE is HOST TARGET binding site found in the 3' untranslated region of mRNA encoded by SYBL1, corresponding to a HOST TARGET binding site such as BINDING SITE I, BINDING SITE II or BINDING SITE III. Table 2 illustrates the complementarity of the nucleotide sequences of SYBL1 BINDING SITE, designated SEQ ID:12166, to the nucleotide sequence of VGAM136 RNA, herein designated VGAM RNA, also designated SEQ ID:2847.

Another function of VGAM136 is therefore inhibition of Synaptobrevin-like 1 (SYBL1, Accession NM_005638), a gene which is synaptobrevin-like 1 and is similar to synaptobrevin. Accordingly, utilities of VGAM136 include diagnosis, prevention and treatment of diseases and clinical conditions associated with SYBL1. The function of SYBL1 has been established by previous studies. From a search for expressed genes in the Xq28 pseudoautosomal region (PAR), d'Esposito et al. (1996) described a 2,576-bp cDNA encoding a synaptobrevin-like gene. The gene, tentatively named SYBL1 by them, encodes a 220-amino acid polypeptide of 25 kD with 60% similarity (37.5% homology) to an unpublished Arabidopsis gene sequence. SYBL1 was found, unlike all Xp pseudoautosomal genes studied to that time, to undergo X inactivation. In addition, it is also inactive on the Y chromosome, thereby maintaining dosage compensation in an unprecedented way. (The synaptobrevin genes, SYB1 (OMIM Ref. No. 185880) and SYB2 (OMIM Ref. No. 185881), are autosomal, being located on chromosomes 12 and 17, respectively.) In studies of the pseudoautosomal regions of the X and Y chromosomes, Ciccodicola et al. (2000) sequenced the telomeric 400 kb of the long arm of the human X chromosome, including 330 kb of the human Xq/Yq pseudoautosomal region and the telomere. Sequencing revealed subregions with distinctive regulatory and evolutionary features. The proximal 295 kb contains 2 genes inactivated on both the inactive X and Y chromosomes: SYBL1 and a human homolog of 'sprouty' in Drosophila. The GC-rich distal 35 kb, added in stages and much later in evolution, contains the X/Y expressed gene IL9R (OMIM Ref. No. 300007) and the gene CXYorf1 only 5 kb from the Xq telomere. These properties make Xq/YqPAR a model for studies of region-specific gene inactivation, telomere evolution, and involvement in sex-limited conditions.

Full details of the abovementioned studies are described in the following publications, the disclosure of which are hereby incorporated by reference:

Ciccodicola, A.; d'Esposito, M.; Esposito, T.; Gianfrancesco, F.; Migliaccio, C.; Miano, M. G.; Matarazzo, M. R.; Vacca, M.; Franze, A.; Cuccurese, M.; Cocchia, M.; Curci, A.: Differentially regulated and evolved genes in the fully sequenced Xq/Yq pseudoautosomal region. Hum. Molec. Genet. 9:395-401, 2000. ; and D'Esposito, M.; Ciccodicola, A.; Gianfrancesco, F.; Esposito, T.; Flagiello, L.; Mazzarella, R.; Schlessinger, D.; d'urso, M.: A synaptobrevin-like gene in the Xq28 pseudoautosomal re.

Further studies establishing the function and utilities of SYBL1 are found in John Hopkins OMIM database record ID 300053, and in sited publications numbered 9001-9004 listed in the bibliography section hereinbelow, which are also hereby incorporated by reference. FLJ10900 (Accession XM_037744) is another VGAM136 host target gene. FLJ10900 BINDING SITE is HOST TARGET binding site found in the 5' untranslated region of mRNA encoded by FLJ10900, corresponding to a HOST TARGET binding site such as BINDING SITE I, BINDING SITE II or BINDING SITE III. Table 2 illustrates the complementarity of the nucleotide sequences of FLJ10900 BINDING SITE, designated SEQ ID:32669, to the nucleotide sequence of VGAM136 RNA, herein designated VGAM RNA, also designated SEQ ID:2847.

Another function of VGAM136 is therefore inhibition of FLJ10900 (Accession XM_037744). Accordingly, utilities of VGAM136 include diagnosis, prevention and treatment of diseases and clinical conditions associated with FLJ10900. FLJ20294 (Accession NM_017749) is another VGAM136 host target gene. FLJ20294 BINDING SITE is HOST TARGET binding site found in the 3' untranslated region of mRNA encoded by FLJ20294, corresponding to a HOST TARGET binding site such as BINDING SITE I, BINDING SITE II or BINDING SITE III. Table 2 illustrates the complementarity of the nucleotide sequences of FLJ20294 BINDING SITE, designated SEQ ID:19347, to the nucleotide sequence of VGAM136 RNA, herein designated VGAM RNA, also designated SEQ ID:2847.

Another function of VGAM136 is therefore inhibition of FLJ20294 (Accession NM_017749). Accordingly, utilities of VGAM136 include diagnosis, prevention and treatment of diseases and clinical conditions associated with FLJ20294. FLJ20297 (Accession NM_017951) is another VGAM136 host target gene. FLJ20297 BINDING SITE is HOST TARGET binding site found in the 5' untranslated region of mRNA encoded by FLJ20297, corresponding to a HOST TARGET binding site such as BINDING SITE I, BINDING SITE II or BINDING SITE III. Table 2 illustrates the complementarity of the nucleotide sequences of FLJ20297 BINDING SITE, designated SEQ ID:19647, to the nucleotide sequence of VGAM136 RNA, herein designated VGAM RNA, also designated SEQ ID:2847.

Another function of VGAM136 is therefore inhibition of FLJ20297 (Accession NM_017951). Accordingly, utilities of VGAM136 include diagnosis, prevention and treatment of diseases and clinical conditions associated with FLJ20297. FLJ22690 (Accession NM_024711) is another VGAM136 host target gene. FLJ22690 BINDING SITE is HOST TARGET binding site found in the 3' untranslated region of mRNA encoded by FLJ22690, corresponding to a HOST TARGET binding site such as BINDING SITE I, BINDING SITE II or BINDING SITE III. Table 2 illustrates the complementarity of the nucleotide sequences of FLJ22690 BINDING SITE, designated SEQ ID:24037, to the nucleotide sequence of VGAM136 RNA, herein designated VGAM RNA, also designated SEQ ID:2847.

Another function of VGAM136 is therefore inhibition of FLJ22690 (Accession NM_024711). Accordingly, utilities of VGAM136 include diagnosis, prevention and treatment of diseases and clinical conditions associated with FLJ22690. JM11 (Accession NM_033626) is another VGAM136 host target gene. JM11 BINDING SITE is HOST TARGET binding site found in the 3' untranslated region of mRNA encoded by JM11, corresponding to a HOST TARGET binding site such as BINDING SITE I, BINDING SITE II or BINDING SITE III. Table 2 illustrates the complementarity of the nucleotide sequences of JM11 BINDING SITE, designated SEQ ID:27327, to the nucleotide sequence of VGAM136 RNA, herein designated VGAM RNA, also designated SEQ ID:2847.

Another function of VGAM136 is therefore inhibition of JM11 (Accession NM_033626). Accordingly, utilities of VGAM136 include diagnosis, prevention and treatment of diseases and clinical conditions associated with JM11. Potassium Voltage-gated Channel, Shab-related Subfamily, Member 2 (KCNB2, Accession XM_171186) is another VGAM136 host target gene. KCNB2 BINDING SITE is HOST TARGET binding site found in the 5' untranslated region of mRNA encoded by KCNB2, corresponding to a HOST TARGET binding site such as BINDING SITE I, BINDING SITE II or BINDING SITE III. Table 2 illustrates the complementarity of the nucleotide sequences of KCNB2 BINDING SITE, designated SEQ ID:45964, to the nucleotide sequence of VGAM136 RNA, herein designated VGAM RNA, also designated SEQ ID:2847.

Another function of VGAM136 is therefore inhibition of Potassium Voltage-gated Channel, Shab-related Subfamily, Member 2 (KCNB2, Accession XM_171186). Accordingly, utilities of VGAM136 include diagnosis, prevention and treatment of diseases and clinical conditions associated with KCNB2. KIAA0064 (Accession NM_014748) is another VGAM136 host target gene. KIAA0064 BINDING SITE is HOST TARGET binding site found in the 5' untranslated region of mRNA encoded by KIAA0064, corresponding to a HOST TARGET binding site such as BINDING SITE I, BINDING SITE II or BINDING SITE III. Table 2 illustrates the complementarity of the nucleotide sequences of KIAA0064 BINDING SITE, designated SEQ ID:16459, to the nucleotide sequence of VGAM136 RNA, herein designated VGAM RNA, also designated SEQ ID:2847.

Another function of VGAM136 is therefore inhibition of KIAA0064 (Accession NM_014748). Accordingly, utilities of VGAM136 include diagnosis, prevention and treatment of diseases and clinical conditions associated with KIAA0064. KIAA0202 (Accession XM_034872) is another VGAM136 host target gene. KIAA0202 BINDING SITE is HOST TARGET binding site found in the 3' untranslated region of mRNA encoded by KIAA0202, corresponding to a HOST TARGET binding site such as BINDING SITE I, BINDING SITE II or BINDING SITE III. Table 2 illustrates the complementarity of the nucleotide sequences of KIAA0202 BINDING SITE, designated SEQ ID:32179, to the nucleotide sequence of VGAM136 RNA, herein designated VGAM RNA, also designated SEQ ID:2847.

Another function of VGAM136 is therefore inhibition of KIAA0202 (Accession XM_034872). Accordingly, utilities of VGAM136 include diagnosis, prevention and treatment of diseases and clinical conditions associated with KIAA0202. KIAA0237 (Accession NM_014747) is another VGAM136 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16438, to the nucleotide sequence of VGAM136 RNA, herein designated VGAM RNA, also designated SEQ ID:2847.

Another function of VGAM136 is therefore inhibition of KIAA0237 (Accession NM_014747). Accordingly, utilities of VGAM136 include diagnosis, prevention and treatment of diseases and clinical conditions associated with KIAA0237. KIAA0682 (Accession NM_014852) is another VGAM136 host target gene. KIAA0682 BINDING SITE is HOST TARGET binding site found in the 3' untranslated region of mRNA encoded by KIAA0682, corresponding to a HOST TARGET binding site such as BINDING SITE I, BINDING SITE II or BINDING SITE III. Table 2 illustrates the complementarity of the nucleotide sequences of KIAA0682 BINDING SITE, designated SEQ ID:16900, to the nucleotide sequence of VGAM136 RNA, herein designated VGAM RNA, also designated SEQ ID:2847.

Another function of VGAM136 is therefore inhibition of KIAA0682 (Accession NM_014852). Accordingly, utilities of VGAM136 include diagnosis, prevention and treatment of diseases and clinical conditions associated with KIAA0682. KIAA1297 (Accession XM_051005) is another VGAM136 host target gene. KIAA1297 BINDING SITE is HOST TARGET binding site found in the 5' untranslated region of mRNA encoded by KIAA1297, corresponding to a HOST TARGET binding site such as BINDING SITE I, BINDING SITE II or BINDING SITE III. Table 2 illustrates the complementarity of the nucleotide sequences of KIAA1297 BINDING SITE, designated SEQ ID:35708, to the nucleotide sequence of VGAM136 RNA, herein designated VGAM RNA, also designated SEQ ID:2847.

Another function of VGAM136 is therefore inhibition of KIAA1297 (Accession XM_051005). Accordingly, utilities of VGAM136 include diagnosis, prevention and treatment of diseases and clinical conditions associated with KIAA1297. PB1 (Accession NM_018313) is another VGAM136 host target gene. PB1 BINDING SITE is HOST TARGET binding site found in the 3' untranslated region of mRNA encoded by PB1, corresponding to a HOST TARGET binding site such as BINDING SITE I, BINDING SITE II or BINDING SITE III. Table 2 illustrates the complementarity of the nucleotide sequences of PB1 BINDING SITE, designated SEQ ID:20307, to the nucleotide sequence of VGAM136 RNA, herein designated VGAM RNA, also designated SEQ ID:2847.

Another function of VGAM136 is therefore inhibition of PB1 (Accession NM_018313). Accordingly, utilities of VGAM136 include diagnosis, prevention and treatment of diseases and clinical conditions associated with PB1. POLD3 (Accession XM_166243) is another VGAM136 host target gene. POLD3 BINDING SITE is HOST TARGET binding site found in the 3' untranslated region of mRNA encoded by POLD3, corresponding to a HOST TARGET binding site such as BINDING SITE I, BINDING SITE II or BINDING SITE III. Table 2 illustrates the complementarity of the nucleotide sequences of POLD3 BINDING SITE, designated SEQ ID:44055, to the nucleotide sequence of VGAM136 RNA, herein designated VGAM RNA, also designated SEQ ID:2847.

Another function of VGAM136 is therefore inhibition of POLD3 (Accession XM_166243). Accordingly, utilities of VGAM136 include diagnosis, prevention and treatment of diseases and clinical conditions associated with POLD3. ZER6 (Accession XM_032742) is another VGAM136 host target gene. ZER6 BINDING SITE is HOST TARGET binding site found in the 3' untranslated region of mRNA encoded by ZER6, corresponding to a HOST TARGET binding site such as BINDING SITE I, BINDING SITE II or BINDING SITE III. Table 2 illustrates the complementarity of the nucleotide sequences of ZER6 BINDING SITE, designated SEQ ID:31742, to the nucleotide sequence of VGAM136 RNA, herein designated VGAM RNA, also designated SEQ ID:2847.

Another function of VGAM136 is therefore inhibition of ZER6 (Accession XM_032742). Accordingly, utilities of VGAM136 include diagnosis, prevention and treatment of diseases and clinical conditions associated with ZER6. LOC146485 (Accession XM_007966) is another VGAM136 host target gene. LOC146485 BINDING SITE is HOST TARGET binding site found in the 5' untranslated region of mRNA encoded by LOC146485, corresponding to a HOST TARGET binding site such as BINDING SITE I, BINDING SITE II or BINDING SITE III. Table 2 illustrates the complementarity of the nucleotide sequences of LOC146485 BINDING SITE, designated SEQ ID:30071, to the nucleotide sequence of VGAM136 RNA, herein designated VGAM RNA, also designated SEQ ID:2847.

Another function of VGAM136 is therefore inhibition of LOC146485 (Accession XM_007966). Accordingly, utilities of VGAM136 include diagnosis, prevention and treatment of diseases and clinical conditions associated with LOC146485. LOC153443 (Accession XM_087669) is another VGAM136 host target gene. LOC153443 BINDING SITE is HOST TARGET binding site found in the 3' untranslated region of mRNA encoded by LOC153443, corresponding to a HOST TARGET binding site such as BINDING SITE I, BINDING SITE II or BINDING SITE III. Table 2 illustrates the complementarity of the nucleotide sequences of LOC153443 BINDING SITE, designated SEQ ID:39372, to the nucleotide sequence of VGAM136 RNA, herein designated VGAM RNA, also designated SEQ ID:2847.

Another function of VGAM136 is therefore inhibition of LOC153443 (Accession XM_087669). Accordingly, utilities of VGAM136 include diagnosis, prevention and treatment of diseases and clinical conditions associated with LOC153443. LOC153910 (Accession XM_087801) is another VGAM136 host target gene. LOC153910 BINDING SITE is HOST TARGET binding site found in the 3' untranslated region of mRNA encoded by LOC153910, corresponding to a HOST TARGET binding site such as BINDING SITE I, BINDING SITE II or BINDING SITE III. Table 2 illustrates the complementarity of the nucleotide sequences of LOC153910 BINDING SITE, designated SEQ ID:39439, to the nucleotide sequence of VGAM136 RNA, herein designated VGAM RNA, also designated SEQ ID:2847.

Another function of VGAM136 is therefore inhibition of LOC153910 (Accession XM_087801). Accordingly, utilities of VGAM136 include diagnosis, prevention and treatment of diseases and clinical conditions associated with LOC153910. LOC221421 (Accession XM_166428) is another VGAM136 host target gene. LOC221421 BINDING SITE is HOST TARGET binding site found in the 3' untranslated region of mRNA encoded by LOC221421, corresponding to a HOST TARGET binding site such as BINDING SITE I, BINDING SITE II or BINDING SITE III. Table 2 illustrates the complementarity of the nucleotide sequences of LOC221421 BINDING SITE, designated SEQ ID:44320, to the nucleotide sequence of VGAM136 RNA, herein designated VGAM RNA, also designated SEQ ID:2847.

Another function of VGAM136 is therefore inhibition of LOC221421 (Accession XM_166428). Accordingly, utilities of VGAM136 include diagnosis, prevention and treatment of diseases and clinical conditions associated with LOC221421. LOC253805 (Accession XM_172854) is another VGAM136 host target gene. LOC253805 BINDING SITE is HOST TARGET binding site found in the 3' untranslated region of mRNA encoded by LOC253805, corresponding to a HOST TARGET binding site such as BINDING SITE I, BINDING SITE II or BINDING SITE III. Table 2 illustrates the complementarity of the nucleotide sequences of LOC253805 BINDING SITE, designated SEQ ID:46131, to the nucleotide sequence of VGAM136 RNA, herein designated VGAM RNA, also designated SEQ ID:2847.

Another function of VGAM136 is therefore inhibition of LOC253805 (Accession XM_172854). Accordingly, utilities of VGAM136 include diagnosis, prevention and treatment of diseases and clinical conditions associated with LOC253805. LOC90190 (Accession XM_029758) is another VGAM136 host target gene. LOC90190 BINDING SITE is HOST TARGET binding site found in the 3' untranslated region of mRNA encoded by LOC90190, corresponding to a HOST TARGET binding site such as BINDING SITE I, BINDING SITE II or BINDING SITE III. Table 2 illustrates the complementarity of the nucleotide sequences of LOC90190 BINDING SITE, designated SEQ ID:30946, to the nucleotide sequence of VGAM136 RNA, herein designated VGAM RNA, also designated SEQ ID:2847.

Another function of VGAM136 is therefore inhibition of LOC90190 (Accession XM_029758). Accordingly, utilities of VGAM136 include diagnosis, prevention and treatment of diseases and clinical conditions associated with LOC90190. LOC91115 (Accession XM_036218) is another VGAM136 host target gene. LOC91115 BINDING SITE is HOST TARGET binding site found in the 3' untranslated region of mRNA encoded by LOC91115, corresponding to a HOST TARGET binding site such as BINDING SITE I, BINDING SITE II or BINDING SITE III. Table 2 illustrates the complementarity of the nucleotide sequences of LOC91115 BINDING SITE, designated SEQ ID:32399, to the nucleotide sequence of VGAM136 RNA, herein designated VGAM RNA, also designated SEQ ID:2847.

Another function of VGAM136 is therefore inhibition of LOC91115 (Accession XM_036218). Accordingly, utilities of VGAM136 include diagnosis, prevention and treatment of diseases and clinical conditions associated with LOC91115. FIG. 1 further provides a conceptual description of a novel bioinformatically detected viral gene of the present invention, referred to here as Viral Genomic Address Messenger 137 (VGAM137) viral gene, which modulates expression of respective host target genes thereof, the function and utility of which host target genes is known in the art.

VGAM137 is a novel bioinformatically detected regulatory, non protein coding, viral micro RNA (miRNA) gene. The method by which VGAM137 was detected is described hereinabove with reference to FIGS. 1-8.

VGAM137 gene, herein designated VGAM GENE, is a viral gene contained in the genome of Shrimp White Spot Syndrome Virus (white spot bacilliform virus). VGAM137 host target gene, herein designated VGAM HOST TARGET GENE, is a human gene contained in the human genome.

VGAM137 gene encodes a VGAM137 precursor RNA, herein designated VGAM PRECURSOR RNA. Similar to other miRNA genes, and unlike most ordinary genes, VGAM137 precursor RNA does not encode a protein. A nucleotide sequence identical or highly similar to the nucleotide sequence of VGAM137 precursor RNA is designated SEQ ID:123, and is provided hereinbelow with reference to the sequence listing part. Nucleotide sequence SEQ ID:123 is located at position 74213 relative to the genome of Shrimp White Spot Syndrome Virus (white spot bacilliform virus).

VGAM137 precursor RNA folds onto itself, forming VGAM137 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM137 folded precursor RNA into VGAM137 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM137 RNA is designated SEQ ID:2848, and is provided hereinbelow with reference to the sequence listing part.

VGAM137 host target gene, herein designated VGAM HOST TARGET GENE, encodes a corresponding messenger RNA, VGAM137 host target RNA, herein designated VGAM HOST TARGET RNA. VGAM137 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM137 RNA, herein designated VGAM RNA, binds complementarily to one or more host target binding sites located in untranslated regions of VGAM137 host target RNA, herein designated VGAM HOST TARGET RNA. This complementary binding is due to the fact that the nucleotide sequence of VGAM137 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM137 RNA, herein designated VGAM RNA, may have a different number of host target binding sites in untranslated regions of a VGAM137 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM137 RNA, herein designated VGAM RNA, to host target binding sites on VGAM137 host target RNA, herein designated VGAM HOST TARGET RNA, such as BINDING SITE I, BINDING SITE II and BINDING SITE III, inhibits translation of VGAM137 host target RNA into VGAM137 host target protein, herein designated VGAM HOST TARGET PROTEIN. VGAM host target protein is therefore outlined by a broken line.

It is appreciated that VGAM137 host target gene, herein designated VGAM HOST TARGET GENE, in fact represents a plurality of VGAM137 host target genes. The mRNA of each one of this plurality of VGAM137 host target genes comprises one or more host target binding sites, each having a nucleotide sequence which is at least partly complementary to VGAM137 RNA, herein designated VGAM RNA, and which when bound by VGAM137 RNA causes inhibition of translation of respective one or more VGAM137 host target proteins.

It is further appreciated by one skilled in the art that the mode of translational inhibition illustrated by FIG. 1 with specific reference to translational inhibition exerted by VGAM137 gene, herein designated VGAM GENE, on one or more VGAM137 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM137 is inhibition of expression of host target genes, as part of a novel viral mechanism of attacking a host. Accordingly, utilities of VGAM137 include diagnosis, prevention and treatment of viral infection by Shrimp White Spot Syndrome Virus (white spot bacilliform virus). Specific functions, and accordingly utilities, of VGAM137 correlate with, and may be deduced from, the identity of the host target genes which VGAM137 binds and inhibits, and the function of these host target genes, as elaborated hereinbelow.

Nucleotide sequences of the VGAM137 precursor RNA, herein designated VGAM PRECURSOR RNA, and of the 'diced' VGAM137 RNA, herein designated VGAM RNA, and a schematic representation of the secondary folding of VGAM137 folded precursor RNA, herein designated VGAM FOLDED PRECURSOR RNA, of VGAM137 are further described hereinbelow with reference to Table 1.

Nucleotide sequences of host target binding sites, such as BINDING SITE-I, BINDING SITE-II and BINDING SITE-III of FIG. 1, found on VGAM137 host target RNA, and schematic representation of the complementarity of each of these host target binding sites to VGAM137 RNA, herein designated VGAM RNA, are described hereinbelow with reference to Table 2.

As mentioned hereinabove with reference to FIG. 1, a function of VGAM137 gene, herein designated VGAM is inhibition of expression of VGAM137 target genes. It is appreciated that specific functions, and accordingly utilities, of VGAM137 correlate with, and may be deduced from, the identity of the target genes which VGAM137 binds and inhibits, and the function of these target genes, as elaborated hereinbelow.

Butyrophilin, Subfamily 2, Member A1 (BTN2A1, Accession NM_078476) is a VGAM137 host target gene. BTN2A1 BINDING SITE is HOST TARGET binding site found in the 3' untranslated region of mRNA encoded by BTN2A1, corresponding to a HOST TARGET binding site such as BINDING SITE I, BINDING SITE II or BINDING SITE III. Table 2 illustrates the complementarity of the nucleotide sequences of BTN2A1 BINDING SITE, designated SEQ ID:27801, to the nucleotide sequence of VGAM137 RNA, herein designated VGAM RNA, also designated SEQ ID:2848.

A function of VGAM137 is therefore inhibition of Butyrophilin, Subfamily 2, Member A1 (BTN2A1, Accession NM_078476). Accordingly, utilities of VGAM137 include diagnosis, prevention and treatment of diseases and clinical conditions associated with BTN2A1. Cat Eye Syndrome Chromosome Region, Candidate 6 (CECR6, Accession NM_031890) is another VGAM137 host target gene. CECR6 BINDING SITE is HOST TARGET binding site found in the 3' untranslated region of mRNA encoded by CECR6, corresponding to a HOST TARGET binding site such as BINDING SITE I, BINDING SITE II or BINDING SITE III. Table 2 illustrates the complementarity of the nucleotide sequences of CECR6 BINDING SITE, designated SEQ ID:25636, to the nucleotide sequence of VGAM137 RNA, herein designated VGAM RNA, also designated SEQ ID:2848.

Another function of VGAM137 is therefore inhibition of Cat Eye Syndrome Chromosome Region, Candidate 6 (CECR6, Accession NM_031890). Accordingly, utilities of VGAM137 include diagnosis, prevention and treatment of diseases and clinical conditions associated with CECR6. Enabled Homolog (Drosophila) (ENAH, Accession NM_018212) is another VGAM137 host target gene. ENAH BINDING SITE is HOST TARGET binding site found in the 3" untranslated region of mRNA encoded by ENAH, corresponding to a HOST TARGET binding site such as BINDING SITE I, BINDING SITE II or BINDING SITE III. Table 2 illustrates the complementarity of the nucleotide sequences of ENAH BINDING SITE, designated SEQ ID:20125, to the nucleotide sequence of VGAM137 RNA, herein designated VGAM RNA, also designated SEQ ID:2848.

Another function of VGAM137 is therefore inhibition of Enabled Homolog (Drosophila) (ENAH, Accession NM_018212). Accordingly, utilities of VGAM137 include diagnosis, prevention and treatment of diseases and clinical conditions associated with ENAH. FLJ11110 (Accession NM_018326) is another VGAM137 host target gene. FLJ11110 BINDING SITE is HOST TARGET binding site found in the 3' untranslated region of mRNA encoded by FLJ11110, corresponding to a HOST TARGET binding site such as BINDING SITE I, BINDING SITE II or BINDING SITE III. Table 2 illustrates the complementarity of the nucleotide sequences of FLJ11110 BINDING SITE, designated SEQ ID:20320, to the nucleotide sequence of VGAM137 RNA, herein designated VGAM RNA, also designated SEQ ID:2848.

Another function of VGAM137 is therefore inhibition of FLJ11110 (Accession NM_018326). Accordingly, utilities of VGAM137 include diagnosis, prevention and treatment of diseases and clinical conditions associated with FLJ11110. KIAA0884 (Accession XM_046660) is another VGAM137 host target gene. KIAA0884 BINDING SITE is HOST TARGET binding site found in the 5' untranslated region of mRNA encoded by KIAA0884, corresponding to a HOST TARGET binding site such as BINDING SITE I, BINDING SITE II or BINDING SITE III. Table 2 illustrates the complementarity of the nucleotide sequences of KIAA0884 BINDING SITE, designated SEQ ID:34775, to the nucleotide sequence of VGAM137 RNA, herein designated VGAM RNA, also designated SEQ ID:2848.

Another function of VGAM137 is therefore inhibition of KIAA0884 (Accession XM_046660). Accordingly, utilities of VGAM137 include diagnosis, prevention and treatment of diseases and clinical conditions associated with KIAA0884. LOC163682 (Accession XM_099402) is another VGAM137 host target gene. LOC163682 BINDING SITE is HOST TARGET binding site found in the 3' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42085, to the nucleotide sequence of VGAM137 RNA, herein designated VGAM RNA, also designated SEQ ID:2848.

Another function of VGAM137 is therefore inhibition of LOC163682 (Accession XM_099402). Accordingly, utilities of VGAM137 include diagnosis, prevention and treatment of diseases and clinical conditions associated with LOC163682. FIG. 1 further provides a conceptual description of a novel bioinformatically detected viral gene of the present invention, referred to here as Viral Genomic Address Messenger 138 (VGAM138) viral gene, which modulates expression of respective host target genes thereof, the function and utility of which host target genes is known in the art.

VGAM138 is a novel bioinformatically detected regulatory, non protein coding, viral micro RNA (miRNA) gene. The method by which VGAM138 was detected is described hereinabove with reference to FIGS. 1-8.

VGAM138 gene, herein designated VGAM GENE, is a viral gene contained in the genome of Shrimp White Spot Syndrome Virus (white spot bacilliform virus). VGAM138 host target gene, herein designated VGAM HOST TARGET GENE, is a human gene contained in the human genome.

VGAM138 gene encodes a VGAM138 precursor RNA, herein designated VGAM PRECURSOR RNA. Similar to other miRNA genes, and unlike most ordinary genes, VGAM138 precursor RNA does not encode a protein. A nucleotide sequence identical or highly similar to the nucleotide sequence of VGAM138 precursor RNA is designated SEQ ID:124, and is provided hereinbelow with reference to the sequence listing part. Nucleotide sequence SEQ ID:124 is located at position 4877 relative to the genome of Shrimp White Spot Syndrome Virus (white spot bacilliform virus).

VGAM138 precursor RNA folds onto itself, forming VGAM138 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM138 folded precursor RNA into VGAM138 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM138 RNA is designated SEQ ID:2849, and is provided hereinbelow with reference to the sequence listing part.

VGAM138 host target gene, herein designated VGAM HOST TARGET GENE, encodes a corresponding messenger RNA, VGAM138 host target RNA, herein designated VGAM HOST TARGET RNA. VGAM138 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM138 RNA, herein designated VGAM RNA, binds complementarily to one or more host target binding sites located in untranslated regions of VGAM138 host target RNA, herein designated VGAM HOST TARGET RNA. This complementary binding is due to the fact that the nucleotide sequence of VGAM138 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM138 RNA, herein designated VGAM RNA, may have a different number of host target binding sites in untranslated regions of a VGAM138 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM138 RNA, herein designated VGAM RNA, to host target binding sites on VGAM138 host target RNA, herein designated VGAM HOST TARGET RNA, such as BINDING SITE I, BINDING SITE II and BINDING SITE III, inhibits translation of VGAM138 host target RNA into VGAM138 host target protein, herein designated VGAM HOST TARGET PROTEIN. VGAM host target protein is therefore outlined by a broken line.

It is appreciated that VGAM138 host target gene, herein designated VGAM HOST TARGET GENE, in fact represents a plurality of VGAM138 host target genes. The mRNA of each one of this plurality of VGAM138 host target genes comprises one or more host target binding sites, each having a nucleotide sequence which is at least partly complementary to VGAM138 RNA, herein designated VGAM RNA, and which when bound by VGAM138 RNA causes inhibition of translation of respective one or more VGAM138 host target proteins.

It is further appreciated by one skilled in the art that the mode of translational inhibition illustrated by FIG. 1 with specific reference to translational inhibition exerted by VGAM138 gene, herein designated VGAM GENE, on one or more VGAM138 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM138 is inhibition of expression of host target genes, as part of a novel viral mechanism of attacking a host. Accordingly, utilities of VGAM138 include diagnosis, prevention and treatment of viral infection by Shrimp White Spot Syndrome Virus (white spot bacilliform virus). Specific functions, and accordingly utilities, of VGAM138 correlate with, and may be deduced from, the identity of the host target genes which VGAM138 binds and inhibits, and the function of these host target genes, as elaborated hereinbelow.

Nucleotide sequences of the VGAM138 precursor RNA, herein designated VGAM PRECURSOR RNA, and of the 'diced' VGAM138 RNA, herein designated VGAM RNA, and a schematic representation of the secondary folding of VGAM138 folded precursor RNA, herein designated VGAM FOLDED PRECURSOR RNA, of VGAM138 are further described hereinbelow with reference to Table 1.

Nucleotide sequences of host target binding sites, such as BINDING SITE-I, BINDING SITE-II and BINDING SITE-III of FIG. 1, found on VGAM138 host target RNA, and schematic representation of the complementarity of each of these host target binding sites to VGAM138 RNA, herein designated VGAM RNA, are described hereinbelow with reference to Table 2.

As mentioned hereinabove with reference to FIG. 1, a function of VGAM138 gene, herein designated VGAM is inhibition of expression of VGAM138 target genes. It is appreciated that specific functions, and accordingly utilities, of VGAM138 correlate with, and may be deduced from, the identity of the target genes which VGAM138 binds and inhibits, and the function of these target genes, as elaborated hereinbelow.

Pallidin Homolog (mouse) (PLDN, Accession NM_012388) is a VGAM138 host target gene. PLDN BINDING SITE is HOST TARGET binding site found in the 5' untranslated region of mRNA encoded by PLDN, corresponding to a HOST TARGET binding site such as BINDING SITE I, BINDING SITE II or BINDING SITE III. Table 2 illustrates the complementarity of the nucleotide sequences of PLDN BINDING SITE, designated SEQ ID:14744, to the nucleotide sequence of VGAM138 RNA, herein designated VGAM RNA, also designated SEQ ID:2849.

A function of VGAM138 is therefore inhibition of Pallidin Homolog (mouse) (PLDN, Accession NM_012388), a gene which may play a role in intracellular vesicle trafficking. Accordingly, utilities of VGAM138 include diagnosis, prevention and treatment of diseases and clinical conditions associated with PLDN. The function of PLDN has been established by previous studies. 'Pallid' is 1 of 13 platelet storage pool deficiency (SPD) mouse mutants. Pallid (pa) animals suffer from prolonged bleeding time, pigment dilution, kidney lysosomal enzyme elevation, serum alpha-1-antitrypsin (OMIM Ref. No. 107400) activity deficiency, and abnormal otolith formation. As with other mouse mutants of this class, characterization of pallid mice suggested a defect in organelle biosynthesis. Huang et al. (1999) described the physical mapping, positional cloning, and mutational and functional analysis of the gene that is defective in pallid mice. The gene encodes a ubiquitously expressed, highly charged 172-amino acid protein, which they called pallidin, with no homology to known proteins. Huang et al. (1999) detected a nonsense mutation at codon 69 of this gene in the pallid mutant. Using a yeast 2-hybrid screen, Huang et al. (1999) discovered that pallidin interacts with syntaxin-13, a t-SNARE protein that mediates vesicle docking and fusion. Huang et al. (1999) confirmed this interaction by coimmunoprecipitation assay. Immunofluorescence studies corroborated that the cellular distribution of pallidin overlaps that of syntaxin-13. Whereas the 'mocha' (OMIM Ref. No. 607246) and 'pearl' (OMIM Ref. No. 603401) SPD mutants have defects in Ap3, the findings of Huang et al. (1999) suggested that pallid SPD mutants are defective in a more downstream event of vesicle trafficking, namely vesicle docking and fusion. Huang et al. (1999) stated that 'pallid' was the fifth storage pool deficiency mutant to be described at the molecular level. These mutants are characterized by abnormalities in platelet-dense granules, melanosomes, and lysosomes, and in each case, the predicted protein is involved in organelle biogenesis. Huang et al. (1999) isolated the orthologous gene encoding human pallidin and found that the predicted protein has 86% amino acid identity with the mouse protein. The human pallidin cDNA sequence has been deposited in GenBank (AF080470). By coimmunoprecipitation and immunodepletion experiments of mouse skin fibroblasts, Falcon-Perez et al. (2002) identified pallidin as a component of BLOC1 (biogenesis of lysosome-related organelles complex-1), which also contains muted (OMIM Ref. No. 607289). A yeast 2-hybrid screen found no direct interaction between muted and pallidin, but pallidin was found to interact with itself. Residues that include 2 putative coiled-coil domains of human palladin were necessary and sufficient for self-assembly. Falcon-Perez et al. (2002) also determined that pallidin/BLOC1 could interact with actin filaments in vitro and in transfected cells. Huang (2000) stated that ESTs of the human PA gene had been mapped to 15q15 by radiation hybrid mapping. By ancestral chromosome mapping, Huang et al. (1999) localized the mouse pallidin gene to chromosome 2E. The pallidin gene is closely linked to mouse Epb42 (OMIM Ref. No. 171070) and B2m (OMIM Ref. No. 109700), 68 cM from the centromere.

Full details of the abovementioned studies are described in the following publications, the disclosure of which are hereby incorporated by reference:

Falcon-Perez, J. M.; Starcevic, M.; Gautam, R.; Dell'Angelica, E. C.: BLOC-1, a novel complex containing the pallidin and muted proteins involved in the biogenesis of melanosomes and platelet-dense granules. J. Biol. Chem. 277: 28191-28199, 2002; and Huang, L.; Kuo, Y.-M.; Gitschier, J.: The pallid gene encodes a novel, syntaxin 13-interacting protein involved in platelet storage pool deficiency. Nature Genet. 23:329-332, 1999.

Further studies establishing the function and utilities of PLDN are found in John Hopkins OMIM database record ID 604310, and in sited publications numbered 7439-7441 listed in the bibliography section hereinbelow, which are also hereby incorporated by reference. MGC3101 (Accession NM_024043) is another VGAM138 host target gene. MGC3101 BINDING SITE is HOST TARGET binding site found in the 3' untranslated region of mRNA encoded by MGC3101, corresponding to a HOST TARGET binding site such as BINDING SITE I, BINDING SITE II or BINDING SITE III. Table 2 illustrates the complementarity of the nucleotide sequences of MGC3101 BINDING SITE, designated SEQ ID:23477, to the nucleotide sequence of VGAM138 RNA, herein designated VGAM RNA, also designated SEQ ID:2849.

Another function of VGAM138 is therefore inhibition of MGC3101 (Accession NM_024043). Accordingly, utilities of VGAM138 include diagnosis, prevention and treatment of diseases and clinical conditions associated with MGC3101. FIG. 1 further provides a conceptual description of a novel bioinformatically detected viral gene of the present invention, referred to here as Viral Genomic Address Messenger 139 (VGAM139) viral gene, which modulates expression of respective host target genes thereof, the function and utility of which host target genes is known in the art.

VGAM139 is a novel bioinformatically detected regulatory, non protein coding, viral micro RNA (miRNA) gene. The method by which VGAM139 was detected is described hereinabove with reference to FIGS. 1-8.

VGAM139 gene, herein designated VGAM GENE, is a viral gene contained in the genome of Shrimp White Spot Syndrome Virus (white spot bacilliform virus). VGAM139 host target gene, herein designated VGAM HOST TARGET GENE, is a human gene contained in the human genome.

VGAM139 gene encodes a VGAM139 precursor RNA, herein designated VGAM PRECURSOR RNA. Similar to other miRNA genes, and unlike most ordinary genes, VGAM139 precursor RNA does not encode a protein. A nucleotide sequence identical or highly similar to the nucleotide sequence of VGAM139 precursor RNA is designated SEQ ID:125, and is provided hereinbelow with reference to the sequence listing part. Nucleotide sequence SEQ ID:125 is located at position 193809 relative to the genome of Shrimp White Spot Syndrome Virus (white spot bacilliform virus).

VGAM139 precursor RNA folds onto itself, forming VGAM139 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM139 folded precursor RNA into VGAM139 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM139 RNA is designated SEQ ID:2850, and is provided hereinbelow with reference to the sequence listing part.

VGAM139 host target gene, herein designated VGAM HOST TARGET GENE, encodes a corresponding messenger RNA, VGAM139 host target RNA, herein designated VGAM HOST TARGET RNA. VGAM139 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM139 RNA, herein designated VGAM RNA, binds complementarily to one or more host target binding sites located in untranslated regions of VGAM139 host target RNA, herein designated VGAM HOST TARGET RNA. This complementary binding is due to the fact that the nucleotide sequence of VGAM139 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM139 RNA, herein designated VGAM RNA, may have a different number of host target binding sites in untranslated regions of a VGAM139 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM139 RNA, herein designated VGAM RNA, to host target binding sites on VGAM139 host target RNA, herein designated VGAM HOST TARGET RNA, such as BINDING SITE I, BINDING SITE II and BINDING SITE III, inhibits translation of VGAM139 host target RNA into VGAM139 host target protein, herein designated VGAM HOST TARGET PROTEIN. VGAM host target protein is therefore outlined by a broken line.

It is appreciated that VGAM139 host target gene, herein designated VGAM HOST TARGET GENE, in fact represents a plurality of VGAM139 host target genes. The mRNA of each one of this plurality of VGAM139 host target genes comprises one or more host target binding sites, each having a nucleotide sequence which is at least partly complementary to VGAM139 RNA, herein designated VGAM RNA, and which when bound by VGAM139 RNA causes inhibition of translation of respective one or more VGAM139 host target proteins.

It is further appreciated by one skilled in the art that the mode of translational inhibition illustrated by FIG. 1 with specific reference to translational inhibition exerted by VGAM139 gene, herein designated VGAM GENE, on one or more VGAM139 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM139 is inhibition of expression of host target genes, as part of a novel viral mechanism of attacking a host. Accordingly, utilities of VGAM139 include diagnosis, prevention and treatment of viral infection by Shrimp White Spot Syndrome Virus (white spot bacilliform virus). Specific functions, and accordingly utilities, of VGAM139 correlate with, and may be deduced from, the identity of the host target genes which VGAM139 binds and inhibits, and the function of these host target genes, as elaborated hereinbelow.

Nucleotide sequences of the VGAM139 precursor RNA, herein designated VGAM PRECURSOR RNA, and of the 'diced' VGAM139 RNA, herein designated VGAM RNA, and a schematic representation of the secondary folding of VGAM139 folded precursor RNA, herein designated VGAM FOLDED PRECURSOR RNA, of VGAM139 are further described hereinbelow with reference to Table 1.

Nucleotide sequences of host target binding sites, such as BINDING SITE-I, BINDING SITE-II and BINDING SITE-III of FIG. 1, found on VGAM139 host target RNA, and schematic representation of the complementarity of each of these host target binding sites to VGAM139 RNA, herein designated VGAM RNA, are described hereinbelow with reference to Table 2.

As mentioned hereinabove with reference to FIG. 1, a function of VGAM139 gene, herein designated VGAM is inhibition of expression of VGAM139 target genes. It is appreciated that specific functions, and accordingly utilities, of VGAM139 correlate with, and may be deduced from, the identity of the target genes which VGAM139 binds and inhibits, and the function of these target genes, as elaborated hereinbelow.

Nuclear Receptor Subfamily 4, Group A, Member 2 (NR4A2, Accession NM_006186) is a VGAM139 host target gene. NR4A2 BINDING SITE is HOST TARGET binding site found in the 3' untranslated region of mRNA encoded by NR4A2, corresponding to a HOST TARGET binding site such as BINDING SITE I, BINDING SITE II or BINDING SITE III. Table 2 illustrates the complementarity of the nucleotide sequences of NR4A2 BINDING SITE, designated SEQ ID:12855, to the nucleotide sequence of VGAM139 RNA, herein designated VGAM RNA, also designated SEQ ID:2850.

A function of VGAM139 is therefore inhibition of Nuclear Receptor Subfamily 4, Group A, Member 2 (NR4A2, Accession NM_006186), a gene which may be a general coactivator of transcription. Accordingly, utilities of VGAM139 include diagnosis, prevention and treatment of diseases and clinical conditions associated with NR4A2. The function of NR4A2 and its association with various diseases and clinical conditions, has been established by previous studies, as described hereinabove with reference to VGAM127. Transforming Growth Factor, Beta Receptor III (betaglycan, 300 kDa) (TGFBR3, Accession NM_003243) is another VGAM139 host target gene. TGFBR3 BINDING SITE is HOST TARGET binding site found in the 3' untranslated region of mRNA encoded by TGFBR3, corresponding to a HOST TARGET binding site such as BINDING SITE I, BINDING SITE II or BINDING SITE III. Table 2 illustrates the complementarity of the nucleotide sequences of TGFBR3 BINDING SITE, designated SEQ ID:9248, to the nucleotide sequence of VGAM139 RNA, herein designated VGAM RNA, also designated SEQ ID:2850.

Another function of VGAM139 is therefore inhibition of Transforming Growth Factor, Beta Receptor III (betaglycan, 300 kDa) (TGFBR3, Accession NM_003243), a gene which involves in capturing and retaining TGF-beta for presentation to the signaling receptors. Accordingly, utilities of VGAM139 include diagnosis, prevention and treatment of diseases and clinical conditions associated with TGFBR3. The function of TGFBR3 has been established by previous studies. In addition to type I TGF-beta receptor (TGFBR1; 190181) and type II (TFGBR2; 190182), type III (OMIM Ref. No. TGFBR3) has been identified. It is a glycoprotein that binds TGF-beta and exists in both a membrane-bound and a soluble form. It may serve as a receptor accessory molecule in both the TGF-beta and fibroblast growth factor systems. TGFBR3 lacks a recognizable signaling domain and has no clearly defined role in TGF-beta signaling. To investigate TGFBR3 function, Brown et al. (1999) studied cardiac endothelial cells in chick atrioventricular cushion explants. Endothelial cells undergoing epithelial-mesenchymal transformation expressed TGFBR3, and TGFBR3-specific antisera were found to inhibit mesenchyme formation and migration. Misexpression of TGFBR3 in nontransforming ventricular endothelial cells conferred transformation in response to TGFB2. These results supported a model where TGFBR3 localizes transformation in the heart and plays an essential, nonredundant role in TGF-beta signaling. Lewis et al. (2000) demonstrated that the type III TGF-beta receptor, or beta-glycan, can function as an inhibin (see OMIM Ref. No. 147380) coreceptor with ActRII (OMIM Ref. No. 102581). Beta-glycan binds inhibin with high affinity and enhances binding in cells coexpressing ActRII and beta-glycan. Inhibin also forms crosslinked complexes with both recombinant and endogenously expressed beta-glycan and ActRII. Lewis et al. (2000) demonstrated that beta-glycan confers inhibin sensitivity to cell lines that otherwise respond poorly to this hormone. The ability of beta-glycan to inhibit to facilitate inhibin antagonism of activin (see OMIM Ref. No. 147290) provided a variation on the emerging roles of proteoglycans as coreceptors modulating ligand-receptor sensitivity, selectivity, and function.

Full details of the abovementioned studies are described in the following publications, the disclosure of which are hereby incorporated by reference:

Brown, C. B.; Boyer, A. S.; Runyan, R. B.; Barnett, J. V.: Requirement of type III TGF-beta receptor for endocardial cell transformation in the heart. Science 283:2080-2082, 1999; and Lewis, K. A.; Gray, P. C.; Blount, A. L.; MacConell, L. A.; Wiater, E.; Bilezikjian, L. M.; Vale, W.: Betaglycan binds inhibin and can mediate functional antagonism of activin signalli.

Further studies establishing the function and utilities of TGFBR3 are found in John Hopkins OMIM database record ID 600742, and in sited publications numbered 757 and 7580 listed in the bibliography section hereinbelow, which are also hereby incorporated by reference. FLJ10560 (Accession NM_018138) is another VGAM139 host target gene. FLJ10560 BINDING SITE is HOST TARGET binding site found in the 3' untranslated region of mRNA encoded by FLJ10560, corresponding to a HOST TARGET binding site such as BINDING SITE I, BINDING SITE II or BINDING SITE III. Table 2 illustrates the complementarity of the nucleotide sequences of FLJ10560 BINDING SITE, designated SEQ ID:19936, to the nucleotide sequence of VGAM139 RNA, herein designated VGAM RNA, also designated SEQ ID:2850.

Another function of VGAM139 is therefore inhibition of FLJ10560 (Accession NM_018138). Accordingly, utilities of VGAM139 include diagnosis, prevention and treatment of diseases and clinical conditions associated with FLJ10560. FLJ20727 (Accession NM_017944) is another VGAM139 host target gene. FLJ20727 BINDING SITE is HOST TARGET binding site found in the 3' untranslated region of mRNA encoded by FLJ20727, corresponding to a HOST TARGET binding site such as BINDING SITE I, BINDING SITE II or BINDING SITE III. Table 2 illustrates the complementarity of the nucleotide sequences of FLJ20727 BINDING SITE, designated SEQ ID:19638, to the nucleotide sequence of VGAM139 RNA, herein designated VGAM RNA, also designated SEQ ID:2850.

Another function of VGAM139 is therefore inhibition of FLJ20727 (Accession NM_017944). Accordingly, utilities of VGAM139 include diagnosis, prevention and treatment of diseases and clinical conditions associated with FLJ20727. KIAA1775 (Accession NM_033100) is another VGAM139 host target gene. KIAA1775 BINDING SITE is HOST TARGET binding site found in the 3' untranslated region of mRNA encoded by KIAA1775, corresponding to a HOST TARGET binding site such as BINDING SITE I, BINDING SITE II or BINDING SITE III. Table 2 illustrates the complementarity of the nucleotide sequences of KIAA1775 BINDING SITE, designated SEQ ID:26943, to the nucleotide sequence of VGAM139 RNA, herein designated VGAM RNA, also designated SEQ ID:2850.

Another function of VGAM139 is therefore inhibition of KIAA1775 (Accession NM_033100). Accordingly, utilities of VGAM139 include diagnosis, prevention and treatment of diseases and clinical conditions associated with KIAA1775. Synaptopodin 2 (SYNPO2, Accession XM_050219) is another VGAM139 host target gene. SYNPO2 BINDING SITE is HOST TARGET binding site found in the 3' untranslated region of mRNA encoded by SYNPO2, corresponding to a HOST TARGET binding site such as BINDING SITE I, BINDING SITE II or BINDING SITE III. Table 2 illustrates the complementarity of the nucleotide sequences of SYNPO2 BINDING SITE, designated SEQ ID:35591, to the nucleotide sequence of VGAM139 RNA, herein designated VGAM RNA, also designated SEQ ID:2850.

Another function of VGAM139 is therefore inhibition of Synaptopodin 2 (SYNPO2, Accession XM_050219). Accordingly, utilities of VGAM139 include diagnosis, prevention and treatment of diseases and clinical conditions associated with SYNPO2. TXI1 (Accession NM_018430) is another VGAM139 host target gene. TXI1 BINDING SITE is HOST TARGET binding site found in the 5' untranslated region of mRNA encoded by TXI1, corresponding to a HOST TARGET binding site such as BINDING SITE I, BINDING SITE II or BINDING SITE III. Table 2 illustrates the complementarity of the nucleotide sequences of TXI1 BINDING SITE, designated SEQ ID:20492, to the nucleotide sequence of VGAM139 RNA, herein designated VGAM RNA, also designated SEQ ID:2850.

Another function of VGAM139 is therefore inhibition of TXI1 (Accession NM_018430). Accordingly, utilities of VGAM139 include diagnosis, prevention and treatment of diseases and clinical conditions associated with TXI1. FIG. 1 further provides a conceptual description of a novel bioinformatically detected viral gene of the present invention, referred to here as Viral Genomic Address Messenger 140 (VGAM140) viral gene, which modulates expression of respective host target genes thereof, the function and utility of which host target genes is known in the art.

VGAM140 is a novel bioinformatically detected regulatory, non protein coding, viral micro RNA (miRNA) gene. The method by which VGAM140 was detected is described hereinabove with reference to FIGS. 1-8.

VGAM140 gene, herein designated VGAM GENE, is a viral gene contained in the genome of Shrimp White Spot Syndrome Virus (white spot bacilliform virus). VGAM140 host target gene, herein designated VGAM HOST TARGET GENE, is a human gene contained in the human genome.

VGAM140 gene encodes a VGAM140 precursor RNA, herein designated VGAM PRECURSOR RNA. Similar to other miRNA genes, and unlike most ordinary genes, VGAM140 precursor RNA does not encode a protein. A nucleotide sequence identical or highly similar to the nucleotide sequence of VGAM140 precursor RNA is designated SEQ ID:126, and is provided hereinbelow with reference to the sequence listing part. Nucleotide sequence SEQ ID:126 is located at position 51736 relative to the genome of Shrimp White Spot Syndrome Virus (white spot bacilliform virus).

VGAM140 precursor RNA folds onto itself, forming VGAM140 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM140 folded precursor RNA into VGAM140 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM140 RNA is designated SEQ ID:2851, and is provided hereinbelow with reference to the sequence listing part.

VGAM140 host target gene, herein designated VGAM HOST TARGET GENE, encodes a corresponding messenger RNA, VGAM140 host target RNA, herein designated VGAM HOST TARGET RNA. VGAM140 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM140 RNA, herein designated VGAM RNA, binds complementarily to one or more host target binding sites located in untranslated regions of VGAM140 host target RNA, herein designated VGAM HOST TARGET RNA. This complementary binding is due to the fact that the nucleotide sequence of VGAM140 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM140 RNA, herein designated VGAM RNA, may have a different number of host target binding sites in untranslated regions of a VGAM140 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM140 RNA, herein designated VGAM RNA, to host target binding sites on VGAM140 host target RNA, herein designated VGAM HOST TARGET RNA, such as BINDING SITE I, BINDING SITE II and BINDING SITE III, inhibits translation of VGAM140 host target RNA into VGAM140 host target protein, herein designated VGAM HOST TARGET PROTEIN. VGAM host target protein is therefore outlined by a broken line.

It is appreciated that VGAM140 host target gene, herein designated VGAM HOST TARGET GENE, in fact represents a plurality of VGAM140 host target genes. The mRNA of each one of this plurality of VGAM140 host target genes comprises one or more host target binding sites, each having a nucleotide sequence which is at least partly complementary to VGAM140 RNA, herein designated VGAM RNA, and which when bound by VGAM140 RNA causes inhibition of translation of respective one or more VGAM140 host target proteins.

It is further appreciated by one skilled in the art that the mode of translational inhibition illustrated by FIG. 1 with specific reference to translational inhibition exerted by VGAM140 gene, herein designated VGAM GENE, on one or more VGAM140 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM140 is inhibition of expression of host target genes, as part of a novel viral mechanism of attacking a host. Accordingly, utilities of VGAM140 include diagnosis, prevention and treatment of viral infection by Shrimp White Spot Syndrome Virus (white spot bacilliform virus). Specific functions, and accordingly utilities, of VGAM140 correlate with, and may be deduced from, the identity of the host target genes which VGAM140 binds and inhibits, and the function of these target genes, as elaborated hereinbelow.

Nucleotide sequences of the VGAM140 precursor RNA, herein designated VGAM PRECURSOR RNA, and of the 'diced' VGAM140 RNA, herein designated VGAM RNA, and a schematic representation of the secondary folding of VGAM140 folded precursor RNA, herein designated VGAM FOLDED PRECURSOR RNA, of VGAM140 are further described hereinbelow with reference to Table 1.

Nucleotide sequences of host target binding sites, such as BINDING SITE-I, BINDING SITE-II and BINDING SITE-III of FIG. 1, found on VGAM140 host target RNA, and schematic representation of the complementarity of each of these host target binding sites to VGAM140 RNA, herein designated VGAM RNA, are described hereinbelow with reference to Table 2.

As mentioned hereinabove with reference to FIG. 1, a function of VGAM140 gene, herein designated VGAM is inhibition of expression of VGAM140 target genes. It is appreciated that specific functions, and accordingly utilities, of VGAM140 correlate with, and may be deduced from, the identity of the target genes which VGAM140 binds and inhibits, and the function of these target genes, as elaborated hereinbelow.

Cullin 4B (CUL4B, Accession NM_003588) is a VGAM140 host target gene. CUL4B BINDING SITE is HOST TARGET binding site found in the 3' untranslated region of mRNA encoded by CUL4B, corresponding to a HOST TARGET binding site such as BINDING SITE I, BINDING SITE II or BINDING SITE III. Table 2 illustrates the complementarity of the nucleotide sequences of CUL4B BINDING SITE, designated SEQ ID:9640, to the nucleotide sequence of VGAM140 RNA, herein designated VGAM RNA, also designated SEQ ID:2851.

A function of VGAM140 is therefore inhibition of Cullin 4B (CUL4B, Accession NM_003588), a gene which is a negative regulator of the cell cycle in C. elegans. Accordingly, utilities of VGAM140 include diagnosis, prevention and treatment of diseases and clinical conditions associated with CUL4B. The function of CUL4B has been established by previous studies. Kipreos et al. (1996) identified the cullin gene family, which includes at least 5 members in nematodes, 6 in human S, and 3 in S. cerevisiae. See CUL1 (OMIM Ref. No. 603134). Human CUL4A (OMIM Ref. No. 603137) and CUL4B are orthologs of nematode cul4. The partial C-terminal amino acid sequences of CUL4A and CUL4B share 88% identity. Rasooly (1998) found that a brain cDNA isolated by Ishikawa et al. (1998), KIAA0695, was 99% identical to CUL4B. The predicted KIAA0695 protein is 717 amino acids long. Using RT-PCR, Ishikawa et al. (1998) determined that KIAA0695 is expressed ubiquitously. Although Ishikawa et al. (1998) mapped the KIAA0695 gene to human chromosome 10, Rasooly (1998) noted the presence of sequences in GenBank (AC002476) identical to CUL4B within a cloned region in Xq23.

Full details of the abovementioned studies are described in the following publications, the disclosure of which are hereby incorporated by reference:

Ishikawa, K.; Nagase, T.; Suyama, M.; Miyajima, N.; Tanaka, A.; Kotani, H.; Nomura, N.; Ohara, O.: Prediction of the coding sequences of unidentified human genes. X. The complete sequences of 100 new cDNA clones from brain which can code for large proteins in vitro. DNA Res. 5:169-176, 1998; and Kipreos, E. T.; Lander, L. E.; Wing, J. P.; He, W. W.; Hedgecock, E. M.: cul-1 is required for cell cycle exit in C. elegans and identifies a novel gene family. Cell 85:829-839, 1996.

Further studies establishing the function and utilities of CUL4B are found in John Hopkins OMIM database record ID 300304, and in sited publications numbered 9440-9442 listed in the bibliography section hereinbelow, which are also hereby incorporated by reference. Coagulation Factor II (thrombin) Receptor (F2R, Accession NM_001992) is another VGAM140 host target gene. F2R BINDING SITE is HOST TARGET binding site found in the 3' untranslated region of mRNA encoded by F2R, corresponding to a HOST TARGET binding site such as BINDING SITE I, BINDING SITE II or BINDING SITE III. Table 2 illustrates the complementarity of the nucleotide sequences of F2R BINDING SITE, designated SEQ ID:7720, to the nucleotide sequence of VGAM140 RNA, herein designated VGAM RNA, also designated SEQ ID:2851.

Another function of VGAM140 is therefore inhibition of Coagulation Factor II (thrombin) Receptor (F2R, Accession NM_001992), a gene which Thrombin receptor; G protein-coupled receptor involved in platelet activation. Accordingly, utilities of VGAM140 include diagnosis, prevention and treatment of diseases and clinical conditions associated with F2R. The function of F2R has been established by previous studies. Coughlin et al. (1992) reviewed the cloning and characterization of a platelet thrombin (OMIM Ref. No. 176930) receptor (Vu et al., 1991). The thrombin receptor is structurally related to other members of the 7-transmembrane receptor family and has been isolated from diverse cell types. It is intimately involved in the regulation of the thrombotic response. Using PCR analyses of a human/rodent hybrid cell mapping panel, Bahou et al. (1993) assigned the TR gene to chromosome 5. By fluorescence in situ hybridization, they refined the localization to 5q13, confirming its presence as a single locus in the human genome. Poirier et al. (1996) mapped the Cf2r gene to mouse chromosome 13 by studies of an interspecific backcross. Utilizing 2 distinct radiation hybrid mapping panels with different levels of resolution, Schmidt et al. (1997) demonstrated that this gene, sometimes referred to as PAR1, and the proteinase activated receptor-2 gene (OMIM Ref. No. 600933) are tightly linked. Physical mapping using yeast artificial chromosomes and inversion field gel electrophoresis demonstrated that they are maximally separated by 90 kb. Riewald et al. (2002) demonstrated that activated protein C (OMIM Ref. No. 176860) uses the endothelial cell protein C receptor (EPCR; 600646) as a coreceptor for cleavage of protease-activated receptor 1 (PAR1) on endothelial cells. Gene profiling demonstrated that PAR1 signaling could account for all activated protein C-induced protective genes, including the immunomodulatory monocyte chemoattractant protein-1 (MCP1; 158105), which was selectively induced by activation of PAR1, but not PAR2 (OMIM Ref. No. 600933). Thus, Riewald et al. (2002) concluded that the prototypical thrombin receptor is the target for EPCR-dependent APC signaling, suggesting a role for this receptor cascade in protection from sepsis. Animal model experiments lend further support to the function of F2R. Griffin et al. (2001) reported a role for Par1, a protease-activated G protein-coupled receptor for thrombin, in embryonic development. Approximately one-half of Par1 -/- embryos died at midgestation with bleeding from multiple sites. Par1 is expressed in endothelial cells, and a Par1 transgene driven by an endothelial-specific promoter prevented death of Par1 -/- embryos. Griffin et al. (2001) concluded that the coagulation cascade and PAR1 modulate endothelial cell function in developing blood vessels and that thrombin's actions on endothelial cells, rather than on platelets, mesenchymal cells, or fibrinogen (see OMIM Ref. No. 134820), contribute to vascular development and hemostasis in the mouse embryo.

It is appreciated that the abovementioned animal model for F2R is acknowledged by those skilled in the art as a scientifically valid animal model, as can be further appreciated from the publications sited hereinbelow.

Full details of the abovementioned studies are described in the following publications, the disclosure of which are hereby incorporated by reference:

Coughlin, S. R.; Vu, T.-K. H.; Hung, D. T.; Wheaton, V. I.: Characterization of a functional thrombin receptor: issues and opportunities. J. Clin. Invest. 89: 351-355, 1992; and Riewald, M.; Petrovan, R. J.; Donner, A.; Mueller, B. M.; Ruf, W.: Activation of endothelial cell protease activated receptor 1 by the protein C pathway. Science 296:1880-1882, 2002.

Further studies establishing the function and utilities of F2R are found in John Hopkins OMIM database record ID 187930, and in sited publications numbered 1750-175 and 5703-1756 listed in the bibliography section hereinbelow, which are also hereby incorporated by reference. Protein Tyrosine Phosphatase, Receptor Type, O (PTPRO, Accession NM_030671) is another VGAM140 host target gene. PTPRO BINDING SITE is HOST TARGET binding site found in the 3' untranslated region of mRNA encoded by PTPRO, corresponding to a HOST TARGET binding site such as BINDING SITE I, BINDING SITE II or BINDING SITE III. Table 2 illustrates the complementarity of the nucleotide sequences of PTPRO BINDING SITE, designated SEQ ID:25028, to the nucleotide sequence of VGAM140 RNA, herein designated VGAM RNA, also designated SEQ ID:2851.

Another function of VGAM140 is therefore inhibition of Protein Tyrosine Phosphatase, Receptor Type, O (PTPRO, Accession NM_030671), a gene which may function as a cell contact receptor that mediates and controls cell-cell signals. Accordingly, utilities of VGAM140 include diagnosis, prevention and treatment of diseases and clinical conditions associated with PTPRO. The function of PTPRO has been established by previous studies. To identify protein-tyrosine phosphatases (PTPases) involved in the oncogenic process leading to the development of pancreatic carcinoma, Wang et al. (1996) performed PCR on pooled poly (A)+ RNA from 9 human pancreatic carcinoma cell lines using PTPase consensus oligonucleotide primers. One of the novel PCR products recovered was termed PCP2 (pancreatic carcinoma phosphatase-2) and was used to screen a human pancreatic adenocarcinoma cDNA library. The full sequence of PCP2 predicts a 1,430 amino acid protein consisting of a putative extracellular domain of 740 amino acids, a single transmembrane domain, and an intracellular domain of 666 amino acids. The intracellular region contains 2 tandemly repeated PTP catalytic domains with a high degree of identity to the catalytic domains of mouse PTP-kappa and PTP-mu. In addition to a signal peptide and 13 potential N-linked glycosylation sites, the extracellular domain contains a MAM (meprin/A5/PTP-mu) domain followed by 1 Ig-like repeat and 4 putative fibronectin type III repeats. The MAM domain, found in Xenopus A5 glycoprotein, meprin A, and meprin B, as well as in PTP-kappa and PTP-mu, may be involved in attachment to the cytoskeleton. PCP2, PTP-kappa, and PTP-mu appear to form a subfamily of MAM-containing receptor-like PTPs (RPTPs). PCP2 also contains the tripeptide HAV, implicated in cell-cell contact in the cadherins. By Northern blot analysis, Wang et al. (1996) demonstrated that the 5.5-kb PCP2 transcript is widely distributed at varying levels, with very high expression in brain, skeletal muscle, and pancreas, but no expression in placenta or spleen. Wang et al. (1996) demonstrated tyrosine phosphatase activity using an in vitro pNPP assay. Subcellular localization using laser scanning immunofluorescence microscopy showed localization of PCP2 at intercellular adhesions and colocalization with beta-catenin and E-cadherin. Wang et al. (1996) hypothesized that PCP2 and other members of this subfamily of RPTPases may function as cell contact receptors that mediate and control cell-cell signals. Wang et al. (1997) used degenerate PCR to clone PTP-J, a member of the type II receptor PTPase family. The PTP-J cDNA encodes a 1,436-amino acid polypeptide that includes a single transmembrane domain and a cytoplasmic domain containing 2 tandemly repeated PTP catalytic domains. The presence of 2 PTP domains indicates that this gene is a member of the type II receptor PTPases. Northern blot analysis detected expression in skeletal muscle, heart, prostate, pancreas, and placenta. Wang et al. (1997) found that in lymphocytes or lymphoma cells, expression of PTP-J is downregulated following stimulation by either phorbol myristate acetate (PMA) or calcium ionophore, suggesting that PMA or calcium signaling pathways may be involved in regulating the expression of PTP-J.

Full details of the abovementioned studies are described in the following publications, the disclosure of which are hereby incorporated by reference:

Wang, B.; Kishihara, K.; Zhang, D.; Hara, H.; Nomoto, K.: Molecular cloning and characterization of a novel human receptor protein tyrosine phosphatase gene, hPTP-J: downregulation of gene expression by PMA and calcium ionophore in Jurkat T lymphoma cells. Biochem. Biophys. Res. Commun. 231:77-81, 1997; and Wang, H; Lian, Z; Lerch, M. M.; Chen, Z; Xie, W; Ullrich, A.: Characterization of PCP-2, a novel receptor protein tyrosine phosphatase of the MAM domain family. Oncogene 12:2555-2562.

Further studies establishing the function and utilities of PTPRO are found in John Hopkins OMIM database record ID 602454, and in sited publications numbered 6323-6324 listed in the bibliography section hereinbelow, which are also hereby incorporated by reference. Sirtuin Silent Mating Type Information Regulation 2 Homolog 3 (S. cerevisiae) (SIRT3, Accession NM_012239) is another VGAM140 host target gene. SIRT3 BINDING SITE is HOST TARGET binding site found in the 3' untranslated region of mRNA encoded by SIRT3, corresponding to a HOST TARGET binding site such as BINDING SITE I, BINDING SITE II or BINDING SITE III. Table 2 illustrates the complementarity of the nucleotide sequences of SIRT3 BINDING SITE, designated SEQ ID:14545, to the nucleotide sequence of VGAM140 RNA, herein designated VGAM RNA, also designated SEQ ID:2851.

Another function of VGAM140 is therefore inhibition of Sirtuin Silent Mating Type Information Regulation 2 Homolog 3 (S. cerevisiae) (SIRT3, Accession NM_012239), a gene which might function in telomeric silencing, cell cycle progression and chromosome stability. Accordingly, utilities of VGAM140 include diagnosis, prevention and treatment of diseases and clinical conditions associated with SIRT3. The function of SIRT3 has been established by previous studies. The yeast Sir2 protein (Shore et al., 1984) regulates epigenetic gene silencing and, as a possible antiaging effect, suppresses recombination of rDNA. Studies involving cobB, a bacterial Sir2-like gene, have suggested that Sir2 may encode a pyridine nucleotide transferase. By in silico and PCR-cloning techniques, Frye (1999) obtained cDNA sequences encoding 5 human Sir2-like genes, which they called sirtuin-1 to -5 (SIRT1 to SIRT5). The SIRT1 (OMIM Ref. No. 604479) sequence has the closest homology to the S. cerevisiae Sir2 protein, while SIRT4 (OMIM Ref. No. 604482) and SIRT5 (OMIM Ref. No. 604483) more closely resemble prokaryotic sirtuin sequences. PCR analysis showed that the 5 human sirtuins are widely expressed in fetal and adult tissues. Recombinant human SIRT2 (OMIM Ref. No. 604480) was able to cause radioactivity to be transferred from (32P)NAD to bovine serum albumin (BSA). When a conserved histidine within SIRT2 was converted to tyrosine, the mutant recombinant protein was unable to transfer radioactivity from (32P)NAD to BSA. These results suggested that the sirtuins may function via mono-ADP-ribosylation of proteins. Tanny et al. (1999) showed that the yeast Sir2 protein can transfer labeled phosphate from nicotinamide adenine dinucleotide to itself and histones in vitro. A modified form of Sir2, which results from its automodification activity, was specifically recognized by anti-mono-ADP-ribose antibodies, suggesting that Sir2 is an ADP-ribosyltransferase. Mutation of a phylogenetically invariant histidine (his364 to tyr) in Sir2 abolished both its enzymatic activity in vitro and its silencing functions in vivo. However, the mutant protein was associated with chromatin and other silencing factors in a manner similar to wildtype Sir2. These findings suggested that Sir2 contains an ADP-ribosyltransferase activity that is essential for its silencing function.

Full details of the abovementioned studies are described in the following publications, the disclosure of which are hereby incorporated by reference:

Tanny, J. C.; Dowd, G. J.; Huang, J.; Hilz, H.; Moazed, D.: An enzymatic activity in the yeast Sir2 protein that is essential for gene silencing. Cell 99:735-745, 1999; and Frye, R. A.: Characterization of five human cDNAs with homology to the yeast SIR2 gene: Sir2-like proteins (sirtuins) metabolize NAD and may have protein ADP-ribosyltransferase activi.

Further studies establishing the function and utilities of SIRT3 are found in John Hopkins OMIM database record ID 604481, and in sited publications numbered 5008, 504 and 5051 listed in the bibliography section hereinbelow, which are also hereby incorporated by reference. Solute Carrier Family 16 (monocarboxylic acid transporters), Member 1 (SLC16A1, Accession NM_003051) is another VGAM140 host target gene. SLC16A1 BINDING SITE is HOST TARGET binding site found in the 3' untranslated region of mRNA encoded by SLC16A1, corresponding to a HOST TARGET binding site such as BINDING SITE I, BINDING SITE II or BINDING SITE III. Table 2 illustrates the complementarity of the nucleotide sequences of SLC16A1 BINDING SITE, designated SEQ ID:9014, to the nucleotide sequence of VGAM140 RNA, herein designated VGAM RNA, also designated SEQ ID:2851.

Another function of VGAM140 is therefore inhibition of Solute Carrier Family 16 (monocarboxylic acid transporters), Member 1 (SLC16A1, Accession NM_003051), a gene which is a Proton-monocarboxylate cotransporter that transports lactate and pyruvate. Accordingly, utilities of VGAM140 include diagnosis, prevention and treatment of diseases and clinical conditions associated with SLC16A1. The function of SLC16A1 has been established by previous studies. The monocarboxylate transporter (MCT) mediates the movement of lactate and pyruvate across cell membranes (Garcia et al., 1994). Import and export of these substrates by tissues such as erythrocytes, muscle, intestine, and kidney are ascribed largely to the action of a proton-coupled MCT. Kim et al. (1992) cloned a cDNA for MCT1, which encodes a protein with 12 putative membrane-spanning regions; it was originally isolated by an expression cloning strategy designed to identify the mevalonate transporter in a mutant Chinese hamster ovary (CHO) cell line. The cloned mevalonate transporter turned out to be a mutant protein, designated Mev, that differed from its wildtype progenitor by 1 amino acid in the tenth membrane spanning region, which changed a phenylalanine (wildtype) to a cysteine (OMIM Ref. No. mutant). The finding that the wildtype cDNA did not elicit increased mevalonate transport in transfected cells suggested that the wild-type protein is a transporter for a molecule other than mevalonate. Indeed, subsequent studies by Garcia et al. (1994) showed that lactate, pyruvate, and related monocarboxylates can be transported by the wildtype molecule, designated MCT1 by them. This protein exhibits properties that resemble those of the erythrocyte MCT, including proton symport, trans acceleration, and sensitivity to alpha-cyanocinnamates. The amino acid sequence of MCT1 did not resemble that of any known protein, suggesting that MCT1 may represent a new class of solute carriers (solute carrier family 16). Garcia et al. (1994) used the hamster cDNA to isolate genomic cDNA clones for human MCT1. Comparison of the human and hamster amino acid sequences demonstrated that the proteins are 86% identical. The gene for human MCT1, symbolized SLC16A1, was localized to 1p13.2-p12 by PCR analysis of panels of human/rodent cell hybrid lines and by fluorescence chromosomal in situ hybridization.

Full details of the abovementioned studies are described in the following publications, the disclosure of which are hereby incorporated by reference:

Garcia, C. K.; Goldstein, J. L.; Pathak, R. K.; Anderson, R. G. W.; Brown, M. S.: Molecular characterization of a membrane transporter for lactate, pyruvate, and other monocarboxylates: implications for the Cori cycle. Cell 76:865-873, 1994; and Garcia, C. K.; Li, X.; Luna, J.; Francke, U.: cDNA cloning of the human monocarboxylate transporter 1 and chromosomal localization of the SLC16A1 locus to 1p13.2-p12. Genomics 23:500-503.

Further studies establishing the function and utilities of SLC16A1 are found in John Hopkins OMIM database record ID 600682, and in sited publications numbered 7130-7132 listed in the bibliography section hereinbelow, which are also hereby incorporated by reference. Activator of Basal Transcription 1 (ABT1, Accession NM_013375) is another VGAM140 host target gene. ABT1 BINDING SITE is HOST TARGET binding site found in the 3' untranslated region of mRNA encoded by ABT1, corresponding to a HOST TARGET binding site such as BINDING SITE I, BINDING SITE II or BINDING SITE III. Table 2 illustrates the complementarity of the nucleotide sequences of ABT1 BINDING SITE, designated SEQ ID:15029, to the nucleotide sequence of VGAM140 RNA, herein designated VGAM RNA, also designated SEQ ID:2851.

Another function of VGAM140 is therefore inhibition of Activator of Basal Transcription 1 (ABT1, Accession NM_013375). Accordingly, utilities of VGAM140 include diagnosis, prevention and treatment of diseases and clinical conditions associated with ABT1. CNIL (Accession NM_005776) is another VGAM140 host target gene. CNIL BINDING SITE is HOST TARGET binding site found in the 3' untranslated region of mRNA encoded by CNIL, corresponding to a HOST TARGET binding site such as BINDING SITE I, BINDING SITE II or BINDING SITE III. Table 2 illustrates the complementarity of the nucleotide sequences of CNIL BINDING SITE, designated SEQ ID:12353, to the nucleotide sequence of VGAM140 RNA, herein designated VGAM RNA, also designated SEQ ID:2851.

Another function of VGAM140 is therefore inhibition of CNIL (Accession NM_005776). Accordingly, utilities of VGAM140 include diagnosis, prevention and treatment of diseases and clinical conditions associated with CNIL. FLJ10876 (Accession NM_018254) is another VGAM140 host target gene. FLJ10876 BINDING SITE is HOST TARGET binding site found in the 3" untranslated region of mRNA encoded by FLJ10876, corresponding to a HOST TARGET binding site such as BINDING SITE I, BINDING SITE II or BINDING SITE III. Table 2 illustrates the complementarity of the nucleotide sequences of FLJ10876 BINDING SITE, designated SEQ ID:20220, to the nucleotide sequence of VGAM140 RNA, herein designated VGAM RNA, also designated SEQ ID:2851.

Another function of VGAM140 is therefore inhibition of FLJ10876 (Accession NM_018254). Accordingly, utilities of VGAM140 include diagnosis, prevention and treatment of diseases and clinical conditions associated with FLJ10876. FLJ14957 (Accession NM_032866) is another VGAM140 host target gene. FLJ14957 BINDING SITE is HOST TARGET binding site found in the 3' untranslated region of mRNA encoded by FLJ14957, corresponding to a HOST TARGET binding site such as BINDING SITE I, BINDING SITE II or BINDING SITE III. Table 2 illustrates the complementarity of the nucleotide sequences of FLJ14957 BINDING SITE, designated SEQ ID:26679, to the nucleotide sequence of VGAM140 RNA, herein designated VGAM RNA, also designated SEQ ID:2851.

Another function of VGAM140 is therefore inhibition of FLJ14957 (Accession NM_032866). Accordingly, utilities of VGAM140 include diagnosis, prevention and treatment of diseases and clinical conditions associated with FLJ14957. FLJ20174 (Accession NM_017699) is another VGAM140 host target gene. FLJ20174 BINDING SITE is HOST TARGET binding site found in the 3' untranslated region of mRNA encoded by FLJ20174, corresponding to a HOST TARGET binding site such as BINDING SITE I, BINDING SITE II or BINDING SITE III. Table 2 illustrates the complementarity of the nucleotide sequences of FLJ20174 BINDING SITE, designated SEQ ID:19267, to the nucleotide sequence of VGAM140 RNA, herein designated VGAM RNA, also designated SEQ ID:2851.

Another function of VGAM140 is therefore inhibition of FLJ20174 (Accession NM_017699). Accordingly, utilities of VGAM140 include diagnosis, prevention and treatment of diseases and clinical conditions associated with FLJ20174. FLJ20847 (Accession XM_170677) is another VGAM140 host target gene. FLJ20847 BINDING SITE is HOST TARGET binding site found in the 5' untranslated region of mRNA encoded by FLJ20847, corresponding to a HOST TARGET binding site such as BINDING SITE I, BINDING SITE II or BINDING SITE III. Table 2 illustrates the complementarity of the nucleotide sequences of FLJ20847 BINDING SITE, designated SEQ ID:45457, to the nucleotide sequence of VGAM140 RNA, herein designated VGAM RNA, also designated SEQ ID:2851.

Another function of VGAM140 is therefore inhibition of FLJ20847 (Accession XM_170677). Accordingly, utilities of VGAM140 include diagnosis, prevention and treatment of diseases and clinical conditions associated with FLJ20847. Glucosidase, Beta (bile acid) 2 (GBA2, Accession XM_048518) is another VGAM140 host target gene. GBA2 BINDING SITE is HOST TARGET binding site found in the 5' untranslated region of mRNA encoded by GBA2, corresponding to a HOST TARGET binding site such as BINDING SITE I, BINDING SITE II or BINDING SITE III. Table 2 illustrates the complementarity of the nucleotide sequences of GBA2 BINDING SITE, designated SEQ ID:35178, to the nucleotide sequence of VGAM140 RNA, herein designated VGAM RNA, also designated SEQ ID:2851.

Another function of VGAM140 is therefore inhibition of Glucosidase, Beta (bile acid) 2 (GBA2, Accession XM_048518). Accordingly, utilities of VGAM140 include diagnosis, prevention and treatment of diseases and clinical conditions associated with GBA2. KIAA0923 (Accession NM_014021) is another VGAM140 host target gene. KIAA0923 BINDING SITE is HOST TARGET binding site found in the 3' untranslated region of mRNA encoded by KIAA0923, corresponding to a HOST TARGET binding site such as BINDING SITE I, BINDING SITE II or BINDING SITE III. Table 2 illustrates the complementarity of the nucleotide sequences of KIAA0923 BINDING SITE, designated SEQ ID:15241, to the nucleotide sequence of VGAM140 RNA, herein designated VGAM RNA, also designated SEQ ID:2851.

Another function of VGAM140 is therefore inhibition of KIAA0923 (Accession NM_014021). Accordingly, utilities of VGAM140 include diagnosis, prevention and treatment of diseases and clinical conditions associated with KIAA0923. KIAA0937 (Accession XM_166213) is another VGAM140 host target gene. KIAA0937 BINDING SITE is HOST TARGET binding site found in the 3' untranslated region of mRNA encoded by KIAA0937, corresponding to a HOST TARGET binding site such as BINDING SITE I, BINDING SITE II or BINDING SITE III. Table 2 illustrates the complementarity of the nucleotide sequences of KIAA0937 BINDING SITE, designated SEQ ID:44013, to the nucleotide sequence of VGAM140 RNA, herein designated VGAM RNA, also designated SEQ ID:2851.

Another function of VGAM140 is therefore inhibition of KIAA0937 (Accession XM_166213). Accordingly, utilities of VGAM140 include diagnosis, prevention and treatment of diseases and clinical conditions associated with KIAA0937. KIAA1203 (Accession XM_049683) is another VGAM140 host target gene. KIAA1203 BINDING SITE is HOST TARGET binding site found in the 3' untranslated region of mRNA encoded by KIAA1203, corresponding to a HOST TARGET binding site such as BINDING SITE I, BINDING SITE II or BINDING SITE III. Table 2 illustrates the complementarity of the nucleotide sequences of KIAA1203 BINDING SITE, designated SEQ ID:35468, to the nucleotide sequence of VGAM140 RNA, herein designated VGAM RNA, also designated SEQ ID:2851.

Another function of VGAM140 is therefore inhibition of KIAA1203 (Accession XM_049683). Accordingly, utilities of VGAM140 include diagnosis, prevention and treatment of diseases and clinical conditions associated with KIAA1203. KIAA1796 (Accession XM_166146) is another VGAM140 host target gene. KIAA1796 BINDING SITE is HOST TARGET binding site found in the 3' untranslated region of mRNA encoded by KIAA1796, corresponding to a HOST TARGET binding site such as BINDING SITE I, BINDING SITE II or BINDING SITE III. Table 2 illustrates the complementarity of the nucleotide sequences of KIAA1796 BINDING SITE, designated SEQ ID:43964, to the nucleotide sequence of VGAM140 RNA, herein designated VGAM RNA, also designated SEQ ID:2851.

Another function of VGAM140 is therefore inhibition of KIAA1796 (Accession XM_166146). Accordingly, utilities of VGAM140 include diagnosis, prevention and treatment of diseases and clinical conditions associated with KIAA1796. Transducer of ERBB2, 2 (TOB2, Accession XM_170995) is another VGAM140 host target gene. TOB2 BINDING SITE is HOST TARGET binding site found in the 3' untranslated region of mRNA encoded by TOB2, corresponding to a HOST TARGET binding site such as BINDING SITE I, BINDING SITE II or BINDING SITE III. Table 2 illustrates the complementarity of the nucleotide sequences of TOB2 BINDING SITE, designated SEQ ID:45765, to the nucleotide sequence of VGAM140 RNA, herein designated VGAM RNA, also designated SEQ ID:2851.

Another function of VGAM140 is therefore inhibition of Transducer of ERBB2, 2 (TOB2, Accession XM_170995). Accordingly, utilities of VGAM140 include diagnosis, prevention and treatment of diseases and clinical conditions associated with TOB2. TP53TG3 (Accession NM_015369) is another VGAM140 host target gene. TP53TG3 BINDING SITE is HOST TARGET binding site found in the 3' untranslated region of mRNA encoded by TP53TG3, corresponding to a HOST TARGET binding site such as BINDING SITE I, BINDING SITE II or BINDING SITE III. Table 2 illustrates the complementarity of the nucleotide sequences of TP53TG3 BINDING SITE, designated SEQ ID:17669, to the nucleotide sequence of VGAM140 RNA, herein designated VGAM RNA, also designated SEQ ID:2851.

Another function of VGAM140 is therefore inhibition of TP53TG3 (Accession NM_015369). Accordingly, utilities of VGAM140 include diagnosis, prevention and treatment of diseases and clinical conditions associated with TP53TG3. LOC147671 (Accession XM_085844) is another VGAM140 host target gene. LOC147671 BINDING SITE is HOST TARGET binding site found in the 3' untranslated region of mRNA encoded by LOC147671, corresponding to a HOST TARGET binding site such as BINDING SITE I, BINDING SITE II or BINDING SITE III. Table 2 illustrates the complementarity of the nucleotide sequences of LOC147671 BINDING SITE, designated SEQ ID:38377, to the nucleotide sequence of VGAM140 RNA, herein designated VGAM RNA, also designated SEQ ID:2851.

Another function of VGAM140 is therefore inhibition of LOC147671 (Accession XM_085844). Accordingly, utilities of VGAM140 include diagnosis, prevention and treatment of diseases and clinical conditions associated with LOC147671. LOC253805 (Accession XM_172854) is another VGAM140 host target gene. LOC253805 BINDING SITE is HOST TARGET binding site found in the 3' untranslated region of mRNA encoded by LOC253805, corresponding to a HOST TARGET binding site such as BINDING SITE I, BINDING SITE II or BINDING SITE III. Table 2 illustrates the complementarity of the nucleotide sequences of LOC253805 BINDING SITE, designated SEQ ID:46134, to the nucleotide sequence of VGAM140 RNA, herein designated VGAM RNA, also designated SEQ ID:2851.

Another function of VGAM140 is therefore inhibition of LOC253805 (Accession XM_172854). Accordingly, utilities of VGAM140 include diagnosis, prevention and treatment of diseases and clinical conditions associated with LOC253805. FIG. 1 further provides a conceptual description of a novel bioinformatically detected viral gene of the present invention, referred to here as Viral Genomic Address Messenger 141 (VGAM141) viral gene, which modulates expression of respective host target genes thereof, the function and utility of which host target genes is known in the art.

VGAM141 is a novel bioinformatically detected regulatory, non protein coding, viral micro RNA (miRNA) gene. The method by which VGAM141 was detected is described hereinabove with reference to FIGS. 1-8.

VGAM141 gene, herein designated VGAM GENE, is a viral gene contained in the genome of Shrimp White Spot Syndrome Virus (white spot bacilliform virus). VGAM141 host target gene, herein designated VGAM HOST TARGET GENE, is a human gene contained in the human genome.

VGAM141 gene encodes a VGAM141 precursor RNA, herein designated VGAM PRECURSOR RNA. Similar to other miRNA genes, and unlike most ordinary genes, VGAM141 precursor RNA does not encode a protein. A nucleotide sequence identical or highly similar to the nucleotide sequence of VGAM141 precursor RNA is designated SEQ ID:127, and is provided hereinbelow with reference to the sequence listing part. Nucleotide sequence SEQ ID:127 is located at position 151833 relative to the genome of Shrimp White Spot Syndrome Virus (white spot bacilliform virus).

VGAM141 precursor RNA folds onto itself, forming VGAM141 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM141 folded precursor RNA into VGAM141 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 62%) nucleotide sequence of VGAM141 RNA is designated SEQ ID:2852, and is provided hereinbelow with reference to the sequence listing part.

VGAM141 host target gene, herein designated VGAM HOST TARGET GENE, encodes a corresponding messenger RNA, VGAM141 host target RNA, herein designated VGAM HOST TARGET RNA. VGAM141 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM141 RNA, herein designated VGAM RNA, binds complementarily to one or more host target binding sites located in untranslated regions of VGAM141 host target RNA, herein designated VGAM HOST TARGET RNA. This complementary binding is due to the fact that the nucleotide sequence of VGAM141 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM141 RNA, herein designated VGAM RNA, may have a different number of host target binding sites in untranslated regions of a VGAM141 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM141 RNA, herein designated VGAM RNA, to host target binding sites on VGAM141 host target RNA, herein designated VGAM HOST TARGET RNA, such as BINDING SITE I, BINDING SITE II and BINDING SITE III, inhibits translation of VGAM141 host target RNA into VGAM141 host target protein, herein designated VGAM HOST TARGET PROTEIN. VGAM host target protein is therefore outlined by a broken line.

It is appreciated that VGAM141 host target gene, herein designated VGAM HOST TARGET GENE, in fact represents a plurality of VGAM141 host target genes. The mRNA of each one of this plurality of VGAM141 host target genes comprises one or more host target binding sites, each having a nucleotide sequence which is at least partly complementary to VGAM141 RNA, herein designated VGAM RNA, and which when bound by VGAM141 RNA causes inhibition of translation of respective one or more VGAM141 host target proteins.

It is further appreciated by one skilled in the art that the mode of translational inhibition illustrated by FIG. 1 with specific reference to translational inhibition exerted by VGAM141 gene, herein designated VGAM GENE, on one or more VGAM141 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM141 is inhibition of expression of host target genes, as part of a novel viral mechanism of attacking a host. Accordingly, utilities of VGAM141 include diagnosis, prevention and treatment of viral infection by Shrimp White Spot Syndrome Virus (white spot bacilliform virus). Specific functions, and accordingly utilities, of VGAM141 correlate with, and may be deduced from, the identity of the host target genes which VGAM141 binds and inhibits, and the function of these host target genes, as elaborated hereinbelow.

Nucleotide sequences of the VGAM141 precursor RNA, herein designated VGAM PRECURSOR RNA, and of the 'diced' VGAM141 RNA, herein designated VGAM RNA, and a schematic representation of the secondary folding of VGAM141 folded precursor RNA, herein designated VGAM FOLDED PRECURSOR RNA, of VGAM141 are further described hereinbelow with reference to Table 1.

Nucleotide sequences of host target binding sites, such as BINDING SITE-I, BINDING SITE-II and BINDING SITE-III of FIG. 1, found on VGAM141 host target RNA, and schematic representation of the complementarity of each of these host target binding sites to VGAM141 RNA, herein designated VGAM RNA, are described hereinbelow with reference to Table 2.

As mentioned hereinabove with reference to FIG. 1, a function of VGAM141 gene, herein designated VGAM is inhibition of expression of VGAM141 target genes. It is appreciated that specific functions, and accordingly utilities, of VGAM141 correlate with, and may be deduced from, the identity of the target genes which VGAM141 binds and inhibits, and the function of these target genes, as elaborated hereinbelow.

Transforming, Acidic Coiled-coil Containing Protein 1 (TACC1, Accession NM_006283) is a VGAM141 host target gene. TACC1 BINDING SITE is HOST TARGET binding site found in the 3' untranslated region of mRNA encoded by TACC1, corresponding to a HOST TARGET binding site such as BINDING SITE I, BINDING SITE II or BINDING SITE III. Table 2 illustrates the complementarity of the nucleotide sequences of TACC1 BINDING SITE, designated SEQ ID:12966, to the nucleotide sequence of VGAM141 RNA, herein designated VGAM RNA, also designated SEQ ID:2852.

A function of VGAM141 is therefore inhibition of Transforming, Acidic Coiled-coil Containing Protein 1 (TACC1, Accession NM_006283). Accordingly, utilities of VGAM141 include diagnosis, prevention and treatment of diseases and clinical conditions associated with TACC1. Transmembrane, Prostate Androgen Induced RNA (TMEPAI, Accession NM_020182) is another VGAM141 host target gene. TMEPAI BINDING SITE is HOST TARGET binding site found in the 3' untranslated region of mRNA encoded by TMEPAI, corresponding to a HOST TARGET binding site such as BINDING SITE I, BINDING SITE II or BINDING SITE III. Table 2 illustrates the complementarity of the nucleotide sequences of TMEPAI BINDING SITE, designated SEQ ID:21402, to the nucleotide sequence of VGAM141 RNA, herein designated VGAM RNA, also designated SEQ ID:2852.

Another function of VGAM141 is therefore inhibition of Transmembrane, Prostate Androgen Induced RNA (TMEPAI, Accession NM_020182). Accordingly, utilities of VGAM141 include diagnosis, prevention and treatment of diseases and clinical conditions associated with TMEPAI. FLJ00026 (Accession XM_036307) is another VGAM141 host target gene. FLJ00026 BINDING SITE is HOST TARGET binding site found in the 3' untranslated region of mRNA encoded by FLJ00026, corresponding to a HOST TARGET binding site such as BINDING SITE I, BINDING SITE II or BINDING SITE III. Table 2 illustrates the complementarity of the nucleotide sequences of FLJ00026 BINDING SITE, designated SEQ ID:32424, to the nucleotide sequence of VGAM141 RNA, herein designated VGAM RNA, also designated SEQ ID:2852.

Another function of VGAM141 is therefore inhibition of FLJ00026 (Accession XM_036307). Accordingly, utilities of VGAM141 include diagnosis, prevention and treatment of diseases and clinical conditions associated with FLJ00026. FLJ11320 (Accession NM_018389) is another VGAM141 host target gene. FLJ11320 BINDING SITE is HOST TARGET binding site found in the 3' untranslated region of mRNA encoded by FLJ11320, corresponding to a HOST TARGET binding site such as BINDING SITE I, BINDING SITE II or BINDING SITE III. Table 2 illustrates the complementarity of the nucleotide sequences of FLJ11320 BINDING SITE, designated SEQ ID:20428, to the nucleotide sequence of VGAM141 RNA, herein designated VGAM RNA, also designated SEQ ID:2852.

Another function of VGAM141 is therefore inhibition of FLJ11320 (Accession NM_018389). Accordingly, utilities of VGAM141 include diagnosis, prevention and treatment of diseases and clinical conditions associated with FLJ11320. FLJ14917 (Accession NM_032861) is another VGAM141 host target gene. FLJ14917 BINDING SITE is HOST TARGET binding site found in the 3' untranslated region of mRNA encoded by FLJ14917, corresponding to a HOST TARGET binding site such as BINDING SITE I, BINDING SITE II or BINDING SITE III. Table 2 illustrates the complementarity of the nucleotide sequences of FLJ14917 BINDING SITE, designated SEQ ID:26665, to the nucleotide sequence of VGAM141 RNA, herein designated VGAM RNA, also designated SEQ ID:2852.

Another function of VGAM141 is therefore inhibition of FLJ14917 (Accession NM_032861). Accordingly, utilities of VGAM141 include diagnosis, prevention and treatment of diseases and clinical conditions associated with FLJ14917. FLJ22794 (Accession XM_166220) is another VGAM141 host target gene. FLJ22794 BINDING SITE is HOST TARGET binding site found in the 5' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44024, to the nucleotide sequence of VGAM141 RNA, herein designated VGAM RNA, also designated SEQ ID:2852.

Another function of VGAM141 is therefore inhibition of FLJ22794 (Accession XM_166220). Accordingly, utilities of VGAM141 include diagnosis, prevention and treatment of diseases and clinical conditions associated with FLJ22794. FIG. 1 further provides a conceptual description of a novel bioinformatically detected viral gene of the present invention, referred to here as Viral Genomic Address Messenger 142 (VGAM142) viral gene, which modulates expression of respective host target genes thereof, the function and utility of which host target genes is known in the art.

VGAM142 is a novel bioinformatically detected regulatory, non protein coding, viral micro RNA (miRNA) gene. The method by which VGAM142 was detected is described hereinabove with reference to FIGS. 1-8.

VGAM142 gene, herein designated VGAM GENE, is a viral gene contained in the genome of Shrimp White Spot Syndrome Virus (white spot bacilliform virus). VGAM142 host target gene, herein designated VGAM HOST TARGET GENE, is a human gene contained in the human genome.

VGAM142 gene encodes a VGAM142 precursor RNA, herein designated VGAM PRECURSOR RNA. Similar to other miRNA genes, and unlike most ordinary genes, VGAM142 precursor RNA does not encode a protein. A nucleotide sequence identical or highly similar to the nucleotide sequence of VGAM142 precursor RNA is designated SEQ ID:128, and is provided hereinbelow with reference to the sequence listing part. Nucleotide sequence SEQ ID:128 is located at position 150841 relative to the genome of Shrimp White Spot Syndrome Virus (white spot bacilliform virus).

VGAM142 precursor RNA folds onto itself, forming VGAM142 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM142 folded precursor RNA into VGAM142 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM142 RNA is designated SEQ ID:2853, and is provided hereinbelow with reference to the sequence listing part.

VGAM142 host target gene, herein designated VGAM HOST TARGET GENE, encodes a corresponding messenger RNA, VGAM142 host target RNA, herein designated VGAM HOST TARGET RNA. VGAM142 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM142 RNA, herein designated VGAM RNA, binds complementarily to one or more host target binding sites located in untranslated regions of VGAM142 host target RNA, herein designated VGAM HOST TARGET RNA. This complementary binding is due to the fact that the nucleotide sequence of VGAM142 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM142 RNA, herein designated VGAM RNA, may have a different number of host target binding sites in untranslated regions of a VGAM142 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM142 RNA, herein designated VGAM RNA, to host target binding sites on VGAM142 host target RNA, herein designated VGAM HOST TARGET RNA, such as BINDING SITE I, BINDING SITE II and BINDING SITE III, inhibits translation of VGAM142 host target RNA into VGAM142 host target protein, herein designated VGAM HOST TARGET PROTEIN. VGAM host target protein is therefore outlined by a broken line.

It is appreciated that VGAM142 host target gene, herein designated VGAM HOST TARGET GENE, in fact represents a plurality of VGAM142 host target genes. The mRNA of each one of this plurality of VGAM142 host target genes comprises one or more host target binding sites, each having a nucleotide sequence which is at least partly complementary to VGAM142 RNA, herein designated VGAM RNA, and which when bound by VGAM142 RNA causes inhibition of translation of respective one or more VGAM142 host target proteins.

It is further appreciated by one skilled in the art that the mode of translational inhibition illustrated by FIG. 1 with specific reference to translational inhibition exerted by VGAM142 gene, herein designated VGAM GENE, on one or more VGAM142 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM142 is inhibition of expression of host target genes, as part of a novel viral mechanism of attacking a host. Accordingly, utilities of VGAM142 include diagnosis, prevention and treatment of viral infection by Shrimp White Spot Syndrome Virus (white spot bacilliform virus). Specific functions, and accordingly utilities, of VGAM142 correlate with, and may be deduced from, the identity of the host target genes which VGAM142 binds and inhibits, and the function of these host target genes, as elaborated hereinbelow.

Nucleotide sequences of the VGAM142 precursor RNA, herein designated VGAM PRECURSOR RNA, and of the 'diced' VGAM142 RNA, herein designated VGAM RNA, and a schematic representation of the secondary folding of VGAM142 folded precursor RNA, herein designated VGAM FOLDED PRECURSOR RNA, of VGAM142 are further described hereinbelow with reference to Table 1.

Nucleotide sequences of host target binding sites, such as BINDING SITE-I, BINDING SITE-II and BINDING SITE-III of FIG. 1, found on VGAM142 host target RNA, and schematic representation of the complementarity of each of these host target binding sites to VGAM142 RNA, herein designated VGAM RNA, are described hereinbelow with reference to Table 2.

As mentioned hereinabove with reference to FIG. 1, a function of VGAM142 gene, herein designated VGAM is inhibition of expression of VGAM142 target genes. It is appreciated that specific functions, and accordingly utilities, of VGAM142 correlate with, and may be deduced from, the identity of the target genes which VGAM142 binds and inhibits, and the function of these target genes, as elaborated hereinbelow.

D10S170 (Accession NM_005436) is a VGAM142 host target gene. D10S170 BINDING SITE is HOST TARGET binding site found in the 3' untranslated region of mRNA encoded by D10S170, corresponding to a HOST TARGET binding site such as BINDING SITE I, BINDING SITE II or BINDING SITE III. Table 2 illustrates the complementarity of the nucleotide sequences of D10S170 BINDING SITE, designated SEQ ID:11919, to the nucleotide sequence of VGAM142 RNA, herein designated VGAM RNA, also designated SEQ ID:2853.

A function of VGAM142 is therefore inhibition of D10S170 (Accession NM_005436), a gene which may provide a structural basis for generation of RET/PTC1 rearrangement. Accordingly, utilities of VGAM142 include diagnosis, prevention and treatment of diseases and clinical conditions associated with D10S170. The function of D10S170 has been established by previous studies. The PTC1 chimeric oncogene (RET/PTC1), which is detected only in papillary thyroid carcinoma (OMIM Ref. No. 188550), is generated by the fusion of the tyrosine kinase domain of the RET proto-oncogene (OMIM Ref. No. 164761) to the 5-prime terminal region of another gene, H4 (Donghi et al., 1989; Grieco et al., 1990; Sozzi et al., 1991). PTC1 oncogene occurs in as many as 30% of papillary thyroid carcinomas. The fusion gene is formed through intrachromosomal 'illegitimate' recombination involving an inversion of 10q (Pierotti et al., 1992). The H4 gene shows no significant homology to known genes, and the function of H4 protein is unknown. The RET proto-oncogene encodes a receptor-type tyrosine kinase, whose receptor is glial cell line-derived neurotrophic factor (OMIM Ref. No. 600837). Tong et al., (1995) showed that the putative leucine zipper in the N-terminal region of H4 can mediate oligomerization of the PTC1 oncogene in vitro. Tong et al. (1997) demonstrated that the PTC1 oncogene forms a dimer in vivo, and the leucine zipper is responsible for this dimerization. Constitutive dimerization of the PTC1 oncogene appears to be essential for PTC1 transforming activity and constitutive oligomerization acquired by rearrangement or by point mutations may be a general mechanism for the activation of receptor tyrosine kinase oncogenes. See 601984 for discussion of the PTC3 chimeric oncogene. Nikiforova et al. (2000) asked whether, despite the great linear distance (30 mg) between RET and H4, recombination might be promoted by their proximity in the nucleus. Nikiforova et al. (2000) used 2-color FISH and 3-dimensional microscopy to map the positions of the RET and H4 loci within interphase nuclei. At least one pair of RET and H4 was juxtaposed in 35% of normal human thyroid cells and in 21% of peripheral blood lymphocytes, but only in 6% of normal mammary epithelial cells. Nikiforova et al. (2000) suggested that spatial contiguity of RET and H4 may provide a structural basis for generation of RET/PTC1 rearrangement by allowing a single radiation track to produce a double-strand break in each gene at the same site in the nucleus.

Full details of the abovementioned studies are described in the following publications, the disclosure of which are hereby incorporated by reference:

Pierotti, M. A.; Santoro, M.; Jenkins, R. B.; Sozzi, G.; Bongarzone, I.; Grieco, M.; Monzini, N.; Miozzo, M.; Herrmann, M. A.; Fusco, A.; Hay, I. D.; Della Porta, G.; Vecchio, G.: Characterization of an inversion on the long arm of chromosome 10 juxtaposing D10S170 and RET and creating the oncogenic sequence RET/PTC. Proc. Nat. Acad. Sci. 89:1616-1620, 1992; and Nikiforova, M. N.; Stringer, J. R.; Blough, R.; Medvedovic, M.; Fagin, J. A.; Nikiforov, Y. E.: Proximity of chromosomal loci that participate in radiation-induced rearrangements in hu.

Further studies establishing the function and utilities of D10S170 are found in John Hopkins OMIM database record ID 601985, and in sited publications numbered 8897, 3532, 8898, 8899-890 and 1145 listed in the bibliography section hereinbelow, which are also hereby incorporated by reference. Hepatic Leukemia Factor (HLF, Accession NM_002126) is another VGAM142 host target gene. HLF BINDING SITE is HOST TARGET binding site found in the 3' untranslated region of mRNA encoded by HLF, corresponding to a HOST TARGET binding site such as BINDING SITE I, BINDING SITE II or BINDING SITE III. Table 2 illustrates the complementarity of the nucleotide sequences of HLF BINDING SITE, designated SEQ ID:7905, to the nucleotide sequence of VGAM142 RNA, herein designated VGAM RNA, also designated SEQ ID:2853.

Another function of VGAM142 is therefore inhibition of Hepatic Leukemia Factor (HLF, Accession NM_002126). Accordingly, utilities of VGAM142 include diagnosis, prevention and treatment of diseases and clinical conditions associated with HLF. Interleukin 12B (natural killer cell stimulatory factor 2, cytotoxic lymphocyte maturation factor 2, p40) (IL12B, Accession NM_002187) is another VGAM142 host target gene. IL12B BINDING SITE is HOST TARGET binding site found in the 3' untranslated region of mRNA encoded by IL12B, corresponding to a HOST TARGET binding site such as BINDING SITE I, BINDING SITE II or BINDING SITE III. Table 2 illustrates the complementarity of the nucleotide sequences of IL12B BINDING SITE, designated SEQ ID:7944, to the nucleotide sequence of VGAM142 RNA, herein designated VGAM RNA, also designated SEQ ID:2853.

Another function of VGAM142 is therefore inhibition of Interleukin 12B (natural killer cell stimulatory factor 2, cytotoxic lymphocyte maturation factor 2, p40) (IL12B, Accession NM_002187). Accordingly, utilities of VGAM142 include diagnosis, prevention and treatment of diseases and clinical conditions associated with IL12B. Interleukin 1 Receptor Accessory Protein (IL1RAP, Accession NM_002182) is another VGAM142 host target gene. IL1RAP BINDING SITE is HOST TARGET binding site found in the 3' untranslated region of mRNA encoded by IL1RAP, corresponding to a HOST TARGET binding site such as BINDING SITE I, BINDING SITE II or BINDING SITE III. Table 2 illustrates the complementarity of the nucleotide sequences of IL1RAP BINDING SITE, designated SEQ ID:7941, to the nucleotide sequence of VGAM142 RNA, herein designated VGAM RNA, also designated SEQ ID:2853.

Another function of VGAM142 is therefore inhibition of Interleukin 1 Receptor Accessory Protein (IL1RAP, Accession NM_002182), a gene which may function as a membrane receptor. promotes heterophilic cellular adhesion. Accordingly, utilities of VGAM142 include diagnosis, prevention and treatment of diseases and clinical conditions associated with IL1RAP. The function of IL1RAP has been established by previous studies. Interleukin-1 (IL1; 147760, 147720) receptor accessory protein (OMIM Ref. No. IL1RAP) is a transmembrane protein that is required for IL1 signal transduction (Wesche et al., 1997). Huang et al. (1997) isolated a human IL1RAP cDNA, called IL1RAcP by them, by screening a placenta cDNA library with a mouse Il1rap cDNA. They found that treatment of cells with IL1 induced the formation of a complex containing IL1RAP and type I IL1 receptor (IL1RA; 147810). The serine/threonine kinase IRAK (OMIM Ref. No. 300283) was recruited to this complex through its association with IL1RAP. Overexpression of mutant IL1RAP proteins lacking the intracellular IRAK-binding domain prevented the recruitment of IRAK to the receptor complex. By fluorescence in situ hybridization and radiation hybrid analysis, Dale et al. (1998) mapped the IL1RAP gene to 3q28.

Full details of the abovementioned studies are described in the following publications, the disclosure of which are hereby incorporated by reference:

Huang, J.; Gao, X.; Li, S.; Cao, Z.: Recruitment of IRAK to the interleukin 1 receptor complex requires interleukin 1 receptor accessory protein. Proc. Nat. Acad. Sci. 94:12829-12832, 1997; and Wesche, H.; Korherr, C.; Kracht, M.; Falk, W.; Resch, K.; Martin, M. U.: The interleukin-1 receptor accessory protein (IL-1RAcP) is essential for IL-1-induced activation of interleukin.

Further studies establishing the function and utilities of IL1RAP are found in John Hopkins OMIM database record ID 602626, and in sited publications numbered 8562-8564 listed in the bibliography section hereinbelow, which are also hereby incorporated by reference. Sodium Channel, Nonvoltage-gated 1, Gamma (SCNN1G, Accession NM_001039) is another VGAM142 host target gene. SCNN1G BINDING SITE is HOST TARGET binding site found in the 3' untranslated region of mRNA encoded by SCNN1G, corresponding to a HOST TARGET binding site such as BINDING SITE I, BINDING SITE II or BINDING SITE III. Table 2 illustrates the complementarity of the nucleotide sequences of SCNN1G BINDING SITE, designated SEQ ID:6706, to the nucleotide sequence of VGAM142 RNA, herein designated VGAM RNA, also designated SEQ ID:2853.

Another function of VGAM142 is therefore inhibition of Sodium Channel, Nonvoltage-gated 1, Gamma (SCNN1G, Accession NM_001039). Accordingly, utilities of VGAM142 include diagnosis, prevention and treatment of diseases and clinical conditions associated with SCNN1G. Solute Carrier Family 24 (sodium/potassium/calcium exchanger), Member 1 (SLC24A1, Accession NM_004727) is another VGAM142 host target gene. SLC24A1 BINDING SITE is HOST TARGET binding site found in the 3" untranslated region of mRNA encoded by SLC24A1, corresponding to a HOST TARGET binding site such as BINDING SITE I, BINDING SITE II or BINDING SITE III. Table 2 illustrates the complementarity of the nucleotide sequences of SLC24A1 BINDING SITE, designated SEQ ID:11103, to the nucleotide sequence of VGAM142 RNA, herein designated VGAM RNA, also designated SEQ ID:2853.

Another function of VGAM142 is therefore inhibition of Solute Carrier Family 24 (sodium/potassium/calcium exchanger), Member 1 (SLC24A1, Accession NM_004727), a gene which is a critical component of the visual transduction cascade, controlling the calcium concentration of outer segments during light and darkness. Accordingly, utilities of VGAM142 include diagnosis, prevention and treatment of diseases and clinical conditions associated with SLC24A1. The function of SLC24A1 has been established by previous studies. By screening a human retinal cDNA library using the entire bovine rod sodium/potassium/calcium (Na-Ca+K) exchanger cDNA as a probe, Tucker et al. (1998) cloned the human NCKX1 gene. Human NCKX1 codes for a protein of 1,081 amino acids that shows 64% overall identity with the bovine protein. The 2 sets of putative transmembrane domains and their short connecting loops showed 94% identity, while the extracellular loop at the amino terminus was only 59% identical. Tucker et al. (1998) determined the genomic structure of the NCKX1 gene and found 1 intron in the 5-prime untranslated region and 8 within the coding region. Exon length varies from 54 to 2,037 bp Using fluorescence in situ hybridization and analysis of a radiation hybrid panel, Tucker et al. (1998) mapped the NCKX1 gene to chromosome 15q22

Full details of the abovementioned studies are described in the following publications, the disclosure of which are hereby incorporated by reference:

Tucker, J. E.; Winkfein, R. J.; Cooper, C. B.; Schnetkamp, P. P.: cDNA cloning of the human retinal rod Na-Ca+K exchanger: comparison with a revised bovine sequence. Invest. Ophthal. Vis. Sci. 39:435-440, 1998; and Tucker, J. E.; Winkfein, R. J.; Murthy, S. K.; Friedman, J. S.; Walter, M. A.; Demetrick, D. J.; Schnetkamp, P. P. M.: Chromosomal localization and genomic organization of the human retina.

Further studies establishing the function and utilities of SLC24A1 are found in John Hopkins OMIM database record ID 603617, and in sited publications numbered 7591-7592 listed in the bibliography section hereinbelow, which are also hereby incorporated by reference. SWI/SNF Related, Matrix Associated, Actin Dependent Regulator of Chromatin, Subfamily C, Member 1 (SMARCC1, Accession NM_003074) is another VGAM142 host target gene. SMARCC1 BINDING SITE is HOST TARGET binding site found in the 3' untranslated region of mRNA encoded by SMARCC1, corresponding to a HOST TARGET binding site such as BINDING SITE I, BINDING SITE II or BINDING SITE III. Table 2 illustrates the complementarity of the nucleotide sequences of SMARCC1 BINDING SITE, designated SEQ ID:9040, to the nucleotide sequence of VGAM142 RNA, herein designated VGAM RNA, also designated SEQ ID:2853.

Another function of VGAM142 is therefore inhibition of SWI/SNF Related, Matrix Associated, Actin Dependent Regulator of Chromatin, Subfamily C, Member 1 (SMARCC1, Accession NM_003074), a gene which is involved in chromatin remodeling. Accordingly, utilities of VGAM142 include diagnosis, prevention and treatment of diseases and clinical conditions associated with SMARCC1. The function of SMARCC1 and its association with various diseases and clinical conditions, has been established by previous studies, as described hereinabove with reference to VGAM57. Zinc Finger Protein 192 (ZNF192, Accession NM_006298) is another VGAM142 host target gene. ZNF192 BINDING SITE is HOST TARGET binding site found in the 3' untranslated region of mRNA encoded by ZNF192, corresponding to a HOST TARGET binding site such as BINDING SITE I, BINDING SITE II or BINDING SITE III. Table 2 illustrates the complementarity of the nucleotide sequences of ZNF192 BINDING SITE, designated SEQ ID:12993, to the nucleotide sequence of VGAM142 RNA, herein designated VGAM RNA, also designated SEQ ID:2853.

Another function of VGAM142 is therefore inhibition of Zinc Finger Protein 192 (ZNF192, Accession NM_006298).

Accordingly, utilities of VGAM142 include diagnosis, prevention and treatment of diseases and clinical conditions associated with ZNF192. Chromosome 21 Open Reading Frame 108 (C21orf108, Accession XM_114191) is another VGAM142 host target gene. C21orf108 BINDING SITE is HOST TARGET binding site found in the 3' untranslated region of mRNA encoded by C21orf108, corresponding to a HOST TARGET binding site such as BINDING SITE I, BINDING SITE II or BINDING SITE III. Table 2 illustrates the complementarity of the nucleotide sequences of C21orf108 BINDING SITE, designated SEQ ID:42774, to the nucleotide sequence of VGAM142 RNA, herein designated VGAM RNA, also designated SEQ ID:2853.

Another function of VGAM142 is therefore inhibition of Chromosome 21 Open Reading Frame 108 (C21orf108, Accession XM_114191). Accordingly, utilities of VGAM142 include diagnosis, prevention and treatment of diseases and clinical conditions associated with C21orf108. Chromosome 8 Open Reading Frame 7 (C8orf7, Accession XM_088376) is another VGAM142 host target gene. C8orf7 BINDING SITE is HOST TARGET binding site found in the 3' untranslated region of mRNA encoded by C8orf7, corresponding to a HOST TARGET binding site such as BINDING SITE I, BINDING SITE II or BINDING SITE III. Table 2 illustrates the complementarity of the nucleotide sequences of C8orf7 BINDING SITE, designated SEQ ID:39650, to the nucleotide sequence of VGAM142 RNA, herein designated VGAM RNA, also designated SEQ ID:2853.

Another function of VGAM142 is therefore inhibition of Chromosome 8 Open Reading Frame 7 (C8orf7, Accession XM_088376). Accordingly, utilities of VGAM142 include diagnosis, prevention and treatment of diseases and clinical conditions associated with C8orf7. Calcium Homeostasis Endoplasmic Reticulum Protein (CHERP, Accession NM_006387) is another VGAM142 host target gene. CHERP BINDING SITE is HOST TARGET binding site found in the 3' untranslated region of mRNA encoded by CHERP, corresponding to a HOST TARGET binding site such as BINDING SITE I, BINDING SITE II or BINDING SITE III. Table 2 illustrates the complementarity of the nucleotide sequences of CHERP BINDING SITE, designated SEQ ID:13092, to the nucleotide sequence of VGAM142 RNA, herein designated VGAM RNA, also designated SEQ ID:2853.

Another function of VGAM142 is therefore inhibition of Calcium Homeostasis Endoplasmic Reticulum Protein (CHERP, Accession NM_006387). Accordingly, utilities of VGAM142 include diagnosis, prevention and treatment of diseases and clinical conditions associated with CHERP. FLJ12121 (Accession NM_024978) is another VGAM142 host target gene. FLJ12121 BINDING SITE is HOST TARGET binding site found in the 5' untranslated region of mRNA encoded by FLJ12121, corresponding to a HOST TARGET binding site such as BINDING SITE I, BINDING SITE II or BINDING SITE III. Table 2 illustrates the complementarity of the nucleotide sequences of FLJ12121 BINDING SITE, designated SEQ ID:24538, to the nucleotide sequence of VGAM142 RNA, herein designated VGAM RNA, also designated SEQ ID:2853.

Another function of VGAM142 is therefore inhibition of FLJ12121 (Accession NM_024978). Accordingly, utilities of VGAM142 include diagnosis, prevention and treatment of diseases and clinical conditions associated with FLJ12121. KIAA0475 (Accession NM_014864) is another VGAM142 host target gene. KIAA0475 BINDING SITE is HOST TARGET binding site found in the 3' untranslated region of mRNA encoded by KIAA0475, corresponding to a HOST TARGET binding site such as BINDING SITE I, BINDING SITE II or BINDING SITE III. Table 2 illustrates the complementarity of the nucleotide sequences of KIAA0475 BINDING SITE, designated SEQ ID:16952, to the nucleotide sequence of VGAM142 RNA, herein designated VGAM RNA, also designated SEQ ID:2853.

Another function of VGAM142 is therefore inhibition of KIAA0475 (Accession NM_014864). Accordingly, utilities of VGAM142 include diagnosis, prevention and treatment of diseases and clinical conditions associated with KIAA0475. KIAA1317 (Accession XM_098368) is another VGAM142 host target gene. KIAA1317 BINDING SITE is HOST TARGET binding site found in the 5' untranslated region of mRNA encoded by KIAA1317, corresponding to a HOST TARGET binding site such as BINDING SITE I, BINDING SITE II or BINDING SITE III. Table 2 illustrates the complementarity of the nucleotide sequences of KIAA1317 BINDING SITE, designated SEQ ID:41630, to the nucleotide sequence of VGAM142 RNA, herein designated VGAM RNA, also designated SEQ ID:2853.

Another function of VGAM142 is therefore inhibition of KIAA1317 (Accession XM_098368). Accordingly, utilities of VGAM142 include diagnosis, prevention and treatment of diseases and clinical conditions associated with KIAA1317. KIAA1434 (Accession XM_045585) is another VGAM142 host target gene. KIAA1434 BINDING SITE is HOST TARGET binding site found in the 3' untranslated region of mRNA encoded by KIAA1434, corresponding to a HOST TARGET binding site such as BINDING SITE I, BINDING SITE II or BINDING SITE III. Table 2 illustrates the complementarity of the nucleotide sequences of KIAA1434 BINDING SITE, designated SEQ ID:34488, to the nucleotide sequence of VGAM142 RNA, herein designated VGAM RNA, also designated SEQ ID:2853.

Another function of VGAM142 is therefore inhibition of KIAA1434 (Accession XM_045585). Accordingly, utilities of VGAM142 include diagnosis, prevention and treatment of diseases and clinical conditions associated with KIAA1434. KIAA1462 (Accession XM_166132) is another VGAM142 host target gene. KIAA1462 BINDING SITE is HOST TARGET binding site found in the 3' untranslated region of mRNA encoded by KIAA1462, corresponding to a HOST TARGET binding site such as BINDING SITE I, BINDING SITE II or BINDING SITE III. Table 2 illustrates the complementarity of the nucleotide sequences of KIAA1462 BINDING SITE, designated SEQ ID:43923, to the nucleotide sequence of VGAM142 RNA, herein designated VGAM RNA, also designated SEQ ID:2853.

Another function of VGAM142 is therefore inhibition of KIAA1462 (Accession XM_166132). Accordingly, utilities of VGAM142 include diagnosis, prevention and treatment of diseases and clinical conditions associated with KIAA1462. KIAA1829 (Accession XM_030378) is another VGAM142 host target gene. KIAA1829 BINDING SITE is HOST TARGET binding site found in the 3' untranslated region of mRNA encoded by KIAA1829, corresponding to a HOST TARGET binding site such as BINDING SITE I, BINDING SITE II or BINDING SITE III. Table 2 illustrates the complementarity of the nucleotide sequences of KIAA1829 BINDING SITE, designated SEQ ID:31034, to the nucleotide sequence of VGAM142 RNA, herein designated VGAM RNA, also designated SEQ ID:2853.

Another function of VGAM142 is therefore inhibition of KIAA1829 (Accession XM_030378). Accordingly, utilities of VGAM142 include diagnosis, prevention and treatment of diseases and clinical conditions associated with KIAA1829. Protein Tyrosine Phosphatase, Receptor Type, R (PTPRR, Accession NM_130846) is another VGAM142 host target gene. PTPRR BINDING SITE is HOST TARGET binding site found in the 5' untranslated region of mRNA encoded by PTPRR, corresponding to a HOST TARGET binding site such as BINDING SITE I, BINDING SITE II or BINDING SITE III. Table 2 illustrates the complementarity of the nucleotide sequences of PTPRR BINDING SITE, designated SEQ ID:28382, to the nucleotide sequence of VGAM142 RNA, herein designated VGAM RNA, also designated SEQ ID:2853.

Another function of VGAM142 is therefore inhibition of Protein Tyrosine Phosphatase, Receptor Type, R (PTPRR, Accession NM_130846). Accordingly, utilities of VGAM142 include diagnosis, prevention and treatment of diseases and clinical conditions associated with PTPRR. Transcription Factor-like 5 (basic helix-loop-helix) (TCFL5, Accession NM_006602) is another VGAM142 host target gene. TCFL5 BINDING SITE is HOST TARGET binding site found in the 3' untranslated region of mRNA encoded by TCFL5, corresponding to a HOST TARGET binding site such as BINDING SITE I, BINDING SITE II or BINDING SITE III. Table 2 illustrates the complementarity of the nucleotide sequences of TCFL5 BINDING SITE, designated SEQ ID:13381, to the nucleotide sequence of VGAM142 RNA, herein designated VGAM RNA, also designated SEQ ID:2853.

Another function of VGAM142 is therefore inhibition of Transcription Factor-like 5 (basic helix-loop-helix) (TCFL5, Accession NM_006602). Accordingly, utilities of VGAM142 include diagnosis, prevention and treatment of diseases and clinical conditions associated with TCFL5. LOC146243 (Accession XM_096956) is another VGAM142 host target gene. LOC146243 BINDING SITE is HOST TARGET binding site found in the 3' untranslated region of mRNA encoded by LOC146243, corresponding to a HOST TARGET binding site such as BINDING SITE I, BINDING SITE II or BINDING SITE III. Table 2 illustrates the complementarity of the nucleotide sequences of LOC146243 BINDING SITE, designated SEQ ID:40677, to the nucleotide sequence of VGAM142 RNA, herein designated VGAM RNA, also designated SEQ ID:2853.

Another function of VGAM142 is therefore inhibition of LOC146243 (Accession XM_096956). Accordingly, utilities of VGAM142 include diagnosis, prevention and treatment of diseases and clinical conditions associated with LOC146243. LOC153129 (Accession XM_087606) is another VGAM142 host target gene. LOC153129 BINDING SITE is HOST TARGET binding site found in the 5' untranslated region of mRNA encoded by LOC153129, corresponding to a HOST TARGET binding site such as BINDING SITE I, BINDING SITE II or BINDING SITE III. Table 2 illustrates the complementarity of the nucleotide sequences of LOC153129 BINDING SITE, designated SEQ ID:39360, to the nucleotide sequence of VGAM142 RNA, herein designated VGAM RNA, also designated SEQ ID:2853.

Another function of VGAM142 is therefore inhibition of LOC153129 (Accession XM_087606). Accordingly, utilities of VGAM142 include diagnosis, prevention and treatment of diseases and clinical conditions associated with LOC153129. LOC202451 (Accession XM_117401) is another VGAM142 host target gene. LOC202451 BINDING SITE is HOST TARGET binding site found in the 5' untranslated region of mRNA encoded by LOC202451, corresponding to a HOST TARGET binding site such as BINDING SITE I, BINDING SITE II or BINDING SITE III. Table 2 illustrates the complementarity of the nucleotide sequences of LOC202451 BINDING SITE, designated SEQ ID:43441, to the nucleotide sequence of VGAM142 RNA, herein designated VGAM RNA, also designated SEQ ID:2853.

Another function of VGAM142 is therefore inhibition of LOC202451 (Accession XM_117401). Accordingly, utilities of VGAM142 include diagnosis, prevention and treatment of diseases and clinical conditions associated with LOC202451.

FIG. 1 further provides a conceptual description of a novel bioinformatically detected viral gene of the present invention, referred to here as Viral Genomic Address Messenger 143 (VGAM143) viral gene, which modulates expression of respective host target genes thereof, the function and utility of which host target genes is known in the art.

VGAM143 is a novel bioinformatically detected regulatory, non protein coding, viral micro RNA (miRNA) gene. The method by which VGAM143 was detected is described hereinabove with reference to FIGS. 1-8.

VGAM143 gene, herein designated VGAM GENE, is a viral gene contained in the genome of Shrimp White Spot Syndrome Virus (white spot bacilliform virus). VGAM143 host target gene, herein designated VGAM HOST TARGET GENE, is a human gene contained in the human genome.

VGAM143 gene encodes a VGAM143 precursor RNA, herein designated VGAM PRECURSOR RNA. Similar to other miRNA genes, and unlike most ordinary genes, VGAM143 precursor RNA does not encode a protein. A nucleotide sequence identical or highly similar to the nucleotide sequence of VGAM143 precursor RNA is designated SEQ ID:129, and is provided hereinbelow with reference to the sequence listing part. Nucleotide sequence SEQ ID:129 is located at position 222208 relative to the genome of Shrimp White Spot Syndrome Virus (white spot bacilliform virus).

VGAM143 precursor RNA folds onto itself, forming VGAM143 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM143 folded precursor RNA into VGAM143 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM143 RNA is designated SEQ ID:2854, and is provided hereinbelow with reference to the sequence listing part.

VGAM143 host target gene, herein designated VGAM HOST TARGET GENE, encodes a corresponding messenger RNA, VGAM143 host target RNA, herein designated VGAM HOST TARGET RNA. VGAM143 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM143 RNA, herein designated VGAM RNA, binds complementarily to one or more host target binding sites located in untranslated regions of VGAM143 host target RNA, herein designated VGAM HOST TARGET RNA. This complementary binding is due to the fact that the nucleotide sequence of VGAM143 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM143 RNA, herein designated VGAM RNA, may have a different number of host target binding sites in untranslated regions of a VGAM143 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM143 RNA, herein designated VGAM RNA, to host target binding sites on VGAM143 host target RNA, herein designated VGAM HOST TARGET RNA, such as BINDING SITE I, BINDING SITE II and BINDING SITE III, inhibits translation of VGAM143 host target RNA into VGAM143 host target protein, herein designated VGAM HOST TARGET PROTEIN. VGAM host target protein is therefore outlined by a broken line.

It is appreciated that VGAM143 host target gene, herein designated VGAM HOST TARGET GENE, in fact represents a plurality of VGAM143 host target genes. The mRNA of each one of this plurality of VGAM143 host target genes comprises one or more host target binding sites, each having a nucleotide sequence which is at least partly complementary to VGAM143 RNA, herein designated VGAM RNA, and which when bound by VGAM143 RNA causes inhibition of translation of respective one or more VGAM143 host target proteins.

It is further appreciated by one skilled in the art that the mode of translational inhibition illustrated by FIG. 1 with specific reference to translational inhibition exerted by VGAM143 gene, herein designated VGAM GENE, on one or more VGAM143 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM143 is inhibition of expression of host target genes, as part of a novel viral mechanism of attacking a host. Accordingly, utilities of VGAM143 include diagnosis, prevention and treatment of viral infection by Shrimp White Spot Syndrome Virus (white spot bacilliform virus). Specific functions, and accordingly utilities, of VGAM143 correlate with, and may be deduced from, the identity of the host target genes which VGAM143 binds and inhibits, and the function of these host target genes, as elaborated hereinbelow.

Nucleotide sequences of the VGAM143 precursor RNA, herein designated VGAM PRECURSOR RNA, and of the 'diced' VGAM143 RNA, herein designated VGAM RNA, and a schematic representation of the secondary folding of VGAM143 folded precursor RNA, herein designated VGAM FOLDED PRECURSOR RNA, of VGAM143 are further described hereinbelow with reference to Table 1.

Nucleotide sequences of host target binding sites, such as BINDING SITE-I, BINDING SITE-II and BINDING SITE-III of FIG. 1, found on VGAM143 host target RNA, and schematic representation of the complementarity of each of these host target binding sites to VGAM143 RNA, herein designated VGAM RNA, are described hereinbelow with reference to Table 2.

As mentioned hereinabove with reference to FIG. 1, a function of VGAM143 gene, herein designated VGAM is inhibition of expression of VGAM143 target genes. It is appreciated that specific functions, and accordingly utilities, of VGAM143 correlate with, and may be deduced from, the identity of the target genes which VGAM143 binds and inhibits, and the function of these target genes, as elaborated hereinbelow.

Cullin 3 (CUL3, Accession NM_003590) is a VGAM143 host target gene. CUL3 BINDING SITE is HOST TARGET binding site found in the 3' untranslated region of mRNA encoded by CUL3, corresponding to a HOST TARGET binding site such as BINDING SITE I, BINDING SITE II or BINDING SITE III. Table 2 illustrates the complementarity of the nucleotide sequences of CUL3 BINDING SITE, designated SEQ ID:9643, to the nucleotide sequence of VGAM143 RNA, herein designated VGAM RNA, also designated SEQ ID:2854.

A function of VGAM143 is therefore inhibition of Cullin 3 (CUL3, Accession NM_003590), a gene which may target other proteins for ubiquitin-dependent proteolysis. Accordingly, utilities of VGAM143 include diagnosis, prevention and treatment of diseases and clinical conditions associated with CUL3. The function of CUL3 has been established by previous studies. Kipreos et al. (1996) identified a conserved gene family, designated cullins, with at least 5 members in nematodes, 6 in human S, and 3 in S. cerevisiae. See CUL1 (OMIM Ref. No. 603134). Human CUL3 is an ortholog of nematode cul3. Michel and Xiong (1998) identified human CUL3 cDNAs and reported that the predicted protein is 768 amino acids long. Ishikawa et al. (1998) isolated a CUL3 cDNA, KIAA0617, as 1 of 100 brain cDNAs encoding large proteins. Using RT-PCR, they found that CUL3 is expressed in several tissues. Du et al. (1998) identified CUL3 as a gene whose expression in human fibroblasts is induced by phorbol 12-myristate 13-acetate (PMA) and suppressed by salicylate. They reported that the sequences of the human and C. elegans cul3 proteins share 46% identity. Northern blot analysis revealed that CUL3 is expressed as major 2.8- and minor 4.3-kb transcripts in various human tissues, with the highest levels in skeletal muscle and heart.

Full details of the abovementioned studies are described in the following publications, the disclosure of which are hereby incorporated by reference:

Du, M.; Sansores-Garcia, L.; Zu, Z.; Wu, K. K.: Cloning and expression analysis of a novel salicylate suppressible gene, Hs-CUL-3, a member of cullin/Cdc53 family. J. Biol. Chem. 273:24289-24292, 1998; and Ishikawa, K.; Nagase, T.; Suyama, M.; Miyajima, N.; Tanaka, A.; Kotani, H.; Nomura, N.; Ohara, O.: Prediction of the coding sequences of unidentified human genes. X. The complete seque.

Further studies establishing the function and utilities of CUL3 are found in John Hopkins OMIM database record ID 603136, and in sited publications numbered 5063, 9440-944 and 5062 listed in the bibliography section hereinbelow, which are also hereby incorporated by reference. BLOV1 (Accession XM_083866) is another VGAM143 host target gene. BLOV1 BINDING SITE is HOST TARGET binding site found in the 3' untranslated region of mRNA encoded by BLOV1, corresponding to a HOST TARGET binding site such as BINDING SITE I, BINDING SITE II or BINDING SITE III. Table 2 illustrates the complementarity of the nucleotide sequences of BLOV1 BINDING SITE, designated SEQ ID:37519, to the nucleotide sequence of VGAM143 RNA, herein designated VGAM RNA, also designated SEQ ID:2854.

Another function of VGAM143 is therefore inhibition of BLOV1 (Accession XM_083866). Accordingly, utilities of VGAM143 include diagnosis, prevention and treatment of diseases and clinical conditions associated with BLOV1. FLJ10849 (Accession NM_018243) is another VGAM143 host target gene. FLJ10849 BINDING SITE is HOST TARGET binding site found in the 3' untranslated region of mRNA encoded by FLJ10849, corresponding to a HOST TARGET binding site such as BINDING SITE I, BINDING SITE II or BINDING SITE III. Table 2 illustrates the complementarity of the nucleotide sequences of FLJ10849 BINDING SITE, designated SEQ ID:20206, to the nucleotide sequence of VGAM143 RNA, herein designated VGAM RNA, also designated SEQ ID:2854.

Another function of VGAM143 is therefore inhibition of FLJ10849 (Accession NM_018243). Accordingly, utilities of VGAM143 include diagnosis, prevention and treatment of diseases and clinical conditions associated with FLJ10849. Mitochondrial Ribosomal Protein L35 (MRPL35, Accession NM_016622) is another VGAM143 host target gene. MRPL35 BINDING SITE is HOST TARGET binding site found in the 3' untranslated region of mRNA encoded by MRPL35, corresponding to a HOST TARGET binding site such as BINDING SITE I, BINDING SITE II or BINDING SITE III. Table 2 illustrates the complementarity of the nucleotide sequences of MRPL35 BINDING SITE, designated SEQ ID:18731, to the nucleotide sequence of VGAM143 RNA, herein designated VGAM RNA, also designated SEQ ID:2854.

Another function of VGAM143 is therefore inhibition of Mitochondrial Ribosomal Protein L35 (MRPL35, Accession NM_016622). Accordingly, utilities of VGAM143 include diagnosis, prevention and treatment of diseases and clinical conditions associated with MRPL35. FIG. 1 further provides a conceptual description of a novel bioinformatically detected viral gene of the present invention, referred to here as Viral Genomic Address Messenger 144 (VGAM144) viral gene, which modulates expression of respective host target genes thereof, the function and utility of which host target genes is known in the art.

VGAM144 is a novel bioinformatically detected regulatory, non protein coding, viral micro RNA (miRNA) gene. The method by which VGAM144 was detected is described hereinabove with reference to FIGS. 1-8.

VGAM144 gene, herein designated VGAM GENE, is a viral gene contained in the genome of Shrimp White Spot Syndrome Virus (white spot bacilliform virus). VGAM144 host target gene, herein designated VGAM HOST TARGET GENE, is a human gene contained in the human genome.

VGAM144 gene encodes a VGAM144 precursor RNA, herein designated VGAM PRECURSOR RNA. Similar to other miRNA genes, and unlike most ordinary genes, VGAM144 precursor RNA does not encode a protein. A nucleotide sequence identical or highly similar to the nucleotide sequence of VGAM144 precursor RNA is designated SEQ ID:130, and is provided hereinbelow with reference to the sequence listing part. Nucleotide sequence SEQ ID:130 is located at position 93494 relative to the genome of Shrimp White Spot Syndrome Virus (white spot bacilliform virus).

VGAM144 precursor RNA folds onto itself, forming VGAM144 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM144 folded precursor RNA into VGAM144 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM144 RNA is designated SEQ ID:2855, and is provided hereinbelow with reference to the sequence listing part.

VGAM144 host target gene, herein designated VGAM HOST TARGET GENE, encodes a corresponding messenger RNA, VGAM144 host target RNA, herein designated VGAM HOST TARGET RNA. VGAM144 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM144 RNA, herein designated VGAM RNA, binds complementarily to one or more host target binding sites located in untranslated regions of VGAM144 host target RNA, herein designated VGAM HOST TARGET RNA. This complementary binding is due to the fact that the nucleotide sequence of VGAM144 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM144 RNA, herein designated VGAM RNA, may have a different number of host target binding sites in untranslated regions of a VGAM144 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM144 RNA, herein designated VGAM RNA, to host target binding sites on VGAM144 host target RNA, herein designated VGAM HOST TARGET RNA, such as BINDING SITE I, BINDING SITE II and BINDING SITE III, inhibits translation of VGAM144 host target RNA into VGAM144 host target protein, herein designated VGAM HOST TARGET PROTEIN. VGAM host target protein is therefore outlined by a broken line.

It is appreciated that VGAM144 host target gene, herein designated VGAM HOST TARGET GENE, in fact represents a plurality of VGAM144 host target genes. The mRNA of each one of this plurality of VGAM144 host target genes comprises one or more host target binding sites, each having a nucleotide sequence which is at least partly complementary to VGAM144 RNA, herein designated VGAM RNA, and which when bound by VGAM144 RNA causes inhibition of translation of respective one or more VGAM144 host target proteins.

It is further appreciated by one skilled in the art that the mode of translational inhibition illustrated by FIG. 1 with specific reference to translational inhibition exerted by VGAM144 gene, herein designated VGAM GENE, on one or more VGAM144 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM144 is inhibition of expression of host target genes, as part of a novel viral mechanism of attacking a host. Accordingly, utilities of VGAM144 include diagnosis, prevention and treatment of viral infection by Shrimp White Spot Syndrome Virus (white spot bacilliform virus). Specific functions, and accordingly utilities, of VGAM144 correlate with, and may be deduced from, the identity of the host target genes which VGAM144 binds and inhibits, and the function of these host target genes, as elaborated hereinbelow.

Nucleotide sequences of the VGAM144 precursor RNA, herein designated VGAM PRECURSOR RNA, and of the 'diced' VGAM144 RNA, herein designated VGAM RNA, and a schematic representation of the secondary folding of VGAM144 folded precursor RNA, herein designated VGAM FOLDED PRECURSOR RNA, of VGAM144 are further described hereinbelow with reference to Table 1.

Nucleotide sequences of host target binding sites, such as BINDING SITE-I, BINDING SITE-II and BINDING SITE-III of FIG. 1, found on VGAM144 host target RNA, and schematic representation of the complementarity of each of these host target binding sites to VGAM144 RNA, herein designated VGAM RNA, are described hereinbelow with reference to Table 2.

As mentioned hereinabove with reference to FIG. 1, a function of VGAM144 gene, herein designated VGAM is inhibition of expression of VGAM144 target genes. It is appreciated that specific functions, and accordingly utilities, of VGAM144 correlate with, and may be deduced from, the identity of the target genes which VGAM144 binds and inhibits, and the function of these target genes, as elaborated hereinbelow.

Axonal Transport of Synaptic Vesicles (ATSV, Accession NM_004321) is a VGAM144 host target gene. ATSV BINDING SITE is HOST TARGET binding site found in the 3' untranslated region of mRNA encoded by ATSV, corresponding to a HOST TARGET binding site such as BINDING SITE I, BINDING SITE II or BINDING SITE III. Table 2 illustrates the complementarity of the nucleotide sequences of ATSV BINDING SITE, designated SEQ ID:10520, to the nucleotide sequence of VGAM144 RNA, herein designated VGAM RNA, also designated SEQ ID:2855.

A function of VGAM144 is therefore inhibition of Axonal Transport of Synaptic Vesicles (ATSV, Accession NM_004321), a gene which is a motor for anterograde axonal transport of synaptic vesicle precursors. Accordingly, utilities of VGAM144 include diagnosis, prevention and treatment of diseases and clinical conditions associated with ATSV. The function of ATSV has been established by previous studies. Kinesin-related proteins constitute a large superfamily of microtubule-dependent proteins that mediate specific and diverse motile processes, including intracellular transport and cell division. The human ATSV protein is a member of the kinesin family and shows 95% identity to the KIF1A protein of mouse (Okada et al., 1995). KIF1A is an anterograde motor protein that transports membranous organelles along axonal microtubules. Its cargo includes a subset of precursors for synaptic vesicles: synaptophysin (OMIM Ref. No. 313475), synaptotagmin (OMIM Ref. No. 185605), and Rab3A (OMIM Ref. No. 179490). Animal model experiments lend further support to the function of ATSV. The phenotype of KIF1A knockout mice includes motor and sensory disturbances, a reduction in the density of synaptic vesicles in nerve terminals, and accumulation of clear vesicles in nerve cell bodies (Yonekawa et al., 1998). It can be hypothesized that ATSV (and KIF1A in the mouse) may play a critical role in the development of axonal neuropathies resulting from impaired axonal transport.

It is appreciated that the abovementioned animal model for ATSV is acknowledged by those skilled in the art as a scientifically valid animal model, as can be further appreciated from the publications sited hereinbelow.

Full details of the abovementioned studies are described in the following publications, the disclosure of which are hereby incorporated by reference:

Okada, Y.; Yamazaki, H.; Sekine-Aizawa, Y.; Hirokawa, N.: The neuron-specific kinesin superfamily protein KIF1A is a unique monomeric motor for anterograde axonal transport of synaptic vesicle precursors. Cell 81:769-780, 1995; and Yonekawa, Y.; Harada, A.; Okada, Y.; Funakoshi, T.; Kanai, Y.; Takei, Y.; Terada, S.; Noda, T.; Hirokawa, N.: Defect in synaptic vesicle precursor transport and neuronal cell death in.

Further studies establishing the function and utilities of ATSV are found in John Hopkins OMIM database record ID 601255, and in sited publications numbered 9473-9479 listed in the bibliography section hereinbelow, which are also hereby incorporated by reference. Fanconi Anemia, Complementation Group A (FANCA, Accession NM_000135) is another VGAM144 host target gene. FANCA BINDING SITE is HOST TARGET binding site found in the 3' untranslated region of mRNA encoded by FANCA, corresponding to a HOST TARGET binding site such as BINDING SITE I, BINDING SITE II or BINDING SITE III. Table 2 illustrates the complementarity of the nucleotide sequences of FANCA BINDING SITE, designated SEQ ID:5628, to the nucleotide sequence of VGAM144 RNA, herein designated VGAM RNA, also designated SEQ ID:2855.

Another function of VGAM144 is therefore inhibition of Fanconi Anemia, Complementation Group A (FANCA, Accession NM_000135). Accordingly, utilities of VGAM144 include diagnosis, prevention and treatment of diseases and clinical conditions associated with FANCA. Heterogeneous Nuclear Ribonucleoprotein D-like (HNRPDL, Accession NM_005463) is another VGAM144 host target gene. HNRPDL BINDING SITE is HOST TARGET binding site found in the 3' untranslated region of mRNA encoded by HNRPDL, corresponding to a HOST TARGET binding site such as BINDING SITE I, BINDING SITE II or BINDING SITE III. Table 2 illustrates the complementarity of the nucleotide sequences of HNRPDL BINDING SITE, designated SEQ ID:11952, to the nucleotide sequence of VGAM144 RNA, herein designated VGAM RNA, also designated SEQ ID:2855.

Another function of VGAM144 is therefore inhibition of Heterogeneous Nuclear Ribonucleoprotein D-like (HNRPDL, Accession NM_005463), a gene which binds to rna molecules that contain au-rich elements. Accordingly, utilities of VGAM144 include diagnosis, prevention and treatment of diseases and clinical conditions associated with HNRPDL. The function of HNRPDL has been established by previous studies. Kamei et al. (1999) identified 2 isoforms of HNRPDL, which they called JKTBP1 and JKTBP2, corresponding to the 1.4- and 2.8-kb transcripts identified by Tsuchiya et al. (1998), respectively. The larger transcript predicts a 420-amino acid protein with a calculated molecular mass of approximately 46.4 kD. The JKTBP2 protein has a longer N terminus, and both proteins contain multiple potential sites for phosphorylation and arginine methylation. Northern blot analysis showed that both transcripts were expressed in all tissues examined, although the amounts and ratios of the transcripts varied in different tissues. Three JKTBP transcripts greater than 2.8 kb were expressed in pancreas, spleen, and thymus. Western blot analysis of myeloid leukemia cells showed proteins of 38 and 53 kD. Tsuchiya et al. (1998) determined that recombinant HNRPDL interacted with both the double- and single-stranded forms of JKT41, an oligodeoxynucleotide corresponding to the cis-acting element in intron 9 of the MPO gene. Recombinant HNRPDL also interacted with poly (G) and poly (A), but not with poly (U) or poly (C). Transient expression of HNRPDL repressed expression of reporter genes located downstream of the intron 9 element of JKT41 or the intron 7 element of FERE27, another oligodeoxynucleotide corresponding to MPO.

Full details of the abovementioned studies are described in the following publications, the disclosure of which are hereby incorporated by reference:

Kamei, D.; Tsuchiya, N.; Yamazaki, M.; Meguro, H.; Yamada, M.: Two forms of expression and genomic structure of the human heterogeneous nuclear ribonucleoprotein D-like JKTBP gene (HNRPDL). Gene 228:13-22, 1999; and Tsuchiya, N.; Kamei, D.; Takano, A.; Matsui, T.; Yamada, M.: Cloning and characterization of a cDNA encoding a novel heterogeneous nuclear ribonucleoprotein-like protein and its expressio.

Further studies establishing the function and utilities of HNRPDL are found in John Hopkins OMIM database record ID 607137, and in sited publications numbered 6085-6087 listed in the bibliography section hereinbelow, which are also hereby incorporated by reference. Interleukin 13 Receptor, Alpha 1 (IL13RA1, Accession NM_001560) is another VGAM144 host target gene. IL13RA1 BINDING SITE is HOST TARGET binding site found in the 3' untranslated region of mRNA encoded by IL13RA1, corresponding to a HOST TARGET binding site such as BINDING SITE I, BINDING SITE II or BINDING SITE III. Table 2 illustrates the complementarity of the nucleotide sequences of IL13RA1 BINDING SITE, designated SEQ ID:7282, to the nucleotide sequence of VGAM144 RNA, herein designated VGAM RNA, also designated SEQ ID:2855.

Another function of VGAM144 is therefore inhibition of Interleukin 13 Receptor, Alpha 1 (IL13RA1, Accession NM_001560), a gene which binds il-13 with a low affinity. together with il-4r- alpha can form a functional receptor for il-13. Accordingly, utilities of VGAM144 include diagnosis, prevention and treatment of diseases and clinical conditions associated with IL13RA1. The function of IL13RA1 has been established by previous studies. Interleukin-4 (IL4; 147780) and interleukin-13 (IL13; 147683) are 2 cytokines that are secreted by activated T cells and have similar effects on monocytes and B cells. Zurawski et al. (1993) demonstrated that the IL4 receptor (OMIM Ref. No. 147781) is a complex of at least 2 components. They described a mutant form of human IL4 that competitively antagonizes both human IL4 and human IL13. The amino acid sequences of IL4 and IL13 are approximately 30% homologous, and circular dichroism spectroscopy demonstrates that both proteins have a highly alpha-helical structure. IL13 competitively inhibited binding of IL4 to functional human IL4 receptors expressed on a cell line that responds to both IL4 and IL13. The binding of IL4 to an IL4-responsive cell line that does not respond to IL13, and the binding of IL4 to cloned IL4R ligand binding protein expressed on heterologous cells, were not inhibited by IL13. The results demonstrated that IL4 and IL13 share a receptor component that is important for signal transduction. Hilton et al. (1996) reviewed these and other data suggesting a model of IL4 and IL13 receptor composition and function Heinzmann et al. (2000) determined that a variant of human IL13 (OMIM Ref. No. 147683), arg110 to gln (OMIM Ref. No. A4464G), associated with asthma in case-control populations from Britain and Japan (peak odds ratio (OR)=2.31, 95% confidence interval, 1.33-4.00); the variant also predicted asthma and higher serum IL13 levels in a general, Japanese pediatric population. The authors referred to this variant as gln110 to arg. Immunohistochemistry demonstrated that both subunits of IL13R are prominently expressed in bronchial epithelium and smooth muscle from asthmatic subjects. Detailed molecular modeling analyses indicated that residue 110 of IL13 is important in the internal constitution of the ligand and crucial in ligand-receptor interaction. A noncoding variant of IL13R-alpha 1, 1398A-G, associated primarily with high IgE levels (OR=3.38 in males, 1.10 in females) rather than asthma Full details of the abovementioned studies are described in the following publications, the disclosure of which are hereby incorporated by reference:

Hilton, D. J.; Zhang, J.-G.; Metcalf, D.; Alexander, W. S.; Nicola, N. A.; Willson, T. A.: Cloning and characterization of a binding subunit of the interleukin 13 receptor that is also a component of the interleukin 4 receptor. Proc. Nat. Acad. Sci. 93:497-501, 1996; and Heinzmann, H.; Mao, X.-Q.; Akaiwa, M.; Kreomer, R. T.; Gao, P.-S.; Ohshima, K.; Umeshita, R.; Abe, Y.; Braun, S.; Yamashita, T.; Roberts, M. H.; Sugimoto, R.; and 20 others: Genetic var.

Further studies establishing the function and utilities of IL13RA1 are found in John Hopkins OMIM database record ID 300119, and in sited publications numbered 10630-10631, 687, 1063 and 11592 listed in the bibliography section hereinbelow, which are also hereby incorporated by reference. Interleukin 1 Receptor Accessory Protein (IL1RAP, Accession NM_002182) is another VGAM144 host target gene. IL1RAP BINDING SITE is HOST TARGET binding site found in the 3' untranslated region of mRNA encoded by IL1RAP, corresponding to a HOST TARGET binding site such as BINDING SITE I, BINDING SITE II or BINDING SITE III. Table 2 illustrates the complementarity of the nucleotide sequences of IL1RAP BINDING SITE, designated SEQ ID:7940, to the nucleotide sequence of VGAM144 RNA, herein designated VGAM RNA, also designated SEQ ID:2855.

Another function of VGAM144 is therefore inhibition of Interleukin 1 Receptor Accessory Protein (IL1RAP, Accession NM_002182), a gene which may function as a membrane receptor. promotes heterophilic cellular adhesion. Accordingly, utilities of VGAM144 include diagnosis, prevention and treatment of diseases and clinical conditions associated with IL1RAP. The function of IL1RAP and its association with various diseases and clinical conditions, has been established by previous studies, as described hereinabove with reference to VGAM142. Kelch-like 3 (Drosophila) (KLHL3, Accession XM_113450) is another VGAM144 host target gene. KLHL3 BINDING SITE is HOST TARGET binding site found in the 3' untranslated region of mRNA encoded by KLHL3, corresponding to a HOST TARGET binding site such as BINDING SITE I, BINDING SITE II or BINDING SITE III. Table 2 illustrates the complementarity of the nucleotide sequences of KLHL3 BINDING SITE, designated SEQ ID:42271, to the nucleotide sequence of VGAM144 RNA, herein designated VGAM RNA, also designated SEQ ID:2855.

Another function of VGAM144 is therefore inhibition of Kelch-like 3 (Drosophila) (KLHL3, Accession XM_113450). Accordingly, utilities of VGAM144 include diagnosis, prevention and treatment of diseases and clinical conditions associated with KLHL3. Methionine Adenosyltransferase I, Alpha (MAT1A, Accession XM_165540) is another VGAM144 host target gene. MAT1A BINDING SITE is HOST TARGET binding site found in the 3' untranslated region of mRNA encoded by MAT1A, corresponding to a HOST TARGET binding site such as BINDING SITE I, BINDING SITE II or BINDING SITE III. Table 2 illustrates the complementarity of the nucleotide sequences of MAT1A BINDING SITE, designated SEQ ID:43666, to the nucleotide sequence of VGAM144 RNA, herein designated VGAM RNA, also designated SEQ ID:2855.

Another function of VGAM144 is therefore inhibition of Methionine Adenosyltransferase I, Alpha (MAT1A, Accession XM_165540). Accordingly, utilities of VGAM144 include diagnosis, prevention and treatment of diseases and clinical conditions associated with MAT1A. N-myc Downstream Regulated Gene 1 (NDRG1, Accession XM_005243) is another VGAM144 host target gene. NDRG1 BINDING SITE is HOST TARGET binding site found in the 3' untranslated region of mRNA encoded by NDRG1, corresponding to a HOST TARGET binding site such as BINDING SITE I, BINDING SITE II or BINDING SITE III. Table 2 illustrates the complementarity of the nucleotide sequences of NDRG1 BINDING SITE, designated SEQ ID:29965, to the nucleotide sequence of VGAM144 RNA, herein designated VGAM RNA, also designated SEQ ID:2855.

Another function of VGAM144 is therefore inhibition of N-myc Downstream Regulated Gene 1 (NDRG1, Accession XM_005243), a gene which may have a growth inhibitory role. Accordingly, utilities of VGAM144 include diagnosis, prevention and treatment of diseases and clinical conditions associated with NDRG1. The function of NDRG1 has been established by previous studies. Using mRNA differential display analysis to compare expression in cells cultured in the presence of 1% or 20% oxygen, Park et al. (2000) determined that NDRG1, which they called PROXY1, is markedly upregulated in hypoxic cells. Northern and Western blot analyses showed that the 43-kD NDRG1 protein has a longer half-life than does the mRNA transcript and that the upregulation occurs through a heme protein-dependent pathway. Autosomal recessive peripheral neuropathies are relatively rare but are clinically more severe than autosomal dominant forms of Charcot-Marie-Tooth disease (CMT). The Lom form of hereditary motor and sensory neuropathy (HMSNL; 601455), or CMT4D, is one such disorder. HMSNL shows features of Schwann cell dysfunction and a concomitant early axonal involvement, suggesting that impaired axon-glia interactions play a major role in its pathogenesis. Kalaydjieva et al. (1996) mapped the disease gene to 8q24.3, where closely related disease haplotypes and strong linkage disequilibrium suggested a single founder mutation. Kalaydjieva et al. (2000) reduced the HSMNL interval to 200 kb and characterized it by means of large-scale genomic sequencing. Sequence analysis of 2 genes located in the critical region, NDRG1 and WISP1 (OMIM Ref. No. 603398), identified the founder HMSNL mutation, a nonsense arg148-to-ter mutation (605262.0001) in the NDRG1 gene.

Full details of the abovementioned studies are described in the following publications, the disclosure of which are hereby incorporated by reference:

Kalaydjieva, L.; Gresham, D.; Gooding, R.; Heather, L.; Baas, F.; de Jonge, R.; Blechschmidt, K.; Angelicheva, D.; Chandler, D.; Worsley, P.; Rosenthal, A.; King, R. H. M.; Thomas, P. K.: N-myc downstream-regulated gene 1 is mutated in hereditary motor and sensory neuropathy-Lom. Am. J. Hum. Genet. 67:47-58, 2000; and Park, H,; Adams, M. A.; Lachat, P.; Bosman, F.; Pang, S. C.; Graham, C. H.: Hypoxia induces the expression of a 43-kDa protein (PROXY-1) in normal and malignant cells. Biochem. Bioph.

Further studies establishing the function and utilities of NDRG1 are found in John Hopkins OMIM database record ID 605262, and in sited publications numbered 1353-135 and 2318-2322 listed in the bibliography section hereinbelow, which are also hereby incorporated by reference. Solute Carrier Family 7 (cationic amino acid transporter, y+ system), Member 6 (SLC7A6, Accession NM_003983) is another VGAM144 host target gene. SLC7A6 BINDING SITE is HOST TARGET binding site found in the 3' untranslated region of mRNA encoded by SLC7A6, corresponding to a HOST TARGET binding site such as BINDING SITE I, BINDING SITE II or BINDING SITE III. Table 2 illustrates the complementarity of the nucleotide sequences of SLC7A6 BINDING SITE, designated SEQ ID:10126, to the nucleotide sequence of VGAM144 RNA, herein designated VGAM RNA, also designated SEQ ID:2855.

Another function of VGAM144 is therefore inhibition of Solute Carrier Family 7 (cationic amino acid transporter, y+ system), Member 6 (SLC7A6, Accession NM_003983), a gene which is involved in mediating amino acid transport. Accordingly, utilities of VGAM144 include diagnosis, prevention and treatment of diseases and clinical conditions associated with SLC7A6. The function of SLC7A6 and its association with various diseases and clinical conditions, has been established by previous studies, as described hereinabove with reference to VGAM87. Transgelin 2 (TAGLN2, Accession NM_003564) is another VGAM144 host target gene. TAGLN2 BINDING SITE is HOST TARGET binding site found in the 3' untranslated region of mRNA encoded by TAGLN2, corresponding to a HOST TARGET binding site such as BINDING SITE I, BINDING SITE II or BINDING SITE III. Table 2 illustrates the complementarity of the nucleotide sequences of TAGLN2 BINDING SITE, designated SEQ ID:9620, to the nucleotide sequence of VGAM144 RNA, herein designated VGAM RNA, also designated SEQ ID:2855.

Another function of VGAM144 is therefore inhibition of Transgelin 2 (TAGLN2, Accession NM_003564), a gene which is similar to transgelins and may be an actin-binding proteins. Accordingly, utilities of VGAM144 include diagnosis, prevention and treatment of diseases and clinical conditions associated with TAGLN2. The function of TAGLN2 has been established by previous studies. By sequencing cDNAs randomly selected from a cDNA library derived from a human immature myeloid cell line, Nagase et al. (1995) isolated a cDNA encoding TAGLN2, which they called KIAA0120. The deduced 199-amino acid TAGLN2 protein shares 69.7% amino acid sequence identity with rat neuronal protein NP25 over 195 amino acids. Northern blot analysis detected TAGLN2 expression in all 16 human tissues examined, with high expression in lung, liver, kidney, spleen, thymus, small intestine, colon, prostate, testis, ovary, placenta, and peripheral blood leukocytes, lower expression in skeletal muscle, pancreas, and heart, and lowest expression in brain. Using a somatic cell hybrid mapping panel, Nagase et al. (1995) determined that the TAGLN2 gene maps to either chromosome 1 or 8. Stanier et al. (1998) noted that an EST cluster representing the TAGLN2 gene had been mapped to 1q21-q25. By linkage analysis, Stanier et al. (1998) mapped the mouse Tagln2 gene to distal chromosome 1, between the Fcgr2 gene (OMIM Ref. No. 146790) and marker D1Mit149. Distal mouse chromosome 1 shows homology of synteny with human 1q21-q25.

Full details of the abovementioned studies are described in the following publications, the disclosure of which are hereby incorporated by reference:

Nagase, T.; Miyajima, N.; Tanaka, A.; Sazuka, T.; Seki, N.; Sato, S.; Tabata, S.; Ishikawa, K.; Kawarabayasi, Y.; Kotani, H.; Nomura, N.: Prediction of the coding sequences of unidentified human genes. III. The coding sequences of 40 new genes (KIAA0081-KIAA0120) deduced by analysis of cDNA clones from human cell line KG-1. DNA Res. 2:37-43, 1995; and Stanier, P.; Abu-Hayyeh, S.; Murdoch, J. N.; Eddleston, J.; Copp, A. J.: Paralogous Sm22-alpha (Tagln) genes map to mouse chromosomes 1 and 9: further evidence for a paralogous relatio.

Further studies establishing the function and utilities of TAGLN2 are found in John Hopkins OMIM database record ID 604634, and in sited publications numbered 108 and 7526 listed in the bibliography section hereinbelow, which are also hereby incorporated by reference. Transcription Factor 3 (E2A immunoglobulin enhancer binding factors E12/E47) (TCF3, Accession XM_047600) is another VGAM144 host target gene. TCF3 BINDING SITE is HOST TARGET binding site found in the 3' untranslated region of mRNA encoded by TCF3, corresponding to a HOST TARGET binding site such as BINDING SITE I, BINDING SITE II or BINDING SITE III. Table 2 illustrates the complementarity of the nucleotide sequences of TCF3 BINDING SITE, designated SEQ ID:35005, to the nucleotide sequence of VGAM144 RNA, herein designated VGAM RNA, also designated SEQ ID:2855.

Another function of VGAM144 is therefore inhibition of Transcription Factor 3 (E2A immunoglobulin enhancer binding factors E12/E47) (TCF3, Accession XM_047600), a gene which plays major roles in determining tissue-specific cell fate during embryogenesis. Accordingly, utilities of VGAM144 include diagnosis, prevention and treatment of diseases and clinical conditions associated with TCF3. The function of TCF3 has been established by previous studies. Expression of immunoglobulin genes depends on various sequence motifs in their enhancer and promoter regions. One class of such sequences is the ‘E boxes,’ which are found in both heavy and light chain enhancers. The kappa-E2 site has been shown to be important for light chain gene transcription. Studies have demonstrated that E boxes are binding sites for proteins. To isolate cDNAs encoding kappa-E2-binding proteins, Murre et al. (1989) screened a cDNA expression library derived from a human B-cell lymphoma cell line (BJAB) with an oligonucleotide containing a trimerized kappa-E2 site. They identified a partial cDNA encoding a protein that they designated E12. Using the E12 cDNA to rescreen the BJAB cDNA library, Murre et al. (1989) isolated a partial cDNA encoding a protein that they designated E47. The authors showed that both E12 and E47 bind specifically to the kappa-E2 sequence. They demonstrated that E47 binds kappa-E2 as a dimer in vitro. Sequence analysis suggested that E12 and E47 are derived from a single gene, called E2A or TCF3, via alternative splicing. E12 contains a leucine zipper; the corresponding region of E47 was not cloned. Both the E12 and E47 proteins contain a region that is homologous to regions in MYOD (OMIM Ref. No. 159970), members of the MYC family (e.g., 190080), the Drosophila 'daughterless' gene product, and products of the Drosophila 'achaete-scute' and 'twist' gene families. The homologous regions have the potential to form 2 amphipathic helices separated by an intervening loop. The hydrophobic residues present in the helices are highly conserved. The authors demonstrated that this helix-loop-helix motif plays a crucial role in both dimerization and DNA binding. Animal model experiments lend further support to the function of TCF3. Heterodimers between tissue-specific basic helix-loop-helix (bHLH) proteins and the products of the E2A gene play major roles in determining tissue-specific cell fate. The E2A gene gives rise to 2 proteins, E12 and E47, by differential splicing of E12- and E47-specific bHLH-encoding exons. Although they were initially identified in B cells as immunoglobulin enhancer-binding proteins, they were subsequently found to be present in most cell types. To understand the broad role of E2A in development, Zhuang et al. (1994) generated E2A mutant mice following homologous recombination in embryonic stem cells. Homozygous mutant mice developed to full term without apparent abnormalities, but then displayed a high rate of postnatal death. The surviving mice showed retarded postnatal growth. Detailed examination of hematopoiesis revealed that the homozygous mutant mice contained no B cells, whereas other lineages, including the T cell, granulocyte, macrophage, and erythroid lineages, were intact. The block to B-cell differentiation occurred before the immunoglobulin gene D(H)-J(H) rearrangement. Surprisingly, heterozygous embryos contained, on average, about half as many B cells as did wildtype embryos, suggesting the existence of a counting mechanism that translates levels of E2A into numbers of B cells. Sun (1994) generated transgenic mice in which the Id1 gene (OMIM Ref. No. 600349) was constitutively overexpressed in the B-cell lineage. The product of this gene is an inhibitor of the DNA-binding activity of bHLH proteins such as the E2A gene product. The phenotype of these transgenic mice depicted severe defects in early B-cell development, suggesting that the bHLH proteins play pivotal roles in B-cell development and that the down regulation of Id1 gene expression is necessary for B cells to differentiate.

It is appreciated that the abovementioned animal model for TCF3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Murre, C.; McCaw, P. S.; Baltimore, D.: Cell 56:777-783, 1989; and

Sun, X.-H.: Constitutive expression of the Id1 gene impairs mouse B cell development. Cell 79:893-900, 1994.

Further studies establishing the function and utilities of TCF3 are found in John Hopkins OMIM database record ID 147141, and in sited publications numbered 11901-11903, 5203-5205, 11904-11907, 520 and 11351 listed in the bibliography section hereinbelow, which are also hereby incorporated by reference.20D7-FC4 (Accession XM_027578) is another VGAM144 host target gene. 20D7-FC4 BINDING SITE is HOST TARGET binding site found in the 3' untranslated region of mRNA encoded by 20D7-FC4, corresponding to a HOST TARGET binding site such as BINDING SITE I, BINDING SITE II or BINDING SITE III. Table 2 illustrates the complementarity of the nucleotide sequences of 20D7-FC4 BINDING SITE, designated SEQ ID:30538, to the nucleotide sequence of VGAM144 RNA, herein designated VGAM RNA, also designated SEQ ID:2855.

Another function of VGAM144 is therefore inhibition of 20D7-FC4 (Accession XM_027578). Accordingly, utilities of VGAM144 include diagnosis, prevention and treatment of diseases and clinical conditions associated with 20D7-FC4. Acetyl-Coenzyme A Synthetase 2 (ADP forming) (ACAS2, Accession NM_018677) is another VGAM144 host target gene. ACAS2 BINDING SITE1 and ACAS2 BINDING SITE2 are HOST TARGET binding sites found in untranslated regions of mRNA encoded by ACAS2, corresponding to HOST TARGET binding sites such as BINDING SITE I, BINDING SITE II or BINDING SITE III. Table 2 illustrates the complementarity of the nucleotide sequences of ACAS2 BINDING SITE1 and ACAS2 BINDING SITE2, designated SEQ ID:20751 and SEQ ID:29264 respectively, to the nucleotide sequence of VGAM144 RNA, herein designated VGAM RNA, also designated SEQ ID:2855.

Another function of VGAM144 is therefore inhibition of Acetyl-Coenzyme A Synthetase 2 (ADP forming) (ACAS2, Accession NM_018677). Accordingly, utilities of VGAM144 include diagnosis, prevention and treatment of diseases and clinical conditions associated with ACAS2. Calsyntenin 3 (CLSTN3, Accession NM_014718) is another VGAM144 host target gene. CLSTN3 BINDING SITE is HOST TARGET binding site found in the 5' untranslated region of mRNA encoded by CLSTN3, corresponding to a HOST TARGET binding site such as BINDING SITE I, BINDING SITE II or BINDING SITE III. Table 2 illustrates the complementarity of the nucleotide sequences of CLSTN3 BINDING SITE, designated SEQ ID:16273, to the nucleotide sequence of VGAM144 RNA, herein designated VGAM RNA, also designated SEQ ID:2855.

Another function of VGAM144 is therefore inhibition of Calsyntenin 3 (CLSTN3, Accession NM_014718). Accordingly, utilities of VGAM144 include diagnosis, prevention and treatment of diseases and clinical conditions associated with CLSTN3. CCR4-NOT Transcription Complex, Subunit 8 (CNOT8, Accession NM_004779) is another VGAM144 host target gene. CNOT8 BINDING SITE is HOST TARGET binding site found in the 3' untranslated region of mRNA encoded by CNOT8, corresponding to a HOST TARGET binding site such as BINDING SITE I, BINDING SITE II or BINDING SITE III. Table 2 illustrates the complementarity of the nucleotide sequences of CNOT8 BINDING SITE, designated SEQ ID:11180, to the nucleotide sequence of VGAM144 RNA, herein designated VGAM RNA, also designated SEQ ID:2855.

Another function of VGAM144 is therefore inhibition of CCR4-NOT Transcription Complex, Subunit 8 (CNOT8, Accession NM_004779). Accordingly, utilities of VGAM144 include diagnosis, prevention and treatment of diseases and clinical conditions associated with CNOT8. FBP17 (Accession XM_052666) is another VGAM144 host target gene. FBP17 BINDING SITE is HOST TARGET binding site found in the 3' untranslated region of mRNA encoded by FBP17, corresponding to a HOST TARGET binding site such as BINDING SITE I, BINDING SITE II or BINDING SITE III. Table 2 illustrates the complementarity of the nucleotide sequences of FBP17 BINDING SITE, designated SEQ ID:36047, to the nucleotide sequence of VGAM144 RNA, herein designated VGAM RNA, also designated SEQ ID:2855.

Another function of VGAM144 is therefore inhibition of FBP17 (Accession XM_052666). Accordingly, utilities of VGAM144 include diagnosis, prevention and treatment of diseases and clinical conditions associated with FBP17.

FLJ12671 (Accession NM_030980) is another VGAM144 host target gene. FLJ12671 BINDING SITE is HOST TARGET binding site found in the 3' untranslated region of mRNA encoded by FLJ12671, corresponding to a HOST TARGET binding site such as BINDING SITE I, BINDING SITE II or BINDING SITE III. Table 2 illustrates the complementarity of the nucleotide sequences of FLJ12671 BINDING SITE, designated SEQ ID:25242, to the nucleotide sequence of VGAM144 RNA, herein designated VGAM RNA, also designated SEQ ID:2855.

Another function of VGAM144 is therefore inhibition of FLJ12671 (Accession NM_030980). Accordingly, utilities of VGAM144 include diagnosis, prevention and treatment of diseases and clinical conditions associated with FLJ12671. FLJ20294 (Accession NM_017749) is another VGAM144 host target gene. FLJ20294 BINDING SITE is HOST TARGET binding site found in the 3' untranslated region of mRNA encoded by FLJ20294, corresponding to a HOST TARGET binding site such as BINDING SITE I, BINDING SITE II or BINDING SITE III. Table 2 illustrates the complementarity of the nucleotide sequences of FLJ20294 BINDING SITE, designated SEQ ID:19345, to the nucleotide sequence of VGAM144 RNA, herein designated VGAM RNA, also designated SEQ ID:2855.

Another function of VGAM144 is therefore inhibition of FLJ20294 (Accession NM_017749). Accordingly, utilities of VGAM144 include diagnosis, prevention and treatment of diseases and clinical conditions associated with FLJ20294. FLJ23510 (Accession NM_024720) is another VGAM144 host target gene. FLJ23510 BINDING SITE is HOST TARGET binding site found in the 5' untranslated region of mRNA encoded by FLJ23510, corresponding to a HOST TARGET binding site such as BINDING SITE I, BINDING SITE II or BINDING SITE III. Table 2 illustrates the complementarity of the nucleotide sequences of FLJ23510 BINDING SITE, designated SEQ ID:24051, to the nucleotide sequence of VGAM144 RNA, herein designated VGAM RNA, also designated SEQ ID:2855.

Another function of VGAM144 is therefore inhibition of FLJ23510 (Accession NM_024720). Accordingly, utilities of VGAM144 include diagnosis, prevention and treatment of diseases and clinical conditions associated with FLJ23510. Gamma-aminobutyric Acid (GABA) B Receptor, 1 (GABBR1, Accession NM_021903) is another VGAM144 host target gene. GABBR1 BINDING SITE1 and GABBR1 BINDING SITE2 are HOST TARGET binding sites found in untranslated regions of mRNA encoded by GABBR1, corresponding to HOST TARGET binding sites such as BINDING SITE I, BINDING SITE II or BINDING SITE III. Table 2 illustrates the complementarity of the nucleotide sequences of GABBR1 BINDING SITE1 and GABBR1 BINDING SITE2, designated SEQ ID:22420 and SEQ ID:7204 respectively, to the nucleotide sequence of VGAM144 RNA, herein designated VGAM RNA, also designated SEQ ID:2855.

Another function of VGAM144 is therefore inhibition of Gamma-aminobutyric Acid (GABA) B Receptor, 1 (GABBR1, Accession NM_021903). Accordingly, utilities of VGAM144 include diagnosis, prevention and treatment of diseases and clinical conditions associated with GABBR1. Golgi Associated, Gamma Adaptin Ear Containing, ARF Binding Protein 2 (GGA2, Accession NM_015044) is another VGAM144 host target gene. GGA2 BINDING SITE1 and GGA2 BINDING SITE2 are HOST TARGET binding sites found in untranslated regions of mRNA encoded by GGA2, corresponding to HOST TARGET binding sites such as BINDING SITE I, BINDING SITE II or BINDING SITE III. Table 2 illustrates the complementarity of the nucleotide sequences of GGA2 BINDING SITE1 and GGA2 BINDING SITE2, designated SEQ ID:17397 and SEQ ID:30450 respectively, to the nucleotide sequence of VGAM144 RNA, herein designated VGAM RNA, also designated SEQ ID:2855.

Another function of VGAM144 is therefore inhibition of Golgi Associated, Gamma Adaptin Ear Containing, ARF Binding Protein 2 (GGA2, Accession NM_015044). Accordingly, utilities of VGAM144 include diagnosis, prevention and treatment of diseases and clinical conditions associated with GGA2. KIAA0703 (Accession NM_014861) is another VGAM144 host target gene. KIAA0703 BINDING SITE is HOST TARGET binding site found in the 5' untranslated region of mRNA encoded by KIAA0703, corresponding to a HOST TARGET binding site such as BINDING SITE I, BINDING SITE II or BINDING SITE III. Table 2 illustrates the complementarity of the nucleotide sequences of KIAA0703 BINDING SITE, designated SEQ ID:16929, to the nucleotide sequence of VGAM144 RNA, herein designated VGAM RNA, also designated SEQ ID:2855.

Another function of VGAM144 is therefore inhibition of KIAA0703 (Accession NM_014861). Accordingly, utilities of VGAM144 include diagnosis, prevention and treatment of diseases and clinical conditions associated with KIAA0703. KIAA1872 (Accession XM_031917) is another VGAM144 host target gene. KIAA1872 BINDING SITE is HOST TARGET binding site found in the 5' untranslated region of mRNA encoded by KIAA1872, corresponding to a HOST TARGET binding site such as BINDING SITE I, BINDING SITE II or BINDING SITE III. Table 2 illustrates the complementarity of the nucleotide sequences of KIAA1872 BINDING SITE, designated SEQ ID:31517, to the nucleotide sequence of VGAM144 RNA, herein designated VGAM RNA, also designated SEQ ID:2855.

Another function of VGAM144 is therefore inhibition of KIAA1872 (Accession XM_031917). Accordingly, utilities of VGAM144 include diagnosis, prevention and treatment of diseases and clinical conditions associated with KIAA1872. LSFR2 (Accession XM_026945) is another VGAM144 host target gene. LSFR2 BINDING SITE is HOST TARGET binding site found in the 3' untranslated region of mRNA encoded by LSFR2, corresponding to a HOST TARGET binding site such as BINDING SITE I, BINDING SITE II or BINDING SITE III. Table 2 illustrates the complementarity of the nucleotide sequences of LSFR2 BINDING SITE, designated SEQ ID:30378, to the nucleotide sequence of VGAM144 RNA, herein designated VGAM RNA, also designated SEQ ID:2855.

Another function of VGAM144 is therefore inhibition of LSFR2 (Accession XM_026945). Accordingly, utilities of VGAM144 include diagnosis, prevention and treatment of diseases and clinical conditions associated with LSFR2. MGC10818 (Accession NM_030568) is another VGAM144 host target gene. MGC10818 BINDING SITE is HOST TARGET binding site found in the 3' untranslated region of mRNA encoded by MGC10818, corresponding to a HOST TARGET binding site such as BINDING SITE I, BINDING SITE II or BINDING SITE III. Table 2 illustrates the complementarity of the nucleotide sequences of MGC10818 BINDING SITE, designated SEQ ID:24939, to the nucleotide sequence of VGAM144 RNA, herein designated VGAM RNA, also designated SEQ ID:2855.

Another function of VGAM144 is therefore inhibition of MGC10818 (Accession NM_030568). Accordingly, utilities of VGAM144 include diagnosis, prevention and treatment of diseases and clinical conditions associated with MGC10818. RIP60 (Accession NM_013400) is another VGAM144 host target gene. RIP60 BINDING SITE is HOST TARGET binding site found in the 3' untranslated region of mRNA encoded by RIP60, corresponding to a HOST TARGET binding site such as BINDING SITE I, BINDING SITE II or BINDING SITE III. Table 2 illustrates the complementarity of the nucleotide sequences of RIP60 BINDING SITE, designated SEQ ID:15059, to the nucleotide sequence of VGAM144 RNA, herein designated VGAM RNA, also designated SEQ ID:2855.

Another function of VGAM144 is therefore inhibition of RIP60 (Accession NM_013400). Accordingly, utilities of VGAM144 include diagnosis, prevention and treatment of diseases and clinical conditions associated with RIP60. LOC122786 (Accession XM_058660) is another VGAM144 host target gene. LOC122786 BINDING SITE is HOST TARGET binding site found in the 3' untranslated region of mRNA encoded by LOC122786, corresponding to a HOST TARGET binding site such as BINDING SITE I, BINDING SITE II or BINDING SITE III. Table 2 illustrates the complementarity of the nucleotide sequences of LOC122786 BINDING SITE, designated SEQ ID:36699, to the nucleotide sequence of VGAM144 RNA, herein designated VGAM RNA, also designated SEQ ID:2855.

Another function of VGAM144 is therefore inhibition of LOC122786 (Accession XM_058660). Accordingly, utilities of VGAM144 include diagnosis, prevention and treatment of diseases and clinical conditions associated with LOC122786. LOC147136 (Accession XM_085716) is another VGAM144 host target gene. LOC147136 BINDING SITE is HOST TARGET binding site found in the 5' untranslated region of mRNA encoded by LOC147136, corresponding to a HOST TARGET binding site such as BINDING SITE I, BINDING SITE II or BINDING SITE III. Table 2 illustrates the complementarity of the nucleotide sequences of LOC147136 BINDING SITE, designated SEQ ID:38299, to the nucleotide sequence of VGAM144 RNA, herein designated VGAM RNA, also designated SEQ ID:2855.

Another function of VGAM144 is therefore inhibition of LOC147136 (Accession XM_085716). Accordingly, utilities of VGAM144 include diagnosis, prevention and treatment of diseases and clinical conditions associated with LOC147136. LOC158267 (Accession XM_088528) is another VGAM144 host target gene. LOC158267 BINDING SITE is HOST TARGET binding site found in the 3' untranslated region of mRNA encoded by LOC158267, corresponding to a HOST TARGET binding site such as BINDING SITE I, BINDING SITE II or BINDING SITE III. Table 2 illustrates the complementarity of the nucleotide sequences of LOC158267 BINDING SITE, designated SEQ ID:39792, to the nucleotide sequence of VGAM144 RNA, herein designated VGAM RNA, also designated SEQ ID:2855.

Another function of VGAM144 is therefore inhibition of LOC158267 (Accession XM_088528). Accordingly, utilities of VGAM144 include diagnosis, prevention and treatment of diseases and clinical conditions associated with LOC158267. LOC164714 (Accession XM_104657) is another VGAM144 host target gene. LOC164714 BINDING SITE is HOST TARGET binding site found in the 5' untranslated region of mRNA encoded by LOC164714, corresponding to a HOST TARGET binding site such as BINDING SITE I, BINDING SITE II or BINDING SITE III. Table 2 illustrates the complementarity of the nucleotide sequences of LOC164714 BINDING SITE, designated SEQ ID:42174, to the nucleotide sequence of VGAM144 RNA, herein designated VGAM RNA, also designated SEQ ID:2855.

Another function of VGAM144 is therefore inhibition of LOC164714 (Accession XM_104657). Accordingly, utilities of VGAM144 include diagnosis, prevention and treatment of diseases and clinical conditions associated with LOC164714. LOC199796 (Accession XM_058994) is another VGAM144 host target gene. LOC199796 BINDING SITE is HOST TARGET binding site found in the 5' untranslated region of mRNA encoded by LOC199796, corresponding to a HOST TARGET binding site such as BINDING SITE I, BINDING SITE II or BINDING SITE III. Table 2 illustrates the complementarity of the nucleotide sequences of LOC199796 BINDING SITE, designated SEQ ID:36808, to the nucleotide sequence of VGAM144 RNA, herein designated VGAM RNA, also designated SEQ ID:2855.

Another function of VGAM144 is therefore inhibition of LOC199796 (Accession XM_058994). Accordingly, utilities of VGAM144 include diagnosis, prevention and treatment of diseases and clinical conditions associated with LOC199796. LOC220522 (Accession XM_018306) is another VGAM144 host target gene. LOC220522 BINDING SITE is HOST TARGET binding site found in the 3' untranslated region of mRNA encoded by LOC220522, corresponding to a HOST TARGET binding site such as BINDING SITE I, BINDING SITE II or BINDING SITE III. Table 2 illustrates the complementarity of the nucleotide sequences of LOC220522 BINDING SITE, designated SEQ ID:30353, to the nucleotide sequence of VGAM144 RNA, herein designated VGAM RNA, also designated SEQ ID:2855.

Another function of VGAM144 is therefore inhibition of LOC220522 (Accession XM_018306). Accordingly, utilities of VGAM144 include diagnosis, prevention and treatment of diseases and clinical conditions associated with LOC220522. LOC222031 (Accession XM_168371) is another VGAM144 host target gene. LOC222031 BINDING SITE is HOST TARGET binding site found in the 3' untranslated region of mRNA encoded by LOC222031, corresponding to a HOST TARGET binding site such as BINDING SITE I, BINDING SITE II or BINDING SITE III. Table 2 illustrates the complementarity of the nucleotide sequences of LOC222031 BINDING SITE, designated SEQ ID:45134, to the nucleotide sequence of VGAM144 RNA, herein designated VGAM RNA, also designated SEQ ID:2855.

Another function of VGAM144 is therefore inhibition of LOC222031 (Accession XM_168371). Accordingly, utilities of VGAM144 include diagnosis, prevention and treatment of diseases and clinical conditions associated with LOC222031. LOC253573 (Accession XM_173110) is another VGAM144 host target gene. LOC253573 BINDING SITE is HOST TARGET binding site found in the 3' untranslated region of mRNA encoded by LOC253573, corresponding to a HOST TARGET binding site such as BINDING SITE I, BINDING SITE II or BINDING SITE III. Table 2 illustrates the complementarity of the nucleotide sequences of LOC253573 BINDING SITE, designated SEQ ID:46365, to the nucleotide sequence of VGAM144 RNA, herein designated VGAM RNA, also designated SEQ ID:2855.

Another function of VGAM144 is therefore inhibition of LOC253573 (Accession XM_173110). Accordingly, utilities of VGAM144 include diagnosis, prevention and treatment of diseases and clinical conditions associated with LOC253573. LOC91380 (Accession XM_038134) is another VGAM144 host target gene. LOC91380 BINDING SITE is HOST TARGET binding site found in the 3' untranslated region of mRNA encoded by LOC91380, corresponding to a HOST TARGET binding site such as BINDING SITE I, BINDING SITE II or BINDING SITE III. Table 2 illustrates the complementarity of the nucleotide sequences of LOC91380 BINDING SITE, designated SEQ ID:32755, to the nucleotide sequence of VGAM144 RNA, herein designated VGAM RNA, also designated SEQ ID:2855.

Another function of VGAM144 is therefore inhibition of LOC91380 (Accession XM_038134). Accordingly, utilities of VGAM144 include diagnosis, prevention and treatment of diseases and clinical conditions associated with LOC91380. FIG. 1 further provides a conceptual description of a novel bioinformatically detected viral gene of the present invention, referred to here as Viral Genomic Address Messenger 145 (VGAM145) viral gene, which modulates expression of respective host target genes thereof, the function and utility of which host target genes is known in the art.

VGAM145 is a novel bioinformatically detected regulatory, non protein coding, viral micro RNA (miRNA) gene. The method by which VGAM145 was detected is described hereinabove with reference to FIGS. 1-8.

VGAM145 gene, herein designated VGAM GENE, is a viral gene contained in the genome of Shrimp White Spot Syndrome Virus (white spot bacilliform virus). VGAM145 host target gene, herein designated VGAM HOST TARGET GENE, is a human gene contained in the human genome.

VGAM145 gene encodes a VGAM145 precursor RNA, herein designated VGAM PRECURSOR RNA. Similar to other miRNA genes, and unlike most ordinary genes, VGAM145 precursor RNA does not encode a protein. A nucleotide sequence identical or highly similar to the nucleotide sequence of VGAM145 precursor RNA is designated SEQ ID:131, and is provided hereinbelow with reference to the sequence listing part. Nucleotide sequence SEQ ID:131 is located at position 279445 relative to the genome of Shrimp White Spot Syndrome Virus (white spot bacilliform virus).

VGAM145 precursor RNA folds onto itself, forming VGAM145 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM145 folded precursor RNA into VGAM145 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM145 RNA is designated SEQ ID:2856, and is provided hereinbelow with reference to the sequence listing part.

VGAM145 host target gene, herein designated VGAM HOST TARGET GENE, encodes a corresponding messenger RNA, VGAM145 host target RNA, herein designated VGAM HOST TARGET RNA. VGAM145 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM145 RNA, herein designated VGAM RNA, binds complementarily to one or more host target binding sites located in untranslated regions of VGAM145 host target RNA, herein designated VGAM HOST TARGET RNA. This complementary binding is due to the fact that the nucleotide sequence of VGAM145 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM145 RNA, herein designated VGAM RNA, may have a different number of host target binding sites in untranslated regions of a VGAM145 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM145 RNA, herein designated VGAM RNA, to host target binding sites on VGAM145 host target RNA, herein designated VGAM HOST TARGET RNA, such as BINDING SITE I, BINDING SITE II and BINDING SITE III, inhibits translation of VGAM145 host target RNA into VGAM145 host target protein, herein designated VGAM HOST TARGET PROTEIN. VGAM host target protein is therefore outlined by a broken line.

It is appreciated that VGAM145 host target gene, herein designated VGAM HOST TARGET GENE, in fact represents a plurality of VGAM145 host target genes. The mRNA of each one of this plurality of VGAM145 host target genes comprises one or more host target binding sites, each having a nucleotide sequence which is at least partly complementary to VGAM145 RNA, herein designated VGAM RNA, and which when bound by VGAM145 RNA causes inhibition of translation of respective one or more VGAM145 host target proteins.

It is further appreciated by one skilled in the art that the mode of translational inhibition illustrated by FIG. 1 with specific reference to translational inhibition exerted by VGAM145 gene, herein designated VGAM GENE, on one or more VGAM145 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM145 is inhibition of expression of host target genes, as part of a novel viral mechanism of attacking a host. Accordingly, utilities of VGAM145 include diagnosis, prevention and treatment of viral infection by Shrimp White Spot Syndrome Virus (white spot bacilliform virus). Specific functions, and accordingly utilities, of VGAM145 correlate with, and may be deduced from, the identity of the host target genes which VGAM145 binds and inhibits, and the function of these host target genes, as elaborated hereinbelow.

Nucleotide sequences of the VGAM145 precursor RNA, herein designated VGAM PRECURSOR RNA, and of the 'diced' VGAM145 RNA, herein designated VGAM RNA, and a schematic representation of the secondary folding of VGAM145 folded precursor RNA, herein designated VGAM FOLDED PRECURSOR RNA, of VGAM145 are further described hereinbelow with reference to Table 1.

Nucleotide sequences of host target binding sites, such as BINDING SITE-I, BINDING SITE-II and BINDING SITE-III of FIG. 1, found on VGAM145 host target RNA, and schematic representation of the complementarity of each of these host target binding sites to VGAM145 RNA, herein designated VGAM RNA, are described hereinbelow with reference to Table 2.

As mentioned hereinabove with reference to FIG. 1, a function of VGAM145 gene, herein designated VGAM is inhibition of expression of VGAM145 target genes. It is appreciated that specific functions, and accordingly utilities, of VGAM145 correlate with, and may be deduced from, the identity of the target genes which VGAM145 binds and inhibits, and the function of these target genes, as elaborated hereinbelow.

Caspase 8, Apoptosis-related Cysteine Protease (CASP8, Accession NM_001228) is a VGAM145 host target gene. CASP8 BINDING SITE1 through CASP8 BINDING SITE4 are HOST TARGET binding sites found in untranslated regions of mRNA encoded by CASP8, corresponding to HOST TARGET binding sites such as BINDING SITE I, BINDING SITE II or BINDING SITE III. Table 2 illustrates the complementarity of the nucleotide sequences of CASP8 BINDING SITE1 through CASP8 BINDING SITE4, designated SEQ ID:6896, SEQ ID:27201, SEQ ID:27203 and SEQ ID:27204 respectively, to the nucleotide sequence of VGAM145 RNA, herein designated VGAM RNA, also designated SEQ ID:2856.

A function of VGAM145 is therefore inhibition of Caspase 8, Apoptosis-related Cysteine Protease (CASP8, Accession NM_001228), a gene which is an apoptosis-related caspase and an upstream component of Fas receptor and tumor necrosis factor (TNF) receptor-induced apoptosis. Accordingly, utilities of VGAM145 include diagnosis, prevention and treatment of diseases and clinical conditions associated with CASP8. The function of CASP8 has been established by previous studies. Expression of cDNAs that encode truncated polypeptides containing mostly expanded polyglutamine repeats, but not of those that encode the corresponding full-length proteins, has been shown to induce cell death by apoptosis. Such truncated proteins have been shown to form aggregates or inclusions (Ikeda et al., 1996). Sanchez et al. (1999) studied the role of caspases in polyglutamine-induced cell death in established cultures of primary cortical, striatal, and cerebellar neurons from embryonic day 17 rat embryos, transfected with an expression construct encoding truncated ataxin-3 that contained 79 glutamine (Q79) residues. The authors showed that the apoptosis inhibitors Bcl2, CrmA, and a truncated Fas/APO1-associated death domain protein (FADD DN) inhibited polyglutamine repeat-induced neuronal cell death. A mutant Jurkat cell line specifically lacking caspase-8 was resistant to polyglutamine-induced cell death. Cells transfected with Q79 showed insoluble inclusions. Caspase-8 was recruited and activated by these Q79 inclusions. Western blot analysis revealed the presence of activated caspase-8 in the insoluble fraction of affected brain regions from Huntington disease (OMIM Ref. No. 143100) patients but not in those from controls. The authors suggested that caspase-8 has an essential role in Huntington-related neurodegenerative diseases. Animal model experiments lend further support to the function of CASP8. Varfolomeev et al. (1998) generated mice deficient in Casp8 by disrupting exons 1 and 2, which encode the N-terminal death effector domains (DEDs) that interact with MORT1/FADD (OMIM Ref. No. 602457). Whereas wildtype and heterozygous mice appeared normal, no homozygous mutant mice survived beyond approximately embryonic day 13.5. Histopathologic analysis revealed marked abdominal hyperemia with erythrocytosis in the liver, major blood vessels, capillaries, and other organs. Cardiac ventricular musculature was thin and similar to early mesenchyme. Colony forming assays showed that hemopoietic precursor cells were markedly reduced in the mutant mice. Immunoprecipitation and Western blot analysis indicated that fibroblasts from mutant mice responded normally to the noncytocidal effects of tumor necrosis factor receptor (TNFR; 191190) and death receptor-3 (DR3, or TNFRSF12; 603366) stimulation, whereas wildtype fibroblasts were killed by TNF (OMIM Ref. No. 191160) treatment or FAS (TNFRSF6; 134637) cross-linking. Agents such as ultraviolet irradiation and protein kinase inhibitors were lethal for mutant and normal fibroblasts. Varfolomeev et al. (1998) concluded that CASP8 is necessary for death induction by receptors of the TNF/nerve growth factor (see OMIM Ref. No. NGFR; 162010) family and is vital in embryonal development.

It is appreciated that the abovementioned animal model for CASP8 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sanchez, I.; Xu, C.-J.; Juo, P.; Kakizaka, A.; Blenis, J.; Yuan, J.: Caspase-8 is required for cell death induced by expanded polyglutamine repeats. Neuron 22:623-633, 1999; and Varfolomeev, E. E.; Schuchmann, M.; Luria, V.; Chiannilkulchai, N.; Beckmann, J. S.; Mett, I. L.; Rebrikov, D.; Brodianski, V. M.; Kemper, O. C.; Kollet, O.; Lapidot, T.; Soffer, D.; So.

Further studies establishing the function and utilities of CASP8 are found in John Hopkins OMIM database record ID 601763, and in sited publications numbered 6718, 7119, 1127 and 12074-6722 listed in the bibliography section hereinbelow, which are also hereby incorporated by reference. ARNTL2 (Accession NM_020183) is another VGAM145 host target gene. ARNTL2 BINDING SITE is HOST TARGET binding site found in the 3' untranslated region of mRNA encoded by ARNTL2, corresponding to a HOST TARGET binding site such as BINDING SITE I, BINDING SITE II or BINDING SITE III. Table 2 illustrates the complementarity of the nucleotide sequences of ARNTL2 BINDING SITE, designated SEQ ID:21411, to the nucleotide sequence of VGAM145 RNA, herein designated VGAM RNA, also designated SEQ ID:2856.

Another function of VGAM145 is therefore inhibition of ARNTL2 (Accession NM_020183). Accordingly, utilities of VGAM145 include diagnosis, prevention and treatment of diseases and clinical conditions associated with ARNTL2. SEC24 Related Gene Family, Member B (S. cerevisiae) (SEC24B, Accession NM_006323) is another VGAM145 host target gene. SEC24B BINDING SITE is HOST TARGET binding site found in the 3' untranslated region of mRNA encoded by SEC24B, corresponding to a HOST TARGET binding site such as BINDING SITE I, BINDING SITE II or BINDING SITE III. Table 2 illustrates the complementarity of the nucleotide sequences of SEC24B BINDING SITE, designated SEQ ID:13016, to the nucleotide sequence of VGAM145 RNA, herein designated VGAM RNA, also designated SEQ ID:2856.

Another function of VGAM145 is therefore inhibition of SEC24 Related Gene Family, Member B (S. cerevisiae) (SEC24B, Accession NM_006323). Accordingly, utilities of VGAM145 include diagnosis, prevention and treatment of diseases and clinical conditions associated with SEC24B. LOC138639 (Accession XM_059988) is another VGAM145 host target gene. LOC138639 BINDING SITE is HOST TARGET binding site found in the 5' untranslated region of mRNA encoded by LOC138639, corresponding to a HOST TARGET binding site such as BINDING SITE I, BINDING SITE II or BINDING SITE III. Table 2 illustrates the complementarity of the nucleotide sequences of LOC138639 BINDING SITE, designated SEQ ID:37139, to the nucleotide sequence of VGAM145 RNA, herein designated VGAM RNA, also designated SEQ ID:2856.

Another function of VGAM145 is therefore inhibition of LOC138639 (Accession XM_059988). Accordingly, utilities of VGAM145 include diagnosis, prevention and treatment of diseases and clinical conditions associated with LOC138639. FIG. 1 further provides a conceptual description of a novel bioinformatically detected viral gene of the present invention, referred to here as Viral Genomic Address Messenger 146 (VGAM146) viral gene, which modulates expression of respective host target genes thereof, the function and utility of which host target genes is known in the art.

VGAM146 is a novel bioinformatically detected regulatory, non protein coding, viral micro RNA (miRNA) gene. The method by which VGAM146 was detected is described hereinabove with reference to FIGS. 1-8.

VGAM146 gene, herein designated VGAM GENE, is a viral gene contained in the genome of Shrimp White Spot Syndrome Virus (white spot baciliform virus). VGAM146 host target gene, herein designated VGAM HOST TARGET GENE, is a human gene contained in the human genome.

VGAM146 gene encodes a VGAM146 precursor RNA, herein designated VGAM PRECURSOR RNA. Similar to other miRNA genes, and unlike most ordinary genes, VGAM146 precursor RNA does not encode a protein. A nucleotide sequence identical or highly similar to the nucleotide sequence of VGAM146 precursor RNA is designated SEQ ID:132, and is provided hereinbelow with reference to the sequence listing part. Nucleotide sequence SEQ ID:132 is located at position 187726 relative to the genome of Shrimp White Spot Syndrome Virus (white spot baciliform virus).

VGAM146 precursor RNA folds onto itself, forming VGAM146 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM146 folded precursor RNA into VGAM146 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM146 RNA is designated SEQ ID:2857, and is provided hereinbelow with reference to the sequence listing part.

VGAM146 host target gene, herein designated VGAM HOST TARGET GENE, encodes a corresponding messenger RNA, VGAM146 host target RNA, herein designated VGAM HOST TARGET RNA. VGAM146 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM146 RNA, herein designated VGAM RNA, binds complementarily to one or more host target binding sites located in untranslated regions of VGAM146 host target RNA, herein designated VGAM HOST TARGET RNA. This complementary binding is due to the fact that the nucleotide sequence of VGAM146 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM146 RNA, herein designated VGAM RNA, may have a different number of host target binding sites in untranslated regions of a VGAM146 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM146 RNA, herein designated VGAM RNA, to host target binding sites on VGAM146 host target RNA, herein designated VGAM HOST TARGET RNA, such as BINDING SITE I, BINDING SITE II and BINDING SITE III, inhibits translation of VGAM146 host target RNA into VGAM146 host target protein, herein designated VGAM HOST TARGET PROTEIN. VGAM host target protein is therefore outlined by a broken line.

It is appreciated that VGAM146 host target gene, herein designated VGAM HOST TARGET GENE, in fact represents a plurality of VGAM146 host target genes. The mRNA of each one of this plurality of VGAM146 host target genes comprises one or more host target binding sites, each having a nucleotide sequence which is at least partly complementary to VGAM146 RNA, herein designated VGAM RNA, and which when bound by VGAM146 RNA causes inhibition of translation of respective one or more VGAM146 host target proteins.

It is further appreciated by one skilled in the art that the mode of translational inhibition illustrated by FIG. 1 with specific reference to translational inhibition exerted by VGAM146 gene, herein designated VGAM GENE, on one or more VGAM146 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM146 is inhibition of expression of host target genes, as part of a novel viral mechanism of attacking a host. Accordingly, utilities of VGAM146 include diagnosis, prevention and treatment of viral infection by Shrimp White Spot Syndrome Virus (white spot baciliform virus). Specific functions, and accordingly utilities, of VGAM146 correlate with, and may be deduced from, the identity of the host target genes which VGAM146 binds and inhibits, and the function of these host target genes, as elaborated hereinbelow.

Nucleotide sequences of the VGAM146 precursor RNA, herein designated VGAM PRECURSOR RNA, and of the 'diced' VGAM146 RNA, herein designated VGAM RNA, and a schematic representation of the secondary folding of VGAM146 folded precursor RNA, herein designated VGAM FOLDED PRECURSOR RNA, of VGAM146 are further described hereinbelow with reference to Table 1.

Nucleotide sequences of host target binding sites, such as BINDING SITE-I, BINDING SITE-II and BINDING SITE-III of FIG. 1, found on VGAM146 host target RNA, and schematic representation of the complementarity of each of these host target binding sites to VGAM146 RNA, herein designated VGAM RNA, are described hereinbelow with reference to Table 2.

As mentioned hereinabove with reference to FIG. 1, a function of VGAM146 gene, herein designated VGAM is inhibition of expression of VGAM146 target genes. It is appreciated that specific functions, and accordingly utilities, of VGAM146 correlate with, and may be deduced from, the identity of the target genes which VGAM146 binds and inhibits, and the function of these target genes, as elaborated hereinbelow.

Bromodomain Adjacent to Zinc Finger Domain, 2B (BAZ2B, Accession NM_013450) is a VGAM146 host target gene. BAZ2B BINDING SITE is HOST TARGET binding site found in the 5' untranslated region of mRNA encoded by BAZ2B, corresponding to a HOST TARGET binding site such as BINDING SITE I, BINDING SITE II or BINDING SITE III. Table 2 illustrates the complementarity of the nucleotide sequences of BAZ2B BINDING SITE, designated SEQ ID:15126, to the nucleotide sequence of VGAM146 RNA, herein designated VGAM RNA, also designated SEQ ID:2857.

A function of VGAM146 is therefore inhibition of Bromodomain Adjacent to Zinc Finger Domain, 2B (BAZ2B, Accession NM_013450). Accordingly, utilities of VGAM146 include diagnosis, prevention and treatment of diseases and clinical conditions associated with BAZ2B. Transient Receptor Potential Cation Channel, Subfamily V, Member 1 (TRPV1, Accession NM_080706) is another VGAM146 host target gene. TRPV1 BINDING SITE is HOST TARGET binding site found in the 5' untranslated region of mRNA encoded by TRPV1, corresponding to a HOST TARGET binding site such as BINDING SITE I, BINDING SITE II or BINDING SITE III. Table 2 illustrates the complementarity of the nucleotide sequences of TRPV1 BINDING SITE, designated SEQ ID:28012, to the nucleotide sequence of VGAM146 RNA, herein designated VGAM RNA, also designated SEQ ID:2857.

Another function of VGAM146 is therefore inhibition of Transient Receptor Potential Cation Channel, Subfamily V, Member 1 (TRPV1, Accession NM_080706), a gene which functions as a receptor for capsaicin. Accordingly, utilities of VGAM146 include diagnosis, prevention and treatment of diseases and clinical conditions associated with TRPV1. The function of TRPV1 has been established by previous studies. Chuang et al. (2001) demonstrated that bradykinin- or NGF-mediated potentiation of thermal sensitivity in vivo requires expression of VR1, a heat-activated ion channel on sensory neurons. Diminution of plasma membrane phosphatidylinositol-4,5, bisphosphate levels through antibody sequestration or PLC-mediated hydrolysis mimics the potentiating effects of bradykinin or NGF at the cellular level. Moreover, recruitment of PLC-gamma (OMIM Ref. No. 172420) to TRK-alpha (OMIM Ref. No. 191315) is essential for NGF-mediated potentiation of channel activity, and biochemical studies suggested that VR1 associates with this complex. Chuang et al. (2001) concluded that their studies delineate a biochemical mechanism through which bradykinin and NGF produce hypersensitivity and might explain how the activation of PLC signaling systems regulates other members of the TRP channel family. Animal model experiments lend further support to the function of TRPV1. Caterina et al. (2000) generated mice deficient in VR1 by targeted disruption. VR1 -/- mice were viable, fertile, and largely indistinguishable from wildtype littermates. Caterina et al. (2000) demonstrated that sensory neurons from mice lacking VR1 are severely deficient in their responses to vanilloid compounds, protons, or heat greater than 43 degrees C. VR1 -/- mice showed normal responses to noxious mechanical stimuli but exhibited no vanilloid-evoked pain behavior, were impaired in the detection of painful heat, and showed little thermal hypersensitivity in the setting of inflammation. Thus, Caterina et al. (2000) concluded that VR1 is essential for selective modalities of pain sensation and for tissue injury-induced thermal hyperalgesia.

It is appreciated that the abovementioned animal model for TRPV1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chuang, H.; Prescott, E. D.; Kong, H.; Shields, S.; Jordt, S.-E.; Basbaum, A. I.; Chao, M. V.; Julius, D.: Bradykinin and nerve growth factor release the capsaicin receptor from PtdIns (4,5)P2-mediated inhibition. Nature 411:957-962, 2001; and Caterina, M. J.; Leffler, A.; Malmberg, A. B.; Martin, W. J.; Trafton, J.; Petersen-Zeltz, K. R.; Koltzenburg, M.; Basbaum, A. I.; Julius, D.: Impaired nociception and pain sensation in m.

Further studies establishing the function and utilities of TRPV1 are found in John Hopkins OMIM database record ID 602076, and in sited publications numbered 702, 1300-1301, 2236-1304, 1547-130 and 9434 listed in the bibliography section hereinbelow, which are also hereby incorporated by reference. BNIP-S (Accession NM_138278) is another VGAM146 host target gene. BNIP-S BINDING SITE is HOST TARGET binding site found in the 5' untranslated region of mRNA encoded by BNIP-S, corresponding to a HOST TARGET binding site such as BINDING SITE I, BINDING SITE II or BINDING SITE III. Table 2 illustrates the complementarity of the nucleotide sequences of BNIP-S BINDING SITE, designated SEQ ID:28692, to the nucleotide sequence of VGAM146 RNA, herein designated VGAM RNA, also designated SEQ ID:2857.

Another function of VGAM146 is therefore inhibition of BNIP-S (Accession NM_138278). Accordingly, utilities of VGAM146 include diagnosis, prevention and treatment of diseases and clinical conditions associated with BNIP-S. FLJ10661 (Accession NM_018172) is another VGAM146 host target gene. FLJ10661 BINDING SITE is HOST TARGET binding site found in the 3' untranslated region of mRNA encoded by FLJ10661, corresponding to a HOST TARGET binding site such as BINDING SITE I, BINDING SITE II or BINDING SITE III. Table 2 illustrates the complementarity of the nucleotide sequences of FLJ10661 BINDING SITE, designated SEQ ID:19996, to the nucleotide sequence of VGAM146 RNA, herein designated VGAM RNA, also designated SEQ ID:2857.

Another function of VGAM146 is therefore inhibition of FLJ10661 (Accession NM_018172). Accordingly, utilities of VGAM146 include diagnosis, prevention and treatment of diseases and clinical conditions associated with FLJ10661. GW112 (Accession NM_006418) is another VGAM146 host target gene. GW112 BINDING SITE is HOST TARGET binding site found in the 5' untranslated region of mRNA encoded by GW112, corresponding to a HOST TARGET binding site such as BINDING SITE I, BINDING SITE II or BINDING SITE III. Table 2 illustrates the complementarity of the nucleotide sequences of GW112 BINDING SITE, designated SEQ ID:13128, to the nucleotide sequence of VGAM146 RNA, herein designated VGAM RNA, also designated SEQ ID:2857.

Another function of VGAM146 is therefore inhibition of GW112 (Accession NM_006418). Accordingly, utilities of VGAM146 include diagnosis, prevention and treatment of diseases and clinical conditions associated with GW112. MGC10812 (Accession NM_031425) is another VGAM146 host target gene. MGC10812 BINDING SITE is HOST TARGET binding site found in the 3' untranslated region of mRNA encoded by MGC10812, corresponding to a HOST TARGET binding site such as BINDING SITE I, BINDING SITE II or BINDING SITE III. Table 2 illustrates the complementarity of the nucleotide sequences of MGC10812 BINDING SITE, designated SEQ ID:25409, to the nucleotide sequence of VGAM146 RNA, herein designated VGAM RNA, also designated SEQ ID:2857.

Another function of VGAM146 is therefore inhibition of MGC10812 (Accession NM_031425). Accordingly, utilities of VGAM146 include diagnosis, prevention and treatment of diseases and clinical conditions associated with MGC10812. MGC16279 (Accession NM_032916) is another VGAM146 host target gene. MGC16279 BINDING SITE is HOST TARGET binding site found in the 3' untranslated region of mRNA encoded by MGC16279, corresponding to a HOST TARGET binding site such as BINDING SITE I, BINDING SITE II or BINDING SITE III. Table 2 illustrates the complementarity of the nucleotide sequences of MGC16279 BINDING SITE, designated SEQ ID:26731, to the nucleotide sequence of VGAM146 RNA, herein designated VGAM RNA, also designated SEQ ID:2857.

Another function of VGAM146 is therefore inhibition of MGC16279 (Accession NM_032916). Accordingly, utilities of VGAM146 include diagnosis, prevention and treatment of diseases and clinical conditions associated with MGC16279. PME-1 (Accession NM_016147) is another VGAM146 host target gene. PME-1 BINDING SITE is HOST TARGET binding site found in the 3' untranslated region of mRNA encoded by PME-1, corresponding to a HOST TARGET binding site such as BINDING SITE I, BINDING SITE II or BINDING SITE III. Table 2 illustrates the complementarity of the nucleotide sequences of PME-1 BINDING SITE, designated SEQ ID:18233, to the nucleotide sequence of VGAM146 RNA, herein designated VGAM RNA, also designated SEQ ID:2857.

Another function of VGAM146 is therefore inhibition of PME-1 (Accession NM_016147). Accordingly, utilities of VGAM146 include diagnosis, prevention and treatment of diseases and clinical conditions associated with PME-1. Solute Carrier Family 39 (zinc transporter), Member 3 (SLC39A3, Accession NM_144564) is another VGAM146 host target gene. SLC39A3 BINDING SITE is HOST TARGET binding site found in the 3' untranslated region of mRNA encoded by SLC39A3, corresponding to a HOST TARGET binding site such as BINDING SITE I, BINDING SITE II or BINDING SITE III. Table 2 illustrates the complementarity of the nucleotide sequences of SLC39A3 BINDING SITE, designated SEQ ID:29360, to the nucleotide sequence of VGAM146 RNA, herein designated VGAM RNA, also designated SEQ ID:2857.

Another function of VGAM146 is therefore inhibition of Solute Carrier Family 39 (zinc transporter), Member 3 (SLC39A3, Accession NM_144564). Accordingly, utilities of VGAM146 include diagnosis, prevention and treatment of diseases and clinical conditions associated with SLC39A3. LOC158490 (Accession XM_088585) is another VGAM146 host target gene. LOC158490 BINDING SITE is HOST TARGET binding site found in the 3' untranslated region of mRNA encoded by LOC158490, corresponding to a HOST TARGET binding site such as BINDING SITE I, BINDING SITE II or BINDING SITE III. Table 2 illustrates the complementarity of the nucleotide sequences of LOC158490 BINDING SITE, designated SEQ ID:39850, to the nucleotide sequence of VGAM146 RNA, herein designated VGAM RNA, also designated SEQ ID:2857.

Another function of VGAM146 is therefore inhibition of LOC158490 (Accession XM_088585). Accordingly, utilities of VGAM146 include diagnosis, prevention and treatment of diseases and clinical conditions associated with LOC158490. LOC220073 (Accession XM_167847) is another VGAM146 host target gene. LOC220073 BINDING SITE is HOST TARGET binding site found in the 5' untranslated region of mRNA encoded by LOC220073, corresponding to a HOST TARGET binding site such as BINDING SITE I, BINDING SITE II or BINDING SITE III. Table 2 illustrates the complementarity of the nucleotide sequences of LOC220073 BINDING SITE, designated SEQ ID:44876, to the nucleotide sequence of VGAM146 RNA, herein designated VGAM RNA, also designated SEQ ID:2857.

Another function of VGAM146 is therefore inhibition of LOC220073 (Accession XM_167847). Accordingly, utilities of VGAM146 include diagnosis, prevention and treatment of diseases and clinical conditions associated with LOC220073. LOC90630 (Accession XM_033046) is another VGAM146 host target gene. LOC90630 BINDING SITE is HOST TARGET binding site found in the 5' untranslated region of mRNA encoded by LOC90630, corresponding to a HOST TARGET binding site such as BINDING SITE I, BINDING SITE II or BINDING SITE III. Table 2 illustrates the complementarity of the nucleotide sequences of LOC90630 BINDING SITE, designated SEQ ID:31826, to the nucleotide sequence of VGAM146 RNA, herein designated VGAM RNA, also designated SEQ ID:2857.

Another function of VGAM146 is therefore inhibition of LOC90630 (Accession XM_033046). Accordingly, utilities of VGAM146 include diagnosis, prevention and treatment of diseases and clinical conditions associated with LOC90630. LOC91069 (Accession XM_035824) is another VGAM146 host target gene. LOC91069 BINDING SITE is HOST TARGET binding site found in the 3' untranslated region of mRNA encoded by LOC91069, corresponding to a HOST TARGET binding site such as BINDING SITE I, BINDING SITE II or BINDING SITE III. Table 2 illustrates the complementarity of the nucleotide sequences of LOC91069 BINDING SITE, designated SEQ ID:32348, to the nucleotide sequence of VGAM146 RNA, herein designated VGAM RNA, also designated SEQ ID:2857.

Another function of VGAM146 is therefore inhibition of LOC91069 (Accession XM_035824). Accordingly, utilities of VGAM146 include diagnosis, prevention and treatment of diseases and clinical conditions associated with LOC91069. LOC92095 (Accession XM_042811) is another VGAM146 host target gene. LOC92095 BINDING SITE is HOST TARGET binding site found in the 5' untranslated region of mRNA encoded by LOC92095, corresponding to a HOST TARGET binding site such as BINDING SITE I, BINDING SITE II or BINDING SITE III. Table 2 illustrates the complementarity of the nucleotide sequences of LOC92095 BINDING SITE, designated SEQ ID:33774, to the nucleotide sequence of VGAM146 RNA, herein designated VGAM RNA, also designated SEQ ID:2857.

Another function of VGAM146 is therefore inhibition of LOC92095 (Accession XM_042811). Accordingly, utilities of VGAM146 include diagnosis, prevention and treatment of diseases and clinical conditions associated with LOC92095. LOC92096 (Accession XM_042812) is another VGAM146 host target gene. LOC92096 BINDING SITE is HOST TARGET binding site found in the 5' untranslated region of mRNA encoded by LOC92096, corresponding to a HOST TARGET binding site such as BINDING SITE I, BINDING SITE II or BINDING SITE III. Table 2 illustrates the complementarity of the nucleotide sequences of LOC92096 BINDING SITE, designated SEQ ID:33778, to the nucleotide sequence of VGAM146 RNA, herein designated VGAM RNA, also designated SEQ ID:2857.

Another function of VGAM146 is therefore inhibition of LOC92096 (Accession XM_042812). Accordingly, utilities of VGAM146 include diagnosis, prevention and treatment of diseases and clinical conditions associated with LOC92096. FIG. 1 further provides a conceptual description of a novel bioinformatically detected viral gene of the present invention, referred to here as Viral Genomic Address Messenger 147 (VGAM147) viral gene, which modulates expression of respective host target genes thereof, the function and utility of which host target genes is known in the art.

VGAM147 is a novel bioinformatically detected regulatory, non protein coding, viral micro RNA (miRNA) gene. The method by which VGAM147 was detected is described hereinabove with reference to FIGS. 1-8.

VGAM147 gene, herein designated VGAM GENE, is a viral gene contained in the genome of Shrimp White Spot Syndrome Virus (white spot bacilliform virus). VGAM147 host target gene, herein designated VGAM HOST TARGET GENE, is a human gene contained in the human genome.

VGAM147 gene encodes a VGAM147 precursor RNA, herein designated VGAM PRECURSOR RNA. Similar to other miRNA genes, and unlike most ordinary genes, VGAM147 precursor RNA does not encode a protein. A nucleotide sequence identical or highly similar to the nucleotide sequence of VGAM147 precursor RNA is designated SEQ ID:133, and is provided hereinbelow with reference to the sequence listing part. Nucleotide sequence SEQ ID:133 is located at position 82267 relative to the genome of Shrimp White Spot Syndrome Virus (white spot bacilliform virus).

VGAM147 precursor RNA folds onto itself, forming VGAM147 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM147 folded precursor RNA into VGAM147 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM147 RNA is designated SEQ ID:2858, and is provided hereinbelow with reference to the sequence listing part.

VGAM147 host target gene, herein designated VGAM HOST TARGET GENE, encodes a corresponding messenger RNA, VGAM147 host target RNA, herein designated VGAM HOST TARGET RNA. VGAM147 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM147 RNA, herein designated VGAM RNA, binds complementarily to one or more host target binding sites located in untranslated regions of VGAM147 host target RNA, herein designated VGAM HOST TARGET RNA. This complementary binding is due to the fact that the nucleotide sequence of VGAM147 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM147 RNA, herein designated VGAM RNA, may have a different number of host target binding sites in untranslated regions of a VGAM147 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM147 RNA, herein designated VGAM RNA, to host target binding sites on VGAM147 host target RNA, herein designated VGAM HOST TARGET RNA, such as BINDING SITE I, BINDING SITE II and BINDING SITE III, inhibits translation of VGAM147 host target RNA into VGAM147 host target protein, herein designated VGAM HOST TARGET PROTEIN. VGAM host target protein is therefore outlined by a broken line.

It is appreciated that VGAM147 host target gene, herein designated VGAM HOST TARGET GENE, in fact represents a plurality of VGAM147 host target genes. The mRNA of each one of this plurality of VGAM147 host target genes comprises one or more host target binding sites, each having a nucleotide sequence which is at least partly complementary to VGAM147 RNA, herein designated VGAM RNA, and which when bound by VGAM147 RNA causes inhibition of translation of respective one or more VGAM147 host target proteins.

It is further appreciated by one skilled in the art that the mode of translational inhibition illustrated by FIG. 1 with specific reference to translational inhibition exerted by VGAM147 gene, herein designated VGAM GENE, on one or more VGAM147 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM147 is inhibition of expression of host target genes, as part of a novel viral mechanism of attacking a host. Accordingly, utilities of VGAM147 include diagnosis, prevention and treatment of viral infection by Shrimp White Spot Syndrome Virus (white spot bacilliform virus). Specific functions, and accordingly utilities, of VGAM147 correlate with, and may be deduced from, the identity of the host target genes which VGAM147 binds and inhibits, and the function of these host target genes, as elaborated hereinbelow.

Nucleotide sequences of the VGAM147 precursor RNA, herein designated VGAM PRECURSOR RNA, and of the 'diced' VGAM147 RNA, herein designated VGAM RNA, and a schematic representation of the secondary folding of VGAM147 folded precursor RNA, herein designated VGAM FOLDED PRECURSOR RNA, of VGAM147 are further described hereinbelow with reference to Table 1.

Nucleotide sequences of host target binding sites, such as BINDING SITE-I, BINDING SITE-II and BINDING SITE-III of FIG. 1, found on VGAM147 host target RNA, and schematic representation of the complementarity of each of these host target binding sites to VGAM147 RNA, herein designated VGAM RNA, are described hereinbelow with reference to Table 2.

As mentioned hereinabove with reference to FIG. 1, a function of VGAM147 gene, herein designated VGAM is inhibition of expression of VGAM147 target genes. It is appreciated that specific functions, and accordingly utilities, of VGAM147 correlate with, and may be deduced from, the identity of the target genes which VGAM147 binds and inhibits, and the function of these target genes, as elaborated hereinbelow.

Lysyl Oxidase-like 2 (LOXL2, Accession NM_002318) is a VGAM147 host target gene. LOXL2 BINDING SITE is HOST TARGET binding site found in the 3' untranslated region of mRNA encoded by LOXL2, corresponding to a HOST TARGET binding site such as BINDING SITE I, BINDING SITE II or BINDING SITE III. Table 2 illustrates the complementarity of the nucleotide sequences of LOXL2 BINDING SITE, designated SEQ ID:8133, to the nucleotide sequence of VGAM147 RNA, herein designated VGAM RNA, also designated SEQ ID:2858.

A function of VGAM147 is therefore inhibition of Lysyl Oxidase-like 2 (LOXL2, Accession NM_002318), a gene which may have roles in senescence and cell adhesion. Accordingly, utilities of VGAM147 include diagnosis, prevention and treatment of diseases and clinical conditions associated with LOXL2. The function of LOXL2 has been established by previous studies. LOXL2 is a member of the lysyl oxidase (LO; 153455) gene family. LO is an extracellular, copper-dependent enzyme that initiates the cross-linking of collagens and elastin by catalyzing the oxidative deamination of peptidyl lysine to alpha-aminoadipic-delta-semialdehyde. Members of the LO family have diverse functions, including tumor suppression and cell adhesion and senescence Saito et al. (1997) used PCR and 5-prime RACE to obtain a full-length cDNA encoding LOXL2. The predicted 774-amino acid LOXL2 protein contains 3 potential N-linked glycosylation sites and 4 scavenger receptor cysteine-rich (SRCR) domains, which are involved in binding to other cell surface or extracellular molecules. LOXL2 also contains residues conserved among copper-binding proteins. In vitro translation produced an 87-kD LOXL2 protein. Northern blot analysis detected a 3.65-kb LOXL2 transcript in adherent tumor cell lines but not in suspension cell lines. Using cultured fibroblasts, Saito et al. (1997) demonstrated that LOXL2 expression is upregulated in senescent fibroblasts, induced by transforming growth factor beta-1 (OMIM Ref. No. 190180) and indomethacin, and inhibited by phorbol ester and retinoic acid. They concluded that LOXL2 is an extracellular matrix component that may be specifically involved in cell adhesion and senescence Full details of the abovementioned studies are described in the following publications, the disclosure of which are hereby incorporated by reference:

Saito, H.; Papaconstantinou, J.; Sato, H.; Goldstein, S.: Regulation of a novel gene encoding a lysyl oxidase-related protein in cellular adhesion and senescence. J. Biol. Chem. 272:8157-8160, 1997; and Saito, H.; Papaconstantinou, J.; Sato, H.; Goldstein, S.: Regulation of a novel gene encoding a lysyl oxidase-related protein in cellular adhesion and senescence. J. Biol. Chem. 272:8157.

Further studies establishing the function and utilities of LOXL2 are found in John Hopkins OMIM database record ID 606663, and in sited publications numbered 6280-6281, 639 and 6450 listed in the bibliography section hereinbelow, which are also hereby incorporated by reference. Low Density Lipoprotein Receptor-related Protein 4 (LRP4, Accession XM_035037) is another VGAM147 host target gene. LRP4 BINDING SITE is HOST TARGET binding site found in the 3' untranslated region of mRNA encoded by LRP4, corresponding to a HOST TARGET binding site such as BINDING SITE I, BINDING SITE II or BINDING SITE III. Table 2 illustrates the complementarity of the nucleotide sequences of LRP4 BINDING SITE, designated SEQ ID:32197, to the nucleotide sequence of VGAM147 RNA, herein designated VGAM RNA, also designated SEQ ID:2858.

Another function of VGAM147 is therefore inhibition of Low Density Lipoprotein Receptor-related Protein 4 (LRP4, Accession XM_035037). Accordingly, utilities of VGAM147 include diagnosis, prevention and treatment of diseases and clinical conditions associated with LRP4. Solute Carrier Family 22 (organic cation transporter), Member 5 (SLC22A5, Accession NM_003060) is another VGAM147 host target gene. SLC22A5 BINDING SITE is HOST TARGET binding site found in the 3' untranslated region of mRNA encoded by SLC22A5, corresponding to a HOST TARGET binding site such as BINDING SITE I, BINDING SITE II or BINDING SITE III. Table 2 illustrates the complementarity of the nucleotide sequences of SLC22A5 BINDING SITE, designated SEQ ID:9026, to the nucleotide sequence of VGAM147 RNA, herein designated VGAM RNA, also designated SEQ ID:2858.

Another function of VGAM147 is therefore inhibition of Solute Carrier Family 22 (organic cation transporter), Member 5 (SLC22A5, Accession NM_003060). Accordingly, utilities of VGAM147 include diagnosis, prevention and treatment of diseases and clinical conditions associated with SLC22A5. KIAA1872 (Accession XM_031917) is another VGAM147 host target gene. KIAA1872 BINDING SITE is HOST TARGET binding site found in the 3' untranslated region of mRNA encoded by KIAA1872, corresponding to a HOST TARGET binding site such as BINDING SITE I, BINDING SITE II or BINDING SITE III. Table 2 illustrates the complementarity of the nucleotide sequences of KIAA1872 BINDING SITE, designated SEQ ID:31520, to the nucleotide sequence of VGAM147 RNA, herein designated VGAM RNA, also designated SEQ ID:2858.

Another function of VGAM147 is therefore inhibition of KIAA1872 (Accession XM_031917). Accordingly, utilities of VGAM147 include diagnosis, prevention and treatment of diseases and clinical conditions associated with KIAA1872. MGC3248 (Accession NM_032486) is another VGAM147 host target gene. MGC3248 BINDING SITE is HOST TARGET binding site found in the 3' untranslated region of mRNA encoded by MGC3248, corresponding to a HOST TARGET binding site such as BINDING SITE I, BINDING SITE II or BINDING SITE III. Table 2 illustrates the complementarity of the nucleotide sequences of MGC3248 BINDING SITE, designated SEQ ID:26238, to the nucleotide sequence of VGAM147 RNA, herein designated VGAM RNA, also designated SEQ ID:2858.

Another function of VGAM147 is therefore inhibition of MGC3248 (Accession NM_032486). Accordingly, utilities of VGAM147 include diagnosis, prevention and treatment of diseases and clinical conditions associated with MGC3248. PEPP3 (Accession NM_014935) is another VGAM147 host target gene. PEPP3 BINDING SITE is HOST TARGET binding site found in the 3' untranslated region of mRNA encoded by PEPP3, corresponding to a HOST TARGET binding site such as BINDING SITE I, BINDING SITE II or BINDING SITE III. Table 2 illustrates the complementarity of the nucleotide sequences of PEPP3 BINDING SITE, designated SEQ ID:17235, to the nucleotide sequence of VGAM147 RNA, herein designated VGAM RNA, also designated SEQ ID:2858.

Another function of VGAM147 is therefore inhibition of PEPP3 (Accession NM_014935). Accordingly, utilities of VGAM147 include diagnosis, prevention and treatment of diseases and clinical conditions associated with PEPP3. LOC157349 (Accession XM_088298) is another VGAM147 host target gene. LOC157349 BINDING SITE is HOST TARGET binding site found in the 3' untranslated region of mRNA encoded by LOC157349, corresponding to a HOST TARGET binding site such as BINDING SITE I, BINDING SITE II or BINDING SITE III. Table 2 illustrates the complementarity of the nucleotide sequences of LOC157349 BINDING SITE, designated SEQ ID:39597, to the nucleotide sequence of VGAM147 RNA, herein designated VGAM RNA, also designated SEQ ID:2858.

Another function of VGAM147 is therefore inhibition of LOC157349 (Accession XM_088298). Accordingly, utilities of VGAM147 include diagnosis, prevention and treatment of diseases and clinical conditions associated with LOC157349. LOC163231 (Accession XM_092094) is another VGAM147 host target gene. LOC163231 BINDING SITE is HOST TARGET binding site found in the 5' untranslated region of mRNA encoded by LOC163231, corresponding to a HOST TARGET binding site such as BINDING SITE I, BINDING SITE II or BINDING SITE III. Table 2 illustrates the complementarity of the nucleotide sequences of LOC163231 BINDING SITE, designated SEQ ID:40099, to the nucleotide sequence of VGAM147 RNA, herein designated VGAM RNA, also designated SEQ ID:2858.

Another function of VGAM147 is therefore inhibition of LOC163231 (Accession XM_092094). Accordingly, utilities of VGAM147 include diagnosis, prevention and treatment of diseases and clinical conditions associated with LOC163231. LOC255527 (Accession XM_173026) is another VGAM147 host target gene. LOC255527 BINDING SITE is HOST TARGET binding site found in the 5' untranslated region of mRNA encoded by LOC255527, corresponding to a HOST TARGET binding site such as BINDING SITE I, BINDING SITE II or BINDING SITE III. Table 2 illustrates the complementarity of the nucleotide sequences of LOC255527 BINDING SITE, designated SEQ ID:46294, to the nucleotide sequence of VGAM147 RNA, herein designated VGAM RNA, also designated SEQ ID:2858.

Another function of VGAM147 is therefore inhibition of LOC255527 (Accession XM_173026). Accordingly, utilities of VGAM147 include diagnosis, prevention and treatment of diseases and clinical conditions associated with LOC255527. FIG. 1 further provides a conceptual description of a novel bioinformatically detected viral gene of the present invention, referred to here as Viral Genomic Address Messenger 148 (VGAM148) viral gene, which modulates expression of respective host target genes thereof, the function and utility of which host target genes is known in the art.

VGAM148 is a novel bioinformatically detected regulatory, non protein coding, viral micro RNA (miRNA) gene. The method by which VGAM148 was detected is described hereinabove with reference to FIGS. 1-8.

VGAM148 gene, herein designated VGAM GENE, is a viral gene contained in the genome of Shrimp White Spot Syndrome Virus (white spot baciliform virus). VGAM148 host target gene, herein designated VGAM HOST TARGET GENE, is a human gene contained in the human genome.

VGAM148 gene encodes a VGAM148 precursor RNA, herein designated VGAM PRECURSOR RNA. Similar to other miRNA genes, and unlike most ordinary genes, VGAM148 precursor RNA does not encode a protein. A nucleotide sequence identical or highly similar to the nucleotide sequence of VGAM148 precursor RNA is designated SEQ ID:134, and is provided hereinbelow with reference to the sequence listing part. Nucleotide sequence SEQ ID:134 is located at position 164623 relative to the genome of Shrimp White Spot Syndrome Virus (white spot baciliform virus).

VGAM148 precursor RNA folds onto itself, forming VGAM148 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM148 folded precursor RNA into VGAM148 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM148 RNA is designated SEQ ID:2859, and is provided hereinbelow with reference to the sequence listing part.

VGAM148 host target gene, herein designated VGAM HOST TARGET GENE, encodes a corresponding messenger RNA, VGAM148 host target RNA, herein designated VGAM HOST TARGET RNA. VGAM148 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM148 RNA, herein designated VGAM RNA, binds complementarily to one or more host target binding sites located in untranslated regions of VGAM148 host target RNA, herein designated VGAM HOST TARGET RNA. This complementary binding is due to the fact that the nucleotide sequence of VGAM148 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM148 RNA, herein designated VGAM RNA, may have a different number of host target binding sites in untranslated regions of a VGAM148 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM148 RNA, herein designated VGAM RNA, to host target binding sites on VGAM148 host target RNA, herein designated VGAM HOST TARGET RNA, such as BINDING SITE I, BINDING SITE II and BINDING SITE III, inhibits translation of VGAM148 host target RNA into VGAM148 host target protein, herein designated VGAM HOST TARGET PROTEIN. VGAM host target protein is therefore outlined by a broken line.

It is appreciated that VGAM148 host target gene, herein designated VGAM HOST TARGET GENE, in fact represents a plurality of VGAM148 host target genes. The mRNA of each one of this plurality of VGAM148 host target genes comprises one or more host target binding sites, each having a nucleotide sequence which is at least partly complementary to VGAM148 RNA, herein designated VGAM RNA, and which when bound by VGAM148 RNA causes inhibition of translation of respective one or more VGAM148 host target proteins.

It is further appreciated by one skilled in the art that the mode of translational inhibition illustrated by FIG. 1 with specific reference to translational inhibition exerted by VGAM148 gene, herein designated VGAM GENE, on one or more VGAM148 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM148 is inhibition of expression of host target genes, as part of a novel viral mechanism of attacking a host. Accordingly, utilities of VGAM148 include diagnosis, prevention and treatment of viral infection by Shrimp White Spot Syndrome Virus (white spot bacilliform virus). Specific functions, and accordingly utilities, of VGAM148 correlate with, and may be deduced from, the identity of the host target genes which VGAM148 binds and inhibits, and the function of these host target genes, as elaborated hereinbelow.

Nucleotide sequences of the VGAM148 precursor RNA, herein designated VGAM PRECURSOR RNA, and of the 'diced' VGAM148 RNA, herein designated VGAM RNA, and a schematic representation of the secondary folding of VGAM148 folded precursor RNA, herein designated VGAM FOLDED PRECURSOR RNA, of VGAM148 are further described hereinbelow with reference to Table 1.

Nucleotide sequences of host target binding sites, such as BINDING SITE-I, BINDING SITE-II and BINDING SITE-III of FIG. 1, found on VGAM148 host target RNA, and schematic representation of the complementarity of each of these host target binding sites to VGAM148 RNA, herein designated VGAM RNA, are described hereinbelow with reference to Table 2.

As mentioned hereinabove with reference to FIG. 1, a function of VGAM148 gene, herein designated VGAM is inhibition of expression of VGAM148 target genes. It is appreciated that specific functions, and accordingly utilities, of VGAM148 correlate with, and may be deduced from, the identity of the target genes which VGAM148 binds and inhibits, and the function of these target genes, as elaborated hereinbelow.

Caspase 2, Apoptosis-related Cysteine Protease (neural precursor cell expressed, developmentally down-regulated 2) (CASP2, Accession NM_001224) is a VGAM148 host target gene. CASP2 BINDING SITE1 through CASP2 BINDING SITE4 are HOST TARGET binding sites found in untranslated regions of mRNA encoded by CASP2, corresponding to HOST TARGET binding sites such as BINDING SITE I, BINDING SITE II or BINDING SITE III. Table 2 illustrates the complementarity of the nucleotide sequences of CASP2 BINDING SITE1 through CASP2 BINDING SITE4, designated SEQ ID:6891, SEQ ID:26854, SEQ ID:26859 and SEQ ID:26864 respectively, to the nucleotide sequence of VGAM148 RNA, herein designated VGAM RNA, also designated SEQ ID:2859.

A function of VGAM148 is therefore inhibition of Caspase 2, Apoptosis-related Cysteine Protease (neural precursor cell expressed, developmentally down-regulated 2) (CASP2, Accession NM_001224), a gene which involves in the activation cascade of caspases responsible for apoptosis execution. Accordingly, utilities of VGAM148 include diagnosis, prevention and treatment of diseases and clinical conditions associated with CASP2. The function of CASP2 has been established by previous studies. Lassus et al. (2002) found that cytotoxic stress causes activation of caspase-2 and that this caspase is required for the permeabilization of mitochondria. Caspase-2 is required for stress-induced apoptosis and for release of cytochrome c and Smac (OMIM Ref. No. 605219) from mitochondria and for translocation of Bax from the cytoplasm to mitochondria. Animal model experiments lend further support to the function of CASP2. To evaluate the requirement for caspase-2 in various aspects of apoptosis, Bergeron et al. (1998) generated caspase-2-deficient mice. Excess numbers of the germ cells were 'endowed' in ovaries of mutant mice, and the oocytes were resistant to cell death following exposure to chemotherapeutic drugs. Apoptosis mediated by granzyme B (OMIM Ref. No. 123910) and perforin (OMIM Ref. No. 170280) was defective in caspase-2-deficient B lymphoblasts. In contrast, cell death of motor neurons during development was accelerated in caspase-2-deficient mice. In addition, caspase-2-deficient sympathetic neurons underwent apoptosis more effectively than wildtype neurons when deprived of nerve growth factor. Thus, caspase-2 acts as both a positive and a negative cell death effector, depending upon cell lineage and stage of development.

It is appreciated that the abovementioned animal model for CASP2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bergeron, L.; Perez, G. I.; Macdonald, G.; Shi, L.; Sun, Y.; Jurisicova, A.; Varmuza, S.; Latham, K. E.; Flaws, J. A.; Salter, J. C. M.; Hara, H.; Moskowitz, M. A.; Li, E.; Greenberg, A.; Tilly, J. L.; Yuan, J.: Defects in regulation of apoptosis in caspase-2-deficient mice. Genes Dev. 12:1304-1314, 1998; and Lassus, P.; Opitz-Araya, X.; Lazebnik, Y.: Requirement for caspase-2 in stress-induced apoptosis before mitochondrial permeabilization. Science 297: 1352-1354, 2002.

Further studies establishing the function and utilities of CASP2 are found in John Hopkins OMIM database record ID 600639, and in sited publications numbered 7129, 7567, 7573-757 and 7126 listed in the bibliography section hereinbelow, which are also hereby incorporated by reference. Angiomotin (AMOT, Accession NM_133265) is another VGAM148 host target gene. AMOT BINDING SITE1 and AMOT BINDING SITE2 are HOST TARGET binding sites found in untranslated regions of mRNA encoded by AMOT, corresponding to HOST TARGET binding sites such as BINDING SITE I, BINDING SITE II or BINDING SITE III. Table 2 illustrates the complementarity of the nucleotide sequences of AMOT BINDING SITE1 and AMOT BINDING SITE2, designated SEQ ID:28410 and SEQ ID:28418 respectively, to the nucleotide sequence of VGAM148 RNA, herein designated VGAM RNA, also designated SEQ ID:2859.

Another function of VGAM148 is therefore inhibition of Angiomotin (AMOT, Accession NM_133265). Accordingly, utilities of VGAM148 include diagnosis, prevention and treatment of diseases and clinical conditions associated with AMOT. Chromosome 5 Open Reading Frame 4 (C5orf4, Accession NM_016348) is another VGAM148 host target gene. C5orf4 BINDING SITE1 and C5orf4 BINDING SITE2 are HOST TARGET binding sites found in untranslated regions of mRNA encoded by C5orf4, corresponding to HOST TARGET binding sites such as BINDING SITE I, BINDING SITE II or BINDING SITE III. Table 2 illustrates the complementarity of the nucleotide sequences of C5orf4 BINDING SITE1 and C5orf4 BINDING SITE2, designated SEQ ID:18475 and SEQ ID:15570 respectively, to the nucleotide sequence of VGAM148 RNA, herein designated VGAM RNA, also designated SEQ ID:2859.

Another function of VGAM148 is therefore inhibition of Chromosome 5 Open Reading Frame 4 (C5orf4, Accession NM_016348). Accordingly, utilities of VGAM148 include diagnosis, prevention and treatment of diseases and clinical conditions associated with C5orf4. FLJ12985 (Accession NM_024924) is another VGAM148 host target gene. FLJ12985 BINDING SITE is HOST TARGET binding site found in the 3' untranslated region of mRNA encoded by FLJ12985, corresponding to a HOST TARGET binding site such as BINDING SITE I, BINDING SITE II or BINDING SITE III. Table 2 illustrates the complementarity of the nucleotide sequences of FLJ12985 BINDING SITE, designated SEQ ID:24464, to the nucleotide sequence of VGAM148 RNA, herein designated VGAM RNA, also designated SEQ ID:2859.

Another function of VGAM148 is therefore inhibition of FLJ12985 (Accession NM_024924). Accordingly, utilities of VGAM148 include diagnosis, prevention and treatment of diseases and clinical conditions associated with FLJ12985. Golgi Associated, Gamma Adaptin Ear Containing, ARF Binding Protein 2 (GGA2, Accession NM_138640) is another VGAM148 host target gene. GGA2 BINDING SITE1 and GGA2 BINDING SITE2 are HOST TARGET binding sites found in untranslated regions of mRNA encoded by GGA2, corresponding to HOST TARGET binding sites such as BINDING SITE I, BINDING SITE II or BINDING SITE III. Table 2 illustrates the complementarity of the nucleotide sequences of GGA2 BINDING SITE1 and GGA2 BINDING SITE2, designated SEQ ID:28926 and SEQ ID:17404 respectively, to the nucleotide sequence of VGAM148 RNA, herein designated VGAM RNA, also designated SEQ ID:2859.

Another function of VGAM148 is therefore inhibition of Golgi Associated, Gamma Adaptin Ear Containing, ARF Binding Protein 2 (GGA2, Accession NM_138640). Accordingly, utilities of VGAM148 include diagnosis, prevention and treatment of diseases and clinical conditions associated with GGA2. KIAA0125 (Accession NM_014792) is another VGAM148 host target gene. KIAA0125 BINDING SITE1 through KIAA0125 BINDING SITE3 are HOST TARGET binding sites found in untranslated regions of mRNA encoded by KIAA0125, corresponding to HOST TARGET binding sites such as BINDING SITE I, BINDING SITE II or BINDING SITE III. Table 2 illustrates the complementarity of the nucleotide sequences of KIAA0125 BINDING SITE1 through KIAA0125 BINDING SITE3, designated SEQ ID:16691, SEQ ID:30345 and SEQ ID:35403 respectively, to the nucleotide sequence of VGAM148 RNA, herein designated VGAM RNA, also designated SEQ ID:2859.

Another function of VGAM148 is therefore inhibition of KIAA0125 (Accession NM_014792). Accordingly, utilities of VGAM148 include diagnosis, prevention and treatment of diseases and clinical conditions associated with KIAA0125. Paternally Expressed 10 (PEG10, Accession NM_015068) is another VGAM148 host target gene. PEG10 BINDING SITE is HOST TARGET binding site found in the 3' untranslated region of mRNA encoded by PEG10, corresponding to a HOST TARGET binding site such as BINDING SITE I, BINDING SITE II or BINDING SITE III. Table 2 illustrates the complementarity of the nucleotide sequences of PEG10 BINDING SITE, designated SEQ ID:17434, to the nucleotide sequence of VGAM148 RNA, herein designated VGAM RNA, also designated SEQ ID:2859.

Another function of VGAM148 is therefore inhibition of Paternally Expressed 10 (PEG10, Accession NM_015068). Accordingly, utilities of VGAM148 include diagnosis, prevention and treatment of diseases and clinical conditions associated with PEG10. PRP8 Pre-mRNA Processing Factor 8 Homolog (yeast) (PRPF8, Accession XM_028335) is another VGAM148 host target gene. PRPF8 BINDING SITE is HOST TARGET binding site found in the 3' untranslated region of mRNA encoded by PRPF8, corresponding to a HOST TARGET binding site such as BINDING SITE I, BINDING SITE II or BINDING SITE III. Table 2 illustrates the complementarity of the nucleotide sequences of PRPF8 BINDING SITE, designated SEQ ID:30677, to the nucleotide sequence of VGAM148 RNA, herein designated VGAM RNA, also designated SEQ ID:2859.

Another function of VGAM148 is therefore inhibition of PRP8 Pre-mRNA Processing Factor 8 Homolog (yeast) (PRPF8, Accession XM_028335). Accordingly, utilities of VGAM148 include diagnosis, prevention and treatment of diseases and clinical conditions associated with PRPF8. PRTD-NY3 (Accession NM_030924) is another VGAM148 host target gene. PRTD-NY3 BINDING SITE is HOST TARGET binding site found in the 5" untranslated region of mRNA encoded by PRTD-NY3, corresponding to a HOST TARGET binding site such as BINDING SITE I, BINDING SITE II or BINDING SITE III. Table 2 illustrates the complementarity of the nucleotide sequences of PRTD-NY3 BINDING SITE, designated SEQ ID:25193, to the nucleotide sequence of VGAM148 RNA, herein designated VGAM RNA, also designated SEQ ID:2859.

Another function of VGAM148 is therefore inhibition of PRTD-NY3 (Accession NM_030924). Accordingly, utilities of VGAM148 include diagnosis, prevention and treatment of diseases and clinical conditions associated with PRTD-NY3. RAI (Accession NM_006663) is another VGAM148 host target gene. RAI BINDING SITE is HOST TARGET binding site found in the 3" untranslated region of mRNA encoded by RAI, corresponding to a HOST TARGET binding site such as BINDING SITE I, BINDING SITE II or BINDING SITE III. Table 2 illustrates the complementarity of the nucleotide sequences of RAI BINDING SITE, designated SEQ ID:13468, to the nucleotide sequence of VGAM148 RNA, herein designated VGAM RNA, also designated SEQ ID:2859.

Another function of VGAM148 is therefore inhibition of RAI (Accession NM_006663). Accordingly, utilities of VGAM148 include diagnosis, prevention and treatment of diseases and clinical conditions associated with RAI. Seizure Related 6 Homolog (mouse) (SEZ6, Accession XM_058869) is another VGAM148 host target gene. SEZ6 BINDING SITE1 and SEZ6 BINDING SITE2 are HOST TARGET binding sites found in untranslated regions of mRNA encoded by SEZ6, corresponding to HOST TARGET binding sites such as BINDING SITE I, BINDING SITE II or BINDING SITE III. Table 2 illustrates the complementarity of the nucleotide sequences of SEZ6 BINDING SITE1 and SEZ6 BINDING SITE2, designated SEQ ID:36771 and SEQ ID:36772 respectively, to the nucleotide sequence of VGAM148 RNA, herein designated VGAM RNA, also designated SEQ ID:2859.

Another function of VGAM148 is therefore inhibition of Seizure Related 6 Homolog (mouse) (SEZ6, Accession XM_058869). Accordingly, utilities of VGAM148 include diagnosis, prevention and treatment of diseases and clinical conditions associated with SEZ6. LOC146227 (Accession XM_085374) is another VGAM148 host target gene. LOC146227 BINDING SITE1 through LOC146227 BINDING SITE4 are HOST TARGET binding sites found in untranslated regions of mRNA encoded by LOC146227, corresponding to HOST TARGET binding sites such as BINDING SITE I, BINDING SITE II or BINDING SITE III. Table 2 illustrates the complementarity of the nucleotide sequences of LOC146227 BINDING SITE1 through LOC146227 BINDING SITE4, designated SEQ ID:38084, SEQ ID:38085, SEQ ID:38086 and SEQ ID:40774 respectively, to the nucleotide sequence of VGAM148 RNA, herein designated VGAM RNA, also designated SEQ ID:2859.

Another function of VGAM148 is therefore inhibition of LOC146227 (Accession XM_085374). Accordingly, utilities of VGAM148 include diagnosis, prevention and treatment of diseases and clinical conditions associated with LOC146227. LOC150333 (Accession XM_097874) is another VGAM148 host target gene. LOC150333 BINDING SITE1 and LOC150333 BINDING SITE2 are HOST TARGET binding sites found in untranslated regions of mRNA encoded by LOC150333, corresponding to HOST TARGET binding sites such as BINDING SITE I, BINDING SITE II or BINDING SITE III. Table 2 illustrates the complementarity of the nucleotide sequences of LOC150333 BINDING SITE1 and LOC150333 BINDING SITE2, designated SEQ ID:41197 and SEQ ID:41199 respectively, to the nucleotide sequence of VGAM148 RNA, herein designated VGAM RNA, also designated SEQ ID:2859.

Another function of VGAM148 is therefore inhibition of LOC150333 (Accession XM_097874). Accordingly, utilities of VGAM148 include diagnosis, prevention and treatment of diseases and clinical conditions associated with LOC150333. LOC153688 (Accession XM_098416) is another VGAM148 host target gene. LOC153688 BINDING SITE is HOST TARGET binding site found in the 3' untranslated region of mRNA encoded by LOC153688, corresponding to a HOST TARGET binding site such as BINDING SITE I, BINDING SITE II or BINDING SITE III. Table 2 illustrates the complementarity of the nucleotide sequences of LOC153688 BINDING SITE, designated SEQ ID:41656, to the nucleotide sequence of VGAM148 RNA, herein designated VGAM RNA, also designated SEQ ID:2859.

Another function of VGAM148 is therefore inhibition of LOC153688 (Accession XM_098416). Accordingly, utilities of VGAM148 include diagnosis, prevention and treatment of diseases and clinical conditions associated with LOC153688. LOC157653 (Accession XM_088353) is another VGAM148 host target gene. LOC157653 BINDING SITE is HOST TARGET binding site found in the 5' untranslated region of mRNA encoded by LOC157653, corresponding to a HOST TARGET binding site such as BINDING SITE I, BINDING SITE II or BINDING SITE III. Table 2 illustrates the complementarity of the nucleotide sequences of LOC157653 BINDING SITE, designated SEQ ID:39632, to the nucleotide sequence of VGAM148 RNA, herein designated VGAM RNA, also designated SEQ ID:2859.

Another function of VGAM148 is therefore inhibition of LOC157653 (Accession XM_088353). Accordingly, utilities of VGAM148 include diagnosis, prevention and treatment of diseases and clinical conditions associated with LOC157653. LOC219404 (Accession XM_167909) is another VGAM148 host target gene. LOC219404 BINDING SITE is HOST TARGET binding site found in the 3' untranslated region of mRNA encoded by LOC219404, corresponding to a HOST TARGET binding site such as BINDING SITE I, BINDING SITE II or BINDING SITE III. Table 2 illustrates the complementarity of the nucleotide sequences of LOC219404 BINDING SITE, designated SEQ ID:44910, to the nucleotide sequence of VGAM148 RNA, herein designated VGAM RNA, also designated SEQ ID:2859.

Another function of VGAM148 is therefore inhibition of LOC219404 (Accession XM_167909). Accordingly, utilities of VGAM148 include diagnosis, prevention and treatment of diseases and clinical conditions associated with LOC219404. LOC221468 (Accession NM_145316) is another VGAM148 host target gene. LOC221468 BINDING SITE is HOST TARGET binding site found in the 3' untranslated region of mRNA encoded by LOC221468, corresponding to a HOST TARGET binding site such as BINDING SITE I, BINDING SITE II or BINDING SITE III. Table 2 illustrates the complementarity of the nucleotide sequences of LOC221468 BINDING SITE, designated SEQ ID:29827, to the nucleotide sequence of VGAM148 RNA, herein designated VGAM RNA, also designated SEQ ID:2859.

Another function of VGAM148 is therefore inhibition of LOC221468 (Accession NM_145316). Accordingly, utilities of VGAM148 include diagnosis, prevention and treatment of diseases and clinical conditions associated with LOC221468. LOC255624 (Accession XM_170531) is another VGAM148 host target gene. LOC255624 BINDING SITE is HOST TARGET binding site found in the 3' untranslated region of mRNA encoded by LOC255624, corresponding to a HOST TARGET binding site such as BINDING SITE I, BINDING SITE II or BINDING SITE III. Table 2 illustrates the complementarity of the nucleotide sequences of LOC255624 BINDING SITE, designated SEQ ID:45352, to the nucleotide sequence of VGAM148 RNA, herein designated VGAM RNA, also designated SEQ ID:2859.

Another function of VGAM148 is therefore inhibition of LOC255624 (Accession XM_170531). Accordingly, utilities of VGAM148 include diagnosis, prevention and treatment of diseases and clinical conditions associated with LOC255624. FIG. 1 further provides a conceptual description of a novel bioinformatically detected viral gene of the present invention, referred to here as Viral Genomic Address Messenger 149 (VGAM149) viral gene, which modulates expression of respective host target genes thereof, the function and utility of which host target genes is known in the art.

VGAM149 is a novel bioinformatically detected regulatory, non protein coding, viral micro RNA (miRNA) gene. The method by which VGAM149 was detected is described hereinabove with reference to FIGS. 1-8.

VGAM149 gene, herein designated VGAM GENE, is a viral gene contained in the genome of Shrimp White Spot Syndrome Virus (white spot bacilliform virus). VGAM149 host target gene, herein designated VGAM HOST TARGET GENE, is a human gene contained in the human genome.

VGAM149 gene encodes a VGAM149 precursor RNA, herein designated VGAM PRECURSOR RNA. Similar to other miRNA genes, and unlike most ordinary genes, VGAM149 precursor RNA does not encode a protein. A nucleotide sequence identical or highly similar to the nucleotide sequence of VGAM149 precursor RNA is designated SEQ ID:135, and is provided hereinbelow with reference to the sequence listing part. Nucleotide sequence SEQ ID:135 is located at position 68772 relative to the genome of Shrimp White Spot Syndrome Virus (white spot bacilliform virus).

VGAM149 precursor RNA folds onto itself, forming VGAM149 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM149 folded precursor RNA into VGAM149 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM149 RNA is designated SEQ ID:2860, and is provided hereinbelow with reference to the sequence listing part.

VGAM149 host target gene, herein designated VGAM HOST TARGET GENE, encodes a corresponding messenger RNA, VGAM149 host target RNA, herein designated VGAM HOST TARGET RNA. VGAM149 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM149 RNA, herein designated VGAM RNA, binds complementarily to one or more host target binding sites located in untranslated regions of VGAM149 host target RNA, herein designated VGAM HOST TARGET RNA. This complementary binding is due to the fact that the nucleotide sequence of VGAM149 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM149 RNA, herein designated VGAM RNA, may have a different number of host target binding sites in untranslated regions of a VGAM149 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM149 RNA, herein designated VGAM RNA, to host target binding sites on VGAM149 host target RNA, herein designated VGAM HOST TARGET RNA, such as BINDING SITE I, BINDING SITE II and BINDING SITE III, inhibits translation of VGAM149 host target RNA into VGAM149 host target protein, herein designated VGAM HOST TARGET PROTEIN. VGAM host target protein is therefore outlined by a broken line.

It is appreciated that VGAM149 host target gene, herein designated VGAM HOST TARGET GENE, in fact represents a plurality of VGAM149 host target genes. The mRNA of each one of this plurality of VGAM149 host target genes comprises one or more host target binding sites, each having a nucleotide sequence which is at least partly complementary to VGAM149 RNA, herein designated VGAM RNA, and which when bound by VGAM149 RNA causes inhibition of translation of respective one or more VGAM149 host target proteins.

It is further appreciated by one skilled in the art that the mode of translational inhibition illustrated by FIG. 1 with specific reference to translational inhibition exerted by VGAM149 gene, herein designated VGAM GENE, on one or more VGAM149 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM149 is inhibition of expression of host target genes, as part of a novel viral mechanism of attacking a host. Accordingly, utilities of VGAM149 include diagnosis, prevention and treatment of viral infection by Shrimp White Spot Syndrome Virus (white spot bacilliform virus). Specific functions, and accordingly utilities, of VGAM149 correlate with, and may be deduced from, the identity of the host target genes which VGAM149 binds and inhibits, and the function of these host target genes, as elaborated hereinbelow.

Nucleotide sequences of the VGAM149 precursor RNA, herein designated VGAM PRECURSOR RNA, and of the 'diced' VGAM149 RNA, herein designated VGAM RNA, and a schematic representation of the secondary folding of VGAM149 folded precursor RNA, herein designated VGAM FOLDED PRECURSOR RNA, of VGAM149 are further described hereinbelow with reference to Table 1.

Nucleotide sequences of host target binding sites, such as BINDING SITE-I, BINDING SITE-II and BINDING SITE-III of FIG. 1, found on VGAM149 host target RNA, and schematic representation of the complementarity of each of these host target binding sites to VGAM149 RNA, herein designated VGAM RNA, are described hereinbelow with reference to Table 2.

As mentioned hereinabove with reference to FIG. 1, a function of VGAM149 gene, herein designated VGAM is inhibition of expression of VGAM149 target genes. It is appreciated that specific functions, and accordingly utilities, of VGAM149 correlate with, and may be deduced from, the identity of the target genes which VGAM149 binds and inhibits, and the function of these target genes, as elaborated hereinbelow.

Dual-specificity tyrosine-(Y)-phosphorylation Regulated Kinase 1A (DYRK1A, Accession NM_101395) is a VGAM149 host target gene. DYRK1A BINDING SITE is HOST TARGET binding site found in the 3' untranslated region of mRNA encoded by DYRK1A, corresponding to a HOST TARGET binding site such as BINDING SITE I, BINDING SITE II or BINDING SITE III. Table 2 illustrates the complementarity of the nucleotide sequences of DYRK1A BINDING SITE, designated SEQ ID:28159, to the nucleotide sequence of VGAM149 RNA, herein designated VGAM RNA, also designated SEQ ID:2860.

A function of VGAM149 is therefore inhibition of Dual-specificity tyrosine-(Y)-phosphorylation Regulated Kinase 1A (DYRK1A, Accession NM_101395), a gene which regulates cell proliferation and may be involved in brain development. Accordingly, utilities of VGAM149 include diagnosis, prevention and treatment of diseases and clinical conditions associated with DYRK1A. The function of DYRK1A and its association with various diseases and clinical conditions, has been established by previous studies, as described hereinabove with reference to VGAM42. Glucosaminyl (N-acetyl) Transferase 1, Core 2 (beta-1,6-N-acetylglucosaminyltransferase) (GCNT1, Accession NM_001490) is another VGAM149 host target gene. GCNT1 BINDING SITE is HOST TARGET binding site found in the 5' untranslated region of mRNA encoded by GCNT1, corresponding to a HOST TARGET binding site such as BINDING SITE I, BINDING SITE II or BINDING SITE III. Table 2 illustrates the complementarity of the nucleotide sequences of GCNT1 BINDING SITE, designated SEQ ID:7237, to the nucleotide sequence of VGAM149 RNA, herein designated VGAM RNA, also designated SEQ ID:2860.

Another function of VGAM149 is therefore inhibition of Glucosaminyl (N-acetyl) Transferase 1, Core 2 (beta-1,6-N-acetylglucosaminyltransferase) (GCNT1, Accession NM_001490), a gene which forms critical branches in o-glycans. Accordingly, utilities of VGAM149 include diagnosis, prevention and treatment of diseases and clinical conditions associated with GCNT1. The function of GCNT1 has been established by previous studies. Bierhuizen et al. (1993) provided the sequence of the developmental I antigen encoded by the cDNA for a member of a beta-1,6-N-acetylglucosaminyltransferase gene family. By Northern blot analysis, Yeh et al. (1999) showed that multiple transcripts of GCNT1 were expressed in nearly all tissues tested, whereas expression of GCNT3 (OMIM Ref. No. 606836) was more restricted. Transcripts were also readily detected in some leukemic cell lines and in colon and cervical carcinoma cell lines, but not in a lung carcinoma cell line.

Full details of the abovementioned studies are described in the following publications, the disclosure of which are hereby incorporated by reference:

Bierhuizen, M. F. A.; Mattei, M.-G.; Fukuda, M.: Expression of the developmental I antigen by a cloned human cDNA encoding a member of a beta-1,6-N-acetylglucosaminyltransferase gene family. Genes Dev. 7:468-478, 1993; and Pilz, A.; Woodward, K.; Povey, S.; Abbott, C.: Comparative mapping of 50 human chromosome 9 loci in the laboratory mouse. Genomics 25:139-149, 1995.

Further studies establishing the function and utilities of GCNT1 are found in John Hopkins OMIM database record ID 600391, and in sited publications numbered 1215 and 12157 listed in the bibliography section hereinbelow, which are also hereby incorporated by reference. Chromosome 22 Open Reading Frame 19 (C22orf19, Accession NM_003678) is another VGAM149 host target gene. C22orf19 BINDING SITE is HOST TARGET binding site found in the 3' untranslated region of mRNA encoded by C22orf19, corresponding to a HOST TARGET binding site such as BINDING SITE I, BINDING SITE II or BINDING SITE III. Table 2 illustrates the complementarity of the nucleotide sequences of C22orf19 BINDING SITE, designated SEQ ID:9772, to the nucleotide sequence of VGAM149 RNA, herein designated VGAM RNA, also designated SEQ ID:2860.

Another function of VGAM149 is therefore inhibition of Chromosome 22 Open Reading Frame 19 (C22orf19, Accession NM_003678). Accordingly, utilities of VGAM149 include diagnosis, prevention and treatment of diseases and clinical conditions associated with C22orf19. FLJ32332 (Accession NM_144641) is another VGAM149 host target gene. FLJ32332 BINDING SITE is HOST TARGET binding site found in the 3' untranslated region of mRNA encoded by FLJ32332, corresponding to a HOST TARGET binding site such as BINDING SITE I, BINDING SITE II or BINDING SITE III. Table 2 illustrates the complementarity of the nucleotide sequences of FLJ32332 BINDING SITE, designated SEQ ID:29466, to the nucleotide sequence of VGAM149 RNA, herein designated VGAM RNA, also designated SEQ ID:2860.

Another function of VGAM149 is therefore inhibition of FLJ32332 (Accession NM_144641). Accordingly, utilities of VGAM149 include diagnosis, prevention and treatment of diseases and clinical conditions associated with FLJ32332. FUS Interacting Protein (serine-arginine rich) 1 (FUSIP1, Accession NM_054016) is another VGAM149 host target gene. FUSIP1 BINDING SITE is HOST TARGET binding site found in the 3' untranslated region of mRNA encoded by FUSIP1, corresponding to a HOST TARGET binding site such as BINDING SITE I, BINDING SITE II or BINDING SITE III. Table 2 illustrates the complementarity of the nucleotide sequences of FUSIP1 BINDING SITE, designated SEQ ID:27622, to the nucleotide sequence of VGAM149 RNA, herein designated VGAM RNA, also designated SEQ ID:2860.

Another function of VGAM149 is therefore inhibition of FUS Interacting Protein (serine-arginine rich) 1 (FUSIP1, Accession NM_054016). Accordingly, utilities of VGAM149 include diagnosis, prevention and treatment of diseases and clinical conditions associated with FUSIP1. ORM1-like 2 (S. cerevisiae) (ORMDL2, Accession NM_014182) is another VGAM149 host target gene. ORMDL2 BINDING SITE is HOST TARGET binding site found in the 3' untranslated region of mRNA encoded by ORMDL2, corresponding to a HOST TARGET binding site such as BINDING SITE I, BINDING SITE II or BINDING SITE III. Table 2 illustrates the complementarity of the nucleotide sequences of ORMDL2 BINDING SITE, designated SEQ ID:15465, to the nucleotide sequence of VGAM149 RNA, herein designated VGAM RNA, also designated SEQ ID:2860.

Another function of VGAM149 is therefore inhibition of ORM1-like 2 (S. cerevisiae) (ORMDL2, Accession NM_014182). Accordingly, utilities of VGAM149 include diagnosis, prevention and treatment of diseases and clinical conditions associated with ORMDL2. RAI (Accession NM_006663) is another VGAM149 host target gene. RAI BINDING SITE is HOST TARGET binding site found in the 3' untranslated region of mRNA encoded by RAI, corresponding to a HOST TARGET binding site such as BINDING SITE I, BINDING SITE II or BINDING SITE III. Table 2 illustrates the complementarity of the nucleotide sequences of RAI BINDING SITE, designated SEQ ID:13466, to the nucleotide sequence of VGAM149 RNA, herein designated VGAM RNA, also designated SEQ ID:2860.

Another function of VGAM149 is therefore inhibition of RAI (Accession NM_006663). Accordingly, utilities of VGAM149 include diagnosis, prevention and treatment of diseases and clinical conditions associated with RAI. FIG. 1 further provides a conceptual description of a novel bioinformatically detected viral gene of the present invention, referred to here as Viral Genomic Address Messenger 150 (VGAM150) viral gene, which modulates expression of respective host target genes thereof, the function and utility of which host target genes is known in the art.

VGAM150 is a novel bioinformatically detected regulatory, non protein coding, viral micro RNA (miRNA) gene. The method by which VGAM150 was detected is described hereinabove with reference to FIGS. 1-8.

VGAM150 gene, herein designated VGAM GENE, is a viral gene contained in the genome of Shrimp White Spot Syndrome Virus (white spot bacilliform virus). VGAM150 host target gene, herein designated VGAM HOST TARGET GENE, is a human gene contained in the human genome.

VGAM150 gene encodes a VGAM150 precursor RNA, herein designated VGAM PRECURSOR RNA. Similar to other miRNA genes, and unlike most ordinary genes, VGAM150 precursor RNA does not encode a protein. A nucleotide sequence identical or highly similar to the nucleotide sequence of VGAM150 precursor RNA is designated SEQ ID:136, and is provided hereinbelow with reference to the sequence listing part. Nucleotide sequence SEQ ID:136 is located at position 59190 relative to the genome of Shrimp White Spot Syndrome Virus (white spot bacilliform virus).

VGAM150 precursor RNA folds onto itself, forming VGAM150 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM150 folded precursor RNA into VGAM150 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM150 RNA is designated SEQ ID:2861, and is provided hereinbelow with reference to the sequence listing part.

VGAM150 host target gene, herein designated VGAM HOST TARGET GENE, encodes a corresponding messenger RNA, VGAM150 host target RNA, herein designated VGAM HOST TARGET RNA. VGAM150 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM150 RNA, herein designated VGAM RNA, binds complementarily to one or more host target binding sites located in untranslated regions of VGAM150 host target RNA, herein designated VGAM HOST TARGET RNA. This complementary binding is due to the fact that the nucleotide sequence of VGAM150 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM150 RNA, herein designated VGAM RNA, may have a different number of host target binding sites in untranslated regions of a VGAM150 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM150 RNA, herein designated VGAM RNA, to host target binding sites on VGAM150 host target RNA, herein designated VGAM HOST TARGET RNA, such as BINDING SITE I, BINDING SITE II and BINDING SITE III, inhibits translation of VGAM150 host target RNA into VGAM150 host target protein, herein designated VGAM HOST TARGET PROTEIN. VGAM host target protein is therefore outlined by a broken line.

It is appreciated that VGAM150 host target gene, herein designated VGAM HOST TARGET GENE, in fact represents a plurality of VGAM150 host target genes. The mRNA of each one of this plurality of VGAM150 host target genes comprises one or more host target binding sites, each having a nucleotide sequence which is at least partly complementary to VGAM150 RNA, herein designated VGAM RNA, and which when bound by VGAM150 RNA causes inhibition of translation of respective one or more VGAM150 host target proteins.

It is further appreciated by one skilled in the art that the mode of translational inhibition illustrated by FIG. 1 with specific reference to translational inhibition exerted by VGAM150 gene, herein designated VGAM GENE, on one or more VGAM150 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM150 is inhibition of expression of host target genes, as part of a novel viral mechanism of attacking a host. Accordingly, utilities of VGAM150 include diagnosis, prevention and treatment of viral infection by Shrimp White Spot Syndrome Virus (white spot bacilliform virus). Specific functions, and accordingly utilities, of VGAM150 correlate with, and may be deduced from, the identity of the host target genes which VGAM150 binds and inhibits, and the function of these host target genes, as elaborated hereinbelow.

Nucleotide sequences of the VGAM150 precursor RNA, herein designated VGAM PRECURSOR RNA, and of the 'diced' VGAM150 RNA, herein designated VGAM RNA, and a schematic representation of the secondary folding of VGAM150 folded precursor RNA, herein designated VGAM FOLDED PRECURSOR RNA, of VGAM150 are further described hereinbelow with reference to Table 1.

Nucleotide sequences of host target binding sites, such as BINDING SITE-I, BINDING SITE-II and BINDING SITE-III of FIG. 1, found on VGAM150 host target RNA, and schematic representation of the complementarity of each of these host target binding sites to VGAM150 RNA, herein designated VGAM RNA, are described hereinbelow with reference to Table 2.

As mentioned hereinabove with reference to FIG. 1, a function of VGAM150 gene, herein designated VGAM is inhibition of expression of VGAM150 target genes. It is appreciated that specific functions, and accordingly utilities, of VGAM150 correlate with, and may be deduced from, the identity of the target genes which VGAM150 binds and inhibits, and the function of these target genes, as elaborated hereinbelow.

PRO1489 (Accession NM_018584) is a VGAM150 host target gene. PRO1489 BINDING SITE is HOST TARGET binding site found in the 3' untranslated region of mRNA encoded by PRO1489, corresponding to a HOST TARGET binding site such as BINDING SITE I, BINDING SITE II or BINDING SITE III. Table 2 illustrates the complementarity of the nucleotide sequences of PRO1489 BINDING SITE, designated SEQ ID:20661, to the nucleotide sequence of VGAM150 RNA, herein designated VGAM RNA, also designated SEQ ID:2861.

A function of VGAM150 is therefore inhibition of PRO1489 (Accession NM_018584). Accordingly, utilities of VGAM150 include diagnosis, prevention and treatment of diseases and clinical conditions associated with PRO1489. FIG. 1 further provides a conceptual description of a novel bioinformatically detected viral gene of the present invention, referred to here as Viral Genomic Address Messenger 151 (VGAM151) viral gene, which modulates expression of respective host target genes thereof, the function and utility of which host target genes is known in the art.

VGAM151 is a novel bioinformatically detected regulatory, non protein coding, viral micro RNA (miRNA) gene. The method by which VGAM151 was detected is described hereinabove with reference to FIGS. 1-8.

VGAM151 gene, herein designated VGAM GENE, is a viral gene contained in the genome of Shrimp White Spot Syndrome Virus (white spot bacilliform virus). VGAM151 host target gene, herein designated VGAM HOST TARGET GENE, is a human gene contained in the human genome.

VGAM151 gene encodes a VGAM151 precursor RNA, herein designated VGAM PRECURSOR RNA. Similar to other miRNA genes, and unlike most ordinary genes, VGAM151 precursor RNA does not encode a protein. A nucleotide sequence identical or highly similar to the nucleotide sequence of VGAM151 precursor RNA is designated SEQ ID:137, and is provided hereinbelow with reference to the sequence listing part. Nucleotide sequence SEQ ID:137 is located at position 141707 relative to the genome of Shrimp White Spot Syndrome Virus (white spot bacilliform virus).

VGAM151 precursor RNA folds onto itself, forming VGAM151 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM151 folded precursor RNA into VGAM151 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM151 RNA is designated SEQ ID:2862, and is provided hereinbelow with reference to the sequence listing part.

VGAM151 host target gene, herein designated VGAM HOST TARGET GENE, encodes a corresponding messenger RNA, VGAM151 host target RNA, herein designated VGAM HOST TARGET RNA. VGAM151 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM151 RNA, herein designated VGAM RNA, binds complementarily to one or more host target binding sites located in untranslated regions of VGAM151 host target RNA, herein designated VGAM HOST TARGET RNA. This complementary binding is due to the fact that the nucleotide sequence of VGAM151 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM151 RNA, herein designated VGAM RNA, may have a different number of host target binding sites in untranslated regions of a VGAM151 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM151 RNA, herein designated VGAM RNA, to host target binding sites on VGAM151 host target RNA, herein designated VGAM HOST TARGET RNA, such as BINDING SITE I, BINDING SITE II and BINDING SITE III, inhibits translation of VGAM151 host target RNA into VGAM151 host target protein, herein designated VGAM HOST TARGET PROTEIN. VGAM host target protein is therefore outlined by a broken line.

It is appreciated that VGAM151 host target gene, herein designated VGAM HOST TARGET GENE, in fact represents a plurality of VGAM151 host target genes. The mRNA of each one of this plurality of VGAM151 host target genes comprises one or more host target binding sites, each having a nucleotide sequence which is at least partly complementary to VGAM151 RNA, herein designated VGAM RNA, and which when bound by VGAM151 RNA causes inhibition of translation of respective one or more VGAM151 host target proteins.

It is further appreciated by one skilled in the art that the mode of translational inhibition illustrated by FIG. 1 with specific reference to translational inhibition exerted by VGAM151 gene, herein designated VGAM GENE, on one or more VGAM151 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM151 is inhibition of expression of host target genes, as part of a novel viral mechanism of attacking a host. Accordingly, utilities of VGAM151 include diagnosis, prevention and treatment of viral infection by Shrimp White Spot Syndrome Virus (white spot bacilliform virus). Specific functions, and accordingly utilities, of VGAM151 correlate with, and may be deduced from, the identity of the host target genes which VGAM151 binds and inhibits, and the function of these host target genes, as elaborated hereinbelow.

Nucleotide sequences of the VGAM151 precursor RNA, herein designated VGAM PRECURSOR RNA, and of the 'diced' VGAM151 RNA, herein designated VGAM RNA, and a schematic representation of the secondary folding of VGAM151 folded precursor RNA, herein designated VGAM FOLDED PRECURSOR RNA, of VGAM151 are further described hereinbelow with reference to Table 1.

Nucleotide sequences of host target binding sites, such as BINDING SITE-I, BINDING SITE-II and BINDING SITE-III of FIG. 1, found on VGAM151 host target RNA, and schematic representation of the complementarity of each of these host target binding sites to VGAM151 RNA, herein designated VGAM RNA, are described hereinbelow with reference to Table 2.

As mentioned hereinabove with reference to FIG. 1, a function of VGAM151 gene, herein designated VGAM is inhibition of expression of VGAM151 target genes. It is appreciated that specific functions, and accordingly utilities, of VGAM151 correlate with, and may be deduced from, the identity of the target genes which VGAM151 binds and inhibits, and the function of these target genes, as elaborated hereinbelow.

PACE (Accession NM_002569) is a VGAM151 host target gene. PACE BINDING SITE is HOST TARGET binding site found in the 3' untranslated region of mRNA encoded by PACE, corresponding to a HOST TARGET binding site such as BINDING SITE I, BINDING SITE II or BINDING SITE III. Table 2 illustrates the complementarity of the nucleotide sequences of PACE BINDING SITE, designated SEQ ID:8424, to the nucleotide sequence of VGAM151 RNA, herein designated VGAM RNA, also designated SEQ ID:2862.

A function of VGAM151 is therefore inhibition of PACE (Accession NM_002569), a gene which processes pro-parathyroid hormone, pro-transforming growth factor beta. Accordingly, utilities of VGAM151 include diagnosis, prevention and treatment of diseases and clinical conditions associated with PACE. The function of PACE has been established by previous studies. Roebroek et al. (1986) described DNA sequences in the immediate upstream region from the FES oncogene (OMIM Ref. No. 190030). They designated this FUR (for FES upstream region) and showed that in both man and cat the sequence codes for a 4.5-kb mRNA. The nucleotide sequence of a 3.1-kb FUR-specific cDNA isolated from a human cDNA library showed an open reading frame of 1,498 bp from which the 499 carboxy-terminal amino acids of the primary FUR translation product could be deduced. Computer analysis indicated that this product, called furin, contained a possible transmembrane domain resembling that of class II MHC antigens. Roebroek et al. (1986) concluded that FUR may encode a membrane-associated protein with a recognition function. From the location of the FES gene, one can conclude that FUR is located in the region 15q25-q26. The 2 sequences are separated by less than 1.1 kb, and the direction of transcription of the 2 is the same. Studying its expression by Northern blot analysis using poly (A)-selected RNA from a variety of organs, Schalken et al. (1987) found that the FUR gene is differentially expressed, being high in organs such as liver and kidney and very low in others such as heart muscle, lung, and testis. FUR expression discriminated sharply between small cell lung cancers, which had no expression, and nonsmall cell lung cancers, which had strong elevation of expression. Hendy et al. (1995) reported experiments strongly suggesting that furin is the enzyme responsible for the physiologic processing of proparathyroid hormone to PTH (OMIM Ref. No. 168450). Dubois et al. (1995) demonstrated in vitro that pro-TGFB1 (see OMIM Ref. No. 190180) was cleaved by furin to produce a biologically active TGFB1 protein. Expression of pro-TGFB1 in furin-deficient cells produced no TGFB1, while coexpression of pro-TGFB1 and furin led to processing of the precursor. Blanchette et al. (1997) showed that furin mRNA levels were increased in rat synovial cells by the addition of TGFB1. This effect was eliminated by pretreatment with actinomycin-D, suggesting to them that regulation was at the gene transcriptional level. Treatment of rat synoviocytes and kidney fibroblasts with TGFB1 or TGFB2 resulted in increased pro-TGFB1 processing, as evidenced by the appearance of a 40-kD immunoreactive band corresponding to the TGFB1 amino-terminal pro-region. Treatment of these cells with TGFB2 resulted in a significant increase in extracellular mature TGFB1. Blanchette et al. (1997) concluded that TGFB1 upregulates gene expression of its own converting enzyme.

Full details of the abovementioned studies are described in the following publications, the disclosure of which are hereby incorporated by reference:

Schalken, J. A.; Roebroek, A. J. M.; Oomen, P. P. C. A.; Wagenaar, S. S.; Debruyne, F. M. J.; Bloemers, H. P. J.; Van de Ven, W. J. M.: FUR gene expression as a discriminating marker for small cell and nonsmall cell lung carcinomas. J. Clin. Invest. 80:1545-1549, 1987; and Blanchette, F.; Day, R.; Dong, W.; Laprise, M.-H.; Dubois, C. M.: TGF-beta-1 regulates gene expression of its own converting enzyme furin. J. Clin. Invest. 99:1974-1983, 1997.

Further studies establishing the function and utilities of PACE are found in John Hopkins OMIM database record ID 136950, and in sited publications numbered 3576-3583 listed in the bibliography section hereinbelow, which are also hereby incorporated by reference. FLJ13241 (Accession NM_025088) is another VGAM151 host target gene. FLJ13241 BINDING SITE is HOST TARGET binding site found in the 3' untranslated region of mRNA encoded by FLJ13241, corresponding to a HOST TARGET binding site such as BINDING SITE I, BINDING SITE II or BINDING SITE III. Table 2 illustrates the complementarity of the nucleotide sequences of FLJ13241 BINDING SITE, designated SEQ ID:24707, to the nucleotide sequence of VGAM151 RNA, herein designated VGAM RNA, also designated SEQ ID:2862.

Another function of VGAM151 is therefore inhibition of FLJ13241 (Accession NM_025088). Accordingly, utilities of VGAM151 include diagnosis, prevention and treatment of diseases and clinical conditions associated with FLJ13241. KIAA0546 (Accession XM_049055) is another VGAM151 host target gene. KIAA0546 BINDING SITE is HOST TARGET binding site found in the 3' untranslated region of mRNA encoded by KIAA0546, corresponding to a HOST TARGET binding site such as BINDING SITE I, BINDING SITE II or BINDING SITE III. Table 2 illustrates the complementarity of the nucleotide sequences of KIAA0546 BINDING SITE, designated SEQ ID:35331, to the nucleotide sequence of VGAM151 RNA, herein designated VGAM RNA, also designated SEQ ID:2862.

Another function of VGAM151 is therefore inhibition of KIAA0546 (Accession XM_049055). Accordingly, utilities of VGAM151 include diagnosis, prevention and treatment of diseases and clinical conditions associated with KIAA0546. KIAA1449 (Accession NM_020839) is another VGAM151 host target gene. KIAA1449 BINDING SITE is HOST TARGET binding site found in the 3' untranslated region of mRNA encoded by KIAA1449, corresponding to a HOST TARGET binding site such as BINDING SITE I, BINDING SITE II or BINDING SITE III. Table 2 illustrates the complementarity of the nucleotide sequences of KIAA1449 BINDING SITE, designated SEQ ID:21898, to the nucleotide sequence of VGAM151 RNA, herein designated VGAM RNA, also designated SEQ ID:2862.

Another function of VGAM151 is therefore inhibition of KIAA1449 (Accession NM_020839). Accordingly, utilities of VGAM151 include diagnosis, prevention and treatment of diseases and clinical conditions associated with KIAA1449. LOC113523 (Accession XM_054378) is another VGAM151 host target gene. LOC113523 BINDING SITE is HOST TARGET binding site found in the 3' untranslated region of mRNA encoded by LOC113523, corresponding to a HOST TARGET binding site such as BINDING SITE I, BINDING SITE II or BINDING SITE III. Table 2 illustrates the complementarity of the nucleotide sequences of LOC113523 BINDING SITE, designated SEQ ID:36151, to the nucleotide sequence of VGAM151 RNA, herein designated VGAM RNA, also designated SEQ ID:2862.

Another function of VGAM151 is therefore inhibition of LOC113523 (Accession XM_054378). Accordingly, utilities of VGAM151 include diagnosis, prevention and treatment of diseases and clinical conditions associated with LOC113523. LOC133584 (Accession XM_059661) is another VGAM151 host target gene. LOC133584 BINDING SITE is HOST TARGET binding site found in the 5' untranslated region of mRNA encoded by LOC133584, corresponding to a HOST TARGET binding site such as BINDING SITE I, BINDING SITE II or BINDING SITE III. Table 2 illustrates the complementarity of the nucleotide sequences of LOC133584 BINDING SITE, designated SEQ ID:37045, to the nucleotide sequence of VGAM151 RNA, herein designated VGAM RNA, also designated SEQ ID:2862.

Another function of VGAM151 is therefore inhibition of LOC133584 (Accession XM_059661). Accordingly, utilities of VGAM151 include diagnosis, prevention and treatment of diseases and clinical conditions associated with LOC133584. FIG. 1 further provides a conceptual description of a novel bioinformatically detected viral gene of the present invention, referred to here as Viral Genomic Address Messenger 152 (VGAM152) viral gene, which modulates expression of respective host target genes thereof, the function and utility of which host target genes is known in the art.

VGAM152 is a novel bioinformatically detected regulatory, non protein coding, viral micro RNA (miRNA) gene. The method by which VGAM152 was detected is described hereinabove with reference to FIGS. 1-8.

VGAM152 gene, herein designated VGAM GENE, is a viral gene contained in the genome of Shrimp White Spot Syndrome Virus (white spot bacilliform virus). VGAM152 host target gene, herein designated VGAM HOST TARGET GENE, is a human gene contained in the human genome.

VGAM152 gene encodes a VGAM152 precursor RNA, herein designated VGAM PRECURSOR RNA. Similar to other miRNA genes, and unlike most ordinary genes, VGAM152 precursor RNA does not encode a protein. A nucleotide sequence identical or highly similar to the nucleotide sequence of VGAM152 precursor RNA is designated SEQ ID:138, and is provided hereinbelow with reference to the sequence listing part. Nucleotide sequence SEQ ID138 is located at position 36222 relative to the genome of Shrimp White Spot Syndrome Virus (white spot bacilliform virus).

VGAM152 precursor RNA folds onto itself, forming VGAM152 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM152 folded precursor RNA into VGAM152 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM152 RNA is designated SEQ ID:2863, and is provided hereinbelow with reference to the sequence listing part.

VGAM152 host target gene, herein designated VGAM HOST TARGET GENE, encodes a corresponding messenger RNA, VGAM152 host target RNA, herein designated VGAM HOST TARGET RNA. VGAM152 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM152 RNA, herein designated VGAM RNA, binds complementarily to one or more host target binding sites located in untranslated regions of VGAM152 host target RNA, herein designated VGAM HOST TARGET RNA. This complementary binding is due to the fact that the nucleotide sequence of VGAM152 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM152 RNA, herein designated VGAM RNA, may have a different number of host target binding sites in untranslated regions of a VGAM152 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM152 RNA, herein designated VGAM RNA, to host target binding sites on VGAM152 host target RNA, herein designated VGAM HOST TARGET RNA, such as BINDING SITE I, BINDING SITE II and BINDING SITE III, inhibits translation of VGAM152 host target RNA into VGAM152 host target protein, herein designated VGAM HOST TARGET PROTEIN. VGAM host target protein is therefore outlined by a broken line.

It is appreciated that VGAM152 host target gene, herein designated VGAM HOST TARGET GENE, in fact represents a plurality of VGAM152 host target genes. The mRNA of each one of this plurality of VGAM152 host target genes comprises one or more host target binding sites, each having a nucleotide sequence which is at least partly complementary to VGAM152 RNA, herein designated VGAM RNA, and which when bound by VGAM152 RNA causes inhibition of translation of respective one or more VGAM152 host target proteins.

It is further appreciated by one skilled in the art that the mode of translational inhibition illustrated by FIG. 1 with specific reference to translational inhibition exerted by VGAM152 gene, herein designated VGAM GENE, on one or more VGAM152 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM152 is inhibition of expression of host target genes, as part of a novel viral mechanism of attacking a host. Accordingly, utilities of VGAM152 include diagnosis, prevention and treatment of viral infection by Shrimp White Spot Syndrome Virus (white spot bacilliform virus). Specific functions, and accordingly utilities, of VGAM152 correlate with, and may be deduced from, the identity of the host target genes which VGAM152 binds and inhibits, and the function of these host target genes, as elaborated hereinbelow.

Nucleotide sequences of the VGAM152 precursor RNA, herein designated VGAM PRECURSOR RNA, and of the 'diced' VGAM152 RNA, herein designated VGAM RNA, and a schematic representation of the secondary folding of VGAM152 folded precursor RNA, herein designated VGAM FOLDED PRECURSOR RNA, of VGAM152 are further described hereinbelow with reference to Table 1.

Nucleotide sequences of host target binding sites, such as BINDING SITE-I, BINDING SITE-II and BINDING SITE-III of FIG. 1, found on VGAM152 host target RNA, and schematic representation of the complementarity of each of these host target binding sites to VGAM152 RNA, herein designated VGAM RNA, are described hereinbelow with reference to Table 2.

As mentioned hereinabove with reference to FIG. 1, a function of VGAM152 gene, herein designated VGAM is inhibition of expression of VGAM152 target genes. It is appreciated that specific functions, and accordingly utilities, of VGAM152 correlate with, and may be deduced from, the identity of the target genes which VGAM152 binds and inhibits, and the function of these target genes, as elaborated hereinbelow.

Apical Protein-like (Xenopus laevis) (APXL, Accession NM_001649) is a VGAM152 host target gene. APXL BINDING SITE is HOST TARGET binding site found in the 3' untranslated region of mRNA encoded by APXL, corresponding to a HOST TARGET binding site such as BINDING SITE I, BINDING SITE II or BINDING SITE III. Table 2 illustrates the complementarity of the nucleotide sequences of APXL BINDING SITE, designated SEQ ID:7354, to the nucleotide sequence of VGAM152 RNA, herein designated VGAM RNA, also designated SEQ ID:2863.

A function of VGAM152 is therefore inhibition of Apical Protein-like (Xenopus laevis) (APXL, Accession NM_001649), a gene which is implicated in amiloride-sensitive sodium channel activity. Accordingly, utilities of VGAM152 include diagnosis, prevention and treatment of diseases and clinical conditions associated with APXL. The function of APXL has been established by previous studies. APXL is a human homolog of the Xenopus laevis APX gene which is implicated in amiloride-sensitive sodium channel activity (Schiaffino et al., 1995). The gene contains 10 exons and spans approximately 160 kb of Xp22.3 in the ocular albinism type 1 (OA1; 300500) critical region. The full-length mRNA is approximately 7.5 kb, and Schiaffino et al. (1995) isolated several clones from a retinal cDNA library that corresponded to this mRNA. The authors found that, along with retina, the gene is expressed in melanoma cells, brain, placenta, lung, kidney, and pancreas. The protein is 1,616 amino acids in length. APXL was deleted in 2 patients with contiguous gene syndromes including OA1 and in 1 patient with isolated OA1. Comparative mapping of the X chromosome in eutherian mammals has revealed distinct regions of conservation as well as evolutionary rearrangements between human and mouse. Dinulos et al. (1996) mapped the murine homologs of OA1 and APXL. They found that the 2 genes map to bands F2-F3 in both M. spretus and the laboratory strains C57BL/6J, defining a new rearrangement between human and mouse X chromosomes.

Full details of the abovementioned studies are described in the following publications, the disclosure of which are hereby incorporated by reference:

Dinulos, M. B.; Bassi, M. T.; Rugarli, E. I.; Chapman, V.; Ballabio, A.; Disteche, C. M.: A new region of conservation is defined between human and mouse X chromosomes. Genomics 35:244-247, 1996; and Schiaffino, M. V.; Bassi, M. T.; Rugarli, E. I.; Renieri, A.; Galli, L.; Ballabio, A.: Cloning of a human homologue of the Xenopus laevis APX gene from the ocular albinism type 1 criti.

Further studies establishing the function and utilities of APXL are found in John Hopkins OMIM database record ID 300103, and in sited publications numbered 8797-8798 listed in the bibliography section hereinbelow, which are also hereby incorporated by reference. ATPase, Na+/K+ Transporting, Beta 2 Polypeptide (ATP1B2, Accession NM_001678) is another VGAM152 host target gene. ATP1B2 BINDING SITE is HOST TARGET binding site found in the 3' untranslated region of mRNA encoded by ATP1B2, corresponding to a HOST TARGET binding site such as BINDING SITE I, BINDING SITE II or BINDING SITE III. Table 2 illustrates the complementarity of the nucleotide sequences of ATP1B2 BINDING SITE, designated SEQ ID:7392, to the nucleotide sequence of VGAM152 RNA, herein designated VGAM RNA, also designated SEQ ID:2863.

Another function of VGAM152 is therefore inhibition of ATPase, Na+/K+ Transporting, Beta 2 Polypeptide (ATP1B2, Accession NM_001678), a gene which catalyzes the hydrolysis of ATP coupled with the exchange of Na +/K+ ions across the plasma membrane. Accordingly, utilities of VGAM152 include diagnosis, prevention and treatment of diseases and clinical conditions associated with ATP1B2. The function of ATP1B2 has been established by previous studies. In the mouse, Malo et al. (1990) mapped the beta-2 subunit of sodium-potassium-ATPase to chromosome 11 in a segment that is conserved on the pericentromeric region of human chromosome 17. Thus, Malo et al. (1990) speculated that the human ATP1B2 gene is on the proximal short arm or pericentric area of chromosome 17. By somatic cell hybrid analysis, Hsieh et al. (1990) demonstrated that the gene is indeed located on human chromosome 17 and confirmed the assignment to mouse chromosome 11, They referred to the gene as AMOG (adhesion molecule on glia). The adhesion molecule on glia is an integral membrane glycoprotein of MW 45-50 K that is expressed by glial cells and mediates granule neuron migration along Bergmann glial cells in the developing cerebellum. The cDNA sequence of the mouse gene (Pagliusi et al., 1989) shows structural similarity to the beta subunit of Na, K-ATPase (ATP1B1; 182330). This enzyme consists of 2 subunits: a catalytic alpha subunit and a beta subunit of unknown function. Like ATP1B1, AMOG is molecularly associated with the alpha subunit and influences its catalytic activity. AMOG may be the same as what is referred to here as ATP1B2. Another beta-isoform gene expressed primarily in brain was isolated by Martin-Vasallo et al. (1989); its sequence is 97% identical to that for AMOG (Gloor et al., 1990). By study of recombinant inbred strains, Hsieh et al. (1990) placed the Amog locus close to the genes for zinc finger protein-3 (OMIM Ref. No. 194480) and the asialoglycoprotein receptor (108360, 108361) in a region of mouse chromosome 11 that is homologous to human 17p.

Full details of the abovementioned studies are described in the following publications, the disclosure of which are hereby incorporated by reference:

Gloor, S.; Antonicek, H.; Sweadner, K. J.; Pagliusi, S.; Frank, R.; Moos, M.; Schachner, M.: The adhesion molecule on glia (AMOG) is a homologue of the beta subunit of the Na, K-ATPase. J. Cell Biol. 110:165-174, 1990; and Martin-Vasallo, P.; Dackowski, P.; Emanuel, J. R.; Levenson, R.: Identification of a putative isoform of the Na, K-ATPase beta subunit: primary structure and tissue-specific expression.

Further studies establishing the function and utilities of ATP1B2 are found in John Hopkins OMIM database record ID 182331, and in sited publications numbered 12450-12454 listed in the bibliography section hereinbelow, which are also hereby incorporated by reference. Core-binding Factor, Runt Domain, Alpha Subunit 2; Translocated To, 2 (CBFA2T2, Accession NM_005093) is another VGAM152 host target gene. CBFA2T2 BINDING SITE is HOST TARGET binding site found in the 3' untranslated region of mRNA encoded by CBFA2T2, corresponding to a HOST TARGET binding site such as BINDING SITE I, BINDING SITE II or BINDING SITE III. Table 2 illustrates the complementarity of the nucleotide sequences of CBFA2T2 BINDING SITE, designated SEQ ID:11548, to the nucleotide sequence of VGAM152 RNA, herein designated VGAM RNA, also designated SEQ ID:2863.

Another function of VGAM152 is therefore inhibition of Core-binding Factor, Runt Domain, Alpha Subunit 2; Translocated To, 2 (CBFA2T2, Accession NM_005093), a gene which is a putative transcription factor. Accordingly, utilities of VGAM152 include diagnosis, prevention and treatment of diseases and clinical conditions associated with CBFA2T2. The function of CBFA2T2 has been established by previous studies. To identify potential new genes homologous to ETO (OMIM Ref. No. 133435), Fracchiolla et al. (1998) screened the EST database using the entire ETO cDNA sequence as a probe. Among the ESTs identified, they selected 2 overlapping clones and sequenced them to completion. A putative translation initiation site was identified by the presence of a strong Kozak consensus sequence, followed by a 1,725-bp open reading frame coding for a putative protein of 575 amino acids. They named this gene EHT for 'ETO homolog on chromosome twenty.' The putative EHT protein is approximately 65% identical to ETO/MTG8 (OMIM Ref. No. 133435) and approximately 24% identical to an ETO Drosophila homolog, Nervy. Kitabayashi et al. (1998) reported the cloning of a similar cDNA, which they named MTGR1 (myeloid translocation gene-related protein-1). Their data suggested the presence of 2 alternative 5-prime ends of the MTGR1/EHT gene. Cytogenetic studies had shown that the 20q11 region is deleted in approximately 10% of cases of polycythemia vera, approximately 5% of cases of myelodysplastic syndromes, and approximately 3% of cases of acute myeloid leukemias. Kitabayashi et al. (1998) showed the direct interaction of MTGR1 in the AML1-MTG8 fusion protein, leading to an enhancement of cell proliferation mediated by granulocyte colony-stimulating factor (CSF3; 138970) in a murine myeloid model. This suggested that MTGR1 has an oncogenic rather than a tumor suppressor activity. Nevertheless, when MTGR1 was transfected alone into the same murine myeloid model cell line, the proliferative response to CSF was lower than that in the normal control, thus suggesting a possible negative growth control in normal cells.

Full details of the abovementioned studies are described in the following publications, the disclosure of which are hereby incorporated by reference:

Fracchiolla, N. S.; Colombo, G.; Finelli, P.; Maiolo, A. T.; Neri, A.: EHT, a new member of the MTG8/ETO gene family, maps on 20q11 region and is deleted in acute myeloid leukemias. (Letter) Blood 92:3481-3484, 1998; and Kitabayashi, I.; Ida, K.; Morohoshi, F.; Yokoyama, A.; Mitsuhashi, N.; Shimizu, K.; Nomura, N.; Hayashi, Y.; Ohki, M.: The AML1-MTG8 leukemic fusion protein forms a complex with a novel.

Further studies establishing the function and utilities of CBFA2T2 are found in John Hopkins OMIM database record ID 603672, and in sited publications numbered 344 and 8659-8660 listed in the bibliography section hereinbelow, which are also hereby incorporated by reference. Cartilage Associated Protein (CRTAP, Accession NM_006371) is another VGAM152 host target gene. CRTAP BINDING SITE is HOST TARGET binding site found in the 3' untranslated region of mRNA encoded by CRTAP, corresponding to a HOST TARGET binding site such as BINDING SITE I, BINDING SITE II or BINDING SITE III. Table 2 illustrates the complementarity of the nucleotide sequences of CRTAP BINDING SITE, designated SEQ ID:13061, to the nucleotide sequence of VGAM152 RNA, herein designated VGAM RNA, also designated SEQ ID:2863.

Another function of VGAM152 is therefore inhibition of Cartilage Associated Protein (CRTAP, Accession NM_006371), a gene which is a novel developmentally regulated chick embryo protein. Accordingly, utilities of VGAM152 include diagnosis, prevention and treatment of diseases and clinical conditions associated with CRTAP. The function of CRTAP has been established by previous studies. Castagnola et al. (1997) isolated a mouse Crtap cDNA from a subtracted library specific for mRNAs highly expressed in hypertrophic chondrocytes compared to proliferating and early differentiating chondrocytes. Using a mouse Crtap clone to screen a human fetal brain cDNA library, Tonachini et al. (1999) identified human CRTAP cDNA clones. Human CRTAP encodes a deduced 401-amino acid protein with a a putative signal peptide of 26 amino acids. CRTAP contains 2 potential N-glycosylation signals. CRTAP shares 89% amino acid sequence identity with mouse Crtap and 51% identity with the chick homolog. The mouse and human genes contain a C-terminal region of approximately 120 amino acids not present in the chick protein Using Northern blot analysis of human tissues, Tonachini et al. (1999) detected 2-kb and 4-kb CRTAP transcripts in brain, heart, kidney, lung, small intestine, and skeletal muscle. In all tissues except brain, the 2-kb transcript was more abundant. Using immunohistochemistry, the authors detected CRTAP expression in articular chondrocytes. In mouse, Morello et al. (1999) detected 3 Crtap transcripts in a range of tissues, including all mouse embryonic cartilages. In chick, Castagnola et al. (1997) detected a single Crtap transcript in a broad range of embryonic tissues with the strongest expression in the developing cartilage. They detected expression in the extracellular matrix of the forming cartilage surrounding the notochord, the developing sclera, the sphenoid and mandibular cartilage, the long bone cartilage, and the developing sternal cartilage Full details of the abovementioned studies are described in the following publications, the disclosure of which are hereby incorporated by reference:

Castagnola, P.; Gennari, M.; Morello, R.; Tonachini, L.; Marin, O.; Gaggero, A.; Cancedda, R.: Cartilage associated protein (CASP) is a novel developmentally regulated chick embryo protein. J. Cell Sci. 110:1351-1359, 1997; and Morello, R.; Tonachini, L.; Monticone, M.; Viggiano, L.; Rocchi, M.; Cancedda, R.; Castagnola, P.: cDNA cloning, characterization and chromosome mapping of Crtap encoding the mouse carti.

Further studies establishing the function and utilities of CRTAP are found in John Hopkins OMIM database record ID 605497, and in sited publications numbered 6396-6398 listed in the bibliography section hereinbelow, which are also hereby incorporated by reference. Eukaryotic Translation Initiation Factor 2C, 1 (EIF2C1, Accession NM_012199) is another VGAM152 host target gene. EIF2C1 BINDING SITE is HOST TARGET binding site found in the 3' untranslated region of mRNA encoded by EIF2C1, corresponding to a HOST TARGET binding site such as BINDING SITE I, BINDING SITE II or BINDING SITE III. Table 2 illustrates the complementarity of the nucleotide sequences of EIF2C1 BINDING SITE, designated SEQ ID:14499, to the nucleotide sequence of VGAM152 RNA, herein designated VGAM RNA, also designated SEQ ID:2863.

Another function of VGAM152 is therefore inhibition of Eukaryotic Translation Initiation Factor 2C, 1 (EIF2C1, Accession NM_012199), a gene which plays an important role in the eukaryotic peptide chain initiation process. Accordingly, utilities of VGAM152 include diagnosis, prevention and treatment of diseases and clinical conditions associated with EIF2C1. The function of EIF2C1 and its association with various diseases and clinical conditions, has been established by previous studies, as described hereinabove with reference to VGAM118. Guanine Nucleotide Binding Protein (G protein), Beta Polypeptide 3 (GNB3, Accession NM_002075) is another VGAM152 host target gene. GNB3 BINDING SITE is HOST TARGET binding site found in the 5' untranslated region of mRNA encoded by GNB3, corresponding to a HOST TARGET binding site such as BINDING SITE I, BINDING SITE II or BINDING SITE III. Table 2 illustrates the complementarity of the nucleotide sequences of GNB3 BINDING SITE, designated SEQ ID:7853, to the nucleotide sequence of VGAM152 RNA, herein designated VGAM RNA, also designated SEQ ID:2863.

Another function of VGAM152 is therefore inhibition of Guanine Nucleotide Binding Protein (G protein), Beta Polypeptide 3 (GNB3, Accession NM_002075), a gene which transduces signals from G protein-coupled receptors to intracellular effectors. Accordingly, utilities of VGAM152 include diagnosis, prevention and treatment of diseases and clinical conditions associated with GNB3. The function of GNB3 has been established by previous studies. Levine et al. (1990) cloned a third form of the G protein beta-subunit polypeptide distinct from the 36-kD form (GNB1; 139380) and the 35-kD form (GNB2; 139390). The GNB3 cDNA corresponded to a 2.0-kb mRNA expressed in all tissues and clonal cell lines examined. The encoded peptide consisted of 340 amino acid residues. Modi et al. (1989) mapped the GNB3 gene to 12p13 by use of somatic cell hybrids and in situ hybridization. Levine et al. (1990) mapped the gene to 12pter-p12.3 by Southern analysis of somatic cell hybrids and by in situ hybridization. Siffert et al. (1995) and Pietruck et al. (1996) demonstrated an enhanced signal transduction via pertussis toxin-sensitive G proteins in lymphoblasts and fibroblasts from selected patients with essential hypertension. They speculated that structural changes in the alpha, beta, or gamma subunit of heterotrimeric G proteins could be responsible for the enhanced G-protein reactivity in hypertensive cells. In studies of the GNB3 gene, they demonstrated an 825C-T polymorphism. Although the polymorphism did not affect the amino acid sequence of the beta-3 subunit, the T allele was associated with deletion of nucleotides 498-620 of exon 9 (139130.0001). This was found to be an example of alternative splicing caused by a nucleotide change outside the splice donor and acceptor sites. Other examples include the alternative splicing of the platelet membrane glycoprotein IIIa, as reported by Jin et al. (1996), in Glanzmann thrombasthenia (OMIM Ref. No. 273800), in the human growth hormone receptor (OMIM Ref. No. 600946) by Stallings-Mann et al. (1996), and in the fibrillin-1 gene (OMIM Ref. No. 134797) in Marfan syndrome by Liu et al. (1997).

Full details of the abovementioned studies are described in the following publications, the disclosure of which are hereby incorporated by reference:

Levine, M. A.; Modi, W. S.; O'Brien, S. J.: Chromosomal localization of the genes encoding two forms of the G-protein beta polypeptide, beta-1 and beta-3, in man. Genomics 8:380-386, 1990; and Siffert, W.; Rosskopf, D.; Moritz, A.; Wieland, T.; Kaldenberg-Stasch, S.; Kettler, N.; Hartung, K.; Beckmann, S.; Jakobs, K. H.: Enhanced G protein activation in immortalized lymphobl.

Further studies establishing the function and utilities of GNB3 are found in John Hopkins OMIM database record ID 139130, and in sited publications numbered 471 and 4715-4727 listed in the bibliography section hereinbelow, which are also hereby incorporated by reference. 5-hydroxytryptamine (serotonin) Receptor 1D (HTR1D, Accession NM_000864) is another VGAM152 host target gene. HTR1D BINDING SITE is HOST TARGET binding site found in the 3' untranslated region of mRNA encoded by HTR1D, corresponding to a HOST TARGET binding site such as BINDING SITE I, BINDING SITE II or BINDING SITE III. Table 2 illustrates the complementarity of the nucleotide sequences of HTR1D BINDING SITE, designated SEQ ID:6529, to the nucleotide sequence of VGAM152 RNA, herein designated VGAM RNA, also designated SEQ ID:2863.

Another function of VGAM152 is therefore inhibition of 5-hydroxytryptamine (serotonin) Receptor 1D (HTR1D, Accession NM_000864), a gene which belongs to g-protein coupled receptor. Accordingly, utilities of VGAM152 include diagnosis, prevention and treatment of diseases and clinical conditions associated with HTR1D. The function of HTR1D has been established by previous studies. The serotonin 1D receptor was initially characterized by radioligand binding procedures using membranes derived from bovine caudate nucleus. The 5-HT-1D receptor is known to be a G protein-coupled receptor. Sumatriptan, an agent effective in the treatment of acute migraine, is the only ligand yet identified that is selective for the 5-HT-1D receptor. Weinshank et al. (1992) reported the cloning, deduced amino acid sequences, pharmacologic properties, and second-messenger coupling of a pair of human 5-HT-1D receptor genes, which they designated alpha and beta due to their strong similarities. Both genes have no introns in their coding regions, are expressed in the human cerebral cortex, and can couple to inhibition of adenylate cyclase activity. Their pharmacologic binding properties match closely those of human, bovine, and guinea pig 5-HT-1D sites. Libert et al. (1991) obtained cDNA clones encoding 4 receptors of the G protein-coupled receptor family by selective amplification and cloning from thyroid cDNA. One of these clones, termed RDC4 by them, showed close structural similarity with the serotonin 5HT1A receptor (OMIM Ref. No. 109760). By in situ hybridization, they demonstrated that the gene (HTR1D) is located on chromosome 1 at 1p36.3-p34.3. By Southern blot analysis of a hybrid cell panel, Jin et al. (1992) showed that the HTR1D gene is located on chromosome 1. Wilkie et al. (1993) showed that the homologous gene in the mouse is located on chromosome 4.

Full details of the abovementioned studies are described in the following publications, the disclosure of which are hereby incorporated by reference:

Weinshank, R. L.; Zgombick, J. M.; Macchi, M. J.; Branchek, T. A.; Hartig, P. R.: Human serotonin 1D receptor is encoded by a subfamily of two distinct genes: 5-HT(1D-alpha) and 5-HT(1D-beta). Proc. Nat. Acad. Sci. 89:3630-3634, 1992; and Wilkie, T. M.; Chen, Y.; Gilbert, D. J.; Moore, K. J.; Yu, L.; Simon, M. I.; Copeland, N. G.; Jenkins, N. A.: Identification, chromosomal location, and genome organization of mammalian.

Further studies establishing the function and utilities of HTR1D are found in John Hopkins OMIM database record ID 182133, and in sited publications numbered 10613, 1061 and 11892 listed in the bibliography section hereinbelow, which are also hereby incorporated by reference. Insulin-like Growth Factor 1 Receptor (IGF1R, Accession NM_000875) is another VGAM152 host target gene. IGF1R BINDING SITE is HOST TARGET binding site found in the 3' untranslated region of mRNA encoded by IGF1R, corresponding to a HOST TARGET binding site such as BINDING SITE I, BINDING SITE II or BINDING SITE III. Table 2 illustrates the complementarity of the nucleotide sequences of IGF1R BINDING SITE, designated SEQ ID:6556, to the nucleotide sequence of VGAM152 RNA, herein designated VGAM RNA, also designated SEQ ID:2863.

Another function of VGAM152 is therefore inhibition of Insulin-like Growth Factor 1 Receptor (IGF1R, Accession NM_000875), a gene which binds insulin-like growth factors and has a tyrosine-protein kinase activity. Accordingly, utilities of VGAM152 include diagnosis, prevention and treatment of diseases and clinical conditions associated with IGF1R. The function of IGF1R has been established by previous studies. Flier et al. (1986) studied a monoclonal antibody to the receptor for type I insulin-like growth factor (IGF1; 147440). This might be the site of the change in some forms of growth disturbance. Ullrich et al. (1986) determined the complete primary structure of the receptor for IGF I from cloned cDNA. The deduced sequence predicts a 1,367-amino acid receptor precursor, including a 30-residue signal peptide, which is removed during translocation of the nascent polypeptide chain. Cleavage of the precursor generates alpha and beta subunits as in the case of the insulin receptor (INSR; 147670). Abbott et al. (1992) determined that the IGF1R gene contains 21 exons and spans about 100 kb. Cooke et al. (1991) analyzed the promoter region and found that the 5-prime flanking and untranslated region is GC-rich and contains numerous potential SP1 and AP2 binding sites as well as a thyroid response element, but no TATA or CCAAT elements. Prager et al. (1992) showed that a mutant human IGF-I receptor interfered with the expected suppression of growth hormone in cultured rat pituitary cells, thus demonstrating a dominant-negative phenotype. (The 'dominant-negative' concept was first clearly articulated by Herskowitz (1987). He recognized 2 classes. The first class comprises multimeric proteins dependent on oligomerization for activity; the presence in a multimer of a mutant subunit with intact binding but altered catalytic domains can abrogate the function of the entire multimer. The second class involves monomeric proteins, in which dominant-negative mutations can occur if substrate is limiting; a mutant able to bind the substrate but not metabolize it would have this effect.) Using a yeast 2-hybrid system, Dey et al. (1998) identified a regulatory subunit of phosphatidylinositol (PI) 3-kinase, PIK3R3 (OMIM Ref. No. 606076), as a binding partner of IGF1R. They concluded that the SH2 domain of PIK3R3 interacts with IGF1R and INSR in a kinase-dependent manner, providing an alternative pathway for the activation of PI 3-kinase by these 2 receptors. Rotem-Yehudar et al. (2001) found evidence that IGF1R associated with SNAP29 (OMIM Ref. No. 604202), a synaptosomal-associated protein, and with EHD1 (OMIM Ref. No. 605888), a protein containing motifs important for protein-protein interaction and for intracellular sorting. Through immunoprecipitation of rat tissues, they found that SNAP29 and EHD1 are present in complexes with IGF1R. They also found that IGF1 induction of EHD1-transfected CHO cells results in intracellular colocalization of EHD1 and IGF1R. Animal model experiments lend further support to the function of IGF1R. Fernandez et al. (2001) developed transgenic mice overexpressing a dominant-negative IGF1R, containing a mutation that abolishes ATPase activity, specifically targeted to skeletal muscle. They found that mutant IGF1R impairs the function of both the normal endogenous IGF1R and the insulin receptor, and that mice overexpressing the mutant IGF1R developed insulin resistance and pancreatic beta-cell dysfunction followed by diabetes. By coimmunoprecipitation experiments, Fernandez et al. (2001) showed interaction between mutant and normal IGF1R hemireceptors as well as between mutant IGF1R and INSR, suggesting the formation of nonfunctional hybrid receptors. Through biochemical analysis, they showed that the mutant hemireceptor fails to autophosphorylate and thereby abrogates the normal function of the hybrid receptors. To identify genetic determinants of hypoxic cell death, Scott et al. (2002) screened for hypoxia-resistant mutants in C. elegans and found that specific reduction-of-function mutants of daf2, an insulin/insulin-like growth factor receptor homolog gene, were profoundly hypoxia resistant. The hypoxia resistance was acutely inducible just before hypoxic exposure and was mediated through the AKT1/PDK1/forkhead transcription factor pathway overlapping with but distinct from signaling pathways regulating lifespan and stress resistance. Selective neuronal and muscle expression of daf2 wildtype restored hypoxic death, and daf2 reduction of function mutants prevented hypoxia-induced muscle and neuronal cell death, demonstrating a potential for insulin/insulin-like growth factor receptor modulation in prophylaxis against hypoxic injury of neurons and myocytes.

It is appreciated that the abovementioned animal model for IGF1R is acknowledged by those skilled in the art as a scientifically valid animal model, as can be further appreciated from the publications sited hereinbelow.

Full details of the abovementioned studies are described in the following publications, the disclosure of which are hereby incorporated by reference:

Fernandez, A. M.; Kim, J. K.; Yakar, S.; Dupont, J.; Hernandez-Sanchez, C.; Castle, A. L.; Filmore, J.; Shulman, G. I.; Le Roith, D.: Functional inactivation of the IGF-I and insulin receptors in skeletal muscle causes type 2 diabetes. Genes Dev. 15:1926-1934, 2001; and All-Ericsson, C.; Girnita, L.; Seregard, S.; Bartolazzi, A.; Jager, M. J.; Larsson, O.: Insulin-like growth factor-1 receptor in uveal melanoma: a predictor for metastatic disease and.

Further studies establishing the function and utilities of IGF1R are found in John Hopkins OMIM database record ID 147370, and in sited publications numbered 11275-11286, 5228, 11287-11288, 11235, 1128 and 11323-11327 listed in the bibliography section hereinbelow, which are also hereby incorporated by reference. Potassium Intermediate/small Conductance Calcium-activated Channel, Subfamily N, Member 4 (KCNN4, Accession NM_002250) is another VGAM152 host target gene. KCNN4 BINDING SITE is HOST TARGET binding site found in the 5' untranslated region of mRNA encoded by KCNN4, corresponding to a HOST TARGET binding site such as BINDING SITE I, BINDING SITE II or BINDING SITE III. Table 2 illustrates the complementarity of the nucleotide sequences of KCNN4 BINDING SITE, designated SEQ ID:8036, to the nucleotide sequence of VGAM152 RNA, herein designated VGAM RNA, also designated SEQ ID:2863.

Another function of VGAM152 is therefore inhibition of Potassium Intermediate/small Conductance Calcium-activated Channel, Subfamily N, Member 4 (KCNN4, Accession NM_002250), a gene which forms a voltage-independent potassium channel that is activated by intracellular calcium. Accordingly, utilities of VGAM152 include diagnosis, prevention and treatment of diseases and clinical conditions associated with KCNN4. The function of KCNN4 has been established by previous studies. The calcium-activated potassium channels (KCa channels) have been classified into 3 groups. Large conductance (BK) channels are gated by the concerted actions of internal calcium ions and membrane potential and have a unit conductance of 100 to 220 picoSiemens (pS). Intermediate conductance (IK) and small conductance (SK) channels are gated solely by internal calcium ions, with a unit conductance of 20 to 85 pS and 2 to 20 pS, respectively, and are more sensitive to calcium than are BK channels. Each type of channel shows a distinct pharmacology (Ishii et al., 1997). Joiner et al. (1997) cloned cDNAs encoding KCNN4, which they called SK4. The predicted 427-amino acid sequence of KCNN4 was approximately 40% identical to that of the rat and human SK channel proteins rSK1, rSK2, rSK3 and hSK1. Sequence analysis revealed that, like the SK channel proteins, KCNN4 contained 6 putative transmembrane domains, a conserved pore region, and a leucine zipper-like motif near the C terminus. When expressed in Chinese hamster ovary cells, KCNN4 generated a conductance of approximately 12 pS and had a very high affinity for calcium. By Northern analysis, the authors found that KCNN4 was expressed as 2.6-kb and 3.8-kb transcripts in placenta and at lower levels in lung and pancreas. On the basis of its expression pattern, physiologic properties, and low homology to other SK channel proteins, Joiner et al. (1997) proposed that KCNN4 belongs to a new subfamily of SK channels.

Full details of the abovementioned studies are described in the following publications, the disclosure of which are hereby incorporated by reference:

Ghanshani, S.; Coleman, M.; Gustavsson, P.; Wu, A. C.-L.; Gargus, J. J.; Gutman, G. A.; Dahl, N.; Mohrenweiser, H.; Chandy, K. G.: Human calcium-activated potassium channel gene KCNN4 maps to chromosome 19q13.2 in the region deleted in Diamond-Blackfan anemia. Genomics 51:160-161, 1998; and Ishii, T. M.; Silvia, C.; Hirschberg, B.; Bond, C. T.; Adelman, J. P.; Maylie, J.: A human intermediate conductance calcium-activated potassium channel. Proc. Nat. Acad. Sci. 94:11651.

Further studies establishing the function and utilities of KCNN4 are found in John Hopkins OMIM database record ID 602754, and in sited publications numbered 5883-5886 listed in the bibliography section hereinbelow, which are also hereby incorporated by reference. Mitogen-activated Protein Kinase 14 (MAPK14, Accession NM_139012) is another VGAM152 host target gene. MAPK14 BINDING SITE1 through MAPK14 BINDING SITE3 are HOST TARGET binding sites found in untranslated regions of mRNA encoded by MAPK14, corresponding to HOST TARGET binding sites such as BINDING SITE I, BINDING SITE II or BINDING SITE III. Table 2 illustrates the complementarity of the nucleotide sequences of MAPK14 BINDING SITE1 through MAPK14 BINDING SITE3, designated SEQ ID:29106, SEQ ID:29113 and SEQ ID:7002 respectively, to the nucleotide sequence of VGAM152 RNA, herein designated VGAM RNA, also designated SEQ ID:2863.

Another function of VGAM152 is therefore inhibition of Mitogen-activated Protein Kinase 14 (MAPK14, Accession NM_139012), a gene which is important for cytokine production; responds to changes in extracellular osmolarity. Accordingly, utilities of VGAM152 include diagnosis, prevention and treatment of diseases and clinical conditions associated with MAPK14. The function of MAPK14 and its association with various diseases and clinical conditions, has been established by previous studies, as described hereinabove with reference to VGAM107. P23 (Accession NM_006601) is another VGAM152 host target gene. P23 BINDING SITE is HOST TARGET binding site found in the 3' untranslated region of mRNA encoded by P23, corresponding to a HOST TARGET binding site such as BINDING SITE I, BINDING SITE II or BINDING SITE III. Table 2 illustrates the complementarity of the nucleotide sequences of P23 BINDING SITE, designated SEQ ID:13380, to the nucleotide sequence of VGAM152 RNA, herein designated VGAM RNA, also designated SEQ ID:2863.

Another function of VGAM152 is therefore inhibition of P23 (Accession NM_006601), a gene which is a component of unstimulated progesterone receptor complex. Accordingly, utilities of VGAM152 include diagnosis, prevention and treatment of diseases and clinical conditions associated with P23. The function of P23 has been established by previous studies. P23 was first observed as a component of the unactivated avian progesterone receptor complex, along with HSP70 (see OMIM Ref. No. 140550) and HSP90 (see OMIM Ref. No. 140571) (Smith et al., 1990). Using the chicken p23 sequence as probe, Johnson et al. (1994) cloned P23 from a human testis cDNA library. The deduced 160-amino acid protein has a calculated molecular mass of about 19 kD and contains several putative phosphorylation sites. P23 shares about 96% sequence identity with the chicken homolog. Western blot analysis revealed a 23-kD band in tissue and cell lysates from several mammalian species including human. Freeman and Yamamoto (2002) determined that the P23 molecular chaperone localizes to genomic response elements in a hormone-dependent manner and showed that it could disrupt receptor-mediated transcriptional activation.

Full details of the abovementioned studies are described in the following publications, the disclosure of which are hereby incorporated by reference:

Johnson, J. L.; Beito, T. G.; Krco, C. J.; Toft, D. O.: Characterization of a novel 23-kilodalton protein of unactive progesterone receptor complexes. Molec. Cell. Biol. 14:1956-1963, 1994; and Freeman, B. C.; Yamamoto, K. R.: Disassembly of transcriptional regulatory complexes by molecular chaperones. Science 296:2232-2235, 2002.

Further studies establishing the function and utilities of P23 are found in John Hopkins OMIM database record ID 607061, and in sited publications numbered 5402-5404 listed in the bibliography section hereinbelow, which are also hereby incorporated by reference. PR Domain Containing 2, with ZNF Domain (PRDM2, Accession NM_012231) is another VGAM152 host target gene. PRDM2 BINDING SITE1 and PRDM2 BINDING SITE2 are HOST TARGET binding sites found in untranslated regions of mRNA encoded by PRDM2, corresponding to HOST TARGET binding sites such as BINDING SITE I, BINDING SITE II or BINDING SITE III. Table 2 illustrates the complementarity of the nucleotide sequences of PRDM2 BINDING SITE1 and PRDM2 BINDING SITE2, designated SEQ ID:14534 and SEQ ID:18001 respectively, to the nucleotide sequence of VGAM152 RNA, herein designated VGAM RNA, also designated SEQ ID:2863.

Another function of VGAM152 is therefore inhibition of PR Domain Containing 2, with ZNF Domain (PRDM2, Accession NM_012231), a gene which plays a role in transcriptional regulation during neuronal differentiation and pathogenesis of retinoblastoma. Accordingly, utilities of VGAM152 include diagnosis, prevention and treatment of diseases and clinical conditions associated with PRDM2. The function of PRDM2 and its association with various diseases and clinical conditions, has been established by previous studies, as described hereinabove with reference to VGAM120. Serine Hydroxymethyltransferase 2 (mitochondrial) (SHMT2, Accession NM_005412) is another VGAM152 host target gene. SHMT2 BINDING SITE is HOST TARGET binding site found in the 3' untranslated region of mRNA encoded by SHMT2, corresponding to a HOST TARGET binding site such as BINDING SITE I, BINDING SITE II or BINDING SITE III. Table 2 illustrates the complementarity of the nucleotide sequences of SHMT2 BINDING SITE, designated SEQ ID:11879, to the nucleotide sequence of VGAM152 RNA, herein designated VGAM RNA, also designated SEQ ID:2863.

Another function of VGAM152 is therefore inhibition of Serine Hydroxymethyltransferase 2 (mitochondrial) (SHMT2, Accession NM_005412), a gene which interconverts serine and glycine. Accordingly, utilities of VGAM152 include diagnosis, prevention and treatment of diseases and clinical conditions associated with SHMT2. The function of SHMT2 has been established by previous studies. By human-hamster hybrids, Kao et al. (1969) have demonstrated that the human complement for hamster glycine (-)A auxotroph is located on chromosome 12. The enzyme, presence of which in human cells complements the deficiency in hamster cells, is thought to be serine hydroxymethyltransferase. Law and Kao (1978) summarized data suggesting the order 12pter--TPI--GAPD--SHMT on chromosome 12. SHMT lies on the proximal part of 12q between the centromere and Pep-B. The regional localization is 12q12-q14. Garrow et al. (1993) cloned human cDNAs for both the cytosolic and the mitochondrial SHMT isozymes by functional complementation of an Escherichia coli glyA mutant with a human cDNA library. By fluorescence in situ hybridization, they demonstrated that the cytosolic (SHMT1; 182144) and mitochondrial (SHMT2) genes localized to 17p11.2 and 12q13, respectively. The high degree of nucleotide sequence identity between the 2 isozymes, as well as the presence of keratin genes in both chromosomal regions, was considered to be consistent with the occurrence of a duplication event in the origin of these regions of chromosomes 12 and 17. Stover et al. (1997) found that the SHMT2 gene, called mSHMT by them, is composed of 11 exons and spans approximately 4.5 kb. Amino acids 1 to 29 encode a mitochondrial import presequence; the corresponding mRNA contains 2 potential ATG start sites, which are encoded by separate exons. Translation initiation from the first ATG is not essential for SHMT2 activity and import into the mitochondria.

Full details of the abovementioned studies are described in the following publications, the disclosure of which are hereby incorporated by reference:

Law, M. L.; Kao, F.-T.: Induced segregation of human syntenic genes by 5-bromodeoxyuridine plus near-visible light. Somat. Cell Genet. 4:465-476, 1978; and Stover, P. J.; Chen, L. H.; Suh, J. R.; Stover, D. M.; Keyomarsi, K.; Shane, B.: Molecular cloning, characterization, and regulation of the human mitochondrial serine hydroxymethyltransfer.

Further studies establishing the function and utilities of SHMT2 are found in John Hopkins OMIM database record ID 138450, and in sited publications numbered 4810-481 and 4969 listed in the bibliography section hereinbelow, which are also hereby incorporated by reference. Solute Carrier Family 35 (CMP-sialic acid transporter), Member 1 (SLC35A1, Accession NM_006416) is another VGAM152 host target gene. SLC35A1 BINDING SITE is HOST TARGET binding site found in the 3' untranslated region of mRNA encoded by SLC35A1, corresponding to a HOST TARGET binding site such as BINDING SITE I, BINDING SITE II or BINDING SITE III. Table 2 illustrates the complementarity of the nucleotide sequences of SLC35A1 BINDING SITE, designated SEQ ID:13126, to the nucleotide sequence of VGAM152 RNA, herein designated VGAM RNA, also designated SEQ ID:2863.

Another function of VGAM152 is therefore inhibition of Solute Carrier Family 35 (CMP-sialic acid transporter), Member 1 (SLC35A1, Accession NM_006416), a gene which transports cmp-sialic acid from the cytosol into golgi vesicles. Accordingly, utilities of VGAM152 include diagnosis, prevention and treatment of diseases and clinical conditions associated with SLC35A1. The function of SLC35A1 has been established by previous studies. By searching an EST database, followed by 5-prime RACE on an adult liver cDNA pool, Ishida et al. (1996) obtained a cDNA encoding SLC35A1, the human homolog of the murine cytidine monophosphate (CMP)-sialic acid transporter. The deduced 337-amino acid protein is approximately 65% identical to SLC35A2 (OMIM Ref. No. 314375). Ishida et al. (1998) used wheat germ agglutination sensitivity assays and flow cytometry analysis to show that SLC35A1 corrects the sialic acid transport deficiency in a mutant cell line. Immunoblot analysis showed that SLC35A1 is expressed as an approximately 29-kD protein in microsomal vesicles. Immunofluorescence microscopy demonstrated expression in the Golgi region, with the C terminus exposed to the cytosol. Northern blot analysis revealed ubiquitous expression of a 2.0-kb transcript.

Full details of the abovementioned studies are described in the following publications, the disclosure of which are hereby incorporated by reference:

Ishida, N.; Ito, M.; Yoshioka, S.; Sun-Wada, G.-H.; Kawakita, M.: Functional expression of human Golgi CMP-sialic acid transporter in the Golgi complex of a transporter-deficient Chinese hamster ovary cell mutant. J. Biochem. 124: 171-178, 1998; and Ishida, N.; Miura, N.; Yoshioka, S.; Kawakita, M.: Molecular cloning and characterization of a novel isoform of the human UDP-galactose transporter, and of related complementary DNAs be.

Further studies establishing the function and utilities of SLC35A1 are found in John Hopkins OMIM database record ID 605634, and in sited publications numbered 450 and 8228 listed in the bibliography section hereinbelow, which are also hereby incorporated by reference. SWI/SNF Related, Matrix Associated, Actin Dependent Regulator of Chromatin, Subfamily D, Member 1 (SMARCD1, Accession NM_139071) is another VGAM152 host target gene. SMARCD1 BINDING SITE1 and SMARCD1 BINDING SITE2 are HOST TARGET binding sites found in untranslated regions of mRNA encoded by SMARCD1, corresponding to HOST TARGET binding sites such as BINDING SITE I, BINDING SITE II or BINDING SITE III. Table 2 illustrates the complementarity of the nucleotide sequences of SMARCD1 BINDING SITE1 and SMARCD1 BINDING SITE2, designated SEQ ID:29145 and SEQ ID:9047 respectively, to the nucleotide sequence of VGAM152 RNA, herein designated VGAM RNA, also designated SEQ ID:2863.

Another function of VGAM152 is therefore inhibition of SWI/SNF Related, Matrix Associated, Actin Dependent Regulator of Chromatin, Subfamily D, Member 1 (SMARCD1, Accession NM_139071), a gene which is involved in chromatin assembly and remodeling. Accordingly, utilities of VGAM152 include diagnosis, prevention and treatment of diseases and clinical conditions associated with SMARCD1. The function of SMARCD1 has been established by previous studies. Chromatin is actively remodeled during development. Chromatin remodeling of certain genes appears to precede their transcriptional activation. In yeast, the multisubunit SWI/SNF complex is thought to be responsible for chromatin remodeling. Wang et al. (1996) isolated an analogous SWI/SNF complex from the human YT cell line. They found that the resultant complexes are composed of 9 to 12 polypeptides, which they termed BAFs (for BRG1-associated factors). Wang et al. (1996) isolated the BAF60a subunit, which encodes a polypeptide of 435 amino acids and is homologous to the yeast SWP73 gene. The authors used BAF60a as a probe to isolate 2 closely related homologs, BAF60b (OMIM Ref. No. 601736) and BAF60c (OMIM Ref. No. 601737). By PCR of a somatic cell hybrid panel and radiation hybrid analysis, Ring et al. (1998) mapped the SMARCD1 gene to chromosome 12q13-q14.

Full details of the abovementioned studies are described in the following publications, the disclosure of which are hereby incorporated by reference:

Ring, H. Z.; Vameghi-Meyers, V.; Wang, W.; Crabtree, G. R.; Francke, U.: Five SWI/SNF-related, matrix-associated, actin-dependent regulator of chromatin (SMARC) genes are dispersed in the human genome. Genomics 51:140-143, 1998; and Wang, W.; Xue, Y.; Zhou, S.; Kuo, A.; Cairns, B. R.; Crabtree, G. R.: Diversity and specialization of mammalian SWI/SNF complexes. Genes Dev. 10:2117-2130, 1996.

Further studies establishing the function and utilities of SMARCD1 are found in John Hopkins OMIM database record ID 601735, and in sited publications numbered 9322-9323 listed in the bibliography section hereinbelow, which are also hereby incorporated by reference. DKFZP434J193 (Accession XM_048452) is another VGAM152 host target gene. DKFZP434J193 BINDING SITE is HOST TARGET binding site found in the 3' untranslated region of mRNA encoded by DKFZP434J193, corresponding to a HOST TARGET binding site such as BINDING SITE I, BINDING SITE II or BINDING SITE III. Table 2 illustrates the complementarity of the nucleotide sequences of DKFZP434J193 BINDING SITE, designated SEQ ID:35162, to the nucleotide sequence of VGAM152 RNA, herein designated VGAM RNA, also designated SEQ ID:2863.

Another function of VGAM152 is therefore inhibition of DKFZP434J193 (Accession XM_048452). Accordingly, utilities of VGAM152 include diagnosis, prevention and treatment of diseases and clinical conditions associated with DKFZP434J193. DKFZP564M182 (Accession XM_085525) is another VGAM152 host target gene. DKFZP564M182 BINDING SITE is HOST TARGET binding site found in the 3' untranslated region of mRNA encoded by DKFZP564M182, corresponding to a HOST TARGET binding site such as BINDING SITE I, BINDING SITE II or BINDING SITE III. Table 2 illustrates the complementarity of the nucleotide sequences of DKFZP564M182 BINDING SITE, designated SEQ ID:38220, to the nucleotide sequence of VGAM152 RNA, herein designated VGAM RNA, also designated SEQ ID:2863.

Another function of VGAM152 is therefore inhibition of DKFZP564M182 (Accession XM_085525). Accordingly, utilities of VGAM152 include diagnosis, prevention and treatment of diseases and clinical conditions associated with DKFZP564M182. FLJ10290 (Accession NM_018047) is another VGAM152 host target gene. FLJ10290 BINDING SITE is HOST TARGET binding site found in the 3' untranslated region of mRNA encoded by FLJ10290, corresponding to a HOST TARGET binding site such as BINDING SITE I, BINDING SITE II or BINDING SITE III. Table 2 illustrates the complementarity of the nucleotide sequences of FLJ10290 BINDING SITE, designated SEQ ID:19797, to the nucleotide sequence of VGAM152 RNA, herein designated VGAM RNA, also designated SEQ ID:2863.

Another function of VGAM152 is therefore inhibition of FLJ10290 (Accession NM_018047). Accordingly, utilities of VGAM152 include diagnosis, prevention and treatment of diseases and clinical conditions associated with FLJ10290. FLJ13194 (Accession NM_025146) is another VGAM152 host target gene. FLJ13194 BINDING SITE is HOST TARGET binding site found in the 3' untranslated region of mRNA encoded by FLJ13194, corresponding to a HOST TARGET binding site such as BINDING SITE I, BINDING SITE II or BINDING SITE III. Table 2 illustrates the complementarity of the nucleotide sequences of FLJ13194 BINDING SITE, designated SEQ ID:24787, to the nucleotide sequence of VGAM152 RNA, herein designated VGAM RNA, also designated SEQ ID:2863.

Another function of VGAM152 is therefore inhibition of FLJ13194 (Accession NM_025146). Accordingly, utilities of VGAM152 include diagnosis, prevention and treatment of diseases and clinical conditions associated with FLJ13194. FLJ21870 (Accession NM_023016) is another VGAM152 host target gene. FLJ21870 BINDING SITE is HOST TARGET binding site found in the 3' untranslated region of mRNA encoded by FLJ21870, corresponding to a HOST TARGET binding site such as BINDING SITE I, BINDING SITE II or BINDING SITE III. Table 2 illustrates the complementarity of the nucleotide sequences of FLJ21870 BINDING SITE, designated SEQ ID:23279, to the nucleotide sequence of VGAM152 RNA, herein designated VGAM RNA, also designated SEQ ID:2863.

Another function of VGAM152 is therefore inhibition of FLJ21870 (Accession NM_023016). Accordingly, utilities of VGAM152 include diagnosis, prevention and treatment of diseases and clinical conditions associated with FLJ21870. H_GS165L15.1 (Accession NM_004904) is another VGAM152 host target gene. H_GS165L15.1 BINDING SITE is HOST TARGET binding site found in the 3' untranslated region of mRNA encoded by H_GS165L15.1, corresponding to a HOST TARGET binding site such as BINDING SITE I, BINDING SITE II or BINDING SITE III. Table 2 illustrates the complementarity of the nucleotide sequences of H_GS165L15.1 BINDING SITE, designated SEQ ID:11338, to the nucleotide sequence of VGAM152 RNA, herein designated VGAM RNA, also designated SEQ ID:2863.

Another function of VGAM152 is therefore inhibition of H_GS165L15.1 (Accession NM_004904). Accordingly, utilities of VGAM152 include diagnosis, prevention and treatment of diseases and clinical conditions associated with H_GS165L15.1. KIAA0295 (Accession XM_042833) is another VGAM152 host target gene. KIAA0295 BINDING SITE is HOST TARGET binding site found in the 3' untranslated region of mRNA encoded by KIAA0295, corresponding to a HOST TARGET binding site such as BINDING SITE I, BINDING SITE II or BINDING SITE III. Table 2 illustrates the complementarity of the nucleotide sequences of KIAA0295 BINDING SITE, designated SEQ ID:33780, to the nucleotide sequence of VGAM152 RNA, herein designated VGAM RNA, also designated SEQ ID:2863.

Another function of VGAM152 is therefore inhibition of KIAA0295 (Accession XM_042833). Accordingly, utilities of VGAM152 include diagnosis, prevention and treatment of diseases and clinical conditions associated with KIAA0295. KIAA0356 (Accession XM_038655) is another VGAM152 host target gene. KIAA0356 BINDING SITE is HOST TARGET binding site found in the 3' untranslated region of mRNA encoded by KIAA0356, corresponding to a HOST TARGET binding site such as BINDING SITE I, BINDING SITE II or BINDING SITE III. Table 2 illustrates the complementarity of the nucleotide sequences of KIAA0356 BINDING SITE, designated SEQ ID:32893, to the nucleotide sequence of VGAM152 RNA, herein designated VGAM RNA, also designated SEQ ID:2863.

Another function of VGAM152 is therefore inhibition of KIAA0356 (Accession XM_038655). Accordingly, utilities of VGAM152 include diagnosis, prevention and treatment of diseases and clinical conditions associated with KIAA0356. KIAA0853 (Accession NM_015070) is another VGAM152 host target gene. KIAA0853 BINDING SITE is HOST TARGET binding site found in the 5' untranslated region of mRNA encoded by KIAA0853, corresponding to a HOST TARGET binding site such as BINDING SITE I, BINDING SITE II or BINDING SITE III. Table 2 illustrates the complementarity of the nucleotide sequences of KIAA0853 BINDING SITE, designated SEQ ID:17440, to the nucleotide sequence of VGAM152 RNA, herein designated VGAM RNA, also designated SEQ ID:2863.

Another function of VGAM152 is therefore inhibition of KIAA0853 (Accession NM_015070). Accordingly, utilities of VGAM152 include diagnosis, prevention and treatment of diseases and clinical conditions associated with KIAA0853. KIAA1102 (Accession XM_044461) is another VGAM152 host target gene. KIAA1102 BINDING SITE is HOST TARGET binding site found in the 3' untranslated region of mRNA encoded by KIAA1102, corresponding to a HOST TARGET binding site such as BINDING SITE I, BINDING SITE II or BINDING SITE III. Table 2 illustrates the complementarity of the nucleotide sequences of KIAA1102 BINDING SITE, designated SEQ ID:34212, to the nucleotide sequence of VGAM152 RNA, herein designated VGAM RNA, also designated SEQ ID:2863.

Another function of VGAM152 is therefore inhibition of KIAA1102 (Accession XM_044461). Accordingly, utilities of VGAM152 include diagnosis, prevention and treatment of diseases and clinical conditions associated with KIAA1102. KIAA1223 (Accession XM_048747) is another VGAM152 host target gene. KIAA1223 BINDING SITE is HOST TARGET binding site found in the 3' untranslated region of mRNA encoded by KIAA1223, corresponding to a HOST TARGET binding site such as BINDING SITE I, BINDING SITE II or BINDING SITE III. Table 2 illustrates the complementarity of the nucleotide sequences of KIAA1223 BINDING SITE, designated SEQ ID:35245, to the nucleotide sequence of VGAM152 RNA, herein designated VGAM RNA, also designated SEQ ID:2863.

Another function of VGAM152 is therefore inhibition of KIAA1223 (Accession XM_048747). Accordingly, utilities of VGAM152 include diagnosis, prevention and treatment of diseases and clinical conditions associated with KIAA1223. KIAA1467 (Accession XM_049605) is another VGAM152 host target gene. KIAA1467 BINDING SITE is HOST TARGET binding site found in the 3' untranslated region of mRNA encoded by KIAA1467, corresponding to a HOST TARGET binding site such as BINDING SITE I, BINDING SITE II or BINDING SITE III. Table 2 illustrates the complementarity of the nucleotide sequences of KIAA1467 BINDING SITE, designated SEQ ID:35453, to the nucleotide sequence of VGAM152 RNA, herein designated VGAM RNA, also designated SEQ ID:2863.

Another function of VGAM152 is therefore inhibition of KIAA1467 (Accession XM_049605). Accordingly, utilities of VGAM152 include diagnosis, prevention and treatment of diseases and clinical conditions associated with KIAA1467. MGC12966 (Accession NM_032706) is another VGAM152 host target gene. MGC12966 BINDING SITE is HOST TARGET binding site found in the 3' untranslated region of mRNA encoded by MGC12966, corresponding to a HOST TARGET binding site such as BINDING SITE I, BINDING SITE II or BINDING SITE III. Table 2 illustrates the complementarity of the nucleotide sequences of MGC12966 BINDING SITE, designated SEQ ID:26419, to the nucleotide sequence of VGAM152 RNA, herein designated VGAM RNA, also designated SEQ ID:2863.

Another function of VGAM152 is therefore inhibition of MGC12966 (Accession NM_032706). Accordingly, utilities of VGAM152 include diagnosis, prevention and treatment of diseases and clinical conditions associated with MGC12966. MGC2306 (Accession NM_032638) is another VGAM152 host target gene. MGC2306 BINDING SITE is HOST TARGET binding site found in the 3' untranslated region of mRNA encoded by MGC2306, corresponding to a HOST TARGET binding site such as BINDING SITE I, BINDING SITE II or BINDING SITE III. Table 2 illustrates the complementarity of the nucleotide sequences of MGC2306 BINDING SITE, designated SEQ ID:26353, to the nucleotide sequence of VGAM152 RNA, herein designated VGAM RNA, also designated SEQ ID:2863.

Another function of VGAM152 is therefore inhibition of MGC2306 (Accession NM_032638). Accordingly, utilities of VGAM152 include diagnosis, prevention and treatment of diseases and clinical conditions associated with MGC2306. ORM1-like 2 (S. cerevisiae) (ORMDL2, Accession NM_014182) is another VGAM152 host target gene. ORMDL2 BINDING SITE is HOST TARGET binding site found in the 3' untranslated region of mRNA encoded by ORMDL2, corresponding to a HOST TARGET binding site such as BINDING SITE I, BINDING SITE II or BINDING SITE III. Table 2 illustrates the complementarity of the nucleotide sequences of ORMDL2 BINDING SITE, designated SEQ ID:15467, to the nucleotide sequence of VGAM152 RNA, herein designated VGAM RNA, also designated SEQ ID:2863.

Another function of VGAM152 is therefore inhibition of ORM1-like 2 (S. cerevisiae) (ORMDL2, Accession NM_014182). Accordingly, utilities of VGAM152 include diagnosis, prevention and treatment of diseases and clinical conditions associated with ORMDL2. P66 (Accession NM_020699) is another VGAM152 host target gene. P66 BINDING SITE is HOST TARGET binding site found in the 3' untranslated region of mRNA encoded by P66, corresponding to a HOST TARGET binding site such as BINDING SITE I, BINDING SITE II or BINDING SITE III. Table 2 illustrates the complementarity of the nucleotide sequences of P66 BINDING SITE, designated SEQ ID:21844, to the nucleotide sequence of VGAM152 RNA, herein designated VGAM RNA, also designated SEQ ID:2863.

Another function of VGAM152 is therefore inhibition of P66 (Accession NM_020699). Accordingly, utilities of VGAM152 include diagnosis, prevention and treatment of diseases and clinical conditions associated with P66. PRO0159 (Accession NM_014118) is another VGAM152 host target gene. PRO0159 BINDING SITE is HOST TARGET binding site found in the 5' untranslated region of mRNA encoded by PRO0159, corresponding to a HOST TARGET binding site such as BINDING SITE I, BINDING SITE II or BINDING SITE III. Table 2 illustrates the complementarity of the nucleotide sequences of PRO0159 BINDING SITE, designated SEQ ID:15372, to the nucleotide sequence of VGAM152 RNA, herein designated VGAM RNA, also designated SEQ ID:2863.

Another function of VGAM152 is therefore inhibition of PRO0159 (Accession NM_014118). Accordingly, utilities of VGAM152 include diagnosis, prevention and treatment of diseases and clinical conditions associated with PRO0159. LOC144740 (Accession XM_084959) is another VGAM152 host target gene. LOC144740 BINDING SITE is HOST TARGET binding site found in the 5' untranslated region of mRNA encoded by LOC144740, corresponding to a HOST TARGET binding site such as BINDING SITE I, BINDING SITE II or BINDING SITE III. Table 2 illustrates the complementarity of the nucleotide sequences of LOC144740 BINDING SITE, designated SEQ ID:37786, to the nucleotide sequence of VGAM152 RNA, herein designated VGAM RNA, also designated SEQ ID:2863.

Another function of VGAM152 is therefore inhibition of LOC144740 (Accession XM_084959). Accordingly, utilities of VGAM152 include diagnosis, prevention and treatment of diseases and clinical conditions associated with LOC144740. LOC145820 (Accession XM_085246) is another VGAM152 host target gene. LOC145820 BINDING SITE is HOST TARGET binding site found in the 3' untranslated region of mRNA encoded by LOC145820, corresponding to a HOST TARGET binding site such as BINDING SITE I, BINDING SITE II or BINDING SITE III. Table 2 illustrates the complementarity of the nucleotide sequences of LOC145820 BINDING SITE, designated SEQ ID:37994, to the nucleotide sequence of VGAM152 RNA, herein designated VGAM RNA, also designated SEQ ID:2863.

Another function of VGAM152 is therefore inhibition of LOC145820 (Accession XM_085246). Accordingly, utilities of VGAM152 include diagnosis, prevention and treatment of diseases and clinical conditions associated with LOC145820. LOC148195 (Accession XM_097419) is another VGAM152 host target gene. LOC148195 BINDING SITE is HOST TARGET binding site found in the 5' untranslated region of mRNA encoded by LOC148195, corresponding to a HOST TARGET binding site such as BINDING SITE I, BINDING SITE II or BINDING SITE III. Table 2 illustrates the complementarity of the nucleotide sequences of LOC148195 BINDING SITE, designated SEQ ID:40873, to the nucleotide sequence of VGAM152 RNA, herein designated VGAM RNA, also designated SEQ ID:2863.

Another function of VGAM152 is therefore inhibition of LOC148195 (Accession XM_097419). Accordingly, utilities of VGAM152 include diagnosis, prevention and treatment of diseases and clinical conditions associated with LOC148195. LOC148811 (Accession XM_086326) is another VGAM152 host target gene. LOC148811 BINDING SITE is HOST TARGET binding site found in the 3' untranslated region of mRNA encoded by LOC148811, corresponding to a HOST TARGET binding site such as BINDING SITE I, BINDING SITE II or BINDING SITE III. Table 2 illustrates the complementarity of the nucleotide sequences of LOC148811 BINDING SITE, designated SEQ ID:38598, to the nucleotide sequence of VGAM152 RNA, herein designated VGAM RNA, also designated SEQ ID:2863.

Another function of VGAM152 is therefore inhibition of LOC148811 (Accession XM_086326). Accordingly, utilities of VGAM152 include diagnosis, prevention and treatment of diseases and clinical conditions associated with LOC148811. LOC148930 (Accession XM_086369) is another VGAM152 host target gene. LOC148930 BINDING SITE is HOST TARGET binding site found in the 3' untranslated region of mRNA encoded by LOC148930, corresponding to a HOST TARGET binding site such as BINDING SITE I, BINDING SITE II or BINDING SITE III. Table 2 illustrates the complementarity of the nucleotide sequences of LOC148930 BINDING SITE, designated SEQ ID:38619, to the nucleotide sequence of VGAM152 RNA, herein designated VGAM RNA, also designated SEQ ID:2863.

Another function of VGAM152 is therefore inhibition of LOC148930 (Accession XM_086369). Accordingly, utilities of VGAM152 include diagnosis, prevention and treatment of diseases and clinical conditions associated with LOC148930. LOC149706 (Accession XM_097718) is another VGAM152 host target gene. LOC149706 BINDING SITE is HOST TARGET binding site found in the 5' untranslated region of mRNA encoded by LOC149706, corresponding to a HOST TARGET binding site such as BINDING SITE I, BINDING SITE II or BINDING SITE III. Table 2 illustrates the complementarity of the nucleotide sequences of LOC149706 BINDING SITE, designated SEQ ID:41059, to the nucleotide sequence of VGAM152 RNA, herein designated VGAM RNA, also designated SEQ ID:2863.

Another function of VGAM152 is therefore inhibition of LOC149706 (Accession XM_097718). Accordingly, utilities of VGAM152 include diagnosis, prevention and treatment of diseases and clinical conditions associated with LOC149706. LOC152765 (Accession XM_087519) is another VGAM152 host target gene. LOC152765 BINDING SITE is HOST TARGET binding site found in the 3' untranslated region of mRNA encoded by LOC152765, corresponding to a HOST TARGET binding site such as BINDING SITE I, BINDING SITE II or BINDING SITE III. Table 2 illustrates the complementarity of the nucleotide sequences of LOC152765 BINDING SITE, designated SEQ ID:39319, to the nucleotide sequence of VGAM152 RNA, herein designated VGAM RNA, also designated SEQ ID:2863.

Another function of VGAM152 is therefore inhibition of LOC152765 (Accession XM_087519). Accordingly, utilities of VGAM152 include diagnosis, prevention and treatment of diseases and clinical conditions associated with LOC152765.
LOC157247 (Accession XM_088275) is another VGAM152 host target gene. LOC157247 BINDING SITE is HOST TARGET binding site found in the 5' untranslated region of mRNA encoded by LOC157247, corresponding to a HOST TARGET binding site such as BINDING SITE I, BINDING SITE II or BINDING SITE III. Table 2 illustrates the complementarity of the nucleotide sequences of LOC157247 BINDING SITE, designated SEQ ID:39574, to the nucleotide sequence of VGAM152 RNA, herein designated VGAM RNA, also designated SEQ ID:2863.

Another function of VGAM152 is therefore inhibition of LOC157247 (Accession XM_088275). Accordingly, utilities of VGAM152 include diagnosis, prevention and treatment of diseases and clinical conditions associated with LOC157247.

LOC201164 (Accession XM_113904) is another VGAM152 host target gene. LOC201164 BINDING SITE is HOST TARGET binding site found in the 3' untranslated region of mRNA encoded by LOC201164, corresponding to a HOST TARGET binding site such as BINDING SITE I, BINDING SITE II or BINDING SITE III. Table 2 illustrates the complementarity of the nucleotide sequences of LOC201164 BINDING SITE, designated SEQ ID:42532, to the nucleotide sequence of VGAM152 RNA, herein designated VGAM RNA, also designated SEQ ID:2863.

Another function of VGAM152 is therefore inhibition of LOC201164 (Accession XM_113904). Accordingly, utilities of VGAM152 include diagnosis, prevention and treatment of diseases and clinical conditions associated with LOC201164.

LOC221738 (Accession XM_168097) is another VGAM152 host target gene. LOC221738 BINDING SITE is HOST TARGET binding site found in the 3' untranslated region of mRNA encoded by LOC221738, corresponding to a HOST TARGET binding site such as BINDING SITE I, BINDING SITE II or BINDING SITE III. Table 2 illustrates the complementarity of the nucleotide sequences of LOC221738 BINDING SITE, designated SEQ ID:45029, to the nucleotide sequence of VGAM152 RNA, herein designated VGAM RNA, also designated SEQ ID:2863.

Another function of VGAM152 is therefore inhibition of LOC221738 (Accession XM_168097). Accordingly, utilities of VGAM152 include diagnosis, prevention and treatment of diseases and clinical conditions associated with LOC221738.

LOC221935 (Accession XM_166537) is another VGAM152 host target gene. LOC221935 BINDING SITE is HOST TARGET binding site found in the 3' untranslated region of mRNA encoded by LOC221935, corresponding to a HOST TARGET binding site such as BINDING SITE I, BINDING SITE II or BINDING SITE III. Table 2 illustrates the complementarity of the nucleotide sequences of LOC221935 BINDING SITE, designated SEQ ID:44499, to the nucleotide sequence of VGAM152 RNA, herein designated VGAM RNA, also designated SEQ ID:2863.

Another function of VGAM152 is therefore inhibition of LOC221935 (Accession XM_166537). Accordingly, utilities of VGAM152 include diagnosis, prevention and treatment of diseases and clinical conditions associated with LOC221935.

LOC222128 (Accession XM_166560) is another VGAM152 host target gene. LOC222128 BINDING SITE is HOST TARGET binding site found in the 5' untranslated region of mRNA encoded by LOC222128, corresponding to a HOST TARGET binding site such as BINDING SITE I, BINDING SITE II or BINDING SITE III. Table 2 illustrates the complementarity of the nucleotide sequences of LOC222128 BINDING SITE, designated SEQ ID:44541, to the nucleotide sequence of VGAM152 RNA, herein designated VGAM RNA, also designated SEQ ID:2863.

Another function of VGAM152 is therefore inhibition of LOC222128 (Accession XM_166560). Accordingly, utilities of VGAM152 include diagnosis, prevention and treatment of diseases and clinical conditions associated with LOC222128.

LOC253639 (Accession XM_171060) is another VGAM152 host target gene. LOC253639 BINDING SITE is HOST TARGET binding site found in the 3' untranslated region of mRNA encoded by LOC253639, corresponding to a HOST TARGET binding site such as BINDING SITE I, BINDING SITE II or BINDING SITE III. Table 2 illustrates the complementarity of the nucleotide sequences of LOC253639 BINDING SITE, designated SEQ ID:45854, to the nucleotide sequence of VGAM152 RNA, herein designated VGAM RNA, also designated SEQ ID:2863.

Another function of VGAM152 is therefore inhibition of LOC253639 (Accession XM_171060). Accordingly, utilities of VGAM152 include diagnosis, prevention and treatment of diseases and clinical conditions associated with LOC253639.

LOC91807 (Accession XM_040819) is another VGAM152 host target gene. LOC91807 BINDING SITE is HOST TARGET binding site found in the 5' untranslated region of mRNA encoded by LOC91807, corresponding to a HOST TARGET binding site such as BINDING SITE I, BINDING SITE II or BINDING SITE III. Table 2 illustrates the complementarity of the nucleotide sequences of LOC91807 BINDING SITE, designated SEQ ID:33385, to the nucleotide sequence of VGAM152 RNA, herein designated VGAM RNA, also designated SEQ ID:2863.

Another function of VGAM152 is therefore inhibition of LOC91807 (Accession XM_040819). Accordingly, utilities of VGAM152 include diagnosis, prevention and treatment of diseases and clinical conditions associated with LOC91807.

FIG. 1 further provides a conceptual description of a novel bioinformatically detected viral gene of the present invention, referred to here as Viral Genomic Address Messenger 153 (VGAM153) viral gene, which modulates expression of respective host target genes thereof, the function and utility of which host target genes is known in the art.

VGAM153 is a novel bioinformatically detected regulatory, non protein coding, viral micro RNA (miRNA) gene. The method by which VGAM153 was detected is described hereinabove with reference to FIGS. 1-8.

VGAM153 gene, herein designated VGAM GENE, is a viral gene contained in the genome of Shrimp White Spot Syndrome Virus (white spot bacilliform virus). VGAM153 host target gene, herein designated VGAM HOST TARGET GENE, is a human gene contained in the human genome.

VGAM153 gene encodes a VGAM153 precursor RNA, herein designated VGAM PRECURSOR RNA. Similar to other miRNA genes, and unlike most ordinary genes, VGAM153 precursor RNA does not encode a protein. A nucleotide sequence identical or highly similar to the nucleotide sequence of VGAM153 precursor RNA is designated SEQ ID:139, and is provided hereinbelow with reference to the sequence listing part. Nucleotide sequence SEQ ID:139 is located at position 49690 relative to the genome of Shrimp White Spot Syndrome Virus (white spot bacilliform virus).

VGAM153 precursor RNA folds onto itself, forming VGAM153 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM153 folded precursor RNA into VGAM153 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM153 RNA is designated SEQ ID:2864, and is provided hereinbelow with reference to the sequence listing part.

VGAM153 host target gene, herein designated VGAM HOST TARGET GENE, encodes a corresponding messenger RNA, VGAM153 host target RNA, herein designated VGAM HOST TARGET RNA. VGAM153 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM153 RNA, herein designated VGAM RNA, binds complementarily to one or more host target binding sites located in untranslated regions of VGAM153 host target RNA, herein designated VGAM HOST TARGET RNA. This complementary binding is due to the fact that the nucleotide sequence of VGAM153 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM153 RNA, herein designated VGAM RNA, may have a different number of host target binding sites in untranslated regions of a VGAM153 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM153 RNA, herein designated VGAM RNA, to host target binding sites on VGAM153 host target RNA, herein designated VGAM HOST TARGET RNA, such as BINDING SITE I, BINDING SITE II and BINDING SITE III, inhibits translation of VGAM153 host target RNA into VGAM153 host target protein, herein designated VGAM HOST TARGET PROTEIN. VGAM host target protein is therefore outlined by a broken line.

It is appreciated that VGAM153 host target gene, herein designated VGAM HOST TARGET GENE, in fact represents a plurality of VGAM153 host target genes. The mRNA of each one of this plurality of VGAM153 host target genes comprises one or more host target binding sites, each having a nucleotide sequence which is at least partly complementary to VGAM153 RNA, herein designated VGAM RNA, and which when bound by VGAM153 RNA causes inhibition of translation of respective one or more VGAM153 host target proteins.

It is further appreciated by one skilled in the art that the mode of translational inhibition illustrated by FIG. 1 with specific reference to translational inhibition exerted by VGAM153 gene, herein designated VGAM GENE, on one or more VGAM153 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM153 is inhibition of expression of host target genes, as part of a novel viral mechanism of attacking a host. Accordingly, utilities of VGAM153 include diagnosis, prevention and treatment of viral infection by Shrimp White Spot Syndrome Virus (white spot bacilliform virus). Specific functions, and accordingly utilities, of VGAM153 correlate with, and may be deduced from, the identity of the host target genes which VGAM153 binds and inhibits, and the function of these host target genes, as elaborated hereinbelow.

Nucleotide sequences of the VGAM153 precursor RNA, herein designated VGAM PRECURSOR RNA, and of the 'diced' VGAM153 RNA, herein designated VGAM RNA, and a schematic representation of the secondary folding of VGAM153 folded precursor RNA, herein designated VGAM FOLDED PRECURSOR RNA, of VGAM153 are further described hereinbelow with reference to Table 1.

Nucleotide sequences of host target binding sites, such as BINDING SITE-I, BINDING SITE-II and BINDING SITE-III of FIG. 1, found on VGAM153 host target RNA, and schematic representation of the complementarity of each of these host target binding sites to VGAM153 RNA, herein designated VGAM RNA, are described hereinbelow with reference to Table 2.

As mentioned hereinabove with reference to FIG. 1, a function of VGAM153 gene, herein designated VGAM is inhibition of expression of VGAM153 target genes. It is appreciated that specific functions, and accordingly utilities, of VGAM153 correlate with, and may be deduced from, the identity of the target genes which VGAM153 binds and inhibits, and the function of these target genes, as elaborated hereinbelow.

A Kinase (PRKA) Anchor Protein 13 (AKAP13, Accession XM_116974) is a VGAM153 host target gene. AKAP13 BINDING SITE is HOST TARGET binding site found in the 3' untranslated region of mRNA encoded by AKAP13, corresponding to a HOST TARGET binding site such as BINDING SITE I, BINDING SITE II or BINDING SITE III. Table 2 illustrates the complementarity of the nucleotide sequences of AKAP13 BINDING SITE, designated SEQ ID:43178, to the nucleotide sequence of VGAM153 RNA, herein designated VGAM RNA, also designated SEQ ID:2864.

A function of VGAM153 is therefore inhibition of A Kinase (PRKA) Anchor Protein 13 (AKAP13, Accession XM_116974), a gene which regulates subcellular localization of type II cAMP-dependent PKA. Accordingly, utilities of VGAM153 include diagnosis, prevention and treatment of diseases and clinical conditions associated with AKAP13. The function of AKAP13 and its association with various diseases and clinical conditions, has been established by previous studies, as described hereinabove with reference to VGAM17. FLJ12700 (Accession NM_024910) is another VGAM153 host target gene. FLJ12700 BINDING SITE is HOST TARGET binding site found in the 3' untranslated region of mRNA encoded by FLJ12700, corresponding to a HOST TARGET binding site such as BINDING SITE I, BINDING SITE II or BINDING SITE III. Table 2 illustrates the complementarity of the nucleotide sequences of FLJ12700 BINDING SITE, designated SEQ ID:24412, to the nucleotide sequence of VGAM153 RNA, herein designated VGAM RNA, also designated SEQ ID:2864.

Another function of VGAM153 is therefore inhibition of FLJ12700 (Accession NM_024910). Accordingly, utilities of VGAM153 include diagnosis, prevention and treatment of diseases and clinical conditions associated with FLJ12700. Hippocalcin Like 4 (HPCAL4, Accession NM_016257) is another VGAM153 host target gene. HPCAL4 BINDING SITE is HOST TARGET binding site found in the 3' untranslated region of mRNA encoded by HPCAL4, corresponding to a HOST TARGET binding site such as BINDING SITE I, BINDING SITE II or BINDING SITE III. Table 2 illustrates the complementarity of the nucleotide sequences of HPCAL4 BINDING SITE, designated SEQ ID:18385, to the nucleotide sequence of VGAM153 RNA, herein designated VGAM RNA, also designated SEQ ID:2864.

Another function of VGAM153 is therefore inhibition of Hippocalcin Like 4 (HPCAL4, Accession NM_016257). Accordingly, utilities of VGAM153 include diagnosis, prevention and treatment of diseases and clinical conditions associated with HPCAL4. LOC146243 (Accession XM_096956) is another VGAM153 host target gene. LOC146243 BINDING SITE is HOST TARGET binding site found in the 3' untranslated region of mRNA encoded by LOC146243, corresponding to a HOST TARGET binding site such as BINDING SITE I, BINDING SITE II or BINDING SITE III. Table 2 illustrates the complementarity of the nucleotide sequences of LOC146243 BINDING SITE, designated SEQ ID:40673, to the nucleotide sequence of VGAM153 RNA, herein designated VGAM RNA, also designated SEQ ID:2864.

Another function of VGAM153 is therefore inhibition of LOC146243 (Accession XM_096956). Accordingly, utilities of VGAM153 include diagnosis, prevention and treatment of diseases and clinical conditions associated with LOC146243. FIG. 1 further provides a conceptual description of a novel bioinformatically detected viral gene of the present invention, referred to here as Viral Genomic Address Messenger 154 (VGAM154) viral gene, which modulates expression of respective host target genes thereof, the function and utility of which host target genes is known in the art.

VGAM154 is a novel bioinformatically detected regulatory, non protein coding, viral micro RNA (miRNA) gene. The method by which VGAM154 was detected is described hereinabove with reference to FIGS. 1-8.

VGAM154 gene, herein designated VGAM GENE, is a viral gene contained in the genome of Shrimp White Spot Syndrome Virus (white spot bacilliform virus). VGAM154 host target gene, herein designated VGAM HOST TARGET GENE, is a human gene contained in the human genome.

VGAM154 gene encodes a VGAM154 precursor RNA, herein designated VGAM PRECURSOR RNA. Similar to other miRNA genes, and unlike most ordinary genes, VGAM154 precursor RNA does not encode a protein. A nucleotide sequence identical or highly similar to the nucleotide sequence of VGAM154 precursor RNA is designated SEQ ID:140, and is provided hereinbelow with reference to the sequence listing part. Nucleotide sequence SEQ ID:140 is located at position 33147 relative to the genome of Shrimp White Spot Syndrome Virus (white spot bacilliform virus).

VGAM154 precursor RNA folds onto itself, forming VGAM154 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM154 folded precursor RNA into VGAM154 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM154 RNA is designated SEQ ID:2865, and is provided hereinbelow with reference to the sequence listing part.

VGAM154 host target gene, herein designated VGAM HOST TARGET GENE, encodes a corresponding messenger RNA, VGAM154 host target RNA, herein designated VGAM HOST TARGET RNA. VGAM154 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM154 RNA, herein designated VGAM RNA, binds complementarily to one or more host target binding sites located in untranslated regions of VGAM154 host target RNA, herein designated VGAM HOST TARGET RNA. This complementary binding is due to the fact that the nucleotide sequence of VGAM154 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM154 RNA, herein designated VGAM RNA, may have a different number of host target binding sites in untranslated regions of a VGAM154 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM154 RNA, herein designated VGAM RNA, to host target binding sites on VGAM154 host target RNA, herein designated VGAM HOST TARGET RNA, such as BINDING SITE I, BINDING SITE II and BINDING SITE III, inhibits translation of VGAM154 host target RNA into VGAM154 host target protein, herein designated VGAM HOST TARGET PROTEIN. VGAM host target protein is therefore outlined by a broken line.

It is appreciated that VGAM154 host target gene, herein designated VGAM HOST TARGET GENE, in fact represents a plurality of VGAM154 host target genes. The mRNA of each one of this plurality of VGAM154 host target genes comprises one or more host target binding sites, each having a nucleotide sequence which is at least partly complementary to VGAM154 RNA, herein designated VGAM RNA, and which when bound by VGAM154 RNA causes inhibition of translation of respective one or more VGAM154 host target proteins.

It is further appreciated by one skilled in the art that the mode of translational inhibition illustrated by FIG. 1 with specific reference to translational inhibition exerted by VGAM154 gene, herein designated VGAM GENE, on one or more VGAM154 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM154 is inhibition of expression of host target genes, as part of a novel viral mechanism of attacking a host. Accordingly, utilities of VGAM154 include diagnosis, prevention and treatment of viral infection by Shrimp White Spot Syndrome Virus (white spot bacilliform virus). Specific functions, and accordingly utilities, of VGAM154 correlate with, and may be deduced from, the identity of the host target genes which VGAM154 binds and inhibits, and the function of these host target genes, as elaborated hereinbelow.

Nucleotide sequences of the VGAM154 precursor RNA, herein designated VGAM PRECURSOR RNA, and of the 'diced' VGAM154 RNA, herein designated VGAM RNA, and a schematic representation of the secondary folding of VGAM154 folded precursor RNA, herein designated VGAM FOLDED PRECURSOR RNA, of VGAM154 are further described hereinbelow with reference to Table 1.

Nucleotide sequences of host target binding sites, such as BINDING SITE-I, BINDING SITE-II and BINDING SITE-III of FIG. 1, found on VGAM154 host target RNA, and schematic representation of the complementarity of each of these host target binding sites to VGAM154 RNA, herein designated VGAM RNA, are described hereinbelow with reference to Table 2.

As mentioned hereinabove with reference to FIG. 1, a function of VGAM154 gene, herein designated VGAM is inhibition of expression of VGAM154 target genes. It is appreciated that specific functions, and accordingly utilities, of VGAM154 correlate with, and may be deduced from, the identity of the target genes which VGAM154 binds and inhibits, and the function of these target genes, as elaborated hereinbelow.

MDM1 (Accession NM_020128) is a VGAM154 host target gene. MDM1 BINDING SITE is HOST TARGET binding site found in the 3' untranslated region of mRNA encoded by MDM1, corresponding to a HOST TARGET binding site such as BINDING SITE I, BINDING SITE II or BINDING SITE III. Table 2 illustrates the complementarity of the nucleotide sequences of MDM1 BINDING SITE, designated SEQ ID:21322, to the nucleotide sequence of VGAM154 RNA, herein designated VGAM RNA, also designated SEQ ID:2865.

A function of VGAM154 is therefore inhibition of MDM1 (Accession NM_020128). Accordingly, utilities of VGAM154 include diagnosis, prevention and treatment of diseases and clinical conditions associated with MDM1. Tumor Necrosis Factor Receptor Superfamily, Member 8 (TNFRSF8, Accession NM_001243) is another VGAM154 host target gene. TNFRSF8 BINDING SITE is HOST TARGET binding site found in the 3' untranslated region of mRNA encoded by TNFRSF8, corresponding to a HOST TARGET binding site such as BINDING SITE I, BINDING SITE II or BINDING SITE III. Table 2 illustrates the complementarity of the nucleotide sequences of TNFRSF8 BINDING SITE, designated SEQ ID:6911, to the nucleotide sequence of VGAM154 RNA, herein designated VGAM RNA, also designated SEQ ID:2865.

Another function of VGAM154 is therefore inhibition of Tumor Necrosis Factor Receptor Superfamily, Member 8 (TNFRSF8, Accession NM_001243), a gene which regulates gene expression through activation of nf-kappab. Accordingly, utilities of VGAM154 include diagnosis, prevention and treatment of diseases and clinical conditions associated with TNFRSF8. The function of TNFRSF8 has been established by previous studies. By in vitro binding, immunoprecipitation, immunoblot, and yeast 2-hybrid analyses, Aizawa et al. (1997) showed that TRAF2 (OMIM Ref. No. 601895) and TRAF5 (OMIM Ref. No. 602356) interact with overlapping but distinct sequences in the C-terminal region of CD30 and mediate the activation of nuclear factor kappa-B (see OMIM Ref. No. 164011). Kurts et al. (1999) identified a new mechanism that protects against autoimmunity mediated through CD30. CD30 is expressed by activated, but not by resting, B or T cells. Using a model system in which ovalbumin-specific CD8+ T cells from the OT-I transgenic line were adoptively transferred into unirradiated transgenic mice that expressed ovalbumin in the pancreatic beta cells and the proximal renal tubular cells, Kurts et al. (1999) found that wildtype OT-I cells caused diabetes only when adoptively transferred in large numbers (greater than 250,000), with lower doses being effectively tolerized. CD30-deficient islet-specific CD8+ T cells were roughly 6,000-fold more autoaggressive than wildtype cells, with the transfer of as few as 160 CD30-deficient T cells leading to the complete destruction of pancreatic islets and the rapid onset of diabetes (within 4 days). Kurts et al. (1999) showed that in the absence of CD30 signaling, cells activated but not yet deleted by the CD95 (OMIM Ref. No. 134637)-dependent cross-tolerance mechanism gain the ability to proliferate extensively upon secondary encounter with antigen on parenchymal tissues, such as the pancreatic islets. Thus, CD30 signaling limits the proliferative potential of autoreactive CD8 effector T cells, and protects the body against autoimmunity.

Full details of the abovementioned studies are described in the following publications, the disclosure of which are hereby incorporated by reference:

Aizawa, S.; Nakano, H.; Ishida, T.; Horie, R.; Nagai, M.; Ito, K.; Yagita, H.; Okumura, K.; Inoue, J.; Watanabe, T.: Tumor necrosis factor receptor-associated factor (TRAF) 5 and TRAF2 are involved in CD30-mediated NF-kappa-B activation. J. Biol. Chem. 272:2042-2045, 1997; and Kurts, C.; Carbone, F. R.; Krummel, M. F.; Koch, K. M.; Miller, J. F. A. P.; Heath, W. R.: Signalling through CD30 protects against autoimmune diabetes mediated by CD8 T cells. Nature 3.

Further studies establishing the function and utilities of TNFRSF8 are found in John Hopkins OMIM database record ID 153243, and in sited publications numbered 11509-11510, 347 and 11511-11513 listed in the bibliography section hereinbelow, which are also hereby incorporated by reference. FLJ13114 (Accession NM_024541) is another VGAM154 host target gene. FLJ13114 BINDING SITE is HOST TARGET binding site found in the 3" untranslated region of mRNA encoded by FLJ13114, corresponding to a HOST TARGET binding site such as BINDING SITE I, BINDING SITE II or BINDING SITE III. Table 2 illustrates the complementarity of the nucleotide sequences of FLJ13114 BINDING SITE, designated SEQ ID:23751, to the nucleotide sequence of VGAM154 RNA, herein designated VGAM RNA, also designated SEQ ID:2865.

Another function of VGAM154 is therefore inhibition of FLJ13114 (Accession NM_024541). Accordingly, utilities of VGAM154 include diagnosis, prevention and treatment of diseases and clinical conditions associated with FLJ13114.

HCA4 (Accession XM_085287) is another VGAM154 host target gene. HCA4 BINDING SITE is HOST TARGET binding site found in the 3' untranslated region of mRNA encoded by HCA4, corresponding to a HOST TARGET binding site such as BINDING SITE I, BINDING SITE II or BINDING SITE III. Table 2 illustrates the complementarity of the nucleotide sequences of HCA4 BINDING SITE, designated SEQ ID:38025, to the nucleotide sequence of VGAM154 RNA, herein designated VGAM RNA, also designated SEQ ID:2865.

Another function of VGAM154 is therefore inhibition of HCA4 (Accession XM_085287). Accordingly, utilities of VGAM154 include diagnosis, prevention and treatment of diseases and clinical conditions associated with HCA4. Insulin-like Growth Factor 2, Antisense (IGF2AS, Accession NM_016412) is another VGAM154 host target gene. IGF2AS BINDING SITE is HOST TARGET binding site found in the 3' untranslated region of mRNA encoded by IGF2AS, corresponding to a HOST TARGET binding site such as BINDING SITE I, BINDING SITE II or BINDING SITE III. Table 2 illustrates the complementarity of the nucleotide sequences of IGF2AS BINDING SITE, designated SEQ ID:18542, to the nucleotide sequence of VGAM154 RNA, herein designated VGAM RNA, also designated SEQ ID:2865.

Another function of VGAM154 is therefore inhibition of Insulin-like Growth Factor 2, Antisense (IGF2AS, Accession NM_016412). Accordingly, utilities of VGAM154 include diagnosis, prevention and treatment of diseases and clinical conditions associated with IGF2AS. KIAA0476 (Accession NM_014856) is another VGAM154 host target gene. KIAA0476 BINDING SITE is HOST TARGET binding site found in the 3' untranslated region of mRNA encoded by KIAA0476, corresponding to a HOST TARGET binding site such as BINDING SITE I, BINDING SITE II or BINDING SITE III. Table 2 illustrates the complementarity of the nucleotide sequences of KIAA0476 BINDING SITE, designated SEQ ID:16904, to the nucleotide sequence of VGAM154 RNA, herein designated VGAM RNA, also designated SEQ ID:2865.

Another function of VGAM154 is therefore inhibition of KIAA0476 (Accession NM_014856). Accordingly, utilities of VGAM154 include diagnosis, prevention and treatment of diseases and clinical conditions associated with KIAA0476. KIAA0652 (Accession NM_014741) is another VGAM154 host target gene. KIAA0652 BINDING SITE is HOST TARGET binding site found in the 3' untranslated region of mRNA encoded by KIAA0652, corresponding to a HOST TARGET binding site such as BINDING SITE I, BINDING SITE II or BINDING SITE III. Table 2 illustrates the complementarity of the nucleotide sequences of KIAA0652 BINDING SITE, designated SEQ ID:16410, to the nucleotide sequence of VGAM154 RNA, herein designated VGAM RNA, also designated SEQ ID:2865.

Another function of VGAM154 is therefore inhibition of KIAA0652 (Accession NM_014741). Accordingly, utilities of VGAM154 include diagnosis, prevention and treatment of diseases and clinical conditions associated with KIAA0652. KIAA0937 (Accession XM_166213) is another VGAM154 host target gene. KIAA0937 BINDING SITE is HOST TARGET binding site found in the 3' untranslated region of mRNA encoded by KIAA0937, corresponding to a HOST TARGET binding site such as BINDING SITE I, BINDING SITE II or BINDING SITE III. Table 2 illustrates the complementarity of the nucleotide sequences of KIAA0937 BINDING SITE, designated SEQ ID:44018, to the nucleotide sequence of VGAM154 RNA, herein designated VGAM RNA, also designated SEQ ID:2865.

Another function of VGAM154 is therefore inhibition of KIAA0937 (Accession XM_166213). Accordingly, utilities of VGAM154 include diagnosis, prevention and treatment of diseases and clinical conditions associated with KIAA0937. Signal Transducer and Activator of Transcription 2, 113 kDa (STAT2, Accession NM_005419) is another VGAM154 host target gene. STAT2 BINDING SITE is HOST TARGET binding site found in the 3' untranslated region of mRNA encoded by STAT2, corresponding to a HOST TARGET binding site such as BINDING SITE I, BINDING SITE II or BINDING SITE III. Table 2 illustrates the complementarity of the nucleotide sequences of STAT2 BINDING SITE, designated SEQ ID:11892, to the nucleotide sequence of VGAM154 RNA, herein designated VGAM RNA, also designated SEQ ID:2865.

Another function of VGAM154 is therefore inhibition of Signal Transducer and Activator of Transcription 2, 113 kDa (STAT2, Accession NM_005419). Accordingly, utilities of VGAM154 include diagnosis, prevention and treatment of diseases and clinical conditions associated with STAT2. LOC145123 (Accession XM_041473) is another VGAM154 host target gene. LOC145123 BINDING SITE is HOST TARGET binding site found in the 5' untranslated region of mRNA encoded by LOC145123, corresponding to a HOST TARGET binding site such as BINDING SITE I, BINDING SITE II or BINDING SITE III. Table 2 illustrates the complementarity of the nucleotide sequences of LOC145123 BINDING SITE, designated SEQ ID:33533, to the nucleotide sequence of VGAM154 RNA, herein designated VGAM RNA, also designated SEQ ID:2865.

Another function of VGAM154 is therefore inhibition of LOC145123 (Accession XM_041473). Accordingly, utilities of VGAM154 include diagnosis, prevention and treatment of diseases and clinical conditions associated with LOC145123. LOC151512 (Accession XM_098072) is another VGAM154 host target gene. LOC151512 BINDING SITE is HOST TARGET binding site found in the 5' untranslated region of mRNA encoded by LOC151512, corresponding to a HOST TARGET binding site such as BINDING SITE I, BINDING SITE II or BINDING SITE III. Table 2 illustrates the complementarity of the nucleotide sequences of LOC151512 BINDING SITE, designated SEQ ID:41363, to the nucleotide sequence of VGAM154 RNA, herein designated VGAM RNA, also designated SEQ ID:2865.

Another function of VGAM154 is therefore inhibition of LOC151512 (Accession XM_098072). Accordingly, utilities of VGAM154 include diagnosis, prevention and treatment of diseases and clinical conditions associated with LOC151512. LOC220549 (Accession XM_167521) is another VGAM154 host target gene. LOC220549 BINDING SITE is HOST TARGET binding site found in the 5' untranslated region of mRNA encoded by LOC220549, corresponding to a HOST TARGET binding site such as BINDING SITE I, BINDING SITE II or BINDING SITE III. Table 2 illustrates the complementarity of the nucleotide sequences of LOC220549 BINDING SITE, designated SEQ ID:44649, to the nucleotide sequence of VGAM154 RNA, herein designated VGAM RNA, also designated SEQ ID:2865.

Another function of VGAM154 is therefore inhibition of LOC220549 (Accession XM_167521). Accordingly, utilities of VGAM154 include diagnosis, prevention and treatment of diseases and clinical conditions associated with LOC220549. LOC220827 (Accession XM_166052) is another VGAM154 host target gene. LOC220827 BINDING SITE is HOST TARGET binding site found in the 3' untranslated region of mRNA encoded by LOC220827, corresponding to a HOST TARGET binding site such as BINDING SITE I, BINDING SITE II or BINDING SITE III. Table 2 illustrates the complementarity of the nucleotide sequences of LOC220827 BINDING SITE, designated SEQ ID:43846, to the nucleotide sequence of VGAM154 RNA, herein designated VGAM RNA, also designated SEQ ID:2865.

Another function of VGAM154 is therefore inhibition of LOC220827 (Accession XM_166052). Accordingly, utilities of VGAM154 include diagnosis, prevention and treatment of diseases and clinical conditions associated with LOC220827. FIG. 1 further provides a conceptual description of a novel bioinformatically detected viral gene of the present invention, referred to here as Viral Genomic Address Messenger 155 (VGAM155) viral gene, which modulates expression of respective host target genes thereof, the function and utility of which host target genes is known in the art.

VGAM155 is a novel bioinformatically detected regulatory, non protein coding, viral micro RNA (miRNA) gene. The method by which VGAM155 was detected is described hereinabove with reference to FIGS. 1-8.

VGAM155 gene, herein designated VGAM GENE, is a viral gene contained in the genome of Shrimp White Spot Syndrome Virus (white spot bacilliform virus). VGAM155 host target gene, herein designated VGAM HOST TARGET GENE, is a human gene contained in the human genome.

VGAM155 gene encodes a VGAM155 precursor RNA, herein designated VGAM PRECURSOR RNA. Similar to other miRNA genes, and unlike most ordinary genes, VGAM155 precursor RNA does not encode a protein. A nucleotide sequence identical or highly similar to the nucleotide sequence of VGAM155 precursor RNA is designated SEQ ID:141, and is provided hereinbelow with reference to the sequence listing part. Nucleotide sequence SEQ ID:141 is located at position 234589 relative to the genome of Shrimp White Spot Syndrome Virus (white spot bacilliform virus).

VGAM155 precursor RNA folds onto itself, forming VGAM155 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM155 folded precursor RNA into VGAM155 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM155 RNA is designated SEQ ID:2866, and is provided hereinbelow with reference to the sequence listing part.

VGAM155 host target gene, herein designated VGAM HOST TARGET GENE, encodes a corresponding messenger RNA, VGAM155 host target RNA, herein designated VGAM HOST TARGET RNA. VGAM155 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM155 RNA, herein designated VGAM RNA, binds complementarily to one or more host target binding sites located in untranslated regions of VGAM155 host target RNA, herein designated VGAM HOST TARGET RNA. This complementary binding is due to the fact that the nucleotide sequence of VGAM155 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM155 RNA, herein designated VGAM RNA, may have a different number of host target binding sites in untranslated regions of a VGAM155 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM155 RNA, herein designated VGAM RNA, to host target binding sites on VGAM155 host target RNA, herein designated VGAM HOST TARGET RNA, such as BINDING SITE I, BINDING SITE II and BINDING SITE III, inhibits translation of VGAM155 host target RNA into VGAM155 host target protein, herein designated VGAM HOST TARGET PROTEIN. VGAM host target protein is therefore outlined by a broken line.

It is appreciated that VGAM155 host target gene, herein designated VGAM HOST TARGET GENE, in fact represents a plurality of VGAM155 host target genes. The mRNA of each one of this plurality of VGAM155 host target genes comprises one or more host target binding sites, each having a nucleotide sequence which is at least partly complementary to VGAM155 RNA, herein designated VGAM RNA, and which when bound by VGAM155 RNA causes inhibition of translation of respective one or more VGAM155 host target proteins.

It is further appreciated by one skilled in the art that the mode of translational inhibition illustrated by FIG. 1 with specific reference to translational inhibition exerted by VGAM155 gene, herein designated VGAM GENE, on one or more VGAM155 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM155 is inhibition of expression of host target genes, as part of a novel viral mechanism of attacking a host. Accordingly, utilities of VGAM155 include diagnosis, prevention and treatment of viral infection by Shrimp White Spot Syndrome Virus (white spot bacilliform virus). Specific functions, and accordingly utilities, of VGAM155 correlate with, and may be deduced from, the identity of the host target genes which VGAM155 binds and inhibits, and the function of these host target genes, as elaborated hereinbelow.

Nucleotide sequences of the VGAM155 precursor RNA, herein designated VGAM PRECURSOR RNA, and of the 'diced' VGAM155 RNA, herein designated VGAM RNA, and a schematic representation of the secondary folding of VGAM155 folded precursor RNA, herein designated VGAM FOLDED PRECURSOR RNA, of VGAM155 are further described hereinbelow with reference to Table 1.

Nucleotide sequences of host target binding sites, such as BINDING SITE-I, BINDING SITE-II and BINDING SITE-III of FIG. 1, found on VGAM155 host target RNA, and schematic representation of the complementarity of each of these host target binding sites to VGAM155 RNA, herein designated VGAM RNA, are described hereinbelow with reference to Table 2.

As mentioned hereinabove with reference to FIG. 1, a function of VGAM155 gene, herein designated VGAM is inhibition of expression of VGAM155 target genes. It is appreciated that specific functions, and accordingly utilities, of VGAM155 correlate with, and may be deduced from, the identity of the target genes which VGAM155 binds and inhibits, and the function of these target genes, as elaborated hereinbelow.

Ubiquitin-conjugating Enzyme E2 Variant 1 (UBE2V1, Accession NM_003349) is a VGAM155 host target gene. UBE2V1 BINDING SITE1 through UBE2V1 BINDING SITE3 are HOST TARGET binding sites found in untranslated regions of mRNA encoded by UBE2V1, corresponding to HOST TARGET binding sites such as BINDING SITE I, BINDING SITE II or BINDING SITE III. Table 2 illustrates the complementarity of the nucleotide sequences of UBE2V1 BINDING SITE1 through UBE2V1 BINDING SITE3, designated SEQ ID:9374, SEQ ID:22526 and SEQ ID:22773 respectively, to the nucleotide sequence of VGAM155 RNA, herein designated VGAM RNA, also designated SEQ ID:2866.

A function of VGAM155 is therefore inhibition of Ubiquitin-conjugating Enzyme E2 Variant 1 (UBE2V1, Accession NM_003349), a gene which may play a role in signaling for DNA repair. Accordingly, utilities of VGAM155 include diagnosis, prevention and treatment of diseases and clinical conditions associated with UBE2V1. The function of UBE2V1 has been established by previous studies. Rothofsky and Lin (1997) isolated human brain cDNAs encoding UBE2V1, which they called CROC1. They identified 2 alternative 5-prime CROC1 cDNA sequences, which resulted in predicted 221- and 170-amino acid proteins that differ at their N-terminal ends. The CROC1 isoforms have an acidic domain and a C-terminal basic domain. They show sequence similarity to ubiquitin-conjugating enzymes (UBCs, or E2s, e.g., UBE2D1; 602961) but lack the conserved cysteine residue that is critical for the catalytic activity of E2s. The CROC1 C-terminal domain has 42% sequence identity with the potential DNA-binding domain of TAFII250 (TAF2A; 313650). Immunofluorescence microscopy showed that recombinant CROC1 was located in the nucleus, excluding the nucleolar organizer regions. The authors demonstrated that CROC1 can cause transcriptional activation of the human FOS (OMIM Ref. No. 164810) promoter. Northern blot analysis detected approximately 2.1- and 2.5-kb CROC1 transcripts in all human tissues examined, with the highest levels in brain, skeletal muscle, and kidney. Sancho et al. (1998) isolated partial human intestinal epithelial cell cDNAs containing the 3-prime coding sequence and 3-prime untranslated region of UBE2V1, which they called UEV1. The UEV1 gene contains at least 6 exons and has at least 3 alternative polyadenylation sites in the 3-prime untranslated region. RT-PCR identified 4 alternatively spliced UEV1 transcripts that encode proteins with identical 90-amino acid C-terminal sequences, including the region homologous to the conserved Ubc domain of E2 enzymes, but unique N-terminal sequences. The 140-amino acid C terminus of the deduced 221- and 170-amino acid UEV1 isoforms identified by Rothofsky and Lin (1997) is 90% identical to UEV2 (UBE2V2; 603001); it is 18%, 24%, and 22% identical to the Ubc domain of human UBE2I (OMIM Ref. No. 601661), S. cerevisiae UBC4 and UBC7, and A. thaliana UBC1, respectively. The authors showed that UEV1 does not have ubiquitin-conjugating activity in vitro. UEV1 transcripts were downregulated upon differentiation of a colon carcinoma cell line. Constitutive expression of exogenous UEV1 protein in these colon carcinoma cells inhibited their capacity to differentiate upon confluence and induced changes in their cell cycle behavior, which was associated with an inhibition of the mitotic kinase CDK1 (see OMIM Ref. No. CDC2; 116940).

Full details of the abovementioned studies are described in the following publications, the disclosure of which are hereby incorporated by reference:

Rothofsky, M. L.; Lin, S. L.: CROC-1 encodes a protein which mediates transcriptional activation of the human FOS promoter. Gene 195:141-149, 1997; and Sancho, E.; Vila, M. R.; Sanchez-Pulido, L.; Lozano, J. J.; Paciucci, R.; Nadal, M.; Fox, M.; Harvey, C.; Bercovich, B.; Loukili, N.; Ciechanover, A.; Lin, S. L.; Sanz, F.; Estivill, X.

Further studies establishing the function and utilities of UBE2V1 are found in John Hopkins OMIM database record ID 602995, and in sited publications numbered 9020-5411 listed in the bibliography section hereinbelow, which are also hereby incorporated by reference. LOC157349 (Accession XM_088298) is another VGAM155 host target gene. LOC157349 BINDING SITE is HOST TARGET binding site found in the 5' untranslated region of mRNA encoded by LOC157349, corresponding to a HOST TARGET binding site such as BINDING SITE I, BINDING SITE II or BINDING SITE III. Table 2 illustrates the complementarity of the nucleotide sequences of LOC157349 BINDING SITE, designated SEQ ID:39586, to the nucleotide sequence of VGAM155 RNA, herein designated VGAM RNA, also designated SEQ ID:2866.

Another function of VGAM155 is therefore inhibition of LOC157349 (Accession XM_088298). Accordingly, utilities of VGAM155 include diagnosis, prevention and treatment of diseases and clinical conditions associated with LOC157349. LOC170409 (Accession XM_096330) is another VGAM155 host target gene. LOC170409 BINDING SITE is HOST TARGET binding site found in the 3' untranslated region of mRNA encoded by LOC170409, corresponding to a HOST TARGET binding site such as BINDING SITE I, BINDING SITE II or BINDING SITE III. Table 2 illustrates the complementarity of the nucleotide sequences of LOC170409 BINDING SITE, designated SEQ ID:40315, to the nucleotide sequence of VGAM155 RNA, herein designated VGAM RNA, also designated SEQ ID:2866.

Another function of VGAM155 is therefore inhibition of LOC170409 (Accession XM_096330). Accordingly, utilities of VGAM155 include diagnosis, prevention and treatment of diseases and clinical conditions associated with LOC170409.

FIG. 1 further provides a conceptual description of a novel bioinformatically detected viral gene of the present invention, referred to here as Viral Genomic Address Messenger 156 (VGAM156) viral gene, which modulates expression of respective host target genes thereof, the function and utility of which host target genes is known in the art.

VGAM156 is a novel bioinformatically detected regulatory, non protein coding, viral micro RNA (miRNA) gene. The method by which VGAM156 was detected is described hereinabove with reference to FIGS. 1-8.

VGAM156 gene, herein designated VGAM GENE, is a viral gene contained in the genome of Shrimp White Spot Syndrome Virus (white spot bacilliform virus). VGAM156 host target gene, herein designated VGAM HOST TARGET GENE, is a human gene contained in the human genome.

VGAM156 gene encodes a VGAM156 precursor RNA, herein designated VGAM PRECURSOR RNA. Similar to other miRNA genes, and unlike most ordinary genes, VGAM156 precursor RNA does not encode a protein. A nucleotide sequence identical or highly similar to the nucleotide sequence of VGAM156 precursor RNA is designated SEQ ID:142, and is provided hereinbelow with reference to the sequence listing part. Nucleotide sequence SEQ ID:142 is located at position 29183 relative to the genome of Shrimp White Spot Syndrome Virus (white spot bacilliform virus).

VGAM156 precursor RNA folds onto itself, forming VGAM156 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM156 folded precursor RNA into VGAM156 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM156 RNA is designated SEQ ID:2867, and is provided hereinbelow with reference to the sequence listing part.

VGAM156 host target gene, herein designated VGAM HOST TARGET GENE, encodes a corresponding messenger RNA, VGAM156 host target RNA, herein designated VGAM HOST TARGET RNA. VGAM156 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM156 RNA, herein designated VGAM RNA, binds complementarily to one or more host target binding sites located in untranslated regions of VGAM156 host target RNA, herein designated VGAM HOST TARGET RNA. This complementary binding is due to the fact that the nucleotide sequence of VGAM156 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM156 RNA, herein designated VGAM RNA, may have a different number of host target binding sites in untranslated regions of a VGAM156 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM156 RNA, herein designated VGAM RNA, to host target binding sites on VGAM156 host target RNA, herein designated VGAM HOST TARGET RNA, such as BINDING SITE I, BINDING SITE II and BINDING SITE III, inhibits translation of VGAM156 host target RNA into VGAM156 host target protein, herein designated VGAM HOST TARGET PROTEIN. VGAM host target protein is therefore outlined by a broken line.

It is appreciated that VGAM156 host target gene, herein designated VGAM HOST TARGET GENE, in fact represents a plurality of VGAM156 host target genes. The mRNA of each one of this plurality of VGAM156 host target genes comprises one or more host target binding sites, each having a nucleotide sequence which is at least partly complementary to VGAM156 RNA, herein designated VGAM RNA, and which when bound by VGAM156 RNA causes inhibition of translation of respective one or more VGAM156 host target proteins.

It is further appreciated by one skilled in the art that the mode of translational inhibition illustrated by FIG. 1 with specific reference to translational inhibition exerted by VGAM156 gene, herein designated VGAM GENE, on one or more VGAM156 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM156 is inhibition of expression of host target genes, as part of a novel viral mechanism of attacking a host. Accordingly, utilities of VGAM156 include diagnosis, prevention and treatment of viral infection by Shrimp White Spot Syndrome Virus (white spot bacilliform virus). Specific functions, and accordingly utilities, of VGAM156 correlate with, and may be deduced from, the identity of the host target genes which VGAM156 binds and inhibits, and the function of these host target genes, as elaborated hereinbelow.

Nucleotide sequences of the VGAM156 precursor RNA, herein designated VGAM PRECURSOR RNA, and of the 'diced' VGAM156 RNA, herein designated VGAM RNA, and a schematic representation of the secondary folding of VGAM156 folded precursor RNA, herein designated VGAM FOLDED PRECURSOR RNA, of VGAM156 are further described hereinbelow with reference to Table 1.

Nucleotide sequences of host target binding sites, such as BINDING SITE-I, BINDING SITE-II and BINDING SITE-III of FIG. 1, found on VGAM156 host target RNA, and schematic representation of the complementarity of each of these host target binding sites to VGAM156 RNA, herein designated VGAM RNA, are described hereinbelow with reference to Table 2.

As mentioned hereinabove with reference to FIG. 1, a function of VGAM156 gene, herein designated VGAM is inhibition of expression of VGAM156 target genes. It is appreciated that specific functions, and accordingly utilities, of VGAM156 correlate with, and may be deduced from, the identity of the target genes which VGAM156 binds and inhibits, and the function of these target genes, as elaborated hereinbelow.

ATPase, Class VI, Type 11A (ATP11A, Accession XM_085028) is a VGAM156 host target gene. ATP11A BINDING SITE is HOST TARGET binding site found in the 3' untranslated region of mRNA encoded by ATP11A, corresponding to a HOST TARGET binding site such as BINDING SITE I, BINDING SITE II or BINDING SITE III. Table 2 illustrates the complementarity of the nucleotide sequences of ATP11A BINDING SITE, designated SEQ ID:37802, to the nucleotide sequence of VGAM156 RNA, herein designated VGAM RNA, also designated SEQ ID:2867.

A function of VGAM156 is therefore inhibition of ATPase, Class VI, Type 11A (ATP11A, Accession XM_085028). Accordingly, utilities of VGAM156 include diagnosis, prevention and treatment of diseases and clinical conditions associated with ATP11A. D12S2489E (Accession NM_007360) is another VGAM156 host target gene. D12S2489E BINDING SITE is HOST TARGET binding site found in the 5' untranslated region of mRNA encoded by D12S2489E, corresponding to a HOST TARGET binding site such as BINDING SITE I, BINDING SITE II or BINDING SITE III. Table 2 illustrates the complementarity of the nucleotide sequences of D12S2489E BINDING SITE, designated SEQ ID:14292, to the nucleotide sequence of VGAM156 RNA, herein designated VGAM RNA, also designated SEQ ID:2867.

Another function of VGAM156 is therefore inhibition of D12S2489E (Accession NM_007360), a gene which interacts in the inhibition and activation of NK cells. Accordingly, utilities of VGAM156 include diagnosis, prevention and treatment of diseases and clinical conditions associated with D12S2489E. The function of D12S2489E has been established by previous studies. Bauer et al. (1999) found that NKG2D is expressed on gamma/delta T cells, CD8-alpha (OMIM Ref. No. 186910)/-beta (OMIM Ref. No. 186730)-positive T cells, and natural killer cells and is a receptor for MICA (OMIM Ref. No. 600169). MICA binding to NKG2D activated cytolytic responses of gamma/delta T cells and NK cells against transfectants and epithelial tumor cells expressing MICA. The authors noted that these results define an activating immunoreceptor-MHC ligand interaction that may promote antitumor NK and T-cell responses. Wu et al. (1999) demonstrated that NKG2D and DAP10 (OMIM Ref. No. 604089) interact specifically to form an activating immunoreceptor complex. Sutherland et al. (2002) showed that an NKG2D fusion protein or antibody to NKG2D blocked the binding of UL16-binding proteins, or ULBPs (see OMIM Ref. No. ULBP1; 605697), and MICs to primary NK cells, indicating that NKG2D is the counterstructure for ULBPs. Immunoblot analysis showed that ULBPs stimulate marked protein phosphorylation, notably of JAK2 (OMIM Ref. No. 147796) and STAT5 (see OMIM Ref. No. 604260), and induce activation of the ERK (see OMIM Ref. No. 601795) mitogen-activated protein kinase (MAPK) pathway. Immunoprecipitation analysis demonstrated that ULBP triggering induces phosphorylation of both the p85 (OMIM Ref. No. 171833) and p110 (OMIM Ref. No. 601232) subunits of phosphatidylinositol 3-kinase (PI3K) through DAP10, the NKG2D signaling partner. PI3K, in turn, was found to be required for ULBP-induced cytokine and chemokine production. In all cases, Sutherland et al. (2002) observed that ULBP3 (OMIM Ref. No. 605699) bound more weakly to NKG2D and induced weaker signaling responses than did ULBP2 (OMIM Ref. No. 605698) or ULBP1. Animal model experiments lend further support to the function of D12S2489E. Colucci et al. (2002) noted that human S with mutations in ZAP70 (OMIM Ref. No. 176947) have T-cell immunodeficiency, that mice lacking Zap70 have blocked T-cell development, and that mice lacking Syk (OMIM Ref. No. 600085) have a failure of B-cell development. NK cells express both molecules, which associate with immunoreceptor tyrosine-based activation motifs (ITAMs). Using mice deficient in both Zap70 and Syk, Colucci et al. (2002) observed NK cell activity comparable to that in wildtype mice. The mutant cells expressed Nkg2d and were able to lyse targets with and without Nkg2d ligands in vitro and in vivo. However, wildtype cells, but not the double-deficient cells, responded to CD16 (OMIM Ref. No. 146740) and Ly49d (see OMIM Ref. No. 604274) cross-linking with increased cytotoxicity, suggesting that these 2 ITAM-bearing receptors are unable to signal in the mutant cells. Inhibitors of PI3K or Src kinases blocked and, in combination, abrogated cytotoxic activity in the mutant cells, whereas inhibition of both kinases was required to reduce wildtype NK activity. Colucci et al. (2002) concluded that intracellular signaling in the adaptive immune system, i.e., in B and T cells, is fundamentally different from that in the NK cells of the innate immune system.

It is appreciated that the abovementioned animal model for D12S2489E is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sutherland, C. L.; Chalupny, N. J.; Schooley, K.; VandenBos, T.; Kubin, M.; Cosman, D.: UL16-binding proteins, novel MHC class I-related proteins, bind to NKG2D and activate multiple signaling pathways in primary NK cells. J. Immun. 168:671-679, 2002; and Groh, V.; Rhinehart, R.; Randolph-Habecker, J.; Topp, M. S.; Riddell, S. R.; Spies, T.: Costimulation of CD8-alpha-beta T cells by NKG2D via engagement by MIC induced on virus-infected.

Further studies establishing the function and utilities of D12S2489E are found in John Hopkins OMIM database record ID 602893, and in sited publications numbered 7909, 12705-7912, 7914, 7915, 8094-242 and 2528 listed in the bibliography section hereinbelow, which are also hereby incorporated by reference. DKFZP434N1511 (Accession XM_166138) is another VGAM156 host target gene. DKFZP434N1511 BINDING SITE is HOST TARGET binding site found in the 5' untranslated region of mRNA encoded by DKFZP434N1511, corresponding to a HOST TARGET binding site such as BINDING SITE I, BINDING SITE II or BINDING SITE III. Table 2 illustrates the complementarity of the nucleotide sequences of DKFZP434N1511 BINDING SITE, designated SEQ ID:43933, to the nucleotide sequence of VGAM156 RNA, herein designated VGAM RNA, also designated SEQ ID:2867.

Another function of VGAM156 is therefore inhibition of DKFZP434N1511 (Accession XM_166138). Accordingly, utilities of VGAM156 include diagnosis, prevention and treatment of diseases and clinical conditions associated with DKFZP434N1511. LOC56906 (Accession NM_020147) is another VGAM156 host target gene. LOC56906 BINDING SITE is HOST TARGET binding site found in the 3' untranslated region of mRNA encoded by LOC56906, corresponding to a HOST TARGET binding site such as BINDING SITE I, BINDING SITE II or BINDING SITE III. Table 2 illustrates the complementarity of the nucleotide sequences of LOC56906 BINDING SITE, designated SEQ ID:21342, to the nucleotide sequence of VGAM156 RNA, herein designated VGAM RNA, also designated SEQ ID:2867.

Another function of VGAM156 is therefore inhibition of LOC56906 (Accession NM_020147). Accordingly, utilities of VGAM156 include diagnosis, prevention and treatment of diseases and clinical conditions associated with LOC56906. FIG. 1 further provides a conceptual description of a novel bioinformatically detected viral gene of the present invention, referred to here as Viral Genomic Address Messenger 157 (VGAM157) viral gene, which modulates expression of respective host target genes thereof, the function and utility of which host target genes is known in the art.

VGAM157 is a novel bioinformatically detected regulatory, non protein coding, viral micro RNA (miRNA) gene. The method by which VGAM157 was detected is described hereinabove with reference to FIGS. 1-8.

VGAM157 gene, herein designated VGAM GENE, is a viral gene contained in the genome of Shrimp White Spot Syndrome Virus (white spot bacilliform virus). VGAM157 host target gene, herein designated VGAM HOST TARGET GENE, is a human gene contained in the human genome.

VGAM157 gene encodes a VGAM157 precursor RNA, herein designated VGAM PRECURSOR RNA. Similar to other miRNA genes, and unlike most ordinary genes, VGAM157 precursor RNA does not encode a protein. A nucleotide sequence identical or highly similar to the nucleotide sequence of VGAM157 precursor RNA is designated SEQ ID:143, and is provided hereinbelow with reference to the sequence listing part. Nucleotide sequence SEQ ID:143 is located at position 96551 relative to the genome of Shrimp White Spot Syndrome Virus (white spot bacilliform virus).

VGAM157 precursor RNA folds onto itself, forming VGAM157 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM157 folded precursor RNA into VGAM157 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM157 RNA is designated SEQ ID:2868, and is provided hereinbelow with reference to the sequence listing part.

VGAM157 host target gene, herein designated VGAM HOST TARGET GENE, encodes a corresponding messenger RNA, VGAM157 host target RNA, herein designated VGAM HOST TARGET RNA. VGAM157 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM157 RNA, herein designated VGAM RNA, binds complementarily to one or more host target binding sites located in untranslated regions of VGAM157 host target RNA, herein designated VGAM HOST TARGET RNA. This complementary binding is due to the fact that the nucleotide sequence of VGAM157 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM157 RNA, herein designated VGAM RNA, may have a different number of host target binding sites in untranslated regions of a VGAM157 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM157 RNA, herein designated VGAM RNA, to host target binding sites on VGAM157 host target RNA, herein designated VGAM HOST TARGET RNA, such as BINDING SITE I, BINDING SITE II and BINDING SITE III, inhibits translation of VGAM157 host target RNA into VGAM157 host target protein, herein designated VGAM HOST TARGET PROTEIN. VGAM host target protein is therefore outlined by a broken line.

It is appreciated that VGAM157 host target gene, herein designated VGAM HOST TARGET GENE, in fact represents a plurality of VGAM157 host target genes. The mRNA of each one of this plurality of VGAM157 host target genes comprises one or more host target binding sites, each having a nucleotide sequence which is at least partly complementary to VGAM157 RNA, herein designated VGAM RNA, and which when bound by VGAM157 RNA causes inhibition of translation of respective one or more VGAM157 host target proteins.

It is further appreciated by one skilled in the art that the mode of translational inhibition illustrated by FIG. 1 with specific reference to translational inhibition exerted by VGAM157 gene, herein designated VGAM GENE, on one or more VGAM157 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM157 is inhibition of expression of host target genes, as part of a novel viral mechanism of attacking a host. Accordingly, utilities of VGAM157 include diagnosis, prevention and treatment of viral infection by Shrimp White Spot Syndrome Virus (white spot bacilliform virus). Specific functions, and accordingly utilities, of VGAM157 correlate with, and may be deduced from, the identity of the host target genes which VGAM157 binds and inhibits, and the function of these host target genes, as elaborated hereinbelow.

Nucleotide sequences of the VGAM157 precursor RNA, herein designated VGAM PRECURSOR RNA, and of the 'diced' VGAM157 RNA, herein designated VGAM RNA, and a schematic representation of the secondary folding of VGAM157 folded precursor RNA, herein designated VGAM FOLDED PRECURSOR RNA, of VGAM157 are further described hereinbelow with reference to Table 1.

Nucleotide sequences of host target binding sites, such as BINDING SITE-I, BINDING SITE-II and BINDING SITE-III of FIG. 1, found on VGAM157 host target RNA, and schematic representation of the complementarity of each of these host target binding sites to VGAM157 RNA, herein designated VGAM RNA, are described hereinbelow with reference to Table 2.

As mentioned hereinabove with reference to FIG. 1, a function of VGAM157 gene, herein designated VGAM is inhibition of expression of VGAM157 target genes. It is appreciated that specific functions, and accordingly utilities, of VGAM157 correlate with, and may be deduced from, the identity of the target genes which VGAM157 binds and inhibits, and the function of these target genes, as elaborated hereinbelow.

Adenylate Cyclase 2 (brain) (ADCY2, Accession XM_036383) is a VGAM157 host target gene. ADCY2 BINDING SITE is HOST TARGET binding site found in the 3' untranslated region of mRNA encoded by ADCY2, corresponding to a HOST TARGET binding site such as BINDING SITE I, BINDING SITE II or BINDING SITE III. Table 2 illustrates the complementarity of the nucleotide sequences of ADCY2 BINDING SITE, designated SEQ ID:32433, to the nucleotide sequence of VGAM157 RNA, herein designated VGAM RNA, also designated SEQ ID:2868.

A function of VGAM157 is therefore inhibition of Adenylate Cyclase 2 (brain) (ADCY2, Accession XM_036383), a gene which Adenylate cyclase (type 2), an ATP-pyrophosphate lyase; converts ATP to cAMP. Accordingly, utilities of VGAM157 include diagnosis, prevention and treatment of diseases and clinical conditions associated with ADCY2. The function of ADCY2 and its association with various diseases and clinical conditions, has been established by previous studies, as described hereinabove with reference to VGAM120. Collagen, Type IV, Alpha 4 (COL4A4, Accession NM_000092) is another VGAM157 host target gene. COL4A4 BINDING SITE is HOST TARGET binding site found in the 3' untranslated region of mRNA encoded by COL4A4, corresponding to a HOST TARGET binding site such as BINDING SITE I, BINDING SITE II or BINDING SITE III. Table 2 illustrates the complementarity of the nucleotide sequences of COL4A4 BINDING SITE, designated SEQ ID:5552, to the nucleotide sequence of VGAM157 RNA, herein designated VGAM RNA, also designated SEQ ID:2868.

Another function of VGAM157 is therefore inhibition of Collagen, Type IV, Alpha 4 (COL4A4, Accession NM_000092). Accordingly, utilities of VGAM157 include diagnosis, prevention and treatment of diseases and clinical conditions associated with COL4A4. Fyn-related Kinase (FRK, Accession NM_002031) is another VGAM157 host target gene. FRK BINDING SITE is HOST TARGET binding site found in the 3' untranslated region of mRNA encoded by FRK, corresponding to a HOST TARGET binding site such as BINDING SITE I, BINDING SITE II or BINDING SITE III. Table 2 illustrates the complementarity of the nucleotide sequences of FRK BINDING SITE, designated SEQ ID:7787, to the nucleotide sequence of VGAM157 RNA, herein designated VGAM RNA, also designated SEQ ID:2868.

Another function of VGAM157 is therefore inhibition of Fyn-related Kinase (FRK, Accession NM_002031), a gene which binds pRb (RB1) during G1 and S phase and suppresses growth. Accordingly, utilities of VGAM157 include diagnosis, prevention and treatment of diseases and clinical conditions associated with FRK. The function of FRK has been established by previous studies. Tyrosine kinases are either expressed cytoplasmically, such as SRC (CSK; 124095), or as transmembrane receptors, such as growth factor receptors. They are involved in signal transduction and the regulation of cellular proliferation and have been linked to tumorigenesis through overexpression or mutation. Anneren et al. (2000) showed that expression of Gtk, the rodent homolog of FRK, in a rat pheochromocytoma cell line used as a model for neuronal cell differentiation induced nerve growth factor (see OMIM Ref. No. 162030)-independent neurite outgrowth and Rap1 (OMIM Ref. No. 605061) activation, probably through activation of the CrkII (OMIM Ref. No. 164762)-C3G (GRF2; 600303) pathway.

Full details of the abovementioned studies are described in the following publications, the disclosure of which are hereby incorporated by reference:

Anneren, C.; Reedquist, K. A.; Bos, J. L.; Welsh, M.: GTK, a Src-related tyrosine kinase, induces nerve growth factor-independent neurite outgrowth in PC12 cells through activation of the Rap1 pathway: relationship to Shb tyrosine phosphorylation and elevated levels of focal adhesion kinase. J. Biol. Chem. 275:29153-29161, 2000; and Cance, W. G.; Craven, R. J.; Bergman, M.; Xu, L.; Alitalo, K.; Liu, E. T.: Rak, a novel nuclear tyrosine kinase expressed in epithelial cells. Cell Growth Differ. 5:1347-1355, 1994.

Further studies establishing the function and utilities of FRK are found in John Hopkins OMIM database record ID 606573, and in sited publications numbered 6108-6112 listed in the bibliography section hereinbelow, which are also hereby incorporated by reference. Zinc Finger Protein 2 (A1-5) (ZNF2, Accession NM_021088) is another VGAM157 host target gene. ZNF2 BINDING SITE is HOST TARGET binding site found in the 5' untranslated region of mRNA encoded by ZNF2, corresponding to a HOST TARGET binding site such as BINDING SITE I, BINDING SITE II or BINDING SITE III. Table 2 illustrates the complementarity of the nucleotide sequences of ZNF2 BINDING SITE, designated SEQ ID:22067, to the nucleotide sequence of VGAM157 RNA, herein designated VGAM RNA, also designated SEQ ID:2868.

Another function of VGAM157 is therefore inhibition of Zinc Finger Protein 2 (A1-5) (ZNF2, Accession NM_021088). Accordingly, utilities of VGAM157 include diagnosis, prevention and treatment of diseases and clinical conditions associated with ZNF2. DKFZP727G051 (Accession XM_045308) is another VGAM157 host target gene. DKFZP727G051 BINDING SITE is HOST TARGET binding site found in the 5' untranslated region of mRNA encoded by DKFZP727G051, corresponding to a HOST TARGET binding site such as BINDING SITE I, BINDING SITE II or BINDING SITE III. Table 2 illustrates the complementarity of the nucleotide sequences of DKFZP727G051 BINDING SITE, designated SEQ ID:34428, to the nucleotide sequence of VGAM157 RNA, herein designated VGAM RNA, also designated SEQ ID:2868.

Another function of VGAM157 is therefore inhibition of DKFZP727G051 (Accession XM_045308). Accordingly, utilities of VGAM157 include diagnosis, prevention and treatment of diseases and clinical conditions associated with DKFZP727G051. Enabled Homolog (Drosophila) (ENAH, Accession NM_018212) is another VGAM157 host target gene. ENAH BINDING SITE is HOST TARGET binding site found in the 3' untranslated region of mRNA encoded by ENAH, corresponding to a HOST TARGET binding site such as BINDING SITE I, BINDING SITE II or BINDING SITE III. Table 2 illustrates the complementarity of the nucleotide sequences of ENAH BINDING SITE, designated SEQ ID:20127, to the nucleotide sequence of VGAM157 RNA, herein designated VGAM RNA, also designated SEQ ID:2868.

Another function of VGAM157 is therefore inhibition of Enabled Homolog (Drosophila) (ENAH, Accession NM_018212). Accordingly, utilities of VGAM157 include diagnosis, prevention and treatment of diseases and clinical conditions associated with ENAH. KIAA1237 (Accession XM_087386) is another VGAM157 host target gene. KIAA1237 BINDING SITE is HOST TARGET binding site found in the 3' untranslated region of mRNA encoded by KIAA1237, corresponding to a HOST TARGET binding site such as BINDING SITE I, BINDING SITE II or BINDING SITE III. Table 2 illustrates the complementarity of the nucleotide sequences of KIAA1237 BINDING SITE, designated SEQ ID:39218, to the nucleotide sequence of VGAM157 RNA, herein designated VGAM RNA, also designated SEQ ID:2868.

Another function of VGAM157 is therefore inhibition of KIAA1237 (Accession XM_087386). Accordingly, utilities of VGAM157 include diagnosis, prevention and treatment of diseases and clinical conditions associated with KIAA1237. Lymphoid-restricted Membrane Protein (LRMP, Accession NM_006152) is another VGAM157 host target gene. LRMP BINDING SITE is HOST TARGET binding site found in the 5' untranslated region of mRNA encoded by LRMP, corresponding to a HOST TARGET binding site such as BINDING SITE I, BINDING SITE II or BINDING SITE III. Table 2 illustrates the complementarity of the nucleotide sequences of LRMP BINDING SITE, designated SEQ ID:12807, to the nucleotide sequence of VGAM157 RNA, herein designated VGAM RNA, also designated SEQ ID:2868.

Another function of VGAM157 is therefore inhibition of Lymphoid-restricted Membrane Protein (LRMP, Accession NM_006152). Accordingly, utilities of VGAM157 include diagnosis, prevention and treatment of diseases and clinical conditions associated with LRMP. MOST2 (Accession NM_020250) is another VGAM157 host target gene. MOST2 BINDING SITE is HOST TARGET binding site found in the 5' untranslated region of mRNA encoded by MOST2, corresponding to a HOST TARGET binding site such as BINDING SITE I, BINDING SITE II or BINDING SITE III. Table 2 illustrates the complementarity of the nucleotide sequences of MOST2 BINDING SITE, designated SEQ ID:21556, to the nucleotide sequence of VGAM157 RNA, herein designated VGAM RNA, also designated SEQ ID:2868.

Another function of VGAM157 is therefore inhibition of MOST2 (Accession NM_020250). Accordingly, utilities of VGAM157 include diagnosis, prevention and treatment of diseases and clinical conditions associated with MOST2. Paralemmin (PALM, Accession NM_002579) is another VGAM157 host target gene. PALM BINDING SITE is HOST TARGET binding site found in the 3' untranslated region of mRNA encoded by PALM, corresponding to a HOST TARGET binding site such as BINDING SITE I, BINDING SITE II or BINDING SITE III. Table 2 illustrates the complementarity of the nucleotide sequences of PALM BINDING SITE, designated SEQ ID:8441, to the nucleotide sequence of VGAM157 RNA, herein designated VGAM RNA, also designated SEQ ID:2868.

Another function of VGAM157 is therefore inhibition of Paralemmin (PALM, Accession NM_002579). Accordingly, utilities of VGAM157 include diagnosis, prevention and treatment of diseases and clinical conditions associated with PALM. LOC197285 (Accession XM_113752) is another VGAM157 host target gene. LOC197285 BINDING SITE is HOST TARGET binding site found in the 3' untranslated region of mRNA encoded by LOC197285, corresponding to a HOST TARGET binding site such as BINDING SITE I, BINDING SITE II or BINDING SITE III. Table 2 illustrates the complementarity of the nucleotide sequences of LOC197285 BINDING SITE, designated SEQ ID:42415, to the nucleotide sequence of VGAM157 RNA, herein designated VGAM RNA, also designated SEQ ID:2868.

Another function of VGAM157 is therefore inhibition of LOC197285 (Accession XM_113752). Accordingly, utilities of VGAM157 include diagnosis, prevention and treatment of diseases and clinical conditions associated with LOC197285. LOC92283 (Accession XM_044049) is another VGAM157 host target gene. LOC92283 BINDING SITE is HOST TARGET binding site found in the 3' untranslated region of mRNA encoded by LOC92283, corresponding to a HOST TARGET binding site such as BINDING SITE I, BINDING SITE II or BINDING SITE III. Table 2 illustrates the complementarity of the nucleotide sequences of LOC92283 BINDING SITE, designated SEQ ID:34093, to the nucleotide sequence of VGAM157 RNA, herein designated VGAM RNA, also designated SEQ ID:2868.

Another function of VGAM157 is therefore inhibition of LOC92283 (Accession XM_044049). Accordingly, utilities of VGAM157 include diagnosis, prevention and treatment of diseases and clinical conditions associated with LOC92283. FIG. 1 further provides a conceptual description of a novel bioinformatically detected viral gene of the present invention, referred to here as Viral Genomic Address Messenger 158 (VGAM158) viral gene, which modulates expression of respective host target genes thereof, the function and utility of which host target genes is known in the art.

VGAM158 is a novel bioinformatically detected regulatory, non protein coding, viral micro RNA (miRNA) gene. The method by which VGAM158 was detected is described hereinabove with reference to FIGS. 1-8.

VGAM158 gene, herein designated VGAM GENE, is a viral gene contained in the genome of Shrimp White Spot Syndrome Virus (white spot bacilliform virus). VGAM158 host target gene, herein designated VGAM HOST TARGET GENE, is a human gene contained in the human genome.

VGAM158 gene encodes a VGAM158 precursor RNA, herein designated VGAM PRECURSOR RNA. Similar to other miRNA genes, and unlike most ordinary genes, VGAM158 precursor RNA does not encode a protein. A nucleotide sequence identical or highly similar to the nucleotide sequence of VGAM158 precursor RNA is designated SEQ ID:144, and is provided hereinbelow with reference to the sequence listing part. Nucleotide sequence SEQ ID:144 is located at position 216380 relative to the genome of Shrimp White Spot Syndrome Virus (white spot bacilliform virus).

VGAM158 precursor RNA folds onto itself, forming VGAM158 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM158 folded precursor RNA into VGAM158 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM158 RNA is designated SEQ ID:2869, and is provided hereinbelow with reference to the sequence listing part.

VGAM158 host target gene, herein designated VGAM HOST TARGET GENE, encodes a corresponding messenger RNA, VGAM158 host target RNA, herein designated VGAM HOST TARGET RNA. VGAM158 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM158 RNA, herein designated VGAM RNA, binds complementarily to one or more host target binding sites located in untranslated regions of VGAM158 host target RNA, herein designated VGAM HOST TARGET RNA. This complementary binding is due to the fact that the nucleotide sequence of VGAM158 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM158 RNA, herein designated VGAM RNA, may have a different number of host target binding sites in untranslated regions of a VGAM158 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM158 RNA, herein designated VGAM RNA, to host target binding sites on VGAM158 host target RNA, herein designated VGAM HOST TARGET RNA, such as BINDING SITE I, BINDING SITE II and BINDING SITE III, inhibits translation of VGAM158 host target RNA into VGAM158 host target protein, herein designated VGAM HOST TARGET PROTEIN. VGAM host target protein is therefore outlined by a broken line.

It is appreciated that VGAM158 host target gene, herein designated VGAM HOST TARGET GENE, in fact represents a plurality of VGAM158 host target genes. The mRNA of each one of this plurality of VGAM158 host target genes comprises one or more host target binding sites, each having a nucleotide sequence which is at least partly complementary to VGAM158 RNA, herein designated VGAM RNA, and which when bound by VGAM158 RNA causes inhibition of translation of respective one or more VGAM158 host target proteins.

It is further appreciated by one skilled in the art that the mode of translational inhibition illustrated by FIG. 1 with specific reference to translational inhibition exerted by VGAM158 gene, herein designated VGAM GENE, on one or more VGAM158 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM158 is inhibition of expression of host target genes, as part of a novel viral mechanism of attacking a host. Accordingly, utilities of VGAM158 include diagnosis, prevention and treatment of viral infection by Shrimp White Spot Syndrome Virus (white spot bacilliform virus). Specific functions, and accordingly utilities, of VGAM158 correlate with, and may be deduced from, the identity of the host target genes which VGAM158 binds and inhibits, and the function of these host target genes, as elaborated hereinbelow.

Nucleotide sequences of the VGAM158 precursor RNA, herein designated VGAM PRECURSOR RNA, and of the 'diced' VGAM158 RNA, herein designated VGAM RNA, and a schematic representation of the secondary folding of VGAM158 folded precursor RNA, herein designated VGAM FOLDED PRECURSOR RNA, of VGAM158 are further described hereinbelow with reference to Table 1.

Nucleotide sequences of host target binding sites, such as BINDING SITE-I, BINDING SITE-II and BINDING SITE-III of FIG. 1, found on VGAM158 host target RNA, and schematic representation of the complementarity of each of these host target binding sites to VGAM158 RNA, herein designated VGAM RNA, are described hereinbelow with reference to Table 2.

As mentioned hereinabove with reference to FIG. 1, a function of VGAM158 gene, herein designated VGAM is inhibition of expression of VGAM158 target genes. It is appreciated that specific functions, and accordingly utilities, of VGAM158 correlate with, and may be deduced from, the identity of the target genes which VGAM158 binds and inhibits, and the function of these target genes, as elaborated hereinbelow.

HERV-H LTR-associating 1 (HHLA1, Accession NM_005712) is a VGAM158 host target gene. HHLA1 BINDING SITE is HOST TARGET binding site found in the 5' untranslated region of mRNA encoded by HHLA1, corresponding to a HOST TARGET binding site such as BINDING SITE I, BINDING SITE II or BINDING SITE III. Table 2 illustrates the complementarity of the nucleotide sequences of HHLA1 BINDING SITE, designated SEQ ID:12265, to the nucleotide sequence of VGAM158 RNA, herein designated VGAM RNA, also designated SEQ ID:2869.

A function of VGAM158 is therefore inhibition of HERV-H LTR-associating 1 (HHLA1, Accession NM_005712), a gene which has unknown function and with low similarity to a region of S. cerevisiae WSC4. Accordingly, utilities of VGAM158 include diagnosis, prevention and treatment of diseases and clinical conditions associated with HHLA1. The function of HHLA1 has been established by previous studies. Human endogenous retroviruses (HERVs) are repetitive elements, derived from ancient germ-line retroviral infections, that have increased in copy number by further rounds of infection, retrotransposition, and/or duplication. The HERV-H family has been shown to play a role in the expression of a variety of adjacent genes. For example, Feuchter-Murthy et al. (1993) isolated a teratocarcinoma cell line transcript, PLA2L (phospholipase A2-like), which initiates in the long terminal repeat (LTR) of an HERV-H element present in an intron and splices into downstream exons. They found that the teratocarcinoma cells contained additional, alternatively spliced PLA2L mRNAs, designated AF6 through -8, which lack the coding regions for the phospholipase A2 (PLA2)-like domains. Kowalski et al. (1999) determined that PLA2L is a tripartite fusion transcript expressed from the HERV-H element's promoter and containing exons from a novel gene, HHLA1, and from OC90 (OMIM Ref. No. 601658), a gene encoding an inner ear protein with PLA2 domains. The coding regions of the AF6, -7, and -8 mRNAs are derived only from the HHLA1 gene and encode a predicted 305-amino acid protein. The authors hypothesized that the human HHLA1 and OC90 genes are normally expressed independently from different promoters, and that the intergenic splicing event that generates PLA2L is specific to teratocarcinoma cells. The HERV-H element is located within an intron of HHLA1 and the OC90 gene is located less than 10 kb downstream of HHLA1. Kowalski et al. (1997) determined that the HERV-H element at this locus integrated 15 to 20 million years ago since it is present in chimpanzee and gorilla but absent in orangutan and lower primates. They mapped the HHLA1 locus to 8q24.

Full details of the abovementioned studies are described in the following publications, the disclosure of which are hereby incorporated by reference:

Kowalski, P. E.; Freeman, J. D.; Mager, D. L.: Intergenic splicing between a HERV-H endogenous retrovirus and two adjacent human genes. Genomics 57:371-379, 1999; and Kowalski, P. E.; Freeman, J. D.; Nelson, D. T.; Mager, D. L.: Genomic structure and evolution of a novel gene (PLA2L) with duplicated phospholipase A2-like domains. Genomics 39:38-46.

Further studies establishing the function and utilities of HHLA1 are found in John Hopkins OMIM database record ID 604109, and in sited publications numbered 6211-621 and 7061 listed in the bibliography section hereinbelow, which are also hereby incorporated by reference. FLJ13657 (Accession NM_024828) is another VGAM158 host target gene. FLJ13657 BINDING SITE is HOST TARGET binding site found in the 3' untranslated region of mRNA encoded by FLJ13657, corresponding to a HOST TARGET binding site such as BINDING SITE I, BINDING SITE II or BINDING SITE III. Table 2 illustrates the complementarity of the nucleotide sequences of FLJ13657 BINDING SITE, designated SEQ ID:24221, to the nucleotide sequence of VGAM158 RNA, herein designated VGAM RNA, also designated SEQ ID:2869.

Another function of VGAM158 is therefore inhibition of FLJ13657 (Accession NM_024828). Accordingly, utilities of VGAM158 include diagnosis, prevention and treatment of diseases and clinical conditions associated with FLJ13657. LOC158629 (Accession XM_098972) is another VGAM158 host target gene. LOC158629 BINDING SITE is HOST TARGET binding site found in the 5' untranslated region of mRNA encoded by LOC158629, corresponding to a HOST TARGET binding site such as BINDING SITE I, BINDING SITE II or BINDING SITE III. Table 2 illustrates the complementarity of the nucleotide sequences of LOC158629 BINDING SITE, designated SEQ ID:42019, to the nucleotide sequence of VGAM158 RNA, herein designated VGAM RNA, also designated SEQ ID:2869.

Another function of VGAM158 is therefore inhibition of LOC158629 (Accession XM_098972). Accordingly, utilities of VGAM158 include diagnosis, prevention and treatment of diseases and clinical conditions associated with LOC158629. LOC169436 (Accession XM_095696) is another VGAM158 host target gene. LOC169436 BINDING SITE is HOST TARGET binding site found in the 5' untranslated region of mRNA encoded by LOC169436, corresponding to a HOST TARGET binding site such as BINDING SITE I, BINDING SITE II or BINDING SITE III. Table 2 illustrates the complementarity of the nucleotide sequences of LOC169436 BINDING SITE, designated SEQ ID:40276, to the nucleotide sequence of VGAM158 RNA, herein designated VGAM RNA, also designated SEQ ID:2869.

Another function of VGAM158 is therefore inhibition of LOC169436 (Accession XM_095696). Accordingly, utilities of VGAM158 include diagnosis, prevention and treatment of diseases and clinical conditions associated with LOC169436. LOC255098 (Accession XM_170912) is another VGAM158 host target gene. LOC255098 BINDING SITE is HOST TARGET binding site found in the 5' untranslated region of mRNA encoded by LOC255098, corresponding to a HOST TARGET binding site such as BINDING SITE I, BINDING SITE II or BINDING SITE III. Table 2 illustrates the complementarity of the nucleotide sequences of LOC255098 BINDING SITE, designated SEQ ID:45688, to the nucleotide sequence of VGAM158 RNA, herein designated VGAM RNA, also designated SEQ ID:2869.

Another function of VGAM158 is therefore inhibition of LOC255098 (Accession XM_170912). Accordingly, utilities of VGAM158 include diagnosis, prevention and treatment of diseases and clinical conditions associated with LOC255098. LOC96597 (Accession XM_039922) is another VGAM158 host target gene. LOC96597 BINDING SITE is HOST TARGET binding site found in the 5' untranslated region of mRNA encoded by LOC96597, corresponding to a HOST TARGET binding site such as BINDING SITE I, BINDING SITE II or BINDING SITE III. Table 2 illustrates the complementarity of the nucleotide sequences of LOC96597 BINDING SITE, designated SEQ ID:33229, to the nucleotide sequence of VGAM158 RNA, herein designated VGAM RNA, also designated SEQ ID:2869.

Another function of VGAM158 is therefore inhibition of LOC96597 (Accession XM_039922). Accordingly, utilities of VGAM158 include diagnosis, prevention and treatment of diseases and clinical conditions associated with LOC96597. FIG. 1 further provides a conceptual description of a novel bioinformatically detected viral gene of the present invention, referred to here as Viral Genomic Address Messenger 159 (VGAM159) viral gene, which modulates expression of respective host target genes thereof, the function and utility of which host target genes is known in the art.

VGAM159 is a novel bioinformatically detected regulatory, non protein coding, viral micro RNA (miRNA) gene. The method by which VGAM159 was detected is described hereinabove with reference to FIGS. 1-8.

VGAM159 gene, herein designated VGAM GENE, is a viral gene contained in the genome of Shrimp White Spot Syndrome Virus (white spot bacilliform virus). VGAM159 host target gene, herein designated VGAM HOST TARGET GENE, is a human gene contained in the human genome.

VGAM159 gene encodes a VGAM159 precursor RNA, herein designated VGAM PRECURSOR RNA. Similar to other miRNA genes, and unlike most ordinary genes, VGAM159 precursor RNA does not encode a protein. A nucleotide sequence identical or highly similar to the nucleotide sequence of VGAM159 precursor RNA is designated SEQ ID:145, and is provided hereinbelow with reference to the sequence listing part. Nucleotide sequence SEQ ID:145 is located at position 40934 relative to the genome of Shrimp White Spot Syndrome Virus (white spot bacilliform virus).

VGAM159 precursor RNA folds onto itself, forming VGAM159 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM159 folded precursor RNA into VGAM159 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 69%) nucleotide sequence of VGAM159 RNA is designated SEQ ID:2870, and is provided hereinbelow with reference to the sequence listing part.

VGAM159 host target gene, herein designated VGAM HOST TARGET GENE, encodes a corresponding messenger RNA, VGAM159 host target RNA, herein designated VGAM HOST TARGET RNA. VGAM159 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM159 RNA, herein designated VGAM RNA, binds complementarily to one or more host target binding sites located in untranslated regions of VGAM159 host target RNA, herein designated VGAM HOST TARGET RNA. This complementary binding is due to the fact that the nucleotide sequence of VGAM159 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM159 RNA, herein designated VGAM RNA, may have a different number of host target binding sites in untranslated regions of a VGAM159 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM159 RNA, herein designated VGAM RNA, to host target binding sites on VGAM159 host target RNA, herein designated VGAM HOST TARGET RNA, such as BINDING SITE I, BINDING SITE II and BINDING SITE III, inhibits translation of VGAM159 host target RNA into VGAM159 host target protein, herein designated VGAM HOST TARGET PROTEIN. VGAM host target protein is therefore outlined by a broken line.

It is appreciated that VGAM159 host target gene, herein designated VGAM HOST TARGET GENE, in fact represents a plurality of VGAM159 host target genes. The mRNA of each one of this plurality of VGAM159 host target genes comprises one or more host target binding sites, each having a nucleotide sequence which is at least partly complementary to VGAM159 RNA, herein designated VGAM RNA, and which when bound by VGAM159 RNA causes inhibition of translation of respective one or more VGAM159 host target proteins.

It is further appreciated by one skilled in the art that the mode of translational inhibition illustrated by FIG. 1 with specific reference to translational inhibition exerted by VGAM159 gene, herein designated VGAM GENE, on one or more VGAM159 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM159 is inhibition of expression of host target genes, as part of a novel viral mechanism of attacking a host. Accordingly, utilities of VGAM159 include diagnosis, prevention and treatment of viral infection by Shrimp White Spot Syndrome Virus (white spot bacilliform virus). Specific functions, and accordingly utilities, of VGAM159 correlate with, and may be deduced from, the identity of the host target genes which VGAM159 binds and inhibits, and the function of these host target genes, as elaborated hereinbelow.

Nucleotide sequences of the VGAM159 precursor RNA, herein designated VGAM PRECURSOR RNA, and of the 'diced' VGAM159 RNA, herein designated VGAM RNA, and a schematic representation of the secondary folding of VGAM159 folded precursor RNA, herein designated VGAM FOLDED PRECURSOR RNA, of VGAM159 are further described hereinbelow with reference to Table 1.

Nucleotide sequences of host target binding sites, such as BINDING SITE-I, BINDING SITE-II and BINDING SITE-III of FIG. 1, found on VGAM159 host target RNA, and schematic representation of the complementarity of each of these host target binding sites to VGAM159 RNA, herein designated VGAM RNA, are described hereinbelow with reference to Table 2.

As mentioned hereinabove with reference to FIG. 1, a function of VGAM159 gene, herein designated VGAM is inhibition of expression of VGAM159 target genes. It is appreciated that specific functions, and accordingly utilities, of VGAM159 correlate with, and may be deduced from, the identity of the target genes which VGAM159 binds and inhibits, and the function of these target genes, as elaborated hereinbelow.

Cyclin T2 (CCNT2, Accession NM_058241) is a VGAM159 host target gene. CCNT2 BINDING SITE is HOST TARGET binding site found in the 3' untranslated region of mRNA encoded by CCNT2, corresponding to a HOST TARGET binding site such as BINDING SITE I, BINDING SITE II or BINDING SITE III. Table 2 illustrates the complementarity of the nucleotide sequences of CCNT2 BINDING SITE, designated SEQ ID:27768, to the nucleotide sequence of VGAM159 RNA, herein designated VGAM RNA, also designated SEQ ID:2870.

A function of VGAM159 is therefore inhibition of Cyclin T2 (CCNT2, Accession NM_058241), a gene which is a regulatory subunit of the cyclin-dependent kinase pair (cdk9/cyclin t) complex. Accordingly, utilities of VGAM159 include diagnosis, prevention and treatment of diseases and clinical conditions associated with CCNT2. The function of CCNT2 has been established by previous studies. Positive transcription elongation factor b (OMIM Ref. No. P-TEFb) is thought to facilitate the transition from abortive to productive elongation by phosphorylating the C-terminal domain (CTD) of the largest subunit of RNA polymerase II (POLR2A; 180660). Drosophila P-TEFb is composed of CDK9 (OMIM Ref. No. 603251) and cyclin T. By searching an EST database for homologs of Drosophila cyclin T, Peng et al. (1998) identified cDNAs encoding human cyclins T1 (OMIM Ref. No. 602506) and T2. Alternative splicing of the primary T2 transcript results in 2 isoforms termed T2a and T2b. The predicted 663-amino acid T2a and 730-amino acid T2b isoforms have different C-termini. Within the conserved N-terminal cyclin box region, cyclin T2 shares 64% and 81% identity with Drosophila cyclin T and human cyclin T1, respectively. Immunoprecipitation studies demonstrated that CDK9 is complexed with the cyclins T1 and T2 in HeLa cell nuclear extracts. Approximately 80% of CDK9 is complexed with cyclin T1, 10% with cyclin T2a and 10% with T2b. Each complex is an active P-TEFb molecule that can phosphorylate the CTD of RNA polymerase II and cause the transition from abortive elongation into productive elongation. When expressed in mammalian cells, all 3 CDK9/cyclin T combinations strongly activated a CMV promoter. Northern blot analysis revealed that cyclin T2 was expressed as multiple mRNAs in all human tissues tested. Yang et al. (2001) identified 7SK snRNA (OMIM Ref. No. 606515) as a specific P-TEFb-associated factor. 7SK inhibits general and HIV-1 Tat-specific transcriptional activities of P-TEFb in vivo and in vitro by inhibiting the kinase activity of CDK9 and preventing recruitment of P-TEFb to the HIV-1 promoter. 7SK is efficiently dissociated from P-TEFb (the CDK9/cyclin T1 heterodimer) by treatment of cells with ultraviolet irradiation and actinomycin D. As these 2 agents have been shown to enhance significantly HIV-1 transcription and phosphorylation of Pol-II, Yang et al. (2001) concluded that their data provide a mechanistic explanation for this stimulatory effect. Yang et al. (2001) further suggested that the 7SK/P-TEFb interaction may serve as a principal control point for the induction of cellular and HIV-1 viral gene expression during stress-related responses. The study demonstrated the involvement of an snRNA in controlling the activity of CDK/cyclin kinase.

Full details of the abovementioned studies are described in the following publications, the disclosure of which are hereby incorporated by reference:

Peng, J.; Zhu, Y.; Milton, J. T.; Price, D. H.: Identification of multiple cyclin subunits of human P-TEFb. Genes Dev. 12:755-762, 1998; and Yang, Z.; Zhu, Q.; Luo, K.; Zhou, Q.: The 7SK small nuclear RNA inhibits the CDK9/cyclin T1 kinase to control transcription. Nature 414:317-322, 2001.

Further studies establishing the function and utilities of CCNT2 are found in John Hopkins OMIM database record ID 603862, and in sited publications numbered 9033-9035 listed in the bibliography section hereinbelow, which are also hereby incorporated by reference. Disrupted In Schizophrenia 1 (DISC1, Accession NM_018662) is another VGAM159 host target gene. DISC1 BINDING SITE1 and DISC1 BINDING SITE2 are HOST TARGET binding sites found in untranslated regions of mRNA encoded by DISC1, corresponding to HOST TARGET binding sites such as BINDING SITE I, BINDING SITE II or BINDING SITE III. Table 2 illustrates the complementarity of the nucleotide sequences of DISC1 BINDING SITE1 and DISC1 BINDING SITE2, designated SEQ ID:20732 and SEQ ID:20733 respectively, to the nucleotide sequence of VGAM159 RNA, herein designated VGAM RNA, also designated SEQ ID:2870.

Another function of VGAM159 is therefore inhibition of Disrupted In Schizophrenia 1 (DISC1, Accession NM_018662), a gene which has globular N-terminal domain (s) and a helical C-terminal domain. Accordingly, utilities of VGAM159 include diagnosis, prevention and treatment of diseases and clinical conditions associated with DISC1. The function of DISC1 and its association with various diseases and clinical conditions, has been established by previous studies, as described hereinabove with reference to VGAM74. GRP3 (Accession NM_015376) is another VGAM159 host target gene. GRP3 BINDING SITE is HOST TARGET binding site found in the 3' untranslated region of mRNA encoded by GRP3, corresponding to a HOST TARGET binding site such as BINDING SITE I, BINDING SITE II or BINDING SITE III. Table 2 illustrates the complementarity of the nucleotide sequences of GRP3 BINDING SITE, designated SEQ ID:17673, to the nucleotide sequence of VGAM159 RNA, herein designated VGAM RNA, also designated SEQ ID:2870.

Another function of VGAM159 is therefore inhibition of GRP3 (Accession NM_015376). Accordingly, utilities of VGAM159 include diagnosis, prevention and treatment of diseases and clinical conditions associated with GRP3. KIAA0205 (Accession NM_014873) is another VGAM159 host target gene. KIAA0205 BINDING SITE is HOST TARGET binding site found in the 3' untranslated region of mRNA encoded by KIAA0205, corresponding to a HOST TARGET binding site such as BINDING SITE I, BINDING SITE II or BINDING SITE III. Table 2 illustrates the complementarity of the nucleotide sequences of KIAA0205 BINDING SITE, designated SEQ ID:17001, to the nucleotide sequence of VGAM159 RNA, herein designated VGAM RNA, also designated SEQ ID:2870.

Another function of VGAM159 is therefore inhibition of KIAA0205 (Accession NM_014873). Accordingly, utilities of VGAM159 include diagnosis, prevention and treatment of diseases and clinical conditions associated with KIAA0205. KIAA1237 (Accession XM_087386) is another VGAM159 host target gene. KIAA1237 BINDING SITE is HOST TARGET binding site found in the 3' untranslated region of mRNA encoded by KIAA1237, corresponding to a HOST TARGET binding site such as BINDING SITE I, BINDING SITE II or BINDING SITE III. Table 2 illustrates the complementarity of the nucleotide sequences of KIAA1237 BINDING SITE, designated SEQ ID:39215, to the nucleotide sequence of VGAM159 RNA, herein designated VGAM RNA, also designated SEQ ID:2870.

Another function of VGAM159 is therefore inhibition of KIAA1237 (Accession XM_087386). Accordingly, utilities of VGAM159 include diagnosis, prevention and treatment of diseases and clinical conditions associated with KIAA1237. KIAA1789 (Accession XM_040486) is another VGAM159 host target gene. KIAA1789 BINDING SITE is HOST TARGET binding site found in the 5' untranslated region of mRNA encoded by KIAA1789, corresponding to a HOST TARGET binding site such as BINDING SITE I, BINDING SITE II or BINDING SITE III. Table 2 illustrates the complementarity of the nucleotide sequences of KIAA1789 BINDING SITE, designated SEQ ID:33306, to the nucleotide sequence of VGAM159 RNA, herein designated VGAM RNA, also designated SEQ ID:2870.

Another function of VGAM159 is therefore inhibition of KIAA1789 (Accession XM_040486). Accordingly, utilities of VGAM159 include diagnosis, prevention and treatment of diseases and clinical conditions associated with KIAA1789. PA26 (Accession NM_014454) is another VGAM159 host target gene. PA26 BINDING SITE is HOST TARGET binding site found in the 3' untranslated region of mRNA encoded by PA26, corresponding to a HOST TARGET binding site such as BINDING SITE I, BINDING SITE II or BINDING SITE III. Table 2 illustrates the complementarity of the nucleotide sequences of PA26 BINDING SITE, designated SEQ ID:15806, to the nucleotide sequence of VGAM159 RNA, herein designated VGAM RNA, also designated SEQ ID:2870.

Another function of VGAM159 is therefore inhibition of PA26 (Accession NM_014454). Accordingly, utilities of VGAM159 include diagnosis, prevention and treatment of diseases and clinical conditions associated with PA26. PHD Finger Protein 5A (PHF5A, Accession NM_032758) is another VGAM159 host target gene. PHF5A BINDING SITE is HOST TARGET binding site found in the 3' untranslated region of mRNA encoded by PHF5A, corresponding to a HOST TARGET binding site such as BINDING SITE I, BINDING SITE II or BINDING SITE III. Table 2 illustrates the complementarity of the nucleotide sequences of PHF5A BINDING SITE, designated SEQ ID:26501, to the nucleotide sequence of VGAM159 RNA, herein designated VGAM RNA, also designated SEQ ID:2870.

Another function of VGAM159 is therefore inhibition of PHD Finger Protein 5A (PHF5A, Accession NM_032758). Accordingly, utilities of VGAM159 include diagnosis, prevention and treatment of diseases and clinical conditions associated with PHF5A. LOC126603 (Accession XM_060090) is another VGAM159 host target gene. LOC126603 BINDING SITE is HOST TARGET binding site found in the 5' untranslated region of mRNA encoded by LOC126603, corresponding to a HOST TARGET binding site such as BINDING SITE I, BINDING SITE II or BINDING SITE III. Table 2 illustrates the complementarity of the nucleotide sequences of LOC126603 BINDING SITE, designated SEQ ID:37151, to the nucleotide sequence of VGAM159 RNA, herein designated VGAM RNA, also designated SEQ ID:2870.

Another function of VGAM159 is therefore inhibition of LOC126603 (Accession XM_060090). Accordingly, utilities of VGAM159 include diagnosis, prevention and treatment of diseases and clinical conditions associated with LOC126603. FIG. 1 further provides a conceptual description of a novel bioinformatically detected viral gene of the present invention, referred to here as Viral Genomic Address Messenger 160 (VGAM160) viral gene, which modulates expression of respective host target genes thereof, the function and utility of which host target genes is known in the art.

VGAM160 is a novel bioinformatically detected regulatory, non protein coding, viral micro RNA (miRNA) gene. The method by which VGAM160 was detected is described hereinabove with reference to FIGS. 1-8.

VGAM160 gene, herein designated VGAM GENE, is a viral gene contained in the genome of Shrimp White Spot Syndrome Virus (white spot bacilliform virus). VGAM160 host target gene, herein designated VGAM HOST TARGET GENE, is a human gene contained in the human genome.

VGAM160 gene encodes a VGAM160 precursor RNA, herein designated VGAM PRECURSOR RNA. Similar to other miRNA genes, and unlike most ordinary genes, VGAM160 precursor RNA does not encode a protein. A nucleotide sequence identical or highly similar to the nucleotide sequence of VGAM160 precursor RNA is designated SEQ ID:146, and is provided hereinbelow with reference to the sequence listing part. Nucleotide sequence SEQ ID:146 is located at position 76536 relative to the genome of Shrimp White Spot Syndrome Virus (white spot bacilliform virus).

VGAM160 precursor RNA folds onto itself, forming VGAM160 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM160 folded precursor RNA into VGAM160 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM160 RNA is designated SEQ ID:2871, and is provided hereinbelow with reference to the sequence listing part.

VGAM160 host target gene, herein designated VGAM HOST TARGET GENE, encodes a corresponding messenger RNA, VGAM160 host target RNA, herein designated VGAM HOST TARGET RNA. VGAM160 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM160 RNA, herein designated VGAM RNA, binds complementarily to one or more host target binding sites located in untranslated regions of VGAM160 host target RNA, herein designated VGAM HOST TARGET RNA. This complementary binding is due to the fact that the nucleotide sequence of VGAM160 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM160 RNA, herein designated VGAM RNA, may have a different number of host target binding sites in untranslated regions of a VGAM160 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM160 RNA, herein designated VGAM RNA, to host target binding sites on VGAM160 host target RNA, herein designated VGAM HOST TARGET RNA, such as BINDING SITE I, BINDING SITE II and BINDING SITE III, inhibits translation of VGAM160 host target RNA into VGAM160 host target protein, herein designated VGAM HOST TARGET PROTEIN. VGAM host target protein is therefore outlined by a broken line.

It is appreciated that VGAM160 host target gene, herein designated VGAM HOST TARGET GENE, in fact represents a plurality of VGAM160 host target genes. The mRNA of each one of this plurality of VGAM160 host target genes comprises one or more host target binding sites, each having a nucleotide sequence which is at least partly complementary to VGAM160 RNA, herein designated VGAM RNA, and which when bound by VGAM160 RNA causes inhibition of translation of respective one or more VGAM160 host target proteins.

It is further appreciated by one skilled in the art that the mode of translational inhibition illustrated by FIG. 1 with specific reference to translational inhibition exerted by VGAM160 gene, herein designated VGAM GENE, on one or more VGAM160 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM160 is inhibition of expression of host target genes, as part of a novel viral mechanism of attacking a host. Accordingly, utilities of VGAM160 include diagnosis, prevention and treatment of viral infection by Shrimp White Spot Syndrome Virus (white spot bacilliform virus). Specific functions, and accordingly utilities, of VGAM160 correlate with, and may be deduced from, the identity of the host target genes which VGAM160 binds and inhibits, and the function of these host target genes, as elaborated hereinbelow.

Nucleotide sequences of the VGAM160 precursor RNA, herein designated VGAM PRECURSOR RNA, and of the 'diced' VGAM160 RNA, herein designated VGAM RNA, and a schematic representation of the secondary folding of VGAM160 folded precursor RNA, herein designated VGAM FOLDED PRECURSOR RNA, of VGAM160 are further described hereinbelow with reference to Table 1.

Nucleotide sequences of host target binding sites, such as BINDING SITE-I, BINDING SITE-II and BINDING SITE-III of FIG. 1, found on VGAM160 host target RNA, and schematic representation of the complementarity of each of these host target binding sites to VGAM160 RNA, herein designated VGAM RNA, are described hereinbelow with reference to Table 2.

As mentioned hereinabove with reference to FIG. 1, a function of VGAM160 gene, herein designated VGAM is inhibition of expression of VGAM160 target genes. It is appreciated that specific functions, and accordingly utilities, of VGAM160 correlate with, and may be deduced from, the identity of the target genes which VGAM160 binds and inhibits, and the function of these target genes, as elaborated hereinbelow.

Collagen, Type IV, Alpha 6 (COL4A6, Accession NM_033641) is a VGAM160 host target gene. COL4A6 BINDING SITE is HOST TARGET binding site found in the 3' untranslated region of mRNA encoded by COL4A6, corresponding to a HOST TARGET binding site such as BINDING SITE I, BINDING SITE II or BINDING SITE III. Table 2 illustrates the complementarity of the nucleotide sequences of COL4A6 BINDING SITE, designated SEQ ID:27356, to the nucleotide sequence of VGAM160 RNA, herein designated VGAM RNA, also designated SEQ ID:2871.

A function of VGAM160 is therefore inhibition of Collagen, Type IV, Alpha 6 (COL4A6, Accession NM_033641). Accordingly, utilities of VGAM160 include diagnosis, prevention and treatment of diseases and clinical conditions associated with COL4A6. FLJ14566 (Accession NM_032806) is another VGAM160 host target gene. FLJ14566 BINDING SITE is HOST TARGET binding site found in the 5' untranslated region of mRNA encoded by FLJ14566, corresponding to a HOST TARGET binding site such as BINDING SITE I, BINDING SITE II or BINDING SITE III. Table 2 illustrates the complementarity of the nucleotide sequences of FLJ14566 BINDING SITE, designated SEQ ID:26563, to the nucleotide sequence of VGAM160 RNA, herein designated VGAM RNA, also designated SEQ ID:2871.

Another function of VGAM160 is therefore inhibition of FLJ14566 (Accession NM_032806). Accordingly, utilities of VGAM160 include diagnosis, prevention and treatment of diseases and clinical conditions associated with FLJ14566. LOC143153 (Accession XM_084440) is another VGAM160 host target gene. LOC143153 BINDING SITE is HOST TARGET binding site found in the 3' untranslated region of mRNA encoded by LOC143153, corresponding to a HOST TARGET binding site such as BINDING SITE I, BINDING SITE II or BINDING SITE III. Table 2 illustrates the complementarity of the nucleotide sequences of LOC143153 BINDING SITE, designated SEQ ID:37578, to the nucleotide sequence of VGAM160 RNA, herein designated VGAM RNA, also designated SEQ ID:2871.

Another function of VGAM160 is therefore inhibition of LOC143153 (Accession XM_084440). Accordingly, utilities of VGAM160 include diagnosis, prevention and treatment of diseases and clinical conditions associated with LOC143153. LOC143154 (Accession XM_084441) is another VGAM160 host target gene. LOC143154 BINDING SITE is HOST TARGET binding site found in the 3' untranslated region of mRNA encoded by LOC143154, corresponding to a HOST TARGET binding site such as BINDING SITE I, BINDING SITE II or BINDING SITE III. Table 2 illustrates the complementarity of the nucleotide sequences of LOC143154 BINDING SITE, designated SEQ ID:37585, to the nucleotide sequence of VGAM160 RNA, herein designated VGAM RNA, also designated SEQ ID:2871.

Another function of VGAM160 is therefore inhibition of LOC143154 (Accession XM_084441). Accordingly, utilities of VGAM160 include diagnosis, prevention and treatment of diseases and clinical conditions associated with LOC143154. FIG. 1 further provides a conceptual description of a novel bioinformatically detected viral gene of the present invention, referred to here as Viral Genomic Address Messenger 161 (VGAM161) viral gene, which modulates expression of respective host target genes thereof, the function and utility of which host target genes is known in the art.

VGAM161 is a novel bioinformatically detected regulatory, non protein coding, viral micro RNA (miRNA) gene. The method by which VGAM161 was detected is described hereinabove with reference to FIGS. 1-8.

VGAM161 gene, herein designated VGAM GENE, is a viral gene contained in the genome of Shrimp White Spot Syndrome Virus (white spot bacilliform virus). VGAM161 host target gene, herein designated VGAM HOST TARGET GENE, is a human gene contained in the human genome.

VGAM161 gene encodes a VGAM161 precursor RNA, herein designated VGAM PRECURSOR RNA. Similar to other miRNA genes, and unlike most ordinary genes, VGAM161 precursor RNA does not encode a protein. A nucleotide sequence identical or highly similar to the nucleotide sequence of VGAM161 precursor RNA is designated SEQ ID:147, and is provided hereinbelow with reference to the sequence listing part. Nucleotide sequence SEQ ID:147 is located at position 96172 relative to the genome of Shrimp White Spot Syndrome Virus (white spot bacilliform virus).

VGAM161 precursor RNA folds onto itself, forming VGAM161 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM161 folded precursor RNA into VGAM161 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM161 RNA is designated SEQ ID:2872, and is provided hereinbelow with reference to the sequence listing part.

VGAM161 host target gene, herein designated VGAM HOST TARGET GENE, encodes a corresponding messenger RNA, VGAM161 host target RNA, herein designated VGAM HOST TARGET RNA. VGAM161 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM161 RNA, herein designated VGAM RNA, binds complementarily to one or more host target binding sites located in untranslated regions of VGAM161 host target RNA, herein designated VGAM HOST TARGET RNA. This complementary binding is due to the fact that the nucleotide sequence of VGAM161 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM161 RNA, herein designated VGAM RNA, may have a different number of host target binding sites in untranslated regions of a VGAM161 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM161 RNA, herein designated VGAM RNA, to host target binding sites on VGAM161 host target RNA, herein designated VGAM HOST TARGET RNA, such as BINDING SITE I, BINDING SITE II and BINDING SITE III, inhibits translation of VGAM161 host target RNA into VGAM161 host target protein, herein designated VGAM HOST TARGET PROTEIN. VGAM host target protein is therefore outlined by a broken line.

It is appreciated that VGAM161 host target gene, herein designated VGAM HOST TARGET GENE, in fact represents a plurality of VGAM161 host target genes. The mRNA of each one of this plurality of VGAM161 host target genes comprises one or more host target binding sites, each having a nucleotide sequence which is at least partly complementary to VGAM161 RNA, herein designated VGAM RNA, and which when bound by VGAM161 RNA causes inhibition of translation of respective one or more VGAM161 host target proteins.

It is further appreciated by one skilled in the art that the mode of translational inhibition illustrated by FIG. 1 with specific reference to translational inhibition exerted by VGAM161 gene, herein designated VGAM GENE, on one or more VGAM161 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM161 is inhibition of expression of host target genes, as part of a novel viral mechanism of attacking a host. Accordingly, utilities of VGAM161 include diagnosis, prevention and treatment of viral infection by Shrimp White Spot Syndrome Virus (white spot bacilliform virus). Specific functions, and accordingly utilities, of VGAM161 correlate with, and may be deduced from, the identity of the host target genes which VGAM161 binds and inhibits, and the function of these target genes, as elaborated hereinbelow.

Nucleotide sequences of the VGAM161 precursor RNA, herein designated VGAM PRECURSOR RNA, and of the 'diced' VGAM161 RNA, herein designated VGAM RNA, and a schematic representation of the secondary folding of VGAM161 folded precursor RNA, herein designated VGAM FOLDED PRECURSOR RNA, of VGAM161 are further described hereinbelow with reference to Table 1.

Nucleotide sequences of host target binding sites, such as BINDING SITE-I, BINDING SITE-II and BINDING SITE-III of FIG. 1, found on VGAM161 host target RNA, and schematic representation of the complementarity of each of these host target binding sites to VGAM161 RNA, herein designated VGAM RNA, are described hereinbelow with reference to Table 2.

As mentioned hereinabove with reference to FIG. 1, a function of VGAM161 gene, herein designated VGAM is inhibition of expression of VGAM161 target genes. It is appreciated that specific functions, and accordingly utilities, of VGAM161 correlate with, and may be deduced from, the identity of the target genes which VGAM161 binds and inhibits, and the function of these target genes, as elaborated hereinbelow.

FLJ10579 (Accession NM_018145) is a VGAM161 host target gene. FLJ10579 BINDING SITE is HOST TARGET binding site found in the 3' untranslated region of mRNA encoded by FLJ10579, corresponding to a HOST TARGET binding site such as BINDING SITE I, BINDING SITE II or BINDING SITE III. Table 2 illustrates the complementarity of the nucleotide sequences of FLJ10579 BINDING SITE, designated SEQ ID:19945, to the nucleotide sequence of VGAM161 RNA, herein designated VGAM RNA, also designated SEQ ID:2872.

A function of VGAM161 is therefore inhibition of FLJ10579 (Accession NM_018145). Accordingly, utilities of VGAM161 include diagnosis, prevention and treatment of diseases and clinical conditions associated with FLJ10579. FIG. 1 further provides a conceptual description of a novel bioinformatically detected viral gene of the present invention, referred to here as Viral Genomic Address Messenger 162 (VGAM162) viral gene, which modulates expression of respective host target genes thereof, the function and utility of which host target genes is known in the art.

VGAM162 is a novel bioinformatically detected regulatory, non protein coding, viral micro RNA (miRNA) gene. The method by which VGAM162 was detected is described hereinabove with reference to FIGS. 1-8.

VGAM162 gene, herein designated VGAM GENE, is a viral gene contained in the genome of Shrimp White Spot Syndrome Virus (white spot bacilliform virus). VGAM162 host target gene, herein designated VGAM HOST TARGET GENE, is a human gene contained in the human genome.

VGAM162 gene encodes a VGAM162 precursor RNA, herein designated VGAM PRECURSOR RNA. Similar to other miRNA genes, and unlike most ordinary genes, VGAM162 precursor RNA does not encode a protein. A nucleotide sequence identical or highly similar to the nucleotide sequence of VGAM162 precursor RNA is designated SEQ ID:148, and is provided hereinbelow with reference to the sequence listing part. Nucleotide sequence SEQ ID:148 is located at position 173989 relative to the genome of Shrimp White Spot Syndrome Virus (white spot bacilliform virus).

VGAM162 precursor RNA folds onto itself, forming VGAM162 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM162 folded precursor RNA into VGAM162 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM162 RNA is designated SEQ ID:2873, and is provided hereinbelow with reference to the sequence listing part.

VGAM162 host target gene, herein designated VGAM HOST TARGET GENE, encodes a corresponding messenger RNA, VGAM162 host target RNA, herein designated VGAM HOST TARGET RNA. VGAM162 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM162 RNA, herein designated VGAM RNA, binds complementarily to one or more host target binding sites located in untranslated regions of VGAM162 host target RNA, herein designated VGAM HOST TARGET RNA. This complementary binding is due to the fact that the nucleotide sequence of VGAM162 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM162 RNA, herein designated VGAM RNA, may have a different number of host target binding sites in untranslated regions of a VGAM162 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM162 RNA, herein designated VGAM RNA, to host target binding sites on VGAM162 host target RNA, herein designated VGAM HOST TARGET RNA, such as BINDING SITE I, BINDING SITE II and BINDING SITE III, inhibits translation of VGAM162 host target RNA into VGAM162 host target protein, herein designated VGAM HOST TARGET PROTEIN. VGAM host target protein is therefore outlined by a broken line.

It is appreciated that VGAM162 host target gene, herein designated VGAM HOST TARGET GENE, in fact represents a plurality of VGAM162 host target genes. The mRNA of each one of this plurality of VGAM162 host target genes comprises one or more host target binding sites, each having a nucleotide sequence which is at least partly complementary to VGAM162 RNA, herein designated VGAM RNA, and which when bound by VGAM162 RNA causes inhibition of translation of respective one or more VGAM162 host target proteins.

It is further appreciated by one skilled in the art that the mode of translational inhibition illustrated by FIG. 1 with specific reference to translational inhibition exerted by VGAM162 gene, herein designated VGAM GENE, on one or more VGAM162 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM162 is inhibition of expression of host target genes, as part of a novel viral mechanism of attacking a host. Accordingly, utilities of VGAM162 include diagnosis, prevention and treatment of viral infection by Shrimp White Spot Syndrome Virus (white spot bacilliform virus). Specific functions, and accordingly utilities, of VGAM162 correlate with, and may be deduced from, the identity of the host target genes which VGAM162 binds and inhibits, and the function of these host target genes, as elaborated hereinbelow.

Nucleotide sequences of the VGAM162 precursor RNA, herein designated VGAM PRECURSOR RNA, and of the 'diced' VGAM162 RNA, herein designated VGAM RNA, and a schematic representation of the secondary folding of VGAM162 folded precursor RNA, herein designated VGAM FOLDED PRECURSOR RNA, of VGAM162 are further described hereinbelow with reference to Table 1.

Nucleotide sequences of host target binding sites, such as BINDING SITE-I, BINDING SITE-II and BINDING SITE-III of FIG. 1, found on VGAM162 host target RNA, and schematic representation of the complementarity of each of these host target binding sites to VGAM162 RNA, herein designated VGAM RNA, are described hereinbelow with reference to Table 2.

As mentioned hereinabove with reference to FIG. 1, a function of VGAM162 gene, herein designated VGAM is inhibition of expression of VGAM162 target genes. It is appreciated that specific functions, and accordingly utilities, of VGAM162 correlate with, and may be deduced from, the identity of the target genes which VGAM162 binds and inhibits, and the function of these target genes, as elaborated hereinbelow.

Kynurenine 3-monooxygenase (kynurenine 3-hydroxylase) (KMO, Accession NM_003679) is a VGAM162 host target gene. KMO BINDING SITE is HOST TARGET binding site found in the 3' untranslated region of mRNA encoded by KMO, corresponding to a HOST TARGET binding site such as BINDING SITE I, BINDING SITE II or BINDING SITE III. Table 2 illustrates the complementarity of the nucleotide sequences of KMO BINDING SITE, designated SEQ ID:9779, to the nucleotide sequence of VGAM162 RNA, herein designated VGAM RNA, also designated SEQ ID:2873.

A function of VGAM162 is therefore inhibition of Kynurenine 3-monooxygenase (kynurenine 3-hydroxylase) (KMO, Accession NM_003679), a gene which may play a role in encephalic photoreception. Accordingly, utilities of VGAM162 include diagnosis, prevention and treatment of diseases and clinical conditions associated with KMO. The function of KMO has been established by previous studies. Kynurenine 3-monooxygenase (KMO; EC 1.14.13.9) is an NADPH-dependent flavin monooxygenase that catalyzes the hydroxylation of the L-tryptophan metabolite L-kynurenine to form L-3-hydroxykynurenine. By screening a human liver cDNA library with a partial Drosophila KMO cDNA, Alberati-Giani et al. (1997) isolated cDNAs encoding human KMO. The predicted 486-amino acid human protein shares 47% sequence identity with Drosophila KMO. When expressed in mammalian cells, recombinant human KMO exhibited kinetic properties similar to those of the native human protein. Northern blot analysis revealed that human KMO is expressed as an approximately 2-kb mRNA in liver and placenta, and at lower levels in kidney. By comparing genomic and cDNA sequences, Halford et al. (2001) determined that the KMO gene contains at least 15 exons spanning approximately 68 kb. By genomic sequence analysis, Halford et al. (2001) determined that the KMO gene overlaps with the OPN3 gene (OMIM Ref. No. 606695) on chromosome 1q43 and that the 2 genes are transcribed from opposite strands.

Full details of the abovementioned studies are described in the following publications, the disclosure of which are hereby incorporated by reference:

Alberati-Giani, D.; Cesura, A. M.; Broger, C.; Warren, W. D.; Rover, S.; Malherbe, P.: Cloning and functional expression of human kynurenine 3-monooxygenase. FEBS Lett. 410:407-412, 1997; and Halford, S.; Freedman, M. S.; Bellingham, J.; Inglis, S. L.; Poopalasundaram, S.; Soni, B. G.; Foster, R. G.; Hunt, D. M.: Characterization of a novel human opsin gene with wide tissue.

Further studies establishing the function and utilities of KMO are found in John Hopkins OMIM database record ID 603538, and in sited publications numbered 507 and 12220 listed in the bibliography section hereinbelow, which are also hereby incorporated by reference. Transforming, Acidic Coiled-coil Containing Protein 1 (TACC1, Accession NM_006283) is another VGAM162 host target gene. TACC1 BINDING SITE is HOST TARGET binding site found in the 3' untranslated region of mRNA encoded by TACC1, corresponding to a HOST TARGET binding site such as BINDING SITE I, BINDING SITE II or BINDING SITE III. Table 2 illustrates the complementarity of the nucleotide sequences of TACC1 BINDING SITE, designated SEQ ID:12962, to the nucleotide sequence of VGAM162 RNA, herein designated VGAM RNA, also designated SEQ ID:2873.

Another function of VGAM162 is therefore inhibition of Transforming, Acidic Coiled-coil Containing Protein 1 (TACC1, Accession NM_006283). Accordingly, utilities of VGAM162 include diagnosis, prevention and treatment of diseases and clinical conditions associated with TACC1. FENS-1 (Accession NM_020830) is another VGAM162 host target gene. FENS-1 BINDING SITE is HOST TARGET binding site found in the 3' untranslated region of mRNA encoded by FENS-1, corresponding to a HOST TARGET binding site such as BINDING SITE I, BINDING SITE II or BINDING SITE III. Table 2 illustrates the complementarity of the nucleotide sequences of FENS-1 BINDING SITE, designated SEQ ID:21890, to the nucleotide sequence of VGAM162 RNA, herein designated VGAM RNA, also designated SEQ ID:2873.

Another function of VGAM162 is therefore inhibition of FENS-1 (Accession NM_020830). Accordingly, utilities of VGAM162 include diagnosis, prevention and treatment of diseases and clinical conditions associated with FENS-1. FLJ10506 (Accession NM_018117) is another VGAM162 host target gene. FLJ10506 BINDING SITE is HOST TARGET binding site found in the 3' untranslated region of mRNA encoded by FLJ10506, corresponding to a HOST TARGET binding site such as BINDING SITE I, BINDING SITE II or BINDING SITE III. Table 2 illustrates the complementarity of the nucleotide sequences of FLJ10506 BINDING SITE, designated SEQ ID:19888, to the nucleotide sequence of VGAM162 RNA, herein designated VGAM RNA, also designated SEQ ID:2873.

Another function of VGAM162 is therefore inhibition of FLJ10506 (Accession NM_018117). Accordingly, utilities of VGAM162 include diagnosis, prevention and treatment of diseases and clinical conditions associated with FLJ10506. KIAA1954 (Accession XM_085375) is another VGAM162 host target gene. KIAA1954 BINDING SITE is HOST TARGET binding site found in the 3' untranslated region of mRNA encoded by KIAA1954, corresponding to a HOST TARGET binding site such as BINDING SITE I, BINDING SITE II or BINDING SITE III. Table 2 illustrates the complementarity of the nucleotide sequences of KIAA1954 BINDING SITE, designated SEQ ID:38091, to the nucleotide sequence of VGAM162 RNA, herein designated VGAM RNA, also designated SEQ ID:2873.

Another function of VGAM162 is therefore inhibition of KIAA1954 (Accession XM_085375). Accordingly, utilities of VGAM162 include diagnosis, prevention and treatment of diseases and clinical conditions associated with KIAA1954. MGC32104 (Accession NM_144684) is another VGAM162 host target gene. MGC32104 BINDING SITE is HOST TARGET binding site found in the 3' untranslated region of mRNA encoded by MGC32104, corresponding to a HOST TARGET binding site such as BINDING SITE I, BINDING SITE II or BINDING SITE III. Table 2 illustrates the complementarity of the nucleotide sequences of MGC32104 BINDING SITE, designated SEQ ID:29502, to the nucleotide sequence of VGAM162 RNA, herein designated VGAM RNA, also designated SEQ ID:2873.

Another function of VGAM162 is therefore inhibition of MGC32104 (Accession NM_144684). Accordingly, utilities of VGAM162 include diagnosis, prevention and treatment of diseases and clinical conditions associated with MGC32104. R3H Domain (binds single-stranded nucleic acids) Containing (R3HDM, Accession NM_015361) is another VGAM162 host target gene. R3HDM BINDING SITE is HOST TARGET binding site found in the 3' untranslated region of mRNA encoded by R3HDM, corresponding to a HOST TARGET binding site such as BINDING SITE I, BINDING SITE II or BINDING SITE III. Table 2 illustrates the complementarity of the nucleotide sequences of R3HDM BINDING SITE, designated SEQ ID:17660, to the nucleotide sequence of VGAM162 RNA, herein designated VGAM RNA, also designated SEQ ID:2873.

Another function of VGAM162 is therefore inhibition of R3H Domain (binds single-stranded nucleic acids) Containing (R3HDM, Accession NM_015361). Accordingly, utilities of VGAM162 include diagnosis, prevention and treatment of diseases and clinical conditions associated with R3HDM. LOC122509 (Accession NM_145249) is another VGAM162 host target gene. LOC122509 BINDING SITE is HOST TARGET binding site found in the 5' untranslated region of mRNA encoded by LOC122509, corresponding to a HOST TARGET binding site such as BINDING SITE I, BINDING SITE II or BINDING SITE III. Table 2 illustrates the complementarity of the nucleotide sequences of LOC122509 BINDING SITE, designated SEQ ID:29760, to the nucleotide sequence of VGAM162 RNA, herein designated VGAM RNA, also designated SEQ ID:2873.

Another function of VGAM162 is therefore inhibition of LOC122509 (Accession NM_145249). Accordingly, utilities of VGAM162 include diagnosis, prevention and treatment of diseases and clinical conditions associated with LOC122509. LOC146138 (Accession XM_096938) is another VGAM162 host target gene. LOC146138 BINDING SITE is HOST TARGET binding site found in the 3' untranslated region of mRNA encoded by LOC146138, corresponding to a HOST TARGET binding site such as BINDING SITE I, BINDING SITE II or BINDING SITE III. Table 2 illustrates the complementarity of the nucleotide sequences of LOC146138 BINDING SITE, designated SEQ ID:40658, to the nucleotide sequence of VGAM162 RNA, herein designated VGAM RNA, also designated SEQ ID:2873.

Another function of VGAM162 is therefore inhibition of LOC146138 (Accession XM_096938). Accordingly, utilities of VGAM162 include diagnosis, prevention and treatment of diseases and clinical conditions associated with LOC146138. LOC199958 (Accession XM_117163) is another VGAM162 host target gene. LOC199958 BINDING SITE is HOST TARGET binding site found in the 3' untranslated region of mRNA encoded by LOC199958, corresponding to a HOST TARGET binding site such as BINDING SITE I, BINDING SITE II or BINDING SITE III. Table 2 illustrates the complementarity of the nucleotide sequences of LOC199958 BINDING SITE, designated SEQ ID:43265, to the nucleotide sequence of VGAM162 RNA, herein designated VGAM RNA, also designated SEQ ID:2873.

Another function of VGAM162 is therefore inhibition of LOC199958 (Accession XM_117163). Accordingly, utilities of VGAM162 include diagnosis, prevention and treatment of diseases and clinical conditions associated with LOC199958. FIG. 1 further provides a conceptual description of a novel bioinformatically detected viral gene of the present invention, referred to here as Viral Genomic Address Messenger 163 (VGAM163) viral gene, which modulates expression of respective host target genes thereof, the function and utility of which host target genes is known in the art.

VGAM163 is a novel bioinformatically detected regulatory, non protein coding, viral micro RNA (miRNA) gene. The method by which VGAM163 was detected is described hereinabove with reference to FIGS. 1-8.

VGAM163 gene, herein designated VGAM GENE, is a viral gene contained in the genome of Shrimp White Spot Syndrome Virus (white spot bacilliform virus). VGAM163 host target gene, herein designated VGAM HOST TARGET GENE, is a human gene contained in the human genome.

VGAM163 gene encodes a VGAM163 precursor RNA, herein designated VGAM PRECURSOR RNA. Similar to other miRNA genes, and unlike most ordinary genes, VGAM163 precursor RNA does not encode a protein. A nucleotide sequence identical or highly similar to the nucleotide sequence of VGAM163 precursor RNA is designated SEQ ID:149, and is provided hereinbelow with reference to the sequence listing part. Nucleotide sequence SEQ ID:149 is located at position 110896 relative to the genome of Shrimp White Spot Syndrome Virus (white spot bacilliform virus).

VGAM163 precursor RNA folds onto itself, forming VGAM163 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM163 folded precursor RNA into VGAM163 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM163 RNA is designated SEQ ID:2874, and is provided hereinbelow with reference to the sequence listing part.

VGAM163 host target gene, herein designated VGAM HOST TARGET GENE, encodes a corresponding messenger RNA, VGAM163 host target RNA, herein designated VGAM HOST TARGET RNA. VGAM163 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM163 RNA, herein designated VGAM RNA, binds complementarily to one or more host target binding sites located in untranslated regions of VGAM163 host target RNA, herein designated VGAM HOST TARGET RNA. This complementary binding is due to the fact that the nucleotide sequence of VGAM163 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM163 RNA, herein designated VGAM RNA, may have a different number of host target binding sites in untranslated regions of a VGAM163 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM163 RNA, herein designated VGAM RNA, to host target binding sites on VGAM163 host target RNA, herein designated VGAM HOST TARGET RNA, such as BINDING SITE I, BINDING SITE II and BINDING SITE III, inhibits translation of VGAM163 host target RNA into VGAM163 host target protein, herein designated VGAM HOST TARGET PROTEIN. VGAM host target protein is therefore outlined by a broken line.

It is appreciated that VGAM163 host target gene, herein designated VGAM HOST TARGET GENE, in fact represents a plurality of VGAM163 host target genes. The mRNA of each one of this plurality of VGAM163 host target genes comprises one or more host target binding sites, each having a nucleotide sequence which is at least partly complementary to VGAM163 RNA, herein designated VGAM RNA, and which when bound by VGAM163 RNA causes inhibition of translation of respective one or more VGAM163 host target proteins.

It is further appreciated by one skilled in the art that the mode of translational inhibition illustrated by FIG. 1 with specific reference to translational inhibition exerted by VGAM163 gene, herein designated VGAM GENE, on one or more VGAM163 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM163 is inhibition of expression of host target genes, as part of a novel viral mechanism of attacking a host. Accordingly, utilities of VGAM163 include diagnosis, prevention and treatment of viral infection by Shrimp White Spot Syndrome Virus (white spot bacilliform virus). Specific functions, and accordingly utilities, of VGAM163 correlate with, and may be deduced from, the identity of the host target genes which VGAM163 binds and inhibits, and the function of these host target genes, as elaborated hereinbelow.

Nucleotide sequences of the VGAM163 precursor RNA, herein designated VGAM PRECURSOR RNA, and of the 'diced' VGAM163 RNA, herein designated VGAM RNA, and a schematic representation of the secondary folding of VGAM163 folded precursor RNA, herein designated VGAM FOLDED PRECURSOR RNA, of VGAM163 are further described hereinbelow with reference to Table 1.

Nucleotide sequences of host target binding sites, such as BINDING SITE-I, BINDING SITE-II and BINDING SITE-III of FIG. 1, found on VGAM163 host target RNA, and schematic representation of the complementarity of each of these host target binding sites to VGAM163 RNA, herein designated VGAM RNA, are described hereinbelow with reference to Table 2.

As mentioned hereinabove with reference to FIG. 1, a function of VGAM163 gene, herein designated VGAM is inhibition of expression of VGAM163 target genes. It is appreciated that specific functions, and accordingly utilities, of VGAM163 correlate with, and may be deduced from, the identity of the target genes which VGAM163 binds and inhibits, and the function of these target genes, as elaborated hereinbelow.

ADP-ribosylation Factor 1 (ARF1, Accession XM_047545) is a VGAM163 host target gene. ARF1 BINDING SITE is HOST TARGET binding site found in the 3' untranslated region of mRNA encoded by ARF1, corresponding to a HOST TARGET binding site such as BINDING SITE I, BINDING SITE II or BINDING SITE III. Table 2 illustrates the complementarity of the nucleotide sequences of ARF1 BINDING SITE, designated SEQ ID:34992, to the nucleotide sequence of VGAM163 RNA, herein designated VGAM RNA, also designated SEQ ID:2874.

A function of VGAM163 is therefore inhibition of ADP-ribosylation Factor 1 (ARF1, Accession XM_047545). Accordingly, utilities of VGAM163 include diagnosis, prevention and treatment of diseases and clinical conditions associated with ARF1. LOC155438 (Accession XM_098722) is another VGAM163 host target gene. LOC155438 BINDING SITE is HOST TARGET binding site found in the 3' untranslated region of mRNA encoded by LOC155438, corresponding to a HOST TARGET binding site such as BINDING SITE I, BINDING SITE II or BINDING SITE III. Table 2 illustrates the complementarity of the nucleotide sequences of LOC155438 BINDING SITE, designated SEQ ID:41767, to the nucleotide sequence of VGAM163 RNA, herein designated VGAM RNA, also designated SEQ ID:2874.

Another function of VGAM163 is therefore inhibition of LOC155438 (Accession XM_098722). Accordingly, utilities of VGAM163 include diagnosis, prevention and treatment of diseases and clinical conditions associated with LOC155438. LOC56891 (Accession NM_020129) is another VGAM163 host target gene. LOC56891 BINDING SITE is HOST TARGET binding site found in the 5' untranslated region of mRNA encoded by LOC56891, corresponding to a HOST TARGET binding site such as BINDING SITE I, BINDING SITE II or BINDING SITE III. Table 2 illustrates the complementarity of the nucleotide sequences of LOC56891 BINDING SITE, designated SEQ ID:21323, to the nucleotide sequence of VGAM163 RNA, herein designated VGAM RNA, also designated SEQ ID:2874.

Another function of VGAM163 is therefore inhibition of LOC56891 (Accession NM_020129). Accordingly, utilities of VGAM163 include diagnosis, prevention and treatment of diseases and clinical conditions associated with LOC56891. LOC89919 (Accession XM_027244) is another VGAM163 host target gene. LOC89919 BINDING SITE is HOST TARGET binding site found in the 5' untranslated region of mRNA encoded by LOC89919, corresponding to a HOST TARGET binding site such as BINDING SITE I, BINDING SITE II or BINDING SITE III. Table 2 illustrates the complementarity of the nucleotide sequences of LOC89919 BINDING SITE, designated SEQ ID:30467, to the nucleotide sequence of VGAM163 RNA, herein designated VGAM RNA, also designated SEQ ID:2874.

Another function of VGAM163 is therefore inhibition of LOC89919 (Accession XM_027244). Accordingly, utilities of VGAM163 include diagnosis, prevention and treatment of diseases and clinical conditions associated with LOC89919. FIG. 1 further provides a conceptual description of a novel bioinformatically detected viral gene of the present invention, referred to here as Viral Genomic Address Messenger 164 (VGAM164) viral gene, which modulates expression of respective host target genes thereof, the function and utility of which host target genes is known in the art.

VGAM164 is a novel bioinformatically detected regulatory, non protein coding, viral micro RNA (miRNA) gene. The method by which VGAM164 was detected is described hereinabove with reference to FIGS. 1-8.

VGAM164 gene, herein designated VGAM GENE, is a viral gene contained in the genome of Shrimp White Spot Syndrome Virus (white spot bacilliform virus). VGAM164 host target gene, herein designated VGAM HOST TARGET GENE, is a human gene contained in the human genome.

VGAM164 gene encodes a VGAM164 precursor RNA, herein designated VGAM PRECURSOR RNA. Similar to other miRNA genes, and unlike most ordinary genes, VGAM164 precursor RNA does not encode a protein. A nucleotide sequence identical or highly similar to the nucleotide sequence of VGAM164 precursor RNA is designated SEQ ID:150, and is provided hereinbelow with reference to the sequence listing part. Nucleotide sequence SEQ ID:150 is located at position 35494 relative to the genome of Shrimp White Spot Syndrome Virus (white spot bacilliform virus).

VGAM164 precursor RNA folds onto itself, forming VGAM164 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM164 folded precursor RNA into VGAM164 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM164 RNA is designated SEQ ID:2875, and is provided hereinbelow with reference to the sequence listing part.

VGAM164 host target gene, herein designated VGAM HOST TARGET GENE, encodes a corresponding messenger RNA, VGAM164 host target RNA, herein designated VGAM HOST TARGET RNA. VGAM164 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM164 RNA, herein designated VGAM RNA, binds complementarily to one or more host target binding sites located in untranslated regions of VGAM164 host target RNA, herein designated VGAM HOST TARGET RNA. This complementary binding is due to the fact that the nucleotide sequence of VGAM164 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM164 RNA, herein designated VGAM RNA, may have a different number of host target binding sites in untranslated regions of a VGAM164 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM164 RNA, herein designated VGAM RNA, to host target binding sites on VGAM164 host target RNA, herein designated VGAM HOST TARGET RNA, such as BINDING SITE I, BINDING SITE II and BINDING SITE III, inhibits translation of VGAM164 host target RNA into VGAM164 host target protein, herein designated VGAM HOST TARGET PROTEIN. VGAM host target protein is therefore outlined by a broken line.

It is appreciated that VGAM164 host target gene, herein designated VGAM HOST TARGET GENE, in fact represents a plurality of VGAM164 host target genes. The mRNA of each one of this plurality of VGAM164 host target genes comprises one or more host target binding sites, each having a nucleotide sequence which is at least partly complementary to VGAM164 RNA, herein designated VGAM RNA, and which when bound by VGAM164 RNA causes inhibition of translation of respective one or more VGAM164 host target proteins.

It is further appreciated by one skilled in the art that the mode of translational inhibition illustrated by FIG. 1 with specific reference to translational inhibition exerted by VGAM164 gene, herein designated VGAM GENE, on one or more VGAM164 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM164 is inhibition of expression of host target genes, as part of a novel viral mechanism of attacking a host. Accordingly, utilities of VGAM164 include diagnosis, prevention and treatment of viral infection by Shrimp White Spot Syndrome Virus (white spot bacilliform virus). Specific functions, and accordingly utilities, of VGAM164 correlate with, and may be deduced from, the identity of the host target genes which VGAM164 binds and inhibits, and the function of these host target genes, as elaborated hereinbelow.

Nucleotide sequences of the VGAM164 precursor RNA, herein designated VGAM PRECURSOR RNA, and of the 'diced' VGAM164 RNA, herein designated VGAM RNA, and a schematic representation of the secondary folding of VGAM164 folded precursor RNA, herein designated VGAM FOLDED PRECURSOR RNA, of VGAM164 are further described hereinbelow with reference to Table 1.

Nucleotide sequences of host target binding sites, such as BINDING SITE-I, BINDING SITE-II and BINDING SITE-III of FIG. 1, found on VGAM164 host target RNA, and schematic representation of the complementarity of each of these host target binding sites to VGAM164 RNA, herein designated VGAM RNA, are described hereinbelow with reference to Table 2.

As mentioned hereinabove with reference to FIG. 1, a function of VGAM164 gene, herein designated VGAM is inhibition of expression of VGAM164 target genes. It is appreciated that specific functions, and accordingly utilities, of VGAM164 correlate with, and may be deduced from, the identity of the target genes which VGAM164 binds and inhibits, and the function of these target genes, as elaborated hereinbelow.

Cyclin D2 (CCND2, Accession NM_001759) is a VGAM164 host target gene. CCND2 BINDING SITE is HOST TARGET binding site found in the 3' untranslated region of mRNA encoded by CCND2, corresponding to a HOST TARGET binding site such as BINDING SITE I, BINDING SITE II or BINDING SITE III. Table 2 illustrates the complementarity of the nucleotide sequences of CCND2 BINDING SITE, designated SEQ ID:7521, to the nucleotide sequence of VGAM164 RNA, herein designated VGAM RNA, also designated SEQ ID:2875.

A function of VGAM164 is therefore inhibition of Cyclin D2 (CCND2, Accession NM_001759), a gene which is essential for the control of the cell cycle at the g1/s (start) transition. Accordingly, utilities of VGAM164 include diagnosis, prevention and treatment of diseases and clinical conditions associated with CCND2. The function of CCND2 and its association with various diseases and clinical conditions, has been established by previous studies, as described hereinabove with reference to VGAM128. EphA3 (EPHA3, Accession NM_005233) is another VGAM164 host target gene. EPHA3 BINDING SITE is HOST TARGET binding site found in the 3' untranslated region of mRNA encoded by EPHA3, corresponding to a HOST TARGET binding site such as BINDING SITE I, BINDING SITE II or BINDING SITE III. Table 2 illustrates the complementarity of the nucleotide sequences of EPHA3 BINDING SITE, designated SEQ ID:11740, to the nucleotide sequence of VGAM164 RNA, herein designated VGAM RNA, also designated SEQ ID:2875.

Another function of VGAM164 is therefore inhibition of EphA3 (EPHA3, Accession NM_005233), a gene which binds to ephrin-a2, -a3, -a4 and -a5. could play a role in lymphoid function. Accordingly, utilities of VGAM164 include diagnosis, prevention and treatment of diseases and clinical conditions associated with EPHA3. The function of EPHA3 has been established by previous studies. See EPH (EPHA1; 179610) for background on Eph receptors and their ligands, the ephrins. Kinases that phosphorylate proteins on tyrosine residues (protein tyrosine kinases; PTKs) form a structurally related group of molecules that exhibit functional diversity. Genetic alterations that lead to the inappropriate activation or expression of PTKs may be oncogenic. Many growth factor receptors are PTKs, e.g., the receptors for epidermal growth factor (EGFR; 131550), platelet-derived growth factor (PDGFR1, 173410; PDGFR2, 173490), colony-stimulating factor-1 (CSF1R; 164770), and stem cell growth factor (OMIM Ref. No. 164920). Wicks et al. (1992) isolated and sequenced a 4.5-kb cDNA encoding the HEK receptor tyrosine kinase. Sequence comparison with other PTKs showed a high degree of homology with members of the EPH and ELK (EPHB1; 600600) families of receptor tyrosine kinases. There was an apparent restriction of HEK expression to lymphoid tumor cell lines, raising the possibility that HEK may play a role in some human lymphoid malignancies and also in normal lymphoid function and differentiation. By purifying the protein from a pre-B acute lymphoblastic leukemia cell line and amino acid sequencing, Boyd et al. (1992) identified this molecule as a member of the eph/elk family of tyrosine kinases. They assigned this molecule the provisional name HEK, for human eph/elk-like kinase. By Southern blot analysis of somatic cell hybrids and fluorescence in situ hybridization, Wicks et al. (1994) localized the ETK gene to 3p11.2. Northern blotting by Fox et al. (1995) revealed that HEK4 is expressed as a single 7-kb transcript in a variety of human tissues, with the highest level of expression in placenta.

Full details of the abovementioned studies are described in the following publications, the disclosure of which are hereby incorporated by reference:

Wicks, I. P.; Wilkinson, D.; Salvaris, E.; Boyd, A. W.: Molecular cloning of HEK, the gene encoding a receptor tyrosine kinase expressed by human lymphoid tumor cell lines. Proc. Nat. Acad. Sci. 89:1611-1615, 1992; and Fox, G. M.; Holst, P. L.; Chute, H. T.; Lindberg, R. A.; Janssen, A. M.; Basu, R.; Welcher, A. A.: cDNA cloning and tissue distribution of five human EPH-like receptor protein-tyrosine.

Further studies establishing the function and utilities of EPHA3 are found in John Hopkins OMIM database record ID 179611, and in sited publications numbered 12674-12677 listed in the bibliography section hereinbelow, which are also hereby incorporated by reference. Ubiquitin-conjugating Enzyme E2G 2 (UBC7 homolog, yeast) (UBE2G2, Accession XM_036087) is another VGAM164 host target gene. UBE2G2 BINDING SITE is HOST TARGET binding site found in the 3' untranslated region of mRNA encoded by UBE2G2, corresponding to a HOST TARGET binding site such as BINDING SITE I, BINDING SITE II or BINDING SITE III. Table 2 illustrates the complementarity of the nucleotide sequences of UBE2G2 BINDING SITE, designated SEQ ID:32377, to the nucleotide sequence of VGAM164 RNA, herein designated VGAM RNA, also designated SEQ ID:2875.

Another function of VGAM164 is therefore inhibition of Ubiquitin-conjugating Enzyme E2G 2 (UBC7 homolog, yeast) (UBE2G2, Accession XM_036087), a gene which catalyzes the covalent attachment of ubiquitin to other proteins. Accordingly, utilities of VGAM164 include diagnosis, prevention and treatment of diseases and clinical conditions associated with UBE2G2. The function of UBE2G2 has been established by previous studies. In eukaryotes, conjugation of target proteins to ubiquitin is an essential step in the proteasome-dependent degradation process and is mediated by a family of ubiquitin-conjugating (UBC) enzymes. See 600012. Katsanis and Fisher (1998) stated that S. cerevisiae Ubc7 is an endoplasmic reticulum-bound molecule whose active site faces the cytosol. Ubc7 has been shown to confer resistance to cadmium and to participate in the degradation of specific yeast proteins. As part of an effort to generate a transcriptional map of human chromosome 21, Katsanis and Fisher (1998) identified UBE2G2 cDNAs. The predicted 165-amino acid protein shares 60% sequence identity with yeast Ubc7. The nucleotide sequence of UBE2G2 is 57% similar to that of UBE2G (OMIM Ref. No. 601569), another human Ubc7 homolog. Northern blot analysis revealed that UBE2G2 is expressed ubiquitously as 2.9- and 7-kb mRNAs. The highest level of expression was seen in skeletal muscle. By inclusion within mapped clones and by analysis of somatic cell hybrid panels, Katsanis and Fisher (1998) mapped the UBE2G2 gene to 21q22.3. Rose et al. (1998) confirmed the localization to 21q22.3 by FISH.

Full details of the abovementioned studies are described in the following publications, the disclosure of which are hereby incorporated by reference:

Katsanis, N.; Fisher, E. M. C.: Identification, expression, and chromosomal localization of ubiquitin conjugating enzyme 7 (UBE2G2), a human homologue of the Saccharomyces cerevisiae Ubc7 gene. Genomics 51:128-131, 1998; and Rose, S. A.; Leek, J. P.; Moynihan, T. P.; Ardley, H. C.; Markham, A. F.; Robinson, P. A.: Assignment of the ubiquitin conjugating enzyme gene, UBE2G2, to human chromosome band 21q22.3.

Further studies establishing the function and utilities of UBE2G2 are found in John Hopkins OMIM database record ID 603124, and in sited publications numbered 639-640 listed in the bibliography section hereinbelow, which are also hereby incorporated by reference. DKFZP547E1010 (Accession NM_015607) is another VGAM164 host target gene. DKFZP547E1010 BINDING SITE1 and DKFZP547E1010 BINDING SITE2 are HOST TARGET binding sites found in untranslated regions of mRNA encoded by DKFZP547E1010, corresponding to HOST TARGET binding sites such as BINDING SITE I, BINDING SITE II or BINDING SITE III. Table 2 illustrates the complementarity of the nucleotide sequences of DKFZP547E1010 BINDING SITE1 and DKFZP547E1010 BINDING SITE2, designated SEQ ID:17879 and SEQ ID:33243 respectively, to the nucleotide sequence of VGAM164 RNA, herein designated VGAM RNA, also designated SEQ ID:2875.

Another function of VGAM164 is therefore inhibition of DKFZP547E1010 (Accession NM_015607). Accordingly, utilities of VGAM164 include diagnosis, prevention and treatment of diseases and clinical conditions associated with DKFZP547E1010. FIG. 1 further provides a conceptual description of a novel bioinformatically detected viral gene of the present invention, referred to here as Viral Genomic Address Messenger 165 (VGAM165) viral gene, which modulates expression of respective host target genes thereof, the function and utility of which host target genes is known in the art.

VGAM165 is a novel bioinformatically detected regulatory, non protein coding, viral micro RNA (miRNA) gene. The method by which VGAM165 was detected is described hereinabove with reference to FIGS. 1-8.

VGAM165 gene, herein designated VGAM GENE, is a viral gene contained in the genome of Shrimp White Spot Syndrome Virus (white spot bacilliform virus). VGAM165 host target gene, herein designated VGAM HOST TARGET GENE, is a human gene contained in the human genome.

VGAM165 gene encodes a VGAM165 precursor RNA, herein designated VGAM PRECURSOR RNA. Similar to other miRNA genes, and unlike most ordinary genes, VGAM165 precursor RNA does not encode a protein. A nucleotide sequence identical or highly similar to the nucleotide sequence of VGAM165 precursor RNA is designated SEQ ID:151, and is provided hereinbelow with reference to the sequence listing part. Nucleotide sequence SEQ ID:151 is located at position 293621 relative to the genome of Shrimp White Spot Syndrome Virus (white spot bacilliform virus).

VGAM165 precursor RNA folds onto itself, forming VGAM165 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM165 folded precursor RNA into VGAM165 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM165 RNA is designated SEQ ID:2876, and is provided hereinbelow with reference to the sequence listing part.

VGAM165 host target gene, herein designated VGAM HOST TARGET GENE, encodes a corresponding messenger RNA, VGAM165 host target RNA, herein designated VGAM HOST TARGET RNA. VGAM165 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM165 RNA, herein designated VGAM RNA, binds complementarily to one or more host target binding sites located in untranslated regions of VGAM165 host target RNA, herein designated VGAM HOST TARGET RNA. This complementary binding is due to the fact that the nucleotide sequence of VGAM165 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM165 RNA, herein designated VGAM RNA, may have a different number of host target binding sites in untranslated regions of a VGAM165 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM165 RNA, herein designated VGAM RNA, to host target binding sites on VGAM165 host target RNA, herein designated VGAM HOST TARGET RNA, such as BINDING SITE I, BINDING SITE II and BINDING SITE III, inhibits translation of VGAM165 host target RNA into VGAM165 host target protein, herein designated VGAM HOST TARGET PROTEIN. VGAM host target protein is therefore outlined by a broken line.

It is appreciated that VGAM165 host target gene, herein designated VGAM HOST TARGET GENE, in fact represents a plurality of VGAM165 host target genes. The mRNA of each one of this plurality of VGAM165 host target genes comprises one or more host target binding sites, each having a nucleotide sequence which is at least partly complementary to VGAM165 RNA, herein designated VGAM RNA, and which when bound by VGAM165 RNA causes inhibition of translation of respective one or more VGAM165 host target proteins.

It is further appreciated by one skilled in the art that the mode of translational inhibition illustrated by FIG. 1 with specific reference to translational inhibition exerted by VGAM165 gene, herein designated VGAM GENE, on one or more VGAM165 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM165 is inhibition of expression of host target genes, as part of a novel viral mechanism of attacking a host. Accordingly, utilities of VGAM165 include diagnosis, prevention and treatment of viral infection by Shrimp White Spot Syndrome Virus (white spot bacilliform virus). Specific functions, and accordingly utilities, of VGAM165 correlate with, and may be deduced from, the identity of the host target genes which VGAM165 binds and inhibits, and the function of these host target genes, as elaborated hereinbelow.

Nucleotide sequences of the VGAM165 precursor RNA, herein designated VGAM PRECURSOR RNA, and of the 'diced' VGAM165 RNA, herein designated VGAM RNA, and a schematic representation of the secondary folding of VGAM165 folded precursor RNA, herein designated VGAM FOLDED PRECURSOR RNA, of VGAM165 are further described hereinbelow with reference to Table 1.

Nucleotide sequences of host target binding sites, such as BINDING SITE-I, BINDING SITE-II and BINDING SITE-III of FIG. 1, found on VGAM165 host target RNA, and schematic representation of the complementarity of each of these host target binding sites to VGAM165 RNA, herein designated VGAM RNA, are described hereinbelow with reference to Table 2.

As mentioned hereinabove with reference to FIG. 1, a function of VGAM165 gene, herein designated VGAM is inhibition of expression of VGAM165 target genes. It is appreciated that specific functions, and accordingly utilities, of VGAM165 correlate with, and may be deduced from, the identity of the target genes which VGAM165 binds and inhibits, and the function of these target genes, as elaborated hereinbelow.

Cell Division Cycle 25B (CDC25B, Accession NM_021873) is a VGAM165 host target gene. CDC25B BINDING SITE1 and CDC25B BINDING SITE2 are HOST TARGET binding sites found in untranslated regions of mRNA encoded by CDC25B, corresponding to HOST TARGET binding sites such as BINDING SITE I, BINDING SITE II or BINDING SITE III. Table 2 illustrates the complementarity of the nucleotide sequences of CDC25B BINDING SITE1 and CDC25B BINDING SITE2, designated SEQ ID:22411 and SEQ ID:22415 respectively, to the nucleotide sequence of VGAM165 RNA, herein designated VGAM RNA, also designated SEQ ID:2876.

A function of VGAM165 is therefore inhibition of Cell Division Cycle 25B (CDC25B, Accession NM_021873), a gene which is positively activated by dephosphorylation. Accordingly, utilities of VGAM165 include diagnosis, prevention and treatment of diseases and clinical conditions associated with CDC25B. The function of CDC25B has been established by previous studies. Central to the onset of mitosis in all eukaryotic cells is the CDC2 protein kinase (CDK1; 116940), the activity of which is negatively regulated by phosphorylation and positively activated by dephosphorylation. The latter function is carried out by a specific phosphatase, CDC25. At least 3 human CDC25 genes code for the A, B, and C forms of CDC25. CDC25C (OMIM Ref. No. 157680) maps to chromosome 5. Lane et al. (1993) demonstrated by fluorescence in situ hybridization that CDC25B maps to 20p13. PCR analysis of a monochromosomal hybrid cell panel yielded results supporting this chromosome assignment. Demetrick and Beach (1993) also mapped CDC25B to 20p13 by fluorescence in situ hybridization with confirmation by the polymerase chain reaction of hamster/human somatic cell hybrid DNA. Animal model experiments lend further support to the function of CDC25B. Lincoln et al. (2002) generated Cdc25b-deficient mice by targeted disruption and found that they were viable. As compared with wildtype cells, fibroblasts from Cdc25b -/- mice grew vigorously in culture and arrested normally in response to DNA damage. Female Cdc25b -/- mice were sterile and Cdc25b -/- oocytes remained arrested at prophase with low maturation-promoting factor activity. Microinjection of wildtype Cdc25b mRNA into Cdc25b -/- oocytes caused activation of maturation-promoting factor and resumption of meiosis. Thus, Lincoln et al. (2002) concluded that Cdc25b -/- female mice were sterile because of permanent meiotic arrest resulting from the inability to activate the maturation-promoting factor component CDK1. Cdc25b is therefore essential for meiotic resumption in female mice. Lincoln et al. (2002) stated that mice lacking Cdc25b provided the first genetic model for studying the mechanisms regulating prophase arrest in vertebrates.

It is appreciated that the abovementioned animal model for CDC25B is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lane, S. A.; Baker, E.; Sutherland, G. R.; Tonks, I.; Hayward, N.; Ellem, K.: The human cell cycle gene CDC25B is located at 20p13. Genomics 15:693-694, 1993; and Lincoln, A. J.; Wickramasinghe, D.; Stein, P.; Schultz, R. M.; Palko, M. E.; De Miguel, M. P.; Tessarollo, L.; Donovan, P. J.: Cdc25b phosphatase is required for resumption of meiosis d.

Further studies establishing the function and utilities of CDC25B are found in John Hopkins OMIM database record ID 116949, and in sited publications numbered 296 and 1936-1937 listed in the bibliography section hereinbelow, which are also hereby incorporated by reference. Glucose-6-phosphatase, Catalytic (glycogen storage disease type I, von Gierke disease) (G6PC, Accession NM_000151) is another VGAM165 host target gene. G6PC BINDING SITE is HOST TARGET binding site found in the 3' untranslated region of mRNA encoded by G6PC, corresponding to a HOST TARGET binding site such as BINDING SITE I, BINDING SITE II or BINDING SITE III. Table 2 illustrates the complementarity of the nucleotide sequences of G6PC BINDING SITE, designated SEQ ID:5655, to the nucleotide sequence of VGAM165 RNA, herein designated VGAM RNA, also designated SEQ ID:2876.

Another function of VGAM165 is therefore inhibition of Glucose-6-phosphatase, Catalytic (glycogen storage disease type I, von Gierke disease) (G6PC, Accession NM_000151). Accordingly, utilities of VGAM165 include diagnosis, prevention and treatment of diseases and clinical conditions associated with G6PC. Mannosyl (alpha-1,3-)-glycoprotein Beta-1,2-N-acetylglucosaminyltransferase (MGAT1, Accession NM_002406) is another VGAM165 host target gene. MGAT1 BINDING SITE is HOST TARGET binding site found in the 3' untranslated region of mRNA encoded by MGAT1, corresponding to a HOST TARGET binding site such as BINDING SITE I, BINDING SITE II or BINDING SITE III. Table 2 illustrates the complementarity of the nucleotide sequences of MGAT1 BINDING SITE, designated SEQ ID:8225, to the nucleotide sequence of VGAM165 RNA, herein designated VGAM RNA, also designated SEQ ID:2876.

Another function of VGAM165 is therefore inhibition of Mannosyl (alpha-1,3-)-glycoprotein Beta-1,2-N-acetylglucosaminyltransferase (MGAT1, Accession NM_002406), a gene which exists as a single protein-encoding exon. Accordingly, utilities of VGAM165 include diagnosis, prevention and treatment of diseases and clinical conditions associated with MGAT1. The function of MGAT1 has been established by previous studies. There are believed to be over 100 different glycosyltransferases involved in the synthesis of protein-bound and lipid-bound oligosaccharides. One of these, UDP-N-acetylglucosamine:alpha-3-D-mannoside beta-1,2-N-acetylglucosaminyltransferase I (GlcNAc-T I; EC 2.4.1.101), is a medial-Golgi enzyme essential for the synthesis of hybrid and complex N-glycans. Kumar and Stanley (1989) identified the human gene encoding N-acetylglucosaminyltransferase I by complementation of the glycosylation defect in the Lec1 Chinese hamster ovary (CHO) cell mutant. Kumar et al. (1990) cloned the gene. The overall features of the cDNA and deduced protein sequence (445 amino acids) were typical of other Golgi transferases that are type II transmembrane proteins. Hull et al. (1991) isolated 2 overlapping genomic DNA clones which span 18 kb containing the single 2.5-kb exon for GlcNAc-T I. The exon includes most of the 5-prime untranslated region, the complete coding sequence (1,335 bases, 445 amino acids), and the complete 3-prime untranslated region. Southern blot analysis indicated that the gene (symbolized GLCT1) exists in single copy in the human genome, and study of human-hamster somatic cell hybrids indicated that the gene is located on chromosome 5. Pownall et al. (1992) demonstrated that the sequence of the mouse gene Mgat1 is highly conserved with respect to the human and rabbit homologs and exists as a single protein-encoding exon. They mapped the gene to mouse chromosome 11, closely linked to the gene encoding IL3 (OMIM Ref. No. 147740), by the analysis of multilocus interspecies backcrosses. Thus, the human gene may be in the same area as IL3, i.e., 5q23-q31. Kumar et al. (1992) mapped the gene to 5q31.2-q31.3 by in situ hybridization. Tan et al. (1995) reported that the MGAT1 gene maps to 5q35 by fluorescence in situ hybridization. They considered the discrepancy with the findings of Kumar et al. (1992) to be due to greater precision of fluorescence analysis compared with radioactive in situ hybridization. Shows (1999) stated that by use of more sensitive FISH technology than that used in their 1992 report (Kumar et al., 1992), he and his colleagues confirmed the assignment of the MGAT1 gene to 5q35. On Northern blots, Yip et al. (1997) found that GlcNAc-T I is expressed as 2 mRNAs of 3.1 and 2.7 to 3.0 kb in all tissues tested, although only the 3.1-kb mRNA is seen in brain, and expression levels are low. Yip et al. (1997) also found that exon 1 of the GlcNAc-T I gene encodes the 5-prime untranslated region and contains multiple transcription start sites. Ioffe and Stanley (1994) produced transgenic mice lacking Mgat1. Homozygous mutant mice died between 9.5 and 10.5 days of development and were developmentally retarded, especially in neural tissue. Metzler et al. (1994) obtained similar results, finding that neural tube formation, vascularization, and left-right asymmetry formation were impaired in homozygous mutant mouse embryos.

Full details of the abovementioned studies are described in the following publications, the disclosure of which are hereby incorporated by reference:

Tan, J.; d'Agostaro, G. A. F.; Bendiak, B.; Reck, F.; Sarkar, M.; Squire, J. A.; Leong, P.; Schachter, H.: The human UDP-N-acetylglucosamine:alpha-6-D-mannoside-beta-1,2-N-acetylglucosaminyltransfe rase II gene (MGAT2): cloning of genomic DNA, localization to chromosome 14q21, expression in insect cells and purification of the recombinant protein. Europ. J. Biochem. 231:317-328, 1995; and Yip, B.; Chen, S.-H.; Mulder, H.; Hoppener, J. W. M.; Schachter, H.: Organization of the human beta-1,2-N-acetylglucosaminyltransferase I gene (MGAT1), which controls complex and hybrid N-.

Further studies establishing the function and utilities of MGAT1 are found in John Hopkins OMIM database record ID 160995, and in sited publications numbered 3807-381 and 3817 listed in the bibliography section hereinbelow, which are also hereby incorporated by reference. KIAA0182 (Accession XM_050495) is another VGAM165 host target gene. KIAA0182 BINDING SITE is HOST TARGET binding site found in the 3' untranslated region of mRNA encoded by KIAA0182, corresponding to a HOST TARGET binding site such as BINDING SITE I, BINDING SITE II or BINDING SITE III. Table 2 illustrates the complementarity of the nucleotide sequences of KIAA0182 BINDING SITE, designated SEQ ID:35643, to the nucleotide sequence of VGAM165 RNA, herein designated VGAM RNA, also designated SEQ ID:2876.

Another function of VGAM165 is therefore inhibition of KIAA0182 (Accession XM_050495). Accordingly, utilities of VGAM165 include diagnosis, prevention and treatment of diseases and clinical conditions associated with KIAA0182. KIAA1061 (Accession XM_048786) is another VGAM165 host target gene. KIAA1061 BINDING SITE is HOST TARGET binding site found in the 3' untranslated region of mRNA encoded by KIAA1061, corresponding to a HOST TARGET binding site such as BINDING SITE I, BINDING SITE II or BINDING SITE III. Table 2 illustrates the complementarity of the nucleotide sequences of KIAA1061 BINDING SITE, designated SEQ ID:35267, to the nucleotide sequence of VGAM165 RNA, herein designated VGAM RNA, also designated SEQ ID:2876.

Another function of VGAM165 is therefore inhibition of KIAA1061 (Accession XM_048786). Accordingly, utilities of VGAM165 include diagnosis, prevention and treatment of diseases and clinical conditions associated with KIAA1061. Phytanoyl-CoA Hydroxylase Interacting Protein (PHYHIP, Accession NM_014759) is another VGAM165 host target gene. PHYHIP BINDING SITE is HOST TARGET binding site found in the 3' untranslated region of mRNA encoded by PHYHIP, corresponding to a HOST TARGET binding site such as BINDING SITE I, BINDING SITE II or BINDING SITE III. Table 2 illustrates the complementarity of the nucleotide sequences of PHYHIP BINDING SITE, designated SEQ ID:16511, to the nucleotide sequence of VGAM165 RNA, herein designated VGAM RNA, also designated SEQ ID:2876.

Another function of VGAM165 is therefore inhibition of Phytanoyl-CoA Hydroxylase Interacting Protein (PHYHIP, Accession NM_014759). Accordingly, utilities of VGAM165 include diagnosis, prevention and treatment of diseases and clinical conditions associated with PHYHIP. STRAIT11499 (Accession NM_021242) is another VGAM165 host target gene. STRAIT11499 BINDING SITE is HOST TARGET binding site found in the 5' untranslated region of mRNA encoded by STRAIT11499, corresponding to a HOST TARGET binding site such as BINDING SITE I, BINDING SITE II or BINDING SITE III. Table 2 illustrates the complementarity of the nucleotide sequences of STRAIT11499 BINDING SITE, designated SEQ ID:22211, to the nucleotide sequence of VGAM165 RNA, herein designated VGAM RNA, also designated SEQ ID:2876.

Another function of VGAM165 is therefore inhibition of STRAIT11499 (Accession NM_021242). Accordingly, utilities of VGAM165 include diagnosis, prevention and treatment of diseases and clinical conditions associated with STRAIT11499. LOC157753 (Accession XM_088381) is another VGAM165 host target gene. LOC157753 BINDING SITE is HOST TARGET binding site found in the 3' untranslated region of mRNA encoded by LOC157753, corresponding to a HOST TARGET binding site such as BINDING SITE I, BINDING SITE II or BINDING SITE III. Table 2 illustrates the complementarity of the nucleotide sequences of LOC157753 BINDING SITE, designated SEQ ID:39662, to the nucleotide sequence of VGAM165 RNA, herein designated VGAM RNA, also designated SEQ ID:2876.

Another function of VGAM165 is therefore inhibition of LOC157753 (Accession XM_088381). Accordingly, utilities of VGAM165 include diagnosis, prevention and treatment of diseases and clinical conditions associated with LOC157753. LOC253070 (Accession XM_173088) is another VGAM165 host target gene. LOC253070 BINDING SITE is HOST TARGET binding site found in the 3' untranslated region of mRNA encoded by LOC253070, corresponding to a HOST TARGET binding site such as BINDING SITE I, BINDING SITE II or BINDING SITE III. Table 2 illustrates the complementarity of the nucleotide sequences of LOC253070 BINDING SITE, designated SEQ ID:46355, to the nucleotide sequence of VGAM165 RNA, herein designated VGAM RNA, also designated SEQ ID:2876.

Another function of VGAM165 is therefore inhibition of LOC253070 (Accession XM_173088). Accordingly, utilities of VGAM165 include diagnosis, prevention and treatment of diseases and clinical conditions associated with LOC253070. LOC257479 (Accession XM_171548) is another VGAM165 host target gene. LOC257479 BINDING SITE is HOST TARGET binding site found in the 5' untranslated region of mRNA encoded by LOC257479, corresponding to a HOST TARGET binding site such as BINDING SITE I, BINDING SITE II or BINDING SITE III. Table 2 illustrates the complementarity of the nucleotide sequences of LOC257479 BINDING SITE, designated SEQ ID:46050, to the nucleotide sequence of VGAM165 RNA, herein designated VGAM RNA, also designated SEQ ID:2876.

Another function of VGAM165 is therefore inhibition of LOC257479 (Accession XM_171548). Accordingly, utilities of VGAM165 include diagnosis, prevention and treatment of diseases and clinical conditions associated with LOC257479. FIG. 1 further provides a conceptual description of a novel bioinformatically detected viral gene of the present invention, referred to here as Viral Genomic Address Messenger 166 (VGAM166) viral gene, which modulates expression of respective host target genes thereof, the function and utility of which host target genes is known in the art.

VGAM166 is a novel bioinformatically detected regulatory, non protein coding, viral micro RNA (miRNA) gene. The method by which VGAM166 was detected is described hereinabove with reference to FIGS. 1-8.

VGAM166 gene, herein designated VGAM GENE, is a viral gene contained in the genome of Shrimp White Spot Syndrome Virus (white spot baciliform virus). VGAM166 host target gene, herein designated VGAM HOST TARGET GENE, is a human gene contained in the human genome.

VGAM166 gene encodes a VGAM166 precursor RNA, herein designated VGAM PRECURSOR RNA. Similar to other miRNA genes, and unlike most ordinary genes, VGAM166 precursor RNA does not encode a protein. A nucleotide sequence identical or highly similar to the nucleotide sequence of VGAM166 precursor RNA is designated SEQ ID:152, and is provided hereinbelow with reference to the sequence listing part. Nucleotide sequence SEQ ID:152 is located at position 222866 relative to the genome of Shrimp White Spot Syndrome Virus (white spot baciliform virus).

VGAM166 precursor RNA folds onto itself, forming VGAM166 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM166 folded precursor RNA into VGAM166 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM166 RNA is designated SEQ ID:2877, and is provided hereinbelow with reference to the sequence listing part.

VGAM166 host target gene, herein designated VGAM HOST TARGET GENE, encodes a corresponding messenger RNA, VGAM166 host target RNA, herein designated VGAM HOST TARGET RNA. VGAM166 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM166 RNA, herein designated VGAM RNA, binds complementarily to one or more host target binding sites located in untranslated regions of VGAM166 host target RNA, herein designated VGAM HOST TARGET RNA. This complementary binding is due to the fact that the nucleotide sequence of VGAM166 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM166 RNA, herein designated VGAM RNA, may have a different number of host target binding sites in untranslated regions of a VGAM166 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM166 RNA, herein designated VGAM RNA, to host target binding sites on VGAM166 host target RNA, herein designated VGAM HOST TARGET RNA, such as BINDING SITE I, BINDING SITE II and BINDING SITE III, inhibits translation of VGAM166 host target RNA into VGAM166 host target protein, herein designated VGAM HOST TARGET PROTEIN. VGAM host target protein is therefore outlined by a broken line.

It is appreciated that VGAM166 host target gene, herein designated VGAM HOST TARGET GENE, in fact represents a plurality of VGAM166 host target genes. The mRNA of each one of this plurality of VGAM166 host target genes comprises one or more host target binding sites, each having a nucleotide sequence which is at least partly complementary to VGAM166 RNA, herein designated VGAM RNA, and which when bound by VGAM166 RNA causes inhibition of translation of respective one or more VGAM166 host target proteins.

It is further appreciated by one skilled in the art that the mode of translational inhibition illustrated by FIG. 1 with specific reference to translational inhibition exerted by VGAM166 gene, herein designated VGAM GENE, on one or more VGAM166 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM166 is inhibition of expression of host target genes, as part of a novel viral mechanism of attacking a host. Accordingly, utilities of VGAM166 include diagnosis, prevention and treatment of viral infection by Shrimp White Spot Syndrome Virus (white spot baciliform virus). Specific functions, and accordingly utilities, of VGAM166 correlate with, and may be deduced from, the identity of the host target genes which VGAM166 binds and inhibits, and the function of these host target genes, as elaborated hereinbelow.

Nucleotide sequences of the VGAM166 precursor RNA, herein designated VGAM PRECURSOR RNA, and of the 'diced' VGAM166 RNA, herein designated VGAM RNA, and a schematic representation of the secondary folding of VGAM166 folded precursor RNA, herein designated VGAM FOLDED PRECURSOR RNA, of VGAM166 are further described hereinbelow with reference to Table 1.

Nucleotide sequences of host target binding sites, such as BINDING SITE-I, BINDING SITE-II and BINDING SITE-III of FIG. 1, found on VGAM166 host target RNA, and schematic representation of the complementarity of each of these host target binding sites to VGAM166 RNA, herein designated VGAM RNA, are described hereinbelow with reference to Table 2.

As mentioned hereinabove with reference to FIG. 1, a function of VGAM166 gene, herein designated VGAM is inhibition of expression of VGAM166 target genes. It is appreciated that specific functions, and accordingly utilities, of VGAM166 correlate with, and may be deduced from, the identity of the target genes which VGAM166 binds and inhibits, and the function of these target genes, as elaborated hereinbelow.

Cholinergic Receptor, Nicotinic, Beta Polypeptide 2 (neuronal) (CHRNB2, Accession NM_000748) is a VGAM166 host target gene. CHRNB2 BINDING SITE is HOST TARGET binding site found in the 3' untranslated region of mRNA encoded by CHRNB2, corresponding to a HOST TARGET binding site such as BINDING SITE I, BINDING SITE II or BINDING SITE III. Table 2 illustrates the complementarity of the nucleotide sequences of CHRNB2 BINDING SITE, designated SEQ ID:6401, to the nucleotide sequence of VGAM166 RNA, herein designated VGAM RNA, also designated SEQ ID:2877.

A function of VGAM166 is therefore inhibition of Cholinergic Receptor, Nicotinic, Beta Polypeptide 2 (neuronal) (CHRNB2, Accession NM_000748), a gene which mediates fast signal transmission at synapses. Accordingly, utilities of VGAM166 include diagnosis, prevention and treatment of diseases and clinical conditions associated with CHRNB2. The function of CHRNB2 has been established by previous studies. The nicotinic acetylcholine receptors (OMIM Ref. No. nAChRs) are members of a superfamily of ligand-gated ion channels that mediate fast signal transmission at synapses. The nAChRs are thought to be (OMIM Ref. No. hetero) pentamers composed of homologous subunits. See 118508 for additional background information on nAChRs. In affected members of a Scottish family with type 3 nocturnal frontal lobe epilepsy (OMIM Ref. No. 605375), Phillips et al. (2001) identified a G-to-A transition at nucleotide 1025 in the CHRNB2 gene, resulting in a val287-to-met (V287M) substitution within the M2 domain. Codon 287 was also involved in the family reported by De Fusco et al. (2000); see 118507.0001. The mutation is located in an evolutionarily conserved region of the gene. Functional receptors with the V287M mutation were highly expressed in Xenopus oocytes and characterized by an approximately 10-fold increase in acetylcholine sensitivity. Animal model experiments lend further support to the function of CHRNB2. Picciotto et al. (1995) disrupted the CHRNB2 mouse homolog in embryonic stem (ES) cells to generate 'knockout' mice deficient in this subunit. Homozygous mice were viable, mated normally, and showed no obvious physical deficits. However, their brains showed absence of high-affinity binding sites for nicotine, and electrophysiologic recordings from brain slices showed that thalamic neurons did not respond to nicotine application. Furthermore, behavioral tests demonstrated that nicotine no longer augmented the performance of the deficient mice on passive avoidance, a test of associative memory. Paradoxically, mutant mice were able to perform better than their nonmutant sibs on this task.

It is appreciated that the abovementioned animal model for CHRNB2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Phillips, H. A.; Favre, I.; Kirkpatrick, M.; Zuberi, S. M.; Goudie, D.; Heron, S. E.; Scheffer, I. E.; Sutherland, G. R.; Berkovic, S. F.; Bertrand, D.; Mulley, J. C. : CHRNB2 is the second acetylcholine receptor subunit associated with autosomal dominant nocturnal frontal lobe epilepsy. Am. J. Hum. Genet. 68:225-231, 2001; and De Fusco, M.; Becchetti, A.; Patrignani, A.; Annesi, G.; Gambardella, A.; Quattrone, A.; Ballabio, A.; Wanke, E.; Casari, G.: The nicotinic receptor beta-2 subunit is mutant in nocturn.

Further studies establishing the function and utilities of CHRNB2 are found in John Hopkins OMIM database record ID 118507, and in sited publications numbered 12690-4453, 12691, 390, 12692, 12693-12694, 39 and 12695 listed in the bibliography section hereinbelow, which are also hereby incorporated by reference. Transcription Factor 8 (represses interleukin 2 expression) (TCF8, Accession NM_030751) is another VGAM166 host target gene. TCF8 BINDING SITE is HOST TARGET binding site found in the 3' untranslated region of mRNA encoded by TCF8, corresponding to a HOST TARGET binding site such as BINDING SITE I, BINDING SITE II or BINDING SITE III. Table 2 illustrates the complementarity of the nucleotide sequences of TCF8 BINDING SITE, designated SEQ ID:25037, to the nucleotide sequence of VGAM166 RNA, herein designated VGAM RNA, also designated SEQ ID:2877.

Another function of VGAM166 is therefore inhibition of Transcription Factor 8 (represses interleukin 2 expression) (TCF8, Accession NM_030751), a gene which may be responsible for transcriptional repression of the il-2 gene and regulates the promoter activity of the atp1a1 gene. Accordingly, utilities of VGAM166 include diagnosis, prevention and treatment of diseases and clinical conditions associated with TCF8. The function of TCF8 has been established by previous studies. TCF8 encodes a human zinc finger transcription factor (Nil-2-a, negative regulator of IL2) that represses T-lymphocyte-specific interleukin-2 gene expression by interacting with a negative regulatory domain within the IL2 gene promoter/enhancer (Williams et al., 1991). Nil-2-a inhibits IL2 gene expression by binding to a negative regulatory domain 100 nucleotides 5-prime of the IL2 transcription start site. Williams et al. (1992) used Southern hybridization and somatic cell hybrids to demonstrate that the murine and human genomes contain homologous genes and that the TCF8 gene resides on human chromosome 10. Fluorescence in situ hybridization localized TCF8 to 10p11.2.

Full details of the abovementioned studies are described in the following publications, the disclosure of which are hereby incorporated by reference:

Williams, T. M.; Montoya, G.; Wu, Y.; Eddy, R. L.; Byers, M. G.; Shows, T. B.: The TCF8 gene encoding a zinc finger protein (Nil-2-a) resides on human chromosome 10p11.2. Genomics 14:194-196, 1992; and Williams, T. M.; Moolten, D.; Burlein, J.; Romano, J.; Bhaerman, R.; Godillot, A.; Mellon, M.; Rauscher, F. J., III; Kant, J. A.: Identification of a zinc finger protein that inhibits.

Further studies establishing the function and utilities of TCF8 are found in John Hopkins OMIM database record ID 189909, and in sited publications numbered 1266 and 12683 listed in the bibliography section hereinbelow, which are also hereby incorporated by reference. Chromosome 20 Open Reading Frame 97 (C20orf97, Accession NM_021158) is another VGAM166 host target gene. C20orf97 BINDING SITE is HOST TARGET binding site found in the 3' untranslated region of mRNA encoded by C20orf97, corresponding to a HOST TARGET binding site such as BINDING SITE I, BINDING SITE II or BINDING SITE III. Table 2 illustrates the complementarity of the nucleotide sequences of C20orf97 BINDING SITE, designated SEQ ID:22138, to the nucleotide sequence of VGAM166 RNA, herein designated VGAM RNA, also designated SEQ ID:2877.

Another function of VGAM166 is therefore inhibition of Chromosome 20 Open Reading Frame 97 (C20orf97, Accession NM_021158). Accordingly, utilities of VGAM166 include diagnosis, prevention and treatment of diseases and clinical conditions associated with C20orf97. DKFZp762E1511 (Accession XM_003460) is another VGAM166 host target gene. DKFZp762E1511 BINDING SITE is HOST TARGET binding site found in the 3' untranslated region of mRNA encoded by DKFZp762E1511, corresponding to a HOST TARGET binding site such as BINDING SITE I, BINDING SITE II or BINDING SITE III. Table 2 illustrates the complementarity of the nucleotide sequences of DKFZp762E1511 BINDING SITE, designated SEQ ID:29936, to the nucleotide sequence of VGAM166 RNA, herein designated VGAM RNA, also designated SEQ ID:2877.

Another function of VGAM166 is therefore inhibition of DKFZp762E1511 (Accession XM_003460). Accordingly, utilities of VGAM166 include diagnosis, prevention and treatment of diseases and clinical conditions associated with DKFZp762E1511. FLJ11618 (Accession NM_022452) is another VGAM166 host target gene. FLJ11618 BINDING SITE is HOST TARGET binding site found in the 5' untranslated region of mRNA encoded by FLJ11618, corresponding to a HOST TARGET binding site such as BINDING SITE I, BINDING SITE II or BINDING SITE III. Table 2 illustrates the complementarity of the nucleotide sequences of FLJ11618 BINDING SITE, designated SEQ ID:22791, to the nucleotide sequence of VGAM166 RNA, herein designated VGAM RNA, also designated SEQ ID:2877.

Another function of VGAM166 is therefore inhibition of FLJ11618 (Accession NM_022452). Accordingly, utilities of VGAM166 include diagnosis, prevention and treatment of diseases and clinical conditions associated with FLJ11618. FLJ14326 (Accession NM_032191) is another VGAM166 host target gene. FLJ14326 BINDING SITE is HOST TARGET binding site found in the 3' untranslated region of mRNA encoded by FLJ14326, corresponding to a HOST TARGET binding site such as BINDING SITE I, BINDING SITE II or BINDING SITE III. Table 2 illustrates the complementarity of the nucleotide sequences of FLJ14326 BINDING SITE, designated SEQ ID:25903, to the nucleotide sequence of VGAM166 RNA, herein designated VGAM RNA, also designated SEQ ID:2877.

Another function of VGAM166 is therefore inhibition of FLJ14326 (Accession NM_032191). Accordingly, utilities of VGAM166 include diagnosis, prevention and treatment of diseases and clinical conditions associated with FLJ14326. KIAA0863 (Accession XM_170863) is another VGAM166 host target gene. KIAA0863 BINDING SITE1 and KIAA0863 BINDING SITE2 are HOST TARGET binding sites found in untranslated regions of mRNA encoded by KIAA0863, corresponding to HOST TARGET binding sites such as BINDING SITE I, BINDING SITE II or BINDING SITE III. Table 2 illustrates the complementarity of the nucleotide sequences of KIAA0863 BINDING SITE1 and KIAA0863 BINDING SITE2, designated SEQ ID:45633 and SEQ ID:17153 respectively, to the nucleotide sequence of VGAM166 RNA, herein designated VGAM RNA, also designated SEQ ID:2877.

Another function of VGAM166 is therefore inhibition of KIAA0863 (Accession XM_170863). Accordingly, utilities of VGAM166 include diagnosis, prevention and treatment of diseases and clinical conditions associated with KIAA0863. KIAA1655 (Accession XM_039442) is another VGAM166 host target gene. KIAA1655 BINDING SITE is HOST TARGET binding site found in the 5' untranslated region of mRNA encoded by KIAA1655, corresponding to a HOST TARGET binding site such as BINDING SITE I, BINDING SITE II or BINDING SITE III. Table 2 illustrates the complementarity of the nucleotide sequences of KIAA1655 BINDING SITE, designated SEQ ID:33082, to the nucleotide sequence of VGAM166 RNA, herein designated VGAM RNA, also designated SEQ ID:2877.

Another function of VGAM166 is therefore inhibition of KIAA1655 (Accession XM_039442). Accordingly, utilities of VGAM166 include diagnosis, prevention and treatment of diseases and clinical conditions associated with KIAA1655. Olfactory Receptor, Family 7, Subfamily C, Member 1 (OR7C1, Accession NM_017506) is another VGAM166 host target gene. OR7C1 BINDING SITE is HOST TARGET binding site found in the 5' untranslated region of mRNA encoded by OR7C1, corresponding to a HOST TARGET binding site such as BINDING SITE I, BINDING SITE II or BINDING SITE III. Table 2 illustrates the complementarity of the nucleotide sequences of OR7C1 BINDING SITE, designated SEQ ID:18960, to the nucleotide sequence of VGAM166 RNA, herein designated VGAM RNA, also designated SEQ ID:2877.

Another function of VGAM166 is therefore inhibition of Olfactory Receptor, Family 7, Subfamily C, Member 1 (OR7C1, Accession NM_017506). Accordingly, utilities of VGAM166 include diagnosis, prevention and treatment of diseases and clinical conditions associated with OR7C1. SEC22C (Accession NM_004206) is another VGAM166 host target gene. SEC22C BINDING SITE is HOST TARGET binding site found in the 3' untranslated region of mRNA encoded by SEC22C, corresponding to a HOST TARGET binding site such as BINDING SITE I, BINDING SITE II or BINDING SITE III. Table 2 illustrates the complementarity of the nucleotide sequences of SEC22C BINDING SITE, designated SEQ ID:10404, to the nucleotide sequence of VGAM166 RNA, herein designated VGAM RNA, also designated SEQ ID:2877.

Another function of VGAM166 is therefore inhibition of SEC22C (Accession NM_004206). Accordingly, utilities of VGAM166 include diagnosis, prevention and treatment of diseases and clinical conditions associated with SEC22C. ZFP106 (Accession NM_022473) is another VGAM166 host target gene. ZFP106 BINDING SITE is HOST TARGET binding site found in the 3' untranslated region of mRNA encoded by ZFP106, corresponding to a HOST TARGET binding site such as BINDING SITE I, BINDING SITE II or BINDING SITE III. Table 2 illustrates the complementarity of the nucleotide sequences of ZFP106 BINDING SITE, designated SEQ ID:22835, to the nucleotide sequence of VGAM166 RNA, herein designated VGAM RNA, also designated SEQ ID:2877.

Another function of VGAM166 is therefore inhibition of ZFP106 (Accession NM_022473). Accordingly, utilities of VGAM166 include diagnosis, prevention and treatment of diseases and clinical conditions associated with ZFP106. LOC147043 (Accession XM_102732) is another VGAM166 host target gene. LOC147043 BINDING SITE is HOST TARGET binding site found in the 5' untranslated region of mRNA encoded by LOC147043, corresponding to a HOST TARGET binding site such as BINDING SITE I, BINDING SITE II or BINDING SITE III. Table 2 illustrates the complementarity of the nucleotide sequences of LOC147043 BINDING SITE, designated SEQ ID:42144, to the nucleotide sequence of VGAM166 RNA, herein designated VGAM RNA, also designated SEQ ID:2877.

Another function of VGAM166 is therefore inhibition of LOC147043 (Accession XM_102732). Accordingly, utilities of VGAM166 include diagnosis, prevention and treatment of diseases and clinical conditions associated with LOC147043. LOC147229 (Accession XM_085742) is another VGAM166 host target gene. LOC147229 BINDING SITE is HOST TARGET binding site found in the 3' untranslated region of mRNA encoded by LOC147229, corresponding to a HOST TARGET binding site such as BINDING SITE I, BINDING SITE II or BINDING SITE III. Table 2 illustrates the complementarity of the nucleotide sequences of LOC147229 BINDING SITE, designated SEQ ID:38321, to the nucleotide sequence of VGAM166 RNA, herein designated VGAM RNA, also designated SEQ ID:2877.

Another function of VGAM166 is therefore inhibition of LOC147229 (Accession XM_085742). Accordingly, utilities of VGAM166 include diagnosis, prevention and treatment of diseases and clinical conditions associated with LOC147229.

FIG. 1 further provides a conceptual description of a novel bioinformatically detected viral gene of the present invention, referred to here as Viral Genomic Address Messenger 167 (VGAM167) viral gene, which modulates expression of respective host target genes thereof, the function and utility of which host target genes is known in the art.

VGAM167 is a novel bioinformatically detected regulatory, non protein coding, viral micro RNA (miRNA) gene. The method by which VGAM167 was detected is described hereinabove with reference to FIGS. 1-8.

VGAM167 gene, herein designated VGAM GENE, is a viral gene contained in the genome of Shrimp White Spot Syndrome Virus (white spot bacilliform virus). VGAM167 host target gene, herein designated VGAM HOST TARGET GENE, is a human gene contained in the human genome.

VGAM167 gene encodes a VGAM167 precursor RNA, herein designated VGAM PRECURSOR RNA. Similar to other miRNA genes, and unlike most ordinary genes, VGAM167 precursor RNA does not encode a protein. A nucleotide sequence identical or highly similar to the nucleotide sequence of VGAM167 precursor RNA is designated SEQ ID:153, and is provided hereinbelow with reference to the sequence listing part. Nucleotide sequence SEQ ID:153 is located at position 169164 relative to the genome of Shrimp White Spot Syndrome Virus (white spot bacilliform virus).

VGAM167 precursor RNA folds onto itself, forming VGAM167 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM167 folded precursor RNA into VGAM167 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM167 RNA is designated SEQ ID:2878, and is provided hereinbelow with reference to the sequence listing part.

VGAM167 host target gene, herein designated VGAM HOST TARGET GENE, encodes a corresponding messenger RNA, VGAM167 host target RNA, herein designated VGAM HOST TARGET RNA. VGAM167 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM167 RNA, herein designated VGAM RNA, binds complementarily to one or more host target binding sites located in untranslated regions of VGAM167 host target RNA, herein designated VGAM HOST TARGET RNA. This complementary binding is due to the fact that the nucleotide sequence of VGAM167 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM167 RNA, herein designated VGAM RNA, may have a different number of host target binding sites in untranslated regions of a VGAM167 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM167 RNA, herein designated VGAM RNA, to host target binding sites on VGAM167 host target RNA, herein designated VGAM HOST TARGET RNA, such as BINDING SITE I, BINDING SITE II and BINDING SITE III, inhibits translation of VGAM167 host target RNA into VGAM167 host target protein, herein designated VGAM HOST TARGET PROTEIN. VGAM host target protein is therefore outlined by a broken line.

It is appreciated that VGAM167 host target gene, herein designated VGAM HOST TARGET GENE, in fact represents a plurality of VGAM167 host target genes. The mRNA of each one of this plurality of VGAM167 host target genes comprises one or more host target binding sites, each having a nucleotide sequence which is at least partly complementary to VGAM167 RNA, herein designated VGAM RNA, and which when bound by VGAM167 RNA causes inhibition of translation of respective one or more VGAM167 host target proteins.

It is further appreciated by one skilled in the art that the mode of translational inhibition illustrated by FIG. 1 with specific reference to translational inhibition exerted by VGAM167 gene, herein designated VGAM GENE, on one or more VGAM167 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM167 is inhibition of expression of host target genes, as part of a novel viral mechanism of attacking a host. Accordingly, utilities of VGAM167 include diagnosis, prevention and treatment of viral infection by Shrimp White Spot Syndrome Virus (white spot bacilliform virus). Specific functions, and accordingly utilities, of VGAM167 correlate with, and may be deduced from, the identity of the host target genes which VGAM167 binds and inhibits, and the function of these host target genes, as elaborated hereinbelow.

Nucleotide sequences of the VGAM167 precursor RNA, herein designated VGAM PRECURSOR RNA, and of the 'diced' VGAM167 RNA, herein designated VGAM RNA, and a schematic representation of the secondary folding of VGAM167 folded precursor RNA, herein designated VGAM FOLDED PRECURSOR RNA, of VGAM167 are further described hereinbelow with reference to Table 1.

Nucleotide sequences of host target binding sites, such as BINDING SITE-I, BINDING SITE-II and BINDING SITE-III of FIG. 1, found on VGAM167 host target RNA, and schematic representation of the complementarity of each of these host target binding sites to VGAM167 RNA, herein designated VGAM RNA, are described hereinbelow with reference to Table 2.

As mentioned hereinabove with reference to FIG. 1, a function of VGAM167 gene, herein designated VGAM is inhibition of expression of VGAM167 target genes. It is appreciated that specific functions, and accordingly utilities, of VGAM167 correlate with, and may be deduced from, the identity of the target genes which VGAM167 binds and inhibits, and the function of these target genes, as elaborated hereinbelow.

CD3Z Antigen, Zeta Polypeptide (TiT3 complex) (CD3Z, Accession NM_000734) is a VGAM167 host target gene. CD3Z BINDING SITE is HOST TARGET binding site found in the 3' untranslated region of mRNA encoded by CD3Z, corresponding to a HOST TARGET binding site such as BINDING SITE I, BINDING SITE II or BINDING SITE III. Table 2 illustrates the complementarity of the nucleotide sequences of CD3Z BINDING SITE, designated SEQ ID:6392, to the nucleotide sequence of VGAM167 RNA, herein designated VGAM RNA, also designated SEQ ID:2878.

A function of VGAM167 is therefore inhibition of CD3Z Antigen, Zeta Polypeptide (TiT3 complex) (CD3Z, Accession NM_000734), a gene which may involve in assembly and expression of the tcr complex as well as signal transduction upon antigen triggering. Accordingly, utilities of VGAM167 include diagnosis, prevention and treatment of diseases and clinical conditions associated with CD3Z. The function of CD3Z has been established by previous studies. Alarcon et al. (1988) described 2 brothers who had a low expression of antigen receptor on the surface of their T lymphocytes. Functional analyses of their T cells showed impaired immune response to alloantigens, tetanus toxoid, and mitogens. Biochemical studies showed reduced intracellular expression of CD3-zeta chains; all other components of the T-cell receptor-CD3 complex were expressed normally. Alarcon et al. (1988) suggested that the impaired association of the CD3-zeta chain with the other chains of the complex was the primary defect leading to the low expression of T-cell receptor-CD3 complex and immunodeficiency in these children. Failure to thrive had been diagnosed in the proband at 11 months; subsequently, chronic anorexia, diarrhea, and recurrent episodes of bronchopneumonia were noted. The diarrhea was shown to be associated with a malabsorption syndrome, which was unresponsive to a gluten-free diet. Biopsy of the small bowel showed absence of villi; however, the patient was negative for HLA-DR3 and -DR7. The boy died of severe autoimmune hemolytic anemia at the age of 3 years. The patient's brother had required hospital admission for respiratory infection, but on the whole was much more mildly affected than his brother. Animal model experiments lend further support to the function of CD3Z. Class I MHC molecules, known to be important for immune responses to antigen, are expressed also by neurons that undergo activity-dependent, long-term structural and synaptic modifications. Huh et al. (2000) showed that in mice genetically deficient for cell surface class I MHC, due to deletion of either TAP1 (OMIM Ref. No. 170260) or beta-2-microglobulin (OMIM Ref. No. 109700), or for the class I MHC receptor component CD3Z, refinement of connections between retina and central targets during development is incomplete. In the hippocampus of adult mutants, N-methyl-D-aspartate receptor-dependent long-term potentiation is enhanced, and long-term depression is absent. Specific class I MHC mRNAs are expressed by distinct mosaics of neurons, reflecting a potential for diverse neuronal functions. These results demonstrated an important role for these molecules in the activity-dependent remodeling and plasticity of connections in the developing and mature mammalian central nervous system.

It is appreciated that the abovementioned animal model for CD3Z is acknowledged by those skilled in the art as a scientifically valid animal model, as can be further appreciated from the publications sited hereinbelow.

Full details of the abovementioned studies are described in the following publications, the disclosure of which are hereby incorporated by reference:

Huh, G. S.; Boulanger, L. M.; Du, H.; Riquelme, P. A.; Brotz, T. M.; Shatz, C. J. : Functional requirement for class I MHC in CNS development and plasticity. Science 290:2155-2159, 2000; and Alarcon, B.; Regueiro, J. R.; Arnaiz-Villena, A.; Terhorst, C.: Familial defect in the surface expression of the T-cell receptor-CD3 complex. New Eng. J. Med. 319:1203-1208, 1988.

Further studies establishing the function and utilities of CD3Z are found in John Hopkins OMIM database record ID 186780, and in sited publications numbered 5687-5690, 1946, 569 and 10857-5694 listed in the bibliography section hereinbelow, which are also hereby incorporated by reference. Interleukin 22 Receptor, Alpha 2 (IL22RA2, Accession NM_052962) is another VGAM167 host target gene. IL22RA2 BINDING SITE is HOST TARGET binding site found in the 3' untranslated region of mRNA encoded by IL22RA2, corresponding to a HOST TARGET binding site such as BINDING SITE I, BINDING SITE II or BINDING SITE III. Table 2 illustrates the complementarity of the nucleotide sequences of IL22RA2 BINDING SITE, designated SEQ ID:27522, to the nucleotide sequence of VGAM167 RNA, herein designated VGAM RNA, also designated SEQ ID:2878.

Another function of VGAM167 is therefore inhibition of Interleukin 22 Receptor, Alpha 2 (IL22RA2, Accession NM_052962), a gene which induces the production of acute-phase reactants. Accordingly, utilities of VGAM167 include diagnosis, prevention and treatment of diseases and clinical conditions associated with IL22RA2. The function of IL22RA2 has been established by previous studies. IL22 (OMIM Ref. No. 605330), a homolog of IL10 (OMIM Ref. No. 124092), is secreted by T cells and binds to and signals through the class II cytokine receptor family (CRF) heterodimer IL22R (OMIM Ref. No. 605457)/IL10RB (OMIM Ref. No. 123889). IL22 induces the production of acute-phase reactants. By DNA database screening for sequences with homology to the extracellular domain of IL10RB and analysis of 6q24 BAC clone, Dumoutier et al. (2001) identified a cDNA encoding IL22BP, which they designated CRF2X. Sequence analysis predicted that the 231-amino acid protein, approximately 33% identical to the extracellular domains of IL20RA (OMIM Ref. No. 605620) and IL22R, contains a signal peptide, 4 cysteines conserved among members of the class II cytokine receptor family, and 5 potential N-linked glycosylation sites, but lacks a transmembrane domain. RT-PCR analysis detected expression in breast, lungs, and intestinal tract, with lower levels in skin, testis, brain, heart, and thymus. ELISA showed that IL22BP does indeed bind IL22. Functional and luciferase reporter analysis indicated that IL22BP specifically blocked IL22-induced STAT3 (OMIM Ref. No. 102582) activation in an intestinal epithelial cell line. Using similar methods, Kotenko et al. (2001) also cloned and characterized IL22BP, which they initially designated CRF2-10. Western blot analysis showed expression of a 34- to 35-kD glycosylated secreted protein. Crosslinking and autoradiographic analysis confirmed the interaction of IL22 and IL22BP. Functional analysis indicated that IL22BP inhibited IL22-mediated MHC class I antigen expression. EMSA analysis demonstrated inhibition of STAT1 (OMIM Ref. No. 600555) and STAT3 DNA-binding complexes. Northern blot analysis showed blocking of SOCS3 (OMIM Ref. No. 604176) expression.

Full details of the abovementioned studies are described in the following publications, the disclosure of which are hereby incorporated by reference:

Dumoutier, L.; Lejeune, D.; Colau, D.; Renauld, J. C.: Cloning and characterization of IL-22 binding protein, a natural antagonist of IL-10-related T cell-derived inducible factor/IL 22. J. Immun. 166:7090-7095, 2001; and Kotenko, S. V.; Izotova, L. S.; Mirochnitchenko, O. V.; Esterova, E.; Dickensheets, H.; Donnelly, R. P.; Pestka, S.: Identification, cloning, and characterization of a novel soluble re.

Further studies establishing the function and utilities of IL22RA2 are found in John Hopkins OMIM database record ID 606648, and in sited publications numbered 6128-6130 listed in the bibliography section hereinbelow, which are also hereby incorporated by reference. Potassium Inwardly-rectifying Channel, Subfamily J, Member 10 (KCNJ10, Accession NM_002241) is another VGAM167 host target gene. KCNJ10 BINDING SITE is HOST TARGET binding site found in the 3' untranslated region of mRNA encoded by KCNJ10, corresponding to a HOST TARGET binding site such as BINDING SITE I, BINDING SITE II or BINDING SITE III. Table 2 illustrates the complementarity of the nucleotide sequences of KCNJ10 BINDING SITE, designated SEQ ID:8027, to the nucleotide sequence of VGAM167 RNA, herein designated VGAM RNA, also designated SEQ ID:2878.

Another function of VGAM167 is therefore inhibition of Potassium Inwardly-rectifying Channel, Subfamily J, Member 10 (KCNJ10, Accession NM_002241), a gene which may be responsible for potassium buffering action of glial cells in the brain. Accordingly, utilities of VGAM167 include diagnosis, prevention and treatment of diseases and clinical conditions associated with KCNJ10. The function of KCNJ10 has been established by previous studies. Potassium channels have been found in virtually all cells, and a large number of K(+) channel cDNAs have been cloned. They are generally classified into voltage-dependent (Kv) type (e.g., 176258 and 176264) and inwardly rectifying (Kir) type (e.g., 602106 and 600937). The former possesses 6 putative transmembrane regions, while the latter has 2 putative transmembrane regions. Doupnik et al. (1995) reported that Kir channels exhibit various physiologic functions, such as the maintenance of the resting membrane potential, the generation of prolonged action potentials, the modulation of cell excitability, and the transport of potassium ions. Takumi et al. (1995) reported that the K(AB)-2/Kir4.1 inwardly rectifying K(+) channel of rat has an ATP-binding domain of Walker-type A motif in the C-terminal intracellular region and is expressed in brain and kidney. In situ hybridization demonstrated that it is expressed predominantly in glial cells of rat membrane but also in the retinal Muller glial cells and marginal cells of the inner ear. By interspecific backcross analysis, Tada et al. (1997) demonstrated that the mouse gene encoding the glial inwardly rectifying potassium channel, symbolized Kcnj10 by them, maps to distal chromosome 1. Because of homology of this region of the mouse genome to human 1q, Tada et al. (1997) suggested that the putative human homolog, KCNJ10, maps to 1q Full details of the abovementioned studies are described in the following publications, the disclosure of which are hereby incorporated by reference:

Doupnik, C. A.; Davidson, N.; Lester, H. A.: The inward rectifier potassium channel family. Curr. Opin. Neurobiol. 5:268-277, 1995; and Tada, Y.; Horio, Y.; Takumi, T.; Terayama, M.; Tsuji, L.; Copeland, N. G.; Jenkins, N. A.; Kurachi, Y.: Assignment of the glial inwardly rectifying potassium channel K(AB)-2/Kir4.1 (Kcn.

Further studies establishing the function and utilities of KCNJ10 are found in John Hopkins OMIM database record ID 602208, and in sited publications numbered 8843-8845 listed in the bibliography section hereinbelow, which are also hereby incorporated by reference. Chromosome 20 Open Reading Frame 12 (C20orf12, Accession NM_018152) is another VGAM167 host target gene. C20orf12 BINDING SITE is HOST TARGET binding site found in the 3' untranslated region of mRNA encoded by C20orf12, corresponding to a HOST TARGET binding site such as BINDING SITE I, BINDING SITE II or BINDING SITE III. Table 2 illustrates the complementarity of the nucleotide sequences of C20orf12 BINDING SITE, designated SEQ ID:19959, to the nucleotide sequence of VGAM167 RNA, herein designated VGAM RNA, also designated SEQ ID:2878.

Another function of VGAM167 is therefore inhibition of Chromosome 20 Open Reading Frame 12 (C20orf12, Accession NM_018152). Accordingly, utilities of VGAM167 include diagnosis, prevention and treatment of diseases and clinical conditions associated with C20orf12. KIAA0528 (Accession XM_051454) is another VGAM167 host target gene. KIAA0528 BINDING SITE is HOST TARGET binding site found in the 5' untranslated region of mRNA encoded by KIAA0528, corresponding to a HOST TARGET binding site such as BINDING SITE I, BINDING SITE II or BINDING SITE III. Table 2 illustrates the complementarity of the nucleotide sequences of KIAA0528 BINDING SITE, designated SEQ ID:35841, to the nucleotide sequence of VGAM167 RNA, herein designated VGAM RNA, also designated SEQ ID:2878.

Another function of VGAM167 is therefore inhibition of KIAA0528 (Accession XM_051454). Accordingly, utilities of VGAM167 include diagnosis, prevention and treatment of diseases and clinical conditions associated with KIAA0528. KIAA1493 (Accession XM_034415) is another VGAM167 host target gene. KIAA1493 BINDING SITE is HOST TARGET binding site found in the 3' untranslated region of mRNA encoded by KIAA1493, corresponding to a HOST TARGET binding site such as BINDING SITE I, BINDING SITE II or BINDING SITE III. Table 2 illustrates the complementarity of the nucleotide sequences of KIAA1493 BINDING SITE, designated SEQ ID:32089, to the nucleotide sequence of VGAM167 RNA, herein designated VGAM RNA, also designated SEQ ID:2878.

Another function of VGAM167 is therefore inhibition of KIAA1493 (Accession XM_034415). Accordingly, utilities of VGAM167 include diagnosis, prevention and treatment of diseases and clinical conditions associated with KIAA1493. LOC51145 (Accession NM_016158) is another VGAM167 host target gene. LOC51145 BINDING SITE is HOST TARGET binding site found in the 3' untranslated region of mRNA encoded by LOC51145, corresponding to a HOST TARGET binding site such as BINDING SITE I, BINDING SITE II or BINDING SITE III. Table 2 illustrates the complementarity of the nucleotide sequences of LOC51145 BINDING SITE, designated SEQ ID:18248, to the nucleotide sequence of VGAM167 RNA, herein designated VGAM RNA, also designated SEQ ID:2878.

Another function of VGAM167 is therefore inhibition of LOC51145 (Accession NM_016158). Accordingly, utilities of VGAM167 include diagnosis, prevention and treatment of diseases and clinical conditions associated with LOC51145. LOC92218 (Accession XM_043647) is another VGAM167 host target gene. LOC92218 BINDING SITE is HOST TARGET binding site found in the 3' untranslated region of mRNA encoded by LOC92218, corresponding to a HOST TARGET binding site such as BINDING SITE I, BINDING SITE II or BINDING SITE III. Table 2 illustrates the complementarity of the nucleotide sequences of LOC92218 BINDING SITE, designated SEQ ID:33985, to the nucleotide sequence of VGAM167 RNA, herein designated VGAM RNA, also designated SEQ ID:2878.

Another function of VGAM167 is therefore inhibition of LOC92218 (Accession XM_043647). Accordingly, utilities of VGAM167 include diagnosis, prevention and treatment of diseases and clinical conditions associated with LOC92218. FIG. 1 further provides a conceptual description of a novel bioinformatically detected viral gene of the present invention, referred to here as Viral Genomic Address Messenger 168 (VGAM168) viral gene, which modulates expression of respective host target genes thereof, the function and utility of which host target genes is known in the art.

VGAM168 is a novel bioinformatically detected regulatory, non protein coding, viral micro RNA (miRNA) gene. The method by which VGAM168 was detected is described hereinabove with reference to FIGS. 1-8.

VGAM168 gene, herein designated VGAM GENE, is a viral gene contained in the genome of Shrimp White Spot Syndrome Virus (white spot bacilliform virus). VGAM168 host target gene, herein designated VGAM HOST TARGET GENE, is a human gene contained in the human genome.

VGAM168 gene encodes a VGAM168 precursor RNA, herein designated VGAM PRECURSOR RNA. Similar to other miRNA genes, and unlike most ordinary genes, VGAM168 precursor RNA does not encode a protein. A nucleotide sequence identical or highly similar to the nucleotide sequence of VGAM168 precursor RNA is designated SEQ ID:154, and is provided hereinbelow with reference to the sequence listing part. Nucleotide sequence SEQ ID:154 is located at position 286571 relative to the genome of Shrimp White Spot Syndrome Virus (white spot bacilliform virus).

VGAM168 precursor RNA folds onto itself, forming VGAM168 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM168 folded precursor RNA into VGAM168 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM168 RNA is designated SEQ ID:2879, and is provided hereinbelow with reference to the sequence listing part.

VGAM168 host target gene, herein designated VGAM HOST TARGET GENE, encodes a corresponding messenger RNA, VGAM168 host target RNA, herein designated VGAM HOST TARGET RNA. VGAM168 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM168 RNA, herein designated VGAM RNA, binds complementarily to one or more host target binding sites located in untranslated regions of VGAM168 host target RNA, herein designated VGAM HOST TARGET RNA. This complementary binding is due to the fact that the nucleotide sequence of VGAM168 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM168 RNA, herein designated VGAM RNA, may have a different number of host target binding sites in untranslated regions of a VGAM168 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM168 RNA, herein designated VGAM RNA, to host target binding sites on VGAM168 host target RNA, herein designated VGAM HOST TARGET RNA, such as BINDING SITE I, BINDING SITE II and BINDING SITE III, inhibits translation of VGAM168 host target RNA into VGAM168 host target protein, herein designated VGAM HOST TARGET PROTEIN. VGAM host target protein is therefore outlined by a broken line.

It is appreciated that VGAM168 host target gene, herein designated VGAM HOST TARGET GENE, in fact represents a plurality of VGAM168 host target genes. The mRNA of each one of this plurality of VGAM168 host target genes comprises one or more host target binding sites, each having a nucleotide sequence which is at least partly complementary to VGAM168 RNA, herein designated VGAM RNA, and which when bound by VGAM168 RNA causes inhibition of translation of respective one or more VGAM168 host target proteins.

It is further appreciated by one skilled in the art that the mode of translational inhibition illustrated by FIG. 1 with specific reference to translational inhibition exerted by VGAM168 gene, herein designated VGAM GENE, on one or more VGAM168 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM168 is inhibition of expression of host target genes, as part of a novel viral mechanism of attacking a host. Accordingly, utilities of VGAM168 include diagnosis, prevention and treatment of viral infection by Shrimp White Spot Syndrome Virus (white spot bacilliform virus). Specific functions, and accordingly utilities, of VGAM168 correlate with, and may be deduced from, the identity of the host target genes which VGAM168 binds and inhibits, and the function of these host target genes, as elaborated hereinbelow.

Nucleotide sequences of the VGAM168 precursor RNA, herein designated VGAM PRECURSOR RNA, and of the 'diced' VGAM168 RNA, herein designated VGAM RNA, and a schematic representation of the secondary folding of VGAM168 folded precursor RNA, herein designated VGAM FOLDED PRECURSOR RNA, of VGAM168 are further described hereinbelow with reference to Table 1.

Nucleotide sequences of host target binding sites, such as BINDING SITE-I, BINDING SITE-II and BINDING SITE-III of FIG. 1, found on VGAM168 host target RNA, and schematic representation of the complementarity of each of these host target binding sites to VGAM168 RNA, herein designated VGAM RNA, are described hereinbelow with reference to Table 2.

As mentioned hereinabove with reference to FIG. 1, a function of VGAM168 gene, herein designated VGAM is inhibition of expression of VGAM168 target genes. It is appreciated that specific functions, and accordingly utilities, of VGAM168 correlate with, and may be deduced from, the identity of the target genes which VGAM168 binds and inhibits, and the function of these target genes, as elaborated hereinbelow.

RAS, Dexamethasone-induced 1 (RASD1, Accession NM_016084) is a VGAM168 host target gene. RASD1 BINDING SITE is HOST TARGET binding site found in the 3' untranslated region of mRNA encoded by RASD1, corresponding to a HOST TARGET binding site such as BINDING SITE I, BINDING SITE II or BINDING SITE III. Table 2 illustrates the complementarity of the nucleotide sequences of RASD1 BINDING SITE, designated SEQ ID:18167, to the nucleotide sequence of VGAM168 RNA, herein designated VGAM RNA, also designated SEQ ID:2879.

A function of VGAM168 is therefore inhibition of RAS, Dexamethasone-induced 1 (RASD1, Accession NM_016084), a gene which is a novel physiologic NO effector. Accordingly, utilities of VGAM168 include diagnosis, prevention and treatment of diseases and clinical conditions associated with RASD1. The function of RASD1 has been established by previous studies. Using differential display, Kemppainen and Behrend (1998) identified Dexras1, a novel RAS superfamily gene induced by dexamethasone in AtT-20 cells (mouse-derived corticotroph tumor cells). The deduced 280-amino acid mouse protein shares highest homology (36% identity) with human RAP2B (OMIM Ref. No. 179541). Northern blot analysis of mouse tissues detected expression of Dexras1 in brain, heart, kidney, and liver. By yeast 2-hybrid screening of a lung cDNA library with the third SH3 domain of NCK2 (OMIM Ref. No. 604930) as bait, Tu and Wu (1999) isolated a cDNA encoding RASD1, which they called DEXRAS1. The deduced 281-amino acid protein, which is 98% identical to the mouse protein, contains a P loop, guanine base-binding loops, and a C-terminal farnesylation site. SDS-PAGE analysis detected a 33-kD protein, close to the predicted size. Northern blot analysis revealed ubiquitous expression of a 5.0-kb RASD1 transcript, with highest levels in heart. Dexamethasone exposure upregulated RASD1 expression.

Full details of the abovementioned studies are described in the following publications, the disclosure of which are hereby incorporated by reference:

Kemppainen, R. J.; Behrend, E. N.: Dexamethasone rapidly induces a novel Ras superfamily member-related gene in AtT-20 cells. J. Biol. Chem. 273: 3129-3131, 1998; and Tu, Y.; Wu, C.: Cloning, expression and characterization of a novel human Ras-related protein that is regulated by glucocorticoid hormone. Biochim. Biophys. Acta 1489:452-456, 1999.

Further studies establishing the function and utilities of RASD1 are found in John Hopkins OMIM database record ID 605550, and in sited publications numbered 6402-6404 listed in the bibliography section hereinbelow, which are also hereby incorporated by reference. Serine Racemase (SRR, Accession NM_021947) is another VGAM168 host target gene. SRR BINDING SITE is HOST TARGET binding site found in the 3' untranslated region of mRNA encoded by SRR, corresponding to a HOST TARGET binding site such as BINDING SITE I, BINDING SITE II or BINDING SITE III. Table 2 illustrates the complementarity of the nucleotide sequences of SRR BINDING SITE, designated SEQ ID:22474, to the nucleotide sequence of VGAM168 RNA, herein designated VGAM RNA, also designated SEQ ID:2879.

Another function of VGAM168 is therefore inhibition of Serine Racemase (SRR, Accession NM_021947). Accordingly, utilities of VGAM168 include diagnosis, prevention and treatment of diseases and clinical conditions associated with SRR. DKFZp762E1511 (Accession XM_003460) is another VGAM168 host target gene. DKFZp762E1511 BINDING SITE is HOST TARGET binding site found in the 3' untranslated region of mRNA encoded by DKFZp762E1511, corresponding to a HOST TARGET binding site such as BINDING SITE I, BINDING SITE II or BINDING SITE III. Table 2 illustrates the complementarity of the nucleotide sequences of DKFZp762E1511 BINDING SITE, designated SEQ ID:29933, to the nucleotide sequence of VGAM168 RNA, herein designated VGAM RNA, also designated SEQ ID:2879.

Another function of VGAM168 is therefore inhibition of DKFZp762E1511 (Accession XM_003460). Accordingly, utilities of VGAM168 include diagnosis, prevention and treatment of diseases and clinical conditions associated with DKFZp762E1511. SDS3 (Accession XM_045014) is another VGAM168 host target gene. SDS3 BINDING SITE is HOST TARGET binding site found in the 3' untranslated region of mRNA encoded by SDS3, corresponding to a HOST TARGET binding site such as BINDING SITE I, BINDING SITE II or BINDING SITE III. Table 2 illustrates the complementarity of the nucleotide sequences of SDS3 BINDING SITE, designated SEQ ID:34318, to the nucleotide sequence of VGAM168 RNA, herein designated VGAM RNA, also designated SEQ ID:2879.

Another function of VGAM168 is therefore inhibition of SDS3 (Accession XM_045014). Accordingly, utilities of VGAM168 include diagnosis, prevention and treatment of diseases and clinical conditions associated with SDS3. LOC151248 (Accession XM_087143) is another VGAM168 host target gene. LOC151248 BINDING SITE is HOST TARGET binding site found in the 5' untranslated region of mRNA encoded by LOC151248, corresponding to a HOST TARGET binding site such as BINDING SITE I, BINDING SITE II or BINDING SITE III. Table 2 illustrates the complementarity of the nucleotide sequences of LOC151248 BINDING SITE, designated SEQ ID:39086, to the nucleotide sequence of VGAM168 RNA, herein designated VGAM RNA, also designated SEQ ID:2879.

Another function of VGAM168 is therefore inhibition of LOC151248 (Accession XM_087143). Accordingly, utilities of VGAM168 include diagnosis, prevention and treatment of diseases and clinical conditions associated with LOC151248. LOC153810 (Accession XM_087778) is another VGAM168 host target gene. LOC153810 BINDING SITE is HOST TARGET binding site found in the 3' untranslated region of mRNA encoded by LOC153810, corresponding to a HOST TARGET binding site such as BINDING SITE I, BINDING SITE II or BINDING SITE III. Table 2 illustrates the complementarity of the nucleotide sequences of LOC153810 BINDING SITE, designated SEQ ID:39412, to the nucleotide sequence of VGAM168 RNA, herein designated VGAM RNA, also designated SEQ ID:2879.

Another function of VGAM168 is therefore inhibition of LOC153810 (Accession XM_087778). Accordingly, utilities of VGAM168 include diagnosis, prevention and treatment of diseases and clinical conditions associated with LOC153810. LOC170425 (Accession XM_084330) is another VGAM168 host target gene. LOC170425 BINDING SITE is HOST TARGET binding site found in the 5' untranslated region of mRNA encoded by LOC170425, corresponding to a HOST TARGET binding site such as BINDING SITE I, BINDING SITE II or BINDING SITE III. Table 2 illustrates the complementarity of the nucleotide sequences of LOC170425 BINDING SITE, designated SEQ ID:37551, to the nucleotide sequence of VGAM168 RNA, herein designated VGAM RNA, also designated SEQ ID:2879.

Another function of VGAM168 is therefore inhibition of LOC170425 (Accession XM_084330). Accordingly, utilities of VGAM168 include diagnosis, prevention and treatment of diseases and clinical conditions associated with LOC170425. FIG. 1 further provides a conceptual description of a novel bioinformatically detected viral gene of the present invention, referred to here as Viral Genomic Address Messenger 169 (VGAM169) viral gene, which modulates expression of respective host target genes thereof, the function and utility of which host target genes is known in the art.

VGAM169 is a novel bioinformatically detected regulatory, non protein coding, viral micro RNA (miRNA) gene. The method by which VGAM169 was detected is described hereinabove with reference to FIGS. 1-8.

VGAM169 gene, herein designated VGAM GENE, is a viral gene contained in the genome of Shrimp White Spot Syndrome Virus (white spot bacilliform virus). VGAM169 host target gene, herein designated VGAM HOST TARGET GENE, is a human gene contained in the human genome.

VGAM169 gene encodes a VGAM169 precursor RNA, herein designated VGAM PRECURSOR RNA. Similar to other miRNA genes, and unlike most ordinary genes, VGAM169 precursor RNA does not encode a protein. A nucleotide sequence identical or highly similar to the nucleotide sequence of VGAM169 precursor RNA is designated SEQ ID:155, and is provided hereinbelow with reference to the sequence listing part. Nucleotide sequence SEQ ID:155 is located at position 40241 relative to the genome of Shrimp White Spot Syndrome Virus (white spot bacilliform virus).

VGAM169 precursor RNA folds onto itself, forming VGAM169 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM169 folded precursor RNA into VGAM169 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 85%) nucleotide sequence of VGAM169 RNA is designated SEQ ID:2880, and is provided hereinbelow with reference to the sequence listing part.

VGAM169 host target gene, herein designated VGAM HOST TARGET GENE, encodes a corresponding messenger RNA, VGAM169 host target RNA, herein designated VGAM HOST TARGET RNA. VGAM169 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM169 RNA, herein designated VGAM RNA, binds complementarily to one or more host target binding sites located in untranslated regions of VGAM169 host target RNA, herein designated VGAM HOST TARGET RNA. This complementary binding is due to the fact that the nucleotide sequence of VGAM169 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM169 RNA, herein designated VGAM RNA, may have a different number of host target binding sites in untranslated regions of a VGAM169 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM169 RNA, herein designated VGAM RNA, to host target binding sites on VGAM169 host target RNA, herein designated VGAM HOST TARGET RNA, such as BINDING SITE I, BINDING SITE II and BINDING SITE III, inhibits translation of VGAM169 host target RNA into VGAM169 host target protein, herein designated VGAM HOST TARGET PROTEIN. VGAM host target protein is therefore outlined by a broken line.

It is appreciated that VGAM169 host target gene, herein designated VGAM HOST TARGET GENE, in fact represents a plurality of VGAM169 host target genes. The mRNA of each one of this plurality of VGAM169 host target genes comprises one or more host target binding sites, each having a nucleotide sequence which is at least partly complementary to VGAM169 RNA, herein designated VGAM RNA, and which when bound by VGAM169 RNA causes inhibition of translation of respective one or more VGAM169 host target proteins.

It is further appreciated by one skilled in the art that the mode of translational inhibition illustrated by FIG. 1 with specific reference to translational inhibition exerted by VGAM169 gene, herein designated VGAM GENE, on one or more VGAM169 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM169 is inhibition of expression of host target genes, as part of a novel viral mechanism of attacking a host. Accordingly, utilities of VGAM169 include diagnosis, prevention and treatment of viral infection by Shrimp White Spot Syndrome Virus (white spot bacilliform virus). Specific functions, and accordingly utilities, of VGAM169 correlate with, and may be deduced from, the identity of the host target genes which VGAM169 binds and inhibits, and the function of these host target genes, as elaborated hereinbelow.

Nucleotide sequences of the VGAM169 precursor RNA, herein designated VGAM PRECURSOR RNA, and of the 'diced' VGAM169 RNA, herein designated VGAM RNA, and a schematic representation of the secondary folding of VGAM169 folded precursor RNA, herein designated VGAM FOLDED PRECURSOR RNA, of VGAM169 are further described hereinbelow with reference to Table 1.

Nucleotide sequences of host target binding sites, such as BINDING SITE-I, BINDING SITE-II and BINDING SITE-III of FIG. 1, found on VGAM169 host target RNA, and schematic representation of the complementarity of each of these host target binding sites to VGAM169 RNA, herein designated VGAM RNA, are described hereinbelow with reference to Table 2.

As mentioned hereinabove with reference to FIG. 1, a function of VGAM169 gene, herein designated VGAM is inhibition of expression of VGAM169 target genes. It is appreciated that specific functions, and accordingly utilities, of VGAM169 correlate with, and may be deduced from, the identity of the target genes which VGAM169 binds and inhibits, and the function of these target genes, as elaborated hereinbelow.

Astrotactin (ASTN, Accession XM_045113) is a VGAM169 host target gene. ASTN BINDING SITE is HOST TARGET binding site found in the 3' untranslated region of mRNA encoded by ASTN, corresponding to a HOST TARGET binding site such as BINDING SITE I, BINDING SITE II or BINDING SITE III. Table 2 illustrates the complementarity of the nucleotide sequences of ASTN BINDING SITE, designated SEQ ID:34361, to the nucleotide sequence of VGAM169 RNA, herein designated VGAM RNA, also designated SEQ ID:2880.

A function of VGAM169 is therefore inhibition of Astrotactin (ASTN, Accession XM_045113). Accordingly, utilities of VGAM169 include diagnosis, prevention and treatment of diseases and clinical conditions associated with ASTN. Calpain 2, (m/II) Large Subunit (CAPN2, Accession NM_001748) is another VGAM169 host target gene. CAPN2 BINDING SITE is HOST TARGET binding site found in the 3' untranslated region of mRNA encoded by CAPN2, corresponding to a HOST TARGET binding site such as BINDING SITE I, BINDING SITE II or BINDING SITE III. Table 2 illustrates the complementarity of the nucleotide sequences of CAPN2 BINDING SITE, designated SEQ ID:7485, to the nucleotide sequence of VGAM169 RNA, herein designated VGAM RNA, also designated SEQ ID:2880.

Another function of VGAM169 is therefore inhibition of Calpain 2, (m/II) Large Subunit (CAPN2, Accession NM_001748). Accordingly, utilities of VGAM169 include diagnosis, prevention and treatment of diseases and clinical conditions associated with CAPN2. Fanconi Anemia, Complementation Group F (FANCF, Accession NM_022725) is another VGAM169 host target gene. FANCF BINDING SITE is HOST TARGET binding site found in the 3' untranslated region of mRNA encoded by FANCF, corresponding to a HOST TARGET binding site such as BINDING SITE I, BINDING SITE II or BINDING SITE III. Table 2 illustrates the complementarity of the nucleotide sequences of FANCF BINDING SITE, designated SEQ ID:22922, to the nucleotide sequence of VGAM169 RNA, herein designated VGAM RNA, also designated SEQ ID:2880.

Another function of VGAM169 is therefore inhibition of Fanconi Anemia, Complementation Group F (FANCF, Accession NM_022725). Accordingly, utilities of VGAM169 include diagnosis, prevention and treatment of diseases and clinical conditions associated with FANCF. Chromosome 20 Open Reading Frame 108 (C20orf108, Accession NM_080821) is another VGAM169 host target gene. C20orf108 BINDING SITE is HOST TARGET binding site found in the 3' untranslated region of mRNA encoded by C20orf108, corresponding to a HOST TARGET binding site such as BINDING SITE I, BINDING SITE II or BINDING SITE III. Table 2 illustrates the complementarity of the nucleotide sequences of C20orf108 BINDING SITE, designated SEQ ID:28087, to the nucleotide sequence of VGAM169 RNA, herein designated VGAM RNA, also designated SEQ ID:2880.

Another function of VGAM169 is therefore inhibition of Chromosome 20 Open Reading Frame 108 (C20orf108, Accession NM_080821). Accordingly, utilities of VGAM169 include diagnosis, prevention and treatment of diseases and clinical conditions associated with C20orf108. Cyclin G2 (CCNG2, Accession NM_004354) is another VGAM169 host target gene. CCNG2 BINDING SITE is HOST TARGET binding site found in the 3' untranslated region of mRNA encoded by CCNG2, corresponding to a HOST TARGET binding site such as BINDING SITE I, BINDING SITE II or BINDING SITE III. Table 2 illustrates the complementarity of the nucleotide sequences of CCNG2 BINDING SITE, designated SEQ ID:10560, to the nucleotide sequence of VGAM169 RNA, herein designated VGAM RNA, also designated SEQ ID:2880.

Another function of VGAM169 is therefore inhibition of Cyclin G2 (CCNG2, Accession NM_004354). Accordingly, utilities of VGAM169 include diagnosis, prevention and treatment of diseases and clinical conditions associated with CCNG2. CDC42 Binding Protein Kinase Beta (DMPK-like) (CDC42BPB, Accession NM_006035) is another VGAM169 host target gene. CDC42BPB BINDING SITE is HOST TARGET binding site found in the 3' untranslated region of mRNA encoded by CDC42BPB, corresponding to a HOST TARGET binding site such as BINDING SITE I, BINDING SITE II or BINDING SITE III. Table 2 illustrates the complementarity of the nucleotide sequences of CDC42BPB BINDING SITE, designated SEQ ID:12657, to the nucleotide sequence of VGAM169 RNA, herein designated VGAM RNA, also designated SEQ ID:2880.

Another function of VGAM169 is therefore inhibition of CDC42 Binding Protein Kinase Beta (DMPK-like) (CDC42BPB, Accession NM_006035). Accordingly, utilities of VGAM169 include diagnosis, prevention and treatment of diseases and clinical conditions associated with CDC42BPB. KIAA0210 (Accession NM_014744) is another VGAM169 host target gene. KIAA0210 BINDING SITE is HOST TARGET binding site found in the 3' untranslated region of mRNA encoded by KIAA0210, corresponding to a HOST TARGET binding site such as BINDING SITE I, BINDING SITE II or BINDING SITE III. Table 2 illustrates the complementarity of the nucleotide sequences of KIAA0210 BINDING SITE, designated SEQ ID:16425, to the nucleotide sequence of VGAM169 RNA, herein designated VGAM RNA, also designated SEQ ID:2880.

Another function of VGAM169 is therefore inhibition of KIAA0210 (Accession NM_014744). Accordingly, utilities of VGAM169 include diagnosis, prevention and treatment of diseases and clinical conditions associated with KIAA0210. KIAA1486 (Accession XM_041126) is another VGAM169 host target gene. KIAA1486 BINDING SITE is HOST TARGET binding site found in the 3' untranslated region of mRNA encoded by KIAA1486, corresponding to a HOST TARGET binding site such as BINDING SITE I, BINDING SITE II or BINDING SITE III. Table 2 illustrates the complementarity of the nucleotide sequences of KIAA1486 BINDING SITE, designated SEQ ID:33460, to the nucleotide sequence of VGAM169 RNA, herein designated VGAM RNA, also designated SEQ ID:2880.

Another function of VGAM169 is therefore inhibition of KIAA1486 (Accession XM_041126). Accordingly, utilities of VGAM169 include diagnosis, prevention and treatment of diseases and clinical conditions associated with KIAA1486. LOC146823 (Accession XM_097105) is another VGAM169 host target gene. LOC146823 BINDING SITE is HOST TARGET binding site found in the 3' untranslated region of mRNA encoded by LOC146823, corresponding to a HOST TARGET binding site such as BINDING SITE I, BINDING SITE II or BINDING SITE III. Table 2 illustrates the complementarity of the nucleotide sequences of LOC146823 BINDING SITE, designated SEQ ID:40748, to the nucleotide sequence of VGAM169 RNA, herein designated VGAM RNA, also designated SEQ ID:2880.

Another function of VGAM169 is therefore inhibition of LOC146823 (Accession XM_097105). Accordingly, utilities of VGAM169 include diagnosis, prevention and treatment of diseases and clinical conditions associated with LOC146823. FIG. 1 further provides a conceptual description of a novel bioinformatically detected viral gene of the present invention, referred to here as Viral Genomic Address Messenger 170 (VGAM170) viral gene, which modulates expression of respective host target genes thereof, the function and utility of which host target genes is known in the art.

VGAM170 is a novel bioinformatically detected regulatory, non protein coding, viral micro RNA (miRNA) gene. The method by which VGAM170 was detected is described hereinabove with reference to FIGS. 1-8.

VGAM170 gene, herein designated VGAM GENE, is a viral gene contained in the genome of Shrimp White Spot Syndrome Virus (white spot bacilliform virus). VGAM170 host target gene, herein designated VGAM HOST TARGET GENE, is a human gene contained in the human genome.

VGAM170 gene encodes a VGAM170 precursor RNA, herein designated VGAM PRECURSOR RNA. Similar to other miRNA genes, and unlike most ordinary genes, VGAM170 precursor RNA does not encode a protein. A nucleotide sequence identical or highly similar to the nucleotide sequence of VGAM170 precursor RNA is designated SEQ ID:156, and is provided hereinbelow with reference to the sequence listing part. Nucleotide sequence SEQ ID:156 is located at position 152649 relative to the genome of Shrimp White Spot Syndrome Virus (white spot bacilliform virus).

VGAM170 precursor RNA folds onto itself, forming VGAM170 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM170 folded precursor RNA into VGAM170 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM170 RNA is designated SEQ ID:2881, and is provided hereinbelow with reference to the sequence listing part.

VGAM170 host target gene, herein designated VGAM HOST TARGET GENE, encodes a corresponding messenger RNA, VGAM170 host target RNA, herein designated VGAM HOST TARGET RNA. VGAM170 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM170 RNA, herein designated VGAM RNA, binds complementarily to one or more host target binding sites located in untranslated regions of VGAM170 host target RNA, herein designated VGAM HOST TARGET RNA. This complementary binding is due to the fact that the nucleotide sequence of VGAM170 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM170 RNA, herein designated VGAM RNA, may have a different number of host target binding sites in untranslated regions of a VGAM170 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM170 RNA, herein designated VGAM RNA, to host target binding sites on VGAM170 host target RNA, herein designated VGAM HOST TARGET RNA, such as BINDING SITE I, BINDING SITE II and BINDING SITE III, inhibits translation of VGAM170 host target RNA into VGAM170 host target protein, herein designated VGAM HOST TARGET PROTEIN. VGAM host target protein is therefore outlined by a broken line.

It is appreciated that VGAM170 host target gene, herein designated VGAM HOST TARGET GENE, in fact represents a plurality of VGAM170 host target genes. The mRNA of each one of this plurality of VGAM170 host target genes comprises one or more host target binding sites, each having a nucleotide sequence which is at least partly complementary to VGAM170 RNA, herein designated VGAM RNA, and which when bound by VGAM170 RNA causes inhibition of translation of respective one or more VGAM170 host target proteins.

It is further appreciated by one skilled in the art that the mode of translational inhibition illustrated by FIG. 1 with specific reference to translational inhibition exerted by VGAM170 gene, herein designated VGAM GENE, on one or more VGAM170 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM170 is inhibition of expression of host target genes, as part of a novel viral mechanism of attacking a host. Accordingly, utilities of VGAM170 include diagnosis, prevention and treatment of viral infection by Shrimp White Spot Syndrome Virus (white spot bacilliform virus). Specific functions, and accordingly utilities, of VGAM170 correlate with, and may be deduced from, the identity of the host target genes which VGAM170 binds and inhibits, and the function of these host target genes, as elaborated hereinbelow.

Nucleotide sequences of the VGAM170 precursor RNA, herein designated VGAM PRECURSOR RNA, and of the 'diced' VGAM170 RNA, herein designated VGAM RNA, and a schematic representation of the secondary folding of VGAM170 folded precursor RNA, herein designated VGAM FOLDED PRECURSOR RNA, of VGAM170 are further described hereinbelow with reference to Table 1.

Nucleotide sequences of host target binding sites, such as BINDING SITE-I, BINDING SITE-II and BINDING SITE-III of FIG. 1, found on VGAM170 host target RNA, and schematic representation of the complementarity of each of these host target binding sites to VGAM170 RNA, herein designated VGAM RNA, are described hereinbelow with reference to Table 2.

As mentioned hereinabove with reference to FIG. 1, a function of VGAM170 gene, herein designated VGAM is inhibition of expression of VGAM170 target genes. It is appreciated that specific functions, and accordingly utilities, of VGAM170 correlate with, and may be deduced from, the identity of the target genes which VGAM170 binds and inhibits, and the function of these target genes, as elaborated hereinbelow.

Inhibitor of Growth Family, Member 1 (ING1, Accession NM_005537) is a VGAM170 host target gene. ING1 BINDING SITE is HOST TARGET binding site found in the 3' untranslated region of mRNA encoded by ING1, corresponding to a HOST TARGET binding site such as BINDING SITE I, BINDING SITE II or BINDING SITE III. Table 2 illustrates the complementarity of the nucleotide sequences of ING1 BINDING SITE, designated SEQ ID:12062, to the nucleotide sequence of VGAM170 RNA, herein designated VGAM RNA, also designated SEQ ID:2881.

A function of VGAM170 is therefore inhibition of Inhibitor of Growth Family, Member 1 (ING1, Accession NM_005537), a gene which acts as a potent growth regulator in normal and in established cells. Accordingly, utilities of VGAM170 include diagnosis, prevention and treatment of diseases and clinical conditions associated with ING1. The function of ING1 has been established by previous studies. Garkavtsev et al. (1996) described a new strategy for the isolation of tumor suppressor genes. This strategy was based on subtractive hybridization followed by selection of transforming genetic suppressor elements. It was used to isolate a novel gene called ING1 which encodes a 33-kD protein (294 amino acids) that displays the characteristics of a tumor suppressor gene. Garkavtsev et al. (1996) reported that expression of high levels of transfected constructs of this gene inhibited growth, while chronic expression of antisense constructs promoted cell transformation. They observed reduced expression of ING1 in some breast cancer cell lines and mutation of ING1 in neuroblastoma cells. Garkavtsev et al. (1997) showed, using indirect immunofluorescence, that the p33(ING1) protein is located in the nucleus, which is consistent with its proposed role as a growth regulator. By fluorescence in situ hybridization, they localized the ING1 gene to 13q33-q34. Using the radiation hybrid mapping technique, Zeremski et al. (1997) mapped ING1 to 13q34.

Full details of the abovementioned studies are described in the following publications, the disclosure of which are hereby incorporated by reference:

Garkavtsev, I.; Kazarov, A.; Gudkov, A.; Riabowol, K.: Suppression of the novel growth inhibitor p33(ING1) promotes neoplastic transformation. Nature Genet. 14:415-420, 1996. Note: Erratum: Nature Genet. 23: 373 only, 1999; and Gunduz, M.; Ouchida, M.; Fukushima, K.; Hanafusa, H.; Etani, T.; Nishioka, S.; Nishizaki, K.; Shimizu, K.: Genomic structure of the human ING1 gene and tumor-specific mutations detected.

Further studies establishing the function and utilities of ING1 are found in John Hopkins OMIM database record ID 601566, and in sited publications numbered 2787-278 and 6496-2790 listed in the bibliography section hereinbelow, which are also hereby incorporated by reference. FLJ12476 (Accession NM_022784) is another VGAM170 host target gene. FLJ12476 BINDING SITE is HOST TARGET binding site found in the 3' untranslated region of mRNA encoded by FLJ12476, corresponding to a HOST TARGET binding site such as BINDING SITE I, BINDING SITE II or BINDING SITE III. Table 2 illustrates the complementarity of the nucleotide sequences of FLJ12476 BINDING SITE, designated SEQ ID:23069, to the nucleotide sequence of VGAM170 RNA, herein designated VGAM RNA, also designated SEQ ID:2881.

Another function of VGAM170 is therefore inhibition of FLJ12476 (Accession NM_022784). Accordingly, utilities of VGAM170 include diagnosis, prevention and treatment of diseases and clinical conditions associated with FLJ12476. KIAA1715 (Accession XM_042834) is another VGAM170 host target gene. KIAA1715 BINDING SITE is HOST TARGET binding site found in the 3' untranslated region of mRNA encoded by KIAA1715, corresponding to a HOST TARGET binding site such as BINDING SITE I, BINDING SITE II or BINDING SITE III. Table 2 illustrates the complementarity of the nucleotide sequences of KIAA1715 BINDING SITE, designated SEQ ID:33787, to the nucleotide sequence of VGAM170 RNA, herein designated VGAM RNA, also designated SEQ ID:2881.

Another function of VGAM170 is therefore inhibition of KIAA1715 (Accession XM_042834). Accordingly, utilities of VGAM170 include diagnosis, prevention and treatment of diseases and clinical conditions associated with KIAA1715. FIG. 1 further provides a conceptual description of a novel bioinformatically detected viral gene of the present invention, referred to here as Viral Genomic Address Messenger 171 (VGAM171) viral gene, which modulates expression of respective host target genes thereof, the function and utility of which host target genes is known in the art.

VGAM171 is a novel bioinformatically detected regulatory, non protein coding, viral micro RNA (miRNA) gene. The method by which VGAM171 was detected is described hereinabove with reference to FIGS. 1-8.

VGAM171 gene, herein designated VGAM GENE, is a viral gene contained in the genome of Shrimp White Spot Syndrome Virus (white spot bacilliform virus). VGAM171 host target gene, herein designated VGAM HOST TARGET GENE, is a human gene contained in the human genome.

VGAM171 gene encodes a VGAM171 precursor RNA, herein designated VGAM PRECURSOR RNA. Similar to other miRNA genes, and unlike most ordinary genes, VGAM171 precursor RNA does not encode a protein. A nucleotide sequence identical or highly similar to the nucleotide sequence of VGAM171 precursor RNA is designated SEQ ID:157, and is provided hereinbelow with reference to the sequence listing part. Nucleotide sequence SEQ ID:157 is located at position 113416 relative to the genome of Shrimp White Spot Syndrome Virus (white spot bacilliform virus).

VGAM171 precursor RNA folds onto itself, forming VGAM171 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM171 folded precursor RNA into VGAM171 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM171 RNA is designated SEQ ID:2882, and is provided hereinbelow with reference to the sequence listing part.

VGAM171 host target gene, herein designated VGAM HOST TARGET GENE, encodes a corresponding messenger RNA, VGAM171 host target RNA, herein designated VGAM HOST TARGET RNA. VGAM171 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM171 RNA, herein designated VGAM RNA, binds complementarily to one or more host target binding sites located in untranslated regions of VGAM171 host target RNA, herein designated VGAM HOST TARGET RNA. This complementary binding is due to the fact that the nucleotide sequence of VGAM171 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM171 RNA, herein designated VGAM RNA, may have a different number of host target binding sites in untranslated regions of a VGAM171 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM171 RNA, herein designated VGAM RNA, to host target binding sites on VGAM171 host target RNA, herein designated VGAM HOST TARGET RNA, such as BINDING SITE I, BINDING SITE II and BINDING SITE III, inhibits translation of VGAM171 host target RNA into VGAM171 host target protein, herein designated VGAM HOST TARGET PROTEIN. VGAM host target protein is therefore outlined by a broken line.

It is appreciated that VGAM171 host target gene, herein designated VGAM HOST TARGET GENE, in fact represents a plurality of VGAM171 host target genes. The mRNA of each one of this plurality of VGAM171 host target genes comprises one or more host target binding sites, each having a nucleotide sequence which is at least partly complementary to VGAM171 RNA, herein designated VGAM RNA, and which when bound by VGAM171 RNA causes inhibition of translation of respective one or more VGAM171 host target proteins.

It is further appreciated by one skilled in the art that the mode of translational inhibition illustrated by FIG. 1 with specific reference to translational inhibition exerted by VGAM171 gene, herein designated VGAM GENE, on one or more VGAM171 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM171 is inhibition of expression of host target genes, as part of a novel viral mechanism of attacking a host. Accordingly, utilities of VGAM171 include diagnosis, prevention and treatment of viral infection by Shrimp White Spot Syndrome Virus (white spot bacilliform virus). Specific functions, and accordingly utilities, of VGAM171 correlate with, and may be deduced from, the identity of the host target genes which VGAM171 binds and inhibits, and the function of these host target genes, as elaborated hereinbelow.

Nucleotide sequences of the VGAM171 precursor RNA, herein designated VGAM PRECURSOR RNA, and of the 'diced' VGAM171 RNA, herein designated VGAM RNA, and a schematic representation of the secondary folding of VGAM171 folded precursor RNA, herein designated VGAM FOLDED PRECURSOR RNA, of VGAM171 are further described hereinbelow with reference to Table 1.

Nucleotide sequences of host target binding sites, such as BINDING SITE-I, BINDING SITE-II and BINDING SITE-III of FIG. 1, found on VGAM171 host target RNA, and schematic representation of the complementarity of each of these host target binding sites to VGAM171 RNA, herein designated VGAM RNA, are described hereinbelow with reference to Table 2.

As mentioned hereinabove with reference to FIG. 1, a function of VGAM171 gene, herein designated VGAM is inhibition of expression of VGAM171 target genes. It is appreciated that specific functions, and accordingly utilities, of VGAM171 correlate with, and may be deduced from, the identity of the target genes which VGAM171 binds and inhibits, and the function of these target genes, as elaborated hereinbelow.

ARP1 Actin-related Protein 1 Homolog B, Centractin Beta (yeast) (ACTR1B, Accession XM_047780) is a VGAM171 host target gene. ACTR1B BINDING SITE is HOST TARGET binding site found in the 3' untranslated region of mRNA encoded by ACTR1B, corresponding to a HOST TARGET binding site such as BINDING SITE I, BINDING SITE II or BINDING SITE III. Table 2 illustrates the complementarity of the nucleotide sequences of ACTR1B BINDING SITE, designated SEQ ID:35053, to the nucleotide sequence of VGAM171 RNA, herein designated VGAM RNA, also designated SEQ ID:2882.

A function of VGAM171 is therefore inhibition of ARP1 Actin-related Protein 1 Homolog B, Centractin Beta (yeast) (ACTR1B, Accession XM_047780), a gene which component of a multi-subunit complex involved in microtubule based vesicle motility. Accordingly, utilities of VGAM171 include diagnosis, prevention and treatment of diseases and clinical conditions associated with ACTR1B. The function of ACTR1B has been established by previous studies. Isoforms of actin (e.g., ACTG1; 102560), in association with myosin motor proteins (e.g., MYO1A; 601478), are required for cellular motile processes. In addition to conventional actins, there are several actin-related proteins (e.g., ACTR2; 604221). By searching an EST database and by screening a testis cDNA library, Clark et al. (1994) isolated cDNAs encoding ACTR1B, which they called beta-centractin. The deduced 376-amino acid ACTR1B protein and the ACTR1A protein (OMIM Ref. No. 605143) are of equal length, and they share 90% amino acid identity and 96% amino acid similarity. Northern blot analysis detected a 2.0-kb ACTR1B transcript at variable levels in all tissues tested. Two-dimensional immunoblot analysis determined that ACTR1B is expressed in the cytosol as part of the dynactin complex, an activator of dynein-driven vesicle movement (see OMIM Ref. No. 601143), as a 43-kD protein with a pI of 6.4; levels of ACTR1B were at least 15-fold lower than those of ACTR1A. By somatic cell hybrid analysis, Elsea et al. (1999) mapped the ACTR1B gene to chromosome 2. They localized the ACTR1B gene to 2q11.1-q11.2 using FISH.

Full details of the abovementioned studies are described in the following publications, the disclosure of which are hereby incorporated by reference:

Clark, S. W.; Staub, O.; Clark, I. B.; Holzbaur, E. L. F.; Paschal, B. M.; Vallee, R. B.; Meyer, D. I.: Beta-centractin: characterization and distribution of a new member of the centractin family of actin-related proteins. Molec. Biol. Cell 5:1301-1310, 1994; and Elsea, S. H.; Clark, I. B.; Juyal, R. C.; Meyer, D. J.; Meyer, D. I.; Patel, P. I.: Assignment of beta-centractin (CTRN2) to human chromosome 2 bands q11.1-q11.2 with somatic cell hybr.

Further studies establishing the function and utilities of ACTR1B are found in John Hopkins OMIM database record ID 605144, and in sited publications numbered 2875-2876 listed in the bibliography section hereinbelow, which are also hereby incorporated by reference. Core-binding Factor, Runt Domain, Alpha Subunit 2; Translocated To, 2 (CBFA2T2, Accession NM_005093) is another VGAM171 host target gene. CBFA2T2 BINDING SITE1 and CBFA2T2 BINDING SITE2 are HOST TARGET binding sites found in untranslated regions of mRNA encoded by CBFA2T2, corresponding to HOST TARGET binding sites such as BINDING SITE I, BINDING SITE II or BINDING SITE III. Table 2 illustrates the complementarity of the nucleotide sequences of CBFA2T2 BINDING SITE1 and CBFA2T2 BINDING SITE2, designated SEQ ID:11555 and SEQ ID:11550 respectively, to the nucleotide sequence of VGAM171 RNA, herein designated VGAM RNA, also designated SEQ ID:2882.

Another function of VGAM171 is therefore inhibition of Core-binding Factor, Runt Domain, Alpha Subunit 2; Translocated To, 2 (CBFA2T2, Accession NM_005093), a gene which is a putative transcription factor. Accordingly, utilities of VGAM171 include diagnosis, prevention and treatment of diseases and clinical conditions associated with CBFA2T2. The function of CBFA2T2 and its association with various diseases and clinical conditions, has been established by previous studies, as described hereinabove with reference to VGAM152. POU Domain, Class 2, Associating Factor 1 (POU2AF1, Accession NM_006235) is another VGAM171 host target gene. POU2AF1 BINDING SITE is HOST TARGET binding site found in the 3' untranslated region of mRNA encoded by POU2AF1, corresponding to a HOST TARGET binding site such as BINDING SITE I, BINDING SITE II or BINDING SITE III. Table 2 illustrates the complementarity of the nucleotide sequences of POU2AF1 BINDING SITE, designated SEQ ID:12895, to the nucleotide sequence of VGAM171 RNA, herein designated VGAM RNA, also designated SEQ ID:2882.

Another function of VGAM171 is therefore inhibition of POU Domain, Class 2, Associating Factor 1 (POU2AF1, Accession NM_006235), a gene which is a transcriptional coactivator that specifically associates with either oct1 or oct2. Accordingly, utilities of VGAM171 include diagnosis, prevention and treatment of diseases and clinical conditions associated with POU2AF1. The function of POU2AF1 has been established by previous studies. POU domain proteins contain a bipartite DNA-binding domain divided by a flexible linker that enables them to adopt various monomer configurations on DNA. The versatility of POU protein operation is additionally conferred at the dimerization level. Tomilin et al. (2000) found that the POU dimer from the OCT1 gene formed on the palindromic OCT factor recognition element, or PORE (ATTTGAAATGCAAAT), could recruit the transcriptional coactivator OBF1, whereas POU dimers formed on the consensus MORE (more PORE) (ATGCATATGCAT) or on MOREs from Ig heavy chain promoters (AT[G/A][C/A]ATATGCAA) failed to interact. An interaction with OBF1 was precluded since the same OCT1 residues that form the MORE dimerization interface are also used for OBF1/OCT1 interactions on the PORE. These findings provided a paradigm of how specific POU dimer assemblies can differentially recruit a coregulatory activity with distinct transcriptional readouts. Animal model experiments lend further support to the function of POU2AF1. Schubart et al. (2001) noted that Oct2-deficient mice die at birth but have normal B-cell development and transcription of Ig genes. Obf1-deficient mice are viable with unaffected B-cell development in bone marrow and normal serum IgM but have reduced B-cell numbers in spleen and low serum IgG. By creating double knockout mice, Schubart et al. (2001) confirmed that B-cell development and Ig gene transcription can proceed normally without these B-cell specific factors. However, in these animals the mature B-cell pool was strongly reduced, suggesting that these factors play an important role in controlling the expansion and/or maintenance of mature B cells.

It is appreciated that the abovementioned animal model for POU2AF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Schubart, K.; Massa, S.; Schubart, D.; Corcoran, L. M.; Rolink, A. G.; Matthias, P.: B cell development and immunoglobulin gene transcription in the absence of Oct-2 and OBF-1. Nature Immun. 2:69-74, 2001; and Tomilin, A.; Remenyi, A.; Lins, K.; Bak, H.; Leidel, S.; Vriend, G.; Wilmanns, M.; Scholer, H. R.: Synergism with the coactivator OBF-1 (OCA-B, BOB-1) is mediated by a specific POU dimer.

Further studies establishing the function and utilities of POU2AF1 are found in John Hopkins OMIM database record ID 601206, and in sited publications numbered 6375-6377, 6882, 10799-688 and 10797 listed in the bibliography section hereinbelow, which are also hereby incorporated by reference. KIAA1950 (Accession XM_166532) is another VGAM171 host target gene. KIAA1950 BINDING SITE is HOST TARGET binding site found in the 5' untranslated region of mRNA encoded by KIAA1950, corresponding to a HOST TARGET binding site such as BINDING SITE I, BINDING SITE II or BINDING SITE III. Table 2 illustrates the complementarity of the nucleotide sequences of KIAA1950 BINDING SITE, designated SEQ ID:44492, to the nucleotide sequence of VGAM171 RNA, herein designated VGAM RNA, also designated SEQ ID:2882.

Another function of VGAM171 is therefore inhibition of KIAA1950 (Accession XM_166532). Accordingly, utilities of VGAM171 include diagnosis, prevention and treatment of diseases and clinical conditions associated with KIAA1950. MGC2647 (Accession XM_057150) is another VGAM171 host target gene. MGC2647 BINDING SITE is HOST TARGET binding site found in the 3' untranslated region of mRNA encoded by MGC2647, corresponding to a HOST TARGET binding site such as BINDING SITE I, BINDING SITE II or BINDING SITE III. Table 2 illustrates the complementarity of the nucleotide sequences of MGC2647 BINDING SITE, designated SEQ ID:36485, to the nucleotide sequence of VGAM171 RNA, herein designated VGAM RNA, also designated SEQ ID:2882.

Another function of VGAM171 is therefore inhibition of MGC2647 (Accession XM_057150). Accordingly, utilities of VGAM171 include diagnosis, prevention and treatment of diseases and clinical conditions associated with MGC2647. RTC Domain Containing 1 (RTCD1, Accession NM_003729) is another VGAM171 host target gene. RTCD1 BINDING SITE is HOST TARGET binding site found in the 5' untranslated region of mRNA encoded by RTCD1, corresponding to a HOST TARGET binding site such as BINDING SITE I, BINDING SITE II or BINDING SITE III. Table 2 illustrates the complementarity of the nucleotide sequences of RTCD1 BINDING SITE, designated SEQ ID:9822, to the nucleotide sequence of VGAM171 RNA, herein designated VGAM RNA, also designated SEQ ID:2882.

Another function of VGAM171 is therefore inhibition of RTC Domain Containing 1 (RTCD1, Accession NM_003729). Accordingly, utilities of VGAM171 include diagnosis, prevention and treatment of diseases and clinical conditions associated with RTCD1. SCMH1 (Accession NM_012236) is another VGAM171 host target gene. SCMH1 BINDING SITE is HOST TARGET binding site found in the 3' untranslated region of mRNA encoded by SCMH1, corresponding to a HOST TARGET binding site such as BINDING SITE I, BINDING SITE II or BINDING SITE III. Table 2 illustrates the complementarity of the nucleotide sequences of SCMH1 BINDING SITE, designated SEQ ID:14540, to the nucleotide sequence of VGAM171 RNA, herein designated VGAM RNA, also designated SEQ ID:2882.

Another function of VGAM171 is therefore inhibition of SCMH1 (Accession NM_012236). Accordingly, utilities of VGAM171 include diagnosis, prevention and treatment of diseases and clinical conditions associated with SCMH1. Tripartite Motif-containing 22 (TRIM22, Accession NM_006074) is another VGAM171 host target gene. TRIM22 BINDING SITE is HOST TARGET binding site found in the 3' untranslated region of mRNA encoded by TRIM22, corresponding to a HOST TARGET binding site such as BINDING SITE I, BINDING SITE II or BINDING SITE III. Table 2 illustrates the complementarity of the nucleotide sequences of TRIM22 BINDING SITE, designated SEQ ID:12718, to the nucleotide sequence of VGAM171 RNA, herein designated VGAM RNA, also designated SEQ ID:2882.

Another function of VGAM171 is therefore inhibition of Tripartite Motif-containing 22 (TRIM22, Accession NM_006074). Accordingly, utilities of VGAM171 include diagnosis, prevention and treatment of diseases and clinical conditions associated with TRIM22. FIG. 1 further provides a conceptual description of a novel bioinformatically detected viral gene of the present invention, referred to here as Viral Genomic Address Messenger 172 (VGAM172) viral gene, which modulates expression of respective host target genes thereof, the function and utility of which host target genes is known in the art.

VGAM172 is a novel bioinformatically detected regulatory, non protein coding, viral micro RNA (miRNA) gene. The method by which VGAM172 was detected is described hereinabove with reference to FIGS. 1-8.

VGAM172 gene, herein designated VGAM GENE, is a viral gene contained in the genome of Shrimp White Spot Syndrome Virus (white spot bacilliform virus). VGAM172 host target gene, herein designated VGAM HOST TARGET GENE, is a human gene contained in the human genome.

VGAM172 gene encodes a VGAM172 precursor RNA, herein designated VGAM PRECURSOR RNA. Similar to other miRNA genes, and unlike most ordinary genes, VGAM172 precursor RNA does not encode a protein. A nucleotide sequence identical or highly similar to the nucleotide sequence of VGAM172 precursor RNA is designated SEQ ID:158, and is provided hereinbelow with reference to the sequence listing part. Nucleotide sequence SEQ ID:158 is located at position 101644 relative to the genome of Shrimp White Spot Syndrome Virus (white spot bacilliform virus).

VGAM172 precursor RNA folds onto itself, forming VGAM172 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM172 folded precursor RNA into VGAM172 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM172 RNA is designated SEQ ID:2883, and is provided hereinbelow with reference to the sequence listing part.

VGAM172 host target gene, herein designated VGAM HOST TARGET GENE, encodes a corresponding messenger RNA, VGAM172 host target RNA, herein designated VGAM HOST TARGET RNA. VGAM172 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM172 RNA, herein designated VGAM RNA, binds complementarily to one or more host target binding sites located in untranslated regions of VGAM172 host target RNA, herein designated VGAM HOST TARGET RNA. This complementary binding is due to the fact that the nucleotide sequence of VGAM172 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM172 RNA, herein designated VGAM RNA, may have a different number of host target binding sites in untranslated regions of a VGAM172 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM172 RNA, herein designated VGAM RNA, to host target binding sites on VGAM172 host target RNA, herein designated VGAM HOST TARGET RNA, such as BINDING SITE I, BINDING SITE II and BINDING SITE III, inhibits translation of VGAM172 host target RNA into VGAM172 host target protein, herein designated VGAM HOST TARGET PROTEIN. VGAM host target protein is therefore outlined by a broken line.

It is appreciated that VGAM172 host target gene, herein designated VGAM HOST TARGET GENE, in fact represents a plurality of VGAM172 host target genes. The mRNA of each one of this plurality of VGAM172 host target genes comprises one or more host target binding sites, each having a nucleotide sequence which is at least partly complementary to VGAM172 RNA, herein designated VGAM RNA, and which when bound by VGAM172 RNA causes inhibition of translation of respective one or more VGAM172 host target proteins.

It is further appreciated by one skilled in the art that the mode of translational inhibition illustrated by FIG. 1 with specific reference to translational inhibition exerted by VGAM172 gene, herein designated VGAM GENE, on one or more VGAM172 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM172 is inhibition of expression of host target genes, as part of a novel viral mechanism of attacking a host. Accordingly, utilities of VGAM172 include diagnosis, prevention and treatment of viral infection by Shrimp White Spot Syndrome Virus (white spot bacilliform virus). Specific functions, and accordingly utilities, of VGAM172 correlate with, and may be deduced from, the identity of the host target genes which VGAM172 binds and inhibits, and the function of these host target genes, as elaborated hereinbelow.

Nucleotide sequences of the VGAM172 precursor RNA, herein designated VGAM PRECURSOR RNA, and of the 'diced' VGAM172 RNA, herein designated VGAM RNA, and a schematic representation of the secondary folding of VGAM172 folded precursor RNA, herein designated VGAM FOLDED PRECURSOR RNA, of VGAM172 are further described hereinbelow with reference to Table 1.

Nucleotide sequences of host target binding sites, such as BINDING SITE-I, BINDING SITE-II and BINDING SITE-III of FIG. 1, found on VGAM172 host target RNA, and schematic representation of the complementarity of each of these host target binding sites to VGAM172 RNA, herein designated VGAM RNA, are described hereinbelow with reference to Table 2.

As mentioned hereinabove with reference to FIG. 1, a function of VGAM172 gene, herein designated VGAM is inhibition of expression of VGAM172 target genes. It is appreciated that specific functions, and accordingly utilities, of VGAM172 correlate with, and may be deduced from, the identity of the target genes which VGAM172 binds and inhibits, and the function of these target genes, as elaborated hereinbelow.

Alpha-1-B Glycoprotein (A1BG, Accession NM_130786) is a VGAM172 host target gene. A1BG BINDING SITE is HOST TARGET binding site found in the 3' untranslated region of mRNA encoded by A1BG, corresponding to a HOST TARGET binding site such as BINDING SITE I, BINDING SITE II or BINDING SITE III. Table 2 illustrates the complementarity of the nucleotide sequences of A1BG BINDING SITE, designated SEQ ID:28277, to the nucleotide sequence of VGAM172 RNA, herein designated VGAM RNA, also designated SEQ ID:2883.

A function of VGAM172 is therefore inhibition of Alpha-1-B Glycoprotein (A1BG, Accession NM_130786), a gene which a plasma protein of unknown function. Accordingly, utilities of VGAM172 include diagnosis, prevention and treatment of diseases and clinical conditions associated with A1BG. The function of A1BG has been established by previous studies. The complete amino acid sequence of alpha-1B-glycoprotein, a plasma protein of unknown function, was determined by Ishioka et al. (1986). Sequence homology to immunoglobulins was recognized. Alpha-1B-glycoprotein is present in normal adult plasma at an average concentration of 22 mg/dl. Gahne et al. (1987) observed genetic polymorphism of A1B using one-dimensional horizontal polyacrylamide gel electrophoresis followed by Western blotting with specific antiserum. Three different phenotypes, designated 1-1, 1-2, and 2-2, were observed. Family data supported the hypothesis that the three phenotypes are determined by 2 codominant alleles at an autosomal locus. In pigs the homologous locus is linked to malignant hyperthermia (OMIM Ref. No. 145600). Several other linkages in pigs and in horses suggest that human chromosomes 19, 6, and 1 are 'candidate chromosomes' for bearing the human A1B. Juneja et al. (1988) found a higher degree of A1B polymorphism in American blacks than in Caucasian populations. They described new alleles. Eiberg et al. (1989) reported exclusion data for localization of the alpha-1B-glycoprotein gene polymorphism. Eiberg et al. (1989) found linkage between A1BG and Lutheran blood group (OMIM Ref. No. 111150); lod=3.06 at theta=0.05 in males, and lod=1.42 at theta=0.10 in females. They suggested that the most likely order of genes on chromosome 19 is C3--SE--LU--A1BG.

Full details of the abovementioned studies are described in the following publications, the disclosure of which are hereby incorporated by reference:

Ishioka, N.; Takahashi, N.; Putnam, F. W.: Amino acid sequence of human plasma alpha-1B-glycoprotein: homology to the immunoglobulin supergene family. Proc. Nat. Acad. Sci. 83:2363-2367, 1986; and Eiberg, H.; Bisgaard, M. L.; Mohr, J.: Linkage between alpha-1-B-glycoprotein (A1BG) and Lutheran (LU) red blood group system: assignment to chromosome 19: new genetic variants of A1BG.

Further studies establishing the function and utilities of A1BG are found in John Hopkins OMIM database record ID 138670, and in sited publications numbered 12027-12031 listed in the bibliography section hereinbelow, which are also hereby incorporated by reference. Aconitase 1, Soluble (ACO1, Accession NM_002197) is another VGAM172 host target gene. ACO1 BINDING SITE is HOST TARGET binding site found in the 3' untranslated region of mRNA encoded by ACO1, corresponding to a HOST TARGET binding site such as BINDING SITE I, BINDING SITE II or BINDING SITE III. Table 2 illustrates the complementarity of the nucleotide sequences of ACO1 BINDING SITE, designated SEQ ID:7955, to the nucleotide sequence of VGAM172 RNA, herein designated VGAM RNA, also designated SEQ ID:2883.

Another function of VGAM172 is therefore inhibition of Aconitase 1, Soluble (ACO1, Accession NM_002197), a gene which an iron-dependent enzyme; catalyzes conversion of citrate to cis-aconitate in the TCA cycle. Accordingly, utilities of VGAM172 include diagnosis, prevention and treatment of diseases and clinical conditions associated with ACO1. The function of ACO1 and its association with various diseases and clinical conditions, has been established by previous studies, as described hereinabove with reference to VGAM53. A Kinase (PRKA) Anchor Protein 2 (AKAP2, Accession NM_007203) is another VGAM172 host target gene. AKAP2 BINDING SITE is HOST TARGET binding site found in the 3' untranslated region of mRNA encoded by AKAP2, corresponding to a HOST TARGET binding site such as BINDING SITE I, BINDING SITE II or BINDING SITE III. Table 2 illustrates the complementarity of the nucleotide sequences of AKAP2 BINDING SITE, designated SEQ ID:14065, to the nucleotide sequence of VGAM172 RNA, herein designated VGAM RNA, also designated SEQ ID:2883.

Another function of VGAM172 is therefore inhibition of A Kinase (PRKA) Anchor Protein 2 (AKAP2, Accession NM_007203), a gene which binds to regulatory subunit (rii) of protein kinase a. Accordingly, utilities of VGAM172 include diagnosis, prevention and treatment of diseases and clinical conditions associated with AKAP2. The function of AKAP2 and its association with various diseases and clinical conditions, has been established by previous studies, as described hereinabove with reference to VGAM18. Cockayne Syndrome 1 (classical) (CKN1, Accession NM_000082) is another VGAM172 host target gene. CKN1 BINDING SITE is HOST TARGET binding site found in the 3' untranslated region of mRNA encoded by CKN1, corresponding to a HOST TARGET binding site such as BINDING SITE I, BINDING SITE II or BINDING SITE III. Table 2 illustrates the complementarity of the nucleotide sequences of CKN1 BINDING SITE, designated SEQ ID:5534, to the nucleotide sequence of VGAM172 RNA, herein designated VGAM RNA, also designated SEQ ID:2883.

Another function of VGAM172 is therefore inhibition of Cockayne Syndrome 1 (classical) (CKN1, Accession NM_000082). Accordingly, utilities of VGAM172 include diagnosis, prevention and treatment of diseases and clinical conditions associated with CKN1. Fatty-acid-Coenzyme A Ligase, Long-chain 2 (FACL2, Accession NM_021122) is another VGAM172 host target gene. FACL2 BINDING SITE is HOST TARGET binding site found in the 3' untranslated region of mRNA encoded by FACL2, corresponding to a HOST TARGET binding site such as BINDING SITE I, BINDING SITE II or BINDING SITE III. Table 2 illustrates the complementarity of the nucleotide sequences of FACL2 BINDING SITE, designated SEQ ID:22097, to the nucleotide sequence of VGAM172 RNA, herein designated VGAM RNA, also designated SEQ ID:2883.

Another function of VGAM172 is therefore inhibition of Fatty-acid-Coenzyme A Ligase, Long-chain 2 (FACL2, Accession NM_021122), a gene which activates long-chain fatty acids for both synthesis of cellular lipids. Accordingly, utilities of VGAM172 include diagnosis, prevention and treatment of diseases and clinical conditions associated with FACL2. The function of FACL2 has been established by previous studies. See 152425. Minoshima et al. (1991) isolated a human cDNA for a long-chain acyl-CoA synthetase from a human liver cDNA library using the rat cDNA as a probe. Using flow-sorted human chromosomes, they demonstrated that the gene, now designated FACL2, is located on human chromosome 4. Cantu et al. (1995) mapped FACL2 to 4q34-q35 by fluorescence in situ hybridization.

Full details of the abovementioned studies are described in the following publications, the disclosure of which are hereby incorporated by reference:

Cantu, E. S.; Sprinkle, T. J.; Ghosh, B.; Singh, I.: The human palmitoyl-CoA ligase (FACL2) gene maps to the chromosome 4q34-q35 region by fluorescence in situ hybridization (FISH) and somatic cell hybrid panels. Genomics 28:600-602, 1995; and Minoshima, S.; Fukuyama, R.; Yamamoto, T.; Shimizu, N.: Mapping of human long-chain acyl-CoA synthetase to chromosome 4. (Abstract) Cytogenet. Cell Genet. 58:1888 only, 1991.

Further studies establishing the function and utilities of FACL2 are found in John Hopkins OMIM database record ID 152426, and in sited publications numbered 3434 listed in the bibliography section hereinbelow, which are also hereby incorporated by reference. Four and A Half LIM Domains 2 (FHL2, Accession NM_001450) is another VGAM172 host target gene. FHL2 BINDING SITE is HOST TARGET binding site found in the 5' untranslated region of mRNA encoded by FHL2, corresponding to a HOST TARGET binding site such as BINDING SITE I, BINDING SITE II or BINDING SITE III. Table 2 illustrates the complementarity of the nucleotide sequences of FHL2 BINDING SITE, designated SEQ ID:7182, to the nucleotide sequence of VGAM172 RNA, herein designated VGAM RNA, also designated SEQ ID:2883.

Another function of VGAM172 is therefore inhibition of Four and A Half LIM Domains 2 (FHL2, Accession NM_001450), a gene which Contains four LIM domains and an additional zinc finger. Accordingly, utilities of VGAM172 include diagnosis, prevention and treatment of diseases and clinical conditions associated with FHL2. The function of FHL2 has been established by previous studies. LIM proteins contain a highly conserved double zinc finger motif called the LIM domain. By searching sequence databases with a partial human SLIM1 (FHL1; 300163) cDNA, Morgan and Madgwick (1996) identified partial SLIM3 cDNAs. Genini et al. (1997) used subtractive cloning to isolate a gene that is downregulated during transformation of normal myoblasts to rhabdomyosarcoma cells. The gene, termed DRAL for 'down-regulated in rhabdomyosarcoma LIM protein,' encodes a 279-amino acid polypeptide with an observed mass of 32 kD. The protein sequence contains 4 complete LIM domains and the second half of a fifth LIM domain. DRAL appears to be a member of the LIM-only class of proteins, which consist primarily of LIM domains and little else. Southern blotting revealed a single-copy gene that is conserved among vertebrates. Northern blotting revealed that the DRAL gene is expressed at highest levels in heart and ovary, and at lower levels in skeletal muscle, prostate, testis, small intestine, and colon. Results of Northern blotting of tumor cell lines suggested to Genini et al. (1997) that this gene may be downregulated during transformation of a variety of cell types. Genini et al. (1997) used in situ hybridization to map the human FHL2 gene to 2q12-q14. By fluorescence in situ hybridization, Chan et al. (1998) mapped the FHL2 gene to 2q12-q13. Using the yeast 2-hybrid system, Tanahashi and Tabira (2000) screened for proteins interacting with an Alzheimer disease gene, presenilin-2 (OMIM Ref. No. 600759), and cloned DRAL. DRAL interacted with a hydrophilic loop region (amino acids 269-298) in the endoproteolytic N-terminal fragment of PS2, but not that of PS1 (OMIM Ref. No. 104311), although residues 269 to 298 of PS2 and the corresponding PS1 sequence differ by only 3 amino acids. Each of 9 PS2 point mutations within a region from residues 275 to 296 abolished the binding. The in vitro interaction was confirmed by affinity column assay and the physiologic interactions between endogenous PS2 and DRAL by coimmunoprecipitation from human lung fibroblast MRC5 cells. The authors suggested that DRAL functions as a link between PS2 and an intracellular signaling pathway.

Full details of the abovementioned studies are described in the following publications, the disclosure of which are hereby incorporated by reference:

Genini, M.; Schwalbe, P.; Scholl, F. A.; Remppis, A.; Mattei, M.-G.; Schafer, B. W.: Subtractive cloning and characterization of DRAL, a novel LIM-domain protein down-regulated in rhabdomyosarcoma. DNA Cell Biol. 16:433-442, 1997; and Tanahashi, H.; Tabira, T.: Alzheimer's disease-associated presenilin 2 interacts with DRAL, an LIM-domain protein. Hum. Molec. Genet. 9:2281-2289, 2000.

Further studies establishing the function and utilities of FHL2 are found in John Hopkins OMIM database record ID 602633, and in sited publications numbered 8751-875 and 11005 listed in the bibliography section hereinbelow, which are also hereby incorporated by reference. Hermansky-Pudlak Syndrome 1 (HPS1, Accession NM_000195) is another VGAM172 host target gene. HPS1 BINDING SITE is HOST TARGET binding site found in the 3' untranslated region of mRNA encoded by HPS1, corresponding to a HOST TARGET binding site such as BINDING SITE I, BINDING SITE II or BINDING SITE III. Table 2 illustrates the complementarity of the nucleotide sequences of HPS1 BINDING SITE, designated SEQ ID:5696, to the nucleotide sequence of VGAM172 RNA, herein designated VGAM RNA, also designated SEQ ID:2883.

Another function of VGAM172 is therefore inhibition of Hermansky-Pudlak Syndrome 1 (HPS1, Accession NM_000195). Accordingly, utilities of VGAM172 include diagnosis, prevention and treatment of diseases and clinical conditions associated with HPS1. Mannosidase, Alpha, Class 1A, Member 1 (MAN1A1, Accession XM_166312) is another VGAM172 host target gene. MAN1A1 BINDING SITE is HOST TARGET binding site found in the 3' untranslated region of mRNA encoded by MAN1A1, corresponding to a HOST TARGET binding site such as BINDING SITE I, BINDING SITE II or BINDING SITE III. Table 2 illustrates the complementarity of the nucleotide sequences of MAN1A1 BINDING SITE, designated SEQ ID:44135, to the nucleotide sequence of VGAM172 RNA, herein designated VGAM RNA, also designated SEQ ID:2883.

Another function of VGAM172 is therefore inhibition of Mannosidase, Alpha, Class 1A, Member 1 (MAN1A1, Accession XM_166312), a gene which removes 3 distinct mannose residues from peptide-bound Man (9)-GlcNAc (2) oligosaccharides. Accordingly, utilities of VGAM172 include diagnosis, prevention and treatment of diseases and clinical conditions associated with MAN1A1. The function of MAN1A1 has been established by previous studies. Man (9)-mannosidase (alpha-1,2-mannosidase 1A) catalyzes the removal of 3 distinct mannose residues from peptide-bound Man (9)-GlcNAc (2) oligosaccharides. See MAN2A1 (OMIM Ref. No. 154582) for general information. Using an oligonucleotide probe derived from a pig liver Man (9)-mannosidase-specific cDNA template, Bause et al. (1993) isolated Man (9)-mannosidase from a human kidney cDNA library. The full-length cDNA predicted a 625-amino acid protein with a calculated molecular mass of 71 kD. Man (9)-mannosidase is a type II transmembrane protein with a short cytoplasmic polypeptide tail, a single transmembrane domain acting as a noncleavable signal sequence, a large luminal catalytic domain, and 3 potential N-glycosylation sites Full details of the abovementioned studies are described in the following publications, the disclosure of which are hereby incorporated by reference:

Bause, E.; Bieberich, E.; Rolfs, A.; Volker, C.; Schmidt, B.: Molecular cloning and primary structure of Man (9)-mannosidase from human kidney. Eur. J. Biochem. 217:535-540, 1993; and Tremblay, L. O; Campbell Dyke, N.; Herscovics, A.: Molecular cloning, chromosomal mapping and tissue-specific expression of a novel human alpha-1,2-mannosidase gene involved in N-glycan.

Further studies establishing the function and utilities of MAN1A1 are found in John Hopkins OMIM database record ID 604344, and in sited publications numbered 4991-4992 listed in the bibliography section hereinbelow, which are also hereby incorporated by reference. Presenilin 1 (Alzheimer disease 3) (PSEN1, Accession NM_007318) is another VGAM172 host target gene. PSEN1 BINDING SITE is HOST TARGET binding site found in the 5' untranslated region of mRNA encoded by PSEN1, corresponding to a HOST TARGET binding site such as BINDING SITE I, BINDING SITE II or BINDING SITE III. Table 2 illustrates the complementarity of the nucleotide sequences of PSEN1 BINDING SITE, designated SEQ ID:14236, to the nucleotide sequence of VGAM172 RNA, herein designated VGAM RNA, also designated SEQ ID:2883.

Another function of VGAM172 is therefore inhibition of Presenilin 1 (Alzheimer disease 3) (PSEN1, Accession NM_007318). Accordingly, utilities of VGAM172 include diagnosis, prevention and treatment of diseases and clinical conditions associated with PSEN1. Solute Carrier Family 25 (mitochondrial carrier; ornithine transporter) Member 15 (SLC25A15, Accession NM_014252) is another VGAM172 host target gene. SLC25A15 BINDING SITE is HOST TARGET binding site found in the 3' untranslated region of mRNA encoded by SLC25A15, corresponding to a HOST TARGET binding site such as BINDING SITE I, BINDING SITE II or BINDING SITE III. Table 2 illustrates the complementarity of the nucleotide sequences of SLC25A15 BINDING SITE, designated SEQ ID:15527, to the nucleotide sequence of VGAM172 RNA, herein designated VGAM RNA, also designated SEQ ID:2883.

Another function of VGAM172 is therefore inhibition of Solute Carrier Family 25 (mitochondrial carrier; ornithine transporter) Member 15 (SLC25A15, Accession NM_014252), a gene which participates theornithine transport across inner mitochondrial membrane, from the cytoplasm to the matrix. Accordingly, utilities of VGAM172 include diagnosis, prevention and treatment of diseases and clinical conditions associated with SLC25A15. The function of SLC25A15 has been established by previous studies. The urea cycle is an example of metabolic homeostasis, maintaining concentrations of a toxic metabolite, ammonium ions, in a narrow, tolerable range despite more than 10-fold variations in dietary intake of its precursor, nitrogen. Five enzymes in 2 subcellular compartments (mitochondrial matrix and cytosol) accomplish this feat. Another vital component of the urea cycle is the transporter required to move ornithine across the inner mitochondrial membrane from cytosol to mitochondrial matrix. This is the transporter that is defective in hyperornithinemia-hyperammonemia-homocitrullinuria (HHH syndrome; 238970 Neurospora crassa ARG13 and Saccharomyces cerevisiae ARG11 encode mitochondrial carrier family proteins that transport ornithine across the mitochondrial inner membrane. Camacho et al. (1999) used their sequences to identify EST candidates derived from genes that encode orthologous mammalian transporters. They thereby identified a gene, ORNT1, that maps to 13q14 and whose expression, similar to that of other urea cycle components, was high in liver and varied with changes in dietary protein. ORNT1 expression restored ornithine metabolism in fibroblasts from patients with HHH syndrome. They found that the ORNT1 gene encodes a 301-residue protein with 95% identity to mouse Ornt1 and 28% identity to Neurospora ARG13. Expression of either murine or human ORNT1 restored normal ornithine metabolism in HHH fibroblasts. The protein localized to mitochondria. In a survey of 11 HHH probands, Camacho et al. (1999) identified 3 ORNT1 mutant alleles that accounted for 21 of 22 possible mutant ORNT1 genes in these patients Full details of the abovementioned studies are described in the following publications, the disclosure of which are hereby incorporated by reference:

Camacho, J. A.; Obie, C.; Biery, B.; Goodman, B. K.; Hu, C.-A.; Almashanu, S.; Steel, G.; Casey, R.; Lambert, M.; Mitchell, G. A.; Valle, D.: Hyperornithinaemia-hyperammonaemia-homocitrullinuria syndrome is caused by mutations in a gene encoding a mitochondrial ornithine transporter. Nature Genet. 22:151-158, 1999; and Tsujino, S.; Kanazawa, N.; Ohashi, T.; Eto, Y.; Saito, T.; Kira, J.; Yamada, T.: Three novel mutations (G27E, insAAC, R179X) in the ORNT1 gene of Japanese patients with hyperornithinemia.

Further studies establishing the function and utilities of SLC25A15 are found in John Hopkins OMIM database record ID 603861, and in sited publications numbered 9450-7424 listed in the bibliography section hereinbelow, which are also hereby incorporated by reference. Syntrophin, Beta 2 (dystrophin-associated protein A1, 59 kDa, basic component 2) (SNTB2, Accession NM_130845) is another VGAM172 host target gene. SNTB2 BINDING SITE is HOST TARGET binding site found in the 3' untranslated region of mRNA encoded by SNTB2, corresponding to a HOST TARGET binding site such as BINDING SITE I, BINDING SITE II or BINDING SITE III. Table 2 illustrates the complementarity of the nucleotide sequences of SNTB2 BINDING SITE, designated SEQ ID:28380, to the nucleotide sequence of VGAM172 RNA, herein designated VGAM RNA, also designated SEQ ID:2883.

Another function of VGAM172 is therefore inhibition of Syntrophin, Beta 2 (dystrophin-associated protein A1, 59 kDa, basic component 2) (SNTB2, Accession NM_130845). Accordingly, utilities of VGAM172 include diagnosis, prevention and treatment of diseases and clinical conditions associated with SNTB2. T-cell Acute Lymphocytic Leukemia 1 (TAL1, Accession NM_003189) is another VGAM172 host target gene. TAL1 BINDING SITE is HOST TARGET binding site found in the 3' untranslated region of mRNA encoded by TAL1, corresponding to a HOST TARGET binding site such as BINDING SITE I, BINDING SITE II or BINDING SITE III. Table 2 illustrates the complementarity of the nucleotide sequences of TAL1 BINDING SITE, designated SEQ ID:9176, to the nucleotide sequence of VGAM172 RNA, herein designated VGAM RNA, also designated SEQ ID:2883.

Another function of VGAM172 is therefore inhibition of T-cell Acute Lymphocytic Leukemia 1 (TAL1, Accession NM_003189), a gene which may help control cell growth and differentiation. Accordingly, utilities of VGAM172 include diagnosis, prevention and treatment of diseases and clinical conditions associated with TAL1. The function of TAL1 has been established by previous studies. Finger et al. (1989) analyzed a t(1;14)(p32; q11) chromosomal translocation in a lymphohemopoietic stem cell line derived from a patient with acute T-lymphoblastic leukemia (Kurtzberg et al., 1985). The chromosomal joining of 14 to 1p occurred at the T-cell receptor delta diversity (D-delta-2) segment, and the reciprocal joining on chromosome 14 occurred at the T-cell delta diversity segment D-delta-1. Involvement of delta diversity segments at the translocation junctions suggested that the translocation occurred during an attempt at delta-1/delta-2 joining in a stem cell. Finger et al. (1989) found that the segment of chromosome 1 at band p32, adjacent to the chromosomal breakpoint, encodes a transcriptional unit designated TCL5. Finger et al. (1989) also demonstrated a rearrangement of the TCL5 locus in a human melanoma cell line carrying a deletion at 1p32. The occurrence of 'biphenotypic' leukemias with lymphoid and myeloid characteristics and evidence of stem cell origin of myeloid, erythroid, megakaryocytic, and lymphoid lineages in chronic myeloid leukemia suggested that leukemias may arise from pluripotent hematopoietic cells. Begley et al. (1989) studied a leukemic stem cell line that was capable of differentiating into either myeloid or lymphoid cells and that carried a translocation between chromosomes 1 and 14, t(1;14)(p33; q11). By means of molecular cloning and sequencing, they showed that as a consequence of the translocation an unusual fusion transcript was generated. The chromosome 1 region involved in the breakpoint was the site of transcriptional activity apparently occurring only in hematopoietic tissues. Begley et al. (1989) concluded that the translocation may identify a gene located on chromosome 1 which is important for hematopoietic development and oncogenesis. They suggested the designation SCL (stem cell leukemia hematopoietic transcription factor).

Full details of the abovementioned studies are described in the following publications, the disclosure of which are hereby incorporated by reference:

Begley, C. G.; Aplan, P. D.; Davey, M. P.; Nakahara, K.; Tchorz, K.; Kurtzberg, J.; Hershfield, M. S.; Haynes, B. F.; Cohen, D. I.; Waldmann, T. A.; Kirsch, I. R.: Chromosomal translocation in a human leukemic stem-cell line disrupts the T-cell antigen receptor delta-chain diversity region and results in a previously unreported fusion transcript. Proc. Nat. Acad. Sci. 86:2031-2035, 1989; and Finger, L. R.; Kagan, J.; Christopher, G.; Kurtzberg, J.; Hershfield, M. S.; Nowell, P. C.; Croce, C. M.: Involvement of the TCL5 gene on human chromosome 1 in T-cell leukemia and mel.

Further studies establishing the function and utilities of TAL1 are found in John Hopkins OMIM database record ID 187040, and in sited publications numbered 12610, 1261 and 2510-2521 listed in the bibliography section hereinbelow, which are also hereby incorporated by reference. Transcription Factor-like 4 (TCFL4, Accession XM_032817) is another VGAM172 host target gene. TCFL4 BINDING SITE is HOST TARGET binding site found in the 3' untranslated region of mRNA encoded by TCFL4, corresponding to a HOST TARGET binding site such as BINDING SITE I, BINDING SITE II or BINDING SITE III. Table 2 illustrates the complementarity of the nucleotide sequences of TCFL4 BINDING SITE, designated SEQ ID:31772, to the nucleotide sequence of VGAM172 RNA, herein designated VGAM RNA, also designated SEQ ID:2883.

Another function of VGAM172 is therefore inhibition of Transcription Factor-like 4 (TCFL4, Accession XM_032817), a gene which interacts with Mad and represses transcription by recruiting the Sin3A-histone deacetylase corepressor complex. Accordingly, utilities of VGAM172 include diagnosis, prevention and treatment of diseases and clinical conditions associated with TCFL4. The function of TCFL4 has been established by previous studies. Members of the basic helix-loop-helix leucine zipper (bHLH-Zip) family are transcription factors with roles in proliferation, determination, and differentiation (e.g., MAX; 154950). By searching sequence databases with a mouse Tcfl4 cDNA, Bjerknes and Cheng (1996) identified several TCFL4 expressed sequence tags derived from a variety of human tissues, and a 46-kb cosmid clone (GenBank U34879) containing the human TCFL4 gene. This cosmid, which maps to 17q21.1, also contains the HSD17B1 gene (OMIM Ref. No. 109684). The TCFL4 gene has 8 exons and spans more than 5 kb. The predicted TCFL4 protein contains a basic helix-loop-helix domain and a leucine zipper domain. RT-PCR detected mouse Tcfl4 expression in all tissues examined. In a 2-hybrid screen to identify Mad1 (OMIM Ref. No. 602686)-interacting proteins, Billin et al. (1999) identified TCFL4 as MLX, a bHLH-Zip protein that is structurally and functionally related to MAX. The predicted amino acid sequence of MLX is conserved at all positions that define the bHLH-Zip class of transcription factors and is most similar to that of MAX, sharing approximately 50% identity in the bHLH-Zip domains. The 244-amino acid human and mouse MLX proteins differ at only 4 amino acid positions. Billin et al. (1999) showed that transcriptional repression by Mad1:Mlx heterodimers is dependent on dimerization, DNA binding, and recruitment of the Sin3A-histone deacetylase (see OMIM Ref. No. 601241) corepressor complex. Their findings suggested that MLX may act to diversify Mad family function by its restricted association with a subset of the Mad family of transcriptional repressors.

Full details of the abovementioned studies are described in the following publications, the disclosure of which are hereby incorporated by reference:

Billin, A. N.; Eilers, A. L.; Queva, C.; Ayer, D. E.: Mlx, a novel Max-like BHLHZip protein that interacts with the Max network of transcription factors. J. Biol. Chem. 274:36344-36350, 1999; and Bjerknes, M.; Cheng, H.: TCFL4: a gene at 17q21.1 encoding a putative basic helix-loop-helix leucine-zipper transcription factor. Gene 181:7-11, 1996.

Further studies establishing the function and utilities of TCFL4 are found in John Hopkins OMIM database record ID 602976, and in sited publications numbered 8541-8543 listed in the bibliography section hereinbelow, which are also hereby incorporated by reference. Trichorhinophalangeal Syndrome I (TRPS1, Accession NM_014112) is another VGAM172 host target gene. TRPS1 BINDING SITE is HOST TARGET binding site found in the 3' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15356, to the nucleotide sequence of VGAM172 RNA, herein designated VGAM RNA, also designated SEQ ID:2883.

Another function of VGAM172 is therefore inhibition of Trichorhinophalangeal Syndrome I (TRPS1, Accession NM_014112), a gene which may function as a transcriptional activator protein. Accordingly, utilities of VGAM172 include diagnosis, prevention and treatment of diseases and clinical conditions associated with TRPS1. The function of TRPS1 has been established by previous studies. Trichorhinophalangeal syndrome type I (OMIM Ref. No. 190350) is a malformation syndrome characterized by distinctive craniofacial and skeletal abnormalities and is inherited as an autosomal dominant. TRPS I patients have sparse scalp hair, bulbous tip of the nose, long flat philtrum, thin upper vermilion border, and protruding ears. Skeletal abnormalities include cone-shaped epiphyses at the phalanges, hip malformations, and short stature. Ludecke et al. (1995) and Hou et al. (1995) assigned the TRPS1 gene to 8q24. It maps centromeric to the gene that is mutant in multiple exostoses type I (EXT1; 133700); EXT1 is deleted in all patients with TRPS type II, or Langer-Giedion syndrome (OMIM Ref. No. 150230), which combines features of TRPS I and multiple exostoses. Momeni et al. (2000) positionally cloned a gene that spanned the chromosomal breakpoint in 2 patients with TRPS I and was deleted in 5 patients with TRPS I associated with an interstitial deletion. Northern blot analyses revealed transcripts of 7 and 10.5 kb. The gene, designated TRPS1, has 7 exons and encodes a polypeptide of 1,281 amino acids. The predicted protein sequence has 2 potential nuclear localization signals and an unusual combination of different zinc finger motifs, including IKAROS-like (see OMIM Ref. No. 603023) and GATA-binding (see OMIM Ref. No. 600576) sequences. Momeni et al. (2000) identified 6 different nonsense mutations in 10 unrelated patients. The findings suggested that haploinsufficiency for this putative transcription factor causes TRPS I. To investigate whether trichorhinophalangeal syndrome type III (OMIM Ref. No. 190351) is caused by TRPS1 mutations and to establish a genotype-phenotype correlation in TRPS, Ludecke et al. (2001) performed extensive mutation analysis and evaluated height and degree of brachydactyly in patients with TRPS I or TRPS III. They found 35 different mutations in 44 of 51 unrelated patients. The detection rate (86%) indicated that TRPS1 is the major locus for TRPS I and TRPS III. They found no mutation in the parents of sporadic patients or in apparently healthy relatives of familial patients, indicating complete penetrance of TRPS1 mutations. Evaluation of skeletal abnormalities of patients with TRPS1 mutations revealed a wide clinical spectrum. The phenotype was variable in unrelated, age- and sex-matched patients with identical mutations, as well as in families. Four of the 5 missense mutations altered the GATA DNA-binding zinc finger, and 6 of the 7 unrelated patients with these mutations could be classified as having TRPS III, because they had severe bradycardia, due to short metacarpals, and severe short stature. The data indicated that TRPS III is at the severe end of the TRPS spectrum and that it is most often caused by a specific class of mutations in exon 6 the TRPS1 gene. In the study of Ludecke et al. (2001), 5 mutations were recurrent, and 4 of these were identified in patients of different ethnicities:1 in patients of Norwegian, Turkish, and Belgian extraction, and another in patients of Belgian, Turkish, and Japanese extraction, for example.

Full details of the abovementioned studies are described in the following publications, the disclosure of which are hereby incorporated by reference:

Momeni, P.; Glockner, G.; Schmidt, O.; von Holtum, D.; Albrecht, B.; Gillessen-Kaesbach, G.; Hennekam, R.; Meinecke, P.; Zabel, B.; Rosenthal, A.; Horsthemke, B.; Ludecke, H.-J.: Mutations in a new gene, encoding a zinc-finger protein, cause tricho-rhino-phalangeal syndrome type I. Nature Genet. 24:71-74, 2000; and Ludecke, H.-J.; Schaper, J.; Meinecke, P.; Momeni, P.; Gross, S.; von Holtum, D.; Hirche, H.; Abramowicz, M. J.; Albrecht, B.; Apacik, C.; Christen, H.-J.; Claussen, U.; and 28 others. G.

Further studies establishing the function and utilities of TRPS1 are found in John Hopkins OMIM database record ID 604386, and in sited publications numbered 7077-7078, 3619, 7945, 1268 and 12627 listed in the bibliography section hereinbelow, which are also hereby incorporated by reference. Zinc Finger Protein 202 (ZNF202, Accession NM_003455) is another VGAM172 host target gene. ZNF202 BINDING SITE is HOST TARGET binding site found in the 3' untranslated region of mRNA encoded by ZNF202, corresponding to a HOST TARGET binding site such as BINDING SITE I, BINDING SITE II or BINDING SITE III. Table 2 illustrates the complementarity of the nucleotide sequences of ZNF202 BINDING SITE, designated SEQ ID:9512, to the nucleotide sequence of VGAM172 RNA, herein designated VGAM RNA, also designated SEQ ID:2883.

Another function of VGAM172 is therefore inhibition of Zinc Finger Protein 202 (ZNF202, Accession NM_003455). Accordingly, utilities of VGAM172 include diagnosis, prevention and treatment of diseases and clinical conditions associated with ZNF202. ARAP3 (Accession NM_022481) is another VGAM172 host target gene. ARAP3 BINDING SITE is HOST TARGET binding site found in the 5' untranslated region of mRNA encoded by ARAP3, corresponding to a HOST TARGET binding site such as BINDING SITE I, BINDING SITE II or BINDING SITE III. Table 2 illustrates the complementarity of the nucleotide sequences of ARAP3 BINDING SITE, designated SEQ ID:22856, to the nucleotide sequence of VGAM172 RNA, herein designated VGAM RNA, also designated SEQ ID:2883.

Another function of VGAM172 is therefore inhibition of ARAP3 (Accession NM_022481). Accordingly, utilities of VGAM172 include diagnosis, prevention and treatment of diseases and clinical conditions associated with ARAP3. Bromodomain Containing 4 (BRD4, Accession NM_014299) is another VGAM172 host target gene. BRD4 BINDING SITE is HOST TARGET binding site found in the 3' untranslated region of mRNA encoded by BRD4, corresponding to a HOST TARGET binding site such as BINDING SITE I, BINDING SITE II or BINDING SITE III. Table 2 illustrates the complementarity of the nucleotide sequences of BRD4 BINDING SITE, designated SEQ ID:15596, to the nucleotide sequence of VGAM172 RNA, herein designated VGAM RNA, also designated SEQ ID:2883.

Another function of VGAM172 is therefore inhibition of Bromodomain Containing 4 (BRD4, Accession NM_014299). Accordingly, utilities of VGAM172 include diagnosis, prevention and treatment of diseases and clinical conditions associated with BRD4. Chromosome 8 Open Reading Frame 2 (C8orf2, Accession NM_007175) is another VGAM172 host target gene. C8orf2 BINDING SITE is HOST TARGET binding site found in the 3' untranslated region of mRNA encoded by C8orf2, corresponding to a HOST TARGET binding site such as BINDING SITE I, BINDING SITE II or BINDING SITE III. Table 2 illustrates the complementarity of the nucleotide sequences of C8orf2 BINDING SITE, designated SEQ ID:14026, to the nucleotide sequence of VGAM172 RNA, herein designated VGAM RNA, also designated SEQ ID:2883.

Another function of VGAM172 is therefore inhibition of Chromosome 8 Open Reading Frame 2 (C8orf2, Accession NM_007175). Accordingly, utilities of VGAM172 include diagnosis, prevention and treatment of diseases and clinical conditions associated with C8orf2. FBP17 (Accession XM_052666) is another VGAM172 host target gene. FBP17 BINDING SITE is HOST TARGET binding site found in the 3' untranslated region of mRNA encoded by FBP17, corresponding to a HOST TARGET binding site such as BINDING SITE I, BINDING SITE II or BINDING SITE III. Table 2 illustrates the complementarity of the nucleotide sequences of FBP17 BINDING SITE, designated SEQ ID:36051, to the nucleotide sequence of VGAM172 RNA, herein designated VGAM RNA, also designated SEQ ID:2883.

Another function of VGAM172 is therefore inhibition of FBP17 (Accession XM_052666). Accordingly, utilities of VGAM172 include diagnosis, prevention and treatment of diseases and clinical conditions associated with FBP17. FLJ00007 (Accession XM_048928) is another VGAM172 host target gene. FLJ00007 BINDING SITE is HOST TARGET binding site found in the 3' untranslated region of mRNA encoded by FLJ00007, corresponding to a HOST TARGET binding site such as BINDING SITE I, BINDING SITE II or BINDING SITE III. Table 2 illustrates the complementarity of the nucleotide sequences of FLJ00007 BINDING SITE, designated SEQ ID:35316, to the nucleotide sequence of VGAM172 RNA, herein designated VGAM RNA, also designated SEQ ID:2883.

Another function of VGAM172 is therefore inhibition of FLJ00007 (Accession XM_048928). Accordingly, utilities of VGAM172 include diagnosis, prevention and treatment of diseases and clinical conditions associated with FLJ00007. FLJ14957 (Accession NM_032866) is another VGAM172 host target gene. FLJ14957 BINDING SITE is HOST TARGET binding site found in the 3' untranslated region of mRNA encoded by FLJ14957, corresponding to a HOST TARGET binding site such as BINDING SITE I, BINDING SITE II or BINDING SITE III. Table 2 illustrates the complementarity of the nucleotide sequences of FLJ14957 BINDING SITE, designated SEQ ID:26686, to the nucleotide sequence of VGAM172 RNA, herein designated VGAM RNA, also designated SEQ ID:2883.

Another function of VGAM172 is therefore inhibition of FLJ14957 (Accession NM_032866). Accordingly, utilities of VGAM172 include diagnosis, prevention and treatment of diseases and clinical conditions associated with FLJ14957. FLJ31101 (Accession NM_017964) is another VGAM172 host target gene. FLJ31101 BINDING SITE is HOST TARGET binding site found in the 3' untranslated region of mRNA encoded by FLJ31101, corresponding to a HOST TARGET binding site such as BINDING SITE I, BINDING SITE II or BINDING SITE III. Table 2 illustrates the complementarity of the nucleotide sequences of FLJ31101 BINDING SITE, designated SEQ ID:19689, to the nucleotide sequence of VGAM172 RNA, herein designated VGAM RNA, also designated SEQ ID:2883.

Another function of VGAM172 is therefore inhibition of FLJ31101 (Accession NM_017964). Accordingly, utilities of VGAM172 include diagnosis, prevention and treatment of diseases and clinical conditions associated with FLJ31101. Golgi Associated, Gamma Adaptin Ear Containing, ARF Binding Protein 2 (GGA2, Accession NM_015044) is another VGAM172 host target gene. GGA2 BINDING SITE1 and GGA2 BINDING SITE2 are HOST TARGET binding sites found in untranslated regions of mRNA encoded by GGA2, corresponding to HOST TARGET binding sites such as BINDING SITE I, BINDING SITE II or BINDING SITE III. Table 2 illustrates the complementarity of the nucleotide sequences of GGA2 BINDING SITE1 and GGA2

BINDING SITE2, designated SEQ ID:17406 and SEQ ID:28928 respectively, to the nucleotide sequence of VGAM172 RNA, herein designated VGAM RNA, also designated SEQ ID:2883.

Another function of VGAM172 is therefore inhibition of Golgi Associated, Gamma Adaptin Ear Containing, ARF Binding Protein 2 (GGA2, Accession NM_015044). Accordingly, utilities of VGAM172 include diagnosis, prevention and treatment of diseases and clinical conditions associated with GGA2. GTP Binding Protein 1 (GTPBP1, Accession NM_004286) is another VGAM172 host target gene. GTPBP1 BINDING SITE is HOST TARGET binding site found in the 3' untranslated region of mRNA encoded by GTPBP1, corresponding to a HOST TARGET binding site such as BINDING SITE I, BINDING SITE II or BINDING SITE III. Table 2 illustrates the complementarity of the nucleotide sequences of GTPBP1 BINDING SITE, designated SEQ ID:10499, to the nucleotide sequence of VGAM172 RNA, herein designated VGAM RNA, also designated SEQ ID:2883.

Another function of VGAM172 is therefore inhibition of GTP Binding Protein 1 (GTPBP1, Accession NM_004286). Accordingly, utilities of VGAM172 include diagnosis, prevention and treatment of diseases and clinical conditions associated with GTPBP1. KIAA0711 (Accession NM_014867) is another VGAM172 host target gene. KIAA0711 BINDING SITE is HOST TARGET binding site found in the 3' untranslated region of mRNA encoded by KIAA0711, corresponding to a HOST TARGET binding site such as BINDING SITE I, BINDING SITE II or BINDING SITE III. Table 2 illustrates the complementarity of the nucleotide sequences of KIAA0711 BINDING SITE, designated SEQ ID:16959, to the nucleotide sequence of VGAM172 RNA, herein designated VGAM RNA, also designated SEQ ID:2883.

Another function of VGAM172 is therefore inhibition of KIAA0711 (Accession NM_014867). Accordingly, utilities of VGAM172 include diagnosis, prevention and treatment of diseases and clinical conditions associated with KIAA0711. KIAA0775 (Accession NM_014726) is another VGAM172 host target gene. KIAA0775 BINDING SITE is HOST TARGET binding site found in the 3' untranslated region of mRNA encoded by KIAA0775, corresponding to a HOST TARGET binding site such as BINDING SITE I, BINDING SITE II or BINDING SITE III. Table 2 illustrates the complementarity of the nucleotide sequences of KIAA0775 BINDING SITE, designated SEQ ID:16323, to the nucleotide sequence of VGAM172 RNA, herein designated VGAM RNA, also designated SEQ ID:2883.

Another function of VGAM172 is therefore inhibition of KIAA0775 (Accession NM_014726). Accordingly, utilities of VGAM172 include diagnosis, prevention and treatment of diseases and clinical conditions associated with KIAA0775. KIAA1538 (Accession XM_049474) is another VGAM172 host target gene. KIAA1538 BINDING SITE is HOST TARGET binding site found in the 3' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35438, to the nucleotide sequence of VGAM172 RNA, herein designated VGAM RNA, also designated SEQ ID:2883.

Another function of VGAM172 is therefore inhibition of KIAA1538 (Accession XM_049474). Accordingly, utilities of VGAM172 include diagnosis, prevention and treatment of diseases and clinical conditions associated with KIAA1538. KIAA1559 (Accession XM_054472) is another VGAM172 host target gene. KIAA1559 BINDING SITE is HOST TARGET binding site found in the 3' untranslated region of mRNA encoded by KIAA1559, corresponding to a HOST TARGET binding site such as BINDING SITE I, BINDING SITE II or BINDING SITE III. Table 2 illustrates the complementarity of the nucleotide sequences of KIAA1559 BINDING SITE, designated SEQ ID:36167, to the nucleotide sequence of VGAM172 RNA, herein designated VGAM RNA, also designated SEQ ID:2883.

Another function of VGAM172 is therefore inhibition of KIAA1559 (Accession XM_054472). Accordingly, utilities of VGAM172 include diagnosis, prevention and treatment of diseases and clinical conditions associated with KIAA1559. KIAA1822 (Accession XM_041566) is another VGAM172 host target gene. KIAA1822 BINDING SITE is HOST TARGET binding site found in the 3' untranslated region of mRNA encoded by KIAA1822, corresponding to a HOST TARGET binding site such as BINDING SITE I, BINDING SITE II or BINDING SITE III. Table 2 illustrates the complementarity of the nucleotide sequences of KIAA1822 BINDING SITE, designated SEQ ID:33557, to the nucleotide sequence of VGAM172 RNA, herein designated VGAM RNA, also designated SEQ ID:2883.

Another function of VGAM172 is therefore inhibition of KIAA1822 (Accession XM_041566). Accordingly, utilities of VGAM172 include diagnosis, prevention and treatment of diseases and clinical conditions associated with KIAA1822. MGC21688 (Accession NM_144635) is another VGAM172 host target gene. MGC21688 BINDING SITE is HOST TARGET binding site found in the 3' untranslated region of mRNA encoded by MGC21688, corresponding to a HOST TARGET binding site such as BINDING SITE I, BINDING SITE II or BINDING SITE III. Table 2 illustrates the complementarity of the nucleotide sequences of MGC21688 BINDING SITE, designated SEQ ID:29455, to the nucleotide sequence of VGAM172 RNA, herein designated VGAM RNA, also designated SEQ ID:2883.

Another function of VGAM172 is therefore inhibition of MGC21688 (Accession NM_144635). Accordingly, utilities of VGAM172 include diagnosis, prevention and treatment of diseases and clinical conditions associated with MGC21688. MGC3101 (Accession NM_024043) is another VGAM172 host target gene. MGC3101 BINDING SITE is HOST TARGET binding site found in the 3' untranslated region of mRNA encoded by MGC3101, corresponding to a HOST TARGET binding site such as BINDING SITE I, BINDING SITE II or BINDING SITE III. Table 2 illustrates the complementarity of the nucleotide sequences of MGC3101 BINDING SITE, designated SEQ ID:23476, to the nucleotide sequence of VGAM172 RNA, herein designated VGAM RNA, also designated SEQ ID:2883.

Another function of VGAM172 is therefore inhibition of MGC3101 (Accession NM_024043). Accordingly, utilities of VGAM172 include diagnosis, prevention and treatment of diseases and clinical conditions associated with MGC3101. Retinoic Acid Induced 16 (RAI16, Accession NM_022749) is another VGAM172 host target gene. RAI16 BINDING SITE is HOST TARGET binding site found in the 3' untranslated region of mRNA encoded by RAI16, corresponding to a HOST TARGET binding site such as BINDING SITE I, BINDING SITE II or BINDING SITE III. Table 2 illustrates the complementarity of the nucleotide sequences of RAI16 BINDING SITE, designated SEQ ID:22972, to the nucleotide sequence of VGAM172 RNA, herein designated VGAM RNA, also designated SEQ ID:2883.

Another function of VGAM172 is therefore inhibition of Retinoic Acid Induced 16 (RAI16, Accession NM_022749). Accordingly, utilities of VGAM172 include diagnosis, prevention and treatment of diseases and clinical conditions associated with RAI16. RDC1 (Accession XM_051522) is another VGAM172 host target gene. RDC1 BINDING SITE is HOST TARGET binding site found in the 3' untranslated region of mRNA encoded by RDC1, corresponding to a HOST TARGET binding site such as BINDING SITE I, BINDING SITE II or BINDING SITE III. Table 2 illustrates the complementarity of the nucleotide sequences of RDC1 BINDING SITE, designated SEQ ID:35849, to the nucleotide sequence of VGAM172 RNA, herein designated VGAM RNA, also designated SEQ ID:2883.

Another function of VGAM172 is therefore inhibition of RDC1 (Accession XM_051522). Accordingly, utilities of VGAM172 include diagnosis, prevention and treatment of diseases and clinical conditions associated with RDC1. RING1 and YY1 Binding Protein (RYBP, Accession XM_002853) is another VGAM172 host target gene. RYBP BINDING SITE is HOST TARGET binding site found in the 5' untranslated region of mRNA encoded by RYBP, corresponding to a HOST TARGET binding site such as BINDING SITE I, BINDING SITE II or BINDING SITE III. Table 2 illustrates the complementarity of the nucleotide sequences of RYBP BINDING SITE, designated SEQ ID:29909, to the nucleotide sequence of VGAM172 RNA, herein designated VGAM RNA, also designated SEQ ID:2883.

Another function of VGAM172 is therefore inhibition of RING1 and YY1 Binding Protein (RYBP, Accession XM_002853). Accordingly, utilities of VGAM172 include diagnosis, prevention and treatment of diseases and clinical conditions associated with RYBP. Sema Domain, Immunoglobulin Domain (Ig), Transmembrane Domain (TM) and Short Cytoplasmic Domain, (semaphorin) 4F (SEMA4F, Accession NM_004263) is another VGAM172 host target gene. SEMA4F BINDING SITE is HOST TARGET binding site found in the 3' untranslated region of mRNA encoded by SEMA4F, corresponding to a HOST TARGET binding site such as BINDING SITE I, BINDING SITE II or BINDING SITE III. Table 2 illustrates the complementarity of the nucleotide sequences of SEMA4F BINDING SITE, designated SEQ ID:10462, to the nucleotide sequence of VGAM172 RNA, herein designated VGAM RNA, also designated SEQ ID:2883.

Another function of VGAM172 is therefore inhibition of Sema Domain, Immunoglobulin Domain (Ig), Transmembrane Domain (TM) and Short Cytoplasmic Domain, (semaphorin) 4F (SEMA4F, Accession NM_004263). Accordingly, utilities of VGAM172 include diagnosis, prevention and treatment of diseases and clinical conditions associated with SEMA4F. SPEC1 (Accession NM_020239) is another VGAM172 host target gene. SPEC1 BINDING SITE is HOST TARGET binding site found in the 3' untranslated region of mRNA encoded by SPEC1, corresponding to a HOST TARGET binding site such as BINDING SITE I, BINDING SITE II or BINDING SITE III. Table 2 illustrates the complementarity of the nucleotide sequences of SPEC1 BINDING SITE, designated SEQ ID:21513, to the nucleotide sequence of VGAM172 RNA, herein designated VGAM RNA, also designated SEQ ID:2883.

Another function of VGAM172 is therefore inhibition of SPEC1 (Accession NM_020239). Accordingly, utilities of VGAM172 include diagnosis, prevention and treatment of diseases and clinical conditions associated with SPEC1. Tripartite Motif-containing 5 (TRIM5, Accession NM_033093) is another VGAM172 host target gene. TRIM5 BINDING SITE1 through TRIM5 BINDING SITE3 are HOST TARGET binding sites found in untranslated regions of mRNA encoded by TRIM5, corresponding to HOST TARGET binding sites such as BINDING SITE I, BINDING SITE II or BINDING SITE III. Table 2 illustrates the complementarity of the nucleotide sequences of TRIM5 BINDING SITE1 through TRIM5 BINDING SITE3, designated SEQ ID:26937, SEQ ID:26927 and SEQ ID:26936 respectively, to the nucleotide sequence of VGAM172 RNA, herein designated VGAM RNA, also designated SEQ ID:2883.

Another function of VGAM172 is therefore inhibition of Tripartite Motif-containing 5 (TRIM5, Accession NM_033093). Accordingly, utilities of VGAM172 include diagnosis, prevention and treatment of diseases and clinical conditions associated with TRIM5. LOC115110 (Accession XM_049825) is another VGAM172 host target gene. LOC115110 BINDING SITE is HOST TARGET binding site found in the 5' untranslated region of mRNA encoded by LOC115110, corresponding to a HOST TARGET binding site such as BINDING SITE I, BINDING SITE II or BINDING SITE III. Table 2 illustrates the complementarity of the nucleotide sequences of LOC115110 BINDING SITE, designated SEQ ID:35511, to the nucleotide sequence of VGAM172 RNA, herein designated VGAM RNA, also designated SEQ ID:2883.

Another function of VGAM172 is therefore inhibition of LOC115110 (Accession XM_049825). Accordingly, utilities of VGAM172 include diagnosis, prevention and treatment of diseases and clinical conditions associated with LOC115110. LOC127428 (Accession XM_059144) is another VGAM172 host target gene. LOC127428 BINDING SITE is HOST TARGET binding site found in the 5' untranslated region of mRNA encoded by LOC127428, corresponding to a HOST TARGET binding site such as BINDING SITE I, BINDING SITE II or BINDING SITE III. Table 2 illustrates the complementarity of the nucleotide sequences of LOC127428 BINDING SITE, designated SEQ ID:36901, to the nucleotide sequence of VGAM172 RNA, herein designated VGAM RNA, also designated SEQ ID:2883.

Another function of VGAM172 is therefore inhibition of LOC127428 (Accession XM_059144). Accordingly, utilities of VGAM172 include diagnosis, prevention and treatment of diseases and clinical conditions associated with LOC127428. LOC145662 (Accession XM_085194) is another VGAM172 host target gene. LOC145662 BINDING SITE is HOST TARGET binding site found in the 3' untranslated region of mRNA encoded by LOC145662, corresponding to a HOST TARGET binding site such as BINDING SITE I, BINDING SITE II or BINDING SITE III. Table 2 illustrates the complementarity of the nucleotide sequences of LOC145662 BINDING SITE, designated SEQ ID:37919, to the nucleotide sequence of VGAM172 RNA, herein designated VGAM RNA, also designated SEQ ID:2883.

Another function of VGAM172 is therefore inhibition of LOC145662 (Accession XM_085194). Accordingly, utilities of VGAM172 include diagnosis, prevention and treatment of diseases and clinical conditions associated with LOC145662. LOC146443 (Accession XM_085461) is another VGAM172 host target gene. LOC146443 BINDING SITE is HOST TARGET binding site found in the 5' untranslated region of mRNA encoded by LOC146443, corresponding to a HOST TARGET binding site such as BINDING SITE I, BINDING SITE II or BINDING SITE III. Table 2 illustrates the complementarity of the nucleotide sequences of LOC146443 BINDING SITE, designated SEQ ID:38150, to the nucleotide sequence of VGAM172 RNA, herein designated VGAM RNA, also designated SEQ ID:2883.

Another function of VGAM172 is therefore inhibition of LOC146443 (Accession XM_085461). Accordingly, utilities of VGAM172 include diagnosis, prevention and treatment of diseases and clinical conditions associated with LOC146443. LOC149372 (Accession XM_086509) is another VGAM172 host target gene. LOC149372 BINDING SITE is HOST TARGET binding site found in the 3' untranslated region of mRNA encoded by LOC149372, corresponding to a HOST TARGET binding site such as BINDING SITE I, BINDING SITE II or BINDING SITE III. Table 2 illustrates the complementarity of the nucleotide sequences of LOC149372 BINDING SITE, designated SEQ ID:38731, to the nucleotide sequence of VGAM172 RNA, herein designated VGAM RNA, also designated SEQ ID:2883.

Another function of VGAM172 is therefore inhibition of LOC149372 (Accession XM_086509). Accordingly, utilities of VGAM172 include diagnosis, prevention and treatment of diseases and clinical conditions associated with LOC149372. LOC151438 (Accession XM_098060) is another VGAM172 host target gene. LOC151438 BINDING SITE is HOST TARGET binding site found in the 5' untranslated region of mRNA encoded by LOC151438, corresponding to a HOST TARGET binding site such as BINDING SITE I, BINDING SITE II or BINDING SITE III. Table 2 illustrates the complementarity of the nucleotide sequences of LOC151438 BINDING SITE, designated SEQ ID:41348, to the nucleotide sequence of VGAM172 RNA, herein designated VGAM RNA, also designated SEQ ID:2883.

Another function of VGAM172 is therefore inhibition of LOC151438 (Accession XM_098060). Accordingly, utilities of VGAM172 include diagnosis, prevention and treatment of diseases and clinical conditions associated with LOC151438. LOC151657 (Accession XM_098100) is another VGAM172 host target gene. LOC151657 BINDING SITE is HOST TARGET binding site found in the 5' untranslated region of mRNA encoded by LOC151657, corresponding to a HOST TARGET binding site such as BINDING SITE I, BINDING SITE II or BINDING SITE III. Table 2 illustrates the complementarity of the nucleotide sequences of LOC151657 BINDING SITE, designated SEQ ID:41383, to the nucleotide sequence of VGAM172 RNA, herein designated VGAM RNA, also designated SEQ ID:2883.

Another function of VGAM172 is therefore inhibition of LOC151657 (Accession XM_098100). Accordingly, utilities of VGAM172 include diagnosis, prevention and treatment of diseases and clinical conditions associated with LOC151657. LOC151877 (Accession XM_098132) is another VGAM172 host target gene. LOC151877 BINDING SITE is HOST TARGET binding site found in the 3' untranslated region of mRNA encoded by LOC151877, corresponding to a HOST TARGET binding site such as BINDING SITE I, BINDING SITE II or BINDING SITE III. Table 2 illustrates the complementarity of the nucleotide sequences of LOC151877 BINDING SITE, designated SEQ ID:41399, to the nucleotide sequence of VGAM172 RNA, herein designated VGAM RNA, also designated SEQ ID:2883.

Another function of VGAM172 is therefore inhibition of LOC151877 (Accession XM_098132). Accordingly, utilities of VGAM172 include diagnosis, prevention and treatment of diseases and clinical conditions associated with LOC151877. LOC157931 (Accession XM_098845) is another VGAM172 host target gene. LOC157931 BINDING SITE is HOST TARGET binding site found in the 3' untranslated region of mRNA encoded by LOC157931, corresponding to a HOST TARGET binding site such as BINDING SITE I, BINDING SITE II or BINDING SITE III. Table 2 illustrates the complementarity of the nucleotide sequences of LOC157931 BINDING SITE, designated SEQ ID:41906, to the nucleotide sequence of VGAM172 RNA, herein designated VGAM RNA, also designated SEQ ID:2883.

Another function of VGAM172 is therefore inhibition of LOC157931 (Accession XM_098845). Accordingly, utilities of VGAM172 include diagnosis, prevention and treatment of diseases and clinical conditions associated with LOC157931. LOC205251 (Accession XM_119554) is another VGAM172 host target gene. LOC205251 BINDING SITE is HOST TARGET binding site found in the 5' untranslated region of mRNA encoded by LOC205251, corresponding to a HOST TARGET binding site such as BINDING SITE I, BINDING SITE II or BINDING SITE III. Table 2 illustrates the complementarity of the nucleotide sequences of LOC205251 BINDING SITE, designated SEQ ID:43589, to the nucleotide sequence of VGAM172 RNA, herein designated VGAM RNA, also designated SEQ ID:2883.

Another function of VGAM172 is therefore inhibition of LOC205251 (Accession XM_119554). Accordingly, utilities of VGAM172 include diagnosis, prevention and treatment of diseases and clinical conditions associated with LOC205251. LOC255177 (Accession XM_172941) is another VGAM172 host target gene. LOC255177 BINDING SITE is HOST TARGET binding site found in the 3' untranslated region of mRNA encoded by LOC255177, corresponding to a HOST TARGET binding site such as BINDING SITE I, BINDING SITE II or BINDING SITE III. Table 2 illustrates the complementarity of the nucleotide sequences of LOC255177 BINDING SITE, designated SEQ ID:46205, to the nucleotide sequence of VGAM172 RNA, herein designated VGAM RNA, also designated SEQ ID:2883.

Another function of VGAM172 is therefore inhibition of LOC255177 (Accession XM_172941). Accordingly, utilities of VGAM172 include diagnosis, prevention and treatment of diseases and clinical conditions associated with LOC255177. LOC256021 (Accession XM_172884) is another VGAM172 host target gene. LOC256021 BINDING SITE is HOST TARGET binding site found in the 3' untranslated region of mRNA encoded by LOC256021, corresponding to a HOST TARGET binding site such as BINDING SITE I, BINDING SITE II or BINDING SITE III. Table 2 illustrates the complementarity of the nucleotide sequences of LOC256021 BINDING SITE, designated SEQ ID:46168, to the nucleotide sequence of VGAM172 RNA, herein designated VGAM RNA, also designated SEQ ID:2883.

Another function of VGAM172 is therefore inhibition of LOC256021 (Accession XM_172884). Accordingly, utilities of VGAM172 include diagnosis, prevention and treatment of diseases and clinical conditions associated with LOC256021. LOC51301 (Accession NM_016591) is another VGAM172 host target gene. LOC51301 BINDING SITE is HOST TARGET binding site found in the 5' untranslated region of mRNA encoded by LOC51301, corresponding to a HOST TARGET binding site such as BINDING SITE I, BINDING SITE II or BINDING SITE III. Table 2 illustrates the complementarity of the nucleotide sequences of LOC51301 BINDING SITE, designated SEQ ID:18675, to the nucleotide sequence of VGAM172 RNA, herein designated VGAM RNA, also designated SEQ ID:2883.

Another function of VGAM172 is therefore inhibition of LOC51301 (Accession NM_016591). Accordingly, utilities of VGAM172 include diagnosis, prevention and treatment of diseases and clinical conditions associated with LOC51301. FIG. 1 further provides a conceptual description of a novel bioinformatically detected viral gene of the present invention, referred to here as Viral Genomic Address Messenger 173 (VGAM173) viral gene, which modulates expression of respective host target genes thereof, the function and utility of which host target genes is known in the art.

VGAM173 is a novel bioinformatically detected regulatory, non protein coding, viral micro RNA (miRNA) gene. The method by which VGAM173 was detected is described hereinabove with reference to FIGS. 1-8.

VGAM173 gene, herein designated VGAM GENE, is a viral gene contained in the genome of Shrimp White Spot Syndrome Virus (white spot baciliform virus). VGAM173 host target gene, herein designated VGAM HOST TARGET GENE, is a human gene contained in the human genome.

VGAM173 gene encodes a VGAM173 precursor RNA, herein designated VGAM PRECURSOR RNA. Similar to other miRNA genes, and unlike most ordinary genes, VGAM173 precursor RNA does not encode a protein. A nucleotide sequence identical or highly similar to the nucleotide sequence of VGAM173 precursor RNA is designated SEQ ID:159, and is provided hereinbelow with reference to the sequence listing part. Nucleotide sequence SEQ ID:159 is located at position 272848 relative to the genome of Shrimp White Spot Syndrome Virus (white spot baciliform virus).

VGAM173 precursor RNA folds onto itself, forming VGAM173 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM173 folded precursor RNA into VGAM173 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM173 RNA is designated SEQ ID:2884, and is provided hereinbelow with reference to the sequence listing part.

VGAM173 host target gene, herein designated VGAM HOST TARGET GENE, encodes a corresponding messenger RNA, VGAM173 host target RNA, herein designated VGAM HOST TARGET RNA. VGAM173 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM173 RNA, herein designated VGAM RNA, binds complementarily to one or more host target binding sites located in untranslated regions of VGAM173 host target RNA, herein designated VGAM HOST TARGET RNA. This complementary binding is due to the fact that the nucleotide sequence of VGAM173 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM173 RNA, herein designated VGAM RNA, may have a different number of host target binding sites in untranslated regions of a VGAM173 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM173 RNA, herein designated VGAM RNA, to host target binding sites on VGAM173 host target RNA, herein designated VGAM HOST TARGET RNA, such as BINDING SITE I, BINDING SITE II and BINDING SITE III, inhibits translation of VGAM173 host target RNA into VGAM173 host target protein, herein designated VGAM HOST TARGET PROTEIN. VGAM host target protein is therefore outlined by a broken line.

It is appreciated that VGAM173 host target gene, herein designated VGAM HOST TARGET GENE, in fact represents a plurality of VGAM173 host target genes. The mRNA of each one of this plurality of VGAM173 host target genes comprises one or more host target binding sites, each having a nucleotide sequence which is at least partly complementary to VGAM173 RNA, herein designated VGAM RNA, and which when bound by VGAM173 RNA causes inhibition of translation of respective one or more VGAM173 host target proteins.

It is further appreciated by one skilled in the art that the mode of translational inhibition illustrated by FIG. 1 with specific reference to translational inhibition exerted by VGAM173 gene, herein designated VGAM GENE, on one or more VGAM173 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM173 is inhibition of expression of host target genes, as part of a novel viral mechanism of attacking a host. Accordingly, utilities of VGAM173 include diagnosis, prevention and treatment of viral infection by Shrimp White Spot Syndrome Virus (white spot baciliform virus). Specific functions, and accordingly utilities, of VGAM173 correlate with, and may be deduced from, the identity of the host target genes which VGAM173 binds and inhibits, and the function of these host target genes, as elaborated hereinbelow.

Nucleotide sequences of the VGAM173 precursor RNA, herein designated VGAM PRECURSOR RNA, and of the 'diced' VGAM173 RNA, herein designated VGAM RNA, and a schematic representation of the secondary folding of VGAM173 folded precursor RNA, herein designated VGAM FOLDED PRECURSOR RNA, of VGAM173 are further described hereinbelow with reference to Table 1.

Nucleotide sequences of host target binding sites, such as BINDING SITE-I, BINDING SITE-II and BINDING SITE-III of FIG. 1, found on VGAM173 host target RNA, and schematic representation of the complementarity of each of these host target binding sites to VGAM173 RNA, herein designated VGAM RNA, are described hereinbelow with reference to Table 2.

As mentioned hereinabove with reference to FIG. 1, a function of VGAM173 gene, herein designated VGAM is inhibition of expression of VGAM173 target genes. It is appreciated that specific functions, and accordingly utilities, of VGAM173 correlate with, and may be deduced from, the identity of the target genes which VGAM173 binds and inhibits, and the function of these target genes, as elaborated hereinbelow.

Beta-site APP-cleaving Enzyme (BACE, Accession NM_012104) is a VGAM173 host target gene. BACE BINDING SITE1 and BACE BINDING SITE2 are HOST TARGET binding sites found in untranslated regions of mRNA encoded by BACE, corresponding to HOST TARGET binding sites such as BINDING SITE I, BINDING SITE II or BINDING SITE III. Table 2 illustrates the complementarity of the nucleotide sequences of BACE BINDING SITE1 and BACE BINDING SITE2, designated SEQ ID:14418 and SEQ ID:29086 respectively, to the nucleotide sequence of VGAM173 RNA, herein designated VGAM RNA, also designated SEQ ID:2884.

A function of VGAM173 is therefore inhibition of Beta-site APP-cleaving Enzyme (BACE, Accession NM_012104), a gene which is responsible for the proteolytic processing of the amyloid precursor protein. Accordingly, utilities of VGAM173 include diagnosis, prevention and treatment of diseases and clinical conditions associated with BACE. The function of BACE has been established by previous studies. Cerebral deposition of amyloid beta peptide is an early and critical feature of Alzheimer disease (AD; 104300). Amyloid beta generation depends on proteolytic cleavage of amyloid precursor protein (APP; 104760) by 2 proteases, beta-secretase and gamma-secretase. Vassar et al. (1999) reported the cloning of a human transmembrane aspartic protease that had all the known characteristics of the beta-secretase. Using an expression cloning strategy, they identified a clone that shared significant sequence similarity with members of the pepsin subfamily of aspartic proteases. This clone encoded a novel protein, designated BACE for 'beta-site APP-cleaving enzyme.' The BACE open reading frame encodes a protein of 501 amino acids containing a 21-amino acid signal peptide followed by a proprotein domain spanning amino acids 22 to 45. The lumenal domain of the mature protein is followed by 1 predicted transmembrane domain and a short cytosolic C-terminal tail of 24 amino acids. BACE was predicted to be a type 1 transmembrane protein with the active site on the lumenal side of the membrane, where beta-secretase cleaves APP. The BACE protein shares greatest amino acid identity (30%) with cathepsin E (OMIM Ref. No. 116890). Rat and mouse BACE orthologs have 96% amino acid sequence identity with the human BACE protein. Northern blot analysis of human BACE mRNA in adult peripheral tissues and various subregions of the brain detected 3 transcripts of approximately 7.0, 4.4, and 2.6 kb. By in situ hybridization, expression of BACE mRNA in rat brain was observed at higher levels in neurons than in glia, supporting the idea that neurons are the primary source of the extracellular A-beta deposited in amyloid plaques. Vassar et al. (1999) ascribed the difference between the apparent and calculated molecular weight (approximately 70 and 51 kD, respectively) of the BACE protein to N-linked glycosylation. Immunostaining demonstrated intracellular localization of BACE to the Golgi and endosomes. Transient overexpression of BACE did not affect APP expression, but decreased alpha-secretase cleavage and increased beta-secretase activity in cells expressing wildtype or Swedish mutant (104760.0008) APP. BACE overexpression induced cleavage only at the known beta-secretase positions, asp1 and glu11. Vassar et al. (1999) concluded that their data provided strong evidence that the BACE aspartic protease is the long-sought beta-secretase. Animal model experiments lend further support to the function of BACE. Luo et al. (2001) found that mice deficient in BACE1 are healthy, fertile, and appear normal in gross anatomy, tissue histology, hematology, and clinical chemistry. Bace1 -/- mice who are also hemizygous for an amyloid precursor protein transgene lack brain beta-amyloid and beta-secretase-cleaved APP C-terminal fragments. These results provided validation of BACE1 as the major beta-secretase in vivo and suggested that therapeutic inhibition of BACE1 for the treatment of Alzheimer disease may be free of mechanism-based toxicity.

It is appreciated that the abovementioned animal model for BACE is acknowledged by those skilled in the art as a scientifically valid animal model, as can be further appreciated from the publications sited hereinbelow.

Full details of the abovementioned studies are described in the following publications, the disclosure of which are hereby incorporated by reference:

Vassar, R.; Bennett, B. D.; Babu-Khan, S.; Kahn, S.; Mendiaz, E. A.; Dents, P.; Taplow, D. B.; Ross, S.; Amaranta, P.; Loeloff, R.; Luo, Y.; Fisher, S.; and 12 others: Beta-secretase cleavage of Alzheimer's amyloid precursor protein by the transmembrane aspartic protease BACE. Science 286:735-741, 1999; and Luo, Y.; Bolon, B.; Kahn, S.; Bennett, B. D.; Babu-Khan, S.; Denis, P.; Fan, W.; Kha, H.; Zhang, J.; Gong, Y.; Martin, L.; Louis, J.-C.; Yan, Q.; Richards, W. G.; Citron, M.; Vassar, R.

Further studies establishing the function and utilities of BACE are found in John Hopkins OMIM database record ID 604252, and in sited publications numbered 5405, 5418-5422, 12307-7054, 7067, 7064-706 and 7068 listed in the bibliography section hereinbelow, which are also hereby incorporated by reference. LIM Domain Kinase 1 (LIMK1, Accession NM_002314) is another VGAM173 host target gene. LIMK1 BINDING SITE1 and LIMK1 BINDING SITE2 are HOST TARGET binding sites found in untranslated regions of mRNA encoded by LIMK1, corresponding to HOST TARGET binding sites such as BINDING SITE I, BINDING SITE II or BINDING SITE III. Table 2 illustrates the complementarity of the nucleotide sequences of LIMK1 BINDING SITE1 and LIMK1 BINDING SITE2, designated SEQ ID:8124 and SEQ ID:18799 respectively, to the nucleotide sequence of VGAM173 RNA, herein designated VGAM RNA, also designated SEQ ID:2884.

Another function of VGAM173 is therefore inhibition of LIM Domain Kinase 1 (LIMK1, Accession NM_002314). Accordingly, utilities of VGAM173 include diagnosis, prevention and treatment of diseases and clinical conditions associated with LIMK1. Low Density Lipoprotein Receptor-related Protein 4 (LRP4, Accession XM_035037) is another VGAM173 host target gene. LRP4 BINDING SITE is HOST TARGET binding site found in the 3' untranslated region of mRNA encoded by LRP4, corresponding to a HOST TARGET binding site such as BINDING SITE I, BINDING SITE II or BINDING SITE III. Table 2 illustrates the complementarity of the nucleotide sequences of LRP4 BINDING SITE, designated SEQ ID:32198, to the nucleotide sequence of VGAM173 RNA, herein designated VGAM RNA, also designated SEQ ID:2884.

Another function of VGAM173 is therefore inhibition of Low Density Lipoprotein Receptor-related Protein 4 (LRP4, Accession XM_035037). Accordingly, utilities of VGAM173 include diagnosis, prevention and treatment of diseases and clinical conditions associated with LRP4. Platelet-derived Growth Factor Beta Polypeptide (simian sarcoma viral (v-sis) Oncogene Homolog) (PDGFB, Accession NM_002608) is another VGAM173 host target gene. PDGFB BINDING SITE is HOST TARGET binding site found in the 5' untranslated region of mRNA encoded by PDGFB, corresponding to a HOST TARGET binding site such as BINDING SITE I, BINDING SITE II or BINDING SITE III. Table 2 illustrates the complementarity of the nucleotide sequences of PDGFB BINDING SITE, designated SEQ ID:8469, to the nucleotide sequence of VGAM173 RNA, herein designated VGAM RNA, also designated SEQ ID:2884.

Another function of VGAM173 is therefore inhibition of Platelet-derived Growth Factor Beta Polypeptide (simian sarcoma viral (v-sis) Oncogene Homolog) (PDGFB, Accession NM_002608), a gene which plays an important role in stimulating adjacent cells to grow and thereby heal the wound. Accordingly, utilities of VGAM173 include diagnosis, prevention and treatment of diseases and clinical conditions associated with PDGFB. The function of PDGFB has been established by previous studies. Most proliferating cells are programmed to undergo apoptosis unless specific survival signals are provided. Platelet-derived growth factor promotes cellular proliferation and inhibits apoptosis. Romashkova and Makarov (1999) showed that PDGF activates the RAS/PIK3/AKT1/IKK/NFKB1 pathway. In this pathway, NFKB1 (OMIM Ref. No. 164011) does not induce c-myc and apoptosis, but instead induces putative antiapoptotic genes. In response to PDGF, AKT1 (OMIM Ref. No. 164730) transiently associates with IKK (see OMIM Ref. No. 600664) and induces IKK activation. The authors suggested that under certain conditions PIK3 (see OMIM Ref. No. 171834) may activate NFKB1 without the involvement of NFKBIA (OMIM Ref. No. 164008) or NFKBIB (OMIM Ref. No. 604495) degradation. Dermatofibrosarcoma protuberans (DFSP), an infiltrative skin tumor of intermediate malignancy, presents specific cytogenetic features such as reciprocal translocations t (17;22)(q22; q13) and supernumerary ring chromosomes derived from t (17;22). Simon et al. (1997) characterized the breakpoints from translocations and rings in dermatofibrosarcoma protuberans and its juvenile form, giant cell fibroblastoma, on the genomic and RNA levels. They found that these rearrangements fuse the PDGFB gene and the COL1A1 gene (OMIM Ref. No. 120150). Simon et al. (1997) commented that PDGFB has transforming activity and is a potent mitogen for a number of cell types, but its role in oncogenic processes was not fully understood. They noted that neither COL1A1 nor PDGFB had hitherto been implicated in tumor translocations. The gene fusions deleted exon 1 of PDGFB and released this growth factor from its normal regulation; see 190040.0002.

Full details of the abovementioned studies are described in the following publications, the disclosure of which are hereby incorporated by reference:

Simon, M.-P.; Pedeutour, F.; Sirvent, N.; Grosgeorge, J.; Minoletti, F.; Coindre, J.-M.; Terrier-Lacombe, M.-J.; Mandahl, N.; Craver, R. D.; Blin, N.; Sozzi, G.; Turc-Carel, C.; O'Brien, K. P.; Kedra, D.; Fransson, I.; Guilbaud, C.; Dumanski, J. P.: Deregulation of the platelet-derived growth factor B-chain gene via fusion with collagen gene COL1A1 in dermatofibrosarcoma protuberans and giant-cell fibroblastoma. Nature Genet. 15:95-98, 1997; and Josephs, S. F.; Guo, C.; Ratner, L.; Wong-Staal, F.: Human proto-oncogene nucleotide sequences corresponding to the transforming region of simian sarcoma virus. Science 223: 487-491, 1.

Further studies establishing the function and utilities of PDGFB are found in John Hopkins OMIM database record ID 190040, and in sited publications numbered 10481-10491, 9741, 9745-9747, 10094-9750, 3292-3294, 9751-9753, 3533, 9754-9758, 12740, 9764, 11491, 976 and 10480 listed in the bibliography section hereinbelow, which are also hereby incorporated by reference. Smcx Homolog, X Chromosome (mouse) (SMCX, Accession NM_004187) is another VGAM173 host target gene. SMCX BINDING SITE is HOST TARGET binding site found in the 3' untranslated region of mRNA encoded by SMCX, corresponding to a HOST TARGET binding site such as BINDING SITE I, BINDING SITE II or BINDING SITE III. Table 2 illustrates the complementarity of the nucleotide sequences of SMCX BINDING SITE, designated SEQ ID:10395, to the nucleotide sequence of VGAM173 RNA, herein designated VGAM RNA, also designated SEQ ID:2884.

Another function of VGAM173 is therefore inhibition of Smcx Homolog, X Chromosome (mouse) (SMCX, Accession NM_004187), a gene which escapes X inactivation. Accordingly, utilities of VGAM173 include diagnosis, prevention and treatment of diseases and clinical conditions associated with SMCX. The function of SMCX and its association with various diseases and clinical conditions, has been established by previous studies, as described hereinabove with reference to VGAM60. Transient Receptor Potential Cation Channel, Subfamily M, Member 6 (TRPM6, Accession NM_017662) is another VGAM173 host target gene. TRPM6 BINDING SITE is HOST TARGET binding site found in the 3' untranslated region of mRNA encoded by TRPM6, corresponding to a HOST TARGET binding site such as BINDING SITE I, BINDING SITE II or BINDING SITE III. Table 2 illustrates the complementarity of the nucleotide sequences of TRPM6 BINDING SITE, designated SEQ ID:19198, to the nucleotide sequence of VGAM173 RNA, herein designated VGAM RNA, also designated SEQ ID:2884.

Another function of VGAM173 is therefore inhibition of Transient Receptor Potential Cation Channel, Subfamily M, Member 6 (TRPM6, Accession NM_017662), a gene which contains a predicted ion channel domain and a protein kinase domain. Accordingly, utilities of VGAM173 include diagnosis, prevention and treatment of diseases and clinical conditions associated with TRPM6. The function of TRPM6 has been established by previous studies. Schlingmann et al. (2002) and Walder et al. (2002) studied hypomagnesemia with secondary hypocalcemia (HSH; 602014), which maps to 9q22, and by positional cloning identified the TRPM6 gene as the site of causative mutations. Walder et al. (2002) found that the complete cDNA sequence of TRPM6 contains 8,429 nucleotides, including an open reading frame of 6,069 nucleotides. The predicted TRPM6 protein contains 2,022 amino acids, has a calculated molecular mass of roughly 234 kD, and contains a predicted ion channel domain and a protein kinase domain. Northern blot analysis detected an 8.5-kb transcript abundantly expressed in kidney and colon. By in situ hybridization to various human tissues, Schlingmann et al. (2002) observed TRPM6 mRNA in colon epithelial cells, duodenum, jejunum, and ileum. Schlingmann et al. (2002) studied 5 families (2 Turkish, 1 Swedish, 1 Israeli, and 1 Albanian) with typical HSH and discovered 7 mutations in the TRPM6 gene; the Swedish and Israeli families were nonconsanguineous and the affected children were compound heterozygotes for TRPM6 mutations. The age at onset of symptoms varied from 3 weeks to 4 months. Neurologic symptoms included tetany, muscle spasms, and seizures due to hypomagnesemic hypocalcemia. Walder et al. (2002) identified mutations in the TRPM6 gene in 7 families:3 Bedouin Arab families from Israel, 1 Arab family from Greece, a family in Germany, and 2 additional Arab families from Israel. This was the first case of a human disorder attributed to mutation in a channel kinase.

Full details of the abovementioned studies are described in the following publications, the disclosure of which are hereby incorporated by reference:

Walder, R. Y.; Landau, D.; Meyer, P.; Shalev, H.; Tsolia, M.; Borochowitz, Z.; Boettger, M. B.; Beck, G. E.; Englehardt, R. K.; Carmi, R.; Sheffield, V. C.: Mutation of TRPM6 causes familial hypomagnesemia with secondary hypocalcemia. Nature Genet. 31:171-174, 2002; and Schlingmann, K. P.; Weber, S.; Peters, M.; Nejsum, L. N.; Vitzthum, H.; Klingel, K.; Kratz, M.; Haddad, E.; Ristoff, E.; Dinour, D.; Syrrou, M.; Nielsen, S.; Sassen, M.; Waldegger, S.; S.

Further studies establishing the function and utilities of TRPM6 are found in John Hopkins OMIM database record ID 607009, and in sited publications numbered 592 and 6145 listed in the bibliography section hereinbelow, which are also hereby incorporated by reference. Zinc Finger Protein 42 (myeloid-specific retinoic acid- responsive) (ZNF42, Accession NM_003422) is another VGAM173 host target gene. ZNF42 BINDING SITE is HOST TARGET binding site found in the 5' untranslated region of mRNA encoded by ZNF42, corresponding to a HOST TARGET binding site such as BINDING SITE I, BINDING SITE II or BINDING SITE III. Table 2 illustrates the complementarity of the nucleotide sequences of ZNF42 BINDING SITE, designated SEQ ID:9467, to the nucleotide sequence of VGAM173 RNA, herein designated VGAM RNA, also designated SEQ ID:2884.

Another function of VGAM173 is therefore inhibition of Zinc Finger Protein 42 (myeloid-specific retinoic acid-responsive) (ZNF42, Accession NM_003422), a gene which may be one regulator of transcriptional events during hemopoietic development. Accordingly, utilities of VGAM173 include diagnosis, prevention and treatment of diseases and clinical conditions associated with ZNF42. The function of ZNF42 has been established by previous studies. Zinc finger genes encode metal-binding proteins that can act as transcriptional regulators of other genes. In an effort to identify activators of the genetic cascade in hemopoietic differentiation, Hromas et al. (1991) used degenerate synthetic oligonucleotides to the conserved zinc finger histidine-cysteine link to probe a human myeloid lambda gt11 cDNA library. One of the cDNA clones obtained hybridized preferentially to mRNA from myeloid cells. Sequence analysis of the coding region for the gene demonstrated 13 zinc finger regions and a glycine-proline-rich region between the fourth and fifth zinc finger domains. The gene was localized to 19q13.2-q13.4 by chromosomal in situ hybridization, confirmed by hybridization of a labeled probe to dot blots of flow-sorted chromosomes. Chromosome 19 contains other zinc finger genes, e.g., ZFP36 (OMIM Ref. No. 190700), which is located at 19q13.1. The new zinc finger gene, which they designated MZF-1 for 'myeloid zinc finger,' was preferentially expressed in myeloid leukemia cell lines, with the highest mRNA levels noted in cells induced to differentiate with retinoic acid. The ZNF42 gene may be a regulator of transcriptional events during hemopoietic development. The myeloid zinc finger gene 1 (MZF1) is a putative transcription factor of the C2H2 zinc finger gene family. Morris et al. (1995) found that MZF1 regulates the CD34 promoter (OMIM Ref. No. 142230) in a tissue-specific manner. They had previously demonstrated MZF-1 binding sites in the promoters of several genes expressed during myeloid differentiation.

Full details of the abovementioned studies are described in the following publications, the disclosure of which are hereby incorporated by reference:

Hromas, R.; Collins, S. J.; Hickstein, D.; Raskind, W.; Deaven, L. L.; O'Hara, P.; Hagen, F. S.; Kaushansky, K.: A retinoic acid-responsive human zinc finger gene, MZF-1, preferentially expressed in myeloid cells. J. Biol. Chem. 266: 14183-14187, 1991; and Morris, J. F.; Rauscher, F. J., III; Davis, B.; Klemsz, M.; Xu, D.; Tenen, D.; Hromas, R.: The myeloid zinc finger gene, MZF-1, regulates the CD34 promoter in vitro. Blood 86:3640-3647.

Further studies establishing the function and utilities of ZNF42 are found in John Hopkins OMIM database record ID 194550, and in sited publications numbered 522-523 listed in the bibliography section hereinbelow, which are also hereby incorporated by reference. Zinc Finger Protein 74 (Cos52) (ZNF74, Accession NM_003426) is another VGAM173 host target gene. ZNF74 BINDING SITE is HOST TARGET binding site found in the 3' untranslated region of mRNA encoded by ZNF74, corresponding to a HOST TARGET binding site such as BINDING SITE I, BINDING SITE II or BINDING SITE III. Table 2 illustrates the complementarity of the nucleotide sequences of ZNF74 BINDING SITE, designated SEQ ID:9472, to the nucleotide sequence of VGAM173 RNA, herein designated VGAM RNA, also designated SEQ ID:2884.

Another function of VGAM173 is therefore inhibition of Zinc Finger Protein 74 (Cos52) (ZNF74, Accession NM_003426). Accordingly, utilities of VGAM173 include diagnosis, prevention and treatment of diseases and clinical conditions associated with ZNF74. COAS3 (Accession NM_139020) is another VGAM173 host target gene. COAS3 BINDING SITE is HOST TARGET binding site found in the 3' untranslated region of mRNA encoded by COAS3, corresponding to a HOST TARGET binding site such as BINDING SITE I, BINDING SITE II or BINDING SITE III. Table 2 illustrates the complementarity of the nucleotide sequences of COAS3 BINDING SITE, designated SEQ ID:29122, to the nucleotide sequence of VGAM173 RNA, herein designated VGAM RNA, also designated SEQ ID:2884.

Another function of VGAM173 is therefore inhibition of COAS3 (Accession NM_139020). Accordingly, utilities of VGAM173 include diagnosis, prevention and treatment of diseases and clinical conditions associated with COAS3. FLJ10408 (Accession NM_018088) is another VGAM173 host target gene. FLJ10408 BINDING SITE is HOST TARGET binding site found in the 5' untranslated region of mRNA encoded by FLJ10408, corresponding to a HOST TARGET binding site such as BINDING SITE I, BINDING SITE II or BINDING SITE III. Table 2 illustrates the complementarity of the nucleotide sequences of FLJ10408 BINDING SITE, designated SEQ ID:19850, to the nucleotide sequence of VGAM173 RNA, herein designated VGAM RNA, also designated SEQ ID:2884.

Another function of VGAM173 is therefore inhibition of FLJ10408 (Accession NM_018088). Accordingly, utilities of VGAM173 include diagnosis, prevention and treatment of diseases and clinical conditions associated with FLJ10408. FLJ12707 (Accession NM_022067) is another VGAM173 host target gene. FLJ12707 BINDING SITE is HOST TARGET binding site found in the 3' untranslated region of mRNA encoded by FLJ12707, corresponding to a HOST TARGET binding site such as BINDING SITE I, BINDING SITE II or BINDING SITE III. Table 2 illustrates the complementarity of the nucleotide sequences of FLJ12707 BINDING SITE, designated SEQ ID:22609, to the nucleotide sequence of VGAM173 RNA, herein designated VGAM RNA, also designated SEQ ID:2884.

Another function of VGAM173 is therefore inhibition of FLJ12707 (Accession NM_022067). Accordingly, utilities of VGAM173 include diagnosis, prevention and treatment of diseases and clinical conditions associated with FLJ12707.

FLJ13204 (Accession NM_024761) is another VGAM173 host target gene. FLJ13204 BINDING SITE is HOST TARGET binding site found in the 3' untranslated region of mRNA encoded by FLJ13204, corresponding to a HOST TARGET binding site such as BINDING SITE I, BINDING SITE II or BINDING SITE III. Table 2 illustrates the complementarity of the nucleotide sequences of FLJ13204 BINDING SITE, designated SEQ ID:24115, to the nucleotide sequence of VGAM173 RNA, herein designated VGAM RNA, also designated SEQ ID:2884.

Another function of VGAM173 is therefore inhibition of FLJ13204 (Accession NM_024761). Accordingly, utilities of VGAM173 include diagnosis, prevention and treatment of diseases and clinical conditions associated with FLJ13204. Interleukin 18 Binding Protein (IL18BP, Accession NM_005699) is another VGAM173 host target gene. IL18BP BINDING SITE is HOST TARGET binding site found in the 3' untranslated region of mRNA encoded by IL18BP, corresponding to a HOST TARGET binding site such as BINDING SITE I, BINDING SITE II or BINDING SITE III. Table 2 illustrates the complementarity of the nucleotide sequences of IL18BP BINDING SITE, designated SEQ ID:12251, to the nucleotide sequence of VGAM173 RNA, herein designated VGAM RNA, also designated SEQ ID:2884.

Another function of VGAM173 is therefore inhibition of Interleukin 18 Binding Protein (IL18BP, Accession NM_005699). Accordingly, utilities of VGAM173 include diagnosis, prevention and treatment of diseases and clinical conditions associated with IL18BP. KIAA0089 (Accession XM_046056) is another VGAM173 host target gene. KIAA0089 BINDING SITE is HOST TARGET binding site found in the 3' untranslated region of mRNA encoded by KIAA0089, corresponding to a HOST TARGET binding site such as BINDING SITE I, BINDING SITE II or BINDING SITE III. Table 2 illustrates the complementarity of the nucleotide sequences of KIAA0089 BINDING SITE, designated SEQ ID:34664, to the nucleotide sequence of VGAM173 RNA, herein designated VGAM RNA, also designated SEQ ID:2884.

Another function of VGAM173 is therefore inhibition of KIAA0089 (Accession XM_046056). Accordingly, utilities of VGAM173 include diagnosis, prevention and treatment of diseases and clinical conditions associated with KIAA0089. KIAA0410 (Accession NM_014778) is another VGAM173 host target gene. KIAA0410 BINDING SITE is HOST TARGET binding site found in the 3' untranslated region of mRNA encoded by KIAA0410, corresponding to a HOST TARGET binding site such as BINDING SITE I, BINDING SITE II or BINDING SITE III. Table 2 illustrates the complementarity of the nucleotide sequences of KIAA0410 BINDING SITE, designated SEQ ID:16618, to the nucleotide sequence of VGAM173 RNA, herein designated VGAM RNA, also designated SEQ ID:2884.

Another function of VGAM173 is therefore inhibition of KIAA0410 (Accession NM_014778). Accordingly, utilities of VGAM173 include diagnosis, prevention and treatment of diseases and clinical conditions associated with KIAA0410. KIAA0459 (Accession XM_027862) is another VGAM173 host target gene. KIAA0459 BINDING SITE is HOST TARGET binding site found in the 3' untranslated region of mRNA encoded by KIAA0459, corresponding to a HOST TARGET binding site such as BINDING SITE I, BINDING SITE II or BINDING SITE III. Table 2 illustrates the complementarity of the nucleotide sequences of KIAA0459 BINDING SITE, designated SEQ ID:30573, to the nucleotide sequence of VGAM173 RNA, herein designated VGAM RNA, also designated SEQ ID:2884.

Another function of VGAM173 is therefore inhibition of KIAA0459 (Accession XM_027862). Accordingly, utilities of VGAM173 include diagnosis, prevention and treatment of diseases and clinical conditions associated with KIAA0459. KIAA0534 (Accession XM_049349) is another VGAM173 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35383, to the nucleotide sequence of VGAM173 RNA, herein designated VGAM RNA, also designated SEQ ID:2884.

Another function of VGAM173 is therefore inhibition of KIAA0534 (Accession XM_049349). Accordingly, utilities of VGAM173 include diagnosis, prevention and treatment of diseases and clinical conditions associated with KIAA0534. KIAA1755 (Accession XM_028810) is another VGAM173 host target gene. KIAA1755 BINDING SITE is HOST TARGET binding site found in the 3' untranslated region of mRNA encoded by KIAA1755, corresponding to a HOST TARGET binding site such as BINDING SITE I, BINDING SITE II or BINDING SITE III. Table 2 illustrates the complementarity of the nucleotide sequences of KIAA1755 BINDING SITE, designated SEQ ID:30749, to the nucleotide sequence of VGAM173 RNA, herein designated VGAM RNA, also designated SEQ ID:2884.

Another function of VGAM173 is therefore inhibition of KIAA1755 (Accession XM_028810). Accordingly, utilities of VGAM173 include diagnosis, prevention and treatment of diseases and clinical conditions associated with KIAA1755. MGC9753 (Accession NM_033419) is another VGAM173 host target gene. MGC9753 BINDING SITE is HOST TARGET binding site found in the 3' untranslated region of mRNA encoded by MGC9753, corresponding to a HOST TARGET binding site such as BINDING SITE I, BINDING SITE II or BINDING SITE III. Table 2 illustrates the complementarity of the nucleotide sequences of MGC9753 BINDING SITE, designated SEQ ID:27241, to the nucleotide sequence of VGAM173 RNA, herein designated VGAM RNA, also designated SEQ ID:2884.

Another function of VGAM173 is therefore inhibition of MGC9753 (Accession NM_033419). Accordingly, utilities of VGAM173 include diagnosis, prevention and treatment of diseases and clinical conditions associated with MGC9753. MPPE1 (Accession NM_023075) is another VGAM173 host target gene. MPPE1 BINDING SITE is HOST TARGET binding site found in the 5' untranslated region of mRNA encoded by MPPE1, corresponding to a HOST TARGET binding site such as BINDING SITE I, BINDING SITE II or BINDING SITE III. Table 2 illustrates the complementarity of the nucleotide sequences of MPPE1 BINDING SITE, designated SEQ ID:23332, to the nucleotide sequence of VGAM173 RNA, herein designated VGAM RNA, also designated SEQ ID:2884.

Another function of VGAM173 is therefore inhibition of MPPE1 (Accession NM_023075). Accordingly, utilities of VGAM173 include diagnosis, prevention and treatment of diseases and clinical conditions associated with MPPE1. Phospholipid Scramblase 3 (PLSCR3, Accession NM_020360) is another VGAM173 host target gene. PLSCR3 BINDING SITE1 and PLSCR3 BINDING SITE2 are HOST TARGET binding sites found in untranslated regions of mRNA encoded by PLSCR3, corresponding to HOST TARGET binding sites such as BINDING SITE I, BINDING SITE II or BINDING SITE III. Table 2 illustrates the complementarity of the nucleotide sequences of PLSCR3 BINDING SITE1 and PLSCR3 BINDING SITE2, designated SEQ ID:21632 and SEQ ID:43637 respectively, to the nucleotide sequence of VGAM173 RNA, herein designated VGAM RNA, also designated SEQ ID:2884.

Another function of VGAM173 is therefore inhibition of Phospholipid Scramblase 3 (PLSCR3, Accession NM_020360). Accordingly, utilities of VGAM173 include diagnosis, prevention and treatment of diseases and clinical conditions associated with PLSCR3. Ribosomal Protein S6 Kinase, 90 kDa, Polypeptide 4 (RPS6KA4, Accession NM_003942) is another VGAM173 host target gene. RPS6KA4 BINDING SITE is HOST TARGET binding site found in the 3' untranslated region of mRNA encoded by RPS6KA4, corresponding to a HOST TARGET binding site such as BINDING SITE I, BINDING SITE II or BINDING SITE III. Table 2 illustrates the complementarity of the nucleotide sequences of RPS6KA4 BINDING SITE, designated SEQ ID:10054, to the nucleotide sequence of VGAM173 RNA, herein designated VGAM RNA, also designated SEQ ID:2884.

Another function of VGAM173 is therefore inhibition of Ribosomal Protein S6 Kinase, 90 kDa, Polypeptide 4 (RPS6KA4, Accession NM_003942). Accordingly, utilities of VGAM173 include diagnosis, prevention and treatment of diseases and clinical conditions associated with RPS6KA4. SET Binding Protein 1 (SETBP1, Accession NM_015559) is another VGAM173 host target gene. SETBP1 BINDING SITE is HOST TARGET binding site found in the 3' untranslated region of mRNA encoded by SETBP1, corresponding to a HOST TARGET binding site such as BINDING SITE I, BINDING SITE II or BINDING SITE III. Table 2 illustrates the complementarity of the nucleotide sequences of SETBP1 BINDING SITE, designated SEQ ID:17825, to the nucleotide sequence of VGAM173 RNA, herein designated VGAM RNA, also designated SEQ ID:2884.

Another function of VGAM173 is therefore inhibition of SET Binding Protein 1 (SETBP1, Accession NM_015559). Accordingly, utilities of VGAM173 include diagnosis, prevention and treatment of diseases and clinical conditions associated with SETBP1. LOC113523 (Accession XM_054378) is another VGAM173 host target gene. LOC113523 BINDING SITE is HOST TARGET binding site found in the 3' untranslated region of mRNA encoded by LOC113523, corresponding to a HOST TARGET binding site such as BINDING SITE I, BINDING SITE II or BINDING SITE III. Table 2 illustrates the complementarity of the nucleotide sequences of LOC113523 BINDING SITE, designated SEQ ID:36157, to the nucleotide sequence of VGAM173 RNA, herein designated VGAM RNA, also designated SEQ ID:2884.

Another function of VGAM173 is therefore inhibition of LOC113523 (Accession XM_054378). Accordingly, utilities of VGAM173 include diagnosis, prevention and treatment of diseases and clinical conditions associated with LOC113523. LOC124987 (Accession XM_064384) is another VGAM173 host target gene. LOC124987 BINDING SITE is HOST TARGET binding site found in the 5' untranslated region of mRNA encoded by LOC124987, corresponding to a HOST TARGET binding site such as BINDING SITE I, BINDING SITE II or BINDING SITE III. Table 2 illustrates the complementarity of the nucleotide sequences of LOC124987 BINDING SITE, designated SEQ ID:37265, to the nucleotide sequence of VGAM173 RNA, herein designated VGAM RNA, also designated SEQ ID:2884.

Another function of VGAM173 is therefore inhibition of LOC124987 (Accession XM_064384). Accordingly, utilities of VGAM173 include diagnosis, prevention and treatment of diseases and clinical conditions associated with LOC124987. LOC127281 (Accession XM_059128) is another VGAM173 host target gene. LOC127281 BINDING SITE is HOST TARGET binding site found in the 3' untranslated region of mRNA encoded by LOC127281, corresponding to a HOST TARGET binding site such as BINDING SITE I, BINDING SITE II or BINDING SITE III. Table 2 illustrates the complementarity of the nucleotide sequences of LOC127281 BINDING SITE, designated SEQ ID:36888, to the nucleotide sequence of VGAM173 RNA, herein designated VGAM RNA, also designated SEQ ID:2884.

Another function of VGAM173 is therefore inhibition of LOC127281 (Accession XM_059128). Accordingly, utilities of VGAM173 include diagnosis, prevention and treatment of diseases and clinical conditions associated with LOC127281. LOC143425 (Accession XM_113695) is another VGAM173 host target gene. LOC143425 BINDING SITE is HOST TARGET binding site found in the 3' untranslated region of mRNA encoded by LOC143425, corresponding to a HOST TARGET binding site such as BINDING SITE I, BINDING SITE II or BINDING SITE III. Table 2 illustrates the complementarity of the nucleotide sequences of LOC143425 BINDING SITE, designated SEQ ID:42353, to the nucleotide sequence of VGAM173 RNA, herein designated VGAM RNA, also designated SEQ ID:2884.

Another function of VGAM173 is therefore inhibition of LOC143425 (Accession XM_113695). Accordingly, utilities of VGAM173 include diagnosis, prevention and treatment of diseases and clinical conditions associated with LOC143425. LOC145195 (Accession XM_096731) is another VGAM173 host target gene. LOC145195 BINDING SITE is HOST TARGET binding site found in the 3' untranslated region of mRNA encoded by LOC145195, corresponding to a HOST TARGET binding site such as BINDING SITE I, BINDING SITE II or BINDING SITE III. Table 2 illustrates the complementarity of the nucleotide sequences of LOC145195 BINDING SITE, designated SEQ ID:40514, to the nucleotide sequence of VGAM173 RNA, herein designated VGAM RNA, also designated SEQ ID:2884.

Another function of VGAM173 is therefore inhibition of LOC145195 (Accession XM_096731). Accordingly, utilities of VGAM173 include diagnosis, prevention and treatment of diseases and clinical conditions associated with LOC145195. LOC145719 (Accession XM_096848) is another VGAM173 host target gene. LOC145719 BINDING SITE is HOST TARGET binding site found in the 5' untranslated region of mRNA encoded by LOC145719, corresponding to a HOST TARGET binding site such as BINDING SITE I, BINDING SITE II or BINDING SITE III. Table 2 illustrates the complementarity of the nucleotide sequences of LOC145719 BINDING SITE, designated SEQ ID:40574, to the nucleotide sequence of VGAM173 RNA, herein designated VGAM RNA, also designated SEQ ID:2884.

Another function of VGAM173 is therefore inhibition of LOC145719 (Accession XM_096848). Accordingly, utilities of VGAM173 include diagnosis, prevention and treatment of diseases and clinical conditions associated with LOC145719. LOC145720 (Accession XM_096846) is another VGAM173 host target gene. LOC145720 BINDING SITE is HOST TARGET binding site found in the 5' untranslated region of mRNA encoded by LOC145720, corresponding to a HOST TARGET binding site such as BINDING SITE I, BINDING SITE II or BINDING SITE III. Table 2 illustrates the complementarity of the nucleotide sequences of LOC145720 BINDING SITE, designated SEQ ID:40563, to the nucleotide sequence of VGAM173 RNA, herein designated VGAM RNA, also designated SEQ ID:2884.

Another function of VGAM173 is therefore inhibition of LOC145720 (Accession XM_096846). Accordingly, utilities of VGAM173 include diagnosis, prevention and treatment of diseases and clinical conditions associated with LOC145720. LOC148029 (Accession XM_086014) is another VGAM173 host target gene. LOC148029 BINDING SITE is HOST TARGET binding site found in the 5' untranslated region of mRNA encoded by LOC148029, corresponding to a HOST TARGET binding site such as BINDING SITE I, BINDING SITE II or BINDING SITE III. Table 2 illustrates the complementarity of the nucleotide sequences of LOC148029 BINDING SITE, designated SEQ ID:38444, to the nucleotide sequence of VGAM173 RNA, herein designated VGAM RNA, also designated SEQ ID:2884.

Another function of VGAM173 is therefore inhibition of LOC148029 (Accession XM_086014). Accordingly, utilities of VGAM173 include diagnosis, prevention and treatment of diseases and clinical conditions associated with LOC148029. LOC150290 (Accession XM_086863) is another VGAM173 host target gene. LOC150290 BINDING SITE is HOST TARGET binding site found in the 3' untranslated region of mRNA encoded by LOC150290, corresponding to a HOST TARGET binding site such as BINDING SITE I, BINDING SITE II or BINDING SITE III. Table 2 illustrates the complementarity of the nucleotide sequences of LOC150290 BINDING SITE, designated SEQ ID:38932, to the nucleotide sequence of VGAM173 RNA, herein designated VGAM RNA, also designated SEQ ID:2884.

Another function of VGAM173 is therefore inhibition of LOC150290 (Accession XM_086863). Accordingly, utilities of VGAM173 include diagnosis, prevention and treatment of diseases and clinical conditions associated with LOC150290. LOC152698 (Accession XM_017241) is another VGAM173 host target gene. LOC152698 BINDING SITE is HOST TARGET binding site found in the 5' untranslated region of mRNA encoded by LOC152698, corresponding to a HOST TARGET binding site such as BINDING SITE I, BINDING SITE II or BINDING SITE III. Table 2 illustrates the complementarity of the nucleotide sequences of LOC152698 BINDING SITE, designated SEQ ID:30312, to the nucleotide sequence of VGAM173 RNA, herein designated VGAM RNA, also designated SEQ ID:2884.

Another function of VGAM173 is therefore inhibition of LOC152698 (Accession XM_017241). Accordingly, utilities of VGAM173 include diagnosis, prevention and treatment of diseases and clinical conditions associated with LOC152698. LOC153894 (Accession XM_087796) is another VGAM173 host target gene. LOC153894 BINDING SITE is HOST TARGET binding site found in the 5' untranslated region of mRNA encoded by LOC153894, corresponding to a HOST TARGET binding site such as BINDING SITE I, BINDING SITE II or BINDING SITE III. Table 2 illustrates the complementarity of the nucleotide sequences of LOC153894 BINDING SITE, designated SEQ ID:39427, to the nucleotide sequence of VGAM173 RNA, herein designated VGAM RNA, also designated SEQ ID:2884.

Another function of VGAM173 is therefore inhibition of LOC153894 (Accession XM_087796). Accordingly, utilities of VGAM173 include diagnosis, prevention and treatment of diseases and clinical conditions associated with LOC153894. LOC157280 (Accession XM_058301) is another VGAM173 host target gene. LOC157280 BINDING SITE is HOST TARGET binding site found in the 5' untranslated region of mRNA encoded by LOC157280, corresponding to a HOST TARGET binding site such as BINDING SITE I, BINDING SITE II or BINDING SITE III. Table 2 illustrates the complementarity of the nucleotide sequences of LOC157280 BINDING SITE, designated SEQ ID:36593, to the nucleotide sequence of VGAM173 RNA, herein designated VGAM RNA, also designated SEQ ID:2884.

Another function of VGAM173 is therefore inhibition of LOC157280 (Accession XM_058301). Accordingly, utilities of VGAM173 include diagnosis, prevention and treatment of diseases and clinical conditions associated with LOC157280. LOC158062 (Accession XM_098861) is another VGAM173 host target gene. LOC158062 BINDING SITE is HOST TARGET binding site found in the 3' untranslated region of mRNA encoded by LOC158062, corresponding to a HOST TARGET binding site such as BINDING SITE I, BINDING SITE II or BINDING SITE III. Table 2 illustrates the complementarity of the nucleotide sequences of LOC158062 BINDING SITE, designated SEQ ID:41914, to the nucleotide sequence of VGAM173 RNA, herein designated VGAM RNA, also designated SEQ ID:2884.

Another function of VGAM173 is therefore inhibition of LOC158062 (Accession XM_098861). Accordingly, utilities of VGAM173 include diagnosis, prevention and treatment of diseases and clinical conditions associated with LOC158062. LOC197114 (Accession XM_116987) is another VGAM173 host target gene. LOC197114 BINDING SITE is HOST TARGET binding site found in the 5' untranslated region of mRNA encoded by LOC197114, corresponding to a HOST TARGET binding site such as BINDING SITE I, BINDING SITE II or BINDING SITE III. Table 2 illustrates the complementarity of the nucleotide sequences of LOC197114 BINDING SITE, designated SEQ ID:43187, to the nucleotide sequence of VGAM173 RNA, herein designated VGAM RNA, also designated SEQ ID:2884.

Another function of VGAM173 is therefore inhibition of LOC197114 (Accession XM_116987). Accordingly, utilities of VGAM173 include diagnosis, prevention and treatment of diseases and clinical conditions associated with LOC197114. LOC200933 (Accession XM_117294) is another VGAM173 host target gene. LOC200933 BINDING SITE is HOST TARGET binding site found in the 5' untranslated region of mRNA encoded by LOC200933, corresponding to a HOST TARGET binding site such as BINDING SITE I, BINDING SITE II or BINDING SITE III. Table 2 illustrates the complementarity of the nucleotide sequences of LOC200933 BINDING SITE, designated SEQ ID:43365, to the nucleotide sequence of VGAM173 RNA, herein designated VGAM RNA, also designated SEQ ID:2884.

Another function of VGAM173 is therefore inhibition of LOC200933 (Accession XM_117294). Accordingly, utilities of VGAM173 include diagnosis, prevention and treatment of diseases and clinical conditions associated with LOC200933. LOC255448 (Accession XM_170623) is another VGAM173 host target gene. LOC255448 BINDING SITE is HOST TARGET binding site found in the 5' untranslated region of mRNA encoded by LOC255448, corresponding to a HOST TARGET binding site such as BINDING SITE I, BINDING SITE II or BINDING SITE III. Table 2 illustrates the complementarity of the nucleotide sequences of LOC255448 BINDING SITE, designated SEQ ID:45403, to the nucleotide sequence of VGAM173 RNA, herein designated VGAM RNA, also designated SEQ ID:2884.

Another function of VGAM173 is therefore inhibition of LOC255448 (Accession XM_170623). Accordingly, utilities of VGAM173 include diagnosis, prevention and treatment of diseases and clinical conditions associated with LOC255448. LOC91050 (Accession XM_035703) is another VGAM173 host target gene. LOC91050 BINDING SITE is HOST TAR- GET binding site found in the 3' untranslated region of mRNA encoded by LOC91050, corresponding to a HOST TARGET binding site such as BINDING SITE I, BINDING SITE II or BINDING SITE III. Table 2 illustrates the complementarity of the nucleotide sequences of LOC91050 BINDING SITE, designated SEQ ID:32335, to the nucleotide sequence of VGAM173 RNA, herein designated VGAM RNA, also designated SEQ ID:2884.

Another function of VGAM173 is therefore inhibition of LOC91050 (Accession XM_035703). Accordingly, utilities of VGAM173 include diagnosis, prevention and treatment of diseases and clinical conditions associated with LOC91050. FIG. 1 further provides a conceptual description of a novel bioinformatically detected viral gene of the present invention, referred to here as Viral Genomic Address Messenger 174 (VGAM174) viral gene, which modulates expression of respective host target genes thereof, the function and utility of which host target genes is known in the art.

VGAM174 is a novel bioinformatically detected regulatory, non protein coding, viral micro RNA (miRNA) gene. The method by which VGAM174 was detected is described hereinabove with reference to FIGS. 1-8.

VGAM174 gene, herein designated VGAM GENE, is a viral gene contained in the genome of Shrimp White Spot Syndrome Virus (white spot bacilliform virus). VGAM174 host target gene, herein designated VGAM HOST TARGET GENE, is a human gene contained in the human genome.

VGAM174 gene encodes a VGAM174 precursor RNA, herein designated VGAM PRECURSOR RNA. Similar to other miRNA genes, and unlike most ordinary genes, VGAM174 precursor RNA does not encode a protein. A nucleotide sequence identical or highly similar to the nucleotide sequence of VGAM174 precursor RNA is designated SEQ ID:160, and is provided hereinbelow with reference to the sequence listing part. Nucleotide sequence SEQ ID:160 is located at position 86647 relative to the genome of Shrimp White Spot Syndrome Virus (white spot bacilliform virus).

VGAM174 precursor RNA folds onto itself, forming VGAM174 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM174 folded precursor RNA into VGAM174 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM174 RNA is designated SEQ ID:2885, and is provided hereinbelow with reference to the sequence listing part.

VGAM174 host target gene, herein designated VGAM HOST TARGET GENE, encodes a corresponding messenger RNA, VGAM174 host target RNA, herein designated VGAM HOST TARGET RNA. VGAM174 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM174 RNA, herein designated VGAM RNA, binds complementarily to one or more host target binding sites located in untranslated regions of VGAM174 host target RNA, herein designated VGAM HOST TARGET RNA. This complementary binding is due to the fact that the nucleotide sequence of VGAM174 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM174 RNA, herein designated VGAM RNA, may have a different number of host target binding sites in untranslated regions of a VGAM174 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM174 RNA, herein designated VGAM RNA, to host target binding sites on VGAM174 host target RNA, herein designated VGAM HOST TARGET RNA, such as BINDING SITE I, BINDING SITE II and BINDING SITE III, inhibits translation of VGAM174 host target RNA into VGAM174 host target protein, herein designated VGAM HOST TARGET PROTEIN. VGAM host target protein is therefore outlined by a broken line.

It is appreciated that VGAM174 host target gene, herein designated VGAM HOST TARGET GENE, in fact represents a plurality of VGAM174 host target genes. The mRNA of each one of this plurality of VGAM174 host target genes comprises one or more host target binding sites, each having a nucleotide sequence which is at least partly complementary to VGAM174 RNA, herein designated VGAM RNA, and which when bound by VGAM174 RNA causes inhibition of translation of respective one or more VGAM174 host target proteins.

It is further appreciated by one skilled in the art that the mode of translational inhibition illustrated by FIG. 1 with specific reference to translational inhibition exerted by VGAM174 gene, herein designated VGAM GENE, on one or more VGAM174 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM174 is inhibition of expression of host target genes, as part of a novel viral mechanism of attacking a host. Accordingly, utilities of VGAM174 include diagnosis, prevention and treatment of viral infection by Shrimp White Spot Syndrome Virus (white spot bacilliform virus). Specific functions, and accordingly utilities, of VGAM174 correlate with, and may be deduced from, the identity of the host target genes which VGAM174 binds and inhibits, and the function of these host target genes, as elaborated hereinbelow.

Nucleotide sequences of the VGAM174 precursor RNA, herein designated VGAM PRECURSOR RNA, and of the 'diced' VGAM174 RNA, herein designated VGAM RNA, and a schematic representation of the secondary folding of VGAM174 folded precursor RNA, herein designated VGAM FOLDED PRECURSOR RNA, of VGAM174 are further described hereinbelow with reference to Table 1.

Nucleotide sequences of host target binding sites, such as BINDING SITE-I, BINDING SITE-II and BINDING SITE-III of FIG. 1, found on VGAM174 host target RNA, and schematic representation of the complementarity of each of these host target binding sites to VGAM174 RNA, herein designated VGAM RNA, are described hereinbelow with reference to Table 2.

As mentioned hereinabove with reference to FIG. 1, a function of VGAM174 gene, herein designated VGAM is inhibition of expression of VGAM174 target genes. It is appreciated that specific functions, and accordingly utilities, of VGAM174 correlate with, and may be deduced from, the identity of the target genes which VGAM174 binds and inhibits, and the function of these target genes, as elaborated hereinbelow.

D8S2298E (Accession NM_005671) is a VGAM174 host target gene. D8S2298E BINDING SITE is HOST TARGET binding site found in the 3' untranslated region of mRNA encoded by D8S2298E, corresponding to a HOST TARGET binding site such as BINDING SITE I, BINDING SITE II or BINDING SITE III. Table 2 illustrates the complementarity of the nucleotide sequences of D8S2298E BINDING SITE, designated SEQ ID:12229, to the nucleotide sequence of VGAM174 RNA, herein designated VGAM RNA, also designated SEQ ID:2885.

A function of VGAM174 is therefore inhibition of D8S2298E (Accession NM_005671). Accordingly, utilities of VGAM174 include diagnosis, prevention and treatment of diseases and clinical conditions associated with D8S2298E. Hepatocyte Growth Factor (hepapoietin A; scatter factor) (HGF, Accession XM_168542) is another VGAM174 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45224, to the nucleotide sequence of VGAM174 RNA, herein designated VGAM RNA, also designated SEQ ID:2885.

Another function of VGAM174 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM174 include diagnosis, prevention and treatment of diseases and clinical conditions associated with HGF. The function of HGF has been established by previous studies. Kilby et al. (1996) found that the protein and mRNA for both hepatocyte growth factor and its receptor (MET) are present in third trimester placentas, suggesting that HGF serves as a paracrine mediator to control placental development and growth. B cells develop in the bone marrow from progenitor cells that have been designated pre-pro-B cells, pro-B cells (no immunoglobulin, or Ig, chains chosen), pre-B cells (which have selected a heavy chain but not a light chain), and finally B cells (which express both heavy and light chains of the Ig molecule). Differentiation of pre-pro-B cells to pro-B cells requires signaling through IL7 receptor (IL7R; 146661) mediated by the pre-pro-B cell growth-stimulating factor (PPBSF), which consists of IL7 (OMIM Ref. No. 146660) and a 30-kD protein cofactor. By amino acid sequencing and RT-PCR analysis, Lai and Goldschneider (2001) determined that the PPBSF cofactor is the 30-kD beta chain of HGF (HGFB) produced independently of the 60-kD alpha chain of HGF. Formation of an IL7-HGFB heterodimer requires the presence of heparin sulfate. Functional analysis indicated that either IL7 or HGFB can maintain the viability of pre-pro-B cells, but only the heterodimer can stimulate their proliferation and differentiation into pro-B cells. Lai and Goldschneider (2001) concluded that PPBSF is a novel form of cytokine, a hybrid cytokine, consisting of the bioactive components of 2 unrelated cytokines. They proposed that through its heparin-binding and mitogenic properties, HGFB enables IL7 to participate in cognate interactions at the stromal cell surface and transduce signals effectively at low levels of IL7R. Animal model experiments lend further support to the function of HGF. Schmidt et al. (1995) and Uehara et al. (1995) produced targeted disruption of the HGF gene in mice and found that mice lacking the gene product fail to develop completely and die in utero. The mutation affects the embryonic liver, which is reduced in size and shows extensive loss of parenchymal cells. In addition, development of the placenta, particularly of trophoblast cells, is impaired. HGF/SF is thought to mediate a signal exchange between the mesenchyme and epithelia during mouse development. Both the HGF gene and the gene for its receptor, the product of the MET proto-oncogene, are expressed in many tissues during embryonic development and in the adult. The findings of these studies indicate that HGF/SF is an essential mediator of allantoic mesenchyme-trophoblastic epithelia interaction required for placental organogenesis.

It is appreciated that the abovementioned animal model for HGF is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lai, L.; Goldschneider, I.: Cutting edge: identification of a hybrid cytokine consisting of IL-7 and the beta-chain of the hepatocyte growth factor/scatter factor. J. Immun. 167:3550-3554, 2001; and Schmidt, C.; Bladt, F.; Goedecke, S.; Brinkmann, V.; Zschiesche, W.; Sharpe, M.; Gherardi, E.; Birchmeier, C.: Scatter factor/hepatocyte growth factor is essential for liver developme.

Further studies establishing the function and utilities of HGF are found in John Hopkins OMIM database record ID 142409, and in sited publications numbered 11303-11306, 2603, 11307-1131 and 12288-11319 listed in the bibliography section hereinbelow, which are also hereby incorporated by reference. KIAA1755 (Accession XM_028810) is another VGAM174 host target gene. KIAA1755 BINDING SITE is HOST TARGET binding site found in the 3' untranslated region of mRNA encoded by KIAA1755, corresponding to a HOST TARGET binding site such as BINDING SITE I, BINDING SITE II or BINDING SITE III. Table 2 illustrates the complementarity of the nucleotide sequences of KIAA1755 BINDING SITE, designated SEQ ID:30745, to the nucleotide sequence of VGAM174 RNA, herein designated VGAM RNA, also designated SEQ ID:2885.

Another function of VGAM174 is therefore inhibition of KIAA1755 (Accession XM_028810). Accordingly, utilities of VGAM174 include diagnosis, prevention and treatment of diseases and clinical conditions associated with KIAA1755. LOC145474 (Accession XM_085147) is another VGAM174 host target gene. LOC145474 BINDING SITE is HOST TARGET binding site found in the 3' untranslated region of mRNA encoded by LOC145474, corresponding to a HOST TARGET binding site such as BINDING SITE I, BINDING SITE II or BINDING SITE III. Table 2 illustrates the complementarity of the nucleotide sequences of LOC145474 BINDING SITE, designated SEQ ID:37867, to the nucleotide sequence of VGAM174 RNA, herein designated VGAM RNA, also designated SEQ ID:2885.

Another function of VGAM174 is therefore inhibition of LOC145474 (Accession XM_085147). Accordingly, utilities of VGAM174 include diagnosis, prevention and treatment of diseases and clinical conditions associated with LOC145474. LOC256283 (Accession XM_173105) is another VGAM174 host target gene. LOC256283 BINDING SITE is HOST TARGET binding site found in the 5' untranslated region of mRNA encoded by LOC256283, corresponding to a HOST TARGET binding site such as BINDING SITE I, BINDING SITE II or BINDING SITE III. Table 2 illustrates the complementarity of the nucleotide sequences of LOC256283 BINDING SITE, designated SEQ ID:46362, to the nucleotide sequence of VGAM174 RNA, herein designated VGAM RNA, also designated SEQ ID:2885.

Another function of VGAM174 is therefore inhibition of LOC256283 (Accession XM_173105). Accordingly, utilities of VGAM174 include diagnosis, prevention and treatment of diseases and clinical conditions associated with LOC256283. LOC90593 (Accession XM_032815) is another VGAM174 host target gene. LOC90593 BINDING SITE is HOST TARGET binding site found in the 3' untranslated region of mRNA encoded by LOC90593, corresponding to a HOST TARGET binding site such as BINDING SITE I, BINDING SITE II or BINDING SITE III. Table 2 illustrates the complementarity of the nucleotide sequences of LOC90593 BINDING SITE, designated SEQ ID:31763, to the nucleotide sequence of VGAM174 RNA, herein designated VGAM RNA, also designated SEQ ID:2885.

Another function of VGAM174 is therefore inhibition of LOC90593 (Accession XM_032815). Accordingly, utilities of VGAM174 include diagnosis, prevention and treatment of diseases and clinical conditions associated with LOC90593. FIG. 1 further provides a conceptual description of a novel bioinformatically detected viral gene of the present invention, referred to here as Viral Genomic Address Messenger 175 (VGAM175) viral gene, which modulates expression of respective host target genes thereof, the function and utility of which host target genes is known in the art.

VGAM175 is a novel bioinformatically detected regulatory, non protein coding, viral micro RNA (miRNA) gene. The method by which VGAM175 was detected is described hereinabove with reference to FIGS. 1-8.

VGAM175 gene, herein designated VGAM GENE, is a viral gene contained in the genome of Shrimp White Spot Syndrome Virus (white spot bacilliform virus). VGAM175 host target gene, herein designated VGAM HOST TARGET GENE, is a human gene contained in the human genome.

VGAM175 gene encodes a VGAM175 precursor RNA, herein designated VGAM PRECURSOR RNA. Similar to other miRNA genes, and unlike most ordinary genes, VGAM175 precursor RNA does not encode a protein. A nucleotide sequence identical or highly similar to the nucleotide sequence of VGAM175 precursor RNA is designated SEQ ID:161, and is provided hereinbelow with reference to the sequence listing part. Nucleotide sequence SEQ ID:161 is located at position 207866 relative to the genome of Shrimp White Spot Syndrome Virus (white spot bacilliform virus).

VGAM175 precursor RNA folds onto itself, forming VGAM175 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM175 folded precursor RNA into VGAM175 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM175 RNA is designated SEQ ID:2886, and is provided hereinbelow with reference to the sequence listing part.

VGAM175 host target gene, herein designated VGAM HOST TARGET GENE, encodes a corresponding messenger RNA, VGAM175 host target RNA, herein designated VGAM HOST TARGET RNA. VGAM175 host target RNA comprises three regions, as is typical of mRNA of a protein coding gene: a 5' untranslated region, a protein coding region and a 3' untranslated region, designated 5'UTR, PROTEIN CODING and 3'UTR respectively.

VGAM175 RNA, herein designated VGAM RNA, binds complementarily to one or more host target binding sites located in untranslated regions of VGAM175 host target RNA, herein designated VGAM HOST TARGET RNA. This complementary binding is due to the fact that the nucleotide sequence of VGAM175 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM175 RNA, herein designated VGAM RNA, may have a different number of host target binding sites in untranslated regions of a VGAM175 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5''UTR region, or in both 3'UTR and 5'UTR regions.

The complementary binding of VGAM175 RNA, herein designated VGAM RNA, to host target binding sites on VGAM175 host target RNA, herein designated VGAM HOST TARGET RNA, such as BINDING SITE I, BINDING SITE II and BINDING SITE III, inhibits translation of VGAM175 host target RNA into VGAM175 host target protein, herein designated VGAM HOST TARGET PROTEIN. VGAM host target protein is therefore outlined by a broken line.

It is appreciated that VGAM175 host target gene, herein designated VGAM HOST TARGET GENE, in fact represents a plurality of VGAM175 host target genes. The mRNA of each one of this plurality of VGAM175 host target genes comprises one or more host target binding sites, each having a nucleotide sequence which is at least partly complementary to VGAM175 RNA, herein designated VGAM RNA, and which when bound by VGAM175 RNA causes inhibition of translation of respective one or more VGAM175 host target proteins.

It is further appreciated by one skilled in the art that the mode of translational inhibition illustrated by FIG. 1 with specific reference to translational inhibition exerted by VGAM175 gene, herein designated VGAM GENE, on one or more VGAM175 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM175 is inhibition of expression of host target genes, as part of a novel viral mechanism of attacking a host. Accordingly, utilities of VGAM175 include diagnosis, prevention and treatment of viral infection by Shrimp White Spot Syndrome Virus (white spot bacilliform virus). Specific functions, and accordingly utilities, of VGAM175 correlate with, and may be deduced from, the identity of the host target genes which VGAM175 binds and inhibits, and the function of these host target genes, as elaborated hereinbelow.

Nucleotide sequences of the VGAM175 precursor RNA, herein designated VGAM PRECURSOR RNA, and of the 'diced' VGAM175 RNA, herein designated VGAM RNA, and a schematic representation of the secondary folding of VGAM175 folded precursor RNA, herein designated VGAM FOLDED PRECURSOR RNA, of VGAM175 are further described hereinbelow with reference to Table 1.

Nucleotide sequences of host target binding sites, such as BINDING SITE-I, BINDING SITE-II and BINDING SITE-III of FIG. 1, found on VGAM175 host target RNA, and schematic representation of the complementarity of each of these host target binding sites to VGAM175 RNA, herein designated VGAM RNA, are described hereinbelow with reference to Table 2.

As mentioned hereinabove with reference to FIG. 1, a function of VGAM175 gene, herein designated VGAM is inhibition of expression of VGAM175 target genes. It is appreciated that specific functions, and accordingly utilities, of VGAM175 correlate with, and may be deduced from, the identity of the target genes which VGAM175 binds and inhibits, and the function of these target genes, as elaborated hereinbelow.

Amine Oxidase, Copper Containing 3 (vascular adhesion protein 1) (AOC3, Accession NM_003734) is a VGAM175 host target gene. AOC3 BINDING SITE is HOST TARGET binding site found in the 3' untranslated region of mRNA encoded by AOC3, corresponding to a HOST TARGET binding site such as BINDING SITE I, BINDING SITE II or BINDING SITE III. Table 2 illustrates the complementarity of the nucleotide sequences of AOC3 BINDING SITE, designated SEQ ID:9823, to the nucleotide sequence of VGAM175 RNA, herein designated VGAM RNA, also designated SEQ ID:2886.

A function of VGAM175 is therefore inhibition of Amine Oxidase, Copper Containing 3 (vascular adhesion protein 1) (AOC3, Accession NM_003734), a gene which catalyze the oxidative conversion of amines to aldehydes in the presence of copper and quinone cofactor. Accordingly, utilities of VGAM175 include diagnosis, prevention and treatment of diseases and clinical conditions associated with AOC3. The function of AOC3 has been established by previous studies. Zhang and McIntire (1996) cloned a novel amine oxidase, HPAO, from a human placenta cDNA library. The gene encodes a 763-amino acid polypeptide which contains a secretory signal sequence. Morris et al. (1997) cloned a partial rat cDNA which they identified as the rat homolog of HPAO. They reported that the product is a major protein on the adipocyte plasma membrane. Smith et al. (1998) studied vascular adhesion protein-1 (VAP1), a molecule expressed in endothelial cells that mediates binding of lymphocytes. These authors noted that the amino acid sequence of VAP1 was identical to that of HPAO. Expression studies revealed that the VAP1 protein has adhesive properties and also has functional monoamine oxidase activity. Northern blot analysis detected a 4.1-kb mRNA in a wide variety of human tissues.

Full details of the abovementioned studies are described in the following publications, the disclosure of which are hereby incorporated by reference:

Morris, N. J.; Ducret, A.; Aebersold, R.; Ross, S. A.; Keller, S. R.; Lienhard, G. E.: Membrane amine oxidase cloning and identification as a major protein in the adipocyte plasma membrane. J. Biol. Chem. 272:9388-9392, 1997; and Smith, D. J.; Salmi, M.; Bono, P.; Hellman, J.; Leu, T.; Jalkanen, S.: Cloning of vascular adhesion protein 1 reveals a novel multifunctional adhesion molecule. J. Exp. Med. 188: 17-27.

Further studies establishing the function and utilities of AOC3 are found in John Hopkins OMIM database record ID 603735, and in sited publications numbered 6313-631 and 5187-5188 listed in the bibliography section hereinbelow, which are also hereby incorporated by reference. Bardet-Biedl Syndrome 4 (BBS4, Accession NM_033028) is another VGAM175 host target gene. BBS4 BINDING SITE is HOST TARGET binding site found in the 3' untranslated region of mRNA encoded by BBS4, corresponding to a HOST TARGET binding site such as BINDING SITE I, BINDING SITE II or BINDING SITE III. Table 2 illustrates the complementarity of the nucleotide sequences of BBS4 BINDING SITE, designated SEQ ID:26921, to the nucleotide sequence of VGAM175 RNA, herein designated VGAM RNA, also designated SEQ ID:2886.

Another function of VGAM175 is therefore inhibition of Bardet-Biedl Syndrome 4 (BBS4, Accession NM_033028). Accordingly, utilities of VGAM175 include diagnosis, prevention and treatment of diseases and clinical conditions associated with BBS4. Chromosome X Open Reading Frame 6 (CXorf6, Accession NM_005491) is another VGAM175 host target gene. CXorf6 BINDING SITE is HOST TARGET binding site found in the 3' untranslated region of mRNA encoded by CXorf6, corresponding to a HOST TARGET binding site such as BINDING SITE I, BINDING SITE II or BINDING SITE III. Table 2 illustrates the complementarity of the nucleotide sequences of CXorf6 BINDING SITE, designated SEQ ID:11994, to the nucleotide sequence of VGAM175 RNA, herein designated VGAM RNA, also designated SEQ ID:2886.

Another function of VGAM175 is therefore inhibition of Chromosome X Open Reading Frame 6 (CXorf6, Accession NM_005491). Accordingly, utilities of VGAM175 include diagnosis, prevention and treatment of diseases and clinical conditions associated with CXorf6. Dystrophia Myotonica-protein Kinase (DMPK, Accession NM_004409) is another VGAM175 host target gene. DMPK BINDING SITE is HOST TARGET binding site found in the 5' untranslated region of mRNA encoded by DMPK, corresponding to a HOST TARGET binding site such as BINDING SITE I, BINDING SITE II or BINDING SITE III. Table 2 illustrates the complementarity of the nucleotide sequences of DMPK BINDING SITE, designated SEQ ID:10663, to the nucleotide sequence of VGAM175 RNA, herein designated VGAM RNA, also designated SEQ ID:2886.

Another function of VGAM175 is therefore inhibition of Dystrophia Myotonica-protein Kinase (DMPK, Accession NM_004409). Accordingly, utilities of VGAM175 include diagnosis, prevention and treatment of diseases and clinical conditions associated with DMPK. Milk Fat Globule-EGF Factor 8 Protein (MFGE8, Accession NM_005928) is another VGAM175 host target gene. MFGE8 BINDING SITE is HOST TARGET binding site found in the 3' untranslated region of mRNA encoded by MFGE8, corresponding to a HOST TARGET binding site such as BINDING SITE I, BINDING SITE II or BINDING SITE III. Table 2 illustrates the complementarity of the nucleotide sequences of MFGE8 BINDING SITE, designated SEQ ID:12558, to the nucleotide sequence of VGAM175 RNA, herein designated VGAM RNA, also designated SEQ ID:2886.

Another function of VGAM175 is therefore inhibition of Milk Fat Globule-EGF Factor 8 Protein (MFGE8, Accession NM_005928), a gene which links apoptotic cells to phagocytes. Accordingly, utilities of VGAM175 include diagnosis, prevention and treatment of diseases and clinical conditions associated with MFGE8. The function of MFGE8 has been established by previous studies. Stubbs et al. (1990) identified a cDNA for a mouse mammary epithelial cell surface protein, which they called milk fat globule-EGF factor 8 (MFGE8) because of its regions of sequence similarity to epidermal growth factor (EGF) and blood clotting factors VIII (OMIM Ref. No. 306700) and V (OMIM Ref. No. 227400). Larocca et al. (1991) raised monoclonal antibodies to a 46-kD human milk fat globule protein, later to be identified as the human homolog of MFGE8, and isolated a partial cDNA by immunoscreening a lambda gt11 human breast cDNA library. Collins et al. (1997) cloned the MFGE8 gene from a human infant cDNA brain library. The gene predicts a protein of 387 amino acids of which 263 (68%) are identical or conserved matches with the mouse protein. Hanayama et al. (2002) found that MFGE8 is a factor that links apoptotic cells to phagocytes. MFGE8 specifically bound to apoptotic cells by recognizing aminophospholipids such as phosphatidylserine. MFGE8, when engaged by phospholipids, bound to cells via its RGD (arg-gly-asp) motif. It bound particularly strongly to cells expressing alpha-V-beta-3 integrin (see OMIM Ref. No. 193210). The NIH3T3 cell transformants that expressed a high level of alpha-V-beta-3 integrin engulfed apoptotic cells when MFGE8 was added. MFGE8 carrying a point mutation in the RGD motif behaved as a dominant-negative form, and inhibited the phagocytosis of apoptotic cells by peritoneal macrophages in vitro and in vivo. Hanayama et al. (2002) concluded that MFGE8 secreted from activated macrophages binds to apoptotic cells and brings them to phagocytes for engulfment.

Full details of the abovementioned studies are described in the following publications, the disclosure of which are hereby incorporated by reference:

Stubbs, J. D.; Lekutis, C.; Singer, K. L.; Bui, A.; Yuzuki, D.; Srinivasan, U.; Parry, G.: cDNA cloning of a mouse mammary epithelial cell surface protein reveals the existence of epidermal growth factor-like domains linked to factor VIII-like sequences. Proc. Nat. Acad. Sci. 87:8417-8421, 1990; and Hanayama, R.; Tanaka, M.; Miwa, K.; Shinohara, A.; Iwamatsu, A.; Nagata, S.: Identification of a factor that links apoptotic cells to phagocytes. Nature 417:182-187, 2002.

Further studies establishing the function and utilities of MFGE8 are found in John Hopkins OMIM database record ID 602281, and in sited publications numbered 8571-8576 listed in the bibliography section hereinbelow, which are also hereby incorporated by reference. Myeloid/lymphoid Or Mixed-lineage Leukemia (trithorax homolog, Drosophila); Translocated To, 7 (MLLT7, Accession NM_005938) is another VGAM175 host target gene. MLLT7 BINDING SITE is HOST TARGET binding site found in the 3' untranslated region of mRNA encoded by MLLT7, corresponding to a HOST TARGET binding site such as BINDING SITE I, BINDING SITE II or BINDING SITE III. Table 2 illustrates the complementarity of the nucleotide sequences of MLLT7 BINDING SITE, designated SEQ ID:12575, to the nucleotide sequence of VGAM175 RNA, herein designated VGAM RNA, also designated SEQ ID:2886.

Another function of VGAM175 is therefore inhibition of Myeloid/lymphoid Or Mixed-lineage Leukemia (trithorax homolog, Drosophila); Translocated To, 7 (MLLT7, Accession NM_005938), a gene which is a Member of the forkhead family. Accordingly, utilities of VGAM175 include diagnosis, prevention and treatment of diseases and clinical conditions associated with MLLT7. The function of MLLT7 has been established by previous studies. A breakpoint in 11q23 is frequently involved in translocations underlying hematologic malignancies, especially acute leukemias. The human homolog of Drosophila 'trithorax,' symbolized MLL (OMIM Ref. No. 159555), for 'myeloid-lymphoid leukemia' or 'mixed lineage leukemia,' is located at this breakpoint. Part of the MLL gene is fused with other genes in leukemia: AF4 (OMIM Ref. No. 159557) in t (4;11)(q21; q23); ENL (OMIM Ref. No. 159556) in t (11;19)(q23; p13.3), AF9 (OMIM Ref. No. 159558) in t (9;11)(p22; q23), AF6 (OMIM Ref. No. 159559) in t (6;11)(q27; q23), and AFX in t (X;11)(q13; q23). Translocations at 11q23 result in the formation of 2 derivative chromosomes that encode chimeric transcripts. The der (11) transcript contains 5-prime MLL sequences fused to 3-prime sequences of the gene located on the partner chromosome, whereas the other derivative chromosome contains the 5-prime sequence of the partner gene potentially fused to the 3-prime sequence of MLL. However, in 25% of patients, translocations are associated with deletions of MLL sequence that is 3-prime to the breakpoint. Thus, in these cases, a fusion transcript from the other derivative chromosome cannot be formed. In addition, analysis of complex 11q23 translocations revealed that the der (11) junction is always conserved. These data indicate that the fusion transcript encoded by the der (11) must be critical to leukemogenesis. Corral et al. (1993) found from a partial sequence of a fusion between MLL and the AFX1 gene from the X chromosome that the latter is rich in ser/pro codons, like the ENL mRNA. Corral et al. (1993) concluded that heterogeneous 11q23 abnormalities may cause attachment of ser/pro-rich segments to the N terminus of MLL, lacking the zinc finger region, and that translocations occur in early hematopoietic cells, before commitment to distinct lineages. Parry et al. (1994) cloned and sequenced the t (X;11) breakpoint region from a cell line established from an infant with acute lymphocytic leukemia. The AFX1 gene (also symbolized MLLT7) was expressed in a variety of cell types. Sequence analysis indicated a high degree of homology between AFX1 and the forkhead family of transcription factors. The high degree of identity within the forkhead region and the lack of homology outside that region suggested to the authors that AFX1 represents a novel forkhead family member. It was predicted that a chimeric fusion protein that altered DNA binding activity would result from the translocation.

Full details of the abovementioned studies are described in the following publications, the disclosure of which are hereby incorporated by reference:

Corral, J.; Forster, A.; Thompson, S.; Lampert, F.; Kaneko, Y.; Slater, R.; Kroes, W. G.; van der Schoot, C. E.; Ludwig, W.-D.; Karpas, A.; Pocock, C.; Cotter, F.; Rabbitts, T. H.: Acute leukemias of different lineages have similar MLL gene fusions encoding related chimeric proteins resulting from chromosomal translocation. Proc. Nat. Acad. Sci. 90:8538-8542, 1993; and Parry, P.; Wei, Y.; Evans, G.: Cloning and characterization of the t (X;11) breakpoint from a leukemic cell line identify a new member of the forkhead gene family. Genes Chromosomes Can.

Further studies establishing the function and utilities of MLLT7 are found in John Hopkins OMIM database record ID 300033, and in sited publications numbered 916 and 12194-8709 listed in the bibliography section hereinbelow, which are also hereby incorporated by reference. Protein Kinase, CAMP-dependent, Catalytic, Alpha (PRKACA, Accession NM_002730) is another VGAM175 host target gene. PRKACA BINDING SITE is HOST TARGET binding site found in the 3' untranslated region of mRNA encoded by PRKACA, corresponding to a HOST TARGET binding site such as BINDING SITE I, BINDING SITE II or BINDING SITE III. Table 2 illustrates the complementarity of the nucleotide sequences of PRKACA BINDING SITE, designated SEQ ID:8598, to the nucleotide sequence of VGAM175 RNA, herein designated VGAM RNA, also designated SEQ ID:2886.

Another function of VGAM175 is therefore inhibition of Protein Kinase, CAMP-dependent, Catalytic, Alpha (PRKACA, Accession NM_002730), a gene which phosphorylates target proteins on serine or threonine residues. Accordingly, utilities of VGAM175 include diagnosis, prevention and treatment of diseases and clinical conditions associated with PRKACA. The function of PRKACA has been established by previous studies. Most of the effects of cAMP in the eukaryotic cell are mediated through the phosphorylation of target proteins on serine or threonine residues by the cAMP-dependent protein kinase (EC 2.7.1.37). The inactive cAMP-dependent protein kinase is a tetramer composed of 2 regulatory and 2 catalytic subunits. The cooperative binding of 4 molecules of cAMP dissociates the enzyme in a regulatory subunit dimer and 2 free active catalytic subunits. In the human, 4 different regulatory subunits (PRKAR1A, 188830; PRKAR1B, 176911; PRKAR2A, 176910; and PRKAR2B, 176912) and 3 catalytic subunits (PRKACA; PRKACB, 176892; and PRKACG 176893) have been identified. Using PCR and Southern blot analysis, Tasken et al. (1996) assigned the PRKACA gene to chromosome 19. By 2-color fluorescence in situ hybridization, they regionalized the assignment to 19p13.1. Animal model experiments lend further support to the function of PRKACA. The intracellular second messenger cAMP affects cell physiology by directly interacting with effector molecules that include cyclic nucleotide-gated ion channels, cAMP-regulated G protein exchange factors, and cAMP-dependent protein kinases (PKA). Two catalytic subunits, C-alpha (OMIM Ref. No. PRKACA) and C-beta (OMIM Ref. No. PRKACB), are expressed in the mouse and mediate the effects of PKA. Skalhegg et al. (2002) generated a null mutation in the major catalytic subunit of PKA, C-alpha, and observed early postnatal lethality in the majority of C-alpha knockout mice. Surprisingly, a small percentage of C-alpha knockout mice, although runted, survived to adulthood. This growth retardation was not due to decreased GH (OMIM Ref. No. 139250) production but did correlate with a reduction in IGF1 (OMIM Ref. No. 147440) mRNA in the liver and diminished production of the major urinary proteins in kidney. In these animals, compensatory increases in C-beta levels occurred in brain whereas many tissues, including skeletal muscle, heart, and sperm, contained less than 10% of the normal PKA activity. Analysis of sperm in C-alpha knockout males revealed that spermatogenesis progressed normally but that mature sperm had defective forward motility It is appreciated that the abovementioned animal model for PRKACA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Skalhegg, B. S.; Huang, Y.; Su, T.; Idzerda, R. L.; McKnight, G. S.; Burton, K. A.: Mutation of the C-alpha subunit of PKA leads to growth retardation and sperm dysfunction. Molec. Endocr. 16:630-639, 2002; and Tasken, K.; Solberg, R.; Zhao, Y.; Hansson, V.; Jahnsen, T.; Siciliano, M. J.: The gene encoding the catalytic subunit C-alpha of cAMP-dependent protein kinase (locus PRKACA) localize.

Further studies establishing the function and utilities of PRKACA are found in John Hopkins OMIM database record ID 601639, and in sited publications numbered 6683-6684 listed in the bibliography section hereinbelow, which are also hereby incorporated by reference. TEM6 (Accession NM_022748) is another VGAM175 host target gene. TEM6 BINDING SITE is HOST TARGET binding site found in the 3' untranslated region of mRNA encoded by TEM6, corresponding to a HOST TARGET binding site such as BINDING SITE I, BINDING SITE II or BINDING SITE III. Table 2 illustrates the complementarity of the nucleotide sequences of TEM6 BINDING SITE, designated SEQ ID:22961, to the nucleotide sequence of VGAM175 RNA, herein designated VGAM RNA, also designated SEQ ID:2886.

Another function of VGAM175 is therefore inhibition of TEM6 (Accession NM_022748), a gene which displayes elevated expression during tumor angiogenesis. Accordingly, utilities of VGAM175 include diagnosis, prevention and treatment of diseases and clinical conditions associated with TEM6. The function of TEM6 has been established by previous studies. Using serial analysis of gene expression (SAGE), St Croix et al. (2000) identified partial cDNAs corresponding to several tumor endothelial markers (TEMs) that displayed elevated expression during tumor angiogenesis. Among the genes they identified was TEM6. Using database searches and 5-prime RACE, Carson-Walter et al. (2001) derived sequences covering the entire TEM6 coding region, which encodes a 261-amino acid protein.

Full details of the abovementioned studies are described in the following publications, the disclosure of which are hereby incorporated by reference:

Carson-Walter, E. B.; Watkins, D. N.; Nanda, A.; Vogelstein, B.; Kinzler, K. W.; St. Croix, B.: Cell surface tumor endothelial markers are conserved in mice and human S. Cancer Res. 61:6649-6655, 2001; and St. Croix, B.; Rago, C.; Velculescu, V.; Traverso, G.; Romans, K. E.; Montgomery, E.; Lal, A.; Riggins, G. J.; Lengauer, C.; Vogelstein, B.; Kinzler, K. W.: Genes expressed in human t.

Further studies establishing the function and utilities of TEM6 are found in John Hopkins OMIM database record ID 606825, and in sited publications numbered 689 and 6907 listed in the bibliography section hereinbelow, which are also hereby incorporated by reference. Transcription Factor AP-4 (activating enhancer binding protein 4) (TFAP4, Accession NM_003223) is another VGAM175 host target gene. TFAP4 BINDING SITE is HOST TARGET binding site found in the 3' untranslated region of mRNA encoded by TFAP4, corresponding to a HOST TARGET binding site such as BINDING SITE I, BINDING SITE II or BINDING SITE III. Table 2 illustrates the complementarity of the nucleotide sequences of TFAP4 BINDING SITE, designated SEQ ID:9224, to the nucleotide sequence of VGAM175 RNA, herein designated VGAM RNA, also designated SEQ ID:2886.

Another function of VGAM175 is therefore inhibition of Transcription Factor AP-4 (activating enhancer binding protein 4) (TFAP4, Accession NM_003223), a gene which activates both viral and cellular genes by binding to the symmetrical dna sequence 5'-cagctg-3'. Accordingly, utilities of VGAM175 include diagnosis, prevention and treatment of diseases and clinical conditions associated with TFAP4. The function of TFAP4 has been established by previous studies. Transcription factors of the basic helix-loop-helix-zipper (bHLH-Zip) family contain a basic domain, which is used for DNA binding, and HLH and Zip domains, which are used for oligomerization. Transcription factor AP4 activates both viral and cellular genes by binding to the symmetrical DNA sequence CAGCTG (Mermod et al., 1988; Hu et al., 1990). By interspecific backcross analysis, Steingrimsson et al. (1995) mapped the Tfap4 gene to mouse chromosome 16, close to the gene for sperm protamine P1 (PRM1; 182880). Since the PRM1 is located on chromosome 16p13.3 in the human, they suggested that TFAP4 is probably on human chromosome 16. The International Radiation Hybrid Mapping Consortium mapped the TFAP4 gene to chromosome 16p13 (sts-S73885).

Full details of the abovementioned studies are described in the following publications, the disclosure of which are hereby incorporated by reference:

Hu, Y.-F.; Luscher, B.; Admon, A.; Mermod, N.; Tjian, R.: Transcription factor AP-4 contains multiple dimerization domains that regulate dimer specificity. Genes Dev. 4:1741-1752, 1990; and Steingrimsson, E.; Sawadogo, M.; Gilbert, D. J.; Zervos, A. S.; Brent, R.; Blanar, M. A.; Fisher, D. E.; Copeland, N. G.; Jenkins, N. A.: Murine chromosomal location of five bHLH-Zip tr.

Further studies establishing the function and utilities of TFAP4 are found in John Hopkins OMIM database record ID 600743, and in sited publications numbered 7581-758 and 12617 listed in the bibliography section hereinbelow, which are also hereby incorporated by reference. Tumor Necrosis Factor (TNF superfamily, member 2) (TNF, Accession XM_165823) is another VGAM175 host target gene. TNF BINDING SITE is HOST TARGET binding site found in the 3' untranslated region of mRNA encoded by TNF, corresponding to a HOST TARGET binding site such as BINDING SITE I, BINDING SITE II or BINDING SITE III. Table 2 illustrates the complementarity of the nucleotide sequences of TNF BINDING SITE, designated SEQ ID:43771, to the nucleotide sequence of VGAM175 RNA, herein designated VGAM RNA, also designated SEQ ID:2886.

Another function of VGAM175 is therefore inhibition of Tumor Necrosis Factor (TNF superfamily, member 2) (TNF, Accession XM_165823), a gene which mediates proinflammatory responses and apoptosis. Accordingly, utilities of VGAM175 include diagnosis, prevention and treatment of diseases and clinical conditions associated with TNF. The function of TNF has been established by previous studies. Ruuls and Sedgwick (1999) reviewed the problem of unlinking TNF biology from that of the MHC. Dysregulation and, in particular, overproduction of TNF have been implicated in a variety of human diseases, including sepsis, cerebral malaria, and autoimmune diseases such as multiple sclerosis (OMIM Ref. No. 126200), rheumatoid arthritis, systemic lupus erythematosus (OMIM Ref. No. 152700), and Crohn disease (see OMIM Ref. No. 266600), as well as cancer. Susceptibility to many of these diseases is thought to have a genetic basis, and the TNF gene is considered a candidate predisposing gene. However, unraveling the importance of genetic variation in the TNF gene to disease susceptibility or severity is complicated by its location within the MHC, a highly polymorphic region that encodes numerous genes involved in immunologic responses. Ruuls and Sedgwick (1999) reviewed studies that had analyzed the contribution of TNF and related genes to susceptibility to human disease, and they discussed how the presence of the TNF gene within the MHC may potentially complicate the interpretation of studies in animal models in which the TNF gene is experimentally manipulated. Animal model experiments lend further support to the function of TNF. Bruce et al. (1996) used targeted gene disruption to generate mice lacking either the p55 or the p75 TNF receptors; mice lacking both p55 and p75 were generated from crosses of the singly deficient mice. The TNFR-deficient (TNFR-KO) mice exhibited no overt phenotype under unchallenged conditions. Bruce et al. (1996) reported that damage to neurons caused by focal cerebral ischemia and epileptic seizures was exacerbated in the TNFR-KO mice, indicating that TNF serves a neuroprotective function. Their studies indicated that TNF protects neurons by stimulating antioxidative pathways. Injury-induced microglial activation was suppressed in TNFR-KO mice. They concluded that drugs which target TNF signaling pathways may prove beneficial in treating stroke or traumatic brain injury.

It is appreciated that the abovementioned animal model for TNF is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ruuls, S. R.; Sedgwick, J. D.: Unlinking tumor necrosis factor biology from the major histocompatibility complex: lessons from human genetics and animal models. Am. J. Hum. Genet. 65:294-301, 1999; and Bruce, A. J.; Boling, W.; Kindy, M. S.; Peschon, J.; Kraemer, P. J.; Carpenter, M. K.; Holtsberg, F. W.; Mattson, M. P.: Altered neuronal and microglial responses to excitotoxic and is.

Further studies establishing the function and utilities of TNF are found in John Hopkins OMIM database record ID 191160, and in sited publications numbered 663, 9569-9574, 451, 9575, 12122-9577, 3684, 12303-9579, 3051, 9580-9582, 2981, 9583-9584, 9798, 10523-10539, 10542, 12143-10541, 10543-10544, 12305-1054 and 10567 listed in the bibliography section hereinbelow, which are also hereby incorporated by reference. Chromosome 20 Open Reading Frame 130 (C20orf130, Accession XM_029741) is another VGAM175 host target gene. C20orf130 BINDING SITE is HOST TARGET binding site found in the 3' untranslated region of mRNA encoded by C20orf130, corresponding to a HOST TARGET binding site such as BINDING SITE I, BINDING SITE II or BINDING SITE III. Table 2 illustrates the complementarity of the nucleotide sequences of C20orf130 BINDING SITE, designated SEQ ID:30936, to the nucleotide sequence of VGAM175 RNA, herein designated VGAM RNA, also designated SEQ ID:2886.

Another function of VGAM175 is therefore inhibition of Chromosome 20 Open Reading Frame 130 (C20orf130, Accession XM_029741). Accordingly, utilities of VGAM175 include diagnosis, prevention and treatment of diseases and clinical conditions associated with C20orf130. DKFZP434K1772 (Accession XM_041936) is another VGAM175 host target gene. DKFZP434K1772 BINDING SITE is HOST TARGET binding site found in the 3' untranslated region of mRNA encoded by DKFZP434K1772, corresponding to a HOST TARGET binding site such as BINDING SITE I, BINDING SITE II or BINDING SITE III. Table 2 illustrates the complementarity of the nucleotide sequences of DKFZP434K1772 BINDING SITE, designated SEQ ID:33630, to the nucleotide sequence of VGAM175 RNA, herein designated VGAM RNA, also designated SEQ ID:2886.

Another function of VGAM175 is therefore inhibition of DKFZP434K1772 (Accession XM_041936). Accordingly, utilities of VGAM175 include diagnosis, prevention and treatment of diseases and clinical conditions associated with DKFZP434K1772. DKFZP564F0522 (Accession XM_043885) is another VGAM175 host target gene. DKFZP564F0522 BINDING SITE is HOST TARGET binding site found in the 3' untranslated region of mRNA encoded by DKFZP564F0522, corresponding to a HOST TARGET binding site such as BINDING SITE I, BINDING SITE II or BINDING SITE III. Table 2 illustrates the complementarity of the nucleotide sequences of DKFZP564F0522 BINDING SITE, designated SEQ ID:34041, to the nucleotide sequence of VGAM175 RNA, herein designated VGAM RNA, also designated SEQ ID:2886.

Another function of VGAM175 is therefore inhibition of DKFZP564F0522 (Accession XM_043885). Accordingly, utilities of VGAM175 include diagnosis, prevention and treatment of diseases and clinical conditions associated with DKFZP564F0522. FLJ10661 (Accession NM_018172) is another VGAM175 host target gene. FLJ10661 BINDING SITE is HOST TARGET binding site found in the 3' untranslated region of mRNA encoded by FLJ10661, corresponding to a HOST TARGET binding site such as BINDING SITE I, BINDING SITE II or BINDING SITE III. Table 2 illustrates the complementarity of the nucleotide sequences of FLJ10661 BINDING SITE, designated SEQ ID:19995, to the nucleotide sequence of VGAM175 RNA, herein designated VGAM RNA, also designated SEQ ID:2886.

Another function of VGAM175 is therefore inhibition of FLJ10661 (Accession NM_018172). Accordingly, utilities of VGAM175 include diagnosis, prevention and treatment of diseases and clinical conditions associated with FLJ10661. FLJ14950 (Accession NM_032865) is another VGAM175 host target gene. FLJ14950 BINDING SITE is HOST TARGET binding site found in the 5' untranslated region of mRNA encoded by FLJ14950, corresponding to a HOST TARGET binding site such as BINDING SITE I, BINDING SITE II or BINDING SITE III. Table 2 illustrates the complementarity of the nucleotide sequences of FLJ14950 BINDING SITE, designated SEQ ID:26676, to the nucleotide sequence of VGAM175 RNA, herein designated VGAM RNA, also designated SEQ ID:2886.

Another function of VGAM175 is therefore inhibition of FLJ14950 (Accession NM_032865). Accordingly, utilities of VGAM175 include diagnosis, prevention and treatment of diseases and clinical conditions associated with FLJ14950. FLJ20847 (Accession XM_170677) is another VGAM175 host target gene. FLJ20847 BINDING SITE is HOST TARGET binding site found in the 5' untranslated region of mRNA encoded by FLJ20847, corresponding to a HOST TARGET binding site such as BINDING SITE I, BINDING SITE II or BINDING SITE III. Table 2 illustrates the complementarity of the nucleotide sequences of FLJ20847 BINDING SITE, designated SEQ ID:45458, to the nucleotide sequence of VGAM175 RNA, herein designated VGAM RNA, also designated SEQ ID:2886.

Another function of VGAM175 is therefore inhibition of FLJ20847 (Accession XM_170677). Accordingly, utilities of VGAM175 include diagnosis, prevention and treatment of diseases and clinical conditions associated with FLJ20847. KIAA1100 (Accession NM_014901) is another VGAM175 host target gene. KIAA1100 BINDING SITE is HOST TARGET binding site found in the 5' untranslated region of mRNA encoded by KIAA1100, corresponding to a HOST TARGET binding site such as BINDING SITE I, BINDING SITE II or BINDING SITE III. Table 2 illustrates the complementarity of the nucleotide sequences of KIAA1100 BINDING SITE, designated SEQ ID:17084, to the nucleotide sequence of VGAM175 RNA, herein designated VGAM RNA, also designated SEQ ID:2886.

Another function of VGAM175 is therefore inhibition of KIAA1100 (Accession NM_014901). Accordingly, utilities of VGAM175 include diagnosis, prevention and treatment of diseases and clinical conditions associated with KIAA1100. Mitochondrial Ribosomal Protein L20 (MRPL20, Accession NM_017971) is another VGAM175 host target gene. MRPL20 BINDING SITE is HOST TARGET binding site found in the 3' untranslated region of mRNA encoded by MRPL20, corresponding to a HOST TARGET binding site such as BINDING SITE I, BINDING SITE II or BINDING SITE III. Table 2 illustrates the complementarity of the nucleotide sequences of MRPL20 BINDING SITE, designated SEQ ID:19696, to the nucleotide sequence of VGAM175 RNA, herein designated VGAM RNA, also designated SEQ ID:2886.

Another function of VGAM175 is therefore inhibition of Mitochondrial Ribosomal Protein L20 (MRPL20, Accession NM_017971). Accordingly, utilities of VGAM175 include diagnosis, prevention and treatment of diseases and clinical conditions associated with MRPL20. PP1628 (Accession NM_025201) is another VGAM175 host target gene. PP1628 BINDING SITE is HOST TARGET binding site found in the 5' untranslated region of mRNA encoded by PP1628, corresponding to a HOST TARGET binding site such as BINDING SITE I, BINDING SITE II or BINDING SITE III. Table 2 illustrates the complementarity of the nucleotide sequences of PP1628 BINDING SITE, designated SEQ ID:24856, to the nucleotide sequence of VGAM175 RNA, herein designated VGAM RNA, also designated SEQ ID:2886.

Another function of VGAM175 is therefore inhibition of PP1628 (Accession NM_025201). Accordingly, utilities of VGAM175 include diagnosis, prevention and treatment of diseases and clinical conditions associated with PP1628. PRKRI (Accession NM_006260) is another VGAM175 host target gene. PRKRI BINDING SITE is HOST TARGET binding site found in the 5' untranslated region of mRNA encoded by PRKRI, corresponding to a HOST TARGET binding site such as BINDING SITE I, BINDING SITE II or BINDING SITE III. Table 2 illustrates the complementarity of the nucleotide sequences of PRKRI BINDING SITE, designated SEQ ID:12943, to the nucleotide sequence of VGAM175 RNA, herein designated VGAM RNA, also designated SEQ ID:2886.

Another function of VGAM175 is therefore inhibition of PRKRI (Accession NM_006260). Accordingly, utilities of VGAM175 include diagnosis, prevention and treatment of diseases and clinical conditions associated with PRKRI. Sema Domain, Transmembrane Domain (TM), and Cytoplasmic Domain, (semaphorin) 6A (SEMA6A, Accession NM_020796) is another VGAM175 host target gene. SEMA6A BINDING SITE is HOST TARGET binding site found in the 5' untranslated region of mRNA encoded by SEMA6A, corresponding to a HOST TARGET binding site such as BINDING SITE I, BINDING SITE II or BINDING SITE III. Table 2 illustrates the complementarity of the nucleotide sequences of SEMA6A BINDING SITE, designated SEQ ID:21880, to the nucleotide sequence of VGAM175 RNA, herein designated VGAM RNA, also designated SEQ ID:2886.

Another function of VGAM175 is therefore inhibition of Sema Domain, Transmembrane Domain (TM), and Cytoplasmic Domain, (semaphorin) 6A (SEMA6A, Accession NM_020796). Accordingly, utilities of VGAM175 include diagnosis, prevention and treatment of diseases and clinical conditions associated with SEMA6A. Sp2 Transcription Factor (SP2, Accession NM_003110) is another VGAM175 host target gene. SP2 BINDING SITE is HOST TARGET binding site found in the 3' untranslated region of mRNA encoded by SP2, corresponding to a HOST TARGET binding site such as BINDING SITE I, BINDING SITE II or BINDING SITE III. Table 2 illustrates the complementarity of the nucleotide sequences of SP2 BINDING SITE, designated SEQ ID:9080, to the nucleotide sequence of VGAM175 RNA, herein designated VGAM RNA, also designated SEQ ID:2886.

Another function of VGAM175 is therefore inhibition of Sp2 Transcription Factor (SP2, Accession NM_003110). Accordingly, utilities of VGAM175 include diagnosis, prevention and treatment of diseases and clinical conditions associated with SP2. TGFB1-induced Anti-apoptotic Factor 1 (TIAF1, Accession NM_078471) is another VGAM175 host target gene. TIAF1 BINDING SITE is HOST TARGET binding site found in the 3' untranslated region of mRNA encoded by TIAF1, corresponding to a HOST TARGET binding site such as BINDING SITE I, BINDING SITE II or BINDING SITE III. Table 2 illustrates the complementarity of the nucleotide sequences of TIAF1 BINDING SITE, designated SEQ ID:27797, to the nucleotide sequence of VGAM175 RNA, herein designated VGAM RNA, also designated SEQ ID:2886.

Another function of VGAM175 is therefore inhibition of TGFB1-induced Anti-apoptotic Factor 1 (TIAF1, Accession NM_078471). Accordingly, utilities of VGAM175 include diagnosis, prevention and treatment of diseases and clinical conditions associated with TIAF1. LOC124930 (Accession XM_058867) is another VGAM175 host target gene. LOC124930 BINDING SITE is HOST TARGET binding site found in the 3' untranslated region of mRNA encoded by LOC124930, corresponding to a HOST TARGET binding site such as BINDING SITE I, BINDING SITE II or BINDING SITE III. Table 2 illustrates the complementarity of the nucleotide sequences of LOC124930 BINDING SITE, designated SEQ ID:36766, to the nucleotide sequence of VGAM175 RNA, herein designated VGAM RNA, also designated SEQ ID:2886.

Another function of VGAM175 is therefore inhibition of LOC124930 (Accession XM_058867). Accordingly, utilities of VGAM175 include diagnosis, prevention and treatment of diseases and clinical conditions associated with LOC124930. LOC145719 (Accession XM_096848) is another VGAM175 host target gene. LOC145719 BINDING SITE is HOST TARGET binding site found in the 5' untranslated region of mRNA encoded by LOC145719, corresponding to a HOST TARGET binding site such as BINDING SITE I, BINDING SITE II or BINDING SITE III. Table 2 illustrates the complementarity of the nucleotide sequences of LOC145719 BINDING SITE, designated SEQ ID:40573, to the nucleotide sequence of VGAM175 RNA, herein designated VGAM RNA, also designated SEQ ID:2886.

Another function of VGAM175 is therefore inhibition of LOC145719 (Accession XM_096848). Accordingly, utilities of VGAM175 include diagnosis, prevention and treatment of diseases and clinical conditions associated with LOC145719. LOC145720 (Accession XM_096846) is another VGAM175 host target gene. LOC145720 BINDING SITE is HOST TARGET binding site found in the 5' untranslated region of mRNA encoded by LOC145720, corresponding to a HOST TARGET binding site such as BINDING SITE I, BINDING SITE II or BINDING SITE III. Table 2 illustrates the complementarity of the nucleotide sequences of LOC145720 BINDING SITE, designated SEQ ID:40564, to the nucleotide sequence of VGAM175 RNA, herein designated VGAM RNA, also designated SEQ ID:2886.

Another function of VGAM175 is therefore inhibition of LOC145720 (Accession XM_096846). Accordingly, utilities of VGAM175 include diagnosis, prevention and treatment of diseases and clinical conditions associated with LOC145720. LOC145725 (Accession XM_085211) is another VGAM175 host target gene. LOC145725 BINDING SITE is HOST TARGET binding site found in the 3' untranslated region of mRNA encoded by LOC145725, corresponding to a HOST TARGET binding site such as BINDING SITE I, BINDING SITE II or BINDING SITE III. Table 2 illustrates the complementarity of the nucleotide sequences of LOC145725 BINDING SITE, designated SEQ ID:37947, to the nucleotide sequence of VGAM175 RNA, herein designated VGAM RNA, also designated SEQ ID:2886.

Another function of VGAM175 is therefore inhibition of LOC145725 (Accession XM_085211). Accordingly, utilities of VGAM175 include diagnosis, prevention and treatment of diseases and clinical conditions associated with LOC145725. LOC145732 (Accession XM_085218) is another VGAM175 host target gene. LOC145732 BINDING SITE is HOST TARGET binding site found in the 3' untranslated region of mRNA encoded by LOC145732, corresponding to a HOST TARGET binding site such as BINDING SITE I, BINDING SITE II or BINDING SITE III. Table 2 illustrates the complementarity of the nucleotide sequences of LOC145732 BINDING SITE, designated SEQ ID:37956, to the nucleotide sequence of VGAM175 RNA, herein designated VGAM RNA, also designated SEQ ID:2886.

Another function of VGAM175 is therefore inhibition of LOC145732 (Accession XM_085218). Accordingly, utilities of VGAM175 include diagnosis, prevention and treatment of diseases and clinical conditions associated with LOC145732. LOC146562 (Accession NM_139170) is another VGAM175 host target gene. LOC146562 BINDING SITE is HOST TARGET binding site found in the 3' untranslated region of mRNA encoded by LOC146562, corresponding to a HOST TARGET binding site such as BINDING SITE I, BINDING SITE II or BINDING SITE III. Table 2 illustrates the complementarity of the nucleotide sequences of LOC146562 BINDING SITE, designated SEQ ID:29178, to the nucleotide sequence of VGAM175 RNA, herein designated VGAM RNA, also designated SEQ ID:2886.

Another function of VGAM175 is therefore inhibition of LOC146562 (Accession NM_139170). Accordingly, utilities of VGAM175 include diagnosis, prevention and treatment of diseases and clinical conditions associated with LOC146562. LOC151878 (Accession XM_087329) is another VGAM175 host target gene. LOC151878 BINDING SITE is HOST TARGET binding site found in the 5' untranslated region of mRNA encoded by LOC151878, corresponding to a HOST TARGET binding site such as BINDING SITE I, BINDING SITE II or BINDING SITE III. Table 2 illustrates the complementarity of the nucleotide sequences of LOC151878 BINDING SITE, designated SEQ ID:39172, to the nucleotide sequence of VGAM175 RNA, herein designated VGAM RNA, also designated SEQ ID:2886.

Another function of VGAM175 is therefore inhibition of LOC151878 (Accession XM_087329). Accordingly, utilities of VGAM175 include diagnosis, prevention and treatment of diseases and clinical conditions associated with LOC151878. LOC197419 (Accession XM_117035) is another VGAM175 host target gene. LOC197419 BINDING SITE is HOST TARGET binding site found in the 5' untranslated region of mRNA encoded by LOC197419, corresponding to a HOST TARGET binding site such as BINDING SITE I, BINDING SITE II or BINDING SITE III. Table 2 illustrates the complementarity of the nucleotide sequences of LOC197419 BINDING SITE, designated SEQ ID:43209, to the nucleotide sequence of VGAM175 RNA, herein designated VGAM RNA, also designated SEQ ID:2886.

Another function of VGAM175 is therefore inhibition of LOC197419 (Accession XM_117035). Accordingly, utilities of VGAM175 include diagnosis, prevention and treatment of diseases and clinical conditions associated with LOC197419. LOC257551 (Accession XM_175158) is another VGAM175 host target gene. LOC257551 BINDING SITE is HOST TARGET binding site found in the 3' untranslated region of mRNA encoded by LOC257551, corresponding to a HOST TARGET binding site such as BINDING SITE I, BINDING SITE II or BINDING SITE III. Table 2 illustrates the complementarity of the nucleotide sequences of LOC257551 BINDING SITE, designated SEQ ID:46645, to the nucleotide sequence of VGAM175 RNA, herein designated VGAM RNA, also designated SEQ ID:2886.

Another function of VGAM175 is therefore inhibition of LOC257551 (Accession XM_175158). Accordingly, utilities of VGAM175 include diagnosis, prevention and treatment of diseases and clinical conditions associated with LOC257551. LOC257601 (Accession XM_175231) is another VGAM175 host target gene. LOC257601 BINDING SITE is HOST TARGET binding site found in the 3' untranslated region of mRNA encoded by LOC257601, corresponding to a HOST TARGET binding site such as BINDING SITE I, BINDING SITE II or BINDING SITE III. Table 2 illustrates the complementarity of the nucleotide sequences of LOC257601 BINDING SITE, designated SEQ ID:46696, to the nucleotide sequence of VGAM175 RNA, herein designated VGAM RNA, also designated SEQ ID:2886.

Another function of VGAM175 is therefore inhibition of LOC257601 (Accession XM_175231). Accordingly, utilities of VGAM175 include diagnosis, prevention and treatment of diseases and clinical conditions associated with LOC257601. LOC91300 (Accession XM_170568) is another VGAM175 host target gene. LOC91300 BINDING SITE1 and LOC91300 BINDING SITE2 are HOST TARGET binding sites found in untranslated regions of mRNA encoded by LOC91300, corresponding to HOST TARGET binding sites such as BINDING SITE I, BINDING SITE II or BINDING SITE III. Table 2 illustrates the complementarity of the nucleotide sequences of LOC91300 BINDING SITE1 and LOC91300 BINDING SITE2, designated SEQ ID:45386 and SEQ ID:29005 respectively, to the nucleotide sequence of VGAM175 RNA, herein designated VGAM RNA, also designated SEQ ID:2886.

Another function of VGAM175 is therefore inhibition of LOC91300 (Accession XM_170568). Accordingly, utilities of VGAM175 include diagnosis, prevention and treatment of diseases and clinical conditions associated with LOC91300. MAD2 Mitotic Arrest Deficient-like 1 (yeast) (MAD2L1, Accession NM_002358) is another VGAM176 host target gene. MAD2L1 BINDING SITE is HOST TARGET binding site found in the 3' untranslated region of mRNA encoded by MAD2L1, corresponding to a HOST TARGET binding site such as BINDING SITE I, BINDING SITE II or BINDING SITE III. Table 2 illustrates the complementarity of the nucleotide sequences of MAD2L1 BINDING SITE, designated SEQ ID:8170, to the nucleotide sequence of VGAM176 RNA, herein designated VGAM RNA, also designated SEQ ID:2887.

Another function of VGAM176 is therefore inhibition of MAD2 Mitotic Arrest Deficient-like 1 (yeast) (MAD2L1, Accession NM_002358), a gene which may monitor the completeness of the spindle-kinetochore attachment. delays the onset of anaphase when this process is not complete. Accordingly, utilities of VGAM176 include diagnosis, prevention and treatment of diseases and clinical conditions associated with MAD2L1. The function of MAD2L1 has been established by previous studies. Using a yeast 2-hybrid analysis with the cytoplasmic tails of several a disintegrin and metalloproteinase domain (ADAM) proteins as bait, Nelson et al. (1999) found that MAD2L1 interacts strongly with TACE (ADAM17; 603639) but not with ADAM9 (OMIM Ref. No. 602713), which interacts with MAD2L2, or with other ADAMs tested. Further binding analyses defined a 35-amino acid stretch of TACE containing a proline-rich SH3-ligand domain (OMIM Ref. No. PXPXXP) as the interaction site for MAD2L1. Luo et al. (2002) showed that RNA interference-mediated suppression of MAD1 (OMIM Ref. No. 602686) function in mammalian cells caused loss of MAD2 kinetochore localization and impairment of the spindle checkpoint. MAD1 and CDC20 (OMIM Ref. No. 603618) contain MAD2-binding motifs that share a common consensus, and the authors identified a class of MAD2-binding peptides (MBPs) with a similar consensus. Binding of one of these ligands, MBP1, triggered an extensive rearrangement of the tertiary structure of MAD2. MAD2 also underwent a similar striking structural change upon binding to a MAD1 or CDC20 binding motif peptide. These data suggested that, upon checkpoint activation, MAD1 recruits MAD2 to unattached kinetochores and may promote binding of MAD2 to CDC20 Animal model experiments lend further support to the function of MAD2L1. The initiation of chromosome segregation at anaphase is linked by the spindle assembly checkpoint to the completion of chromosome-microtubule attachment during metaphase. To determine the function of the Mad2 protein during normal cell division, Dobles et al. (2000) knocked out the Mad2 gene in mice. They found that embryonic cells lacking Mad2 at embryonic day 5.5, like mad2 yeast, grew normally but were unable to arrest in response to spindle disruption. At embryonic day 6.5, the cells of the epiblast began rapid cell division, and the absence of a checkpoint resulted in widespread chromosome missegregation and apoptosis. In contrast, the postmitotic trophoblast giant cells survived without Mad2. Thus, the spindle assembly checkpoint is required for accurate chromosome segregation in mitotic mouse cells and for embryonic viability, even in the absence of spindle damage. Shonn et al. (2000) characterized the spindle checkpoint in meiosis of S. cerevisiae by comparing wildtype and mad2-deficient yeast. In the absence of the checkpoint, the frequency of meiosis I missegregation increased with increasing chromosome length, reaching 19% for the longest chromosome. Meiosis I nondisjunction in spindle checkpoint mutants could be prevented by delaying the onset of anaphase. In a recombinant-defective mutant, the checkpoint delayed the biochemical events of anaphase I, suggesting that chromosomes that are attached to microtubules but are not under tension can activate the spindle checkpoint. Spindle checkpoint mutants reduced the accuracy of chromosome segregation in meiosis I much more than that in meiosis II, suggesting that checkpoint defects may contribute to Down syndrome (OMIM Ref. No. 190685). Shonn et al. (2000) showed that the budding yeast spindle checkpoint, which is largely dispensable in wildtype mitosis, plays a critical role in meiotic chromosome segregation. They suggested that the difference may reflect the different chromosome linkages in mitosis and meiosis I. In mitosis, sister chromatid cohesion forces sister kinetochores to face opposite spindle poles. In meiosis I, homologs are linked at sites of recombination that can be far from the kinetochores, creating a floppy linkage. If the nearest recombination event is further from the centromere on long chromosomes, this idea may explain why long chromosomes preferentially nondisjoin in checkpoint-defective cells. Michel et al. (2001) reported that deletion of one MAD2 allele results in a defective mitotic checkpoint in both human cancer cells and murine primary embryonic fibroblasts. Checkpoint-defective cells show premature sister chromatid separation in the presence of spindle inhibitors and an elevated rate of chromosome missegregation events in the absence of these agents. Furthermore, Mad2 +/- mice develop lung tumors at high rates after long latencies, implicating defects in the mitotic checkpoint in tumorigenesis It is appreciated that the abovementioned animal model for MAD2L1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Michel, L. S.; Liberal, V.; Chatterjee, A.; Kirchwegger, R.; Pasche, B.; Gerald, W.; Dobles, M.; Sorger, P. K.; Murty, V. V. V. S.; Benezra, R.: MAD2 haplo-insufficiency causes premature anaphase and chromosome instability in mammalian cells. Nature 409:355-359, 2001; and Luo, X.; Tang, Z.; Rizo, J.; Yu, H.: The Mad2 spindle checkpoint protein undergoes similar major conformational changes upon binding to either Mad1 or Cdc20. Molec. Cell 9:59-71, 2002.

Further studies establishing the function and utilities of MAD2L1 are found in John Hopkins OMIM database record ID 601467, and in sited publications numbered 2758-2768 listed in the bibliography section hereinbelow, which are also hereby incorporated by reference. Macrophage Scavenger Receptor 1 (MSR1, Accession NM_138715) is another VGAM176 host target gene. MSR1 BINDING SITE1 and MSR1 BINDING SITE2 are HOST TARGET binding sites found in untranslated regions of mRNA encoded by MSR1, corresponding to HOST TARGET binding sites such as BINDING SITE I, BINDING SITE II or BINDING SITE III. Table 2 illustrates the complementarity of the nucleotide sequences of MSR1 BINDING SITE1 and MSR1 BINDING SITE2, designated SEQ ID:28960 and SEQ ID:28962 respectively, to the nucleotide sequence of VGAM176 RNA, herein designated VGAM RNA, also designated SEQ ID:2887.

Another function of VGAM176 is therefore inhibition of Macrophage Scavenger Receptor 1 (MSR1, Accession NM_138715), a gene which plays a role in endocytosis of macromolecules. Accordingly, utilities of VGAM176 include diagnosis, prevention and treatment of diseases and clinical conditions associated with MSR1. The function of MSR1 has been established by previous studies. Deletions on 8p23-p22 in prostate cancer cells (Latil and Lidereau, 1998) and linkage studies in families affected with hereditary prostate cancer (Xu et al., 2001) have implicated this region in the development of prostate cancer. The MSR1 gene is located at 8p22 and functions in several processes proposed to be relevant to prostate carcinogenesis. In studies of families affected with hereditary prostate cancer, Xu et al. (2002) identified 6 missense mutations and 1 nonsense mutation in the MSR1 gene. A family-based linkage and association test indicated that these mutations cosegregate with prostate cancer (P=0.0007). In addition, among men of European descent, MSR1 mutations were detected in 4.4% of individuals affected with nonhereditary prostate cancer as compared with 0.8% of unaffected men (P=0.009). Among African American men, these values were 12.5% and 1.8%, respectively (P=0.01). These results showed that MSR1 may be important in susceptibility to prostate cancer in men of both African American and European descent.

Full details of the abovementioned studies are described in the following publications, the disclosure of which are hereby incorporated by reference:

Emi, M.; Asaoka, H.; Matsumoto, A.; Itakura, H.; Kurihara, Y.; Wada, Y.; Kanamori, H.; Yazaki, Y.; Takahashi, E.; Lepert, M.; Lalouel, J.-M.; Kodama, T.; Mukai, T.: Structure, organization, and chromosomal mapping of the human macrophage scavenger receptor gene. J. Biol. Chem. 268:2120-2125, 1993; and Latil, A.; Lidereau, R.: Genetic aspects of prostate cancer. Virchows Arch. 432:389-406, 1998.

Further studies establishing the function and utilities of MSR1 are found in John Hopkins OMIM database record ID 153622, and in sited publications numbered 11661-11665 listed in the bibliography section hereinbelow, which are also hereby incorporated by reference. Tripartite Motif-containing 39 (TRIM39, Accession NM_021253) is another VGAM176 host target gene. TRIM39 BINDING SITE is HOST TARGET binding site found in the 5' untranslated region of mRNA encoded by TRIM39, corresponding to a HOST TARGET binding site such as BINDING SITE I, BINDING SITE II or BINDING SITE III. Table 2 illustrates the complementarity of the nucleotide sequences of TRIM39 BINDING SITE, designated SEQ ID:22225, to the nucleotide sequence of VGAM176 RNA, herein designated VGAM RNA, also designated SEQ ID:2887.

Another function of VGAM176 is therefore inhibition of Tripartite Motif-containing 39 (TRIM39, Accession NM_021253). Accordingly, utilities of VGAM176 include diagnosis, prevention and treatment of diseases and clinical conditions associated with TRIM39. COP9 Constitutive Photomorphogenic Homolog Subunit 7B (Arabidopsis) (COPS7B, Accession NM_022730) is another VGAM176 host target gene. COPS7B BINDING SITE is HOST TARGET binding site found in the 3' untranslated region of mRNA encoded by COPS7B, corresponding to a HOST TARGET binding site such as BINDING SITE I, BINDING SITE II or BINDING SITE III. Table 2 illustrates the complementarity of the nucleotide sequences of COPS7B BINDING SITE, designated SEQ ID:22930, to the nucleotide sequence of VGAM176 RNA, herein designated VGAM RNA, also designated SEQ ID:2887.

Another function of VGAM176 is therefore inhibition of COP9 Constitutive Photomorphogenic Homolog Subunit 7B (Arabidopsis) (COPS7B, Accession NM_022730). Accordingly, utilities of VGAM176 include diagnosis, prevention and treatment of diseases and clinical conditions associated with COPS7B. KIAA1229 (Accession XM_030665) is another VGAM176 host target gene. KIAA1229 BINDING SITE is HOST TARGET binding site found in the 3' untranslated region of mRNA encoded by KIAA1229, corresponding to a HOST TARGET binding site such as BINDING SITE I, BINDING SITE II or BINDING SITE III. Table 2 illustrates the complementarity of the nucleotide sequences of KIAA1229 BINDING SITE, designated SEQ ID:31095, to the nucleotide sequence of VGAM176 RNA, herein designated VGAM RNA, also designated SEQ ID:2887.

Another function of VGAM176 is therefore inhibition of KIAA1229 (Accession XM_030665). Accordingly, utilities of VGAM176 include diagnosis, prevention and treatment of diseases and clinical conditions associated with KIAA1229. NRF (Accession NM_017544) is another VGAM176 host target gene. NRF BINDING SITE is HOST TARGET binding site found in the 3' untranslated region of mRNA encoded by NRF, corresponding to a HOST TARGET binding site such as BINDING SITE I, BINDING SITE II or BINDING SITE III. Table 2 illustrates the complementarity of the nucleotide sequences of NRF BINDING SITE, designated SEQ ID:18983, to the nucleotide sequence of VGAM176 RNA, herein designated VGAM RNA, also designated SEQ ID:2887.

Another function of VGAM176 is therefore inhibition of NRF (Accession NM_017544). Accordingly, utilities of VGAM176 include diagnosis, prevention and treatment of diseases and clinical conditions associated with NRF. UBX Domain Containing 2 (UBXD2, Accession XM_043196) is another VGAM176 host target gene. UBXD2 BINDING SITE is HOST TARGET binding site found in the 3' untranslated region of mRNA encoded by UBXD2, corresponding to a HOST TARGET binding site such as BINDING SITE I, BINDING SITE II or BINDING SITE III. Table 2 illustrates the complementarity of the nucleotide sequences of UBXD2 BINDING SITE, designated SEQ ID:33914, to the nucleotide sequence of VGAM176 RNA, herein designated VGAM RNA, also designated SEQ ID:2887.

Another function of VGAM176 is therefore inhibition of UBX Domain Containing 2 (UBXD2, Accession XM_043196). Accordingly, utilities of VGAM176 include diagnosis, prevention and treatment of diseases and clinical conditions associated with UBXD2. LOC115219 (Accession XM_055499) is another VGAM176 host target gene. LOC115219 BINDING SITE is HOST TARGET binding site found in the 5' untranslated region of mRNA encoded by LOC115219, corresponding to a HOST TARGET binding site such as BINDING SITE I, BINDING SITE II or BINDING SITE III. Table 2 illustrates the complementarity of the nucleotide sequences of LOC115219 BINDING SITE, designated SEQ ID:36279, to the nucleotide sequence of VGAM176 RNA, herein designated VGAM RNA, also designated SEQ ID:2887.

Another function of VGAM176 is therefore inhibition of LOC115219 (Accession XM_055499). Accordingly, utilities of VGAM176 include diagnosis, prevention and treatment of diseases and clinical conditions associated with LOC115219. LOC158187 (Accession XM_098892) is another VGAM176 host target gene. LOC158187 BINDING SITE is HOST TARGET binding site found in the 3' untranslated region of mRNA encoded by LOC158187, corresponding to a HOST TARGET binding site such as BINDING SITE I, BINDING SITE II or BINDING SITE III. Table 2 illustrates the complementarity of the nucleotide sequences of LOC158187 BINDING SITE, designated SEQ ID:41921, to the nucleotide sequence of VGAM176 RNA, herein designated VGAM RNA, also designated SEQ ID:2887.

Another function of VGAM176 is therefore inhibition of LOC158187 (Accession XM_098892). Accordingly, utilities of VGAM176 include diagnosis, prevention and treatment of diseases and clinical conditions associated with LOC158187. FIG. 1 further provides a conceptual description of a novel bioinformatically detected viral gene of the present invention, referred to here as Viral Genomic Address Messenger 177 (VGAM177) viral gene, which modulates expression of respective host target genes thereof, the function and utility of which host target genes is known in the art.

VGAM177 is a novel bioinformatically detected regulatory, non protein coding, viral micro RNA (miRNA) gene. The method by which VGAM177 was detected is described hereinabove with reference to FIGS. 1-8.

VGAM177 gene, herein designated VGAM GENE, is a viral gene contained in the genome of Shrimp White Spot Syndrome Virus (white spot bacilliform virus). VGAM177 host target gene, herein designated VGAM HOST TARGET GENE, is a human gene contained in the human genome.

VGAM177 gene encodes a VGAM177 precursor RNA, herein designated VGAM PRECURSOR RNA. Similar to other miRNA genes, and unlike most ordinary genes, VGAM177 precursor RNA does not encode a protein. A nucleotide sequence identical or highly similar to the nucleotide sequence of VGAM177 precursor RNA is designated SEQ ID:163, and is provided hereinbelow with reference to the sequence listing part. Nucleotide sequence SEQ ID:163 is located at position 117656 relative to the genome of Shrimp White Spot Syndrome Virus (white spot bacilliform virus).

VGAM177 precursor RNA folds onto itself, forming VGAM177 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM177 folded precursor RNA into VGAM177 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM177 RNA is designated SEQ ID:2888, and is provided hereinbelow with reference to the sequence listing part.

VGAM177 host target gene, herein designated VGAM HOST TARGET GENE, encodes a corresponding messenger RNA, VGAM177 host target RNA, herein designated VGAM HOST TARGET RNA. VGAM177 host target RNA comprises three regions, as is typical of mRNA of a protein coding gene: a 5' untranslated region, a protein coding region and a 3' untranslated region, designated 5'UTR, PROTEIN CODING and 3'UTR respectively.

VGAM177 RNA, herein designated VGAM RNA, binds complementarily to one or more host target binding sites located in untranslated regions of VGAM177 host target RNA, herein designated VGAM HOST TARGET RNA. This complementary binding is due to the fact that the nucleotide sequence of VGAM177 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM177 RNA, herein designated VGAM RNA, may have a different number of host target binding sites in untranslated regions of a VGAM177 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5'UTR regions.

The complementary binding of VGAM177 RNA, herein designated VGAM RNA, to host target binding sites on VGAM177 host target RNA, herein designated VGAM HOST TARGET RNA, such as BINDING SITE I, BINDING SITE II and BINDING SITE III, inhibits translation of VGAM177 host target RNA into VGAM177 host target protein, herein designated VGAM HOST TARGET PROTEIN. VGAM host target protein is therefore outlined by a broken line.

It is appreciated that VGAM177 host target gene, herein designated VGAM HOST TARGET GENE, in fact represents a plurality of VGAM177 host target genes. The mRNA of each one of this plurality of VGAM177 host target genes comprises one or more host target binding sites, each having a nucleotide sequence which is at least partly complementary to VGAM177 RNA, herein designated VGAM RNA, and which when bound by VGAM177 RNA causes inhibition of translation of respective one or more VGAM177 host target proteins.

It is further appreciated by one skilled in the art that the mode of translational inhibition illustrated by FIG. 1 with specific reference to translational inhibition exerted by VGAM177 gene, herein designated VGAM GENE, on one or more VGAM177 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM177 is inhibition of expression of host target genes, as part of a novel viral mechanism of attacking a host. Accordingly, utilities of VGAM177 include diagnosis, prevention and treatment of viral infection by Shrimp White Spot Syndrome Virus (white spot bacilliform virus). Specific functions, and accordingly utilities, of VGAM177 correlate with, and may be deduced from, the identity of the host target genes which VGAM177 binds and inhibits, and the function of these host target genes, as elaborated hereinbelow.

Nucleotide sequences of the VGAM177 precursor RNA, herein designated VGAM PRECURSOR RNA, and of the 'diced' VGAM177 RNA, herein designated VGAM RNA, and a schematic representation of the secondary folding of VGAM177 folded precursor RNA, herein designated VGAM FOLDED PRECURSOR RNA, of VGAM177 are further described hereinbelow with reference to Table 1.

Nucleotide sequences of host target binding sites, such as BINDING SITE-I, BINDING SITE-II and BINDING SITE-III of FIG. 1, found on VGAM177 host target RNA, and schematic representation of the complementarity of each of these host target binding sites to VGAM177 RNA, herein designated VGAM RNA, are described hereinbelow with reference to Table 2.

As mentioned hereinabove with reference to FIG. 1, a function of VGAM177 gene, herein designated VGAM is inhibition of expression of VGAM177 target genes. It is appreciated that specific functions, and accordingly utilities, of VGAM177 correlate with, and may be deduced from, the identity of the target genes which VGAM177 binds and inhibits, and the function of these target genes, as elaborated hereinbelow.

Cytochrome C Oxidase Subunit VIIa Polypeptide 1 (muscle) (COX7A1, Accession NM_001864) is a VGAM177 host target gene. COX7A1 BINDING SITE is HOST TARGET binding site found in the 5' untranslated region of mRNA encoded by COX7A1, corresponding to a HOST TARGET binding site such as BINDING SITE I, BINDING SITE II or BINDING SITE III. Table 2 illustrates the complementarity of the nucleotide sequences of COX7A1 BINDING SITE, designated SEQ ID:7602, to the nucleotide sequence of VGAM177 RNA, herein designated VGAM RNA, also designated SEQ ID:2888.

A function of VGAM177 is therefore inhibition of Cytochrome C Oxidase Subunit VIIa Polypeptide 1 (muscle) (COX7A1, Accession NM_001864), a gene which is one of the nuclear-coded polypeptide chains of cytochrome c oxidase. Accordingly, utilities of VGAM177 include diagnosis, prevention and treatment of diseases and clinical conditions associated with COX7A1. The function of COX7A1 has been established by previous studies. Cytochrome c oxidase (COX; EC 1.9.3.1), the last component of the mitochondrial respiratory chain, catalyzes the transfer of electrons from reduced cytochrome c to molecular oxygen. In mammals, the apoprotein is composed of 3 large catalytic subunits, encoded by the mitochondrial genome (516030, 516040, and 516050), and by 10 smaller, nuclear-encoded subunits which may play a regulatory role. Subunit VIIa of mammalian COX exists in at least 2 isoforms, liver (L) and muscle (M). Arnaudo et al. (1992) isolated a full-length cDNA encoding the muscle isoform. The deduced polypeptide shares 78% identity with the bovine muscle form but only 63% identity with the human liver isoform. Northern blot analysis of primate tissues demonstrated that mRNA for the muscle form is present only in muscle tissues; in contrast, liver mRNA is present in both muscle and nonmuscle tissues. Southern blot analysis of human/rodent cell hybrid genomic DNA indicated that the muscle form is encoded by a single locus, designated COX7A1, on chromosome 19; in contrast, cDNA probes for the liver isoform hybridized fragments from 2 loci, one on chromosome 4 (COX7A2; 123996) and the other on chromosome 14 (COX7A3; 123997 Fabrizi et al. (1989) reported the sequence of the human COX7A1 gene. Wolz et al. (1997) described the genomic sequence and organization of the human COX7A1 gene and compared it with its bovine homolog. The coding region of the gene extends over 1.45 kb of genomic sequence and is organized into 4 exons. Intron-exon boundaries are well conserved between cattle and human S. Although COX7A1 is a gene for a tissue-specific isoform, it has some features of a housekeeping gene: it is located in a CpG island, like its bovine homolog, and no TATA or CCAAT boxes are found in the 5-prime flanking sequence Full details of the abovementioned studies are described in the following publications, the disclosure of which are hereby incorporated by reference:

Arnaudo, E.; Hirano, M.; Seelan, R. S.; Milatovich, A.; Hsieh, C.-L.; Fabrizi, G. M.; Grossman, L. I.; Francke, U.; Schon, E. A.: Tissue-specific expression and chromosome assignment of genes specifying two isoforms of subunit VIIa of human cytochrome c oxidase. Gene 119:299-305, 1992; and Fabrizi, G. M.; Rizzuto, R.; Nakase, H.; Mita, S.; Lomax, M. I.; Grossman, L. I.; Schon, E. A.: Sequence of a cDNA specifying subunit VIIa of human cytochrome c oxidase. Nucleic Acids R.

Further studies establishing the function and utilities of COX7A1 are found in John Hopkins OMIM database record ID 123995, and in sited publications numbered 87 and 3410-3411 listed in the bibliography section hereinbelow, which are also hereby incorporated by reference. DNA (cytosine-5-)-methyltransferase 2 (DNMT2, Accession NM_004412) is another VGAM177 host target gene. DNMT2 BINDING SITE is HOST TARGET binding site found in the 3' untranslated region of mRNA encoded by DNMT2, corresponding to a HOST TARGET binding site such as BINDING SITE I, BINDING SITE II or BINDING SITE III. Table 2 illustrates the complementarity of the nucleotide sequences of DNMT2 BINDING SITE, designated SEQ ID:10669, to the nucleotide sequence of VGAM177 RNA, herein designated VGAM RNA, also designated SEQ ID:2888.

Another function of VGAM177 is therefore inhibition of DNA (cytosine-5-)-methyltransferase 2 (DNMT2, Accession NM_004412), a gene which may mark specific sequences in the genome. Accordingly, utilities of VGAM177 include diagnosis, prevention and treatment of diseases and clinical conditions associated with DNMT2. The function of DNMT2 has been established by previous studies. Trace levels of 5-methylcytosine persist in the DNA of mouse embryonic stem cells that are homozygous for null mutations in Dnmt1 (OMIM Ref. No. 126375). Yoder and Bestor (1998) showed that this residual 5-methylcytosine may be the product of a second DNA methyltransferase, Dnmt2. Dnmt2 contains all the sequence motifs diagnostic of DNA (cytosine-5)-methyltransferases but appears to lack the large N-terminal regulatory domain common to other eukaryotic methyltransferases. It is more similar to a putative DNA methyltransferase of the fission yeast Schizosaccharomyces pombe than to Dnmt1. Dnmt2 produces multiple mRNA species that are present at low levels in all tissues of human and mouse and is not restricted to those cell types known to be active in de novo methylation. Yoder and Bestor (1998) mapped the human DNMT2 gene to 10p14-p12 in a panel of radiation hybrids. By fluorescence in situ hybridization, Vilain et al. (1998) assigned the DNMT2 gene to 10p15.1.

Full details of the abovementioned studies are described in the following publications, the disclosure of which are hereby incorporated by reference:

Vilain, A.; Apiou, F.; Dutrillaux, B.; Malfoy, B.: Assignment of candidate DNA methyltransferase gene (DNMT2) to human chromosome band 10p15.1 by in situ hybridization. Cytogenet. Cell Genet. 82:120 only, 1998; and Yoder, J. A.; Bestor, T. H.: A candidate mammalian DNA methyltransferase related to pmt1p of fission yeast. Hum. Molec. Genet. 7:279-284, 1998.

Further studies establishing the function and utilities of DNMT2 are found in John Hopkins OMIM database record ID 602478, and in sited publications numbered 7961-7962 listed in the bibliography section hereinbelow, which are also hereby incorporated by reference. Complement Component 1, Q Subcomponent, Receptor 1 (C1QR1, Accession NM_012072) is another VGAM177 host target gene. C1QR1 BINDING SITE is HOST TARGET binding site found in the 3' untranslated region of mRNA encoded by C1QR1, corresponding to a HOST TARGET binding site such as BINDING SITE I, BINDING SITE II or BINDING SITE III. Table 2 illustrates the complementarity of the nucleotide sequences of C1QR1 BINDING SITE, designated SEQ ID:14338, to the nucleotide sequence of VGAM177 RNA, herein designated VGAM RNA, also designated SEQ ID:2888.

Another function of VGAM177 is therefore inhibition of Complement Component 1, Q Subcomponent, Receptor 1 (C1QR1, Accession NM_012072). Accordingly, utilities of VGAM177 include diagnosis, prevention and treatment of diseases and clinical conditions associated with C1QR1. FLJ23511 (Accession NM_032239) is another VGAM177 host target gene. FLJ23511 BINDING SITE is HOST TARGET binding site found in the 5' untranslated region of mRNA encoded by FLJ23511, corresponding to a HOST TARGET binding site such as BINDING SITE I, BINDING SITE II or BINDING SITE III. Table 2 illustrates the complementarity of the nucleotide sequences of FLJ23511 BINDING SITE, designated SEQ ID:25965, to the nucleotide sequence of VGAM177 RNA, herein designated VGAM RNA, also designated SEQ ID:2888.

Another function of VGAM177 is therefore inhibition of FLJ23511 (Accession NM_032239). Accordingly, utilities of VGAM177 include diagnosis, prevention and treatment of diseases and clinical conditions associated with FLJ23511. KIAA0447 (Accession XM_049733) is another VGAM177 host target gene. KIAA0447 BINDING SITE is HOST TARGET binding site found in the 3' untranslated region of mRNA encoded by KIAA0447, corresponding to a HOST TARGET binding site such as BINDING SITE I, BINDING SITE II or BINDING SITE III. Table 2 illustrates the complementarity of the nucleotide sequences of KIAA0447 BINDING SITE, designated SEQ ID:35491, to the nucleotide sequence of VGAM177 RNA, herein designated VGAM RNA, also designated SEQ ID:2888.

Another function of VGAM177 is therefore inhibition of KIAA0447 (Accession XM_049733). Accordingly, utilities of VGAM177 include diagnosis, prevention and treatment of diseases and clinical conditions associated with KIAA0447. MSTP032 (Accession NM_025226) is another VGAM177 host target gene. MSTP032 BINDING SITE is HOST TARGET binding site found in the 3' untranslated region of mRNA encoded by MSTP032, corresponding to a HOST TARGET binding site such as BINDING SITE I, BINDING SITE II or BINDING SITE III. Table 2 illustrates the complementarity of the nucleotide sequences of MSTP032 BINDING SITE, designated SEQ ID:24906, to the nucleotide sequence of VGAM177 RNA, herein designated VGAM RNA, also designated SEQ ID:2888.

Another function of VGAM177 is therefore inhibition of MSTP032 (Accession NM_025226). Accordingly, utilities of VGAM177 include diagnosis, prevention and treatment of diseases and clinical conditions associated with MSTP032. FIG. 1 further provides a conceptual description of a novel bioinformatically detected viral gene of the present invention, referred to here as Viral Genomic Address Messenger 178 (VGAM178) viral gene, which modulates expression of respective host target genes thereof, the function and utility of which host target genes is known in the art.

VGAM178 is a novel bioinformatically detected regulatory, non protein coding, viral micro RNA (miRNA) gene. The method by which VGAM178 was detected is described hereinabove with reference to FIGS. 1-8.

VGAM178 gene, herein designated VGAM GENE, is a viral gene contained in the genome of Shrimp White Spot Syndrome Virus (white spot bacilliform virus). VGAM178 host target gene, herein designated VGAM HOST TARGET GENE, is a human gene contained in the human genome.

VGAM178 gene encodes a VGAM178 precursor RNA, herein designated VGAM PRECURSOR RNA. Similar to other miRNA genes, and unlike most ordinary genes, VGAM178 precursor RNA does not encode a protein. A nucleotide sequence identical or highly similar to the nucleotide sequence of VGAM178 precursor RNA is designated SEQ ID:164, and is provided hereinbelow with reference to the sequence listing part. Nucleotide sequence SEQ ID:164 is located at position 152069 relative to the genome of Shrimp White Spot Syndrome Virus (white spot bacilliform virus).

VGAM178 precursor RNA folds onto itself, forming VGAM178 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM178 folded precursor RNA into VGAM178 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM178 RNA is designated SEQ ID:2889, and is provided hereinbelow with reference to the sequence listing part.

VGAM178 host target gene, herein designated VGAM HOST TARGET GENE, encodes a corresponding messenger RNA, VGAM178 host target RNA, herein designated VGAM HOST TARGET RNA. VGAM178 host target RNA comprises three regions, as is typical of mRNA of a protein coding gene: a 5' untranslated region, a protein coding region and a 3' untranslated region, designated 5'UTR, PROTEIN CODING and 3'UTR respectively.

VGAM178 RNA, herein designated VGAM RNA, binds complementarily to one or more host target binding sites located in untranslated regions of VGAM178 host target RNA, herein designated VGAM HOST TARGET RNA. This complementary binding is due to the fact that the nucleotide sequence of VGAM178 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM178 RNA, herein designated VGAM RNA, may have a different number of host target binding sites in untranslated regions of a VGAM178 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5'UTR region, or in both 3'UTR and 5"UTR regions.

The complementary binding of VGAM178 RNA, herein designated VGAM RNA, to host target binding sites on VGAM178 host target RNA, herein designated VGAM HOST TARGET RNA, such as BINDING SITE I, BINDING SITE II and BINDING SITE III, inhibits translation of VGAM178 host target RNA into VGAM178 host target protein, herein designated VGAM HOST TARGET PROTEIN. VGAM host target protein is therefore outlined by a broken line.

It is appreciated that VGAM178 host target gene, herein designated VGAM HOST TARGET GENE, in fact represents a plurality of VGAM178 host target genes. The mRNA of each one of this plurality of VGAM178 host target genes comprises one or more host target binding sites, each having a nucleotide sequence which is at least partly complementary to VGAM178 RNA, herein designated VGAM RNA, and which when bound by VGAM178 RNA causes inhibition of translation of respective one or more VGAM178 host target proteins.

It is further appreciated by one skilled in the art that the mode of translational inhibition illustrated by FIG. 1 with specific reference to translational inhibition exerted by VGAM178 gene, herein designated VGAM GENE, on one or more VGAM178 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM178 is inhibition of expression of host target genes, as part of a novel viral mechanism of attacking a host. Accordingly, utilities of VGAM178 include diagnosis, prevention and treatment of viral infection by Shrimp White Spot Syndrome Virus (white spot bacilliform virus). Specific functions, and accordingly utilities, of VGAM178 correlate with, and may be deduced from, the identity of the host target genes which VGAM178 binds and inhibits, and the function of these host target genes, as elaborated hereinbelow.

Nucleotide sequences of the VGAM178 precursor RNA, herein designated VGAM PRECURSOR RNA, and of the 'diced' VGAM178 RNA, herein designated VGAM RNA, and a schematic representation of the secondary folding of VGAM178 folded precursor RNA, herein designated VGAM FOLDED PRECURSOR RNA, of VGAM178 are further described hereinbelow with reference to Table 1.

Nucleotide sequences of host target binding sites, such as BINDING SITE-I, BINDING SITE-II and BINDING SITE-III of FIG. 1, found on VGAM178 host target RNA, and schematic representation of the complementarity of each of these host target binding sites to VGAM178 RNA, herein designated VGAM RNA, are described hereinbelow with reference to Table 2.

As mentioned hereinabove with reference to FIG. 1, a function of VGAM178 gene, herein designated VGAM is inhibition of expression of VGAM178 target genes. It is appreciated that specific functions, and accordingly utilities, of VGAM178 correlate with, and may be deduced from, the identity of the target genes which VGAM178 binds and inhibits, and the function of these target genes, as elaborated hereinbelow.

B-cell CLL/lymphoma 7A (BCL7A, Accession NM_020993) is a VGAM178 host target gene. BCL7A BINDING SITE is HOST TARGET binding site found in the 3' untranslated region of mRNA encoded by BCL7A, corresponding to a HOST TARGET binding site such as BINDING SITE I, BINDING SITE II or BINDING SITE III. Table 2 illustrates the complementarity of the nucleotide sequences of BCL7A BINDING SITE, designated SEQ ID:21990, to the nucleotide sequence of VGAM178 RNA, herein designated VGAM RNA, also designated SEQ ID:2889.

A function of VGAM178 is therefore inhibition of B-cell CLL/lymphoma 7A (BCL7A, Accession NM_020993). Accordingly, utilities of VGAM178 include diagnosis, prevention and treatment of diseases and clinical conditions associated with BCL7A. Calcium Channel, Voltage-dependent, Beta 1 Subunit (CACNB1, Accession NM_000723) is another VGAM178 host target gene. CACNB1 BINDING SITE is HOST TARGET binding site found in the 3' untranslated region of mRNA encoded by CACNB1, corresponding to a HOST TARGET binding site such as BINDING SITE I, BINDING SITE II or BINDING SITE III. Table 2 illustrates the complementarity of the nucleotide sequences of CACNB1 BINDING SITE, designated SEQ ID:6384, to the nucleotide sequence of VGAM178 RNA, herein designated VGAM RNA, also designated SEQ ID:2889.

Another function of VGAM178 is therefore inhibition of Calcium Channel, Voltage-dependent, Beta 1 Subunit (CACNB1, Accession NM_000723), a gene which may not only play an important role in the transport/insertion of the alpha-1S subunit into the membrane. Accordingly, utilities of VGAM178 include diagnosis, prevention and treatment of diseases and clinical conditions associated with CACNB1. The function of CACNB1 and its association with various diseases and clinical conditions, has been established by previous studies, as described hereinabove with reference to VGAM114. Dual-specificity tyrosine-(Y)-phosphorylation Regulated Kinase 1A (DYRK1A, Accession NM_101395) is another VGAM178 host target gene. DYRK1A BINDING SITE is HOST TARGET binding site found in the 3' untranslated region of mRNA encoded by DYRK1A, corresponding to a HOST TARGET binding site such as BINDING SITE I, BINDING SITE II or BINDING SITE III. Table 2 illustrates the complementarity of the nucleotide sequences of DYRK1A BINDING SITE, designated SEQ ID:28161, to the nucleotide sequence of VGAM178 RNA, herein designated VGAM RNA, also designated SEQ ID:2889.

Another function of VGAM178 is therefore inhibition of Dual-specificity tyrosine-(Y)-phosphorylation Regulated Kinase 1A (DYRK1A, Accession NM_101395), a gene which regulates cell proliferation and may be involved in brain development. Accordingly, utilities of VGAM178 include diagnosis, prevention and treatment of diseases and clinical conditions associated with DYRK1A. The function of DYRK1A and its association with various diseases and clinical conditions, has been established by previous studies, as described hereinabove with reference to VGAM42. ELK1, Member of ETS Oncogene Family (ELK1, Accession NM_005229) is another VGAM178 host target gene. ELK1 BINDING SITE is HOST TARGET binding site found in the 3' untranslated region of mRNA encoded by ELK1, corresponding to a HOST TARGET binding site such as BINDING SITE I, BINDING SITE II or BINDING SITE III. Table 2 illustrates the complementarity of the nucleotide sequences of ELK1 BINDING SITE, designated SEQ ID:11729, to the nucleotide sequence of VGAM178 RNA, herein designated VGAM RNA, also designated SEQ ID:2889.

Another function of VGAM178 is therefore inhibition of ELK1, Member of ETS Oncogene Family (ELK1, Accession NM_005229), a gene which stimulates transcription. can form a ternary complex with the serum response factor and the ets and srf motifs of the fos serum response element. Accordingly, utilities of VGAM178 include diagnosis, prevention and treatment of diseases and clinical conditions associated with ELK1. The function of ELK1 has been established by previous studies. Rao et al. (1989) identified 2 new members of the ETS (164720, 164740) oncogene superfamily, ELK1 and ELK2. The ELK or related sequences appear to be transcriptionally active in testis and lung. By analysis of somatic cell hybrids and in situ hybridization, Rao et al. (1989) mapped the ELK1 gene to Xp11.2 and the ELK2 gene to 14q32.3. The former is near the translocation breakpoint seen in t (X;18)(p11.2; q11.2), which is characteristic of synovial sarcoma; the latter is near the 14q32 breakpoint seen in ataxia-telangiectasia and other T-cell malignancies. Janz et al. (1994) used fluorescence in situ hybridization and a panel of tumor-derived somatic cell hybrids to assign the ELK1 gene to Xp11.4-p11.2, distal to the OATL1 region (OMIM Ref. No. 311240). Tamai et al. (1995) used interspecific backcross mice to map the Elk gene to the mouse X chromosome. Giovane et al. (1995) mapped ELK1 to human Xp11.2-p11.1 and to mouse XA1-A3 by in situ hybridization. Yamauchi et al. (1999) found by sequence analysis that the ELK2 locus on 14q32.2 that was identified by Rao et al. (1989) is actually a processed pseudogene (OMIM Ref. No. ELK2P1) of ELK1.

Full details of the abovementioned studies are described in the following publications, the disclosure of which are hereby incorporated by reference:

Tamai, Y.; Taketo, M.; Nozaki, M.; Seldin, M. F.: Mouse Elk oncogene maps to chromosome X and a novel Elk oncogene (Elk3) maps to chromosome 10. Genomics 26:414-416, 1995; and Yamauchi, T.; Toko, M.; Suga, M.; Hatakeyama, T.; Isobe, M.: Structural organization of the human Elk1 gene and its processed pseudogene Elk2. DNA Res. 6:21-27, 1999.

Further studies establishing the function and utilities of ELK1 are found in John Hopkins OMIM database record ID 311040, and in sited publications numbered 8627-8631 listed in the bibliography section hereinbelow, which are also hereby incorporated by reference. Fatty-acid-Coenzyme A Ligase, Long-chain 4 (FACL4, Accession NM_004458) is another VGAM178 host target gene. FACL4 BINDING SITE1 and FACL4 BINDING SITE2 are HOST TARGET binding sites found in untranslated regions of mRNA encoded by FACL4, corresponding to HOST TARGET binding sites such as BINDING SITE I, BINDING SITE II or BINDING SITE III. Table 2 illustrates the complementarity of the nucleotide sequences of FACL4 BINDING SITE1 and FACL4 BINDING SITE2, designated SEQ ID:10762 and SEQ ID:23252 respectively, to the nucleotide sequence of VGAM178 RNA, herein designated VGAM RNA, also designated SEQ ID:2889.

Another function of VGAM178 is therefore inhibition of Fatty-acid-Coenzyme A Ligase, Long-chain 4 (FACL4, Accession NM_004458). Accordingly, utilities of VGAM178 include diagnosis, prevention and treatment of diseases and clinical conditions associated with FACL4. H1 Histone Family, Member 0 (H1F0, Accession NM_005318) is another VGAM178 host target gene. H1F0 BINDING SITE is HOST TARGET binding site found in the 3' untranslated region of mRNA encoded by H1F0, corresponding to a HOST TARGET binding site such as BINDING SITE I, BINDING SITE II or BINDING SITE III. Table 2 illustrates the complementarity of the nucleotide sequences of H1F0 BINDING SITE, designated SEQ ID:11794, to the nucleotide sequence of VGAM178 RNA, herein designated VGAM RNA, also designated SEQ ID:2889.

Another function of VGAM178 is therefore inhibition of H1 Histone Family, Member 0 (H1F0, Accession NM_005318), a gene which is necessary for the condensation of nucleosome chains into higher order structures. Accordingly, utilities of VGAM178 include diagnosis, prevention and treatment of diseases and clinical conditions associated with H1F0. The function of H1F0 has been established by previous studies. Histones are basic nuclear proteins that are responsible for the nucleosome structure within the chromosomal fiber in eukaryotes. See 142711. Doenecke and Tonjes (1986) cloned the human H1(0) gene. By PCR analysis of chromosomal DNA from a panel of human/rodent somatic cell hybrids, Albig et al. (1993) demonstrated that the H1(0) subtype maps to chromosome 22. By fluorescence in situ hybridization, they further localized the gene to 22q13.1.

Full details of the abovementioned studies are described in the following publications, the disclosure of which are hereby incorporated by reference:

Albig, W.; Drabent, B.; Kunz, J.; Kalff-Suske, M.; Grzeschik, K.-H.; Doenecke, D.: All known human H1 histone genes except the H1(0) gene are clustered on chromosome 6. Genomics 16:649-654, 1993; and Doenecke, D.; Tonjes, R.: Differential distribution of lysine and arginine residues in the closely related histones H1 and H5. Analysis of a human H1 gene. J. Molec. Biol. 187: 461-464.

Further studies establishing the function and utilities of H1F0 are found in John Hopkins OMIM database record ID 142708, and in sited publications numbered 2672 listed in the bibliography section hereinbelow, which are also hereby incorporated by reference. Homeo Box B9 (HOXB9, Accession NM_024017) is another VGAM178 host target gene. HOXB9 BINDING SITE is HOST TARGET binding site found in the 3' untranslated region of mRNA encoded by HOXB9, corresponding to a HOST TARGET binding site such as BINDING SITE I, BINDING SITE II or BINDING SITE III. Table 2 illustrates the complementarity of the nucleotide sequences of HOXB9 BINDING SITE, designated SEQ ID:23445, to the nucleotide sequence of VGAM178 RNA, herein designated VGAM RNA, also designated SEQ ID:2889.

Another function of VGAM178 is therefore inhibition of Homeo Box B9 (HOXB9, Accession NM_024017). Accordingly, utilities of VGAM178 include diagnosis, prevention and treatment of diseases and clinical conditions associated with HOXB9. Interleukin 11 (IL11, Accession NM_000641) is another VGAM178 host target gene. IL11 BINDING SITE is HOST TARGET binding site found in the 3' untranslated region of mRNA encoded by IL11, corresponding to a HOST TARGET binding site such as BINDING SITE I, BINDING SITE II or BINDING SITE III. Table 2 illustrates the complementarity of the nucleotide sequences of IL11 BINDING SITE, designated SEQ ID:6278, to the nucleotide sequence of VGAM178 RNA, herein designated VGAM RNA, also designated SEQ ID:2889.

Another function of VGAM178 is therefore inhibition of Interleukin 11 (IL11, Accession NM_000641), a gene which stimulates the proliferation of hematopoietic stem cells and megakaryocyte progenitor cells and induces megakaryocyte maturation. Accordingly, utilities of VGAM178 include diagnosis, prevention and treatment of diseases and clinical conditions associated with IL11. The function of IL11 has been established by previous studies. Paul et al. (1990) identified and cloned the gene for a new stromal cell-derived lymphopoietic and hematopoietic cytokine which they called interleukin-11. The cDNA indicated a single reading frame of 597 nucleotides encoding a predicted 199-amino acid polypeptide. The IL11 produced in COS-1 cells showed an apparent molecular mass of about 23 kD. McKinley et al. (1992) determined that the genomic sequence is 7 kb long and consists of 5 exons and 4 introns. Biologic characterization indicated that in addition to stimulating plasmacytoma proliferation, IL11 stimulates T-cell-dependent development of immunoglobulin-producing B cells and collaborates with IL3 in supporting murine megakaryocyte colony formation (Paul et al., 1990). Du and Williams (1994) reviewed the pleiotropic effects of IL11 on hematopoietic cells. Yang-Feng et al. (1991) demonstrated by in situ hybridization that a cDNA for IL11 maps to 19q13.3-q13.4. Since translocations involving 19q13 occur in patients with acute lymphocytic leukemia, the IL11 gene may be implicated. Du and Williams (1997) reviewed the molecular, cell biologic, and clinical aspects of interleukin-11.

Full details of the abovementioned studies are described in the following publications, the disclosure of which are hereby incorporated by reference:

Du, X.; Williams, D. A.: Interleukin-11: review of molecular, cell biology, and clinical use. Blood 89:3897-3908, 1997; and Du, X. X.; Williams, D. A.: Interleukin-11: a multifunctional growth factor derived from the hematopoietic microenvironment. Blood 83:2023-2030, 1994.

Further studies establishing the function and utilities of IL11 are found in John Hopkins OMIM database record ID 147681, and in sited publications numbered 682-686 listed in the bibliography section hereinbelow, which are also hereby incorporated by reference. Kelch-like 3 (Drosophila) (KLHL3, Accession XM_113450) is another VGAM178 host target gene. KLHL3 BINDING SITE is HOST TARGET binding site found in the 3' untranslated region of mRNA encoded by KLHL3, corresponding to a HOST TARGET binding site such as BINDING SITE I, BINDING SITE II or BINDING SITE III. Table 2 illustrates the complementarity of the nucleotide sequences of KLHL3 BINDING SITE, designated SEQ ID:42266, to the nucleotide sequence of VGAM178 RNA, herein designated VGAM RNA, also designated SEQ ID:2889.

Another function of VGAM178 is therefore inhibition of Kelch-like 3 (Drosophila) (KLHL3, Accession XM_113450). Accordingly, utilities of VGAM178 include diagnosis, prevention and treatment of diseases and clinical conditions associated with KLHL3. MAD, Mothers Against Decapentaplegic Homolog 3 (Drosophila) (MADH3, Accession NM_005902) is another VGAM178 host target gene. MADH3 BINDING SITE is HOST TARGET binding site found in the 3' untranslated region of mRNA encoded by MADH3, corresponding to a HOST TARGET binding site such as BINDING SITE I, BINDING SITE II or BINDING SITE III. Table 2 illustrates the complementarity of the nucleotide sequences of MADH3 BINDING SITE, designated SEQ ID:12522, to the nucleotide sequence of VGAM178 RNA, herein designated VGAM RNA, also designated SEQ ID:2889.

Another function of VGAM178 is therefore inhibition of MAD, Mothers Against Decapentaplegic Homolog 3 (Drosophila) (MADH3, Accession NM_005902), a gene which affects transcription in response to TGF-beta signaling pathways. Accordingly, utilities of VGAM178 include diagnosis, prevention and treatment of diseases and clinical conditions associated with MADH3. The function of MADH3 has been established by previous studies. Zhang et al. (1996) showed that MADH3 and MADH4 (SMAD4; 600993) synergized to induce strong ligand-independent TGF-beta-like responses. MADH3 containing a C-terminal truncation acted as a dominant-negative inhibitor of the normal TGF-beta response. The activity of MADH3 was regulated by the TGF-beta receptors (e.g., 190181), and MADH3 was phosphorylated and associated with the ligand-bound receptor complex. Zhang et al. (1996) stated that these results define MADH3 as an effector of the TGF-beta response. Zawel et al. (1998) found that human SMAD3 and SMAD4 proteins could specifically recognize an identical 8-bp palindromic sequence (GTCTAGAC). Tandem repeats of this palindrome conferred striking TGF-beta responsiveness to a minimal promoter. This responsiveness was abrogated by targeted deletion of the cellular SMAD4 gene. These results showed that SMAD proteins are involved in the biologic Animal model experiments lend further support to the function of MADH3. Zhu et al. (1998) reported the targeted disruption of the mouse Smad3 gene. Smad3 mutant mice were viable and fertile. Between 4 and 6 months of age, the Smad3 mutant mice became moribund with colorectal adenocarcinomas. The neoplasms penetrated through the intestinal wall and metastasized to lymph nodes. Since TGF-beta transduces its signal to the interior of the cell via Smad2, Smad3, and Smad4, these results directly implicate TGF-beta signaling in the pathogenesis of colorectal cancer and provide a compelling animal model for the study of human colorectal cancer It is appreciated that the abovementioned animal model for MADH3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Zawel, L.; Dai, J. L.; Buckhaults, P.; Zhou, S.; Kinzler, K. W.; Vogelstein, B.; Kern, S. E.: Human Smad3 and Smad4 are sequence-specific transcription activators. Molec. Cell 1:611-617, 1998; and Zhu, Y.; Richardson, J. A.; Parada, L. F.; Graff, J. M.: Smad3 mutant mice develop metastatic colorectal cancer. Cell 94:703-714, 1998.

Further studies establishing the function and utilities of MADH3 are found in John Hopkins OMIM database record ID 603109, and in sited publications numbered 8579, 12349, 6480, 7824, 783 and 8580-8581 listed in the bibliography section hereinbelow, which are also hereby incorporated by reference. Microtubule-associated Protein, RP/EB Family, Member 2 (MAPRE2, Accession NM_014268) is another VGAM178 host target gene. MAPRE2 BINDING SITE is HOST TARGET binding site found in the 3' untranslated region of mRNA encoded by MAPRE2, corresponding to a HOST TARGET binding site such as BINDING SITE I, BINDING SITE II or BINDING SITE III. Table 2 illustrates the complementarity of the nucleotide sequences of MAPRE2 BINDING SITE, designated SEQ ID:15545, to the nucleotide sequence of VGAM178 RNA, herein designated VGAM RNA, also designated SEQ ID:2889.

Another function of VGAM178 is therefore inhibition of Microtubule-associated Protein, RP/EB Family, Member 2 (MAPRE2, Accession NM_014268), a gene which The functional inactivation of the APC gene product is a key event in colorectal tumorigenesis. Accordingly, utilities of VGAM178 include diagnosis, prevention and treatment of diseases and clinical conditions associated with MAPRE2. The function of MAPRE2 has been established by previous studies. EB1 family proteins (e.g., MAPRE1; 603108) interact with cytoplasmic microtubules in interphase cells, with mitotic spindles, and with the adenomatous polyposis coli (APC; 175100) tumor suppressor gene. The functional inactivation of the APC gene product is a key event in colorectal tumorigenesis. By differential mRNA display of resting and activated T cells, followed by 5-prime RACE, Renner et al. (1997) isolated a cDNA encoding MAPRE2, which they termed RP1. The deduced 327-amino acid protein has significant homology with EB1 family proteins. Northern blot analysis detected a 2.6-kb transcript in T cells activated by 2 signals (i.e., cell surface antigen (s) and/or cytokine) and also in lymphocyte tumor cell lines. Immunoprecipitation analysis indicated that RP1 associates with full-length but not C terminus-deleted APC. Renner et al. (1997) concluded that RP1 may be an immediate-early T-cell regulatory gene. Using immunoprecipitation analysis, Juwana et al. (1999) showed that the N terminus of RP1 interacted with monomeric or polymerized tubulin in fibrosarcoma cell lines. Immunofluorescence microscopy demonstrated that RP1 is localized in the plus ends of microtubule networks in the presence or absence of APC. By radiation hybrid and sequence analyses, Su and Qi (2001) mapped the MAPRE2 gene to 18q12. By FISH, Wadle et al. (2001) assigned the gene to 18q21.

Full details of the abovementioned studies are described in the following publications, the disclosure of which are hereby incorporated by reference:

Juwana, J.-P.; Henderikx, P.; Mischo, A.; Wadle, A.; Fadle, N.; Gerlach, K.; Arends, J. W.; Hoogenboom, H.; Pfreundschuh, M.; Renner, C.: EB/RP gene family encodes tubulin binding proteins. Int. J. Cancer 81:275-284, 1999; and Renner, C.; Pfitzenmeier, J.-P.; Gerlach, K.; Held, G.; Ohnesorge, S.; Sahin, U.; Bauer, S.; Pfreundschuh, M.: RP1, a new member of the adenomatous polyposis coli-binding EB1-like gen.

Further studies establishing the function and utilities of MAPRE2 are found in John Hopkins OMIM database record ID 605789, and in sited publications numbered 734-73 and 8578 listed in the bibliography section hereinbelow, which are also hereby incorporated by reference. Microtubule-associated Protein Tau (MAPT, Accession NM_005910) is another VGAM178 host target gene. MAPT BINDING SITE1 through MAPT BINDING SITE4 are HOST TARGET binding sites found in untranslated regions of mRNA encoded by MAPT, corresponding to HOST TARGET binding sites such as BINDING SITE I, BINDING SITE II or BINDING SITE III. Table 2 illustrates the complementarity of the nucleotide sequences of MAPT BINDING SITE1 through MAPT BINDING SITE4, designated SEQ ID:12538, SEQ ID:18826, SEQ ID:18832 and SEQ ID:18838 respectively, to the nucleotide sequence of VGAM178 RNA, herein designated VGAM RNA, also designated SEQ ID:2889.

Another function of VGAM178 is therefore inhibition of Microtubule-associated Protein Tau (MAPT, Accession NM_005910), a gene which Microtubule-associated protein tau; promotes microtubule assembly. Accordingly, utilities of VGAM178 include diagnosis, prevention and treatment of diseases and clinical conditions associated with MAPT. The function of MAPT has been established by previous studies. The microtubule-associated proteins (MAPs) coassemble with tubulin (see OMIM Ref. No. 602529) into microtubules in vitro. Microtubule-associated protein tau appears to be enriched in axons. Neve et al. (1986) identified tau cDNA clones in a human fetal brain cDNA library. The clones recognized a 6-kb message that was expressed in human brain but not in other human tissues and exhibited a developmental shift in size. By screening cDNA libraries prepared from the frontal cortex of an Alzheimer disease patient and from fetal human brain, Goedert et al. (1988) isolated the cDNA for a core protein of the paired helical filament of Alzheimer disease (OMIM Ref. No. 104300). The partial amino acid sequence of this core protein was used to design synthetic oligonucleotide probes. The cDNA encodes a protein of 352 amino acids that contains a characteristic amino acid repeat in its carboxyl-terminal half. Because of extensive homology to the sequence of the mouse microtubule-associated protein tau, they stated that this protein must constitute the human equivalent of mouse tau. Tau protein mRNA was found in normal amounts in the frontal cortex from patients with Alzheimer disease. Hutton et al. (1998) studied 13 families in which an autosomal dominant inherited dementia, frontotemporal dementia with parkinsonism (OMIM Ref. No. 600274), had been shown to be linked to chromosome 17. The authors stated that this disorder has historically been termed Pick disease (OMIM Ref. No. 172700). Most cases showed neuronal and/or glial inclusions that stained positively with antibodies raised against tau, although the tau pathology varied considerably in both its quantity (or severity) and characteristics. This form of dementia, symbolized FTDP17 by them, had been mapped to a 2-cM region on 17q21.11. Since the tau gene was known to lie within this region and because the disorder was recognized to be a 'tauopathy,' Hutton et al. (1998) sequenced the MAPT gene in the thirteen 17-linked families and identified 3 missense mutations (gly272 to val, 157140.0002; pro301 to leu, 157140.0001; and arg406 to trp, 157140.0003) and 3 mutations in the 5-prime splice site of exon 10. All of the splice site mutations destabilized a potential stem-loop structure that is probably involved in regulating the alternative splicing of exon 10 (Goedert et al., 1989). This caused more frequent usage of the 5-prime splice site and an increased proportion of tau transcripts that include exon 10. The increase in exon 10+ mRNA was expected to increase the proportion of tau containing 4 microtubule-binding repeats, which is consistent with the neuropathology described in families with FTDP17. Hong et al. (1998) indicated that more than 10 exonic and intronic mutations of the MAPT gene had been identified in about 20 FTDP17 families. They found that analyses of soluble and insoluble tau proteins from brains of FTDP17 patients indicated that different pathogenic mutations differentially altered distinct biochemical properties and stoichiometry of brain tau isoforms. Functional assays of recombinant tau proteins with different FTDP17 missense mutations implicated all but 1 of these mutations in disease pathogenesis by reducing the ability of tau to bind microtubules and promote microtubule assembly. In a study of frontotemporal dementia in the Netherlands during the period January 1994 to June 1998, Rizzu et al. (1999) found 37 patients who had one or more first-degree relatives with dementia. A mutation in the MAPT gene was found in 17.8% of the group of patients with FTDP17 and in 43% of patients with FTDP17 who also had a positive family history of the disorder. Three distinct missense mutations, G272V (157140.0002), P301L (157140.0001), and R406W (157140.0003), accounted for 15.6% of the mutations. These 3 missense mutations, and a single amino acid deletion, K280del, that was detected in 1 patient, strongly reduced the ability of tau to promote microtubule assembly. In some FTDP17 families, MAPT mutations have not been found, suggesting locus and/or allelic heterogeneity. Rizzu et al. (1999) suggested that the MAPT mutations may result in disturbances in the interactions of the protein tau with microtubules, resulting in hyperphosphorylation of tau protein, assembly into filaments, and subsequent cell death. Verpillat et al. (2002) found that the tau H1/H1 genotype was significantly overrepresented in 100 patients with frontotemporal dementia compared to controls (odds ratio for H1/H1 = 1.95). In addition, there was a significant negative effect in carriers of both the H1/H1 genotype and the APOE2 allele (OMIM Ref. No. 107741). The association of intronic mutations in the MAPT gene in frontotemporal dementia with parkinsonism (e.g., 157140.0004) highlights the involvement of aberrant pre-mRNA splicing in the pathogenesis of neurodegenerative disorders. To establish a model system for studying the role of pre-mRNA splicing in neurodegenerative diseases, Jiang et al. (2000) constructed a MAPT minigene that reproduced alternative splicing in both cultured cells and in vitro biochemical assays. They demonstrated that mutations in a nonconserved intronic region of the human MAPT gene led to increased splicing between exons 10 and 11. Systematic biochemical analyses indicated the importance of U1 snRNP (OMIM Ref. No. 180740) and, to a lesser extent, U6 snRNP (OMIM Ref. No. 180692) in differentially recognizing wild-type versus intron-mutant MAPT pre-mRNAs. Goedert et al. (1998) reviewed the role of tau mutations in frontotemporal dementias. Heutink (2000) reviewed the role of tau protein in frontotemporal dementia and other neurodegenerative disorders. Hutton (2001) reviewed the known missense and splice site mutations in the tau gene that are associated with disease and described different mechanisms involved in pathogenesis, including disruption of the interaction between tau and tubulin, deposition of abnormal tau filaments, and the generation of abnormal ratios of tau isoforms. Animal model experiments lend further support to the function of MAPT. Lewis et al. (2000) demonstrated that expression of human tau containing the most common mutation, P301L (157140.0001), results in motor and behavioral deficits in transgenic mice, with age- and gene-dose-dependent development of neurofibrillary tangles (NFT).

It is appreciated that the abovementioned animal model for MAPT is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hutton, M.; Lendon, C. L.; Rizzu, P.; Baker, M.; Froelich, S.; Houlden, H.; Pickering-Brown, S.; Chakraverty, S.; Isaacs, A.; Grover, A.; Hackett, J.; Adamson, J.; and 39 others: Association of missense and 5-prime-splice-site mutations in tau with the inherited dementia FTDP-17. Nature 393:702-705, 1998; and Rizzu, P.; Van Swieten, J. C.; Joosse, M.; Hasegawa, M.; Stevens, M.; Tibben, A.; Niermeijer, M. F.; Hillebrand, M.; Ravid, R.; Oostra, B. A.; Goedert, M.; van Duijn, C. M.; Heutink, P.

Further studies establishing the function and utilities of MAPT are found in John Hopkins OMIM database record ID 157140, and in sited publications numbered 11119-11133, 1212, 11134-11142, 11160, 11165-11164, 413 and 11166-1683 listed in the bibliography section hereinbelow, which are also hereby incorporated by reference. Membrane Protein, Palmitoylated 3 (MAGUK p55 subfamily member 3) (MPP3, Accession NM_001932) is another VGAM178 host target gene. MPP3 BINDING SITE is HOST TARGET binding site found in the 5' untranslated region of mRNA encoded by MPP3, corresponding to a HOST TARGET binding site such as BINDING SITE I, BINDING SITE II or BINDING SITE III. Table 2 illustrates the complementarity of the nucleotide sequences of MPP3 BINDING SITE, designated SEQ ID:7641, to the nucleotide sequence of VGAM178 RNA, herein designated VGAM RNA, also designated SEQ ID:2889.

Another function of VGAM178 is therefore inhibition of Membrane Protein, Palmitoylated 3 (MAGUK p55 subfamily member 3) (MPP3, Accession NM_001932). Accordingly, utilities of VGAM178 include diagnosis, prevention and treatment of diseases and clinical conditions associated with MPP3. Musashi Homolog 1 (Drosophila) (MSI1, Accession NM_002442) is another VGAM178 host target gene. MSI1 BINDING SITE is HOST TARGET binding site found in the 3' untranslated region of mRNA encoded by MSI1, corresponding to a HOST TARGET binding site such as BINDING SITE I, BINDING SITE II or BINDING SITE III. Table 2 illustrates the complementarity of the nucleotide sequences of MSI1 BINDING SITE, designated SEQ ID:8283, to the nucleotide sequence of VGAM178 RNA, herein designated VGAM RNA, also designated SEQ ID:2889.

Another function of VGAM178 is therefore inhibition of Musashi Homolog 1 (Drosophila) (MSI1, Accession NM_002442). Accordingly, utilities of VGAM178 include diagnosis, prevention and treatment of diseases and clinical conditions associated with MSI1. Myosin, Heavy Polypeptide 11, Smooth Muscle (MYH11, Accession NM_002474) is another VGAM178 host target gene. MYH11 BINDING SITE1 and MYH11 BINDING SITE2 are HOST TARGET binding sites found in untranslated regions of mRNA encoded by MYH11, corresponding to HOST TARGET binding sites such as BINDING SITE I, BINDING SITE II or BINDING SITE III. Table 2 illustrates the complementarity of the nucleotide sequences of MYH11 BINDING SITE1 and MYH11 BINDING SITE2, designated SEQ ID:8301 and SEQ ID:23143 respectively, to the nucleotide sequence of VGAM178 RNA, herein designated VGAM RNA, also designated SEQ ID:2889.

Another function of VGAM178 is therefore inhibition of Myosin, Heavy Polypeptide 11, Smooth Muscle (MYH11, Accession NM_002474), a gene which is involved in muscle contraction. Accordingly, utilities of VGAM178 include diagnosis, prevention and treatment of diseases and clinical conditions associated with MYH11. The function of MYH11 has been established by previous studies. Matsuoka et al. (1991, 1993) isolated a smooth muscle myosin heavy-chain gene from a human cDNA library. They confirmed it as a smooth muscle MHC gene by Northern blot hybridization and a partial DNA sequence analysis. By study of human/ Chinese hamster and human/mouse hybrid cells and by in situ hybridization, they localized the gene to 16q12.1. This localization was later found to be an error and the gene was shown, in fact, to be located on the short arm of chromosome 16 in a region involved in pericentric inversion inv (16)(OMIM Ref. No. p13q22), a characteristic abnormality associated with acute myeloid leukemia, most commonly of the M4Eo subtype. Liu et al. (1993) pinpointed the 16p and 16q breakpoints by yeast artificial chromosome and cosmid cloning and identified the 2 genes involved in the inversion. On 16p, the MYH11 gene was interrupted; on 16q, the inversion occurred near the end of the coding region for CBF-beta (OMIM Ref. No. 121360), also known as PEBP2-beta, a subunit of a heterodimeric transcription factor regulating genes expressed in T cells. In all of 6 inv (16) patients tested, an in-frame fusion messenger RNA was demonstrated that connected the first 165 amino acids of CBFB with the tail region of MYH11. The repeated coiled coil of MYH11 may result in dimerization of the CBFB fusion protein, which in turn would lead to alterations in transcriptional regulation and contribute to leukemic transformation. Deng et al. (1993) mapped the MYH11 gene to the middle of the short arm of chromosome 16 by fluorescence in situ hybridization. Southern blots of a panel of hybrids containing different portions of human chromosome 16 localized the gene to 16p13.13-p13.12. Studies of DNA from a CHO/mouse hybrid clone mapping panel showed that the gene was located on mouse chromosome 16. Castilla et al. (1999) showed that the fusion Cbfb-MYH11 blocks myeloid differentiation in mice and predisposes the mice to acute myelomonocytic leukemia when exposed to N-ethyl-N-nitrosourea (ENU), a potent DNA alkylating mutagen.

Full details of the abovementioned studies are described in the following publications, the disclosure of which are hereby incorporated by reference:

Castilla, L. H.; Garrett, L.; Adya, N.; Orlic, D.; Dutra, A.; Anderson, S.; Owens, J.; Eckhaus, M.; Bodine, D.; Liu, P. P.: The fusion gene Cbfb-MYH11 blocks myeloid differentiation and predisposes mice to acute myelomonocytic leukaemia. (Letter) Nature Genet. 23:144-146, 1999; and Liu, P.; Tarle, S. A.; Hajra, A.; Claxton, D. F.; Marlton, P.; Freedman, M.; Siciliano, M. J.; Collins, F. S.: Fusion between transcription factor CBF-beta/PEBP2-beta and a myosin heav.

Further studies establishing the function and utilities of MYH11 are found in John Hopkins OMIM database record ID 160745, and in sited publications numbered 3222-3223, 3403, 460 and 4607 listed in the bibliography section hereinbelow, which are also hereby incorporated by reference. Neurexin 2 (NRXN2, Accession NM_138732) is another VGAM178 host target gene. NRXN2 BINDING SITE1 through NRXN2 BINDING SITE3 are HOST TARGET binding sites found in untranslated regions of mRNA encoded by NRXN2, corresponding to HOST TARGET binding sites such as BINDING SITE I, BINDING SITE II or BINDING SITE III. Table 2 illustrates the complementarity of the nucleotide sequences of NRXN2 BINDING SITE1 through NRXN2 BINDING SITE3, designated SEQ ID:28981, SEQ ID:28987 and SEQ ID:17465 respectively, to the nucleotide sequence of VGAM178 RNA, herein designated VGAM RNA, also designated SEQ ID:2889.

Another function of VGAM178 is therefore inhibition of Neurexin 2 (NRXN2, Accession NM_138732), a gene which may be involved in cell recognition, cell adhesion, and may mediate intracellular signaling. Accordingly, utilities of VGAM178 include diagnosis, prevention and treatment of diseases and clinical conditions associated with NRXN2. The function of NRXN2 has been established by previous studies. Neurexins are polymorphic cell surface proteins that are expressed in neurons. Neurexin II is 1 of 3 rat neurexin genes identified by Ushkaryov et al. (1992). Each gene contains 2 promoters that direct synthesis of alpha- and beta-neurexins. By analysis of a 1.2-Mb region flanking the MEN1 (OMIM Ref. No. 131100) locus on 11q13, Bergman et al. (1999) identified MCG36, a human gene similar to rat neurexin II-alpha. By genomic sequence analysis, Tabuchi and Sudhof (2002) determined that the NRXN2 gene contains 23 exons, has very large introns, and spans 106 kb, making it a relatively small gene compared to NRXN1 (OMIM Ref. No. 600565) and NRXN3. Exon 1 is more than 2 kb and encodes the first LNS domain and the first EGF-like repeat of alpha-neurexins. Other exons are average in size, with the remaining LNS domains interrupted by at least 1 intron, whereas all EGF-like repeats are encoded in single exons. The last exon, also relatively large, encodes the transmembrane region and cytoplasmic tail. Tabuchi and Sudhof (2002) also described a number of neurexin splice sites.

Full details of the abovementioned studies are described in the following publications, the disclosure of which are hereby incorporated by reference:

Bergman, L.; Silins, G.; Grimmond, S.; Hummerich, H.; Stewart, C.; Little, P.; Hayward, N.: A 500-kb sequence-ready cosmid contig and transcript map of the MEN1 region on 11q13. Genomics 55:49-56, 1999; and Tabuchi, K.; Sudhof, T. C.: Structure and evolution of neurexin genes: insight into the mechanism of alternative splicing. Genomics 79:849-859, 2002.

Further studies establishing the function and utilities of NRXN2 are found in John Hopkins OMIM database record ID 600566, and in sited publications numbered 9529, 9525-952 and 9530 listed in the bibliography section hereinbelow, which are also hereby incorporated by reference. RAD23 Homolog B (S. cerevisiae) (RAD23B, Accession NM_002874) is another VGAM178 host target gene. RAD23B BINDING SITE is HOST TARGET binding site found in the 5' untranslated region of mRNA encoded by RAD23B, corresponding to a HOST TARGET binding site such as BINDING SITE I, BINDING SITE II or BINDING SITE III. Table 2 illustrates the complementarity of the nucleotide sequences of RAD23B BINDING SITE, designated SEQ ID:8784, to the nucleotide sequence of VGAM178 RNA, herein designated VGAM RNA, also designated SEQ ID:2889.

Another function of VGAM178 is therefore inhibition of RAD23 Homolog B (S. cerevisiae) (RAD23B, Accession NM_002874), a gene which is involved in dna excision repair. Accordingly, utilities of VGAM178 include diagnosis, prevention and treatment of diseases and clinical conditions associated with RAD23B. The function of RAD23B has been established by previous studies. Volker et al. (2001) described the assembly of the nucleotide excision repair (NER) complex in normal and repair-deficient (xeroderma pigmentosum) human cells by employing a novel technique of local ultraviolet irradiation combined with fluorescent antibody labeling. The damage-recognition complex XPC-HHR23B (OMIM Ref. No. RAD23B) appeared to be essential for the recruitment of all subsequent NER factors in the preincision complex, including transcription repair factor TFIIH (see OMIM Ref. No. 189972). The authors found that XPA (OMIM Ref. No. 278700) associates relatively late, is required for anchoring of ERCC1 (OMIM Ref. No. 126380)-XPF (OMIM Ref. No. 133520), and may be essential for activation of the endonuclease activity of XPG (OMIM Ref. No. 133530). These findings identified XPC as the earliest known NER factor in the reaction mechanism, gave insight into the order of subsequent NER components, provided evidence for a dual role of XPA, and supported a concept of sequential assembly of repair proteins at the site of damage rather than a preassembled repairosome. Animal model experiments lend further support to the function of RAD23B. Ng et al. (2002) created a Rad23B knockout mouse model. Fibroblasts cultured from embryonic animals were not UV sensitive and retained the repair characteristics of wildtype cells, suggesting that Rad23A can functionally replace Rad23B in NER. However, there was a high rate of intrauterine or neonatal death in Rad23B -/- animals, and surviving animals displayed a variety of abnormalities, including retarded growth, facial dysmorphology, and male sterility. These findings suggested a function for Rad23B in normal development that cannot be compensated for by Rad23A.

It is appreciated that the abovementioned animal model for RAD23B is acknowledged by those skilled in the art as a scientifically valid animal model, as can be further appreciated from the publications sited hereinbelow.

Full details of the abovementioned studies are described in the following publications, the disclosure of which are hereby incorporated by reference:

Volker, M.; Mone, M. J.; Karmakar, P.; van Hoffen, A.; Schul, W.; Vermeulen, W.; Hoeijmakers, J. H. J.; van Driel, R.; van Zeeland, A. A.; Mullenders, L. H. F.: Sequential assembly of the nucleotide excision repair factors in vivo. Molec. Cell 8:213-224, 2001; and Ng, J. M. Y.; Vrieling, H.; Sugasawa, K.; Ooms, M. P.; Grootegoed, J. A.; Vreeburg, J. T. M.; Visser, P.; Beems, R. B.; Gorgels, T. G. M. F.; Hanaoka, F.; Hoeijmakers, J. H. J.; van der.

Further studies establishing the function and utilities of RAD23B are found in John Hopkins OMIM database record ID 600062, and in sited publications numbered 8410, 8793-879 and 8249 listed in the bibliography section hereinbelow, which are also hereby incorporated by reference. RAD50 Homolog (S. cerevisiae) (RAD50, Accession NM_005732) is another VGAM178 host target gene. RAD50 BINDING SITE1 and RAD50 BINDING SITE2 are HOST TARGET binding sites found in untranslated regions of mRNA encoded by RAD50, corresponding to HOST TARGET binding sites such as BINDING SITE I, BINDING SITE II or BINDING SITE III. Table 2 illustrates the complementarity of the nucleotide sequences of RAD50 BINDING SITE1 and RAD50 BINDING SITE2, designated SEQ ID:12293 and SEQ ID:28550 respectively, to the nucleotide sequence of VGAM178 RNA, herein designated VGAM RNA, also designated SEQ ID:2889.

Another function of VGAM178 is therefore inhibition of RAD50 Homolog (S. cerevisiae) (RAD50, Accession NM_005732), a gene which is involved in dna double-strand break repair (dsbr). Accordingly, utilities of VGAM178 include diagnosis, prevention and treatment of diseases and clinical conditions associated with RAD50. The function of RAD50 and its association with various diseases and clinical conditions, has been established by previous studies, as described hereinabove with reference to VGAM132. RAR-related Orphan Receptor B (RORB, Accession NM_006914) is another VGAM178 host target gene. RORB BINDING SITE is HOST TARGET binding site found in the 5' untranslated region of mRNA encoded by RORB, corresponding to a HOST TARGET binding site such as BINDING SITE I, BINDING SITE II or BINDING SITE III. Table 2 illustrates the complementarity of the nucleotide sequences of RORB BINDING SITE, designated SEQ ID:13785, to the nucleotide sequence of VGAM178 RNA, herein designated VGAM RNA, also designated SEQ ID:2889.

Another function of VGAM178 is therefore inhibition of RAR-related Orphan Receptor B (RORB, Accession NM_006914), a gene which is an orphan nuclear receptor. Accordingly, utilities of VGAM178 include diagnosis, prevention and treatment of diseases and clinical conditions associated with RORB. The function of RORB has been established by previous studies. ROR-beta is a transcription factor and belongs to the nuclear receptor family (Carlberg et al., 1994). Members of this superfamily share a common modular structure composed of a transactivation domain, a DNA-binding domain, and a ligand-binding domain (Evans, 1988). Typically, their transcriptional transactivation function is regulated by small lipophilic molecules, such as steroid hormones, vitamin D, retinoic acids, and thyroid hormone. These molecules are synthesized in the organism and pass readily through the plasma membrane to reach the corresponding receptors inside the cell. In addition to the classic hormone receptors, a growing number of nuclear receptors for which no ligands are known have been identified by homology cloning. These nuclear receptors are referred to as 'orphan' nuclear receptors. ROR-beta is such an orphan nuclear receptor, forming a subfamily with the closely related nuclear receptors ROR-alpha (RORA; 600825) and ROR-gamma (RORC; 602943 Animal model experiments lend further support to the function of RORB. ROR-beta is expressed in areas of the central nervous system that are involved in the processing of sensory information, including spinal cord, thalamus, and sensory cerebellar cortices. Additionally, ROR-beta localizes to the 3 principal anatomic components of the mammalian timing system: the suprachiasmatic nuclei, the retina, and the pineal gland. Andre et al. (1998) showed that RORB mRNA levels oscillate in retina and pineal gland with a circadian rhythm that persists in constant darkness. They generated RORB-deficient mice by gene targeting in embryonic stem cells and analyzed their phenotypic behavior. Rorb -/- mice display a duck-like gait, transient male incapability to reproduce sexually, and a severely disorganized retina that suffers from postnatal degeneration. Consequently, adult Rorb -/- mice are blind, yet their circadian activity rhythm is still entrained by light-dark cycles. Under conditions of constant darkness, Rorb -/- mice display an extended period of free-running rhythmicity. The overall behavioral phenotype of Rorb -/- mice, together with the chromosomal localization of the gene on mouse chromosome 4, suggested a close relationship to the spontaneous mouse mutation 'vacillans' described by Sirlin (1956) and now thought to be extinct It is appreciated that the abovementioned animal model for RORB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Evans, R. M.: The steroid and thyroid hormone receptor superfamily. Science 240:889-895, 1988; and Andre, E.; Conquet, F.; Steinmayr, M.; Stratton, S. C.; Porciatti, V.; Becker-Andre, M.: Disruption of retinoid-related orphan receptor beta changes circadian behavior, causes retinal deg.

Further studies establishing the function and utilities of RORB are found in John Hopkins OMIM database record ID 601972, and in sited publications numbered 8522, 8523-852 and 7778 listed in the bibliography section hereinbelow, which are also hereby incorporated by reference. Smoothened Homolog (Drosophila) (SMOH, Accession NM_005631) is another VGAM178 host target gene. SMOH BINDING SITE is HOST TARGET binding site found in the 3" untranslated region of mRNA encoded by SMOH, corresponding to a HOST TARGET binding site such as BINDING SITE I, BINDING SITE II or BINDING SITE III. Table 2 illustrates the complementarity of the nucleotide sequences of SMOH BINDING SITE, designated SEQ ID:12161, to the nucleotide sequence of VGAM178 RNA, herein designated VGAM RNA, also designated SEQ ID:2889.

Another function of VGAM178 is therefore inhibition of Smoothened Homolog (Drosophila) (SMOH, Accession NM_005631). Accordingly, utilities of VGAM178 include diagnosis, prevention and treatment of diseases and clinical conditions associated with SMOH. Suppression of Tumorigenicity 7 (ST7, Accession NM_021908) is another VGAM178 host target gene. ST7 BINDING SITE is HOST TARGET binding site found in the 3' untranslated region of mRNA encoded by ST7, corresponding to a HOST TARGET binding site such as BINDING SITE I, BINDING SITE II or BINDING SITE III. Table 2 illustrates the complementarity of the nucleotide sequences of ST7 BINDING SITE, designated SEQ ID:22428, to the nucleotide sequence of VGAM178 RNA, herein designated VGAM RNA, also designated SEQ ID:2889.

Another function of VGAM178 is therefore inhibition of Suppression of Tumorigenicity 7 (ST7, Accession NM_021908), a gene which has a role in regulating cell-environment or cell-cell interactions. Accordingly, utilities of VGAM178 include diagnosis, prevention and treatment of diseases and clinical conditions associated with ST7. The function of ST7 and its association with various diseases and clinical conditions, has been established by previous studies, as described hereinabove with reference to VGAM107. Synaptogyrin 1 (SYNGR1, Accession NM_004711) is another VGAM178 host target gene. SYNGR1 BINDING SITE is HOST TARGET binding site found in the 3' untranslated region of mRNA encoded by SYNGR1, corresponding to a HOST TARGET binding site such as BINDING SITE I, BINDING SITE II or BINDING SITE III. Table 2 illustrates the complementarity of the nucleotide sequences of SYNGR1 BINDING SITE, designated SEQ ID:11061, to the nucleotide sequence of VGAM178 RNA, herein designated VGAM RNA, also designated SEQ ID:2889.

Another function of VGAM178 is therefore inhibition of Synaptogyrin 1 (SYNGR1, Accession NM_004711), a gene which belongs to transmembrane synaptic vesicle protein and may function in membrane recycling. Accordingly, utilities of VGAM178 include diagnosis, prevention and treatment of diseases and clinical conditions associated with SYNGR1. The function of SYNGR1 and its association with various diseases and clinical conditions, has been established by previous studies, as described hereinabove with reference to VGAM107. Transcription Factor 2, Hepatic; LF-B3; Variant Hepatic Nuclear Factor (TCF2, Accession NM_006481) is another VGAM178 host target gene. TCF2 BINDING SITE1 and TCF2 BINDING SITE2 are HOST TARGET binding sites found in untranslated regions of mRNA encoded by TCF2, corresponding to HOST TARGET binding sites such as BINDING SITE I, BINDING SITE II or BINDING SITE III. Table 2 illustrates the complementarity of the nucleotide sequences of TCF2 BINDING SITE1 and TCF2 BINDING SITE2, designated SEQ ID:13199 and SEQ ID:6073 respectively, to the nucleotide sequence of VGAM178 RNA, herein designated VGAM RNA, also designated SEQ ID:2889.

Another function of VGAM178 is therefore inhibition of Transcription Factor 2, Hepatic; LF-B3; Variant Hepatic Nuclear Factor (TCF2, Accession NM_006481), a gene which probably binds to the inverted palindrome 5'-gttaatnat-taac-3'. Accordingly, utilities of VGAM178 include diagnosis, prevention and treatment of diseases and clinical conditions associated with TCF2. The function of TCF2 and its association with various diseases and clinical conditions, has been established by previous studies, as described hereinabove with reference to VGAM118. Transforming Growth Factor, Beta 1 (Camurati-Engelmann disease) (TGFB1, Accession NM_000660) is another VGAM178 host target gene. TGFB1 BINDING SITE is HOST TARGET binding site found in the 5' untranslated region of mRNA encoded by TGFB1, corresponding to a HOST TARGET binding site such as BINDING SITE I, BINDING SITE II or BINDING SITE III. Table 2 illustrates the complementarity of the nucleotide sequences of TGFB1 BINDING SITE, designated SEQ ID:6318, to the nucleotide sequence of VGAM178 RNA, herein designated VGAM RNA, also designated SEQ ID:2889.

Another function of VGAM178 is therefore inhibition of Transforming Growth Factor, Beta 1 (Camurati-Engelmann disease) (TGFB1, Accession NM_000660). Accordingly, utilities of VGAM178 include diagnosis, prevention and treatment of diseases and clinical conditions associated with TGFB1. Vang-like 2 (van gogh, Drosophila) (VANGL2, Accession XM_049695) is another VGAM178 host target gene. VANGL2 BINDING SITE is HOST TARGET binding site found in the 3' untranslated region of mRNA encoded by VANGL2, corresponding to a HOST TARGET binding site such as BINDING SITE I, BINDING SITE II or BINDING SITE III. Table 2 illustrates the complementarity of the nucleotide sequences of VANGL2 BINDING SITE, designated SEQ ID:35475, to the nucleotide sequence of VGAM178 RNA, herein designated VGAM RNA, also designated SEQ ID:2889.

Another function of VGAM178 is therefore inhibition of Vang-like 2 (van gogh, Drosophila) (VANGL2, Accession XM_049695), a gene which may take part in defining the lateral boundary of floorplate differentiation. Accordingly, utilities of VGAM178 include diagnosis, prevention and treatment of diseases and clinical conditions associated with VANGL2. The function of VANGL2 and its association with various diseases and clinical conditions, has been established by previous studies, as described hereinabove with reference to VGAM111. Wingless-type MMTV Integration Site Family Member 2 (WNT2, Accession NM_003391) is another VGAM178 host target gene. WNT2 BINDING SITE is HOST TARGET binding site found in the 3' untranslated region of mRNA encoded by WNT2, corresponding to a HOST TARGET binding site such as BINDING SITE I, BINDING SITE II or BINDING SITE III. Table 2 illustrates the complementarity of the nucleotide sequences of WNT2 BINDING SITE, designated SEQ ID:9427, to the nucleotide sequence of VGAM178 RNA, herein designated VGAM RNA, also designated SEQ ID:2889.

Another function of VGAM178 is therefore inhibition of Wingless-type MMTV Integration Site Family Member 2 (WNT2, Accession NM_003391), a gene which is the ligand for members of the frizzled family of seven transmembrane receptors. probable developmental protein and may be a signaling molecule. Accordingly, utilities of VGAM178 include diagnosis, prevention and treatment of diseases and clinical conditions associated with WNT2. The function of WNT2 has been established by previous studies. Wainwright et al. (1988) cloned from a human lung cDNA library an expressed gene sequence that was identified by isolation of a methylation-free CpG island from human chromosome 7. (Bird et al. (1985) described so-called HTF (HpaII tiny fragments) islands which are relatively rich in G/C and virtually free of methylation at the CpG dinucleotide. Such regions usually occur at discrete units, 1 to 2 kb long, which can be detected by analysis with methylation-sensitive restriction enzymes. HTF islands are particularly associated with the site of initiation of transcription and the first exons of genes. Both tissue-specific and housekeeping genes have been described in association with HTF islands (Bird, 1987). The characteristics of HTF islands make it possible to isolate selectively regions of the genome that are likely to contain structural genes.) As part of the strategy to isolate the gene for cystic fibrosis (OMIM Ref. No. 219700), Wainwright et al. (1988) found and characterized a coding sequence with marked similarity to the murine proto-oncogene Int1 and its Drosophila homolog ‘wingless,’ but which was distinct from the human INT1 gene located on chromosome 12 (OMIM Ref. No. 164820). Indirect evidence that INT1 is secreted and that the product of ‘wingless’ is a diffusible gene product suggests that these proteins are secreted growth factors. Wainwright et al. (1988) suggested that the INT1-related protein is an additional member of the INT1 growth factor gene family. Because of its homology to proto-oncogene INT1, IRP is also symbolized INT1L1. IRP is expressed in a variety of fetal and adult human tissues that do not overlap with the pattern of expression of INT1. Chan et al. (1989) isolated overlapping genomic clones that correspond to the mouse homolog of the IRP gene and demonstrated in mouse-hamster somatic cell hybrids that the gene is located on mouse chromosome 6. In addition, they showed that the mouse Int1l1 and Met genes coamplified in lines of spontaneously transformed mouse NIH 3T3 cells, indicating that these genes are closely linked. IRP is about 500 kb from MET (OMIM Ref. No. 164860); the CFTR gene (OMIM Ref. No. 602421) is in the 500-kb interval between IRP and a point 1,000 kb from MET. Anonymous probe J3.11 is about 500 kb farther distally. Nusse et al. (1991) suggested that IRP be referred to as WNT2. Wassink et al. (2001) examined WNT2 as a candidate gene for autism (OMIM Ref. No. 209850) for the following reasons: first, the WNT family of genes influences the development of numerous organs and systems, including the central nervous system; second, WNT2 is located in the 7q31-q33 region linked to autism and is adjacent to a chromosomal breakpoint in an individual with autism; third, a mouse knockout of the dishevelled-1 (DVL1; 601365) gene, a member of a gene family essential for the function of the WNT pathway, exhibits a behavioral phenotype characterized primarily by diminished social interaction. Wassink et al. (2001) found 2 families containing nonconservative coding sequence variants that segregated with autism. They also identified linkage disequilibrium between a WNT2 3-prime-untranslated region single nucleotide polymorphism (SNP) and their sample of autism-affected sib pair families and trios (2 parents and 1 affected child). Linkage disequilibrium occurred almost exclusively in a subgroup of affected sib pair families defined by the presence of severe language abnormalities and was also found to be associated with evidence for linkage to 7q. Expression analysis demonstrated WNT2 expression in the human thalamus. Using ribonuclease protection analysis, Huguet et al. (1994) investigated expression of WNT genes, including WNT2, in human cell lines, as well as in normal, benign, and malignant breast tissue. They detected WNT2 in human breast tissue and hypothesized that WNT2 may be associated with abnormal proliferation in breast tissue. In a later study, McCoy et al. (2002) could find no significant association between autistic disorder and WNT2 genotypes in either an overall dataset or a language-impaired subset of families. No activating mutation in the coding region of WNT2 was found.

Full details of the abovementioned studies are described in the following publications, the disclosure of which are hereby incorporated by reference:

Wainwright, B. J.; Scambler, P. J.; Stanier, P.; Watson, E. K.; Bell, G.; Wicking, C.; Estivill, X.; Courtney, M.; Bour, A.; Pedersen, P. S.; Williamson, R.; Farrall, M.: Isolation of a human gene with protein sequence similarity to human and murine int-1 and the Drosophila segment polarity mutant wingless. EMBO J. 7:1743-1748, 1988; and Wassink, T. H.; Piven, J.; Vieland, V. J.; Huang, J.; Swiderski, R. E.; Pietila, J.; Braun, T.; Beck, G.; Folstein, S. E.; Haines, J. L.; Sheffield, V. C.: Evidence supporting WNT2 as a.

Further studies establishing the function and utilities of WNT2 are found in John Hopkins OMIM database record ID 147870, and in sited publications numbered 3469, 392 and 3968-3973 listed in the bibliography section hereinbelow, which are also hereby incorporated by reference. BIKE (Accession NM_017593) is another VGAM178 host target gene. BIKE BINDING SITE is HOST TARGET binding site found in the 3' untranslated region of mRNA encoded by BIKE, corresponding to a HOST TARGET binding site such as BINDING SITE I, BINDING SITE II or BINDING SITE III. Table 2 illustrates the complementarity of the nucleotide sequences of BIKE BINDING SITE, designated SEQ ID:19038, to the nucleotide sequence of VGAM178 RNA, herein designated VGAM RNA, also designated SEQ ID:2889.

Another function of VGAM178 is therefore inhibition of BIKE (Accession NM_017593). Accordingly, utilities of VGAM178 include diagnosis, prevention and treatment of diseases and clinical conditions associated with BIKE. Baculoviral IAP Repeat-containing 4 (BIRC4, Accession NM_001167) is another VGAM178 host target gene. BIRC4 BINDING SITE is HOST TARGET binding site found in the 3' untranslated region of mRNA encoded by BIRC4, corresponding to a HOST TARGET binding site such as BIND- ING SITE I, BINDING SITE II or BINDING SITE III. Table 2 illustrates the complementarity of the nucleotide sequences of BIRC4 BINDING SITE, designated SEQ ID:6834, to the nucleotide sequence of VGAM178 RNA, herein designated VGAM RNA, also designated SEQ ID:2889.

Another function of VGAM178 is therefore inhibition of Baculoviral IAP Repeat-containing 4 (BIRC4, Accession NM_001167). Accordingly, utilities of VGAM178 include diagnosis, prevention and treatment of diseases and clinical conditions associated with BIRC4. Chromosome 20 Open Reading Frame 12 (C20orf12, Accession NM_018152) is another VGAM178 host target gene. C20orf12 BINDING SITE is HOST TARGET binding site found in the 3' untranslated region of mRNA encoded by C20orf12, corresponding to a HOST TARGET binding site such as BINDING SITE I, BINDING SITE II or BINDING SITE III. Table 2 illustrates the complementarity of the nucleotide sequences of C20orf12 BINDING SITE, designated SEQ ID:19957, to the nucleotide sequence of VGAM178 RNA, herein designated VGAM RNA, also designated SEQ ID:2889.

Another function of VGAM178 is therefore inhibition of Chromosome 20 Open Reading Frame 12 (C20orf12, Accession NM_018152). Accordingly, utilities of VGAM178 include diagnosis, prevention and treatment of diseases and clinical conditions associated with C20orf12. Calpain 6 (CAPN6, Accession NM_014289) is another VGAM178 host target gene. CAPN6 BINDING SITE is HOST TARGET binding site found in the 3' untranslated region of mRNA encoded by CAPN6, corresponding to a HOST TARGET binding site such as BINDING SITE I, BINDING SITE II or BINDING SITE III. Table 2 illustrates the complementarity of the nucleotide sequences of CAPN6 BINDING SITE, designated SEQ ID:15566, to the nucleotide sequence of VGAM178 RNA, herein designated VGAM RNA, also designated SEQ ID:2889.

Another function of VGAM178 is therefore inhibition of Calpain 6 (CAPN6, Accession NM_014289). Accordingly, utilities of VGAM178 include diagnosis, prevention and treatment of diseases and clinical conditions associated with CAPN6. Deiodinase, Iodothyronine, Type II (DIO2, Accession NM_013989) is another VGAM178 host target gene. DIO2 BINDING SITE is HOST TARGET binding site found in the 5' untranslated region of mRNA encoded by DIO2, corresponding to a HOST TARGET binding site such as BINDING SITE I, BINDING SITE II or BINDING SITE III. Table 2 illustrates the complementarity of the nucleotide sequences of DIO2 BINDING SITE, designated SEQ ID:15175, to the nucleotide sequence of VGAM178 RNA, herein designated VGAM RNA, also designated SEQ ID:2889.

Another function of VGAM178 is therefore inhibition of Deiodinase, Iodothyronine, Type II (DIO2, Accession NM_013989). Accordingly, utilities of VGAM178 include diagnosis, prevention and treatment of diseases and clinical conditions associated with DIO2. DKFZP434H132 (Accession XM_057020) is another VGAM178 host target gene. DKFZP434H132 BINDING SITE is HOST TARGET binding site found in the 5' untranslated region of mRNA encoded by DKFZP434H132, corresponding to a HOST TARGET binding site such as BINDING SITE I, BINDING SITE II or BINDING SITE III. Table 2 illustrates the complementarity of the nucleotide sequences of DKFZP434H132 BINDING SITE, designated SEQ ID:36444, to the nucleotide sequence of VGAM178 RNA, herein designated VGAM RNA, also designated SEQ ID:2889.

Another function of VGAM178 is therefore inhibition of DKFZP434H132 (Accession XM_057020). Accordingly, utilities of VGAM178 include diagnosis, prevention and treatment of diseases and clinical conditions associated with DKFZP434H132. DKFZP434L0718 (Accession NM_032139) is another VGAM178 host target gene. DKFZP434L0718 BINDING SITE is HOST TARGET binding site found in the 3' untranslated region of mRNA encoded by DKFZP434L0718, corresponding to a HOST TARGET binding site such as BINDING SITE I, BINDING SITE II or BINDING SITE III. Table 2 illustrates the complementarity of the nucleotide sequences of DKFZP434L0718 BINDING SITE, designated SEQ ID:25819, to the nucleotide sequence of VGAM178 RNA, herein designated VGAM RNA, also designated SEQ ID:2889.

Another function of VGAM178 is therefore inhibition of DKFZP434L0718 (Accession NM_032139). Accordingly, utilities of VGAM178 include diagnosis, prevention and treatment of diseases and clinical conditions associated with DKFZP434L0718. DKFZp547O146 (Accession NM_020224) is another VGAM178 host target gene. DKFZp547O146 BINDING SITE is HOST TARGET binding site found in the 5' untranslated region of mRNA encoded by DKFZp547O146, corresponding to a HOST TARGET binding site such as BINDING SITE I, BINDING SITE II or BINDING SITE III. Table 2 illustrates the complementarity of the nucleotide sequences of DKFZp547O146 BINDING SITE, designated SEQ ID:21486, to the nucleotide sequence of VGAM178 RNA, herein designated VGAM RNA, also designated SEQ ID:2889.

Another function of VGAM178 is therefore inhibition of DKFZp547O146 (Accession NM_020224). Accordingly, utilities of VGAM178 include diagnosis, prevention and treatment of diseases and clinical conditions associated with DKFZp547O146. Ephrin-A5 (EFNA5, Accession NM_001962) is another VGAM178 host target gene. EFNA5 BINDING SITE is HOST TARGET binding site found in the 5' untranslated region of mRNA encoded by EFNA5, corresponding to a HOST TARGET binding site such as BINDING SITE I, BINDING SITE II or BINDING SITE III. Table 2 illustrates the complementarity of the nucleotide sequences of EFNA5 BINDING SITE, designated SEQ ID:7684, to the nucleotide sequence of VGAM178 RNA, herein designated VGAM RNA, also designated SEQ ID:2889.

Another function of VGAM178 is therefore inhibition of Ephrin-A5 (EFNA5, Accession NM_001962). Accordingly, utilities of VGAM178 include diagnosis, prevention and treatment of diseases and clinical conditions associated with EFNA5. FLJ00001 (Accession XM_088525) is another VGAM178 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39774, to the nucleotide sequence of VGAM178 RNA, herein designated VGAM RNA, also designated SEQ ID:2889.

Another function of VGAM178 is therefore inhibition of FLJ00001 (Accession XM_088525). Accordingly, utilities of VGAM178 include diagnosis, prevention and treatment of diseases and clinical conditions associated with FLJ00001. FLJ12076 (Accession NM_025187) is another VGAM178 host target gene. FLJ12076 BINDING SITE is HOST TARGET binding site found in the 3' untranslated region of mRNA encoded by FLJ12076, corresponding to a HOST TARGET binding site such as BINDING SITE I, BINDING SITE II or BINDING SITE III. Table 2 illustrates the complementarity of the nucleotide sequences of FLJ12076 BIND- ING SITE, designated SEQ ID:24823, to the nucleotide sequence of VGAM178 RNA, herein designated VGAM RNA, also designated SEQ ID:2889.

Another function of VGAM178 is therefore inhibition of FLJ12076 (Accession NM_025187). Accordingly, utilities of VGAM178 include diagnosis, prevention and treatment of diseases and clinical conditions associated with FLJ12076. FLJ12363 (Accession NM_032167) is another VGAM178 host target gene. FLJ12363 BINDING SITE is HOST TARGET binding site found in the 3' untranslated region of mRNA encoded by FLJ12363, corresponding to a HOST TARGET binding site such as BINDING SITE I, BINDING SITE II or BINDING SITE III. Table 2 illustrates the complementarity of the nucleotide sequences of FLJ12363 BINDING SITE, designated SEQ ID:25865, to the nucleotide sequence of VGAM178 RNA, herein designated VGAM RNA, also designated SEQ ID:2889.

Another function of VGAM178 is therefore inhibition of FLJ12363 (Accession NM_032167). Accordingly, utilities of VGAM178 include diagnosis, prevention and treatment of diseases and clinical conditions associated with FLJ12363. FLJ13441 (Accession NM_023924) is another VGAM178 host target gene. FLJ13441 BINDING SITE is HOST TARGET binding site found in the 3' untranslated region of mRNA encoded by FLJ13441, corresponding to a HOST TARGET binding site such as BINDING SITE I, BINDING SITE II or BINDING SITE III. Table 2 illustrates the complementarity of the nucleotide sequences of FLJ13441 BINDING SITE, designated SEQ ID:23391, to the nucleotide sequence of VGAM178 RNA, herein designated VGAM RNA, also designated SEQ ID:2889.

Another function of VGAM178 is therefore inhibition of FLJ13441 (Accession NM_023924). Accordingly, utilities of VGAM178 include diagnosis, prevention and treatment of diseases and clinical conditions associated with FLJ13441. FLJ14594 (Accession NM_032808) is another VGAM178 host target gene. FLJ14594 BINDING SITE is HOST TARGET binding site found in the 3' untranslated region of mRNA encoded by FLJ14594, corresponding to a HOST TARGET binding site such as BINDING SITE I, BINDING SITE II or BINDING SITE III. Table 2 illustrates the complementarity of the nucleotide sequences of FLJ14594 BINDING SITE, designated SEQ ID:26565, to the nucleotide sequence of VGAM178 RNA, herein designated VGAM RNA, also designated SEQ ID:2889.

Another function of VGAM178 is therefore inhibition of FLJ14594 (Accession NM_032808). Accordingly, utilities of VGAM178 include diagnosis, prevention and treatment of diseases and clinical conditions associated with FLJ14594. FLJ20898 (Accession NM_024600) is another VGAM178 host target gene. FLJ20898 BINDING SITE is HOST TARGET binding site found in the 3' untranslated region of mRNA encoded by FLJ20898, corresponding to a HOST TARGET binding site such as BINDING SITE I, BINDING SITE II or BINDING SITE III. Table 2 illustrates the complementarity of the nucleotide sequences of FLJ20898 BINDING SITE, designated SEQ ID:23850, to the nucleotide sequence of VGAM178 RNA, herein designated VGAM RNA, also designated SEQ ID:2889.

Another function of VGAM178 is therefore inhibition of FLJ20898 (Accession NM_024600). Accordingly, utilities of VGAM178 include diagnosis, prevention and treatment of diseases and clinical conditions associated with FLJ20898. FLJ21603 (Accession NM_024762) is another VGAM178 host target gene. FLJ21603 BINDING SITE is HOST TARGET binding site found in the 3' untranslated region of mRNA encoded by FLJ21603, corresponding to a HOST TARGET binding site such as BINDING SITE I, BINDING SITE II or BINDING SITE III. Table 2 illustrates the complementarity of the nucleotide sequences of FLJ21603 BINDING SITE, designated SEQ ID:24118, to the nucleotide sequence of VGAM178 RNA, herein designated VGAM RNA, also designated SEQ ID:2889.

Another function of VGAM178 is therefore inhibition of FLJ21603 (Accession NM_024762). Accordingly, utilities of VGAM178 include diagnosis, prevention and treatment of diseases and clinical conditions associated with FLJ21603. FLJ22938 (Accession NM_024676) is another VGAM178 host target gene. FLJ22938 BINDING SITE is HOST TARGET binding site found in the 3' untranslated region of mRNA encoded by FLJ22938, corresponding to a HOST TARGET binding site such as BINDING SITE I, BINDING SITE II or BINDING SITE III. Table 2 illustrates the complementarity of the nucleotide sequences of FLJ22938 BINDING SITE, designated SEQ ID:23985, to the nucleotide sequence of VGAM178 RNA, herein designated VGAM RNA, also designated SEQ ID:2889.

Another function of VGAM178 is therefore inhibition of FLJ22938 (Accession NM_024676). Accordingly, utilities of VGAM178 include diagnosis, prevention and treatment of diseases and clinical conditions associated with FLJ22938. GW112 (Accession NM_006418) is another VGAM178 host target gene. GW112 BINDING SITE is HOST TARGET binding site found in the 3' untranslated region of mRNA encoded by GW112, corresponding to a HOST TARGET binding site such as BINDING SITE I, BINDING SITE II or BINDING SITE III. Table 2 illustrates the complementarity of the nucleotide sequences of GW112 BINDING SITE, designated SEQ ID:13130, to the nucleotide sequence of VGAM178 RNA, herein designated VGAM RNA, also designated SEQ ID:2889.

Another function of VGAM178 is therefore inhibition of GW112 (Accession NM_006418). Accordingly, utilities of VGAM178 include diagnosis, prevention and treatment of diseases and clinical conditions associated with GW112. Histamine Receptor H3 (HRH3, Accession NM_007232) is another VGAM178 host target gene. HRH3 BINDING SITE is HOST TARGET binding site found in the 3' untranslated region of mRNA encoded by HRH3, corresponding to a HOST TARGET binding site such as BINDING SITE I, BINDING SITE II or BINDING SITE III. Table 2 illustrates the complementarity of the nucleotide sequences of HRH3 BINDING SITE, designated SEQ ID:14107, to the nucleotide sequence of VGAM178 RNA, herein designated VGAM RNA, also designated SEQ ID:2889.

Another function of VGAM178 is therefore inhibition of Histamine Receptor H3 (HRH3, Accession NM_007232). Accordingly, utilities of VGAM178 include diagnosis, prevention and treatment of diseases and clinical conditions associated with HRH3. KIAA0446 (Accession XM_044155) is another VGAM178 host target gene. KIAA0446 BINDING SITE is HOST TARGET binding site found in the 3' untranslated region of mRNA encoded by KIAA0446, corresponding to a HOST TARGET binding site such as BINDING SITE I, BINDING SITE II or BINDING SITE III. Table 2 illustrates the complementarity of the nucleotide sequences of KIAA0446 BINDING SITE, designated SEQ ID:34146, to the nucleotide sequence of VGAM178 RNA, herein designated VGAM RNA, also designated SEQ ID:2889.

Another function of VGAM178 is therefore inhibition of KIAA0446 (Accession XM_044155). Accordingly, utilities of VGAM178 include diagnosis, prevention and treatment of diseases and clinical conditions associated with KIAA0446. KIAA0563 (Accession NM_014834) is another VGAM178 host target gene. KIAA0563 BINDING SITE is HOST TARGET binding site found in the 5' untranslated region of mRNA encoded by KIAA0563, corresponding to a HOST TARGET binding site such as BINDING SITE I, BINDING SITE II or BINDING SITE III. Table 2 illustrates the complementarity of the nucleotide sequences of KIAA0563 BINDING SITE, designated SEQ ID:16840, to the nucleotide sequence of VGAM178 RNA, herein designated VGAM RNA, also designated SEQ ID:2889.

Another function of VGAM178 is therefore inhibition of KIAA0563 (Accession NM_014834). Accordingly, utilities of VGAM178 include diagnosis, prevention and treatment of diseases and clinical conditions associated with KIAA0563. KIAA0630 (Accession XM_114729) is another VGAM178 host target gene. KIAA0630 BINDING SITE is HOST TARGET binding site found in the 3' untranslated region of mRNA encoded by KIAA0630, corresponding to a HOST TARGET binding site such as BINDING SITE I, BINDING SITE II or BINDING SITE III. Table 2 illustrates the complementarity of the nucleotide sequences of KIAA0630 BINDING SITE, designated SEQ ID:43059, to the nucleotide sequence of VGAM178 RNA, herein designated VGAM RNA, also designated SEQ ID:2889.

Another function of VGAM178 is therefore inhibition of KIAA0630 (Accession XM_114729). Accordingly, utilities of VGAM178 include diagnosis, prevention and treatment of diseases and clinical conditions associated with KIAA0630. KIAA0773 (Accession NM_014690) is another VGAM178 host target gene. KIAA0773 BINDING SITE is HOST TARGET binding site found in the 3' untranslated region of mRNA encoded by KIAA0773, corresponding to a HOST TARGET binding site such as BINDING SITE I, BINDING SITE II or BINDING SITE III. Table 2 illustrates the complementarity of the nucleotide sequences of KIAA0773 BINDING SITE, designated SEQ ID:16193, to the nucleotide sequence of VGAM178 RNA, herein designated VGAM RNA, also designated SEQ ID:2889.

Another function of VGAM178 is therefore inhibition of KIAA0773 (Accession NM_014690). Accordingly, utilities of VGAM178 include diagnosis, prevention and treatment of diseases and clinical conditions associated with KIAA0773. KIAA0903 (Accession XM_049251) is another VGAM178 host target gene. KIAA0903 BINDING SITE is HOST TARGET binding site found in the 3' untranslated region of mRNA encoded by KIAA0903, corresponding to a HOST TARGET binding site such as BINDING SITE I, BINDING SITE II or BINDING SITE III. Table 2 illustrates the complementarity of the nucleotide sequences of KIAA0903 BINDING SITE, designated SEQ ID:35371, to the nucleotide sequence of VGAM178 RNA, herein designated VGAM RNA, also designated SEQ ID:2889.

Another function of VGAM178 is therefore inhibition of KIAA0903 (Accession XM_049251). Accordingly, utilities of VGAM178 include diagnosis, prevention and treatment of diseases and clinical conditions associated with KIAA0903. KIAA1016 (Accession XM_166260) is another VGAM178 host target gene. KIAA1016 BINDING SITE is HOST TARGET binding site found in the 5' untranslated region of mRNA encoded by KIAA1016, corresponding to a HOST TARGET binding site such as BINDING SITE I, BINDING SITE II or BINDING SITE III. Table 2 illustrates the complementarity of the nucleotide sequences of KIAA1016 BINDING SITE, designated SEQ ID:44084, to the nucleotide sequence of VGAM178 RNA, herein designated VGAM RNA, also designated SEQ ID:2889.

Another function of VGAM178 is therefore inhibition of KIAA1016 (Accession XM_166260). Accordingly, utilities of VGAM178 include diagnosis, prevention and treatment of diseases and clinical conditions associated with KIAA1016. KIAA1554 (Accession XM_170834) is another VGAM178 host target gene. KIAA1554 BINDING SITE is HOST TARGET binding site found in the 3' untranslated region of mRNA encoded by KIAA1554, corresponding to a HOST TARGET binding site such as BINDING SITE I, BINDING SITE II or BINDING SITE III. Table 2 illustrates the complementarity of the nucleotide sequences of KIAA1554 BINDING SITE, designated SEQ ID:45609, to the nucleotide sequence of VGAM178 RNA, herein designated VGAM RNA, also designated SEQ ID:2889.

Another function of VGAM178 is therefore inhibition of KIAA1554 (Accession XM_170834). Accordingly, utilities of VGAM178 include diagnosis, prevention and treatment of diseases and clinical conditions associated with KIAA1554. KIAA1582 (Accession XM_037262) is another VGAM178 host target gene. KIAA1582 BINDING SITE is HOST TARGET binding site found in the 5' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32584, to the nucleotide sequence of VGAM178 RNA, herein designated VGAM RNA, also designated SEQ ID:2889.

Another function of VGAM178 is therefore inhibition of KIAA1582 (Accession XM_037262). Accordingly, utilities of VGAM178 include diagnosis, prevention and treatment of diseases and clinical conditions associated with KIAA1582. KIAA1817 (Accession XM_042978) is another VGAM178 host target gene. KIAA1817 BINDING SITE is HOST TARGET binding site found in the 3' untranslated region of mRNA encoded by KIAA1817, corresponding to a HOST TARGET binding site such as BINDING SITE I, BINDING SITE II or BINDING SITE III. Table 2 illustrates the complementarity of the nucleotide sequences of KIAA1817 BINDING SITE, designated SEQ ID:33861, to the nucleotide sequence of VGAM178 RNA, herein designated VGAM RNA, also designated SEQ ID:2889.

Another function of VGAM178 is therefore inhibition of KIAA1817 (Accession XM_042978). Accordingly, utilities of VGAM178 include diagnosis, prevention and treatment of diseases and clinical conditions associated with KIAA1817. KIAA1853 (Accession XM_045184) is another VGAM178 host target gene. KIAA1853 BINDING SITE is HOST TARGET binding site found in the 3' untranslated region of mRNA encoded by KIAA1853, corresponding to a HOST TARGET binding site such as BINDING SITE I, BINDING SITE II or BINDING SITE III. Table 2 illustrates the complementarity of the nucleotide sequences of KIAA1853 BINDING SITE, designated SEQ ID:34383, to the nucleotide sequence of VGAM178 RNA, herein designated VGAM RNA, also designated SEQ ID:2889.

Another function of VGAM178 is therefore inhibition of KIAA1853 (Accession XM_045184). Accordingly, utilities of VGAM178 include diagnosis, prevention and treatment of diseases and clinical conditions associated with KIAA1853. KIAA1940 (Accession XM_086981) is another VGAM178 host target gene. KIAA1940 BINDING SITE is HOST TARGET binding site found in the 5' untranslated region of mRNA encoded by KIAA1940, corresponding to a HOST TARGET binding site such as BINDING SITE I, BINDING SITE II or BINDING SITE III. Table 2 illustrates the complementarity of the nucleotide sequences of KIAA1940 BINDING SITE, designated SEQ ID:39004, to the nucleotide sequence of VGAM178 RNA, herein designated VGAM RNA, also designated SEQ ID:2889.

Another function of VGAM178 is therefore inhibition of KIAA1940 (Accession XM_086981). Accordingly, utilities of VGAM178 include diagnosis, prevention and treatment of diseases and clinical conditions associated with KIAA1940. Myristoylated Alanine-rich Protein Kinase C Substrate (MARCKS, Accession NM_002356) is another VGAM178 host target gene. MARCKS BINDING SITE is HOST TARGET binding site found in the 5' untranslated region of mRNA encoded by MARCKS, corresponding to a HOST TARGET binding site such as BINDING SITE I, BINDING SITE II or BINDING SITE III. Table 2 illustrates the complementarity of the nucleotide sequences of MARCKS BINDING SITE, designated SEQ ID:8166, to the nucleotide sequence of VGAM178 RNA, herein designated VGAM RNA, also designated SEQ ID:2889.

Another function of VGAM178 is therefore inhibition of Myristoylated Alanine-rich Protein Kinase C Substrate (MARCKS, Accession NM_002356). Accordingly, utilities of VGAM178 include diagnosis, prevention and treatment of diseases and clinical conditions associated with MARCKS. MGC15619 (Accession NM_032369) is another VGAM178 host target gene. MGC15619 BINDING SITE is HOST TARGET binding site found in the 5' untranslated region of mRNA encoded by MGC15619, corresponding to a HOST TARGET binding site such as BINDING SITE I, BINDING SITE II or BINDING SITE III. Table 2 illustrates the complementarity of the nucleotide sequences of MGC15619 BINDING SITE, designated SEQ ID:26158, to the nucleotide sequence of VGAM178 RNA, herein designated VGAM RNA, also designated SEQ ID:2889.

Another function of VGAM178 is therefore inhibition of MGC15619 (Accession NM_032369). Accordingly, utilities of VGAM178 include diagnosis, prevention and treatment of diseases and clinical conditions associated with MGC15619. MGC20460 (Accession NM_053043) is another VGAM178 host target gene. MGC20460 BINDING SITE is HOST TARGET binding site found in the 5' untranslated region of mRNA encoded by MGC20460, corresponding to a HOST TARGET binding site such as BINDING SITE I, BINDING SITE II or BINDING SITE III. Table 2 illustrates the complementarity of the nucleotide sequences of MGC20460 BINDING SITE, designated SEQ ID:27586, to the nucleotide sequence of VGAM178 RNA, herein designated VGAM RNA, also designated SEQ ID:2889.

Another function of VGAM178 is therefore inhibition of MGC20460 (Accession NM_053043). Accordingly, utilities of VGAM178 include diagnosis, prevention and treatment of diseases and clinical conditions associated with MGC20460. MGC2744 (Accession XM_017557) is another VGAM178 host target gene. MGC2744 BINDING SITE is HOST TARGET binding site found in the 5' untranslated region of mRNA encoded by MGC2744, corresponding to a HOST TARGET binding site such as BINDING SITE I, BINDING SITE II or BINDING SITE III. Table 2 illustrates the complementarity of the nucleotide sequences of MGC2744 BINDING SITE, designated SEQ ID:30325, to the nucleotide sequence of VGAM178 RNA, herein designated VGAM RNA, also designated SEQ ID:2889.

Another function of VGAM178 is therefore inhibition of MGC2744 (Accession XM_017557). Accordingly, utilities of VGAM178 include diagnosis, prevention and treatment of diseases and clinical conditions associated with MGC2744. MGC3248 (Accession NM_032486) is another VGAM178 host target gene. MGC3248 BINDING SITE is HOST TARGET binding site found in the 3' untranslated region of mRNA encoded by MGC3248, corresponding to a HOST TARGET binding site such as BINDING SITE I, BINDING SITE II or BINDING SITE III. Table 2 illustrates the complementarity of the nucleotide sequences of MGC3248 BINDING SITE, designated SEQ ID:26237, to the nucleotide sequence of VGAM178 RNA, herein designated VGAM RNA, also designated SEQ ID:2889.

Another function of VGAM178 is therefore inhibition of MGC3248 (Accession NM_032486). Accordingly, utilities of VGAM178 include diagnosis, prevention and treatment of diseases and clinical conditions associated with MGC3248. NIR3 (Accession XM_038799) is another VGAM178 host target gene. NIR3 BINDING SITE is HOST TARGET binding site found in the 3' untranslated region of mRNA encoded by NIR3, corresponding to a HOST TARGET binding site such as BINDING SITE I, BINDING SITE II or BINDING SITE III. Table 2 illustrates the complementarity of the nucleotide sequences of NIR3 BINDING SITE, designated SEQ ID:32926, to the nucleotide sequence of VGAM178 RNA, herein designated VGAM RNA, also designated SEQ ID:2889.

Another function of VGAM178 is therefore inhibition of NIR3 (Accession XM_038799). Accordingly, utilities of VGAM178 include diagnosis, prevention and treatment of diseases and clinical conditions associated with NIR3. Purinergic Receptor P2X, Ligand-gated Ion Channel, 1 (P2RX1, Accession XM_040635) is another VGAM178 host target gene. P2RX1 BINDING SITE is HOST TARGET binding site found in the 5' untranslated region of mRNA encoded by P2RX1, corresponding to a HOST TARGET binding site such as BINDING SITE I, BINDING SITE II or BINDING SITE III. Table 2 illustrates the complementarity of the nucleotide sequences of P2RX1 BINDING SITE, designated SEQ ID:33352, to the nucleotide sequence of VGAM178 RNA, herein designated VGAM RNA, also designated SEQ ID:2889.

Another function of VGAM178 is therefore inhibition of Purinergic Receptor P2X, Ligand-gated Ion Channel, 1 (P2RX1, Accession XM_040635). Accordingly, utilities of VGAM178 include diagnosis, prevention and treatment of diseases and clinical conditions associated with P2RX1. Paternally Expressed 10 (PEG10, Accession NM_015068) is another VGAM178 host target gene. PEG10 BINDING SITE is HOST TARGET binding site found in the 3' untranslated region of mRNA encoded by PEG10, corresponding to a HOST TARGET binding site such as BINDING SITE I, BINDING SITE II or BINDING SITE III. Table 2 illustrates the complementarity of the nucleotide sequences of PEG10 BINDING SITE, designated SEQ ID:17424, to the nucleotide sequence of VGAM178 RNA, herein designated VGAM RNA, also designated SEQ ID:2889.

Another function of VGAM178 is therefore inhibition of Paternally Expressed 10 (PEG10, Accession NM_015068). Accordingly, utilities of VGAM178 include diagnosis, prevention and treatment of diseases and clinical conditions associated with PEG10. Protein Tyrosine Phosphatase, Non-receptor Type Substrate 1 (PTPNS1, Accession NM_080792) is another VGAM178 host target gene. PTPNS1 BINDING SITE is HOST TARGET binding site found in the 3' untranslated region of mRNA encoded by PTPNS1, corresponding to a HOST TARGET binding site such as BINDING SITE I, BINDING SITE II or BINDING SITE III. Table 2 illustrates the complementarity of the nucleotide sequences of PTPNS1 BINDING SITE, designated SEQ ID:28050, to the nucleotide sequence of VGAM178 RNA, herein designated VGAM RNA, also designated SEQ ID:2889.

Another function of VGAM178 is therefore inhibition of Protein Tyrosine Phosphatase, Non-receptor Type Substrate 1 (PTPNS1, Accession NM_080792). Accordingly, utilities of VGAM178 include diagnosis, prevention and treatment of diseases and clinical conditions associated with PTPNS1. Ribosomal Protein S6 Kinase, 90 kDa, Polypeptide 4 (RPS6KA4, Accession NM_003942) is another VGAM178 host target gene. RPS6KA4 BINDING SITE is HOST TARGET binding site found in the 3' untranslated region of mRNA encoded by RPS6KA4, corresponding to a HOST TARGET binding site such as BINDING SITE I, BINDING SITE II or BINDING SITE III. Table 2 illustrates the complementarity of the nucleotide sequences of RPS6KA4 BINDING SITE, designated SEQ ID:10052, to the nucleotide sequence of VGAM178 RNA, herein designated VGAM RNA, also designated SEQ ID:2889.

Another function of VGAM178 is therefore inhibition of Ribosomal Protein S6 Kinase, 90 kDa, Polypeptide 4 (RPS6KA4, Accession NM_003942). Accordingly, utilities of VGAM178 include diagnosis, prevention and treatment of diseases and clinical conditions associated with RPS6KA4. SCAMP-4 (Accession NM_079834) is another VGAM178 host target gene. SCAMP-4 BINDING SITE is HOST TARGET binding site found in the 3' untranslated region of mRNA encoded by SCAMP-4, corresponding to a HOST TARGET binding site such as BINDING SITE I, BINDING SITE II or BINDING SITE III. Table 2 illustrates the complementarity of the nucleotide sequences of SCAMP-4 BINDING SITE, designated SEQ ID:27819, to the nucleotide sequence of VGAM178 RNA, herein designated VGAM RNA, also designated SEQ ID:2889.

Another function of VGAM178 is therefore inhibition of SCAMP-4 (Accession NM_079834). Accordingly, utilities of VGAM178 include diagnosis, prevention and treatment of diseases and clinical conditions associated with SCAMP-4. SCLY (Accession NM_016510) is another VGAM178 host target gene. SCLY BINDING SITE is HOST TARGET binding site found in the 3" untranslated region of mRNA encoded by SCLY, corresponding to a HOST TARGET binding site such as BINDING SITE I, BINDING SITE II or BINDING SITE III. Table 2 illustrates the complementarity of the nucleotide sequences of SCLY BINDING SITE, designated SEQ ID:18589, to the nucleotide sequence of VGAM178 RNA, herein designated VGAM RNA, also designated SEQ ID:2889.

Another function of VGAM178 is therefore inhibition of SCLY (Accession NM_016510). Accordingly, utilities of VGAM178 include diagnosis, prevention and treatment of diseases and clinical conditions associated with SCLY. Sep.in 3 (SEPT3, Accession NM_019106) is another VGAM178 host target gene. SEPT3 BINDING SITE1 and SEPT3 BINDING SITE2 are HOST TARGET binding sites found in untranslated regions of mRNA encoded by SEPT3, corresponding to HOST TARGET binding sites such as BINDING SITE I, BINDING SITE II or BINDING SITE III. Table 2 illustrates the complementarity of the nucleotide sequences of SEPT3 BINDING SITE1 and SEPT3 BINDING SITE2, designated SEQ ID:21178 and SEQ ID:21177 respectively, to the nucleotide sequence of VGAM178 RNA, herein designated VGAM RNA, also designated SEQ ID:2889.

Another function of VGAM178 is therefore inhibition of Sep.in 3 (SEPT3, Accession NM_019106). Accordingly, utilities of VGAM178 include diagnosis, prevention and treatment of diseases and clinical conditions associated with SEPT3. Solute Carrier Family 12 (potassium/chloride transporters), Member 8 (SLC12A8, Accession NM_024628) is another VGAM178 host target gene. SLC12A8 BINDING SITE is HOST TARGET binding site found in the 3' untranslated region of mRNA encoded by SLC12A8, corresponding to a HOST TARGET binding site such as BINDING SITE I, BINDING SITE II or BINDING SITE III. Table 2 illustrates the complementarity of the nucleotide sequences of SLC12A8 BINDING SITE, designated SEQ ID:23893, to the nucleotide sequence of VGAM178 RNA, herein designated VGAM RNA, also designated SEQ ID:2889.

Another function of VGAM178 is therefore inhibition of Solute Carrier Family 12 (potassium/chloride transporters), Member 8 (SLC12A8, Accession NM_024628). Accordingly, utilities of VGAM178 include diagnosis, prevention and treatment of diseases and clinical conditions associated with SLC12A8. SFRS Protein Kinase 1 (SRPK1, Accession NM_003137) is another VGAM178 host target gene. SRPK1 BINDING SITE is HOST TARGET binding site found in the 3' untranslated region of mRNA encoded by SRPK1, corresponding to a HOST TARGET binding site such as BINDING SITE I, BINDING SITE II or BINDING SITE III. Table 2 illustrates the complementarity of the nucleotide sequences of SRPK1 BINDING SITE, designated SEQ ID:9109, to the nucleotide sequence of VGAM178 RNA, herein designated VGAM RNA, also designated SEQ ID:2889.

Another function of VGAM178 is therefore inhibition of SFRS Protein Kinase 1 (SRPK1, Accession NM_003137). Accordingly, utilities of VGAM178 include diagnosis, prevention and treatment of diseases and clinical conditions associated with SRPK1. Uronyl-2-sulfotransferase (UST, Accession NM_005715) is another VGAM178 host target gene. UST BINDING SITE is HOST TARGET binding site found in the 3' untranslated region of mRNA encoded by UST, corresponding to a HOST TARGET binding site such as BINDING SITE I, BINDING SITE II or BINDING SITE III. Table 2 illustrates the complementarity of the nucleotide sequences of UST BINDING SITE, designated SEQ ID:12270, to the nucleotide sequence of VGAM178 RNA, herein designated VGAM RNA, also designated SEQ ID:2889.

Another function of VGAM178 is therefore inhibition of Uronyl-2-sulfotransferase (UST, Accession NM_005715). Accordingly, utilities of VGAM178 include diagnosis, prevention and treatment of diseases and clinical conditions associated with UST. VELI1 (Accession NM_004664) is another VGAM178 host target gene. VELI1 BINDING SITE is HOST TARGET binding site found in the 5' untranslated region of mRNA encoded by VELI1, corresponding to a HOST TARGET binding site such as BINDING SITE I, BINDING SITE II or BINDING SITE III. Table 2 illustrates the complementarity of the nucleotide sequences of VELI1 BINDING SITE, designated SEQ ID:11037, to the nucleotide sequence of VGAM178 RNA, herein designated VGAM RNA, also designated SEQ ID:2889.

Another function of VGAM178 is therefore inhibition of VELI1 (Accession NM_004664). Accordingly, utilities of VGAM178 include diagnosis, prevention and treatment of diseases and clinical conditions associated with VELI1. LOC126823 (Accession XM_059086) is another VGAM178 host target gene. LOC126823 BINDING SITE is HOST TARGET binding site found in the 5' untranslated region of mRNA encoded by LOC126823, corresponding to a HOST TARGET binding site such as BINDING SITE I, BINDING SITE II or BINDING SITE III. Table 2 illustrates the complementarity of the nucleotide sequences of LOC126823 BINDING SITE, designated SEQ ID:36863, to the nucleotide sequence of VGAM178 RNA, herein designated VGAM RNA, also designated SEQ ID:2889.

Another function of VGAM178 is therefore inhibition of LOC126823 (Accession XM_059086). Accordingly, utilities of VGAM178 include diagnosis, prevention and treatment of diseases and clinical conditions associated with LOC126823.

LOC129303 (Accession XM_059343) is another VGAM178 host target gene. LOC129303 BINDING SITE is HOST TARGET binding site found in the 5' untranslated region of mRNA encoded by LOC129303, corresponding to a HOST TARGET binding site such as BINDING SITE I, BINDING SITE II or BINDING SITE III. Table 2 illustrates the complementarity of the nucleotide sequences of LOC129303 BINDING SITE, designated SEQ ID:36969, to the nucleotide sequence of VGAM178 RNA, herein designated VGAM RNA, also designated SEQ ID:2889.

Another function of VGAM178 is therefore inhibition of LOC129303 (Accession XM_059343). Accordingly, utilities of VGAM178 include diagnosis, prevention and treatment of diseases and clinical conditions associated with LOC129303.

LOC146108 (Accession XM_085322) is another VGAM178 host target gene. LOC146108 BINDING SITE is HOST TARGET binding site found in the 3' untranslated region of mRNA encoded by LOC146108, corresponding to a HOST TARGET binding site such as BINDING SITE I, BINDING SITE II or BINDING SITE III. Table 2 illustrates the complementarity of the nucleotide sequences of LOC146108 BINDING SITE, designated SEQ ID:38061, to the nucleotide sequence of VGAM178 RNA, herein designated VGAM RNA, also designated SEQ ID:2889.

Another function of VGAM178 is therefore inhibition of LOC146108 (Accession XM_085322). Accordingly, utilities of VGAM178 include diagnosis, prevention and treatment of diseases and clinical conditions associated with LOC146108.

LOC146237 (Accession XM_096954) is another VGAM178 host target gene. LOC146237 BINDING SITE is HOST TARGET binding site found in the 3' untranslated region of mRNA encoded by LOC146237, corresponding to a HOST TARGET binding site such as BINDING SITE I, BINDING SITE II or BINDING SITE III. Table 2 illustrates the complementarity of the nucleotide sequences of LOC146237 BINDING SITE, designated SEQ ID:40665, to the nucleotide sequence of VGAM178 RNA, herein designated VGAM RNA, also designated SEQ ID:2889.

Another function of VGAM178 is therefore inhibition of LOC146237 (Accession XM_096954). Accordingly, utilities of VGAM178 include diagnosis, prevention and treatment of diseases and clinical conditions associated with LOC146237.

LOC146745 (Accession XM_085577) is another VGAM178 host target gene. LOC146745 BINDING SITE is HOST TARGET binding site found in the 5' untranslated region of mRNA encoded by LOC146745, corresponding to a HOST TARGET binding site such as BINDING SITE I, BINDING SITE II or BINDING SITE III. Table 2 illustrates the complementarity of the nucleotide sequences of LOC146745 BINDING SITE, designated SEQ ID:38231, to the nucleotide sequence of VGAM178 RNA, herein designated VGAM RNA, also designated SEQ ID:2889.

Another function of VGAM178 is therefore inhibition of LOC146745 (Accession XM_085577). Accordingly, utilities of VGAM178 include diagnosis, prevention and treatment of diseases and clinical conditions associated with LOC146745.

LOC147071 (Accession XM_054031) is another VGAM178 host target gene. LOC147071 BINDING SITE is HOST TARGET binding site found in the 5' untranslated region of mRNA encoded by LOC147071, corresponding to a HOST TARGET binding site such as BINDING SITE I, BINDING SITE II or BINDING SITE III. Table 2 illustrates the complementarity of the nucleotide sequences of LOC147071 BINDING SITE, designated SEQ ID:36134, to the nucleotide sequence of VGAM178 RNA, herein designated VGAM RNA, also designated SEQ ID:2889.

Another function of VGAM178 is therefore inhibition of LOC147071 (Accession XM_054031). Accordingly, utilities of VGAM178 include diagnosis, prevention and treatment of diseases and clinical conditions associated with LOC147071.

LOC147669 (Accession XM_097262) is another VGAM178 host target gene. LOC147669 BINDING SITE is HOST TARGET binding site found in the 5' untranslated region of mRNA encoded by LOC147669, corresponding to a HOST TARGET binding site such as BINDING SITE I, BINDING SITE II or BINDING SITE III. Table 2 illustrates the complementarity of the nucleotide sequences of LOC147669 BINDING SITE, designated SEQ ID:40853, to the nucleotide sequence of VGAM178 RNA, herein designated VGAM RNA, also designated SEQ ID:2889.

Another function of VGAM178 is therefore inhibition of LOC147669 (Accession XM_097262). Accordingly, utilities of VGAM178 include diagnosis, prevention and treatment of diseases and clinical conditions associated with LOC147669.

LOC148255 (Accession XM_086120) is another VGAM178 host target gene. LOC148255 BINDING SITE1 and LOC148255 BINDING SITE2 are HOST TARGET binding sites found in untranslated regions of mRNA encoded by LOC148255, corresponding to HOST TARGET binding sites such as BINDING SITE I, BINDING SITE II or BINDING SITE III. Table 2 illustrates the complementarity of the nucleotide sequences of LOC148255 BINDING SITE1 and LOC148255 BINDING SITE2, designated SEQ ID:38498 and SEQ ID:38499 respectively, to the nucleotide sequence of VGAM178 RNA, herein designated VGAM RNA, also designated SEQ ID:2889.

Another function of VGAM178 is therefore inhibition of LOC148255 (Accession XM_086120). Accordingly, utilities of VGAM178 include diagnosis, prevention and treatment of diseases and clinical conditions associated with LOC148255.

LOC148946 (Accession XM_097557) is another VGAM178 host target gene. LOC148946 BINDING SITE is HOST TARGET binding site found in the 5' untranslated region of mRNA encoded by LOC148946, corresponding to a HOST TARGET binding site such as BINDING SITE I, BINDING SITE II or BINDING SITE III. Table 2 illustrates the complementarity of the nucleotide sequences of LOC148946 BINDING SITE, designated SEQ ID:40936, to the nucleotide sequence of VGAM178 RNA, herein designated VGAM RNA, also designated SEQ ID:2889.

Another function of VGAM178 is therefore inhibition of LOC148946 (Accession XM_097557). Accordingly, utilities of VGAM178 include diagnosis, prevention and treatment of diseases and clinical conditions associated with LOC148946.

LOC149296 (Accession XM_086481) is another VGAM178 host target gene. LOC149296 BINDING SITE is HOST TARGET binding site found in the 5' untranslated region of mRNA encoded by LOC149296, corresponding to a HOST TARGET binding site such as BINDING SITE I, BINDING SITE II or BINDING SITE III. Table 2 illustrates the complementarity of the nucleotide sequences of LOC149296 BINDING SITE, designated SEQ ID:38693, to the nucleotide sequence of VGAM178 RNA, herein designated VGAM RNA, also designated SEQ ID:2889.

Another function of VGAM178 is therefore inhibition of LOC149296 (Accession XM_086481). Accordingly, utilities of VGAM178 include diagnosis, prevention and treatment of diseases and clinical conditions associated with LOC149296.

LOC151174 (Accession XM_098013) is another VGAM178 host target gene. LOC151174 BINDING SITE is HOST TARGET binding site found in the 5' untranslated region of mRNA encoded by LOC151174, corresponding to a HOST TARGET binding site such as BINDING SITE I, BINDING SITE II or BINDING SITE III. Table 2 illustrates the complementarity of the nucleotide sequences of LOC151174 BINDING SITE, designated SEQ ID:41310, to the nucleotide sequence of VGAM178 RNA, herein designated VGAM RNA, also designated SEQ ID:2889.

Another function of VGAM178 is therefore inhibition of LOC151174 (Accession XM_098013). Accordingly, utilities of VGAM178 include diagnosis, prevention and treatment of diseases and clinical conditions associated with LOC151174. LOC162333 (Accession XM_102591) is another VGAM178 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42126, to the nucleotide sequence of VGAM178 RNA, herein designated VGAM RNA, also designated SEQ ID:2889.

Another function of VGAM178 is therefore inhibition of LOC162333 (Accession XM_102591). Accordingly, utilities of VGAM178 include diagnosis, prevention and treatment of diseases and clinical conditions associated with LOC162333. LOC163412 (Accession XM_088868) is another VGAM178 host target gene. LOC163412 BINDING SITE is HOST TARGET binding site found in the 5' untranslated region of mRNA encoded by LOC163412, corresponding to a HOST TARGET binding site such as BINDING SITE I, BINDING SITE II or BINDING SITE III. Table 2 illustrates the complementarity of the nucleotide sequences of LOC163412 BINDING SITE, designated SEQ ID:39951, to the nucleotide sequence of VGAM178 RNA, herein designated VGAM RNA, also designated SEQ ID:2889.

Another function of VGAM178 is therefore inhibition of LOC163412 (Accession XM_088868). Accordingly, utilities of VGAM178 include diagnosis, prevention and treatment of diseases and clinical conditions associated with LOC163412. LOC196027 (Accession XM_113633) is another VGAM178 host target gene. LOC196027 BINDING SITE is HOST TARGET binding site found in the 3' untranslated region of mRNA encoded by LOC196027, corresponding to a HOST TARGET binding site such as BINDING SITE I, BINDING SITE II or BINDING SITE III. Table 2 illustrates the complementarity of the nucleotide sequences of LOC196027 BINDING SITE, designated SEQ ID:42304, to the nucleotide sequence of VGAM178 RNA, herein designated VGAM RNA, also designated SEQ ID:2889.

Another function of VGAM178 is therefore inhibition of LOC196027 (Accession XM_113633). Accordingly, utilities of VGAM178 include diagnosis, prevention and treatment of diseases and clinical conditions associated with LOC196027. LOC196955 (Accession XM_085210) is another VGAM178 host target gene. LOC196955 BINDING SITE is HOST TARGET binding site found in the 5' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37926, to the nucleotide sequence of VGAM178 RNA, herein designated VGAM RNA, also designated SEQ ID:2889.

Another function of VGAM178 is therefore inhibition of LOC196955 (Accession XM_085210). Accordingly, utilities of VGAM178 include diagnosis, prevention and treatment of diseases and clinical conditions associated with LOC196955. LOC197408 (Accession XM_117031) is another VGAM178 host target gene. LOC197408 BINDING SITE is HOST TARGET binding site found in the 5' untranslated region of mRNA encoded by LOC197408, corresponding to a HOST TARGET binding site such as BINDING SITE I, BINDING SITE II or BINDING SITE III. Table 2 illustrates the complementarity of the nucleotide sequences of LOC197408 BINDING SITE, designated SEQ ID:43206, to the nucleotide sequence of VGAM178 RNA, herein designated VGAM RNA, also designated SEQ ID:2889.

Another function of VGAM178 is therefore inhibition of LOC197408 (Accession XM_117031). Accordingly, utilities of VGAM178 include diagnosis, prevention and treatment of diseases and clinical conditions associated with LOC197408. LOC200251 (Accession XM_114173) is another VGAM178 host target gene. LOC200251 BINDING SITE is HOST TARGET binding site found in the 5' untranslated region of mRNA encoded by LOC200251, corresponding to a HOST TARGET binding site such as BINDING SITE I, BINDING SITE II or BINDING SITE III. Table 2 illustrates the complementarity of the nucleotide sequences of LOC200251 BINDING SITE, designated SEQ ID:42754, to the nucleotide sequence of VGAM178 RNA, herein designated VGAM RNA, also designated SEQ ID:2889.

Another function of VGAM178 is therefore inhibition of LOC200251 (Accession XM_114173). Accordingly, utilities of VGAM178 include diagnosis, prevention and treatment of diseases and clinical conditions associated with LOC200251. LOC201173 (Accession XM_113312) is another VGAM178 host target gene. LOC201173 BINDING SITE is HOST TARGET binding site found in the 5' untranslated region of mRNA encoded by LOC201173, corresponding to a HOST TARGET binding site such as BINDING SITE I, BINDING SITE II or BINDING SITE III. Table 2 illustrates the complementarity of the nucleotide sequences of LOC201173 BINDING SITE, designated SEQ ID:42213, to the nucleotide sequence of VGAM178 RNA, herein designated VGAM RNA, also designated SEQ ID:2889.

Another function of VGAM178 is therefore inhibition of LOC201173 (Accession XM_113312). Accordingly, utilities of VGAM178 include diagnosis, prevention and treatment of diseases and clinical conditions associated with LOC201173. LOC201220 (Accession XM_113321) is another VGAM178 host target gene. LOC201220 BINDING SITE is HOST TARGET binding site found in the 5' untranslated region of mRNA encoded by LOC201220, corresponding to a HOST TARGET binding site such as BINDING SITE I, BINDING SITE II or BINDING SITE III. Table 2 illustrates the complementarity of the nucleotide sequences of LOC201220 BINDING SITE, designated SEQ ID:42220, to the nucleotide sequence of VGAM178 RNA, herein designated VGAM RNA, also designated SEQ ID:2889.

Another function of VGAM178 is therefore inhibition of LOC201220 (Accession XM_113321). Accordingly, utilities of VGAM178 include diagnosis, prevention and treatment of diseases and clinical conditions associated with LOC201220. LOC201243 (Accession XM_113935) is another VGAM178 host target gene. LOC201243 BINDING SITE is HOST TARGET binding site found in the 5' untranslated region of mRNA encoded by LOC201243, corresponding to a HOST TARGET binding site such as BINDING SITE I, BINDING SITE II or BINDING SITE III. Table 2 illustrates the complementarity of the nucleotide sequences of LOC201243 BINDING SITE, designated SEQ ID:42553, to the nucleotide sequence of VGAM178 RNA, herein designated VGAM RNA, also designated SEQ ID:2889.

Another function of VGAM178 is therefore inhibition of LOC201243 (Accession XM_113935). Accordingly, utilities of VGAM178 include diagnosis, prevention and treatment of diseases and clinical conditions associated with LOC201243. LOC220739 (Accession XM_167548) is another VGAM178 host target gene. LOC220739 BINDING SITE is HOST TARGET binding site found in the 3' untranslated region of mRNA encoded by LOC220739, corresponding to a HOST TARGET binding site such as BINDING SITE I, BINDING SITE II or BINDING SITE III. Table 2 illustrates the complementarity of the nucleotide sequences of LOC220739 BINDING SITE, designated SEQ ID:44655, to the nucleotide sequence of VGAM178 RNA, herein designated VGAM RNA, also designated SEQ ID:2889.

Another function of VGAM178 is therefore inhibition of LOC220739 (Accession XM_167548). Accordingly, utilities of VGAM178 include diagnosis, prevention and treatment of diseases and clinical conditions associated with LOC220739. LOC253715 (Accession XM_173053) is another VGAM178 host target gene. LOC253715 BINDING SITE is HOST TARGET binding site found in the 5' untranslated region of mRNA encoded by LOC253715, corresponding to a HOST TARGET binding site such as BINDING SITE I, BINDING SITE II or BINDING SITE III. Table 2 illustrates the complementarity of the nucleotide sequences of LOC253715 BINDING SITE, designated SEQ ID:46310, to the nucleotide sequence of VGAM178 RNA, herein designated VGAM RNA, also designated SEQ ID:2889.

Another function of VGAM178 is therefore inhibition of LOC253715 (Accession XM_173053). Accordingly, utilities of VGAM178 include diagnosis, prevention and treatment of diseases and clinical conditions associated with LOC253715. LOC255565 (Accession XM_170811) is another VGAM178 host target gene. LOC255565 BINDING SITE is HOST TARGET binding site found in the 5' untranslated region of mRNA encoded by LOC255565, corresponding to a HOST TARGET binding site such as BINDING SITE I, BINDING SITE II or BINDING SITE III. Table 2 illustrates the complementarity of the nucleotide sequences of LOC255565 BINDING SITE, designated SEQ ID:45590, to the nucleotide sequence of VGAM178 RNA, herein designated VGAM RNA, also designated SEQ ID:2889.

Another function of VGAM178 is therefore inhibition of LOC255565 (Accession XM_170811). Accordingly, utilities of VGAM178 include diagnosis, prevention and treatment of diseases and clinical conditions associated with LOC255565. LOC256273 (Accession XM_172847) is another VGAM178 host target gene. LOC256273 BINDING SITE is HOST TARGET binding site found in the 3' untranslated region of mRNA encoded by LOC256273, corresponding to a HOST TARGET binding site such as BINDING SITE I, BINDING SITE II or BINDING SITE III. Table 2 illustrates the complementarity of the nucleotide sequences of LOC256273 BINDING SITE, designated SEQ ID:46124, to the nucleotide sequence of VGAM178 RNA, herein designated VGAM RNA, also designated SEQ ID:2889.

Another function of VGAM178 is therefore inhibition of LOC256273 (Accession XM_172847). Accordingly, utilities of VGAM178 include diagnosis, prevention and treatment of diseases and clinical conditions associated with LOC256273. LOC90525 (Accession XM_032304) is another VGAM178 host target gene. LOC90525 BINDING SITE is HOST TARGET binding site found in the 3' untranslated region of mRNA encoded by LOC90525, corresponding to a HOST TARGET binding site such as BINDING SITE I, BINDING SITE II or BINDING SITE III. Table 2 illustrates the complementarity of the nucleotide sequences of LOC90525 BINDING SITE, designated SEQ ID:31638, to the nucleotide sequence of VGAM178 RNA, herein designated VGAM RNA, also designated SEQ ID:2889.

Another function of VGAM178 is therefore inhibition of LOC90525 (Accession XM_032304). Accordingly, utilities of VGAM178 include diagnosis, prevention and treatment of diseases and clinical conditions associated with LOC90525. FIG. 1 further provides a conceptual description of a novel bioinformatically detected viral gene of the present invention, referred to here as Viral Genomic Address Messenger 179 (VGAM179) viral gene, which modulates expression of respective host target genes thereof, the function and utility of which host target genes is known in the art.

VGAM179 is a novel bioinformatically detected regulatory, non protein coding, viral micro RNA (miRNA) gene. The method by which VGAM179 was detected is described hereinabove with reference to FIGS. 1-8.

VGAM179 gene, herein designated VGAM GENE, is a viral gene contained in the genome of Shrimp White Spot Syndrome Virus (white spot bacilliform virus). VGAM179 host target gene, herein designated VGAM HOST TARGET GENE, is a human gene contained in the human genome.

VGAM179 gene encodes a VGAM179 precursor RNA, herein designated VGAM PRECURSOR RNA. Similar to other miRNA genes, and unlike most ordinary genes, VGAM179 precursor RNA does not encode a protein. A nucleotide sequence identical or highly similar to the nucleotide sequence of VGAM179 precursor RNA is designated SEQ ID:165, and is provided hereinbelow with reference to the sequence listing part. Nucleotide sequence SEQ ID:165 is located at position 69393 relative to the genome of Shrimp White Spot Syndrome Virus (white spot bacilliform virus).

VGAM179 precursor RNA folds onto itself, forming VGAM179 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM179 folded precursor RNA into VGAM179 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM179 RNA is designated SEQ ID:2890, and is provided hereinbelow with reference to the sequence listing part.

VGAM179 host target gene, herein designated VGAM HOST TARGET GENE, encodes a corresponding messenger RNA, VGAM179 host target RNA, herein designated VGAM HOST TARGET RNA. VGAM179 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM179 RNA, herein designated VGAM RNA, binds complementarily to one or more host target binding sites located in untranslated regions of VGAM179 host target RNA, herein designated VGAM HOST TARGET RNA. This complementary binding is due to the fact that the nucleotide sequence of VGAM179 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM179 RNA, herein designated VGAM RNA, may have a different number of host target binding sites in untranslated regions of a VGAM179 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM179 RNA, herein designated VGAM RNA, to host target binding sites on VGAM179 host target RNA, herein designated VGAM HOST TARGET RNA, such as BINDING SITE I, BINDING SITE II and BINDING SITE III, inhibits translation of VGAM179 host target RNA into VGAM179 host target protein, herein designated VGAM HOST TARGET PROTEIN. VGAM host target protein is therefore outlined by a broken line.

It is appreciated that VGAM179 host target gene, herein designated VGAM HOST TARGET GENE, in fact represents a plurality of VGAM179 host target genes. The mRNA of each one of this plurality of VGAM179 host target genes comprises one or more host target binding sites, each having a nucleotide sequence which is at least partly complementary to VGAM179 RNA, herein designated VGAM RNA, and which when bound by VGAM179 RNA causes inhibition of translation of respective one or more VGAM179 host target proteins.

It is further appreciated by one skilled in the art that the mode of translational inhibition illustrated by FIG. 1 with specific reference to translational inhibition exerted by VGAM179 gene, herein designated VGAM GENE, on one or more VGAM179 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM179 is inhibition of expression of host target genes, as part of a novel viral mechanism of attacking a host. Accordingly, utilities of VGAM179 include diagnosis, prevention and treatment of viral infection by Shrimp White Spot Syndrome Virus (white spot bacilliform virus). Specific functions, and accordingly utilities, of VGAM179 correlate with, and may be deduced from, the identity of the host target genes which VGAM179 binds and inhibits, and the function of these host target genes, as elaborated hereinbelow.

Nucleotide sequences of the VGAM179 precursor RNA, herein designated VGAM PRECURSOR RNA, and of the 'diced' VGAM179 RNA, herein designated VGAM RNA, and a schematic representation of the secondary folding of VGAM179 folded precursor RNA, herein designated VGAM FOLDED PRECURSOR RNA, of VGAM179 are further described hereinbelow with reference to Table 1.

Nucleotide sequences of host target binding sites, such as BINDING SITE-I, BINDING SITE-II and BINDING SITE-III of FIG. 1, found on VGAM179 host target RNA, and schematic representation of the complementarity of each of these host target binding sites to VGAM179 RNA, herein designated VGAM RNA, are described hereinbelow with reference to Table 2.

As mentioned hereinabove with reference to FIG. 1, a function of VGAM179 gene, herein designated VGAM is inhibition of expression of VGAM179 target genes. It is appreciated that specific functions, and accordingly utilities, of VGAM179 correlate with, and may be deduced from, the identity of the target genes which VGAM179 binds and inhibits, and the function of these target genes, as elaborated hereinbelow.

Acid Phosphatase 1, Soluble (ACP1, Accession NM_004300) is a VGAM179 host target gene. ACP1 BINDING SITE1 and ACP1 BINDING SITE2 are HOST TARGET binding sites found in untranslated regions of mRNA encoded by ACP1, corresponding to HOST TARGET binding sites such as BINDING SITE I, BINDING SITE II or BINDING SITE III. Table 2 illustrates the complementarity of the nucleotide sequences of ACP1 BINDING SITE1 and ACP1 BINDING SITE2, designated SEQ ID:10509 and SEQ ID:13959 respectively, to the nucleotide sequence of VGAM179 RNA, herein designated VGAM RNA, also designated SEQ ID:2890.

A function of VGAM179 is therefore inhibition of Acid Phosphatase 1, Soluble (ACP1, Accession NM_004300), a gene which as demonstrated in starch-gel electrophoresis. Accordingly, utilities of VGAM179 include diagnosis, prevention and treatment of diseases and clinical conditions associated with ACP1. The function of ACP1 has been established by previous studies. Hopkinson et al. (1963) described a new human polymorphism involving erythrocyte acid phosphatase (EC 3.1.3.2) as demonstrated in starch-gel electrophoresis. Three alleles, P(a), P(b) and P(c), are thought to be involved, their frequency being estimated to be 0.35, 0.60 and 0.05, respectively. Another rare allele, P(r), was described by Giblett and Scott (1965). Mohrenweiser and Novotny (1982) described a low activity variant of ACP1 that is frequent (gene frequency of 0.132) in Guaymi Indians of Central America. Data on gene frequencies of allelic variants were tabulated by Roychoudhury and Nei (1988). Red cells of persons with the GUA-1 phenotype had increased basal levels of the flavoenzyme glutathione reductase and a larger fraction of the glutathione reductase protein in the form of the holoenzyme, indicating increased levels of flavin adenine dinucleotide in the red cells of these persons. The finding was consistent with the suggestion that ACP1 has a physiologic function as a flavin mononucleotide phosphatase. This function could regulate the intracellular concentrations of flavin coenzymes and, ultimately, of flavoenzymes, and could be the mechanism for the association between ACP1 type and certain disease states. Sensabaugh and Golden (1978) showed that ACP1 is inhibited by folic acid and various folates, and that the inhibition is phenotype dependent: ACP1(C) more than ACP1(A) more than ACP1(B). This explains elevation of ACP levels in red cells of patients with megaloblastic anemia and also variation in incidence and severity of favism in G6PD-deficient persons. Swallow et al. (1973) showed that 'red cell' acid phosphatase is not limited to erythrocytes but can be demonstrated in other tissues, including cultured fibroblasts and lymphoblastoid cells where there is no possibility of contamination by blood. Dissing et al. (1991) concluded that 2 electrophoretically distinct isozymes, f and s, which are produced in allele-specific ratios and are associated with each of the 3 major alleles, are generated by alternative splicing of the primary RNA transcript. 2. Junien et al. (1979) assigned the ACP1 locus to 2p25. Larson et al. (1982) studied 4 patients who had inherited an unbalanced form of a familial reciprocal translocation, t(2;10)(p24; q26), giving them partial duplication of 2p. Increased levels of acid phosphatase indicated that ACP1 is located in the 2p24-2pter region and that MDH is not. The previous inconsistency of the SRO (smallest region of overlap) is now resolved; ACP1 is at 2p25. Wo et al. (1992) cloned genes encoding 2 low molecular weight phosphotyrosyl protein phosphatases from a human placenta cDNA library. They were found to have identical nucleotide sequences, with the exception of a 108-bp segment in the middle of the open reading frame. From further studies they concluded that the 2 represent the fast and slow electrophoretic forms of red cell acid phosphatase and that this enzyme is not unique to the red cell but instead is expressed in all human tissues. They examined a human chromosome 2-specific library and demonstrated that the sequences they were studying are located on chromosome 2.

Full details of the abovementioned studies are described in the following publications, the disclosure of which are hereby incorporated by reference:

Dissing, J.; Johnsen, A. H.; Sensabaugh, G. F.: Human red cell acid phosphatase (ACP1): the amino acid sequence of the two isozymes Bf and Bs encoded by the ACP1*B allele. J. Biol. Chem. 266:20619-20625, 1991; and Wo, Y.-Y. P.; McCormack, A. L.; Shabanowitz, J.; Hunt, D. F.; Davis, J. P.; Mitchell, G. L.; Van Etten, R. L.: Sequencing, cloning, and expression of human red cell-type acid phosphata.

Further studies establishing the function and utilities of ACP1 are found in John Hopkins OMIM database record ID 171500, and in sited publications numbered 11035-11039, 11204, 11234, 11236-11242, 11206, 11243-11248, 3478, 11249-11259, 3780, 1126 and 11261-1853 listed in the bibliography section hereinbelow, which are also hereby incorporated by reference. Adrenergic, Beta-3-, Receptor (ADRB3, Accession NM_000025) is another VGAM179 host target gene. ADRB3 BINDING SITE is HOST TARGET binding site found in the 5' untranslated region of mRNA encoded by ADRB3, corresponding to a HOST TARGET binding site such as BINDING SITE I, BINDING SITE II or BINDING SITE III. Table 2 illustrates the complementarity of the nucleotide sequences of ADRB3 BINDING SITE, designated SEQ ID:5459, to the nucleotide sequence of VGAM179 RNA, herein designated VGAM RNA, also designated SEQ ID:2890.

Another function of VGAM179 is therefore inhibition of Adrenergic, Beta-3-, Receptor (ADRB3, Accession NM_000025), a gene which stimulates adenylyl cyclase activity and regulates lipolysis. Accordingly, utilities of VGAM179 include diagnosis, prevention and treatment of diseases and clinical conditions associated with ADRB3. The function of ADRB3 has been established by previous studies. Emorine et al. (1989) isolated a third beta-adrenergic receptor, beta-3-adrenergic receptor (ADRB3). (See ADRB1 (OMIM Ref. No. 109630) and ADRB2 (OMIM Ref. No. 109690).) Exposure of eukaryotic cells transfected with this gene to adrenaline or noradrenaline promoted the accumulation of adenosine 3-prime, 5-prime-monophosphate. The potency of beta-AR agonists and inhibitors was described. Van Spronsen et al. (1993) demonstrated that the transcription-start sites of the mouse and human ADRB3 mRNA are located in a region comprised between 150 and 200 nucleotides 5-prime from the ATG translation-start codon. Motifs potentially implicated in heterologous regulation of ADRB3 expression by glucocorticoids and by beta-adrenergic agonists were identified upstream from these cap sites. Van Spronsen et al. (1993) also described the exon/intron structure of the genes. Their results suggested that utilization of alternate promoters and/or 3-prime untranslated regions may allow tissue-specific regulation of the expression of ADRB3. Wilkie et al. (1993) presented a list of G protein-coupled receptor genes (their Table 3), indicating that the ADRB3 gene had been mapped to 8p12-p11.2 and the homologous gene to mouse chromosome 8. Animal model experiments lend further support to the function of ADRB3. Bachman et al. (2002) created mice that lacked the beta-adrenergic receptors ADRB1, ADRB2, and ADRB3. Beta-less mice on a chow diet had a reduced metabolic rate and were slightly obese. On a high-fat diet, beta-less mice, in contrast to wildtype mice, developed massive obesity that was due entirely to a failure of diet-induced thermogenesis.

It is appreciated that the abovementioned animal model for ADRB3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Van Spronsen, A.; Nahmias, C.; Krief, S.; Briend-Sutren, M.-M.; Strosberg, A. D.; Emorine, L. J.: The promoter and intron/exon structure of the human and mouse beta-3-adrenergic-receptor genes. Europ. J. Biochem. 213:1117-1124, 1993; and Bachman, E. S.; Dhillon, H.; Zhang, C.-Y.; Cinti, S.; Bianco, A. C.; Kobilka, B. K.; Lowell, B. B.: Beta-AR signaling required for diet-induced thermogenesis and obesity resistance. Sci.

Further studies establishing the function and utilities of ADRB3 are found in John Hopkins OMIM database record ID 109691, and in sited publications numbered 1446, 4273-4274, 3172, 4275-4284, 4286, 4287-428 and 11892 listed in the bibliography section hereinbelow, which are also hereby incorporated by reference. ATPase, Ca++ Transporting, Cardiac Muscle, Slow Twitch 2 (ATP2A2, Accession NM_001681) is another VGAM179 host target gene. ATP2A2 BINDING SITE is HOST TARGET binding site found in the 3' untranslated region of mRNA encoded by ATP2A2, corresponding to a HOST TARGET binding site such as BINDING SITE I, BINDING SITE II or BINDING SITE III. Table 2 illustrates the complementarity of the nucleotide sequences of ATP2A2 BINDING SITE, designated SEQ ID:7401, to the nucleotide sequence of VGAM179 RNA, herein designated VGAM RNA, also designated SEQ ID:2890.

Another function of VGAM179 is therefore inhibition of ATPase, Ca++ Transporting, Cardiac Muscle, Slow Twitch 2 (ATP2A2, Accession NM_001681). Accordingly, utilities of VGAM179 include diagnosis, prevention and treatment of diseases and clinical conditions associated with ATP2A2. Betaine-homocysteine Methyltransferase 2 (BHMT2, Accession NM_017614) is another VGAM179 host target gene. BHMT2 BINDING SITE is HOST TARGET binding site found in the 3' untranslated region of mRNA encoded by BHMT2, corresponding to a HOST TARGET binding site such as BINDING SITE I, BINDING SITE II or BINDING SITE III. Table 2 illustrates the complementarity of the nucleotide sequences of BHMT2 BINDING SITE, designated SEQ ID:19116, to the nucleotide sequence of VGAM179 RNA, herein designated VGAM RNA, also designated SEQ ID:2890.

Another function of VGAM179 is therefore inhibition of Betaine-homocysteine Methyltransferase 2 (BHMT2, Accession NM_017614). Accordingly, utilities of VGAM179 include diagnosis, prevention and treatment of diseases and clinical conditions associated with BHMT2. Breast Cancer 1, Early Onset (BRCA1, Accession NM_007294) is another VGAM179 host target gene. BRCA1 BINDING SITE1 through BRCA1 BINDING SITE10 are HOST TARGET binding sites found in untranslated regions of mRNA encoded by BRCA1, corresponding to HOST TARGET binding sites such as BINDING SITE I, BINDING SITE II or BINDING SITE III. Table 2 illustrates the complementarity of the nucleotide sequences of BRCA1 BINDING SITE1 through BRCA1 BINDING SITE10, designated SEQ ID:14162, SEQ ID:14168, SEQ ID:14174, SEQ ID:14180, SEQ ID:14187, SEQ ID:14193, SEQ ID:14199, SEQ ID:14207, SEQ ID:14213 and SEQ ID:14219 respectively, to the nucleotide sequence of VGAM179 RNA, herein designated VGAM RNA, also designated SEQ ID:2890.

Another function of VGAM179 is therefore inhibition of Breast Cancer 1, Early Onset (BRCA1, Accession NM_007294). Accordingly, utilities of VGAM179 include diagnosis, prevention and treatment of diseases and clinical conditions associated with BRCA1. UDP-N-acetyl-alpha-D-galactosamine:(N-acetylneuraminyl)-galactosylglucosylceramide N-acetylgalactosaminyltransferase (GalNAc-T) (GALGT, Accession NM_001478) is another VGAM179 host target gene. GALGT BINDING SITE is HOST TARGET binding site found in the 3' untranslated region of mRNA encoded by GALGT, corresponding to a HOST TARGET binding site such as BINDING SITE I, BINDING SITE II or BINDING SITE III. Table 2 illustrates the complementarity of the nucleotide sequences of GALGT BINDING SITE, designated SEQ ID:7209, to the nucleotide sequence of VGAM179 RNA, herein designated VGAM RNA, also designated SEQ ID:2890.

Another function of VGAM179 is therefore inhibition of UDP-N-acetyl-alpha-D-galactosamine:(N-acetylneuraminyl)-galactosylglucosylceramide N-acetylgalactosaminyltransferase (GalNAc-T) (GALGT, Accession NM_001478), a gene which is involved in the biosynthesis of gangliosides gm2, gd2 and ga2. Accordingly, utilities of VGAM179 include diagnosis, prevention and treatment of diseases and clinical conditions associated with GALGT. The function of GALGT has been established by previous studies. The G(M2) and G(D2) gangliosides are sialic acid-containing glycosphingolipids involved in signal transduction and cell-cell recognition. Nagata et al. (1992) used expression cloning to isolate the cDNA encoding the enzyme responsible for generating G(M2) and G(D2) glycosphingolipids. This gene is termed beta-1,4-N-acetylgalactosaminyltransferase (GalNAc-T) (EC 2.4.1.92), or G(M2)/G(D2) synthase. The cDNA encodes a 561-amino acid polypeptide. Northern blot analysis revealed that the gene is expressed as 2 differently sized transcripts in all cells tested that expressed G(MS), G(D2), or both. These findings indicate that the cDNAs catalyze the transfer of GalNAc into G(M3) and G(D3) by a beta-1,4 linkage, resulting in the synthesis of G(M2) and G(D2), respectively Animal model experiments lend further support to the function of GALGT. Niemann-Pick disease type C (NPC; 267220) is a progressive neurodegenerative disorder caused by mutations in the NPC1 gene and characterized by intracellular accumulation of cholesterol and sphingolipids. To determine the relative contribution of ganglioside accumulation in the neuropathogenesis of Niemann-Pick C disease, Liu et al. (2000) bred NPC model mice with mice carrying a targeted mutation in GalNAc-T. Unlike the NPC model mice, the double mutant mice did not exhibit central nervous system (CNS) accumulation of gangliosides GM2 or of glycolipids GA1 and GA2. Histologic analysis revealed that the characteristic neuronal storage pathology of NPC disease was substantially reduced in the double mutant mice. By contrast, visceral pathology was similar in the NPC and double mutant mice. Most notably, the clinical phenotype of the double mutant mice, in the absence of CNS ganglioside accumulation and associated neuronal pathology, did not improve. The authors concluded that complex ganglioside storage, while responsible for much of the neuronal pathology, did not significantly influence the clinical phenotype of the NPC model.

It is appreciated that the abovementioned animal model for GALGT is acknowledged by those skilled in the art as a scientifically valid animal model, as can be further appreciated from the publications sited hereinbelow.

Full details of the abovementioned studies are described in the following publications, the disclosure of which are hereby incorporated by reference:

Liu, Y.; Wu, Y.-P.; Wada, R.; Neufeld, E. B.; Mullin, K. A.; Howard, A. C.; Pentchev, P. G.; Vanier, M. T.; Suzuki, K.; Proia, R. L.: Alleviation of neuronal ganglioside storage does not improve the clinical course of the Niemann-Pick C disease mouse. Hum. Molec. Genet. 9:1087-1092, 2000; and Nagata, Y.; Yamashiro, S.; Yodoi, J.; Lloyd, K. O.; Shiku, H.; Furukawa, K.: Expression cloning of beta-1,4-N-acetylgalactosaminyltransferase cDNAs that determine the expression of G.

Further studies establishing the function and utilities of GALGT are found in John Hopkins OMIM database record ID 601873, and in sited publications numbered 1291, 129 and 11383 listed in the bibliography section hereinbelow, which are also hereby incorporated by reference. Hepatic Leukemia Factor (HLF, Accession NM_002126) is another VGAM179 host target gene. HLF BINDING SITE is HOST TARGET binding site found in the 3' untranslated region of mRNA encoded by HLF, corresponding to a HOST TARGET binding site such as BINDING SITE I, BINDING SITE II or BINDING SITE III. Table 2 illustrates the complementarity of the nucleotide sequences of HLF BINDING SITE, designated SEQ ID:7902, to the nucleotide sequence of VGAM179 RNA, herein designated VGAM RNA, also designated SEQ ID:2890.

Another function of VGAM179 is therefore inhibition of Hepatic Leukemia Factor (HLF, Accession NM_002126). Accordingly, utilities of VGAM179 include diagnosis, prevention and treatment of diseases and clinical conditions associated with HLF. Meningioma (disrupted in balanced translocation) 1 (MN1, Accession NM_002430) is another VGAM179 host target gene. MN1 BINDING SITE is HOST TARGET binding site found in the 3' untranslated region of mRNA encoded by MN1, corresponding to a HOST TARGET binding site such as BINDING SITE I, BINDING SITE II or BINDING SITE III. Table 2 illustrates the complementarity of the nucleotide sequences of MN1 BINDING SITE, designated SEQ ID:8272, to the nucleotide sequence of VGAM179 RNA, herein designated VGAM RNA, also designated SEQ ID:2890.

Another function of VGAM179 is therefore inhibition of Meningioma (disrupted in balanced translocation) 1 (MN1, Accession NM_002430). Accordingly, utilities of VGAM179 include diagnosis, prevention and treatment of diseases and clinical conditions associated with MN1. Retinoic Acid Receptor, Beta (RARB, Accession NM_016152) is another VGAM179 host target gene. RARB BINDING SITE is HOST TARGET binding site found in the 5' untranslated region of mRNA encoded by RARB, corresponding to a HOST TARGET binding site such as BINDING SITE I, BINDING SITE II or BINDING SITE III. Table 2 illustrates the complementarity of the nucleotide sequences of RARB BINDING SITE, designated SEQ ID:18238, to the nucleotide sequence of VGAM179 RNA, herein designated VGAM RNA, also designated SEQ ID:2890.

Another function of VGAM179 is therefore inhibition of Retinoic Acid Receptor, Beta (RARB, Accession NM_016152), a gene which is one member of the steroid/thyroid hormone receptor family of ligand-activated transcription factors. Accordingly, utilities of VGAM179 include diagnosis, prevention and treatment of diseases and clinical conditions associated with RARB. The function of RARB has been established by previous studies. The 3 retinoic acid receptors, alpha (RARA; 180240), beta (RARB), and gamma (RARG; 180190), are members of the nuclear receptor superfamily. Retinoic acid was the first morphogen described in vertebrates. The RARA and RARB genes are more homologous to those of the 2 closely related thyroid hormone receptors THRA and THRB, located on chromosomes 17 and 3, respectively, than to any other members of the nuclear receptor family. These observations suggest that the thyroid hormone and retinoic acid receptors evolved by gene, and possibly chromosome, duplications from a common ancestor which itself diverged rather early in evolution from the common ancestor of the steroid receptor group of the family. The RARB gene, formerly symbolized HAP, maps to 3p24 by somatic cell hybridization and in situ hybridization. Benbrook et al. (1988) showed a predominant distribution in epithelial tissues and therefore used the designation RAR (epsilon). By in situ hybridization, Mattei et al. (1988) assigned the RARB gene to 3p24. Using deletion mapping, de The et al. (1990) identified a 27-bp fragment located 59-bp upstream of the transcriptional start, which confers retinoic acid responsiveness on the herpesvirus thymidine kinase promoter. They found indications that both alpha and beta receptors act through the same DNA sequence. Mattei et al. (1991) assigned the corresponding gene to chromosome 14, band A, in the mouse, and to chromosome 15 in the rat. Nadeau et al. (1992) confirmed assignment of the mouse homolog to the centromeric portion of chromosome 14. From a comparison of a hepatitis-B virus (HBV) integration site present in a particular human hepatocellular carcinoma (HCC; 114550) with the corresponding unoccupied site in the nontumorous tissue of the same liver, Dejean et al. (1986) found that HBV integration placed the viral sequence next to a liver cell sequence that bears a striking resemblance to both an oncogene, ERBA (OMIM Ref. No. 190120), and the supposed DNA-binding domain of the human glucocorticoid receptor (OMIM Ref. No. 138040) and estrogen receptor (OMIM Ref. No. 133430) genes. Dejean et al. (1986) suggested that this gene, usually silent or transcribed at a very low level in normal hepatocytes, becomes inappropriately expressed as a consequence of HBV integration, thus contributing to the cell transformation. By means of a panel of rodent-human somatic cell hybrid DNAs, Dejean et al. (1986) localized the gene to chromosome 3. Further studies by de The et al. (1987) suggested that the HAP gene product may be a novel ligand-responsive regulatory protein whose inappropriate expression in liver is related to hepatocellular carcinogenesis. Brand et al. (1988) showed that the novel protein called HAP (for HBV-activated protein) is a retinoic acid receptor. They referred to this receptor as the beta type (RARB) and mapped it to 3p25-p21.

Full details of the abovementioned studies are described in the following publications, the disclosure of which are hereby incorporated by reference:

Benbrook, D.; Lernhardt, E.; Pfahl, M.: A new retinoic acid receptor identified from a hepatocellular carcinoma. (Letter) Nature 333:669-672, 1988; and de The, H.; Marchio, A.; Tiollais, P.; Dejean, A.: A novel steroid thyroid hormone receptor-related gene inappropriately expressed in human hepatocellular carcinoma. Nature 330:667-670.

Further studies establishing the function and utilities of RARB are found in John Hopkins OMIM database record ID 180220, and in sited publications numbered 5669-5672, 5709, 5728-573 and 11147-5732 listed in the bibliography section hereinbelow, which are also hereby incorporated by reference. Reelin (RELN, Accession XM_168628) is another VGAM179 host target gene. RELN BINDING SITE is HOST TARGET binding site found in the 3' untranslated region of mRNA encoded by RELN, corresponding to a HOST TARGET binding site such as BINDING SITE I, BINDING SITE II or BINDING SITE III. Table 2 illustrates the complementarity of the nucleotide sequences of RELN BINDING SITE, designated SEQ ID:45281, to the nucleotide sequence of VGAM179 RNA, herein designated VGAM RNA, also designated SEQ ID:2890.

Another function of VGAM179 is therefore inhibition of Reelin (RELN, Accession XM_168628), a gene which regulates microtubule function in neurons and neuronal migration. Accordingly, utilities of VGAM179 include diagnosis, prevention and treatment of diseases and clinical conditions associated with RELN. The function of RELN and its association with various diseases and clinical conditions, has been established by previous studies, as described hereinabove with reference to VGAM35. Spinocerebellar Ataxia 7 (olivopontocerebellar atrophy with retinal degeneration) (SCA7, Accession NM_000333) is another VGAM179 host target gene. SCA7 BINDING SITE is HOST TARGET binding site found in the 3' untranslated region of mRNA encoded by SCA7, corresponding to a HOST TARGET binding site such as BINDING SITE I, BINDING SITE II or BINDING SITE III. Table 2 illustrates the complementarity of the nucleotide sequences of SCA7 BINDING SITE, designated SEQ ID:5883, to the nucleotide sequence of VGAM179 RNA, herein designated VGAM RNA, also designated SEQ ID:2890.

Another function of VGAM179 is therefore inhibition of Spinocerebellar Ataxia 7 (olivopontocerebellar atrophy with retinal degeneration) (SCA7, Accession NM_000333). Accordingly, utilities of VGAM179 include diagnosis, prevention and treatment of diseases and clinical conditions associated with SCA7. SH3-domain Binding Protein 4 (SH3BP4, Accession NM_014521) is another VGAM179 host target gene. SH3BP4 BINDING SITE is HOST TARGET binding site found in the 3' untranslated region of mRNA encoded by SH3BP4, corresponding to a HOST TARGET binding site such as BINDING SITE I, BINDING SITE II or BINDING SITE III. Table 2 illustrates the complementarity of the nucleotide sequences of SH3BP4 BINDING SITE, designated SEQ ID:15852, to the nucleotide sequence of VGAM179 RNA, herein designated VGAM RNA, also designated SEQ ID:2890.

Another function of VGAM179 is therefore inhibition of SH3-domain Binding Protein 4 (SH3BP4, Accession NM_014521), a gene which is of unknown function, contains SH3-domain binding protein 4; similar to the EH-binding protein. Accordingly, utilities of VGAM179 include diagnosis, prevention and treatment of diseases and clinical conditions associated with SH3BP4. The function of SH3BP4 has been established by previous studies. A major element of the cornea is a transparent stroma produced and maintained by corneal fibroblasts, or keratocytes. Using differential display of RNA from normal and macular corneal dystrophy cultured keratocytes, followed by screening a corneal fibroblast library, Dunlevy et al. (1999) identified a cDNA encoding SH3BP4. The deduced 963-amino acid SH3BP4 protein contains 3 asn-pro-phe (NPF) motifs, which are EPS15 (OMIM Ref. No. 600051) homology (EH)-binding sites (see OMIM Ref. No. NUMB; 603728); an SH3 domain; a PXXP motif; a bipartite nuclear targeting signal; and a tyrosine phosphorylation site. Sequence analysis predicted that SH3BP4 is identical to a 479-amino acid EH-binding protein (Wong et al., 1995) except for the presence of an additional 73 N-terminal and 411 mid- to C-terminal residues in SH3BP4. Northern blot analysis revealed ubiquitous expression of a 5.6-kb transcript, with highest levels in pancreas, low levels in kidney, skeletal muscle, and liver, and lowest levels in lung and brain. Expression was also detected in cultured normal keratocytes. Using FISH, Dunlevy et al. (1999) mapped the SH3BP4 gene to 2q37.1-q37.2.

Full details of the abovementioned studies are described in the following publications, the disclosure of which are hereby incorporated by reference:

Dunlevy, J. R.; Berryhill, B. L.; Vergnes, J.-P.; SundarRaj, N.; Hassell, J. R.: Cloning, chromosomal localization, and characterization of cDNA from a novel gene, SH3BP4, expressed by human corneal fibroblasts. Genomics 62:519-524, 1999; and Wong, W. T.; Schumacher, C.; Salcini, A. E.; Romano, A.; Castagnino, P.; Pelicci, P. G.; DiFiore, P. P.: A protein-binding domain, EH, identified in the receptor tyrosine kinase substrat.

Further studies establishing the function and utilities of SH3BP4 are found in John Hopkins OMIM database record ID 605611, and in sited publications numbered 6768-6769 listed in the bibliography section hereinbelow, which are also hereby incorporated by reference. Transmembrane Protein 1 (TMEM1, Accession NM_003274) is another VGAM179 host target gene. TMEM1 BINDING SITE is HOST TARGET binding site found in the 3' untranslated region of mRNA encoded by TMEM1, corresponding to a HOST TARGET binding site such as BINDING SITE I, BINDING SITE II or BINDING SITE III. Table 2 illustrates the complementarity of the nucleotide sequences of TMEM1 BINDING SITE, designated SEQ ID:9290, to the nucleotide sequence of VGAM179 RNA, herein designated VGAM RNA, also designated SEQ ID:2890.

Another function of VGAM179 is therefore inhibition of Transmembrane Protein 1 (TMEM1, Accession NM_003274). Accordingly, utilities of VGAM179 include diagnosis, prevention and treatment of diseases and clinical conditions associated with TMEM1. BNIP-S (Accession NM_138278) is another VGAM179 host target gene. BNIP-S BINDING SITE is HOST TARGET binding site found in the 3' untranslated region of mRNA encoded by BNIP-S, corresponding to a HOST TARGET binding site such as BINDING SITE I, BINDING SITE II or BINDING SITE III. Table 2 illustrates the complementarity of the nucleotide sequences of BNIP-S BINDING SITE, designated SEQ ID:28689, to the nucleotide sequence of VGAM179 RNA, herein designated VGAM RNA, also designated SEQ ID:2890.

Another function of VGAM179 is therefore inhibition of BNIP-S (Accession NM_138278). Accordingly, utilities of VGAM179 include diagnosis, prevention and treatment of diseases and clinical conditions associated with BNIP-S. C1q and Tumor Necrosis Factor Related Protein 6 (C1QTNF6, Accession NM_031910) is another VGAM179 host target gene. C1QTNF6 BINDING SITE is HOST TARGET binding site found in the 3' untranslated region of mRNA encoded by C1QTNF6, corresponding to a HOST TARGET binding site such as BINDING SITE I, BINDING SITE II or BINDING SITE III. Table 2 illustrates the complementarity of the nucleotide sequences of C1QTNF6 BINDING SITE, designated SEQ ID:25655, to the nucleotide sequence of VGAM179 RNA, herein designated VGAM RNA, also designated SEQ ID:2890.

Another function of VGAM179 is therefore inhibition of C1q and Tumor Necrosis Factor Related Protein 6 (C1QTNF6, Accession NM_031910). Accordingly, utilities of VGAM179 include diagnosis, prevention and treatment of diseases and clinical conditions associated with C1QTNF6. Chromosome 20 Open Reading Frame 110 (C20orf110, Accession XM_086728) is another VGAM179 host target gene. C20orf110 BINDING SITE is HOST TARGET binding site found in the 3" untranslated region of mRNA encoded by C20orf110, corresponding to a HOST TARGET binding site such as BINDING SITE I, BINDING SITE II or BINDING SITE III. Table 2 illustrates the complementarity of the nucleotide sequences of C20orf110 BINDING SITE, designated SEQ ID:38836, to the nucleotide sequence of VGAM179 RNA, herein designated VGAM RNA, also designated SEQ ID:2890.

Another function of VGAM179 is therefore inhibition of Chromosome 20 Open Reading Frame 110 (C20orf110, Accession XM_086728). Accordingly, utilities of VGAM179 include diagnosis, prevention and treatment of diseases and clinical conditions associated with C20orf110. Choline Kinase (CHK, Accession NM_001277) is another VGAM179 host target gene. CHK BINDING SITE is HOST TARGET binding site found in the 3" untranslated region of mRNA encoded by CHK, corresponding to a HOST TARGET binding site such as BINDING SITE I, BINDING SITE II or BINDING SITE III. Table 2 illustrates the complementarity of the nucleotide sequences of CHK BINDING SITE, designated SEQ ID:6944, to the nucleotide sequence of VGAM179 RNA, herein designated VGAM RNA, also designated SEQ ID:2890.

Another function of VGAM179 is therefore inhibition of Choline Kinase (CHK, Accession NM_001277). Accordingly, utilities of VGAM179 include diagnosis, prevention and treatment of diseases and clinical conditions associated with CHK. Cbp/p300-interacting Transactivator, with Glu/Asp-rich Carboxy-terminal Domain, 2 (CITED2, Accession NM_006079) is another VGAM179 host target gene. CITED2 BINDING SITE is HOST TARGET binding site found in the 3' untranslated region of mRNA encoded by CITED2, corresponding to a HOST TARGET binding site such as BINDING SITE I, BINDING SITE II or BINDING SITE III. Table 2 illustrates the complementarity of the nucleotide sequences of CITED2 BINDING SITE, designated SEQ ID:12726, to the nucleotide sequence of VGAM179 RNA, herein designated VGAM RNA, also designated SEQ ID:2890.

Another function of VGAM179 is therefore inhibition of Cbp/p300-interacting Transactivator, with Glu/Asp-rich Carboxy-terminal Domain, 2 (CITED2, Accession NM_006079). Accordingly, utilities of VGAM179 include diagnosis, prevention and treatment of diseases and clinical conditions associated with CITED2. CTP Synthase II (CTPS2, Accession NM_019857) is another VGAM179 host target gene. CTPS2 BINDING SITE is HOST TARGET binding site found in the 3' untranslated region of mRNA encoded by CTPS2, corresponding to a HOST TARGET binding site such as BINDING SITE I, BINDING SITE II or BINDING SITE III. Table 2 illustrates the complementarity of the nucleotide sequences of CTPS2 BINDING SITE, designated SEQ ID:21261, to the nucleotide sequence of VGAM179 RNA, herein designated VGAM RNA, also designated SEQ ID:2890.

Another function of VGAM179 is therefore inhibition of CTP Synthase II (CTPS2, Accession NM_019857). Accordingly, utilities of VGAM179 include diagnosis, prevention and treatment of diseases and clinical conditions associated with CTPS2. FLJ13782 (Accession NM_024915) is another VGAM179 host target gene. FLJ13782 BINDING SITE is HOST TARGET binding site found in the 3' untranslated region of mRNA encoded by FLJ13782, corresponding to a HOST TARGET binding site such as BINDING SITE I, BINDING SITE II or BINDING SITE III. Table 2 illustrates the complementarity of the nucleotide sequences of FLJ13782 BINDING SITE, designated SEQ ID:24436, to the nucleotide sequence of VGAM179 RNA, herein designated VGAM RNA, also designated SEQ ID:2890.

Another function of VGAM179 is therefore inhibition of FLJ13782 (Accession NM_024915). Accordingly, utilities of VGAM179 include diagnosis, prevention and treatment of diseases and clinical conditions associated with FLJ13782. JIK (Accession NM_016281) is another VGAM179 host target gene. JIK BINDING SITE is HOST TARGET binding site found in the 3" untranslated region of mRNA encoded by JIK, corresponding to a HOST TARGET binding site such as BINDING SITE I, BINDING SITE II or BINDING SITE III. Table 2 illustrates the complementarity of the nucleotide sequences of JIK BINDING SITE, designated SEQ ID:18405, to the nucleotide sequence of VGAM179 RNA, herein designated VGAM RNA, also designated SEQ ID:2890.

Another function of VGAM179 is therefore inhibition of JIK (Accession NM_016281). Accordingly, utilities of VGAM179 include diagnosis, prevention and treatment of diseases and clinical conditions associated with JIK. Potassium Voltage-gated Channel, Shal-related Subfamily, Member 1 (KCND1, Accession NM_004979) is another VGAM179 host target gene. KCND1 BINDING SITE is HOST TARGET binding site found in the 5' untranslated region of mRNA encoded by KCND1, corresponding to a HOST TARGET binding site such as BINDING SITE I, BINDING SITE II or BINDING SITE III. Table 2 illustrates the complementarity of the nucleotide sequences of KCND1 BINDING SITE, designated SEQ ID:11422, to the nucleotide sequence of VGAM179 RNA, herein designated VGAM RNA, also designated SEQ ID:2890.

Another function of VGAM179 is therefore inhibition of Potassium Voltage-gated Channel, Shal-related Subfamily, Member 1 (KCND1, Accession NM_004979). Accordingly, utilities of VGAM179 include diagnosis, prevention and treatment of diseases and clinical conditions associated with KCND1. KIAA0240 (Accession XM_166479) is another VGAM179 host target gene. KIAA0240 BINDING SITE is HOST TARGET binding site found in the 3' untranslated region of mRNA encoded by KIAA0240, corresponding to a HOST TARGET binding site such as BINDING SITE I, BINDING SITE II or BINDING SITE III. Table 2 illustrates the complementarity of the nucleotide sequences of KIAA0240 BINDING SITE, designated SEQ ID:44406, to the nucleotide sequence of VGAM179 RNA, herein designated VGAM RNA, also designated SEQ ID:2890.

Another function of VGAM179 is therefore inhibition of KIAA0240 (Accession XM_166479). Accordingly, utilities of VGAM179 include diagnosis, prevention and treatment of diseases and clinical conditions associated with KIAA0240. KIAA0417 (Accession XM_048898) is another VGAM179 host target gene. KIAA0417 BINDING SITE is HOST TARGET binding site found in the 3' untranslated region of mRNA encoded by KIAA0417, corresponding to a HOST TARGET binding site such as BINDING SITE I, BINDING SITE II or BINDING SITE III. Table 2 illustrates the complementarity of the nucleotide sequences of KIAA0417 BINDING SITE, designated SEQ ID:35288, to the nucleotide sequence of VGAM179 RNA, herein designated VGAM RNA, also designated SEQ ID:2890.

Another function of VGAM179 is therefore inhibition of KIAA0417 (Accession XM_048898). Accordingly, utilities of VGAM179 include diagnosis, prevention and treatment of diseases and clinical conditions associated with KIAA0417. KIAA1509 (Accession XM_029353) is another VGAM179 host target gene. KIAA1509 BINDING SITE is HOST TARGET binding site found in the 3' untranslated region of mRNA encoded by KIAA1509, corresponding to a HOST TARGET binding site such as BINDING SITE I, BINDING SITE II or BINDING SITE III. Table 2 illustrates the complementarity of the nucleotide sequences of KIAA1509 BINDING SITE, designated SEQ ID:30875, to the nucleotide sequence of VGAM179 RNA, herein designated VGAM RNA, also designated SEQ ID:2890.

Another function of VGAM179 is therefore inhibition of KIAA1509 (Accession XM_029353). Accordingly, utilities of VGAM179 include diagnosis, prevention and treatment of diseases and clinical conditions associated with KIAA1509. MGC1127 (Accession NM_033549) is another VGAM179 host target gene. MGC1127 BINDING SITE is HOST TARGET binding site found in the 3' untranslated region of mRNA encoded by MGC1127, corresponding to a HOST TARGET binding site such as BINDING SITE I, BINDING SITE II or BINDING SITE III. Table 2 illustrates the complementarity of the nucleotide sequences of MGC1127 BINDING SITE, designated SEQ ID:27308, to the nucleotide sequence of VGAM179 RNA, herein designated VGAM RNA, also designated SEQ ID:2890.

Another function of VGAM179 is therefore inhibition of MGC1127 (Accession NM_033549). Accordingly, utilities of VGAM179 include diagnosis, prevention and treatment of diseases and clinical conditions associated with MGC1127. SP192 (Accession NM_021639) is another VGAM179 host target gene. SP192 BINDING SITE is HOST TARGET binding site found in the 5' untranslated region of mRNA encoded by SP192, corresponding to a HOST TARGET binding site such as BINDING SITE I, BINDING SITE II or BINDING SITE III. Table 2 illustrates the complementarity of the nucleotide sequences of SP192 BINDING SITE, designated SEQ ID:22295, to the nucleotide sequence of VGAM179 RNA, herein designated VGAM RNA, also designated SEQ ID:2890.

Another function of VGAM179 is therefore inhibition of SP192 (Accession NM_021639). Accordingly, utilities of VGAM179 include diagnosis, prevention and treatment of diseases and clinical conditions associated with SP192. Testis-specific Kinase 2 (TESK2, Accession XM_032399) is another VGAM179 host target gene. TESK2 BINDING SITE is HOST TARGET binding site found in the 3' untranslated region of mRNA encoded by TESK2, corresponding to a HOST TARGET binding site such as BINDING SITE I, BINDING SITE II or BINDING SITE III. Table 2 illustrates the complementarity of the nucleotide sequences of TESK2 BINDING SITE, designated SEQ ID:31651, to the nucleotide sequence of VGAM179 RNA, herein designated VGAM RNA, also designated SEQ ID:2890.

Another function of VGAM179 is therefore inhibition of Testis-specific Kinase 2 (TESK2, Accession XM_032399).

Accordingly, utilities of VGAM179 include diagnosis, prevention and treatment of diseases and clinical conditions associated with TESK2. LOC122830 (Accession XM_058661) is another VGAM179 host target gene. LOC122830 BINDING SITE is HOST TARGET binding site found in the 3' untranslated region of mRNA encoded by LOC122830, corresponding to a HOST TARGET binding site such as BINDING SITE I, BINDING SITE II or BINDING SITE III. Table 2 illustrates the complementarity of the nucleotide sequences of LOC122830 BINDING SITE, designated SEQ ID:36705, to the nucleotide sequence of VGAM179 RNA, herein designated VGAM RNA, also designated SEQ ID:2890.

Another function of VGAM179 is therefore inhibition of LOC122830 (Accession XM_058661). Accordingly, utilities of VGAM179 include diagnosis, prevention and treatment of diseases and clinical conditions associated with LOC122830. LOC220846 (Accession XM_165515) is another VGAM179 host target gene. LOC220846 BINDING SITE is HOST TARGET binding site found in the 5' untranslated region of mRNA encoded by LOC220846, corresponding to a HOST TARGET binding site such as BINDING SITE I, BINDING SITE II or BINDING SITE III. Table 2 illustrates the complementarity of the nucleotide sequences of LOC220846 BINDING SITE, designated SEQ ID:43661, to the nucleotide sequence of VGAM179 RNA, herein designated VGAM RNA, also designated SEQ ID:2890.

Another function of VGAM179 is therefore inhibition of LOC220846 (Accession XM_165515). Accordingly, utilities of VGAM179 include diagnosis, prevention and treatment of diseases and clinical conditions associated with LOC220846. LOC55580 (Accession NM_017571) is another VGAM179 host target gene. LOC55580 BINDING SITE is HOST TARGET binding site found in the 5' untranslated region of mRNA encoded by LOC55580, corresponding to a HOST TARGET binding site such as BINDING SITE I, BINDING SITE II or BINDING SITE III. Table 2 illustrates the complementarity of the nucleotide sequences of LOC55580 BINDING SITE, designated SEQ ID:18995, to the nucleotide sequence of VGAM179 RNA, herein designated VGAM RNA, also designated SEQ ID:2890.

Another function of VGAM179 is therefore inhibition of LOC55580 (Accession NM_017571). Accordingly, utilities of VGAM179 include diagnosis, prevention and treatment of diseases and clinical conditions associated with LOC55580. LOC91948 (Accession XM_041723) is another VGAM179 host target gene. LOC91948 BINDING SITE is HOST TARGET binding site found in the 3' untranslated region of mRNA encoded by LOC91948, corresponding to a HOST TARGET binding site such as BINDING SITE I, BINDING SITE II or BINDING SITE III. Table 2 illustrates the complementarity of the nucleotide sequences of LOC91948 BINDING SITE, designated SEQ ID:33573, to the nucleotide sequence of VGAM179 RNA, herein designated VGAM RNA, also designated SEQ ID:2890.

Another function of VGAM179 is therefore inhibition of LOC91948 (Accession XM_041723). Accordingly, utilities of VGAM179 include diagnosis, prevention and treatment of diseases and clinical conditions associated with LOC91948. FIG. 1 further provides a conceptual description of a novel bioinformatically detected viral gene of the present invention, referred to here as Viral Genomic Address Messenger 180 (VGAM180) viral gene, which modulates expression of respective host target genes thereof, the function and utility of which host target genes is known in the art.

VGAM180 is a novel bioinformatically detected regulatory, non protein coding, viral micro RNA (miRNA) gene. The method by which VGAM180 was detected is described hereinabove with reference to FIGS. 1-8.

VGAM180 gene, herein designated VGAM GENE, is a viral gene contained in the genome of Shrimp White Spot Syndrome Virus (white spot bacilliform virus). VGAM180 host target gene, herein designated VGAM HOST TARGET GENE, is a human gene contained in the human genome.

VGAM180 gene encodes a VGAM180 precursor RNA, herein designated VGAM PRECURSOR RNA. Similar to other miRNA genes, and unlike most ordinary genes, VGAM180 precursor RNA does not encode a protein. A nucleotide sequence identical or highly similar to the nucleotide sequence of VGAM180 precursor RNA is designated SEQ ID:166, and is provided hereinbelow with reference to the sequence listing part. Nucleotide sequence SEQ ID:166 is located at position 10036 relative to the genome of Shrimp White Spot Syndrome Virus (white spot bacilliform virus).

VGAM180 precursor RNA folds onto itself, forming VGAM180 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM180 folded precursor RNA into VGAM180 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM180 RNA is designated SEQ ID:2891, and is provided hereinbelow with reference to the sequence listing part.

VGAM180 host target gene, herein designated VGAM HOST TARGET GENE, encodes a corresponding messenger RNA, VGAM180 host target RNA, herein designated VGAM HOST TARGET RNA. VGAM180 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM180 RNA, herein designated VGAM RNA, binds complementarily to one or more host target binding sites located in untranslated regions of VGAM180 host target RNA, herein designated VGAM HOST TARGET RNA. This complementary binding is due to the fact that the nucleotide sequence of VGAM180 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM180 RNA, herein designated VGAM RNA, may have a different number of host target binding sites in untranslated regions of a VGAM180 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM180 RNA, herein designated VGAM RNA, to host target binding sites on VGAM180 host target RNA, herein designated VGAM HOST TARGET RNA, such as BINDING SITE I, BINDING SITE II and BINDING SITE III, inhibits translation of VGAM180 host target RNA into VGAM180 host target protein, herein designated VGAM HOST TARGET PROTEIN. VGAM host target protein is therefore outlined by a broken line.

It is appreciated that VGAM180 host target gene, herein designated VGAM HOST TARGET GENE, in fact represents a plurality of VGAM180 host target genes. The mRNA of each one of this plurality of VGAM180 host target genes comprises one or more host target binding sites, each having a nucleotide sequence which is at least partly complementary to VGAM180 RNA, herein designated VGAM RNA, and which when bound by VGAM180 RNA causes inhibition of translation of respective one or more VGAM180 host target proteins.

It is further appreciated by one skilled in the art that the mode of translational inhibition illustrated by FIG. 1 with specific reference to translational inhibition exerted by VGAM180 gene, herein designated VGAM GENE, on one or more VGAM180 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM180 is inhibition of expression of host target genes, as part of a novel viral mechanism of attacking a host. Accordingly, utilities of VGAM180 include diagnosis, prevention and treatment of viral infection by Shrimp White Spot Syndrome Virus (white spot bacilliform virus). Specific functions, and accordingly utilities, of VGAM180 correlate with, and may be deduced from, the identity of the host target genes which VGAM180 binds and inhibits, and the function of these host target genes, as elaborated hereinbelow.

Nucleotide sequences of the VGAM180 precursor RNA, herein designated VGAM PRECURSOR RNA, and of the 'diced' VGAM180 RNA, herein designated VGAM RNA, and a schematic representation of the secondary folding of VGAM180 folded precursor RNA, herein designated VGAM FOLDED PRECURSOR RNA, of VGAM180 are further described hereinbelow with reference to Table 1.

Nucleotide sequences of host target binding sites, such as BINDING SITE-I, BINDING SITE-II and BINDING SITE-III of FIG. 1, found on VGAM180 host target RNA, and schematic representation of the complementarity of each of these host target binding sites to VGAM180 RNA, herein designated VGAM RNA, are described hereinbelow with reference to Table 2.

As mentioned hereinabove with reference to FIG. 1, a function of VGAM180 gene, herein designated VGAM is inhibition of expression of VGAM180 target genes. It is appreciated that specific functions, and accordingly utilities, of VGAM180 correlate with, and may be deduced from, the identity of the target genes which VGAM180 binds and inhibits, and the function of these target genes, as elaborated hereinbelow.

Phosphodiesterase 4D, CAMP-specific (phosphodiesterase E3 dunce homolog, Drosophila) (PDE4D, Accession XM_056815) is a VGAM180 host target gene. PDE4D BINDING SITE is HOST TARGET binding site found in the 3' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36434, to the nucleotide sequence of VGAM180 RNA, herein designated VGAM RNA, also designated SEQ ID:2891.

A function of VGAM180 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM180 include diagnosis, prevention and treatment of diseases and clinical conditions associated with PDE4D. The function of PDE4D has been established by previous studies. PDE4D is the mammalian homolog of 'dunce' in Drosophila. Flies deficient in this PDE display impairments of the central nervous system and reproductive functions (Dudai et al., 1976). Although only 1 dunce PDE has been described in the fly, 4 orthologous genes are present in mice, rats, and human S: PDE4A (OMIM Ref. No. 600126), PDE4B (OMIM Ref. No. 600127), PDE4C (OMIM Ref. No. 600128), and PDE4D. The encoded proteins share considerable homology in their catalytic and regulatory domains. To examine the role of a PDE in cAMP signaling in vivo, Jin et al. (1999) inactivated the PDE4D gene in mice. This isozyme is involved in feedback regulation of cAMP levels. Mice deficient in PDE4D exhibited delayed growth as well as reduced viability and female fertility. The decrease in fertility of the null female was caused by impaired ovulation and diminished sensitivity of the granulosa cells to gonadotropins. These pleiotropic phenotypes demonstrated that PDE4D plays a critical role in cAMP signaling and that the activity of this isoenzyme is required for the regulation of growth and fertility. Muscarinic cholinergic signaling plays an essential role in the control of normal airway functions and in the development of pulmonary disease states, including asthma. Hansen et al. (2000) demonstrated that the airways of mice deficient in the cAMP-specific phosphodiesterase PDE4D were no longer responsive to cholinergic stimulation. Airway hyperreactivity that followed exposure to antigen was also abolished in PDE4D -/- mice, despite apparently normal lung inflammatory infiltration. The loss of cholinergic responsiveness was specific to the airway, not observed in the heart, and was associated with a loss of signaling through muscarinic receptors with an inability to decrease cAMP accumulation. These findings demonstrated that the PDE4D gene plays an essential role in cAMP homeostasis and cholinergic stimulation of the airway, and in the development of hyperreactivity. In view of the therapeutic potentials of PDE4 inhibitors, the findings provided the rationale for novel strategies that target a single PDE isoenzyme.

Full details of the abovementioned studies are described in the following publications, the disclosure of which are hereby incorporated by reference:

Jin, S.-L. C.; Richard, F. J.; Kuo, W.-P.; d'Ercole, A. J.; Conti, M.: Impaired growth and fertility of cAMP-specific phosphodiesterase PDE4D-deficient mice. Proc. Nat. Acad. Sci. 96:11998-12003, 1999; and Hansen, G.; Jin, S.-L. C.; Umetsu, D. T.; Conti, M.: Absence of muscarinic cholinergic airway responses in mice deficient in the cyclic nucleotide phosphodiesterase PDE4D. Proc. Nat. A.

Further studies establishing the function and utilities of PDE4D are found in John Hopkins OMIM database record ID 600129, and in sited publications numbered 1348-135 and 12445 listed in the bibliography section hereinbelow, which are also hereby incorporated by reference. Replication Protein A1, 70 kDa (RPA1, Accession NM_002945) is another VGAM180 host target gene. RPA1 BINDING SITE is HOST TARGET binding site found in the 3' untranslated region of mRNA encoded by RPA1, corresponding to a HOST TARGET binding site such as BINDING SITE I, BINDING SITE II or BINDING SITE III. Table 2 illustrates the complementarity of the nucleotide sequences of RPA1 BINDING SITE, designated SEQ ID:8854, to the nucleotide sequence of VGAM180 RNA, herein designated VGAM RNA, also designated SEQ ID:2891.

Another function of VGAM180 is therefore inhibition of Replication Protein A1, 70 kDa (RPA1, Accession NM_002945), a gene which is required for simian virus 40 dna replication in vitro. it participates in a very early step in initiation. rp-a is a single-stranded dna-binding protein. Accordingly, utilities of VGAM180 include diagnosis, prevention and treatment of diseases and clinical conditions associated with RPA1. The function of RPA1 has been established by previous studies. Replication protein A (RPA) is a 3-subunit single-stranded DNA-binding protein that has been isolated from human cells and found to be essential for in vitro replication of the papovavirus SV40. Erdile et al. (1991) reported the sequence of a cDNA encoding the 70-kD subunit. The human cDNA directed production in E. coli of a 70-kD protein that reacted with a monoclonal antibody directed against the 70-kD subunit of the human protein. The recombinant subunit, purified from bacteria, exhibited single-stranded DNA-binding activity comparable to that of the complete RPA complex. It could substitute for the complete complex in stimulating the activity of DNA polymerase alpha-primase, but could not substitute for the complete complex in SV40 DNA replication in vitro, suggesting an important functional role for the other subunits. Using PCR amplification of genomic DNA from rodent-human cell lines, Umbricht et al. (1993) mapped the gene for the 70-kD subunit to chromosome 17. By the same method, they mapped the genes for the 32-kD (OMIM Ref. No. 179836) and the 14-kD (OMIM Ref. No. 179837) subunits to chromosomes 1 and 7, respectively. Using a combination of PCR amplification of somatic cell hybrids and radiation hybrids containing chromosome 17 fragments, Umbricht et al. (1994) mapped RPA1 to 17p13.3. Gomes and Wold (1996) constructed a series of N-terminal deletions of RPA70 to explore the function of the protein. Their data indicated that RPA70 is composed of 3 functional domains: an N-terminal domain that is not required for single-stranded DNA binding or SV40 replication, a central DNA-binding domain, and a C-terminal domain that is essential for subunit interactions Full details of the abovementioned studies are described in the following publications, the disclosure of which are hereby incorporated by reference:

Umbricht, C. B.; Griffin, C. A.; Hawkins, A. L.; Grzeschik, K. H.; O'Connell, P.; Leach, R.; Green, E. D.; Kelly, T. J.: High-resolution genomic mapping of the three human replication protein A genes (RPA1, RPA2, and RPA3). Genomics 20:249-257, 1994; and Gomes, X. V.; Wold, M. S.: Functional domains of the 70-kilodalton subunit of human replication protein A. Biochemistry 35:10558-10568, 1996.

Further studies establishing the function and utilities of RPA1 are found in John Hopkins OMIM database record ID 179835, and in sited publications numbered 1798-1799, 3280-328 and 1800-1802 listed in the bibliography section hereinbelow, which are also hereby incorporated by reference. Son of Sevenless Homolog 2 (Drosophila) (SOS2, Accession XM_043720) is another VGAM180 host target gene. SOS2 BINDING SITE is HOST TARGET binding site found in the 3' untranslated region of mRNA encoded by SOS2, corresponding to a HOST TARGET binding site such as BINDING SITE I, BINDING SITE II or BINDING SITE III. Table 2 illustrates the complementarity of the nucleotide sequences of SOS2 BINDING SITE, designated SEQ ID:34000, to the nucleotide sequence of VGAM180 RNA, herein designated VGAM RNA, also designated SEQ ID:2891.

Another function of VGAM180 is therefore inhibition of Son of Sevenless Homolog 2 (Drosophila) (SOS2, Accession XM_043720). Accordingly, utilities of VGAM180 include diagnosis, prevention and treatment of diseases and clinical conditions associated with SOS2. TRAM (Accession NM_014294) is another VGAM180 host target gene. TRAM BINDING SITE is HOST TARGET binding site found in the 3' untranslated region of mRNA encoded by TRAM, corresponding to a HOST TARGET binding site such as BINDING SITE I, BINDING SITE II or BINDING SITE III. Table 2 illustrates the complementarity of the nucleotide sequences of TRAM BINDING SITE, designated SEQ ID:15593, to the nucleotide sequence of VGAM180 RNA, herein designated VGAM RNA, also designated SEQ ID:2891.

Another function of VGAM180 is therefore inhibition of TRAM (Accession NM_014294). Accordingly, utilities of VGAM180 include diagnosis, prevention and treatment of diseases and clinical conditions associated with TRAM. Tripartite Motif-containing 14 (TRIM14, Accession NM_014788) is another VGAM180 host target gene. TRIM14 BINDING SITE is HOST TARGET binding site found in the 3' untranslated region of mRNA encoded by TRIM14, corresponding to a HOST TARGET binding site such as BINDING SITE I, BINDING SITE II or BINDING SITE III. Table 2 illustrates the complementarity of the nucleotide sequences of TRIM14 BINDING SITE, designated SEQ ID:16668, to the nucleotide sequence of VGAM180 RNA, herein designated VGAM RNA, also designated SEQ ID:2891.

Another function of VGAM180 is therefore inhibition of Tripartite Motif-containing 14 (TRIM14, Accession NM_014788), a gene which is composed of 3 zinc-binding domains and is involved in development and cell growth. Accordingly, utilities of VGAM180 include diagnosis, prevention and treatment of diseases and clinical conditions associated with TRIM14. The function of TRIM14 has been established by previous studies. TRIM proteins are composed of 3 zinc-binding domains, a RING, a B-box type 1, and a B-box type 2, followed by a coiled-coil region. They are involved in development and cell growth. By sequencing cDNAs randomly selected from a cDNA library derived from the human immature myeloid cell line KG-1, Nagase et al. (1995) identified a partial cDNA encoding TRIM14, which they called KIAA0129. The deduced 406-amino acid protein is 25% identical to RFP (OMIM Ref. No. 602165). Northern blot analysis revealed wide expression of KIAA0129 that was highest in liver but undetectable in skeletal muscle.

Full details of the abovementioned studies are described in the following publications, the disclosure of which are hereby incorporated by reference:

Nagase, T.; Seki, N.; Tanaka, A.; Ishikawa, K.; Nomura, N.: Prediction of the coding sequences of unidentified human genes. IV. The coding sequences of 40 new genes (KIAA0121-KIAA0160) deduced by analysis of cDNA clones from human cell line KG-1. DNA Res. 2:167-174, 1995; and Reymond, A.; Meroni, G.; Fantozzi, A.; Merla, G.; Cairo, S.; Luzi, L.; Riganelli, D.; Zanaria, E.; Messali, S.; Cainarca, S.; Guffanti, A.; Minucci, S.; Pelicci, P. G.; Ballabio, A.: T.

Further studies establishing the function and utilities of TRIM14 are found in John Hopkins OMIM database record ID 606556, and in sited publications numbered 10969 listed in the bibliography section hereinbelow, which are also hereby incorporated by reference. Tripartite Motif-containing 37 (TRIM37, Accession NM_015294) is another VGAM180 host target gene. TRIM37 BINDING SITE is HOST TARGET binding site found in the 3' untranslated region of mRNA encoded by TRIM37, corresponding to a HOST TARGET binding site such as BINDING SITE I, BINDING SITE II or BINDING SITE III. Table 2 illustrates the complementarity of the nucleotide sequences of TRIM37 BINDING SITE, designated SEQ ID:17618, to the nucleotide sequence of VGAM180 RNA, herein designated VGAM RNA, also designated SEQ ID:2891.

Another function of VGAM180 is therefore inhibition of Tripartite Motif-containing 37 (TRIM37, Accession NM_015294). Accordingly, utilities of VGAM180 include diagnosis, prevention and treatment of diseases and clinical conditions associated with TRIM37. Tyrosine 3-monooxygenase/tryptophan 5-monooxygenase Activation Protein, Gamma Polypeptide (YWHAG, Accession NM_012479) is another VGAM180 host target gene. YWHAG BINDING SITE is HOST TARGET binding site found in the 3' untranslated region of mRNA encoded by YWHAG, corresponding to a HOST TARGET binding site such as BINDING SITE I, BINDING SITE II or BINDING SITE III. Table 2 illustrates the complementarity of the nucleotide sequences of YWHAG BINDING SITE, designated SEQ ID:14857, to the nucleotide sequence of VGAM180 RNA, herein designated VGAM RNA, also designated SEQ ID:2891.

Another function of VGAM180 is therefore inhibition of Tyrosine 3-monooxygenase/tryptophan 5-monooxygenase Activation Protein, Gamma Polypeptide (YWHAG, Accession NM_012479), a gene which mediates mitogenic signals of PDGF in vascular smooth muscle cells. Accordingly, utilities of VGAM180 include diagnosis, prevention and treatment of diseases and clinical conditions associated with YWHAG. The function of YWHAG has been established by previous studies. Members of the 14-3-3 protein family play an important role in signal transduction leading to mitosis and cellular proliferation (Morrison, 1994). For background information on 14-3-3 proteins, see 113508. Autieri et al. (1995, 1996) found that rat 14-3-3-gamma (YWHAG) is upregulated in injured rat carotid arteries and that YWHAG mRNA is upregulated in cytokine-stimulated human vascular smooth muscle cells (VSMC). Using PCR primers based on the rat YWHAG sequence to screen human VSMC, Autieri and Carbone (1999) isolated a cDNA encoding YWHAG. The deduced 246-amino acid protein, which shares 98% sequence identity with the rat sequence, has preserved 14-3-3 family signature motifs, a predicted annexin motif, and several potential phosphorylation sites but not the CDK2 (OMIM Ref. No. 116953) phosphorylation motif. By EST database searching, Horie et al. (1999) also obtained a cDNA encoding YWHAG, which they found to be 100% identical to the 247-amino acid rat sequence. Northern blot analysis revealed ubiquitous expression of a 3.8-kb YWHAG transcript that is relatively strong in brain, skeletal muscle, and heart but weak in peripheral blood leukocytes. By SDS-PAGE and autoradiographic analysis, Autieri and Carbone (1999) found that YWHAG is expressed and phosphorylated by activation with platelet-derived growth factor (OMIM Ref. No. 190040) and other activators of several isoforms of protein kinase C (PKC; e.g., 176960). Inhibitors of PKC block YWHAG phosphorylation. Western blot analysis showed that YWHAG interacts with PKC and with RAF1 (OMIM Ref. No. 164760).

Full details of the abovementioned studies are described in the following publications, the disclosure of which are hereby incorporated by reference:

Autieri, M. V.; Carbone, C. J.:14-3-3-Gamma interacts with and is phosphorylated by multiple protein kinase C isoforms in PDGF-stimulated human vascular smooth muscle cells. DNA Cell Biol. 18:555-564, 1999; and Horie, M.; Suzuki, M.; Takahashi, E.; Tanigami, A.: Cloning, expression, and chromosomal mapping of the human 14-3-3gamma gene (YWHAG) to 7q11.23. Genomics 60:241-243, 1999.

Further studies establishing the function and utilities of YWHAG are found in John Hopkins OMIM database record ID 605356, and in sited publications numbered 618 and 6629-6632 listed in the bibliography section hereinbelow, which are also hereby incorporated by reference. Basic Leucine Zipper Nuclear Factor 1 (JEM-1) (BLZF1, Accession NM_003666) is another VGAM180 host target gene. BLZF1 BINDING SITE is HOST TARGET binding site found in the 3' untranslated region of mRNA encoded by BLZF1, corresponding to a HOST TARGET binding site such as BINDING SITE I, BINDING SITE II or BINDING SITE III. Table 2 illustrates the complementarity of the nucleotide sequences of BLZF1 BINDING SITE, designated SEQ ID:9751, to the nucleotide sequence of VGAM180 RNA, herein designated VGAM RNA, also designated SEQ ID:2891.

Another function of VGAM180 is therefore inhibition of Basic Leucine Zipper Nuclear Factor 1 (JEM-1) (BLZF1, Accession NM_003666). Accordingly, utilities of VGAM180 include diagnosis, prevention and treatment of diseases and clinical conditions associated with BLZF1. DKFZP564D172 (Accession NM_032042) is another VGAM180 host target gene. DKFZP564D172 BINDING SITE is HOST TARGET binding site found in the 3' untranslated region of mRNA encoded by DKFZP564D172, corresponding to a HOST TARGET binding site such as BINDING SITE I, BINDING SITE II or BINDING SITE III. Table 2 illustrates the complementarity of the nucleotide sequences of DKFZP564D172 BINDING SITE, designated SEQ ID:25752, to the nucleotide sequence of VGAM180 RNA, herein designated VGAM RNA, also designated SEQ ID:2891.

Another function of VGAM180 is therefore inhibition of DKFZP564D172 (Accession NM_032042). Accordingly, utilities of VGAM180 include diagnosis, prevention and treatment of diseases and clinical conditions associated with DKFZP564D172. FLJ10154 (Accession NM_018011) is another VGAM180 host target gene. FLJ10154 BINDING SITE is HOST TARGET binding site found in the 3' untranslated region of mRNA encoded by FLJ10154, corresponding to a HOST TARGET binding site such as BINDING SITE I, BINDING SITE II or BINDING SITE III. Table 2 illustrates the complementarity of the nucleotide sequences of FLJ10154 BINDING SITE, designated SEQ ID:19746, to the nucleotide sequence of VGAM180 RNA, herein designated VGAM RNA, also designated SEQ ID:2891.

Another function of VGAM180 is therefore inhibition of FLJ10154 (Accession NM_018011). Accordingly, utilities of VGAM180 include diagnosis, prevention and treatment of diseases and clinical conditions associated with FLJ10154. FLJ11996 (Accession NM_024976) is another VGAM180 host target gene. FLJ11996 BINDING SITE is HOST TARGET binding site found in the 5' untranslated region of mRNA encoded by FLJ11996, corresponding to a HOST TARGET binding site such as BINDING SITE I, BINDING SITE II or BINDING SITE III. Table 2 illustrates the complementarity of the nucleotide sequences of FLJ11996 BINDING SITE, designated SEQ ID:24533, to the nucleotide sequence of VGAM180 RNA, herein designated VGAM RNA, also designated SEQ ID:2891.

Another function of VGAM180 is therefore inhibition of FLJ11996 (Accession NM_024976). Accordingly, utilities of VGAM180 include diagnosis, prevention and treatment of diseases and clinical conditions associated with FLJ11996. KIAA1432 (Accession XM_039698) is another VGAM180 host target gene. KIAA1432 BINDING SITE is HOST TARGET binding site found in the 3' untranslated region of mRNA encoded by KIAA1432, corresponding to a HOST TARGET binding site such as BINDING SITE I, BINDING SITE II or BINDING SITE III. Table 2 illustrates the complementarity of the nucleotide sequences of KIAA1432 BINDING SITE, designated SEQ ID:33157, to the nucleotide sequence of VGAM180 RNA, herein designated VGAM RNA, also designated SEQ ID:2891.

Another function of VGAM180 is therefore inhibition of KIAA1432 (Accession XM_039698). Accordingly, utilities of VGAM180 include diagnosis, prevention and treatment of diseases and clinical conditions associated with KIAA1432. KIAA1946 (Accession XM_092459) is another VGAM180 host target gene. KIAA1946 BINDING SITE is HOST TARGET binding site found in the 3' untranslated region of mRNA encoded by KIAA1946, corresponding to a HOST TARGET binding site such as BINDING SITE I, BINDING SITE II or BINDING SITE III. Table 2 illustrates the complementarity of the nucleotide sequences of KIAA1946 BINDING SITE, designated SEQ ID:40121, to the nucleotide sequence of VGAM180 RNA, herein designated VGAM RNA, also designated SEQ ID:2891.

Another function of VGAM180 is therefore inhibition of KIAA1946 (Accession XM_092459). Accordingly, utilities of VGAM180 include diagnosis, prevention and treatment of diseases and clinical conditions associated with KIAA1946. Spir-1 (Accession XM_035640) is another VGAM180 host target gene. Spir-1 BINDING SITE is HOST TARGET binding site found in the 3' untranslated region of mRNA encoded by Spir-1, corresponding to a HOST TARGET binding site such as BINDING SITE I, BINDING SITE II or BINDING SITE III. Table 2 illustrates the complementarity of the nucleotide sequences of Spir-1 BINDING SITE, designated SEQ ID:32308, to the nucleotide sequence of VGAM180 RNA, herein designated VGAM RNA, also designated SEQ ID:2891.

Another function of VGAM180 is therefore inhibition of Spir-1 (Accession XM_035640). Accordingly, utilities of VGAM180 include diagnosis, prevention and treatment of diseases and clinical conditions associated with Spir-1. Trinucleotide Repeat Containing 6 (TNRC6, Accession XM_047123) is another VGAM180 host target gene. TNRC6 BINDING SITE is HOST TARGET binding site found in the 3' untranslated region of mRNA encoded by TNRC6, corresponding to a HOST TARGET binding site such as BINDING SITE I, BINDING SITE II or BINDING SITE III. Table 2 illustrates the complementarity of the nucleotide sequences of TNRC6 BINDING SITE, designated SEQ ID:34900, to the nucleotide sequence of VGAM180 RNA, herein designated VGAM RNA, also designated SEQ ID:2891.

Another function of VGAM180 is therefore inhibition of Trinucleotide Repeat Containing 6 (TNRC6, Accession XM_047123). Accordingly, utilities of VGAM180 include diagnosis, prevention and treatment of diseases and clinical conditions associated with TNRC6. LOC143098 (Accession XM_084421) is another VGAM180 host target gene. LOC143098 BINDING SITE is HOST TARGET binding site found in the 5' untranslated region of mRNA encoded by LOC143098, corresponding to a HOST TARGET binding site such as BINDING SITE I, BINDING SITE II or BINDING SITE III. Table 2 illustrates the complementarity of the nucleotide sequences of LOC143098 BINDING SITE, designated SEQ ID:37576, to the nucleotide sequence of VGAM180 RNA, herein designated VGAM RNA, also designated SEQ ID:2891.

Another function of VGAM180 is therefore inhibition of LOC143098 (Accession XM_084421). Accordingly, utilities of VGAM180 include diagnosis, prevention and treatment of diseases and clinical conditions associated with LOC143098. LOC220883 (Accession XM_166076) is another VGAM180 host target gene. LOC220883 BINDING SITE is HOST TARGET binding site found in the 3' untranslated region of mRNA encoded by LOC220883, corresponding to a HOST TARGET binding site such as BINDING SITE I, BINDING SITE II or BINDING SITE III. Table 2 illustrates the complementarity of the nucleotide sequences of LOC220883 BINDING SITE, designated SEQ ID:43850, to the nucleotide sequence of VGAM180 RNA, herein designated VGAM RNA, also designated SEQ ID:2891.

Another function of VGAM180 is therefore inhibition of LOC220883 (Accession XM_166076). Accordingly, utilities of VGAM180 include diagnosis, prevention and treatment of diseases and clinical conditions associated with LOC220883. LOC253981 (Accession XM_171064) is another VGAM180 host target gene. LOC253981 BINDING SITE is HOST TARGET binding site found in the 3' untranslated region of mRNA encoded by LOC253981, corresponding to a HOST TARGET binding site such as BINDING SITE I, BINDING SITE II or BINDING SITE III. Table 2 illustrates the complementarity of the nucleotide sequences of LOC253981 BINDING SITE, designated SEQ ID:45867, to the nucleotide sequence of VGAM180 RNA, herein designated VGAM RNA, also designated SEQ ID:2891.

Another function of VGAM180 is therefore inhibition of LOC253981 (Accession XM_171064). Accordingly, utilities of VGAM180 include diagnosis, prevention and treatment of diseases and clinical conditions associated with LOC253981. LOC257464 (Accession XM_116972) is another VGAM180 host target gene. LOC257464 BINDING SITE is HOST TARGET binding site found in the 3' untranslated region of mRNA encoded by LOC257464, corresponding to a HOST TARGET binding site such as BINDING SITE I, BINDING SITE II or BINDING SITE III. Table 2 illustrates the complementarity of the nucleotide sequences of LOC257464 BINDING SITE, designated SEQ ID:43168, to the nucleotide sequence of VGAM180 RNA, herein designated VGAM RNA, also designated SEQ ID:2891.

Another function of VGAM180 is therefore inhibition of LOC257464 (Accession XM_116972). Accordingly, utilities of VGAM180 include diagnosis, prevention and treatment of diseases and clinical conditions associated with LOC257464. LOC55885 (Accession NM_018640) is another VGAM180 host target gene. LOC55885 BINDING SITE is HOST TARGET binding site found in the 3' untranslated region of mRNA encoded by LOC55885, corresponding to a HOST TARGET binding site such as BINDING SITE I, BINDING SITE II or BINDING SITE III. Table 2 illustrates the complementarity of the nucleotide sequences of LOC55885 BINDING SITE, designated SEQ ID:20712, to the nucleotide sequence of VGAM180 RNA, herein designated VGAM RNA, also designated SEQ ID:2891.

Another function of VGAM180 is therefore inhibition of LOC55885 (Accession NM_018640). Accordingly, utilities of VGAM180 include diagnosis, prevention and treatment of diseases and clinical conditions associated with LOC55885.

FIG. 1 further provides a conceptual description of a novel bioinformatically detected viral gene of the present invention, referred to here as Viral Genomic Address Messenger 181 (VGAM181) viral gene, which modulates expression of respective host target genes thereof, the function and utility of which host target genes is known in the art.

VGAM181 is a novel bioinformatically detected regulatory, non protein coding, viral micro RNA (miRNA) gene. The method by which VGAM181 was detected is described hereinabove with reference to FIGS. 1-8.

VGAM181 gene, herein designated VGAM GENE, is a viral gene contained in the genome of Shrimp White Spot Syndrome Virus (white spot bacilliform virus). VGAM181 host target gene, herein designated VGAM HOST TARGET GENE, is a human gene contained in the human genome.

VGAM181 gene encodes a VGAM181 precursor RNA, herein designated VGAM PRECURSOR RNA. Similar to other miRNA genes, and unlike most ordinary genes, VGAM181 precursor RNA does not encode a protein. A nucleotide sequence identical or highly similar to the nucleotide sequence of VGAM181 precursor RNA is designated SEQ ID:167, and is provided hereinbelow with reference to the sequence listing part. Nucleotide sequence SEQ ID:167 is located at position 284231 relative to the genome of Shrimp White Spot Syndrome Virus (white spot bacilliform virus).

VGAM181 precursor RNA folds onto itself, forming VGAM181 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM181 folded precursor RNA into VGAM181 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM181 RNA is designated SEQ ID:2892, and is provided hereinbelow with reference to the sequence listing part.

VGAM181 host target gene, herein designated VGAM HOST TARGET GENE, encodes a corresponding messenger RNA, VGAM181 host target RNA, herein designated VGAM HOST TARGET RNA. VGAM181 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM181 RNA, herein designated VGAM RNA, binds complementarily to one or more host target binding sites located in untranslated regions of VGAM181 host target RNA, herein designated VGAM HOST TARGET RNA. This complementary binding is due to the fact that the nucleotide sequence of VGAM181 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM181 RNA, herein designated VGAM RNA, may have a different number of host target binding sites in untranslated regions of a VGAM181 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM181 RNA, herein designated VGAM RNA, to host target binding sites on VGAM181 host target RNA, herein designated VGAM HOST TARGET RNA, such as BINDING SITE I, BINDING SITE II and BINDING SITE III, inhibits translation of VGAM181 host target RNA into VGAM181 host target protein, herein designated VGAM HOST TARGET PROTEIN. VGAM host target protein is therefore outlined by a broken line.

It is appreciated that VGAM181 host target gene, herein designated VGAM HOST TARGET GENE, in fact represents a plurality of VGAM181 host target genes. The mRNA of each one of this plurality of VGAM181 host target genes comprises one or more host target binding sites, each having a nucleotide sequence which is at least partly complementary to VGAM181 RNA, herein designated VGAM RNA, and which when bound by VGAM181 RNA causes inhibition of translation of respective one or more VGAM181 host target proteins.

It is further appreciated by one skilled in the art that the mode of translational inhibition illustrated by FIG. 1 with specific reference to translational inhibition exerted by VGAM181 gene, herein designated VGAM GENE, on one or more VGAM181 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM181 is inhibition of expression of host target genes, as part of a novel viral mechanism of attacking a host. Accordingly, utilities of VGAM181 include diagnosis, prevention and treatment of viral infection by Shrimp White Spot Syndrome Virus (white spot bacilliform virus). Specific functions, and accordingly utilities, of VGAM181 correlate with, and may be deduced from, the identity of the host target genes which VGAM181 binds and inhibits, and the function of these host target genes, as elaborated hereinbelow.

Nucleotide sequences of the VGAM181 precursor RNA, herein designated VGAM PRECURSOR RNA, and of the 'diced' VGAM181 RNA, herein designated VGAM RNA, and a schematic representation of the secondary folding of VGAM181 folded precursor RNA, herein designated VGAM FOLDED PRECURSOR RNA, of VGAM181 are further described hereinbelow with reference to Table 1.

Nucleotide sequences of host target binding sites, such as BINDING SITE-I, BINDING SITE-II and BINDING SITE-III of FIG. 1, found on VGAM181 host target RNA, and schematic representation of the complementarity of each of these host target binding sites to VGAM181 RNA, herein designated VGAM RNA, are described hereinbelow with reference to Table 2.

As mentioned hereinabove with reference to FIG. 1, a function of VGAM181 gene, herein designated VGAM is inhibition of expression of VGAM181 target genes. It is appreciated that specific functions, and accordingly utilities, of VGAM181 correlate with, and may be deduced from, the identity of the target genes which VGAM181 binds and inhibits, and the function of these target genes, as elaborated hereinbelow.

Phosphatidylinositol Glycan, Class C (PIGC, Accession NM_002642) is a VGAM181 host target gene. PIGC BINDING SITE is HOST TARGET binding site found in the 5' untranslated region of mRNA encoded by PIGC, corresponding to a HOST TARGET binding site such as BINDING SITE I, BINDING SITE II or BINDING SITE III. Table 2 illustrates the complementarity of the nucleotide sequences of PIGC BINDING SITE, designated SEQ ID:8502, to the nucleotide sequence of VGAM181 RNA, herein designated VGAM RNA, also designated SEQ ID:2892.

A function of VGAM181 is therefore inhibition of Phosphatidylinositol Glycan, Class C (PIGC, Accession NM_002642), a gene which is involved in the first step of gpi biosynthesis. Accordingly, utilities of VGAM181 include diagnosis, prevention and treatment of diseases and clinical conditions associated with PIGC. The function of PIGC has been established by previous studies. Many eukaryotic membrane proteins are anchored to membranes via glycosylphosphatidylinositol (GPI) anchors. GPI anchoring is a posttranslational modification occurring in the endoplasmic reticulum (ER). The first step of GPI biosynthesis requires at least 3 genes termed PIGA (OMIM Ref. No. 311770), PIGH (OMIM Ref. No. 600154), and PIGC. Inoue et al. (1996) cloned a human homolog of GPI2 and showed that it is PIGC. PIGC encodes a 297-amino acid polypeptide that is 20% identical to yeast GPI2. This gene, when transfected into human cells mutant for PIGC activity, restored proper GPI anchoring. Using immunolocalization, they found human PIGC protein to be present primarily in the ER in transfected cells Using immunoprecipitation experiments, Watanabe et al. (1998) demonstrated that PIGQ (OMIM Ref. No. 605754) associates specifically with PIGA, PIGC, and PIGH and that all 4 proteins form a complex that has GPI-GlcNAc transferase (GPI-GnT) activity in vitro.

Full details of the abovementioned studies are described in the following publications, the disclosure of which are hereby incorporated by reference:

Inoue, N.; Watanabe, R.; Takeda, J.; Kinoshita, T.: PIG-C, one of the three human genes involved in the first step of glycosylphosphatidylinositol biosynthesis is a homologue of Saccharomyces cerevisiae GPI2. Biochem. Biophys. Res. Commun. 226:193-199, 1996; and Watanabe, R.; Inoue, N.; Westfall, B.; Taron, C. H.; Orlean, P.; Takeda, J.; Kinoshita, T.: The first step of glycosylphosphatidylinositol biosynthesis is mediated by a complex of PIG-A.

Further studies establishing the function and utilities of PIGC are found in John Hopkins OMIM database record ID 601730, and in sited publications numbered 930 and 9321 listed in the bibliography section hereinbelow, which are also hereby incorporated by reference. FLJ10408 (Accession NM_018088) is another VGAM181 host target gene. FLJ10408 BINDING SITE is HOST TARGET binding site found in the 5' untranslated region of mRNA encoded by FLJ10408, corresponding to a HOST TARGET binding site such as BINDING SITE I, BINDING SITE II or BINDING SITE III. Table 2 illustrates the complementarity of the nucleotide sequences of FLJ10408 BINDING SITE, designated SEQ ID:19851, to the nucleotide sequence of VGAM181 RNA, herein designated VGAM RNA, also designated SEQ ID:2892.

Another function of VGAM181 is therefore inhibition of FLJ10408 (Accession NM_018088). Accordingly, utilities of VGAM181 include diagnosis, prevention and treatment of diseases and clinical conditions associated with FLJ10408. KIAA0350 (Accession XM_028332) is another VGAM181 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30660, to the nucleotide sequence of VGAM181 RNA, herein designated VGAM RNA, also designated SEQ ID:2892.

Another function of VGAM181 is therefore inhibition of KIAA0350 (Accession XM_028332). Accordingly, utilities of VGAM181 include diagnosis, prevention and treatment of diseases and clinical conditions associated with KIAA0350. KIAA0892 (Accession XM_048457) is another VGAM181 host target gene. KIAA0892 BINDING SITE is HOST TARGET binding site found in the 3' untranslated region of mRNA encoded by KIAA0892, corresponding to a HOST TARGET binding site such as BINDING SITE I, BINDING SITE II or BINDING SITE III. Table 2 illustrates the complementarity of the nucleotide sequences of KIAA0892 BINDING SITE, designated SEQ ID:35174, to the nucleotide sequence of VGAM181 RNA, herein designated VGAM RNA, also designated SEQ ID:2892.

Another function of VGAM181 is therefore inhibition of KIAA0892 (Accession XM_048457). Accordingly, utilities of VGAM181 include diagnosis, prevention and treatment of diseases and clinical conditions associated with KIAA0892. TNF Receptor-associated Factor 3 (TRAF3, Accession XM_007256) is another VGAM181 host target gene. TRAF3 BINDING SITE is HOST TARGET binding site found in the 3' untranslated region of mRNA encoded by TRAF3, corresponding to a HOST TARGET binding site such as BINDING SITE I, BINDING SITE II or BINDING SITE III. Table 2 illustrates the complementarity of the nucleotide sequences of TRAF3 BINDING SITE, designated SEQ ID:30039, to the nucleotide sequence of VGAM181 RNA, herein designated VGAM RNA, also designated SEQ ID:2892.

Another function of VGAM181 is therefore inhibition of TNF Receptor-associated Factor 3 (TRAF3, Accession XM_007256). Accordingly, utilities of VGAM181 include diagnosis, prevention and treatment of diseases and clinical conditions associated with TRAF3. LOC150245 (Accession XM_097843) is another VGAM181 host target gene. LOC150245 BINDING SITE is HOST TARGET binding site found in the 3' untranslated region of mRNA encoded by LOC150245, corresponding to a HOST TARGET binding site such as BINDING SITE I, BINDING SITE II or BINDING SITE III. Table 2 illustrates the complementarity of the nucleotide sequences of LOC150245 BINDING SITE, designated SEQ ID:41159, to the nucleotide sequence of VGAM181 RNA, herein designated VGAM RNA, also designated SEQ ID:2892.

Another function of VGAM181 is therefore inhibition of LOC150245 (Accession XM_097843). Accordingly, utilities of VGAM181 include diagnosis, prevention and treatment of diseases and clinical conditions associated with LOC150245. FIG. 1 further provides a conceptual description of a novel bioinformatically detected viral gene of the present invention, referred to here as Viral Genomic Address Messenger 182 (VGAM182) viral gene, which modulates expression of respective host target genes thereof, the function and utility of which host target genes is known in the art.

VGAM182 is a novel bioinformatically detected regulatory, non protein coding, viral micro RNA (miRNA) gene. The method by which VGAM182 was detected is described hereinabove with reference to FIGS. 1-8.

VGAM182 gene, herein designated VGAM GENE, is a viral gene contained in the genome of Shrimp White Spot Syndrome Virus (white spot bacilliform virus). VGAM182 host target gene, herein designated VGAM HOST TARGET GENE, is a human gene contained in the human genome.

VGAM182 gene encodes a VGAM182 precursor RNA, herein designated VGAM PRECURSOR RNA. Similar to other miRNA genes, and unlike most ordinary genes, VGAM182 precursor RNA does not encode a protein. A nucleotide sequence identical or highly similar to the nucleotide sequence of VGAM182 precursor RNA is designated SEQ ID:168, and is provided hereinbelow with reference to the sequence listing part. Nucleotide sequence SEQ ID:168 is located at position 31462 relative to the genome of Shrimp White Spot Syndrome Virus (white spot bacilliform virus).

VGAM182 precursor RNA folds onto itself, forming VGAM182 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM182 folded precursor RNA into VGAM182 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM182 RNA is designated SEQ ID:2893, and is provided hereinbelow with reference to the sequence listing part.

VGAM182 host target gene, herein designated VGAM HOST TARGET GENE, encodes a corresponding messenger RNA, VGAM182 host target RNA, herein designated VGAM HOST TARGET RNA. VGAM182 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM182 RNA, herein designated VGAM RNA, binds complementarily to one or more host target binding sites located in untranslated regions of VGAM182 host target RNA, herein designated VGAM HOST TARGET RNA. This complementary binding is due to the fact that the nucleotide sequence of VGAM182 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM182 RNA, herein designated VGAM RNA, may have a different number of host target binding sites in untranslated regions of a VGAM182 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM182 RNA, herein designated VGAM RNA, to host target binding sites on VGAM182 host target RNA, herein designated VGAM HOST TARGET RNA, such as BINDING SITE I, BINDING SITE II and BINDING SITE III, inhibits translation of VGAM182 host target RNA into VGAM182 host target protein, herein designated VGAM HOST TARGET PROTEIN. VGAM host target protein is therefore outlined by a broken line.

It is appreciated that VGAM182 host target gene, herein designated VGAM HOST TARGET GENE, in fact represents a plurality of VGAM182 host target genes. The mRNA of each one of this plurality of VGAM182 host target genes comprises one or more host target binding sites, each having a nucleotide sequence which is at least partly complementary to VGAM182 RNA, herein designated VGAM RNA, and which when bound by VGAM182 RNA causes inhibition of translation of respective one or more VGAM182 host target proteins.

It is further appreciated by one skilled in the art that the mode of translational inhibition illustrated by FIG. 1 with specific reference to translational inhibition exerted by VGAM182 gene, herein designated VGAM GENE, on one or more VGAM182 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM182 is inhibition of expression of host target genes, as part of a novel viral mechanism of attacking a host. Accordingly, utilities of VGAM182 include diagnosis, prevention and treatment of viral infection by Shrimp White Spot Syndrome Virus (white spot bacilliform virus). Specific functions, and accordingly utilities, of VGAM182 correlate with, and may be deduced from, the identity of the host target genes which VGAM182 binds and inhibits, and the function of these host target genes, as elaborated hereinbelow.

Nucleotide sequences of the VGAM182 precursor RNA, herein designated VGAM PRECURSOR RNA, and of the 'diced' VGAM182 RNA, herein designated VGAM RNA, and a schematic representation of the secondary folding of VGAM182 folded precursor RNA, herein designated VGAM FOLDED PRECURSOR RNA, of VGAM182 are further described hereinbelow with reference to Table 1.

Nucleotide sequences of host target binding sites, such as BINDING SITE-I, BINDING SITE-II and BINDING SITE-III of FIG. 1, found on VGAM182 host target RNA, and schematic representation of the complementarity of each of these host target binding sites to VGAM182 RNA, herein designated VGAM RNA, are described hereinbelow with reference to Table 2.

As mentioned hereinabove with reference to FIG. 1, a function of VGAM182 gene, herein designated VGAM is inhibition of expression of VGAM182 target genes. It is appreciated that specific functions, and accordingly utilities, of VGAM182 correlate with, and may be deduced from, the identity of the target genes which VGAM182 binds and inhibits, and the function of these target genes, as elaborated hereinbelow.

Calcium Channel, Voltage-dependent, L Type, Alpha 1C Subunit (CACNA1C, Accession NM_000719) is a VGAM182 host target gene. CACNA1C BINDING SITE is HOST TARGET binding site found in the 5' untranslated region of mRNA encoded by CACNA1C, corresponding to a HOST TARGET binding site such as BINDING SITE I, BINDING SITE II or BINDING SITE III. Table 2 illustrates the complementarity of the nucleotide sequences of CACNA1C BINDING SITE, designated SEQ ID:6383, to the nucleotide sequence of VGAM182 RNA, herein designated VGAM RNA, also designated SEQ ID:2893.

A function of VGAM182 is therefore inhibition of Calcium Channel, Voltage-dependent, L Type, Alpha 1C Subunit (CACNA1C, Accession NM_000719), a gene which is alpha-1 subunit of DHP-sensitive calcium channels from cardiac muscle and the brain. Accordingly, utilities of VGAM182 include diagnosis, prevention and treatment of diseases and clinical conditions associated with CACNA1C. The function of CACNA1C has been established by previous studies. Activation of voltage-sensitive calcium channels by membrane depolarization triggers key cellular responses such as contraction, secretion, excitation, and electrical signaling (Tsien et al., 1991). The L-type currents produced by voltage-sensitive calcium channels are blocked by 1,4-dihydropyridine (DHP) derivatives; thus, the channels responsible for these currents are referred to as DHP-sensitive. The skeletal muscle DHP-sensitive calcium channel is a complex of 5 subunits: alpha-1, alpha-2, beta, gamma, and delta. The DHP-sensitive calcium channels from cardiac muscle and the brain have pharmacologic and electrophysiologic properties that differ from those of the skeletal muscle channel. Powers et al. (1991) isolated a clone for the human CCHL1A1 gene and partially sequenced it. Oligonucleotides based on the human sequence were constructed and used in PCR to amplify specifically this human gene in human-rodent somatic cell hybrids. In this way, the gene was assigned to 12pter-p12. Using a dinucleotide repeat for linkage analysis in the CEPH panel of families, Powers et al. (1992) narrowed the assignment to 12pter-p13.2. The data placed CACNL1A1 distal to PRB1 (OMIM Ref. No. 180989). By study of somatic cell hybrids, Sun et al. (1992) likewise assigned the CACNL1A1 gene to 12pter-p13. (The gene is also symbolized CACNA1C and CCHL1A1.) Schultz et al. (1993) localized the CCHL1A1 gene to 12p13.3 by study of a 12p somatic cell hybrid mapping panel and by fluorescence in situ hybridization. Animal model experiments lend further support to the function of CACNA1C. Valenzuela et al. (1997) generated knockout mice lacking both forms of Go-alpha (OMIM Ref. No. 139311) by homologous recombination and studied the muscarinic regulation of calcium channels in cardiac muscles in Go-alpha -/- mice and controls. There was no difference in the effect of isoproterenol on the L-type voltage-dependent calcium channel in ventricular myocytes of both groups, but the inhibitory effect of carbamylcholine was almost completely abolished in the Go-alpha -/- group. This demonstrated that, in the heart, Go-alpha is specifically required for transmission of signals from the muscarinic receptor to the L-type voltage-dependent calcium channel.

It is appreciated that the abovementioned animal model for CACNA1C is acknowledged by those skilled in the art as a scientifically valid animal model, as can be further appreciated from the publications sited hereinbelow.

Full details of the abovementioned studies are described in the following publications, the disclosure of which are hereby incorporated by reference:

Valenzuela, D.; Han, X.; Mende, U.; Fankhauser, C.; Mashimo, H.; Huang, P.; Pfeffer, J.; Neer, E. J.; Fishman, M. C.: G-alpha-o is necessary for muscarinic regulation of Ca (2+) channels in mouse heart. Proc. Nat. Acad. Sci. 94:1727-2732, 1997; and Tsien, R. W.; Ellinor, P. T.; Horne, W. A.: Molecular diversity of voltage-dependent Ca (2+) channels. Trends Pharm. Sci. 12:349-354, 1991.

Further studies establishing the function and utilities of CACNA1C are found in John Hopkins OMIM database record ID 114205, and in sited publications numbered 179, 10478-4700, 10079-4702, 4850-4849, 361 and 10270 listed in the bibliography section hereinbelow, which are also hereby incorporated by reference. FLJ11101 (Accession NM_018322) is another VGAM182 host target gene. FLJ11101 BINDING SITE is HOST TARGET binding site found in the 3' untranslated region of mRNA encoded by FLJ11101, corresponding to a HOST TARGET binding site such as BINDING SITE I, BINDING SITE II or BINDING SITE III. Table 2 illustrates the complementarity of the nucleotide sequences of FLJ11101 BINDING SITE, designated SEQ ID:20316, to the nucleotide sequence of VGAM182 RNA, herein designated VGAM RNA, also designated SEQ ID:2893.

Another function of VGAM182 is therefore inhibition of FLJ11101 (Accession NM_018322). Accordingly, utilities of VGAM182 include diagnosis, prevention and treatment of diseases and clinical conditions associated with FLJ11101. FYVE and Coiled-coil Domain Containing 1 (FYCO1, Accession NM_024513) is another VGAM182 host target gene. FYCO1 BINDING SITE is HOST TARGET binding site found in the 3' untranslated region of mRNA encoded by FYCO1, corresponding to a HOST TARGET binding site such as BINDING SITE I, BINDING SITE II or BINDING SITE III. Table 2 illustrates the complementarity of the nucleotide sequences of FYCO1 BINDING SITE, designated SEQ ID:23715, to the nucleotide sequence of VGAM182 RNA, herein designated VGAM RNA, also designated SEQ ID:2893.

Another function of VGAM182 is therefore inhibition of FYVE and Coiled-coil Domain Containing 1 (FYCO1, Accession NM_024513). Accordingly, utilities of VGAM182 include diagnosis, prevention and treatment of diseases and clinical conditions associated with FYCO1. Makorin, Ring Finger Protein, 1 (MKRN1, Accession NM_013446) is another VGAM182 host target gene. MKRN1 BINDING SITE is HOST TARGET binding site found in the 3' untranslated region of mRNA encoded by MKRN1, corresponding to a HOST TARGET binding site such as BINDING SITE I, BINDING SITE II or BINDING SITE III. Table 2 illustrates the complementarity of the nucleotide sequences of MKRN1 BINDING SITE, designated SEQ ID:15113, to the nucleotide sequence of VGAM182 RNA, herein designated VGAM RNA, also designated SEQ ID:2893.

Another function of VGAM182 is therefore inhibition of Makorin, Ring Finger Protein, 1 (MKRN1, Accession NM_013446). Accordingly, utilities of VGAM182 include diagnosis, prevention and treatment of diseases and clinical conditions associated with MKRN1. Makorin, Ring Finger Protein, 4 (MKRN4, Accession NM_030757) is another VGAM182 host target gene. MKRN4 BINDING SITE is HOST TARGET binding site found in the 3' untranslated region of mRNA encoded by MKRN4, corresponding to a HOST TARGET binding site such as BINDING SITE I, BINDING SITE II or BINDING SITE III. Table 2 illustrates the complementarity of the nucleotide sequences of MKRN4 BINDING SITE, designated SEQ ID:25042, to the nucleotide sequence of VGAM182 RNA, herein designated VGAM RNA, also designated SEQ ID:2893.

Another function of VGAM182 is therefore inhibition of Makorin, Ring Finger Protein, 4 (MKRN4, Accession NM_030757). Accordingly, utilities of VGAM182 include diagnosis, prevention and treatment of diseases and clinical conditions associated with MKRN4. MTO1 (Accession NM_133645) is another VGAM182 host target gene. MTO1 BINDING SITE is HOST TARGET binding site found in the 3' untranslated region of mRNA encoded by MTO1, corresponding to a HOST TARGET binding site such as BINDING SITE I, BINDING SITE II or BINDING SITE III. Table 2 illustrates the complementarity of the nucleotide sequences of MTO1 BINDING SITE, designated SEQ ID:28603, to the nucleotide sequence of VGAM182 RNA, herein designated VGAM RNA, also designated SEQ ID:2893.

Another function of VGAM182 is therefore inhibition of MTO1 (Accession NM_133645). Accordingly, utilities of VGAM182 include diagnosis, prevention and treatment of diseases and clinical conditions associated with MTO1. Protein Phosphatase 1, Regulatory Subunit 10 (PPP1R10, Accession NM_002714) is another VGAM182 host target gene. PPP1R10 BINDING SITE is HOST TARGET binding site found in the 3" untranslated region of mRNA encoded by PPP1R10, corresponding to a HOST TARGET binding site such as BINDING SITE I, BINDING SITE II or BINDING SITE III. Table 2 illustrates the complementarity of the nucleotide sequences of PPP1R10 BINDING SITE, designated SEQ ID:8574, to the nucleotide sequence of VGAM182 RNA, herein designated VGAM RNA, also designated SEQ ID:2893.

Another function of VGAM182 is therefore inhibition of Protein Phosphatase 1, Regulatory Subunit 10 (PPP1R10, Accession NM_002714). Accordingly, utilities of VGAM182 include diagnosis, prevention and treatment of diseases and clinical conditions associated with PPP1R10. STRIN (Accession NM_016271) is another VGAM182 host target gene. STRIN BINDING SITE is HOST TARGET binding site found in the 3' untranslated region of mRNA encoded by STRIN, corresponding to a HOST TARGET binding site such as BINDING SITE I, BINDING SITE II or BINDING SITE III. Table 2 illustrates the complementarity of the nucleotide sequences of STRIN BINDING SITE, designated SEQ ID:18398, to the nucleotide sequence of VGAM182 RNA, herein designated VGAM RNA, also designated SEQ ID:2893.

Another function of VGAM182 is therefore inhibition of STRIN (Accession NM_016271). Accordingly, utilities of VGAM182 include diagnosis, prevention and treatment of diseases and clinical conditions associated with STRIN. Testis-specific Kinase 2 (TESK2, Accession XM_032399) is another VGAM182 host target gene. TESK2 BINDING SITE is HOST TARGET binding site found in the 3' untranslated region of mRNA encoded by TESK2, corresponding to a HOST TARGET binding site such as BINDING SITE I, BINDING SITE II or BINDING SITE III. Table 2 illustrates the complementarity of the nucleotide sequences of TESK2 BINDING SITE, designated SEQ ID:31650, to the nucleotide sequence of VGAM182 RNA, herein designated VGAM RNA, also designated SEQ ID:2893.

Another function of VGAM182 is therefore inhibition of Testis-specific Kinase 2 (TESK2, Accession XM_032399). Accordingly, utilities of VGAM182 include diagnosis, prevention and treatment of diseases and clinical conditions associated with TESK2. LOC150481 (Accession XM_086929) is another VGAM182 host target gene. LOC150481 BINDING SITE is HOST TARGET binding site found in the 3' untranslated region of mRNA encoded by LOC150481, corresponding to a HOST TARGET binding site such as BINDING SITE I, BINDING SITE II or BINDING SITE III. Table 2 illustrates the complementarity of the nucleotide sequences of LOC150481 BINDING SITE, designated SEQ ID:38983, to the nucleotide sequence of VGAM182 RNA, herein designated VGAM RNA, also designated SEQ ID:2893.

Another function of VGAM182 is therefore inhibition of LOC150481 (Accession XM_086929). Accordingly, utilities of VGAM182 include diagnosis, prevention and treatment of diseases and clinical conditions associated with LOC150481. LOC158191 (Accession XM_088505) is another VGAM182 host target gene. LOC158191 BINDING SITE is HOST TARGET binding site found in the 3' untranslated region of mRNA encoded by LOC158191, corresponding to a HOST TARGET binding site such as BINDING SITE I, BINDING SITE II or BINDING SITE III. Table 2 illustrates the complementarity of the nucleotide sequences of LOC158191 BINDING SITE, designated SEQ ID:39759, to the nucleotide sequence of VGAM182 RNA, herein designated VGAM RNA, also designated SEQ ID:2893.

Another function of VGAM182 is therefore inhibition of LOC158191 (Accession XM_088505). Accordingly, utilities of VGAM182 include diagnosis, prevention and treatment of diseases and clinical conditions associated with LOC158191. FIG. 1 further provides a conceptual description of a novel bioinformatically detected viral gene of the present invention, referred to here as Viral Genomic Address Messenger 183 (VGAM183) viral gene, which modulates expression of respective host target genes thereof, the function and utility of which host target genes is known in the art.

VGAM183 is a novel bioinformatically detected regulatory, non protein coding, viral micro RNA (miRNA) gene. The method by which VGAM183 was detected is described hereinabove with reference to FIGS. 1-8.

VGAM183 gene, herein designated VGAM GENE, is a viral gene contained in the genome of Shrimp White Spot Syndrome Virus (white spot bacilliform virus). VGAM183 host target gene, herein designated VGAM HOST TARGET GENE, is a human gene contained in the human genome.

VGAM183 gene encodes a VGAM183 precursor RNA, herein designated VGAM PRECURSOR RNA. Similar to other miRNA genes, and unlike most ordinary genes, VGAM183 precursor RNA does not encode a protein. A nucleotide sequence identical or highly similar to the nucleotide sequence of VGAM183 precursor RNA is designated SEQ ID:169, and is provided hereinbelow with reference to the sequence listing part. Nucleotide sequence SEQ ID:169 is located at position 93258 relative to the genome of Shrimp White Spot Syndrome Virus (white spot bacilliform virus).

VGAM183 precursor RNA folds onto itself, forming VGAM183 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM183 folded precursor RNA into VGAM183 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM183 RNA is designated SEQ ID:2894, and is provided hereinbelow with reference to the sequence listing part.

VGAM183 host target gene, herein designated VGAM HOST TARGET GENE, encodes a corresponding messenger RNA, VGAM183 host target RNA, herein designated VGAM HOST TARGET RNA. VGAM183 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM183 RNA, herein designated VGAM RNA, binds complementarily to one or more host target binding sites located in untranslated regions of VGAM183 host target RNA, herein designated VGAM HOST TARGET RNA. This complementary binding is due to the fact that the nucleotide sequence of VGAM183 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM183 RNA, herein designated VGAM RNA, may have a different number of host target binding sites in untranslated regions of a VGAM183 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM183 RNA, herein designated VGAM RNA, to host target binding sites on VGAM183 host target RNA, herein designated VGAM HOST TARGET RNA, such as BINDING SITE I, BINDING SITE II and BINDING SITE III, inhibits translation of VGAM183 host target RNA into VGAM183 host target protein, herein designated VGAM HOST TARGET PROTEIN. VGAM host target protein is therefore outlined by a broken line.

It is appreciated that VGAM183 host target gene, herein designated VGAM HOST TARGET GENE, in fact represents a plurality of VGAM183 host target genes. The mRNA of each one of this plurality of VGAM183 host target genes comprises one or more host target binding sites, each having a nucleotide sequence which is at least partly complementary to VGAM183 RNA, herein designated VGAM RNA, and which when bound by VGAM183 RNA causes inhibition of translation of respective one or more VGAM183 host target proteins.

It is further appreciated by one skilled in the art that the mode of translational inhibition illustrated by FIG. 1 with specific reference to translational inhibition exerted by VGAM183 gene, herein designated VGAM GENE, on one or more VGAM183 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM183 is inhibition of expression of host target genes, as part of a novel viral mechanism of attacking a host. Accordingly, utilities of VGAM183 include diagnosis, prevention and treatment of viral infection by Shrimp White Spot Syndrome Virus (white spot bacilliform virus). Specific functions, and accordingly utilities, of VGAM183 correlate with, and may be deduced from, the identity of the host target genes which VGAM183 binds and inhibits, and the function of these host target genes, as elaborated hereinbelow.

Nucleotide sequences of the VGAM183 precursor RNA, herein designated VGAM PRECURSOR RNA, and of the 'diced' VGAM183 RNA, herein designated VGAM RNA, and a schematic representation of the secondary folding of VGAM183 folded precursor RNA, herein designated VGAM FOLDED PRECURSOR RNA, of VGAM183 are further described hereinbelow with reference to Table 1.

Nucleotide sequences of host target binding sites, such as BINDING SITE-I, BINDING SITE-II and BINDING SITE-III of FIG. 1, found on VGAM183 host target RNA, and schematic representation of the complementarity of each of these host target binding sites to VGAM183 RNA, herein designated VGAM RNA, are described hereinbelow with reference to Table 2.

As mentioned hereinabove with reference to FIG. 1, a function of VGAM183 gene, herein designated VGAM is inhibition of expression of VGAM183 target genes. It is appreciated that specific functions, and accordingly utilities, of VGAM183 correlate with, and may be deduced from, the identity of the target genes which VGAM183 binds and inhibits, and the function of these target genes, as elaborated hereinbelow.

UDP-Gal:betaGlcNAc Beta 1,4-Galactosyltransferase, Polypeptide 6 (B4GALT6, Accession XM_008799) is a VGAM183 host target gene. B4GALT6 BINDING SITE is HOST TARGET binding site found in the 3' untranslated region of mRNA encoded by B4GALT6, corresponding to a HOST TARGET binding site such as BINDING SITE I, BINDING SITE II or BINDING SITE III. Table 2 illustrates the complementarity of the nucleotide sequences of B4GALT6 BINDING SITE, designated SEQ ID:30091, to the nucleotide sequence of VGAM183 RNA, herein designated VGAM RNA, also designated SEQ ID:2894.

A function of VGAM183 is therefore inhibition of UDP-Gal:betaGlcNAc Beta 1,4-Galactosyltransferase, Polypeptide 6 (B4GALT6, Accession XM_008799). Accordingly, utilities of VGAM183 include diagnosis, prevention and treatment of diseases and clinical conditions associated with B4GALT6. Orthopedia Homolog (Drosophila) (OTP, Accession NM_032109) is another VGAM183 host target gene. OTP BINDING SITE is HOST TARGET binding site found in the 3' untranslated region of mRNA encoded by OTP, corresponding to a HOST TARGET binding site such as BINDING SITE I, BINDING SITE II or BINDING SITE III. Table 2 illustrates the complementarity of the nucleotide sequences of OTP BINDING SITE, designated SEQ ID:25803, to the nucleotide sequence of VGAM183 RNA, herein designated VGAM RNA, also designated SEQ ID:2894.

Another function of VGAM183 is therefore inhibition of Orthopedia Homolog (Drosophila) (OTP, Accession NM_032109), a gene which involves in the development of the forebrain and spinal cord. Accordingly, utilities of VGAM183 include diagnosis, prevention and treatment of diseases and clinical conditions associated with OTP. The function of OTP has been established by previous studies. Homeodomain genes are helix-turn-helix transcription factors that play key roles in the specification of cell fates. In the central nervous system, homeodomain genes not only position cells along an axis, but also specify cell migration patterns and may influence axonal connectivity. In an effort to identify novel homeodomain genes involved in the development of the human central nervous system, Lin et al. (1999) cloned, characterized, and mapped the human homolog of the murine homeodomain gene Orthopedia (Otp), whose product is found in multiple cell groups within the mouse hypothalamus, amygdala, and brain stem. The human OTP cDNA encodes a protein of 325 amino acids. The deduced amino acid sequence is 99% homologous to mouse Otp and demonstrated a high degree of conservation when compared to sea urchin and Drosophila Otp proteins. A single putative OTP gene product was found in 17-week human fetal brain tissue by Western blot analysis using a novel polyclonal antibody raised against a conserved 13-amino acid sequence in the C terminus of the OTP protein. Expression in the developing human hypothalamus was confirmed by immunohistochemistry. Lin et al. (1999) mapped the human OTP gene to chromosome 5q13.3 using analysis of a radiation hybrid panel and by fluorescence in situ hybridization. Animal model experiments lend further support to the function of OTP. Acampora et al. (1999) generated mice deficient in Otp by homologous recombination. Homozygous Otp -/- mice died soon after birth and displayed progressive impairment of crucial neuroendocrine developmental events such as reduced cell proliferation, abnormal cell migration, and failure in terminal differentiation of the parvocellular and magnocellular neurons of the anterior periventricular, paraventricular, supraoptic, and arcuate nuclei. Acampora et al. (1999) suggested that Otp and Sim1 (OMIM Ref. No. 603128) are required to maintain Brn2 (OMIM Ref. No. 600494) expression which, in turn, is required for neuronal cell lineages secreting oxytocin (OMIM Ref. No. 167050), arginine vasopressin (OMIM Ref. No. 192340), and corticotropin-releasing (OMIM Ref. No. 122560) hormones.

It is appreciated that the abovementioned animal model for OTP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Acampora, D.; Postiglione, M. P.; Avantaggiato, V.; Di Bonito, M.; Vaccarino, F. M.; Michaud, J.; Simeone, A.: Progressive impairment of developing neuroendocrine cell lineages in the hypothalamus of mice lacking the Orthopedia gene. Genes Dev. 13:2787-2800, 1999; and Lin, X.; State, M. W.; Vaccarino, F. M.; Greally, J.; Hass, M.; Leckman, J. F.: Identification, chromosomal assignment, and expression analysis of the human homeodomain-containing gene.

Further studies establishing the function and utilities of OTP are found in John Hopkins OMIM database record ID 604529, and in sited publications numbered 7088-7089 listed in the bibliography section hereinbelow, which are also hereby incorporated by reference. FLJ20160 (Accession NM_017694) is another VGAM183 host target gene. FLJ20160 BINDING SITE is HOST TARGET binding site found in the 3' untranslated region of mRNA encoded by FLJ20160, corresponding to a HOST TARGET binding site such as BINDING SITE I, BINDING SITE II or BINDING SITE III. Table 2 illustrates the complementarity of the nucleotide sequences of FLJ20160 BINDING SITE, designated SEQ ID:19257, to the nucleotide sequence of VGAM183 RNA, herein designated VGAM RNA, also designated SEQ ID:2894.

Another function of VGAM183 is therefore inhibition of FLJ20160 (Accession NM_017694). Accordingly, utilities of VGAM183 include diagnosis, prevention and treatment of diseases and clinical conditions associated with FLJ20160. High-mobility Group (nonhistone chromosomal) Protein 17-like 1 (HMG17L1, Accession NM_021024) is another VGAM183 host target gene. HMG17L1 BINDING SITE is HOST TARGET binding site found in the 3' untranslated region of mRNA encoded by HMG17L1, corresponding to a HOST TARGET binding site such as BINDING SITE I, BINDING SITE II or BINDING SITE III. Table 2 illustrates the complementarity of the nucleotide sequences of HMG17L1 BINDING SITE, designated SEQ ID:22015, to the nucleotide sequence of VGAM183 RNA, herein designated VGAM RNA, also designated SEQ ID:2894.

Another function of VGAM183 is therefore inhibition of High-mobility Group (nonhistone chromosomal) Protein 17-like 1 (HMG17L1, Accession NM_021024). Accordingly, utilities of VGAM183 include diagnosis, prevention and treatment of diseases and clinical conditions associated with HMG17L1. LOC123283 (Accession XM_071829) is another VGAM183 host target gene. LOC123283 BINDING SITE is HOST TARGET binding site found in the 3' untranslated region of mRNA encoded by LOC123283, corresponding to a HOST TARGET binding site such as BINDING SITE I, BINDING SITE II or BINDING SITE III. Table 2 illustrates the complementarity of the nucleotide sequences of LOC123283 BINDING SITE, designated SEQ ID:37423, to the nucleotide sequence of VGAM183 RNA, herein designated VGAM RNA, also designated SEQ ID:2894.

Another function of VGAM183 is therefore inhibition of LOC123283 (Accession XM_071829). Accordingly, utilities of VGAM183 include diagnosis, prevention and treatment of diseases and clinical conditions associated with LOC123283. LOC143524 (Accession XM_084559) is another VGAM183 host target gene. LOC143524 BINDING SITE is HOST TARGET binding site found in the 3' untranslated region of mRNA encoded by LOC143524, corresponding to a HOST TARGET binding site such as BINDING SITE I, BINDING SITE II or BINDING SITE III. Table 2 illustrates the complementarity of the nucleotide sequences of LOC143524 BINDING SITE, designated SEQ ID:37629, to the nucleotide sequence of VGAM183 RNA, herein designated VGAM RNA, also designated SEQ ID:2894.

Another function of VGAM183 is therefore inhibition of LOC143524 (Accession XM_084559). Accordingly, utilities of VGAM183 include diagnosis, prevention and treatment of diseases and clinical conditions associated with LOC143524. FIG. 1 further provides a conceptual description of a novel bioinformatically detected viral gene of the present invention, referred to here as Viral Genomic Address Messenger 184 (VGAM184) viral gene, which modulates expression of respective host target genes thereof, the function and utility of which host target genes is known in the art.

VGAM184 is a novel bioinformatically detected regulatory, non protein coding, viral micro RNA (miRNA) gene. The method by which VGAM184 was detected is described hereinabove with reference to FIGS. 1-8.

VGAM184 gene, herein designated VGAM GENE, is a viral gene contained in the genome of Shrimp White Spot Syndrome Virus (white spot bacilliform virus). VGAM184 host target gene, herein designated VGAM HOST TARGET GENE, is a human gene contained in the human genome.

VGAM184 gene encodes a VGAM184 precursor RNA, herein designated VGAM PRECURSOR RNA. Similar to other miRNA genes, and unlike most ordinary genes, VGAM184 precursor RNA does not encode a protein. A nucleotide sequence identical or highly similar to the nucleotide sequence of VGAM184 precursor RNA is designated SEQ ID:170, and is provided hereinbelow with reference to the sequence listing part. Nucleotide sequence SEQ ID:170 is located at position 166001 relative to the genome of Shrimp White Spot Syndrome Virus (white spot baciliform virus).

VGAM184 precursor RNA folds onto itself, forming VGAM184 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM184 folded precursor RNA into VGAM184 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM184 RNA is designated SEQ ID:2895, and is provided hereinbelow with reference to the sequence listing part.

VGAM184 host target gene, herein designated VGAM HOST TARGET GENE, encodes a corresponding messenger RNA, VGAM184 host target RNA, herein designated VGAM HOST TARGET RNA. VGAM184 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM184 RNA, herein designated VGAM RNA, binds complementarily to one or more host target binding sites located in untranslated regions of VGAM184 host target RNA, herein designated VGAM HOST TARGET RNA. This complementary binding is due to the fact that the nucleotide sequence of VGAM184 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM184 RNA, herein designated VGAM RNA, may have a different number of host target binding sites in untranslated regions of a VGAM184 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM184 RNA, herein designated VGAM RNA, to host target binding sites on VGAM184 host target RNA, herein designated VGAM HOST TARGET RNA, such as BINDING SITE I, BINDING SITE II and BINDING SITE III, inhibits translation of VGAM184 host target RNA into VGAM184 host target protein, herein designated VGAM HOST TARGET PROTEIN. VGAM host target protein is therefore outlined by a broken line.

It is appreciated that VGAM184 host target gene, herein designated VGAM HOST TARGET GENE, in fact represents a plurality of VGAM184 host target genes. The mRNA of each one of this plurality of VGAM184 host target genes comprises one or more host target binding sites, each having a nucleotide sequence which is at least partly complementary to VGAM184 RNA, herein designated VGAM RNA, and which when bound by VGAM184 RNA causes inhibition of translation of respective one or more VGAM184 host target proteins.

It is further appreciated by one skilled in the art that the mode of translational inhibition illustrated by FIG. 1 with specific reference to translational inhibition exerted by VGAM184 gene, herein designated VGAM GENE, on one or more VGAM184 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM184 is inhibition of expression of host target genes, as part of a novel viral mechanism of attacking a host. Accordingly, utilities of VGAM184 include diagnosis, prevention and treatment of viral infection by Shrimp White Spot Syndrome Virus (white spot baciliform virus). Specific functions, and accordingly utilities, of VGAM184 correlate with, and may be deduced from, the identity of the host target genes which VGAM184 binds and inhibits, and the function of these host target genes, as elaborated hereinbelow.

Nucleotide sequences of the VGAM184 precursor RNA, herein designated VGAM PRECURSOR RNA, and of the 'diced' VGAM184 RNA, herein designated VGAM RNA, and a schematic representation of the secondary folding of VGAM184 folded precursor RNA, herein designated VGAM FOLDED PRECURSOR RNA, of VGAM184 are further described hereinbelow with reference to Table 1.

Nucleotide sequences of host target binding sites, such as BINDING SITE-I, BINDING SITE-II and BINDING SITE-III of FIG. 1, found on VGAM184 host target RNA, and schematic representation of the complementarity of each of these host target binding sites to VGAM184 RNA, herein designated VGAM RNA, are described hereinbelow with reference to Table 2.

As mentioned hereinabove with reference to FIG. 1, a function of VGAM184 gene, herein designated VGAM is inhibition of expression of VGAM184 target genes. It is appreciated that specific functions, and accordingly utilities, of VGAM184 correlate with, and may be deduced from, the identity of the target genes which VGAM184 binds and inhibits, and the function of these target genes, as elaborated hereinbelow.

D10S170 (Accession NM_005436) is a VGAM184 host target gene. D10S170 BINDING SITE is HOST TARGET binding site found in the 3' untranslated region of mRNA encoded by D10S170, corresponding to a HOST TARGET binding site such as BINDING SITE I, BINDING SITE II or BINDING SITE III. Table 2 illustrates the complementarity of the nucleotide sequences of D10S170 BINDING SITE, designated SEQ ID:11917, to the nucleotide sequence of VGAM184 RNA, herein designated VGAM RNA, also designated SEQ ID:2895.

A function of VGAM184 is therefore inhibition of D10S170 (Accession NM_005436), a gene which may provide a structural basis for generation of RET/PTC1 rearrangement. Accordingly, utilities of VGAM184 include diagnosis, prevention and treatment of diseases and clinical conditions associated with D10S170. The function of D10S170 and its association with various diseases and clinical conditions, has been established by previous studies, as described hereinabove with reference to VGAM142. Dihydropyrimidine Dehydrogenase (DPYD, Accession XM_017469) is another VGAM184 host target gene. DPYD BINDING SITE is HOST TARGET binding site found in the 3' untranslated region of mRNA encoded by DPYD, corresponding to a HOST TARGET binding site such as BINDING SITE I, BINDING SITE II or BINDING SITE III. Table 2 illustrates the complementarity of the nucleotide sequences of DPYD BINDING SITE, designated SEQ ID:30315, to the nucleotide sequence of VGAM184 RNA, herein designated VGAM RNA, also designated SEQ ID:2895.

Another function of VGAM184 is therefore inhibition of Dihydropyrimidine Dehydrogenase (DPYD, Accession XM_017469). Accordingly, utilities of VGAM184 include diagnosis, prevention and treatment of diseases and clinical conditions associated with DPYD. V-myb Myeloblastosis Viral Oncogene Homolog (avian)-like 1 (MYBL1, Accession XM_034274) is another VGAM184 host target gene. MYBL1 BINDING SITE is HOST TARGET binding site found in the 3' untranslated region of mRNA encoded by MYBL1, corresponding to a HOST TARGET binding site such as BINDING SITE I, BINDING SITE II or BINDING SITE III. Table 2 illustrates the complementarity of the nucleotide sequences of MYBL1 BINDING SITE, designated SEQ ID:32040, to the nucleotide sequence of VGAM184 RNA, herein designated VGAM RNA, also designated SEQ ID:2895.

Another function of VGAM184 is therefore inhibition of V-myb Myeloblastosis Viral Oncogene Homolog (avian)-like 1 (MYBL1, Accession XM_034274), a gene which could have a role in the proliferation and/or differentiation of neurogenic, spermatogenic and b-lymphoid cells. Accordingly, utilities of VGAM184 include diagnosis, prevention and treatment of diseases and clinical conditions associated with MYBL1. The function of MYBL1 has been established by previous studies. Nomura et al. (1988) isolated and characterized cDNA clones for 2 human MYB-related genes, AMYB and BMYB (OMIM Ref. No. 601415). Using probes in Southern blot analysis of rodent-human hybrid DNAs, Barletta et al. (1991) localized the MYBL1 locus to 8cen-q22 and refined the localization to 8q22-q23 by in situ hybridization. Takahashi et al. (1995) found that MYBL1 mRNA is expressed mainly in testis and peripheral blood leukocytes. AMYB could activate transcription from the promoter-containing MYB-binding sites in all cells examined. In addition to the 2 domains (a DNA-binding domain and a transcriptional activation domain), 2 negative regulatory domains were identified in the MYBL1 gene. These results indicated that the gene functions as a transcriptional activator and that the regulatory mechanism of gene activity is similar to that of the MYB (OMIM Ref. No. 189990) gene.

Full details of the abovementioned studies are described in the following publications, the disclosure of which are hereby incorporated by reference:

Nomura, N.; Takahashi, M.; Matsui, M.; Ishii, S.; Date, T.; Sasamoto, S.; Ishizaki, R.: Isolation of human cDNA clones of MYB-related genes, A-MYB and B-MYB. Nucleic Acids Res. 16:11075-11089, 1988; and Takahashi, T.; Nakagoshi, H.; Sarai, A.; Nomura, N.; Yamamoto, T.; Ishii, S.: Human A-myb gene encodes a transcriptional activator containing the negative regulatory domains. FEBS Lett.

Further studies establishing the function and utilities of MYBL1 are found in John Hopkins OMIM database record ID 159405, and in sited publications numbered 11008-11010 listed in the bibliography section hereinbelow, which are also hereby incorporated by reference. Ornithine Carbamoyltransferase (OTC, Accession NM_000531) is another VGAM184 host target gene. OTC BINDING SITE is HOST TARGET binding site found in the 5' untranslated region of mRNA encoded by OTC, corresponding to a HOST TARGET binding site such as BINDING SITE I, BINDING SITE II or BINDING SITE III. Table 2 illustrates the complementarity of the nucleotide sequences of OTC BINDING SITE, designated SEQ ID:6132, to the nucleotide sequence of VGAM184 RNA, herein designated VGAM RNA, also designated SEQ ID:2895.

Another function of VGAM184 is therefore inhibition of Ornithine Carbamoyltransferase (OTC, Accession NM_000531). Accordingly, utilities of VGAM184 include diagnosis, prevention and treatment of diseases and clinical conditions associated with OTC. CASPR3 (Accession NM_033655) is another VGAM184 host target gene. CASPR3 BINDING SITE is HOST TARGET binding site found in the 3' untranslated region of mRNA encoded by CASPR3, corresponding to a HOST TARGET binding site such as BINDING SITE I, BINDING SITE II or BINDING SITE III. Table 2 illustrates the complementarity of the nucleotide sequences of CASPR3 BINDING SITE, designated SEQ ID:27387, to the nucleotide sequence of VGAM184 RNA, herein designated VGAM RNA, also designated SEQ ID:2895.

Another function of VGAM184 is therefore inhibition of CASPR3 (Accession NM_033655). Accordingly, utilities of VGAM184 include diagnosis, prevention and treatment of diseases and clinical conditions associated with CASPR3. KIAA1046 (Accession NM_014928) is another VGAM184 host target gene. KIAA1046 BINDING SITE is HOST TARGET binding site found in the 3' untranslated region of mRNA encoded by KIAA1046, corresponding to a HOST TARGET binding site such as BINDING SITE I, BINDING SITE II or BINDING SITE III. Table 2 illustrates the complementarity of the nucleotide sequences of KIAA1046 BINDING SITE, designated SEQ ID:17218, to the nucleotide sequence of VGAM184 RNA, herein designated VGAM RNA, also designated SEQ ID:2895.

Another function of VGAM184 is therefore inhibition of KIAA1046 (Accession NM_014928). Accordingly, utilities of VGAM184 include diagnosis, prevention and treatment of diseases and clinical conditions associated with KIAA1046. Voltage-dependent Anion Channel 3 (VDAC3, Accession NM_005662) is another VGAM184 host target gene. VDAC3 BINDING SITE is HOST TARGET binding site found in the 3' untranslated region of mRNA encoded by VDAC3, corresponding to a HOST TARGET binding site such as BINDING SITE I, BINDING SITE II or BINDING SITE III. Table 2 illustrates the complementarity of the nucleotide sequences of VDAC3 BINDING SITE, designated SEQ ID:12201, to the nucleotide sequence of VGAM184 RNA, herein designated VGAM RNA, also designated SEQ ID:2895.

Another function of VGAM184 is therefore inhibition of Voltage-dependent Anion Channel 3 (VDAC3, Accession NM_005662). Accordingly, utilities of VGAM184 include diagnosis, prevention and treatment of diseases and clinical conditions associated with VDAC3. LOC143888 (Accession XM_084669) is another VGAM184 host target gene. LOC143888 BINDING SITE is HOST TARGET binding site found in the 3' untranslated region of mRNA encoded by LOC143888, corresponding to a HOST TARGET binding site such as BINDING SITE I, BINDING SITE II or BINDING SITE III. Table 2 illustrates the complementarity of the nucleotide sequences of LOC143888 BINDING SITE, designated SEQ ID:37664, to the nucleotide sequence of VGAM184 RNA, herein designated VGAM RNA, also designated SEQ ID:2895.

Another function of VGAM184 is therefore inhibition of LOC143888 (Accession XM_084669). Accordingly, utilities of VGAM184 include diagnosis, prevention and treatment of diseases and clinical conditions associated with LOC143888. LOC149271 (Accession XM_086475) is another VGAM184 host target gene. LOC149271 BINDING SITE is HOST TARGET binding site found in the 5' untranslated region of mRNA encoded by LOC149271, corresponding to a HOST TARGET binding site such as BINDING SITE I, BINDING SITE II or BINDING SITE III. Table 2 illustrates the complementarity of the nucleotide sequences of LOC149271 BINDING SITE, designated SEQ ID:38672, to the nucleotide sequence of VGAM184 RNA, herein designated VGAM RNA, also designated SEQ ID:2895.

Another function of VGAM184 is therefore inhibition of LOC149271 (Accession XM_086475). Accordingly, utilities of VGAM184 include diagnosis, prevention and treatment of diseases and clinical conditions associated with LOC149271. LOC149910 (Accession XM_086699) is another VGAM184 host target gene. LOC149910 BINDING SITE is HOST TARGET binding site found in the 3' untranslated region of mRNA encoded by LOC149910, corresponding to a HOST TARGET binding site such as BINDING SITE I, BINDING SITE II or BINDING SITE III. Table 2 illustrates the complementarity of the nucleotide sequences of LOC149910 BINDING SITE, designated SEQ ID:38825, to the nucleotide sequence of VGAM184 RNA, herein designated VGAM RNA, also designated SEQ ID:2895.

Another function of VGAM184 is therefore inhibition of LOC149910 (Accession XM_086699). Accordingly, utilities of VGAM184 include diagnosis, prevention and treatment of diseases and clinical conditions associated with LOC149910. FIG. 1 further provides a conceptual description of a novel bioinformatically detected viral gene of the present invention, referred to here as Viral Genomic Address Messenger 185 (VGAM185) viral gene, which modulates expression of respective host target genes thereof, the function and utility of which host target genes is known in the art.

VGAM185 is a novel bioinformatically detected regulatory, non protein coding, viral micro RNA (miRNA) gene. The method by which VGAM185 was detected is described hereinabove with reference to FIGS. 1-8.

VGAM185 gene, herein designated VGAM GENE, is a viral gene contained in the genome of Shrimp White Spot Syndrome Virus (white spot bacilliform virus). VGAM185 host target gene, herein designated VGAM HOST TARGET GENE, is a human gene contained in the human genome.

VGAM185 gene encodes a VGAM185 precursor RNA, herein designated VGAM PRECURSOR RNA. Similar to other miRNA genes, and unlike most ordinary genes, VGAM185 precursor RNA does not encode a protein. A nucleotide sequence identical or highly similar to the nucleotide sequence of VGAM185 precursor RNA is designated SEQ ID:171, and is provided hereinbelow with reference to the sequence listing part. Nucleotide sequence SEQ ID:171 is located at position 283443 relative to the genome of Shrimp White Spot Syndrome Virus (white spot bacilliform virus).

VGAM185 precursor RNA folds onto itself, forming VGAM185 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM185 folded precursor RNA into VGAM185 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM185 RNA is designated SEQ ID:2896, and is provided hereinbelow with reference to the sequence listing part.

VGAM185 host target gene, herein designated VGAM HOST TARGET GENE, encodes a corresponding messenger RNA, VGAM185 host target RNA, herein designated VGAM HOST TARGET RNA. VGAM185 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM185 RNA, herein designated VGAM RNA, binds complementarily to one or more host target binding sites located in untranslated regions of VGAM185 host target RNA, herein designated VGAM HOST TARGET RNA. This complementary binding is due to the fact that the nucleotide sequence of VGAM185 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM185 RNA, herein designated VGAM RNA, may have a different number of host target binding sites in untranslated regions of a VGAM185 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM185 RNA, herein designated VGAM RNA, to host target binding sites on VGAM185 host target RNA, herein designated VGAM HOST TARGET RNA, such as BINDING SITE I, BINDING SITE II and BINDING SITE III, inhibits translation of VGAM185 host target RNA into VGAM185 host target protein, herein designated VGAM HOST TARGET PROTEIN. VGAM host target protein is therefore outlined by a broken line.

It is appreciated that VGAM185 host target gene, herein designated VGAM HOST TARGET GENE, in fact represents a plurality of VGAM185 host target genes. The mRNA of each one of this plurality of VGAM185 host target genes comprises one or more host target binding sites, each having a nucleotide sequence which is at least partly complementary to VGAM185 RNA, herein designated VGAM RNA, and which when bound by VGAM185 RNA causes inhibition of translation of respective one or more VGAM185 host target proteins.

It is further appreciated by one skilled in the art that the mode of translational inhibition illustrated by FIG. 1 with specific reference to translational inhibition exerted by VGAM185 gene, herein designated VGAM GENE, on one or more VGAM185 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM185 is inhibition of expression of host target genes, as part of a novel viral mechanism of attacking a host. Accordingly, utilities of VGAM185 include diagnosis, prevention and treatment of viral infection by Shrimp White Spot Syndrome Virus (white spot bacilliform virus). Specific functions, and accordingly utilities, of VGAM185 correlate with, and may be deduced from, the identity of the host target genes which VGAM185 binds and inhibits, and the function of these host target genes, as elaborated hereinbelow.

Nucleotide sequences of the VGAM185 precursor RNA, herein designated VGAM PRECURSOR RNA, and of the 'diced' VGAM185 RNA, herein designated VGAM RNA, and a schematic representation of the secondary folding of VGAM185 folded precursor RNA, herein designated VGAM FOLDED PRECURSOR RNA, of VGAM185 are further described hereinbelow with reference to Table 1.

Nucleotide sequences of host target binding sites, such as BINDING SITE-I, BINDING SITE-II and BINDING SITE-III of FIG. 1, found on VGAM185 host target RNA, and schematic representation of the complementarity of each of these host target binding sites to VGAM185 RNA, herein designated VGAM RNA, are described hereinbelow with reference to Table 2.

As mentioned hereinabove with reference to FIG. 1, a function of VGAM185 gene, herein designated VGAM is inhibition of expression of VGAM185 target genes. It is appreciated that specific functions, and accordingly utilities, of VGAM185 correlate with, and may be deduced from, the identity of the target genes which VGAM185 binds and inhibits, and the function of these target genes, as elaborated hereinbelow.

Phospholipase A2, Group IID (PLA2G2D, Accession NM_012400) is a VGAM185 host target gene. PLA2G2D BINDING SITE is HOST TARGET binding site found in the 3' untranslated region of mRNA encoded by PLA2G2D, corresponding to a HOST TARGET binding site such as BINDING SITE I, BINDING SITE II or BINDING SITE III. Table 2 illustrates the complementarity of the nucleotide sequences of PLA2G2D BINDING SITE, designated SEQ ID:14770, to the nucleotide sequence of VGAM185 RNA, herein designated VGAM RNA, also designated SEQ ID:2896.

A function of VGAM185 is therefore inhibition of Phospholipase A2, Group IID (PLA2G2D, Accession NM_012400), a gene which is involved in phospholipid digestion, remodeling of cell membranes, and host defense, as well as pathophysiologic processes. Accordingly, utilities of VGAM185 include diagnosis, prevention and treatment of diseases and clinical conditions associated with PLA2G2D.

The function of PLA2G2D and its association with various diseases and clinical conditions, has been established by previous studies, as described hereinabove with reference to VGAM74. DKFZp761D221 (Accession NM_032291) is another VGAM185 host target gene. DKFZp761D221 BINDING SITE is HOST TARGET binding site found in the 3' untranslated region of mRNA encoded by DKFZp761D221, corresponding to a HOST TARGET binding site such as BINDING SITE I, BINDING SITE II or BINDING SITE III. Table 2 illustrates the complementarity of the nucleotide sequences of DKFZp761D221 BINDING SITE, designated SEQ ID:26059, to the nucleotide sequence of VGAM185 RNA, herein designated VGAM RNA, also designated SEQ ID:2896.

Another function of VGAM185 is therefore inhibition of DKFZp761D221 (Accession NM_032291). Accordingly, utilities of VGAM185 include diagnosis, prevention and treatment of diseases and clinical conditions associated with DKFZp761D221. KIAA0632 (Accession NM_015545) is another VGAM185 host target gene. KIAA0632 BINDING SITE is HOST TARGET binding site found in the 3' untranslated region of mRNA encoded by KIAA0632, corresponding to a HOST TARGET binding site such as BINDING SITE I, BINDING SITE II or BINDING SITE III. Table 2 illustrates the complementarity of the nucleotide sequences of KIAA0632 BINDING SITE, designated SEQ ID:17807, to the nucleotide sequence of VGAM185 RNA, herein designated VGAM RNA, also designated SEQ ID:2896.

Another function of VGAM185 is therefore inhibition of KIAA0632 (Accession NM_015545). Accordingly, utilities of VGAM185 include diagnosis, prevention and treatment of diseases and clinical conditions associated with KIAA0632. NDRG Family Member 4 (NDRG4, Accession NM_020465) is another VGAM185 host target gene. NDRG4 BINDING SITE1 and NDRG4 BINDING SITE2 are HOST TARGET binding sites found in untranslated regions of mRNA encoded by NDRG4, corresponding to HOST TARGET binding sites such as BINDING SITE I, BINDING SITE II or BINDING SITE III. Table 2 illustrates the complementarity of the nucleotide sequences of NDRG4 BINDING SITE1 and NDRG4 BINDING SITE2, designated SEQ ID:21700 and SEQ ID:23215 respectively, to the nucleotide sequence of VGAM185 RNA, herein designated VGAM RNA, also designated SEQ ID:2896.

Another function of VGAM185 is therefore inhibition of NDRG Family Member 4 (NDRG4, Accession NM_020465). Accordingly, utilities of VGAM185 include diagnosis, prevention and treatment of diseases and clinical conditions associated with NDRG4. Carbohydrate (N-acetylglucosamine 6-O) Sulfotransferase 5 (CHST5, Accession NM_012126) is another VGAM186 host target gene. CHST5 BINDING SITE is HOST TARGET binding site found in the 3' untranslated region of mRNA encoded by CHST5, corresponding to a HOST TARGET binding site such as BINDING SITE I, BINDING SITE II or BINDING SITE III. Table 2 illustrates the complementarity of the nucleotide sequences of CHST5 BINDING SITE, designated SEQ ID:14441, to the nucleotide sequence of VGAM186 RNA, herein designated VGAM RNA, also designated SEQ ID:2897.

Another function of VGAM186 is therefore inhibition of Carbohydrate (N-acetylglucosamine 6-O) Sulfotransferase 5 (CHST5, Accession NM_012126), a gene which may be involved in sulfation of glycoproteins and proteoglycans. Accordingly, utilities of VGAM186 include diagnosis, prevention and treatment of diseases and clinical conditions associated with CHST5. The function of CHST5 has been established by previous studies. The carbohydrates of glycoconjugates are highly diverse structures with variation in monosaccharide composition, glycosidic linkage positions, and branching of chains. Further diversity is added by the covalent addition of sulfate moieties to particular hydroxyl groups and amino groups of saccharides. The sulfate modifications of glycoproteins can be extensive in amount and frequently occur at high density. They can have a profound effect on the physiochemical properties of the glycoconjugates, at least in part through the addition of negative charge. Carbohydrate sulfation plays a critical role in many biologic processes. The GST family of sulfotransferases includes CHST1 (OMIM Ref. No. 603797), CHST2 (OMIM Ref. No. 603798), CHST3 (OMIM Ref. No. 603799), and LSST. These enzymes are 6-O-sulfotransferases, which add sulfate to C6 of galactose (Gal), N-acetylgalactosamine (OMIM Ref. No. GalNAc), or N-acetylglucosamine (OMIM Ref. No. GlcNAc). By searching an EST database with the sequences of CHST1 and LSST, Lee et al. (1999) identified nonoverlapping ESTs encoding CHST5, which they called IGlcNAc6ST. They isolated additional CHST5 ESTs and assembled a complete CHST5 coding sequence. The deduced 390-amino acid CHST5 protein is predicted to be a type II transmembrane protein, with an N-terminal cytoplasmic tail of 9 residues and a single transmembrane domain. The extracellular domain contains 3 potential N-glycosylation sites. CHST5 shares 55% amino acid sequence identity with LSST, 35.8% identity with CHST1, and 76% identity with mouse Chst5, whose cDNA Lee et al. (1999) also cloned. Recombinant CHST5 expressed in mammalian cells catalyzed the addition of sulfate to C6 of GlcNAc. Lee et al. (1999) isolated the CHST5 genomic sequence. The CHST5 gene is intronless. Northern blot analysis of a variety of normal human tissues showed a major 2.8-kb CHST5 transcript at relatively high levels in colon and small intestine and at lower levels in fetal liver. Minor transcripts of 3.5, 4, 5, and 8 kb were also found in colon and small intestine. CHST5 expression was not detected in any of the other tissues tested. CHST5, encoding an intestinal sulfotransferase, is situated close to CHST6 (OMIM Ref. No. 605294), which encodes a corneal sulfotransferase and is mutant in cases of macular corneal dystrophy (OMIM Ref. No. 217800). By radiation hybrid analysis, Akama et al. (2000) mapped the CHST5 and CHST6 genes to 16q22, between markers D16S3326 and D16S3016

Full details of the abovementioned studies are described in the following publications, the disclosure of which are hereby incorporated by reference:

Akama, T. O.; Nishida, K.; Nakayama, J.; Watanabe, H.; Ozaki, K.; Nakamura, T.; Dota, A.; Kawasaki, S.; Inoue, Y.; Maeda, N.; Yamamoto, S.; Fujiwara, T.; Thonar, E. J.-M. A.; Shimomura, Y.; Kinoshita, S.; Tanigami, A.; Fukuda, M. N.: Macular corneal dystrophy type I and type II are caused by distinct mutations in a new sulphotransferase gene. Nature Genet. 26:237-241, 2000; and Lee, J. K.; Bhakta, S.; Rosen, S. D.; Hemmerich, S.: Cloning and characterization of a mammalian N-acetylglucosamine-6-sulfotransferase that is highly restricted to intestinal tissue.

Further studies establishing the function and utilities of CHST5 are found in John Hopkins OMIM database record ID 604817, and in sited publications numbered 10107 listed in the bibliography section hereinbelow, which are also hereby incorporated by reference. Cytochrome P450, Subfamily IVF, Polypeptide 3 (leukotriene B4 omega hydroxylase) (CYP4F3, Accession NM_000896) is another VGAM186 host target gene. CYP4F3 BINDING SITE is HOST TARGET binding site found in the 3' untranslated region of mRNA encoded by CYP4F3, corresponding to a HOST TARGET binding site such as BINDING SITE I, BINDING SITE II or BINDING SITE III. Table 2 illustrates the complementarity of the nucleotide sequences of CYP4F3 BINDING SITE, designated SEQ ID:6593, to the nucleotide sequence of VGAM186 RNA, herein designated VGAM RNA, also designated SEQ ID:2897.

Another function of VGAM186 is therefore inhibition of Cytochrome P450, Subfamily IVF, Polypeptide 3 (leukotriene B4 omega hydroxylase) (CYP4F3, Accession NM_000896), a gene which converts leukotriene B4 into the less active 20-hydroxy-leukotriene B4. Accordingly, utilities of VGAM186 include diagnosis, prevention and treatment of diseases and clinical conditions associated with CYP4F3. The function of CYP4F3 has been established by previous studies. Leukotrienes are a group of bioactive compounds that play important roles in such processes as inflammation. Kikuta et al. (1993) isolated a cDNA for the human leukotriene B4 omega-hydroxylase (LTB4H), an enzyme which catalyzes the omega-hydroxylation of leukotriene B4. Their cDNA encoded a 520-amino acid protein with a predicted molecular weight of 59,805 Da. The deduced amino acid sequence contains a cysteine in the conserved heme-binding domain near the C-terminus, which is a characteristic feature of the cytochrome P450 superfamily; the protein shares 31 to 44% similarity with CYP4A, CYP4B (OMIM Ref. No. 124075), and CYP4C. Kikuta et al. (1993) detected transcript from the LTB4H gene in polymorphonuclear leukocytes and leukocytes.

Full details of the abovementioned studies are described in the following publications, the disclosure of which are hereby incorporated by reference:

Kikuta, Y.; Kato, M.; Yamashita, Y.; Miyauchi, Y.; Tanaka, K.; Kamada, N.; Kusunose, M.: Human leukotriene B4 omega-hydroxylase (CYP4F3) gene: molecular cloning and chromosomal localization. DNA Cell Biol. 17:221-230, 1998; and Kikuta, Y.; Kusunose, E.; Endo, K.; Yamamoto, S.; Sogawa, K.; Fujii-Kuriyama, Y.; Kusunose, M.: A novel form of cytochrome P-450 family 4 in human polymorphonuclear leukocytes: cDNA cl.

Further studies establishing the function and utilities of CYP4F3 are found in John Hopkins OMIM database record ID 601270, and in sited publications numbered 9856-9857 listed in the bibliography section hereinbelow, which are also hereby incorporated by reference. Gamma-glutamyl Carboxylase (GGCX, Accession NM_000821) is another VGAM186 host target gene. GGCX BINDING SITE is HOST TARGET binding site found in the 3' untranslated region of mRNA encoded by GGCX, corresponding to a HOST TARGET binding site such as BINDING SITE I, BINDING SITE II or BINDING SITE III. Table 2 illustrates the complementarity of the nucleotide sequences of GGCX BINDING SITE, designated SEQ ID:6483, to the nucleotide sequence of VGAM186 RNA, herein designated VGAM RNA, also designated SEQ ID:2897.

Another function of VGAM186 is therefore inhibition of Gamma-glutamyl Carboxylase (GGCX, Accession NM_000821). Accordingly, utilities of VGAM186 include diagnosis, prevention and treatment of diseases and clinical conditions associated with GGCX. Nuclear Receptor Subfamily 3, Group C, Member 2 (NR3C2, Accession NM_000901) is another VGAM186 host target gene. NR3C2 BINDING SITE is HOST TARGET binding site found in the 3' untranslated region of mRNA encoded by NR3C2, corresponding to a HOST TARGET binding site such as BINDING SITE I, BINDING SITE II or BINDING SITE III. Table 2 illustrates the complementarity of the nucleotide sequences of NR3C2 BINDING SITE, designated SEQ ID:6596, to the nucleotide sequence of VGAM186 RNA, herein designated VGAM RNA, also designated SEQ ID:2897.

Another function of VGAM186 is therefore inhibition of Nuclear Receptor Subfamily 3, Group C, Member 2 (NR3C2, Accession NM_000901), a gene which is to increase ion and water transport and thus raise extracellular fluid volume and blood pressure and lower potassium levels. Accordingly, utilities of VGAM186 include diagnosis, prevention and treatment of diseases and clinical conditions associated with NR3C2. The function of NR3C2 has been established by previous studies. Arriza et al. (1987) used low-stringency hybridization with human glucocorticoid receptor cDNA to isolate a new gene encoding a predicted 107-kD polypeptide. Expression studies demonstrated its ability to bind aldosterone with high affinity and to activate gene transcription in response to aldosterone, thus establishing its identity as the human mineralocorticoid receptor. This molecule also showed high affinity for glucocorticoids. They speculated that, since the circulating level of glucocorticoids is several times higher than those of aldosterone, the primary mineralocorticoid, glucocorticoid activation of the mineralocorticoid receptor may be functionally significant. The gene for the estrogen receptor (OMIM Ref. No. 133430) and that for the progesterone receptor (OMIM Ref. No. 607311) have also been cloned. Animal model experiments lend further support to the function of NR3C2. Berger et al. (1998) generated MLR-deficient mice by gene targeting. These mice had a normal prenatal development. During the first week of life, the MLR-deficient mice developed symptoms of pseudohypoaldosteronism. They lost weight and eventually died at approximately 10 days after birth from dehydration by renal sodium and water loss. At day 8, MLR -/- mice showed hyperkalemia, hyponatremia, and a strong increase in renin, angiotensin II, and aldosterone plasma concentrations. The fractional renal Na+ excretion was elevated more than 8-fold. The glomerular filtration rate in MLR -/- mice was not different from that in controls. The effect of amiloride on renal Na+ excretion in colonic transepithelial voltage reflected the function of amiloride-sensitive epithelial Na+ channels.

It is appreciated that the abovementioned animal model for NR3C2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Arriza, J. L.; Weinberger, C.; Cerelli, G.; Glaser, T. M.; Handelin, B. L.; Housman, D. E.; Evans, R. M.: Cloning of human mineralocorticoid receptor complementary DNA: structural and functional kinship with the glucocorticoid receptor. Science 237:268-275, 1987; and Berger, S.; Bleich, M.; Schmid, W.; Cole, T. J.; Peters, J.; Watanabe, H.; Kriz, W.; Warth, R.; Greger, R.; Schutz, G.: Mineralocorticoid receptor knockout mice: pathophysiology of Na+.

Further studies establishing the function and utilities of NR3C2 are found in John Hopkins OMIM database record ID 600983, and in sited publications numbered 7886-7887, 8592-789 and 5457-5458 listed in the bibliography section hereinbelow, which are also hereby incorporated by reference. Chemokine (C-C motif) Receptor 6 (CCR6, Accession NM_004367) is another VGAM186 host target gene. CCR6 BINDING SITE1 and CCR6 BINDING SITE2 are HOST TARGET binding sites found in untranslated regions of mRNA encoded by CCR6, corresponding to HOST TARGET binding sites such as BINDING SITE I, BINDING SITE II or BINDING SITE III. Table 2 illustrates the complementarity of the nucleotide sequences of CCR6 BINDING SITE1 and CCR6 BINDING SITE2, designated SEQ ID:10578 and SEQ ID:25372 respectively, to the nucleotide sequence of VGAM186 RNA, herein designated VGAM RNA, also designated SEQ ID:2897.

Another function of VGAM186 is therefore inhibition of Chemokine (C-C motif) Receptor 6 (CCR6, Accession NM_004367). Accordingly, utilities of VGAM186 include diagnosis, prevention and treatment of diseases and clinical conditions associated with CCR6. FLJ10656 (Accession NM_018170) is another VGAM186 host target gene. FLJ10656 BINDING SITE is HOST TARGET binding site found in the 3' untranslated region of mRNA encoded by FLJ10656, corresponding to a HOST TARGET binding site such as BINDING SITE I, BINDING SITE II or BINDING SITE III. Table 2 illustrates the complementarity of the nucleotide sequences of FLJ10656 BINDING SITE, designated SEQ ID:19989, to the nucleotide sequence of VGAM186 RNA, herein designated VGAM RNA, also designated SEQ ID:2897.

Another function of VGAM186 is therefore inhibition of FLJ10656 (Accession NM_018170). Accordingly, utilities of VGAM186 include diagnosis, prevention and treatment of diseases and clinical conditions associated with FLJ10656. FLJ10751 (Accession NM_018205) is another VGAM186 host target gene. FLJ10751 BINDING SITE1 and FLJ10751 BINDING SITE2 are HOST TARGET binding sites found in untranslated regions of mRNA encoded by FLJ10751, corresponding to HOST TARGET binding sites such as BINDING SITE I, BINDING SITE II or BINDING SITE III. Table 2 illustrates the complementarity of the nucleotide sequences of FLJ10751 BINDING SITE1 and FLJ10751 BINDING SITE2, designated SEQ ID:20097 and SEQ ID:20196 respectively, to the nucleotide sequence of VGAM186 RNA, herein designated VGAM RNA, also designated SEQ ID:2897.

Another function of VGAM186 is therefore inhibition of FLJ10751 (Accession NM_018205). Accordingly, utilities of VGAM186 include diagnosis, prevention and treatment of diseases and clinical conditions associated with FLJ10751. FLJ12363 (Accession NM_032167) is another VGAM186 host target gene. FLJ12363 BINDING SITE is HOST TARGET binding site found in the 3' untranslated region of mRNA encoded by FLJ12363, corresponding to a HOST TARGET binding site such as BINDING SITE I, BINDING SITE II or BINDING SITE III. Table 2 illustrates the complementarity of the nucleotide sequences of FLJ12363 BINDING SITE, designated SEQ ID:25871, to the nucleotide sequence of VGAM186 RNA, herein designated VGAM RNA, also designated SEQ ID:2897.

Another function of VGAM186 is therefore inhibition of FLJ12363 (Accession NM_032167). Accordingly, utilities of VGAM186 include diagnosis, prevention and treatment of diseases and clinical conditions associated with FLJ12363. FLJ22054 (Accession XM_170478) is another VGAM186 host target gene. FLJ22054 BINDING SITE is HOST TARGET binding site found in the 3' untranslated region of mRNA encoded by FLJ22054, corresponding to a HOST TARGET binding site such as BINDING SITE I, BINDING SITE II or BINDING SITE III. Table 2 illustrates the complementarity of the nucleotide sequences of FLJ22054 BINDING SITE, designated SEQ ID:45319, to the nucleotide sequence of VGAM186 RNA, herein designated VGAM RNA, also designated SEQ ID:2897.

Another function of VGAM186 is therefore inhibition of FLJ22054 (Accession XM_170478). Accordingly, utilities of VGAM186 include diagnosis, prevention and treatment of diseases and clinical conditions associated with FLJ22054. FLJ22167 (Accession NM_024533) is another VGAM186 host target gene. FLJ22167 BINDING SITE is HOST TARGET binding site found in the 3' untranslated region of mRNA encoded by FLJ22167, corresponding to a HOST TARGET binding site such as BINDING SITE I, BINDING SITE II or BINDING SITE III. Table 2 illustrates the complementarity of the nucleotide sequences of FLJ22167 BINDING SITE, designated SEQ ID:23743, to the nucleotide sequence of VGAM186 RNA, herein designated VGAM RNA, also designated SEQ ID:2897.

Another function of VGAM186 is therefore inhibition of FLJ22167 (Accession NM_024533). Accordingly, utilities of VGAM186 include diagnosis, prevention and treatment of diseases and clinical conditions associated with FLJ22167. FLJ31455 (Accession NM_144964) is another VGAM186 host target gene. FLJ31455 BINDING SITE is HOST TARGET binding site found in the 3' untranslated region of mRNA encoded by FLJ31455, corresponding to a HOST TARGET binding site such as BINDING SITE I, BINDING SITE II or BINDING SITE III. Table 2 illustrates the complementarity of the nucleotide sequences of FLJ31455 BINDING SITE, designated SEQ ID:29580, to the nucleotide sequence of VGAM186 RNA, herein designated VGAM RNA, also designated SEQ ID:2897.

Another function of VGAM186 is therefore inhibition of FLJ31455 (Accession NM_144964). Accordingly, utilities of VGAM186 include diagnosis, prevention and treatment of diseases and clinical conditions associated with FLJ31455. HSA249128 (Accession NM_017583) is another VGAM186 host target gene. HSA249128 BINDING SITE is HOST TARGET binding site found in the 3' untranslated region of mRNA encoded by HSA249128, corresponding to a HOST TARGET binding site such as BINDING SITE I, BINDING SITE II or BINDING SITE III. Table 2 illustrates the complementarity of the nucleotide sequences of HSA249128 BINDING SITE, designated SEQ ID:19026, to the nucleotide sequence of VGAM186 RNA, herein designated VGAM RNA, also designated SEQ ID:2897.

Another function of VGAM186 is therefore inhibition of HSA249128 (Accession NM_017583). Accordingly, utilities of VGAM186 include diagnosis, prevention and treatment of diseases and clinical conditions associated with HSA249128. KIAA0408 (Accession NM_014702) is another VGAM186 host target gene. KIAA0408 BINDING SITE is HOST TARGET binding site found in the 3' untranslated region of mRNA encoded by KIAA0408, corresponding to a HOST TARGET binding site such as BINDING SITE I, BINDING SITE II or BINDING SITE III. Table 2 illustrates the complementarity of the nucleotide sequences of KIAA0408 BINDING SITE, designated SEQ ID:16235, to the nucleotide sequence of VGAM186 RNA, herein designated VGAM RNA, also designated SEQ ID:2897.

Another function of VGAM186 is therefore inhibition of KIAA0408 (Accession NM_014702). Accordingly, utilities of VGAM186 include diagnosis, prevention and treatment of diseases and clinical conditions associated with KIAA0408. KIAA0798 (Accession NM_014650) is another VGAM186 host target gene. KIAA0798 BINDING SITE is HOST TARGET binding site found in the 3' untranslated region of mRNA encoded by KIAA0798, corresponding to a HOST TARGET binding site such as BINDING SITE I, BINDING SITE II or BINDING SITE III. Table 2 illustrates the complementarity of the nucleotide sequences of KIAA0798 BINDING SITE, designated SEQ ID:16071, to the nucleotide sequence of VGAM186 RNA, herein designated VGAM RNA, also designated SEQ ID:2897.

Another function of VGAM186 is therefore inhibition of KIAA0798 (Accession NM_014650). Accordingly, utilities of VGAM186 include diagnosis, prevention and treatment of diseases and clinical conditions associated with KIAA0798. KIAA1950 (Accession XM_166532) is another VGAM186 host target gene. KIAA1950 BINDING SITE is HOST TARGET binding site found in the 3' untranslated region of mRNA encoded by KIAA1950, corresponding to a HOST TARGET binding site such as BINDING SITE I, BINDING SITE II or BINDING SITE III. Table 2 illustrates the complementarity of the nucleotide sequences of KIAA1950 BINDING SITE, designated SEQ ID:44494, to the nucleotide sequence of VGAM186 RNA, herein designated VGAM RNA, also designated SEQ ID:2897.

Another function of VGAM186 is therefore inhibition of KIAA1950 (Accession XM_166532). Accordingly, utilities of VGAM186 include diagnosis, prevention and treatment of diseases and clinical conditions associated with KIAA1950. MGC11352 (Accession XM_035941) is another VGAM186 host target gene. MGC11352 BINDING SITE is HOST TARGET binding site found in the 3' untranslated region of mRNA encoded by MGC11352, corresponding to a HOST TARGET binding site such as BINDING SITE I, BINDING SITE II or BINDING SITE III. Table 2 illustrates the complementarity of the nucleotide sequences of MGC11352 BINDING SITE, designated SEQ ID:32357, to the nucleotide sequence of VGAM186 RNA, herein designated VGAM RNA, also designated SEQ ID:2897.

Another function of VGAM186 is therefore inhibition of MGC11352 (Accession XM_035941). Accordingly, utilities of VGAM186 include diagnosis, prevention and treatment of diseases and clinical conditions associated with MGC11352. MRPL56 (Accession NM_032857) is another VGAM186 host target gene. MRPL56 BINDING SITE is HOST TARGET binding site found in the 3' untranslated region of mRNA encoded by MRPL56, corresponding to a HOST TARGET binding site such as BINDING SITE I, BINDING SITE II or BINDING SITE III. Table 2 illustrates the complementarity of the nucleotide sequences of MRPL56 BINDING SITE, designated SEQ ID:26659, to the nucleotide sequence of VGAM186 RNA, herein designated VGAM RNA, also designated SEQ ID:2897.

Another function of VGAM186 is therefore inhibition of MRPL56 (Accession NM_032857). Accordingly, utilities of VGAM186 include diagnosis, prevention and treatment of diseases and clinical conditions associated with MRPL56. Netrin 4 (NTN4, Accession XM_031896) is another VGAM186 host target gene. NTN4 BINDING SITE is HOST TARGET binding site found in the 3' untranslated region of mRNA encoded by NTN4, corresponding to a HOST TARGET binding site such as BINDING SITE I, BINDING SITE II or BINDING SITE III. Table 2 illustrates the complementarity of the nucleotide sequences of NTN4 BINDING SITE, designated SEQ ID:31516, to the nucleotide sequence of VGAM186 RNA, herein designated VGAM RNA, also designated SEQ ID:2897.

Another function of VGAM186 is therefore inhibition of Netrin 4 (NTN4, Accession XM_031896). Accordingly, utilities of VGAM186 include diagnosis, prevention and treatment of diseases and clinical conditions associated with NTN4. Ring Finger Protein 11 (RNF11, Accession NM_014372) is another VGAM186 host target gene. RNF11 BINDING SITE is HOST TARGET binding site found in the 3' untranslated region of mRNA encoded by RNF11, corresponding to a HOST TARGET binding site such as BINDING SITE I, BINDING SITE II or BINDING SITE III. Table 2 illustrates the complementarity of the nucleotide sequences of RNF11 BINDING SITE, designated SEQ ID:15707, to the nucleotide sequence of VGAM186 RNA, herein designated VGAM RNA, also designated SEQ ID:2897.

Another function of VGAM186 is therefore inhibition of Ring Finger Protein 11 (RNF11, Accession NM_014372). Accordingly, utilities of VGAM186 include diagnosis, prevention and treatment of diseases and clinical conditions associated with RNF11. LOC116071 (Accession NM_138456) is another VGAM186 host target gene. LOC116071 BINDING SITE is HOST TARGET binding site found in the 3' untranslated region of mRNA encoded by LOC116071, corresponding to a HOST TARGET binding site such as BINDING SITE I, BINDING SITE II or BINDING SITE III. Table 2 illustrates the complementarity of the nucleotide sequences of LOC116071 BINDING SITE, designated SEQ ID:28816, to the nucleotide sequence of VGAM186 RNA, herein designated VGAM RNA, also designated SEQ ID:2897.

Another function of VGAM186 is therefore inhibition of LOC116071 (Accession NM_138456). Accordingly, utilities of VGAM186 include diagnosis, prevention and treatment of diseases and clinical conditions associated with LOC116071. LOC159036 (Accession XM_099018) is another VGAM186 host target gene. LOC159036 BINDING SITE is HOST TARGET binding site found in the 3' untranslated region of mRNA encoded by LOC159036, corresponding to a HOST TARGET binding site such as BINDING SITE I, BINDING SITE II or BINDING SITE III. Table 2 illustrates the complementarity of the nucleotide sequences of LOC159036 BINDING SITE, designated SEQ ID:42055, to the nucleotide sequence of VGAM186 RNA, herein designated VGAM RNA, also designated SEQ ID:2897.

Another function of VGAM186 is therefore inhibition of LOC159036 (Accession XM_099018). Accordingly, utilities of VGAM186 include diagnosis, prevention and treatment of diseases and clinical conditions associated with LOC159036. LOC196540 (Accession XM_116933) is another VGAM186 host target gene. LOC196540 BINDING SITE is HOST TARGET binding site found in the 3' untranslated region of mRNA encoded by LOC196540, corresponding to a HOST TARGET binding site such as BINDING SITE I, BINDING SITE II or BINDING SITE III. Table 2 illustrates the complementarity of the nucleotide sequences of LOC196540 BINDING SITE, designated SEQ ID:43152, to the nucleotide sequence of VGAM186 RNA, herein designated VGAM RNA, also designated SEQ ID:2897.

Another function of VGAM186 is therefore inhibition of LOC196540 (Accession XM_116933). Accordingly, utilities of VGAM186 include diagnosis, prevention and treatment of diseases and clinical conditions associated with LOC196540. LOC220662 (Accession XM_165978) is another VGAM186 host target gene. LOC220662 BINDING SITE is HOST TARGET binding site found in the 3' untranslated region of mRNA encoded by LOC220662, corresponding to a HOST TARGET binding site such as BINDING SITE I, BINDING SITE II or BINDING SITE III. Table 2 illustrates the complementarity of the nucleotide sequences of LOC220662 BINDING SITE, designated SEQ ID:43826, to the nucleotide sequence of VGAM186 RNA, herein designated VGAM RNA, also designated SEQ ID:2897.

Another function of VGAM186 is therefore inhibition of LOC220662 (Accession XM_165978). Accordingly, utilities of VGAM186 include diagnosis, prevention and treatment of diseases and clinical conditions associated with LOC220662. LOC221178 (Accession XM_167936) is another VGAM186 host target gene. LOC221178 BINDING SITE is HOST TARGET binding site found in the 3' untranslated region of mRNA encoded by LOC221178, corresponding to a HOST TARGET binding site such as BINDING SITE I, BINDING SITE II or BINDING SITE III. Table 2 illustrates the complementarity of the nucleotide sequences of LOC221178 BINDING SITE, designated SEQ ID:44929, to the nucleotide sequence of VGAM186 RNA, herein designated VGAM RNA, also designated SEQ ID:2897.

Another function of VGAM186 is therefore inhibition of LOC221178 (Accession XM_167936). Accordingly, utilities of VGAM186 include diagnosis, prevention and treatment of diseases and clinical conditions associated with LOC221178. LOC221490 (Accession XM_168084) is another VGAM186 host target gene. LOC221490 BINDING SITE is HOST TARGET binding site found in the 5' untranslated region of mRNA encoded by LOC221490, corresponding to a HOST TARGET binding site such as BINDING SITE I, BINDING SITE II or BINDING SITE III. Table 2 illustrates the complementarity of the nucleotide sequences of LOC221490 BINDING SITE, designated SEQ ID:44986, to the nucleotide sequence of VGAM186 RNA, herein designated VGAM RNA, also designated SEQ ID:2897.

Another function of VGAM186 is therefore inhibition of LOC221490 (Accession XM_168084). Accordingly, utilities of VGAM186 include diagnosis, prevention and treatment of diseases and clinical conditions associated with LOC221490. LOC254100 (Accession XM_172851) is another VGAM186 host target gene. LOC254100 BINDING SITE is HOST TARGET binding site found in the 3' untranslated region of mRNA encoded by LOC254100, corresponding to a HOST TARGET binding site such as BINDING SITE I, BINDING SITE II or BINDING SITE III. Table 2 illustrates the complementarity of the nucleotide sequences of LOC254100 BINDING SITE, designated SEQ ID:46130, to the nucleotide sequence of VGAM186 RNA, herein designated VGAM RNA, also designated SEQ ID:2897.

Another function of VGAM186 is therefore inhibition of LOC254100 (Accession XM_172851). Accordingly, utilities of VGAM186 include diagnosis, prevention and treatment of diseases and clinical conditions associated with LOC254100. LOC255328 (Accession XM_172920) is another VGAM186 host target gene. LOC255328 BINDING SITE is HOST TARGET binding site found in the 3' untranslated region of mRNA encoded by LOC255328, corresponding to a HOST TARGET binding site such as BINDING SITE I, BINDING SITE II or BINDING SITE III. Table 2 illustrates the complementarity of the nucleotide sequences of LOC255328 BINDING SITE, designated SEQ ID:46181, to the nucleotide sequence of VGAM186 RNA, herein designated VGAM RNA, also designated SEQ ID:2897.

Another function of VGAM186 is therefore inhibition of LOC255328 (Accession XM_172920). Accordingly, utilities of VGAM186 include diagnosis, prevention and treatment of diseases and clinical conditions associated with LOC255328. LOC90072 (Accession XM_028702) is another VGAM186 host target gene. LOC90072 BINDING SITE is HOST TARGET binding site found in the 3' untranslated region of mRNA encoded by LOC90072, corresponding to a HOST TARGET binding site such as BINDING SITE I, BINDING SITE II or BINDING SITE III. Table 2 illustrates the complementarity of the nucleotide sequences of LOC90072 BINDING SITE, designated SEQ ID:30730, to the nucleotide sequence of VGAM186 RNA, herein designated VGAM RNA, also designated SEQ ID:2897.

Another function of VGAM186 is therefore inhibition of LOC90072 (Accession XM_028702). Accordingly, utilities of VGAM186 include diagnosis, prevention and treatment of diseases and clinical conditions associated with LOC90072.

LOC92267 (Accession XM_043979) is another VGAM186 host target gene. LOC92267 BINDING SITE is HOST TARGET binding site found in the 3' untranslated region of mRNA encoded by LOC92267, corresponding to a HOST TARGET binding site such as BINDING SITE I, BINDING SITE II or BINDING SITE III. Table 2 illustrates the complementarity of the nucleotide sequences of LOC92267 BINDING SITE, designated SEQ ID:34060, to the nucleotide sequence of VGAM186 RNA, herein designated VGAM RNA, also designated SEQ ID:2897.

Another function of VGAM186 is therefore inhibition of LOC92267 (Accession XM_043979). Accordingly, utilities of VGAM186 include diagnosis, prevention and treatment of diseases and clinical conditions associated with LOC92267. FIG. 1 further provides a conceptual description of a novel bioinformatically detected viral gene of the present invention, referred to here as Viral Genomic Address Messenger 187 (VGAM187) viral gene, which modulates expression of respective host target genes thereof, the function and utility of which host target genes is known in the art.

VGAM187 is a novel bioinformatically detected regulatory, non protein coding, viral micro RNA (miRNA) gene. The method by which VGAM187 was detected is described hereinabove with reference to FIGS. 1-8.

VGAM187 gene, herein designated VGAM GENE, is a viral gene contained in the genome of Shrimp White Spot Syndrome Virus (white spot bacilliform virus). VGAM187 host target gene, herein designated VGAM HOST TARGET GENE, is a human gene contained in the human genome.

VGAM187 gene encodes a VGAM187 precursor RNA, herein designated VGAM PRECURSOR RNA. Similar to other miRNA genes, and unlike most ordinary genes, VGAM187 precursor RNA does not encode a protein. A nucleotide sequence identical or highly similar to the nucleotide sequence of VGAM187 precursor RNA is designated SEQ ID:173, and is provided hereinbelow with reference to the sequence listing part. Nucleotide sequence SEQ ID:173 is located at position 290507 relative to the genome of Shrimp White Spot Syndrome Virus (white spot bacilliform virus).

VGAM187 precursor RNA folds onto itself, forming VGAM187 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM187 folded precursor RNA into VGAM187 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM187 RNA is designated SEQ ID:2898, and is provided hereinbelow with reference to the sequence listing part.

VGAM187 host target gene, herein designated VGAM HOST TARGET GENE, encodes a corresponding messenger RNA, VGAM187 host target RNA, herein designated VGAM HOST TARGET RNA. VGAM187 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM187 RNA, herein designated VGAM RNA, binds complementarily to one or more host target binding sites located in untranslated regions of VGAM187 host target RNA, herein designated VGAM HOST TARGET RNA. This complementary binding is due to the fact that the nucleotide sequence of VGAM187 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM187 RNA, herein designated VGAM RNA, may have a different number of host target binding sites in untranslated regions of a VGAM187 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM187 RNA, herein designated VGAM RNA, to host target binding sites on VGAM187 host target RNA, herein designated VGAM HOST TARGET RNA, such as BINDING SITE I, BINDING SITE II and BINDING SITE III, inhibits translation of VGAM187 host target RNA into VGAM187 host target protein, herein designated VGAM HOST TARGET PROTEIN. VGAM host target protein is therefore outlined by a broken line.

It is appreciated that VGAM187 host target gene, herein designated VGAM HOST TARGET GENE, in fact represents a plurality of VGAM187 host target genes. The mRNA of each one of this plurality of VGAM187 host target genes comprises one or more host target binding sites, each having a nucleotide sequence which is at least partly complementary to VGAM187 RNA, herein designated VGAM RNA, and which when bound by VGAM187 RNA causes inhibition of translation of respective one or more VGAM187 host target proteins.

It is further appreciated by one skilled in the art that the mode of translational inhibition illustrated by FIG. 1 with specific reference to translational inhibition exerted by VGAM187 gene, herein designated VGAM GENE, on one or more VGAM187 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM187 is inhibition of expression of host target genes, as part of a novel viral mechanism of attacking a host. Accordingly, utilities of VGAM187 include diagnosis, prevention and treatment of viral infection by Shrimp White Spot Syndrome Virus (white spot bacilliform virus). Specific functions, and accordingly utilities, of VGAM187 correlate with, and may be deduced from, the identity of the host target genes which VGAM187 binds and inhibits, and the function of these host target genes, as elaborated hereinbelow.

Nucleotide sequences of the VGAM187 precursor RNA, herein designated VGAM PRECURSOR RNA, and of the 'diced' VGAM187 RNA, herein designated VGAM RNA, and a schematic representation of the secondary folding of VGAM187 folded precursor RNA, herein designated VGAM FOLDED PRECURSOR RNA, of VGAM187 are further described hereinbelow with reference to Table 1.

Nucleotide sequences of host target binding sites, such as BINDING SITE-I, BINDING SITE-II and BINDING SITE-III of FIG. 1, found on VGAM187 host target RNA, and schematic representation of the complementarity of each of these host target binding sites to VGAM187 RNA, herein designated VGAM RNA, are described hereinbelow with reference to Table 2.

As mentioned hereinabove with reference to FIG. 1, a function of VGAM187 gene, herein designated VGAM is inhibition of expression of VGAM187 target genes. It is appreciated that specific functions, and accordingly utilities, of VGAM187 correlate with, and may be deduced from, the identity of the target genes which VGAM187 binds and inhibits, and the function of these target genes, as elaborated hereinbelow.

Ankyrin 1, Erythrocytic (ANK1, Accession NM_000037) is a VGAM187 host target gene. ANK1 BINDING SITE1 through ANK1 BINDING SITE3 are HOST TARGET binding sites found in untranslated regions of mRNA encoded by ANK1, corresponding to HOST TARGET binding sites such as BINDING SITE I, BINDING SITE II or BINDING SITE III. Table 2 illustrates the complementarity of the nucleotide sequences of ANK1 BINDING SITE1 through ANK1 BINDING SITE3, designated SEQ ID:5475, SEQ ID:21728 and SEQ ID:30278 respectively, to the nucleotide sequence of VGAM187 RNA, herein designated VGAM RNA, also designated SEQ ID:2898.

A function of VGAM187 is therefore inhibition of Ankyrin 1, Erythrocytic (ANK1, Accession NM_000037). Accordingly, utilities of VGAM187 include diagnosis, prevention and treatment of diseases and clinical conditions associated with ANK1. UDP-N-acetyl-alpha-D-galactosamine: polypeptide N-acetylgalactosaminyltransferase 2 (GalNAc-T2) (GALNT2, Accession NM_004481) is another VGAM187 host target gene. GALNT2 BINDING SITE is HOST TARGET binding site found in the 3' untranslated region of mRNA encoded by GALNT2, corresponding to a HOST TARGET binding site such as BINDING SITE I, BINDING SITE II or BINDING SITE III. Table 2 illustrates the complementarity of the nucleotide sequences of GALNT2 BINDING SITE, designated SEQ ID:10800, to the nucleotide sequence of VGAM187 RNA, herein designated VGAM RNA, also designated SEQ ID:2898.

Another function of VGAM187 is therefore inhibition of UDP-N-acetyl-alpha-D-galactosamine:polypeptide N-acetylgalactosaminyltransferase 2 (GalNAc-T2) (GALNT2, Accession NM_004481), a gene which catalyzes the initial reaction in o-linked oligosaccharide biosynthesis. Accordingly, utilities of VGAM187 include diagnosis, prevention and treatment of diseases and clinical conditions associated with GALNT2. The function of GALNT2 has been established by previous studies. UDP-N-acetyl-alpha-D-galactosamine:polypeptide N-acetylgalactosaminyltransferase (GalNAc-T; EC 2.4.1.41) transfers an N-acetyl galactosamine (OMIM Ref. No. GalNAc) to the hydroxyl group of a serine or threonine residue in the first step of O-linked oligosaccharide biosynthesis. White et al. (1995) purified GALNT2, termed GalNAc-T2 by them, from human placenta, using a defined synthetic acceptor peptide as an affinity ligand. They also identified a cDNA for GALNT2 using polymerase chain reaction with primers derived from the protein sequence of the purified GALNT2. The GALNT2 cDNA encodes a predicted 571-amino acid protein of approximately 64 kD (White et al., 1995). Bennett et al. (1998) found that the GALNT1 (OMIM Ref. No. 602273), GALNT2, and GALNT3 (OMIM Ref. No. 601756) genes contain 11, 16, and 10 exons, respectively. Several intron/exon boundaries are conserved within the 3 genes. By FISH, Bennett et al. (1998) mapped the GALNT2 gene to chromosome 1q41-q42.

Full details of the abovementioned studies are described in the following publications, the disclosure of which are hereby incorporated by reference:

Bennett, E. P.; Weghuis, D. O.; Merkx, G.; Geurts van Kessel, A.; Eiberg, H.; Clausen, H.: Genomic organization and chromosomal localization of three members of the UDP-N-acetylgalactosamine:polypeptide N-acetylgalactosaminyltransferase family. Glycobiology 8:547-555, 1998; and White, T.; Bennett, E. P.; Takio, K.; Sorensen, T.; Bonding, N.; Clausen, H.: Purification and cDNA cloning of a human UDP-N-acetyl-alpha-D-galactosamine:polypeptide N-acetylgalactosam.

Further studies establishing the function and utilities of GALNT2 are found in John Hopkins OMIM database record ID 602274, and in sited publications numbered 2824 listed in the bibliography section hereinbelow, which are also hereby incorporated by reference. Ubiquitin Protein Ligase E3A (human papilloma virus E6-associated protein, Angelman syndrome) (UBE3A, Accession NM_130838) is another VGAM187 host target gene. UBE3A BINDING SITE1 through UBE3A BINDING SITE3 are HOST TARGET binding sites found in untranslated regions of mRNA encoded by UBE3A, corresponding to HOST TARGET binding sites such as BINDING SITE I, BINDING SITE II or BINDING SITE III. Table 2 illustrates the complementarity of the nucleotide sequences of UBE3A BINDING SITE1 through UBE3A BINDING SITE3, designated SEQ ID:28361, SEQ ID:28365 and SEQ ID:6080 respectively, to the nucleotide sequence of VGAM187 RNA, herein designated VGAM RNA, also designated SEQ ID:2898.

Another function of VGAM187 is therefore inhibition of Ubiquitin Protein Ligase E3A (human papilloma virus E6-associated protein, Angelman syndrome) (UBE3A, Accession NM_130838). Accordingly, utilities of VGAM187 include diagnosis, prevention and treatment of diseases and clinical conditions associated with UBE3A. Paraneoplastic Antigen MA1 (PNMA1, Accession NM_006029) is another VGAM187 host target gene. PNMA1 BINDING SITE is HOST TARGET binding site found in the 3' untranslated region of mRNA encoded by PNMA1, corresponding to a HOST TARGET binding site such as BINDING SITE I, BINDING SITE II or BINDING SITE III. Table 2 illustrates the complementarity of the nucleotide sequences of PNMA1 BINDING SITE, designated SEQ ID:12645, to the nucleotide sequence of VGAM187 RNA, herein designated VGAM RNA, also designated SEQ ID:2898.

Another function of VGAM187 is therefore inhibition of Paraneoplastic Antigen MA1 (PNMA1, Accession NM_006029). Accordingly, utilities of VGAM187 include diagnosis, prevention and treatment of diseases and clinical conditions associated with PNMA1. Ring Finger Protein (C3HC4 type) 8 (RNF8, Accession NM_003958) is another VGAM187 host target gene. RNF8 BINDING SITE is HOST TARGET binding site found in the 3' untranslated region of mRNA encoded by RNF8, corresponding to a HOST TARGET binding site such as BINDING SITE I, BINDING SITE II or BINDING SITE III. Table 2 illustrates the complementarity of the nucleotide sequences of RNF8 BINDING SITE, designated SEQ ID:10093, to the nucleotide sequence of VGAM187 RNA, herein designated VGAM RNA, also designated SEQ ID:2898.

Another function of VGAM187 is therefore inhibition of Ring Finger Protein (C3HC4 type) 8 (RNF8, Accession NM_003958). Accordingly, utilities of VGAM187 include diagnosis, prevention and treatment of diseases and clinical conditions associated with RNF8. LOC256642 (Accession XM_172797) is another VGAM187 host target gene. LOC256642 BINDING SITE is HOST TARGET binding site found in the 3' untranslated region of mRNA encoded by LOC256642, corresponding to a HOST TARGET binding site such as BINDING SITE I, BINDING SITE II or BINDING SITE III. Table 2 illustrates the complementarity of the nucleotide sequences of LOC256642 BINDING SITE, designated SEQ ID:46079, to the nucleotide sequence of VGAM187 RNA, herein designated VGAM RNA, also designated SEQ ID:2898.

Another function of VGAM187 is therefore inhibition of LOC256642 (Accession XM_172797). Accordingly, utilities of VGAM187 include diagnosis, prevention and treatment of diseases and clinical conditions associated with LOC256642. FIG. 1 further provides a conceptual description of a novel bioinformatically detected viral gene of the present invention, referred to here as Viral Genomic Address Messenger 188 (VGAM188) viral gene, which modulates expression of respective host target genes thereof, the function and utility of which host target genes is known in the art.

VGAM188 is a novel bioinformatically detected regulatory, non protein coding, viral micro RNA (miRNA) gene. The method by which VGAM188 was detected is described hereinabove with reference to FIGS. 1-8.

VGAM188 gene, herein designated VGAM GENE, is a viral gene contained in the genome of Shrimp White Spot Syndrome Virus (white spot bacilliform virus). VGAM188 host target gene, herein designated VGAM HOST TARGET GENE, is a human gene contained in the human genome.

VGAM188 gene encodes a VGAM188 precursor RNA, herein designated VGAM PRECURSOR RNA. Similar to other miRNA genes, and unlike most ordinary genes, VGAM188 precursor RNA does not encode a protein. A nucleotide sequence identical or highly similar to the nucleotide sequence of VGAM188 precursor RNA is designated SEQ ID:174, and is provided hereinbelow with reference to the sequence listing part. Nucleotide sequence SEQ ID:174 is located at position 52782 relative to the genome of Shrimp White Spot Syndrome Virus (white spot bacilliform virus).

VGAM188 precursor RNA folds onto itself, forming VGAM188 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM188 folded precursor RNA into VGAM188 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM188 RNA is designated SEQ ID:2899, and is provided hereinbelow with reference to the sequence listing part.

VGAM188 host target gene, herein designated VGAM HOST TARGET GENE, encodes a corresponding messenger RNA, VGAM188 host target RNA, herein designated VGAM HOST TARGET RNA. VGAM188 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM188 RNA, herein designated VGAM RNA, binds complementarily to one or more host target binding sites located in untranslated regions of VGAM188 host target RNA, herein designated VGAM HOST TARGET RNA. This complementary binding is due to the fact that the nucleotide sequence of VGAM188 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM188 RNA, herein designated VGAM RNA, may have a different number of host target binding sites in untranslated regions of a VGAM188 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM188 RNA, herein designated VGAM RNA, to host target binding sites on VGAM188 host target RNA, herein designated VGAM HOST TARGET RNA, such as BINDING SITE I, BINDING SITE II and BINDING SITE III, inhibits translation of VGAM188 host target RNA into VGAM188 host target protein, herein designated VGAM HOST TARGET PROTEIN. VGAM host target protein is therefore outlined by a broken line.

It is appreciated that VGAM188 host target gene, herein designated VGAM HOST TARGET GENE, in fact represents a plurality of VGAM188 host target genes. The mRNA of each one of this plurality of VGAM188 host target genes comprises one or more host target binding sites, each having a nucleotide sequence which is at least partly complementary to VGAM188 RNA, herein designated VGAM RNA, and which when bound by VGAM188 RNA causes inhibition of translation of respective one or more VGAM188 host target proteins.

It is further appreciated by one skilled in the art that the mode of translational inhibition illustrated by FIG. 1 with specific reference to translational inhibition exerted by VGAM188 gene, herein designated VGAM GENE, on one or more VGAM188 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM188 is inhibition of expression of host target genes, as part of a novel viral mechanism of attacking a host. Accordingly, utilities of VGAM188 include diagnosis, prevention and treatment of viral infection by Shrimp White Spot Syndrome Virus (white spot bacilliform virus). Specific functions, and accordingly utilities, of VGAM188 correlate with, and may be deduced from, the identity of the host target genes which VGAM188 binds and inhibits, and the function of these host target genes, as elaborated hereinbelow.

Nucleotide sequences of the VGAM188 precursor RNA, herein designated VGAM PRECURSOR RNA, and of the 'diced' VGAM188 RNA, herein designated VGAM RNA, and a schematic representation of the secondary folding of VGAM188 folded precursor RNA, herein designated VGAM FOLDED PRECURSOR RNA, of VGAM188 are further described hereinbelow with reference to Table 1.

Nucleotide sequences of host target binding sites, such as BINDING SITE-I, BINDING SITE-II and BINDING SITE-III of FIG. 1, found on VGAM188 host target RNA, and schematic representation of the complementarity of each of these host target binding sites to VGAM188 RNA, herein designated VGAM RNA, are described hereinbelow with reference to Table 2.

As mentioned hereinabove with reference to FIG. 1, a function of VGAM188 gene, herein designated VGAM is inhibition of expression of VGAM188 target genes. It is appreciated that specific functions, and accordingly utilities, of VGAM188 correlate with, and may be deduced from, the identity of the target genes which VGAM188 binds and inhibits, and the function of these target genes, as elaborated hereinbelow.

V-akt Murine Thymoma Viral Oncogene Homolog 1 (AKT1, Accession NM_005163) is a VGAM188 host target gene. AKT1 BINDING SITE is HOST TARGET binding site found in the 5' untranslated region of mRNA encoded by AKT1, corresponding to a HOST TARGET binding site such as BINDING SITE I, BINDING SITE II or BINDING SITE III. Table 2 illustrates the complementarity of the nucleotide sequences of AKT1 BINDING SITE, designated SEQ ID:11652, to the nucleotide sequence of VGAM188 RNA, herein designated VGAM RNA, also designated SEQ ID:2899.

A function of VGAM188 is therefore inhibition of V-akt Murine Thymoma Viral Oncogene Homolog 1 (AKT1, Accession NM_005163), a gene which Serine-threonine protein kinase. Accordingly, utilities of VGAM188 include diagnosis, prevention and treatment of diseases and clinical conditions associated with AKT1. The function of AKT1 has been established by previous studies. Phosphoinositide 3-kinases, or PI3Ks (see OMIM Ref. No. PIK3CA; 171834), generate specific inositol lipids implicated in the regulation of cell growth, proliferation, survival, differentiation, and cytoskeletal changes. One of the best characterized targets of PI3K lipid products is the protein kinase AKT, or protein kinase B (PKB). In quiescent cells, PKB resides in the cytosol in a low-activity conformation. Upon cellular stimulation, PKB is activated through recruitment to cellular membranes by PI3K lipid products and by phosphorylation by 3-prime phosphoinositide-dependent kinase-1 (PDPK1; 605213). For a review of the mechanism that activates PKB and the downstream actions of this multifunctional kinase, see Vanhaesebroeck and Alessi (2000). For a review of the possible role of PKB in glucose transport, see Hajduch et al. (2001). Animal model experiments lend further support to the function of AKT1. Holland et al. (2000) transferred, in a tissue-specific manner, genes encoding activated forms of Ras (OMIM Ref. No. 190070) and Akt to astrocytes and neural progenitors in mice. Holland et al. (2000) found that although neither activated Ras nor Akt alone was sufficient to induce glioblastoma multiforme (GBM; 137800) formation, the combination of activated Ras and Akt induced high-grade gliomas with the histologic features of human GBMs. These tumors appeared to arise after gene transfer to neural progenitors, but not after transfer to differentiated astrocytes. Increased activity of RAS is found in many human GBMs, and Holland et al. (2000) demonstrated that Akt activity is increased in most of these tumors, implying that combined activation of these 2 pathways accurately models the biology of this disease. By targeted disruption of the Akt1 gene, Chen et al. (2001) created an Akt1 null mouse model. Homozygous mice were viable but smaller than wildtype littermates, and they did not display a diabetic phenotype. Upon exposure to genotoxic stress, their life span was shorter. Chen et al. (2001) found that the Akt1 null mice showed increased spontaneous apoptosis in testes and thymi. They observed an attenuation of spermatogenesis in the Akt1 null male mice, and thymocytes were more sensitive to gamma irradiation and dexamethasone-induced apoptosis. Akt1 null mouse embryo fibroblasts were also more susceptible to apoptosis induced by TNF, anti-Fas (OMIM Ref. No. 134637), ultraviolet irradiation, and serum withdrawal.

It is appreciated that the abovementioned animal model for AKT1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Vanhaesebroeck, B.; Alessi, D. R.: The PI3K-PDK1 connection: more than just a road to PKB. Biochem. J. 346:561-576, 2000; and Hajduch, E.; Litherland, G. J.; Hundal, H. S.: Protein kinase B (PKB/Akt)--a key regulator of glucose transport? FEBS Lett. 492:199-203, 2001.

Further studies establishing the function and utilities of AKT1 are found in John Hopkins OMIM database record ID 164730, and in sited publications numbered 11046-11049, 11203, 11215-11217, 11033, 11218-11220, 4713, 11221-11223, 1273 and 12740-11229 listed in the bibliography section hereinbelow, which are also hereby incorporated by reference. Recombination Activating Gene 1 (RAG1, Accession NM_000448) is another VGAM188 host target gene. RAG1 BINDING SITE is HOST TARGET binding site found in the 3' untranslated region of mRNA encoded by RAG1, corresponding to a HOST TARGET binding site such as BINDING SITE I, BINDING SITE II or BINDING SITE III. Table 2 illustrates the complementarity of the nucleotide sequences of RAG1 BINDING SITE, designated SEQ ID:6042, to the nucleotide sequence of VGAM188 RNA, herein designated VGAM RNA, also designated SEQ ID:2899.

Another function of VGAM188 is therefore inhibition of Recombination Activating Gene 1 (RAG1, Accession NM_000448). Accordingly, utilities of VGAM188 include diagnosis, prevention and treatment of diseases and clinical conditions associated with RAG1. FLJ10856 (Accession NM_018247) is another VGAM188 host target gene. FLJ10856 BINDING SITE is HOST TARGET binding site found in the 3' untranslated region of mRNA encoded by FLJ10856, corresponding to a HOST TARGET binding site such as BINDING SITE I, BINDING SITE II or BINDING SITE III. Table 2 illustrates the complementarity of the nucleotide sequences of FLJ10856 BINDING SITE, designated SEQ ID:20218, to the nucleotide sequence of VGAM188 RNA, herein designated VGAM RNA, also designated SEQ ID:2899.

Another function of VGAM188 is therefore inhibition of FLJ10856 (Accession NM_018247). Accordingly, utilities of VGAM188 include diagnosis, prevention and treatment of diseases and clinical conditions associated with FLJ10856. KIAA0157 (Accession NM_032182) is another VGAM188 host target gene. KIAA0157 BINDING SITE is HOST TARGET binding site found in the 3' untranslated region of mRNA encoded by KIAA0157, corresponding to a HOST TARGET binding site such as BINDING SITE I, BINDING SITE II or BINDING SITE III. Table 2 illustrates the complementarity of the nucleotide sequences of KIAA0157 BINDING SITE, designated SEQ ID:25897, to the nucleotide sequence of VGAM188 RNA, herein designated VGAM RNA, also designated SEQ ID:2899.

Another function of VGAM188 is therefore inhibition of KIAA0157 (Accession NM_032182). Accordingly, utilities of VGAM188 include diagnosis, prevention and treatment of diseases and clinical conditions associated with KIAA0157. FIG. 1 further provides a conceptual description of a novel bioinformatically detected viral gene of the present invention, referred to here as Viral Genomic Address Messenger 189 (VGAM189) viral gene, which modulates expression of respective host target genes thereof, the function and utility of which host target genes is known in the art.

VGAM189 is a novel bioinformatically detected regulatory, non protein coding, viral micro RNA (miRNA) gene. The method by which VGAM189 was detected is described hereinabove with reference to FIGS. 1-8.

VGAM189 gene, herein designated VGAM GENE, is a viral gene contained in the genome of Shrimp White Spot Syndrome Virus (white spot baciliform virus). VGAM189 host target gene, herein designated VGAM HOST TARGET GENE, is a human gene contained in the human genome.

VGAM189 gene encodes a VGAM189 precursor RNA, herein designated VGAM PRECURSOR RNA. Similar to other miRNA genes, and unlike most ordinary genes, VGAM189 precursor RNA does not encode a protein. A nucleotide sequence identical or highly similar to the nucleotide sequence of VGAM189 precursor RNA is designated SEQ ID:175, and is provided hereinbelow with reference to the sequence listing part. Nucleotide sequence SEQ ID:175 is located at position 194768 relative to the genome of Shrimp White Spot Syndrome Virus (white spot baciliform virus).

VGAM189 precursor RNA folds onto itself, forming VGAM189 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM189 folded precursor RNA into VGAM189 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM189 RNA is designated SEQ ID:2900, and is provided hereinbelow with reference to the sequence listing part.

VGAM189 host target gene, herein designated VGAM HOST TARGET GENE, encodes a corresponding messenger RNA, VGAM189 host target RNA, herein designated VGAM HOST TARGET RNA. VGAM189 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM189 RNA, herein designated VGAM RNA, binds complementarily to one or more host target binding sites located in untranslated regions of VGAM189 host target RNA, herein designated VGAM HOST TARGET RNA. This complementary binding is due to the fact that the nucleotide sequence of VGAM189 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM189 RNA, herein designated VGAM RNA, may have a different number of host target binding sites in untranslated regions of a VGAM189 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM189 RNA, herein designated VGAM RNA, to host target binding sites on VGAM189 host target RNA, herein designated VGAM HOST TARGET RNA, such as BINDING SITE I, BINDING SITE II and BINDING SITE III, inhibits translation of VGAM189 host target RNA into VGAM189 host target protein, herein designated VGAM HOST TARGET PROTEIN. VGAM host target protein is therefore outlined by a broken line.

It is appreciated that VGAM189 host target gene, herein designated VGAM HOST TARGET GENE, in fact represents a plurality of VGAM189 host target genes. The mRNA of each one of this plurality of VGAM189 host target genes comprises one or more host target binding sites, each having a nucleotide sequence which is at least partly complementary to VGAM189 RNA, herein designated VGAM RNA, and which when bound by VGAM189 RNA causes inhibition of translation of respective one or more VGAM189 host target proteins.

It is further appreciated by one skilled in the art that the mode of translational inhibition illustrated by FIG. 1 with specific reference to translational inhibition exerted by VGAM189 gene, herein designated VGAM GENE, on one or more VGAM189 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM189 is inhibition of expression of host target genes, as part of a novel viral mechanism of attacking a host. Accordingly, utilities of VGAM189 include diagnosis, prevention and treatment of viral infection by Shrimp White Spot Syndrome Virus (white spot baciliform virus). Specific functions, and accordingly utilities, of VGAM189 correlate with, and may be deduced from, the identity of the host target genes which VGAM189 binds and inhibits, and the function of these host target genes, as elaborated hereinbelow.

Nucleotide sequences of the VGAM189 precursor RNA, herein designated VGAM PRECURSOR RNA, and of the 'diced' VGAM189 RNA, herein designated VGAM RNA, and a schematic representation of the secondary folding of VGAM189 folded precursor RNA, herein designated VGAM FOLDED PRECURSOR RNA, of VGAM189 are further described hereinbelow with reference to Table 1.

Nucleotide sequences of host target binding sites, such as BINDING SITE-I, BINDING SITE-II and BINDING SITE-III of FIG. 1, found on VGAM189 host target RNA, and schematic representation of the complementarity of each of these host target binding sites to VGAM189 RNA, herein designated VGAM RNA, are described hereinbelow with reference to Table 2.

As mentioned hereinabove with reference to FIG. 1, a function of VGAM189 gene, herein designated VGAM is inhibition of expression of VGAM189 target genes. It is appreciated that specific functions, and accordingly utilities, of VGAM189 correlate with, and may be deduced from, the identity of the target genes which VGAM189 binds and inhibits, and the function of these target genes, as elaborated hereinbelow.

Chromosome 14 Open Reading Frame 1 (C14orf1, Accession NM_007176) is a VGAM189 host target gene. C14orf1 BINDING SITE is HOST TARGET binding site found in the 3' untranslated region of mRNA encoded by C14orf1, corresponding to a HOST TARGET binding site such as BINDING SITE I, BINDING SITE II or BINDING SITE III. Table 2 illustrates the complementarity of the nucleotide sequences of C14orf1 BINDING SITE, designated SEQ ID:14030, to the nucleotide sequence of VGAM189 RNA, herein designated VGAM RNA, also designated SEQ ID:2900.

A function of VGAM189 is therefore inhibition of Chromosome 14 Open Reading Frame 1 (C14orf1, Accession NM_007176). Accordingly, utilities of VGAM189 include diagnosis, prevention and treatment of diseases and clinical conditions associated with C14orf1. Early Growth Response 3 (EGR3, Accession XM_005040) is another VGAM189 host target gene. EGR3 BINDING SITE is HOST TARGET binding site found in the 3' untranslated region of mRNA encoded by EGR3, corresponding to a HOST TARGET binding site such as BINDING SITE I, BINDING SITE II or BINDING SITE III. Table 2 illustrates the complementarity of the nucleotide sequences of EGR3 BINDING SITE, designated SEQ ID:29959, to the nucleotide sequence of VGAM189 RNA, herein designated VGAM RNA, also designated SEQ ID:2900.

Another function of VGAM189 is therefore inhibition of Early Growth Response 3 (EGR3, Accession XM_005040), a gene which is a putative transcription factor. Accordingly, utilities of VGAM189 include diagnosis, prevention and treatment of diseases and clinical conditions associated with EGR3. The function of EGR3 has been established by previous studies. The human EGR3 gene was described by Patwardhan et al. (1991) as predicting a 387-amino acid protein containing 3 C2H2 zinc fingers nearly identical to those of EGR1 and EGR2. The EGR3 gene has a single intron. The gene was known to be induced in various brain regions in response to stress or following focal brain injury. Morris et al. (1998) stated that, in the SCN, it probably participates in the transcriptional regulation of genes in response to retinal input, as had been proposed for FOS. Muscle spindles are skeletal muscle sensory organs that provide axial and limb position information (proprioception) to the central nervous system. Spindles consist of encapsulated muscle fibers (intrafusal fibers) that are innervated by specialized motor and sensory axons. Tourtellotte and Milbrandt (1998) found that mice rendered deficient in Egr3 by gene targeting had gait ataxia, increased frequency of perinatal mortality, scoliosis, resting tremors, and ptosis. Although extrafusal skeletal muscle fibers appeared normal, Egr3-deficient animals lacked muscle spindles, a finding that is consistent with their profound gait ataxia. Egr3 was highly expressed in developing muscle spindles, but not in IIa afferent neurons or their terminals during developmental periods that coincided with the induction of spindle morphogenesis by sensory afferent axons. These results indicated that type I myotubes are dependent upon Egr3-mediated transcription for proper spindle development.

Full details of the abovementioned studies are described in the following publications, the disclosure of which are hereby incorporated by reference:

Morris, M. E.; Viswanathan, N.; Kuhlman, S.; Davis, F. C.; Weitz, C. J.: A screen for genes induced in the suprachiasmatic nucleus by light. Science 279:1544-1547, 1998; and Tourtellotte, W. G.; Milbrandt, J.: Sensory ataxia and muscle spindle agenesis in mice lacking the transcription factor Egr3. Nature Genet. 20:87-91, 1998.

Further studies establishing the function and utilities of EGR3 are found in John Hopkins OMIM database record ID 602419, and in sited publications numbered 1029-1031 listed in the bibliography section hereinbelow, which are also hereby incorporated by reference. Hyaluronoglucosaminidase 4 (HYAL4, Accession NM_012269) is another VGAM189 host target gene. HYAL4 BINDING SITE is HOST TARGET binding site found in the 5' untranslated region of mRNA encoded by HYAL4, corresponding to a HOST TARGET binding site such as BINDING SITE I, BINDING SITE II or BINDING SITE III. Table 2 illustrates the complementarity of the nucleotide sequences of HYAL4 BINDING SITE, designated SEQ ID:14593, to the nucleotide sequence of VGAM189 RNA, herein designated VGAM RNA, also designated SEQ ID:2900.

Another function of VGAM189 is therefore inhibition of Hyaluronoglucosaminidase 4 (HYAL4, Accession NM_012269). Accordingly, utilities of VGAM189 include diagnosis, prevention and treatment of diseases and clinical conditions associated with HYAL4. Protein Kinase (cAMP-dependent, catalytic) Inhibitor Alpha (PKIA, Accession NM_006823) is another VGAM189 host target gene. PKIA BINDING SITE is HOST TARGET binding site found in the 5' untranslated region of mRNA encoded by PKIA, corresponding to a HOST TARGET binding site such as BINDING SITE I, BINDING SITE II or BINDING SITE III. Table 2 illustrates the complementarity of the nucleotide sequences of PKIA BINDING SITE, designated SEQ ID:13695, to the nucleotide sequence of VGAM189 RNA, herein designated VGAM RNA, also designated SEQ ID:2900.

Another function of VGAM189 is therefore inhibition of Protein Kinase (cAMP-dependent, catalytic) Inhibitor Alpha (PKIA, Accession NM_006823). Accordingly, utilities of VGAM189 include diagnosis, prevention and treatment of diseases and clinical conditions associated with PKIA. POU Domain, Class 2, Associating Factor 1 (POU2AF1, Accession NM_006235) is another VGAM189 host target gene. POU2AF1 BINDING SITE is HOST TARGET binding site found in the 3' untranslated region of mRNA encoded by POU2AF1, corresponding to a HOST TARGET binding site such as BINDING SITE I, BINDING SITE II or BINDING SITE III. Table 2 illustrates the complementarity of the nucleotide sequences of POU2AF1 BINDING SITE, designated SEQ ID:12889, to the nucleotide sequence of VGAM189

RNA, herein designated VGAM RNA, also designated SEQ ID:2900.

Another function of VGAM189 is therefore inhibition of POU Domain, Class 2, Associating Factor 1 (POU2AF1, Accession NM_006235), a gene which is a transcriptional coactivator that specifically associates with either oct1 or oct2. Accordingly, utilities of VGAM189 include diagnosis, prevention and treatment of diseases and clinical conditions associated with POU2AF1. The function of POU2AF1 and its association with various diseases and clinical conditions, has been established by previous studies, as described hereinabove with reference to VGAM171. Telomeric Repeat Binding Factor (NIMA-interacting) 1 (TERF1, Accession NM_017489) is another VGAM189 host target gene. TERF1 BINDING SITE is HOST TARGET binding site found in the 3' untranslated region of mRNA encoded by TERF1, corresponding to a HOST TARGET binding site such as BINDING SITE I, BINDING SITE II or BINDING SITE III. Table 2 illustrates the complementarity of the nucleotide sequences of TERF1 BINDING SITE, designated SEQ ID:18952, to the nucleotide sequence of VGAM189 RNA, herein designated VGAM RNA, also designated SEQ ID:2900.

Another function of VGAM189 is therefore inhibition of Telomeric Repeat Binding Factor (NIMA-interacting) 1 (TERF1, Accession NM_017489), a gene which negatively regulates telomere length, involves in regulation of the mitotic spindle. Accordingly, utilities of VGAM189 include diagnosis, prevention and treatment of diseases and clinical conditions associated with TERF1. The function of TERF1 has been established by previous studies. Human chromosomes carry at their termini long arrays of double-stranded hexamers (OMIM Ref. No. TTAGGG) that are maintained by the enzyme telomerase (OMIM Ref. No. 187270). Chong et al. (1995) noted that telomeric DNA is thought to form a protective nucleoprotein cap through its association with telomere-specific proteins; also see review by Zakian (1995). Because the loss of telomere function can induce cell cycle arrest and genome instability, the telomeric complex is probably required in all human cells. Changes in the structure and function of human telomeres are thought to play a role in malignant transformation and cellular senescence. Protein components of the telomeric complex had been identified in ciliates and yeast, but not in vertebrate systems. Quests for vertebrate telomeric proteins had yielded a single candidate that could potentially bind along the length of the telomeric TTAGGG repeat array. This protein, called TRF (telomeric repeat-binding factor) by Chong et al. (1995), was shown by the authors to associate with double-stranded TTAGGG repeat arrays in vitro. TRF displays strong specificity for vertebrate telomere DNA. Human TRF activity is detectable in HeLa cell nuclear extracts on the basis of its ability to alter the mobility of double-stranded DNA fragments containing the sequence (OMIM Ref. No. TTAGGG)12. Using this assay, Chong et al. (1995) purified HeLa TRF to near homogeneity. Three independent preparations of purified TRF contained a protein in the 60-kD apparent molecular mass range, which copurified with TRF activity over a column containing double-stranded TTAGGG repeats. Amino acid sequences revealed sequence identity to an anonymous partial cDNA in the GenBank database. On the basis of this nucleotide sequence, cDNAs were isolated from a HeLa cell library, sequenced, and found to contain an open reading frame encoding all sequence peptides. The cDNA hybridized 2 mRNAs of approximately 1.8 and 3.0 kb that are expressed in a variety of human tissues. The cDNA derived from the larger mRNA revealed an open reading frame encoding a 439-amino acid protein. In vitro transcription and translation of the cloned cDNA produced a protein of the same size as purified HeLa TRF. Comparison with the sequence information in the databases indicated that human TRF is a novel protein with 3 previously recognized sequence motifs. There is one DNA-binding repeat resembling that of MYB (OMIM Ref. No. 189990) and an N-terminal acidic domain. Immunofluorescent labeling showed that TRF specifically colocalizes with telomeric DNA in human metaphase cells and is located at chromosome ends during metaphase. Chong et al. (1995) stated that the presence of TRF along the telomeric TTAGGG repeat array demonstrates that human telomeres form a specialized nuclear protein complex. In yeast, Marcand et al. (1997) demonstrated a protein-counting mechanism for regulation of the length of telomeres. This mechanism involves the telomere repeat-binding protein Rap1p. Because the structural and functional properties of telomeres appear to be highly conserved, Marcand et al. (1997) suggested that their findings may be relevant to telomere length regulation in human S, which has been associated with aging and cancer. Okabe et al. (2000) investigated cellular factors required for telomere formation using the frequency of telomere seeding as an index and identified TRF1 as an essential transacting factor. The exogenous telomere repeat induced telomere formation at a frequency determined by the availability of TRF1, even in telomerase-negative cells. The authors concluded that TRF1 has a novel physiologic significance distinct from its role as a regulator of telomere length in the endogenous chromosome.

Full details of the abovementioned studies are described in the following publications, the disclosure of which are hereby incorporated by reference:

Chong, L.; van Steensel, B.; Broccoli, D.; Erdjument-Bromage, H.; Hanish, J.; Tempst, P.; de Lange, T.: A human telomeric protein. Science 270:1663-1667, 1995; and Okabe, J.; Eguchi, A.; Masago, A.; Hayakawa, T.; Nakanishi, M.: TRF1 is a critical trans-acting factor required for de novo telomere formation in human cells. Hum. Molec. Genet. 9:263.

Further studies establishing the function and utilities of TERF1 are found in John Hopkins OMIM database record ID 600951, and in sited publications numbered 9620-9628 listed in the bibliography section hereinbelow, which are also hereby incorporated by reference. TIRAP (Accession NM_052887) is another VGAM189 host target gene. TIRAP BINDING SITE is HOST TARGET binding site found in the 3' untranslated region of mRNA encoded by TIRAP, corresponding to a HOST TARGET binding site such as BINDING SITE I, BINDING SITE II or BINDING SITE III. Table 2 illustrates the complementarity of the nucleotide sequences of TIRAP BINDING SITE, designated SEQ ID:27476, to the nucleotide sequence of VGAM189 RNA, herein designated VGAM RNA, also designated SEQ ID:2900.

Another function of VGAM189 is therefore inhibition of TIRAP (Accession NM_052887), a gene which is a adapter involved in theTLR4 signaling pathway in the innate immune response. Accordingly, utilities of VGAM189 include diagnosis, prevention and treatment of diseases and clinical conditions associated with TIRAP. The function of TIRAP has been established by previous studies. Different Toll-like receptors (e.g., TLR5, 603031) are part of the innate immune system and recognize pathogen-associated molecular patterns (PAMPs). TLR4 recognizes the lipopolysaccharide of gram-negative bacteria and, like other TLRs, signals through a Toll/IL1R (OMIM Ref. No. 147810) (TIR) domain. MYD88 (OMIM Ref. No. 602170) is an adaptor protein containing a TIR domain and is involved in TLR2 (OMIM Ref. No. 603028), TLR4, TLR5, and TLR9 (OMIM Ref. No.

605474) signaling. By high-throughput sequencing of a dendritic cell EST cDNA library followed by PCR, Fitzgerald et al. (2001) identified a cDNA encoding a MYD88-adaptor-like protein, which they termed MAL. Sequence analysis predicted that the cytoplasmic protein contains a C-terminal TIR domain expected to have a secondary structure similar to that of TLR2 and an N-terminal region lacking a death domain and that is shorter than that of MYD88. Northern blot analysis revealed wide expression of a 2.3-kb transcript, with particularly strong expression in kidney, liver, heart, and placenta. RT-PCR analysis detected expression in murine dendritic and murine and human monocyte/macrophage cell lines. Using mutational and functional analyses, Horng et al. (2001) determined that TIRAP functions downstream of TLR4, but not IL1R or TLR9. Lipopolysaccharide or CpG stimulation results in PRKR (OMIM Ref. No. 176871) phosphorylation, indicating that PRKR is a component of both the TLR4 and TLR9 pathways. Immunoprecipitation analysis showed that PRKR, as well as its activator PACT (PRKRA; 603424) and inhibitor p58 (DNAJC3; 601184), are associated with TIRAP. Treatment of a macrophage cell line with an N-terminal mouse Tirap peptide containing the proline-125 region linked to the C terminus of 'antennapedia,' a Drosophila transcription factor, potently inhibited lipopolysaccharide-induced, but not CpG-induced or IL1B-induced, NFKB or JNK activation, suggesting a potential antiinflammatory molecule. Likewise, the Tirap peptide inhibited CD80 (OMIM Ref. No. 112203) and CD86 (OMIM Ref. No. 601020) upregulation as well as IL12 (OMIM Ref. No. 161560) and IL6 (OMIM Ref. No. 147620) cytokine production in lipopolysaccharide-activated dendritic cells. Horng et al. (2001) concluded that TIRAP functions downstream of TLR4, but not TLR9, TLR2, or IL1R, and upstream of PRKR, probably in the TLR4/MYD88-independent pathway.

Full details of the abovementioned studies are described in the following publications, the disclosure of which are hereby incorporated by reference:

Fitzgerald, K. A.; Palsson-McDermott, E. M.; Bowie, A. G.; Jefferies, C. A.; Mansell, A. S.; Brady, G.; Brint, E.; Dunne, A.; Gray, P.; Harte, M. T.; McMurray, D.; Smith, D. E.; Sims, J. E.; Bird, T. A.; O'Neill, L. A. J.: Mal (MyD88-adapter-like) is required for Toll-like receptor-4 signal transduction. Nature 413: 78-83, 2001; and Horng, T.; Barton, G. M.; Medzhitov, R.: TIRAP: an adapter molecule in the Toll signaling pathway. Nature Immun. 2:835-841, 2001.

Further studies establishing the function and utilities of TIRAP are found in John Hopkins OMIM database record ID 606252, and in sited publications numbered 6137-6138 listed in the bibliography section hereinbelow, which are also hereby incorporated by reference. Baculoviral IAP Repeat-containing 3 (BIRC3, Accession XM_040715) is another VGAM189 host target gene. BIRC3 BINDING SITE is HOST TARGET binding site found in the 5' untranslated region of mRNA encoded by BIRC3, corresponding to a HOST TARGET binding site such as BINDING SITE I, BINDING SITE II or BINDING SITE III. Table 2 illustrates the complementarity of the nucleotide sequences of BIRC3 BINDING SITE, designated SEQ ID:33370, to the nucleotide sequence of VGAM189 RNA, herein designated VGAM RNA, also designated SEQ ID:2900.

Another function of VGAM189 is therefore inhibition of Baculoviral IAP Repeat-containing 3 (BIRC3, Accession XM_040715). Accordingly, utilities of VGAM189 include diagnosis, prevention and treatment of diseases and clinical conditions associated with BIRC3. Dynein, Axonemal, Light Polypeptide 4 (DNAL4, Accession NM_005740) is another VGAM189 host target gene. DNAL4 BINDING SITE is HOST TARGET binding site found in the 3' untranslated region of mRNA encoded by DNAL4, corresponding to a HOST TARGET binding site such as BINDING SITE I, BINDING SITE II or BINDING SITE III. Table 2 illustrates the complementarity of the nucleotide sequences of DNAL4 BINDING SITE, designated SEQ ID:12304, to the nucleotide sequence of VGAM189 RNA, herein designated VGAM RNA, also designated SEQ ID:2900.

Another function of VGAM189 is therefore inhibition of Dynein, Axonemal, Light Polypeptide 4 (DNAL4, Accession NM_005740). Accordingly, utilities of VGAM189 include diagnosis, prevention and treatment of diseases and clinical conditions associated with DNAL4. FLJ10656 (Accession NM_018170) is another VGAM189 host target gene. FLJ10656 BINDING SITE is HOST TARGET binding site found in the 3' untranslated region of mRNA encoded by FLJ10656, corresponding to a HOST TARGET binding site such as BINDING SITE I, BINDING SITE II or BINDING SITE III. Table 2 illustrates the complementarity of the nucleotide sequences of FLJ10656 BINDING SITE, designated SEQ ID:19987, to the nucleotide sequence of VGAM189 RNA, herein designated VGAM RNA, also designated SEQ ID:2900.

Another function of VGAM189 is therefore inhibition of FLJ10656 (Accession NM_018170). Accordingly, utilities of VGAM189 include diagnosis, prevention and treatment of diseases and clinical conditions associated with FLJ10656. FLJ21240 (Accession NM_024847) is another VGAM189 host target gene. FLJ21240 BINDING SITE is HOST TARGET binding site found in the 3' untranslated region of mRNA encoded by FLJ21240, corresponding to a HOST TARGET binding site such as BINDING SITE I, BINDING SITE II or BINDING SITE III. Table 2 illustrates the complementarity of the nucleotide sequences of FLJ21240 BINDING SITE, designated SEQ ID:24280, to the nucleotide sequence of VGAM189 RNA, herein designated VGAM RNA, also designated SEQ ID:2900.

Another function of VGAM189 is therefore inhibition of FLJ21240 (Accession NM_024847). Accordingly, utilities of VGAM189 include diagnosis, prevention and treatment of diseases and clinical conditions associated with FLJ21240. FLJ21302 (Accession NM_022901) is another VGAM189 host target gene. FLJ21302 BINDING SITE is HOST TARGET binding site found in the 3' untranslated region of mRNA encoded by FLJ21302, corresponding to a HOST TARGET binding site such as BINDING SITE I, BINDING SITE II or BINDING SITE III. Table 2 illustrates the complementarity of the nucleotide sequences of FLJ21302 BINDING SITE, designated SEQ ID:23184, to the nucleotide sequence of VGAM189 RNA, herein designated VGAM RNA, also designated SEQ ID:2900.

Another function of VGAM189 is therefore inhibition of FLJ21302 (Accession NM_022901). Accordingly, utilities of VGAM189 include diagnosis, prevention and treatment of diseases and clinical conditions associated with FLJ21302. KIAA0931 (Accession XM_041191) is another VGAM189 host target gene. KIAA0931 BINDING SITE is HOST TARGET binding site found in the 3' untranslated region of mRNA encoded by KIAA0931, corresponding to a HOST TARGET binding site such as BINDING SITE I, BINDING SITE II or BINDING SITE III. Table 2 illustrates the complementarity of the nucleotide sequences of KIAA0931 BINDING SITE, designated SEQ ID:33484, to the nucleotide sequence of VGAM189 RNA, herein designated VGAM RNA, also designated SEQ ID:2900.

Another function of VGAM189 is therefore inhibition of KIAA0931 (Accession XM_041191). Accordingly, utilities of VGAM189 include diagnosis, prevention and treatment of diseases and clinical conditions associated with KIAA0931. KIAA1348 (Accession XM_043826) is another VGAM189 host target gene. KIAA1348 BINDING SITE is HOST TARGET binding site found in the 3' untranslated region of mRNA encoded by KIAA1348, corresponding to a HOST TARGET binding site such as BINDING SITE I, BINDING SITE II or BINDING SITE III. Table 2 illustrates the complementarity of the nucleotide sequences of KIAA1348 BINDING SITE, designated SEQ ID:34028, to the nucleotide sequence of VGAM189 RNA, herein designated VGAM RNA, also designated SEQ ID:2900.

Another function of VGAM189 is therefore inhibition of KIAA1348 (Accession XM_043826). Accordingly, utilities of VGAM189 include diagnosis, prevention and treatment of diseases and clinical conditions associated with KIAA1348. Nucleoredoxin (NXN, Accession NM_022463) is another VGAM189 host target gene. NXN BINDING SITE is HOST TARGET binding site found in the 3' untranslated region of mRNA encoded by NXN, corresponding to a HOST TARGET binding site such as BINDING SITE I, BINDING SITE II or BINDING SITE III. Table 2 illustrates the complementarity of the nucleotide sequences of NXN BINDING SITE, designated SEQ ID:22804, to the nucleotide sequence of VGAM189 RNA, herein designated VGAM RNA, also designated SEQ ID:2900.

Another function of VGAM189 is therefore inhibition of Nucleoredoxin (NXN, Accession NM_022463). Accordingly, utilities of VGAM189 include diagnosis, prevention and treatment of diseases and clinical conditions associated with NXN. LOC147299 (Accession XM_085763) is another VGAM189 host target gene. LOC147299 BINDING SITE is HOST TARGET binding site found in the 5' untranslated region of mRNA encoded by LOC147299, corresponding to a HOST TARGET binding site such as BINDING SITE I, BINDING SITE II or BINDING SITE III. Table 2 illustrates the complementarity of the nucleotide sequences of LOC147299 BINDING SITE, designated SEQ ID:38334, to the nucleotide sequence of VGAM189 RNA, herein designated VGAM RNA, also designated SEQ ID:2900.

Another function of VGAM189 is therefore inhibition of LOC147299 (Accession XM_085763). Accordingly, utilities of VGAM189 include diagnosis, prevention and treatment of diseases and clinical conditions associated with LOC147299. LOC152627 (Accession XM_087495) is another VGAM189 host target gene. LOC152627 BINDING SITE is HOST TARGET binding site found in the 5' untranslated region of mRNA encoded by LOC152627, corresponding to a HOST TARGET binding site such as BINDING SITE I, BINDING SITE II or BINDING SITE III. Table 2 illustrates the complementarity of the nucleotide sequences of LOC152627 BINDING SITE, designated SEQ ID:39293, to the nucleotide sequence of VGAM189 RNA, herein designated VGAM RNA, also designated SEQ ID:2900.

Another function of VGAM189 is therefore inhibition of LOC152627 (Accession XM_087495). Accordingly, utilities of VGAM189 include diagnosis, prevention and treatment of diseases and clinical conditions associated with LOC152627. LOC221395 (Accession XM_166354) is another VGAM189 host target gene. LOC221395 BINDING SITE is HOST TARGET binding site found in the 3' untranslated region of mRNA encoded by LOC221395, corresponding to a HOST TARGET binding site such as BINDING SITE I, BINDING SITE II or BINDING SITE III. Table 2 illustrates the complementarity of the nucleotide sequences of LOC221395 BINDING SITE, designated SEQ ID:44183, to the nucleotide sequence of VGAM189 RNA, herein designated VGAM RNA, also designated SEQ ID:2900.

Another function of VGAM189 is therefore inhibition of LOC221395 (Accession XM_166354). Accordingly, utilities of VGAM189 include diagnosis, prevention and treatment of diseases and clinical conditions associated with LOC221395. LOC222001 (Accession XM_167489) is another VGAM189 host target gene. LOC222001 BINDING SITE is HOST TARGET binding site found in the 3' untranslated region of mRNA encoded by LOC222001, corresponding to a HOST TARGET binding site such as BINDING SITE I, BINDING SITE II or BINDING SITE III. Table 2 illustrates the complementarity of the nucleotide sequences of LOC222001 BINDING SITE, designated SEQ ID:44640, to the nucleotide sequence of VGAM189 RNA, herein designated VGAM RNA, also designated SEQ ID:2900.

Another function of VGAM189 is therefore inhibition of LOC222001 (Accession XM_167489). Accordingly, utilities of VGAM189 include diagnosis, prevention and treatment of diseases and clinical conditions associated with LOC222001. LOC222070 (Accession XM_168433) is another VGAM189 host target gene. LOC222070 BINDING SITE is HOST TARGET binding site found in the 5' untranslated region of mRNA encoded by LOC222070, corresponding to a HOST TARGET binding site such as BINDING SITE I, BINDING SITE II or BINDING SITE III. Table 2 illustrates the complementarity of the nucleotide sequences of LOC222070 BINDING SITE, designated SEQ ID:45174, to the nucleotide sequence of VGAM189 RNA, herein designated VGAM RNA, also designated SEQ ID:2900.

Another function of VGAM189 is therefore inhibition of LOC222070 (Accession XM_168433). Accordingly, utilities of VGAM189 include diagnosis, prevention and treatment of diseases and clinical conditions associated with LOC222070. LOC255326 (Accession XM_172832) is another VGAM189 host target gene. LOC255326 BINDING SITE is HOST TARGET binding site found in the 3' untranslated region of mRNA encoded by LOC255326, corresponding to a HOST TARGET binding site such as BINDING SITE I, BINDING SITE II or BINDING SITE III. Table 2 illustrates the complementarity of the nucleotide sequences of LOC255326 BINDING SITE, designated SEQ ID:46105, to the nucleotide sequence of VGAM189 RNA, herein designated VGAM RNA, also designated SEQ ID:2900.

Another function of VGAM189 is therefore inhibition of LOC255326 (Accession XM_172832). Accordingly, utilities of VGAM189 include diagnosis, prevention and treatment of diseases and clinical conditions associated with LOC255326. FIG. 1 further provides a conceptual description of a novel bioinformatically detected viral gene of the present invention, referred to here as Viral Genomic Address Messenger 190 (VGAM190) viral gene, which modulates expression of respective host target genes thereof, the function and utility of which host target genes is known in the art.

VGAM190 is a novel bioinformatically detected regulatory, non protein coding, viral micro RNA (miRNA) gene. The method by which VGAM190 was detected is described hereinabove with reference to FIGS. 1-8.

VGAM190 gene, herein designated VGAM GENE, is a viral gene contained in the genome of Shrimp White Spot Syndrome Virus (white spot bacilliform virus). VGAM190 host target gene, herein designated VGAM HOST TARGET GENE, is a human gene contained in the human genome.

VGAM190 gene encodes a VGAM190 precursor RNA, herein designated VGAM PRECURSOR RNA. Similar to other miRNA genes, and unlike most ordinary genes, VGAM190 precursor RNA does not encode a protein. A nucleotide sequence identical or highly similar to the nucleotide sequence of VGAM190 precursor RNA is designated SEQ ID:176, and is provided hereinbelow with reference to the sequence listing part. Nucleotide sequence SEQ ID:176 is located at position 18488 relative to the genome of Shrimp White Spot Syndrome Virus (white spot baciliform virus).

VGAM190 precursor RNA folds onto itself, forming VGAM190 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM190 folded precursor RNA into VGAM190 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM190 RNA is designated SEQ ID:2901, and is provided hereinbelow with reference to the sequence listing part.

VGAM190 host target gene, herein designated VGAM HOST TARGET GENE, encodes a corresponding messenger RNA, VGAM190 host target RNA, herein designated VGAM HOST TARGET RNA. VGAM190 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM190 RNA, herein designated VGAM RNA, binds complementarily to one or more host target binding sites located in untranslated regions of VGAM190 host target RNA, herein designated VGAM HOST TARGET RNA. This complementary binding is due to the fact that the nucleotide sequence of VGAM190 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM190 RNA, herein designated VGAM RNA, may have a different number of host target binding sites in untranslated regions of a VGAM190 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM190 RNA, herein designated VGAM RNA, to host target binding sites on VGAM190 host target RNA, herein designated VGAM HOST TARGET RNA, such as BINDING SITE I, BINDING SITE II and BINDING SITE III, inhibits translation of VGAM190 host target RNA into VGAM190 host target protein, herein designated VGAM HOST TARGET PROTEIN. VGAM host target protein is therefore outlined by a broken line.

It is appreciated that VGAM190 host target gene, herein designated VGAM HOST TARGET GENE, in fact represents a plurality of VGAM190 host target genes. The mRNA of each one of this plurality of VGAM190 host target genes comprises one or more host target binding sites, each having a nucleotide sequence which is at least partly complementary to VGAM190 RNA, herein designated VGAM RNA, and which when bound by VGAM190 RNA causes inhibition of translation of respective one or more VGAM190 host target proteins.

It is further appreciated by one skilled in the art that the mode of translational inhibition illustrated by FIG. 1 with specific reference to translational inhibition exerted by VGAM190 gene, herein designated VGAM GENE, on one or more VGAM190 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM190 is inhibition of expression of host target genes, as part of a novel viral mechanism of attacking a host. Accordingly, utilities of VGAM190 include diagnosis, prevention and treatment of viral infection by Shrimp White Spot Syndrome Virus (white spot baciliform virus). Specific functions, and accordingly utilities, of VGAM190 correlate with, and may be deduced from, the identity of the host target genes which VGAM190 binds and inhibits, and the function of these host target genes, as elaborated hereinbelow.

Nucleotide sequences of the VGAM190 precursor RNA, herein designated VGAM PRECURSOR RNA, and of the 'diced' VGAM190 RNA, herein designated VGAM RNA, and a schematic representation of the secondary folding of VGAM190 folded precursor RNA, herein designated VGAM FOLDED PRECURSOR RNA, of VGAM190 are further described hereinbelow with reference to Table 1.

Nucleotide sequences of host target binding sites, such as BINDING SITE-I, BINDING SITE-II and BINDING SITE-III of FIG. 1, found on VGAM190 host target RNA, and schematic representation of the complementarity of each of these host target binding sites to VGAM190 RNA, herein designated VGAM RNA, are described hereinbelow with reference to Table 2.

As mentioned hereinabove with reference to FIG. 1, a function of VGAM190 gene, herein designated VGAM is inhibition of expression of VGAM190 target genes. It is appreciated that specific functions, and accordingly utilities, of VGAM190 correlate with, and may be deduced from, the identity of the target genes which VGAM190 binds and inhibits, and the function of these target genes, as elaborated hereinbelow.

B-cell CLL/lymphoma 11A (zinc finger protein) (BCL11A, Accession NM_022893) is a VGAM190 host target gene. BCL11A BINDING SITE is HOST TARGET binding site found in the 3' untranslated region of mRNA encoded by BCL11A, corresponding to a HOST TARGET binding site such as BINDING SITE I, BINDING SITE II or BINDING SITE III. Table 2 illustrates the complementarity of the nucleotide sequences of BCL11A BINDING SITE, designated SEQ ID:23152, to the nucleotide sequence of VGAM190 RNA, herein designated VGAM RNA, also designated SEQ ID:2901.

A function of VGAM190 is therefore inhibition of B-cell CLL/lymphoma 11A (zinc finger protein) (BCL11A, Accession NM_022893), a gene which acts as a transcriptional repressor. Accordingly, utilities of VGAM190 include diagnosis, prevention and treatment of diseases and clinical conditions associated with BCL11A. The function of BCL11A has been established by previous studies. By screening a fetal brain cDNA library with mouse Evi9 as probe, Saiki et al. (2000) isolated a cDNA encoding EVI9, also termed BCL11A, and a shorter splice variant, EVI9C. Sequence analysis predicted that the 797-amino acid BCL11A protein, which is 99% identical to the mouse protein apart from an additional 35 N-terminal residues, contains 3 C2H2-type zinc finger motifs, a proline-rich region, and an acidic domain. Northern blot analysis revealed highest expression in brain, spleen, and testis. RT-PCR analysis detected expression in most hematopoietic cells but down regulation during monocytic differentiation. Satterwhite et al. (2001) reported the recurrent involvement and deregulated expression of BCL11A in 4 cases of B-cell malignancy with the translocation t (2;14)(p13; q32.3). They noted that this translocation is a rare cytogenetic abnormality in the clinically aggressive subset of B-cell chronic lymphocytic leukemia (OMIM Ref. No. 151400)/immunocytoma. FISH analysis showed colocalization of BCL11A and REL (OMIM Ref. No. 164910) in B-cell non-Hodgkin lymphoma (OMIM Ref. No. 605027). Satterwhite et al. (2001) also identified a BCL11A homolog, BCL11B (OMIM Ref. No. 606558). Comparative genomic hybridization studies showed gains in chromosome region 2p as the most common imbalance in classical Hodgkin lymphoma. The minimal region of gain contained 2 candidate oncogenes, REL and BCL11A. Martin-Subero et al. (2002) examined the involvement of REL and BCL11A loci in 44 primary cases of classic Hodgkin lymphoma by combined immunophenotyping and interphase cytogenetics. A median 2p13 copy number above the tetraploid range was detected in 24 (55%) cases. One case displayed selective amplification of the REL locus not affecting BCL11A. Two other cases showed evidence of breakpoints in the region spanned by the REL probe. These data indicated that REL rather than BCL11A may be the target of the 2p13 alterations in classic Hodgkin lymphoma.

Full details of the abovementioned studies are described in the following publications, the disclosure of which are hereby incorporated by reference:

Satterwhite, E.; Sonoki, T.; Willis, T. G.; Harder, L.; Nowak, R.; Arriola, E. L.; Liu, H.; Price, H. P.; Gesk, S.; Steinemann, D.; Schlegelberger, B.; Oscier, D. G.; Siebert, R.; Tucker, P. W.; Dyer, M. J. S.: The BCL11 gene family: involvement of BCL11A in lymphoid malignancies. Blood 98:3413-3420, 2001; and Martin-Subero, J. I.; Gesk, S.; Harder, L.; Sonoki, T.; Tucker, P. W.; Schlegelberger, B.; Grote, W.; Novo, F. J.; Calasanz, M. J.; Hansmann, M. L.; Dyer, M. J. S.; Siebert, R.: Recurr.

Further studies establishing the function and utilities of BCL11A are found in John Hopkins OMIM database record ID 606557, and in sited publications numbered 11660-5556 listed in the bibliography section hereinbelow, which are also hereby incorporated by reference. CDT6 (Accession NM_021146) is another VGAM190 host target gene. CDT6 BINDING SITE is HOST TARGET binding site found in the 3' untranslated region of mRNA encoded by CDT6, corresponding to a HOST TARGET binding site such as BINDING SITE I, BINDING SITE II or BINDING SITE III. Table 2 illustrates the complementarity of the nucleotide sequences of CDT6 BINDING SITE, designated SEQ ID:22120, to the nucleotide sequence of VGAM190 RNA, herein designated VGAM RNA, also designated SEQ ID:2901.

Another function of VGAM190 is therefore inhibition of CDT6 (Accession NM_021146). Accordingly, utilities of VGAM190 include diagnosis, prevention and treatment of diseases and clinical conditions associated with CDT6. GFR (Accession NM_012294) is another VGAM190 host target gene. GFR BINDING SITE is HOST TARGET binding site found in the 3' untranslated region of mRNA encoded by GFR, corresponding to a HOST TARGET binding site such as BINDING SITE I, BINDING SITE II or BINDING SITE III. Table 2 illustrates the complementarity of the nucleotide sequences of GFR BINDING SITE, designated SEQ ID:14634, to the nucleotide sequence of VGAM190 RNA, herein designated VGAM RNA, also designated SEQ ID:2901.

Another function of VGAM190 is therefore inhibition of GFR (Accession NM_012294). Accordingly, utilities of VGAM190 include diagnosis, prevention and treatment of diseases and clinical conditions associated with GFR. Hemogen (HEMGN, Accession NM_018437) is another VGAM190 host target gene. HEMGN BINDING SITE is HOST TARGET binding site found in the 5' untranslated region of mRNA encoded by HEMGN, corresponding to a HOST TARGET binding site such as BINDING SITE I, BINDING SITE II or BINDING SITE III. Table 2 illustrates the complementarity of the nucleotide sequences of HEMGN BINDING SITE, designated SEQ ID:20499, to the nucleotide sequence of VGAM190 RNA, herein designated VGAM RNA, also designated SEQ ID:2901.

Another function of VGAM190 is therefore inhibition of Hemogen (HEMGN, Accession NM_018437). Accordingly, utilities of VGAM190 include diagnosis, prevention and treatment of diseases and clinical conditions associated with HEMGN. KIAA0155 (Accession NM_014633) is another VGAM190 host target gene. KIAA0155 BINDING SITE is HOST TARGET binding site found in the 3' untranslated region of mRNA encoded by KIAA0155, corresponding to a HOST TARGET binding site such as BINDING SITE I, BINDING SITE II or BINDING SITE III. Table 2 illustrates the complementarity of the nucleotide sequences of KIAA0155 BINDING SITE, designated SEQ ID:16001, to the nucleotide sequence of VGAM190 RNA, herein designated VGAM RNA, also designated SEQ ID:2901.

Another function of VGAM190 is therefore inhibition of KIAA0155 (Accession NM_014633). Accordingly, utilities of VGAM190 include diagnosis, prevention and treatment of diseases and clinical conditions associated with KIAA0155. Ubiquitin Specific Protease 25 (USP25, Accession NM_013396) is another VGAM190 host target gene. USP25 BINDING SITE is HOST TARGET binding site found in the 3' untranslated region of mRNA encoded by USP25, corresponding to a HOST TARGET binding site such as BINDING SITE I, BINDING SITE II or BINDING SITE III. Table 2 illustrates the complementarity of the nucleotide sequences of USP25 BINDING SITE, designated SEQ ID:15048, to the nucleotide sequence of VGAM190 RNA, herein designated VGAM RNA, also designated SEQ ID:2901.

Another function of VGAM190 is therefore inhibition of Ubiquitin Specific Protease 25 (USP25, Accession NM_013396). Accordingly, utilities of VGAM190 include diagnosis, prevention and treatment of diseases and clinical conditions associated with USP25. LOC200269 (Accession XM_114175) is another VGAM190 host target gene. LOC200269 BINDING SITE is HOST TARGET binding site found in the 3' untranslated region of mRNA encoded by LOC200269, corresponding to a HOST TARGET binding site such as BINDING SITE I, BINDING SITE II or BINDING SITE III. Table 2 illustrates the complementarity of the nucleotide sequences of LOC200269 BINDING SITE, designated SEQ ID:42762, to the nucleotide sequence of VGAM190 RNA, also designated VGAM RNA, designated SEQ ID:2901.

Another function of VGAM190 is therefore inhibition of LOC200269 (Accession XM_114175). Accordingly, utilities of VGAM190 include diagnosis, prevention and treatment of diseases and clinical conditions associated with LOC200269. FIG. 1 further provides a conceptual description of a novel bioinformatically detected viral gene of the present invention, referred to here as Viral Genomic Address Messenger 191 (VGAM191) viral gene, which modulates expression of respective host target genes thereof, the function and utility of which host target genes is known in the art.

VGAM191 is a novel bioinformatically detected regulatory, non protein coding, viral micro RNA (miRNA) gene. The method by which VGAM191 was detected is described hereinabove with reference to FIGS. 1-8.

VGAM191 gene, herein designated VGAM GENE, is a viral gene contained in the genome of Shrimp White Spot Syndrome Virus (white spot bacilliform virus). VGAM191 host target gene, herein designated VGAM HOST TARGET GENE, is a human gene contained in the human genome.

VGAM191 gene encodes a VGAM191 precursor RNA, herein designated VGAM PRECURSOR RNA. Similar to other miRNA genes, and unlike most ordinary genes, VGAM191 precursor RNA does not encode a protein. A nucleotide sequence identical or highly similar to the nucleotide sequence of VGAM191 precursor RNA is designated SEQ ID:177, and is provided hereinbelow with reference to the sequence listing part. Nucleotide sequence SEQ ID:177 is located at position 229393 relative to the genome of Shrimp White Spot Syndrome Virus (white spot bacilliform virus).

VGAM191 precursor RNA folds onto itself, forming VGAM191 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM191 folded precursor RNA into VGAM191 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM191 RNA is designated SEQ ID:2902, and is provided hereinbelow with reference to the sequence listing part.

VGAM191 host target gene, herein designated VGAM HOST TARGET GENE, encodes a corresponding messenger RNA, VGAM191 host target RNA, herein designated VGAM HOST TARGET RNA. VGAM191 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM191 RNA, herein designated VGAM RNA, binds complementarily to one or more host target binding sites located in untranslated regions of VGAM191 host target RNA, herein designated VGAM HOST TARGET RNA. This complementary binding is due to the fact that the nucleotide sequence of VGAM191 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM191 RNA, herein designated VGAM RNA, may have a different number of host target binding sites in untranslated regions of a VGAM191 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM191 RNA, herein designated VGAM RNA, to host target binding sites on VGAM191 host target RNA, herein designated VGAM HOST TARGET RNA, such as BINDING SITE I, BINDING SITE II and BINDING SITE III, inhibits translation of VGAM191 host target RNA into VGAM191 host target protein, herein designated VGAM HOST TARGET PROTEIN. VGAM host target protein is therefore outlined by a broken line.

It is appreciated that VGAM191 host target gene, herein designated VGAM HOST TARGET GENE, in fact represents a plurality of VGAM191 host target genes. The mRNA of each one of this plurality of VGAM191 host target genes comprises one or more host target binding sites, each having a nucleotide sequence which is at least partly complementary to VGAM191 RNA, herein designated VGAM RNA, and which when bound by VGAM191 RNA causes inhibition of translation of respective one or more VGAM191 host target proteins.

It is further appreciated by one skilled in the art that the mode of translational inhibition illustrated by FIG. 1 with specific reference to translational inhibition exerted by VGAM191 gene, herein designated VGAM GENE, on one or more VGAM191 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM191 is inhibition of expression of host target genes, as part of a novel viral mechanism of attacking a host. Accordingly, utilities of VGAM191 include diagnosis, prevention and treatment of viral infection by Shrimp White Spot Syndrome Virus (white spot bacilliform virus). Specific functions, and accordingly utilities, of VGAM191 correlate with, and may be deduced from, the identity of the host target genes which VGAM191 binds and inhibits, and the function of these host target genes, as elaborated hereinbelow.

Nucleotide sequences of the VGAM191 precursor RNA, herein designated VGAM PRECURSOR RNA, and of the 'diced' VGAM191 RNA, herein designated VGAM RNA, and a schematic representation of the secondary folding of VGAM191 folded precursor RNA, herein designated VGAM FOLDED PRECURSOR RNA, of VGAM191 are further described hereinbelow with reference to Table 1.

Nucleotide sequences of host target binding sites, such as BINDING SITE-I, BINDING SITE-II and BINDING SITE-III of FIG. 1, found on VGAM191 host target RNA, and schematic representation of the complementarity of each of these host target binding sites to VGAM191 RNA, herein designated VGAM RNA, are described hereinbelow with reference to Table 2.

As mentioned hereinabove with reference to FIG. 1, a function of VGAM191 gene, herein designated VGAM is inhibition of expression of VGAM191 target genes. It is appreciated that specific functions, and accordingly utilities, of VGAM191 correlate with, and may be deduced from, the identity of the target genes which VGAM191 binds and inhibits, and the function of these target genes, as elaborated hereinbelow.

Chediak-Higashi Syndrome 1 (CHS1, Accession NM_000081) is a VGAM191 host target gene. CHS1 BINDING SITE is HOST TARGET binding site found in the 3' untranslated region of mRNA encoded by CHS1, corresponding to a HOST TARGET binding site such as BINDING SITE I, BINDING SITE II or BINDING SITE III. Table 2 illustrates the complementarity of the nucleotide sequences of CHS1 BINDING SITE, designated SEQ ID:5525, to the nucleotide sequence of VGAM191 RNA, herein designated VGAM RNA, also designated SEQ ID:2902.

A function of VGAM191 is therefore inhibition of Chediak-Higashi Syndrome 1 (CHS1, Accession NM_000081), a gene which may sort endosomal resident proteins into late multivesicular endosome. Accordingly, utilities of VGAM191 include diagnosis, prevention and treatment of diseases and clinical conditions associated with CHS1. The function of CHS1 has been established by previous studies. Barbosa et al. (1997) identified novel mutations within the region of the coding domain common to both CHS1 isoforms in 3 CHS patients: C-to-T transitions that generated stop codons (R50X; 606897.0006 and Q1029X; 606897.0007) were found in 2 patients, and a novel frameshift mutation (deletion of nucleotides 3073 and 3074 of the coding domain) was found in a third. Northern blots of lymphoblastoid mRNA from CHS patients revealed loss of the largest transcript (approximately 13.5 kb) in 2 of 7 CHS patients, while the small mRNA was undiminished in abundance. These results suggested that the small isoform alone cannot complement Chediak-Higashi syndrome. All beige and CHS1 mutations that had been identified were predicted to result in either truncated or absent proteins. Although Perou et al. (1996) and Barbosa et al. (1996) reported identification of the 'beige' gene, the 2 cDNAs were quite different. Nagle et al. (1996) described the sequence of a human cDNA homologous to mouse 'beige,' identified pathologic mutations in patients with Chediak-Higashi syndrome, and clarified the discrepancies of the previous reports of sequence. Analysis of the CHS1 polypeptide demonstrated that its modular architecture is similar to that of the yeast vacuolar sorting protein VPS15. Nagle et al. (1996) screened human cDNA libraries with mouse 'beige' probes to yield the human 'beige' cDNA homolog, and found 87.9% amino acid identity between the 2 sequences. The predicted human protein comprises 3,801 amino acids, with a molecular mass of approximately 43 kD. Barbosa et al. (1997) reported the sequences of 2 major mRNA isoforms of the CHS1 gene in human and mouse. These isoforms differ both in size and in sequence at the 3-prime end of their coding domains, with a small isoform (approximately 5.8 kb) arising from incomplete splicing and reading through an intron. These mRNAs also differ in tissue distribution of transcription and in predicted biologic properties.

Full details of the abovementioned studies are described in the following publications, the disclosure of which are hereby incorporated by reference:

Karim, M. A.; Nagle, D. L.; Kandil, H. H.; Burger, J.; Moore, K. J.; Spritz, R. A.: Mutations in the Chediak-Higashi syndrome gene (CHS1) indicate requirement for the complete 3801 amino acid CHS protein. Hum. Molec. Genet. 6:1087-1089, 1997; and Barbosa, M. D. F. S.; Barrat, F. J.; Tchernev, V. T.; Nguyen, Q. A.; Mishra, V. S.; Colman, S. D.; Pastural, E.; Dufourcq-Lagelouse, R.; Fischer, A.; Holcombe, R. F.; Wallace, M. R.; Bra.

Further studies establishing the function and utilities of CHS1 are found in John Hopkins OMIM database record ID 606897, and in sited publications numbered 10101, 10102-10104, 5267-5268, 4584, 5269, 10105-1010 and 5270-5271 listed in the bibliography section hereinbelow, which are also hereby incorporated by reference. E1A Binding Protein P300 (EP300, Accession NM_001429) is another VGAM191 host target gene. EP300 BINDING SITE is HOST TARGET binding site found in the 3' untranslated region of mRNA encoded by EP300, corresponding to a HOST TARGET binding site such as BINDING SITE I, BINDING SITE II or BINDING SITE III. Table 2 illustrates the complementarity of the nucleotide sequences of EP300 BINDING SITE, designated SEQ ID:7153, to the nucleotide sequence of VGAM191 RNA, herein designated VGAM RNA, also designated SEQ ID:2902.

Another function of VGAM191 is therefore inhibition of E1A Binding Protein P300 (EP300, Accession NM_001429), a gene which may have a function in cell cycle regulation. Accordingly, utilities of VGAM191 include diagnosis, prevention and treatment of diseases and clinical conditions associated with EP300. The function of EP300 has been established by previous studies. The growth-controlling functions of the adenovirus E1A oncoprotein depend on its ability to interact with a set of cellular proteins. Among these are the retinoblastoma protein, p107, p130, and p300. Eckner et al. (1994) isolated a cDNA encoding full-length human p300. p300 contains 3 cysteine- and histidine-rich regions of which the most carboxy-terminal region interacts specifically with E1A. In its center, p300 contains a bromodomain, a hallmark of certain transcriptional coactivators. p300 and CREB-binding protein (CREBBP, or CBP; 600140) are highly related in primary structure (Arany et al., 1994). Several protein motifs such as a bromodomain, a KIX domain, and 3 regions rich in cys/his residues are well conserved between these 2 proteins. Animal model experiments lend further support to the function of EP300. The EP300 protein is a histone acetyltransferase that regulates transcription via chromatin remodeling and is important in the processes of cell proliferation and differentiation. A role for EP300 in cancer had been implied by the fact that it is targeted by viral oncoproteins (Arany et al., 1995), it is fused to MLL (OMIM Ref. No. 159555) in leukemia (Ida et al., 1997), and 2 missense sequence alterations in EP300 were identified in epithelial malignancies (Muraoka et al., 1996). Gayther et al. (2000) described EP300 mutations that predicted a truncated protein in 6 (3%) of 193 epithelial cancers analyzed. Of these 6 mutations, 2 were in primary tumors (a colorectal cancer and a breast cancer) and 4 were in cancer cell lines (colorectal, breast, and pancreatic). In addition, they identified a somatic in-frame insertion in a primary breast cancer and missense alterations in a primary colorectal cancer and 2 cell lines (breast and pancreatic). Inactivation of the second allele was demonstrated in 5 of the 6 cases with truncating mutations and in 2 other cases. The data showed that EP300 is mutated in epithelial cancers and provided the first evidence that it behaves as a classic tumor suppressor gene.

It is appreciated that the abovementioned animal model for EP300 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Tini, M.; Benecke, A.; Um, S.-J.; Torchia, J.; Evans, R. M.; Chambon, P.: Association of CBP/p300 acetylase and thymine DNA glycosylase links DNA repair and transcription. Molec. Cell 9:265-277, 2002; and Lin, C. H.; Hare, B. J.; Wagner, G.; Harrison, S. C.; Maniatis, T.; Fraenkel, E. : A small domain of CBP/p300 binds diverse proteins: solution structure and functional studies. Molec. C.

Further studies establishing the function and utilities of EP300 are found in John Hopkins OMIM database record ID 602700, and in sited publications numbered 7969, 10673, 1792, 7102, 10674, 3381, 10686-1068 and 1045 listed in the bibliography section hereinbelow, which are also hereby incorporated by reference. GA Binding Protein Transcription Factor, Beta Subunit 1, 53 kDa (GABPB1, Accession NM_005254) is another VGAM191 host target gene. GABPB1 BINDING SITE is HOST TARGET binding site found in the 3' untranslated region of mRNA encoded by GABPB1, corresponding to a HOST TARGET binding site such as BINDING SITE I, BINDING SITE II or BINDING SITE III. Table 2 illustrates the complementarity of the nucleotide sequences of GABPB1 BINDING SITE, designated SEQ ID:11760, to the nucleotide sequence of VGAM191 RNA, herein designated VGAM RNA, also designated SEQ ID:2902.

Another function of VGAM191 is therefore inhibition of GA Binding Protein Transcription Factor, Beta Subunit 1, 53 kDa (GABPB1, Accession NM_005254), a gene which activates adenovirus E4 gene transcription. Accordingly, utilities of VGAM191 include diagnosis, prevention and treatment of diseases and clinical conditions associated with GABPB1. The function of GABPB1 has been established by previous studies. The GA-binding protein transcription factor, also called nuclear respiratory factor-2 (NRF2), was originally identified through its role in the expression of the adenovirus E4 gene. The GABP complex contributes to the transcriptional regulation of a number of subunits of mitochondrial enzymes, including cytochrome c oxidase (CO; OMIM Ref. No. 516030).

Full details of the abovementioned studies are described in the following publications, the disclosure of which are hereby incorporated by reference:

Gugneja, S.; Virbasius, J. V.; Scarpulla, R. C.: Four structurally distinct, non-DNA-binding subunits of human nuclear respiratory factor 2 share a conserved transcriptional activation domain. Molec. Cell. Biol. 15:102-111, 1995; and Sawada, J.; Goto, M.; Watanabe, H.; Handa, H.; Yoshida, M. C.: Regional mapping of two subunits of transcription factor E4TF1 to human chromosome. Jpn. J. Cancer Res. 86:10-12, 1995.

Further studies establishing the function and utilities of GABPB1 are found in John Hopkins OMIM database record ID 600610, and in sited publications numbered 10057, 1005 and 10061 listed in the bibliography section hereinbelow, which are also hereby incorporated by reference. Low Density Lipoprotein Receptor-related Protein 8, Apolipoprotein E Receptor (LRP8, Accession NM_004631) is another VGAM191 host target gene. LRP8 BINDING SITE1 and LRP8 BINDING SITE2 are HOST TARGET binding sites found in untranslated regions of mRNA encoded by LRP8, corresponding to HOST TARGET binding sites such as BINDING SITE I, BINDING SITE II or BINDING SITE III. Table 2 illustrates the complementarity of the nucleotide sequences of LRP8 BINDING SITE1 and LRP8 BINDING SITE2, designated SEQ ID:11004 and SEQ ID:27128 respectively, to the nucleotide sequence of VGAM191 RNA, herein designated VGAM RNA, also designated SEQ ID:2902.

Another function of VGAM191 is therefore inhibition of Low Density Lipoprotein Receptor-related Protein 8, Apolipoprotein E Receptor (LRP8, Accession NM_004631), a gene which binds vldl and transports it into cells by endocytosis. Accordingly, utilities of VGAM191 include diagnosis, prevention and treatment of diseases and clinical conditions associated with LRP8. The function of LRP8 has been established by previous studies. Apolipoprotein E (APOE; 107741) is a 34-kD lipophilic protein that mediates high-affinity binding of APOE-containing lipoproteins to the low density lipoprotein receptor (see OMIM Ref. No. LDLR; 606945) and the very low density lipoprotein receptor (VLDLR; 192977). By screening a human placenta cDNA library with degenerate oligonucleotides based on a highly conserved region between LDLR and VLDLR, Kim et al. (1996) identified a cDNA encoding APOE receptor-2 (OMIM Ref. No. APOER2). The predicted 963-amino acid protein contains a putative 41-amino acid signal sequence and 5 functional domains that resemble those of LDLR and VLDLR. APOER2 appears specific for APOE-containing ligands: LDLR-deficient mammalian cells expressing APOER bound APOE-rich beta-VLDL with high affinity, but bound LDL and VLDL with much lower affinities. Northern blot analysis revealed that APOER2 is expressed as 4.5- and 8.5-kb mRNAs in brain and placenta Kim et al. (1997) reported that the APOER2 gene contains 19 exons and spans approximately 60 kb. Alternative splicing generates multiple transcripts encoding receptors with different numbers of cysteine-rich repeats in the ligand-binding domain Full details of the abovementioned studies are described in the following publications, the disclosure of which are hereby incorporated by reference:

Kim, D.-H.; Iijima, H.; Goto, K.; Sakai, J.; Ishii, H.; Kim, H.-J.; Suzuki, H.; Kondo, H.; Saeki, S.; Yamamoto, T.: Human apolipoprotein E receptor 2: a novel lipoprotein receptor of the low density lipoprotein receptor family predominantly expressed in brain. J. Biol. Chem. 271:8373-8380, 1996; and Kim, D.-H.; Magoori, K.; Inoue, T. R.; Mao, C. C.; Kim, H.-J.; Suzuki, H.; Fujita, T.; Endo, Y.; Saeki, S.; Yamamoto, T. T.: Exon/intron organization, chromosome localization, alternativ.

Further studies establishing the function and utilities of LRP8 are found in John Hopkins OMIM database record ID 602600, and in sited publications numbered 10019-825 and 10024 listed in the bibliography section hereinbelow, which are also hereby incorporated by reference. Neurexin 1 (NRXN1, Accession NM_004801) is another VGAM191 host target gene. NRXN1 BINDING SITE1 and NRXN1 BINDING SITE2 are HOST TARGET binding sites found in untranslated regions of mRNA encoded by NRXN1, corresponding to HOST TARGET binding sites such as BINDING SITE I, BINDING SITE II or BINDING SITE III. Table 2 illustrates the complementarity of the nucleotide sequences of NRXN1 BINDING SITE1 and NRXN1 BINDING SITE2, designated SEQ ID:11223 and SEQ ID:28997 respectively, to the nucleotide sequence of VGAM191 RNA, herein designated VGAM RNA, also designated SEQ ID:2902.

Another function of VGAM191 is therefore inhibition of Neurexin 1 (NRXN1, Accession NM_004801), a gene which may be involved in cell recognition, cell adhesion, and mediate intracellular signaling. Accordingly, utilities of VGAM191 include diagnosis, prevention and treatment of diseases and clinical conditions associated with NRXN1. The function of NRXN1 has been established by previous studies. Neurexins are polymorphic cell surface proteins that are expressed in neurons. They were discovered by Ushkaryov et al. (1992) in the course of cloning the presynaptic receptor for alpha-latrotoxin. Three neurexin genes, designated 1 (NRXN1), 2 (NRXN2; 600566), and 3 (NRXN3; 600567), were identified in a rat brain cDNA library by Ushkaryov et al. (1992). Ichtchenko et al. (1995) observed that each neurexin gene has 2 independent promoters which generate 2 classes of mRNAs: the longer mRNAs encode alpha-neurexins and the shorter mRNAs encode beta-neurexins. Thus, 6 principal neurexin isoforms, called neurexins I-alpha to III-beta, result, of which neurexin I-alpha corresponds to the high molecular weight component of the alpha-latrotoxin receptor. Ushkaryov et al. (1992) showed that rat neurexins are expressed at significant levels only in brain. Ullrich et al. (1995) found that the 6 rat neurexin isoforms are coexpressed in neurons and are distributed differentially in various brain regions. Neurexins display a remarkable evolutionarily conserved pattern of extensive alternative splicing. As a result, the total number of neurexins in brain probably exceeds 2,000 (Ullrich et al., 1995). Neurexins contain epidermal growth factor-like sequences and domains homologous to the G domain repeats of laminin A (LAMA; 150320), indicating a function in cell-cell interactions. Animal model experiments lend further support to the function of NRXN1. Alpha-latrotoxin is a potent neurotoxin from black widow spider venom that binds to presynaptic receptors and causes massive neurotransmitter release. In rat, 2 alpha-latrotoxin receptors have been identified: neurexin I-alpha, which binds the toxin in a calcium-dependent manner, and CIRL/latrophilin, which binds in a calcium-independent manner. Geppert et al. (1998) isolated the mouse neurexin I-alpha gene and found that it contains a large first exon of more than 1.5 kb that extends to the first site of alternative splicing in the coding region. To evaluate the importance of neurexin I-alpha in alpha-latrotoxin action, Geppert et al. (1998) generated mice carrying a deletion of the first exon of the neurexin I-alpha gene. Homozygous mutant mice lacked neurexin I-alpha, although the levels of neurexin I-beta were unaffected. The mutant mice were viable and fertile, and were indistinguishable in appearance from wildtype animals. The only abnormality observed was that female knockout mice were less able to attend to litters, leading to the death of more pups independent of pup genotype. Geppert et al. (1998) found that alpha-latrotoxin binding to brain membranes from mutant mice was decreased by almost 50% compared with wildtype membranes. In cultured hippocampal neurons from mutant mice, the toxin was still capable of activating neurotransmission. However, measurements of glutamate release from synaptosomes indicated a major decrease in the amount of release triggered by alpha-latrotoxin in the presence of calcium. The authors concluded that neurexin I-alpha is not essential for alpha-latrotoxin action but contributes to toxin action when calcium is present. They suggested that the action of alpha-latrotoxin may be mediated by independent parallel pathways.

It is appreciated that the abovementioned animal model for NRXN1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Geppert, M.; Khvotchev, M.; Krasnoperov, V.; Goda, Y.; Missler, M.; Hammer, R. E.; Ichtchenko, K.; Petrenko, A. G.; Sudhof, T. C.: Neurexin I-alpha is a major alpha-latrotoxin receptor that cooperates in alpha-latrotoxin action. J. Biol. Chem. 273:1705-1710, 1998; and Ushkaryov, Y. A.; Petrenko, A. G.; Geppert, M.; Sudhof, T. C.: Neurexins: synaptic cell surface proteins related to the alpha-latrotoxin receptor and laminin. Science 257:50-56, 199.

Further studies establishing the function and utilities of NRXN1 are found in John Hopkins OMIM database record ID 600565, and in sited publications numbered 8169-8173, 673 and 9525-9528 listed in the bibliography section hereinbelow, which are also hereby incorporated by reference. Pleckstrin Homology, Sec7 and Coiled/coil Domains 3 (PSCD3, Accession NM_004227) is another VGAM191 host target gene. PSCD3 BINDING SITE is HOST TARGET binding site found in the 3' untranslated region of mRNA encoded by PSCD3, corresponding to a HOST TARGET binding site such as BINDING SITE I, BINDING SITE II or BINDING SITE III. Table 2 illustrates the complementarity of the nucleotide sequences of PSCD3 BINDING SITE, designated SEQ ID:10423, to the nucleotide sequence of VGAM191 RNA, herein designated VGAM RNA, also designated SEQ ID:2902.

Another function of VGAM191 is therefore inhibition of Pleckstrin Homology, Sec7 and Coiled/coil Domains 3 (PSCD3, Accession NM_004227), a gene which regulates vesicle trafficking in eukaryotic cells. Accordingly, utilities of VGAM191 include diagnosis, prevention and treatment of diseases and clinical conditions associated with PSCD3. The function of PSCD3 has been established by previous studies. ADP-ribosylation factors, or ARFS (see OMIM Ref. No. ARF1; 103180), are small GTP-binding proteins within the Ras superfamily that regulate vesicle trafficking in eukaryotic cells. ARF1 recruits coat proteins (e.g., COPA; 601924) to membranes on the cytoplasmic face of the Golgi apparatus. The PSCD proteins (e.g., PSCD1; 182115), a family of proteins containing a C-terminal pleckstrin homology (PH) domain and a central 200-amino acid region similar to a domain within the yeast Sec7 protein, which is required for vesicular traffic of polypeptides through the Golgi, function as guanine-nucleotide exchange factors (GEFs) for ARFs. Klarlund et al. (1997) identified a cDNA encoding mouse Grp1 (general receptor for phosphoinositides-1) by screening mouse adipocyte and brain cDNA expression libraries with phosphoinositide probes. By searching an EST database for sequences similar to mouse brain Grp1, followed by PCR and screening of a human blood cDNA library, Venkateswarlu et al. (1998) obtained a cDNA encoding PSCD3, which they called GRP1. Sequence analysis showed that the predicted 399-amino acid PSCD3 protein contains a 39-amino acid coiled-coil domain, a 172-amino acid Sec7 domain, and a 118-amino acid PH domain. PSCD3 shares 82.7% and 79.5% amino acid identity with PSCD1 and PSCD2 (OMIM Ref. No. 602488), respectively, as well as 98.8% identity with mouse Grp1. By Scatchard and mutational analyses, Venkateswarlu et al. (1998) determined that PSCD3 binds via its PH domain to the inositol head group of phosphatidylinositol 3,4,5-triphosphate with high affinity. Confocal laser microscopy demonstrated that stimulation of cells with either epidermal growth factor (EGF; 131530) or nerve growth factor (NGF; 162030) results in PH domain-dependent translocation of PSCD3 from the cytosol to the plasma membrane. The translocation was rapid and transient with EGF, whereas NGF mediated a relatively longer translocation. By searching an EST database for Sec7 domain-related sequences and by screening a placenta cDNA library, Franco et al. (1998) isolated a cDNA encoding PSCD3, which they called ARNO3. Northern blot analysis revealed that PSCD3, in contrast to the ubiquitously expressed PSCD1 and PSCD2, is expressed as a 4.5-kb transcript that is almost absent from liver, thymus, and peripheral blood lymphocytes. Franco et al. (1998) found that PSCD3, like PSCD1 and PSCD2, shows GEF activity, mediated by the Sec7 domain, towards ARF1 but not ARF6 (OMIM Ref. No. 600464). Immunofluorescence microscopy indicated that overexpression of PSCD3 induces major morphologic alterations of the Golgi apparatus, including redistribution of Golgi resident proteins and the coat protein COPB (OMIM Ref. No. 600959). Lietzke et al. (2000) and Ferguson et al. (2000) determined the structure of the GRP1 PH domain in the unliganded form and bound to inositol 1,3,4,5-tetraphosphate. Lietzke et al. (2000) found that a novel mode of phosphoinositide recognition involving a 20-residue insertion within the beta-6/beta-7 loop explains the unusually high specificity of the GRP1 PH domain and the promiscuous 3-phosphoinositide binding typical of several other PH domains, including that of protein kinase B (AKT1; 164730). By comparing the GRP1 PH domain to other PH domains, general determinants of 3-phosphoinositide recognition and specificity could be deduced. The International Radiation Hybrid Mapping Consortium mapped the PSCD3 gene to chromosome 7 (SHGC-35947).

Full details of the abovementioned studies are described in the following publications, the disclosure of which are hereby incorporated by reference:

Ferguson, K. M.; Kavran, J. M.; Sankaran, V. G.; Fournier, E.; Isakoff, S. J.; Skolnik, E. Y.; Lemmon, M. A.: Structural basis for discrimination of 3-phosphoinositides by pleckstrin homology domains. Molec. Cell 6:373-384, 2000; and Franco, M.; Boretto, J.; Robineau, S.; Monier, S.; Goud, B.; Chardin, P.; Chavrier, P.: ARNO3, a Sec7-domain guanine nucleotide exchange factor for ADP ribosylation factor 1, is involv.

Further studies establishing the function and utilities of PSCD3 are found in John Hopkins OMIM database record ID 605081, and in sited publications numbered 6807-6809, 490 and 6596 listed in the bibliography section hereinbelow, which are also hereby incorporated by reference. Recombination Activating Gene 1 (RAG1, Accession NM_000448) is another VGAM191 host target gene. RAG1 BINDING SITE is HOST TARGET binding site found in the 3' untranslated region of mRNA encoded by RAG1, corresponding to a HOST TARGET binding site such as BINDING SITE I, BINDING SITE II or BINDING SITE III. Table 2 illustrates the complementarity of the nucleotide sequences of RAG1 BINDING SITE, designated SEQ ID:6037, to the nucleotide sequence of VGAM191 RNA, herein designated VGAM RNA, also designated SEQ ID:2902.

Another function of VGAM191 is therefore inhibition of Recombination Activating Gene 1 (RAG1, Accession NM_000448). Accordingly, utilities of VGAM191 include diagnosis, prevention and treatment of diseases and clinical conditions associated with RAG1. Ribosomal Protein S6 Kinase, 90 kDa, Polypeptide 5 (RPS6KA5, Accession NM_004755) is another VGAM191 host target gene. RPS6KA5 BINDING SITE is HOST TARGET binding site found in the 3' untranslated region of mRNA encoded by RPS6KA5, corresponding to a HOST TARGET binding site such as BINDING SITE I, BINDING SITE II or BINDING SITE III. Table 2 illustrates the complementarity of the nucleotide sequences of RPS6KA5 BINDING SITE, designated SEQ ID:11144, to the nucleotide sequence of VGAM191 RNA, herein designated VGAM RNA, also designated SEQ ID:2902.

Another function of VGAM191 is therefore inhibition of Ribosomal Protein S6 Kinase, 90 kDa, Polypeptide 5 (RPS6KA5, Accession NM_004755), a gene which plays an essential role in the proliferation of yeast cells. Accordingly, utilities of VGAM191 include diagnosis, prevention and treatment of diseases and clinical conditions associated with RPS6KA5. The function of RPS6KA5 has been established by previous studies. Members of the extracellular signal-regulated kinase (ERK) subfamily of the mitogen-activated protein kinases (MAPKs) are activated by growth factors (see OMIM Ref. No. ERK2, 176948), while stress-activated protein kinase (SAPK) subfamily members are strongly activated by stress signals (see OMIM Ref. No. SAPK4, 602899). MAPKAP-K1 (see OMIM Ref. No. RPS6KA1, 601684) isoforms appear to be in vivo substrates for ERKs, while MAPKAP-K2 (OMIM Ref. No. 602006) and MAPKAP-K3 (OMIM Ref. No. 602130) are in vivo substrates for SAPK2A (OMIM Ref. No. 600289) and SAPK2B (OMIM Ref. No. 602898). The MAPKAP-K1 proteins each contain 2 protein kinase domains within a single polypeptide, and 1 role of the C-terminal kinase domain is to activate the N-terminal kinase domain. By searching an EST database with the sequence of the MAPKAP-K1 N-terminal kinase domain, Deak et al. (1998) identified cDNAs encoding 2 novel kinases: mitogen- and stress-activated protein kinase-1 (MSK1) and mitogen- and stress-activated protein kinase-2 (OMIM Ref. No. 603606). The predicted 802-amino acid MSK1 protein contains 2 protein kinase domains, each of which includes the 11 subdomains characteristic of all protein kinases. MSK1 shares 43% protein sequence identity with the MAPKAP-K1 isoforms. Northern blot analysis indicated that MSK1 was expressed as a 4-kb mRNA in all tissues tested, with the highest levels of expression in brain, muscle, and placenta. Immunoelectron microscopy localized MSK1 to the nucleus. MSK1 was activated in vitro and in vivo by either ERK or SAPK2 proteins. Deak et al. (1998) presented evidence suggesting that MSK1, rather than MAPKAP-K1 or MAPKAP-K2/K3, mediates activation of the cAMP response element-binding protein (see OMIM Ref. No. CREB1, 123810) and activating transcription factor-1 (OMIM Ref. No. 123803) by either growth factors or stress signals. By radiation hybrid analysis, Jiang et al. (1999) mapped the RPS6KA5 gene to chromosome 14q31-q32.

Full details of the abovementioned studies are described in the following publications, the disclosure of which are hereby incorporated by reference:

Deak, M.; Clifton, A. D.; Lucocq, J. M.; Alessi, D. R.: Mitogen- and stress-activated protein kinase-1 (MSK1) is directly activated by MAPK and SAPK2/p38, and may mediate activation of CREB. EMBO J. 17: 4426-4441, 1998; and Jiang, C.; Yu, L.; Tu, Q.; Zhao, Y.; Zhang, H.; Zhao, S.: Assignment of a member of the ribosomal protein S6 kinase family, RPS6KA5, to human chromosome 14q31-q32.1 by radiation hybrid map.

Further studies establishing the function and utilities of RPS6KA5 are found in John Hopkins OMIM database record ID 603607, and in sited publications numbered 2883-2884 listed in the bibliography section hereinbelow, which are also hereby incorporated by reference. Splicing Factor, Arginine/serine-rich 7, 35 kDa (SFRS7, Accession XM_002575) is another VGAM191 host target gene. SFRS7 BINDING SITE is HOST TARGET binding site found in the 3' untranslated region of mRNA encoded by SFRS7, corresponding to a HOST TARGET binding site such as BINDING SITE I, BINDING SITE II or BINDING SITE III. Table 2 illustrates the complementarity of the nucleotide sequences of SFRS7 BINDING SITE, designated SEQ ID:29899, to the nucleotide sequence of VGAM191 RNA, herein designated VGAM RNA, also designated SEQ ID:2902.

Another function of VGAM191 is therefore inhibition of Splicing Factor, Arginine/serine-rich 7, 35 kDa (SFRS7, Accession XM_002575), a gene which is required for pre-mnra splicing. Accordingly, utilities of VGAM191 include diagnosis, prevention and treatment of diseases and clinical conditions associated with SFRS7. The function of SFRS7 has been established by previous studies. Cavaloc et al. (1994) used a monoclonal antibody to identify a splicing factor of 35 kD which they named 9G8. Based on partial sequence of tryptic peptides, the authors designed degenerate PCR primers and obtained a PCR product which was used to probe genomic and cDNA libraries. The isolation and characterization of cDNA clones indicated that the 9G8 protein (gene symbol, SFRS7) is a member of the serine/arginine (SR) splicing factor family because it includes an N-terminal RNA binding domain and a C-terminal SR domain. Members of this family are thought to play key roles in alternative splicing. The RNA binding domain of 9G8 is closely related (79 to 71% identity) to those of the SR factors human SRp20 (OMIM Ref. No. 603364) and Drosophila RBP1. Immunodepletion of the 9G8 protein from a nuclear extract resulted in the loss of splicing activity. In turn, in vitro-expressed recombinant 9G8 protein rescued the splicing activity of a 9G8-depleted nuclear extract. Popielarz et al. (1995) isolated and characterized the human 9G8 gene. The gene spans 7,745 bp and consists of 8 exons and 7 introns within the coding sequence, thus contrasting with the organization of some other genes of the SR splicing factor family. By isotopic in situ hybridization, they localized the gene to 2p22-p21. The 5-prime flanking region is GC-rich and contains basal promoter sequences and potential regulatory elements. They presented results raising the possibility that alternative splicing of intron 3 provides a mechanism for modulation of the 9G8 function.

Full details of the abovementioned studies are described in the following publications, the disclosure of which are hereby incorporated by reference:

Cavaloc, Y.; Popielarz, M.; Fuchs, J.-P.; Gattoni, R.; Stevenin, J.: Characterization and cloning of the human splicing factor 9G8: a novel 35 kDa factor of the serine/arginine protein family. EMBO J. 13:2639-2649, 1994; and Popielarz, M.; Cavaloc, Y.; Mattei, M.-G.; Gattoni, R.; Stevenin, J.: The gene encoding human splicing factor 9G8: structure, chromosomal localization, and expression of alternatively pro.

Further studies establishing the function and utilities of SFRS7 are found in John Hopkins OMIM database record ID 600572, and in sited publications numbered 9532-9533 listed in the bibliography section hereinbelow, which are also hereby incorporated by reference. SWI/SNF Related, Matrix Associated, Actin Dependent Regulator of Chromatin, Subfamily A, Member 2 (SMARCA2, Accession NM_003070) is another VGAM191 host target gene. SMARCA2 BINDING SITE is HOST TARGET binding site found in the 3' untranslated region of mRNA encoded by SMARCA2, corresponding to a HOST TARGET binding site such as BINDING SITE I, BINDING SITE II or BINDING SITE III. Table 2 illustrates the complementarity of the nucleotide sequences of SMARCA2 BINDING SITE, designated SEQ ID:9034, to the nucleotide sequence of VGAM191 RNA, herein designated VGAM RNA, also designated SEQ ID:2902.

Another function of VGAM191 is therefore inhibition of SWI/SNF Related, Matrix Associated, Actin Dependent Regulator of Chromatin, Subfamily A, Member 2 (SMARCA2, Accession NM_003070), a gene which is involved in chromatin assembly and remodeling. Accordingly, utilities of VGAM191 include diagnosis, prevention and treatment of diseases and clinical conditions associated with SMARCA2. The function of SMARCA2 has been established by previous studies. Mammalian SWI/SNF complexes are ATP-dependent chromatin remodeling enzymes that have been implicated in the regulation of gene expression, cell cycle control, and oncogenesis. MyoD (MYOD1; 159970) is a muscle-specific regulator capable of inducing myogenesis in numerous cell types. To ascertain the requirement for chromatin remodeling enzymes in cellular differentiation processes, de la Serna et al. (2001) examined MyoD-mediated induction of muscle differentiation in fibroblasts expressing dominant-negative versions of the human brahma-related gene-1 (BRG1; 603254) or human brahma, the ATPase subunits of 2 distinct SWI/SNF enzymes. They found that induction of the myogenic phenotype was completely abrogated in the presence of the mutant enzymes. They further demonstrated that failure to induce muscle-specific gene expression correlated with inhibition of chromatin remodeling in the promoter region of an endogenous muscle-specific gene. The results demonstrated that SWI/SNF enzymes promote MyoD-mediated muscle differentiation and indicated that these enzymes function by altering chromatin structure in promoter regions of endogenous, differentiation-specific loci. Hakimi et al. (2002) reported the isolation of a human SNF2-containing chromatin remodeling complex that encompasses components of the cohesin and NURD (see OMIM Ref. No. 603526) complexes. They showed that the RAD21 (OMIM Ref. No. 606462) subunit of the cohesin complex directly interacts with the ATPase subunit SNF2. Mapping of RAD21, SNF2, and Mi2 (see OMIM Ref. No. 603277) binding sites by chromatin immunoprecipitation experiments revealed the specific association of these 3 proteins with human DNA elements containing alu sequences. Hakimi et al. (2002) found a correlation between modification of histone tails and association of the SNF2/cohesin complex with chromatin. In addition, they showed that the association of the cohesin complex with chromatin can be regulated by the state of DNA methylation. Finally, they presented evidence pointing to a role for the ATPase activity of SNF2 in the loading of RAD21 on chromatin.

Full details of the abovementioned studies are described in the following publications, the disclosure of which are hereby incorporated by reference:

de la Serna, I. L.; Carlson, K. A.; Imbalzano, A. N.: Mammalian SWI/SNF complexes promote MyoD-mediated muscle differentiation. Nature Genet. 27:187-190, 2001; and Hakimi, M.-A.; Bochar, D. A.; Schmiesing, J. A.; Dong, Y.; Barak, O. G.; Speicher, D. W.; Yokomori, K.; Shiekhattar, R.: A chromatin remodelling complex that loads cohesin onto human.

Further studies establishing the function and utilities of SMARCA2 are found in John Hopkins OMIM database record ID 600014, and in sited publications numbered 11144, 8358-836 and 804 listed in the bibliography section hereinbelow, which are also hereby incorporated by reference. Sorting Nexin 9 (SNX9, Accession NM_016224) is another VGAM191 host target gene. SNX9 BINDING SITE is HOST TARGET binding site found in the 3' untranslated region of mRNA encoded by SNX9, corresponding to a HOST TAR- GET binding site such as BINDING SITE I, BINDING SITE II or BINDING SITE III. Table 2 illustrates the complementarity of the nucleotide sequences of SNX9 BINDING SITE, designated SEQ ID:18328, to the nucleotide sequence of VGAM191 RNA, herein designated VGAM RNA, also designated SEQ ID:2902.

Another function of VGAM191 is therefore inhibition of Sorting Nexin 9 (SNX9, Accession NM_016224). Accordingly, utilities of VGAM191 include diagnosis, prevention and treatment of diseases and clinical conditions associated with SNX9. TATA Box Binding Protein (TBP)-associated Factor, RNA Polymerase I, C, 110 kDa (TAF1C, Accession NM_005679) is another VGAM191 host target gene. TAF1C BINDING SITE is HOST TARGET binding site found in the 3' untranslated region of mRNA encoded by TAF1C, corresponding to a HOST TARGET binding site such as BINDING SITE I, BINDING SITE II or BINDING SITE III. Table 2 illustrates the complementarity of the nucleotide sequences of TAF1C BINDING SITE, designated SEQ ID:12235, to the nucleotide sequence of VGAM191 RNA, herein designated VGAM RNA, also designated SEQ ID:2902.

Another function of VGAM191 is therefore inhibition of TATA Box Binding Protein (TBP)-associated Factor, RNA Polymerase I, C, 110 kDa (TAF1C, Accession NM_005679), a gene which belongs to component of the RNA polymerase I and II SL1 transcription factor. Accordingly, utilities of VGAM191 include diagnosis, prevention and treatment of diseases and clinical conditions associated with TAF1C. The function of TAF1C has been established by previous studies. Using immunoaffinity chromatography with anti-TBP, followed by SDS-PAGE analysis, Comai et al. (1994) isolated the purified 110-kD subunit of SL1. By screening teratocarcinoma and HeLa cell cDNA libraries using degenerate PCR primers corresponding to peptide sequences of the 110-kD subunit of SL1, they obtained a cDNA encoding TAF1C, which they called TAFI110. Comai et al. (1994) also obtained cDNAs encoding TAF1A (OMIM Ref. No. 604903) and TAF1B (OMIM Ref. No. 604904). TAF1C encodes a deduced 869-amino acid protein. Western blot analysis confirmed that TAF1C is expressed as a 110-kD protein. Analysis of SL1 subunit interactions showed that all 3 TAF1 proteins bind to TBP and to each other. However, binding of the SL1 complex to TBP excluded binding of the RNA polymerase II transcription factor TFIID (see OMIM Ref. No. TAF2A; 313650) to TBP. Comai et al. (1994) concluded that this mutually exclusive binding directs the formation of promoter- and RNA polymerase-selective TBP-TAF complexes. The International Radiation Hybrid Mapping Consortium mapped the TAF1C gene to 16q (OMIM Ref. No. L39059). Di Pietro et al. (2000) mapped the TAF1C gene to chromosome 16q24 by fluorescence in situ hybridization.

Full details of the abovementioned studies are described in the following publications, the disclosure of which are hereby incorporated by reference:

Comai, L.; Zomerdijk, J. C. B. M.; Beckmann, H.; Zhou, S.; Admon, A.; Tjian, R.: Reconstitution of transcription factor SL1: exclusive binding of TBP by SL1 or TFIID subunits. Science 266:1966-1972, 1994; and Di Pietro, C.; Rapisarda, A.; Amico, V.; Bonaiuto, C.; Viola, A.; Scalia, M.; Motta, S.; Amato, A.; Engel, H.; Messina, A.; Sichel, G.; Grzeschik, K.-H.; Purrello, M.: Genomic localiza.

Further studies establishing the function and utilities of TAF1C are found in John Hopkins OMIM database record ID 604905, and in sited publications numbered 2910-2911 listed in the bibliography section hereinbelow, which are also hereby incorporated by reference. Complement Component 1, Q Subcomponent, Receptor 1 (C1QR1, Accession NM_012072) is another VGAM191 host target gene. C1QR1 BINDING SITE is HOST TARGET binding site found in the 3' untranslated region of mRNA encoded by C1QR1, corresponding to a HOST TARGET binding site such as BINDING SITE I, BINDING SITE II or BINDING SITE III. Table 2 illustrates the complementarity of the nucleotide sequences of C1QR1 BINDING SITE, designated SEQ ID:14331, to the nucleotide sequence of VGAM191 RNA, herein designated VGAM RNA, also designated SEQ ID:2902.

Another function of VGAM191 is therefore inhibition of Complement Component 1, Q Subcomponent, Receptor 1 (C1QR1, Accession NM_012072). Accordingly, utilities of VGAM191 include diagnosis, prevention and treatment of diseases and clinical conditions associated with C1QR1. FLJ22174 (Accession NM_021945) is another VGAM191 host target gene. FLJ22174 BINDING SITE is HOST TARGET binding site found in the 3' untranslated region of mRNA encoded by FLJ22174, corresponding to a HOST TARGET binding site such as BINDING SITE I, BINDING SITE II or BINDING SITE III. Table 2 illustrates the complementarity of the nucleotide sequences of FLJ22174 BINDING SITE, designated SEQ ID:22466, to the nucleotide sequence of VGAM191 RNA, herein designated VGAM RNA, also designated SEQ ID:2902.

Another function of VGAM191 is therefore inhibition of FLJ22174 (Accession NM_021945). Accordingly, utilities of VGAM191 include diagnosis, prevention and treatment of diseases and clinical conditions associated with FLJ22174. KIAA0446 (Accession XM_044155) is another VGAM191 host target gene. KIAA0446 BINDING SITE is HOST TARGET binding site found in the 5' untranslated region of mRNA encoded by KIAA0446, corresponding to a HOST TARGET binding site such as BINDING SITE I, BINDING SITE II or BINDING SITE III. Table 2 illustrates the complementarity of the nucleotide sequences of KIAA0446 BINDING SITE, designated SEQ ID:34154, to the nucleotide sequence of VGAM191 RNA, herein designated VGAM RNA, also designated SEQ ID:2902.

Another function of VGAM191 is therefore inhibition of KIAA0446 (Accession XM_044155). Accordingly, utilities of VGAM191 include diagnosis, prevention and treatment of diseases and clinical conditions associated with KIAA0446. KIAA1211 (Accession XM_044178) is another VGAM191 host target gene. KIAA1211 BINDING SITE is HOST TARGET binding site found in the 3' untranslated region of mRNA encoded by KIAA1211, corresponding to a HOST TARGET binding site such as BINDING SITE I, BINDING SITE II or BINDING SITE III. Table 2 illustrates the complementarity of the nucleotide sequences of KIAA1211 BINDING SITE, designated SEQ ID:34160, to the nucleotide sequence of VGAM191 RNA, herein designated VGAM RNA, also designated SEQ ID:2902.

Another function of VGAM191 is therefore inhibition of KIAA1211 (Accession XM_044178). Accordingly, utilities of VGAM191 include diagnosis, prevention and treatment of diseases and clinical conditions associated with KIAA1211. Kelch-like 8 (Drosophila) (KLHL8, Accession XM_031735) is another VGAM191 host target gene. KLHL8 BINDING SITE is HOST TARGET binding site found in the 3' untranslated region of mRNA encoded by KLHL8, corresponding to a HOST TARGET binding site such as BINDING SITE I, BINDING SITE II or BINDING SITE III. Table 2 illustrates the complementarity of the nucleotide sequences of KLHL8 BINDING SITE, designated SEQ ID:31475, to the nucleotide sequence of VGAM191 RNA, herein designated VGAM RNA, also designated SEQ ID:2902.

Another function of VGAM191 is therefore inhibition of Kelch-like 8 (Drosophila) (KLHL8, Accession XM_031735). Accordingly, utilities of VGAM191 include diagnosis, prevention and treatment of diseases and clinical conditions associated with KLHL8. POU Domain, Class 4, Transcription Factor 2 (POU4F2, Accession NM_004575) is another VGAM191 host target gene. POU4F2 BINDING SITE is HOST TARGET binding site found in the 3' untranslated region of mRNA encoded by POU4F2, corresponding to a HOST TARGET binding site such as BINDING SITE I, BINDING SITE II or BINDING SITE III. Table 2 illustrates the complementarity of the nucleotide sequences of POU4F2 BINDING SITE, designated SEQ ID:10919, to the nucleotide sequence of VGAM191 RNA, herein designated VGAM RNA, also designated SEQ ID:2902.

Another function of VGAM191 is therefore inhibition of POU Domain, Class 4, Transcription Factor 2 (POU4F2, Accession NM_004575). Accordingly, utilities of VGAM191 include diagnosis, prevention and treatment of diseases and clinical conditions associated with POU4F2. LOC152756 (Accession XM_098262) is another VGAM191 host target gene. LOC152756 BINDING SITE is HOST TARGET binding site found in the 3' untranslated region of mRNA encoded by LOC152756, corresponding to a HOST TARGET binding site such as BINDING SITE I, BINDING SITE II or BINDING SITE III. Table 2 illustrates the complementarity of the nucleotide sequences of LOC152756 BINDING SITE, designated SEQ ID:41551, to the nucleotide sequence of VGAM191 RNA, herein designated VGAM RNA, also designated SEQ ID:2902.

Another function of VGAM191 is therefore inhibition of LOC152756 (Accession XM_098262). Accordingly, utilities of VGAM191 include diagnosis, prevention and treatment of diseases and clinical conditions associated with LOC152756. LOC196528 (Accession XM_113745) is another VGAM191 host target gene. LOC196528 BINDING SITE is HOST TARGET binding site found in the 3' untranslated region of mRNA encoded by LOC196528, corresponding to a HOST TARGET binding site such as BINDING SITE I, BINDING SITE II or BINDING SITE III. Table 2 illustrates the complementarity of the nucleotide sequences of LOC196528 BINDING SITE, designated SEQ ID:42404, to the nucleotide sequence of VGAM191 RNA, herein designated VGAM RNA, also designated SEQ ID:2902.

Another function of VGAM191 is therefore inhibition of LOC196528 (Accession XM_113745). Accordingly, utilities of VGAM191 include diagnosis, prevention and treatment of diseases and clinical conditions associated with LOC196528. LOC219529 (Accession XM_167563) is another VGAM191 host target gene. LOC219529 BINDING SITE is HOST TARGET binding site found in the 3' untranslated region of mRNA encoded by LOC219529, corresponding to a HOST TARGET binding site such as BINDING SITE I, BINDING SITE II or BINDING SITE III. Table 2 illustrates the complementarity of the nucleotide sequences of LOC219529 BINDING SITE, designated SEQ ID:44673, to the nucleotide sequence of VGAM191 RNA, herein designated VGAM RNA, also designated SEQ ID:2902.

Another function of VGAM191 is therefore inhibition of LOC219529 (Accession XM_167563). Accordingly, utilities of VGAM191 include diagnosis, prevention and treatment of diseases and clinical conditions associated with LOC219529. LOC221751 (Accession XM_166370) is another VGAM191 host target gene. LOC221751 BINDING SITE is HOST TARGET binding site found in the 3' untranslated region of mRNA encoded by LOC221751, corresponding to a HOST TARGET binding site such as BINDING SITE I, BINDING SITE II or BINDING SITE III. Table 2 illustrates the complementarity of the nucleotide sequences of LOC221751 BINDING SITE, designated SEQ ID:44188, to the nucleotide sequence of VGAM191 RNA, herein designated VGAM RNA, also designated SEQ ID:2902.

Another function of VGAM191 is therefore inhibition of LOC221751 (Accession XM_166370). Accordingly, utilities of VGAM191 include diagnosis, prevention and treatment of diseases and clinical conditions associated with LOC221751. FIG. 1 further provides a conceptual description of a novel bioinformatically detected viral gene of the present invention, referred to here as Viral Genomic Address Messenger 192 (VGAM192) viral gene, which modulates expression of respective host target genes thereof, the function and utility of which host target genes is known in the art.

VGAM192 is a novel bioinformatically detected regulatory, non protein coding, viral micro RNA (miRNA) gene. The method by which VGAM192 was detected is described hereinabove with reference to FIGS. 1-8.

VGAM192 gene, herein designated VGAM GENE, is a viral gene contained in the genome of Shrimp White Spot Syndrome Virus (white spot baciliform virus). VGAM192 host target gene, herein designated VGAM HOST TARGET GENE, is a human gene contained in the human genome.

VGAM192 gene encodes a VGAM192 precursor RNA, herein designated VGAM PRECURSOR RNA. Similar to other miRNA genes, and unlike most ordinary genes, VGAM192 precursor RNA does not encode a protein. A nucleotide sequence identical or highly similar to the nucleotide sequence of VGAM192 precursor RNA is designated SEQ ID:178, and is provided hereinbelow with reference to the sequence listing part. Nucleotide sequence SEQ ID:178 is located at position 73488 relative to the genome of Shrimp White Spot Syndrome Virus (white spot baciliform virus).

VGAM192 precursor RNA folds onto itself, forming VGAM192 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM192 folded precursor RNA into VGAM192 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM192 RNA is designated SEQ ID:2903, and is provided hereinbelow with reference to the sequence listing part.

VGAM192 host target gene, herein designated VGAM HOST TARGET GENE, encodes a corresponding messenger RNA, VGAM192 host target RNA, herein designated VGAM HOST TARGET RNA. VGAM192 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM192 RNA, herein designated VGAM RNA, binds complementarily to one or more host target binding sites located in untranslated regions of VGAM192 host target RNA, herein designated VGAM HOST TARGET RNA. This complementary binding is due to the fact that the nucleotide sequence of VGAM192 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM192 RNA, herein designated VGAM RNA, may have a different number of host target binding sites in untranslated regions of a VGAM192 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM192 RNA, herein designated VGAM RNA, to host target binding sites on VGAM192 host target RNA, herein designated VGAM HOST TARGET RNA, such as BINDING SITE I, BINDING SITE II and BINDING SITE III, inhibits translation of VGAM192 host target RNA into VGAM192 host target protein, herein designated VGAM HOST TARGET PROTEIN. VGAM host target protein is therefore outlined by a broken line.

It is appreciated that VGAM192 host target gene, herein designated VGAM HOST TARGET GENE, in fact represents a plurality of VGAM192 host target genes. The mRNA of each one of this plurality of VGAM192 host target genes comprises one or more host target binding sites, each having a nucleotide sequence which is at least partly complementary to VGAM192 RNA, herein designated VGAM RNA, and which when bound by VGAM192 RNA causes inhibition of translation of respective one or more VGAM192 host target proteins.

It is further appreciated by one skilled in the art that the mode of translational inhibition illustrated by FIG. 1 with specific reference to translational inhibition exerted by VGAM192 gene, herein designated VGAM GENE, on one or more VGAM192 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM192 is inhibition of expression of host target genes, as part of a novel viral mechanism of attacking a host. Accordingly, utilities of VGAM192 include diagnosis, prevention and treatment of viral infection by Shrimp White Spot Syndrome Virus (white spot bacilliform virus). Specific functions, and accordingly utilities, of VGAM192 correlate with, and may be deduced from, the identity of the host target genes which VGAM192 binds and inhibits, and the function of these host target genes, as elaborated hereinbelow.

Nucleotide sequences of the VGAM192 precursor RNA, herein designated VGAM PRECURSOR RNA, and of the 'diced' VGAM192 RNA, herein designated VGAM RNA, and a schematic representation of the secondary folding of VGAM192 folded precursor RNA, herein designated VGAM FOLDED PRECURSOR RNA, of VGAM192 are further described hereinbelow with reference to Table 1.

Nucleotide sequences of host target binding sites, such as BINDING SITE-I, BINDING SITE-II and BINDING SITE-III of FIG. 1, found on VGAM192 host target RNA, and schematic representation of the complementarity of each of these host target binding sites to VGAM192 RNA, herein designated VGAM RNA, are described hereinbelow with reference to Table 2.

As mentioned hereinabove with reference to FIG. 1, a function of VGAM192 gene, herein designated VGAM is inhibition of expression of VGAM192 target genes. It is appreciated that specific functions, and accordingly utilities, of VGAM192 correlate with, and may be deduced from, the identity of the target genes which VGAM192 binds and inhibits, and the function of these target genes, as elaborated hereinbelow.

C-type (calcium dependent, carbohydrate-recognition domain) Lectin, Superfamily Member 5 (CLECSF5, Accession NM_013252) is a VGAM192 host target gene. CLECSF5 BINDING SITE is HOST TARGET binding site found in the 3' untranslated region of mRNA encoded by CLECSF5, corresponding to a HOST TARGET binding site such as BINDING SITE I, BINDING SITE II or BINDING SITE III. Table 2 illustrates the complementarity of the nucleotide sequences of CLECSF5 BINDING SITE, designated SEQ ID:14922, to the nucleotide sequence of VGAM192 RNA, herein designated VGAM RNA, also designated SEQ ID:2903.

A function of VGAM192 is therefore inhibition of C-type (calcium dependent, carbohydrate-recognition domain) Lectin, Superfamily Member 5 (CLECSF5, Accession NM_013252). Accordingly, utilities of VGAM192 include diagnosis, prevention and treatment of diseases and clinical conditions associated with CLECSF5. Nuclear Mitotic Apparatus Protein 1 (NUMA1, Accession XM_167853) is another VGAM192 host target gene. NUMA1 BINDING SITE is HOST TARGET binding site found in the 5' untranslated region of mRNA encoded by NUMA1, corresponding to a HOST TARGET binding site such as BINDING SITE I, BINDING SITE II or BINDING SITE III. Table 2 illustrates the complementarity of the nucleotide sequences of NUMA1 BINDING SITE, designated SEQ ID:44880, to the nucleotide sequence of VGAM192 RNA, herein designated VGAM RNA, also designated SEQ ID:2903.

Another function of VGAM192 is therefore inhibition of Nuclear Mitotic Apparatus Protein 1 (NUMA1, Accession XM_167853), a gene which is nuclear mitotic apparatus protein. Accordingly, utilities of VGAM192 include diagnosis, prevention and treatment of diseases and clinical conditions associated with NUMA1. The function of NUMA1 has been established by previous studies. The NuMA protein was one of the first to be described as a cell cycle-related protein based on a distinct immunofluorescent staining pattern: in interphase, NuMA is present throughout the nucleus, and in mitosis, it localizes to the spindle apparatus (Lydersen and Pettijohn, 1980). Some patients with autoimmune disease have antibodies directed against the NuMA protein. The full-length NUMA cDNA (Compton et al., 1992; Yang et al., 1992) predicts a protein with the largest known coiled-coil region in a protein. By fluorescence in situ hybridization, Sparks et al. (1993) demonstrated that the NUMA1 gene is present in single copy and located on 11q13. Acute promyelocytic leukemia (APL) is uniquely associated with chromosomal translocations that disrupt the gene encoding the retinoic acid receptor, RARA (OMIM Ref. No. 180240). In more than 99% of cases, this disruption results in the formation of a fusion of the RARA gene with the PML gene (OMIM Ref. No. 102578). In rare variants of APL, the RARA gene has been found to be fused to 1 of 2 other genes, PLZF (OMIM Ref. No. 176797) and NPM (OMIM Ref. No. 164040). Although RARA dysregulation is evidently important in APL, the role of the various fusion partners is unclear. Wells et al. (1997) characterized a fourth APL gene fusion, which linked exons encoding the retinoic acid and DNA-binding domains of RARA to 5-prime exons of NUMA1. The NUMA/RARA fusion protein existed in sheet-like nuclear aggregates with which normal NUMA partly colocalized. In contrast to t (15;17) APL (the usual variety) the intracellular distribution of PML was normal in these cells. Wells et al. (1997) suggested that interference with retinoid signaling, and not disruption of PML organization, is essential to the APL phenotype. Their work implicated for the first time an element of the mitotic apparatus in the molecular pathogenesis of human malignancy. The proband of their study was a Caucasian male first seen at 6 months of age for investigation of multiple cutaneous lesions. Despite this unusual clinical presentation, peripheral blood morphology and cell-surface immunophenotype were typical of APL. Routine analysis of diagnostic bone marrow revealed a clonal cytogenetic abnormality, t (11;17)(q13; q21). The patient was treated with all-trans retinoic acid and achieved complete remission; he remained in morphologic remission 38 months after autologous bone marrow transplantation.

Full details of the abovementioned studies are described in the following publications, the disclosure of which are hereby incorporated by reference:

Lydersen, B. K.; Pettijohn, D. E.: Human-specific nuclear protein that associates with the polar region of the mitotic apparatus: distribution in a human/hamster hybrid cell. Cell 22:489-499, 1980; and Wells, R. A.; Catzavelos, C.; Kamel-Reid, S.: Fusion of retinoic acid receptor alpha to NuMA, the nuclear mitotic apparatus protein, by a variant translocation in acute promyelocytic l.

Further studies establishing the function and utilities of NUMA1 are found in John Hopkins OMIM database record ID 164009, and in sited publications numbered 2246-2252 listed in the bibliography section hereinbelow, which are also hereby incorporated by reference. Zinc Finger Protein 146 (ZNF146, Accession NM_007145) is another VGAM192 host target gene. ZNF146 BINDING SITE is HOST TARGET binding site found in the 5' untranslated region of mRNA encoded by ZNF146, corresponding to a HOST TARGET binding site such as BINDING SITE I, BINDING SITE II or BINDING SITE III. Table 2 illustrates the complementarity of the nucleotide sequences of ZNF146 BINDING SITE, designated SEQ ID:13994, to the nucleotide sequence of VGAM192 RNA, herein designated VGAM RNA, also designated SEQ ID:2903.

Another function of VGAM192 is therefore inhibition of Zinc Finger Protein 146 (ZNF146, Accession NM_007145), a gene which binds zinc ions, DNA, and heparin. Accordingly, utilities of VGAM192 include diagnosis, prevention and treatment of diseases and clinical conditions associated with ZNF146. The function of ZNF146 has been established by previous studies. Ferbus et al. (1996) reported the characterization of the human OZF protein. The protein produced in E. coli binds zinc ions, DNA, and heparin. These binding activities are characteristic of zinc finger proteins. Immunochemical analysis using antibodies produced against the recombinant protein detected its expression in human mammary epithelial cells but not in stroma cells, which is consistent with the pattern of expression observed at the RNA level within cell cultures. Western blot analysis demonstrated the expression of a 33-kD nuclear protein similar in size to the predicted protein and, therefore, excluded the presence of an additional transfer-activating domain. The data established the unique structure of the OZF protein which is distinct from previously identified zinc finger proteins. In addition, OZF protein overexpression was found in a tumor cell line, which suggests a possible involvement in carcinogenesis Full details of the abovementioned studies are described in the following publications, the disclosure of which are hereby incorporated by reference:

Le Chalony, C.; Prosperi, M.-T.; Haluza, R.; Apiou, F.; Dutrillaux, B.; Goubin, G. : The OZF gene encodes a protein consisting essentially of zinc-finger motifs. J. Molec. Biol. 236:399-404, 1994; and Ferbus, D.; Le Chalony, C.; Prosperi, M.-T.; Muleris, M.; Vincent-Salomon, A.; Goubin, G.: Identification, nuclear localization, and binding activities of OZF, a human protein solely compo.

Further studies establishing the function and utilities of ZNF146 are found in John Hopkins OMIM database record ID 601505, and in sited publications numbered 9488-9490 listed in the bibliography section hereinbelow, which are also hereby incorporated by reference. VI (Accession NM_013443) is another VGAM192 host target gene. VI BINDING SITE is HOST TARGET binding site found in the 3' untranslated region of mRNA encoded by VI, corresponding to a HOST TARGET binding site such as BINDING SITE I, BINDING SITE II or BINDING SITE III. Table 2 illustrates the complementarity of the nucleotide sequences of VI BINDING SITE, designated SEQ ID:15108, to the nucleotide sequence of VGAM192 RNA, herein designated VGAM RNA, also designated SEQ ID:2903.

Another function of VGAM192 is therefore inhibition of VI (Accession NM_013443). Accordingly, utilities of VGAM192 include diagnosis, prevention and treatment of diseases and clinical conditions associated with VI. LOC152263 (Accession XM_098195) is another VGAM192 host target gene. LOC152263 BINDING SITE is HOST TARGET binding site found in the 3' untranslated region of mRNA encoded by LOC152263, corresponding to a HOST TARGET binding site such as BINDING SITE I, BINDING SITE II or BINDING SITE III. Table 2 illustrates the complementarity of the nucleotide sequences of LOC152263 BINDING SITE, designated SEQ ID:41482, to the nucleotide sequence of VGAM192 RNA, herein designated VGAM RNA, also designated SEQ ID:2903.

Another function of VGAM192 is therefore inhibition of LOC152263 (Accession XM_098195). Accordingly, utilities of VGAM192 include diagnosis, prevention and treatment of diseases and clinical conditions associated with LOC152263. LOC169966 (Accession XM_093010) is another VGAM192 host target gene. LOC169966 BINDING SITE is HOST TARGET binding site found in the 3' untranslated region of mRNA encoded by LOC169966, corresponding to a HOST TARGET binding site such as BINDING SITE I, BINDING SITE II or BINDING SITE III. Table 2 illustrates the complementarity of the nucleotide sequences of LOC169966 BINDING SITE, designated SEQ ID:40165, to the nucleotide sequence of VGAM192 RNA, herein designated VGAM RNA, also designated SEQ ID:2903.

Another function of VGAM192 is therefore inhibition of LOC169966 (Accession XM_093010). Accordingly, utilities of VGAM192 include diagnosis, prevention and treatment of diseases and clinical conditions associated with LOC169966. FIG. 1 further provides a conceptual description of a novel bioinformatically detected viral gene of the present invention, referred to here as Viral Genomic Address Messenger 193 (VGAM193) viral gene, which modulates expression of respective host target genes thereof, the function and utility of which host target genes is known in the art.

VGAM193 is a novel bioinformatically detected regulatory, non protein coding, viral micro RNA (miRNA) gene. The method by which VGAM193 was detected is described hereinabove with reference to FIGS. 1-8.

VGAM193 gene, herein designated VGAM GENE, is a viral gene contained in the genome of Shrimp White Spot Syndrome Virus (white spot bacilliform virus). VGAM193 host target gene, herein designated VGAM HOST TARGET GENE, is a human gene contained in the human genome.

VGAM193 gene encodes a VGAM193 precursor RNA, herein designated VGAM PRECURSOR RNA. Similar to other miRNA genes, and unlike most ordinary genes, VGAM193 precursor RNA does not encode a protein. A nucleotide sequence identical or highly similar to the nucleotide sequence of VGAM193 precursor RNA is designated SEQ ID:179, and is provided hereinbelow with reference to the sequence listing part. Nucleotide sequence SEQ ID:179 is located at position 94372 relative to the genome of Shrimp White Spot Syndrome Virus (white spot bacilliform virus).

VGAM193 precursor RNA folds onto itself, forming VGAM193 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM193 folded precursor RNA into VGAM193 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM193 RNA is designated SEQ ID:2904, and is provided hereinbelow with reference to the sequence listing part.

VGAM193 host target gene, herein designated VGAM HOST TARGET GENE, encodes a corresponding messenger RNA, VGAM193 host target RNA, herein designated VGAM HOST TARGET RNA. VGAM193 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM193 RNA, herein designated VGAM RNA, binds complementarily to one or more host target binding sites located in untranslated regions of VGAM193 host target RNA, herein designated VGAM HOST TARGET RNA. This complementary binding is due to the fact that the nucleotide sequence of VGAM193 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM193 RNA, herein designated VGAM RNA, may have a different number of host target binding sites in untranslated regions of a VGAM193 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM193 RNA, herein designated VGAM RNA, to host target binding sites on VGAM193 host target RNA, herein designated VGAM HOST TARGET RNA, such as BINDING SITE I, BINDING SITE II and BINDING SITE III, inhibits translation of VGAM193 host target RNA into VGAM193 host target protein, herein designated VGAM HOST TARGET PROTEIN. VGAM host target protein is therefore outlined by a broken line.

It is appreciated that VGAM193 host target gene, herein designated VGAM HOST TARGET GENE, in fact represents a plurality of VGAM193 host target genes. The mRNA of each one of this plurality of VGAM193 host target genes comprises one or more host target binding sites, each having a nucleotide sequence which is at least partly complementary to VGAM193 RNA, herein designated VGAM RNA, and which when bound by VGAM193 RNA causes inhibition of translation of respective one or more VGAM193 host target proteins.

It is further appreciated by one skilled in the art that the mode of translational inhibition illustrated by FIG. 1 with specific reference to translational inhibition exerted by VGAM193 gene, herein designated VGAM GENE, on one or more VGAM193 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM193 is inhibition of expression of host target genes, as part of a novel viral mechanism of attacking a host. Accordingly, utilities of VGAM193 include diagnosis, prevention and treatment of viral infection by Shrimp White Spot Syndrome Virus (white spot bacilliform virus). Specific functions, and accordingly utilities, of VGAM193 correlate with, and may be deduced from, the identity of the host target genes which VGAM193 binds and inhibits, and the function of these host target genes, as elaborated hereinbelow.

Nucleotide sequences of the VGAM193 precursor RNA, herein designated VGAM PRECURSOR RNA, and of the 'diced' VGAM193 RNA, herein designated VGAM RNA, and a schematic representation of the secondary folding of VGAM193 folded precursor RNA, herein designated VGAM FOLDED PRECURSOR RNA, of VGAM193 are further described hereinbelow with reference to Table 1.

Nucleotide sequences of host target binding sites, such as BINDING SITE-I, BINDING SITE-II and BINDING SITE-III of FIG. 1, found on VGAM193 host target RNA, and schematic representation of the complementarity of each of these host target binding sites to VGAM193 RNA, herein designated VGAM RNA, are described hereinbelow with reference to Table 2.

As mentioned hereinabove with reference to FIG. 1, a function of VGAM193 gene, herein designated VGAM is inhibition of expression of VGAM193 target genes. It is appreciated that specific functions, and accordingly utilities, of VGAM193 correlate with, and may be deduced from, the identity of the target genes which VGAM193 binds and inhibits, and the function of these target genes, as elaborated hereinbelow.

Cyclin-dependent Kinase (CDC2-like) 10 (CDK10, Accession NM_003674) is a VGAM193 host target gene. CDK10 BINDING SITE1 and CDK10 BINDING SITE2 are HOST TARGET binding sites found in untranslated regions of mRNA encoded by CDK10, corresponding to HOST TARGET binding sites such as BINDING SITE I, BINDING SITE II or BINDING SITE III. Table 2 illustrates the complementarity of the nucleotide sequences of CDK10 BINDING SITE1 and CDK10 BINDING SITE2, designated SEQ ID:9768 and SEQ ID:27557 respectively, to the nucleotide sequence of VGAM193 RNA, herein designated VGAM RNA, also designated SEQ ID:2904.

A function of VGAM193 is therefore inhibition of Cyclin-dependent Kinase (CDC2-like) 10 (CDK10, Accession NM_003674), a gene which plays a pivotal role in the regulation of the eukaryotic cell cycle. Accordingly, utilities of VGAM193 include diagnosis, prevention and treatment of diseases and clinical conditions associated with CDK10. The function of CDK10 has been established by previous studies. Cyclin-dependent kinases (CDKs) are CDC2 (OMIM Ref. No. 116940)-related kinases that bind to cyclin to form active holoenzymes that play a pivotal role in the regulation of the eukaryotic cell cycle. To identify additional CDC2-like protein kinases, Brambilla and Draetta (1994) performed RT-PCR on human tumor cell line mRNA using degenerate oligonucleotides based on regions conserved among CDC2-related proteins. They used a resulting PCR product to screen a HeLa cell library and isolated a partial cDNA encoding a novel protein kinase. The 5-prime end of the cDNA was obtained using RACE. Brambilla and Draetta (1994) designated the predicted 360-amino acid protein PISSLRE, based on the amino acid sequence of the region corresponding to the conserved CDC2 PSTAIRE motif. PISSLRE contains all the structural elements characteristic of CDKs and unique extensions at both ends. Sequence comparisons revealed that it shares 41% and 50% protein sequence identity with CDC2 and CDC2L1 (OMIM Ref. No. 176873), respectively. By Northern blot analysis, the authors determined that PISSLRE was expressed broadly in human tissues as a 2-kb mRNA. An additional 3.5-kb transcript was observed in some tissues. Using a combination of library screening and 5-prime RACE, Grana et al. (1994) isolated PISSLRE cDNAs that differed significantly at both ends from those isolated by Brambilla and Draetta (1994). Brambilla and Draetta (1994) attributed the differences to alternative splicing. Grana et al. (1994) were unable to identify any ATG initiation codons upstream of the sequence encoding the catalytic domain of the putative kinase. They suggested that translation may initiate at 1 of 3 non-ATG initiation codons.

Full details of the abovementioned studies are described in the following publications, the disclosure of which are hereby incorporated by reference:

Bullrich, F.; MacLachlan, T. K.; Sang, N.; Druck, T.; Veronese, M. L.; Allen, S. L.; Chiorazzi, N.; Koff, A.; Heubner, K.; Croce, C. M.; Giordano, A.: Chromosomal mapping of members of the cdc2 family of protein kinases, cdk3, cdk6, PISSLRE, and PITALRE, and a cdk inhibitor, p27-Kip1, to regions involved in human cancer. Cancer Res. 55:1199-1205, 1995; and Grana, X.; Claudio, P. P.; De Luca, A.; Sang, N.; Giordano, A.: PISSLRE, a human novel CDC2-related protein kinase. Oncogene 9:2097-2103, 1994.

Further studies establishing the function and utilities of CDK10 are found in John Hopkins OMIM database record ID 603464, and in sited publications numbered 288 and 2881 listed in the bibliography section hereinbelow, which are also hereby incorporated by reference. Elongation of Very Long Chain Fatty Acids (FEN1/Elo2, SUR4/Elo3, yeast)-like 4 (ELOVL4, Accession NM_022726) is another VGAM193 host target gene. ELOVL4 BINDING SITE is HOST TARGET binding site found in the 3' untranslated region of mRNA encoded by ELOVL4, corresponding to a HOST TARGET binding site such as BINDING SITE I, BINDING SITE II or BINDING SITE III. Table 2 illustrates the complementarity of the nucleotide sequences of ELOVL4 BINDING SITE, designated SEQ ID:22927, to the nucleotide sequence of VGAM193 RNA, herein designated VGAM RNA, also designated SEQ ID:2904.

Another function of VGAM193 is therefore inhibition of Elongation of Very Long Chain Fatty Acids (FEN1/Elo2, SUR4/Elo3, yeast)-like 4 (ELOVL4, Accession NM_022726). Accordingly, utilities of VGAM193 include diagnosis, prevention and treatment of diseases and clinical conditions associated with ELOVL4. Echinoderm Microtubule Associated Protein Like 1 (EML1, Accession XM_007243) is another VGAM193 host target gene. EML1 BINDING SITE is HOST TARGET binding site found in the 3' untranslated region of mRNA encoded by EML1, corresponding to a HOST TARGET binding site such as BINDING SITE I, BINDING SITE II or BINDING SITE III. Table 2 illustrates the complementarity of the nucleotide sequences of EML1 BINDING SITE, designated SEQ ID:30036, to the nucleotide sequence of VGAM193 RNA, herein designated VGAM RNA, also designated SEQ ID:2904.

Another function of VGAM193 is therefore inhibition of Echinoderm Microtubule Associated Protein Like 1 (EML1, Accession XM_007243). Accordingly, utilities of VGAM193 include diagnosis, prevention and treatment of diseases and clinical conditions associated with EML1. Coagulation Factor II (thrombin) Receptor-like 3 (F2RL3, Accession NM_003950) is another VGAM193 host target gene. F2RL3 BINDING SITE is HOST TARGET binding site found in the 3' untranslated region of mRNA encoded by F2RL3, corresponding to a HOST TARGET binding site such as BINDING SITE I, BINDING SITE II or BINDING SITE III. Table 2 illustrates the complementarity of the nucleotide sequences of F2RL3 BINDING SITE, designated SEQ ID:10083, to the nucleotide sequence of VGAM193 RNA, herein designated VGAM RNA, also designated SEQ ID:2904.

Another function of VGAM193 is therefore inhibition of Coagulation Factor II (thrombin) Receptor-like 3 (F2RL3, Accession NM_003950), a gene which Protease-activated receptor 4; G protein-coupled receptor that increases phosphoinositide hydrolysis. Accordingly, utilities of VGAM193 include diagnosis, prevention and treatment of diseases and clinical conditions associated with F2RL3. The function of F2RL3 has been established by previous studies. Protease-activated receptors 1 (PAR1; 187930), 2 (PAR2; 600933), and 3 (PAR3; 601919) are members of a unique G protein-coupled receptor family. They are characterized by a tethered peptide ligand at the extracellular amino terminus that is generated by minor proteolysis. Xu et al. (1998) identified a partial cDNA sequence of a fourth member of this family, PAR4, in an expressed sequence tag (EST) database, and a full-length cDNA clone was isolated from a lymphoma Daudi cell cDNA library. The open reading frame coded for a 7-transmembrane domain protein of 385 amino acids with 33% amino acid sequence identity with PAR1-3. A putative protease cleavage site was identified within the extracellular amino terminus. Northern blot analysis showed that PAR4 mRNA is expressed in a number of human tissues, with high levels being present in lung, pancreas, thyroid, testis, and small intestine. By fluorescence in situ hybridization, Xu et al. (1998) mapped the PAR4 gene to 19p12. Animal model experiments lend further support to the function of F2RL3. Sambrano et al. (2001) demonstrated that platelets from Par4-deficient mice failed to change shape, mobilize calcium, secrete ATP, or aggregate in response to thrombin.

It is appreciated that the abovementioned animal model for F2RL3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Xu, W.-F.; Andersen, H.; Whitmore, T. E.; Presnell, S. R.; Yee, D. P.; Ching, A.; Gilbert, T.; Davie, E. W.; Foster, D. C.: Cloning and characterization of human protease-activated receptor 4. Proc. Nat. Acad. Sci. 95:6642-6646, 1998; and Sambrano, G. R.; Weiss, E. J.; Zheng, Y.-W.; Huang, W.; Coughlin, S. R.: Role of thrombin signalling in platelets in haemostasis and thrombosis. Nature 413: 74-78, 2001.

Further studies establishing the function and utilities of F2RL3 are found in John Hopkins OMIM database record ID 602779, and in sited publications numbered 7653, 9406-940 and 7654 listed in the bibliography section hereinbelow, which are also hereby incorporated by reference. Interleukin 1 Receptor Antagonist (IL1RN, Accession NM_000577) is another VGAM193 host target gene. IL1RN BINDING SITE is HOST TARGET binding site found in the 3' untranslated region of mRNA encoded by IL1RN, corresponding to a HOST TARGET binding site such as BINDING SITE I, BINDING SITE II or BINDING SITE III. Table 2 illustrates the complementarity of the nucleotide sequences of IL1RN BINDING SITE, designated SEQ ID:6180, to the nucleotide sequence of VGAM193 RNA, herein designated VGAM RNA, also designated SEQ ID:2904.

Another function of VGAM193 is therefore inhibition of Interleukin 1 Receptor Antagonist (IL1RN, Accession NM_000577), a gene which inhibits the activity of il-1 by binding to its receptor. il-1ra has no il-1 like activity. Accordingly, utilities of VGAM193 include diagnosis, prevention and treatment of diseases and clinical conditions associated with IL1RN. The function of IL1RN has been established by previous studies. Using a homology-based PCR approach to identify IL1 receptor-related genes, Lovenberg et al. (1996) identified a cDNA, which they called IL1RRP2, that encodes a 561-amino acid protein with significant sequence identity to the IL1 receptor. Like IL1RRP (OMIM Ref. No. 604494), IL1RRP2 failed to bind IL1-alpha (OMIM Ref. No. 147760) or IL1-beta (OMIM Ref. No. 147720). Dale and Nicklin (1999) showed by radiation hybrid mapping that IL1R2 (OMIM Ref. No. 147811), IL1R1 (OMIM Ref. No. 147810), IL1RL2, IL1RL1 (OMIM Ref. No. 601203), and IL18R1 (OMIM Ref. No. 604494) map to 2q12 and are transcribed in the same direction, with IL1R2 being transcribed towards the cluster Full details of the abovementioned studies are described in the following publications, the disclosure of which are hereby incorporated by reference:

Dale, M.; Nicklin, M. J.: Interleukin-1 receptor cluster: gene organization of IL1R2, IL1R1, IL1RL2 (IL-1Rrp2), IL1RL1 (T1/ST2), and IL18R1 (IL-1Rrp) on human chromosome 2q. Genomics 57:177-179, 1999; and Lovenberg, T. W.; Crowe, P. D.; Liu, C.; Chalmers, D. T.; Liu, X. J.; Liaw, C.; Clevenger, W.; Oltersdorf, T.; De Souza, E. B.; Maki, R. A.: Cloning of a cDNA encoding a novel interleu.

Further studies establishing the function and utilities of IL1RN are found in John Hopkins OMIM database record ID 147679, and in sited publications numbered 465-467, 469, 470-472, 4803-4805, 471 and 4806-4808 listed in the bibliography section hereinbelow, which are also hereby incorporated by reference. Peroxisomal Farnesylated Protein (PXF, Accession NM_002857) is another VGAM193 host target gene. PXF BINDING SITE is HOST TARGET binding site found in the 3' untranslated region of mRNA encoded by PXF, corresponding to a HOST TARGET binding site such as BINDING SITE I, BINDING SITE II or BINDING SITE III. Table 2 illustrates the complementarity of the nucleotide sequences of PXF BINDING SITE, designated SEQ ID:8751, to the nucleotide sequence of VGAM193 RNA, herein designated VGAM RNA, also designated SEQ ID:2904.

Another function of VGAM193 is therefore inhibition of Peroxisomal Farnesylated Protein (PXF, Accession NM_002857), a gene which may function in peroxisomal biogenesis or assembly. Accordingly, utilities of VGAM193 include diagnosis, prevention and treatment of diseases and clinical conditions associated with PXF. The function of PXF has been established by previous studies. The covalent attachment of prenyl lipids, such as farnesyl or geranylgeranyl groups, by specific transferases is indispensable for the cellular sorting of many proteins. James et al. (1994) identified in hamster a farnesylated protein, called peroxisomal farnesylated protein or PxF, that localized to the outer surface of peroxisomes. Kammerer et al. (1997) found that the protein sequence of PxF is 93% identical to that of HK33, a human protein identified by Braun et al. (1994). Braun et al. (1994) reported that HK33 is a predicted 299-amino acid protein with a mass of 33 kD by SDS-PAGE. Northern blot analysis and RT-PCR revealed that HK33 is expressed ubiquitously as 2.2 to 2.5-kb and 4-kb mRNAs. The fact that the gene was transcribed in all cells and tissues tested indicated its status as a housekeeping gene. Braun et al. (1994) demonstrated that at least 2 different HK33 transcripts result from the use of alternative polyadenylation sites. Kammerer et al. (1997) isolated 4 variant HK33, or PXF, mRNAs produced by alternative splicing. They found that the proteins encoded by 2 of the splice variants were farnesylated in vitro. Using immunoelectron microscopy, Kammerer et al. (1997) showed that PXF is localized to the cytoplasmic surface of peroxisomes in liver cells. These authors reported that the PXF gene contains 8 exons and spans approximately 9 kb. The basal promoter is located within the first 239 bp upstream of the coding region.

Full details of the abovementioned studies are described in the following publications, the disclosure of which are hereby incorporated by reference:

Braun, A.; Kammerer, S.; Weissenhorn, W.; Weiss, E. H.; Cleve, H.: Sequence of a putative human housekeeping gene (HK33) localized on chromosome 1. Gene 146:291-295, 1994; and Kammerer, S.; Arnold, N.; Gutensohn, W.; Mewes, H.-W.; Kunau, W.-H.; Hofler, G.; Roscher, A. A.; Braun, A.: Genomic organization and molecular characterization of a gene encoding HsPX.

Further studies establishing the function and utilities of PXF are found in John Hopkins OMIM database record ID 600279, and in sited publications numbered 8427-843 and 7739 listed in the bibliography section hereinbelow, which are also hereby incorporated by reference. DCOHM (Accession NM_032151) is another VGAM193 host target gene. DCOHM BINDING SITE is HOST TARGET binding site found in the 3' untranslated region of mRNA encoded by DCOHM, corresponding to a HOST TARGET binding site such as BINDING SITE I, BINDING SITE II or BINDING SITE III. Table 2 illustrates the complementarity of the nucleotide sequences of DCOHM BINDING SITE, designated SEQ ID:25843, to the nucleotide sequence of VGAM193 RNA, herein designated VGAM RNA, also designated SEQ ID:2904.

Another function of VGAM193 is therefore inhibition of DCOHM (Accession NM_032151). Accordingly, utilities of VGAM193 include diagnosis, prevention and treatment of diseases and clinical conditions associated with DCOHM. FLJ32334 (Accession NM_144565) is another VGAM193 host target gene. FLJ32334 BINDING SITE is HOST TARGET binding site found in the 3" untranslated region of mRNA encoded by FLJ32334, corresponding to a HOST TARGET binding site such as BINDING SITE I, BINDING SITE II or BINDING SITE III. Table 2 illustrates the complementarity of the nucleotide sequences of FLJ32334 BINDING SITE, designated SEQ ID:29363, to the nucleotide sequence of VGAM193 RNA, herein designated VGAM RNA, also designated SEQ ID:2904.

Another function of VGAM193 is therefore inhibition of FLJ32334 (Accession NM_144565). Accordingly, utilities of VGAM193 include diagnosis, prevention and treatment of diseases and clinical conditions associated with FLJ32334. KIAA1391 (Accession XM_040866) is another VGAM193 host target gene. KIAA1391 BINDING SITE is HOST TARGET binding site found in the 3' untranslated region of mRNA encoded by KIAA1391, corresponding to a HOST TARGET binding site such as BINDING SITE I, BINDING SITE II or BINDING SITE III. Table 2 illustrates the complementarity of the nucleotide sequences of KIAA1391 BINDING SITE, designated SEQ ID:33402, to the nucleotide sequence of VGAM193 RNA, herein designated VGAM RNA, also designated SEQ ID:2904.

Another function of VGAM193 is therefore inhibition of KIAA1391 (Accession XM_040866). Accordingly, utilities of VGAM193 include diagnosis, prevention and treatment of diseases and clinical conditions associated with KIAA1391. NY-REN-60 (Accession XM_040506) is another VGAM193 host target gene. NY-REN-60 BINDING SITE is HOST TARGET binding site found in the 3' untranslated region of mRNA encoded by NY-REN-60, corresponding to a HOST TARGET binding site such as BINDING SITE I, BINDING SITE II or BINDING SITE III. Table 2 illustrates the complementarity of the nucleotide sequences of NY-REN-60 BINDING SITE, designated SEQ ID:33316, to the nucleotide sequence of VGAM193 RNA, herein designated VGAM RNA, also designated SEQ ID:2904.

Another function of VGAM193 is therefore inhibition of NY-REN-60 (Accession XM_040506). Accordingly, utilities of VGAM193 include diagnosis, prevention and treatment of diseases and clinical conditions associated with NY-REN-60. SP329 (Accession NM_030793) is another VGAM193 host target gene. SP329 BINDING SITE is HOST TARGET binding site found in the 5' untranslated region of mRNA encoded by SP329, corresponding to a HOST TARGET binding site such as BINDING SITE I, BINDING SITE II or BINDING SITE III. Table 2 illustrates the complementarity of the nucleotide sequences of SP329 BINDING SITE, designated SEQ ID:25099, to the nucleotide sequence of VGAM193 RNA, herein designated VGAM RNA, also designated SEQ ID:2904.

Another function of VGAM193 is therefore inhibition of SP329 (Accession NM_030793). Accordingly, utilities of VGAM193 include diagnosis, prevention and treatment of diseases and clinical conditions associated with SP329. Testis-specific Kinase 2 (TESK2, Accession XM_032399) is another VGAM193 host target gene. TESK2 BINDING SITE is HOST TARGET binding site found in the 3' untranslated region of mRNA encoded by TESK2, corresponding to a HOST TARGET binding site such as BINDING SITE I, BINDING SITE II or BINDING SITE III. Table 2 illustrates the complementarity of the nucleotide sequences of TESK2 BINDING SITE, designated SEQ ID:31649, to the nucleotide sequence of VGAM193 RNA, herein designated VGAM RNA, also designated SEQ ID:2904.

Another function of VGAM193 is therefore inhibition of Testis-specific Kinase 2 (TESK2, Accession XM_032399). Accordingly, utilities of VGAM193 include diagnosis, prevention and treatment of diseases and clinical conditions associated with TESK2. LOC147622 (Accession XM_097255) is another VGAM193 host target gene. LOC147622 BINDING SITE is HOST TARGET binding site found in the 5' untranslated region of mRNA encoded by LOC147622, corresponding to a HOST TARGET binding site such as BINDING SITE I, BINDING SITE II or BINDING SITE III. Table 2 illustrates the complementarity of the nucleotide sequences of LOC147622 BINDING SITE, designated SEQ ID:40849, to the nucleotide sequence of VGAM193 RNA, herein designated VGAM RNA, also designated SEQ ID:2904.

Another function of VGAM193 is therefore inhibition of LOC147622 (Accession XM_097255). Accordingly, utilities of VGAM193 include diagnosis, prevention and treatment of diseases and clinical conditions associated with LOC147622. LOC155435 (Accession XM_088257) is another VGAM193 host target gene. LOC155435 BINDING SITE is HOST TARGET binding site found in the 3' untranslated region of mRNA encoded by LOC155435, corresponding to a HOST TARGET binding site such as BINDING SITE I, BINDING SITE II or BINDING SITE III. Table 2 illustrates the complementarity of the nucleotide sequences of LOC155435 BINDING SITE, designated SEQ ID:39569, to the nucleotide sequence of VGAM193 RNA, herein designated VGAM RNA, also designated SEQ ID:2904.

Another function of VGAM193 is therefore inhibition of LOC155435 (Accession XM_088257). Accordingly, utilities of VGAM193 include diagnosis, prevention and treatment of diseases and clinical conditions associated with LOC155435. FIG. 1 further provides a conceptual description of a novel bioinformatically detected viral gene of the present invention, referred to here as Viral Genomic Address Messenger 194 (VGAM194) viral gene, which modulates expression of respective host target genes thereof, the function and utility of which host target genes is known in the art.

VGAM194 is a novel bioinformatically detected regulatory, non protein coding, viral micro RNA (miRNA) gene. The method by which VGAM194 was detected is described hereinabove with reference to FIGS. 1-8.

VGAM194 gene, herein designated VGAM GENE, is a viral gene contained in the genome of Shrimp White Spot Syndrome Virus (white spot bacilliform virus). VGAM194 host target gene, herein designated VGAM HOST TARGET GENE, is a human gene contained in the human genome.

VGAM194 gene encodes a VGAM194 precursor RNA, herein designated VGAM PRECURSOR RNA. Similar to other miRNA genes, and unlike most ordinary genes, VGAM194 precursor RNA does not encode a protein. A nucleotide sequence identical or highly similar to the nucleotide sequence of VGAM194 precursor RNA is designated SEQ ID:180, and is provided hereinbelow with reference to the sequence listing part. Nucleotide sequence SEQ ID:180 is located at position 172456 relative to the genome of Shrimp White Spot Syndrome Virus (white spot bacilliform virus).

VGAM194 precursor RNA folds onto itself, forming VGAM194 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM194 folded precursor RNA into VGAM194 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM194 RNA is designated SEQ ID:2905, and is provided hereinbelow with reference to the sequence listing part.

VGAM194 host target gene, herein designated VGAM HOST TARGET GENE, encodes a corresponding messenger RNA, VGAM194 host target RNA, herein designated VGAM HOST TARGET RNA. VGAM194 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM194 RNA, herein designated VGAM RNA, binds complementarily to one or more host target binding sites located in untranslated regions of VGAM194 host target RNA, herein designated VGAM HOST TARGET RNA. This complementary binding is due to the fact that the nucleotide sequence of VGAM194 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM194 RNA, herein designated VGAM RNA, may have a different number of host target binding sites in untranslated regions of a VGAM194 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM194 RNA, herein designated VGAM RNA, to host target binding sites on VGAM194 host target RNA, herein designated VGAM HOST TARGET RNA, such as BINDING SITE I, BINDING SITE II and BINDING SITE III, inhibits translation of VGAM194 host target RNA into VGAM194 host target protein, herein designated VGAM HOST TARGET PROTEIN. VGAM host target protein is therefore outlined by a broken line.

It is appreciated that VGAM194 host target gene, herein designated VGAM HOST TARGET GENE, in fact represents a plurality of VGAM194 host target genes. The mRNA of each one of this plurality of VGAM194 host target genes comprises one or more host target binding sites, each having a nucleotide sequence which is at least partly complementary to VGAM194 RNA, herein designated VGAM RNA, and which when bound by VGAM194 RNA causes inhibition of translation of respective one or more VGAM194 host target proteins.

It is further appreciated by one skilled in the art that the mode of translational inhibition illustrated by FIG. 1 with specific reference to translational inhibition exerted by VGAM194 gene, herein designated VGAM GENE, on one or more VGAM194 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM194 is inhibition of expression of host target genes, as part of a novel viral mechanism of attacking a host. Accordingly, utilities of VGAM194 include diagnosis, prevention and treatment of viral infection by Shrimp White Spot Syndrome Virus (white spot baciliform virus). Specific functions, and accordingly utilities, of VGAM194 correlate with, and may be deduced from, the identity of the host target genes which VGAM194 binds and inhibits, and the function of these host target genes, as elaborated hereinbelow.

Nucleotide sequences of the VGAM194 precursor RNA, herein designated VGAM PRECURSOR RNA, and of the 'diced' VGAM194 RNA, herein designated VGAM RNA, and a schematic representation of the secondary folding of VGAM194 folded precursor RNA, herein designated VGAM FOLDED PRECURSOR RNA, of VGAM194 are further described hereinbelow with reference to Table 1.

Nucleotide sequences of host target binding sites, such as BINDING SITE-I, BINDING SITE-II and BINDING SITE-III of FIG. 1, found on VGAM194 host target RNA, and schematic representation of the complementarity of each of these host target binding sites to VGAM194 RNA, herein designated VGAM RNA, are described hereinbelow with reference to Table 2.

As mentioned hereinabove with reference to FIG. 1, a function of VGAM194 gene, herein designated VGAM is inhibition of expression of VGAM194 target genes. It is appreciated that specific functions, and accordingly utilities, of VGAM194 correlate with, and may be deduced from, the identity of the target genes which VGAM194 binds and inhibits, and the function of these target genes, as elaborated hereinbelow.

A Kinase (PRKA) Anchor Protein 13 (AKAP13, Accession NM_007200) is a VGAM194 host target gene. AKAP13 BINDING SITE is HOST TARGET binding site found in the 3' untranslated region of mRNA encoded by AKAP13, corresponding to a HOST TARGET binding site such as BINDING SITE I, BINDING SITE II or BINDING SITE III. Table 2 illustrates the complementarity of the nucleotide sequences of AKAP13 BINDING SITE, designated SEQ ID:14055, to the nucleotide sequence of VGAM194 RNA, herein designated VGAM RNA, also designated SEQ ID:2905.

A function of VGAM194 is therefore inhibition of A Kinase (PRKA) Anchor Protein 13 (AKAP13, Accession NM_007200), a gene which regulates subcellular localization of type II cAMP-dependent PKA. Accordingly, utilities of VGAM194 include diagnosis, prevention and treatment of diseases and clinical conditions associated with AKAP13. The function of AKAP13 and its association with various diseases and clinical conditions, has been established by previous studies, as described hereinabove with reference to VGAM17. Charot-Leyden Crystal Protein (CLC, Accession NM_013246) is another VGAM194 host target gene. CLC BINDING SITE is HOST TARGET binding site found in the 3" untranslated region of mRNA encoded by CLC, corresponding to a HOST TARGET binding site such as BINDING SITE I, BINDING SITE II or BINDING SITE III. Table 2 illustrates the complementarity of the nucleotide sequences of CLC BINDING SITE, designated SEQ ID:14907, to the nucleotide sequence of VGAM194 RNA, herein designated VGAM RNA, also designated SEQ ID:2905.

Another function of VGAM194 is therefore inhibition of Charot-Leyden Crystal Protein (CLC, Accession NM_013246). Accordingly, utilities of VGAM194 include diagnosis, prevention and treatment of diseases and clinical conditions associated with CLC. Fucosyltransferase 6 (alpha (1,3) Fucosyltransferase) (FUT6, Accession NM_000150) is another VGAM194 host target gene. FUT6 BINDING SITE is HOST TARGET binding site found in the 5' untranslated region of mRNA encoded by FUT6, corresponding to a HOST TARGET binding site such as BINDING SITE I, BINDING SITE II or BINDING SITE III. Table 2 illustrates the complementarity of the nucleotide sequences of FUT6 BINDING SITE, designated SEQ ID:5648, to the nucleotide sequence of VGAM194 RNA, herein designated VGAM RNA, also designated SEQ ID:2905.

Another function of VGAM194 is therefore inhibition of Fucosyltransferase 6 (alpha (1,3) Fucosyltransferase) (FUT6, Accession NM_000150), a gene which is involved in the biosynthesis of the e-selectin ligand, sialyl-lewis x. catalyzes the transfer of fucose from gdp-beta-fucose to alpha-2,3 sialylated substrates. Accordingly, utilities of VGAM194 include diagnosis, prevention and treatment of diseases and clinical conditions associated with FUT6. The function of FUT6 has been established by previous studies. The alpha-1, 3-fucosyltransferases constitute a large family of glycosyltransferases with a high degree of homology. The enzymes of this family comprise 3 main activity patterns called myeloid, plasma, and Lewis, based on their capacity to transfer alpha-L-fucose to distinct oligosaccharide acceptors, their sensitivity to N-ethylmaleimide inhibition, their cation requirements, and their tissue-specific expression patterns. The different categories of alpha-1,3-fucosyltransferases are sequentially expressed during embryo-fetal development.

Full details of the abovementioned studies are described in the following publications, the disclosure of which are hereby incorporated by reference:

Brinkman-Van der Linden, E. C. M.; Mollicone, R.; Oriol, R.; Larson, G.; Van den Eijnden, D. H.; Van Dijk, W.: A missense mutation in the FUT6 gene results in total absence of alpha-3-fucosylation of human alpha-1-acid glycoprotein. J. Biol. Chem. 271:14492-14495, 1996; and Cameron, H. S.; Szczepaniak, D.; Weston, B. W.: Expression of human chromosome 19p alpha-(1,3)-fucosyltransferase genes in normal tissues: alternative splicing, polyadenylation, and is.

Further studies establishing the function and utilities of FUT6 are found in John Hopkins OMIM database record ID 136836, and in sited publications numbered 2180, 2983-2984, 2177, 2985-298 and 2179 listed in the bibliography section hereinbelow, which are also hereby incorporated by reference. Chromosome 20 Open Reading Frame 19 (C20orf19, Accession NM_018474) is another VGAM194 host target gene. C20orf19 BINDING SITE is HOST TARGET binding site found in the 5" untranslated region of mRNA encoded by C20orf19, corresponding to a HOST TARGET binding site such as BINDING SITE I, BINDING SITE II or BINDING SITE III. Table 2 illustrates the complementarity of the nucleotide sequences of C20orf19 BINDING SITE, designated SEQ ID:20541, to the nucleotide sequence of VGAM194 RNA, herein designated VGAM RNA, also designated SEQ ID:2905.

Another function of VGAM194 is therefore inhibition of Chromosome 20 Open Reading Frame 19 (C20orf19, Accession NM_018474). Accordingly, utilities of VGAM194 include diagnosis, prevention and treatment of diseases and clinical conditions associated with C20orf19. DKFZp434O0320 (Accession XM_097012) is another VGAM194 host target gene. DKFZp434O0320 BINDING SITE is HOST TARGET binding site found in the 3' untranslated region of mRNA encoded by DKFZp434O0320, corresponding to a HOST TARGET binding site such as BINDING SITE I, BINDING SITE II or BINDING SITE III. Table 2 illustrates the complementarity of the nucleotide sequences of DKFZp434O0320 BINDING SITE, designated SEQ ID:40702, to the nucleotide sequence of VGAM194 RNA, herein designated VGAM RNA, also designated SEQ ID:2905.

Another function of VGAM194 is therefore inhibition of DKFZp434O0320 (Accession XM_097012). Accordingly, utilities of VGAM194 include diagnosis, prevention and treatment of diseases and clinical conditions associated with DKFZp434O0320. FLJ12934 (Accession NM_022899) is another VGAM194 host target gene. FLJ12934 BINDING SITE is HOST TARGET binding site found in the 3' untranslated region of mRNA encoded by FLJ12934, corresponding to a HOST TARGET binding site such as BINDING SITE I, BINDING SITE II or BINDING SITE III. Table 2 illustrates the complementarity of the nucleotide sequences of FLJ12934 BINDING SITE, designated SEQ ID:23173, to the nucleotide sequence of VGAM194 RNA, herein designated VGAM RNA, also designated SEQ ID:2905.

Another function of VGAM194 is therefore inhibition of FLJ12934 (Accession NM_022899). Accordingly, utilities of VGAM194 include diagnosis, prevention and treatment of diseases and clinical conditions associated with FLJ12934. FLJ13441 (Accession NM_023924) is another VGAM194 host target gene. FLJ13441 BINDING SITE is HOST TARGET binding site found in the 5' untranslated region of mRNA encoded by FLJ13441, corresponding to a HOST TARGET binding site such as BINDING SITE I, BINDING SITE II or BINDING SITE III. Table 2 illustrates the complementarity of the nucleotide sequences of FLJ13441 BINDING SITE, designated SEQ ID:23389, to the nucleotide sequence of VGAM194 RNA, herein designated VGAM RNA, also designated SEQ ID:2905.

Another function of VGAM194 is therefore inhibition of FLJ13441 (Accession NM_023924). Accordingly, utilities of VGAM194 include diagnosis, prevention and treatment of diseases and clinical conditions associated with FLJ13441. FLJ20079 (Accession NM_017656) is another VGAM194 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19175, to the nucleotide sequence of VGAM194 RNA, herein designated VGAM RNA, also designated SEQ ID:2905.

Another function of VGAM194 is therefore inhibition of FLJ20079 (Accession NM_017656). Accordingly, utilities of VGAM194 include diagnosis, prevention and treatment of diseases and clinical conditions associated with FLJ20079. KIAA0426 (Accession NM_014724) is another VGAM194 host target gene. KIAA0426 BINDING SITE is HOST TARGET binding site found in the 3' untranslated region of mRNA encoded by KIAA0426, corresponding to a HOST TARGET binding site such as BINDING SITE I, BINDING SITE II or BINDING SITE III. Table 2 illustrates the complementarity of the nucleotide sequences of KIAA0426 BINDING SITE, designated SEQ ID:16305, to the nucleotide sequence of VGAM194 RNA, herein designated VGAM RNA, also designated SEQ ID:2905.

Another function of VGAM194 is therefore inhibition of KIAA0426 (Accession NM_014724). Accordingly, utilities of VGAM194 include diagnosis, prevention and treatment of diseases and clinical conditions associated with KIAA0426. KIAA1143 (Accession XM_044014) is another VGAM194 host target gene. KIAA1143 BINDING SITE is HOST TARGET binding site found in the 3' untranslated region of mRNA encoded by KIAA1143, corresponding to a HOST TARGET binding site such as BINDING SITE I, BINDING SITE II or BINDING SITE III. Table 2 illustrates the complementarity of the nucleotide sequences of KIAA1143 BINDING SITE, designated SEQ ID:34074, to the nucleotide sequence of VGAM194 RNA, herein designated VGAM RNA, also designated SEQ ID:2905.

Another function of VGAM194 is therefore inhibition of KIAA1143 (Accession XM_044014). Accordingly, utilities of VGAM194 include diagnosis, prevention and treatment of diseases and clinical conditions associated with KIAA1143. Synaptojanin 2 (SYNJ2, Accession XM_029746) is another VGAM194 host target gene. SYNJ2 BINDING SITE is HOST TARGET binding site found in the 3' untranslated region of mRNA encoded by SYNJ2, corresponding to a HOST TARGET binding site such as BINDING SITE I, BINDING SITE II or BINDING SITE III. Table 2 illustrates the complementarity of the nucleotide sequences of SYNJ2 BINDING SITE, designated SEQ ID:30941, to the nucleotide sequence of VGAM194 RNA, herein designated VGAM RNA, also designated SEQ ID:2905.

Another function of VGAM194 is therefore inhibition of Synaptojanin 2 (SYNJ2, Accession XM_029746). Accordingly, utilities of VGAM194 include diagnosis, prevention and treatment of diseases and clinical conditions associated with SYNJ2. LOC220776 (Accession XM_043388) is another VGAM194 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33928, to the nucleotide sequence of VGAM194 RNA, herein designated VGAM RNA, also designated SEQ ID:2905.

Another function of VGAM194 is therefore inhibition of LOC220776 (Accession XM_043388). Accordingly, utilities of VGAM194 include diagnosis, prevention and treatment of diseases and clinical conditions associated with LOC220776. LOC257239 (Accession XM_173125) is another VGAM194 host target gene. LOC257239 BINDING SITE is HOST TARGET binding site found in the 5' untranslated region of mRNA encoded by LOC257239, corresponding to a HOST TARGET binding site such as BINDING SITE I, BINDING SITE II or BINDING SITE III. Table 2 illustrates the complementarity of the nucleotide sequences of LOC257239 BINDING SITE, designated SEQ ID:46372, to the nucleotide sequence of VGAM194 RNA, herein designated VGAM RNA, also designated SEQ ID:2905.

Another function of VGAM194 is therefore inhibition of LOC257239 (Accession XM_173125). Accordingly, utilities of VGAM194 include diagnosis, prevention and treatment of diseases and clinical conditions associated with LOC257239. LOC90594 (Accession XM_032820) is another VGAM194 host target gene. LOC90594 BINDING SITE is HOST TARGET binding site found in the 3' untranslated region of mRNA encoded by LOC90594, corresponding to a HOST TARGET binding site such as BINDING SITE I, BINDING SITE II or BINDING SITE III. Table 2 illustrates the complementarity of the nucleotide sequences of LOC90594 BINDING SITE, designated SEQ ID:31773, to the nucleotide sequence of VGAM194 RNA, herein designated VGAM RNA, also designated SEQ ID:2905.

Another function of VGAM194 is therefore inhibition of LOC90594 (Accession XM_032820). Accordingly, utilities of VGAM194 include diagnosis, prevention and treatment of diseases and clinical conditions associated with LOC90594. FIG. 1 further provides a conceptual description of a novel bioinformatically detected viral gene of the present invention, referred to here as Viral Genomic Address Messenger 195 (VGAM195) viral gene, which modulates expression of respective host target genes thereof, the function and utility of which host target genes is known in the art.

VGAM195 is a novel bioinformatically detected regulatory, non protein coding, viral micro RNA (miRNA) gene. The method by which VGAM195 was detected is described hereinabove with reference to FIGS. 1-8.

VGAM195 gene, herein designated VGAM GENE, is a viral gene contained in the genome of Shrimp White Spot Syndrome Virus (white spot bacilliform virus). VGAM195 host target gene, herein designated VGAM HOST TARGET GENE, is a human gene contained in the human genome.

VGAM195 gene encodes a VGAM195 precursor RNA, herein designated VGAM PRECURSOR RNA. Similar to other miRNA genes, and unlike most ordinary genes, VGAM195 precursor RNA does not encode a protein. A nucleotide sequence identical or highly similar to the nucleotide sequence of VGAM195 precursor RNA is designated SEQ ID:181, and is provided hereinbelow with reference to the sequence listing part. Nucleotide sequence SEQ ID:181 is located at position 113163 relative to the genome of Shrimp White Spot Syndrome Virus (white spot bacilliform virus).

VGAM195 precursor RNA folds onto itself, forming VGAM195 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM195 folded precursor RNA into VGAM195 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM195 RNA is designated SEQ ID:2906, and is provided hereinbelow with reference to the sequence listing part.

VGAM195 host target gene, herein designated VGAM HOST TARGET GENE, encodes a corresponding messenger RNA, VGAM195 host target RNA, herein designated VGAM HOST TARGET RNA. VGAM195 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM195 RNA, herein designated VGAM RNA, binds complementarily to one or more host target binding sites located in untranslated regions of VGAM195 host target RNA, herein designated VGAM HOST TARGET RNA. This complementary binding is due to the fact that the nucleotide sequence of VGAM195 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM195 RNA, herein designated VGAM RNA, may have a different number of host target binding sites in untranslated regions of a VGAM195 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM195 RNA, herein designated VGAM RNA, to host target binding sites on VGAM195 host target RNA, herein designated VGAM HOST TARGET RNA, such as BINDING SITE I, BINDING SITE II and BINDING SITE III, inhibits translation of VGAM195 host target RNA into VGAM195 host target protein, herein designated VGAM HOST TARGET PROTEIN. VGAM host target protein is therefore outlined by a broken line.

It is appreciated that VGAM195 host target gene, herein designated VGAM HOST TARGET GENE, in fact represents a plurality of VGAM195 host target genes. The mRNA of each one of this plurality of VGAM195 host target genes comprises one or more host target binding sites, each having a nucleotide sequence which is at least partly complementary to VGAM195 RNA, herein designated VGAM RNA, and which when bound by VGAM195 RNA causes inhibition of translation of respective one or more VGAM195 host target proteins.

It is further appreciated by one skilled in the art that the mode of translational inhibition illustrated by FIG. 1 with specific reference to translational inhibition exerted by VGAM195 gene, herein designated VGAM GENE, on one or more VGAM195 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM195 is inhibition of expression of host target genes, as part of a novel viral mechanism of attacking a host. Accordingly, utilities of VGAM195 include diagnosis, prevention and treatment of viral infection by Shrimp White Spot Syndrome Virus (white spot bacilliform virus). Specific functions, and accordingly utilities, of VGAM195 correlate with, and may be deduced from, the identity of the host target genes which VGAM195 binds and inhibits, and the function of these host target genes, as elaborated hereinbelow.

Nucleotide sequences of the VGAM195 precursor RNA, herein designated VGAM PRECURSOR RNA, and of the 'diced' VGAM195 RNA, herein designated VGAM RNA, and a schematic representation of the secondary folding of VGAM195 folded precursor RNA, herein designated VGAM FOLDED PRECURSOR RNA, of VGAM195 are further described hereinbelow with reference to Table 1.

Nucleotide sequences of host target binding sites, such as BINDING SITE-I, BINDING SITE-II and BINDING SITE-III of FIG. 1, found on VGAM195 host target RNA, and schematic representation of the complementarity of each of these host target binding sites to VGAM195 RNA, herein designated VGAM RNA, are described hereinbelow with reference to Table 2.

As mentioned hereinabove with reference to FIG. 1, a function of VGAM195 gene, herein designated VGAM is inhibition of expression of VGAM195 target genes. It is appreciated that specific functions, and accordingly utilities, of VGAM195 correlate with, and may be deduced from, the identity of the target genes which VGAM195 binds and inhibits, and the function of these target genes, as elaborated hereinbelow.

Collagen, Type X, Alpha 1(Schmid metaphyseal chondrodysplasia) (COL10A1, Accession NM_000493) is a VGAM195 host target gene. COL10A1 BINDING SITE is HOST TARGET binding site found in the 3' untranslated region of mRNA encoded by COL10A1, corresponding to a HOST TARGET binding site such as BINDING SITE I, BINDING SITE II or BINDING SITE III. Table 2 illustrates the complementarity of the nucleotide sequences of COL10A1 BINDING SITE, designated SEQ ID:6105, to the nucleotide sequence of VGAM195 RNA, herein designated VGAM RNA, also designated SEQ ID:2906.

A function of VGAM195 is therefore inhibition of Collagen, Type X, Alpha 1(Schmid metaphyseal chondrodysplasia) (COL10A1, Accession NM_000493). Accordingly, utilities of VGAM195 include diagnosis, prevention and treatment of diseases and clinical conditions associated with COL10A1. COX15 Homolog, Cytochrome C Oxidase Assembly Protein (yeast) (COX15, Accession NM_004376) is another VGAM195 host target gene. COX15 BINDING SITE is HOST TARGET binding site found in the 3' untranslated region of mRNA encoded by COX15, corresponding to a HOST TARGET binding site such as BINDING SITE I, BINDING SITE II or BINDING SITE III. Table 2 illustrates the complementarity of the nucleotide sequences of COX15 BINDING SITE, designated SEQ ID:10598, to the nucleotide sequence of VGAM195 RNA, herein designated VGAM RNA, also designated SEQ ID:2906.

Another function of VGAM195 is therefore inhibition of COX15 Homolog, Cytochrome C Oxidase Assembly Protein (yeast) (COX15, Accession NM_004376). Accordingly, utilities of VGAM195 include diagnosis, prevention and treatment of diseases and clinical conditions associated with COX15. Chromosome 20 Open Reading Frame 110 (C20orf110, Accession XM_086728) is another VGAM195 host target gene. C20orf110 BINDING SITE is HOST TARGET binding site found in the 3' untranslated region of mRNA encoded by C20orf110, corresponding to a HOST TARGET binding site such as BINDING SITE I, BINDING SITE II or BINDING SITE III. Table 2 illustrates the complementarity of the nucleotide sequences of C20orf110 BINDING SITE, designated SEQ ID:38830, to the nucleotide sequence of VGAM195 RNA, herein designated VGAM RNA, also designated SEQ ID:2906.

Another function of VGAM195 is therefore inhibition of Chromosome 20 Open Reading Frame 110 (C20orf110, Accession XM_086728). Accordingly, utilities of VGAM195 include diagnosis, prevention and treatment of diseases and clinical conditions associated with C20orf110. CGI-142 (Accession NM_016073) is another VGAM195 host target gene. CGI-142 BINDING SITE is HOST TARGET binding site found in the 3' untranslated region of mRNA encoded by CGI-142, corresponding to a HOST TARGET binding site such as BINDING SITE I, BINDING SITE II or BINDING SITE III. Table 2 illustrates the complementarity of the nucleotide sequences of CGI-142 BINDING SITE, designated SEQ ID:18147, to the nucleotide sequence of VGAM195 RNA, herein designated VGAM RNA, also designated SEQ ID:2906.

Another function of VGAM195 is therefore inhibition of CGI-142 (Accession NM_016073). Accordingly, utilities of VGAM195 include diagnosis, prevention and treatment of diseases and clinical conditions associated with CGI-142. DIS3 (Accession NM_014953) is another VGAM195 host target gene. DIS3 BINDING SITE is HOST TARGET binding site found in the 3' untranslated region of mRNA encoded by DIS3, corresponding to a HOST TARGET binding site such as BINDING SITE I, BINDING SITE II or BINDING SITE III. Table 2 illustrates the complementarity of the nucleotide sequences of DIS3 BINDING SITE, designated SEQ ID:17302, to the nucleotide sequence of VGAM195 RNA, herein designated VGAM RNA, also designated SEQ ID:2906.

Another function of VGAM195 is therefore inhibition of DIS3 (Accession NM_014953). Accordingly, utilities of VGAM195 include diagnosis, prevention and treatment of diseases and clinical conditions associated with DIS3. LOC153338 (Accession XM_098361) is another VGAM195 host target gene. LOC153338 BINDING SITE is HOST TARGET binding site found in the 3' untranslated region of mRNA encoded by LOC153338, corresponding to a HOST TARGET binding site such as BINDING SITE I, BINDING SITE II or BINDING SITE III. Table 2 illustrates the complementarity of the nucleotide sequences of LOC153338 BINDING SITE, designated SEQ ID:41607, to the nucleotide sequence of VGAM195 RNA, herein designated VGAM RNA, also designated SEQ ID:2906.

Another function of VGAM195 is therefore inhibition of LOC153338 (Accession XM_098361). Accordingly, utilities of VGAM195 include diagnosis, prevention and treatment of diseases and clinical conditions associated with LOC153338. LOC202781 (Accession XM_117455) is another VGAM195 host target gene. LOC202781 BINDING SITE is HOST TARGET binding site found in the 3' untranslated region of mRNA encoded by LOC202781, corresponding to a HOST TARGET binding site such as BINDING SITE I, BINDING SITE II or BINDING SITE III. Table 2 illustrates the complementarity of the nucleotide sequences of LOC202781 BINDING SITE, designated SEQ ID:43444, to the nucleotide sequence of VGAM195 RNA, herein designated VGAM RNA, also designated SEQ ID:2906.

Another function of VGAM195 is therefore inhibition of LOC202781 (Accession XM_117455). Accordingly, utilities of VGAM195 include diagnosis, prevention and treatment of diseases and clinical conditions associated with LOC202781. FIG. 1 further provides a conceptual description of a novel bioinformatically detected viral gene of the present invention, referred to here as Viral Genomic Address Messenger 196 (VGAM196) viral gene, which modulates expression of respective host target genes thereof, the function and utility of which host target genes is known in the art.

VGAM196 is a novel bioinformatically detected regulatory, non protein coding, viral micro RNA (miRNA) gene. The method by which VGAM196 was detected is described hereinabove with reference to FIGS. 1-8.

VGAM196 gene, herein designated VGAM GENE, is a viral gene contained in the genome of Shrimp White Spot Syndrome Virus (white spot bacilliform virus). VGAM196 host target gene, herein designated VGAM HOST TARGET GENE, is a human gene contained in the human genome.

VGAM196 gene encodes a VGAM196 precursor RNA, herein designated VGAM PRECURSOR RNA. Similar to other miRNA genes, and unlike most ordinary genes, VGAM196 precursor RNA does not encode a protein. A nucleotide sequence identical or highly similar to the nucleotide sequence of VGAM196 precursor RNA is designated SEQ ID:182, and is provided hereinbelow with reference to the sequence listing part. Nucleotide sequence SEQ ID:182 is located at position 205571 relative to the genome of Shrimp White Spot Syndrome Virus (white spot bacilliform virus).

VGAM196 precursor RNA folds onto itself, forming VGAM196 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM196 folded precursor RNA into VGAM196 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM196 RNA is designated SEQ ID:2907, and is provided hereinbelow with reference to the sequence listing part.

VGAM196 host target gene, herein designated VGAM HOST TARGET GENE, encodes a corresponding messenger RNA, VGAM196 host target RNA, herein designated VGAM HOST TARGET RNA. VGAM196 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM196 RNA, herein designated VGAM RNA, binds complementarily to one or more host target binding sites located in untranslated regions of VGAM196 host target RNA, herein designated VGAM HOST TARGET RNA. This complementary binding is due to the fact that the nucleotide sequence of VGAM196 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM196 RNA, herein designated VGAM RNA, may have a different number of host target binding sites in untranslated regions of a VGAM196 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM196 RNA, herein designated VGAM RNA, to host target binding sites on VGAM196 host target RNA, herein designated VGAM HOST TARGET RNA, such as BINDING SITE I, BINDING SITE II and BINDING SITE III, inhibits translation of VGAM196 host target RNA into VGAM196 host target protein, herein designated VGAM HOST TARGET PROTEIN. VGAM host target protein is therefore outlined by a broken line.

It is appreciated that VGAM196 host target gene, herein designated VGAM HOST TARGET GENE, in fact represents a plurality of VGAM196 host target genes. The mRNA of each one of this plurality of VGAM196 host target genes comprises one or more host target binding sites, each having a nucleotide sequence which is at least partly complementary to VGAM196 RNA, herein designated VGAM RNA, and which when bound by VGAM196 RNA causes inhibition of translation of respective one or more VGAM196 host target proteins.

It is further appreciated by one skilled in the art that the mode of translational inhibition illustrated by FIG. 1 with specific reference to translational inhibition exerted by VGAM196 gene, herein designated VGAM GENE, on one or more VGAM196 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM196 is inhibition of expression of host target genes, as part of a novel viral mechanism of attacking a host. Accordingly, utilities of VGAM196 include diagnosis, prevention and treatment of viral infection by Shrimp White Spot Syndrome Virus (white spot bacilliform virus). Specific functions, and accordingly utilities, of VGAM196 correlate with, and may be deduced from, the identity of the host target genes which VGAM196 binds and inhibits, and the function of these host target genes, as elaborated hereinbelow.

Nucleotide sequences of the VGAM196 precursor RNA, herein designated VGAM PRECURSOR RNA, and of the ‘diced’ VGAM196 RNA, herein designated VGAM RNA, and a schematic representation of the secondary folding of VGAM196 folded precursor RNA, herein designated VGAM FOLDED PRECURSOR RNA, of VGAM196 are further described hereinbelow with reference to Table 1.

Nucleotide sequences of host target binding sites, such as BINDING SITE-I, BINDING SITE-II and BINDING SITE-III of FIG. 1, found on VGAM196 host target RNA, and schematic representation of the complementarity of each of these host target binding sites to VGAM196 RNA, herein designated VGAM RNA, are described hereinbelow with reference to Table 2.

As mentioned hereinabove with reference to FIG. 1, a function of VGAM196 gene, herein designated VGAM is inhibition of expression of VGAM196 target genes. It is appreciated that specific functions, and accordingly utilities, of VGAM196 correlate with, and may be deduced from, the identity of the target genes which VGAM196 binds and inhibits, and the function of these target genes, as elaborated hereinbelow.

ATPase, Class I, Type 8B, Member 2 (ATP8B2, Accession XM_036933) is a VGAM196 host target gene. ATP8B2 BINDING SITE is HOST TARGET binding site found in the 5' untranslated region of mRNA encoded by ATP8B2, corresponding to a HOST TARGET binding site such as BINDING SITE I, BINDING SITE II or BINDING SITE III. Table 2 illustrates the complementarity of the nucleotide sequences of ATP8B2 BINDING SITE, designated SEQ ID:32520, to the nucleotide sequence of VGAM196 RNA, herein designated VGAM RNA, also designated SEQ ID:2907.

A function of VGAM196 is therefore inhibition of ATPase, Class I, Type 8B, Member 2 (ATP8B2, Accession XM_036933). Accordingly, utilities of VGAM196 include diagnosis, prevention and treatment of diseases and clinical conditions associated with ATP8B2. Oculocerebrorenal Syndrome of Lowe (OCRL, Accession NM_000276) is another VGAM196 host target gene. OCRL BINDING SITE1 and OCRL BINDING SITE2 are HOST TARGET binding sites found in untranslated regions of mRNA encoded by OCRL, corresponding to HOST TARGET binding sites such as BINDING SITE I, BINDING SITE II or BINDING SITE III. Table 2 illustrates the complementarity of the nucleotide sequences of OCRL BINDING SITE1 and OCRL BINDING SITE2, designated SEQ ID:5819 and SEQ ID:7306 respectively, to the nucleotide sequence of VGAM196 RNA, herein designated VGAM RNA, also designated SEQ ID:2907.

Another function of VGAM196 is therefore inhibition of Oculocerebrorenal Syndrome of Lowe (OCRL, Accession NM_000276). Accordingly, utilities of VGAM196 include diagnosis, prevention and treatment of diseases and clinical conditions associated with OCRL. Thymine-DNA Glycosylase (TDG, Accession NM_003211) is another VGAM196 host target gene. TDG BINDING SITE is HOST TARGET binding site found in the 3' untranslated region of mRNA encoded by TDG, corresponding to a HOST TARGET binding site such as BINDING SITE I, BINDING SITE II or BINDING SITE III. Table 2 illustrates the complementarity of the nucleotide sequences of TDG BINDING SITE, designated SEQ ID:9206, to the nucleotide sequence of VGAM196 RNA, herein designated VGAM RNA, also designated SEQ ID:2907.

Another function of VGAM196 is therefore inhibition of Thymine-DNA Glycosylase (TDG, Accession NM_003211), a gene which excises uracil and thymine from mispairs with guanidine. Accordingly, utilities of VGAM196 include diagnosis, prevention and treatment of diseases and clinical conditions associated with TDG. The function of TDG has been established by previous studies. The process of spontaneous hydrolytic deamination affects all DNA bases with exocyclic amino groups (Lindahl, 1982). Hydrolytic deamination of 5-methylcytosine leads to the formation of G/T mismatches. These G/T mismatches are corrected to G/C basepairs by a mismatch-specific DNA-binding glycosylase, TDG. TDG initiates repair of G/T and G/U mismatches, commonly associated with CpG islands, by removing thymine and uracil moieties. Tini et al. (2002) reported that TDG associates with transcriptional coactivators CBP (OMIM Ref. No. 600140) and p300 (OMIM Ref. No. 602700) and that the resulting complexes are competent for both the excision step of repair and histone acetylation. TDG stimulated CBP transcriptional activity in transfected cells and reciprocally served as a substrate for CBP/p300 acetylation. This acetylation triggered release of CBP from DNA ternary complexes and also regulated recruitment of repair endonuclease APE (OMIM Ref. No. 107748). These observations revealed a potential regulatory role for protein acetylation in base mismatch repair and a role for CBP/p300 in maintaining genomic stability.

Full details of the abovementioned studies are described in the following publications, the disclosure of which are hereby incorporated by reference:

Tini, M.; Benecke, A.; Um, S.-J.; Torchia, J.; Evans, R. M.; Chambon, P.: Association of CBP/p300 acetylase and thymine DNA glycosylase links DNA repair and transcription. Molec. Cell 9:265-277, 2002; and Neddermann, P.; Gallinari, P.; Lettieri, T.; Schmid, D.; Truong, O.; Hsuan, J. J.; Wiebauer, K.; Jiricny, J.: Cloning and expression of human G/T mismatch-specific thymine-DNA glycosyl.

Further studies establishing the function and utilities of TDG are found in John Hopkins OMIM database record ID 601423, and in sited publications numbered 9268-927 and 10686 listed in the bibliography section hereinbelow, which are also hereby incorporated by reference. BICD2 (Accession XM_046863) is another VGAM196 host target gene. BICD2 BINDING SITE is HOST TARGET binding site found in the 3' untranslated region of mRNA encoded by BICD2, corresponding to a HOST TARGET binding site such as BINDING SITE I, BINDING SITE II or BINDING SITE III. Table 2 illustrates the complementarity of the nucleotide sequences of BICD2 BINDING SITE, designated SEQ ID:34854, to the nucleotide sequence of VGAM196 RNA, herein designated VGAM RNA, also designated SEQ ID:2907.

Another function of VGAM196 is therefore inhibition of BICD2 (Accession XM_046863). Accordingly, utilities of VGAM196 include diagnosis, prevention and treatment of diseases and clinical conditions associated with BICD2. Reserved (C8orf13, Accession XM_088377) is another VGAM196 host target gene. C8orf13 BINDING SITE is HOST TARGET binding site found in the 3' untranslated region of mRNA encoded by C8orf13, corresponding to a HOST TARGET binding site such as BINDING SITE I, BINDING SITE II or BINDING SITE III. Table 2 illustrates the complementarity of the nucleotide sequences of C8orf13 BINDING SITE, designated SEQ ID:39654, to the nucleotide sequence of VGAM196 RNA, herein designated VGAM RNA, also designated SEQ ID:2907.

Another function of VGAM196 is therefore inhibition of Reserved (C8orf13, Accession XM_088377). Accordingly, utilities of VGAM196 include diagnosis, prevention and treatment of diseases and clinical conditions associated with C8orf13. DKFZp434D177 (Accession NM_032264) is another VGAM196 host target gene. DKFZp434D177 BINDING SITE is HOST TARGET binding site found in the 3' untranslated region of mRNA encoded by DKFZp434D177, corresponding to a HOST TARGET binding site such as BINDING SITE I, BINDING SITE II or BINDING SITE III. Table 2 illustrates the complementarity of the nucleotide sequences of DKFZp434D177 BINDING SITE, designated SEQ ID:26011, to the nucleotide sequence of VGAM196 RNA, herein designated VGAM RNA, also designated SEQ ID:2907.

Another function of VGAM196 is therefore inhibition of DKFZp434D177 (Accession NM_032264). Accordingly, utilities of VGAM196 include diagnosis, prevention and treatment of diseases and clinical conditions associated with DKFZp434D177. DKFZp761P1010 (Accession NM_018423) is another VGAM196 host target gene. DKFZp761P1010 BINDING SITE is HOST TARGET binding site found in the 3' untranslated region of mRNA encoded by DKFZp761P1010, corresponding to a HOST TARGET binding site such as BINDING SITE I, BINDING SITE II or BINDING SITE III. Table 2 illustrates the complementarity of the nucleotide sequences of DKFZp761P1010 BINDING SITE, designated SEQ ID:20479, to the nucleotide sequence of VGAM196 RNA, herein designated VGAM RNA, also designated SEQ ID:2907.

Another function of VGAM196 is therefore inhibition of DKFZp761P1010 (Accession NM_018423). Accordingly, utilities of VGAM196 include diagnosis, prevention and treatment of diseases and clinical conditions associated with DKFZp761P1010. FLJ10535 (Accession NM_018129) is another VGAM196 host target gene. FLJ10535 BINDING SITE is HOST TARGET binding site found in the 3' untranslated region of mRNA encoded by FLJ10535, corresponding to a HOST TARGET binding site such as BINDING SITE I, BINDING SITE II or BINDING SITE III. Table 2 illustrates the complementarity of the nucleotide sequences of FLJ10535 BINDING SITE, designated SEQ ID:19922, to the nucleotide sequence of VGAM196 RNA, herein designated VGAM RNA, also designated SEQ ID:2907.

Another function of VGAM196 is therefore inhibition of FLJ10535 (Accession NM_018129). Accordingly, utilities of VGAM196 include diagnosis, prevention and treatment of diseases and clinical conditions associated with FLJ10535. FLJ23186 (Accession XM_017088) is another VGAM196 host target gene. FLJ23186 BINDING SITE is HOST TARGET binding site found in the 3' untranslated region of mRNA encoded by FLJ23186, corresponding to a HOST TARGET binding site such as BINDING SITE I, BINDING SITE II or BINDING SITE III. Table 2 illustrates the complementarity of the nucleotide sequences of FLJ23186 BINDING SITE, designated SEQ ID:30297, to the nucleotide sequence of VGAM196 RNA, herein designated VGAM RNA, also designated SEQ ID:2907.

Another function of VGAM196 is therefore inhibition of FLJ23186 (Accession XM_017088). Accordingly, utilities of VGAM196 include diagnosis, prevention and treatment of diseases and clinical conditions associated with FLJ23186. KIAA0495 (Accession XM_031397) is another VGAM196 host target gene. KIAA0495 BINDING SITE is HOST TARGET binding site found in the 5' untranslated region of mRNA encoded by KIAA0495, corresponding to a HOST TARGET binding site such as BINDING SITE I, BINDING SITE II or BINDING SITE III. Table 2 illustrates the complementarity of the nucleotide sequences of KIAA0495 BINDING SITE, designated SEQ ID:31362, to the nucleotide sequence of VGAM196 RNA, herein designated VGAM RNA, also designated SEQ ID:2907.

Another function of VGAM196 is therefore inhibition of KIAA0495 (Accession XM_031397). Accordingly, utilities of VGAM196 include diagnosis, prevention and treatment of diseases and clinical conditions associated with KIAA0495. KIAA1126 (Accession XM_050325) is another VGAM196 host target gene. KIAA1126 BINDING SITE is HOST TARGET binding site found in the 3' untranslated region of mRNA encoded by KIAA1126, corresponding to a HOST TARGET binding site such as BINDING SITE I, BINDING SITE II or BINDING SITE III. Table 2 illustrates the complementarity of the nucleotide sequences of KIAA1126 BINDING SITE, designated SEQ ID:35611, to the nucleotide sequence of VGAM196 RNA, herein designated VGAM RNA, also designated SEQ ID:2907.

Another function of VGAM196 is therefore inhibition of KIAA1126 (Accession XM_050325). Accordingly, utilities of VGAM196 include diagnosis, prevention and treatment of diseases and clinical conditions associated with KIAA1126. MKP-7 (Accession XM_039106) is another VGAM196 host target gene. MKP-7 BINDING SITE is HOST TARGET binding site found in the 3' untranslated region of mRNA encoded by MKP-7, corresponding to a HOST TARGET binding site such as BINDING SITE I, BINDING SITE II or BINDING SITE III. Table 2 illustrates the complementarity of the nucleotide sequences of MKP-7 BINDING SITE, designated SEQ ID:33009, to the nucleotide sequence of VGAM196 RNA, herein designated VGAM RNA, also designated SEQ ID:2907.

Another function of VGAM196 is therefore inhibition of MKP-7 (Accession XM_039106). Accordingly, utilities of VGAM196 include diagnosis, prevention and treatment of diseases and clinical conditions associated with MKP-7. SCDGF-B (Accession NM_033135) is another VGAM196 host target gene. SCDGF-B BINDING SITE1 and SCDGF-B BINDING SITE2 are HOST TARGET binding sites found in untranslated regions of mRNA encoded by SCDGF-B, corresponding to HOST TARGET binding sites such as BINDING SITE I, BINDING SITE II or BINDING SITE III. Table 2 illustrates the complementarity of the nucleotide sequences of SCDGF-B BINDING SITE1 and SCDGF-B BINDING SITE2, designated SEQ ID:26984 and SEQ ID:24882 respectively, to the nucleotide sequence of VGAM196 RNA, herein designated VGAM RNA, also designated SEQ ID:2907.

Another function of VGAM196 is therefore inhibition of SCDGF-B (Accession NM_033135). Accordingly, utilities of VGAM196 include diagnosis, prevention and treatment of diseases and clinical conditions associated with SCDGF-B. LOC199725 (Accession XM_117119) is another VGAM196 host target gene. LOC199725 BINDING SITE is HOST TARGET binding site found in the 3' untranslated region of mRNA encoded by LOC199725, corresponding to a HOST TARGET binding site such as BINDING SITE I, BINDING SITE II or BINDING SITE III. Table 2 illustrates the complementarity of the nucleotide sequences of LOC199725 BINDING SITE, designated SEQ ID:43244, to the nucleotide sequence of VGAM196 RNA, herein designated VGAM RNA, also designated SEQ ID:2907.

Another function of VGAM196 is therefore inhibition of LOC199725 (Accession XM_117119). Accordingly, utilities of VGAM196 include diagnosis, prevention and treatment of diseases and clinical conditions associated with LOC199725. LOC202459 (Accession NM_145303) is another VGAM196 host target gene. LOC202459 BINDING SITE is HOST TARGET binding site found in the 3' untranslated region of mRNA encoded by LOC202459, corresponding to a HOST TARGET binding site such as BINDING SITE I, BINDING SITE II or BINDING SITE III. Table 2 illustrates the complementarity of the nucleotide sequences of LOC202459 BINDING SITE, designated SEQ ID:29816, to the nucleotide sequence of VGAM196 RNA, herein designated VGAM RNA, also designated SEQ ID:2907.

Another function of VGAM196 is therefore inhibition of LOC202459 (Accession NM_145303). Accordingly, utilities of VGAM196 include diagnosis, prevention and treatment of diseases and clinical conditions associated with LOC202459. LOC257048 (Accession XM_171240) is another VGAM196 host target gene. LOC257048 BINDING SITE is HOST TARGET binding site found in the 3' untranslated region of mRNA encoded by LOC257048, corresponding to a HOST TARGET binding site such as BINDING SITE I, BINDING SITE II or BINDING SITE III. Table 2 illustrates the complementarity of the nucleotide sequences of LOC257048 BINDING SITE, designated SEQ ID:46028, to the nucleotide sequence of VGAM196 RNA, herein designated VGAM RNA, also designated SEQ ID:2907.

Another function of VGAM196 is therefore inhibition of LOC257048 (Accession XM_171240). Accordingly, utilities of VGAM196 include diagnosis, prevention and treatment of diseases and clinical conditions associated with LOC257048. FIG. 1 further provides a conceptual description of a novel bioinformatically detected viral gene of the present invention, referred to here as Viral Genomic Address Messenger 197 (VGAM197) viral gene, which modulates expression of respective host target genes thereof, the function and utility of which host target genes is known in the art.

VGAM197 is a novel bioinformatically detected regulatory, non protein coding, viral micro RNA (miRNA) gene. The method by which VGAM197 was detected is described hereinabove with reference to FIGS. 1-8.

VGAM197 gene, herein designated VGAM GENE, is a viral gene contained in the genome of Shrimp White Spot Syndrome Virus (white spot baciliform virus). VGAM197 host target gene, herein designated VGAM HOST TARGET GENE, is a human gene contained in the human genome.

VGAM197 gene encodes a VGAM197 precursor RNA, herein designated VGAM PRECURSOR RNA. Similar to other miRNA genes, and unlike most ordinary genes, VGAM197 precursor RNA does not encode a protein. A nucleotide sequence identical or highly similar to the nucleotide sequence of VGAM197 precursor RNA is designated SEQ ID:183, and is provided hereinbelow with reference to the sequence listing part. Nucleotide sequence SEQ ID:183 is located at position 31769 relative to the genome of Shrimp White Spot Syndrome Virus (white spot baciliform virus).

VGAM197 precursor RNA folds onto itself, forming VGAM197 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM197 folded precursor RNA into VGAM197 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM197 RNA is designated SEQ ID:2908, and is provided hereinbelow with reference to the sequence listing part.

VGAM197 host target gene, herein designated VGAM HOST TARGET GENE, encodes a corresponding messenger RNA, VGAM197 host target RNA, herein designated VGAM HOST TARGET RNA. VGAM197 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM197 RNA, herein designated VGAM RNA, binds complementarily to one or more host target binding sites located in untranslated regions of VGAM197 host target RNA, herein designated VGAM HOST TARGET RNA. This complementary binding is due to the fact that the nucleotide sequence of VGAM197 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM197 RNA, herein designated VGAM RNA, may have a different number of host target binding sites in untranslated regions of a VGAM197 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM197 RNA, herein designated VGAM RNA, to host target binding sites on VGAM197 host target RNA, herein designated VGAM HOST TARGET RNA, such as BINDING SITE I, BINDING SITE II and BINDING SITE III, inhibits translation of VGAM197 host target RNA into VGAM197 host target protein, herein designated VGAM HOST TARGET PROTEIN. VGAM host target protein is therefore outlined by a broken line.

It is appreciated that VGAM197 host target gene, herein designated VGAM HOST TARGET GENE, in fact represents a plurality of VGAM197 host target genes. The mRNA of each one of this plurality of VGAM197 host target genes comprises one or more host target binding sites, each having a nucleotide sequence which is at least partly complementary to VGAM197 RNA, herein designated VGAM RNA, and which when bound by VGAM197 RNA causes inhibition of translation of respective one or more VGAM197 host target proteins.

It is further appreciated by one skilled in the art that the mode of translational inhibition illustrated by FIG. 1 with specific reference to translational inhibition exerted by VGAM197 gene, herein designated VGAM GENE, on one or more VGAM197 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM197 is inhibition of expression of host target genes, as part of a novel viral mechanism of attacking a host. Accordingly, utilities of VGAM197 include diagnosis, prevention and treatment of viral infection by Shrimp White Spot Syndrome Virus (white spot bacilliform virus). Specific functions, and accordingly utilities, of VGAM197 correlate with, and may be deduced from, the identity of the host target genes which VGAM197 binds and inhibits, and the function of these host target genes, as elaborated hereinbelow.

Nucleotide sequences of the VGAM197 precursor RNA, herein designated VGAM PRECURSOR RNA, and of the 'diced' VGAM197 RNA, herein designated VGAM RNA, and a schematic representation of the secondary folding of VGAM197 folded precursor RNA, herein designated VGAM FOLDED PRECURSOR RNA, of VGAM197 are further described hereinbelow with reference to Table 1.

Nucleotide sequences of host target binding sites, such as BINDING SITE-I, BINDING SITE-II and BINDING SITE-III of FIG. 1, found on VGAM197 host target RNA, and schematic representation of the complementarity of each of these host target binding sites to VGAM197 RNA, herein designated VGAM RNA, are described hereinbelow with reference to Table 2.

As mentioned hereinabove with reference to FIG. 1, a function of VGAM197 gene, herein designated VGAM is inhibition of expression of VGAM197 target genes. It is appreciated that specific functions, and accordingly utilities, of VGAM197 correlate with, and may be deduced from, the identity of the target genes which VGAM197 binds and inhibits, and the function of these target genes, as elaborated hereinbelow.

Diaphanous Homolog 2 (Drosophila) (DIAPH2, Accession NM_006729) is a VGAM197 host target gene. DIAPH2 BINDING SITE is HOST TARGET binding site found in the 3' untranslated region of mRNA encoded by DIAPH2, corresponding to a HOST TARGET binding site such as BINDING SITE I, BINDING SITE II or BINDING SITE III. Table 2 illustrates the complementarity of the nucleotide sequences of DIAPH2 BINDING SITE, designated SEQ ID:13559, to the nucleotide sequence of VGAM197 RNA, herein designated VGAM RNA, also designated SEQ ID:2908.

A function of VGAM197 is therefore inhibition of Diaphanous Homolog 2 (Drosophila) (DIAPH2, Accession NM_006729), a gene which may affect in oogenesis. Accordingly, utilities of VGAM197 include diagnosis, prevention and treatment of diseases and clinical conditions associated with DIAPH2. The function of DIAPH2 and its association with various diseases and clinical conditions, has been established by previous studies, as described hereinabove with reference to VGAM129. F-box and WD-40 Domain Protein 1B (FBXW1B, Accession NM_033644) is another VGAM197 host target gene. FBXW1B BINDING SITE1 through FBXW1B BINDING SITE3 are HOST TARGET binding sites found in untranslated regions of mRNA encoded by FBXW1B, corresponding to HOST TARGET binding sites such as BINDING SITE I, BINDING SITE II or BINDING SITE III. Table 2 illustrates the complementarity of the nucleotide sequences of FBXW1B BINDING SITE1 through FBXW1B BINDING SITE3, designated SEQ ID:27368, SEQ ID:14666 and SEQ ID:27378 respectively, to the nucleotide sequence of VGAM197 RNA, herein designated VGAM RNA, also designated SEQ ID:2908.

Another function of VGAM197 is therefore inhibition of F-box and WD-40 Domain Protein 1B (FBXW1B, Accession NM_033644), a gene which somehow is involved in the process of neuronal cell differentiation or brain development. Accordingly, utilities of VGAM197 include diagnosis, prevention and treatment of diseases and clinical conditions associated with FBXW1B. The function of FBXW1B and its association with various diseases and clinical conditions, has been established by previous studies, as described hereinabove with reference to VGAM25. ARP1 Actin-related Protein 1 Homolog A, Centractin Alpha (yeast) (ACTR1A, Accession XM_031949) is another VGAM197 host target gene. ACTR1A BINDING SITE is HOST TARGET binding site found in the 3' untranslated region of mRNA encoded by ACTR1A, corresponding to a HOST TARGET binding site such as BINDING SITE I, BINDING SITE II or BINDING SITE III. Table 2 illustrates the complementarity of the nucleotide sequences of ACTR1A BINDING SITE, designated SEQ ID:31536, to the nucleotide sequence of VGAM197 RNA, herein designated VGAM RNA, also designated SEQ ID:2908.

Another function of VGAM197 is therefore inhibition of ARP1 Actin-related Protein 1 Homolog A, Centractin Alpha (yeast) (ACTR1A, Accession XM_031949). Accordingly, utilities of VGAM197 include diagnosis, prevention and treatment of diseases and clinical conditions associated with ACTR1A. CED-6 (Accession NM_016315) is another VGAM197 host target gene. CED-6 BINDING SITE is HOST TARGET binding site found in the 3' untranslated region of mRNA encoded by CED-6, corresponding to a HOST TARGET binding site such as BINDING SITE I, BINDING SITE II or BINDING SITE III. Table 2 illustrates the complementarity of the nucleotide sequences of CED-6 BINDING SITE, designated SEQ ID:18432, to the nucleotide sequence of VGAM197 RNA, herein designated VGAM RNA, also designated SEQ ID:2908.

Another function of VGAM197 is therefore inhibition of CED-6 (Accession NM_016315). Accordingly, utilities of VGAM197 include diagnosis, prevention and treatment of diseases and clinical conditions associated with CED-6. GABA(A) Receptor-associated Protein Like 1 (GABARAPL1, Accession NM_031412) is another VGAM197 host target gene. GABARAPL1 BINDING SITE is HOST TARGET binding site found in the 3' untranslated region of mRNA encoded by GABARAPL1, corresponding to a HOST TARGET binding site such as BINDING SITE I, BINDING SITE II or BINDING SITE III. Table 2 illustrates the complementarity of the nucleotide sequences of GABARAPL1 BINDING SITE, designated SEQ ID:25391, to the nucleotide sequence of VGAM197 RNA, herein designated VGAM RNA, also designated SEQ ID:2908.

Another function of VGAM197 is therefore inhibition of GABA(A) Receptor-associated Protein Like 1 (GABARAPL1, Accession NM_031412). Accordingly, utilities of VGAM197 include diagnosis, prevention and treatment of diseases and clinical conditions associated with GABARAPL1. MGC15396 (Accession NM_052855) is another VGAM197 host target gene. MGC15396 BINDING SITE is HOST TARGET binding site found in the 3" untranslated region of mRNA encoded by MGC15396, corresponding to a HOST TARGET binding site such as BINDING SITE I, BINDING SITE II or BINDING SITE III. Table 2 illustrates the complementarity of the nucleotide sequences of MGC15396 BINDING SITE, designated SEQ ID:27438, to the nucleotide sequence of VGAM197 RNA, herein designated VGAM RNA, also designated SEQ ID:2908.

Another function of VGAM197 is therefore inhibition of MGC15396 (Accession NM_052855). Accordingly, utilities of VGAM197 include diagnosis, prevention and treatment of diseases and clinical conditions associated with MGC15396. Pellino Homolog 1 (Drosophila) (PELI1, Accession NM_020651) is another VGAM197 host target gene. PELI1 BINDING SITE is HOST TARGET binding site found in the 5' untranslated region of mRNA encoded by PELI1, corresponding to a HOST TARGET binding site such as BINDING SITE I, BINDING SITE II or BINDING SITE III. Table 2 illustrates the complementarity of the nucleotide sequences of PELI1 BINDING SITE, designated SEQ ID:21817, to the nucleotide sequence of VGAM197 RNA, herein designated VGAM RNA, also designated SEQ ID:2908.

Another function of VGAM197 is therefore inhibition of Pellino Homolog 1 (Drosophila) (PELI1, Accession NM_020651). Accordingly, utilities of VGAM197 include diagnosis, prevention and treatment of diseases and clinical conditions associated with PELI1. LOC203411 (Accession XM_117547) is another VGAM197 host target gene. LOC203411 BINDING SITE is HOST TARGET binding site found in the 3' untranslated region of mRNA encoded by LOC203411, corresponding to a HOST TARGET binding site such as BINDING SITE I, BINDING SITE II or BINDING SITE III. Table 2 illustrates the complementarity of the nucleotide sequences of LOC203411 BINDING SITE, designated SEQ ID:43565, to the nucleotide sequence of VGAM197 RNA, herein designated VGAM RNA, also designated SEQ ID:2908.

Another function of VGAM197 is therefore inhibition of LOC203411 (Accession XM_117547). Accordingly, utilities of VGAM197 include diagnosis, prevention and treatment of diseases and clinical conditions associated with LOC203411. FIG. 1 further provides a conceptual description of a novel bioinformatically detected viral gene of the present invention, referred to here as Viral Genomic Address Messenger 198 (VGAM198) viral gene, which modulates expression of respective host target genes thereof, the function and utility of which host target genes is known in the art.

VGAM198 is a novel bioinformatically detected regulatory, non protein coding, viral micro RNA (miRNA) gene. The method by which VGAM198 was detected is described hereinabove with reference to FIGS. 1-8.

VGAM198 gene, herein designated VGAM GENE, is a viral gene contained in the genome of Shrimp White Spot Syndrome Virus (white spot bacilliform virus). VGAM198 host target gene, herein designated VGAM HOST TARGET GENE, is a human gene contained in the human genome.

VGAM198 gene encodes a VGAM198 precursor RNA, herein designated VGAM PRECURSOR RNA. Similar to other miRNA genes, and unlike most ordinary genes, VGAM198 precursor RNA does not encode a protein. A nucleotide sequence identical or highly similar to the nucleotide sequence of VGAM198 precursor RNA is designated SEQ ID:184, and is provided hereinbelow with reference to the sequence listing part. Nucleotide sequence SEQ ID:184 is located at position 194945 relative to the genome of Shrimp White Spot Syndrome Virus (white spot bacilliform virus).

VGAM198 precursor RNA folds onto itself, forming VGAM198 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM198 folded precursor RNA into VGAM198 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM198 RNA is designated SEQ ID:2909, and is provided hereinbelow with reference to the sequence listing part.

VGAM198 host target gene, herein designated VGAM HOST TARGET GENE, encodes a corresponding messenger RNA, VGAM198 host target RNA, herein designated VGAM HOST TARGET RNA. VGAM198 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM198 RNA, herein designated VGAM RNA, binds complementarily to one or more host target binding sites located in untranslated regions of VGAM198 host target RNA, herein designated VGAM HOST TARGET RNA. This complementary binding is due to the fact that the nucleotide sequence of VGAM198 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM198 RNA, herein designated VGAM RNA, may have a different number of host target binding sites in untranslated regions of a VGAM198 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM198 RNA, herein designated VGAM RNA, to host target binding sites on VGAM198 host target RNA, herein designated VGAM HOST TARGET RNA, such as BINDING SITE I, BINDING SITE II and BINDING SITE III, inhibits translation of VGAM198 host target RNA into VGAM198 host target protein, herein designated VGAM HOST TARGET PROTEIN. VGAM host target protein is therefore outlined by a broken line.

It is appreciated that VGAM198 host target gene, herein designated VGAM HOST TARGET GENE, in fact represents a plurality of VGAM198 host target genes. The mRNA of each one of this plurality of VGAM198 host target genes comprises one or more host target binding sites, each having a nucleotide sequence which is at least partly complementary to VGAM198 RNA, herein designated VGAM RNA, and which when bound by VGAM198 RNA causes inhibition of translation of respective one or more VGAM198 host target proteins.

It is further appreciated by one skilled in the art that the mode of translational inhibition illustrated by FIG. 1 with specific reference to translational inhibition exerted by VGAM198 gene, herein designated VGAM GENE, on one or more VGAM198 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM198 is inhibition of expression of host target genes, as part of a novel viral mechanism of attacking a host. Accordingly, utilities of VGAM198 include diagnosis, prevention and treatment of viral infection by Shrimp White Spot Syndrome Virus (white spot bacilliform virus). Specific functions, and accordingly utilities, of VGAM198 correlate with, and may be deduced from, the identity of the host target genes which VGAM198 binds and inhibits, and the function of these host target genes, as elaborated hereinbelow.

Nucleotide sequences of the VGAM198 precursor RNA, herein designated VGAM PRECURSOR RNA, and of the 'diced' VGAM198 RNA, herein designated VGAM RNA, and a schematic representation of the secondary folding of VGAM198 folded precursor RNA, herein designated VGAM FOLDED PRECURSOR RNA, of VGAM198 are further described hereinbelow with reference to Table 1.

Nucleotide sequences of host target binding sites, such as BINDING SITE-I, BINDING SITE-II and BINDING SITE-III of FIG. 1, found on VGAM198 host target RNA, and schematic representation of the complementarity of each of these host target binding sites to VGAM198 RNA, herein designated VGAM RNA, are described hereinbelow with reference to Table 2.

As mentioned hereinabove with reference to FIG. 1, a function of VGAM198 gene, herein designated VGAM is inhibition of expression of VGAM198 target genes. It is appreciated that specific functions, and accordingly utilities, of VGAM198 correlate with, and may be deduced from, the identity of the target genes which VGAM198 binds and inhibits, and the function of these target genes, as elaborated hereinbelow.

FLJ23516 (Accession NM_024539) is a VGAM198 host target gene. FLJ23516 BINDING SITE is HOST TARGET binding site found in the 3' untranslated region of mRNA encoded by FLJ23516, corresponding to a HOST TARGET binding site such as BINDING SITE I, BINDING SITE II or BINDING SITE III. Table 2 illustrates the complementarity of the nucleotide sequences of FLJ23516 BINDING SITE, designated SEQ ID:23747, to the nucleotide sequence of VGAM198 RNA, herein designated VGAM RNA, also designated SEQ ID:2909.

A function of VGAM198 is therefore inhibition of FLJ23516 (Accession NM_024539). Accordingly, utilities of VGAM198 include diagnosis, prevention and treatment of diseases and clinical conditions associated with FLJ23516. LOC148189 (Accession XM_086087) is another VGAM198 host target gene. LOC148189 BINDING SITE is HOST TARGET binding site found in the 5' untranslated region of mRNA encoded by LOC148189, corresponding to a HOST TARGET binding site such as BINDING SITE I, BINDING SITE II or BINDING SITE III. Table 2 illustrates the complementarity of the nucleotide sequences of LOC148189 BINDING SITE, designated SEQ ID:38483, to the nucleotide sequence of VGAM198 RNA, herein designated VGAM RNA, also designated SEQ ID:2909.

Another function of VGAM198 is therefore inhibition of LOC148189 (Accession XM_086087). Accordingly, utilities of VGAM198 include diagnosis, prevention and treatment of diseases and clinical conditions associated with LOC148189. FIG. 1 further provides a conceptual description of a novel bioinformatically detected viral gene of the present invention, referred to here as Viral Genomic Address Messenger 199 (VGAM199) viral gene, which modulates expression of respective host target genes thereof, the function and utility of which host target genes is known in the art.

VGAM199 is a novel bioinformatically detected regulatory, non protein coding, viral micro RNA (miRNA) gene. The method by which VGAM199 was detected is described hereinabove with reference to FIGS. 1-8.

VGAM199 gene, herein designated VGAM GENE, is a viral gene contained in the genome of Shrimp White Spot Syndrome Virus (white spot bacilliform virus). VGAM199 host target gene, herein designated VGAM HOST TARGET GENE, is a human gene contained in the human genome.

VGAM199 gene encodes a VGAM199 precursor RNA, herein designated VGAM PRECURSOR RNA. Similar to other miRNA genes, and unlike most ordinary genes, VGAM199 precursor RNA does not encode a protein. A nucleotide sequence identical or highly similar to the nucleotide sequence of VGAM199 precursor RNA is designated SEQ ID:185, and is provided hereinbelow with reference to the sequence listing part. Nucleotide sequence SEQ ID:185 is located at position 121113 relative to the genome of Shrimp White Spot Syndrome Virus (white spot bacilliform virus).

VGAM199 precursor RNA folds onto itself, forming VGAM199 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM199 folded precursor RNA into VGAM199 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM199 RNA is designated SEQ ID:2910, and is provided hereinbelow with reference to the sequence listing part.

VGAM199 host target gene, herein designated VGAM HOST TARGET GENE, encodes a corresponding messenger RNA, VGAM199 host target RNA, herein designated VGAM HOST TARGET RNA. VGAM199 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM199 RNA, herein designated VGAM RNA, binds complementarily to one or more host target binding sites located in untranslated regions of VGAM199 host target RNA, herein designated VGAM HOST TARGET RNA. This complementary binding is due to the fact that the nucleotide sequence of VGAM199 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM199 RNA, herein designated VGAM RNA, may have a different number of host target binding sites in untranslated regions of a VGAM199 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM199 RNA, herein designated VGAM RNA, to host target binding sites on VGAM199 host target RNA, herein designated VGAM HOST TARGET RNA, such as BINDING SITE I, BINDING SITE II and BINDING SITE III, inhibits translation of VGAM199 host target RNA into VGAM199 host target protein, herein designated VGAM HOST TARGET PROTEIN. VGAM host target protein is therefore outlined by a broken line.

It is appreciated that VGAM199 host target gene, herein designated VGAM HOST TARGET GENE, in fact represents a plurality of VGAM199 host target genes. The mRNA of each one of this plurality of VGAM199 host target genes comprises one or more host target binding sites, each having a nucleotide sequence which is at least partly complementary to VGAM199 RNA, herein designated VGAM RNA, and which when bound by VGAM199 RNA causes inhibition of translation of respective one or more VGAM199 host target proteins.

It is further appreciated by one skilled in the art that the mode of translational inhibition illustrated by FIG. 1 with specific reference to translational inhibition exerted by VGAM199 gene, herein designated VGAM GENE, on one or more VGAM199 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM199 is inhibition of expression of host target genes, as part of a novel viral mechanism of attacking a host. Accordingly, utilities of VGAM199 include diagnosis, prevention and treatment of viral infection by Shrimp White Spot Syndrome Virus (white spot bacilliform virus). Specific functions, and accordingly utilities, of VGAM199 correlate with, and may be deduced from, the identity of the host target genes which VGAM199 binds and inhibits, and the function of these host target genes, as elaborated hereinbelow.

Nucleotide sequences of the VGAM199 precursor RNA, herein designated VGAM PRECURSOR RNA, and of the 'diced' VGAM199 RNA, herein designated VGAM RNA, and a schematic representation of the secondary folding of VGAM199 folded precursor RNA, herein designated VGAM FOLDED PRECURSOR RNA, of VGAM199 are further described hereinbelow with reference to Table 1.

Nucleotide sequences of host target binding sites, such as BINDING SITE-I, BINDING SITE-II and BINDING SITE-III of FIG. 1, found on VGAM199 host target RNA, and schematic representation of the complementarity of each of these host target binding sites to VGAM199 RNA, herein designated VGAM RNA, are described hereinbelow with reference to Table 2.

As mentioned hereinabove with reference to FIG. 1, a function of VGAM199 gene, herein designated VGAM is inhibition of expression of VGAM199 target genes. It is appreciated that specific functions, and accordingly utilities, of VGAM199 correlate with, and may be deduced from, the identity of the target genes which VGAM199 binds and inhibits, and the function of these target genes, as elaborated hereinbelow.

Catalase (CAT, Accession NM_001752) is a VGAM199 host target gene. CAT BINDING SITE is HOST TARGET binding site found in the 3' untranslated region of mRNA encoded by CAT, corresponding to a HOST TARGET binding site such as BINDING SITE I, BINDING SITE II or BINDING SITE III. Table 2 illustrates the complementarity of the nucleotide sequences of CAT BINDING SITE, designated SEQ ID:7487, to the nucleotide sequence of VGAM199 RNA, herein designated VGAM RNA, also designated SEQ ID:2910.

A function of VGAM199 is therefore inhibition of Catalase (CAT, Accession NM_001752). Accordingly, utilities of VGAM199 include diagnosis, prevention and treatment of diseases and clinical conditions associated with CAT. FLJ11101 (Accession NM_018322) is another VGAM199 host target gene. FLJ11101 BINDING SITE is HOST TARGET binding site found in the 3" untranslated region of mRNA encoded by FLJ11101, corresponding to a HOST TARGET binding site such as BINDING SITE I, BINDING SITE II or BINDING SITE III. Table 2 illustrates the complementarity of the nucleotide sequences of FLJ11101 BINDING SITE, designated SEQ ID:20313, to the nucleotide sequence of VGAM199 RNA, herein designated VGAM RNA, also designated SEQ ID:2910.

Another function of VGAM199 is therefore inhibition of FLJ11101 (Accession NM_018322). Accordingly, utilities of VGAM199 include diagnosis, prevention and treatment of diseases and clinical conditions associated with FLJ11101.

FIG. 1 further provides a conceptual description of a novel bioinformatically detected viral gene of the present invention, referred to here as Viral Genomic Address Messenger 200 (VGAM200) viral gene, which modulates expression of respective host target genes thereof, the function and utility of which host target genes is known in the art.

VGAM200 is a novel bioinformatically detected regulatory, non protein coding, viral micro RNA (miRNA) gene. The method by which VGAM200 was detected is described hereinabove with reference to FIGS. 1-8.

VGAM200 gene, herein designated VGAM GENE, is a viral gene contained in the genome of Shrimp White Spot Syndrome Virus (white spot bacilliform virus). VGAM200 host target gene, herein designated VGAM HOST TARGET GENE, is a human gene contained in the human genome.

VGAM200 gene encodes a VGAM200 precursor RNA, herein designated VGAM PRECURSOR RNA. Similar to other miRNA genes, and unlike most ordinary genes, VGAM200 precursor RNA does not encode a protein. A nucleotide sequence identical or highly similar to the nucleotide sequence of VGAM200 precursor RNA is designated SEQ ID:186, and is provided hereinbelow with reference to the sequence listing part. Nucleotide sequence SEQ ID:186 is located at position 92234 relative to the genome of Shrimp White Spot Syndrome Virus (white spot bacilliform virus).

VGAM200 precursor RNA folds onto itself, forming VGAM200 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM200 folded precursor RNA into VGAM200 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM200 RNA is designated SEQ ID:2911, and is provided hereinbelow with reference to the sequence listing part.

VGAM200 host target gene, herein designated VGAM HOST TARGET GENE, encodes a corresponding messenger RNA, VGAM200 host target RNA, herein designated VGAM HOST TARGET RNA. VGAM200 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM200 RNA, herein designated VGAM RNA, binds complementarily to one or more host target binding sites located in untranslated regions of VGAM200 host target RNA, herein designated VGAM HOST TARGET RNA. This complementary binding is due to the fact that the nucleotide sequence of VGAM200 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM200 RNA, herein designated VGAM RNA, may have a different number of host target binding sites in untranslated regions of a VGAM200 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM200 RNA, herein designated VGAM RNA, to host target binding sites on VGAM200 host target RNA, herein designated VGAM HOST TARGET RNA, such as BINDING SITE I, BINDING SITE II and BINDING SITE III, inhibits translation of VGAM200 host target RNA into VGAM200 host target protein, herein designated VGAM HOST TARGET PROTEIN. VGAM host target protein is therefore outlined by a broken line.

It is appreciated that VGAM200 host target gene, herein designated VGAM HOST TARGET GENE, in fact represents a plurality of VGAM200 host target genes. The mRNA of each one of this plurality of VGAM200 host target genes comprises one or more host target binding sites, each having a nucleotide sequence which is at least partly complementary to VGAM200 RNA, herein designated VGAM RNA, and which when bound by VGAM200 RNA causes inhibition of translation of respective one or more VGAM200 host target proteins.

It is further appreciated by one skilled in the art that the mode of translational inhibition illustrated by FIG. 1 with specific reference to translational inhibition exerted by VGAM200 gene, herein designated VGAM GENE, on one or more VGAM200 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM200 is inhibition of expression of host target genes, as part of a novel viral mechanism of attacking a host. Accordingly, utilities of VGAM200 include diagnosis, prevention and treatment of viral infection by Shrimp White Spot Syndrome Virus (white spot bacilliform virus). Specific functions, and accordingly utilities, of VGAM200 correlate with, and may be deduced from, the identity of the host target genes which VGAM200 binds and inhibits, and the function of these host target genes, as elaborated hereinbelow.

Nucleotide sequences of the VGAM200 precursor RNA, herein designated VGAM PRECURSOR RNA, and of the 'diced' VGAM200 RNA, herein designated VGAM RNA, and a schematic representation of the secondary folding of VGAM200 folded precursor RNA, herein designated VGAM FOLDED PRECURSOR RNA, of VGAM200 are further described hereinbelow with reference to Table 1.

Nucleotide sequences of host target binding sites, such as BINDING SITE-I, BINDING SITE-II and BINDING SITE-III of FIG. 1, found on VGAM200 host target RNA, and schematic representation of the complementarity of each of these host target binding sites to VGAM200 RNA, herein designated VGAM RNA, are described hereinbelow with reference to Table 2.

As mentioned hereinabove with reference to FIG. 1, a function of VGAM200 gene, herein designated VGAM is inhibition of expression of VGAM200 target genes. It is appreciated that specific functions, and accordingly utilities, of VGAM200 correlate with, and may be deduced from, the identity of the target genes which VGAM200 binds and inhibits, and the function of these target genes, as elaborated hereinbelow.

UDP-Gal:betaGlcNAc Beta 1,4-Galactosyltransferase, Polypeptide 4 (B4GALT4, Accession NM_003778) is a VGAM200 host target gene. B4GALT4 BINDING SITE is HOST TARGET binding site found in the 3' untranslated region of mRNA encoded by B4GALT4, corresponding to a HOST TARGET binding site such as BINDING SITE I, BINDING SITE II or BINDING SITE III. Table 2 illustrates the complementarity of the nucleotide sequences of B4GALT4 BINDING SITE, designated SEQ ID:9861, to the nucleotide sequence of VGAM200 RNA, herein designated VGAM RNA, also designated SEQ ID:2911.

A function of VGAM200 is therefore inhibition of UDP-Gal:betaGlcNAc Beta 1,4-Galactosyltransferase, Polypeptide 4 (B4GALT4, Accession NM_003778). Accordingly, utilities of VGAM200 include diagnosis, prevention and treatment of diseases and clinical conditions associated with B4GALT4. Chromosome 14 Open Reading Frame 1 (C14orf1, Accession NM_007176) is another VGAM200 host target gene. C14orf1 BINDING SITE is HOST TARGET binding site found in the 3" untranslated region of mRNA encoded by C14orf1, corresponding to a HOST TARGET binding site such as BINDING SITE I, BINDING SITE II or BINDING SITE III. Table 2 illustrates the complementarity of the nucleotide sequences of C14orf1 BINDING SITE, designated SEQ ID:14028, to the nucleotide sequence of VGAM200 RNA, herein designated VGAM RNA, also designated SEQ ID:2911.

Another function of VGAM200 is therefore inhibition of Chromosome 14 Open Reading Frame 1 (C14orf1, Accession NM_007176). Accordingly, utilities of VGAM200 include diagnosis, prevention and treatment of diseases and clinical conditions associated with C14orf1. Epidermal Growth Factor (beta-urogastrone) (EGF, Accession NM_001963) is another VGAM200 host target gene. EGF BINDING SITE is HOST TARGET binding site found in the 5' untranslated region of mRNA encoded by EGF, corresponding to a HOST TARGET binding site such as BINDING SITE I, BINDING SITE II or BINDING SITE III. Table 2 illustrates the complementarity of the nucleotide sequences of EGF BINDING SITE, designated SEQ ID:7689, to the nucleotide sequence of VGAM200 RNA, herein designated VGAM RNA, also designated SEQ ID:2911.

Another function of VGAM200 is therefore inhibition of Epidermal Growth Factor (beta-urogastrone) (EGF, Accession NM_001963), a gene which stimulates the growth of epidermal and epithelial tissues and of some fibroblasts in cell culture. Accordingly, utilities of VGAM200 include diagnosis, prevention and treatment of diseases and clinical conditions associated with EGF. The function of EGF and its association with various diseases and clinical conditions, has been established by previous studies, as described hereinabove with reference to VGAM57. Follistatin-like 3 (secreted glycoprotein) (FSTL3, Accession NM_005860) is another VGAM200 host target gene. FSTL3 BINDING SITE is HOST TARGET binding site found in the 3' untranslated region of mRNA encoded by FSTL3, corresponding to a HOST TARGET binding site such as BINDING SITE I, BINDING SITE II or BINDING SITE III. Table 2 illustrates the complementarity of the nucleotide sequences of FSTL3 BINDING SITE, designated SEQ ID:12473, to the nucleotide sequence of VGAM200 RNA, herein designated VGAM RNA, also designated SEQ ID:2911.

Another function of VGAM200 is therefore inhibition of Follistatin-like 3 (secreted glycoprotein) (FSTL3, Accession NM_005860), a gene which is a member of the follistatin-module-protein family. Accordingly, utilities of VGAM200 include diagnosis, prevention and treatment of diseases and clinical conditions associated with FSTL3. The function of FSTL3 has been established by previous studies. Follistatin-like-3 (FSTL3) is a member of the follistatin-module protein family, which is composed of extracellular matrix-associated glycoproteins thought to act in a paracrine manner to bind morphogens or growth/differentiation factors and regulate their activity during development (Hayette et al., 1998). In addition to the t (11;19) translocation in a case of B-cell chronic lymphocytic leukemia from which FSTL3 was isolated, Hayette et al. (1998) also observed rearrangement of the FSTL3 gene in a case of B-cell non-Hodgkin lymphoma (NHL; 605027) and in a case of B-cell mantle zone lymphoma, suggesting that FSTL3 may be involved in the leukemogenesis process.

Full details of the abovementioned studies are described in the following publications, the disclosure of which are hereby incorporated by reference:

Hayette, S.; Gadoux, M.; Martel, S.; Bertrand, S.; Tigaud, I.; Magaud, J.-P.; Rimokh, R.: FLRG (follistatin-related gene), a new target of chromosomal rearrangement in malignant blood disorders. Oncogene 16:2949-2954, 1998; and Rimokh, R.; Berger, F.; Delsol, G.; Charrin, C.; Bertheas, M. F.; Ffrench, M.; Garoscio, M.; Felman, P.; Coiffier, C.; Bryon, P. A.: Rearrangement and overexpression of the BCL-1/PRAD-1.

Further studies establishing the function and utilities of FSTL3 are found in John Hopkins OMIM database record ID 605343, and in sited publications numbered 4423, 545 and 4906 listed in the bibliography section hereinbelow, which are also hereby incorporated by reference. Interleukin 1 Receptor Antagonist (IL1RN, Accession NM_000577) is another VGAM200 host target gene. IL1RN BINDING SITE is HOST TARGET binding site found in the 3' untranslated region of mRNA encoded by IL1RN, corresponding to a HOST TARGET binding site such as BINDING SITE I, BINDING SITE II or BINDING SITE III. Table 2 illustrates the complementarity of the nucleotide sequences of IL1RN BINDING SITE, designated SEQ ID:6179, to the nucleotide sequence of VGAM200 RNA, herein designated VGAM RNA, also designated SEQ ID:2911.

Another function of VGAM200 is therefore inhibition of Interleukin 1 Receptor Antagonist (IL1RN, Accession NM_000577), a gene which inhibits the activity of il-1 by binding to its receptor. il-1ra has no il-1 like activity. Accordingly, utilities of VGAM200 include diagnosis, prevention and treatment of diseases and clinical conditions associated with IL1RN. The function of IL1RN and its association with various diseases and clinical conditions, has been established by previous studies, as described hereinabove with reference to VGAM193. Insulin Receptor (INSR, Accession XM_048346) is another VGAM200 host target gene. INSR BINDING SITE is HOST TARGET binding site found in the 3' untranslated region of mRNA encoded by INSR, corresponding to a HOST TARGET binding site such as BINDING SITE I, BINDING SITE II or BINDING SITE III. Table 2 illustrates the complementarity of the nucleotide sequences of INSR BINDING SITE, designated SEQ ID:35154, to the nucleotide sequence of VGAM200 RNA, herein designated VGAM RNA, also designated SEQ ID:2911.

Another function of VGAM200 is therefore inhibition of Insulin Receptor (INSR, Accession XM_048346), a gene which binds insulin and has a tyrosine-protein kinase activity. Accordingly, utilities of VGAM200 include diagnosis, prevention and treatment of diseases and clinical conditions associated with INSR. The function of INSR has been established by previous studies. The insulin (INS; 176730) receptor is a tetramer of 2 alpha and 2 beta subunits. The alpha and beta subunits are coded by a single gene and are joined by disulfide bonds, a mechanism parallel to that of the ligand, insulin (Rubin, 1984). Mutation in either the structural gene or some of the processing steps may lead to insulin resistance. Ullrich et al. (1985) deduced the entire 1,370-amino acid sequence from a cDNA clone. The precursor starts with a 27-amino acid signal sequence, followed by the receptor alpha subunit, a precursor processing enzyme cleavage site, then the beta subunit containing a single 23-amino acid transmembrane sequence. Seino et al. (1989) found that the INSR gene spans more than 120 kb and has 22 exons. All introns interrupt protein coding regions of the gene. The 11 exons encoding the alpha subunit are dispersed over more than 90 kb, whereas the 11 exons encoding the beta subunit are located together in a region of about 30 kb. Three transcriptional initiation sites were identified, located 276, 282, and 283 bp upstream of the translation initiation site. There is heterogeneity of insulin receptors in different tissues Leibiger et al. (2001) showed that insulin activates the transcription of its own gene and that of the beta-cell glucokinase gene (GCK; 138079) by different mechanisms. Whereas INS gene transcription is promoted by signaling through INSR type A (without exon 11), phosphatidylinositol 3-kinase (PI3K) class IA (see OMIM Ref. No. 171833), and the 70-kD S6 kinase, insulin stimulates the beta-cell GCK gene by signaling via INSR type B (with exon 11), PI3K class II (see OMIM Ref. No. 602838)-like activity, and protein kinase B (OMIM Ref. No. 164730). These data provided evidence for selectivity in insulin action via the 2 INSR isoforms, the molecular basis being preferential signaling through different PI3K and protein kinases. Using a yeast 2-hybrid system, Dey et al. (1998) identified a regulatory subunit of PI3K, PIK3R3 (OMIM Ref. No. 606076), as a binding partner of INSR. They concluded that PIK3R3 interacts with IGF1R (OMIM Ref. No. 147370) and INSR in a kinase-dependent manner, providing an alternative pathway for the activation of PI3K by these 2 receptors. Rajala and Anderson (2001) sought to identify the tyrosine-phosphorylated protein (s) in the bovine rod outer segments (ROS) that are associated with PI3K. They concluded that tyrosine phosphorylation of the beta subunit of the insulin receptor is involved in the regulation of PI3K activity in the ROS. Animal model experiments lend further support to the function of INSR. Belke et al. (2002) generated mice with a cardiomyocyte-specific insulin receptor knockout (CIRKO), using cre/loxP recombination. Hearts of CIRKO mice were 20 to 30% smaller because of decreased postnatal hypertrophy of cardiomyocytes; they had persistent expression of the fetal beta-myosin heavy chain isoform, approximately half the normal expression of glucose transporter-1 (GLUT1; 138140), and a 2-fold increase in GLUT4 expression. Cardiac glucose uptake was increased in vivo, glycolysis was increased in isolated working hearts, and there was reduced expression of enzymes that catalyze mitochondrial beta-oxidation, leading to decreased fatty acid oxidation rates.

It is appreciated that the abovementioned animal model for INSR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Leibiger, B.; Leibiger, I. B.; Moede, T.; Kemper, S.; Kulkarni, R. N.; Kahn, C. R.; de Vargas, L. M.; Berggren, P.-O.: Selective insulin signaling through A and B insulin receptors regulates transcription of insulin and glucokinase genes in pancreatic beta cells. Molec. Cell 7:559-570, 2001; and Belke, D. D.; Betuing, S.; Tuttle, M. J.; Graveleau, C.; Young, M. E.; Pham, M.; Zhang, D.; Cooksey, R. C.; McClain, D. A.; Litwin, S. E.; Taegtmeyer, H.; Severson, D.; Kahn, C. R.; Abe.

Further studies establishing the function and utilities of INSR are found in John Hopkins OMIM database record ID 147670, and in sited publications numbered 129, 11700-11706, 11709-11708, 11710-11711, 3941-3945, 11278-3967, 11442-11443, 1210, 2612-2639, 12698, 3190, 3192-319 and 4710-3209 listed in the bibliography section hereinbelow, which are also hereby incorporated by reference. Integrin, Alpha L (antigen CD11A (p180), Lymphocyte Function-associated Antigen 1; Alpha Polypeptide) (ITGAL, Accession NM_002209) is another VGAM200 host target gene. ITGAL BINDING SITE is HOST TARGET binding site found in the 3' untranslated region of mRNA encoded by ITGAL, corresponding to a HOST TARGET binding site such as BINDING SITE I, BINDING SITE II or BINDING SITE III. Table 2 illustrates the complementarity of the nucleotide sequences of ITGAL BINDING SITE, designated SEQ ID:7973, to the nucleotide sequence of VGAM200 RNA, herein designated VGAM RNA, also designated SEQ ID:2911.

Another function of VGAM200 is therefore inhibition of Integrin, Alpha L (antigen CD11A (p180), Lymphocyte Function-associated Antigen 1; Alpha Polypeptide) (ITGAL, Accession NM_002209), a gene which s a receptor for icam1, icam2, icam3 and icam4. it is involved in a variety of immune phenomena including leukocyte-endothelial cell interaction, cytotoxic t-cell mediated killing, and antibody dependent killing by granulocytes and monocytes. Accordingly, utilities of VGAM200 include diagnosis, prevention and treatment of diseases and clinical conditions associated with ITGAL. The function of ITGAL has been established by previous studies. See 120980 and 151510. Lymphocyte function-associated antigen-1 (LFA-1) shares a beta subunit (see OMIM Ref. No. 116920) with other members of a family of leukocyte surface membrane antigens but has a unique alpha subunit (Sanchez-Madrid et al., 1983). LFA-1 is expressed on lymphocytes and phagocytic cells. The LFA-1 molecule is involved in the adhesion of cytotoxic T cells to their target cells. Patients with LFA-1 immunodeficiency disease (see OMIM Ref. No. 116920) have recurrent life-threatening infections, show deficiency of the beta chain of all 3 molecules, LFA-1, Mac-1 (macrophage antigen-1), and p150,95, and display profound defects in adhesion-dependent granulocyte, monocyte, and B- and T-lymphocyte functions. The alpha subunits were designated by Marlin et al. (1986) as alpha-L for LFA-1, alpha-M for Mac-1, and alpha-X for p150,95. Lu and Cyster (2002) studied the mechanisms that control localization of marginal zone B cells. They demonstrated that marginal zone B cells express elevated levels of the integrins LFA-1 and alpha-4-beta-1 (see OMIM Ref. No. 192975 and 135630) and that the marginal zone B cells bind to the ligands ICAM1 (OMIM Ref. No. 147840) and VCAM1 (OMIM Ref. No. 192225). These ligands are expressed within the marginal zone in a lymphotoxin-dependent manner. Combined inhibition of LFA-1 and alpha-4-beta-1 causes a rapid and selective release of B cells from the marginal zone. Furthermore, lipopolysaccharide-triggered marginal zone B cell relocalization involves down regulation of integrin-mediated adhesion. Lu and Cyster (2002) concluded that their studies identified key requirements for marginal zone B cell localization and established a role for integrins in peripheral lymphoid tissue compartmentalization Full details of the abovementioned studies are described in the following publications, the disclosure of which are hereby incorporated by reference:

Lu, T. T.; Cyster, J. G.: Integrin-mediated long-term B cell retention in the splenic marginal zone. Science 297:409-412, 2002; and Marlin, S. D.; Morton, C. C.; Anderson, D. C.; Springer, T. A.: LFA-1 immunodeficiency disease: definition of the genetic defect and chromosomal mapping of alpha and beta subunits of t.

Further studies establishing the function and utilities of ITGAL are found in John Hopkins OMIM database record ID 153370, and in sited publications numbered 4962, 4964, 3348, 354 and 3556 listed in the bibliography section hereinbelow, which are also hereby incorporated by reference. Jagged 2 (JAG2, Accession NM_002226) is another VGAM200 host target gene. JAG2 BINDING SITE is HOST TARGET binding site found in the 3' untranslated region of mRNA encoded by JAG2, corresponding to a HOST TARGET binding site such as BINDING SITE I, BINDING SITE II or BINDING SITE III. Table 2 illustrates the complementarity of the nucleotide sequences of JAG2 BINDING SITE, designated SEQ ID:8006, to the nucleotide sequence of VGAM200 RNA, herein designated VGAM RNA, also designated SEQ ID:2911.

Another function of VGAM200 is therefore inhibition of Jagged 2 (JAG2, Accession NM_002226), a gene which is a putative notch ligand involved in the mediation of notch signaling. Accordingly, utilities of VGAM200 include diagnosis, prevention and treatment of diseases and clinical conditions associated with JAG2. The function of JAG2 and its association with various diseases and clinical conditions, has been established by previous studies, as described hereinabove with reference to VGAM136. Junctional Adhesion Molecule 3 (JAM3, Accession NM_032801) is another VGAM200 host target gene. JAM3 BINDING SITE is HOST TARGET binding site found in the 3' untranslated region of mRNA encoded by JAM3, corresponding to a HOST TARGET binding site such as BINDING SITE I, BINDING SITE II or BINDING SITE III. Table 2 illustrates the complementarity of the nucleotide sequences of JAM3 BINDING SITE, designated SEQ ID:26553, to the nucleotide sequence of VGAM200 RNA, herein designated VGAM RNA, also designated SEQ ID:2911.

Another function of VGAM200 is therefore inhibition of Junctional Adhesion Molecule 3 (JAM3, Accession NM_032801), a gene which is a member of the junctional adhesion molecule protein family. Accordingly, utilities of VGAM200 include diagnosis, prevention and treatment of diseases and clinical conditions associated with JAM3. The function of JAM3 has been established by previous studies. JAM3 is a member of the junctional adhesion molecule (JAM) family. The first identified member of the JAM family, JAM1 (OMIM Ref. No. 605721), is an immunoglobulin (Ig)-like molecule that colocalizes with tight junctions in endothelium and epithelium and is also found on blood leukocytes and platelets. Adhesion proteins targeted to cell-cell borders, like JAM1, are ideally situated to participate in leukocyte emigration By searching an EST database for sequences similar to JAM2 (OMIM Ref. No. 606870), followed by amplification of a fetal brain cDNA library, Arrate et al. (2001) isolated a cDNA encoding JAM3. The deduced 310-amino acid protein is more than 30% identical to JAM2 and JAM1. It possesses a signal sequence; 2 Ig-like folds, one a V type and the other a C2 type, containing 6 cysteines; 2 potential N-glycosylation sites; and a 46-amino acid intracellular tail with a C-terminal binding motif for PDZ domains and a phosphorylation site. Northern blot analysis revealed wide expression of an approximately 3.3-kb transcript, with highest levels in placenta, brain, and kidney. Expression was also detected in cultured endothelial cells. Binding analysis showed that unlike JAM2, JAM3 is unable to adhere to leukocyte cell lines and only forms weak homotypic interactions. However, JAM3 was found to interact strongly with JAM2. RT-PCR and flow cytometric analyses detected strong expression in cytotoxic T-cell lines and activated T lymphocytes, but not in resting cells. Immunoprecipitation analysis indicated that the 43-kD JAM3 protein binds with JAM2. While studying JAM2 with immunoprecipitation analysis, Liang et al. (2002) identified a 40-kD protein and subsequently cloned JAM3. Western blot analysis showed expression on natural killer cells. Liang et al. (2002) proposed that JAM3 is a functional JAM2 receptor.

Full details of the abovementioned studies are described in the following publications, the disclosure of which are hereby incorporated by reference:

Arrate, M. P.; Rodriguez, J. M.; Tran, T. T.; Brock, T. A.; Cunningham, S. A.: Cloning of human junctional adhesion molecule 3 (JAM3) and its identification as the JAM2 counter-receptor. J. Biol. Chem. 276: 45826-45832, 2001; and Liang, T. W.; Chiu, H. H.; Gurney, A.; Sidle, A.; Tumas, D. B.; Schow, P.; Foster, J.; Klassen, T.; Dennis, K.; DeMarco, R. A.; Pham, T.; Frantz, G.; Fong, S.: Vascular endothelial-jun.

Further studies establishing the function and utilities of JAM3 are found in John Hopkins OMIM database record ID 606871, and in sited publications numbered 5392 listed in the bibliography section hereinbelow, which are also hereby incorporated by reference. Lymphoid Enhancer-binding Factor 1 (LEF1, Accession NM_016269) is another VGAM200 host target gene. LEF1 BINDING SITE is HOST TARGET binding site found in the 3' untranslated region of mRNA encoded by LEF1, corresponding to a HOST TARGET binding site such as BINDING SITE I, BINDING SITE II or BINDING SITE III. Table 2 illustrates the complementarity of the nucleotide sequences of LEF1 BINDING SITE, designated SEQ ID:18392, to the nucleotide sequence of VGAM200 RNA, herein designated VGAM RNA, also designated SEQ ID:2911.

Another function of VGAM200 is therefore inhibition of Lymphoid Enhancer-binding Factor 1 (LEF1, Accession NM_016269), a gene which plays an essential role in the formation of several organs and structures that require inductive tissue interactions. Accordingly, utilities of VGAM200 include diagnosis, prevention and treatment of diseases and clinical conditions associated with LEF1. The function of LEF1 has been established by previous studies. Lymphoid enhancer-binding factor-1 (LEF1) is a 48-kD nuclear protein that is expressed in pre-B and T cells. It binds to a functionally important site in the T-cell receptor-alpha (TCRA; 186880) enhancer and confers maximal enhancer activity. LEF1 belongs to a family of regulatory proteins that share homology with high mobility group protein-1 (HMG1; 163905). Animal model experiments lend further support to the function of LEF1. Lef1 is a sequence-specific DNA-binding protein that is expressed in pre-B and T lymphocytes of adult mice, and in the neural crest, mesencephalon, tooth germs, whisker follicles, and other sites during mouse embryogenesis. Van Genderen et al. (1994) generated mice carrying a homozygous germline mutation in the Lef1 gene that eliminated Lef1 protein expression and caused postnatal lethality. The mutant mice lacked teeth, mammary glands, whiskers, and hair, although they developed rudimentary hair follicles. The Lef1-deficient mice also lacked the mesencephalic nucleus of the trigeminal nerve, the only neural crest-derived neuronal populations. The mutant mice showed no obvious defects in lymphoid cell populations at birth. Van Genderen et al. (1994) suggested that Lef1 plays an essential role in the formation of several organs and structures that require inductive tissue interactions It is appreciated that the abovementioned animal model for LEF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

van Genderen, C.; Okamura, R. M.; Farinas, I.; Quo, R. G.; Parslow, T. G.; Bruhn, L.; Grosschedl, R.: Development of several organs that require inductive epithelial-mesenchymal interactions is impaired in LEF-1-deficient mice. Genes Dev. 8:2691-2703, 1994; and de Lau, W.; Clevers, H.: LEF1 turns over a new leaf. Nature Genet. 28:3-5, 2001.

Further studies establishing the function and utilities of LEF1 are found in John Hopkins OMIM database record ID 153245, and in sited publications numbered 11514-11521 listed in the bibliography section hereinbelow, which are also hereby incorporated by reference. Myosin IE (MYO1E, Accession NM_004998) is another VGAM200 host target gene. MYO1E BINDING SITE is HOST TARGET binding site found in the 5' untranslated region of mRNA encoded by MYO1E, corresponding to a HOST TARGET binding site such as BINDING SITE I, BINDING SITE II or BINDING SITE III. Table 2 illustrates the complementarity of the nucleotide sequences of MYO1E BINDING SITE, designated SEQ ID:11442, to the nucleotide sequence of VGAM200 RNA, herein designated VGAM RNA, also designated SEQ ID:2911.

Another function of VGAM200 is therefore inhibition of Myosin IE (MYO1E, Accession NM_004998), a gene which is an unconventional myosin. Accordingly, utilities of VGAM200 include diagnosis, prevention and treatment of diseases and clinical conditions associated with MYO1E. The function of MYO1E has been established by previous studies. Bement et al. (1994) cloned a human unconventional myosin gene, MYO1E, encoding a predicted 127-kD polypeptide of 1,109 amino acids. The gene, which they designated myosin IC, contains a characteristic N-terminal myosin head, a single 'IQ motif' predicted to bind a single myosin light chain, and a C-terminal tail with a putative membrane-binding site. They also noted the presence of a C-terminal src-homology domain, reminiscent of 'long-tailed' myosins I from amoeboid organisms. By Northern analysis, Bement et al. (1994) detected ubiquitous expression of MYO1E. Hasson et al. (1996) used fluorescence in situ hybridization to map the loci for 4 unconventional myosin loci in human S: MYO1E (formerly MYO1C), MYO1A (OMIM Ref. No. 601478), MYO1F (OMIM Ref. No. 601480), and MYO10 (OMIM Ref. No. 601481). The MYO1E gene was found to be located on 15q21-q22 in the precise location predicted from its location on chromosome 9 of the mouse.

Full details of the abovementioned studies are described in the following publications, the disclosure of which are hereby incorporated by reference:

Bement, W. M.; Wirth, J. A.; Mooseker, M. S.: Cloning and mRNA expression of human unconventional myosin-IC: a homologue of amoeboid myosins-I with a single IQ motif and an SH3 domain. J. Molec. Biol. 243:356-363, 1994; and Hasson, T.; Skowron, J. F.; Gilbert, D. J.; Avraham, K. B.; Perry, W. L.; Bement, W. M.; Anderson, B. L.; Sherr, E. H.; Chen, Z.-Y.; Greene, L. A.; Ward, D. C.; Corey, D. P.; Mooseker.

Further studies establishing the function and utilities of MYO1E are found in John Hopkins OMIM database record ID 601479, and in sited publications numbered 651 and 7027 listed in the bibliography section hereinbelow, which are also hereby incorporated by reference. Neurotensin Receptor 1 (high affinity) (NTSR1, Accession NM_002531) is another VGAM200 host target gene. NTSR1 BINDING SITE is HOST TARGET binding site found in the 3' untranslated region of mRNA encoded by NTSR1, corresponding to a HOST TARGET binding site such as BINDING SITE I, BINDING SITE II or BINDING SITE III. Table 2 illustrates the complementarity of the nucleotide sequences of NTSR1 BINDING SITE, designated SEQ ID:8372, to the nucleotide sequence of VGAM200 RNA, herein designated VGAM RNA, also designated SEQ ID:2911.

Another function of VGAM200 is therefore inhibition of Neurotensin Receptor 1 (high affinity) (NTSR1, Accession NM_002531), a gene which is associated with g proteins that activate a phosphatidylinositol- calcium second messenger system. Accordingly, utilities of VGAM200 include diagnosis, prevention and treatment of diseases and clinical conditions associated with NTSR1. The function of NTSR1 has been established by previous studies. The tridecapeptide neurotensin (OMIM Ref. No. 162650) is widely distributed in various regions of the brain and in peripheral tissues. In the brain, neurotensin acts as a neuromodulator, in particular of dopamine transmission in the nigrostriatal and mesocorticolimbic systems, suggesting its possible implication in dopamine-associated behavioral neurodegenerative and neuropsychiatric disorders. Its various effects are mediated by specific membrane receptors. Vita et al. (1993) isolated a cDNA encoding a human neurotensin receptor (NTSR1) and showed that it predicts a 418-amino acid protein that shares 84% homology with the rat protein. Le et al. (1997) also cloned human NTSR1 cDNA and its genomic DNA. The gene contains 4 exons and spans more than 10 kb. The authors identified a highly polymorphic tetranucleotide repeat approximately 3 kb from the gene. Southern blot analysis revealed that the NTSR1 gene is present in the human genome as a single-copy gene. Le et al. (1997) stated that the neurotensin receptor has 7 transmembrane spanning regions and high homology to other receptors that couple to G proteins. Vincent (1995) reviewed pharmacologic and molecular data suggesting the existence of other types of functional neurotensin receptors.

Full details of the abovementioned studies are described in the following publications, the disclosure of which are hereby incorporated by reference:

Le, F.; Groshan, K.; Zeng, X. P.; Richelson, E.: Characterization of the genomic structure, promoter region, and a tetranucleotide repeat polymorphism of the human neurotensin receptor gene. J. Biol. Chem. 272:1315-1322, 1997; and Vincent, J.-P.: Neurotensin receptors: binding properties, transduction pathways, and structure. Cell. Molec. Neurobiol. 15:501-512, 1995.

Further studies establishing the function and utilities of NTSR1 are found in John Hopkins OMIM database record ID 162651, and in sited publications numbered 5197-5200 listed in the bibliography section hereinbelow, which are also hereby incorporated by reference. Platelet-activating Factor Acetylhydrolase, Isoform Ib, Alpha Subunit 45 kDa (PAFAH1B1, Accession NM_000430) is another VGAM200 host target gene. PAFAH1B1 BINDING SITE is HOST TARGET binding site found in the 3' untranslated region of mRNA encoded by PAFAH1B1, corresponding to a HOST TARGET binding site such as BINDING SITE I, BINDING SITE II or BINDING SITE III. Table 2 illustrates the complementarity of the nucleotide sequences of PAFAH1B1 BINDING SITE, designated SEQ ID:6013, to the nucleotide sequence of VGAM200 RNA, herein designated VGAM RNA, also designated SEQ ID:2911.

Another function of VGAM200 is therefore inhibition of Platelet-activating Factor Acetylhydrolase, Isoform Ib, Alpha Subunit 45 kDa (PAFAH1B1, Accession NM_000430). Accordingly, utilities of VGAM200 include diagnosis, prevention and treatment of diseases and clinical conditions associated with PAFAH1B1. Pyruvate Dehydrogenase Kinase, Isoenzyme 4 (PDK4, Accession NM_002612) is another VGAM200 host target gene. PDK4 BINDING SITE is HOST TARGET binding site found in the 5' untranslated region of mRNA encoded by PDK4, corresponding to a HOST TARGET binding site such as BINDING SITE I, BINDING SITE II or BINDING SITE III. Table 2 illustrates the complementarity of the nucleotide sequences of PDK4 BINDING SITE, designated SEQ ID:8477, to the nucleotide sequence of VGAM200 RNA, herein designated VGAM RNA, also designated SEQ ID:2911.

Another function of VGAM200 is therefore inhibition of Pyruvate Dehydrogenase Kinase, Isoenzyme 4 (PDK4, Accession NM_002612). Accordingly, utilities of VGAM200 include diagnosis, prevention and treatment of diseases and clinical conditions associated with PDK4. Phosphatidylinositol 4-kinase, Catalytic, Beta Polypeptide (PIK4CB, Accession NM_002651) is another VGAM200 host target gene. PIK4CB BINDING SITE is HOST TARGET binding site found in the 3' untranslated region of mRNA encoded by PIK4CB, corresponding to a HOST TARGET binding site such as BINDING SITE I, BINDING SITE II or BINDING SITE III. Table 2 illustrates the complementarity of the nucleotide sequences of PIK4CB BINDING SITE, designated SEQ ID:8513, to the nucleotide sequence of VGAM200 RNA, herein designated VGAM RNA, also designated SEQ ID:2911.

Another function of VGAM200 is therefore inhibition of Phosphatidylinositol 4-kinase, Catalytic, Beta Polypeptide (PIK4CB, Accession NM_002651), a gene which phosphorylates the 4-OH position of phosphatidyl inositol. Accordingly, utilities of VGAM200 include diagnosis, prevention and treatment of diseases and clinical conditions associated with PIK4CB. The function of PIK4CB has been established by previous studies. By degenerate PCR, library screening, and 5-prime-RACE, Meyers and Cantley (1997) cloned human placenta and heart cDNAs encoding a novel PI 4-kinase, which they called PI4K-beta. The predicted 801-amino acid PI4K-beta protein contains an N-terminal lipid kinase unique domain, which is shared by members of both the PI 3-kinase (e.g., 171834) and PI 4-kinase families, and a C-terminal catalytic domain, which defines this protein as a member of a much larger protein/lipid kinase family. PI4K-beta shares significant amino acid sequence similarity with yeast PIK1. Western blot analysis of mammalian cell lysates using an antibody against PI4K-beta detected a 110-kD protein. Northern blot analysis showed that PI4K-beta is ubiquitously expressed as an approximately 4-kb transcript, with highest expression in heart, pancreas, and skeletal muscle. Biochemical analyses indicated that PI4K-beta is a type III enzyme that is sensitive to wortmannin. Meyers and Cantley (1997) stated that PI4K-beta is likely the wortmannin-sensitive PI 4-kinase described by Nakanishi et al. (1995) that is responsible for regulating the synthesis of agonist-sensitive pools of polyphosphoinositides. Saito et al. (1997) isolated a PI 4-kinase cDNA from a human adult brain cDNA library. The sequence of the cDNA was highly identical to that of the PI4K-beta cDNA (Meyers and Cantley, 1997), and Saito et al. (1997) suggested that they represented alternative products of the same gene. Suzuki et al. (1997) cloned 3 forms of cDNAs encoding human PIK4CB, which they named NPIK for 'novel putative phosphatidylinositol kinase;' 2 of the cDNAs had different 5-prime open reading frame sequences, and the third contained a 45-bp insertion within the coding sequence. The authors suggested that these cDNAs resulted from alternative transcription initiation sites and alternative splicing. By Northern blot analysis, they detected 4.8- and 3.6-kb transcripts whose relative levels varied in different tissues. Using the green fluorescent protein system, they demonstrated that PIK4CB is localized in the cytoplasm.

Full details of the abovementioned studies are described in the following publications, the disclosure of which are hereby incorporated by reference:

Saito, T.; Seki, N.; Ishii, H.; Ohira, M.; Hayashi, A.; Kozuma, S.; Hori, T.: Complementary DNA cloning and chromosomal mapping of a novel phosphatidylinositol kinase gene. DNA Res. 4:301-305, 1997; and Suzuki, K.; Hirano, H.; Okutomi, K.; Suzuki, M.; Kuga, Y.; Fujiwara, T.; Kanemoto, N.; Isono, K.; Horie, M.: Identification and characterization of a novel human phosphatidylinositol 4.

Further studies establishing the function and utilities of PIK4CB are found in John Hopkins OMIM database record ID 602758, and in sited publications numbered 5889-5892 listed in the bibliography section hereinbelow, which are also hereby incorporated by reference. Pleckstrin (PLEK, Accession NM_002664) is another VGAM200 host target gene. PLEK BINDING SITE is HOST TARGET binding site found in the 3' untranslated region of mRNA encoded by PLEK, corresponding to a HOST TARGET binding site such as BINDING SITE I, BINDING SITE II or BINDING SITE III. Table 2 illustrates the complementarity of the nucleotide sequences of PLEK BINDING SITE, designated SEQ ID:8533, to the nucleotide sequence of VGAM200 RNA, herein designated VGAM RNA, also designated SEQ ID:2911.

Another function of VGAM200 is therefore inhibition of Pleckstrin (PLEK, Accession NM_002664), a gene which is the major protein kinase c substrate of platelets. Accordingly, utilities of VGAM200 include diagnosis, prevention and treatment of diseases and clinical conditions associated with PLEK. The function of PLEK has been established by previous studies. In platelets, agonists that stimulate phosphoinositide turnover cause the rapid phosphorylation of a protein of apparent relative molecular mass 40,000-47,000, called P47, by protein kinase C. Tyers et al. (1988) isolated human P47 clones by immunologic screening of a lambda-gt11 cDNA library from a promyelocytic leukemia cell line. A 1,050 basepair open reading frame that could encode the protein in question was confirmed by comparison with peptide sequences from platelet P47 and by expression of the putative P47 in E. coli and in vitro. The P47 sequence appeared to have been conserved throughout vertebrate evolution and was not similar to any other known sequence, including lipocortin (OMIM Ref. No. 151690). Based on its specific expression in platelets and various differentiated white blood cells, Tyers et al. (1988) proposed the name pleckstrin for platelet and leukocyte C kinase substrate and for the KSTR string of amino acids in the sequence KFARK-STRRSIR, the probable phosphorylation site. Tyers et al. (1989) reported the pleckstrin sequence. They deduced a molecular weight of 40,087. By differential display comparison of murine epidermal promotion-sensitive and -resistant cell lines after exposure to a tumor promoter, phorbol ester TPA, Cmarik et al. (2000) observed preferential expression in promotion-resistant cells of a cDNA encoding Plek. Northern blot analysis detected a 3.6-kb Plek transcript in mouse heart, lung, and spleen. Mouse Plek shares 91% amino acid identity with human PLEK. Using an interspecific backcross panel, Cmarik et al. (2000) mapped the mouse Plek gene to the proximal part of chromosome 11 in a region showing homology of synteny to human 2p, where they stated the PLEK gene has been mapped.

Full details of the abovementioned studies are described in the following publications, the disclosure of which are hereby incorporated by reference:

Cmarik, J. L.; Hegamyer, G.; Gerrard, B.; Dean, M.; Colburn, N. H.: cDNA cloning and mapping of mouse pleckstrin (Plek), a gene upregulated in transformation-resistant cells. Genomics 66:204-212, 2000; and Tyers, M.; Haslam, R. J.; Rachubinski, R. A.; Harley, C. B.: Molecular analysis of pleckstrin: the major protein kinase C substrate of platelets. J. Cell. Biochem. 40:133-145, 1989.

Further studies establishing the function and utilities of PLEK are found in John Hopkins OMIM database record ID 173570, and in sited publications numbered 1195-1197 listed in the bibliography section hereinbelow, which are also hereby incorporated by reference. Parathymosin (PTMS, Accession NM_002824) is another VGAM200 host target gene. PTMS BINDING SITE is HOST TARGET binding site found in the 5' untranslated region of mRNA encoded by PTMS, corresponding to a HOST TARGET binding site such as BINDING SITE I, BINDING SITE II or BINDING SITE III. Table 2 illustrates the complementarity of the nucleotide sequences of PTMS BINDING SITE, designated SEQ ID:8696, to the nucleotide sequence of VGAM200 RNA, herein designated VGAM RNA, also designated SEQ ID:2911.

Another function of VGAM200 is therefore inhibition of Parathymosin (PTMS, Accession NM_002824), a gene which is involved in the regulation of cellular immunity. Accordingly, utilities of VGAM200 include diagnosis, prevention and treatment of diseases and clinical conditions associated with PTMS. The function of PTMS has been established by previous studies. Parathymosin is a polypeptide similar in size and amino acid composition to prothymosin-alpha (OMIM Ref. No. 188390). It has a high content of dicarboxylic amino acids and a complete absence of aromatic and sulfur-containing amino acids. It has 101 amino acid residues as compared to 111 for prothymosin. Clinton et al. (1989) reported the isolation of a cDNA clone for human kidney parathymosin containing the complete coding region and extending into the 5-prime and 3-prime flanking sequences. The open reading frame contains 306 nucleotides, including the codon for the initiator methionine. Analysis of the 5-prime flanking sequence excluded the presence of a hydrophobic signal peptide in the translated sequence. This permitted the conclusion that parathymosin, like prothymosin-alpha, is synthesized without formation of a larger precursor polypeptide. Parathymosin and prothymosin show a reciprocal relationship: the highest levels of parathymosin and its mRNA are present in liver, kidney, and brain (with lowest levels in thymus and spleen), whereas prothymosin-alpha and its mRNA are present in highest concentrations in thymus and spleen (with lower levels in kidney, brain, and liver). By in situ hybridization of rat parathymosin cDNA to human metaphase chromosomes, Szabo et al. (1989) localized the gene for human parathymosin to 17q12-q22.

Full details of the abovementioned studies are described in the following publications, the disclosure of which are hereby incorporated by reference:

Clinton, M.; Frangou-Lazaridis, M.; Panneerselvam, C.; Horecker, B. L.: The sequence of human parathymosin deduced from a cloned human kidney cDNA. Biochem. Biophys. Res. Commun. 158:855-862, 1989; and Szabo, P.; Clinton, M.; Macera, M.; Horecker, B. L.: Localization of the gene coding for parathymosin to chromosome 17 in human S. Cytogenet. Cell Genet. 50:91-92, 1989.

Further studies establishing the function and utilities of PTMS are found in John Hopkins OMIM database record ID 168440, and in sited publications numbered 2387-2388 listed in the bibliography section hereinbelow, which are also hereby incorporated by reference. RAS Guanyl Releasing Protein 1 (calcium and DAG-regulated) (RASGRP1, Accession NM_005739) is another VGAM200 host target gene. RASGRP1 BINDING SITE is HOST TARGET binding site found in the 3' untranslated region of mRNA encoded by RASGRP1, corresponding to a HOST TARGET binding site such as BINDING SITE I, BINDING SITE II or BINDING SITE III. Table 2 illustrates the complementarity of the nucleotide sequences of RASGRP1 BINDING SITE, designated SEQ ID:12303, to the nucleotide sequence of VGAM200 RNA, herein designated VGAM RNA, also designated SEQ ID:2911.

Another function of VGAM200 is therefore inhibition of RAS Guanyl Releasing Protein 1 (calcium and DAG-regulated) (RASGRP1, Accession NM_005739). Accordingly, utilities of VGAM200 include diagnosis, prevention and treatment of diseases and clinical conditions associated with RASGRP1. Regenerating Islet-derived-like, Pancreatic Stone Protein-like, Pancreatic Thread Protein-like (rat) (REGL, Accession NM_006508) is another VGAM200 host target gene. REGL BINDING SITE is HOST TARGET binding site found in the 3' untranslated region of mRNA encoded by REGL, corresponding to a HOST TARGET binding site such as BINDING SITE I, BINDING SITE II or BINDING SITE III. Table 2 illustrates the complementarity of the nucleotide sequences of REGL BINDING SITE, designated SEQ ID:13257, to the nucleotide sequence of VGAM200 RNA, herein designated VGAM RNA, also designated SEQ ID:2911.

Another function of VGAM200 is therefore inhibition of Regenerating Islet-derived-like, Pancreatic Stone Protein-like, Pancreatic Thread Protein-like (rat) (REGL, Accession NM_006508), a gene which is a member of REG family with unknown function. Accordingly, utilities of VGAM200 include diagnosis, prevention and treatment of diseases and clinical conditions associated with REGL. The function of REGL has been established by previous studies. The REG1A (OMIM Ref. No. 167770) and REG1B genes belong to the type I subclass of the REG family of genes, each of which encodes a 166-amino acid protein. Moriizumi et al. (1994) and Gharib et al. (1993) mapped the REG1A and REG1B genes to 2p12. Miyashita et al. (1995) demonstrated that 4 REG family genes are tandemly ordered in a 95-kb DNA region of 2p12. From analysis of YAC clones containing the 4 genes using 2-color fluorescence in situ hybridization, they demonstrated the following order: 2cen--PAP--RS--REG1A--REG1B--ptel. (RS, so designated for REG-related sequence, shows a high degree of homology to the REG1 genes but has an in-frame stop codon in the protein coding region.)

Full details of the abovementioned studies are described in the following publications, the disclosure of which are hereby incorporated by reference:

Miyashita, H.; Nakagawara, K.; Mori, M.; Narushima, Y.; Noguchi, N.; Moriizumi, S.; Takasawa, S.; Yonekura, H.; Takeuchi, T.; Okamoto, H.: Human REG family genes are tandemly ordered in a 95-kilobase region of chromosome 2p12. FEBS Lett. 377:429-433, 1995; and Moriizumi, S.; Watanabe, T.; Unno, M.; Nakagawara, K.; Suzuki, Y.; Miyashita, H.; Yonekura, H.; Okamoto, H.: Isolation, structural determination and expression of a novel reg gene, hum.

Further studies establishing the function and utilities of REGL are found in John Hopkins OMIM database record ID 167771, and in sited publications numbered 10915, 1091 and 10925 listed in the bibliography section hereinbelow, which are also hereby incorporated by reference. Selectin P Ligand (SELPLG, Accession XM_006867) is another VGAM200 host target gene. SELPLG BINDING SITE is HOST TARGET binding site found in the 3' untranslated region of mRNA encoded by SELPLG, corresponding to a HOST TARGET binding site such as BINDING SITE I, BINDING SITE II or BINDING SITE III. Table 2 illustrates the complementarity of the nucleotide sequences of SELPLG BINDING SITE, designated SEQ ID:30020, to the nucleotide sequence of VGAM200 RNA, herein designated VGAM RNA, also designated SEQ ID:2911.

Another function of VGAM200 is therefore inhibition of Selectin P Ligand (SELPLG, Accession XM_006867), a gene which binds to p-, e- and l-selectins, which mediates the tethering and rolling of neutrophils and t-lymphocytes on endothelial cells. Accordingly, utilities of VGAM200 include diagnosis, prevention and treatment of diseases and clinical conditions associated with SELPLG. The function of SELPLG has been established by previous studies. Human granulocyte ehrlichiosis (HGE) is a febrile tick-bone illness caused by an intracellular bacterium remarkable for its tropism for professionally phagocytic neutrophils. Herron et al. (2000) demonstrated that monoclonal antibodies against the P-selectin binding domain of the leukocyte P-selectin glycoprotein ligand PSGL1 prevented HGE cell binding and infection, as did enzymatic digestion of PSGL1. Furthermore, simultaneous neoexpression in nonsusceptible cells of complementary DNAs for both PSGL1 and its modifying alpha-(1,3) fucosyltransferase, Fuc-TVII (FUT7), allowed binding and infection by HGE. Thus, the HGE bacterium specifically bound to fucosylated leukocyte PSGL1. Selection mimicry is likely central to the organism's unique ability to target and infect neutrophils. Selectin P ligand, or P-selectin glycoprotein ligand (OMIM Ref. No. PSGL-1), is the high affinity counter-receptor for P-selectin (SELP; 173610) on myeloid cells and stimulated T lymphocytes. As such, it plays a critical role in the tethering of these cells to activated platelets or endothelia expressing P-selectin. Veldman et al. (1995) cloned the SELPLG gene from a human placenta genomic DNA library and showed that a single intron of approximately 9 kb is located in the 5-prime untranslated region and that the complete coding region resides in exon 2. The organization of the gene, designated SELPLG, closely resembles that of CD43 (OMIM Ref. No. 182160) and the human platelet glycoprotein GpIb-alpha (OMIM Ref. No. 231200), both of which have an intron in the 5-prime-noncoding region, a long second exon containing the complete coding region, and TATA-less promoters.

Full details of the abovementioned studies are described in the following publications, the disclosure of which are hereby incorporated by reference:

Herron, M. J.; Nelson, C. M.; Larson, J.; Snapp, K. R.; Kansas, G. S.; Goodman, J. L.: Intracellular parasitism by the human granulocytic ehrlichiosis bacterium through the P-selectin ligand, PSGL-1. Science 288:1653-1656, 2000; and Veldman, G. M.; Bean, K. M.; Cumming, D. A.; Eddy, R. L.; Sait, S. N. J.; Shows, T. B.: Genomic organization and chromosomal localization of the gene encoding human P-selectin glycop.

Further studies establishing the function and utilities of SELPLG are found in John Hopkins OMIM database record ID 600738, and in sited publications numbered 7575-7578 listed in the bibliography section hereinbelow, which are also hereby incorporated by reference. Solute Carrier Family 12 (potassium/chloride transporters), Member 7 (SLC12A7, Accession NM_006598) is another VGAM200 host target gene. SLC12A7 BINDING SITE is HOST TARGET binding site found in the 3' untranslated region of mRNA encoded by SLC12A7, corresponding to a HOST TARGET binding site such as BINDING SITE I, BINDING SITE II or BINDING SITE III. Table 2 illustrates the complementarity of the nucleotide sequences of SLC12A7 BINDING SITE, designated SEQ ID:13375, to the nucleotide sequence of VGAM200 RNA, herein designated VGAM RNA, also designated SEQ ID:2911.

Another function of VGAM200 is therefore inhibition of Solute Carrier Family 12 (potassium/chloride transporters), Member 7 (SLC12A7, Accession NM_006598), a gene which is a potassium/chloride-cotransporter. Accordingly, utilities of VGAM200 include diagnosis, prevention and treatment of diseases and clinical conditions associated with SLC12A7. The function of SLC12A7 has been established by previous studies. By searching EST databases, Mount et al. (1999) identified a cDNA encoding SLC12A7, which they initially termed KCC3 but later renamed KCC4. The deduced 1,083-amino acid SLC12A7 protein contains 12 membrane-spanning segments, 8 phosphorylation sites, 7 of which are in the C terminus, and 4 potential N-glycosylation sites. SLC12A7 shares 65% amino acid identity with SLC12A4 (OMIM Ref. No. 604119) and 66% identity with SLC12A6 (OMIM Ref. No. 604878). Northern blot analysis detected a 5.3-kb SLC12A7 transcript in most tissues tested, with highest expression in heart and kidney and little or no expression in adult brain. Functional analysis confirmed that SLC12A7 is a KCC. Animal model experiments lend further support to the function of SLC12A7. Boettger et al. (2002) generated mice constitutively lacking KCC4, which is predominantly expressed in kidney, heart, lung, and liver. Kcc4 -/- mice were born at the expected mendelian ratio. They were viable and fertile; however, their body weight was roughly 90% that of their littermates. Mice had normal hearing loss at postnatal day 14, indicated by normal auditory brainstem responses. Hearing deteriorated quickly during the following week, after which mice were nearly deaf, with a hearing loss of 70 to 80 decibels. Histologic analysis revealed that the inner ear developed normally and could not be distinguished from those of wildtype animals at postnatal day 14. At postnatal day 21, however, outer hair cells of basal turns of the cochlea were almost totally absent, whereas inner hair cells were still present. The degeneration proceeded from basal to apical turns. In adult knockout mice, the organ of Corti was lost completely in basal turns. In apical turns, some hair cells survived, accounting for the residual hearing ability in adult mice. Even in adult mice, there was no collapse of the Reissner membrane, which separates the scala media from the scala vestibuli, suggesting that Kcc4 is not essential for endolymph production. Outer hair cells of Kcc4 -/- mice degenerated before Deiters cells were lost, although Deiters cells and not outer hair cells normally express Kcc4 at this stage. This is consistent with a disturbance of extracellular homeostasis due to impaired salt uptake by Deiters cells, and may lead to death of outer hair cells by osmotic stress or membrane depolarization. Deafness in Kcc4 -/- mice was associated with renal tubular acidosis. The urine of knockout mice was more alkaline than that of wildtype littermates, whereas concentrations of sodium, potassium, and chloride were not changed. Blood gas analysis indicated a compensated metabolic acidosis with significantly decreased base excess. Immunofluorescence revealed that Kcc4 is expressed in basolateral membranes of several nephron segments. Intracellular chloride concentration was increased in proximal tubules and particularly in alpha-intercalated cells of knockout mice. Considering the prominent chloride/bicarbonate exchange activity in alpha-intercalated cells, the rise in intracellular chloride predicts a more alkaline intracellular pH in the knockout mice. This will decrease apical proton secretion by increasing the electrochemical gradient against which pumping has to occur. Thus, KCC4 joins the hydrogen ATPase (OMIM Ref. No. 192132) and AE1 anion exchanger (OMIM Ref. No. 109270) as the third transport protein of alpha-intercalated cells whose mutation entails renal tubular acidosis. Boettger et al. (2002) concluded that KCC4 is important for potassium recycling by siphoning potassium ions after their exit from outer hair cells into supporting Deiters cells, where potassium enters the gap junction pathway.

It is appreciated that the abovementioned animal model for SLC12A7 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Mount, D. B.; Mercado, A.; Song, L.; Xu, J.; George, A. L., Jr.; Delpire, E.; Gamba, G.: Cloning and characterization of KCC3 and KCC4, new members of the cation-chloride cotransporter gene family. J. Biol. Chem. 274:16355-16362, 1999; and Boettger, T.; Hubner, C. A.; Maler, H.; Rust, M. B.; Beck, F. X.; Jentsch, T. J. : Deafness and renal tubular acidosis in mice lacking the K-CI co-transporter Kcc4. Nature 416:874-878, 20.

Further studies establishing the function and utilities of SLC12A7 are found in John Hopkins OMIM database record ID 604879, and in sited publications numbered 6944 listed in the bibliography section hereinbelow, which are also hereby incorporated by reference. Solute Carrier Family 38, Member 2 (SLC38A2, Accession NM_018976) is another VGAM200 host target gene. SLC38A2 BINDING SITE is HOST TARGET binding site found in the 5' untranslated region of mRNA encoded by SLC38A2, corresponding to a HOST TARGET binding site such as BINDING SITE I, BINDING SITE II or BINDING SITE III. Table 2 illustrates the complementarity of the nucleotide sequences of SLC38A2 BINDING SITE, designated SEQ ID:21049, to the nucleotide sequence of VGAM200 RNA, herein designated VGAM RNA, also designated SEQ ID:2911.

Another function of VGAM200 is therefore inhibition of Solute Carrier Family 38, Member 2 (SLC38A2, Accession NM_018976), a gene which is an amino acid transporter. Accordingly, utilities of VGAM200 include diagnosis, prevention and treatment of diseases and clinical conditions associated with SLC38A2. The function of SLC38A2 has been established by previous studies. Sugawara et al. (2000) cloned a rat skeletal muscle Ata2 cDNA. The deduced Ata2 protein shares 55% sequence identity with the rat glutamine transporter GlnT (Ata1). When expressed in mammalian cells, Ata2 mediated sodium-dependent transport of MeAIB. The Ata2 transporter was specific for neutral amino acids. It was pH-sensitive and lithium-intolerant. The sodium:amino acid stoichiometry was 1:1. When expressed in Xenopus oocytes, transport of neutral amino acids via Ata2 was associated with inward currents. The substrate-induced current was sodium-dependent and pH-sensitive. By screening human fetal brain cDNAs for the potential to encode large proteins, Nagase et al. (2000) isolated a partial ATA2 cDNA, which they called KIAA1382, that lacks 5-prime coding sequence. The deduced 462-amino acid ATA2 partial protein shares 57% amino acid sequence identity with the human transporter protein g17 across 98% of its length. RT-PCR followed by ELISA detected ATA2 expression in all human tissues examined, with the highest level in adult brain. Within the brain, ATA2 expression was found in all regions tested, with the highest level in the subthalamic nucleus.

Full details of the abovementioned studies are described in the following publications, the disclosure of which are hereby incorporated by reference:

Nagase, T.; Kikuno, R.; Ishikawa, K.; Hirosawa, M.; Ohara, O.: Prediction of the coding sequences of unidentified human genes. XVI. The complete sequences of 150 new cDNA clones from brain which code for large proteins in vitro. DNA Res. 7:65-73, 2000; and Sugawara, M.; Nakanishi, T.; Fei, Y.-J.; Huang, W.; Ganapathy, M. E.; Leibach, F. H.; Ganapathy, V.: Cloning of an amino acid transporter with functional characteristics and tissue exp.

Further studies establishing the function and utilities of SLC38A2 are found in John Hopkins OMIM database record ID 605180, and in sited publications numbered 6371 listed in the bibliography section hereinbelow, which are also hereby incorporated by reference. Synaptogyrin 1 (SYNGR1, Accession NM_004711) is another VGAM200 host target gene. SYNGR1 BINDING SITE1 and SYNGR1 BINDING SITE2 are HOST TARGET binding sites found in untranslated regions of mRNA encoded by SYNGR1, corresponding to HOST TARGET binding sites such as BINDING SITE I, BINDING SITE II or BINDING SITE III. Table 2 illustrates the complementarity of the nucleotide sequences of SYNGR1 BINDING SITE1 and SYNGR1 BINDING SITE2, designated SEQ ID:11060 and SEQ ID:11068 respectively, to the nucleotide sequence of VGAM200 RNA, herein designated VGAM RNA, also designated SEQ ID:2911.

Another function of VGAM200 is therefore inhibition of Synaptogyrin 1 (SYNGR1, Accession NM_004711), a gene which belongs to transmembrane synaptic vesicle protein and may function in membrane recycling. Accordingly, utilities of VGAM200 include diagnosis, prevention and treatment of diseases and clinical conditions associated with SYNGR1. The function of SYNGR1 and its association with various diseases and clinical conditions, has been established by previous studies, as described hereinabove with reference to VGAM107. Tripartite Motif-containing 9 (TRIM9, Accession NM_052978) is another VGAM200 host target gene. TRIM9 BINDING SITE is HOST TARGET binding site found in the 3' untranslated region of mRNA encoded by TRIM9, corresponding to a HOST TARGET binding site such as BINDING SITE I, BINDING SITE II or BINDING SITE III. Table 2 illustrates the complementarity of the nucleotide sequences of TRIM9 BINDING SITE, designated SEQ ID:27551, to the nucleotide sequence of VGAM200 RNA, herein designated VGAM RNA, also designated SEQ ID:2911.

Another function of VGAM200 is therefore inhibition of Tripartite Motif-containing 9 (TRIM9, Accession NM_052978), a gene which may function as a positive regulator for mannosylphosphate transferase and is required to mediate mannosylphosphate transfer in both the core and outer chain portions of n-linked. oligosaccharides. Accordingly, utilities of VGAM200 include diagnosis, prevention and treatment of diseases and clinical conditions associated with TRIM9. The function of TRIM9 and its association with various diseases and clinical conditions, has been established by previous studies, as described hereinabove with reference to VGAM74. Transient Receptor Potential Cation Channel, Subfamily C, Member 1 (TRPC1, Accession NM_003304) is another VGAM200 host target gene. TRPC1 BINDING SITE is HOST TARGET binding site found in the 3' untranslated region of mRNA encoded by TRPC1, corresponding to a HOST TARGET binding site such as BINDING SITE I, BINDING SITE II or BINDING SITE III. Table 2 illustrates the complementarity of the nucleotide sequences of TRPC1 BINDING SITE, designated SEQ ID:9305, to the nucleotide sequence of VGAM200 RNA, herein designated VGAM RNA, also designated SEQ ID:2911.

Another function of VGAM200 is therefore inhibition of Transient Receptor Potential Cation Channel, Subfamily C, Member 1 (TRPC1, Accession NM_003304), a gene which acts as a non-voltage-sensitive store-operated Ca2+ channel. Accordingly, utilities of VGAM200 include diagnosis, prevention and treatment of diseases and clinical conditions associated with TRPC1. The function of TRPC1 has been established by previous studies. Zitt et al. (1996) cloned a truncated TRPC1 cDNA, which they designated TRPC1A, that lacks amino acids 109-143 of the human TRP1 sequence. By transfection studies in Chinese hamster ovary cells, Zitt et al. (1996) showed that the TRPC1A gene product functions as a store-operated calcium-permeable cation channel. Zhu et al. (1996) similarly showed that TRPC1 increased store-operated calcium entry in transfected COS cells. Xu et al. (1997) reported that the TRPC1 and TRPC3 proteins form heteromultimeric complexes. Berg et al. (1997) stated that TRPC1 is expressed in megakaryocytic cell lines and therefore may play a role in calcium homeostasis in megakaryocytes and platelets.

Full details of the abovementioned studies are described in the following publications, the disclosure of which are hereby incorporated by reference:

Zitt, C.; Zobel, A.; Obukhov, A. G.; Harteneck, C.; Kalkbrenner, F.; Luckhoff, A.; Schultz, G.: Cloning and functional expression of a human Ca (2+)-permeable cation channel activated by calcium store depletion. Neuron 16:1189-1196, 1996; and Xu, X.-Z. S.; Li, H.-S.; Guggino, W. B.; Montell, C.: Coassembly of TRP and TRPL produces a distinct store-operated conductance. Cell 89:1155-1164, 1997.

Further studies establishing the function and utilities of TRPC1 are found in John Hopkins OMIM database record ID 602343, and in sited publications numbered 1007-1012 listed in the bibliography section hereinbelow, which are also hereby incorporated by reference. Transient Receptor Potential Cation Channel, Subfamily V, Member 1 (TRPV1, Accession NM_080706) is another VGAM200 host target gene. TRPV1 BINDING SITE is HOST TARGET binding site found in the 5' untranslated region of mRNA encoded by TRPV1, corresponding to a HOST TARGET binding site such as BINDING SITE I, BINDING SITE II or BINDING SITE III. Table 2 illustrates the complementarity of the nucleotide sequences of TRPV1 BINDING SITE, designated SEQ ID:28014, to the nucleotide sequence of VGAM200 RNA, herein designated VGAM RNA, also designated SEQ ID:2911.

Another function of VGAM200 is therefore inhibition of Transient Receptor Potential Cation Channel, Subfamily V, Member 1 (TRPV1, Accession NM_080706), a gene which functions as a receptor for capsaicin. Accordingly, utilities of VGAM200 include diagnosis, prevention and treatment of diseases and clinical conditions associated with TRPV1. The function of TRPV1 and its association with various diseases and clinical conditions, has been established by previous studies, as described hereinabove with reference to VGAM146. Wolf-Hirschhorn Syndrome Candidate 1 (WHSC1, Accession NM_133332) is another VGAM200 host target gene. WHSC1 BINDING SITE1 through WHSC1 BINDING SITE3 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE3, designated SEQ ID:28453, SEQ ID:28470 and SEQ ID:17189 respectively, to the nucleotide sequence of VGAM200 RNA, herein designated VGAM RNA, also designated SEQ ID:2911.

Another function of VGAM200 is therefore inhibition of Wolf-Hirschhorn Syndrome Candidate 1 (WHSC1, Accession NM_133332), a gene which binds covalently to and repairs g/t mismatches. Accordingly, utilities of VGAM200 include diagnosis, prevention and treatment of diseases and clinical conditions associated with WHSC1. The function of WHSC1 has been established by previous studies. Wolf-Hirschhorn syndrome (WHS; 194190) is a malformation syndrome associated with a hemizygous deletion of the distal short arm of chromosome 4 (OMIM Ref. No. 4p16.3). The shortest region of overlap of the deletions observed in WHS patients, the WHS critical region, has been confined to a region of 165 kb (Wright et al., 1997). This region was sequenced completely during the search for the Huntington disease gene (Baxendale et al., 1993). Stec et al. (1998) described a novel developmental gene, two-thirds of which maps in the distal part of the WHS critical region. They designated the gene WHSC1 (Wolf-Hirschhorn syndrome candidate-1). The WHSC1 gene was identified initially through its high similarity to the translation product of an expressed sequence tag, located in the 165-kb WHCR, with the SET domain (see OMIM Ref. No. 600960) of the Drosophila protein ASH1 (OMIM Ref. No. 100790). The SET domain is found in proteins that are involved in embryonic development. The 25-exon WHSC1 gene was found to be expressed ubiquitously in early development and to undergo complex alternative splicing and differential polyadenylation. It encodes a 136 -kD protein containing 4 domains present in other developmental proteins: a PWWP domain, an HMG box, a SET domain also found in the Drosophila dysmorphy gene ash-encoded protein, and a PHD-type zinc finger. It is expressed preferentially in rapidly growing embryonic tissues, in a pattern corresponding to affected organs in WHS patients. The nature of the protein motifs, the expression pattern, and its mapping to the critical region led Stec et al. (1998) to propose WHSC1 as a good candidate gene to be responsible for many of the phenotypic features of WHS. Stec et al. (1998) noted that the t (4;14)(p16.3; q32.3) translocations described in a significant fraction of multiple myelomas (Richelda et al., 1997; Chesi et al., 1997) have breakpoints located less than 100 kb centromeric of the FGFR3 gene (OMIM Ref. No. 134934) on 4p16.3. They found that at least 3 of the breakpoints merged the immunoglobulin heavy-chain gene (IGHG1; 147100) on chromosome 14 with the WHSC1 gene. This fusion of genes and their untimely expression in the myeloid lineage driven from the 5-prime IgH enhancer may indicate that WHSC1-encoded proteins are involved in the clinical heterogeneity of multiple myeloma.

Full details of the abovementioned studies are described in the following publications, the disclosure of which are hereby incorporated by reference:

Chesi, M.; Nardini, E.; Brents, L. A.; Schrock, E.; Ried, T.; Kuehl, W. M.; Bergsagel, P. L.: Frequent translocation t (4;14)(p16.3; q32.3) in multiple myeloma is associated with increased expression and activating mutations of fibroblast growth factor receptor 3. Nature Genet. 16:260-264, 1997; and Richelda, R.; Ronchetti, D.; Baldini, L.; Cro, L.; Viggiano, L.; Marzella, R.; Rocchi, M.; Otsuki, T.; Lombardi, L.; Maiolo, A. T.; Neri, A.: A novel chromosomal translocation t (4;14)(p16.

Further studies establishing the function and utilities of WHSC1 are found in John Hopkins OMIM database record ID 602952, and in sited publications numbered 1060, 1137 and 7987 listed in the bibliography section hereinbelow, which are also hereby incorporated by reference. Betaine-homocysteine Methyltransferase (BHMT, Accession NM_001713) is another VGAM200 host target gene. BHMT BINDING SITE is HOST TARGET binding site found in the 3' untranslated region of mRNA encoded by BHMT, corresponding to a HOST TARGET binding site such as BINDING SITE I, BINDING SITE II or BINDING SITE III. Table 2 illustrates the complementarity of the nucleotide sequences of BHMT BINDING SITE, designated SEQ ID:7443, to the nucleotide sequence of VGAM200 RNA, herein designated VGAM RNA, also designated SEQ ID:2911.

Another function of VGAM200 is therefore inhibition of Betaine-homocysteine Methyltransferase (BHMT, Accession NM_001713). Accordingly, utilities of VGAM200 include diagnosis, prevention and treatment of diseases and clinical conditions associated with BHMT. Chromosome 1 Open Reading Frame 16 (C1orf16, Accession NM_014837) is another VGAM200 host target gene. C1orf16 BINDING SITE is HOST TARGET binding site found in the 3' untranslated region of mRNA encoded by C1orf16, corresponding to a HOST TARGET binding site such as BINDING SITE I, BINDING SITE II or BINDING SITE III. Table 2 illustrates the complementarity of the nucleotide sequences of C1orf16 BINDING SITE, designated SEQ ID:16858, to the nucleotide sequence of VGAM200 RNA, herein designated VGAM RNA, also designated SEQ ID:2911.

Another function of VGAM200 is therefore inhibition of Chromosome 1 Open Reading Frame 16 (C1orf16, Accession NM_014837). Accordingly, utilities of VGAM200 include diagnosis, prevention and treatment of diseases and clinical conditions associated with C1orf16. Complement Component 1, Q Subcomponent, Receptor 1 (C1QR1, Accession NM_012072) is another VGAM200 host target gene. C1QR1 BINDING SITE is HOST TARGET binding site found in the 3' untranslated region of mRNA encoded by C1QR1, corresponding to a HOST TARGET binding site such as BINDING SITE I, BINDING SITE II or BINDING SITE III. Table 2 illustrates the complementarity of the nucleotide sequences of C1QR1 BINDING SITE, designated SEQ ID:14340, to the nucleotide sequence of VGAM200 RNA, herein designated VGAM RNA, also designated SEQ ID:2911.

Another function of VGAM200 is therefore inhibition of Complement Component 1, Q Subcomponent, Receptor 1 (C1QR1, Accession NM_012072). Accordingly, utilities of VGAM200 include diagnosis, prevention and treatment of diseases and clinical conditions associated with C1QR1. Chromosome 20 Open Reading Frame 28 (C20orf28, Accession NM_015417) is another VGAM200 host target gene. C20orf28 BINDING SITE is HOST TARGET binding site found in the 3" untranslated region of mRNA encoded by C20orf28, corresponding to a HOST TARGET binding site such as BINDING SITE I, BINDING SITE II or BINDING SITE III. Table 2 illustrates the complementarity of the nucleotide sequences of C20orf28 BINDING SITE, designated SEQ ID:17720, to the nucleotide sequence of VGAM200 RNA, herein designated VGAM RNA, also designated SEQ ID:2911.

Another function of VGAM200 is therefore inhibition of Chromosome 20 Open Reading Frame 28 (C20orf28, Accession NM_015417). Accordingly, utilities of VGAM200 include diagnosis, prevention and treatment of diseases and clinical conditions associated with C20orf28. CDC14 Cell Division Cycle 14 Homolog B (S. cerevisiae) (CDC14B, Accession NM_033332) is another VGAM200 host target gene. CDC14B BINDING SITE is HOST TARGET binding site found in the 3' untranslated region of mRNA encoded by CDC14B, corresponding to a HOST TARGET binding site such as BINDING SITE I, BINDING SITE II or BINDING SITE III. Table 2 illustrates the complementarity of the nucleotide sequences of CDC14B BINDING SITE, designated SEQ ID:27175, to the nucleotide sequence of VGAM200 RNA, herein designated VGAM RNA, also designated SEQ ID:2911.

Another function of VGAM200 is therefore inhibition of CDC14 Cell Division Cycle 14 Homolog B (S. cerevisiae) (CDC14B, Accession NM_033332). Accordingly, utilities of VGAM200 include diagnosis, prevention and treatment of diseases and clinical conditions associated with CDC14B. Calsyntenin 1 (CLSTN1, Accession NM_014944) is another VGAM200 host target gene. CLSTN1 BINDING SITE is HOST TARGET binding site found in the 5' untranslated region of mRNA encoded by CLSTN1, corresponding to a HOST TARGET binding site such as BINDING SITE I, BINDING SITE II or BINDING SITE III. Table 2 illustrates the complementarity of the nucleotide sequences of CLSTN1 BINDING SITE, designated SEQ ID:17257, to the nucleotide sequence of VGAM200 RNA, herein designated VGAM RNA, also designated SEQ ID:2911.

Another function of VGAM200 is therefore inhibition of Calsyntenin 1 (CLSTN1, Accession NM_014944). Accordingly, utilities of VGAM200 include diagnosis, prevention and treatment of diseases and clinical conditions associated with CLSTN1. CXYorf1 (Accession XM_088704) is another VGAM200 host target gene. CXYorf1 BINDING SITE is HOST TARGET binding site found in the 5' untranslated region of mRNA encoded by CXYorf1, corresponding to a HOST TARGET binding site such as BINDING SITE I, BINDING SITE II or BINDING SITE III. Table 2 illustrates the complementarity of the nucleotide sequences of CXYorf1 BINDING SITE, designated SEQ ID:39914, to the nucleotide sequence of VGAM200 RNA, herein designated VGAM RNA, also designated SEQ ID:2911.

Another function of VGAM200 is therefore inhibition of CXYorf1 (Accession XM_088704). Accordingly, utilities of VGAM200 include diagnosis, prevention and treatment of diseases and clinical conditions associated with CXYorf1.

DKFZp434G179 (Accession XM_087065) is another VGAM200 host target gene. DKFZp434G179 BINDING SITE is HOST TARGET binding site found in the 3' untranslated region of mRNA encoded by DKFZp434G179, corresponding to a HOST TARGET binding site such as BINDING SITE I, BINDING SITE II or BINDING SITE III. Table 2 illustrates the complementarity of the nucleotide sequences of DKFZp434G179 BINDING SITE, designated SEQ ID:39043, to the nucleotide sequence of VGAM200 RNA, herein designated VGAM RNA, also designated SEQ ID:2911.

Another function of VGAM200 is therefore inhibition of DKFZp434G179 (Accession XM_087065). Accordingly, utilities of VGAM200 include diagnosis, prevention and treatment of diseases and clinical conditions associated with DKFZp434G179. DKFZp566D133 (Accession XM_050005) is another VGAM200 host target gene. DKFZp566D133 BINDING SITE is HOST TARGET binding site found in the 3' untranslated region of mRNA encoded by DKFZp566D133, corresponding to a HOST TARGET binding site such as BINDING SITE I, BINDING SITE II or BINDING SITE III. Table 2 illustrates the complementarity of the nucleotide sequences of DKFZp566D133 BINDING SITE, designated SEQ ID:35544, to the nucleotide sequence of VGAM200 RNA, herein designated VGAM RNA, also designated SEQ ID:2911.

Another function of VGAM200 is therefore inhibition of DKFZp566D133 (Accession XM_050005). Accordingly, utilities of VGAM200 include diagnosis, prevention and treatment of diseases and clinical conditions associated with DKFZp566D133. DKFZP586F1524 (Accession NM_015584) is another VGAM200 host target gene. DKFZP586F1524 BINDING SITE is HOST TARGET binding site found in the 3' untranslated region of mRNA encoded by DKFZP586F1524, corresponding to a HOST TARGET binding site such as BINDING SITE I, BINDING SITE II or BINDING SITE III. Table 2 illustrates the complementarity of the nucleotide sequences of DKFZP586F1524 BINDING SITE, designated SEQ ID:17854, to the nucleotide sequence of VGAM200 RNA, herein designated VGAM RNA, also designated SEQ ID:2911.

Another function of VGAM200 is therefore inhibition of DKFZP586F1524 (Accession NM_015584). Accordingly, utilities of VGAM200 include diagnosis, prevention and treatment of diseases and clinical conditions associated with DKFZP586F1524. Erythrocyte Membrane Protein Band 4.1-like 1 (EPB41L1, Accession XM_047295) is another VGAM200 host target gene. EPB41L1 BINDING SITE is HOST TARGET binding site found in the 3' untranslated region of mRNA encoded by EPB41L1, corresponding to a HOST TARGET binding site such as BINDING SITE I, BINDING SITE II or BINDING SITE III. Table 2 illustrates the complementarity of the nucleotide sequences of EPB41L1 BINDING SITE, designated SEQ ID:34946, to the nucleotide sequence of VGAM200 RNA, herein designated VGAM RNA, also designated SEQ ID:2911.

Another function of VGAM200 is therefore inhibition of Erythrocyte Membrane Protein Band 4.1-like 1 (EPB41L1, Accession XM_047295). Accordingly, utilities of VGAM200 include diagnosis, prevention and treatment of diseases and clinical conditions associated with EPB41L1. FLJ12229 (Accession NM_024876) is another VGAM200 host target gene. FLJ12229 BINDING SITE is HOST TARGET binding site found in the 5' untranslated region of mRNA encoded by FLJ12229, corresponding to a HOST TARGET binding site such as BINDING SITE I, BINDING SITE II or BINDING SITE III. Table 2 illustrates the complementarity of the nucleotide sequences of FLJ12229 BINDING SITE, designated SEQ ID:24310, to the nucleotide sequence of VGAM200 RNA, herein designated VGAM RNA, also designated SEQ ID:2911.

Another function of VGAM200 is therefore inhibition of FLJ12229 (Accession NM_024876). Accordingly, utilities of VGAM200 include diagnosis, prevention and treatment of diseases and clinical conditions associated with FLJ12229. FLJ12529 (Accession NM_024811) is another VGAM200 host target gene. FLJ12529 BINDING SITE is HOST TARGET binding site found in the 3' untranslated region of mRNA encoded by FLJ12529, corresponding to a HOST TARGET binding site such as BINDING SITE I, BINDING SITE II or BINDING SITE III. Table 2 illustrates the complementarity of the nucleotide sequences of FLJ12529 BINDING SITE, designated SEQ ID:24192, to the nucleotide sequence of VGAM200 RNA, herein designated VGAM RNA, also designated SEQ ID:2911.

Another function of VGAM200 is therefore inhibition of FLJ12529 (Accession NM_024811). Accordingly, utilities of VGAM200 include diagnosis, prevention and treatment of diseases and clinical conditions associated with FLJ12529. FLJ12688 (Accession XM_055071) is another VGAM200 host target gene. FLJ12688 BINDING SITE is HOST TARGET binding site found in the 3' untranslated region of mRNA encoded by FLJ12688, corresponding to a HOST TARGET binding site such as BINDING SITE I, BINDING SITE II or BINDING SITE III. Table 2 illustrates the complementarity of the nucleotide sequences of FLJ12688 BINDING SITE, designated SEQ ID:36222, to the nucleotide sequence of VGAM200 RNA, herein designated VGAM RNA, also designated SEQ ID:2911.

Another function of VGAM200 is therefore inhibition of FLJ12688 (Accession XM_055071). Accordingly, utilities of VGAM200 include diagnosis, prevention and treatment of diseases and clinical conditions associated with FLJ12688. FLJ14708 (Accession NM_032827) is another VGAM200 host target gene. FLJ14708 BINDING SITE is HOST TARGET binding site found in the 3' untranslated region of mRNA encoded by FLJ14708, corresponding to a HOST TARGET binding site such as BINDING SITE I, BINDING SITE II or BINDING SITE III. Table 2 illustrates the complementarity of the nucleotide sequences of FLJ14708 BINDING SITE, designated SEQ ID:26601, to the nucleotide sequence of VGAM200 RNA, herein designated VGAM RNA, also designated SEQ ID:2911.

Another function of VGAM200 is therefore inhibition of FLJ14708 (Accession NM_032827). Accordingly, utilities of VGAM200 include diagnosis, prevention and treatment of diseases and clinical conditions associated with FLJ14708. FLJ14855 (Accession NM_033210) is another VGAM200 host target gene. FLJ14855 BINDING SITE is HOST TARGET binding site found in the 3' untranslated region of mRNA encoded by FLJ14855, corresponding to a HOST TARGET binding site such as BINDING SITE I, BINDING SITE II or BINDING SITE III. Table 2 illustrates the complementarity of the nucleotide sequences of FLJ14855 BINDING SITE, designated SEQ ID:27059, to the nucleotide sequence of VGAM200 RNA, herein designated VGAM RNA, also designated SEQ ID:2911.

Another function of VGAM200 is therefore inhibition of FLJ14855 (Accession NM_033210). Accordingly, utilities of VGAM200 include diagnosis, prevention and treatment of diseases and clinical conditions associated with FLJ14855. FLJ20069 (Accession NM_017651) is another VGAM200 host target gene. FLJ20069 BINDING SITE is HOST TARGET binding site found in the 3' untranslated region of mRNA encoded by FLJ20069, corresponding to a HOST TARGET binding site such as BINDING SITE I, BINDING SITE II or BINDING SITE III. Table 2 illustrates the complementarity of the nucleotide sequences of FLJ20069 BINDING SITE, designated SEQ ID:19158, to the nucleotide sequence of VGAM200 RNA, herein designated VGAM RNA, also designated SEQ ID:2911.

Another function of VGAM200 is therefore inhibition of FLJ20069 (Accession NM_017651). Accordingly, utilities of VGAM200 include diagnosis, prevention and treatment of diseases and clinical conditions associated with FLJ20069. FLJ20232 (Accession NM_019008) is another VGAM200 host target gene. FLJ20232 BINDING SITE is HOST TARGET binding site found in the 3' untranslated region of mRNA encoded by FLJ20232, corresponding to a HOST TARGET binding site such as BINDING SITE I, BINDING SITE II or BINDING SITE III. Table 2 illustrates the complementarity of the nucleotide sequences of FLJ20232 BINDING SITE, designated SEQ ID:21087, to the nucleotide sequence of VGAM200 RNA, herein designated VGAM RNA, also designated SEQ ID:2911.

Another function of VGAM200 is therefore inhibition of FLJ20232 (Accession NM_019008). Accordingly, utilities of VGAM200 include diagnosis, prevention and treatment of diseases and clinical conditions associated with FLJ20232. FLJ20294 (Accession NM_017749) is another VGAM200 host target gene. FLJ20294 BINDING SITE is HOST TARGET binding site found in the 3' untranslated region of mRNA encoded by FLJ20294, corresponding to a HOST TARGET binding site such as BINDING SITE I, BINDING SITE II or BINDING SITE III. Table 2 illustrates the complementarity of the nucleotide sequences of FLJ20294 BINDING SITE, designated SEQ ID:19348, to the nucleotide sequence of VGAM200 RNA, herein designated VGAM RNA, also designated SEQ ID:2911.

Another function of VGAM200 is therefore inhibition of FLJ20294 (Accession NM_017749). Accordingly, utilities of VGAM200 include diagnosis, prevention and treatment of diseases and clinical conditions associated with FLJ20294. FLJ20507 (Accession NM_017849) is another VGAM200 host target gene. FLJ20507 BINDING SITE1 and FLJ20507 BINDING SITE2 are HOST TARGET binding sites found in untranslated regions of mRNA encoded by FLJ20507, corresponding to HOST TARGET binding sites such as BINDING SITE I, BINDING SITE II or BINDING SITE III. Table 2 illustrates the complementarity of the nucleotide sequences of FLJ20507 BINDING SITE1 and FLJ20507 BINDING SITE2, designated SEQ ID:19514 and SEQ ID:30222 respectively, to the nucleotide sequence of VGAM200 RNA, herein designated VGAM RNA, also designated SEQ ID:2911.

Another function of VGAM200 is therefore inhibition of FLJ20507 (Accession NM_017849). Accordingly, utilities of VGAM200 include diagnosis, prevention and treatment of diseases and clinical conditions associated with FLJ20507. FYVE and Coiled-coil Domain Containing 1 (FYCO1, Accession NM_024513) is another VGAM200 host target gene. FYCO1 BINDING SITE is HOST TARGET binding site found in the 3' untranslated region of mRNA encoded by FYCO1, corresponding to a HOST TARGET binding site such as BINDING SITE I, BINDING SITE II or BINDING SITE III. Table 2 illustrates the complementarity of the nucleotide sequences of FYCO1 BINDING SITE, designated SEQ ID:23707, to the nucleotide sequence of VGAM200 RNA, herein designated VGAM RNA, also designated SEQ ID:2911.

Another function of VGAM200 is therefore inhibition of FYVE and Coiled-coil Domain Containing 1 (FYCO1, Accession NM_024513). Accordingly, utilities of VGAM200 include diagnosis, prevention and treatment of diseases and clinical conditions associated with FYCO1. Growth Differentiation Factor 10 (GDF10, Accession NM_004962) is another VGAM200 host target gene. GDF10 BINDING SITE is HOST TARGET binding site found in the 5' untranslated region of mRNA encoded by GDF10, corresponding to a HOST TARGET binding site such as BINDING SITE I, BINDING SITE II or BINDING SITE III. Table 2 illustrates the complementarity of the nucleotide sequences of GDF10 BINDING SITE, designated SEQ ID:11410, to the nucleotide sequence of VGAM200 RNA, herein designated VGAM RNA, also designated SEQ ID:2911.

Another function of VGAM200 is therefore inhibition of Growth Differentiation Factor 10 (GDF10, Accession NM_004962). Accordingly, utilities of VGAM200 include diagnosis, prevention and treatment of diseases and clinical conditions associated with GDF10. GMPPB (Accession XM_171044) is another VGAM200 host target gene. GMPPB BINDING SITE is HOST TARGET binding site found in the 3' untranslated region of mRNA encoded by GMPPB, corresponding to a HOST TARGET binding site such as BINDING SITE I, BINDING SITE II or BINDING SITE III. Table 2 illustrates the complementarity of the nucleotide sequences of GMPPB BINDING SITE, designated SEQ ID:45820, to the nucleotide sequence of VGAM200 RNA, herein designated VGAM RNA, also designated SEQ ID:2911.

Another function of VGAM200 is therefore inhibition of GMPPB (Accession XM_171044). Accordingly, utilities of VGAM200 include diagnosis, prevention and treatment of diseases and clinical conditions associated with GMPPB. HCCA2 (Accession XM_039894) is another VGAM200 host target gene. HCCA2 BINDING SITE is HOST TARGET binding site found in the 5' untranslated region of mRNA encoded by HCCA2, corresponding to a HOST TARGET binding site such as BINDING SITE I, BINDING SITE II or BINDING SITE III. Table 2 illustrates the complementarity of the nucleotide sequences of HCCA2 BINDING SITE, designated SEQ ID:33204, to the nucleotide sequence of VGAM200 RNA, herein designated VGAM RNA, also designated SEQ ID:2911.

Another function of VGAM200 is therefore inhibition of HCCA2 (Accession XM_039894). Accordingly, utilities of VGAM200 include diagnosis, prevention and treatment of diseases and clinical conditions associated with HCCA2. Interleukin 14 (IL14, Accession XM_170924) is another VGAM200 host target gene. IL14 BINDING SITE is HOST TARGET binding site found in the 5' untranslated region of mRNA encoded by IL14, corresponding to a HOST TARGET binding site such as BINDING SITE I, BINDING SITE II or BINDING SITE III. Table 2 illustrates the complementarity of the nucleotide sequences of IL14 BINDING SITE, designated SEQ ID:45706, to the nucleotide sequence of VGAM200 RNA, herein designated VGAM RNA, also designated SEQ ID:2911.

Another function of VGAM200 is therefore inhibition of Interleukin 14 (IL14, Accession XM_170924). Accordingly, utilities of VGAM200 include diagnosis, prevention and treatment of diseases and clinical conditions associated with IL14. ISL2 Transcription Factor, LIM/homeodomain, (islet-2) (ISL2, Accession XM_047951) is another VGAM200 host target gene. ISL2 BINDING SITE is HOST TARGET binding site found in the 3' untranslated region of mRNA encoded by ISL2, corresponding to a HOST TARGET binding site such as BINDING SITE I, BINDING SITE II or BINDING SITE III. Table 2 illustrates the complementarity of the nucleotide sequences of ISL2 BINDING SITE, designated SEQ ID:35082, to the nucleotide sequence of VGAM200 RNA, herein designated VGAM RNA, also designated SEQ ID:2911.

Another function of VGAM200 is therefore inhibition of ISL2 Transcription Factor, LIM/homeodomain, (islet-2) (ISL2, Accession XM_047951). Accordingly, utilities of VGAM200 include diagnosis, prevention and treatment of diseases and clinical conditions associated with ISL2. Potassium Voltage-gated Channel, Shab-related Subfamily, Member 2 (KCNB2, Accession XM_171186) is another VGAM200 host target gene. KCNB2 BINDING SITE is HOST TARGET binding site found in the 5' untranslated region of mRNA encoded by KCNB2, corresponding to a HOST TARGET binding site such as BINDING SITE I, BINDING SITE II or BINDING SITE III. Table 2 illustrates the complementarity of the nucleotide sequences of KCNB2 BINDING SITE, designated SEQ ID:45965, to the nucleotide sequence of VGAM200 RNA, herein designated VGAM RNA, also designated SEQ ID:2911.

Another function of VGAM200 is therefore inhibition of Potassium Voltage-gated Channel, Shab-related Subfamily, Member 2 (KCNB2, Accession XM_171186). Accordingly, utilities of VGAM200 include diagnosis, prevention and treatment of diseases and clinical conditions associated with KCNB2. KIAA0040 (Accession NM_014656) is another VGAM200 host target gene. KIAA0040 BINDING SITE is HOST TARGET binding site found in the 3' untranslated region of mRNA encoded by KIAA0040, corresponding to a HOST TARGET binding site such as BINDING SITE I, BINDING SITE II or BINDING SITE III. Table 2 illustrates the complementarity of the nucleotide sequences of KIAA0040 BINDING SITE, designated SEQ ID:16095, to the nucleotide sequence of VGAM200 RNA, herein designated VGAM RNA, also designated SEQ ID:2911.

Another function of VGAM200 is therefore inhibition of KIAA0040 (Accession NM_014656). Accordingly, utilities of VGAM200 include diagnosis, prevention and treatment of diseases and clinical conditions associated with KIAA0040. KIAA0237 (Accession NM_014747) is another VGAM200 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16457, to the nucleotide sequence of VGAM200 RNA, herein designated VGAM RNA, also designated SEQ ID:2911.

Another function of VGAM200 is therefore inhibition of KIAA0237 (Accession NM_014747). Accordingly, utilities of VGAM200 include diagnosis, prevention and treatment of diseases and clinical conditions associated with KIAA0237. KIAA0415 (Accession XM_166527) is another VGAM200 host target gene. KIAA0415 BINDING SITE is HOST TARGET binding site found in the 3' untranslated region of mRNA encoded by KIAA0415, corresponding to a HOST TARGET binding site such as BINDING SITE I, BINDING SITE II or BINDING SITE III. Table 2 illustrates the complementarity of the nucleotide sequences of KIAA0415 BINDING SITE, designated SEQ ID:44478, to the nucleotide sequence of VGAM200 RNA, herein designated VGAM RNA, also designated SEQ ID:2911.

Another function of VGAM200 is therefore inhibition of KIAA0415 (Accession XM_166527). Accordingly, utilities of VGAM200 include diagnosis, prevention and treatment of diseases and clinical conditions associated with KIAA0415. KIAA0469 (Accession NM_014851) is another VGAM200 host target gene. KIAA0469 BINDING SITE is HOST TARGET binding site found in the 3' untranslated region of mRNA encoded by KIAA0469, corresponding to a HOST TARGET binding site such as BINDING SITE I, BINDING SITE II or BINDING SITE III. Table 2 illustrates the complementarity of the nucleotide sequences of KIAA0469 BINDING SITE, designated SEQ ID:16898, to the nucleotide sequence of VGAM200 RNA, herein designated VGAM RNA, also designated SEQ ID:2911.

Another function of VGAM200 is therefore inhibition of KIAA0469 (Accession NM_014851). Accordingly, utilities of VGAM200 include diagnosis, prevention and treatment of diseases and clinical conditions associated with KIAA0469. KIAA0495 (Accession XM_031397) is another VGAM200 host target gene. KIAA0495 BINDING SITE is HOST TARGET binding site found in the 5' untranslated region of mRNA encoded by KIAA0495, corresponding to a HOST TARGET binding site such as BINDING SITE I, BINDING SITE II or BINDING SITE III. Table 2 illustrates the complementarity of the nucleotide sequences of KIAA0495 BINDING SITE, designated SEQ ID:31359, to the nucleotide sequence of VGAM200 RNA, herein designated VGAM RNA, also designated SEQ ID:2911.

Another function of VGAM200 is therefore inhibition of KIAA0495 (Accession XM_031397). Accordingly, utilities of VGAM200 include diagnosis, prevention and treatment of diseases and clinical conditions associated with KIAA0495. KIAA0574 (Accession XM_045076) is another VGAM200 host target gene. KIAA0574 BINDING SITE is HOST TARGET binding site found in the 3' untranslated region of mRNA encoded by KIAA0574, corresponding to a HOST TARGET binding site such as BINDING SITE I, BINDING SITE II or BINDING SITE III. Table 2 illustrates the complementarity of the nucleotide sequences of KIAA0574 BINDING SITE, designated SEQ ID:34349, to the nucleotide sequence of VGAM200 RNA, herein designated VGAM RNA, also designated SEQ ID:2911.

Another function of VGAM200 is therefore inhibition of KIAA0574 (Accession XM_045076). Accordingly, utilities of VGAM200 include diagnosis, prevention and treatment of diseases and clinical conditions associated with KIAA0574. KIAA0763 (Accession NM_014869) is another VGAM200 host target gene. KIAA0763 BINDING SITE is HOST TARGET binding site found in the 3' untranslated region of mRNA encoded by KIAA0763, corresponding to a HOST TARGET binding site such as BINDING SITE I, BINDING SITE II or BINDING SITE III. Table 2 illustrates the complementarity of the nucleotide sequences of KIAA0763 BINDING SITE, designated SEQ ID:16972, to the nucleotide sequence of VGAM200 RNA, herein designated VGAM RNA, also designated SEQ ID:2911.

Another function of VGAM200 is therefore inhibition of KIAA0763 (Accession NM_014869). Accordingly, utilities of VGAM200 include diagnosis, prevention and treatment of diseases and clinical conditions associated with KIAA0763. KIAA0773 (Accession NM_014690) is another VGAM200 host target gene. KIAA0773 BINDING SITE is HOST TARGET binding site found in the 3' untranslated region of mRNA encoded by KIAA0773, corresponding to a HOST TARGET binding site such as BINDING SITE I, BINDING SITE II or BINDING SITE III. Table 2 illustrates the complementarity of the nucleotide sequences of KIAA0773 BINDING SITE, designated SEQ ID:16195, to the nucleotide sequence of VGAM200 RNA, herein designated VGAM RNA, also designated SEQ ID:2911.

Another function of VGAM200 is therefore inhibition of KIAA0773 (Accession NM_014690). Accordingly, utilities of VGAM200 include diagnosis, prevention and treatment of diseases and clinical conditions associated with KIAA0773.

KIAA0930 (Accession XM_047214) is another VGAM200 host target gene. KIAA0930 BINDING SITE is HOST TARGET binding site found in the 3' untranslated region of mRNA encoded by KIAA0930, corresponding to a HOST TARGET binding site such as BINDING SITE I, BINDING SITE II or BINDING SITE III. Table 2 illustrates the complementarity of the nucleotide sequences of KIAA0930 BINDING SITE, designated SEQ ID:34914, to the nucleotide sequence of VGAM200 RNA, herein designated VGAM RNA, also designated SEQ ID:2911.

Another function of VGAM200 is therefore inhibition of KIAA0930 (Accession XM_047214). Accordingly, utilities of VGAM200 include diagnosis, prevention and treatment of diseases and clinical conditions associated with KIAA0930.

KIAA0939 (Accession XM_030524) is another VGAM200 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31059, to the nucleotide sequence of VGAM200 RNA, herein designated VGAM RNA, also designated SEQ ID:2911.

Another function of VGAM200 is therefore inhibition of KIAA0939 (Accession XM_030524). Accordingly, utilities of VGAM200 include diagnosis, prevention and treatment of diseases and clinical conditions associated with KIAA0939.

KIAA1014 (Accession XM_037205) is another VGAM200 host target gene. KIAA1014 BINDING SITE is HOST TARGET binding site found in the 3' untranslated region of mRNA encoded by KIAA1014, corresponding to a HOST TARGET binding site such as BINDING SITE I, BINDING SITE II or BINDING SITE III. Table 2 illustrates the complementarity of the nucleotide sequences of KIAA1014 BINDING SITE, designated SEQ ID:32571, to the nucleotide sequence of VGAM200 RNA, herein designated VGAM RNA, also designated SEQ ID:2911.

Another function of VGAM200 is therefore inhibition of KIAA1014 (Accession XM_037205). Accordingly, utilities of VGAM200 include diagnosis, prevention and treatment of diseases and clinical conditions associated with KIAA1014.

KIAA1297 (Accession XM_051005) is another VGAM200 host target gene. KIAA1297 BINDING SITE1 and KIAA1297 BINDING SITE2 are HOST TARGET binding sites found in untranslated regions of mRNA encoded by KIAA1297, corresponding to HOST TARGET binding sites such as BINDING SITE I, BINDING SITE II or BINDING SITE III. Table 2 illustrates the complementarity of the nucleotide sequences of KIAA1297 BINDING SITE1 and KIAA1297 BINDING SITE2, designated SEQ ID:35722 and SEQ ID:35723 respectively, to the nucleotide sequence of VGAM200 RNA, herein designated VGAM RNA, also designated SEQ ID:2911.

Another function of VGAM200 is therefore inhibition of KIAA1297 (Accession XM_051005). Accordingly, utilities of VGAM200 include diagnosis, prevention and treatment of diseases and clinical conditions associated with KIAA1297.

KIAA1649 (Accession NM_032311) is another VGAM200 host target gene. KIAA1649 BINDING SITE1 and KIAA1649 BINDING SITE2 are HOST TARGET binding sites found in untranslated regions of mRNA encoded by KIAA1649, corresponding to HOST TARGET binding sites such as BINDING SITE I, BINDING SITE II or BINDING SITE III. Table 2 illustrates the complementarity of the nucleotide sequences of KIAA1649 BINDING SITE1 and KIAA1649 BINDING SITE2, designated SEQ ID:26107 and SEQ ID:33256 respectively, to the nucleotide sequence of VGAM200 RNA, herein designated VGAM RNA, also designated SEQ ID:2911.

Another function of VGAM200 is therefore inhibition of KIAA1649 (Accession NM_032311). Accordingly, utilities of VGAM200 include diagnosis, prevention and treatment of diseases and clinical conditions associated with KIAA1649.

KIAA1870 (Accession NM_032888) is another VGAM200 host target gene. KIAA1870 BINDING SITE is HOST TARGET binding site found in the 5' untranslated region of mRNA encoded by KIAA1870, corresponding to a HOST TARGET binding site such as BINDING SITE I, BINDING SITE II or BINDING SITE III. Table 2 illustrates the complementarity of the nucleotide sequences of KIAA1870 BINDING SITE, designated SEQ ID:26708, to the nucleotide sequence of VGAM200 RNA, herein designated VGAM RNA, also designated SEQ ID:2911.

Another function of VGAM200 is therefore inhibition of KIAA1870 (Accession NM_032888). Accordingly, utilities of VGAM200 include diagnosis, prevention and treatment of diseases and clinical conditions associated with KIAA1870.

KIAA1884 (Accession XM_055539) is another VGAM200 host target gene. KIAA1884 BINDING SITE is HOST TARGET binding site found in the 3' untranslated region of mRNA encoded by KIAA1884, corresponding to a HOST TARGET binding site such as BINDING SITE I, BINDING SITE II or BINDING SITE III. Table 2 illustrates the complementarity of the nucleotide sequences of KIAA1884 BINDING SITE, designated SEQ ID:36294, to the nucleotide sequence of VGAM200 RNA, herein designated VGAM RNA, also designated SEQ ID:2911.

Another function of VGAM200 is therefore inhibition of KIAA1884 (Accession XM_055539). Accordingly, utilities of VGAM200 include diagnosis, prevention and treatment of diseases and clinical conditions associated with KIAA1884.

KIAA1944 (Accession XM_062545) is another VGAM200 host target gene. KIAA1944 BINDING SITE is HOST TARGET binding site found in the 5' untranslated region of mRNA encoded by KIAA1944, corresponding to a HOST TARGET binding site such as BINDING SITE I, BINDING SITE II or BINDING SITE III. Table 2 illustrates the complementarity of the nucleotide sequences of KIAA1944 BINDING SITE, designated SEQ ID:37227, to the nucleotide sequence of VGAM200 RNA, herein designated VGAM RNA, also designated SEQ ID:2911.

Another function of VGAM200 is therefore inhibition of KIAA1944 (Accession XM_062545). Accordingly, utilities of VGAM200 include diagnosis, prevention and treatment of diseases and clinical conditions associated with KIAA1944.

Mannosidase, Alpha, Class 1C, Member 1 (MAN1C1, Accession NM_020379) is another VGAM200 host target gene. MAN1C1 BINDING SITE is HOST TARGET binding site found in the 5' untranslated region of mRNA encoded by MAN1C1, corresponding to a HOST TARGET binding site such as BINDING SITE I, BINDING SITE II or BINDING SITE III. Table 2 illustrates the complementarity of the nucleotide sequences of MAN1C1 BINDING SITE, designated SEQ ID:21646, to the nucleotide sequence of VGAM200 RNA, herein designated VGAM RNA, also designated SEQ ID:2911.

Another function of VGAM200 is therefore inhibition of Mannosidase, Alpha, Class 1C, Member 1 (MAN1C1, Accession NM_020379). Accordingly, utilities of VGAM200 include diagnosis, prevention and treatment of diseases and clinical conditions associated with MAN1C1. MGC19556 (Accession NM_033551) is another VGAM200 host target gene. MGC19556 BINDING SITE is HOST TARGET binding site found in the 5' untranslated region of mRNA encoded by MGC19556, corresponding to a HOST TARGET binding site such as BINDING SITE I, BINDING SITE II or BINDING SITE III. Table 2 illustrates the complementarity of the nucleotide sequences of MGC19556 BINDING SITE, designated SEQ ID:27318, to the nucleotide sequence of VGAM200 RNA, herein designated VGAM RNA, also designated SEQ ID:2911.

Another function of VGAM200 is therefore inhibition of MGC19556 (Accession NM_033551). Accordingly, utilities of VGAM200 include diagnosis, prevention and treatment of diseases and clinical conditions associated with MGC19556. MGC20460 (Accession NM_053043) is another VGAM200 host target gene. MGC20460 BINDING SITE is HOST TARGET binding site found in the 5' untranslated region of mRNA encoded by MGC20460, corresponding to a HOST TARGET binding site such as BINDING SITE I, BINDING SITE II or BINDING SITE III. Table 2 illustrates the complementarity of the nucleotide sequences of MGC20460 BINDING SITE, designated SEQ ID:27587, to the nucleotide sequence of VGAM200 RNA, herein designated VGAM RNA, also designated SEQ ID:2911.

Another function of VGAM200 is therefore inhibition of MGC20460 (Accession NM_053043). Accordingly, utilities of VGAM200 include diagnosis, prevention and treatment of diseases and clinical conditions associated with MGC20460. MICAL (Accession NM_022765) is another VGAM200 host target gene. MICAL BINDING SITE is HOST TARGET binding site found in the 5" untranslated region of mRNA encoded by MICAL, corresponding to a HOST TARGET binding site such as BINDING SITE I, BINDING SITE II or BINDING SITE III. Table 2 illustrates the complementarity of the nucleotide sequences of MICAL BINDING SITE, designated SEQ ID:23011, to the nucleotide sequence of VGAM200 RNA, herein designated VGAM RNA, also designated SEQ ID:2911.

Another function of VGAM200 is therefore inhibition of MICAL (Accession NM_022765). Accordingly, utilities of VGAM200 include diagnosis, prevention and treatment of diseases and clinical conditions associated with MICAL. My015 (Accession XM_039512) is another VGAM200 host target gene. My015 BINDING SITE is HOST TARGET binding site found in the 3' untranslated region of mRNA encoded by My015, corresponding to a HOST TARGET binding site such as BINDING SITE I, BINDING SITE II or BINDING SITE III. Table 2 illustrates the complementarity of the nucleotide sequences of My015 BINDING SITE, designated SEQ ID:33108, to the nucleotide sequence of VGAM200 RNA, herein designated VGAM RNA, also designated SEQ ID:2911.

Another function of VGAM200 is therefore inhibition of My015 (Accession XM_039512). Accordingly, utilities of VGAM200 include diagnosis, prevention and treatment of diseases and clinical conditions associated with My015. Myelin Transcription Factor 1 (MYT1, Accession NM_004535) is another VGAM200 host target gene. MYT1 BINDING SITE is HOST TARGET binding site found in the 3' untranslated region of mRNA encoded by MYT1, corresponding to a HOST TARGET binding site such as BINDING SITE I, BINDING SITE II or BINDING SITE III. Table 2 illustrates the complementarity of the nucleotide sequences of MYT1 BINDING SITE, designated SEQ ID:10875, to the nucleotide sequence of VGAM200 RNA, herein designated VGAM RNA, also designated SEQ ID:2911.

Another function of VGAM200 is therefore inhibition of Myelin Transcription Factor 1 (MYT1, Accession NM_004535). Accordingly, utilities of VGAM200 include diagnosis, prevention and treatment of diseases and clinical conditions associated with MYT1. Phosphate Cytidylyltransferase 2, Ethanolamine (PCYT2, Accession NM_002861) is another VGAM200 host target gene. PCYT2 BINDING SITE is HOST TARGET binding site found in the 3' untranslated region of mRNA encoded by PCYT2, corresponding to a HOST TARGET binding site such as BINDING SITE I, BINDING SITE II or BINDING SITE III. Table 2 illustrates the complementarity of the nucleotide sequences of PCYT2 BINDING SITE, designated SEQ ID:8762, to the nucleotide sequence of VGAM200 RNA, herein designated VGAM RNA, also designated SEQ ID:2911.

Another function of VGAM200 is therefore inhibition of Phosphate Cytidylyltransferase 2, Ethanolamine (PCYT2, Accession NM_002861). Accordingly, utilities of VGAM200 include diagnosis, prevention and treatment of diseases and clinical conditions associated with PCYT2. Phosphatidylinositol-4-phosphate 5-kinase, Type II, Beta (PIP5K2B, Accession NM_138687) is another VGAM200 host target gene. PIP5K2B BINDING SITE1 and PIP5K2B BINDING SITE2 are HOST TARGET binding sites found in untranslated regions of mRNA encoded by PIP5K2B, corresponding to HOST TARGET binding sites such as BINDING SITE I, BINDING SITE II or BINDING SITE III. Table 2 illustrates the complementarity of the nucleotide sequences of PIP5K2B BINDING SITE1 and PIP5K2B BINDING SITE2, designated SEQ ID:28929 and SEQ ID:9607 respectively, to the nucleotide sequence of VGAM200 RNA, herein designated VGAM RNA, also designated SEQ ID:2911.

Another function of VGAM200 is therefore inhibition of Phosphatidylinositol-4-phosphate 5-kinase, Type II, Beta (PIP5K2B, Accession NM_138687). Accordingly, utilities of VGAM200 include diagnosis, prevention and treatment of diseases and clinical conditions associated with PIP5K2B. Phosphatidylserine Decarboxylase (PISD, Accession NM_014338) is another VGAM200 host target gene. PISD BINDING SITE1 and PISD BINDING SITE2 are HOST TARGET binding sites found in untranslated regions of mRNA encoded by PISD, corresponding to HOST TARGET binding sites such as BINDING SITE I, BINDING SITE II or BINDING SITE III. Table 2 illustrates the complementarity of the nucleotide sequences of PISD BINDING SITE1 and PISD BINDING SITE2, designated SEQ ID:15658 and SEQ ID:18234 respectively, to the nucleotide sequence of VGAM200 RNA, herein designated VGAM RNA, also designated SEQ ID:2911.

Another function of VGAM200 is therefore inhibition of Phosphatidylserine Decarboxylase (PISD, Accession NM_014338). Accordingly, utilities of VGAM200 include diagnosis, prevention and treatment of diseases and clinical conditions associated with PISD. PRO1163 (Accession NM_018576) is another VGAM200 host target gene. PRO1163 BINDING SITE is HOST TARGET binding site found in the 5' untranslated region of mRNA encoded by PRO1163, corresponding to a HOST TARGET binding site such as BINDING SITE I, BINDING SITE II or BINDING SITE III. Table 2 illustrates the complementarity of the nucleotide sequences of PRO1163 BINDING SITE, designated SEQ ID:20655, to the nucleotide sequence of VGAM200 RNA, herein designated VGAM RNA, also designated SEQ ID:2911.

Another function of VGAM200 is therefore inhibition of PRO1163 (Accession NM_018576). Accordingly, utilities of VGAM200 include diagnosis, prevention and treatment of diseases and clinical conditions associated with PRO1163. Solute Carrier Family 39 (zinc transporter), Member 3 (SLC39A3, Accession NM_144564) is another VGAM200 host target gene. SLC39A3 BINDING SITE is HOST TARGET binding site found in the 3' untranslated region of mRNA encoded by SLC39A3, corresponding to a HOST TARGET binding site such as BINDING SITE I, BINDING SITE II or BINDING SITE III. Table 2 illustrates the complementarity of the nucleotide sequences of SLC39A3 BINDING SITE, designated SEQ ID:29362, to the nucleotide sequence of VGAM200 RNA, herein designated VGAM RNA, also designated SEQ ID:2911.

Another function of VGAM200 is therefore inhibition of Solute Carrier Family 39 (zinc transporter), Member 3 (SLC39A3, Accession NM_144564). Accordingly, utilities of VGAM200 include diagnosis, prevention and treatment of diseases and clinical conditions associated with SLC39A3. TED (Accession NM_015686) is another VGAM200 host target gene. TED BINDING SITE is HOST TARGET binding site found in the 3' untranslated region of mRNA encoded by TED, corresponding to a HOST TARGET binding site such as BINDING SITE I, BINDING SITE II or BINDING SITE III. Table 2 illustrates the complementarity of the nucleotide sequences of TED BINDING SITE, designated SEQ ID:17918, to the nucleotide sequence of VGAM200 RNA, herein designated VGAM RNA, also designated SEQ ID:2911.

Another function of VGAM200 is therefore inhibition of TED (Accession NM_015686). Accordingly, utilities of VGAM200 include diagnosis, prevention and treatment of diseases and clinical conditions associated with TED. Testis Specific, 14 (TSGA14, Accession NM_018718) is another VGAM200 host target gene. TSGA14 BINDING SITE is HOST TARGET binding site found in the 3' untranslated region of mRNA encoded by TSGA14, corresponding to a HOST TARGET binding site such as BINDING SITE I, BINDING SITE II or BINDING SITE III. Table 2 illustrates the complementarity of the nucleotide sequences of TSGA14 BINDING SITE, designated SEQ ID:20796, to the nucleotide sequence of VGAM200 RNA, herein designated VGAM RNA, also designated SEQ ID:2911.

Another function of VGAM200 is therefore inhibition of Testis Specific, 14 (TSGA14, Accession NM_018718). Accordingly, utilities of VGAM200 include diagnosis, prevention and treatment of diseases and clinical conditions associated with TSGA14. Zinc Finger, DHHC Domain Containing 2 (ZDHHC2, Accession NM_016353) is another VGAM200 host target gene. ZDHHC2 BINDING SITE is HOST TARGET binding site found in the 5' untranslated region of mRNA encoded by ZDHHC2, corresponding to a HOST TARGET binding site such as BINDING SITE I, BINDING SITE II or BINDING SITE III. Table 2 illustrates the complementarity of the nucleotide sequences of ZDHHC2 BINDING SITE, designated SEQ ID:18489, to the nucleotide sequence of VGAM200 RNA, herein designated VGAM RNA, also designated SEQ ID:2911.

Another function of VGAM200 is therefore inhibition of Zinc Finger, DHHC Domain Containing 2 (ZDHHC2, Accession NM_016353). Accordingly, utilities of VGAM200 include diagnosis, prevention and treatment of diseases and clinical conditions associated with ZDHHC2. LOC115073 (Accession XM_055193) is another VGAM200 host target gene. LOC115073 BINDING SITE1 and LOC115073 BINDING SITE2 are HOST TARGET binding sites found in untranslated regions of mRNA encoded by LOC115073, corresponding to HOST TARGET binding sites such as BINDING SITE I, BINDING SITE II or BINDING SITE III. Table 2 illustrates the complementarity of the nucleotide sequences of LOC115073 BINDING SITE1 and LOC115073 BINDING SITE2, designated SEQ ID:36243 and SEQ ID:36244 respectively, to the nucleotide sequence of VGAM200 RNA, herein designated VGAM RNA, also designated SEQ ID:2911.

Another function of VGAM200 is therefore inhibition of LOC115073 (Accession XM_055193). Accordingly, utilities of VGAM200 include diagnosis, prevention and treatment of diseases and clinical conditions associated with LOC115073. LOC129138 (Accession NM_138797) is another VGAM200 host target gene. LOC129138 BINDING SITE is HOST TARGET binding site found in the 3' untranslated region of mRNA encoded by LOC129138, corresponding to a HOST TARGET binding site such as BINDING SITE I, BINDING SITE II or BINDING SITE III. Table 2 illustrates the complementarity of the nucleotide sequences of LOC129138 BINDING SITE, designated SEQ ID:29020, to the nucleotide sequence of VGAM200 RNA, herein designated VGAM RNA, also designated SEQ ID:2911.

Another function of VGAM200 is therefore inhibition of LOC129138 (Accession NM_138797). Accordingly, utilities of VGAM200 include diagnosis, prevention and treatment of diseases and clinical conditions associated with LOC129138. LOC132235 (Accession XM_072302) is another VGAM200 host target gene. LOC132235 BINDING SITE is HOST TARGET binding site found in the 5' untranslated region of mRNA encoded by LOC132235, corresponding to a HOST TARGET binding site such as BINDING SITE I, BINDING SITE II or BINDING SITE III. Table 2 illustrates the complementarity of the nucleotide sequences of LOC132235 BINDING SITE, designated SEQ ID:37484, to the nucleotide sequence of VGAM200 RNA, herein designated VGAM RNA, also designated SEQ ID:2911.

Another function of VGAM200 is therefore inhibition of LOC132235 (Accession XM_072302). Accordingly, utilities of VGAM200 include diagnosis, prevention and treatment of diseases and clinical conditions associated with LOC132235. LOC143310 (Accession XM_084485) is another VGAM200 host target gene. LOC143310 BINDING SITE is HOST TARGET binding site found in the 3' untranslated region of mRNA encoded by LOC143310, corresponding to a HOST TARGET binding site such as BINDING SITE I, BINDING SITE II or BINDING SITE III. Table 2 illustrates the complementarity of the nucleotide sequences of LOC143310 BINDING SITE, designated SEQ ID:37608, to the nucleotide sequence of VGAM200 RNA, herein designated VGAM RNA, also designated SEQ ID:2911.

Another function of VGAM200 is therefore inhibition of LOC143310 (Accession XM_084485). Accordingly, utilities of VGAM200 include diagnosis, prevention and treatment of diseases and clinical conditions associated with LOC143310. LOC144317 (Accession XM_084813) is another VGAM200 host target gene. LOC144317 BINDING SITE is HOST TARGET binding site found in the 5' untranslated region of mRNA encoded by LOC144317, corresponding to a HOST TARGET binding site such as BINDING SITE I, BINDING SITE II or BINDING SITE III. Table 2 illustrates the complementarity of the nucleotide sequences of LOC144317 BINDING SITE, designated SEQ ID:37719, to the nucleotide sequence of VGAM200 RNA, herein designated VGAM RNA, also designated SEQ ID:2911.

Another function of VGAM200 is therefore inhibition of LOC144317 (Accession XM_084813). Accordingly, utilities of VGAM200 include diagnosis, prevention and treatment of diseases and clinical conditions associated with LOC144317.

LOC144699 (Accession XM_084940) is another VGAM200 host target gene. LOC144699 BINDING SITE is HOST TARGET binding site found in the 3' untranslated region of mRNA encoded by LOC144699, corresponding to a HOST TARGET binding site such as BINDING SITE I, BINDING SITE II or BINDING SITE III. Table 2 illustrates the complementarity of the nucleotide sequences of LOC144699 BINDING SITE, designated SEQ ID:37770, to the nucleotide sequence of VGAM200 RNA, herein designated VGAM RNA, also designated SEQ ID:2911.

Another function of VGAM200 is therefore inhibition of LOC144699 (Accession XM_084940). Accordingly, utilities of VGAM200 include diagnosis, prevention and treatment of diseases and clinical conditions associated with LOC144699.

LOC145717 (Accession XM_039771) is another VGAM200 host target gene. LOC145717 BINDING SITE is HOST TARGET binding site found in the 5' untranslated region of mRNA encoded by LOC145717, corresponding to a HOST TARGET binding site such as BINDING SITE I, BINDING SITE II or BINDING SITE III. Table 2 illustrates the complementarity of the nucleotide sequences of LOC145717 BINDING SITE, designated SEQ ID:33191, to the nucleotide sequence of VGAM200 RNA, herein designated VGAM RNA, also designated SEQ ID:2911.

Another function of VGAM200 is therefore inhibition of LOC145717 (Accession XM_039771). Accordingly, utilities of VGAM200 include diagnosis, prevention and treatment of diseases and clinical conditions associated with LOC145717.

LOC146520 (Accession XM_085492) is another VGAM200 host target gene. LOC146520 BINDING SITE is HOST TARGET binding site found in the 5' untranslated region of mRNA encoded by LOC146520, corresponding to a HOST TARGET binding site such as BINDING SITE I, BINDING SITE II or BINDING SITE III. Table 2 illustrates the complementarity of the nucleotide sequences of LOC146520 BINDING SITE, designated SEQ ID:38189, to the nucleotide sequence of VGAM200 RNA, herein designated VGAM RNA, also designated SEQ ID:2911.

Another function of VGAM200 is therefore inhibition of LOC146520 (Accession XM_085492). Accordingly, utilities of VGAM200 include diagnosis, prevention and treatment of diseases and clinical conditions associated with LOC146520.

LOC147664 (Accession XM_085826) is another VGAM200 host target gene. LOC147664 BINDING SITE is HOST TARGET binding site found in the 3' untranslated region of mRNA encoded by LOC147664, corresponding to a HOST TARGET binding site such as BINDING SITE I, BINDING SITE II or BINDING SITE III. Table 2 illustrates the complementarity of the nucleotide sequences of LOC147664 BINDING SITE, designated SEQ ID:38353, to the nucleotide sequence of VGAM200 RNA, herein designated VGAM RNA, also designated SEQ ID:2911.

Another function of VGAM200 is therefore inhibition of LOC147664 (Accession XM_085826). Accordingly, utilities of VGAM200 include diagnosis, prevention and treatment of diseases and clinical conditions associated with LOC147664.

LOC148029 (Accession XM_086014) is another VGAM200 host target gene. LOC148029 BINDING SITE is HOST TARGET binding site found in the 5' untranslated region of mRNA encoded by LOC148029, corresponding to a HOST TARGET binding site such as BINDING SITE I, BINDING SITE II or BINDING SITE III. Table 2 illustrates the complementarity of the nucleotide sequences of LOC148029 BINDING SITE, designated SEQ ID:38448, to the nucleotide sequence of VGAM200 RNA, herein designated VGAM RNA, also designated SEQ ID:2911.

Another function of VGAM200 is therefore inhibition of LOC148029 (Accession XM_086014). Accordingly, utilities of VGAM200 include diagnosis, prevention and treatment of diseases and clinical conditions associated with LOC148029.

LOC149950 (Accession XM_086732) is another VGAM200 host target gene. LOC149950 BINDING SITE is HOST TARGET binding site found in the 5' untranslated region of mRNA encoded by LOC149950, corresponding to a HOST TARGET binding site such as BINDING SITE I, BINDING SITE II or BINDING SITE III. Table 2 illustrates the complementarity of the nucleotide sequences of LOC149950 BINDING SITE, designated SEQ ID:38841, to the nucleotide sequence of VGAM200 RNA, herein designated VGAM RNA, also designated SEQ ID:2911.

Another function of VGAM200 is therefore inhibition of LOC149950 (Accession XM_086732). Accordingly, utilities of VGAM200 include diagnosis, prevention and treatment of diseases and clinical conditions associated with LOC149950.

LOC150245 (Accession XM_097843) is another VGAM200 host target gene. LOC150245 BINDING SITE is HOST TARGET binding site found in the 3' untranslated region of mRNA encoded by LOC150245, corresponding to a HOST TARGET binding site such as BINDING SITE I, BINDING SITE II or BINDING SITE III. Table 2 illustrates the complementarity of the nucleotide sequences of LOC150245 BINDING SITE, designated SEQ ID:41165, to the nucleotide sequence of VGAM200 RNA, herein designated VGAM RNA, also designated SEQ ID:2911.

Another function of VGAM200 is therefore inhibition of LOC150245 (Accession XM_097843). Accordingly, utilities of VGAM200 include diagnosis, prevention and treatment of diseases and clinical conditions associated with LOC150245.

LOC152992 (Accession XM_087575) is another VGAM200 host target gene. LOC152992 BINDING SITE is HOST TARGET binding site found in the 3' untranslated region of mRNA encoded by LOC152992, corresponding to a HOST TARGET binding site such as BINDING SITE I, BINDING SITE II or BINDING SITE III. Table 2 illustrates the complementarity of the nucleotide sequences of LOC152992 BINDING SITE, designated SEQ ID:39351, to the nucleotide sequence of VGAM200 RNA, herein designated VGAM RNA, also designated SEQ ID:2911.

Another function of VGAM200 is therefore inhibition of LOC152992 (Accession XM_087575). Accordingly, utilities of VGAM200 include diagnosis, prevention and treatment of diseases and clinical conditions associated with LOC152992.

LOC154092 (Accession XM_098466) is another VGAM200 host target gene. LOC154092 BINDING SITE is HOST TARGET binding site found in the 3' untranslated region of mRNA encoded by LOC154092, corresponding to a HOST TARGET binding site such as BINDING SITE I, BINDING SITE II or BINDING SITE III. Table 2 illustrates the complementarity of the nucleotide sequences of LOC154092 BINDING SITE, designated SEQ ID:41682, to the nucleotide sequence of VGAM200 RNA, herein designated VGAM RNA, also designated SEQ ID:2911.

Another function of VGAM200 is therefore inhibition of LOC154092 (Accession XM_098466). Accordingly, utilities of VGAM200 include diagnosis, prevention and treatment of diseases and clinical conditions associated with LOC154092.

LOC158428 (Accession XM_047249) is another VGAM200 host target gene. LOC158428 BINDING SITE is HOST TARGET binding site found in the 3' untranslated region of mRNA encoded by LOC158428, corresponding to a HOST TARGET binding site such as BINDING SITE I, BINDING SITE II or BINDING SITE III. Table 2 illustrates the complementarity of the nucleotide sequences of LOC158428 BINDING SITE, designated SEQ ID:34923, to the nucleotide sequence of VGAM200 RNA, herein designated VGAM RNA, also designated SEQ ID:2911.

Another function of VGAM200 is therefore inhibition of LOC158428 (Accession XM_047249). Accordingly, utilities of VGAM200 include diagnosis, prevention and treatment of diseases and clinical conditions associated with LOC158428. LOC158434 (Accession XM_098939) is another VGAM200 host target gene. LOC158434 BINDING SITE is HOST TARGET binding site found in the 5' untranslated region of mRNA encoded by LOC158434, corresponding to a HOST TARGET binding site such as BINDING SITE I, BINDING SITE II or BINDING SITE III. Table 2 illustrates the complementarity of the nucleotide sequences of LOC158434 BINDING SITE, designated SEQ ID:41987, to the nucleotide sequence of VGAM200 RNA, herein designated VGAM RNA, also designated SEQ ID:2911.

Another function of VGAM200 is therefore inhibition of LOC158434 (Accession XM_098939). Accordingly, utilities of VGAM200 include diagnosis, prevention and treatment of diseases and clinical conditions associated with LOC158434. LOC158515 (Accession XM_092979) is another VGAM200 host target gene. LOC158515 BINDING SITE is HOST TARGET binding site found in the 5' untranslated region of mRNA encoded by LOC158515, corresponding to a HOST TARGET binding site such as BINDING SITE I, BINDING SITE II or BINDING SITE III. Table 2 illustrates the complementarity of the nucleotide sequences of LOC158515 BINDING SITE, designated SEQ ID:40162, to the nucleotide sequence of VGAM200 RNA, herein designated VGAM RNA, also designated SEQ ID:2911.

Another function of VGAM200 is therefore inhibition of LOC158515 (Accession XM_092979). Accordingly, utilities of VGAM200 include diagnosis, prevention and treatment of diseases and clinical conditions associated with LOC158515. LOC161635 (Accession XM_172921) is another VGAM200 host target gene. LOC161635 BINDING SITE is HOST TARGET binding site found in the 5' untranslated region of mRNA encoded by LOC161635, corresponding to a HOST TARGET binding site such as BINDING SITE I, BINDING SITE II or BINDING SITE III. Table 2 illustrates the complementarity of the nucleotide sequences of LOC161635 BINDING SITE, designated SEQ ID:46186, to the nucleotide sequence of VGAM200 RNA, herein designated VGAM RNA, also designated SEQ ID:2911.

Another function of VGAM200 is therefore inhibition of LOC161635 (Accession XM_172921). Accordingly, utilities of VGAM200 include diagnosis, prevention and treatment of diseases and clinical conditions associated with LOC161635. LOC195977 (Accession XM_113625) is another VGAM200 host target gene. LOC195977 BINDING SITE is HOST TARGET binding site found in the 3' untranslated region of mRNA encoded by LOC195977, corresponding to a HOST TARGET binding site such as BINDING SITE I, BINDING SITE II or BINDING SITE III. Table 2 illustrates the complementarity of the nucleotide sequences of LOC195977 BINDING SITE, designated SEQ ID:42301, to the nucleotide sequence of VGAM200 RNA, herein designated VGAM RNA, also designated SEQ ID:2911.

Another function of VGAM200 is therefore inhibition of LOC195977 (Accession XM_113625). Accordingly, utilities of VGAM200 include diagnosis, prevention and treatment of diseases and clinical conditions associated with LOC195977. LOC199786 (Accession XM_114021) is another VGAM200 host target gene. LOC199786 BINDING SITE is HOST TARGET binding site found in the 3' untranslated region of mRNA encoded by LOC199786, corresponding to a HOST TARGET binding site such as BINDING SITE I, BINDING SITE II or BINDING SITE III. Table 2 illustrates the complementarity of the nucleotide sequences of LOC199786 BINDING SITE, designated SEQ ID:42622, to the nucleotide sequence of VGAM200 RNA, herein designated VGAM RNA, also designated SEQ ID:2911.

Another function of VGAM200 is therefore inhibition of LOC199786 (Accession XM_114021). Accordingly, utilities of VGAM200 include diagnosis, prevention and treatment of diseases and clinical conditions associated with LOC199786. LOC200093 (Accession XM_032184) is another VGAM200 host target gene. LOC200093 BINDING SITE is HOST TARGET binding site found in the 5' untranslated region of mRNA encoded by LOC200093, corresponding to a HOST TARGET binding site such as BINDING SITE I, BINDING SITE II or BINDING SITE III. Table 2 illustrates the complementarity of the nucleotide sequences of LOC200093 BINDING SITE, designated SEQ ID:31606, to the nucleotide sequence of VGAM200 RNA, herein designated VGAM RNA, also designated SEQ ID:2911.

Another function of VGAM200 is therefore inhibition of LOC200093 (Accession XM_032184). Accordingly, utilities of VGAM200 include diagnosis, prevention and treatment of diseases and clinical conditions associated with LOC200093. LOC200138 (Accession XM_117194) is another VGAM200 host target gene. LOC200138 BINDING SITE is HOST TARGET binding site found in the 3' untranslated region of mRNA encoded by LOC200138, corresponding to a HOST TARGET binding site such as BINDING SITE I, BINDING SITE II or BINDING SITE III. Table 2 illustrates the complementarity of the nucleotide sequences of LOC200138 BINDING SITE, designated SEQ ID:43280, to the nucleotide sequence of VGAM200 RNA, herein designated VGAM RNA, also designated SEQ ID:2911.

Another function of VGAM200 is therefore inhibition of LOC200138 (Accession XM_117194). Accordingly, utilities of VGAM200 include diagnosis, prevention and treatment of diseases and clinical conditions associated with LOC200138. LOC200918 (Accession XM_114316) is another VGAM200 host target gene. LOC200918 BINDING SITE is HOST TARGET binding site found in the 3' untranslated region of mRNA encoded by LOC200918, corresponding to a HOST TARGET binding site such as BINDING SITE I, BINDING SITE II or BINDING SITE III. Table 2 illustrates the complementarity of the nucleotide sequences of LOC200918 BINDING SITE, designated SEQ ID:42870, to the nucleotide sequence of VGAM200 RNA, herein designated VGAM RNA, also designated SEQ ID:2911.

Another function of VGAM200 is therefore inhibition of LOC200918 (Accession XM_114316). Accordingly, utilities of VGAM200 include diagnosis, prevention and treatment of diseases and clinical conditions associated with LOC200918. LOC205418 (Accession XM_119792) is another VGAM200 host target gene. LOC205418 BINDING SITE is HOST TARGET binding site found in the 5' untranslated region of mRNA encoded by LOC205418, corresponding to a HOST TARGET binding site such as BINDING SITE I, BINDING SITE II or BINDING SITE III. Table 2 illustrates the complementarity of the nucleotide sequences of LOC205418 BINDING SITE, designated SEQ ID:43598, to the nucleotide sequence of VGAM200 RNA, herein designated VGAM RNA, also designated SEQ ID:2911.

Another function of VGAM200 is therefore inhibition of LOC205418 (Accession XM_119792). Accordingly, utilities of VGAM200 include diagnosis, prevention and treatment of diseases and clinical conditions associated with LOC205418. LOC220980 (Accession XM_167629) is another VGAM200 host target gene. LOC220980 BINDING SITE is HOST TARGET binding site found in the 5' untranslated region of mRNA encoded by LOC220980, corresponding to a HOST TARGET binding site such as BINDING SITE I, BINDING SITE II or BINDING SITE III. Table 2 illustrates the complementarity of the nucleotide sequences of LOC220980 BINDING SITE, designated SEQ ID:44741, to the nucleotide sequence of VGAM200 RNA, herein designated VGAM RNA, also designated SEQ ID:2911.

Another function of VGAM200 is therefore inhibition of LOC220980 (Accession XM_167629). Accordingly, utilities of VGAM200 include diagnosis, prevention and treatment of diseases and clinical conditions associated with LOC220980. LOC221751 (Accession XM_166370) is another VGAM200 host target gene. LOC221751 BINDING SITE is HOST TARGET binding site found in the 5' untranslated region of mRNA encoded by LOC221751, corresponding to a HOST TARGET binding site such as BINDING SITE I, BINDING SITE II or BINDING SITE III. Table 2 illustrates the complementarity of the nucleotide sequences of LOC221751 BINDING SITE, designated SEQ ID:44189, to the nucleotide sequence of VGAM200 RNA, herein designated VGAM RNA, also designated SEQ ID:2911.

Another function of VGAM200 is therefore inhibition of LOC221751 (Accession XM_166370). Accordingly, utilities of VGAM200 include diagnosis, prevention and treatment of diseases and clinical conditions associated with LOC221751. LOC245727 (Accession XM_165913) is another VGAM200 host target gene. LOC245727 BINDING SITE is HOST TARGET binding site found in the 5' untranslated region of mRNA encoded by LOC245727, corresponding to a HOST TARGET binding site such as BINDING SITE I, BINDING SITE II or BINDING SITE III. Table 2 illustrates the complementarity of the nucleotide sequences of LOC245727 BINDING SITE, designated SEQ ID:43796, to the nucleotide sequence of VGAM200 RNA, herein designated VGAM RNA, also designated SEQ ID:2911.

Another function of VGAM200 is therefore inhibition of LOC245727 (Accession XM_165913). Accordingly, utilities of VGAM200 include diagnosis, prevention and treatment of diseases and clinical conditions associated with LOC245727. LOC253001 (Accession XM_171711) is another VGAM200 host target gene. LOC253001 BINDING SITE is HOST TARGET binding site found in the 3' untranslated region of mRNA encoded by LOC253001, corresponding to a HOST TARGET binding site such as BINDING SITE I, BINDING SITE II or BINDING SITE III. Table 2 illustrates the complementarity of the nucleotide sequences of LOC253001 BINDING SITE, designated SEQ ID:46059, to the nucleotide sequence of VGAM200 RNA, herein designated VGAM RNA, also designated SEQ ID:2911.

Another function of VGAM200 is therefore inhibition of LOC253001 (Accession XM_171711). Accordingly, utilities of VGAM200 include diagnosis, prevention and treatment of diseases and clinical conditions associated with LOC253001. LOC253070 (Accession XM_173088) is another VGAM200 host target gene. LOC253070 BINDING SITE is HOST TARGET binding site found in the 5' untranslated region of mRNA encoded by LOC253070, corresponding to a HOST TARGET binding site such as BINDING SITE I, BINDING SITE II or BINDING SITE III. Table 2 illustrates the complementarity of the nucleotide sequences of LOC253070 BINDING SITE, designated SEQ ID:46353, to the nucleotide sequence of VGAM200 RNA, herein designated VGAM RNA, also designated SEQ ID:2911.

Another function of VGAM200 is therefore inhibition of LOC253070 (Accession XM_173088). Accordingly, utilities of VGAM200 include diagnosis, prevention and treatment of diseases and clinical conditions associated with LOC253070. LOC253805 (Accession XM_172854) is another VGAM200 host target gene. LOC253805 BINDING SITE is HOST TARGET binding site found in the 3' untranslated region of mRNA encoded by LOC253805, corresponding to a HOST TARGET binding site such as BINDING SITE I, BINDING SITE II or BINDING SITE III. Table 2 illustrates the complementarity of the nucleotide sequences of LOC253805 BINDING SITE, designated SEQ ID:46138, to the nucleotide sequence of VGAM200 RNA, herein designated VGAM RNA, also designated SEQ ID:2911.

Another function of VGAM200 is therefore inhibition of LOC253805 (Accession XM_172854). Accordingly, utilities of VGAM200 include diagnosis, prevention and treatment of diseases and clinical conditions associated with LOC253805. LOC253959 (Accession XM_170749) is another VGAM200 host target gene. LOC253959 BINDING SITE is HOST TARGET binding site found in the 3' untranslated region of mRNA encoded by LOC253959, corresponding to a HOST TARGET binding site such as BINDING SITE I, BINDING SITE II or BINDING SITE III. Table 2 illustrates the complementarity of the nucleotide sequences of LOC253959 BINDING SITE, designated SEQ ID:45510, to the nucleotide sequence of VGAM200 RNA, herein designated VGAM RNA, also designated SEQ ID:2911.

Another function of VGAM200 is therefore inhibition of LOC253959 (Accession XM_170749). Accordingly, utilities of VGAM200 include diagnosis, prevention and treatment of diseases and clinical conditions associated with LOC253959. LOC254387 (Accession XM_170731) is another VGAM200 host target gene. LOC254387 BINDING SITE is HOST TARGET binding site found in the 3' untranslated region of mRNA encoded by LOC254387, corresponding to a HOST TARGET binding site such as BINDING SITE I, BINDING SITE II or BINDING SITE III. Table 2 illustrates the complementarity of the nucleotide sequences of LOC254387 BINDING SITE, designated SEQ ID:45489, to the nucleotide sequence of VGAM200 RNA, herein designated VGAM RNA, also designated SEQ ID:2911.

Another function of VGAM200 is therefore inhibition of LOC254387 (Accession XM_170731). Accordingly, utilities of VGAM200 include diagnosis, prevention and treatment of diseases and clinical conditions associated with LOC254387. LOC254532 (Accession XM_172961) is another VGAM200 host target gene. LOC254532 BINDING SITE is HOST TARGET binding site found in the 5' untranslated region of mRNA encoded by LOC254532, corresponding to a HOST TARGET binding site such as BINDING SITE I, BINDING SITE II or BINDING SITE III. Table 2 illustrates the complementarity of the nucleotide sequences of LOC254532 BINDING SITE, designated SEQ ID:46208, to the nucleotide sequence of VGAM200 RNA, herein designated VGAM RNA, also designated SEQ ID:2911.

Another function of VGAM200 is therefore inhibition of LOC254532 (Accession XM_172961). Accordingly, utilities of VGAM200 include diagnosis, prevention and treatment of diseases and clinical conditions associated with LOC254532. LOC255650 (Accession XM_172981) is another VGAM200 host target gene. LOC255650 BINDING SITE is HOST TARGET binding site found in the 3' untranslated region of mRNA encoded by LOC255650, corresponding to a HOST TARGET binding site such as BINDING SITE I, BINDING SITE II or BINDING SITE III. Table 2 illustrates the complementarity of the nucleotide sequences of LOC255650 BIND- ING SITE, designated SEQ ID:46248, to the nucleotide sequence of VGAM200 RNA, herein designated VGAM RNA, also designated SEQ ID:2911.

Another function of VGAM200 is therefore inhibition of LOC255650 (Accession XM_172981). Accordingly, utilities of VGAM200 include diagnosis, prevention and treatment of diseases and clinical conditions associated with LOC255650. LOC256158 (Accession XM_175125) is another VGAM200 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46633, to the nucleotide sequence of VGAM200 RNA, herein designated VGAM RNA, also designated SEQ ID:2911.

Another function of VGAM200 is therefore inhibition of LOC256158 (Accession XM_175125). Accordingly, utilities of VGAM200 include diagnosis, prevention and treatment of diseases and clinical conditions associated with LOC256158. LOC256248 (Accession XM_172550) is another VGAM200 host target gene. LOC256248 BINDING SITE is HOST TARGET binding site found in the 5' untranslated region of mRNA encoded by LOC256248, corresponding to a HOST TARGET binding site such as BINDING SITE I, BINDING SITE II or BINDING SITE III. Table 2 illustrates the complementarity of the nucleotide sequences of LOC256248 BINDING SITE, designated SEQ ID:46075, to the nucleotide sequence of VGAM200 RNA, herein designated VGAM RNA, also designated SEQ ID:2911.

Another function of VGAM200 is therefore inhibition of LOC256248 (Accession XM_172550). Accordingly, utilities of VGAM200 include diagnosis, prevention and treatment of diseases and clinical conditions associated with LOC256248. LOC256790 (Accession XM_170679) is another VGAM200 host target gene. LOC256790 BINDING SITE is HOST TARGET binding site found in the 5' untranslated region of mRNA encoded by LOC256790, corresponding to a HOST TARGET binding site such as BINDING SITE I, BINDING SITE II or BINDING SITE III. Table 2 illustrates the complementarity of the nucleotide sequences of LOC256790 BINDING SITE, designated SEQ ID:45461, to the nucleotide sequence of VGAM200 RNA, herein designated VGAM RNA, also designated SEQ ID:2911.

Another function of VGAM200 is therefore inhibition of LOC256790 (Accession XM_170679). Accordingly, utilities of VGAM200 include diagnosis, prevention and treatment of diseases and clinical conditions associated with LOC256790. LOC89958 (Accession XM_027627) is another VGAM200 host target gene. LOC89958 BINDING SITE is HOST TARGET binding site found in the 3' untranslated region of mRNA encoded by LOC89958, corresponding to a HOST TARGET binding site such as BINDING SITE I, BINDING SITE II or BINDING SITE III. Table 2 illustrates the complementarity of the nucleotide sequences of LOC89958 BINDING SITE, designated SEQ ID:30544, to the nucleotide sequence of VGAM200 RNA, herein designated VGAM RNA, also designated SEQ ID:2911.

Another function of VGAM200 is therefore inhibition of LOC89958 (Accession XM_027627). Accordingly, utilities of VGAM200 include diagnosis, prevention and treatment of diseases and clinical conditions associated with LOC89958. LOC90362 (Accession XM_031163) is another VGAM200 host target gene. LOC90362 BINDING SITE is HOST TARGET binding site found in the 5' untranslated region of mRNA encoded by LOC90362, corresponding to a HOST TARGET binding site such as BINDING SITE I, BINDING SITE II or BINDING SITE III. Table 2 illustrates the complementarity of the nucleotide sequences of LOC90362 BINDING SITE, designated SEQ ID:31296, to the nucleotide sequence of VGAM200 RNA, herein designated VGAM RNA, also designated SEQ ID:2911.

Another function of VGAM200 is therefore inhibition of LOC90362 (Accession XM_031163). Accordingly, utilities of VGAM200 include diagnosis, prevention and treatment of diseases and clinical conditions associated with LOC90362. LOC90678 (Accession NM_138361) is another VGAM200 host target gene. LOC90678 BINDING SITE is HOST TARGET binding site found in the 3' untranslated region of mRNA encoded by LOC90678, corresponding to a HOST TARGET binding site such as BINDING SITE I, BINDING SITE II or BINDING SITE III. Table 2 illustrates the complementarity of the nucleotide sequences of LOC90678 BINDING SITE, designated SEQ ID:28748, to the nucleotide sequence of VGAM200 RNA, herein designated VGAM RNA, also designated SEQ ID:2911.

Another function of VGAM200 is therefore inhibition of LOC90678 (Accession NM_138361). Accordingly, utilities of VGAM200 include diagnosis, prevention and treatment of diseases and clinical conditions associated with LOC90678. LOC90841 (Accession XM_034427) is another VGAM200 host target gene. LOC90841 BINDING SITE is HOST TARGET binding site found in the 5' untranslated region of mRNA encoded by LOC90841, corresponding to a HOST TARGET binding site such as BINDING SITE I, BINDING SITE II or BINDING SITE III. Table 2 illustrates the complementarity of the nucleotide sequences of LOC90841 BINDING SITE, designated SEQ ID:32114, to the nucleotide sequence of VGAM200 RNA, herein designated VGAM RNA, also designated SEQ ID:2911.

Another function of VGAM200 is therefore inhibition of LOC90841 (Accession XM_034427). Accordingly, utilities of VGAM200 include diagnosis, prevention and treatment of diseases and clinical conditions associated with LOC90841. LOC90925 (Accession XM_034917) is another VGAM200 host target gene. LOC90925 BINDING SITE is HOST TARGET binding site found in the 3' untranslated region of mRNA encoded by LOC90925, corresponding to a HOST TARGET binding site such as BINDING SITE I, BINDING SITE II or BINDING SITE III. Table 2 illustrates the complementarity of the nucleotide sequences of LOC90925 BINDING SITE, designated SEQ ID:32187, to the nucleotide sequence of VGAM200 RNA, herein designated VGAM RNA, also designated SEQ ID:2911.

Another function of VGAM200 is therefore inhibition of LOC90925 (Accession XM_034917). Accordingly, utilities of VGAM200 include diagnosis, prevention and treatment of diseases and clinical conditions associated with LOC90925. LOC91040 (Accession XM_035641) is another VGAM200 host target gene. LOC91040 BINDING SITE is HOST TARGET binding site found in the 5' untranslated region of mRNA encoded by LOC91040, corresponding to a HOST TARGET binding site such as BINDING SITE I, BINDING SITE II or BINDING SITE III. Table 2 illustrates the complementarity of the nucleotide sequences of LOC91040 BINDING SITE, designated SEQ ID:32323, to the nucleotide sequence of VGAM200 RNA, herein designated VGAM RNA, also designated SEQ ID:2911.

Another function of VGAM200 is therefore inhibition of LOC91040 (Accession XM_035641). Accordingly, utilities of VGAM200 include diagnosis, prevention and treatment of diseases and clinical conditions associated with LOC91040. LOC91409 (Accession XM_038298) is another VGAM200 host target gene. LOC91409 BINDING SITE is HOST TARGET binding site found in the 3' untranslated region of mRNA encoded by LOC91409, corresponding to a HOST TARGET binding site such as BINDING SITE I, BINDING SITE II or BINDING SITE III. Table 2 illustrates the complementarity of the nucleotide sequences of LOC91409 BINDING SITE, designated SEQ ID:32807, to the nucleotide sequence of VGAM200 RNA, herein designated VGAM RNA, also designated SEQ ID:2911.

Another function of VGAM200 is therefore inhibition of LOC91409 (Accession XM_038298). Accordingly, utilities of VGAM200 include diagnosis, prevention and treatment of diseases and clinical conditions associated with LOC91409. LOC91663 (Accession NM_138373) is another VGAM200 host target gene. LOC91663 BINDING SITE is HOST TARGET binding site found in the 5' untranslated region of mRNA encoded by LOC91663, corresponding to a HOST TARGET binding site such as BINDING SITE I, BINDING SITE II or BINDING SITE III. Table 2 illustrates the complementarity of the nucleotide sequences of LOC91663 BINDING SITE, designated SEQ ID:28754, to the nucleotide sequence of VGAM200 RNA, herein designated VGAM RNA, also designated SEQ ID:2911.

Another function of VGAM200 is therefore inhibition of LOC91663 (Accession NM_138373). Accordingly, utilities of VGAM200 include diagnosis, prevention and treatment of diseases and clinical conditions associated with LOC91663. FIG. 1 further provides a conceptual description of a novel bioinformatically detected viral gene of the present invention, referred to here as Viral Genomic Address Messenger 201 (VGAM201) viral gene, which modulates expression of respective host target genes thereof, the function and utility of which host target genes is known in the art.

VGAM201 is a novel bioinformatically detected regulatory, non protein coding, viral micro RNA (miRNA) gene. The method by which VGAM201 was detected is described hereinabove with reference to FIGS. 1-8.

VGAM201 gene, herein designated VGAM GENE, is a viral gene contained in the genome of Shrimp White Spot Syndrome Virus (white spot bacilliform virus). VGAM201 host target gene, herein designated VGAM HOST TARGET GENE, is a human gene contained in the human genome.

VGAM201 gene encodes a VGAM201 precursor RNA, herein designated VGAM PRECURSOR RNA. Similar to other miRNA genes, and unlike most ordinary genes, VGAM201 precursor RNA does not encode a protein. A nucleotide sequence identical or highly similar to the nucleotide sequence of VGAM201 precursor RNA is designated SEQ ID:187, and is provided hereinbelow with reference to the sequence listing part. Nucleotide sequence SEQ ID:187 is located at position 124735 relative to the genome of Shrimp White Spot Syndrome Virus (white spot bacilliform virus).

VGAM201 precursor RNA folds onto itself, forming VGAM201 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM201 folded precursor RNA into VGAM201 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM201 RNA is designated SEQ ID:2912, and is provided hereinbelow with reference to the sequence listing part.

VGAM201 host target gene, herein designated VGAM HOST TARGET GENE, encodes a corresponding messenger RNA, VGAM201 host target RNA, herein designated VGAM HOST TARGET RNA. VGAM201 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM201 RNA, herein designated VGAM RNA, binds complementarily to one or more host target binding sites located in untranslated regions of VGAM201 host target RNA, herein designated VGAM HOST TARGET RNA. This complementary binding is due to the fact that the nucleotide sequence of VGAM201 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM201 RNA, herein designated VGAM RNA, may have a different number of host target binding sites in untranslated regions of a VGAM201 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM201 RNA, herein designated VGAM RNA, to host target binding sites on VGAM201 host target RNA, herein designated VGAM HOST TARGET RNA, such as BINDING SITE I, BINDING SITE II and BINDING SITE III, inhibits translation of VGAM201 host target RNA into VGAM201 host target protein, herein designated VGAM HOST TARGET PROTEIN. VGAM host target protein is therefore outlined by a broken line.

It is appreciated that VGAM201 host target gene, herein designated VGAM HOST TARGET GENE, in fact represents a plurality of VGAM201 host target genes. The mRNA of each one of this plurality of VGAM201 host target genes comprises one or more host target binding sites, each having a nucleotide sequence which is at least partly complementary to VGAM201 RNA, herein designated VGAM RNA, and which when bound by VGAM201 RNA causes inhibition of translation of respective one or more VGAM201 host target proteins.

It is further appreciated by one skilled in the art that the mode of translational inhibition illustrated by FIG. 1 with specific reference to translational inhibition exerted by VGAM201 gene, herein designated VGAM GENE, on one or more VGAM201 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM201 is inhibition of expression of host target genes, as part of a novel viral mechanism of attacking a host. Accordingly, utilities of VGAM201 include diagnosis, prevention and treatment of viral infection by Shrimp White Spot Syndrome Virus (white spot bacilliform virus). Specific functions, and accordingly utilities, of VGAM201 correlate with, and may be deduced from, the identity of the host target genes which VGAM201 binds and inhibits, and the function of these host target genes, as elaborated hereinbelow.

Nucleotide sequences of the VGAM201 precursor RNA, herein designated VGAM PRECURSOR RNA, and of the 'diced' VGAM201 RNA, herein designated VGAM RNA, and a schematic representation of the secondary folding of VGAM201 folded precursor RNA, herein designated VGAM FOLDED PRECURSOR RNA, of VGAM201 are further described hereinbelow with reference to Table 1.

Nucleotide sequences of host target binding sites, such as BINDING SITE-I, BINDING SITE-II and BINDING SITE-III of FIG. 1, found on VGAM201 host target RNA, and schematic representation of the complementarity of each of these host target binding sites to VGAM201 RNA, herein designated VGAM RNA, are described hereinbelow with reference to Table 2.

As mentioned hereinabove with reference to FIG. 1, a function of VGAM201 gene, herein designated VGAM is inhibition of expression of VGAM201 target genes. It is appreciated that specific functions, and accordingly utilities, of VGAM201 correlate with, and may be deduced from, the identity of the target genes which VGAM201 binds and inhibits, and the function of these target genes, as elaborated hereinbelow.

FCRH1 (Accession NM_052938) is a VGAM201 host target gene. FCRH1 BINDING SITE is HOST TARGET binding site found in the 3' untranslated region of mRNA encoded by FCRH1, corresponding to a HOST TARGET binding site such as BINDING SITE I, BINDING SITE II or BINDING SITE III. Table 2 illustrates the complementarity of the nucleotide sequences of FCRH1 BINDING SITE, designated SEQ ID:27496, to the nucleotide sequence of VGAM201 RNA, herein designated VGAM RNA, also designated SEQ ID:2912.

A function of VGAM201 is therefore inhibition of FCRH1 (Accession NM_052938). Accordingly, utilities of VGAM201 include diagnosis, prevention and treatment of diseases and clinical conditions associated with FCRH1. Transient Receptor Potential Cation Channel, Subfamily M, Member 8 (TRPM8, Accession NM_024080) is another VGAM201 host target gene. TRPM8 BINDING SITE is HOST TARGET binding site found in the 3' untranslated region of mRNA encoded by TRPM8, corresponding to a HOST TARGET binding site such as BINDING SITE I, BINDING SITE II or BINDING SITE III. Table 2 illustrates the complementarity of the nucleotide sequences of TRPM8 BINDING SITE, designated SEQ ID:23512, to the nucleotide sequence of VGAM201 RNA, herein designated VGAM RNA, also designated SEQ ID:2912.

Another function of VGAM201 is therefore inhibition of Transient Receptor Potential Cation Channel, Subfamily M, Member 8 (TRPM8, Accession NM_024080), a gene which is thought to form a receptor-activated calcium permeant cation channel. Accordingly, utilities of VGAM201 include diagnosis, prevention and treatment of diseases and clinical conditions associated with TRPM8. The function of TRPM8 has been established by previous studies. Using expression cloning of a rat trigeminal nerve cDNA library in a human embryonic kidney cell line and screening for changes in intracellular calcium on exposure to room-temperature menthol, McKemy et al. (2002) identified a cDNA encoding Cmr1 (cold-menthol receptor-1). The deduced 1,104-amino acid protein, 92% identical to human TRPM8, is also responsive to icilin, cold (with a range from 8 to 28 degrees C), and eucalyptol (the main constituent of oil of Eucalyptus) with low or no responses to menthone, camphor, cyclohexanol, or capsaicin, the agonist for VR1, which is related to the TRP family. Northern blot analysis detected transcripts of 6.0 and 4.5 kb in rat dorsal root ganglia and trigeminal neurons. In situ hybridization analysis demonstrated expression in small-diameter, but not larger-diameter, sensory neurons, similar in size to VR1-expressing cells. Cells expressing both Cmr1 and Vr1 endow cells to respond to distinct temperature thresholds, cool and hot (more than 43 degrees C), respectively. McKemy et al. (2002) suggested this coexpression may explain the paradox that noxious cold is sometimes perceived as burning pain. The authors also proposed that in other contexts, such as prostate and tumors, an endogenous menthol-like ligand may modulate the TRPM8 channel. Peier et al. (2002) showed that mouse Trpm8 is specifically expressed in a subset of pain- and temperature-sensing neurons. Cells overexpressing the Trpm8 channel could be activated by cold temperatures and by a cooling agent, menthol. The authors concluded that the identification of a cold-sensing TRP channel in a distinct subpopulation of sensory neurons implicated an expanded role for this family of ion channels in somatic sensory detection.

Full details of the abovementioned studies are described in the following publications, the disclosure of which are hereby incorporated by reference:

McKemy, D. D.; Neuhausser, W. M.; Julius, D.: Identification of a cold receptor reveals a general role for TRP channels in thermosensation. Nature 416:52-58, 2002; and Peier, A. M.; Moqrich, A.; Hergarden, A. C.; Reeve, A. J.; Andersson, D. A.; Story, G. M.; Earley, T. J.; Dragoni, I.; McIntyre, P.; Bevan, S.; Patapoutian, A.: A TRP channel that senses.

Further studies establishing the function and utilities of TRPM8 are found in John Hopkins OMIM database record ID 606678, and in sited publications numbered 5545-554 and 4909 listed in the bibliography section hereinbelow, which are also hereby incorporated by reference. LOC154222 (Accession XM_098497) is another VGAM201 host target gene. LOC154222 BINDING SITE is HOST TARGET binding site found in the 3' untranslated region of mRNA encoded by LOC154222, corresponding to a HOST TARGET binding site such as BINDING SITE I, BINDING SITE II or BINDING SITE III. Table 2 illustrates the complementarity of the nucleotide sequences of LOC154222 BINDING SITE, designated SEQ ID:41688, to the nucleotide sequence of VGAM201 RNA, herein designated VGAM RNA, also designated SEQ ID:2912.

Another function of VGAM201 is therefore inhibition of LOC154222 (Accession XM_098497). Accordingly, utilities of VGAM201 include diagnosis, prevention and treatment of diseases and clinical conditions associated with LOC154222. LOC221814 (Accession XM_168226) is another VGAM201 host target gene. LOC221814 BINDING SITE is HOST TARGET binding site found in the 3' untranslated region of mRNA encoded by LOC221814, corresponding to a HOST TARGET binding site such as BINDING SITE I, BINDING SITE II or BINDING SITE III. Table 2 illustrates the complementarity of the nucleotide sequences of LOC221814 BINDING SITE, designated SEQ ID:45089, to the nucleotide sequence of VGAM201 RNA, herein designated VGAM RNA, also designated SEQ ID:2912.

Another function of VGAM201 is therefore inhibition of LOC221814 (Accession XM_168226). Accordingly, utilities of VGAM201 include diagnosis, prevention and treatment of diseases and clinical conditions associated with LOC221814. LOC91397 (Accession XM_038219) is another VGAM201 host target gene. LOC91397 BINDING SITE is HOST TARGET binding site found in the 5' untranslated region of mRNA encoded by LOC91397, corresponding to a HOST TARGET binding site such as BINDING SITE I, BINDING SITE II or BINDING SITE III. Table 2 illustrates the complementarity of the nucleotide sequences of LOC91397 BINDING SITE, designated SEQ ID:32778, to the nucleotide sequence of VGAM201 RNA, herein designated VGAM RNA, also designated SEQ ID:2912.

Another function of VGAM201 is therefore inhibition of LOC91397 (Accession XM_038219). Accordingly, utilities of VGAM201 include diagnosis, prevention and treatment of diseases and clinical conditions associated with LOC91397. FIG. 1 further provides a conceptual description of a novel bioinformatically detected viral gene of the present invention, referred to here as Viral Genomic Address Messenger 202 (VGAM202) viral gene, which modulates expression of respective host target genes thereof, the function and utility of which host target genes is known in the art.

VGAM202 is a novel bioinformatically detected regulatory, non protein coding, viral micro RNA (miRNA) gene. The method by which VGAM202 was detected is described hereinabove with reference to FIGS. 1-8.

VGAM202 gene, herein designated VGAM GENE, is a viral gene contained in the genome of Shrimp White Spot Syndrome Virus (white spot bacilliform virus). VGAM202 host target gene, herein designated VGAM HOST TARGET GENE, is a human gene contained in the human genome.

VGAM202 gene encodes a VGAM202 precursor RNA, herein designated VGAM PRECURSOR RNA. Similar to other miRNA genes, and unlike most ordinary genes, VGAM202 precursor RNA does not encode a protein. A nucleotide sequence identical or highly similar to the nucleotide sequence of VGAM202 precursor RNA is designated SEQ ID:188, and is provided hereinbelow with reference to the sequence listing part. Nucleotide sequence SEQ ID:188 is located at position 276590 relative to the genome of Shrimp White Spot Syndrome Virus (white spot bacilliform virus).

VGAM202 precursor RNA folds onto itself, forming VGAM202 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM202 folded precursor RNA into VGAM202 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM202 RNA is designated SEQ ID:2913, and is provided hereinbelow with reference to the sequence listing part.

VGAM202 host target gene, herein designated VGAM HOST TARGET GENE, encodes a corresponding messenger RNA, VGAM202 host target RNA, herein designated VGAM HOST TARGET RNA. VGAM202 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM202 RNA, herein designated VGAM RNA, binds complementarily to one or more host target binding sites located in untranslated regions of VGAM202 host target RNA, herein designated VGAM HOST TARGET RNA. This complementary binding is due to the fact that the nucleotide sequence of VGAM202 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM202 RNA, herein designated VGAM RNA, may have a different number of host target binding sites in untranslated regions of a VGAM202 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM202 RNA, herein designated VGAM RNA, to host target binding sites on VGAM202 host target RNA, herein designated VGAM HOST TARGET RNA, such as BINDING SITE I, BINDING SITE II and BINDING SITE III, inhibits translation of VGAM202 host target RNA into VGAM202 host target protein, herein designated VGAM HOST TARGET PROTEIN. VGAM host target protein is therefore outlined by a broken line.

It is appreciated that VGAM202 host target gene, herein designated VGAM HOST TARGET GENE, in fact represents a plurality of VGAM202 host target genes. The mRNA of each one of this plurality of VGAM202 host target genes comprises one or more host target binding sites, each having a nucleotide sequence which is at least partly complementary to VGAM202 RNA, herein designated VGAM RNA, and which when bound by VGAM202 RNA causes inhibition of translation of respective one or more VGAM202 host target proteins.

It is further appreciated by one skilled in the art that the mode of translational inhibition illustrated by FIG. 1 with specific reference to translational inhibition exerted by VGAM202 gene, herein designated VGAM GENE, on one or more VGAM202 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM202 is inhibition of expression of host target genes, as part of a novel viral mechanism of attacking a host. Accordingly, utilities of VGAM202 include diagnosis, prevention and treatment of viral infection by Shrimp White Spot Syndrome Virus (white spot bacilliform virus). Specific functions, and accordingly utilities, of VGAM202 correlate with, and may be deduced from, the identity of the host target genes which VGAM202 binds and inhibits, and the function of these host target genes, as elaborated hereinbelow.

Nucleotide sequences of the VGAM202 precursor RNA, herein designated VGAM PRECURSOR RNA, and of the 'diced' VGAM202 RNA, herein designated VGAM RNA, and a schematic representation of the secondary folding of VGAM202 folded precursor RNA, herein designated VGAM FOLDED PRECURSOR RNA, of VGAM202 are further described hereinbelow with reference to Table 1.

Nucleotide sequences of host target binding sites, such as BINDING SITE-I, BINDING SITE-II and BINDING SITE-III of FIG. 1, found on VGAM202 host target RNA, and schematic representation of the complementarity of each of these host target binding sites to VGAM202 RNA, herein designated VGAM RNA, are described hereinbelow with reference to Table 2.

As mentioned hereinabove with reference to FIG. 1, a function of VGAM202 gene, herein designated VGAM is inhibition of expression of VGAM202 target genes. It is appreciated that specific functions, and accordingly utilities, of VGAM202 correlate with, and may be deduced from, the identity of the target genes which VGAM202 binds and inhibits, and the function of these target genes, as elaborated hereinbelow.

Rho GTPase Activating Protein 5 (ARHGAP5, Accession XM_085082) is a VGAM202 host target gene. ARHGAP5 BINDING SITE is HOST TARGET binding site found in the 3' untranslated region of mRNA encoded by ARHGAP5, corresponding to a HOST TARGET binding site such as BINDING SITE I, BINDING SITE II or BINDING SITE III. Table 2 illustrates the complementarity of the nucleotide sequences of ARHGAP5 BINDING SITE, designated SEQ ID:37815, to the nucleotide sequence of VGAM202 RNA, herein designated VGAM RNA, also designated SEQ ID:2913.

A function of VGAM202 is therefore inhibition of Rho GTPase Activating Protein 5 (ARHGAP5, Accession XM_085082). Accordingly, utilities of VGAM202 include diagnosis, prevention and treatment of diseases and clinical conditions associated with ARHGAP5. PRP8 Pre-mRNA Processing Factor 8 Homolog (yeast) (PRPF8, Accession XM_028335) is another VGAM202 host target gene. PRPF8 BINDING SITE is HOST TARGET binding site found in the 3' untranslated region of mRNA encoded by PRPF8, corresponding to a HOST TARGET binding site such as BINDING SITE I, BINDING SITE II or BINDING SITE III. Table 2 illustrates the complementarity of the nucleotide sequences of PRPF8 BINDING SITE, designated SEQ ID:30675, to the nucleotide sequence of VGAM202 RNA, herein designated VGAM RNA, also designated SEQ ID:2913.

Another function of VGAM202 is therefore inhibition of PRP8 Pre-mRNA Processing Factor 8 Homolog (yeast) (PRPF8, Accession XM_028335). Accordingly, utilities of VGAM202 include diagnosis, prevention and treatment of diseases and clinical conditions associated with PRPF8. FIG. 1 further provides a conceptual description of a novel bioinformatically detected viral gene of the present invention, referred to here as Viral Genomic Address Messenger 203 (VGAM203) viral gene, which modulates expression of respective host target genes thereof, the function and utility of which host target genes is known in the art.

VGAM203 is a novel bioinformatically detected regulatory, non protein coding, viral micro RNA (miRNA) gene. The method by which VGAM203 was detected is described hereinabove with reference to FIGS. 1-8.

VGAM203 gene, herein designated VGAM GENE, is a viral gene contained in the genome of Shrimp White Spot Syndrome Virus (white spot bacilliform virus). VGAM203 host target gene, herein designated VGAM HOST TARGET GENE, is a human gene contained in the human genome.

VGAM203 gene encodes a VGAM203 precursor RNA, herein designated VGAM PRECURSOR RNA. Similar to other miRNA genes, and unlike most ordinary genes, VGAM203 precursor RNA does not encode a protein. A nucleotide sequence identical or highly similar to the nucleotide sequence of VGAM203 precursor RNA is designated SEQ ID:189, and is provided hereinbelow with reference to the sequence listing part. Nucleotide sequence SEQ ID:189 is located at position 64186 relative to the genome of Shrimp White Spot Syndrome Virus (white spot bacilliform virus).

VGAM203 precursor RNA folds onto itself, forming VGAM203 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM203 folded precursor RNA into VGAM203 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM203 RNA is designated SEQ ID:2914, and is provided hereinbelow with reference to the sequence listing part.

VGAM203 host target gene, herein designated VGAM HOST TARGET GENE, encodes a corresponding messenger RNA, VGAM203 host target RNA, herein designated VGAM HOST TARGET RNA. VGAM203 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM203 RNA, herein designated VGAM RNA, binds complementarily to one or more host target binding sites located in untranslated regions of VGAM203 host target RNA, herein designated VGAM HOST TARGET RNA. This complementary binding is due to the fact that the nucleotide sequence of VGAM203 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM203 RNA, herein designated VGAM RNA, may have a different number of host target binding sites in untranslated regions of a VGAM203 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM203 RNA, herein designated VGAM RNA, to host target binding sites on VGAM203 host target RNA, herein designated VGAM HOST TARGET RNA, such as BINDING SITE I, BINDING SITE II and BINDING SITE III, inhibits translation of VGAM203 host target RNA into VGAM203 host target protein, herein designated VGAM HOST TARGET PROTEIN. VGAM host target protein is therefore outlined by a broken line.

It is appreciated that VGAM203 host target gene, herein designated VGAM HOST TARGET GENE, in fact represents a plurality of VGAM203 host target genes. The mRNA of each one of this plurality of VGAM203 host target genes comprises one or more host target binding sites, each having a nucleotide sequence which is at least partly complementary to VGAM203 RNA, herein designated VGAM RNA, and which when bound by VGAM203 RNA causes inhibition of translation of respective one or more VGAM203 host target proteins.

It is further appreciated by one skilled in the art that the mode of translational inhibition illustrated by FIG. 1 with specific reference to translational inhibition exerted by VGAM203 gene, herein designated VGAM GENE, on one or more VGAM203 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM203 is inhibition of expression of host target genes, as part of a novel viral mechanism of attacking a host. Accordingly, utilities of VGAM203 include diagnosis, prevention and treatment of viral infection by Shrimp White Spot Syndrome Virus (white spot bacilliform virus). Specific functions, and accordingly utilities, of VGAM203 correlate with, and may be deduced from, the identity of the host target genes which VGAM203 binds and inhibits, and the function of these host target genes, as elaborated hereinbelow.

Nucleotide sequences of the VGAM203 precursor RNA, herein designated VGAM PRECURSOR RNA, and of the 'diced' VGAM203 RNA, herein designated VGAM RNA, and a schematic representation of the secondary folding of VGAM203 folded precursor RNA, herein designated VGAM FOLDED PRECURSOR RNA, of VGAM203 are further described hereinbelow with reference to Table 1.

Nucleotide sequences of host target binding sites, such as BINDING SITE-I, BINDING SITE-II and BINDING SITE-III of FIG. 1, found on VGAM203 host target RNA, and schematic representation of the complementarity of each of these host target binding sites to VGAM203 RNA, herein designated VGAM RNA, are described hereinbelow with reference to Table 2.

As mentioned hereinabove with reference to FIG. 1, a function of VGAM203 gene, herein designated VGAM is inhibition of expression of VGAM203 target genes. It is appreciated that specific functions, and accordingly utilities, of VGAM203 correlate with, and may be deduced from, the identity of the target genes which VGAM203 binds and inhibits, and the function of these target genes, as elaborated hereinbelow.

Calcium Channel, Voltage-dependent, Alpha 2/delta Subunit 2 (CACNA2D2, Accession NM_006030) is a VGAM203 host target gene. CACNA2D2 BINDING SITE is HOST TARGET binding site found in the 3' untranslated region of mRNA encoded by CACNA2D2, corresponding to a HOST TARGET binding site such as BINDING SITE I, BINDING SITE II or BINDING SITE III. Table 2 illustrates the complementarity of the nucleotide sequences of CACNA2D2 BINDING SITE, designated SEQ ID:12646, to the nucleotide sequence of VGAM203 RNA, herein designated VGAM RNA, also designated SEQ ID:2914.

A function of VGAM203 is therefore inhibition of Calcium Channel, Voltage-dependent, Alpha 2/delta Subunit 2 (CACNA2D2, Accession NM_006030), a gene which is a calcium channel protein which plays an important role in excitation-contraction coupling. Accordingly, utilities of VGAM203 include diagnosis, prevention and treatment of diseases and clinical conditions associated with CACNA2D2. The function of CACNA2D2 has been established by previous studies. By physical cloning methodologies and bioinformatic computational analyses, Lerman and Minna (2000) identified a number of genes, including CACNA2D2, in a region of chromosome 3p21.3 that is associated with a putative lung cancer tumor suppressor gene. They did not detect CACNA2D2 mutations in any lung cancer cell lines tested. Animal model experiments lend further support to the function of CACNA2D2. Brodbeck et al. (2002) showed that mice with the 'ducky' (du) mutation, a model for absence epilepsy (see OMIM Ref. No. 600131), had a mutation in Cacna2d2 gene. The mutation resulted in the introduction of a premature stop codon and the expression of a truncated protein encoded by the first 3 exons of Cacna2d2, followed by 8 novel amino acids. The shortened mRNA and protein were expressed in mutant mouse cerebellum and Purkinje cells. Brodbeck et al. (2002) detected high expression of the normal protein in cerebellar Purkinje cells, but found that ducky mice had abnormalities in their Purkinje cell dendritic trees. Functional analysis indicated that the mutant Cacna2d2 protein failed to increase or even decreased the peak current density of the voltage-gated Ca (V)2.1 (CACNA1A; 601011)/beta-4 (CACNB4; 601949) channel combination, suggesting that it may contribute to the ducky phenotype.

It is appreciated that the abovementioned animal model for CACNA2D2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Brodbeck, J.; Davies, A.; Courtney, J.-M.; Meir, A.; Balaguero, N.; Canti, C.; Moss, F. J.; Page, K. M.; Pratt, W. S.; Hunt, S. P.; Barclay, J.; Rees, M.; Dolphin, A. C. : The ducky mutation in Cacna2d2 results in altered Purkinje cell morphology and is associated with the expression of a truncated alpha-2/delta-2 protein with abnormal function. J. Biol. Chem. 277:7684-7693, 2002; and Lerman, M. I.; Minna, J. D.: The 630-kb lung cancer homozygous deletion region on human chromosome 3p21.3: identification and evaluation of the resident candidate tumor suppressor gene.

Further studies establishing the function and utilities of CACNA2D2 are found in John Hopkins OMIM database record ID 607082, and in sited publications numbered 5491-5492, 10 and 6735 listed in the bibliography section hereinbelow, which are also hereby incorporated by reference. Ferredoxin 1 (FDX1, Accession XM_016467) is another VGAM203 host target gene. FDX1 BINDING SITE is HOST TARGET binding site found in the 3' untranslated region of mRNA encoded by FDX1, corresponding to a HOST TARGET binding site such as BINDING SITE I, BINDING SITE II or BINDING SITE III. Table 2 illustrates the complementarity of the nucleotide sequences of FDX1 BINDING SITE, designated SEQ ID:30259, to the nucleotide sequence of VGAM203 RNA, herein designated VGAM RNA, also designated SEQ ID:2914.

Another function of VGAM203 is therefore inhibition of Ferredoxin 1 (FDX1, Accession XM_016467), a gene which tcytochromes P450 involved in steroid, vitamin D, and bile acid metabolism. Accordingly, utilities of VGAM203 include diagnosis, prevention and treatment of diseases and clinical conditions associated with FDX1. The function of FDX1 has been established by previous studies. Ferredoxin is a small, acidic, iron-sulfur protein that functions as an electron transport intermediate for mitochondrial cytochromes P450 involved in steroid, vitamin D, and bile acid metabolism. Electrons are transferred from NADPH through a flavin-containing protein (ferredoxin oxidoreductase) and ferredoxin to the terminal cytochrome P450 for oxidation/reduction reactions. Mitochondrial P450s and their ferredoxin are found mainly in the steroidogenic tissues, including adrenal, ovary, testis, and placenta (Jefcoate et al., 1986). Small amounts of them are also found in the liver and kidney for bile acid and vitamin D synthesis. Because of its relative abundance, the adrenal ferredoxin, designated adrenodoxin, has been characterized in the most detail. It is synthesized as a precursor in which 60 amino acids of the signal peptide are later cleaved upon transport into the mitochondrial inner matrix to form a mature protein of 124 amino acids (Okamura et al., 1985). In almost all human tissues, Morel et al. (1987, 1988) found ADX mRNA in 3 sizes:1.1, 1.4, and 1.65 kb. Cloning and sequencing of 3 ADX cDNAs showed that the mRNAs of various sizes resulted from alternate polyadenylation sites yielding 3-prime untranslated regions of 229, 530, and 790 bp, respectively. The 540-bp coding region and the 5-prime untranslated region were identical in all cases. By means of Southern blot analysis of DNA from somatic cell hybrids using stringent conditions of hybridization, 2 chromosomal sites were identified for the ADX gene: chromosomes 11 and 20. One sequence was suspected to represent a processed, intronless pseudogene. Because of the restriction pattern, Morel et al. (1987) suggested that the sequence on chromosome 20 is a pseudogene. Chang et al. (1988) found that the ADX gene spans more than 20 kb and contains 4 exons and 3 introns. The first exon encodes the 60-amino acid signal peptide, which directs transport of the protein into the inner mitochondrial matrix. The mature peptide of 124 amino acids is encoded by the other 3 exons. The third exon encodes the portion of the protein containing the ion-sulfur center and a domain that binds other components of the electron transport chain. By analysis of somatic cell hybrids, Morel et al. (1988) and Chang et al. (1990) assigned the ADX gene to 11q13-qter. Chang et al. (1990) identified pseudogenes on both chromosome 20 and chromosome 21. The pseudogenes lacked introns and contained numerous mutations, including an insertion, deletion, and substitution, which rendered them inactive. They concluded that there are 2 expressed genes, but only 1 gene product and that both expressed genes are located on chromosome 11. Human adrenodoxin and placental ferredoxin cDNAs share an identical sequence, suggesting that they are the same (Mittal et al., 1988). Chashchin et al. (1986) found that adrenodoxin is identical in sequence to liver ferredoxin (hepatoredoxin). Renal ferredoxin (renodoxin) has similar optic, renal, and immunochemical properties to adrenodoxin, although Maruya et al. (1983) suggested that the 2 have minor differences. Because they identified only 1 protein sequence, Chang et al. (1990) suggested that there is no need to designate ferredoxin according to the tissue origin. By in situ hybridization, Sparkes et al. (1991) refined the assignment of ADX to 11q22 and demonstrated pseudogenes on 20q11-q12.

Full details of the abovementioned studies are described in the following publications, the disclosure of which are hereby incorporated by reference:

Chang, C.-Y.; Wu, D.-A.; Lai, C.-C.; Miller, W. L.; Chung, B.-C.: Cloning and structure of the human adrenodoxin gene. DNA 7:609-615, 1988; and Sparkes, R. S.; Klisak, I.; Miller, W. L.: Regional mapping of genes encoding human steroidogenic enzymes: P450scc to 15q23-q24; adrenodoxin to 11q22; adrenodoxin reductase to 17q24-q2.

Further studies establishing the function and utilities of FDX1 are found in John Hopkins OMIM database record ID 103260, and in sited publications numbered 4101-410 and 4289-4297 listed in the bibliography section hereinbelow, which are also hereby incorporated by reference. BCL2-associated Athanogene 3 (BAG3, Accession NM_004281) is another VGAM203 host target gene. BAG3 BINDING SITE is HOST TARGET binding site found in the 5' untranslated region of mRNA encoded by BAG3, corresponding to a HOST TARGET binding site such as BINDING SITE I, BINDING SITE II or BINDING SITE III. Table 2 illustrates the complementarity of the nucleotide sequences of BAG3 BINDING SITE, designated SEQ ID:10493, to the nucleotide sequence of VGAM203 RNA, herein designated VGAM RNA, also designated SEQ ID:2914.

Another function of VGAM203 is therefore inhibition of BCL2-associated Athanogene 3 (BAG3, Accession NM_004281). Accordingly, utilities of VGAM203 include diagnosis, prevention and treatment of diseases and clinical conditions associated with BAG3. FLJ21369 (Accession NM_024802) is another VGAM203 host target gene. FLJ21369 BINDING SITE is HOST TARGET binding site found in the 3' untranslated region of mRNA encoded by FLJ21369, corresponding to a HOST TARGET binding site such as BINDING SITE I, BINDING SITE II or BINDING SITE III. Table 2 illustrates the complementarity of the nucleotide sequences of FLJ21369 BINDING SITE, designated SEQ ID:24183, to the nucleotide sequence of VGAM203 RNA, herein designated VGAM RNA, also designated SEQ ID:2914.

Another function of VGAM203 is therefore inhibition of FLJ21369 (Accession NM_024802). Accordingly, utilities of VGAM203 include diagnosis, prevention and treatment of diseases and clinical conditions associated with FLJ21369. MGC19556 (Accession NM_033551) is another VGAM203 host target gene. MGC19556 BINDING SITE is HOST TARGET binding site found in the 3' untranslated region of mRNA encoded by MGC19556, corresponding to a HOST TARGET binding site such as BINDING SITE I, BINDING SITE II or BINDING SITE III. Table 2 illustrates the complementarity of the nucleotide sequences of MGC19556 BINDING SITE, designated SEQ ID:27311, to the nucleotide sequence of VGAM203 RNA, herein designated VGAM RNA, also designated SEQ ID:2914.

Another function of VGAM203 is therefore inhibition of MGC19556 (Accession NM_033551). Accordingly, utilities of VGAM203 include diagnosis, prevention and treatment of diseases and clinical conditions associated with MGC19556. LOC90632 (Accession XM_033067) is another VGAM203 host target gene. LOC90632 BINDING SITE is HOST TARGET binding site found in the 3' untranslated region of mRNA encoded by LOC90632, corresponding to a HOST TARGET binding site such as BINDING SITE I, BINDING SITE II or BINDING SITE III. Table 2 illustrates the complementarity of the nucleotide sequences of LOC90632 BINDING SITE, designated SEQ ID:31828, to the nucleotide sequence of VGAM203 RNA, herein designated VGAM RNA, also designated SEQ ID:2914.

Another function of VGAM203 is therefore inhibition of LOC90632 (Accession XM_033067). Accordingly, utilities of VGAM203 include diagnosis, prevention and treatment of diseases and clinical conditions associated with LOC90632. FIG. 1 further provides a conceptual description of a novel bioinformatically detected viral gene of the present invention, referred to here as Viral Genomic Address Messenger 204 (VGAM204) viral gene, which modulates expression of respective host target genes thereof, the function and utility of which host target genes is known in the art.

VGAM204 is a novel bioinformatically detected regulatory, non protein coding, viral micro RNA (miRNA) gene. The method by which VGAM204 was detected is described hereinabove with reference to FIGS. 1-8.

VGAM204 gene, herein designated VGAM GENE, is a viral gene contained in the genome of Shrimp White Spot Syndrome Virus (white spot bacilliform virus). VGAM204 host target gene, herein designated VGAM HOST TARGET GENE, is a human gene contained in the human genome.

VGAM204 gene encodes a VGAM204 precursor RNA, herein designated VGAM PRECURSOR RNA. Similar to other miRNA genes, and unlike most ordinary genes, VGAM204 precursor RNA does not encode a protein. A nucleotide sequence identical or highly similar to the nucleotide sequence of VGAM204 precursor RNA is designated SEQ ID:190, and is provided hereinbelow with reference to the sequence listing part. Nucleotide sequence SEQ ID:190 is located at position 271598 relative to the genome of Shrimp White Spot Syndrome Virus (white spot bacilliform virus).

VGAM204 precursor RNA folds onto itself, forming VGAM204 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM204 folded precursor RNA into VGAM204 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM204 RNA is designated SEQ ID:2915, and is provided hereinbelow with reference to the sequence listing part.

VGAM204 host target gene, herein designated VGAM HOST TARGET GENE, encodes a corresponding messenger RNA, VGAM204 host target RNA, herein designated VGAM HOST TARGET RNA. VGAM204 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM204 RNA, herein designated VGAM RNA, binds complementarily to one or more host target binding sites located in untranslated regions of VGAM204 host target RNA, herein designated VGAM HOST TARGET RNA. This complementary binding is due to the fact that the nucleotide sequence of VGAM204 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM204 RNA, herein designated VGAM RNA, may have a different number of host target binding sites in untranslated regions of a VGAM204 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM204 RNA, herein designated VGAM RNA, to host target binding sites on VGAM204 host target RNA, herein designated VGAM HOST TARGET RNA, such as BINDING SITE I, BINDING SITE II and BINDING SITE III, inhibits translation of VGAM204 host target RNA into VGAM204 host target protein, herein designated VGAM HOST TARGET PROTEIN. VGAM host target protein is therefore outlined by a broken line.

It is appreciated that VGAM204 host target gene, herein designated VGAM HOST TARGET GENE, in fact represents a plurality of VGAM204 host target genes. The mRNA of each one of this plurality of VGAM204 host target genes comprises one or more host target binding sites, each having a nucleotide sequence which is at least partly complementary to VGAM204 RNA, herein designated VGAM RNA, and which when bound by VGAM204 RNA causes inhibition of translation of respective one or more VGAM204 host target proteins.

It is further appreciated by one skilled in the art that the mode of translational inhibition illustrated by FIG. 1 with specific reference to translational inhibition exerted by VGAM204 gene, herein designated VGAM GENE, on one or more VGAM204 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM204 is inhibition of expression of host target genes, as part of a novel viral mechanism of attacking a host. Accordingly, utilities of VGAM204 include diagnosis, prevention and treatment of viral infection by Shrimp White Spot Syndrome Virus (white spot bacilliform virus). Specific functions, and accordingly utilities, of VGAM204 correlate with, and may be deduced from, the identity of the host target genes which VGAM204 binds and inhibits, and the function of these host target genes, as elaborated hereinbelow.

Nucleotide sequences of the VGAM204 precursor RNA, herein designated VGAM PRECURSOR RNA, and of the 'diced' VGAM204 RNA, herein designated VGAM RNA, and a schematic representation of the secondary folding of VGAM204 folded precursor RNA, herein designated VGAM FOLDED PRECURSOR RNA, of VGAM204 are further described hereinbelow with reference to Table 1.

Nucleotide sequences of host target binding sites, such as BINDING SITE-I, BINDING SITE-II and BINDING SITE-III of FIG. 1, found on VGAM204 host target RNA, and schematic representation of the complementarity of each of these host target binding sites to VGAM204 RNA, herein designated VGAM RNA, are described hereinbelow with reference to Table 2.

As mentioned hereinabove with reference to FIG. 1, a function of VGAM204 gene, herein designated VGAM is inhibition of expression of VGAM204 target genes. It is appreciated that specific functions, and accordingly utilities, of VGAM204 correlate with, and may be deduced from, the identity of the target genes which VGAM204 binds and inhibits, and the function of these target genes, as elaborated hereinbelow.

Interleukin 1 Receptor Accessory Protein-like 1 (IL1RAPL1, Accession NM_014271) is a VGAM204 host target gene. IL1RAPL1 BINDING SITE is HOST TARGET binding site found in the 5' untranslated region of mRNA encoded by IL1RAPL1, corresponding to a HOST TARGET binding site such as BINDING SITE I, BINDING SITE II or BINDING SITE III. Table 2 illustrates the complementarity of the nucleotide sequences of IL1RAPL1 BINDING SITE, designated SEQ ID:15554, to the nucleotide sequence of VGAM204 RNA, herein designated VGAM RNA, also designated SEQ ID:2915.

A function of VGAM204 is therefore inhibition of Interleukin 1 Receptor Accessory Protein-like 1 (IL1RAPL1, Accession NM_014271). Accordingly, utilities of VGAM204 include diagnosis, prevention and treatment of diseases and clinical conditions associated with IL1RAPL1. LOC197322 (Accession XM_117012) is another VGAM204 host target gene. LOC197322 BINDING SITE is HOST TARGET binding site found in the 5' untranslated region of mRNA encoded by LOC197322, corresponding to a HOST TARGET binding site such as BINDING SITE I, BINDING SITE II or BINDING SITE III. Table 2 illustrates the complementarity of the nucleotide sequences of LOC197322 BINDING SITE, designated SEQ ID:43204, to the nucleotide sequence of VGAM204 RNA, herein designated VGAM RNA, also designated SEQ ID:2915.

Another function of VGAM204 is therefore inhibition of LOC197322 (Accession XM_117012). Accordingly, utilities of VGAM204 include diagnosis, prevention and treatment of diseases and clinical conditions associated with LOC197322. LOC51313 (Accession NM_016613) is another VGAM204 host target gene. LOC51313 BINDING SITE is HOST TARGET binding site found in the 3' untranslated region of mRNA encoded by LOC51313, corresponding to a HOST TARGET binding site such as BINDING SITE I, BINDING SITE II or BINDING SITE III. Table 2 illustrates the complementarity of the nucleotide sequences of LOC51313 BINDING SITE, designated SEQ ID:18722, to the nucleotide sequence of VGAM204 RNA, herein designated VGAM RNA, also designated SEQ ID:2915.

Another function of VGAM204 is therefore inhibition of LOC51313 (Accession NM_016613). Accordingly, utilities of VGAM204 include diagnosis, prevention and treatment of diseases and clinical conditions associated with LOC51313. FIG. 1 further provides a conceptual description of a novel bioinformatically detected viral gene of the present invention, referred to here as Viral Genomic Address Messenger 205 (VGAM205) viral gene, which modulates expression of respective host target genes thereof, the function and utility of which host target genes is known in the art.

VGAM205 is a novel bioinformatically detected regulatory, non protein coding, viral micro RNA (miRNA) gene.

The method by which VGAM205 was detected is described hereinabove with reference to FIGS. 1-8.

VGAM205 gene, herein designated VGAM GENE, is a viral gene contained in the genome of Shrimp White Spot Syndrome Virus (white spot bacilliform virus). VGAM205 host target gene, herein designated VGAM HOST TARGET GENE, is a human gene contained in the human genome.

VGAM205 gene encodes a VGAM205 precursor RNA, herein designated VGAM PRECURSOR RNA. Similar to other miRNA genes, and unlike most ordinary genes, VGAM205 precursor RNA does not encode a protein. A nucleotide sequence identical or highly similar to the nucleotide sequence of VGAM205 precursor RNA is designated SEQ ID:191, and is provided hereinbelow with reference to the sequence listing part. Nucleotide sequence SEQ ID:191 is located at position 53165 relative to the genome of Shrimp White Spot Syndrome Virus (white spot bacilliform virus).

VGAM205 precursor RNA folds onto itself, forming VGAM205 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM205 folded precursor RNA into VGAM205 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM205 RNA is designated SEQ ID:2916, and is provided hereinbelow with reference to the sequence listing part.

VGAM205 host target gene, herein designated VGAM HOST TARGET GENE, encodes a corresponding messenger RNA, VGAM205 host target RNA, herein designated VGAM HOST TARGET RNA. VGAM205 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM205 RNA, herein designated VGAM RNA, binds complementarily to one or more host target binding sites located in untranslated regions of VGAM205 host target RNA, herein designated VGAM HOST TARGET RNA. This complementary binding is due to the fact that the nucleotide sequence of VGAM205 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM205 RNA, herein designated VGAM RNA, may have a different number of host target binding sites in untranslated regions of a VGAM205 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM205 RNA, herein designated VGAM RNA, to host target binding sites on VGAM205 host target RNA, herein designated VGAM HOST TARGET RNA, such as BINDING SITE I, BINDING SITE II and BINDING SITE III, inhibits translation of VGAM205 host target RNA into VGAM205 host target protein, herein designated VGAM HOST TARGET PROTEIN. VGAM host target protein is therefore outlined by a broken line.

It is appreciated that VGAM205 host target gene, herein designated VGAM HOST TARGET GENE, in fact represents a plurality of VGAM205 host target genes. The mRNA of each one of this plurality of VGAM205 host target genes comprises one or more host target binding sites, each having a nucleotide sequence which is at least partly complementary to VGAM205 RNA, herein designated VGAM RNA, and which when bound by VGAM205 RNA causes inhibition of translation of respective one or more VGAM205 host target proteins.

It is further appreciated by one skilled in the art that the mode of translational inhibition illustrated by FIG. 1 with specific reference to translational inhibition exerted by VGAM205 gene, herein designated VGAM GENE, on one or more VGAM205 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM205 is inhibition of expression of host target genes, as part of a novel viral mechanism of attacking a host. Accordingly, utilities of VGAM205 include diagnosis, prevention and treatment of viral infection by Shrimp White Spot Syndrome Virus (white spot bacilliform virus). Specific functions, and accordingly utilities, of VGAM205 correlate with, and may be deduced from, the identity of the host target genes which VGAM205 binds and inhibits, and the function of these host target genes, as elaborated hereinbelow.

Nucleotide sequences of the VGAM205 precursor RNA, herein designated VGAM PRECURSOR RNA, and of the 'diced' VGAM205 RNA, herein designated VGAM RNA, and a schematic representation of the secondary folding of VGAM205 folded precursor RNA, herein designated VGAM FOLDED PRECURSOR RNA, of VGAM205 are further described hereinbelow with reference to Table 1.

Nucleotide sequences of host target binding sites, such as BINDING SITE-I, BINDING SITE-II and BINDING SITE-III of FIG. 1, found on VGAM205 host target RNA, and schematic representation of the complementarity of each of these host target binding sites to VGAM205 RNA, herein designated VGAM RNA, are described hereinbelow with reference to Table 2.

As mentioned hereinabove with reference to FIG. 1, a function of VGAM205 gene, herein designated VGAM is inhibition of expression of VGAM205 target genes. It is appreciated that specific functions, and accordingly utilities, of VGAM205 correlate with, and may be deduced from, the identity of the target genes which VGAM205 binds and inhibits, and the function of these target genes, as elaborated hereinbelow.

Like-glycosyltransferase (LARGE, Accession NM_004737) is a VGAM205 host target gene. LARGE BINDING SITE1 and LARGE BINDING SITE2 are HOST TARGET binding sites found in untranslated regions of mRNA encoded by LARGE, corresponding to HOST TARGET binding sites such as BINDING SITE I, BINDING SITE II or BINDING SITE III. Table 2 illustrates the complementarity of the nucleotide sequences of LARGE BINDING SITE1 and LARGE BINDING SITE2, designated SEQ ID:11128 and SEQ ID:28600 respectively, to the nucleotide sequence of VGAM205 RNA, herein designated VGAM RNA, also designated SEQ ID:2916.

A function of VGAM205 is therefore inhibition of Like-glycosyltransferase (LARGE, Accession NM_004737), a gene which is a member of the N-acetylglucosaminyltransferase family. Accordingly, utilities of VGAM205 include diagnosis, prevention and treatment of diseases and clinical conditions associated with LARGE. The function of LARGE has been established by previous studies. Peyrard et al. (1999) investigated the gene content of a segment of 22q12.3-q13.1 that had been shown to contain meningioma-related genes (OMIM Ref. No. 156100) on the basis of studies of deletions. They characterized a new member of the N-acetylglucosaminyltransferase gene family, which they designated the LARGE gene. The LARGE gene spans more than 664 kb of genomic DNA, making it the fifth largest in the human genome, after dystrophin (DMD; 300377), with 2.3 Mb; DCC (OMIM Ref. No. 120470), with 1.4 Mb; GRM8 (OMIM Ref. No. 601116), with 1 Mb; and utrophin (UTRN; 128240), with 900 kb. The LARGE gene contains 16 exons (4,326-bp cDNA) and has an exon content of less than 0.66%, which is similar to the exon content of the DMD gene (0.6%). The chromosomal segment of 22q containing the LARGE gene is apparently poor in genes. By fluorescence in situ hybridization, Peyrard et al. (1999) mapped the mouse Large gene to 8C1 in a region of conserved synteny with 22q12.3-q13.1. The expression pattern of the human and mouse LARGE orthologs is similar. Both genes are expressed ubiquitously, consistent with their function as housekeeping genes. These genes are also evolutionarily well conserved, as Peyrard et al. (1999) identified an ortholog in C. elegans encoding a polypeptide that is 33% identical with the human protein. Michele et al. (2002) demonstrated in both muscle-eye-brain disease (OMIM Ref. No. 253280) and Fukuyama congenital muscular dystrophy (FCMD; 253800) patients that alpha-dystroglycan is expressed at the muscle membrane, but similar hypoglycosylation in the diseases directly abolishes binding activity of dystroglycan for the ligands laminin (see OMIM Ref. No. 150240), neurexin (see OMIM Ref. No. 600565), and agrin (OMIM Ref. No. 103320). Michele et al. (2002) showed that this posttranslational biochemical and functional disruption of alpha-dystroglycan is recapitulated in the muscle and central nervous system of myd mice. Michele et al. (2002) demonstrated that myd mice have abnormal neuronal migration in the cerebral cortex, cerebellum, and hippocampus, and show disruption of the basal lamina. In addition, myd mice reveal that dystroglycan targets proteins to functional sites in brain through its interactions with extracellular matrix proteins. Michele et al. (2002) suggested that at least 3 mammalian genes function within a convergent posttranslational processing pathway during the biosynthesis of dystroglycan and that abnormal dystroglycan-ligand interactions underlie the pathogenic mechanism of muscular dystrophy with brain abnormalities. Animal model experiments lend further support to the function of LARGE. Michele et al. (2002) demonstrated in both muscle-eye-brain disease (OMIM Ref. No. 253280) and Fukuyama congenital muscular dystrophy (FCMD; 253800) patients that alpha-dystroglycan is expressed at the muscle membrane, but similar hypoglycosylation in the diseases directly abolishes binding activity of dystroglycan for the ligands laminin (see OMIM Ref. No. 150240), neurexin (see OMIM Ref. No. 600565), and agrin (OMIM Ref. No. 103320). Michele et al. (2002) showed that this posttranslational biochemical and functional disruption of alpha-dystroglycan is recapitulated in the muscle and central nervous system of myd mice. Michele et al. (2002) demonstrated that myd mice have abnormal neuronal migration in the cerebral cortex, cerebellum, and hippocampus, and show disruption of the basal lamina. In addition, myd mice reveal that dystroglycan targets proteins to functional sites in brain through its interactions with extracellular matrix proteins. Michele et al. (2002) suggested that at least 3 mammalian genes function within a convergent posttranslational processing pathway during the biosynthesis of dystroglycan and that abnormal dystroglycan-ligand interactions underlie the pathogenic mechanism of muscular dystrophy with brain abnormalities.

It is appreciated that the abovementioned animal model for LARGE is acknowledged by those skilled in the art as a scientifically valid animal model, as can be further appreciated from the publications sited hereinbelow.

Full details of the abovementioned studies are described in the following publications, the disclosure of which are hereby incorporated by reference:

Grewal, P. K.; Holzfeind, P. J.; Bittner, R. E.; Hewitt, J. E.: Mutant glycosyltransferase and altered glycosylation of alpha-dystroglycan in the myodystrophy mouse. Nature Genet. 28:151-154, 2001; and Michele, D. E.; Barresi, R.; Kanagawa, M.; Saito, F.; Cohn, R. D.; Satz, J. S.; Dollar, J.; Nishino, I.; Kelley, R. I.; Somer, H.; Straub, V.; Mathews, K. D.; Moore, S. A.; Campbell, K.

Further studies establishing the function and utilities of LARGE are found in John Hopkins OMIM database record ID 603590, and in sited publications numbered 1271 and 5843 listed in the bibliography section hereinbelow, which are also hereby incorporated by reference. KIAA0895 (Accession XM_166573) is another VGAM205 host target gene. KIAA0895 BINDING SITE is HOST TARGET binding site found in the 3' untranslated region of mRNA encoded by KIAA0895, corresponding to a HOST TARGET binding site such as BINDING SITE I, BINDING SITE II or BINDING SITE III. Table 2 illustrates the complementarity of the nucleotide sequences of KIAA0895 BINDING SITE, designated SEQ ID:44545, to the nucleotide sequence of VGAM205 RNA, herein designated VGAM RNA, also designated SEQ ID:2916.

Another function of VGAM205 is therefore inhibition of KIAA0895 (Accession XM_166573). Accordingly, utilities of VGAM205 include diagnosis, prevention and treatment of diseases and clinical conditions associated with KIAA0895. MGC13102 (Accession NM_032323) is another VGAM205 host target gene. MGC13102 BINDING SITE is HOST TARGET binding site found in the 3' untranslated region of mRNA encoded by MGC13102, corresponding to a HOST TARGET binding site such as BINDING SITE I, BINDING SITE II or BINDING SITE III. Table 2 illustrates the complementarity of the nucleotide sequences of MGC13102 BINDING SITE, designated SEQ ID:26133, to the nucleotide sequence of VGAM205 RNA, herein designated VGAM RNA, also designated SEQ ID:2916.

Another function of VGAM205 is therefore inhibition of MGC13102 (Accession NM_032323). Accordingly, utilities of VGAM205 include diagnosis, prevention and treatment of diseases and clinical conditions associated with MGC13102. SCDGF-B (Accession NM_033135) is another VGAM205 host target gene. SCDGF-B BINDING SITE1 and SCDGF-B BINDING SITE2 are HOST TARGET binding sites found in untranslated regions of mRNA encoded by SCDGF-B, corresponding to HOST TARGET binding sites such as BINDING SITE I, BINDING SITE II or BINDING SITE III. Table 2 illustrates the complementarity of the nucleotide sequences of SCDGF-B BINDING SITE1 and SCDGF-B BINDING SITE2, designated SEQ ID:26981 and SEQ ID:24879 respectively, to the nucleotide sequence of VGAM205 RNA, herein designated VGAM RNA, also designated SEQ ID:2916.

Another function of VGAM205 is therefore inhibition of SCDGF-B (Accession NM_033135). Accordingly, utilities of VGAM205 include diagnosis, prevention and treatment of diseases and clinical conditions associated with SCDGF-B. FIG. 1 further provides a conceptual description of a novel bioinformatically detected viral gene of the present invention, referred to here as Viral Genomic Address Messenger 206 (VGAM206) viral gene, which modulates expression of respective host target genes thereof, the function and utility of which host target genes is known in the art.

VGAM206 is a novel bioinformatically detected regulatory, non protein coding, viral micro RNA (miRNA) gene. The method by which VGAM206 was detected is described hereinabove with reference to FIGS. 1-8.

VGAM206 gene, herein designated VGAM GENE, is a viral gene contained in the genome of Shrimp White Spot Syndrome Virus (white spot bacilliform virus). VGAM206 host target gene, herein designated VGAM HOST TARGET GENE, is a human gene contained in the human genome.

VGAM206 gene encodes a VGAM206 precursor RNA, herein designated VGAM PRECURSOR RNA. Similar to other miRNA genes, and unlike most ordinary genes, VGAM206 precursor RNA does not encode a protein. A nucleotide sequence identical or highly similar to the nucleotide sequence of VGAM206 precursor RNA is designated SEQ ID:192, and is provided hereinbelow with reference to the sequence listing part. Nucleotide sequence SEQ ID:192 is located at position 273179 relative to the genome of Shrimp White Spot Syndrome Virus (white spot bacilliform virus).

VGAM206 precursor RNA folds onto itself, forming VGAM206 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM206 folded precursor RNA into VGAM206 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM206 RNA is designated SEQ ID:2917, and is provided hereinbelow with reference to the sequence listing part.

VGAM206 host target gene, herein designated VGAM HOST TARGET GENE, encodes a corresponding messenger RNA, VGAM206 host target RNA, herein designated VGAM HOST TARGET RNA. VGAM206 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM206 RNA, herein designated VGAM RNA, binds complementarily to one or more host target binding sites located in untranslated regions of VGAM206 host target RNA, herein designated VGAM HOST TARGET RNA. This complementary binding is due to the fact that the nucleotide sequence of VGAM206 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM206 RNA, herein designated VGAM RNA, may have a different number of host target binding sites in untranslated regions of a VGAM206 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM206 RNA, herein designated VGAM RNA, to host target binding sites on VGAM206 host target RNA, herein designated VGAM HOST TARGET RNA, such as BINDING SITE I, BINDING SITE II and BINDING SITE III, inhibits translation of VGAM206 host target RNA into VGAM206 host target protein, herein designated VGAM HOST TARGET PROTEIN. VGAM host target protein is therefore outlined by a broken line.

It is appreciated that VGAM206 host target gene, herein designated VGAM HOST TARGET GENE, in fact represents a plurality of VGAM206 host target genes. The mRNA of each one of this plurality of VGAM206 host target genes comprises one or more host target binding sites, each having a nucleotide sequence which is at least partly complementary to VGAM206 RNA, herein designated VGAM RNA, and which when bound by VGAM206 RNA causes inhibition of translation of respective one or more VGAM206 host target proteins.

It is further appreciated by one skilled in the art that the mode of translational inhibition illustrated by FIG. 1 with specific reference to translational inhibition exerted by VGAM206 gene, herein designated VGAM GENE, on one or more VGAM206 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM206 is inhibition of expression of host target genes, as part of a novel viral mechanism of attacking a host. Accordingly, utilities of VGAM206 include diagnosis, prevention and treatment of viral infection by Shrimp White Spot Syndrome Virus (white spot bacilliform virus). Specific functions, and accordingly utilities, of VGAM206 correlate with, and may be deduced from, the identity of the host target genes which VGAM206 binds and inhibits, and the function of these host target genes, as elaborated hereinbelow.

Nucleotide sequences of the VGAM206 precursor RNA, herein designated VGAM PRECURSOR RNA, and of the 'diced' VGAM206 RNA, herein designated VGAM RNA, and a schematic representation of the secondary folding of VGAM206 folded precursor RNA, herein designated VGAM FOLDED PRECURSOR RNA, of VGAM206 are further described hereinbelow with reference to Table 1.

Nucleotide sequences of host target binding sites, such as BINDING SITE-I, BINDING SITE-II and BINDING SITE-III of FIG. 1, found on VGAM206 host target RNA, and schematic representation of the complementarity of each of these host target binding sites to VGAM206 RNA, herein designated VGAM RNA, are described hereinbelow with reference to Table 2.

As mentioned hereinabove with reference to FIG. 1, a function of VGAM206 gene, herein designated VGAM is inhibition of expression of VGAM206 target genes. It is appreciated that specific functions, and accordingly utilities, of VGAM206 correlate with, and may be deduced from, the identity of the target genes which VGAM206 binds and inhibits, and the function of these target genes, as elaborated hereinbelow.

Acid Phosphatase, Testicular (ACPT, Accession NM_080789) is a VGAM206 host target gene. ACPT BINDING SITE1 and ACPT BINDING SITE2 are HOST TARGET binding sites found in untranslated regions of mRNA encoded by ACPT, corresponding to HOST TARGET binding sites such as BINDING SITE I, BINDING SITE II or BINDING SITE III. Table 2 illustrates the complementarity of the nucleotide sequences of ACPT BINDING SITE1 and ACPT BINDING SITE2, designated SEQ ID:28044 and SEQ ID:28047 respectively, to the nucleotide sequence of VGAM206 RNA, herein designated VGAM RNA, also designated SEQ ID:2917.

A function of VGAM206 is therefore inhibition of Acid Phosphatase, Testicular (ACPT, Accession NM_080789). Accordingly, utilities of VGAM206 include diagnosis, prevention and treatment of diseases and clinical conditions associated with ACPT. V-akt Murine Thymoma Viral Oncogene Homolog 1 (AKT1, Accession NM_005163) is another VGAM206 host target gene. AKT1 BINDING SITE is HOST TARGET binding site found in the 3' untranslated region of mRNA encoded by AKT1, corresponding to a HOST TARGET binding site such as BINDING SITE I, BINDING SITE II or BINDING SITE III. Table 2 illustrates the complementarity of the nucleotide sequences of AKT1 BINDING SITE, designated SEQ ID:11655, to the nucleotide sequence of VGAM206 RNA, herein designated VGAM RNA, also designated SEQ ID:2917.

Another function of VGAM206 is therefore inhibition of V-akt Murine Thymoma Viral Oncogene Homolog 1 (AKT1, Accession NM_005163), a gene which Serine-threonine protein kinase. Accordingly, utilities of VGAM206 include diagnosis, prevention and treatment of diseases and clinical conditions associated with AKT1. The function of AKT1 and its association with various diseases and clinical conditions, has been established by previous studies, as described hereinabove with reference to VGAM188. UDP-GlcNAc:betaGal Beta-1,3-N-acetylglucosaminyltransferase 3 (B3GNT3, Accession NM_014256) is another VGAM206 host target gene. B3GNT3 BINDING SITE is HOST TARGET binding site found in the 3' untranslated region of mRNA encoded by B3GNT3, corresponding to a HOST TARGET binding site such as BINDING SITE I, BINDING SITE II or BINDING SITE III. Table 2 illustrates the complementarity of the nucleotide sequences of B3GNT3 BINDING SITE, designated SEQ ID:15532, to the nucleotide sequence of VGAM206 RNA, herein designated VGAM RNA, also designated SEQ ID:2917.

Another function of VGAM206 is therefore inhibition of UDP-GlcNAc:betaGal Beta-1,3-N-acetylglucosaminyl-transferase 3 (B3GNT3, Accession NM_014256). Accordingly, utilities of VGAM206 include diagnosis, prevention and treatment of diseases and clinical conditions associated with B3GNT3. Beta-site APP-cleaving Enzyme (BACE, Accession NM_138971) is another VGAM206 host target gene. BACE BINDING SITE1 and BACE BINDING SITE2 are HOST TARGET binding sites found in untranslated regions of mRNA encoded by BACE, corresponding to HOST TARGET binding sites such as BINDING SITE I, BINDING SITE II or BINDING SITE III. Table 2 illustrates the complementarity of the nucleotide sequences of BACE BINDING SITE1 and BACE BINDING SITE2, designated SEQ ID:29088 and SEQ ID:14420 respectively, to the nucleotide sequence of VGAM206 RNA, herein designated VGAM RNA, also designated SEQ ID:2917.

Another function of VGAM206 is therefore inhibition of Beta-site APP-cleaving Enzyme (BACE, Accession NM_138971), a gene which is responsible for the proteolytic processing of the amyloid precursor protein. Accordingly, utilities of VGAM206 include diagnosis, prevention and treatment of diseases and clinical conditions associated with BACE. The function of BACE and its association with various diseases and clinical conditions, has been established by previous studies, as described hereinabove with reference to VGAM173. CD34 Antigen (CD34, Accession NM_001773) is another VGAM206 host target gene. CD34 BINDING SITE is HOST TARGET binding site found in the 3' untranslated region of mRNA encoded by CD34, corresponding to a HOST TARGET binding site such as BINDING SITE I, BINDING SITE II or BINDING SITE III. Table 2 illustrates the complementarity of the nucleotide sequences of CD34 BINDING SITE, designated SEQ ID:7536, to the nucleotide sequence of VGAM206 RNA, herein designated VGAM RNA, also designated SEQ ID:2917.

Another function of VGAM206 is therefore inhibition of CD34 Antigen (CD34, Accession NM_001773), a gene which is a monomeric cell surface antigen that is selectively expressed on human hematopoietic progenitor cells. Accordingly, utilities of VGAM206 include diagnosis, prevention and treatment of diseases and clinical conditions associated with CD34. The function of CD34 and its association with various diseases and clinical conditions, has been established by previous studies, as described hereinabove with reference to VGAM55. CD53 Antigen (CD53, Accession NM_000560) is another VGAM206 host target gene. CD53 BINDING SITE is HOST TARGET binding site found in the 3' untranslated region of mRNA encoded by CD53, corresponding to a HOST TARGET binding site such as BINDING SITE I, BINDING SITE II or BINDING SITE III. Table 2 illustrates the complementarity of the nucleotide sequences of CD53 BINDING SITE, designated SEQ ID:6170, to the nucleotide sequence of VGAM206 RNA, herein designated VGAM RNA, also designated SEQ ID:2917.

Another function of VGAM206 is therefore inhibition of CD53 Antigen (CD53, Accession NM_000560). Accordingly, utilities of VGAM206 include diagnosis, prevention and treatment of diseases and clinical conditions associated with CD53. Centromere Protein B, 80 kDa (CENPB, Accession XM_045451) is another VGAM206 host target gene. CENPB BINDING SITE is HOST TARGET binding site found in the 3' untranslated region of mRNA encoded by CENPB, corresponding to a HOST TARGET binding site such as BINDING SITE I, BINDING SITE II or BINDING SITE III. Table 2 illustrates the complementarity of the nucleotide sequences of CENPB BINDING SITE, designated SEQ ID:34464, to the nucleotide sequence of VGAM206 RNA, herein designated VGAM RNA, also designated SEQ ID:2917.

Another function of VGAM206 is therefore inhibition of Centromere Protein B, 80 kDa (CENPB, Accession XM_045451), a gene which is the major centromere antigen. Accordingly, utilities of VGAM206 include diagnosis, prevention and treatment of diseases and clinical conditions associated with CENPB. The function of CENPB has been established by previous studies. The structure and function of the centromere regions of mitotic chromosomes have been of interest to cell biologists, geneticists and rheumatologists. Cell biologists focus on the centromere as both the site of sister chromatid pairing and the site of mitotic spindle attachment. The latter site, the kinetochore, is a trilaminar plaque structure embedded in the chromatin at the surface of the chromosome, as visualized by electron microscopy. Geneticists have been interested in centromeric sequences involved in the control of chromosomal segregation. Rheumatologists became interested in centromere structure when it was observed that centromere compounds are the target of autoimmune responses. Earnshaw et al. (1987) isolated a series of overlapping DNA clones for about 95% of the mRNA that encodes the B centromeric protein. Anticentromere antibodies recognize 3 antigens: CENPA (17 kD; 117139), CENPB (80 kD), and CENPC (140 kD; 117141). CENPB is considered the major centromere antigen since antibody to it is consistently present at high titer in serum positive for anticentromere antibodies. The B protein is the product of a 2.9-kb mRNA that is encoded by a single locus. By optimizing the primer-annealing temperature in a rapid air cycling procedure, Sugimoto et al. (1993) specifically amplified human DNA sequences encoding CENPB and CENPC, without any detectable amplification of highly homologous rodent DNA sequences. Using a panel of rodent/human hybrid DNAs, the human CENPB and CENPC genes were mapped to chromosomes 20 and 12, respectively. By fluorescence in situ hybridization, Seki et al. (1994) assigned the CENPB gene to 20p13.

Full details of the abovementioned studies are described in the following publications, the disclosure of which are hereby incorporated by reference:

Earnshaw, W. C.; Sullivan, K. F.; Machlin, P. S.; Cooke, C. A.; Kaiser, D. A.; Pollard, T. D.; Rothfield, N. F.; Cleveland, D. W.: Molecular cloning of cDNA for CENP-B, the major human centromere autoantigen. J. Cell Biol. 104:817-829, 1987; and Seki, N.; Saito, T.; Kitagawa, K.; Masumoto, H.; Okazaki, T.; Hori, T.-A.: Mapping of the human centromere protein B gene (CENPB) to chromosome 20p13 by fluorescence in situ hybridizat.

Further studies establishing the function and utilities of CENPB are found in John Hopkins OMIM database record ID 117140, and in sited publications numbered 4671-4673 listed in the bibliography section hereinbelow, which are also hereby incorporated by reference. Deleted In Azoospermia (DAZ, Accession NM_004081) is another VGAM206 host target gene. DAZ BINDING SITE is HOST TARGET binding site found in the 3' untranslated region of mRNA encoded by DAZ, corresponding to a HOST TARGET binding site such as BINDING SITE I, BINDING SITE II or BINDING SITE III. Table 2 illustrates the complementarity of the nucleotide sequences of DAZ BINDING SITE, designated SEQ ID:10284, to the nucleotide sequence of VGAM206 RNA, herein designated VGAM RNA, also designated SEQ ID:2917.

Another function of VGAM206 is therefore inhibition of Deleted In Azoospermia (DAZ, Accession NM_004081), a gene which may play a role in the germ-cell-specific patterns of RNA splicing and storage. Accordingly, utilities of VGAM206 include diagnosis, prevention and treatment of diseases and clinical conditions associated with DAZ. The function of DAZ has been established by previous studies. Cooke et al. (1996) postulated that the DAZ gene product may play a role in the germ-cell-specific patterns of RNA splicing and storage. They isolated the mouse homolog of DAZ and mapped it by fluorescence in situ hybridization to chromosome 17 at position 25.6 cM. Cooke et al. (1996) reported that the predicted protein product of the mouse homolog is highly homologous to that of the human gene. By RT-PCR analysis, they established that transcripts occur only in mouse germ cells. Deletions of the azoospermia factors on the Y chromosome long arm are an important cause of male infertility, and they may involve germ cell-specific genes or ubiquitously expressed genes. Foresta et al. (2001) hypothesized that microdeletions involving genes specifically expressed in germ cells should not alter Sertoli cell function. To examine this, they evaluated the testicular hormonal function in infertile patients affected by severe testiculopathies with and without Yq microdeletions, with particular emphasis on Sertoli cell function. They studied 102 well-characterized infertile patients; 27 had Yq microdeletions, and 75 were classified as idiopathic infertiles. Patients with Yq microdeletions had lower FSH (see OMIM Ref. No. 136530) and higher inhibin B (see OMIM Ref. No. 147290) plasma concentrations compared to patients without microdeletions, suggesting that Sertoli cell function in Yq-deleted men is only partially altered. Furthermore, patients with deletions involving germ cell-specific genes had higher concentrations of inhibin B compared to patients with deletions of ubiquitously expressed genes. The authors inferred that a specific alteration of germ cells only partially influences Sertoli cell function. The hormonal status of patients without deletions suggested that in such cases the cause of the spermatogenic defect may have damaged both Sertoli and germ cells. Inhibin B production in patients with Yq deletions was about 70% higher than in nondeleted patients, and the functional relationship between FSH and inhibin B was normally preserved.

Full details of the abovementioned studies are described in the following publications, the disclosure of which are hereby incorporated by reference:

Cooke, H. J.; Lee, M.; Kerr, S.; Ruggiu, M.: A murine homologue of the human DAZ gene is autosomal and expressed only in male and female gonads. Hum. Molec. Genet. 5:513-516, 1996; and Foresta, C.; Bertella, A.; Moro, E.; Roverato, A.; Merico, M.; Ferlin, A.: Sertoli cell function in infertile patients with and without microdeletions of the azoospermia factors on th.

Further studies establishing the function and utilities of DAZ are found in John Hopkins OMIM database record ID 400003, and in sited publications numbered 8236-8238, 8234, 8239-8242, 8246-8245, 880 and 8826 listed in the bibliography section hereinbelow, which are also hereby incorporated by reference. Deleted In Azoospermia-like (DAZL, Accession XM_042839) is another VGAM206 host target gene. DAZL BINDING SITE is HOST TARGET binding site found in the 5' untranslated region of mRNA encoded by DAZL, corresponding to a HOST TARGET binding site such as BINDING SITE I, BINDING SITE II or BINDING SITE III. Table 2 illustrates the complementarity of the nucleotide sequences of DAZL BINDING SITE, designated SEQ ID:33800, to the nucleotide sequence of VGAM206 RNA, herein designated VGAM RNA, also designated SEQ ID:2917.

Another function of VGAM206 is therefore inhibition of Deleted In Azoospermia-like (DAZL, Accession XM_042839), a gene which may be essential for gametogenesis. Accordingly, utilities of VGAM206 include diagnosis, prevention and treatment of diseases and clinical conditions associated with DAZL. The function of DAZL has been established by previous studies. Yen et al. (1996) reported the isolation of a human gene homolog of the mouse Dazla gene by screening of a testis-specific library with a DAZ cDNA clone. The gene they isolated contained only 1 of 7 repeats found in DAZ, showed a high degree of homology to the mouse Dazla gene, and mapped to chromosome 3p24. RBM and DAZ/SPGY are 2 families of genes located on the Y chromosome that encode proteins containing RNA-binding motifs, and both have been described as candidate human spermatogenesis genes. Neither gene family had been shown to be essential for spermatogenesis in human males, but a Dazla homolog in Drosophila is essential for spermatogenesis (Eberhart et al., 1996). With a polyclonal antibody raised in rabbits against Dazla and with knockout technology in mice, Rugglu et al. (1997) demonstrated that the Dazla protein is cytoplasmic in male and female germ cells, unlike the nuclear RBM protein. Disruption of the Dazla gene led to loss of germ cells and complete absence of gamete production, demonstrating that Dazla is essential for the differentiation of germ cells.

Full details of the abovementioned studies are described in the following publications, the disclosure of which are hereby incorporated by reference:

Yen, P. H.; Chai, N. N.; Salido, E. C.: The human autosomal gene DAZLA: testis specificity and a candidate for male infertility. Hum. Molec. Genet. 5:2013-2017, 1996; and Rugglu, M.; Speed, R.; Taggart, M.; McKay, S. J.; Kilanowski, F.; Saunders, P.; Derin, J.; Cooke, H. J.: The mouse Dazla gene encodes a cytoplasmic protein essential for gametogenesis.

Further studies establishing the function and utilities of DAZL are found in John Hopkins OMIM database record ID 601486, and in sited publications numbered 8236-683 and 8245-6835 listed in the bibliography section hereinbelow, which are also hereby incorporated by reference. Diacylglycerol O-acyltransferase Homolog 2 (mouse) (DGAT2, Accession NM_032564) is another VGAM206 host target gene. DGAT2 BINDING SITE is HOST TARGET binding site found in the 3' untranslated region of mRNA encoded by DGAT2, corresponding to a HOST TARGET binding site such as BINDING SITE I, BINDING SITE II or BINDING SITE III. Table 2 illustrates the complementarity of the nucleotide sequences of DGAT2 BINDING SITE, designated SEQ ID:26294, to the nucleotide sequence of VGAM206 RNA, herein designated VGAM RNA, also designated SEQ ID:2917.

Another function of VGAM206 is therefore inhibition of Diacylglycerol O-acyltransferase Homolog 2 (mouse) (DGAT2, Accession NM_032564). Accordingly, utilities of VGAM206 include diagnosis, prevention and treatment of diseases and clinical conditions associated with DGAT2. Discs, Large (Drosophila) Homolog 4 (DLG4, Accession NM_001365) is another VGAM206 host target gene. DLG4 BINDING SITE is HOST TARGET binding site found in the 5' untranslated region of mRNA encoded by DLG4, corresponding to a HOST TARGET binding site such as BINDING SITE I, BINDING SITE II or BINDING SITE III. Table 2 illustrates the complementarity of the nucleotide sequences of DLG4 BINDING SITE, designated SEQ ID:7047, to the nucleotide sequence of VGAM206 RNA, herein designated VGAM RNA, also designated SEQ ID:2917.

Another function of VGAM206 is therefore inhibition of Discs, Large (Drosophila) Homolog 4 (DLG4, Accession NM_001365), a gene which is a membrane-associated guanylate kinase and may intervene in synaptogenesis. Accordingly, utilities of VGAM206 include diagnosis, prevention and treatment of diseases and clinical conditions associated with DLG4. The function of DLG4 has been established by previous studies. Neuregulins and their receptors, the ERBB protein tyrosine kinases, are essential for neuronal development, but their functions in the adult central nervous system are unknown. Huang et al. (2000) reported that ERBB4 (OMIM Ref. No. 600543) is enriched in the postsynaptic density and associates with PSD95. Heterologous expression of PSD95 enhanced NRG (OMIM Ref. No. 142445) activation of ERBB4 and MAP kinase (see OMIM Ref. No. 176948). Conversely, inhibiting expression of PSD95 in neurons attenuated NRG-mediated activation of MAP kinase. PSD95 formed a ternary complex with 2 molecules of ERBB4, suggesting that PSD95 facilitates ERBB4 dimerization. Finally, NRG suppressed induction of long-term potentiation in the hippocampal CA1 region without affecting basal synaptic transmission. Thus, NRG signaling may be synaptic and regulated by PSD95. Huang et al. (2000) concluded that a role of NRG signaling in the adult central nervous system may be modulation of synaptic plasticity. El-Husseini et al. (2002) identified palmitate cycling on PSD95 at the synapse and found that palmitate turnover on PSD95 is regulated by glutamate receptor activity. Acutely blocking palmitoylation dispersed synaptic clusters of PSD95 and caused a selective loss of synaptic AMPA receptors (e.g., GRIA1; 138248). The authors also found that rapid glutamate-mediated AMPA receptor internalization requires depalmitoylation of PSD95. In a nonneuronal model system, clustering of PSD95, stargazin (OMIM Ref. No. 602911), and AMPA receptors was also regulated by ongoing palmitoylation of PSD95 at the plasma membrane. El-Husseini et al. (2002) concluded that palmitate cycling on PSD95 can regulate synaptic strength and activity-dependent plasticity.

Full details of the abovementioned studies are described in the following publications, the disclosure of which are hereby incorporated by reference:

Huang, Y. Z.; Won, S.; Ali, D. W.; Wang, Q.; Tanowitz, M.; Du, Q. S.; Pelkey, K. A.; Yang, D. J.; Xiong, W. C.; Salter, M. W.; Mei, L.: Regulation of neuregulin signaling by PSD-95 interacting with ErbB4 at CNS synapses. Neuron 26:443-455, 2000; and El-Husseini, A. E.-D.; Schnell, E.; Dakoji, S.; Sweeney, N.; Zhou, Q.; Prange, O.; Gauthier-Campbell, C.; Aguilera-Moreno, A.; Nicoll, R. A.; Bredt, D. S.: Synaptic strength regulated.

Further studies establishing the function and utilities of DLG4 are found in John Hopkins OMIM database record ID 602887, and in sited publications numbered 5327-532 and 11573-5334 listed in the bibliography section hereinbelow, which are also hereby incorporated by reference. Egl Nine Homolog 3 (C. elegans) (EGLN3, Accession NM_022073) is another VGAM206 host target gene. EGLN3 BINDING SITE1 and EGLN3 BINDING SITE2 are HOST TARGET binding sites found in untranslated regions of mRNA encoded by EGLN3, corresponding to HOST TARGET binding sites such as BINDING SITE I, BINDING SITE II or BINDING SITE III. Table 2 illustrates the complementarity of the nucleotide sequences of EGLN3 BINDING SITE1 and EGLN3 BINDING SITE2, designated SEQ ID:22619 and SEQ ID:27198 respectively, to the nucleotide sequence of VGAM206 RNA, herein designated VGAM RNA, also designated SEQ ID:2917.

Another function of VGAM206 is therefore inhibition of Egl Nine Homolog 3 (C. elegans) (EGLN3, Accession NM_022073), a gene which is an essential component of the pathway. Accordingly, utilities of VGAM206 include diagnosis, prevention and treatment of diseases and clinical conditions associated with EGLN3. The function of EGLN3 has been established by previous studies. In cultured mammalian cells, Bruick and McKnight (2001) found that the inappropriate accumulation of HIF caused by forced expression of the HIF1-alpha subunit under normoxic conditions was attenuated by coexpression of HPH. Suppression of HPH in cultured Drosophila melanogaster cells by RNA interference resulted in elevated expression of the hypoxia-inducible gene LDH (see OMIM Ref. No. 150000) under normoxic conditions. Bruick and McKnight (2001) concluded that HPH is an essential component of the pathway through which cells sense oxygen. HIF is a transcriptional complex that plays a central role in mammalian oxygen homeostasis. Posttranslational modification by prolyl hydroxylation is a key regulatory event that targets HIF-alpha (HIF1; 603348) subunits for proteasomal destruction via the von Hippel-Lindau (VHL; 193300) ubiquitylation complex. Epstein et al. (2001) defined a conserved HIF-VHL-prolyl hydroxylase pathway in C. elegans and identified Egl9 as a dioxygenase that regulates HIF by prolyl hydroxylation. In mammalian cells, they showed that the HIF-prolyl hydroxylases are represented by 3 proteins with a conserved 2-histidine-1-carboxylate iron coordination motif at the catalytic site. The genes encoding these proteins were cloned and termed PHD1 (OMIM Ref. No. 606424), PHD2 (OMIM Ref. No. 606425), and PHD3 by the authors. Direct modulation of recombinant enzyme activity by graded hypoxia, iron chelation, and cobaltous ions mirrored the characteristics of HIF induction in vivo, fulfilling requirements for these enzymes being oxygen sensors that regulate HIF.

Full details of the abovementioned studies are described in the following publications, the disclosure of which are hereby incorporated by reference:

Bruick, R. K.; McKnight, S. L.: A conserved family of prolyl-4-hydroxylases that modify HIF. Science 294:1337-1340, 2001; and Epstein, A. C. R.; Gleadle, J. M.; McNeill, L. A.; Hewitson, K. S.; O'Rourke, J.; Mole, D. R.; Mukherji, M.; Metzen, E.; Wilson, M. I.; Dhanda, A.; Tian, Y.-M.; Masson, N.; Hamilton, D.

Further studies establishing the function and utilities of EGLN3 are found in John Hopkins OMIM database record ID 606426, and in sited publications numbered 4543-4544 listed in the bibliography section hereinbelow, which are also hereby incorporated by reference. Fucosyltransferase 9 (alpha (1,3) Fucosyltransferase) (FUT9, Accession XM_042167) is another VGAM206 host target gene. FUT9 BINDING SITE is HOST TARGET binding site found in the 3' untranslated region of mRNA encoded by FUT9, corresponding to a HOST TARGET binding site such as BINDING SITE I, BINDING SITE II or BINDING SITE III. Table 2 illustrates the complementarity of the nucleotide sequences of FUT9 BINDING SITE, designated SEQ ID:33700, to the nucleotide sequence of VGAM206 RNA, herein designated VGAM RNA, also designated SEQ ID:2917.

Another function of VGAM206 is therefore inhibition of Fucosyltransferase 9 (alpha (1,3) Fucosyltransferase) (FUT9, Accession XM_042167), a gene which catalyzes alpha-1,3 glycosidic linkages. Accordingly, utilities of VGAM206 include diagnosis, prevention and treatment of diseases and clinical conditions associated with FUT9. The function of FUT9 has been established by previous studies. FUT9 is one of several alpha-3-fucosyltransferases that can catalyze the last step in the biosynthesis of Lewis antigen, the addition of a fucose to precursor polysaccharides. FUT9 synthesizes the LeX oligosaccharide, which is expressed in organ buds progressing in mesenchyma during human embryogenesis.

Full details of the abovementioned studies are described in the following publications, the disclosure of which are hereby incorporated by reference:

Cailleau-Thomas, A.; Coullin, P.; Candelier, J.-J.; Balanzino, L.; Mennesson, B.; Oriol, R.; Mollicone, R.: FUT4 and FUT9 genes are expressed early in human embryogenesis. Glycobiology 10:789-802, 2000; and Kaneko, M.; Kudo, T.; Iwasaki, H.; Ikehara, Y.; Nishihara, S.; Nakagawa, S.; Sasaki, K.; Shiina, T.; Inoko, H.; Saitou, N.; Narimatsu, H.: Alpha-1,3-fucoslytransferase (sic) IX (Fuc-T.

Further studies establishing the function and utilities of FUT9 are found in John Hopkins OMIM database record ID 606865, and in sited publications numbered 83 and 5581-5582 listed in the bibliography section hereinbelow, which are also hereby incorporated by reference. UDP-N-acetyl-alpha-D-galactosamine:polypeptide N-acetylgalactosaminyltransferase 2 (GalNAc-T2) (GALNT2, Accession NM_004481) is another VGAM206 host target gene. GALNT2 BINDING SITE is HOST TARGET binding site found in the 3' untranslated region of mRNA encoded by GALNT2, corresponding to a HOST TARGET binding site such as BINDING SITE I, BINDING SITE II or BINDING SITE III. Table 2 illustrates the complementarity of the nucleotide sequences of GALNT2 BINDING SITE, designated SEQ ID:10798, to the nucleotide sequence of VGAM206 RNA, herein designated VGAM RNA, also designated SEQ ID:2917.

Another function of VGAM206 is therefore inhibition of UDP-N-acetyl-alpha-D-galactosamine:polypeptide N-acetylgalactosaminyltransferase 2 (GalNAc-T2) (GALNT2, Accession NM_004481), a gene which catalyzes the initial reaction in o-linked oligosaccharide biosynthesis. Accordingly, utilities of VGAM206 include diagnosis, prevention and treatment of diseases and clinical conditions associated with GALNT2. The function of GALNT2 and its association with various diseases and clinical conditions, has been established by previous studies, as described hereinabove with reference to VGAM187. G Protein-coupled Receptor 63 (GPR63, Accession NM_030784) is another VGAM206 host target gene. GPR63 BINDING SITE is HOST TARGET binding site found in the 5' untranslated region of mRNA encoded by GPR63, corresponding to a HOST TARGET binding site such as BINDING SITE I, BINDING SITE II or BINDING SITE III. Table 2 illustrates the complementarity of the nucleotide sequences of GPR63 BINDING SITE, designated SEQ ID:25079, to the nucleotide sequence of VGAM206 RNA, herein designated VGAM RNA, also designated SEQ ID:2917.

Another function of VGAM206 is therefore inhibition of G Protein-coupled Receptor 63 (GPR63, Accession NM_030784), a gene which transduces extracellular signals through heterotrimeric G proteins. Accordingly, utilities of VGAM206 include diagnosis, prevention and treatment of diseases and clinical conditions associated with GPR63. The function of GPR63 has been established by previous studies. Using degenerate primers designed from sequence conserved between Xenopus and mouse PSP24 homologs, Kawasawa et al. (2000) cloned GPR63, which they called PSP24B, by PCR followed by RACE using human brain mRNA as template. The deduced 419-amino acid protein shares 57% identity with Xenopus PSP24 and 92% identity with the mouse homolog. Lee et al. (2001) identified GPR63 within a human genomic DNA library using GPR61 (OMIM Ref. No. 606916) as probe. Primers to the intronless sequence were synthesized, and GPR63 cDNA was amplified by PCR and cloned. Northern blot analysis revealed expression of a single 6.8-kb transcript in various brain regions, with stronger expression in caudate and thalamus, and fainter expression in hypothalamus and midbrain. Kawasawa et al. (2000) cloned mouse Gpr63, which they called mPSP24B, by screening a mouse genomic library with the cDNA fragment of Xenopus PSP24. The 6.0-kb mouse transcript was expressed almost exclusively in brain. In situ hybridization of mouse brain sections revealed expression in neuronal cells such as olfactory mitral cells, cortical neurons, hippocampal pyramidal cells, and Purkinje cells in the cerebellum. Kawasawa et al. (2000) noted that Xenopus PSP24 was originally identified as a lysophosphatidic acid receptor (LPA). Functional analysis of mouse Gpr63 transfected into a rat hepatoma cell line suggested that the mouse protein does not function as an LPA receptor.

Full details of the abovementioned studies are described in the following publications, the disclosure of which are hereby incorporated by reference:

Kawasawa, Y.; Kume, K.; Nakade, S.; Haga, H.; Izumi, T.; Shimizu, T.: Brain-specific expression of novel G-protein-coupled receptors, with homologies to Xenopus PSP24 and human GPR45. Biochem. Biophys. Res. Commun. 276:952-956, 2000; and Lee, D. K.; George, S. R.; Cheng, R.; Nguyen, T.; Liu, Y.; Brown, M.; Lynch, K. R.; O'Dowd, B. F.: Identification of four novel human G protein-coupled receptors expressed in the brai.

Further studies establishing the function and utilities of GPR63 are found in John Hopkins OMIM database record ID 606915, and in sited publications numbered 5501-5503 listed in the bibliography section hereinbelow, which are also hereby incorporated by reference. Glutamate Receptor, Metabotropic 6 (GRM6, Accession NM_000843) is another VGAM206 host target gene. GRM6 BINDING SITE is HOST TARGET binding site found in the 3' untranslated region of mRNA encoded by GRM6, corresponding to a HOST TARGET binding site such as BINDING SITE I, BINDING SITE II or BINDING SITE III. Table 2 illustrates the complementarity of the nucleotide sequences of GRM6 BINDING SITE, designated SEQ ID:6512, to the nucleotide sequence of VGAM206 RNA, herein designated VGAM RNA, also designated SEQ ID:2917.

Another function of VGAM206 is therefore inhibition of Glutamate Receptor, Metabotropic 6 (GRM6, Accession NM_000843). Accordingly, utilities of VGAM206 include diagnosis, prevention and treatment of diseases and clinical conditions associated with GRM6. Guanylate Cyclase 1, Soluble, Alpha 3 (GUCY1A3, Accession XM_032838) is another VGAM206 host target gene. GUCY1A3 BINDING SITE is HOST TARGET binding site found in the 5' untranslated region of mRNA encoded by GUCY1A3, corresponding to a HOST TARGET binding site such as BINDING SITE I, BINDING SITE II or BINDING SITE III. Table 2 illustrates the complementarity of the nucleotide sequences of GUCY1A3 BINDING SITE, designated SEQ ID:31780, to the nucleotide sequence of VGAM206 RNA, herein designated VGAM RNA, also designated SEQ ID:2917.

Another function of VGAM206 is therefore inhibition of Guanylate Cyclase 1, Soluble, Alpha 3 (GUCY1A3, Accession XM_032838), a gene which is alpha 1 (alpha 3) subunit of soluble guanylate cyclase and forms a heterodimer with GUCY1B3 that converts GTP to cGMP. Accordingly, utilities of VGAM206 include diagnosis, prevention and treatment of diseases and clinical conditions associated with GUCY1A3. The function of GUCY1A3 has been established by previous studies. Cyclic GMP (cGMP) plays an important role as an intracellular messenger. The diverse array of its functions includes a central role in phototransduction and in platelet function. Synthesis of cGMP is catalyzed by guanylyl cyclase which exists in soluble and particulate isoforms. Soluble guanylyl cyclase is a dimer composed of a large (alpha) and a small (beta) subunit. Both subunits, alpha-3 and beta-3, were cloned from human brain by Giuili et al. (1992). They found that the alpha-3 and beta-3 subunits are of 82 kD and 70 kD, respectively. Giuili et al. (1993) used the cDNAs coding for these 2 subunits to identify the chromosomal location of the corresponding genes by in situ hybridization. Each probe gave a strong specific signal on chromosome 4 at the 4q31.3-q33 region, with the maximal signal in the 4q32 band. The colocalization of these genes may be related to the coordinated regulation of their expression.

Full details of the abovementioned studies are described in the following publications, the disclosure of which are hereby incorporated by reference:

Giuili, G.; Roechel, N.; Scholl, U.; Mattei, M.-G.; Guellaen, G.: Colocalization of the genes coding for the alpha-3 and beta-3 subunits of soluble guanylyl cyclase to human chromosome 4 at q31.3-q33. Hum. Genet. 91:257-260, 1993; and Giuili, G.; Scholl, U.; Bulle, F.; Guellaen, G.: Molecular cloning of the cDNAs coding for the two subunits of soluble guanylyl cyclase from human brain. FEBS Lett. 304:83-88, 1992.

Further studies establishing the function and utilities of GUCY1A3 are found in John Hopkins OMIM database record ID 139396, and in sited publications numbered 298 and 3571 listed in the bibliography section hereinbelow, which are also hereby incorporated by reference. Glycophorin A (includes MN blood group) (GYPA, Accession XM_113439) is another VGAM206 host target gene. GYPA BINDING SITE is HOST TARGET binding site found in the 3" untranslated region of mRNA encoded by GYPA, corresponding to a HOST TARGET binding site such as BINDING SITE I, BINDING SITE II or BINDING SITE III. Table 2 illustrates the complementarity of the nucleotide sequences of GYPA BINDING SITE, designated SEQ ID:42264, to the nucleotide sequence of VGAM206 RNA, herein designated VGAM RNA, also designated SEQ ID:2917.

Another function of VGAM206 is therefore inhibition of Glycophorin A (includes MN blood group) (GYPA, Accession XM_113439), a gene which determines the M or N blood group. Accordingly, utilities of VGAM206 include diagnosis, prevention and treatment of diseases and clinical conditions associated with GYPA. The function of GYPA and its association with various diseases and clinical conditions, has been established by previous studies, as described hereinabove with reference to VGAM145. Homeo Box A7 (HOXA7, Accession NM_006896) is another VGAM206 host target gene. HOXA7 BINDING SITE is HOST TARGET binding site found in the 3' untranslated region of mRNA encoded by HOXA7, corresponding to a HOST TARGET binding site such as BINDING SITE I, BINDING SITE II or BINDING SITE III. Table 2 illustrates the complementarity of the nucleotide sequences of HOXA7 BINDING SITE, designated SEQ ID:13772, to the nucleotide sequence of VGAM206 RNA, herein designated VGAM RNA, also designated SEQ ID:2917.

Another function of VGAM206 is therefore inhibition of Homeo Box A7 (HOXA7, Accession NM_006896), a gene which provides cells with specific positional identities on the anterior-posterior axis. Accordingly, utilities of VGAM206 include diagnosis, prevention and treatment of diseases and clinical conditions associated with HOXA7. The function of HOXA7 has been established by previous studies. The homeotic genes, whose products serve as determinants of embryonic cell fate, are expressed in a series of different but partially overlapping domains that extend along the anterior-posterior (A-P) axis of the embryo. The Hox genes share a 180-bp homeo box, which encodes a 60-amino acid homeodomain that binds specifically to DNA. There are 4 Hox gene clusters: HOXA (formerly HOX1) on chromosome 7, HOXB (formerly HOX2) on chromosome 17, HOXC (formerly HOX3) on chromosome 12, and HOXD (formerly HOX4) on chromosome 2. By sequence comparison, the genes of each cluster are assigned to 1 of 13 groups. The order of the HOX genes along the chromosome reflects where they are expressed along the body axis. This principle is followed in homeo box gene nomenclature. For a review of homeo box gene nomenclature, see Scott (1992). The homeo box is a 180-bp DNA sequence conserved in Drosophila homeotic genes which regulate early development (review by Gehring, 1985). These DNA sequences are present in open reading frames and have been identified in Drosophila and Xenopus embryos. They share structural features with genes encoding some DNA-binding proteins. Homologous homeo box sequences have been detected in species ranging from insects and annelids to vertebrates. The high degree of sequence conservation (70 to 90%) suggests a common role in embryonic development. Schughart et al. (1989) pointed to evidence of duplication of large genomic regions during evolution of the mouse homeo box genes. The findings were considered consistent with the hypothesis of Ohno (1970) that during vertebrate evolution duplications of the entire genome occurred. Such are likely to be less deleterious than duplications of individual chromosomes. Ferguson-Smith et al. (1989) showed that the sequence of the HOX1 gene has 100% identity to the deduced amino acid sequence of the mouse HOX1.4 homeo box. They detected no RFLPs with the 14-kD clone, which was devoid of any moderately repetitive DNA sequences. This implied an inability of this region to tolerate change in sequence, consistent with a function highly conserved throughout evolution Animal model experiments lend further support to the function of HOXA7. As reviewed by Gaunt and Singh (1990), in both the mouse and Drosophila, Antennapedia-like homeo box-containing genes (homeogenes) display a strict correspondence between the order of genes (3-prime to 5-prime) along the chromosome and the order of their expression domains (anterior to posterior) in the developing embryo. Gaunt and Singh (1990) suggested that this and other points of similarity indicate that the 2 species use a common mechanism of chromosomal imprinting in order to retain cellular memory of homeogene expression patterns throughout embryonic development. The 'open for transcription' model suggests that imprinting is a matter of open and closed chromatin, the molecular nature of which is not clear. It is possible that a clue to the mechanism of memory used within the homeogene complex, at least in Drosophila, is provided by the Drosophila mutant 'Polycomb' (Pc). The product of the Pc gene, which presumably has a homolog in man, appears to act as a repressor of 'posterior' genes in anterior segments. Thus, it may be involved in restricting the state of 'openness' of the homeotic gene complex.

It is appreciated that the abovementioned animal model for HOXA7 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Schughart, K.; Kappen, C.; Ruddle, F. H.: Duplication of large genomic regions during the evolution of vertebrate homeobox genes. Proc. Nat. Acad. Sci. 86: 7067-7071, 1989; and Scott, M. P.: Vertebrate homeobox gene nomenclature. (Letter) Cell 71: 551-553, 1992.

Further studies establishing the function and utilities of HOXA7 are found in John Hopkins OMIM database record ID 142950, and in sited publications numbered 5207-5221 listed in the bibliography section hereinbelow, which are also hereby incorporated by reference. Homeo Box C4 (HOXC4, Accession NM_014620) is another VGAM206 host target gene. HOXC4 BINDING SITE is HOST TARGET binding site found in the 5' untranslated region of mRNA encoded by HOXC4, corresponding to a HOST TARGET binding site such as BINDING SITE I, BINDING SITE II or BINDING SITE III. Table 2 illustrates the complementarity of the nucleotide sequences of HOXC4 BINDING SITE, designated SEQ ID:15975, to the nucleotide sequence of VGAM206 RNA, herein designated VGAM RNA, also designated SEQ ID:2917.

Another function of VGAM206 is therefore inhibition of Homeo Box C4 (HOXC4, Accession NM_014620), a gene which is part of a developmental regulatory system that provides cells with specific positional identities on the anterior-posterior axis. Accordingly, utilities of VGAM206 include diagnosis, prevention and treatment of diseases and clinical conditions associated with HOXC4. The function of HOXC4 has been established by previous studies. As reviewed by Acampora et al. (1989), the homeo box region 3, which maps to 12q12-q13, contains at least 7 homeo boxes in 160 kb of DNA. HOX3A is homologous to mouse Hox-3.1; HOX3B to mouse Hox-3.2; HOX3C to mouse Hox-6.1, and HOX3D to mouse Hox-6.2. The order of genes, from 5-prime to 3-prime, is HOX3G, HOX3F, HOX3B, HOX3A, HOX3C, HOX3D, HOX3E (Acampora et al., 1989). Masuda et al. (1991) mapped the feline equivalent to chromosome B4, which shares syntenic homology with human chromosome 12 and mouse chromosome 15. This gene is also called HOXC8; see HOXC9 (OMIM Ref. No. 142971). Yueh et al. (1998) showed that overexpression of a Hoxc8 transgene causes cartilage defects whose severity depends on transgene dosage. The abnormal cartilage is characterized by an accumulation of proliferating chondrocytes and reduced maturation. Since Hoxc8 is normally expressed in chondrocytes, these results suggested that Hoxc8 continues to regulate skeletal development well beyond pattern formation in a tissue-specific manner, presumably by controlling the progression of cells along the chondrocyte differentiation pathway. They found that Hoxd4 and Hoxc8 appear to act on chondrocyte differentiation in a similar manner. The protein sequences of the 2 share 67% identity within the homeodomain and 50% in the hexapeptide motif but little similarity in the remaining 70% of the molecules. Isl1, which shares no significant sequence similarities with Hoxc8 or Hoxd4, is not associated with abnormalities of skeletal development, implying that the cartilage abnormalities are specifically induced by HOX genes. The capacity of the HOX genes to regulate cartilage differentiation suggests that they may be involved in human chondrodysplasias or other cartilage disorders.

Full details of the abovementioned studies are described in the following publications, the disclosure of which are hereby incorporated by reference:

Simeone, A.; Pannese, M.; Acampora, D.; d'Esposito, M.; Boncinelli, E.: At least three human homeoboxes on chromosome 12 belong to the same transcription unit. Nucleic Acids Res. 16:5379-5390, 1988; and Yueh, Y. G.; Gardner, D. P.; Kappen, C.: Evidence for regulation of cartilage differentiation by the homeobox gene Hoxc-8. Proc. Nat. Acad. Sci. 95: 9956-9961, 1998.

Further studies establishing the function and utilities of HOXC4 are found in John Hopkins OMIM database record ID 142974, and in sited publications numbered 5223 listed in the bibliography section hereinbelow, which are also hereby incorporated by reference. Hippocalcin-like 1 (HPCAL1, Accession NM_134421) is another VGAM206 host target gene. HPCAL1 BINDING SITE is HOST TARGET binding site found in the 5' untranslated region of mRNA encoded by HPCAL1, corresponding to a HOST TARGET binding site such as BINDING SITE I, BINDING SITE II or BINDING SITE III. Table 2 illustrates the complementarity of the nucleotide sequences of HPCAL1 BINDING SITE, designated SEQ ID:28639, to the nucleotide sequence of VGAM206 RNA, herein designated VGAM RNA, also designated SEQ ID:2917.

Another function of VGAM206 is therefore inhibition of Hippocalcin-like 1 (HPCAL1, Accession NM_134421). Accordingly, utilities of VGAM206 include diagnosis, prevention and treatment of diseases and clinical conditions associated with HPCAL1. IRTA2 (Accession NM_031281) is another VGAM206 host target gene. IRTA2 BINDING SITE is HOST TARGET binding site found in the 3' untranslated region of mRNA encoded by IRTA2, corresponding to a HOST TARGET binding site such as BINDING SITE I, BINDING SITE II or BINDING SITE III. Table 2 illustrates the complementarity of the nucleotide sequences of IRTA2 BINDING SITE, designated SEQ ID:25298, to the nucleotide sequence of VGAM206 RNA, herein designated VGAM RNA, also designated SEQ ID:2917.

Another function of VGAM206 is therefore inhibition of IRTA2 (Accession NM_031281), a gene which binds to the fc region of immunoglobulins gamma low affinity receptor. Accordingly, utilities of VGAM206 include diagnosis, prevention and treatment of diseases and clinical conditions associated with IRTA2. The function of IRTA2 has been established by previous studies. Chromosomal abnormalities involving translocation breakpoints at 1q21-q23 are frequent in B-cell non-Hodgkin lymphoma (see OMIM Ref. No. BCL9; 602597) and multiple myeloma (MM; OMIM Ref. No. 254500). By cloning the breakpoints of a (1;14)(q21;q32) chromosomal translocation in the FR4 multiple myeloma cell line, followed by exon trapping and screening a spleen cDNA library, Hatzivassiliou et al. (2001) obtained cDNAs encoding 3 isoforms of IRTA1 (OMIM Ref. No. 605876) and 4 isoforms of IRTA2. The 3 major IRTA2 mRNA isoforms (ITRA2A, ITRA2B, and ITRA2C) each have their own unique 3-prime untranslated region, and the proteins they encode share a common amino acid sequence until residue 560, including a signal peptide and 6 extracellular Ig-type domains. Sequence analysis predicted that IRTA2A is a 759-amino acid secreted glycoprotein with 8 total extracellular Ig-type domains followed by 13 unique, predominantly polar residues at its C terminus. After the common 560 amino acids, IRTA2B has only 32 additional residues, whose hydrophobicity is compatible with its docking to the plasma membrane via a GPI anchor. The 977-amino acid IRTA2C protein shares the first 746 amino acids with IRTA2A. IRTA2C has a total of 9 extracellular Ig-type domains with 8 potential N-linked glycosylation sites; a 23-residue transmembrane region; and a 104-residue cytoplasmic domain with 3 consensus SH2-binding domains, all of which exhibit features of ITIMs (immune-receptor tyrosine-based inhibition motifs) and are encoded by separate exons. The fourth isoform, IRTA2D, encodes a peptide of 152 amino acids. Northern blot analysis detected 2.8-, 4.4-, 5.3-, and 0.6-kb IRTA2 transcripts in lymph node, spleen, bone marrow, and small intestine, with a preponderance of the IRTA2A isoform. In situ hybridization analysis detected IRTA2 expression in tonsillar germinal center centrocytes, but not in centroblasts, as well as in intraepithelial and interfollicular regions. Nakayama et al. (2001) independently cloned IRTA2, which they called BXMAS1, by representational difference analysis of genes activated by anti-IgM crosslinking of a human B-cell line. The deduced 977-amino acid protein contains 8 ITIMs and 8 potential N-linked glycosylation sites. Northern blot analysis detected a 6.7-kb transcript and a larger transcript between 14- and 17-kb in B cells 24 to 36 hours after activation. Northern blot analysis of tissues detected expression only in spleen In situ hybridization analysis demonstrated expression of IRTA2 in the mantle zone of tonsil tissue but not in germinal center cells Full details of the abovementioned studies are described in the following publications, the disclosure of which are hereby incorporated by reference:

Hatzivassiliou, G.; Miller, I.; Takizawa, J.; Palanisamy, N.; Rao, P. H.; Iida, S.; Tagawa, S.; Taniwaki, M.; Russo, J.; Neri, A.; Cattoretti, G.; Clynes, R.; Mendelsohn, C.; Chaganti, R. S. K.; Dalla-Favera, R.: IRTA1 and IRTA2, novel immunoglobulin superfamily receptors expressed in B cells and involved in chromosome 1q21 abnormalities in B cell malignancy. Immunity 14:277-289, 2001; and Nakayama, Y.; Weissman, S. M.; Bothwell, A. L. M.: BXMAS1 identifies a cluster of homologous genes differentially expressed in B cells. Biochem. Biophys. Res. Commun. 285:830-837, 200.

Further studies establishing the function and utilities of IRTA2 are found in John Hopkins OMIM database record ID 605877, and in sited publications numbered 29 and 7008 listed in the bibliography section hereinbelow, which are also hereby incorporated by reference. Itchy Homolog E3 Ubiquitin Protein Ligase (mouse) (ITCH, Accession NM_031483) is another VGAM206 host target gene. ITCH BINDING SITE is HOST TARGET binding site found in the 3' untranslated region of mRNA encoded by ITCH, corresponding to a HOST TARGET binding site such as BINDING SITE I, BINDING SITE II or BINDING SITE III. Table 2 illustrates the complementarity of the nucleotide sequences of ITCH BINDING SITE, designated SEQ ID:25564, to the nucleotide sequence of VGAM206 RNA, herein designated VGAM RNA, also designated SEQ ID:2917.

Another function of VGAM206 is therefore inhibition of Itchy Homolog E3 Ubiquitin Protein Ligase (mouse) (ITCH, Accession NM_031483), a gene which accepts ubiquitin from an e2 ubiquitin-conjugating enzyme in the form of a thioester and then directly transfers the ubiquitin to targeted substrates. Accordingly, utilities of VGAM206 include diagnosis, prevention and treatment of diseases and clinical conditions associated with ITCH. The function of ITCH has been established by previous studies. Using GST pull-down and coimmunoprecipitation experiments, Winberg et al. (2000) demonstrated that ITCH and KIAA0439 (OMIM Ref. No. 606384) form physiological complexes with the Epstein-Barr virus (EBV) latent membrane protein 2a (LMP2A) in EBV-positive cells. They concluded that the ability of LMP2A to recognize the WW domains of ITCH or KIAA0439 is dependent on the LMP2A PPPPY motifs. Using chimeric protein analysis, they determined that the N-terminal region of LMP2A is necessary and sufficient for binding to ITCH and that this interaction is not dependent on tyrosine phosphorylation. The authors hypothesized that LMP2A promotes ITCH-mediated ubiquitination of Lyn (OMIM Ref. No. 165120) and Syk (OMIM Ref. No. 600085). With GST pull-down assays and immunoprecipitation assays, Qiu et al. (2000) demonstrated that Itch binds to the N-terminal portion of the Notch (see OMIM Ref. No. 190198) intracellular domain via its WW domains and promotes ubiquitination of Notch through its HECT ubiquitin ligase domain. They hypothesized that Itch may participate in the regulation of immune responses by modifying Notch-mediated signaling. Using transfection experiments, Chen et al. (2001) concluded that ITCH can act as a transcriptional corepressor of p45/NFE2. The interaction between these 2 proteins is modulated through the WW1 domain of ITCH and requires the PY motif of p45/NFE2. In cotransfection assays, they observed that ITCH suppressed transcriptional activation by p45/NFE2. They hypothesized that the erythroid hyperplasia observed in a18H mice (see OMIM Ref. No. Animal Model section) is likely due to the loss of NFE2/ITCH interaction. Animal model experiments lend further support to the function of ITCH. By analyzing genomic clones from wildtype and mutant mice, Perry et al. (1998) determined that the phenotype of the non-agouti-lethal 18H (a18H) or Itchy mice results from a small inversion that disrupts both the agouti and the Itch genes. The mice develop a spectrum of immunologic diseases not seen in other mice with mutations in agouti. The phenotype includes inflammation of the lung and stomach, hyperplasia of lymphoid and hematopoietic cells, and constant itching in the skin, suggesting that Itch is involved in the regulation of immune response. The inversion in a18H mice appears to produce a null allele of Itch by removing the promoter from the coding region of the Itch gene. Perry et al. (1998) concluded that the a18H mutation provides a link between ubiquitin-dependent proteolysis and normal immune function in vivo in addition to identifying a molecule important for the regulation of epithelial and hematopoietic cell growth. d'Andrea and Serhan (1998) presented models of how the disruption of the Itch locus may cause the immune reaction seen in a18H mice and discussed the implications for possible functions of Itch It is appreciated that the abovementioned animal model for ITCH is acknowledged by those skilled in the art as a scientifically valid animal model, as can be further appreciated from the publications sited hereinbelow.

Full details of the abovementioned studies are described in the following publications, the disclosure of which are hereby incorporated by reference:

Perry, W. L.; Hustad, C. M.; Swing, D. A.; O'Sullivan, T. N.; Jenkins, N. A.; Copeland, N. G.: The itchy locus encodes a novel ubiquitin protein ligase that is disrupted in a18H mice. Nature Genet. 18:143-146, 1998; and Chen, X.; Wen, S.; Fukuda, M. N.; Gavva, N. R.; Hsu, D.; Akama, T. O.; Yang-Feng, T.; Shen, C. K. J.: Human ITCH is a coregulator of the hematopoietic transcription factor NF-E2. Genomi.

Further studies establishing the function and utilities of ITCH are found in John Hopkins OMIM database record ID 606409, and in sited publications numbered 4528-453 and 2569 listed in the bibliography section hereinbelow, which are also hereby incorporated by reference. Integrin, Alpha 11 (ITGA11, Accession NM_012211) is another VGAM206 host target gene. ITGA11 BINDING SITE is HOST TARGET binding site found in the 3' untranslated region of mRNA encoded by ITGA11, corresponding to a HOST TARGET binding site such as BINDING SITE I, BINDING SITE II or BINDING SITE III. Table 2 illustrates the complementarity of the nucleotide sequences of ITGA11 BINDING SITE, designated SEQ ID:14514, to the nucleotide sequence of VGAM206 RNA, herein designated VGAM RNA, also designated SEQ ID:2917.

Another function of VGAM206 is therefore inhibition of Integrin, Alpha 11 (ITGA11, Accession NM_012211), a gene which acts as a collagen I receptor. Accordingly, utilities of VGAM206 include diagnosis, prevention and treatment of diseases and clinical conditions associated with ITGA11. The function of ITGA11 has been established by previous studies. By screening a uterus cDNA library with an integrin-like cDNA fragment isolated from a fetal myoblast cDNA library, Velling et al. (1999) obtained a full-length cDNA sequence encoding integrin alpha-11. ITGA11 encodes a deduced 1,188-amino acid protein, including a 22-amino acid signal peptide. The mature 1,166-amino acid protein contains a 23-amino acid transmembrane region and a 24-amino acid cytoplasmic tail. It differs from most other integrin alpha chains in that the cytoplasmic tail contains the sequence GFFRS instead of the conserved GFFKR sequence. The extracellular domain contains 7 FG-GAP repeats with an I domain of 195 amino acids between repeats 2 and 3 that includes a conserved metal ion-dependent adhesion site motif. Twenty cysteines are located in the extracellular domain and there are 16 potential N-glycosylation sites. ITGA11 is 42%, 37%, and 35% identical with I domain alpha-integrins ITGA10 (OMIM Ref. No. 604042), ITGA1 (OMIM Ref. No. 192968), and ITGA2 (OMIM Ref. No. 192974), respectively. Northern blot analysis revealed expression of an approximately 5.5-kb ITGA11 transcript. Expression was highest in uterus, strong in heart, intermediate in skeletal muscle, stomach, small intestine, bladder, prostate, and colon, and low in nonmuscle tissues such as pancreas, kidney, and placenta. The authors found that, in contrast, ITGA1 is not expressed in the uterus. Immunoprecipitation studies and SDS-PAGE analysis showed that ITGA11 encodes a 145-kD protein, intermediate in size between ITGA2 or ITGA10 and ITGA1; the authors suggested that the difference is probably due to differential glycosylation. Like other I domain-containing integrins, ITGA11 binds to collagen By sequence analysis, Lehnert et al. (1999) found that the deduced ITGA11 protein contains an I domain of 207 amino acids and 15 N-glycosylation sites in a mature protein of 1167 amino acids. By FISH, Velling et al. (1999) mapped the ITGA11 gene to chromosome 15q23. By somatic cell hybrid analysis and FISH, Lehnert et al. (1999) mapped the gene to 15q22.3-q23.

Full details of the abovementioned studies are described in the following publications, the disclosure of which are hereby incorporated by reference:

Lehnert, K.; Ni, J.; Leung, E.; Gough, S. M.; Weaver, A.; Yao, W.-P.; Liu, D.; Wang, S.-X.; Morris, C. M.; Krissansen, G. W.: Cloning, sequence analysis, and chromosomal localization of the novel human integrin alpha-11 subunit (ITGA11). Genomics 60:179-187, 1999; and Velling, T.; Kusche-Gullberg, M.; Sejersen, T.; Gullberg, D.: cDNA cloning and chromosomal localization of human alpha-11 integrin: a collagen-binding, I domain-containing, beta-1-asso.

Further studies establishing the function and utilities of ITGA11 are found in John Hopkins OMIM database record ID 604789, and in sited publications numbered 2906-2907 listed in the bibliography section hereinbelow, which are also hereby incorporated by reference. KIP2 (Accession NM_006383) is another VGAM206 host target gene. KIP2 BINDING SITE is HOST TARGET binding site found in the 3' untranslated region of mRNA encoded by KIP2, corresponding to a HOST TARGET binding site such as BINDING SITE I, BINDING SITE II or BINDING SITE III. Table 2 illustrates the complementarity of the nucleotide sequences of KIP2 BINDING SITE, designated SEQ ID:13089, to the nucleotide sequence of VGAM206 RNA, herein designated VGAM RNA, also designated SEQ ID:2917.

Another function of VGAM206 is therefore inhibition of KIP2 (Accession NM_006383). Accordingly, utilities of VGAM206 include diagnosis, prevention and treatment of diseases and clinical conditions associated with KIP2. Keratin 16 (focal non-epidermolytic palmoplantar keratoderma) (KRT16, Accession XM_170845) is another VGAM206 host target gene. KRT16 BINDING SITE is HOST TARGET binding site found in the 5' untranslated region of mRNA encoded by KRT16, corresponding to a HOST TARGET binding site such as BINDING SITE I, BINDING SITE II or BINDING SITE III. Table 2 illustrates the complementarity of the nucleotide sequences of KRT16 BINDING SITE, designated SEQ ID:45630, to the nucleotide sequence of VGAM206 RNA, herein designated VGAM RNA, also designated SEQ ID:2917.

Another function of VGAM206 is therefore inhibition of Keratin 16 (focal non-epidermolytic palmoplantar keratoderma) (KRT16, Accession XM_170845). Accordingly, utilities of VGAM206 include diagnosis, prevention and treatment of diseases and clinical conditions associated with KRT16. Leucine Zipper, Down-regulated In Cancer 1 (LDOC1, Accession NM_012317) is another VGAM206 host target gene. LDOC1 BINDING SITE is HOST TARGET binding site found in the 3' untranslated region of mRNA encoded by LDOC1, corresponding to a HOST TARGET binding site such as BINDING SITE I, BINDING SITE II or BINDING SITE III. Table 2 illustrates the complementarity of the nucleotide sequences of LDOC1 BINDING SITE, designated SEQ ID:14693, to the nucleotide sequence of VGAM206 RNA, herein designated VGAM RNA, also designated SEQ ID:2917.

Another function of VGAM206 is therefore inhibition of Leucine Zipper, Down-regulated In Cancer 1 (LDOC1, Accession NM_012317). Accordingly, utilities of VGAM206 include diagnosis, prevention and treatment of diseases and clinical conditions associated with LDOC1. Leucine-zipper-like Transcriptional Regulator, 1 (LZTR1, Accession NM_006767) is another VGAM206 host target gene. LZTR1 BINDING SITE is HOST TARGET binding site found in the 3' untranslated region of mRNA encoded by LZTR1, corresponding to a HOST TARGET binding site such as BINDING SITE I, BINDING SITE II or BINDING SITE III. Table 2 illustrates the complementarity of the nucleotide sequences of LZTR1 BINDING SITE, designated SEQ ID:13640, to the nucleotide sequence of VGAM206 RNA, herein designated VGAM RNA, also designated SEQ ID:2917.

Another function of VGAM206 is therefore inhibition of Leucine-zipper-like Transcriptional Regulator, 1 (LZTR1, Accession NM_006767). Accordingly, utilities of VGAM206 include diagnosis, prevention and treatment of diseases and clinical conditions associated with LZTR1. Nyctalopin (NYX, Accession NM_022567) is another VGAM206 host target gene. NYX BINDING SITE is HOST TARGET binding site found in the 3' untranslated region of mRNA encoded by NYX, corresponding to a HOST TARGET binding site such as BINDING SITE I, BINDING SITE II or BINDING SITE III. Table 2 illustrates the complementarity of the nucleotide sequences of NYX BINDING SITE, designated SEQ ID:22889, to the nucleotide sequence of VGAM206 RNA, herein designated VGAM RNA, also designated SEQ ID:2917.

Another function of VGAM206 is therefore inhibition of Nyctalopin (NYX, Accession NM_022567), a gene which functions as the von willebrand factor receptor and mediates von willebrand factor-dependent platelet adhesion to blood vessels. the adhesion of platelets to injured vascular surfaces in the arterial circulation is a critical initiating event in hemostasis (by similarity). Accordingly, utilities of VGAM206 include diagnosis, prevention and treatment of diseases and clinical conditions associated with NYX. The function of NYX has been established by previous studies. By positional cloning and the candidate gene approach, directed at the elucidation of the defect in complete congenital stationary night blindness (CSNB1; 310500), Bech-Hansen et al. (2000) identified a novel gene, NYX, that encodes a protein (nyctalopin) of 481 amino acids. Nyctalopin shows sequence similarity with members of the superfamily of proteins containing tandem arrays of the leucine-rich repeat (LRR) motif, as well as other features qualifying the protein as a member of the subfamily of small leucine-rich proteoglycans (SLRPs). By PCR amplification of tissue-specific cDNA, Bech-Hansen et al. (2000) detected expression of NYX in retina and kidney only. In the retina it appeared to be expressed in photoreceptors, bipolar and amacrine interneurons, and ganglion cells. Pusch et al. (2000) likewise detected 14 different mutations. In 3 families the gene was partially deleted. They found expression of the gene at low levels in retina, brain, testis, and muscle.

Full details of the abovementioned studies are described in the following publications, the disclosure of which are hereby incorporated by reference:

Bech-Hansen, N. T.; Naylor, M. J.; Maybaum, T. A.; Sparkes, R. L.; Koop, B.; Birch, D. G.; Bergen, A. A. B.; Prinsen, C. F. M.; Polomeno, R. C.; Gal, A.; Drack, A. V.; Musarella, M. A.; Jacobson, S. G.; Young, R. S. L.; Weleber, R. G.: Mutations in NYX, encoding the leucine-rich proteoglycan nyctalopin, cause X-linked complete congenital stationary night blindness. Nature Genet. 26:319-323, 2000. ; and Pusch, C. M.; Zeitz, C.; Brandau, O.; Pesch, K.; Achatz, H.; Feil, S.; Scharfe, C.; Maurer, J.; Jacobi, F. K.; Pinckers, A.; Andreasson, S.; Hardcastle, A.; Wissinger, B.; Berger, W.;

Further studies establishing the function and utilities of NYX are found in John Hopkins OMIM database record ID 300278, and in sited publications numbered 10994-10995 listed in the bibliography section hereinbelow, which are also hereby incorporated by reference. Optic Atrophy 1 (autosomal dominant) (OPA1, Accession NM_130835) is another VGAM206 host target gene. OPA1 BINDING SITE1 through OPA1 BINDING SITE5 are HOST TARGET binding sites found in untranslated regions of mRNA encoded by OPA1, corresponding to HOST TARGET binding sites such as BINDING SITE I, BINDING SITE II or BINDING SITE III. Table 2 illustrates the complementarity of the nucleotide sequences of OPA1 BINDING SITE1 through OPA1 BINDING SITE5, designated SEQ ID:28340, SEQ ID:28324, SEQ ID:28356, SEQ ID:28348 and SEQ ID:28332 respectively, to the nucleotide sequence of VGAM206 RNA, herein designated VGAM RNA, also designated SEQ ID:2917.

Another function of VGAM206 is therefore inhibition of Optic Atrophy 1 (autosomal dominant) (OPA1, Accession NM_130835). Accordingly, utilities of VGAM206 include diagnosis, prevention and treatment of diseases and clinical conditions associated with OPA1. PR Domain Containing 2, with ZNF Domain (PRDM2, Accession NM_012231) is another VGAM206 host target gene. PRDM2 BINDING SITE is HOST TARGET binding site found in the 3' untranslated region of mRNA encoded by PRDM2, corresponding to a HOST TARGET binding site such as BINDING SITE I, BINDING SITE II or BINDING SITE III. Table 2 illustrates the complementarity of the nucleotide sequences of PRDM2 BINDING SITE, designated SEQ ID:14537, to the nucleotide sequence of VGAM206 RNA, herein designated VGAM RNA, also designated SEQ ID:2917.

Another function of VGAM206 is therefore inhibition of PR Domain Containing 2, with ZNF Domain (PRDM2, Accession NM_012231), a gene which plays a role in transcriptional regulation during neuronal differentiation and pathogenesis of retinoblastoma. Accordingly, utilities of VGAM206 include diagnosis, prevention and treatment of diseases and clinical conditions associated with PRDM2. The function of PRDM2 and its association with various diseases and clinical conditions, has been established by previous studies, as described hereinabove with reference to VGAM120. Prostaglandin E Synthase (PTGES, Accession NM_004878) is another VGAM206 host target gene. PTGES BINDING SITE is HOST TARGET binding site found in the 3' untranslated region of mRNA encoded by PTGES, corresponding to a HOST TARGET binding site such as BINDING SITE I, BINDING SITE II or BINDING SITE III. Table 2 illustrates the complementarity of the nucleotide sequences of PTGES BINDING SITE, designated SEQ ID:11312, to the nucleotide sequence of VGAM206 RNA, herein designated VGAM RNA, also designated SEQ ID:2917.

Another function of VGAM206 is therefore inhibition of Prostaglandin E Synthase (PTGES, Accession NM_004878). Accordingly, utilities of VGAM206 include diagnosis, prevention and treatment of diseases and clinical conditions associated with PTGES. Prostaglandin I2 (prostacyclin) Synthase (PTGIS, Accession NM_000961) is another VGAM206 host target gene. PTGIS BINDING SITE is HOST TARGET binding site found in the 3' untranslated region of mRNA encoded by PTGIS, corresponding to a HOST TARGET binding site such as BINDING SITE I, BINDING SITE II or BINDING SITE III. Table 2 illustrates the complementarity of the nucleotide sequences of PTGIS BINDING SITE, designated SEQ ID:6668, to the nucleotide sequence of VGAM206 RNA, herein designated VGAM RNA, also designated SEQ ID:2917.

Another function of VGAM206 is therefore inhibition of Prostaglandin I2 (prostacyclin) Synthase (PTGIS, Accession NM_000961), a gene which catalyzes the isomerization of prostaglandin h2 to prostacyclin (= prostaglandin i2). Accordingly, utilities of VGAM206 include diagnosis, prevention and treatment of diseases and clinical conditions associated with PTGIS. The function of PTGIS has been established by previous studies. Yokoyama et al. (1996) demonstrated that the prostacyclin synthase gene, which they symbolized PTGIS, consists of 10 exons spanning approximately 60 kb. All the splice donor and acceptor sites conformed to the GT/AG rule. The major product of the primer extension analysis suggested that the transcription of the gene started from the positions around 49 bp upstream of the translation initiation codon. By fluorescence in situ hybridization, they demonstrated that the gene is located at 20q13.11-q13.13. Prostacyclin (also known as prostaglandin I2) is a potent vasodilator and inhibitor of platelet aggregation. The enzyme prostacyclin synthase (EC 5.3.99.4) catalyzes the isomerization of prostaglandin H2 (PGH2) to prostacyclin. Wang and Chen (1996) noted that although it has absorbance spectral features characteristic of the cytochrome P450s, PGIS has no monooxygenase activity and does not require an external source of electrons to initiate its enzyme reaction. Prostacyclin synthase is the single member of family 8 of the cytochrome P450 superfamily (Nelson et al., 1996).

Full details of the abovementioned studies are described in the following publications, the disclosure of which are hereby incorporated by reference:

Wang, L.-H.; Chen, L.: Organization of the gene encoding human prostacyclin synthase. Biochem. Biophys. Res. Commun. 226:631-637, 1996. ; and Yokoyama, C.; Yabuki, T.; Inoue, H.; Tone, Y.; Hara, S.; Hatae, T.; Nagata, M.; Takahashi, E.-I.; Tanabe, T.: Human gene encoding prostacyclin synthase (PTGIS): genomic organization, ch.

Further studies establishing the function and utilities of PTGIS are found in John Hopkins OMIM database record ID 601699, and in sited publications numbered 670 and 2859-2861 listed in the bibliography section hereinbelow, which are also hereby incorporated by reference. Peroxisomal Membrane Protein 3, 35kDa (Zellweger syndrome) (PXMP3, Accession NM_000318) is another VGAM206 host target gene. PXMP3 BINDING SITE is HOST TARGET binding site found in the 5' untranslated region of mRNA encoded by PXMP3, corresponding to a HOST TARGET binding site such as BINDING SITE I, BINDING SITE II or BINDING SITE III. Table 2 illustrates the complementarity of the nucleotide sequences of PXMP3 BINDING SITE, designated SEQ ID:5860, to the nucleotide sequence of VGAM206 RNA, herein designated VGAM RNA, also designated SEQ ID:2917.

Another function of VGAM206 is therefore inhibition of Peroxisomal Membrane Protein 3, 35 kDa (Zellweger syndrome) (PXMP3, Accession NM_000318). Accordingly, utilities of VGAM206 include diagnosis, prevention and treatment of diseases and clinical conditions associated with PXMP3. RIG (Accession NM_006394) is another VGAM206 host target gene. RIG BINDING SITE is HOST TARGET binding site found in the 3' untranslated region of mRNA encoded by RIG, corresponding to a HOST TARGET binding site such as BINDING SITE I, BINDING SITE II or BINDING SITE III. Table 2 illustrates the complementarity of the nucleotide sequences of RIG BINDING SITE, designated SEQ ID:13105, to the nucleotide sequence of VGAM206 RNA, herein designated VGAM RNA, also designated SEQ ID:2917.

Another function of VGAM206 is therefore inhibition of RIG (Accession NM_006394), a gene which is ribosomal protein S15. Accordingly, utilities of VGAM206 include diagnosis, prevention and treatment of diseases and clinical conditions associated with RIG. The function of RIG has been established by previous studies. The gene called Rig (rat insulinoma gene) was first isolated from a cDNA library of rat insulinomas. Its cognate gene has been found to be activated in various human tumors such as insulinomas, esophageal cancers, and colon cancers. Inoue et al. (1987) isolated a human insulinoma cDNA encoding the human homolog of Rig. Structural analysis indicated that the predicted 145-amino acid RIG protein may be a DNA-binding protein. Shiga et al. (1990) isolated the genomic sequence of human RIG from a genomic DNA library constructed from a human esophageal carcinoma and determined its complete nucleotide sequence. The gene is composed of about 3,000 nucleotides and divided into 4 exons separated by 3 introns. The transcription initiation site was located -46 bp upstream from the first ATG codon. Because of CpG islands in the 5-prime region and regions with a high GC content and because of the wide expression of RIG in tissues and cells, Shiga et al. (1990) suggested that RIG may belong to the class of 'housekeeping' genes, whose products are necessary for the growth of all cell types. The human genome contains at least 6 copies of RIG pseudogenes, 4 of which have the characteristics of processed pseudogenes. Kitagawa et al. (1991) demonstrated the normal function of Rig. They showed that the immunoreactivity to a monoclonal antibody against the deduced Rig protein and the translation product of Rig mRNA comigrated with ribosomal protein S15. The amino acid sequence of ribosomal protein S15 purified from rat liver coincided with that deduced from the nucleotide sequence of Rig mRNA, but there were indications that the initiator methionine was removed and the succeeding alanyl residue was monoacetylated. The authors concluded that the product of the Rig gene is ribosomal protein S15. Animal model experiments lend further support to the function of RIG. By somatic cell hybrid and radiation hybrid mapping analyses, Kenmochi et al. (1998) mapped the human RPS15 gene to 19p.

It is appreciated that the abovementioned animal model for RIG is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kitagawa, M.; Takasawa, S.; Kikuchi, N.; Itoh, T.; Teraoka, H.; Yamamoto, H.; Okamoto, H.: Rig encodes ribosomal protein S15: the primary structure of mammalian ribosomal protein S15. FEBS Lett. 283:210-214, 1991; and Kenmochi, N.; Kawaguchi, T.; Rozen, S.; Davis, E.; Goodman, N.; Hudson, T. J.; Tanaka, T.; Page, D. C.: A map of 75 human ribosomal protein genes. Genome Res. 8:509-523, 1998.

Further studies establishing the function and utilities of RIG are found in John Hopkins OMIM database record ID 180535, and in sited publications numbered 1239 and 12396-12397 listed in the bibliography section hereinbelow, which are also hereby incorporated by reference. RNA (guanine-7-) Methyltransferase (RNMT, Accession NM_003799) is another VGAM206 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9891, to the nucleotide sequence of VGAM206 RNA, herein designated VGAM RNA, also designated SEQ ID:2917.

Another function of VGAM206 is therefore inhibition of RNA (guanine-7-) Methyltransferase (RNMT, Accession NM_003799), a gene which catalyzes the methylation of GpppN- at the guanine N7 position. Accordingly, utilities of VGAM206 include diagnosis, prevention and treatment of diseases and clinical conditions associated with RNMT. The function of RNMT and its association with various diseases and clinical conditions, has been established by previous studies, as described hereinabove with reference to VGAM178. SHC (Src homology 2 domain containing) Transforming Protein 1 (SHC1, Accession NM_003029) is another VGAM206 host target gene. SHC1 BINDING SITE is HOST TARGET binding site found in the 3' untranslated region of mRNA encoded by SHC1, corresponding to a HOST TARGET binding site such as BINDING SITE I, BINDING SITE II or BINDING SITE III. Table 2 illustrates the complementarity of the nucleotide sequences of SHC1 BINDING SITE, designated SEQ ID:8972, to the nucleotide sequence of VGAM206 RNA, herein designated VGAM RNA, also designated SEQ ID:2917.

Another function of VGAM206 is therefore inhibition of SHC (Src homology 2 domain containing) Transforming Protein 1 (SHC1, Accession NM_003029), a gene which couples activated growth factor receptors to a signaling pathway. Accordingly, utilities of VGAM206 include diagnosis, prevention and treatment of diseases and clinical conditions associated with SHC1. The function of SHC1 and its association with various diseases and clinical conditions, has been established by previous studies, as described hereinabove with reference to VGAM53. Solute Carrier Family 1 (neuronal/epithelial high affinity glutamate transporter, system Xag), Member 1 (SLC1A1, Accession NM_004170) is another VGAM206 host target gene. SLC1A1 BINDING SITE is HOST TARGET binding site found in the 3' untranslated region of mRNA encoded by SLC1A1, corresponding to a HOST TARGET binding site such as BINDING SITE I, BINDING SITE II or BINDING SITE III. Table 2 illustrates the complementarity of the nucleotide sequences of SLC1A1 BINDING SITE, designated SEQ ID:10380, to the nucleotide sequence of VGAM206 RNA, herein designated VGAM RNA, also designated SEQ ID:2917.

Another function of VGAM206 is therefore inhibition of Solute Carrier Family 1 (neuronal/epithelial high affinity glutamate transporter, system Xag), Member 1 (SLC1A1, Accession NM_004170), a gene which is a glutamate transporter, essential for terminating the postsynaptic action of glutamate by rapidly removing it from the synaptic cleft. Accordingly, utilities of VGAM206 include diagnosis, prevention and treatment of diseases and clinical conditions associated with SLC1A1. The function of SLC1A1 has been established by previous studies. High-affinity glutamate transporters play an essential role in transporting glutamate across plasma membranes. In brain, these transporters are crucial in terminating the action of the excitatory neurotransmitter glutamate and in maintaining extracellular glutamate concentrations below neurotoxic levels. Functional defects of high-affinity glutamate transporters have been suggested to be involved in the pathophysiology of amyotrophic lateral sclerosis (OMIM Ref. No. 105400). In small intestine and kidney, in which the high-affinity glutamate transporter mediates net absorption of glutamate and aspartate across epithelial cells, an inborn error of glutamate transport is thought to cause dicarboxylicaminoaciduria (OMIM Ref. No. 222730). Kanai and Hediger (1992) isolated a cDNA encoding a high-affinity glutamate transporter, designated EAAC1, that also transports aspartate but not other amino acids. EAAC1 was found to be uniquely expressed throughout the body, particularly in brain (neurons), intestine, and kidney. By Southern analysis of a panel of human/rodent somatic cell hybrids and by fluorescence in situ hybridization (FISH), Smith et al. (1994) mapped the EAAC1 gene to 9p24. They suggested that mutations in this gene may be responsible for dicarboxylicaminoaciduria or for a form of familial ALS separate from the form due to mutation in the SOD1 gene (OMIM Ref. No. 147450) on chromosome 21. Lin et al. (2001) used a yeast 2-hybrid assay to identify a protein that interacts with EAAC1. This protein, termed GTRAP3-18 (OMIM Ref. No. 605709), is expressed in numerous tissues, localizes to the cell membrane and cytoplasm, and specifically interacts with the carboxy-terminal intracellular domain of EAAC1. Increasing the expression of GTRAP3-18 in cells reduces EAAC1-mediated glutamate transport by lowering substrate affinity. The expression of GTRAP3-18 can be upregulated by retinoic acid, which results in a specific reduction of EAAC1-mediated glutamate transport. Lin et al. (2001) concluded that glutamate transport proteins can be regulated potently and that GTRAP can modulate the transport functions ascribed to EAAC1. GTRAP3-18 may be important in regulating the metabolic functions of EAAC1.

Full details of the abovementioned studies are described in the following publications, the disclosure of which are hereby incorporated by reference:

Kanai, Y.; Hediger, M. A.: Primary structure and functional characterization of a high-affinity glutamate transporter. Nature 360:467-471, 1992; and Smith, C. P.; Weremowicz, S.; Kanai, Y.; Stelzner, M.; Morton, C. C.; Hediger, M. A.: Assignment of the gene coding for the human high-affinity glutamate transporter EAAC1 to 9p24: pot.

Further studies establishing the function and utilities of SLC1A1 are found in John Hopkins OMIM database record ID 133550, and in sited publications numbered 3585-3587 listed in the bibliography section hereinbelow, which are also hereby incorporated by reference. Solute Carrier Family 2 (facilitated glucose/fructose transporter), Member 5 (SLC2A5, Accession NM_003039) is another VGAM206 host target gene. SLC2A5 BINDING SITE is HOST TARGET binding site found in the 3' untranslated region of mRNA encoded by SLC2A5, corresponding to a HOST TARGET binding site such as BINDING SITE I, BINDING SITE II or BINDING SITE III. Table 2 illustrates the complementarity of the nucleotide sequences of SLC2A5 BINDING SITE, designated SEQ ID:9001, to the nucleotide sequence of VGAM206 RNA, herein designated VGAM RNA, also designated SEQ ID:2917.

Another function of VGAM206 is therefore inhibition of Solute Carrier Family 2 (facilitated glucose/fructose transporter), Member 5 (SLC2A5, Accession NM_003039), a gene which has probable role as a fructose transporter. Accordingly, utilities of VGAM206 include diagnosis, prevention and treatment of diseases and clinical conditions associated with SLC2A5. The function of SLC2A5 has been established by previous studies. Davidson et al. (1992) showed that the glucose transporter isoform, GLUT5, is expressed on the brush border membrane of human small intestinal enterocytes. Burant et al. (1992) showed further that GLUT5 is a fructose transporter and may be largely responsible for the uptake of fructose from the lumen of the small intestine. GLUT2, which is present on the basolateral membrane of enterocytes, probably mediates the efflux of fructose from these cells. In addition, GLUT5 is probably responsible for the uptake of fructose by spermatozoa. The pattern of GLUT5 immunoreactivity in maturing spermatids suggested that the expression of GLUT5 may serve as a marker for terminal maturation of male germ cells. An increasing fraction of calories consumed in Western diets is derived from fructose. Increases in fructose consumption have been implicated in a rising incidence of hypertriglyceridemia and hyperinsulinemia. Mutations in the small intestinal sodium/glucose cotransporter (OMIM Ref. No. 182380), which effectively abolish glucose uptake, have no effect on the absorption of fructose, indicating a separate fructose carrier protein. Using cDNA probes for Southern blotting of DNA from somatic cell hybrids and for in situ hybridization, Fan et al. (1989) showed that the GLUT5 gene (also symbolized SLC2A5) is located on chromosome 1. Also see Kayano et al. (1990). White et al. (1998) concluded that the correct assignment of SLC2A5 is 1p36.2. This was confirmed by use of somatic cell and radiation hybrid mapping panels and was consistent with previous EST mapping data. The carbonic anhydrase-6 (CA6; 114780) and alpha-enolase (ENO1; 172430) genes were physically linked to SLCA5 in yeast- and P1-artificial chromosome (YAC and PAC) contigs. PACs from the contig were mapped to 1p36.2 by fluorescence in situ hybridization.

Full details of the abovementioned studies are described in the following publications, the disclosure of which are hereby incorporated by reference:

Davidson, N. O.; Hausman, A. M. L.; Ifkovits, C. A.; Buse, J. B.; Gould, G. W.; Burant, C. F.; Bell, G. I.: Human intestinal glucose transporter expression and localization of GLUT5. Am. J. Physiol. 262: C795-C800, 1992; and White, P. S.; Jensen, S. J.; Rajalingam, V.; Stairs, D.; Sulman, E. P.; Maris, J. M.; Biegel, J. A.; Wooster, R.; Brodeur, G. M.: Physical mapping of the CA6, ENO1, and SLC2A5 (GLUT5) gene.

Further studies establishing the function and utilities of SLC2A5 are found in John Hopkins OMIM database record ID 138230, and in sited publications numbered 12195-12196, 1190 and 11911 listed in the bibliography section hereinbelow, which are also hereby incorporated by reference. Solute Carrier Family 9 (sodium/hydrogen exchanger), Isoform 1 (antiporter, Na+/H+, amiloride sensitive) (SLC9A1, Accession XM_046881) is another VGAM206 host target gene. SLC9A1 BINDING SITE is HOST TARGET binding site found in the 5' untranslated region of mRNA encoded by SLC9A1, corresponding to a HOST TARGET binding site such as BINDING SITE I, BINDING SITE II or BINDING SITE III. Table 2 illustrates the complementarity of the nucleotide sequences of SLC9A1 BINDING SITE, designated SEQ ID:34856, to the nucleotide sequence of VGAM206 RNA, herein designated VGAM RNA, also designated SEQ ID:2917.

Another function of VGAM206 is therefore inhibition of Solute Carrier Family 9 (sodium/hydrogen exchanger), Isoform 1 (antiporter, Na+/H+, amiloride sensitive) (SLC9A1, Accession XM_046881), a gene which is involved in ph regulation to eliminate acids generated by active metabolism or to counter adverse environmental conditions. Accordingly, utilities of VGAM206 include diagnosis, prevention and treatment of diseases and clinical conditions associated with SLC9A1. The function of SLC9A1 has been established by previous studies. Denker et al. (2000) showed that the plasma membrane ion exchanger NHE1 acts as an anchor for actin filaments to control the integrity of the cortical cytoskeleton. This occurs through a previously unrecognized structural link between NHE1 and the actin-binding proteins ezrin (OMIM Ref. No. 123900), radixin (OMIM Ref. No. 179410), and moesin (OMIM Ref. No. 309845), which are collectively referred to as ERM proteins. NHE1 and ERM proteins were found to associate directly and colocalize in lamellipodia. Fibroblasts expressing NHE1 with mutations that disrupted binding with ERM proteins but not ion translocation had impaired organization of focal adhesions and actin stress fibers and an irregular cell shape. Denker et al. (2000) proposed a structural role for NHE1 in regulating the cortical cytoskeleton that is independent of its function as an ion exchanger. The genomic probe reported by Mattei et al. (1987) was used to map the APNH gene to 1p36.1-p35 by in situ hybridization (Mattei et al., 1988). Mattei et al. (1989) used in situ hybridization of the human cDNA probe to map the antiporter gene to the distal portion of mouse chromosome 4 and to the long arm of Chinese hamster chromosome 2, confirming the conserved homology between the distal part of human chromosome 1p, the mouse distal 4, and Chinese hamster distal 2q. By the analysis of fragment length variations in recombinant inbred strains, Morahan and Rakar (1993) likewise mapped the Nhe1 gene to mouse chromosome 4, between Lck and Akp2. Lifton et al. (1990) used genomic clones of the SLC9A1 gene to identify 2 polymorphisms. Using these RFLPs in 59 reference families, they found that the antiporter gene lies 3 cM proximal to the RH locus. Dudley et al. (1990) PCR-amplified a 376-bp fragment corresponding to the 5-prime end of SLC9A1 and detected a polymorphism within this fragment by denaturing gradient gel electrophoresis. By genetic linkage studies, they mapped SLC9A1 telomeric to D1S57 and close to RH (OMIM Ref. No. 111700) and ALPL (OMIM Ref. No. 171760). They pointed out that SLC9A1 is a plausible candidate gene for human essential hypertension.

Full details of the abovementioned studies are described in the following publications, the disclosure of which are hereby incorporated by reference:

Denker, S. P.; Huang, D. C.; Orlowski, J.; Furthmayr, H.; Barber, D. L.: Direct binding of the Na-H exchanger NHE1 to ERM proteins regulates the cortical cytoskeleton and cell shape independently of H(+) translocation. Molec. Cell 6:1425-1436, 2000; and Dudley, C. R. K.; Giuffra, L. A.; Tippett, P.; Kidd, K. K.; Reeders, S. T.: The Na+/H+ antiporter: a 'melt' polymorphism allows regional mapping to the short arm of chromosome 1. Hum. G.

Further studies establishing the function and utilities of SLC9A1 are found in John Hopkins OMIM database record ID 107310, and in sited publications numbered 4068-4077 listed in the bibliography section hereinbelow, which are also hereby incorporated by reference. SWI/SNF Related, Matrix Associated, Actin Dependent Regulator of Chromatin, Subfamily C, Member 1 (SMARCC1, Accession NM_003074) is another VGAM206 host target gene. SMARCC1 BINDING SITE is HOST TARGET binding site found in the 3' untranslated region of mRNA encoded by SMARCC1, corresponding to a HOST TARGET binding site such as BINDING SITE I, BINDING SITE II or BINDING SITE III. Table 2 illustrates the complementarity of the nucleotide sequences of SMARCC1 BINDING SITE, designated SEQ ID:9042, to the nucleotide sequence of VGAM206 RNA, herein designated VGAM RNA, also designated SEQ ID:2917.

Another function of VGAM206 is therefore inhibition of SWI/SNF Related, Matrix Associated, Actin Dependent Regulator of Chromatin, Subfamily C, Member 1 (SMARCC1, Accession NM_003074), a gene which is involved in chromatin remodeling. Accordingly, utilities of VGAM206 include diagnosis, prevention and treatment of diseases and clinical conditions associated with SMARCC1. The function of SMARCC1 and its association with various diseases and clinical conditions, has been established by previous studies, as described hereinabove with reference to VGAM57. Steroidogenic Acute Regulatory Protein (STAR, Accession NM_000349) is another VGAM206 host target gene. STAR BINDING SITE is HOST TARGET binding site found in the 3' untranslated region of mRNA encoded by STAR, corresponding to a HOST TARGET binding site such as BINDING SITE I, BINDING SITE II or BINDING SITE III. Table 2 illustrates the complementarity of the nucleotide sequences of STAR BINDING SITE, designated SEQ ID:5905, to the nucleotide sequence of VGAM206 RNA, herein designated VGAM RNA, also designated SEQ ID:2917.

Another function of VGAM206 is therefore inhibition of Steroidogenic Acute Regulatory Protein (STAR, Accession NM_000349). Accordingly, utilities of VGAM206 include diagnosis, prevention and treatment of diseases and clinical conditions associated with STAR. Transporter 2, ATP-binding Cassette, Sub-family B (MDR/TAP) (TAP2, Accession NM_000544) is another VGAM206 host target gene. TAP2 BINDING SITE is HOST TARGET binding site found in the 3' untranslated region of mRNA encoded by TAP2, corresponding to a HOST TARGET binding site such as BINDING SITE I, BINDING SITE II or BINDING SITE III. Table 2 illustrates the complementarity of the nucleotide sequences of TAP2 BINDING SITE, designated SEQ ID:6143, to the nucleotide sequence of VGAM206 RNA, herein designated VGAM RNA, also designated SEQ ID:2917.

Another function of VGAM206 is therefore inhibition of Transporter 2, ATP-binding Cassette, Sub-family B (MDR/TAP) (TAP2, Accession NM_000544), a gene which is involved in the transport of antigens from the cytoplasm to a membrane-bound compartment for association with mhc class i molecules. Accordingly, utilities of VGAM206 include diagnosis, prevention and treatment of diseases and clinical conditions associated with TAP2. The function of TAP2 and its association with various diseases and clinical conditions, has been established by previous studies, as described hereinabove with reference to VGAM55. Tight Junction Protein 1 (zona occludens 1) (TJP1, Accession NM_003257) is another VGAM206 host target gene. TJP1 BINDING SITE is HOST TARGET binding site found in the 3' untranslated region of mRNA encoded by TJP1, corresponding to a HOST TARGET binding site such as BINDING SITE I, BINDING SITE II or BINDING SITE III. Table 2 illustrates the complementarity of the nucleotide sequences of TJP1 BINDING SITE, designated SEQ ID:9267, to the nucleotide sequence of VGAM206 RNA, herein designated VGAM RNA, also designated SEQ ID:2917.

Another function of VGAM206 is therefore inhibition of Tight Junction Protein 1 (zona occludens 1) (TJP1, Accession NM_003257), a gene which colocalizes and interacts with cadherins in cells lacking tight junctions. Accordingly, utilities of VGAM206 include diagnosis, prevention and treatment of diseases and clinical conditions associated with TJP1. The function of TJP1 and its association with various diseases and clinical conditions, has been established by previous studies, as described hereinabove with reference to VGAM95. Ubiquitin-like 1 (sentrin) (UBL1, Accession NM_003352) is another VGAM206 host target gene. UBL1 BINDING SITE is HOST TARGET binding site found in the 3' untranslated region of mRNA encoded by UBL1, corresponding to a HOST TARGET binding site such as BINDING SITE I, BINDING SITE II or BINDING SITE III. Table 2 illustrates the complementarity of the nucleotide sequences of UBL1 BINDING SITE, designated SEQ ID:9380, to the nucleotide sequence of VGAM206 RNA, herein designated VGAM RNA, also designated SEQ ID:2917.

Another function of VGAM206 is therefore inhibition of Ubiquitin-like 1 (sentrin) (UBL1, Accession NM_003352), a gene which generates proteins resistant to degradation through its modification. Accordingly, utilities of VGAM206 include diagnosis, prevention and treatment of diseases and clinical conditions associated with UBL1. The function of UBL1 has been established by previous studies. Activation of NF-kappa-B is achieved by ubiquitination and proteasome-mediated degradation of I-kappa-B-alpha (OMIM Ref. No. 164008). Desterro et al. (1998) detected modified I-kappa-B-alpha, conjugated to the small ubiquitin-like protein SUMO1, which is resistant to signal-induced degradation. Overexpression of SUMO1 inhibits signal-induced activation of NF-kappa-B-dependent transcription. SUMO1 modification of I-kappa-B-alpha is inhibited by phosphorylation. Thus, while ubiquitination targets proteins for rapid degradation, SUMO1 modification acts antagonistically to generate proteins resistant to degradation. Many antibiotics, anticancer drugs, toxins, carcinogens, and physiologic stresses abort the catalytic cycles of topoisomerases (see OMIM Ref. No. TOP1, 126420), resulting in topoisomerase-mediated DNA damage. Mao et al. (2000) showed that camptothecin, a TOP1-specific poison, can induce rapid and extensive conjugation of SUMO1 to human DNA. This and other observations suggested that SUMO1 may be involved in the repair of TOP1-mediated DNA damage.

Full details of the abovementioned studies are described in the following publications, the disclosure of which are hereby incorporated by reference:

Desterro, J. M. P.; Rodriguez, M. S.; Hay, R. T.: SUMO-1 modification of I-kappa-B-alpha inhibits NF-kappa-B activation. Molec. Cell 2:233-239, 1998; and Mao, Y.; Sun, M.; Desai, S. D.; Liu, L. F.: SUMO-1 conjugation to topoisomerase I: a possible repair response to topoisomerase-mediated DNA damage. Proc. Nat. Acad. Sci. 97:4046-4051.

Further studies establishing the function and utilities of UBL1 are found in John Hopkins OMIM database record ID 601912, and in sited publications numbered 9134-9139 listed in the bibliography section hereinbelow, which are also hereby incorporated by reference. Uracil-DNA Glycosylase (UNG, Accession NM_003362) is another VGAM206 host target gene. UNG BINDING SITE1 and UNG BINDING SITE2 are HOST TARGET binding sites found in untranslated regions of mRNA encoded by UNG, corresponding to HOST TARGET binding sites such as BINDING SITE I, BINDING SITE II or BINDING SITE III. Table 2 illustrates the complementarity of the nucleotide sequences of UNG BINDING SITE1 and UNG BINDING SITE2, designated SEQ ID:9390 and SEQ ID:28128 respectively, to the nucleotide sequence of VGAM206 RNA, herein designated VGAM RNA, also designated SEQ ID:2917.

Another function of VGAM206 is therefore inhibition of Uracil-DNA Glycosylase (UNG, Accession NM_003362), a gene which excises uracil residues from the dna to prevent mutagenesis and initiate the base-excision repair (BER) pathway. Accordingly, utilities of VGAM206 include diagnosis, prevention and treatment of diseases and clinical conditions associated with UNG. The function of UNG has been established by previous studies. Uracil DNA glycosylase removes uracil in DNA resulting from deamination of cytosine or replicative incorporation of dUMP instead of dTMP (Haug et al., 1996). Animal model experiments lend further support to the function of UNG. Nilsen et al. (2000) generated knockout mice lacking Ung. In contrast to Ung - mutants of bacteria and yeast, these mice did not exhibit a greatly increased spontaneous mutation frequency. There was, however, only slow removal of uracil from misincorporated dUMP in isolated Ung -/- nuclei and an elevated steady-state level of uracil in DNA in dividing Ung -/- cells. A backup uracil-excising activity in tissue extracts from Ung null mice, with properties indistinguishable from the mammalian SMUG1 DNA glycosylase, may account for the repair of premutagenic U:G mispairs resulting from cytosine deamination in vivo. The authors suggested that the nuclear UNG protein has evolved a specialized role in mammalian cells counteracting U:A base pairs formed by use of dUTP during DNA synthesis.

It is appreciated that the abovementioned animal model for UNG is acknowledged by those skilled in the art as a scientifically valid animal model, as can be further appreciated from the publications sited hereinbelow.

Full details of the abovementioned studies are described in the following publications, the disclosure of which are hereby incorporated by reference:

Haug, T.; Skorpen, F.; Kvaloy, K.; Eftedal, I.; Lund, H.; Krokan, H. E.: Human uracil-DNA glycosylase gene:

sequence organization, methylation pattern, and mapping to chromosome 12q23-q24.1. Genomics 36:408-416, 1996; and Nilsen, H.; Rosewell, I.; Robins, P.; Skjelbred, C. F.; Andersen, S.; Slupphaug, G.; Daly, G.; Krokan, H. E.; Lindahl, T.; Barnes, D. E.: Uracil-DNA glycosylase (UNG)-deficient mice rev.

Further studies establishing the function and utilities of UNG are found in John Hopkins OMIM database record ID 191525, and in sited publications numbered 12619-12626 listed in the bibliography section hereinbelow, which are also hereby incorporated by reference. Zinc Finger Protein 74 (Cos52) (ZNF74, Accession NM_003426) is another VGAM206 host target gene. ZNF74 BINDING SITE is HOST TARGET binding site found in the 3' untranslated region of mRNA encoded by ZNF74, corresponding to a HOST TARGET binding site such as BINDING SITE I, BINDING SITE II or BINDING SITE III. Table 2 illustrates the complementarity of the nucleotide sequences of ZNF74 BINDING SITE, designated SEQ ID:9471, to the nucleotide sequence of VGAM206 RNA, herein designated VGAM RNA, also designated SEQ ID:2917.

Another function of VGAM206 is therefore inhibition of Zinc Finger Protein 74 (Cos52) (ZNF74, Accession NM_003426). Accordingly, utilities of VGAM206 include diagnosis, prevention and treatment of diseases and clinical conditions associated with ZNF74. ATP-binding Cassette, Sub-family C (CFTR/MRP), Member 13 (ABCC13, Accession NM_138726) is another VGAM206 host target gene. ABCC13 BINDING SITE is HOST TARGET binding site found in the 3' untranslated region of mRNA encoded by ABCC13, corresponding to a HOST TARGET binding site such as BINDING SITE I, BINDING SITE II or BINDING SITE III. Table 2 illustrates the complementarity of the nucleotide sequences of ABCC13 BINDING SITE, designated SEQ ID:28974, to the nucleotide sequence of VGAM206 RNA, herein designated VGAM RNA, also designated SEQ ID:2917.

Another function of VGAM206 is therefore inhibition of ATP-binding Cassette, Sub-family C (CFTR/MRP), Member 13 (ABCC13, Accession NM_138726). Accordingly, utilities of VGAM206 include diagnosis, prevention and treatment of diseases and clinical conditions associated with ABCC13. Amyotrophic Lateral Sclerosis 2 (juvenile) Chromosome Region, Candidate 3 (ALS2CR3, Accession NM_015049) is another VGAM206 host target gene. ALS2CR3 BINDING SITE is HOST TARGET binding site found in the 5' untranslated region of mRNA encoded by ALS2CR3, corresponding to a HOST TARGET binding site such as BINDING SITE I, BINDING SITE II or BINDING SITE III. Table 2 illustrates the complementarity of the nucleotide sequences of ALS2CR3 BINDING SITE, designated SEQ ID:17414, to the nucleotide sequence of VGAM206 RNA, herein designated VGAM RNA, also designated SEQ ID:2917.

Another function of VGAM206 is therefore inhibition of Amyotrophic Lateral Sclerosis 2 (juvenile) Chromosome Region, Candidate 3 (ALS2CR3, Accession NM_015049). Accordingly, utilities of VGAM206 include diagnosis, prevention and treatment of diseases and clinical conditions associated with ALS2CR3. AP1 Gamma Subunit Binding Protein 1 (AP1GBP1, Accession NM_080551) is another VGAM206 host target gene. AP1GBP1 BINDING SITE1 through AP1GBP1 BINDING SITE5 are HOST TARGET binding sites found in untranslated regions of mRNA encoded by AP1GBP1, corresponding to HOST TARGET binding sites such as BINDING SITE I, BINDING SITE II or BINDING SITE III. Table 2 illustrates the complementarity of the nucleotide sequences of AP1GBP1 BINDING SITE1 through AP1GBP1 BINDING SITE5, designated SEQ ID:27882, SEQ ID:27874, SEQ ID:14118, SEQ ID:27873 and SEQ ID:14119 respectively, to the nucleotide sequence of VGAM206 RNA, herein designated VGAM RNA, also designated SEQ ID:2917.

Another function of VGAM206 is therefore inhibition of AP1 Gamma Subunit Binding Protein 1 (AP1GBP1, Accession NM_080551). Accordingly, utilities of VGAM206 include diagnosis, prevention and treatment of diseases and clinical conditions associated with AP1GBP1. Chromosome 20 Open Reading Frame 164 (C20orf164, Accession XM_086633) is another VGAM206 host target gene. C20orf164 BINDING SITE is HOST TARGET binding site found in the 5' untranslated region of mRNA encoded by C20orf164, corresponding to a HOST TARGET binding site such as BINDING SITE I, BINDING SITE II or BINDING SITE III. Table 2 illustrates the complementarity of the nucleotide sequences of C20orf164 BINDING SITE, designated SEQ ID:38802, to the nucleotide sequence of VGAM206 RNA, herein designated VGAM RNA, also designated SEQ ID:2917.

Another function of VGAM206 is therefore inhibition of Chromosome 20 Open Reading Frame 164 (C20orf164, Accession XM_086633). Accordingly, utilities of VGAM206 include diagnosis, prevention and treatment of diseases and clinical conditions associated with C20orf164. Chromosome 20 Open Reading Frame 177 (C20orf177, Accession XM_030726) is another VGAM206 host target gene. C20orf177 BINDING SITE is HOST TARGET binding site found in the 3' untranslated region of mRNA encoded by C20orf177, corresponding to a HOST TARGET binding site such as BINDING SITE I, BINDING SITE II or BINDING SITE III. Table 2 illustrates the complementarity of the nucleotide sequences of C20orf177 BINDING SITE, designated SEQ ID:31129, to the nucleotide sequence of VGAM206 RNA, herein designated VGAM RNA, also designated SEQ ID:2917.

Another function of VGAM206 is therefore inhibition of Chromosome 20 Open Reading Frame 177 (C20orf177, Accession XM_030726). Accordingly, utilities of VGAM206 include diagnosis, prevention and treatment of diseases and clinical conditions associated with C20orf177. COAS3 (Accession NM_139020) is another VGAM206 host target gene. COAS3 BINDING SITE is HOST TARGET binding site found in the 3' untranslated region of mRNA encoded by COAS3, corresponding to a HOST TARGET binding site such as BINDING SITE I, BINDING SITE II or BINDING SITE III. Table 2 illustrates the complementarity of the nucleotide sequences of COAS3 BINDING SITE, designated SEQ ID:29123, to the nucleotide sequence of VGAM206 RNA, herein designated VGAM RNA, also designated SEQ ID:2917.

Another function of VGAM206 is therefore inhibition of COAS3 (Accession NM_139020). Accordingly, utilities of VGAM206 include diagnosis, prevention and treatment of diseases and clinical conditions associated with COAS3. COP9 Constitutive Photomorphogenic Homolog Subunit 7B (Arabidopsis) (COPS7B, Accession NM_022730) is another VGAM206 host target gene. COPS7B BINDING SITE is HOST TARGET binding site found in the 3' untranslated region of mRNA encoded by COPS7B, corresponding to a HOST TARGET binding site such as BINDING SITE I, BINDING SITE II or BINDING SITE III. Table 2 illustrates the complementarity of the nucleotide sequences of COPS7B BINDING SITE, designated SEQ ID:22932, to the nucleotide sequence of VGAM206 RNA, herein designated VGAM RNA, also designated SEQ ID:2917.

Another function of VGAM206 is therefore inhibition of COP9 Constitutive Photomorphogenic Homolog Subunit 7B (Arabidopsis) (COPS7B, Accession NM_022730). Accordingly, utilities of VGAM206 include diagnosis, prevention and treatment of diseases and clinical conditions associated with COPS7B. CSL4 (Accession NM_016046) is another VGAM206 host target gene. CSL4 BINDING SITE is HOST TARGET binding site found in the 3' untranslated region of mRNA encoded by CSL4, corresponding to a HOST TARGET binding site such as BINDING SITE I, BINDING SITE II or BINDING SITE III. Table 2 illustrates the complementarity of the nucleotide sequences of CSL4 BINDING SITE, designated SEQ ID:18126, to the nucleotide sequence of VGAM206 RNA, herein designated VGAM RNA, also designated SEQ ID:2917.

Another function of VGAM206 is therefore inhibition of CSL4 (Accession NM_016046). Accordingly, utilities of VGAM206 include diagnosis, prevention and treatment of diseases and clinical conditions associated with CSL4. Doublecortin and CaM Kinase-like 1 (DCAMKL1, Accession NM_004734) is another VGAM206 host target gene. DCAMKL1 BINDING SITE is HOST TARGET binding site found in the 3' untranslated region of mRNA encoded by DCAMKL1, corresponding to a HOST TARGET binding site such as BINDING SITE I, BINDING SITE II or BINDING SITE III. Table 2 illustrates the complementarity of the nucleotide sequences of DCAMKL1 BINDING SITE, designated SEQ ID:11113, to the nucleotide sequence of VGAM206 RNA, herein designated VGAM RNA, also designated SEQ ID:2917.

Another function of VGAM206 is therefore inhibition of Doublecortin and CaM Kinase-like 1 (DCAMKL1, Accession NM_004734). Accordingly, utilities of VGAM206 include diagnosis, prevention and treatment of diseases and clinical conditions associated with DCAMKL1. DEAD/H (Asp-Glu-Ala-Asp/His) Box Polypeptide 34 (DDX34, Accession NM_014681) is another VGAM206 host target gene. DDX34 BINDING SITE is HOST TARGET binding site found in the 5' untranslated region of mRNA encoded by DDX34, corresponding to a HOST TARGET binding site such as BINDING SITE I, BINDING SITE II or BINDING SITE III. Table 2 illustrates the complementarity of the nucleotide sequences of DDX34 BINDING SITE, designated SEQ ID:16159, to the nucleotide sequence of VGAM206 RNA, herein designated VGAM RNA, also designated SEQ ID:2917.

Another function of VGAM206 is therefore inhibition of DEAD/H (Asp-Glu-Ala-Asp/His) Box Polypeptide 34 (DDX34, Accession NM_014681). Accordingly, utilities of VGAM206 include diagnosis, prevention and treatment of diseases and clinical conditions associated with DDX34. DKFZp434C0328 (Accession NM_017577) is another VGAM206 host target gene. DKFZp434C0328 BINDING SITE is HOST TARGET binding site found in the 5' untranslated region of mRNA encoded by DKFZp434C0328, corresponding to a HOST TARGET binding site such as BINDING SITE I, BINDING SITE II or BINDING SITE III. Table 2 illustrates the complementarity of the nucleotide sequences of DKFZp434C0328 BINDING SITE, designated SEQ ID:19016, to the nucleotide sequence of VGAM206 RNA, herein designated VGAM RNA, also designated SEQ ID:2917.

Another function of VGAM206 is therefore inhibition of DKFZp434C0328 (Accession NM_017577). Accordingly, utilities of VGAM206 include diagnosis, prevention and treatment of diseases and clinical conditions associated with DKFZp434C0328. DKFZP434H132 (Accession XM_057020) is another VGAM206 host target gene. DKFZP434H132 BINDING SITE is HOST TARGET binding site found in the 5' untranslated region of mRNA encoded by DKFZP434H132, corresponding to a HOST TARGET binding site such as BINDING SITE I, BINDING SITE II or BINDING SITE III. Table 2 illustrates the complementarity of the nucleotide sequences of DKFZP434H132 BINDING SITE, designated SEQ ID:36451, to the nucleotide sequence of VGAM206 RNA, herein designated VGAM RNA, also designated SEQ ID:2917.

Another function of VGAM206 is therefore inhibition of DKFZP434H132 (Accession XM_057020). Accordingly, utilities of VGAM206 include diagnosis, prevention and treatment of diseases and clinical conditions associated with DKFZP434H132. DKFZP434L1435 (Accession XM_175250) is another VGAM206 host target gene. DKFZP434L1435 BINDING SITE1 through DKFZP434L1435 BINDING SITE3 are HOST TARGET binding sites found in untranslated regions of mRNA encoded by DKFZP434L1435, corresponding to HOST TARGET binding sites such as BINDING SITE I, BINDING SITE II or BINDING SITE III. Table 2 illustrates the complementarity of the nucleotide sequences of DKFZP434L1435 BINDING SITE1 through DKFZP434L1435 BINDING SITE3, designated SEQ ID:46703, SEQ ID:44269 and SEQ ID:46665 respectively, to the nucleotide sequence of VGAM206 RNA, herein designated VGAM RNA, also designated SEQ ID:2917.

Another function of VGAM206 is therefore inhibition of DKFZP434L1435 (Accession XM_175250). Accordingly, utilities of VGAM206 include diagnosis, prevention and treatment of diseases and clinical conditions associated with DKFZP434L1435. DKFZP564I052 (Accession XM_039660) is another VGAM206 host target gene. DKFZP564I052 BINDING SITE is HOST TARGET binding site found in the 3' untranslated region of mRNA encoded by DKFZP564I052, corresponding to a HOST TARGET binding site such as BINDING SITE I, BINDING SITE II or BINDING SITE III. Table 2 illustrates the complementarity of the nucleotide sequences of DKFZP564I052 BINDING SITE, designated SEQ ID:33137, to the nucleotide sequence of VGAM206 RNA, herein designated VGAM RNA, also designated SEQ ID:2917.

Another function of VGAM206 is therefore inhibition of DKFZP564I052 (Accession XM_039660). Accordingly, utilities of VGAM206 include diagnosis, prevention and treatment of diseases and clinical conditions associated with DKFZP564I052. DnaJ (Hsp40) Homolog, Subfamily A, Member 2 (DNAJA2, Accession XM_007963) is another VGAM206 host target gene. DNAJA2 BINDING SITE is HOST TARGET binding site found in the 3' untranslated region of mRNA encoded by DNAJA2, corresponding to a HOST TARGET binding site such as BINDING SITE I, BINDING SITE II or BINDING SITE III. Table 2 illustrates the complementarity of the nucleotide sequences of DNAJA2 BINDING SITE, designated SEQ ID:30069, to the nucleotide sequence of VGAM206 RNA, herein designated VGAM RNA, also designated SEQ ID:2917.

Another function of VGAM206 is therefore inhibition of DnaJ (Hsp40) Homolog, Subfamily A, Member 2 (DNAJA2, Accession XM_007963). Accordingly, utilities of VGAM206 include diagnosis, prevention and treatment of diseases and clinical conditions associated with DNAJA2. Docking Protein 4 (DOK4, Accession NM_018110) is another VGAM206 host target gene. DOK4 BINDING SITE is HOST TARGET binding site found in the 3' untranslated region of mRNA encoded by DOK4, corresponding to a HOST TARGET binding site such as BINDING SITE I, BINDING SITE II or BINDING SITE III. Table 2 illustrates the complementarity of the nucleotide sequences of DOK4 BINDING SITE, designated SEQ ID:19881, to the nucleotide sequence of VGAM206 RNA, herein designated VGAM RNA, also designated SEQ ID:2917.

Another function of VGAM206 is therefore inhibition of Docking Protein 4 (DOK4, Accession NM_018110). Accordingly, utilities of VGAM206 include diagnosis, prevention and treatment of diseases and clinical conditions associated with DOK4. Down Syndrome Critical Region Gene 1-like 1 (DSCR1L1, Accession NM_005822) is another VGAM206 host target gene. DSCR1L1 BINDING SITE is HOST TARGET binding site found in the 3' untranslated region of mRNA encoded by DSCR1L1, corresponding to a HOST TARGET binding site such as BINDING SITE I, BINDING SITE II or BINDING SITE III. Table 2 illustrates the complementarity of the nucleotide sequences of DSCR1L1 BINDING SITE, designated SEQ ID:12432, to the nucleotide sequence of VGAM206 RNA, herein designated VGAM RNA, also designated SEQ ID:2917.

Another function of VGAM206 is therefore inhibition of Down Syndrome Critical Region Gene 1-like 1 (DSCR1L1, Accession NM_005822). Accordingly, utilities of VGAM206 include diagnosis, prevention and treatment of diseases and clinical conditions associated with DSCR1L1. Eukaryotic Translation Initiation Factor 5 (EIF5, Accession NM_001969) is another VGAM206 host target gene. EIF5 BINDING SITE is HOST TARGET binding site found in the 5' untranslated region of mRNA encoded by EIF5, corresponding to a HOST TARGET binding site such as BINDING SITE I, BINDING SITE II or BINDING SITE III. Table 2 illustrates the complementarity of the nucleotide sequences of EIF5 BINDING SITE, designated SEQ ID:7699, to the nucleotide sequence of VGAM206 RNA, herein designated VGAM RNA, also designated SEQ ID:2917.

Another function of VGAM206 is therefore inhibition of Eukaryotic Translation Initiation Factor 5 (EIF5, Accession NM_001969). Accordingly, utilities of VGAM206 include diagnosis, prevention and treatment of diseases and clinical conditions associated with EIF5. FLJ10477 (Accession NM_018105) is another VGAM206 host target gene. FLJ10477 BINDING SITE is HOST TARGET binding site found in the 3' untranslated region of mRNA encoded by FLJ10477, corresponding to a HOST TARGET binding site such as BINDING SITE I, BINDING SITE II or BINDING SITE III. Table 2 illustrates the complementarity of the nucleotide sequences of FLJ10477 BINDING SITE, designated SEQ ID:19875, to the nucleotide sequence of VGAM206 RNA, herein designated VGAM RNA, also designated SEQ ID:2917.

Another function of VGAM206 is therefore inhibition of FLJ10477 (Accession NM_018105). Accordingly, utilities of VGAM206 include diagnosis, prevention and treatment of diseases and clinical conditions associated with FLJ10477. FLJ10781 (Accession NM_018215) is another VGAM206 host target gene. FLJ10781 BINDING SITE is HOST TARGET binding site found in the 3' untranslated region of mRNA encoded by FLJ10781, corresponding to a HOST TARGET binding site such as BINDING SITE I, BINDING SITE II or BINDING SITE III. Table 2 illustrates the complementarity of the nucleotide sequences of FLJ10781 BINDING SITE, designated SEQ ID:20140, to the nucleotide sequence of VGAM206 RNA, herein designated VGAM RNA, also designated SEQ ID:2917.

Another function of VGAM206 is therefore inhibition of FLJ10781 (Accession NM_018215). Accordingly, utilities of VGAM206 include diagnosis, prevention and treatment of diseases and clinical conditions associated with FLJ10781. FLJ10898 (Accession XM_002486) is another VGAM206 host target gene. FLJ10898 BINDING SITE is HOST TARGET binding site found in the 5' untranslated region of mRNA encoded by FLJ10898, corresponding to a HOST TARGET binding site such as BINDING SITE I, BINDING SITE II or BINDING SITE III. Table 2 illustrates the complementarity of the nucleotide sequences of FLJ10898 BINDING SITE, designated SEQ ID:29895, to the nucleotide sequence of VGAM206 RNA, herein designated VGAM RNA, also designated SEQ ID:2917.

Another function of VGAM206 is therefore inhibition of FLJ10898 (Accession XM_002486). Accordingly, utilities of VGAM206 include diagnosis, prevention and treatment of diseases and clinical conditions associated with FLJ10898. FLJ12221 (Accession XM_031342) is another VGAM206 host target gene. FLJ12221 BINDING SITE1 and FLJ12221 BINDING SITE2 are HOST TARGET binding sites found in untranslated regions of mRNA encoded by FLJ12221, corresponding to HOST TARGET binding sites such as BINDING SITE I, BINDING SITE II or BINDING SITE III. Table 2 illustrates the complementarity of the nucleotide sequences of FLJ12221 BINDING SITE1 and FLJ12221 BINDING SITE2, designated SEQ ID:31348 and SEQ ID:31347 respectively, to the nucleotide sequence of VGAM206 RNA, herein designated VGAM RNA, also designated SEQ ID:2917.

Another function of VGAM206 is therefore inhibition of FLJ12221 (Accession XM_031342). Accordingly, utilities of VGAM206 include diagnosis, prevention and treatment of diseases and clinical conditions associated with FLJ12221. FLJ12484 (Accession NM_022767) is another VGAM206 host target gene. FLJ12484 BINDING SITE1 through FLJ12484 BINDING SITE4 are HOST TARGET binding sites found in untranslated regions of mRNA encoded by FLJ12484, corresponding to HOST TARGET binding sites such as BINDING SITE I, BINDING SITE II or BINDING SITE III. Table 2 illustrates the complementarity of the nucleotide sequences of FLJ12484 BINDING SITE1 through FLJ12484 BINDING SITE4, designated SEQ ID:23021, SEQ ID:34519, SEQ ID:23022 and SEQ ID:34520 respectively, to the nucleotide sequence of VGAM206 RNA, herein designated VGAM RNA, also designated SEQ ID:2917.

Another function of VGAM206 is therefore inhibition of FLJ12484 (Accession NM_022767). Accordingly, utilities of VGAM206 include diagnosis, prevention and treatment of diseases and clinical conditions associated with FLJ12484. FLJ12707 (Accession NM_022067) is another VGAM206 host target gene. FLJ12707 BINDING SITE is HOST TARGET binding site found in the 3' untranslated region of mRNA encoded by FLJ12707, corresponding to a HOST TARGET binding site such as BINDING SITE I, BINDING SITE II or BINDING SITE III. Table 2 illustrates the complementarity of the nucleotide sequences of FLJ12707 BINDING SITE, designated SEQ ID:22609, to the nucleotide sequence of VGAM206 RNA, herein designated VGAM RNA, also designated SEQ ID:2917.

Another function of VGAM206 is therefore inhibition of FLJ12707 (Accession NM_022067). Accordingly, utilities of VGAM206 include diagnosis, prevention and treatment of diseases and clinical conditions associated with FLJ12707. FLJ13096 (Accession NM_025000) is another VGAM206 host target gene. FLJ13096 BINDING SITE is HOST TARGET binding site found in the 3' untranslated region of mRNA encoded by FLJ13096, corresponding to a HOST TARGET binding site such as BINDING SITE I, BINDING SITE II or BINDING SITE III. Table 2 illustrates the complementarity of the nucleotide sequences of FLJ13096 BINDING SITE, designated SEQ ID:24569, to the nucleotide sequence of VGAM206 RNA, herein designated VGAM RNA, also designated SEQ ID:2917.

Another function of VGAM206 is therefore inhibition of FLJ13096 (Accession NM_025000). Accordingly, utilities of VGAM206 include diagnosis, prevention and treatment of diseases and clinical conditions associated with FLJ13096. FLJ13984 (Accession NM_024770) is another VGAM206 host target gene. FLJ13984 BINDING SITE is HOST TARGET binding site found in the 3' untranslated region of mRNA encoded by FLJ13984, corresponding to a HOST TARGET binding site such as BINDING SITE I, BINDING SITE II or BINDING SITE III. Table 2 illustrates the complementarity of the nucleotide sequences of FLJ13984 BINDING SITE, designated SEQ ID:24131, to the nucleotide sequence of VGAM206 RNA, herein designated VGAM RNA, also designated SEQ ID:2917.

Another function of VGAM206 is therefore inhibition of FLJ13984 (Accession NM_024770). Accordingly, utilities of VGAM206 include diagnosis, prevention and treatment of diseases and clinical conditions associated with FLJ13984. FLJ14457 (Accession NM_032788) is another VGAM206 host target gene. FLJ14457 BINDING SITE is HOST TARGET binding site found in the 5' untranslated region of mRNA encoded by FLJ14457, corresponding to a HOST TARGET binding site such as BINDING SITE I, BINDING SITE II or BINDING SITE III. Table 2 illustrates the complementarity of the nucleotide sequences of FLJ14457 BINDING SITE, designated SEQ ID:26543, to the nucleotide sequence of VGAM206 RNA, herein designated VGAM RNA, also designated SEQ ID:2917.

Another function of VGAM206 is therefore inhibition of FLJ14457 (Accession NM_032788). Accordingly, utilities of VGAM206 include diagnosis, prevention and treatment of diseases and clinical conditions associated with FLJ14457. FLJ20051 (Accession NM_019087) is another VGAM206 host target gene. FLJ20051 BINDING SITE is HOST TARGET binding site found in the 3' untranslated region of mRNA encoded by FLJ20051, corresponding to a HOST TARGET binding site such as BINDING SITE I, BINDING SITE II or BINDING SITE III. Table 2 illustrates the complementarity of the nucleotide sequences of FLJ20051 BINDING SITE, designated SEQ ID:21164, to the nucleotide sequence of VGAM206 RNA, herein designated VGAM RNA, also designated SEQ ID:2917.

Another function of VGAM206 is therefore inhibition of FLJ20051 (Accession NM_019087). Accordingly, utilities of VGAM206 include diagnosis, prevention and treatment of diseases and clinical conditions associated with FLJ20051. FLJ20508 (Accession NM_017850) is another VGAM206 host target gene. FLJ20508 BINDING SITE is HOST TARGET binding site found in the 3' untranslated region of mRNA encoded by FLJ20508, corresponding to a HOST TARGET binding site such as BINDING SITE I, BINDING SITE II or BINDING SITE III. Table 2 illustrates the complementarity of the nucleotide sequences of FLJ20508 BINDING SITE, designated SEQ ID:19521, to the nucleotide sequence of VGAM206 RNA, herein designated VGAM RNA, also designated SEQ ID:2917.

Another function of VGAM206 is therefore inhibition of FLJ20508 (Accession NM_017850). Accordingly, utilities of VGAM206 include diagnosis, prevention and treatment of diseases and clinical conditions associated with FLJ20508. FLJ20984 (Accession NM_024630) is another VGAM206 host target gene. FLJ20984 BINDING SITE is HOST TARGET binding site found in the 3' untranslated region of mRNA encoded by FLJ20984, corresponding to a HOST TARGET binding site such as BINDING SITE I, BINDING SITE II or BINDING SITE III. Table 2 illustrates the complementarity of the nucleotide sequences of FLJ20984 BINDING SITE, designated SEQ ID:23896, to the nucleotide sequence of VGAM206 RNA, herein designated VGAM RNA, also designated SEQ ID:2917.

Another function of VGAM206 is therefore inhibition of FLJ20984 (Accession NM_024630). Accordingly, utilities of VGAM206 include diagnosis, prevention and treatment of diseases and clinical conditions associated with FLJ20984. FLJ21302 (Accession NM_022901) is another VGAM206 host target gene. FLJ21302 BINDING SITE is HOST TARGET binding site found in the 3' untranslated region of mRNA encoded by FLJ21302, corresponding to a HOST TARGET binding site such as BINDING SITE I, BINDING SITE II or BINDING SITE III. Table 2 illustrates the complementarity of the nucleotide sequences of FLJ21302 BINDING SITE, designated SEQ ID:23187, to the nucleotide sequence of VGAM206 RNA, herein designated VGAM RNA, also designated SEQ ID:2917.

Another function of VGAM206 is therefore inhibition of FLJ21302 (Accession NM_022901). Accordingly, utilities of VGAM206 include diagnosis, prevention and treatment of diseases and clinical conditions associated with FLJ21302. FLJ22283 (Accession NM_032220) is another VGAM206 host target gene. FLJ22283 BINDING SITE is HOST TARGET binding site found in the 5' untranslated region of mRNA encoded by FLJ22283, corresponding to a HOST TARGET binding site such as BINDING SITE I, BINDING SITE II or BINDING SITE III. Table 2 illustrates the complementarity of the nucleotide sequences of FLJ22283 BINDING SITE, designated SEQ ID:25948, to the nucleotide sequence of VGAM206 RNA, herein designated VGAM RNA, also designated SEQ ID:2917.

Another function of VGAM206 is therefore inhibition of FLJ22283 (Accession NM_032220). Accordingly, utilities of VGAM206 include diagnosis, prevention and treatment of diseases and clinical conditions associated with FLJ22283. FLJ31951 (Accession NM_144726) is another VGAM206 host target gene. FLJ31951 BINDING SITE is HOST TARGET binding site found in the 3' untranslated region of mRNA encoded by FLJ31951, corresponding to a HOST TARGET binding site such as BINDING SITE I, BINDING SITE II or BINDING SITE III. Table 2 illustrates the complementarity of the nucleotide sequences of FLJ31951 BINDING SITE, designated SEQ ID:29553, to the nucleotide sequence of VGAM206 RNA, herein designated VGAM RNA, also designated SEQ ID:2917.

Another function of VGAM206 is therefore inhibition of FLJ31951 (Accession NM_144726). Accordingly, utilities of VGAM206 include diagnosis, prevention and treatment of diseases and clinical conditions associated with FLJ31951. Golgi Autoantigen, Golgin Subfamily A, 1 (GOLGA1, Accession NM_002077) is another VGAM206 host target gene. GOLGA1 BINDING SITE is HOST TARGET binding site found in the 3' untranslated region of mRNA encoded by GOLGA1, corresponding to a HOST TARGET binding site such as BINDING SITE I, BINDING SITE II or BINDING SITE III. Table 2 illustrates the complementarity of the nucleotide sequences of GOLGA1 BINDING SITE, designated SEQ ID:7866, to the nucleotide sequence of VGAM206 RNA, herein designated VGAM RNA, also designated SEQ ID:2917.

Another function of VGAM206 is therefore inhibition of Golgi Autoantigen, Golgin Subfamily A, 1 (GOLGA1, Accession NM_002077). Accordingly, utilities of VGAM206 include diagnosis, prevention and treatment of diseases and clinical conditions associated with GOLGA1. HTGN29 (Accession NM_020199) is another VGAM206 host target gene. HTGN29 BINDING SITE is HOST TARGET binding site found in the 5' untranslated region of mRNA encoded by HTGN29, corresponding to a HOST TARGET binding site such as BINDING SITE I, BINDING SITE II or BINDING SITE III. Table 2 illustrates the complementarity of the nucleotide sequences of HTGN29 BINDING SITE, designated SEQ ID:21434, to the nucleotide sequence of VGAM206 RNA, herein designated VGAM RNA, also designated SEQ ID:2917.

Another function of VGAM206 is therefore inhibition of HTGN29 (Accession NM_020199). Accordingly, utilities of VGAM206 include diagnosis, prevention and treatment of diseases and clinical conditions associated with HTGN29. Interleukin 14 (IL14, Accession XM_170924) is another VGAM206 host target gene. IL14 BINDING SITE is HOST TARGET binding site found in the 5' untranslated region of mRNA encoded by IL14, corresponding to a HOST TARGET binding site such as BINDING SITE I, BINDING SITE II or BINDING SITE III. Table 2 illustrates the complementarity of the nucleotide sequences of IL14 BINDING SITE, designated SEQ ID:45703, to the nucleotide sequence of VGAM206 RNA, herein designated VGAM RNA, also designated SEQ ID:2917.

Another function of VGAM206 is therefore inhibition of Interleukin 14 (IL14, Accession XM_170924). Accordingly, utilities of VGAM206 include diagnosis, prevention and treatment of diseases and clinical conditions associated with IL14. KBRAS2 (Accession NM_017595) is another VGAM206 host target gene. KBRAS2 BINDING SITE is HOST TARGET binding site found in the 3' untranslated region of mRNA encoded by KBRAS2, corresponding to a HOST TARGET binding site such as BINDING SITE I, BINDING SITE II or BINDING SITE III. Table 2 illustrates the complementarity of the nucleotide sequences of KBRAS2 BINDING SITE, designated SEQ ID:19048, to the nucleotide sequence of VGAM206 RNA, herein designated VGAM RNA, also designated SEQ ID:2917.

Another function of VGAM206 is therefore inhibition of KBRAS2 (Accession NM_017595). Accordingly, utilities of VGAM206 include diagnosis, prevention and treatment of diseases and clinical conditions associated with KBRAS2. Potassium Voltage-gated Channel, Shab-related Subfamily, Member 2 (KCNB2, Accession XM_171186) is another VGAM206 host target gene. KCNB2 BINDING SITE is HOST TARGET binding site found in the 5' untranslated region of mRNA encoded by KCNB2, corresponding to a HOST TARGET binding site such as BINDING SITE I, BINDING SITE II or BINDING SITE III. Table 2 illustrates the complementarity of the nucleotide sequences of KCNB2 BINDING SITE, designated SEQ ID:45965, to the nucleotide sequence of VGAM206 RNA, herein designated VGAM RNA, also designated SEQ ID:2917.

Another function of VGAM206 is therefore inhibition of Potassium Voltage-gated Channel, Shab-related Subfamily, Member 2 (KCNB2, Accession XM_171186). Accordingly, utilities of VGAM206 include diagnosis, prevention and treatment of diseases and clinical conditions associated with KCNB2. KIAA0227 (Accession XM_027236) is another VGAM206 host target gene. KIAA0227 BINDING SITE is HOST TARGET binding site found in the 3' untranslated region of mRNA encoded by KIAA0227, corresponding to a HOST TARGET binding site such as BINDING SITE I, BINDING SITE II or BINDING SITE III. Table 2 illustrates the complementarity of the nucleotide sequences of KIAA0227 BINDING SITE, designated SEQ ID:30457, to the nucleotide sequence of VGAM206 RNA, herein designated VGAM RNA, also designated SEQ ID:2917.

Another function of VGAM206 is therefore inhibition of KIAA0227 (Accession XM_027236). Accordingly, utilities of VGAM206 include diagnosis, prevention and treatment of diseases and clinical conditions associated with KIAA0227. KIAA0332 (Accession XM_031553) is another VGAM206 host target gene. KIAA0332 BINDING SITE is HOST TARGET binding site found in the 3' untranslated region of mRNA encoded by KIAA0332, corresponding to a HOST TARGET binding site such as BINDING SITE I, BINDING SITE II or BINDING SITE III. Table 2 illustrates the complementarity of the nucleotide sequences of KIAA0332 BINDING SITE, designated SEQ ID:31419, to the nucleotide sequence of VGAM206 RNA, herein designated VGAM RNA, also designated SEQ ID:2917.

Another function of VGAM206 is therefore inhibition of KIAA0332 (Accession XM_031553). Accordingly, utilities of VGAM206 include diagnosis, prevention and treatment of diseases and clinical conditions associated with KIAA0332. KIAA0416 (Accession NM_015564) is another VGAM206 host target gene. KIAA0416 BINDING SITE is HOST TARGET binding site found in the 5' untranslated region of mRNA encoded by KIAA0416, corresponding to a HOST TARGET binding site such as BINDING SITE I, BINDING SITE II or BINDING SITE III. Table 2 illustrates the complementarity of the nucleotide sequences of KIAA0416 BINDING SITE, designated SEQ ID:17839, to the nucleotide sequence of VGAM206 RNA, herein designated VGAM RNA, also designated SEQ ID:2917.

Another function of VGAM206 is therefore inhibition of KIAA0416 (Accession NM_015564). Accordingly, utilities of VGAM206 include diagnosis, prevention and treatment of diseases and clinical conditions associated with KIAA0416. KIAA0469 (Accession NM_014851) is another VGAM206 host target gene. KIAA0469 BINDING SITE is HOST TARGET binding site found in the 3' untranslated region of mRNA encoded by KIAA0469, corresponding to a HOST TARGET binding site such as BINDING SITE I, BINDING SITE II or BINDING SITE III. Table 2 illustrates the complementarity of the nucleotide sequences of KIAA0469 BINDING SITE, designated SEQ ID:16896, to the nucleotide sequence of VGAM206 RNA, herein designated VGAM RNA, also designated SEQ ID:2917.

Another function of VGAM206 is therefore inhibition of KIAA0469 (Accession NM_014851). Accordingly, utilities of VGAM206 include diagnosis, prevention and treatment of diseases and clinical conditions associated with KIAA0469. KIAA0620 (Accession XM_030707) is another VGAM206 host target gene. KIAA0620 BINDING SITE is HOST TARGET binding site found in the 3' untranslated region of mRNA encoded by KIAA0620, corresponding to a HOST TARGET binding site such as BINDING SITE I, BINDING SITE II or BINDING SITE III. Table 2 illustrates the complementarity of the nucleotide sequences of KIAA0620 BINDING SITE, designated SEQ ID:31121, to the nucleotide sequence of VGAM206 RNA, herein designated VGAM RNA, also designated SEQ ID:2917.

Another function of VGAM206 is therefore inhibition of KIAA0620 (Accession XM_030707). Accordingly, utilities of VGAM206 include diagnosis, prevention and treatment of diseases and clinical conditions associated with KIAA0620. KIAA0748 (Accession NM_014796) is another VGAM206 host target gene. KIAA0748 BINDING SITE is HOST TARGET binding site found in the 3' untranslated region of mRNA encoded by KIAA0748, corresponding to a HOST TARGET binding site such as BINDING SITE I, BINDING SITE II or BINDING SITE III. Table 2 illustrates the complementarity of the nucleotide sequences of KIAA0748 BINDING SITE, designated SEQ ID:16705, to the nucleotide sequence of VGAM206 RNA, herein designated VGAM RNA, also designated SEQ ID:2917.

Another function of VGAM206 is therefore inhibition of KIAA0748 (Accession NM_014796). Accordingly, utilities of VGAM206 include diagnosis, prevention and treatment of diseases and clinical conditions associated with KIAA0748. KIAA0763 (Accession NM_014869) is another VGAM206 host target gene. KIAA0763 BINDING SITE is HOST TARGET binding site found in the 3' untranslated region of mRNA encoded by KIAA0763, corresponding to a HOST TARGET binding site such as BINDING SITE I, BINDING SITE II or BINDING SITE III. Table 2 illustrates the complementarity of the nucleotide sequences of KIAA0763 BINDING SITE, designated SEQ ID:16971, to the nucleotide sequence of VGAM206 RNA, herein designated VGAM RNA, also designated SEQ ID:2917.

Another function of VGAM206 is therefore inhibition of KIAA0763 (Accession NM_014869). Accordingly, utilities of VGAM206 include diagnosis, prevention and treatment of diseases and clinical conditions associated with KIAA0763. KIAA0836 (Accession XM_035390) is another VGAM206 host target gene. KIAA0836 BINDING SITE is HOST TARGET binding site found in the 5' untranslated region of mRNA encoded by KIAA0836, corresponding to a HOST TARGET binding site such as BINDING SITE I, BINDING SITE II or BINDING SITE III. Table 2 illustrates the complementarity of the nucleotide sequences of KIAA0836 BINDING SITE, designated SEQ ID:32251, to the nucleotide sequence of VGAM206 RNA, herein designated VGAM RNA, also designated SEQ ID:2917.

Another function of VGAM206 is therefore inhibition of KIAA0836 (Accession XM_035390). Accordingly, utilities of VGAM206 include diagnosis, prevention and treatment of diseases and clinical conditions associated with KIAA0836. KIAA0930 (Accession XM_047214) is another VGAM206 host target gene. KIAA0930 BINDING SITE is HOST TARGET binding site found in the 3' untranslated region of mRNA encoded by KIAA0930, corresponding to a HOST TARGET binding site such as BINDING SITE I, BINDING SITE II or BINDING SITE III. Table 2 illustrates the complementarity of the nucleotide sequences of KIAA0930 BINDING SITE, designated SEQ ID:34919, to the nucleotide sequence of VGAM206 RNA, herein designated VGAM RNA, also designated SEQ ID:2917.

Another function of VGAM206 is therefore inhibition of KIAA0930 (Accession XM_047214). Accordingly, utilities of VGAM206 include diagnosis, prevention and treatment of diseases and clinical conditions associated with KIAA0930. KIAA1026 (Accession XM_048825) is another VGAM206 host target gene. KIAA1026 BINDING SITE is HOST TARGET binding site found in the 3' untranslated region of mRNA encoded by KIAA1026, corresponding to a HOST TARGET binding site such as BINDING SITE I, BINDING SITE II or BINDING SITE III. Table 2 illustrates the complementarity of the nucleotide sequences of KIAA1026 BINDING SITE, designated SEQ ID:35279, to the nucleotide sequence of VGAM206 RNA, herein designated VGAM RNA, also designated SEQ ID:2917.

Another function of VGAM206 is therefore inhibition of KIAA1026 (Accession XM_048825). Accordingly, utilities of VGAM206 include diagnosis, prevention and treatment of diseases and clinical conditions associated with KIAA1026. KIAA1056 (Accession NM_014894) is another VGAM206 host target gene. KIAA1056 BINDING SITE is HOST TARGET binding site found in the 3' untranslated region of mRNA encoded by KIAA1056, corresponding to a HOST TARGET binding site such as BINDING SITE I, BINDING SITE II or BINDING SITE III. Table 2 illustrates the complementarity of the nucleotide sequences of KIAA1056 BINDING SITE, designated SEQ ID:17051, to the nucleotide sequence of VGAM206 RNA, herein designated VGAM RNA, also designated SEQ ID:2917.

Another function of VGAM206 is therefore inhibition of KIAA1056 (Accession NM_014894). Accordingly, utilities of VGAM206 include diagnosis, prevention and treatment of diseases and clinical conditions associated with KIAA1056. KIAA1078 (Accession XM_036589) is another VGAM206 host target gene. KIAA1078 BINDING SITE is HOST TARGET binding site found in the 3' untranslated region of mRNA encoded by KIAA1078, corresponding to a HOST TARGET binding site such as BINDING SITE I, BINDING SITE II or BINDING SITE III. Table 2 illustrates the complementarity of the nucleotide sequences of KIAA1078 BINDING SITE, designated SEQ ID:32475, to the nucleotide sequence of VGAM206 RNA, herein designated VGAM RNA, also designated SEQ ID:2917.

Another function of VGAM206 is therefore inhibition of KIAA1078 (Accession XM_036589). Accordingly, utilities of VGAM206 include diagnosis, prevention and treatment of diseases and clinical conditions associated with KIAA1078. KIAA1171 (Accession XM_113868) is another VGAM206 host target gene. KIAA1171 BINDING SITE1 and KIAA1171 BINDING SITE2 are HOST TARGET binding sites found in untranslated regions of mRNA encoded by KIAA1171, corresponding to HOST TARGET binding sites such as BINDING SITE I, BINDING SITE II or BINDING SITE III. Table 2 illustrates the complementarity of the nucleotide sequences of KIAA1171 BINDING SITE1 and KIAA1171 BINDING SITE2, designated SEQ ID:42484 and SEQ ID:42483 respectively, to the nucleotide sequence of VGAM206 RNA, herein designated VGAM RNA, also designated SEQ ID:2917.

Another function of VGAM206 is therefore inhibition of KIAA1171 (Accession XM_113868). Accordingly, utilities of VGAM206 include diagnosis, prevention and treatment of diseases and clinical conditions associated with KIAA1171. KIAA1297 (Accession XM_051005) is another VGAM206 host target gene. KIAA1297 BINDING SITE is HOST TARGET binding site found in the 3' untranslated region of mRNA encoded by KIAA1297, corresponding to a HOST TARGET binding site such as BINDING SITE I, BINDING SITE II or BINDING SITE III. Table 2 illustrates the complementarity of the nucleotide sequences of KIAA1297 BINDING SITE, designated SEQ ID:35719, to the nucleotide sequence of VGAM206 RNA, herein designated VGAM RNA, also designated SEQ ID:2917.

Another function of VGAM206 is therefore inhibition of KIAA1297 (Accession XM_051005). Accordingly, utilities of VGAM206 include diagnosis, prevention and treatment of diseases and clinical conditions associated with KIAA1297. KIAA1354 (Accession XM_027604) is another VGAM206 host target gene. KIAA1354 BINDING SITE is HOST TARGET binding site found in the 3' untranslated region of mRNA encoded by KIAA1354, corresponding to a HOST TARGET binding site such as BINDING SITE I, BINDING SITE II or BINDING SITE III. Table 2 illustrates the complementarity of the nucleotide sequences of KIAA1354 BINDING SITE, designated SEQ ID:30542, to the nucleotide sequence of VGAM206 RNA, herein designated VGAM RNA, also designated SEQ ID:2917.

Another function of VGAM206 is therefore inhibition of KIAA1354 (Accession XM_027604). Accordingly, utilities of VGAM206 include diagnosis, prevention and treatment of diseases and clinical conditions associated with KIAA1354. KIAA1391 (Accession XM_040866) is another VGAM206 host target gene. KIAA1391 BINDING SITE is HOST TARGET binding site found in the 3' untranslated region of mRNA encoded by KIAA1391, corresponding to a HOST TARGET binding site such as BINDING SITE I, BINDING SITE II or BINDING SITE III. Table 2 illustrates the complementarity of the nucleotide sequences of KIAA1391 BINDING SITE, designated SEQ ID:33403, to the nucleotide sequence of VGAM206 RNA, herein designated VGAM RNA, also designated SEQ ID:2917.

Another function of VGAM206 is therefore inhibition of KIAA1391 (Accession XM_040866). Accordingly, utilities of VGAM206 include diagnosis, prevention and treatment of diseases and clinical conditions associated with KIAA1391. KIAA1571 (Accession XM_027744) is another VGAM206 host target gene. KIAA1571 BINDING SITE is HOST TARGET binding site found in the 3' untranslated region of mRNA encoded by KIAA1571, corresponding to a HOST TARGET binding site such as BINDING SITE I, BINDING SITE II or BINDING SITE III. Table 2 illustrates the complementarity of the nucleotide sequences of KIAA1571 BINDING SITE, designated SEQ ID:30568, to the nucleotide sequence of VGAM206 RNA, herein designated VGAM RNA, also designated SEQ ID:2917.

Another function of VGAM206 is therefore inhibition of KIAA1571 (Accession XM_027744). Accordingly, utilities of VGAM206 include diagnosis, prevention and treatment of diseases and clinical conditions associated with KIAA1571. KIAA1753 (Accession XM_036115) is another VGAM206 host target gene. KIAA1753 BINDING SITE is HOST TARGET binding site found in the 3' untranslated region of mRNA encoded by KIAA1753, corresponding to a HOST TARGET binding site such as BINDING SITE I, BINDING SITE II or BINDING SITE III. Table 2 illustrates the complementarity of the nucleotide sequences of KIAA1753 BINDING SITE, designated SEQ ID:32382, to the nucleotide sequence of VGAM206 RNA, herein designated VGAM RNA, also designated SEQ ID:2917.

Another function of VGAM206 is therefore inhibition of KIAA1753 (Accession XM_036115). Accordingly, utilities of VGAM206 include diagnosis, prevention and treatment of diseases and clinical conditions associated with KIAA1753. KIAA1855 (Accession XM_166453) is another VGAM206 host target gene. KIAA1855 BINDING SITE is HOST TARGET binding site found in the 3' untranslated region of mRNA encoded by KIAA1855, corresponding to a HOST TARGET binding site such as BINDING SITE I, BINDING SITE II or BINDING SITE III. Table 2 illustrates the complementarity of the nucleotide sequences of KIAA1855 BINDING SITE, designated SEQ ID:44362, to the nucleotide sequence of VGAM206 RNA, herein designated VGAM RNA, also designated SEQ ID:2917.

Another function of VGAM206 is therefore inhibition of KIAA1855 (Accession XM_166453). Accordingly, utilities of VGAM206 include diagnosis, prevention and treatment of diseases and clinical conditions associated with KIAA1855. KIAA1872 (Accession XM_031917) is another VGAM206 host target gene. KIAA1872 BINDING SITE is HOST TARGET binding site found in the 3' untranslated region of mRNA encoded by KIAA1872, corresponding to a HOST TARGET binding site such as BINDING SITE I, BINDING SITE II or BINDING SITE III. Table 2 illustrates the complementarity of the nucleotide sequences of KIAA1872 BINDING SITE, designated SEQ ID:31523, to the nucleotide sequence of VGAM206 RNA, herein designated VGAM RNA, also designated SEQ ID:2917.

Another function of VGAM206 is therefore inhibition of KIAA1872 (Accession XM_031917). Accordingly, utilities of VGAM206 include diagnosis, prevention and treatment of diseases and clinical conditions associated with KIAA1872. 1 (3) mbt-like 2 (Drosophila) (L3MBTL2, Accession XM_114201) is another VGAM206 host target gene. L3MBTL2 BINDING SITE is HOST TARGET binding site found in the 5' untranslated region of mRNA encoded by L3MBTL2, corresponding to a HOST TARGET binding site such as BINDING SITE I, BINDING SITE II or BINDING SITE III. Table 2 illustrates the complementarity of the nucleotide sequences of L3MBTL2 BINDING SITE, designated SEQ ID:42794, to the nucleotide sequence of VGAM206 RNA, herein designated VGAM RNA, also designated SEQ ID:2917.

Another function of VGAM206 is therefore inhibition of l (3) mbt-like 2 (Drosophila) (L3MBTL2, Accession XM_114201). Accordingly, utilities of VGAM206 include diagnosis, prevention and treatment of diseases and clinical conditions associated with L3MBTL2. LEC3 (Accession NM_015236) is another VGAM206 host target gene. LEC3 BINDING SITE is HOST TARGET binding site found in the 3' untranslated region of mRNA encoded by LEC3, corresponding to a HOST TARGET binding site such as BINDING SITE I, BINDING SITE II or BINDING SITE III. Table 2 illustrates the complementarity of the nucleotide sequences of LEC3 BINDING SITE, designated SEQ ID:17573, to the nucleotide sequence of VGAM206 RNA, herein designated VGAM RNA, also designated SEQ ID:2917.

Another function of VGAM206 is therefore inhibition of LEC3 (Accession NM_015236). Accordingly, utilities of VGAM206 include diagnosis, prevention and treatment of diseases and clinical conditions associated with LEC3. LIN-7-C (Accession NM_018362) is another VGAM206 host target gene. LIN-7-C BINDING SITE is HOST TARGET binding site found in the 3' untranslated region of mRNA encoded by LIN-7-C, corresponding to a HOST TARGET binding site such as BINDING SITE I, BINDING SITE II or BINDING SITE III. Table 2 illustrates the complementarity of the nucleotide sequences of LIN-7-C BINDING SITE, designated SEQ ID:20370, to the nucleotide sequence of VGAM206 RNA, herein designated VGAM RNA, also designated SEQ ID:2917.

Another function of VGAM206 is therefore inhibition of LIN-7-C (Accession NM_018362). Accordingly, utilities of VGAM206 include diagnosis, prevention and treatment of diseases and clinical conditions associated with LIN-7-C. Lipase, Member I (LIPI, Accession XM_086767) is another VGAM206 host target gene. LIPI BINDING SITE is HOST TARGET binding site found in the 3' untranslated region of mRNA encoded by LIPI, corresponding to a HOST TARGET binding site such as BINDING SITE I, BINDING SITE II or BINDING SITE III. Table 2 illustrates the complementarity of the nucleotide sequences of LIPI BINDING SITE, designated SEQ ID:38844, to the nucleotide sequence of VGAM206 RNA, herein designated VGAM RNA, also designated SEQ ID:2917.

Another function of VGAM206 is therefore inhibition of Lipase, Member I (LIPI, Accession XM_086767). Accordingly, utilities of VGAM206 include diagnosis, prevention and treatment of diseases and clinical conditions associated with LIPI. MGC10715 (Accession NM_024325) is another VGAM206 host target gene. MGC10715 BINDING SITE is HOST TARGET binding site found in the 3' untranslated region of mRNA encoded by MGC10715, corresponding to a HOST TARGET binding site such as BINDING SITE I, BINDING SITE II or BINDING SITE III. Table 2 illustrates the complementarity of the nucleotide sequences of MGC10715 BINDING SITE, designated SEQ ID:23618, to the nucleotide sequence of VGAM206 RNA, herein designated VGAM RNA, also designated SEQ ID:2917.

Another function of VGAM206 is therefore inhibition of MGC10715 (Accession NM_024325). Accordingly, utilities of VGAM206 include diagnosis, prevention and treatment of diseases and clinical conditions associated with MGC10715. MGC20576 (Accession NM_144691) is another VGAM206 host target gene. MGC20576 BINDING SITE is HOST TARGET binding site found in the 5' untranslated region of mRNA encoded by MGC20576, corresponding to a HOST TARGET binding site such as BINDING SITE I, BINDING SITE II or BINDING SITE III. Table 2 illustrates the complementarity of the nucleotide sequences of MGC20576 BINDING SITE, designated SEQ ID:29511, to the nucleotide sequence of VGAM206 RNA, herein designated VGAM RNA, also designated SEQ ID:2917.

Another function of VGAM206 is therefore inhibition of MGC20576 (Accession NM_144691). Accordingly, utilities of VGAM206 include diagnosis, prevention and treatment of diseases and clinical conditions associated with MGC20576. MGC3123 (Accession NM_024107) is another VGAM206 host target gene. MGC3123 BINDING SITE is HOST TARGET binding site found in the 3' untranslated region of mRNA encoded by MGC3123, corresponding to a HOST TARGET binding site such as BINDING SITE I, BINDING SITE II or BINDING SITE III. Table 2 illustrates the complementarity of the nucleotide sequences of MGC3123 BINDING SITE, designated SEQ ID:23552, to the nucleotide sequence of VGAM206 RNA, herein designated VGAM RNA, also designated SEQ ID:2917.

Another function of VGAM206 is therefore inhibition of MGC3123 (Accession NM_024107). Accordingly, utilities of VGAM206 include diagnosis, prevention and treatment of diseases and clinical conditions associated with MGC3123. MGC5302 (Accession NM_024089) is another VGAM206 host target gene. MGC5302 BINDING SITE is HOST TARGET binding site found in the 5' untranslated region of mRNA encoded by MGC5302, corresponding to a HOST TARGET binding site such as BINDING SITE I, BINDING SITE II or BINDING SITE III. Table 2 illustrates the complementarity of the nucleotide sequences of MGC5302 BINDING SITE, designated SEQ ID:23531, to the nucleotide sequence of VGAM206 RNA, herein designated VGAM RNA, also designated SEQ ID:2917.

Another function of VGAM206 is therefore inhibition of MGC5302 (Accession NM_024089). Accordingly, utilities of VGAM206 include diagnosis, prevention and treatment of diseases and clinical conditions associated with MGC5302. MGC9753 (Accession NM_033419) is another VGAM206 host target gene. MGC9753 BINDING SITE1 and MGC9753 BINDING SITE2 are HOST TARGET binding sites found in untranslated regions of mRNA encoded by MGC9753, corresponding to HOST TARGET binding sites such as BINDING SITE I, BINDING SITE II or BINDING SITE III. Table 2 illustrates the complementarity of the nucleotide sequences of MGC9753 BINDING SITE1 and MGC9753 BINDING SITE2, designated SEQ ID:27245 and SEQ ID:27239 respectively, to the nucleotide sequence of VGAM206 RNA, herein designated VGAM RNA, also designated SEQ ID:2917.

Another function of VGAM206 is therefore inhibition of MGC9753 (Accession NM_033419). Accordingly, utilities of VGAM206 include diagnosis, prevention and treatment of diseases and clinical conditions associated with MGC9753. MPPE1 (Accession NM_023075) is another VGAM206 host target gene. MPPE1 BINDING SITE is HOST TARGET binding site found in the 5' untranslated region of mRNA encoded by MPPE1, corresponding to a HOST TARGET binding site such as BINDING SITE I, BINDING SITE II or BINDING SITE III. Table 2 illustrates the complementarity of the nucleotide sequences of MPPE1 BINDING SITE, designated SEQ ID:23333, to the nucleotide sequence of VGAM206 RNA, herein designated VGAM RNA, also designated SEQ ID:2917.

Another function of VGAM206 is therefore inhibition of MPPE1 (Accession NM_023075). Accordingly, utilities of VGAM206 include diagnosis, prevention and treatment of diseases and clinical conditions associated with MPPE1. p21 (CDKN1A)-activated Kinase 7 (PAK7, Accession XM_045653) is another VGAM206 host target gene. PAK7 BINDING SITE is HOST TARGET binding site found in the 3' untranslated region of mRNA encoded by PAK7, corresponding to a HOST TARGET binding site such as BINDING SITE I, BINDING SITE II or BINDING SITE III. Table 2 illustrates the complementarity of the nucleotide sequences of PAK7 BINDING SITE, designated SEQ ID:34511, to the nucleotide sequence of VGAM206 RNA, herein designated VGAM RNA, also designated SEQ ID:2917.

Another function of VGAM206 is therefore inhibition of p21(CDKN1A)-activated Kinase 7 (PAK7, Accession XM_045653). Accordingly, utilities of VGAM206 include diagnosis, prevention and treatment of diseases and clinical conditions associated with PAK7. Phospholipid Scramblase 3 (PLSCR3, Accession XM_165421) is another VGAM206 host target gene. PLSCR3 BINDING SITE1 and PLSCR3 BINDING SITE2 are HOST TARGET binding sites found in untranslated regions of mRNA encoded by PLSCR3, corresponding to HOST TARGET binding sites such as BINDING SITE I, BINDING SITE II or BINDING SITE III. Table 2 illustrates the complementarity of the nucleotide sequences of PLSCR3 BINDING SITE1 and PLSCR3 BINDING SITE2, designated SEQ ID:43638 and SEQ ID:21633 respectively, to the nucleotide sequence of VGAM206 RNA, herein designated VGAM RNA, also designated SEQ ID:2917.

Another function of VGAM206 is therefore inhibition of Phospholipid Scramblase 3 (PLSCR3, Accession XM_165421). Accordingly, utilities of VGAM206 include diagnosis, prevention and treatment of diseases and clinical conditions associated with PLSCR3. PRO1430 (Accession NM_018599) is another VGAM206 host target gene. PRO1430 BINDING SITE is HOST TARGET binding site found in the 5' untranslated region of mRNA encoded by PRO1430, corresponding to a HOST TARGET binding site such as BINDING SITE I, BINDING SITE II or BINDING SITE III. Table 2 illustrates the complementarity of the nucleotide sequences of PRO1430 BINDING SITE, designated SEQ ID:20676, to the nucleotide sequence of VGAM206 RNA, herein designated VGAM RNA, also designated SEQ ID:2917.

Another function of VGAM206 is therefore inhibition of PRO1430 (Accession NM_018599). Accordingly, utilities of VGAM206 include diagnosis, prevention and treatment of diseases and clinical conditions associated with PRO1430. RAB3D, Member RAS Oncogene Family (RAB3D, Accession NM_004283) is another VGAM206 host target gene. RAB3D BINDING SITE is HOST TARGET binding site found in the 3' untranslated region of mRNA encoded by RAB3D, corresponding to a HOST TARGET binding site such as BINDING SITE I, BINDING SITE II or BINDING SITE III. Table 2 illustrates the complementarity of the nucleotide sequences of RAB3D BINDING SITE, designated SEQ ID:10494, to the nucleotide sequence of VGAM206 RNA, herein designated VGAM RNA, also designated SEQ ID:2917.

Another function of VGAM206 is therefore inhibition of RAB3D, Member RAS Oncogene Family (RAB3D, Accession NM_004283). Accordingly, utilities of VGAM206 include diagnosis, prevention and treatment of diseases and clinical conditions associated with RAB3D. RABEX5 (Accession NM_014504) is another VGAM206 host target gene. RABEX5 BINDING SITE is HOST TARGET binding site found in the 3' untranslated region of mRNA encoded by RABEX5, corresponding to a HOST TARGET binding site such as BINDING SITE I, BINDING SITE II or BINDING SITE III. Table 2 illustrates the complementarity of the nucleotide sequences of RABEX5 BINDING SITE, designated SEQ ID:15838, to the nucleotide sequence of VGAM206 RNA, herein designated VGAM RNA, also designated SEQ ID:2917.

Another function of VGAM206 is therefore inhibition of RABEX5 (Accession NM_014504). Accordingly, utilities of VGAM206 include diagnosis, prevention and treatment of diseases and clinical conditions associated with RABEX5. Regulator of G-protein Signalling 11 (RGS11, Accession NM_003834) is another VGAM206 host target gene. RGS11 BINDING SITE is HOST TARGET binding site found in the 3' untranslated region of mRNA encoded by RGS11, corresponding to a HOST TARGET binding site such as BINDING SITE I, BINDING SITE II or BINDING SITE III. Table 2 illustrates the complementarity of the nucleotide sequences of RGS11 BINDING SITE, designated SEQ ID:9926, to the nucleotide sequence of VGAM206 RNA, herein designated VGAM RNA, also designated SEQ ID:2917.

Another function of VGAM206 is therefore inhibition of Regulator of G-protein Signalling 11 (RGS11, Accession NM_003834). Accordingly, utilities of VGAM206 include diagnosis, prevention and treatment of diseases and clinical conditions associated with RGS11. RNAHP (Accession NM_007372) is another VGAM206 host target gene. RNAHP BINDING SITE is HOST TARGET binding site found in the 3' untranslated region of mRNA encoded by RNAHP, corresponding to a HOST TARGET binding site such as BINDING SITE I, BINDING SITE II or BINDING SITE III. Table 2 illustrates the complementarity of the nucleotide sequences of RNAHP BINDING SITE, designated SEQ ID:14301, to the nucleotide sequence of VGAM206 RNA, herein designated VGAM RNA, also designated SEQ ID:2917.

Another function of VGAM206 is therefore inhibition of RNAHP (Accession NM_007372). Accordingly, utilities of VGAM206 include diagnosis, prevention and treatment of diseases and clinical conditions associated with RNAHP. RoXaN (Accession NM_025013) is another VGAM206 host target gene. RoXaN BINDING SITE is HOST TARGET binding site found in the 3' untranslated region of mRNA encoded by RoXaN, corresponding to a HOST TARGET binding site such as BINDING SITE I, BINDING SITE II or BINDING SITE III. Table 2 illustrates the complementarity of the nucleotide sequences of RoXaN BINDING SITE, designated SEQ ID:24606, to the nucleotide sequence of VGAM206 RNA, herein designated VGAM RNA, also designated SEQ ID:2917.

Another function of VGAM206 is therefore inhibition of RoXaN (Accession NM_025013). Accordingly, utilities of VGAM206 include diagnosis, prevention and treatment of diseases and clinical conditions associated with RoXaN. Ribosomal Protein S6 Kinase, 90 kDa, Polypeptide 4 (RPS6KA4, Accession NM_003942) is another VGAM206 host target gene. RPS6KA4 BINDING SITE is HOST TARGET binding site found in the 3' untranslated region of mRNA encoded by RPS6KA4, corresponding to a HOST TARGET binding site such as BINDING SITE I, BINDING SITE II or BINDING SITE III. Table 2 illustrates the complementarity of the nucleotide sequences of RPS6KA4 BINDING SITE, designated SEQ ID:10057, to the nucleotide sequence of VGAM206 RNA, herein designated VGAM RNA, also designated SEQ ID:2917.

Another function of VGAM206 is therefore inhibition of Ribosomal Protein S6 Kinase, 90 kDa, Polypeptide 4 (RPS6KA4, Accession NM_003942). Accordingly, utilities of VGAM206 include diagnosis, prevention and treatment of diseases and clinical conditions associated with RPS6KA4. Syndecan Binding Protein (syntenin) (SDCBP, Accession NM_005625) is another VGAM206 host target gene. SDCBP BINDING SITE is HOST TARGET binding site found in the 3' untranslated region of mRNA encoded by SDCBP, corresponding to a HOST TARGET binding site such as BINDING SITE I, BINDING SITE II or BINDING SITE III. Table 2 illustrates the complementarity of the nucleotide sequences of SDCBP BINDING SITE, designated SEQ ID:12137, to the nucleotide sequence of VGAM206 RNA, herein designated VGAM RNA, also designated SEQ ID:2917.

Another function of VGAM206 is therefore inhibition of Syndecan Binding Protein (syntenin) (SDCBP, Accession NM_005625). Accordingly, utilities of VGAM206 include diagnosis, prevention and treatment of diseases and clinical conditions associated with SDCBP. SEC24 Related Gene Family, Member D (S. cerevisiae) (SEC24D, Accession NM_014822) is another VGAM206 host target gene. SEC24D BINDING SITE is HOST TARGET binding site found in the 3' untranslated region of mRNA encoded by SEC24D, corresponding to a HOST TARGET binding site such as BINDING SITE I, BINDING SITE II or BINDING SITE III. Table 2 illustrates the complementarity of the nucleotide sequences of SEC24D BINDING SITE, designated SEQ ID:16801, to the nucleotide sequence of VGAM206 RNA, herein designated VGAM RNA, also designated SEQ ID:2917.

Another function of VGAM206 is therefore inhibition of SEC24 Related Gene Family, Member D (S. cerevisiae) (SEC24D, Accession NM_014822). Accordingly, utilities of VGAM206 include diagnosis, prevention and treatment of diseases and clinical conditions associated with SEC24D. Sep.in 3 (SEPT3, Accession NM_019106) is another VGAM206 host target gene. SEPT3 BINDING SITE is HOST TARGET binding site found in the 3' untranslated region of mRNA encoded by SEPT3, corresponding to a HOST TARGET binding site such as BINDING SITE I, BINDING SITE II or BINDING SITE III. Table 2 illustrates the complementarity of the nucleotide sequences of SEPT3 BINDING SITE, designated SEQ ID:21186, to the nucleotide sequence of VGAM206 RNA, herein designated VGAM RNA, also designated SEQ ID:2917.

Another function of VGAM206 is therefore inhibition of Sep.in 3 (SEPT3, Accession NM_019106). Accordingly, utilities of VGAM206 include diagnosis, prevention and treatment of diseases and clinical conditions associated with SEPT3. SHC3 (Accession NM_016848) is another VGAM206 host target gene. SHC3 BINDING SITE is HOST TARGET binding site found in the 5' untranslated region of mRNA encoded by SHC3, corresponding to a HOST TARGET binding site such as BINDING SITE I, BINDING SITE II or BINDING SITE III. Table 2 illustrates the complementarity of the nucleotide sequences of SHC3 BINDING SITE, designated SEQ ID:18843, to the nucleotide sequence of VGAM206 RNA, herein designated VGAM RNA, also designated SEQ ID:2917.

Another function of VGAM206 is therefore inhibition of SHC3 (Accession NM_016848). Accordingly, utilities of VGAM206 include diagnosis, prevention and treatment of diseases and clinical conditions associated with SHC3. Solute Carrier Family 37 (glycerol-3-phosphate transporter), Member 1 (SLC37A1, Accession NM_018964) is another VGAM206 host target gene. SLC37A1 BINDING SITE is HOST TARGET binding site found in the 3' untranslated region of mRNA encoded by SLC37A1, corresponding to a HOST TARGET binding site such as BINDING SITE I, BINDING SITE II or BINDING SITE III. Table 2 illustrates the complementarity of the nucleotide sequences of SLC37A1 BINDING SITE, designated SEQ ID:21035, to the nucleotide sequence of VGAM206 RNA, herein designated VGAM RNA, also designated SEQ ID:2917.

Another function of VGAM206 is therefore inhibition of Solute Carrier Family 37 (glycerol-3-phosphate transporter), Member 1 (SLC37A1, Accession NM_018964). Accordingly, utilities of VGAM206 include diagnosis, prevention and treatment of diseases and clinical conditions associated with SLC37A1. SWI/SNF Related, Matrix Associated, Actin Dependent Regulator of Chromatin, Subfamily F, Member 1 (SMARCF1, Accession NM_018450) is another VGAM206 host target gene. SMARCF1 BINDING SITE is HOST TARGET binding site found in the 3' untranslated region of mRNA encoded by SMARCF1, corresponding to a HOST TARGET binding site such as BINDING SITE I, BINDING SITE II or BINDING SITE III. Table 2 illustrates the complementarity of the nucleotide sequences of SMARCF1 BINDING SITE, designated SEQ ID:20523, to the nucleotide sequence of VGAM206 RNA, herein designated VGAM RNA, also designated SEQ ID:2917.

Another function of VGAM206 is therefore inhibition of SWI/SNF Related, Matrix Associated, Actin Dependent Regulator of Chromatin, Subfamily F, Member 1 (SMARCF1, Accession NM_018450). Accordingly, utilities of VGAM206 include diagnosis, prevention and treatment of diseases and clinical conditions associated with SMARCF1. SR-BP1 (Accession NM_005866) is another VGAM206 host target gene. SR-BP1 BINDING SITE is HOST TARGET binding site found in the 3' untranslated region of mRNA encoded by SR-BP1, corresponding to a HOST TARGET binding site such as BINDING SITE I, BINDING SITE II or BINDING SITE III. Table 2 illustrates the complementarity of the nucleotide sequences of SR-BP1 BINDING SITE, designated SEQ ID:12487, to the nucleotide sequence of VGAM206 RNA, herein designated VGAM RNA, also designated SEQ ID:2917.

Another function of VGAM206 is therefore inhibition of SR-BP1 (Accession NM_005866). Accordingly, utilities of VGAM206 include diagnosis, prevention and treatment of diseases and clinical conditions associated with SR-BP1. Suppression of Tumorigenicity 7 Like (ST7L, Accession NM_139195) is another VGAM206 host target gene. ST7L BINDING SITE1 and ST7L BINDING SITE2 are HOST TARGET binding sites found in untranslated regions of mRNA encoded by ST7L, corresponding to HOST TARGET binding sites such as BINDING SITE I, BINDING SITE II or BINDING SITE III. Table 2 illustrates the complementarity of the nucleotide sequences of ST7L BINDING SITE1 and ST7L BINDING SITE2, designated SEQ ID:29204 and SEQ ID:29209 respectively, to the nucleotide sequence of VGAM206 RNA, herein designated VGAM RNA, also designated SEQ ID:2917.

Another function of VGAM206 is therefore inhibition of Suppression of Tumorigenicity 7 Like (ST7L, Accession NM_139195). Accordingly, utilities of VGAM206 include diagnosis, prevention and treatment of diseases and clinical conditions associated with ST7L. T-cell Leukemia/lymphoma 6 (TCL6, Accession NM_012468) is another VGAM206 host target gene. TCL6 BINDING SITE1 and TCL6 BINDING SITE2 are HOST TARGET binding sites found in untranslated regions of mRNA encoded by TCL6, corresponding to HOST TARGET binding sites such as BINDING SITE I, BINDING SITE II or BINDING SITE III. Table 2 illustrates the complementarity of the nucleotide sequences of TCL6 BINDING SITE1 and TCL6 BINDING SITE2, designated SEQ ID:14848 and SEQ ID:20797 respectively, to the nucleotide sequence of VGAM206 RNA, herein designated VGAM RNA, also designated SEQ ID:2917.

Another function of VGAM206 is therefore inhibition of T-cell Leukemia/lymphoma 6 (TCL6, Accession NM_012468). Accordingly, utilities of VGAM206 include diagnosis, prevention and treatment of diseases and clinical conditions associated with TCL6. TUSP (Accession NM_020245) is another VGAM206 host target gene. TUSP BINDING SITE is HOST TARGET binding site found in the 3' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21534, to the nucleotide sequence of VGAM206 RNA, herein designated VGAM RNA, also designated SEQ ID:2917.

Another function of VGAM206 is therefore inhibition of TUSP (Accession NM_020245). Accordingly, utilities of VGAM206 include diagnosis, prevention and treatment of diseases and clinical conditions associated with TUSP. LOC123242 (Accession XM_063548) is another VGAM206 host target gene. LOC123242 BINDING SITE is HOST TARGET binding site found in the 5' untranslated region of mRNA encoded by LOC123242, corresponding to a HOST TARGET binding site such as BINDING SITE I, BINDING SITE II or BINDING SITE III. Table 2 illustrates the complementarity of the nucleotide sequences of LOC123242 BINDING SITE, designated SEQ ID:37248, to the nucleotide sequence of VGAM206 RNA, herein designated VGAM RNA, also designated SEQ ID:2917.

Another function of VGAM206 is therefore inhibition of LOC123242 (Accession XM_063548). Accordingly, utilities of VGAM206 include diagnosis, prevention and treatment of diseases and clinical conditions associated with LOC123242. LOC134637 (Accession XM_059727) is another VGAM206 host target gene. LOC134637 BINDING SITE is HOST TARGET binding site found in the 3' untranslated region of mRNA encoded by LOC134637, corresponding to a HOST TARGET binding site such as BINDING SITE I, BINDING SITE II or BINDING SITE III. Table 2 illustrates the complementarity of the nucleotide sequences of LOC134637 BINDING SITE, designated SEQ ID:37080, to the nucleotide sequence of VGAM206 RNA, herein designated VGAM RNA, also designated SEQ ID:2917.

Another function of VGAM206 is therefore inhibition of LOC134637 (Accession XM_059727). Accordingly, utilities of VGAM206 include diagnosis, prevention and treatment of diseases and clinical conditions associated with LOC134637. LOC135398 (Accession XM_069333) is another VGAM206 host target gene. LOC135398 BINDING SITE is HOST TARGET binding site found in the 3' untranslated region of mRNA encoded by LOC135398, corresponding to a HOST TARGET binding site such as BINDING SITE I, BINDING SITE II or BINDING SITE III. Table 2 illustrates the complementarity of the nucleotide sequences of LOC135398 BINDING SITE, designated SEQ ID:37389, to the nucleotide sequence of VGAM206 RNA, herein designated VGAM RNA, also designated SEQ ID:2917.

Another function of VGAM206 is therefore inhibition of LOC135398 (Accession XM_069333). Accordingly, utilities of VGAM206 include diagnosis, prevention and treatment of diseases and clinical conditions associated with LOC135398. LOC143308 (Accession XM_096411) is another VGAM206 host target gene. LOC143308 BINDING SITE is HOST TARGET binding site found in the 5' untranslated region of mRNA encoded by LOC143308, corresponding to a HOST TARGET binding site such as BINDING SITE I, BINDING SITE II or BINDING SITE III. Table 2 illustrates the complementarity of the nucleotide sequences of LOC143308 BINDING SITE, designated SEQ ID:40350, to the nucleotide sequence of VGAM206 RNA, herein designated VGAM RNA, also designated SEQ ID:2917.

Another function of VGAM206 is therefore inhibition of LOC143308 (Accession XM_096411). Accordingly, utilities of VGAM206 include diagnosis, prevention and treatment of diseases and clinical conditions associated with LOC143308. LOC144742 (Accession XM_084949) is another VGAM206 host target gene. LOC144742 BINDING SITE is HOST TARGET binding site found in the 5' untranslated region of mRNA encoded by LOC144742, corresponding to a HOST TARGET binding site such as BINDING SITE I, BINDING SITE II or BINDING SITE III. Table 2 illustrates the complementarity of the nucleotide sequences of LOC144742 BINDING SITE, designated SEQ ID:37780, to the nucleotide sequence of VGAM206 RNA, herein designated VGAM RNA, also designated SEQ ID:2917.

Another function of VGAM206 is therefore inhibition of LOC144742 (Accession XM_084949). Accordingly, utilities of VGAM206 include diagnosis, prevention and treatment of diseases and clinical conditions associated with LOC144742. LOC145945 (Accession XM_096908) is another VGAM206 host target gene. LOC145945 BINDING SITE is HOST TARGET binding site found in the 5' untranslated region of mRNA encoded by LOC145945, corresponding to a HOST TARGET binding site such as BINDING SITE I, BINDING SITE II or BINDING SITE III. Table 2 illustrates the complementarity of the nucleotide sequences of LOC145945 BINDING SITE, designated SEQ ID:40640, to the nucleotide sequence of VGAM206 RNA, herein designated VGAM RNA, also designated SEQ ID:2917.

Another function of VGAM206 is therefore inhibition of LOC145945 (Accession XM_096908). Accordingly, utilities of VGAM206 include diagnosis, prevention and treatment of diseases and clinical conditions associated with LOC145945. LOC147632 (Accession NM_138478) is another VGAM206 host target gene. LOC147632 BINDING SITE is HOST TARGET binding site found in the 5' untranslated region of mRNA encoded by LOC147632, corresponding to a HOST TARGET binding site such as BINDING SITE I, BINDING SITE II or BINDING SITE III. Table 2 illustrates the complementarity of the nucleotide sequences of LOC147632 BINDING SITE, designated SEQ ID:28829, to the nucleotide sequence of VGAM206 RNA, herein designated VGAM RNA, also designated SEQ ID:2917.

Another function of VGAM206 is therefore inhibition of LOC147632 (Accession NM_138478). Accordingly, utilities of VGAM206 include diagnosis, prevention and treatment of diseases and clinical conditions associated with LOC147632. LOC147669 (Accession XM_097262) is another VGAM206 host target gene. LOC147669 BINDING SITE is HOST TARGET binding site found in the 5' untranslated region of mRNA encoded by LOC147669, corresponding to a HOST TARGET binding site such as BINDING SITE I, BINDING SITE II or BINDING SITE III. Table 2 illustrates the complementarity of the nucleotide sequences of LOC147669 BINDING SITE, designated SEQ ID:40855, to the nucleotide sequence of VGAM206 RNA, herein designated VGAM RNA, also designated SEQ ID:2917.

Another function of VGAM206 is therefore inhibition of LOC147669 (Accession XM_097262). Accordingly, utilities of VGAM206 include diagnosis, prevention and treatment of diseases and clinical conditions associated with LOC147669. LOC149157 (Accession XM_086442) is another VGAM206 host target gene. LOC149157 BINDING SITE is HOST TARGET binding site found in the 5' untranslated region of mRNA encoded by LOC149157, corresponding to a HOST TARGET binding site such as BINDING SITE I, BINDING SITE II or BINDING SITE III. Table 2 illustrates the complementarity of the nucleotide sequences of LOC149157 BINDING SITE, designated SEQ ID:38658, to the nucleotide sequence of VGAM206 RNA, herein designated VGAM RNA, also designated SEQ ID:2917.

Another function of VGAM206 is therefore inhibition of LOC149157 (Accession XM_086442). Accordingly, utilities of VGAM206 include diagnosis, prevention and treatment of diseases and clinical conditions associated with LOC149157. LOC149373 (Accession XM_086507) is another VGAM206 host target gene. LOC149373 BINDING SITE is HOST TARGET binding site found in the 3' untranslated region of mRNA encoded by LOC149373, corresponding to a HOST TARGET binding site such as BINDING SITE I, BINDING SITE II or BINDING SITE III. Table 2 illustrates the complementarity of the nucleotide sequences of LOC149373 BINDING SITE, designated SEQ ID:38721, to the nucleotide sequence of VGAM206 RNA, herein designated VGAM RNA, also designated SEQ ID:2917.

Another function of VGAM206 is therefore inhibition of LOC149373 (Accession XM_086507). Accordingly, utilities of VGAM206 include diagnosis, prevention and treatment of diseases and clinical conditions associated with LOC149373. LOC149935 (Accession XM_015885) is another VGAM206 host target gene. LOC149935 BINDING SITE is HOST TARGET binding site found in the 3' untranslated region of mRNA encoded by LOC149935, corresponding to a HOST TARGET binding site such as BINDING SITE I, BINDING SITE II or BINDING SITE III. Table 2 illustrates the complementarity of the nucleotide sequences of LOC149935 BINDING SITE, designated SEQ ID:30248, to the nucleotide sequence of VGAM206 RNA, herein designated VGAM RNA, also designated SEQ ID:2917.

Another function of VGAM206 is therefore inhibition of LOC149935 (Accession XM_015885). Accordingly, utilities of VGAM206 include diagnosis, prevention and treatment of diseases and clinical conditions associated with LOC149935. LOC150157 (Accession XM_097823) is another VGAM206 host target gene. LOC150157 BINDING SITE is HOST TARGET binding site found in the 5' untranslated region of mRNA encoded by LOC150157, corresponding to a HOST TARGET binding site such as BINDING SITE I, BINDING SITE II or BINDING SITE III. Table 2 illustrates the complementarity of the nucleotide sequences of LOC150157 BINDING SITE, designated SEQ ID:41145, to the nucleotide sequence of VGAM206 RNA, herein designated VGAM RNA, also designated SEQ ID:2917.

Another function of VGAM206 is therefore inhibition of LOC150157 (Accession XM_097823). Accordingly, utilities of VGAM206 include diagnosis, prevention and treatment of diseases and clinical conditions associated with LOC150157. LOC150271 (Accession XM_097859) is another VGAM206 host target gene. LOC150271 BINDING SITE is HOST TARGET binding site found in the 3' untranslated region of mRNA encoded by LOC150271, corresponding to a HOST TARGET binding site such as BINDING SITE I, BINDING SITE II or BINDING SITE III. Table 2 illustrates the complementarity of the nucleotide sequences of LOC150271 BINDING SITE, designated SEQ ID:41174, to the nucleotide sequence of VGAM206 RNA, herein designated VGAM RNA, also designated SEQ ID:2917.

Another function of VGAM206 is therefore inhibition of LOC150271 (Accession XM_097859). Accordingly, utilities of VGAM206 include diagnosis, prevention and treatment of diseases and clinical conditions associated with LOC150271. LOC150279 (Accession XM_086820) is another VGAM206 host target gene. LOC150279 BINDING SITE is HOST TARGET binding site found in the 3' untranslated region of mRNA encoded by LOC150279, corresponding to a HOST TARGET binding site such as BINDING SITE I, BINDING SITE II or BINDING SITE III. Table 2 illustrates the complementarity of the nucleotide sequences of LOC150279 BINDING SITE, designated SEQ ID:38902, to the nucleotide sequence of VGAM206 RNA, herein designated VGAM RNA, also designated SEQ ID:2917.

Another function of VGAM206 is therefore inhibition of LOC150279 (Accession XM_086820). Accordingly, utilities of VGAM206 include diagnosis, prevention and treatment of diseases and clinical conditions associated with LOC150279. LOC150407 (Accession XM_086906) is another VGAM206 host target gene. LOC150407 BINDING SITE is HOST TARGET binding site found in the 3' untranslated region of mRNA encoded by LOC150407, corresponding to a HOST TARGET binding site such as BINDING SITE I, BINDING SITE II or BINDING SITE III. Table 2 illustrates the complementarity of the nucleotide sequences of LOC150407 BINDING SITE, designated SEQ ID:38955, to the nucleotide sequence of VGAM206 RNA, herein designated VGAM RNA, also designated SEQ ID:2917.

Another function of VGAM206 is therefore inhibition of LOC150407 (Accession XM_086906). Accordingly, utilities of VGAM206 include diagnosis, prevention and treatment of diseases and clinical conditions associated with LOC150407. LOC152447 (Accession XM_087471) is another VGAM206 host target gene. LOC152447 BINDING SITE is HOST TARGET binding site found in the 5' untranslated region of mRNA encoded by LOC152447, corresponding to a HOST TARGET binding site such as BINDING SITE I, BINDING SITE II or BINDING SITE III. Table 2 illustrates the complementarity of the nucleotide sequences of LOC152447 BINDING SITE, designated SEQ ID:39274, to the nucleotide sequence of VGAM206 RNA, herein designated VGAM RNA, also designated SEQ ID:2917.

Another function of VGAM206 is therefore inhibition of LOC152447 (Accession XM_087471). Accordingly, utilities of VGAM206 include diagnosis, prevention and treatment of diseases and clinical conditions associated with LOC152447. LOC153163 (Accession XM_087612) is another VGAM206 host target gene. LOC153163 BINDING SITE is HOST TARGET binding site found in the 3' untranslated region of mRNA encoded by LOC153163, corresponding to a HOST TARGET binding site such as BINDING SITE I, BINDING SITE II or BINDING SITE III. Table 2 illustrates the complementarity of the nucleotide sequences of LOC153163 BINDING SITE, designated SEQ ID:39361, to the nucleotide sequence of VGAM206 RNA, herein designated VGAM RNA, also designated SEQ ID:2917.

Another function of VGAM206 is therefore inhibition of LOC153163 (Accession XM_087612). Accordingly, utilities of VGAM206 include diagnosis, prevention and treatment of diseases and clinical conditions associated with LOC153163. LOC158062 (Accession XM_098861) is another VGAM206 host target gene. LOC158062 BINDING SITE is HOST TARGET binding site found in the 3' untranslated region of mRNA encoded by LOC158062, corresponding to a HOST TARGET binding site such as BINDING SITE I, BINDING SITE II or BINDING SITE III. Table 2 illustrates the complementarity of the nucleotide sequences of LOC158062 BINDING SITE, designated SEQ ID:41915, to the nucleotide sequence of VGAM206 RNA, herein designated VGAM RNA, also designated SEQ ID:2917.

Another function of VGAM206 is therefore inhibition of LOC158062 (Accession XM_098861). Accordingly, utilities of VGAM206 include diagnosis, prevention and treatment of diseases and clinical conditions associated with LOC158062. LOC158292 (Accession XM_098914) is another VGAM206 host target gene. LOC158292 BINDING SITE is HOST TARGET binding site found in the 5' untranslated region of mRNA encoded by LOC158292, corresponding to a HOST TARGET binding site such as BINDING SITE I, BINDING SITE II or BINDING SITE III. Table 2 illustrates the complementarity of the nucleotide sequences of LOC158292 BINDING SITE, designated SEQ ID:41933, to the nucleotide sequence of VGAM206 RNA, herein designated VGAM RNA, also designated SEQ ID:2917.

Another function of VGAM206 is therefore inhibition of LOC158292 (Accession XM_098914). Accordingly, utilities of VGAM206 include diagnosis, prevention and treatment of diseases and clinical conditions associated with LOC158292. LOC196283 (Accession XM_113684) is another VGAM206 host target gene. LOC196283 BINDING SITE is HOST TARGET binding site found in the 3' untranslated region of mRNA encoded by LOC196283, corresponding to a HOST TARGET binding site such as BINDING SITE I, BINDING SITE II or BINDING SITE III. Table 2 illustrates the complementarity of the nucleotide sequences of LOC196283 BINDING SITE, designated SEQ ID:42343, to the nucleotide sequence of VGAM206 RNA, herein designated VGAM RNA, also designated SEQ ID:2917.

Another function of VGAM206 is therefore inhibition of LOC196283 (Accession XM_113684). Accordingly, utilities of VGAM206 include diagnosis, prevention and treatment of diseases and clinical conditions associated with LOC196283. LOC196812 (Accession XM_116868) is another VGAM206 host target gene. LOC196812 BINDING SITE is HOST TARGET binding site found in the 3' untranslated region of mRNA encoded by LOC196812, corresponding to a HOST TARGET binding site such as BINDING SITE I, BINDING SITE II or BINDING SITE III. Table 2 illustrates the complementarity of the nucleotide sequences of LOC196812 BINDING SITE, designated SEQ ID:43141, to the nucleotide sequence of VGAM206 RNA, herein designated VGAM RNA, also designated SEQ ID:2917.

Another function of VGAM206 is therefore inhibition of LOC196812 (Accession XM_116868). Accordingly, utilities of VGAM206 include diagnosis, prevention and treatment of diseases and clinical conditions associated with LOC196812. LOC196890 (Accession XM_116951) is another VGAM206 host target gene. LOC196890 BINDING SITE is HOST TARGET binding site found in the 5' untranslated region of mRNA encoded by LOC196890, corresponding to a HOST TARGET binding site such as BINDING SITE I, BINDING SITE II or BINDING SITE III. Table 2 illustrates the complementarity of the nucleotide sequences of LOC196890 BIND- ING SITE, designated SEQ ID:43156, to the nucleotide sequence of VGAM206 RNA, herein designated VGAM RNA, also designated SEQ ID:2917.

Another function of VGAM206 is therefore inhibition of LOC196890 (Accession XM_116951). Accordingly, utilities of VGAM206 include diagnosis, prevention and treatment of diseases and clinical conditions associated with LOC196890. LOC200035 (Accession XM_055305) is another VGAM206 host target gene. LOC200035 BINDING SITE is HOST TARGET binding site found in the 3' untranslated region of mRNA encoded by LOC200035, corresponding to a HOST TARGET binding site such as BINDING SITE I, BINDING SITE II or BINDING SITE III. Table 2 illustrates the complementarity of the nucleotide sequences of LOC200035 BINDING SITE, designated SEQ ID:36264, to the nucleotide sequence of VGAM206 RNA, herein designated VGAM RNA, also designated SEQ ID:2917.

Another function of VGAM206 is therefore inhibition of LOC200035 (Accession XM_055305). Accordingly, utilities of VGAM206 include diagnosis, prevention and treatment of diseases and clinical conditions associated with LOC200035. LOC201229 (Accession XM_113925) is another VGAM206 host target gene. LOC201229 BINDING SITE is HOST TARGET binding site found in the 5' untranslated region of mRNA encoded by LOC201229, corresponding to a HOST TARGET binding site such as BINDING SITE I, BINDING SITE II or BINDING SITE III. Table 2 illustrates the complementarity of the nucleotide sequences of LOC201229 BINDING SITE, designated SEQ ID:42546, to the nucleotide sequence of VGAM206 RNA, herein designated VGAM RNA, also designated SEQ ID:2917.

Another function of VGAM206 is therefore inhibition of LOC201229 (Accession XM_113925). Accordingly, utilities of VGAM206 include diagnosis, prevention and treatment of diseases and clinical conditions associated with LOC201229. LOC201252 (Accession XM_113941) is another VGAM206 host target gene. LOC201252 BINDING SITE is HOST TARGET binding site found in the 3' untranslated region of mRNA encoded by LOC201252, corresponding to a HOST TARGET binding site such as BINDING SITE I, BINDING SITE II or BINDING SITE III. Table 2 illustrates the complementarity of the nucleotide sequences of LOC201252 BINDING SITE, designated SEQ ID:42557, to the nucleotide sequence of VGAM206 RNA, herein designated VGAM RNA, also designated SEQ ID:2917.

Another function of VGAM206 is therefore inhibition of LOC201252 (Accession XM_113941). Accordingly, utilities of VGAM206 include diagnosis, prevention and treatment of diseases and clinical conditions associated with LOC201252. LOC204285 (Accession XM_115292) is another VGAM206 host target gene. LOC204285 BINDING SITE is HOST TARGET binding site found in the 5' untranslated region of mRNA encoded by LOC204285, corresponding to a HOST TARGET binding site such as BINDING SITE I, BINDING SITE II or BINDING SITE III. Table 2 illustrates the complementarity of the nucleotide sequences of LOC204285 BINDING SITE, designated SEQ ID:43091, to the nucleotide sequence of VGAM206 RNA, herein designated VGAM RNA, also designated SEQ ID:2917.

Another function of VGAM206 is therefore inhibition of LOC204285 (Accession XM_115292). Accordingly, utilities of VGAM206 include diagnosis, prevention and treatment of diseases and clinical conditions associated with LOC204285. LOC204970 (Accession XM_114795) is another VGAM206 host target gene. LOC204970 BINDING SITE is HOST TARGET binding site found in the 3' untranslated region of mRNA encoded by LOC204970, corresponding to a HOST TARGET binding site such as BINDING SITE I, BINDING SITE II or BINDING SITE III. Table 2 illustrates the complementarity of the nucleotide sequences of LOC204970 BINDING SITE, designated SEQ ID:43074, to the nucleotide sequence of VGAM206 RNA, herein designated VGAM RNA, also designated SEQ ID:2917.

Another function of VGAM206 is therefore inhibition of LOC204970 (Accession XM_114795). Accordingly, utilities of VGAM206 include diagnosis, prevention and treatment of diseases and clinical conditions associated with LOC204970. LOC219654 (Accession XM_166095) is another VGAM206 host target gene. LOC219654 BINDING SITE is HOST TARGET binding site found in the 3' untranslated region of mRNA encoded by LOC219654, corresponding to a HOST TARGET binding site such as BINDING SITE I, BINDING SITE II or BINDING SITE III. Table 2 illustrates the complementarity of the nucleotide sequences of LOC219654 BINDING SITE, designated SEQ ID:43873, to the nucleotide sequence of VGAM206 RNA, herein designated VGAM RNA, also designated SEQ ID:2917.

Another function of VGAM206 is therefore inhibition of LOC219654 (Accession XM_166095). Accordingly, utilities of VGAM206 include diagnosis, prevention and treatment of diseases and clinical conditions associated with LOC219654. LOC220064 (Accession XM_167827) is another VGAM206 host target gene. LOC220064 BINDING SITE is HOST TARGET binding site found in the 3' untranslated region of mRNA encoded by LOC220064, corresponding to a HOST TARGET binding site such as BINDING SITE I, BINDING SITE II or BINDING SITE III. Table 2 illustrates the complementarity of the nucleotide sequences of LOC220064 BINDING SITE, designated SEQ ID:44871, to the nucleotide sequence of VGAM206 RNA, herein designated VGAM RNA, also designated SEQ ID:2917.

Another function of VGAM206 is therefore inhibition of LOC220064 (Accession XM_167827). Accordingly, utilities of VGAM206 include diagnosis, prevention and treatment of diseases and clinical conditions associated with LOC220064. LOC221025 (Accession XM_167644) is another VGAM206 host target gene. LOC221025 BINDING SITE is HOST TARGET binding site found in the 3' untranslated region of mRNA encoded by LOC221025, corresponding to a HOST TARGET binding site such as BINDING SITE I, BINDING SITE II or BINDING SITE III. Table 2 illustrates the complementarity of the nucleotide sequences of LOC221025 BINDING SITE, designated SEQ ID:44747, to the nucleotide sequence of VGAM206 RNA, herein designated VGAM RNA, also designated SEQ ID:2917.

Another function of VGAM206 is therefore inhibition of LOC221025 (Accession XM_167644). Accordingly, utilities of VGAM206 include diagnosis, prevention and treatment of diseases and clinical conditions associated with LOC221025. LOC221794 (Accession XM_168214) is another VGAM206 host target gene. LOC221794 BINDING SITE is HOST TARGET binding site found in the 5' untranslated region of mRNA encoded by LOC221794, corresponding to a HOST TARGET binding site such as BINDING SITE I, BINDING SITE II or BINDING SITE III. Table 2 illustrates the complementarity of the nucleotide sequences of LOC221794 BINDING SITE, designated SEQ ID:45072, to the nucleotide sequence of VGAM206 RNA, herein designated VGAM RNA, also designated SEQ ID:2917.

Another function of VGAM206 is therefore inhibition of LOC221794 (Accession XM_168214). Accordingly, utilities of VGAM206 include diagnosis, prevention and treatment of diseases and clinical conditions associated with LOC221794. LOC222256 (Accession XM_168571) is another VGAM206 host target gene. LOC222256 BINDING SITE is HOST TARGET binding site found in the 3' untranslated region of mRNA encoded by LOC222256, corresponding to a HOST TARGET binding site such as BINDING SITE I, BINDING SITE II or BINDING SITE III. Table 2 illustrates the complementarity of the nucleotide sequences of LOC222256 BINDING SITE, designated SEQ ID:45251, to the nucleotide sequence of VGAM206 RNA, herein designated VGAM RNA, also designated SEQ ID:2917.

Another function of VGAM206 is therefore inhibition of LOC222256 (Accession XM_168571). Accordingly, utilities of VGAM206 include diagnosis, prevention and treatment of diseases and clinical conditions associated with LOC222256. LOC222614 (Accession XM_169970) is another VGAM206 host target gene. LOC222614 BINDING SITE is HOST TARGET binding site found in the 5' untranslated region of mRNA encoded by LOC222614, corresponding to a HOST TARGET binding site such as BINDING SITE I, BINDING SITE II or BINDING SITE III. Table 2 illustrates the complementarity of the nucleotide sequences of LOC222614 BINDING SITE, designated SEQ ID:45307, to the nucleotide sequence of VGAM206 RNA, herein designated VGAM RNA, also designated SEQ ID:2917.

Another function of VGAM206 is therefore inhibition of LOC222614 (Accession XM_169970). Accordingly, utilities of VGAM206 include diagnosis, prevention and treatment of diseases and clinical conditions associated with LOC222614. LOC222962 (Accession XM_167291) is another VGAM206 host target gene. LOC222962 BINDING SITE is HOST TARGET binding site found in the 3' untranslated region of mRNA encoded by LOC222962, corresponding to a HOST TARGET binding site such as BINDING SITE I, BINDING SITE II or BINDING SITE III. Table 2 illustrates the complementarity of the nucleotide sequences of LOC222962 BINDING SITE, designated SEQ ID:44632, to the nucleotide sequence of VGAM206 RNA, herein designated VGAM RNA, also designated SEQ ID:2917.

Another function of VGAM206 is therefore inhibition of LOC222962 (Accession XM_167291). Accordingly, utilities of VGAM206 include diagnosis, prevention and treatment of diseases and clinical conditions associated with LOC222962. LOC253001 (Accession XM_171711) is another VGAM206 host target gene. LOC253001 BINDING SITE is HOST TARGET binding site found in the 5' untranslated region of mRNA encoded by LOC253001, corresponding to a HOST TARGET binding site such as BINDING SITE I, BINDING SITE II or BINDING SITE III. Table 2 illustrates the complementarity of the nucleotide sequences of LOC253001 BINDING SITE, designated SEQ ID:46062, to the nucleotide sequence of VGAM206 RNA, herein designated VGAM RNA, also designated SEQ ID:2917.

Another function of VGAM206 is therefore inhibition of LOC253001 (Accession XM_171711). Accordingly, utilities of VGAM206 include diagnosis, prevention and treatment of diseases and clinical conditions associated with LOC253001. LOC253639 (Accession XM_171060) is another VGAM206 host target gene. LOC253639 BINDING SITE is HOST TARGET binding site found in the 3' untranslated region of mRNA encoded by LOC253639, corresponding to a HOST TARGET binding site such as BINDING SITE I, BINDING SITE II or BINDING SITE III. Table 2 illustrates the complementarity of the nucleotide sequences of LOC253639 BINDING SITE, designated SEQ ID:45857, to the nucleotide sequence of VGAM206 RNA, herein designated VGAM RNA, also designated SEQ ID:2917.

Another function of VGAM206 is therefore inhibition of LOC253639 (Accession XM_171060). Accordingly, utilities of VGAM206 include diagnosis, prevention and treatment of diseases and clinical conditions associated with LOC253639. LOC254381 (Accession XM_173436) is another VGAM206 host target gene. LOC254381 BINDING SITE is HOST TARGET binding site found in the 5' untranslated region of mRNA encoded by LOC254381, corresponding to a HOST TARGET binding site such as BINDING SITE I, BINDING SITE II or BINDING SITE III. Table 2 illustrates the complementarity of the nucleotide sequences of LOC254381 BINDING SITE, designated SEQ ID:46545, to the nucleotide sequence of VGAM206 RNA, herein designated VGAM RNA, also designated SEQ ID:2917.

Another function of VGAM206 is therefore inhibition of LOC254381 (Accession XM_173436). Accordingly, utilities of VGAM206 include diagnosis, prevention and treatment of diseases and clinical conditions associated with LOC254381. LOC254423 (Accession XM_173286) is another VGAM206 host target gene. LOC254423 BINDING SITE is HOST TARGET binding site found in the 5' untranslated region of mRNA encoded by LOC254423, corresponding to a HOST TARGET binding site such as BINDING SITE I, BINDING SITE II or BINDING SITE III. Table 2 illustrates the complementarity of the nucleotide sequences of LOC254423 BINDING SITE, designated SEQ ID:46532, to the nucleotide sequence of VGAM206 RNA, herein designated VGAM RNA, also designated SEQ ID:2917.

Another function of VGAM206 is therefore inhibition of LOC254423 (Accession XM_173286). Accordingly, utilities of VGAM206 include diagnosis, prevention and treatment of diseases and clinical conditions associated with LOC254423. LOC255452 (Accession XM_174088) is another VGAM206 host target gene. LOC255452 BINDING SITE is HOST TARGET binding site found in the 3' untranslated region of mRNA encoded by LOC255452, corresponding to a HOST TARGET binding site such as BINDING SITE I, BINDING SITE II or BINDING SITE III. Table 2 illustrates the complementarity of the nucleotide sequences of LOC255452 BINDING SITE, designated SEQ ID:46578, to the nucleotide sequence of VGAM206 RNA, herein designated VGAM RNA, also designated SEQ ID:2917.

Another function of VGAM206 is therefore inhibition of LOC255452 (Accession XM_174088). Accordingly, utilities of VGAM206 include diagnosis, prevention and treatment of diseases and clinical conditions associated with LOC255452. LOC256520 (Accession XM_171126) is another VGAM206 host target gene. LOC256520 BINDING SITE is HOST TARGET binding site found in the 3' untranslated region of mRNA encoded by LOC256520, corresponding to a HOST TARGET binding site such as BINDING SITE I, BINDING SITE II or BINDING SITE III. Table 2 illustrates the complementarity of the nucleotide sequences of LOC256520 BINDING SITE, designated SEQ ID:45929, to the nucleotide sequence of VGAM206 RNA, herein designated VGAM RNA, also designated SEQ ID:2917.

Another function of VGAM206 is therefore inhibition of LOC256520 (Accession XM_171126). Accordingly, utilities of VGAM206 include diagnosis, prevention and treatment of diseases and clinical conditions associated with LOC256520. LOC257104 (Accession XM_173830) is another VGAM206 host target gene. LOC257104 BINDING SITE is HOST TARGET binding site found in the 5' untranslated region of mRNA encoded by LOC257104, corresponding to a HOST TARGET binding site such as BINDING SITE I, BINDING SITE II or BINDING SITE III. Table 2 illustrates the complementarity of the nucleotide sequences of LOC257104 BINDING SITE, designated SEQ ID:46564, to the nucleotide sequence of VGAM206 RNA, herein designated VGAM RNA, also designated SEQ ID:2917.

Another function of VGAM206 is therefore inhibition of LOC257104 (Accession XM_173830). Accordingly, utilities of VGAM206 include diagnosis, prevention and treatment of diseases and clinical conditions associated with LOC257104. LOC257282 (Accession XM_172844) is another VGAM206 host target gene. LOC257282 BINDING SITE is HOST TARGET binding site found in the 5' untranslated region of mRNA encoded by LOC257282, corresponding to a HOST TARGET binding site such as BINDING SITE I, BINDING SITE II or BINDING SITE III. Table 2 illustrates the complementarity of the nucleotide sequences of LOC257282 BINDING SITE, designated SEQ ID:46122, to the nucleotide sequence of VGAM206 RNA, herein designated VGAM RNA, also designated SEQ ID:2917.

Another function of VGAM206 is therefore inhibition of LOC257282 (Accession XM_172844). Accordingly, utilities of VGAM206 include diagnosis, prevention and treatment of diseases and clinical conditions associated with LOC257282. LOC91409 (Accession XM_038298) is another VGAM206 host target gene. LOC91409 BINDING SITE is HOST TARGET binding site found in the 3' untranslated region of mRNA encoded by LOC91409, corresponding to a HOST TARGET binding site such as BINDING SITE I, BINDING SITE II or BINDING SITE III. Table 2 illustrates the complementarity of the nucleotide sequences of LOC91409 BINDING SITE, designated SEQ ID:32806, to the nucleotide sequence of VGAM206 RNA, herein designated VGAM RNA, also designated SEQ ID:2917.

Another function of VGAM206 is therefore inhibition of LOC91409 (Accession XM_038298). Accordingly, utilities of VGAM206 include diagnosis, prevention and treatment of diseases and clinical conditions associated with LOC91409. LOC91828 (Accession XM_040910) is another VGAM206 host target gene. LOC91828 BINDING SITE is HOST TARGET binding site found in the 5' untranslated region of mRNA encoded by LOC91828, corresponding to a HOST TARGET binding site such as BINDING SITE I, BINDING SITE II or BINDING SITE III. Table 2 illustrates the complementarity of the nucleotide sequences of LOC91828 BINDING SITE, designated SEQ ID:33410, to the nucleotide sequence of VGAM206 RNA, herein designated VGAM RNA, also designated SEQ ID:2917.

Another function of VGAM206 is therefore inhibition of LOC91828 (Accession XM_040910). Accordingly, utilities of VGAM206 include diagnosis, prevention and treatment of diseases and clinical conditions associated with LOC91828. FIG. 1 further provides a conceptual description of a novel bioinformatically detected viral gene of the present invention, referred to here as Viral Genomic Address Messenger 207 (VGAM207) viral gene, which modulates expression of respective host target genes thereof, the function and utility of which host target genes is known in the art.

VGAM207 is a novel bioinformatically detected regulatory, non protein coding, viral micro RNA (miRNA) gene. The method by which VGAM207 was detected is described hereinabove with reference to FIGS. 1-8.

VGAM207 gene, herein designated VGAM GENE, is a viral gene contained in the genome of Shrimp White Spot Syndrome Virus (white spot baciliform virus). VGAM207 host target gene, herein designated VGAM HOST TARGET GENE, is a human gene contained in the human genome.

VGAM207 gene encodes a VGAM207 precursor RNA, herein designated VGAM PRECURSOR RNA. Similar to other miRNA genes, and unlike most ordinary genes, VGAM207 precursor RNA does not encode a protein. A nucleotide sequence identical or highly similar to the nucleotide sequence of VGAM207 precursor RNA is designated SEQ ID:193, and is provided hereinbelow with reference to the sequence listing part. Nucleotide sequence SEQ ID:193 is located at position 203744 relative to the genome of Shrimp White Spot Syndrome Virus (white spot baciliform virus).

VGAM207 precursor RNA folds onto itself, forming VGAM207 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM207 folded precursor RNA into VGAM207 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM207 RNA is designated SEQ ID:2918, and is provided hereinbelow with reference to the sequence listing part.

VGAM207 host target gene, herein designated VGAM HOST TARGET GENE, encodes a corresponding messenger RNA, VGAM207 host target RNA, herein designated VGAM HOST TARGET RNA. VGAM207 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM207 RNA, herein designated VGAM RNA, binds complementarily to one or more host target binding sites located in untranslated regions of VGAM207 host target RNA, herein designated VGAM HOST TARGET RNA. This complementary binding is due to the fact that the nucleotide sequence of VGAM207 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM207 RNA, herein designated VGAM RNA, may have a different number of host target binding sites in untranslated regions of a VGAM207 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM207 RNA, herein designated VGAM RNA, to host target binding sites on VGAM207 host target RNA, herein designated VGAM HOST TARGET RNA, such as BINDING SITE I, BINDING SITE II and BINDING SITE III, inhibits translation of VGAM207 host target RNA into VGAM207 host target protein, herein designated VGAM HOST TARGET PROTEIN. VGAM host target protein is therefore outlined by a broken line.

It is appreciated that VGAM207 host target gene, herein designated VGAM HOST TARGET GENE, in fact represents a plurality of VGAM207 host target genes. The mRNA of each one of this plurality of VGAM207 host target genes comprises one or more host target binding sites, each having a nucleotide sequence which is at least partly complementary to VGAM207 RNA, herein designated VGAM RNA, and which when bound by VGAM207 RNA causes inhibition of translation of respective one or more VGAM207 host target proteins.

It is further appreciated by one skilled in the art that the mode of translational inhibition illustrated by FIG. 1 with specific reference to translational inhibition exerted by VGAM207 gene, herein designated VGAM GENE, on one or more VGAM207 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM207 is inhibition of expression of host target genes, as part of a novel viral mechanism of attacking a host. Accordingly, utilities of VGAM207 include diagnosis, prevention and treatment of viral infection by Shrimp White Spot Syndrome Virus (white spot bacilliform virus). Specific functions, and accordingly utilities, of VGAM207 correlate with, and may be deduced from, the identity of the host target genes which VGAM207 binds and inhibits, and the function of these host target genes, as elaborated hereinbelow.

Nucleotide sequences of the VGAM207 precursor RNA, herein designated VGAM PRECURSOR RNA, and of the 'diced' VGAM207 RNA, herein designated VGAM RNA, and a schematic representation of the secondary folding of VGAM207 folded precursor RNA, herein designated VGAM FOLDED PRECURSOR RNA, of VGAM207 are further described hereinbelow with reference to Table 1.

Nucleotide sequences of host target binding sites, such as BINDING SITE-I, BINDING SITE-II and BINDING SITE-III of FIG. 1, found on VGAM207 host target RNA, and schematic representation of the complementarity of each of these host target binding sites to VGAM207 RNA, herein designated VGAM RNA, are described hereinbelow with reference to Table 2.

As mentioned hereinabove with reference to FIG. 1, a function of VGAM207 gene, herein designated VGAM is inhibition of expression of VGAM207 target genes. It is appreciated that specific functions, and accordingly utilities, of VGAM207 correlate with, and may be deduced from, the identity of the target genes which VGAM207 binds and inhibits, and the function of these target genes, as elaborated hereinbelow.

Optic Atrophy 3 (autosomal recessive, with chorea and spastic paraplegia) (OPA3, Accession NM_025136) is a VGAM207 host target gene. OPA3 BINDING SITE is HOST TARGET binding site found in the 3' untranslated region of mRNA encoded by OPA3, corresponding to a HOST TARGET binding site such as BINDING SITE I, BINDING SITE II or BINDING SITE III. Table 2 illustrates the complementarity of the nucleotide sequences of OPA3 BINDING SITE, designated SEQ ID:24776, to the nucleotide sequence of VGAM207 RNA, herein designated VGAM RNA, also designated SEQ ID:2918.

A function of VGAM207 is therefore inhibition of Optic Atrophy 3 (autosomal recessive, with chorea and spastic paraplegia) (OPA3, Accession NM_025136). Accordingly, utilities of VGAM207 include diagnosis, prevention and treatment of diseases and clinical conditions associated with OPA3. LOC159184 (Accession XM_010658) is another VGAM207 host target gene. LOC159184 BINDING SITE is HOST TARGET binding site found in the 5' untranslated region of mRNA encoded by LOC159184, corresponding to a HOST TARGET binding site such as BINDING SITE I, BINDING SITE II or BINDING SITE III. Table 2 illustrates the complementarity of the nucleotide sequences of LOC159184 BINDING SITE, designated SEQ ID:30162, to the nucleotide sequence of VGAM207 RNA, herein designated VGAM RNA, also designated SEQ ID:2918.

Another function of VGAM207 is therefore inhibition of LOC159184 (Accession XM_010658). Accordingly, utilities of VGAM207 include diagnosis, prevention and treatment of diseases and clinical conditions associated with LOC159184. FIG. 1 further provides a conceptual description of a novel bioinformatically detected viral gene of the present invention, referred to here as Viral Genomic Address Messenger 208 (VGAM208) viral gene, which modulates expression of respective host target genes thereof, the function and utility of which host target genes is known in the art.

VGAM208 is a novel bioinformatically detected regulatory, non protein coding, viral micro RNA (miRNA) gene. The method by which VGAM208 was detected is described hereinabove with reference to FIGS. 1-8.

VGAM208 gene, herein designated VGAM GENE, is a viral gene contained in the genome of Shrimp White Spot Syndrome Virus (white spot bacilliform virus). VGAM208 host target gene, herein designated VGAM HOST TARGET GENE, is a human gene contained in the human genome.

VGAM208 gene encodes a VGAM208 precursor RNA, herein designated VGAM PRECURSOR RNA. Similar to other miRNA genes, and unlike most ordinary genes, VGAM208 precursor RNA does not encode a protein. A nucleotide sequence identical or highly similar to the nucleotide sequence of VGAM208 precursor RNA is designated SEQ ID:194, and is provided hereinbelow with reference to the sequence listing part. Nucleotide sequence SEQ ID:194 is located at position 15808 relative to the genome of Shrimp White Spot Syndrome Virus (white spot bacilliform virus).

VGAM208 precursor RNA folds onto itself, forming VGAM208 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM208 folded precursor RNA into VGAM208 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM208 RNA is designated SEQ ID:2919, and is provided hereinbelow with reference to the sequence listing part.

VGAM208 host target gene, herein designated VGAM HOST TARGET GENE, encodes a corresponding messenger RNA, VGAM208 host target RNA, herein designated VGAM HOST TARGET RNA. VGAM208 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM208 RNA, herein designated VGAM RNA, binds complementarily to one or more host target binding sites located in untranslated regions of VGAM208 host target RNA, herein designated VGAM HOST TARGET RNA. This complementary binding is due to the fact that the nucleotide sequence of VGAM208 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM208 RNA, herein designated VGAM RNA, may have a different number of host target binding sites in untranslated regions of a VGAM208 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM208 RNA, herein designated VGAM RNA, to host target binding sites on VGAM208 host target RNA, herein designated VGAM HOST TARGET RNA, such as BINDING SITE I, BINDING SITE II and BINDING SITE III, inhibits translation of VGAM208 host target RNA into VGAM208 host target protein, herein designated VGAM HOST TARGET PROTEIN. VGAM host target protein is therefore outlined by a broken line.

It is appreciated that VGAM208 host target gene, herein designated VGAM HOST TARGET GENE, in fact represents a plurality of VGAM208 host target genes. The mRNA of each one of this plurality of VGAM208 host target genes comprises one or more host target binding sites, each having a nucleotide sequence which is at least partly complementary to VGAM208 RNA, herein designated VGAM RNA, and which when bound by VGAM208 RNA causes inhibition of translation of respective one or more VGAM208 host target proteins.

It is further appreciated by one skilled in the art that the mode of translational inhibition illustrated by FIG. 1 with specific reference to translational inhibition exerted by VGAM208 gene, herein designated VGAM GENE, on one or more VGAM208 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM208 is inhibition of expression of host target genes, as part of a novel viral mechanism of attacking a host. Accordingly, utilities of VGAM208 include diagnosis, prevention and treatment of viral infection by Shrimp White Spot Syndrome Virus (white spot bacilliform virus). Specific functions, and accordingly utilities, of VGAM208 correlate with, and may be deduced from, the identity of the host target genes which VGAM208 binds and inhibits, and the function of these host target genes, as elaborated hereinbelow.

Nucleotide sequences of the VGAM208 precursor RNA, herein designated VGAM PRECURSOR RNA, and of the 'diced' VGAM208 RNA, herein designated VGAM RNA, and a schematic representation of the secondary folding of VGAM208 folded precursor RNA, herein designated VGAM FOLDED PRECURSOR RNA, of VGAM208 are further described hereinbelow with reference to Table 1.

Nucleotide sequences of host target binding sites, such as BINDING SITE-I, BINDING SITE-II and BINDING SITE-III of FIG. 1, found on VGAM208 host target RNA, and schematic representation of the complementarity of each of these host target binding sites to VGAM208 RNA, herein designated VGAM RNA, are described hereinbelow with reference to Table 2.

As mentioned hereinabove with reference to FIG. 1, a function of VGAM208 gene, herein designated VGAM is inhibition of expression of VGAM208 target genes. It is appreciated that specific functions, and accordingly utilities, of VGAM208 correlate with, and may be deduced from, the identity of the target genes which VGAM208 binds and inhibits, and the function of these target genes, as elaborated hereinbelow.

Activin A Receptor, Type IB (ACVR1B, Accession NM_004302) is a VGAM208 host target gene. ACVR1B BINDING SITE is HOST TARGET binding site found in the 3' untranslated region of mRNA encoded by ACVR1B, corresponding to a HOST TARGET binding site such as BINDING SITE I, BINDING SITE II or BINDING SITE III. Table 2 illustrates the complementarity of the nucleotide sequences of ACVR1B BINDING SITE, designated SEQ ID:10511, to the nucleotide sequence of VGAM208 RNA, herein designated VGAM RNA, also designated SEQ ID:2919.

A function of VGAM208 is therefore inhibition of Activin A Receptor, Type IB (ACVR1B, Accession NM_004302), a gene which Activin receptor-like kinase; similar to activin, TGF-beta, and C. elegans daf-1 receptors. Accordingly, utilities of VGAM208 include diagnosis, prevention and treatment of diseases and clinical conditions associated with ACVR1B. The function of ACVR1B has been established by previous studies. See ACVRL1 (OMIM Ref. No. 601284). Human cDNA clones encoding 4 putative transmembrane ser/thr kinases were identified by ten Dijke et al. (1993). Using degenerate DNA primers based on the human activin receptor type II (see OMIM Ref. No. 102581) and C. elegans Daf-1 gene products, they PCR-amplified mRNA from human erythroleukemia (HEL) cells, a cell type known to respond both to activin (OMIM Ref. No. 147290) and TGF-beta (OMIM Ref. No. 190180). Their partial clone of the ALK4 gene encodes a 383-amino acid polypeptide with a truncated extracellular domain but sequence and structural domain similarities with the other 3 ALK genes they cloned. ALK1, ALK2 (OMIM Ref. No. 102576), ALK3 (OMIM Ref. No. 601299), and ALK4 share approximately 40% sequence identity with activin receptors type II and IIB, TGF-beta receptor (see OMIM Ref. No. 190181), and Daf-1 in their kinase domains but share 60 to 79% sequence identity among themselves, suggesting to ten Dijke et al. (1993) that the ALK gene products form a subfamily of receptor ser/thr kinases. By Northern analysis, ten Dijke et al. (1993) showed that ALK4 is expressed in many tissues, most strongly in human kidney, pancreas, brain, lung, and liver. Su et al. (2001) described the gene structure and novel somatic mutations of the activin type IB receptor in pancreatic cancer. This was the first description of ACVR1B as a tumor suppressor gene.

Full details of the abovementioned studies are described in the following publications, the disclosure of which are hereby incorporated by reference:

ten Dijke, P.; Ichijo, H.; Franzen, P.; Schulz, P.; Saras, J.; Toyoshima, H.; Heldin, C.-H.; Miyazono, K.: Activin receptor-like kinases: a novel subclass of cell-surface receptors with predicted serine/threonine kinase activity. Oncogene 8:2879-2887, 1993; and Su, G. H.; Bansal, R.; Murphy, K. M.; Montgomery, E.; Yeo, C. J.; Hruban, R. H.; Kern, S. E.: ACVR1B (ALK4, activin receptor type 1B) gene mutations in pancreatic carcinoma. Proc. Nat.

Further studies establishing the function and utilities of ACVR1B are found in John Hopkins OMIM database record ID 601300, and in sited publications numbered 6501, 650 and 6503-6504 listed in the bibliography section hereinbelow, which are also hereby incorporated by reference. Kinesin Family Member 3C (KIF3C, Accession NM_002254) is another VGAM208 host target gene. KIF3C BINDING SITE is HOST TARGET binding site found in the 3' untranslated region of mRNA encoded by KIF3C, corresponding to a HOST TARGET binding site such as BINDING SITE I, BINDING SITE II or BINDING SITE III. Table 2 illustrates the complementarity of the nucleotide sequences of KIF3C BINDING SITE, designated SEQ ID:8056, to the nucleotide sequence of VGAM208 RNA, herein designated VGAM RNA, also designated SEQ ID:2919.

Another function of VGAM208 is therefore inhibition of Kinesin Family Member 3C (KIF3C, Accession NM_002254). Accordingly, utilities of VGAM208 include diagnosis, prevention and treatment of diseases and clinical conditions associated with KIF3C. Adaptor-related Protein Complex 3, Sigma 2 Subunit (AP3S2, Accession NM_005829) is another VGAM208 host target gene. AP3S2 BINDING SITE is HOST TARGET binding site found in the 3' untranslated region of mRNA encoded by AP3S2, corresponding to a HOST TARGET binding site such as BINDING SITE I, BINDING SITE II or BINDING SITE III. Table 2 illustrates the complementarity of the nucleotide sequences of AP3S2 BINDING SITE, designated SEQ ID:12438, to the nucleotide sequence of VGAM208 RNA, herein designated VGAM RNA, also designated SEQ ID:2919.

Another function of VGAM208 is therefore inhibition of Adaptor-related Protein Complex 3, Sigma 2 Subunit (AP3S2, Accession NM_005829). Accordingly, utilities of VGAM208 include diagnosis, prevention and treatment of diseases and clinical conditions associated with AP3S2. DRIL2 (Accession NM_006465) is another VGAM208 host target gene. DRIL2 BINDING SITE is HOST TARGET binding site found in the 3' untranslated region of mRNA encoded by DRIL2, corresponding to a HOST TARGET binding site such as BINDING SITE I, BINDING SITE II or BINDING SITE III. Table 2 illustrates the complementarity of the nucleotide sequences of DRIL2 BINDING SITE, designated SEQ ID:13183, to the nucleotide sequence of VGAM208 RNA, herein designated VGAM RNA, also designated SEQ ID:2919.

Another function of VGAM208 is therefore inhibition of DRIL2 (Accession NM_006465). Accordingly, utilities of VGAM208 include diagnosis, prevention and treatment of diseases and clinical conditions associated with DRIL2. FLJ23311 (Accession NM_024680) is another VGAM208 host target gene. FLJ23311 BINDING SITE is HOST TARGET binding site found in the 5' untranslated region of mRNA encoded by FLJ23311, corresponding to a HOST TARGET binding site such as BINDING SITE I, BINDING SITE II or BINDING SITE III. Table 2 illustrates the complementarity of the nucleotide sequences of FLJ23311 BINDING SITE, designated SEQ ID:23992, to the nucleotide sequence of VGAM208 RNA, herein designated VGAM RNA, also designated SEQ ID:2919.

Another function of VGAM208 is therefore inhibition of FLJ23311 (Accession NM_024680). Accordingly, utilities of VGAM208 include diagnosis, prevention and treatment of diseases and clinical conditions associated with FLJ23311. KIAA0193 (Accession NM_014766) is another VGAM208 host target gene. KIAA0193 BINDING SITE is HOST TARGET binding site found in the 3' untranslated region of mRNA encoded by KIAA0193, corresponding to a HOST TARGET binding site such as BINDING SITE I, BINDING SITE II or BINDING SITE III. Table 2 illustrates the complementarity of the nucleotide sequences of KIAA0193 BINDING SITE, designated SEQ ID:16539, to the nucleotide sequence of VGAM208 RNA, herein designated VGAM RNA, also designated SEQ ID:2919.

Another function of VGAM208 is therefore inhibition of KIAA0193 (Accession NM_014766). Accordingly, utilities of VGAM208 include diagnosis, prevention and treatment of diseases and clinical conditions associated with KIAA0193. MGC4172 (Accession NM_024308) is another VGAM208 host target gene. MGC4172 BINDING SITE is HOST TARGET binding site found in the 3' untranslated region of mRNA encoded by MGC4172, corresponding to a HOST TARGET binding site such as BINDING SITE I, BINDING SITE II or BINDING SITE III. Table 2 illustrates the complementarity of the nucleotide sequences of MGC4172 BINDING SITE, designated SEQ ID:23601, to the nucleotide sequence of VGAM208 RNA, herein designated VGAM RNA, also designated SEQ ID:2919.

Another function of VGAM208 is therefore inhibition of MGC4172 (Accession NM_024308). Accordingly, utilities of VGAM208 include diagnosis, prevention and treatment of diseases and clinical conditions associated with MGC4172. LOC112609 (Accession XM_053013) is another VGAM208 host target gene. LOC112609 BINDING SITE is HOST TARGET binding site found in the 3' untranslated region of mRNA encoded by LOC112609, corresponding to a HOST TARGET binding site such as BINDING SITE I, BINDING SITE II or BINDING SITE III. Table 2 illustrates the complementarity of the nucleotide sequences of LOC112609 BINDING SITE, designated SEQ ID:36058, to the nucleotide sequence of VGAM208 RNA, herein designated VGAM RNA, also designated SEQ ID:2919.

Another function of VGAM208 is therefore inhibition of LOC112609 (Accession XM_053013). Accordingly, utilities of VGAM208 include diagnosis, prevention and treatment of diseases and clinical conditions associated with LOC112609. LOC196484 (Accession XM_031807) is another VGAM208 host target gene. LOC196484 BINDING SITE is HOST TARGET binding site found in the 5' untranslated region of mRNA encoded by LOC196484, corresponding to a HOST TARGET binding site such as BINDING SITE I, BINDING SITE II or BINDING SITE III. Table 2 illustrates the complementarity of the nucleotide sequences of LOC196484 BINDING SITE, designated SEQ ID:31485, to the nucleotide sequence of VGAM208 RNA, herein designated VGAM RNA, also designated SEQ ID:2919.

Another function of VGAM208 is therefore inhibition of LOC196484 (Accession XM_031807). Accordingly, utilities of VGAM208 include diagnosis, prevention and treatment of diseases and clinical conditions associated with LOC196484. LOC220073 (Accession XM_167847) is another VGAM208 host target gene. LOC220073 BINDING SITE is HOST TARGET binding site found in the 5' untranslated region of mRNA encoded by LOC220073, corresponding to a HOST TARGET binding site such as BINDING SITE I, BINDING SITE II or BINDING SITE III. Table 2 illustrates the complementarity of the nucleotide sequences of LOC220073 BINDING SITE, designated SEQ ID:44873, to the nucleotide sequence of VGAM208 RNA, herein designated VGAM RNA, also designated SEQ ID:2919.

Another function of VGAM208 is therefore inhibition of LOC220073 (Accession XM_167847). Accordingly, utilities of VGAM208 include diagnosis, prevention and treatment of diseases and clinical conditions associated with LOC220073. LOC91069 (Accession XM_035824) is another VGAM208 host target gene. LOC91069 BINDING SITE is HOST TARGET binding site found in the 3' untranslated region of mRNA encoded by LOC91069, corresponding to a HOST TARGET binding site such as BINDING SITE I, BINDING SITE II or BINDING SITE III. Table 2 illustrates the complementarity of the nucleotide sequences of LOC91069 BINDING SITE, designated SEQ ID:32345, to the nucleotide sequence of VGAM208 RNA, herein designated VGAM RNA, also designated SEQ ID:2919.

Another function of VGAM208 is therefore inhibition of LOC91069 (Accession XM_035824). Accordingly, utilities of VGAM208 include diagnosis, prevention and treatment of diseases and clinical conditions associated with LOC91069. FIG. 1 further provides a conceptual description of a novel bioinformatically detected viral gene of the present invention, referred to here as Viral Genomic Address Messenger 209 (VGAM209) viral gene, which modulates expression of respective host target genes thereof, the function and utility of which host target genes is known in the art.

VGAM209 is a novel bioinformatically detected regulatory, non protein coding, viral micro RNA (miRNA) gene. The method by which VGAM209 was detected is described hereinabove with reference to FIGS. 1-8.

VGAM209 gene, herein designated VGAM GENE, is a viral gene contained in the genome of Shrimp White Spot Syndrome Virus (white spot bacilliform virus). VGAM209 host target gene, herein designated VGAM HOST TARGET GENE, is a human gene contained in the human genome.

VGAM209 gene encodes a VGAM209 precursor RNA, herein designated VGAM PRECURSOR RNA. Similar to other miRNA genes, and unlike most ordinary genes, VGAM209 precursor RNA does not encode a protein. A nucleotide sequence identical or highly similar to the nucleotide sequence of VGAM209 precursor RNA is designated SEQ ID:195, and is provided hereinbelow with reference to the sequence listing part. Nucleotide sequence SEQ ID:195 is located at position 72618 relative to the genome of Shrimp White Spot Syndrome Virus (white spot bacilliform virus).

VGAM209 precursor RNA folds onto itself, forming VGAM209 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM209 folded precursor RNA into VGAM209 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM209 RNA is designated SEQ ID:2920, and is provided hereinbelow with reference to the sequence listing part.

VGAM209 host target gene, herein designated VGAM HOST TARGET GENE, encodes a corresponding messenger RNA, VGAM209 host target RNA, herein designated VGAM HOST TARGET RNA. VGAM209 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM209 RNA, herein designated VGAM RNA, binds complementarily to one or more host target binding sites located in untranslated regions of VGAM209 host target RNA, herein designated VGAM HOST TARGET RNA. This complementary binding is due to the fact that the nucleotide sequence of VGAM209 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM209 RNA, herein designated VGAM RNA, may have a different number of host target binding sites in untranslated regions of a VGAM209 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM209 RNA, herein designated VGAM RNA, to host target binding sites on VGAM209 host target RNA, herein designated VGAM HOST TARGET RNA, such as BINDING SITE I, BINDING SITE II and BINDING SITE III, inhibits translation of VGAM209 host target RNA into VGAM209 host target protein, herein designated VGAM HOST TARGET PROTEIN. VGAM host target protein is therefore outlined by a broken line.

It is appreciated that VGAM209 host target gene, herein designated VGAM HOST TARGET GENE, in fact represents a plurality of VGAM209 host target genes. The mRNA of each one of this plurality of VGAM209 host target genes comprises one or more host target binding sites, each having a nucleotide sequence which is at least partly complementary to VGAM209 RNA, herein designated VGAM RNA, and which when bound by VGAM209 RNA causes inhibition of translation of respective one or more VGAM209 host target proteins.

It is further appreciated by one skilled in the art that the mode of translational inhibition illustrated by FIG. 1 with specific reference to translational inhibition exerted by VGAM209 gene, herein designated VGAM GENE, on one or more VGAM209 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM209 is inhibition of expression of host target genes, as part of a novel viral mechanism of attacking a host. Accordingly, utilities of VGAM209 include diagnosis, prevention and treatment of viral infection by Shrimp White Spot Syndrome Virus (white spot bacilliform virus). Specific functions, and accordingly utilities, of VGAM209 correlate with, and may be deduced from, the identity of the host target genes which VGAM209 binds and inhibits, and the function of these host target genes, as elaborated hereinbelow.

Nucleotide sequences of the VGAM209 precursor RNA, herein designated VGAM PRECURSOR RNA, and of the 'diced' VGAM209 RNA, herein designated VGAM RNA, and a schematic representation of the secondary folding of VGAM209 folded precursor RNA, herein designated VGAM FOLDED PRECURSOR RNA, of VGAM209 are further described hereinbelow with reference to Table 1.

Nucleotide sequences of host target binding sites, such as BINDING SITE-I, BINDING SITE-II and BINDING SITE-III of FIG. 1, found on VGAM209 host target RNA, and schematic representation of the complementarity of each of these host target binding sites to VGAM209 RNA, herein designated VGAM RNA, are described hereinbelow with reference to Table 2.

As mentioned hereinabove with reference to FIG. 1, a function of VGAM209 gene, herein designated VGAM is inhibition of expression of VGAM209 target genes. It is appreciated that specific functions, and accordingly utilities, of VGAM209 correlate with, and may be deduced from, the identity of the target genes which VGAM209 binds and inhibits, and the function of these target genes, as elaborated hereinbelow.

Insulin-like Growth Factor 2 Receptor (IGF2R, Accession NM_000876) is a VGAM209 host target gene. IGF2R BINDING SITE is HOST TARGET binding site found in the 3' untranslated region of mRNA encoded by IGF2R, corresponding to a HOST TARGET binding site such as BINDING SITE I, BINDING SITE II or BINDING SITE III. Table 2 illustrates the complementarity of the nucleotide sequences of IGF2R BINDING SITE, designated SEQ ID:6560, to the nucleotide sequence of VGAM209 RNA, herein designated VGAM RNA, also designated SEQ ID:2920.

A function of VGAM209 is therefore inhibition of Insulin-like Growth Factor 2 Receptor (IGF2R, Accession NM_000876), a gene which transport of phosphorylated lysosomal enzymes from the golgi complex and the cell surface to lysosomes. lysosomal enzymes bearing phosphomannosyl residues bind specifically to mannose-6-phosphate receptors in the golgi apparatus and the resulting receptor-ligand complex is transported to an acidic prelyosomal compartment where the low ph mediates the dissociation of the complex. this receptor also binds insulin growth factor ii. Accordingly, utilities of VGAM209 include diagnosis, prevention and treatment of diseases and clinical conditions associated with IGF2R. The function of IGF2R has been established by previous studies. The mannose 6-phosphate/insulin-like growth factor II receptor functions in the intracellular trafficking of lysosomal enzymes, the activation of the potent growth inhibitor, transforming growth factor beta, and the degradation of IGF2, a mitogen often overproduced in tumors. De Souza et al. (1995) demonstrated that 70% of human hepatocellular tumors have loss of heterozygosity (LOH) at the M6P/IGF2R locus at 6q26. In a separate report, De Souza et al. (1995) described a mutation screen that identified point mutations in the remaining allele of 25% of human hepatocellular carcinomas with LOH. One mutation created an alternative splice site within an intron (corresponding to intron 40 in mouse) and resulted in a truncated receptor; 2 others (147280.0001, 147280.0002) gave rise to significant amino acid substitutions. These mutations provided evidence to the authors that the M6P/IGF2R gene functions as a tumor suppressor in human liver carcinogenesis. Souza et al. (1996) reported that the IGF2R gene contains a number of microsatellite repeats within its coding sequence. They demonstrated microsatellite instability in this gene in 12 of 92 gastrointestinal tumors studied which were replication/repair error-positive. Mutations occurred in 6 of the poorly differentiated tumors. They noted an anticorrespondence of IGF2R and TGFBR2 (OMIM Ref. No. 190182) mutations. Of 31 gastrointestinal lesions studied with IGF2R or TGFBR2 mutations, 90% (28) contained mutations in one or the other, but not both, of these genes. Souza et al. (1996) demonstrated that all but 1 of the mutations occurred within an 8-polydeoxyguanine tract spanning nucleotides 4089-4096 of the IGF2R coding sequence. In 1 case of gastric adenocarcinoma, mutation occurred in a polyCT tract spanning nucleotides 6169-6180. These mutations all comprised 1- or 2-bp deletions or insertions within the microsatellite region, causing frameshifts and premature stop codons downstream. Souza et al. (1996) noted that the TGFBR2 gene is also subject to microsatellite instability within its coding region. They noted further that IGF2R and TGFBR2 genes comprise serial points in the same tumorigenesis pathway, since mutation of either gene alone occurred in 90% of the gastrointestinal tumors that they analyzed. To facilitate genetic analyses of the imprint status of human M6P/IGF2R and loss of heterozygosity at this locus in cancer, Killian et al. (2001) screened American and Japanese populations for M6P/IGF2R single nucleotide polymorphisms (SNPs). They identified 9 novel intragenic SNPs and 3 amino acid variants in the ligand-binding domains of M6P/IGF2R that may be under selection in human S Animal model experiments lend further support to the function of IGF2R. To determine whether paternal expression of the Igf2r gene is necessary for early development in the mouse, Lau et al. (1994) derived mice in which the gene had been disrupted by targeted mutagenesis in embryonic stem (ES) cells with the subsequent introduction of the mutation into the germline of mice. Lau et al. (1994) found that murine embryos that inherit a nonfunctional Igf2r gene from their father are viable and develop normally into adults; however, most mice inheriting the same mutated allele from their mothers die around the time of birth as a consequence of major cardiac abnormalities. The mice that inherit the mutant allele from their mothers do not express Igf2r in their tissues, are 25 to 30% larger than their normal sibs, have elevated levels of circulating IGF2 and IGF-binding proteins, and exhibit a slight kink in the tail. The findings of overgrowth may support the suggestion that relaxation of maternal imprinting of IGF2 plays a role in the features of Beckwith-Wiedemann syndrome (OMIM Ref. No. 130650) (Feinberg, 1993).

It is appreciated that the abovementioned animal model for IGF2R is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lau, M. M. H.; Stewart, C. E. H.; Liu, Z.; Bhatt, H.; Rotwein, P.; Stewart, C. L. : Loss of the imprinted IGF2/cation-independent mannose 6-phosphate receptor results in fetal overgrowth and perinatal lethality. Genes Dev. 8:2953-2963, 1994; and Sleutels, F.; Zwart, R.; Barlow, D. P.: The non-coding Air RNA is required for silencing autosomal imprinted genes. Nature 415:810-813, 2002.

Further studies establishing the function and utilities of IGF2R are found in John Hopkins OMIM database record ID 147280, and in sited publications numbered 4824-4839, 470 and 5228-5240 listed in the bibliography section hereinbelow, which are also hereby incorporated by reference. Neural Precursor Cell Expressed, Developmentally Down-regulated 4 (NEDD4, Accession XM_046129) is another VGAM209 host target gene. NEDD4 BINDING SITE is HOST TARGET binding site found in the 3' untranslated region of mRNA encoded by NEDD4, corresponding to a HOST TARGET binding site such as BINDING SITE I, BINDING SITE II or BINDING SITE III. Table 2 illustrates the complementarity of the nucleotide sequences of NEDD4 BINDING SITE, designated SEQ ID:34692, to the nucleotide sequence of VGAM209 RNA, herein designated VGAM RNA, also designated SEQ ID:2920.

Another function of VGAM209 is therefore inhibition of Neural Precursor Cell Expressed, Developmentally Down-regulated 4 (NEDD4, Accession XM_046129), a gene which ubiquitinates regulatory proteins involved in transcription. Accordingly, utilities of VGAM209 include diagnosis, prevention and treatment of diseases and clinical conditions associated with NEDD4. The function of NEDD4 has been established by previous studies. Kumar et al. (1992) identified Nedd4 as one of a group of mouse genes that show developmentally regulated expression in mouse embryonic brain. Kumar et al. (1997) showed that Nedd4 is expressed in various other embryonic tissues and persists in most adult tissues. Using antibody raised against a fusion protein, they demonstrated that the Nedd4 protein is localized to the cellular cytoplasm. Kumar et al. (1997) reported that the human NEDD4 protein has 86% amino acid identity with the mouse protein. It has homology to ubiquitin-protein ligases and contains 4 protein-protein interaction (WW) domains and a calcium/phospholipid binding domain. Imhof and McDonnell (1996) found that both human NEDD4 and yeast RSP5 potentiate hormone-dependent activation of transcription by the human progesterone and glucocorticoid receptors. They used mutant proteins to show that neither the ubiquitin-protein ligase activity nor the WW domains are absolutely required for the potentiation of the steroid receptors.

Full details of the abovementioned studies are described in the following publications, the disclosure of which are hereby incorporated by reference:

Imhof, M. O.; McDonnell, D. P.: Yeast RSP5 and its human homolog hRPF1 potentiate hormone-dependent activation of transcription by human progesterone and glucocorticoid receptors. Molec. Cell. Biol. 16:2594-2605, 1996; and Kumar, S.; Harvey, K. F.; Kinoshita, M.; Copeland, N. G.; Noda, M.; Jenkins, N. A. : cDNA cloning, expression analysis, and mapping of the mouse Nedd4 gene. Genomics 40:435-443, 1997.

Further studies establishing the function and utilities of NEDD4 are found in John Hopkins OMIM database record ID 602278, and in sited publications numbered 7555-280 and 1596 listed in the bibliography section hereinbelow, which are also hereby incorporated by reference. RAD17 Homolog (S. pombe) (RAD17, Accession NM_133340) is another VGAM209 host target gene. RAD17 BINDING SITE is HOST TARGET binding site found in the 5' untranslated region of mRNA encoded by RAD17, corresponding to a HOST TARGET binding site such as BINDING SITE I, BINDING SITE II or BINDING SITE III. Table 2 illustrates the complementarity of the nucleotide sequences of RAD17 BINDING SITE, designated SEQ ID:28481, to the nucleotide sequence of VGAM209 RNA, herein designated VGAM RNA, also designated SEQ ID:2920.

Another function of VGAM209 is therefore inhibition of RAD17 Homolog (S. pombe) (RAD17, Accession NM_133340), a gene which may have a role in DNA damage-dependent and DNA replication-dependent cell cycle checkpoints. Accordingly, utilities of VGAM209 include diagnosis, prevention and treatment of diseases and clinical conditions associated with RAD17. The function of RAD17 has been established by previous studies. Cell cycle checkpoints are complex signal transduction pathways that ensure the coordination of the timing and order of cell cycle events. These checkpoint pathways play critical roles in maintaining genomic stability and integrity to prevent the development of cancer and hereditary diseases. In the fission yeast Schizosaccharomyces pombe, the rad17 gene is required for both the DNA damage-dependent and the DNA replication-dependent cell cycle checkpoints. Parker et al. (1998) identified expressed sequence tags corresponding to a human homolog of S. pombe rad17. By PCR, they isolated a human SK-N-MC neuroblastoma cell cDNA containing the complete open reading frame of this homolog, RAD17. The deduced 670-amino acid RAD17 protein has a calculated molecular mass of 71 kD and has 20% sequence identity to S. pombe rad17. Northern blot analysis detected an approximately 3.0-kb transcript in all tissues examined, with elevated levels in testis and cancer cell lines. Although human RAD17 did not complement the checkpoint phenotypes of an S. pombe rad17 mutant, it interacted with human RAD1 (OMIM Ref. No. 603153) in a yeast 2-hybrid system, and Parker et al. (1998) suggested that it is the homolog of S. pombe rad17.

Full details of the abovementioned studies are described in the following publications, the disclosure of which are hereby incorporated by reference:

Parker, A. E.; Van de Weyer, I.; Laus, M. C.; Verhasselt, P.; Luyten, W. H. M. L. : Identification of a human homologue of the Schizosaccharomyces pombe rad17+ checkpoint gene. J. Biol. Chem. 273:18340-18346, 1998. Note: Erratum: J. Biol. Chem. 274:24438-24439, 1999; and Bao, S.; Tibbetts, R. S.; Brumbaugh, K. M.; Fang, Y.; Richardson, D. A.; Ali, A.; Chen, S. M.; Abraham, R. T.; Wang, X.-F.: ATR/ATM-mediated phosphorylation of human Rad17 is required f.

Further studies establishing the function and utilities of RAD17 are found in John Hopkins OMIM database record ID 603139, and in sited publications numbered 5065, 1010 and 5423-5424 listed in the bibliography section hereinbelow, which are also hereby incorporated by reference. BC022889 (Accession XM_096964) is another VGAM209 host target gene. BC022889 BINDING SITE is HOST TARGET binding site found in the 3' untranslated region of mRNA encoded by BC022889, corresponding to a HOST TARGET binding site such as BINDING SITE I, BINDING SITE II or BINDING SITE III. Table 2 illustrates the complementarity of the nucleotide sequences of BC022889 BINDING SITE, designated SEQ ID:40685, to the nucleotide sequence of VGAM209 RNA, herein designated VGAM RNA, also designated SEQ ID:2920.

Another function of VGAM209 is therefore inhibition of BC022889 (Accession XM_096964). Accordingly, utilities of VGAM209 include diagnosis, prevention and treatment of diseases and clinical conditions associated with BC022889. FIG. 1 further provides a conceptual description of a novel bioinformatically detected viral gene of the present invention, referred to here as Viral Genomic Address Messenger 210 (VGAM210) viral gene, which modulates expression of respective host target genes thereof, the function and utility of which host target genes is known in the art.

VGAM210 is a novel bioinformatically detected regulatory, non protein coding, viral micro RNA (miRNA) gene. The method by which VGAM210 was detected is described hereinabove with reference to FIGS. 1-8.

VGAM210 gene, herein designated VGAM GENE, is a viral gene contained in the genome of Shrimp White Spot Syndrome Virus (white spot bacilliform virus). VGAM210 host target gene, herein designated VGAM HOST TARGET GENE, is a human gene contained in the human genome.

VGAM210 gene encodes a VGAM210 precursor RNA, herein designated VGAM PRECURSOR RNA. Similar to other miRNA genes, and unlike most ordinary genes, VGAM210 precursor RNA does not encode a protein. A nucleotide sequence identical or highly similar to the nucleotide sequence of VGAM210 precursor RNA is designated SEQ ID:196, and is provided hereinbelow with reference to the sequence listing part. Nucleotide sequence SEQ ID:196 is located at position 58881 relative to the genome of Shrimp White Spot Syndrome Virus (white spot bacilliform virus).

VGAM210 precursor RNA folds onto itself, forming VGAM210 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM210 folded precursor RNA into VGAM210 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM210 RNA is designated SEQ ID:2921, and is provided hereinbelow with reference to the sequence listing part.

VGAM210 host target gene, herein designated VGAM HOST TARGET GENE, encodes a corresponding messenger RNA, VGAM210 host target RNA, herein designated VGAM HOST TARGET RNA. VGAM210 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM210 RNA, herein designated VGAM RNA, binds complementarily to one or more host target binding sites located in untranslated regions of VGAM210 host target RNA, herein designated VGAM HOST TARGET RNA. This complementary binding is due to the fact that the nucleotide sequence of VGAM210 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM210 RNA, herein designated VGAM RNA, may have a different number of host target binding sites in untranslated regions of a VGAM210 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM210 RNA, herein designated VGAM RNA, to host target binding sites on VGAM210 host target RNA, herein designated VGAM HOST TARGET RNA, such as BINDING SITE I, BINDING SITE II and BINDING SITE III, inhibits translation of VGAM210 host target RNA into VGAM210 host target protein, herein designated VGAM HOST TARGET PROTEIN. VGAM host target protein is therefore outlined by a broken line.

It is appreciated that VGAM210 host target gene, herein designated VGAM HOST TARGET GENE, in fact represents a plurality of VGAM210 host target genes. The mRNA of each one of this plurality of VGAM210 host target genes comprises one or more host target binding sites, each having a nucleotide sequence which is at least partly complementary to VGAM210 RNA, herein designated VGAM RNA, and which when bound by VGAM210 RNA causes inhibition of translation of respective one or more VGAM210 host target proteins.

It is further appreciated by one skilled in the art that the mode of translational inhibition illustrated by FIG. 1 with specific reference to translational inhibition exerted by VGAM210 gene, herein designated VGAM GENE, on one or more VGAM210 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM210 is inhibition of expression of host target genes, as part of a novel viral mechanism of attacking a host. Accordingly, utilities of VGAM210 include diagnosis, prevention and treatment of viral infection by Shrimp White Spot Syndrome Virus (white spot bacilliform virus). Specific functions, and accordingly utilities, of VGAM210 correlate with, and may be deduced from, the identity of the host target genes which VGAM210 binds and inhibits, and the function of these host target genes, as elaborated hereinbelow.

Nucleotide sequences of the VGAM210 precursor RNA, herein designated VGAM PRECURSOR RNA, and of the 'diced' VGAM210 RNA, herein designated VGAM RNA, and a schematic representation of the secondary folding of VGAM210 folded precursor RNA, herein designated VGAM FOLDED PRECURSOR RNA, of VGAM210 are further described hereinbelow with reference to Table 1.

Nucleotide sequences of host target binding sites, such as BINDING SITE-I, BINDING SITE-II and BINDING SITE-III of FIG. 1, found on VGAM210 host target RNA, and schematic representation of the complementarity of each of these host target binding sites to VGAM210 RNA, herein designated VGAM RNA, are described hereinbelow with reference to Table 2.

As mentioned hereinabove with reference to FIG. 1, a function of VGAM210 gene, herein designated VGAM is inhibition of expression of VGAM210 target genes. It is appreciated that specific functions, and accordingly utilities, of VGAM210 correlate with, and may be deduced from, the identity of the target genes which VGAM210 binds and inhibits, and the function of these target genes, as elaborated hereinbelow.

Cadherin 3, Type 1, P-cadherin (placental) (CDH3, Accession NM_001793) is a VGAM210 host target gene. CDH3 BINDING SITE is HOST TARGET binding site found in the 3' untranslated region of mRNA encoded by CDH3, corresponding to a HOST TARGET binding site such as BINDING SITE I, BINDING SITE II or BINDING SITE III. Table 2 illustrates the complementarity of the nucleotide sequences of CDH3 BINDING SITE, designated SEQ ID:7545, to the nucleotide sequence of VGAM210 RNA, herein designated VGAM RNA, also designated SEQ ID:2921.

A function of VGAM210 is therefore inhibition of Cadherin 3, Type 1, P-cadherin (placental) (CDH3, Accession NM_001793), a gene which is a calcium dependent cell adhesion protein. Accordingly, utilities of VGAM210 include diagnosis, prevention and treatment of diseases and clinical conditions associated with CDH3. The function of CDH3 has been established by previous studies. Cadherins are a multigene family of Ca (2+)-dependent cell adhesion molecules. They are transmembrane glycoproteins consisting of an extracellular domain, a transmembrane region, and a cytoplasmic domain. The extracellular domains mediate Ca (2+)-dependent intercellular adhesion by homophilic interactions. The binding properties and specificities of the adhesive function are located in the N-terminal part of the molecules. Neural (OMIM Ref. No. 114020), placental (OMIM Ref. No. 114021), and epithelial (also called uvomorulin; 192090) forms of cadherin have been characterized. Donalies et al. (1991) identified a member of the cadherin family in myogenic mouse cells and referred to it as M-cadherin. It was not found in fibroblasts and was expressed at low levels in myoblasts. It is upregulated after induction of myotube formation, indicating a specific function in skeletal muscle cell differentiation. Kaupmann et al. (1992) used a mouse myotube-derived cDNA encoding M-cadherin to demonstrate linkage of the gene (symbolized Cdh3 by them) to the gene for E-cadherin (uvomorulin; Um) in a mouse interspecific backcross. The linkage group is located on chromosome 8 in a region of conserved synteny with human chromosome 16q. The gene order was cen--Junb--Um--Tat--(Cdh3/Aprt). The human homolog, symbolized CDH3 by them, was mapped to 16q24.1-qter by analyzing human/mouse somatic cell hybrids. Kremmidiotis et al. (1998) mapped the human CDH15 gene to 16q24.3 using somatic cell hybrid panels.

Full details of the abovementioned studies are described in the following publications, the disclosure of which are hereby incorporated by reference:

Donalies, M.; Cramer, M.; Ringwald, M.; Starzinski-Powitz, A.: Expression of M-cadherin, a member of the cadherin multigene family, correlates with differentiation of skeletal muscle cells. Proc. Nat. Acad. Sci. 88:8024-8028, 1991; and Kaupmann, K.; Becker-Follmann, J.; Scherer, G.; Jockusch, H.; Starzinski-Powitz, A.: The gene for the cell adhesion molecule M-cadherin maps to mouse chromosome 8 and human chromosome.

Further studies establishing the function and utilities of CDH3 are found in John Hopkins OMIM database record ID 114019, and in sited publications numbered 11644-11646 listed in the bibliography section hereinbelow, which are also hereby incorporated by reference. Dual-specificity tyrosine-(Y)-phosphorylation Regulated Kinase 1A (DYRK1A, Accession NM_001396) is another VGAM210 host target gene. DYRK1A BINDING SITE1 through DYRK1A BINDING SITE3 are HOST TARGET binding sites found in untranslated regions of mRNA encoded by DYRK1A, corresponding to HOST TARGET binding sites such as BINDING SITE I, BINDING SITE II or BINDING SITE III. Table 2 illustrates the complementarity of the nucleotide sequences of DYRK1A BINDING SITE1 through DYRK1A BINDING SITE3, designated SEQ ID:7092, SEQ ID:28160 and SEQ ID:28185 respectively, to the nucleotide sequence of VGAM210 RNA, herein designated VGAM RNA, also designated SEQ ID:2921.

Another function of VGAM210 is therefore inhibition of Dual-specificity tyrosine-(Y)-phosphorylation Regulated Kinase 1A (DYRK1A, Accession NM_001396), a gene which regulates cell proliferation and may be involved in brain development. Accordingly, utilities of VGAM210 include diagnosis, prevention and treatment of diseases and clinical conditions associated with DYRK1A. The function of DYRK1A and its association with various diseases and clinical conditions, has been established by previous studies, as described hereinabove with reference to VGAM42. Interleukin 22 Receptor, Alpha 2 (IL22RA2, Accession NM_052962) is another VGAM210 host target gene. IL22RA2 BINDING SITE is HOST TARGET binding site found in the 3' untranslated region of mRNA encoded by IL22RA2, corresponding to a HOST TARGET binding site such as BINDING SITE I, BINDING SITE II or BINDING SITE III. Table 2 illustrates the complementarity of the nucleotide sequences of IL22RA2 BINDING SITE, designated SEQ ID:27521, to the nucleotide sequence of VGAM210 RNA, herein designated VGAM RNA, also designated SEQ ID:2921.

Another function of VGAM210 is therefore inhibition of Interleukin 22 Receptor, Alpha 2 (IL22RA2, Accession NM_052962), a gene which induces the production of acute-phase reactants. Accordingly, utilities of VGAM210 include diagnosis, prevention and treatment of diseases and clinical conditions associated with IL22RA2. The function of IL22RA2 and its association with various diseases and clinical conditions, has been established by previous studies, as described hereinabove with reference to VGAM167. Jerky Homolog (mouse) (JRK, Accession XM_098818) is another VGAM210 host target gene. JRK BINDING SITE is HOST TARGET binding site found in the 3" untranslated region of mRNA encoded by JRK, corresponding to a HOST TARGET binding site such as BINDING SITE I, BINDING SITE II or BINDING SITE III. Table 2 illustrates the complementarity of the nucleotide sequences of JRK BINDING SITE, designated SEQ ID:41834, to the nucleotide sequence of VGAM210 RNA, herein designated VGAM RNA, also designated SEQ ID:2921.

Another function of VGAM210 is therefore inhibition of Jerky Homolog (mouse) (JRK, Accession XM_098818), a gene which might function as a DNA-binding protein. Accordingly, utilities of VGAM210 include diagnosis, prevention and treatment of diseases and clinical conditions associated with JRK. The function of JRK has been established by previous studies. Toth et al. (1995) found that insertional inactivation of the mouse 'jerky' gene resulted in handling-induced whole body jerks, generalized clonic seizures, and epileptic brain activity. All homozygous animals displayed seizures. Homozygotes also displayed some degree of kyphosis of the thoracic spine and were proportionate dwarfs. Approximately half died before 3 months of age. Approximately 50% of the hemizygous animals showed generalized clonic seizures. The other hemizygous animals either displayed seizures limited to the head and limbs or showed no seizure activity. There was no apparent correlation between the level of jerky mRNA and the severity of seizures in hemizygotes. Toth et al. (1995) reported the sequence of jerky and a corrected version in a published erratum. The predicted protein has homology to several nuclear regulatory proteins, including CENPB (OMIM Ref. No. 117140), suggesting that jerky might function as a DNA-binding protein. By searching an EST database, Morita et al. (1998) identified a human infant brain cDNA encoding JH8 (jerky homolog of human on chromosome 8). Using this cDNA as a probe, they recovered additional clones corresponding to the entire JH8 coding region. The predicted 520-amino acid protein shares 76% and 41% sequence identity with jerky and HHMJG (OMIM Ref. No. 603211), respectively. Northern blot analysis revealed that JH8 is expressed as a 9.5-kb mRNA in all tissues. Additional smaller bands were also detected. Toth et al. (1995) mapped the jerky gene to mouse chromosome 15 by analysis of an interspecific backcross. By fluorescence in situ hybridization and analysis of a radiation hybrid panel, Morita et al. (1998) mapped the JH8 gene to 8q24. The mouse chromosome region containing jerky shows homology of synteny with human chromosome 8q24, suggesting that JH8, rather than HHMJG, is the human homolog of jerky. Morita et al. (1998) considered JH8 a prominent candidate gene for childhood absence epilepsy-1 (OMIM Ref. No. 600131), which maps to 8q24.

Full details of the abovementioned studies are described in the following publications, the disclosure of which are hereby incorporated by reference:

Morita, R.; Miyazaki, E.; Fong, C. G.; Chen, X.-N.; Korenberg, J. R.; Delgado-Escueta, A. V.; Yamakawa, K.: JH8, a gene highly homologous to the mouse jerky gene, maps to the region for childhood absence epilepsy on 8q24. Biochem. Biophys. Res. Commun. 248:307-314, 1998; and Toth, M.; Grimsby, J.; Buzsaki, G.; Donovan, G. P.: Epileptic seizures caused by inactivation of a novel gene, jerky, related to centromere binding protein-B in transgenic mice. Nature.

Further studies establishing the function and utilities of JRK are found in John Hopkins OMIM database record ID 603210, and in sited publications numbered 5437-5438 listed in the bibliography section hereinbelow, which are also hereby incorporated by reference. Pyruvate Dehydrogenase Kinase, Isoenzyme 4 (PDK4, Accession XM_173198) is another VGAM210 host target gene. PDK4 BINDING SITE is HOST TARGET binding site found in the 3' untranslated region of mRNA encoded by PDK4, corresponding to a HOST TARGET binding site such as BINDING SITE I, BINDING SITE II or BINDING SITE III. Table 2 illustrates the complementarity of the nucleotide sequences of PDK4 BINDING SITE, designated SEQ ID:46444, to the nucleotide sequence of VGAM210 RNA, herein designated VGAM RNA, also designated SEQ ID:2921.

Another function of VGAM210 is therefore inhibition of Pyruvate Dehydrogenase Kinase, Isoenzyme 4 (PDK4, Accession XM_173198). Accordingly, utilities of VGAM210 include diagnosis, prevention and treatment of diseases and clinical conditions associated with PDK4. Protein Phosphatase 1, Regulatory (inhibitor) Subunit 8 (PPP1R8, Accession NM_138558) is another VGAM210 host target gene. PPP1R8 BINDING SITE1 through PPP1R8 BINDING SITE3 are HOST TARGET binding sites found in untranslated regions of mRNA encoded by PPP1R8, corresponding to HOST TARGET binding sites such as BINDING SITE I, BINDING SITE II or BINDING SITE III. Table 2 illustrates the complementarity of the nucleotide sequences of PPP1R8 BINDING SITE1 through PPP1R8 BINDING SITE3, designated SEQ ID:28858, SEQ ID:15342 and SEQ ID:8572 respectively, to the nucleotide sequence of VGAM210 RNA, herein designated VGAM RNA, also designated SEQ ID:2921.

Another function of VGAM210 is therefore inhibition of Protein Phosphatase 1, Regulatory (inhibitor) Subunit 8 (PPP1R8, Accession NM_138558), a gene which is an inhibitor subunit of the major nuclear protein phosphatase-1 (pp-1). Accordingly, utilities of VGAM210 include diagnosis, prevention and treatment of diseases and clinical conditions associated with PPP1R8. The function of PPP1R8 and its association with various diseases and clinical conditions, has been established by previous studies, as described hereinabove with reference to VGAM101. SWI/SNF Related, Matrix Associated, Actin Dependent Regulator of Chromatin, Subfamily D, Member 1 (SMARCD1, Accession NM_003076) is another VGAM210 host target gene. SMARCD1 BINDING SITE1 and SMARCD1 BINDING SITE2 are HOST TARGET binding sites found in untranslated regions of mRNA encoded by SMARCD1, corresponding to HOST TARGET binding sites such as BINDING SITE I, BINDING SITE II or BINDING SITE III. Table 2 illustrates the complementarity of the nucleotide sequences of SMARCD1 BINDING SITE1 and SMARCD1 BINDING SITE2, designated SEQ ID:9049 and SEQ ID:29147 respectively, to the nucleotide sequence of VGAM210 RNA, herein designated VGAM RNA, also designated SEQ ID:2921.

Another function of VGAM210 is therefore inhibition of SWI/SNF Related, Matrix Associated, Actin Dependent Regulator of Chromatin, Subfamily D, Member 1 (SMARCD1, Accession NM_003076), a gene which is involved in chromatin assembly and remodeling. Accordingly, utilities of VGAM210 include diagnosis, prevention and treatment of diseases and clinical conditions associated with SMARCD1. The function of SMARCD1 and its association with various diseases and clinical conditions, has been established by previous studies, as described hereinabove with reference to VGAM152. Transforming Growth Factor, Beta Receptor II (70/80 kDa) (TGFBR2, Accession NM_003242) is another VGAM210 host target gene. TGFBR2 BINDING SITE is HOST TARGET binding site found in the 3' untranslated region of mRNA encoded by TGFBR2, corresponding to a HOST TARGET binding site such as BINDING SITE I, BINDING SITE II or BINDING SITE III. Table 2 illustrates the complementarity of the nucleotide sequences of TGFBR2 BINDING SITE, designated SEQ ID:9241, to the nucleotide sequence of VGAM210 RNA, herein designated VGAM RNA, also designated SEQ ID:2921.

Another function of VGAM210 is therefore inhibition of Transforming Growth Factor, Beta Receptor II (70/80 kDa) (TGFBR2, Accession NM_003242). Accordingly, utilities of VGAM210 include diagnosis, prevention and treatment of diseases and clinical conditions associated with TGFBR2. Thymidine Kinase 2, Mitochondrial (TK2, Accession NM_004614) is another VGAM210 host target gene. TK2 BINDING SITE is HOST TARGET binding site found in the 3' untranslated region of mRNA encoded by TK2, corresponding to a HOST TARGET binding site such as BINDING SITE I, BINDING SITE II or BINDING SITE III. Table 2 illustrates the complementarity of the nucleotide sequences of TK2 BINDING SITE, designated SEQ ID:10958, to the nucleotide sequence of VGAM210 RNA, herein designated VGAM RNA, also designated SEQ ID:2921.

Another function of VGAM210 is therefore inhibition of Thymidine Kinase 2, Mitochondrial (TK2, Accession NM_004614), a gene which phosphorylates thymidine, deoxycytidine, deoxyuridine, and also anti-viral and anticancer nucleoside analogs. Accordingly, utilities of VGAM210 include diagnosis, prevention and treatment of diseases and clinical conditions associated with TK2. The function of TK2 has been established by previous studies. Johansson and Karlsson (1997) cloned cDNAs encoding human TK2. The gene encodes a 234-amino acid polypeptide. Although TK2 is believed to reside in mitochondria, it contains no mitochondrial translocation signal sequence. Northern blot analysis revealed that TK2 was ubiquitously expressed as 2 transcripts of 2.4 and 4 kb. Expression of the TK2 cDNA revealed a 60-kD protein with phosphorylation activity similar to purified human TK2. Based on the partial protein sequence of human TK2, Wang et al. (1999) isolated a human brain TK2 cDNA. These authors noted that although the cDNA they isolated corresponds to the full-length mature protein, it is likely to be incomplete because it lacks the coding region for a mitochondrial target presequence. They reported that the predicted protein sequence matched that of purified TK2, but differed at the N-terminus and at amino acid 28 from the TK2 sequence deduced by Johansson and Karlsson (1997). TK2 shares approximately 40% identity with deoxycytidine kinase (OMIM Ref. No. 125450) and deoxyguanosine kinase (OMIM Ref. No. 601465) on the amino acid level. Wang et al. (1999) characterized both recombinant and native TK2 forms and found that the enzyme has broad substrate specificity and complex kinetics, suggesting that it may play a role in the activation of chemotherapeutic nucleoside analogs. Northern blot analysis indicated that the TK2 gene was expressed as multiple transcripts, some of which show a tissue-specific pattern. The highest levels of expression were observed in testis and ovary. Saada et al. (2001) identified 2 mutations in TK2, his90 to asn (188250.0001) and ile181 to asn (188250.0002), in 4 individuals who developed devastating myopathy and depletion of muscular mtDNA in infancy. In these individuals, the activity of TK2 in muscle mitochondria was reduced to 14 to 45% of the mean value in healthy control individuals. Mandel et al. (2001) identified mutations in the DGUOK gene in another form of mtDNA depletion syndrome, the hepatocerebral form (see OMIM Ref. No. 251880). They noted that the main supply of dNTPs for mtDNA synthesis comes from the salvage pathway initiated by DGK and TK2. The association of mtDNA depletion with mutations in the genes encoding these 2 kinases suggested that the salvage pathway enzymes are involved in the maintenance of balanced mitochondrial dNTP pools.

Full details of the abovementioned studies are described in the following publications, the disclosure of which are hereby incorporated by reference:

Wang, L.; Munch-Petersen, B.; Herrstrom Sjoberg, A.; Hellman, U.; Bergman, T.; Jornvall, H.; Eriksson, S.: Human thymidine kinase 2: molecular cloning and characterisation of the enzyme activity with antiviral and cytostatic nucleoside substrates. FEBS Lett. 443:170-174, 1999; and Saada, A.; Shaag, A.; Mandel, H.; Nevo, Y.; Eriksson, S.; Elpeleg, O.: Mutant mitochondrial thymidine kinase in mitochondrial DNA depletion myopathy. Nature Genet. 29:342-344, 2001.

Further studies establishing the function and utilities of TK2 are found in John Hopkins OMIM database record ID 188250, and in sited publications numbered 10085-10089 listed in the bibliography section hereinbelow, which are also hereby incorporated by reference. WAS Protein Family, Member 1 (WASF1, Accession NM_003931) is another VGAM210 host target gene. WASF1 BINDING SITE is HOST TARGET binding site found in the 5' untranslated region of mRNA encoded by WASF1, corresponding to a HOST TARGET binding site such as BINDING SITE I, BINDING SITE II or BINDING SITE III. Table 2 illustrates the complementarity of the nucleotide sequences of WASF1 BINDING SITE, designated SEQ ID:10031, to the nucleotide sequence of VGAM210 RNA, herein designated VGAM RNA, also designated SEQ ID:2921.

Another function of VGAM210 is therefore inhibition of WAS Protein Family, Member 1 (WASF1, Accession NM_003931), a gene which is a downstream effector molecules involved in the transmission of signals to the actin cytoskeleton. Accordingly, utilities of VGAM210 include diagnosis, prevention and treatment of diseases and clinical conditions associated with WASF1. The function of WASF1 has been established by previous studies. Eden et al. (2002) reported a mechanism by which RAC1 and the adaptor protein NCK (OMIM Ref. No. 600508) activate actin nucleation through WAVE1. WAVE1 exists in a heterotetrameric complex that includes orthologs of human PIR121 (OMIM Ref. No. 606323), NAP125 (OMIM Ref. No. 604891), and HSPC300. Whereas recombinant WAVE1 is constitutively active, the WAVE1 complex is inactive. Eden et al. (2002) proposed that Rac1 and Nck cause dissociation of the WAVE1 complex, which releases active WAVE1-HSPC300 and leads to actin nucleation. Eden et al. (2002) also determined that ABI2 (OMIM Ref. No. 606442) interacts with WAVE1 and appears to remain associated with the NAP125-PIR121 subcomplex upon dissociation of the WAVE1 complex. By searching databases for WASP-like molecules containing the highly conserved verprolin homology (VPH) domain, Miki et al. (1998) identified the KIAA0269 cDNA (Nagase et al., 1996) encoding WASF1, which they called WAVE. Sequence analysis predicted that WASF1 has no similarity to WASP or WASL in the N terminus, through which WASP and WASL are regulated by CDC42. The N terminus of WASF1 contains a putative leucine zipper motif and a highly basic region. The midsequence proline-rich region and the C-terminal VPH domain and highly acidic region of WASF1 are similar to WASP family proteins. Western blot analysis showed higher expression of WASF1 in neuronal cell lines than in fibroblast or kidney cell lines. Confocal microscopy demonstrated that WASF1 is expressed in a dot-like pattern in the cytoplasm and is concentrated in RAC-regulated membrane-ruffling areas. Mutational analysis and immunofluorescence microscopy showed that WASF1 induces actin reorganization downstream of RAC. By screening a brain cDNA library using a yeast 2-hybrid Full details of the abovementioned studies are described in the following publications, the disclosure of which are hereby incorporated by reference:

Eden, S.; Rohatgi, R.; Podtelejnikov, A. V.; Mann, M.; Kirschner, M. W.: Mechanism of regulation of WAVE1-induced actin nucleation by Rac1 and Nck. Nature 418:790-793, 2002; and Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human gen.

Further studies establishing the function and utilities of WASF1 are found in John Hopkins OMIM database record ID 605035, and in sited publications numbered 10410, 1063 and 9011 listed in the bibliography section hereinbelow, which are also hereby incorporated by reference. DKFZp434N074 (Accession XM_031481) is another VGAM210 host target gene. DKFZp434N074 BINDING SITE is HOST TARGET binding site found in the 5' untranslated region of mRNA encoded by DKFZp434N074, corresponding to a HOST TARGET binding site such as BINDING SITE I, BINDING SITE II or BINDING SITE III. Table 2 illustrates the complementarity of the nucleotide sequences of DKFZp434N074 BINDING SITE, designated SEQ ID:31389, to the nucleotide sequence of VGAM210 RNA, herein designated VGAM RNA, also designated SEQ ID:2921.

Another function of VGAM210 is therefore inhibition of DKFZp434N074 (Accession XM_031481). Accordingly, utilities of VGAM210 include diagnosis, prevention and treatment of diseases and clinical conditions associated with DKFZp434N074. FLJ21477 (Accession NM_025153) is another VGAM210 host target gene. FLJ21477 BINDING SITE is HOST TARGET binding site found in the 3' untranslated region of mRNA encoded by FLJ21477, corresponding to a HOST TARGET binding site such as BINDING SITE I, BINDING SITE II or BINDING SITE III. Table 2 illustrates the complementarity of the nucleotide sequences of FLJ21477 BINDING SITE, designated SEQ ID:24789, to the nucleotide sequence of VGAM210 RNA, herein designated VGAM RNA, also designated SEQ ID:2921.

Another function of VGAM210 is therefore inhibition of FLJ21477 (Accession NM_025153). Accordingly, utilities of VGAM210 include diagnosis, prevention and treatment of diseases and clinical conditions associated with FLJ21477. HSPC054 (Accession NM_014152) is another VGAM210 host target gene. HSPC054 BINDING SITE is HOST TARGET binding site found in the 3' untranslated region of mRNA encoded by HSPC054, corresponding to a HOST TARGET binding site such as BINDING SITE I, BINDING SITE II or BINDING SITE III. Table 2 illustrates the complementarity of the nucleotide sequences of HSPC054 BINDING SITE, designated SEQ ID:15433, to the nucleotide sequence of VGAM210 RNA, herein designated VGAM RNA, also designated SEQ ID:2921.

Another function of VGAM210 is therefore inhibition of HSPC054 (Accession NM_014152). Accordingly, utilities of VGAM210 include diagnosis, prevention and treatment of diseases and clinical conditions associated with HSPC054. P37NB (Accession NM_005824) is another VGAM210 host target gene. P37NB BINDING SITE is HOST TARGET binding site found in the 3' untranslated region of mRNA encoded by P37NB, corresponding to a HOST TARGET binding site such as BINDING SITE I, BINDING SITE II or BINDING SITE III. Table 2 illustrates the complementarity of the nucleotide sequences of P37NB BINDING SITE, designated SEQ ID:12434, to the nucleotide sequence of VGAM210 RNA, herein designated VGAM RNA, also designated SEQ ID:2921.

Another function of VGAM210 is therefore inhibition of P37NB (Accession NM_005824). Accordingly, utilities of VGAM210 include diagnosis, prevention and treatment of diseases and clinical conditions associated with P37NB. LOC114971 (Accession XM_054936) is another VGAM210 host target gene. LOC114971 BINDING SITE is HOST TARGET binding site found in the 3' untranslated region of mRNA encoded by LOC114971, corresponding to a HOST TARGET binding site such as BINDING SITE I, BINDING SITE II or BINDING SITE III. Table 2 illustrates the complementarity of the nucleotide sequences of LOC114971 BINDING SITE, designated SEQ ID:36209, to the nucleotide sequence of VGAM210 RNA, herein designated VGAM RNA, also designated SEQ ID:2921.

Another function of VGAM210 is therefore inhibition of LOC114971 (Accession XM_054936). Accordingly, utilities of VGAM210 include diagnosis, prevention and treatment of diseases and clinical conditions associated with LOC114971. LOC133686 (Accession XM_059667) is another VGAM210 host target gene. LOC133686 BINDING SITE is HOST TARGET binding site found in the 3' untranslated region of mRNA encoded by LOC133686, corresponding to a HOST TARGET binding site such as BINDING SITE I, BINDING SITE II or BINDING SITE III. Table 2 illustrates the complementarity of the nucleotide sequences of LOC133686 BINDING SITE, designated SEQ ID:37056, to the nucleotide sequence of VGAM210 RNA, herein designated VGAM RNA, also designated SEQ ID:2921.

Another function of VGAM210 is therefore inhibition of LOC133686 (Accession XM_059667). Accordingly, utilities of VGAM210 include diagnosis, prevention and treatment of diseases and clinical conditions associated with LOC133686. LOC146226 (Accession XM_096946) is another VGAM210 host target gene. LOC146226 BINDING SITE is HOST TARGET binding site found in the 5' untranslated region of mRNA encoded by LOC146226, corresponding to a HOST TARGET binding site such as BINDING SITE I, BINDING SITE II or BINDING SITE III. Table 2 illustrates the complementarity of the nucleotide sequences of LOC146226 BINDING SITE, designated SEQ ID:40662, to the nucleotide sequence of VGAM210 RNA, herein designated VGAM RNA, also designated SEQ ID:2921.

Another function of VGAM210 is therefore inhibition of LOC146226 (Accession XM_096946). Accordingly, utilities of VGAM210 include diagnosis, prevention and treatment of diseases and clinical conditions associated with LOC146226. LOC253263 (Accession XM_173102) is another VGAM210 host target gene. LOC253263 BINDING SITE is HOST TARGET binding site found in the 3' untranslated region of mRNA encoded by LOC253263, corresponding to a HOST TARGET binding site such as BINDING SITE I, BINDING SITE II or BINDING SITE III. Table 2 illustrates the complementarity of the nucleotide sequences of LOC253263 BINDING SITE, designated SEQ ID:46361, to the nucleotide sequence of VGAM210 RNA, herein designated VGAM RNA, also designated SEQ ID:2921.

Another function of VGAM210 is therefore inhibition of LOC253263 (Accession XM_173102). Accordingly, utilities of VGAM210 include diagnosis, prevention and treatment of diseases and clinical conditions associated with LOC253263. LOC90362 (Accession XM_031163) is another VGAM210 host target gene. LOC90362 BINDING SITE is HOST TARGET binding site found in the 5' untranslated region of mRNA encoded by LOC90362, corresponding to a HOST TARGET binding site such as BINDING SITE I, BINDING SITE II or BINDING SITE III. Table 2 illustrates the complementarity of the nucleotide sequences of LOC90362 BINDING SITE, designated SEQ ID:31295, to the nucleotide sequence of VGAM210 RNA, herein designated VGAM RNA, also designated SEQ ID:2921.

Another function of VGAM210 is therefore inhibition of LOC90362 (Accession XM_031163). Accordingly, utilities of VGAM210 include diagnosis, prevention and treatment of diseases and clinical conditions associated with LOC90362. LOC91263 (Accession XM_037264) is another VGAM210 host target gene. LOC91263 BINDING SITE is HOST TARGET binding site found in the 3' untranslated region of mRNA encoded by LOC91263, corresponding to a HOST TARGET binding site such as BINDING SITE I, BINDING SITE II or BINDING SITE III. Table 2 illustrates the complementarity of the nucleotide sequences of LOC91263 BINDING SITE, designated SEQ ID:32596, to the nucleotide sequence of VGAM210 RNA, herein designated VGAM RNA, also designated SEQ ID:2921.

Another function of VGAM210 is therefore inhibition of LOC91263 (Accession XM_037264). Accordingly, utilities of VGAM210 include diagnosis, prevention and treatment of diseases and clinical conditions associated with LOC91263. FIG. 1 further provides a conceptual description of a novel bioinformatically detected viral gene of the present invention, referred to here as Viral Genomic Address Messenger 211 (VGAM211) viral gene, which modulates expression of respective host target genes thereof, the function and utility of which host target genes is known in the art.

VGAM211 is a novel bioinformatically detected regulatory, non protein coding, viral micro RNA (miRNA) gene. The method by which VGAM211 was detected is described hereinabove with reference to FIGS. 1-8.

VGAM211 gene, herein designated VGAM GENE, is a viral gene contained in the genome of Simian Virus 40. VGAM211 host target gene, herein designated VGAM HOST TARGET GENE, is a human gene contained in the human genome.

VGAM211 gene encodes a VGAM211 precursor RNA, herein designated VGAM PRECURSOR RNA. Similar to other miRNA genes, and unlike most ordinary genes, VGAM211 precursor RNA does not encode a protein. A nucleotide sequence identical or highly similar to the nucleotide sequence of VGAM211 precursor RNA is designated SEQ ID:197, and is provided hereinbelow with reference to the sequence listing part. Nucleotide sequence SEQ ID:197 is located at position 112 relative to the genome of Simian Virus 40.

VGAM211 precursor RNA folds onto itself, forming VGAM211 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM211 folded precursor RNA into VGAM211 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM211 RNA is designated SEQ ID:2922, and is provided hereinbelow with reference to the sequence listing part.

VGAM211 host target gene, herein designated VGAM HOST TARGET GENE, encodes a corresponding messenger RNA, VGAM211 host target RNA, herein designated VGAM HOST TARGET RNA. VGAM211 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM211 RNA, herein designated VGAM RNA, binds complementarily to one or more host target binding sites located in untranslated regions of VGAM211 host target RNA, herein designated VGAM HOST TARGET RNA. This complementary binding is due to the fact that the nucleotide sequence of VGAM211 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM211 RNA, herein designated VGAM RNA, may have a different number of host target binding sites in untranslated regions of a VGAM211 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM211 RNA, herein designated VGAM RNA, to host target binding sites on VGAM211 host target RNA, herein designated VGAM HOST TARGET RNA, such as BINDING SITE I, BINDING SITE II and BINDING SITE III, inhibits translation of VGAM211 host target RNA into VGAM211 host target protein, herein designated VGAM HOST TARGET PROTEIN. VGAM host target protein is therefore outlined by a broken line.

It is appreciated that VGAM211 host target gene, herein designated VGAM HOST TARGET GENE, in fact represents a plurality of VGAM211 host target genes. The mRNA of each one of this plurality of VGAM211 host target genes comprises one or more host target binding sites, each having a nucleotide sequence which is at least partly complementary to VGAM211 RNA, herein designated VGAM RNA, and which when bound by VGAM211 RNA causes inhibition of translation of respective one or more VGAM211 host target proteins.

It is further appreciated by one skilled in the art that the mode of translational inhibition illustrated by FIG. 1 with specific reference to translational inhibition exerted by VGAM211 gene, herein designated VGAM GENE, on one or more VGAM211 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM211 is inhibition of expression of host target genes, as part of a novel viral mechanism of attacking a host. Accordingly, utilities of VGAM211 include diagnosis, prevention and treatment of viral infection by Simian Virus 40. Specific functions, and accordingly utilities, of VGAM211 correlate with, and may be deduced from, the identity of the host target genes which VGAM211 binds and inhibits, and the function of these host target genes, as elaborated hereinbelow.

Nucleotide sequences of the VGAM211 precursor RNA, herein designated VGAM PRECURSOR RNA, and of the 'diced' VGAM211 RNA, herein designated VGAM RNA, and a schematic representation of the secondary folding of VGAM211 folded precursor RNA, herein designated VGAM FOLDED PRECURSOR RNA, of VGAM211 are further described hereinbelow with reference to Table 1.

Nucleotide sequences of host target binding sites, such as BINDING SITE-I, BINDING SITE-II and BINDING SITE-III of FIG. 1, found on VGAM211 host target RNA, and schematic representation of the complementarity of each of these host target binding sites to VGAM211 RNA, herein designated VGAM RNA, are described hereinbelow with reference to Table 2.

As mentioned hereinabove with reference to FIG. 1, a function of VGAM211 gene, herein designated VGAM is inhibition of expression of VGAM211 target genes. It is appreciated that specific functions, and accordingly utilities, of VGAM211 correlate with, and may be deduced from, the identity of the target genes which VGAM211 binds and inhibits, and the function of these target genes, as elaborated hereinbelow.

A Disintegrin-like and Metalloprotease (reprolysin type) with Thrombospondin Type 1 Motif, 3 (ADAMTS3, Accession NM_014243) is a VGAM211 host target gene. ADAMTS3 BINDING SITE is HOST TARGET binding site found in the 3' untranslated region of mRNA encoded by ADAMTS3, corresponding to a HOST TARGET binding site such as BINDING SITE I, BINDING SITE II or BINDING SITE III. Table 2 illustrates the complementarity of the nucleotide sequences of ADAMTS3 BINDING SITE, designated SEQ ID:15509, to the nucleotide sequence of VGAM211 RNA, herein designated VGAM RNA, also designated SEQ ID:2922.

A function of VGAM211 is therefore inhibition of A Disintegrin-like and Metalloprotease (reprolysin type) with Thrombospondin Type 1 Motif, 3 (ADAMTS3, Accession NM_014243), a gene which cleaves the propeptides of type ii collagen prior to fibril assembly. Accordingly, utilities of VGAM211 include diagnosis, prevention and treatment of diseases and clinical conditions associated with ADAMTS3. The function of ADAMTS3 has been established by previous studies. Members of the ADAMTS family contain a signal peptide, a prodomain, a metalloproteinase domain, a disintegrin-like domain, varying numbers of thrombospondin type 1 motifs, and a cysteine-rich domain. See ADAMTS5 (OMIM Ref. No. 605007) for additional background information on the ADAMTS family. By sequencing randomly selected cDNAs corresponding to relatively long transcripts from human brain, Nagase et al. (1997) identified a partial ADAMTS3 cDNA, which they called KIAA0366, that lacked 5-prime coding sequence. The deduced partial ADAMTS3 protein had 1,201 amino acids. In vitro transcribed/translated ADAMTS3 protein had an apparent molecular mass of larger than 100 kD by SDS-PAGE. The authors examined ADAMTS3 expression in 14 human tissues using RT-PCR. By radiation hybrid mapping, Nagase et al. (1997) mapped the ADAMTS3 gene to chromosome 4. Hurskainen et al. (1999) mapped the ADAMTS3 gene to chromosome 4 using somatic cell hybrid analysis. They localized the ADAMTS3 gene to 4q21 by radiation hybrid mapping.

Full details of the abovementioned studies are described in the following publications, the disclosure of which are hereby incorporated by reference:

Nagase, T.; Ishikawa, K.; Nakajima, D.; Ohira, M.; Seki, N.; Miyajima, N.; Tanaka, A.; Kotani, H.; Nomura, N.; Ohara, O.: Prediction of the coding sequences of unidentified human genes. VII. The complete sequences of 100 new cDNA clones from brain which can code for large proteins in vitro. DNA Res. 4:141-150, 1997; and Hurskainen, T. L.; Hirohata, S.; Seldin, M. F.; Apte, S. S.: ADAM-TS5, ADAM-TS6, and ADAM-TS7, novel members of a new family of zinc metalloproteases: general features and genomic distr.

Further studies establishing the function and utilities of ADAMTS3 are found in John Hopkins OMIM database record ID 605011, and in sited publications numbered 760 and 7605 listed in the bibliography section hereinbelow, which are also hereby incorporated by reference. ADP-ribosylation Factor 4-like (ARF4L, Accession XM_045890) is another VGAM211 host target gene. ARF4L BINDING SITE is HOST TARGET binding site found in the 3' untranslated region of mRNA encoded by ARF4L, corresponding to a HOST TARGET binding site such as BINDING SITE I, BINDING SITE II or BINDING SITE III. Table 2 illustrates the complementarity of the nucleotide sequences of ARF4L BINDING SITE, designated SEQ ID:34604, to the nucleotide sequence of VGAM211 RNA, herein designated VGAM RNA, also designated SEQ ID:2922.

Another function of VGAM211 is therefore inhibition of ADP-ribosylation Factor 4-like (ARF4L, Accession XM_045890). Accordingly, utilities of VGAM211 include diagnosis, prevention and treatment of diseases and clinical conditions associated with ARF4L. ELAV (embryonic lethal, abnormal vision, Drosophila)-like 2 (Hu antigen B) (ELAVL2, Accession NM_004432) is another VGAM211 host target gene. ELAVL2 BINDING SITE is HOST TARGET binding site found in the 5' untranslated region of mRNA encoded by ELAVL2, corresponding to a HOST TARGET binding site such as BINDING SITE I, BINDING SITE II or BINDING SITE III. Table 2 illustrates the complementarity of the nucleotide sequences of ELAVL2 BINDING SITE, designated SEQ ID:10717, to the nucleotide sequence of VGAM211 RNA, herein designated VGAM RNA, also designated SEQ ID:2922.

Another function of VGAM211 is therefore inhibition of ELAV (embryonic lethal, abnormal vision, Drosophila)-like 2 (Hu antigen B) (ELAVL2, Accession NM_004432), a gene which binds rna. seems to recognize a gaaa motif. can bind to its own 3' untranslated region (3'utr), the c-fos 3'utr and the id 3'utr. Accordingly, utilities of VGAM211 include diagnosis, prevention and treatment of diseases and clinical conditions associated with ELAVL2. The function of ELAVL2 has been established by previous studies. Hel-N1 is an evolutionarily conserved neural-specific RNA-binding protein expressed in neurons of the brain. The rat and human cDNAs were cloned by King et al. (1994). The human cDNA, symbolized ELAVL2 for 'embryonic lethal abnormal vision-like 2,' encodes a predicted 359-amino acid protein that shows significant similarity to the product of the Drosophila elav gene, the absence of which causes multiple structural defects and hypotrophy of the fly's central nervous system. In situ hybridization of rat tissues demonstrated that the mRNA occurs within a subset of neurons of the hippocampus, cortex, and other areas of the gray matter (King et al., 1994). Hel-N1 was shown to bind in vitro to the 3-prime untranslated region of an mRNA for Id (OMIM Ref. No. 600349), an inhibitor of DNA binding. King (1994) showed that alternative splicing of a 91-bp exon produces a longer isoform. The ELAVL2-homologous gene is referred to as Hub in the mouse. It is one of the tumor antigens that underlie paraneoplastic neurologic disorders (PND), which arise when an immune response to systemic tumors expressing neuronal proteins ('onconeural antigens') develops into an autoimmune neuronal degeneration (Fletcher et al., 1997). It is in the class of neuron-specific RNA-binding proteins. Han et al. (1996) mapped the ELAVL2 gene to 9p21 by chromosome microdissection PCR and by fluorescence in situ hybridization. Fletcher et al. (1997) demonstrated that the mouse gene maps to mouse chromosome 4 close to the homolog of interferon alpha (OMIM Ref. No. 147660), which maps to 9p22 in the human genome Full details of the abovementioned studies are described in the following publications, the disclosure of which are hereby incorporated by reference:

Fletcher, C. F.; Okano, H. J.; Gilbert, D. J.; Yang, Y.; Yang, C.; Copeland, N. G.; Jenkins, N. A.; Darnell, R. B.: Mouse chromosomal locations of nine genes encoding homologs of human paraneoplastic neurologic disorder antigens. Genomics 45: 313-319, 1997; and Han, J.; Knops, J. F.; Longshore, J. W.; King, P. H.: Localization of human elav-like neuronal protein 1 (Hel-N1) on chromosome 9p21 by chromosome microdissection polymerase chain react.

Further studies establishing the function and utilities of ELAVL2 are found in John Hopkins OMIM database record ID 601673, and in sited publications numbered 238 and 9482-9484 listed in the bibliography section hereinbelow, which are also hereby incorporated by reference. Fyn-related Kinase (FRK, Accession NM_002031) is another VGAM211 host target gene. FRK BINDING SITE is HOST TARGET binding site found in the 5' untranslated region of mRNA encoded by FRK, corresponding to a HOST TARGET binding site such as BINDING SITE I, BINDING SITE II or BINDING SITE III. Table 2 illustrates the complementarity of the nucleotide sequences of FRK BINDING SITE, designated SEQ ID:7785, to the nucleotide sequence of VGAM211 RNA, herein designated VGAM RNA, also designated SEQ ID:2922.

Another function of VGAM211 is therefore inhibition of Fyn-related Kinase (FRK, Accession NM_002031), a gene which binds pRb (RB1) during G1 and S phase and suppresses growth. Accordingly, utilities of VGAM211 include diagnosis, prevention and treatment of diseases and clinical conditions associated with FRK. The function of FRK and its association with various diseases and clinical conditions, has been established by previous studies, as described hereinabove with reference to VGAM157. Spondin 1, (f-spondin) Extracellular Matrix Protein (SPON1, Accession XM_031184) is another VGAM211 host target gene. SPON1 BINDING SITE is HOST TARGET binding site found in the 3' untranslated region of mRNA encoded by SPON1, corresponding to a HOST TARGET binding site such as BINDING SITE I, BINDING SITE II or BINDING SITE III. Table 2 illustrates the complementarity of the nucleotide sequences of SPON1 BINDING SITE, designated SEQ ID:31302, to the nucleotide sequence of VGAM211 RNA, herein designated VGAM RNA, also designated SEQ ID:2922.

Another function of VGAM211 is therefore inhibition of Spondin 1, (f-spondin) Extracellular Matrix Protein (SPON1, Accession XM_031184). Accordingly, utilities of VGAM211 include diagnosis, prevention and treatment of diseases and clinical conditions associated with SPON1. Transcription Elongation Factor A (SII), 1 (TCEA1, Accession XM_087370) is another VGAM211 host target gene. TCEA1 BINDING SITE is HOST TARGET binding site found in the 3' untranslated region of mRNA encoded by TCEA1, corresponding to a HOST TARGET binding site such as BINDING SITE I, BINDING SITE II or BINDING SITE III. Table 2 illustrates the complementarity of the nucleotide sequences of TCEA1 BINDING SITE, designated SEQ ID:39202, to the nucleotide sequence of VGAM211 RNA, herein designated VGAM RNA, also designated SEQ ID:2922.

Another function of VGAM211 is therefore inhibition of Transcription Elongation Factor A (SII), 1 (TCEA1, Accession XM_087370), a gene which helps RNA polymerase II to transcribe past blockages. Accordingly, utilities of VGAM211 include diagnosis, prevention and treatment of diseases and clinical conditions associated with TCEA1. The function of TCEA1 has been established by previous studies. Transcription elongation factors help RNA polymerase II (see OMIM Ref. No. 180660) to transcribe past blockages due to specific DNA sequences, DNA-binding proteins, and transcription-arresting drugs. Transcription elongation factors in human S fall into 2 classes: the SIII (see OMIM Ref. No. 600788)/TF2F (see OMIM Ref. No. 189968) class, members of which increase the average rate of RNA chain elongation (Aso et al., 1995); and the SII class, which releases RNA polymerase II from transcriptional arrest (Reines, 1994). Park et al. (1994) cloned and characterized a human gene encoding an SII-type elongation factor. The gene, designated TFIIS by them, is 2.8 kb long, intronless, and produces a 2.5-kb transcript. DiMarco et al. (1996) designed PCR primers for the SII gene (also symbolized TCEA) and mapped it to human chromosome 3 by analysis of human-rodent hybrid mapping panel. Further regionalization to 3p22-p21.3 was accomplished by fluorescence in situ hybridization using a YAC containing the gene. DiMarco et al. (1996) cited reports that this region of 3p exhibits loss of heterozygosity (LOH) in small- and non-small-cell lung carcinomas as well as several other malignancies. Thomas et al. (1998) addressed whether the intrinsic 3-prime to 5-prime nuclease activity of human RNA polymerase II (OMIM Ref. No. pol II) can proofread during transcription in vitro. In the presence of SII, a protein that stimulates the nuclease activity, pol II quantitatively removed misincorporated nucleotides from the nascent transcript during rapid chain extension. The basis of discrimination between the correct and incorrect base was the slow addition of the next nucleotide to the mismatched terminus. Incorporation of inosine monophosphate inhibited the next nucleotide addition by a similar magnitude as a mismatched base. Thomas et al. (1998) demonstrated that addition of SII to a transcription reaction dramatically altered the RNA base content, reflecting the stable incorporation of more 'correct' (GMP) and fewer 'incorrect' (IMP) nucleotides.

Full details of the abovementioned studies are described in the following publications, the disclosure of which are hereby incorporated by reference:

DiMarco, S. P.; Glover, T. W.; Miller, D. E.; Reines, D.; Warren, S. T.: Transcription elongation factor SII (TCEA) maps to human chromosome 3p22-p21.3. Genomics 36:185-188, 1996; and Thomas, M. J.; Platas, A. A.; Hawley, D. K.: Transcriptional fidelity and proofreading by RNA polymerase II. Cell 93:627-637, 1998.

Further studies establishing the function and utilities of TCEA1 are found in John Hopkins OMIM database record ID 601425, and in sited publications numbered 1020 and 9273-9276 listed in the bibliography section hereinbelow, which are also hereby incorporated by reference. Chromosome 5 Open Reading Frame 4 (C5orf4, Accession NM_016348) is another VGAM211 host target gene. C5orf4 BINDING SITE1 and C5orf4 BINDING SITE2 are HOST TARGET binding sites found in untranslated regions of mRNA encoded by C5orf4, corresponding to HOST TARGET binding sites such as BINDING SITE I, BINDING SITE II or BINDING SITE III. Table 2 illustrates the complementarity of the nucleotide sequences of C5orf4 BINDING SITE1 and C5orf4 BINDING SITE2, designated SEQ ID:18474 and SEQ ID:26180 respectively, to the nucleotide sequence of VGAM211 RNA, herein designated VGAM RNA, also designated SEQ ID:2922.

Another function of VGAM211 is therefore inhibition of Chromosome 5 Open Reading Frame 4 (C5orf4, Accession NM_016348). Accordingly, utilities of VGAM211 include diagnosis, prevention and treatment of diseases and clinical conditions associated with C5orf4. FLJ11175 (Accession NM_018349) is another VGAM211 host target gene. FLJ11175 BINDING SITE is HOST TARGET binding site found in the 3' untranslated region of mRNA encoded by FLJ11175, corresponding to a HOST TARGET binding site such as BINDING SITE I, BINDING SITE II or BINDING SITE III. Table 2 illustrates the complementarity of the nucleotide sequences of FLJ11175 BINDING SITE, designated SEQ ID:20360, to the nucleotide sequence of VGAM211 RNA, herein designated VGAM RNA, also designated SEQ ID:2922.

Another function of VGAM211 is therefore inhibition of FLJ11175 (Accession NM_018349). Accordingly, utilities of VGAM211 include diagnosis, prevention and treatment of diseases and clinical conditions associated with FLJ11175. FLJ14054 (Accession NM_024563) is another VGAM211 host target gene. FLJ14054 BINDING SITE is HOST TARGET binding site found in the 3' untranslated region of mRNA encoded by FLJ14054, corresponding to a HOST TARGET binding site such as BINDING SITE I, BINDING SITE II or BINDING SITE III. Table 2 illustrates the complementarity of the nucleotide sequences of FLJ14054 BINDING SITE, designated SEQ ID:23785, to the nucleotide sequence of VGAM211 RNA, herein designated VGAM RNA, also designated SEQ ID:2922.

Another function of VGAM211 is therefore inhibition of FLJ14054 (Accession NM_024563). Accordingly, utilities of VGAM211 include diagnosis, prevention and treatment of diseases and clinical conditions associated with FLJ14054. Hippocalcin Like 4 (HPCAL4, Accession NM_016257) is another VGAM211 host target gene. HPCAL4 BINDING SITE is HOST TARGET binding site found in the 3' untranslated region of mRNA encoded by HPCAL4, corresponding to a HOST TARGET binding site such as BINDING SITE I, BINDING SITE II or BINDING SITE III. Table 2 illustrates the complementarity of the nucleotide sequences of HPCAL4 BINDING SITE, designated SEQ ID:18387, to the nucleotide sequence of VGAM211 RNA, herein designated VGAM RNA, also designated SEQ ID:2922.

Another function of VGAM211 is therefore inhibition of Hippocalcin Like 4 (HPCAL4, Accession NM_016257). Accordingly, utilities of VGAM211 include diagnosis, prevention and treatment of diseases and clinical conditions associated with HPCAL4. KIAA0931 (Accession XM_041191) is another VGAM211 host target gene. KIAA0931 BINDING SITE1 and KIAA0931 BINDING SITE2 are HOST TARGET binding sites found in untranslated regions of mRNA encoded by KIAA0931, corresponding to HOST TARGET binding sites such as BINDING SITE I, BINDING SITE II or BINDING SITE III. Table 2 illustrates the complementarity of the nucleotide sequences of KIAA0931 BINDING SITE1 and KIAA0931 BINDING SITE2, designated SEQ ID:33483 and SEQ ID:33485 respectively, to the nucleotide sequence of VGAM211 RNA, herein designated VGAM RNA, also designated SEQ ID:2922.

Another function of VGAM211 is therefore inhibition of KIAA0931 (Accession XM_041191). Accordingly, utilities of VGAM211 include diagnosis, prevention and treatment of diseases and clinical conditions associated with KIAA0931. KIAA1198 (Accession XM_032674) is another VGAM211 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31709, to the nucleotide sequence of VGAM211 RNA, herein designated VGAM RNA, also designated SEQ ID:2922.

Another function of VGAM211 is therefore inhibition of KIAA1198 (Accession XM_032674). Accordingly, utilities of VGAM211 include diagnosis, prevention and treatment of diseases and clinical conditions associated with KIAA1198. PXR2b (Accession NM_016559) is another VGAM211 host target gene. PXR2b BINDING SITE is HOST TARGET binding site found in the 3' untranslated region of mRNA encoded by PXR2b, corresponding to a HOST TARGET binding site such as BINDING SITE I, BINDING SITE II or BINDING SITE III. Table 2 illustrates the complementarity of the nucleotide sequences of PXR2b BINDING SITE, designated SEQ ID:18633, to the nucleotide sequence of VGAM211 RNA, herein designated VGAM RNA, also designated SEQ ID:2922.

Another function of VGAM211 is therefore inhibition of PXR2b (Accession NM_016559). Accordingly, utilities of VGAM211 include diagnosis, prevention and treatment of diseases and clinical conditions associated with PXR2b. LOC120856 (Accession XM_058509) is another VGAM211 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36632, to the nucleotide sequence of VGAM211 RNA, herein designated VGAM RNA, also designated SEQ ID:2922.

Another function of VGAM211 is therefore inhibition of LOC120856 (Accession XM_058509). Accordingly, utilities of VGAM211 include diagnosis, prevention and treatment of diseases and clinical conditions associated with LOC120856. LOC200853 (Accession XM_114308) is another VGAM211 host target gene. LOC200853 BINDING SITE is HOST TARGET binding site found in the 5' untranslated region of mRNA encoded by LOC200853, corresponding to a HOST TARGET binding site such as BINDING SITE I, BINDING SITE II or BINDING SITE III. Table 2 illustrates the complementarity of the nucleotide sequences of LOC200853 BINDING SITE, designated SEQ ID:42866, to the nucleotide sequence of VGAM211 RNA, herein designated VGAM RNA, also designated SEQ ID:2922.

Another function of VGAM211 is therefore inhibition of LOC200853 (Accession XM_114308). Accordingly, utilities of VGAM211 include diagnosis, prevention and treatment of diseases and clinical conditions associated with LOC200853. LOC203084 (Accession XM_113540) is another VGAM211 host target gene. LOC203084 BINDING SITE is HOST TARGET binding site found in the 3' untranslated region of mRNA encoded by LOC203084, corresponding to a HOST TARGET binding site such as BINDING SITE I, BINDING SITE II or BINDING SITE III. Table 2 illustrates the complementarity of the nucleotide sequences of LOC203084 BINDING SITE, designated SEQ ID:42280, to the nucleotide sequence of VGAM211 RNA, herein designated VGAM RNA, also designated SEQ ID:2922.

Another function of VGAM211 is therefore inhibition of LOC203084 (Accession XM_113540). Accordingly, utilities of VGAM211 include diagnosis, prevention and treatment of diseases and clinical conditions associated with LOC203084. FIG. 1 further provides a conceptual description of a novel bioinformatically detected viral gene of the present invention, referred to here as Viral Genomic Address Messenger 212 (VGAM212) viral gene, which modulates expression of respective host target genes thereof, the function and utility of which host target genes is known in the art.

VGAM212 is a novel bioinformatically detected regulatory, non protein coding, viral micro RNA (miRNA) gene. The method by which VGAM212 was detected is described hereinabove with reference to FIGS. 1-8.

VGAM212 gene, herein designated VGAM GENE, is a viral gene contained in the genome of Simian Virus 40. VGAM212 host target gene, herein designated VGAM HOST TARGET GENE, is a human gene contained in the human genome.

VGAM212 gene encodes a VGAM212 precursor RNA, herein designated VGAM PRECURSOR RNA. Similar to other miRNA genes, and unlike most ordinary genes, VGAM212 precursor RNA does not encode a protein. A nucleotide sequence identical or highly similar to the nucleotide sequence of VGAM212 precursor RNA is designated SEQ ID:198, and is provided hereinbelow with reference to the sequence listing part. Nucleotide sequence SEQ ID:198 is located at position 2253 relative to the genome of Simian Virus 40.

VGAM212 precursor RNA folds onto itself, forming VGAM212 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM212 folded precursor RNA into VGAM212 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM212 RNA is designated SEQ ID:2923, and is provided hereinbelow with reference to the sequence listing part.

VGAM212 host target gene, herein designated VGAM HOST TARGET GENE, encodes a corresponding messenger RNA, VGAM212 host target RNA, herein designated VGAM HOST TARGET RNA. VGAM212 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM212 RNA, herein designated VGAM RNA, binds complementarily to one or more host target binding sites located in untranslated regions of VGAM212 host target RNA, herein designated VGAM HOST TARGET RNA. This complementary binding is due to the fact that the nucleotide sequence of VGAM212 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM212 RNA, herein designated VGAM RNA, may have a different number of host target binding sites in untranslated regions of a VGAM212 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM212 RNA, herein designated VGAM RNA, to host target binding sites on VGAM212 host target RNA, herein designated VGAM HOST TARGET RNA, such as BINDING SITE I, BINDING SITE II and BINDING SITE III, inhibits translation of VGAM212 host target RNA into VGAM212 host target protein, herein designated VGAM HOST TARGET PROTEIN. VGAM host target protein is therefore outlined by a broken line.

It is appreciated that VGAM212 host target gene, herein designated VGAM HOST TARGET GENE, in fact represents a plurality of VGAM212 host target genes. The mRNA of each one of this plurality of VGAM212 host target genes comprises one or more host target binding sites, each having a nucleotide sequence which is at least partly complementary to VGAM212 RNA, herein designated VGAM RNA, and which when bound by VGAM212 RNA causes inhibition of translation of respective one or more VGAM212 host target proteins.

It is further appreciated by one skilled in the art that the mode of translational inhibition illustrated by FIG. 1 with specific reference to translational inhibition exerted by VGAM212 gene, herein designated VGAM GENE, on one or more VGAM212 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM212 is inhibition of expression of host target genes, as part of a novel viral mechanism of attacking a host. Accordingly, utilities of VGAM212 include diagnosis, prevention and treatment of viral infection by Simian Virus 40. Specific functions, and accordingly utilities, of VGAM212 correlate with, and may be deduced from, the identity of the host target genes which VGAM212 binds and inhibits, and the function of these host target genes, as elaborated hereinbelow.

Nucleotide sequences of the VGAM212 precursor RNA, herein designated VGAM PRECURSOR RNA, and of the 'diced' VGAM212 RNA, herein designated VGAM RNA, and a schematic representation of the secondary folding of VGAM212 folded precursor RNA, herein designated VGAM FOLDED PRECURSOR RNA, of VGAM212 are further described hereinbelow with reference to Table 1.

Nucleotide sequences of host target binding sites, such as BINDING SITE-I, BINDING SITE-II and BINDING SITE-III of FIG. 1, found on VGAM212 host target RNA, and schematic representation of the complementarity of each of these host target binding sites to VGAM212 RNA, herein designated VGAM RNA, are described hereinbelow with reference to Table 2.

As mentioned hereinabove with reference to FIG. 1, a function of VGAM212 gene, herein designated VGAM is inhibition of expression of VGAM212 target genes. It is appreciated that specific functions, and accordingly utilities, of VGAM212 correlate with, and may be deduced from, the identity of the target genes which VGAM212 binds and inhibits, and the function of these target genes, as elaborated hereinbelow.

Acid Phosphatase 2, Lysosomal (ACP2, Accession NM_001610) is a VGAM212 host target gene. ACP2 BINDING SITE is HOST TARGET binding site found in the 3' untranslated region of mRNA encoded by ACP2, corresponding to a HOST TARGET binding site such as BINDING SITE I, BINDING SITE II or BINDING SITE III. Table 2 illustrates the complementarity of the nucleotide sequences of ACP2 BINDING SITE, designated SEQ ID:7319, to the nucleotide sequence of VGAM212 RNA, herein designated VGAM RNA, also designated SEQ ID:2923.

A function of VGAM212 is therefore inhibition of Acid Phosphatase 2, Lysosomal (ACP2, Accession NM_001610). Accordingly, utilities of VGAM212 include diagnosis, prevention and treatment of diseases and clinical conditions associated with ACP2. Angiopoietin 2 (ANGPT2, Accession NM_001147) is another VGAM212 host target gene. ANGPT2 BINDING SITE is HOST TARGET binding site found in the 5' untranslated region of mRNA encoded by ANGPT2, corresponding to a HOST TARGET binding site such as BINDING SITE I, BINDING SITE II or BINDING SITE III. Table 2 illustrates the complementarity of the nucleotide sequences of ANGPT2 BINDING SITE, designated SEQ ID:6818, to the nucleotide sequence of VGAM212 RNA, herein designated VGAM RNA, also designated SEQ ID:2923.

Another function of VGAM212 is therefore inhibition of Angiopoietin 2 (ANGPT2, Accession NM_001147), a gene which is a vascular endothelial growth factor that acts as an antagonist of TIE2 (TEK) receptor protein tyrosine kinase. Accordingly, utilities of VGAM212 include diagnosis, prevention and treatment of diseases and clinical conditions associated with ANGPT2. The function of ANGPT2 has been established by previous studies. Tanaka et al. (1999) investigated angiopoietin expression in 23 samples of hepatocellular carcinoma (HCC) and paired adjacent uninvolved liver samples to determine if these genes have a potential role in the growth and spread of the malignancy. They obtained the full coding sequence of a variant angiopoietin-2 cDNA from HCC specimens, and the biologic consequences of overexpression on tumor formation and hemorrhage were determined in an animal model system. Angiopoietin-1 was equally expressed in HCC and adjacent noncarcinomatous liver tissue. On the other hand, angiopoietin-2 was found to be highly expressed only in tumor tissue. In addition, angiopoietin-2 was expressed in 10 of 12 hypervascular HCCs, but only in 2 of 11 hypovascular HCCs. Ectopic expression of angiopoietin-2 in nonexpressing HCC cells promoted the rapid development of human hepatomas and produced hemorrhage within tumors in nude mice. These results suggested a role for angiopoietin-2 in the neovascularization of HCC. The enhanced gene expression may contribute to the clinical hypervascular phenotype as well as to tumor formation and progression. To explore the possibility that VEGF and angiopoietins collaborate during tumor angiogenesis, Holash et al. (1999) analyzed several different murine and human tumor models. Holash et al. (1999) noted that angiopoietin-1 was antiapoptotic for cultured endothelial cells and expression of its antagonist angiopoietin-2 was induced in the endothelium of co-opted tumor vessels before their regression. Expression of Ang2 continued to mark not only the few surviving internal vessels but also the angiogenic vessels at the tumor margin, suggesting that the destabilizing action of angiopoietin-2 facilitates the angiogenic action of VEGF at the tumor rim. Holash et al. (1999) examined human glioblastomas. Angiopoietin-2 was not detectable in the normal human brain, but its expression was dramatically induced in co-opted tumor vessels, preceding vessel regression. Holash et al. (1999) implanted rat RBA mammary adenocarcinoma cells into rat brains. Co-opted vessels displayed striking and specific upregulation of angiopoietin-2, which was not detectable in the vessels of adjacent brain tissue. Holash et al. (1999) concluded that their observations indicate that a subset of tumors rapidly co-opts existing host vessels to form an initially well-vascularized tumor mass. Perhaps as part of a host defense mechanism there is widespread regression of these initially co-opted vessels, leading to a secondarily avascular tumor and a massive tumor cell loss. However, the remaining tumor is ultimately rescued by robust angiogenesis at the tumor margin.

Full details of the abovementioned studies are described in the following publications, the disclosure of which are hereby incorporated by reference:

Holash, J.; Maisonpierre, P. C.; Compton, D.; Boland, P.; Alexander, C. R.; Zagzag, D.; Yancopoulos, G. D.; Wiegand, S. J.: Vessel cooption, regression, and growth in tumors mediated by angiopoietins and VEGF. Science 284:1994-1998, 1999; and Tanaka, S.; Mori, M.; Sakamoto, Y.; Makuuchi, M.; Sugimachi, K.; Wands, J. R.: Biologic significance of angiopoietin-2 expression in human hepatocellular carcinoma. J. Clin. Invest. 10.

Further studies establishing the function and utilities of ANGPT2 are found in John Hopkins OMIM database record ID 601922, and in sited publications numbered 9394, 10441-581 and 9401 listed in the bibliography section hereinbelow, which are also hereby incorporated by reference. Collagen, Type V, Alpha 3 (COL5A3, Accession NM_015719) is another VGAM212 host target gene. COL5A3 BINDING SITE is HOST TARGET binding site found in the 3' untranslated region of mRNA encoded by COL5A3, corresponding to a HOST TARGET binding site such as BINDING SITE I, BINDING SITE II or BINDING SITE III. Table 2 illustrates the complementarity of the nucleotide sequences of COL5A3 BINDING SITE, designated SEQ ID:17934, to the nucleotide sequence of VGAM212 RNA, herein designated VGAM RNA, also designated SEQ ID:2923.

Another function of VGAM212 is therefore inhibition of Collagen, Type V, Alpha 3 (COL5A3, Accession NM_015719). Accordingly, utilities of VGAM212 include diagnosis, prevention and treatment of diseases and clinical conditions associated with COL5A3. Deleted In Lymphocytic Leukemia, 2 (DLEU2, Accession NM_006021) is another VGAM212 host target gene. DLEU2 BINDING SITE is HOST TARGET binding site found in the 3' untranslated region of mRNA encoded by DLEU2, corresponding to a HOST TARGET binding site such as BINDING SITE I, BINDING SITE II or BINDING SITE III. Table 2 illustrates the complementarity of the nucleotide sequences of DLEU2 BINDING SITE, designated SEQ ID:12639, to the nucleotide sequence of VGAM212 RNA, herein designated VGAM RNA, also designated SEQ ID:2923.

Another function of VGAM212 is therefore inhibition of Deleted In Lymphocytic Leukemia, 2 (DLEU2, Accession NM_006021). Accordingly, utilities of VGAM212 include diagnosis, prevention and treatment of diseases and clinical conditions associated with DLEU2. Junctional Adhesion Molecule 3 (JAM3, Accession NM_032801) is another VGAM212 host target gene. JAM3 BINDING SITE is HOST TARGET binding site found in the 3' untranslated region of mRNA encoded by JAM3, corresponding to a HOST TARGET binding site such as BINDING SITE I, BINDING SITE II or BINDING SITE III. Table 2 illustrates the complementarity of the nucleotide sequences of JAM3 BINDING SITE, designated SEQ ID:26556, to the nucleotide sequence of VGAM212 RNA, herein designated VGAM RNA, also designated SEQ ID:2923.

Another function of VGAM212 is therefore inhibition of Junctional Adhesion Molecule 3 (JAM3, Accession NM_032801), a gene which is a member of the junctional adhesion molecule protein family. Accordingly, utilities of VGAM212 include diagnosis, prevention and treatment of diseases and clinical conditions associated with JAM3. The function of JAM3 and its association with various diseases and clinical conditions, has been established by previous studies, as described hereinabove with reference to VGAM200. V-myc Myelocytomatosis Viral Oncogene Homolog 2 (avian) (MYCL2, Accession NM_005377) is another VGAM212 host target gene. MYCL2 BINDING SITE is HOST TARGET binding site found in the 3' untranslated region of mRNA encoded by MYCL2, corresponding to a HOST TARGET binding site such as BINDING SITE I, BINDING SITE II or BINDING SITE III. Table 2 illustrates the complementarity of the nucleotide sequences of MYCL2 BINDING SITE, designated SEQ ID:11859, to the nucleotide sequence of VGAM212 RNA, herein designated VGAM RNA, also designated SEQ ID:2923.

Another function of VGAM212 is therefore inhibition of V-myc Myelocytomatosis Viral Oncogene Homolog 2 (avian) (MYCL2, Accession NM_005377). Accordingly, utilities of VGAM212 include diagnosis, prevention and treatment of diseases and clinical conditions associated with MYCL2. Nerve Growth Factor Receptor (TNFR superfamily, member 16) (NGFR, Accession NM_002507) is another VGAM212 host target gene. NGFR BINDING SITE is HOST TARGET binding site found in the 3' untranslated region of mRNA encoded by NGFR, corresponding to a HOST TARGET binding site such as BINDING SITE I, BINDING SITE II or BINDING SITE III. Table 2 illustrates the complementarity of the nucleotide sequences of NGFR BINDING SITE, designated SEQ ID:8337, to the nucleotide sequence of VGAM212 RNA, herein designated VGAM RNA, also designated SEQ ID:2923.

Another function of VGAM212 is therefore inhibition of Nerve Growth Factor Receptor (TNFR superfamily, member 16) (NGFR, Accession NM_002507), a gene which can mediate cell survival as well as cell death of neural cells. Accordingly, utilities of VGAM212 include diagnosis, prevention and treatment of diseases and clinical conditions associated with NGFR. The function of NGFR has been established by previous studies. Bothwell (1996), Carter and Lewin (1997), and Bibel and Barde (2000) reviewed neurotrophins and their receptors. Nerve growth factor receptor (NGFR) is also referred to as p75(NTR) due to its molecular mass and its ability to bind at low affinity not only NGF (see OMIM Ref. No. 162030), but also other neurotrophins, including brain-derived neurotrophic factor (BDNF; 113505), neurotrophin-3 (NTF3; 162660), and neurotrophin-4/5 (NTF5; 162662). At the time of its discovery, NGFR was considered a unique type of protein. Subsequently, however, a large superfamily of tumor necrosis factor receptors were found to share the overall structure of NGFR (4 extracellular ligand-binding, cysteine-rich repeats, or CRs, and signaling through association with, or disassociation from, cytoplasmic interactors). The identification of this superfamily helped elucidate some of the biologic functions of NGFR, including its ultimate involvement in the nuclear factor kappa-B (NFKB; OMIM Ref. No. 164011) and apoptosis pathways. As a monomer, NGFR binds NGF with low affinity. Higher affinity binding is achieved by association with higher molecular mass, low-affinity neurotrophin receptors, namely the tropomyosin receptor kinases, TRKA (NTRK1; 191315), TRKB (NTRK2; 600456), and TRKC (NTRK3; 191316). TRKA, TRKB, and TRKC are specific for or 'preferred by' NGF, NTF5 and BDNF, and NTF3, respectively (Ip et al., 1993). NTF3 also binds to TRKA and TRKB, but with significantly lower affinity. Animal model experiments lend further support to the function of NGFR. By targeted disruption of exon 3 of the Ngfr gene, which encodes CR2, CR3, and CR4, Lee et al. (1992) generated mice lacking functional Ngfr. The Ngfr -/- mice were viable and fertile but developed skin defects in all extremities as well as ulcers that were prone to secondary infection with loss of epidermis. Immunohistochemistry revealed a lack of calcitonin gene-related peptide (CALCA; 114130)- and substance P (OMIM Ref. No. 162320)-expressing peripheral sensory nerve fibers. Mutant mice had a loss of heat sensitivity but no defects in innervation of the iris or salivary gland. Mice carrying a single copy of a human NGFR transgene did not have neuropeptide and sensory loss or the peripheral ulcers.

It is appreciated that the abovementioned animal model for NGFR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bibel, M.; Barde, Y.-A.: Neurotrophins: key regulators of cell fate and cell shape in the vertebrate nervous system. Genes Dev. 14:2919-2937, 2000; and Lee, K. F.; Li, E.; Huber, J.; Landis, S. C.; Sharpe, A. H.; Chao, M. V.; Jaenisch, R.: Targeted mutation of the gene encoding the low affinity NGF receptor p75 leads to deficits in t.

Further studies establishing the function and utilities of NGFR are found in John Hopkins OMIM database record ID 162010, and in sited publications numbered 1938-1944, 181 and 2227-2235 listed in the bibliography section hereinbelow, which are also hereby incorporated by reference. POU Domain, Class 3, Transcription Factor 1 (POU3F1, Accession XM_001334) is another VGAM212 host target gene. POU3F1 BINDING SITE is HOST TARGET binding site found in the 3' untranslated region of mRNA encoded by POU3F1, corresponding to a HOST TARGET binding site such as BINDING SITE I, BINDING SITE II or BINDING SITE III. Table 2 illustrates the complementarity of the nucleotide sequences of POU3F1 BINDING SITE, designated SEQ ID:29832, to the nucleotide sequence of VGAM212 RNA, herein designated VGAM RNA, also designated SEQ ID:2923.

Another function of VGAM212 is therefore inhibition of POU Domain, Class 3, Transcription Factor 1 (POU3F1, Accession XM_001334), a gene which involves in early embryogenesis and neurogenesis. Accordingly, utilities of VGAM212 include diagnosis, prevention and treatment of diseases and clinical conditions associated with POU3F1. The function of POU3F1 and its association with various diseases and clinical conditions, has been established by previous studies, as described hereinabove with reference to VGAM85. Selenoprotein N, 1 (SEPN1, Accession XM_039033) is another VGAM212 host target gene. SEPN1 BINDING SITE is HOST TARGET binding site found in the 3' untranslated region of mRNA encoded by SEPN1, corresponding to a HOST TARGET binding site such as BINDING SITE I, BINDING SITE II or BINDING SITE III. Table 2 illustrates the complementarity of the nucleotide sequences of SEPN1 BINDING SITE, designated SEQ ID:32990, to the nucleotide sequence of VGAM212 RNA, herein designated VGAM RNA, also designated SEQ ID:2923.

Another function of VGAM212 is therefore inhibition of Selenoprotein N, 1 (SEPN1, Accession XM_039033). Accordingly, utilities of VGAM212 include diagnosis, prevention and treatment of diseases and clinical conditions associated with SEPN1. Vesicle Amine Transport Protein 1 Homolog (T californica) (VAT1, Accession NM_006373) is another VGAM212 host target gene. VAT1 BINDING SITE is HOST TARGET binding site found in the 3' untranslated region of mRNA encoded by VAT1, corresponding to a HOST TARGET binding site such as BINDING SITE I, BINDING SITE II or BINDING SITE III. Table 2 illustrates the complementarity of the nucleotide sequences of VAT1 BINDING SITE, designated SEQ ID:13068, to the nucleotide sequence of VGAM212 RNA, herein designated VGAM RNA, also designated SEQ ID:2923.

Another function of VGAM212 is therefore inhibition of Vesicle Amine Transport Protein 1 Homolog (T californica) (VAT1, Accession NM_006373), a gene which is a membrane protein of cholinergic synaptic vesicles. Accordingly, utilities of VGAM212 include diagnosis, prevention and treatment of diseases and clinical conditions associated with VAT1. The function of VAT1 has been established by previous studies. Synaptic vesicles are responsible for regulating the storage and release of neurotransmitters in the nerve terminal. Using expression screening of a marine ray (Torpedo) electric lobe library, Linial et al. (1989) identified a cDNA encoding a 379-amino acid synaptic vesicle integral membrane protein, which they termed VAT1. Northern blot analysis revealed that a 5.8-kb transcript is expressed in electromotor neurons. Western blot analysis determined expression of a 42-kD protein in the electric organ that copurified with synaptic vesicles. While attempting to identify the BRCA1 (OMIM Ref. No. 113705) gene, Friedman et al. (1995) cloned cDNAs for a number of genes on chromosome 17q21, including one with significant homology to Torpedo VAT1. By random sequencing of 4 cosmids from a human chromosome 17-specific library, Smith et al. (1996) identified the sequence of 2 complete genes within 117 kb of DNA containing the BRCA1 gene: RHO7 (OMIM Ref. No. 601555) and VAT1, an abundant membrane protein of cholinergic synaptic vesicles. The coding sequence of VAT1 predicts a 301-amino acid peptide. The authors found that a CpG island precedes the VAT1 gene, which contains 6 exons spanning 8.1 kb. They determined the following order of genes in this region: cen--IFP35 (OMIM Ref. No. 600735)--VAT1--RHO7--BRCA1--1A1-3B--tel.

Full details of the abovementioned studies are described in the following publications, the disclosure of which are hereby incorporated by reference:

Linial, M.; Miller, K.; Scheller, R. H.: VAT-1: an abundant membrane protein from Torpedo cholinergic synaptic vesicles. Neuron 2:1265-1273, 1989; and Friedman, L. S.; Ostermeyer, E. A.; Lynch, E. D.; Welcsh, P.; Szabo, C. I.; Meza, J. E.; Anderson, L. A.; Dowd, P.; Lee, M. K.; Rowell, S. E.; Ellison, J.; Boyd, J.; King, M.-C.:22 genes.

Further studies establishing the function and utilities of VAT1 are found in John Hopkins OMIM database record ID 604631, and in sited publications numbered 4982-4984 listed in the bibliography section hereinbelow, which are also hereby incorporated by reference. Bromodomain and PHD Finger Containing, 3 (BRPF3, Accession XM_166450) is another VGAM212 host target gene. BRPF3 BINDING SITE is HOST TARGET binding site found in the 3' untranslated region of mRNA encoded by BRPF3, corresponding to a HOST TARGET binding site such as BINDING SITE I, BINDING SITE II or BINDING SITE III. Table 2 illustrates the complementarity of the nucleotide sequences of BRPF3 BINDING SITE, designated SEQ ID:44345, to the nucleotide sequence of VGAM212 RNA, herein designated VGAM RNA, also designated SEQ ID:2923.

Another function of VGAM212 is therefore inhibition of Bromodomain and PHD Finger Containing, 3 (BRPF3, Accession XM_166450). Accordingly, utilities of VGAM212 include diagnosis, prevention and treatment of diseases and clinical conditions associated with BRPF3. DKFZP434P0721 (Accession XM_033181) is another VGAM212 host target gene. DKFZP434P0721 BINDING SITE is HOST TARGET binding site found in the 3' untranslated region of mRNA encoded by DKFZP434P0721, corresponding to a HOST TARGET binding site such as BINDING SITE I, BINDING SITE II or BINDING SITE III. Table 2 illustrates the complementarity of the nucleotide sequences of DKFZP434P0721 BINDING SITE, designated SEQ ID:31871, to the nucleotide sequence of VGAM212 RNA, herein designated VGAM RNA, also designated SEQ ID:2923.

Another function of VGAM212 is therefore inhibition of DKFZP434P0721 (Accession XM_033181). Accordingly, utilities of VGAM212 include diagnosis, prevention and treatment of diseases and clinical conditions associated with DKFZP434P0721. Family with Sequence Similarity 3, Member D (FAM3D, Accession NM_138805) is another VGAM212 host target gene. FAM3D BINDING SITE is HOST TARGET binding site found in the 5' untranslated region of mRNA encoded by FAM3D, corresponding to a HOST TARGET binding site such as BINDING SITE I, BINDING SITE II or BINDING SITE III. Table 2 illustrates the complementarity of the nucleotide sequences of FAM3D BINDING SITE, designated SEQ ID:29029, to the nucleotide sequence of VGAM212 RNA, herein designated VGAM RNA, also designated SEQ ID:2923.

Another function of VGAM212 is therefore inhibition of Family with Sequence Similarity 3, Member D (FAM3D, Accession NM_138805). Accordingly, utilities of VGAM212 include diagnosis, prevention and treatment of diseases and clinical conditions associated with FAM3D. FHX (Accession NM_018416) is another VGAM212 host target gene. FHX BINDING SITE is HOST TARGET binding site found in the 3' untranslated region of mRNA encoded by FHX, corresponding to a HOST TARGET binding site such as BINDING SITE I, BINDING SITE II or BINDING SITE III. Table 2 illustrates the complementarity of the nucleotide sequences of FHX BINDING SITE, designated SEQ ID:20464, to the nucleotide sequence of VGAM212 RNA, herein designated VGAM RNA, also designated SEQ ID:2923.

Another function of VGAM212 is therefore inhibition of FHX (Accession NM_018416). Accordingly, utilities of VGAM212 include diagnosis, prevention and treatment of diseases and clinical conditions associated with FHX. FLJ12800 (Accession NM_022903) is another VGAM212 host target gene. FLJ12800 BINDING SITE is HOST TARGET binding site found in the 3" untranslated region of mRNA encoded by FLJ12800, corresponding to a HOST TARGET binding site such as BINDING SITE I, BINDING SITE II or BINDING SITE III. Table 2 illustrates the complementarity of the nucleotide sequences of FLJ12800 BINDING SITE, designated SEQ ID:23195, to the nucleotide sequence of VGAM212 RNA, herein designated VGAM RNA, also designated SEQ ID:2923.

Another function of VGAM212 is therefore inhibition of FLJ12800 (Accession NM_022903). Accordingly, utilities of VGAM212 include diagnosis, prevention and treatment of diseases and clinical conditions associated with FLJ12800. FLJ13955 (Accession NM_024759) is another VGAM212 host target gene. FLJ13955 BINDING SITE is HOST TARGET binding site found in the 3' untranslated region of mRNA encoded by FLJ13955, corresponding to a HOST TARGET binding site such as BINDING SITE I, BINDING SITE II or BINDING SITE III. Table 2 illustrates the complementarity of the nucleotide sequences of FLJ13955 BINDING SITE, designated SEQ ID:24110, to the nucleotide sequence of VGAM212 RNA, herein designated VGAM RNA, also designated SEQ ID:2923.

Another function of VGAM212 is therefore inhibition of FLJ13955 (Accession NM_024759). Accordingly, utilities of VGAM212 include diagnosis, prevention and treatment of diseases and clinical conditions associated with FLJ13955. FLJ20666 (Accession NM_017922) is another VGAM212 host target gene. FLJ20666 BINDING SITE is HOST TARGET binding site found in the 3' untranslated region of mRNA encoded by FLJ20666, corresponding to a HOST TARGET binding site such as BINDING SITE I, BINDING SITE II or BINDING SITE III. Table 2 illustrates the complementarity of the nucleotide sequences of FLJ20666 BINDING SITE, designated SEQ ID:19587, to the nucleotide sequence of VGAM212 RNA, herein designated VGAM RNA, also designated SEQ ID:2923.

Another function of VGAM212 is therefore inhibition of FLJ20666 (Accession NM_017922). Accordingly, utilities of VGAM212 include diagnosis, prevention and treatment of diseases and clinical conditions associated with FLJ20666. FLJ20958 (Accession NM_022102) is another VGAM212 host target gene. FLJ20958 BINDING SITE is HOST TARGET binding site found in the 3' untranslated region of mRNA encoded by FLJ20958, corresponding to a HOST TARGET binding site such as BINDING SITE I, BINDING SITE II or BINDING SITE III. Table 2 illustrates the complementarity of the nucleotide sequences of FLJ20958 BINDING SITE, designated SEQ ID:22647, to the nucleotide sequence of VGAM212 RNA, herein designated VGAM RNA, also designated SEQ ID:2923.

Another function of VGAM212 is therefore inhibition of FLJ20958 (Accession NM_022102). Accordingly, utilities of VGAM212 include diagnosis, prevention and treatment of diseases and clinical conditions associated with FLJ20958. G Protein-coupled Receptor Kinase-interactor 2 (GIT2, Accession NM_139201) is another VGAM212 host target gene. GIT2 BINDING SITE is HOST TARGET binding site found in the 3' untranslated region of mRNA encoded by GIT2, corresponding to a HOST TARGET binding site such as BINDING SITE I, BINDING SITE II or BINDING SITE III. Table 2 illustrates the complementarity of the nucleotide sequences of GIT2 BINDING SITE, designated SEQ ID:29214, to the nucleotide sequence of VGAM212 RNA, herein designated VGAM RNA, also designated SEQ ID:2923.

Another function of VGAM212 is therefore inhibition of G Protein-coupled Receptor Kinase-interactor 2 (GIT2, Accession NM_139201). Accordingly, utilities of VGAM212 include diagnosis, prevention and treatment of diseases and clinical conditions associated with GIT2. HPIP (Accession NM_020524) is another VGAM212 host target gene. HPIP BINDING SITE is HOST TARGET binding site found in the 3' untranslated region of mRNA encoded by HPIP, corresponding to a HOST TARGET binding site such as BINDING SITE I, BINDING SITE II or BINDING SITE III. Table 2 illustrates the complementarity of the nucleotide sequences of HPIP BINDING SITE, designated SEQ ID:21739, to the nucleotide sequence of VGAM212 RNA, herein designated VGAM RNA, also designated SEQ ID:2923.

Another function of VGAM212 is therefore inhibition of HPIP (Accession NM_020524). Accordingly, utilities of VGAM212 include diagnosis, prevention and treatment of diseases and clinical conditions associated with HPIP. KIAA0544 (Accession XM_048119) is another VGAM212 host target gene. KIAA0544 BINDING SITE is HOST TARGET binding site found in the 3" untranslated region of mRNA encoded by KIAA0544, corresponding to a HOST TARGET binding site such as BINDING SITE I, BINDING SITE II or BINDING SITE III. Table 2 illustrates the complementarity of the nucleotide sequences of KIAA0544 BINDING SITE, designated SEQ ID:35114, to the nucleotide sequence of VGAM212 RNA, herein designated VGAM RNA, also designated SEQ ID:2923.

Another function of VGAM212 is therefore inhibition of KIAA0544 (Accession XM_048119). Accordingly, utilities of VGAM212 include diagnosis, prevention and treatment of diseases and clinical conditions associated with KIAA0544. KIAA1198 (Accession XM_032674) is another VGAM212 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31711, to the nucleotide sequence of VGAM212 RNA, herein designated VGAM RNA, also designated SEQ ID:2923.

Another function of VGAM212 is therefore inhibition of KIAA1198 (Accession XM_032674). Accordingly, utilities of VGAM212 include diagnosis, prevention and treatment of diseases and clinical conditions associated with KIAA1198. MGC12538 (Accession NM_032746) is another VGAM212 host target gene. MGC12538 BINDING SITE is HOST TARGET binding site found in the 3' untranslated region of mRNA encoded by MGC12538, corresponding to a HOST TARGET binding site such as BINDING SITE I, BINDING SITE II or BINDING SITE III. Table 2 illustrates the complementarity of the nucleotide sequences of MGC12538 BINDING SITE, designated SEQ ID:26483, to the nucleotide sequence of VGAM212 RNA, herein designated VGAM RNA, also designated SEQ ID:2923.

Another function of VGAM212 is therefore inhibition of MGC12538 (Accession NM_032746). Accordingly, utilities of VGAM212 include diagnosis, prevention and treatment of diseases and clinical conditions associated with MGC12538. MGC15854 (Accession NM_145029) is another VGAM212 host target gene. MGC15854 BINDING SITE is HOST TARGET binding site found in the 5' untranslated region of mRNA encoded by MGC15854, corresponding to a HOST TARGET binding site such as BINDING SITE I, BINDING SITE II or BINDING SITE III. Table 2 illustrates the complementarity of the nucleotide sequences of MGC15854 BINDING SITE, designated SEQ ID:29645, to the nucleotide sequence of VGAM212 RNA, herein designated VGAM RNA, also designated SEQ ID:2923.

Another function of VGAM212 is therefore inhibition of MGC15854 (Accession NM_145029). Accordingly, utilities of VGAM212 include diagnosis, prevention and treatment of diseases and clinical conditions associated with MGC15854. MGC2541 (Accession NM_080670) is another VGAM212 host target gene. MGC2541 BINDING SITE is HOST TARGET binding site found in the 3' untranslated region of mRNA encoded by MGC2541, corresponding to a HOST TARGET binding site such as BINDING SITE I, BINDING SITE II or BINDING SITE III. Table 2 illustrates the complementarity of the nucleotide sequences of MGC2541 BINDING SITE, designated SEQ ID:27966, to the nucleotide sequence of VGAM212 RNA, herein designated VGAM RNA, also designated SEQ ID:2923.

Another function of VGAM212 is therefore inhibition of MGC2541 (Accession NM_080670). Accordingly, utilities of VGAM212 include diagnosis, prevention and treatment of diseases and clinical conditions associated with MGC2541. MGC4707 (Accession NM_024113) is another VGAM212 host target gene. MGC4707 BINDING SITE is HOST TARGET binding site found in the 3' untranslated region of mRNA encoded by MGC4707, corresponding to a HOST TARGET binding site such as BINDING SITE I, BINDING SITE II or BINDING SITE III. Table 2 illustrates the complementarity of the nucleotide sequences of MGC4707 BINDING SITE, designated SEQ ID:23563, to the nucleotide sequence of VGAM212 RNA, herein designated VGAM RNA, also designated SEQ ID:2923.

Another function of VGAM212 is therefore inhibition of MGC4707 (Accession NM_024113). Accordingly, utilities of VGAM212 include diagnosis, prevention and treatment of diseases and clinical conditions associated with MGC4707. Polymerase (DNA directed), Mu (POLM, Accession XM_165867) is another VGAM212 host target gene. POLM BINDING SITE is HOST TARGET binding site found in the 3' untranslated region of mRNA encoded by POLM, corresponding to a HOST TARGET binding site such as BINDING SITE I, BINDING SITE II or BINDING SITE III. Table 2 illustrates the complementarity of the nucleotide sequences of POLM BINDING SITE, designated SEQ ID:43786, to the nucleotide sequence of VGAM212 RNA, herein designated VGAM RNA, also designated SEQ ID:2923.

Another function of VGAM212 is therefore inhibition of Polymerase (DNA directed), Mu (POLM, Accession XM_165867). Accordingly, utilities of VGAM212 include diagnosis, prevention and treatment of diseases and clinical conditions associated with POLM. Scavenger Receptor Cysteine Rich Domain Containing, Group B (4 domains) (SRCRB4D, Accession NM_080744) is another VGAM212 host target gene. SRCRB4D BINDING SITE is HOST TARGET binding site found in the 3' untranslated region of mRNA encoded by SRCRB4D, corresponding to a HOST TARGET binding site such as BINDING SITE I, BINDING SITE II or BINDING SITE III. Table 2 illustrates the complementarity of the nucleotide sequences of SRCRB4D BINDING SITE, designated SEQ ID:28031, to the nucleotide sequence of VGAM212 RNA, herein designated VGAM RNA, also designated SEQ ID:2923.

Another function of VGAM212 is therefore inhibition of Scavenger Receptor Cysteine Rich Domain Containing, Group B (4 domains) (SRCRB4D, Accession NM_080744). Accordingly, utilities of VGAM212 include diagnosis, prevention and treatment of diseases and clinical conditions associated with SRCRB4D. LOC126669 (Accession XM_060121) is another VGAM212 host target gene. LOC126669 BINDING SITE is HOST TARGET binding site found in the 3' untranslated region of mRNA encoded by LOC126669, corresponding to a HOST TARGET binding site such as BINDING SITE I, BINDING SITE II or BINDING SITE III. Table 2 illustrates the complementarity of the nucleotide sequences of LOC126669 BINDING SITE, designated SEQ ID:37160, to the nucleotide sequence of VGAM212 RNA, herein designated VGAM RNA, also designated SEQ ID:2923.

Another function of VGAM212 is therefore inhibition of LOC126669 (Accession XM_060121). Accordingly, utilities of VGAM212 include diagnosis, prevention and treatment of diseases and clinical conditions associated with LOC126669. LOC131000 (Accession XM_067145) is another VGAM212 host target gene. LOC131000 BINDING SITE is HOST TARGET binding site found in the 3' untranslated region of mRNA encoded by LOC131000, corresponding to a HOST TARGET binding site such as BINDING SITE I, BINDING SITE II or BINDING SITE III. Table 2 illustrates the complementarity of the nucleotide sequences of LOC131000 BINDING SITE, designated SEQ ID:37349, to the nucleotide sequence of VGAM212 RNA, herein designated VGAM RNA, also designated SEQ ID:2923.

Another function of VGAM212 is therefore inhibition of LOC131000 (Accession XM_067145). Accordingly, utilities of VGAM212 include diagnosis, prevention and treatment of diseases and clinical conditions associated with LOC131000. LOC147639 (Accession XM_085822) is another VGAM212 host target gene. LOC147639 BINDING SITE is HOST TARGET binding site found in the 5' untranslated region of mRNA encoded by LOC147639, corresponding to a HOST TARGET binding site such as BINDING SITE I, BINDING SITE II or BINDING SITE III. Table 2 illustrates the complementarity of the nucleotide sequences of LOC147639 BINDING SITE, designated SEQ ID:38346, to the nucleotide sequence of VGAM212 RNA, herein designated VGAM RNA, also designated SEQ ID:2923.

Another function of VGAM212 is therefore inhibition of LOC147639 (Accession XM_085822). Accordingly, utilities of VGAM212 include diagnosis, prevention and treatment of diseases and clinical conditions associated with LOC147639. LOC148189 (Accession XM_086087) is another VGAM212 host target gene. LOC148189 BINDING SITE is HOST TARGET binding site found in the 5' untranslated region of mRNA encoded by LOC148189, corresponding to a HOST TARGET binding site such as BINDING SITE I, BINDING SITE II or BINDING SITE III. Table 2 illustrates the complementarity of the nucleotide sequences of LOC148189 BINDING SITE, designated SEQ ID:38487, to the nucleotide sequence of VGAM212 RNA, herein designated VGAM RNA, also designated SEQ ID:2923.

Another function of VGAM212 is therefore inhibition of LOC148189 (Accession XM_086087). Accordingly, utilities of VGAM212 include diagnosis, prevention and treatment of diseases and clinical conditions associated with LOC148189. LOC151124 (Accession XM_098006) is another VGAM212 host target gene. LOC151124 BINDING SITE is HOST TARGET binding site found in the 5' untranslated region of mRNA encoded by LOC151124, corresponding to a HOST TARGET binding site such as BINDING SITE I, BINDING SITE II or BINDING SITE III. Table 2 illustrates the complementarity of the nucleotide sequences of LOC151124 BINDING SITE, designated SEQ ID:41301, to the nucleotide sequence of VGAM212 RNA, herein designated VGAM RNA, also designated SEQ ID:2923.

Another function of VGAM212 is therefore inhibition of LOC151124 (Accession XM_098006). Accordingly, utilities of VGAM212 include diagnosis, prevention and treatment of diseases and clinical conditions associated with LOC151124. LOC157381 (Accession XM_098754) is another VGAM212 host target gene. LOC157381 BINDING SITE is HOST TARGET binding site found in the 3' untranslated region of mRNA encoded by LOC157381, corresponding to a HOST TARGET binding site such as BINDING SITE I, BINDING SITE II or BINDING SITE III. Table 2 illustrates the complementarity of the nucleotide sequences of LOC157381 BINDING SITE, designated SEQ ID:41789, to the nucleotide sequence of VGAM212 RNA, herein designated VGAM RNA, also designated SEQ ID:2923.

Another function of VGAM212 is therefore inhibition of LOC157381 (Accession XM_098754). Accordingly, utilities of VGAM212 include diagnosis, prevention and treatment of diseases and clinical conditions associated with LOC157381. LOC158450 (Accession XM_088580) is another VGAM212 host target gene. LOC158450 BINDING SITE is HOST TARGET binding site found in the 5' untranslated region of mRNA encoded by LOC158450, corresponding to a HOST TARGET binding site such as BINDING SITE I, BINDING SITE II or BINDING SITE III. Table 2 illustrates the complementarity of the nucleotide sequences of LOC158450 BINDING SITE, designated SEQ ID:39842, to the nucleotide sequence of VGAM212 RNA, herein designated VGAM RNA, also designated SEQ ID:2923.

Another function of VGAM212 is therefore inhibition of LOC158450 (Accession XM_088580). Accordingly, utilities of VGAM212 include diagnosis, prevention and treatment of diseases and clinical conditions associated with LOC158450. LOC158504 (Accession XM_088591) is another VGAM212 host target gene. LOC158504 BINDING SITE is HOST TARGET binding site found in the 5' untranslated region of mRNA encoded by LOC158504, corresponding to a HOST TARGET binding site such as BINDING SITE I, BINDING SITE II or BINDING SITE III. Table 2 illustrates the complementarity of the nucleotide sequences of LOC158504 BINDING SITE, designated SEQ ID:39853, to the nucleotide sequence of VGAM212 RNA, herein designated VGAM RNA, also designated SEQ ID:2923.

Another function of VGAM212 is therefore inhibition of LOC158504 (Accession XM_088591). Accordingly, utilities of VGAM212 include diagnosis, prevention and treatment of diseases and clinical conditions associated with LOC158504. LOC199923 (Accession XM_114057) is another VGAM212 host target gene. LOC199923 BINDING SITE is HOST TARGET binding site found in the 3' untranslated region of mRNA encoded by LOC199923, corresponding to a HOST TARGET binding site such as BINDING SITE I, BINDING SITE II or BINDING SITE III. Table 2 illustrates the complementarity of the nucleotide sequences of LOC199923 BINDING SITE, designated SEQ ID:42668, to the nucleotide sequence of VGAM212 RNA, herein designated VGAM RNA, also designated SEQ ID:2923.

Another function of VGAM212 is therefore inhibition of LOC199923 (Accession XM_114057). Accordingly, utilities of VGAM212 include diagnosis, prevention and treatment of diseases and clinical conditions associated with LOC199923. LOC90246 (Accession XM_030283) is another VGAM212 host target gene. LOC90246 BINDING SITE is HOST TARGET binding site found in the 5' untranslated region of mRNA encoded by LOC90246, corresponding to a HOST TARGET binding site such as BINDING SITE I, BINDING SITE II or BINDING SITE III. Table 2 illustrates the complementarity of the nucleotide sequences of LOC90246 BINDING SITE, designated SEQ ID:31004, to the nucleotide sequence of VGAM212 RNA, herein designated VGAM RNA, also designated SEQ ID:2923.

Another function of VGAM212 is therefore inhibition of LOC90246 (Accession XM_030283). Accordingly, utilities of VGAM212 include diagnosis, prevention and treatment of diseases and clinical conditions associated with LOC90246. LOC91450 (Accession XM_038515) is another VGAM212 host target gene. LOC91450 BINDING SITE is HOST TARGET binding site found in the 5' untranslated region of mRNA encoded by LOC91450, corresponding to a HOST TARGET binding site such as BINDING SITE I, BINDING SITE II or BINDING SITE III. Table 2 illustrates the complementarity of the nucleotide sequences of LOC91450 BINDING SITE, designated SEQ ID:32855, to the nucleotide sequence of VGAM212 RNA, herein designated VGAM RNA, also designated SEQ ID:2923.

Another function of VGAM212 is therefore inhibition of LOC91450 (Accession XM_038515). Accordingly, utilities of VGAM212 include diagnosis, prevention and treatment of diseases and clinical conditions associated with LOC91450. FIG. 1 further provides a conceptual description of a novel bioinformatically detected viral gene of the present invention, referred to here as Viral Genomic Address Messenger 213 (VGAM213) viral gene, which modulates expression of respective host target genes thereof, the function and utility of which host target genes is known in the art.

VGAM213 is a novel bioinformatically detected regulatory, non protein coding, viral micro RNA (miRNA) gene. The method by which VGAM213 was detected is described hereinabove with reference to FIGS. 1-8.

VGAM213 gene, herein designated VGAM GENE, is a viral gene contained in the genome of Simian Virus 40. VGAM213 host target gene, herein designated VGAM HOST TARGET GENE, is a human gene contained in the human genome.

VGAM213 gene encodes a VGAM213 precursor RNA, herein designated VGAM PRECURSOR RNA. Similar to other miRNA genes, and unlike most ordinary genes, VGAM213 precursor RNA does not encode a protein. A nucleotide sequence identical or highly similar to the nucleotide sequence of VGAM213 precursor RNA is designated SEQ ID:199, and is provided hereinbelow with reference to the sequence listing part. Nucleotide sequence SEQ ID:199 is located at position 4571 relative to the genome of Simian Virus 40.

VGAM213 precursor RNA folds onto itself, forming VGAM213 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM213 folded precursor RNA into VGAM213 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 88%) nucleotide sequence of VGAM213 RNA is designated SEQ ID:2924, and is provided hereinbelow with reference to the sequence listing part.

VGAM213 host target gene, herein designated VGAM HOST TARGET GENE, encodes a corresponding messenger RNA, VGAM213 host target RNA, herein designated VGAM HOST TARGET RNA. VGAM213 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM213 RNA, herein designated VGAM RNA, binds complementarily to one or more host target binding sites located in untranslated regions of VGAM213 host target RNA, herein designated VGAM HOST TARGET RNA. This complementary binding is due to the fact that the nucleotide sequence of VGAM213 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM213 RNA, herein designated VGAM RNA, may have a different number of host target binding sites in untranslated regions of a VGAM213 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5'UTR region, or in both 3'UTR and 5'UTR regions.

The complementary binding of VGAM213 RNA, herein designated VGAM RNA, to host target binding sites on VGAM213 host target RNA, herein designated VGAM HOST TARGET RNA, such as BINDING SITE I, BINDING SITE II and BINDING SITE III, inhibits translation of VGAM213 host target RNA into VGAM213 host target protein, herein designated VGAM HOST TARGET PROTEIN. VGAM host target protein is therefore outlined by a broken line.

It is appreciated that VGAM213 host target gene, herein designated VGAM HOST TARGET GENE, in fact represents a plurality of VGAM213 host target genes. The mRNA of each one of this plurality of VGAM213 host target genes comprises one or more host target binding sites, each having a nucleotide sequence which is at least partly complementary to VGAM213 RNA, herein designated VGAM RNA, and which when bound by VGAM213 RNA causes inhibition of translation of respective one or more VGAM213 host target proteins.

It is further appreciated by one skilled in the art that the mode of translational inhibition illustrated by FIG. 1 with specific reference to translational inhibition exerted by VGAM213 gene, herein designated VGAM GENE, on one or more VGAM213 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM213 is inhibition of expression of host target genes, as part of a novel viral mechanism of attacking a host. Accordingly, utilities of VGAM213 include diagnosis, prevention and treatment of viral infection by Simian Virus 40. Specific functions, and accordingly utilities, of VGAM213 correlate with, and may be deduced from, the identity of the host target genes which VGAM213 binds and inhibits, and the function of these host target genes, as elaborated hereinbelow.

Nucleotide sequences of the VGAM213 precursor RNA, herein designated VGAM PRECURSOR RNA, and of the 'diced' VGAM213 RNA, herein designated VGAM RNA, and a schematic representation of the secondary folding of VGAM213 folded precursor RNA, herein designated VGAM FOLDED PRECURSOR RNA, of VGAM213 are further described hereinbelow with reference to Table 1.

Nucleotide sequences of host target binding sites, such as BINDING SITE-I, BINDING SITE-II and BINDING SITE-III of FIG. 1, found on VGAM213 host target RNA, and schematic representation of the complementarity of each of these host target binding sites to VGAM213 RNA, herein designated VGAM RNA, are described hereinbelow with reference to Table 2.

As mentioned hereinabove with reference to FIG. 1, a function of VGAM213 gene, herein designated VGAM is inhibition of expression of VGAM213 target genes. It is appreciated that specific functions, and accordingly utilities, of VGAM213 correlate with, and may be deduced from, the identity of the target genes which VGAM213 binds and inhibits, and the function of these target genes, as elaborated hereinbelow.

KIAA1229 (Accession XM_030665) is a VGAM213 host target gene. KIAA1229 BINDING SITE is HOST TARGET binding site found in the 3' untranslated region of mRNA encoded by KIAA1229, corresponding to a HOST TARGET binding site such as BINDING SITE I, BINDING SITE II or BINDING SITE III. Table 2 illustrates the complementarity of the nucleotide sequences of KIAA1229 BINDING SITE, designated SEQ ID:31098, to the nucleotide sequence of VGAM213 RNA, herein designated VGAM RNA, also designated SEQ ID:2924.

A function of VGAM213 is therefore inhibition of KIAA1229 (Accession XM_030665). Accordingly, utilities of VGAM213 include diagnosis, prevention and treatment of diseases and clinical conditions associated with KIAA1229. FIG. 1 further provides a conceptual description of a novel bioinformatically detected viral gene of the present invention, referred to here as Viral Genomic Address Messenger 214 (VGAM214) viral gene, which modulates expression of respective host target genes thereof, the function and utility of which host target genes is known in the art.

VGAM214 is a novel bioinformatically detected regulatory, non protein coding, viral micro RNA (miRNA) gene. The method by which VGAM214 was detected is described hereinabove with reference to FIGS. 1-8.

VGAM214 gene, herein designated VGAM GENE, is a viral gene contained in the genome of Autographa Californica Nucleopolyhedrovirus. VGAM214 host target gene, herein designated VGAM HOST TARGET GENE, is a human gene contained in the human genome.

VGAM214 gene encodes a VGAM214 precursor RNA, herein designated VGAM PRECURSOR RNA. Similar to other miRNA genes, and unlike most ordinary genes, VGAM214 precursor RNA does not encode a protein. A nucleotide sequence identical or highly similar to the nucleotide sequence of VGAM214 precursor RNA is designated SEQ ID:200, and is provided hereinbelow with reference to the sequence listing part. Nucleotide sequence SEQ ID:200 is located at position 124772 relative to the genome of Autographa Californica Nucleopolyhedrovirus.

VGAM214 precursor RNA folds onto itself, forming VGAM214 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM214 folded precursor RNA into VGAM214 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM214 RNA is designated SEQ ID:2925, and is provided hereinbelow with reference to the sequence listing part.

VGAM214 host target gene, herein designated VGAM HOST TARGET GENE, encodes a corresponding messenger RNA, VGAM214 host target RNA, herein designated VGAM HOST TARGET RNA. VGAM214 host target RNA comprises three regions, as is typical of mRNA of a protein coding gene: a 5' untranslated region, a protein coding region and a 3' untranslated region, designated 5'UTR, PROTEIN CODING and 3'UTR respectively.

VGAM214 RNA, herein designated VGAM RNA, binds complementarily to one or more host target binding sites located in untranslated regions of VGAM214 host target RNA, herein designated VGAM HOST TARGET RNA. This complementary binding is due to the fact that the nucleotide sequence of VGAM214 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM214 RNA, herein designated VGAM RNA, may have a different number of host target binding sites in untranslated regions of a VGAM214 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5'UTR region, or in both 3'UTR and 5'UTR regions.

The complementary binding of VGAM214 RNA, herein designated VGAM RNA, to host target binding sites on VGAM214 host target RNA, herein designated VGAM HOST TARGET RNA, such as BINDING SITE I, BINDING SITE II and BINDING SITE III, inhibits translation of VGAM214 host target RNA into VGAM214 host target protein, herein designated VGAM HOST TARGET PROTEIN. VGAM host target protein is therefore outlined by a broken line.

It is appreciated that VGAM214 host target gene, herein designated VGAM HOST TARGET GENE, in fact represents a plurality of VGAM214 host target genes. The mRNA of each one of this plurality of VGAM214 host target genes comprises one or more host target binding sites, each having a nucleotide sequence which is at least partly complementary to VGAM214 RNA, herein designated VGAM RNA, and which when bound by VGAM214 RNA causes inhibition of translation of respective one or more VGAM214 host target proteins.

It is further appreciated by one skilled in the art that the mode of translational inhibition illustrated by FIG. 1 with specific reference to translational inhibition exerted by VGAM214 gene, herein designated VGAM GENE, on one or more VGAM214 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM214 is inhibition of expression of host target genes, as part of a novel viral mechanism of attacking a host. Accordingly, utilities of VGAM214 include diagnosis, prevention and treatment of viral infection by Autographa Californica Nucleopolyhedrovirus. Specific functions, and accordingly utilities, of VGAM214 correlate with, and may be deduced from, the identity of the host target genes which VGAM214 binds and inhibits, and the function of these host target genes, as elaborated hereinbelow.

Nucleotide sequences of the VGAM214 precursor RNA, herein designated VGAM PRECURSOR RNA, and of the 'diced' VGAM214 RNA, herein designated VGAM RNA, and a schematic representation of the secondary folding of VGAM214 folded precursor RNA, herein designated VGAM FOLDED PRECURSOR RNA, of VGAM214 are further described hereinbelow with reference to Table 1.

Nucleotide sequences of host target binding sites, such as BINDING SITE-I, BINDING SITE-II and BINDING SITE-III of FIG. 1, found on VGAM214 host target RNA, and schematic representation of the complementarity of each of these host target binding sites to VGAM214 RNA, herein designated VGAM RNA, are described hereinbelow with reference to Table 2.

As mentioned hereinabove with reference to FIG. 1, a function of VGAM214 gene, herein designated VGAM is inhibition of expression of VGAM214 target genes. It is appreciated that specific functions, and accordingly utilities, of VGAM214 correlate with, and may be deduced from, the identity of the target genes which VGAM214 binds and inhibits, and the function of these target genes, as elaborated hereinbelow.

Roundabout, Axon Guidance Receptor, Homolog 1 (Drosophila) (ROBO1, Accession NM_133631) is a VGAM214 host target gene. ROBO1 BINDING SITE1 and ROBO1 BINDING SITE2 are HOST TARGET binding sites found in untranslated regions of mRNA encoded by ROBO1, corresponding to HOST TARGET binding sites such as BINDING SITE I, BINDING SITE II or BINDING SITE III. Table 2 illustrates the complementarity of the nucleotide sequences of ROBO1 BINDING SITE1 and ROBO1 BINDING SITE2, designated SEQ ID:28583 and SEQ ID:8848 respectively, to the nucleotide sequence of VGAM214 RNA, herein designated VGAM RNA, also designated SEQ ID:2925.

A function of VGAM214 is therefore inhibition of Roundabout, Axon Guidance Receptor, Homolog 1 (Drosophila) (ROBO1, Accession NM_133631), a gene which is an axon guidance receptor. Accordingly, utilities of VGAM214 include diagnosis, prevention and treatment of diseases and clinical conditions associated with ROBO1. The function of ROBO1 and its association with various diseases and clinical conditions, has been established by previous studies, as described hereinabove with reference to VGAM37. LOC92568 (Accession XM_045852) is another VGAM214 host target gene. LOC92568 BINDING SITE is HOST TARGET binding site found in the 3' untranslated region of mRNA encoded by LOC92568, corresponding to a HOST TARGET binding site such as BINDING SITE I, BINDING SITE II or BINDING SITE III. Table 2 illustrates the complementarity of the nucleotide sequences of LOC92568 BINDING SITE, designated SEQ ID:34576, to the nucleotide sequence of VGAM214 RNA, herein designated VGAM RNA, also designated SEQ ID:2925.

Another function of VGAM214 is therefore inhibition of LOC92568 (Accession XM_045852). Accordingly, utilities of VGAM214 include diagnosis, prevention and treatment of diseases and clinical conditions associated with LOC92568. FIG. 1 further provides a conceptual description of a novel bioinformatically detected viral gene of the present invention, referred to here as Viral Genomic Address Messenger 215 (VGAM215) viral gene, which modulates expression of respective host target genes thereof, the function and utility of which host target genes is known in the art.

VGAM215 is a novel bioinformatically detected regulatory, non protein coding, viral micro RNA (miRNA) gene. The method by which VGAM215 was detected is described hereinabove with reference to FIGS. 1-8.

VGAM215 gene, herein designated VGAM GENE, is a viral gene contained in the genome of Autographa Californica Nucleopolyhedrovirus. VGAM215 host target gene, herein designated VGAM HOST TARGET GENE, is a human gene contained in the human genome.

VGAM215 gene encodes a VGAM215 precursor RNA, herein designated VGAM PRECURSOR RNA. Similar to other miRNA genes, and unlike most ordinary genes, VGAM215 precursor RNA does not encode a protein. A nucleotide sequence identical or highly similar to the nucleotide sequence of VGAM215 precursor RNA is designated SEQ ID:201, and is provided hereinbelow with reference to the sequence listing part. Nucleotide sequence SEQ ID:201 is located at position 123142 relative to the genome of Autographa Californica Nucleopolyhedrovirus.

VGAM215 precursor RNA folds onto itself, forming VGAM215 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM215 folded precursor RNA into VGAM215 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM215 RNA is designated SEQ ID:2926, and is provided hereinbelow with reference to the sequence listing part.

VGAM215 host target gene, herein designated VGAM HOST TARGET GENE, encodes a corresponding messenger RNA, VGAM215 host target RNA, herein designated VGAM HOST TARGET RNA. VGAM215 host target RNA comprises three regions, as is typical of mRNA of a protein coding gene: a 5' untranslated region, a protein coding region and a 3' untranslated region, designated 5'UTR, PROTEIN CODING and 3'UTR respectively.

VGAM215 RNA, herein designated VGAM RNA, binds complementarily to one or more host target binding sites located in untranslated regions of VGAM215 host target RNA, herein designated VGAM HOST TARGET RNA. This complementary binding is due to the fact that the nucleotide sequence of VGAM215 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM215 RNA, herein designated VGAM RNA, may have a different number of host target binding sites in untranslated regions of a VGAM215 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5'UTR region, or in both 3 UTR and 5'UTR regions.

The complementary binding of VGAM215 RNA, herein designated VGAM RNA, to host target binding sites on VGAM215 host target RNA, herein designated VGAM HOST TARGET RNA, such as BINDING SITE I, BINDING SITE II and BINDING SITE III, inhibits translation of VGAM215 host target RNA into VGAM215 host target protein, herein designated VGAM HOST TARGET PROTEIN. VGAM host target protein is therefore outlined by a broken line.

It is appreciated that VGAM215 host target gene, herein designated VGAM HOST TARGET GENE, in fact represents a plurality of VGAM215 host target genes. The mRNA of each one of this plurality of VGAM215 host target genes comprises one or more host target binding sites, each having a nucleotide sequence which is at least partly complementary to VGAM215 RNA, herein designated VGAM RNA, and which when bound by VGAM215 RNA causes inhibition of translation of respective one or more VGAM215 host target proteins.

It is further appreciated by one skilled in the art that the mode of translational inhibition illustrated by FIG. 1 with specific reference to translational inhibition exerted by VGAM215 gene, herein designated VGAM GENE, on one or more VGAM215 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM215 is inhibition of expression of host target genes, as part of a novel viral mechanism of attacking a host. Accordingly, utilities of VGAM215 include diagnosis, prevention and treatment of viral infection by Autographa Californica Nucleopolyhedrovirus. Specific functions, and accordingly utilities, of VGAM215 correlate with, and may be deduced from, the identity of the host target genes which VGAM215 binds and inhibits, and the function of these host target genes, as elaborated hereinbelow.

Nucleotide sequences of the VGAM215 precursor RNA, herein designated VGAM PRECURSOR RNA, and of the 'diced' VGAM215 RNA, herein designated VGAM RNA, and a schematic representation of the secondary folding of VGAM215 folded precursor RNA, herein designated VGAM FOLDED PRECURSOR RNA, of VGAM215 are further described hereinbelow with reference to Table 1.

Nucleotide sequences of host target binding sites, such as BINDING SITE-I, BINDING SITE-II and BINDING SITE-III of FIG. 1, found on VGAM215 host target RNA, and schematic representation of the complementarity of each of these host target binding sites to VGAM215 RNA, herein designated VGAM RNA, are described hereinbelow with reference to Table 2.

As mentioned hereinabove with reference to FIG. 1, a function of VGAM215 gene, herein designated VGAM is inhibition of expression of VGAM215 target genes. It is appreciated that specific functions, and accordingly utilities, of VGAM215 correlate with, and may be deduced from, the identity of the target genes which VGAM215 binds and inhibits, and the function of these target genes, as elaborated hereinbelow.

HLA-B Associated Transcript 1 (BAT1, Accession NM_080598) is a VGAM215 host target gene. BAT1 BINDING SITE1 and BAT1 BINDING SITE2 are HOST TARGET binding sites found in untranslated regions of mRNA encoded by BAT1, corresponding to HOST TARGET binding sites such as BINDING SITE I, BINDING SITE II or BINDING SITE III. Table 2 illustrates the complementarity of the nucleotide sequences of BAT1 BINDING SITE1 and BAT1 BINDING SITE2, designated SEQ ID:27907 and SEQ ID:11014 respectively, to the nucleotide sequence of VGAM215 RNA, herein designated VGAM RNA, also designated SEQ ID:2926.

A function of VGAM215 is therefore inhibition of HLA-B Associated Transcript 1 (BAT1, Accession NM_080598), a gene which associates with the major histocompatibility complex, a negative regulator of inflammation. Accordingly, utilities of VGAM215 include diagnosis, prevention and treatment of diseases and clinical conditions associated with BAT1. The function of BAT1 and its association with various diseases and clinical conditions, has been established by previous studies, as described hereinabove with reference to VGAM55. Ubiquitin-conjugating Enzyme E2L 3 (UBE2L3, Accession NM_003347) is another VGAM215 host target gene. UBE2L3 BINDING SITE is HOST TARGET binding site found in the 3' untranslated region of mRNA encoded by UBE2L3, corresponding to a HOST TARGET binding site such as BINDING SITE I, BINDING SITE II or BINDING SITE III. Table 2 illustrates the complementarity of the nucleotide sequences of UBE2L3 BINDING SITE, designated SEQ ID:9355, to the nucleotide sequence of VGAM215 RNA, herein designated VGAM RNA, also designated SEQ ID:2926.

Another function of VGAM215 is therefore inhibition of Ubiquitin-conjugating Enzyme E2L 3 (UBE2L3, Accession NM_003347), a gene which catalyzes the covalent attachment of ubiquitin to other proteins. Accordingly, utilities of VGAM215 include diagnosis, prevention and treatment of diseases and clinical conditions associated with UBE2L3. The function of UBE2L3 has been established by previous studies. Shimura et al. (2001) hypothesized that alpha-synuclein (OMIM Ref. No. 163890) and parkin (OMIM Ref. No. 602544) interact functionally, namely, that parkin ubiquitinates alpha-synuclein normally and that this process is altered in autosomal recessive Parkinson disease (OMIM Ref. No. 600116). Shimura et al. (2001) identified a protein complex in normal human brain that includes parkin as the E3 ubiquitin ligase, UBCH7 as its associated E2 ubiquitin-conjugating enzyme, and a novel 22-kD glycosylated form of alpha-synuclein (alpha-Sp22) as its substrate. In contrast to normal parkin, mutant parkin associated with autosomal recessive Parkinson disease failed to bind alpha-Sp22. In an in vitro ubiquitination assay, alpha-Sp22 was modified by normal, but not mutant, parkin into polyubiquitinated, high molecular weight species. Accordingly, alpha-Sp22 accumulated in a nonubiquitinated form in parkin-deficient Parkinson disease brains. Shimura et al. (2001) concluded that alpha-Sp22 is a substrate for parkin's ubiquitin ligase activity in normal human brain and that loss of parkin function causes pathologic accumulation of alpha-Sp22. These findings demonstrated a critical biochemical reaction between the 2 Parkinson disease-linked gene products and suggested that this reaction underlies the accumulation of ubiquitinated alpha-synuclein in conventional Parkinson disease. By RT-PCR, Moynihan et al. (1998) determined that UBE2L3 is expressed as 4 mRNAs that differ in the length of the 3-prime untranslated region (UTR). Sequence comparisons revealed that the human and mouse UBE2L3 cDNAs share 97% DNA sequence identity in the coding region and 93% identity for 287 nucleotides extending into the 3-prime UTR. The predicted mouse and human UBE2L3 proteins are identical.

Full details of the abovementioned studies are described in the following publications, the disclosure of which are hereby incorporated by reference:

Moynihan, T. P.; Cole, C. G.; Dunham, I.; O'Neil, L.; Markham, A. F.; Robinson, P. A.: Fine-mapping, genomic organization, and transcript analysis of the human ubiquitin-conjugating enzyme gene UBE2L3. Genomics 51:124-127, 1998; and Shimura, H.; Schlossmacher, M. G.; Hattori, N.; Frosch, M. P.; Trockenbacher, A.; Schneider, R.; Mizuno, Y.; Kosik, K. S.; Selkoe, D. J.: Ubiquitination of a new form of alpha-synuclei.

Further studies establishing the function and utilities of UBE2L3 are found in John Hopkins OMIM database record ID 603721, and in sited publications numbered 5363, 834 and 6191 listed in the bibliography section hereinbelow, which are also hereby incorporated by reference. KIAA0391 (Accession NM_014672) is another VGAM215 host target gene. KIAA0391 BINDING SITE is HOST TARGET binding site found in the 5' untranslated region of mRNA encoded by KIAA0391, corresponding to a HOST TARGET binding site such as BINDING SITE I, BINDING SITE II or BINDING SITE III. Table 2 illustrates the complementarity of the nucleotide sequences of KIAA0391 BINDING SITE, designated SEQ ID:16139, to the nucleotide sequence of VGAM215 RNA, herein designated VGAM RNA, also designated SEQ ID:2926.

Another function of VGAM215 is therefore inhibition of KIAA0391 (Accession NM_014672). Accordingly, utilities of VGAM215 include diagnosis, prevention and treatment of diseases and clinical conditions associated with KIAA0391. RAB20, Member RAS Oncogene Family (RAB20, Accession NM_017817) is another VGAM215 host target gene. RAB20 BINDING SITE is HOST TARGET binding site found in the 5' untranslated region of mRNA encoded by RAB20, corresponding to a HOST TARGET binding site such as BINDING SITE I, BINDING SITE II or BINDING SITE III. Table 2 illustrates the complementarity of the nucleotide sequences of RAB20 BINDING SITE, designated SEQ ID:19463, to the nucleotide sequence of VGAM215 RNA, herein designated VGAM RNA, also designated SEQ ID:2926.

Another function of VGAM215 is therefore inhibition of RAB20, Member RAS Oncogene Family (RAB20, Accession NM_017817). Accordingly, utilities of VGAM215 include diagnosis, prevention and treatment of diseases and clinical conditions associated with RAB20. Solute Carrier Family 12, (potassium-chloride transporter) Member 5 (SLC12A5, Accession NM_020708) is another VGAM215 host target gene. SLC12A5 BINDING SITE is HOST TARGET binding site found in the 3' untranslated region of mRNA encoded by SLC12A5, corresponding to a HOST TARGET binding site such as BINDING SITE I, BINDING SITE II or BINDING SITE III. Table 2 illustrates the complementarity of the nucleotide sequences of SLC12A5 BINDING SITE, designated SEQ ID:21855, to the nucleotide sequence of VGAM215 RNA, herein designated VGAM RNA, also designated SEQ ID:2926.

Another function of VGAM215 is therefore inhibition of Solute Carrier Family 12, (potassium-chloride transporter) Member 5 (SLC12A5, Accession NM_020708). Accordingly, utilities of VGAM215 include diagnosis, prevention and treatment of diseases and clinical conditions associated with SLC12A5. FIG. 1 further provides a conceptual description of a novel bioinformatically detected viral gene of the present invention, referred to here as Viral Genomic Address Messenger 216 (VGAM216) viral gene, which modulates expression of respective host target genes thereof, the function and utility of which host target genes is known in the art.

VGAM216 is a novel bioinformatically detected regulatory, non protein coding, viral micro RNA (miRNA) gene. The method by which VGAM216 was detected is described hereinabove with reference to FIGS. 1-8.

VGAM216 gene, herein designated VGAM GENE, is a viral gene contained in the genome of Avian Leukosis Virus. VGAM216 host target gene, herein designated VGAM HOST TARGET GENE, is a human gene contained in the human genome.

VGAM216 gene encodes a VGAM216 precursor RNA, herein designated VGAM PRECURSOR RNA. Similar to other miRNA genes, and unlike most ordinary genes, VGAM216 precursor RNA does not encode a protein. A nucleotide sequence identical or highly similar to the nucleotide sequence of VGAM216 precursor RNA is designated SEQ ID:202, and is provided hereinbelow with reference to the sequence listing part. Nucleotide sequence SEQ ID:202 is located at position 1866 relative to the genome of Avian Leukosis Virus.

VGAM216 precursor RNA folds onto itself, forming VGAM216 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM216 folded precursor RNA into VGAM216 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM216 RNA is designated SEQ ID:2927, and is provided hereinbelow with reference to the sequence listing part.

VGAM216 host target gene, herein designated VGAM HOST TARGET GENE, encodes a corresponding messenger RNA, VGAM216 host target RNA, herein designated VGAM HOST TARGET RNA. VGAM216 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM216 RNA, herein designated VGAM RNA, binds complementarily to one or more host target binding sites located in untranslated regions of VGAM216 host target RNA, herein designated VGAM HOST TARGET RNA. This complementary binding is due to the fact that the nucleotide sequence of VGAM216 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM216 RNA, herein designated VGAM RNA, may have a different number of host target binding sites in untranslated regions of a VGAM216 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM216 RNA, herein designated VGAM RNA, to host target binding sites on VGAM216 host target RNA, herein designated VGAM HOST TARGET RNA, such as BINDING SITE I, BINDING SITE II and BINDING SITE III, inhibits translation of VGAM216 host target RNA into VGAM216 host target protein, herein designated VGAM HOST TARGET PROTEIN. VGAM host target protein is therefore outlined by a broken line.

It is appreciated that VGAM216 host target gene, herein designated VGAM HOST TARGET GENE, in fact represents a plurality of VGAM216 host target genes. The mRNA of each one of this plurality of VGAM216 host target genes comprises one or more host target binding sites, each having a nucleotide sequence which is at least partly complementary to VGAM216 RNA, herein designated VGAM RNA, and which when bound by VGAM216 RNA causes inhibition of translation of respective one or more VGAM216 host target proteins.

It is further appreciated by one skilled in the art that the mode of translational inhibition illustrated by FIG. 1 with specific reference to translational inhibition exerted by VGAM216 gene, herein designated VGAM GENE, on one or more VGAM216 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM216 is inhibition of expression of host target genes, as part of a novel viral mechanism of attacking a host. Accordingly, utilities of VGAM216 include diagnosis, prevention and treatment of viral infection by Avian Leukosis Virus. Specific functions, and accordingly utilities, of VGAM216 correlate with, and may be deduced from, the identity of the host target genes which VGAM216 binds and inhibits, and the function of these host target genes, as elaborated hereinbelow.

Nucleotide sequences of the VGAM216 precursor RNA, herein designated VGAM PRECURSOR RNA, and of the 'diced' VGAM216 RNA, herein designated VGAM RNA, and a schematic representation of the secondary folding of VGAM216 folded precursor RNA, herein designated VGAM FOLDED PRECURSOR RNA, of VGAM216 are further described hereinbelow with reference to Table 1.

Nucleotide sequences of host target binding sites, such as BINDING SITE-I, BINDING SITE-II and BINDING SITE-III of FIG. 1, found on VGAM216 host target RNA, and schematic representation of the complementarity of each of these host target binding sites to VGAM216 RNA, herein designated VGAM RNA, are described hereinbelow with reference to Table 2.

As mentioned hereinabove with reference to FIG. 1, a function of VGAM216 gene, herein designated VGAM is inhibition of expression of VGAM216 target genes. It is appreciated that specific functions, and accordingly utilities, of VGAM216 correlate with, and may be deduced from, the identity of the target genes which VGAM216 binds and inhibits, and the function of these target genes, as elaborated hereinbelow.

Egl Nine Homolog 1 (C. elegans) (EGLN1, Accession NM_022051) is a VGAM216 host target gene. EGLN1 BINDING SITE is HOST TARGET binding site found in the 5' untranslated region of mRNA encoded by EGLN1, corresponding to a HOST TARGET binding site such as BINDING SITE I, BINDING SITE II or BINDING SITE III. Table 2 illustrates the complementarity of the nucleotide sequences of EGLN1 BINDING SITE, designated SEQ ID:22584, to the nucleotide sequence of VGAM216 RNA, herein designated VGAM RNA, also designated SEQ ID:2927.

A function of VGAM216 is therefore inhibition of Egl Nine Homolog 1 (C. elegans) (EGLN1, Accession NM_022051), a gene which is expressed in the cytoplasm of arterial smooth muscle cells. Accordingly, utilities of VGAM216 include diagnosis, prevention and treatment of diseases and clinical conditions associated with EGLN1. The function of EGLN1 has been established by previous studies. HIF is a transcriptional complex that plays a central role in mammalian oxygen homeostasis. Posttranslational modification by prolyl hydroxylation is a key regulatory event that targets HIF-alpha (HIF1; 603348) subunits for proteasomal destruction via the von Hippel-Lindau (VHL; 193300) ubiquitylation complex. Epstein et al. (2001) defined a conserved HIF-VHL-prolyl hydroxylase pathway in C. elegans and identified Egl9 as a dioxygenase that regulates HIF by prolyl hydroxylation. In mammalian cells, they showed that the HIF-prolyl hydroxylases are represented by 3 proteins with a conserved 2-histidine-1-carboxylate iron coordination motif at the catalytic site. The genes encoding these proteins were cloned and termed PHD1 (OMIM Ref. No. 606424), PHD2, and PHD3 (OMIM Ref. No. 606426) by the authors. Direct modulation of recombinant enzyme activity by graded hypoxia, iron chelation, and cobaltous ions mirrored the characteristics of HIF induction in vivo, fulfilling requirements for these enzymes being oxygen sensors that regulate HIF. In cultured mammalian cells, Bruick and McKnight (2001) found that the inappropriate accumulation of HIF caused by forced expression of the HIF1-alpha (OMIM Ref. No. 603348) subunit under normoxic conditions was attenuated by coexpression of HPH. Suppression of HPH in cultured Drosophila melanogaster cells by RNA interference resulted in elevated expression of the hypoxia-inducible gene LDH (see OMIM Ref. No. 150000) under normoxic conditions. Bruick and McKnight (2001) concluded that HPH is an essential component of the pathway through which cells sense oxygen.

Full details of the abovementioned studies are described in the following publications, the disclosure of which are hereby incorporated by reference:

Bruick, R. K.; McKnight, S. L.: A conserved family of prolyl-4-hydroxylases that modify HIF. Science 294:1337-1340, 2001; and Epstein, A. C. R.; Gleadle, J. M.; McNeill, L. A.; Hewitson, K. S.; O'Rourke, J.; Mole, D. R.; Mukherji, M.; Metzen, E.; Wilson, M. I.; Dhanda, A.; Tian, Y.-M.; Masson, N.; Hamilton.

Further studies establishing the function and utilities of EGLN1 are found in John Hopkins OMIM database record ID 606425, and in sited publications numbered 454 and 4545 listed in the bibliography section hereinbelow, which are also hereby incorporated by reference. Ribosomal Protein S6 Kinase, 90kDa, Polypeptide 2 (RPS6KA2, Accession NM_021135) is another VGAM216 host target gene. RPS6KA2 BINDING SITE is HOST TARGET binding site found in the 5' untranslated region of mRNA encoded by RPS6KA2, corresponding to a HOST TARGET binding site such as BINDING SITE I, BINDING SITE II or BINDING SITE III. Table 2 illustrates the complementarity of the nucleotide sequences of RPS6KA2 BINDING SITE, designated SEQ ID:22105, to the nucleotide sequence of VGAM216 RNA, herein designated VGAM RNA, also designated SEQ ID:2927.

Another function of VGAM216 is therefore inhibition of Ribosomal Protein S6 Kinase, 90 kDa, Polypeptide 2 (RPS6KA2, Accession NM_021135), a gene which phosphorylates a wide range of substrates including ribosomal protein s6. Accordingly, utilities of VGAM216 include diagnosis, prevention and treatment of diseases and clinical conditions associated with RPS6KA2. The function of RPS6KA2 has been established by previous studies. Serine/threonine protein kinases in the ribosomal S6 kinase (RSK) family have been implicated as signaling intermediates in the cellular response to several growth factors. Moller et al. (1994) described the cloning and characterization of 3 genes encoding 3 isoforms of ribosomal protein S6 kinase, which they called HU1 (RPS6KA1; 601684), HU2 (RPS6KA2), and HU3 (RPS6KA3; 300075). The partial HU2 cDNA (GenBank L07598) encodes a predicted protein containing 2 distinct consensus ATP-binding site sequences. Northern blot and RNase protection analyses detected major 7.5-kb and minor 3.5-kb HU2 transcripts in fibroblasts, skeletal muscle, lymphocytes, and placenta. Zhao et al. (1995) cloned a full-length cDNA encoding the RPS6KA2 isoform of ribosomal protein S6 kinase, which they designated RSK3. The deduced 733-amino acid RSK3 protein has 84% and 75% sequence identity with RSK2 (RPS6KA3) and RSK1 (RPS6KA1), respectively. RSK3 has a unique N-terminal sequence which contains a putative bipartite nuclear localization signal. Immunoblot analysis of human cell lysates detected an 83-kD RSK protein. The authors demonstrated serum-stimulated nuclear translocation of endogenous RSK3 in HeLa cells. RSK3 exhibited growth-stimulated autophosphorylation and kinase activity; however, its relative activity toward several known RSK substrates differed from the activities of other RSKs. Unlike RSK1, RSK3 was not activated by ERK2 (PRKM1; 176948) in vitro. Northern blot analysis detected a single 6.5-kb RSK3 transcript in all tissues examined, with the highest expression in lung and skeletal muscle.

Full details of the abovementioned studies are described in the following publications, the disclosure of which are hereby incorporated by reference:

Moller, D. E.; Xia, C. H.; Tang, W.; Zhu, A. X.; Jakubowski, M.: Human rsk isoforms: cloning and characterization of tissue-specific expression. Am. J. Physiol. 266: C351-C359, 1994; and Zhao, Y.; Bjorbaek, C.; Weremowicz, S.; Morton, C. C.; Moller, D. E.: RSK3 encodes a novel pp90rsk isoform with a unique N-terminal sequence: growth factor-stimulated kinase function and n.

Further studies establishing the function and utilities of RPS6KA2 are found in John Hopkins OMIM database record ID 601685, and in sited publications numbered 622 and 9211-9212 listed in the bibliography section hereinbelow, which are also hereby incorporated by reference. Glucocorticoid Modulatory Element Binding Protein 2 (GMEB2, Accession NM_012384) is another VGAM216 host target gene. GMEB2 BINDING SITE is HOST TARGET binding site found in the 3' untranslated region of mRNA encoded by GMEB2, corresponding to a HOST TARGET binding site such as BINDING SITE I, BINDING SITE II or BINDING SITE III. Table 2 illustrates the complementarity of the nucleotide sequences of GMEB2 BINDING SITE, designated SEQ ID:14740, to the nucleotide sequence of VGAM216 RNA, herein designated VGAM RNA, also designated SEQ ID:2927.

Another function of VGAM216 is therefore inhibition of Glucocorticoid Modulatory Element Binding Protein 2 (GMEB2, Accession NM_012384). Accordingly, utilities of VGAM216 include diagnosis, prevention and treatment of diseases and clinical conditions associated with GMEB2. HS6ST (Accession XM_030529) is another VGAM216 host target gene. HS6ST BINDING SITE is HOST TARGET binding site found in the 3' untranslated region of mRNA encoded by HS6ST, corresponding to a HOST TARGET binding site such as BINDING SITE I, BINDING SITE II or BINDING SITE III. Table 2 illustrates the complementarity of the nucleotide sequences of HS6ST BINDING SITE, designated SEQ ID:31072, to the nucleotide sequence of VGAM216 RNA, herein designated VGAM RNA, also designated SEQ ID:2927.

Another function of VGAM216 is therefore inhibition of HS6ST (Accession XM_030529). Accordingly, utilities of VGAM216 include diagnosis, prevention and treatment of diseases and clinical conditions associated with HS6ST. Heparan Sulfate 6-O-sulfotransferase 1 (HS6ST1, Accession NM_004807) is another VGAM216 host target gene. HS6ST1 BINDING SITE is HOST TARGET binding site found in the 3' untranslated region of mRNA encoded by HS6ST1, corresponding to a HOST TARGET binding site such as BINDING SITE I, BINDING SITE II or BINDING SITE III. Table 2 illustrates the complementarity of the nucleotide sequences of HS6ST1 BINDING SITE, designated SEQ ID:11230, to the nucleotide sequence of VGAM216 RNA, herein designated VGAM RNA, also designated SEQ ID:2927.

Another function of VGAM216 is therefore inhibition of Heparan Sulfate 6-O-sulfotransferase 1 (HS6ST1, Accession NM_004807). Accordingly, utilities of VGAM216 include diagnosis, prevention and treatment of diseases and clinical conditions associated with HS6ST1. KIAA0339 (Accession XM_049380) is another VGAM216 host target gene. KIAA0339 BINDING SITE is HOST TARGET binding site found in the 3' untranslated region of mRNA encoded by KIAA0339, corresponding to a HOST TARGET binding site such as BINDING SITE I, BINDING SITE II or BINDING SITE III. Table 2 illustrates the complementarity of the nucleotide sequences of KIAA0339 BINDING SITE, designated SEQ ID:35404, to the nucleotide sequence of VGAM216 RNA, herein designated VGAM RNA, also designated SEQ ID:2927.

Another function of VGAM216 is therefore inhibition of KIAA0339 (Accession XM_049380). Accordingly, utilities of VGAM216 include diagnosis, prevention and treatment of diseases and clinical conditions associated with KIAA0339. LOC115051 (Accession XM_010647) is another VGAM216 host target gene. LOC115051 BINDING SITE is HOST TARGET binding site found in the 3' untranslated region of mRNA encoded by LOC115051, corresponding to a HOST TARGET binding site such as BINDING SITE I, BINDING SITE II or BINDING SITE III. Table 2 illustrates the complementarity of the nucleotide sequences of LOC115051 BINDING SITE, designated SEQ ID:30160, to the nucleotide sequence of VGAM216 RNA, herein designated VGAM RNA, also designated SEQ ID:2927.

Another function of VGAM216 is therefore inhibition of LOC115051 (Accession XM_010647). Accordingly, utilities of VGAM216 include diagnosis, prevention and treatment of diseases and clinical conditions associated with LOC115051. LOC123096 (Accession XM_058679) is another VGAM216 host target gene. LOC123096 BINDING SITE is HOST TARGET binding site found in the 3' untranslated region of mRNA encoded by LOC123096, corresponding to a HOST TARGET binding site such as BINDING SITE I, BINDING SITE II or BINDING SITE III. Table 2 illustrates the complementarity of the nucleotide sequences of LOC123096 BINDING SITE, designated SEQ ID:36721, to the nucleotide sequence of VGAM216 RNA, herein designated VGAM RNA, also designated SEQ ID:2927.

Another function of VGAM216 is therefore inhibition of LOC123096 (Accession XM_058679). Accordingly, utilities of VGAM216 include diagnosis, prevention and treatment of diseases and clinical conditions associated with LOC123096. LOC220549 (Accession XM_167521) is another VGAM216 host target gene. LOC220549 BINDING SITE is HOST TARGET binding site found in the 5' untranslated region of mRNA encoded by LOC220549, corresponding to a HOST TARGET binding site such as BINDING SITE I, BINDING SITE II or BINDING SITE III. Table 2 illustrates the complementarity of the nucleotide sequences of LOC220549 BINDING SITE, designated SEQ ID:44652, to the nucleotide sequence of VGAM216 RNA, herein designated VGAM RNA, also designated SEQ ID:2927.

Another function of VGAM216 is therefore inhibition of LOC220549 (Accession XM_167521). Accordingly, utilities of VGAM216 include diagnosis, prevention and treatment of diseases and clinical conditions associated with LOC220549. LOC253100 (Accession XM_174623) is another VGAM216 host target gene. LOC253100 BINDING SITE is HOST TARGET binding site found in the 5' untranslated region of mRNA encoded by LOC253100, corresponding to a HOST TARGET binding site such as BINDING SITE I, BINDING SITE II or BINDING SITE III. Table 2 illustrates the complementarity of the nucleotide sequences of LOC253100 BINDING SITE, designated SEQ ID:46600, to the nucleotide sequence of VGAM216 RNA, herein designated VGAM RNA, also designated SEQ ID:2927.

Another function of VGAM216 is therefore inhibition of LOC253100 (Accession XM_174623). Accordingly, utilities of VGAM216 include diagnosis, prevention and treatment of diseases and clinical conditions associated with LOC253100. LOC51054 (Accession NM_015899) is another VGAM216 host target gene. LOC51054 BINDING SITE is HOST TARGET binding site found in the 5' untranslated region of mRNA encoded by LOC51054, corresponding to a HOST TARGET binding site such as BINDING SITE I, BINDING SITE II or BINDING SITE III. Table 2 illustrates the complementarity of the nucleotide sequences of LOC51054 BINDING SITE, designated SEQ ID:18042, to the nucleotide sequence of VGAM216 RNA, herein designated VGAM RNA, also designated SEQ ID:2927.

Another function of VGAM216 is therefore inhibition of LOC51054 (Accession NM_015899). Accordingly, utilities of VGAM216 include diagnosis, prevention and treatment of diseases and clinical conditions associated with LOC51054. LOC84661 (Accession NM_032574) is another VGAM216 host target gene. LOC84661 BINDING SITE is HOST TARGET binding site found in the 5' untranslated region of mRNA encoded by LOC84661, corresponding to a HOST TARGET binding site such as BINDING SITE I, BINDING SITE II or BINDING SITE III. Table 2 illustrates the complementarity of the nucleotide sequences of LOC84661 BINDING SITE, designated SEQ ID:26303, to the nucleotide sequence of VGAM216 RNA, herein designated VGAM RNA, also designated SEQ ID:2927.

Another function of VGAM216 is therefore inhibition of LOC84661 (Accession NM_032574). Accordingly, utilities of VGAM216 include diagnosis, prevention and treatment of diseases and clinical conditions associated with LOC84661.

FIG. 1 further provides a conceptual description of a novel bioinformatically detected viral gene of the present invention, referred to here as Viral Genomic Address Messenger 217 (VGAM217) viral gene, which modulates expression of respective host target genes thereof, the function and utility of which host target genes is known in the art.

VGAM217 is a novel bioinformatically detected regulatory, non protein coding, viral micro RNA (miRNA) gene. The method by which VGAM217 was detected is described hereinabove with reference to FIGS. 1-8.

VGAM217 gene, herein designated VGAM GENE, is a viral gene contained in the genome of Avian Leukosis Virus. VGAM217 host target gene, herein designated VGAM HOST TARGET GENE, is a human gene contained in the human genome.

VGAM217 gene encodes a VGAM217 precursor RNA, herein designated VGAM PRECURSOR RNA. Similar to other miRNA genes, and unlike most ordinary genes, VGAM217 precursor RNA does not encode a protein. A nucleotide sequence identical or highly similar to the nucleotide sequence of VGAM217 precursor RNA is designated SEQ ID:203, and is provided hereinbelow with reference to the sequence listing part. Nucleotide sequence SEQ ID:203 is located at position 3402 relative to the genome of Avian Leukosis Virus.

VGAM217 precursor RNA folds onto itself, forming VGAM217 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM217 folded precursor RNA into VGAM217 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM217 RNA is designated SEQ ID:2928, and is provided hereinbelow with reference to the sequence listing part.

VGAM217 host target gene, herein designated VGAM HOST TARGET GENE, encodes a corresponding messenger RNA, VGAM217 host target RNA, herein designated VGAM HOST TARGET RNA. VGAM217 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM217 RNA, herein designated VGAM RNA, binds complementarily to one or more host target binding sites located in untranslated regions of VGAM217 host target RNA, herein designated VGAM HOST TARGET RNA. This complementary binding is due to the fact that the nucleotide sequence of VGAM217 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM217 RNA, herein designated VGAM RNA, may have a different number of host target binding sites in untranslated regions of a VGAM217 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM217 RNA, herein designated VGAM RNA, to host target binding sites on VGAM217 host target RNA, herein designated VGAM HOST TARGET RNA, such as BINDING SITE I, BINDING SITE II and BINDING SITE III, inhibits translation of VGAM217 host target RNA into VGAM217 host target protein, herein designated VGAM HOST TARGET PROTEIN. VGAM host target protein is therefore outlined by a broken line.

It is appreciated that VGAM217 host target gene, herein designated VGAM HOST TARGET GENE, in fact represents a plurality of VGAM217 host target genes. The mRNA of each one of this plurality of VGAM217 host target genes comprises one or more host target binding sites, each having a nucleotide sequence which is at least partly complementary to VGAM217 RNA, herein designated VGAM RNA, and which when bound by VGAM217 RNA causes inhibition of translation of respective one or more VGAM217 host target proteins.

It is further appreciated by one skilled in the art that the mode of translational inhibition illustrated by FIG. 1 with specific reference to translational inhibition exerted by VGAM217 gene, herein designated VGAM GENE, on one or more VGAM217 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM217 is inhibition of expression of host target genes, as part of a novel viral mechanism of attacking a host. Accordingly, utilities of VGAM217 include diagnosis, prevention and treatment of viral infection by Avian Leukosis Virus. Specific functions, and accordingly utilities, of VGAM217 correlate with, and may be deduced from, the identity of the host target genes which VGAM217 binds and inhibits, and the function of these host target genes, as elaborated hereinbelow.

Nucleotide sequences of the VGAM217 precursor RNA, herein designated VGAM PRECURSOR RNA, and of the 'diced' VGAM217 RNA, herein designated VGAM RNA, and a schematic representation of the secondary folding of VGAM217 folded precursor RNA, herein designated VGAM FOLDED PRECURSOR RNA, of VGAM217 are further described hereinbelow with reference to Table 1.

Nucleotide sequences of host target binding sites, such as BINDING SITE-I, BINDING SITE-II and BINDING SITE-III of FIG. 1, found on VGAM217 host target RNA, and schematic representation of the complementarity of each of these host target binding sites to VGAM217 RNA, herein designated VGAM RNA, are described hereinbelow with reference to Table 2.

As mentioned hereinabove with reference to FIG. 1, a function of VGAM217 gene, herein designated VGAM is inhibition of expression of VGAM217 target genes. It is appreciated that specific functions, and accordingly utilities, of VGAM217 correlate with, and may be deduced from, the identity of the target genes which VGAM217 binds and inhibits, and the function of these target genes, as elaborated hereinbelow.

Activin A Receptor, Type I (ACVR1, Accession NM_001105) is a VGAM217 host target gene. ACVR1 BINDING SITE is HOST TARGET binding site found in the 3' untranslated region of mRNA encoded by ACVR1, corresponding to a HOST TARGET binding site such as BINDING SITE I, BINDING SITE II or BINDING SITE III. Table 2 illustrates the complementarity of the nucleotide sequences of ACVR1 BINDING SITE, designated SEQ ID:6761, to the nucleotide sequence of VGAM217 RNA, herein designated VGAM RNA, also designated SEQ ID:2928.

A function of VGAM217 is therefore inhibition of Activin A Receptor, Type I (ACVR1, Accession NM_001105), a gene which Activin receptor-like kinase; similar to activin, TGF-beta, and C. elegans daf-1 receptors. Accordingly, utilities of VGAM217 include diagnosis, prevention and treatment of diseases and clinical conditions associated with ACVR1. The function of ACVR1 has been established by previous studies. See ACVRLK1 (OMIM Ref. No. 601284). Although activins were discovered by virtue of their capacity to stimulate the production of follicle-stimulating hormone (FSH; 136530) by the pituitary gland and inhibins were initially characterized as FSH inhibitors, activins and inhibins are dimeric proteins that share a common subunit. There are 3 activins (A, B, and A-B), comprising different combinations of 2 closely related beta subunits (beta-A/beta-A; beta-B/beta-B; and beta-A/beta-B, respectively) and 2 inhibins (A and B), consisting of 1 beta-subunit and an inhibin-specific alpha subunit (alpha/beta-A and alpha/beta-B). Activins impinge on a much broader spectrum of cells than do inhibins; however, in those systems in which both proteins are functional, they have opposing biologic effects. Activins are members of a family of polypeptide growth factors that includes also the transforming growth factors-beta (190180, 190220, 190230), mullerian duct-inhibiting substance, and several bone morphogenetic proteins. Human cDNA clones encoding 4 putative transmembrane ser/thr kinases were identified by ten Dijke et al. (1993). By Southern blot analysis of DNAs from a somatic cell hybrid mapping panel, Roijer et al. (1998) mapped the ACVR1 gene to chromosome 2. By fluorescence in situ hybridization, they regionalized the gene to 2q23-q24.

Full details of the abovementioned studies are described in the following publications, the disclosure of which are hereby incorporated by reference:

ten Dijke, P.; Ichijo, H.; Franzen, P.; Schulz, P.; Saras, J.; Toyoshima, H.; Heldin, C.-H.; Miyazono, K.: Activin receptor-like kinases: a novel subclass of cell-surface receptors with predicted serine/threonine kinase activity. Oncogene 8:2879-2887, 1993; and Roijer, E.; Miyazono, K.; Astrom, A.-K.; Geurts van Kessel, A.; ten Dijke, P.; Stenman, G.: Chromosomal localization of three human genes encoding members of the TGF-beta superfamily of.

Further studies establishing the function and utilities of ACVR1 are found in John Hopkins OMIM database record ID 102576, and in sited publications numbered 4267-4271 listed in the bibliography section hereinbelow, which are also hereby incorporated by reference. Dihydropyrimidinase-like 2 (DPYSL2, Accession NM_001386) is another VGAM217 host target gene. DPYSL2 BINDING SITE is HOST TARGET binding site found in the 3' untranslated region of mRNA encoded by DPYSL2, corresponding to a HOST TARGET binding site such as BINDING SITE I, BINDING SITE II or BINDING SITE III. Table 2 illustrates the complementarity of the nucleotide sequences of DPYSL2 BINDING SITE, designated SEQ ID:7062, to the nucleotide sequence of VGAM217 RNA, herein designated VGAM RNA, also designated SEQ ID:2928.

Another function of VGAM217 is therefore inhibition of Dihydropyrimidinase-like 2 (DPYSL2, Accession NM_001386), a gene which is a member of the dihydropyrimidinase family. Accordingly, utilities of VGAM217 include diagnosis, prevention and treatment of diseases and clinical conditions associated with DPYSL2. The function of DPYSL2 has been established by previous studies. Hamajima et al. (1996) isolated a human cDNA encoding dihydropyrimidinase-like 2 (OMIM Ref. No. DPYSL2), called DRP2 by them, from a fetal brain cDNA library (see OMIM Ref. No. 222748). The DPYSL2 protein has 572 amino acids. Northern blot analysis detected a 4.9-kb DPYSL2 transcript in all tissues examined except liver. Hamajima et al. (1996) noted that 3 ESTs mapped to 8p21 by Koyama et al. (1995) correspond to a portion of the coding region of DPYSL2.

Full details of the abovementioned studies are described in the following publications, the disclosure of which are hereby incorporated by reference:

Hamajima, N.; Matsuda, K.; Sakata, S.; Tamaki, N.; Sasaki, M.; Nonaka, M.: A novel gene family defined by human dihydropyrimidinase and three related proteins with differential tissue distribution. Gene 180:157-163, 1996; and Koyama, K.; Sudo, K.; Nakamura, Y.: Isolation of 115 human chromosome 8-specific expressed-sequence tags by exon amplification. Genomics 26:245-253, 1995.

Further studies establishing the function and utilities of DPYSL2 are found in John Hopkins OMIM database record ID 602463, and in sited publications numbered 327 and 6187 listed in the bibliography section hereinbelow, which are also hereby incorporated by reference. Forkhead Box F2 (FOXF2, Accession NM_001452) is another VGAM217 host target gene. FOXF2 BINDING SITE is HOST TARGET binding site found in the 3' untranslated region of mRNA encoded by FOXF2, corresponding to a HOST TARGET binding site such as BINDING SITE I, BINDING SITE II or BINDING SITE III. Table 2 illustrates the complementarity of the nucleotide sequences of FOXF2 BINDING SITE, designated SEQ ID:7186, to the nucleotide sequence of VGAM217 RNA, herein designated VGAM RNA, also designated SEQ ID:2928.

Another function of VGAM217 is therefore inhibition of Forkhead Box F2 (FOXF2, Accession NM_001452), a gene which is a probable transcription activator for a number of lung-specific genes. Accordingly, utilities of VGAM217 include diagnosis, prevention and treatment of diseases and clinical conditions associated with FOXF2. The function of FOXF2 has been established by previous studies. The forkhead domain is a 100-amino acid monomeric DNA binding motif originally identified as a region of homology between the Drosophila forkhead protein and rat HNF3. Pierrou et al. (1994) identified 7 human genes containing forkhead domains and designated them forkhead related activators (FREAC) 1 through 7. Northern blot analysis revealed that the FREAC2, or FKHL6, gene is expressed as a 2.4-kb mRNA primarily in placenta and adult and fetal lung. Pierrou et al. (1994) determined the DNA binding specificity of FKHL6 through selection of high-affinity binding sites from random sequence oligonucleotides. Hellqvist et al. (1996) reported the sequence of a partial FREAC2 cDNA. The predicted 408-amino acid protein is missing the N-terminal region. Sequence analysis revealed that the FREAC1 (FKHL5; 601089) and FREAC2 proteins are nearly identical within a 112-residue region containing the forkhead domain and adjacent sequences, and within the C-terminal region. Using a reporter gene construct containing in the promoter the FREAC2 binding sequences identified by Pierrou et al. (1994), Hellqvist et al. (1996) demonstrated that both FREAC1 and FREAC2 have C-terminal transcriptional activation domains. FREAC1/FREAC2 binding sequences are present in the promoters of several lung-specific genes, including CC10 (OMIM Ref. No. 192020) and SPB (SFTPB; 178640). Both FREAC1 and FREAC2 transactivated an SPB promoter construct. Blixt et al. (1998) reported that the full-length FREAC2 protein contains 444 amino acids.

Full details of the abovementioned studies are described in the following publications, the disclosure of which are hereby incorporated by reference:

Hellqvist, M.; Mahlapuu, M.; Samuelsson, L.; Enerback, S.; Carlsson, P.: Differential activation of lung-specific genes by two forkhead proteins, FREAC-1 and FREAC-2. J. Biol. Chem. 271:4482-4490, 1996; and Pierrou, S.; Hellqvist, M.; Samuelsson, L.; Enerback, S.; Carlsson, P.: Cloning and characterization of seven human forkhead proteins: binding site specificity and DNA bending. EMBO J.

Further studies establishing the function and utilities of FOXF2 are found in John Hopkins OMIM database record ID 603250, and in sited publications numbered 8656, 9457-945 and 9460 listed in the bibliography section hereinbelow, which are also hereby incorporated by reference. MAD, Mothers Against Decapentaplegic Homolog 4 (Drosophila) (MADH4, Accession NM_005359) is another VGAM217 host target gene. MADH4 BINDING SITE is HOST TARGET binding site found in the 3' untranslated region of mRNA encoded by MADH4, corresponding to a HOST TARGET binding site such as BINDING SITE I, BINDING SITE II or BINDING SITE III. Table 2 illustrates the complementarity of the nucleotide sequences of MADH4 BINDING SITE, designated SEQ ID:11829, to the nucleotide sequence of VGAM217 RNA, herein designated VGAM RNA, also designated SEQ ID:2928.

Another function of VGAM217 is therefore inhibition of MAD, Mothers Against Decapentaplegic Homolog 4 (Drosophila) (MADH4, Accession NM_005359), a gene which common mediator of signal transduction by tgf-beta (transforming growth factor) superfamily; smad4 is the common smad (co-smad). promotes binding of the smad2/smad4/fast-1 complex to dna and provides an activation function required for smad1 or smad2 to stimulate transcription. may act as a tumor suppressor. Accordingly, utilities of VGAM217 include diagnosis, prevention and treatment of diseases and clinical conditions associated with MADH4. The function of MADH4 has been established by previous studies. About 90% of human pancreatic carcinomas show allelic loss at 18q. Hahn et al. (1996) reported the identification of a putative tumor suppressor gene on chromosome 18q21.1 that may be a candidate for pancreatic carcinoma. The gene was homozygously deleted in 25 of 84 tumors and mutations were identified as somatic mutations in 6 of 27 carcinomas that lacked deletions. The gene was localized by deletion analysis of xenograft DNA. Markers absent in these samples were used to screen the CEPH mega-YAC library. YACs spanning the minimal deletion region were subcloned as cosmids for sequencing and recovery of cDNAs. A 2,680-bp cDNA was found and shown to code for a predicted 552-amino acid protein. The predicted protein shares blocks of as much as 85% similarity to the Drosophila Mad protein and the Caenorhabditis elegans sma-2,-3 and -4 proteins. In Drosophila, homozygous Mad mutants exhibit a variety of developmental defects. The authors showed that the human gene contains 11 exons. Hahn et al. (1996) designated the gene DPC4 (for homozygously deleted in pancreatic carcinoma, locus 4). This region of chromosome 18q also contains a gene (DCC; 120470) found to be deleted in colorectal cancers. Animal model experiments lend further support to the function of MADH4. Takaku et al. (1998) inactivated the mouse Dpc4 (Smad4) homolog. The homozygous mutants were embryonic lethal, whereas the heterozygotes showed no abnormality. The investigators then introduced the Dpc4 mutation into the knockout mice for the mouse homolog of the human APC (OMIM Ref. No. 175100) gene, Apc-delta716, a model for human familial adenomatous polyposis. Because both Apc and Dpc4 are located on mouse chromosome 18, they constructed compound heterozygotes carrying both mutations on the same chromosome by meiotic recombination. In such mice, intestinal polyps developed into more malignant tumors than those in the simple Apc-delta716 heterozygotes, showing an extensive stromal cell proliferation, submucosal invasion, cell type heterogeneity, and in vivo transplantability. Takaku et al. (1998) suggested that mutations in DPC4 play a significant role in the malignant progression of colorectal tumors. Sirard et al. (1998) demonstrated that homozygous Smad4 mutant mice died before embryonic day 7.5. Mutant embryos have reduced size, fail to gastrulate or express a mesodermal marker, and show abnormal visceral endoderm development. Growth retardation of the Smad4-deficient embryos results from reduced cell proliferation rather than increased apoptosis. Aggregation of mutant Smad4 embryonic stem cells with wildtype tetraploid morulae rescued the gastrulation defect. The results of Sirard et al. (1998) indicated that Smad4 is initially required for the differentiation of the visceral endoderm and that the gastrulation defect in the epiblast is secondary and noncell autonomous. Rescued embryos showed severe anterior truncations, indicating a second important role for Smad4 in anterior patterning during embryogenesis It is appreciated that the abovementioned animal model for MADH4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sirard, C.; de la Pompa, J. L.; Elia, A.; Itie, A.; Mirtsos, C.; Cheung, A.; Hahn, S.; Wakeham, A.; Schwartz, L.; Kern, S. E.; Rossant, J.; Mak, T. W.: The tumor suppressor gene Smad4/Dpc4 is required for gastrulation and later for anterior development of the mouse embryo. Genes Dev. 12:107-119, 1998; and Hahn, S. A.; Schutte, M.; Hoque, T. M. S.; Moskaluk, C. A.; da Costa, L. T.; Rozenblum, E.; Weinstein, C. L.; Fischer, A.; Yeo, C. J.; Hruban, R. H.; Kern, S. E. : DPC4, a candidate tumor s.

Further studies establishing the function and utilities of MADH4 are found in John Hopkins OMIM database record ID 600993, and in sited publications numbered 7161, 7798, 12349-7817, 10962, 10965-1096 and 7819-7832 listed in the bibliography section hereinbelow, which are also hereby incorporated by reference. Mitogen-activated Protein Kinase 1 (MAPK1, Accession NM_002745) is another VGAM217 host target gene. MAPK1 BINDING SITE is HOST TAR- GET binding site found in the 3' untranslated region of mRNA encoded by MAPK1, corresponding to a HOST TARGET binding site such as BINDING SITE I, BINDING SITE II or BINDING SITE III. Table 2 illustrates the complementarity of the nucleotide sequences of MAPK1 BINDING SITE, designated SEQ ID:8615, to the nucleotide sequence of VGAM217 RNA, herein designated VGAM RNA, also designated SEQ ID:2928.

Another function of VGAM217 is therefore inhibition of Mitogen-activated Protein Kinase 1 (MAPK1, Accession NM_002745), a gene which phosphorylates microtubule-associated protein-2 (map2). myelin basic protein (mbp), and elk-1; may promote entry in the cell cycle. Accordingly, utilities of VGAM217 include diagnosis, prevention and treatment of diseases and clinical conditions associated with MAPK1. The function of MAPK1 has been established by previous studies. Forcet et al. (2002) showed that in embryonic kidney cells expressing full-length, but not cytoplasmic domain-truncated, DCC (OMIM Ref. No. 120470), NTN1 (OMIM Ref. No. 601614) causes increased transient phosphorylation and activity of ERK1 and ERK2, but not of JNK1 (OMIM Ref. No. 601158), JNK2 (OMIM Ref. No. 602896), or p38 (MAPK14; 600289). This phosphorylation was mediated by MEK1 and/or MEK2. NTN1 also activated the transcription factor ELK1 (OMIM Ref. No. 311040) and serum response element-regulated gene expression. Immunoprecipitation analysis showed interaction of full-length DCC with MEK1/2 in the presence or absence of NTN1. Forcet et al. (2002) showed that activation of Dcc by Ntn1 in rat embryonic day-13 dorsal spinal cord stimulates and is required for the outgrowth of commissural axons and Erk1/2 activation. Immunohistochemical analysis demonstrated expression of activated Erk1/2 in embryonic commissural axons, and this expression was diminished in Dcc or Ntn1 knockout animals. Forcet et al. (2002) concluded that the MAPK pathway is involved in responses to NTN1 and proposed that ERK activation affects axonal growth by phosphorylation of microtubule-associated proteins and neurofilaments. Stefanovsky et al. (2001) showed that epidermal growth factor (OMIM Ref. No. 131530) induces immediate, ERK1/ERK2-dependent activation of endogenous ribosomal transcription, while inactivation of ERK1/ERK2 causes an equally immediate reversion to the basal transcription level. ERK1/ERK2 was found to phosphorylate the architectural transcription factor UBF (OMIM Ref. No. 600673) at amino acids 117 and 201 within HMG boxes 1 and 2, preventing their interaction with DNA. Mutation of these sites inhibited transcription activation and abrogated the transcriptional response to ERK1/ERK2. Thus, growth factor regulation of ribosomal transcription likely acts by a cyclic modulation of DNA architecture. The data suggested a central role for ribosome biogenesis in growth regulation Full details of the abovementioned studies are described in the following publications, the disclosure of which are hereby incorporated by reference:

Forcet, C.; Stein, E.; Pays, L.; Corset, V.; Llambi, F.; Tessier-Lavigne, M.; Mehlen, P.: Netrin-1-mediated axon outgrowth requires deleted in colorectal cancer-dependent MAPK activation. Nature 417:443-447, 2002. ; and Stefanovsky, V. Y.; Pelletier, G.; Hannan, R.; Gagnon-Kugler, T.; Rothblum, L. I.; Moss, T.: An immediate response of ribosomal transcription to growth factor stimulation in mammals is.

Further studies establishing the function and utilities of MAPK1 are found in John Hopkins OMIM database record ID 176948, and in sited publications numbered 1529-1532, 10346-1536, 10350, 10354-153 and 3462 listed in the bibliography section hereinbelow, which are also hereby incorporated by reference.5',3'-nucleotidase, Mitochondrial (NT5M, Accession NM_020201) is another VGAM217 host target gene. NT5M BINDING SITE is HOST TARGET binding site found in the 3' untranslated region of mRNA encoded by NT5M, corresponding to a HOST TARGET binding site such as BINDING SITE I, BINDING SITE II or BINDING SITE III. Table 2 illustrates the complementarity of the nucleotide sequences of NT5M BINDING SITE, designated SEQ ID:21436, to the nucleotide sequence of VGAM217 RNA, herein designated VGAM RNA, also designated SEQ ID:2928.

Another function of VGAM217 is therefore inhibition of 5',3'-nucleotidase, Mitochondrial (NT5M, Accession NM_020201). Accordingly, utilities of VGAM217 include diagnosis, prevention and treatment of diseases and clinical conditions associated with NT5M. Protein Tyrosine Phosphatase Type IVA, Member 2 (PTP4A2, Accession NM_003479) is another VGAM217 host target gene. PTP4A2 BINDING SITE is HOST TARGET binding site found in the 3' untranslated region of mRNA encoded by PTP4A2, corresponding to a HOST TARGET binding site such as BINDING SITE I, BINDING SITE II or BINDING SITE III. Table 2 illustrates the complementarity of the nucleotide sequences of PTP4A2 BINDING SITE, designated SEQ ID:9550, to the nucleotide sequence of VGAM217 RNA, herein designated VGAM RNA, also designated SEQ ID:2928.

Another function of VGAM217 is therefore inhibition of Protein Tyrosine Phosphatase Type IVA, Member 2 (PTP4A2, Accession NM_003479), a gene which is a protein tyrosine phosphatase which has a C-terminal prenylation site. Accordingly, utilities of VGAM217 include diagnosis, prevention and treatment of diseases and clinical conditions associated with PTP4A2. The function of PTP4A2 has been established by previous studies. The rat Prl1 (phosphatase of regenerating liver-1; 601585) protein is a 20-kD nuclear protein tyrosine phosphatase (OMIM Ref. No. PTPase) that is not homologous to previously characterized dual-specificity PTPases or the monospecific PTPases. Montagna et al. (1995) identified a cDNA encoding a human PRL1-like protein, which they designated OV1. By using an in vitro prenylation screen, Cates et al. (1996) found that human PRL1 and OV1, which they referred to as PTP(CAAX1) and PTP(CAAX2), respectively, are farnesylated in vitro by mammalian farnesyl: protein transferase. Overexpression of these PTPs in epithelial cells caused a transformed phenotype in cultured cells and tumor growth in nude mice. Cates et al. (1996) concluded that PTP(CAAX1) and PTP(CAAX2) represent a novel class of isoprenylated, oncogenic PTPs. Zhao et al. (1996) isolated both cDNA and genomic clones as part of a screen for genes with CTG repeats. Among these were 2 cDNAs, HH13 and HH7-2, that were identical in their coding regions but differed primarily in their 5-prime untranslated regions (UTRs). The predicted 167-amino acid sequence from each was 89% identical to rat Prl1 but was unrelated to other PTPs except for the active site. The protein contains a large number of basic residues and has a predicted isoelectric point of 8.33. Northern blot analysis using a probe from the common 3-prime UTR of HH13 and HH7-2 identified transcripts of 2 and 4 kb in all human tissues examined. Zeng et al. (1998) identified cDNAs encoding the mouse homolog of human PTP (CAAX2), or PRL2. The predicted human and mouse PRL2 proteins are identical. Zhao et al. (1996) used the HH13 cDNA to identify a YAC that was mapped to 1p35 by fluorescence in situ hybridization. They found a third cDNA (designated HH18) which contains a large deletion in the reading frame and may be a splice variant of either HH13 or HH7-2. Furthermore, a processed pseudogene with 96% sequence identity was found in the BRCA1 (OMIM Ref. No. 113705) region of 17q21.

Full details of the abovementioned studies are described in the following publications, the disclosure of which are hereby incorporated by reference:

Cates, C. A.; Michael, R. L.; Stayrook, K. R.; Harvey, K. A.; Burke, Y. D.; Randall, S. K.; Crowell, P. L.; Crowell, D. N.: Prenylation of oncogenic human PTP(CAAX) protein tyrosine phosphatases. Cancer Lett. 110:49-55, 1996; and Zhao, Z.; Lee, C.-C.; Monckton, D. G.; Yazdani, A.; Coolbaugh, M. I.; Li, X.; Bailey, J.; Shen, Y.; Caskey, C. T.: Characterization and genomic mapping of genes and pseudogenes of a new.

Further studies establishing the function and utilities of PTP4A2 are found in John Hopkins OMIM database record ID 601584, and in sited publications numbered 6551-655 and 7174 listed in the bibliography section hereinbelow, which are also hereby incorporated by reference. Protein Tyrosine Phosphatase, Receptor Type, D (PTPRD, Accession NM_130391) is another VGAM217 host target gene. PTPRD BINDING SITE1 through PTPRD BINDING SITE4 are HOST TARGET binding sites found in untranslated regions of mRNA encoded by PTPRD, corresponding to HOST TARGET binding sites such as BINDING SITE I, BINDING SITE II or BINDING SITE III. Table 2 illustrates the complementarity of the nucleotide sequences of PTPRD BINDING SITE1 through PTPRD BINDING SITE4, designated SEQ ID:28178, SEQ ID:28179, SEQ ID:28180 and SEQ ID:8722 respectively, to the nucleotide sequence of VGAM217 RNA, herein designated VGAM RNA, also designated SEQ ID:2928.

Another function of VGAM217 is therefore inhibition of Protein Tyrosine Phosphatase, Receptor Type, D (PTPRD, Accession NM_130391), a gene which plays important roles in regulating hippocampal LTP and learning processes. Accordingly, utilities of VGAM217 include diagnosis, prevention and treatment of diseases and clinical conditions associated with PTPRD. The function of PTPRD has been established by previous studies. Mizuno et al. (1993) isolated a mouse gene that was highly homologous to human protein-tyrosine phosphatase-delta. The cDNA clones were isolated by screening mouse brain cDNA libraries with mouse CD45 protein-tyrosine phosphatase domain probes under reduced stringency. Northern blot analysis demonstrated expression of 3 mRNA species in brain, kidney, and heart. In situ hybridization of brain samples revealed that the mRNA was present in hippocampus, thalamic reticular nucleus, and piriform cortex. Although this murine mRNA was not detected in lymphoid tissues, all of the pre-B cell lines tested and 1 of 3 B-cell lines tested expressed mRNA, whereas antibody-producing B-cell hybridomas and T-cell and macrophage lines did not. Testing a panel of recombinant inbred strains, Mizuno et al. (1993) mapped the gene to mouse chromosome 4 in tight linkage to the 'brown' (b) locus. They found that the mouse gene was closely homologous to the human PTPRD gene. A high degree of structural similarity had been demonstrated between LAR (PTPRF; 179590) in the human and human PTPRD. This raised the possibility that they are allelic forms or that PTPRD and LAR are related but distinct gene products. The findings of Mizuno et al. (1993) in the mouse supported the latter possibility. First, the LAR gene is expressed predominantly in cells of epithelial origin and T cells but not in B cells, whereas expression of murine PTP-delta is restricted to brain, kidney, heart, and some B-cell lines. Second, the chromosomal localization of LAR to human 1p34-p32 is different from the location on mouse chromosome 4, close to the b locus, which corresponds to human 9q. It is noteworthy that the Ptprf gene maps to mouse chromosome 4 (Schaapveld et al., 1995). Animal model experiments lend further support to the function of PTPRD. Ptprd is a receptor-type protein-tyrosine phosphatase expressed in the specialized regions of the brain, including the hippocampal CA2 and CA3, in B lymphocytes, and in the thymic medulla. To elucidate the physiologic roles of Ptprd, Uetani et al. (2000) produced Ptprd-deficient mice by gene targeting. They found that Ptprd-deficient mice were semilethal due to insufficient food intake. The mice also exhibited learning impairment in the Morris water maze, reinforced T-maze, and radial arm maze tasks. Although the histology of the hippocampus appeared normal, the magnitudes of long-term potentiation (LTP) induced at hippocampal CA1 and CA3 synapses were significantly enhanced in Ptprd-deficient mice, with augmented paired-pulse facilitation in the CA1 region. Uetani et al. (2000) concluded that Ptprd plays important roles in regulating hippocampal LTP and learning processes, and that hippocampal LTP does not necessarily positively correlate with spatial learning ability. They stated that Ptprd is an important regulator of synaptic plasticity and discussed the role of Ptprd in learning and memory It is appreciated that the abovementioned animal model for PTPRD is acknowledged by those skilled in the art as a scientifically valid animal model, as can be further appreciated from the publications sited hereinbelow.

Full details of the abovementioned studies are described in the following publications, the disclosure of which are hereby incorporated by reference:

Schaapveld, R. Q. J.; van den Maagdenberg, A. M. J. M.; Schepens, J. T. G.; Olde Weghuis, D.; Geurts van Kessel, A.; Wieringa, B.; Hendriks, W. J. A. J.: The mouse gene Ptprf encoding the leukocyte common antigen-related molecule LAR: cloning, characterization, and chromosomal localization. Genomics 27:124-130, 1995; and Uetani, N.; Kato, K.; Ogura, H.; Mizuno, K.; Kawano, K.; Mikoshiba, K.; Yakura, H.; Asano, M.; Iwakura, Y.: Impaired learning with enhanced hippocampal long-term potentiation in PTP-del.

Further studies establishing the function and utilities of PTPRD are found in John Hopkins OMIM database record ID 601598, and in sited publications numbered 933 and 12389 listed in the bibliography section hereinbelow, which are also hereby incorporated by reference. Replication Factor C (activator 1) 1, 145 kDa (RFC1, Accession NM_002913) is another VGAM217 host target gene. RFC1 BINDING SITE is HOST TARGET binding site found in the 3' untranslated region of mRNA encoded by RFC1, corresponding to a HOST TARGET binding site such as BINDING SITE I, BINDING SITE II or BINDING SITE III. Table 2 illustrates the complementarity of the nucleotide sequences of RFC1 BINDING SITE, designated SEQ ID:8820, to the nucleotide sequence of VGAM217 RNA, herein designated VGAM RNA, also designated SEQ ID:2928.

Another function of VGAM217 is therefore inhibition of Replication Factor C (activator 1) 1, 145 kDa (RFC1, Accession NM_002913), a gene which plays a role in dna transcription, replication and/or repair. Accordingly, utilities of VGAM217 include diagnosis, prevention and treatment of diseases and clinical conditions associated with RFC1. The function of RFC1 has been established by previous studies. Replication factor C is a multisubunit, DNA polymerase accessory protein required for the coordinated synthesis of both DNA strands during simian virus 40 DNA replication in vitro. It is a DNA-dependent ATPase that binds in a structure-specific manner to the 3-prime end of a primer hybridized to a template DNA, an activity thought intrinsic to the 140-kD component of this multisubunit complex. Bunz et al. (1993) isolated and analyzed cDNAs encoding the 140-kD subunit. An open reading frame of 3.4 kb was predicted to encode a 1,148-amino acid protein with a predicted molecular mass of 130 kD. A putative ATP-binding motif was observed that is similar to a motif in several of the smaller subunits of RFC and in functionally homologous replication factors of bacterial and viral origin. The predicted protein showed similarities to other DNA-binding proteins. Wang et al. (2000) used immunoprecipitation and mass spectrometry analyses to identify BRCA1 (OMIM Ref. No. 113705)-associated proteins. They found that BRCA1 is part of a large multisubunit protein complex of tumor suppressors, DNA damage sensors, and signal transducers. They named this complex BASC, for 'BRCA1-associated genome surveillance complex.' Among the DNA repair proteins identified in the complex were ATM (OMIM Ref. No. 208900), BLM (OMIM Ref. No. 604610), MSH2 (OMIM Ref. No. 120435), MSH6 (OMIM Ref. No. 600678), MLH1 (OMIM Ref. No. 120436), the RAD50 (OMIM Ref. No. 604040)-MRE11 (OMIM Ref. No. 600814)-NBS1 (OMIM Ref. No. 602667) complex, and the RFC1-RFC2 (OMIM Ref. No. 600404)-RFC4 (OMIM Ref. No. 102577) complex. Wang et al. (2000) suggested that BASC may serve as a sensor of abnormal DNA structures and/or as a regulator of the postreplication repair process.

Full details of the abovementioned studies are described in the following publications, the disclosure of which are hereby incorporated by reference:

Bunz, F.; Kobayashi, R.; Stillman, B.: cDNAs encoding the large subunit of human replication factor C. Proc. Nat. Acad. Sci. 90:11014-11018, 1993; and Wang, Y.; Cortez, D.; Yazdi, P.; Neff, N.; Elledge, S. J.; Qin, J.: BASC, a super complex of BRCA1-associated proteins involved in the recognition and repair of aberrant DNA structures.

Further studies establishing the function and utilities of RFC1 are found in John Hopkins OMIM database record ID 102579, and in sited publications numbered 12335-1233 and 7118 listed in the bibliography section hereinbelow, which are also hereby incorporated by reference. DKFZP434P211 (Accession NM_014549) is another VGAM217 host target gene. DKFZP434P211 BINDING SITE is HOST TARGET binding site found in the 3' untranslated region of mRNA encoded by DKFZP434P211, corresponding to a HOST TARGET binding site such as BINDING SITE I, BINDING SITE II or BINDING SITE III. Table 2 illustrates the complementarity of the nucleotide sequences of DKFZP434P211 BINDING SITE, designated SEQ ID:15864, to the nucleotide sequence of VGAM217 RNA, herein designated VGAM RNA, also designated SEQ ID:2928.

Another function of VGAM217 is therefore inhibition of DKFZP434P211 (Accession NM_014549). Accordingly, utilities of VGAM217 include diagnosis, prevention and treatment of diseases and clinical conditions associated with DKFZP434P211. KIAA0354 (Accession NM_014872) is another VGAM217 host target gene. KIAA0354 BINDING SITE is HOST TARGET binding site found in the 3' untranslated region of mRNA encoded by KIAA0354, corresponding to a HOST TARGET binding site such as BINDING SITE I, BINDING SITE II or BINDING SITE III. Table 2 illustrates the complementarity of the nucleotide sequences of KIAA0354 BINDING SITE, designated SEQ ID:16998, to the nucleotide sequence of VGAM217 RNA, herein designated VGAM RNA, also designated SEQ ID:2928.

Another function of VGAM217 is therefore inhibition of KIAA0354 (Accession NM_014872). Accordingly, utilities of VGAM217 include diagnosis, prevention and treatment of diseases and clinical conditions associated with KIAA0354. KIAA0748 (Accession NM_014796) is another VGAM217 host target gene. KIAA0748 BINDING SITE is HOST TARGET binding site found in the 3' untranslated region of mRNA encoded by KIAA0748, corresponding to a HOST TARGET binding site such as BINDING SITE I, BINDING SITE II or BINDING SITE III. Table 2 illustrates the complementarity of the nucleotide sequences of KIAA0748 BINDING SITE, designated SEQ ID:16701, to the nucleotide sequence of VGAM217 RNA, herein designated VGAM RNA, also designated SEQ ID:2928.

Another function of VGAM217 is therefore inhibition of KIAA0748 (Accession NM_014796). Accordingly, utilities of VGAM217 include diagnosis, prevention and treatment of diseases and clinical conditions associated with KIAA0748. KIAA1056 (Accession NM_014894) is another VGAM217 host target gene. KIAA1056 BINDING SITE is HOST TARGET binding site found in the 3' untranslated region of mRNA encoded by KIAA1056, corresponding to a HOST TARGET binding site such as BINDING SITE I, BINDING SITE II or BINDING SITE III. Table 2 illustrates the complementarity of the nucleotide sequences of KIAA1056 BINDING SITE, designated SEQ ID:17043, to the nucleotide sequence of VGAM217 RNA, herein designated VGAM RNA, also designated SEQ ID:2928.

Another function of VGAM217 is therefore inhibition of KIAA1056 (Accession NM_014894). Accordingly, utilities of VGAM217 include diagnosis, prevention and treatment of diseases and clinical conditions associated with KIAA1056. KIAA1505 (Accession XM_168469) is another VGAM217 host target gene. KIAA1505 BINDING SITE is HOST TARGET binding site found in the 5' untranslated region of mRNA encoded by KIAA1505, corresponding to a HOST TARGET binding site such as BINDING SITE I, BINDING SITE II or BINDING SITE III. Table 2 illustrates the complementarity of the nucleotide sequences of KIAA1505 BINDING SITE, designated SEQ ID:45192, to the nucleotide sequence of VGAM217 RNA, herein designated VGAM RNA, also designated SEQ ID:2928.

Another function of VGAM217 is therefore inhibition of KIAA1505 (Accession XM_168469). Accordingly, utilities of VGAM217 include diagnosis, prevention and treatment of diseases and clinical conditions associated with KIAA1505. Phosphatidylserine Synthase 2 (PTDSS2, Accession NM_030783) is another VGAM217 host target gene. PTDSS2 BINDING SITE is HOST TARGET binding site found in the 3' untranslated region of mRNA encoded by PTDSS2, corresponding to a HOST TARGET binding site such as BINDING SITE I, BINDING SITE II or BINDING SITE III. Table 2 illustrates the complementarity of the nucleotide sequences of PTDSS2 BINDING SITE, designated SEQ ID:25074, to the nucleotide sequence of VGAM217 RNA, herein designated VGAM RNA, also designated SEQ ID:2928.

Another function of VGAM217 is therefore inhibition of Phosphatidylserine Synthase 2 (PTDSS2, Accession NM_030783). Accordingly, utilities of VGAM217 include diagnosis, prevention and treatment of diseases and clinical conditions associated with PTDSS2. RAB6C, Member RAS Oncogene Family (RAB6C, Accession NM_032144) is another VGAM217 host target gene. RAB6C BINDING SITE is HOST TARGET binding site found in the 3' untranslated region of mRNA encoded by RAB6C, corresponding to a HOST TARGET binding site such as BINDING SITE I, BINDING SITE II or BINDING SITE III. Table 2 illustrates the complementarity of the nucleotide sequences of RAB6C BINDING SITE, designated SEQ ID:25833, to the nucleotide sequence of VGAM217 RNA, herein designated VGAM RNA, also designated SEQ ID:2928.

Another function of VGAM217 is therefore inhibition of RAB6C, Member RAS Oncogene Family (RAB6C, Accession NM_032144). Accordingly, utilities of VGAM217 include diagnosis, prevention and treatment of diseases and clinical conditions associated with RAB6C. Ras Association (RalGDS/AF-6) Domain Family 2 (RASSF2, Accession NM_014737) is another VGAM217 host target gene. RASSF2 BINDING SITE is HOST TARGET binding site found in the 3' untranslated region of mRNA encoded by RASSF2, corresponding to a HOST TARGET binding site such as BINDING SITE I, BINDING SITE II or BINDING SITE III. Table 2 illustrates the complementarity of the nucleotide sequences of RASSF2 BINDING SITE, designated SEQ ID:16392, to the nucleotide sequence of VGAM217 RNA, herein designated VGAM RNA, also designated SEQ ID:2928.

Another function of VGAM217 is therefore inhibition of Ras Association (RalGDS/AF-6) Domain Family 2 (RASSF2, Accession NM_014737). Accordingly, utilities of VGAM217 include diagnosis, prevention and treatment of diseases and clinical conditions associated with RASSF2. Syntaphilin (SNPH, Accession NM_014723) is another VGAM217 host target gene. SNPH BINDING SITE is HOST TARGET binding site found in the 3' untranslated region of mRNA encoded by SNPH, corresponding to a HOST TARGET binding site such as BINDING SITE I, BINDING SITE II or BINDING SITE III. Table 2 illustrates the complementarity of the nucleotide sequences of SNPH BINDING SITE, designated SEQ ID:16290, to the nucleotide sequence of VGAM217 RNA, herein designated VGAM RNA, also designated SEQ ID:2928.

Another function of VGAM217 is therefore inhibition of Syntaphilin (SNPH, Accession NM_014723). Accordingly, utilities of VGAM217 include diagnosis, prevention and treatment of diseases and clinical conditions associated with SNPH. Tankyrase, TRF1-interacting Ankyrin-related ADP-ribose Polymerase 2 (TNKS2, Accession NM_025235) is another VGAM217 host target gene. TNKS2 BINDING SITE is HOST TARGET binding site found in the 3' untranslated region of mRNA encoded by TNKS2, corresponding to a HOST TARGET binding site such as BINDING SITE I, BINDING SITE II or BINDING SITE III. Table 2 illustrates the complementarity of the nucleotide sequences of TNKS2 BINDING SITE, designated SEQ ID:24911, to the nucleotide sequence of VGAM217 RNA, herein designated VGAM RNA, also designated SEQ ID:2928.

Another function of VGAM217 is therefore inhibition of Tankyrase, TRF1-interacting Ankyrin-related ADP-ribose Polymerase 2 (TNKS2, Accession NM_025235). Accordingly, utilities of VGAM217 include diagnosis, prevention and treatment of diseases and clinical conditions associated with TNKS2. WIT-1 (Accession NM_015855) is another VGAM217 host target gene. WIT-1 BINDING SITE is HOST TARGET binding site found in the 5' untranslated region of mRNA encoded by WIT-1, corresponding to a HOST TARGET binding site such as BINDING SITE I, BINDING SITE II or BINDING SITE III. Table 2 illustrates the complementarity of the nucleotide sequences of WIT-1 BINDING SITE, designated SEQ ID:17987, to the nucleotide sequence of VGAM217 RNA, herein designated VGAM RNA, also designated SEQ ID:2928.

Another function of VGAM217 is therefore inhibition of WIT-1 (Accession NM_015855). Accordingly, utilities of VGAM217 include diagnosis, prevention and treatment of diseases and clinical conditions associated with WIT-1. YKT6 (Accession NM_006555) is another VGAM217 host target gene. YKT6 BINDING SITE is HOST TARGET binding site found in the 3' untranslated region of mRNA encoded by YKT6, corresponding to a HOST TARGET binding site such as BINDING SITE I, BINDING SITE II or BINDING SITE III. Table 2 illustrates the complementarity of the nucleotide sequences of YKT6 BINDING SITE, designated SEQ ID:13317, to the nucleotide sequence of VGAM217 RNA, herein designated VGAM RNA, also designated SEQ ID:2928.

Another function of VGAM217 is therefore inhibition of YKT6 (Accession NM_006555). Accordingly, utilities of VGAM217 include diagnosis, prevention and treatment of diseases and clinical conditions associated with YKT6. LOC150174 (Accession XM_086802) is another VGAM217 host target gene. LOC150174 BINDING SITE is HOST TARGET binding site found in the 3' untranslated region of mRNA encoded by LOC150174, corresponding to a HOST TARGET binding site such as BINDING SITE I, BINDING SITE II or BINDING SITE III. Table 2 illustrates the complementarity of the nucleotide sequences of LOC150174 BINDING SITE, designated SEQ ID:38871, to the nucleotide sequence of VGAM217 RNA, herein designated VGAM RNA, also designated SEQ ID:2928.

Another function of VGAM217 is therefore inhibition of LOC150174 (Accession XM_086802). Accordingly, utilities of VGAM217 include diagnosis, prevention and treatment of diseases and clinical conditions associated with LOC150174. LOC150213 (Accession XM_059324) is another VGAM217 host target gene. LOC150213 BINDING SITE is HOST TARGET binding site found in the 3' untranslated region of mRNA encoded by LOC150213, corresponding to a HOST TARGET binding site such as BINDING SITE I, BINDING SITE II or BINDING SITE III. Table 2 illustrates the complementarity of the nucleotide sequences of LOC150213 BINDING SITE, designated SEQ ID:36955, to the nucleotide sequence of VGAM217 RNA, herein designated VGAM RNA, also designated SEQ ID:2928.

Another function of VGAM217 is therefore inhibition of LOC150213 (Accession XM_059324). Accordingly, utilities of VGAM217 include diagnosis, prevention and treatment of diseases and clinical conditions associated with LOC150213. LOC150236 (Accession XM_086824) is another VGAM217 host target gene. LOC150236 BINDING SITE is HOST TARGET binding site found in the 3' untranslated region of mRNA encoded by LOC150236, corresponding to a HOST TARGET binding site such as BINDING SITE I, BINDING SITE II or BINDING SITE III. Table 2 illustrates the complementarity of the nucleotide sequences of LOC150236 BINDING SITE, designated SEQ ID:38904, to the nucleotide sequence of VGAM217 RNA, herein designated VGAM RNA, also designated SEQ ID:2928.

Another function of VGAM217 is therefore inhibition of LOC150236 (Accession XM_086824). Accordingly, utilities of VGAM217 include diagnosis, prevention and treatment of diseases and clinical conditions associated with LOC150236. LOC158450 (Accession XM_088580) is another VGAM217 host target gene. LOC158450 BINDING SITE is HOST TARGET binding site found in the 3' untranslated region of mRNA encoded by LOC158450, corresponding to a HOST TARGET binding site such as BINDING SITE I, BINDING SITE II or BINDING SITE III. Table 2 illustrates the complementarity of the nucleotide sequences of LOC158450 BIND- ING SITE, designated SEQ ID:39841, to the nucleotide sequence of VGAM217 RNA, herein designated VGAM RNA, also designated SEQ ID:2928.

Another function of VGAM217 is therefore inhibition of LOC158450 (Accession XM_088580). Accordingly, utilities of VGAM217 include diagnosis, prevention and treatment of diseases and clinical conditions associated with LOC158450. LOC158504 (Accession XM_088591) is another VGAM217 host target gene. LOC158504 BINDING SITE is HOST TARGET binding site found in the 3' untranslated region of mRNA encoded by LOC158504, corresponding to a HOST TARGET binding site such as BINDING SITE I, BINDING SITE II or BINDING SITE III. Table 2 illustrates the complementarity of the nucleotide sequences of LOC158504 BINDING SITE, designated SEQ ID:39852, to the nucleotide sequence of VGAM217 RNA, herein designated VGAM RNA, also designated SEQ ID:2928.

Another function of VGAM217 is therefore inhibition of LOC158504 (Accession XM_088591). Accordingly, utilities of VGAM217 include diagnosis, prevention and treatment of diseases and clinical conditions associated with LOC158504. LOC158677 (Accession XM_098976) is another VGAM217 host target gene. LOC158677 BINDING SITE is HOST TARGET binding site found in the 5' untranslated region of mRNA encoded by LOC158677, corresponding to a HOST TARGET binding site such as BINDING SITE I, BINDING SITE II or BINDING SITE III. Table 2 illustrates the complementarity of the nucleotide sequences of LOC158677 BINDING SITE, designated SEQ ID:42022, to the nucleotide sequence of VGAM217 RNA, herein designated VGAM RNA, also designated SEQ ID:2928.

Another function of VGAM217 is therefore inhibition of LOC158677 (Accession XM_098976). Accordingly, utilities of VGAM217 include diagnosis, prevention and treatment of diseases and clinical conditions associated with LOC158677. LOC219347 (Accession XM_167564) is another VGAM217 host target gene. LOC219347 BINDING SITE is HOST TARGET binding site found in the 3' untranslated region of mRNA encoded by LOC219347, corresponding to a HOST TARGET binding site such as BINDING SITE I, BINDING SITE II or BINDING SITE III. Table 2 illustrates the complementarity of the nucleotide sequences of LOC219347 BINDING SITE, designated SEQ ID:44676, to the nucleotide sequence of VGAM217 RNA, herein designated VGAM RNA, also designated SEQ ID:2928.

Another function of VGAM217 is therefore inhibition of LOC219347 (Accession XM_167564). Accordingly, utilities of VGAM217 include diagnosis, prevention and treatment of diseases and clinical conditions associated with LOC219347. LOC222962 (Accession XM_167291) is another VGAM217 host target gene. LOC222962 BINDING SITE is HOST TARGET binding site found in the 3' untranslated region of mRNA encoded by LOC222962, corresponding to a HOST TARGET binding site such as BINDING SITE I, BINDING SITE II or BINDING SITE III. Table 2 illustrates the complementarity of the nucleotide sequences of LOC222962 BINDING SITE, designated SEQ ID:44626, to the nucleotide sequence of VGAM217 RNA, herein designated VGAM RNA, also designated SEQ ID:2928.

Another function of VGAM217 is therefore inhibition of LOC222962 (Accession XM_167291). Accordingly, utilities of VGAM217 include diagnosis, prevention and treatment of diseases and clinical conditions associated with LOC222962. LOC245811 (Accession XM_168197) is another VGAM217 host target gene. LOC245811 BINDING SITE is HOST TARGET binding site found in the 5' untranslated region of mRNA encoded by LOC245811, corresponding to a HOST TARGET binding site such as BINDING SITE I, BINDING SITE II or BINDING SITE III. Table 2 illustrates the complementarity of the nucleotide sequences of LOC245811 BINDING SITE, designated SEQ ID:45071, to the nucleotide sequence of VGAM217 RNA, herein designated VGAM RNA, also designated SEQ ID:2928.

Another function of VGAM217 is therefore inhibition of LOC245811 (Accession XM_168197). Accordingly, utilities of VGAM217 include diagnosis, prevention and treatment of diseases and clinical conditions associated with LOC245811. LOC254826 (Accession XM_173188) is another VGAM217 host target gene. LOC254826 BINDING SITE is HOST TARGET binding site found in the 3' untranslated region of mRNA encoded by LOC254826, corresponding to a HOST TARGET binding site such as BINDING SITE I, BINDING SITE II or BINDING SITE III. Table 2 illustrates the complementarity of the nucleotide sequences of LOC254826 BINDING SITE, designated SEQ ID:46433, to the nucleotide sequence of VGAM217 RNA, herein designated VGAM RNA, also designated SEQ ID:2928.

Another function of VGAM217 is therefore inhibition of LOC254826 (Accession XM_173188). Accordingly, utilities of VGAM217 include diagnosis, prevention and treatment of diseases and clinical conditions associated with LOC254826. FIG. 1 further provides a conceptual description of a novel bioinformatically detected viral gene of the present invention, referred to here as Viral Genomic Address Messenger 218 (VGAM218) viral gene, which modulates expression of respective host target genes thereof, the function and utility of which host target genes is known in the art.

VGAM218 is a novel bioinformatically detected regulatory, non protein coding, viral micro RNA (miRNA) gene. The method by which VGAM218 was detected is described hereinabove with reference to FIGS. 1-8.

VGAM218 gene, herein designated VGAM GENE, is a viral gene contained in the genome of Bovine Leukemia Virus. VGAM218 host target gene, herein designated VGAM HOST TARGET GENE, is a human gene contained in the human genome.

VGAM218 gene encodes a VGAM218 precursor RNA, herein designated VGAM PRECURSOR RNA. Similar to other miRNA genes, and unlike most ordinary genes, VGAM218 precursor RNA does not encode a protein. A nucleotide sequence identical or highly similar to the nucleotide sequence of VGAM218 precursor RNA is designated SEQ ID:204, and is provided hereinbelow with reference to the sequence listing part. Nucleotide sequence SEQ ID:204 is located at position 6277 relative to the genome of Bovine Leukemia Virus.

VGAM218 precursor RNA folds onto itself, forming VGAM218 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM218 folded precursor RNA into VGAM218 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM218 RNA is designated SEQ ID:2929, and is provided hereinbelow with reference to the sequence listing part.

VGAM218 host target gene, herein designated VGAM HOST TARGET GENE, encodes a corresponding messenger RNA, VGAM218 host target RNA, herein designated VGAM HOST TARGET RNA. VGAM218 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM218 RNA, herein designated VGAM RNA, binds complementarily to one or more host target binding sites located in untranslated regions of VGAM218 host target RNA, herein designated VGAM HOST TARGET RNA. This complementary binding is due to the fact that the nucleotide sequence of VGAM218 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM218 RNA, herein designated VGAM RNA, may have a different number of host target binding sites in untranslated regions of a VGAM218 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM218 RNA, herein designated VGAM RNA, to host target binding sites on VGAM218 host target RNA, herein designated VGAM HOST TARGET RNA, such as BINDING SITE I, BINDING SITE II and BINDING SITE III, inhibits translation of VGAM218 host target RNA into VGAM218 host target protein, herein designated VGAM HOST TARGET PROTEIN. VGAM host target protein is therefore outlined by a broken line.

It is appreciated that VGAM218 host target gene, herein designated VGAM HOST TARGET GENE, in fact represents a plurality of VGAM218 host target genes. The mRNA of each one of this plurality of VGAM218 host target genes comprises one or more host target binding sites, each having a nucleotide sequence which is at least partly complementary to VGAM218 RNA, herein designated VGAM RNA, and which when bound by VGAM218 RNA causes inhibition of translation of respective one or more VGAM218 host target proteins.

It is further appreciated by one skilled in the art that the mode of translational inhibition illustrated by FIG. 1 with specific reference to translational inhibition exerted by VGAM218 gene, herein designated VGAM GENE, on one or more VGAM218 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM218 is inhibition of expression of host target genes, as part of a novel viral mechanism of attacking a host. Accordingly, utilities of VGAM218 include diagnosis, prevention and treatment of viral infection by Bovine Leukemia Virus. Specific functions, and accordingly utilities, of VGAM218 correlate with, and may be deduced from, the identity of the host target genes which VGAM218 binds and inhibits, and the function of these host target genes, as elaborated hereinbelow.

Nucleotide sequences of the VGAM218 precursor RNA, herein designated VGAM PRECURSOR RNA, and of the 'diced' VGAM218 RNA, herein designated VGAM RNA, and a schematic representation of the secondary folding of VGAM218 folded precursor RNA, herein designated VGAM FOLDED PRECURSOR RNA, of VGAM218 are further described hereinbelow with reference to Table 1.

Nucleotide sequences of host target binding sites, such as BINDING SITE-I, BINDING SITE-II and BINDING SITE-III of FIG. 1, found on VGAM218 host target RNA, and schematic representation of the complementarity of each of these host target binding sites to VGAM218 RNA, herein designated VGAM RNA, are described hereinbelow with reference to Table 2.

As mentioned hereinabove with reference to FIG. 1, a function of VGAM218 gene, herein designated VGAM is inhibition of expression of VGAM218 target genes. It is appreciated that specific functions, and accordingly utilities, of VGAM218 correlate with, and may be deduced from, the identity of the target genes which VGAM218 binds and inhibits, and the function of these target genes, as elaborated hereinbelow.

Dystrophin (muscular dystrophy, Duchenne and Becker types) (DMD, Accession NM_000109) is a VGAM218 host target gene. DMD BINDING SITE is HOST TARGET binding site found in the 5' untranslated region of mRNA encoded by DMD, corresponding to a HOST TARGET binding site such as BINDING SITE I, BINDING SITE II or BINDING SITE III. Table 2 illustrates the complementarity of the nucleotide sequences of DMD BINDING SITE, designated SEQ ID:5571, to the nucleotide sequence of VGAM218 RNA, herein designated VGAM RNA, also designated SEQ ID:2929.

A function of VGAM218 is therefore inhibition of Dystrophin (muscular dystrophy, Duchenne and Becker types) (DMD, Accession NM_000109), a gene which muscular dystrophy. Accordingly, utilities of VGAM218 include diagnosis, prevention and treatment of diseases and clinical conditions associated with DMD. The function of DMD has been established by previous studies. Roberts et al. (1992) described a general approach to the identification of the basic defect in the one-third of DMD patients who do not show a gross rearrangement of the dystrophin gene. The method involved nested amplification, chemical mismatched detection, and sequencing of reverse transcripts of trace amounts of dystrophin mRNA from peripheral blood lymphocytes. Analysis of the entire coding region (11 kb) in 7 patients resulted in detection of a sequence change in each case that was clearly sufficient to cause the disease. All the mutations were expected to cause premature translation termination, and the resulting phenotypes were thus equivalent to those caused by frameshifting deletions; see 300377.0003-300377.0009. Deletions and point mutations in the DMD gene cause either DMD or the milder Becker muscular dystrophy, depending on whether the translational reading frame is lost or maintained. De Angelis et al. (2002) reasoned that because internal in-frame deletions in the protein produce only mild myopathic symptoms, a partially corrected phenotype could be restored by preventing the inclusion of specific mutated exons in the mature dystrophin mRNA. Such control had previously been accomplished by the use of synthetic oligonucleotides. To circumvent the disadvantageous necessity for periodic administration of the synthetic oligonucleotides, De Angelis et al. (2002) produced several constructs able to express in vivo, in a stable fashion, large amounts of chimeric RNAs containing antisense sequences. They showed that antisense molecules against exon 51 splice junctions were able to direct skipping of that exon in the human DMD deletion 48-50 and to rescue dystrophin synthesis. They also showed that the highest skipping activity occurred when antisense constructs against the 5-prime and 3-prime splice sites were coexpressed in the same cell. The effects were tested in cultured myoblasts from a DMD patient. The deletion of exons 48-50 resulted in a premature termination codon in exon 51. The antisense sequences complementary to exon 51 splice junctions induced efficient skipping of exon 51 and partial rescue of dystrophin synthesis. X-linked dilated cardiomyopathy is a dystrophinopathy characterized by severe cardiomyopathy with no skeletal muscle involvement. Several XLCM patients have been described with mutations that abolish dystrophin muscle isoform expression, but with increased expression of brain and cerebellar Purkinje isoforms of the gene exclusively in the skeletal muscle. Bastianutto et al. (2001) determined that 2 XLCM patients bore deletions that removed the muscle promoter and exon 1, but not the brain and cerebellar Purkinje promoters. The brain and cerebellar Purkinje promoters were found to be essentially inactive in muscle cell lines and primary cultures. Since dystrophin muscle enhancer 1 (DME1), a muscle-specific enhancer, is preserved in these patients, the authors tested its ability to upregulate the brain and cerebellar Purkinje promoters in muscle cells. Brain and cerebellar Purkinje promoter activity was significantly increased in the presence of DME1, and activation was observed exclusively in cells presenting a skeletal muscle phenotype versus cardiomyocytes. The authors suggested a role for DME1 in the induction of brain and cerebellar Purkinje isoform expression in the skeletal muscle of XLCM patients defective for muscle isoform expression. Animal model experiments lend further support to the function of DMD. Using DNA microarray, Porter et al. (2002) established a molecular signature of dystrophinopathy in the mdx mouse. In leg muscle, 242 differentially expressed genes were identified. Data provided evidence for coordinated activity of numerous components of a chronic inflammatory response, including cytokine and chemokine signaling, leukocyte adhesion and diapedesis, invasive cell type-specific markers, and complement system activation. Upregulation of secreted phosphoprotein 1 (SPP1; 166490) mRNA and protein in dystrophic muscle identified a novel linkage between inflammatory cells and repair processes. Extracellular matrix genes were upregulated in mdx to levels similar to those in DMD. Since, unlike DMD, mdx exhibits little fibrosis, data suggested that collagen regulation at post-transcriptional stages may mediate extensive fibrosis in DMD.

It is appreciated that the abovementioned animal model for DMD is acknowledged by those skilled in the art as a scientifically valid animal model, as can be further appreciated from the publications sited hereinbelow.

Full details of the abovementioned studies are described in the following publications, the disclosure of which are hereby incorporated by reference:

De Angelis, F. G.; Sthandier, O.; Berarducci, B.; Toso, S.; Galluzzi, G.; Ricci, E.; Cossu, G.; Bozzoni, I.: Chimeric snRNA molecules carrying antisense sequences against the splice junctions of exon 51 of the dystrophin pre-mRNA induce exon skipping and restoration of a dystrophin synthesis in delta-48-50 DMD cells. Proc Nat. Acad. Sci. 99:9456-9461, 2002; and Bastianutto, C.; Bestard, J. A.; Lahnakoski, K.; Broere, D.; De Visser, M.; Zaccolo, M.; Pozzan, T.; Ferlini, A.; Muntoni, F.; Patarnello, T.; Klamut, H. J.: Dystrophin muscle enhance.

Further studies establishing the function and utilities of DMD are found in John Hopkins OMIM database record ID 300377, and in sited publications numbered 7833-7838, 7840, 7841-7848, 7274, 7275, 7849-7854, 4629, 7318-7323, 7276, 7324-7329, 7334-7333, 7335-7339, 7344, 7341-7343, 7277, 7351, 7353, 7354-7363, 7049, 7364-7372, 7376-7375, 7377-7378, 2930-984, 7050-7051, 98 and 988 listed in the bibliography section hereinbelow, which are also hereby incorporated by reference. LAG1 Longevity Assurance Homolog 2 (S. cerevisiae) (LASS2, Accession XM_041889) is another VGAM218 host target gene. LASS2 BINDING SITE is HOST TARGET binding site found in the 3' untranslated region of mRNA encoded by LASS2, corresponding to a HOST TARGET binding site such as BINDING SITE I, BINDING SITE II or BINDING SITE III. Table 2 illustrates the complementarity of the nucleotide sequences of LASS2 BINDING SITE, designated SEQ ID:33622, to the nucleotide sequence of VGAM218 RNA, herein designated VGAM RNA, also designated SEQ ID:2929.

Another function of VGAM218 is therefore inhibition of LAG1 Longevity Assurance Homolog 2 (S. cerevisiae) (LASS2, Accession XM_041889). Accordingly, utilities of VGAM218 include diagnosis, prevention and treatment of diseases and clinical conditions associated with LASS2. FIG. 1 further provides a conceptual description of a novel bioinformatically detected viral gene of the present invention, referred to here as Viral Genomic Address Messenger 219 (VGAM219) viral gene, which modulates expression of respective host target genes thereof, the function and utility of which host target genes is known in the art.

VGAM219 is a novel bioinformatically detected regulatory, non protein coding, viral micro RNA (miRNA) gene. The method by which VGAM219 was detected is described hereinabove with reference to FIGS. 1-8.

VGAM219 gene, herein designated VGAM GENE, is a viral gene contained in the genome of Bovine Leukemia Virus. VGAM219 host target gene, herein designated VGAM HOST TARGET GENE, is a human gene contained in the human genome.

VGAM219 gene encodes a VGAM219 precursor RNA, herein designated VGAM PRECURSOR RNA. Similar to other miRNA genes, and unlike most ordinary genes, VGAM219 precursor RNA does not encode a protein. A nucleotide sequence identical or highly similar to the nucleotide sequence of VGAM219 precursor RNA is designated SEQ ID:205, and is provided hereinbelow with reference to the sequence listing part. Nucleotide sequence SEQ ID:205 is located at position 6411 relative to the genome of Bovine Leukemia Virus.

VGAM219 precursor RNA folds onto itself, forming VGAM219 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM219 folded precursor RNA into VGAM219

RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM219 RNA is designated SEQ ID:2930, and is provided hereinbelow with reference to the sequence listing part.

VGAM219 host target gene, herein designated VGAM HOST TARGET GENE, encodes a corresponding messenger RNA, VGAM219 host target RNA, herein designated VGAM HOST TARGET RNA. VGAM219 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM219 RNA, herein designated VGAM RNA, binds complementarily to one or more host target binding sites located in untranslated regions of VGAM219 host target RNA, herein designated VGAM HOST TARGET RNA. This complementary binding is due to the fact that the nucleotide sequence of VGAM219 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM219 RNA, herein designated VGAM RNA, may have a different number of host target binding sites in untranslated regions of a VGAM219 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM219 RNA, herein designated VGAM RNA, to host target binding sites on VGAM219 host target RNA, herein designated VGAM HOST TARGET RNA, such as BINDING SITE I, BINDING SITE II and BINDING SITE III, inhibits translation of VGAM219 host target RNA into VGAM219 host target protein, herein designated VGAM HOST TARGET PROTEIN. VGAM host target protein is therefore outlined by a broken line.

It is appreciated that VGAM219 host target gene, herein designated VGAM HOST TARGET GENE, in fact represents a plurality of VGAM219 host target genes. The mRNA of each one of this plurality of VGAM219 host target genes comprises one or more host target binding sites, each having a nucleotide sequence which is at least partly complementary to VGAM219 RNA, herein designated VGAM RNA, and which when bound by VGAM219 RNA causes inhibition of translation of respective one or more VGAM219 host target proteins.

It is further appreciated by one skilled in the art that the mode of translational inhibition illustrated by FIG. 1 with specific reference to translational inhibition exerted by VGAM219 gene, herein designated VGAM GENE, on one or more VGAM219 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM219 is inhibition of expression of host target genes, as part of a novel viral mechanism of attacking a host. Accordingly, utilities of VGAM219 include diagnosis, prevention and treatment of viral infection by Bovine Leukemia Virus. Specific functions, and accordingly utilities, of VGAM219 correlate with, and may be deduced from, the identity of the host target genes which VGAM219 binds and inhibits, and the function of these host target genes, as elaborated hereinbelow.

Nucleotide sequences of the VGAM219 precursor RNA, herein designated VGAM PRECURSOR RNA, and of the 'diced' VGAM219 RNA, herein designated VGAM RNA, and a schematic representation of the secondary folding of VGAM219 folded precursor RNA, herein designated VGAM FOLDED PRECURSOR RNA, of VGAM219 are further described hereinbelow with reference to Table 1.

Nucleotide sequences of host target binding sites, such as BINDING SITE-I, BINDING SITE-II and BINDING SITE-III of FIG. 1, found on VGAM219 host target RNA, and schematic representation of the complementarity of each of these host target binding sites to VGAM219 RNA, herein designated VGAM RNA, are described hereinbelow with reference to Table 2.

As mentioned hereinabove with reference to FIG. 1, a function of VGAM219 gene, herein designated VGAM is inhibition of expression of VGAM219 target genes. It is appreciated that specific functions, and accordingly utilities, of VGAM219 correlate with, and may be deduced from, the identity of the target genes which VGAM219 binds and inhibits, and the function of these target genes, as elaborated hereinbelow.

FLJ14525 (Accession NM_032800) is a VGAM219 host target gene. FLJ14525 BINDING SITE is HOST TARGET binding site found in the 3' untranslated region of mRNA encoded by FLJ14525, corresponding to a HOST TARGET binding site such as BINDING SITE I, BINDING SITE II or BINDING SITE III. Table 2 illustrates the complementarity of the nucleotide sequences of FLJ14525 BINDING SITE, designated SEQ ID:26547, to the nucleotide sequence of VGAM219 RNA, herein designated VGAM RNA, also designated SEQ ID:2930.

A function of VGAM219 is therefore inhibition of FLJ14525 (Accession NM_032800). Accordingly, utilities of VGAM219 include diagnosis, prevention and treatment of diseases and clinical conditions associated with FLJ14525. KIAA1280 (Accession XM_045766) is another VGAM219 host target gene. KIAA1280 BINDING SITE is HOST TARGET binding site found in the 5' untranslated region of mRNA encoded by KIAA1280, corresponding to a HOST TARGET binding site such as BINDING SITE I, BINDING SITE II or BINDING SITE III. Table 2 illustrates the complementarity of the nucleotide sequences of KIAA1280 BINDING SITE, designated SEQ ID:34547, to the nucleotide sequence of VGAM219 RNA, herein designated VGAM RNA, also designated SEQ ID:2930.

Another function of VGAM219 is therefore inhibition of KIAA1280 (Accession XM_045766). Accordingly, utilities of VGAM219 include diagnosis, prevention and treatment of diseases and clinical conditions associated with KIAA1280. Vesicular Inhibitory Amino Acid Transporter (VIAAT, Accession NM_080552) is another VGAM219 host target gene. VIAAT BINDING SITE is HOST TARGET binding site found in the 3' untranslated region of mRNA encoded by VIAAT, corresponding to a HOST TARGET binding site such as BINDING SITE I, BINDING SITE II or BINDING SITE III. Table 2 illustrates the complementarity of the nucleotide sequences of VIAAT BINDING SITE, designated SEQ ID:27883, to the nucleotide sequence of VGAM219 RNA, herein designated VGAM RNA, also designated SEQ ID:2930.

Another function of VGAM219 is therefore inhibition of Vesicular Inhibitory Amino Acid Transporter (VIAAT, Accession NM_080552). Accordingly, utilities of VGAM219 include diagnosis, prevention and treatment of diseases and clinical conditions associated with VIAAT. LOC197201 (Accession XM_113839) is another VGAM219 host target gene. LOC197201 BINDING SITE is HOST TARGET binding site found in the 3' untranslated region of mRNA encoded by LOC197201, corresponding to a HOST TARGET binding site such as BINDING SITE I, BINDING SITE II or BINDING SITE III. Table 2 illustrates the complementarity of the nucleotide sequences of LOC197201 BINDING SITE, designated SEQ ID:42461, to the nucleotide sequence of VGAM219 RNA, herein designated VGAM RNA, also designated SEQ ID:2930.

Another function of VGAM219 is therefore inhibition of LOC197201 (Accession XM_113839). Accordingly, utilities of VGAM219 include diagnosis, prevention and treatment of diseases and clinical conditions associated with LOC197201. LOC221895 (Accession XM_166511) is another VGAM219 host target gene. LOC221895 BINDING SITE is HOST TARGET binding site found in the 3' untranslated region of mRNA encoded by LOC221895, corresponding to a HOST TARGET binding site such as BINDING SITE I, BINDING SITE II or BINDING SITE III. Table 2 illustrates the complementarity of the nucleotide sequences of LOC221895 BINDING SITE, designated SEQ ID:44444, to the nucleotide sequence of VGAM219 RNA, herein designated VGAM RNA, also designated SEQ ID:2930.

Another function of VGAM219 is therefore inhibition of LOC221895 (Accession XM_166511). Accordingly, utilities of VGAM219 include diagnosis, prevention and treatment of diseases and clinical conditions associated with LOC221895. FIG. 1 further provides a conceptual description of a novel bioinformatically detected viral gene of the present invention, referred to here as Viral Genomic Address Messenger 220 (VGAM220) viral gene, which modulates expression of respective host target genes thereof, the function and utility of which host target genes is known in the art.

VGAM220 is a novel bioinformatically detected regulatory, non protein coding, viral micro RNA (miRNA) gene. The method by which VGAM220 was detected is described hereinabove with reference to FIGS. 1-8.

VGAM220 gene, herein designated VGAM GENE, is a viral gene contained in the genome of Callitrichine Herpesvirus 3. VGAM220 host target gene, herein designated VGAM HOST TARGET GENE, is a human gene contained in the human genome.

VGAM220 gene encodes a VGAM220 precursor RNA, herein designated VGAM PRECURSOR RNA. Similar to other miRNA genes, and unlike most ordinary genes, VGAM220 precursor RNA does not encode a protein. A nucleotide sequence identical or highly similar to the nucleotide sequence of VGAM220 precursor RNA is designated SEQ ID:206, and is provided hereinbelow with reference to the sequence listing part. Nucleotide sequence SEQ ID:206 is located at position 16550 relative to the genome of Callitrichine Herpesvirus 3.

VGAM220 precursor RNA folds onto itself, forming VGAM220 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM220 folded precursor RNA into VGAM220 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM220 RNA is designated SEQ ID:2931, and is provided hereinbelow with reference to the sequence listing part.

VGAM220 host target gene, herein designated VGAM HOST TARGET GENE, encodes a corresponding messenger RNA, VGAM220 host target RNA, herein designated VGAM HOST TARGET RNA. VGAM220 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM220 RNA, herein designated VGAM RNA, binds complementarily to one or more host target binding sites located in untranslated regions of VGAM220 host target RNA, herein designated VGAM HOST TARGET RNA. This complementary binding is due to the fact that the nucleotide sequence of VGAM220 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM220 RNA, herein designated VGAM RNA, may have a different number of host target binding sites in untranslated regions of a VGAM220 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM220 RNA, herein designated VGAM RNA, to host target binding sites on VGAM220 host target RNA, herein designated VGAM HOST TARGET RNA, such as BINDING SITE I, BINDING SITE II and BINDING SITE III, inhibits translation of VGAM220 host target RNA into VGAM220 host target protein, herein designated VGAM HOST TARGET PROTEIN. VGAM host target protein is therefore outlined by a broken line.

It is appreciated that VGAM220 host target gene, herein designated VGAM HOST TARGET GENE, in fact represents a plurality of VGAM220 host target genes. The mRNA of each one of this plurality of VGAM220 host target genes comprises one or more host target binding sites, each having a nucleotide sequence which is at least partly complementary to VGAM220 RNA, herein designated VGAM RNA, and which when bound by VGAM220 RNA causes inhibition of translation of respective one or more VGAM220 host target proteins.

It is further appreciated by one skilled in the art that the mode of translational inhibition illustrated by FIG. 1 with specific reference to translational inhibition exerted by VGAM220 gene, herein designated VGAM GENE, on one or more VGAM220 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM220 is inhibition of expression of host target genes, as part of a novel viral mechanism of attacking a host. Accordingly, utilities of VGAM220 include diagnosis, prevention and treatment of viral infection by Callitrichine Herpesvirus 3. Specific functions, and accordingly utilities, of VGAM220 correlate with, and may be deduced from, the identity of the host target genes which VGAM220 binds and inhibits, and the function of these host target genes, as elaborated hereinbelow.

Nucleotide sequences of the VGAM220 precursor RNA, herein designated VGAM PRECURSOR RNA, and of the 'diced' VGAM220 RNA, herein designated VGAM RNA, and a schematic representation of the secondary folding of VGAM220 folded precursor RNA, herein designated VGAM FOLDED PRECURSOR RNA, of VGAM220 are further described hereinbelow with reference to Table 1.

Nucleotide sequences of host target binding sites, such as BINDING SITE-I, BINDING SITE-II and BINDING SITE-III of FIG. 1, found on VGAM220 host target RNA, and schematic representation of the complementarity of each of these host target binding sites to VGAM220 RNA, herein designated VGAM RNA, are described hereinbelow with reference to Table 2.

As mentioned hereinabove with reference to FIG. 1, a function of VGAM220 gene, herein designated VGAM is inhibition of expression of VGAM220 target genes. It is appreciated that specific functions, and accordingly utilities, of VGAM220 correlate with, and may be deduced from, the identity of the target genes which VGAM220 binds and inhibits, and the function of these target genes, as elaborated hereinbelow.

B-cell CLL/lymphoma 7A (BCL7A, Accession NM_020993) is a VGAM220 host target gene. BCL7A BINDING SITE is HOST TARGET binding site found in the 5' untranslated region of mRNA encoded by BCL7A, corresponding to a HOST TARGET binding site such as BINDING SITE I, BINDING SITE II or BINDING SITE III. Table 2 illustrates the complementarity of the nucleotide sequences of BCL7A BINDING SITE, designated SEQ ID:21989, to the nucleotide sequence of VGAM220 RNA, herein designated VGAM RNA, also designated SEQ ID:2931.

A function of VGAM220 is therefore inhibition of B-cell CLL/lymphoma 7A (BCL7A, Accession NM_020993). Accordingly, utilities of VGAM220 include diagnosis, prevention and treatment of diseases and clinical conditions associated with BCL7A. Cyclin D1 (PRAD1: parathyroid adenomatosis 1) (CCND1, Accession NM_053056) is another VGAM220 host target gene. CCND1 BINDING SITE is HOST TARGET binding site found in the 3' untranslated region of mRNA encoded by CCND1, corresponding to a HOST TARGET binding site such as BINDING SITE I, BINDING SITE II or BINDING SITE III. Table 2 illustrates the complementarity of the nucleotide sequences of CCND1 BINDING SITE, designated SEQ ID:27598, to the nucleotide sequence of VGAM220 RNA, herein designated VGAM RNA, also designated SEQ ID:2931.

Another function of VGAM220 is therefore inhibition of Cyclin D1 (PRAD1: parathyroid adenomatosis 1) (CCND1, Accession NM_053056), a gene which is involved in the control of cell cycle and is required for Schwann cell proliferation to proceed normally during Wallerian degeneration. Accordingly, utilities of VGAM220 include diagnosis, prevention and treatment of diseases and clinical conditions associated with CCND1. The function of CCND1 has been established by previous studies. Tsujimoto et al. (1984) cloned the chromosomal breakpoint of chronic lymphocytic leukemia (CLL; OMIM Ref. No. 151400) cells of the B-cell type carrying t (11;14)(q13; q32). The breakpoint was in the joining segment of the heavy chain locus on chromosome 14. A probe that is specific for chromosome 11 and maps immediately 5-prime to the breakpoint on 14q+ was isolated. The probe detected a rearrangement of the homologous genomic DNA segment in CLL cells and in DNA from a diffuse large cell lymphoma with the t (11;14) translocation. This rearranged DNA segment was not present in Burkitt lymphoma cells with the t (8;14) translocation or in nonneoplastic human lymphoblastoid cells. The probe thus can be used to identify and characterize a gene located on 11q13 involved in the malignant transformation of B cells in the t (11;14) translocation. Tsujimoto et al. (1984) referred to this gene as BCL1. In 2 different cases of B-cell chronic lymphatic leukemia, Tsujimoto et al. (1985) found that the breakpoints on chromosome 11 were within 8 nucleotides of each other and on chromosome 14 involved the J4 DNA segment of the Ig heavy chain segment. Because they detected a 7mer-9mer signallike sequence with a 12-base-long spacer on the normal chromosome 11, close to the breakpoint, they speculated that the t (11;14) chromosome translocation in CLL may be sequence specific and may involve the recombination system for immunoglobulin V-D-J gene segment joining. Animal model experiments lend further support to the function of CCND1. Ma et al. (1998) studied cyclin D1-deficient mice, which have small eyes with thin retinas, and observed that there was a lower level of retinal cell proliferation and a unique pattern of photoreceptor cell death. Death was first observed in scattered clusters of cells in the retina. It then appeared to spread from these few cells to nearby photoreceptors, eventually producing extensive holes in the photoreceptor layer. These holes appeared to be filled with interneurons from the inner nuclear layer. The death occurred mainly during the second to fourth postnatal weeks. Other models of photoreceptor degeneration in rodents differed in that they occur more uniformly across the retina, with death proceeding over a longer period of time until all, or nearly all, of the photoreceptors degenerate. Ma et al. (1998) found that expression of a bcl2 transgene could not prevent the death.

It is appreciated that the abovementioned animal model for CCND1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ma, C.; Papermaster, D.; Cepko, C. L.: A unique pattern of photoreceptor degeneration in cyclin D1 mutant mice. Proc. Nat. Acad. Sci. 95:9938-9943, 1998; and Tsujimoto, Y.; Yunis, J.; Onorato-Showe, L.; Erikson, J.; Nowell, P. C.; Croce, C. M.: Molecular cloning of the chromosomal breakpoint of B-cell lymphomas and leukemias with the t (11;1.

Further studies establishing the function and utilities of CCND1 are found in John Hopkins OMIM database record ID 168461, and in sited publications numbered 2389, 4458, 5452-5453, 11374, 5455-5456, 5468-4344, 5470-5479, 11078-5481, 5614, 11079-1108 and 5615-5618 listed in the bibliography section hereinbelow, which are also hereby incorporated by reference. Chediak-Higashi Syndrome 1 (CHS1, Accession NM_000081) is another VGAM220 host target gene. CHS1 BINDING SITE is HOST TARGET binding site found in the 3' untranslated region of mRNA encoded by CHS1, corresponding to a HOST TARGET binding site such as BINDING SITE I, BINDING SITE II or BINDING SITE III. Table 2 illustrates the complementarity of the nucleotide sequences of CHS1 BINDING SITE, designated SEQ ID:5524, to the nucleotide sequence of VGAM220 RNA, herein designated VGAM RNA, also designated SEQ ID:2931.

Another function of VGAM220 is therefore inhibition of Chediak-Higashi Syndrome 1 (CHS1, Accession NM_000081), a gene which may sort endosomal resident proteins into late multivesicular endosome. Accordingly, utilities of VGAM220 include diagnosis, prevention and treatment of diseases and clinical conditions associated with CHS1. The function of CHS1 and its association with various diseases and clinical conditions, has been established by previous studies, as described hereinabove with reference to VGAM191. Eukaryotic Translation Initiation Factor 2B, Subunit 1 Alpha, 26 kDa (EIF2B1, Accession XM_006566) is another VGAM220 host target gene. EIF2B1 BINDING SITE is HOST TARGET binding site found in the 3' untranslated region of mRNA encoded by EIF2B1, corresponding to a HOST TARGET binding site such as BINDING SITE I, BINDING SITE II or BINDING SITE III. Table 2 illustrates the complementarity of the nucleotide sequences of EIF2B1 BINDING SITE, designated SEQ ID:30004, to the nucleotide sequence of VGAM220 RNA, herein designated VGAM RNA, also designated SEQ ID:2931.

Another function of VGAM220 is therefore inhibition of Eukaryotic Translation Initiation Factor 2B, Subunit 1 Alpha, 26 kDa (EIF2B1, Accession XM_006566). Accordingly, utilities of VGAM220 include diagnosis, prevention and treatment of diseases and clinical conditions associated with EIF2B1. Molybdenum Cofactor Synthesis 2 (MOCS2, Accession NM_004531) is another VGAM220 host target gene. MOCS2 BINDING SITE is HOST TARGET binding site found in the 5' untranslated region of mRNA encoded by MOCS2, corresponding to a HOST TARGET binding site such as BINDING SITE I, BINDING SITE II or BINDING SITE III. Table 2 illustrates the complementarity of the nucleotide sequences of MOCS2 BINDING SITE, designated SEQ ID:10873, to the nucleotide sequence of VGAM220 RNA, herein designated VGAM RNA, also designated SEQ ID:2931.

Another function of VGAM220 is therefore inhibition of Molybdenum Cofactor Synthesis 2 (MOCS2, Accession NM_004531). Accordingly, utilities of VGAM220 include diagnosis, prevention and treatment of diseases and clinical conditions associated with MOCS2. Mature T-cell Proliferation 1 (MTCP1, Accession NM_014221) is another VGAM220 host target gene. MTCP1 BINDING SITE is HOST TARGET binding site found in the 5' untranslated region of mRNA encoded by MTCP1, corresponding to a HOST TARGET binding site such as BINDING SITE I, BINDING SITE II or BINDING SITE III. Table 2 illustrates the complementarity of the nucleotide sequences of MTCP1 BINDING SITE, designated SEQ ID:15483, to the nucleotide sequence of VGAM220 RNA, herein designated VGAM RNA, also designated SEQ ID:2931.

Another function of VGAM220 is therefore inhibition of Mature T-cell Proliferation 1 (MTCP1, Accession NM_014221). Accordingly, utilities of VGAM220 include diagnosis, prevention and treatment of diseases and clinical conditions associated with MTCP1. N4BP2 (Accession NM_018177) is another VGAM220 host target gene. N4BP2 BINDING SITE is HOST TARGET binding site found in the 5' untranslated region of mRNA encoded by N4BP2, corresponding to a HOST TARGET binding site such as BINDING SITE I, BINDING SITE II or BINDING SITE III. Table 2 illustrates the complementarity of the nucleotide sequences of N4BP2 BINDING SITE, designated SEQ ID:20003, to the nucleotide sequence of VGAM220 RNA, herein designated VGAM RNA, also designated SEQ ID:2931.

Another function of VGAM220 is therefore inhibition of N4BP2 (Accession NM_018177). Accordingly, utilities of VGAM220 include diagnosis, prevention and treatment of diseases and clinical conditions associated with N4BP2. RALGPS1A (Accession NM_014636) is another VGAM220 host target gene. RALGPS1A BINDING SITE is HOST TARGET binding site found in the 3' untranslated region of mRNA encoded by RALGPS1A, corresponding to a HOST TARGET binding site such as BINDING SITE I, BINDING SITE II or BINDING SITE III. Table 2 illustrates the complementarity of the nucleotide sequences of RALGPS1A BINDING SITE, designated SEQ ID:16016, to the nucleotide sequence of VGAM220 RNA, herein designated VGAM RNA, also designated SEQ ID:2931.

Another function of VGAM220 is therefore inhibition of RALGPS1A (Accession NM_014636). Accordingly, utilities of VGAM220 include diagnosis, prevention and treatment of diseases and clinical conditions associated with RALGPS1A. LOC144348 (Accession XM_084826) is another VGAM220 host target gene. LOC144348 BINDING SITE is HOST TARGET binding site found in the 5' untranslated region of mRNA encoded by LOC144348, corresponding to a HOST TARGET binding site such as BINDING SITE I, BINDING SITE II or BINDING SITE III. Table 2 illustrates the complementarity of the nucleotide sequences of LOC144348 BINDING SITE, designated SEQ ID:37720, to the nucleotide sequence of VGAM220 RNA, herein designated VGAM RNA, also designated SEQ ID:2931.

Another function of VGAM220 is therefore inhibition of LOC144348 (Accession XM_084826). Accordingly, utilities of VGAM220 include diagnosis, prevention and treatment of diseases and clinical conditions associated with LOC144348. LOC196418 (Accession XM_113717) is another VGAM220 host target gene. LOC196418 BINDING SITE is HOST TARGET binding site found in the 5' untranslated region of mRNA encoded by LOC196418, corresponding to a HOST TARGET binding site such as BINDING SITE I, BINDING SITE II or BINDING SITE III. Table 2 illustrates the complementarity of the nucleotide sequences of LOC196418 BINDING SITE, designated SEQ ID:42368, to the nucleotide sequence of VGAM220 RNA, herein designated VGAM RNA, also designated SEQ ID:2931.

Another function of VGAM220 is therefore inhibition of LOC196418 (Accession XM_113717). Accordingly, utilities of VGAM220 include diagnosis, prevention and treatment of diseases and clinical conditions associated with LOC196418. FIG. 1 further provides a conceptual description of a novel bioinformatically detected viral gene of the present invention, referred to here as Viral Genomic Address Messenger 221 (VGAM221) viral gene, which modulates expression of respective host target genes thereof, the function and utility of which host target genes is known in the art.

VGAM221 is a novel bioinformatically detected regulatory, non protein coding, viral micro RNA (miRNA) gene. The method by which VGAM221 was detected is described hereinabove with reference to FIGS. 1-8.

VGAM221 gene, herein designated VGAM GENE, is a viral gene contained in the genome of Callitrichine Herpesvirus 3. VGAM221 host target gene, herein designated VGAM HOST TARGET GENE, is a human gene contained in the human genome.

VGAM221 gene encodes a VGAM221 precursor RNA, herein designated VGAM PRECURSOR RNA. Similar to other miRNA genes, and unlike most ordinary genes, VGAM221 precursor RNA does not encode a protein. A nucleotide sequence identical or highly similar to the nucleotide sequence of VGAM221 precursor RNA is designated SEQ ID:207, and is provided hereinbelow with reference to the sequence listing part. Nucleotide sequence SEQ ID:207 is located at position 46723 relative to the genome of Callitrichine Herpesvirus 3.

VGAM221 precursor RNA folds onto itself, forming VGAM221 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM221 folded precursor RNA into VGAM221 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM221 RNA is designated SEQ ID:2932, and is provided hereinbelow with reference to the sequence listing part.

VGAM221 host target gene, herein designated VGAM HOST TARGET GENE, encodes a corresponding messenger RNA, VGAM221 host target RNA, herein designated VGAM HOST TARGET RNA. VGAM221 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM221 RNA, herein designated VGAM RNA, binds complementarily to one or more host target binding sites located in untranslated regions of VGAM221 host target RNA, herein designated VGAM HOST TARGET RNA. This complementary binding is due to the fact that the nucleotide sequence of VGAM221 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM221 RNA, herein designated VGAM RNA, may have a different number of host target binding sites in untranslated regions of a VGAM221 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM221 RNA, herein designated VGAM RNA, to host target binding sites on VGAM221 host target RNA, herein designated VGAM HOST TARGET RNA, such as BINDING SITE I, BINDING SITE II and BINDING SITE III, inhibits translation of VGAM221 host target RNA into VGAM221 host target protein, herein designated VGAM HOST TARGET PROTEIN. VGAM host target protein is therefore outlined by a broken line.

It is appreciated that VGAM221 host target gene, herein designated VGAM HOST TARGET GENE, in fact represents a plurality of VGAM221 host target genes. The mRNA of each one of this plurality of VGAM221 host target genes comprises one or more host target binding sites, each having a nucleotide sequence which is at least partly complementary to VGAM221 RNA, herein designated VGAM RNA, and which when bound by VGAM221 RNA causes inhibition of translation of respective one or more VGAM221 host target proteins.

It is further appreciated by one skilled in the art that the mode of translational inhibition illustrated by FIG. 1 with specific reference to translational inhibition exerted by VGAM221 gene, herein designated VGAM GENE, on one or more VGAM221 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM221 is inhibition of expression of host target genes, as part of a novel viral mechanism of attacking a host. Accordingly, utilities of VGAM221 include diagnosis, prevention and treatment of viral infection by Callitrichine Herpesvirus 3. Specific functions, and accordingly utilities, of VGAM221 correlate with, and may be deduced from, the identity of the host target genes which VGAM221 binds and inhibits, and the function of these host target genes, as elaborated hereinbelow.

Nucleotide sequences of the VGAM221 precursor RNA, herein designated VGAM PRECURSOR RNA, and of the 'diced' VGAM221 RNA, herein designated VGAM RNA, and a schematic representation of the secondary folding of VGAM221 folded precursor RNA, herein designated VGAM FOLDED PRECURSOR RNA, of VGAM221 are further described hereinbelow with reference to Table 1.

Nucleotide sequences of host target binding sites, such as BINDING SITE-I, BINDING SITE-II and BINDING SITE-III of FIG. 1, found on VGAM221 host target RNA, and schematic representation of the complementarity of each of these host target binding sites to VGAM221 RNA, herein designated VGAM RNA, are described hereinbelow with reference to Table 2.

As mentioned hereinabove with reference to FIG. 1, a function of VGAM221 gene, herein designated VGAM is inhibition of expression of VGAM221 target genes. It is appreciated that specific functions, and accordingly utilities, of VGAM221 correlate with, and may be deduced from, the identity of the target genes which VGAM221 binds and inhibits, and the function of these target genes, as elaborated hereinbelow.

Breast Carcinoma Amplified Sequence 1 (BCAS1, Accession NM_003657) is a VGAM221 host target gene. BCAS1 BINDING SITE is HOST TARGET binding site found in the 3' untranslated region of mRNA encoded by BCAS1, corresponding to a HOST TARGET binding site such as BINDING SITE I, BINDING SITE II or BINDING SITE III. Table 2 illustrates the complementarity of the nucleotide sequences of BCAS1 BINDING SITE, designated SEQ ID:9730, to the nucleotide sequence of VGAM221 RNA, herein designated VGAM RNA, also designated SEQ ID:2932.

A function of VGAM221 is therefore inhibition of Breast Carcinoma Amplified Sequence 1 (BCAS1, Accession NM_003657). Accordingly, utilities of VGAM221 include diagnosis, prevention and treatment of diseases and clinical conditions associated with BCAS1. Cysteine Knot Superfamily 1, BMP Antagonist 1 (CKTSF1B1, Accession NM_013372) is another VGAM221 host target gene. CKTSF1B1 BINDING SITE is HOST TARGET binding site found in the 3' untranslated region of mRNA encoded by CKTSF1B1, corresponding to a HOST TARGET binding site such as BINDING SITE I, BINDING SITE II or BINDING SITE III. Table 2 illustrates the complementarity of the nucleotide sequences of CKTSF1B1 BINDING SITE, designated SEQ ID:15026, to the nucleotide sequence of VGAM221 RNA, herein designated VGAM RNA, also designated SEQ ID:2932.

Another function of VGAM221 is therefore inhibition of Cysteine Knot Superfamily 1, BMP Antagonist 1 (CKTSF1B1, Accession NM_013372), a gene which blocks signaling of bone morphogenetic protein (BMP). Accordingly, utilities of VGAM221 include diagnosis, prevention and treatment of diseases and clinical conditions associated with CKTSF1B1. The function of CKTSF1B1 and its association with various diseases and clinical conditions, has been established by previous studies, as described hereinabove with reference to VGAM28. CTP Synthase (CTPS, Accession XM_114141) is another VGAM221 host target gene. CTPS BINDING SITE is HOST TARGET binding site found in the 3' untranslated region of mRNA encoded by CTPS, corresponding to a HOST TARGET binding site such as BINDING SITE I, BINDING SITE II or BINDING SITE III. Table 2 illustrates the complementarity of the nucleotide sequences of CTPS BINDING SITE, designated SEQ ID:42714, to the nucleotide sequence of VGAM221 RNA, herein designated VGAM RNA, also designated SEQ ID:2932.

Another function of VGAM221 is therefore inhibition of CTP Synthase (CTPS, Accession XM_114141), a gene which is important in the biosynthesis of phospholipids and nucleic acids. Accordingly, utilities of VGAM221 include diagnosis, prevention and treatment of diseases and clinical conditions associated with CTPS. The function of CTPS has been established by previous studies. The catalytic conversion of UTP to CTP is accomplished by the enzyme cytidine-5-prime-triphosphate synthetase (UTP:L-glutamine amido ligase; EC 6.3.4.2). The enzyme is important in the biosynthesis of phospholipids and nucleic acids, and plays a key role in cell growth, development, and tumorigenesis. Thomas et al. (1989) isolated a cDNA clone of the CTP synthetase gene from a rat liver cDNA library. It is a key regulatory enzyme in pyrimidine biosynthesis. These authors have isolated both cDNA and genomic gene sequences from the rat and Chinese hamster. Yamauchi et al. (1990) cloned the CTPS gene and showed that the open reading frame encodes 591 amino acids that have a striking degree of similarity to the structural gene in E. coli Yamauchi et al. (1991) assigned the structural gene to 1p by study of a panel of human/rodent somatic cell hybrids and the CTPS cDNA. By a method of mapping that combines fluorescence in situ hybridization with replicated prometaphase R-bands (Takahashi et al., 1990), Takahashi et al. (1991) mapped the CTPS gene to 1p34.3-p34.1. By high-resolution banding analysis, they further narrowed the assignment to 1p34.1; see Yamauchi et al. (1991). The genomic sequence is distributed in 19 exons covering about 35 kb. Mutations eliminating the feedback regulation of CTPS result in multidrug resistance and mutator phenotype in Chinese hamster ovary (CHO) cells. The region to which the CTPS gene has been mapped is the location of breakpoints involved in several tumor types. Yamauchi et al. (1993) found that inactivating mutations clustered in a highly conserved region of the gene make it feasible to assess the role of such mutations in the development of drug resistance encountered in the treatment of malignant disease and not readily explained by altered expression of the multidrug resistance genes (e.g., 171050).

Full details of the abovementioned studies are described in the following publications, the disclosure of which are hereby incorporated by reference:

Yamauchi, M.; Yamauchi, N.; Phear, G.; Spurr, N. K.; Martinsson, T.; Weith, A.; Meuth, M.: Genomic organization and chromosomal localization of the human CTP synthetase gene (CTPS). Genomics 11:1088-1096, 1991; and Whelan, J.; Phear, G.; Yamauchi, M.; Meuth, M.: Clustered base substitutions in CTP synthetase conferring drug resistance in Chinese hamster ovary cells. Nature Genet. 3:317-322, 1993.

Further studies establishing the function and utilities of CTPS are found in John Hopkins OMIM database record ID 123860, and in sited publications numbered 12754-12759, and 3981 listed in the bibliography section hereinbelow, which are also hereby incorporated by reference. Epithelial Cell Transforming Sequence 2 Oncogene (ECT2, Accession NM_018098) is another VGAM221 host target gene. ECT2 BINDING SITE is HOST TARGET binding site found in the 3' untranslated region of mRNA encoded by ECT2, corresponding to a HOST TARGET binding site such as BINDING SITE I, BINDING SITE II or BINDING SITE III. Table 2 illustrates the complementarity of the nucleotide sequences of ECT2 BINDING SITE, designated SEQ ID:19871, to the nucleotide sequence of VGAM221 RNA, herein designated VGAM RNA, also designated SEQ ID:2932.

Another function of VGAM221 is therefore inhibition of Epithelial Cell Transforming Sequence 2 Oncogene (ECT2, Accession NM_018098), a gene which is a transforming protein that can interact with Rho-like proteins of the Ras superfamily. Accordingly, utilities of VGAM221 include diagnosis, prevention and treatment of diseases and clinical conditions associated with ECT2. The function of ECT2 has been established by previous studies. ECT2 is a transforming protein that can interact with Rho-like proteins of the Ras superfamily. First isolated in the mouse, the Ect2 gene acts as an oncogene. To investigate its involvement in human tumors, Takai et al. (1995) isolated the human homolog, ECT2, and by fluorescence in situ hybridization determined that the gene is located on 3q26.1-q26.2. Localization to chromosome 3 was confirmed by PCR analysis of human/hamster somatic cell hybrid DNAs. Takai et al. (1998) mapped the Ect2 gene to mouse chromosome band 3B by in situ hybridization. They commented that the EVI1 (OMIM Ref. No. 165215) and Fim3 genes (OMIM Ref. No. 136770) are also in mouse 3B and that the human counterparts of these genes are also linked to ECT2, indicating that this chromosome region is evolutionarily conserved between human and mouse.

Full details of the abovementioned studies are described in the following publications, the disclosure of which are hereby incorporated by reference:

Takai, S.; Long, J. E.; Yamada, K.; Miki, T.: Chromosomal localization of the human ECT2 proto-oncogene to 3q26.1-q26.2 by somatic cell analysis and fluorescence in situ hybridization. Genomics 27:220-222, 1995; and Takai, S.; Lorenzi, M. V.; Long, J. E.; Yamada, K.; Miki, T.: Assignment of the Ect2 proto-oncogene to mouse chromosome band 3B by in situ hybridization. Cytogenet. Cell Genet. 81:83-84.

Further studies establishing the function and utilities of ECT2 are found in John Hopkins OMIM database record ID 600586, and in sited publications numbered 10215-10216 listed in the bibliography section hereinbelow, which are also hereby incorporated by reference. Hematopoietic Protein 1 (HEM1, Accession NM_005337) is another VGAM221 host target gene. HEM1 BINDING SITE is HOST TARGET binding site found in the 5' untranslated region of mRNA encoded by HEM1, corresponding to a HOST TARGET binding site such as BINDING SITE I, BINDING SITE II or BINDING SITE III. Table 2 illustrates the complementarity of the nucleotide sequences of HEM1 BINDING SITE, designated SEQ ID:11808, to the nucleotide sequence of VGAM221 RNA, herein designated VGAM RNA, also designated SEQ ID:2932.

Another function of VGAM221 is therefore inhibition of Hematopoietic Protein 1 (HEM1, Accession NM_005337). Accordingly, utilities of VGAM221 include diagnosis, prevention and treatment of diseases and clinical conditions associated with HEM1. Transforming Growth Factor, Beta Receptor II (70/80 kDa) (TGFBR2, Accession NM_003242) is another VGAM221 host target gene. TGFBR2 BINDING SITE is HOST TARGET binding site found in the 3' untranslated region of mRNA encoded by TGFBR2, corresponding to a HOST TARGET binding site such as BINDING SITE I, BINDING SITE II or BINDING SITE III. Table 2 illustrates the complementarity of the nucleotide sequences of TGFBR2 BINDING SITE, designated SEQ ID:9244, to the nucleotide sequence of VGAM221 RNA, herein designated VGAM RNA, also designated SEQ ID:2932.

Another function of VGAM221 is therefore inhibition of Transforming Growth Factor, Beta Receptor II (70/80 kDa) (TGFBR2, Accession NM_003242). Accordingly, utilities of VGAM221 include diagnosis, prevention and treatment of diseases and clinical conditions associated with TGFBR2. DKFZP564D0478 (Accession NM_032125) is another VGAM221 host target gene. DKFZP564D0478 BINDING SITE is HOST TARGET binding site found in the 3' untranslated region of mRNA encoded by DKFZP564D0478, corresponding to a HOST TARGET binding site such as BINDING SITE I, BINDING SITE II or BINDING SITE III. Table 2 illustrates the complementarity of the nucleotide sequences of DKFZP564D0478 BINDING SITE, designated SEQ ID:25809, to the nucleotide sequence of VGAM221 RNA, herein designated VGAM RNA, also designated SEQ ID:2932.

Another function of VGAM221 is therefore inhibition of DKFZP564D0478 (Accession NM_032125). Accordingly, utilities of VGAM221 include diagnosis, prevention and treatment of diseases and clinical conditions associated with DKFZP564D0478. FLJ22169 (Accession NM_024085) is another VGAM221 host target gene. FLJ22169 BINDING SITE is HOST TARGET binding site found in the 3' untranslated region of mRNA encoded by FLJ22169, corresponding to a HOST TARGET binding site such as BINDING SITE I, BINDING SITE II or BINDING SITE III. Table 2 illustrates the complementarity of the nucleotide sequences of FLJ22169 BINDING SITE, designated SEQ ID:23519, to the nucleotide sequence of VGAM221 RNA, herein designated VGAM RNA, also designated SEQ ID:2932.

Another function of VGAM221 is therefore inhibition of FLJ22169 (Accession NM_024085). Accordingly, utilities of VGAM221 include diagnosis, prevention and treatment of diseases and clinical conditions associated with FLJ22169. KIAA0205 (Accession NM_014873) is another VGAM221 host target gene. KIAA0205 BINDING SITE is HOST TARGET binding site found in the 5' untranslated region of mRNA encoded by KIAA0205, corresponding to a HOST TARGET binding site such as BINDING SITE I, BINDING SITE II or BINDING SITE III. Table 2 illustrates the complementarity of the nucleotide sequences of KIAA0205 BINDING SITE, designated SEQ ID:17005, to the nucleotide sequence of VGAM221 RNA, herein designated VGAM RNA, also designated SEQ ID:2932.

Another function of VGAM221 is therefore inhibition of KIAA0205 (Accession NM_014873). Accordingly, utilities of VGAM221 include diagnosis, prevention and treatment of diseases and clinical conditions associated with KIAA0205. KIAA0685 (Accession NM_014678) is another VGAM221 host target gene. KIAA0685 BINDING SITE is HOST TARGET binding site found in the 5' untranslated region of mRNA encoded by KIAA0685, corresponding to a HOST TARGET binding site such as BINDING SITE I, BINDING SITE II or BINDING SITE III. Table 2 illustrates the complementarity of the nucleotide sequences of KIAA0685 BINDING SITE, designated SEQ ID:16149, to the nucleotide sequence of VGAM221 RNA, herein designated VGAM RNA, also designated SEQ ID:2932.

Another function of VGAM221 is therefore inhibition of KIAA0685 (Accession NM_014678). Accordingly, utilities of VGAM221 include diagnosis, prevention and treatment of diseases and clinical conditions associated with KIAA0685. LOC196283 (Accession XM_113684) is another VGAM221 host target gene. LOC196283 BINDING SITE is HOST TARGET binding site found in the 3' untranslated region of mRNA encoded by LOC196283, corresponding to a HOST TARGET binding site such as BINDING SITE I, BINDING SITE II or BINDING SITE III. Table 2 illustrates the complementarity of the nucleotide sequences of LOC196283 BINDING SITE, designated SEQ ID:42339, to the nucleotide sequence of VGAM221 RNA, herein designated VGAM RNA, also designated SEQ ID:2932.

Another function of VGAM221 is therefore inhibition of LOC196283 (Accession XM_113684). Accordingly, utilities of VGAM221 include diagnosis, prevention and treatment of diseases and clinical conditions associated with LOC196283. LOC203248 (Accession XM_114659) is another VGAM221 host target gene. LOC203248 BINDING SITE is HOST TARGET binding site found in the 3' untranslated region of mRNA encoded by LOC203248, corresponding to a HOST TARGET binding site such as BINDING SITE I, BINDING SITE II or BINDING SITE III. Table 2 illustrates the complementarity of the nucleotide sequences of LOC203248 BINDING SITE, designated SEQ ID:43017, to the nucleotide sequence of VGAM221 RNA, herein designated VGAM RNA, also designated SEQ ID:2932.

Another function of VGAM221 is therefore inhibition of LOC203248 (Accession XM_114659). Accordingly, utilities of VGAM221 include diagnosis, prevention and treatment of diseases and clinical conditions associated with LOC203248. LOC219731 (Accession XM_167596) is another VGAM221 host target gene. LOC219731 BINDING SITE is HOST TARGET binding site found in the 5' untranslated region of mRNA encoded by LOC219731, corresponding to a HOST TARGET binding site such as BINDING SITE I, BINDING SITE II or BINDING SITE III. Table 2 illustrates the complementarity of the nucleotide sequences of LOC219731 BINDING SITE, designated SEQ ID:44717, to the nucleotide sequence of VGAM221 RNA, herein designated VGAM RNA, also designated SEQ ID:2932.

Another function of VGAM221 is therefore inhibition of LOC219731 (Accession XM_167596). Accordingly, utilities of VGAM221 include diagnosis, prevention and treatment of diseases and clinical conditions associated with LOC219731. FIG. 1 further provides a conceptual description of a novel bioinformatically detected viral gene of the present invention, referred to here as Viral Genomic Address Messenger 222 (VGAM222) viral gene, which modulates expression of respective host target genes thereof, the function and utility of which host target genes is known in the art.

VGAM222 is a novel bioinformatically detected regulatory, non protein coding, viral micro RNA (miRNA) gene. The method by which VGAM222 was detected is described hereinabove with reference to FIGS. 1-8.

VGAM222 gene, herein designated VGAM GENE, is a viral gene contained in the genome of Callitrichine Herpesvirus 3. VGAM222 host target gene, herein designated VGAM HOST TARGET GENE, is a human gene contained in the human genome.

VGAM222 gene encodes a VGAM222 precursor RNA, herein designated VGAM PRECURSOR RNA. Similar to other miRNA genes, and unlike most ordinary genes, VGAM222 precursor RNA does not encode a protein. A nucleotide sequence identical or highly similar to the nucleotide sequence of VGAM222 precursor RNA is designated SEQ ID:208, and is provided hereinbelow with reference to the sequence listing part. Nucleotide sequence SEQ ID:208 is located at position 94113 relative to the genome of Callitrichine Herpesvirus 3.

VGAM222 precursor RNA folds onto itself, forming VGAM222 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or a partial inversed-reversed sequence of the nucleotide sequence of the second half thereof.

An enzyme complex designated DICER COMPLEX, 'dices' the VGAM222 folded precursor RNA into VGAM222 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM222 RNA is designated SEQ ID:2933, and is provided hereinbelow with reference to the sequence listing part.

VGAM222 host target gene, herein designated VGAM HOST TARGET GENE, encodes a corresponding messenger RNA, VGAM222 host target RNA, herein designated VGAM HOST TARGET RNA. VGAM222 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM222 RNA, herein designated VGAM RNA, binds complementarily to one or more host target binding sites located in untranslated regions of VGAM222 host target RNA, herein designated VGAM HOST TARGET RNA. This complementary binding is due to the fact that the nucleotide sequence of VGAM222 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM222 RNA, herein designated VGAM RNA, may have a different number of host target binding sites in untranslated regions of a VGAM222 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM222 RNA, herein designated VGAM RNA, to host target binding sites on VGAM222 host target RNA, herein designated VGAM HOST TARGET RNA, such as BINDING SITE I, BINDING SITE II and BINDING SITE III, inhibits translation of VGAM222 host target RNA into VGAM222 host target protein, herein designated VGAM HOST TARGET PROTEIN. VGAM host target protein is therefore outlined by a broken line.

It is appreciated that VGAM222 host target gene, herein designated VGAM HOST TARGET GENE, in fact represents a plurality of VGAM222 host target genes. The mRNA of each one of this plurality of VGAM222 host target genes comprises one or more host target binding sites, each having a nucleotide sequence which is at least partly complementary to VGAM222 RNA, herein designated VGAM RNA, and which when bound by VGAM222 RNA causes inhibition of translation of respective one or more VGAM222 host target proteins.

It is further appreciated by one skilled in the art that the mode of translational inhibition illustrated by FIG. 1 with specific reference to translational inhibition exerted by VGAM222 gene, herein designated VGAM GENE, on one or more VGAM222 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM222 is inhibition of expression of host target genes, as part of a novel viral mechanism of attacking a host. Accordingly, utilities of VGAM222 include diagnosis, prevention and treatment of viral infection by Callitrichine Herpesvirus 3. Specific functions, and accordingly utilities, of VGAM222 correlate with, and may be deduced from, the identity of the host target genes which VGAM222 binds and inhibits, and the function of these host target genes, as elaborated hereinbelow.

Nucleotide sequences of the VGAM222 precursor RNA, herein designated VGAM PRECURSOR RNA, and of the 'diced' VGAM222 RNA, herein designated VGAM RNA, and a schematic representation of the secondary folding of VGAM222 folded precursor RNA, herein designated VGAM FOLDED PRECURSOR RNA, of VGAM222 are further described hereinbelow with reference to Table 1.

Nucleotide sequences of host target binding sites, such as BINDING SITE-I, BINDING SITE-II and BINDING SITE-III of FIG. 1, found on VGAM222 host target RNA, and schematic representation of the complementarity of each of these host target binding sites to VGAM222 RNA, herein designated VGAM RNA, are described hereinbelow with reference to Table 2.

As mentioned hereinabove with reference to FIG. 1, a function of VGAM222 gene, herein designated VGAM is inhibition of expression of VGAM222 target genes. It is appreciated that specific functions, and accordingly utilities, of VGAM222 correlate with, and may be deduced from, the identity of the target genes which VGAM222 binds and inhibits, and the function of these target genes, as elaborated hereinbelow.

SAR1 (Accession NM_020150) is a VGAM222 host target gene. SAR1 BINDING SITE is HOST TARGET binding site found in the 3' untranslated region of mRNA encoded by SAR1, corresponding to a HOST TARGET binding site such as BINDING SITE I, BINDING SITE II or BINDING SITE III. Table 2 illustrates the complementarity of the nucleotide sequences of SAR1 BINDING SITE, designated SEQ ID:21350, to the nucleotide sequence of VGAM222 RNA, herein designated VGAM RNA, also designated SEQ ID:2933.

A function of VGAM222 is therefore inhibition of SAR1 (Accession NM_020150), a gene which is involved in transport from the endoplasmic reticulum to the golgi apparatus (by similarity). Accordingly, utilities of VGAM222 include diagnosis, prevention and treatment of diseases and clinical conditions associated with SAR1. The function of SAR1 has been established by previous studies. Sugimoto et al. (2001) demonstrated that IQGAP1, a negative regulator of cell-cell adhesion, is upregulated by gene amplification at 15q26 in 2 gastric cancer cell lines. Amplification at 15q26 had been found in various malignancies, including breast cancers, and FES (OMIM Ref. No. 190030) and/or IGF1R (OMIM Ref. No. 147370) had been identified as targets for gene amplification in breast cancer, melanoma, and pancreatic adenocarcinoma. In contrast, Sugimoto et al. (2001) found that both genes are located telomeric to the amplicon at 15q26 in the 2 gastric cancer cell lines they studied. Fukata et al. (2002) found that IQGAP1, an effector of RAC1 (OMIM Ref. No. 602048) and CDC42, interacts with CLIP170 (RSN; 179838). In Vero fibroblasts, IQGAP1 localized at the polarized leading edge. Expression of a C-terminal fragment of IQGAP1 that included the CLIP170-binding region delocalized GFP-CLIP170 from the tips of microtubules and altered the microtubule array. The authors found that activated RAC1/CDC42, IQGAP1, and CLIP170 form a tripartite complex. Furthermore, expression of an IQGAP1 mutant defective in RAC1/CDC42 binding induced multiple leading edges. These results indicated that RAC1/CDC42 marks special cortical spots where the IQGAP1 and CLIP170 complex is targeted, leading to a polarized microtubule array and cell polarization.

Full details of the abovementioned studies are described in the following publications, the disclosure of which are hereby incorporated by reference:

Sugimoto, N.; Imoto, I.; Fukuda, Y.; Kurihara, N.; Kuroda, S.; Tanigami, A.; Kaibuchi, K.; Kamiyama, R.; Inazawa, J.: IQGAP1, a negative regulator of cell-cell adhesion, is upregulated by gene amplification at 15q26 in gastric cancer cell lines HSC39 and 40A. J. Hum. Genet. 46:21-25, 2001; and Fukata, M.; Watanabe, T.; Noritake, J.; Nakagawa, M.; Yamaga, M.; Kuroda, S.; Matsuura, Y.; Iwamatsu, A.; Perez, F.; Kaibuchi, K.: Rac1 and Cdc42 capture microtubules through IQGAP1 an.

Further studies establishing the function and utilities of SAR1 are found in John Hopkins OMIM database record ID 603379, and in sited publications numbered 180 and 7498-7500 listed in the bibliography section hereinbelow, which are also hereby incorporated by reference. Solute Carrier Family 4, Sodium Bicarbonate Cotransporter, Member 4 (SLC4A4, Accession NM_003759) is another VGAM222 host target gene. SLC4A4 BINDING SITE is HOST TARGET binding site found in the 3' untranslated region of mRNA encoded by SLC4A4, corresponding to a HOST TARGET binding site such as BINDING SITE I, BINDING SITE II or BINDING SITE III. Table 2 illustrates the complementarity of the nucleotide sequences of SLC4A4 BINDING SITE, designated SEQ ID:9835, to the nucleotide sequence of VGAM222 RNA, herein designated VGAM RNA, also designated SEQ ID:2933.

Another function of VGAM222 is therefore inhibition of Solute Carrier Family 4, Sodium Bicarbonate Cotransporter, Member 4 (SLC4A4, Accession NM_003759), a gene which is a sodium bicarbonate cotransporter. Accordingly, utilities of VGAM222 include diagnosis, prevention and treatment of diseases and clinical conditions associated with SLC4A4. The function of SLC4A4 has been established by previous studies. By screening a human heart cDNA library with rat kidney Nbc cDNAs, followed by a PCR approach, Choi et al. (1999) isolated a full-length cDNA encoding a heart NBC, which they called hhNBC. They reported that the coding sequence of hhNBC is identical to that of pNBC (Abuladze et al., 1998). However, the 5-prime untranslated regions of hhNBC and pNBC differ. Northern blot analysis using the 5-prime region of the hhNBC coding sequence as probe detected an approximately 9-kb transcript that was strongly expressed in pancreas and weakly expressed in heart and brain. Choi et al. (1999) found that both hhNBC and kNBC (Burnham et al., 1997), when expressed in Xenopus, are electrogenic. Soleimani and Burnham (2000) stated that kNBC (Burnham et al., 1997) and pNBC (Abuladze et al., 1998) are encoded by splice variants of the same gene, SLC4A4, which they called NBC1. Mutations in the SLC4A4 gene (e.g., 603345.0001, 603345.0002) cause proximal renal tubular acidosis with bilateral glaucoma, cataracts, and band keratopathy (OMIM Ref. No. 604278). Such mutations may increase the bicarbonate concentration in the corneal stroma, which would facilitate calcium deposition leading to band keratopathy. Igarashi et al. (1999) suggested that the kidney and pancreatic NBCs are derived from a common gene by alternative splicing and that mutations at the common region would inactivate both isoforms. Studies by Usui et al. (1999) confirmed that both kidney and pancreatic NBC are involved in the transport of sodium and bicarbonate out of the corneal stroma and into the aqueous humor.

Full details of the abovementioned studies are described in the following publications, the disclosure of which are hereby incorporated by reference:

Soleimani, M.; Burnham, C. E.: Physiologic and molecular aspects of the Na (+):HCO(3-) cotransporter in health and disease processes. Kidney Int. 57: 371-384, 2000; and Choi, I.; Romero, M. F.; Khandoudi, N.; Bril, A.; Boron, W. F.: Cloning and characterization of a human electrogenic Na (+)-HCO(3-) cotransporter isoform (hhNBC). Am. J. Physiol. 276: C57.

Further studies establishing the function and utilities of SLC4A4 are found in John Hopkins OMIM database record ID 603345, and in sited publications numbered 7954-7960 listed in the bibliography section hereinbelow, which are also hereby incorporated by reference. Transcription Factor Dp-2 (E2F dimerization partner 2) (TFDP2, Accession NM_006286) is another VGAM222 host target gene. TFDP2 BINDING SITE is HOST TARGET binding site found in the 3' untranslated region of mRNA encoded by TFDP2, corresponding to a HOST TARGET binding site such as BINDING SITE I, BINDING SITE II or BINDING SITE III. Table 2 illustrates the complementarity of the nucleotide sequences of TFDP2 BINDING SITE, designated SEQ ID:12972, to the nucleotide sequence of VGAM222 RNA, herein designated VGAM RNA, also designated SEQ ID:2933.

Another function of VGAM222 is therefore inhibition of Transcription Factor Dp-2 (E2F dimerization partner 2) (TFDP2, Accession NM_006286), a gene which is required for the progression of S-phase during the cell cycle. Accordingly, utilities of VGAM222 include diagnosis, prevention and treatment of diseases and clinical conditions associated with TFDP2. The function of TFDP2 has been established by previous studies. Zhang and Chellappan (1995) cloned an E2F dimerization partner, transcription factor DP2, from a human kidney cDNA library. The TFDP2 gene encodes a predicted 386-amino acid protein that is 68% identical to TFDP1 (OMIM Ref. No. 189902). Northern blot analysis revealed 5 distinct transcript sizes ranging from 1.4 to 9.5 kb, with expression of at least one size observed in all cell lines tested. TFDP2 is able to form a functional heterodimer with E2F1 (OMIM Ref. No. 189971). Zhang et al. (1997) used fluorescence in situ hybridization to map the TFDP2 gene to human chromosome 3q23.

Full details of the abovementioned studies are described in the following publications, the disclosure of which are hereby incorporated by reference:

Zhang, Y.; Chellappan, S. P.: Cloning and characterization of human DP2, a novel dimerization partner of E2F. Oncogene 10:2085-2093, 1995; and Zhang, Y.; Venkatraj, V. S.; Fischer, S. G.; Warburton, D.; Chellappan, S. P.: Genomic cloning and chromosomal assignment of the E2F dimerization partner TFDP gene family. Genomics 39.

Further studies establishing the function and utilities of TFDP2 are found in John Hopkins OMIM database record ID 602160, and in sited publications numbered 76 and 12350 listed in the bibliography section hereinbelow, which are also hereby incorporated by reference. KIAA0923 (Accession NM_014021) is another VGAM222 host target gene. KIAA0923 BINDING SITE is HOST TARGET binding site found in the 3' untranslated region of mRNA encoded by KIAA0923, corresponding to a HOST TARGET binding site such as BINDING SITE I, BINDING SITE II or BINDING SITE III. Table 2 illustrates the complementarity of the nucleotide sequences of KIAA0923 BINDING SITE, designated SEQ ID:15238, to the nucleotide sequence of VGAM222 RNA, herein designated VGAM RNA, also designated SEQ ID:2933.

Another function of VGAM222 is therefore inhibition of KIAA0923 (Accession NM_014021). Accordingly, utilities of VGAM222 include diagnosis, prevention and treatment of diseases and clinical conditions associated with KIAA0923. Zinc Finger Protein 238 (ZNF238, Accession NM_006352) is another VGAM222 host target gene. ZNF238 BINDING SITE is HOST TARGET binding site found in the 3' untranslated region of mRNA encoded by ZNF238, corresponding to a HOST TARGET binding site such as BINDING SITE I, BINDING SITE II or BINDING SITE III. Table 2 illustrates the complementarity of the nucleotide sequences of ZNF238 BINDING SITE, designated SEQ ID:13042, to the nucleotide sequence of VGAM222 RNA, herein designated VGAM RNA, also designated SEQ ID:2933.

Another function of VGAM222 is therefore inhibition of Zinc Finger Protein 238 (ZNF238, Accession NM_006352). Accordingly, utilities of VGAM222 include diagnosis, prevention and treatment of diseases and clinical conditions associated with ZNF238. FIG. 1 further provides a conceptual description of a novel bioinformatically detected viral gene of the present invention, referred to here as Viral Genomic Address Messenger 223 (VGAM223) viral gene, which modulates expression of respective host target genes thereof, the function and utility of which host target genes is known in the art.

VGAM223 is a novel bioinformatically detected regulatory, non protein coding, viral micro RNA (miRNA) gene. The method by which VGAM223 was detected is described hereinabove with reference to FIGS. 1-8.

VGAM223 gene, herein designated VGAM GENE, is a viral gene contained in the genome of Callitrichine Herpesvirus 3. VGAM223 host target gene, herein designated VGAM HOST TARGET GENE, is a human gene contained in the human genome.

VGAM223 gene encodes a VGAM223 precursor RNA, herein designated VGAM PRECURSOR RNA. Similar to other miRNA genes, and unlike most ordinary genes, VGAM223 precursor RNA does not encode a protein. A nucleotide sequence identical or highly similar to the nucleotide sequence of VGAM223 precursor RNA is designated SEQ ID:209, and is provided hereinbelow with reference to the sequence listing part. Nucleotide sequence SEQ ID:209 is located at position 133004 relative to the genome of Callitrichine Herpesvirus 3.

VGAM223 precursor RNA folds onto itself, forming VGAM223 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM223 folded precursor RNA into VGAM223 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM223 RNA is designated SEQ ID:2934, and is provided hereinbelow with reference to the sequence listing part.

VGAM223 host target gene, herein designated VGAM HOST TARGET GENE, encodes a corresponding messenger RNA, VGAM223 host target RNA, herein designated VGAM HOST TARGET RNA. VGAM223 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM223 RNA, herein designated VGAM RNA, binds complementarily to one or more host target binding sites located in untranslated regions of VGAM223 host target RNA, herein designated VGAM HOST TARGET RNA. This complementary binding is due to the fact that the nucleotide sequence of VGAM223 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM223 RNA, herein designated VGAM RNA, may have a different number of host target binding sites in untranslated regions of a VGAM223 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM223 RNA, herein designated VGAM RNA, to host target binding sites on VGAM223 host target RNA, herein designated VGAM HOST TARGET RNA, such as BINDING SITE I, BINDING SITE II and BINDING SITE III, inhibits translation of VGAM223 host target RNA into VGAM223 host target protein, herein designated VGAM HOST TARGET PROTEIN. VGAM host target protein is therefore outlined by a broken line.

It is appreciated that VGAM223 host target gene, herein designated VGAM HOST TARGET GENE, in fact represents a plurality of VGAM223 host target genes. The mRNA of each one of this plurality of VGAM223 host target genes comprises one or more host target binding sites, each having a nucleotide sequence which is at least partly complementary to VGAM223 RNA, herein designated VGAM RNA, and which when bound by VGAM223 RNA causes inhibition of translation of respective one or more VGAM223 host target proteins.

It is further appreciated by one skilled in the art that the mode of translational inhibition illustrated by FIG. 1 with specific reference to translational inhibition exerted by VGAM223 gene, herein designated VGAM GENE, on one or more VGAM223 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM223 is inhibition of expression of host target genes, as part of a novel viral mechanism of attacking a host. Accordingly, utilities of VGAM223 include diagnosis, prevention and treatment of viral infection by Callitrichine Herpesvirus 3. Specific functions, and accordingly utilities, of VGAM223 correlate with, and may be deduced from, the identity of the host target genes which VGAM223 binds and inhibits, and the function of these host target genes, as elaborated hereinbelow.

Nucleotide sequences of the VGAM223 precursor RNA, herein designated VGAM PRECURSOR RNA, and of the 'diced' VGAM223 RNA, herein designated VGAM RNA, and a schematic representation of the secondary folding of VGAM223 folded precursor RNA, herein designated VGAM FOLDED PRECURSOR RNA, of VGAM223 are further described hereinbelow with reference to Table 1.

Nucleotide sequences of host target binding sites, such as BINDING SITE-I, BINDING SITE-II and BINDING SITE-III of FIG. 1, found on VGAM223 host target RNA, and schematic representation of the complementarity of each of these host target binding sites to VGAM223 RNA, herein designated VGAM RNA, are described hereinbelow with reference to Table 2.

As mentioned hereinabove with reference to FIG. 1, a function of VGAM223 gene, herein designated VGAM is inhibition of expression of VGAM223 target genes. It is appreciated that specific functions, and accordingly utilities, of VGAM223 correlate with, and may be deduced from, the identity of the target genes which VGAM223 binds and inhibits, and the function of these target genes, as elaborated hereinbelow.

Dual Specificity Phosphatase 4 (DUSP4, Accession NM_001394) is a VGAM223 host target gene. DUSP4 BINDING SITE is HOST TARGET binding site found in the 5' untranslated region of mRNA encoded by DUSP4, corresponding to a HOST TARGET binding site such as BINDING SITE I, BINDING SITE II or BINDING SITE III. Table 2 illustrates the complementarity of the nucleotide sequences of DUSP4 BINDING SITE, designated SEQ ID:7090, to the nucleotide sequence of VGAM223 RNA, herein designated VGAM RNA, also designated SEQ ID:2934.

A function of VGAM223 is therefore inhibition of Dual Specificity Phosphatase 4 (DUSP4, Accession NM_001394), a gene which regulates mitogenic signal transduction. Accordingly, utilities of VGAM223 include diagnosis, prevention and treatment of diseases and clinical conditions associated with DUSP4. The function of DUSP4 and its association with various diseases and clinical conditions, has been established by previous studies, as described hereinabove with reference to VGAM110. Niemann-Pick Disease, Type C1 (NPC1, Accession NM_000271) is another VGAM223 host target gene. NPC1 BINDING SITE is HOST TARGET binding site found in the 3' untranslated region of mRNA encoded by NPC1, corresponding to a HOST TARGET binding site such as BINDING SITE I, BINDING SITE II or BINDING SITE III. Table 2 illustrates the complementarity of the nucleotide sequences of NPC1 BINDING SITE, designated SEQ ID:5815, to the nucleotide sequence of VGAM223 RNA, herein designated VGAM RNA, also designated SEQ ID:2934.

Another function of VGAM223 is therefore inhibition of Niemann-Pick Disease, Type C1 (NPC1, Accession NM_000271). Accordingly, utilities of VGAM223 include diagnosis, prevention and treatment of diseases and clinical conditions associated with NPC1. Transcription Factor-like 4 (TCFL4, Accession XM_032817) is another VGAM223 host target gene. TCFL4 BINDING SITE is HOST TARGET binding site found in the 3' untranslated region of mRNA encoded by TCFL4, corresponding to a HOST TARGET binding site such as BINDING SITE I, BINDING SITE II or BINDING SITE III. Table 2 illustrates the complementarity of the nucleotide sequences of TCFL4 BINDING SITE, designated SEQ ID:31770, to the nucleotide sequence of VGAM223 RNA, herein designated VGAM RNA, also designated SEQ ID:2934.

Another function of VGAM223 is therefore inhibition of Transcription Factor-like 4 (TCFL4, Accession XM_032817), a gene which interacts with Mad and represses transcription by recruiting the Sin3A-histone deacetylase corepressor complex. Accordingly, utilities of VGAM223 include diagnosis, prevention and treatment of diseases and clinical conditions associated with TCFL4. The function of TCFL4 and its association with various diseases and clinical conditions, has been established by previous studies, as described hereinabove with reference to VGAM172. Zinc Finger Protein (C2H2 type) 277 (ZNF277, Accession NM_021994) is another VGAM223 host target gene. ZNF277 BINDING SITE is HOST TARGET binding site found in the 5' untranslated region of mRNA encoded by ZNF277, corresponding to a HOST TARGET binding site such as BINDING SITE I, BINDING SITE II or BINDING SITE III. Table 2 illustrates the complementarity of the nucleotide sequences of ZNF277 BINDING SITE, designated SEQ ID:22535, to the nucleotide sequence of VGAM223 RNA, herein designated VGAM RNA, also designated SEQ ID:2934.

Another function of VGAM223 is therefore inhibition of Zinc Finger Protein (C2H2 type) 277 (ZNF277, Accession NM_021994). Accordingly, utilities of VGAM223 include diagnosis, prevention and treatment of diseases and clinical conditions associated with ZNF277. Chromosome 11 Open Reading Frame 9 (C11orf9, Accession NM_013279) is another VGAM223 host target gene. C11orf9 BINDING SITE is HOST TARGET binding site found in the 3' untranslated region of mRNA encoded by C11orf9, corresponding to a HOST TARGET binding site such as BINDING SITE I, BINDING SITE II or BINDING SITE III. Table 2 illustrates the complementarity of the nucleotide sequences of C11orf9 BINDING SITE, designated SEQ ID:14946, to the nucleotide sequence of VGAM223 RNA, herein designated VGAM RNA, also designated SEQ ID:2934.

Another function of VGAM223 is therefore inhibition of Chromosome 11 Open Reading Frame 9 (C11orf9, Accession NM_013279). Accordingly, utilities of VGAM223 include diagnosis, prevention and treatment of diseases and clinical conditions associated with C11orf9. DKFZP564I0422 (Accession NM_031435) is another VGAM223 host target gene. DKFZP564I0422 BINDING SITE is HOST TARGET binding site found in the 3' untranslated region of mRNA encoded by DKFZP564I0422, corresponding to a HOST TARGET binding site such as BINDING SITE I, BINDING SITE II or BINDING SITE III. Table 2 illustrates the complementarity of the nucleotide sequences of DKFZP564I0422 BINDING SITE, designated SEQ ID:25435, to the nucleotide sequence of VGAM223 RNA, herein designated VGAM RNA, also designated SEQ ID:2934.

Another function of VGAM223 is therefore inhibition of DKFZP564I0422 (Accession NM_031435). Accordingly, utilities of VGAM223 include diagnosis, prevention and treatment of diseases and clinical conditions associated with DKFZP564I0422. FLJ12076 (Accession NM_025187) is another VGAM223 host target gene. FLJ12076 BINDING SITE is HOST TARGET binding site found in the 3' untranslated region of mRNA encoded by FLJ12076, corresponding to a HOST TARGET binding site such as BINDING SITE I, BINDING SITE II or BINDING SITE III. Table 2 illustrates the complementarity of the nucleotide sequences of FLJ12076 BINDING SITE, designated SEQ ID:24825, to the nucleotide sequence of VGAM223 RNA, herein designated VGAM RNA, also designated SEQ ID:2934.

Another function of VGAM223 is therefore inhibition of FLJ12076 (Accession NM_025187). Accordingly, utilities of VGAM223 include diagnosis, prevention and treatment of diseases and clinical conditions associated with FLJ12076. FLJ22596 (Accession NM_025086) is another VGAM223 host target gene. FLJ22596 BINDING SITE is HOST TARGET binding site found in the 5' untranslated region of mRNA encoded by FLJ22596, corresponding to a HOST TARGET binding site such as BINDING SITE I, BINDING SITE II or BINDING SITE III. Table 2 illustrates the complementarity of the nucleotide sequences of FLJ22596 BINDING SITE, designated SEQ ID:24705, to the nucleotide sequence of VGAM223 RNA, herein designated VGAM RNA, also designated SEQ ID:2934.

Another function of VGAM223 is therefore inhibition of FLJ22596 (Accession NM_025086). Accordingly, utilities of VGAM223 include diagnosis, prevention and treatment of diseases and clinical conditions associated with FLJ22596. HA-1 (Accession XM_037574) is another VGAM223 host target gene. HA-1 BINDING SITE is HOST TARGET binding site found in the 3' untranslated region of mRNA encoded by HA-1, corresponding to a HOST TARGET binding site such as BINDING SITE I, BINDING SITE II or BINDING SITE III. Table 2 illustrates the complementarity of the nucleotide sequences of HA-1 BINDING SITE, designated SEQ ID:32654, to the nucleotide sequence of VGAM223 RNA, herein designated VGAM RNA, also designated SEQ ID:2934.

Another function of VGAM223 is therefore inhibition of HA-1 (Accession XM_037574). Accordingly, utilities of VGAM223 include diagnosis, prevention and treatment of diseases and clinical conditions associated with HA-1. KIAA1056 (Accession NM_014894) is another VGAM223 host target gene. KIAA1056 BINDING SITE is HOST TARGET binding site found in the 3' untranslated region of mRNA encoded by KIAA1056, corresponding to a HOST TARGET binding site such as BINDING SITE I, BINDING SITE II or BINDING SITE III. Table 2 illustrates the complementarity of the nucleotide sequences of KIAA1056 BINDING SITE, designated SEQ ID:17048, to the nucleotide sequence of VGAM223 RNA, herein designated VGAM RNA, also designated SEQ ID:2934.

Another function of VGAM223 is therefore inhibition of KIAA1056 (Accession NM_014894). Accordingly, utilities of VGAM223 include diagnosis, prevention and treatment of diseases and clinical conditions associated with KIAA1056. KIAA1193 (Accession XM_041843) is another VGAM223 host target gene. KIAA1193 BINDING SITE is HOST TARGET binding site found in the 3' untranslated region of mRNA encoded by KIAA1193, corresponding to a HOST TARGET binding site such as BINDING SITE I, BINDING SITE II or BINDING SITE III. Table 2 illustrates the complementarity of the nucleotide sequences of KIAA1193 BINDING SITE, designated SEQ ID:33607, to the nucleotide sequence of VGAM223 RNA, herein designated VGAM RNA, also designated SEQ ID:2934.

Another function of VGAM223 is therefore inhibition of KIAA1193 (Accession XM_041843). Accordingly, utilities of VGAM223 include diagnosis, prevention and treatment of diseases and clinical conditions associated with KIAA1193. KIAA1753 (Accession XM_036115) is another VGAM223 host target gene. KIAA1753 BINDING SITE is HOST TARGET binding site found in the 3' untranslated region of mRNA encoded by KIAA1753, corresponding to a HOST TARGET binding site such as BINDING SITE I, BINDING SITE II or BINDING SITE III. Table 2 illustrates the complementarity of the nucleotide sequences of KIAA1753 BINDING SITE, designated SEQ ID:32380, to the nucleotide sequence of VGAM223 RNA, herein designated VGAM RNA, also designated SEQ ID:2934.

Another function of VGAM223 is therefore inhibition of KIAA1753 (Accession XM_036115). Accordingly, utilities of VGAM223 include diagnosis, prevention and treatment of diseases and clinical conditions associated with KIAA1753. Protocadherin 10 (PCDH10, Accession NM_020815) is another VGAM223 host target gene. PCDH10 BINDING SITE1 and PCDH10 BINDING SITE2 are HOST TARGET binding sites found in untranslated regions of mRNA encoded by PCDH10, corresponding to HOST TARGET binding sites such as BINDING SITE I, BINDING SITE II or BINDING SITE III. Table 2 illustrates the complementarity of the nucleotide sequences of PCDH10 BINDING SITE1 and PCDH10 BINDING SITE2, designated SEQ ID:21882 and SEQ ID:26767 respectively, to the nucleotide sequence of VGAM223 RNA, herein designated VGAM RNA, also designated SEQ ID:2934.

Another function of VGAM223 is therefore inhibition of Protocadherin 10 (PCDH10, Accession NM_020815). Accordingly, utilities of VGAM223 include diagnosis, prevention and treatment of diseases and clinical conditions associated with PCDH10. LOC203377 (Accession XM_117540) is another VGAM223 host target gene. LOC203377 BINDING SITE is HOST TARGET binding site found in the 5' untranslated region of mRNA encoded by LOC203377, corresponding to a HOST TARGET binding site such as BINDING SITE I, BINDING SITE II or BINDING SITE III. Table 2 illustrates the complementarity of the nucleotide sequences of LOC203377 BINDING SITE, designated SEQ ID:43543, to the nucleotide sequence of VGAM223 RNA, herein designated VGAM RNA, also designated SEQ ID:2934.

Another function of VGAM223 is therefore inhibition of LOC203377 (Accession XM_117540). Accordingly, utilities of VGAM223 include diagnosis, prevention and treatment of diseases and clinical conditions associated with LOC203377. LOC219654 (Accession XM_166095) is another VGAM223 host target gene. LOC219654 BINDING SITE is HOST TARGET binding site found in the 3' untranslated region of mRNA encoded by LOC219654, corresponding to a HOST TARGET binding site such as BINDING SITE I, BINDING SITE II or BINDING SITE III. Table 2 illustrates the complementarity of the nucleotide sequences of LOC219654 BINDING SITE, designated SEQ ID:43879, to the nucleotide sequence of VGAM223 RNA, herein designated VGAM RNA, also designated SEQ ID:2934.

Another function of VGAM223 is therefore inhibition of LOC219654 (Accession XM_166095). Accordingly, utilities of VGAM223 include diagnosis, prevention and treatment of diseases and clinical conditions associated with LOC219654. LOC220070 (Accession NM_145308) is another VGAM223 host target gene. LOC220070 BINDING SITE is HOST TARGET binding site found in the 3' untranslated region of mRNA encoded by LOC220070, corresponding to a HOST TARGET binding site such as BINDING SITE I, BINDING SITE II or BINDING SITE III. Table 2 illustrates the complementarity of the nucleotide sequences of LOC220070 BINDING SITE, designated SEQ ID:29819, to the nucleotide sequence of VGAM223 RNA, herein designated VGAM RNA, also designated SEQ ID:2934.

Another function of VGAM223 is therefore inhibition of LOC220070 (Accession NM_145308). Accordingly, utilities of VGAM223 include diagnosis, prevention and treatment of diseases and clinical conditions associated with LOC220070. LOC56959 (Accession XM_088578) is another VGAM223 host target gene. LOC56959 BINDING SITE is HOST TARGET binding site found in the 5' untranslated region of mRNA encoded by LOC56959, corresponding to a HOST TARGET binding site such as BINDING SITE I, BINDING SITE II or BINDING SITE III. Table 2 illustrates the complementarity of the nucleotide sequences of LOC56959 BINDING SITE, designated SEQ ID:39839, to the nucleotide sequence of VGAM223 RNA, herein designated VGAM RNA, also designated SEQ ID:2934.

Another function of VGAM223 is therefore inhibition of LOC56959 (Accession XM_088578). Accordingly, utilities of VGAM223 include diagnosis, prevention and treatment of diseases and clinical conditions associated with LOC56959. FIG. 1 further provides a conceptual description of a novel bioinformatically detected viral gene of the present invention, referred to here as Viral Genomic Address Messenger 224 (VGAM224) viral gene, which modulates expression of respective host target genes thereof, the function and utility of which host target genes is known in the art.

VGAM224 is a novel bioinformatically detected regulatory, non protein coding, viral micro RNA (miRNA) gene. The method by which VGAM224 was detected is described hereinabove with reference to FIGS. 1-8.

VGAM224 gene, herein designated VGAM GENE, is a viral gene contained in the genome of Callitrichine Herpesvirus 3. VGAM224 host target gene, herein designated VGAM HOST TARGET GENE, is a human gene contained in the human genome.

VGAM224 gene encodes a VGAM224 precursor RNA, herein designated VGAM PRECURSOR RNA. Similar to other miRNA genes, and unlike most ordinary genes, VGAM224 precursor RNA does not encode a protein. A nucleotide sequence identical or highly similar to the nucleotide sequence of VGAM224 precursor RNA is designated SEQ ID:210, and is provided hereinbelow with reference to the sequence listing part. Nucleotide sequence SEQ ID:210 is located at position 52378 relative to the genome of Callitrichine Herpesvirus 3.

VGAM224 precursor RNA folds onto itself, forming VGAM224 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM224 folded precursor RNA into VGAM224 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM224 RNA is designated SEQ ID:2935, and is provided hereinbelow with reference to the sequence listing part.

VGAM224 host target gene, herein designated VGAM HOST TARGET GENE, encodes a corresponding messenger RNA, VGAM224 host target RNA, herein designated VGAM HOST TARGET RNA. VGAM224 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM224 RNA, herein designated VGAM RNA, binds complementarily to one or more host target binding sites located in untranslated regions of VGAM224 host target RNA, herein designated VGAM HOST TARGET RNA. This complementary binding is due to the fact that the nucleotide sequence of VGAM224 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM224 RNA, herein designated VGAM RNA, may have a different number of host target binding sites in untranslated regions of a VGAM224 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM224 RNA, herein designated VGAM RNA, to host target binding sites on VGAM224 host target RNA, herein designated VGAM HOST TARGET RNA, such as BINDING SITE I, BINDING SITE II and BINDING SITE III, inhibits translation of VGAM224 host target RNA into VGAM224 host target protein, herein designated VGAM HOST TARGET PROTEIN. VGAM host target protein is therefore outlined by a broken line.

It is appreciated that VGAM224 host target gene, herein designated VGAM HOST TARGET GENE, in fact represents a plurality of VGAM224 host target genes. The mRNA of each one of this plurality of VGAM224 host target genes comprises one or more host target binding sites, each having a nucleotide sequence which is at least partly complementary to VGAM224 RNA, herein designated VGAM RNA, and which when bound by VGAM224 RNA causes inhibition of translation of respective one or more VGAM224 host target proteins.

It is further appreciated by one skilled in the art that the mode of translational inhibition illustrated by FIG. 1 with specific reference to translational inhibition exerted by VGAM224 gene, herein designated VGAM GENE, on one or more VGAM224 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM224 is inhibition of expression of host target genes, as part of a novel viral mechanism of attacking a host. Accordingly, utilities of VGAM224 include diagnosis, prevention and treatment of viral infection by Callitrichine Herpesvirus 3. Specific functions, and accordingly utilities, of VGAM224 correlate with, and may be deduced from, the identity of the host target genes which VGAM224 binds and inhibits, and the function of these host target genes, as elaborated hereinbelow.

Nucleotide sequences of the VGAM224 precursor RNA, herein designated VGAM PRECURSOR RNA, and of the 'diced' VGAM224 RNA, herein designated VGAM RNA, and a schematic representation of the secondary folding of VGAM224 folded precursor RNA, herein designated VGAM FOLDED PRECURSOR RNA, of VGAM224 are further described hereinbelow with reference to Table 1.

Nucleotide sequences of host target binding sites, such as BINDING SITE-I, BINDING SITE-II and BINDING SITE-III of FIG. 1, found on VGAM224 host target RNA, and schematic representation of the complementarity of each of these host target binding sites to VGAM224 RNA, herein designated VGAM RNA, are described hereinbelow with reference to Table 2.

As mentioned hereinabove with reference to FIG. 1, a function of VGAM224 gene, herein designated VGAM is inhibition of expression of VGAM224 target genes. It is appreciated that specific functions, and accordingly utilities, of VGAM224 correlate with, and may be deduced from, the identity of the target genes which VGAM224 binds and inhibits, and the function of these target genes, as elaborated hereinbelow.

Ankyrin 1, Erythrocytic (ANK1, Accession XM_016774) is a VGAM224 host target gene. ANK1 BINDING SITE is HOST TARGET binding site found in the 3' untranslated region of mRNA encoded by ANK1, corresponding to a HOST TARGET binding site such as BINDING SITE I, BINDING SITE II or BINDING SITE III. Table 2 illustrates the complementarity of the nucleotide sequences of ANK1 BINDING SITE, designated SEQ ID:30287, to the nucleotide sequence of VGAM224 RNA, herein designated VGAM RNA, also designated SEQ ID:2935.

A function of VGAM224 is therefore inhibition of Ankyrin 1, Erythrocytic (ANK1, Accession XM_016774). Accordingly, utilities of VGAM224 include diagnosis, prevention and treatment of diseases and clinical conditions associated with ANK1. Fer (fps/fes related) Tyrosine Kinase (phosphoprotein NCP94) (FER, Accession NM_005246) is another VGAM224 host target gene. FER BINDING SITE is HOST TARGET binding site found in the 5' untranslated region of mRNA encoded by FER, corresponding to a HOST TARGET binding site such as BINDING SITE I, BINDING SITE II or BINDING SITE III. Table 2 illustrates the complementarity of the nucleotide sequences of FER BINDING SITE, designated SEQ ID:11755, to the nucleotide sequence of VGAM224 RNA, herein designated VGAM RNA, also designated SEQ ID:2935.

Another function of VGAM224 is therefore inhibition of Fer (fps/fes related) Tyrosine Kinase (phosphoprotein NCP94) (FER, Accession NM_005246), a gene which Non-receptor protein tyrosine kinase; member of the Src family. Accordingly, utilities of VGAM224 include diagnosis, prevention and treatment of diseases and clinical conditions associated with FER. The function of FER has been established by previous studies. To identify novel protein tyrosine kinase genes expressed in human lymphoid cells, Krolewski et al. (1990) screened B- and T-cell cDNA libraries at low stringency using an FMS (OMIM Ref. No. 164770) tyrosine kinase domain probe. One of 3 genes so identified had been cloned previously by Hao et al. (1989). Arregui et al. (2000) demonstrated that cell-permeable (OMIM Ref. No. Trojan) peptides containing the third helix of the antennapedia homeodomain fused to a peptide mimicking the juxtamembrane (JMP) region of the cytoplasmic domain of N-cadherin (CDH2; 114020) result in the inhibition of both CDH2 and beta-1 integrin (ITGB1; 135630) function. Microscopic analysis showed that expression of JMP, which binds to the cytoplasmic domain of CDH2, results in a reduction of neurite outgrowth on cadherin substrates. Treatment of cells with JMP resulted in the release of FER from the cadherin complex and its accumulation in the integrin complex. The accumulation of FER in the integrin complex and the inhibitory effects of JMP could be reversed with a peptide that mimics the first coiled-coil domain of FER. The results suggested that FER mediates crosstalk between CDH2 and ITGB1. By Southern analysis of somatic cell hybrid DNAs, Krolewski et al. (1990) assigned the TYK3 gene to human chromosome 5. By in situ hybridization, Morris et al. (1990) concluded that the FER gene is located at 5q21-q22. Asada and Nadeau (1994) mapped the mouse homolog, Fert, to chromosome 11 by interspecific backcross analysis.

Full details of the abovementioned studies are described in the following publications, the disclosure of which are hereby incorporated by reference:

Arregui, C.; Pathre, P.; Lilien, J.; Balsamo, J.: The nonreceptor tyrosine kinase Fer mediates cross-talk between N-cadherin and beta-1-integrins. J. Cell Biol. 149:1263-1273, 2000; and Morris, C.; Heisterkamp, N.; Hao, Q. L.; Testa, J. R.; Groffen, J.: The human tyrosine kinase gene (FER) maps to chromosome 5 and is deleted in myeloid leukemias with a del (5q). Cytoge.

Further studies establishing the function and utilities of FER are found in John Hopkins OMIM database record ID 176942, and in sited publications numbered 3341, 12361-12362, 507 and 12666 listed in the bibliography section hereinbelow, which are also hereby incorporated by reference. Baculoviral IAP Repeat-containing 3 (BIRC3, Accession XM_040715) is another VGAM224 host target gene. BIRC3 BINDING SITE is HOST TARGET binding site found in the 5' untranslated region of mRNA encoded by BIRC3, corresponding to a HOST TARGET binding site such as BINDING SITE I, BINDING SITE II or BINDING SITE III. Table 2 illustrates the complementarity of the nucleotide sequences of BIRC3 BINDING SITE, designated SEQ ID:33367, to the nucleotide sequence of VGAM224 RNA, herein designated VGAM RNA, also designated SEQ ID:2935.

Another function of VGAM224 is therefore inhibition of Baculoviral IAP Repeat-containing 3 (BIRC3, Accession XM_040715). Accordingly, utilities of VGAM224 include diagnosis, prevention and treatment of diseases and clinical conditions associated with BIRC3. LOC196382 (Accession XM_116913) is another VGAM224 host target gene. LOC196382 BINDING SITE is HOST TARGET binding site found in the 5' untranslated region of mRNA encoded by LOC196382, corresponding to a HOST TARGET binding site such as BINDING SITE I, BINDING SITE II or BINDING SITE III. Table 2 illustrates the complementarity of the nucleotide sequences of LOC196382 BINDING SITE, designated SEQ ID:43148, to the nucleotide sequence of VGAM224 RNA, herein designated VGAM RNA, also designated SEQ ID:2935.

Another function of VGAM224 is therefore inhibition of LOC196382 (Accession XM_116913). Accordingly, utilities of VGAM224 include diagnosis, prevention and treatment of diseases and clinical conditions associated with LOC196382. LOC93097 (Accession XM_049221) is another VGAM224 host target gene. LOC93097 BINDING SITE is HOST TARGET binding site found in the 5' untranslated region of mRNA encoded by LOC93097, corresponding to a HOST TARGET binding site such as BINDING SITE I, BINDING SITE II or BINDING SITE III. Table 2 illustrates the complementarity of the nucleotide sequences of LOC93097 BINDING SITE, designated SEQ ID:35354, to the nucleotide sequence of VGAM224 RNA, herein designated VGAM RNA, also designated SEQ ID:2935.

Another function of VGAM224 is therefore inhibition of LOC93097 (Accession XM_049221). Accordingly, utilities of VGAM224 include diagnosis, prevention and treatment of diseases and clinical conditions associated with LOC93097. FIG. 1 further provides a conceptual description of a novel bioinformatically detected viral gene of the present invention, referred to here as Viral Genomic Address Messenger 225 (VGAM225) viral gene, which modulates expression of respective host target genes thereof, the function and utility of which host target genes is known in the art.

VGAM225 is a novel bioinformatically detected regulatory, non protein coding, viral micro RNA (miRNA) gene.

The method by which VGAM225 was detected is described hereinabove with reference to FIGS. 1-8.

VGAM225 gene, herein designated VGAM GENE, is a viral gene contained in the genome of Callitrichine Herpesvirus 3. VGAM225 host target gene, herein designated VGAM HOST TARGET GENE, is a human gene contained in the human genome.

VGAM225 gene encodes a VGAM225 precursor RNA, herein designated VGAM PRECURSOR RNA. Similar to other miRNA genes, and unlike most ordinary genes, VGAM225 precursor RNA does not encode a protein. A nucleotide sequence identical or highly similar to the nucleotide sequence of VGAM225 precursor RNA is designated SEQ ID:211, and is provided hereinbelow with reference to the sequence listing part. Nucleotide sequence SEQ ID:211 is located at position 113297 relative to the genome of Callitrichine Herpesvirus 3.

VGAM225 precursor RNA folds onto itself, forming VGAM225 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM225 folded precursor RNA into VGAM225 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM225 RNA is designated SEQ ID:2936, and is provided hereinbelow with reference to the sequence listing part.

VGAM225 host target gene, herein designated VGAM HOST TARGET GENE, encodes a corresponding messenger RNA, VGAM225 host target RNA, herein designated VGAM HOST TARGET RNA. VGAM225 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM225 RNA, herein designated VGAM RNA, binds complementarily to one or more host target binding sites located in untranslated regions of VGAM225 host target RNA, herein designated VGAM HOST TARGET RNA. This complementary binding is due to the fact that the nucleotide sequence of VGAM225 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM225 RNA, herein designated VGAM RNA, may have a different number of host target binding sites in untranslated regions of a VGAM225 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM225 RNA, herein designated VGAM RNA, to host target binding sites on VGAM225 host target RNA, herein designated VGAM HOST TARGET RNA, such as BINDING SITE I, BINDING SITE II and BINDING SITE III, inhibits translation of VGAM225 host target RNA into VGAM225 host target protein, herein designated VGAM HOST TARGET PROTEIN. VGAM host target protein is therefore outlined by a broken line.

It is appreciated that VGAM225 host target gene, herein designated VGAM HOST TARGET GENE, in fact represents a plurality of VGAM225 host target genes. The mRNA of each one of this plurality of VGAM225 host target genes comprises one or more host target binding sites, each having a nucleotide sequence which is at least partly complementary to VGAM225 RNA, herein designated VGAM RNA, and which when bound by VGAM225 RNA causes inhibition of translation of respective one or more VGAM225 host target proteins.

It is further appreciated by one skilled in the art that the mode of translational inhibition illustrated by FIG. 1 with specific reference to translational inhibition exerted by VGAM225 gene, herein designated VGAM GENE, on one or more VGAM225 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM225 is inhibition of expression of host target genes, as part of a novel viral mechanism of attacking a host. Accordingly, utilities of VGAM225 include diagnosis, prevention and treatment of viral infection by Callitrichine Herpesvirus 3. Specific functions, and accordingly utilities, of VGAM225 correlate with, and may be deduced from, the identity of the host target genes which VGAM225 binds and inhibits, and the function of these host target genes, as elaborated hereinbelow.

Nucleotide sequences of the VGAM225 precursor RNA, herein designated VGAM PRECURSOR RNA, and of the 'diced' VGAM225 RNA, herein designated VGAM RNA, and a schematic representation of the secondary folding of VGAM225 folded precursor RNA, herein designated VGAM FOLDED PRECURSOR RNA, of VGAM225 are further described hereinbelow with reference to Table 1.

Nucleotide sequences of host target binding sites, such as BINDING SITE-I, BINDING SITE-II and BINDING SITE-III of FIG. 1, found on VGAM225 host target RNA, and schematic representation of the complementarity of each of these host target binding sites to VGAM225 RNA, herein designated VGAM RNA, are described hereinbelow with reference to Table 2.

As mentioned hereinabove with reference to FIG. 1, a function of VGAM225 gene, herein designated VGAM is inhibition of expression of VGAM225 target genes. It is appreciated that specific functions, and accordingly utilities, of VGAM225 correlate with, and may be deduced from, the identity of the target genes which VGAM225 binds and inhibits, and the function of these target genes, as elaborated hereinbelow.

Glutathione Peroxidase 3 (plasma) (GPX3, Accession NM_002084) is a VGAM225 host target gene. GPX3 BINDING SITE is HOST TARGET binding site found in the 3' untranslated region of mRNA encoded by GPX3, corresponding to a HOST TARGET binding site such as BINDING SITE I, BINDING SITE II or BINDING SITE III. Table 2 illustrates the complementarity of the nucleotide sequences of GPX3 BINDING SITE, designated SEQ ID:7878, to the nucleotide sequence of VGAM225 RNA, herein designated VGAM RNA, also designated SEQ ID:2936.

A function of VGAM225 is therefore inhibition of Glutathione Peroxidase 3 (plasma) (GPX3, Accession NM_002084), a gene which reduces lipid hydroperoxide and H2O2 in plasma. Accordingly, utilities of VGAM225 include diagnosis, prevention and treatment of diseases and clinical conditions associated with GPX3. The function of GPX3 has been established by previous studies. Glutathione peroxidase (EC 1.11.1.9) catalyzes the reduction of hydrogen peroxide, organic hydroperoxide, and lipid peroxides by reduced glutathione and functions in the protection of cells against oxidative damage. This enzyme, found mainly in the cytosol of mammalian cells, is unusual in its content of a selenocysteine residue in its active site that is encoded by a TGA opal codon (Chambers et al., 1986). The glutathione peroxidase found in plasma is immunologically distinct from the erythrocyte and liver cytosolic enzymes (OMIM Ref. No. 138320). It also has some differences in physical and kinetic properties. Takahashi et al. (1990) isolated cDNA clones coding for plasma GPX. They found that the nucleotide sequence consisted of a 678-bp open reading frame coding for a 226-amino acid polypeptide with a molecular mass of 25,389. The amino acid sequence showed only 44% homology with human cellular GPX. Northern blot analysis showed a single transcript of 2.2 kb in the polyadenylated RNA fractions of human placenta and of a human hepatic cell line, HepG2, but not in those of human liver and endothelial cells. Takahashi et al. (1990) concluded that as the plasma enzyme contains 1 atom of selenium per subunit, the in-frame TGA observed at positions 217-219 could be assigned to selenocysteine. Chu et al. (1992) found that glutathione peroxidase-3 is expressed in kidney, lung, heart, breast, placenta, and, in the human but not the rodent, in liver as well. By Southern analysis of genomic DNA from human/hamster somatic cell hybrids, Chu (1994) mapped the GPX3 gene to chromosome 5.

Full details of the abovementioned studies are described in the following publications, the disclosure of which are hereby incorporated by reference:

Chu, F.-F.; Esworthy, R. S.; Doroshow, J. H.; Doan, K.; Liu, X.-F.: Expression of glutathione peroxidase in human liver in addition to kidney, heart, lung, and breast in human S and rodents. Blood 79:3233-3238, 1992; and Takahashi, K.; Akasaka, M.; Yamamoto, Y.; Kobayashi, C.; Mizoguchi, J.; Koyama, J. : Primary structure of human plasma glutathione peroxidase deduced from cDNA sequences. J. Biochem. 108.

Further studies establishing the function and utilities of GPX3 are found in John Hopkins OMIM database record ID 138321, and in sited publications numbered 374 and 3745-3746 listed in the bibliography section hereinbelow, which are also hereby incorporated by reference. FIG. 1 further provides a conceptual description of a novel bioinformatically detected viral gene of the present invention, referred to here as Viral Genomic Address Messenger 226 (VGAM226) viral gene, which modulates expression of respective host target genes thereof, the function and utility of which host target genes is known in the art.

VGAM226 is a novel bioinformatically detected regulatory, non protein coding, viral micro RNA (miRNA) gene. The method by which VGAM226 was detected is described hereinabove with reference to FIGS. 1-8.

VGAM226 gene, herein designated VGAM GENE, is a viral gene contained in the genome of Callitrichine Herpesvirus 3. VGAM226 host target gene, herein designated VGAM HOST TARGET GENE, is a human gene contained in the human genome.

VGAM226 gene encodes a VGAM226 precursor RNA, herein designated VGAM PRECURSOR RNA. Similar to other miRNA genes, and unlike most ordinary genes, VGAM226 precursor RNA does not encode a protein. A nucleotide sequence identical or highly similar to the nucleotide sequence of VGAM226 precursor RNA is designated SEQ ID:212, and is provided hereinbelow with reference to the sequence listing part. Nucleotide sequence SEQ ID:212 is located at position 82259 relative to the genome of Callitrichine Herpesvirus 3.

VGAM226 precursor RNA folds onto itself, forming VGAM226 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM226 folded precursor RNA into VGAM226 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 41%) nucleotide sequence of VGAM226 RNA is designated SEQ ID:2937, and is provided hereinbelow with reference to the sequence listing part.

VGAM226 host target gene, herein designated VGAM HOST TARGET GENE, encodes a corresponding messenger RNA, VGAM226 host target RNA, herein designated VGAM HOST TARGET RNA. VGAM226 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM226 RNA, herein designated VGAM RNA, binds complementarily to one or more host target binding sites located in untranslated regions of VGAM226 host target RNA, herein designated VGAM HOST TARGET RNA. This complementary binding is due to the fact that the nucleotide sequence of VGAM226 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM226 RNA, herein designated VGAM RNA, may have a different number of host target binding sites in untranslated regions of a VGAM226 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM226 RNA, herein designated VGAM RNA, to host target binding sites on VGAM226 host target RNA, herein designated VGAM HOST TARGET RNA, such as BINDING SITE I, BINDING SITE II and BINDING SITE III, inhibits translation of VGAM226 host target RNA into VGAM226 host target protein, herein designated VGAM HOST TARGET PROTEIN. VGAM host target protein is therefore outlined by a broken line.

It is appreciated that VGAM226 host target gene, herein designated VGAM HOST TARGET GENE, in fact represents a plurality of VGAM226 host target genes. The mRNA of each one of this plurality of VGAM226 host target genes comprises one or more host target binding sites, each having a nucleotide sequence which is at least partly complementary to VGAM226 RNA, herein designated VGAM RNA, and which when bound by VGAM226 RNA causes inhibition of translation of respective one or more VGAM226 host target proteins.

It is further appreciated by one skilled in the art that the mode of translational inhibition illustrated by FIG. 1 with specific reference to translational inhibition exerted by VGAM226 gene, herein designated VGAM GENE, on one or more VGAM226 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM226 is inhibition of expression of host target genes, as part of a novel viral mechanism of attacking a host. Accordingly, utilities of VGAM226 include diagnosis, prevention and treatment of viral infection by Callitrichine Herpesvirus 3. Specific functions, and accordingly utilities, of VGAM226 correlate with, and may be deduced from, the identity of the host target genes which VGAM226 binds and inhibits, and the function of these host target genes, as elaborated hereinbelow.

Nucleotide sequences of the VGAM226 precursor RNA, herein designated VGAM PRECURSOR RNA, and of the ‘diced’ VGAM226 RNA, herein designated VGAM RNA, and a schematic representation of the secondary folding of VGAM226 folded precursor RNA, herein designated VGAM FOLDED PRECURSOR RNA, of VGAM226 are further described hereinbelow with reference to Table 1.

Nucleotide sequences of host target binding sites, such as BINDING SITE-I, BINDING SITE-II and BINDING SITE-III of FIG. 1, found on VGAM226 host target RNA, and schematic representation of the complementarity of each of these host target binding sites to VGAM226 RNA, herein designated VGAM RNA, are described hereinbelow with reference to Table 2.

As mentioned hereinabove with reference to FIG. 1, a function of VGAM226 gene, herein designated VGAM is inhibition of expression of VGAM226 target genes. It is appreciated that specific functions, and accordingly utilities, of VGAM226 correlate with, and may be deduced from, the identity of the target genes which VGAM226 binds and inhibits, and the function of these target genes, as elaborated hereinbelow.

MGC1136 (Accession NM_024025) is a VGAM226 host target gene. MGC1136 BINDING SITE is HOST TARGET binding site found in the 5' untranslated region of mRNA encoded by MGC1136, corresponding to a HOST TARGET binding site such as BINDING SITE I, BINDING SITE II or BINDING SITE III. Table 2 illustrates the complementarity of the nucleotide sequences of MGC1136 BINDING SITE, designated SEQ ID:23453, to the nucleotide sequence of VGAM226 RNA, herein designated VGAM RNA, also designated SEQ ID:2937.

A function of VGAM226 is therefore inhibition of MGC1136 (Accession NM_024025). Accordingly, utilities of VGAM226 include diagnosis, prevention and treatment of diseases and clinical conditions associated with MGC1136. MGC4796 (Accession XM_029031) is another VGAM226 host target gene. MGC4796 BINDING SITE is HOST TARGET binding site found in the 3' untranslated region of mRNA encoded by MGC4796, corresponding to a HOST TARGET binding site such as BINDING SITE I, BINDING SITE II or BINDING SITE III. Table 2 illustrates the complementarity of the nucleotide sequences of MGC4796 BINDING SITE, designated SEQ ID:30826, to the nucleotide sequence of VGAM226 RNA, herein designated VGAM RNA, also designated SEQ ID:2937.

Another function of VGAM226 is therefore inhibition of MGC4796 (Accession XM_029031). Accordingly, utilities of VGAM226 include diagnosis, prevention and treatment of diseases and clinical conditions associated with MGC4796. LOC92539 (Accession XM_045632) is another VGAM226 host target gene. LOC92539 BINDING SITE is HOST TARGET binding site found in the 5' untranslated region of mRNA encoded by LOC92539, corresponding to a HOST TARGET binding site such as BINDING SITE I, BINDING SITE II or BINDING SITE III. Table 2 illustrates the complementarity of the nucleotide sequences of LOC92539 BINDING SITE, designated SEQ ID:34497, to the nucleotide sequence of VGAM226 RNA, herein designated VGAM RNA, also designated SEQ ID:2937.

Another function of VGAM226 is therefore inhibition of LOC92539 (Accession XM_045632). Accordingly, utilities of VGAM226 include diagnosis, prevention and treatment of diseases and clinical conditions associated with LOC92539. FIG. 1 further provides a conceptual description of a novel bioinformatically detected viral gene of the present invention, referred to here as Viral Genomic Address Messenger 227 (VGAM227) viral gene, which modulates expression of respective host target genes thereof, the function and utility of which host target genes is known in the art.

VGAM227 is a novel bioinformatically detected regulatory, non protein coding, viral micro RNA (miRNA) gene. The method by which VGAM227 was detected is described hereinabove with reference to FIGS. 1-8.

VGAM227 gene, herein designated VGAM GENE, is a viral gene contained in the genome of Callitrichine Herpesvirus 3. VGAM227 host target gene, herein designated VGAM HOST TARGET GENE, is a human gene contained in the human genome.

VGAM227 gene encodes a VGAM227 precursor RNA, herein designated VGAM PRECURSOR RNA. Similar to other miRNA genes, and unlike most ordinary genes, VGAM227 precursor RNA does not encode a protein. A nucleotide sequence identical or highly similar to the nucleotide sequence of VGAM227 precursor RNA is designated SEQ ID:213, and is provided hereinbelow with reference to the sequence listing part. Nucleotide sequence SEQ ID:213 is located at position 28474 relative to the genome of Callitrichine Herpesvirus 3.

VGAM227 precursor RNA folds onto itself, forming VGAM227 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM227 folded precursor RNA into VGAM227 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM227 RNA is designated SEQ ID:2938, and is provided hereinbelow with reference to the sequence listing part.

VGAM227 host target gene, herein designated VGAM HOST TARGET GENE, encodes a corresponding messenger RNA, VGAM227 host target RNA, herein designated VGAM HOST TARGET RNA. VGAM227 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM227 RNA, herein designated VGAM RNA, binds complementarily to one or more host target binding sites located in untranslated regions of VGAM227 host target RNA, herein designated VGAM HOST TARGET RNA. This complementary binding is due to the fact that the nucleotide sequence of VGAM227 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM227 RNA, herein designated VGAM RNA, may have a different number of host target binding sites in untranslated regions of a VGAM227 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM227 RNA, herein designated VGAM RNA, to host target binding sites on VGAM227 host target RNA, herein designated VGAM HOST TARGET RNA, such as BINDING SITE I, BINDING SITE II and BINDING SITE III, inhibits translation of VGAM227 host target RNA into VGAM227 host target protein, herein designated VGAM HOST TARGET PROTEIN. VGAM host target protein is therefore outlined by a broken line.

It is appreciated that VGAM227 host target gene, herein designated VGAM HOST TARGET GENE, in fact represents a plurality of VGAM227 host target genes. The mRNA of each one of this plurality of VGAM227 host target genes comprises one or more host target binding sites, each having a nucleotide sequence which is at least partly complementary to VGAM227 RNA, herein designated VGAM RNA, and which when bound by VGAM227 RNA causes inhibition of translation of respective one or more VGAM227 host target proteins.

It is further appreciated by one skilled in the art that the mode of translational inhibition illustrated by FIG. 1 with specific reference to translational inhibition exerted by VGAM227 gene, herein designated VGAM GENE, on one or more VGAM227 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM227 is inhibition of expression of host target genes, as part of a novel viral mechanism of attacking a host. Accordingly, utilities of VGAM227 include diagnosis, prevention and treatment of viral infection by Callitrichine Herpesvirus 3. Specific functions, and accordingly utilities, of VGAM227 correlate with, and may be deduced from, the identity of the host target genes which VGAM227 binds and inhibits, and the function of these host target genes, as elaborated hereinbelow.

Nucleotide sequences of the VGAM227 precursor RNA, herein designated VGAM PRECURSOR RNA, and of the 'diced' VGAM227 RNA, herein designated VGAM RNA, and a schematic representation of the secondary folding of VGAM227 folded precursor RNA, herein designated VGAM FOLDED PRECURSOR RNA, of VGAM227 are further described hereinbelow with reference to Table 1.

Nucleotide sequences of host target binding sites, such as BINDING SITE-I, BINDING SITE-II and BINDING SITE-III of FIG. 1, found on VGAM227 host target RNA, and schematic representation of the complementarity of each of these host target binding sites to VGAM227 RNA, herein designated VGAM RNA, are described hereinbelow with reference to Table 2.

As mentioned hereinabove with reference to FIG. 1, a function of VGAM227 gene, herein designated VGAM is inhibition of expression of VGAM227 target genes. It is appreciated that specific functions, and accordingly utilities, of VGAM227 correlate with, and may be deduced from, the identity of the target genes which VGAM227 binds and inhibits, and the function of these target genes, as elaborated hereinbelow.

TRIM (Accession NM_016388) is a VGAM227 host target gene. TRIM BINDING SITE is HOST TARGET binding site found in the 3' untranslated region of mRNA encoded by TRIM, corresponding to a HOST TARGET binding site such as BINDING SITE I, BINDING SITE II or BINDING SITE III. Table 2 illustrates the complementarity of the nucleotide sequences of TRIM BINDING SITE, designated SEQ ID:18532, to the nucleotide sequence of VGAM227 RNA, herein designated VGAM RNA, also designated SEQ ID:2938.

A function of VGAM227 is therefore inhibition of TRIM (Accession NM_016388), a gene which plays a role in recruiting signaling proteins to the plasma membrane upon T-cell receptor (TCR) complex activation in T cells. Accordingly, utilities of VGAM227 include diagnosis, prevention and treatment of diseases and clinical conditions associated with TRIM. The function of TRIM has been established by previous studies. T-cell activation requires stimulation of the T-cell receptor (TCR; OMIM Ref. No. 186880)-CD3 (see OMIM Ref. No. CD3Z; 186780) complex, followed by recruitment of an array of intracellular signaling proteins (e.g., GRB2 (OMIM Ref. No. 108355) and PLCG1 (OMIM Ref. No. 172420)). Mediating the interaction between the extracellular receptors and intracellular signaling pathways are adaptor proteins such as LAT (OMIM Ref. No. 602354).

Bruyns et al. (1998) purified a 29/30-kD disulfide-linked dimeric phosphoprotein, which they called TRIM (TCR-interacting molecule), that associates and comodulates with the TCR-CD3 complex in T lymphocytes. By tryptic peptide sequence analysis and touchdown PCR analysis of a T-cell cDNA library, they isolated a cDNA encoding TRIM. Sequence analysis predicted that TRIM is a 186-amino acid type III transmembrane protein containing an 8-amino acid extracellular domain, which includes a cys residue, and a 19-amino acid transmembrane region that lacks charged residues. The intracellular portion possesses 4 potential phosphorylation sites and 8 tyrosine residues, at least 3 of which may be involved in Src (OMIM Ref. No. 190090) homology 2 (SH2)-mediated interactions with other signaling proteins. Northern blot analysis detected preferential expression of an approximately 2.0-kb TRIM transcript in thymus, with weaker expression in spleen, lymph nodes, and peripheral blood leukocytes. Western blot analysis of hematopoietic cell lines detected TRIM protein in T cell lines and, to a lesser extent, in natural killer cell lines, but not in B cell lines or in a monocytic cell line. Immunofluorescence and Western blot analyses showed that TRIM is localized in the cell membrane and is associated with CD3E (OMIM Ref. No. 186830) and CD3Z. The authors found that after T-cell activation, TRIM is phosphorylated by Src kinases on tyrosine residues, then associates with PIK3R1 (OMIM Ref. No. 171833).

Full details of the abovementioned studies are described in the following publications, the disclosure of which are hereby incorporated by reference:

Bruyns, E.; Marie-Cardine, A.; Kirchgessner, H.; Sagolla, K.; Shevchenko, A.; Mann, M.; Autschbach, F.; Bensussan, A.; Meuer, S.; Schraven, B.: T cell receptor (TCR) interacting molecule (TRIM), a novel disulfide-linked dimer associated with the TCR-CD3-zeta complex, recruits intracellular signaling proteins to the plasma membrane. J. Exp. Med. 188: 561-575, 1998; and Hubener, C.; Mincheva, A.; Lichter, P.; Schraven, B.; Bruyns, E.: Genomic organization and chromosomal localization of the human gene encoding the T-cell receptor-interacting molecule.

Further studies establishing the function and utilities of TRIM are found in John Hopkins OMIM database record ID 604962, and in sited publications numbered 5002 listed in the bibliography section hereinbelow, which are also hereby incorporated by reference. FLJ22060 (Accession NM_024612) is another VGAM227 host target gene. FLJ22060 BINDING SITE is HOST TARGET binding site found in the 3' untranslated region of mRNA encoded by FLJ22060, corresponding to a HOST TARGET binding site such as BINDING SITE I, BINDING SITE II or BINDING SITE III. Table 2 illustrates the complementarity of the nucleotide sequences of FLJ22060 BINDING SITE, designated SEQ ID:23867, to the nucleotide sequence of VGAM227 RNA, herein designated VGAM RNA, also designated SEQ ID:2938.

Another function of VGAM227 is therefore inhibition of FLJ22060 (Accession NM_024612). Accordingly, utilities of VGAM227 include diagnosis, prevention and treatment of diseases and clinical conditions associated with FLJ22060. HBP1 (Accession NM_012257) is another VGAM227 host target gene. HBP1 BINDING SITE is HOST TARGET binding site found in the 3' untranslated region of mRNA encoded by HBP1, corresponding to a HOST TARGET binding site such as BINDING SITE I, BINDING SITE II or BINDING SITE III. Table 2 illustrates the complementarity of the nucleotide sequences of HBP1 BINDING SITE, designated SEQ ID:14563, to the nucleotide sequence of VGAM227 RNA, herein designated VGAM RNA, also designated SEQ ID:2938.

Another function of VGAM227 is therefore inhibition of HBP1 (Accession NM_012257). Accordingly, utilities of VGAM227 include diagnosis, prevention and treatment of diseases and clinical conditions associated with HBP1. LOC148823 (Accession NM_145278) is another VGAM227 host target gene. LOC148823 BINDING SITE is HOST TARGET binding site found in the 3' untranslated region of mRNA encoded by LOC148823, corresponding to a HOST TARGET binding site such as BINDING SITE I, BINDING SITE II or BINDING SITE III. Table 2 illustrates the complementarity of the nucleotide sequences of LOC148823 BINDING SITE, designated SEQ ID:29795, to the nucleotide sequence of VGAM227 RNA, herein designated VGAM RNA, also designated SEQ ID:2938.

Another function of VGAM227 is therefore inhibition of LOC148823 (Accession NM_145278). Accordingly, utilities of VGAM227 include diagnosis, prevention and treatment of diseases and clinical conditions associated with LOC148823. FIG. 1 further provides a conceptual description of a novel bioinformatically detected viral gene of the present invention, referred to here as Viral Genomic Address Messenger 228 (VGAM228) viral gene, which modulates expression of respective host target genes thereof, the function and utility of which host target genes is known in the art.

VGAM228 is a novel bioinformatically detected regulatory, non protein coding, viral micro RNA (miRNA) gene. The method by which VGAM228 was detected is described hereinabove with reference to FIGS. 1-8.

VGAM228 gene, herein designated VGAM GENE, is a viral gene contained in the genome of Callitrichine Herpesvirus 3. VGAM228 host target gene, herein designated VGAM HOST TARGET GENE, is a human gene contained in the human genome.

VGAM228 gene encodes a VGAM228 precursor RNA, herein designated VGAM PRECURSOR RNA. Similar to other miRNA genes, and unlike most ordinary genes, VGAM228 precursor RNA does not encode a protein. A nucleotide sequence identical or highly similar to the nucleotide sequence of VGAM228 precursor RNA is designated SEQ ID:214, and is provided hereinbelow with reference to the sequence listing part. Nucleotide sequence SEQ ID:214 is located at position 130971 relative to the genome of Callitrichine Herpesvirus 3.

VGAM228 precursor RNA folds onto itself, forming VGAM228 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM228 folded precursor RNA into VGAM228 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM228 RNA is designated SEQ ID:2939, and is provided hereinbelow with reference to the sequence listing part.

VGAM228 host target gene, herein designated VGAM HOST TARGET GENE, encodes a corresponding messenger RNA, VGAM228 host target RNA, herein designated VGAM HOST TARGET RNA. VGAM228 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM228 RNA, herein designated VGAM RNA, binds complementarily to one or more host target binding sites located in untranslated regions of VGAM228 host target RNA, herein designated VGAM HOST TARGET RNA. This complementary binding is due to the fact that the nucleotide sequence of VGAM228 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM228 RNA, herein designated VGAM RNA, may have a different number of host target binding sites in untranslated regions of a VGAM228 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM228 RNA, herein designated VGAM RNA, to host target binding sites on VGAM228 host target RNA, herein designated VGAM HOST TARGET RNA, such as BINDING SITE I, BINDING SITE II and BINDING SITE III, inhibits translation of VGAM228 host target RNA into VGAM228 host target protein, herein designated VGAM HOST TARGET PROTEIN. VGAM host target protein is therefore outlined by a broken line.

It is appreciated that VGAM228 host target gene, herein designated VGAM HOST TARGET GENE, in fact represents a plurality of VGAM228 host target genes. The mRNA of each one of this plurality of VGAM228 host target genes comprises one or more host target binding sites, each having a nucleotide sequence which is at least partly complementary to VGAM228 RNA, herein designated VGAM RNA, and which when bound by VGAM228 RNA causes inhibition of translation of respective one or more VGAM228 host target proteins.

It is further appreciated by one skilled in the art that the mode of translational inhibition illustrated by FIG. 1 with specific reference to translational inhibition exerted by VGAM228 gene, herein designated VGAM GENE, on one or more VGAM228 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM228 is inhibition of expression of host target genes, as part of a novel viral mechanism of attacking a host. Accordingly, utilities of VGAM228 include diagnosis, prevention and treatment of viral infection by Callitrichine Herpesvirus 3. Specific functions, and accordingly utilities, of VGAM228 correlate with, and may be deduced from, the identity of the host target genes which VGAM228 binds and inhibits, and the function of these host target genes, as elaborated hereinbelow.

Nucleotide sequences of the VGAM228 precursor RNA, herein designated VGAM PRECURSOR RNA, and of the 'diced' VGAM228 RNA, herein designated VGAM RNA, and a schematic representation of the secondary folding of VGAM228 folded precursor RNA, herein designated VGAM FOLDED PRECURSOR RNA, of VGAM228 are further described hereinbelow with reference to Table 1.

Nucleotide sequences of host target binding sites, such as BINDING SITE-I, BINDING SITE-II and BINDING SITE-III of FIG. 1, found on VGAM228 host target RNA, and schematic representation of the complementarity of each of these host target binding sites to VGAM228 RNA, herein designated VGAM RNA, are described hereinbelow with reference to Table 2.

As mentioned hereinabove with reference to FIG. 1, a function of VGAM228 gene, herein designated VGAM is inhibition of expression of VGAM228 target genes. It is appreciated that specific functions, and accordingly utilities, of VGAM228 correlate with, and may be deduced from, the identity of the target genes which VGAM228 binds and inhibits, and the function of these target genes, as elaborated hereinbelow.

Forkhead Box O1A (rhabdomyosarcoma) (FOXO1A, Accession NM_002015) is a VGAM228 host target gene. FOXO1A BINDING SITE is HOST TARGET binding site found in the 3' untranslated region of mRNA encoded by FOXO1A, corresponding to a HOST TARGET binding site such as BINDING SITE I, BINDING SITE II or BINDING SITE III. Table 2 illustrates the complementarity of the nucleotide sequences of FOXO1A BINDING SITE, designated SEQ ID:7760, to the nucleotide sequence of VGAM228 RNA, herein designated VGAM RNA, also designated SEQ ID:2939.

A function of VGAM228 is therefore inhibition of Forkhead Box O1A (rhabdomyosarcoma) (FOXO1A, Accession NM_002015), a gene which is a probable transcription factor. Accordingly, utilities of VGAM228 include diagnosis, prevention and treatment of diseases and clinical conditions associated with FOXO1A. The function of FOXO1A has been established by previous studies. In alveolar rhabdomyosarcoma, the translocation t (2;13)(q35; q14) is frequently found. Barr et al. (1993) determined that PAX3 (OMIM Ref. No. 606597), which had previously been found to be mutated in Waardenburg syndrome (OMIM Ref. No. 193500), was affected by this t (2;13) in alveolar rhabdomyosarcoma (OMIM Ref. No. 268220). Galili et al. (1993) isolated the chromosome 13 gene that is fused with PAX3. The rearrangement breakpoints occurred within an intron downstream of the paired box and homeodomain-encoding regions. and identified it as a member of the forkhead domain family, which encodes transcription factors containing a conserved DNA-binding motif related to the Drosophila region-specific homeotic gene 'forkhead.' The distal half of the forkhead and the C-terminal region of the FKHR gene are involved in the chimeric transcript and fusion protein. (Because of the homology to 'forkhead,' the gene was symbolized FKHR, for 'forkhead' in rhabdomyosarcoma.) See human T-cell leukemia virus enhancer factor (OMIM Ref. No. 143089) and interleukin enhancer binding factor (OMIM Ref. No. 147685) for other members of the forkhead domain family of transcription factors. Fredericks et al. (1995) demonstrated expression of a 97-kD PAX3/FKHR fusion protein in a t (2;13)-positive rhabdomyosarcoma cell line and verified that a single polypeptide contained epitopes derived from each protein. The fusion protein was localized to the nucleus in these cells, as was wildtype PAX3 in cells lacking the translocation. They found that DNA binding of the fusion protein was significantly impaired relative to that of PAX3 despite the fact that the 2 proteins had identical PAX DNA-binding domains. However, the fusion protein was a much more potent transcriptional activator than PAX3. Thus, the fusion protein may function as an oncogenic transcription factor by enhancing activation of normal PAX3 target genes.

Full details of the abovementioned studies are described in the following publications, the disclosure of which are hereby incorporated by reference:

Barr, F. G.; Galili, N.; Holick, J.; Biegel, J. A.; Rovera, G.; Emanuel, B. S.: Rearrangement of the PAX3 paired box gene in the paediatric solid tumor alveolar rhabdomyosarcoma. Nature Genet. 3:113-117, 1993; and Fredericks, W. J.; Galili, N.; Mukhopadhyay, S.; Rovera, G.; Bennicelli, J.; Barr, F. G.; Rauscher, F. J., III : The PAX3-FKHR fusion protein created by the t (2;13) translocation in alve.

Further studies establishing the function and utilities of FOXO1A are found in John Hopkins OMIM database record ID 136533, and in sited publications numbered 12164-12170, 1219 and 2126-2128 listed in the bibliography section hereinbelow, which are also hereby incorporated by reference.

HUS1 Checkpoint Homolog (S. pombe) (HUS1, Accession XM_165873) is another VGAM228 host target gene. HUS1 BINDING SITE is HOST TARGET binding site found in the 3' untranslated region of mRNA encoded by HUS1, corresponding to a HOST TARGET binding site such as BINDING SITE I, BINDING SITE II or BINDING SITE III. Table 2 illustrates the complementarity of the nucleotide sequences of HUS1 BINDING SITE, designated SEQ ID:43789, to the nucleotide sequence of VGAM228 RNA, herein designated VGAM RNA, also designated SEQ ID:2939.

Another function of VGAM228 is therefore inhibition of HUS1 Checkpoint Homolog (S. pombe) (HUS1, Accession XM_165873), a gene which May form DNA damage-responsive protein complex. Accordingly, utilities of VGAM228 include diagnosis, prevention and treatment of diseases and clinical conditions associated with HUS1. The function of HUS1 has been established by previous studies. The S. pombe 'checkpoint rad' genes hus1, rad1 (OMIM Ref. No. 603153), rad3, rad9 (OMIM Ref. No. 603761), rad17 (OMIM Ref. No. 603139), and rad26 are essential for both the incomplete DNA replication (S-M) and DNA damage checkpoints. An early step in the DNA damage checkpoint response appears to involve activation of the rad3 phosphatidylinositol 3-kinase-related (PIK-R) checkpoint kinase (see OMIM Ref. No. AT; 208900) by the other 5 checkpoint rad gene products. Kostrub et al. (1998) found that the fission yeast hus1 and rad1 proteins form a stable complex, and that the formation of this complex is dependent on rad9, suggesting that these 3 proteins may exist in a discrete complex in the absence of checkpoint activation. Hus1 is phosphorylated in response to DNA damage, and this phosphorylation requires rad3 and the other checkpoint rad genes. By searching EST databases, Kostrub et al. (1998) and Dean et al. (1998) each identified mouse and human cDNAs encoding hus1 homologs. Kostrub et al. (1998) reported that the predicted 281-amino acid human protein shares 30% and 86% identity with S. pombe hus1 and mouse Hus1, respectively. However, neither mammalian gene complemented a fission yeast hus1 mutation. Volkmer and Karnitz (1999) demonstrated that the human RAD1 and HUS1 proteins associate in a complex that interacts with a highly modified form of RAD9. They concluded that these 3 proteins are central components of a DNA damage-responsive protein complex in human cells. AU-rich elements (AREs) are cis-acting sequences typically found in 3-prime untranslated regions of many labile mRNAs. AREs either mediate rapid degradation of mRNA or inhibit its translation. Dominguez et al. (1998) identified EE2-16C, a HUS1 cDNA, among a collection of ARE-containing mRNAs.

Full details of the abovementioned studies are described in the following publications, the disclosure of which are hereby incorporated by reference:

Kostrub, C. F.; Knudsen, K.; Subramani, S.; Enoch, T.: Hus1p, a conserved fission yeast checkpoint protein, interacts with Rad1p and is phosphorylated in response to DNA damage. EMBO J. 17:2055-2066, 1998; and Volkmer, E.; Karnitz, L. M.: Human homologs of Schizosaccharomyces pombe Rad1, Hus1, and Rad9 form a DNA damage-responsive protein complex. J. Biol. Chem. 274:567-570, 1999.

Further studies establishing the function and utilities of HUS1 are found in John Hopkins OMIM database record ID 603760, and in sited publications numbered 690, 7624-762 and 2422 listed in the bibliography section hereinbelow, which are also hereby incorporated by reference. Basic, Immunoglobulin-like Variable Motif Containing (BIVM, Accession NM_017693) is another VGAM228 host target gene. BIVM BINDING SITE is HOST TARGET binding site found in the 3' untranslated region of mRNA encoded by BIVM, corresponding to a HOST TARGET binding site such as BINDING SITE I, BINDING SITE II or BINDING SITE III. Table 2 illustrates the complementarity of the nucleotide sequences of BIVM BINDING SITE, designated SEQ ID:19253, to the nucleotide sequence of VGAM228 RNA, herein designated VGAM RNA, also designated SEQ ID:2939.

Another function of VGAM228 is therefore inhibition of Basic, Immunoglobulin-like Variable Motif Containing (BIVM, Accession NM_017693). Accordingly, utilities of VGAM228 include diagnosis, prevention and treatment of diseases and clinical conditions associated with BIVM. Chromosome 6 Open Reading Frame 37 (C6orf37, Accession XM_041375) is another VGAM228 host target gene. C6orf37 BINDING SITE is HOST TARGET binding site found in the 3' untranslated region of mRNA encoded by C6orf37, corresponding to a HOST TARGET binding site such as BINDING SITE I, BINDING SITE II or BINDING SITE III. Table 2 illustrates the complementarity of the nucleotide sequences of C6orf37 BINDING SITE, designated SEQ ID:33516, to the nucleotide sequence of VGAM228 RNA, herein designated VGAM RNA, also designated SEQ ID:2939.

Another function of VGAM228 is therefore inhibition of Chromosome 6 Open Reading Frame 37 (C6orf37, Accession XM_041375). Accordingly, utilities of VGAM228 include diagnosis, prevention and treatment of diseases and clinical conditions associated with C6orf37. KIAA1615 (Accession XM_044021) is another VGAM228 host target gene. KIAA1615 BINDING SITE is HOST TARGET binding site found in the 3' untranslated region of mRNA encoded by KIAA1615, corresponding to a HOST TARGET binding site such as BINDING SITE I, BINDING SITE II or BINDING SITE III. Table 2 illustrates the complementarity of the nucleotide sequences of KIAA1615 BINDING SITE, designated SEQ ID:34089, to the nucleotide sequence of VGAM228 RNA, herein designated VGAM RNA, also designated SEQ ID:2939.

Another function of VGAM228 is therefore inhibition of KIAA1615 (Accession XM_044021). Accordingly, utilities of VGAM228 include diagnosis, prevention and treatment of diseases and clinical conditions associated with KIAA1615. p21(CDKN1A)-activated Kinase 7 (PAK7, Accession XM_045653) is another VGAM228 host target gene. PAK7 BINDING SITE is HOST TARGET binding site found in the 3' untranslated region of mRNA encoded by PAK7, corresponding to a HOST TARGET binding site such as BINDING SITE I, BINDING SITE II or BINDING SITE III. Table 2 illustrates the complementarity of the nucleotide sequences of PAK7 BINDING SITE, designated SEQ ID:34508, to the nucleotide sequence of VGAM228 RNA, herein designated VGAM RNA, also designated SEQ ID:2939.

Another function of VGAM228 is therefore inhibition of p21(CDKN1A)-activated Kinase 7 (PAK7, Accession XM_045653). Accordingly, utilities of VGAM228 include diagnosis, prevention and treatment of diseases and clinical conditions associated with PAK7. SMOC2 (Accession XM_051452) is another VGAM228 host target gene. SMOC2 BINDING SITE is HOST TARGET binding site found in the 3' untranslated region of mRNA encoded by SMOC2, corresponding to a HOST TARGET binding site such as BINDING SITE I, BINDING SITE II or BINDING SITE III. Table 2 illustrates the complementarity of the nucleotide sequences of SMOC2 BINDING SITE, designated SEQ ID:35833, to the nucleotide sequence of VGAM228 RNA, herein designated VGAM RNA, also designated SEQ ID:2939.

Another function of VGAM228 is therefore inhibition of SMOC2 (Accession XM_051452). Accordingly, utilities of VGAM228 include diagnosis, prevention and treatment of diseases and clinical conditions associated with SMOC2. LOC150372 (Accession XM_086893) is another VGAM228 host target gene. LOC150372 BINDING SITE is HOST TARGET binding site found in the 3' untranslated region of mRNA encoded by LOC150372, corresponding to a HOST TARGET binding site such as BINDING SITE I, BINDING SITE II or BINDING SITE III. Table 2 illustrates the complementarity of the nucleotide sequences of LOC150372 BINDING SITE, designated SEQ ID:38937, to the nucleotide sequence of VGAM228 RNA, herein designated VGAM RNA, also designated SEQ ID:2939.

Another function of VGAM228 is therefore inhibition of LOC150372 (Accession XM_086893). Accordingly, utilities of VGAM228 include diagnosis, prevention and treatment of diseases and clinical conditions associated with LOC150372. LOC151760 (Accession XM_098117) is another VGAM228 host target gene. LOC151760 BINDING SITE is HOST TARGET binding site found in the 5' untranslated region of mRNA encoded by LOC151760, corresponding to a HOST TARGET binding site such as BINDING SITE I, BINDING SITE II or BINDING SITE III. Table 2 illustrates the complementarity of the nucleotide sequences of LOC151760 BINDING SITE, designated SEQ ID:41388, to the nucleotide sequence of VGAM228 RNA, herein designated VGAM RNA, also designated SEQ ID:2939.

Another function of VGAM228 is therefore inhibition of LOC151760 (Accession XM_098117). Accordingly, utilities of VGAM228 include diagnosis, prevention and treatment of diseases and clinical conditions associated with LOC151760. LOC221300 (Accession XM_166322) is another VGAM228 host target gene. LOC221300 BINDING SITE is HOST TARGET binding site found in the 3' untranslated region of mRNA encoded by LOC221300, corresponding to a HOST TARGET binding site such as BINDING SITE I, BINDING SITE II or BINDING SITE III. Table 2 illustrates the complementarity of the nucleotide sequences of LOC221300 BINDING SITE, designated SEQ ID:44146, to the nucleotide sequence of VGAM228 RNA, herein designated VGAM RNA, also designated SEQ ID:2939.

Another function of VGAM228 is therefore inhibition of LOC221300 (Accession XM_166322). Accordingly, utilities of VGAM228 include diagnosis, prevention and treatment of diseases and clinical conditions associated with LOC221300. LOC221489 (Accession XM_168066) is another VGAM228 host target gene. LOC221489 BINDING SITE is HOST TARGET binding site found in the 5' untranslated region of mRNA encoded by LOC221489, corresponding to a HOST TARGET binding site such as BINDING SITE I, BINDING SITE II or BINDING SITE III. Table 2 illustrates the complementarity of the nucleotide sequences of LOC221489 BINDING SITE, designated SEQ ID:44982, to the nucleotide sequence of VGAM228 RNA, herein designated VGAM RNA, also designated SEQ ID:2939.

Another function of VGAM228 is therefore inhibition of LOC221489 (Accession XM_168066). Accordingly, utilities of VGAM228 include diagnosis, prevention and treatment of diseases and clinical conditions associated with LOC221489. FIG. 1 further provides a conceptual description of a novel bioinformatically detected viral gene of the present invention, referred to here as Viral Genomic Address Messenger 229 (VGAM229) viral gene, which modulates expression of respective host target genes thereof, the function and utility of which host target genes is known in the art.

VGAM229 is a novel bioinformatically detected regulatory, non protein coding, viral micro RNA (miRNA) gene. The method by which VGAM229 was detected is described hereinabove with reference to FIGS. 1-8.

VGAM229 gene, herein designated VGAM GENE, is a viral gene contained in the genome of Callitrichine Herpesvirus 3. VGAM229 host target gene, herein designated VGAM HOST TARGET GENE, is a human gene contained in the human genome.

VGAM229 gene encodes a VGAM229 precursor RNA, herein designated VGAM PRECURSOR RNA. Similar to other miRNA genes, and unlike most ordinary genes, VGAM229 precursor RNA does not encode a protein. A nucleotide sequence identical or highly similar to the nucleotide sequence of VGAM229 precursor RNA is designated SEQ ID:215, and is provided hereinbelow with reference to the sequence listing part. Nucleotide sequence SEQ ID:215 is located at position 61747 relative to the genome of Callitrichine Herpesvirus 3.

VGAM229 precursor RNA folds onto itself, forming VGAM229 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM229 folded precursor RNA into VGAM229 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM229 RNA is designated SEQ ID:2940, and is provided hereinbelow with reference to the sequence listing part.

VGAM229 host target gene, herein designated VGAM HOST TARGET GENE, encodes a corresponding messenger RNA, VGAM229 host target RNA, herein designated VGAM HOST TARGET RNA. VGAM229 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM229 RNA, herein designated VGAM RNA, binds complementarily to one or more host target binding sites located in untranslated regions of VGAM229 host target RNA, herein designated VGAM HOST TARGET RNA. This complementary binding is due to the fact that the nucleotide sequence of VGAM229 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM229 RNA, herein designated VGAM RNA, may have a different number of host target binding sites in untranslated regions of a VGAM229 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM229 RNA, herein designated VGAM RNA, to host target binding sites on VGAM229 host target RNA, herein designated VGAM HOST TARGET RNA, such as BINDING SITE I, BINDING SITE II and BINDING SITE III, inhibits translation of VGAM229 host target RNA into VGAM229 host target protein, herein designated VGAM HOST TARGET PROTEIN. VGAM host target protein is therefore outlined by a broken line.

It is appreciated that VGAM229 host target gene, herein designated VGAM HOST TARGET GENE, in fact represents a plurality of VGAM229 host target genes. The mRNA of each one of this plurality of VGAM229 host target genes comprises one or more host target binding sites, each having a nucleotide sequence which is at least partly complementary to VGAM229 RNA, herein designated VGAM RNA, and which when bound by VGAM229 RNA causes inhibition of translation of respective one or more VGAM229 host target proteins.

It is further appreciated by one skilled in the art that the mode of translational inhibition illustrated by FIG. 1 with specific reference to translational inhibition exerted by VGAM229 gene, herein designated VGAM GENE, on one or more VGAM229 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM229 is inhibition of expression of host target genes, as part of a novel viral mechanism of attacking a host. Accordingly, utilities of VGAM229 include diagnosis, prevention and treatment of viral infection by Callitrichine Herpesvirus 3. Specific functions, and accordingly utilities, of VGAM229 correlate with, and may be deduced from, the identity of the host target genes which VGAM229 binds and inhibits, and the function of these host target genes, as elaborated hereinbelow.

Nucleotide sequences of the VGAM229 precursor RNA, herein designated VGAM PRECURSOR RNA, and of the 'diced' VGAM229 RNA, herein designated VGAM RNA, and a schematic representation of the secondary folding of VGAM229 folded precursor RNA, herein designated VGAM FOLDED PRECURSOR RNA, of VGAM229 are further described hereinbelow with reference to Table 1.

Nucleotide sequences of host target binding sites, such as BINDING SITE-I, BINDING SITE-II and BINDING SITE-III of FIG. 1, found on VGAM229 host target RNA, and schematic representation of the complementarity of each of these host target binding sites to VGAM229 RNA, herein designated VGAM RNA, are described hereinbelow with reference to Table 2.

As mentioned hereinabove with reference to FIG. 1, a function of VGAM229 gene, herein designated VGAM is inhibition of expression of VGAM229 target genes. It is appreciated that specific functions, and accordingly utilities, of VGAM229 correlate with, and may be deduced from, the identity of the target genes which VGAM229 binds and inhibits, and the function of these target genes, as elaborated hereinbelow.

ATP-binding Cassette, Sub-family D (ALD), Member 2 (ABCD2, Accession NM_005164) is a VGAM229 host target gene. ABCD2 BINDING SITE is HOST TARGET binding site found in the 3' untranslated region of mRNA encoded by ABCD2, corresponding to a HOST TARGET binding site such as BINDING SITE I, BINDING SITE II or BINDING SITE III. Table 2 illustrates the complementarity of the nucleotide sequences of ABCD2 BINDING SITE, designated SEQ ID:11657, to the nucleotide sequence of VGAM229 RNA, herein designated VGAM RNA, also designated SEQ ID:2940.

A function of VGAM229 is therefore inhibition of ATP-binding Cassette, Sub-family D (ALD), Member 2 (ABCD2, Accession NM_005164), a gene which probable transporter. Accordingly, utilities of VGAM229 include diagnosis, prevention and treatment of diseases and clinical conditions associated with ABCD2. The function of ABCD2 has been established by previous studies. Lombard-Platet et al. (1996) described the cloning and characterization of a mouse Ald-related gene, symbolized Aldr by them, that codes for a 741-amino acid protein sharing the same half-ABC transporter structure and 66% amino acid identity with the protein that is mutant in X-linked adrenoleukodystrophy (ALD; 300100). PMP70 (OMIM Ref. No. 170995), another half-ABC transporter in the peroxisomal membrane protein, had 38% sequence identity to the mouse Aldr protein. Lombard-Platet et al. (1996) showed that the mouse Aldr protein is associated with peroxisomes. The mouse Ald and Aldr genes show overlapping but distinctive expression patterns. Interestingly, at least in mouse, Aldr is expressed at high levels in brain and adrenal, 2 organs with major involvement in adrenoleukodystrophy. Using oligonucleotide primers designed from the mouse sequence, the authors PCR-amplified 2 overlapping fragments of an 866-bp segment from human genomic DNA. This segment from the human ALDR ortholog shares 90% amino acid identity with the mouse protein. Lombard-Platet et al. (1996) speculated that the human gene may be a candidate for a modifier gene that accounts for some of the extreme phenotypic variability of ALD. The human ALDR gene was also a candidate for 1 of the complementation groups of Zellweger syndrome (see OMIM Ref. No. 214100), a genetically heterogeneous disorder of peroxisomal biogenesis. By isotopic in situ hybridization, Savary et al. (1997) mapped the ALDR gene to 12q11-q12 and its murine homolog to a region of homology of synteny on mouse chromosome 15. The mapping to chromosome 12 was confirmed by PCR analysis of a panel of whole genome radiation hybrids.

Full details of the abovementioned studies are described in the following publications, the disclosure of which are hereby incorporated by reference:

Lombard-Platet, G.; Savary, S.; Sarde, C.-O.; Mandel, J.-L.; Chimini, G.: A close relative of the adrenoleukodystrophy (ALD) gene codes for a peroxisomal protein with a specific expression pattern. Proc. Nat. Acad. Sci. 93:1265-1269, 1996; and Savary, S.; Troffer-Charlier, N.; Gyapay, G.; Mattei, M.-G.; Chimini, G.: Chromosomal localization of the adrenoleukodystrophy-related gene in man and mice. Europ. J. Hum. Genet. 5:99.

Further studies establishing the function and utilities of ABCD2 are found in John Hopkins OMIM database record ID 601081, and in sited publications numbered 1259-126 and 8796 listed in the bibliography section hereinbelow, which are also hereby incorporated by reference. Epidermal Growth Factor Receptor (erythroblastic leukemia viral (v-erb-b) Oncogene Homolog, Avian) (EGFR, Accession NM_005228) is another VGAM229 host target gene. EGFR BINDING SITE is HOST TARGET binding site found in the 3' untranslated region of mRNA encoded by EGFR, corresponding to a HOST TARGET binding site such as BINDING SITE I, BINDING SITE II or BINDING SITE III. Table 2 illustrates the complementarity of the nucleotide sequences of EGFR BINDING SITE, designated SEQ ID:11721, to the nucleotide sequence of VGAM229 RNA, herein designated VGAM RNA, also designated SEQ ID:2940.

Another function of VGAM229 is therefore inhibition of Epidermal Growth Factor Receptor (erythroblastic leukemia viral (v-erb-b) Oncogene Homolog, Avian) (EGFR, Accession NM_005228), a gene which is a receptor for egf, but also for other members of the egf family. Accordingly, utilities of VGAM229 include diagnosis, prevention and treatment of diseases and clinical conditions associated with EGFR. The function of EGFR has been established by previous studies. Maternal uniparental disomy (UPD) of chromosome 7 has been reported in approximately 10% of cases of Silver-Russell syndrome (SRS; 180860). This suggests that at least 1 gene on chromosome 7 is imprinted and involved in the pathogenesis of SRS. Wakeling et al. (1998) investigated the EGFR gene as a candidate for imprinting because the gene maps to 7p12, a region homologous to an imprinted region on mouse chromosome 11. Using a restriction fragment length polymorphism, they found, however, biallelic expression of EGFR in a range of normal human fetal tissues. Expression was also demonstrated in fibroblasts and lymphoblasts from SRS patients with maternal UPD7. Thus, no evidence that EGFR is imprinted was found, making its involvement in SRS unlikely. However, EGFR was shown to be widely expressed in the human fetus, providing evidence that it plays an important role in early development. The only gene known to be imprinted on chromosome 7 at that time was MEST, also called paternally expressed gene-1 (OMIM Ref. No. 601029), which maps to 7q32. Animal model experiments lend further support to the function of EGFR. Activation of epidermal growth factor receptor triggers mitogenic signaling in gastrointestinal mucosa, and its expression is also upregulated in colon cancers and most neoplasms. Pai et al. (2002) investigated whether prostaglandins transactivate EGFR. Pai et al. (2002) demonstrated that prostaglandin E2 (PGE2; 176804) rapidly phosphorylates EGFR and triggers the extracellular signal-regulated kinase 2 (ERK2; 176948)-mitogenic signaling pathway in normal gastric epithelial and colon cancer cell lines. Inactivation of EGFR kinase with selective inhibitors significantly reduced PGE2-induced ERK2 activation, c-fos mRNA expression, and cell proliferation. Inhibition of matrix metalloproteinases, TGFA, or c-Src (OMIM Ref. No. 190090) blocked PGE2-mediated EGFR transactivation and downstream signaling, indicating that PGE2-induced EGFR transactivation involves signaling transduced via TGF-alpha, an EGFR ligand, likely released by c-Src-activated MMPs.

It is appreciated that the abovementioned animal model for EGFR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pai, R.; Soreghan, B.; Szabo, I. L.; Pavelka, M.; Baatar, D.; Tarnawski, A. S.: Prostaglandin E2 transactivates EGF receptor: a novel mechanism for promoting colon cancer growth and gastrointestinal hypertrophy. Nature Med. 8:289-293, 2002; and Wakeling, E. L.; Abu-Amero, S. N.; Stanier, P.; Preece, M. A.; Moore, G. E.: Human EGFR, a candidate gene for the Silver-Russell syndrome, is biallelically expressed in a wide range.

Further studies establishing the function and utilities of EGFR are found in John Hopkins OMIM database record ID 131550, and in sited publications numbered 4645-4649, 369-377, 422 and 4587-4597 listed in the bibliography section hereinbelow, which are also hereby incorporated by reference. UDP-N-acetyl-alpha-D-galactosamine:polypeptide N-acetylgalactosaminyltransferase 7 (GalNAc-T7) (GALNT7, Accession NM_017423) is another VGAM229 host target gene. GALNT7 BINDING SITE is HOST TARGET binding site found in the 3' untranslated region of mRNA encoded by GALNT7, corresponding to a HOST TARGET binding site such as BINDING SITE I, BINDING SITE II or BINDING SITE III. Table 2 illustrates the complementarity of the nucleotide sequences of GALNT7 BINDING SITE, designated SEQ ID:18878, to the nucleotide sequence of VGAM229 RNA, herein designated VGAM RNA, also designated SEQ ID:2940.

Another function of VGAM229 is therefore inhibition of UDP-N-acetyl-alpha-D-galactosamine:polypeptide N-acetylgalactosaminyltransferase 7 (GalNAc-T7) (GALNT7, Accession NM_017423). Accordingly, utilities of VGAM229 include diagnosis, prevention and treatment of diseases and clinical conditions associated with GALNT7. Hypoxia-inducible Factor 1, Alpha Subunit (basic helix-loop-helix transcription factor) (HIF1A, Accession NM_001530) is another VGAM229 host target gene. HIF1A BINDING SITE is HOST TARGET binding site found in the 3' untranslated region of mRNA encoded by HIF1A, corresponding to a HOST TARGET binding site such as BINDING SITE I, BINDING SITE II or BINDING SITE III. Table 2 illustrates the complementarity of the nucleotide sequences of HIF1A BINDING SITE, designated SEQ ID:7266, to the nucleotide sequence of VGAM229 RNA, herein designated VGAM RNA, also designated SEQ ID:2940.

Another function of VGAM229 is therefore inhibition of Hypoxia-inducible Factor 1, Alpha Subunit (basic helix-loop-helix transcription factor) (HIF1A, Accession NM_001530), a gene which is a basic helix-loop-helix transcription factor and mediates transcriptional responses to hypoxia and dioxin-signaling. Accordingly, utilities of VGAM229 include diagnosis, prevention and treatment of diseases and clinical conditions associated with HIF1A. The function of HIF1A has been established by previous studies. HIF1 has a key role in cellular response to hypoxia, including the regulation of genes involved in energy metabolism, angiogenesis, and apoptosis. The alpha subunits of HIF are rapidly degraded by the proteasome under normal conditions but are stabilized by hypoxia. Cobaltous ions or iron chelators mimic hypoxia, indicating that the stimuli may interact through effects on a ferroprotein oxygen sensor. Maxwell et al. (1999) demonstrated a critical role for the von Hippel-Lindau tumor suppressor gene product VHL (OMIM Ref. No. 193300) in HIF1 regulation. In VHL-defective cells, HIF-alpha subunits were constitutively stabilized and HIF1 was activated. Reexpression of VHL restored oxygen-dependent instability. VHL and HIF-alpha subunits coimmunoprecipitated, and VHL was present in the hypoxic HIF1 DNA-binding complex. In cells exposed to iron chelation or cobaltous ions, HIF1 is dissociated from VHL. These findings indicated that the interaction between HIF1 and VHL is iron dependent and that it is necessary for the oxygen-dependent degradation of HIF-alpha subunits. Maxwell et al. (1999) suggested that constitutive HIF1 activation may underlie the angiogenic phenotype of VHL-associated tumors. Animal model experiments lend further support to the function of HIF1A. To investigate whether HIF1 is required for ventilatory responses to hypoxia, Kline et al. (2002) analyzed mice that were either wildtype or heterozygous for a loss-of-function (knockout) allele at the Hif1a locus. Although ventilatory response to acute hypoxia was not impaired in heterozygous Hif1a mice, the response was primarily mediated via vagal afferents, whereas in wildtype mice, carotid body chemoreceptors played a predominant role. When carotid bodies isolated from wildtype mice were exposed to either cyanide or hypoxia, a marked increase in sinus nerve activity was recorded. In contrast, carotid bodies from heterozygous mice responded to cyanide but not to hypoxia. Histologic analysis revealed no abnormalities of carotid body morphology in heterozygous mice. Wildtype mice exposed to hypoxia for 3 days manifested an augmented ventilatory response to a subsequent acute hypoxic challenge. In contrast, prior chronic hypoxia resulted in a diminished ventilatory response to acute hypoxia in heterozygous Hif1a mice. Thus, partial HIF1A deficiency has a dramatic effect on carotid body neural activity and ventilatory adaptation to chronic hypoxia.

It is appreciated that the abovementioned animal model for HIF1A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Maxwell, P. H.; Wiesener, M. S.; Chang, G.-W.; Clifford, S. C.; Vaux, E. C.; Cockman, M. E.; Wykoff, C. C.; Pugh, C. W.; Maher, E. R.; Ratcliffe, P. J.: The tumour suppressor protein VHL targets hypoxia-inducible factors for oxygen-dependent proteolysis. Nature 399:271-275, 1999; and Kline, D. D.; Peng, Y.-J.; Manalo, D. J.; Semenza, G. L.; Prabhakar, N. R.: Defective carotid body function and impaired ventilatory responses to chronic hypoxia in mice partially defi.

Further studies establishing the function and utilities of HIF1A are found in John Hopkins OMIM database record ID 603348, and in sited publications numbered 5343, 4366, 2691, 7997, 7998-8005, 436 and 8006-8008 listed in the bibliography section hereinbelow, which are also hereby incorporated by reference. Multiple Endocrine Neoplasia I (MEN1, Accession XM_167804) is another VGAM229 host target gene. MEN1 BINDING SITE is HOST TARGET binding site found in the 5' untranslated region of mRNA encoded by MEN1, corresponding to a HOST TARGET binding site such as BINDING SITE I, BINDING SITE II or BINDING SITE III. Table 2 illustrates the complementarity of the nucleotide sequences of MEN1 BINDING SITE, designated SEQ ID:44844, to the nucleotide sequence of VGAM229 RNA, herein designated VGAM RNA, also designated SEQ ID:2940.

Another function of VGAM229 is therefore inhibition of Multiple Endocrine Neoplasia I (MEN1, Accession XM_167804). Accordingly, utilities of VGAM229 include diagnosis, prevention and treatment of diseases and clinical conditions associated with MEN1. Myosin IB (MYO1B, Accession NM_012223) is another VGAM229 host target gene. MYO1B BINDING SITE is HOST TARGET binding site found in the 3' untranslated region of mRNA encoded by MYO1B, corresponding to a HOST TARGET binding site such as BINDING SITE I, BINDING SITE II or BINDING SITE III. Table 2 illustrates the complementarity of the nucleotide sequences of MYO1B BINDING SITE, designated SEQ ID:14523, to the nucleotide sequence of VGAM229 RNA, herein designated VGAM RNA, also designated SEQ ID:2940.

Another function of VGAM229 is therefore inhibition of Myosin IB (MYO1B, Accession NM_012223). Accordingly, utilities of VGAM229 include diagnosis, prevention and treatment of diseases and clinical conditions associated with MYO1B. Transducin (beta)-like 2 (TBL2, Accession NM_012453) is another VGAM229 host target gene. TBL2 BINDING SITE1 and TBL2 BINDING SITE2 are HOST TARGET binding sites found in untranslated regions of mRNA encoded by TBL2, corresponding to HOST TARGET binding sites such as BINDING SITE I, BINDING SITE II or BINDING SITE III. Table 2 illustrates the complementarity of the nucleotide sequences of TBL2 BINDING SITE1 and TBL2 BINDING SITE2, designated SEQ ID:14821 and SEQ ID:26867 respectively, to the nucleotide sequence of VGAM229 RNA, herein designated VGAM RNA, also designated SEQ ID:2940.

Another function of VGAM229 is therefore inhibition of Transducin (beta)-like 2 (TBL2, Accession NM_012453), a gene which is of unknown function. Accordingly, utilities of VGAM229 include diagnosis, prevention and treatment of diseases and clinical conditions associated with TBL2. The function of TBL2 has been established by previous studies. Meng et al. (1998) constructed a physical map encompassing the 1.5-Mb region of chromosome 7q11.23 that is commonly deleted in Williams-Beuren syndrome (WBS; 194050). They identified 3 genes within this region, including TBL2, which they designated WS-beta-TRP. By EST database searching, screening of a testis cDNA library, and sequencing, they cloned a TBL2 cDNA encoding a deduced 426-amino acid protein with 4 WD (or beta-transducin) repeats. TBL2 shares approximately 40% homology with a hypothetical C. elegans protein, suggesting that the gene has been conserved through evolution. Northern blot analysis detected a 2.4-kb transcript in all tissues examined, with high expression in heart, brain, placenta, skeletal muscle, and pancreas. Perez Jurado et al. (1999) cloned a TBL2 cDNA from a fetal brain cDNA library and found that it encodes a deduced 447-amino acid protein with a predicted molecular mass of 49.8 kD. They also cloned the mouse ortholog, which shares 84% sequence identity with the human protein. Northern blot analysis of human tissues detected not only the 2.4-kb transcript, but an approximately 5-kb transcript which was ubiquitously expressed at lower levels. Perez Jurado et al. (1999) also identified an alternatively spliced transcript containing an additional exon (exon 2-prime) with an inframe stop codon that encodes a deduced 75-amino acid protein with 43 amino acids identical to TBL2 at the N terminus and no known functional domain.

Full details of the abovementioned studies are described in the following publications, the disclosure of which are hereby incorporated by reference:

Meng, X.; Lu, X.; Li, Z.; Green, E. D.; Massa, H.; Trask, B. J.; Morris, C. A.; Keating, M. T.: Complete physical map of the common deletion region in Williams syndrome and identification and characterization of three novel genes. Hum. Genet. 103: 590-599, 1998; and Perez Jurado, L. A.; Wang, Y.-K.; Francke, U.; Cruces, J.: TBL2, a novel transducin family member in the WBS deletion: characterization of the complete sequence, genomic structure, tra.

Further studies establishing the function and utilities of TBL2 are found in John Hopkins OMIM database record ID 605842, and in sited publications numbered 97 and 6619 listed in the bibliography section hereinbelow, which are also hereby incorporated by reference. AUT-like 1, Cysteine Endopeptidase (S. cerevisiae) (AUTL1, Accession NM_032852) is another VGAM229 host target gene. AUTL1 BINDING SITE is HOST TARGET binding site found in the 3' untranslated region of mRNA encoded by AUTL1, corresponding to a HOST TARGET binding site such as BINDING SITE I, BINDING SITE II or BINDING SITE III. Table 2 illustrates the complementarity of the nucleotide sequences of AUTL1 BINDING SITE, designated SEQ ID:26645, to the nucleotide sequence of VGAM229 RNA, herein designated VGAM RNA, also designated SEQ ID:2940.

Another function of VGAM229 is therefore inhibition of AUT-like 1, Cysteine Endopeptidase (S. cerevisiae) (AUTL1, Accession NM_032852). Accordingly, utilities of VGAM229 include diagnosis, prevention and treatment of diseases and clinical conditions associated with AUTL1. B1 (Accession NM_014451) is another VGAM229 host target gene. B1 BINDING SITE is HOST TARGET binding site found in the 3' untranslated region of mRNA encoded by B1, corresponding to a HOST TARGET binding site such as BINDING SITE I, BINDING SITE II or BINDING SITE III. Table 2 illustrates the complementarity of the nucleotide sequences of B1 BINDING SITE, designated SEQ ID:15800, to the nucleotide sequence of VGAM229 RNA, herein designated VGAM RNA, also designated SEQ ID:2940.

Another function of VGAM229 is therefore inhibition of B1 (Accession NM_014451). Accordingly, utilities of VGAM229 include diagnosis, prevention and treatment of diseases and clinical conditions associated with B1. BCL2-associated Athanogene 5 (BAG5, Accession NM_004873) is another VGAM229 host target gene. BAG5 BINDING SITE is HOST TARGET binding site found in the 3' untranslated region of mRNA encoded by BAG5, corresponding to a HOST TARGET binding site such as BINDING SITE I, BINDING SITE II or BINDING SITE III. Table 2 illustrates the complementarity of the nucleotide sequences of BAG5 BINDING SITE, designated SEQ ID:11305, to the nucleotide sequence of VGAM229 RNA, herein designated VGAM RNA, also designated SEQ ID:2940.

Another function of VGAM229 is therefore inhibition of BCL2-associated Athanogene 5 (BAG5, Accession NM_004873). Accordingly, utilities of VGAM229 include diagnosis, prevention and treatment of diseases and clinical conditions associated with BAG5. CDK5 Regulatory Subunit Associated Protein 3 (CDK5RAP3, Accession NM_025197) is another VGAM229 host target gene. CDK5RAP3 BINDING SITE is HOST TARGET binding site found in the 5' untranslated region of mRNA encoded by CDK5RAP3, corresponding to a HOST TARGET binding site such as BINDING SITE I, BINDING SITE II or BINDING SITE III. Table 2 illustrates the complementarity of the nucleotide sequences of CDK5RAP3 BINDING SITE, designated SEQ ID:24851, to the nucleotide sequence of VGAM229 RNA, herein designated VGAM RNA, also designated SEQ ID:2940.

Another function of VGAM229 is therefore inhibition of CDK5 Regulatory Subunit Associated Protein 3 (CDK5RAP3, Accession NM_025197). Accordingly, utilities of VGAM229 include diagnosis, prevention and treatment of diseases and clinical conditions associated with CDK5RAP3. DEAD/H (Asp-Glu-Ala-Asp/His) Box Polypeptide 28 (DDX28, Accession NM_018380) is another VGAM229 host target gene. DDX28 BINDING SITE is HOST TARGET binding site found in the 5' untranslated region of mRNA encoded by DDX28, corresponding to a HOST TARGET binding site such as BINDING SITE I, BINDING SITE II or BINDING SITE III. Table 2 illustrates the complementarity of the nucleotide sequences of DDX28 BINDING SITE, designated SEQ ID:20410, to the nucleotide sequence of VGAM229 RNA, herein designated VGAM RNA, also designated SEQ ID:2940.

Another function of VGAM229 is therefore inhibition of DEAD/H (Asp-Glu-Ala-Asp/His) Box Polypeptide 28 (DDX28, Accession NM_018380). Accordingly, utilities of VGAM229 include diagnosis, prevention and treatment of diseases and clinical conditions associated with DDX28. DKFZP434L187 (Accession XM_044070) is another VGAM229 host target gene. DKFZP434L187 BINDING SITE is HOST TARGET binding site found in the 5' untranslated region of mRNA encoded by DKFZP434L187, corresponding to a HOST TARGET binding site such as BINDING SITE I, BINDING SITE II or BINDING SITE III. Table 2 illustrates the complementarity of the nucleotide sequences of DKFZP434L187 BINDING SITE, designated SEQ ID:34117, to the nucleotide sequence of VGAM229 RNA, herein designated VGAM RNA, also designated SEQ ID:2940.

Another function of VGAM229 is therefore inhibition of DKFZP434L187 (Accession XM_044070). Accordingly, utilities of VGAM229 include diagnosis, prevention and treatment of diseases and clinical conditions associated with DKFZP434L187. FLJ13322 (Accession NM_024722) is another VGAM229 host target gene. FLJ13322 BINDING SITE is HOST TARGET binding site found in the 5' untranslated region of mRNA encoded by FLJ13322, corresponding to a HOST TARGET binding site such as BINDING SITE I, BINDING SITE II or BINDING SITE III. Table 2 illustrates the complementarity of the nucleotide sequences of FLJ13322 BINDING SITE, designated SEQ ID:24059, to the nucleotide sequence of VGAM229 RNA, herein designated VGAM RNA, also designated SEQ ID:2940.

Another function of VGAM229 is therefore inhibition of FLJ13322 (Accession NM_024722). Accordingly, utilities of VGAM229 include diagnosis, prevention and treatment of diseases and clinical conditions associated with FLJ13322. FLJ14564 (Accession XM_084459) is another VGAM229 host target gene. FLJ14564 BINDING SITE is HOST TARGET binding site found in the 3' untranslated region of mRNA encoded by FLJ14564, corresponding to a HOST TARGET binding site such as BINDING SITE I, BINDING SITE II or BINDING SITE III. Table 2 illustrates the complementarity of the nucleotide sequences of FLJ14564 BINDING SITE, designated SEQ ID:37593, to the nucleotide sequence of VGAM229 RNA, herein designated VGAM RNA, also designated SEQ ID:2940.

Another function of VGAM229 is therefore inhibition of FLJ14564 (Accession XM_084459). Accordingly, utilities of VGAM229 include diagnosis, prevention and treatment of diseases and clinical conditions associated with FLJ14564. FLJ20086 (Accession NM_017661) is another VGAM229 host target gene. FLJ20086 BINDING SITE is HOST TARGET binding site found in the 3' untranslated region of mRNA encoded by FLJ20086, corresponding to a HOST TARGET binding site such as BINDING SITE I, BINDING SITE II or BINDING SITE III. Table 2 illustrates the complementarity of the nucleotide sequences of FLJ20086 BINDING SITE, designated SEQ ID:19188, to the nucleotide sequence of VGAM229 RNA, herein designated VGAM RNA, also designated SEQ ID:2940.

Another function of VGAM229 is therefore inhibition of FLJ20086 (Accession NM_017661). Accordingly, utilities of VGAM229 include diagnosis, prevention and treatment of diseases and clinical conditions associated with FLJ20086. FLJ20445 (Accession NM_017824) is another VGAM229 host target gene. FLJ20445 BINDING SITE is HOST TARGET binding site found in the 3' untranslated region of mRNA encoded by FLJ20445, corresponding to a HOST TARGET binding site such as BINDING SITE I, BINDING SITE II or BINDING SITE III. Table 2 illustrates the complementarity of the nucleotide sequences of FLJ20445 BINDING SITE, designated SEQ ID:19480, to the nucleotide sequence of VGAM229 RNA, herein designated VGAM RNA, also designated SEQ ID:2940.

Another function of VGAM229 is therefore inhibition of FLJ20445 (Accession NM_017824). Accordingly, utilities of VGAM229 include diagnosis, prevention and treatment of diseases and clinical conditions associated with FLJ20445. G Protein-coupled Receptor Kinase-interactor 2 (GIT2, Accession NM_139201) is another VGAM229 host target gene. GIT2 BINDING SITE is HOST TARGET binding site found in the 3' untranslated region of mRNA encoded by GIT2, corresponding to a HOST TARGET binding site such as BINDING SITE I, BINDING SITE II or BINDING SITE III. Table 2 illustrates the complementarity of the nucleotide sequences of GIT2 BINDING SITE, designated SEQ ID:29212, to the nucleotide sequence of VGAM229 RNA, herein designated VGAM RNA, also designated SEQ ID:2940.

Another function of VGAM229 is therefore inhibition of G Protein-coupled Receptor Kinase-interactor 2 (GIT2, Accession NM_139201). Accordingly, utilities of VGAM229 include diagnosis, prevention and treatment of diseases and clinical conditions associated with GIT2. H2A Histone Family, Member J (H2AFJ, Accession NM_018267) is another VGAM229 host target gene. H2AFJ BINDING SITE is HOST TARGET binding site found in the 3' untranslated region of mRNA encoded by H2AFJ, corresponding to a HOST TARGET binding site such as BINDING SITE I, BINDING SITE II or BINDING SITE III. Table 2 illustrates the complementarity of the nucleotide sequences of H2AFJ BINDING SITE, designated SEQ ID:20236, to the nucleotide sequence of VGAM229 RNA, herein designated VGAM RNA, also designated SEQ ID:2940.

Another function of VGAM229 is therefore inhibition of H2A Histone Family, Member J (H2AFJ, Accession NM_018267). Accordingly, utilities of VGAM229 include diagnosis, prevention and treatment of diseases and clinical conditions associated with H2AFJ. NPD009 (Accession XM_170795) is another VGAM229 host target gene. NPD009 BINDING SITE is HOST TARGET binding site found in the 5' untranslated region of mRNA encoded by NPD009, corresponding to a HOST TARGET binding site such as BINDING SITE I, BINDING SITE II or BINDING SITE III. Table 2 illustrates the complementarity of the nucleotide sequences of NPD009 BINDING SITE, designated SEQ ID:45562, to the nucleotide sequence of VGAM229 RNA, herein designated VGAM RNA, also designated SEQ ID:2940.

Another function of VGAM229 is therefore inhibition of NPD009 (Accession XM_170795). Accordingly, utilities of VGAM229 include diagnosis, prevention and treatment of diseases and clinical conditions associated with NPD009. Oxysterol Binding Protein-like 2 (OSBPL2, Accession NM_144498) is another VGAM229 host target gene. OSBPL2 BINDING SITE1 and OSBPL2 BINDING SITE2 are HOST TARGET binding sites found in untranslated regions of mRNA encoded by OSBPL2, corresponding to HOST TARGET binding sites such as BINDING SITE I, BINDING SITE II or BINDING SITE III. Table 2 illustrates the complementarity of the nucleotide sequences of OSBPL2 BINDING SITE1 and OSBPL2 BINDING SITE2, designated SEQ ID:29317 and SEQ ID:16849 respectively, to the nucleotide sequence of VGAM229 RNA, herein designated VGAM RNA, also designated SEQ ID:2940.

Another function of VGAM229 is therefore inhibition of Oxysterol Binding Protein-like 2 (OSBPL2, Accession NM_144498). Accordingly, utilities of VGAM229 include diagnosis, prevention and treatment of diseases and clinical conditions associated with OSBPL2. Ubiquitin-conjugating Enzyme E2G 1 (UBC7 homolog, C. elegans) (UBE2G1, Accession NM_003342) is another VGAM229 host target gene. UBE2G1 BINDING SITE is HOST TARGET binding site found in the 3' untranslated region of mRNA encoded by UBE2G1, corresponding to a HOST TARGET binding site such as BINDING SITE I, BINDING SITE II or BINDING SITE III. Table 2 illustrates the complementarity of the nucleotide sequences of UBE2G1 BINDING SITE, designated SEQ ID:9348, to the nucleotide sequence of VGAM229 RNA, herein designated VGAM RNA, also designated SEQ ID:2940.

Another function of VGAM229 is therefore inhibition of Ubiquitin-conjugating Enzyme E2G 1 (UBC7 homolog, C. elegans) (UBE2G1, Accession NM_003342). Accordingly, utilities of VGAM229 include diagnosis, prevention and treatment of diseases and clinical conditions associated with UBE2G1. LOC133418 (Accession XM_059649) is another VGAM229 host target gene. LOC133418 BINDING SITE is HOST TARGET binding site found in the 3' untranslated region of mRNA encoded by LOC133418, corresponding to a HOST TARGET binding site such as BINDING SITE I, BINDING SITE II or BINDING SITE III. Table 2 illustrates the complementarity of the nucleotide sequences of LOC133418 BINDING SITE, designated SEQ ID:37037, to the nucleotide sequence of VGAM229 RNA, herein designated VGAM RNA, also designated SEQ ID:2940.

Another function of VGAM229 is therefore inhibition of LOC133418 (Accession XM_059649). Accordingly, utilities of VGAM229 include diagnosis, prevention and treatment of diseases and clinical conditions associated with LOC133418. LOC143098 (Accession XM_084421) is another VGAM229 host target gene. LOC143098 BINDING SITE is HOST TARGET binding site found in the 5' untranslated region of mRNA encoded by LOC143098, corresponding to a HOST TARGET binding site such as BINDING SITE I, BINDING SITE II or BINDING SITE III. Table 2 illustrates the complementarity of the nucleotide sequences of LOC143098 BINDING SITE, designated SEQ ID:37575, to the nucleotide sequence of VGAM229 RNA, herein designated VGAM RNA, also designated SEQ ID:2940.

Another function of VGAM229 is therefore inhibition of LOC143098 (Accession XM_084421). Accordingly, utilities of VGAM229 include diagnosis, prevention and treatment of diseases and clinical conditions associated with LOC143098. LOC145622 (Accession XM_085186) is another VGAM229 host target gene. LOC145622 BINDING SITE is HOST TARGET binding site found in the 3' untranslated region of mRNA encoded by LOC145622, corresponding to a HOST TARGET binding site such as BINDING SITE I, BINDING SITE II or BINDING SITE III. Table 2 illustrates the complementarity of the nucleotide sequences of LOC145622 BINDING SITE, designated SEQ ID:37910, to the nucleotide sequence of VGAM229 RNA, herein designated VGAM RNA, also designated SEQ ID:2940.

Another function of VGAM229 is therefore inhibition of LOC145622 (Accession XM_085186). Accordingly, utilities of VGAM229 include diagnosis, prevention and treatment of diseases and clinical conditions associated with LOC145622. LOC148195 (Accession XM_097419) is another VGAM229 host target gene. LOC148195 BINDING SITE is HOST TARGET binding site found in the 3' untranslated region of mRNA encoded by LOC148195, corresponding to a HOST TARGET binding site such as BINDING SITE I, BINDING SITE II or BINDING SITE III. Table 2 illustrates the complementarity of the nucleotide sequences of LOC148195 BINDING SITE, designated SEQ ID:40872, to the nucleotide sequence of VGAM229 RNA, herein designated VGAM RNA, also designated SEQ ID:2940.

Another function of VGAM229 is therefore inhibition of LOC148195 (Accession XM_097419). Accordingly, utilities of VGAM229 include diagnosis, prevention and treatment of diseases and clinical conditions associated with LOC148195. LOC221510 (Accession XM_165807) is another VGAM229 host target gene. LOC221510 BINDING SITE is HOST TARGET binding site found in the 3' untranslated region of mRNA encoded by LOC221510, corresponding to a HOST TARGET binding site such as BINDING SITE I, BINDING SITE II or BINDING SITE III. Table 2 illustrates the complementarity of the nucleotide sequences of LOC221510 BINDING SITE, designated SEQ ID:43769, to the nucleotide sequence of VGAM229 RNA, herein designated VGAM RNA, also designated SEQ ID:2940.

Another function of VGAM229 is therefore inhibition of LOC221510 (Accession XM_165807). Accordingly, utilities of VGAM229 include diagnosis, prevention and treatment of diseases and clinical conditions associated with LOC221510. FIG. 1 further provides a conceptual description of a novel bioinformatically detected viral gene of the present invention, referred to here as Viral Genomic Address Messenger 230 (VGAM230) viral gene, which modulates expression of respective host target genes thereof, the function and utility of which host target genes is known in the art.

VGAM230 is a novel bioinformatically detected regulatory, non protein coding, viral micro RNA (miRNA) gene. The method by which VGAM230 was detected is described hereinabove with reference to FIGS. 1-8.

VGAM230 gene, herein designated VGAM GENE, is a viral gene contained in the genome of Callitrichine Herpesvirus 3. VGAM230 host target gene, herein designated VGAM HOST TARGET GENE, is a human gene contained in the human genome.

VGAM230 gene encodes a VGAM230 precursor RNA, herein designated VGAM PRECURSOR RNA. Similar to other miRNA genes, and unlike most ordinary genes, VGAM230 precursor RNA does not encode a protein. A nucleotide sequence identical or highly similar to the nucleotide sequence of VGAM230 precursor RNA is designated SEQ ID:216, and is provided hereinbelow with reference to the sequence listing part. Nucleotide sequence SEQ ID:216 is located at position 57457 relative to the genome of Callitrichine Herpesvirus 3.

VGAM230 precursor RNA folds onto itself, forming VGAM230 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM230 folded precursor RNA into VGAM230 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM230 RNA is designated SEQ ID:2941, and is provided hereinbelow with reference to the sequence listing part.

VGAM230 host target gene, herein designated VGAM HOST TARGET GENE, encodes a corresponding messenger RNA, VGAM230 host target RNA, herein designated VGAM HOST TARGET RNA. VGAM230 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM230 RNA, herein designated VGAM RNA, binds complementarily to one or more host target binding sites located in untranslated regions of VGAM230 host target RNA, herein designated VGAM HOST TARGET RNA. This complementary binding is due to the fact that the nucleotide sequence of VGAM230 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM230 RNA, herein designated VGAM RNA, may have a different number of host target binding sites in untranslated regions of a VGAM230 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM230 RNA, herein designated VGAM RNA, to host target binding sites on VGAM230 host target RNA, herein designated VGAM HOST TARGET RNA, such as BINDING SITE I, BINDING SITE II and BINDING SITE III, inhibits translation of VGAM230 host target RNA into VGAM230 host target protein, herein designated VGAM HOST TARGET PROTEIN. VGAM host target protein is therefore outlined by a broken line.

It is appreciated that VGAM230 host target gene, herein designated VGAM HOST TARGET GENE, in fact represents a plurality of VGAM230 host target genes. The mRNA of each one of this plurality of VGAM230 host target genes comprises one or more host target binding sites, each having a nucleotide sequence which is at least partly complementary to VGAM230 RNA, herein designated VGAM RNA, and which when bound by VGAM230 RNA causes inhibition of translation of respective one or more VGAM230 host target proteins.

It is further appreciated by one skilled in the art that the mode of translational inhibition illustrated by FIG. 1 with specific reference to translational inhibition exerted by VGAM230 gene, herein designated VGAM GENE, on one or more VGAM230 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM230 is inhibition of expression of host target genes, as part of a novel viral mechanism of attacking a host. Accordingly, utilities of VGAM230 include diagnosis, prevention and treatment of viral infection by Callitrichine Herpesvirus 3. Specific functions, and accordingly utilities, of VGAM230 correlate with, and may be deduced from, the identity of the host target genes which VGAM230 binds and inhibits, and the function of these host target genes, as elaborated hereinbelow.

Nucleotide sequences of the VGAM230 precursor RNA, herein designated VGAM PRECURSOR RNA, and of the 'diced' VGAM230 RNA, herein designated VGAM RNA, and a schematic representation of the secondary folding of VGAM230 folded precursor RNA, herein designated VGAM FOLDED PRECURSOR RNA, of VGAM230 are further described hereinbelow with reference to Table 1.

Nucleotide sequences of host target binding sites, such as BINDING SITE-I, BINDING SITE-II and BINDING SITE-III of FIG. 1, found on VGAM230 host target RNA, and schematic representation of the complementarity of each of these host target binding sites to VGAM230 RNA, herein designated VGAM RNA, are described hereinbelow with reference to Table 2.

As mentioned hereinabove with reference to FIG. 1, a function of VGAM230 gene, herein designated VGAM is inhibition of expression of VGAM230 target genes. It is appreciated that specific functions, and accordingly utilities, of VGAM230 correlate with, and may be deduced from, the identity of the target genes which VGAM230 binds and inhibits, and the function of these target genes, as elaborated hereinbelow.

Ciliary Neurotrophic Factor Receptor (CNTFR, Accession NM_001842) is a VGAM230 host target gene. CNTFR BINDING SITE is HOST TARGET binding site found in the 3' untranslated region of mRNA encoded by CNTFR, corresponding to a HOST TARGET binding site such as BINDING SITE I, BINDING SITE II or BINDING SITE III. Table 2 illustrates the complementarity of the nucleotide sequences of CNTFR BINDING SITE, designated SEQ ID:7577, to the nucleotide sequence of VGAM230 RNA, herein designated VGAM RNA, also designated SEQ ID:2941.

A function of VGAM230 is therefore inhibition of Ciliary Neurotrophic Factor Receptor (CNTFR, Accession NM_001842), a gene which is critical for the developing nervous system. Accordingly, utilities of VGAM230 include diagnosis, prevention and treatment of diseases and clinical conditions associated with CNTFR. The function of CNTFR has been established by previous studies. Davis et al. (1991) used the 'tagged-ligand panning' procedure to clone a receptor for ciliary neurotrophic factor (OMIM Ref. No. 118945). This receptor is expressed exclusively in the nervous system and skeletal muscle. The CNTF receptor was found to have a structure unrelated to the receptors utilized by the nerve growth factor family of neurotrophic molecules, but instead is most homologous to the receptor for a cytokine, interleukin-6 (IL6; 147620). This similarity suggested that the CNTF receptor, like the IL6 receptor, requires a second, signal-transducing component. In contrast to all known receptors, the CNTF receptor is anchored to cell membranes by a glycosyl-phosphatidylinositol linkage. Donaldson et al. (1993) mapped the CNTFR gene to chromosome 9 by PCR on a panel of human/CHO somatic cell hybrids and regionalized the assignment to 9p13 by PCR on a panel of radiation hybrids By interspecific backcross linkage analysis, Pilz et al. (1995) mapped the Cntfr gene to mouse chromosome 4. By fluorescence in situ hybridization, Valenzuela et al. (1995) mapped the CNTFR gene to 9p13, and by interspecific backcross linkage analysis, they mapped the gene to mouse chromosome 4 in a region of known homology of synteny to 9p. Valenzuela et al. (1995) found that the human and mouse genes have an identical intron/exon structure that correlates well with the domain structure of the protein. The signal peptide and the immunoglobulin-like domain are each encoded by a single exon, the cytokine receptor-like domain is distributed among 4 exons, and the C-terminal glycosylphosphatidylinositol recognition domain is encoded by the final coding exon. The position of the introns within the cytokine receptor-like domain corresponds to that found in other members of the cytokine receptor superfamily Full details of the abovementioned studies are described in the following publications, the disclosure of which are hereby incorporated by reference:

Davis, S.; Aldrich, T. H.; Valenzuela, D. M.; Wong, V.; Furth, M. E.; Squinto, S. P.; Yancopoulos, G. D.: The receptor for ciliary neurotrophic factor. Science 253:59-63, 1991; and Pilz, A.; Woodward, K.; Povey, S.; Abbott, C.: Comparative mapping of 50 human chromosome 9 loci in the laboratory mouse. Genomics 25:139-149, 1995.

Further studies establishing the function and utilities of CNTFR are found in John Hopkins OMIM database record ID 118946, and in sited publications numbered 1462, 146 and 1464 listed in the bibliography section hereinbelow, which are also hereby incorporated by reference. Desmocollin 3 (DSC3, Accession NM_001941) is another VGAM230 host target gene. DSC3 BINDING SITE1 and DSC3 BINDING SITE2 are HOST TARGET binding sites found in untranslated regions of mRNA encoded by DSC3, corresponding to HOST TARGET binding sites such as BINDING SITE I, BINDING SITE II or BINDING SITE III. Table 2 illustrates the complementarity of the nucleotide sequences of DSC3 BINDING SITE1 and DSC3 BINDING SITE2, designated SEQ ID:7654 and SEQ ID:23665 respectively, to the nucleotide sequence of VGAM230 RNA, herein designated VGAM RNA, also designated SEQ ID:2941.

Another function of VGAM230 is therefore inhibition of Desmocollin 3 (DSC3, Accession NM_001941), a gene which is a component of intercellular desmosome junctions. Accordingly, utilities of VGAM230 include diagnosis, prevention and treatment of diseases and clinical conditions associated with DSC3. The function of DSC3 has been established by previous studies. From a bladder carcinoma cell line cDNA library, Kawamura et al. (1994) cloned a human cDNA encoding for a novel transmembrane protein. Sequence analysis revealed an open reading frame of 2,691 bp encoding a protein of 896 amino acids. Sequence comparisons showed significant homology to desmocollins, intercellular adhesion molecules belonging to the cadherin superfamily. The protein consisted of a signal peptide of 30 amino acids, a precursor segment of 105 amino acids, and a mature protein of 761 amino acids. Antibodies recognizing the predicted mature adhesion molecule of the protein stained antigens along the cell boundaries of normal human keratinocytes resembling the pattern of desmosome localization. Kawamura et al. (1994) concluded that the clone represented a new member of the desmocollin family and tentatively referred to it as desmocollin type 4. King et al. (1995) used the designation DSC3 for a gene encoding a desmocollin present in human foreskin epidermis and stated that the gene is identical to that encoding the desmocollin isolated from a bladder carcinoma cell line and called DSC4 by Kawamura et al. (1994). They likewise mapped the gene to chromosome 18 by PCR analysis of rodent/human somatic cell hybrids. They stated that the cDNA sequence showed 67% amino acid identity with the original human desmocollin, designated DSC2, and 52% amino acid identity with DSC1. By in situ hybridization studies, they showed that DSC1 was not present in any of the nonkeratinizing human epithelia, such as buccal mucosa, cervix, and esophagus, whereas all these internal epithelia expressed DSC2 and DSC3 and were present in most of the living layers of tissues, including the basal layers.

Full details of the abovementioned studies are described in the following publications, the disclosure of which are hereby incorporated by reference:

Kawamura, K.; Watanabe, K.; Suzuki, T.; Yamakawa, T.; Kamiyama, T.; Nakagawa, H.; Tsurufuji, S.: cDNA cloning and expression of a novel human desmocollin. J. Biol. Chem. 269:26295-26302, 1994; and King, I. A.; Sullivan, K. H.; Bennett, R., Jr.; Buxton, R. S.: The desmocollins of human foreskin epidermis: identification and chromosomal assignment of a third gene and expression p.

Further studies establishing the function and utilities of DSC3 are found in John Hopkins OMIM database record ID 600271, and in sited publications numbered 7347-7349 listed in the bibliography section hereinbelow, which are also hereby incorporated by reference. Protocadherin Alpha 9 (PCDHA9, Accession NM_014005) is another VGAM230 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:15209, to the nucleotide sequence of VGAM230 RNA, herein designated VGAM RNA, also designated SEQ ID:2941.

Another function of VGAM230 is therefore inhibition of Protocadherin Alpha 9 (PCDHA9, Accession NM_014005), a gene which is a calcium-dependent cell-adhesion protein. Accordingly, utilities of VGAM230 include diagnosis, prevention and treatment of diseases and clinical conditions associated with PCDHA9. The function of PCDHA9 and its association with various diseases and clinical conditions, has been established by previous studies, as described hereinabove with reference to VGAM71. RPP30 (Accession NM_006413) is another VGAM230 host target gene. RPP30 BINDING SITE is HOST TARGET binding site found in the 3' untranslated region of mRNA encoded by RPP30, corresponding to a HOST TARGET binding site such as BINDING SITE I, BINDING SITE II or BINDING SITE III. Table 2 illustrates the complementarity of the nucleotide sequences of RPP30 BINDING SITE, designated SEQ ID:13124, to the nucleotide sequence of VGAM230 RNA, herein designated VGAM RNA, also designated SEQ ID:2941.

Another function of VGAM230 is therefore inhibition of RPP30 (Accession NM_006413), a gene which is a component of ribonuclease p that processes 5' ends of precursor tRNAs. Accordingly, utilities of VGAM230 include diagnosis, prevention and treatment of diseases and clinical conditions associated with RPP30. The function of RPP30 has been established by previous studies. By biochemical purification of RNase P, micropeptide sequence analysis, and EST database searching, Eder et al. (1997) obtained a cDNA encoding RPP30. The deduced protein contains 268 amino acids with a predicted molecular mass of nearly 30 kD. Jarrous et al. (1998) determined that RPP30 is a target for antisera from systemic sclerosis patients. Immunoprecipitation analysis showed that polyclonal antibodies raised against RPP20, RPP30, RPP38, or RPP40 interact with RNase P from HeLa cells.

Full details of the abovementioned studies are described in the following publications, the disclosure of which are hereby incorporated by reference:

Eder, P. S.; Kekuda, R.; Stolc, V.; Altman, S.: Characterization of two scleroderma autoimmune antigens that copurify with human ribonuclease P. Proc. Nat. Acad. Sci. 94:1101-1106, 1997; and Jarrous, N.; Eder, P. S.; Guerrier-Takada, C.; Hoog, C.; Altman, S.: Autoantigenic properties of some protein subunits of catalytically active complexes of human ribonuclease P. RNA 4:407.

Further studies establishing the function and utilities of RPP30 are found in John Hopkins OMIM database record ID 606115, and in sited publications numbered 74 and 897 listed in the bibliography section hereinbelow, which are also hereby incorporated by reference. AFAP (Accession NM_021638) is another VGAM230 host target gene. AFAP BINDING SITE is HOST TARGET binding site found in the 3' untranslated region of mRNA encoded by AFAP, corresponding to a HOST TARGET binding site such as BINDING SITE I, BINDING SITE II or BINDING SITE III. Table 2 illustrates the complementarity of the nucleotide sequences of AFAP BINDING SITE, designated SEQ ID:22291, to the nucleotide sequence of VGAM230 RNA, herein designated VGAM RNA, also designated SEQ ID:2941.

Another function of VGAM230 is therefore inhibition of AFAP (Accession NM_021638). Accordingly, utilities of VGAM230 include diagnosis, prevention and treatment of diseases and clinical conditions associated with AFAP. FLJ10583 (Accession NM_018148) is another VGAM230 host target gene. FLJ10583 BINDING SITE is HOST TARGET binding site found in the 3" untranslated region of mRNA encoded by FLJ10583, corresponding to a HOST TARGET binding site such as BINDING SITE I, BINDING SITE II or BINDING SITE III. Table 2 illustrates the complementarity of the nucleotide sequences of FLJ10583 BINDING SITE, designated SEQ ID:19950, to the nucleotide sequence of VGAM230 RNA, herein designated VGAM RNA, also designated SEQ ID:2941.

Another function of VGAM230 is therefore inhibition of FLJ10583 (Accession NM_018148). Accordingly, utilities of VGAM230 include diagnosis, prevention and treatment of diseases and clinical conditions associated with FLJ10583. FLJ20208 (Accession NM_017712) is another VGAM230 host target gene. FLJ20208 BINDING SITE is HOST TARGET binding site found in the 3' untranslated region of mRNA encoded by FLJ20208, corresponding to a HOST TARGET binding site such as BINDING SITE I, BINDING SITE II or BINDING SITE III. Table 2 illustrates the complementarity of the nucleotide sequences of FLJ20208 BINDING SITE, designated SEQ ID:19292, to the nucleotide sequence of VGAM230 RNA, herein designated VGAM RNA, also designated SEQ ID:2941.

Another function of VGAM230 is therefore inhibition of FLJ20208 (Accession NM_017712). Accordingly, utilities of VGAM230 include diagnosis, prevention and treatment of diseases and clinical conditions associated with FLJ20208. FLJ23519 (Accession NM_032240) is another VGAM230 host target gene. FLJ23519 BINDING SITE is HOST TARGET binding site found in the 3' untranslated region of mRNA encoded by FLJ23519, corresponding to a HOST TARGET binding site such as BINDING SITE I, BINDING SITE II or BINDING SITE III. Table 2 illustrates the complementarity of the nucleotide sequences of FLJ23519 BINDING SITE, designated SEQ ID:25977, to the nucleotide sequence of VGAM230 RNA, herein designated VGAM RNA, also designated SEQ ID:2941.

Another function of VGAM230 is therefore inhibition of FLJ23519 (Accession NM_032240). Accordingly, utilities of VGAM230 include diagnosis, prevention and treatment of diseases and clinical conditions associated with FLJ23519. TADA3L (Accession NM_133480) is another VGAM230 host target gene. TADA3L BINDING SITE is HOST TARGET binding site found in the 3' untranslated region of mRNA encoded by TADA3L, corresponding to a HOST TARGET binding site such as BINDING SITE I, BINDING SITE II or BINDING SITE III. Table 2 illustrates the complementarity of the nucleotide sequences of TADA3L BINDING SITE, designated SEQ ID:28548, to the nucleotide sequence of VGAM230 RNA, herein designated VGAM RNA, also designated SEQ ID:2941.

Another function of VGAM230 is therefore inhibition of TADA3L (Accession NM_133480). Accordingly, utilities of VGAM230 include diagnosis, prevention and treatment of diseases and clinical conditions associated with TADA3L. Ubiquitin Specific Protease 24 (USP24, Accession XM_165973) is another VGAM230 host target gene. USP24 BINDING SITE is HOST TARGET binding site found in the 3' untranslated region of mRNA encoded by USP24, corresponding to a HOST TARGET binding site such as BINDING SITE I, BINDING SITE II or BINDING SITE III. Table 2 illustrates the complementarity of the nucleotide sequences of USP24 BINDING SITE, designated SEQ ID:43817, to the nucleotide sequence of VGAM230 RNA, herein designated VGAM RNA, also designated SEQ ID:2941.

Another function of VGAM230 is therefore inhibition of Ubiquitin Specific Protease 24 (USP24, Accession XM_165973). Accordingly, utilities of VGAM230 include diagnosis, prevention and treatment of diseases and clinical conditions associated with USP24. LOC118987 (Accession XM_058361) is another VGAM230 host target gene. LOC118987 BINDING SITE is HOST TARGET binding site found in the 3' untranslated region of mRNA encoded by LOC118987, corresponding to a HOST TARGET binding site such as BINDING SITE I, BINDING SITE II or BINDING SITE III. Table 2 illustrates the complementarity of the nucleotide sequences of LOC118987 BINDING SITE, designated SEQ ID:36607, to the nucleotide sequence of VGAM230 RNA, herein designated VGAM RNA, also designated SEQ ID:2941.

Another function of VGAM230 is therefore inhibition of LOC118987 (Accession XM_058361). Accordingly, utilities of VGAM230 include diagnosis, prevention and treatment of diseases and clinical conditions associated with LOC118987. LOC138046 (Accession XM_059936) is another VGAM230 host target gene. LOC138046 BINDING SITE is HOST TARGET binding site found in the 3' untranslated region of mRNA encoded by LOC138046, corresponding to a HOST TARGET binding site such as BINDING SITE I, BINDING SITE II or BINDING SITE III. Table 2 illustrates the complementarity of the nucleotide sequences of LOC138046 BINDING SITE, designated SEQ ID:37115, to the nucleotide sequence of VGAM230 RNA, herein designated VGAM RNA, also designated SEQ ID:2941.

Another function of VGAM230 is therefore inhibition of LOC138046 (Accession XM_059936). Accordingly, utilities of VGAM230 include diagnosis, prevention and treatment of diseases and clinical conditions associated with LOC138046. LOC147178 (Accession XM_028755) is another VGAM230 host target gene. LOC147178 BINDING SITE is HOST TARGET binding site found in the 3' untranslated region of mRNA encoded by LOC147178, corresponding to a HOST TARGET binding site such as BINDING SITE I, BINDING SITE II or BINDING SITE III. Table 2 illustrates the complementarity of the nucleotide sequences of LOC147178 BINDING SITE, designated SEQ ID:30742, to the nucleotide sequence of VGAM230 RNA, herein designated VGAM RNA, also designated SEQ ID:2941.

Another function of VGAM230 is therefore inhibition of LOC147178 (Accession XM_028755). Accordingly, utilities of VGAM230 include diagnosis, prevention and treatment of diseases and clinical conditions associated with LOC147178. LOC147991 (Accession XM_085993) is another VGAM230 host target gene. LOC147991 BINDING SITE is HOST TARGET binding site found in the 3' untranslated region of mRNA encoded by LOC147991, corresponding to a HOST TARGET binding site such as BINDING SITE I, BINDING SITE II or BINDING SITE III. Table 2 illustrates the complementarity of the nucleotide sequences of LOC147991 BINDING SITE, designated SEQ ID:38436, to the nucleotide sequence of VGAM230 RNA, herein designated VGAM RNA, also designated SEQ ID:2941.

Another function of VGAM230 is therefore inhibition of LOC147991 (Accession XM_085993). Accordingly, utilities of VGAM230 include diagnosis, prevention and treatment of diseases and clinical conditions associated with LOC147991. LOC155434 (Accession XM_098723) is another VGAM230 host target gene. LOC155434 BINDING SITE is HOST TARGET binding site found in the 3' untranslated region of mRNA encoded by LOC155434, corresponding to a HOST TARGET binding site such as BINDING SITE I, BINDING SITE II or BINDING SITE III. Table 2 illustrates the complementarity of the nucleotide sequences of LOC155434 BINDING SITE, designated SEQ ID:41771, to the nucleotide sequence of VGAM230 RNA, herein designated VGAM RNA, also designated SEQ ID:2941.

Another function of VGAM230 is therefore inhibition of LOC155434 (Accession XM_098723). Accordingly, utilities of VGAM230 include diagnosis, prevention and treatment of diseases and clinical conditions associated with LOC155434. LOC199699 (Accession XM_113990) is another VGAM230 host target gene. LOC199699 BINDING SITE is HOST TARGET binding site found in the 3' untranslated region of mRNA encoded by LOC199699, corresponding to a HOST TARGET binding site such as BINDING SITE I, BINDING SITE II or BINDING SITE III. Table 2 illustrates the complementarity of the nucleotide sequences of LOC199699 BINDING SITE, designated SEQ ID:42597, to the nucleotide sequence of VGAM230 RNA, herein designated VGAM RNA, also designated SEQ ID:2941.

Another function of VGAM230 is therefore inhibition of LOC199699 (Accession XM_113990). Accordingly, utilities of VGAM230 include diagnosis, prevention and treatment of diseases and clinical conditions associated with LOC199699. LOC93048 (Accession XM_048903) is another VGAM230 host target gene. LOC93048 BINDING SITE is HOST TARGET binding site found in the 5' untranslated region of mRNA encoded by LOC93048, corresponding to a HOST TARGET binding site such as BINDING SITE I, BINDING SITE II or BINDING SITE III. Table 2 illustrates the complementarity of the nucleotide sequences of LOC93048 BINDING SITE, designated SEQ ID:35295, to the nucleotide sequence of VGAM230 RNA, herein designated VGAM RNA, also designated SEQ ID:2941.

Another function of VGAM230 is therefore inhibition of LOC93048 (Accession XM_048903). Accordingly, utilities of VGAM230 include diagnosis, prevention and treatment of diseases and clinical conditions associated with LOC93048. FIG. 1 further provides a conceptual description of a novel bioinformatically detected viral gene of the present invention, referred to here as Viral Genomic Address Messenger 231 (VGAM231) viral gene, which modulates expression of respective host target genes thereof, the function and utility of which host target genes is known in the art.

VGAM231 is a novel bioinformatically detected regulatory, non protein coding, viral micro RNA (miRNA) gene. The method by which VGAM231 was detected is described hereinabove with reference to FIGS. 1-8.

VGAM231 gene, herein designated VGAM GENE, is a viral gene contained in the genome of Callitrichine Herpesvirus 3. VGAM231 host target gene, herein designated VGAM HOST TARGET GENE, is a human gene contained in the human genome.

VGAM231 gene encodes a VGAM231 precursor RNA, herein designated VGAM PRECURSOR RNA. Similar to other miRNA genes, and unlike most ordinary genes, VGAM231 precursor RNA does not encode a protein. A nucleotide sequence identical or highly similar to the nucleotide sequence of VGAM231 precursor RNA is designated SEQ ID:217, and is provided hereinbelow with reference to the sequence listing part. Nucleotide sequence SEQ ID:217 is located at position 73231 relative to the genome of Callitrichine Herpesvirus 3.

VGAM231 precursor RNA folds onto itself, forming VGAM231 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM231 folded precursor RNA into VGAM231 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM231 RNA is designated SEQ ID:2942, and is provided hereinbelow with reference to the sequence listing part.

VGAM231 host target gene, herein designated VGAM HOST TARGET GENE, encodes a corresponding messenger RNA, VGAM231 host target RNA, herein designated VGAM HOST TARGET RNA. VGAM231 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM231 RNA, herein designated VGAM RNA, binds complementarily to one or more host target binding sites located in untranslated regions of VGAM231 host target RNA, herein designated VGAM HOST TARGET RNA. This complementary binding is due to the fact that the nucleotide sequence of VGAM231 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM231 RNA, herein designated VGAM RNA, may have a different number of host target binding sites in untranslated regions of a VGAM231 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM231 RNA, herein designated VGAM RNA, to host target binding sites on VGAM231 host target RNA, herein designated VGAM HOST TARGET RNA, such as BINDING SITE I, BINDING SITE II and BINDING SITE III, inhibits translation of VGAM231 host target RNA into VGAM231 host target protein, herein designated VGAM HOST TARGET PROTEIN. VGAM host target protein is therefore outlined by a broken line.

It is appreciated that VGAM231 host target gene, herein designated VGAM HOST TARGET GENE, in fact represents a plurality of VGAM231 host target genes. The mRNA of each one of this plurality of VGAM231 host target genes comprises one or more host target binding sites, each having a nucleotide sequence which is at least partly complementary to VGAM231 RNA, herein designated VGAM RNA, and which when bound by VGAM231 RNA causes inhibition of translation of respective one or more VGAM231 host target proteins.

It is further appreciated by one skilled in the art that the mode of translational inhibition illustrated by FIG. 1 with specific reference to translational inhibition exerted by VGAM231 gene, herein designated VGAM GENE, on one or more VGAM231 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM231 is inhibition of expression of host target genes, as part of a novel viral mechanism of attacking a host. Accordingly, utilities of VGAM231 include diagnosis, prevention and treatment of viral infection by Callitrichine Herpesvirus 3. Specific functions, and accordingly utilities, of VGAM231 correlate with, and may be deduced from, the identity of the host target genes which VGAM231 binds and inhibits, and the function of these target genes, as elaborated hereinbelow.

Nucleotide sequences of the VGAM231 precursor RNA, herein designated VGAM PRECURSOR RNA, and of the 'diced' VGAM231 RNA, herein designated VGAM RNA, and a schematic representation of the secondary folding of VGAM231 folded precursor RNA, herein designated VGAM FOLDED PRECURSOR RNA, of VGAM231 are further described hereinbelow with reference to Table 1.

Nucleotide sequences of host target binding sites, such as BINDING SITE-I, BINDING SITE-II and BINDING SITE-III of FIG. 1, found on VGAM231 host target RNA, and schematic representation of the complementarity of each of these host target binding sites to VGAM231 RNA, herein designated VGAM RNA, are described hereinbelow with reference to Table 2.

As mentioned hereinabove with reference to FIG. 1, a function of VGAM231 gene, herein designated VGAM is inhibition of expression of VGAM231 target genes. It is appreciated that specific functions, and accordingly utilities, of VGAM231 correlate with, and may be deduced from, the identity of the target genes which VGAM231 binds and inhibits, and the function of these target genes, as elaborated hereinbelow.

Amyloid Beta (A4) Precursor-like Protein 2 (APLP2, Accession XM_165592) is a VGAM231 host target gene. APLP2 BINDING SITE is HOST TARGET binding site found in the 3' untranslated region of mRNA encoded by APLP2, corresponding to a HOST TARGET binding site such as BINDING SITE I, BINDING SITE II or BINDING SITE III. Table 2 illustrates the complementarity of the nucleotide sequences of APLP2 BINDING SITE, designated SEQ ID:43699, to the nucleotide sequence of VGAM231 RNA, herein designated VGAM RNA, also designated SEQ ID:2942.

A function of VGAM231 is therefore inhibition of Amyloid Beta (A4) Precursor-like Protein 2 (APLP2, Accession XM_165592), a gene which may play a role in the regulation of hemostasis. Accordingly, utilities of VGAM231 include diagnosis, prevention and treatment of diseases and clinical conditions associated with APLP2. The function of APLP2 has been established by previous studies. Yan et al. (1990) cloned a cDNA that encoded a human sperm membrane protein identified by a monoclonal antibody raised against this protein and designated YWK-II. They found that the deduced polypeptide contains a segment with high homology to the transmembrane-cytoplasmic domains of the A4 amyloid protein (APP; 104760) found in brain plaques of Alzheimer disease patients. Rather than the lys-lys-lys sequence found in the A4 protein, an arg-lys-arg sequence was found at the probable membrane-cytoplasmic junction that may represent a unique property of sperm membrane proteins. The human amyloid precursor-like protein APLP2 is a highly conserved homolog of a sequence-specific DNA-binding mouse protein with an important function in the cell cycle. The mouse amyloid precursor-like protein Aplp1 has 42% sequence identity to mouse App; the human homolog of APLP1 (OMIM Ref. No. 104775) maps to 19q11-q13.2 (Wasco et al., 1993). By study of somatic cell hybrids segregating human chromosomes, von der Kammer et al. (1994) mapped the APLP2 gene to chromosome 11; by fluorescence in situ hybridization, the assignment was confirmed and further localized to 11q23-q25. By FISH, Leach et al. (1999) mapped the gene to 11q24.

Full details of the abovementioned studies are described in the following publications, the disclosure of which are hereby incorporated by reference:

Wasco, W.; Brook, J. D.; Tanzi, R. E.: The amyloid precursor-like protein (APLP) gene maps to the long arm of human chromosome 19. Genomics 15:237-239, 1993; and Yan, Y. C.; Bai, Y.; Wang, L.; Miao, S.; Koide, S. S.: Characterization of cDNA encoding a human sperm membrane protein related to A4 amyloid protein. Proc. Nat. Acad. Sci. 87:2405-240.

Further studies establishing the function and utilities of APLP2 are found in John Hopkins OMIM database record ID 104776, and in sited publications numbered 4310-4312, 430 and 4313-4314 listed in the bibliography section hereinbelow, which are also hereby incorporated by reference. Apical Protein-like (Xenopus laevis) (APXL, Accession NM_001649) is another VGAM231 host target gene. APXL BINDING SITE is HOST TARGET binding site found in the 3' untranslated region of mRNA encoded by APXL, corresponding to a HOST TARGET binding site such as BINDING SITE I, BINDING SITE II or BINDING SITE III. Table 2 illustrates the complementarity of the nucleotide sequences of APXL BINDING SITE, designated SEQ ID:7351, to the nucleotide sequence of VGAM231 RNA, herein designated VGAM RNA, also designated SEQ ID:2942.

Another function of VGAM231 is therefore inhibition of Apical Protein-like (Xenopus laevis) (APXL, Accession NM_001649), a gene which is implicated in amiloride-sensitive sodium channel activity. Accordingly, utilities of VGAM231 include diagnosis, prevention and treatment of diseases and clinical conditions associated with APXL. The function of APXL and its association with various diseases and clinical conditions, has been established by previous studies, as described hereinabove with reference to VGAM152. Collagen, Type I, Alpha 2 (COL1A2, Accession NM_000089) is another VGAM231 host target gene. COL1A2 BINDING SITE is HOST TARGET binding site found in the 3' untranslated region of mRNA encoded by COL1A2, corresponding to a HOST TARGET binding site such as BINDING SITE I, BINDING SITE II or BINDING SITE III. Table 2 illustrates the complementarity of the nucleotide sequences of COL1A2 BINDING SITE, designated SEQ ID:5542, to the nucleotide sequence of VGAM231 RNA, herein designated VGAM RNA, also designated SEQ ID:2942.

Another function of VGAM231 is therefore inhibition of Collagen, Type I, Alpha 2 (COL1A2, Accession NM_000089). Accordingly, utilities of VGAM231 include diagnosis, prevention and treatment of diseases and clinical conditions associated with COL1A2. Fucosyltransferase 6 (alpha (1,3) Fucosyltransferase) (FUT6, Accession NM_000150) is another VGAM231 host target gene. FUT6 BINDING SITE is HOST TARGET binding site found in the 3' untranslated region of mRNA encoded by FUT6, corresponding to a HOST TARGET binding site such as BINDING SITE I, BINDING SITE II or BINDING SITE III. Table 2 illustrates the complementarity of the nucleotide sequences of FUT6 BINDING SITE, designated SEQ ID:5651, to the nucleotide sequence of VGAM231 RNA, herein designated VGAM RNA, also designated SEQ ID:2942.

Another function of VGAM231 is therefore inhibition of Fucosyltransferase 6 (alpha (1,3) Fucosyltransferase) (FUT6, Accession NM_000150), a gene which is involved in the biosynthesis of the e-selectin ligand, sialyl-lewis x. catalyzes the transfer of fucose from gdp-beta-fucose to alpha-2,3 sialylated substrates. Accordingly, utilities of VGAM231 include diagnosis, prevention and treatment of diseases and clinical conditions associated with FUT6. The function of FUT6 and its association with various diseases and clinical conditions, has been established by previous studies, as described hereinabove with reference to VGAM194. JJAZ1 (Accession NM_015355) is another VGAM231 host target gene. JJAZ1 BINDING SITE is HOST TARGET binding site found in the 3' untranslated region of mRNA encoded by JJAZ1, corresponding to a HOST TARGET binding site such as BINDING SITE I, BINDING SITE II or BINDING SITE III. Table 2 illustrates the complementarity of the nucleotide sequences of JJAZ1 BINDING SITE, designated SEQ ID:17654, to the nucleotide sequence of VGAM231 RNA, herein designated VGAM RNA, also designated SEQ ID:2942.

Another function of VGAM231 is therefore inhibition of JJAZ1 (Accession NM_015355), a gene which is a zinc finger protein. Accordingly, utilities of VGAM231 include diagnosis, prevention and treatment of diseases and clinical conditions associated with JJAZ1. The function of JJAZ1 has been established by previous studies. Nagase et al. (1995) deduced the sequence of a full-length cDNA clone from cell line KG-1, which they designated KIAA0160, encoding a predicted 803-amino acid protein. Northern blot analysis revealed expression in all tissues tested. A variety of cytogenetic abnormalities involving chromosome 7 have been reported in endometrial stromal sarcomas, including a recurrent t (7;17)(p15; q21). Koontz et al. (2001) identified 2 zinc finger genes, which they termed JAZF1 (OMIM Ref. No. 606246) and JJAZ1, at the sites of the 7p15 and 17q21 breakpoints, respectively. Analyses of tumor RNA indicated that a JAZF1/JJAZ1 fusion was present in all types of endometrial stromal tumors; however, the fusion appeared to be rarer among endometrial stromal sarcomas that would be considered high-grade according to certain classification schemes Full details of the abovementioned studies are described in the following publications, the disclosure of which are hereby incorporated by reference:

Koontz, J. I.; Soreng, A. L.; Nucci, M.; Kuo, F. C.; Pauwels, P.; van den Berghe, H.; Cin, P. D.; Fletcher, J. A.; Sklar, J.: Frequent fusion of the JAZF1 and JJAZ1 genes in endometrial stromal tumors. Proc. Nat. Acad. Sci. 98: 6348-6353, 2001; and Nagase, T.; Seki, N.; Tanaka, A.; Ishikawa, K.; Nomura, N.: Prediction of the coding sequences of unidentified human genes. IV. The coding sequences of 40 new genes (KIAA0121-KIAA0160).

Further studies establishing the function and utilities of JJAZ1 are found in John Hopkins OMIM database record ID 606245, and in sited publications numbered 613 and 10969 listed in the bibliography section hereinbelow, which are also hereby incorporated by reference. Protein Tyrosine Phosphatase, Receptor-type, Z Polypeptide 1 (PTPRZ1, Accession NM_002851) is another VGAM231 host target gene. PTPRZ1 BINDING SITE is HOST TARGET binding site found in the 3' untranslated region of mRNA encoded by PTPRZ1, corresponding to a HOST TARGET binding site such as BINDING SITE I, BINDING SITE II or BINDING SITE III. Table 2 illustrates the complementarity of the nucleotide sequences of PTPRZ1 BINDING SITE, designated SEQ ID:8745, to the nucleotide sequence of VGAM231 RNA, herein designated VGAM RNA, also designated SEQ ID:2942.

Another function of VGAM231 is therefore inhibition of Protein Tyrosine Phosphatase, Receptor-type, Z Polypeptide 1 (PTPRZ1, Accession NM_002851), a gene which may be involved in the regulation of specific developmental processes in the cns. Accordingly, utilities of VGAM231 include diagnosis, prevention and treatment of diseases and clinical conditions associated with PTPRZ1. The function of PTPRZ1 has been established by previous studies. Phosphorylation of proteins on tyrosine residues plays a key role in the signaling of cell growth, differentiation, and transformation. The net phosphorylation of cellular proteins on tyrosine residues is controlled by the balanced action of protein-tyrosine kinases and protein-tyrosine phosphatases present in the cell. Levy et al. (1993) isolated cDNA clones and deduced the complete amino acid sequence of a large receptor-type protein tyrosine phosphatase containing 2,307 amino acids. They found that the protein, designated PTP-zeta (PTPRZ), is a transmembrane protein with 2 cytoplasmic PTPase domains and a 1,616-amino acid extracellular domain. As in PTP-gamma (OMIM Ref. No. 176886), the 266 N-terminal residues of the extracellular domain are homologous to carbonic anhydrases (see OMIM Ref. No. 114880). The human gene encoding PTPRZ was mapped to chromosome 7 by analysis of rodent-human hybrids and was regionalized to 7q31.3-q32 by chromosomal in situ hybridization. Northern blot analysis showed that PTP-zeta is expressed only in the central nervous system. By in situ hybridization, Levy et al. (1993) localized the expression to different regions of the adult brain, including the Purkinje cell layer of the cerebellum, the dentate gyrus, and the subependymal layer of the anterior horn of the lateral ventricle. They stated that this was the first mammalian tyrosine phosphatase whose expression is restricted to the nervous system. High levels of expression in the embryonic brain suggested an important role in CNS development. Ariyama et al. (1995) localized the PTPRZ gene to 7q31.3 by somatic cell hybrid mapping and fluorescence in situ hybridization. Animal model experiments lend further support to the function of PTPRZ1. Harroch et al. (2002) examined the susceptibility of mice deficient in Pprz to experimental autoimmune encephalomyelitis (EAE), a model of multiple sclerosis (OMIM Ref. No. 126200). They observed that mice deficient in Ptprz showed impaired recovery from EAE induced by myelin-oligodendrocyte glycoprotein (MOG; 159465) peptide. This sustained paralysis was associated with increased apoptosis of mature oligodendrocytes in the spinal cords of mutant mice at the peak of inflammation. They further demonstrated that expression of PTPRZ1, the human homolog, is induced in multiple sclerosis lesions and that the gene is specifically expressed in remyelinating oligodendrocytes in these lesions. These reports support a role for Ptprz in oligodendrocyte survival and in recovery from demyelinating disease.

It is appreciated that the abovementioned animal model for PTPRZ1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ariyama, T.; Hasegawa, K.; Inazawa, J.; Mizuno, K.; Ogimoto, M.; Katagiri, T.; Yakura, H.: Assignment of the human protein tyrosine phosphatase, receptor-type, zeta (PT-PRZ) gene to chromosome band 7q31.3. Cytogenet. Cell Genet. 70: 52-54, 1995; and Harroch, S.; Furtado, G. C.; Brueck, W.; Rosenbluth, J.; Lafaille, J.; Chao, M.; Buxbaum, J. D.; Schlessinger, J.: A critical role for the protein tyrosine phosphatase receptor type Z i.

Further studies establishing the function and utilities of PTPRZ1 are found in John Hopkins OMIM database record ID 176891, and in sited publications numbered 1058 and 11262 listed in the bibliography section hereinbelow, which are also hereby incorporated by reference. Rho Guanine Nucleotide Exchange Factor (GEF) 15 (ARHGEF15, Accession NM_014958) is another VGAM231 host target gene. ARHGEF15 BINDING SITE is HOST TARGET binding site found in the 3' untranslated region of mRNA encoded by ARHGEF15, corresponding to a HOST TARGET binding site such as BINDING SITE I, BINDING SITE II or BINDING SITE III. Table 2 illustrates the complementarity of the nucleotide sequences of ARHGEF15 BINDING SITE, designated SEQ ID:17316, to the nucleotide sequence of VGAM231 RNA, herein designated VGAM RNA, also designated SEQ ID:2942.

Another function of VGAM231 is therefore inhibition of Rho Guanine Nucleotide Exchange Factor (GEF) 15 (ARHGEF15, Accession NM_014958). Accordingly, utilities of VGAM231 include diagnosis, prevention and treatment of diseases and clinical conditions associated with ARHGEF15. Death Associated Transcription Factor 1 (DATF1, Accession NM_022105) is another VGAM231 host target gene. DATF1 BINDING SITE1 and DATF1 BINDING SITE2 are HOST TARGET binding sites found in untranslated regions of mRNA encoded by DATF1, corresponding to HOST TARGET binding sites such as BINDING SITE I, BINDING SITE II or BINDING SITE III. Table 2 illustrates the complementarity of the nucleotide sequences of DATF1 BINDING SITE1 and DATF1 BINDING SITE2, designated SEQ ID:22651 and SEQ ID:28062 respectively, to the nucleotide sequence of VGAM231 RNA, herein designated VGAM RNA, also designated SEQ ID:2942.

Another function of VGAM231 is therefore inhibition of Death Associated Transcription Factor 1 (DATF1, Accession NM_022105). Accordingly, utilities of VGAM231 include diagnosis, prevention and treatment of diseases and clinical conditions associated with DATF1. DKFZp761B0514 (Accession NM_032289) is another VGAM231 host target gene. DKFZp761B0514 BINDING SITE is HOST TARGET binding site found in the 3' untranslated region of mRNA encoded by DKFZp761B0514, corresponding to a HOST TARGET binding site such as BINDING SITE I, BINDING SITE II or BINDING SITE III. Table 2 illustrates the complementarity of the nucleotide sequences of DKFZp761B0514 BINDING SITE, designated SEQ ID:26051, to the nucleotide sequence of VGAM231 RNA, herein designated VGAM RNA, also designated SEQ ID:2942.

Another function of VGAM231 is therefore inhibition of DKFZp761B0514 (Accession NM_032289). Accordingly, utilities of VGAM231 include diagnosis, prevention and treatment of diseases and clinical conditions associated with DKFZp761B0514. Family with Sequence Similarity 3, Member C (FAM3C, Accession NM_014888) is another VGAM231 host target gene. FAM3C BINDING SITE is HOST TARGET binding site found in the 3' untranslated region of mRNA encoded by FAM3C, corresponding to a HOST TARGET binding site such as BINDING SITE I, BINDING SITE II or BINDING SITE III. Table 2 illustrates the complementarity of the nucleotide sequences of FAM3C BINDING SITE, designated SEQ ID:17039, to the nucleotide sequence of VGAM231 RNA, herein designated VGAM RNA, also designated SEQ ID:2942.

Another function of VGAM231 is therefore inhibition of Family with Sequence Similarity 3, Member C (FAM3C, Accession NM_014888). Accordingly, utilities of VGAM231 include diagnosis, prevention and treatment of diseases and clinical conditions associated with FAM3C. FLJ20337 (Accession NM_017772) is another VGAM231 host target gene. FLJ20337 BINDING SITE is HOST TARGET binding site found in the 3' untranslated region of mRNA encoded by FLJ20337, corresponding to a HOST TARGET binding site such as BINDING SITE I, BINDING SITE II or BINDING SITE III. Table 2 illustrates the complementarity of the nucleotide sequences of FLJ20337 BINDING SITE, designated SEQ ID:19394, to the nucleotide sequence of VGAM231 RNA, herein designated VGAM RNA, also designated SEQ ID:2942.

Another function of VGAM231 is therefore inhibition of FLJ20337 (Accession NM_017772). Accordingly, utilities of VGAM231 include diagnosis, prevention and treatment of diseases and clinical conditions associated with FLJ20337. Fucosyltransferase 10 (alpha (1,3) Fucosyltransferase) (FUT10, Accession NM_032664) is another VGAM231 host target gene. FUT10 BINDING SITE is HOST TARGET binding site found in the 3' untranslated region of mRNA encoded by FUT10, corresponding to a HOST TARGET binding site such as BINDING SITE I, BINDING SITE II or BINDING SITE III. Table 2 illustrates the complementarity of the nucleotide sequences of FUT10 BINDING SITE, designated SEQ ID:26393, to the nucleotide sequence of VGAM231 RNA, herein designated VGAM RNA, also designated SEQ ID:2942.

Another function of VGAM231 is therefore inhibition of Fucosyltransferase 10 (alpha (1,3) Fucosyltransferase) (FUT10, Accession NM_032664). Accordingly, utilities of VGAM231 include diagnosis, prevention and treatment of diseases and clinical conditions associated with FUT10. HEF1 (Accession NM_006403) is another VGAM231 host target gene. HEF1 BINDING SITE is HOST TARGET binding site found in the 3' untranslated region of mRNA encoded by HEF1, corresponding to a HOST TARGET binding site such as BINDING SITE I, BINDING SITE II or BINDING SITE III. Table 2 illustrates the complementarity of the nucleotide sequences of HEF1 BINDING SITE, designated SEQ ID:13112, to the nucleotide sequence of VGAM231 RNA, herein designated VGAM RNA, also designated SEQ ID:2942.

Another function of VGAM231 is therefore inhibition of HEF1 (Accession NM_006403). Accordingly, utilities of VGAM231 include diagnosis, prevention and treatment of diseases and clinical conditions associated with HEF1. KIAA0903 (Accession XM_049251) is another VGAM231 host target gene. KIAA0903 BINDING SITE is HOST TARGET binding site found in the 5' untranslated region of mRNA encoded by KIAA0903, corresponding to a HOST TARGET binding site such as BINDING SITE I, BINDING SITE II or BINDING SITE III. Table 2 illustrates the complementarity of the nucleotide sequences of KIAA0903 BINDING SITE, designated SEQ ID:35367, to the nucleotide sequence of VGAM231 RNA, herein designated VGAM RNA, also designated SEQ ID:2942.

Another function of VGAM231 is therefore inhibition of KIAA0903 (Accession XM_049251). Accordingly, utilities of VGAM231 include diagnosis, prevention and treatment of diseases and clinical conditions associated with KIAA0903. MBLL39 (Accession NM_144778) is another VGAM231 host target gene. MBLL39 BINDING SITE1 and MBLL39 BINDING SITE2 are HOST TARGET binding sites found in untranslated regions of mRNA encoded by MBLL39, corresponding to HOST TARGET binding sites such as BINDING SITE I, BINDING SITE II or BINDING SITE III. Table 2 illustrates the complementarity of the nucleotide sequences of MBLL39 BINDING SITE1 and MBLL39 BINDING SITE2, designated SEQ ID:29577 and SEQ ID:12320 respectively, to the nucleotide sequence of VGAM231 RNA, herein designated VGAM RNA, also designated SEQ ID:2942.

Another function of VGAM231 is therefore inhibition of MBLL39 (Accession NM_144778). Accordingly, utilities of VGAM231 include diagnosis, prevention and treatment of diseases and clinical conditions associated with MBLL39. LOC145241 (Accession XM_031799) is another VGAM231 host target gene. LOC145241 BINDING SITE is HOST TARGET binding site found in the 5' untranslated region of mRNA encoded by LOC145241, corresponding to a HOST TARGET binding site such as BINDING SITE I, BINDING SITE II or BINDING SITE III. Table 2 illustrates the complementarity of the nucleotide sequences of LOC145241 BINDING SITE, designated SEQ ID:31483, to the nucleotide sequence of VGAM231 RNA, herein designated VGAM RNA, also designated SEQ ID:2942.

Another function of VGAM231 is therefore inhibition of LOC145241 (Accession XM_031799). Accordingly, utilities of VGAM231 include diagnosis, prevention and treatment of diseases and clinical conditions associated with LOC145241. LOC157503 (Accession XM_098767) is another VGAM231 host target gene. LOC157503 BINDING SITE is HOST TARGET binding site found in the 3' untranslated region of mRNA encoded by LOC157503, corresponding to a HOST TARGET binding site such as BINDING SITE I, BINDING SITE II or BINDING SITE III. Table 2 illustrates the complementarity of the nucleotide sequences of LOC157503 BINDING SITE, designated SEQ ID:41811, to the nucleotide sequence of VGAM231 RNA, herein designated VGAM RNA, also designated SEQ ID:2942.

Another function of VGAM231 is therefore inhibition of LOC157503 (Accession XM_098767). Accordingly, utilities of VGAM231 include diagnosis, prevention and treatment of diseases and clinical conditions associated with LOC157503. LOC163231 (Accession XM_092094) is another VGAM231 host target gene. LOC163231 BINDING SITE is HOST TARGET binding site found in the 5' untranslated region of mRNA encoded by LOC163231, corresponding to a HOST TARGET binding site such as BINDING SITE I, BINDING SITE II or BINDING SITE III. Table 2 illustrates the complementarity of the nucleotide sequences of LOC163231 BINDING SITE, designated SEQ ID:40094, to the nucleotide sequence of VGAM231 RNA, herein designated VGAM RNA, also designated SEQ ID:2942.

Another function of VGAM231 is therefore inhibition of LOC163231 (Accession XM_092094). Accordingly, utilities of VGAM231 include diagnosis, prevention and treatment of diseases and clinical conditions associated with LOC163231. FIG. 1 further provides a conceptual description of a novel bioinformatically detected viral gene of the present invention, referred to here as Viral Genomic Address Messenger 232 (VGAM232) viral gene, which modulates expression of respective host target genes thereof, the function and utility of which host target genes is known in the art.

VGAM232 is a novel bioinformatically detected regulatory, non protein coding, viral micro RNA (miRNA) gene. The method by which VGAM232 was detected is described hereinabove with reference to FIGS. 1-8.

VGAM232 gene, herein designated VGAM GENE, is a viral gene contained in the genome of Callitrichine Herpesvirus 3. VGAM232 host target gene, herein designated VGAM HOST TARGET GENE, is a human gene contained in the human genome.

VGAM232 gene encodes a VGAM232 precursor RNA, herein designated VGAM PRECURSOR RNA. Similar to other miRNA genes, and unlike most ordinary genes, VGAM232 precursor RNA does not encode a protein. A nucleotide sequence identical or highly similar to the nucleotide sequence of VGAM232 precursor RNA is designated SEQ ID:218, and is provided hereinbelow with reference to the sequence listing part. Nucleotide sequence SEQ ID:218 is located at position 121062 relative to the genome of Callitrichine Herpesvirus 3.

VGAM232 precursor RNA folds onto itself, forming VGAM232 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM232 folded precursor RNA into VGAM232 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM232 RNA is designated SEQ ID:2943, and is provided hereinbelow with reference to the sequence listing part.

VGAM232 host target gene, herein designated VGAM HOST TARGET GENE, encodes a corresponding messenger RNA, VGAM232 host target RNA, herein designated VGAM HOST TARGET RNA. VGAM232 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM232 RNA, herein designated VGAM RNA, binds complementarily to one or more host target binding sites located in untranslated regions of VGAM232 host target RNA, herein designated VGAM HOST TARGET RNA. This complementary binding is due to the fact that the nucleotide sequence of VGAM232 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM232 RNA, herein designated VGAM RNA, may have a different number of host target binding sites in untranslated regions of a VGAM232 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM232 RNA, herein designated VGAM RNA, to host target binding sites on VGAM232 host target RNA, herein designated VGAM HOST TARGET RNA, such as BINDING SITE I, BINDING SITE II and BINDING SITE III, inhibits translation of VGAM232 host target RNA into VGAM232 host target protein, herein designated VGAM HOST TARGET PROTEIN. VGAM host target protein is therefore outlined by a broken line.

It is appreciated that VGAM232 host target gene, herein designated VGAM HOST TARGET GENE, in fact represents a plurality of VGAM232 host target genes. The mRNA of each one of this plurality of VGAM232 host target genes comprises one or more host target binding sites, each having a nucleotide sequence which is at least partly complementary to VGAM232 RNA, herein designated VGAM RNA, and which when bound by VGAM232 RNA causes inhibition of translation of respective one or more VGAM232 host target proteins.

It is further appreciated by one skilled in the art that the mode of translational inhibition illustrated by FIG. 1 with specific reference to translational inhibition exerted by VGAM232 gene, herein designated VGAM GENE, on one or more VGAM232 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM232 is inhibition of expression of host target genes, as part of a novel viral mechanism of attacking a host. Accordingly, utilities of VGAM232 include diagnosis, prevention and treatment of viral infection by Callitrichine Herpesvirus 3. Specific functions, and accordingly utilities, of VGAM232 correlate with, and may be deduced from, the identity of the host target genes which VGAM232 binds and inhibits, and the function of these host target genes, as elaborated hereinbelow.

Nucleotide sequences of the VGAM232 precursor RNA, herein designated VGAM PRECURSOR RNA, and of the 'diced' VGAM232 RNA, herein designated VGAM RNA, and a schematic representation of the secondary folding of VGAM232 folded precursor RNA, herein designated VGAM FOLDED PRECURSOR RNA, of VGAM232 are further described hereinbelow with reference to Table 1.

Nucleotide sequences of host target binding sites, such as BINDING SITE-I, BINDING SITE-II and BINDING SITE-III of FIG. 1, found on VGAM232 host target RNA, and schematic representation of the complementarity of each of these host target binding sites to VGAM232 RNA, herein designated VGAM RNA, are described hereinbelow with reference to Table 2.

As mentioned hereinabove with reference to FIG. 1, a function of VGAM232 gene, herein designated VGAM is inhibition of expression of VGAM232 target genes. It is appreciated that specific functions, and accordingly utilities, of VGAM232 correlate with, and may be deduced from, the identity of the target genes which VGAM232 binds and inhibits, and the function of these target genes, as elaborated hereinbelow.

Arylsulfatase D (ARSD, Accession NM_009589) is a VGAM232 host target gene. ARSD BINDING SITE is HOST TARGET binding site found in the 3" untranslated region of mRNA encoded by ARSD, corresponding to a HOST TARGET binding site such as BINDING SITE I, BINDING SITE II or BINDING SITE III. Table 2 illustrates the complementarity of the nucleotide sequences of ARSD BINDING SITE, designated SEQ ID:14317, to the nucleotide sequence of VGAM232 RNA, herein designated VGAM RNA, also designated SEQ ID:2943.

A function of VGAM232 is therefore inhibition of Arylsulfatase D (ARSD, Accession NM_009589), a gene which hydrolyzes sulfate groups from sugar residues in complex glycoconjugates. Accordingly, utilities of VGAM232 include diagnosis, prevention and treatment of diseases and clinical conditions associated with ARSD. The function of ARSD has been established by previous studies. In the course of positional cloning of the gene mutant in X-linked chondrodysplasia punctata (OMIM Ref. No. 302950), Franco et al. (1995) identified a cluster of 3 sulfatase genes located in the region Xp22.3. The genes were arylsulfatases and were designated ARSD, ARSE (OMIM Ref. No. 300180), and ARSF (OMIM Ref. No. 300003), in that order, proceeding from the telomere of Xp toward the centromere. Mutations in ARSE were identified in males with chondrodysplasia punctata. Franco et al. (1995) showed that both ARSD and ARSE have 11 exons and are transcribed toward the telomere. Their natural substrate was not determined. Meroni et al. (1996) reported that ARSD and ARSE have several typical features of genes that map in the pseudoautosomal region of the X chromosome, i.e., they escape X inactivation, have homologs on the Y chromosome, and are not conserved in mouse. Meroni et al. (1996) noted that ARSD, ARSE, and STS have a conserved gene structure; alignment of the genomic structures revealed perfect conservation of the intron-exon junctions. Sequence analysis of the Y-linked homologs of ARSD and ARSE indicated that they represent truncated pseudogenes.

Full details of the abovementioned studies are described in the following publications, the disclosure of which are hereby incorporated by reference:

Franco, B.; Meroni, G.; Parenti, G.; Levilliers, J.; Bernard, L.; Gebbia, M.; Cox, L.; Maroteaux, P.; Sheffield, L.; Rappold, G. A.; Andria, G.; Petit, C.; Ballabio, A. : A cluster of sulfatase genes on Xp22.3: mutations in chondrodysplasia punctata (CDPX) and implications for warfarin embryopathy. Cell 81:1-20, 1995; and Meroni, G.; Franco, B.; Archidiacono, N.; Messali, S.; Andolfi, G.; Rocchi, M.; Ballabio, A.: Characterization of a cluster of sulfatase genes on Xp22.3 suggests gene duplications in a.

Further studies establishing the function and utilities of ARSD are found in John Hopkins OMIM database record ID 300002, and in sited publications numbered 9009-9010 listed in the bibliography section hereinbelow, which are also hereby incorporated by reference. BRF1 Homolog, Subunit of RNA Polymerase III Transcription Initiation Factor IIIB (S. cerevisiae) (BRF1, Accession NM_001519) is another VGAM232 host target gene. BRF1 BINDING SITE is HOST TARGET binding site found in the 3' untranslated region of mRNA encoded by BRF1, corresponding to a HOST TARGET binding site such as BINDING SITE I, BINDING SITE II or BINDING SITE III. Table 2 illustrates the complementarity of the nucleotide sequences of BRF1 BINDING SITE, designated SEQ ID:7258, to the nucleotide sequence of VGAM232 RNA, herein designated VGAM RNA, also designated SEQ ID:2943.

Another function of VGAM232 is therefore inhibition of BRF1 Homolog, Subunit of RNA Polymerase III Transcription Initiation Factor IIIB (S. cerevisiae) (BRF1, Accession NM_001519), a gene which is a general activator of RNA polymerase III. Accordingly, utilities of VGAM232 include diagnosis, prevention and treatment of diseases and clinical conditions associated with BRF1. The function of BRF1 has been established by previous studies. By screening a Burkitt lymphoma and other human cDNA cell libraries using degenerate PCR primers corresponding to peptide sequences of the 90-kD subunit of GTF3B, Wang and Roeder (1995) obtained a cDNA encoding TAF3B2, which they called TFIIIB90. Sequence analysis revealed that the 675-amino acid TAF3B2 protein contains a high mobility group protein-2 (HMG2; 163906)-related region in the highly charged C-terminal half of the protein and a sequence related to GTF2B (OMIM Ref. No. 189963) in the N terminus. Western blot analysis showed that TAF3B2 is expressed as a 92-kD protein, the C terminus of which binds TBP. Recombinant TAF3B2 together with TBP, but neither alone, could replace purified natural GTF3B. Deletion of either the N-terminal GTF2B-related or the C-terminal HMG2-related half of the protein abolished activity. Mital et al. (1996) cloned a cDNA identical to the TAF3B2 cDNA obtained by Wang and Roeder (1995) except for scattered nucleotide differences and the presence of 6 additional nucleotides. These last differences change the open reading frame, predicting a different sequence over 67 amino acids of the TAF3B2 protein, which Mital et al. (1996) called BRF due to its homology with the S. cerevisiae BRF protein. Mital et al. (1996) confirmed the association of TAF3B2 with TBP reported by Wang and Roeder (1995).

Full details of the abovementioned studies are described in the following publications, the disclosure of which are hereby incorporated by reference:

Wang, Z.; Roeder, R. G.: Structure and function of a human transcription factor TFIIIB subunit that is evolutionarily conserved and contains both TFIIB- and high-mobility-group protein 2-related domains. Proc. Nat. Acad. Sci. 92: 7026-7030, 1995; and Mital, R.; Kobayashi, R.; Hernandez, N.: RNA polymerase III transcription from the human U6 and adenovirus type 2 VAI promoters has different requirements for human BRF, a subunit of hu.

Further studies establishing the function and utilities of BRF1 are found in John Hopkins OMIM database record ID 604902, and in sited publications numbered 2908-2909 listed in the bibliography section hereinbelow, which are also hereby incorporated by reference. DEAD/H (Asp-Glu-Ala-Asp/His) Box Polypeptide 3 (DDX3, Accession NM_024005) is another VGAM232 host target gene. DDX3 BINDING SITE1 and DDX3 BINDING SITE2 are HOST TARGET binding sites found in untranslated regions of mRNA encoded by DDX3, corresponding to HOST TARGET binding sites such as BINDING SITE I, BINDING SITE II or BINDING SITE III. Table 2 illustrates the complementarity of the nucleotide sequences of DDX3 BINDING SITE1 and DDX3 BINDING SITE2, designated SEQ ID:23433 and SEQ ID:7037 respectively, to the nucleotide sequence of VGAM232 RNA, herein designated VGAM RNA, also designated SEQ ID:2943.

Another function of VGAM232 is therefore inhibition of DEAD/H (Asp-Glu-Ala-Asp/His) Box Polypeptide 3 (DDX3, Accession NM_024005), a gene which interacts with hepatitis c virus core protein resulting a change in intracellular location. Accordingly, utilities of VGAM232 include diagnosis, prevention and treatment of diseases and clinical conditions associated with DDX3. The function of DDX3 has been established by previous studies. DEAD box proteins are putative RNA helicases that have a characteristic Asp-Glu-Ala-Asp (DEAD) box as 1 of 8 highly conserved sequence motifs. See 600396. Chung et al. (1995) cloned cDNAs encoding DDX3 (Genbank U50553), a putative RNA helicase belonging to the DEAD box protein family. Lahn and Page (1997) identified DDX3, which they called DBX, as 1 of 5 X-linked genes that have homologs located in the nonrecombining region of the Y chromosome (NRY). See DBY (OMIM Ref. No. 400010). They determined that these 5 X-linked genes escape X inactivation. Lahn and Page (1997) postulated that these 5 genes are cases in which gene expression is maintained at comparable levels in males and females by preservation of homologous genes on both the X and the NRY, with male and female cells expressing both copies of each gene. Sequence analysis revealed that DBX shares 91% protein sequence identity with DBY, the Y-linked homolog.

Full details of the abovementioned studies are described in the following publications, the disclosure of which are hereby incorporated by reference:

Lahn, B. T.; Page, D. C.: Functional coherence of the human Y chromosome. Science 278:675-680, 1997; and Park, S. H.; Lee, S.-G.; Kim, Y.; Song, K.: Assignment of a human putative RNA helicase gene, DDX3, to human X chromosome bands p11.3-p11.23. Cytogenet. Cell Genet. 81:178-179, 1998.

Further studies establishing the function and utilities of DDX3 are found in John Hopkins OMIM database record ID 300160, and in sited publications numbered 1099 and 11000 listed in the bibliography section hereinbelow, which are also hereby incorporated by reference. Engrailed Homolog 2 (EN2, Accession NM_001427) is another VGAM232 host target gene. EN2 BINDING SITE is HOST TARGET binding site found in the 3' untranslated region of mRNA encoded by EN2, corresponding to a HOST TARGET binding site such as BINDING SITE I, BINDING SITE II or BINDING SITE III. Table 2 illustrates the complementarity of the nucleotide sequences of EN2 BINDING SITE, designated SEQ ID:7145, to the nucleotide sequence of VGAM232 RNA, herein designated VGAM RNA, also designated SEQ ID:2943.

Another function of VGAM232 is therefore inhibition of Engrailed Homolog 2 (EN2, Accession NM_001427), a gene which may be required for normal cerebellar development; a homeobox protein, very strongly similar to murine En2. Accordingly, utilities of VGAM232 include diagnosis, prevention and treatment of diseases and clinical conditions associated with EN2. The function of EN2 has been established by previous studies. In Drosophila, the 'engrailed' (en) homeo box protein plays an important role during development in segmentation, where it is required for the formation of posterior compartments. See EN1 (OMIM Ref. No. 131290). By low stringency hybridization, Poole et al. (1989) isolated from a human cosmid genomic library sequences homologous with a probe from the Drosophila 'engrailed' gene. Partial nucleotide sequence analysis showed a consensus splice acceptor site followed by an open reading frame capable of coding 104 amino acids; the first 94 amino acids showed 71% identity with the Drosophila engrailed protein. The shared region contained a homeo domain. At the amino acid level, the human sequence was 85% identical with the mouse En1 gene and 100% identical with the mouse En2 gene. Logan et al. (1992) isolated human and chicken genomic clones of the EN1 and EN2 genes. As in mouse, the predicted coding region of the human and chicken EN2 genes is interrupted by a single intron. The deduced 333-amino acid human EN2 protein is 90% identical to mouse En1. By sequence analysis, the authors determined that En proteins from various species contain 5 distinct conserved subregions. Northern blot analysis revealed that EN2, but not EN1, is expressed as a 4-kb mRNA in human cerebellum. Similarly, Western blots indicated that only EN2 is expressed fetal cerebellum. To study the role of the En2 gene in development, Joyner et al. (1989) created mutations in 3 pluripotent embryonic stem cell (ES) lines by homologous recombination. Joyner et al. (1991) generated mice homozygous for a targeted deletion of the En2 homeo box. The mutant mice were viable and showed no obvious defects in embryonic development. The authors suggested that this might be due to functional redundancy of En2 and En1. They found that the mutant mice had abnormal foliation in the adult cerebellum, where normally only En2 is expressed. To determine whether the contrasting phenotypes of En2 and En1 reflect differences in temporal expression or biochemical activity of the En proteins, Hanks et al. (1995) replaced En1 coding sequences with En2 sequences in transgenic mice by gene targeting. The En2 sequences rescued all En1 mutant defects, demonstrating that the difference between En1 and En2 stems from their divergent expression patterns. By Southern blot analysis of DNA from a panel of human-hamster somatic cell hybrids, Poole et al. (1989) mapped the EN2 gene to human chromosome 7; regional mapping by in situ hybridization localized it to 7q36. Logan et al. (1989) arrived independently at the same assignment.

Full details of the abovementioned studies are described in the following publications, the disclosure of which are hereby incorporated by reference:

Hanks, M.; Wurst, W.; Anson-Cartwright, L.; Auerbach, A. B.; Joyner, A. L.: Rescue of the En-1 mutant phenotype by replacement of En-1 with En-2. Science 269:679-682, 1995; and Joyner, A. L.; Herrup, K.; Auerbach, B. A.; Davis, C. A.; Rossant, J.: Subtle cerebellar phenotype in mice homozygous for a targeted deletion of the En-2 homeobox. Science 251: 1239-124.

Further studies establishing the function and utilities of EN2 are found in John Hopkins OMIM database record ID 131310, and in sited publications numbered 2603, 2977-2978, 2606-260 and 2979 listed in the bibliography section hereinbelow, which are also hereby incorporated by reference. Growth Arrest-specific 7 (GAS7, Accession NM_003644) is another VGAM232 host target gene. GAS7 BINDING SITE is HOST TARGET binding site found in the 5' untranslated region of mRNA encoded by GAS7, corresponding to a HOST TARGET binding site such as BINDING SITE I, BINDING SITE II or BINDING SITE III. Table 2 illustrates the complementarity of the nucleotide sequences of GAS7 BINDING SITE, designated SEQ ID:9716, to the nucleotide sequence of VGAM232 RNA, herein designated VGAM RNA, also designated SEQ ID:2943.

Another function of VGAM232 is therefore inhibition of Growth Arrest-specific 7 (GAS7, Accession NM_003644), a gene which may play a role in promoting maturation and morphological differentiation of cerebellar neurons. Accordingly, utilities of VGAM232 include diagnosis, prevention and treatment of diseases and clinical conditions associated with GAS7. The function of GAS7 has been established by previous studies. Growth arrest-specific (GAS) genes are expressed preferentially in cells that enter a quiescent state. Ju et al. (1998) described the isolation and characterization of a GAS gene (GAS7) that is expressed primarily in vivo in terminally differentiated brain cells and particularly prominently in mature cerebellar Purkinje neurons. The gene had originally been identified in serum-starved murine fibroblasts. GAS7 transcripts encode a 48-kD protein containing a structural domain that resembles sequences of OCT2 (OMIM Ref. No. 602608), a POU transcription factor implicated in neuronal development, and synapsins, e.g., synapsin I (SYN1; 313440), which have a role in modulating neurotransmitter release. Using in situ hybridization and immunocytochemical analysis, Ju et al. (1998) showed that inhibition of production of GAS7 in terminally differentiating cultures of embryonic murine cerebellum impedes neurite outgrowth from maturing Purkinje cells. Conversely, GAS7 overexpression in undifferentiated neuroblastoma cell cultures dramatically promotes neurite-like outgrowth. Collectively, the results provided evidence for an association between expression of GAS7 and neuronal development. By analysis of cell hybrid DNAs prepared from a panel of 21 Chinese hamster/mouse hybrid cell lines, Ju et al. (1998) mapped the mouse Gas7 gene to chromosome 11. They reported that a human DNA fragment (GenBank G13706) having 85% sequence identity with Gas7 mapped to 17p, which is largely syngeneic with mouse chromosome 11 (Kurtz and Zimmer, 1995).

Full details of the abovementioned studies are described in the following publications, the disclosure of which are hereby incorporated by reference:

Ju, Y.-T.; Chang, A. C. Y.; She, B.-R.; Tsaur, M.-L.; Hwang, H.-M.; Chao, C. C.-K.; Cohen, S. N.; Lin-Chao, S.: Gas7: a gene expressed preferentially in growth-arrested fibroblasts and terminally differentiated Purkinje neurons affects neurite formation. Proc. Nat. Acad. Sci. 95:11423-11428, 1998; and Kurtz, A.; Zimmer, A.: Interspecies fluorescence in situ hybridization further defines synteny homology between mouse chromosome 11 and human chromosome 17. Mammalian Genome 6:379-380.

Further studies establishing the function and utilities of GAS7 are found in John Hopkins OMIM database record ID 603127, and in sited publications numbered 641-64 and 644 listed in the bibliography section hereinbelow, which are also hereby incorporated by reference. Glutathione Peroxidase 3 (plasma) (GPX3, Accession NM_002084) is another VGAM232 host target gene. GPX3 BINDING SITE is HOST TARGET binding site found in the 3' untranslated region of mRNA encoded by GPX3, corresponding to a HOST TARGET binding site such as BINDING SITE I, BINDING SITE II or BINDING SITE III. Table 2 illustrates the complementarity of the nucleotide sequences of GPX3 BINDING SITE, designated SEQ ID:7879, to the nucleotide sequence of VGAM232 RNA, herein designated VGAM RNA, also designated SEQ ID:2943.

Another function of VGAM232 is therefore inhibition of Glutathione Peroxidase 3 (plasma) (GPX3, Accession NM_002084), a gene which reduces lipid hydroperoxide and H2O2 in plasma. Accordingly, utilities of VGAM232 include diagnosis, prevention and treatment of diseases and clinical conditions associated with GPX3. The function of GPX3 and its association with various diseases and clinical conditions, has been established by previous studies, as described hereinabove with reference to VGAM225. Kelch-like 1 (Drosophila) (KLHL1, Accession NM_020866) is another VGAM232 host target gene. KLHL1 BINDING SITE is HOST TARGET binding site found in the 5' untranslated region of mRNA encoded by KLHL1, corresponding to a HOST TARGET binding site such as BINDING SITE I, BINDING SITE II or BINDING SITE III. Table 2 illustrates the complementarity of the nucleotide sequences of KLHL1 BINDING SITE, designated SEQ ID:21919, to the nucleotide sequence of VGAM232 RNA, herein designated VGAM RNA, also designated SEQ ID:2943.

Another function of VGAM232 is therefore inhibition of Kelch-like 1 (Drosophila) (KLHL1, Accession NM_020866). Accordingly, utilities of VGAM232 include diagnosis, prevention and treatment of diseases and clinical conditions associated with KLHL1. Megalencephalic Leukoencephalopathy with Subcortical Cysts 1 (MLC1, Accession NM_015166) is another VGAM232 host target gene. MLC1 BINDING SITE1 and MLC1 BINDING SITE2 are HOST TARGET binding sites found in untranslated regions of mRNA encoded by MLC1, corresponding to HOST TARGET binding sites such as BINDING SITE I, BINDING SITE II or BINDING SITE III. Table 2 illustrates the complementarity of the nucleotide sequences of MLC1 BINDING SITE1 and MLC1 BINDING SITE2, designated SEQ ID:17525 and SEQ ID:29219 respectively, to the nucleotide sequence of VGAM232 RNA, herein designated VGAM RNA, also designated SEQ ID:2943.

Another function of VGAM232 is therefore inhibition of Megalencephalic Leukoencephalopathy with Subcortical Cysts 1 (MLC1, Accession NM_015166). Accordingly, utilities of VGAM232 include diagnosis, prevention and treatment of diseases and clinical conditions associated with MLC1. Neurofibromin 1 (neurofibromatosis, von Recklinghausen disease, Watson disease) (NF1, Accession NM_000267) is another VGAM232 host target gene. NF1 BINDING SITE is HOST TARGET binding site found in the 5' untranslated region of mRNA encoded by NF1, corresponding to a HOST TARGET binding site such as BINDING SITE I, BINDING SITE II or BINDING SITE III. Table 2 illustrates the complementarity of the nucleotide sequences of NF1 BINDING SITE, designated SEQ ID:5813, to the nucleotide sequence of VGAM232 RNA, herein designated VGAM RNA, also designated SEQ ID:2943.

Another function of VGAM232 is therefore inhibition of Neurofibromin 1 (neurofibromatosis, von Recklinghausen disease, Watson disease) (NF1, Accession NM_000267). Accordingly, utilities of VGAM232 include diagnosis, prevention and treatment of diseases and clinical conditions associated with NF1. Neurotensin Receptor 1 (high affinity) (NTSR1, Accession NM_002531) is another VGAM232 host target gene. NTSR1 BINDING SITE is HOST TARGET binding site found in the 5' untranslated region of mRNA encoded by NTSR1, corresponding to a HOST TARGET binding site such as BINDING SITE I, BINDING SITE II or BINDING SITE III. Table 2 illustrates the complementarity of the nucleotide sequences of NTSR1 BINDING SITE, designated SEQ ID:8370, to the nucleotide sequence of VGAM232 RNA, herein designated VGAM RNA, also designated SEQ ID:2943.

Another function of VGAM232 is therefore inhibition of Neurotensin Receptor 1 (high affinity) (NTSR1, Accession NM_002531), a gene which is associated with g proteins that activate a phosphatidylinositol- calcium second messenger system. Accordingly, utilities of VGAM232 include diagnosis, prevention and treatment of diseases and clinical conditions associated with NTSR1. The function of NTSR1 and its association with various diseases and clinical conditions, has been established by previous studies, as described hereinabove with reference to VGAM200. Protein Kinase C-like 1 (PRKCL1, Accession XM_031273) is another VGAM232 host target gene. PRKCL1 BINDING SITE is HOST TARGET binding site found in the 5' untranslated region of mRNA encoded by PRKCL1, corresponding to a HOST TARGET binding site such as BINDING SITE I, BINDING SITE II or BINDING SITE III. Table 2 illustrates the complementarity of the nucleotide sequences of PRKCL1 BINDING SITE, designated SEQ ID:31329, to the nucleotide sequence of VGAM232 RNA, herein designated VGAM RNA, also designated SEQ ID:2943.

Another function of VGAM232 is therefore inhibition of Protein Kinase C-like 1 (PRKCL1, Accession XM_031273). Accordingly, utilities of VGAM232 include diagnosis, prevention and treatment of diseases and clinical conditions associated with PRKCL1. RAD52 Homolog (S. cerevisiae) (RAD52, Accession NM_134422) is another VGAM232 host target gene. RAD52 BINDING SITE is HOST TARGET binding site found in the 3' untranslated region of mRNA encoded by RAD52, corresponding to a HOST TARGET binding site such as BINDING SITE I, BINDING SITE II or BINDING SITE III. Table 2 illustrates the complementarity of the nucleotide sequences of RAD52 BINDING SITE, designated SEQ ID:28645, to the nucleotide sequence of VGAM232 RNA, herein designated VGAM RNA, also designated SEQ ID:2943.

Another function of VGAM232 is therefore inhibition of RAD52 Homolog (S. cerevisiae) (RAD52, Accession NM_134422). Accordingly, utilities of VGAM232 include diagnosis, prevention and treatment of diseases and clinical conditions associated with RAD52. Receptor Tyrosine Kinase-like Orphan Receptor 2 (ROR2, Accession NM_004560) is another VGAM232 host target gene. ROR2 BINDING SITE is HOST TARGET binding site found in the 3' untranslated region of mRNA encoded by ROR2, corresponding to a HOST TARGET binding site such as BINDING SITE I, BINDING SITE II or BINDING SITE III. Table 2 illustrates the complementarity of the nucleotide sequences of ROR2 BINDING SITE, designated SEQ ID:10899, to the nucleotide sequence of VGAM232 RNA, herein designated VGAM RNA, also designated SEQ ID:2943.

Another function of VGAM232 is therefore inhibition of Receptor Tyrosine Kinase-like Orphan Receptor 2 (ROR2, Accession NM_004560), a gene which may be involved in the early formayion of the chonrocytes. Accordingly, utilities of VGAM232 include diagnosis, prevention and treatment of diseases and clinical conditions associated with ROR2. The function of ROR2 has been established by previous studies. Receptor tyrosine kinases often have critical roles in particular cell lineages by initiating signal cascades in those lineages. Many lineage-restricted receptor tyrosine kinases were initially identified as 'orphans' homologous to known receptors, and only subsequently used to identify their unknown growth factors. DeChiara et al. (2000) identified one such orphan, encoded by Ror2. They reported that disruption of mouse Ror2 leads to profound skeletal abnormalities, with essentially all endochondrally derived bones foreshortened or misshapen, albeit to differing degrees. Further, they found that Ror2 is selectively expressed in the chondrocytes of all developing cartilage anlagen, where it is essential during initial growth and patterning, as well as subsequently in the proliferating chondrocytes of mature growth plates, where it is required for normal expansion. Thus, Ror2 encodes a receptor-like tyrosine kinase that is selectively expressed in, and particularly important for, the chondrocyte lineage Animal model experiments lend further support to the function of ROR2. Takeuchi et al. (2000) generated mice with a mutation in the Ror2 gene and observed that homozygous mutant mice died just after birth, exhibiting dwarfism, severe cyanosis, and short limbs and tails. Whole-mount in situ hybridization analysis showed that Ror2 is expressed in the branchial arches, heart, and limb/tailbuds, in addition to the developing nervous system. The Ror2-deficient mice had cardiac septal defects and skeletal abnormalities, including shorter limbs, vertebrae, and facial structure, with a particular defect in their distal portions. Takeuchi et al. (2000) concluded that Ror2 plays essential roles in the development of the heart and in limb/tail formation, in particular cardiac septal formation and ossification of distal portions of limbs and tails It is appreciated that the abovementioned animal model for ROR2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Takeuchi, S.; Takeda, K.; Oishi, I.; Nomi, M.; Ikeya, M.; Itoh, K.; Tamura, S.; Ueda, T.; Hatta, T.; Otani, H.; Terashima, T.; Takada, S.; Yamamura, H.; Akira, S.; Minami, Y.: Mouse Ror2 receptor tyrosine kinase is required for the heart development and limb formation. Genes Cells 5:71-78, 2000; and DeChiara, T. M.; Kimble, R. B.; Poueymirou, W. T.; Rojas, J.; Masiakowski, P.; Valenzuela, D. M.; Yancopoulos, G. D.: Ror2, encoding a receptor-like tyrosine kinase, is required for carti.

Further studies establishing the function and utilities of ROR2 are found in John Hopkins OMIM database record ID 602337, and in sited publications numbered 6739, 12054, 2780-2781, 6013, 6310, 4678, 4846-278 and 6740 listed in the bibliography section hereinbelow, which are also hereby incorporated by reference. Serine (or cysteine) Proteinase Inhibitor, Clade E (nexin, plasminogen activator inhibitor type 1), Member 2 (SERPINE2, Accession XM_059422) is another VGAM232 host target gene. SERPINE2 BINDING SITE is HOST TARGET binding site found in the 5' untranslated region of mRNA encoded by SERPINE2, corresponding to a HOST TARGET binding site such as BINDING SITE I, BINDING SITE II or BINDING SITE III. Table 2 illustrates the complementarity of the nucleotide sequences of SERPINE2 BINDING SITE, designated SEQ ID:36988, to the nucleotide sequence of VGAM232 RNA, herein designated VGAM RNA, also designated SEQ ID:2943.

Another function of VGAM232 is therefore inhibition of Serine (or cysteine) Proteinase Inhibitor, Clade E (nexin, plasminogen activator inhibitor type 1), Member 2 (SERPINE2, Accession XM_059422), a gene which inhibits thrombin, trypsin, and urokinase. binds heparin. promotes neurite extension. Accordingly, utilities of VGAM232 include diagnosis, prevention and treatment of diseases and clinical conditions associated with SERPINE2. The function of SERPINE2 has been established by previous studies. Protease nexin I is the most important physiologic regulator of alpha-thrombin in tissues. PN1 is highly expressed and developmentally regulated in the nervous system where it is concentrated at neuromuscular junctions and also central synapses in the hippocampus and striatum. Approximately 10% of identified proteins at mammalian neuromuscular junctions are serine protease inhibitors, consistent with their central role in balancing serine protease activity to develop, maintain, and remodel synapses. By Southern blot hybridization of PN1 cDNA to somatic cell hybrid DNAs, Carter et al. (1995) mapped the PN1 gene, also known as PI7, to 2q33-q35. The regional localization was achieved by studying microcell hybrids that retained fragments of chromosome 2. The gene was located between the markers CRYGA (OMIM Ref. No. 123660) and MYL1 (OMIM Ref. No. 160780), both of which are located in the 2q33-q35 region. Further observations indicated that PN1 is close to MYL1 and farther removed from CRYGA. By hybrid cell methods, Carter et al. (1995) mapped the homologous gene to mouse chromosome 1 and sheep 2q, which are known to have regions of homology of synteny to human 2q. Carter et al. (1995) noted that a form of juvenile-onset amyotrophic lateral sclerosis maps to this same region of chromosome 2, making PN1 a candidate gene. The mammalian sex-determining pathway is controlled by the presence or absence of SRY (OMIM Ref. No. 480000) expression in the embryonic gonad. In order to identify additional sex-determining or gonadal differentiation genes, Grimmond et al. (2000) screened for genes exhibiting sexually dimorphic patterns of expression in the mouse gonad at 12.5 and 13.5 days postcoitum, after overt gonad differentiation, by comparing complex cDNA probes derived from male and female gonadal tissue at these stages on microarrays constructed from a normalized urogenital ridge library. Using in situ hybridization analysis, they determined that mouse Pn1 and vanin-1 (OMIM Ref. No. 603570) exhibit male-specific expression prior to overt gonadal differentiation and are detected in the somatic portion of the developing gonad, suggesting to the authors a possible direct link to the testis-determining pathway for both genes. Grimmond, S.; Van Hateren, N.; Siggers, P.; Arkell, R.; Larder, R.; Soares, M. B.; de Fatima Bonaldo, M.; Smith, L.; Tymowska-Lalanne, Z.; Wells, C.; Greenfield, A.: Sexually dimorphic expression of protease nexin-1 and vanin-1 in the developing mouse gonad prior to overt differentiation suggests a role in mammalian sexual development. Hum. Molec. Genet. 9:1553-1560, 2000. PubMed ID:10888606

Full details of the abovementioned studies are described in the following publications, the disclosure of which are hereby incorporated by reference:

Carter, R. E.; Cerosaletti, K. M.; Burkin, D. J.; Fournier, R. E. K.; Jones, C.; Greenberg, B. D.; Citron, B. A.; Festoff, B. W.: The gene for the serpin thrombin inhibitor (PI7), protease nexin 1, is located on human chromosome 2q33-q35 and on syntenic regions in the mouse and sheep genomes. Genomics 27:196-199, 1995; and Grimmond, S.; Van Hateren, N.; Siggers, P.; Arkell, R.; Larder, R.; Soares, M. B.; de Fatima Bonaldo, M.; Smith, L.; Tymowska-Lalanne, Z.; Wells, C.; Greenfield, A.: Sexually dimorphic ex.

Further studies establishing the function and utilities of SERPINE2 are found in John Hopkins OMIM database record ID 177010, and in sited publications numbered 2752-2753, 1 and 1160-1161 listed in the bibliography section hereinbelow, which are also hereby incorporated by reference. Solute Carrier Family 20 (phosphate transporter), Member 2 (SLC20A2, Accession NM_006749) is another VGAM232 host target gene. SLC20A2 BINDING SITE is HOST TARGET binding site found in the 5" untranslated region of mRNA encoded by SLC20A2, corresponding to a HOST TARGET binding site such as BINDING SITE I, BINDING SITE II or BINDING SITE III. Table 2 illustrates the complementarity of the nucleotide sequences of SLC20A2 BINDING SITE, designated SEQ ID:13603, to the nucleotide sequence of VGAM232 RNA, herein designated VGAM RNA, also designated SEQ ID:2943.

Another function of VGAM232 is therefore inhibition of Solute Carrier Family 20 (phosphate transporter), Member 2 (SLC20A2, Accession NM_006749), a gene which is a sodium-phosphate symporter. Accordingly, utilities of VGAM232 include diagnosis, prevention and treatment of diseases and clinical conditions associated with SLC20A2. The function of SLC20A2 has been established by previous studies. The host range of retroviruses is determined primarily by the presence of specific receptors on target cells which are recognized by the retroviral envelope glycoprotein. Somatic cell hybrids have been used to determine the chromosomal location of several retroviral receptors in mice prior to their molecular cloning. By use of human-Chinese hamster somatic cell hybrids and a retroviral vector, Garcia et al. (1991) mapped the receptor for the amphotropic murine leukemia virus to the pericentromeric region of human chromosome 8. Kaelbling et al. (1991) described a receptor for the gibbon ape leukemia retrovirus. In an effort to isolate related human genes to determine if these function as receptors for any other retroviruses, van Zeijl et al. (1993, 1994) screened a human cDNA library at low stringency using GLVR1 (OMIM Ref. No. 137570) as a probe. A single GLVR1-related cDNA (designated GLVR2) was isolated and found to have 62% identity to GLVR1 and its amino acid sequence. Using a somatic cell hybrid panel, GLVR2 was found to map to human chromosome 8, a location distinct from that for GLVR1, which maps to human chromosome 2. The location of GLVR2 on chromosome 8 highlighted the possibility that the locus may encode a receptor for the murine amphotropic virus because a receptor gene (MLVAR) for this virus was mapped to chromosome 8 by Garcia et al. (1991). Expression of GLVR2 in CHO-K1 cells, which are resistant to infection by amphotropic virus because of the absence of a receptor, rendered the cells sensitive to infection by the virus. Thus, GLVR2 is a receptor for amphotropic virus. It was pointed out by van Zeijl et al. (1994) that expression of the GLVR2 protein might be a requirement for infection of human cells by amphotropic retroviral vectors for purposes of gene therapy.

Full details of the abovementioned studies are described in the following publications, the disclosure of which are hereby incorporated by reference:

van Zeijl, M.; Johann, S. V.; Closs, E.; Cunningham, J.; Eddy, R.; Shows, T. B.; O'Hara, B.: A human amphotropic retrovirus receptor is a second member of the gibbon ape leukemia virus receptor family. Proc. Nat. Acad. Sci. 91:1168-1172, 1994; and Garcia, J. V.; Jones, C.; Miller, A. D.: Localization of the amphotropic murine leukemia virus receptor gene to the pericentromeric region of human chromosome 8. J. Virol. 65:6316-6319.

Further studies establishing the function and utilities of SLC20A2 are found in John Hopkins OMIM database record ID 158378, and in sited publications numbered 380 and 4026-3802 listed in the bibliography section hereinbelow, which are also hereby incorporated by reference. Solute Carrier Family 30 (zinc transporter), Member 3 (SLC30A3, Accession NM_003459) is another VGAM232 host target gene. SLC30A3 BINDING SITE is HOST TARGET binding site found in the 5" untranslated region of mRNA encoded by SLC30A3, corresponding to a HOST TARGET binding site such as BINDING SITE I, BINDING SITE II or BINDING SITE III. Table 2 illustrates the complementarity of the nucleotide sequences of SLC30A3 BINDING SITE, designated SEQ ID:9527, to the nucleotide sequence of VGAM232 RNA, herein designated VGAM RNA, also designated SEQ ID:2943.

Another function of VGAM232 is therefore inhibition of Solute Carrier Family 30 (zinc transporter), Member 3 (SLC30A3, Accession NM_003459). Accordingly, utilities of VGAM232 include diagnosis, prevention and treatment of diseases and clinical conditions associated with SLC30A3. Spondin 1, (f-spondin) Extracellular Matrix Protein (SPON1, Accession XM_031184) is another VGAM232 host target gene. SPON1 BINDING SITE is HOST TARGET binding site found in the 3' untranslated region of mRNA encoded by SPON1, corresponding to a HOST TARGET binding site such as BINDING SITE I, BINDING SITE II or BINDING SITE III. Table 2 illustrates the complementarity of the nucleotide sequences of SPON1 BINDING SITE, designated SEQ ID:31301, to the nucleotide sequence of VGAM232 RNA, herein designated VGAM RNA, also designated SEQ ID:2943.

Another function of VGAM232 is therefore inhibition of Spondin 1, (f-spondin) Extracellular Matrix Protein (SPON1, Accession XM_031184). Accordingly, utilities of VGAM232 include diagnosis, prevention and treatment of diseases and clinical conditions associated with SPON1. Vascular Endothelial Growth Factor (VEGF, Accession NM_003376) is another VGAM232 host target gene. VEGF BINDING SITE1 and VEGF BINDING SITE2 are HOST TARGET binding sites found in untranslated regions of mRNA encoded by VEGF, corresponding to HOST TARGET binding sites such as BINDING SITE I, BINDING SITE II or BINDING SITE III. Table 2 illustrates the complementarity of the nucleotide sequences of VEGF BINDING SITE1 and VEGF BINDING SITE2, designated SEQ ID:9408 and SEQ ID:9409 respectively, to the nucleotide sequence of VGAM232 RNA, herein designated VGAM RNA, also designated SEQ ID:2943.

Another function of VGAM232 is therefore inhibition of Vascular Endothelial Growth Factor (VEGF, Accession NM_003376), a gene which induces endothelial cell proliferation and vascular permeability. Accordingly, utilities of VGAM232 include diagnosis, prevention and treatment of diseases and clinical conditions associated with VEGF. The function of VEGF has been established by previous studies. To explore the possibility that VEGF and angiopoietins (see OMIM Ref. No. ANG2, 601922) collaborate during tumor angiogenesis, Holash et al. (1999) analyzed several different murine and human tumor models. Holash et al. (1999) noted that angiopoietin-1 (ANG1; 601667) was antiapoptotic for cultured endothelial cells and expression of its antagonist angiopoietin-2 was induced in the endothelium of co-opted tumor vessels before their regression. In contrast, marked induction of VEGF expression occurred much later in tumor progression, in the hypoxic periphery of tumor cells surrounding the few remaining internal vessels, as well as adjacent to the robust plexus of vessels at the tumor margin. Expression of Ang2 in the few surviving internal vessels and in the angiogenic vessels at the tumor margin suggested that the destabilizing action of angiopoietin-2 facilitates the angiogenic action of VEGF at the tumor rim. Holash et al. (1999) implanted rat RBA mammary adenocarcinoma cells into rat brains. Tumor cells rapidly associated with and migrated along cerebral blood vessels. There was minimal upregulation of VEGF. Holash et al. (1999) suggested that a subset of tumors rapidly co-opts existing host vessels to form an initially well vascularized tumor mass. Perhaps as part of a host defense mechanism there is widespread regression of these initially co-opted vessels, leading to a secondarily avascular tumor and a massive tumor cell loss. However, the remaining tumor is ultimately rescued by robust angiogenesis at the tumor margin. Animal model experiments lend further support to the function of VEGF. De Fraipont et al. (2000) measured the cytosolic concentrations of 3 proteins involved in angiogenesis, namely, platelet-derived endothelial cell growth factor (PDECGF; 131222), VEGFA, and thrombospondin-1 (THBS1; 188060) in a series of 43 human sporadic adrenocortical tumors. The tumors were classified as adenomas, transitional tumors, or carcinomas. PDECGF/thymidine phosphorylase levels were not significantly different among these 3 groups. One hundred percent of the adenomas and 73% of the transitional tumors showed VEGFA concentrations under the threshold value of 107 ng/g protein, whereas 75% of the carcinomas had VEGFA concentrations above this threshold value. Similarly, 89% of the adenomas showed THBS1 concentrations above the threshold value of 57 microg/g protein, whereas only 25% of the carcinomas and 33% of the transitional tumor samples did so. IGF2 (OMIM Ref. No. 147470) overexpression, a common genetic alteration of adrenocortical carcinomas, was significantly correlated with higher VEGFA and lower THBS1 concentrations. The authors concluded that a decrease in THBS1 expression is an event that precedes an increase in VEGFA expression during adrenocortical tumor progression. The population of premalignant tumors with low THBS1 and normal VEGFA levels could represent a selective target for antiangiogenic therapies.

It is appreciated that the abovementioned animal model for VEGF is acknowledged by those skilled in the art as a scientifically valid animal model, as can be further appreciated from the publications sited hereinbelow.

Full details of the abovementioned studies are described in the following publications, the disclosure of which are hereby incorporated by reference:

Holash, J.; Maisonpierre, P. C.; Compton, D.; Boland, P.; Alexander, C. R.; Zagzag, D.; Yancopoulos, G. D.; Wiegand, S. J.: Vessel cooption, regression, and growth in tumors mediated by angiopoietins and VEGF. Science 284:1994-1998, 1999; and de Fraipont, F.; El Atifi, M.; Gicquel, C.; Bertagna, X.; Chambaz, E. M.; Feige, J. J.: Expression of the angiogenesis markers vascular endothelial growth factor-A, thrombospondin-1, and.

Further studies establishing the function and utilities of VEGF are found in John Hopkins OMIM database record ID 192240, and in sited publications numbered 3273, 11896, 10431-10432, 10516-10435, 11162-10442, 10595, 11761-1045 and 10479-9662 listed in the bibliography section hereinbelow, which are also hereby incorporated by reference. Calcium Channel, Voltage-dependent, Gamma Subunit 4 (CACNG4, Accession NM_014405) is another VGAM232 host target gene. CACNG4 BINDING SITE is HOST TARGET binding site found in the 3' untranslated region of mRNA encoded by CACNG4, corresponding to a HOST TARGET binding site such as BINDING SITE I, BINDING SITE II or BINDING SITE III. Table 2 illustrates the complementarity of the nucleotide sequences of CACNG4 BINDING SITE, designated SEQ ID:15745, to the nucleotide sequence of VGAM232 RNA, herein designated VGAM RNA, also designated SEQ ID:2943.

Another function of VGAM232 is therefore inhibition of Calcium Channel, Voltage-dependent, Gamma Subunit 4 (CACNG4, Accession NM_014405). Accordingly, utilities of VGAM232 include diagnosis, prevention and treatment of diseases and clinical conditions associated with CACNG4. Calcium/calmodulin-dependent Protein Kinase Kinase 1, Alpha (CAMKK1, Accession NM_032294) is another VGAM232 host target gene. CAMKK1 BINDING SITE is HOST TARGET binding site found in the 3' untranslated region of mRNA encoded by CAMKK1, corresponding to a HOST TARGET binding site such as BINDING SITE I, BINDING SITE II or BINDING SITE III. Table 2 illustrates the complementarity of the nucleotide sequences of CAMKK1 BINDING SITE, designated SEQ ID:26069, to the nucleotide sequence of VGAM232 RNA, herein designated VGAM RNA, also designated SEQ ID:2943.

Another function of VGAM232 is therefore inhibition of Calcium/calmodulin-dependent Protein Kinase Kinase 1, Alpha (CAMKK1, Accession NM_032294). Accordingly, utilities of VGAM232 include diagnosis, prevention and treatment of diseases and clinical conditions associated with CAMKK1. CAMP-GEFII (Accession NM_007023) is another VGAM232 host target gene. CAMP-GEFII BINDING SITE is HOST TARGET binding site found in the 3' untranslated region of mRNA encoded by CAMP-GEFII, corresponding to a HOST TARGET binding site such as BINDING SITE I, BINDING SITE II or BINDING SITE III. Table 2 illustrates the complementarity of the nucleotide sequences of CAMP-GEFII BINDING SITE, designated SEQ ID:13882, to the nucleotide sequence of VGAM232 RNA, herein designated VGAM RNA, also designated SEQ ID:2943.

Another function of VGAM232 is therefore inhibition of CAMP-GEFII (Accession NM_007023). Accordingly, utilities of VGAM232 include diagnosis, prevention and treatment of diseases and clinical conditions associated with CAMP-GEFII. Claudin 7 (CLDN7, Accession NM_001307) is another VGAM232 host target gene. CLDN7 BINDING SITE1 and CLDN7 BINDING SITE2 are HOST TARGET binding sites found in untranslated regions of mRNA encoded by CLDN7, corresponding to HOST TARGET binding sites such as BINDING SITE I, BINDING SITE II or BINDING SITE III. Table 2 illustrates the complementarity of the nucleotide sequences of CLDN7 BINDING SITE1 and CLDN7 BINDING SITE2, designated SEQ ID:6989 and SEQ ID:45384 respectively, to the nucleotide sequence of VGAM232 RNA, herein designated VGAM RNA, also designated SEQ ID:2943.

Another function of VGAM232 is therefore inhibition of Claudin 7 (CLDN7, Accession NM_001307). Accordingly, utilities of VGAM232 include diagnosis, prevention and treatment of diseases and clinical conditions associated with CLDN7. Erythrocyte Membrane Protein Band 4.1-like 1 (EPB41L1, Accession XM_047295) is another VGAM232 host target gene. EPB41L1 BINDING SITE is HOST TARGET binding site found in the 3' untranslated region of mRNA encoded by EPB41L1, corresponding to a HOST TARGET binding site such as BINDING SITE I, BINDING SITE II or BINDING SITE III. Table 2 illustrates the complementarity of the nucleotide sequences of EPB41L1 BINDING SITE, designated SEQ ID:34941, to the nucleotide sequence of VGAM232 RNA, herein designated VGAM RNA, also designated SEQ ID:2943.

Another function of VGAM232 is therefore inhibition of Erythrocyte Membrane Protein Band 4.1-like 1 (EPB41L1, Accession XM_047295). Accordingly, utilities of VGAM232 include diagnosis, prevention and treatment of diseases and clinical conditions associated with EPB41L1. FLJ20886 (Accession XM_170820) is another VGAM232 host target gene. FLJ20886 BINDING SITE is HOST TARGET binding site found in the 5' untranslated region of mRNA encoded by FLJ20886, corresponding to a HOST TARGET binding site such as BINDING SITE I, BINDING SITE II or BINDING SITE III. Table 2 illustrates the complementarity of the nucleotide sequences of FLJ20886 BINDING SITE, designated SEQ ID:45595, to the nucleotide sequence of VGAM232 RNA, herein designated VGAM RNA, also designated SEQ ID:2943.

Another function of VGAM232 is therefore inhibition of FLJ20886 (Accession XM_170820). Accordingly, utilities of VGAM232 include diagnosis, prevention and treatment of diseases and clinical conditions associated with FLJ20886. FLJ23024 (Accession NM_024936) is another VGAM232 host target gene. FLJ23024 BINDING SITE is HOST TARGET binding site found in the 3' untranslated region of mRNA encoded by FLJ23024, corresponding to a HOST TARGET binding site such as BINDING SITE I, BINDING SITE II or BINDING SITE III. Table 2 illustrates the complementarity of the nucleotide sequences of FLJ23024 BINDING SITE, designated SEQ ID:24473, to the nucleotide sequence of VGAM232 RNA, herein designated VGAM RNA, also designated SEQ ID:2943.

Another function of VGAM232 is therefore inhibition of FLJ23024 (Accession NM_024936). Accordingly, utilities of VGAM232 include diagnosis, prevention and treatment of diseases and clinical conditions associated with FLJ23024. FLJ31709 (Accession NM_144636) is another VGAM232 host target gene. FLJ31709 BINDING SITE is HOST TARGET binding site found in the 5' untranslated region of mRNA encoded by FLJ31709, corresponding to a HOST TARGET binding site such as BINDING SITE I, BINDING SITE II or BINDING SITE III. Table 2 illustrates the complementarity of the nucleotide sequences of FLJ31709 BINDING SITE, designated SEQ ID:29457, to the nucleotide sequence of VGAM232 RNA, herein designated VGAM RNA, also designated SEQ ID:2943.

Another function of VGAM232 is therefore inhibition of FLJ31709 (Accession NM_144636). Accordingly, utilities of VGAM232 include diagnosis, prevention and treatment of diseases and clinical conditions associated with FLJ31709. GPCR150 (Accession NM_014373) is another VGAM232 host target gene. GPCR150 BINDING SITE is HOST TARGET binding site found in the 5' untranslated region of mRNA encoded by GPCR150, corresponding to a HOST TARGET binding site such as BINDING SITE I, BINDING SITE II or BINDING SITE III. Table 2 illustrates the complementarity of the nucleotide sequences of GPCR150 BINDING SITE, designated SEQ ID:15708, to the nucleotide sequence of VGAM232 RNA, herein designated VGAM RNA, also designated SEQ ID:2943.

Another function of VGAM232 is therefore inhibition of GPCR150 (Accession NM_014373). Accordingly, utilities of VGAM232 include diagnosis, prevention and treatment of diseases and clinical conditions associated with GPCR150. HELO1 (Accession NM_021814) is another VGAM232 host target gene. HELO1 BINDING SITE is HOST TARGET binding site found in the 5' untranslated region of mRNA encoded by HELO1, corresponding to a HOST TARGET binding site such as BINDING SITE I, BINDING SITE II or BINDING SITE III. Table 2 illustrates the complementarity of the nucleotide sequences of HELO1 BINDING SITE, designated SEQ ID:22384, to the nucleotide sequence of VGAM232 RNA, herein designated VGAM RNA, also designated SEQ ID:2943.

Another function of VGAM232 is therefore inhibition of HELO1 (Accession NM_021814). Accordingly, utilities of VGAM232 include diagnosis, prevention and treatment of diseases and clinical conditions associated with HELO1. IDI2 (Accession NM_033261) is another VGAM232 host target gene. IDI2 BINDING SITE is HOST TARGET binding site found in the 3' untranslated region of mRNA encoded by IDI2, corresponding to a HOST TARGET binding site such as BINDING SITE I, BINDING SITE II or BINDING SITE III. Table 2 illustrates the complementarity of the nucleotide sequences of IDI2 BINDING SITE, designated SEQ ID:27092, to the nucleotide sequence of VGAM232 RNA, herein designated VGAM RNA, also designated SEQ ID:2943.

Another function of VGAM232 is therefore inhibition of IDI2 (Accession NM_033261). Accordingly, utilities of VGAM232 include diagnosis, prevention and treatment of diseases and clinical conditions associated with IDI2. KIAA0515 (Accession XM_033380) is another VGAM232 host target gene. KIAA0515 BINDING SITE is HOST TARGET binding site found in the 5' untranslated region of mRNA encoded by KIAA0515, corresponding to a HOST TARGET binding site such as BINDING SITE I, BINDING SITE II or BINDING SITE III. Table 2 illustrates the complementarity of the nucleotide sequences of KIAA0515 BINDING SITE, designated SEQ ID:31926, to the nucleotide sequence of VGAM232 RNA, herein designated VGAM RNA, also designated SEQ ID:2943.

Another function of VGAM232 is therefore inhibition of KIAA0515 (Accession XM_033380). Accordingly, utilities of VGAM232 include diagnosis, prevention and treatment of diseases and clinical conditions associated with KIAA0515. KIAA0561 (Accession XM_038150) is another VGAM232 host target gene. KIAA0561 BINDING SITE is HOST TARGET binding site found in the 3' untranslated region of mRNA encoded by KIAA0561, corresponding to a HOST TARGET binding site such as BINDING SITE I, BINDING SITE II or BINDING SITE III. Table 2 illustrates the complementarity of the nucleotide sequences of KIAA0561 BINDING SITE, designated SEQ ID:32765, to the nucleotide sequence of VGAM232 RNA, herein designated VGAM RNA, also designated SEQ ID:2943.

Another function of VGAM232 is therefore inhibition of KIAA0561 (Accession XM_038150). Accordingly, utilities of VGAM232 include diagnosis, prevention and treatment of diseases and clinical conditions associated with KIAA0561. KIAA1052 (Accession NM_014956) is another VGAM232 host target gene. KIAA1052 BINDING SITE is HOST TARGET binding site found in the 3' untranslated region of mRNA encoded by KIAA1052, corresponding to a HOST TARGET binding site such as BINDING SITE I, BINDING SITE II or BINDING SITE III. Table 2 illustrates the complementarity of the nucleotide sequences of KIAA1052 BINDING SITE, designated SEQ ID:17314, to the nucleotide sequence of VGAM232 RNA, herein designated VGAM RNA, also designated SEQ ID:2943.

Another function of VGAM232 is therefore inhibition of KIAA1052 (Accession NM_014956). Accordingly, utilities of VGAM232 include diagnosis, prevention and treatment of diseases and clinical conditions associated with KIAA1052. KIAA1509 (Accession XM_029353) is another VGAM232 host target gene. KIAA1509 BINDING SITE is HOST TARGET binding site found in the 3' untranslated region of mRNA encoded by KIAA1509, corresponding to a HOST TARGET binding site such as BINDING SITE I, BINDING SITE II or BINDING SITE III. Table 2 illustrates the complementarity of the nucleotide sequences of KIAA1509 BINDING SITE, designated SEQ ID:30874, to the nucleotide sequence of VGAM232 RNA, herein designated VGAM RNA, also designated SEQ ID:2943.

Another function of VGAM232 is therefore inhibition of KIAA1509 (Accession XM_029353). Accordingly, utilities of VGAM232 include diagnosis, prevention and treatment of diseases and clinical conditions associated with KIAA1509. KIAA1855 (Accession XM_166453) is another VGAM232 host target gene. KIAA1855 BINDING SITE is HOST TARGET binding site found in the 3' untranslated region of mRNA encoded by KIAA1855, corresponding to a HOST TARGET binding site such as BINDING SITE I, BINDING SITE II or BINDING SITE III. Table 2 illustrates the complementarity of the nucleotide sequences of KIAA1855 BINDING SITE, designated SEQ ID:44360, to the nucleotide sequence of VGAM232 RNA, herein designated VGAM RNA, also designated SEQ ID:2943.

Another function of VGAM232 is therefore inhibition of KIAA1855 (Accession XM_166453). Accordingly, utilities of VGAM232 include diagnosis, prevention and treatment of diseases and clinical conditions associated with KIAA1855. LIM and SH3 Protein 1 (LASP1, Accession NM_006148) is another VGAM232 host target gene. LASP1 BINDING SITE is HOST TARGET binding site found in the 3' untranslated region of mRNA encoded by LASP1, corresponding to a HOST TARGET binding site such as BINDING SITE I, BINDING SITE II or BINDING SITE III. Table 2 illustrates the complementarity of the nucleotide sequences of LASP1 BINDING SITE, designated SEQ ID:12800, to the nucleotide sequence of VGAM232 RNA, herein designated VGAM RNA, also designated SEQ ID:2943.

Another function of VGAM232 is therefore inhibition of LIM and SH3 Protein 1 (LASP1, Accession NM_006148). Accordingly, utilities of VGAM232 include diagnosis, prevention and treatment of diseases and clinical conditions associated with LASP1. MGC13057 (Accession NM_032321) is another VGAM232 host target gene. MGC13057 BINDING SITE is HOST TARGET binding site found in the 5' untranslated region of mRNA encoded by MGC13057, corresponding to a HOST TARGET binding site such as BINDING SITE I, BINDING SITE II or BINDING SITE III. Table 2 illustrates the complementarity of the nucleotide sequences of MGC13057 BINDING SITE, designated SEQ ID:26126, to the nucleotide sequence of VGAM232 RNA, herein designated VGAM RNA, also designated SEQ ID:2943.

Another function of VGAM232 is therefore inhibition of MGC13057 (Accession NM_032321). Accordingly, utilities of VGAM232 include diagnosis, prevention and treatment of diseases and clinical conditions associated with MGC13057. Netrin 4 (NTN4, Accession XM_031896) is another VGAM232 host target gene. NTN4 BINDING SITE is HOST TARGET binding site found in the 5' untranslated region of mRNA encoded by NTN4, corresponding to a HOST TARGET binding site such as BINDING SITE I, BINDING SITE II or BINDING SITE III. Table 2 illustrates the complementarity of the nucleotide sequences of NTN4 BINDING SITE, designated SEQ ID:31514, to the nucleotide sequence of VGAM232 RNA, herein designated VGAM RNA, also designated SEQ ID:2943.

Another function of VGAM232 is therefore inhibition of Netrin 4 (NTN4, Accession XM_031896). Accordingly, utilities of VGAM232 include diagnosis, prevention and treatment of diseases and clinical conditions associated with NTN4. PPI5PIV (Accession NM_019892) is another VGAM232 host target gene. PPI5PIV BINDING SITE is HOST TARGET binding site found in the 3' untranslated region of mRNA encoded by PPI5PIV, corresponding to a HOST TARGET binding site such as BINDING SITE I, BINDING SITE II or BINDING SITE III. Table 2 illustrates the complementarity of the nucleotide sequences of PPI5PIV BINDING SITE, designated SEQ ID:21276, to the nucleotide sequence of VGAM232 RNA, herein designated VGAM RNA, also designated SEQ ID:2943.

Another function of VGAM232 is therefore inhibition of PPI5PIV (Accession NM_019892). Accordingly, utilities of VGAM232 include diagnosis, prevention and treatment of diseases and clinical conditions associated with PPI5PIV. SKIP (Accession NM_016532) is another VGAM232 host target gene. SKIP BINDING SITE1 and SKIP BINDING SITE2 are HOST TARGET binding sites found in untranslated regions of mRNA encoded by SKIP, corresponding to HOST TARGET binding sites such as BINDING SITE I, BINDING SITE II or BINDING SITE III. Table 2 illustrates the complementarity of the nucleotide sequences of SKIP BINDING SITE1 and SKIP BINDING SITE2, designated SEQ ID:18598 and SEQ ID:28261 respectively, to the nucleotide sequence of VGAM232 RNA, herein designated VGAM RNA, also designated SEQ ID:2943.

Another function of VGAM232 is therefore inhibition of SKIP (Accession NM_016532). Accordingly, utilities of VGAM232 include diagnosis, prevention and treatment of diseases and clinical conditions associated with SKIP. ZNF340 (Accession XM_097701) is another VGAM232 host target gene. ZNF340 BINDING SITE is HOST TARGET binding site found in the 5' untranslated region of mRNA encoded by ZNF340, corresponding to a HOST TARGET binding site such as BINDING SITE I, BINDING SITE II or BINDING SITE III. Table 2 illustrates the complementarity of the nucleotide sequences of ZNF340 BINDING SITE, designated SEQ ID:41033, to the nucleotide sequence of VGAM232 RNA, herein designated VGAM RNA, also designated SEQ ID:2943.

Another function of VGAM232 is therefore inhibition of ZNF340 (Accession XM_097701). Accordingly, utilities of VGAM232 include diagnosis, prevention and treatment of diseases and clinical conditions associated with ZNF340. LOC113763 (Accession NM_138434) is another VGAM232 host target gene. LOC113763 BINDING SITE is HOST TARGET binding site found in the 3' untranslated region of mRNA encoded by LOC113763, corresponding to a HOST TARGET binding site such as BINDING SITE I, BINDING SITE II or BINDING SITE III. Table 2 illustrates the complementarity of the nucleotide sequences of LOC113763 BINDING SITE, designated SEQ ID:28802, to the nucleotide sequence of VGAM232 RNA, herein designated VGAM RNA, also designated SEQ ID:2943.

Another function of VGAM232 is therefore inhibition of LOC113763 (Accession NM_138434). Accordingly, utilities of VGAM232 include diagnosis, prevention and treatment of diseases and clinical conditions associated with LOC113763. LOC145482 (Accession XM_085154) is another VGAM232 host target gene. LOC145482 BINDING SITE is HOST TARGET binding site found in the 3' untranslated region of mRNA encoded by LOC145482, corresponding to a HOST TARGET binding site such as BINDING SITE I, BINDING SITE II or BINDING SITE III. Table 2 illustrates the complementarity of the nucleotide sequences of LOC145482 BINDING SITE, designated SEQ ID:37877, to the nucleotide sequence of VGAM232 RNA, herein designated VGAM RNA, also designated SEQ ID:2943.

Another function of VGAM232 is therefore inhibition of LOC145482 (Accession XM_085154). Accordingly, utilities of VGAM232 include diagnosis, prevention and treatment of diseases and clinical conditions associated with LOC145482. LOC145694 (Accession XM_096838) is another VGAM232 host target gene. LOC145694 BINDING SITE is HOST TARGET binding site found in the 5' untranslated region of mRNA encoded by LOC145694, corresponding to a HOST TARGET binding site such as BINDING SITE I, BINDING SITE II or BINDING SITE III. Table 2 illustrates the complementarity of the nucleotide sequences of LOC145694 BINDING SITE, designated SEQ ID:40557, to the nucleotide sequence of VGAM232 RNA, herein designated VGAM RNA, also designated SEQ ID:2943.

Another function of VGAM232 is therefore inhibition of LOC145694 (Accession XM_096838). Accordingly, utilities of VGAM232 include diagnosis, prevention and treatment of diseases and clinical conditions associated with LOC145694. LOC149171 (Accession XM_086450) is another VGAM232 host target gene. LOC149171 BINDING SITE is HOST TARGET binding site found in the 5' untranslated region of mRNA encoded by LOC149171, corresponding to a HOST TARGET binding site such as BINDING SITE I, BINDING SITE II or BINDING SITE III. Table 2 illustrates the complementarity of the nucleotide sequences of LOC149171 BINDING SITE, designated SEQ ID:38667, to the nucleotide sequence of VGAM232 RNA, herein designated VGAM RNA, also designated SEQ ID:2943.

Another function of VGAM232 is therefore inhibition of LOC149171 (Accession XM_086450). Accordingly, utilities of VGAM232 include diagnosis, prevention and treatment of diseases and clinical conditions associated with LOC149171. LOC149706 (Accession XM_097718) is another VGAM232 host target gene. LOC149706 BINDING SITE is HOST TARGET binding site found in the 5' untranslated region of mRNA encoded by LOC149706, corresponding to a HOST TARGET binding site such as BINDING SITE I, BINDING SITE II or BINDING SITE III. Table 2 illustrates the complementarity of the nucleotide sequences of LOC149706 BINDING SITE, designated SEQ ID:41058, to the nucleotide sequence of VGAM232 RNA, herein designated VGAM RNA, also designated SEQ ID:2943.

Another function of VGAM232 is therefore inhibition of LOC149706 (Accession XM_097718). Accordingly, utilities of VGAM232 include diagnosis, prevention and treatment of diseases and clinical conditions associated with LOC149706. LOC164382 (Accession XM_104390) is another VGAM232 host target gene. LOC164382 BINDING SITE is HOST TARGET binding site found in the 3' untranslated region of mRNA encoded by LOC164382, corresponding to a HOST TARGET binding site such as BINDING SITE I, BINDING SITE II or BINDING SITE III. Table 2 illustrates the complementarity of the nucleotide sequences of LOC164382 BINDING SITE, designated SEQ ID:42164, to the nucleotide sequence of VGAM232 RNA, herein designated VGAM RNA, also designated SEQ ID:2943.

Another function of VGAM232 is therefore inhibition of LOC164382 (Accession XM_104390). Accordingly, utilities of VGAM232 include diagnosis, prevention and treatment of diseases and clinical conditions associated with LOC164382. LOC166042 (Accession XM_093623) is another VGAM232 host target gene. LOC166042 BINDING SITE is HOST TARGET binding site found in the 5' untranslated region of mRNA encoded by LOC166042, corresponding to a HOST TARGET binding site such as BINDING SITE I, BINDING SITE II or BINDING SITE III. Table 2 illustrates the complementarity of the nucleotide sequences of LOC166042 BINDING SITE, designated SEQ ID:40200, to the nucleotide sequence of VGAM232 RNA, herein designated VGAM RNA, also designated SEQ ID:2943.

Another function of VGAM232 is therefore inhibition of LOC166042 (Accession XM_093623). Accordingly, utilities of VGAM232 include diagnosis, prevention and treatment of diseases and clinical conditions associated with LOC166042. LOC204161 (Accession XM_118480) is another VGAM232 host target gene. LOC204161 BINDING SITE1 and LOC204161 BINDING SITE2 are HOST TARGET binding sites found in untranslated regions of mRNA encoded by LOC204161, corresponding to HOST TARGET binding sites such as BINDING SITE I, BINDING SITE II or BINDING SITE III. Table 2 illustrates the complementarity of the nucleotide sequences of LOC204161 BINDING SITE1 and LOC204161 BINDING SITE2, designated SEQ ID:43580 and SEQ ID:43581 respectively, to the nucleotide sequence of VGAM232 RNA, herein designated VGAM RNA, also designated SEQ ID:2943.

Another function of VGAM232 is therefore inhibition of LOC204161 (Accession XM_118480). Accordingly, utilities of VGAM232 include diagnosis, prevention and treatment of diseases and clinical conditions associated with LOC204161. FIG. 1 further provides a conceptual description of a novel bioinformatically detected viral gene of the present invention, referred to here as Viral Genomic Address Messenger 233 (VGAM233) viral gene, which modulates expression of respective host target genes thereof, the function and utility of which host target genes is known in the art.

VGAM233 is a novel bioinformatically detected regulatory, non protein coding, viral micro RNA (miRNA) gene. The method by which VGAM233 was detected is described hereinabove with reference to FIGS. 1-8.

VGAM233 gene, herein designated VGAM GENE, is a viral gene contained in the genome of Callitrichine Herpesvirus 3. VGAM233 host target gene, herein designated VGAM HOST TARGET GENE, is a human gene contained in the human genome.

VGAM233 gene encodes a VGAM233 precursor RNA, herein designated VGAM PRECURSOR RNA. Similar to other miRNA genes, and unlike most ordinary genes, VGAM233 precursor RNA does not encode a protein. A nucleotide sequence identical or highly similar to the nucleotide sequence of VGAM233 precursor RNA is designated SEQ ID:219, and is provided hereinbelow with reference to the sequence listing part. Nucleotide sequence SEQ ID:219 is located at position 55213 relative to the genome of Callitrichine Herpesvirus 3.

VGAM233 precursor RNA folds onto itself, forming VGAM233 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM233 folded precursor RNA into VGAM233 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM233 RNA is designated SEQ ID:2944, and is provided hereinbelow with reference to the sequence listing part.

VGAM233 host target gene, herein designated VGAM HOST TARGET GENE, encodes a corresponding messenger RNA, VGAM233 host target RNA, herein designated VGAM HOST TARGET RNA. VGAM233 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM233 RNA, herein designated VGAM RNA, binds complementarily to one or more host target binding sites located in untranslated regions of VGAM233 host target RNA, herein designated VGAM HOST TARGET RNA. This complementary binding is due to the fact that the nucleotide sequence of VGAM233 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM233 RNA, herein designated VGAM RNA, may have a different number of host target binding sites in untranslated regions of a VGAM233 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM233 RNA, herein designated VGAM RNA, to host target binding sites on VGAM233 host target RNA, herein designated VGAM HOST TARGET RNA, such as BINDING SITE I, BINDING SITE II and BINDING SITE III, inhibits translation of VGAM233 host target RNA into VGAM233 host target protein, herein designated VGAM HOST TARGET PROTEIN. VGAM host target protein is therefore outlined by a broken line.

It is appreciated that VGAM233 host target gene, herein designated VGAM HOST TARGET GENE, in fact represents a plurality of VGAM233 host target genes. The mRNA of each one of this plurality of VGAM233 host target genes comprises one or more host target binding sites, each having a nucleotide sequence which is at least partly complementary to VGAM233 RNA, herein designated VGAM RNA, and which when bound by VGAM233 RNA causes inhibition of translation of respective one or more VGAM233 host target proteins.

It is further appreciated by one skilled in the art that the mode of translational inhibition illustrated by FIG. 1 with specific reference to translational inhibition exerted by VGAM233 gene, herein designated VGAM GENE, on one or more VGAM233 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM233 is inhibition of expression of host target genes, as part of a novel viral mechanism of attacking a host. Accordingly, utilities of VGAM233 include diagnosis, prevention and treatment of viral infection by Callitrichine Herpesvirus 3. Specific functions, and accordingly utilities, of VGAM233 correlate with, and may be deduced from, the identity of the host target genes which VGAM233 binds and inhibits, and the function of these host target genes, as elaborated hereinbelow.

Nucleotide sequences of the VGAM233 precursor RNA, herein designated VGAM PRECURSOR RNA, and of the 'diced' VGAM233 RNA, herein designated VGAM RNA, and a schematic representation of the secondary folding of VGAM233 folded precursor RNA, herein designated VGAM FOLDED PRECURSOR RNA, of VGAM233 are further described hereinbelow with reference to Table 1.

Nucleotide sequences of host target binding sites, such as BINDING SITE-I, BINDING SITE-II and BINDING SITE-III of FIG. 1, found on VGAM233 host target RNA, and schematic representation of the complementarity of each of these host target binding sites to VGAM233 RNA, herein designated VGAM RNA, are described hereinbelow with reference to Table 2.

As mentioned hereinabove with reference to FIG. 1, a function of VGAM233 gene, herein designated VGAM is inhibition of expression of VGAM233 target genes. It is appreciated that specific functions, and accordingly utilities, of VGAM233 correlate with, and may be deduced from, the identity of the target genes which VGAM233 binds and inhibits, and the function of these target genes, as elaborated hereinbelow.

Bone Morphogenetic Protein 6 (BMP6, Accession NM_001718) is a VGAM233 host target gene. BMP6 BINDING SITE is HOST TARGET binding site found in the 3' untranslated region of mRNA encoded by BMP6, corresponding to a HOST TARGET binding site such as BINDING SITE I, BINDING SITE II or BINDING SITE III. Table 2 illustrates the complementarity of the nucleotide sequences of BMP6 BINDING SITE, designated SEQ ID:7454, to the nucleotide sequence of VGAM233 RNA, herein designated VGAM RNA, also designated SEQ ID:2944.

A function of VGAM233 is therefore inhibition of Bone Morphogenetic Protein 6 (BMP6, Accession NM_001718), a gene which induces cartilage and bone formation. Accordingly, utilities of VGAM233 include diagnosis, prevention and treatment of diseases and clinical conditions associated with BMP6. The function of BMP6 has been established by previous studies. See BMP5 (OMIM Ref. No. 112265). Hahn et al. (1992) mapped both BMP5 and BMP6 to human chromosome 6 by study of human/rodent somatic cell hybrid lines with cDNA probes. Olavesen et al. (1997) reported fine mapping of 39 ESTs on 6p25-p23. Most of the ESTs (31 of 39) were positioned in the 6p24-p23 interval; of these, 8 were located within a single PAC clone. BMP6 was 1 of the 8 loci on the PAC, between TFAP2 (OMIM Ref. No. 107580) at the centromeric side and DSP (OMIM Ref. No. 125647) on the telomeric side. Rickard et al. (1998) presented evidence that the skeletal effects of estrogen on bone and cartilage may be mediated by increased production of BMP6 by osteoblasts. They investigated the effect of estrogen on BMP production in 2 estrogen-responsive, human immortalized cell lines that display the mature osteoblast phenotype.

Full details of the abovementioned studies are described in the following publications, the disclosure of which are hereby incorporated by reference:

Hahn, G. V.; Cohen, R. B.; Wozney, J. M.; Levitz, C. L.; Shore, E. M.; Zasloff, M. A.; Kaplan, F. S.: A bone morphogenetic protein subfamily: chromosomal localization of human genes for BMP5, BMP6, and BMP7. Genomics 14:759-762, 1992; and Rickard, D. J.; Hofbauer, L. C.; Bonde, S. K.; Gori, F.; Spelsberg, T. C.; Riggs, B. L.: Bone morphogenetic protein-6 production in human osteoblastic cell lines: selective regulation b.

Further studies establishing the function and utilities of BMP6 are found in John Hopkins OMIM database record ID 112266, and in sited publications numbered 2714-191 and 4585 listed in the bibliography section hereinbelow, which are also hereby incorporated by reference. Calcium Channel, Voltage-dependent, Beta 1 Subunit (CACNB1, Accession NM_000723) is another VGAM233 host target gene. CACNB1 BINDING SITE is HOST TARGET binding site found in the 3' untranslated region of mRNA encoded by CACNB1, corresponding to a HOST TARGET binding site such as BINDING SITE I, BINDING SITE II or BINDING SITE III. Table 2 illustrates the complementarity of the nucleotide sequences of CACNB1 BINDING SITE, designated SEQ ID:6386, to the nucleotide sequence of VGAM233 RNA, herein designated VGAM RNA, also designated SEQ ID:2944.

Another function of VGAM233 is therefore inhibition of Calcium Channel, Voltage-dependent, Beta 1 Subunit (CACNB1, Accession NM_000723), a gene which may not only play an important role in the transport/insertion of the alpha-1S subunit into the membrane. Accordingly, utilities of VGAM233 include diagnosis, prevention and treatment of diseases and clinical conditions associated with CACNB1. The function of CACNB1 and its association with various diseases and clinical conditions, has been established by previous studies, as described hereinabove with reference to VGAM114. Disrupted In Schizophrenia 1 (DISC1, Accession NM_018662) is another VGAM233 host target gene. DISC1 BINDING SITE is HOST TARGET binding site found in the 3' untranslated region of mRNA encoded by DISC1, corresponding to a HOST TARGET binding site such as BINDING SITE I, BINDING SITE II or BINDING SITE III. Table 2 illustrates the complementarity of the nucleotide sequences of DISC1 BINDING SITE, designated SEQ ID:20735, to the nucleotide sequence of VGAM233 RNA, herein designated VGAM RNA, also designated SEQ ID:2944.

Another function of VGAM233 is therefore inhibition of Disrupted In Schizophrenia 1 (DISC1, Accession NM_018662), a gene which has globular N-terminal domain (s) and a helical C-terminal domain. Accordingly, utilities of VGAM233 include diagnosis, prevention and treatment of diseases and clinical conditions associated with DISC1. The function of DISC1 and its association with various diseases and clinical conditions, has been established by previous studies, as described hereinabove with reference to VGAM74. Ectodermal-neural Cortex (with BTB-like domain) (ENC1, Accession NM_003633) is another VGAM233 host target gene. ENC1 BINDING SITE is HOST TARGET binding site found in the 3' untranslated region of mRNA encoded by ENC1, corresponding to a HOST TARGET binding site such as BINDING SITE I, BINDING SITE II or BINDING SITE III. Table 2 illustrates the complementarity of the nucleotide sequences of ENC1 BINDING SITE, designated SEQ ID:9698, to the nucleotide sequence of VGAM233 RNA, herein designated VGAM RNA, also designated SEQ ID:2944.

Another function of VGAM233 is therefore inhibition of Ectodermal-neural Cortex (with BTB-like domain) (ENC1, Accession NM_003633), a gene which is an actin-binding protein involved in the regulation of neuronal process formation and in differentiation of neural crest cells. Accordingly, utilities of VGAM233 include diagnosis, prevention and treatment of diseases and clinical conditions associated with ENC1. The function of ENC1 has been established by previous studies. DNA damage and/or hyperproliferative signals activate wildtype p53 tumor suppressor protein (TP53; 191170), inducing cell cycle arrest or apoptosis. Mutations that inactivate p53 occur in 50% of all tumors. Polyak et al. (1997) used serial analysis of gene expression (SAGE) to evaluate cellular mRNA levels in a colorectal cancer cell line transfected with p53. Of 7,202 transcripts identified, only 14 were expressed at levels more than 10-fold higher in p53-expressing cells than in control cells. Polyak et al. (1997) termed these genes 'p53-induced genes,' or PIGs, several of which were predicted to encode redox-controlling proteins. They noted that reactive oxygen species (ROS) are potent inducers of apoptosis. Flow cytometric analysis showed that p53 expression induces ROS production, which increases as apoptosis progresses under some conditions. The authors stated that the PIG10 gene, also called ENC1, encodes an actin-binding protein. By screening fetal and adult hippocampus cDNA libraries using a brain development-related cDNA as the probe, Kim et al. (1998) obtained cDNAs encoding ENC1, which they called NRPB (nuclear-restricted protein/brain). Human and mouse ENC1 share 99% amino acid identity. The deduced 589-amino acid ENC1 protein has a 114-amino acid BTB/POZ-like domain in the alpha-helical N terminus and a beta sheet bearing a 50-amino acid 'kelch' motif repeated 6 times in the C terminus. The kelch motif invariably contains 2 adjacent glycine residues and shares homology with several actin-associated proteins, including the Drosophila kelch protein. Northern blot analysis detected abundant expression of a 5.5-kb ENC1 transcript in fetal brain, with moderate expression in fetal heart, lung, and kidney. In adult tissues, high levels of ENC1 were detected in brain, particularly in amygdala and hippocampus, and lower levels were detected in pancreas. In 12 day- but not 10 day-postcoitus mouse embryos, expression of Enc1 was 50-fold higher in brain than in other tissues. Immunoprecipitation and Western blot analysis showed that ENC1 is expressed as a 67-kD protein in nuclear pellets and as 67- and 57-kD proteins in total cell lysates from primary neurons. Western blot analysis, immunofluorescence, and confocal microscopy demonstrated that Enc1 is expressed in the nuclear matrix of rat hippocampal neurons but not at all in astrocytes. By searching an EST database for homologs of mouse Enc1, Hernandez et al. (1998) identified human ENC1. Northern blot analysis detected abundant expression of an approximately 4.5-kb ENC1 transcript in brain, with lower expression in pancreas and no expression in other tissues. Within the central nervous system, expression was highest in cerebral cortex, frontal and temporal lobes, putamen, and spinal cord; lower expression was found in medulla and cerebellum, and very low levels of expression were found in the occipital pole. Low levels of ENC1 were also detected in a variety of neural tumor cell lines. ENC1 expression increased dramatically in a neuroblastoma cell line undergoing retinoic acid-induced differentiation. By differential display, Zhao et al. (2000) identified rat Enc1 as a transcript associated with differentiation of rat preadipocytes in primary culture. Using the fragment identified by differential display as probe, they cloned full-length Enc1 cDNA from a mouse brain cDNA library. By Northern blot analysis of rat tissues, Zhao et al. (2000) found high expression in brain, low expression in testis, and no expression in other tissues tested. They also found high expression of Enc1 in the stroma-vascular fraction of adipose tissue but very little in mature adipocyte fraction. Transient transfection in a 3T3 fibroblastic preadipocyte cell line resulted in subcellular colocalization with F-actin (OMIM Ref. No. 102560). Kim et al. (1998) showed that expression of ENC1 induced neuronal process formation, whereas antisense treatment inhibited neurite development. Immunoblot analysis showed that ENC1 can be phosphorylated and binds to the functionally active hypophosphorylated form of the nuclear matrix protein RB1 (OMIM Ref. No. 180200) during neuronal differentiation. Using primary cell culture of rat stroma-vascular cells, Zhao et al. (2000) found that transient early expression of Enc1 preceded the conversion of the fibroblastic preadipocytes to mature adipose. Enc1 expression also preceded expression of adipocyte-specific markers, including transcription factors known to activate adipocyte genes. Antisense transfection blocked differentiation to the mature adipocyte morphology.

Full details of the abovementioned studies are described in the following publications, the disclosure of which are hereby incorporated by reference:

Zhao, L.; Gregoire, F.; Sul, H. S.: Transient induction of ENC-1, a kelch-related actin-binding protein, is required for adipocyte differentiation. J. Biol. Chem. 275:16845-16850, 2000; and Hernandez, M.-C.; Andres-Barquin, P. J.; Israel, M. A.: Assignment of the ectodermal-neural cortex 1 gene (Enc1) to mouse chromosome band 13D1 by fluorescence in situ hybridization. Cy.

Further studies establishing the function and utilities of ENC1 are found in John Hopkins OMIM database record ID 605173, and in sited publications numbered 2332-2335, 233 and 4795 listed in the bibliography section hereinbelow, which are also hereby incorporated by reference. F-box and WD-40 Domain Protein 1B (FBXW1B, Accession NM_012300) is another VGAM233 host target gene. FBXW1B BINDING SITE1 through FBXW1B BINDING SITE3 are HOST TARGET binding sites found in untranslated regions of mRNA encoded by FBXW1B, corresponding to HOST TARGET binding sites such as BINDING SITE I, BINDING SITE II or BINDING SITE III. Table 2 illustrates the complementarity of the nucleotide sequences of FBXW1B BINDING SITE1 through FBXW1B BINDING SITE3, designated SEQ ID:14662, SEQ ID:27364 and SEQ ID:27374 respectively, to the nucleotide sequence of VGAM233 RNA, herein designated VGAM RNA, also designated SEQ ID:2944.

Another function of VGAM233 is therefore inhibition of F-box and WD-40 Domain Protein 1B (FBXW1B, Accession NM_012300), a gene which somehow is involved in the process of neuronal cell differentiation or brain development. Accordingly, utilities of VGAM233 include diagnosis, prevention and treatment of diseases and clinical conditions associated with FBXW1B. The function of FBXW1B and its association with various diseases and clinical conditions, has been established by previous studies, as described hereinabove with reference to VGAM25. Protocadherin Gamma Subfamily A, 11 (PCDHGA11, Accession NM_018914) is another VGAM233 host target gene. PCDHGA11 BINDING SITE1 through PCDHGA11 BINDING SITE3 are HOST TARGET binding sites found in untranslated regions of mRNA encoded by PCDHGA11, corresponding to HOST TARGET binding sites such as BINDING SITE I, BINDING SITE II or BINDING SITE III. Table 2 illustrates the complementarity of the nucleotide sequences of PCDHGA11 BINDING SITE1 through PCDHGA11 BINDING SITE3, designated SEQ ID:20983, SEQ ID:25788 and SEQ ID:25789 respectively, to the nucleotide sequence of VGAM233 RNA, herein designated VGAM RNA, also designated SEQ ID:2944.

Another function of VGAM233 is therefore inhibition of Protocadherin Gamma Subfamily A, 11 (PCDHGA11, Accession NM_018914). Accordingly, utilities of VGAM233 include diagnosis, prevention and treatment of diseases and clinical conditions associated with PCDHGA11. Trichorhinophalangeal Syndrome I (TRPS1, Accession NM_014112) is another VGAM233 host target gene. TRPS1 BINDING SITE is HOST TARGET binding site found in the 3' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15349, to the nucleotide sequence of VGAM233 RNA, herein designated VGAM RNA, also designated SEQ ID:2944.

Another function of VGAM233 is therefore inhibition of Trichorhinophalangeal Syndrome I (TRPS1, Accession NM_014112), a gene which may function as a transcriptional activator protein. Accordingly, utilities of VGAM233 include diagnosis, prevention and treatment of diseases and clinical conditions associated with TRPS1. The function of TRPS1 and its association with various diseases and clinical conditions, has been established by previous studies, as described hereinabove with reference to VGAM172. A Kinase (PRKA) Anchor Protein (yotiao) 9 (AKAP9, Accession NM_005751) is another VGAM233 host target gene. AKAP9 BINDING SITE is HOST TARGET binding site found in the 5' untranslated region of mRNA encoded by AKAP9, corresponding to a HOST TARGET binding site such as BINDING SITE I, BINDING SITE II or BINDING SITE III. Table 2 illustrates the complementarity of the nucleotide sequences of AKAP9 BINDING SITE, designated SEQ ID:12313, to the nucleotide sequence of VGAM233 RNA, herein designated VGAM RNA, also designated SEQ ID:2944.

Another function of VGAM233 is therefore inhibition of A Kinase (PRKA) Anchor Protein (yotiao) 9 (AKAP9, Accession NM_005751). Accordingly, utilities of VGAM233 include diagnosis, prevention and treatment of diseases and clinical conditions associated with AKAP9. Rho GDP Dissociation Inhibitor (GDI) Gamma (ARHGDIG, Accession NM_001176) is another VGAM233 host target gene. ARHGDIG BINDING SITE is HOST TARGET binding site found in the 3' untranslated region of mRNA encoded by ARHGDIG, corresponding to a HOST TARGET binding site such as BINDING SITE I, BINDING SITE II or BINDING SITE III. Table 2 illustrates the complementarity of the nucleotide sequences of ARHGDIG BINDING SITE, designated SEQ ID:6851, to the nucleotide sequence of VGAM233 RNA, herein designated VGAM RNA, also designated SEQ ID:2944.

Another function of VGAM233 is therefore inhibition of Rho GDP Dissociation Inhibitor (GDI) Gamma (ARHGDIG, Accession NM_001176). Accordingly, utilities of VGAM233 include diagnosis, prevention and treatment of diseases and clinical conditions associated with ARHGDIG. FLJ00001 (Accession XM_088525) is another VGAM233 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39776, to the nucleotide sequence of VGAM233 RNA, herein designated VGAM RNA, also designated SEQ ID:2944.

Another function of VGAM233 is therefore inhibition of FLJ00001 (Accession XM_088525). Accordingly, utilities of VGAM233 include diagnosis, prevention and treatment of diseases and clinical conditions associated with FLJ00001. FLJ13842 (Accession NM_024645) is another VGAM233 host target gene. FLJ13842 BINDING SITE is HOST TARGET binding site found in the 3' untranslated region of mRNA encoded by FLJ13842, corresponding to a HOST TARGET binding site such as BINDING SITE I, BINDING SITE II or BINDING SITE III. Table 2 illustrates the complementarity of the nucleotide sequences of FLJ13842 BINDING SITE, designated SEQ ID:23928, to the nucleotide sequence of VGAM233 RNA, herein designated VGAM RNA, also designated SEQ ID:2944.

Another function of VGAM233 is therefore inhibition of FLJ13842 (Accession NM_024645). Accordingly, utilities of VGAM233 include diagnosis, prevention and treatment of diseases and clinical conditions associated with FLJ13842. Guanine Nucleotide Binding Protein (G protein), Gamma 4 (GNG4, Accession NM_004485) is another VGAM233 host target gene. GNG4 BINDING SITE is HOST TARGET binding site found in the 3' untranslated region of mRNA encoded by GNG4, corresponding to a HOST TARGET binding site such as BINDING SITE I, BINDING SITE II or BINDING SITE III. Table 2 illustrates the complementarity of the nucleotide sequences of GNG4 BINDING SITE, designated SEQ ID:10808, to the nucleotide sequence of VGAM233 RNA, herein designated VGAM RNA, also designated SEQ ID:2944.

Another function of VGAM233 is therefore inhibition of Guanine Nucleotide Binding Protein (G protein), Gamma 4 (GNG4, Accession NM_004485). Accordingly, utilities of VGAM233 include diagnosis, prevention and treatment of diseases and clinical conditions associated with GNG4. Potassium Voltage-gated Channel, Delayed-rectifier, Subfamily S, Member 1 (KCNS1, Accession NM_002251) is another VGAM233 host target gene. KCNS1 BINDING SITE is HOST TARGET binding site found in the 5' untranslated region of mRNA encoded by KCNS1, corresponding to a HOST TARGET binding site such as BINDING SITE I, BINDING SITE II or BINDING SITE III. Table 2 illustrates the complementarity of the nucleotide sequences of KCNS1 BINDING SITE, designated SEQ ID:8042, to the nucleotide sequence of VGAM233 RNA, herein designated VGAM RNA, also designated SEQ ID:2944.

Another function of VGAM233 is therefore inhibition of Potassium Voltage-gated Channel, Delayed-rectifier, Subfamily S, Member 1 (KCNS1, Accession NM_002251). Accordingly, utilities of VGAM233 include diagnosis, prevention and treatment of diseases and clinical conditions associated with KCNS1. KIAA0513 (Accession NM_014732) is another VGAM233 host target gene. KIAA0513 BINDING SITE is HOST TARGET binding site found in the 3' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16352, to the nucleotide sequence of VGAM233 RNA, herein designated VGAM RNA, also designated SEQ ID:2944.

Another function of VGAM233 is therefore inhibition of KIAA0513 (Accession NM_014732). Accordingly, utilities of VGAM233 include diagnosis, prevention and treatment of diseases and clinical conditions associated with KIAA0513. KIAA0555 (Accession NM_014790) is another VGAM233 host target gene. KIAA0555 BINDING SITE is HOST TARGET binding site found in the 3' untranslated region of mRNA encoded by KIAA0555, corresponding to a HOST TARGET binding site such as BINDING SITE I, BINDING SITE II or BINDING SITE III. Table 2 illustrates the complementarity of the nucleotide sequences of KIAA0555 BINDING SITE, designated SEQ ID:16683, to the nucleotide sequence of VGAM233 RNA, herein designated VGAM RNA, also designated SEQ ID:2944.

Another function of VGAM233 is therefore inhibition of KIAA0555 (Accession NM_014790). Accordingly, utilities of VGAM233 include diagnosis, prevention and treatment of diseases and clinical conditions associated with KIAA0555. KIAA1497 (Accession XM_041431) is another VGAM233 host target gene. KIAA1497 BINDING SITE is HOST TARGET binding site found in the 3' untranslated region of mRNA encoded by KIAA1497, corresponding to a HOST TARGET binding site such as BINDING SITE I, BINDING SITE II or BINDING SITE III. Table 2 illustrates the complementarity of the nucleotide sequences of KIAA1497 BINDING SITE, designated SEQ ID:33526, to the nucleotide sequence of VGAM233 RNA, herein designated VGAM RNA, also designated SEQ ID:2944.

Another function of VGAM233 is therefore inhibition of KIAA1497 (Accession XM_041431). Accordingly, utilities of VGAM233 include diagnosis, prevention and treatment of diseases and clinical conditions associated with KIAA1497. Mannosidase, Alpha, Class 1C, Member 1 (MAN1C1, Accession NM_020379) is another VGAM233 host target gene. MAN1C1 BINDING SITE is HOST TARGET binding site found in the 3' untranslated region of mRNA encoded by MAN1C1, corresponding to a HOST TARGET binding site such as BINDING SITE I, BINDING SITE II or BINDING SITE III. Table 2 illustrates the complementarity of the nucleotide sequences of MAN1C1 BINDING SITE, designated SEQ ID:21644, to the nucleotide sequence of VGAM233 RNA, herein designated VGAM RNA, also designated SEQ ID:2944.

Another function of VGAM233 is therefore inhibition of Mannosidase, Alpha, Class 1C, Member 1 (MAN1C1, Accession NM_020379). Accordingly, utilities of VGAM233 include diagnosis, prevention and treatment of diseases and clinical conditions associated with MAN1C1. LOC124402 (Accession NM_145253) is another VGAM233 host target gene. LOC124402 BINDING SITE is HOST TARGET binding site found in the 3' untranslated region of mRNA encoded by LOC124402, corresponding to a HOST TARGET binding site such as BINDING SITE I, BINDING SITE II or BINDING SITE III. Table 2 illustrates the complementarity of the nucleotide sequences of LOC124402 BINDING SITE, designated SEQ ID:29766, to the nucleotide sequence of VGAM233 RNA, herein designated VGAM RNA, also designated SEQ ID:2944.

Another function of VGAM233 is therefore inhibition of LOC124402 (Accession NM_145253). Accordingly, utilities of VGAM233 include diagnosis, prevention and treatment of diseases and clinical conditions associated with LOC124402. LOC142955 (Accession XM_084389) is another VGAM233 host target gene. LOC142955 BINDING SITE is HOST TARGET binding site found in the 5' untranslated region of mRNA encoded by LOC142955, corresponding to a HOST TARGET binding site such as BINDING SITE I, BINDING SITE II or BINDING SITE III. Table 2 illustrates the complementarity of the nucleotide sequences of LOC142955 BINDING SITE, designated SEQ ID:37573, to the nucleotide sequence of VGAM233 RNA, herein designated VGAM RNA, also designated SEQ ID:2944.

Another function of VGAM233 is therefore inhibition of LOC142955 (Accession XM_084389). Accordingly, utilities of VGAM233 include diagnosis, prevention and treatment of diseases and clinical conditions associated with LOC142955. LOC147054 (Accession XM_097172) is another VGAM233 host target gene. LOC147054 BINDING SITE is HOST TARGET binding site found in the 5' untranslated region of mRNA encoded by LOC147054, corresponding to a HOST TARGET binding site such as BINDING SITE I, BINDING SITE II or BINDING SITE III. Table 2 illustrates the complementarity of the nucleotide sequences of LOC147054 BINDING SITE, designated SEQ ID:40790, to the nucleotide sequence of VGAM233 RNA, herein designated VGAM RNA, also designated SEQ ID:2944.

Another function of VGAM233 is therefore inhibition of LOC147054 (Accession XM_097172). Accordingly, utilities of VGAM233 include diagnosis, prevention and treatment of diseases and clinical conditions associated with LOC147054. LOC150538 (Accession XM_086945) is another VGAM233 host target gene. LOC150538 BINDING SITE is HOST TARGET binding site found in the 5' untranslated region of mRNA encoded by LOC150538, corresponding to a HOST TARGET binding site such as BINDING SITE I, BINDING SITE II or BINDING SITE III. Table 2 illustrates the complementarity of the nucleotide sequences of LOC150538 BINDING SITE, designated SEQ ID:38991, to the nucleotide sequence of VGAM233 RNA, herein designated VGAM RNA, also designated SEQ ID:2944.

Another function of VGAM233 is therefore inhibition of LOC150538 (Accession XM_086945). Accordingly, utilities of VGAM233 include diagnosis, prevention and treatment of diseases and clinical conditions associated with LOC150538. LOC153454 (Accession XM_087672) is another VGAM233 host target gene. LOC153454 BINDING SITE is HOST TARGET binding site found in the 5' untranslated region of mRNA encoded by LOC153454, corresponding to a HOST TARGET binding site such as BINDING SITE I, BINDING SITE II or BINDING SITE III. Table 2 illustrates the complementarity of the nucleotide sequences of LOC153454 BINDING SITE, designated SEQ ID:39374, to the nucleotide sequence of VGAM233 RNA, herein designated VGAM RNA, also designated SEQ ID:2944.

Another function of VGAM233 is therefore inhibition of LOC153454 (Accession XM_087672). Accordingly, utilities of VGAM233 include diagnosis, prevention and treatment of diseases and clinical conditions associated with LOC153454. LOC196411 (Accession XM_113714) is another VGAM233 host target gene. LOC196411 BINDING SITE is HOST TARGET binding site found in the 3' untranslated region of mRNA encoded by LOC196411, corresponding to a HOST TARGET binding site such as BINDING SITE I, BINDING SITE II or BINDING SITE III. Table 2 illustrates the complementarity of the nucleotide sequences of LOC196411 BINDING SITE, designated SEQ ID:42363, to the nucleotide sequence of VGAM233 RNA, herein designated VGAM RNA, also designated SEQ ID:2944.

Another function of VGAM233 is therefore inhibition of LOC196411 (Accession XM_113714). Accordingly, utilities of VGAM233 include diagnosis, prevention and treatment of diseases and clinical conditions associated with LOC196411. LOC200317 (Accession XM_114208) is another VGAM233 host target gene. LOC200317 BINDING SITE is HOST TARGET binding site found in the 3' untranslated region of mRNA encoded by LOC200317, corresponding to a HOST TARGET binding site such as BINDING SITE I, BINDING SITE II or BINDING SITE III. Table 2 illustrates the complementarity of the nucleotide sequences of LOC200317 BINDING SITE, designated SEQ ID:42802, to the nucleotide sequence of VGAM233 RNA, herein designated VGAM RNA, also designated SEQ ID:2944.

Another function of VGAM233 is therefore inhibition of LOC200317 (Accession XM_114208). Accordingly, utilities of VGAM233 include diagnosis, prevention and treatment of diseases and clinical conditions associated with LOC200317. LOC200609 (Accession XM_117256) is another VGAM233 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43327, to the nucleotide sequence of VGAM233 RNA, herein designated VGAM RNA, also designated SEQ ID:2944.

Another function of VGAM233 is therefore inhibition of LOC200609 (Accession XM_117256). Accordingly, utilities of VGAM233 include diagnosis, prevention and treatment of diseases and clinical conditions associated with LOC200609. LOC203595 (Accession XM_119962) is another VGAM233 host target gene. LOC203595 BINDING SITE is HOST TARGET binding site found in the 5' untranslated region of mRNA encoded by LOC203595, corresponding to a HOST TARGET binding site such as BINDING SITE I, BINDING SITE II or BINDING SITE III. Table 2 illustrates the complementarity of the nucleotide sequences of LOC203595 BINDING SITE, designated SEQ ID:43605, to the nucleotide sequence of VGAM233 RNA, herein designated VGAM RNA, also designated SEQ ID:2944.

Another function of VGAM233 is therefore inhibition of LOC203595 (Accession XM_119962). Accordingly, utilities of VGAM233 include diagnosis, prevention and treatment of diseases and clinical conditions associated with LOC203595. LOC254196 (Accession XM_173220) is another VGAM233 host target gene. LOC254196 BINDING SITE is HOST TARGET binding site found in the 5' untranslated region of mRNA encoded by LOC254196, corresponding to a HOST TARGET binding site such as BINDING SITE I, BINDING SITE II or BINDING SITE III. Table 2 illustrates the complementarity of the nucleotide sequences of LOC254196 BIND- ING SITE, designated SEQ ID:46476, to the nucleotide sequence of VGAM233 RNA, herein designated VGAM RNA, also designated SEQ ID:2944.

Another function of VGAM233 is therefore inhibition of LOC254196 (Accession XM_173220). Accordingly, utilities of VGAM233 include diagnosis, prevention and treatment of diseases and clinical conditions associated with LOC254196. LOC255040 (Accession XM_172837) is another VGAM233 host target gene. LOC255040 BINDING SITE is HOST TARGET binding site found in the 3' untranslated region of mRNA encoded by LOC255040, corresponding to a HOST TARGET binding site such as BINDING SITE I, BINDING SITE II or BINDING SITE III. Table 2 illustrates the complementarity of the nucleotide sequences of LOC255040 BINDING SITE, designated SEQ ID:46108, to the nucleotide sequence of VGAM233 RNA, herein designated VGAM RNA, also designated SEQ ID:2944.

Another function of VGAM233 is therefore inhibition of LOC255040 (Accession XM_172837). Accordingly, utilities of VGAM233 include diagnosis, prevention and treatment of diseases and clinical conditions associated with LOC255040. LOC255041 (Accession XM_172838) is another VGAM233 host target gene. LOC255041 BINDING SITE is HOST TARGET binding site found in the 3' untranslated region of mRNA encoded by LOC255041, corresponding to a HOST TARGET binding site such as BINDING SITE I, BINDING SITE II or BINDING SITE III. Table 2 illustrates the complementarity of the nucleotide sequences of LOC255041 BINDING SITE, designated SEQ ID:46111, to the nucleotide sequence of VGAM233 RNA, herein designated VGAM RNA, also designated SEQ ID:2944.

Another function of VGAM233 is therefore inhibition of LOC255041 (Accession XM_172838). Accordingly, utilities of VGAM233 include diagnosis, prevention and treatment of diseases and clinical conditions associated with LOC255041. LOC91907 (Accession XM_041430) is another VGAM233 host target gene. LOC91907 BINDING SITE is HOST TARGET binding site found in the 3' untranslated region of mRNA encoded by LOC91907, corresponding to a HOST TARGET binding site such as BINDING SITE I, BINDING SITE II or BINDING SITE III. Table 2 illustrates the complementarity of the nucleotide sequences of LOC91907 BINDING SITE, designated SEQ ID:33520, to the nucleotide sequence of VGAM233 RNA, herein designated VGAM RNA, also designated SEQ ID:2944.

Another function of VGAM233 is therefore inhibition of LOC91907 (Accession XM_041430). Accordingly, utilities of VGAM233 include diagnosis, prevention and treatment of diseases and clinical conditions associated with LOC91907. FIG. 1 further provides a conceptual description of a novel bioinformatically detected viral gene of the present invention, referred to here as Viral Genomic Address Messenger 234 (VGAM234) viral gene, which modulates expression of respective host target genes thereof, the function and utility of which host target genes is known in the art.

VGAM234 is a novel bioinformatically detected regulatory, non protein coding, viral micro RNA (miRNA) gene. The method by which VGAM234 was detected is described hereinabove with reference to FIGS. 1-8.

VGAM234 gene, herein designated VGAM GENE, is a viral gene contained in the genome of Callitrichine Herpesvirus 3. VGAM234 host target gene, herein designated VGAM HOST TARGET GENE, is a human gene contained in the human genome.

VGAM234 gene encodes a VGAM234 precursor RNA, herein designated VGAM PRECURSOR RNA. Similar to other miRNA genes, and unlike most ordinary genes, VGAM234 precursor RNA does not encode a protein. A nucleotide sequence identical or highly similar to the nucleotide sequence of VGAM234 precursor RNA is designated SEQ ID:220, and is provided hereinbelow with reference to the sequence listing part. Nucleotide sequence SEQ ID:220 is located at position 25253 relative to the genome of Callitrichine Herpesvirus 3.

VGAM234 precursor RNA folds onto itself, forming VGAM234 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM234 folded precursor RNA into VGAM234 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM234 RNA is designated SEQ ID:2945, and is provided hereinbelow with reference to the sequence listing part.

VGAM234 host target gene, herein designated VGAM HOST TARGET GENE, encodes a corresponding messenger RNA, VGAM234 host target RNA, herein designated VGAM HOST TARGET RNA. VGAM234 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM234 RNA, herein designated VGAM RNA, binds complementarily to one or more host target binding sites located in untranslated regions of VGAM234 host target RNA, herein designated VGAM HOST TARGET RNA. This complementary binding is due to the fact that the nucleotide sequence of VGAM234 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM234 RNA, herein designated VGAM RNA, may have a different number of host target binding sites in untranslated regions of a VGAM234 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM234 RNA, herein designated VGAM RNA, to host target binding sites on VGAM234 host target RNA, herein designated VGAM HOST TARGET RNA, such as BINDING SITE I, BINDING SITE II and BINDING SITE III, inhibits translation of VGAM234 host target RNA into VGAM234 host target protein, herein designated VGAM HOST TARGET PROTEIN. VGAM host target protein is therefore outlined by a broken line.

It is appreciated that VGAM234 host target gene, herein designated VGAM HOST TARGET GENE, in fact represents a plurality of VGAM234 host target genes. The mRNA of each one of this plurality of VGAM234 host target genes comprises one or more host target binding sites, each having a nucleotide sequence which is at least partly complementary to VGAM234 RNA, herein designated VGAM RNA, and which when bound by VGAM234 RNA causes inhibition of translation of respective one or more VGAM234 host target proteins.

It is further appreciated by one skilled in the art that the mode of translational inhibition illustrated by FIG. 1 with specific reference to translational inhibition exerted by VGAM234 gene, herein designated VGAM GENE, on one or more VGAM234 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM234 is inhibition of expression of host target genes, as part of a novel viral mechanism of attacking a host. Accordingly, utilities of VGAM234 include diagnosis, prevention and treatment of viral infection by Callitrichine Herpesvirus 3. Specific functions, and accordingly utilities, of VGAM234 correlate with, and may be deduced from, the identity of the host target genes which VGAM234 binds and inhibits, and the function of these host target genes, as elaborated hereinbelow.

Nucleotide sequences of the VGAM234 precursor RNA, herein designated VGAM PRECURSOR RNA, and of the 'diced' VGAM234 RNA, herein designated VGAM RNA, and a schematic representation of the secondary folding of VGAM234 folded precursor RNA, herein designated VGAM FOLDED PRECURSOR RNA, of VGAM234 are further described hereinbelow with reference to Table 1.

Nucleotide sequences of host target binding sites, such as BINDING SITE-I, BINDING SITE-II and BINDING SITE-III of FIG. 1, found on VGAM234 host target RNA, and schematic representation of the complementarity of each of these host target binding sites to VGAM234 RNA, herein designated VGAM RNA, are described hereinbelow with reference to Table 2.

As mentioned hereinabove with reference to FIG. 1, a function of VGAM234 gene, herein designated VGAM is inhibition of expression of VGAM234 target genes. It is appreciated that specific functions, and accordingly utilities, of VGAM234 correlate with, and may be deduced from, the identity of the target genes which VGAM234 binds and inhibits, and the function of these target genes, as elaborated hereinbelow.

Adenosine A1 Receptor (ADORA1, Accession NM_000674) is a VGAM234 host target gene. ADORA1 BINDING SITE is HOST TARGET binding site found in the 3' untranslated region of mRNA encoded by ADORA1, corresponding to a HOST TARGET binding site such as BINDING SITE I, BINDING SITE II or BINDING SITE III. Table 2 illustrates the complementarity of the nucleotide sequences of ADORA1 BINDING SITE, designated SEQ ID:6329, to the nucleotide sequence of VGAM234 RNA, herein designated VGAM RNA, also designated SEQ ID:2945.

A function of VGAM234 is therefore inhibition of Adenosine A1 Receptor (ADORA1, Accession NM_000674), a gene which the activity of this receptor is mediated by g proteins which inhibit adenylyl cyclase. Accordingly, utilities of VGAM234 include diagnosis, prevention and treatment of diseases and clinical conditions associated with ADORA1. The function of ADORA1 has been established by previous studies. Diverse physiologic effects of adenosine were recognized as early as the 1920s (Drury and Szent-Gyorgyi, 1929; Berne, 1963). Once released, adenosine activates adenosine receptors, which in turn regulate a diverse set of physiologic functions including cardiac rate and contractility, smooth muscle tone, sedation, release of neurotransmitters, platelet function, lipolysis, renal function, and white blood cell function. Stiles (1992) reviewed the structure and function of adenosine receptors important in the mediation of these multiple effects. Also see adenosine A2 receptor (ADORA2A; 102776). Libert et al. (1991) obtained cDNA clones for 4 receptors of the G protein-coupled receptor family by selective amplification of cloning from thyroid cDNA and termed them RDC1 (VIPR1; 192321), RDC4 (HTR1D; 182133), RDC7, and RDC8 (ADORA2A). RDC7 and RDC8 were identified as A1 and A2 adenosine receptors, respectively. By in situ hybridization, Libert et al. (1991) assigned the RDC7 gene to 22q11.2-q13.1. However, using fluorescence in situ hybridization, Townsend-Nicholson et al. (1995) demonstrated that the ADORA1 gene is located on 1q32.1. Animal model experiments lend further support to the function of ADORA1. Sun et al. (2001) used homologous recombination to generate viable mice without gross behavioral or anatomic defects that were deficient in the 2-exon A1ar gene, which encodes a protein 87% identical to the human protein.

It is appreciated that the abovementioned animal model for ADORA1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Stiles, G. L.: Adenosine receptors. J. Biol. Chem. 267: 6451-6454, 1992; and

Sun, D.; Samuelson, L. C.; Yang, T.; Huang, Y.; Paliege, A.; Saunders, T.; Briggs, J.; Schnermann, J.: Mediation of tubuloglomerular feedback by adenosine: evidence from mice lacking ad.

Further studies establishing the function and utilities of ADORA1 are found in John Hopkins OMIM database record ID 102775, and in sited publications numbered 12772-192 listed in the bibliography section hereinbelow, which are also hereby incorporated by reference. CAMP Responsive Element Binding Protein-like 2 (CREBL2, Accession NM_001310) is another VGAM234 host target gene. CREBL2 BINDING SITE is HOST TARGET binding site found in the 3' untranslated region of mRNA encoded by CREBL2, corresponding to a HOST TARGET binding site such as BINDING SITE I, BINDING SITE II or BINDING SITE III. Table 2 illustrates the complementarity of the nucleotide sequences of CREBL2 BINDING SITE, designated SEQ ID:6997, to the nucleotide sequence of VGAM234 RNA, herein designated VGAM RNA, also designated SEQ ID:2945.

Another function of VGAM234 is therefore inhibition of CAMP Responsive Element Binding Protein-like 2 (CREBL2, Accession NM_001310). Accordingly, utilities of VGAM234 include diagnosis, prevention and treatment of diseases and clinical conditions associated with CREBL2. Early Growth Response 2 (Krox-20 homolog, Drosophila) (EGR2, Accession NM_000399) is another VGAM234 host target gene. EGR2 BINDING SITE is HOST TARGET binding site found in the 3' untranslated region of mRNA encoded by EGR2, corresponding to a HOST TARGET binding site such as BINDING SITE I, BINDING SITE II or BINDING SITE III. Table 2 illustrates the complementarity of the nucleotide sequences of EGR2 BINDING SITE, designated SEQ ID:5972, to the nucleotide sequence of VGAM234 RNA, herein designated VGAM RNA, also designated SEQ ID:2945.

Another function of VGAM234 is therefore inhibition of Early Growth Response 2 (Krox-20 homolog, Drosophila) (EGR2, Accession NM_000399), a gene which binds to two specific dna sites located in the promoter region of hox-1.4. Accordingly, utilities of VGAM234 include diagnosis, prevention and treatment of diseases and clinical conditions associated with EGR2. The function of EGR2 has been established by previous studies. Timmerman et al. (1999) screened 170 unrelated neuropathy patients and identified 2 with Dejerine-Sottas neuropathy (DSN; 145900) who had a heterozygous R359W mutation (129010.0004) in the alpha-helix domain of the first zinc finger of EGR2. Boerkoel et al. (2001) reported 2 additional DSN patients with the R359W mutation and suggested that it is the most common neuropathy-associated EGR2 mutation and consistently causes DSN. The expressivity ranged from that typical for DSN to a more rapidly progressive neuropathy that can cause death by age 6 years. Furthermore, in contrast to patients with typical DSN, patients with the EGR2 R359W mutation had more respiratory compromise and cranial nerve involvement. Animal model experiments lend further support to the function of EGR2. Congenital hypomyelinating neuropathy (CHN; 605253) is characterized clinically by early onset of hypotonia, areflexia, distal muscle weakness, and very slow nerve conduction velocities. Warner et al. (1997, 1998) noted that pathologic findings on sural nerve biopsies show hypomyelination of most or all fibers. Based on these findings, CHN is considered to be a result of congenital impairment in myelin formation. The disorder is inherited as an autosomal recessive. The EGR2 gene attracted the attention of Warner et al. (1997, 1998) as a potential candidate for CHN because of the expression and knockout phenotype of its mouse homolog, Krox20. Krox20, a member of a multigene family of zinc finger proteins, is thought to function as an immediate early protein with basal expression in selected neuronal populations of the central and peripheral nervous systems. Krox20 knockout mice showed disrupted hindbrain segmentation and development and a block of Schwann cells at an early stage of differentiation as evidenced by the fact that the expression of early myelin genes, such as myelin-associated glycoprotein (OMIM Ref. No. 159460), are barely affected while the expression of the late myelin genes, myelin basic protein (OMIM Ref. No. 159430) and myelin protein zero (MPZ; 159440), are decreased or absent.

It is appreciated that the abovementioned animal model for EGR2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Timmerman, V.; De Jonghe, P.; Ceuterick, C.; De Vriendt, E.; Lofgren, A.; Nelis, E.; Warner, L. E.; Lupski, J. R.; Martin, J.-J.; Van Broeckhoven, C.: Novel missense mutation in the early growth response 2 gene associated with Dejerine-Sottas syndrome phenotype. Neurology 52:1827-1832, 1999; and Warner, L. E.; Mancias, P.; Butler, I. J.; McDonald, C. M.; Keppen, L.; Koob, K. G.; Lupski, J. R.: Mutations in the early growth response 2 (EGR2) gene are associated with hereditary.

Further studies establishing the function and utilities of EGR2 are found in John Hopkins OMIM database record ID 129010, and in sited publications numbered 1167 and 12036-12043 listed in the bibliography section hereinbelow, which are also hereby incorporated by reference. Fms-related Tyrosine Kinase 1 (vascular endothelial growth factor/vascular permeability factor receptor) (FLT1, Accession NM_002019) is another VGAM234 host target gene. FLT1 BINDING SITE is HOST TARGET binding site found in the 3' untranslated region of mRNA encoded by FLT1, corresponding to a HOST TARGET binding site such as BINDING SITE I, BINDING SITE II or BINDING SITE III. Table 2 illustrates the complementarity of the nucleotide sequences of FLT1 BINDING SITE, designated SEQ ID:7767, to the nucleotide sequence of VGAM234 RNA, herein designated VGAM RNA, also designated SEQ ID:2945.

Another function of VGAM234 is therefore inhibition of Fms-related Tyrosine Kinase 1 (vascular endothelial growth factor/vascular permeability factor receptor) (FLT1, Accession NM_002019). Accordingly, utilities of VGAM234 include diagnosis, prevention and treatment of diseases and clinical conditions associated with FLT1. GATA Binding Protein 3 (GATA3, Accession NM_002051) is another VGAM234 host target gene. GATA3 BINDING SITE is HOST TARGET binding site found in the 3' untranslated region of mRNA encoded by GATA3, corresponding to a HOST TARGET binding site such as BINDING SITE I, BINDING SITE II or BINDING SITE III. Table 2 illustrates the complementarity of the nucleotide sequences of GATA3 BINDING SITE, designated SEQ ID:7808, to the nucleotide sequence of VGAM234 RNA, herein designated VGAM RNA, also designated SEQ ID:2945.

Another function of VGAM234 is therefore inhibition of GATA Binding Protein 3 (GATA3, Accession NM_002051). Accordingly, utilities of VGAM234 include diagnosis, prevention and treatment of diseases and clinical conditions associated with GATA3. LAPTM5 (Accession NM_006762) is another VGAM234 host target gene. LAPTM5 BINDING SITE is HOST TARGET binding site found in the 3' untranslated region of mRNA encoded by LAPTM5, corresponding to a HOST TARGET binding site such as BINDING SITE I, BINDING SITE II or BINDING SITE III. Table 2 illustrates the complementarity of the nucleotide sequences of LAPTM5 BINDING SITE, designated SEQ ID:13619, to the nucleotide sequence of VGAM234 RNA, herein designated VGAM RNA, also designated SEQ ID:2945.

Another function of VGAM234 is therefore inhibition of LAPTM5 (Accession NM_006762). Accordingly, utilities of VGAM234 include diagnosis, prevention and treatment of diseases and clinical conditions associated with LAPTM5. Platelet-derived Growth Factor Beta Polypeptide (simian sarcoma viral (v-sis) Oncogene Homolog) (PDGFB, Accession NM_002608) is another VGAM234 host target gene. PDGFB BINDING SITE is HOST TARGET binding site found in the 3' untranslated region of mRNA encoded by PDGFB, corresponding to a HOST TARGET binding site such as BINDING SITE I, BINDING SITE II or BINDING SITE III. Table 2 illustrates the complementarity of the nucleotide sequences of PDGFB BINDING SITE, designated SEQ ID:8472, to the nucleotide sequence of VGAM234 RNA, herein designated VGAM RNA, also designated SEQ ID:2945.

Another function of VGAM234 is therefore inhibition of Platelet-derived Growth Factor Beta Polypeptide (simian sarcoma viral (v-sis) Oncogene Homolog) (PDGFB, Accession NM_002608), a gene which plays an important role in stimulating adjacent cells to grow and thereby heal the wound. Accordingly, utilities of VGAM234 include diagnosis, prevention and treatment of diseases and clinical conditions associated with PDGFB. The function of PDGFB and its association with various diseases and clinical conditions, has been established by previous studies, as described hereinabove with reference to VGAM173. Solute Carrier Family 6 (neurotransmitter transporter, taurine), Member 6 (SLC6A6, Accession NM_003043) is another VGAM234 host target gene. SLC6A6 BINDING SITE is HOST TARGET binding site found in the 3' untranslated region of mRNA encoded by SLC6A6, corresponding to a HOST TARGET binding site such as BINDING SITE I, BINDING SITE II or BINDING SITE III. Table 2 illustrates the complementarity of the nucleotide sequences of SLC6A6 BINDING SITE, designated SEQ ID:9008, to the nucleotide sequence of VGAM234 RNA, herein designated VGAM RNA, also designated SEQ ID:2945.

Another function of VGAM234 is therefore inhibition of Solute Carrier Family 6 (neurotransmitter transporter, taurine), Member 6 (SLC6A6, Accession NM_003043), a gene which transports taurine and other beta-amino acids like beta-alanine. Accordingly, utilities of VGAM234 include diagnosis, prevention and treatment of diseases and clinical conditions associated with SLC6A6. The function of SLC6A6 and its association with various diseases and clinical conditions, has been established by previous studies, as described hereinabove with reference to VGAM36. Tumor Necrosis Factor (ligand) Superfamily, Member 6 (TNFSF6, Accession NM_000639) is another VGAM234 host target gene. TNFSF6 BINDING SITE is HOST TARGET binding site found in the 3' untranslated region of mRNA encoded by TNFSF6, corresponding to a HOST TARGET binding site such as BINDING SITE I, BINDING SITE II or BINDING SITE III. Table 2 illustrates the complementarity of the nucleotide sequences of TNFSF6 BINDING SITE, designated SEQ ID:6275, to the nucleotide sequence of VGAM234 RNA, herein designated VGAM RNA, also designated SEQ ID:2945.

Another function of VGAM234 is therefore inhibition of Tumor Necrosis Factor (ligand) Superfamily, Member 6 (TNFSF6, Accession NM_000639). Accordingly, utilities of VGAM234 include diagnosis, prevention and treatment of diseases and clinical conditions associated with TNFSF6. Reserved (C8orf13, Accession XM_088377) is another VGAM234 host target gene. C8orf13 BINDING SITE is HOST TARGET binding site found in the 3" untranslated region of mRNA encoded by C8orf13, corresponding to a HOST TARGET binding site such as BINDING SITE I, BINDING SITE II or BINDING SITE III. Table 2 illustrates the complementarity of the nucleotide sequences of C8orf13 BINDING SITE, designated SEQ ID:39659, to the nucleotide sequence of VGAM234 RNA, herein designated VGAM RNA, also designated SEQ ID:2945.

Another function of VGAM234 is therefore inhibition of Reserved (C8orf13, Accession XM_088377). Accordingly, utilities of VGAM234 include diagnosis, prevention and treatment of diseases and clinical conditions associated with C8orf13. DKFZP434E2135 (Accession NM_030804) is another VGAM234 host target gene. DKFZP434E2135 BINDING SITE is HOST TARGET binding site found in the 3' untranslated region of mRNA encoded by DKFZP434E2135, corresponding to a HOST TARGET binding site such as BINDING SITE I, BINDING SITE II or BINDING SITE III. Table 2 illustrates the complementarity of the nucleotide sequences of DKFZP434E2135 BINDING SITE, designated SEQ ID:25120, to the nucleotide sequence of VGAM234 RNA, herein designated VGAM RNA, also designated SEQ ID:2945.

Another function of VGAM234 is therefore inhibition of DKFZP434E2135 (Accession NM_030804). Accordingly, utilities of VGAM234 include diagnosis, prevention and treatment of diseases and clinical conditions associated with DKFZP434E2135. DKFZp762L0311 (Accession NM_018719) is another VGAM234 host target gene. DKFZp762L0311 BINDING SITE is HOST TARGET binding site found in the 3' untranslated region of mRNA encoded by DKFZp762L0311, corresponding to a HOST TARGET binding site such as BINDING SITE I, BINDING SITE II or BINDING SITE III. Table 2 illustrates the complementarity of the nucleotide sequences of DKFZp762L0311 BINDING SITE, designated SEQ ID:20800, to the nucleotide sequence of VGAM234 RNA, herein designated VGAM RNA, also designated SEQ ID:2945.

Another function of VGAM234 is therefore inhibition of DKFZp762L0311 (Accession NM_018719). Accordingly, utilities of VGAM234 include diagnosis, prevention and treatment of diseases and clinical conditions associated with DKFZp762L0311. Endothelial Cell-specific Molecule 1 (ESM1, Accession NM_007036) is another VGAM234 host target gene. ESM1 BINDING SITE is HOST TARGET binding site found in the 3' untranslated region of mRNA encoded by ESM1, corresponding to a HOST TARGET binding site such as BINDING SITE I, BINDING SITE II or BINDING SITE III. Table 2 illustrates the complementarity of the nucleotide sequences of ESM1 BINDING SITE, designated SEQ ID:13914, to the nucleotide sequence of VGAM234 RNA, herein designated VGAM RNA, also designated SEQ ID:2945.

Another function of VGAM234 is therefore inhibition of Endothelial Cell-specific Molecule 1 (ESM1, Accession NM_007036). Accordingly, utilities of VGAM234 include diagnosis, prevention and treatment of diseases and clinical conditions associated with ESM1. FLJ13798 (Accession XM_102377) is another VGAM234 host target gene. FLJ13798 BINDING SITE is HOST TARGET binding site found in the 3' untranslated region of mRNA encoded by FLJ13798, corresponding to a HOST TARGET binding site such as BINDING SITE I, BINDING SITE II or BINDING SITE III. Table 2 illustrates the complementarity of the nucleotide sequences of FLJ13798 BINDING SITE, designated SEQ ID:42112, to the nucleotide sequence of VGAM234 RNA, herein designated VGAM RNA, also designated SEQ ID:2945.

Another function of VGAM234 is therefore inhibition of FLJ13798 (Accession XM_102377). Accordingly, utilities of VGAM234 include diagnosis, prevention and treatment of diseases and clinical conditions associated with FLJ13798. FLJ20047 (Accession NM_017639) is another VGAM234 host target gene. FLJ20047 BINDING SITE is HOST TARGET binding site found in the 5' untranslated region of mRNA encoded by FLJ20047, corresponding to a HOST TARGET binding site such as BINDING SITE I, BINDING SITE II or BINDING SITE III. Table 2 illustrates the complementarity of the nucleotide sequences of FLJ20047 BINDING SITE, designated SEQ ID:19145, to the nucleotide sequence of VGAM234 RNA, herein designated VGAM RNA, also designated SEQ ID:2945.

Another function of VGAM234 is therefore inhibition of FLJ20047 (Accession NM_017639). Accordingly, utilities of VGAM234 include diagnosis, prevention and treatment of diseases and clinical conditions associated with FLJ20047. G2 (Accession XM_039515) is another VGAM234 host target gene. G2 BINDING SITE is HOST TARGET binding site found in the 3' untranslated region of mRNA encoded by G2, corresponding to a HOST TARGET binding site such as BINDING SITE I, BINDING SITE II or BINDING SITE III. Table 2 illustrates the complementarity of the nucleotide sequences of G2 BINDING SITE, designated SEQ ID:33114, to the nucleotide sequence of VGAM234 RNA, herein designated VGAM RNA, also designated SEQ ID:2945.

Another function of VGAM234 is therefore inhibition of G2 (Accession XM_039515). Accordingly, utilities of VGAM234 include diagnosis, prevention and treatment of diseases and clinical conditions associated with G2. KIAA0016 (Accession NM_014765) is another VGAM234 host target gene. KIAA0016 BINDING SITE is HOST TARGET binding site found in the 3' untranslated region of mRNA encoded by KIAA0016, corresponding to a HOST TARGET binding site such as BINDING SITE I, BINDING SITE II or BINDING SITE III. Table 2 illustrates the complementarity of the nucleotide sequences of KIAA0016 BINDING SITE, designated SEQ ID:16532, to the nucleotide sequence of VGAM234 RNA, herein designated VGAM RNA, also designated SEQ ID:2945.

Another function of VGAM234 is therefore inhibition of KIAA0016 (Accession NM_014765). Accordingly, utilities of VGAM234 include diagnosis, prevention and treatment of diseases and clinical conditions associated with KIAA0016. KIAA1822 (Accession XM_041566) is another VGAM234 host target gene. KIAA1822 BINDING SITE is HOST TARGET binding site found in the 3' untranslated region of mRNA encoded by KIAA1822, corresponding to a HOST TARGET binding site such as BINDING SITE I, BINDING SITE II or BINDING SITE III. Table 2 illustrates the complementarity of the nucleotide sequences of KIAA1822 BINDING SITE, designated SEQ ID:33555, to the nucleotide sequence of VGAM234 RNA, herein designated VGAM RNA, also designated SEQ ID:2945.

Another function of VGAM234 is therefore inhibition of KIAA1822 (Accession XM_041566). Accordingly, utilities of VGAM234 include diagnosis, prevention and treatment of diseases and clinical conditions associated with KIAA1822. KOC1 (Accession XM_165847) is another VGAM234 host target gene. KOC1 BINDING SITE is HOST TARGET binding site found in the 3' untranslated region of mRNA encoded by KOC1, corresponding to a HOST TARGET binding site such as BINDING SITE I, BINDING SITE II or BINDING SITE III. Table 2 illustrates the complementarity of the nucleotide sequences of KOC1 BINDING SITE, designated SEQ ID:43777, to the nucleotide sequence of VGAM234 RNA, herein designated VGAM RNA, also designated SEQ ID:2945.

Another function of VGAM234 is therefore inhibition of KOC1 (Accession XM_165847). Accordingly, utilities of VGAM234 include diagnosis, prevention and treatment of diseases and clinical conditions associated with KOC1. MEF-2 (Accession XM_034883) is another VGAM234 host target gene. MEF-2 BINDING SITE is HOST TARGET binding site found in the 3' untranslated region of mRNA encoded by MEF-2, corresponding to a HOST TARGET binding site such as BINDING SITE I, BINDING SITE II or BINDING SITE III. Table 2 illustrates the complementarity of the nucleotide sequences of MEF-2 BINDING SITE, designated SEQ ID:32182, to the nucleotide sequence of VGAM234 RNA, herein designated VGAM RNA, also designated SEQ ID:2945.

Another function of VGAM234 is therefore inhibition of MEF-2 (Accession XM_034883). Accordingly, utilities of VGAM234 include diagnosis, prevention and treatment of diseases and clinical conditions associated with MEF-2. MGC20496 (Accession NM_052845) is another VGAM234 host target gene. MGC20496 BINDING SITE is HOST TARGET binding site found in the 3' untranslated region of mRNA encoded by MGC20496, corresponding to a HOST TARGET binding site such as BINDING SITE I, BINDING SITE II or BINDING SITE III. Table 2 illustrates the complementarity of the nucleotide sequences of MGC20496 BINDING SITE, designated SEQ ID:27426, to the nucleotide sequence of VGAM234 RNA, herein designated VGAM RNA, also designated SEQ ID:2945.

Another function of VGAM234 is therefore inhibition of MGC20496 (Accession NM_052845). Accordingly, utilities of VGAM234 include diagnosis, prevention and treatment of diseases and clinical conditions associated with MGC20496. N4BP3 (Accession XM_038920) is another VGAM234 host target gene. N4BP3 BINDING SITE is HOST TARGET binding site found in the 3' untranslated region of mRNA encoded by N4BP3, corresponding to a HOST TARGET binding site such as BINDING SITE I, BINDING SITE II or BINDING SITE III. Table 2 illustrates the complementarity of the nucleotide sequences of N4BP3 BINDING SITE, designated SEQ ID:32942, to the nucleotide sequence of VGAM234 RNA, herein designated VGAM RNA, also designated SEQ ID:2945.

Another function of VGAM234 is therefore inhibition of N4BP3 (Accession XM_038920). Accordingly, utilities of VGAM234 include diagnosis, prevention and treatment of diseases and clinical conditions associated with N4BP3. PTK6 Protein Tyrosine Kinase 6 (PTK6, Accession NM_005975) is another VGAM234 host target gene. PTK6 BINDING SITE is HOST TARGET binding site found in the 5' untranslated region of mRNA encoded by PTK6, corresponding to a HOST TARGET binding site such as BINDING SITE I, BINDING SITE II or BINDING SITE III. Table 2 illustrates the complementarity of the nucleotide sequences of PTK6 BINDING SITE, designated SEQ ID:12602, to the nucleotide sequence of VGAM234 RNA, herein designated VGAM RNA, also designated SEQ ID:2945.

Another function of VGAM234 is therefore inhibition of PTK6 Protein Tyrosine Kinase 6 (PTK6, Accession NM_005975). Accordingly, utilities of VGAM234 include diagnosis, prevention and treatment of diseases and clinical conditions associated with PTK6. LOC145622 (Accession XM_085186) is another VGAM234 host target gene. LOC145622 BINDING SITE is HOST TARGET binding site found in the 3' untranslated region of mRNA encoded by LOC145622, corresponding to a HOST TARGET binding site such as BINDING SITE I, BINDING SITE II or BINDING SITE III. Table 2 illustrates the complementarity of the nucleotide sequences of LOC145622 BINDING SITE, designated SEQ ID:37903, to the nucleotide sequence of VGAM234 RNA, herein designated VGAM RNA, also designated SEQ ID:2945.

Another function of VGAM234 is therefore inhibition of LOC145622 (Accession XM_085186). Accordingly, utilities of VGAM234 include diagnosis, prevention and treatment of diseases and clinical conditions associated with LOC145622. LOC154092 (Accession XM_098466) is another VGAM234 host target gene. LOC154092 BINDING SITE is HOST TARGET binding site found in the 3' untranslated region of mRNA encoded by LOC154092, corresponding to a HOST TARGET binding site such as BINDING SITE I, BINDING SITE II or BINDING SITE III. Table 2 illustrates the complementarity of the nucleotide sequences of LOC154092 BINDING SITE, designated SEQ ID:41683, to the nucleotide sequence of VGAM234 RNA, herein designated VGAM RNA, also designated SEQ ID:2945.

Another function of VGAM234 is therefore inhibition of LOC154092 (Accession XM_098466). Accordingly, utilities of VGAM234 include diagnosis, prevention and treatment of diseases and clinical conditions associated with LOC154092.

LOC170063 (Accession XM_104820) is another VGAM234 host target gene. LOC170063 BINDING SITE is HOST TARGET binding site found in the 3' untranslated region of mRNA encoded by LOC170063, corresponding to a HOST TARGET binding site such as BINDING SITE I, BINDING SITE II or BINDING SITE III. Table 2 illustrates the complementarity of the nucleotide sequences of LOC170063 BINDING SITE, designated SEQ ID:42185, to the nucleotide sequence of VGAM234 RNA, herein designated VGAM RNA, also designated SEQ ID:2945.

Another function of VGAM234 is therefore inhibition of LOC170063 (Accession XM_104820). Accordingly, utilities of VGAM234 include diagnosis, prevention and treatment of diseases and clinical conditions associated with LOC170063.

LOC205327 (Accession XM_115788) is another VGAM234 host target gene. LOC205327 BINDING SITE is HOST TARGET binding site found in the 3' untranslated region of mRNA encoded by LOC205327, corresponding to a HOST TARGET binding site such as BINDING SITE I, BINDING SITE II or BINDING SITE III. Table 2 illustrates the complementarity of the nucleotide sequences of LOC205327 BINDING SITE, designated SEQ ID:43106, to the nucleotide sequence of VGAM234 RNA, herein designated VGAM RNA, also designated SEQ ID:2945.

Another function of VGAM234 is therefore inhibition of LOC205327 (Accession XM_115788). Accordingly, utilities of VGAM234 include diagnosis, prevention and treatment of diseases and clinical conditions associated with LOC205327.

LOC221463 (Accession XM_166374) is another VGAM234 host target gene. LOC221463 BINDING SITE is HOST TARGET binding site found in the 3' untranslated region of mRNA encoded by LOC221463, corresponding to a HOST TARGET binding site such as BINDING SITE I, BINDING SITE II or BINDING SITE III. Table 2 illustrates the complementarity of the nucleotide sequences of LOC221463 BINDING SITE, designated SEQ ID:44206, to the nucleotide sequence of VGAM234 RNA, herein designated VGAM RNA, also designated SEQ ID:2945.

Another function of VGAM234 is therefore inhibition of LOC221463 (Accession XM_166374). Accordingly, utilities of VGAM234 include diagnosis, prevention and treatment of diseases and clinical conditions associated with LOC221463.

LOC221466 (Accession XM_168087) is another VGAM234 host target gene. LOC221466 BINDING SITE is HOST TARGET binding site found in the 5' untranslated region of mRNA encoded by LOC221466, corresponding to a HOST TARGET binding site such as BINDING SITE I, BINDING SITE II or BINDING SITE III. Table 2 illustrates the complementarity of the nucleotide sequences of LOC221466 BINDING SITE, designated SEQ ID:44997, to the nucleotide sequence of VGAM234 RNA, herein designated VGAM RNA, also designated SEQ ID:2945.

Another function of VGAM234 is therefore inhibition of LOC221466 (Accession XM_168087). Accordingly, utilities of VGAM234 include diagnosis, prevention and treatment of diseases and clinical conditions associated with LOC221466.

LOC51031 (Accession NM_016080) is another VGAM234 host target gene. LOC51031 BINDING SITE is HOST TARGET binding site found in the 3' untranslated region of mRNA encoded by LOC51031, corresponding to a HOST TARGET binding site such as BINDING SITE I, BINDING SITE II or BINDING SITE III. Table 2 illustrates the complementarity of the nucleotide sequences of LOC51031 BINDING SITE, designated SEQ ID:18154, to the nucleotide sequence of VGAM234 RNA, herein designated VGAM RNA, also designated SEQ ID:2945.

Another function of VGAM234 is therefore inhibition of LOC51031 (Accession NM_016080). Accordingly, utilities of VGAM234 include diagnosis, prevention and treatment of diseases and clinical conditions associated with LOC51031.

FIG. 1 further provides a conceptual description of a novel bioinformatically detected viral gene of the present invention, referred to here as Viral Genomic Address Messenger 235 (VGAM235) viral gene, which modulates expression of respective host target genes thereof, the function and utility of which host target genes is known in the art.

VGAM235 is a novel bioinformatically detected regulatory, non protein coding, viral micro RNA (miRNA) gene. The method by which VGAM235 was detected is described hereinabove with reference to FIGS. 1-8.

VGAM235 gene, herein designated VGAM GENE, is a viral gene contained in the genome of Callitrichine Herpesvirus 3. VGAM235 host target gene, herein designated VGAM HOST TARGET GENE, is a human gene contained in the human genome.

VGAM235 gene encodes a VGAM235 precursor RNA, herein designated VGAM PRECURSOR RNA. Similar to other miRNA genes, and unlike most ordinary genes, VGAM235 precursor RNA does not encode a protein. A nucleotide sequence identical or highly similar to the nucleotide sequence of VGAM235 precursor RNA is designated SEQ ID:221, and is provided hereinbelow with reference to the sequence listing part. Nucleotide sequence SEQ ID:221 is located at position 99717 relative to the genome of Callitrichine Herpesvirus 3.

VGAM235 precursor RNA folds onto itself, forming VGAM235 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM235 folded precursor RNA into VGAM235 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM235 RNA is designated SEQ ID:2946, and is provided hereinbelow with reference to the sequence listing part.

VGAM235 host target gene, herein designated VGAM HOST TARGET GENE, encodes a corresponding messenger RNA, VGAM235 host target RNA, herein designated VGAM HOST TARGET RNA. VGAM235 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM235 RNA, herein designated VGAM RNA, binds complementarily to one or more host target binding sites located in untranslated regions of VGAM235 host target RNA, herein designated VGAM HOST TARGET RNA. This complementary binding is due to the fact that the nucleotide sequence of VGAM235 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM235 RNA, herein designated VGAM RNA, may have a different number of host target binding sites in untranslated regions of a VGAM235 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM235 RNA, herein designated VGAM RNA, to host target binding sites on VGAM235 host target RNA, herein designated VGAM HOST TARGET RNA, such as BINDING SITE I, BINDING SITE II and BINDING SITE III, inhibits translation of VGAM235 host target RNA into VGAM235 host target protein, herein designated VGAM HOST TARGET PROTEIN. VGAM host target protein is therefore outlined by a broken line.

It is appreciated that VGAM235 host target gene, herein designated VGAM HOST TARGET GENE, in fact represents a plurality of VGAM235 host target genes. The mRNA of each one of this plurality of VGAM235 host target genes comprises one or more host target binding sites, each having a nucleotide sequence which is at least partly complementary to VGAM235 RNA, herein designated VGAM RNA, and which when bound by VGAM235 RNA causes inhibition of translation of respective one or more VGAM235 host target proteins.

It is further appreciated by one skilled in the art that the mode of translational inhibition illustrated by FIG. 1 with specific reference to translational inhibition exerted by VGAM235 gene, herein designated VGAM GENE, on one or more VGAM235 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM235 is inhibition of expression of host target genes, as part of a novel viral mechanism of attacking a host. Accordingly, utilities of VGAM235 include diagnosis, prevention and treatment of viral infection by Callitrichine Herpesvirus 3. Specific functions, and accordingly utilities, of VGAM235 correlate with, and may be deduced from, the identity of the host target genes which VGAM235 binds and inhibits, and the function of these host target genes, as elaborated hereinbelow.

Nucleotide sequences of the VGAM235 precursor RNA, herein designated VGAM PRECURSOR RNA, and of the 'diced' VGAM235 RNA, herein designated VGAM RNA, and a schematic representation of the secondary folding of VGAM235 folded precursor RNA, herein designated VGAM FOLDED PRECURSOR RNA, of VGAM235 are further described hereinbelow with reference to Table 1.

Nucleotide sequences of host target binding sites, such as BINDING SITE-I, BINDING SITE-II and BINDING SITE-III of FIG. 1, found on VGAM235 host target RNA, and schematic representation of the complementarity of each of these host target binding sites to VGAM235 RNA, herein designated VGAM RNA, are described hereinbelow with reference to Table 2.

As mentioned hereinabove with reference to FIG. 1, a function of VGAM235 gene, herein designated VGAM is inhibition of expression of VGAM235 target genes. It is appreciated that specific functions, and accordingly utilities, of VGAM235 correlate with, and may be deduced from, the identity of the target genes which VGAM235 binds and inhibits, and the function of these target genes, as elaborated hereinbelow.

Apolipoprotein L, 1 (APOL1, Accession NM_003661) is a VGAM235 host target gene. APOL1 BINDING SITE is HOST TARGET binding site found in the 3' untranslated region of mRNA encoded by APOL1, corresponding to a HOST TARGET binding site such as BINDING SITE I, BINDING SITE II or BINDING SITE III. Table 2 illustrates the complementarity of the nucleotide sequences of APOL1 BINDING SITE, designated SEQ ID:9732, to the nucleotide sequence of VGAM235 RNA, herein designated VGAM RNA, also designated SEQ ID:2946.

A function of VGAM235 is therefore inhibition of Apolipoprotein L, 1 (APOL1, Accession NM_003661), a gene which may participate in reverse cholesterol transport from peripheral cells to the liver. Accordingly, utilities of VGAM235 include diagnosis, prevention and treatment of diseases and clinical conditions associated with APOL1. The function of APOL1 has been established by previous studies. By genomic sequence analysis, Page et al. (2001) identified APOL1 within the APOL gene cluster. The predicted 398-amino acid protein has a calculated molecular mass of 43.9 kD. They noted that the APOL proteins share significant identity within the predicted amphipathic alpha helices. Semiquantitative RT-PCR revealed ubiquitous expression of APOL1, with highest levels in lung, spleen, prostate, and placenta, and weak expression in fetal brain and pancreas. In situ hybridization of human placenta revealed expression in all 3 tissue layers, including the basal plate, cytiotrophoblast, and chorionic plate. In a microarray analysis of gene expression in the prefrontal cortex of schizophrenia (OMIM Ref. No. 181500) and control brains, Mimmack et al. (2002) found significant upregulation of the APOL1, APOL2 (OMIM Ref. No. 607252), and APOL4 (OMIM Ref. No. 607254) genes.

Full details of the abovementioned studies are described in the following publications, the disclosure of which are hereby incorporated by reference:

Mimmack, M. L.; Ryan, M.; Baba, H.; Navarro-Ruiz, J.; Iritani, S.; Faull, R. L. M.; McKenna, P. J.; Jones, P. B.; Arai, H.; Starkey, M.; Emson, P. C.; Bahn, S.: Gene expression analysis in schizophrenia: reproducible up-regulation of several members of the apolipoprotein L family located in a high-susceptibility locus for schizophrenia on chromosome 22. Proc. Nat. Acad. Sci. 99:4680-4685, 2002; and Page, N. M.; Butlin, D. J.; Lomthaisong, K.; Lowry, P. J.: The human apolipoprotein L gene cluster: identification, classification, and sites of distribution. Genomics 74:71-78, 200.

Further studies establishing the function and utilities of APOL1 are found in John Hopkins OMIM database record ID 603743, and in sited publications numbered 2899-290 and 4884-2902 listed in the bibliography section hereinbelow, which are also hereby incorporated by reference.24-dehydrocholesterol Reductase (DHCR24, Accession NM_014762) is another VGAM235 host target gene. DHCR24 BINDING SITE is HOST TARGET binding site found in the 3' untranslated region of mRNA encoded by DHCR24, corresponding to a HOST TARGET binding site such as BINDING SITE I, BINDING SITE II or BINDING SITE III. Table 2 illustrates the complementarity of the nucleotide sequences of DHCR24 BINDING SITE, designated SEQ ID:16528, to the nucleotide sequence of VGAM235 RNA, herein designated VGAM RNA, also designated SEQ ID:2946.

Another function of VGAM235 is therefore inhibition of 24-dehydrocholesterol Reductase (DHCR24, Accession NM_014762), a gene which catalyzes the reduction of sterol intermediates. Accordingly, utilities of VGAM235 include diagnosis, prevention and treatment of diseases and clinical conditions associated with DHCR24. The function of DHCR24 has been established by previous studies. Sarkar et al. (2001) showed that the gene encoding seladin-1, a human homolog of the Diminuto/Dwarf1 gene described in plants and C. elegans, has adenoma-specific overexpression. Northern blot analysis revealed that seladin-1 mRNA was overexpressed in the adenoma tissue of 14 patients with Cushing syndrome in comparison to the adjacent nontumorous adrenal gland. In situ hybridization using a seladin-1 cRNA probe showed its abundant expression in the tumor cells, whereas the nontumorous cells showed a low level of expression. Almost no apoptotic cell was detected in the tumor or in the normal adrenal cortex where seladin-1 expression was abundant. The authors noted that their results were compatible with a recent report that seladin-1 acts as an antiapoptotic factor in neurons (Greeve et al., 2000). In addition, expression of seladin-1 in the normal adrenal cortex was most abundant in the zona fasciculata, suggesting its possible regulation by ACTH/cAMP. The authors concluded that the overexpression of seladin-1 in the adenoma could be due to the abundant expression of ACTH receptor and hypothesized that seladin-1 might be involved in the molecular events of adrenocortical tumorigenesis by facilitating steroid synthesis and cell growth. In a severely affected infant with desmosterolosis (OMIM Ref. No. 602398), Waterham et al. (2001) identified 3 mutations in the DHCR24 gene. The mutation inherited from the mother was a 1412A-C change resulting in a tyr471-to-ser (Y471S) substitution. Expression studies in S. cerevisiae showed nondetectable activity of this variant, consistent with the severe phenotype of the patient. Two mutations on the same allele were inherited from the father: an 881A-C change resulting in an asn294-to-thr substitution (N294T), and a 918G-C change resulting in a lys306-to-asn (K306N) substitution (606418.0002). Expression studies in S. cerevisiae of the N294T and K306N variants showed 14.4% and 49.8% of wildtype activity, respectively. Expression studies in S. cerevisiae of an allele with both mutations from the father showed less than 1% of wildtype activity. To determine whether one of the mutations inherited from the father was a common polymorphic variant, 50 alleles of controls were analyzed but neither mutation was detected.

Full details of the abovementioned studies are described in the following publications, the disclosure of which are hereby incorporated by reference:

Sarkar, D.; Imai, T.; Kambe, F.; Shibata, A.; Ohmori, S.; Siddiq, A.; Hayasaka, S.; Funahashi, H.; Seo, H.: The human homolog of Diminuto/Dwarf1 gene (hDiminuto): a novel ACTH-responsive gene overexpressed in benign cortisol-producing adrenocortical adenomas. J. Clin. Endocr. Metab. 86:5130-5137, 2001; and Greeve, I.; Hermans-Borgmeyer, I.; Brellinger, C.; Kasper, D.; Gomez-Isla, T.; Behl, C.; Levkau, B.; Nitsch, R. M.: The human DIMINUTO/DWARF1 homolog seladin-1 confers resistance to A.

Further studies establishing the function and utilities of DHCR24 are found in John Hopkins OMIM database record ID 606418, and in sited publications numbered 676 and 6949 listed in the bibliography section hereinbelow, which are also hereby incorporated by reference. Gamma-glutamyltransferase 2 (GGT2, Accession XM_057166) is another VGAM235 host target gene. GGT2 BINDING SITE is HOST TARGET binding site found in the 5' untranslated region of mRNA encoded by GGT2, corresponding to a HOST TARGET binding site such as BINDING SITE I, BINDING SITE II or BINDING SITE III. Table 2 illustrates the complementarity of the nucleotide sequences of GGT2 BINDING SITE, designated SEQ ID:36488, to the nucleotide sequence of VGAM235 RNA, herein designated VGAM RNA, also designated SEQ ID:2946.

Another function of VGAM235 is therefore inhibition of Gamma-glutamyltransferase 2 (GGT2, Accession XM_057166). Accordingly, utilities of VGAM235 include diagnosis, prevention and treatment of diseases and clinical conditions associated with GGT2. Kell Blood Group Precursor (McLeod phenotype) (XK, Accession NM_021083) is another VGAM235 host target gene. XK BINDING SITE is HOST TARGET binding site found in the 3' untranslated region of mRNA encoded by XK, corresponding to a HOST TARGET binding site such as BINDING SITE I, BINDING SITE II or BINDING SITE III. Table 2 illustrates the complementarity of the nucleotide sequences of XK BINDING SITE, designated SEQ ID:22059, to the nucleotide sequence of VGAM235 RNA, herein designated VGAM RNA, also designated SEQ ID:2946.

Another function of VGAM235 is therefore inhibition of Kell Blood Group Precursor (McLeod phenotype) (XK, Accession NM_021083). Accordingly, utilities of VGAM235 include diagnosis, prevention and treatment of diseases and clinical conditions associated with XK. DKFZp434C0328 (Accession NM_017577) is another VGAM235 host target gene. DKFZp434C0328 BINDING SITE is HOST TARGET binding site found in the 3' untranslated region of mRNA encoded by DKFZp434C0328, corresponding to a HOST TARGET binding site such as BINDING SITE I, BINDING SITE II or BINDING SITE III. Table 2 illustrates the complementarity of the nucleotide sequences of DKFZp434C0328 BINDING SITE, designated SEQ ID:19015, to the nucleotide sequence of VGAM235 RNA, herein designated VGAM RNA, also designated SEQ ID:2946.

Another function of VGAM235 is therefore inhibition of DKFZp434C0328 (Accession NM_017577). Accordingly, utilities of VGAM235 include diagnosis, prevention and treatment of diseases and clinical conditions associated with DKFZp434C0328. FLJ21195 (Accession NM_022469) is another VGAM235 host target gene. FLJ21195 BINDING SITE is HOST TARGET binding site found in the 3' untranslated region of mRNA encoded by FLJ21195, corresponding to a HOST TARGET binding site such as BINDING SITE I, BINDING SITE II or BINDING SITE III. Table 2 illustrates the complementarity of the nucleotide sequences of FLJ21195 BINDING SITE, designated SEQ ID:22825, to the nucleotide sequence of VGAM235 RNA, herein designated VGAM RNA, also designated SEQ ID:2946.

Another function of VGAM235 is therefore inhibition of FLJ21195 (Accession NM_022469). Accordingly, utilities of VGAM235 include diagnosis, prevention and treatment of diseases and clinical conditions associated with FLJ21195. MEGF11 (Accession NM_032445) is another VGAM235 host target gene. MEGF11 BINDING SITE is HOST TARGET binding site found in the 3' untranslated region of mRNA encoded by MEGF11, corresponding to a HOST TARGET binding site such as BINDING SITE I, BINDING SITE II or BINDING SITE III. Table 2 illustrates the complementarity of the nucleotide sequences of MEGF11 BINDING SITE, designated SEQ ID:26205, to the nucleotide sequence of VGAM235 RNA, herein designated VGAM RNA, also designated SEQ ID:2946.

Another function of VGAM235 is therefore inhibition of MEGF11 (Accession NM_032445). Accordingly, utilities of VGAM235 include diagnosis, prevention and treatment of diseases and clinical conditions associated with MEGF11. LOC153937 (Accession XM_087813) is another VGAM235 host target gene. LOC153937 BINDING SITE is HOST TARGET binding site found in the 5' untranslated region of mRNA encoded by LOC153937, corresponding to a HOST TARGET binding site such as BINDING SITE I, BINDING SITE II or BINDING SITE III. Table 2 illustrates the complementarity of the nucleotide sequences of LOC153937 BINDING SITE, designated SEQ ID:39449, to the nucleotide sequence of VGAM235 RNA, herein designated VGAM RNA, also designated SEQ ID:2946.

Another function of VGAM235 is therefore inhibition of LOC153937 (Accession XM_087813). Accordingly, utilities of VGAM235 include diagnosis, prevention and treatment of diseases and clinical conditions associated with LOC153937. LOC85414 (Accession NM_033102) is another VGAM235 host target gene. LOC85414 BINDING SITE is HOST TARGET binding site found in the 3' untranslated region of mRNA encoded by LOC85414, corresponding to a HOST TARGET binding site such as BINDING SITE I, BINDING SITE II or BINDING SITE III. Table 2 illustrates the complementarity of the nucleotide sequences of LOC85414 BINDING SITE, designated SEQ ID:26954, to the nucleotide sequence of VGAM235 RNA, herein designated VGAM RNA, also designated SEQ ID:2946.

Another function of VGAM235 is therefore inhibition of LOC85414 (Accession NM_033102). Accordingly, utilities of VGAM235 include diagnosis, prevention and treatment of diseases and clinical conditions associated with LOC85414.

FIG. 1 further provides a conceptual description of a novel bioinformatically detected viral gene of the present invention, referred to here as Viral Genomic Address Messenger 236 (VGAM236) viral gene, which modulates expression of respective host target genes thereof, the function and utility of which host target genes is known in the art.

VGAM236 is a novel bioinformatically detected regulatory, non protein coding, viral micro RNA (miRNA) gene. The method by which VGAM236 was detected is described hereinabove with reference to FIGS. 1-8.

VGAM236 gene, herein designated VGAM GENE, is a viral gene contained in the genome of Callitrichine Herpesvirus 3. VGAM236 host target gene, herein designated VGAM HOST TARGET GENE, is a human gene contained in the human genome.

VGAM236 gene encodes a VGAM236 precursor RNA, herein designated VGAM PRECURSOR RNA. Similar to other miRNA genes, and unlike most ordinary genes, VGAM236 precursor RNA does not encode a protein. A nucleotide sequence identical or highly similar to the nucleotide sequence of VGAM236 precursor RNA is designated SEQ ID:222, and is provided hereinbelow with reference to the sequence listing part. Nucleotide sequence SEQ ID:222 is located at position 88403 relative to the genome of Callitrichine Herpesvirus 3.

VGAM236 precursor RNA folds onto itself, forming VGAM236 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM236 folded precursor RNA into VGAM236 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM236 RNA is designated SEQ ID:2947, and is provided hereinbelow with reference to the sequence listing part.

VGAM236 host target gene, herein designated VGAM HOST TARGET GENE, encodes a corresponding messenger RNA, VGAM236 host target RNA, herein designated VGAM HOST TARGET RNA. VGAM236 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM236 RNA, herein designated VGAM RNA, binds complementarily to one or more host target binding sites located in untranslated regions of VGAM236 host target RNA, herein designated VGAM HOST TARGET RNA. This complementary binding is due to the fact that the nucleotide sequence of VGAM236 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM236 RNA, herein designated VGAM RNA, may have a different number of host target binding sites in untranslated regions of a VGAM236 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM236 RNA, herein designated VGAM RNA, to host target binding sites on VGAM236 host target RNA, herein designated VGAM HOST TARGET RNA, such as BINDING SITE I, BINDING SITE II and BINDING SITE III, inhibits translation of VGAM236 host target RNA into VGAM236 host target protein, herein designated VGAM HOST TARGET PROTEIN. VGAM host target protein is therefore outlined by a broken line.

It is appreciated that VGAM236 host target gene, herein designated VGAM HOST TARGET GENE, in fact represents a plurality of VGAM236 host target genes. The mRNA of each one of this plurality of VGAM236 host target genes comprises one or more host target binding sites, each having a nucleotide sequence which is at least partly complementary to VGAM236 RNA, herein designated VGAM RNA, and which when bound by VGAM236 RNA causes inhibition of translation of respective one or more VGAM236 host target proteins.

It is further appreciated by one skilled in the art that the mode of translational inhibition illustrated by FIG. 1 with specific reference to translational inhibition exerted by VGAM236 gene, herein designated VGAM GENE, on one or more VGAM236 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM236 is inhibition of expression of host target genes, as part of a novel viral mechanism of attacking a host. Accordingly, utilities of VGAM236 include diagnosis, prevention and treatment of viral infection by Callitrichine Herpesvirus 3. Specific functions, and accordingly utilities, of VGAM236 correlate with, and may be deduced from, the identity of the host target genes which VGAM236 binds and inhibits, and the function of these host target genes, as elaborated hereinbelow.

Nucleotide sequences of the VGAM236 precursor RNA, herein designated VGAM PRECURSOR RNA, and of the 'diced' VGAM236 RNA, herein designated VGAM RNA, and a schematic representation of the secondary folding of VGAM236 folded precursor RNA, herein designated VGAM FOLDED PRECURSOR RNA, of VGAM236 are further described hereinbelow with reference to Table 1.

Nucleotide sequences of host target binding sites, such as BINDING SITE-I, BINDING SITE-II and BINDING SITE-III of FIG. 1, found on VGAM236 host target RNA, and schematic representation of the complementarity of each of these host target binding sites to VGAM236 RNA, herein designated VGAM RNA, are described hereinbelow with reference to Table 2.

As mentioned hereinabove with reference to FIG. 1, a function of VGAM236 gene, herein designated VGAM is inhibition of expression of VGAM236 target genes. It is appreciated that specific functions, and accordingly utilities, of VGAM236 correlate with, and may be deduced from, the identity of the target genes which VGAM236 binds and inhibits, and the function of these target genes, as elaborated hereinbelow.

V-abl Abelson Murine Leukemia Viral Oncogene Homolog 1 (ABL1, Accession NM_005157) is a VGAM236 host target gene. ABL1 BINDING SITE1 and ABL1 BINDING SITE2 are HOST TARGET binding sites found in untranslated regions of mRNA encoded by ABL1, corresponding to HOST TARGET binding sites such as BINDING SITE I, BINDING SITE II or BINDING SITE III. Table 2 illustrates the complementarity of the nucleotide sequences of ABL1 BINDING SITE1 and ABL1 BINDING SITE2, designated SEQ ID:11636 and SEQ ID:14225 respectively, to the nucleotide sequence of VGAM236 RNA, herein designated VGAM RNA, also designated SEQ ID:2947.

A function of VGAM236 is therefore inhibition of V-abl Abelson Murine Leukemia Viral Oncogene Homolog 1 (ABL1, Accession NM_005157). Accordingly, utilities of VGAM236 include diagnosis, prevention and treatment of diseases and clinical conditions associated with ABL1. Sodium Channel, Voltage-gated, Type I, Alpha Polypeptide (SCN1A, Accession XM_114281) is another VGAM236 host target gene. SCN1A BINDING SITE is HOST TARGET binding site found in the 3' untranslated region of mRNA encoded by SCN1A, corresponding to a HOST TARGET binding site such as BINDING SITE I, BINDING SITE II or BINDING SITE III. Table 2 illustrates the complementarity of the nucleotide sequences of SCN1A BINDING SITE, designated SEQ ID:42828, to the nucleotide sequence of VGAM236 RNA, herein designated VGAM RNA, also designated SEQ ID:2947.

Another function of VGAM236 is therefore inhibition of Sodium Channel, Voltage-gated, Type I, Alpha Polypeptide (SCN1A, Accession XM_114281). Accordingly, utilities of VGAM236 include diagnosis, prevention and treatment of diseases and clinical conditions associated with SCN1A. Wolf-Hirschhorn Syndrome Candidate 1 (WHSC1, Accession NM_014919) is another VGAM236 host target gene. WHSC1 BINDING SITE1 through WHSC1 BINDING SITE3 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE3, designated SEQ ID:17174, SEQ ID:28438 and SEQ ID:28455 respectively, to the nucleotide sequence of VGAM236 RNA, herein designated VGAM RNA, also designated SEQ ID:2947.

Another function of VGAM236 is therefore inhibition of Wolf-Hirschhorn Syndrome Candidate 1 (WHSC1, Accession NM_014919), a gene which binds covalently to and repairs g/t mismatches. Accordingly, utilities of VGAM236 include diagnosis, prevention and treatment of diseases and clinical conditions associated with WHSC1. The function of WHSC1 and its association with various diseases and clinical conditions, has been established by previous studies, as described hereinabove with reference to VGAM200. Synaptojanin 2 (SYNJ2, Accession XM_029746) is another VGAM236 host target gene. SYNJ2 BINDING SITE is HOST TARGET binding site found in the 3' untranslated region of mRNA encoded by SYNJ2, corresponding to a HOST TARGET binding site such as BINDING SITE I, BINDING SITE II or BINDING SITE III. Table 2 illustrates the complementarity of the nucleotide sequences of SYNJ2 BINDING SITE, designated SEQ ID:30940, to the nucleotide sequence of VGAM236 RNA, herein designated VGAM RNA, also designated SEQ ID:2947.

Another function of VGAM236 is therefore inhibition of Synaptojanin 2 (SYNJ2, Accession XM_029746). Accordingly, utilities of VGAM236 include diagnosis, prevention and treatment of diseases and clinical conditions associated with SYNJ2. Synaptotagmin XIII (SYT13, Accession XM_167880) is another VGAM236 host target gene. SYT13 BINDING SITE is HOST TARGET binding site found in the 3' untranslated region of mRNA encoded by SYT13, corresponding to a HOST TARGET binding site such as BINDING SITE I, BINDING SITE II or BINDING SITE III. Table 2 illustrates the complementarity of the nucleotide sequences of SYT13 BINDING SITE, designated SEQ ID:44884, to the nucleotide sequence of VGAM236 RNA, herein designated VGAM RNA, also designated SEQ ID:2947.

Another function of VGAM236 is therefore inhibition of Synaptotagmin XIII (SYT13, Accession XM_167880). Accordingly, utilities of VGAM236 include diagnosis, prevention and treatment of diseases and clinical conditions associated with SYT13. LOC152698 (Accession XM_017241) is another VGAM236 host target gene. LOC152698 BINDING SITE is HOST TARGET binding site found in the 5' untranslated region of mRNA encoded by LOC152698, corresponding to a HOST TARGET binding site such as BINDING SITE I, BINDING SITE II or BINDING SITE III. Table 2 illustrates the complementarity of the nucleotide sequences of LOC152698 BINDING SITE, designated SEQ ID:30311, to the nucleotide sequence of VGAM236 RNA, herein designated VGAM RNA, also designated SEQ ID:2947.

Another function of VGAM236 is therefore inhibition of LOC152698 (Accession XM_017241). Accordingly, utilities of VGAM236 include diagnosis, prevention and treatment of diseases and clinical conditions associated with LOC152698. LOC157280 (Accession XM_058301) is another VGAM236 host target gene. LOC157280 BINDING SITE is HOST TARGET binding site found in the 5' untranslated region of mRNA encoded by LOC157280, corresponding to a HOST TARGET binding site such as BINDING SITE I, BINDING SITE II or BINDING SITE III. Table 2 illustrates the complementarity of the nucleotide sequences of LOC157280 BINDING SITE, designated SEQ ID:36590, to the nucleotide sequence of VGAM236 RNA, herein designated VGAM RNA, also designated SEQ ID:2947.

Another function of VGAM236 is therefore inhibition of LOC157280 (Accession XM_058301). Accordingly, utilities of VGAM236 include diagnosis, prevention and treatment of diseases and clinical conditions associated with LOC157280. LOC255448 (Accession XM_170623) is another VGAM236 host target gene. LOC255448 BINDING SITE is HOST TARGET binding site found in the 5' untranslated region of mRNA encoded by LOC255448, corresponding to a HOST TARGET binding site such as BINDING SITE I, BINDING SITE II or BINDING SITE III. Table 2 illustrates the complementarity of the nucleotide sequences of LOC255448 BINDING SITE, designated SEQ ID:45400, to the nucleotide sequence of VGAM236 RNA, herein designated VGAM RNA, also designated SEQ ID:2947.

Another function of VGAM236 is therefore inhibition of LOC255448 (Accession XM_170623). Accordingly, utilities of VGAM236 include diagnosis, prevention and treatment of diseases and clinical conditions associated with LOC255448.

FIG. 1 further provides a conceptual description of a novel bioinformatically detected viral gene of the present invention, referred to here as Viral Genomic Address Messenger 237 (VGAM237) viral gene, which modulates expression of respective host target genes thereof, the function and utility of which host target genes is known in the art.

VGAM237 is a novel bioinformatically detected regulatory, non protein coding, viral micro RNA (miRNA) gene. The method by which VGAM237 was detected is described hereinabove with reference to FIGS. 1-8.

VGAM237 gene, herein designated VGAM GENE, is a viral gene contained in the genome of Callitrichine Herpesvirus 3. VGAM237 host target gene, herein designated VGAM HOST TARGET GENE, is a human gene contained in the human genome.

VGAM237 gene encodes a VGAM237 precursor RNA, herein designated VGAM PRECURSOR RNA. Similar to other miRNA genes, and unlike most ordinary genes, VGAM237 precursor RNA does not encode a protein. A nucleotide sequence identical or highly similar to the nucleotide sequence of VGAM237 precursor RNA is designated SEQ ID:223, and is provided hereinbelow with reference to the sequence listing part. Nucleotide sequence SEQ ID:223 is located at position 74899 relative to the genome of Callitrichine Herpesvirus 3.

VGAM237 precursor RNA folds onto itself, forming VGAM237 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM237 folded precursor RNA into VGAM237 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM237 RNA is designated SEQ ID:2948, and is provided hereinbelow with reference to the sequence listing part.

VGAM237 host target gene, herein designated VGAM HOST TARGET GENE, encodes a corresponding messenger RNA, VGAM237 host target RNA, herein designated VGAM HOST TARGET RNA. VGAM237 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM237 RNA, herein designated VGAM RNA, binds complementarily to one or more host target binding sites located in untranslated regions of VGAM237 host target RNA, herein designated VGAM HOST TARGET RNA. This complementary binding is due to the fact that the nucleotide sequence of VGAM237 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM237 RNA, herein designated VGAM RNA, may have a different number of host target binding sites in untranslated regions of a VGAM237 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM237 RNA, herein designated VGAM RNA, to host target binding sites on VGAM237 host target RNA, herein designated VGAM HOST TARGET RNA, such as BINDING SITE I, BINDING SITE II and BINDING SITE III, inhibits translation of VGAM237 host target RNA into VGAM237 host target protein, herein designated VGAM HOST TARGET PROTEIN. VGAM host target protein is therefore outlined by a broken line.

It is appreciated that VGAM237 host target gene, herein designated VGAM HOST TARGET GENE, in fact represents a plurality of VGAM237 host target genes. The mRNA of each one of this plurality of VGAM237 host target genes comprises one or more host target binding sites, each having a nucleotide sequence which is at least partly complementary to VGAM237 RNA, herein designated VGAM RNA, and which when bound by VGAM237 RNA causes inhibition of translation of respective one or more VGAM237 host target proteins.

It is further appreciated by one skilled in the art that the mode of translational inhibition illustrated by FIG. 1 with specific reference to translational inhibition exerted by VGAM237 gene, herein designated VGAM GENE, on one or more VGAM237 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM237 is inhibition of expression of host target genes, as part of a novel viral mechanism of attacking a host. Accordingly, utilities of VGAM237 include diagnosis, prevention and treatment of viral infection by Callitrichine Herpesvirus 3. Specific functions, and accordingly utilities, of VGAM237 correlate with, and may be deduced from, the identity of the host target genes which VGAM237 binds and inhibits, and the function of these host target genes, as elaborated hereinbelow.

Nucleotide sequences of the VGAM237 precursor RNA, herein designated VGAM PRECURSOR RNA, and of the 'diced' VGAM237 RNA, herein designated VGAM RNA, and a schematic representation of the secondary folding of VGAM237 folded precursor RNA, herein designated VGAM FOLDED PRECURSOR RNA, of VGAM237 are further described hereinbelow with reference to Table 1.

Nucleotide sequences of host target binding sites, such as BINDING SITE-I, BINDING SITE-II and BINDING SITE-III of FIG. 1, found on VGAM237 host target RNA, and schematic representation of the complementarity of each of these host target binding sites to VGAM237 RNA, herein designated VGAM RNA, are described hereinbelow with reference to Table 2.

As mentioned hereinabove with reference to FIG. 1, a function of VGAM237 gene, herein designated VGAM is inhibition of expression of VGAM237 target genes. It is appreciated that specific functions, and accordingly utilities, of VGAM237 correlate with, and may be deduced from, the identity of the target genes which VGAM237 binds and inhibits, and the function of these target genes, as elaborated hereinbelow.

Chemokine-like Receptor 1 (CMKLR1, Accession NM_004072) is a VGAM237 host target gene. CMKLR1 BINDING SITE is HOST TARGET binding site found in the 5' untranslated region of mRNA encoded by CMKLR1, corresponding to a HOST TARGET binding site such as BINDING SITE I, BINDING SITE II or BINDING SITE III. Table 2 illustrates the complementarity of the nucleotide sequences of CMKLR1 BINDING SITE, designated SEQ ID:10276, to the nucleotide sequence of VGAM237 RNA, herein designated VGAM RNA, also designated SEQ ID:2948.

A function of VGAM237 is therefore inhibition of Chemokine-like Receptor 1 (CMKLR1, Accession NM_004072), a gene which may have a function in bone metabolism. Accordingly, utilities of VGAM237 include diagnosis, prevention and treatment of diseases and clinical conditions associated with CMKLR1. The function of CMKLR1 has been established by previous studies. Chemokines, a family of small cytokines, recruit leukocytes during inflammation and immune responses. Chemokine receptors, such as the somatostatin receptors (see, OMIM Ref. No., e.g., 182451), belong to the family of 7-transmembrane G protein-coupled receptors. Gantz et al. (1996) cloned CMKLR1 by PCR of genomic DNA with degenerate primers based on the conserved regions of somatostatin receptors 1-4. The predicted 371-amino acid protein has 7 hydrophobic domains. The CMKLR1 gene has over 40% nucleotide sequence homology to the somatostatin receptors 1-4 and over 50% to IL81R (OMIM Ref. No. 146929) and FPR1 (OMIM Ref. No. 136537). Northern blot analysis revealed expression of multiple transcripts of different size in all tissues examined. Gantz et al. (1996) mapped the CMKLR1 gene to chromosome 12q24.1 by fluorescence in situ hybridization While attempting to identify new neuropeptide receptors from a neuroblastoma x glioma cell line by RT-PCR with primers based on conserved regions of G protein-coupled neuropeptide receptors, Methner et al. (1997) cloned a mouse Cmklr1 cDNA, which they designated Dez. Using in situ hybridization, Methner et al. (1997) found that Dez is differentially regulated during mouse development, with prominent expression in developing osseous and cartilaginous tissues. Owman et al. (1997) cloned the rat homolog, which they designated Cmkrl3, from a liver cDNA library. Using in situ hybridization, they found that Cmkrl3 is widely expressed in the brain and periphery, particularly in cardiovascular elements Full details of the abovementioned studies are described in the following publications, the disclosure of which are hereby incorporated by reference:

Gantz, I.; Konda, Y.; Yang, Y.-K.; Miller, D. E.; Dierick, H. A.; Yamada, T.: Molecular cloning of a novel receptor (CMKLR1) with homology to the chemotactic factor receptors. Cytogenet. Cell Genet. 74:286-290, 1996; and Methner, A.; Hermey, G.; Schinke, B.; Hermans-Borgmeyer, I.: A novel G protein-coupled receptor with homology to neuropeptide and chemoattractant receptors expressed during bone develop.

Further studies establishing the function and utilities of CMKLR1 are found in John Hopkins OMIM database record ID 602351, and in sited publications numbered 1015-101 and 1018 listed in the bibliography section hereinbelow, which are also hereby incorporated by reference. Fibroblast Growth Factor 23 (FGF23, Accession NM_020638) is another VGAM237 host target gene. FGF23 BINDING SITE is HOST TARGET binding site found in the 3' untranslated region of mRNA encoded by FGF23, corresponding to a HOST TARGET binding site such as BINDING SITE I, BINDING SITE II or BINDING SITE III. Table 2 illustrates the complementarity of the nucleotide sequences of FGF23 BINDING SITE, designated SEQ ID:21790, to the nucleotide sequence of VGAM237 RNA, herein designated VGAM RNA, also designated SEQ ID:2948.

Another function of VGAM237 is therefore inhibition of Fibroblast Growth Factor 23 (FGF23, Accession NM_020638), a gene which a member of the fibroblast growth factor family. Accordingly, utilities of VGAM237 include diagnosis, prevention and treatment of diseases and clinical conditions associated with FGF23. The function of FGF23 and its association with various diseases and clinical conditions, has been established by previous studies, as described hereinabove with reference to VGAM24. Pim-1 Oncogene (PIM1, Accession XM_165800) is another VGAM237 host target gene. PIM1 BINDING SITE is HOST TARGET binding site found in the 5' untranslated region of mRNA encoded by PIM1, corresponding to a HOST TARGET binding site such as BINDING SITE I, BINDING SITE II or BINDING SITE III. Table 2 illustrates the complementarity of the nucleotide sequences of PIM1 BINDING SITE, designated SEQ ID:43755, to the nucleotide sequence of VGAM237 RNA, herein designated VGAM RNA, also designated SEQ ID:2948.

Another function of VGAM237 is therefore inhibition of Pim-1 Oncogene (PIM1, Accession XM_165800), a gene which is a proto-oncogene. Accordingly, utilities of VGAM237 include diagnosis, prevention and treatment of diseases and clinical conditions associated with PIM1. The function of PIM1 and its association with various diseases and clinical conditions, has been established by previous studies, as described hereinabove with reference to VGAM95. Thrombomodulin (THBD, Accession NM_000361) is another VGAM237 host target gene. THBD BINDING SITE is HOST TARGET binding site found in the 5' untranslated region of mRNA encoded by THBD, corresponding to a HOST TARGET binding site such as BINDING SITE I, BINDING SITE II or BINDING SITE III. Table 2 illustrates the complementarity of the nucleotide sequences of THBD BINDING SITE, designated SEQ ID:5921, to the nucleotide sequence of VGAM237 RNA, herein designated VGAM RNA, also designated SEQ ID:2948.

Another function of VGAM237 is therefore inhibition of Thrombomodulin (THBD, Accession NM_000361). Accordingly, utilities of VGAM237 include diagnosis, prevention and treatment of diseases and clinical conditions associated with THBD. KIAA1056 (Accession NM_014894) is another VGAM237 host target gene. KIAA1056 BINDING SITE is HOST TARGET binding site found in the 5' untranslated region of mRNA encoded by KIAA1056, corresponding to a HOST TARGET binding site such as BINDING SITE I, BINDING SITE II or BINDING SITE III. Table 2 illustrates the complementarity of the nucleotide sequences of KIAA1056 BINDING SITE, designated SEQ ID:17044, to the nucleotide sequence of VGAM237 RNA, herein designated VGAM RNA, also designated SEQ ID:2948.

Another function of VGAM237 is therefore inhibition of KIAA1056 (Accession NM_014894). Accordingly, utilities of VGAM237 include diagnosis, prevention and treatment of diseases and clinical conditions associated with KIAA1056. LOC118786 (Accession XM_061147) is another VGAM237 host target gene. LOC118786 BINDING SITE is HOST TARGET binding site found in the 5' untranslated region of mRNA encoded by LOC118786, corresponding to a HOST TARGET binding site such as BINDING SITE I, BINDING SITE II or BINDING SITE III. Table 2 illustrates the complementarity of the nucleotide sequences of LOC118786 BINDING SITE, designated SEQ ID:37198, to the nucleotide sequence of VGAM237 RNA, herein designated VGAM RNA, also designated SEQ ID:2948.

Another function of VGAM237 is therefore inhibition of LOC118786 (Accession XM_061147). Accordingly, utilities of VGAM237 include diagnosis, prevention and treatment of diseases and clinical conditions associated with LOC118786. FIG. 1 further provides a conceptual description of a novel bioinformatically detected viral gene of the present invention, referred to here as Viral Genomic Address Messenger 238 (VGAM238) viral gene, which modulates expression of respective host target genes thereof, the function and utility of which host target genes is known in the art.

VGAM238 is a novel bioinformatically detected regulatory, non protein coding, viral micro RNA (miRNA) gene. The method by which VGAM238 was detected is described hereinabove with reference to FIGS. 1-8.

VGAM238 gene, herein designated VGAM GENE, is a viral gene contained in the genome of Callitrichine Herpesvirus 3. VGAM238 host target gene, herein designated VGAM HOST TARGET GENE, is a human gene contained in the human genome.

VGAM238 gene encodes a VGAM238 precursor RNA, herein designated VGAM PRECURSOR RNA. Similar to other miRNA genes, and unlike most ordinary genes, VGAM238 precursor RNA does not encode a protein. A nucleotide sequence identical or highly similar to the nucleotide sequence of VGAM238 precursor RNA is designated SEQ ID:224, and is provided hereinbelow with reference to the sequence listing part. Nucleotide sequence SEQ ID:224 is located at position 31365 relative to the genome of Callitrichine Herpesvirus 3.

VGAM238 precursor RNA folds onto itself, forming VGAM238 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM238 folded precursor RNA into VGAM238 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM238 RNA is designated SEQ ID:2949, and is provided hereinbelow with reference to the sequence listing part.

VGAM238 host target gene, herein designated VGAM HOST TARGET GENE, encodes a corresponding messenger RNA, VGAM238 host target RNA, herein designated VGAM HOST TARGET RNA. VGAM238 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM238 RNA, herein designated VGAM RNA, binds complementarily to one or more host target binding sites located in untranslated regions of VGAM238 host target RNA, herein designated VGAM HOST TARGET RNA. This complementary binding is due to the fact that the nucleotide sequence of VGAM238 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM238 RNA, herein designated VGAM RNA, may have a different number of host target binding sites in untranslated regions of a VGAM238 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM238 RNA, herein designated VGAM RNA, to host target binding sites on VGAM238 host target RNA, herein designated VGAM HOST TARGET RNA, such as BINDING SITE I, BINDING SITE II and BINDING SITE III, inhibits translation of VGAM238 host target RNA into VGAM238 host target protein, herein designated VGAM HOST TARGET PROTEIN. VGAM host target protein is therefore outlined by a broken line.

It is appreciated that VGAM238 host target gene, herein designated VGAM HOST TARGET GENE, in fact represents a plurality of VGAM238 host target genes. The mRNA of each one of this plurality of VGAM238 host target genes comprises one or more host target binding sites, each having a nucleotide sequence which is at least partly complementary to VGAM238 RNA, herein designated VGAM RNA, and which when bound by VGAM238 RNA causes inhibition of translation of respective one or more VGAM238 host target proteins.

It is further appreciated by one skilled in the art that the mode of translational inhibition illustrated by FIG. 1 with specific reference to translational inhibition exerted by VGAM238 gene, herein designated VGAM GENE, on one or more VGAM238 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM238 is inhibition of expression of host target genes, as part of a novel viral mechanism of attacking a host. Accordingly, utilities of VGAM238 include diagnosis, prevention and treatment of viral infection by Callitrichine Herpesvirus 3. Specific functions, and accordingly utilities, of VGAM238 correlate with, and may be deduced from, the identity of the host target genes which VGAM238 binds and inhibits, and the function of these host target genes, as elaborated hereinbelow.

Nucleotide sequences of the VGAM238 precursor RNA, herein designated VGAM PRECURSOR RNA, and of the 'diced' VGAM238 RNA, herein designated VGAM RNA, and a schematic representation of the secondary folding of VGAM238 folded precursor RNA, herein designated VGAM FOLDED PRECURSOR RNA, of VGAM238 are further described hereinbelow with reference to Table 1.

Nucleotide sequences of host target binding sites, such as BINDING SITE-I, BINDING SITE-II and BINDING SITE-III of FIG. 1, found on VGAM238 host target RNA, and schematic representation of the complementarity of each of these host target binding sites to VGAM238 RNA, herein designated VGAM RNA, are described hereinbelow with reference to Table 2.

As mentioned hereinabove with reference to FIG. 1, a function of VGAM238 gene, herein designated VGAM is inhibition of expression of VGAM238 target genes. It is appreciated that specific functions, and accordingly utilities, of VGAM238 correlate with, and may be deduced from, the identity of the target genes which VGAM238 binds and inhibits, and the function of these target genes, as elaborated hereinbelow.

KIAA0441 (Accession NM_014797) is a VGAM238 host target gene. KIAA0441 BINDING SITE is HOST TARGET binding site found in the 3' untranslated region of mRNA encoded by KIAA0441, corresponding to a HOST TARGET binding site such as BINDING SITE I, BINDING SITE II or BINDING SITE III. Table 2 illustrates the complementarity of the nucleotide sequences of KIAA0441 BINDING SITE, designated SEQ ID:16706, to the nucleotide sequence of VGAM238 RNA, herein designated VGAM RNA, also designated SEQ ID:2949.

A function of VGAM238 is therefore inhibition of KIAA0441 (Accession NM_014797). Accordingly, utilities of VGAM238 include diagnosis, prevention and treatment of diseases and clinical conditions associated with KIAA0441. KIAA0481 (Accession XM_050144) is another VGAM238 host target gene. KIAA0481 BINDING SITE is HOST TAR-GET binding site found in the 5' untranslated region of mRNA encoded by KIAA0481, corresponding to a HOST TARGET binding site such as BINDING SITE I, BINDING SITE II or BINDING SITE III. Table 2 illustrates the complementarity of the nucleotide sequences of KIAA0481 BINDING SITE, designated SEQ ID:35566, to the nucleotide sequence of VGAM238 RNA, herein designated VGAM RNA, also designated SEQ ID:2949.

Another function of VGAM238 is therefore inhibition of KIAA0481 (Accession XM_050144). Accordingly, utilities of VGAM238 include diagnosis, prevention and treatment of diseases and clinical conditions associated with KIAA0481. KIAA0721 (Accession XM_171125) is another VGAM238 host target gene. KIAA0721 BINDING SITE1 and KIAA0721 BINDING SITE2 are HOST TARGET binding sites found in untranslated regions of mRNA encoded by KIAA0721, corresponding to HOST TARGET binding sites such as BINDING SITE I, BINDING SITE II or BINDING SITE III. Table 2 illustrates the complementarity of the nucleotide sequences of KIAA0721 BINDING SITE1 and KIAA0721 BINDING SITE2, designated SEQ ID:45923 and SEQ ID:22316 respectively, to the nucleotide sequence of VGAM238 RNA, herein designated VGAM RNA, also designated SEQ ID:2949.

Another function of VGAM238 is therefore inhibition of KIAA0721 (Accession XM_171125). Accordingly, utilities of VGAM238 include diagnosis, prevention and treatment of diseases and clinical conditions associated with KIAA0721. LOC131870 (Accession XM_059544) is another VGAM238 host target gene. LOC131870 BINDING SITE is HOST TARGET binding site found in the 3' untranslated region of mRNA encoded by LOC131870, corresponding to a HOST TARGET binding site such as BINDING SITE I, BINDING SITE II or BINDING SITE III. Table 2 illustrates the complementarity of the nucleotide sequences of LOC131870 BINDING SITE, designated SEQ ID:37014, to the nucleotide sequence of VGAM238 RNA, herein designated VGAM RNA, also designated SEQ ID:2949.

Another function of VGAM238 is therefore inhibition of LOC131870 (Accession XM_059544). Accordingly, utilities of VGAM238 include diagnosis, prevention and treatment of diseases and clinical conditions associated with LOC131870. LOC202018 (Accession XM_114420) is another VGAM238 host target gene. LOC202018 BINDING SITE is HOST TARGET binding site found in the 3' untranslated region of mRNA encoded by LOC202018, corresponding to a HOST TARGET binding site such as BINDING SITE I, BINDING SITE II or BINDING SITE III. Table 2 illustrates the complementarity of the nucleotide sequences of LOC202018 BINDING SITE, designated SEQ ID:42957, to the nucleotide sequence of VGAM238 RNA, herein designated VGAM RNA, also designated SEQ ID:2949.

Another function of VGAM238 is therefore inhibition of LOC202018 (Accession XM_114420). Accordingly, utilities of VGAM238 include diagnosis, prevention and treatment of diseases and clinical conditions associated with LOC202018. FIG. 1 further provides a conceptual description of a novel bioinformatically detected viral gene of the present invention, referred to here as Viral Genomic Address Messenger 239 (VGAM239) viral gene, which modulates expression of respective host target genes thereof, the function and utility of which host target genes is known in the art.

VGAM239 is a novel bioinformatically detected regulatory, non protein coding, viral micro RNA (miRNA) gene. The method by which VGAM239 was detected is described hereinabove with reference to FIGS. 1-8.

VGAM239 gene, herein designated VGAM GENE, is a viral gene contained in the genome of Callitrichine Herpesvirus 3. VGAM239 host target gene, herein designated VGAM HOST TARGET GENE, is a human gene contained in the human genome.

VGAM239 gene encodes a VGAM239 precursor RNA, herein designated VGAM PRECURSOR RNA. Similar to other miRNA genes, and unlike most ordinary genes, VGAM239 precursor RNA does not encode a protein. A nucleotide sequence identical or highly similar to the nucleotide sequence of VGAM239 precursor RNA is designated SEQ ID:225, and is provided hereinbelow with reference to the sequence listing part. Nucleotide sequence SEQ ID:225 is located at position 83602 relative to the genome of Callitrichine Herpesvirus 3.

VGAM239 precursor RNA folds onto itself, forming VGAM239 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM239 folded precursor RNA into VGAM239 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM239 RNA is designated SEQ ID:2950, and is provided hereinbelow with reference to the sequence listing part.

VGAM239 host target gene, herein designated VGAM HOST TARGET GENE, encodes a corresponding messenger RNA, VGAM239 host target RNA, herein designated VGAM HOST TARGET RNA. VGAM239 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM239 RNA, herein designated VGAM RNA, binds complementarily to one or more host target binding sites located in untranslated regions of VGAM239 host target RNA, herein designated VGAM HOST TARGET RNA. This complementary binding is due to the fact that the nucleotide sequence of VGAM239 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM239 RNA, herein designated VGAM RNA, may have a different number of host target binding sites in untranslated regions of a VGAM239 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM239 RNA, herein designated VGAM RNA, to host target binding sites on VGAM239 host target RNA, herein designated VGAM HOST TARGET RNA, such as BINDING SITE I, BINDING SITE II and BINDING SITE III, inhibits translation of VGAM239 host target RNA into VGAM239 host target protein, herein designated VGAM HOST TARGET PROTEIN. VGAM host target protein is therefore outlined by a broken line.

It is appreciated that VGAM239 host target gene, herein designated VGAM HOST TARGET GENE, in fact represents a plurality of VGAM239 host target genes. The mRNA of each one of this plurality of VGAM239 host target genes comprises one or more host target binding sites, each having a nucleotide sequence which is at least partly complementary to VGAM239 RNA, herein designated VGAM RNA, and which when bound by VGAM239 RNA causes inhibition of translation of respective one or more VGAM239 host target proteins.

It is further appreciated by one skilled in the art that the mode of translational inhibition illustrated by FIG. 1 with specific reference to translational inhibition exerted by VGAM239 gene, herein designated VGAM GENE, on one or more VGAM239 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM239 is inhibition of expression of host target genes, as part of a novel viral mechanism of attacking a host. Accordingly, utilities of VGAM239 include diagnosis, prevention and treatment of viral infection by Callitrichine Herpesvirus 3. Specific functions, and accordingly utilities, of VGAM239 correlate with, and may be deduced from, the identity of the host target genes which VGAM239 binds and inhibits, and the function of these host target genes, as elaborated hereinbelow.

Nucleotide sequences of the VGAM239 precursor RNA, herein designated VGAM PRECURSOR RNA, and of the 'diced' VGAM239 RNA, herein designated VGAM RNA, and a schematic representation of the secondary folding of VGAM239 folded precursor RNA, herein designated VGAM FOLDED PRECURSOR RNA, of VGAM239 are further described hereinbelow with reference to Table 1.

Nucleotide sequences of host target binding sites, such as BINDING SITE-I, BINDING SITE-II and BINDING SITE-III of FIG. 1, found on VGAM239 host target RNA, and schematic representation of the complementarity of each of these host target binding sites to VGAM239 RNA, herein designated VGAM RNA, are described hereinbelow with reference to Table 2.

As mentioned hereinabove with reference to FIG. 1, a function of VGAM239 gene, herein designated VGAM is inhibition of expression of VGAM239 target genes. It is appreciated that specific functions, and accordingly utilities, of VGAM239 correlate with, and may be deduced from, the identity of the target genes which VGAM239 binds and inhibits, and the function of these target genes, as elaborated hereinbelow.

Neurocalcin Delta (NCALD, Accession NM_032041) is a VGAM239 host target gene. NCALD BINDING SITE is HOST TARGET binding site found in the 3" untranslated region of mRNA encoded by NCALD, corresponding to a HOST TARGET binding site such as BINDING SITE I, BINDING SITE II or BINDING SITE III. Table 2 illustrates the complementarity of the nucleotide sequences of NCALD BINDING SITE, designated SEQ ID:25741, to the nucleotide sequence of VGAM239 RNA, herein designated VGAM RNA, also designated SEQ ID:2950.

A function of VGAM239 is therefore inhibition of Neurocalcin Delta (NCALD, Accession NM_032041). Accordingly, utilities of VGAM239 include diagnosis, prevention and treatment of diseases and clinical conditions associated with NCALD. Chromosome 20 Open Reading Frame 20 (C20orf20, Accession NM_018270) is another VGAM239 host target gene. C20orf20 BINDING SITE is HOST TARGET binding site found in the 3' untranslated region of mRNA encoded by C20orf20, corresponding to a HOST TARGET binding site such as BINDING SITE I, BINDING SITE II or BINDING SITE III. Table 2 illustrates the complementarity of the nucleotide sequences of C20orf20 BINDING SITE, designated SEQ ID:20243, to the nucleotide sequence of VGAM239 RNA, herein designated VGAM RNA, also designated SEQ ID:2950.

Another function of VGAM239 is therefore inhibition of Chromosome 20 Open Reading Frame 20 (C20orf20, Accession NM_018270). Accordingly, utilities of VGAM239 include diagnosis, prevention and treatment of diseases and clinical conditions associated with C20orf20. DKFZP434I0714 (Accession XM_098247) is another VGAM239 host target gene. DKFZP434I0714 BINDING SITE is HOST TARGET binding site found in the 5' untranslated region of mRNA encoded by DKFZP434I0714, corresponding to a HOST TARGET binding site such as BINDING SITE I, BINDING SITE II or BINDING SITE III. Table 2 illustrates the complementarity of the nucleotide sequences of DKFZP434I0714 BINDING SITE, designated SEQ ID:41527, to the nucleotide sequence of VGAM239 RNA, herein designated VGAM RNA, also designated SEQ ID:2950.

Another function of VGAM239 is therefore inhibition of DKFZP434I0714 (Accession XM_098247). Accordingly, utilities of VGAM239 include diagnosis, prevention and treatment of diseases and clinical conditions associated with DKFZP434I0714. DKFZP564L0862 (Accession NM_024087) is another VGAM239 host target gene. DKFZP564L0862 BINDING SITE is HOST TARGET binding site found in the 5' untranslated region of mRNA encoded by DKFZP564L0862, corresponding to a HOST TARGET binding site such as BINDING SITE I, BINDING SITE II or BINDING SITE III. Table 2 illustrates the complementarity of the nucleotide sequences of DKFZP564L0862 BINDING SITE, designated SEQ ID:23530, to the nucleotide sequence of VGAM239 RNA, herein designated VGAM RNA, also designated SEQ ID:2950.

Another function of VGAM239 is therefore inhibition of DKFZP564L0862 (Accession NM_024087). Accordingly, utilities of VGAM239 include diagnosis, prevention and treatment of diseases and clinical conditions associated with DKFZP564L0862. KIAA1649 (Accession NM_032311) is another VGAM239 host target gene. KIAA1649 BINDING SITE is HOST TARGET binding site found in the 3' untranslated region of mRNA encoded by KIAA1649, corresponding to a HOST TARGET binding site such as BINDING SITE I, BINDING SITE II or BINDING SITE III. Table 2 illustrates the complementarity of the nucleotide sequences of KIAA1649 BINDING SITE, designated SEQ ID:26101, to the nucleotide sequence of VGAM239 RNA, herein designated VGAM RNA, also designated SEQ ID:2950.

Another function of VGAM239 is therefore inhibition of KIAA1649 (Accession NM_032311). Accordingly, utilities of VGAM239 include diagnosis, prevention and treatment of diseases and clinical conditions associated with KIAA1649. PR Domain Containing 15 (PRDM15, Accession XM_029600) is another VGAM239 host target gene. PRDM15 BINDING SITE is HOST TARGET binding site found in the 3' untranslated region of mRNA encoded by PRDM15, corresponding to a HOST TARGET binding site such as BINDING SITE I, BINDING SITE II or BINDING SITE III. Table 2 illustrates the complementarity of the nucleotide sequences of PRDM15 BINDING SITE, designated SEQ ID:30915, to the nucleotide sequence of VGAM239 RNA, herein designated VGAM RNA, also designated SEQ ID:2950.

Another function of VGAM239 is therefore inhibition of PR Domain Containing 15 (PRDM15, Accession XM_029600). Accordingly, utilities of VGAM239 include diagnosis, prevention and treatment of diseases and clinical conditions associated with PRDM15. FIG. 1 further provides a conceptual description of a novel bioinformatically detected viral gene of the present invention, referred to here as Viral Genomic Address Messenger 240 (VGAM240) viral gene, which modulates expression of respective host target genes thereof, the function and utility of which host target genes is known in the art.

VGAM240 is a novel bioinformatically detected regulatory, non protein coding, viral micro RNA (miRNA) gene. The method by which VGAM240 was detected is described hereinabove with reference to FIGS. 1-8.

VGAM240 gene, herein designated VGAM GENE, is a viral gene contained in the genome of Callitrichine Herpesvirus 3. VGAM240 host target gene, herein designated VGAM HOST TARGET GENE, is a human gene contained in the human genome.

VGAM240 gene encodes a VGAM240 precursor RNA, herein designated VGAM PRECURSOR RNA. Similar to other miRNA genes, and unlike most ordinary genes, VGAM240 precursor RNA does not encode a protein. A nucleotide sequence identical or highly similar to the nucleotide sequence of VGAM240 precursor RNA is designated SEQ ID:226, and is provided hereinbelow with reference to the sequence listing part. Nucleotide sequence SEQ ID:226 is located at position 32744 relative to the genome of Callitrichine Herpesvirus 3.

VGAM240 precursor RNA folds onto itself, forming VGAM240 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM240 folded precursor RNA into VGAM240 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM240 RNA is designated SEQ ID:2951, and is provided hereinbelow with reference to the sequence listing part.

VGAM240 host target gene, herein designated VGAM HOST TARGET GENE, encodes a corresponding messenger RNA, VGAM240 host target RNA, herein designated VGAM HOST TARGET RNA. VGAM240 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM240 RNA, herein designated VGAM RNA, binds complementarily to one or more host target binding sites located in untranslated regions of VGAM240 host target RNA, herein designated VGAM HOST TARGET RNA. This complementary binding is due to the fact that the nucleotide sequence of VGAM240 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM240 RNA, herein designated VGAM RNA, may have a different number of host target binding sites in untranslated regions of a VGAM240 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM240 RNA, herein designated VGAM RNA, to host target binding sites on VGAM240 host target RNA, herein designated VGAM HOST TARGET RNA, such as BINDING SITE I, BINDING SITE II and BINDING SITE III, inhibits translation of VGAM240 host target RNA into VGAM240 host target protein, herein designated VGAM HOST TARGET PROTEIN. VGAM host target protein is therefore outlined by a broken line.

It is appreciated that VGAM240 host target gene, herein designated VGAM HOST TARGET GENE, in fact represents a plurality of VGAM240 host target genes. The mRNA of each one of this plurality of VGAM240 host target genes comprises one or more host target binding sites, each having a nucleotide sequence which is at least partly complementary to VGAM240 RNA, herein designated VGAM RNA, and which when bound by VGAM240 RNA causes inhibition of translation of respective one or more VGAM240 host target proteins.

It is further appreciated by one skilled in the art that the mode of translational inhibition illustrated by FIG. 1 with specific reference to translational inhibition exerted by VGAM240 gene, herein designated VGAM GENE, on one or more VGAM240 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM240 is inhibition of expression of host target genes, as part of a novel viral mechanism of attacking a host. Accordingly, utilities of VGAM240 include diagnosis, prevention and treatment of viral infection by Callitrichine Herpesvirus 3. Specific functions, and accordingly utilities, of VGAM240 correlate with, and may be deduced from, the identity of the host target genes which VGAM240 binds and inhibits, and the function of these host target genes, as elaborated hereinbelow.

Nucleotide sequences of the VGAM240 precursor RNA, herein designated VGAM PRECURSOR RNA, and of the 'diced' VGAM240 RNA, herein designated VGAM RNA, and a schematic representation of the secondary folding of VGAM240 folded precursor RNA, herein designated VGAM FOLDED PRECURSOR RNA, of VGAM240 are further described hereinbelow with reference to Table 1.

Nucleotide sequences of host target binding sites, such as BINDING SITE-I, BINDING SITE-II and BINDING SITE-III of FIG. 1, found on VGAM240 host target RNA, and schematic representation of the complementarity of each of these host target binding sites to VGAM240 RNA, herein designated VGAM RNA, are described hereinbelow with reference to Table 2.

As mentioned hereinabove with reference to FIG. 1, a function of VGAM240 gene, herein designated VGAM is inhibition of expression of VGAM240 target genes. It is appreciated that specific functions, and accordingly utilities, of VGAM240 correlate with, and may be deduced from, the identity of the target genes which VGAM240 binds and inhibits, and the function of these target genes, as elaborated hereinbelow.

Cell Matrix Adhesion Regulator (CMAR, Accession NM_005200) is a VGAM240 host target gene. CMAR BINDING SITE is HOST TARGET binding site found in the 5' untranslated region of mRNA encoded by CMAR, corresponding to a HOST TARGET binding site such as BINDING SITE I, BINDING SITE II or BINDING SITE III. Table 2 illustrates the complementarity of the nucleotide sequences of CMAR BINDING SITE, designated SEQ ID:11698, to the nucleotide sequence of VGAM240 RNA, herein designated VGAM RNA, also designated SEQ ID:2951.

A function of VGAM240 is therefore inhibition of Cell Matrix Adhesion Regulator (CMAR, Accession NM_005200). Accordingly, utilities of VGAM240 include diagnosis, prevention and treatment of diseases and clinical conditions associated with CMAR. Dystrophin (muscular dystrophy, Duchenne and Becker types) (DMD, Accession NM_004009) is another VGAM240 host target gene. DMD BINDING SITE1 and DMD BINDING SITE2 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 and DMD BINDING SITE2, designated SEQ ID:10167 and SEQ ID:10173 respectively, to the nucleotide sequence of VGAM240 RNA, herein designated VGAM RNA, also designated SEQ ID:2951.

Another function of VGAM240 is therefore inhibition of Dystrophin (muscular dystrophy, Duchenne and Becker types) (DMD, Accession NM_004009), a gene which muscular dystrophy. Accordingly, utilities of VGAM240 include diagnosis, prevention and treatment of diseases and clinical conditions associated with DMD. The function of DMD and its association with various diseases and clinical conditions, has been established by previous studies, as described hereinabove with reference to VGAM218. MGC22014 (Accession XM_035307) is another VGAM240 host target gene. MGC22014 BINDING SITE is HOST TARGET binding site found in the 3' untranslated region of mRNA encoded by MGC22014, corresponding to a HOST TARGET binding site such as BINDING SITE I, BINDING SITE II or BINDING SITE III. Table 2 illustrates the complementarity of the nucleotide sequences of MGC22014 BINDING SITE, designated SEQ ID:32223, to the nucleotide sequence of VGAM240 RNA, herein designated VGAM RNA, also designated SEQ ID:2951.

Another function of VGAM240 is therefore inhibition of MGC22014 (Accession XM_035307). Accordingly, utilities of VGAM240 include diagnosis, prevention and treatment of diseases and clinical conditions associated with MGC22014. Serum/glucocorticoid Regulated Kinase-like (SGKL, Accession NM_013257) is another VGAM240 host target gene. SGKL BINDING SITE is HOST TARGET binding site found in the 3' untranslated region of mRNA encoded by SGKL, corresponding to a HOST TARGET binding site such as BINDING SITE I, BINDING SITE II or BINDING SITE III. Table 2 illustrates the complementarity of the nucleotide sequences of SGKL BINDING SITE, designated SEQ ID:14929, to the nucleotide sequence of VGAM240 RNA, herein designated VGAM RNA, also designated SEQ ID:2951.

Another function of VGAM240 is therefore inhibition of Serum/glucocorticoid Regulated Kinase-like (SGKL, Accession NM_013257). Accordingly, utilities of VGAM240 include diagnosis, prevention and treatment of diseases and clinical conditions associated with SGKL. FIG. 1 further provides a conceptual description of a novel bioinformatically detected viral gene of the present invention, referred to here as Viral Genomic Address Messenger 241 (VGAM241) viral gene, which modulates expression of respective host target genes thereof, the function and utility of which host target genes is known in the art.

VGAM241 is a novel bioinformatically detected regulatory, non protein coding, viral micro RNA (miRNA) gene. The method by which VGAM241 was detected is described hereinabove with reference to FIGS. 1-8.

VGAM241 gene, herein designated VGAM GENE, is a viral gene contained in the genome of Callitrichine Herpesvirus 3. VGAM241 host target gene, herein designated VGAM HOST TARGET GENE, is a human gene contained in the human genome.

VGAM241 gene encodes a VGAM241 precursor RNA, herein designated VGAM PRECURSOR RNA. Similar to other miRNA genes, and unlike most ordinary genes, VGAM241 precursor RNA does not encode a protein. A nucleotide sequence identical or highly similar to the nucleotide sequence of VGAM241 precursor RNA is designated SEQ ID:227, and is provided hereinbelow with reference to the sequence listing part. Nucleotide sequence SEQ ID:227 is located at position 21896 relative to the genome of Callitrichine Herpesvirus 3.

VGAM241 precursor RNA folds onto itself, forming VGAM241 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM241 folded precursor RNA into VGAM241 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM241 RNA is designated SEQ ID:2952, and is provided hereinbelow with reference to the sequence listing part.

VGAM241 host target gene, herein designated VGAM HOST TARGET GENE, encodes a corresponding messenger RNA, VGAM241 host target RNA, herein designated VGAM HOST TARGET RNA. VGAM241 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM241 RNA, herein designated VGAM RNA, binds complementarily to one or more host target binding sites located in untranslated regions of VGAM241 host target RNA, herein designated VGAM HOST TARGET RNA. This complementary binding is due to the fact that the nucleotide sequence of VGAM241 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM241 RNA, herein designated VGAM RNA, may have a different number of host target binding sites in untranslated regions of a VGAM241 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM241 RNA, herein designated VGAM RNA, to host target binding sites on VGAM241 host target RNA, herein designated VGAM HOST TARGET RNA, such as BINDING SITE I, BINDING SITE II and BINDING SITE III, inhibits translation of VGAM241 host target RNA into VGAM241 host target protein, herein designated VGAM HOST TARGET PROTEIN. VGAM host target protein is therefore outlined by a broken line.

It is appreciated that VGAM241 host target gene, herein designated VGAM HOST TARGET GENE, in fact represents a plurality of VGAM241 host target genes. The mRNA of each one of this plurality of VGAM241 host target genes comprises one or more host target binding sites, each having a nucleotide sequence which is at least partly complementary to VGAM241 RNA, herein designated VGAM RNA, and which when bound by VGAM241 RNA causes inhibition of translation of respective one or more VGAM241 host target proteins.

It is further appreciated by one skilled in the art that the mode of translational inhibition illustrated by FIG. 1 with specific reference to translational inhibition exerted by VGAM241 gene, herein designated VGAM GENE, on one or more VGAM241 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM241 is inhibition of expression of host target genes, as part of a novel viral mechanism of attacking a host. Accordingly, utilities of VGAM241 include diagnosis, prevention and treatment of viral infection by Callitrichine Herpesvirus 3. Specific functions, and accordingly utilities, of VGAM241 correlate with, and may be deduced from, the identity of the host target genes which VGAM241 binds and inhibits, and the function of these host target genes, as elaborated hereinbelow.

Nucleotide sequences of the VGAM241 precursor RNA, herein designated VGAM PRECURSOR RNA, and of the 'diced' VGAM241 RNA, herein designated VGAM RNA, and a schematic representation of the secondary folding of VGAM241 folded precursor RNA, herein designated VGAM FOLDED PRECURSOR RNA, of VGAM241 are further described hereinbelow with reference to Table 1.

Nucleotide sequences of host target binding sites, such as BINDING SITE-I, BINDING SITE-II and BINDING SITE-III of FIG. 1, found on VGAM241 host target RNA, and schematic representation of the complementarity of each of these host target binding sites to VGAM241 RNA, herein designated VGAM RNA, are described hereinbelow with reference to Table 2.

As mentioned hereinabove with reference to FIG. 1, a function of VGAM241 gene, herein designated VGAM is inhibition of expression of VGAM241 target genes. It is appreciated that specific functions, and accordingly utilities, of VGAM241 correlate with, and may be deduced from, the identity of the target genes which VGAM241 binds and inhibits, and the function of these target genes, as elaborated hereinbelow.

Cystinosis, Nephropathic (CTNS, Accession NM_004937) is a VGAM241 host target gene. CTNS BINDING SITE is HOST TARGET binding site found in the 3' untranslated region of mRNA encoded by CTNS, corresponding to a HOST TARGET binding site such as BINDING SITE I, BINDING SITE II or BINDING SITE III. Table 2 illustrates the complementarity of the nucleotide sequences of CTNS BINDING SITE, designated SEQ ID:11381, to the nucleotide sequence of VGAM241 RNA, herein designated VGAM RNA, also designated SEQ ID:2952.

A function of VGAM241 is therefore inhibition of Cystinosis, Nephropathic (CTNS, Accession NM_004937). Accordingly, utilities of VGAM241 include diagnosis, prevention and treatment of diseases and clinical conditions associated with CTNS. RAS Guanyl Releasing Protein 1 (calcium and DAG-regulated) (RASGRP1, Accession NM_005739) is another VGAM241 host target gene. RASGRP1 BINDING SITE is HOST TARGET binding site found in the 3' untranslated region of mRNA encoded by RASGRP1, corresponding to a HOST TARGET binding site such as BINDING SITE I, BINDING SITE II or BINDING SITE III. Table 2 illustrates the complementarity of the nucleotide sequences of RASGRP1 BINDING SITE, designated SEQ ID:12300, to the nucleotide sequence of VGAM241 RNA, herein designated VGAM RNA, also designated SEQ ID:2952.

Another function of VGAM241 is therefore inhibition of RAS Guanyl Releasing Protein 1 (calcium and DAG-regulated) (RASGRP1, Accession NM_005739). Accordingly, utilities of VGAM241 include diagnosis, prevention and treatment of diseases and clinical conditions associated with RASGRP1. X-ray Repair Complementing Defective Repair In Chinese Hamster Cells 2 (XRCC2, Accession NM_005431) is another VGAM241 host target gene. XRCC2 BINDING SITE is HOST TARGET binding site found in the 3' untranslated region of mRNA encoded by XRCC2, corresponding to a HOST TARGET binding site such as BINDING SITE I, BINDING SITE II or BINDING SITE III. Table 2 illustrates the complementarity of the nucleotide sequences of XRCC2 BINDING SITE, designated SEQ ID:11899, to the nucleotide sequence of VGAM241 RNA, herein designated VGAM RNA, also designated SEQ ID:2952.

Another function of VGAM241 is therefore inhibition of X-ray Repair Complementing Defective Repair In Chinese Hamster Cells 2 (XRCC2, Accession NM_005431), a gene which involves in the homologous recombination repair (hrr) pathway of double-stranded dna. Accordingly, utilities of VGAM241 include diagnosis, prevention and treatment of diseases and clinical conditions associated with XRCC2. The function of XRCC2 has been established by previous studies. Johnson et al. (1999) demonstrated that XRCC2 is essential for the efficient repair of DNA double-strand breaks by homologous recombination between sister chromatids. Hamster cells deficient in XRCC2 showed a more than 100-fold decrease in homologous recombination induced by double-strand breaks compared with the parental cell line. This defect was corrected to almost wildtype levels by transient transfection with a plasmid expressing XRCC2. The repair defect in XRCC2 mutant cells appeared to be restricted to recombinational repair because nonhomologous end joining was normal. Johnson et al. (1999) concluded that XRCC2 is involved in the repair of DNA double-strand breaks by homologous recombination. Using a yeast 2-hybrid assay, Braybrooke et al. (2000) identified a direct interaction between XRCC2 and RAD51L3 (OMIM Ref. No. 602954), and they confirmed the interaction by pull-down assays between recombinant XRCC2 and endogenous RAD51L3 in HeLa cell extracts. Size-exclusion chromatography followed by Western blot analysis suggested that the 2 proteins exist as a heterodimer of about 70 kD.

Full details of the abovementioned studies are described in the following publications, the disclosure of which are hereby incorporated by reference:

Johnson, R. D.; Liu, N.; Jasin, M.: Mammalian XRCC2 promotes the repair of DNA double-strand breaks by homologous recombination. Nature 401:397-399, 1999; and Braybrooke, J. P.; Spink, K. G.; Thacker, J.; Hickson, I. D.: The RAD51 family member, RAD51L3, is a DNA-stimulated ATPase that forms a complex with XRCC2. J. Biol. Chem. 275:29100-29.

Further studies establishing the function and utilities of XRCC2 are found in John Hopkins OMIM database record ID 600375, and in sited publications numbered 1597-1605 listed in the bibliography section hereinbelow, which are also hereby incorporated by reference. DKFZP434O047 (Accession NM_015594) is another VGAM241 host target gene. DKFZP434O047 BINDING SITE is HOST TARGET binding site found in the 5' untranslated region of mRNA encoded by DKFZP434O047, corresponding to a HOST TARGET binding site such as BINDING SITE I, BINDING SITE II or BINDING SITE III. Table 2 illustrates the complementarity of the nucleotide sequences of DKFZP434O047 BINDING SITE, designated SEQ ID:17858, to the nucleotide sequence of VGAM241 RNA, herein designated VGAM RNA, also designated SEQ ID:2952.

Another function of VGAM241 is therefore inhibition of DKFZP434O047 (Accession NM_015594). Accordingly, utilities of VGAM241 include diagnosis, prevention and treatment of diseases and clinical conditions associated with DKFZP434O047. F-box Only Protein 9 (FBXO9, Accession NM_033480) is another VGAM241 host target gene. FBXO9 BINDING SITE is HOST TARGET binding site found in the 3' untranslated region of mRNA encoded by FBXO9, corresponding to a HOST TARGET binding site such as BINDING SITE I, BINDING SITE II or BINDING SITE III. Table 2 illustrates the complementarity of the nucleotide sequences of FBXO9 BINDING SITE, designated SEQ ID:27259, to the nucleotide sequence of VGAM241 RNA, herein designated VGAM RNA, also designated SEQ ID:2952.

Another function of VGAM241 is therefore inhibition of F-box Only Protein 9 (FBXO9, Accession NM_033480). Accordingly, utilities of VGAM241 include diagnosis, prevention and treatment of diseases and clinical conditions associated with FBXO9. FLJ21940 (Accession NM_022828) is another VGAM241 host target gene. FLJ21940 BINDING SITE is HOST TARGET binding site found in the 3' untranslated region of mRNA encoded by FLJ21940, corresponding to a HOST TARGET binding site such as BINDING SITE I, BINDING SITE II or BINDING SITE III. Table 2 illustrates the complementarity of the nucleotide sequences of FLJ21940 BINDING SITE, designated SEQ ID:23106, to the nucleotide sequence of VGAM241 RNA, herein designated VGAM RNA, also designated SEQ ID:2952.

Another function of VGAM241 is therefore inhibition of FLJ21940 (Accession NM_022828). Accordingly, utilities of VGAM241 include diagnosis, prevention and treatment of diseases and clinical conditions associated with FLJ21940. FLJ22031 (Accession NM_025074) is another VGAM241 host target gene. FLJ22031 BINDING SITE is HOST TARGET binding site found in the 3' untranslated region of mRNA encoded by FLJ22031, corresponding to a HOST TARGET binding site such as BINDING SITE I, BINDING SITE II or BINDING SITE III. Table 2 illustrates the complementarity of the nucleotide sequences of FLJ22031 BINDING SITE, designated SEQ ID:24675, to the nucleotide sequence of VGAM241 RNA, herein designated VGAM RNA, also designated SEQ ID:2952.

Another function of VGAM241 is therefore inhibition of FLJ22031 (Accession NM_025074). Accordingly, utilities of VGAM241 include diagnosis, prevention and treatment of diseases and clinical conditions associated with FLJ22031. Interferon Regulatory Factor 7 (IRF7, Accession NM_004030) is another VGAM241 host target gene. IRF7 BINDING SITE1 through IRF7 BINDING SITE4 are HOST TARGET binding sites found in untranslated regions of mRNA encoded by IRF7, corresponding to HOST TARGET binding sites such as BINDING SITE I, BINDING SITE II or BINDING SITE III. Table 2 illustrates the complementarity of the nucleotide sequences of IRF7 BINDING SITE1 through IRF7 BINDING SITE4, designated SEQ ID:10250, SEQ ID:7302, SEQ ID:10252 and SEQ ID:10248 respectively, to the nucleotide sequence of VGAM241 RNA, herein designated VGAM RNA, also designated SEQ ID:2952.

Another function of VGAM241 is therefore inhibition of Interferon Regulatory Factor 7 (IRF7, Accession NM_004030). Accordingly, utilities of VGAM241 include diagnosis, prevention and treatment of diseases and clinical conditions associated with IRF7. KIAA1431 (Accession XM_032055) is another VGAM241 host target gene. KIAA1431 BINDING SITE is HOST TARGET binding site found in the 3' untranslated region of mRNA encoded by KIAA1431, corresponding to a HOST TARGET binding site such as BINDING SITE I, BINDING SITE II or BINDING SITE III. Table 2 illustrates the complementarity of the nucleotide sequences of KIAA1431 BINDING SITE, designated SEQ ID:31550, to the nucleotide sequence of VGAM241 RNA, herein designated VGAM RNA, also designated SEQ ID:2952.

Another function of VGAM241 is therefore inhibition of KIAA1431 (Accession XM_032055). Accordingly, utilities of VGAM241 include diagnosis, prevention and treatment of diseases and clinical conditions associated with KIAA1431. PP1628 (Accession NM_025201) is another VGAM241 host target gene. PP1628 BINDING SITE is HOST TARGET binding site found in the 3' untranslated region of mRNA encoded by PP1628, corresponding to a HOST TARGET binding site such as BINDING SITE I, BINDING SITE II or BINDING SITE III. Table 2 illustrates the complementarity of the nucleotide sequences of PP1628 BINDING SITE, designated SEQ ID:24854, to the nucleotide sequence of VGAM241 RNA, herein designated VGAM RNA, also designated SEQ ID:2952.

Another function of VGAM241 is therefore inhibition of PP1628 (Accession NM_025201). Accordingly, utilities of VGAM241 include diagnosis, prevention and treatment of diseases and clinical conditions associated with PP1628. QKI (Accession XM_037438) is another VGAM241 host target gene. QKI BINDING SITE is HOST TARGET binding site found in the 3' untranslated region of mRNA encoded by QKI, corresponding to a HOST TARGET binding site such as BINDING SITE I, BINDING SITE II or BINDING SITE III. Table 2 illustrates the complementarity of the nucleotide sequences of QKI BINDING SITE, designated SEQ ID:32615, to the nucleotide sequence of VGAM241 RNA, herein designated VGAM RNA, also designated SEQ ID:2952.

Another function of VGAM241 is therefore inhibition of QKI (Accession XM_037438). Accordingly, utilities of VGAM241 include diagnosis, prevention and treatment of diseases and clinical conditions associated with QKI. Serologically Defined Colon Cancer Antigen 33 (SDCCAG33, Accession NM_005786) is another VGAM241 host target gene. SDCCAG33 BINDING SITE is HOST TARGET binding site found in the 5' untranslated region of mRNA encoded by SDCCAG33, corresponding to a HOST TARGET binding site such as BINDING SITE I, BINDING SITE II or BINDING SITE III. Table 2 illustrates the complementarity of the nucleotide sequences of SDCCAG33 BINDING SITE, designated SEQ ID:12369, to the nucleotide sequence of VGAM241 RNA, herein designated VGAM RNA, also designated SEQ ID:2952.

Another function of VGAM241 is therefore inhibition of Serologically Defined Colon Cancer Antigen 33 (SDCCAG33, Accession NM_005786). Accordingly, utilities of VGAM241 include diagnosis, prevention and treatment of diseases and clinical conditions associated with SDCCAG33. Syntaphilin (SNPH, Accession NM_014723) is another VGAM241 host target gene. SNPH BINDING SITE is HOST TARGET binding site found in the 3' untranslated region of mRNA encoded by SNPH, corresponding to a HOST TARGET binding site such as BINDING SITE I, BINDING SITE II or BINDING SITE III. Table 2 illustrates the complementarity of the nucleotide sequences of SNPH BINDING SITE, designated SEQ ID:16300, to the nucleotide sequence of VGAM241 RNA, herein designated VGAM RNA, also designated SEQ ID:2952.

Another function of VGAM241 is therefore inhibition of Syntaphilin (SNPH, Accession NM_014723). Accordingly, utilities of VGAM241 include diagnosis, prevention and treatment of diseases and clinical conditions associated with SNPH. LOC145644 (Accession XM_035608) is another VGAM241 host target gene. LOC145644 BINDING SITE is HOST TARGET binding site found in the 5' untranslated region of mRNA encoded by LOC145644, corresponding to a HOST TARGET binding site such as BINDING SITE I, BINDING SITE II or BINDING SITE III. Table 2 illustrates the complementarity of the nucleotide sequences of LOC145644 BINDING SITE, designated SEQ ID:32288, to the nucleotide sequence of VGAM241 RNA, herein designated VGAM RNA, also designated SEQ ID:2952.

Another function of VGAM241 is therefore inhibition of LOC145644 (Accession XM_035608). Accordingly, utilities of VGAM241 include diagnosis, prevention and treatment of diseases and clinical conditions associated with LOC145644.

FIG. 1 further provides a conceptual description of a novel bioinformatically detected viral gene of the present invention, referred to here as Viral Genomic Address Messenger 242 (VGAM242) viral gene, which modulates expression of respective host target genes thereof, the function and utility of which host target genes is known in the art.

VGAM242 is a novel bioinformatically detected regulatory, non protein coding, viral micro RNA (miRNA) gene. The method by which VGAM242 was detected is described hereinabove with reference to FIGS. 1-8.

VGAM242 gene, herein designated VGAM GENE, is a viral gene contained in the genome of Callitrichine Herpesvirus 3. VGAM242 host target gene, herein designated VGAM HOST TARGET GENE, is a human gene contained in the human genome.

VGAM242 gene encodes a VGAM242 precursor RNA, herein designated VGAM PRECURSOR RNA. Similar to other miRNA genes, and unlike most ordinary genes, VGAM242 precursor RNA does not encode a protein. A nucleotide sequence identical or highly similar to the nucleotide sequence of VGAM242 precursor RNA is designated SEQ ID:228, and is provided hereinbelow with reference to the sequence listing part. Nucleotide sequence SEQ ID:228 is located at position 102669 relative to the genome of Callitrichine Herpesvirus 3.

VGAM242 precursor RNA folds onto itself, forming VGAM242 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM242 folded precursor RNA into VGAM242 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM242 RNA is designated SEQ ID:2953, and is provided hereinbelow with reference to the sequence listing part.

VGAM242 host target gene, herein designated VGAM HOST TARGET GENE, encodes a corresponding messenger RNA, VGAM242 host target RNA, herein designated VGAM HOST TARGET RNA. VGAM242 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM242 RNA, herein designated VGAM RNA, binds complementarily to one or more host target binding sites located in untranslated regions of VGAM242 host target RNA, herein designated VGAM HOST TARGET RNA. This complementary binding is due to the fact that the nucleotide sequence of VGAM242 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM242 RNA, herein designated VGAM RNA, may have a different number of host target binding sites in untranslated regions of a VGAM242 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM242 RNA, herein designated VGAM RNA, to host target binding sites on VGAM242 host target RNA, herein designated VGAM HOST TARGET RNA, such as BINDING SITE I, BINDING SITE II and BINDING SITE III, inhibits translation of VGAM242 host target RNA into VGAM242 host target protein, herein designated VGAM HOST TARGET PROTEIN. VGAM host target protein is therefore outlined by a broken line.

It is appreciated that VGAM242 host target gene, herein designated VGAM HOST TARGET GENE, in fact represents a plurality of VGAM242 host target genes. The mRNA of each one of this plurality of VGAM242 host target genes comprises one or more host target binding sites, each having a nucleotide sequence which is at least partly complementary to VGAM242 RNA, herein designated VGAM RNA, and which when bound by VGAM242 RNA causes inhibition of translation of respective one or more VGAM242 host target proteins.

It is further appreciated by one skilled in the art that the mode of translational inhibition illustrated by FIG. 1 with specific reference to translational inhibition exerted by VGAM242 gene, herein designated VGAM GENE, on one or more VGAM242 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM242 is inhibition of expression of host target genes, as part of a novel viral mechanism of attacking a host. Accordingly, utilities of VGAM242 include diagnosis, prevention and treatment of viral infection by Callitrichine Herpesvirus 3. Specific functions, and accordingly utilities, of VGAM242 correlate with, and may be deduced from, the identity of the host target genes which VGAM242 binds and inhibits, and the function of these host target genes, as elaborated hereinbelow.

Nucleotide sequences of the VGAM242 precursor RNA, herein designated VGAM PRECURSOR RNA, and of the 'diced' VGAM242 RNA, herein designated VGAM RNA, and a schematic representation of the secondary folding of VGAM242 folded precursor RNA, herein designated VGAM FOLDED PRECURSOR RNA, of VGAM242 are further described hereinbelow with reference to Table 1.

Nucleotide sequences of host target binding sites, such as BINDING SITE-I, BINDING SITE-II and BINDING SITE-III of FIG. 1, found on VGAM242 host target RNA, and schematic representation of the complementarity of each of these host target binding sites to VGAM242 RNA, herein designated VGAM RNA, are described hereinbelow with reference to Table 2.

As mentioned hereinabove with reference to FIG. 1, a function of VGAM242 gene, herein designated VGAM is inhibition of expression of VGAM242 target genes. It is appreciated that specific functions, and accordingly utilities, of VGAM242 correlate with, and may be deduced from, the identity of the target genes which VGAM242 binds and inhibits, and the function of these target genes, as elaborated hereinbelow.

Adenylate Cyclase 6 (ADCY6, Accession NM_015270) is a VGAM242 host target gene. ADCY6 BINDING SITE1 and ADCY6 BINDING SITE2 are HOST TARGET binding sites found in untranslated regions of mRNA encoded by ADCY6, corresponding to HOST TARGET binding sites such as BINDING SITE I, BINDING SITE II or BINDING SITE III. Table 2 illustrates the complementarity of the nucleotide sequences of ADCY6 BINDING SITE1 and ADCY6 BINDING SITE2, designated SEQ ID:17587 and SEQ ID:21975 respectively, to the nucleotide sequence of VGAM242 RNA, herein designated VGAM RNA, also designated SEQ ID:2953.

A function of VGAM242 is therefore inhibition of Adenylate Cyclase 6 (ADCY6, Accession NM_015270), a gene which this a membrane-bound, ca (2+)-inhibitable adenylyl cyclase (by similarity). Accordingly, utilities of VGAM242 include diagnosis, prevention and treatment of diseases and clinical conditions associated with ADCY6. The function of ADCY6 and its association with various diseases and clinical conditions, has been established by previous studies, as described hereinabove with reference to VGAM22. Frizzled Homolog 10 (Drosophila) (FZD10, Accession NM_007197) is another VGAM242 host target gene. FZD10 BINDING SITE is HOST TARGET binding site found in the 3' untranslated region of mRNA encoded by FZD10, corresponding to a HOST TARGET binding site such as BINDING SITE I, BINDING SITE II or BINDING SITE III. Table 2 illustrates the complementarity of the nucleotide sequences of FZD10 BINDING SITE, designated SEQ ID:14051, to the nucleotide sequence of VGAM242 RNA, herein designated VGAM RNA, also designated SEQ ID:2953.

Another function of VGAM242 is therefore inhibition of Frizzled Homolog 10 (Drosophila) (FZD10, Accession NM_007197). Accordingly, utilities of VGAM242 include diagnosis, prevention and treatment of diseases and clinical conditions associated with FZD10. Homeo Box C4 (HOXC4, Accession NM_014620) is another VGAM242 host target gene. HOXC4 BINDING SITE is HOST TARGET binding site found in the 5' untranslated region of mRNA encoded by HOXC4, corresponding to a HOST TARGET binding site such as BINDING SITE I, BINDING SITE II or BINDING SITE III. Table 2 illustrates the complementarity of the nucleotide sequences of HOXC4 BINDING SITE, designated SEQ ID:15973, to the nucleotide sequence of VGAM242 RNA, herein designated VGAM RNA, also designated SEQ ID:2953.

Another function of VGAM242 is therefore inhibition of Homeo Box C4 (HOXC4, Accession NM_014620), a gene which is part of a developmental regulatory system that provides cells with specific positional identities on the anterior-posterior axis. Accordingly, utilities of VGAM242 include diagnosis, prevention and treatment of diseases and clinical conditions associated with HOXC4. The function of HOXC4 and its association with various diseases and clinical conditions, has been established by previous studies, as described hereinabove with reference to VGAM206. DnaJ (Hsp40) Homolog, Subfamily B, Member 5 (DNAJB5, Accession NM_012266) is another VGAM242 host target gene. DNAJB5 BINDING SITE is HOST TARGET binding site found in the 3' untranslated region of mRNA encoded by DNAJB5, corresponding to a HOST TARGET binding site such as BINDING SITE I, BINDING SITE II or BINDING SITE III. Table 2 illustrates the complementarity of the nucleotide sequences of DNAJB5 BINDING SITE, designated SEQ ID:14588, to the nucleotide sequence of VGAM242 RNA, herein designated VGAM RNA, also designated SEQ ID:2953.

Another function of VGAM242 is therefore inhibition of DnaJ (Hsp40) Homolog, Subfamily B, Member 5 (DNAJB5, Accession NM_012266). Accordingly, utilities of VGAM242 include diagnosis, prevention and treatment of diseases and clinical conditions associated with DNAJB5. DRIL2 (Accession NM_006465) is another VGAM242 host target gene. DRIL2 BINDING SITE is HOST TARGET binding site found in the 3' untranslated region of mRNA encoded by DRIL2, corresponding to a HOST TARGET binding site such as BINDING SITE I, BINDING SITE II or BINDING SITE III. Table 2 illustrates the complementarity of the nucleotide sequences of DRIL2 BINDING SITE, designated SEQ ID:13185, to the nucleotide sequence of VGAM242 RNA, herein designated VGAM RNA, also designated SEQ ID:2953.

Another function of VGAM242 is therefore inhibition of DRIL2 (Accession NM_006465). Accordingly, utilities of VGAM242 include diagnosis, prevention and treatment of diseases and clinical conditions associated with DRIL2. KIAA0418 (Accession NM_014631) is another VGAM242 host target gene. KIAA0418 BINDING SITE is HOST TARGET binding site found in the 3' untranslated region of mRNA encoded by KIAA0418, corresponding to a HOST TARGET binding site such as BINDING SITE I, BINDING SITE II or BINDING SITE III. Table 2 illustrates the complementarity of the nucleotide sequences of KIAA0418 BINDING SITE, designated SEQ ID:15996, to the nucleotide sequence of VGAM242 RNA, herein designated VGAM RNA, also designated SEQ ID:2953.

Another function of VGAM242 is therefore inhibition of KIAA0418 (Accession NM_014631). Accordingly, utilities of VGAM242 include diagnosis, prevention and treatment of diseases and clinical conditions associated with KIAA0418. Phosphatidylinositol-4-phosphate 5-kinase, Type II, Beta (PIP5K2B, Accession NM_003559) is another VGAM242 host target gene. PIP5K2B BINDING SITE1 and PIP5K2B BINDING SITE2 are HOST TARGET binding sites found in untranslated regions of mRNA encoded by PIP5K2B, corresponding to HOST TARGET binding sites such as BINDING SITE I, BINDING SITE II or BINDING SITE III. Table 2 illustrates the complementarity of the nucleotide sequences of PIP5K2B BINDING SITE1 and PIP5K2B BINDING SITE2, designated SEQ ID:9608 and SEQ ID:9609 respectively, to the nucleotide sequence of VGAM242 RNA, herein designated VGAM RNA, also designated SEQ ID:2953.

Another function of VGAM242 is therefore inhibition of Phosphatidylinositol-4-phosphate 5-kinase, Type II, Beta (PIP5K2B, Accession NM_003559). Accordingly, utilities of VGAM242 include diagnosis, prevention and treatment of diseases and clinical conditions associated with PIP5K2B. Retinoic Acid Induced 15 (RAI15, Accession XM_039548) is another VGAM242 host target gene. RAI15 BINDING SITE is HOST TARGET binding site found in the 3' untranslated region of mRNA encoded by RAI15, corresponding to a HOST TARGET binding site such as BINDING SITE I, BINDING SITE II or BINDING SITE III. Table 2 illustrates the complementarity of the nucleotide sequences of RAI15

BINDING SITE, designated SEQ ID:33118, to the nucleotide sequence of VGAM242 RNA, herein designated VGAM RNA, also designated SEQ ID:2953.

Another function of VGAM242 is therefore inhibition of Retinoic Acid Induced 15 (RAI15, Accession XM_039548). Accordingly, utilities of VGAM242 include diagnosis, prevention and treatment of diseases and clinical conditions associated with RAI15. SEC14-like 2 (S. cerevisiae) (SEC14L2, Accession NM_012429) is another VGAM242 host target gene. SEC14L2 BINDING SITE is HOST TARGET binding site found in the 5' untranslated region of mRNA encoded by SEC14L2, corresponding to a HOST TARGET binding site such as BINDING SITE I, BINDING SITE II or BINDING SITE III. Table 2 illustrates the complementarity of the nucleotide sequences of SEC14L2 BINDING SITE, designated SEQ ID:14805, to the nucleotide sequence of VGAM242 RNA, herein designated VGAM RNA, also designated SEQ ID:2953.

Another function of VGAM242 is therefore inhibition of SEC14-like 2 (S. cerevisiae) (SEC14L2, Accession NM_012429). Accordingly, utilities of VGAM242 include diagnosis, prevention and treatment of diseases and clinical conditions associated with SEC14L2. LOC127534 (Accession XM_060532) is another VGAM242 host target gene. LOC127534 BINDING SITE is HOST TARGET binding site found in the 3' untranslated region of mRNA encoded by LOC127534, corresponding to a HOST TARGET binding site such as BINDING SITE I, BINDING SITE II or BINDING SITE III. Table 2 illustrates the complementarity of the nucleotide sequences of LOC127534 BINDING SITE, designated SEQ ID:37167, to the nucleotide sequence of VGAM242 RNA, herein designated VGAM RNA, also designated SEQ ID:2953.

Another function of VGAM242 is therefore inhibition of LOC127534 (Accession XM_060532). Accordingly, utilities of VGAM242 include diagnosis, prevention and treatment of diseases and clinical conditions associated with LOC127534. LOC143916 (Accession XM_084664) is another VGAM242 host target gene. LOC143916 BINDING SITE is HOST TARGET binding site found in the 3' untranslated region of mRNA encoded by LOC143916, corresponding to a HOST TARGET binding site such as BINDING SITE I, BINDING SITE II or BINDING SITE III. Table 2 illustrates the complementarity of the nucleotide sequences of LOC143916 BINDING SITE, designated SEQ ID:37650, to the nucleotide sequence of VGAM242 RNA, herein designated VGAM RNA, also designated SEQ ID:2953.

Another function of VGAM242 is therefore inhibition of LOC143916 (Accession XM_084664). Accordingly, utilities of VGAM242 include diagnosis, prevention and treatment of diseases and clinical conditions associated with LOC143916. LOC253917 (Accession XM_171832) is another VGAM242 host target gene. LOC253917 BINDING SITE is HOST TARGET binding site found in the 5' untranslated region of mRNA encoded by LOC253917, corresponding to a HOST TARGET binding site such as BINDING SITE I, BINDING SITE II or BINDING SITE III. Table 2 illustrates the complementarity of the nucleotide sequences of LOC253917 BINDING SITE, designated SEQ ID:46065, to the nucleotide sequence of VGAM242 RNA, herein designated VGAM RNA, also designated SEQ ID:2953.

Another function of VGAM242 is therefore inhibition of LOC253917 (Accession XM_171832). Accordingly, utilities of VGAM242 include diagnosis, prevention and treatment of diseases and clinical conditions associated with LOC253917. LOC92568 (Accession XM_045852) is another VGAM242 host target gene. LOC92568 BINDING SITE is HOST TARGET binding site found in the 3' untranslated region of mRNA encoded by LOC92568, corresponding to a HOST TARGET binding site such as BINDING SITE I, BINDING SITE II or BINDING SITE III. Table 2 illustrates the complementarity of the nucleotide sequences of LOC92568 BINDING SITE, designated SEQ ID:34577, to the nucleotide sequence of VGAM242 RNA, herein designated VGAM RNA, also designated SEQ ID:2953.

Another function of VGAM242 is therefore inhibition of LOC92568 (Accession XM_045852). Accordingly, utilities of VGAM242 include diagnosis, prevention and treatment of diseases and clinical conditions associated with LOC92568. LOC93589 (Accession XM_052387) is another VGAM242 host target gene. LOC93589 BINDING SITE is HOST TARGET binding site found in the 3' untranslated region of mRNA encoded by LOC93589, corresponding to a HOST TARGET binding site such as BINDING SITE I, BINDING SITE II or BINDING SITE III. Table 2 illustrates the complementarity of the nucleotide sequences of LOC93589 BINDING SITE, designated SEQ ID:35978, to the nucleotide sequence of VGAM242 RNA, herein designated VGAM RNA, also designated SEQ ID:2953.

Another function of VGAM242 is therefore inhibition of LOC93589 (Accession XM_052387). Accordingly, utilities of VGAM242 include diagnosis, prevention and treatment of diseases and clinical conditions associated with LOC93589. FIG. 1 further provides a conceptual description of a novel bioinformatically detected viral gene of the present invention, referred to here as Viral Genomic Address Messenger 243 (VGAM243) viral gene, which modulates expression of respective host target genes thereof, the function and utility of which host target genes is known in the art.

VGAM243 is a novel bioinformatically detected regulatory, non protein coding, viral micro RNA (miRNA) gene. The method by which VGAM243 was detected is described hereinabove with reference to FIGS. 1-8.

VGAM243 gene, herein designated VGAM GENE, is a viral gene contained in the genome of Callitrichine Herpesvirus 3. VGAM243 host target gene, herein designated VGAM HOST TARGET GENE, is a human gene contained in the human genome.

VGAM243 gene encodes a VGAM243 precursor RNA, herein designated VGAM PRECURSOR RNA. Similar to other miRNA genes, and unlike most ordinary genes, VGAM243 precursor RNA does not encode a protein. A nucleotide sequence identical or highly similar to the nucleotide sequence of VGAM243 precursor RNA is designated SEQ ID:229, and is provided hereinbelow with reference to the sequence listing part. Nucleotide sequence SEQ ID:229 is located at position 30312 relative to the genome of Callitrichine Herpesvirus 3.

VGAM243 precursor RNA folds onto itself, forming VGAM243 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM243 folded precursor RNA into VGAM243 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM243 RNA is designated SEQ ID:2954, and is provided hereinbelow with reference to the sequence listing part.

VGAM243 host target gene, herein designated VGAM HOST TARGET GENE, encodes a corresponding messenger RNA, VGAM243 host target RNA, herein designated VGAM HOST TARGET RNA. VGAM243 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM243 RNA, herein designated VGAM RNA, binds complementarily to one or more host target binding sites located in untranslated regions of VGAM243 host target RNA, herein designated VGAM HOST TARGET RNA. This complementary binding is due to the fact that the nucleotide sequence of VGAM243 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM243 RNA, herein designated VGAM RNA, may have a different number of host target binding sites in untranslated regions of a VGAM243 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM243 RNA, herein designated VGAM RNA, to host target binding sites on VGAM243 host target RNA, herein designated VGAM HOST TARGET RNA, such as BINDING SITE I, BINDING SITE II and BINDING SITE III, inhibits translation of VGAM243 host target RNA into VGAM243 host target protein, herein designated VGAM HOST TARGET PROTEIN. VGAM host target protein is therefore outlined by a broken line.

It is appreciated that VGAM243 host target gene, herein designated VGAM HOST TARGET GENE, in fact represents a plurality of VGAM243 host target genes. The mRNA of each one of this plurality of VGAM243 host target genes comprises one or more host target binding sites, each having a nucleotide sequence which is at least partly complementary to VGAM243 RNA, herein designated VGAM RNA, and which when bound by VGAM243 RNA causes inhibition of translation of respective one or more VGAM243 host target proteins.

It is further appreciated by one skilled in the art that the mode of translational inhibition illustrated by FIG. 1 with specific reference to translational inhibition exerted by VGAM243 gene, herein designated VGAM GENE, on one or more VGAM243 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM243 is inhibition of expression of host target genes, as part of a novel viral mechanism of attacking a host. Accordingly, utilities of VGAM243 include diagnosis, prevention and treatment of viral infection by Callitrichine Herpesvirus 3. Specific functions, and accordingly utilities, of VGAM243 correlate with, and may be deduced from, the identity of the host target genes which VGAM243 binds and inhibits, and the function of these host target genes, as elaborated hereinbelow.

Nucleotide sequences of the VGAM243 precursor RNA, herein designated VGAM PRECURSOR RNA, and of the 'diced' VGAM243 RNA, herein designated VGAM RNA, and a schematic representation of the secondary folding of VGAM243 folded precursor RNA, herein designated VGAM FOLDED PRECURSOR RNA, of VGAM243 are further described hereinbelow with reference to Table 1.

Nucleotide sequences of host target binding sites, such as BINDING SITE-I, BINDING SITE-II and BINDING SITE-III of FIG. 1, found on VGAM243 host target RNA, and schematic representation of the complementarity of each of these host target binding sites to VGAM243 RNA, herein designated VGAM RNA, are described hereinbelow with reference to Table 2.

As mentioned hereinabove with reference to FIG. 1, a function of VGAM243 gene, herein designated VGAM is inhibition of expression of VGAM243 target genes. It is appreciated that specific functions, and accordingly utilities, of VGAM243 correlate with, and may be deduced from, the identity of the target genes which VGAM243 binds and inhibits, and the function of these target genes, as elaborated hereinbelow.

Kinesin Family Member 3C (KIF3C, Accession NM_002254) is a VGAM243 host target gene. KIF3C BINDING SITE is HOST TARGET binding site found in the 3' untranslated region of mRNA encoded by KIF3C, corresponding to a HOST TARGET binding site such as BINDING SITE I, BINDING SITE II or BINDING SITE III. Table 2 illustrates the complementarity of the nucleotide sequences of KIF3C BINDING SITE, designated SEQ ID:8060, to the nucleotide sequence of VGAM243 RNA, herein designated VGAM RNA, also designated SEQ ID:2954.

A function of VGAM243 is therefore inhibition of Kinesin Family Member 3C (KIF3C, Accession NM_002254). Accordingly, utilities of VGAM243 include diagnosis, prevention and treatment of diseases and clinical conditions associated with KIF3C. KIAA1828 (Accession XM_057526) is another VGAM243 host target gene. KIAA1828 BINDING SITE is HOST TARGET binding site found in the 5' untranslated region of mRNA encoded by KIAA1828, corresponding to a HOST TARGET binding site such as BINDING SITE I, BINDING SITE II or BINDING SITE III. Table 2 illustrates the complementarity of the nucleotide sequences of KIAA1828 BINDING SITE, designated SEQ ID:36524, to the nucleotide sequence of VGAM243 RNA, herein designated VGAM RNA, also designated SEQ ID:2954.

Another function of VGAM243 is therefore inhibition of KIAA1828 (Accession XM_057526). Accordingly, utilities of VGAM243 include diagnosis, prevention and treatment of diseases and clinical conditions associated with KIAA1828. Kv6.3 (Accession NM_133490) is another VGAM243 host target gene. Kv6.3 BINDING SITE is HOST TARGET binding site found in the 3' untranslated region of mRNA encoded by Kv6.3, corresponding to a HOST TARGET binding site such as BINDING SITE I, BINDING SITE II or BINDING SITE III. Table 2 illustrates the complementarity of the nucleotide sequences of Kv6.3 BINDING SITE, designated SEQ ID:28564, to the nucleotide sequence of VGAM243 RNA, herein designated VGAM RNA, also designated SEQ ID:2954.

Another function of VGAM243 is therefore inhibition of Kv6.3 (Accession NM_133490). Accordingly, utilities of VGAM243 include diagnosis, prevention and treatment of diseases and clinical conditions associated with Kv6.3. Matrin 3 (MATR3, Accession NM_018834) is another VGAM243 host target gene. MATR3 BINDING SITE is HOST TARGET binding site found in the 3' untranslated region of mRNA encoded by MATR3, corresponding to a HOST TARGET binding site such as BINDING SITE I, BINDING SITE II or BINDING SITE III. Table 2 illustrates the complementarity of the nucleotide sequences of MATR3 BINDING SITE, designated SEQ ID:20819, to the nucleotide sequence of VGAM243 RNA, herein designated VGAM RNA, also designated SEQ ID:2954.

Another function of VGAM243 is therefore inhibition of Matrin 3 (MATR3, Accession NM_018834). Accordingly, utilities of VGAM243 include diagnosis, prevention and treatment of diseases and clinical conditions associated with MATR3. RRN3 (Accession NM_018427) is another VGAM243 host target gene. RRN3 BINDING SITE is HOST TARGET binding site found in the 3' untranslated region of mRNA encoded by RRN3, corresponding to a HOST TARGET binding site such as BINDING SITE I, BINDING SITE II or BINDING SITE III. Table 2 illustrates the complementarity of the nucleotide sequences of RRN3 BINDING SITE, designated SEQ ID:20486, to the nucleotide sequence of VGAM243 RNA, herein designated VGAM RNA, also designated SEQ ID:2954.

Another function of VGAM243 is therefore inhibition of RRN3 (Accession NM_018427). Accordingly, utilities of VGAM243 include diagnosis, prevention and treatment of diseases and clinical conditions associated with RRN3. LOC253039 (Accession XM_171203) is another VGAM243 host target gene. LOC253039 BINDING SITE is HOST TARGET binding site found in the 3' untranslated region of mRNA encoded by LOC253039, corresponding to a HOST TARGET binding site such as BINDING SITE I, BINDING SITE II or BINDING SITE III. Table 2 illustrates the complementarity of the nucleotide sequences of LOC253039 BINDING SITE, designated SEQ ID:45993, to the nucleotide sequence of VGAM243 RNA, herein designated VGAM RNA, also designated SEQ ID:2954.

Another function of VGAM243 is therefore inhibition of LOC253039 (Accession XM_171203). Accordingly, utilities of VGAM243 include diagnosis, prevention and treatment of diseases and clinical conditions associated with LOC253039. LOC51634 (Accession NM_016024) is another VGAM243 host target gene. LOC51634 BINDING SITE is HOST TARGET binding site found in the 3' untranslated region of mRNA encoded by LOC51634, corresponding to a HOST TARGET binding site such as BINDING SITE I, BINDING SITE II or BINDING SITE III. Table 2 illustrates the complementarity of the nucleotide sequences of LOC51634 BINDING SITE, designated SEQ ID:18100, to the nucleotide sequence of VGAM243 RNA, herein designated VGAM RNA, also designated SEQ ID:2954.

Another function of VGAM243 is therefore inhibition of LOC51634 (Accession NM_016024). Accordingly, utilities of VGAM243 include diagnosis, prevention and treatment of diseases and clinical conditions associated with LOC51634. FIG. 1 further provides a conceptual description of a novel bioinformatically detected viral gene of the present invention, referred to here as Viral Genomic Address Messenger 244 (VGAM244) viral gene, which modulates expression of respective host target genes thereof, the function and utility of which host target genes is known in the art.

VGAM244 is a novel bioinformatically detected regulatory, non protein coding, viral micro RNA (miRNA) gene. The method by which VGAM244 was detected is described hereinabove with reference to FIGS. 1-8.

VGAM244 gene, herein designated VGAM GENE, is a viral gene contained in the genome of Callitrichine Herpesvirus 3. VGAM244 host target gene, herein designated VGAM HOST TARGET GENE, is a human gene contained in the human genome.

VGAM244 gene encodes a VGAM244 precursor RNA, herein designated VGAM PRECURSOR RNA. Similar to other miRNA genes, and unlike most ordinary genes, VGAM244 precursor RNA does not encode a protein. A nucleotide sequence identical or highly similar to the nucleotide sequence of VGAM244 precursor RNA is designated SEQ ID:230, and is provided hereinbelow with reference to the sequence listing part. Nucleotide sequence SEQ ID:230 is located at position 84833 relative to the genome of Callitrichine Herpesvirus 3.

VGAM244 precursor RNA folds onto itself, forming VGAM244 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM244 folded precursor RNA into VGAM244 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM244 RNA is designated SEQ ID:2955, and is provided hereinbelow with reference to the sequence listing part.

VGAM244 host target gene, herein designated VGAM HOST TARGET GENE, encodes a corresponding messenger RNA, VGAM244 host target RNA, herein designated VGAM HOST TARGET RNA. VGAM244 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM244 RNA, herein designated VGAM RNA, binds complementarily to one or more host target binding sites located in untranslated regions of VGAM244 host target RNA, herein designated VGAM HOST TARGET RNA. This complementary binding is due to the fact that the nucleotide sequence of VGAM244 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM244 RNA, herein designated VGAM RNA, may have a different number of host target binding sites in untranslated regions of a VGAM244 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM244 RNA, herein designated VGAM RNA, to host target binding sites on VGAM244 host target RNA, herein designated VGAM HOST TARGET RNA, such as BINDING SITE I, BINDING SITE II and BINDING SITE III, inhibits translation of VGAM244 host target RNA into VGAM244 host target protein, herein designated VGAM HOST TARGET PROTEIN. VGAM host target protein is therefore outlined by a broken line.

It is appreciated that VGAM244 host target gene, herein designated VGAM HOST TARGET GENE, in fact represents a plurality of VGAM244 host target genes. The mRNA of each one of this plurality of VGAM244 host target genes comprises one or more host target binding sites, each having a nucleotide sequence which is at least partly complementary to VGAM244 RNA, herein designated VGAM RNA, and which when bound by VGAM244 RNA causes inhibition of translation of respective one or more VGAM244 host target proteins.

It is further appreciated by one skilled in the art that the mode of translational inhibition illustrated by FIG. 1 with specific reference to translational inhibition exerted by VGAM244 gene, herein designated VGAM GENE, on one or more VGAM244 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM244 is inhibition of expression of host target genes, as part of a novel viral mechanism of attacking a host. Accordingly, utilities of VGAM244 include diagnosis, prevention and treatment of viral infection by Callitrichine Herpesvirus 3. Specific functions, and accordingly utilities, of VGAM244 correlate with, and may be deduced from, the identity of the host target genes which VGAM244 binds and inhibits, and the function of these host target genes, as elaborated hereinbelow.

Nucleotide sequences of the VGAM244 precursor RNA, herein designated VGAM PRECURSOR RNA, and of the 'diced' VGAM244 RNA, herein designated VGAM RNA, and a schematic representation of the secondary folding of VGAM244 folded precursor RNA, herein designated VGAM FOLDED PRECURSOR RNA, of VGAM244 are further described hereinbelow with reference to Table 1.

Nucleotide sequences of host target binding sites, such as BINDING SITE-I, BINDING SITE-II and BINDING SITE-III of FIG. 1, found on VGAM244 host target RNA, and schematic representation of the complementarity of each of these host target binding sites to VGAM244 RNA, herein designated VGAM RNA, are described hereinbelow with reference to Table 2.

As mentioned hereinabove with reference to FIG. 1, a function of VGAM244 gene, herein designated VGAM is inhibition of expression of VGAM244 target genes. It is appreciated that specific functions, and accordingly utilities, of VGAM244 correlate with, and may be deduced from, the identity of the target genes which VGAM244 binds and inhibits, and the function of these target genes, as elaborated hereinbelow.

Sirtuin Silent Mating Type Information Regulation 2 Homolog 1 (S. cerevisiae) (SIRT1, Accession NM_012238) is a VGAM244 host target gene. SIRT1 BINDING SITE is HOST TARGET binding site found in the 3' untranslated region of mRNA encoded by SIRT1, corresponding to a HOST TARGET binding site such as BINDING SITE I, BINDING SITE II or BINDING SITE III. Table 2 illustrates the complementarity of the nucleotide sequences of SIRT1 BINDING SITE, designated SEQ ID:14541, to the nucleotide sequence of VGAM244 RNA, herein designated VGAM RNA, also designated SEQ ID:2955.

A function of VGAM244 is therefore inhibition of Sirtuin Silent Mating Type Information Regulation 2 Homolog 1 (S. cerevisiae) (SIRT1, Accession NM_012238), a gene which may function as intracellular regulatory protein with mono-ADP-ribosyltransferase activity. Accordingly, utilities of VGAM244 include diagnosis, prevention and treatment of diseases and clinical conditions associated with SIRT1. The function of SIRT1 has been established by previous studies. Vaziri et al. (2001) showed that the SIRT1 protein binds and deacetylates the p53 protein (OMIM Ref. No. 191170) with a specificity for its C-terminal lys382 residue, modification of which is implicated in the activation of p53 as a transcription factor. Expression of wildtype SIRT1 in human cells reduced the transcriptional activity of p53. In contrast, expression of a catalytically inactive SIRT1 protein potentiated p53-dependent apoptosis and radiosensitivity. These results suggested that SIRT1 is involved in the regulation of p53 function via deacetylation. Luo et al. (2001) showed that mammalian SIRT1 physically interacts with p53 and attenuates p53-mediated functions. Nicotinamide (vitamin B3) inhibited an NAD-dependent p53 deacetylation induced by SIRT1 and also enhanced the p53 acetylation levels in vivo. Furthermore, SIRT1 repressed p53-dependent apoptosis in response to DNA damage and oxidative stress, whereas expression of a SIRT1 point mutant increased the sensitivity of cells in the stress response.

Full details of the abovementioned studies are described in the following publications, the disclosure of which are hereby incorporated by reference:

Vaziri, H.; Dessain, S. K.; Eaton, E. N.; Imai, S.-I.; Frye, R. A.; Pandita, T. K.; Guarente, L.; Weinberg, R. A.: hSIR2-SIRT1 functions as an NAD-dependent p53 deacetylase. Cell 107:149-159, 2001; and Luo, J.; Nikolaev, A. Y.; Imai, S.; Chen, D.; Su, F.; Shiloh, A.; Guarente, L.; Gu, W.: Negative control of p53 by Sir2-alpha promotes cell survival under stress. Cell 107:137-148, 2.

Further studies establishing the function and utilities of SIRT1 are found in John Hopkins OMIM database record ID 604479, and in sited publications numbered 5008-5010, 504 and 5049-5052 listed in the bibliography section hereinbelow, which are also hereby incorporated by reference. Zinc Finger Protein 10 (KOX 1) (ZNF10, Accession NM_015394) is another VGAM244 host target gene. ZNF10 BINDING SITE is HOST TARGET binding site found in the 3' untranslated region of mRNA encoded by ZNF10, corresponding to a HOST TARGET binding site such as BINDING SITE I, BINDING SITE II or BINDING SITE III. Table 2 illustrates the complementarity of the nucleotide sequences of ZNF10 BINDING SITE, designated SEQ ID:17692, to the nucleotide sequence of VGAM244 RNA, herein designated VGAM RNA, also designated SEQ ID:2955.

Another function of VGAM244 is therefore inhibition of Zinc Finger Protein 10 (KOX 1) (ZNF10, Accession NM_015394), a gene which may function as a transcriptional regulator. Accordingly, utilities of VGAM244 include diagnosis, prevention and treatment of diseases and clinical conditions associated with ZNF10. The function of ZNF10 and its association with various diseases and clinical conditions, has been established by previous studies, as described hereinabove with reference to VGAM36. Rho Guanine Nucleotide Exchange Factor (GEF) 11 (ARHGEF11, Accession NM_014784) is another VGAM244 host target gene. ARHGEF11 BINDING SITE is HOST TARGET binding site found in the 5' untranslated region of mRNA encoded by ARHGEF11, corresponding to a HOST TARGET binding site such as BINDING SITE I, BINDING SITE II or BINDING SITE III. Table 2 illustrates the complementarity of the nucleotide sequences of ARHGEF11 BINDING SITE, designated SEQ ID:16639, to the nucleotide sequence of VGAM244 RNA, herein designated VGAM RNA, also designated SEQ ID:2955.

Another function of VGAM244 is therefore inhibition of Rho Guanine Nucleotide Exchange Factor (GEF) 11 (ARHGEF11, Accession NM_014784). Accordingly, utilities of VGAM244 include diagnosis, prevention and treatment of diseases and clinical conditions associated with ARHGEF11. Low Density Lipoprotein-related Protein 1B (deleted in tumors) (LRP1B, Accession NM_018557) is another VGAM244 host target gene. LRP1B BINDING SITE is HOST TARGET binding site found in the 5' untranslated region of mRNA encoded by LRP1B, corresponding to a HOST TARGET binding site such as BINDING SITE I, BINDING SITE II or BINDING SITE III. Table 2 illustrates the complementarity of the nucleotide sequences of LRP1B BINDING SITE, designated SEQ ID:20637, to the nucleotide sequence of VGAM244 RNA, herein designated VGAM RNA, also designated SEQ ID:2955.

Another function of VGAM244 is therefore inhibition of Low Density Lipoprotein-related Protein 1B (deleted in tumors) (LRP1B, Accession NM_018557). Accordingly, utilities of VGAM244 include diagnosis, prevention and treatment of diseases and clinical conditions associated with LRP1B. Retinoic Acid Induced 15 (RAI15, Accession XM_039548) is another VGAM244 host target gene. RAI15 BINDING SITE is HOST TARGET binding site found in the 3' untranslated region of mRNA encoded by RAI15, corresponding to a HOST TARGET binding site such as BINDING SITE I, BINDING SITE II or BINDING SITE III. Table 2 illustrates the complementarity of the nucleotide sequences of RAI15 BINDING SITE, designated SEQ ID:33117, to the nucleotide sequence of VGAM244 RNA, herein designated VGAM RNA, also designated SEQ ID:2955.

Another function of VGAM244 is therefore inhibition of Retinoic Acid Induced 15 (RAI15, Accession XM_039548). Accordingly, utilities of VGAM244 include diagnosis, prevention and treatment of diseases and clinical conditions associated with RAI15. SDF1 (Accession XM_165565) is another VGAM244 host target gene. SDF1 BINDING SITE is HOST TARGET binding site found in the 3' untranslated region of mRNA encoded by SDF1, corresponding to a HOST TARGET binding site such as BINDING SITE I, BINDING SITE II or BINDING SITE III. Table 2 illustrates the complementarity of the nucleotide sequences of SDF1 BINDING SITE, designated SEQ ID:43687, to the nucleotide sequence of VGAM244 RNA, herein designated VGAM RNA, also designated SEQ ID:2955.

Another function of VGAM244 is therefore inhibition of SDF1 (Accession XM_165565). Accordingly, utilities of VGAM244 include diagnosis, prevention and treatment of diseases and clinical conditions associated with SDF1. LOC149373 (Accession XM_086507) is another VGAM244 host target gene. LOC149373 BINDING SITE is HOST TARGET binding site found in the 3' untranslated region of mRNA encoded by LOC149373, corresponding to a HOST TARGET binding site such as BINDING SITE I, BINDING SITE II or BINDING SITE III. Table 2 illustrates the complementarity of the nucleotide sequences of LOC149373 BINDING SITE, designated SEQ ID:38717, to the nucleotide sequence of VGAM244 RNA, herein designated VGAM RNA, also designated SEQ ID:2955.

Another function of VGAM244 is therefore inhibition of LOC149373 (Accession XM_086507). Accordingly, utilities of VGAM244 include diagnosis, prevention and treatment of diseases and clinical conditions associated with LOC149373. LOC257464 (Accession XM_116972) is another VGAM244 host target gene. LOC257464 BINDING SITE is HOST TARGET binding site found in the 5' untranslated region of mRNA encoded by LOC257464, corresponding to a HOST TARGET binding site such as BINDING SITE I, BINDING SITE II or BINDING SITE III. Table 2 illustrates the complementarity of the nucleotide sequences of LOC257464 BINDING SITE, designated SEQ ID:43160, to the nucleotide sequence of VGAM244 RNA, herein designated VGAM RNA, also designated SEQ ID:2955.

Another function of VGAM244 is therefore inhibition of LOC257464 (Accession XM_116972). Accordingly, utilities of VGAM244 include diagnosis, prevention and treatment of diseases and clinical conditions associated with LOC257464. FIG. 1 further provides a conceptual description of a novel bioinformatically detected viral gene of the present invention, referred to here as Viral Genomic Address Messenger 245 (VGAM245) viral gene, which modulates expression of respective host target genes thereof, the function and utility of which host target genes is known in the art.

VGAM245 is a novel bioinformatically detected regulatory, non protein coding, viral micro RNA (miRNA) gene. The method by which VGAM245 was detected is described hereinabove with reference to FIGS. 1-8.

VGAM245 gene, herein designated VGAM GENE, is a viral gene contained in the genome of Callitrichine Herpesvirus 3. VGAM245 host target gene, herein designated VGAM HOST TARGET GENE, is a human gene contained in the human genome.

VGAM245 gene encodes a VGAM245 precursor RNA, herein designated VGAM PRECURSOR RNA. Similar to other miRNA genes, and unlike most ordinary genes, VGAM245 precursor RNA does not encode a protein. A nucleotide sequence identical or highly similar to the nucleotide sequence of VGAM245 precursor RNA is designated SEQ ID:231, and is provided hereinbelow with reference to the sequence listing part. Nucleotide sequence SEQ ID:231 is located at position 42813 relative to the genome of Callitrichine Herpesvirus 3.

VGAM245 precursor RNA folds onto itself, forming VGAM245 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM245 folded precursor RNA into VGAM245 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM245 RNA is designated SEQ ID:2956, and is provided hereinbelow with reference to the sequence listing part.

VGAM245 host target gene, herein designated VGAM HOST TARGET GENE, encodes a corresponding messenger RNA, VGAM245 host target RNA, herein designated VGAM HOST TARGET RNA. VGAM245 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM245 RNA, herein designated VGAM RNA, binds complementarily to one or more host target binding sites located in untranslated regions of VGAM245 host target RNA, herein designated VGAM HOST TARGET RNA. This complementary binding is due to the fact that the nucleotide sequence of VGAM245 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM245 RNA, herein designated VGAM RNA, may have a different number of host target binding sites in untranslated regions of a VGAM245 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM245 RNA, herein designated VGAM RNA, to host target binding sites on VGAM245 host target RNA, herein designated VGAM HOST TARGET RNA, such as BINDING SITE I, BINDING SITE II and BINDING SITE III, inhibits translation of VGAM245 host target RNA into VGAM245 host target protein, herein designated VGAM HOST TARGET PROTEIN. VGAM host target protein is therefore outlined by a broken line.

It is appreciated that VGAM245 host target gene, herein designated VGAM HOST TARGET GENE, in fact represents a plurality of VGAM245 host target genes. The mRNA of each one of this plurality of VGAM245 host target genes comprises one or more host target binding sites, each having a nucleotide sequence which is at least partly complementary to VGAM245 RNA, herein designated VGAM RNA, and which when bound by VGAM245 RNA causes inhibition of translation of respective one or more VGAM245 host target proteins.

It is further appreciated by one skilled in the art that the mode of translational inhibition illustrated by FIG. 1 with specific reference to translational inhibition exerted by VGAM245 gene, herein designated VGAM GENE, on one or more VGAM245 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM245 is inhibition of expression of host target genes, as part of a novel viral mechanism of attacking a host. Accordingly, utilities of VGAM245 include diagnosis, prevention and treatment of viral infection by Callitrichine Herpesvirus 3. Specific functions, and accordingly utilities, of VGAM245 correlate with, and may be deduced from, the identity of the host target genes which VGAM245 binds and inhibits, and the function of these host target genes, as elaborated hereinbelow.

Nucleotide sequences of the VGAM245 precursor RNA, herein designated VGAM PRECURSOR RNA, and of the 'diced' VGAM245 RNA, herein designated VGAM RNA, and a schematic representation of the secondary folding of VGAM245 folded precursor RNA, herein designated VGAM FOLDED PRECURSOR RNA, of VGAM245 are further described hereinbelow with reference to Table 1.

Nucleotide sequences of host target binding sites, such as BINDING SITE-I, BINDING SITE-II and BINDING SITE-III of FIG. 1, found on VGAM245 host target RNA, and schematic representation of the complementarity of each of these host target binding sites to VGAM245 RNA, herein designated VGAM RNA, are described hereinbelow with reference to Table 2.

As mentioned hereinabove with reference to FIG. 1, a function of VGAM245 gene, herein designated VGAM is inhibition of expression of VGAM245 target genes. It is appreciated that specific functions, and accordingly utilities, of VGAM245 correlate with, and may be deduced from, the identity of the target genes which VGAM245 binds and inhibits, and the function of these target genes, as elaborated hereinbelow.

ADP-ribosylation Factor 3 (ARF3, Accession NM_001659) is a VGAM245 host target gene. ARF3 BINDING SITE is HOST TARGET binding site found in the 3' untranslated region of mRNA encoded by ARF3, corresponding to a HOST TARGET binding site such as BINDING SITE I, BINDING SITE II or BINDING SITE III. Table 2 illustrates the complementarity of the nucleotide sequences of ARF3 BINDING SITE, designated SEQ ID:7377, to the nucleotide sequence of VGAM245 RNA, herein designated VGAM RNA, also designated SEQ ID:2956.

A function of VGAM245 is therefore inhibition of ADP-ribosylation Factor 3 (ARF3, Accession NM_001659). Accordingly, utilities of VGAM245 include diagnosis, prevention and treatment of diseases and clinical conditions associated with ARF3. FE65L2 (Accession NM_133175) is another VGAM245 host target gene. FE65L2 BINDING SITE1 and FE65L2 BINDING SITE2 are HOST TARGET binding sites found in untranslated regions of mRNA encoded by FE65L2, corresponding to HOST TARGET binding sites such as BINDING SITE I, BINDING SITE II or BINDING SITE III. Table 2 illustrates the complementarity of the nucleotide sequences of FE65L2 BINDING SITE1 and FE65L2 BINDING SITE2, designated SEQ ID:28396 and SEQ ID:28397 respectively, to the nucleotide sequence of VGAM245 RNA, herein designated VGAM RNA, also designated SEQ ID:2956.

Another function of VGAM245 is therefore inhibition of FE65L2 (Accession NM_133175), a gene which may modulate the internalization of beta-amyloid precursor protein. Accordingly, utilities of VGAM245 include diagnosis, prevention and treatment of diseases and clinical conditions associated with FE65L2. The function of FE65L2 has been established by previous studies. To identify genes similar to Fe65 (OMIM Ref. No. 602709), Duilio et al. (1998) screened a rat brain cDNA library and isolated a Fe65L2 cDNA encoding a deduced 504-amino acid polypeptide. Like Fe65 and Fe65L1 (OMIM Ref. No. 602710), the rat Fe65L2 protein contains 2 phosphotyrosine-binding (PTB) domains and a WW domain. Northern blot analysis detected predominant expression of a 2-kb Fe65L2 mRNA in rat brain and testis. Using the rat cDNA fragment as probe, Tanahashi and Tabira (1999) cloned human Fe65L2 from a fetal brain cDNA library. Fe65L2 encodes a deduced 486-amino acid protein that shares 86% sequence identity with the rat protein. Using RT-PCR of human fetal brain mRNA, Tanahashi and Tabira (1999) also identified a variant, caused by the splicing of a 6-nucleotide mini-exon, that results results in a peptide lacking 2 amino acids in the first PTB domain. Northern blot analysis revealed expression of a 2.2-kb transcript expressed mainly in the brain and in all brain regions tested. A 2.9-kb transcript was found in other tissues, with strongest expression in pancreas. By radiation hybrid analysis, Tanahashi and Tabira (1999) mapped the FE65L2 gene to chromosome 5.

Full details of the abovementioned studies are described in the following publications, the disclosure of which are hereby incorporated by reference:

Duilio, A.; Faraonio, R.; Minopoli, G.; Zambrano, N.; Russo, T.: Fe65L2: a new member of the Fe65 protein family interacting with the intracellular domain of the Alzheimer's beta-amyloid precursor protein. Biochem. J. 330: 513-519, 1998; and Tanahashi, H.; Tabira, T.: Genome structure and chromosomal mapping of the gene for Fe65L2 interacting with Alzheimer's beta-amyloid precursor protein. Biochem. Biophys. Res. Commun. 25.

Further studies establishing the function and utilities of FE65L2 are found in John Hopkins OMIM database record ID 602711, and in sited publications numbered 1120-1122 listed in the bibliography section hereinbelow, which are also hereby incorporated by reference. Spondyloepiphyseal Dysplasia, Late (SEDL, Accession NM_014563) is another VGAM245 host target gene. SEDL BINDING SITE is HOST TARGET binding site found in the 3' untranslated region of mRNA encoded by SEDL, corresponding to a HOST TARGET binding site such as BINDING SITE I, BINDING SITE II or BINDING SITE III. Table 2 illustrates the complementarity of the nucleotide sequences of SEDL BINDING SITE, designated SEQ ID:15902, to the nucleotide sequence of VGAM245 RNA, herein designated VGAM RNA, also designated SEQ ID:2956.

Another function of VGAM245 is therefore inhibition of Spondyloepiphyseal Dysplasia, Late (SEDL, Accession NM_014563), a gene which may play role in vesicular transport from endoplasmic reticulum to golgi. Accordingly, utilities of VGAM245 include diagnosis, prevention and treatment of diseases and clinical conditions associated with SEDL. The function of SEDL and its association with various diseases and clinical conditions, has been established by previous studies, as described hereinabove with reference to VGAM74. Sel-1 Suppressor of Lin-12-like (C. elegans) (SEL1L, Accession NM_005065) is another VGAM245 host target gene. SEL1L BINDING SITE is HOST TARGET binding site found in the 3' untranslated region of mRNA encoded by SEL1L, corresponding to a HOST TARGET binding site such as BINDING SITE I, BINDING SITE II or BINDING SITE III. Table 2 illustrates the complementarity of the nucleotide sequences of SEL1L BINDING SITE, designated SEQ ID:11500, to the nucleotide sequence of VGAM245 RNA, herein designated VGAM RNA, also designated SEQ ID:2956.

Another function of VGAM245 is therefore inhibition of Sel-1 Suppressor of Lin-12-like (C. elegans) (SEL1L, Accession NM_005065), a gene which may play a role in notch signaling (by similarity). Accordingly, utilities of VGAM245 include diagnosis, prevention and treatment of diseases and clinical conditions associated with SEL1L. The function of SEL1L has been established by previous studies. Biunno et al. (1997) isolated a novel cDNA, designated SEL1L by them, that shows sequence similarities to sel-1, a gene identified as an extragenic suppressor of the lin-12 hypomorphic mutant from C. elegans (3,4:Grant and Greenwald, 1996, 1997). SEL1L exhibited a tissue-specific pattern of expression: high levels of a single 7.5-kb transcript were detected only in the pancreas of healthy individuals, whereas low to undetectable levels were observed in other adult tissues and in some fetal tissues. Because of the tissue-specific expression of the gene, Biunno et al. (1997) studied the gene in human pancreatic carcinomas. They found that 17% of adenocarcinomas of the pancreas did not express SEL1L to a detectable level; however, no gross genomic alterations were apparent within a few hundred kb of the relevant region. By somatic cell hybrid analysis and fluorescence in situ hybridization, Biunno et al. (1997) mapped the SEL1L gene to chromosome 14q31. Donoviel and Bernstein (1999) localized the gene to 14q24.3-q31 by FISH and radiation hybrid analysis.

Full details of the abovementioned studies are described in the following publications, the disclosure of which are hereby incorporated by reference:

Biunno, I.; Appierto, V.; Cattaneo, M.; Leone, B. E.; Balzano, G.; Socci, C.; Saccone, S.; Letizia, A.; Valle, G. D.; Sgaramella, V.: Isolation of a pancreas-specific gene located on human chromosome 14q31: expression analysis in human pancreatic ductal carcinomas. Genomics 46:284-286, 1997; and Donoviel, D. B.; Bernstein, A.: SEL-1L maps to human chromosome 14, near the insulin-dependent diabetes mellitus locus 11. Genomics 56:232-233, 1999.

Further studies establishing the function and utilities of SEL1L are found in John Hopkins OMIM database record ID 602329, and in sited publications numbered 6003-6006 listed in the bibliography section hereinbelow, which are also hereby incorporated by reference. FLJ10853 (Accession NM_018246) is another VGAM245 host target gene. FLJ10853 BINDING SITE is HOST TARGET binding site found in the 3' untranslated region of mRNA encoded by FLJ10853, corresponding to a HOST TARGET binding site such as BINDING SITE I, BINDING SITE II or BINDING SITE III. Table 2 illustrates the complementarity of the nucleotide sequences of FLJ10853 BINDING SITE, designated SEQ ID:20209, to the nucleotide sequence of VGAM245 RNA, herein designated VGAM RNA, also designated SEQ ID:2956.

Another function of VGAM245 is therefore inhibition of FLJ10853 (Accession NM_018246). Accordingly, utilities of VGAM245 include diagnosis, prevention and treatment of diseases and clinical conditions associated with FLJ10853. FLJ20511 (Accession NM_017853) is another VGAM245 host target gene. FLJ20511 BINDING SITE is HOST TARGET binding site found in the 3' untranslated region of mRNA encoded by FLJ20511, corresponding to a HOST TARGET binding site such as BINDING SITE I, BINDING SITE II or BINDING SITE III. Table 2 illustrates the complementarity of the nucleotide sequences of FLJ20511 BINDING SITE, designated SEQ ID:19526, to the nucleotide sequence of VGAM245 RNA, herein designated VGAM RNA, also designated SEQ ID:2956.

Another function of VGAM245 is therefore inhibition of FLJ20511 (Accession NM_017853). Accordingly, utilities of VGAM245 include diagnosis, prevention and treatment of diseases and clinical conditions associated with FLJ20511. KIAA1026 (Accession XM_048825) is another VGAM245 host target gene. KIAA1026 BINDING SITE is HOST TARGET binding site found in the 3' untranslated region of mRNA encoded by KIAA1026, corresponding to a HOST TARGET binding site such as BINDING SITE I, BINDING SITE II or BINDING SITE III. Table 2 illustrates the complementarity of the nucleotide sequences of KIAA1026 BINDING SITE, designated SEQ ID:35276, to the nucleotide sequence of VGAM245 RNA, herein designated VGAM RNA, also designated SEQ ID:2956.

Another function of VGAM245 is therefore inhibition of KIAA1026 (Accession XM_048825). Accordingly, utilities of VGAM245 include diagnosis, prevention and treatment of diseases and clinical conditions associated with KIAA1026. KIAA1198 (Accession XM_032674) is another VGAM245 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31701, to the nucleotide sequence of VGAM245 RNA, herein designated VGAM RNA, also designated SEQ ID:2956.

Another function of VGAM245 is therefore inhibition of KIAA1198 (Accession XM_032674). Accordingly, utilities of VGAM245 include diagnosis, prevention and treatment of diseases and clinical conditions associated with KIAA1198. KIAA1536 (Accession NM_020898) is another VGAM245 host target gene. KIAA1536 BINDING SITE is HOST TARGET binding site found in the 3' untranslated region of mRNA encoded by KIAA1536, corresponding to a HOST TARGET binding site such as BINDING SITE I, BINDING SITE II or BINDING SITE III. Table 2 illustrates the complementarity of the nucleotide sequences of KIAA1536 BINDING SITE, designated SEQ ID:21921, to the nucleotide sequence of VGAM245 RNA, herein designated VGAM RNA, also designated SEQ ID:2956.

Another function of VGAM245 is therefore inhibition of KIAA1536 (Accession NM_020898). Accordingly, utilities of VGAM245 include diagnosis, prevention and treatment of diseases and clinical conditions associated with KIAA1536. KIAA1615 (Accession XM_044021) is another VGAM245 host target gene. KIAA1615 BINDING SITE is HOST TARGET binding site found in the 3' untranslated region of mRNA encoded by KIAA1615, corresponding to a HOST TARGET binding site such as BINDING SITE I, BINDING SITE II or BINDING SITE III. Table 2 illustrates the complementarity of the nucleotide sequences of KIAA1615 BINDING SITE, designated SEQ ID:34080, to the nucleotide sequence of VGAM245 RNA, herein designated VGAM RNA, also designated SEQ ID:2956.

Another function of VGAM245 is therefore inhibition of KIAA1615 (Accession XM_044021). Accordingly, utilities of VGAM245 include diagnosis, prevention and treatment of diseases and clinical conditions associated with KIAA1615. LOC146227 (Accession XM_085374) is another VGAM245 host target gene. LOC146227 BINDING SITE is HOST TARGET binding site found in the 3' untranslated region of mRNA encoded by LOC146227, corresponding to a HOST TARGET binding site such as BINDING SITE I, BINDING SITE II or BINDING SITE III. Table 2 illustrates the complementarity of the nucleotide sequences of LOC146227 BINDING SITE, designated SEQ ID:38080, to the nucleotide sequence of VGAM245 RNA, herein designated VGAM RNA, also designated SEQ ID:2956.

Another function of VGAM245 is therefore inhibition of LOC146227 (Accession XM_085374). Accordingly, utilities of VGAM245 include diagnosis, prevention and treatment of diseases and clinical conditions associated with LOC146227. LOC148137 (Accession NM_144692) is another VGAM245 host target gene. LOC148137 BINDING SITE is HOST TARGET binding site found in the 3' untranslated region of mRNA encoded by LOC148137, corresponding to a HOST TARGET binding site such as BINDING SITE I, BINDING SITE II or BINDING SITE III. Table 2 illustrates the complementarity of the nucleotide sequences of LOC148137 BINDING SITE, designated SEQ ID:29517, to the nucleotide sequence of VGAM245 RNA, herein designated VGAM RNA, also designated SEQ ID:2956.

Another function of VGAM245 is therefore inhibition of LOC148137 (Accession NM_144692). Accordingly, utilities of VGAM245 include diagnosis, prevention and treatment of diseases and clinical conditions associated with LOC148137. LOC92876 (Accession XM_047739) is another VGAM245 host target gene. LOC92876 BINDING SITE is HOST TARGET binding site found in the 5' untranslated region of mRNA encoded by LOC92876, corresponding to a HOST TARGET binding site such as BINDING SITE I, BINDING SITE II or BINDING SITE III. Table 2 illustrates the complementarity of the nucleotide sequences of LOC92876 BINDING SITE, designated SEQ ID:35039, to the nucleotide sequence of VGAM245 RNA, herein designated VGAM RNA, also designated SEQ ID:2956.

Another function of VGAM245 is therefore inhibition of LOC92876 (Accession XM_047739). Accordingly, utilities of VGAM245 include diagnosis, prevention and treatment of diseases and clinical conditions associated with LOC92876. FIG. 1 further provides a conceptual description of a novel bioinformatically detected viral gene of the present invention, referred to here as Viral Genomic Address Messenger 246 (VGAM246) viral gene, which modulates expression of respective host target genes thereof, the function and utility of which host target genes is known in the art.

VGAM246 is a novel bioinformatically detected regulatory, non protein coding, viral micro RNA (miRNA) gene. The method by which VGAM246 was detected is described hereinabove with reference to FIGS. 1-8.

VGAM246 gene, herein designated VGAM GENE, is a viral gene contained in the genome of Callitrichine Herpesvirus 3. VGAM246 host target gene, herein designated VGAM HOST TARGET GENE, is a human gene contained in the human genome.

VGAM246 gene encodes a VGAM246 precursor RNA, herein designated VGAM PRECURSOR RNA. Similar to other miRNA genes, and unlike most ordinary genes, VGAM246 precursor RNA does not encode a protein. A nucleotide sequence identical or highly similar to the nucleotide sequence of VGAM246 precursor RNA is designated SEQ ID:232, and is provided hereinbelow with reference to the sequence listing part. Nucleotide sequence SEQ ID:232 is located at position 84351 relative to the genome of Callitrichine Herpesvirus 3.

VGAM246 precursor RNA folds onto itself, forming VGAM246 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM246 folded precursor RNA into VGAM246 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM246 RNA is designated SEQ ID:2957, and is provided hereinbelow with reference to the sequence listing part.

VGAM246 host target gene, herein designated VGAM HOST TARGET GENE, encodes a corresponding messenger RNA, VGAM246 host target RNA, herein designated VGAM HOST TARGET RNA. VGAM246 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM246 RNA, herein designated VGAM RNA, binds complementarily to one or more host target binding sites located in untranslated regions of VGAM246 host target RNA, herein designated VGAM HOST TARGET RNA. This complementary binding is due to the fact that the nucleotide sequence of VGAM246 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM246 RNA, herein designated VGAM RNA, may have a different number of host target binding sites in untranslated regions of a VGAM246 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM246 RNA, herein designated VGAM RNA, to host target binding sites on VGAM246 host target RNA, herein designated VGAM HOST TARGET RNA, such as BINDING SITE I, BINDING SITE II and BINDING SITE III, inhibits translation of VGAM246 host target RNA into VGAM246 host target protein, herein designated VGAM HOST TARGET PROTEIN. VGAM host target protein is therefore outlined by a broken line.

It is appreciated that VGAM246 host target gene, herein designated VGAM HOST TARGET GENE, in fact represents a plurality of VGAM246 host target genes. The mRNA of each one of this plurality of VGAM246 host target genes comprises one or more host target binding sites, each having a nucleotide sequence which is at least partly complementary to VGAM246 RNA, herein designated VGAM RNA, and which when bound by VGAM246 RNA causes inhibition of translation of respective one or more VGAM246 host target proteins.

It is further appreciated by one skilled in the art that the mode of translational inhibition illustrated by FIG. 1 with specific reference to translational inhibition exerted by VGAM246 gene, herein designated VGAM GENE, on one or more VGAM246 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM246 is inhibition of expression of host target genes, as part of a novel viral mechanism of attacking a host. Accordingly, utilities of VGAM246 include diagnosis, prevention and treatment of viral infection by Callitrichine Herpesvirus 3. Specific functions, and accordingly utilities, of VGAM246 correlate with, and may be deduced from, the identity of the host target genes which VGAM246 binds and inhibits, and the function of these host target genes, as elaborated hereinbelow.

Nucleotide sequences of the VGAM246 precursor RNA, herein designated VGAM PRECURSOR RNA, and of the 'diced' VGAM246 RNA, herein designated VGAM RNA, and a schematic representation of the secondary folding of VGAM246 folded precursor RNA, herein designated VGAM FOLDED PRECURSOR RNA, of VGAM246 are further described hereinbelow with reference to Table 1.

Nucleotide sequences of host target binding sites, such as BINDING SITE-I, BINDING SITE-II and BINDING SITE-III of FIG. 1, found on VGAM246 host target RNA, and schematic representation of the complementarity of each of these host target binding sites to VGAM246 RNA, herein designated VGAM RNA, are described hereinbelow with reference to Table 2.

As mentioned hereinabove with reference to FIG. 1, a function of VGAM246 gene, herein designated VGAM is inhibition of expression of VGAM246 target genes. It is appreciated that specific functions, and accordingly utilities, of VGAM246 correlate with, and may be deduced from, the identity of the target genes which VGAM246 binds and inhibits, and the function of these target genes, as elaborated hereinbelow.

Activin A Receptor Type II-like 1 (ACVRL1, Accession NM_000020) is a VGAM246 host target gene. ACVRL1 BINDING SITE is HOST TARGET binding site found in the 5' untranslated region of mRNA encoded by ACVRL1, corresponding to a HOST TARGET binding site such as BINDING SITE I, BINDING SITE II or BINDING SITE III. Table 2 illustrates the complementarity of the nucleotide sequences of ACVRL1 BINDING SITE, designated SEQ ID:5453, to the nucleotide sequence of VGAM246 RNA, herein designated VGAM RNA, also designated SEQ ID:2957.

A function of VGAM246 is therefore inhibition of Activin A Receptor Type II-like 1 (ACVRL1, Accession NM_000020), a gene which form an heteromeric complex after binding tgf-beta at the cell surface and act as signal transducers. Accordingly, utilities of VGAM246 include diagnosis, prevention and treatment of diseases and clinical conditions associated with ACVRL1. The function of ACVRL1 has been established by previous studies. Activin A receptor, type II-like kinase 1 (also called activin receptor-like kinase 1) is a type I cell-surface receptor for the TGF-beta superfamily of ligands (see OMIM Ref. No. TGF-beta, 190180). It shares with other type I receptors a high degree of similarity in serine-threonine kinase subdomains, a glycine- and serine-rich region (called the GS domain) preceding the kinase domain, and a short C-terminal tail (ten Dijke et al., 1994). The protein (symbolized ALK1 by Johnson et al., 1996) can associate with the TGF-beta or activin type II receptors (OMIM Ref. No. 102581) after cotransfection in COS cells, with the complex binding TGF-beta or activin (see OMIM Ref. No. 147290), respectively. However, the ALK1 ligand in vivo is unknown. Using a polyclonal antibody to ALK1, Abdalla et al. (2000) measured ALK1 expression on human umbilical vein endothelial cells (HUVEC) of newborns from HHT2 families. Animal model experiments lend further support to the function of ACVRL1. Urness et al. (2000) focused on HHT, wherein arterial and venous beds fail to remain distinct. They generated mice lacking Acvrl1, the substance missing in one form of HHT.

It is appreciated that the abovementioned animal model for ACVRL1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Johnson, D. W.; Berg, J. N.; Baldwin, M. A.; Gallione, C. J.; Marondel, I.; Yoon, S.-J.; Stenzel, T. T.; Speer, M.; Pericak-Vance, M. A.; Diamond, A.; Guttmacher, A. E.; Jackson, C. E.; Attisano, L.; Kucherlapati, R.; Porteous, M. E. M.; Marchuk, D. A.: Mutations in the activin receptor-like kinase 1 gene in hereditary haemorrhagic telangiectasia type 2. Nature Genet. 13:189-195, 1996.; and Urness, L. D.; Sorensen, L. K.; Li, D. Y.: Arteriovenous malformations in mice lacking activin receptor-like kinase-1. Nature Genet. 26:328-331, 2000.

Further studies establishing the function and utilities of ACVRL1 are found in John Hopkins OMIM database record ID 601284, and in sited publications numbered 11919-1334, 10177, 4270, 427 and 6378 listed in the bibliography section hereinbelow, which are also hereby incorporated by reference. E2F Transcription Factor 2 (E2F2, Accession NM_004091) is another VGAM246 host target gene. E2F2 BINDING SITE is HOST TARGET binding site found in the 5' untranslated region of mRNA encoded by E2F2, corresponding to a HOST TARGET binding site such as BINDING SITE I, BINDING SITE II or BINDING SITE III. Table 2 illustrates the complementarity of the nucleotide sequences of E2F2 BINDING SITE, designated SEQ ID:10293, to the nucleotide sequence of VGAM246 RNA, herein designated VGAM RNA, also designated SEQ ID:2957.

Another function of VGAM246 is therefore inhibition of E2F Transcription Factor 2 (E2F2, Accession NM_004091), a gene which binds dna cooperatively with dp proteins and involves in cell cycle regulation. Accordingly, utilities of VGAM246 include diagnosis, prevention and treatment of diseases and clinical conditions associated with E2F2. The function of E2F2 has been established by previous studies. MYC (OMIM Ref. No. 190080) induces transcription of the E2F1, E2F2, and E2F3 (OMIM Ref. No. 600427) genes. Using primary mouse embryo fibroblasts deleted for individual E2f genes, Leone et al. (2001) showed that MYC-induced S phase and apoptosis requires distinct E2F activities. The ability of Myc to induce S phase was impaired in the absence of either E2f2 or E2f3 but not E2f1 or E2f4 (OMIM Ref. No. 600659). In contrast, the ability of Myc to induce apoptosis was markedly reduced in cells deleted for E2f1 but not E2f2 or E2f3. The authors proposed that the induction of specific E2F activities is an essential component in the MYC pathways that control cell proliferation and cell fate decisions. The retinoblastoma tumor suppressor (Rb) pathway is believed to have a critical role in the control of cellular proliferation by regulating E2F activities. E2F1, E2F2, and E2F3 belong to a subclass of E2F factors thought to act as transcriptional activators important for progression through the G1/S transition. Wu et al. (2001) used a conditional gene targeting approach to demonstrate that combined loss of these 3 E2F factors severely affects E2F target expression and completely abolishes the ability of mouse embryonic fibroblasts to enter S phase, progress through mitosis, and proliferate. Loss of E2F function results in elevation of CIP1 (OMIM Ref. No. 116899) protein, leading to a decrease in cyclin-dependent kinase activity and Rb phosphorylation. Wu et al. (2001) concluded that these findings suggest a function for this subclass of E2F transcriptional activators in a positive feedback loop, through downmodulation of CIP1, that leads to the inactivation of Rb-dependent repression and S phase entry. By targeting the entire subclass of E2F transcriptional activators, Wu et al. (2001) provided direct genetic evidence for their essential role in cell cycle progression, proliferation, and development. Wu et al. (2001) initially generated and interbred E2f1, E2f2, and E2f3 mutant mice, and found that although mice null for E2f1 and E2f2 were viable and developed to adulthood, mice null for E2f1 and E2f3 or E2f2 and E2f3 died early during embryonic development, at or just before embryonic day 9.5, pointing to a central role for E2F3 in mouse development.

Full details of the abovementioned studies are described in the following publications, the disclosure of which are hereby incorporated by reference:

Leone, G.; Sears, R.; Huang, E.; Rempel, R.; Nuckolls, F.; Park, C.-H.; Giangrande, P.; Wu, L.; Saavedra, H. I.; Field, S. J.; Thompson, M. A.; Yang, H.; Fujiwara, Y.; Greenberg, M. E.; Orkin, S.; Smith, C.; Nevins, J. R.: Myc requires distinct E2F activities to induce S phase and apoptosis. Molec. Cell 8:105-113, 2001; and Wu, L.; Timmers, C.; Maiti, B.; Saavedra, H. I.; Sang, L.; Chong, G. T.; Nuckolls, F.; Giangrande, P.; Wright, F. A.; Field, S. J.; Greenberg, M. E.; Orkin, S.; Nevins, J. R.; Robinson.

Further studies establishing the function and utilities of E2F2 are found in John Hopkins OMIM database record ID 600426, and in sited publications numbered 7561-756 and 9711 listed in the bibliography section hereinbelow, which are also hereby incorporated by reference. Platelet-derived Growth Factor Receptor, Alpha Polypeptide (PDGFRA, Accession NM_006206) is another VGAM246 host target gene. PDGFRA BINDING SITE is HOST TARGET binding site found in the 3' untranslated region of mRNA encoded by PDGFRA, corresponding to a HOST TARGET binding site such as BINDING SITE I, BINDING SITE II or BINDING SITE III. Table 2 illustrates the complementarity of the nucleotide sequences of PDGFRA BINDING SITE, designated SEQ ID:12882, to the nucleotide sequence of VGAM246 RNA, herein designated VGAM RNA, also designated SEQ ID:2957.

Another function of VGAM246 is therefore inhibition of Platelet-derived Growth Factor Receptor, Alpha Polypeptide (PDGFRA, Accession NM_006206), a gene which this receptor binds platelet-derived growth factor and has a tyrosine-protein kinase activity. Accordingly, utilities of VGAM246 include diagnosis, prevention and treatment of diseases and clinical conditions associated with PDGFRA. The function of PDGFRA and its association with various diseases and clinical conditions, has been established by previous studies, as described hereinabove with reference to VGAM117. Phospholipase A2, Group IID (PLA2G2D, Accession NM_012400) is another VGAM246 host target gene. PLA2G2D BINDING SITE is HOST TARGET binding site found in the 3' untranslated region of mRNA encoded by PLA2G2D, corresponding to a HOST TARGET binding site such as BINDING SITE I, BINDING SITE II or BIND- ING SITE III. Table 2 illustrates the complementarity of the nucleotide sequences of PLA2G2D BINDING SITE, designated SEQ ID:14773, to the nucleotide sequence of VGAM246 RNA, herein designated VGAM RNA, also designated SEQ ID:2957.

Another function of VGAM246 is therefore inhibition of Phospholipase A2, Group IID (PLA2G2D, Accession NM_012400), a gene which is involved in phospholipid digestion, remodeling of cell membranes, and host defense, as well as pathophysiologic processes. Accordingly, utilities of VGAM246 include diagnosis, prevention and treatment of diseases and clinical conditions associated with PLA2G2D. The function of PLA2G2D and its association with various diseases and clinical conditions, has been established by previous studies, as described hereinabove with reference to VGAM74. Complexin 1 (CPLX1, Accession NM_006651) is another VGAM246 host target gene. CPLX1 BINDING SITE is HOST TARGET binding site found in the 3' untranslated region of mRNA encoded by CPLX1, corresponding to a HOST TARGET binding site such as BINDING SITE I, BINDING SITE II or BINDING SITE III. Table 2 illustrates the complementarity of the nucleotide sequences of CPLX1 BINDING SITE, designated SEQ ID:13451, to the nucleotide sequence of VGAM246 RNA, herein designated VGAM RNA, also designated SEQ ID:2957.

Another function of VGAM246 is therefore inhibition of Complexin 1 (CPLX1, Accession NM_006651). Accordingly, utilities of VGAM246 include diagnosis, prevention and treatment of diseases and clinical conditions associated with CPLX1. DKFZP566K1924 (Accession XM_057469) is another VGAM246 host target gene. DKFZP566K1924 BINDING SITE is HOST TARGET binding site found in the 5' untranslated region of mRNA encoded by DKFZP566K1924, corresponding to a HOST TARGET binding site such as BINDING SITE I, BINDING SITE II or BINDING SITE III. Table 2 illustrates the complementarity of the nucleotide sequences of DKFZP566K1924 BINDING SITE, designated SEQ ID:36519, to the nucleotide sequence of VGAM246 RNA, herein designated VGAM RNA, also designated SEQ ID:2957.

Another function of VGAM246 is therefore inhibition of DKFZP566K1924 (Accession XM_057469). Accordingly, utilities of VGAM246 include diagnosis, prevention and treatment of diseases and clinical conditions associated with DKFZP566K1924. PAX Transcription Activation Domain Interacting Protein 1 Like (PAXIP1L, Accession XM_046538) is another VGAM246 host target gene. PAXIP1L BINDING SITE is HOST TARGET binding site found in the 3' untranslated region of mRNA encoded by PAXIP1L, corresponding to a HOST TARGET binding site such as BINDING SITE I, BINDING SITE II or BINDING SITE III. Table 2 illustrates the complementarity of the nucleotide sequences of PAXIP1L BINDING SITE, designated SEQ ID:34739, to the nucleotide sequence of VGAM246 RNA, herein designated VGAM RNA, also designated SEQ ID:2957.

Another function of VGAM246 is therefore inhibition of PAX Transcription Activation Domain Interacting Protein 1 Like (PAXIP1L, Accession XM_046538). Accordingly, utilities of VGAM246 include diagnosis, prevention and treatment of diseases and clinical conditions associated with PAXIP1L. LOC147791 (Accession XM_097293) is another VGAM246 host target gene. LOC147791 BINDING SITE is HOST TARGET binding site found in the 3' untranslated region of mRNA encoded by LOC147791, corresponding to a HOST TARGET binding site such as BINDING SITE I, BINDING SITE II or BINDING SITE III. Table 2 illustrates the complementarity of the nucleotide sequences of LOC147791 BINDING SITE, designated SEQ ID:40858, to the nucleotide sequence of VGAM246 RNA, herein designated VGAM RNA, also designated SEQ ID:2957.

Another function of VGAM246 is therefore inhibition of LOC147791 (Accession XM_097293). Accordingly, utilities of VGAM246 include diagnosis, prevention and treatment of diseases and clinical conditions associated with LOC147791. LOC149296 (Accession XM_086481) is another VGAM246 host target gene. LOC149296 BINDING SITE is HOST TARGET binding site found in the 5' untranslated region of mRNA encoded by LOC149296, corresponding to a HOST TARGET binding site such as BINDING SITE I, BINDING SITE II or BINDING SITE III. Table 2 illustrates the complementarity of the nucleotide sequences of LOC149296 BINDING SITE, designated SEQ ID:38695, to the nucleotide sequence of VGAM246 RNA, herein designated VGAM RNA, also designated SEQ ID:2957.

Another function of VGAM246 is therefore inhibition of LOC149296 (Accession XM_086481). Accordingly, utilities of VGAM246 include diagnosis, prevention and treatment of diseases and clinical conditions associated with LOC149296. FIG. 1 further provides a conceptual description of a novel bioinformatically detected viral gene of the present invention, referred to here as Viral Genomic Address Messenger 247 (VGAM247) viral gene, which modulates expression of respective host target genes thereof, the function and utility of which host target genes is known in the art.

VGAM247 is a novel bioinformatically detected regulatory, non protein coding, viral micro RNA (miRNA) gene. The method by which VGAM247 was detected is described hereinabove with reference to FIGS. 1-8.

VGAM247 gene, herein designated VGAM GENE, is a viral gene contained in the genome of Callitrichine Herpesvirus 3. VGAM247 host target gene, herein designated VGAM HOST TARGET GENE, is a human gene contained in the human genome.

VGAM247 gene encodes a VGAM247 precursor RNA, herein designated VGAM PRECURSOR RNA. Similar to other miRNA genes, and unlike most ordinary genes, VGAM247 precursor RNA does not encode a protein. A nucleotide sequence identical or highly similar to the nucleotide sequence of VGAM247 precursor RNA is designated SEQ ID:233, and is provided hereinbelow with reference to the sequence listing part. Nucleotide sequence SEQ ID:233 is located at position 25823 relative to the genome of Callitrichine Herpesvirus 3.

VGAM247 precursor RNA folds onto itself, forming VGAM247 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM247 folded precursor RNA into VGAM247 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM247 RNA is designated SEQ ID:2958, and is provided hereinbelow with reference to the sequence listing part.

VGAM247 host target gene, herein designated VGAM HOST TARGET GENE, encodes a corresponding messenger RNA, VGAM247 host target RNA, herein designated VGAM HOST TARGET RNA. VGAM247 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM247 RNA, herein designated VGAM RNA, binds complementarily to one or more host target binding sites located in untranslated regions of VGAM247 host target RNA, herein designated VGAM HOST TARGET RNA. This complementary binding is due to the fact that the nucleotide sequence of VGAM247 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM247 RNA, herein designated VGAM RNA, may have a different number of host target binding sites in untranslated regions of a VGAM247 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM247 RNA, herein designated VGAM RNA, to host target binding sites on VGAM247 host target RNA, herein designated VGAM HOST TARGET RNA, such as BINDING SITE I, BINDING SITE II and BINDING SITE III, inhibits translation of VGAM247 host target RNA into VGAM247 host target protein, herein designated VGAM HOST TARGET PROTEIN. VGAM host target protein is therefore outlined by a broken line.

It is appreciated that VGAM247 host target gene, herein designated VGAM HOST TARGET GENE, in fact represents a plurality of VGAM247 host target genes. The mRNA of each one of this plurality of VGAM247 host target genes comprises one or more host target binding sites, each having a nucleotide sequence which is at least partly complementary to VGAM247 RNA, herein designated VGAM RNA, and which when bound by VGAM247 RNA causes inhibition of translation of respective one or more VGAM247 host target proteins.

It is further appreciated by one skilled in the art that the mode of translational inhibition illustrated by FIG. 1 with specific reference to translational inhibition exerted by VGAM247 gene, herein designated VGAM GENE, on one or more VGAM247 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM247 is inhibition of expression of host target genes, as part of a novel viral mechanism of attacking a host. Accordingly, utilities of VGAM247 include diagnosis, prevention and treatment of viral infection by Callitrichine Herpesvirus 3. Specific functions, and accordingly utilities, of VGAM247 correlate with, and may be deduced from, the identity of the host target genes which VGAM247 binds and inhibits, and the function of these host target genes, as elaborated hereinbelow.

Nucleotide sequences of the VGAM247 precursor RNA, herein designated VGAM PRECURSOR RNA, and of the 'diced' VGAM247 RNA, herein designated VGAM RNA, and a schematic representation of the secondary folding of VGAM247 folded precursor RNA, herein designated VGAM FOLDED PRECURSOR RNA, of VGAM247 are further described hereinbelow with reference to Table 1.

Nucleotide sequences of host target binding sites, such as BINDING SITE-I, BINDING SITE-II and BINDING SITE-III of FIG. 1, found on VGAM247 host target RNA, and schematic representation of the complementarity of each of these host target binding sites to VGAM247 RNA, herein designated VGAM RNA, are described hereinbelow with reference to Table 2.

As mentioned hereinabove with reference to FIG. 1, a function of VGAM247 gene, herein designated VGAM is inhibition of expression of VGAM247 target genes. It is appreciated that specific functions, and accordingly utilities, of VGAM247 correlate with, and may be deduced from, the identity of the target genes which VGAM247 binds and inhibits, and the function of these target genes, as elaborated hereinbelow.

Amyloid Beta (A4) Precursor Protein-binding, Family A, Member 1 (X11) (APBA1, Accession XM_046018) is a VGAM247 host target gene. APBA1 BINDING SITE is HOST TARGET binding site found in the 3' untranslated region of mRNA encoded by APBA1, corresponding to a HOST TARGET binding site such as BINDING SITE I, BINDING SITE II or BINDING SITE III. Table 2 illustrates the complementarity of the nucleotide sequences of APBA1 BINDING SITE, designated SEQ ID:34647, to the nucleotide sequence of VGAM247 RNA, herein designated VGAM RNA, also designated SEQ ID:2958.

A function of VGAM247 is therefore inhibition of Amyloid Beta (A4) Precursor Protein-binding, Family A, Member 1 (X11) (APBA1, Accession XM_046018), a gene which stabilises APP and inhibits production of proteolytic APP fragments. Accordingly, utilities of VGAM247 include diagnosis, prevention and treatment of diseases and clinical conditions associated with APBA1. The function of APBA1 has been established by previous studies. Abnormal processing of the membrane-spanning amyloid precursor protein (APP; 104760), resulting in the production of increased amounts of fibrillogenic beta-amyloid peptide (OMIM Ref. No. A-beta), is considered to be one of the key metabolic events underlying Alzheimer disease (OMIM Ref. No. 104300). One pathway for A-beta production involves the reinternalization of membrane-bound APP into lysosomes where APP containing intact A-beta are generated. In common with a number of cell surface receptors, the C-terminal cytoplasmic domain of APP contains an asn-pro-thr-tyr (NPTY) motif that mediates re-internalization via clathrin-coated pits (Chen et al., 1990). This motif has also been demonstrated to be a consensus sequence for binding to phosphotyrosine-binding/-interacting domain (PTB)-bearing proteins (van der Geer and Pawson, 1995). Several groups demonstrated that the cytoplasmic domain of APP binds to 4 human PTB proteins: X11, X11-like (APBA2; 602712), Fe65 (APBB1; 602709), and Fe65-like (APBB2; 602710). PTB-domain proteins are believed to be involved in signal transduction processes, and the interaction of APP with the 4 human PTB proteins suggest a role for APP in such signal transaction mechanisms. Furthermore, as the 4 proteins interact with the YENPTY motif in APP, these PTB proteins may modulate processing of APP and hence formation of A-beta. Blanco et al. (1998) pointed out that it is generally agreed that there are as yet unidentified susceptibility genes for Alzheimer disease. The genes APBA1, APBA2, APBB1, and APBB2 represent such candidate genes. By searching for proteins that bind to Munc18-1 (OMIM Ref. No. 602926), Okamoto and Sudhof (1997) isolated rat cDNAs encoding Mint1 and Mint2. They determined the full-length human MINT1 cDNA sequence (GenBank AF029106) using human MINT1 ESTs. The deduced 837-amino acid MINT1 protein contains an N-terminal domain that binds to Munc18-1, a middle phosphotyrosine-binding (PTB) domain that binds to phosphatidylinositol phosphates, and 2 C-terminal PDZ domains. The rat Mint1 protein is largely membrane-bound and copurifies with synaptic plasma membranes, but it is not a component of synaptic vesicles. The authors suggested that in the brain Mint1 is part of a multimeric complex containing Munc18-1 and syntaxin-1 (OMIM Ref. No. 186590) that likely functions as an intermediate in synaptic vesicle docking/fusion.

Full details of the abovementioned studies are described in the following publications, the disclosure of which are hereby incorporated by reference:

Blanco, G.; Irving, N. G.; Brown, S. D. M.; Miller, C. C. J.; McLoughlin, D. M.: Mapping of the human and murine X11-like genes (APBA2 and Apba2), the murine Fe65 gene (Apbb1), and the human Fe65-like gene (APBB2): genes encoding phosphotyrosine-binding domain proteins that interact with the Alzheimer's disease amyloid precursor protein. Mammalian Genome 9:473-475, 1998; and Okamoto, M.; Sudhof, T. C.: Mints, Munc18-interacting proteins in synaptic vesicle exocytosis. J. Biol. Chem. 272: 31459-31464, 1997.

Further studies establishing the function and utilities of APBA1 are found in John Hopkins OMIM database record ID 602414, and in sited publications numbered 1019-1023, 9589, 102 and 1455 listed in the bibliography section hereinbelow, which are also hereby incorporated by reference. Bone Morphogenetic Protein 1 (BMP1, Accession NM_006132) is another VGAM247 host target gene. BMP1 BINDING SITE is HOST TARGET binding site found in the 3' untranslated region of mRNA encoded by BMP1, corresponding to a HOST TARGET binding site such as BINDING SITE I, BINDING SITE II or BINDING SITE III. Table 2 illustrates the complementarity of the nucleotide sequences of BMP1 BINDING SITE, designated SEQ ID:12773, to the nucleotide sequence of VGAM247 RNA, herein designated VGAM RNA, also designated SEQ ID:2958.

Another function of VGAM247 is therefore inhibition of Bone Morphogenetic Protein 1 (BMP1, Accession NM_006132), a gene which cleaves procollagens leading to formation of extracellular matrix. Accordingly, utilities of VGAM247 include diagnosis, prevention and treatment of diseases and clinical conditions associated with BMP1. The function of BMP1 has been established by previous studies. The BMP1 locus encodes a protein that is capable of inducing formation of cartilage in vivo (Wozney et al., 1988). Although other bone morphogenetic proteins are members of the TGF-beta (OMIM Ref. No. 190180) superfamily, BMP1 encodes a novel protein that is not closely related to other known growth factors. Kessler et al. (1996) showed that recombinantly expressed BMP1 and purified procollagen C proteinase (PCP), a secreted metalloprotease requiring calcium and needed for cartilage and bone formation, are, in fact, identical. PCP cleaves the C-terminal propeptides of procollagen I (OMIM Ref. No. 120150), II (OMIM Ref. No. 120140), and III (OMIM Ref. No. 120180) and its activity is increased by the procollagen C-endopeptidase enhancer protein (OMIM Ref. No. 600270). Reddi (1996) discussed the significance of the finding that BMP1 is the same as procollagen C-proteinase.

Full details of the abovementioned studies are described in the following publications, the disclosure of which are hereby incorporated by reference:

Wozney, J. M.; Rosen, V.; Celeste, A. J.; Mitsock, L. M.; Whitters, M. J.; Kriz, R. W.; Hewick, R. M.; Wang, E. A.: Novel regulators of bone formation: molecular clones and activities. Science 242:1528-1534, 1988; and Kessler, E.; Takahara, K.; Biniaminov, L.; Brusel, M.; Greenspan, D.: Bone morphogenic protein-1: the type I procollagen C-proteinase. Science 271: 360-362, 1996.

Further studies establishing the function and utilities of BMP1 are found in John Hopkins OMIM database record ID 112264, and in sited publications numbered 11640-11643, 1909, 1912, 11629-191 and 11630 listed in the bibliography section hereinbelow, which are also hereby incorporated by reference. Calpain 10 (CAPN10, Accession NM_023088) is another VGAM247 host target gene. CAPN10 BINDING SITE is HOST TARGET binding site found in the 3' untranslated region of mRNA encoded by CAPN10, corresponding to a HOST TARGET binding site such as BINDING SITE I, BINDING SITE II or BINDING SITE III. Table 2 illustrates the complementarity of the nucleotide sequences of CAPN10 BINDING SITE, designated SEQ ID:23354, to the nucleotide sequence of VGAM247 RNA, herein designated VGAM RNA, also designated SEQ ID:2958.

Another function of VGAM247 is therefore inhibition of Calpain 10 (CAPN10, Accession NM_023088), a gene which catalyzes limited proteolysis of substrates involved in cytoskeletal remodelling and signal tranduction. Accordingly, utilities of VGAM247 include diagnosis, prevention and treatment of diseases and clinical conditions associated with CAPN10. The function of CAPN10 has been established by previous studies. The results of Horikawa et al. (2000) suggested a novel pathway involved in the pathophysiology of diabetes, one that may include, in addition to calpain-10, its substrates, inhibitors, and activators. Calpain-10 may represent the third example of a protease contributing to the development of diabetes, the others being prohormone-processing carboxypeptidase E (OMIM Ref. No. 114855) and prohormone convertase-1 (OMIM Ref. No. 162150), both of which are associated with diabetes and obesity. Horikawa et al. (2000) found a single-nucleotide polymorphism (SNP) associated with noninsulin-dependent diabetes mellitus (OMIM Ref. No. 125853). The G/A variation involved nucleotide 4852 of the genomic sequence of the CAPN10 gene and was located in intron 3, 746 bp downstream of the splice donor site and 176 bp upstream of the splice acceptor site. This and 2 other polymorphisms in the CAPN10 gene refined a haplotype that was associated with greatest risk of diabetes in Mexican-Americans, as well as in Finnish and German populations.

Full details of the abovementioned studies are described in the following publications, the disclosure of which are hereby incorporated by reference:

Horikawa, Y.; Oda, N.; Cox, N. J.; Li, X.; Orho-Melander, M.; Hara, M.; Hinokio, Y.; Lindner, T. H.; Mashima, H.; Schwarz, P. E. H.; del Bosque-Plata, L.; Horikawa, Y.; and 14 others. Genetic variation in the gene encoding calpain-10 is associated with type 2 diabetes mellitus. Nature Genet. 26:163-175, 2000; and Hanis, C. L.; Boerwinkle, E.; Chakraborty, R.; Ellsworth, D. L.; Concannon, P.; Stirling, B.; Morrison, V. A.; Wapelhorst, B.; Spielman, R. S.; Gogolin-Ewens, K. J.; Shephard, J. M.; Wi.

Further studies establishing the function and utilities of CAPN10 are found in John Hopkins OMIM database record ID 605286, and in sited publications numbered 1330-1331, 6979-6981, 698 and 6982-6983 listed in the bibliography section hereinbelow, which are also hereby incorporated by reference. Cyclin-dependent Kinase Inhibitor 2B (p15, inhibits CDK4) (CDKN2B, Accession NM_078487) is another VGAM247 host target gene. CDKN2B BINDING SITE is HOST TARGET binding site found in the 5" untranslated region of mRNA encoded by CDKN2B, corresponding to a HOST TARGET binding site such as BINDING SITE I, BINDING SITE II or BINDING SITE III. Table 2 illustrates the complementarity of the nucleotide sequences of CDKN2B BINDING SITE, designated SEQ ID:27809, to the nucleotide sequence of VGAM247 RNA, herein designated VGAM RNA, also designated SEQ ID:2958.

Another function of VGAM247 is therefore inhibition of Cyclin-dependent Kinase Inhibitor 2B (p15, inhibits CDK4) (CDKN2B, Accession NM_078487). Accordingly, utilities of VGAM247 include diagnosis, prevention and treatment of diseases and clinical conditions associated with CDKN2B. Cyclin-dependent Kinase Inhibitor 2D (p19, inhibits CDK4) (CDKN2D, Accession NM_001800) is another VGAM247 host target gene. CDKN2D BINDING SITE is HOST TARGET binding site found in the 5' untranslated region of mRNA encoded by CDKN2D, corresponding to a HOST TARGET binding site such as BINDING SITE I, BINDING SITE II or BINDING SITE III. Table 2 illustrates the complementarity of the nucleotide sequences of CDKN2D BINDING SITE, designated SEQ ID:7554, to the nucleotide sequence of VGAM247 RNA, herein designated VGAM RNA, also designated SEQ ID:2958.

Another function of VGAM247 is therefore inhibition of Cyclin-dependent Kinase Inhibitor 2D (p19, inhibits CDK4) (CDKN2D, Accession NM_001800), a gene which interacts strongly with cdk4 and cdk6. Accordingly, utilities of VGAM247 include diagnosis, prevention and treatment of diseases and clinical conditions associated with CDKN2D. The function of CDKN2D has been established by previous studies. Cyclins are important in regulating the cell cycle through their formation of enzymatic complexes with various cyclin-dependent kinases. The D type cyclins complex with CDK4 (OMIM Ref. No. 123829) and CDK6 to govern progression through the G1 phase of the cell cycle and later are involved with inactivating phosphorylation of the RB protein (OMIM Ref. No. 180200) which results in release of RB-associated transcription factors that are needed for entry into S phase (Okuda et al., 1995). The activity of the cyclin D-dependent kinases is, in part, controlled by inhibitors such as the INK4 family (which includes INK4a (CDKN2A; 600160), 4b (CDKN2B; 600431), 4c (OMIM Ref. No. CDKN2C), and 4d (OMIM Ref. No. CDKN2D)). INK4a has been shown to act by competing with CDK4 and CDK6 and functions as a tumor suppressor in a variety of cancers. The INK4d protein was first identified in a yeast 2-hybrid system screened for CDK4 binding proteins (Hirai et al., 1995). The mouse INK4d protein interacts with cdk6 as well. In fibroblasts and macrophages it is rapidly induced at the G1-to-S transition. Overexpression of INK4d caused NIH 3T3 cells to arrest in G1 phase and inhibited cyclin D1-CDK4 kinase activity (Hirai et al., 1995). Okuda et al. (1995) described the cloning and mapping of the human INK4d gene (OMIM Ref. No. CDKN2D). The predicted 166-amino acid protein is 86% identical to the mouse protein and about 45% identical to other human INK4 family members. Northern blots showed that the 1.4-kb transcript is ubiquitously expressed with the highest levels in tissues with the most rapidly dividing cells. Lowest expression occurs at mid G1 phase and is highest during S phase. Okuda et al. (1995) obtained a P1-phage genomic clone including the gene and mapped it by fluorescence in situ hybridization to 19p13

Full details of the abovementioned studies are described in the following publications, the disclosure of which are hereby incorporated by reference:

Hirai, H.; Roussel, M. F.; Kato, J.-Y.; Ashmun, R. A.; Sherr, C. J.: Novel INK4 proteins, p19 and p18, are specific inhibitors of cyclin D-dependent kinases CDK4 and CDK6. Molec. Cell. Biol. 15:2672-2681, 1995; and Okuda, T.; Hirai, H.; Valentine, V. A.; Shurtleff, S. A.; Kidd, V. J.; Lahti, J. M.; Sherr, C. J.; Downing, J. R.: Molecular cloning, expression pattern, and chromosomal localization o.

Further studies establishing the function and utilities of CDKN2D are found in John Hopkins OMIM database record ID 600927, and in sited publications numbered 6859-6860 listed in the bibliography section hereinbelow, which are also hereby incorporated by reference. Dishevelled Associated Activator of Morphogenesis 2 (DAAM2, Accession XM_166434) is another VGAM247 host target gene. DAAM2 BINDING SITE is HOST TARGET binding site found in the 3' untranslated region of mRNA encoded by DAAM2, corresponding to a HOST TARGET binding site such as BINDING SITE I, BINDING SITE II or BINDING SITE III. Table 2 illustrates the complementarity of the nucleotide sequences of DAAM2 BINDING SITE, designated SEQ ID:44330, to the nucleotide sequence of VGAM247 RNA, herein designated VGAM RNA, also designated SEQ ID:2958.

Another function of VGAM247 is therefore inhibition of Dishevelled Associated Activator of Morphogenesis 2 (DAAM2, Accession XM_166434), a gene which controls cell polarity and movement during development. Accordingly, utilities of VGAM247 include diagnosis, prevention and treatment of diseases and clinical conditions associated with DAAM2. The function of DAAM2 has been established by previous studies. By sequencing randomly selected cDNAs corresponding to relatively long transcripts from brain, Nagase et al. (1997) identified a cDNA which they designated KIAA0381. The KIAA0381 cDNA encodes an 864-amino acid protein predicted to be involved in cell division. RT-PCR analysis detected expression of KIAA0381 in most tissues tested. Wnt (see OMIM Ref. No. 164975) signaling via the frizzled receptor (Fz; OMIM Ref. No. 600667) controls cell polarity and movement during development. Habas et al. (2001) reported that in human cells and during Xenopus embryogenesis, Wnt/Fz signaling activates the small GTPase Rho (OMIM Ref. No. 165390), a key regulator of cytoskeleton architecture. Wnt/Fz activation of Rho requires the cytoplasmic protein dishevelled (DVL; OMIM Ref. No. 601365) and a novel formin (see OMIM Ref. No. 136535) homology (FH) protein that they identified and named DAAM1 (OMIM Ref. No. 606626). Habas et al. (2001) identified DAAM2, which is identical to KIAA0381, as a protein that is closely related to DAAM1.

Full details of the abovementioned studies are described in the following publications, the disclosure of which are hereby incorporated by reference:

Habas, R.; Kato, Y.; He, X.: Wnt/Frizzled activation of Rho regulates vertebrate gastrulation and requires a novel Formin homology protein Daam1. Cell 107:843-854, 2001; and Nagase, T.; Ishikawa, K.; Nakajima, D.; Ohira, M.; Seki, N.; Miyajima, N.; Tanaka, A.; Kotani, H.; Nomura, N.; Ohara, O.: Prediction of the coding sequences of unidentified human gene.

Further studies establishing the function and utilities of DAAM2 are found in John Hopkins OMIM database record ID 606627, and in sited publications numbered 4522 listed in the bibliography section hereinbelow, which are also hereby incorporated by reference. Fibronectin Leucine Rich Transmembrane Protein 2 (FLRT2, Accession NM_013231) is another VGAM247 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14882, to the nucleotide sequence of VGAM247 RNA, herein designated VGAM RNA, also designated SEQ ID:2958.

Another function of VGAM247 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM247 include diagnosis, prevention and treatment of diseases and clinical conditions associated with FLRT2. The function of FLRT2 has been established by previous studies. The FLRT family of proteins structurally resembles small leucine-rich proteoglycans found in the extracellular matrix. By screening human brain cDNAs for the potential to encode proteins that are at least 50 kD, Ishikawa et al. (1997) isolated a FLRT2 cDNA, which they called KIAA0405. The deduced 660-amino acid full-length FLRT2 protein shares 25% amino acid sequence identity with the precursor of the alpha chain of human platelet glycoprotein Ib (GP1BA; OMIM Ref. No. 231200) across 180 residues. By SDS-PAGE, in vitro transcribed/translated FLRT2 had an apparent molecular mass of approximately 75 kD. RT-PCR detected FLRT2 expression in a number of human tissues, with highest expression in ovary and relatively high expression in brain and pancreas. By searching a human EST database with portions of the FLRT1 protein (OMIM Ref. No. 604806) sequence, Lacy et al. (1999) identified ESTs encoding FLRT2. The full-length FLRT2 coding sequence encodes a predicted 660-amino acid protein containing a putative N-terminal signal sequence, 10 leucine-rich repeats (LRRs) flanked by N- and C-terminal cysteine-rich regions, a fibronectin-/collagen-like domain, a transmembrane domain, and an intracellular C-terminal tail. FLRT2 has 5 potential N-glycosylation sites in its extracellular region. FLRT2 shares 44% amino acid sequence identity with FLRT3 (OMIM Ref. No. 604808) and 41% identity with FLRT1. Recombinant FLRT2 expressed in SF9 insect cells and monkey COS-1 cells migrated as an 85-kD protein on SDS-polyacrylamide gels. The authors demonstrated that FLRT2 is glycosylated. Northern blot analysis of a variety of human adult tissues detected a 7.5-kb FLRT2 transcript that was expressed abundantly in pancreas and less abundantly in skeletal muscle, brain, and heart. Lacy et al. (1999) suggested that FLRT2 functions in cell adhesion and/or receptor signaling. By analysis of a radiation hybrid mapping panel, Ishikawa et al. (1997) mapped the FLRT2 gene to chromosome 14. Lacy et al. (1999) noted that a UniGene cluster corresponding to the FLRT2 gene has been mapped to 14q24-q32.

Full details of the abovementioned studies are described in the following publications, the disclosure of which are hereby incorporated by reference:

Ishikawa, K.; Nagase, T.; Nakajima, D.; Seki, N.; Ohira, M.; Miyajima, N.; Tanaka, A.; Kotani, H.; Nomura, N.; Ohara, O.: Prediction of the coding sequences of unidentified human genes. VIII. 78 new cDNA clones from brain which code for large proteins in vitro. DNA Res. 4:307-313, 1997; and Lacy, S. E.; Bonnemann, C. G.; Buzney, E. A.; Kunkel, L. M.: Identification of FLRT1, FLRT2, and FLRT3: a novel family of transmembrane leucine-rich repeat proteins. Genomics 62:417-4.

Further studies establishing the function and utilities of FLRT2 are found in John Hopkins OMIM database record ID 604807, and in sited publications numbered 110 and 4385 listed in the bibliography section hereinbelow, which are also hereby incorporated by reference. Glypican 6 (GPC6, Accession NM_005708) is another VGAM247 host target gene. GPC6 BINDING SITE is HOST TARGET binding site found in the 5' untranslated region of mRNA encoded by GPC6, corresponding to a HOST TARGET binding site such as BINDING SITE I, BINDING SITE II or BINDING SITE III. Table 2 illustrates the complementarity of the nucleotide sequences of GPC6 BINDING SITE, designated SEQ ID:12261, to the nucleotide sequence of VGAM247 RNA, herein designated VGAM RNA, also designated SEQ ID:2958.

Another function of VGAM247 is therefore inhibition of Glypican 6 (GPC6, Accession NM_005708), a gene which may play a role in growth control and differentation. Accordingly, utilities of VGAM247 include diagnosis, prevention and treatment of diseases and clinical conditions associated with GPC6. The function of GPC6 has been established by previous studies. By searching an EST database for glypican-related cDNA sequences and using 5-prime RACE on a human fetal brain cDNA library, Veugelers et al. (1999) identified a novel glypican, which they designated glypican-6. The GPC6 gene, which contains 9 exons, encodes a 555-amino acid protein with a molecular mass of approximately 65 kD. The GPC6 protein is 63% identical to GPC4 (OMIM Ref. No. 300168). Like all glypicans, GPC6 starts and terminates with signal peptide-like sequences. The N-terminal sequence is predicted to be required for membrane translocation, and the C-terminal sequence supports the temporary membrane anchoring and subsequent glypiation of the protein. A motif that promotes the assembly of heparan sulfate in proteoglycans is also found at the C-terminal end. Northern blot analysis revealed ubiquitous expression of GPC6 in all fetal and nearly all adult tissues, with the exception of thymus and peripheral blood leukocytes. A major mRNA species of 6.2 kb was most abundant in the ovary, with high expression also in liver, kidney, small intestine, and colon (Paine-Saunders et al., 1999; Veugelers et al., 1999). In situ hybridization studies localized glypican-6 predominantly to mesenchymal tissues in the developing mouse embryo. Veugelers et al. (1999) suggested that growth factor signaling in these tissues might be regulated in part by GPC6 on the cell surface. Paine-Saunders et al. (1999) and Veugelers et al. (1999) mapped the GPC6 gene to 13q32 in a tight cluster with GPC5 (OMIM Ref. No. 602446) by radiation hybrid techniques and FISH, respectively. The GPC6/GPC5 cluster is analogous to the GPC3/GPC4 (OMIM Ref. No. 300168) cluster on Xq26.

Full details of the abovementioned studies are described in the following publications, the disclosure of which are hereby incorporated by reference:

Paine-Saunders, S.; Viviano, B. L.; Saunders, S.: GPC6, a novel member of the glypican gene family, encodes a product structurally related to GPC4 and is colocalized with GPC5 on human chromosome 13. Genomics 57: 455-458, 1999; and Veugelers, M.; De Cat, B.; Ceulemans, H.; Bruystens, A. M.; Coomans, C.; Durr, J.; Vermeesch, J.; Marynen, P.; David, G.: Glypican-6, a new member of the glypican family of cell surfa.

Further studies establishing the function and utilities of GPC6 are found in John Hopkins OMIM database record ID 604404, and in sited publications numbered 7442-7443 listed in the bibliography section hereinbelow, which are also hereby incorporated by reference. Lamin B Receptor (LBR, Accession XM_001795) is another VGAM247 host target gene. LBR BINDING SITE is HOST TARGET binding site found in the 3' untranslated region of mRNA encoded by LBR, corresponding to a HOST TARGET binding site such as BINDING SITE I, BINDING SITE II or BINDING SITE III. Table 2 illustrates the complementarity of the nucleotide sequences of LBR BINDING SITE, designated SEQ ID:29853, to the nucleotide sequence of VGAM247 RNA, herein designated VGAM RNA, also designated SEQ ID:2958.

Another function of VGAM247 is therefore inhibition of Lamin B Receptor (LBR, Accession XM_001795). Accordingly, utilities of VGAM247 include diagnosis, prevention and treatment of diseases and clinical conditions associated with LBR. LFG (Accession XM_084780) is another VGAM247 host target gene. LFG BINDING SITE is HOST TARGET binding site found in the 3' untranslated region of mRNA encoded by LFG, corresponding to a HOST TARGET binding site such as BINDING SITE I, BINDING SITE II or BINDING SITE III. Table 2 illustrates the complementarity of the nucleotide sequences of LFG BINDING SITE, designated SEQ ID:37696, to the nucleotide sequence of VGAM247 RNA, herein designated VGAM RNA, also designated SEQ ID:2958.

Another function of VGAM247 is therefore inhibition of LFG (Accession XM_084780). Accordingly, utilities of VGAM247 include diagnosis, prevention and treatment of diseases and clinical conditions associated with LFG. V-yes-1 Yamaguchi Sarcoma Viral Related Oncogene Homolog (LYN, Accession NM_002350) is another VGAM247 host target gene. LYN BINDING SITE is HOST TARGET binding site found in the 5' untranslated region of mRNA encoded by LYN, corresponding to a HOST TARGET binding site such as BINDING SITE I, BINDING SITE II or BINDING SITE III. Table 2 illustrates the complementarity of the nucleotide sequences of LYN BINDING SITE, designated SEQ ID:8154, to the nucleotide sequence of VGAM247 RNA, herein designated VGAM RNA, also designated SEQ ID:2958.

Another function of VGAM247 is therefore inhibition of V-yes-1 Yamaguchi Sarcoma Viral Related Oncogene Homolog (LYN, Accession NM_002350), a gene which is a Tyrosine kinase with similarity to murine tyrosine kinase p56lck; similar to v-yes protein and the gene products of v-fgr and v-src. Accordingly, utilities of VGAM247 include diagnosis, prevention and treatment of diseases and clinical conditions associated with LYN. The function of LYN has been established by previous studies. Parravicini et al. (2002) noted that Lyn deficiency impairs some mast cell functions, but degranulation and cytokine production are intact. In Gab2 (OMIM Ref. No. 606203)-deficient mice, on the other hand, degranulation and cytokine production are impaired. Using immunoblot analysis, they showed that although Lyn is essential for Syk (OMIM Ref. No. 600085) activation and Lat (OMIM Ref. No. 602354) phosphorylation after Fcer1 (see OMIM Ref. No. FCER1G; 147139) aggregation, neither Lyn nor Lat are necessary for Gab2 phosphorylation. RT-PCR and coimmunoprecipitation analyses demonstrated abundant Fyn (OMIM Ref. No. 137025) expression in mast cells and an association with Gab2. In cells lacking Fyn, neither Gab2 nor Akt (OMIM Ref. No. 164730) were phosphorylated. Functional analysis showed that Lyn -/- mast cells exhibited hyperdegranulation and enhanced PI3K (see OMIM Ref. No. 601232) activity and Akt phosphorylation, whereas in Fyn -/- mast cells the degranulation response was inhibited. The inhibition was associated with decreased binding of PI3K with Gab2. Parravicini et al. (2002) observed that the degranulation response was independent of Fcer1 stimulation in Fyn-deficient mast cells and that degranulation was dependent on PI3K in wildtype and mutant cell lines. The degranulation response was dependent on a rise in intracellular calcium that was inhibited in Lyn-deficient mast cells but intact in Fyn-deficient cells. Degranulation proceeded in Lyn -/- cells due to increased activation and constitutive phosphorylation of the calcium-independent protein kinase C delta isoform (PRKCD; 176977). Parravicini et al. (2002) concluded that Fyn- and Lyn-initiated pathways synergize in late events at the level of protein kinase C and calcium, respectively, to regulate mast cell degranulation. Animal model experiments lend further support to the function of LYN. Hibbs et al. (1995) demonstrated that mice homozygous for a disruption of the Lyn locus display abnormalities associated with the B-lymphocyte lineage and in mast cell function. Despite reduced numbers of recirculating B lymphocytes, the homozygous deficient mice are immunoglobulin M hyperglobulinemic. Lyn-deficient mice show IgM hyperglobulinemia. Immune responses to T-independent and T-dependent antigens were affected. The deficient mice failed to mediate an allergic response to IgE cross-linking, indicating that activation of Lyn plays an indispensable role in signaling by the high-affinity IgE receptor (FCER). Homozygous deficient mice had circulating autoreactive antibodies, and many showed severe glomerulonephritis caused by the deposition of IgG immune complexes in the kidney, a pathology reminiscent of systemic lupus erythematosus. Hibbs et al. (1995) stated that, collectively, these results implicated LYN as having an indispensable role in immunoglobulin-mediated signaling, particularly in establishing B cell tolerance. Harder et al. (2001) generated mice with a gain-of-function Lyn mutation (tyr508 to phe, which they referred to as 'up') analogous to the tyr527-to-phe activating mutation in the mouse Src gene (OMIM Ref. No. 190090) (Webster et al., 1995). Even aging mice with the Lyn up/up phenotype did not display hematologic malignancies, unlike Lyn -/- mice, which developed splenomegaly, increased myeloid progenitors, and monocyte/macrophage tumors. Biochemical analysis revealed that Lyn is essential in establishing ITIM (immunoreceptor tyrosine-based inhibitory motif)-dependent signaling and for the activation of specific protein tyrosine phosphatases within myeloid cells, which may underlie the susceptibility of Lyn -/- mice to tumorigenesis. Hasegawa et al. (2001) generated mice deficient in both Cd19 (OMIM Ref. No. 107265) and Lyn. Cd19 deficiency It is appreciated that the abovementioned animal model for LYN is acknowledged by those skilled in the art as a scientifically valid animal model, as can be further appreciated from the publications sited hereinbelow.

Full details of the abovementioned studies are described in the following publications, the disclosure of which are hereby incorporated by reference:

Harder, K. W.; Parsons, L. M.; Armes, J.; Evans, N.; Kountouri, N.; Clark, R.; Quillici, C.; Grail, D.; Hodgson, G. S.; Dunn, A. R.; Hibbs, M. L.: Gain- and loss-of-function Lyn mutant mice define a critical inhibitory role for Lyn in the myeloid lineage. Immunity 15:603-615, 2001; and Parravicini, V.; Gadina, M.; Kovarova, M.; Odom, S.; Gonzalez-Espinosa, C.; Furumoto, Y.; Saitoh, S.; Samelson, L. E.; O'Shea, J. J.; Rivera, J.: Fyn kinase initiates complementary signal.

Further studies establishing the function and utilities of LYN are found in John Hopkins OMIM database record ID 165120, and in sited publications numbered 2976, 4818, 510 and 5110-5111 listed in the bibliography section hereinbelow, which are also hereby incorporated by reference. Methyl-CpG Binding Domain Protein 3 (MBD3, Accession NM_003926) is another VGAM247 host target gene. MBD3 BINDING SITE is HOST TARGET binding site found in the 3' untranslated region of mRNA encoded by MBD3, corresponding to a HOST TARGET binding site such as BINDING SITE I, BINDING SITE II or BINDING SITE III. Table 2 illustrates the complementarity of the nucleotide sequences of MBD3 BINDING SITE, designated SEQ ID:10022, to the nucleotide sequence of VGAM247 RNA, herein designated VGAM RNA, also designated SEQ ID:2958.

Another function of VGAM247 is therefore inhibition of Methyl-CpG Binding Domain Protein 3 (MBD3, Accession NM_003926), a gene which are subunits of the NURD (nucleosome remodeling and histone deacetylase) complex. Accordingly, utilities of VGAM247 include diagnosis, prevention and treatment of diseases and clinical conditions associated with MBD3. The function of MBD3 has been established by previous studies. The MECP2 (OMIM Ref. No. 300005) and MBD1 (OMIM Ref. No. 156535) proteins bind specifically to methylated DNA via a methyl-CpG-binding domain (MBD). Both proteins can repress transcription and appear to be important in interpreting the signal that methylation of DNA represents. By searching an EST database for proteins containing an MBD-like motif, Hendrich and Bird (1998) identified human and mouse cDNAs encoding the 3 novel proteins MBD2 (OMIM Ref. No. 603547), MBD3, and MBD4 (OMIM Ref. No. 603574). The predicted 291-amino acid human MBD3 protein (GenBank AF072247) is 94% identical to mouse Mbd3. MBD3 failed to specifically bind methylated DNA in vitro. A green fluorescence protein (GFP)-MBD3 fusion protein showed diffuse nuclear staining in cells in which it was expressed at low levels, and accumulated in many nuclear foci in cells in which it was expressed at high levels. However, MBD3 did not appear to associate with the highly methylated major satellite DNA in mouse cells. The authors identified cDNAs representing an alternatively spliced mouse Mbd3 mRNA that lacks the coding sequence for the N-terminal half of the MBD. RT-PCR analysis of many mouse tissues indicated that this shorter message constitutes a significant fraction of total Mbd3 transcripts. Northern blot analysis detected Mbd3 transcripts in all mouse tissues tested. Zhang et al. (1999) showed that MTA2 (MTA1L1; 603947) and the 32-kD MBD3 protein are subunits of the NURD (nucleosome remodeling and histone deacetylase) complex (see OMIM Ref. No. MTA1; 603526). Immunoprecipitation analysis showed that MBD3 interacts with HDAC1 (OMIM Ref. No. 601241), RBBP4 (OMIM Ref. No. 602923), and RBBP7 (OMIM Ref. No. 602922), but not with MI2 (CHD4; 603277), suggesting that MBD3 is embedded within the NURD complex. The authors found that MTA2 directs the assembly of an active histone deacetylase complex and that the association of MTA2 with the complex requires MBD3. Gel mobility shift analysis determined that both NURD and MBD3 are unable to bind to methylated DNA in the absence of MBD2. Zhang et al. (1999) proposed that NURD is involved in the transcriptional repression of methylated DNA. Wade et al. (1999) also identified MTA1, MTA1L, and MBD3 as components of the NURD complex, which they referred to as the MI2 complex.

Full details of the abovementioned studies are described in the following publications, the disclosure of which are hereby incorporated by reference:

Zhang, Y.; Ng, H.-H.; Erdjument-Bromage, H; Tempst, P.; Bird, A.; Reinberg, D.: Analysis of the NuRD subunits reveals a histone deacetylase core complex and a connection with DNA methylation. Genes Dev. 13:1924-1935, 1999; and Hendrich, B.; Bird, A.: Identification and characterization of a family of mammalian methyl-CpG binding proteins. Molec. Cell. Biol. 18:6538-6547, 1998.

Further studies establishing the function and utilities of MBD3 are found in John Hopkins OMIM database record ID 603573, and in sited publications numbered 2226, 5359-5360, 506 and 5361 listed in the bibliography section hereinbelow, which are also hereby incorporated by reference. Megalencephalic Leukoencephalopathy with Subcortical Cysts 1 (MLC1, Accession NM_139202) is another VGAM247 host target gene. MLC1 BINDING SITE1 and MLC1 BINDING SITE2 are HOST TARGET binding sites found in untranslated regions of mRNA encoded by MLC1, corresponding to HOST TARGET binding sites such as BINDING SITE I, BINDING SITE II or BINDING SITE III. Table 2 illustrates the complementarity of the nucleotide sequences of MLC1 BINDING SITE1 and MLC1 BINDING SITE2, designated SEQ ID:29220 and SEQ ID:17526 respectively, to the nucleotide sequence of VGAM247 RNA, herein designated VGAM RNA, also designated SEQ ID:2958.

Another function of VGAM247 is therefore inhibition of Megalencephalic Leukoencephalopathy with Subcortical Cysts 1 (MLC1, Accession NM_139202). Accordingly, utilities of VGAM247 include diagnosis, prevention and treatment of diseases and clinical conditions associated with MLC1. Sialidase 3 (membrane sialidase) (NEU3, Accession NM_006656) is another VGAM247 host target gene. NEU3 BINDING SITE is HOST TARGET binding site found in the 3' untranslated region of mRNA encoded by NEU3, corresponding to a HOST TARGET binding site such as BINDING SITE I, BINDING SITE II or BINDING SITE III. Table 2 illustrates the complementarity of the nucleotide sequences of NEU3 BINDING SITE, designated SEQ ID:13455, to the nucleotide sequence of VGAM247 RNA, herein designated VGAM RNA, also designated SEQ ID:2958.

Another function of VGAM247 is therefore inhibition of Sialidase 3 (membrane sialidase) (NEU3, Accession NM_006656). Accordingly, utilities of VGAM247 include diagnosis, prevention and treatment of diseases and clinical conditions associated with NEU3. Podocalyxin-like (PODXL, Accession NM_005397) is another VGAM247 host target gene. PODXL BINDING SITE is HOST TARGET binding site found in the 3' untranslated region of mRNA encoded by PODXL, corresponding to a HOST TARGET binding site such as BINDING SITE I, BINDING SITE II or BINDING SITE III. Table 2 illustrates the complementarity of the nucleotide sequences of PODXL BINDING SITE, designated SEQ ID:11876, to the nucleotide sequence of VGAM247 RNA, herein designated VGAM RNA, also designated SEQ ID:2958.

Another function of VGAM247 is therefore inhibition of Podocalyxin-like (PODXL, Accession NM_005397), a gene which is an antiadhesin. Accordingly, utilities of VGAM247 include diagnosis, prevention and treatment of diseases and clinical conditions associated with PODXL. The function of PODXL has been established by previous studies. The renal glomerular epithelial cell, or podocyte, is a highly differentiated cell with characteristic interdigitating foot processes covering the outer aspect of the glomerular basement membrane. The foot processes are covered on their apical suface with a polyanionic glycocalyx, which is an essential element of the glomerular filter. Podocalyxin, a sialoglycoprotein, is thought to be a major component of this glycocalyx. By screening human renal cortex and heart cDNA libraries with a rabbit podocalyxin-like protein-1 (PCLP1) cDNA, Kershaw et al. (1997) cloned cDNAs encoding human PCLP, or PODXL. Northern blot analysis revealed that PODXL is expressed as a major 5.9-kb transcript and minor 4.4- and 9.6-kb transcripts in various tissues, with highest expression in kidney, pancreas, and heart. The predicted 528-amino acid protein has a 21-amino acid signal peptide, a transmembrane domain, and a highly acidic intracellular domain. The amino acid sequence of human PODXL is 48% identical to that of rabbit PCLP1, with 96% identity in the transmembrane and intracellular domains. The calculated molecular mass of PODXL is 54 kD. Western blot analysis of renal glomerular extracts showed that monoclonal antibodies against human PODXL recognize a 160/165-kD human PODXL doublet, rat podocalyxin, and rabbit PCLP1. Kershaw et al. (1997) suggested that the discrepancy between the calculated and observed masses of human PODXL is due to posttranslational modifications. By immunofluorescence of human kidney sections using antibodies against PODXL, Kershaw et al. (1997) found intense vascular endothelial cell and glomerular staining. Kershaw et al. (1997) mapped the human PODXL gene to 7q32-q33 by fluorescence in situ hybridization.

Full details of the abovementioned studies are described in the following publications, the disclosure of which are hereby incorporated by reference:

Kershaw, D. B.; Beck, S. G.; Wharram, B. L.; Wiggins, J. E.; Goyal, M.; Thomas, P. E.; Wiggins, R. C.: Molecular cloning and characterization of human podocalyxin-like protein: orthologous relationship to rabbit PCLP1 and rat podocalyxin. J. Biol. Chem. 272:15708-15714, 1997; and Kershaw, D. B.; Wiggins, J. E.; Wharram, B. L.; Wiggins, R. C.: Assignment of the human podocalyxin-like protein (PODXL) gene to 7q32-q33. Genomics 45:239-240, 1997.

Further studies establishing the function and utilities of PODXL are found in John Hopkins OMIM database record ID 602632, and in sited publications numbered 8749-8750 listed in the bibliography section hereinbelow, which are also hereby incorporated by reference. Solute Carrier Family 2 (facilitated glucose transporter), Member 3 (SLC2A3, Accession NM_006931) is another VGAM247 host target gene. SLC2A3 BINDING SITE is HOST TARGET binding site found in the 3' untranslated region of mRNA encoded by SLC2A3, corresponding to a HOST TARGET binding site such as BINDING SITE I, BINDING SITE II or BINDING SITE III. Table 2 illustrates the complementarity of the nucleotide sequences of SLC2A3 BINDING SITE, designated SEQ ID:13817, to the nucleotide sequence of VGAM247 RNA, herein designated VGAM RNA, also designated SEQ ID:2958.

Another function of VGAM247 is therefore inhibition of Solute Carrier Family 2 (facilitated glucose transporter), Member 3 (SLC2A3, Accession NM_006931), a gene which probably is a neuronal glucose transporter. Accordingly, utilities of VGAM247 include diagnosis, prevention and treatment of diseases and clinical conditions associated with SLC2A3. The function of SLC2A3 has been established by previous studies. Gould and Holman (1993), who provided a review of the glucose transporter family, referred to GLUT3 as the brain-type glucose transporter. It appears that high GLUT3 protein expression is confined generally to tissues that exhibit a high glucose demand, such as brain and nerve. Hauguel-de Mouzon et al. (1997) examined the cellular localization of GLUT3 mRNA and protein. In situ hybridization showed that GLUT3 mRNA was present in the trophoblast cell layer and in vascular endothelium with a heterogeneous distribution pattern. GLUT3 protein, migrating at an apparent molecular mass of 49 kD, was detected by immunoblotting in membranes from whole placenta and endothelial cells derived from intraplacental microvessels, but not in isolated trophoblast cells. This cell-specific pattern of expression was confirmed by immunocytochemical studies showing localization of GLUT3 protein in vascular endothelium. Based on the cell-specific distribution of GLUT3 protein at the fetal interface, the authors suggested that this protein may be important in the transport of glucose from the placenta to the fetal circulation.

Full details of the abovementioned studies are described in the following publications, the disclosure of which are hereby incorporated by reference:

Gould, G. W.; Holman, G. D.: The glucose transporter family: structure, function and tissue-specific expression. Biochem. J. 295:329-341, 1993; and Hauguel-de Mouzon, S.; Challier, J. C.; Kacemi, A.; Cauzac, M.; Malek, A.; Girard, J.: The GLUT3 glucose transporter isoform is differentially expressed within human placental cell types.

Further studies establishing the function and utilities of SLC2A3 are found in John Hopkins OMIM database record ID 138170, and in sited publications numbered 11908-11912 listed in the bibliography section hereinbelow, which are also hereby incorporated by reference. Transcription Elongation Factor A (SII), 1 (TCEA1, Accession XM_087370) is another VGAM247 host target gene. TCEA1 BINDING SITE is HOST TARGET binding site found in the 3' untranslated region of mRNA encoded by TCEA1, corresponding to a HOST TARGET binding site such as BINDING SITE I, BINDING SITE II or BINDING SITE III. Table 2 illustrates the complementarity of the nucleotide sequences of TCEA1 BINDING SITE, designated SEQ ID:39203, to the nucleotide sequence of VGAM247 RNA, herein designated VGAM RNA, also designated SEQ ID:2958.

Another function of VGAM247 is therefore inhibition of Transcription Elongation Factor A (SII), 1 (TCEA1, Accession XM_087370), a gene which helps RNA polymerase II to transcribe past blockages. Accordingly, utilities of VGAM247 include diagnosis, prevention and treatment of diseases and clinical conditions associated with TCEA1. The function of TCEA1 and its association with various diseases and clinical conditions, has been established by previous studies, as described hereinabove with reference to VGAM211. TIC (Accession NM_012455) is another VGAM247 host target gene. TIC BINDING SITE is HOST TARGET binding site found in the 3' untranslated region of mRNA encoded by TIC, corresponding to a HOST TARGET binding site such as BINDING SITE I, BINDING SITE II or BINDING SITE III. Table 2 illustrates the complementarity of the nucleotide sequences of TIC BINDING SITE, designated SEQ ID:14829, to the nucleotide sequence of VGAM247 RNA, herein designated VGAM RNA, also designated SEQ ID:2958.

Another function of VGAM247 is therefore inhibition of TIC (Accession NM_012455). Accordingly, utilities of VGAM247 include diagnosis, prevention and treatment of diseases and clinical conditions associated with TIC. TSG (Accession NM_020648) is another VGAM247 host target gene. TSG BINDING SITE is HOST TARGET binding site found in the 3' untranslated region of mRNA encoded by TSG, corresponding to a HOST TARGET binding site such as BINDING SITE I, BINDING SITE II or BINDING SITE III. Table 2 illustrates the complementarity of the nucleotide sequences of TSG BINDING SITE, designated SEQ ID:21812, to the nucleotide sequence of VGAM247 RNA, herein designated VGAM RNA, also designated SEQ ID:2958.

Another function of VGAM247 is therefore inhibition of TSG (Accession NM_020648). Accordingly, utilities of VGAM247 include diagnosis, prevention and treatment of diseases and clinical conditions associated with TSG. Thioredoxin Reductase 1 (TXNRD1, Accession NM_003330) is another VGAM247 host target gene. TXNRD1 BINDING SITE is HOST TARGET binding site found in the 5' untranslated region of mRNA encoded by TXNRD1, corresponding to a HOST TARGET binding site such as BINDING SITE I, BINDING SITE II or BINDING SITE III. Table 2 illustrates the complementarity of the nucleotide sequences of TXNRD1 BINDING SITE, designated SEQ ID:9336, to the nucleotide sequence of VGAM247 RNA, herein designated VGAM RNA, also designated SEQ ID:2958.

Another function of VGAM247 is therefore inhibition of Thioredoxin Reductase 1 (TXNRD1, Accession NM_003330), a gene which acts as an antioxidant enzyme and is involved in maintaining redox balance. Accordingly, utilities of VGAM247 include diagnosis, prevention and treatment of diseases and clinical conditions associated with TXNRD1. The function of TXNRD1 has been established by previous studies. Thioredoxin reductase (EC 1.6.4.5) is a key enzyme in the regulation of the intracellular redox environment. Gasdaska et al. (1995) purified human thioredoxin reductase from placenta and obtained amino acid sequence from tryptic peptides. Based on protein sequence data, the authors designed degenerate PCR primers and used them to screen a human placental cDNA library. The authors obtained a 3.8-kb cDNA encoding a predicted 495-amino acid protein that is 40% identical to glutathione reductase and 24% identical to thioredoxin reductase from E. coli. The protein is predicted to contain a FAD-binding domain, as expected, but this activity could not be demonstrated with recombinantly expressed enzyme. By Northern blot analysis, Gasdaska et al. (1996) found that thioredoxin reductase was expressed in all tissues examined but at varying levels. The authors found no correlation between the relative expression levels of thioredoxin and thioredoxin reductase. See also selenocysteine-containing thioredoxin reductase (OMIM Ref. No. 601339). Selenium has been indirectly implicated in immunologic function and numerous nutritional studies over many years. Furthermore, HIV-infected persons are reported to have decreased levels of plasma selenium and selenium-containing glutathione peroxidase (e.g., 138321). For this reason, Gladyshev et al. (1996) initiated studies on selenium metabolism in human T cells. The authors identified one of the selenoproteins detected in T cells as thioredoxin reductase and demonstrated that the location of selenocysteine in this protein corresponds to a TGA codon in the cloned placental gene. The finding that T-cell thioredoxin reductase is a selenoenzyme that contains selenium in a conserved C-terminal region provides another example of the role of selenium in the major antioxidant enzyme system (i.e., thioredoxin-thioredoxin reductase), in addition to the well-known glutathione peroxidase enzyme system.

Full details of the abovementioned studies are described in the following publications, the disclosure of which are hereby incorporated by reference:

Gasdaska, J. R.; Gasdaska, P. Y.; Gallegos, A.; Powis, G.: Human thioredoxin reductase gene localization to chromosomal position 12q23-q24.1 and mRNA distribution in human tissue. Genomics 37:257-259, 1996; and Gasdaska, P. Y.; Gasdaska, J. R.; Cochran, S.; Powis, G.: Cloning and sequencing of a human thioredoxin reductase. FEBS Lett. 373:5-9, 1995.

Further studies establishing the function and utilities of TXNRD1 are found in John Hopkins OMIM database record ID 601112, and in sited publications numbered 10041-1004 and 9635 listed in the bibliography section hereinbelow, which are also hereby incorporated by reference. A2BP1 (Accession NM_018723) is another VGAM247 host target gene. A2BP1 BINDING SITE1 and A2BP1 BINDING SITE2 are HOST TARGET binding sites found in untranslated regions of mRNA encoded by A2BP1, corresponding to HOST TARGET binding sites such as BINDING SITE I, BINDING SITE II or BINDING SITE III. Table 2 illustrates the complementarity of the nucleotide sequences of A2BP1 BINDING SITE1 and A2BP1 BINDING SITE2, designated SEQ ID:20807 and SEQ ID:20808 respectively, to the nucleotide sequence of VGAM247 RNA, herein designated VGAM RNA, also designated SEQ ID:2958.

Another function of VGAM247 is therefore inhibition of A2BP1 (Accession NM_018723). Accordingly, utilities of VGAM247 include diagnosis, prevention and treatment of diseases and clinical conditions associated with A2BP1. Ras Homolog Gene Family, Member U (ARHU, Accession NM_021205) is another VGAM247 host target gene. ARHU BINDING SITE is HOST TARGET binding site found in the 3' untranslated region of mRNA encoded by ARHU, corresponding to a HOST TARGET binding site such as BINDING SITE I, BINDING SITE II or BINDING SITE III. Table 2 illustrates the complementarity of the nucleotide sequences of ARHU BINDING SITE, designated SEQ ID:22184, to the nucleotide sequence of VGAM247 RNA, herein designated VGAM RNA, also designated SEQ ID:2958.

Another function of VGAM247 is therefore inhibition of Ras Homolog Gene Family, Member U (ARHU, Accession NM_021205). Accordingly, utilities of VGAM247 include diagnosis, prevention and treatment of diseases and clinical conditions associated with ARHU. DKFZp547I094 (Accession NM_032155) is another VGAM247 host target gene. DKFZp547I094 BINDING SITE is HOST TARGET binding site found in the 3' untranslated region of mRNA encoded by DKFZp547I094, corresponding to a HOST TARGET binding site such as BINDING SITE I, BINDING SITE II or BINDING SITE III. Table 2 illustrates the complementarity of the nucleotide sequences of DKFZp547I094 BINDING SITE, designated SEQ ID:25857, to the nucleotide sequence of VGAM247 RNA, herein designated VGAM RNA, also designated SEQ ID:2958.

Another function of VGAM247 is therefore inhibition of DKFZp547I094 (Accession NM_032155). Accordingly, utilities of VGAM247 include diagnosis, prevention and treatment of diseases and clinical conditions associated with DKFZp547I094. Double C2-like Domains, Beta (DOC2B, Accession NM_003585) is another VGAM247 host target gene. DOC2B BINDING SITE is HOST TARGET binding site found in the 5' untranslated region of mRNA encoded by DOC2B, corresponding to a HOST TARGET binding site such as BINDING SITE I, BINDING SITE II or BINDING SITE III. Table 2 illustrates the complementarity of the nucleotide sequences of DOC2B BINDING SITE, designated SEQ ID:9638, to the nucleotide sequence of VGAM247 RNA, herein designated VGAM RNA, also designated SEQ ID:2958.

Another function of VGAM247 is therefore inhibition of Double C2-like Domains, Beta (DOC2B, Accession NM_003585). Accordingly, utilities of VGAM247 include diagnosis, prevention and treatment of diseases and clinical conditions associated with DOC2B. FASTK (Accession NM_025096) is another VGAM247 host target gene. FASTK BINDING SITE is HOST TARGET binding site found in the 3' untranslated region of mRNA encoded by FASTK, corresponding to a HOST TARGET binding site such as BINDING SITE I, BINDING SITE II or BINDING SITE III. Table 2 illustrates the complementarity of the nucleotide sequences of FASTK BINDING SITE, designated SEQ ID:24730, to the nucleotide sequence of VGAM247 RNA, herein designated VGAM RNA, also designated SEQ ID:2958.

Another function of VGAM247 is therefore inhibition of FASTK (Accession NM_025096). Accordingly, utilities of VGAM247 include diagnosis, prevention and treatment of diseases and clinical conditions associated with FASTK. FLJ12975 (Accession XM_045522) is another VGAM247 host target gene. FLJ12975 BINDING SITE is HOST TARGET binding site found in the 3" untranslated region of mRNA encoded by FLJ12975, corresponding to a HOST TARGET binding site such as BINDING SITE I, BINDING SITE II or BINDING SITE III. Table 2 illustrates the complementarity of the nucleotide sequences of FLJ12975 BINDING SITE, designated SEQ ID:34480, to the nucleotide sequence of VGAM247 RNA, herein designated VGAM RNA, also designated SEQ ID:2958.

Another function of VGAM247 is therefore inhibition of FLJ12975 (Accession XM_045522). Accordingly, utilities of VGAM247 include diagnosis, prevention and treatment of diseases and clinical conditions associated with FLJ12975. FLJ14297 (Accession NM_024903) is another VGAM247 host target gene. FLJ14297 BINDING SITE is HOST TARGET binding site found in the 3' untranslated region of mRNA encoded by FLJ14297, corresponding to a HOST TARGET binding site such as BINDING SITE I, BINDING SITE II or BINDING SITE III. Table 2 illustrates the complementarity of the nucleotide sequences of FLJ14297 BINDING SITE, designated SEQ ID:24391, to the nucleotide sequence of VGAM247 RNA, herein designated VGAM RNA, also designated SEQ ID:2958.

Another function of VGAM247 is therefore inhibition of FLJ14297 (Accession NM_024903). Accordingly, utilities of VGAM247 include diagnosis, prevention and treatment of diseases and clinical conditions associated with FLJ14297. FLJ21687 (Accession NM_024859) is another VGAM247 host target gene. FLJ21687 BINDING SITE is HOST TARGET binding site found in the 3' untranslated region of mRNA encoded by FLJ21687, corresponding to a HOST TARGET binding site such as BINDING SITE I, BINDING SITE II or BINDING SITE III. Table 2 illustrates the complementarity of the nucleotide sequences of FLJ21687 BINDING SITE, designated SEQ ID:24290, to the nucleotide sequence of VGAM247 RNA, herein designated VGAM RNA, also designated SEQ ID:2958.

Another function of VGAM247 is therefore inhibition of FLJ21687 (Accession NM_024859). Accordingly, utilities of VGAM247 include diagnosis, prevention and treatment of diseases and clinical conditions associated with FLJ21687. FLJ22559 (Accession NM_024928) is another VGAM247 host target gene. FLJ22559 BINDING SITE is HOST TARGET binding site found in the 5' untranslated region of mRNA encoded by FLJ22559, corresponding to a HOST TARGET binding site such as BINDING SITE I, BINDING SITE II or BINDING SITE III. Table 2 illustrates the complementarity of the nucleotide sequences of FLJ22559 BINDING SITE, designated SEQ ID:24465, to the nucleotide sequence of VGAM247 RNA, herein designated VGAM RNA, also designated SEQ ID:2958.

Another function of VGAM247 is therefore inhibition of FLJ22559 (Accession NM_024928). Accordingly, utilities of VGAM247 include diagnosis, prevention and treatment of diseases and clinical conditions associated with FLJ22559. FLJ23071 (Accession NM_025192) is another VGAM247 host target gene. FLJ23071 BINDING SITE is HOST TARGET binding site found in the 3' untranslated region of mRNA encoded by FLJ23071, corresponding to a HOST TARGET binding site such as BINDING SITE I, BINDING SITE II or BINDING SITE III. Table 2 illustrates the complementarity of the nucleotide sequences of FLJ23071 BINDING SITE, designated SEQ ID:24847, to the nucleotide sequence of VGAM247 RNA, herein designated VGAM RNA, also designated SEQ ID:2958.

Another function of VGAM247 is therefore inhibition of FLJ23071 (Accession NM_025192). Accordingly, utilities of VGAM247 include diagnosis, prevention and treatment of diseases and clinical conditions associated with FLJ23071. FLJ23168 (Accession NM_025055) is another VGAM247 host target gene. FLJ23168 BINDING SITE is HOST TARGET binding site found in the 3' untranslated region of mRNA encoded by FLJ23168, corresponding to a HOST TARGET binding site such as BINDING SITE I, BINDING SITE II or BINDING SITE III. Table 2 illustrates the complementarity of the nucleotide sequences of FLJ23168 BINDING SITE, designated SEQ ID:24652, to the nucleotide sequence of VGAM247 RNA, herein designated VGAM RNA, also designated SEQ ID:2958.

Another function of VGAM247 is therefore inhibition of FLJ23168 (Accession NM_025055). Accordingly, utilities of VGAM247 include diagnosis, prevention and treatment of diseases and clinical conditions associated with FLJ23168. jdp2 (Accession NM_130469) is another VGAM247 host target gene. jdp2 BINDING SITE is HOST TARGET binding site found in the 3' untranslated region of mRNA encoded by jdp2, corresponding to a HOST TARGET binding site such as BINDING SITE I, BINDING SITE II or BINDING SITE III. Table 2 illustrates the complementarity of the nucleotide sequences of jdp2 BINDING SITE, designated SEQ ID:28230, to the nucleotide sequence of VGAM247 RNA, herein designated VGAM RNA, also designated SEQ ID:2958.

Another function of VGAM247 is therefore inhibition of jdp2 (Accession NM_130469). Accordingly, utilities of VGAM247 include diagnosis, prevention and treatment of diseases and clinical conditions associated with jdp2. KIAA0557 (Accession XM_085507) is another VGAM247 host target gene. KIAA0557 BINDING SITE is HOST TARGET binding site found in the 3' untranslated region of mRNA encoded by KIAA0557, corresponding to a HOST TARGET binding site such as BINDING SITE I, BINDING SITE II or BINDING SITE III. Table 2 illustrates the complementarity of the nucleotide sequences of KIAA0557 BINDING SITE, designated SEQ ID:38207, to the nucleotide sequence of VGAM247 RNA, herein designated VGAM RNA, also designated SEQ ID:2958.

Another function of VGAM247 is therefore inhibition of KIAA0557 (Accession XM_085507). Accordingly, utilities of VGAM247 include diagnosis, prevention and treatment of diseases and clinical conditions associated with KIAA0557. KIAA0599 (Accession XM_085127) is another VGAM247 host target gene. KIAA0599 BINDING SITE is HOST TARGET binding site found in the 5' untranslated region of mRNA encoded by KIAA0599, corresponding to a HOST TARGET binding site such as BINDING SITE I, BINDING SITE II or BINDING SITE III. Table 2 illustrates the complementarity of the nucleotide sequences of KIAA0599 BINDING SITE, designated SEQ ID:37857, to the nucleotide sequence of VGAM247 RNA, herein designated VGAM RNA, also designated SEQ ID:2958.

Another function of VGAM247 is therefore inhibition of KIAA0599 (Accession XM_085127). Accordingly, utilities of VGAM247 include diagnosis, prevention and treatment of diseases and clinical conditions associated with KIAA0599. KIAA0674 (Accession XM_027054) is another VGAM247 host target gene. KIAA0674 BINDING SITE is HOST TARGET binding site found in the 5' untranslated region of mRNA encoded by KIAA0674, corresponding to a HOST TARGET binding site such as BINDING SITE I, BINDING SITE II or BINDING SITE III. Table 2 illustrates the complementarity of the nucleotide sequences of KIAA0674 BINDING SITE, designated SEQ ID:30400, to the nucleotide sequence of VGAM247 RNA, herein designated VGAM RNA, also designated SEQ ID:2958.

Another function of VGAM247 is therefore inhibition of KIAA0674 (Accession XM_027054). Accordingly, utilities of VGAM247 include diagnosis, prevention and treatment of diseases and clinical conditions associated with KIAA0674. KIAA1340 (Accession XM_044836) is another VGAM247 host target gene. KIAA1340 BINDING SITE is HOST TARGET binding site found in the 3' untranslated region of mRNA encoded by KIAA1340, corresponding to a HOST TARGET binding site such as BINDING SITE I, BINDING SITE II or BINDING SITE III. Table 2 illustrates the complementarity of the nucleotide sequences of KIAA1340 BINDING SITE, designated SEQ ID:34296, to the nucleotide sequence of VGAM247 RNA, herein designated VGAM RNA, also designated SEQ ID:2958.

Another function of VGAM247 is therefore inhibition of KIAA1340 (Accession XM_044836). Accordingly, utilities of VGAM247 include diagnosis, prevention and treatment of diseases and clinical conditions associated with KIAA1340. KIAA1465 (Accession XM_027396) is another VGAM247 host target gene. KIAA1465 BINDING SITE is HOST TARGET binding site found in the 3' untranslated region of mRNA encoded by KIAA1465, corresponding to a HOST TARGET binding site such as BINDING SITE I, BINDING SITE II or BINDING SITE III. Table 2 illustrates the complementarity of the nucleotide sequences of KIAA1465 BINDING SITE, designated SEQ ID:30505, to the nucleotide sequence of VGAM247 RNA, herein designated VGAM RNA, also designated SEQ ID:2958.

Another function of VGAM247 is therefore inhibition of KIAA1465 (Accession XM_027396). Accordingly, utilities of VGAM247 include diagnosis, prevention and treatment of diseases and clinical conditions associated with KIAA1465. KIAA1649 (Accession NM_032311) is another VGAM247 host target gene. KIAA1649 BINDING SITE is HOST TARGET binding site found in the 3' untranslated region of mRNA encoded by KIAA1649, corresponding to a HOST TARGET binding site such as BINDING SITE I, BINDING SITE II or BINDING SITE III. Table 2 illustrates the complementarity of the nucleotide sequences of KIAA1649 BINDING SITE, designated SEQ ID:26109, to the nucleotide sequence of VGAM247 RNA, herein designated VGAM RNA, also designated SEQ ID:2958.

Another function of VGAM247 is therefore inhibition of KIAA1649 (Accession NM_032311). Accordingly, utilities of VGAM247 include diagnosis, prevention and treatment of diseases and clinical conditions associated with KIAA1649. KIAA1918 (Accession XM_054951) is another VGAM247 host target gene. KIAA1918 BINDING SITE is HOST TARGET binding site found in the 3' untranslated region of mRNA encoded by KIAA1918, corresponding to a HOST TARGET binding site such as BINDING SITE I, BINDING SITE II or BINDING SITE III. Table 2 illustrates the complementarity of the nucleotide sequences of KIAA1918 BINDING SITE, designated SEQ ID:36215, to the nucleotide sequence of VGAM247 RNA, herein designated VGAM RNA, also designated SEQ ID:2958.

Another function of VGAM247 is therefore inhibition of KIAA1918 (Accession XM_054951). Accordingly, utilities of VGAM247 include diagnosis, prevention and treatment of diseases and clinical conditions associated with KIAA1918. MGC11349 (Accession NM_025112) is another VGAM247 host target gene. MGC11349 BINDING SITE is HOST TARGET binding site found in the 3' untranslated region of mRNA encoded by MGC11349, corresponding to a HOST TARGET binding site such as BINDING SITE I, BINDING SITE II or BINDING SITE III. Table 2 illustrates the complementarity of the nucleotide sequences of MGC11349 BINDING SITE, designated SEQ ID:24760, to the nucleotide sequence of VGAM247 RNA, herein designated VGAM RNA, also designated SEQ ID:2958.

Another function of VGAM247 is therefore inhibition of MGC11349 (Accession NM_025112). Accordingly, utilities of VGAM247 include diagnosis, prevention and treatment of diseases and clinical conditions associated with MGC11349. MGC2821 (Accession NM_024054) is another VGAM247 host target gene. MGC2821 BINDING SITE is HOST TARGET binding site found in the 5' untranslated region of mRNA encoded by MGC2821, corresponding to a HOST TARGET binding site such as BINDING SITE I, BINDING SITE II or BINDING SITE III. Table 2 illustrates the complementarity of the nucleotide sequences of MGC2821 BINDING SITE, designated SEQ ID:23489, to the nucleotide sequence of VGAM247 RNA, herein designated VGAM RNA, also designated SEQ ID:2958.

Another function of VGAM247 is therefore inhibition of MGC2821 (Accession NM_024054). Accordingly, utilities of VGAM247 include diagnosis, prevention and treatment of diseases and clinical conditions associated with MGC2821. MGC35558 (Accession NM_145013) is another VGAM247 host target gene. MGC35558 BINDING SITE is HOST TARGET binding site found in the 3' untranslated region of mRNA encoded by MGC35558, corresponding to a HOST TARGET binding site such as BINDING SITE I, BINDING SITE II or BINDING SITE III. Table 2 illustrates the complementarity of the nucleotide sequences of MGC35558 BINDING SITE, designated SEQ ID:29614, to the nucleotide sequence of VGAM247 RNA, herein designated VGAM RNA, also designated SEQ ID:2958.

Another function of VGAM247 is therefore inhibition of MGC35558 (Accession NM_145013). Accordingly, utilities of VGAM247 include diagnosis, prevention and treatment of diseases and clinical conditions associated with MGC35558. MGC4368 (Accession NM_024510) is another VGAM247 host target gene. MGC4368 BINDING SITE is HOST TARGET binding site found in the 5' untranslated region of mRNA encoded by MGC4368, corresponding to a HOST TARGET binding site such as BINDING SITE I, BINDING SITE II or BINDING SITE III. Table 2 illustrates the complementarity of the nucleotide sequences of MGC4368 BINDING SITE, designated SEQ ID:23700, to the nucleotide sequence of VGAM247 RNA, herein designated VGAM RNA, also designated SEQ ID:2958.

Another function of VGAM247 is therefore inhibition of MGC4368 (Accession NM_024510). Accordingly, utilities of VGAM247 include diagnosis, prevention and treatment of diseases and clinical conditions associated with MGC4368. MGC7036 (Accession NM_145058) is another VGAM247 host target gene. MGC7036 BINDING SITE is HOST TARGET binding site found in the 5' untranslated region of mRNA encoded by MGC7036, corresponding to a HOST TARGET binding site such as BINDING SITE I, BINDING SITE II or BINDING SITE III. Table 2 illustrates the complementarity of the nucleotide sequences of MGC7036 BINDING SITE, designated SEQ ID:29694, to the nucleotide sequence of VGAM247 RNA, herein designated VGAM RNA, also designated SEQ ID:2958.

Another function of VGAM247 is therefore inhibition of MGC7036 (Accession NM_145058). Accordingly, utilities of VGAM247 include diagnosis, prevention and treatment of diseases and clinical conditions associated with MGC7036. Prostate Cancer Associated Protein 7 (PCANAP7, Accession XM_167803) is another VGAM247 host target gene. PCANAP7 BINDING SITE is HOST TARGET binding site found in the 5' untranslated region of mRNA encoded by PCANAP7, corresponding to a HOST TARGET binding site such as BINDING SITE I, BINDING SITE II or BINDING SITE III. Table 2 illustrates the complementarity of the nucleotide sequences of PCANAP7 BINDING SITE, designated SEQ ID:44838, to the nucleotide sequence of VGAM247 RNA, herein designated VGAM RNA, also designated SEQ ID:2958.

Another function of VGAM247 is therefore inhibition of Prostate Cancer Associated Protein 7 (PCANAP7, Accession XM_167803). Accordingly, utilities of VGAM247 include diagnosis, prevention and treatment of diseases and clinical conditions associated with PCANAP7. Phosphatidylinositol-4-phosphate 5-kinase, Type II, Beta (PIP5K2B, Accession NM_138687) is another VGAM247 host target gene. PIP5K2B BINDING SITE1 and PIP5K2B BINDING SITE2 are HOST TARGET binding sites found in untranslated regions of mRNA encoded by PIP5K2B, corresponding to HOST TARGET binding sites such as BINDING SITE I, BINDING SITE II or BINDING SITE III. Table 2 illustrates the complementarity of the nucleotide sequences of PIP5K2B BINDING SITE1 and PIP5K2B BINDING SITE2, designated SEQ ID:28930 and SEQ ID:9614 respectively, to the nucleotide sequence of VGAM247 RNA, herein designated VGAM RNA, also designated SEQ ID:2958.

Another function of VGAM247 is therefore inhibition of Phosphatidylinositol-4-phosphate 5-kinase, Type II, Beta (PIP5K2B, Accession NM_138687). Accordingly, utilities of VGAM247 include diagnosis, prevention and treatment of diseases and clinical conditions associated with PIP5K2B. SNF1 Sucrose Nonfermenting Like Kinase (yeast) (SLK, Accession NM_014720) is another VGAM247 host target gene. SLK BINDING SITE is HOST TARGET binding site found in the 5' untranslated region of mRNA encoded by SLK, corresponding to a HOST TARGET binding site such as BINDING SITE I, BINDING SITE II or BINDING SITE III. Table 2 illustrates the complementarity of the nucleotide sequences of SLK BINDING SITE, designated SEQ ID:16281, to the nucleotide sequence of VGAM247 RNA, herein designated VGAM RNA, also designated SEQ ID:2958.

Another function of VGAM247 is therefore inhibition of SNF1 Sucrose Nonfermenting Like Kinase (yeast) (SLK, Accession NM_014720). Accordingly, utilities of VGAM247 include diagnosis, prevention and treatment of diseases and clinical conditions associated with SLK. ZFP106 (Accession NM_022473) is another VGAM247 host target gene. ZFP106 BINDING SITE is HOST TARGET binding site found in the 3' untranslated region of mRNA encoded by ZFP106, corresponding to a HOST TARGET binding site such as BINDING SITE I, BINDING SITE II or BINDING SITE III. Table 2 illustrates the complementarity of the nucleotide sequences of ZFP106 BINDING SITE, designated SEQ ID:22833, to the nucleotide sequence of VGAM247 RNA, herein designated VGAM RNA, also designated SEQ ID:2958.

Another function of VGAM247 is therefore inhibition of ZFP106 (Accession NM_022473). Accordingly, utilities of VGAM247 include diagnosis, prevention and treatment of diseases and clinical conditions associated with ZFP106. LOC130617 (Accession NM_138802) is another VGAM247 host target gene. LOC130617 BINDING SITE is HOST TARGET binding site found in the 5' untranslated region of mRNA encoded by LOC130617, corresponding to a HOST TARGET binding site such as BINDING SITE I, BINDING SITE II or BINDING SITE III. Table 2 illustrates the complementarity of the nucleotide sequences of LOC130617 BINDING SITE, designated SEQ ID:29025, to the nucleotide sequence of VGAM247 RNA, herein designated VGAM RNA, also designated SEQ ID:2958.

Another function of VGAM247 is therefore inhibition of LOC130617 (Accession NM_138802). Accordingly, utilities of VGAM247 include diagnosis, prevention and treatment of diseases and clinical conditions associated with LOC130617. LOC132332 (Accession XM_072306) is another VGAM247 host target gene. LOC132332 BINDING SITE is HOST TARGET binding site found in the 3' untranslated region of mRNA encoded by LOC132332, corresponding to a HOST TARGET binding site such as BINDING SITE I, BINDING SITE II or BINDING SITE III. Table 2 illustrates the complementarity of the nucleotide sequences of LOC132332 BINDING SITE, designated SEQ ID:37488, to the nucleotide sequence of VGAM247 RNA, herein designated VGAM RNA, also designated SEQ ID:2958.

Another function of VGAM247 is therefore inhibition of LOC132332 (Accession XM_072306). Accordingly, utilities of VGAM247 include diagnosis, prevention and treatment of diseases and clinical conditions associated with LOC132332. LOC144195 (Accession XM_016498) is another VGAM247 host target gene. LOC144195 BINDING SITE is HOST TARGET binding site found in the 3' untranslated region of mRNA encoded by LOC144195, corresponding to a HOST TARGET binding site such as BINDING SITE I, BINDING SITE II or BINDING SITE III. Table 2 illustrates the complementarity of the nucleotide sequences of LOC144195 BINDING SITE, designated SEQ ID:30265, to the nucleotide sequence of VGAM247 RNA, herein designated VGAM RNA, also designated SEQ ID:2958.

Another function of VGAM247 is therefore inhibition of LOC144195 (Accession XM_016498). Accordingly, utilities of VGAM247 include diagnosis, prevention and treatment of diseases and clinical conditions associated with LOC144195. LOC144893 (Accession XM_096687) is another VGAM247 host target gene. LOC144893 BINDING SITE is HOST TARGET binding site found in the 5' untranslated region of mRNA encoded by LOC144893, corresponding to a HOST TARGET binding site such as BINDING SITE I, BINDING SITE II or BINDING SITE III. Table 2 illustrates the complementarity of the nucleotide sequences of LOC144893 BINDING SITE, designated SEQ ID:40461, to the nucleotide sequence of VGAM247 RNA, herein designated VGAM RNA, also designated SEQ ID:2958.

Another function of VGAM247 is therefore inhibition of LOC144893 (Accession XM_096687). Accordingly, utilities of VGAM247 include diagnosis, prevention and treatment of diseases and clinical conditions associated with LOC144893.

LOC146375 (Accession XM_085434) is another VGAM247 host target gene. LOC146375 BINDING SITE is HOST TARGET binding site found in the 5' untranslated region of mRNA encoded by LOC146375, corresponding to a HOST TARGET binding site such as BINDING SITE I, BINDING SITE II or BINDING SITE III. Table 2 illustrates the complementarity of the nucleotide sequences of LOC146375 BINDING SITE, designated SEQ ID:38141, to the nucleotide sequence of VGAM247 RNA, herein designated VGAM RNA, also designated SEQ ID:2958.

Another function of VGAM247 is therefore inhibition of LOC146375 (Accession XM_085434). Accordingly, utilities of VGAM247 include diagnosis, prevention and treatment of diseases and clinical conditions associated with LOC146375. LOC157543 (Accession XM_088325) is another VGAM247 host target gene. LOC157543 BINDING SITE is HOST TARGET binding site found in the 5' untranslated region of mRNA encoded by LOC157543, corresponding to a HOST TARGET binding site such as BINDING SITE I, BINDING SITE II or BINDING SITE III. Table 2 illustrates the complementarity of the nucleotide sequences of LOC157543 BINDING SITE, designated SEQ ID:39611, to the nucleotide sequence of VGAM247 RNA, herein designated VGAM RNA, also designated SEQ ID:2958.

Another function of VGAM247 is therefore inhibition of LOC157543 (Accession XM_088325). Accordingly, utilities of VGAM247 include diagnosis, prevention and treatment of diseases and clinical conditions associated with LOC157543. LOC201294 (Accession XM_113950) is another VGAM247 host target gene. LOC201294 BINDING SITE is HOST TARGET binding site found in the 3' untranslated region of mRNA encoded by LOC201294, corresponding to a HOST TARGET binding site such as BINDING SITE I, BINDING SITE II or BINDING SITE III. Table 2 illustrates the complementarity of the nucleotide sequences of LOC201294 BINDING SITE, designated SEQ ID:42568, to the nucleotide sequence of VGAM247 RNA, herein designated VGAM RNA, also designated SEQ ID:2958.

Another function of VGAM247 is therefore inhibition of LOC201294 (Accession XM_113950). Accordingly, utilities of VGAM247 include diagnosis, prevention and treatment of diseases and clinical conditions associated with LOC201294. LOC202181 (Accession XM_114456) is another VGAM247 host target gene. LOC202181 BINDING SITE is HOST TARGET binding site found in the 5' untranslated region of mRNA encoded by LOC202181, corresponding to a HOST TARGET binding site such as BINDING SITE I, BINDING SITE II or BINDING SITE III. Table 2 illustrates the complementarity of the nucleotide sequences of LOC202181 BINDING SITE, designated SEQ ID:42969, to the nucleotide sequence of VGAM247 RNA, herein designated VGAM RNA, also designated SEQ ID:2958.

Another function of VGAM247 is therefore inhibition of LOC202181 (Accession XM_114456). Accordingly, utilities of VGAM247 include diagnosis, prevention and treatment of diseases and clinical conditions associated with LOC202181. LOC203084 (Accession XM_113540) is another VGAM247 host target gene. LOC203084 BINDING SITE is HOST TARGET binding site found in the 3' untranslated region of mRNA encoded by LOC203084, corresponding to a HOST TARGET binding site such as BINDING SITE I, BINDING SITE II or BINDING SITE III. Table 2 illustrates the complementarity of the nucleotide sequences of LOC203084 BINDING SITE, designated SEQ ID:42281, to the nucleotide sequence of VGAM247 RNA, herein designated VGAM RNA, also designated SEQ ID:2958.

Another function of VGAM247 is therefore inhibition of LOC203084 (Accession XM_113540). Accordingly, utilities of VGAM247 include diagnosis, prevention and treatment of diseases and clinical conditions associated with LOC203084. LOC203427 (Accession XM_114699) is another VGAM247 host target gene. LOC203427 BINDING SITE is HOST TARGET binding site found in the 5' untranslated region of mRNA encoded by LOC203427, corresponding to a HOST TARGET binding site such as BINDING SITE I, BINDING SITE II or BINDING SITE III. Table 2 illustrates the complementarity of the nucleotide sequences of LOC203427 BINDING SITE, designated SEQ ID:43045, to the nucleotide sequence of VGAM247 RNA, herein designated VGAM RNA, also designated SEQ ID:2958.

Another function of VGAM247 is therefore inhibition of LOC203427 (Accession XM_114699). Accordingly, utilities of VGAM247 include diagnosis, prevention and treatment of diseases and clinical conditions associated with LOC203427. LOC219855 (Accession XM_166184) is another VGAM247 host target gene. LOC219855 BINDING SITE is HOST TARGET binding site found in the 3' untranslated region of mRNA encoded by LOC219855, corresponding to a HOST TARGET binding site such as BINDING SITE I, BINDING SITE II or BINDING SITE III. Table 2 illustrates the complementarity of the nucleotide sequences of LOC219855 BINDING SITE, designated SEQ ID:43997, to the nucleotide sequence of VGAM247 RNA, herein designated VGAM RNA, also designated SEQ ID:2958.

Another function of VGAM247 is therefore inhibition of LOC219855 (Accession XM_166184). Accordingly, utilities of VGAM247 include diagnosis, prevention and treatment of diseases and clinical conditions associated with LOC219855. LOC219994 (Accession XM_167792) is another VGAM247 host target gene. LOC219994 BINDING SITE is HOST TARGET binding site found in the 5' untranslated region of mRNA encoded by LOC219994, corresponding to a HOST TARGET binding site such as BINDING SITE I, BINDING SITE II or BINDING SITE III. Table 2 illustrates the complementarity of the nucleotide sequences of LOC219994 BINDING SITE, designated SEQ ID:44835, to the nucleotide sequence of VGAM247 RNA, herein designated VGAM RNA, also designated SEQ ID:2958.

Another function of VGAM247 is therefore inhibition of LOC219994 (Accession XM_167792). Accordingly, utilities of VGAM247 include diagnosis, prevention and treatment of diseases and clinical conditions associated with LOC219994. LOC51103 (Accession XM_031645) is another VGAM247 host target gene. LOC51103 BINDING SITE is HOST TARGET binding site found in the 5' untranslated region of mRNA encoded by LOC51103, corresponding to a HOST TARGET binding site such as BINDING SITE I, BINDING SITE II or BINDING SITE III. Table 2 illustrates the complementarity of the nucleotide sequences of LOC51103 BINDING SITE, designated SEQ ID:31446, to the nucleotide sequence of VGAM247 RNA, herein designated VGAM RNA, also designated SEQ ID:2958.

Another function of VGAM247 is therefore inhibition of LOC51103 (Accession XM_031645). Accordingly, utilities of VGAM247 include diagnosis, prevention and treatment of diseases and clinical conditions associated with LOC51103. FIG. 1 further provides a conceptual description of a novel bioinformatically detected viral gene of the present invention, referred to here as Viral Genomic Address Messenger 248 (VGAM248) viral gene, which modulates expression of respective host target genes thereof, the function and utility of which host target genes is known in the art.

VGAM248 is a novel bioinformatically detected regulatory, non protein coding, viral micro RNA (miRNA) gene. The method by which VGAM248 was detected is described hereinabove with reference to FIGS. 1-8.

VGAM248 gene, herein designated VGAM GENE, is a viral gene contained in the genome of Callitrichine Herpesvirus 3. VGAM248 host target gene, herein designated VGAM HOST TARGET GENE, is a human gene contained in the human genome.

VGAM248 gene encodes a VGAM248 precursor RNA, herein designated VGAM PRECURSOR RNA. Similar to other miRNA genes, and unlike most ordinary genes, VGAM248 precursor RNA does not encode a protein. A nucleotide sequence identical or highly similar to the nucleotide sequence of VGAM248 precursor RNA is designated SEQ ID:234, and is provided hereinbelow with reference to the sequence listing part. Nucleotide sequence SEQ ID:234 is located at position 106248 relative to the genome of Callitrichine Herpesvirus 3.

VGAM248 precursor RNA folds onto itself, forming VGAM248 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM248 folded precursor RNA into VGAM248 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM248 RNA is designated SEQ ID:2959, and is provided hereinbelow with reference to the sequence listing part.

VGAM248 host target gene, herein designated VGAM HOST TARGET GENE, encodes a corresponding messenger RNA, VGAM248 host target RNA, herein designated VGAM HOST TARGET RNA. VGAM248 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM248 RNA, herein designated VGAM RNA, binds complementarily to one or more host target binding sites located in untranslated regions of VGAM248 host target RNA, herein designated VGAM HOST TARGET RNA. This complementary binding is due to the fact that the nucleotide sequence of VGAM248 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM248 RNA, herein designated VGAM RNA, may have a different number of host target binding sites in untranslated regions of a VGAM248 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM248 RNA, herein designated VGAM RNA, to host target binding sites on VGAM248 host target RNA, herein designated VGAM HOST TARGET RNA, such as BINDING SITE I, BINDING SITE II and BINDING SITE III, inhibits translation of VGAM248 host target RNA into VGAM248 host target protein, herein designated VGAM HOST TARGET PROTEIN. VGAM host target protein is therefore outlined by a broken line.

It is appreciated that VGAM248 host target gene, herein designated VGAM HOST TARGET GENE, in fact represents a plurality of VGAM248 host target genes. The mRNA of each one of this plurality of VGAM248 host target genes comprises one or more host target binding sites, each having a nucleotide sequence which is at least partly complementary to VGAM248 RNA, herein designated VGAM RNA, and which when bound by VGAM248 RNA causes inhibition of translation of respective one or more VGAM248 host target proteins.

It is further appreciated by one skilled in the art that the mode of translational inhibition illustrated by FIG. 1 with specific reference to translational inhibition exerted by VGAM248 gene, herein designated VGAM GENE, on one or more VGAM248 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM248 is inhibition of expression of host target genes, as part of a novel viral mechanism of attacking a host. Accordingly, utilities of VGAM248 include diagnosis, prevention and treatment of viral infection by Callitrichine Herpesvirus 3. Specific functions, and accordingly utilities, of VGAM248 correlate with, and may be deduced from, the identity of the host target genes which VGAM248 binds and inhibits, and the function of these host target genes, as elaborated hereinbelow.

Nucleotide sequences of the VGAM248 precursor RNA, herein designated VGAM PRECURSOR RNA, and of the 'diced' VGAM248 RNA, herein designated VGAM RNA, and a schematic representation of the secondary folding of VGAM248 folded precursor RNA, herein designated VGAM FOLDED PRECURSOR RNA, of VGAM248 are further described hereinbelow with reference to Table 1.

Nucleotide sequences of host target binding sites, such as BINDING SITE-I, BINDING SITE-II and BINDING SITE-III of FIG. 1, found on VGAM248 host target RNA, and schematic representation of the complementarity of each of these host target binding sites to VGAM248 RNA, herein designated VGAM RNA, are described hereinbelow with reference to Table 2.

As mentioned hereinabove with reference to FIG. 1, a function of VGAM248 gene, herein designated VGAM is inhibition of expression of VGAM248 target genes. It is appreciated that specific functions, and accordingly utilities, of VGAM248 correlate with, and may be deduced from, the identity of the target genes which VGAM248 binds and inhibits, and the function of these target genes, as elaborated hereinbelow.

BCLG (Accession NM_030766) is a VGAM248 host target gene. BCLG BINDING SITE1 and BCLG BINDING SITE2 are HOST TARGET binding sites found in untranslated regions of mRNA encoded by BCLG, corresponding to HOST TARGET binding sites such as BINDING SITE I, BINDING SITE II or BINDING SITE III. Table 2 illustrates the complementarity of the nucleotide sequences of BCLG BINDING SITE1 and BCLG BINDING SITE2, designated SEQ ID:25053 and SEQ ID:28967 respectively, to the nucleotide sequence of VGAM248 RNA, herein designated VGAM RNA, also designated SEQ ID:2959.

A function of VGAM248 is therefore inhibition of BCLG (Accession NM_030766). Accordingly, utilities of VGAM248 include diagnosis, prevention and treatment of diseases and clinical conditions associated with BCLG. Zinc Finger Protein 42 (myeloid-specific retinoic acid- responsive) (ZNF42, Accession NM_003422) is another VGAM248 host target gene. ZNF42 BINDING SITE is HOST TARGET binding site found in the 5' untranslated region of mRNA encoded by ZNF42, corresponding to a HOST TARGET binding site such as BINDING SITE I, BINDING SITE II or BINDING SITE III. Table 2 illustrates the complementarity of the nucleotide sequences of ZNF42 BINDING SITE, designated SEQ ID:9468, to the nucleotide sequence of VGAM248 RNA, herein designated VGAM RNA, also designated SEQ ID:2959.

Another function of VGAM248 is therefore inhibition of Zinc Finger Protein 42 (myeloid-specific retinoic acid-responsive) (ZNF42, Accession NM_003422), a gene which may be one regulator of transcriptional events during hemopoietic development. Accordingly, utilities of VGAM248 include diagnosis, prevention and treatment of diseases and clinical conditions associated with ZNF42. The function of ZNF42 and its association with various diseases and clinical conditions, has been established by previous studies, as described hereinabove with reference to VGAM173. DKFZP434I0714 (Accession XM_098247) is another VGAM248 host target gene. DKFZP434I0714 BINDING SITE is HOST TARGET binding site found in the 3' untranslated region of mRNA encoded by DKFZP434I0714, corresponding to a HOST TARGET binding site such as BINDING SITE I, BINDING SITE II or BINDING SITE III. Table 2 illustrates the complementarity of the nucleotide sequences of DKFZP434I0714 BINDING SITE, designated SEQ ID:41531, to the nucleotide sequence of VGAM248 RNA, herein designated VGAM RNA, also designated SEQ ID:2959.

Another function of VGAM248 is therefore inhibition of DKFZP434I0714 (Accession XM_098247). Accordingly, utilities of VGAM248 include diagnosis, prevention and treatment of diseases and clinical conditions associated with DKFZP434I0714. FLJ14082 (Accession NM_025024) is another VGAM248 host target gene. FLJ14082 BINDING SITE is HOST TARGET binding site found in the 3' untranslated region of mRNA encoded by FLJ14082, corresponding to a HOST TARGET binding site such as BINDING SITE I, BINDING SITE II or BINDING SITE III. Table 2 illustrates the complementarity of the nucleotide sequences of FLJ14082 BINDING SITE, designated SEQ ID:24611, to the nucleotide sequence of VGAM248 RNA, herein designated VGAM RNA, also designated SEQ ID:2959.

Another function of VGAM248 is therefore inhibition of FLJ14082 (Accession NM_025024). Accordingly, utilities of VGAM248 include diagnosis, prevention and treatment of diseases and clinical conditions associated with FLJ14082. KIAA0632 (Accession NM_015545) is another VGAM248 host target gene. KIAA0632 BINDING SITE is HOST TARGET binding site found in the 3' untranslated region of mRNA encoded by KIAA0632, corresponding to a HOST TARGET binding site such as BINDING SITE I, BINDING SITE II or BINDING SITE III. Table 2 illustrates the complementarity of the nucleotide sequences of KIAA0632 BINDING SITE, designated SEQ ID:17806, to the nucleotide sequence of VGAM248 RNA, herein designated VGAM RNA, also designated SEQ ID:2959.

Another function of VGAM248 is therefore inhibition of KIAA0632 (Accession NM_015545). Accordingly, utilities of VGAM248 include diagnosis, prevention and treatment of diseases and clinical conditions associated with KIAA0632. KIAA1010 (Accession XM_050742) is another VGAM248 host target gene. KIAA1010 BINDING SITE is HOST TARGET binding site found in the 3' untranslated region of mRNA encoded by KIAA1010, corresponding to a HOST TARGET binding site such as BINDING SITE I, BINDING SITE II or BINDING SITE III. Table 2 illustrates the complementarity of the nucleotide sequences of KIAA1010 BINDING SITE, designated SEQ ID:35669, to the nucleotide sequence of VGAM248 RNA, herein designated VGAM RNA, also designated SEQ ID:2959.

Another function of VGAM248 is therefore inhibition of KIAA1010 (Accession XM_050742). Accordingly, utilities of VGAM248 include diagnosis, prevention and treatment of diseases and clinical conditions associated with KIAA1010. LOC148089 (Accession XM_086040) is another VGAM248 host target gene. LOC148089 BINDING SITE is HOST TARGET binding site found in the 3' untranslated region of mRNA encoded by LOC148089, corresponding to a HOST TARGET binding site such as BINDING SITE I, BINDING SITE II or BINDING SITE III. Table 2 illustrates the complementarity of the nucleotide sequences of LOC148089 BINDING SITE, designated SEQ ID:38449, to the nucleotide sequence of VGAM248 RNA, herein designated VGAM RNA, also designated SEQ ID:2959.

Another function of VGAM248 is therefore inhibition of LOC148089 (Accession XM_086040). Accordingly, utilities of VGAM248 include diagnosis, prevention and treatment of diseases and clinical conditions associated with LOC148089. LOC222031 (Accession XM_168371) is another VGAM248 host target gene. LOC222031 BINDING SITE is HOST TARGET binding site found in the 3' untranslated region of mRNA encoded by LOC222031, corresponding to a HOST TARGET binding site such as BINDING SITE I, BINDING SITE II or BINDING SITE III. Table 2 illustrates the complementarity of the nucleotide sequences of LOC222031 BINDING SITE, designated SEQ ID:45130, to the nucleotide sequence of VGAM248 RNA, herein designated VGAM RNA, also designated SEQ ID:2959.

Another function of VGAM248 is therefore inhibition of LOC222031 (Accession XM_168371). Accordingly, utilities of VGAM248 include diagnosis, prevention and treatment of diseases and clinical conditions associated with LOC222031. LOC93589 (Accession XM_052387) is another VGAM248 host target gene. LOC93589 BINDING SITE is HOST TARGET binding site found in the 3' untranslated region of mRNA encoded by LOC93589, corresponding to a HOST TARGET binding site such as BINDING SITE I, BINDING SITE II or BINDING SITE III. Table 2 illustrates the complementarity of the nucleotide sequences of LOC93589 BINDING SITE, designated SEQ ID:35980, to the nucleotide sequence of VGAM248 RNA, herein designated VGAM RNA, also designated SEQ ID:2959.

Another function of VGAM248 is therefore inhibition of LOC93589 (Accession XM_052387). Accordingly, utilities of VGAM248 include diagnosis, prevention and treatment of diseases and clinical conditions associated with LOC93589. FIG. 1 further provides a conceptual description of a novel bioinformatically detected viral gene of the present invention, referred to here as Viral Genomic Address Messenger 249 (VGAM249) viral gene, which modulates expression of respective host target genes thereof, the function and utility of which host target genes is known in the art.

VGAM249 is a novel bioinformatically detected regulatory, non protein coding, viral micro RNA (miRNA) gene. The method by which VGAM249 was detected is described hereinabove with reference to FIGS. 1-8.

VGAM249 gene, herein designated VGAM GENE, is a viral gene contained in the genome of Callitrichine Herpesvirus 3. VGAM249 host target gene, herein designated VGAM HOST TARGET GENE, is a human gene contained in the human genome.

VGAM249 gene encodes a VGAM249 precursor RNA, herein designated VGAM PRECURSOR RNA. Similar to other miRNA genes, and unlike most ordinary genes, VGAM249 precursor RNA does not encode a protein. A nucleotide sequence identical or highly similar to the nucleotide sequence of VGAM249 precursor RNA is designated SEQ ID:235, and is provided hereinbelow with reference to the sequence listing part. Nucleotide sequence SEQ ID:235 is located at position 15261 relative to the genome of Callitrichine Herpesvirus 3.

VGAM249 precursor RNA folds onto itself, forming VGAM249 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM249 folded precursor RNA into VGAM249 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM249 RNA is designated SEQ ID:2960, and is provided hereinbelow with reference to the sequence listing part.

VGAM249 host target gene, herein designated VGAM HOST TARGET GENE, encodes a corresponding messenger RNA, VGAM249 host target RNA, herein designated VGAM HOST TARGET RNA. VGAM249 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM249 RNA, herein designated VGAM RNA, binds complementarily to one or more host target binding sites located in untranslated regions of VGAM249 host target RNA, herein designated VGAM HOST TARGET RNA. This complementary binding is due to the fact that the nucleotide sequence of VGAM249 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM249 RNA, herein designated VGAM RNA, may have a different number of host target binding sites in untranslated regions of a VGAM249 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM249 RNA, herein designated VGAM RNA, to host target binding sites on VGAM249 host target RNA, herein designated VGAM HOST TARGET RNA, such as BINDING SITE I, BINDING SITE II and BINDING SITE III, inhibits translation of VGAM249 host target RNA into VGAM249 host target protein, herein designated VGAM HOST TARGET PROTEIN. VGAM host target protein is therefore outlined by a broken line.

It is appreciated that VGAM249 host target gene, herein designated VGAM HOST TARGET GENE, in fact represents a plurality of VGAM249 host target genes. The mRNA of each one of this plurality of VGAM249 host target genes comprises one or more host target binding sites, each having a nucleotide sequence which is at least partly complementary to VGAM249 RNA, herein designated VGAM RNA, and which when bound by VGAM249 RNA causes inhibition of translation of respective one or more VGAM249 host target proteins.

It is further appreciated by one skilled in the art that the mode of translational inhibition illustrated by FIG. 1 with specific reference to translational inhibition exerted by VGAM249 gene, herein designated VGAM GENE, on one or more VGAM249 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM249 is inhibition of expression of host target genes, as part of a novel viral mechanism of attacking a host. Accordingly, utilities of VGAM249 include diagnosis, prevention and treatment of viral infection by Callitrichine Herpesvirus 3. Specific functions, and accordingly utilities, of VGAM249 correlate with, and may be deduced from, the identity of the host target genes which VGAM249 binds and inhibits, and the function of these host target genes, as elaborated hereinbelow.

Nucleotide sequences of the VGAM249 precursor RNA, herein designated VGAM PRECURSOR RNA, and of the 'diced' VGAM249 RNA, herein designated VGAM RNA, and a schematic representation of the secondary folding of VGAM249 folded precursor RNA, herein designated VGAM FOLDED PRECURSOR RNA, of VGAM249 are further described hereinbelow with reference to Table 1.

Nucleotide sequences of host target binding sites, such as BINDING SITE-I, BINDING SITE-II and BINDING SITE-III of FIG. 1, found on VGAM249 host target RNA, and schematic representation of the complementarity of each of these host target binding sites to VGAM249 RNA, herein designated VGAM RNA, are described hereinbelow with reference to Table 2.

As mentioned hereinabove with reference to FIG. 1, a function of VGAM249 gene, herein designated VGAM is inhibition of expression of VGAM249 target genes. It is appreciated that specific functions, and accordingly utilities, of VGAM249 correlate with, and may be deduced from, the identity of the target genes which VGAM249 binds and inhibits, and the function of these target genes, as elaborated hereinbelow.

Ubiquitin-conjugating Enzyme E2G 2 (UBC7 homolog, yeast) (UBE2G2, Accession XM_036087) is a VGAM249 host target gene. UBE2G2 BINDING SITE is HOST TARGET binding site found in the 3' untranslated region of mRNA encoded by UBE2G2, corresponding to a HOST TARGET binding site such as BINDING SITE I, BINDING SITE II or BINDING SITE III. Table 2 illustrates the complementarity of the nucleotide sequences of UBE2G2 BINDING SITE, designated SEQ ID:32376, to the nucleotide sequence of VGAM249 RNA, herein designated VGAM RNA, also designated SEQ ID:2960.

A function of VGAM249 is therefore inhibition of Ubiquitin-conjugating Enzyme E2G 2 (UBC7 homolog, yeast) (UBE2G2, Accession XM_036087), a gene which catalyzes the covalent attachment of ubiquitin to other proteins. Accordingly, utilities of VGAM249 include diagnosis, prevention and treatment of diseases and clinical conditions associated with UBE2G2. The function of UBE2G2 and its association with various diseases and clinical conditions, has been established by previous studies, as described hereinabove with reference to VGAM164. LOC147118 (Accession XM_097200) is another VGAM249 host target gene. LOC147118 BINDING SITE is HOST TARGET binding site found in the 5' untranslated region of mRNA encoded by LOC147118, corresponding to a HOST TARGET binding site such as BINDING SITE I, BINDING SITE II or BINDING SITE III. Table 2 illustrates the complementarity of the nucleotide sequences of LOC147118 BINDING SITE, designated SEQ ID:40807, to the nucleotide sequence of VGAM249 RNA, herein designated VGAM RNA, also designated SEQ ID:2960.

Another function of VGAM249 is therefore inhibition of LOC147118 (Accession XM_097200). Accordingly, utilities of VGAM249 include diagnosis, prevention and treatment of diseases and clinical conditions associated with LOC147118. LOC148089 (Accession XM_086040) is another VGAM249 host target gene. LOC148089 BINDING SITE is HOST TARGET binding site found in the 3' untranslated region of mRNA encoded by LOC148089, corresponding to a HOST TARGET binding site such as BINDING SITE I, BINDING SITE II or BINDING SITE III. Table 2 illustrates the complementarity of the nucleotide sequences of LOC148089 BINDING SITE, designated SEQ ID:38452, to the nucleotide sequence of VGAM249 RNA, herein designated VGAM RNA, also designated SEQ ID:2960.

Another function of VGAM249 is therefore inhibition of LOC148089 (Accession XM_086040). Accordingly, utilities of VGAM249 include diagnosis, prevention and treatment of diseases and clinical conditions associated with LOC148089. LOC220883 (Accession XM_166076) is another VGAM249 host target gene. LOC220883 BINDING SITE is HOST TARGET binding site found in the 3' untranslated region of mRNA encoded by LOC220883, corresponding to a HOST TARGET binding site such as BINDING SITE I, BINDING SITE II or BINDING SITE III. Table 2 illustrates the complementarity of the nucleotide sequences of LOC220883 BINDING SITE, designated SEQ ID:43851, to the nucleotide sequence of VGAM249 RNA, herein designated VGAM RNA, also designated SEQ ID:2960.

Another function of VGAM249 is therefore inhibition of LOC220883 (Accession XM_166076). Accordingly, utilities of VGAM249 include diagnosis, prevention and treatment of diseases and clinical conditions associated with LOC220883. LOC51279 (Accession NM_016546) is another VGAM249 host target gene. LOC51279 BINDING SITE is HOST TARGET binding site found in the 3' untranslated region of mRNA encoded by LOC51279, corresponding to a HOST TARGET binding site such as BINDING SITE I, BINDING SITE II or BINDING SITE III. Table 2 illustrates the complementarity of the nucleotide sequences of LOC51279 BINDING SITE, designated SEQ ID:18617, to the nucleotide sequence of VGAM249 RNA, herein designated VGAM RNA, also designated SEQ ID:2960.

Another function of VGAM249 is therefore inhibition of LOC51279 (Accession NM_016546). Accordingly, utilities of VGAM249 include diagnosis, prevention and treatment of diseases and clinical conditions associated with LOC51279.

FIG. 1 further provides a conceptual description of a novel bioinformatically detected viral gene of the present invention, referred to here as Viral Genomic Address Messenger 250 (VGAM250) viral gene, which modulates expression of respective host target genes thereof, the function and utility of which host target genes is known in the art.

VGAM250 is a novel bioinformatically detected regulatory, non protein coding, viral micro RNA (miRNA) gene. The method by which VGAM250 was detected is described hereinabove with reference to FIGS. 1-8.

VGAM250 gene, herein designated VGAM GENE, is a viral gene contained in the genome of Callitrichine Herpesvirus 3. VGAM250 host target gene, herein designated VGAM HOST TARGET GENE, is a human gene contained in the human genome.

VGAM250 gene encodes a VGAM250 precursor RNA, herein designated VGAM PRECURSOR RNA. Similar to other miRNA genes, and unlike most ordinary genes, VGAM250 precursor RNA does not encode a protein. A nucleotide sequence identical or highly similar to the nucleotide sequence of VGAM250 precursor RNA is designated SEQ ID:236, and is provided hereinbelow with reference to the sequence listing part. Nucleotide sequence SEQ ID:236 is located at position 23102 relative to the genome of Callitrichine Herpesvirus 3.

VGAM250 precursor RNA folds onto itself, forming VGAM250 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM250 folded precursor RNA into VGAM250 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM250 RNA is designated SEQ ID:2961, and is provided hereinbelow with reference to the sequence listing part.

VGAM250 host target gene, herein designated VGAM HOST TARGET GENE, encodes a corresponding messenger RNA, VGAM250 host target RNA, herein designated VGAM HOST TARGET RNA. VGAM250 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM250 RNA, herein designated VGAM RNA, binds complementarily to one or more host target binding sites located in untranslated regions of VGAM250 host target RNA, herein designated VGAM HOST TARGET RNA. This complementary binding is due to the fact that the nucleotide sequence of VGAM250 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM250 RNA, herein designated VGAM RNA, may have a different number of host target binding sites in untranslated regions of a VGAM250 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM250 RNA, herein designated VGAM RNA, to host target binding sites on VGAM250 host target RNA, herein designated VGAM HOST TARGET RNA, such as BINDING SITE I, BINDING SITE II and BINDING SITE III, inhibits translation of VGAM250 host target RNA into VGAM250 host target protein, herein designated VGAM HOST TARGET PROTEIN. VGAM host target protein is therefore outlined by a broken line.

It is appreciated that VGAM250 host target gene, herein designated VGAM HOST TARGET GENE, in fact represents a plurality of VGAM250 host target genes. The mRNA of each one of this plurality of VGAM250 host target genes comprises one or more host target binding sites, each having a nucleotide sequence which is at least partly complementary to VGAM250 RNA, herein designated VGAM RNA, and which when bound by VGAM250 RNA causes inhibition of translation of respective one or more VGAM250 host target proteins.

It is further appreciated by one skilled in the art that the mode of translational inhibition illustrated by FIG. 1 with specific reference to translational inhibition exerted by VGAM250 gene, herein designated VGAM GENE, on one or more VGAM250 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM250 is inhibition of expression of host target genes, as part of a novel viral mechanism of attacking a host. Accordingly, utilities of VGAM250 include diagnosis, prevention and treatment of viral infection by Callitrichine Herpesvirus 3. Specific functions, and accordingly utilities, of VGAM250 correlate with, and may be deduced from, the identity of the host target genes which VGAM250 binds and inhibits, and the function of these target genes, as elaborated hereinbelow.

Nucleotide sequences of the VGAM250 precursor RNA, herein designated VGAM PRECURSOR RNA, and of the 'diced' VGAM250 RNA, herein designated VGAM RNA, and a schematic representation of the secondary folding of VGAM250 folded precursor RNA, herein designated VGAM FOLDED PRECURSOR RNA, of VGAM250 are further described hereinbelow with reference to Table 1.

Nucleotide sequences of host target binding sites, such as BINDING SITE-I, BINDING SITE-II and BINDING SITE-III of FIG. 1, found on VGAM250 host target RNA, and schematic representation of the complementarity of each of these host target binding sites to VGAM250 RNA, herein designated VGAM RNA, are described hereinbelow with reference to Table 2.

As mentioned hereinabove with reference to FIG. 1, a function of VGAM250 gene, herein designated VGAM is inhibition of expression of VGAM250 target genes. It is appreciated that specific functions, and accordingly utilities, of VGAM250 correlate with, and may be deduced from, the identity of the target genes which VGAM250 binds and inhibits, and the function of these target genes, as elaborated hereinbelow.

Optic Atrophy 3 (autosomal recessive, with chorea and spastic paraplegia) (OPA3, Accession NM_025136) is a VGAM250 host target gene. OPA3 BINDING SITE is HOST TARGET binding site found in the 3' untranslated region of mRNA encoded by OPA3, corresponding to a HOST TARGET binding site such as BINDING SITE I, BINDING SITE II or BINDING SITE III. Table 2 illustrates the complementarity of the nucleotide sequences of OPA3 BINDING SITE, designated SEQ ID:24774, to the nucleotide sequence of VGAM250 RNA, herein designated VGAM RNA, also designated SEQ ID:2961.

A function of VGAM250 is therefore inhibition of Optic Atrophy 3 (autosomal recessive, with chorea and spastic paraplegia) (OPA3, Accession NM_025136). Accordingly, utilities of VGAM250 include diagnosis, prevention and treatment of diseases and clinical conditions associated with OPA3. Secreted Frizzled-related Protein 1 (SFRP1, Accession NM_003012) is another VGAM250 host target gene. SFRP1 BINDING SITE is HOST TARGET binding site found in the 3' untranslated region of mRNA encoded by SFRP1, corresponding to a HOST TARGET binding site such as BINDING SITE I, BINDING SITE II or BINDING SITE III. Table 2 illustrates the complementarity of the nucleotide sequences of SFRP1 BINDING SITE, designated SEQ ID:8931, to the nucleotide sequence of VGAM250 RNA, herein designated VGAM RNA, also designated SEQ ID:2961.

Another function of VGAM250 is therefore inhibition of Secreted Frizzled-related Protein 1 (SFRP1, Accession NM_003012), a gene which is a receptor for wnt proteins that may have an anti-apoptotic function. Accordingly, utilities of VGAM250 include diagnosis, prevention and treatment of diseases and clinical conditions associated with SFRP1. The function of SFRP1 has been established by previous studies. A frequent epigenetic change in cancer involves aberrantly hypermethylated CpG islands in gene promoters, with loss of transcription of the genes (Baylin and Herman, (2000)) Cameron et al. (1999) showed that silencing of hypermethylated genes in cancer is dependent on both methylation of dense CpG islands and histone deacetylase (see OMIM Ref. No. 601241) activity. Suzuki et al. (2002) used cDNA microarray analysis to screen for genes that are epigenetically silenced in human colorectal cancer. By screening over 10,000 genes, they showed that they could identify a substantial number of genes with promoter hypermethylation in a given cancer;

these are distinct from genes with unmethylated promoters, for which increased expression is produced by histone deacetylase inhibition alone. Many of the hypermethylated genes identified have high potential for roles in tumorigenesis by virtue of their predicted function and chromosome position. They also identified a group of genes that are preferentially hypermethylated in colorectal cancer and gastric cancer. One of these genes, SFRP1, belongs to a gene family; Suzuki et al. (2002) showed that hypermethylation of 4 genes in this family occur frequently in colorectal cancer, providing for (i) a unique potential mechanism for loss of tumor suppressor gene function and (ii) construction of a molecular marker panel that could detect virtually all colorectal cancer. Fukuhara et al. (2002) investigated the expression and function of SFRP1 in uterine leiomyomas. Northern and Western blot analyses detected increased SFRP1 expression in leiomyomas compared with normal myometrium. Expression was strongest in the late follicular phase (high estrogenic milieu) of the menstrual cycle. Interestingly, expression was negligible in leiomyomas treated with GNRH agonist. They authors concluded that strong SFRP1 expression, which appeared to be independent of cell proliferation, under high estrogenic conditions contributes to the development of uterine leiomyomas through the antiapoptotic effect of SFRP1.

Full details of the abovementioned studies are described in the following publications, the disclosure of which are hereby incorporated by reference:

Suzuki, H.; Gabrielson, E.; Chen, W.; Anbazhagan, R.; van Engeland, M.; Weijenberg, M. P.; Herman, J. G.; Baylin, S. B.: A genomic screen for genes upregulated by demethylation and histone deacetylase inhibition in human colorectal cancer. Nature Genet. 31:141-149, 2002; and Fukuhara, K.; Kariya, M.; Kita, M.; Shime, H.; Kanamori, T.; Kosaka, C.; Orii, A.; Fujita, J.; Fujii, S.: Secreted frizzled related protein 1 is overexpressed in uterine leiomyomas, ass.

Further studies establishing the function and utilities of SFRP1 are found in John Hopkins OMIM database record ID 604156, and in sited publications numbered 420-425 listed in the bibliography section hereinbelow, which are also hereby incorporated by reference. Steroid Sulfatase (microsomal), Arylsulfatase C, Isozyme S (STS, Accession NM_000351) is another VGAM250 host target gene. STS BINDING SITE is HOST TARGET binding site found in the 3' untranslated region of mRNA encoded by STS, corresponding to a HOST TARGET binding site such as BINDING SITE I, BINDING SITE II or BINDING SITE III. Table 2 illustrates the complementarity of the nucleotide sequences of STS BINDING SITE, designated SEQ ID:5909, to the nucleotide sequence of VGAM250 RNA, herein designated VGAM RNA, also designated SEQ ID:2961.

Another function of VGAM250 is therefore inhibition of Steroid Sulfatase (microsomal), Arylsulfatase C, Isozyme S (STS, Accession NM_000351). Accordingly, utilities of VGAM250 include diagnosis, prevention and treatment of diseases and clinical conditions associated with STS. TNF Receptor-associated Factor 1 (TRAF1, Accession NM_005658) is another VGAM250 host target gene. TRAF1 BINDING SITE is HOST TARGET binding site found in the 3' untranslated region of mRNA encoded by TRAF1, corresponding to a HOST TARGET binding site such as BINDING SITE I, BINDING SITE II or BINDING SITE III. Table 2 illustrates the complementarity of the nucleotide sequences of TRAF1 BINDING SITE, designated SEQ ID:12199, to the nucleotide sequence of VGAM250 RNA, herein designated VGAM RNA, also designated SEQ ID:2961.

Another function of VGAM250 is therefore inhibition of TNF Receptor-associated Factor 1 (TRAF1, Accession NM_005658), a gene which signal transducer associated with the cytoplasmic domain of the 75 kda tumor necrosis factor receptor (tnf-r2). Accordingly, utilities of VGAM250 include diagnosis, prevention and treatment of diseases and clinical conditions associated with TRAF1. The function of TRAF1 has been established by previous studies. In order to determine how tumor necrosis factor (TNF; 191160) elicits cellular response, factors that interact with the cytoplasmic domain of TNF receptor-2 (TNFR2; 191191) were identified. Rothe et al. (1994) used the yeast-based 2-hybrid system to detect mouse proteins that interact with TNFR2. They identified and cloned 2 TNF receptor-associated factors, which they termed TRAF1 and TRAF2 (OMIM Ref. No. 601895). Each of the TRAFs contains a C-terminal TRAF domain of approximately 230 amino acids. TRAF1 and TRAF2 can form both homo- and heterodimers. Mosialos et al. (1995) identified the human homolog of TRAF1 as Epstein-Barr virus (EBV)-induced mRNA 6 (EBI6), an mRNA that is more abundant in EBV-infected B lymphoblasts than in uninfected control cells. The predicted 416-amino acid human protein is 86% identical to mouse TRAF1. Both the human and mouse proteins contain N-terminal zinc finger motifs and C-terminal TRAF domains. Northern blot analysis revealed that the 2.6-kb EBI6 mRNA is expressed in lung, spleen, tonsil, and weakly in placenta. Mosialos et al. (1995) found that LMP1, the EBV-transforming protein, specifically associates with LAP1 (TRAF3) or EBI6 in B lymphoblasts. LMP1 expression redirects LAP1 and EBI6 from scattered cytoplasmic structures to LMP1 plasma membrane patches. Both LAP1 and EBI6 associated with the cytoplasmic domain of p80/TNFR2 in vivo. The authors stated that the interaction of LMP1 with the LAP1 and EBI6 TNFR-associated proteins is evidence for the role of these proteins in signaling, and links LMP1-mediated transformation to signal transduction from the TNFR family. The structural hallmark of signal-transducing proteins associated with members of the TNFR superfamily is a novel C-terminal homology region of 230 amino acids, designated the TRAF domain. This domain is involved in a variety of specific protein-protein interactions. Siemienski et al. (1997) found that the human TRAF1 gene has a total length of approximately 12 kb. It is split into 6 exons, 4 of which encode parts of the TRAF domain. Analysis of the genomic structure of the TRAF domains of TRAF2 and TRAF3 (OMIM Ref. No. 601896) suggest that these domains are also encoded by several exons. Animal model experiments lend further support to the function of TRAF1. Tsitsikov et al. (2001) generated Traf1 null mice. Although lymphocyte development was normal, T cells responded to anti-CD3 stimulation with enhanced proliferation. Through TNFR2, but not through TNFR1 (OMIM Ref. No. 191190), they also exhibited enhanced proliferation as well as NFKB (OMIM Ref. No. 164011) and AP1 activation. TNF-induced, lymphocyte-dependent skin necrosis occurred in Traf1 -/- mice at a suboptimal dose of the cytokine. Tsitsikov et al. (2001) concluded that TRAF1 negatively regulates TNFR2-mediated proliferation and NFKB activation It is appreciated that the abovementioned animal model for TRAF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Siemienski, K.; Peters, N.; Scheurich, P.; Wajant, H.: Organization of the human tumour necrosis factor receptor-associated factor 1 (TRAF1) gene and mapping to chromosome 9q33-34. Gene 195:35-39, 1997; and Tsitsikov, E. N.; Laouini, D.; Dunn, I. F.; Sannikova, T. Y.; Davidson, L.; Alt, F. W.; Geha, R. S.: TRAF1 is a negative regulator of TNF signaling: enhanced TNF signaling in TRAF1-defi.

Further studies establishing the function and utilities of TRAF1 are found in John Hopkins OMIM database record ID 601711, and in sited publications numbered 8862-8865 listed in the bibliography section hereinbelow, which are also hereby incorporated by reference. KIAA1165 (Accession XM_041162) is another VGAM250 host target gene. KIAA1165 BINDING SITE is HOST TARGET binding site found in the 3' untranslated region of mRNA encoded by KIAA1165, corresponding to a HOST TARGET binding site such as BINDING SITE I, BINDING SITE II or BINDING SITE III. Table 2 illustrates the complementarity of the nucleotide sequences of KIAA1165 BINDING SITE, designated SEQ ID:33477, to the nucleotide sequence of VGAM250 RNA, herein designated VGAM RNA, also designated SEQ ID:2961.

Another function of VGAM250 is therefore inhibition of KIAA1165 (Accession XM_041162). Accordingly, utilities of VGAM250 include diagnosis, prevention and treatment of diseases and clinical conditions associated with KIAA1165. KIAA1822 (Accession XM_041566) is another VGAM250 host target gene. KIAA1822 BINDING SITE is HOST TARGET binding site found in the 3' untranslated region of mRNA encoded by KIAA1822, corresponding to a HOST TARGET binding site such as BINDING SITE I, BINDING SITE II or BINDING SITE III. Table 2 illustrates the complementarity of the nucleotide sequences of KIAA1822 BINDING SITE, designated SEQ ID:33552, to the nucleotide sequence of VGAM250 RNA, herein designated VGAM RNA, also designated SEQ ID:2961.

Another function of VGAM250 is therefore inhibition of KIAA1822 (Accession XM_041566). Accordingly, utilities of VGAM250 include diagnosis, prevention and treatment of diseases and clinical conditions associated with KIAA1822. PRIC285 (Accession XM_028918) is another VGAM250 host target gene. PRIC285 BINDING SITE is HOST TARGET binding site found in the 3' untranslated region of mRNA encoded by PRIC285, corresponding to a HOST TARGET binding site such as BINDING SITE I, BINDING SITE II or BINDING SITE III. Table 2 illustrates the complementarity of the nucleotide sequences of PRIC285 BINDING SITE, designated SEQ ID:30804, to the nucleotide sequence of VGAM250 RNA, herein designated VGAM RNA, also designated SEQ ID:2961.

Another function of VGAM250 is therefore inhibition of PRIC285 (Accession XM_028918). Accordingly, utilities of VGAM250 include diagnosis, prevention and treatment of diseases and clinical conditions associated with PRIC285. LOC146714 (Accession XM_097072) is another VGAM250 host target gene. LOC146714 BINDING SITE is HOST TARGET binding site found in the 5' untranslated region of mRNA encoded by LOC146714, corresponding to a HOST TARGET binding site such as BINDING SITE I, BINDING SITE II or BINDING SITE III. Table 2 illustrates the complementarity of the nucleotide sequences of LOC146714 BINDING SITE, designated SEQ ID:40721, to the nucleotide sequence of VGAM250 RNA, herein designated VGAM RNA, also designated SEQ ID:2961.

Another function of VGAM250 is therefore inhibition of LOC146714 (Accession XM_097072). Accordingly, utilities of VGAM250 include diagnosis, prevention and treatment of diseases and clinical conditions associated with LOC146714. LOC149832 (Accession XM_097733) is another VGAM250 host target gene. LOC149832 BINDING SITE is HOST TARGET binding site found in the 5' untranslated region of mRNA encoded by LOC149832, corresponding to a HOST TARGET binding site such as BINDING SITE I, BINDING SITE II or BINDING SITE III. Table 2 illustrates the complementarity of the nucleotide sequences of LOC149832 BINDING SITE, designated SEQ ID:41081, to the nucleotide sequence of VGAM250 RNA, herein designated VGAM RNA, also designated SEQ ID:2961.

Another function of VGAM250 is therefore inhibition of LOC149832 (Accession XM_097733). Accordingly, utilities of VGAM250 include diagnosis, prevention and treatment of diseases and clinical conditions associated with LOC149832. LOC159110 (Accession XM_088753) is another VGAM250 host target gene. LOC159110 BINDING SITE is HOST TARGET binding site found in the 3' untranslated region of mRNA encoded by LOC159110, corresponding to a HOST TARGET binding site such as BINDING SITE I, BINDING SITE II or BINDING SITE III. Table 2 illustrates the complementarity of the nucleotide sequences of LOC159110 BINDING SITE, designated SEQ ID:39942, to the nucleotide sequence of VGAM250 RNA, herein designated VGAM RNA, also designated SEQ ID:2961.

Another function of VGAM250 is therefore inhibition of LOC159110 (Accession XM_088753). Accordingly, utilities of VGAM250 include diagnosis, prevention and treatment of diseases and clinical conditions associated with LOC159110. LOC159116 (Accession XM_088752) is another VGAM250 host target gene. LOC159116 BINDING SITE is HOST TARGET binding site found in the 3' untranslated region of mRNA encoded by LOC159116, corresponding to a HOST TARGET binding site such as BINDING SITE I, BINDING SITE II or BINDING SITE III. Table 2 illustrates the complementarity of the nucleotide sequences of LOC159116 BINDING SITE, designated SEQ ID:39940, to the nucleotide sequence of VGAM250 RNA, herein designated VGAM RNA, also designated SEQ ID:2961.

Another function of VGAM250 is therefore inhibition of LOC159116 (Accession XM_088752). Accordingly, utilities of VGAM250 include diagnosis, prevention and treatment of diseases and clinical conditions associated with LOC159116. LOC199958 (Accession XM_117163) is another VGAM250 host target gene. LOC199958 BINDING SITE is HOST TARGET binding site found in the 3' untranslated region of mRNA encoded by LOC199958, corresponding to a HOST TARGET binding site such as BINDING SITE I, BINDING SITE II or BINDING SITE III. Table 2 illustrates the complementarity of the nucleotide sequences of LOC199958 BINDING SITE, designated SEQ ID:43264, to the nucleotide sequence of VGAM250 RNA, herein designated VGAM RNA, also designated SEQ ID:2961.

Another function of VGAM250 is therefore inhibition of LOC199958 (Accession XM_117163). Accordingly, utilities of VGAM250 include diagnosis, prevention and treatment of diseases and clinical conditions associated with LOC199958. LOC205251 (Accession XM_119554) is another VGAM250 host target gene. LOC205251 BINDING SITE is HOST TARGET binding site found in the 5' untranslated region of mRNA encoded by LOC205251, corresponding to a HOST TARGET binding site such as BINDING SITE I, BINDING SITE II or BINDING SITE III. Table 2 illustrates the complementarity of the nucleotide sequences of LOC205251 BINDING SITE, designated SEQ ID:43587, to the nucleotide sequence of VGAM250 RNA, herein designated VGAM RNA, also designated SEQ ID:2961.

Another function of VGAM250 is therefore inhibition of LOC205251 (Accession XM_119554). Accordingly, utilities of VGAM250 include diagnosis, prevention and treatment of diseases and clinical conditions associated with LOC205251. LOC220021 (Accession XM_167814) is another VGAM250 host target gene. LOC220021 BINDING SITE is HOST TARGET binding site found in the 3' untranslated region of mRNA encoded by LOC220021, corresponding to a HOST TARGET binding site such as BINDING SITE I, BINDING SITE II or BINDING SITE III. Table 2 illustrates the complementarity of the nucleotide sequences of LOC220021 BINDING SITE, designated SEQ ID:44852, to the nucleotide sequence of VGAM250 RNA, herein designated VGAM RNA, also designated SEQ ID:2961.

Another function of VGAM250 is therefore inhibition of LOC220021 (Accession XM_167814). Accordingly, utilities of VGAM250 include diagnosis, prevention and treatment of diseases and clinical conditions associated with LOC220021. LOC254100 (Accession XM_172851) is another VGAM250 host target gene. LOC254100 BINDING SITE is HOST TARGET binding site found in the 3' untranslated region of mRNA encoded by LOC254100, corresponding to a HOST TARGET binding site such as BINDING SITE I, BINDING SITE II or BINDING SITE III. Table 2 illustrates the complementarity of the nucleotide sequences of LOC254100 BINDING SITE, designated SEQ ID:46128, to the nucleotide sequence of VGAM250 RNA, herein designated VGAM RNA, also designated SEQ ID:2961.

Another function of VGAM250 is therefore inhibition of LOC254100 (Accession XM_172851). Accordingly, utilities of VGAM250 include diagnosis, prevention and treatment of diseases and clinical conditions associated with LOC254100. LOC56920 (Accession NM_020163) is another VGAM250 host target gene. LOC56920 BINDING SITE is HOST TARGET binding site found in the 3' untranslated region of mRNA encoded by LOC56920, corresponding to a HOST TARGET binding site such as BINDING SITE I, BINDING SITE II or BINDING SITE III. Table 2 illustrates the complementarity of the nucleotide sequences of LOC56920 BINDING SITE, designated SEQ ID:21382, to the nucleotide sequence of VGAM250 RNA, herein designated VGAM RNA, also designated SEQ ID:2961.

Another function of VGAM250 is therefore inhibition of LOC56920 (Accession NM_020163). Accordingly, utilities of VGAM250 include diagnosis, prevention and treatment of diseases and clinical conditions associated with LOC56920. FIG. 1 further provides a conceptual description of a novel bioinformatically detected viral gene of the present invention, referred to here as Viral Genomic Address Messenger 251 (VGAM251) viral gene, which modulates expression of respective host target genes thereof, the function and utility of which host target genes is known in the art.

VGAM251 is a novel bioinformatically detected regulatory, non protein coding, viral micro RNA (miRNA) gene. The method by which VGAM251 was detected is described hereinabove with reference to FIGS. 1-8.

VGAM251 gene, herein designated VGAM GENE, is a viral gene contained in the genome of Callitrichine Herpesvirus 3. VGAM251 host target gene, herein designated VGAM HOST TARGET GENE, is a human gene contained in the human genome.

VGAM251 gene encodes a VGAM251 precursor RNA, herein designated VGAM PRECURSOR RNA. Similar to other miRNA genes, and unlike most ordinary genes, VGAM251 precursor RNA does not encode a protein. A nucleotide sequence identical or highly similar to the nucleotide sequence of VGAM251 precursor RNA is designated SEQ ID:237, and is provided hereinbelow with reference to the sequence listing part. Nucleotide sequence SEQ ID:237 is located at position 21575 relative to the genome of Callitrichine Herpesvirus 3.

VGAM251 precursor RNA folds onto itself, forming VGAM251 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM251 folded precursor RNA into VGAM251 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM251 RNA is designated SEQ ID:2962, and is provided hereinbelow with reference to the sequence listing part.

VGAM251 host target gene, herein designated VGAM HOST TARGET GENE, encodes a corresponding messenger RNA, VGAM251 host target RNA, herein designated VGAM HOST TARGET RNA. VGAM251 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM251 RNA, herein designated VGAM RNA, binds complementarily to one or more host target binding sites located in untranslated regions of VGAM251 host target RNA, herein designated VGAM HOST TARGET RNA. This complementary binding is due to the fact that the nucleotide sequence of VGAM251 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM251 RNA, herein designated VGAM RNA, may have a different number of host target binding sites in untranslated regions of a VGAM251 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM251 RNA, herein designated VGAM RNA, to host target binding sites on VGAM251 host target RNA, herein designated VGAM HOST TARGET RNA, such as BINDING SITE I, BINDING SITE II and BINDING SITE III, inhibits translation of VGAM251 host target RNA into VGAM251 host target protein, herein designated VGAM HOST TARGET PROTEIN. VGAM host target protein is therefore outlined by a broken line.

It is appreciated that VGAM251 host target gene, herein designated VGAM HOST TARGET GENE, in fact represents a plurality of VGAM251 host target genes. The mRNA of each one of this plurality of VGAM251 host target genes comprises one or more host target binding sites, each having a nucleotide sequence which is at least partly complementary to VGAM251 RNA, herein designated VGAM RNA, and which when bound by VGAM251 RNA causes inhibition of translation of respective one or more VGAM251 host target proteins.

It is further appreciated by one skilled in the art that the mode of translational inhibition illustrated by FIG. 1 with specific reference to translational inhibition exerted by VGAM251 gene, herein designated VGAM GENE, on one or more VGAM251 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM251 is inhibition of expression of host target genes, as part of a novel viral mechanism of attacking a host. Accordingly, utilities of VGAM251 include diagnosis, prevention and treatment of viral infection by Callitrichine Herpesvirus 3. Specific functions, and accordingly utilities, of VGAM251 correlate with, and may be deduced from, the identity of the host target genes which VGAM251 binds and inhibits, and the function of these host target genes, as elaborated hereinbelow.

Nucleotide sequences of the VGAM251 precursor RNA, herein designated VGAM PRECURSOR RNA, and of the 'diced' VGAM251 RNA, herein designated VGAM RNA, and a schematic representation of the secondary folding of VGAM251 folded precursor RNA, herein designated VGAM FOLDED PRECURSOR RNA, of VGAM251 are further described hereinbelow with reference to Table 1.

Nucleotide sequences of host target binding sites, such as BINDING SITE-I, BINDING SITE-II and BINDING SITE-III of FIG. 1, found on VGAM251 host target RNA, and schematic representation of the complementarity of each of these host target binding sites to VGAM251 RNA, herein designated VGAM RNA, are described hereinbelow with reference to Table 2.

As mentioned hereinabove with reference to FIG. 1, a function of VGAM251 gene, herein designated VGAM is inhibition of expression of VGAM251 target genes. It is appreciated that specific functions, and accordingly utilities, of VGAM251 correlate with, and may be deduced from, the identity of the target genes which VGAM251 binds and inhibits, and the function of these target genes, as elaborated hereinbelow.

Aldehyde Dehydrogenase 3 Family, Member B2 (ALDH3B2, Accession NM_000695) is a VGAM251 host target gene. ALDH3B2 BINDING SITE is HOST TARGET binding site found in the 3' untranslated region of mRNA encoded by ALDH3B2, corresponding to a HOST TARGET binding site such as BINDING SITE I, BINDING SITE II or BINDING SITE III. Table 2 illustrates the complementarity of the nucleotide sequences of ALDH3B2 BINDING SITE, designated SEQ ID:6358, to the nucleotide sequence of VGAM251 RNA, herein designated VGAM RNA, also designated SEQ ID:2962.

A function of VGAM251 is therefore inhibition of Aldehyde Dehydrogenase 3 Family, Member B2 (ALDH3B2, Accession NM_000695), a gene which may play a role in alcohol detoxitation. Accordingly, utilities of VGAM251 include diagnosis, prevention and treatment of diseases and clinical conditions associated with ALDH3B2. The function of ALDH3B2 has been established by previous studies. See ALDH1 (OMIM Ref. No. 100640). Hsu et al. (1995) and Hsu and Chang (1996) reported the cloning, sequencing and expression of the human ALDH8 gene. Hsu et al. (1997) determined the structure of the ALDH7 (OMIM Ref. No. 600466) and ALDH8 genes. The ALDH7 gene spans about 20 kb of genomic DNA and contains 9 coding exons. The ALDH8 gene is over 10 kb long and contains at least 10 exons. The ALDH8 gene contains an in-frame stop codon at the seventeenth codon position from the first initiator methionine. The coding region of the ALDH7 gene shows about 86% nucleotide identity with the corresponding region of the ALDH8 gene. The numbers and positions of the introns of the 2 genes are conserved, suggesting that gene duplication is involved in the expansion of the ALDH gene family. The human ALDH7 and ALDH8 genes have a close evolutionary relationship with human ALDH3 (OMIM Ref. No. 100660). The International Radiation Hybrid Mapping Consortium mapped the ALDH8 gene to chromosome 11 (OMIM Ref. No. U37519).

Full details of the abovementioned studies are described in the following publications, the disclosure of which are hereby incorporated by reference:

Hsu, L. C.; Chang, W.-C.: Sequencing and expression of the human ALDH8 encoding a new member of the aldehyde dehydrogenase family. Gene 174:319-322, 1996; and Hsu, L. C.; Chang, W.-C.; Lin, S. W.; Yoshida, A.: Cloning and characterization of genes encoding four additional human aldehyde dehydrogenase isozymes. Adv. Exp. Med. Biol. 372:159-1.

Further studies establishing the function and utilities of ALDH3B2 are found in John Hopkins OMIM database record ID 601917, and in sited publications numbered 9140-914 and 7732 listed in the bibliography section hereinbelow, which are also hereby incorporated by reference. Enhancer of Zeste Homolog 1 (Drosophila) (EZH1, Accession NM_001991) is another VGAM251 host target gene. EZH1 BINDING SITE is HOST TARGET binding site found in the 3' untranslated region of mRNA encoded by EZH1, corresponding to a HOST TARGET binding site such as BINDING SITE I, BINDING SITE II or BINDING SITE III. Table 2 illustrates the complementarity of the nucleotide sequences of EZH1 BINDING SITE, designated SEQ ID:7715, to the nucleotide sequence of VGAM251 RNA, herein designated VGAM RNA, also designated SEQ ID:2962.

Another function of VGAM251 is therefore inhibition of Enhancer of Zeste Homolog 1 (Drosophila) (EZH1, Accession NM_001991), a gene which may act in transcriptional regulation and heterochromatin maintenance. Accordingly, utilities of VGAM251 include diagnosis, prevention and treatment of diseases and clinical conditions associated with EZH1. The function of EZH1 has been established by previous studies. Transcription mapping efforts within chromosome 17q21 identified a human homolog of the Drosophila gene 'enhancer of zeste' E(z). In Drosophila, the gene acts as a negative regulator of segment identity genes of the Antennapedia and Bithorax complexes. Abel et al. (1996) reported the full-length protein coding sequence of the human homolog, EZH1, and compared the respective protein sequences in human and Drosophila. EZH1 encodes a protein of 747 amino acids that displays 55% amino acid identity overall (70% similarity) with the Drosophila protein. The strong sequence conservation suggested potential roles for EZH1 in human development as a transcriptional regulator and as a component of protein complexes that stably maintain heterochromatin. EZH1 is expressed as 2 major transcripts in all adult and fetal human tissues surveyed; comparison of cloned cDNAs suggested that alternative splicing may account for at least part of the transcript size differences. Analysis of an EZH1 cDNA revealed an unusual splicing event involving EZH1 and a tandemly linked gene GPR2 (OMIM Ref. No. 600240) and suggested a potential mechanism for modifying the EZH1 protein in the conserved C-terminal domain. The GPR2 gene maps to 17q21.1-q21.3 in the vicinity of the BRCA1 gene (OMIM Ref. No. 113705). See also EZH2 (OMIM Ref. No. 601573). By FISH, Laible et al. (1999) mapped the mouse Ezh1 gene to chromosome 11.

Full details of the abovementioned studies are described in the following publications, the disclosure of which are hereby incorporated by reference:

Abel, K. J.; Brody, L. C.; Valdes, J. M.; Erdos, M. R.; McKinley, D. R.; Castilla, L. H.; Merajver, S. D.; Couch, F. J.; Friedman, L. S.; Ostermeyer, E. A.; Lynch, E. D.; King, M.-C.; Welcsh, P. L.; Osborne-Lawrence, S.; Spillman, M.; Bowcock, A. M.; Collins, F. S.; Weber, B. L.: Characterization of EZH1, a human homolog of Drosophila enhancer of zeste near BRCA1. Genomics 37:161-171, 1996; and Laible, G.; Haynes, A. R.; Lebersorger, A.; O'Carroll, D.; Mattei, M.-G.; Denny, P.; Brown, S. D. M.; Jenuwein, T.: The murine polycomb-group genes Ezh1 and Ezh2 map close to Hox gene.

Further studies establishing the function and utilities of EZH1 are found in John Hopkins OMIM database record ID 601674, and in sited publications numbered 9485 listed in the bibliography section hereinbelow, which are also hereby incorporated by reference. GATA Binding Protein 2 (GATA2, Accession NM_002050) is another VGAM251 host target gene. GATA2 BINDING SITE is HOST TARGET binding site found in the 3' untranslated region of mRNA encoded by GATA2, corresponding to a HOST TARGET binding site such as BINDING SITE I, BINDING SITE II or BINDING SITE III. Table 2 illustrates the complementarity of the nucleotide sequences of GATA2 BINDING SITE, designated SEQ ID:7806, to the nucleotide sequence of VGAM251 RNA, herein designated VGAM RNA, also designated SEQ ID:2962.

Another function of VGAM251 is therefore inhibition of GATA Binding Protein 2 (GATA2, Accession NM_002050). Accordingly, utilities of VGAM251 include diagnosis, prevention and treatment of diseases and clinical conditions associated with GATA2. Peptidylprolyl Isomerase F (cyclophilin F) (PPIF, Accession NM_005729) is another VGAM251 host target gene. PPIF BINDING SITE is HOST TARGET binding site found in the 3' untranslated region of mRNA encoded by PPIF, corresponding to a HOST TARGET binding site such as BINDING SITE I, BINDING SITE II or BINDING SITE III. Table 2 illustrates the complementarity of the nucleotide sequences of PPIF BINDING SITE, designated SEQ ID:12282, to the nucleotide sequence of VGAM251 RNA, herein designated VGAM RNA, also designated SEQ ID:2962.

Another function of VGAM251 is therefore inhibition of Peptidylprolyl Isomerase F (cyclophilin F) (PPIF, Accession NM_005729), a gene which catalyzes the cis to trans isomerization of certain proline imidic peptide bonds in oligopeptides. Accordingly, utilities of VGAM251 include diagnosis, prevention and treatment of diseases and clinical conditions associated with PPIF. The function of PPIF has been established by previous studies. Cyclophilins, also referred to as rotamases, catalyze the cis to trans isomerization of certain proline imidic peptide bonds in oligopeptides, which can be the rate limiting step in the folding of proteins. By screening a human cDNA library with a CyP1 (peptidyl-prolyl isomerase) probe, Bergsma et al. (1991) isolated a novel cDNA, PPIF, which encodes a 207-amino acid protein.

Northern blot analysis showed that PPIF, which the authors termed CYP3, is expressed as a major 2-kb transcript in Jurkat cells. RNA slot blot analysis revealed expression of PPIF in most cell lines and types. Western blot analysis of Jurkat cells separated by differential centrifugation suggested that PPIF is predominantly associated with membranes or organelles. Bowles et al. (1999) characterized the genomic structure of the PPIF gene, which contains 6 exons. On the multigene physical map constructed by Deloukas et al. (1998), the PPIF gene was found to be located in the 10q21-q23 region. By screening BAC libraries for the presence of CEPH markers, Bowles et al. (1999) mapped the PPIF gene between D10S201 and D10S1777 at 10q22-q23. Bowles et al. (1999) studied PPIF as a candidate gene for a form of familial dilated cardiomyopathy (CMD1C; 601493) that maps to 10q21-q23, but found no mutation in the gene as a cause of the disorder.

Full details of the abovementioned studies are described in the following publications, the disclosure of which are hereby incorporated by reference:

Bowles, K. R.; Zintz, C.; Abraham, S. E.; Brandon, L.; Bowles, N. E.; Towbin, J. A.: Genomic characterization of the human peptidyl-prolyl-cis-trans-isomerase, mitochondrial precursor gene: assessment of its role in familial dilated cardiomyopathy. Hum. Genet. 105:582-586, 1999; and Deloukas, P.; Schuler, G. D.; Gyapay, G.; Beasley, E. M.; Soderlund, C.; Rodriguez-Tome, P.; Hui, L.; Matise, T. C.; McKusick, K. B.; Beckmann, J. S.; Bentolila, S.; Bihoreau, M.-T.; an.

Further studies establishing the function and utilities of PPIF are found in John Hopkins OMIM database record ID 604486, and in sited publications numbered 4749-475 and 12054 listed in the bibliography section hereinbelow, which are also hereby incorporated by reference. Transforming Growth Factor, Beta Receptor III (betaglycan, 300 kDa) (TGFBR3, Accession NM_003243) is another VGAM251 host target gene. TGFBR3 BINDING SITE is HOST TARGET binding site found in the 3' untranslated region of mRNA encoded by TGFBR3, corresponding to a HOST TARGET binding site such as BINDING SITE I, BINDING SITE II or BINDING SITE III. Table 2 illustrates the complementarity of the nucleotide sequences of TGFBR3 BINDING SITE, designated SEQ ID:9251, to the nucleotide sequence of VGAM251 RNA, herein designated VGAM RNA, also designated SEQ ID:2962.

Another function of VGAM251 is therefore inhibition of Transforming Growth Factor, Beta Receptor III (betaglycan, 300 kDa) (TGFBR3, Accession NM_003243), a gene which involves in capturing and retaining TGF-beta for presentation to the signaling receptors. Accordingly, utilities of VGAM251 include diagnosis, prevention and treatment of diseases and clinical conditions associated with TGFBR3. The function of TGFBR3 and its association with various diseases and clinical conditions, has been established by previous studies, as described hereinabove with reference to VGAM139. Apolipoprotein L, 2 (APOL2, Accession NM_030882) is another VGAM251 host target gene. APOL2 BINDING SITE is HOST TARGET binding site found in the 3' untranslated region of mRNA encoded by APOL2, corresponding to a HOST TARGET binding site such as BINDING SITE I, BINDING SITE II or BINDING SITE III. Table 2 illustrates the complementarity of the nucleotide sequences of APOL2 BINDING SITE, designated SEQ ID:25160, to the nucleotide sequence of VGAM251 RNA, herein designated VGAM RNA, also designated SEQ ID:2962.

Another function of VGAM251 is therefore inhibition of Apolipoprotein L, 2 (APOL2, Accession NM_030882).

Accordingly, utilities of VGAM251 include diagnosis, prevention and treatment of diseases and clinical conditions associated with APOL2. Calneuron 1 (CALN1, Accession NM_031468) is another VGAM251 host target gene. CALN1 BINDING SITE is HOST TARGET binding site found in the 3' untranslated region of mRNA encoded by CALN1, corresponding to a HOST TARGET binding site such as BINDING SITE I, BINDING SITE II or BINDING SITE III. Table 2 illustrates the complementarity of the nucleotide sequences of CALN1 BINDING SITE, designated SEQ ID:25511, to the nucleotide sequence of VGAM251 RNA, herein designated VGAM RNA, also designated SEQ ID:2962.

Another function of VGAM251 is therefore inhibition of Calneuron 1 (CALN1, Accession NM_031468). Accordingly, utilities of VGAM251 include diagnosis, prevention and treatment of diseases and clinical conditions associated with CALN1. DKFZP434E2135 (Accession NM_030804) is another VGAM251 host target gene. DKFZP434E2135 BINDING SITE is HOST TARGET binding site found in the 3' untranslated region of mRNA encoded by DKFZP434E2135, corresponding to a HOST TARGET binding site such as BINDING SITE I, BINDING SITE II or BINDING SITE III. Table 2 illustrates the complementarity of the nucleotide sequences of DKFZP434E2135 BINDING SITE, designated SEQ ID:25111, to the nucleotide sequence of VGAM251 RNA, herein designated VGAM RNA, also designated SEQ ID:2962.

Another function of VGAM251 is therefore inhibition of DKFZP434E2135 (Accession NM_030804). Accordingly, utilities of VGAM251 include diagnosis, prevention and treatment of diseases and clinical conditions associated with DKFZP434E2135. DKFZP586F1524 (Accession NM_015584) is another VGAM251 host target gene. DKFZP586F1524 BINDING SITE is HOST TARGET binding site found in the 3' untranslated region of mRNA encoded by DKFZP586F1524, corresponding to a HOST TARGET binding site such as BINDING SITE I, BINDING SITE II or BINDING SITE III. Table 2 illustrates the complementarity of the nucleotide sequences of DKFZP586F1524 BINDING SITE, designated SEQ ID:17852, to the nucleotide sequence of VGAM251 RNA, herein designated VGAM RNA, also designated SEQ ID:2962.

Another function of VGAM251 is therefore inhibition of DKFZP586F1524 (Accession NM_015584). Accordingly, utilities of VGAM251 include diagnosis, prevention and treatment of diseases and clinical conditions associated with DKFZP586F1524. FLJ10853 (Accession NM_018246) is another VGAM251 host target gene. FLJ10853 BINDING SITE is HOST TARGET binding site found in the 3' untranslated region of mRNA encoded by FLJ10853, corresponding to a HOST TARGET binding site such as BINDING SITE I, BINDING SITE II or BINDING SITE III. Table 2 illustrates the complementarity of the nucleotide sequences of FLJ10853 BINDING SITE, designated SEQ ID:20216, to the nucleotide sequence of VGAM251 RNA, herein designated VGAM RNA, also designated SEQ ID:2962.

Another function of VGAM251 is therefore inhibition of FLJ10853 (Accession NM_018246). Accordingly, utilities of VGAM251 include diagnosis, prevention and treatment of diseases and clinical conditions associated with FLJ10853. FLJ23071 (Accession NM_025192) is another VGAM251 host target gene. FLJ23071 BINDING SITE is HOST TARGET binding site found in the 3' untranslated region of mRNA encoded by FLJ23071, corresponding to a HOST TARGET binding site such as BINDING SITE I, BINDING SITE II or BINDING SITE III. Table 2 illustrates the complementarity of the nucleotide sequences of FLJ23071 BINDING SITE, designated SEQ ID:24848, to the nucleotide sequence of VGAM251 RNA, herein designated VGAM RNA, also designated SEQ ID:2962.

Another function of VGAM251 is therefore inhibition of FLJ23071 (Accession NM_025192). Accordingly, utilities of VGAM251 include diagnosis, prevention and treatment of diseases and clinical conditions associated with FLJ23071. KIAA0261 (Accession XM_042946) is another VGAM251 host target gene. KIAA0261 BINDING SITE is HOST TARGET binding site found in the 3' untranslated region of mRNA encoded by KIAA0261, corresponding to a HOST TARGET binding site such as BINDING SITE I, BINDING SITE II or BINDING SITE III. Table 2 illustrates the complementarity of the nucleotide sequences of KIAA0261 BINDING SITE, designated SEQ ID:33835, to the nucleotide sequence of VGAM251 RNA, herein designated VGAM RNA, also designated SEQ ID:2962.

Another function of VGAM251 is therefore inhibition of KIAA0261 (Accession XM_042946). Accordingly, utilities of VGAM251 include diagnosis, prevention and treatment of diseases and clinical conditions associated with KIAA0261. MGC2306 (Accession NM_032638) is another VGAM251 host target gene. MGC2306 BINDING SITE is HOST TARGET binding site found in the 3' untranslated region of mRNA encoded by MGC2306, corresponding to a HOST TARGET binding site such as BINDING SITE I, BINDING SITE II or BINDING SITE III. Table 2 illustrates the complementarity of the nucleotide sequences of MGC2306 BINDING SITE, designated SEQ ID:26356, to the nucleotide sequence of VGAM251 RNA, herein designated VGAM RNA, also designated SEQ ID:2962.

Another function of VGAM251 is therefore inhibition of MGC2306 (Accession NM_032638). Accordingly, utilities of VGAM251 include diagnosis, prevention and treatment of diseases and clinical conditions associated with MGC2306. Zinc Finger Protein, Subfamily 1A, 2 (Helios) (ZNFN1A2, Accession NM_016260) is another VGAM251 host target gene. ZNFN1A2 BINDING SITE is HOST TARGET binding site found in the 3' untranslated region of mRNA encoded by ZNFN1A2, corresponding to a HOST TARGET binding site such as BINDING SITE I, BINDING SITE II or BINDING SITE III. Table 2 illustrates the complementarity of the nucleotide sequences of ZNFN1A2 BINDING SITE, designated SEQ ID:18389, to the nucleotide sequence of VGAM251 RNA, herein designated VGAM RNA, also designated SEQ ID:2962.

Another function of VGAM251 is therefore inhibition of Zinc Finger Protein, Subfamily 1A, 2 (Helios) (ZNFN1A2, Accession NM_016260). Accordingly, utilities of VGAM251 include diagnosis, prevention and treatment of diseases and clinical conditions associated with ZNFN1A2. LOC149603 (Accession XM_047499) is another VGAM251 host target gene. LOC149603 BINDING SITE is HOST TARGET binding site found in the 3' untranslated region of mRNA encoded by LOC149603, corresponding to a HOST TARGET binding site such as BINDING SITE I, BINDING SITE II or BINDING SITE III. Table 2 illustrates the complementarity of the nucleotide sequences of LOC149603 BINDING SITE, designated SEQ ID:34969, to the nucleotide sequence of VGAM251 RNA, herein designated VGAM RNA, also designated SEQ ID:2962.

Another function of VGAM251 is therefore inhibition of LOC149603 (Accession XM_047499). Accordingly, utilities of VGAM251 include diagnosis, prevention and treatment of diseases and clinical conditions associated with LOC149603. LOC221466 (Accession XM_168087) is another VGAM251 host target gene. LOC221466 BINDING SITE is HOST TARGET binding site found in the 3' untranslated region of mRNA encoded by LOC221466, corresponding to a HOST TARGET binding site such as BINDING SITE I, BINDING SITE II or BINDING SITE III. Table 2 illustrates the complementarity of the nucleotide sequences of LOC221466 BINDING SITE, designated SEQ ID:44991, to the nucleotide sequence of VGAM251 RNA, herein designated VGAM RNA, also designated SEQ ID:2962.

Another function of VGAM251 is therefore inhibition of LOC221466 (Accession XM_168087). Accordingly, utilities of VGAM251 include diagnosis, prevention and treatment of diseases and clinical conditions associated with LOC221466. LOC91380 (Accession XM_038134) is another VGAM251 host target gene. LOC91380 BINDING SITE is HOST TARGET binding site found in the 5' untranslated region of mRNA encoded by LOC91380, corresponding to a HOST TARGET binding site such as BINDING SITE I, BINDING SITE II or BINDING SITE III. Table 2 illustrates the complementarity of the nucleotide sequences of LOC91380 BINDING SITE, designated SEQ ID:32754, to the nucleotide sequence of VGAM251 RNA, herein designated VGAM RNA, also designated SEQ ID:2962.

Another function of VGAM251 is therefore inhibition of LOC91380 (Accession XM_038134). Accordingly, utilities of VGAM251 include diagnosis, prevention and treatment of diseases and clinical conditions associated with LOC91380. FIG. 1 further provides a conceptual description of a novel bioinformatically detected viral gene of the present invention, referred to here as Viral Genomic Address Messenger 252 (VGAM252) viral gene, which modulates expression of respective host target genes thereof, the function and utility of which host target genes is known in the art.

VGAM252 is a novel bioinformatically detected regulatory, non protein coding, viral micro RNA (miRNA) gene. The method by which VGAM252 was detected is described hereinabove with reference to FIGS. 1-8.

VGAM252 gene, herein designated VGAM GENE, is a viral gene contained in the genome of Callitrichine Herpesvirus 3. VGAM252 host target gene, herein designated VGAM HOST TARGET GENE, is a human gene contained in the human genome.

VGAM252 gene encodes a VGAM252 precursor RNA, herein designated VGAM PRECURSOR RNA. Similar to other miRNA genes, and unlike most ordinary genes, VGAM252 precursor RNA does not encode a protein. A nucleotide sequence identical or highly similar to the nucleotide sequence of VGAM252 precursor RNA is designated SEQ ID:238, and is provided hereinbelow with reference to the sequence listing part. Nucleotide sequence SEQ ID:238 is located at position 138077 relative to the genome of Callitrichine Herpesvirus 3.

VGAM252 precursor RNA folds onto itself, forming VGAM252 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM252 folded precursor RNA into VGAM252 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM252 RNA is designated SEQ ID:2963, and is provided hereinbelow with reference to the sequence listing part.

VGAM252 host target gene, herein designated VGAM HOST TARGET GENE, encodes a corresponding messenger RNA, VGAM252 host target RNA, herein designated VGAM HOST TARGET RNA. VGAM252 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM252 RNA, herein designated VGAM RNA, binds complementarily to one or more host target binding sites located in untranslated regions of VGAM252 host target RNA, herein designated VGAM HOST TARGET RNA. This complementary binding is due to the fact that the nucleotide sequence of VGAM252 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM252 RNA, herein designated VGAM RNA, may have a different number of host target binding sites in untranslated regions of a VGAM252 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM252 RNA, herein designated VGAM RNA, to host target binding sites on VGAM252 host target RNA, herein designated VGAM HOST TARGET RNA, such as BINDING SITE I, BINDING SITE II and BINDING SITE III, inhibits translation of VGAM252 host target RNA into VGAM252 host target protein, herein designated VGAM HOST TARGET PROTEIN. VGAM host target protein is therefore outlined by a broken line.

It is appreciated that VGAM252 host target gene, herein designated VGAM HOST TARGET GENE, in fact represents a plurality of VGAM252 host target genes. The mRNA of each one of this plurality of VGAM252 host target genes comprises one or more host target binding sites, each having a nucleotide sequence which is at least partly complementary to VGAM252 RNA, herein designated VGAM RNA, and which when bound by VGAM252 RNA causes inhibition of translation of respective one or more VGAM252 host target proteins.

It is further appreciated by one skilled in the art that the mode of translational inhibition illustrated by FIG. 1 with specific reference to translational inhibition exerted by VGAM252 gene, herein designated VGAM GENE, on one or more VGAM252 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM252 is inhibition of expression of host target genes, as part of a novel viral mechanism of attacking a host. Accordingly, utilities of VGAM252 include diagnosis, prevention and treatment of viral infection by Callitrichine Herpesvirus 3. Specific functions, and accordingly utilities, of VGAM252 correlate with, and may be deduced from, the identity of the host target genes which VGAM252 binds and inhibits, and the function of these host target genes, as elaborated hereinbelow.

Nucleotide sequences of the VGAM252 precursor RNA, herein designated VGAM PRECURSOR RNA, and of the 'diced' VGAM252 RNA, herein designated VGAM RNA, and a schematic representation of the secondary folding of VGAM252 folded precursor RNA, herein designated VGAM FOLDED PRECURSOR RNA, of VGAM252 are further described hereinbelow with reference to Table 1.

Nucleotide sequences of host target binding sites, such as BINDING SITE-I, BINDING SITE-II and BINDING SITE-III of FIG. 1, found on VGAM252 host target RNA, and schematic representation of the complementarity of each of these host target binding sites to VGAM252 RNA, herein designated VGAM RNA, are described hereinbelow with reference to Table 2.

As mentioned hereinabove with reference to FIG. 1, a function of VGAM252 gene, herein designated VGAM is inhibition of expression of VGAM252 target genes. It is appreciated that specific functions, and accordingly utilities, of VGAM252 correlate with, and may be deduced from, the identity of the target genes which VGAM252 binds and inhibits, and the function of these target genes, as elaborated hereinbelow.

Kinesin-like 1 (KNSL1, Accession NM_004523) is a VGAM252 host target gene. KNSL1 BINDING SITE is HOST TARGET binding site found in the 3' untranslated region of mRNA encoded by KNSL1, corresponding to a HOST TARGET binding site such as BINDING SITE I, BINDING SITE II or BINDING SITE III. Table 2 illustrates the complementarity of the nucleotide sequences of KNSL1 BINDING SITE, designated SEQ ID:10861, to the nucleotide sequence of VGAM252 RNA, herein designated VGAM RNA, also designated SEQ ID:2963.

A function of VGAM252 is therefore inhibition of Kinesin-like 1 (KNSL1, Accession NM_004523), a gene which is a motor protein required for establishing a bipolar spindle. Accordingly, utilities of VGAM252 include diagnosis, prevention and treatment of diseases and clinical conditions associated with KNSL1. The function of KNSL1 has been established by previous studies. Kinesins are tubulin (see OMIM Ref. No. 191130) molecular motors that function to transport organelles within cells and to move chromosomes along microtubules during cell division. In sea urchin and mammalian cells, kinesins have been characterized as tetrameric proteins comprising 2 heavy chains (alpha chains) of approximately 120 kD and 2 light chains (beta chains) of approximately 70 kD. The alpha chains provide the tubulin binding site and the ATPase domains, whereas the beta chains are responsible for the specific attachment of the organelle to be moved by the kinesin tetramer. Kinesins transport their bound organelle to the plus end of the microtubule. Chernajovsky et al., (1996) noted that differential splicing occurs for the kinesin beta (light) cDNA sequences at the 3-prime end of the rat kinesin mRNA, producing kinesins having different C-terminal ends that seem to confer the kinesin specificity for organelle binding. Cabeza-Arvelaiz et al. (1993) isolated and sequenced a cDNA encoding the human kinesin light chain protein (KLC). The cDNA consists of 276 nucleotides of 5-prime untranslated region, a coding sequence of 1,710 nucleotides, and 322 nucleotides of 3-prime untranslated region. It encodes a polypeptide of 569 amino acids and a deduced molecular mass of 64,789 daltons. The predicted secondary internal structure of the KLC molecule consists of about 27 contiguous repeats, each of approximately 21 amino acids, and could be divided into 3 domains. See also 601334 Chernajovsky et al. (1996) characterized the human KNS2 gene product of a differentially spliced, T-cell-derived mRNA and cloned its promoter region. The promoter region transcribes constitutively. In permanently transfected human HeLa and NB100 neuroblastoma cells, a reporter gene containing the promoter and part of the first exon of beta kinesin was 75-fold more active than the HSV-tk promoter. The first exon contains a 5-prime untranslated sequence capable of forming a stable double-hairpin loop, which functions as a translational enhancer. Its deletion decreases the efficiency of in vitro translation of beta kinesin mRNA. Kamal et al. (2000) demonstrated that the axonal transport of APP (OMIM Ref. No. 104760) in neurons is mediated by the direct binding of APP to the kinesin light chain subunit of kinesin-I.

Full details of the abovementioned studies are described in the following publications, the disclosure of which are hereby incorporated by reference:

Goedert, M.; Marsh, S.; Carter, N.: Localization of the human kinesin light chain gene (KNS2) to chromosome 14q32.3 by fluorescence in situ hybridization. Genomics 32:173-175, 1996; and Kamal, A.; Stokin, G. B.; Yang, Z.; Xia, C.; Goldstein, L. S.: Axonal transport of amyloid precursor protein is mediated by direct binding to the kinesin light chain subunit of kinesin-.

Further studies establishing the function and utilities of KNSL1 are found in John Hopkins OMIM database record ID 148760, and in sited publications numbered 319 and 12000-3225 listed in the bibliography section hereinbelow, which are also hereby incorporated by reference. CDC14 Cell Division Cycle 14 Homolog B (S. cerevisiae) (CDC14B, Accession NM_003671) is another VGAM252 host target gene. CDC14B BINDING SITE1 and CDC14B BINDING SITE2 are HOST TARGET binding sites found in untranslated regions of mRNA encoded by CDC14B, corresponding to HOST TARGET binding sites such as BINDING SITE I, BINDING SITE II or BINDING SITE III. Table 2 illustrates the complementarity of the nucleotide sequences of CDC14B BINDING SITE1 and CDC14B BINDING SITE2, designated SEQ ID:9758 and SEQ ID:27162 respectively, to the nucleotide sequence of VGAM252 RNA, herein designated VGAM RNA, also designated SEQ ID:2963.

Another function of VGAM252 is therefore inhibition of CDC14 Cell Division Cycle 14 Homolog B (S. cerevisiae) (CDC14B, Accession NM_003671). Accordingly, utilities of VGAM252 include diagnosis, prevention and treatment of diseases and clinical conditions associated with CDC14B. FLJ11164 (Accession NM_018346) is another VGAM252 host target gene. FLJ11164 BINDING SITE is HOST TARGET binding site found in the 3' untranslated region of mRNA encoded by FLJ11164, corresponding to a HOST TARGET binding site such as BINDING SITE I, BINDING SITE II or BINDING SITE III. Table 2 illustrates the complementarity of the nucleotide sequences of FLJ11164 BINDING SITE, designated SEQ ID:20355, to the nucleotide sequence of VGAM252 RNA, herein designated VGAM RNA, also designated SEQ ID:2963.

Another function of VGAM252 is therefore inhibition of FLJ11164 (Accession NM_018346). Accordingly, utilities of VGAM252 include diagnosis, prevention and treatment of diseases and clinical conditions associated with FLJ11164. Rho-related BTB Domain Containing 2 (RHOBTB2, Accession XM_027679) is another VGAM252 host target gene. RHOBTB2 BINDING SITE is HOST TARGET binding site found in the 3' untranslated region of mRNA encoded by RHOBTB2, corresponding to a HOST TARGET binding site such as BINDING SITE I, BINDING SITE II or BINDING SITE III. Table 2 illustrates the complementarity of the nucleotide sequences of RHOBTB2 BINDING SITE, designated SEQ ID:30559, to the nucleotide sequence of VGAM252 RNA, herein designated VGAM RNA, also designated SEQ ID:2963.

Another function of VGAM252 is therefore inhibition of Rho-related BTB Domain Containing 2 (RHOBTB2, Accession XM_027679). Accordingly, utilities of VGAM252 include diagnosis, prevention and treatment of diseases and clinical conditions associated with RHOBTB2. LOC150577 (Accession XM_097918) is another VGAM252 host target gene. LOC150577 BINDING SITE is HOST TARGET binding site found in the 5' untranslated region of mRNA encoded by LOC150577, corresponding to a HOST TARGET binding site such as BINDING SITE I, BINDING SITE II or BINDING SITE III. Table 2 illustrates the complementarity of the nucleotide sequences of LOC150577 BINDING SITE, designated SEQ ID:41218, to the nucleotide sequence of VGAM252 RNA, herein designated VGAM RNA, also designated SEQ ID:2963.

Another function of VGAM252 is therefore inhibition of LOC150577 (Accession XM_097918). Accordingly, utilities of VGAM252 include diagnosis, prevention and treatment of diseases and clinical conditions associated with LOC150577. FIG. 1 further provides a conceptual description of a novel bioinformatically detected viral gene of the present invention, referred to here as Viral Genomic Address Messenger 253 (VGAM253) viral gene, which modulates expression of respective host target genes thereof, the function and utility of which host target genes is known in the art.

VGAM253 is a novel bioinformatically detected regulatory, non protein coding, viral micro RNA (miRNA) gene. The method by which VGAM253 was detected is described hereinabove with reference to FIGS. 1-8.

VGAM253 gene, herein designated VGAM GENE, is a viral gene contained in the genome of Callitrichine Herpesvirus 3. VGAM253 host target gene, herein designated VGAM HOST TARGET GENE, is a human gene contained in the human genome.

VGAM253 gene encodes a VGAM253 precursor RNA, herein designated VGAM PRECURSOR RNA. Similar to other miRNA genes, and unlike most ordinary genes, VGAM253 precursor RNA does not encode a protein. A nucleotide sequence identical or highly similar to the nucleotide sequence of VGAM253 precursor RNA is designated SEQ ID:239, and is provided hereinbelow with reference to the sequence listing part. Nucleotide sequence SEQ ID:239 is located at position 58790 relative to the genome of Callitrichine Herpesvirus 3.

VGAM253 precursor RNA folds onto itself, forming VGAM253 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM253 folded precursor RNA into VGAM253 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM253 RNA is designated SEQ ID:2964, and is provided hereinbelow with reference to the sequence listing part.

VGAM253 host target gene, herein designated VGAM HOST TARGET GENE, encodes a corresponding messenger RNA, VGAM253 host target RNA, herein designated VGAM HOST TARGET RNA. VGAM253 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM253 RNA, herein designated VGAM RNA, binds complementarily to one or more host target binding sites located in untranslated regions of VGAM253 host target RNA, herein designated VGAM HOST TARGET RNA. This complementary binding is due to the fact that the nucleotide sequence of VGAM253 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM253 RNA, herein designated VGAM RNA, may have a different number of host target binding sites in untranslated regions of a VGAM253 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM253 RNA, herein designated VGAM RNA, to host target binding sites on VGAM253 host target RNA, herein designated VGAM HOST TARGET RNA, such as BINDING SITE I, BINDING SITE II and BINDING SITE III, inhibits translation of VGAM253 host target RNA into VGAM253 host target protein, herein designated VGAM HOST TARGET PROTEIN. VGAM host target protein is therefore outlined by a broken line.

It is appreciated that VGAM253 host target gene, herein designated VGAM HOST TARGET GENE, in fact represents a plurality of VGAM253 host target genes. The mRNA of each one of this plurality of VGAM253 host target genes comprises one or more host target binding sites, each having a nucleotide sequence which is at least partly complementary to VGAM253 RNA, herein designated VGAM RNA, and which when bound by VGAM253 RNA causes inhibition of translation of respective one or more VGAM253 host target proteins.

It is further appreciated by one skilled in the art that the mode of translational inhibition illustrated by FIG. 1 with specific reference to translational inhibition exerted by VGAM253 gene, herein designated VGAM GENE, on one or more VGAM253 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM253 is inhibition of expression of host target genes, as part of a novel viral mechanism of attacking a host. Accordingly, utilities of VGAM253 include diagnosis, prevention and treatment of viral infection by Callitrichine Herpesvirus 3. Specific functions, and accordingly utilities, of VGAM253 correlate with, and may be deduced from, the identity of the host target genes which VGAM253 binds and inhibits, and the function of these host target genes, as elaborated hereinbelow.

Nucleotide sequences of the VGAM253 precursor RNA, herein designated VGAM PRECURSOR RNA, and of the 'diced' VGAM253 RNA, herein designated VGAM RNA, and a schematic representation of the secondary folding of VGAM253 folded precursor RNA, herein designated VGAM FOLDED PRECURSOR RNA, of VGAM253 are further described hereinbelow with reference to Table 1.

Nucleotide sequences of host target binding sites, such as BINDING SITE-I, BINDING SITE-II and BINDING SITE-III of FIG. 1, found on VGAM253 host target RNA, and schematic representation of the complementarity of each of these host target binding sites to VGAM253 RNA, herein designated VGAM RNA, are described hereinbelow with reference to Table 2.

As mentioned hereinabove with reference to FIG. 1, a function of VGAM253 gene, herein designated VGAM is inhibition of expression of VGAM253 target genes. It is appreciated that specific functions, and accordingly utilities, of VGAM253 correlate with, and may be deduced from, the identity of the target genes which VGAM253 binds and inhibits, and the function of these target genes, as elaborated hereinbelow.

Calumenin (CALU, Accession NM_001219) is a VGAM253 host target gene. CALU BINDING SITE is HOST TARGET binding site found in the 3' untranslated region of mRNA encoded by CALU, corresponding to a HOST TARGET binding site such as BINDING SITE I, BINDING SITE II or BINDING SITE III. Table 2 illustrates the complementarity of the nucleotide sequences of CALU BINDING SITE, designated SEQ ID:6885, to the nucleotide sequence of VGAM253 RNA, herein designated VGAM RNA, also designated SEQ ID:2964.

A function of VGAM253 is therefore inhibition of Calumenin (CALU, Accession NM_001219), a gene which binds 7 calcium ions with a low affinity with unidtified function. Accordingly, utilities of VGAM253 include diagnosis, prevention and treatment of diseases and clinical conditions associated with CALU. The function of CALU has been established by previous studies. Many calcium-binding proteins are reported to be localized in the endoplasmic reticulum (ER) and involved in such ER functions as protein folding and sorting. Among these are RCN1 (OMIM Ref. No. 602735), RCN2 (OMIM Ref. No. 602584), and calumenin (CALU), which form a novel family of calcium-binding proteins in the ER and Golgi apparatus. By searching sequence databases with a mouse Calu cDNA sequence (Yabe et al., 1997), Yabe et al. (1998) identified a human CALU EST, which they used to clone a full-length CALU cDNA. The cDNA encodes a deduced 315-amino acid protein containing 6 EF-hand motifs, 1 potential N-glycosylation site, and a C-terminal ER retention signal. The human and mouse CALU proteins are 98% identical. Northern blot analysis demonstrated that the 3.4-kb CALU mRNA is ubiquitously expressed in human tissues. Southern blot analysis using a human CALU cDNA probe detected bands in a variety of species. Yabe et al. (1997) mapped the mouse Calu gene to the proximal portion of chromosome 7. By fluorescence in situ hybridization, Yabe et al. (1998) localized the human CALU gene to 7q32, which was an unexpected result due to the homology of synteny between proximal mouse chromosome 7 and human 19q13.2-q13.3.

Full details of the abovementioned studies are described in the following publications, the disclosure of which are hereby incorporated by reference:

Yabe, D.; Nakamura, T.; Kanazawa, N.; Tashiro, K.; Honjo, T.: Calumenin, a Ca (2+)-binding protein retained in the endoplasmic reticulum with a novel carboxyl-terminal sequence, HDEF. J. Biol. Chem. 272:18232-18239, 1997; and Yabe, D.; Taniwaki, M.; Nakamura, T.; Kanazawa, N.; Tashiro, K.; Honjo, T.: Human calumenin gene (CALU): cDNA isolation and chromosomal mapping to 7q32. Genomics 49:331-333, 1998.

Further studies establishing the function and utilities of CALU are found in John Hopkins OMIM database record ID 603420, and in sited publications numbered 8186-8187 listed in the bibliography section hereinbelow, which are also hereby incorporated by reference. Egl Nine Homolog 1 (C. elegans) (EGLN1, Accession NM_022051) is another VGAM253 host target gene. EGLN1 BINDING SITE is HOST TARGET binding site found in the 5' untranslated region of mRNA encoded by EGLN1, corresponding to a HOST TARGET binding site such as BINDING SITE I, BINDING SITE II or BINDING SITE III. Table 2 illustrates the complementarity of the nucleotide sequences of EGLN1 BINDING SITE, designated SEQ ID:22585, to the nucleotide sequence of VGAM253 RNA, herein designated VGAM RNA, also designated SEQ ID:2964.

Another function of VGAM253 is therefore inhibition of Egl Nine Homolog 1 (C. elegans) (EGLN1, Accession NM_022051), a gene which is expressed in the cytoplasm of arterial smooth muscle cells. Accordingly, utilities of VGAM253 include diagnosis, prevention and treatment of diseases and clinical conditions associated with EGLN1. The function of EGLN1 and its association with various diseases and clinical conditions, has been established by previous studies, as described hereinabove with reference to VGAM216. FLJ11155 (Accession NM_018342) is another VGAM253 host target gene. FLJ11155 BINDING SITE is HOST TARGET binding site found in the 5' untranslated region of mRNA encoded by FLJ11155, corresponding to a HOST TARGET binding site such as BINDING SITE I, BINDING SITE II or BINDING SITE III. Table 2 illustrates the complementarity of the nucleotide sequences of FLJ11155 BINDING SITE, designated SEQ ID:20348, to the nucleotide sequence of VGAM253 RNA, herein designated VGAM RNA, also designated SEQ ID:2964.

Another function of VGAM253 is therefore inhibition of FLJ11155 (Accession NM_018342). Accordingly, utilities of VGAM253 include diagnosis, prevention and treatment of diseases and clinical conditions associated with FLJ11155. FLJ12697 (Accession XM_166526) is another VGAM253 host target gene. FLJ12697 BINDING SITE is HOST TARGET binding site found in the 3' untranslated region of mRNA encoded by FLJ12697, corresponding to a HOST TARGET binding site such as BINDING SITE I, BINDING SITE II or BINDING SITE III. Table 2 illustrates the complementarity of the nucleotide sequences of FLJ12697 BINDING SITE, designated SEQ ID:44473, to the nucleotide sequence of VGAM253 RNA, herein designated VGAM RNA, also designated SEQ ID:2964.

Another function of VGAM253 is therefore inhibition of FLJ12697 (Accession XM_166526). Accordingly, utilities of VGAM253 include diagnosis, prevention and treatment of diseases and clinical conditions associated with FLJ12697.
KIAA1023 (Accession NM_017604) is another VGAM253 host target gene. KIAA1023 BINDING SITE is HOST TARGET binding site found in the 3' untranslated region of mRNA encoded by KIAA1023, corresponding to a HOST TARGET binding site such as BINDING SITE I, BINDING SITE II or BINDING SITE III. Table 2 illustrates the complementarity of the nucleotide sequences of KIAA1023 BINDING SITE, designated SEQ ID:19091, to the nucleotide sequence of VGAM253 RNA, herein designated VGAM RNA, also designated SEQ ID:2964.

Another function of VGAM253 is therefore inhibition of KIAA1023 (Accession NM_017604). Accordingly, utilities of VGAM253 include diagnosis, prevention and treatment of diseases and clinical conditions associated with KIAA1023.
KIAA1941 (Accession XM_059318) is another VGAM253 host target gene. KIAA1941 BINDING SITE is HOST TARGET binding site found in the 3' untranslated region of mRNA encoded by KIAA1941, corresponding to a HOST TARGET binding site such as BINDING SITE I, BINDING SITE II or BINDING SITE III. Table 2 illustrates the complementarity of the nucleotide sequences of KIAA1941 BINDING SITE, designated SEQ ID:36952, to the nucleotide sequence of VGAM253 RNA, herein designated VGAM RNA, also designated SEQ ID:2964.

Another function of VGAM253 is therefore inhibition of KIAA1941 (Accession XM_059318). Accordingly, utilities of VGAM253 include diagnosis, prevention and treatment of diseases and clinical conditions associated with KIAA1941.
LOC149912 (Accession XM_097743) is another VGAM253 host target gene. LOC149912 BINDING SITE is HOST TARGET binding site found in the 5' untranslated region of mRNA encoded by LOC149912, corresponding to a HOST TARGET binding site such as BINDING SITE I, BINDING SITE II or BINDING SITE III. Table 2 illustrates the complementarity of the nucleotide sequences of LOC149912 BINDING SITE, designated SEQ ID:41087, to the nucleotide sequence of VGAM253 RNA, herein designated VGAM RNA, also designated SEQ ID:2964.

Another function of VGAM253 is therefore inhibition of LOC149912 (Accession XM_097743). Accordingly, utilities of VGAM253 include diagnosis, prevention and treatment of diseases and clinical conditions associated with LOC149912.
LOC155179 (Accession XM_088169) is another VGAM253 host target gene. LOC155179 BINDING SITE is HOST TARGET binding site found in the 3' untranslated region of mRNA encoded by LOC155179, corresponding to a HOST TARGET binding site such as BINDING SITE I, BINDING SITE II or BINDING SITE III. Table 2 illustrates the complementarity of the nucleotide sequences of LOC155179 BINDING SITE, designated SEQ ID:39558, to the nucleotide sequence of VGAM253 RNA, herein designated VGAM RNA, also designated SEQ ID:2964.

Another function of VGAM253 is therefore inhibition of LOC155179 (Accession XM_088169). Accordingly, utilities of VGAM253 include diagnosis, prevention and treatment of diseases and clinical conditions associated with LOC155179.
LOC199958 (Accession XM_117163) is another VGAM253 host target gene. LOC199958 BINDING SITE is HOST TARGET binding site found in the 3' untranslated region of mRNA encoded by LOC199958, corresponding to a HOST TARGET binding site such as BINDING SITE I, BINDING SITE II or BINDING SITE III. Table 2 illustrates the complementarity of the nucleotide sequences of LOC199958 BINDING SITE, designated SEQ ID:43266, to the nucleotide sequence of VGAM253 RNA, herein designated VGAM RNA, also designated SEQ ID:2964.

Another function of VGAM253 is therefore inhibition of LOC199958 (Accession XM_117163). Accordingly, utilities of VGAM253 include diagnosis, prevention and treatment of diseases and clinical conditions associated with LOC199958.
LOC219731 (Accession XM_167596) is another VGAM253 host target gene. LOC219731 BINDING SITE is HOST TARGET binding site found in the 5' untranslated region of mRNA encoded by LOC219731, corresponding to a HOST TARGET binding site such as BINDING SITE I, BINDING SITE II or BINDING SITE III. Table 2 illustrates the complementarity of the nucleotide sequences of LOC219731 BINDING SITE, designated SEQ ID:44718, to the nucleotide sequence of VGAM253 RNA, herein designated VGAM RNA, also designated SEQ ID:2964.

Another function of VGAM253 is therefore inhibition of LOC219731 (Accession XM_167596). Accordingly, utilities of VGAM253 include diagnosis, prevention and treatment of diseases and clinical conditions associated with LOC219731.
LOC254735 (Accession XM_171051) is another VGAM253 host target gene. LOC254735 BINDING SITE is HOST TARGET binding site found in the 5' untranslated region of mRNA encoded by LOC254735, corresponding to a HOST TARGET binding site such as BINDING SITE I, BINDING SITE II or BINDING SITE III. Table 2 illustrates the complementarity of the nucleotide sequences of LOC254735 BINDING SITE, designated SEQ ID:45838, to the nucleotide sequence of VGAM253 RNA, herein designated VGAM RNA, also designated SEQ ID:2964.

Another function of VGAM253 is therefore inhibition of LOC254735 (Accession XM_171051). Accordingly, utilities of VGAM253 include diagnosis, prevention and treatment of diseases and clinical conditions associated with LOC254735.
FIG. 1 further provides a conceptual description of a novel bioinformatically detected viral gene of the present invention, referred to here as Viral Genomic Address Messenger 254 (VGAM254) viral gene, which modulates expression of respective host target genes thereof, the function and utility of which host target genes is known in the art.

VGAM254 is a novel bioinformatically detected regulatory, non protein coding, viral micro RNA (miRNA) gene. The method by which VGAM254 was detected is described hereinabove with reference to FIGS. 1-8.

VGAM254 gene, herein designated VGAM GENE, is a viral gene contained in the genome of Callitrichine Herpesvirus 3. VGAM254 host target gene, herein designated VGAM HOST TARGET GENE, is a human gene contained in the human genome.

VGAM254 gene encodes a VGAM254 precursor RNA, herein designated VGAM PRECURSOR RNA. Similar to other miRNA genes, and unlike most ordinary genes, VGAM254 precursor RNA does not encode a protein. A nucleotide sequence identical or highly similar to the nucleotide sequence of VGAM254 precursor RNA is designated SEQ ID:240, and is provided hereinbelow with reference to the sequence listing part. Nucleotide sequence SEQ ID:240 is located at position 17777 relative to the genome of Callitrichine Herpesvirus 3.

VGAM254 precursor RNA folds onto itself, forming VGAM254 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM254 folded precursor RNA into VGAM254 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM254 RNA is designated SEQ ID:2965, and is provided hereinbelow with reference to the sequence listing part.

VGAM254 host target gene, herein designated VGAM HOST TARGET GENE, encodes a corresponding messenger RNA, VGAM254 host target RNA, herein designated VGAM HOST TARGET RNA. VGAM254 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM254 RNA, herein designated VGAM RNA, binds complementarily to one or more host target binding sites located in untranslated regions of VGAM254 host target RNA, herein designated VGAM HOST TARGET RNA. This complementary binding is due to the fact that the nucleotide sequence of VGAM254 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM254 RNA, herein designated VGAM RNA, may have a different number of host target binding sites in untranslated regions of a VGAM254 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM254 RNA, herein designated VGAM RNA, to host target binding sites on VGAM254 host target RNA, herein designated VGAM HOST TARGET RNA, such as BINDING SITE I, BINDING SITE II and BINDING SITE III, inhibits translation of VGAM254 host target RNA into VGAM254 host target protein, herein designated VGAM HOST TARGET PROTEIN. VGAM host target protein is therefore outlined by a broken line.

It is appreciated that VGAM254 host target gene, herein designated VGAM HOST TARGET GENE, in fact represents a plurality of VGAM254 host target genes. The mRNA of each one of this plurality of VGAM254 host target genes comprises one or more host target binding sites, each having a nucleotide sequence which is at least partly complementary to VGAM254 RNA, herein designated VGAM RNA, and which when bound by VGAM254 RNA causes inhibition of translation of respective one or more VGAM254 host target proteins.

It is further appreciated by one skilled in the art that the mode of translational inhibition illustrated by FIG. 1 with specific reference to translational inhibition exerted by VGAM254 gene, herein designated VGAM GENE, on one or more VGAM254 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM254 is inhibition of expression of host target genes, as part of a novel viral mechanism of attacking a host. Accordingly, utilities of VGAM254 include diagnosis, prevention and treatment of viral infection by Callitrichine Herpesvirus 3. Specific functions, and accordingly utilities, of VGAM254 correlate with, and may be deduced from, the identity of the host target genes which VGAM254 binds and inhibits, and the function of these host target genes, as elaborated hereinbelow.

Nucleotide sequences of the VGAM254 precursor RNA, herein designated VGAM PRECURSOR RNA, and of the 'diced' VGAM254 RNA, herein designated VGAM RNA, and a schematic representation of the secondary folding of VGAM254 folded precursor RNA, herein designated VGAM FOLDED PRECURSOR RNA, of VGAM254 are further described hereinbelow with reference to Table 1.

Nucleotide sequences of host target binding sites, such as BINDING SITE-I, BINDING SITE-II and BINDING SITE-III of FIG. 1, found on VGAM254 host target RNA, and schematic representation of the complementarity of each of these host target binding sites to VGAM254 RNA, herein designated VGAM RNA, are described hereinbelow with reference to Table 2.

As mentioned hereinabove with reference to FIG. 1, a function of VGAM254 gene, herein designated VGAM is inhibition of expression of VGAM254 target genes. It is appreciated that specific functions, and accordingly utilities, of VGAM254 correlate with, and may be deduced from, the identity of the target genes which VGAM254 binds and inhibits, and the function of these target genes, as elaborated hereinbelow.

Fibrillin 2 (congenital contractural arachnodactyly) (FBN2, Accession NM_001999) is a VGAM254 host target gene. FBN2 BINDING SITE is HOST TARGET binding site found in the 3' untranslated region of mRNA encoded by FBN2, corresponding to a HOST TARGET binding site such as BINDING SITE I, BINDING SITE II or BINDING SITE III. Table 2 illustrates the complementarity of the nucleotide sequences of FBN2 BINDING SITE, designated SEQ ID:7725, to the nucleotide sequence of VGAM254 RNA, herein designated VGAM RNA, also designated SEQ ID:2965.

A function of VGAM254 is therefore inhibition of Fibrillin 2 (congenital contractural arachnodactyly) (FBN2, Accession NM_001999), a gene which structural component of connective tissue microfibrils that binds calcium. fibrillin-2-containing microfibrils regulate the early process of elastic fiber assembly. Accordingly, utilities of VGAM254 include diagnosis, prevention and treatment of diseases and clinical conditions associated with FBN2. The function of FBN2 has been established by previous studies. Beals and Hecht (1971) described father and 2 sons affected in 1 kindred and father, daughter and son (by different mothers) affected in a second kindred. They proposed that the disorder be called 'contractural arachnodactyly' and further suggested that the patient reported by Marfan (1896) had this disorder rather than the Marfan syndrome (OMIM Ref. No. 154700) as presently delineated (Hecht and Beals, 1972). They found several other reports, apparently of the same disorder. Beyer et al. (1965) probably described the same condition in a mother and 4 children and some of the reports of combined Marfan syndrome and arthrogryposis multiplex congenita may be further examples (e.g., Reeve et al., 1960; Kingsley-Pillers, 1946). Epstein et al. (1968) described father and son with a connective tissue disorder with some features suggesting the Marfan syndrome and some suggesting osteogenesis imperfecta. Severe kyphoscoliosis, generalized osteopenia, flexion contractures of the fingers and abnormally shaped ears were among the characteristics. Abnormally shaped ('crumpled') ears have been emphasized by other students of CCA. According to Mirise and Shear (1979), the ocular and cardiovascular complications of the Marfan syndrome do not occur in contractural arachnodactyly (Mirise and Shear, 1979). Hence, the correct diagnosis has prognostic significance. Park et al. (1998) identified FBN2 mutations in 6 of 12 unrelated CCA patient cell strains. All of the identified mutations were clustered in a limited region of the gene, a region corresponding to that in FBN1 where mutations produce the severe, congenital form of Marfan syndrome, so-called neonatal Marfan syndrome. Furthermore, 3 of the identified mutations occurred in the FBN2 locations exactly corresponding to FBN1 mutations that had been reported in cases of neonatal Marfan syndrome. These mutations indicate that this central region of both fibrillins plays a critical role in human embryogenesis. The limited region of FBN2 that can be mutated to cause CCA may also help explain the rarity of CCA compared to Marfan syndrome. Belleh et al. (2000) reported 2 additional FBN2 mutations in CCA: C1141F in exon 26 (121050.0008) and C1252W in exon 29 (121050.0009). As in previous cases, mutations clustered in the region of fibrillin-2 homologous to the so-called neonatal Marfan syndrome region of fibrillin-1 (FBN1; 134797) (Kainulainen et al., 1994). Gupta et al. (2002) noted that all of the identified CCA mutations in FBN2 cluster in a limited region similar to that where severe Marfan syndrome mutations cluster in FBN1, specifically between exons 23 and 34. Gupta et al. (2002) screened exons 22 through 36 of FBN2 for mutations in 13 patients with classic CCA by single-stranded conformation polymorphism analysis followed by direct sequencing. They successfully identified 10 novel mutations in this critical region of FBN2 in these patients, indicating a mutation detection rate of 75% in this region. None of these identified FBN2 mutations alter amino acids in the calcium-binding consensus sequence in the EGF-like domains, whereas many of the FBN1 mutations alter the consensus sequence. Gupta et al. (2002) reviewed the 21 known CAA mutations in the FBN2 gene, along with available clinical information on the probands. They found that 3 of the 21 patients had dilatation of the aortic root. All 3 were young, and the degree of dilatation appeared to have been borderline in all. However, because of the lack of knowledge of the natural history of aortic involvement in CCA, Gupta et al. (2002) recommended that all CCA patients have an echocardiogram. They cited Su et al. (2000) as indicating that approximately 15% of CCA patients have congenital heart defects. Their review did not support this conclusion, instead suggesting that congenital heart defects are only an occasional finding in these patients. Animal model experiments lend further support to the function of FBN2. Chaudhry et al. (2001) analyzed the classic mouse mutant 'Shaker-with-syndactylism' (sy) using a positional candidate approach. The authors demonstrated that several loss-of-function mutations, each located outside the 'neonatal region' of Fbn2, caused syndactyly in mice, rather than CCA as in man. The deafness in these animals is caused by mutations in the contiguous Na-K-2Cl cotransporter gene Slc12a2 (OMIM Ref. No. 600840) (Dixon et al., 1999).

It is appreciated that the abovementioned animal model for FBN2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gupta, P. A.; Putnam, E. A.; Carmical, S. G.; Kaitila, I.; Steinmann, B.; Child, A.; Danesino, C.; Metcalfe, K.; Berry, S. A.; Chen, E.; Delorme, C. V.; Thong, M.-K.; Ades, L. C.; Milewicz, D. M.: Ten novel FBN2 mutations in congenital contractural arachnodactyly: delineation of the molecular pathogenesis and clinical phenotype. Hum. Mutat. 19:39-48, 2002; and Su, P.-H.; Hou, J.-W.; Hwu, W.-L.; Wu, M.-H.; Wang, J.-K.; Wang, T.-R.: Congenital contractural arachnodactyly (Beals syndrome). Acta Paediat. 41:59-62, 2000.

Further studies establishing the function and utilities of FBN2 are found in John Hopkins OMIM database record ID 121050, and in sited publications numbered 148-149, 298-309, 313, 314-312, 315-330, 38 and 4654-4661 listed in the bibliography section hereinbelow, which are also hereby incorporated by reference. Junctophilin 3 (JPH3, Accession NM_020655) is another VGAM254 host target gene. JPH3 BINDING SITE is HOST TARGET binding site found in the 3' untranslated region of mRNA encoded by JPH3, corresponding to a HOST TARGET binding site such as BINDING SITE I, BINDING SITE II or BINDING SITE III. Table 2 illustrates the complementarity of the nucleotide sequences of JPH3 BINDING SITE, designated SEQ ID:21827, to the nucleotide sequence of VGAM254 RNA, herein designated VGAM RNA, also designated SEQ ID:2965.

Another function of VGAM254 is therefore inhibition of Junctophilin 3 (JPH3, Accession NM_020655), a gene which is involved in cytoskeletal organization and cellular growth. Accordingly, utilities of VGAM254 include diagnosis, prevention and treatment of diseases and clinical conditions associated with JPH3. The function of JPH3 has been established by previous studies. Junctional complexes between the plasma membrane (PM) and endoplasmic/sarcoplasmic reticulum (ER/SR) are a common feature of all excitable cell types and mediate cross talk between cell surface and intracellular ion channels. Takeshima et al. (2000) identified the junctophilins (JPs), a conserved family of proteins that are components of the junctional complexes. JPs are composed of a C-terminal hydrophobic segment spanning the ER/SR membrane and a remaining cytoplasmic domain that shows specific affinity for the PM. In mouse, there are at least 3 JP subtypes: Jp1, Jp2, and Jp3 Margolis et al. (2001) described a disorder termed Huntington disease-like 2 (HDL2; 606438) segregating in an autosomal dominant pattern in a large pedigree with an unidentified CAG/CTG expansion. Holmes et al. (2001) reported the cloning of this expansion and its localization to a variably spliced exon of JPH3, a gene involved in the formation of junctional membrane structures. They stated the location of the gene as 16q24.3. All 10 affected individuals tested had a repeat expansion, ranging in size from 51 to 57 triplets, whereas 3 unaffected individuals had 2 unexpanded alleles. The variability of the length of the expanded repeat among sibs from 3 different sibships indicated that the expanded allele is unstable in vertical transmission. There was no apparent correlation between repeat size and age of onset, but the range of repeat length among family members was narrow. The index family was African-American; Holmes et al. (2001) detected HDL2-related repeat expansions in 4 African-American individuals from the southeastern United States, each of whom had a familial Huntington disease-like disorder and had tested negative for the Huntington disease mutation. They demonstrated that the CTG repeat is localized 760 nucleotides 3-prime to the end of exon 1. At least 4 lines of evidence suggested that the CTG repeat is contained within an alternatively spliced exon (termed 2A) of the JPH3 gene that has multiple splice acceptor sites.

Full details of the abovementioned studies are described in the following publications, the disclosure of which are hereby incorporated by reference:

Holmes, S. E.; O'Hearn, E.; Rosenblatt, A.; Callahan, C.; Hwang, H. S.; Ingersoll-Ashworth, R. G.; Fleisher, A.; Stevanin, G.; Brice, A.; Potter, N. T.; Ross, C. A.; Margolis, R. L.: A repeat expansion in the gene encoding junctophilin-3 is associated with Huntington disease-like 2. Nature Genet. 29:377-378, 2001. Note: Erratum: Nature Genet. 30:123 only, 2002; and Margolis, R. L.; O'Hearn, E.; Rosenblatt, A.; Willour, V.; Holmes, S. E.; Franz, M. L.; Callahan, C.; Hwang, H. S.; Troncoso, J. C.; Ross, C. A.: A disorder similar to Huntington's dis.

Further studies establishing the function and utilities of JPH3 are found in John Hopkins OMIM database record ID 605268, and in sited publications numbered 503 and 5036-5037 listed in the bibliography section hereinbelow, which are also hereby incorporated by reference. LOC145371 (Accession XM_085123) is another VGAM254 host target gene. LOC145371 BINDING SITE is HOST TARGET binding site found in the 3' untranslated region of mRNA encoded by LOC145371, corresponding to a HOST TARGET binding site such as BINDING SITE I, BINDING SITE II or BINDING SITE III. Table 2 illustrates the complementarity of the nucleotide sequences of LOC145371 BINDING SITE, designated SEQ ID:37843, to the nucleotide sequence of VGAM254 RNA, herein designated VGAM RNA, also designated SEQ ID:2965.

Another function of VGAM254 is therefore inhibition of LOC145371 (Accession XM_085123). Accordingly, utilities of VGAM254 include diagnosis, prevention and treatment of diseases and clinical conditions associated with LOC145371.

FIG. 1 further provides a conceptual description of a novel bioinformatically detected viral gene of the present invention, referred to here as Viral Genomic Address Messenger 255 (VGAM255) viral gene, which modulates expression of respective host target genes thereof, the function and utility of which host target genes is known in the art.

VGAM255 is a novel bioinformatically detected regulatory, non protein coding, viral micro RNA (miRNA) gene. The method by which VGAM255 was detected is described hereinabove with reference to FIGS. 1-8.

VGAM255 gene, herein designated VGAM GENE, is a viral gene contained in the genome of Callitrichine Herpesvirus 3. VGAM255 host target gene, herein designated VGAM HOST TARGET GENE, is a human gene contained in the human genome.

VGAM255 gene encodes a VGAM255 precursor RNA, herein designated VGAM PRECURSOR RNA. Similar to other miRNA genes, and unlike most ordinary genes, VGAM255 precursor RNA does not encode a protein. A nucleotide sequence identical or highly similar to the nucleotide sequence of VGAM255 precursor RNA is designated SEQ ID:241, and is provided hereinbelow with reference to the sequence listing part. Nucleotide sequence SEQ ID:241 is located at position 113673 relative to the genome of Callitrichine Herpesvirus 3.

VGAM255 precursor RNA folds onto itself, forming VGAM255 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM255 folded precursor RNA into VGAM255 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM255 RNA is designated SEQ ID:2966, and is provided hereinbelow with reference to the sequence listing part.

VGAM255 host target gene, herein designated VGAM HOST TARGET GENE, encodes a corresponding messenger RNA, VGAM255 host target RNA, herein designated VGAM HOST TARGET RNA. VGAM255 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM255 RNA, herein designated VGAM RNA, binds complementarily to one or more host target binding sites located in untranslated regions of VGAM255 host target RNA, herein designated VGAM HOST TARGET RNA. This complementary binding is due to the fact that the nucleotide sequence of VGAM255 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM255 RNA, herein designated VGAM RNA, may have a different number of host target binding sites in untranslated regions of a VGAM255 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM255 RNA, herein designated VGAM RNA, to host target binding sites on VGAM255 host target RNA, herein designated VGAM HOST TARGET RNA, such as BINDING SITE I, BINDING SITE II and BINDING SITE III, inhibits translation of VGAM255 host target RNA into VGAM255 host target protein, herein designated VGAM HOST TARGET PROTEIN. VGAM host target protein is therefore outlined by a broken line.

It is appreciated that VGAM255 host target gene, herein designated VGAM HOST TARGET GENE, in fact represents a plurality of VGAM255 host target genes. The mRNA of each one of this plurality of VGAM255 host target genes comprises one or more host target binding sites, each having a nucleotide sequence which is at least partly complementary to VGAM255 RNA, herein designated VGAM RNA, and which when bound by VGAM255 RNA causes inhibition of translation of respective one or more VGAM255 host target proteins.

It is further appreciated by one skilled in the art that the mode of translational inhibition illustrated by FIG. 1 with specific reference to translational inhibition exerted by VGAM255 gene, herein designated VGAM GENE, on one or more VGAM255 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM255 is inhibition of expression of host target genes, as part of a novel viral mechanism of attacking a host. Accordingly, utilities of VGAM255 include diagnosis, prevention and treatment of viral infection by Callitrichine Herpesvirus 3. Specific functions, and accordingly utilities, of VGAM255 correlate with, and may be deduced from, the identity of the host target genes which VGAM255 binds and inhibits, and the function of these host target genes, as elaborated hereinbelow.

Nucleotide sequences of the VGAM255 precursor RNA, herein designated VGAM PRECURSOR RNA, and of the 'diced' VGAM255 RNA, herein designated VGAM RNA, and a schematic representation of the secondary folding of VGAM255 folded precursor RNA, herein designated VGAM FOLDED PRECURSOR RNA, of VGAM255 are further described hereinbelow with reference to Table 1.

Nucleotide sequences of host target binding sites, such as BINDING SITE-I, BINDING SITE-II and BINDING SITE-III of FIG. 1, found on VGAM255 host target RNA, and schematic representation of the complementarity of each of these host target binding sites to VGAM255 RNA, herein designated VGAM RNA, are described hereinbelow with reference to Table 2.

As mentioned hereinabove with reference to FIG. 1, a function of VGAM255 gene, herein designated VGAM is inhibition of expression of VGAM255 target genes. It is appreciated that specific functions, and accordingly utilities, of VGAM255 correlate with, and may be deduced from, the identity of the target genes which VGAM255 binds and inhibits, and the function of these target genes, as elaborated hereinbelow.

UDP-Gal:betaGlcNAc Beta 1,4-Galactosyltransferase, Polypeptide 6 (B4GALT6, Accession XM_008799) is a VGAM255 host target gene. B4GALT6 BINDING SITE is HOST TARGET binding site found in the 3' untranslated region of mRNA encoded by B4GALT6, corresponding to a HOST TARGET binding site such as BINDING SITE I, BINDING SITE II or BINDING SITE III. Table 2 illustrates the complementarity of the nucleotide sequences of B4GALT6 BINDING SITE, designated SEQ ID:30095, to the nucleotide sequence of VGAM255 RNA, herein designated VGAM RNA, also designated SEQ ID:2966.

A function of VGAM255 is therefore inhibition of UDP-Gal:betaGlcNAc Beta 1,4-Galactosyltransferase, Polypeptide 6 (B4GALT6, Accession XM_008799). Accordingly, utilities of VGAM255 include diagnosis, prevention and treatment of diseases and clinical conditions associated with B4GALT6. Chemokine (C-C motif) Receptor 2 (CCR2, Accession NM_000648) is another VGAM255 host target gene. CCR2 BINDING SITE is HOST TARGET binding site found in the 3' untranslated region of mRNA encoded by CCR2, corresponding to a HOST TARGET binding site such as BINDING SITE I, BINDING SITE II or BINDING SITE III. Table 2 illustrates the complementarity of the nucleotide sequences of CCR2 BINDING SITE, designated SEQ ID:6312, to the nucleotide sequence of VGAM255 RNA, herein designated VGAM RNA, also designated SEQ ID:2966.

Another function of VGAM255 is therefore inhibition of Chemokine (C-C motif) Receptor 2 (CCR2, Accession NM_000648), a gene which binds chemokines and transduces a signal by increasing the intracellular calcium ions level. Accordingly, utilities of VGAM255 include diagnosis, prevention and treatment of diseases and clinical conditions associated with CCR2. The function of CCR2 and its association with various diseases and clinical conditions, has been established by previous studies, as described hereinabove with reference to VGAM206. Kruppel-like Factor 5 (intestinal) (KLF5, Accession NM_001730) is another VGAM255 host target gene. KLF5 BINDING SITE is HOST TARGET binding site found in the 3' untranslated region of mRNA encoded by KLF5, corresponding to a HOST TARGET binding site such as BINDING SITE I, BINDING SITE II or BINDING SITE III. Table 2 illustrates the complementarity of the nucleotide sequences of KLF5 BINDING SITE, designated SEQ ID:7463, to the nucleotide sequence of VGAM255 RNA, herein designated VGAM RNA, also designated SEQ ID:2966.

Another function of VGAM255 is therefore inhibition of Kruppel-like Factor 5 (intestinal) (KLF5, Accession NM_001730). Accordingly, utilities of VGAM255 include diagnosis, prevention and treatment of diseases and clinical conditions associated with KLF5. N-acetylated Alpha-linked Acidic Dipeptidase 2 (NAALAD2, Accession NM_005467) is another VGAM255 host target gene. NAALAD2 BINDING SITE is HOST TARGET binding site found in the 3' untranslated region of mRNA encoded by NAALAD2, corresponding to a HOST TARGET binding site such as BINDING SITE I, BINDING SITE II or BINDING SITE III. Table 2 illustrates the complementarity of the nucleotide sequences of NAALAD2 BINDING SITE, designated SEQ ID:11963, to the nucleotide sequence of VGAM255 RNA, herein designated VGAM RNA, also designated SEQ ID:2966.

Another function of VGAM255 is therefore inhibition of N-acetylated Alpha-linked Acidic Dipeptidase 2 (NAALAD2, Accession NM_005467). Accordingly, utilities of VGAM255 include diagnosis, prevention and treatment of diseases and clinical conditions associated with NAALAD2. Progesterone Receptor Membrane Component 2 (PGRMC2, Accession NM_006320) is another VGAM255 host target gene. PGRMC2 BINDING SITE is HOST TARGET binding site found in the 3' untranslated region of mRNA encoded by PGRMC2, corresponding to a HOST TARGET binding site such as BINDING SITE I, BINDING SITE II or BINDING SITE III. Table 2 illustrates the complementarity of the nucleotide sequences of PGRMC2 BINDING SITE, designated SEQ ID:13012, to the nucleotide sequence of VGAM255 RNA, herein designated VGAM RNA, also designated SEQ ID:2966.

Another function of VGAM255 is therefore inhibition of Progesterone Receptor Membrane Component 2 (PGRMC2, Accession NM_006320). Accordingly, utilities of VGAM255 include diagnosis, prevention and treatment of diseases and clinical conditions associated with PGRMC2. LOC92270 (Accession XM_043989) is another VGAM255 host target gene. LOC92270 BINDING SITE is HOST TARGET binding site found in the 5' untranslated region of mRNA encoded by LOC92270, corresponding to a HOST TARGET binding site such as BINDING SITE I, BINDING SITE II or BINDING SITE III. Table 2 illustrates the complementarity of the nucleotide sequences of LOC92270 BINDING SITE, designated SEQ ID:34061, to the nucleotide sequence of VGAM255 RNA, herein designated VGAM RNA, also designated SEQ ID:2966.

Another function of VGAM255 is therefore inhibition of LOC92270 (Accession XM_043989). Accordingly, utilities of VGAM255 include diagnosis, prevention and treatment of diseases and clinical conditions associated with LOC92270. FIG. 1 further provides a conceptual description of a novel bioinformatically detected viral gene of the present invention, referred to here as Viral Genomic Address Messenger 256 (VGAM256) viral gene, which modulates expression of respective host target genes thereof, the function and utility of which host target genes is known in the art.

VGAM256 is a novel bioinformatically detected regulatory, non protein coding, viral micro RNA (miRNA) gene. The method by which VGAM256 was detected is described hereinabove with reference to FIGS. 1-8.

VGAM256 gene, herein designated VGAM GENE, is a viral gene contained in the genome of Callitrichine Herpesvirus 3. VGAM256 host target gene, herein designated VGAM HOST TARGET GENE, is a human gene contained in the human genome.

VGAM256 gene encodes a VGAM256 precursor RNA, herein designated VGAM PRECURSOR RNA. Similar to other miRNA genes, and unlike most ordinary genes, VGAM256 precursor RNA does not encode a protein. A nucleotide sequence identical or highly similar to the nucleotide sequence of VGAM256 precursor RNA is designated SEQ ID:242, and is provided hereinbelow with reference to the sequence listing part. Nucleotide sequence SEQ ID:242 is located at position 43629 relative to the genome of Callitrichine Herpesvirus 3.

VGAM256 precursor RNA folds onto itself, forming VGAM256 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM256 folded precursor RNA into VGAM256 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM256 RNA is designated SEQ ID:2967, and is provided hereinbelow with reference to the sequence listing part.

VGAM256 host target gene, herein designated VGAM HOST TARGET GENE, encodes a corresponding messenger RNA, VGAM256 host target RNA, herein designated VGAM HOST TARGET RNA. VGAM256 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM256 RNA, herein designated VGAM RNA, binds complementarily to one or more host target binding sites located in untranslated regions of VGAM256 host target RNA, herein designated VGAM HOST TARGET RNA. This complementary binding is due to the fact that the nucleotide sequence of VGAM256 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM256 RNA, herein designated VGAM RNA, may have a different number of host target binding sites in untranslated regions of a VGAM256 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM256 RNA, herein designated VGAM RNA, to host target binding sites on VGAM256 host target RNA, herein designated VGAM HOST TARGET RNA, such as BINDING SITE I, BINDING SITE II and BINDING SITE III, inhibits translation of VGAM256 host target RNA into VGAM256 host target protein, herein designated VGAM HOST TARGET PROTEIN. VGAM host target protein is therefore outlined by a broken line.

It is appreciated that VGAM256 host target gene, herein designated VGAM HOST TARGET GENE, in fact represents a plurality of VGAM256 host target genes. The mRNA of each one of this plurality of VGAM256 host target genes comprises one or more host target binding sites, each having a nucleotide sequence which is at least partly complementary to VGAM256 RNA, herein designated VGAM RNA, and which when bound by VGAM256 RNA causes inhibition of translation of respective one or more VGAM256 host target proteins.

It is further appreciated by one skilled in the art that the mode of translational inhibition illustrated by FIG. 1 with specific reference to translational inhibition exerted by VGAM256 gene, herein designated VGAM GENE, on one or more VGAM256 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM256 is inhibition of expression of host target genes, as part of a novel viral mechanism of attacking a host. Accordingly, utilities of VGAM256 include diagnosis, prevention and treatment of viral infection by Callitrichine Herpesvirus 3. Specific functions, and accordingly utilities, of VGAM256 correlate with, and may be deduced from, the identity of the host target genes which VGAM256 binds and inhibits, and the function of these host target genes, as elaborated hereinbelow.

Nucleotide sequences of the VGAM256 precursor RNA, herein designated VGAM PRECURSOR RNA, and of the 'diced' VGAM256 RNA, herein designated VGAM RNA, and a schematic representation of the secondary folding of VGAM256 folded precursor RNA, herein designated VGAM FOLDED PRECURSOR RNA, of VGAM256 are further described hereinbelow with reference to Table 1.

Nucleotide sequences of host target binding sites, such as BINDING SITE-I, BINDING SITE-II and BINDING SITE-III of FIG. 1, found on VGAM256 host target RNA, and schematic representation of the complementarity of each of these host target binding sites to VGAM256 RNA, herein designated VGAM RNA, are described hereinbelow with reference to Table 2.

As mentioned hereinabove with reference to FIG. 1, a function of VGAM256 gene, herein designated VGAM is inhibition of expression of VGAM256 target genes. It is appreciated that specific functions, and accordingly utilities, of VGAM256 correlate with, and may be deduced from, the identity of the target genes which VGAM256 binds and inhibits, and the function of these target genes, as elaborated hereinbelow.

Carnitine O-octanoyltransferase (CROT, Accession NM_021151) is a VGAM256 host target gene. CROT BINDING SITE is HOST TARGET binding site found in the 3' untranslated region of mRNA encoded by CROT, corresponding to a HOST TARGET binding site such as BINDING SITE I, BINDING SITE II or BINDING SITE III. Table 2 illustrates the complementarity of the nucleotide sequences of CROT BINDING SITE, designated SEQ ID:22125, to the nucleotide sequence of VGAM256 RNA, herein designated VGAM RNA, also designated SEQ ID:2967.

A function of VGAM256 is therefore inhibition of Carnitine O-octanoyltransferase (CROT, Accession NM_021151), a gene which CROT plays a crucial role in the beta-oxidation of branched-chain fatty acids including pristanic acid. Accordingly, utilities of VGAM256 include diagnosis, prevention and treatment of diseases and clinical conditions associated with CROT. The function of CROT and its association with various diseases and clinical conditions, has been established by previous studies, as described hereinabove with reference to VGAM70. D10S170 (Accession NM_005436) is another VGAM256 host target gene. D10S170 BINDING SITE is HOST TARGET binding site found in the 3' untranslated region of mRNA encoded by D10S170, corresponding to a HOST TARGET binding site such as BINDING SITE I, BINDING SITE II or BINDING SITE III. Table 2 illustrates the complementarity of the nucleotide sequences of D10S170 BINDING SITE, designated SEQ ID:11920, to the nucleotide sequence of VGAM256 RNA, herein designated VGAM RNA, also designated SEQ ID:2967.

Another function of VGAM256 is therefore inhibition of D10S170 (Accession NM_005436), a gene which may provide a structural basis for generation of RET/PTC1 rearrangement. Accordingly, utilities of VGAM256 include diagnosis, prevention and treatment of diseases and clinical conditions associated with D10S170. The function of D10S170 and its association with various diseases and clinical conditions, has been established by previous studies, as described hereinabove with reference to VGAM142. MHC Class II Transactivator (MHC2TA, Accession NM_000246) is another VGAM256 host target gene. MHC2TA BINDING SITE is HOST TARGET binding site found in the 3' untranslated region of mRNA encoded by MHC2TA, corresponding to a HOST TARGET binding site such as BINDING SITE I, BINDING SITE II or BINDING SITE III. Table 2 illustrates the complementarity of the nucleotide sequences of MHC2TA BINDING SITE, designated SEQ ID:5776, to the nucleotide sequence of VGAM256 RNA, herein designated VGAM RNA, also designated SEQ ID:2967.

Another function of VGAM256 is therefore inhibition of MHC Class II Transactivator (MHC2TA, Accession NM_000246). Accordingly, utilities of VGAM256 include diagnosis, prevention and treatment of diseases and clinical conditions associated with MHC2TA. Neuroligin 2 (NLGN2, Accession XM_113932) is another VGAM256 host target gene. NLGN2 BINDING SITE is HOST TARGET binding site found in the 5' untranslated region of mRNA encoded by NLGN2, corresponding to a HOST TARGET binding site such as BINDING SITE I, BINDING SITE II or BINDING SITE III. Table 2 illustrates the complementarity of the nucleotide sequences of NLGN2 BINDING SITE, designated SEQ ID:42551, to the nucleotide sequence of VGAM256 RNA, herein designated VGAM RNA, also designated SEQ ID:2967.

Another function of VGAM256 is therefore inhibition of Neuroligin 2 (NLGN2, Accession XM_113932), a gene which rapidly hydrolyzes choline released into the synapse. Accordingly, utilities of VGAM256 include diagnosis, prevention and treatment of diseases and clinical conditions associated with NLGN2. The function of NLGN2 and its association with various diseases and clinical conditions, has been established by previous studies, as described hereinabove with reference to VGAM178. Src Family Associated Phosphoprotein 2 (SCAP2, Accession NM_003930) is another VGAM256 host target gene. SCAP2 BINDING SITE is HOST TARGET binding site found in the 3' untranslated region of mRNA encoded by SCAP2, corresponding to a HOST TARGET binding site such as BINDING SITE I, BINDING SITE II or BINDING SITE III. Table 2 illustrates the complementarity of the nucleotide sequences of SCAP2 BINDING SITE, designated SEQ ID:10030, to the nucleotide sequence of VGAM256 RNA, herein designated VGAM RNA, also designated SEQ ID:2967.

Another function of VGAM256 is therefore inhibition of Src Family Associated Phosphoprotein 2 (SCAP2, Accession NM_003930), a gene which interacts with Src family protein tyrosine kinases and SLAP/FYB (SLA). Accordingly, utilities of VGAM256 include diagnosis, prevention and treatment of diseases and clinical conditions associated with SCAP2. The function of SCAP2 and its association with various diseases and clinical conditions, has been established by previous studies, as described hereinabove with reference to VGAM134. DKFZP566M114 (Accession NM_032128) is another VGAM256 host target gene. DKFZP566M114 BINDING SITE is HOST TARGET binding site found in the 3' untranslated region of mRNA encoded by DKFZP566M114, corresponding to a HOST TARGET binding site such as BINDING SITE I, BINDING SITE II or BINDING SITE III. Table 2 illustrates the complementarity of the nucleotide sequences of DKFZP566M114 BINDING SITE, designated SEQ ID:25814, to the nucleotide sequence of VGAM256 RNA, herein designated VGAM RNA, also designated SEQ ID:2967.

Another function of VGAM256 is therefore inhibition of DKFZP566M114 (Accession NM_032128). Accordingly, utilities of VGAM256 include diagnosis, prevention and treatment of diseases and clinical conditions associated with DKFZP566M114.FLJ22833 (Accession NM_022837) is another VGAM256 host target gene. FLJ22833 BINDING SITE is HOST TARGET binding site found in the 3' untranslated region of mRNA encoded by FLJ22833, corresponding to a HOST TARGET binding site such as BINDING SITE I, BINDING SITE II or BINDING SITE III. Table 2 illustrates the complementarity of the nucleotide sequences of FLJ22833 BINDING SITE, designated SEQ ID:23123, to the nucleotide sequence of VGAM256 RNA, herein designated VGAM RNA, also designated SEQ ID:2967.

Another function of VGAM256 is therefore inhibition of FLJ22833 (Accession NM_022837). Accordingly, utilities of VGAM256 include diagnosis, prevention and treatment of diseases and clinical conditions associated with FLJ22833. LHX6 (Accession NM_014368) is another VGAM256 host target gene. LHX6 BINDING SITE is HOST TARGET binding site found in the 3' untranslated region of mRNA encoded by LHX6, corresponding to a HOST TARGET binding site such as BINDING SITE I, BINDING SITE II or BINDING SITE III. Table 2 illustrates the complementarity of the nucleotide sequences of LHX6 BINDING SITE, designated SEQ ID:15698, to the nucleotide sequence of VGAM256 RNA, herein designated VGAM RNA, also designated SEQ ID:2967.

Another function of VGAM256 is therefore inhibition of LHX6 (Accession NM_014368). Accordingly, utilities of VGAM256 include diagnosis, prevention and treatment of diseases and clinical conditions associated with LHX6. Protein Serine Kinase H1 (PSKH1, Accession XM_043047) is another VGAM256 host target gene. PSKH1 BINDING SITE is HOST TARGET binding site found in the 3' untranslated region of mRNA encoded by PSKH1, corresponding to a HOST TARGET binding site such as BINDING SITE I, BINDING SITE II or BINDING SITE III. Table 2 illustrates the complementarity of the nucleotide sequences of PSKH1 BINDING SITE, designated SEQ ID:33869, to the nucleotide sequence of VGAM256 RNA, herein designated VGAM RNA, also designated SEQ ID:2967.

Another function of VGAM256 is therefore inhibition of Protein Serine Kinase H1 (PSKH1, Accession XM_043047). Accordingly, utilities of VGAM256 include diagnosis, prevention and treatment of diseases and clinical conditions associated with PSKH1. FIG. 1 further provides a conceptual description of a novel bioinformatically detected viral gene of the present invention, referred to here as Viral Genomic Address Messenger 257 (VGAM257) viral gene, which modulates expression of respective host target genes thereof, the function and utility of which host target genes is known in the art.

VGAM257 is a novel bioinformatically detected regulatory, non protein coding, viral micro RNA (miRNA) gene. The method by which VGAM257 was detected is described hereinabove with reference to FIGS. 1-8.

VGAM257 gene, herein designated VGAM GENE, is a viral gene contained in the genome of Callitrichine Herpesvirus 3. VGAM257 host target gene, herein designated VGAM HOST TARGET GENE, is a human gene contained in the human genome.

VGAM257 gene encodes a VGAM257 precursor RNA, herein designated VGAM PRECURSOR RNA. Similar to other miRNA genes, and unlike most ordinary genes, VGAM257 precursor RNA does not encode a protein. A nucleotide sequence identical or highly similar to the nucleotide sequence of VGAM257 precursor RNA is designated SEQ ID:243, and is provided hereinbelow with reference to the sequence listing part. Nucleotide sequence SEQ ID:243 is located at position 100658 relative to the genome of Callitrichine Herpesvirus 3.

VGAM257 precursor RNA folds onto itself, forming VGAM257 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM257 folded precursor RNA into VGAM257 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM257 RNA is designated SEQ ID:2968, and is provided hereinbelow with reference to the sequence listing part.

VGAM257 host target gene, herein designated VGAM HOST TARGET GENE, encodes a corresponding messenger RNA, VGAM257 host target RNA, herein designated VGAM HOST TARGET RNA. VGAM257 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM257 RNA, herein designated VGAM RNA, binds complementarily to one or more host target binding sites located in untranslated regions of VGAM257 host target RNA, herein designated VGAM HOST TARGET RNA. This complementary binding is due to the fact that the nucleotide sequence of VGAM257 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM257 RNA, herein designated VGAM RNA, may have a different number of host target binding sites in untranslated regions of a VGAM257 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM257 RNA, herein designated VGAM RNA, to host target binding sites on VGAM257 host target RNA, herein designated VGAM HOST TARGET RNA, such as BINDING SITE I, BINDING SITE II and BINDING SITE III, inhibits translation of VGAM257 host target RNA into VGAM257 host target protein, herein designated VGAM HOST TARGET PROTEIN. VGAM host target protein is therefore outlined by a broken line.

It is appreciated that VGAM257 host target gene, herein designated VGAM HOST TARGET GENE, in fact represents a plurality of VGAM257 host target genes. The mRNA of each one of this plurality of VGAM257 host target genes comprises one or more host target binding sites, each having a nucleotide sequence which is at least partly complementary to VGAM257 RNA, herein designated VGAM RNA, and which when bound by VGAM257 RNA causes inhibition of translation of respective one or more VGAM257 host target proteins.

It is further appreciated by one skilled in the art that the mode of translational inhibition illustrated by FIG. 1 with specific reference to translational inhibition exerted by VGAM257 gene, herein designated VGAM GENE, on one or more VGAM257 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM257 is inhibition of expression of host target genes, as part of a novel viral mechanism of attacking a host. Accordingly, utilities of VGAM257 include diagnosis, prevention and treatment of viral infection by Callitrichine Herpesvirus 3. Specific functions, and accordingly utilities, of VGAM257 correlate with, and may be deduced from, the identity of the host target genes which VGAM257 binds and inhibits, and the function of these host target genes, as elaborated hereinbelow.

Nucleotide sequences of the VGAM257 precursor RNA, herein designated VGAM PRECURSOR RNA, and of the 'diced' VGAM257 RNA, herein designated VGAM RNA, and a schematic representation of the secondary folding of VGAM257 folded precursor RNA, herein designated VGAM FOLDED PRECURSOR RNA, of VGAM257 are further described hereinbelow with reference to Table 1.

Nucleotide sequences of host target binding sites, such as BINDING SITE-I, BINDING SITE-II and BINDING SITE-III of FIG. 1, found on VGAM257 host target RNA, and schematic representation of the complementarity of each of these host target binding sites to VGAM257 RNA, herein designated VGAM RNA, are described hereinbelow with reference to Table 2.

As mentioned hereinabove with reference to FIG. 1, a function of VGAM257 gene, herein designated VGAM is inhibition of expression of VGAM257 target genes. It is appreciated that specific functions, and accordingly utilities, of VGAM257 correlate with, and may be deduced from, the identity of the target genes which VGAM257 binds and inhibits, and the function of these target genes, as elaborated hereinbelow.

Caspase 4, Apoptosis-related Cysteine Protease (CASP4, Accession NM_033307) is a VGAM257 host target gene. CASP4 BINDING SITE is HOST TARGET binding site found in the 5' untranslated region of mRNA encoded by CASP4, corresponding to a HOST TARGET binding site such as BINDING SITE I, BINDING SITE II or BINDING SITE III. Table 2 illustrates the complementarity of the nucleotide sequences of CASP4 BINDING SITE, designated SEQ ID:27142, to the nucleotide sequence of VGAM257 RNA, herein designated VGAM RNA, also designated SEQ ID:2968.

A function of VGAM257 is therefore inhibition of Caspase 4, Apoptosis-related Cysteine Protease (CASP4, Accession NM_033307), a gene which is an apoptosis-related caspase and involves in the activation cascade of caspases responsible for apoptosis execution. Accordingly, utilities of VGAM257 include diagnosis, prevention and treatment of diseases and clinical conditions associated with CASP4. The function of CASP4 has been established by previous studies. Cysteine proteases related to mammalian interleukin-1-beta converting enzyme (ICE; 147678) and nematode CED3 have been implicated in apoptotic cell death. By screening a human thymus cDNA library with the human ICE coding sequence, Kamens et al. (1995) isolated cDNAs encoding CASP4, named ICH2 (ICE and CED3 homolog-2) by them. The 377-amino acid ICH2 protein has 53% amino acid identity with ICE and contains the residues conserved in all ICE family members. ICH2 and ICE share catalytic properties but may differ in substrate specificities, suggesting that the 2 enzymes have different functions in vivo. Overexpression of ICH2 in insect cells induced apoptosis. By Northern blot analysis, ICH2 was expressed as an approximately 1.7-kb transcript in all tissues examined, with the exception of brain. The ICH2 coding sequence is contained within 8 exons. The authors mapped the ICH2 gene to a P1 clone containing the ICE gene, which is located at 11q22.2-q22.3. Animal model experiments lend further support to the function of CASP4. Wang et al. (1998) reported the inactivation of mouse casp11, which is most homologous to human CASP4, by gene targeting. Like Ice-deficient mice, casp11 mutant mice are resistant to endotoxic shock induced by lipopolysaccharide. Production of both IL1-alpha and IL1-beta after lipopolysaccharide stimulation, a crucial event during septic shock and an indication of ICE activation, is blocked in casp11 mutant mice. Casp11 mutant embryonic fibroblast cells are resistant to apoptosis induced by overexpression of ICE. Furthermore, Wang et al. (1998) found that pro-caspase-11 physically interacts with pro-ICE in cells and that the expression of casp11 is essential for activation of ICE. The authors suggested that caspase-11 is a component of the ICE complex and is required for the activation of ICE.

It is appreciated that the abovementioned animal model for CASP4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Wang, S.; Miura, M.; Jung, Y.; Zhu, H.; Li, E.; Yuan, J.: Murine caspase-11, an ICE-interacting protease, is essential for the activation of ICE. Cell 92: 501-509, 1998; and Kamens, J.; Paskind, M.; Hugunin, M.; Talanian, R. V.; Allen, H.; Banach, D.; Bump, N.; Hackett, M.; Johnston, C. G.; Li, P.; Mankovich, J. A.; Terranova, M.; Ghayur, T.: Identification.

Further studies establishing the function and utilities of CASP4 are found in John Hopkins OMIM database record ID 602664, and in sited publications numbered 5915-591 and 5913-5914 listed in the bibliography section hereinbelow, which are also hereby incorporated by reference. Major Histocompatibility Complex, Class II, DQ Alpha 1 (HLA-DQA1, Accession XM_175260) is another VGAM257 host target gene. HLA-DQA1 BINDING SITE is HOST TARGET binding site found in the 3' untranslated region of mRNA encoded by HLA-DQA1, corresponding to a HOST TARGET binding site such as BINDING SITE I, BINDING SITE II or BINDING SITE III. Table 2 illustrates the complementarity of the nucleotide sequences of HLA-DQA1 BINDING SITE, designated SEQ ID:46727, to the nucleotide sequence of VGAM257 RNA, herein designated VGAM RNA, also designated SEQ ID:2968.

Another function of VGAM257 is therefore inhibition of Major Histocompatibility Complex, Class II, DQ Alpha 1 (HLA-DQA1, Accession XM_175260), a gene which is alpha 1 chain of HLA-DQ1 class II molecule (Ia antigen) which binds peptides and presents them to CD4+ T lymphocytes. Accordingly, utilities of VGAM257 include diagnosis, prevention and treatment of diseases and clinical conditions associated with HLA-DQA1. The function of HLA-DQA1 and its association with various diseases and clinical conditions, has been established by previous studies, as described hereinabove with reference to VGAM132. FLJ11210 (Accession XM_005298) is another VGAM257 host target gene. FLJ11210 BINDING SITE is HOST TARGET binding site found in the 3' untranslated region of mRNA encoded by FLJ11210, corresponding to a HOST TARGET binding site such as BINDING SITE I, BINDING SITE II or BINDING SITE III. Table 2 illustrates the complementarity of the nucleotide sequences of FLJ11210 BINDING SITE, designated SEQ ID:29972, to the nucleotide sequence of VGAM257 RNA, herein designated VGAM RNA, also designated SEQ ID:2968.

Another function of VGAM257 is therefore inhibition of FLJ11210 (Accession XM_005298). Accordingly, utilities of VGAM257 include diagnosis, prevention and treatment of diseases and clinical conditions associated with FLJ11210. FLJ14564 (Accession XM_084459) is another VGAM257 host target gene. FLJ14564 BINDING SITE is HOST TARGET binding site found in the 3' untranslated region of mRNA encoded by FLJ14564, corresponding to a HOST TARGET binding site such as BINDING SITE I, BINDING SITE II or BINDING SITE III. Table 2 illustrates the complementarity of the nucleotide sequences of FLJ14564 BINDING SITE, designated SEQ ID:37599, to the nucleotide sequence of VGAM257 RNA, herein designated VGAM RNA, also designated SEQ ID:2968.

Another function of VGAM257 is therefore inhibition of FLJ14564 (Accession XM_084459). Accordingly, utilities of VGAM257 include diagnosis, prevention and treatment of diseases and clinical conditions associated with FLJ14564. KIAA1854 (Accession XM_049884) is another VGAM257 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35527, to the nucleotide sequence of VGAM257 RNA, herein designated VGAM RNA, also designated SEQ ID:2968.

Another function of VGAM257 is therefore inhibition of KIAA1854 (Accession XM_049884). Accordingly, utilities of VGAM257 include diagnosis, prevention and treatment of diseases and clinical conditions associated with KIAA1854. PIP3-E (Accession XM_039749) is another VGAM257 host target gene. PIP3-E BINDING SITE is HOST TARGET binding site found in the 3' untranslated region of mRNA encoded by PIP3-E, corresponding to a HOST TARGET binding site such as BINDING SITE I, BINDING SITE II or BINDING SITE III. Table 2 illustrates the complementarity of the nucleotide sequences of PIP3-E BINDING SITE, designated SEQ ID:33178, to the nucleotide sequence of VGAM257 RNA, herein designated VGAM RNA, also designated SEQ ID:2968.

Another function of VGAM257 is therefore inhibition of PIP3-E (Accession XM_039749). Accordingly, utilities of VGAM257 include diagnosis, prevention and treatment of diseases and clinical conditions associated with PIP3-E. LOC135932 (Accession XM_072433) is another VGAM257 host target gene. LOC135932 BINDING SITE is HOST TARGET binding site found in the 3' untranslated region of mRNA encoded by LOC135932, corresponding to a HOST TARGET binding site such as BINDING SITE I, BINDING SITE II or BINDING SITE III. Table 2 illustrates the complementarity of the nucleotide sequences of LOC135932 BINDING SITE, designated SEQ ID:37499, to the nucleotide sequence of VGAM257 RNA, herein designated VGAM RNA, also designated SEQ ID:2968.

Another function of VGAM257 is therefore inhibition of LOC135932 (Accession XM_072433). Accordingly, utilities of VGAM257 include diagnosis, prevention and treatment of diseases and clinical conditions associated with LOC135932. FIG. 1 further provides a conceptual description of a novel bioinformatically detected viral gene of the present invention, referred to here as Viral Genomic Address Messenger 258 (VGAM258) viral gene, which modulates expression of respective host target genes thereof, the function and utility of which host target genes is known in the art.

VGAM258 is a novel bioinformatically detected regulatory, non protein coding, viral micro RNA (miRNA) gene. The method by which VGAM258 was detected is described hereinabove with reference to FIGS. 1-8.

VGAM258 gene, herein designated VGAM GENE, is a viral gene contained in the genome of Callitrichine Herpesvirus 3. VGAM258 host target gene, herein designated VGAM HOST TARGET GENE, is a human gene contained in the human genome.

VGAM258 gene encodes a VGAM258 precursor RNA, herein designated VGAM PRECURSOR RNA. Similar to other miRNA genes, and unlike most ordinary genes, VGAM258 precursor RNA does not encode a protein. A nucleotide sequence identical or highly similar to the nucleotide sequence of VGAM258 precursor RNA is designated SEQ ID:244, and is provided hereinbelow with reference to the sequence listing part. Nucleotide sequence SEQ ID:244 is located at position 29168 relative to the genome of Callitrichine Herpesvirus 3.

VGAM258 precursor RNA folds onto itself, forming VGAM258 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM258 folded precursor RNA into VGAM258 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM258 RNA is designated SEQ ID:2969, and is provided hereinbelow with reference to the sequence listing part.

VGAM258 host target gene, herein designated VGAM HOST TARGET GENE, encodes a corresponding messenger RNA, VGAM258 host target RNA, herein designated VGAM HOST TARGET RNA. VGAM258 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM258 RNA, herein designated VGAM RNA, binds complementarily to one or more host target binding sites located in untranslated regions of VGAM258 host target RNA, herein designated VGAM HOST TARGET RNA. This complementary binding is due to the fact that the nucleotide sequence of VGAM258 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM258 RNA, herein designated VGAM RNA, may have a different number of host target binding sites in untranslated regions of a VGAM258 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM258 RNA, herein designated VGAM RNA, to host target binding sites on VGAM258 host target RNA, herein designated VGAM HOST TARGET RNA, such as BINDING SITE I, BINDING SITE II and BINDING SITE III, inhibits translation of VGAM258 host target RNA into VGAM258 host target protein, herein designated VGAM HOST TARGET PROTEIN. VGAM host target protein is therefore outlined by a broken line.

It is appreciated that VGAM258 host target gene, herein designated VGAM HOST TARGET GENE, in fact represents a plurality of VGAM258 host target genes. The mRNA of each one of this plurality of VGAM258 host target genes comprises one or more host target binding sites, each having a nucleotide sequence which is at least partly complementary to VGAM258 RNA, herein designated VGAM RNA, and which when bound by VGAM258 RNA causes inhibition of translation of respective one or more VGAM258 host target proteins.

It is further appreciated by one skilled in the art that the mode of translational inhibition illustrated by FIG. 1 with specific reference to translational inhibition exerted by VGAM258 gene, herein designated VGAM GENE, on one or more VGAM258 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM258 is inhibition of expression of host target genes, as part of a novel viral mechanism of attacking a host. Accordingly, utilities of VGAM258 include diagnosis, prevention and treatment of viral infection by Callitrichine Herpesvirus 3. Specific functions, and accordingly utilities, of VGAM258 correlate with, and may be deduced from, the identity of the host target genes which VGAM258 binds and inhibits, and the function of these host target genes, as elaborated hereinbelow.

Nucleotide sequences of the VGAM258 precursor RNA, herein designated VGAM PRECURSOR RNA, and of the 'diced' VGAM258 RNA, herein designated VGAM RNA, and a schematic representation of the secondary folding of VGAM258 folded precursor RNA, herein designated VGAM FOLDED PRECURSOR RNA, of VGAM258 are further described hereinbelow with reference to Table 1.

Nucleotide sequences of host target binding sites, such as BINDING SITE-I, BINDING SITE-II and BINDING SITE-III of FIG. 1, found on VGAM258 host target RNA, and schematic representation of the complementarity of each of these host target binding sites to VGAM258 RNA, herein designated VGAM RNA, are described hereinbelow with reference to Table 2.

As mentioned hereinabove with reference to FIG. 1, a function of VGAM258 gene, herein designated VGAM is inhibition of expression of VGAM258 target genes. It is appreciated that specific functions, and accordingly utilities, of VGAM258 correlate with, and may be deduced from, the identity of the target genes which VGAM258 binds and inhibits, and the function of these target genes, as elaborated hereinbelow.

Heat Shock 70 kDa Protein 8 (HSPA8, Accession NM_006597) is a VGAM258 host target gene. HSPA8 BINDING SITE is HOST TARGET binding site found in the 5' untranslated region of mRNA encoded by HSPA8, corresponding to a HOST TARGET binding site such as BINDING SITE I, BINDING SITE II or BINDING SITE III. Table 2 illustrates the complementarity of the nucleotide sequences of HSPA8 BINDING SITE, designated SEQ ID:13369, to the nucleotide sequence of VGAM258 RNA, herein designated VGAM RNA, also designated SEQ ID:2969.

A function of VGAM258 is therefore inhibition of Heat Shock 70 kDa Protein 8 (HSPA8, Accession NM_006597), a gene which acts as a chaperone.plays an important role in cells by transiently associating with nascent polypeptides to facilitate correct folding. Accordingly, utilities of VGAM258 include diagnosis, prevention and treatment of diseases and clinical conditions associated with HSPA8. The function of HSPA8 has been established by previous studies. Cytokine and proto-oncogene mRNAs are rapidly degraded through AU-rich elements in the 3-prime untranslated region. Rapid decay involves AU-rich binding protein AUF1, which complexes with heat-shock proteins HSC70 and HSP70, translation initiation factor EIF4G (OMIM Ref. No. 600495), and poly (A)-binding protein (OMIM Ref. No. 604679). AU-rich mRNA decay is associated with displacement of EIF4G from AUF1, ubiquitination of AUF1, and degradation of AUF1 by proteasomes. Induction of HSP70 by heat shock, down regulation of the ubiquitin-proteasome network, or inactivation of ubiquitinating enzyme E1 (OMIM Ref. No. 314370), all result in HSP70 sequestration of AUF1 in the perinucleus-nucleus, and all 3 processes block decay of AU-rich mRNAs and AUF1 protein. These results link the rapid degradation of cytokine mRNAs to the ubiquitin-proteasome pathway (Larola et al., 1999). CD14 (OMIM Ref. No. 158120) and lipopolysaccharide (LPS)-binding protein (LBP; 151990) are major receptors for LPS; however, binding analyses and TNF production assays have suggested the presence of additional cell surface receptors, designated LPS-associated proteins (LAPs), that are distinct from CD14, LBP, and the Toll-like receptors (see OMIM Ref. No. TLR4; 603030). Using affinity chromatography, peptide mass fingerprinting, and fluorescence resonance energy transfer, Triantafilou et al. (2001) identified 4 diverse proteins, heat shock cognate protein (HSPA8), HSP90A, chemokine receptor CXCR4 (OMIM Ref. No. 162643), and growth differentiation factor-5 (GDF5; 601146), on monocytes that form an activation cluster after LPS ligation and are involved in LPS signal transduction. Antibody inhibition analysis suggested that disruption of cluster formation abrogates TNF release. Triantafilou et al. (2001) proposed that heat shock proteins, which are highly conserved from bacteria to eukaryotic cells, are remnants of an ancient system of antigen presentation and defense against microbial pathogens.

Full details of the abovementioned studies are described in the following publications, the disclosure of which are hereby incorporated by reference:

Larola, G.; Cuesta, R.; Brewer, G.; Schneider, R. J.: Control of mRNA decay by heat shock-ubiquitin-proteasome pathway. Science 284:499-502, 1999; and Triantafilou, K.; Triantafilou, M.; Dedrick, R. L.: A CD14-independent LPS receptor cluster. Nature Immun. 2:338-345, 2001.

Further studies establishing the function and utilities of HSPA8 are found in John Hopkins OMIM database record ID 600816, and in sited publications numbered 7522-7523, 821 and 12001 listed in the bibliography section hereinbelow, which are also hereby incorporated by reference. Interleukin 24 (IL24, Accession NM_006850) is another VGAM258 host target gene. IL24 BINDING SITE is HOST TARGET binding site found in the 3' untranslated region of mRNA encoded by IL24, corresponding to a HOST TARGET binding site such as BINDING SITE I, BINDING SITE II or BINDING SITE III. Table 2 illustrates the complementarity of the nucleotide sequences of IL24 BINDING SITE, designated SEQ ID:13719, to the nucleotide sequence of VGAM258 RNA, herein designated VGAM RNA, also designated SEQ ID:2969.

Another function of VGAM258 is therefore inhibition of Interleukin 24 (IL24, Accession NM_006850), a gene which may contribute to terminal cell differentiation. Accordingly, utilities of VGAM258 include diagnosis, prevention and treatment of diseases and clinical conditions associated with IL24. The function of IL24 has been established by previous studies. Jiang et al. (1995) used a differentiation induction subtraction hybridization strategy to identify and clone genes involved in growth control and terminal differentiation in human cancer cells. By this approach they identified melanoma differentiation-associated gene-7 (MDA7), whose expression is upregulated as a consequence of terminal differentiation in human melanoma cells. Forced expression of MDA7 was found to be growth inhibitory toward diverse human tumor cells (Jiang et al., 1996). Huang et al. (2001) determined that the human MDA7 gene encodes a protein with a predicted size of 23.8 kD, consisting of 206 amino acids. They concluded that MDA7 represents a differentiation-, growth-, and apoptosis-associated gene with potential utility for the gene-based therapy of diverse human cancers Animal model experiments lend further support to the function of IL24. selectively suppresses the growth of human breast cancer cells and the consequence of ectopic expression of MDA7 on human breast tumor formation in vivo in nude mice.

It is appreciated that the abovementioned animal model for IL24 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Huang, E. Y.; Madireddi, M. T.; Gopalkrishnan, R. V.; Leszczyniecka, M.; Su, Z.; Lebedeva, I. V.; Kang, D.; Jiang, H.; Lin, J. J.; Alexandre, D.; Chen, Y.; Vozhilla, N.: {and 9 others}: Genomic structure, chromosomal localization and expression profile of a novel melanoma differentiation associated (mda-7) gene with cancer specific growth suppressing and apoptosis inducing properties. Oncogene 20:7051-7063, 2001; and Jiang, H.; Lin, J. J.; Su, Z.-Z.; Goldstein, N. I.; Fisher, P. B.: Subtraction hybridization identifies a novel melanoma differentiation associated gene, mda-7, modulated during human.

Further studies establishing the function and utilities of IL24 are found in John Hopkins OMIM database record ID 604136, and in sited publications numbered 4438-4442 listed in the bibliography section hereinbelow, which are also hereby incorporated by reference. Ligase IV, DNA, ATP-dependent (LIG4, Accession NM_002312) is another VGAM258 host target gene. LIG4 BINDING SITE is HOST TARGET binding site found in the 5' untranslated region of mRNA encoded by LIG4, corresponding to a HOST TARGET binding site such as BINDING SITE I, BINDING SITE II or BINDING SITE III. Table 2 illustrates the complementarity of the nucleotide sequences of LIG4 BINDING SITE, designated SEQ ID:8108, to the nucleotide sequence of VGAM258 RNA, herein designated VGAM RNA, also designated SEQ ID:2969.

Another function of VGAM258 is therefore inhibition of Ligase IV, DNA, ATP-dependent (LIG4, Accession NM_002312), a gene which functions in DNA nonhomologous end-joining and V(D)J recombination. Accordingly, utilities of VGAM258 include diagnosis, prevention and treatment of diseases and clinical conditions associated with LIG4. The function of LIG4 has been established by previous studies. Grawunder et al. (1998) showed that targeted disruption of both DNA ligase IV alleles in a human pre-B cell line rendered the cells sensitive to ionizing radiation and ablated V(D)J recombination. This phenotype could only be reversed by complementation with DNA ligase IV but not by expression of either of the remaining 2 ligases, DNA ligase I or III. Hence, DNA ligase IV is the activity responsible for the ligation step in nonhomologous DNA end joining and in V(D)J recombination Animal model experiments lend further support to the function of LIG4. In mice, Lig4 deficiency causes embryonic lethality, massive neuronal apoptosis, arrested lymphogenesis, and various cellular defects (Frank et al., 1998). Frank et al. (2000) assessed potential roles in this phenotype for INK4a/ARF (CDKN2A; 600160) and p53 (OMIM Ref. No. 191170), 2 proteins implicated in apoptosis and senescence. Ink4a/Arf deficiency rescued proliferation/senescence defects of Lig4-deficient fibroblasts but not other phenotypic aspects. In contrast, p53 deficiency rescued embryonic lethality, neuronal apoptosis, and fibroblast proliferation/senescence defects but not lymphocyte development or radiosensitivity. Young Lig4/p53 double-null mice routinely died from pro-B lymphomas. Thus, in the context of Lig4 deficiency, embryonic lethality and neuronal apoptosis likely result from a p53-dependent response to unrepaired DNA damage, and neuronal apoptosis and lymphocyte developmental defects can be mechanistically dissociated It is appreciated that the abovementioned animal model for LIG4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Grawunder, U.; Zimmer, D.; Fugmann, S.; Schwarz, K.; Lieber, M. R.: DNA ligase IV is essential for V(D)J recombination and DNA double-strand break repair in human precursor lymphocytes. Molec. Cell 2:477-484, 1998; and Frank, K. M.; Sekiguchi, J. M.; Seidl, K. J.; Swat, W.; Rathbun, G. A.; Cheng, H.-L.; Davidson, L.; Kangaloo, L.; Alt, F. W.: Late embryonic lethality and impaired V(D)J recombination in.

Further studies establishing the function and utilities of LIG4 are found in John Hopkins OMIM database record ID 601837, and in sited publications numbered 9053-9058, 887 and 8877 listed in the bibliography section hereinbelow, which are also hereby incorporated by reference. Chromosome 11 Open Reading Frame 23 (C11orf23, Accession NM_018312) is another VGAM258 host target gene. C11orf23 BINDING SITE is HOST TARGET binding site found in the 3' untranslated region of mRNA encoded by C11orf23, corresponding to a HOST TARGET binding site such as BINDING SITE I, BINDING SITE II or BINDING SITE III. Table 2 illustrates the complementarity of the nucleotide sequences of C11orf23 BINDING SITE, designated SEQ ID:20300, to the nucleotide sequence of VGAM258 RNA, herein designated VGAM RNA, also designated SEQ ID:2969.

Another function of VGAM258 is therefore inhibition of Chromosome 11 Open Reading Frame 23 (C11orf23, Accession NM_018312). Accordingly, utilities of VGAM258 include diagnosis, prevention and treatment of diseases and clinical conditions associated with C11orf23. DKFZP434F0318 (Accession NM_030817) is another VGAM258 host target gene. DKFZP434F0318 BINDING SITE is HOST TARGET binding site found in the 3' untranslated region of mRNA encoded by DKFZP434F0318, corresponding to a HOST TARGET binding site such as BINDING SITE I, BINDING SITE II or BINDING SITE III. Table 2 illustrates the complementarity of the nucleotide sequences of DKFZP434F0318 BINDING SITE, designated SEQ ID:25141, to the nucleotide sequence of VGAM258 RNA, herein designated VGAM RNA, also designated SEQ ID:2969.

Another function of VGAM258 is therefore inhibition of DKFZP434F0318 (Accession NM_030817). Accordingly, utilities of VGAM258 include diagnosis, prevention and treatment of diseases and clinical conditions associated with DKFZP434F0318. GFR (Accession NM_012294) is another VGAM258 host target gene. GFR BINDING SITE is HOST TARGET binding site found in the 3' untranslated region of mRNA encoded by GFR, corresponding to a HOST TARGET binding site such as BINDING SITE I, BINDING SITE II or BINDING SITE III. Table 2 illustrates the complementarity of the nucleotide sequences of GFR BINDING SITE, designated SEQ ID:14638, to the nucleotide sequence of VGAM258 RNA, herein designated VGAM RNA, also designated SEQ ID:2969.

Another function of VGAM258 is therefore inhibition of GFR (Accession NM_012294). Accordingly, utilities of VGAM258 include diagnosis, prevention and treatment of diseases and clinical conditions associated with GFR. KIAA1301 (Accession XM_038999) is another VGAM258 host target gene. KIAA1301 BINDING SITE is HOST TARGET binding site found in the 3" untranslated region of mRNA encoded by KIAA1301, corresponding to a HOST TARGET binding site such as BINDING SITE I, BINDING SITE II or BINDING SITE III. Table 2 illustrates the complementarity of the nucleotide sequences of KIAA1301 BINDING SITE, designated SEQ ID:32975, to the nucleotide sequence of VGAM258 RNA, herein designated VGAM RNA, also designated SEQ ID:2969.

Another function of VGAM258 is therefore inhibition of KIAA1301 (Accession XM_038999). Accordingly, utilities of VGAM258 include diagnosis, prevention and treatment of diseases and clinical conditions associated with KIAA1301. KIAA1922 (Accession XM_057040) is another VGAM258 host target gene. KIAA1922 BINDING SITE is HOST TARGET binding site found in the 3' untranslated region of mRNA encoded by KIAA1922, corresponding to a HOST TARGET binding site such as BINDING SITE I, BINDING SITE II or BINDING SITE III. Table 2 illustrates the complementarity of the nucleotide sequences of KIAA1922 BINDING SITE, designated SEQ ID:36453, to the nucleotide sequence of VGAM258 RNA, herein designated VGAM RNA, also designated SEQ ID:2969.

Another function of VGAM258 is therefore inhibition of KIAA1922 (Accession XM_057040). Accordingly, utilities of VGAM258 include diagnosis, prevention and treatment of diseases and clinical conditions associated with KIAA1922. Protein Phosphatase 1, Regulatory (inhibitor) Subunit 16B (PPP1R16B, Accession XM_028840) is another VGAM258 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30767, to the nucleotide sequence of VGAM258 RNA, herein designated VGAM RNA, also designated SEQ ID:2969.

Another function of VGAM258 is therefore inhibition of Protein Phosphatase 1, Regulatory (inhibitor) Subunit 16B (PPP1R16B, Accession XM_028840). Accordingly, utilities of VGAM258 include diagnosis, prevention and treatment of diseases and clinical conditions associated with PPP1R16B. PRO2958 (Accession NM_018546) is another VGAM258 host target gene. PRO2958 BINDING SITE is HOST TARGET binding site found in the 3' untranslated region of mRNA encoded by PRO2958, corresponding to a HOST TARGET binding site such as BINDING SITE I, BINDING SITE II or BINDING SITE III. Table 2 illustrates the complementarity of the nucleotide sequences of PRO2958 BINDING SITE, designated SEQ ID:20626, to the nucleotide sequence of VGAM258 RNA, herein designated VGAM RNA, also designated SEQ ID:2969.

Another function of VGAM258 is therefore inhibition of PRO2958 (Accession NM_018546). Accordingly, utilities of VGAM258 include diagnosis, prevention and treatment of diseases and clinical conditions associated with PRO2958. LOC145725 (Accession XM_085211) is another VGAM258 host target gene. LOC145725 BINDING SITE is HOST TARGET binding site found in the 5' untranslated region of mRNA encoded by LOC145725, corresponding to a HOST TARGET binding site such as BINDING SITE I, BINDING SITE II or BINDING SITE III. Table 2 illustrates the complementarity of the nucleotide sequences of LOC145725 BINDING SITE, designated SEQ ID:37950, to the nucleotide sequence of VGAM258 RNA, herein designated VGAM RNA, also designated SEQ ID:2969.

Another function of VGAM258 is therefore inhibition of LOC145725 (Accession XM_085211). Accordingly, utilities of VGAM258 include diagnosis, prevention and treatment of diseases and clinical conditions associated with LOC145725. LOC145732 (Accession XM_085218) is another VGAM258 host target gene. LOC145732 BINDING SITE is HOST TARGET binding site found in the 5' untranslated region of mRNA encoded by LOC145732, corresponding to a HOST TARGET binding site such as BINDING SITE I, BINDING SITE II or BINDING SITE III. Table 2 illustrates the complementarity of the nucleotide sequences of LOC145732 BINDING SITE, designated SEQ ID:37959, to the nucleotide sequence of VGAM258 RNA, herein designated VGAM RNA, also designated SEQ ID:2969.

Another function of VGAM258 is therefore inhibition of LOC145732 (Accession XM_085218). Accordingly, utilities of VGAM258 include diagnosis, prevention and treatment of diseases and clinical conditions associated with LOC145732. LOC146540 (Accession XM_085497) is another VGAM258 host target gene. LOC146540 BINDING SITE is HOST TARGET binding site found in the 3' untranslated region of mRNA encoded by LOC146540, corresponding to a HOST TARGET binding site such as BINDING SITE I, BINDING SITE II or BINDING SITE III. Table 2 illustrates the complementarity of the nucleotide sequences of LOC146540 BINDING SITE, designated SEQ ID:38198, to the nucleotide sequence of VGAM258 RNA, herein designated VGAM RNA, also designated SEQ ID:2969.

Another function of VGAM258 is therefore inhibition of LOC146540 (Accession XM_085497). Accordingly, utilities of VGAM258 include diagnosis, prevention and treatment of diseases and clinical conditions associated with LOC146540.

LOC196957 (Accession XM_113789) is another VGAM258 host target gene. LOC196957 BINDING SITE is HOST TARGET binding site found in the 5' untranslated region of mRNA encoded by LOC196957, corresponding to a HOST TARGET binding site such as BINDING SITE I, BINDING SITE II or BINDING SITE III. Table 2 illustrates the complementarity of the nucleotide sequences of LOC196957 BINDING SITE, designated SEQ ID:42431, to the nucleotide sequence of VGAM258 RNA, herein designated VGAM RNA, also designated SEQ ID:2969.

Another function of VGAM258 is therefore inhibition of LOC196957 (Accession XM_113789). Accordingly, utilities of VGAM258 include diagnosis, prevention and treatment of diseases and clinical conditions associated with LOC196957. LOC196961 (Accession XM_113790) is another VGAM258 host target gene. LOC196961 BINDING SITE is HOST TARGET binding site found in the 5' untranslated region of mRNA encoded by LOC196961, corresponding to a HOST TARGET binding site such as BINDING SITE I, BINDING SITE II or BINDING SITE III. Table 2 illustrates the complementarity of the nucleotide sequences of LOC196961 BINDING SITE, designated SEQ ID:42440, to the nucleotide sequence of VGAM258 RNA, herein designated VGAM RNA, also designated SEQ ID:2969.

Another function of VGAM258 is therefore inhibition of LOC196961 (Accession XM_113790). Accordingly, utilities of VGAM258 include diagnosis, prevention and treatment of diseases and clinical conditions associated with LOC196961. LOC197138 (Accession XM_113829) is another VGAM258 host target gene. LOC197138 BINDING SITE is HOST TARGET binding site found in the 5' untranslated region of mRNA encoded by LOC197138, corresponding to a HOST TARGET binding site such as BINDING SITE I, BINDING SITE II or BINDING SITE III. Table 2 illustrates the complementarity of the nucleotide sequences of LOC197138 BINDING SITE, designated SEQ ID:42458, to the nucleotide sequence of VGAM258 RNA, herein designated VGAM RNA, also designated SEQ ID:2969.

Another function of VGAM258 is therefore inhibition of LOC197138 (Accession XM_113829). Accordingly, utilities of VGAM258 include diagnosis, prevention and treatment of diseases and clinical conditions associated with LOC197138. LOC199957 (Accession XM_114068) is another VGAM258 host target gene. LOC199957 BINDING SITE is HOST TARGET binding site found in the 3' untranslated region of mRNA encoded by LOC199957, corresponding to a HOST TARGET binding site such as BINDING SITE I, BINDING SITE II or BINDING SITE III. Table 2 illustrates the complementarity of the nucleotide sequences of LOC199957 BINDING SITE, designated SEQ ID:42672, to the nucleotide sequence of VGAM258 RNA, herein designated VGAM RNA, also designated SEQ ID:2969.

Another function of VGAM258 is therefore inhibition of LOC199957 (Accession XM_114068). Accordingly, utilities of VGAM258 include diagnosis, prevention and treatment of diseases and clinical conditions associated with LOC199957. LOC256940 (Accession XM_172879) is another VGAM258 host target gene. LOC256940 BINDING SITE is HOST TARGET binding site found in the 5' untranslated region of mRNA encoded by LOC256940, corresponding to a HOST TARGET binding site such as BINDING SITE I, BINDING SITE II or BINDING SITE III. Table 2 illustrates the complementarity of the nucleotide sequences of LOC256940 BINDING SITE, designated SEQ ID:46154, to the nucleotide sequence of VGAM258 RNA, herein designated VGAM RNA, also designated SEQ ID:2969.

Another function of VGAM258 is therefore inhibition of LOC256940 (Accession XM_172879). Accordingly, utilities of VGAM258 include diagnosis, prevention and treatment of diseases and clinical conditions associated with LOC256940. FIG. 1 further provides a conceptual description of a novel bioinformatically detected viral gene of the present invention, referred to here as Viral Genomic Address Messenger 259 (VGAM259) viral gene, which modulates expression of respective host target genes thereof, the function and utility of which host target genes is known in the art.

VGAM259 is a novel bioinformatically detected regulatory, non protein coding, viral micro RNA (miRNA) gene. The method by which VGAM259 was detected is described hereinabove with reference to FIGS. 1-8.

VGAM259 gene, herein designated VGAM GENE, is a viral gene contained in the genome of Callitrichine Herpesvirus 3. VGAM259 host target gene, herein designated VGAM HOST TARGET GENE, is a human gene contained in the human genome.

VGAM259 gene encodes a VGAM259 precursor RNA, herein designated VGAM PRECURSOR RNA. Similar to other miRNA genes, and unlike most ordinary genes, VGAM259 precursor RNA does not encode a protein. A nucleotide sequence identical or highly similar to the nucleotide sequence of VGAM259 precursor RNA is designated SEQ ID:245, and is provided hereinbelow with reference to the sequence listing part. Nucleotide sequence SEQ ID:245 is located at position 56367 relative to the genome of Callitrichine Herpesvirus 3.

VGAM259 precursor RNA folds onto itself, forming VGAM259 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM259 folded precursor RNA into VGAM259 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM259 RNA is designated SEQ ID:2970, and is provided hereinbelow with reference to the sequence listing part.

VGAM259 host target gene, herein designated VGAM HOST TARGET GENE, encodes a corresponding messenger RNA, VGAM259 host target RNA, herein designated VGAM HOST TARGET RNA. VGAM259 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM259 RNA, herein designated VGAM RNA, binds complementarily to one or more host target binding sites located in untranslated regions of VGAM259 host target RNA, herein designated VGAM HOST TARGET RNA. This complementary binding is due to the fact that the nucleotide sequence of VGAM259 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM259 RNA, herein designated VGAM RNA, may have a different number of host target binding sites in untranslated regions of a VGAM259 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM259 RNA, herein designated VGAM RNA, to host target binding sites on VGAM259 host target RNA, herein designated VGAM HOST TARGET RNA, such as BINDING SITE I, BINDING SITE II and BINDING SITE III, inhibits translation of VGAM259 host target RNA into VGAM259 host target protein, herein designated VGAM HOST TARGET PROTEIN. VGAM host target protein is therefore outlined by a broken line.

It is appreciated that VGAM259 host target gene, herein designated VGAM HOST TARGET GENE, in fact represents a plurality of VGAM259 host target genes. The mRNA of each one of this plurality of VGAM259 host target genes comprises one or more host target binding sites, each having a nucleotide sequence which is at least partly complementary to VGAM259 RNA, herein designated VGAM RNA, and which when bound by VGAM259 RNA causes inhibition of translation of respective one or more VGAM259 host target proteins.

It is further appreciated by one skilled in the art that the mode of translational inhibition illustrated by FIG. 1 with specific reference to translational inhibition exerted by VGAM259 gene, herein designated VGAM GENE, on one or more VGAM259 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM259 is inhibition of expression of host target genes, as part of a novel viral mechanism of attacking a host. Accordingly, utilities of VGAM259 include diagnosis, prevention and treatment of viral infection by Callitrichine Herpesvirus 3. Specific functions, and accordingly utilities, of VGAM259 correlate with, and may be deduced from, the identity of the host target genes which VGAM259 binds and inhibits, and the function of these host target genes, as elaborated hereinbelow.

Nucleotide sequences of the VGAM259 precursor RNA, herein designated VGAM PRECURSOR RNA, and of the 'diced' VGAM259 RNA, herein designated VGAM RNA, and a schematic representation of the secondary folding of VGAM259 folded precursor RNA, herein designated VGAM FOLDED PRECURSOR RNA, of VGAM259 are further described hereinbelow with reference to Table 1.

Nucleotide sequences of host target binding sites, such as BINDING SITE-I, BINDING SITE-II and BINDING SITE-III of FIG. 1, found on VGAM259 host target RNA, and schematic representation of the complementarity of each of these host target binding sites to VGAM259 RNA, herein designated VGAM RNA, are described hereinbelow with reference to Table 2.

As mentioned hereinabove with reference to FIG. 1, a function of VGAM259 gene, herein designated VGAM is inhibition of expression of VGAM259 target genes. It is appreciated that specific functions, and accordingly utilities, of VGAM259 correlate with, and may be deduced from, the identity of the target genes which VGAM259 binds and inhibits, and the function of these target genes, as elaborated hereinbelow.

Amino-terminal Enhancer of Split (AES, Accession NM_001130) is a VGAM259 host target gene. AES BINDING SITE is HOST TARGET binding site found in the 3' untranslated region of mRNA encoded by AES, corresponding to a HOST TARGET binding site such as BINDING SITE I, BINDING SITE II or BINDING SITE III. Table 2 illustrates the complementarity of the nucleotide sequences of AES BINDING SITE, designated SEQ ID:6803, to the nucleotide sequence of VGAM259 RNA, herein designated VGAM RNA, also designated SEQ ID:2970.

A function of VGAM259 is therefore inhibition of Amino-terminal Enhancer of Split (AES, Accession NM_001130), a gene which may function during epithelial differentiation. Accordingly, utilities of VGAM259 include diagnosis, prevention and treatment of diseases and clinical conditions associated with AES. The function of AES has been established by previous studies. In Drosophila melanogaster, neurogenesis is under the control of several loci whose products appear to determine the fate of neuroectodermal cells during embryonic development. One of these neurogenic loci is the enhancer of split gene complex. Hartley et al. (1988) serendipitously isolated a mouse cDNA which predicted a sequence of 202 amino acids exhibiting strong similarity with the amino-terminal region of Drosophila enhancer of split groucho protein. Miyasaka et al. (1993) reported the cDNA cloning, nucleotide and deduced amino acid sequencing, and tissue-specific expression of mouse and human AES (amino-terminal enhancer of split) and ESG (enhancer of split groucho) genes. (ESG is also called TLE for 'transducin-like enhancer of split.') Human AES transcripts of 1.6 kb and 1.4 kb were predominantly present in muscle, heart, and placenta. Using human/Chinese hamster hybrid cell lines, Miyasaka et al. (1993) mapped the human AES gene to chromosome 19. Hou and Li (1998) used fluorescence in situ hybridization to localize the AES gene to 19p13.3 near the transcription factor-3 (TCF3; 141741) gene. They also determined the nucleotide sequence for approximately 12 kb from the AES gene and showed that its protein-encoding sequence is interrupted by 6 introns.

Full details of the abovementioned studies are described in the following publications, the disclosure of which are hereby incorporated by reference:

Hou, E. W.; Li, S.-L.: Genomic organization and chromosome localization to band 19p13.3 of the human AES gene: gene product exhibits strong similarity to the N-terminal domain of Drosophila enhancer of split Groucho protein. DNA Cell Biol. 17:911-913, 1998; and Miyasaka, H.; Choudhury, B. K.; Hou, E. W.; Li, S. S.-L.: Molecular cloning and expression of mouse and human cDNA encoding AES and ESG proteins with strong similarity to Drosophila en.

Further studies establishing the function and utilities of AES are found in John Hopkins OMIM database record ID 600188, and in sited publications numbered 10113-10115 listed in the bibliography section hereinbelow, which are also hereby incorporated by reference. Contactin 2 (axonal) (CNTN2, Accession NM_005076) is another VGAM259 host target gene. CNTN2 BINDING SITE is HOST TARGET binding site found in the 3' untranslated region of mRNA encoded by CNTN2, corresponding to a HOST TARGET binding site such as BINDING SITE I, BINDING SITE II or BINDING SITE III. Table 2 illustrates the complementarity of the nucleotide sequences of CNTN2 BINDING SITE, designated SEQ ID:11523, to the nucleotide sequence of VGAM259 RNA, herein designated VGAM RNA, also designated SEQ ID:2970.

Another function of VGAM259 is therefore inhibition of Contactin 2 (axonal) (CNTN2, Accession NM_005076), a gene which may play a role in axonal growth and cell adhesion. Accordingly, utilities of VGAM259 include diagnosis, prevention and treatment of diseases and clinical conditions associated with CNTN2. The function of CNTN2 has been established by previous studies. The pathfinding of axons toward their targets represents an early step in the development of the nervous system. Axonal extension involves selective interactions between molecules on the surface of the axon and those in the local microenvironment. Functional studies in vitro of axonal surface glycoproteins suggest that they are involved in cell adhesion and in the promotion of neurite outgrowth. One of these proteins, the rat transient axonal glycoprotein (Tag1), is expressed by restricted subsets of central and peripheral neurons during the initial phase of neurite outgrowth (Dodd et al., 1988). Tag1 belongs to the immunoglobulin superfamily. Tsiotra et al. (1993) isolated cDNAs encoding TAX1, the human homolog of TAG1. Human TAX1 showed a high degree of homology to the rat protein and less to its chick counterpart, axonin-1, with 91 and 75% identity at the amino acid level, respectively. The numbers of immunoglobulin (IgC2) domains and fibronectin repeats present in TAG1 were conserved among the 3 species Rickman et al. (2001) found TAX1 to be amplified in 2 high-grade gliomas among a group of 26 gliomas investigated. Furthermore, they found high levels of TAX1 mRNA in glial tumors, even in the absence of TAX1 gene amplification. Because glial tumors are highly invasive and in view of the role of TAX1 in neurite outgrowth, they investigated the potential role of TAX1 in glioma cell migration. Using an in vitro assay, they found that the migration of glioma tumor cells is profoundly reduced in the presence of either an anti-TAX1 antibody or a TAX1 antisense oligonucleotide. The findings suggested that TAX1 plays a role in glial tumorigenesis and may provide a potential target for therapeutic intervention Full details of the abovementioned studies are described in the following publications, the disclosure of which are hereby incorporated by reference:

Dodd, J.; Morton, S. B.; Karagogeos, D.; Yamamoto, M.; Jessell, T. M.: Spatial regulation of axonal glycoprotein expression on subsets of embryonic spinal neurons. Neuron 1:105-116, 1988; and Rickman, D. S.; Tyagi, R.; Zhu, X.-X.; Bobek, M. P.; Song, S.; Blaivas, M.; Misek, D. E.; Israel, M. A.; Kurnit, D. M.; Ross, D. A.; Kish, P. E.; Hanash, S. M.: The gene for the axonal.

Further studies establishing the function and utilities of CNTN2 are found in John Hopkins OMIM database record ID 190197, and in sited publications numbered 5741-574 and 5733-5734 listed in the bibliography section hereinbelow, which are also hereby incorporated by reference. Gamma-aminobutyric Acid (GABA) A Receptor, Epsilon (GABRE, Accession NM_021990) is another VGAM259 host target gene. GABRE BINDING SITE is HOST TARGET binding site found in the 5' untranslated region of mRNA encoded by GABRE, corresponding to a HOST TARGET binding site such as BINDING SITE I, BINDING SITE II or BINDING SITE III. Table 2 illustrates the complementarity of the nucleotide sequences of GABRE BINDING SITE, designated SEQ ID:22532, to the nucleotide sequence of VGAM259 RNA, herein designated VGAM RNA, also designated SEQ ID:2970.

Another function of VGAM259 is therefore inhibition of Gamma-aminobutyric Acid (GABA) A Receptor, Epsilon (GABRE, Accession NM_021990), a gene which mediates neuronal inhibition by binding to the gaba/benzodiazepine receptor and opening an integral chloride channel. Accordingly, utilities of VGAM259 include diagnosis, prevention and treatment of diseases and clinical conditions associated with GABRE. The function of GABRE has been established by previous studies. Davies et al. (1997) described a member of a new class of human GABA(A) receptor subunit, the epsilon subunit. The subunit was detected in the brain and can assemble with alpha and beta subunits. Wilke et al. (1997) also identified a cDNA sequence of a gene coding for a 506-amino acid protein, representing a member of a putative new class (epsilon) of the GABA-A receptor. The gene, symbolized GABRE, encodes a polypeptide almost identical to the one reported by Davies et al. (1997). GABRE was transcribed in several different tissues, with the highest levels being detected in adult heart and placenta. Wilke et al. (1997) observed alternative splicing of GABRE transcripts isolated from different tissues at multiple positions of the gene, yielding an unusually complex variety of cDNA variants. The structure of the 5-prime region of most cDNAs is compatible with expression of GABRE in adult brain only, whereas in other tissues, most transcripts code for truncated protein sequences. The GABRE gene extends over 14 kb and is clustered together with the alpha-3 (OMIM Ref. No. 305660) and the putative beta-4 GABA-A receptor subunit genes in an interval of approximately 0.8 Mb in band Xq28. It is located in the candidate regions of 2 different neurologic diseases, early-onset parkinsonism, or Waisman syndrome (OMIM Ref. No. 311510), and MRX3 (OMIM Ref. No. 309541), a form of X-linked mental retardation. Sinkkonen et al. (2000) obtained cDNAs encoding rat Gabre and Gabrq (OMIM Ref. No. 300349), which are highly divergent from their human homologs. They noted that rat Gabre and Gabrq have expression patterns distinct from those reported in primates.

Full details of the abovementioned studies are described in the following publications, the disclosure of which are hereby incorporated by reference:

Davies, P. A.; Hanna, M. C.; Hales, T. G.; Kirkness, E. F.: Insensitivity to anaesthetic agents conferred by a class of GABA(A) receptor subunit. Nature 385:820-823, 1997; and Sinkkonen, S. T.; Hanna, M. C.; Kirkness, E. F.; Korpi, E. R.: GABA-A receptor epsilon and theta subunits display unusual structural variation between species and are enriched in the r.

Further studies establishing the function and utilities of GABRE are found in John Hopkins OMIM database record ID 300093, and in sited publications numbered 9081-9083 listed in the bibliography section hereinbelow, which are also hereby incorporated by reference. LENG4 (Accession NM_024298) is another VGAM259 host target gene. LENG4 BINDING SITE is HOST TARGET binding site found in the 3' untranslated region of mRNA encoded by LENG4, corresponding to a HOST TARGET binding site such as BINDING SITE I, BINDING SITE II or BINDING SITE III. Table 2 illustrates the complementarity of the nucleotide sequences of LENG4 BINDING SITE, designated SEQ ID:23578, to the nucleotide sequence of VGAM259 RNA, herein designated VGAM RNA, also designated SEQ ID:2970.

Another function of VGAM259 is therefore inhibition of LENG4 (Accession NM_024298), a gene which may be a transmembrane protein. Accordingly, utilities of VGAM259 include diagnosis, prevention and treatment of diseases and clinical conditions associated with LENG4. The function of LENG4 has been established by previous studies. Overexpression of genes is one of the genetic alterations that may have a role in the development and progression of cancers. By immunoscreening a bladder tumor cell cDNA expression library with antibody to AN43, a bladder tumor-associated antigen, Fukunaga-Johnson et al. (1996) isolated a cDNA encoding BB1. The deduced 343-amino acid protein contains both hydrophilic and hydrophobic regions, suggesting that it may be a transmembrane protein. Northern blot analysis revealed elevated expression of a 2.0-kb transcript in breast and bladder tumor cells compared with normal cells. Expression in the cancer cells could be reduced by treatment with gamma-interferon (IFNG; 147570). Because of a lack of reactivity of the expressed BB1 protein on Western blots, Fukunaga-Johnson et al. (1996) concluded that BB1 is distinct from the AN43 antigen. By genomic sequence analysis, Wende et al. (2000) mapped the BB1 gene, which they termed LENG4, to 19q13.4. They noted that the LENG genes, unlike other genes in the leukocyter receptor cluster on 19q13.4, do not encode proteins with immunoglobulin domains.

Full details of the abovementioned studies are described in the following publications, the disclosure of which are hereby incorporated by reference:

Fukunaga-Johnson, N.; Lee, S. W.; Liebert, M.; Grossman, H. B.: Molecular analysis of a gene, BB1, overexpressed in bladder and breast carcinoma. Anticancer Res. 16:1085-1090, 1996; and Wende, H.; Volz, A.; Ziegler, A.: Extensive gene duplications and a large inversion characterize the human leukocyte receptor cluster. Immunogenetics 51:703-713, 2000.

Further studies establishing the function and utilities of LENG4 are found in John Hopkins OMIM database record ID 606048, and in sited publications numbered 6449 listed in the bibliography section hereinbelow, which are also hereby incorporated by reference. Leucine-zipper-like Transcriptional Regulator, 1 (LZTR1, Accession NM_006767) is another VGAM259 host target gene. LZTR1 BINDING SITE is HOST TARGET binding site found in the 3' untranslated region of mRNA encoded by LZTR1, corresponding to a HOST TARGET binding site such as BINDING SITE I, BINDING SITE II or BINDING SITE III. Table 2 illustrates the complementarity of the nucleotide sequences of LZTR1 BINDING SITE, designated SEQ ID:13635, to the nucleotide sequence of VGAM259 RNA, herein designated VGAM RNA, also designated SEQ ID:2970.

Another function of VGAM259 is therefore inhibition of Leucine-zipper-like Transcriptional Regulator, 1 (LZTR1, Accession NM_006767). Accordingly, utilities of VGAM259 include diagnosis, prevention and treatment of diseases and clinical conditions associated with LZTR1. Neuroligin 2 (NLGN2, Accession XM_113932) is another VGAM259 host target gene. NLGN2 BINDING SITE is HOST TARGET binding site found in the 3' untranslated region of mRNA encoded by NLGN2, corresponding to a HOST TARGET binding site such as BINDING SITE I, BINDING SITE II or BINDING SITE III. Table 2 illustrates the complementarity of the nucleotide sequences of NLGN2 BINDING SITE, designated SEQ ID:42548, to the nucleotide sequence of VGAM259 RNA, herein designated VGAM RNA, also designated SEQ ID:2970.

Another function of VGAM259 is therefore inhibition of Neuroligin 2 (NLGN2, Accession XM_113932), a gene which rapidly hydrolyzes choline released into the synapse. Accordingly, utilities of VGAM259 include diagnosis, prevention and treatment of diseases and clinical conditions associated with NLGN2. The function of NLGN2 and its association with various diseases and clinical conditions, has been established by previous studies, as described hereinabove with reference to VGAM178. Chromosome 21 Open Reading Frame 25 (C21orf25, Accession XM_032945) is another VGAM259 host target gene. C21orf25 BINDING SITE is HOST TARGET binding site found in the 3' untranslated region of mRNA encoded by C21orf25, corresponding to a HOST TARGET binding site such as BINDING SITE I, BINDING SITE II or BINDING SITE III. Table 2 illustrates the complementarity of the nucleotide sequences of C21orf25 BINDING SITE, designated SEQ ID:31798, to the nucleotide sequence of VGAM259 RNA, herein designated VGAM RNA, also designated SEQ ID:2970.

Another function of VGAM259 is therefore inhibition of Chromosome 21 Open Reading Frame 25 (C21orf25, Accession XM_032945). Accordingly, utilities of VGAM259 include diagnosis, prevention and treatment of diseases and clinical conditions associated with C21orf25. FLJ22814 (Accession NM_024916) is another VGAM259 host target gene. FLJ22814 BINDING SITE is HOST TARGET binding site found in the 3' untranslated region of mRNA encoded by FLJ22814, corresponding to a HOST TARGET binding site such as BINDING SITE I, BINDING SITE II or BINDING SITE III. Table 2 illustrates the complementarity of the nucleotide sequences of FLJ22814 BINDING SITE, designated SEQ ID:24440, to the nucleotide sequence of VGAM259 RNA, herein designated VGAM RNA, also designated SEQ ID:2970.

Another function of VGAM259 is therefore inhibition of FLJ22814 (Accession NM_024916). Accordingly, utilities of VGAM259 include diagnosis, prevention and treatment of diseases and clinical conditions associated with FLJ22814. FLJ23519 (Accession NM_032240) is another VGAM259 host target gene. FLJ23519 BINDING SITE is HOST TARGET binding site found in the 3' untranslated region of mRNA encoded by FLJ23519, corresponding to a HOST TARGET binding site such as BINDING SITE I, BINDING SITE II or BINDING SITE III. Table 2 illustrates the complementarity of the nucleotide sequences of FLJ23519 BINDING SITE, designated SEQ ID:25974, to the nucleotide sequence of VGAM259 RNA, herein designated VGAM RNA, also designated SEQ ID:2970.

Another function of VGAM259 is therefore inhibition of FLJ23519 (Accession NM_032240). Accordingly, utilities of VGAM259 include diagnosis, prevention and treatment of diseases and clinical conditions associated with FLJ23519. HSGP25L2G (Accession XM_030771) is another VGAM259 host target gene. HSGP25L2G BINDING SITE is HOST TARGET binding site found in the 3' untranslated region of mRNA encoded by HSGP25L2G, corresponding to a HOST TARGET binding site such as BINDING SITE I, BINDING SITE II or BINDING SITE III. Table 2 illustrates the complementarity of the nucleotide sequences of HSGP25L2G BINDING SITE, designated SEQ ID:31133, to the nucleotide sequence of VGAM259 RNA, herein designated VGAM RNA, also designated SEQ ID:2970.

Another function of VGAM259 is therefore inhibition of HSGP25L2G (Accession XM_030771). Accordingly, utilities of VGAM259 include diagnosis, prevention and treatment of diseases and clinical conditions associated with HSGP25L2G. KIAA1257 (Accession XM_031577) is another VGAM259 host target gene. KIAA1257 BINDING SITE is HOST TARGET binding site found in the 3' untranslated region of mRNA encoded by KIAA1257, corresponding to a HOST TARGET binding site such as BINDING SITE I, BINDING SITE II or BINDING SITE III. Table 2 illustrates the complementarity of the nucleotide sequences of KIAA1257 BINDING SITE, designated SEQ ID:31437, to the nucleotide sequence of VGAM259 RNA, herein designated VGAM RNA, also designated SEQ ID:2970.

Another function of VGAM259 is therefore inhibition of KIAA1257 (Accession XM_031577). Accordingly, utilities of VGAM259 include diagnosis, prevention and treatment of diseases and clinical conditions associated with KIAA1257. MGC11352 (Accession XM_035941) is another VGAM259 host target gene. MGC11352 BINDING SITE is HOST TARGET binding site found in the 5' untranslated region of mRNA encoded by MGC11352, corresponding to a HOST TARGET binding site such as BINDING SITE I, BINDING SITE II or BINDING SITE III. Table 2 illustrates the complementarity of the nucleotide sequences of MGC11352 BINDING SITE, designated SEQ ID:32353, to the nucleotide sequence of VGAM259 RNA, herein designated VGAM RNA, also designated SEQ ID:2970.

Another function of VGAM259 is therefore inhibition of MGC11352 (Accession XM_035941). Accordingly, utilities of VGAM259 include diagnosis, prevention and treatment of diseases and clinical conditions associated with MGC11352. MGC2721 (Accession NM_032737) is another VGAM259 host target gene. MGC2721 BINDING SITE is HOST TARGET binding site found in the 3' untranslated region of mRNA encoded by MGC2721, corresponding to a HOST TARGET binding site such as BINDING SITE I, BINDING SITE II or BINDING SITE III. Table 2 illustrates the complementarity of the nucleotide sequences of MGC2721 BINDING SITE, designated SEQ ID:26461, to the nucleotide sequence of VGAM259 RNA, herein designated VGAM RNA, also designated SEQ ID:2970.

Another function of VGAM259 is therefore inhibition of MGC2721 (Accession NM_032737). Accordingly, utilities of VGAM259 include diagnosis, prevention and treatment of diseases and clinical conditions associated with MGC2721. SSB-3 (Accession NM_080861) is another VGAM259 host target gene. SSB-3 BINDING SITE is HOST TARGET binding site found in the 3' untranslated region of mRNA encoded by SSB-3, corresponding to a HOST TARGET binding site such as BINDING SITE I, BINDING SITE II or BINDING SITE III. Table 2 illustrates the complementarity of the nucleotide sequences of SSB-3 BINDING SITE, designated SEQ ID:28099, to the nucleotide sequence of VGAM259 RNA, herein designated VGAM RNA, also designated SEQ ID:2970.

Another function of VGAM259 is therefore inhibition of SSB-3 (Accession NM_080861). Accordingly, utilities of VGAM259 include diagnosis, prevention and treatment of diseases and clinical conditions associated with SSB-3. TUSP (Accession NM_020245) is another VGAM259 host target gene. TUSP BINDING SITE is HOST TARGET binding site found in the 5' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21531, to the nucleotide sequence of VGAM259 RNA, herein designated VGAM RNA, also designated SEQ ID:2970.

Another function of VGAM259 is therefore inhibition of TUSP (Accession NM_020245). Accordingly, utilities of VGAM259 include diagnosis, prevention and treatment of diseases and clinical conditions associated with TUSP. LOC124987 (Accession XM_064384) is another VGAM259 host target gene. LOC124987 BINDING SITE is HOST TARGET binding site found in the 5' untranslated region of mRNA encoded by LOC124987, corresponding to a HOST TARGET binding site such as BINDING SITE I, BINDING SITE II or BINDING SITE III. Table 2 illustrates the complementarity of the nucleotide sequences of LOC124987 BINDING SITE, designated SEQ ID:37264, to the nucleotide sequence of VGAM259 RNA, herein designated VGAM RNA, also designated SEQ ID:2970.

Another function of VGAM259 is therefore inhibition of LOC124987 (Accession XM_064384). Accordingly, utilities of VGAM259 include diagnosis, prevention and treatment of diseases and clinical conditions associated with LOC124987. LOC145725 (Accession XM_085211) is another VGAM259 host target gene. LOC145725 BINDING SITE is HOST TARGET binding site found in the 5' untranslated region of mRNA encoded by LOC145725, corresponding to a HOST TARGET binding site such as BINDING SITE I, BINDING SITE II or BINDING SITE III. Table 2 illustrates the complementarity of the nucleotide sequences of LOC145725 BINDING SITE, designated SEQ ID:37944, to the nucleotide sequence of VGAM259 RNA, herein designated VGAM RNA, also designated SEQ ID:2970.

Another function of VGAM259 is therefore inhibition of LOC145725 (Accession XM_085211). Accordingly, utilities of VGAM259 include diagnosis, prevention and treatment of diseases and clinical conditions associated with LOC145725. LOC145732 (Accession XM_085218) is another VGAM259 host target gene. LOC145732 BINDING SITE is HOST TARGET binding site found in the 5' untranslated region of mRNA encoded by LOC145732, corresponding to a HOST TARGET binding site such as BINDING SITE I, BINDING SITE II or BINDING SITE III. Table 2 illustrates the complementarity of the nucleotide sequences of LOC145732 BINDING SITE, designated SEQ ID:37953, to the nucleotide sequence of VGAM259 RNA, herein designated VGAM RNA, also designated SEQ ID:2970.

Another function of VGAM259 is therefore inhibition of LOC145732 (Accession XM_085218). Accordingly, utilities of VGAM259 include diagnosis, prevention and treatment of diseases and clinical conditions associated with LOC145732. LOC157918 (Accession XM_098842) is another VGAM259 host target gene. LOC157918 BINDING SITE is HOST TARGET binding site found in the 5' untranslated region of mRNA encoded by LOC157918, corresponding to a HOST TARGET binding site such as BINDING SITE I, BINDING SITE II or BINDING SITE III. Table 2 illustrates the complementarity of the nucleotide sequences of LOC157918 BINDING SITE, designated SEQ ID:41892, to the nucleotide sequence of VGAM259 RNA, herein designated VGAM RNA, also designated SEQ ID:2970.

Another function of VGAM259 is therefore inhibition of LOC157918 (Accession XM_098842). Accordingly, utilities of VGAM259 include diagnosis, prevention and treatment of diseases and clinical conditions associated with LOC157918. LOC196957 (Accession XM_113789) is another VGAM259 host target gene. LOC196957 BINDING SITE is HOST TARGET binding site found in the 5' untranslated region of mRNA encoded by LOC196957, corresponding to a HOST TARGET binding site such as BINDING SITE I, BINDING SITE II or BINDING SITE III. Table 2 illustrates the complementarity of the nucleotide sequences of LOC196957 BINDING SITE, designated SEQ ID:42426, to the nucleotide sequence of VGAM259 RNA, herein designated VGAM RNA, also designated SEQ ID:2970.

Another function of VGAM259 is therefore inhibition of LOC196957 (Accession XM_113789). Accordingly, utilities of VGAM259 include diagnosis, prevention and treatment of diseases and clinical conditions associated with LOC196957.

LOC196961 (Accession XM_113790) is another VGAM259 host target gene. LOC196961 BINDING SITE is HOST TARGET binding site found in the 5' untranslated region of mRNA encoded by LOC196961, corresponding to a HOST TARGET binding site such as BINDING SITE I, BINDING SITE II or BINDING SITE III. Table 2 illustrates the complementarity of the nucleotide sequences of LOC196961 BINDING SITE, designated SEQ ID:42435, to the nucleotide sequence of VGAM259 RNA, herein designated VGAM RNA, also designated SEQ ID:2970.

Another function of VGAM259 is therefore inhibition of LOC196961 (Accession XM_113790). Accordingly, utilities of VGAM259 include diagnosis, prevention and treatment of diseases and clinical conditions associated with LOC196961.

LOC197138 (Accession XM_113829) is another VGAM259 host target gene. LOC197138 BINDING SITE is HOST TARGET binding site found in the 5' untranslated region of mRNA encoded by LOC197138, corresponding to a HOST TARGET binding site such as BINDING SITE I, BINDING SITE II or BINDING SITE III. Table 2 illustrates the complementarity of the nucleotide sequences of LOC197138 BINDING SITE, designated SEQ ID:42453, to the nucleotide sequence of VGAM259 RNA, herein designated VGAM RNA, also designated SEQ ID:2970.

Another function of VGAM259 is therefore inhibition of LOC197138 (Accession XM_113829). Accordingly, utilities of VGAM259 include diagnosis, prevention and treatment of diseases and clinical conditions associated with LOC197138.

LOC254439 (Accession XM_170659) is another VGAM259 host target gene. LOC254439 BINDING SITE is HOST TARGET binding site found in the 3' untranslated region of mRNA encoded by LOC254439, corresponding to a HOST TARGET binding site such as BINDING SITE I, BINDING SITE II or BINDING SITE III. Table 2 illustrates the complementarity of the nucleotide sequences of LOC254439 BINDING SITE, designated SEQ ID:45433, to the nucleotide sequence of VGAM259 RNA, herein designated VGAM RNA, also designated SEQ ID:2970.

Another function of VGAM259 is therefore inhibition of LOC254439 (Accession XM_170659). Accordingly, utilities of VGAM259 include diagnosis, prevention and treatment of diseases and clinical conditions associated with LOC254439.

LOC255196 (Accession XM_173157) is another VGAM259 host target gene. LOC255196 BINDING SITE is HOST TARGET binding site found in the 3' untranslated region of mRNA encoded by LOC255196, corresponding to a HOST TARGET binding site such as BINDING SITE I, BINDING SITE II or BINDING SITE III. Table 2 illustrates the complementarity of the nucleotide sequences of LOC255196 BINDING SITE, designated SEQ ID:46414, to the nucleotide sequence of VGAM259 RNA, herein designated VGAM RNA, also designated SEQ ID:2970.

Another function of VGAM259 is therefore inhibition of LOC255196 (Accession XM_173157). Accordingly, utilities of VGAM259 include diagnosis, prevention and treatment of diseases and clinical conditions associated with LOC255196.

LOC257437 (Accession XM_166089) is another VGAM259 host target gene. LOC257437 BINDING SITE is HOST TARGET binding site found in the 5' untranslated region of mRNA encoded by LOC257437, corresponding to a HOST TARGET binding site such as BINDING SITE I, BINDING SITE II or BINDING SITE III. Table 2 illustrates the complementarity of the nucleotide sequences of LOC257437 BINDING SITE, designated SEQ ID:43854, to the nucleotide sequence of VGAM259 RNA, herein designated VGAM RNA, also designated SEQ ID:2970.

Another function of VGAM259 is therefore inhibition of LOC257437 (Accession XM_166089). Accordingly, utilities of VGAM259 include diagnosis, prevention and treatment of diseases and clinical conditions associated with LOC257437.

LOC90019 (Accession NM_138567) is another VGAM259 host target gene. LOC90019 BINDING SITE is HOST TARGET binding site found in the 3' untranslated region of mRNA encoded by LOC90019, corresponding to a HOST TARGET binding site such as BINDING SITE I, BINDING SITE II or BINDING SITE III. Table 2 illustrates the complementarity of the nucleotide sequences of LOC90019 BINDING SITE, designated SEQ ID:28869, to the nucleotide sequence of VGAM259 RNA, herein designated VGAM RNA, also designated SEQ ID:2970.

Another function of VGAM259 is therefore inhibition of LOC90019 (Accession NM_138567). Accordingly, utilities of VGAM259 include diagnosis, prevention and treatment of diseases and clinical conditions associated with LOC90019.

LOC91496 (Accession XM_038788) is another VGAM259 host target gene. LOC91496 BINDING SITE is HOST TARGET binding site found in the 5' untranslated region of mRNA encoded by LOC91496, corresponding to a HOST TARGET binding site such as BINDING SITE I, BINDING SITE II or BINDING SITE III. Table 2 illustrates the complementarity of the nucleotide sequences of LOC91496 BINDING SITE, designated SEQ ID:32920, to the nucleotide sequence of VGAM259 RNA, herein designated VGAM RNA, also designated SEQ ID:2970.

Another function of VGAM259 is therefore inhibition of LOC91496 (Accession XM_038788). Accordingly, utilities of VGAM259 include diagnosis, prevention and treatment of diseases and clinical conditions associated with LOC91496.

FIG. 1 further provides a conceptual description of a novel bioinformatically detected viral gene of the present invention, referred to here as Viral Genomic Address Messenger 260 (VGAM260) viral gene, which modulates expression of respective host target genes thereof, the function and utility of which host target genes is known in the art.

VGAM260 is a novel bioinformatically detected regulatory, non protein coding, viral micro RNA (miRNA) gene. The method by which VGAM260 was detected is described hereinabove with reference to FIGS. 1-8.

VGAM260 gene, herein designated VGAM GENE, is a viral gene contained in the genome of Callitrichine Herpesvirus 3. VGAM260 host target gene, herein designated VGAM HOST TARGET GENE, is a human gene contained in the human genome.

VGAM260 gene encodes a VGAM260 precursor RNA, herein designated VGAM PRECURSOR RNA. Similar to other miRNA genes, and unlike most ordinary genes, VGAM260 precursor RNA does not encode a protein. A nucleotide sequence identical or highly similar to the nucleotide sequence of VGAM260 precursor RNA is designated SEQ ID:246, and is provided hereinbelow with reference to the sequence listing part. Nucleotide sequence SEQ ID:246 is located at position 19614 relative to the genome of Callitrichine Herpesvirus 3.

VGAM260 precursor RNA folds onto itself, forming VGAM260 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM260 folded precursor RNA into VGAM260 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 85%) nucleotide sequence of VGAM260 RNA is designated SEQ ID:2971, and is provided hereinbelow with reference to the sequence listing part.

VGAM260 host target gene, herein designated VGAM HOST TARGET GENE, encodes a corresponding messenger RNA, VGAM260 host target RNA, herein designated VGAM HOST TARGET RNA. VGAM260 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM260 RNA, herein designated VGAM RNA, binds complementarily to one or more host target binding sites located in untranslated regions of VGAM260 host target RNA, herein designated VGAM HOST TARGET RNA. This complementary binding is due to the fact that the nucleotide sequence of VGAM260 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM260 RNA, herein designated VGAM RNA, may have a different number of host target binding sites in untranslated regions of a VGAM260 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM260 RNA, herein designated VGAM RNA, to host target binding sites on VGAM260 host target RNA, herein designated VGAM HOST TARGET RNA, such as BINDING SITE I, BINDING SITE II and BINDING SITE III, inhibits translation of VGAM260 host target RNA into VGAM260 host target protein, herein designated VGAM HOST TARGET PROTEIN. VGAM host target protein is therefore outlined by a broken line.

It is appreciated that VGAM260 host target gene, herein designated VGAM HOST TARGET GENE, in fact represents a plurality of VGAM260 host target genes. The mRNA of each one of this plurality of VGAM260 host target genes comprises one or more host target binding sites, each having a nucleotide sequence which is at least partly complementary to VGAM260 RNA, herein designated VGAM RNA, and which when bound by VGAM260 RNA causes inhibition of translation of respective one or more VGAM260 host target proteins.

It is further appreciated by one skilled in the art that the mode of translational inhibition illustrated by FIG. 1 with specific reference to translational inhibition exerted by VGAM260 gene, herein designated VGAM GENE, on one or more VGAM260 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM260 is inhibition of expression of host target genes, as part of a novel viral mechanism of attacking a host. Accordingly, utilities of VGAM260 include diagnosis, prevention and treatment of viral infection by Callitrichine Herpesvirus 3. Specific functions, and accordingly utilities, of VGAM260 correlate with, and may be deduced from, the identity of the host target genes which VGAM260 binds and inhibits, and the function of these host target genes, as elaborated hereinbelow.

Nucleotide sequences of the VGAM260 precursor RNA, herein designated VGAM PRECURSOR RNA, and of the 'diced' VGAM260 RNA, herein designated VGAM RNA, and a schematic representation of the secondary folding of VGAM260 folded precursor RNA, herein designated VGAM FOLDED PRECURSOR RNA, of VGAM260 are further described hereinbelow with reference to Table 1.

Nucleotide sequences of host target binding sites, such as BINDING SITE-I, BINDING SITE-II and BINDING SITE-III of FIG. 1, found on VGAM260 host target RNA, and schematic representation of the complementarity of each of these host target binding sites to VGAM260 RNA, herein designated VGAM RNA, are described hereinbelow with reference to Table 2.

As mentioned hereinabove with reference to FIG. 1, a function of VGAM260 gene, herein designated VGAM is inhibition of expression of VGAM260 target genes. It is appreciated that specific functions, and accordingly utilities, of VGAM260 correlate with, and may be deduced from, the identity of the target genes which VGAM260 binds and inhibits, and the function of these target genes, as elaborated hereinbelow.

Amylo-1, 6-glucosidase, 4-alpha-glucanotransferase (glycogen debranching enzyme, glycogen storage disease type III) (AGL, Accession NM_000644) is a VGAM260 host target gene. AGL BINDING SITE1 through AGL BINDING SITE6 are HOST TARGET binding sites found in untranslated regions of mRNA encoded by AGL, corresponding to HOST TARGET binding sites such as BINDING SITE I, BINDING SITE II or BINDING SITE III. Table 2 illustrates the complementarity of the nucleotide sequences of AGL BINDING SITE1 through AGL BINDING SITE6, designated SEQ ID:6295, SEQ ID:6300, SEQ ID:6308, SEQ ID:5468, SEQ ID:6285 and SEQ ID:6290 respectively, to the nucleotide sequence of VGAM260 RNA, herein designated VGAM RNA, also designated SEQ ID:2971.

A function of VGAM260 is therefore inhibition of Amylo-1, 6-glucosidase, 4-alpha-glucanotransferase (glycogen debranching enzyme, glycogen storage disease type III) (AGL, Accession NM_000644). Accordingly, utilities of VGAM260 include diagnosis, prevention and treatment of diseases and clinical conditions associated with AGL. Desmoglein 1 (DSG1, Accession NM_001942) is another VGAM260 host target gene. DSG1 BINDING SITE is HOST TARGET binding site found in the 3' untranslated region of mRNA encoded by DSG1, corresponding to a HOST TARGET binding site such as BINDING SITE I, BINDING SITE II or BINDING SITE III. Table 2 illustrates the complementarity of the nucleotide sequences of DSG1 BINDING SITE, designated SEQ ID:7655, to the nucleotide sequence of VGAM260 RNA, herein designated VGAM RNA, also designated SEQ ID:2971.

Another function of VGAM260 is therefore inhibition of Desmoglein 1 (DSG1, Accession NM_001942). Accordingly, utilities of VGAM260 include diagnosis, prevention and treatment of diseases and clinical conditions associated with DSG1. Nerve Growth Factor Receptor (TNFRSF16) Associated Protein 1 (NGFRAP1, Accession NM_014380) is another VGAM260 host target gene. NGFRAP1 BINDING SITE is HOST TARGET binding site found in the 5' untranslated region of mRNA encoded by NGFRAP1, corresponding to a HOST TARGET binding site such as BINDING SITE I, BINDING SITE II or BINDING SITE III. Table 2 illustrates the complementarity of the nucleotide sequences of NGFRAP1 BINDING SITE, designated SEQ ID:15716, to the nucleotide sequence of VGAM260 RNA, herein designated VGAM RNA, also designated SEQ ID:2971.

Another function of VGAM260 is therefore inhibition of Nerve Growth Factor Receptor (TNFRSF16) Associated Protein 1 (NGFRAP1, Accession NM_014380), a gene which may play an important role in the pathogenesis of neurogenetic diseases. Accordingly, utilities of VGAM260 include diagnosis, prevention and treatment of diseases and clinical conditions associated with NGFRAP1. The function of NGFRAP1 has been established by previous studies. The C-terminal cytoplasmic domain of p75(NTR) (NGFR; 162010) has a type-2 death domain. However, TRAF (e.g., TRAF6; 602355)-like proteins that interact with this domain do not affect NGF (OMIM Ref. No. 162030)-dependent apoptosis. Using a yeast 2-hybrid screen with the cytosolic domain of p75(NTR) as bait, Mukai et al. (2000) obtained cDNAs encoding mouse and human p75(NTR)-associated cell death executor, or NADE. Human NADE is identical to the HGR74 cDNA cloned by Rapp et al. (1990) from an ovarian granulosa cDNA library. HGR74 was expressed in testis, prostate, seminal vesicle, and ovarian granulosa cells (Rapp et al., 1990). By sequence analysis, Mukai et al. (2000) predicted that the 111-amino acid NADE protein has a leucine-rich nuclear export signal (NES) and 2 ubiquitination sequence boxes. Western blot analysis showed expression of mouse Nade only after proteasome inhibition, implying that native Nade is modified by the ubiquitin conjugating system. Immunofluorescence microscopy demonstrated expression of wildtype Nade, but not Nade carrying leu94-to-ala and leu97-to-ala mutations in the NES, in the cytoplasm. GST pull-down analysis indicated that the C terminus of Nade binds to the cytoplasmic cell death domain of p75(NTR). Coimmunoprecipitation analysis showed that NGF induces interaction of NADE and p75(NTR). Tunel analysis determined that NGF, but not other neurotrophins, could induce apoptosis in cells expressing NADE and p75(NTR). NGF-treated cells expressing NADE and p75(NTR) processed CASP2 (OMIM Ref. No. 600639) and CASP3 (OMIM Ref. No. 600636) to their active forms. Confocal microscopy established that most NGF-treated oligodendrocytes underwent apoptosis and expressed NADE. Scott (2001) mapped the NGFRAP1 gene to Xq22.1-q23 based on sequence similarity between the NGFRAP1 sequence and the chromosome X clone RP13-349O20 (GenBank AL606763).

Full details of the abovementioned studies are described in the following publications, the disclosure of which are hereby incorporated by reference:

Mukai, J.; Hachiya, T.; Shoji-Hoshino, S.; Kimura, M. T.; Nadano, D.; Suvanto, P.; Hanaoka, T.; Li, Y.; Irie, S.; Greene, L. A.; Sato, T.-A.: NADE, a p75NTR-associated cell death executor, is involved in signal transduction mediated by the common neurotrophin receptor p75NTR. J. Biol. Chem. 275: 17566-17570, 2000; and Rapp, G.; Freudenstein, J.; Klaudiny, J.; Mucha, J.; Wempe, F.; Zimmer, M.; Scheit, K. H.: Characterization of three abundant mRNAs from human ovarian granulosa cells. DNA Cell Biol.

Further studies establishing the function and utilities of NGFRAP1 are found in John Hopkins OMIM database record ID 300361, and in sited publications numbered 6731-6733 listed in the bibliography section hereinbelow, which are also hereby incorporated by reference. Procollagen-proline, 2-oxoglutarate 4-dioxygenase (proline 4-hydroxylase), Alpha Polypeptide I (P4HA1, Accession NM_000917) is another VGAM260 host target gene. P4HA1 BINDING SITE is HOST TARGET binding site found in the 3' untranslated region of mRNA encoded by P4HA1, corresponding to a HOST TARGET binding site such as BINDING SITE I, BINDING SITE II or BINDING SITE III. Table 2 illustrates the complementarity of the nucleotide sequences of P4HA1 BINDING SITE, designated SEQ ID:6627, to the nucleotide sequence of VGAM260 RNA, herein designated VGAM RNA, also designated SEQ ID:2971.

Another function of VGAM260 is therefore inhibition of Procollagen-proline, 2-oxoglutarate 4-dioxygenase (proline 4-hydroxylase), Alpha Polypeptide I (P4HA1, Accession NM_000917), a gene which catalyzes the formation of 4-hydroxyproline in collagen. Accordingly, utilities of VGAM260 include diagnosis, prevention and treatment of diseases and clinical conditions associated with P4HA1. The function of P4HA1 has been established by previous studies. Prolyl 4-hydroxylase (EC 1.14.11.2) plays a central role in collagen synthesis. It catalyzes the formation of 4-hydroxyproline in collagens by hydroxylation of proline residues in peptide linkages. The 4-hydroxyproline residues are essential for the folding of the newly synthesized procollagen polypeptide chain into triple helical molecules. The active enzyme is a tetramer of 2 alpha and 2 beta subunits with a molecular weight of about 240,000. The beta subunit (P4HB; 176790) is identical to the enzyme disulfide isomerase (EC 5.3.4.1) and a major cellular thyroid-binding protein. The alpha subunit probably contributes a major part of the catalytic site of the enzyme. Helaakoski et al. (1989) isolated cDNA clones for the alpha subunit. They found that the clones encode a polypeptide of 517 amino acid residues and a signal peptide of 17 amino acids. Southern blot analyses of human genomic DNA with a cDNA probe for the alpha subunit suggested the presence of only 1 gene encoding 2 types of mRNA, which appear to result from mutually exclusive alternative splicing of primary transcripts of 1 gene. Helaakoski et al. (1994) reported that the P4HA gene covers more than 69 kilobases and consists of 16 exons. Evidence had previously been presented for a mutually exclusive alternative splicing of RNA transcripts of the gene. The present data indicated that the mutually exclusive sequences found in the mRNAs are coded by 2 consecutive, homologous 71-bp exons, 9 and 10. These exons are identical in their first 5 basepairs and the overall identity between them is 61% at the nucleotide level and 58% at the level of the coded amino acids. Both types of mRNA were found to be expressed in all of the tissues studied, but in some tissues the type coding for the exon 9 or exon 10 sequences was more abundant than the other type.

Full details of the abovementioned studies are described in the following publications, the disclosure of which are hereby incorporated by reference:

Helaakoski, T.; Vuori, K.; Myllyla, R.; Kivirikko, K. I.; Pihlajaniemi, T.: Molecular cloning of the alpha-subunit of human prolyl 4-hydroxylase: the complete cDNA-derived amino acid sequence and evidence for alternative splicing of RNA transcripts. Proc. Nat. Acad. Sci. 86:4392-4396, 1989; and Helaakoski, T.; Veijola, J.; Vuori, K.; Rehn, M.; Chow, L. T.; Taillon-Miller, P.; Kivirikko, K. I.; Pihlajaniemi, T.: Structure and expression of the human gene for the alpha subunit.

Further studies establishing the function and utilities of P4HA1 are found in John Hopkins OMIM database record ID 176710, and in sited publications numbered 1523-152 and 1528-1527 listed in the bibliography section hereinbelow, which are also hereby incorporated by reference. ATPase, (Na+)/K+ Transporting, Beta 4 Polypeptide (ATP1B4, Accession NM_012069) is another VGAM260 host target gene. ATP1B4 BINDING SITE is HOST TARGET binding site found in the 3' untranslated region of mRNA encoded by ATP1B4, corresponding to a HOST TARGET binding site such as BINDING SITE I, BINDING SITE II or BINDING SITE III. Table 2 illustrates the complementarity of the nucleotide sequences of ATP1B4 BINDING SITE, designated SEQ ID:14329, to the nucleotide sequence of VGAM260 RNA, herein designated VGAM RNA, also designated SEQ ID:2971.

Another function of VGAM260 is therefore inhibition of ATPase, (Na+)/K+ Transporting, Beta 4 Polypeptide (ATP1B4, Accession NM_012069). Accordingly, utilities of VGAM260 include diagnosis, prevention and treatment of diseases and clinical conditions associated with ATP1B4. KIAA1209 (Accession XM_027307) is another VGAM260 host target gene. KIAA1209 BINDING SITE is HOST TARGET binding site found in the 3' untranslated region of mRNA encoded by KIAA1209, corresponding to a HOST TARGET binding site such as BINDING SITE I, BINDING SITE II or BINDING SITE III. Table 2 illustrates the complementarity of the nucleotide sequences of KIAA1209 BINDING SITE, designated SEQ ID:30475, to the nucleotide sequence of VGAM260 RNA, herein designated VGAM RNA, also designated SEQ ID:2971.

Another function of VGAM260 is therefore inhibition of KIAA1209 (Accession XM_027307). Accordingly, utilities of VGAM260 include diagnosis, prevention and treatment of diseases and clinical conditions associated with KIAA1209. MGC15482 (Accession NM_032875) is another VGAM260 host target gene. MGC15482 BINDING SITE is HOST TARGET binding site found in the 3' untranslated region of mRNA encoded by MGC15482, corresponding to a HOST TARGET binding site such as BINDING SITE I, BINDING SITE II or BINDING SITE III. Table 2 illustrates the complementarity of the nucleotide sequences of MGC15482 BINDING SITE, designated SEQ ID:26696, to the nucleotide sequence of VGAM260 RNA, herein designated VGAM RNA, also designated SEQ ID:2971.

Another function of VGAM260 is therefore inhibition of MGC15482 (Accession NM_032875). Accordingly, utilities of VGAM260 include diagnosis, prevention and treatment of diseases and clinical conditions associated with MGC15482. LOC130733 (Accession XM_059466) is another VGAM260 host target gene. LOC130733 BINDING SITE is HOST TARGET binding site found in the 3' untranslated region of mRNA encoded by LOC130733, corresponding to a HOST TARGET binding site such as BINDING SITE I, BINDING SITE II or BINDING SITE III. Table 2 illustrates the complementarity of the nucleotide sequences of LOC130733 BINDING SITE, designated SEQ ID:37004, to the nucleotide sequence of VGAM260 RNA, herein designated VGAM RNA, also designated SEQ ID:2971.

Another function of VGAM260 is therefore inhibition of LOC130733 (Accession XM_059466). Accordingly, utilities of VGAM260 include diagnosis, prevention and treatment of diseases and clinical conditions associated with LOC130733. LOC152059 (Accession XM_087372) is another VGAM260 host target gene. LOC152059 BINDING SITE is HOST TARGET binding site found in the 3' untranslated region of mRNA encoded by LOC152059, corresponding to a HOST TARGET binding site such as BINDING SITE I, BINDING SITE II or BINDING SITE III. Table 2 illustrates the complementarity of the nucleotide sequences of LOC152059 BINDING SITE, designated SEQ ID:39210, to the nucleotide sequence of VGAM260 RNA, herein designated VGAM RNA, also designated SEQ ID:2971.

Another function of VGAM260 is therefore inhibition of LOC152059 (Accession XM_087372). Accordingly, utilities of VGAM260 include diagnosis, prevention and treatment of diseases and clinical conditions associated with LOC152059. LOC154743 (Accession XM_088029) is another VGAM260 host target gene. LOC154743 BINDING SITE is HOST TARGET binding site found in the 3' untranslated region of mRNA encoded by LOC154743, corresponding to a HOST TARGET binding site such as BINDING SITE I, BINDING SITE II or BINDING SITE III. Table 2 illustrates the complementarity of the nucleotide sequences of LOC154743 BINDING SITE, designated SEQ ID:39480, to the nucleotide sequence of VGAM260 RNA, herein designated VGAM RNA, also designated SEQ ID:2971.

Another function of VGAM260 is therefore inhibition of LOC154743 (Accession XM_088029). Accordingly, utilities of VGAM260 include diagnosis, prevention and treatment of diseases and clinical conditions associated with LOC154743. FIG. 1 further provides a conceptual description of a novel bioinformatically detected viral gene of the present invention, referred to here as Viral Genomic Address Messenger 261 (VGAM261) viral gene, which modulates expression of respective host target genes thereof, the function and utility of which host target genes is known in the art.

VGAM261 is a novel bioinformatically detected regulatory, non protein coding, viral micro RNA (miRNA) gene. The method by which VGAM261 was detected is described hereinabove with reference to FIGS. 1-8.

VGAM261 gene, herein designated VGAM GENE, is a viral gene contained in the genome of Callitrichine Herpesvirus 3. VGAM261 host target gene, herein designated VGAM HOST TARGET GENE, is a human gene contained in the human genome.

VGAM261 gene encodes a VGAM261 precursor RNA, herein designated VGAM PRECURSOR RNA. Similar to other miRNA genes, and unlike most ordinary genes, VGAM261 precursor RNA does not encode a protein. A nucleotide sequence identical or highly similar to the nucleotide sequence of VGAM261 precursor RNA is designated SEQ ID:247, and is provided hereinbelow with reference to the sequence listing part. Nucleotide sequence SEQ ID:247 is located at position 117465 relative to the genome of Callitrichine Herpesvirus 3.

VGAM261 precursor RNA folds onto itself, forming VGAM261 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM261 folded precursor RNA into VGAM261 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM261 RNA is designated SEQ ID:2972, and is provided hereinbelow with reference to the sequence listing part.

VGAM261 host target gene, herein designated VGAM HOST TARGET GENE, encodes a corresponding messenger RNA, VGAM261 host target RNA, herein designated VGAM HOST TARGET RNA. VGAM261 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM261 RNA, herein designated VGAM RNA, binds complementarily to one or more host target binding sites located in untranslated regions of VGAM261 host target RNA, herein designated VGAM HOST TARGET RNA. This complementary binding is due to the fact that the nucleotide sequence of VGAM261 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM261 RNA, herein designated VGAM RNA, may have a different number of host target binding sites in untranslated regions of a VGAM261 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM261 RNA, herein designated VGAM RNA, to host target binding sites on VGAM261 host target RNA, herein designated VGAM HOST TARGET RNA, such as BINDING SITE I, BINDING SITE II and BINDING SITE III, inhibits translation of VGAM261 host target RNA into VGAM261 host target protein, herein designated VGAM HOST TARGET PROTEIN. VGAM host target protein is therefore outlined by a broken line.

It is appreciated that VGAM261 host target gene, herein designated VGAM HOST TARGET GENE, in fact represents a plurality of VGAM261 host target genes. The mRNA of each one of this plurality of VGAM261 host target genes comprises one or more host target binding sites, each having a nucleotide sequence which is at least partly complementary to VGAM261 RNA, herein designated VGAM RNA, and which when bound by VGAM261 RNA causes inhibition of translation of respective one or more VGAM261 host target proteins.

It is further appreciated by one skilled in the art that the mode of translational inhibition illustrated by FIG. 1 with specific reference to translational inhibition exerted by VGAM261 gene, herein designated VGAM GENE, on one or more VGAM261 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM261 is inhibition of expression of host target genes, as part of a novel viral mechanism of attacking a host. Accordingly, utilities of VGAM261 include diagnosis, prevention and treatment of viral infection by Callitrichine Herpesvirus 3. Specific functions, and accordingly utilities, of VGAM261 correlate with, and may be deduced from, the identity of the host target genes which VGAM261 binds and inhibits, and the function of these host target genes, as elaborated hereinbelow.

Nucleotide sequences of the VGAM261 precursor RNA, herein designated VGAM PRECURSOR RNA, and of the 'diced' VGAM261 RNA, herein designated VGAM RNA, and a schematic representation of the secondary folding of VGAM261 folded precursor RNA, herein designated VGAM FOLDED PRECURSOR RNA, of VGAM261 are further described hereinbelow with reference to Table 1.

Nucleotide sequences of host target binding sites, such as BINDING SITE-I, BINDING SITE-II and BINDING SITE-III of FIG. 1, found on VGAM261 host target RNA, and schematic representation of the complementarity of each of these host target binding sites to VGAM261 RNA, herein designated VGAM RNA, are described hereinbelow with reference to Table 2.

As mentioned hereinabove with reference to FIG. 1, a function of VGAM261 gene, herein designated VGAM is inhibition of expression of VGAM261 target genes. It is appreciated that specific functions, and accordingly utilities, of VGAM261 correlate with, and may be deduced from, the identity of the target genes which VGAM261 binds and inhibits, and the function of these target genes, as elaborated hereinbelow.

Platelet-derived Growth Factor Receptor, Beta Polypeptide (PDGFRB, Accession XM_038350) is a VGAM261 host target gene. PDGFRB BINDING SITE is HOST TARGET binding site found in the 3' untranslated region of mRNA encoded by PDGFRB, corresponding to a HOST TARGET binding site such as BINDING SITE I, BINDING SITE II or BINDING SITE III. Table 2 illustrates the complementarity of the nucleotide sequences of PDGFRB BINDING SITE, designated SEQ ID:32813, to the nucleotide sequence of VGAM261 RNA, herein designated VGAM RNA, also designated SEQ ID:2972.

A function of VGAM261 is therefore inhibition of Platelet-derived Growth Factor Receptor, Beta Polypeptide (PDGFRB, Accession XM_038350), a gene which Platelet-derived growth factor receptor beta chain; tyrosine kinase receptor. Accordingly, utilities of VGAM261 include diagnosis, prevention and treatment of diseases and clinical conditions associated with PDGFRB. The function of PDGFRB and its association with various diseases and clinical conditions, has been established by previous studies, as described hereinabove with reference to VGAM125. Promyelocytic Leukemia (PML, Accession NM_033238) is another VGAM261 host target gene. PML BINDING SITE is HOST TARGET binding site found in the 3' untranslated region of mRNA encoded by PML, corresponding to a HOST TARGET binding site such as BINDING SITE I, BINDING SITE II or BINDING SITE III. Table 2 illustrates the complementarity of the nucleotide sequences of PML BINDING SITE, designated SEQ ID:27076, to the nucleotide sequence of VGAM261 RNA, herein designated VGAM RNA, also designated SEQ ID:2972.

Another function of VGAM261 is therefore inhibition of Promyelocytic Leukemia (PML, Accession NM_033238). Accordingly, utilities of VGAM261 include diagnosis, prevention and treatment of diseases and clinical conditions associated with PML. Pleckstrin and Sec7 Domain Protein (PSD, Accession NM_002779) is another VGAM261 host target gene. PSD BINDING SITE is HOST TARGET binding site found in the 5' untranslated region of mRNA encoded by PSD, corresponding to a HOST TARGET binding site such as BINDING SITE I, BINDING SITE II or BINDING SITE III. Table 2 illustrates the complementarity of the nucleotide sequences of PSD BINDING SITE, designated SEQ ID:8668, to the nucleotide sequence of VGAM261 RNA, herein designated VGAM RNA, also designated SEQ ID:2972.

Another function of VGAM261 is therefore inhibition of Pleckstrin and Sec7 Domain Protein (PSD, Accession NM_002779), a gene which promotes guanine-nucleotide exchange on arf6. Accordingly, utilities of VGAM261 include diagnosis, prevention and treatment of diseases and clinical conditions associated with PSD. The function of PSD has been established by previous studies. Perletti et al. (1997) identified a novel human gene on 10q24, contiguous to the 3-prime end of the NFKB2 gene (OMIM Ref. No. 164012) in a tail-to-tail arrangement. They described a cDNA of 4,307 bp, isolated from an adult human brain cDNA library, which contains an open reading frame encoding a putative protein of 645 amino acids with a predicted molecular weight of 71 kD. Database homology searches indicated that the novel gene codes for a putative protein containing 2 discrete domains with significant homology to the Sec7 and pleckstrin-homology (PH) domains, respectively. They used the gene symbol PSD for 'pleckstrin-Sec7 domains.' Northern blot analysis of a panel of RNAs from normal human tissues using the PSD cDNA as probe revealed the presence of 3 different tissue-specific transcripts of approximately 4.3, 2.3, and 1.8 kb, the longest of which was expressed only in brain. The data suggested that the PSD gene may encode a protein related to the protein family containing both the Sec7 in the PH domains and thought to be involved in signaling transduction processes. Other human proteins in the same family include cytohesin-1 (Kolanus et al., 1996) and ARNO (OMIM Ref. No. 602488) (Chardin et al., 1996).

Full details of the abovementioned studies are described in the following publications, the disclosure of which are hereby incorporated by reference:

Kolanus, W.; Nagel, W.; Schiller, B.; Zeitlmann, L.; Godar, S.; Stockinger, H.; Seed, B.: Alpha-L-beta-2 integrin/LFA-1 binding to ICAM-1 induced by cytohesin-1, a cytoplasmic regulatory molecule. Cell 86:233-242, 1996; and Perletti, L.; Talarico, D.; Trecca, D.; Ronchetti, D.; Fracchiolla, N. S.; Maiolo, A. T.; Neri, A.: Identification of a novel gene, PSD, adjacent to NFKB2/lyt-10, which contains Sec7 an.

Further studies establishing the function and utilities of PSD are found in John Hopkins OMIM database record ID 602327, and in sited publications numbered 600 and 10704 listed in the bibliography section hereinbelow, which are also hereby incorporated by reference. Serine (or cysteine) Proteinase Inhibitor, Clade B (ovalbumin), Member 9 (SERPINB9, Accession NM_004155) is another VGAM261 host target gene. SERPINB9 BINDING SITE is HOST TARGET binding site found in the 3' untranslated region of mRNA encoded by SERPINB9, corresponding to a HOST TARGET binding site such as BINDING SITE I, BINDING SITE II or BINDING SITE III. Table 2 illustrates the complementarity of the nucleotide sequences of SERPINB9 BINDING SITE, designated SEQ ID:10364, to the nucleotide sequence of VGAM261 RNA, herein designated VGAM RNA, also designated SEQ ID:2972.

Another function of VGAM261 is therefore inhibition of Serine (or cysteine) Proteinase Inhibitor, Clade B (ovalbumin), Member 9 (SERPINB9, Accession NM_004155), a gene which may be a serpin serine protease inhibitor that interacts with granzyme B (GZMB). Accordingly, utilities of VGAM261 include diagnosis, prevention and treatment of diseases and clinical conditions associated with SERPINB9. The function of SERPINB9 and its association with various diseases and clinical conditions, has been established by previous studies, as described hereinabove with reference to VGAM60. Src-like-adaptor 2 (SLA2, Accession NM_032214) is another VGAM261 host target gene. SLA2 BINDING SITE is HOST TARGET binding site found in the 3' untranslated region of mRNA encoded by SLA2, corresponding to a HOST TARGET binding site such as BINDING SITE I, BINDING SITE II or BINDING SITE III. Table 2 illustrates the complementarity of the nucleotide sequences of SLA2 BINDING SITE, designated SEQ ID:25941, to the nucleotide sequence of VGAM261 RNA, herein designated VGAM RNA, also designated SEQ ID:2972.

Another function of VGAM261 is therefore inhibition of Src-like-adaptor 2 (SLA2, Accession NM_032214). Accordingly, utilities of VGAM261 include diagnosis, prevention and treatment of diseases and clinical conditions associated with SLA2. Apolipoprotein L, 3 (APOL3, Accession NM_014349) is another VGAM261 host target gene. APOL3 BINDING SITE is HOST TARGET binding site found in the 3' untranslated region of mRNA encoded by APOL3, corresponding to a HOST TARGET binding site such as BINDING SITE I, BINDING SITE II or BINDING SITE III. Table 2 illustrates the complementarity of the nucleotide sequences of APOL3 BINDING SITE, designated SEQ ID:15674, to the nucleotide sequence of VGAM261 RNA, herein designated VGAM RNA, also designated SEQ ID:2972.

Another function of VGAM261 is therefore inhibition of Apolipoprotein L, 3 (APOL3, Accession NM_014349). Accordingly, utilities of VGAM261 include diagnosis, prevention and treatment of diseases and clinical conditions associated with APOL3. ERAP140 (Accession XM_059748) is another VGAM261 host target gene. ERAP140 BINDING SITE is HOST TARGET binding site found in the 3' untranslated region of mRNA encoded by ERAP140, corresponding to a HOST TARGET binding site such as BINDING SITE I, BINDING SITE II or BINDING SITE III. Table 2 illustrates the complementarity of the nucleotide sequences of ERAP140 BINDING SITE, designated SEQ ID:37084, to the nucleotide sequence of VGAM261 RNA, herein designated VGAM RNA, also designated SEQ ID:2972.

Another function of VGAM261 is therefore inhibition of ERAP140 (Accession XM_059748). Accordingly, utilities of VGAM261 include diagnosis, prevention and treatment of diseases and clinical conditions associated with ERAP140. IKKE (Accession NM_014002) is another VGAM261 host target gene. IKKE BINDING SITE is HOST TARGET binding site found in the 3" untranslated region of mRNA encoded by IKKE, corresponding to a HOST TARGET binding site such as BINDING SITE I, BINDING SITE II or BINDING SITE III. Table 2 illustrates the complementarity of the nucleotide sequences of IKKE BINDING SITE, designated SEQ ID:15201, to the nucleotide sequence of VGAM261 RNA, herein designated VGAM RNA, also designated SEQ ID:2972.

Another function of VGAM261 is therefore inhibition of IKKE (Accession NM_014002). Accordingly, utilities of VGAM261 include diagnosis, prevention and treatment of diseases and clinical conditions associated with IKKE. LOC127534 (Accession XM_060532) is another VGAM261 host target gene. LOC127534 BINDING SITE is HOST TARGET binding site found in the 3' untranslated region of mRNA encoded by LOC127534, corresponding to a HOST TARGET binding site such as BINDING SITE I, BINDING SITE II or BINDING SITE III. Table 2 illustrates the complementarity of the nucleotide sequences of LOC127534 BINDING SITE, designated SEQ ID:37168, to the nucleotide sequence of VGAM261 RNA, herein designated VGAM RNA, also designated SEQ ID:2972.

Another function of VGAM261 is therefore inhibition of LOC127534 (Accession XM_060532). Accordingly, utilities of VGAM261 include diagnosis, prevention and treatment of diseases and clinical conditions associated with LOC127534. LOC145082 (Accession XM_096719) is another VGAM261 host target gene. LOC145082 BINDING SITE is HOST TARGET binding site found in the 5' untranslated region of mRNA encoded by LOC145082, corresponding to a HOST TARGET binding site such as BINDING SITE I, BINDING SITE II or BINDING SITE III. Table 2 illustrates the complementarity of the nucleotide sequences of LOC145082 BINDING SITE, designated SEQ ID:40492, to the nucleotide sequence of VGAM261 RNA, herein designated VGAM RNA, also designated SEQ ID:2972.

Another function of VGAM261 is therefore inhibition of LOC145082 (Accession XM_096719). Accordingly, utilities of VGAM261 include diagnosis, prevention and treatment of diseases and clinical conditions associated with LOC145082. LOC170082 (Accession XM_093092) is another VGAM261 host target gene. LOC170082 BINDING SITE is HOST TARGET binding site found in the 3' untranslated region of mRNA encoded by LOC170082, corresponding to a HOST TARGET binding site such as BINDING SITE I, BINDING SITE II or BINDING SITE III. Table 2 illustrates the complementarity of the nucleotide sequences of LOC170082 BINDING SITE, designated SEQ ID:40169, to the nucleotide sequence of VGAM261 RNA, herein designated VGAM RNA, also designated SEQ ID:2972.

Another function of VGAM261 is therefore inhibition of LOC170082 (Accession XM_093092). Accordingly, utilities of VGAM261 include diagnosis, prevention and treatment of diseases and clinical conditions associated with LOC170082. LOC220370 (Accession XM_166943) is another VGAM261 host target gene. LOC220370 BINDING SITE is HOST TARGET binding site found in the 3' untranslated region of mRNA encoded by LOC220370, corresponding to a HOST TARGET binding site such as BINDING SITE I, BINDING SITE II or BINDING SITE III. Table 2 illustrates the complementarity of the nucleotide sequences of LOC220370 BINDING SITE, designated SEQ ID:44598, to the nucleotide sequence of VGAM261 RNA, herein designated VGAM RNA, also designated SEQ ID:2972.

Another function of VGAM261 is therefore inhibition of LOC220370 (Accession XM_166943). Accordingly, utilities of VGAM261 include diagnosis, prevention and treatment of diseases and clinical conditions associated with LOC220370. LOC221540 (Accession XM_168133) is another VGAM261 host target gene. LOC221540 BINDING SITE is HOST TARGET binding site found in the 3' untranslated region of mRNA encoded by LOC221540, corresponding to a HOST TARGET binding site such as BINDING SITE I, BINDING SITE II or BINDING SITE III. Table 2 illustrates the complementarity of the nucleotide sequences of LOC221540 BINDING SITE, designated SEQ ID:45043, to the nucleotide sequence of VGAM261 RNA, herein designated VGAM RNA, also designated SEQ ID:2972.

Another function of VGAM261 is therefore inhibition of LOC221540 (Accession XM_168133). Accordingly, utilities of VGAM261 include diagnosis, prevention and treatment of diseases and clinical conditions associated with LOC221540. LOC257545 (Accession XM_175217) is another VGAM261 host target gene. LOC257545 BINDING SITE is HOST TARGET binding site found in the 3' untranslated region of mRNA encoded by LOC257545, corresponding to a HOST TARGET binding site such as BINDING SITE I, BINDING SITE II or BINDING SITE III. Table 2 illustrates the complementarity of the nucleotide sequences of LOC257545 BINDING SITE, designated SEQ ID:46691, to the nucleotide sequence of VGAM261 RNA, herein designated VGAM RNA, also designated SEQ ID:2972.

Another function of VGAM261 is therefore inhibition of LOC257545 (Accession XM_175217). Accordingly, utilities of VGAM261 include diagnosis, prevention and treatment of diseases and clinical conditions associated with LOC257545. LOC257598 (Accession XM_175295) is another VGAM261 host target gene. LOC257598 BINDING SITE is HOST TARGET binding site found in the 3' untranslated region of mRNA encoded by LOC257598, corresponding to a HOST TARGET binding site such as BINDING SITE I, BINDING SITE II or BINDING SITE III. Table 2 illustrates the complementarity of the nucleotide sequences of LOC257598 BINDING SITE, designated SEQ ID:46748, to the nucleotide sequence of VGAM261 RNA, herein designated VGAM RNA, also designated SEQ ID:2972.

Another function of VGAM261 is therefore inhibition of LOC257598 (Accession XM_175295). Accordingly, utilities of VGAM261 include diagnosis, prevention and treatment of diseases and clinical conditions associated with LOC257598. FIG. 1 further provides a conceptual description of a novel bioinformatically detected viral gene of the present invention, referred to here as Viral Genomic Address Messenger 262 (VGAM262) viral gene, which modulates expression of respective host target genes thereof, the function and utility of which host target genes is known in the art.

VGAM262 is a novel bioinformatically detected regulatory, non protein coding, viral micro RNA (miRNA) gene. The method by which VGAM262 was detected is described hereinabove with reference to FIGS. 1-8.

VGAM262 gene, herein designated VGAM GENE, is a viral gene contained in the genome of Callitrichine Herpesvirus 3. VGAM262 host target gene, herein designated VGAM HOST TARGET GENE, is a human gene contained in the human genome.

VGAM262 gene encodes a VGAM262 precursor RNA, herein designated VGAM PRECURSOR RNA. Similar to other miRNA genes, and unlike most ordinary genes, VGAM262 precursor RNA does not encode a protein. A nucleotide sequence identical or highly similar to the nucleotide sequence of VGAM262 precursor RNA is designated SEQ ID:248, and is provided hereinbelow with reference to the sequence listing part. Nucleotide sequence SEQ ID:248 is located at position 13862 relative to the genome of Callitrichine Herpesvirus 3.

VGAM262 precursor RNA folds onto itself, forming VGAM262 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM262 folded precursor RNA into VGAM262 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM262 RNA is designated SEQ ID:2973, and is provided hereinbelow with reference to the sequence listing part.

VGAM262 host target gene, herein designated VGAM HOST TARGET GENE, encodes a corresponding messenger RNA, VGAM262 host target RNA, herein designated VGAM HOST TARGET RNA. VGAM262 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM262 RNA, herein designated VGAM RNA, binds complementarily to one or more host target binding sites located in untranslated regions of VGAM262 host target RNA, herein designated VGAM HOST TARGET RNA. This complementary binding is due to the fact that the nucleotide sequence of VGAM262 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM262 RNA, herein designated VGAM RNA, may have a different number of host target binding sites in untranslated regions of a VGAM262 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM262 RNA, herein designated VGAM RNA, to host target binding sites on VGAM262 host target RNA, herein designated VGAM HOST TARGET RNA, such as BINDING SITE I, BINDING SITE II and BINDING SITE III, inhibits translation of VGAM262 host target RNA into VGAM262 host target protein, herein designated VGAM HOST TARGET PROTEIN. VGAM host target protein is therefore outlined by a broken line.

It is appreciated that VGAM262 host target gene, herein designated VGAM HOST TARGET GENE, in fact represents a plurality of VGAM262 host target genes. The mRNA of each one of this plurality of VGAM262 host target genes comprises one or more host target binding sites, each having a nucleotide sequence which is at least partly complementary to VGAM262 RNA, herein designated VGAM RNA, and which when bound by VGAM262 RNA causes inhibition of translation of respective one or more VGAM262 host target proteins.

It is further appreciated by one skilled in the art that the mode of translational inhibition illustrated by FIG. 1 with specific reference to translational inhibition exerted by VGAM262 gene, herein designated VGAM GENE, on one or more VGAM262 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM262 is inhibition of expression of host target genes, as part of a novel viral mechanism of attacking a host. Accordingly, utilities of VGAM262 include diagnosis, prevention and treatment of viral infection by Callitrichine Herpesvirus 3. Specific functions, and accordingly utilities, of VGAM262 correlate with, and may be deduced from, the identity of the host target genes which VGAM262 binds and inhibits, and the function of these host target genes, as elaborated hereinbelow.

Nucleotide sequences of the VGAM262 precursor RNA, herein designated VGAM PRECURSOR RNA, and of the 'diced' VGAM262 RNA, herein designated VGAM RNA, and a schematic representation of the secondary folding of VGAM262 folded precursor RNA, herein designated VGAM FOLDED PRECURSOR RNA, of VGAM262 are further described hereinbelow with reference to Table 1.

Nucleotide sequences of host target binding sites, such as BINDING SITE-I, BINDING SITE-II and BINDING SITE-III of FIG. 1, found on VGAM262 host target RNA, and schematic representation of the complementarity of each of these host target binding sites to VGAM262 RNA, herein designated VGAM RNA, are described hereinbelow with reference to Table 2.

As mentioned hereinabove with reference to FIG. 1, a function of VGAM262 gene, herein designated VGAM is inhibition of expression of VGAM262 target genes. It is appreciated that specific functions, and accordingly utilities, of VGAM262 correlate with, and may be deduced from, the identity of the target genes which VGAM262 binds and inhibits, and the function of these target genes, as elaborated hereinbelow.

FLJ21432 (Accession NM_024551) is a VGAM262 host target gene. FLJ21432 BINDING SITE is HOST TARGET binding site found in the 3' untranslated region of mRNA encoded by FLJ21432, corresponding to a HOST TARGET binding site such as BINDING SITE I, BINDING SITE II or BINDING SITE III. Table 2 illustrates the complementarity of the nucleotide sequences of FLJ21432 BINDING SITE, designated SEQ ID:23765, to the nucleotide sequence of VGAM262 RNA, herein designated VGAM RNA, also designated SEQ ID:2973.

A function of VGAM262 is therefore inhibition of FLJ21432 (Accession NM_024551). Accordingly, utilities of VGAM262 include diagnosis, prevention and treatment of diseases and clinical conditions associated with FLJ21432. LOC204010 (Accession XM_115138) is another VGAM262 host target gene. LOC204010 BINDING SITE is HOST TARGET binding site found in the 5' untranslated region of mRNA encoded by LOC204010, corresponding to a HOST TARGET binding site such as BINDING SITE I, BINDING SITE II or BINDING SITE III. Table 2 illustrates the complementarity of the nucleotide sequences of LOC204010 BINDING SITE, designated SEQ ID:43081, to the nucleotide sequence of VGAM262 RNA, herein designated VGAM RNA, also designated SEQ ID:2973.

Another function of VGAM262 is therefore inhibition of LOC204010 (Accession XM_115138). Accordingly, utilities of VGAM262 include diagnosis, prevention and treatment of diseases and clinical conditions associated with LOC204010. FIG. 1 further provides a conceptual description of a novel bioinformatically detected viral gene of the present invention, referred to here as Viral Genomic Address Messenger 263 (VGAM263) viral gene, which modulates expression of respective host target genes thereof, the function and utility of which host target genes is known in the art.

VGAM263 is a novel bioinformatically detected regulatory, non protein coding, viral micro RNA (miRNA) gene. The method by which VGAM263 was detected is described hereinabove with reference to FIGS. 1-8.

VGAM263 gene, herein designated VGAM GENE, is a viral gene contained in the genome of Callitrichine Herpesvirus 3. VGAM263 host target gene, herein designated VGAM HOST TARGET GENE, is a human gene contained in the human genome.

VGAM263 gene encodes a VGAM263 precursor RNA, herein designated VGAM PRECURSOR RNA. Similar to other miRNA genes, and unlike most ordinary genes, VGAM263 precursor RNA does not encode a protein. A nucleotide sequence identical or highly similar to the nucleotide sequence of VGAM263 precursor RNA is designated SEQ ID:249, and is provided hereinbelow with reference to the sequence listing part. Nucleotide sequence SEQ ID:249 is located at position 131570 relative to the genome of Callitrichine Herpesvirus 3.

VGAM263 precursor RNA folds onto itself, forming VGAM263 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM263 folded precursor RNA into VGAM263 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM263 RNA is designated SEQ ID:2974, and is provided hereinbelow with reference to the sequence listing part.

VGAM263 host target gene, herein designated VGAM HOST TARGET GENE, encodes a corresponding messenger RNA, VGAM263 host target RNA, herein designated VGAM HOST TARGET RNA. VGAM263 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM263 RNA, herein designated VGAM RNA, binds complementarily to one or more host target binding sites located in untranslated regions of VGAM263 host target RNA, herein designated VGAM HOST TARGET RNA. This complementary binding is due to the fact that the nucleotide sequence of VGAM263 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM263 RNA, herein designated VGAM RNA, may have a different number of host target binding sites in untranslated regions of a VGAM263 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM263 RNA, herein designated VGAM RNA, to host target binding sites on VGAM263 host target RNA, herein designated VGAM HOST TARGET RNA, such as BINDING SITE I, BINDING SITE II and BINDING SITE III, inhibits translation of VGAM263 host target RNA into VGAM263 host target protein, herein designated VGAM HOST TARGET PROTEIN. VGAM host target protein is therefore outlined by a broken line.

It is appreciated that VGAM263 host target gene, herein designated VGAM HOST TARGET GENE, in fact represents a plurality of VGAM263 host target genes. The mRNA of each one of this plurality of VGAM263 host target genes comprises one or more host target binding sites, each having a nucleotide sequence which is at least partly complementary to VGAM263 RNA, herein designated VGAM RNA, and which when bound by VGAM263 RNA causes inhibition of translation of respective one or more VGAM263 host target proteins.

It is further appreciated by one skilled in the art that the mode of translational inhibition illustrated by FIG. 1 with specific reference to translational inhibition exerted by VGAM263 gene, herein designated VGAM GENE, on one or more VGAM263 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM263 is inhibition of expression of host target genes, as part of a novel viral mechanism of attacking a host. Accordingly, utilities of VGAM263 include diagnosis, prevention and treatment of viral infection by Callitrichine Herpesvirus 3. Specific functions, and accordingly utilities, of VGAM263 correlate with, and may be deduced from, the identity of the host target genes which VGAM263 binds and inhibits, and the function of these host target genes, as elaborated hereinbelow.

Nucleotide sequences of the VGAM263 precursor RNA, herein designated VGAM PRECURSOR RNA, and of the 'diced' VGAM263 RNA, herein designated VGAM RNA, and a schematic representation of the secondary folding of VGAM263 folded precursor RNA, herein designated VGAM FOLDED PRECURSOR RNA, of VGAM263 are further described hereinbelow with reference to Table 1.

Nucleotide sequences of host target binding sites, such as BINDING SITE-I, BINDING SITE-II and BINDING SITE-III of FIG. 1, found on VGAM263 host target RNA, and schematic representation of the complementarity of each of these host target binding sites to VGAM263 RNA, herein designated VGAM RNA, are described hereinbelow with reference to Table 2.

As mentioned hereinabove with reference to FIG. 1, a function of VGAM263 gene, herein designated VGAM is inhibition of expression of VGAM263 target genes. It is appreciated that specific functions, and accordingly utilities, of VGAM263 correlate with, and may be deduced from, the identity of the target genes which VGAM263 binds and inhibits, and the function of these target genes, as elaborated hereinbelow.

Histone Deacetylase 5 (HDAC5, Accession NM_139205) is a VGAM263 host target gene. HDAC5 BINDING SITE is HOST TARGET binding site found in the 3' untranslated region of mRNA encoded by HDAC5, corresponding to a HOST TARGET binding site such as BINDING SITE I, BINDING SITE II or BINDING SITE III. Table 2 illustrates the complementarity of the nucleotide sequences of HDAC5 BINDING SITE, designated SEQ ID:29221, to the nucleotide sequence of VGAM263 RNA, herein designated VGAM RNA, also designated SEQ ID:2974.

A function of VGAM263 is therefore inhibition of Histone Deacetylase 5 (HDAC5, Accession NM_139205), a gene which is responsible for the deacetylation of lysine residues on the n-terminal part of the core histones and mediate transcriptional regulation. Accordingly, utilities of VGAM263 include diagnosis, prevention and treatment of diseases and clinical conditions associated with HDAC5. The function of HDAC5 has been established by previous studies. Members of the myocyte enhancer factor-2 (MEF2A; 600660) family of transcription factors associate with myogenic basic helix-loop-helix transcription factors such as MYOD1 (OMIM Ref. No. 159970) to activate skeletal myogenesis. MEF2 proteins also interact with the class II histone deacetylases HDAC4 and HDAC5, resulting in repression of MEF2-dependent genes. Execution of the muscle differentiation program requires release of MEF2 from repression by HDACs, which are expressed constitutively in myoblasts and myotubes. McKinsey et al. (2000) demonstrated that HDAC5 shuttles from the nucleus to the cytoplasm when myoblasts are triggered to differentiate. Calcium/calmodulin-dependent protein kinase (CAMK1; 604998) signaling, which stimulates myogenesis and prevents formation of MEF2-HDAC complexes, also induces nuclear export of HDAC4 and HDAC5 by phosphorylation of these transcriptional repressors. An HDAC5 mutant lacking 2 CAMK phosphorylation sites is resistant to CAMK-mediated nuclear export and acts as a dominant inhibitor of skeletal myogenesis, whereas a cytoplasmic HDAC5 mutant is unable to block efficiently the muscle differentiation program. McKinsey et al. (2000) concluded that their results highlight a mechanism for transcriptional regulation through signal and differentiation-dependent nuclear export of a chromatin-remodeling enzyme, and suggest that nucleocytoplasmic trafficking of HDACs is involved in the control of cellular differentiation. Nagase et al. (1998) isolated a partial cDNA encoding HDAC5, which they called KIAA0600, from a brain cDNA library. RT-PCR analysis detected HDAC5 expression in all tissues tested, with relatively low expression in spleen and pancreas. By serologic analysis of recombinant colon cancer cDNA expression libraries, Scanlan et al. (1998) identified a partial cDNA encoding HDAC5, which they called NYCO9. Northern blot and RT-PCR analysis indicated weak but universal expression of a 3.7-kb HDAC5 transcript. Serologic analysis demonstrated that 5 of 29 colon cancer patients had antibodies to HDAC5.

Full details of the abovementioned studies are described in the following publications, the disclosure of which are hereby incorporated by reference:

Nagase, T.; Ishikawa, K.; Miyajima, N.; Tanaka, A.; Kotani, H.; Nomura, N.; Ohara, O.: Prediction of the coding sequences of unidentified human genes. IX. The complete sequences of 100 new cDNA clones from brain which can code for large proteins in vitro. DNA Res. 5:31-39, 1998; and McKinsey, T. A.; Zhang, C.-L.; Lu, J.; Olson, E. N.: Signal-dependent nuclear export of a histone deacetylase regulates muscle differentiation. Nature 408:106-111, 2000.

Further studies establishing the function and utilities of HDAC5 are found in John Hopkins OMIM database record ID 605315, and in sited publications numbered 10820-448 and 6735 listed in the bibliography section hereinbelow, which are also hereby incorporated by reference. Interleukin 1 Family, Member 5 (delta) (IL1F5, Accession NM_012275) is another VGAM263 host target gene. IL1F5 BINDING SITE is HOST TARGET binding site found in the 3' untranslated region of mRNA encoded by IL1F5, corresponding to a HOST TARGET binding site such as BINDING SITE I, BINDING SITE II or BINDING SITE III. Table 2 illustrates the complementarity of the nucleotide sequences of IL1F5 BINDING SITE, designated SEQ ID:14595, to the nucleotide sequence of VGAM263 RNA, herein designated VGAM RNA, also designated SEQ ID:2974.

Another function of VGAM263 is therefore inhibition of Interleukin 1 Family, Member 5 (delta) (IL1F5, Accession NM_012275), a gene which is a novel interleukin-1 receptor antagonist gene. Accordingly, utilities of VGAM263 include diagnosis, prevention and treatment of diseases and clinical conditions associated with IL1F5. The function of IL1F5 has been established by previous studies. The cytokine interleukin-1 (IL1; OMIM Ref. No. 147760) elicits a wide array of biologic activities that initiate and promote the host response to injury or infection by activating a set of transcription factors, including NFKB (see OMIM Ref. No. 164011) and AP1 (see OMIM Ref. No. 165160), which in turn induce production of effectors of the inflammatory response. Using a high-throughput cDNA screening technology and BLAST searching, followed by additional library screenings, RT-PCR, and 5-prime RACE analysis, Mulero et al. (1999) isolated a cDNA encoding a novel member of the interleukin-1 family, which they termed IL1HY1. The deduced 155-amino acid protein shares 52% sequence identity with IL1RA (OMIM Ref. No. 147679). It contains 3 of 4 highly conserved cysteine residues and an aspartate at position 148, which is cognate to asp145 in IL1B (OMIM Ref. No. 147720), and has been shown to impart agonist activity to IL1B. It does not contain a signal peptide or a prodomain. PCR analysis revealed expression in leukocytes, spleen, and brain as well as in fetal brain and most abundantly in a fetal skin library. RT-PCR analysis also established that IL1HY1 expression is amplified in a stimulated macrophage cell line. By EST database searching, Smith et al. (2000) also identified a cDNA encoding IL1HY1, which they termed FIL1-delta. Modeling indicated that IL1HY1 has a conserved 12-stranded beta-trefoil structure. Binding analysis detected no interaction with multiple IL1R family members.

Full details of the abovementioned studies are described in the following publications, the disclosure of which are hereby incorporated by reference:

Busfield, S. J.; Comrack, C. A.; Yu, G.; Chickering, T. W.; Smutko, J. S.; Zhou, H.; Leiby, K. R.; Holmgren, L. M.; Gearing, D. P.; Pan, Y.: Identification and gene organization of three novel members of the IL-1 family on human chromosome 2. Genomics 66:213-216, 2000; and Mulero, J. J.; Pace, A. M.; Nelken, S. T.; Loeb, D. B.; Correa, T. R.; Drmanac, R.; Ford, J. E.: IL1HY1: a novel interleukin-1 receptor antagonist gene. Biochem. Biophys. Res. Commun.

Further studies establishing the function and utilities of IL1F5 are found in John Hopkins OMIM database record ID 605507, and in sited publications numbered 4500-450 and 4493 listed in the bibliography section hereinbelow, which are also hereby incorporated by reference. Serine (or cysteine) Proteinase Inhibitor, Clade B (ovalbumin), Member 9 (SERPINB9, Accession NM_004155) is another VGAM263 host target gene. SERPINB9 BINDING SITE is HOST TARGET binding site found in the 3' untranslated region of mRNA encoded by SERPINB9, corresponding to a HOST TARGET binding site such as BINDING SITE I, BINDING SITE II or BINDING SITE III. Table 2 illustrates the complementarity of the nucleotide sequences of SERPINB9 BINDING SITE, designated SEQ ID:10360, to the nucleotide sequence of VGAM263 RNA, herein designated VGAM RNA, also designated SEQ ID:2974.

Another function of VGAM263 is therefore inhibition of Serine (or cysteine) Proteinase Inhibitor, Clade B (ovalbumin), Member 9 (SERPINB9, Accession NM_004155), a gene which may be a serpin serine protease inhibitor that interacts with granzyme B (GZMB). Accordingly, utilities of VGAM263 include diagnosis, prevention and treatment of diseases and clinical conditions associated with SERPINB9. The function of SERPINB9 and its association with various diseases and clinical conditions, has been established by previous studies, as described hereinabove with reference to VGAM60. RI58 (Accession NM_012420) is another VGAM263 host target gene. RI58 BINDING SITE is HOST TARGET binding site found in the 3' untranslated region of mRNA encoded by RI58, corresponding to a HOST TARGET binding site such as BINDING SITE I, BINDING SITE II or BINDING SITE III. Table 2 illustrates the complementarity of the nucleotide sequences of RI58 BINDING SITE, designated SEQ ID:14792, to the nucleotide sequence of VGAM263 RNA, herein designated VGAM RNA, also designated SEQ ID:2974.

Another function of VGAM263 is therefore inhibition of RI58 (Accession NM_012420). Accordingly, utilities of VGAM263 include diagnosis, prevention and treatment of diseases and clinical conditions associated with RI58. FIG. 1 further provides a conceptual description of a novel bioinformatically detected viral gene of the present invention, referred to here as Viral Genomic Address Messenger 264 (VGAM264) viral gene, which modulates expression of respective host target genes thereof, the function and utility of which host target genes is known in the art.

VGAM264 is a novel bioinformatically detected regulatory, non protein coding, viral micro RNA (miRNA) gene. The method by which VGAM264 was detected is described hereinabove with reference to FIGS. 1-8.

VGAM264 gene, herein designated VGAM GENE, is a viral gene contained in the genome of Callitrichine Herpesvirus 3. VGAM264 host target gene, herein designated VGAM HOST TARGET GENE, is a human gene contained in the human genome.

VGAM264 gene encodes a VGAM264 precursor RNA, herein designated VGAM PRECURSOR RNA. Similar to other miRNA genes, and unlike most ordinary genes, VGAM264 precursor RNA does not encode a protein. A nucleotide sequence identical or highly similar to the nucleotide sequence of VGAM264 precursor RNA is designated SEQ ID:250, and is provided hereinbelow with reference to the sequence listing part. Nucleotide sequence SEQ ID:250 is located at position 45887 relative to the genome of Callitrichine Herpesvirus 3.

VGAM264 precursor RNA folds onto itself, forming VGAM264 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM264 folded precursor RNA into VGAM264 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM264 RNA is designated SEQ ID:2975, and is provided hereinbelow with reference to the sequence listing part.

VGAM264 host target gene, herein designated VGAM HOST TARGET GENE, encodes a corresponding messenger RNA, VGAM264 host target RNA, herein designated VGAM HOST TARGET RNA. VGAM264 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM264 RNA, herein designated VGAM RNA, binds complementarily to one or more host target binding sites located in untranslated regions of VGAM264 host target RNA, herein designated VGAM HOST TARGET RNA. This complementary binding is due to the fact that the nucleotide sequence of VGAM264 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM264 RNA, herein designated VGAM RNA, may have a different number of host target binding sites in untranslated regions of a VGAM264 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM264 RNA, herein designated VGAM RNA, to host target binding sites on VGAM264 host target RNA, herein designated VGAM HOST TARGET RNA, such as BINDING SITE I, BINDING SITE II and BINDING SITE III, inhibits translation of VGAM264 host target RNA into VGAM264 host target protein, herein designated VGAM HOST TARGET PROTEIN. VGAM host target protein is therefore outlined by a broken line.

It is appreciated that VGAM264 host target gene, herein designated VGAM HOST TARGET GENE, in fact represents a plurality of VGAM264 host target genes. The mRNA of each one of this plurality of VGAM264 host target genes comprises one or more host target binding sites, each having a nucleotide sequence which is at least partly complementary to VGAM264 RNA, herein designated VGAM RNA, and which when bound by VGAM264 RNA causes inhibition of translation of respective one or more VGAM264 host target proteins.

It is further appreciated by one skilled in the art that the mode of translational inhibition illustrated by FIG. 1 with specific reference to translational inhibition exerted by VGAM264 gene, herein designated VGAM GENE, on one or more VGAM264 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM264 is inhibition of expression of host target genes, as part of a novel viral mechanism of attacking a host. Accordingly, utilities of VGAM264 include diagnosis, prevention and treatment of viral infection by Callitrichine Herpesvirus 3. Specific functions, and accordingly utilities, of VGAM264 correlate with, and may be deduced from, the identity of the host target genes which VGAM264 binds and inhibits, and the function of these host target genes, as elaborated hereinbelow.

Nucleotide sequences of the VGAM264 precursor RNA, herein designated VGAM PRECURSOR RNA, and of the 'diced' VGAM264 RNA, herein designated VGAM RNA, and a schematic representation of the secondary folding of VGAM264 folded precursor RNA, herein designated VGAM FOLDED PRECURSOR RNA, of VGAM264 are further described hereinbelow with reference to Table 1.

Nucleotide sequences of host target binding sites, such as BINDING SITE-I, BINDING SITE-II and BINDING SITE-III of FIG. 1, found on VGAM264 host target RNA, and schematic representation of the complementarity of each of these host target binding sites to VGAM264 RNA, herein designated VGAM RNA, are described hereinbelow with reference to Table 2.

As mentioned hereinabove with reference to FIG. 1, a function of VGAM264 gene, herein designated VGAM is inhibition of expression of VGAM264 target genes. It is appreciated that specific functions, and accordingly utilities, of VGAM264 correlate with, and may be deduced from, the identity of the target genes which VGAM264 binds and inhibits, and the function of these target genes, as elaborated hereinbelow.

A Disintegrin and Metalloproteinase Domain 17 (tumor necrosis factor, alpha, converting enzyme) (ADAM17, Accession NM_003183) is a VGAM264 host target gene. ADAM17 BINDING SITE1 and ADAM17 BINDING SITE2 are HOST TARGET binding sites found in untranslated regions of mRNA encoded by ADAM17, corresponding to HOST TARGET binding sites such as BINDING SITE I, BINDING SITE II or BINDING SITE III. Table 2 illustrates the complementarity of the nucleotide sequences of ADAM17 BINDING SITE1 and ADAM17 BINDING SITE2, designated SEQ ID:9156 and SEQ ID:22409 respectively, to the nucleotide sequence of VGAM264 RNA, herein designated VGAM RNA, also designated SEQ ID:2975.

A function of VGAM264 is therefore inhibition of A Disintegrin and Metalloproteinase Domain 17 (tumor necrosis factor, alpha, converting enzyme) (ADAM17, Accession NM_003183), a gene which member of ADAM family of zinc metalloproteases. Accordingly, utilities of VGAM264 include diagnosis, prevention and treatment of diseases and clinical conditions associated with ADAM17. The function of ADAM17 has been established by previous studies. Black et al. (1997) cloned a human cDNA encoding ADAM17, which they called TACE. The gene encodes an 824-amino acid polypeptide containing the features of the ADAM family: a secretory signal sequence, a disintegrin domain, and a metalloprotease domain. Expression studies showed that the encoded protein cleaves precursor tumor necrosis factor-alpha (TNFA; 191160) to its mature form. Northern blot analysis revealed that the gene was expressed as a 5-kb mRNA in all tissues examined. Black et al. (1997) generated mouse T cells with a homozygous deficiency in the TACE gene; these cells showed an 80 to 90% reduction in the release of TNFA. Yamazaki et al. (1998) used PCR of a backcross panel to map the mouse Tace gene to the proximal arm of chromosome 12. Hirohata et al. (1998) used radiation hybrids to map ADAM17 to human chromosome 2p25. Animal model experiments lend further support to the function of ADAM17. Peschon et al. (1998) found that mice lacking the zinc-binding domain of Tace died in utero after embryonic day 17.5 or failed to survive beyond 1 week of age.

It is appreciated that the abovementioned animal model for ADAM17 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Black, R. A.; Rauch, C. T.; Kozlosky, C. J.; Peschon, J. J.; Slack, J. L.; Wolfson, M. F.; Castner, B. J.; Stocking, K. L.; Reddy, P.; Srinivasan, S.; Nelson, N.; Boiani, N.; Schooley, K. A.; Gerhart, M.; Davis, R.; Fitzner, J. N.; Johnson, R. S.; Paxton, R. J.; March, C. J.; Cerretti, D. P.: A metalloproteinase disintegrin that releases tumour-necrosis factor-alpha from cells. Nature 385:729-733, 1997; and Peschon, J. J.; Slack, J. L.; Reddy, P.; Stocking, K. L.; Sunnarborg, S. W.; Lee, D. C.; Russell, W. E.; Castner, B. J.; Johnson, R. S.; Fitzner, J. N.; Boyce, R. W.; Nelson, N.; Kozlosk.

Further studies establishing the function and utilities of ADAM17 are found in John Hopkins OMIM database record ID 603639, and in sited publications numbered 7990, 7991-7992, 276 and 7993-7995 listed in the bibliography section hereinbelow, which are also hereby incorporated by reference. Protein Phosphatase 2, Regulatory Subunit B (B56), Beta Isoform (PPP2R5B, Accession NM_006244) is another VGAM264 host target gene. PPP2R5B BINDING SITE is HOST TARGET binding site found in the 3' untranslated region of mRNA encoded by PPP2R5B, corresponding to a HOST TARGET binding site such as BINDING SITE I, BINDING SITE II or BINDING SITE III. Table 2 illustrates the complementarity of the nucleotide sequences of PPP2R5B BINDING SITE, designated SEQ ID:12915, to the nucleotide sequence of VGAM264 RNA, herein designated VGAM RNA, also designated SEQ ID:2975.

Another function of VGAM264 is therefore inhibition of Protein Phosphatase 2, Regulatory Subunit B (B56), Beta Isoform (PPP2R5B, Accession NM_006244), a gene which is a regulatory subunit of protein phosphatase 2A. Accordingly, utilities of VGAM264 include diagnosis, prevention and treatment of diseases and clinical conditions associated with PPP2R5B. The function of PPP2R5B has been established by previous studies. Protein phosphorylation is a regulatory mechanism commonly employed in cellular processes such as cell cycle progression, growth factor signaling, and cell transformation. Protein phosphatase 2A (PP2A), a heterotrimeric serine/threonine phosphatase, has been implicated in a variety of regulatory processes including cell growth and division, muscle contraction, and gene transcription. PP2A is a trimeric enzyme composed of a catalytic subunit (OMIM Ref. No. 176915), a structural subunit, and any of several different regulatory subunits which control its specificity.

One family of related PP2A regulatory subunits is designated the B56 family and contains at least 5 different members (McCright and Virshup (1995)). The beta, delta (OMIM Ref. No. 601646), and epsilon (OMIM Ref. No. 601647) subunits are expressed at highest levels in the brain and the expression of the beta and delta subunits increases when neuroblastoma cells are induced to differentiate with retinoic acid. See also the alpha subunit (OMIM Ref. No. 601643). McCright et al. (1996) mapped the gene for the beta subunit, designated PPP2R5B, to 11q12 by fluorescence in situ hybridization. The European Consortium on MEN1 (1997) localized the PPP2R5B gene to 11q13 in the course of constructing a contig of the region containing the MEN1 gene (OMIM Ref. No. 131100).

Full details of the abovementioned studies are described in the following publications, the disclosure of which are hereby incorporated by reference:

McCright, B.; Brothman, A. R.; Virshup, D. M.: Assignment of human protein phosphatase 2A regulatory subunit genes B56-alpha, B56-beta, B56-gamma, B56-delta, and B56-epsilon (PPP2R5A--PPP2R5E), highly expressed in muscle and brain, to chromosome regions 1q41, 11q12, 3p21, 6p21.1, and 7p11.2-to-p12. Genomics 36:168-170, 1996; and McCright, B.; Virshup, D. M.: Identification of a new family of protein phosphatase 2A regulatory subunits. J. Biol. Chem. 270:26123-26128, 1995.

Further studies establishing the function and utilities of PPP2R5B are found in John Hopkins OMIM database record ID 601644, and in sited publications numbered 648 and 6687-6688 listed in the bibliography section hereinbelow, which are also hereby incorporated by reference. Arginine-glutamic Acid Dipeptide (RE) Repeats (RERE, Accession NM_012102) is another VGAM264 host target gene. RERE BINDING SITE is HOST TARGET binding site found in the 3' untranslated region of mRNA encoded by RERE, corresponding to a HOST TARGET binding site such as BINDING SITE I, BINDING SITE II or BINDING SITE III. Table 2 illustrates the complementarity of the nucleotide sequences of RERE BINDING SITE, designated SEQ ID:14410, to the nucleotide sequence of VGAM264 RNA, herein designated VGAM RNA, also designated SEQ ID:2975.

Another function of VGAM264 is therefore inhibition of Arginine-glutamic Acid Dipeptide (RE) Repeats (RERE, Accession NM_012102), a gene which binds DRPLA and locates in the nucleus. Accordingly, utilities of VGAM264 include diagnosis, prevention and treatment of diseases and clinical conditions associated with RERE. The function of RERE and its association with various diseases and clinical conditions, has been established by previous studies, as described hereinabove with reference to VGAM51. Sodium Channel, Voltage-gated, Type IV, Alpha Polypeptide (SCN4A, Accession NM_000334) is another VGAM264 host target gene. SCN4A BINDING SITE is HOST TARGET binding site found in the 3' untranslated region of mRNA encoded by SCN4A, corresponding to a HOST TARGET binding site such as BINDING SITE I, BINDING SITE II or BINDING SITE III. Table 2 illustrates the complementarity of the nucleotide sequences of SCN4A BINDING SITE, designated SEQ ID:5890, to the nucleotide sequence of VGAM264 RNA, herein designated VGAM RNA, also designated SEQ ID:2975.

Another function of VGAM264 is therefore inhibition of Sodium Channel, Voltage-gated, Type IV, Alpha Polypeptide (SCN4A, Accession NM_000334). Accordingly, utilities of VGAM264 include diagnosis, prevention and treatment of diseases and clinical conditions associated with SCN4A. Thrombospondin 1 (THBS1, Accession NM_003246) is another VGAM264 host target gene. THBS1 BINDING SITE is HOST TARGET binding site found in the 3' untranslated region of mRNA encoded by THBS1, corresponding to a HOST TARGET binding site such as BINDING SITE I, BINDING SITE II or BINDING SITE III. Table 2 illustrates the complementarity of the nucleotide sequences of THBS1 BINDING SITE, designated SEQ ID:9256, to the nucleotide sequence of VGAM264 RNA, herein designated VGAM RNA, also designated SEQ ID:2975.

Another function of VGAM264 is therefore inhibition of Thrombospondin 1 (THBS1, Accession NM_003246), a gene which is a member of a family of adhesive molecules, involves in blood clotting and in angiogenesis. Accordingly, utilities of VGAM264 include diagnosis, prevention and treatment of diseases and clinical conditions associated with THBS1. The function of THBS1 and its association with various diseases and clinical conditions, has been established by previous studies, as described hereinabove with reference to VGAM20. Chromosome 17 Open Reading Frame 31 (C17orf31, Accession NM_017575) is another VGAM264 host target gene. C17orf31 BINDING SITE is HOST TARGET binding site found in the 3' untranslated region of mRNA encoded by C17orf31, corresponding to a HOST TARGET binding site such as BINDING SITE I, BINDING SITE II or BINDING SITE III. Table 2 illustrates the complementarity of the nucleotide sequences of C17orf31 BINDING SITE, designated SEQ ID:18998, to the nucleotide sequence of VGAM264 RNA, herein designated VGAM RNA, also designated SEQ ID:2975.

Another function of VGAM264 is therefore inhibition of Chromosome 17 Open Reading Frame 31 (C17orf31, Accession NM_017575). Accordingly, utilities of VGAM264 include diagnosis, prevention and treatment of diseases and clinical conditions associated with C17orf31. CGI-96 (Accession NM_015703) is another VGAM264 host target gene. CGI-96 BINDING SITE is HOST TARGET binding site found in the 3' untranslated region of mRNA encoded by CGI-96, corresponding to a HOST TARGET binding site such as BINDING SITE I, BINDING SITE II or BINDING SITE III. Table 2 illustrates the complementarity of the nucleotide sequences of CGI-96 BINDING SITE, designated SEQ ID:17926, to the nucleotide sequence of VGAM264 RNA, herein designated VGAM RNA, also designated SEQ ID:2975.

Another function of VGAM264 is therefore inhibition of CGI-96 (Accession NM_015703). Accordingly, utilities of VGAM264 include diagnosis, prevention and treatment of diseases and clinical conditions associated with CGI-96. DRIL2 (Accession NM_006465) is another VGAM264 host target gene. DRIL2 BINDING SITE is HOST TARGET binding site found in the 3' untranslated region of mRNA encoded by DRIL2, corresponding to a HOST TARGET binding site such as BINDING SITE I, BINDING SITE II or BINDING SITE III. Table 2 illustrates the complementarity of the nucleotide sequences of DRIL2 BINDING SITE, designated SEQ ID:13184, to the nucleotide sequence of VGAM264 RNA, herein designated VGAM RNA, also designated SEQ ID:2975.

Another function of VGAM264 is therefore inhibition of DRIL2 (Accession NM_006465). Accordingly, utilities of VGAM264 include diagnosis, prevention and treatment of diseases and clinical conditions associated with DRIL2. FLJ14957 (Accession NM_032866) is another VGAM264 host target gene. FLJ14957 BINDING SITE is HOST TARGET binding site found in the 3' untranslated region of mRNA encoded by FLJ14957, corresponding to a HOST TARGET binding site such as BINDING SITE I, BINDING SITE II or BINDING SITE III. Table 2 illustrates the complementarity of the nucleotide sequences of FLJ14957 BINDING SITE, designated SEQ ID:26680, to the nucleotide sequence of VGAM264 RNA, herein designated VGAM RNA, also designated SEQ ID:2975.

Another function of VGAM264 is therefore inhibition of FLJ14957 (Accession NM_032866). Accordingly, utilities of VGAM264 include diagnosis, prevention and treatment of diseases and clinical conditions associated with FLJ14957. KIAA1056 (Accession NM_014894) is another VGAM264 host target gene. KIAA1056 BINDING SITE is HOST TARGET binding site found in the 5' untranslated region of mRNA encoded by KIAA1056, corresponding to a HOST TARGET binding site such as BINDING SITE I, BINDING SITE II or BINDING SITE III. Table 2 illustrates the complementarity of the nucleotide sequences of KIAA1056 BINDING SITE, designated SEQ ID:17050, to the nucleotide sequence of VGAM264 RNA, herein designated VGAM RNA, also designated SEQ ID:2975.

Another function of VGAM264 is therefore inhibition of KIAA1056 (Accession NM_014894). Accordingly, utilities of VGAM264 include diagnosis, prevention and treatment of diseases and clinical conditions associated with KIAA1056. KIAA1323 (Accession XM_032146) is another VGAM264 host target gene. KIAA1323 BINDING SITE is HOST TARGET binding site found in the 5' untranslated region of mRNA encoded by KIAA1323, corresponding to a HOST TARGET binding site such as BINDING SITE I, BINDING SITE II or BINDING SITE III. Table 2 illustrates the complementarity of the nucleotide sequences of KIAA1323 BINDING SITE, designated SEQ ID:31567, to the nucleotide sequence of VGAM264 RNA, herein designated VGAM RNA, also designated SEQ ID:2975.

Another function of VGAM264 is therefore inhibition of KIAA1323 (Accession XM_032146). Accordingly, utilities of VGAM264 include diagnosis, prevention and treatment of diseases and clinical conditions associated with KIAA1323. LANO (Accession NM_018214) is another VGAM264 host target gene. LANO BINDING SITE is HOST TARGET binding site found in the 3" untranslated region of mRNA encoded by LANO, corresponding to a HOST TARGET binding site such as BINDING SITE I, BINDING SITE II or BINDING SITE III. Table 2 illustrates the complementarity of the nucleotide sequences of LANO BINDING SITE, designated SEQ ID:20130, to the nucleotide sequence of VGAM264 RNA, herein designated VGAM RNA, also designated SEQ ID:2975.

Another function of VGAM264 is therefore inhibition of LANO (Accession NM_018214). Accordingly, utilities of VGAM264 include diagnosis, prevention and treatment of diseases and clinical conditions associated with LANO. MGC3101 (Accession NM_024043) is another VGAM264 host target gene. MGC3101 BINDING SITE is HOST TARGET binding site found in the 3" untranslated region of mRNA encoded by MGC3101, corresponding to a HOST TARGET binding site such as BINDING SITE I, BINDING SITE II or BINDING SITE III. Table 2 illustrates the complementarity of the nucleotide sequences of MGC3101 BINDING SITE, designated SEQ ID:23478, to the nucleotide sequence of VGAM264 RNA, herein designated VGAM RNA, also designated SEQ ID:2975.

Another function of VGAM264 is therefore inhibition of MGC3101 (Accession NM_024043). Accordingly, utilities of VGAM264 include diagnosis, prevention and treatment of diseases and clinical conditions associated with MGC3101. Ring Finger Protein 24 (RNF24, Accession NM_007219) is another VGAM264 host target gene. RNF24 BINDING SITE is HOST TARGET binding site found in the 3' untranslated region of mRNA encoded by RNF24, corresponding to a HOST TARGET binding site such as BINDING SITE I, BINDING SITE II or BINDING SITE III. Table 2 illustrates the complementarity of the nucleotide sequences of RNF24 BINDING SITE, designated SEQ ID:14088, to the nucleotide sequence of VGAM264 RNA, herein designated VGAM RNA, also designated SEQ ID:2975.

Another function of VGAM264 is therefore inhibition of Ring Finger Protein 24 (RNF24, Accession NM_007219). Accordingly, utilities of VGAM264 include diagnosis, prevention and treatment of diseases and clinical conditions associated with RNF24. LOC123346 (Accession XM_063609) is another VGAM264 host target gene. LOC123346 BINDING SITE is HOST TARGET binding site found in the 5' untranslated region of mRNA encoded by LOC123346, corresponding to a HOST TARGET binding site such as BINDING SITE I, BINDING SITE II or BINDING SITE III. Table 2 illustrates the complementarity of the nucleotide sequences of LOC123346 BINDING SITE, designated SEQ ID:37250, to the nucleotide sequence of VGAM264 RNA, herein designated VGAM RNA, also designated SEQ ID:2975.

Another function of VGAM264 is therefore inhibition of LOC123346 (Accession XM_063609). Accordingly, utilities of VGAM264 include diagnosis, prevention and treatment of diseases and clinical conditions associated with LOC123346. LOC148932 (Accession XM_086372) is another VGAM264 host target gene. LOC148932 BINDING SITE is HOST TARGET binding site found in the 3' untranslated region of mRNA encoded by LOC148932, corresponding to a HOST TARGET binding site such as BINDING SITE I, BINDING SITE II or BINDING SITE III. Table 2 illustrates the complementarity of the nucleotide sequences of LOC148932 BINDING SITE, designated SEQ ID:38626, to the nucleotide sequence of VGAM264 RNA, herein designated VGAM RNA, also designated SEQ ID:2975.

Another function of VGAM264 is therefore inhibition of LOC148932 (Accession XM_086372). Accordingly, utilities of VGAM264 include diagnosis, prevention and treatment of diseases and clinical conditions associated with LOC148932. LOC150139 (Accession XM_086794) is another VGAM264 host target gene. LOC150139 BINDING SITE is HOST TARGET binding site found in the 3' untranslated region of mRNA encoded by LOC150139, corresponding to a HOST TARGET binding site such as BINDING SITE I, BINDING SITE II or BINDING SITE III. Table 2 illustrates the complementarity of the nucleotide sequences of LOC150139 BINDING SITE, designated SEQ ID:38861, to the nucleotide sequence of VGAM264 RNA, herein designated VGAM RNA, also designated SEQ ID:2975.

Another function of VGAM264 is therefore inhibition of LOC150139 (Accession XM_086794). Accordingly, utilities of VGAM264 include diagnosis, prevention and treatment of diseases and clinical conditions associated with LOC150139. LOC150397 (Accession XM_086907) is another VGAM264 host target gene. LOC150397 BINDING SITE is HOST TARGET binding site found in the 3' untranslated region of mRNA encoded by LOC150397, corresponding to a HOST TARGET binding site such as BINDING SITE I, BINDING SITE II or BINDING SITE III. Table 2 illustrates the complementarity of the nucleotide sequences of LOC150397 BINDING SITE, designated SEQ ID:38961, to the nucleotide sequence of VGAM264 RNA, herein designated VGAM RNA, also designated SEQ ID:2975.

Another function of VGAM264 is therefore inhibition of LOC150397 (Accession XM_086907). Accordingly, utilities of VGAM264 include diagnosis, prevention and treatment of diseases and clinical conditions associated with LOC150397.
LOC152502 (Accession XM_001389) is another VGAM264 host target gene. LOC152502 BINDING SITE is HOST TARGET binding site found in the 3' untranslated region of mRNA encoded by LOC152502, corresponding to a HOST TARGET binding site such as BINDING SITE I, BINDING SITE II or BINDING SITE III. Table 2 illustrates the complementarity of the nucleotide sequences of LOC152502 BINDING SITE, designated SEQ ID:29835, to the nucleotide sequence of VGAM264 RNA, herein designated VGAM RNA, also designated SEQ ID:2975.

Another function of VGAM264 is therefore inhibition of LOC152502 (Accession XM_001389). Accordingly, utilities of VGAM264 include diagnosis, prevention and treatment of diseases and clinical conditions associated with LOC152502.
LOC51667 (Accession NM_016118) is another VGAM264 host target gene. LOC51667 BINDING SITE is HOST TARGET binding site found in the 3' untranslated region of mRNA encoded by LOC51667, corresponding to a HOST TARGET binding site such as BINDING SITE I, BINDING SITE II or BINDING SITE III. Table 2 illustrates the complementarity of the nucleotide sequences of LOC51667 BINDING SITE, designated SEQ ID:18200, to the nucleotide sequence of VGAM264 RNA, herein designated VGAM RNA, also designated SEQ ID:2975.

Another function of VGAM264 is therefore inhibition of LOC51667 (Accession NM_016118). Accordingly, utilities of VGAM264 include diagnosis, prevention and treatment of diseases and clinical conditions associated with LOC51667.
LOC91695 (Accession XM_040084) is another VGAM264 host target gene. LOC91695 BINDING SITE is HOST TARGET binding site found in the 3' untranslated region of mRNA encoded by LOC91695, corresponding to a HOST TARGET binding site such as BINDING SITE I, BINDING SITE II or BINDING SITE III. Table 2 illustrates the complementarity of the nucleotide sequences of LOC91695 BINDING SITE, designated SEQ ID:33253, to the nucleotide sequence of VGAM264 RNA, herein designated VGAM RNA, also designated SEQ ID:2975.

Another function of VGAM264 is therefore inhibition of LOC91695 (Accession XM_040084). Accordingly, utilities of VGAM264 include diagnosis, prevention and treatment of diseases and clinical conditions associated with LOC91695.
FIG. 1 further provides a conceptual description of a novel bioinformatically detected viral gene of the present invention, referred to here as Viral Genomic Address Messenger 265 (VGAM265) viral gene, which modulates expression of respective host target genes thereof, the function and utility of which host target genes is known in the art.

VGAM265 is a novel bioinformatically detected regulatory, non protein coding, viral micro RNA (miRNA) gene. The method by which VGAM265 was detected is described hereinabove with reference to FIGS. 1-8.

VGAM265 gene, herein designated VGAM GENE, is a viral gene contained in the genome of Callitrichine Herpesvirus 3. VGAM265 host target gene, herein designated VGAM HOST TARGET GENE, is a human gene contained in the human genome.

VGAM265 gene encodes a VGAM265 precursor RNA, herein designated VGAM PRECURSOR RNA. Similar to other miRNA genes, and unlike most ordinary genes, VGAM265 precursor RNA does not encode a protein. A nucleotide sequence identical or highly similar to the nucleotide sequence of VGAM265 precursor RNA is designated SEQ ID:251, and is provided hereinbelow with reference to the sequence listing part. Nucleotide sequence SEQ ID:251 is located at position 60938 relative to the genome of Callitrichine Herpesvirus 3.

VGAM265 precursor RNA folds onto itself, forming VGAM265 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM265 folded precursor RNA into VGAM265 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM265 RNA is designated SEQ ID:2976, and is provided hereinbelow with reference to the sequence listing part.

VGAM265 host target gene, herein designated VGAM HOST TARGET GENE, encodes a corresponding messenger RNA, VGAM265 host target RNA, herein designated VGAM HOST TARGET RNA. VGAM265 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM265 RNA, herein designated VGAM RNA, binds complementarily to one or more host target binding sites located in untranslated regions of VGAM265 host target RNA, herein designated VGAM HOST TARGET RNA. This complementary binding is due to the fact that the nucleotide sequence of VGAM265 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM265 RNA, herein designated VGAM RNA, may have a different number of host target binding sites in untranslated regions of a VGAM265 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM265 RNA, herein designated VGAM RNA, to host target binding sites on VGAM265 host target RNA, herein designated VGAM HOST TARGET RNA, such as BINDING SITE I, BINDING SITE II and BINDING SITE III, inhibits translation of VGAM265 host target RNA into VGAM265 host target protein, herein designated VGAM HOST TARGET PROTEIN. VGAM host target protein is therefore outlined by a broken line.

It is appreciated that VGAM265 host target gene, herein designated VGAM HOST TARGET GENE, in fact represents a plurality of VGAM265 host target genes. The mRNA of each one of this plurality of VGAM265 host target genes comprises one or more host target binding sites, each having a nucleotide sequence which is at least partly complementary to VGAM265 RNA, herein designated VGAM RNA, and which when bound by VGAM265 RNA causes inhibition of translation of respective one or more VGAM265 host target proteins.

It is further appreciated by one skilled in the art that the mode of translational inhibition illustrated by FIG. 1 with specific reference to translational inhibition exerted by VGAM265 gene, herein designated VGAM GENE, on one or more VGAM265 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM265 is inhibition of expression of host target genes, as part of a novel viral mechanism of attacking a host. Accordingly, utilities of VGAM265 include diagnosis, prevention and treatment of viral infection by Callitrichine Herpesvirus 3. Specific functions, and accordingly utilities, of VGAM265 correlate with, and may be deduced from, the identity of the host target genes which VGAM265 binds and inhibits, and the function of these host target genes, as elaborated hereinbelow.

Nucleotide sequences of the VGAM265 precursor RNA, herein designated VGAM PRECURSOR RNA, and of the 'diced' VGAM265 RNA, herein designated VGAM RNA, and a schematic representation of the secondary folding of VGAM265 folded precursor RNA, herein designated VGAM FOLDED PRECURSOR RNA, of VGAM265 are further described hereinbelow with reference to Table 1.

Nucleotide sequences of host target binding sites, such as BINDING SITE-I, BINDING SITE-II and BINDING SITE-III of FIG. 1, found on VGAM265 host target RNA, and schematic representation of the complementarity of each of these host target binding sites to VGAM265 RNA, herein designated VGAM RNA, are described hereinbelow with reference to Table 2.

As mentioned hereinabove with reference to FIG. 1, a function of VGAM265 gene, herein designated VGAM is inhibition of expression of VGAM265 target genes. It is appreciated that specific functions, and accordingly utilities, of VGAM265 correlate with, and may be deduced from, the identity of the target genes which VGAM265 binds and inhibits, and the function of these target genes, as elaborated hereinbelow.

Epithelial V-like Antigen 1 (EVA1, Accession NM_005797) is a VGAM265 host target gene. EVA1 BINDING SITE is HOST TARGET binding site found in the 3' untranslated region of mRNA encoded by EVA1, corresponding to a HOST TARGET binding site such as BINDING SITE I, BINDING SITE II or BINDING SITE III. Table 2 illustrates the complementarity of the nucleotide sequences of EVA1 BINDING SITE, designated SEQ ID:12378, to the nucleotide sequence of VGAM265 RNA, herein designated VGAM RNA, also designated SEQ ID:2976.

A function of VGAM265 is therefore inhibition of Epithelial V-like Antigen 1 (EVA1, Accession NM_005797). Accordingly, utilities of VGAM265 include diagnosis, prevention and treatment of diseases and clinical conditions associated with EVA1. KIAA0630 (Accession XM_114729) is another VGAM265 host target gene. KIAA0630 BINDING SITE is HOST TARGET binding site found in the 3' untranslated region of mRNA encoded by KIAA0630, corresponding to a HOST TARGET binding site such as BINDING SITE I, BINDING SITE II or BINDING SITE III. Table 2 illustrates the complementarity of the nucleotide sequences of KIAA0630 BINDING SITE, designated SEQ ID:43065, to the nucleotide sequence of VGAM265 RNA, herein designated VGAM RNA, also designated SEQ ID:2976.

Another function of VGAM265 is therefore inhibition of KIAA0630 (Accession XM_114729). Accordingly, utilities of VGAM265 include diagnosis, prevention and treatment of diseases and clinical conditions associated with KIAA0630. PRO1598 (Accession NM_018503) is another VGAM265 host target gene. PRO1598 BINDING SITE is HOST TARGET binding site found in the 3' untranslated region of mRNA encoded by PRO1598, corresponding to a HOST TARGET binding site such as BINDING SITE I, BINDING SITE II or BINDING SITE III. Table 2 illustrates the complementarity of the nucleotide sequences of PRO1598 BINDING SITE, designated SEQ ID:20569, to the nucleotide sequence of VGAM265 RNA, herein designated VGAM RNA, also designated SEQ ID:2976.

Another function of VGAM265 is therefore inhibition of PRO1598 (Accession NM_018503). Accordingly, utilities of VGAM265 include diagnosis, prevention and treatment of diseases and clinical conditions associated with PRO1598. Squamous Cell Carcinoma Antigen Recognised By T Cells 3 (SART3, Accession NM_014706) is another VGAM265 host target gene. SART3 BINDING SITE is HOST TARGET binding site found in the 3' untranslated region of mRNA encoded by SART3, corresponding to a HOST TARGET binding site such as BINDING SITE I, BINDING SITE II or BINDING SITE III. Table 2 illustrates the complementarity of the nucleotide sequences of SART3 BINDING SITE, designated SEQ ID:16248, to the nucleotide sequence of VGAM265 RNA, herein designated VGAM RNA, also designated SEQ ID:2976.

Another function of VGAM265 is therefore inhibition of Squamous Cell Carcinoma Antigen Recognised By T Cells 3 (SART3, Accession NM_014706). Accordingly, utilities of VGAM265 include diagnosis, prevention and treatment of diseases and clinical conditions associated with SART3. LOC158450 (Accession XM_088580) is another VGAM265 host target gene. LOC158450 BINDING SITE is HOST TARGET binding site found in the 5' untranslated region of mRNA encoded by LOC158450, corresponding to a HOST TARGET binding site such as BINDING SITE I, BINDING SITE II or BINDING SITE III. Table 2 illustrates the complementarity of the nucleotide sequences of LOC158450 BINDING SITE, designated SEQ ID:39846, to the nucleotide sequence of VGAM265 RNA, herein designated VGAM RNA, also designated SEQ ID:2976.

Another function of VGAM265 is therefore inhibition of LOC158450 (Accession XM_088580). Accordingly, utilities of VGAM265 include diagnosis, prevention and treatment of diseases and clinical conditions associated with LOC158450. LOC158504 (Accession XM_088591) is another VGAM265 host target gene. LOC158504 BINDING SITE is HOST TARGET binding site found in the 5' untranslated region of mRNA encoded by LOC158504, corresponding to a HOST TARGET binding site such as BINDING SITE I, BINDING SITE II or BINDING SITE III. Table 2 illustrates the complementarity of the nucleotide sequences of LOC158504 BINDING SITE, designated SEQ ID:39857, to the nucleotide sequence of VGAM265 RNA, herein designated VGAM RNA, also designated SEQ ID:2976.

Another function of VGAM265 is therefore inhibition of LOC158504 (Accession XM_088591). Accordingly, utilities of VGAM265 include diagnosis, prevention and treatment of diseases and clinical conditions associated with LOC158504. LOC196812 (Accession XM_116868) is another VGAM265 host target gene. LOC196812 BINDING SITE is HOST TARGET binding site found in the 3' untranslated region of mRNA encoded by LOC196812, corresponding to a HOST TARGET binding site such as BINDING SITE I, BINDING SITE II or BINDING SITE III. Table 2 illustrates the complementarity of the nucleotide sequences of LOC196812 BINDING SITE, designated SEQ ID:43136, to the nucleotide sequence of VGAM265 RNA, herein designated VGAM RNA, also designated SEQ ID:2976.

Another function of VGAM265 is therefore inhibition of LOC196812 (Accession XM_116868). Accordingly, utilities of VGAM265 include diagnosis, prevention and treatment of diseases and clinical conditions associated with LOC196812. FIG. 1 further provides a conceptual description of a novel bioinformatically detected viral gene of the present invention, referred to here as Viral Genomic Address Messenger 266 (VGAM266) viral gene, which modulates expression of respective host target genes thereof, the function and utility of which host target genes is known in the art.

VGAM266 is a novel bioinformatically detected regulatory, non protein coding, viral micro RNA (miRNA) gene. The method by which VGAM266 was detected is described hereinabove with reference to FIGS. 1-8.

VGAM266 gene, herein designated VGAM GENE, is a viral gene contained in the genome of Epiphyas Postvittana Nucleopolyhedrovirus. VGAM266 host target gene, herein designated VGAM HOST TARGET GENE, is a human gene contained in the human genome.

VGAM266 gene encodes a VGAM266 precursor RNA, herein designated VGAM PRECURSOR RNA. Similar to other miRNA genes, and unlike most ordinary genes, VGAM266 precursor RNA does not encode a protein. A nucleotide sequence identical or highly similar to the nucleotide sequence of VGAM266 precursor RNA is designated SEQ ID:252, and is provided hereinbelow with reference to the sequence listing part. Nucleotide sequence SEQ ID:252 is located at position 4402 relative to the genome of Epiphyas Postvittana Nucleopolyhedrovirus.

VGAM266 precursor RNA folds onto itself, forming VGAM266 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM266 folded precursor RNA into VGAM266 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM266 RNA is designated SEQ ID:2977, and is provided hereinbelow with reference to the sequence listing part.

VGAM266 host target gene, herein designated VGAM HOST TARGET GENE, encodes a corresponding messenger RNA, VGAM266 host target RNA, herein designated VGAM HOST TARGET RNA. VGAM266 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM266 RNA, herein designated VGAM RNA, binds complementarily to one or more host target binding sites located in untranslated regions of VGAM266 host target RNA, herein designated VGAM HOST TARGET RNA. This complementary binding is due to the fact that the nucleotide sequence of VGAM266 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM266 RNA, herein designated VGAM RNA, may have a different number of host target binding sites in untranslated regions of a VGAM266 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM266 RNA, herein designated VGAM RNA, to host target binding sites on VGAM266 host target RNA, herein designated VGAM HOST TARGET RNA, such as BINDING SITE I, BINDING SITE II and BINDING SITE III, inhibits translation of VGAM266 host target RNA into VGAM266 host target protein, herein designated VGAM HOST TARGET PROTEIN. VGAM host target protein is therefore outlined by a broken line.

It is appreciated that VGAM266 host target gene, herein designated VGAM HOST TARGET GENE, in fact represents a plurality of VGAM266 host target genes. The mRNA of each one of this plurality of VGAM266 host target genes comprises one or more host target binding sites, each having a nucleotide sequence which is at least partly complementary to VGAM266 RNA, herein designated VGAM RNA, and which when bound by VGAM266 RNA causes inhibition of translation of respective one or more VGAM266 host target proteins.

It is further appreciated by one skilled in the art that the mode of translational inhibition illustrated by FIG. 1 with specific reference to translational inhibition exerted by VGAM266 gene, herein designated VGAM GENE, on one or more VGAM266 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM266 is inhibition of expression of host target genes, as part of a novel viral mechanism of attacking a host. Accordingly, utilities of VGAM266 include diagnosis, prevention and treatment of viral infection by Epiphyas Postvittana Nucleopolyhedrovirus. Specific functions, and accordingly utilities, of VGAM266 correlate with, and may be deduced from, the identity of the host target genes which VGAM266 binds and inhibits, and the function of these host target genes, as elaborated hereinbelow.

Nucleotide sequences of the VGAM266 precursor RNA, herein designated VGAM PRECURSOR RNA, and of the 'diced' VGAM266 RNA, herein designated VGAM RNA, and a schematic representation of the secondary folding of VGAM266 folded precursor RNA, herein designated VGAM FOLDED PRECURSOR RNA, of VGAM266 are further described hereinbelow with reference to Table 1.

Nucleotide sequences of host target binding sites, such as BINDING SITE-I, BINDING SITE-II and BINDING SITE-III of FIG. 1, found on VGAM266 host target RNA, and schematic representation of the complementarity of each of these host target binding sites to VGAM266 RNA, herein designated VGAM RNA, are described hereinbelow with reference to Table 2.

As mentioned hereinabove with reference to FIG. 1, a function of VGAM266 gene, herein designated VGAM is inhibition of expression of VGAM266 target genes. It is appreciated that specific functions, and accordingly utilities, of VGAM266 correlate with, and may be deduced from, the identity of the target genes which VGAM266 binds and inhibits, and the function of these target genes, as elaborated hereinbelow.

Calbindin 1, 28 kDa (CALB1, Accession NM_004929) is a VGAM266 host target gene. CALB1 BINDING SITE is HOST TARGET binding site found in the 3' untranslated region of mRNA encoded by CALB1, corresponding to a HOST TARGET binding site such as BINDING SITE I, BINDING SITE II or BINDING SITE III. Table 2 illustrates the complementarity of the nucleotide sequences of CALB1 BINDING SITE, designated SEQ ID:11367, to the nucleotide sequence of VGAM266 RNA, herein designated VGAM RNA, also designated SEQ ID:2977.

A function of VGAM266 is therefore inhibition of Calbindin 1, 28kDa (CALB1, Accession NM_004929), a gene which buffers cytosolic calcium. Accordingly, utilities of VGAM266 include diagnosis, prevention and treatment of diseases and clinical conditions associated with CALB1. The function of CALB1 has been established by previous studies. Calbindin is a calcium-binding protein belonging to the troponin C superfamily (see OMIM Ref. No. 191040). It was originally described as a 27-kD protein induced by vitamin D in the duodenum of the chick. Calbindin immunoreactivity was further detected by radioimmunoassay and immunohistochemistry in the kidney, pancreatic islets, and brain. In the brain, its synthesis is independent of vitamin-D-derived hormones. Two different proteins presenting calbindin immunoreactivity, one of molecular mass 27 kD (now known to be 28 kD) and the other of 29 kD (OMIM Ref. No. 114051), were identified in the central nervous system. Both molecular species are present in the brain of all vertebrates except fish. Parmentier et al. (1987) selected human 28-kD calbindin cDNA clones by antibody screening of lambda-gt11 brain libraries. The sequence showed an open reading frame coding for a protein of 261 amino acids, containing 4 active calcium-binding domains, and 2 modified domains that presumably have lost their calcium-binding capacity. The preliminary data suggested that the 29-kD protein in brain is encoded by a different gene. By means of immunohistochemical methods, Seto-Ohshima et al. (1988) demonstrated a dearth of neurons containing calbindin in the brains of patients with Huntington disease. Calbindin depletion was particularly notable in the neostriatum (caudate nucleus and putamen) of these patients. Parmentier and Vassart (1988) described a HindIII RFLP of the calbindin 28-kilodalton gene. Parmentier et al. (1989) cloned and sequenced the 5-prime and 3-prime regions of the calbindin 28-kD gene and assigned it to chromosome 8 using human-rodent hybrid cell lines. By Southern analysis of somatic cell hybrids and in situ hybridization, Modi et al. (1991) assigned the CALB1 gene to 8p12-q11.2 Parmentier et al. (1991) mapped the CALB1 gene to 8q21.3-q22.1 by in situ hybridization. At the same time, they mapped the CALB2 gene, called by them calretinin, to 16q22-q23, also by in situ hybridization. These localizations matched the chromosomal regions where the carbonic anhydrase isozyme gene cluster (CA1, 114800; CA2, 259730; CA3, 114750) and the related gene CA7 (OMIM Ref. No. 114770) have been mapped, respectively. This suggests that in evolution a common duplication of the calbindin/calretinin and carbonic anhydrase ancestral genes occurred. By computer-assisted analysis of 5 BAC clones and an EST sequence, Tauchi et al. (1999) defined the genomic organization of an 800-kb region on chromosome 8q21 as 5-prime C8ORF1 (OMIM Ref. No. 604598), 3-prime NBS1, 5-prime DECR1 (OMIM Ref. No. 222745), and 3-prime CALB1.

Full details of the abovementioned studies are described in the following publications, the disclosure of which are hereby incorporated by reference:

Parmentier, M.; Lawson, D. E. M.; Vassart, G.: Human 27-kDa calbindin complementary DNA sequence: evolutionary and functional implications. Europ. J. Biochem. 170:207-215, 1987; and Seto-Ohshima, A.; Emson, P. C.; Lawson, E.; Mountjoy, C. Q.; Carrasco, L. H.: Loss of matrix calcium-binding protein-containing neurons in Huntington's disease. Lancet I:1252-1254, 198.

Further studies establishing the function and utilities of CALB1 are found in John Hopkins OMIM database record ID 114050, and in sited publications numbered 1917-192 and 3271 listed in the bibliography section hereinbelow, which are also hereby incorporated by reference. Heterogeneous Nuclear Ribonucleoprotein D-like (HNRPDL, Accession NM_005463) is another VGAM266 host target gene. HNRPDL BINDING SITE is HOST TARGET binding site found in the 3' untranslated region of mRNA encoded by HNRPDL, corresponding to a HOST TARGET binding site such as BINDING SITE I, BINDING SITE II or BINDING SITE III. Table 2 illustrates the complementarity of the nucleotide sequences of HNRPDL BINDING SITE, designated SEQ ID:11947, to the nucleotide sequence of VGAM266 RNA, herein designated VGAM RNA, also designated SEQ ID:2977.

Another function of VGAM266 is therefore inhibition of Heterogeneous Nuclear Ribonucleoprotein D-like (HNRPDL, Accession NM_005463), a gene which binds to rna molecules that contain au-rich elements. Accordingly, utilities of VGAM266 include diagnosis, prevention and treatment of diseases and clinical conditions associated with HNRPDL. The function of HNRPDL and its association with various diseases and clinical conditions, has been established by previous studies, as described hereinabove with reference to VGAM144. Interleukin 24 (IL24, Accession NM_006850) is another VGAM266 host target gene. IL24 BINDING SITE is HOST TARGET binding site found in the 3' untranslated region of mRNA encoded by IL24, corresponding to a HOST TARGET binding site such as BINDING SITE I, BINDING SITE II or BINDING SITE III. Table 2 illustrates the complementarity of the nucleotide sequences of IL24 BINDING SITE, designated SEQ ID:13718, to the nucleotide sequence of VGAM266 RNA, herein designated VGAM RNA, also designated SEQ ID:2977.

Another function of VGAM266 is therefore inhibition of Interleukin 24 (IL24, Accession NM_006850), a gene which may contribute to terminal cell differentiation. Accordingly, utilities of VGAM266 include diagnosis, prevention and treatment of diseases and clinical conditions associated with IL24. The function of IL24 and its association with various diseases and clinical conditions, has been established by previous studies, as described hereinabove with reference to VGAM258. Solute Carrier Family 10 (sodium/bile acid cotransporter family), Member 2 (SLC10A2, Accession NM_000452) is another VGAM266 host target gene. SLC10A2 BINDING SITE is HOST TARGET binding site found in the 5' untranslated region of mRNA encoded by SLC10A2, corresponding to a HOST TARGET binding site such as BINDING SITE I, BINDING SITE II or BINDING SITE III. Table 2 illustrates the complementarity of the nucleotide sequences of SLC10A2 BINDING SITE, designated SEQ ID:6060, to the nucleotide sequence of VGAM266 RNA, herein designated VGAM RNA, also designated SEQ ID:2977.

Another function of VGAM266 is therefore inhibition of Solute Carrier Family 10 (sodium/bile acid cotransporter family), Member 2 (SLC10A2, Accession NM_000452). Accordingly, utilities of VGAM266 include diagnosis, prevention and treatment of diseases and clinical conditions associated with SLC10A2. Transcription Factor 7 (T-cell specific, HMG-box) (TCF7, Accession NM_003202) is another VGAM266 host target gene. TCF7 BINDING SITE is HOST TARGET binding site found in the 3' untranslated region of mRNA encoded by TCF7, corresponding to a HOST TARGET binding site such as BINDING SITE I, BINDING SITE II or BINDING SITE III. Table 2 illustrates the complementarity of the nucleotide sequences of TCF7 BINDING SITE, designated SEQ ID:9191, to the nucleotide sequence of VGAM266 RNA, herein designated VGAM RNA, also designated SEQ ID:2977.

Another function of VGAM266 is therefore inhibition of Transcription Factor 7 (T-cell specific, HMG-box) (TCF7, Accession NM_003202). Accordingly, utilities of VGAM266 include diagnosis, prevention and treatment of diseases and clinical conditions associated with TCF7. DKFZP434P0111 (Accession XM_041116) is another VGAM266 host target gene. DKFZP434P0111 BINDING SITE is HOST TARGET binding site found in the 3' untranslated region of mRNA encoded by DKFZP434P0111, corresponding to a HOST TARGET binding site such as BINDING SITE I, BINDING SITE II or BINDING SITE III. Table 2 illustrates the complementarity of the nucleotide sequences of DKFZP434P0111 BINDING SITE, designated SEQ ID:33452, to the nucleotide sequence of VGAM266 RNA, herein designated VGAM RNA, also designated SEQ ID:2977.

Another function of VGAM266 is therefore inhibition of DKFZP434P0111 (Accession XM_041116). Accordingly, utilities of VGAM266 include diagnosis, prevention and treatment of diseases and clinical conditions associated with DKFZP434P0111. KIAA0495 (Accession XM_031397) is another VGAM266 host target gene. KIAA0495 BINDING SITE is HOST TARGET binding site found in the 3' untranslated region of mRNA encoded by KIAA0495, corresponding to a HOST TARGET binding site such as BINDING SITE I, BINDING SITE II or BINDING SITE III. Table 2 illustrates the complementarity of the nucleotide sequences of KIAA0495 BINDING SITE, designated SEQ ID:31358, to the nucleotide sequence of VGAM266 RNA, herein designated VGAM RNA, also designated SEQ ID:2977.

Another function of VGAM266 is therefore inhibition of KIAA0495 (Accession XM_031397). Accordingly, utilities of VGAM266 include diagnosis, prevention and treatment of diseases and clinical conditions associated with KIAA0495. LOC139221 (Accession XM_066558) is another VGAM266 host target gene. LOC139221 BINDING SITE is HOST TARGET binding site found in the 5' untranslated region of mRNA encoded by LOC139221, corresponding to a HOST TARGET binding site such as BINDING SITE I, BINDING SITE II or BINDING SITE III. Table 2 illustrates the complementarity of the nucleotide sequences of LOC139221 BINDING SITE, designated SEQ ID:37330, to the nucleotide sequence of VGAM266 RNA, herein designated VGAM RNA, also designated SEQ ID:2977.

Another function of VGAM266 is therefore inhibition of LOC139221 (Accession XM_066558). Accordingly, utilities of VGAM266 include diagnosis, prevention and treatment of diseases and clinical conditions associated with LOC139221. LOC257482 (Accession XM_168544) is another VGAM266 host target gene. LOC257482 BINDING SITE is HOST TARGET binding site found in the 3' untranslated region of mRNA encoded by LOC257482, corresponding to a HOST TARGET binding site such as BINDING SITE I, BINDING SITE II or BINDING SITE III. Table 2 illustrates the complementarity of the nucleotide sequences of LOC257482 BINDING SITE, designated SEQ ID:45232, to the nucleotide sequence of VGAM266 RNA, herein designated VGAM RNA, also designated SEQ ID:2977.

Another function of VGAM266 is therefore inhibition of LOC257482 (Accession XM_168544). Accordingly, utilities of VGAM266 include diagnosis, prevention and treatment of diseases and clinical conditions associated with LOC257482. LOC90346 (Accession NM_138351) is another VGAM266 host target gene. LOC90346 BINDING SITE is HOST TARGET binding site found in the 5' untranslated region of mRNA encoded by LOC90346, corresponding to a HOST TARGET binding site such as BINDING SITE I, BINDING SITE II or BINDING SITE III. Table 2 illustrates the complementarity of the nucleotide sequences of LOC90346 BINDING SITE, designated SEQ ID:28746, to the nucleotide sequence of VGAM266 RNA, herein designated VGAM RNA, also designated SEQ ID:2977.

Another function of VGAM266 is therefore inhibition of LOC90346 (Accession NM_138351). Accordingly, utilities of VGAM266 include diagnosis, prevention and treatment of diseases and clinical conditions associated with LOC90346. FIG. 1 further provides a conceptual description of a novel bioinformatically detected viral gene of the present invention, referred to here as Viral Genomic Address Messenger 267 (VGAM267) viral gene, which modulates expression of respective host target genes thereof, the function and utility of which host target genes is known in the art.

VGAM267 is a novel bioinformatically detected regulatory, non protein coding, viral micro RNA (miRNA) gene. The method by which VGAM267 was detected is described hereinabove with reference to FIGS. 1-8.

VGAM267 gene, herein designated VGAM GENE, is a viral gene contained in the genome of Epiphyas Postvittana Nucleopolyhedrovirus. VGAM267 host target gene, herein designated VGAM HOST TARGET GENE, is a human gene contained in the human genome.

VGAM267 gene encodes a VGAM267 precursor RNA, herein designated VGAM PRECURSOR RNA. Similar to other miRNA genes, and unlike most ordinary genes, VGAM267 precursor RNA does not encode a protein. A nucleotide sequence identical or highly similar to the nucleotide sequence of VGAM267 precursor RNA is designated SEQ ID:253, and is provided hereinbelow with reference to the sequence listing part. Nucleotide sequence SEQ ID:253 is located at position 87252 relative to the genome of Epiphyas Postvittana Nucleopolyhedrovirus.

VGAM267 precursor RNA folds onto itself, forming VGAM267 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM267 folded precursor RNA into VGAM267 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM267 RNA is designated SEQ ID:2978, and is provided hereinbelow with reference to the sequence listing part.

VGAM267 host target gene, herein designated VGAM HOST TARGET GENE, encodes a corresponding messenger RNA, VGAM267 host target RNA, herein designated VGAM HOST TARGET RNA. VGAM267 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM267 RNA, herein designated VGAM RNA, binds complementarily to one or more host target binding sites located in untranslated regions of VGAM267 host target RNA, herein designated VGAM HOST TARGET RNA. This complementary binding is due to the fact that the nucleotide sequence of VGAM267 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM267 RNA, herein designated VGAM RNA, may have a different number of host target binding sites in untranslated regions of a VGAM267 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM267 RNA, herein designated VGAM RNA, to host target binding sites on VGAM267 host target RNA, herein designated VGAM HOST TARGET RNA, such as BINDING SITE I, BINDING SITE II and BINDING SITE III, inhibits translation of VGAM267 host target RNA into VGAM267 host target protein, herein designated VGAM HOST TARGET PROTEIN. VGAM host target protein is therefore outlined by a broken line.

It is appreciated that VGAM267 host target gene, herein designated VGAM HOST TARGET GENE, in fact represents a plurality of VGAM267 host target genes. The mRNA of each one of this plurality of VGAM267 host target genes comprises one or more host target binding sites, each having a nucleotide sequence which is at least partly complementary to VGAM267 RNA, herein designated VGAM RNA, and which when bound by VGAM267 RNA causes inhibition of translation of respective one or more VGAM267 host target proteins.

It is further appreciated by one skilled in the art that the mode of translational inhibition illustrated by FIG. 1 with specific reference to translational inhibition exerted by VGAM267 gene, herein designated VGAM GENE, on one or more VGAM267 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM267 is inhibition of expression of host target genes, as part of a novel viral mechanism of attacking a host. Accordingly, utilities of VGAM267 include diagnosis, prevention and treatment of viral infection by Epiphyas Postvittana Nucleopolyhedrovirus. Specific functions, and accordingly utilities, of VGAM267 correlate with, and may be deduced from, the identity of the host target genes which VGAM267 binds and inhibits, and the function of these host target genes, as elaborated hereinbelow.

Nucleotide sequences of the VGAM267 precursor RNA, herein designated VGAM PRECURSOR RNA, and of the 'diced' VGAM267 RNA, herein designated VGAM RNA, and a schematic representation of the secondary folding of VGAM267 folded precursor RNA, herein designated VGAM FOLDED PRECURSOR RNA, of VGAM267 are further described hereinbelow with reference to Table 1.

Nucleotide sequences of host target binding sites, such as BINDING SITE-I, BINDING SITE-II and BINDING SITE-III of FIG. 1, found on VGAM267 host target RNA, and schematic representation of the complementarity of each of these host target binding sites to VGAM267 RNA, herein designated VGAM RNA, are described hereinbelow with reference to Table 2.

As mentioned hereinabove with reference to FIG. 1, a function of VGAM267 gene, herein designated VGAM is inhibition of expression of VGAM267 target genes. It is appreciated that specific functions, and accordingly utilities, of VGAM267 correlate with, and may be deduced from, the identity of the target genes which VGAM267 binds and inhibits, and the function of these target genes, as elaborated hereinbelow.

ATPase, Na+/K+ Transporting, Beta 2 Polypeptide (ATP1B2, Accession NM_001678) is a VGAM267 host target gene. ATP1B2 BINDING SITE is HOST TARGET binding site found in the 3' untranslated region of mRNA encoded by ATP1B2, corresponding to a HOST TARGET binding site such as BINDING SITE I, BINDING SITE II or BINDING SITE III. Table 2 illustrates the complementarity of the nucleotide sequences of ATP1B2 BINDING SITE, designated SEQ ID:7388, to the nucleotide sequence of VGAM267 RNA, herein designated VGAM RNA, also designated SEQ ID:2978.

A function of VGAM267 is therefore inhibition of ATPase, Na+/K+ Transporting, Beta 2 Polypeptide (ATP1B2, Accession NM_001678), a gene which catalyzes the hydrolysis of ATP coupled with the exchange of Na +/K+ ions across the plasma membrane. Accordingly, utilities of VGAM267 include diagnosis, prevention and treatment of diseases and clinical conditions associated with ATP1B2. The function of ATP1B2 and its association with various diseases and clinical conditions, has been established by previous studies, as described hereinabove with reference to VGAM152. KIAA0711 (Accession NM_014867) is another VGAM267 host target gene. KIAA0711 BINDING SITE is HOST TARGET binding site found in the 5' untranslated region of mRNA encoded by KIAA0711, corresponding to a HOST TARGET binding site such as BINDING SITE I, BINDING SITE II or BINDING SITE III. Table 2 illustrates the complementarity of the nucleotide sequences of KIAA0711 BINDING SITE, designated SEQ ID:16957, to the nucleotide sequence of VGAM267 RNA, herein designated VGAM RNA, also designated SEQ ID:2978.

Another function of VGAM267 is therefore inhibition of KIAA0711 (Accession NM_014867). Accordingly, utilities of VGAM267 include diagnosis, prevention and treatment of diseases and clinical conditions associated with KIAA0711. RDC1 (Accession XM_051522) is another VGAM267 host target gene. RDC1 BINDING SITE is HOST TARGET binding site found in the 3' untranslated region of mRNA encoded by RDC1, corresponding to a HOST TARGET binding site such as BINDING SITE I, BINDING SITE II or BINDING SITE III. Table 2 illustrates the complementarity of the nucleotide sequences of RDC1 BINDING SITE, designated SEQ ID:35847, to the nucleotide sequence of VGAM267 RNA, herein designated VGAM RNA, also designated SEQ ID:2978.

Another function of VGAM267 is therefore inhibition of RDC1 (Accession XM_051522). Accordingly, utilities of VGAM267 include diagnosis, prevention and treatment of diseases and clinical conditions associated with RDC1. Vav 3 Oncogene (VAV3, Accession NM_006113) is another VGAM267 host target gene. VAV3 BINDING SITE is HOST TARGET binding site found in the 3' untranslated region of mRNA encoded by VAV3, corresponding to a HOST TARGET binding site such as BINDING SITE I, BINDING SITE II or BINDING SITE III. Table 2 illustrates the complementarity of the nucleotide sequences of VAV3 BINDING SITE, designated SEQ ID:12756, to the nucleotide sequence of VGAM267 RNA, herein designated VGAM RNA, also designated SEQ ID:2978.

Another function of VGAM267 is therefore inhibition of Vav 3 Oncogene (VAV3, Accession NM_006113). Accordingly, utilities of VGAM267 include diagnosis, prevention and treatment of diseases and clinical conditions associated with VAV3. LOC147837 (Accession XM_085915) is another VGAM267 host target gene. LOC147837 BINDING SITE is HOST TARGET binding site found in the 3' untranslated region of mRNA encoded by LOC147837, corresponding to a HOST TARGET binding site such as BINDING SITE I, BINDING SITE II or BINDING SITE III. Table 2 illustrates the complementarity of the nucleotide sequences of LOC147837 BINDING SITE, designated SEQ ID:38390, to the nucleotide sequence of VGAM267 RNA, herein designated VGAM RNA, also designated SEQ ID:2978.

Another function of VGAM267 is therefore inhibition of LOC147837 (Accession XM_085915). Accordingly, utilities of VGAM267 include diagnosis, prevention and treatment of diseases and clinical conditions associated with LOC147837. FIG. 1 further provides a conceptual description of a novel bioinformatically detected viral gene of the present invention, referred to here as Viral Genomic Address Messenger 268 (VGAM268) viral gene, which modulates expression of respective host target genes thereof, the function and utility of which host target genes is known in the art.

VGAM268 is a novel bioinformatically detected regulatory, non protein coding, viral micro RNA (miRNA) gene. The method by which VGAM268 was detected is described hereinabove with reference to FIGS. 1-8.

VGAM268 gene, herein designated VGAM GENE, is a viral gene contained in the genome of Epiphyas Postvittana Nucleopolyhedrovirus. VGAM268 host target gene, herein designated VGAM HOST TARGET GENE, is a human gene contained in the human genome.

VGAM268 gene encodes a VGAM268 precursor RNA, herein designated VGAM PRECURSOR RNA. Similar to other miRNA genes, and unlike most ordinary genes, VGAM268 precursor RNA does not encode a protein. A nucleotide sequence identical or highly similar to the nucleotide sequence of VGAM268 precursor RNA is designated SEQ ID:254, and is provided hereinbelow with reference to the sequence listing part. Nucleotide sequence SEQ ID:254 is located at position 84311 relative to the genome of Epiphyas Postvittana Nucleopolyhedrovirus.

VGAM268 precursor RNA folds onto itself, forming VGAM268 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM268 folded precursor RNA into VGAM268 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 68%) nucleotide sequence of VGAM268 RNA is designated SEQ ID:2979, and is provided hereinbelow with reference to the sequence listing part.

VGAM268 host target gene, herein designated VGAM HOST TARGET GENE, encodes a corresponding messenger RNA, VGAM268 host target RNA, herein designated VGAM HOST TARGET RNA. VGAM268 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM268 RNA, herein designated VGAM RNA, binds complementarily to one or more host target binding sites located in untranslated regions of VGAM268 host target RNA, herein designated VGAM HOST TARGET RNA. This complementary binding is due to the fact that the nucleotide sequence of VGAM268 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM268 RNA, herein designated VGAM RNA, may have a different number of host target binding sites in untranslated regions of a VGAM268 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM268 RNA, herein designated VGAM RNA, to host target binding sites on VGAM268 host target RNA, herein designated VGAM HOST TARGET RNA, such as BINDING SITE I, BINDING SITE II and BINDING SITE III, inhibits translation of VGAM268 host target RNA into VGAM268 host target protein, herein designated VGAM HOST TARGET PROTEIN. VGAM host target protein is therefore outlined by a broken line.

It is appreciated that VGAM268 host target gene, herein designated VGAM HOST TARGET GENE, in fact represents a plurality of VGAM268 host target genes. The mRNA of each one of this plurality of VGAM268 host target genes comprises one or more host target binding sites, each having a nucleotide sequence which is at least partly complementary to VGAM268 RNA, herein designated VGAM RNA, and which when bound by VGAM268 RNA causes inhibition of translation of respective one or more VGAM268 host target proteins.

It is further appreciated by one skilled in the art that the mode of translational inhibition illustrated by FIG. 1 with specific reference to translational inhibition exerted by VGAM268 gene, herein designated VGAM GENE, on one or more VGAM268 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM268 is inhibition of expression of host target genes, as part of a novel viral mechanism of attacking a host. Accordingly, utilities of VGAM268 include diagnosis, prevention and treatment of viral infection by Epiphyas Postvittana Nucleopolyhedrovirus. Specific functions, and accordingly utilities, of VGAM268 correlate with, and may be deduced from, the identity of the host target genes which VGAM268 binds and inhibits, and the function of these host target genes, as elaborated hereinbelow.

Nucleotide sequences of the VGAM268 precursor RNA, herein designated VGAM PRECURSOR RNA, and of the 'diced' VGAM268 RNA, herein designated VGAM RNA, and a schematic representation of the secondary folding of VGAM268 folded precursor RNA, herein designated VGAM FOLDED PRECURSOR RNA, of VGAM268 are further described hereinbelow with reference to Table 1.

Nucleotide sequences of host target binding sites, such as BINDING SITE-I, BINDING SITE-II and BINDING SITE-III of FIG. 1, found on VGAM268 host target RNA, and schematic representation of the complementarity of each of these host target binding sites to VGAM268 RNA, herein designated VGAM RNA, are described hereinbelow with reference to Table 2.

As mentioned hereinabove with reference to FIG. 1, a function of VGAM268 gene, herein designated VGAM is inhibition of expression of VGAM268 target genes. It is appreciated that specific functions, and accordingly utilities, of VGAM268 correlate with, and may be deduced from, the identity of the target genes which VGAM268 binds and inhibits, and the function of these target genes, as elaborated hereinbelow.

Neuronal Cell Adhesion Molecule (NRCAM, Accession NM_005010) is a VGAM268 host target gene. NRCAM BINDING SITE is HOST TARGET binding site found in the 5' untranslated region of mRNA encoded by NRCAM, corresponding to a HOST TARGET binding site such as BINDING SITE I, BINDING SITE II or BINDING SITE III. Table 2 illustrates the complementarity of the nucleotide sequences of NRCAM BINDING SITE, designated SEQ ID:11449, to the nucleotide sequence of VGAM268 RNA, herein designated VGAM RNA, also designated SEQ ID:2979.

A function of VGAM268 is therefore inhibition of Neuronal Cell Adhesion Molecule (NRCAM, Accession NM_005010), a gene which functions as a cell surface protein and belongs to the immunoglobulin superfamily. Accordingly, utilities of VGAM268 include diagnosis, prevention and treatment of diseases and clinical conditions associated with NRCAM. The function of NRCAM has been established by previous studies. The cell adhesion molecules (CAMs) are a subset of the immunoglobin (Ig) superfamily found in the nervous systems of both vertebrates and invertebrates. They are usually surface membrane proteins with multiple Ig domains at their N termini followed by several fibronectin type III repeats and either a transmembrane intracellular domain or a glycophosphatidylinositol-linked membrane anchor at the C terminus (Lane et al., 1996). The chicken Bravo/Nr-CAM was described by Grumet et al. (1991) and Kayyem et al. (1992) and shown to play a role in nervous system development. The protein interacts with other cell surface molecules of the Ig superfamily and appears to be necessary for specific pathfinding by axonal growth cones during development (Lane et al., 1996). Lane et al. (1996) cloned the human homolog (NRCAM) of the chicken gene from a fetal brain library. Like its chicken counterpart, the predicted 1,275-amino acid protein has 6 V-like Ig domains and 5 fibronectin type III repeats. The transmembrane and intracellular domains of human and chicken NRCAM are entirely conserved and the proteins are 82% identical overall. Alternative splice variants were observed involving sequence around the fifth fibronectin repeat. Northern blots showed an approximately 7-kb transcript in all tissues of adult human brain examined.

Full details of the abovementioned studies are described in the following publications, the disclosure of which are hereby incorporated by reference:

Kayyem, J. F.; Roman, J. M.; de la Rosa, E. J.; Schwarz, U.; Dreyer, W. J.: Bravo/Nr-CAM is closely related to the cell adhesion molecules L1 and Ng-CAM and has a similar heterodimer structure. J. Cell. Biol. 118:1259-1270, 1992; and Lane, R. P.; Chen, X.-N.; Yamakawa, K.; Vielmetter, J.; Korenberg, J. R.; Dreyer, W. J.: Characterization of a highly conserved human homolog to the chicken neural cell surface protein.

Further studies establishing the function and utilities of NRCAM are found in John Hopkins OMIM database record ID 601581, and in sited publications numbered 6535-6539 listed in the bibliography section hereinbelow, which are also hereby incorporated by reference. DKFZP586P0123 (Accession XM_170681) is another VGAM268 host target gene. DKFZP586P0123 BINDING SITE is HOST TARGET binding site found in the 5' untranslated region of mRNA encoded by DKFZP586P0123, corresponding to a HOST TARGET binding site such as BINDING SITE I, BINDING SITE II or BINDING SITE III. Table 2 illustrates the complementarity of the nucleotide sequences of DKFZP586P0123 BINDING SITE, designated SEQ ID:45466, to the nucleotide sequence of VGAM268 RNA, herein designated VGAM RNA, also designated SEQ ID:2979.

Another function of VGAM268 is therefore inhibition of DKFZP586P0123 (Accession XM_170681). Accordingly, utilities of VGAM268 include diagnosis, prevention and treatment of diseases and clinical conditions associated with DKFZP586P0123. MP1 (Accession NM_014968) is another VGAM268 host target gene. MP1 BINDING SITE is HOST TARGET binding site found in the 5' untranslated region of mRNA encoded by MP1, corresponding to a HOST TARGET binding site such as BINDING SITE I, BINDING SITE II or BINDING SITE III. Table 2 illustrates the complementarity of the nucleotide sequences of MP1 BINDING SITE, designated SEQ ID:17359, to the nucleotide sequence of VGAM268 RNA, herein designated VGAM RNA, also designated SEQ ID:2979.

Another function of VGAM268 is therefore inhibition of MP1 (Accession NM_014968). Accordingly, utilities of VGAM268 include diagnosis, prevention and treatment of diseases and clinical conditions associated with MP1. Phorbol-12-myristate-13-acetate-induced Protein 1 (PMAIP1, Accession NM_021127) is another VGAM268 host target gene. PMAIP1 BINDING SITE is HOST TARGET binding site found in the 3' untranslated region of mRNA encoded by PMAIP1, corresponding to a HOST TARGET binding site such as BINDING SITE I, BINDING SITE II or BINDING SITE III. Table 2 illustrates the complementarity of the nucleotide sequences of PMAIP1 BINDING SITE, designated SEQ ID:22100, to the nucleotide sequence of VGAM268 RNA, herein designated VGAM RNA, also designated SEQ ID:2979.

Another function of VGAM268 is therefore inhibition of Phorbol-12-myristate-13-acetate-induced Protein 1 (PMAIP1, Accession NM_021127). Accordingly, utilities of VGAM268 include diagnosis, prevention and treatment of diseases and clinical conditions associated with PMAIP1. Rpo1-2 (Accession NM_019014) is another VGAM268 host target gene. Rpo1-2 BINDING SITE is HOST TARGET binding site found in the 3' untranslated region of mRNA encoded by Rpo1-2, corresponding to a HOST TARGET binding site such as BINDING SITE I, BINDING SITE II or BINDING SITE III. Table 2 illustrates the complementarity of the nucleotide sequences of Rpo1-2 BINDING SITE, designated SEQ ID:21098, to the nucleotide sequence of VGAM268 RNA, herein designated VGAM RNA, also designated SEQ ID:2979.

Another function of VGAM268 is therefore inhibition of Rpo1-2 (Accession NM_019014). Accordingly, utilities of VGAM268 include diagnosis, prevention and treatment of diseases and clinical conditions associated with Rpo1-2. LOC220002 (Accession XM_166224) is another VGAM268 host target gene. LOC220002 BINDING SITE is HOST TARGET binding site found in the 3' untranslated region of mRNA encoded by LOC220002, corresponding to a HOST TARGET binding site such as BINDING SITE I, BINDING SITE II or BINDING SITE III. Table 2 illustrates the complementarity of the nucleotide sequences of LOC220002 BINDING SITE, designated SEQ ID:44048, to the nucleotide sequence of VGAM268 RNA, herein designated VGAM RNA, also designated SEQ ID:2979.

Another function of VGAM268 is therefore inhibition of LOC220002 (Accession XM_166224). Accordingly, utilities of VGAM268 include diagnosis, prevention and treatment of diseases and clinical conditions associated with LOC220002.

FIG. 1 further provides a conceptual description of a novel bioinformatically detected viral gene of the present invention, referred to here as Viral Genomic Address Messenger 269 (VGAM269) viral gene, which modulates expression of respective host target genes thereof, the function and utility of which host target genes is known in the art.

VGAM269 is a novel bioinformatically detected regulatory, non protein coding, viral micro RNA (miRNA) gene. The method by which VGAM269 was detected is described hereinabove with reference to FIGS. 1-8.

VGAM269 gene, herein designated VGAM GENE, is a viral gene contained in the genome of Epiphyas Postvittana Nucleopolyhedrovirus. VGAM269 host target gene, herein designated VGAM HOST TARGET GENE, is a human gene contained in the human genome.

VGAM269 gene encodes a VGAM269 precursor RNA, herein designated VGAM PRECURSOR RNA. Similar to other miRNA genes, and unlike most ordinary genes, VGAM269 precursor RNA does not encode a protein. A nucleotide sequence identical or highly similar to the nucleotide sequence of VGAM269 precursor RNA is designated SEQ ID:255, and is provided hereinbelow with reference to the sequence listing part. Nucleotide sequence SEQ ID:255 is located at position 10259 relative to the genome of Epiphyas Postvittana Nucleopolyhedrovirus.

VGAM269 precursor RNA folds onto itself, forming VGAM269 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM269 folded precursor RNA into VGAM269 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM269 RNA is designated SEQ ID:2980, and is provided hereinbelow with reference to the sequence listing part.

VGAM269 host target gene, herein designated VGAM HOST TARGET GENE, encodes a corresponding messenger RNA, VGAM269 host target RNA, herein designated VGAM HOST TARGET RNA. VGAM269 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM269 RNA, herein designated VGAM RNA, binds complementarily to one or more host target binding sites located in untranslated regions of VGAM269 host target RNA, herein designated VGAM HOST TARGET RNA. This complementary binding is due to the fact that the nucleotide sequence of VGAM269 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM269 RNA, herein designated VGAM RNA, may have a different number of host target binding sites in untranslated regions of a VGAM269 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM269 RNA, herein designated VGAM RNA, to host target binding sites on VGAM269 host target RNA, herein designated VGAM HOST TARGET RNA, such as BINDING SITE I, BINDING SITE II and BINDING SITE III, inhibits translation of VGAM269 host target RNA into VGAM269 host target protein, herein designated VGAM HOST TARGET PROTEIN. VGAM host target protein is therefore outlined by a broken line.

It is appreciated that VGAM269 host target gene, herein designated VGAM HOST TARGET GENE, in fact represents a plurality of VGAM269 host target genes. The mRNA of each one of this plurality of VGAM269 host target genes comprises one or more host target binding sites, each having a nucleotide sequence which is at least partly complementary to VGAM269 RNA, herein designated VGAM RNA, and which when bound by VGAM269 RNA causes inhibition of translation of respective one or more VGAM269 host target proteins.

It is further appreciated by one skilled in the art that the mode of translational inhibition illustrated by FIG. 1 with specific reference to translational inhibition exerted by VGAM269 gene, herein designated VGAM GENE, on one or more VGAM269 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM269 is inhibition of expression of host target genes, as part of a novel viral mechanism of attacking a host. Accordingly, utilities of VGAM269 include diagnosis, prevention and treatment of viral infection by Epiphyas Postvittana Nucleopolyhedrovirus. Specific functions, and accordingly utilities, of VGAM269 correlate with, and may be deduced from, the identity of the host target genes which VGAM269 binds and inhibits, and the function of these host target genes, as elaborated hereinbelow.

Nucleotide sequences of the VGAM269 precursor RNA, herein designated VGAM PRECURSOR RNA, and of the 'diced' VGAM269 RNA, herein designated VGAM RNA, and a schematic representation of the secondary folding of VGAM269 folded precursor RNA, herein designated VGAM FOLDED PRECURSOR RNA, of VGAM269 are further described hereinbelow with reference to Table 1.

Nucleotide sequences of host target binding sites, such as BINDING SITE-I, BINDING SITE-II and BINDING SITE-III of FIG. 1, found on VGAM269 host target RNA, and schematic representation of the complementarity of each of these host target binding sites to VGAM269 RNA, herein designated VGAM RNA, are described hereinbelow with reference to Table 2.

As mentioned hereinabove with reference to FIG. 1, a function of VGAM269 gene, herein designated VGAM is inhibition of expression of VGAM269 target genes. It is appreciated that specific functions, and accordingly utilities, of VGAM269 correlate with, and may be deduced from, the identity of the target genes which VGAM269 binds and inhibits, and the function of these target genes, as elaborated hereinbelow.

Family with Sequence Similarity 8, Member A1 (FAM8A1, Accession NM_016255) is a VGAM269 host target gene. FAM8A1 BINDING SITE is HOST TARGET binding site found in the 3' untranslated region of mRNA encoded by FAM8A1, corresponding to a HOST TARGET binding site such as BINDING SITE I, BINDING SITE II or BINDING SITE III. Table 2 illustrates the complementarity of the nucleotide sequences of FAM8A1 BINDING SITE, designated SEQ ID:18380, to the nucleotide sequence of VGAM269 RNA, herein designated VGAM RNA, also designated SEQ ID:2980.

A function of VGAM269 is therefore inhibition of Family with Sequence Similarity 8, Member A1 (FAM8A1, Accession NM_016255). Accordingly, utilities of VGAM269 include diagnosis, prevention and treatment of diseases and clinical conditions associated with FAM8A1. IMP-2 (Accession NM_006548) is another VGAM269 host target gene. IMP-2 BINDING SITE is HOST TARGET binding site found in the 5' untranslated region of mRNA encoded by IMP-2, corresponding to a HOST TARGET binding site such as BINDING SITE I, BINDING SITE II or BINDING SITE III. Table 2 illustrates the complementarity of the nucleotide sequences of IMP-2 BINDING SITE, designated SEQ ID:13305, to the nucleotide sequence of VGAM269 RNA, herein designated VGAM RNA, also designated SEQ ID:2980.

Another function of VGAM269 is therefore inhibition of IMP-2 (Accession NM_006548). Accordingly, utilities of VGAM269 include diagnosis, prevention and treatment of diseases and clinical conditions associated with IMP-2. FIG. 1 further provides a conceptual description of a novel bioinformatically detected viral gene of the present invention, referred to here as Viral Genomic Address Messenger 270 (VGAM270) viral gene, which modulates expression of respective host target genes thereof, the function and utility of which host target genes is known in the art.

VGAM270 is a novel bioinformatically detected regulatory, non protein coding, viral micro RNA (miRNA) gene. The method by which VGAM270 was detected is described hereinabove with reference to FIGS. 1-8.

VGAM270 gene, herein designated VGAM GENE, is a viral gene contained in the genome of Epiphyas Postvittana Nucleopolyhedrovirus. VGAM270 host target gene, herein designated VGAM HOST TARGET GENE, is a human gene contained in the human genome.

VGAM270 gene encodes a VGAM270 precursor RNA, herein designated VGAM PRECURSOR RNA. Similar to other miRNA genes, and unlike most ordinary genes, VGAM270 precursor RNA does not encode a protein. A nucleotide sequence identical or highly similar to the nucleotide sequence of VGAM270 precursor RNA is designated SEQ ID:256, and is provided hereinbelow with reference to the sequence listing part. Nucleotide sequence SEQ ID:256 is located at position 21071 relative to the genome of Epiphyas Postvittana Nucleopolyhedrovirus.

VGAM270 precursor RNA folds onto itself, forming VGAM270 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM270 folded precursor RNA into VGAM270 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM270 RNA is designated SEQ ID:2981, and is provided hereinbelow with reference to the sequence listing part.

VGAM270 host target gene, herein designated VGAM HOST TARGET GENE, encodes a corresponding messenger RNA, VGAM270 host target RNA, herein designated VGAM HOST TARGET RNA. VGAM270 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM270 RNA, herein designated VGAM RNA, binds complementarily to one or more host target binding sites located in untranslated regions of VGAM270 host target RNA, herein designated VGAM HOST TARGET RNA. This complementary binding is due to the fact that the nucleotide sequence of VGAM270 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM270 RNA, herein designated VGAM RNA, may have a different number of host target binding sites in untranslated regions of a VGAM270 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM270 RNA, herein designated VGAM RNA, to host target binding sites on VGAM270 host target RNA, herein designated VGAM HOST TARGET RNA, such as BINDING SITE I, BINDING SITE II and BINDING SITE III, inhibits translation of VGAM270 host target RNA into VGAM270 host target protein, herein designated VGAM HOST TARGET PROTEIN. VGAM host target protein is therefore outlined by a broken line.

It is appreciated that VGAM270 host target gene, herein designated VGAM HOST TARGET GENE, in fact represents a plurality of VGAM270 host target genes. The mRNA of each one of this plurality of VGAM270 host target genes comprises one or more host target binding sites, each having a nucleotide sequence which is at least partly complementary to VGAM270 RNA, herein designated VGAM RNA, and which when bound by VGAM270 RNA causes inhibition of translation of respective one or more VGAM270 host target proteins.

It is further appreciated by one skilled in the art that the mode of translational inhibition illustrated by FIG. 1 with specific reference to translational inhibition exerted by VGAM270 gene, herein designated VGAM GENE, on one or more VGAM270 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM270 is inhibition of expression of host target genes, as part of a novel viral mechanism of attacking a host. Accordingly, utilities of VGAM270 include diagnosis, prevention and treatment of viral infection by Epiphyas Postvittana Nucleopolyhedrovirus. Specific functions, and accordingly utilities, of VGAM270 correlate with, and may be deduced from, the identity of the host target genes which VGAM270 binds and inhibits, and the function of these host target genes, as elaborated hereinbelow.

Nucleotide sequences of the VGAM270 precursor RNA, herein designated VGAM PRECURSOR RNA, and of the 'diced' VGAM270 RNA, herein designated VGAM RNA, and a schematic representation of the secondary folding of VGAM270 folded precursor RNA, herein designated VGAM FOLDED PRECURSOR RNA, of VGAM270 are further described hereinbelow with reference to Table 1.

Nucleotide sequences of host target binding sites, such as BINDING SITE-I, BINDING SITE-II and BINDING SITE-III of FIG. 1, found on VGAM270 host target RNA, and schematic representation of the complementarity of each of these host target binding sites to VGAM270 RNA, herein designated VGAM RNA, are described hereinbelow with reference to Table 2.

As mentioned hereinabove with reference to FIG. 1, a function of VGAM270 gene, herein designated VGAM is inhibition of expression of VGAM270 target genes. It is appreciated that specific functions, and accordingly utilities, of VGAM270 correlate with, and may be deduced from, the identity of the target genes which VGAM270 binds and inhibits, and the function of these target genes, as elaborated hereinbelow.

FREB (Accession NM_032738) is a VGAM270 host target gene. FREB BINDING SITE is HOST TARGET binding site found in the 3' untranslated region of mRNA encoded by FREB, corresponding to a HOST TARGET binding site such as BINDING SITE I, BINDING SITE II or BINDING SITE III. Table 2 illustrates the complementarity of the nucleotide sequences of FREB BINDING SITE, designated SEQ ID:26467, to the nucleotide sequence of VGAM270 RNA, herein designated VGAM RNA, also designated SEQ ID:2981.

A function of VGAM270 is therefore inhibition of FREB (Accession NM_032738). Accordingly, utilities of VGAM270 include diagnosis, prevention and treatment of diseases and clinical conditions associated with FREB. FLJ12610 (Accession NM_024782) is another VGAM270 host target gene. FLJ12610 BINDING SITE is HOST TARGET binding site found in the 3" untranslated region of mRNA encoded by FLJ12610, corresponding to a HOST TARGET binding site such as BINDING SITE I, BINDING SITE II or BINDING SITE III. Table 2 illustrates the complementarity of the nucleotide sequences of FLJ12610 BINDING SITE, designated SEQ ID:24151, to the nucleotide sequence of VGAM270 RNA, herein designated VGAM RNA, also designated SEQ ID:2981.

Another function of VGAM270 is therefore inhibition of FLJ12610 (Accession NM_024782). Accordingly, utilities of VGAM270 include diagnosis, prevention and treatment of diseases and clinical conditions associated with FLJ12610. RAB40A, Member RAS Oncogene Family (RAB40A, Accession XM_088733) is another VGAM270 host target gene. RAB40A BINDING SITE is HOST TARGET binding site found in the 5' untranslated region of mRNA encoded by RAB40A, corresponding to a HOST TARGET binding site such as BINDING SITE I, BINDING SITE II or BINDING SITE III. Table 2 illustrates the complementarity of the nucleotide sequences of RAB40A BINDING SITE, designated SEQ ID:39932, to the nucleotide sequence of VGAM270 RNA, herein designated VGAM RNA, also designated SEQ ID:2981.

Another function of VGAM270 is therefore inhibition of RAB40A, Member RAS Oncogene Family (RAB40A, Accession XM_088733). Accordingly, utilities of VGAM270 include diagnosis, prevention and treatment of diseases and clinical conditions associated with RAB40A. LOC131870 (Accession XM_059544) is another VGAM270 host target gene. LOC131870 BINDING SITE is HOST TARGET binding site found in the 3' untranslated region of mRNA encoded by LOC131870, corresponding to a HOST TARGET binding site such as BINDING SITE I, BINDING SITE II or BINDING SITE III. Table 2 illustrates the complementarity of the nucleotide sequences of LOC131870 BINDING SITE, designated SEQ ID:37018, to the nucleotide sequence of VGAM270 RNA, herein designated VGAM RNA, also designated SEQ ID:2981.

Another function of VGAM270 is therefore inhibition of LOC131870 (Accession XM_059544). Accordingly, utilities of VGAM270 include diagnosis, prevention and treatment of diseases and clinical conditions associated with LOC131870. LOC154222 (Accession XM_098497) is another VGAM270 host target gene. LOC154222 BINDING SITE is HOST TARGET binding site found in the 3' untranslated region of mRNA encoded by LOC154222, corresponding to a HOST TARGET binding site such as BINDING SITE I, BINDING SITE II or BINDING SITE III. Table 2 illustrates the complementarity of the nucleotide sequences of LOC154222 BINDING SITE, designated SEQ ID:41693, to the nucleotide sequence of VGAM270 RNA, herein designated VGAM RNA, also designated SEQ ID:2981.

Another function of VGAM270 is therefore inhibition of LOC154222 (Accession XM_098497). Accordingly, utilities of VGAM270 include diagnosis, prevention and treatment of diseases and clinical conditions associated with LOC154222. LOC155064 (Accession XM_088128) is another VGAM270 host target gene. LOC155064 BINDING SITE is HOST TARGET binding site found in the 3' untranslated region of mRNA encoded by LOC155064, corresponding to a HOST TARGET binding site such as BINDING SITE I, BINDING SITE II or BINDING SITE III. Table 2 illustrates the complementarity of the nucleotide sequences of LOC155064 BINDING SITE, designated SEQ ID:39529, to the nucleotide sequence of VGAM270 RNA, herein designated VGAM RNA, also designated SEQ ID:2981.

Another function of VGAM270 is therefore inhibition of LOC155064 (Accession XM_088128). Accordingly, utilities of VGAM270 include diagnosis, prevention and treatment of diseases and clinical conditions associated with LOC155064. LOC201194 (Accession XM_117061) is another VGAM270 host target gene. LOC201194 BINDING SITE is HOST TARGET binding site found in the 3' untranslated region of mRNA encoded by LOC201194, corresponding to a HOST TARGET binding site such as BINDING SITE I, BINDING SITE II or BINDING SITE III. Table 2 illustrates the complementarity of the nucleotide sequences of LOC201194 BINDING SITE, designated SEQ ID:43218, to the nucleotide sequence of VGAM270 RNA, herein designated VGAM RNA, also designated SEQ ID:2981.

Another function of VGAM270 is therefore inhibition of LOC201194 (Accession XM_117061). Accordingly, utilities of VGAM270 include diagnosis, prevention and treatment of diseases and clinical conditions associated with LOC201194. LOC91351 (Accession XM_037817) is another VGAM270 host target gene. LOC91351 BINDING SITE is HOST TARGET binding site found in the 3' untranslated region of mRNA encoded by LOC91351, corresponding to a HOST TARGET binding site such as BINDING SITE I, BINDING SITE II or BINDING SITE III. Table 2 illustrates the complementarity of the nucleotide sequences of LOC91351 BINDING SITE, designated SEQ ID:32700, to the nucleotide sequence of VGAM270 RNA, herein designated VGAM RNA, also designated SEQ ID:2981.

Another function of VGAM270 is therefore inhibition of LOC91351 (Accession XM_037817). Accordingly, utilities of VGAM270 include diagnosis, prevention and treatment of diseases and clinical conditions associated with LOC91351.

FIG. 1 further provides a conceptual description of a novel bioinformatically detected viral gene of the present invention, referred to here as Viral Genomic Address Messenger 271 (VGAM271) viral gene, which modulates expression of respective host target genes thereof, the function and utility of which host target genes is known in the art.

VGAM271 is a novel bioinformatically detected regulatory, non protein coding, viral micro RNA (miRNA) gene. The method by which VGAM271 was detected is described hereinabove with reference to FIGS. 1-8.

VGAM271 gene, herein designated VGAM GENE, is a viral gene contained in the genome of Epiphyas Postvittana Nucleopolyhedrovirus. VGAM271 host target gene, herein designated VGAM HOST TARGET GENE, is a human gene contained in the human genome.

VGAM271 gene encodes a VGAM271 precursor RNA, herein designated VGAM PRECURSOR RNA. Similar to other miRNA genes, and unlike most ordinary genes, VGAM271 precursor RNA does not encode a protein. A nucleotide sequence identical or highly similar to the nucleotide sequence of VGAM271 precursor RNA is designated SEQ ID:257, and is provided hereinbelow with reference to the sequence listing part. Nucleotide sequence SEQ ID:257 is located at position 113843 relative to the genome of Epiphyas Postvittana Nucleopolyhedrovirus.

VGAM271 precursor RNA folds onto itself, forming VGAM271 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM271 folded precursor RNA into VGAM271 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM271 RNA is designated SEQ ID:2982, and is provided hereinbelow with reference to the sequence listing part.

VGAM271 host target gene, herein designated VGAM HOST TARGET GENE, encodes a corresponding messenger RNA, VGAM271 host target RNA, herein designated VGAM HOST TARGET RNA. VGAM271 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM271 RNA, herein designated VGAM RNA, binds complementarily to one or more host target binding sites located in untranslated regions of VGAM271 host target RNA, herein designated VGAM HOST TARGET RNA. This complementary binding is due to the fact that the nucleotide sequence of VGAM271 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM271 RNA, herein designated VGAM RNA, may have a different number of host target binding sites in untranslated regions of a VGAM271 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM271 RNA, herein designated VGAM RNA, to host target binding sites on VGAM271 host target RNA, herein designated VGAM HOST TARGET RNA, such as BINDING SITE I, BINDING SITE II and BINDING SITE III, inhibits translation of VGAM271 host target RNA into VGAM271 host target protein, herein designated VGAM HOST TARGET PROTEIN. VGAM host target protein is therefore outlined by a broken line.

It is appreciated that VGAM271 host target gene, herein designated VGAM HOST TARGET GENE, in fact represents a plurality of VGAM271 host target genes. The mRNA of each one of this plurality of VGAM271 host target genes comprises one or more host target binding sites, each having a nucleotide sequence which is at least partly complementary to VGAM271 RNA, herein designated VGAM RNA, and which when bound by VGAM271 RNA causes inhibition of translation of respective one or more VGAM271 host target proteins.

It is further appreciated by one skilled in the art that the mode of translational inhibition illustrated by FIG. 1 with specific reference to translational inhibition exerted by VGAM271 gene, herein designated VGAM GENE, on one or more VGAM271 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM271 is inhibition of expression of host target genes, as part of a novel viral mechanism of attacking a host. Accordingly, utilities of VGAM271 include diagnosis, prevention and treatment of viral infection by Epiphyas Postvittana Nucleopolyhedrovirus. Specific functions, and accordingly utilities, of VGAM271 correlate with, and may be deduced from, the identity of the host target genes which VGAM271 binds and inhibits, and the function of these host target genes, as elaborated hereinbelow.

Nucleotide sequences of the VGAM271 precursor RNA, herein designated VGAM PRECURSOR RNA, and of the 'diced' VGAM271 RNA, herein designated VGAM RNA, and a schematic representation of the secondary folding of VGAM271 folded precursor RNA, herein designated VGAM FOLDED PRECURSOR RNA, of VGAM271 are further described hereinbelow with reference to Table 1.

Nucleotide sequences of host target binding sites, such as BINDING SITE-I, BINDING SITE-II and BINDING SITE-III of FIG. 1, found on VGAM271 host target RNA, and schematic representation of the complementarity of each of these host target binding sites to VGAM271 RNA, herein designated VGAM RNA, are described hereinbelow with reference to Table 2.

As mentioned hereinabove with reference to FIG. 1, a function of VGAM271 gene, herein designated VGAM is inhibition of expression of VGAM271 target genes. It is appreciated that specific functions, and accordingly utilities, of VGAM271 correlate with, and may be deduced from, the identity of the target genes which VGAM271 binds and inhibits, and the function of these target genes, as elaborated hereinbelow.

Solute Carrier Family 25 (mitochondrial carrier, Aralar), Member 12 (SLC25A12, Accession NM_003705) is a VGAM271 host target gene. SLC25A12 BINDING SITE is HOST TARGET binding site found in the 3' untranslated region of mRNA encoded by SLC25A12, corresponding to a HOST TARGET binding site such as BINDING SITE I, BINDING SITE II or BINDING SITE III. Table 2 illustrates the complementarity of the nucleotide sequences of SLC25A12 BINDING SITE, designated SEQ ID:9805, to the nucleotide sequence of VGAM271 RNA, herein designated VGAM RNA, also designated SEQ ID:2982.

A function of VGAM271 is therefore inhibition of Solute Carrier Family 25 (mitochondrial carrier, Aralar), Member 12 (SLC25A12, Accession NM_003705), a gene which is a calcium -dependent mitochondrial solute carrier.may have a function in the urea cycle (by similarity). Accordingly, utilities of VGAM271 include diagnosis, prevention and treatment of diseases and clinical conditions associated with SLC25A12. The function of SLC25A12 has been established by previous studies. The mitochondrial inner membrane harbors a set of carrier proteins for metabolite transport that constitute of superfamily of related proteins. The yeast open reading frame YNL083W encodes a predicted protein with characteristics of both mitochondrial carrier and calcium-binding proteins. By searching EST databases for proteins with similar features, del Arco and Satrustegui (1998) identified several C. elegans cDNAs encoding putative calcium-dependent mitochondrial carrier proteins. Using the sequence of one of the C. elegans cDNAs, the authors searched human EST databases and found cDNAs encoding a related human protein that they designated 'Aralar' (formed by combining the given name of the first author, 'Araceli,' with a Spanish word meaning 'very long,' 'hiperlarga'). The N-terminal portion of the predicted 678-amino acid Aralar protein contains 3 canonical EF-hand calcium-binding domains and 2 imperfect EF-hand domains. The authors demonstrated that this half of the protein bound calcium in vitro. The C-terminal half of Aralar shares 28 to 29% identity with proteins of the mitochondrial solute carrier family, including oxoglutarate/ malate carrier (OMIM Ref. No. 604165), ADP/ATP translocase-2 (OMIM Ref. No. 300150), UCP1 (OMIM Ref. No. 113730), and tricarboxylate carrier (OMIM Ref. No. 190315). Like the other mitochondrial carrier proteins, the C-terminal region of Aralar contains 6 potential transmembrane domains. Immunocytochemistry and cell fractionation studies showed that both exogenously expressed and endogenous Aralar protein are localized within the mitochondria. Northern blot analysis revealed that Aralar is expressed as 2.9- and 3.2-kb mRNAs predominantly in heart and skeletal muscle, with weaker expression in brain and kidney. Del Arco and Satrustegui (1998) concluded that the domain structure, mitochondrial localization, and expression in excitable tissues of Aralar suggest a possible function for this protein as a calcium-dependent mitochondrial solute carrier Crackower et al. (1999) mapped the SLC25A12 gene to chromosome 2q24 by FISH, somatic cell and radiation hybrid mapping, and YAC clone analyses. Sanz et al. (2000) localized the SLC25A12 gene to 2q31 by FISH Full details of the abovementioned studies are described in the following publications, the disclosure of which are hereby incorporated by reference:

del Arco, A.; Satrustegui, J.: Molecular cloning of aralar, a new member of the mitochondrial carrier superfamily that binds calcium and is present in human muscle and brain. J. Biol. Chem. 273:23327-23334, 1998; and Crackower, M. A.; Sinasac, D. S.; Lee, J. R.; Herbrick, J.-A.; Tsui, L.-C.; Scherer, S. W.: Assignment of the SLC25A12 gene coding for the human calcium-binding mitochondrial solute carrie.

Further studies establishing the function and utilities of SLC25A12 are found in John Hopkins OMIM database record ID 603667, and in sited publications numbered 989-991 listed in the bibliography section hereinbelow, which are also hereby incorporated by reference. ATPase, Class II, Type 9A (ATP9A, Accession XM_030577) is another VGAM271 host target gene. ATP9A BINDING SITE is HOST TARGET binding site found in the 3' untranslated region of mRNA encoded by ATP9A, corresponding to a HOST TARGET binding site such as BINDING SITE I, BINDING SITE II or BINDING SITE III. Table 2 illustrates the complementarity of the nucleotide sequences of ATP9A BINDING SITE, designated SEQ ID:31078, to the nucleotide sequence of VGAM271 RNA, herein designated VGAM RNA, also designated SEQ ID:2982.

Another function of VGAM271 is therefore inhibition of ATPase, Class II, Type 9A (ATP9A, Accession XM_030577). Accordingly, utilities of VGAM271 include diagnosis, prevention and treatment of diseases and clinical conditions associated with ATP9A. F-box Only Protein 21 (FBXO21, Accession NM_033624) is another VGAM271 host target gene. FBXO21 BINDING SITE is HOST TARGET binding site found in the 3' untranslated region of mRNA encoded by FBXO21, corresponding to a HOST TARGET binding site such as BINDING SITE I, BINDING SITE II or BINDING SITE III. Table 2 illustrates the complementarity of the nucleotide sequences of FBXO21 BINDING SITE, designated SEQ ID:27321, to the nucleotide sequence of VGAM271 RNA, herein designated VGAM RNA, also designated SEQ ID:2982.

Another function of VGAM271 is therefore inhibition of F-box Only Protein 21 (FBXO21, Accession NM_033624). Accordingly, utilities of VGAM271 include diagnosis, prevention and treatment of diseases and clinical conditions associated with FBXO21. FLJ22601 (Accession NM_024822) is another VGAM271 host target gene. FLJ22601 BINDING SITE is HOST TARGET binding site found in the 3' untranslated region of mRNA encoded by FLJ22601, corresponding to a HOST TARGET binding site such as BINDING SITE I, BINDING SITE II or BINDING SITE III. Table 2 illustrates the complementarity of the nucleotide sequences of FLJ22601 BINDING SITE, designated SEQ ID:24211, to the nucleotide sequence of VGAM271 RNA, herein designated VGAM RNA, also designated SEQ ID:2982.

Another function of VGAM271 is therefore inhibition of FLJ22601 (Accession NM_024822). Accordingly, utilities of VGAM271 include diagnosis, prevention and treatment of diseases and clinical conditions associated with FLJ22601. Interleukin 10 Receptor, Beta (IL10RB, Accession NM_000628) is another VGAM271 host target gene. IL10RB BINDING SITE is HOST TARGET binding site found in the 3' untranslated region of mRNA encoded by IL10RB, corresponding to a HOST TARGET binding site such as BINDING SITE I, BINDING SITE II or BINDING SITE III. Table 2 illustrates the complementarity of the nucleotide sequences of IL10RB BINDING SITE, designated SEQ ID:6244, to the nucleotide sequence of VGAM271 RNA, herein designated VGAM RNA, also designated SEQ ID:2982.

Another function of VGAM271 is therefore inhibition of Interleukin 10 Receptor, Beta (IL10RB, Accession NM_000628). Accordingly, utilities of VGAM271 include diagnosis, prevention and treatment of diseases and clinical conditions associated with IL10RB. MGC13102 (Accession NM_032323) is another VGAM271 host target gene. MGC13102 BINDING SITE is HOST TARGET binding site found in the 3' untranslated region of mRNA encoded by MGC13102, corresponding to a HOST TARGET binding site such as BINDING SITE I, BINDING SITE II or BINDING SITE III. Table 2 illustrates the complementarity of the nucleotide sequences of MGC13102 BINDING SITE, designated SEQ ID:26134, to the nucleotide sequence of VGAM271 RNA, herein designated VGAM RNA, also designated SEQ ID:2982.

Another function of VGAM271 is therefore inhibition of MGC13102 (Accession NM_032323). Accordingly, utilities of VGAM271 include diagnosis, prevention and treatment of diseases and clinical conditions associated with MGC13102. SPEC1 (Accession NM_020239) is another VGAM271 host target gene. SPEC1 BINDING SITE is HOST TARGET binding site found in the 3' untranslated region of mRNA encoded by SPEC1, corresponding to a HOST TARGET binding site such as BINDING SITE I, BINDING SITE II or BINDING SITE III. Table 2 illustrates the complementarity of the nucleotide sequences of SPEC1 BINDING SITE, designated SEQ ID:21509, to the nucleotide sequence of VGAM271 RNA, herein designated VGAM RNA, also designated SEQ ID:2982.

Another function of VGAM271 is therefore inhibition of SPEC1 (Accession NM_020239). Accordingly, utilities of VGAM271 include diagnosis, prevention and treatment of diseases and clinical conditions associated with SPEC1. LOC147645 (Accession XM_085831) is another VGAM271 host target gene. LOC147645 BINDING SITE is HOST TARGET binding site found in the 3' untranslated region of mRNA encoded by LOC147645, corresponding to a HOST TARGET binding site such as BINDING SITE I, BINDING SITE II or BINDING SITE III. Table 2 illustrates the complementarity of the nucleotide sequences of LOC147645 BINDING SITE, designated SEQ ID:38357, to the nucleotide sequence of VGAM271 RNA, herein designated VGAM RNA, also designated SEQ ID:2982.

Another function of VGAM271 is therefore inhibition of LOC147645 (Accession XM_085831). Accordingly, utilities of VGAM271 include diagnosis, prevention and treatment of diseases and clinical conditions associated with LOC147645. LOC150378 (Accession XM_086857) is another VGAM271 host target gene. LOC150378 BINDING SITE is HOST TARGET binding site found in the 3' untranslated region of mRNA encoded by LOC150378, corresponding to a HOST TARGET binding site such as BINDING SITE I, BINDING SITE II or BINDING SITE III. Table 2 illustrates the complementarity of the nucleotide sequences of LOC150378 BINDING SITE, designated SEQ ID:38921, to the nucleotide sequence of VGAM271 RNA, herein designated VGAM RNA, also designated SEQ ID:2982.

Another function of VGAM271 is therefore inhibition of LOC150378 (Accession XM_086857). Accordingly, utilities of VGAM271 include diagnosis, prevention and treatment of diseases and clinical conditions associated with LOC150378. LOC152313 (Accession XM_098190) is another VGAM271 host target gene. LOC152313 BINDING SITE is HOST TARGET binding site found in the 3' untranslated region of mRNA encoded by LOC152313, corresponding to a HOST TARGET binding site such as BINDING SITE I, BINDING SITE II or BINDING SITE III. Table 2 illustrates the complementarity of the nucleotide sequences of LOC152313 BINDING SITE, designated SEQ ID:41474, to the nucleotide sequence of VGAM271 RNA, herein designated VGAM RNA, also designated SEQ ID:2982.

Another function of VGAM271 is therefore inhibition of LOC152313 (Accession XM_098190). Accordingly, utilities of VGAM271 include diagnosis, prevention and treatment of diseases and clinical conditions associated with LOC152313. LOC164397 (Accession XM_092780) is another VGAM271 host target gene. LOC164397 BINDING SITE is HOST TARGET binding site found in the 5' untranslated region of mRNA encoded by LOC164397, corresponding to a HOST TARGET binding site such as BINDING SITE I, BINDING SITE II or BINDING SITE III. Table 2 illustrates the complementarity of the nucleotide sequences of LOC164397 BINDING SITE, designated SEQ ID:40150, to the nucleotide sequence of VGAM271 RNA, herein designated VGAM RNA, also designated SEQ ID:2982.

Another function of VGAM271 is therefore inhibition of LOC164397 (Accession XM_092780). Accordingly, utilities of VGAM271 include diagnosis, prevention and treatment of diseases and clinical conditions associated with LOC164397. LOC220763 (Accession XM_055551) is another VGAM271 host target gene. LOC220763 BINDING SITE is HOST TARGET binding site found in the 5' untranslated region of mRNA encoded by LOC220763, corresponding to a HOST TARGET binding site such as BINDING SITE I, BINDING SITE II or BINDING SITE III. Table 2 illustrates the complementarity of the nucleotide sequences of LOC220763 BINDING SITE, designated SEQ ID:36301, to the nucleotide sequence of VGAM271 RNA, herein designated VGAM RNA, also designated SEQ ID:2982.

Another function of VGAM271 is therefore inhibition of LOC220763 (Accession XM_055551). Accordingly, utilities of VGAM271 include diagnosis, prevention and treatment of diseases and clinical conditions associated with LOC220763. LOC90317 (Accession XM_030892) is another VGAM271 host target gene. LOC90317 BINDING SITE is HOST TARGET binding site found in the 5' untranslated region of mRNA encoded by LOC90317, corresponding to a HOST TARGET binding site such as BINDING SITE I, BINDING SITE II or BINDING SITE III. Table 2 illustrates the complementarity of the nucleotide sequences of LOC90317 BINDING SITE, designated SEQ ID:31206, to the nucleotide sequence of VGAM271 RNA, herein designated VGAM RNA, also designated SEQ ID:2982.

Another function of VGAM271 is therefore inhibition of LOC90317 (Accession XM_030892). Accordingly, utilities of VGAM271 include diagnosis, prevention and treatment of diseases and clinical conditions associated with LOC90317. FIG. 1 further provides a conceptual description of a novel bioinformatically detected viral gene of the present invention, referred to here as Viral Genomic Address Messenger 272 (VGAM272) viral gene, which modulates expression of respective host target genes thereof, the function and utility of which host target genes is known in the art.

VGAM272 is a novel bioinformatically detected regulatory, non protein coding, viral micro RNA (miRNA) gene. The method by which VGAM272 was detected is described hereinabove with reference to FIGS. 1-8.

VGAM272 gene, herein designated VGAM GENE, is a viral gene contained in the genome of Epiphyas Postvittana Nucleopolyhedrovirus. VGAM272 host target gene, herein designated VGAM HOST TARGET GENE, is a human gene contained in the human genome.

VGAM272 gene encodes a VGAM272 precursor RNA, herein designated VGAM PRECURSOR RNA. Similar to other miRNA genes, and unlike most ordinary genes, VGAM272 precursor RNA does not encode a protein. A nucleotide sequence identical or highly similar to the nucleotide sequence of VGAM272 precursor RNA is designated SEQ ID:258, and is provided hereinbelow with reference to the sequence listing part. Nucleotide sequence SEQ ID:258 is located at position 105105 relative to the genome of Epiphyas Postvittana Nucleopolyhedrovirus.

VGAM272 precursor RNA folds onto itself, forming VGAM272 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM272 folded precursor RNA into VGAM272 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM272 RNA is designated SEQ ID:2983, and is provided hereinbelow with reference to the sequence listing part.

VGAM272 host target gene, herein designated VGAM HOST TARGET GENE, encodes a corresponding messenger RNA, VGAM272 host target RNA, herein designated VGAM HOST TARGET RNA. VGAM272 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM272 RNA, herein designated VGAM RNA, binds complementarily to one or more host target binding sites located in untranslated regions of VGAM272 host target RNA, herein designated VGAM HOST TARGET RNA. This complementary binding is due to the fact that the nucleotide sequence of VGAM272 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM272 RNA, herein designated VGAM RNA, may have a different number of host target binding sites in untranslated regions of a VGAM272 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM272 RNA, herein designated VGAM RNA, to host target binding sites on VGAM272 host target RNA, herein designated VGAM HOST TARGET RNA, such as BINDING SITE I, BINDING SITE II and BINDING SITE III, inhibits translation of VGAM272 host target RNA into VGAM272 host target protein, herein designated VGAM HOST TARGET PROTEIN. VGAM host target protein is therefore outlined by a broken line.

It is appreciated that VGAM272 host target gene, herein designated VGAM HOST TARGET GENE, in fact represents a plurality of VGAM272 host target genes. The mRNA of each one of this plurality of VGAM272 host target genes comprises one or more host target binding sites, each having a nucleotide sequence which is at least partly complementary to VGAM272 RNA, herein designated VGAM RNA, and which when bound by VGAM272 RNA causes inhibition of translation of respective one or more VGAM272 host target proteins.

It is further appreciated by one skilled in the art that the mode of translational inhibition illustrated by FIG. 1 with specific reference to translational inhibition exerted by VGAM272 gene, herein designated VGAM GENE, on one or more VGAM272 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM272 is inhibition of expression of host target genes, as part of a novel viral mechanism of attacking a host. Accordingly, utilities of VGAM272 include diagnosis, prevention and treatment of viral infection by Epiphyas Postvittana Nucleopolyhedrovirus. Specific functions, and accordingly utilities, of VGAM272 correlate with, and may be deduced from, the identity of the host target genes which VGAM272 binds and inhibits, and the function of these host target genes, as elaborated hereinbelow.

Nucleotide sequences of the VGAM272 precursor RNA, herein designated VGAM PRECURSOR RNA, and of the 'diced' VGAM272 RNA, herein designated VGAM RNA, and a schematic representation of the secondary folding of VGAM272 folded precursor RNA, herein designated VGAM FOLDED PRECURSOR RNA, of VGAM272 are further described hereinbelow with reference to Table 1.

Nucleotide sequences of host target binding sites, such as BINDING SITE-I, BINDING SITE-II and BINDING SITE-III of FIG. 1, found on VGAM272 host target RNA, and schematic representation of the complementarity of each of these host target binding sites to VGAM272 RNA, herein designated VGAM RNA, are described hereinbelow with reference to Table 2.

As mentioned hereinabove with reference to FIG. 1, a function of VGAM272 gene, herein designated VGAM is inhibition of expression of VGAM272 target genes. It is appreciated that specific functions, and accordingly utilities, of VGAM272 correlate with, and may be deduced from, the identity of the target genes which VGAM272 binds and inhibits, and the function of these target genes, as elaborated hereinbelow.

Kelch-like 3 (Drosophila) (KLHL3, Accession XM_113450) is a VGAM272 host target gene. KLHL3 BINDING SITE is HOST TARGET binding site found in the 3' untranslated region of mRNA encoded by KLHL3, corresponding to a HOST TARGET binding site such as BINDING SITE I, BINDING SITE II or BINDING SITE III. Table 2 illustrates the complementarity of the nucleotide sequences of KLHL3 BINDING SITE, designated SEQ ID:42270, to the nucleotide sequence of VGAM272 RNA, herein designated VGAM RNA, also designated SEQ ID:2983.

A function of VGAM272 is therefore inhibition of Kelch-like 3 (Drosophila) (KLHL3, Accession XM_113450). Accordingly, utilities of VGAM272 include diagnosis, prevention and treatment of diseases and clinical conditions associated with KLHL3. Solute Carrier Family 24 (sodium/potassium/calcium exchanger), Member 1 (SLC24A1, Accession NM_004727) is another VGAM272 host target gene. SLC24A1 BINDING SITE is HOST TARGET binding site found in the 3' untranslated region of mRNA encoded by SLC24A1, corresponding to a HOST TARGET binding site such as BINDING SITE I, BINDING SITE II or BINDING SITE III. Table 2 illustrates the complementarity of the nucleotide sequences of SLC24A1 BINDING SITE, designated SEQ ID:11100, to the nucleotide sequence of VGAM272 RNA, herein designated VGAM RNA, also designated SEQ ID:2983.

Another function of VGAM272 is therefore inhibition of Solute Carrier Family 24 (sodium/potassium/calcium exchanger), Member 1 (SLC24A1, Accession NM_004727), a gene which is a critical component of the visual transduction cascade, controlling the calcium concentration of outer segments during light and darkness. Accordingly, utilities of VGAM272 include diagnosis, prevention and treatment of diseases and clinical conditions associated with SLC24A1. The function of SLC24A1 and its association with various diseases and clinical conditions, has been established by previous studies, as described hereinabove with reference to VGAM142. Suppressor of Fused Homolog (Drosophila) (SUFU, Accession NM_016169) is another VGAM272 host target gene. SUFU BINDING SITE is HOST TARGET binding site found in the 3' untranslated region of mRNA encoded by SUFU, corresponding to a HOST TARGET binding site such as BINDING SITE I, BINDING SITE II or BINDING SITE III. Table 2 illustrates the complementarity of the nucleotide sequences of SUFU BINDING SITE, designated SEQ ID:18255, to the nucleotide sequence of VGAM272 RNA, herein designated VGAM RNA, also designated SEQ ID:2983.

Another function of VGAM272 is therefore inhibition of Suppressor of Fused Homolog (Drosophila) (SUFU, Accession NM_016169). Accordingly, utilities of VGAM272 include diagnosis, prevention and treatment of diseases and clinical conditions associated with SUFU. ADP-ribosylation Factor GTPase Activating Protein 1 (ARFGAP1, Accession NM_018209) is another VGAM272 host target gene. ARFGAP1 BINDING SITE is HOST TARGET binding site found in the 3' untranslated region of mRNA encoded by ARFGAP1, corresponding to a HOST TARGET binding site such as BINDING SITE I, BINDING SITE II or BINDING SITE III. Table 2 illustrates the complementarity of the nucleotide sequences of ARFGAP1 BINDING SITE, designated SEQ ID:20110, to the nucleotide sequence of VGAM272 RNA, herein designated VGAM RNA, also designated SEQ ID:2983.

Another function of VGAM272 is therefore inhibition of ADP-ribosylation Factor GTPase Activating Protein 1 (ARF-GAP1, Accession NM_018209). Accordingly, utilities of VGAM272 include diagnosis, prevention and treatment of diseases and clinical conditions associated with ARFGAP1. Cyclin E2 (CCNE2, Accession NM_057749) is another VGAM272 host target gene. CCNE2 BINDING SITE1 and CCNE2 BINDING SITE2 are HOST TARGET binding sites found in untranslated regions of mRNA encoded by CCNE2, corresponding to HOST TARGET binding sites such as BINDING SITE I, BINDING SITE II or BINDING SITE III. Table 2 illustrates the complementarity of the nucleotide sequences of CCNE2 BINDING SITE1 and CCNE2 BINDING SITE2, designated SEQ ID:27711 and SEQ ID:11050 respectively, to the nucleotide sequence of VGAM272 RNA, herein designated VGAM RNA, also designated SEQ ID:2983.

Another function of VGAM272 is therefore inhibition of Cyclin E2 (CCNE2, Accession NM_057749). Accordingly, utilities of VGAM272 include diagnosis, prevention and treatment of diseases and clinical conditions associated with CCNE2. KIAA0553 (Accession XM_045981) is another VGAM272 host target gene. KIAA0553 BINDING SITE is HOST TARGET binding site found in the 3' untranslated region of mRNA encoded by KIAA0553, corresponding to a HOST TARGET binding site such as BINDING SITE I, BINDING SITE II or BINDING SITE III. Table 2 illustrates the complementarity of the nucleotide sequences of KIAA0553 BINDING SITE, designated SEQ ID:34638, to the nucleotide sequence of VGAM272 RNA, herein designated VGAM RNA, also designated SEQ ID:2983.

Another function of VGAM272 is therefore inhibition of KIAA0553 (Accession XM_045981). Accordingly, utilities of VGAM272 include diagnosis, prevention and treatment of diseases and clinical conditions associated with KIAA0553. KIAA1200 (Accession XM_031054) is another VGAM272 host target gene. KIAA1200 BINDING SITE is HOST TARGET binding site found in the 3' untranslated region of mRNA encoded by KIAA1200, corresponding to a HOST TARGET binding site such as BINDING SITE I, BINDING SITE II or BINDING SITE III. Table 2 illustrates the complementarity of the nucleotide sequences of KIAA1200 BINDING SITE, designated SEQ ID:31264, to the nucleotide sequence of VGAM272 RNA, herein designated VGAM RNA, also designated SEQ ID:2983.

Another function of VGAM272 is therefore inhibition of KIAA1200 (Accession XM_031054). Accordingly, utilities of VGAM272 include diagnosis, prevention and treatment of diseases and clinical conditions associated with KIAA1200. MGC12760 (Accession NM_032723) is another VGAM272 host target gene. MGC12760 BINDING SITE is HOST TARGET binding site found in the 5' untranslated region of mRNA encoded by MGC12760, corresponding to a HOST TARGET binding site such as BINDING SITE I, BINDING SITE II or BINDING SITE III. Table 2 illustrates the complementarity of the nucleotide sequences of MGC12760 BINDING SITE, designated SEQ ID:26450, to the nucleotide sequence of VGAM272 RNA, herein designated VGAM RNA, also designated SEQ ID:2983.

Another function of VGAM272 is therefore inhibition of MGC12760 (Accession NM_032723). Accordingly, utilities of VGAM272 include diagnosis, prevention and treatment of diseases and clinical conditions associated with MGC12760. LOC153505 (Accession XM_087693) is another VGAM272 host target gene. LOC153505 BINDING SITE is HOST TARGET binding site found in the 3' untranslated region of mRNA encoded by LOC153505, corresponding to a HOST TARGET binding site such as BINDING SITE I, BINDING SITE II or BINDING SITE III. Table 2 illustrates the complementarity of the nucleotide sequences of LOC153505 BINDING SITE, designated SEQ ID:39383, to the nucleotide sequence of VGAM272 RNA, herein designated VGAM RNA, also designated SEQ ID:2983.

Another function of VGAM272 is therefore inhibition of LOC153505 (Accession XM_087693). Accordingly, utilities of VGAM272 include diagnosis, prevention and treatment of diseases and clinical conditions associated with LOC153505. LOC157503 (Accession XM_098767) is another VGAM272 host target gene. LOC157503 BINDING SITE is HOST TARGET binding site found in the 3' untranslated region of mRNA encoded by LOC157503, corresponding to a HOST TARGET binding site such as BINDING SITE I, BINDING SITE II or BINDING SITE III. Table 2 illustrates the complementarity of the nucleotide sequences of LOC157503 BINDING SITE, designated SEQ ID:41812, to the nucleotide sequence of VGAM272 RNA, herein designated VGAM RNA, also designated SEQ ID:2983.

Another function of VGAM272 is therefore inhibition of LOC157503 (Accession XM_098767). Accordingly, utilities of VGAM272 include diagnosis, prevention and treatment of diseases and clinical conditions associated with LOC157503. LOC162333 (Accession XM_102591) is another VGAM272 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42128, to the nucleotide sequence of VGAM272 RNA, herein designated VGAM RNA, also designated SEQ ID:2983.

Another function of VGAM272 is therefore inhibition of LOC162333 (Accession XM_102591). Accordingly, utilities of VGAM272 include diagnosis, prevention and treatment of diseases and clinical conditions associated with LOC162333. LOC253782 (Accession XM_171023) is another VGAM272 host target gene. LOC253782 BINDING SITE is HOST TARGET binding site found in the 3' untranslated region of mRNA encoded by LOC253782, corresponding to a HOST TARGET binding site such as BINDING SITE I, BINDING SITE II or BINDING SITE III. Table 2 illustrates the complementarity of the nucleotide sequences of LOC253782 BINDING SITE, designated SEQ ID:45797, to the nucleotide sequence of VGAM272 RNA, herein designated VGAM RNA, also designated SEQ ID:2983.

Another function of VGAM272 is therefore inhibition of LOC253782 (Accession XM_171023). Accordingly, utilities of VGAM272 include diagnosis, prevention and treatment of diseases and clinical conditions associated with LOC253782. FIG. 1 further provides a conceptual description of a novel bioinformatically detected viral gene of the present invention, referred to here as Viral Genomic Address Messenger 273 (VGAM273) viral gene, which modulates expression of respective host target genes thereof, the function and utility of which host target genes is known in the art.

VGAM273 is a novel bioinformatically detected regulatory, non protein coding, viral micro RNA (miRNA) gene. The method by which VGAM273 was detected is described hereinabove with reference to FIGS. 1-8.

VGAM273 gene, herein designated VGAM GENE, is a viral gene contained in the genome of Epiphyas Postvittana Nucleopolyhedrovirus. VGAM273 host target gene, herein designated VGAM HOST TARGET GENE, is a human gene contained in the human genome.

VGAM273 gene encodes a VGAM273 precursor RNA, herein designated VGAM PRECURSOR RNA. Similar to other miRNA genes, and unlike most ordinary genes, VGAM273 precursor RNA does not encode a protein. A nucleotide sequence identical or highly similar to the nucleotide sequence of VGAM273 precursor RNA is designated SEQ ID:259, and is provided hereinbelow with reference to the sequence listing part. Nucleotide sequence SEQ ID:259 is located at position 90664 relative to the genome of Epiphyas Postvittana Nucleopolyhedrovirus.

VGAM273 precursor RNA folds onto itself, forming VGAM273 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM273 folded precursor RNA into VGAM273 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM273 RNA is designated SEQ ID:2984, and is provided hereinbelow with reference to the sequence listing part.

VGAM273 host target gene, herein designated VGAM HOST TARGET GENE, encodes a corresponding messenger RNA, VGAM273 host target RNA, herein designated VGAM HOST TARGET RNA. VGAM273 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM273 RNA, herein designated VGAM RNA, binds complementarily to one or more host target binding sites located in untranslated regions of VGAM273 host target RNA, herein designated VGAM HOST TARGET RNA. This complementary binding is due to the fact that the nucleotide sequence of VGAM273 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM273 RNA, herein designated VGAM RNA, may have a different number of host target binding sites in untranslated regions of a VGAM273 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM273 RNA, herein designated VGAM RNA, to host target binding sites on VGAM273 host target RNA, herein designated VGAM HOST TARGET RNA, such as BINDING SITE I, BINDING SITE II and BINDING SITE III, inhibits translation of VGAM273 host target RNA into VGAM273 host target protein, herein designated VGAM HOST TARGET PROTEIN. VGAM host target protein is therefore outlined by a broken line.

It is appreciated that VGAM273 host target gene, herein designated VGAM HOST TARGET GENE, in fact represents a plurality of VGAM273 host target genes. The mRNA of each one of this plurality of VGAM273 host target genes comprises one or more host target binding sites, each having a nucleotide sequence which is at least partly complementary to VGAM273 RNA, herein designated VGAM RNA, and which when bound by VGAM273 RNA causes inhibition of translation of respective one or more VGAM273 host target proteins.

It is further appreciated by one skilled in the art that the mode of translational inhibition illustrated by FIG. 1 with specific reference to translational inhibition exerted by VGAM273 gene, herein designated VGAM GENE, on one or more VGAM273 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM273 is inhibition of expression of host target genes, as part of a novel viral mechanism of attacking a host. Accordingly, utilities of VGAM273 include diagnosis, prevention and treatment of viral infection by Epiphyas Postvittana Nucleopolyhedrovirus. Specific functions, and accordingly utilities, of VGAM273 correlate with, and may be deduced from, the identity of the host target genes which VGAM273 binds and inhibits, and the function of these host target genes, as elaborated hereinbelow.

Nucleotide sequences of the VGAM273 precursor RNA, herein designated VGAM PRECURSOR RNA, and of the 'diced' VGAM273 RNA, herein designated VGAM RNA, and a schematic representation of the secondary folding of VGAM273 folded precursor RNA, herein designated VGAM FOLDED PRECURSOR RNA, of VGAM273 are further described hereinbelow with reference to Table 1.

Nucleotide sequences of host target binding sites, such as BINDING SITE-I, BINDING SITE-II and BINDING SITE-III of FIG. 1, found on VGAM273 host target RNA, and schematic representation of the complementarity of each of these host target binding sites to VGAM273 RNA, herein designated VGAM RNA, are described hereinbelow with reference to Table 2.

As mentioned hereinabove with reference to FIG. 1, a function of VGAM273 gene, herein designated VGAM is inhibition of expression of VGAM273 target genes. It is appreciated that specific functions, and accordingly utilities, of VGAM273 correlate with, and may be deduced from, the identity of the target genes which VGAM273 binds and inhibits, and the function of these target genes, as elaborated hereinbelow.

Fibroblast Growth Factor 23 (FGF23, Accession NM_020638) is a VGAM273 host target gene. FGF23 BINDING SITE is HOST TARGET binding site found in the 3' untranslated region of mRNA encoded by FGF23, corresponding to a HOST TARGET binding site such as BINDING SITE I, BINDING SITE II or BINDING SITE III. Table 2 illustrates the complementarity of the nucleotide sequences of FGF23 BINDING SITE, designated SEQ ID:21794, to the nucleotide sequence of VGAM273 RNA, herein designated VGAM RNA, also designated SEQ ID:2984.

A function of VGAM273 is therefore inhibition of Fibroblast Growth Factor 23 (FGF23, Accession NM_020638), a gene which a member of the fibroblast growth factor family. Accordingly, utilities of VGAM273 include diagnosis, prevention and treatment of diseases and clinical conditions associated with FGF23. The function of FGF23 and its association with various diseases and clinical conditions, has been established by previous studies, as described hereinabove with reference to VGAM24. Potassium Inwardly-rectifying Channel, Subfamily J, Member 16 (KCNJ16, Accession NM_018658) is another VGAM273 host target gene. KCNJ16 BINDING SITE is HOST TARGET binding site found in the 3' untranslated region of mRNA encoded by KCNJ16, corresponding to a HOST TARGET binding site such as BINDING SITE I, BINDING SITE II or BINDING SITE III. Table 2 illustrates the complementarity of the nucleotide sequences of KCNJ16 BINDING SITE, designated SEQ ID:20729, to the nucleotide sequence of VGAM273 RNA, herein designated VGAM RNA, also designated SEQ ID:2984.

Another function of VGAM273 is therefore inhibition of Potassium Inwardly-rectifying Channel, Subfamily J, Member 16 (KCNJ16, Accession NM_018658). Accordingly, utilities of VGAM273 include diagnosis, prevention and treatment of diseases and clinical conditions associated with KCNJ16. Lactate Dehydrogenase B (LDHB, Accession NM_002300) is another VGAM273 host target gene. LDHB BINDING SITE is HOST TARGET binding site found in the 5' untranslated region of mRNA encoded by LDHB, corresponding to a HOST TARGET binding site such as BINDING SITE I, BINDING SITE II or BINDING SITE III. Table 2 illustrates the complementarity of the nucleotide sequences of LDHB BINDING SITE, designated SEQ ID:8087, to the nucleotide sequence of VGAM273 RNA, herein designated VGAM RNA, also designated SEQ ID:2984.

Another function of VGAM273 is therefore inhibition of Lactate Dehydrogenase B (LDHB, Accession NM_002300), a gene which causes dehydrogenation of lactate. Accordingly, utilities of VGAM273 include diagnosis, prevention and treatment of diseases and clinical conditions associated with LDHB. The function of LDHB has been established by previous studies. LDHB and peptidase B (OMIM Ref. No. 169900) are linked (Santachiara et al., 1970) and both loci are on chromosome 12 (Chen et al., 1973). Kitamura et al. (1971) reported the first case of a complete deficiency of lactate dehydrogenase subunit H(B) in serum, saliva and erythrocytes of a 64-year-old male with mild diabetes. Study made on family members revealed low LDH activity in their serum also linked with decreased relative activity of the H4(B4) fraction. Based on the comparison of the calculated ratio of H to M subunits in normal and affected family members, it was hypothesized that the proband is homozygous while the abnormal family members are heterozygous, assuming a single gene is involved. Red cell metabolism in the proband was studied by Miwa et al. (1971); neither reticulocytosis nor hemolytic anemia was present. Thus, although LDHA deficiency leads to myoglobinuria and risk of renal failure after strenuous exercise, LDHB deficiency probably has no clear symptomatic consequences. As pointed out by Sudo (1993), LDH deficiency is of interest to laboratory medicine mainly because it can cause misdiagnosis in those disorders in which elevation of serum LDH is expected. LDH deficiency can probably be considered a 'nondisease.' In a screening of 2,880 blood samples from healthy persons in the Fukuoka Prefecture in Japan, Maekawa et al. (1994) found that the frequency of heterozygotes for either LDHA or LDHB deficiency was 0.104% at each locus. These estimated frequencies were slightly lower than, but not significantly different from, those found previously in the Shizuoka Prefecture. In a case of deletion of the short arm of chromosome 12, Weiss et al. (1973) found evidence that LDHB is located there. From study of somatic cell hybrids Hamerton et al. (1975) concluded that LDHB is in the 12q21-pter region. Rethore et al. (1975) found augmentation of LDHB activity in a boy trisomic for the short arm of chromosome 12. From study of 3 patients with different deletions of chromosome 12, Rethore et al. (1976) concluded that the G3PD locus is on the distal part of 12p, between p12.2 and 12pter, and that the LDHB locus is on the middle third between 12p12.1 and 12p12.2. The results for TPI were similar to those for G3PD, suggesting the same distal localization. Mohrenweiser and Neel (1981) identified thermolabile variants of lactate dehydrogenase B, glucosephosphate isomerase, and glucose-6-phosphate dehydrogenase. None was detectable as a variant by standard electrophoretic techniques. All were inherited. Steinbach and Rehder (1987) demonstrated dosage effect with LDHB in a case of tetrasomy of 12p. Sakai et al. (1987) isolated and sequenced LDHB cDNA. Nucleotide and amino acid sequences showed 68% and 75% identity, respectively, with those of LDHA. Sudo et al. (1990) demonstrated 93% homology between an LDHB processed pseudogene and the functional gene. The pseudogene was mapped to the X chromosome by dot blot analysis.

Full details of the abovementioned studies are described in the following publications, the disclosure of which are hereby incorporated by reference:

Kitamura, M.; Iijima, N.; Hashimoto, F.; Hiratsuka, A.: Hereditary deficiency of subunit H of lactate dehydrogenase. Clin. Chim. Acta 34:419-423, 1971; and Sudo, K.; Maekawa, M.; Luedemann, M. M.; Deaven, L. L.; Li, S. S.-L.: Human lactate dehydrogenase-B processed pseudogene: nucleotide sequence analysis and assignment to the X-chromosom.

Further studies establishing the function and utilities of LDHB are found in John Hopkins OMIM database record ID 150100, and in sited publications numbered 5076, 11205-11214, 1127 and 11290-11301 listed in the bibliography section hereinbelow, which are also hereby incorporated by reference. Opioid Binding Protein/cell Adhesion Molecule-like (OPCML, Accession NM_002545) is another VGAM273 host target gene. OPCML BINDING SITE is HOST TARGET binding site found in the 3' untranslated region of mRNA encoded by OPCML, corresponding to a HOST TARGET binding site such as BINDING SITE I, BINDING SITE II or BINDING SITE III. Table 2 illustrates the complementarity of the nucleotide sequences of OPCML BINDING SITE, designated SEQ ID:8396, to the nucleotide sequence of VGAM273 RNA, herein designated VGAM RNA, also designated SEQ ID:2984.

Another function of VGAM273 is therefore inhibition of Opioid Binding Protein/cell Adhesion Molecule-like (OPCML, Accession NM_002545), a gene which may function as a GPI-anchored neural cell adhesion molecule. Accordingly, utilities of VGAM273 include diagnosis, prevention and treatment of diseases and clinical conditions associated with OPCML. The function of OPCML and its association with various diseases and clinical conditions, has been established by previous studies, as described hereinabove with reference to VGAM71. Protein Kinase, CAMP-dependent, Catalytic, Alpha (PRKACA, Accession NM_002730) is another VGAM273 host target gene. PRKACA BINDING SITE is HOST TARGET binding site found in the 3' untranslated region of mRNA encoded by PRKACA, corresponding to a HOST TARGET binding site such as BINDING SITE I, BINDING SITE II or BINDING SITE III. Table 2 illustrates the complementarity of the nucleotide sequences of PRKACA BINDING SITE, designated SEQ ID:8597, to the nucleotide sequence of VGAM273 RNA, herein designated VGAM RNA, also designated SEQ ID:2984.

Another function of VGAM273 is therefore inhibition of Protein Kinase, CAMP-dependent, Catalytic, Alpha (PRKACA, Accession NM_002730), a gene which phosphorylates target proteins on serine or threonine residues. Accordingly, utilities of VGAM273 include diagnosis, prevention and treatment of diseases and clinical conditions associated with PRKACA. The function of PRKACA and its association with various diseases and clinical conditions, has been established by previous studies, as described hereinabove with reference to VGAM175. Rho-associated, Coiled-coil Containing Protein Kinase 2 (ROCK2, Accession XM_038377) is another VGAM273 host target gene. ROCK2 BINDING SITE is HOST TARGET binding site found in the 3' untranslated region of mRNA encoded by ROCK2, corresponding to a HOST TARGET binding site such as BINDING SITE I, BINDING SITE II or BINDING SITE III. Table 2 illustrates the complementarity of the nucleotide sequences of ROCK2 BINDING SITE, designated SEQ ID:32835, to the nucleotide sequence of VGAM273 RNA, herein designated VGAM RNA, also designated SEQ ID:2984.

Another function of VGAM273 is therefore inhibition of Rho-associated, Coiled-coil Containing Protein Kinase 2 (ROCK2, Accession XM_038377), a gene which regulates cytokinesis, smooth muscle contraction, the formation of actin stress fibers and focal adhesions. Accordingly, utilities of VGAM273 include diagnosis, prevention and treatment of diseases and clinical conditions associated with ROCK2. The function of ROCK2 has been established by previous studies. ROCK2 is a serine/threonine kinase that regulates cytokinesis, smooth muscle contraction, the formation of actin stress fibers and focal adhesions, and the activation of the c-fos (OMIM Ref. No. 164810) serum response element. ROCK2, which is an isozyme of ROCK1 (OMIM Ref. No. 601702), is a target for the small GTPase Rho (e.g., 165390). Nakamura et al. (2001) studied the role of Rho in the migration of corneal epithelial cells in rabbit. They detected both ROCK1 (OMIM Ref. No. 601702) and ROCK2 in the corneal epithelium at protein and mRNA levels. They found that exoenzyme C3, a Rho inhibitor, inhibits corneal epithelial migration in a dose-dependent manner and prevents the stimulatory effect of the Rho activator lysophosphatidic acid (LPA). Both cytochalasin B, an inhibitor of actin filament assembly, and ML7, an inhibitor of myosin light chain kinase, also prevent LPA stimulation of epithelial migration. The authors suggested that Rho mediates corneal epithelial migration in response to external stimuli by regulating the organization of the actin cytoskeleton. Rao et al. (2001) investigated the role of Rho kinase in the modulation of aqueous humor outflow facility. The treatment of human trabecular meshwork and canal of Schlemm cells with a Rho kinase-specific inhibitor led to significant but reversible changes in cell shape and decreased actin stress fibers, focal adhesions, and protein phosphotyrosine staining. Based on the Rho kinase inhibitor-induced changes in myosin light chain phosphorylation and actomyosin organization, the authors suggested that cellular relaxation and loss of cell-substratum adhesions in the human trabecular meshwork and canal of Schlemm cells could result in either increased paracellular fluid flow across the canal of Schlemm or altered flow pathway through the juxtacanalicular tissue, thereby lowering resistance to outflow. They suggested Rho kinase as a potential target for the development of drugs to modulate intraocular pressure in glaucoma patients.

Full details of the abovementioned studies are described in the following publications, the disclosure of which are hereby incorporated by reference:

Nakamura, M.; Nagano, T.; Chikama, T.; Nishida, T.: Role of the small GTP-binding protein Rho in epithelial cell migration in the rabbit cornea. Invest. Ophthal. Vis. Sci. 42:941-947, 2001; and Rao, P. V.; Deng, P.-F.; Kumar, J.; Epstein, D. L.: Modulation of aqueous humor outflow facility by the Rho kinase-specific inhibitor Y-27632. Invest. Ophthal. Vis. Sci. 42:1029-1037.

Further studies establishing the function and utilities of ROCK2 are found in John Hopkins OMIM database record ID 604002, and in sited publications numbered 9440, 10912-1091 and 7392 listed in the bibliography section hereinbelow, which are also hereby incorporated by reference. Cysteine and Tyrosine-rich 1 (CYYR1, Accession NM_052954) is another VGAM273 host target gene. CYYR1 BINDING SITE is HOST TARGET binding site found in the 3' untranslated region of mRNA encoded by CYYR1, corresponding to a HOST TARGET binding site such as BINDING SITE I, BINDING SITE II or BINDING SITE III. Table 2 illustrates the complementarity of the nucleotide sequences of CYYR1 BINDING SITE, designated SEQ ID:27514, to the nucleotide sequence of VGAM273 RNA, herein designated VGAM RNA, also designated SEQ ID:2984.

Another function of VGAM273 is therefore inhibition of Cysteine and Tyrosine-rich 1 (CYYR1, Accession NM_052954). Accordingly, utilities of VGAM273 include diagnosis, prevention and treatment of diseases and clinical conditions associated with CYYR1. KIAA1036 (Accession NM_014909) is another VGAM273 host target gene. KIAA1036 BINDING SITE is HOST TARGET binding site found in the 3' untranslated region of mRNA encoded by KIAA1036, corresponding to a HOST TARGET binding site such as BINDING SITE I, BINDING SITE II or BINDING SITE III. Table 2 illustrates the complementarity of the nucleotide sequences of KIAA1036 BINDING SITE, designated SEQ ID:17126, to the nucleotide sequence of VGAM273 RNA, herein designated VGAM RNA, also designated SEQ ID:2984.

Another function of VGAM273 is therefore inhibition of KIAA1036 (Accession NM_014909). Accordingly, utilities of VGAM273 include diagnosis, prevention and treatment of diseases and clinical conditions associated with KIAA1036. SBBI31 (Accession NM_014035) is another VGAM273 host target gene. SBBI31 BINDING SITE is HOST TARGET binding site found in the 3' untranslated region of mRNA encoded by SBBI31, corresponding to a HOST TARGET binding site such as BINDING SITE I, BINDING SITE II or BINDING SITE III. Table 2 illustrates the complementarity of the nucleotide sequences of SBBI31 BINDING SITE, designated SEQ ID:15266, to the nucleotide sequence of VGAM273 RNA, herein designated VGAM RNA, also designated SEQ ID:2984.

Another function of VGAM273 is therefore inhibition of SBBI31 (Accession NM_014035). Accordingly, utilities of VGAM273 include diagnosis, prevention and treatment of diseases and clinical conditions associated with SBBI31. LOC124842 (Accession XM_064333) is another VGAM273 host target gene. LOC124842 BINDING SITE is HOST TARGET binding site found in the 5' untranslated region of mRNA encoded by LOC124842, corresponding to a HOST TARGET binding site such as BINDING SITE I, BINDING SITE II or BINDING SITE III. Table 2 illustrates the complementarity of the nucleotide sequences of LOC124842 BINDING SITE, designated SEQ ID:37261, to the nucleotide sequence of VGAM273 RNA, herein designated VGAM RNA, also designated SEQ ID:2984.

Another function of VGAM273 is therefore inhibition of LOC124842 (Accession XM_064333). Accordingly, utilities of VGAM273 include diagnosis, prevention and treatment of diseases and clinical conditions associated with LOC124842. LOC138399 (Accession XM_059971) is another VGAM273 host target gene. LOC138399 BINDING SITE is HOST TARGET binding site found in the 5' untranslated region of mRNA encoded by LOC138399, corresponding to a HOST TARGET binding site such as BINDING SITE I, BINDING SITE II or BINDING SITE III. Table 2 illustrates the complementarity of the nucleotide sequences of LOC138399 BINDING SITE, designated SEQ ID:37131, to the nucleotide sequence of VGAM273 RNA, herein designated VGAM RNA, also designated SEQ ID:2984.

Another function of VGAM273 is therefore inhibition of LOC138399 (Accession XM_059971). Accordingly, utilities of VGAM273 include diagnosis, prevention and treatment of diseases and clinical conditions associated with LOC138399. LOC221814 (Accession XM_168226) is another VGAM273 host target gene. LOC221814 BINDING SITE is HOST TARGET binding site found in the 5' untranslated region of mRNA encoded by LOC221814, corresponding to a HOST TARGET binding site such as BINDING SITE I, BINDING SITE II or BINDING SITE III. Table 2 illustrates the complementarity of the nucleotide sequences of LOC221814 BINDING SITE, designated SEQ ID:45090, to the nucleotide sequence of VGAM273 RNA, herein designated VGAM RNA, also designated SEQ ID:2984.

Another function of VGAM273 is therefore inhibition of LOC221814 (Accession XM_168226). Accordingly, utilities of VGAM273 include diagnosis, prevention and treatment of diseases and clinical conditions associated with LOC221814. LOC90317 (Accession XM_030892) is another VGAM273 host target gene. LOC90317 BINDING SITE is HOST TARGET binding site found in the 5' untranslated region of mRNA encoded by LOC90317, corresponding to a HOST TARGET binding site such as BINDING SITE I, BINDING SITE II or BINDING SITE III. Table 2 illustrates the complementarity of the nucleotide sequences of LOC90317 BINDING SITE, designated SEQ ID:31207, to the nucleotide sequence of VGAM273 RNA, herein designated VGAM RNA, also designated SEQ ID:2984.

Another function of VGAM273 is therefore inhibition of LOC90317 (Accession XM_030892). Accordingly, utilities of VGAM273 include diagnosis, prevention and treatment of diseases and clinical conditions associated with LOC90317. FIG. 1 further provides a conceptual description of a novel bioinformatically detected viral gene of the present invention, referred to here as Viral Genomic Address Messenger 274 (VGAM274) viral gene, which modulates expression of respective host target genes thereof, the function and utility of which host target genes is known in the art.

VGAM274 is a novel bioinformatically detected regulatory, non protein coding, viral micro RNA (miRNA) gene. The method by which VGAM274 was detected is described hereinabove with reference to FIGS. 1-8.

VGAM274 gene, herein designated VGAM GENE, is a viral gene contained in the genome of Epiphyas Postvittana Nucleopolyhedrovirus. VGAM274 host target gene, herein designated VGAM HOST TARGET GENE, is a human gene contained in the human genome.

VGAM274 gene encodes a VGAM274 precursor RNA, herein designated VGAM PRECURSOR RNA. Similar to other miRNA genes, and unlike most ordinary genes, VGAM274 precursor RNA does not encode a protein. A nucleotide sequence identical or highly similar to the nucleotide sequence of VGAM274 precursor RNA is designated SEQ ID:260, and is provided hereinbelow with reference to the sequence listing part. Nucleotide sequence SEQ ID:260 is located at position 80659 relative to the genome of Epiphyas Postvittana Nucleopolyhedrovirus.

VGAM274 precursor RNA folds onto itself, forming VGAM274 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM274 folded precursor RNA into VGAM274 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM274 RNA is designated SEQ ID:2985, and is provided hereinbelow with reference to the sequence listing part.

VGAM274 host target gene, herein designated VGAM HOST TARGET GENE, encodes a corresponding messenger RNA, VGAM274 host target RNA, herein designated VGAM HOST TARGET RNA. VGAM274 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM274 RNA, herein designated VGAM RNA, binds complementarily to one or more host target binding sites located in untranslated regions of VGAM274 host target RNA, herein designated VGAM HOST TARGET RNA. This complementary binding is due to the fact that the nucleotide sequence of VGAM274 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM274 RNA, herein designated VGAM RNA, may have a different number of host target binding sites in untranslated regions of a VGAM274 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM274 RNA, herein designated VGAM RNA, to host target binding sites on VGAM274 host target RNA, herein designated VGAM HOST TARGET RNA, such as BINDING SITE I, BINDING SITE II and BINDING SITE III, inhibits translation of VGAM274 host target RNA into VGAM274 host target protein, herein designated VGAM HOST TARGET PROTEIN. VGAM host target protein is therefore outlined by a broken line.

It is appreciated that VGAM274 host target gene, herein designated VGAM HOST TARGET GENE, in fact represents a plurality of VGAM274 host target genes. The mRNA of each one of this plurality of VGAM274 host target genes comprises one or more host target binding sites, each having a nucleotide sequence which is at least partly complementary to VGAM274 RNA, herein designated VGAM RNA, and which when bound by VGAM274 RNA causes inhibition of translation of respective one or more VGAM274 host target proteins.

It is further appreciated by one skilled in the art that the mode of translational inhibition illustrated by FIG. 1 with specific reference to translational inhibition exerted by VGAM274 gene, herein designated VGAM GENE, on one or more VGAM274 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM274 is inhibition of expression of host target genes, as part of a novel viral mechanism of attacking a host. Accordingly, utilities of VGAM274 include diagnosis, prevention and treatment of viral infection by Epiphyas Postvittana Nucleopolyhedrovirus. Specific functions, and accordingly utilities, of VGAM274 correlate with, and may be deduced from, the identity of the host target genes which VGAM274 binds and inhibits, and the function of these host target genes, as elaborated hereinbelow.

Nucleotide sequences of the VGAM274 precursor RNA, herein designated VGAM PRECURSOR RNA, and of the 'diced' VGAM274 RNA, herein designated VGAM RNA, and a schematic representation of the secondary folding of VGAM274 folded precursor RNA, herein designated VGAM FOLDED PRECURSOR RNA, of VGAM274 are further described hereinbelow with reference to Table 1.

Nucleotide sequences of host target binding sites, such as BINDING SITE-I, BINDING SITE-II and BINDING SITE-III of FIG. 1, found on VGAM274 host target RNA, and schematic representation of the complementarity of each of these host target binding sites to VGAM274 RNA, herein designated VGAM RNA, are described hereinbelow with reference to Table 2.

As mentioned hereinabove with reference to FIG. 1, a function of VGAM274 gene, herein designated VGAM is inhibition of expression of VGAM274 target genes. It is appreciated that specific functions, and accordingly utilities, of VGAM274 correlate with, and may be deduced from, the identity of the target genes which VGAM274 binds and inhibits, and the function of these target genes, as elaborated hereinbelow.

SRB7 Suppressor of RNA Polymerase B Homolog (yeast) (SURB7, Accession NM_004264) is a VGAM274 host target gene. SURB7 BINDING SITE is HOST TARGET binding site found in the 3' untranslated region of mRNA encoded by SURB7, corresponding to a HOST TARGET binding site such as BINDING SITE I, BINDING SITE II or BINDING SITE III. Table 2 illustrates the complementarity of the nucleotide sequences of SURB7 BINDING SITE, designated SEQ ID:10463, to the nucleotide sequence of VGAM274 RNA, herein designated VGAM RNA, also designated SEQ ID:2985.

A function of VGAM274 is therefore inhibition of SRB7 Suppressor of RNA Polymerase B Homolog (yeast) (SURB7, Accession NM_004264). Accordingly, utilities of VGAM274 include diagnosis, prevention and treatment of diseases and clinical conditions associated with SURB7. LOC221035 (Accession XM_167640) is another VGAM274 host target gene. LOC221035 BINDING SITE is HOST TARGET binding site found in the 3' untranslated region of mRNA encoded by LOC221035, corresponding to a HOST TARGET binding site such as BINDING SITE I, BINDING SITE II or BINDING SITE III. Table 2 illustrates the complementarity of the nucleotide sequences of LOC221035 BINDING SITE, designated SEQ ID:44745, to the nucleotide sequence of VGAM274 RNA, herein designated VGAM RNA, also designated SEQ ID:2985.

Another function of VGAM274 is therefore inhibition of LOC221035 (Accession XM_167640). Accordingly, utilities of VGAM274 include diagnosis, prevention and treatment of diseases and clinical conditions associated with LOC221035. LOC221405 (Accession XM_168138) is another VGAM274 host target gene. LOC221405 BINDING SITE is HOST TARGET binding site found in the 5' untranslated region of mRNA encoded by LOC221405, corresponding to a HOST TARGET binding site such as BINDING SITE I, BINDING SITE II or BINDING SITE III. Table 2 illustrates the complementarity of the nucleotide sequences of LOC221405 BINDING SITE, designated SEQ ID:45065, to the nucleotide sequence of VGAM274 RNA, herein designated VGAM RNA, also designated SEQ ID:2985.

Another function of VGAM274 is therefore inhibition of LOC221405 (Accession XM_168138). Accordingly, utilities of VGAM274 include diagnosis, prevention and treatment of diseases and clinical conditions associated with LOC221405. LOC51701 (Accession NM_016231) is another VGAM274 host target gene. LOC51701 BINDING SITE is HOST TARGET binding site found in the 3' untranslated region of mRNA encoded by LOC51701, corresponding to a HOST TARGET binding site such as BINDING SITE I, BINDING SITE II or BINDING SITE III. Table 2 illustrates the complementarity of the nucleotide sequences of LOC51701 BINDING SITE, designated SEQ ID:18344, to the nucleotide sequence of VGAM274 RNA, herein designated VGAM RNA, also designated SEQ ID:2985.

Another function of VGAM274 is therefore inhibition of LOC51701 (Accession NM_016231). Accordingly, utilities of VGAM274 include diagnosis, prevention and treatment of diseases and clinical conditions associated with LOC51701. FIG. 1 further provides a conceptual description of a novel bioinformatically detected viral gene of the present invention, referred to here as Viral Genomic Address Messenger 275 (VGAM275) viral gene, which modulates expression of respective host target genes thereof, the function and utility of which host target genes is known in the art.

VGAM275 is a novel bioinformatically detected regulatory, non protein coding, viral micro RNA (miRNA) gene. The method by which VGAM275 was detected is described hereinabove with reference to FIGS. 1-8.

VGAM275 gene, herein designated VGAM GENE, is a viral gene contained in the genome of Epiphyas Postvittana Nucleopolyhedrovirus. VGAM275 host target gene, herein designated VGAM HOST TARGET GENE, is a human gene contained in the human genome.

VGAM275 gene encodes a VGAM275 precursor RNA, herein designated VGAM PRECURSOR RNA. Similar to other miRNA genes, and unlike most ordinary genes, VGAM275 precursor RNA does not encode a protein. A nucleotide sequence identical or highly similar to the nucleotide sequence of VGAM275 precursor RNA is designated SEQ ID:261, and is provided hereinbelow with reference to the sequence listing part. Nucleotide sequence SEQ ID:261 is located at position 65605 relative to the genome of Epiphyas Postvittana Nucleopolyhedrovirus.

VGAM275 precursor RNA folds onto itself, forming VGAM275 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM275 folded precursor RNA into VGAM275 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM275 RNA is designated SEQ ID:2986, and is provided hereinbelow with reference to the sequence listing part.

VGAM275 host target gene, herein designated VGAM HOST TARGET GENE, encodes a corresponding messenger RNA, VGAM275 host target RNA, herein designated VGAM HOST TARGET RNA. VGAM275 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM275 RNA, herein designated VGAM RNA, binds complementarily to one or more host target binding sites located in untranslated regions of VGAM275 host target RNA, herein designated VGAM HOST TARGET RNA. This complementary binding is due to the fact that the nucleotide sequence of VGAM275 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM275 RNA, herein designated VGAM RNA, may have a different number of host target binding sites in untranslated regions of a VGAM275 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM275 RNA, herein designated VGAM RNA, to host target binding sites on VGAM275 host target RNA, herein designated VGAM HOST TARGET RNA, such as BINDING SITE I, BINDING SITE II and BINDING SITE III, inhibits translation of VGAM275 host target RNA into VGAM275 host target protein, herein designated VGAM HOST TARGET PROTEIN. VGAM host target protein is therefore outlined by a broken line.

It is appreciated that VGAM275 host target gene, herein designated VGAM HOST TARGET GENE, in fact represents a plurality of VGAM275 host target genes. The mRNA of each one of this plurality of VGAM275 host target genes comprises one or more host target binding sites, each having a nucleotide sequence which is at least partly complementary to VGAM275 RNA, herein designated VGAM RNA, and which when bound by VGAM275 RNA causes inhibition of translation of respective one or more VGAM275 host target proteins.

It is further appreciated by one skilled in the art that the mode of translational inhibition illustrated by FIG. 1 with specific reference to translational inhibition exerted by VGAM275 gene, herein designated VGAM GENE, on one or more VGAM275 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM275 is inhibition of expression of host target genes, as part of a novel viral mechanism of attacking a host. Accordingly, utilities of VGAM275 include diagnosis, prevention and treatment of viral infection by Epiphyas Postvittana Nucleopolyhedrovirus. Specific functions, and accordingly utilities, of VGAM275 correlate with, and may be deduced from, the identity of the host target genes which VGAM275 binds and inhibits, and the function of these host target genes, as elaborated hereinbelow.

Nucleotide sequences of the VGAM275 precursor RNA, herein designated VGAM PRECURSOR RNA, and of the 'diced' VGAM275 RNA, herein designated VGAM RNA, and a schematic representation of the secondary folding of VGAM275 folded precursor RNA, herein designated VGAM FOLDED PRECURSOR RNA, of VGAM275 are further described hereinbelow with reference to Table 1.

Nucleotide sequences of host target binding sites, such as BINDING SITE-I, BINDING SITE-II and BINDING SITE-III of FIG. 1, found on VGAM275 host target RNA, and schematic representation of the complementarity of each of these host target binding sites to VGAM275 RNA, herein designated VGAM RNA, are described hereinbelow with reference to Table 2.

As mentioned hereinabove with reference to FIG. 1, a function of VGAM275 gene, herein designated VGAM is inhibition of expression of VGAM275 target genes. It is appreciated that specific functions, and accordingly utilities, of VGAM275 correlate with, and may be deduced from, the identity of the target genes which VGAM275 binds and inhibits, and the function of these target genes, as elaborated hereinbelow.

Solute Carrier Family 9 (sodium/hydrogen exchanger), Isoform 5 (SLC9A5, Accession XM_007868) is a VGAM275 host target gene. SLC9A5 BINDING SITE is HOST TARGET binding site found in the 3' untranslated region of mRNA encoded by SLC9A5, corresponding to a HOST TARGET binding site such as BINDING SITE I, BINDING SITE II or BINDING SITE III. Table 2 illustrates the complementarity of the nucleotide sequences of SLC9A5 BINDING SITE, designated SEQ ID:30066, to the nucleotide sequence of VGAM275 RNA, herein designated VGAM RNA, also designated SEQ ID:2986.

A function of VGAM275 is therefore inhibition of Solute Carrier Family 9 (sodium/hydrogen exchanger), Isoform 5 (SLC9A5, Accession XM_007868). Accordingly, utilities of VGAM275 include diagnosis, prevention and treatment of diseases and clinical conditions associated with SLC9A5. FIG. 1 further provides a conceptual description of a novel bioinformatically detected viral gene of the present invention, referred to here as Viral Genomic Address Messenger 276 (VGAM276) viral gene, which modulates expression of respective host target genes thereof, the function and utility of which host target genes is known in the art.

VGAM276 is a novel bioinformatically detected regulatory, non protein coding, viral micro RNA (miRNA) gene. The method by which VGAM276 was detected is described hereinabove with reference to FIGS. 1-8.

VGAM276 gene, herein designated VGAM GENE, is a viral gene contained in the genome of Epiphyas Postvittana Nucleopolyhedrovirus. VGAM276 host target gene, herein designated VGAM HOST TARGET GENE, is a human gene contained in the human genome.

VGAM276 gene encodes a VGAM276 precursor RNA, herein designated VGAM PRECURSOR RNA. Similar to other miRNA genes, and unlike most ordinary genes, VGAM276 precursor RNA does not encode a protein. A nucleotide sequence identical or highly similar to the nucleotide sequence of VGAM276 precursor RNA is designated SEQ ID:262, and is provided hereinbelow with reference to the sequence listing part. Nucleotide sequence SEQ ID:262 is located at position 19006 relative to the genome of Epiphyas Postvittana Nucleopolyhedrovirus.

VGAM276 precursor RNA folds onto itself, forming VGAM276 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM276 folded precursor RNA into VGAM276 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM276 RNA is designated SEQ ID:2987, and is provided hereinbelow with reference to the sequence listing part.

VGAM276 host target gene, herein designated VGAM HOST TARGET GENE, encodes a corresponding messenger RNA, VGAM276 host target RNA, herein designated VGAM HOST TARGET RNA. VGAM276 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM276 RNA, herein designated VGAM RNA, binds complementarily to one or more host target binding sites located in untranslated regions of VGAM276 host target RNA, herein designated VGAM HOST TARGET RNA. This complementary binding is due to the fact that the nucleotide sequence of VGAM276 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM276 RNA, herein designated VGAM RNA, may have a different number of host target binding sites in untranslated regions of a VGAM276 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM276 RNA, herein designated VGAM RNA, to host target binding sites on VGAM276 host target RNA, herein designated VGAM HOST TARGET RNA, such as BINDING SITE I, BINDING SITE II and BINDING SITE III, inhibits translation of VGAM276 host target RNA into VGAM276 host target protein, herein designated VGAM HOST TARGET PROTEIN. VGAM host target protein is therefore outlined by a broken line.

It is appreciated that VGAM276 host target gene, herein designated VGAM HOST TARGET GENE, in fact represents a plurality of VGAM276 host target genes. The mRNA of each one of this plurality of VGAM276 host target genes comprises one or more host target binding sites, each having a nucleotide sequence which is at least partly complementary to VGAM276 RNA, herein designated VGAM RNA, and which when bound by VGAM276 RNA causes inhibition of translation of respective one or more VGAM276 host target proteins.

It is further appreciated by one skilled in the art that the mode of translational inhibition illustrated by FIG. 1 with specific reference to translational inhibition exerted by VGAM276 gene, herein designated VGAM GENE, on one or more VGAM276 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM276 is inhibition of expression of host target genes, as part of a novel viral mechanism of attacking a host. Accordingly, utilities of VGAM276 include diagnosis, prevention and treatment of viral infection by Epiphyas Postvittana Nucleopolyhedrovirus. Specific functions, and accordingly utilities, of VGAM276 correlate with, and may be deduced from, the identity of the host target genes which VGAM276 binds and inhibits, and the function of these host target genes, as elaborated hereinbelow.

Nucleotide sequences of the VGAM276 precursor RNA, herein designated VGAM PRECURSOR RNA, and of the 'diced' VGAM276 RNA, herein designated VGAM RNA, and a schematic representation of the secondary folding of VGAM276 folded precursor RNA, herein designated VGAM FOLDED PRECURSOR RNA, of VGAM276 are further described hereinbelow with reference to Table 1.

Nucleotide sequences of host target binding sites, such as BINDING SITE-I, BINDING SITE-II and BINDING SITE- III of FIG. 1, found on VGAM276 host target RNA, and schematic representation of the complementarity of each of these host target binding sites to VGAM276 RNA, herein designated VGAM RNA, are described hereinbelow with reference to Table 2.

As mentioned hereinabove with reference to FIG. 1, a function of VGAM276 gene, herein designated VGAM is inhibition of expression of VGAM276 target genes. It is appreciated that specific functions, and accordingly utilities, of VGAM276 correlate with, and may be deduced from, the identity of the target genes which VGAM276 binds and inhibits, and the function of these target genes, as elaborated hereinbelow.

Fibroblast Growth Factor 5 (FGF5, Accession NM_004464) is a VGAM276 host target gene. FGF5 BINDING SITE1 and FGF5 BINDING SITE2 are HOST TARGET binding sites found in untranslated regions of mRNA encoded by FGF5, corresponding to HOST TARGET binding sites such as BINDING SITE I, BINDING SITE II or BINDING SITE III. Table 2 illustrates the complementarity of the nucleotide sequences of FGF5 BINDING SITE1 and FGF5 BINDING SITE2, designated SEQ ID:10773 and SEQ ID:27000 respectively, to the nucleotide sequence of VGAM276 RNA, herein designated VGAM RNA, also designated SEQ ID:2987.

A function of VGAM276 is therefore inhibition of Fibroblast Growth Factor 5 (FGF5, Accession NM_004464), a gene which induces transformation and may regulate neuronal differentiation. Accordingly, utilities of VGAM276 include diagnosis, prevention and treatment of diseases and clinical conditions associated with FGF5. The function of FGF5 has been established by previous studies. Zhan et al. (1988) identified a fifth oncogene related to fibroblast growth factors and termed it FGF5. The other four are FGFA (OMIM Ref. No. 131220), FGFB (OMIM Ref. No. 134920), INT2 (OMIM Ref. No. 164950), and HST (OMIM Ref. No. 164980). FGF5 was discovered when it acquired transforming potential by a DNA rearrangement accompanying transfection of NIH 3T3 cells with human tumor DNA. Two regions of the FGF5 sequence, containing 122 of its 267 amino acid residues, were 40 to 50% homologous to the sequences of the 4 other members of the FGF oncogene family. FGF5, furthermore, was found to have a 3-exon structure typical for members of this family. FGF5 was found to be expressed in neonatal brain and in 3 of 13 human tumor cell lines examined. Nguyen et al. (1988) mapped FGF5 to 4q21 by in situ hybridization. Thus, it is not in the same cluster as the related HST and INT2 genes, which are coamplified in some tumor cells and were found by Nguyen et al. (1988), using pulsed field gel analysis, to be separated by only 40 kb. By polymerase chain reaction (PCR) amplification of target sequences in DNAs from somatic cell hybrids, Dionne et al. (1990) mapped the FGF5 gene to chromosome 4. By in situ chromosomal hybridization, Mattei et al. (1992) demonstrated that the corresponding gene in the mouse is on chromosome 5. Hebert et al. (1994) found that mice homozygous for a null allele of the Fgf5 gene, produced by gene targeting in embryonic stem cells, have abnormally long hair. This phenotype appeared identical to that of mice homozygous for the spontaneous mutation 'angora' (go). The transgenic mutant and the 'gO' mutant failed to complement one another, and exon 1 of Fgf5 was found to be deleted in DNA from go homozygotes. Expression of Fgf5 is detected in hair follicles from wildtype mice and is localized to the outer root sheath during the anagen VI phase of the hair growth cycle. The findings were interpreted as evidence that FGF5 functions as an inhibitor of hair elongation, thus identifying a molecule whose normal function is apparently to regulate one step in the progression of the follicle through the hair growth cycle. It will be of interest to search for mutations in the FGF5 gene in hypertrichosis universalis (145700, 145701) as well as in other forms of hypertrichosis such as hairy elbows (OMIM Ref. No. 139600).

Full details of the abovementioned studies are described in the following publications, the disclosure of which are hereby incorporated by reference:

Zhan, X.; Bates, B.; Hu, X.; Goldfarb, M.: The human FGF-5 oncogene encodes a novel protein related to fibroblast growth factors. Molec. Cell. Biol. 8: 3487-3495, 1988; and Hebert, J. M.; Rosenquist, T.; Gotz, J.; Martin, G. R.: FGF5 as a regulator of the hair growth cycle: evidence from targeted and spontaneous mutations. Cell 78:1017-1025, 1994.

Further studies establishing the function and utilities of FGF5 are found in John Hopkins OMIM database record ID 165190, and in sited publications numbered 698-699, 17 and 700-701 listed in the bibliography section hereinbelow, which are also hereby incorporated by reference. Nuclear Receptor Interacting Protein 1 (NRIP1, Accession XM_009699) is another VGAM276 host target gene. NRIP1 BINDING SITE is HOST TARGET binding site found in the 3' untranslated region of mRNA encoded by NRIP1, corresponding to a HOST TARGET binding site such as BINDING SITE I, BINDING SITE II or BINDING SITE III. Table 2 illustrates the complementarity of the nucleotide sequences of NRIP1 BINDING SITE, designated SEQ ID:30118, to the nucleotide sequence of VGAM276 RNA, herein designated VGAM RNA, also designated SEQ ID:2987.

Another function of VGAM276 is therefore inhibition of Nuclear Receptor Interacting Protein 1 (NRIP1, Accession XM_009699), a gene which modulates transcriptional activation by the estrogen receptor. Accordingly, utilities of VGAM276 include diagnosis, prevention and treatment of diseases and clinical conditions associated with NRIP1. The function of NRIP1 has been established by previous studies. Cavailles et al. (1995) identified the receptor-interacting protein 140 (OMIM Ref. No. RIP140) by virtue of its direct association with a transcriptional activation domain of the estrogen receptor (ESR; 133430) in the presence of estrogen; by fluorescence in situ hybridization with a cDNA clone, they mapped the gene to 21q11. Katsanis et al. (1998) used hybrids, YACs, and PACs to place the RIP140 gene on the physical map of chromosome 21; 21q11 is a gene-poor region.

Full details of the abovementioned studies are described in the following publications, the disclosure of which are hereby incorporated by reference:

Cavailles, V.; Dauvois, S.; Horset, L. F.; Lopez, G.; Hoare, S.; Kushner, P. J.; Parker, M. G.: Nuclear factor RIP140 modulates transcriptional activation by the estrogen receptor. EMBO J. 14:3741-3751, 1995; and Katsanis, N.; Ives, J. H.; Groet, J.; Nizetic, D.; Fisher, E. M. C.: Localisation of receptor interacting protein 140 (RIP140) within 100 kb of D21S13 on 21q11, a gene-poor region of t.

Further studies establishing the function and utilities of NRIP1 are found in John Hopkins OMIM database record ID 602490, and in sited publications numbered 1036-1037 listed in the bibliography section hereinbelow, which are also hereby incorporated by reference. PBX/knotted 1 Homeobox 1 (PKNOX1, Accession NM_004571) is another VGAM276 host target gene. PKNOX1 BINDING SITE is HOST TARGET binding site found in the 3' untranslated region of mRNA encoded by PKNOX1, corresponding to a HOST TARGET binding site such as BINDING SITE I, BINDING SITE II or BINDING SITE III. Table 2 illustrates the complementarity of the nucleotide sequences of PKNOX1 BINDING SITE, designated SEQ ID:10913, to the nucleotide sequence of VGAM276 RNA, herein designated VGAM RNA, also designated SEQ ID:2987.

Another function of VGAM276 is therefore inhibition of PBX/knotted 1 Homeobox 1 (PKNOX1, Accession NM_004571), a gene which may regulate gene expression and control cell differentiation. Accordingly, utilities of VGAM276 include diagnosis, prevention and treatment of diseases and clinical conditions associated with PKNOX1. The function of PKNOX1 has been established by previous studies. As part of developing a transcript map of human chromosome 21, Chen et al. (1997) used exon trapping to identify portions of genes from chromosome 21-specific cosmids. They identified a trapped exon that is identical to a region of the human expressed sequence tag (EST) L12425. Using the exon and EST as probes, they screened human fetal brain and kidney cDNA libraries and cloned the corresponding gene, which encodes a homeodomain-containing polypeptide of 436 amino acids. Chen et al. (1997) used the EST as a probe for Northern analysis and detected transcripts of 2.5 and 5 kb in every human tissue examined, including heart, brain and brain subregions, placenta, lung, liver, muscle, and several fetal tissues. The gene, designated PBX/knotted-1 homeo box-1 (OMIM Ref. No. PKNOX1), has a homeodomain closely related to those of the mammalian PBX family (such as mouse Meis1) and the plant knotted-1 family (involved in plant development). Chen et al. (1997) used PCR amplification, hybridization, and genetic linkage analysis to map PKNOX1 to 21q22.3 between markers D21S212 and D21S25 on YAC350F7. By fluorescence in situ hybridization, Berthelsen et al. (1998) mapped the PKNOX1 gene to human chromosome 21q22.3 and mouse chromosome 17B/C.

Full details of the abovementioned studies are described in the following publications, the disclosure of which are hereby incorporated by reference:

Berthelsen, J.; Viggiano, L.; Schulz, H.; Ferretti, E.; Consalez, G. G.; Rocchi, M.; Blasi, F.: PKNOX1, a gene encoding PREP1, a new regulator of Pbx activity, maps on human chromosome 21q22.3 and murine chromosome 17B/C. Genomics 47:323-324, 1998; and Chen, H.; Rossier, C.; Nakamura, Y.; Lynn, A.; Chakravarti, A.; Antonarakis, S. E.: Cloning of a novel homeobox-containing gene, PKNOX1, and mapping to human chromosome 21q22.3. Genomi.

Further studies establishing the function and utilities of PKNOX1 are found in John Hopkins OMIM database record ID 602100, and in sited publications numbered 8527-8528 listed in the bibliography section hereinbelow, which are also hereby incorporated by reference. TIA1 Cytotoxic Granule-associated RNA Binding Protein (TIA1, Accession NM_022173) is another VGAM276 host target gene. TIA1 BINDING SITE1 and TIA1 BINDING SITE2 are HOST TARGET binding sites found in untranslated regions of mRNA encoded by TIA1, corresponding to HOST TARGET binding sites such as BINDING SITE I, BINDING SITE II or BINDING SITE III. Table 2 illustrates the complementarity of the nucleotide sequences of TIA1 BINDING SITE1 and TIA1 BINDING SITE2, designated SEQ ID:22734 and SEQ ID:22559 respectively, to the nucleotide sequence of VGAM276 RNA, herein designated VGAM RNA, also designated SEQ ID:2987.

Another function of VGAM276 is therefore inhibition of TIA1 Cytotoxic Granule-associated RNA Binding Protein (TIA1, Accession NM_022173), a gene which possesses nucleolytic activity against cytotoxic lymphocyte target cells. Accordingly, utilities of VGAM276 include diagnosis, prevention and treatment of diseases and clinical conditions associated with TIA1. The function of TIA1 has been established by previous studies. Cytolytic lymphocytes (CTLs) are characterized by their inclusion of cytoplasmic granules containing effector molecules that can mediate target cell death. One mechanism of lymphocyte-mediated killing is the induction of target cell apoptosis. Central to this autolytic pathway is the activation of an endogenous endonuclease that degrades target cell DNA. TIA1 is a 15-kD cytoplasmic granule-associated protein whose expression is restricted to CTLs and natural killer cells (Anderson et al., 1990). Upon activation with mitogens or with antibodies reactive with the T-cell receptor complex, the expression of TIA1 greatly increases and 28-, 40-, and 53-kD forms of the protein are induced. Tian et al. (1991) described the cDNA cloning and functional characterization of 2 TIA1 isoforms. By immunoscreening a cytolytic T-cell cDNA expression library with a monoclonal antibody against TIA1, they isolated a 1.6-kb TIA1 cDNA encoding a deduced 146-amino acid protein, referred to as rp15-TIA1, that has an apparent molecular mass of 15 kD by SDS-PAGE. Using the 1.6-kb cDNA to screen a phytohemagglutinin-activated T-cell cDNA library, the authors isolated a 2.2-kb cDNA encoding a deduced 375-amino acid protein, referred to as rp40-TIA1, that has an apparent molecular mass of 40 kD by SDS-PAGE. The 1.6-kb cDNA is identical in sequence to the last 1,618 bp of the 2.2-kb cDNA. The rp40-TIA1 protein contains 3 RNA-binding domains, each with 2 ribonucleoprotein consensus octapeptide sequences, at the N terminus, and a glutamine-rich domain and a lysosomal membrane-targeting motif at the C terminus; the rp15-TIA1 protein contains the glutamine-rich domain and the lysosomal membrane-targeting motif. Tian et al. (1991) suggested that the 15-kD TIA1 isoform may be derived from the 40-kD isoform by proteolytic processing and showed that peripheral blood lymphocytes express a protease capable of specifically cleaving rp40-TIA1, resulting in the release of its 15-kD C terminus. The authors demonstrated that TIA1 is a nucleic acid-binding protein that preferentially recognizes poly (A) homopolymers, and induces DNA fragmentation in permeabilized thymocytes. They suggested that TIA1 may be involved in the induction of apoptosis in CTL targets. Northern blot analysis detected 2.7- and 4.0-kb TIA1 transcripts in lymphocytes and 1.7-, 2.2-, 2.7-, and 4.0-kb TIA1 transcripts in a cytotoxic T-cell clone. Forch et al. (2000) reported that the apoptosis-promoting protein TIA1 regulates alternative pre-mRNA splicing of the Drosophila male-specific lethal-2 gene (Msl2; OMIM Ref. No. 604880) and of the human apoptotic gene FAS (TNFRSF6; 134637). TIA1 associates selectively with pre-mRNAs that contain 5-prime splice sites followed by U-rich sequences. TIA1 binding to the U-rich stretches facilitates 5-prime splice site recognition by U1 snRNP (see OMIM Ref. No. 180740). This activity is critical for activation of the weak 5-prime splice site of Msl2 and for modulating the choice of splice site partner in FAS. Structural and functional similarities with the S. cerevisiae splicing factor Nam8 suggest striking evolutionary conservation of a mechanism of pre-mRNA splicing regulation that controls biologic processes as diverse as meiosis in yeast, dosage compensation in fruit flies, or programmed cell death in human S.

Full details of the abovementioned studies are described in the following publications, the disclosure of which are hereby incorporated by reference:

Tian, Q.; Streuli, M.; Saito, H.; Schlossman, S. F.; Anderson, P.: A polyadenylate binding protein localized to the granules of cytolytic lymphocytes induces DNA fragmentation in target cells. Cell 67:629-639, 1991; and Forch, P.; Puig, O.; Kedersha, N.; Martinez, C.; Granneman, S.; Seraphin, B.; Anderson, P.; Valcarcel, J.: The apoptosis-promoting factor TIA-1 is a regulator of alternative pre-mRNA s.

Further studies establishing the function and utilities of TIA1 are found in John Hopkins OMIM database record ID 603518, and in sited publications numbered 8669-8672 listed in the bibliography section hereinbelow, which are also hereby incorporated by reference. DKFZp434A2417 (Accession XM_038526) is another VGAM276 host target gene. DKFZp434A2417 BINDING SITE is HOST TARGET binding site found in the 3' untranslated region of mRNA encoded by DKFZp434A2417, corresponding to a HOST TARGET binding site such as BINDING SITE I, BINDING SITE II or BINDING SITE III. Table 2 illustrates the complementarity of the nucleotide sequences of DKFZp434A2417 BINDING SITE, designated SEQ ID:32862, to the nucleotide sequence of VGAM276 RNA, herein designated VGAM RNA, also designated SEQ ID:2987.

Another function of VGAM276 is therefore inhibition of DKFZp434A2417 (Accession XM_038526). Accordingly, utilities of VGAM276 include diagnosis, prevention and treatment of diseases and clinical conditions associated with DKFZp434A2417. DKFZp761B1514 (Accession NM_032288) is another VGAM276 host target gene. DKFZp761B1514 BINDING SITE is HOST TARGET binding site found in the 3' untranslated region of mRNA encoded by DKFZp761B1514, corresponding to a HOST TARGET binding site such as BINDING SITE I, BINDING SITE II or BINDING SITE III. Table 2 illustrates the complementarity of the nucleotide sequences of DKFZp761B1514 BINDING SITE, designated SEQ ID:26046, to the nucleotide sequence of VGAM276 RNA, herein designated VGAM RNA, also designated SEQ ID:2987.

Another function of VGAM276 is therefore inhibition of DKFZp761B1514 (Accession NM_032288). Accordingly, utilities of VGAM276 include diagnosis, prevention and treatment of diseases and clinical conditions associated with DKFZp761B1514. FLJ20136 (Accession NM_017684) is another VGAM276 host target gene. FLJ20136 BINDING SITE is HOST TARGET binding site found in the 3' untranslated region of mRNA encoded by FLJ20136, corresponding to a HOST TARGET binding site such as BINDING SITE I, BINDING SITE II or BINDING SITE III. Table 2 illustrates the complementarity of the nucleotide sequences of FLJ20136 BINDING SITE, designated SEQ ID:19228, to the nucleotide sequence of VGAM276 RNA, herein designated VGAM RNA, also designated SEQ ID:2987.

Another function of VGAM276 is therefore inhibition of FLJ20136 (Accession NM_017684). Accordingly, utilities of VGAM276 include diagnosis, prevention and treatment of diseases and clinical conditions associated with FLJ20136. KIAA0410 (Accession NM_014778) is another VGAM276 host target gene. KIAA0410 BINDING SITE is HOST TARGET binding site found in the 3' untranslated region of mRNA encoded by KIAA0410, corresponding to a HOST TARGET binding site such as BINDING SITE I, BINDING SITE II or BINDING SITE III. Table 2 illustrates the complementarity of the nucleotide sequences of KIAA0410 BINDING SITE, designated SEQ ID:16617, to the nucleotide sequence of VGAM276 RNA, herein designated VGAM RNA, also designated SEQ ID:2987.

Another function of VGAM276 is therefore inhibition of KIAA0410 (Accession NM_014778). Accordingly, utilities of VGAM276 include diagnosis, prevention and treatment of diseases and clinical conditions associated with KIAA0410. KIAA1908 (Accession XM_055834) is another VGAM276 host target gene. KIAA1908 BINDING SITE is HOST TARGET binding site found in the 5' untranslated region of mRNA encoded by KIAA1908, corresponding to a HOST TARGET binding site such as BINDING SITE I, BINDING SITE II or BINDING SITE III. Table 2 illustrates the complementarity of the nucleotide sequences of KIAA1908 BINDING SITE, designated SEQ ID:36329, to the nucleotide sequence of VGAM276 RNA, herein designated VGAM RNA, also designated SEQ ID:2987.

Another function of VGAM276 is therefore inhibition of KIAA1908 (Accession XM_055834). Accordingly, utilities of VGAM276 include diagnosis, prevention and treatment of diseases and clinical conditions associated with KIAA1908. Paternally Expressed 10 (PEG10, Accession NM_015068) is another VGAM276 host target gene. PEG10 BINDING SITE is HOST TARGET binding site found in the 3' untranslated region of mRNA encoded by PEG10, corresponding to a HOST TARGET binding site such as BINDING SITE I, BINDING SITE II or BINDING SITE III. Table 2 illustrates the complementarity of the nucleotide sequences of PEG10 BINDING SITE, designated SEQ ID:17427, to the nucleotide sequence of VGAM276 RNA, herein designated VGAM RNA, also designated SEQ ID:2987.

Another function of VGAM276 is therefore inhibition of Paternally Expressed 10 (PEG10, Accession NM_015068). Accordingly, utilities of VGAM276 include diagnosis, prevention and treatment of diseases and clinical conditions associated with PEG10. PHD Finger Protein 7 (PHF7, Accession NM_016483) is another VGAM276 host target gene. PHF7 BINDING SITE is HOST TARGET binding site found in the 5' untranslated region of mRNA encoded by PHF7, corresponding to a HOST TARGET binding site such as BINDING SITE I, BINDING SITE II or BINDING SITE III. Table 2 illustrates the complementarity of the nucleotide sequences of PHF7 BINDING SITE, designated SEQ ID:18580, to the nucleotide sequence of VGAM276 RNA, herein designated VGAM RNA, also designated SEQ ID:2987.

Another function of VGAM276 is therefore inhibition of PHD Finger Protein 7 (PHF7, Accession NM_016483). Accordingly, utilities of VGAM276 include diagnosis, prevention and treatment of diseases and clinical conditions associated with PHF7. Proline-rich Gla (G-carboxyglutamic acid) Polypeptide 1 (PRRG1, Accession NM_000950) is another VGAM276 host target gene. PRRG1 BINDING SITE is HOST TARGET binding site found in the 3' untranslated region of mRNA encoded by PRRG1, corresponding to a HOST TARGET binding site such as BINDING SITE I, BINDING SITE II or BINDING SITE III. Table 2 illustrates the complementarity of the nucleotide sequences of PRRG1 BINDING SITE, designated SEQ ID:6651, to the nucleotide sequence of VGAM276 RNA, herein designated VGAM RNA, also designated SEQ ID:2987.

Another function of VGAM276 is therefore inhibition of Proline-rich Gla (G-carboxyglutamic acid) Polypeptide 1 (PRRG1, Accession NM_000950). Accordingly, utilities of VGAM276 include diagnosis, prevention and treatment of diseases and clinical conditions associated with PRRG1. LOC129198 (Accession XM_072197) is another VGAM276 host target gene. LOC129198 BINDING SITE is HOST TARGET binding site found in the 3' untranslated region of mRNA encoded by LOC129198, corresponding to a HOST TARGET binding site such as BINDING SITE I, BINDING SITE II or BINDING SITE III. Table 2 illustrates the complementarity of the nucleotide sequences of LOC129198 BINDING SITE, designated SEQ ID:37463, to the nucleotide sequence of VGAM276 RNA, herein designated VGAM RNA, also designated SEQ ID:2987.

Another function of VGAM276 is therefore inhibition of LOC129198 (Accession XM_072197). Accordingly, utilities of VGAM276 include diagnosis, prevention and treatment of diseases and clinical conditions associated with LOC129198. LOC145719 (Accession XM_096848) is another VGAM276 host target gene. LOC145719 BINDING SITE is HOST TARGET binding site found in the 5' untranslated region of mRNA encoded by LOC145719, corresponding to a HOST TARGET binding site such as BINDING SITE I, BINDING SITE II or BINDING SITE III. Table 2 illustrates the complementarity of the nucleotide sequences of LOC145719 BINDING SITE, designated SEQ ID:40571, to the nucleotide sequence of VGAM276 RNA, herein designated VGAM RNA, also designated SEQ ID:2987.

Another function of VGAM276 is therefore inhibition of LOC145719 (Accession XM_096848). Accordingly, utilities of VGAM276 include diagnosis, prevention and treatment of diseases and clinical conditions associated with LOC145719. LOC145720 (Accession XM_096846) is another VGAM276 host target gene. LOC145720 BINDING SITE is HOST TARGET binding site found in the 5' untranslated region of mRNA encoded by LOC145720, corresponding to a HOST TARGET binding site such as BINDING SITE I, BINDING SITE II or BINDING SITE III. Table 2 illustrates the complementarity of the nucleotide sequences of LOC145720 BINDING SITE, designated SEQ ID:40561, to the nucleotide sequence of VGAM276 RNA, herein designated VGAM RNA, also designated SEQ ID:2987.

Another function of VGAM276 is therefore inhibition of LOC145720 (Accession XM_096846). Accordingly, utilities of VGAM276 include diagnosis, prevention and treatment of diseases and clinical conditions associated with LOC145720. LOC158295 (Accession XM_098915) is another VGAM276 host target gene. LOC158295 BINDING SITE is HOST TARGET binding site found in the 5' untranslated region of mRNA encoded by LOC158295, corresponding to a HOST TARGET binding site such as BINDING SITE I, BINDING SITE II or BINDING SITE III. Table 2 illustrates the complementarity of the nucleotide sequences of LOC158295 BINDING SITE, designated SEQ ID:41938, to the nucleotide sequence of VGAM276 RNA, herein designated VGAM RNA, also designated SEQ ID:2987.

Another function of VGAM276 is therefore inhibition of LOC158295 (Accession XM_098915). Accordingly, utilities of VGAM276 include diagnosis, prevention and treatment of diseases and clinical conditions associated with LOC158295. LOC197114 (Accession XM_116987) is another VGAM276 host target gene. LOC197114 BINDING SITE is HOST TARGET binding site found in the 5' untranslated region of mRNA encoded by LOC197114, corresponding to a HOST TARGET binding site such as BINDING SITE I, BINDING SITE II or BINDING SITE III. Table 2 illustrates the complementarity of the nucleotide sequences of LOC197114 BINDING SITE, designated SEQ ID:43185, to the nucleotide sequence of VGAM276 RNA, herein designated VGAM RNA, also designated SEQ ID:2987.

Another function of VGAM276 is therefore inhibition of LOC197114 (Accession XM_116987). Accordingly, utilities of VGAM276 include diagnosis, prevention and treatment of diseases and clinical conditions associated with LOC197114. LOC197117 (Accession XM_116989) is another VGAM276 host target gene. LOC197117 BINDING SITE is HOST TARGET binding site found in the 5' untranslated region of mRNA encoded by LOC197117, corresponding to a HOST TARGET binding site such as BINDING SITE I, BINDING SITE II or BINDING SITE III. Table 2 illustrates the complementarity of the nucleotide sequences of LOC197117 BINDING SITE, designated SEQ ID:43194, to the nucleotide sequence of VGAM276 RNA, herein designated VGAM RNA, also designated SEQ ID:2987.

Another function of VGAM276 is therefore inhibition of LOC197117 (Accession XM_116989). Accordingly, utilities of VGAM276 include diagnosis, prevention and treatment of diseases and clinical conditions associated with LOC197117.

FIG. 1 further provides a conceptual description of a novel bioinformatically detected viral gene of the present invention, referred to here as Viral Genomic Address Messenger 277 (VGAM277) viral gene, which modulates expression of respective host target genes thereof, the function and utility of which host target genes is known in the art.

VGAM277 is a novel bioinformatically detected regulatory, non protein coding, viral micro RNA (miRNA) gene. The method by which VGAM277 was detected is described hereinabove with reference to FIGS. 1-8.

VGAM277 gene, herein designated VGAM GENE, is a viral gene contained in the genome of Epiphyas Postvittana Nucleopolyhedrovirus. VGAM277 host target gene, herein designated VGAM HOST TARGET GENE, is a human gene contained in the human genome.

VGAM277 gene encodes a VGAM277 precursor RNA, herein designated VGAM PRECURSOR RNA. Similar to other miRNA genes, and unlike most ordinary genes, VGAM277 precursor RNA does not encode a protein. A nucleotide sequence identical or highly similar to the nucleotide sequence of VGAM277 precursor RNA is designated SEQ ID:263, and is provided hereinbelow with reference to the sequence listing part. Nucleotide sequence SEQ ID:263 is located at position 54634 relative to the genome of Epiphyas Postvittana Nucleopolyhedrovirus.

VGAM277 precursor RNA folds onto itself, forming VGAM277 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM277 folded precursor RNA into VGAM277 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM277 RNA is designated SEQ ID:2988, and is provided hereinbelow with reference to the sequence listing part.

VGAM277 host target gene, herein designated VGAM HOST TARGET GENE, encodes a corresponding messenger RNA, VGAM277 host target RNA, herein designated VGAM HOST TARGET RNA. VGAM277 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM277 RNA, herein designated VGAM RNA, binds complementarily to one or more host target binding sites located in untranslated regions of VGAM277 host target RNA, herein designated VGAM HOST TARGET RNA. This complementary binding is due to the fact that the nucleotide sequence of VGAM277 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM277 RNA, herein designated VGAM RNA, may have a different number of host target binding sites in untranslated regions of a VGAM277 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM277 RNA, herein designated VGAM RNA, to host target binding sites on VGAM277 host target RNA, herein designated VGAM HOST TARGET RNA, such as BINDING SITE I, BINDING SITE II and BINDING SITE III, inhibits translation of VGAM277 host target RNA into VGAM277 host target protein, herein designated VGAM HOST TARGET PROTEIN. VGAM host target protein is therefore outlined by a broken line.

It is appreciated that VGAM277 host target gene, herein designated VGAM HOST TARGET GENE, in fact represents a plurality of VGAM277 host target genes. The mRNA of each one of this plurality of VGAM277 host target genes comprises one or more host target binding sites, each having a nucleotide sequence which is at least partly complementary to VGAM277 RNA, herein designated VGAM RNA, and which when bound by VGAM277 RNA causes inhibition of translation of respective one or more VGAM277 host target proteins.

It is further appreciated by one skilled in the art that the mode of translational inhibition illustrated by FIG. 1 with specific reference to translational inhibition exerted by VGAM277 gene, herein designated VGAM GENE, on one or more VGAM277 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM277 is inhibition of expression of host target genes, as part of a novel viral mechanism of attacking a host. Accordingly, utilities of VGAM277 include diagnosis, prevention and treatment of viral infection by Epiphyas Postvittana Nucleopolyhedrovirus. Specific functions, and accordingly utilities, of VGAM277 correlate with, and may be deduced from, the identity of the host target genes which VGAM277 binds and inhibits, and the function of these host target genes, as elaborated hereinbelow.

Nucleotide sequences of the VGAM277 precursor RNA, herein designated VGAM PRECURSOR RNA, and of the 'diced' VGAM277 RNA, herein designated VGAM RNA, and a schematic representation of the secondary folding of VGAM277 folded precursor RNA, herein designated VGAM FOLDED PRECURSOR RNA, of VGAM277 are further described hereinbelow with reference to Table 1.

Nucleotide sequences of host target binding sites, such as BINDING SITE-I, BINDING SITE-II and BINDING SITE-III of FIG. 1, found on VGAM277 host target RNA, and schematic representation of the complementarity of each of these host target binding sites to VGAM277 RNA, herein designated VGAM RNA, are described hereinbelow with reference to Table 2.

As mentioned hereinabove with reference to FIG. 1, a function of VGAM277 gene, herein designated VGAM is inhibition of expression of VGAM277 target genes. It is appreciated that specific functions, and accordingly utilities, of VGAM277 correlate with, and may be deduced from, the identity of the target genes which VGAM277 binds and inhibits, and the function of these target genes, as elaborated hereinbelow.

DNA (cytosine-5-)-methyltransferase 2 (DNMT2, Accession NM_004412) is a VGAM277 host target gene. DNMT2 BINDING SITE is HOST TARGET binding site found in the 3' untranslated region of mRNA encoded by DNMT2, corresponding to a HOST TARGET binding site such as BINDING SITE I, BINDING SITE II or BINDING SITE III. Table 2 illustrates the complementarity of the nucleotide sequences of DNMT2 BINDING SITE, designated SEQ ID:10673, to the nucleotide sequence of VGAM277 RNA, herein designated VGAM RNA, also designated SEQ ID:2988.

A function of VGAM277 is therefore inhibition of DNA (cytosine-5-)-methyltransferase 2 (DNMT2, Accession NM_004412), a gene which may mark specific sequences in the genome. Accordingly, utilities of VGAM277 include diagnosis, prevention and treatment of diseases and clinical conditions associated with DNMT2. The function of DNMT2 and its association with various diseases and clinical conditions, has been established by previous studies, as described hereinabove with reference to VGAM177. ELL (Accession NM_006532) is another VGAM277 host target gene. ELL BINDING SITE is HOST TARGET binding site found in the 3' untranslated region of mRNA encoded by ELL, corresponding to a HOST TARGET binding site such as BINDING SITE I, BINDING SITE II or BINDING SITE III. Table 2 illustrates the complementarity of the nucleotide sequences of ELL BINDING SITE, designated SEQ ID:13281, to the nucleotide sequence of VGAM277 RNA, herein designated VGAM RNA, also designated SEQ ID:2988.

Another function of VGAM277 is therefore inhibition of ELL (Accession NM_006532). Accordingly, utilities of VGAM277 include diagnosis, prevention and treatment of diseases and clinical conditions associated with ELL. Mitogen-activated Protein Kinase Kinase Kinase 7 Interacting Protein 2 (MAP3K7IP2, Accession NM_015093) is another VGAM277 host target gene. MAP3K7IP2 BINDING SITE is HOST TARGET binding site found in the 3' untranslated region of mRNA encoded by MAP3K7IP2, corresponding to a HOST TARGET binding site such as BINDING SITE I, BINDING SITE II or BINDING SITE III. Table 2 illustrates the complementarity of the nucleotide sequences of MAP3K7IP2 BINDING SITE, designated SEQ ID:17489, to the nucleotide sequence of VGAM277 RNA, herein designated VGAM RNA, also designated SEQ ID:2988.

Another function of VGAM277 is therefore inhibition of Mitogen-activated Protein Kinase Kinase Kinase 7 Interacting Protein 2 (MAP3K7IP2, Accession NM_015093). Accordingly, utilities of VGAM277 include diagnosis, prevention and treatment of diseases and clinical conditions associated with MAP3K7IP2. Mitochondrial Ribosomal Protein L49 (MRPL49, Accession XM_045499) is another VGAM277 host target gene. MRPL49 BINDING SITE is HOST TARGET binding site found in the 3' untranslated region of mRNA encoded by MRPL49, corresponding to a HOST TARGET binding site such as BINDING SITE I, BINDING SITE II or BINDING SITE III. Table 2 illustrates the complementarity of the nucleotide sequences of MRPL49 BINDING SITE, designated SEQ ID:34477, to the nucleotide sequence of VGAM277 RNA, herein designated VGAM RNA, also designated SEQ ID:2988.

Another function of VGAM277 is therefore inhibition of Mitochondrial Ribosomal Protein L49 (MRPL49, Accession XM_045499). Accordingly, utilities of VGAM277 include diagnosis, prevention and treatment of diseases and clinical conditions associated with MRPL49. Wolf-Hirschhorn Syndrome Candidate 1 (WHSC1, Accession NM_007331) is another VGAM277 host target gene. WHSC1 BINDING SITE is HOST TARGET binding site found in the 3' untranslated region of mRNA encoded by WHSC1, corresponding to a HOST TARGET binding site such as BINDING SITE I, BINDING SITE II or BINDING SITE III. Table 2 illustrates the complementarity of the nucleotide sequences of WHSC1 BINDING SITE, designated SEQ ID:14248, to the nucleotide sequence of VGAM277 RNA, herein designated VGAM RNA, also designated SEQ ID:2988.

Another function of VGAM277 is therefore inhibition of Wolf-Hirschhorn Syndrome Candidate 1 (WHSC1, Accession NM_007331), a gene which binds covalently to and repairs g/t mismatches. Accordingly, utilities of VGAM277 include diagnosis, prevention and treatment of diseases and clinical conditions associated with WHSC1. The function of WHSC1 and its association with various diseases and clinical conditions, has been established by previous studies, as described hereinabove with reference to VGAM200. CGI-203 (Accession NM_020408) is another VGAM277 host target gene. CGI-203 BINDING SITE is HOST TARGET binding site found in the 5' untranslated region of mRNA encoded by CGI-203, corresponding to a HOST TARGET binding site such as BINDING SITE I, BINDING SITE II or BINDING SITE III. Table 2 illustrates the complementarity of the nucleotide sequences of CGI-203 BINDING SITE, designated SEQ ID:21676, to the nucleotide sequence of VGAM277 RNA, herein designated VGAM RNA, also designated SEQ ID:2988.

Another function of VGAM277 is therefore inhibition of CGI-203 (Accession NM_020408). Accordingly, utilities of VGAM277 include diagnosis, prevention and treatment of diseases and clinical conditions associated with CGI-203. CCR4-NOT Transcription Complex, Subunit 8 (CNOT8, Accession NM_004779) is another VGAM277 host target gene. CNOT8 BINDING SITE is HOST TARGET binding site found in the 3' untranslated region of mRNA encoded by CNOT8, corresponding to a HOST TARGET binding site such as BINDING SITE I, BINDING SITE II or BINDING SITE III. Table 2 illustrates the complementarity of the nucleotide sequences of CNOT8 BINDING SITE, designated SEQ ID:11178, to the nucleotide sequence of VGAM277 RNA, herein designated VGAM RNA, also designated SEQ ID:2988.

Another function of VGAM277 is therefore inhibition of CCR4-NOT Transcription Complex, Subunit 8 (CNOT8, Accession NM_004779). Accordingly, utilities of VGAM277 include diagnosis, prevention and treatment of diseases and clinical conditions associated with CNOT8. FLJ21709 (Accession XM_085480) is another VGAM277 host target gene. FLJ21709 BINDING SITE is HOST TARGET binding site found in the 3" untranslated region of mRNA encoded by FLJ21709, corresponding to a HOST TARGET binding site such as BINDING SITE I, BINDING SITE II or BINDING SITE III. Table 2 illustrates the complementarity of the nucleotide sequences of FLJ21709 BINDING SITE, designated SEQ ID:38173, to the nucleotide sequence of VGAM277 RNA, herein designated VGAM RNA, also designated SEQ ID:2988.

Another function of VGAM277 is therefore inhibition of FLJ21709 (Accession XM_085480). Accordingly, utilities of VGAM277 include diagnosis, prevention and treatment of diseases and clinical conditions associated with FLJ21709. FLJ21939 (Accession NM_022461) is another VGAM277 host target gene. FLJ21939 BINDING SITE is HOST TARGET binding site found in the 3' untranslated region of mRNA encoded by FLJ21939, corresponding to a HOST TARGET binding site such as BINDING SITE I, BINDING SITE II or BINDING SITE III. Table 2 illustrates the complementarity of the nucleotide sequences of FLJ21939 BINDING SITE, designated SEQ ID:22802, to the nucleotide sequence of VGAM277 RNA, herein designated VGAM RNA, also designated SEQ ID:2988.

Another function of VGAM277 is therefore inhibition of FLJ21939 (Accession NM_022461). Accordingly, utilities of VGAM277 include diagnosis, prevention and treatment of diseases and clinical conditions associated with FLJ21939. LOC152503 (Accession XM_098238) is another VGAM277 host target gene. LOC152503 BINDING SITE is HOST TARGET binding site found in the 3' untranslated region of mRNA encoded by LOC152503, corresponding to a HOST TARGET binding site such as BINDING SITE I, BINDING SITE II or BINDING SITE III. Table 2 illustrates the complementarity of the nucleotide sequences of LOC152503 BINDING SITE, designated SEQ ID:41519, to the nucleotide sequence of VGAM277 RNA, herein designated VGAM RNA, also designated SEQ ID:2988.

Another function of VGAM277 is therefore inhibition of LOC152503 (Accession XM_098238). Accordingly, utilities of VGAM277 include diagnosis, prevention and treatment of diseases and clinical conditions associated with LOC152503. LOC152897 (Accession XM_087555) is another VGAM277 host target gene. LOC152897 BINDING SITE is HOST TARGET binding site found in the 5' untranslated region of mRNA encoded by LOC152897, corresponding to a HOST TARGET binding site such as BINDING SITE I, BINDING SITE II or BINDING SITE III. Table 2 illustrates the complementarity of the nucleotide sequences of LOC152897 BINDING SITE, designated SEQ ID:39328, to the nucleotide sequence of VGAM277 RNA, herein designated VGAM RNA, also designated SEQ ID:2988.

Another function of VGAM277 is therefore inhibition of LOC152897 (Accession XM_087555). Accordingly, utilities of VGAM277 include diagnosis, prevention and treatment of diseases and clinical conditions associated with LOC152897. FIG. 1 further provides a conceptual description of a novel bioinformatically detected viral gene of the present invention, referred to here as Viral Genomic Address Messenger 278 (VGAM278) viral gene, which modulates expression of respective host target genes thereof, the function and utility of which host target genes is known in the art.

VGAM278 is a novel bioinformatically detected regulatory, non protein coding, viral micro RNA (miRNA) gene. The method by which VGAM278 was detected is described hereinabove with reference to FIGS. 1-8.

VGAM278 gene, herein designated VGAM GENE, is a viral gene contained in the genome of Epiphyas Postvittana Nucleopolyhedrovirus. VGAM278 host target gene, herein designated VGAM HOST TARGET GENE, is a human gene contained in the human genome.

VGAM278 gene encodes a VGAM278 precursor RNA, herein designated VGAM PRECURSOR RNA. Similar to other miRNA genes, and unlike most ordinary genes, VGAM278 precursor RNA does not encode a protein. A nucleotide sequence identical or highly similar to the nucleotide sequence of VGAM278 precursor RNA is designated SEQ ID:264, and is provided hereinbelow with reference to the sequence listing part. Nucleotide sequence SEQ ID:264 is located at position 17046 relative to the genome of Epiphyas Postvittana Nucleopolyhedrovirus.

VGAM278 precursor RNA folds onto itself, forming VGAM278 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM278 folded precursor RNA into VGAM278 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 86%) nucleotide sequence of VGAM278 RNA is designated SEQ ID:2989, and is provided hereinbelow with reference to the sequence listing part.

VGAM278 host target gene, herein designated VGAM HOST TARGET GENE, encodes a corresponding messenger RNA, VGAM278 host target RNA, herein designated VGAM HOST TARGET RNA. VGAM278 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM278 RNA, herein designated VGAM RNA, binds complementarily to one or more host target binding sites located in untranslated regions of VGAM278 host target RNA, herein designated VGAM HOST TARGET RNA. This complementary binding is due to the fact that the nucleotide sequence of VGAM278 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM278 RNA, herein designated VGAM RNA, may have a different number of host target binding sites in untranslated regions of a VGAM278 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM278 RNA, herein designated VGAM RNA, to host target binding sites on VGAM278 host target RNA, herein designated VGAM HOST TARGET RNA, such as BINDING SITE I, BINDING SITE II and BINDING SITE III, inhibits translation of VGAM278 host target RNA into VGAM278 host target protein, herein designated VGAM HOST TARGET PROTEIN. VGAM host target protein is therefore outlined by a broken line.

It is appreciated that VGAM278 host target gene, herein designated VGAM HOST TARGET GENE, in fact represents a plurality of VGAM278 host target genes. The mRNA of each one of this plurality of VGAM278 host target genes comprises one or more host target binding sites, each having a nucleotide sequence which is at least partly complementary to VGAM278 RNA, herein designated VGAM RNA, and which when bound by VGAM278 RNA causes inhibition of translation of respective one or more VGAM278 host target proteins.

It is further appreciated by one skilled in the art that the mode of translational inhibition illustrated by FIG. 1 with specific reference to translational inhibition exerted by VGAM278 gene, herein designated VGAM GENE, on one or more VGAM278 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM278 is inhibition of expression of host target genes, as part of a novel viral mechanism of attacking a host. Accordingly, utilities of VGAM278 include diagnosis, prevention and treatment of viral infection by Epiphyas Postvittana Nucleopolyhedrovirus. Specific functions, and accordingly utilities, of VGAM278 correlate with, and may be deduced from, the identity of the host target genes which VGAM278 binds and inhibits, and the function of these host target genes, as elaborated hereinbelow.

Nucleotide sequences of the VGAM278 precursor RNA, herein designated VGAM PRECURSOR RNA, and of the 'diced' VGAM278 RNA, herein designated VGAM RNA, and a schematic representation of the secondary folding of VGAM278 folded precursor RNA, herein designated VGAM FOLDED PRECURSOR RNA, of VGAM278 are further described hereinbelow with reference to Table 1.

Nucleotide sequences of host target binding sites, such as BINDING SITE-I, BINDING SITE-II and BINDING SITE-III of FIG. 1, found on VGAM278 host target RNA, and schematic representation of the complementarity of each of these host target binding sites to VGAM278 RNA, herein designated VGAM RNA, are described hereinbelow with reference to Table 2.

As mentioned hereinabove with reference to FIG. 1, a function of VGAM278 gene, herein designated VGAM is inhibition of expression of VGAM278 target genes. It is appreciated that specific functions, and accordingly utilities, of VGAM278 correlate with, and may be deduced from, the identity of the target genes which VGAM278 binds and inhibits, and the function of these target genes, as elaborated hereinbelow.

Phosphodiesterase 4D, CAMP-specific (phosphodiesterase E3 dunce homolog, Drosophila) (PDE4D, Accession XM_056815) is a VGAM278 host target gene. PDE4D BINDING SITE is HOST TARGET binding site found in the 3' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36426, to the nucleotide sequence of VGAM278 RNA, herein designated VGAM RNA, also designated SEQ ID:2989.

A function of VGAM278 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM278 include diagnosis, prevention and treatment of diseases and clinical conditions associated with PDE4D. The function of PDE4D and its association with various diseases and clinical conditions, has been established by previous studies, as described hereinabove with reference to VGAM180. Transient Receptor Potential Cation Channel, Subfamily C, Member 6 (TRPC6, Accession NM_004621) is another VGAM278 host target gene. TRPC6 BINDING SITE is HOST TARGET binding site found in the 5' untranslated region of mRNA encoded by TRPC6, corresponding to a HOST TARGET binding site such as BINDING SITE I, BINDING SITE II or BINDING SITE III. Table 2 illustrates the complementarity of the nucleotide sequences of TRPC6 BINDING SITE, designated SEQ ID:10977, to the nucleotide sequence of VGAM278 RNA, herein designated VGAM RNA, also designated SEQ ID:2989.

Another function of VGAM278 is therefore inhibition of Transient Receptor Potential Cation Channel, Subfamily C, Member 6 (TRPC6, Accession NM_004621), a gene which has calcium channel activity. Accordingly, utilities of VGAM278 include diagnosis, prevention and treatment of diseases and clinical conditions associated with TRPC6. The function of TRPC6 and its association with various diseases and clinical conditions, has been established by previous studies, as described hereinabove with reference to VGAM25. FIG. 1 further provides a conceptual description of a novel bioinformatically detected viral gene of the present invention, referred to here as Viral Genomic Address Messenger 279 (VGAM279) viral gene, which modulates expression of respective host target genes thereof, the function and utility of which host target genes is known in the art.

VGAM279 is a novel bioinformatically detected regulatory, non protein coding, viral micro RNA (miRNA) gene. The method by which VGAM279 was detected is described hereinabove with reference to FIGS. 1-8.

VGAM279 gene, herein designated VGAM GENE, is a viral gene contained in the genome of Epiphyas Postvittana Nucleopolyhedrovirus. VGAM279 host target gene, herein designated VGAM HOST TARGET GENE, is a human gene contained in the human genome.

VGAM279 gene encodes a VGAM279 precursor RNA, herein designated VGAM PRECURSOR RNA. Similar to other miRNA genes, and unlike most ordinary genes, VGAM279 precursor RNA does not encode a protein. A nucleotide sequence identical or highly similar to the nucleotide sequence of VGAM279 precursor RNA is designated SEQ ID:265, and is provided hereinbelow with reference to the sequence listing part. Nucleotide sequence SEQ ID:265 is located at position 12207 relative to the genome of Epiphyas Postvittana Nucleopolyhedrovirus.

VGAM279 precursor RNA folds onto itself, forming VGAM279 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM279 folded precursor RNA into VGAM279 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM279 RNA is designated SEQ ID:2990, and is provided hereinbelow with reference to the sequence listing part.

VGAM279 host target gene, herein designated VGAM HOST TARGET GENE, encodes a corresponding messenger RNA, VGAM279 host target RNA, herein designated VGAM HOST TARGET RNA. VGAM279 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM279 RNA, herein designated VGAM RNA, binds complementarily to one or more host target binding sites located in untranslated regions of VGAM279 host target RNA, herein designated VGAM HOST TARGET RNA. This complementary binding is due to the fact that the nucleotide sequence of VGAM279 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM279 RNA, herein designated VGAM RNA, may have a different number of host target binding sites in untranslated regions of a VGAM279 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM279 RNA, herein designated VGAM RNA, to host target binding sites on VGAM279 host target RNA, herein designated VGAM HOST TARGET RNA, such as BINDING SITE I, BINDING SITE II and BINDING SITE III, inhibits translation of VGAM279 host target RNA into VGAM279 host target protein, herein designated VGAM HOST TARGET PROTEIN. VGAM host target protein is therefore outlined by a broken line.

It is appreciated that VGAM279 host target gene, herein designated VGAM HOST TARGET GENE, in fact represents a plurality of VGAM279 host target genes. The mRNA of each one of this plurality of VGAM279 host target genes comprises one or more host target binding sites, each having a nucleotide sequence which is at least partly complementary to VGAM279 RNA, herein designated VGAM RNA, and which when bound by VGAM279 RNA causes inhibition of translation of respective one or more VGAM279 host target proteins.

It is further appreciated by one skilled in the art that the mode of translational inhibition illustrated by FIG. 1 with specific reference to translational inhibition exerted by VGAM279 gene, herein designated VGAM GENE, on one or more VGAM279 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM279 is inhibition of expression of host target genes, as part of a novel viral mechanism of attacking a host. Accordingly, utilities of VGAM279 include diagnosis, prevention and treatment of viral infection by Epiphyas Postvittana Nucleopolyhedrovirus. Specific functions, and accordingly utilities, of VGAM279 correlate with, and may be deduced from, the identity of the host target genes which VGAM279 binds and inhibits, and the function of these host target genes, as elaborated hereinbelow.

Nucleotide sequences of the VGAM279 precursor RNA, herein designated VGAM PRECURSOR RNA, and of the 'diced' VGAM279 RNA, herein designated VGAM RNA, and a schematic representation of the secondary folding of VGAM279 folded precursor RNA, herein designated VGAM FOLDED PRECURSOR RNA, of VGAM279 are further described hereinbelow with reference to Table 1.

Nucleotide sequences of host target binding sites, such as BINDING SITE-I, BINDING SITE-II and BINDING SITE-III of FIG. 1, found on VGAM279 host target RNA, and schematic representation of the complementarity of each of these host target binding sites to VGAM279 RNA, herein designated VGAM RNA, are described hereinbelow with reference to Table 2.

As mentioned hereinabove with reference to FIG. 1, a function of VGAM279 gene, herein designated VGAM is inhibition of expression of VGAM279 target genes. It is appreciated that specific functions, and accordingly utilities, of VGAM279 correlate with, and may be deduced from, the identity of the target genes which VGAM279 binds and inhibits, and the function of these target genes, as elaborated hereinbelow.

DEAD/H (Asp-Glu-Ala-Asp/His) Box Polypeptide 6 (RNA helicase, 54 kDa) (DDX6, Accession NM_004397) is a VGAM279 host target gene. DDX6 BINDING SITE is HOST TARGET binding site found in the 3' untranslated region of mRNA encoded by DDX6, corresponding to a HOST TARGET binding site such as BINDING SITE I, BINDING SITE II or BINDING SITE III. Table 2 illustrates the complementarity of the nucleotide sequences of DDX6 BINDING SITE, designated SEQ ID:10647, to the nucleotide sequence of VGAM279 RNA, herein designated VGAM RNA, also designated SEQ ID:2990.

A function of VGAM279 is therefore inhibition of DEAD/H (Asp-Glu-Ala-Asp/His) Box Polypeptide 6 (RNA helicase, 54 kDa) (DDX6, Accession NM_004397), a gene which is putative RNA helicases. Accordingly, utilities of VGAM279 include diagnosis, prevention and treatment of diseases and clinical conditions associated with DDX6. The function of DDX6 and its association with various diseases and clinical conditions, has been established by previous studies, as described hereinabove with reference to VGAM179. Engulfment and Cell Motility 2 (ced-12 homolog, C. elegans) (ELMO2, Accession NM_133171) is another VGAM279 host target gene. ELMO2 BINDING SITE is HOST TARGET binding site found in the 3' untranslated region of mRNA encoded by ELMO2, corresponding to a HOST TARGET binding site such as BINDING SITE I, BINDING SITE II or BINDING SITE III. Table 2 illustrates the complementarity of the nucleotide sequences of ELMO2 BINDING SITE, designated SEQ ID:28395, to the nucleotide sequence of VGAM279 RNA, herein designated VGAM RNA, also designated SEQ ID:2990.

Another function of VGAM279 is therefore inhibition of Engulfment and Cell Motility 2 (ced-12 homolog, C. elegans) (ELMO2, Accession NM_133171). Accordingly, utilities of VGAM279 include diagnosis, prevention and treatment of diseases and clinical conditions associated with ELMO2. Hepatocyte Growth Factor (hepapoietin A; scatter factor) (HGF, Accession XM_168542) is another VGAM279 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45230, to the nucleotide sequence of VGAM279 RNA, herein designated VGAM RNA, also designated SEQ ID:2990.

Another function of VGAM279 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM279 include diagnosis, prevention and treatment of diseases and clinical conditions associated with HGF. The function of HGF and its association with various diseases and clinical conditions, has been established by previous studies, as described hereinabove with reference to VGAM174. Rho GTPase Activating Protein 5 (ARHGAP5, Accession XM_085082) is another VGAM279 host target gene. ARHGAP5 BINDING SITE is HOST TARGET binding site found in the 5' untranslated region of mRNA encoded by ARHGAP5, corresponding to a HOST TARGET binding site such as BINDING SITE I, BINDING SITE II or BINDING SITE III. Table 2 illustrates the complementarity of the nucleotide sequences of ARHGAP5 BINDING SITE, designated SEQ ID:37822, to the nucleotide sequence of VGAM279 RNA, herein designated VGAM RNA, also designated SEQ ID:2990.

Another function of VGAM279 is therefore inhibition of Rho GTPase Activating Protein 5 (ARHGAP5, Accession XM_085082). Accordingly, utilities of VGAM279 include diagnosis, prevention and treatment of diseases and clinical conditions associated with ARHGAP5. DKFZP434P0721 (Accession XM_033181) is another VGAM279 host target gene. DKFZP434P0721 BINDING SITE is HOST TARGET binding site found in the 3' untranslated region of mRNA encoded by DKFZP434P0721, corresponding to a HOST TARGET binding site such as BINDING SITE I, BINDING SITE II or BINDING SITE III. Table 2 illustrates the complementarity of the nucleotide sequences of DKFZP434P0721 BINDING SITE, designated SEQ ID:31872, to the nucleotide sequence of VGAM279 RNA, herein designated VGAM RNA, also designated SEQ ID:2990.

Another function of VGAM279 is therefore inhibition of DKFZP434P0721 (Accession XM_033181). Accordingly, utilities of VGAM279 include diagnosis, prevention and treatment of diseases and clinical conditions associated with DKFZP434P0721. FLJ13189 (Accession NM_024882) is another VGAM279 host target gene. FLJ13189 BINDING SITE is HOST TARGET binding site found in the 3' untranslated region of mRNA encoded by FLJ13189, corresponding to a HOST TARGET binding site such as BINDING SITE I, BINDING SITE II or BINDING SITE III. Table 2 illustrates the complementarity of the nucleotide sequences of FLJ13189 BINDING SITE, designated SEQ ID:24334, to the nucleotide sequence of VGAM279 RNA, herein designated VGAM RNA, also designated SEQ ID:2990.

Another function of VGAM279 is therefore inhibition of FLJ13189 (Accession NM_024882). Accordingly, utilities of VGAM279 include diagnosis, prevention and treatment of diseases and clinical conditions associated with FLJ13189. FLJ20456 (Accession NM_017831) is another VGAM279 host target gene. FLJ20456 BINDING SITE is HOST TARGET binding site found in the 3' untranslated region of mRNA encoded by FLJ20456, corresponding to a HOST TARGET binding site such as BINDING SITE I, BINDING SITE II or BINDING SITE III. Table 2 illustrates the complementarity of the nucleotide sequences of FLJ20456 BINDING SITE, designated SEQ ID:19494, to the nucleotide sequence of VGAM279 RNA, herein designated VGAM RNA, also designated SEQ ID:2990.

Another function of VGAM279 is therefore inhibition of FLJ20456 (Accession NM_017831). Accordingly, utilities of VGAM279 include diagnosis, prevention and treatment of diseases and clinical conditions associated with FLJ20456. FLJ20695 (Accession NM_017929) is another VGAM279 host target gene. FLJ20695 BINDING SITE is HOST TARGET binding site found in the 3' untranslated region of mRNA encoded by FLJ20695, corresponding to a HOST TARGET binding site such as BINDING SITE I, BINDING SITE II or BINDING SITE III. Table 2 illustrates the complementarity of the nucleotide sequences of FLJ20695 BINDING SITE, designated SEQ ID:19613, to the nucleotide sequence of VGAM279 RNA, herein designated VGAM RNA, also designated SEQ ID:2990.

Another function of VGAM279 is therefore inhibition of FLJ20695 (Accession NM_017929). Accordingly, utilities of VGAM279 include diagnosis, prevention and treatment of diseases and clinical conditions associated with FLJ20695. KIAA1754 (Accession XM_032587) is another VGAM279 host target gene. KIAA1754 BINDING SITE is HOST TARGET binding site found in the 3' untranslated region of mRNA encoded by KIAA1754, corresponding to a HOST TARGET binding site such as BINDING SITE I, BINDING SITE II or BINDING SITE III. Table 2 illustrates the complementarity of the nucleotide sequences of KIAA1754 BINDING SITE, designated SEQ ID:31682, to the nucleotide sequence of VGAM279 RNA, herein designated VGAM RNA, also designated SEQ ID:2990.

Another function of VGAM279 is therefore inhibition of KIAA1754 (Accession XM_032587). Accordingly, utilities of VGAM279 include diagnosis, prevention and treatment of diseases and clinical conditions associated with KIAA1754. Nucleosome Assembly Protein 1-like 2 (NAP1L2, Accession NM_021963) is another VGAM279 host target gene. NAP1L2 BINDING SITE is HOST TARGET binding site found in the 3' untranslated region of mRNA encoded by NAP1L2, corresponding to a HOST TARGET binding site such as BINDING SITE I, BINDING SITE II or BINDING SITE III. Table 2 illustrates the complementarity of the nucleotide sequences of NAP1L2 BINDING SITE, designated SEQ ID:22497, to the nucleotide sequence of VGAM279 RNA, herein designated VGAM RNA, also designated SEQ ID:2990.

Another function of VGAM279 is therefore inhibition of Nucleosome Assembly Protein 1-like 2 (NAP1L2, Accession NM_021963). Accordingly, utilities of VGAM279 include diagnosis, prevention and treatment of diseases and clinical conditions associated with NAP1L2. LOC150159 (Accession NM_139173) is another VGAM279 host target gene. LOC150159 BINDING SITE is HOST TARGET binding site found in the 3' untranslated region of mRNA encoded by LOC150159, corresponding to a HOST TARGET binding site such as BINDING SITE I, BINDING SITE II or BINDING SITE III. Table 2 illustrates the complementarity of the nucleotide sequences of LOC150159 BINDING SITE, designated SEQ ID:29182, to the nucleotide sequence of VGAM279 RNA, herein designated VGAM RNA, also designated SEQ ID:2990.

Another function of VGAM279 is therefore inhibition of LOC150159 (Accession NM_139173). Accordingly, utilities of VGAM279 include diagnosis, prevention and treatment of diseases and clinical conditions associated with LOC150159. LOC164714 (Accession XM_104657) is another VGAM279 host target gene. LOC164714 BINDING SITE is HOST TARGET binding site found in the 3' untranslated region of mRNA encoded by LOC164714, corresponding to a HOST TARGET binding site such as BINDING SITE I, BINDING SITE II or BINDING SITE III. Table 2 illustrates the complementarity of the nucleotide sequences of LOC164714 BINDING SITE, designated SEQ ID:42180, to the nucleotide sequence of VGAM279 RNA, herein designated VGAM RNA, also designated SEQ ID:2990.

Another function of VGAM279 is therefore inhibition of LOC164714 (Accession XM_104657). Accordingly, utilities of VGAM279 include diagnosis, prevention and treatment of diseases and clinical conditions associated with LOC164714. LOC196485 (Accession XM_113731) is another VGAM279 host target gene. LOC196485 BINDING SITE is HOST TARGET binding site found in the 3' untranslated region of mRNA encoded by LOC196485, corresponding to a HOST TARGET binding site such as BINDING SITE I, BINDING SITE II or BINDING SITE III. Table 2 illustrates the complementarity of the nucleotide sequences of LOC196485 BINDING SITE, designated SEQ ID:42383, to the nucleotide sequence of VGAM279 RNA, herein designated VGAM RNA, also designated SEQ ID:2990.

Another function of VGAM279 is therefore inhibition of LOC196485 (Accession XM_113731). Accordingly, utilities of VGAM279 include diagnosis, prevention and treatment of diseases and clinical conditions associated with LOC196485. LOC199858 (Accession XM_114040) is another VGAM279 host target gene. LOC199858 BINDING SITE is HOST TARGET binding site found in the 5' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42636, to the nucleotide sequence of VGAM279 RNA, herein designated VGAM RNA, also designated SEQ ID:2990.

Another function of VGAM279 is therefore inhibition of LOC199858 (Accession XM_114040). Accordingly, utilities of VGAM279 include diagnosis, prevention and treatment of diseases and clinical conditions associated with LOC199858. LOC202986 (Accession XM_117489) is another VGAM279 host target gene. LOC202986 BINDING SITE is HOST TARGET binding site found in the 3' untranslated region of mRNA encoded by LOC202986, corresponding to a HOST TARGET binding site such as BINDING SITE I, BINDING SITE II or BINDING SITE III. Table 2 illustrates the complementarity of the nucleotide sequences of LOC202986 BINDING SITE, designated SEQ ID:43474, to the nucleotide sequence of VGAM279 RNA, herein designated VGAM RNA, also designated SEQ ID:2990.

Another function of VGAM279 is therefore inhibition of LOC202986 (Accession XM_117489). Accordingly, utilities of VGAM279 include diagnosis, prevention and treatment of diseases and clinical conditions associated with LOC202986. LOC222060 (Accession XM_168427) is another VGAM279 host target gene. LOC222060 BINDING SITE is HOST TARGET binding site found in the 5' untranslated region of mRNA encoded by LOC222060, corresponding to a HOST TARGET binding site such as BINDING SITE I, BINDING SITE II or BINDING SITE III. Table 2 illustrates the complementarity of the nucleotide sequences of LOC222060 BINDING SITE, designated SEQ ID:45159, to the nucleotide sequence of VGAM279 RNA, herein designated VGAM RNA, also designated SEQ ID:2990.

Another function of VGAM279 is therefore inhibition of LOC222060 (Accession XM_168427). Accordingly, utilities of VGAM279 include diagnosis, prevention and treatment of diseases and clinical conditions associated with LOC222060. LOC222160 (Accession XM_168431) is another VGAM279 host target gene. LOC222160 BINDING SITE is HOST TARGET binding site found in the 5' untranslated region of mRNA encoded by LOC222160, corresponding to a HOST TARGET binding site such as BINDING SITE I, BINDING SITE II or BINDING SITE III. Table 2 illustrates the complementarity of the nucleotide sequences of LOC222160 BINDING SITE, designated SEQ ID:45168, to the nucleotide sequence of VGAM279 RNA, herein designated VGAM RNA, also designated SEQ ID:2990.

Another function of VGAM279 is therefore inhibition of LOC222160 (Accession XM_168431). Accordingly, utilities of VGAM279 include diagnosis, prevention and treatment of diseases and clinical conditions associated with LOC222160. FIG. 1 further provides a conceptual description of a novel bioinformatically detected viral gene of the present invention, referred to here as Viral Genomic Address Messenger 280 (VGAM280) viral gene, which modulates expression of respective host target genes thereof, the function and utility of which host target genes is known in the art.

VGAM280 is a novel bioinformatically detected regulatory, non protein coding, viral micro RNA (miRNA) gene. The method by which VGAM280 was detected is described hereinabove with reference to FIGS. 1-8.

VGAM280 gene, herein designated VGAM GENE, is a viral gene contained in the genome of Epiphyas Postvittana Nucleopolyhedrovirus. VGAM280 host target gene, herein designated VGAM HOST TARGET GENE, is a human gene contained in the human genome.

VGAM280 gene encodes a VGAM280 precursor RNA, herein designated VGAM PRECURSOR RNA. Similar to other miRNA genes, and unlike most ordinary genes, VGAM280 precursor RNA does not encode a protein. A nucleotide sequence identical or highly similar to the nucleotide sequence of VGAM280 precursor RNA is designated SEQ ID:266, and is provided hereinbelow with reference to the sequence listing part. Nucleotide sequence SEQ ID:266 is located at position 110345 relative to the genome of Epiphyas Postvittana Nucleopolyhedrovirus.

VGAM280 precursor RNA folds onto itself, forming VGAM280 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM280 folded precursor RNA into VGAM280 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM280 RNA is designated SEQ ID:2991, and is provided hereinbelow with reference to the sequence listing part.

VGAM280 host target gene, herein designated VGAM HOST TARGET GENE, encodes a corresponding messenger RNA, VGAM280 host target RNA, herein designated VGAM HOST TARGET RNA. VGAM280 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM280 RNA, herein designated VGAM RNA, binds complementarily to one or more host target binding sites located in untranslated regions of VGAM280 host target RNA, herein designated VGAM HOST TARGET RNA. This complementary binding is due to the fact that the nucleotide sequence of VGAM280 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM280 RNA, herein designated VGAM RNA, may have a different number of host target binding sites in untranslated regions of a VGAM280 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM280 RNA, herein designated VGAM RNA, to host target binding sites on VGAM280 host target RNA, herein designated VGAM HOST TARGET RNA, such as BINDING SITE I, BINDING SITE II and BINDING SITE III, inhibits translation of VGAM280 host target RNA into VGAM280 host target protein, herein designated VGAM HOST TARGET PROTEIN. VGAM host target protein is therefore outlined by a broken line.

It is appreciated that VGAM280 host target gene, herein designated VGAM HOST TARGET GENE, in fact represents a plurality of VGAM280 host target genes. The mRNA of each one of this plurality of VGAM280 host target genes comprises one or more host target binding sites, each having a nucleotide sequence which is at least partly complementary to VGAM280 RNA, herein designated VGAM RNA, and which when bound by VGAM280 RNA causes inhibition of translation of respective one or more VGAM280 host target proteins.

It is further appreciated by one skilled in the art that the mode of translational inhibition illustrated by FIG. 1 with specific reference to translational inhibition exerted by VGAM280 gene, herein designated VGAM GENE, on one or more VGAM280 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM280 is inhibition of expression of host target genes, as part of a novel viral mechanism of attacking a host. Accordingly, utilities of VGAM280 include diagnosis, prevention and treatment of viral infection by Epiphyas Postvittana Nucleopolyhedrovirus. Specific functions, and accordingly utilities, of VGAM280 correlate with, and may be deduced from, the identity of the host target genes which VGAM280 binds and inhibits, and the function of these host target genes, as elaborated hereinbelow.

Nucleotide sequences of the VGAM280 precursor RNA, herein designated VGAM PRECURSOR RNA, and of the 'diced' VGAM280 RNA, herein designated VGAM RNA, and a schematic representation of the secondary folding of VGAM280 folded precursor RNA, herein designated VGAM FOLDED PRECURSOR RNA, of VGAM280 are further described hereinbelow with reference to Table 1.

Nucleotide sequences of host target binding sites, such as BINDING SITE-I, BINDING SITE-II and BINDING SITE-III of FIG. 1, found on VGAM280 host target RNA, and schematic representation of the complementarity of each of these host target binding sites to VGAM280 RNA, herein designated VGAM RNA, are described hereinbelow with reference to Table 2.

As mentioned hereinabove with reference to FIG. 1, a function of VGAM280 gene, herein designated VGAM is inhibition of expression of VGAM280 target genes. It is appreciated that specific functions, and accordingly utilities, of VGAM280 correlate with, and may be deduced from, the identity of the target genes which VGAM280 binds and inhibits, and the function of these target genes, as elaborated hereinbelow.

DNA (cytosine-5-)-methyltransferase 3 Beta (DNMT3B, Accession NM_006892) is a VGAM280 host target gene. DNMT3B BINDING SITE is HOST TARGET binding site found in the 5' untranslated region of mRNA encoded by DNMT3B, corresponding to a HOST TARGET binding site such as BINDING SITE I, BINDING SITE II or BINDING SITE III. Table 2 illustrates the complementarity of the nucleotide sequences of DNMT3B BINDING SITE, designated SEQ ID:13764, to the nucleotide sequence of VGAM280 RNA, herein designated VGAM RNA, also designated SEQ ID:2991.

A function of VGAM280 is therefore inhibition of DNA (cytosine-5-)-methyltransferase 3 Beta (DNMT3B, Accession NM_006892), a gene which is required for genome wide de novo methylation. Accordingly, utilities of VGAM280 include diagnosis, prevention and treatment of diseases and clinical conditions associated with DNMT3B. The function of DNMT3B has been established by previous studies. Ehrlich et al. (2001) performed microarray expression analysis on B-cell lymphoblastoid cell lines from 5 ICF patients with diverse DNMT3B mutations and on control lymphoblastoid cell lines. They employed oligonucleotide arrays for approximately 5600 different genes, 510 of which showed a lymphoid lineage-restricted expression pattern among several different lineages tested. A set of 32 genes, half of which are thought to play a role in immune function, had consistent and significant ICF-specific changes in RNA levels. ICF-specific increases in immunoglobulin (Ig) heavy constant mu- and delta-RNA and cell surface IgM and IgD, decreases in Ig-gamma and Ig-alpha RNA, and surface IgG and IgA suggested inhibition of the later steps of lymphocyte maturation. ICF-specific increases were seen in RNA for RGS1 (OMIM Ref. No. 600323), a B-cell specific inhibitor of G-protein signaling implicated in negative regulation of B-cell migration, and in RNA for the proapoptotic protein kinase C eta gene (OMIM Ref. No. 605437). ICF-associated decreases were observed in RNAs encoding proteins involved in activation, migration, or survival of lymphoid cells, namely, transcription factor negative regulator ID3 (OMIM Ref. No. 600277), the enhancer-binding MEF2C (OMIM Ref. No. 600662), the iron regulatory TFRC (OMIM Ref. No. 190010), integrin beta-7 (ITGB7; 147559), the stress protein heme oxygenase (HMOX1; 141250), and the lymphocyte-specific tumor necrosis factor receptor family members 7 and 17 (TNFRSF7, 186711; TNFRSF17, 109545). No differences in promoter methylation were seen between ICF and normal lymphoblastoid cell lines for 3 ICF upregulated genes and 1 downregulated gene by a quantitative methylation assay. The authors hypothesized that DNMT3B mutations in the ICF syndrome may cause lymphogenesis-associated gene dysregulation by indirect effects on gene expression that interfere with normal lymphocyte signaling, maturation, and migration. Shirohzu et al. (2002) reported 3 Japanese cases of ICF syndrome from 2 unrelated families. All patients had typical facial dysmorphism and IgA deficiency, but none of them had apparent mental retardation. Cytogenetic analysis of peripheral blood lymphocytes showed chromosomal abnormalities, including multiradial configurations and a stretching of the pericentromeric heterochromatin of chromosomes 1 and 16. Hypomethylation of classical satellite-2 DNA was also observed. Three mutations in DNMT3B were found. One patient was a compound heterozygote for a gln42-to-ter (Q42X; 602900.0011) and an arg832-to-gln (R832Q; 602900.0012) mutation. The 2 patients from the second family were both homozygous for a ser282-to-pro (S282P; 602900.0013) mutation. Animal model experiments lend further support to the function of DNMT3B. Okano et al. (1999) generated mice with targeted disruption of the Dnmt3a and Dnmt3b genes. Inactivation of both genes blocked de novo methylation in embryonic stem cells and early embryos but had no effect on maintenance of imprinted methylation patterns. Dnmt3a -/- mice developed to term and appeared to be normal at birth. However, most homozygous mutant mice became runted and died at about 4 weeks of age. In contrast, no viable Dnmt3b -/- mice were recovered at birth. Dissection of embryos at different stages of development revealed that Dnmt3b -/- embryos had multiple developmental defects, including growth impairment and rostral neural tube defects with variable severity at later stages of development, though most of them appeared to develop normally before E9.5. Dnmt3a and Dnmt3b also exhibited nonoverlapping functions in development, with Dnmt3b specifically required for methylation of centromeric minor satellite repeats. These results indicated that both Dnmt3a and Dnmt3b are required for genomewide de novo methylation and are essential for mammalian development.

It is appreciated that the abovementioned animal model for DNMT3B is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ehrlich, M.; Buchanan, K. L.; Tsien, F.; Jiang, G.; Sun, B.; Uicker, W.; Weemaes, C. M. R.; Smeets, D.; Sperling, K.; Belohradsky, B. H.; Tommerup, N.; Misek, D. E.; Rouillard, J.-M.; Kuick, R.; Hanash, S. M.: DNA methyltransferase 3B mutations linked to the ICF syndrome cause dysregulation of lymphogenesis genes. Hum. Molec. Genet. 10:2917-2931, 2001; and Rhee, I.; Bachman, K. E.; Park, B. H.; Jair, K.-W.; Yen, R.-W. C.; Schuebel, K. E.; Cui, H.; Feinberg, A. P.; Lengauer, C.; Kinzler, K. W.; Baylin, S. B.; Vogelstein, B.: DNMT1 and DNM.

Further studies establishing the function and utilities of DNMT3B are found in John Hopkins OMIM database record ID 602900, and in sited publications numbered 5910, 5781-5782, 11685, 6216, 1168 and 11686 listed in the bibliography section hereinbelow, which are also hereby incorporated by reference. Mitogen-activated Protein Kinase Kinase Kinase 8 (MAP3K8, Accession NM_005204) is another VGAM280 host target gene. MAP3K8 BINDING SITE is HOST TARGET binding site found in the 5' untranslated region of mRNA encoded by MAP3K8, corresponding to a HOST TARGET binding site such as BINDING SITE I, BINDING SITE II or BINDING SITE III. Table 2 illustrates the complementarity of the nucleotide sequences of MAP3K8 BINDING SITE, designated SEQ ID:11705, to the nucleotide sequence of VGAM280 RNA, herein designated VGAM RNA, also designated SEQ ID:2991.

Another function of VGAM280 is therefore inhibition of Mitogen-activated Protein Kinase Kinase Kinase 8 (MAP3K8, Accession NM_005204), a gene which is able to activate nf-kappa-b 1 by stimulating proteasome- mediated p. Accordingly, utilities of VGAM280 include diagnosis, prevention and treatment of diseases and clinical conditions associated with MAP3K8. The function of MAP3K8 and its association with various diseases and clinical conditions, has been established by previous studies, as described hereinabove with reference to VGAM32.poly (A) Binding Protein, Cytoplasmic 1 (PABPC1, Accession NM_002568) is another VGAM280 host target gene. PABPC1 BINDING SITE is HOST TARGET binding site found in the 5' untranslated region of mRNA encoded by PABPC1, corresponding to a HOST TARGET binding site such as BINDING SITE I, BINDING SITE II or BINDING SITE III. Table 2 illustrates the complementarity of the nucleotide sequences of PABPC1 BINDING SITE, designated SEQ ID:8420, to the nucleotide sequence of VGAM280 RNA, herein designated VGAM RNA, also designated SEQ ID:2991.

Another function of VGAM280 is therefore inhibition of poly (A) Binding Protein, Cytoplasmic 1 (PABPC1, Accession NM_002568), a gene which involves in cytoplasmic regulatory processes of mRNA metabolism. Accordingly, utilities of VGAM280 include diagnosis, prevention and treatment of diseases and clinical conditions associated with PABPC1. The function of PABPC1 has been established by previous studies. The poly (A)-binding protein (PABP), which is found complexed to the 3-prime poly (A) tail of eukaryotic mRNA, is required for poly (A) shortening and translation initiation. Grange et al. (1987) isolated a melanoma cell cDNA encoding human PABP. The predicted 633-amino acid protein contains 4 repeats of an approximately 80-amino acid unit in its N-terminal half. The authors found that this repeat region is highly conserved between human and yeast PABP and is sufficient for poly (A) binding. In vitro translation of the human PABP cDNA yielded a protein with an apparent molecular mass of 73 kD by SDS-PAGE. Northern blot analysis indicated that PABP is expressed as a 2.9-kb mRNA in human melanoma cells. Gorlach et al. (1994) noted that each of the 4 repeats of PABP is a ribonucleoprotein (RNP) consensus sequence RNA-binding domain. They determined that PABP has a pI of approximately 10.3 and is a very abundant, stable protein. Immunofluorescence studies of mammalian cells indicated that PABP is located exclusively in the cytoplasm. However, using both indirect immunofluorescence and tagging of PABP1 by fusion to the green fluorescent protein (GFP), Afonina et al. (1998) demonstrated that PABP1 shuttles between the nucleus and cytoplasm. PABP1 accumulated in the nucleus when transcription was inhibited, suggesting that active transcription is required for nuclear export of PABP1. Deletion mutagenesis showed that the RNA binding ability of PABP1 is important for nuclear retention. Afonina et al. (1998) suggested that PABP1 is involved in nuclear events associated with the formation and transport of mRNP to the cytoplasm. Deo et al. (1999) determined the cocrystal structure of human PABP at 2.6-angstrom resolution. PABP recognizes the 3-prime mRNA poly (A) tail and plays critical roles in eukaryotic translation initiation and mRNA stabilization/degradation. The minimal PABP used by Deo et al. (1999) consisted of the N-terminal 2 RRM-type RNA-binding domains connected by a short linker (collectively referred to as RRM1/2). These 2 RRMs form a continuous RNA-binding trough lined by an antiparallel beta sheet backed by 4 alpha helices. The polyadenylate RNA adopts an extended conformation running the length of the molecular trough. Adenine recognition is primarily mediated by contacts with conserved residues found in the RNP motifs of the 2 RRMs. The convex dorsum of RRM1/2 displays a phylogenetically conserved hydrophobic/acidic portion, which may interact with translation initiation factors and regulatory proteins Full details of the abovementioned studies are described in the following publications, the disclosure of which are hereby incorporated by reference:

Gorlach, M.; Burd, C. G.; Dreyfuss, G.: The mRNA poly (A)-binding protein: localization, abundance, and RNA-binding specificity. Exp. Cell Res. 211:400-407, 1994; and Deo, R. C.; Bonanno, J. B.; Sonenberg, N.; Burley, S. K.: Recognition of polyadenylate RNA by the poly (A)-binding protein. Cell 98:835-845, 1999.

Further studies establishing the function and utilities of PABPC1 are found in John Hopkins OMIM database record ID 604679, and in sited publications numbered 7941-7942, 5300, 7943-794 and 11608 listed in the bibliography section hereinbelow, which are also hereby incorporated by reference. Solute Carrier Family 8 (sodium-calcium exchanger), Member 2 (SLC8A2, Accession XM_038970) is another VGAM280 host target gene. SLC8A2 BINDING SITE is HOST TARGET binding site found in the 3' untranslated region of mRNA encoded by SLC8A2, corresponding to a HOST TARGET binding site such as BINDING SITE I, BINDING SITE II or BINDING SITE III. Table 2 illustrates the complementarity of the nucleotide sequences of SLC8A2 BINDING SITE, designated SEQ ID:32970, to the nucleotide sequence of VGAM280 RNA, herein designated VGAM RNA, also designated SEQ ID:2991.

Another function of VGAM280 is therefore inhibition of Solute Carrier Family 8 (sodium-calcium exchanger), Member 2 (SLC8A2, Accession XM_038970). Accordingly, utilities of VGAM280 include diagnosis, prevention and treatment of diseases and clinical conditions associated with SLC8A2. FLJ13855 (Accession NM_023079) is another VGAM280 host target gene. FLJ13855 BINDING SITE is HOST TARGET binding site found in the 5' untranslated region of mRNA encoded by FLJ13855, corresponding to a HOST TARGET binding site such as BINDING SITE I, BINDING SITE II or BINDING SITE III. Table 2 illustrates the complementarity of the nucleotide sequences of FLJ13855 BINDING SITE, designated SEQ ID:23343, to the nucleotide sequence of VGAM280 RNA, herein designated VGAM RNA, also designated SEQ ID:2991.

Another function of VGAM280 is therefore inhibition of FLJ13855 (Accession NM_023079). Accordingly, utilities of VGAM280 include diagnosis, prevention and treatment of diseases and clinical conditions associated with FLJ13855.

FLJ14431 (Accession NM_032783) is another VGAM280 host target gene. FLJ14431 BINDING SITE is HOST TARGET binding site found in the 3' untranslated region of mRNA encoded by FLJ14431, corresponding to a HOST TARGET binding site such as BINDING SITE I, BINDING SITE II or BINDING SITE III. Table 2 illustrates the complementarity of the nucleotide sequences of FLJ14431 BINDING SITE, designated SEQ ID:26528, to the nucleotide sequence of VGAM280 RNA, herein designated VGAM RNA, also designated SEQ ID:2991.

Another function of VGAM280 is therefore inhibition of FLJ14431 (Accession NM_032783). Accordingly, utilities of VGAM280 include diagnosis, prevention and treatment of diseases and clinical conditions associated with FLJ14431. KIAA0373 (Accession NM_014684) is another VGAM280 host target gene. KIAA0373 BINDING SITE is HOST TARGET binding site found in the 5' untranslated region of mRNA encoded by KIAA0373, corresponding to a HOST TARGET binding site such as BINDING SITE I, BINDING SITE II or BINDING SITE III. Table 2 illustrates the complementarity of the nucleotide sequences of KIAA0373 BINDING SITE, designated SEQ ID:16184, to the nucleotide sequence of VGAM280 RNA, herein designated VGAM RNA, also designated SEQ ID:2991.

Another function of VGAM280 is therefore inhibition of KIAA0373 (Accession NM_014684). Accordingly, utilities of VGAM280 include diagnosis, prevention and treatment of diseases and clinical conditions associated with KIAA0373. Meningioma Expressed Antigen 6 (coiled-coil proline-rich) (MGEA6, Accession NM_005930) is another VGAM280 host target gene. MGEA6 BINDING SITE is HOST TARGET binding site found in the 5' untranslated region of mRNA encoded by MGEA6, corresponding to a HOST TARGET binding site such as BINDING SITE I, BINDING SITE II or BINDING SITE III. Table 2 illustrates the complementarity of the nucleotide sequences of MGEA6 BINDING SITE, designated SEQ ID:12560, to the nucleotide sequence of VGAM280 RNA, herein designated VGAM RNA, also designated SEQ ID:2991.

Another function of VGAM280 is therefore inhibition of Meningioma Expressed Antigen 6 (coiled-coil proline-rich) (MGEA6, Accession NM_005930). Accordingly, utilities of VGAM280 include diagnosis, prevention and treatment of diseases and clinical conditions associated with MGEA6. LOC116349 (Accession XM_057993) is another VGAM280 host target gene. LOC116349 BINDING SITE is HOST TARGET binding site found in the 3' untranslated region of mRNA encoded by LOC116349, corresponding to a HOST TARGET binding site such as BINDING SITE I, BINDING SITE II or BINDING SITE III. Table 2 illustrates the complementarity of the nucleotide sequences of LOC116349 BINDING SITE, designated SEQ ID:36556, to the nucleotide sequence of VGAM280 RNA, herein designated VGAM RNA, also designated SEQ ID:2991.

Another function of VGAM280 is therefore inhibition of LOC116349 (Accession XM_057993). Accordingly, utilities of VGAM280 include diagnosis, prevention and treatment of diseases and clinical conditions associated with LOC116349. FIG. 1 further provides a conceptual description of a novel bioinformatically detected viral gene of the present invention, referred to here as Viral Genomic Address Messenger 281 (VGAM281) viral gene, which modulates expression of respective host target genes thereof, the function and utility of which host target genes is known in the art.

VGAM281 is a novel bioinformatically detected regulatory, non protein coding, viral micro RNA (miRNA) gene. The method by which VGAM281 was detected is described hereinabove with reference to FIGS. 1-8.

VGAM281 gene, herein designated VGAM GENE, is a viral gene contained in the genome of Epiphyas Postvittana Nucleopolyhedrovirus. VGAM281 host target gene, herein designated VGAM HOST TARGET GENE, is a human gene contained in the human genome.

VGAM281 gene encodes a VGAM281 precursor RNA, herein designated VGAM PRECURSOR RNA. Similar to other miRNA genes, and unlike most ordinary genes, VGAM281 precursor RNA does not encode a protein. A nucleotide sequence identical or highly similar to the nucleotide sequence of VGAM281 precursor RNA is designated SEQ ID:267, and is provided hereinbelow with reference to the sequence listing part. Nucleotide sequence SEQ ID:267 is located at position 83939 relative to the genome of Epiphyas Postvittana Nucleopolyhedrovirus.

VGAM281 precursor RNA folds onto itself, forming VGAM281 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM281 folded precursor RNA into VGAM281 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM281 RNA is designated SEQ ID:2992, and is provided hereinbelow with reference to the sequence listing part.

VGAM281 host target gene, herein designated VGAM HOST TARGET GENE, encodes a corresponding messenger RNA, VGAM281 host target RNA, herein designated VGAM HOST TARGET RNA. VGAM281 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM281 RNA, herein designated VGAM RNA, binds complementarily to one or more host target binding sites located in untranslated regions of VGAM281 host target RNA, herein designated VGAM HOST TARGET RNA. This complementary binding is due to the fact that the nucleotide sequence of VGAM281 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM281 RNA, herein designated VGAM RNA, may have a different number of host target binding sites in untranslated regions of a VGAM281 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM281 RNA, herein designated VGAM RNA, to host target binding sites on VGAM281 host target RNA, herein designated VGAM HOST TARGET RNA, such as BINDING SITE I, BINDING SITE II and BINDING SITE III, inhibits translation of VGAM281 host target RNA into VGAM281 host target protein, herein designated VGAM HOST TARGET PROTEIN. VGAM host target protein is therefore outlined by a broken line.

It is appreciated that VGAM281 host target gene, herein designated VGAM HOST TARGET GENE, in fact represents a plurality of VGAM281 host target genes. The mRNA of each one of this plurality of VGAM281 host target genes comprises one or more host target binding sites, each having a nucleotide sequence which is at least partly complementary to VGAM281 RNA, herein designated VGAM RNA, and which when bound by VGAM281 RNA causes inhibition of translation of respective one or more VGAM281 host target proteins.

It is further appreciated by one skilled in the art that the mode of translational inhibition illustrated by FIG. 1 with specific reference to translational inhibition exerted by VGAM281 gene, herein designated VGAM GENE, on one or more VGAM281 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM281 is inhibition of expression of host target genes, as part of a novel viral mechanism of attacking a host. Accordingly, utilities of VGAM281 include diagnosis, prevention and treatment of viral infection by Epiphyas Postvittana Nucleopolyhedrovirus. Specific functions, and accordingly utilities, of VGAM281 correlate with, and may be deduced from, the identity of the host target genes which VGAM281 binds and inhibits, and the function of these host target genes, as elaborated hereinbelow.

Nucleotide sequences of the VGAM281 precursor RNA, herein designated VGAM PRECURSOR RNA, and of the 'diced' VGAM281 RNA, herein designated VGAM RNA, and a schematic representation of the secondary folding of VGAM281 folded precursor RNA, herein designated VGAM FOLDED PRECURSOR RNA, of VGAM281 are further described hereinbelow with reference to Table 1.

Nucleotide sequences of host target binding sites, such as BINDING SITE-I, BINDING SITE-II and BINDING SITE-III of FIG. 1, found on VGAM281 host target RNA, and schematic representation of the complementarity of each of these host target binding sites to VGAM281 RNA, herein designated VGAM RNA, are described hereinbelow with reference to Table 2.

As mentioned hereinabove with reference to FIG. 1, a function of VGAM281 gene, herein designated VGAM is inhibition of expression of VGAM281 target genes. It is appreciated that specific functions, and accordingly utilities, of VGAM281 correlate with, and may be deduced from, the identity of the target genes which VGAM281 binds and inhibits, and the function of these target genes, as elaborated hereinbelow.

CD28 Antigen (Tp44) (CD28, Accession NM_006139) is a VGAM281 host target gene. CD28 BINDING SITE is HOST TARGET binding site found in the 3' untranslated region of mRNA encoded by CD28, corresponding to a HOST TARGET binding site such as BINDING SITE I, BINDING SITE II or BINDING SITE III. Table 2 illustrates the complementarity of the nucleotide sequences of CD28 BINDING SITE, designated SEQ ID:12786, to the nucleotide sequence of VGAM281 RNA, herein designated VGAM RNA, also designated SEQ ID:2992.

A function of VGAM281 is therefore inhibition of CD28 Antigen (Tp44) (CD28, Accession NM_006139), a gene which possibly involved in t-cell activation. Accordingly, utilities of VGAM281 include diagnosis, prevention and treatment of diseases and clinical conditions associated with CD28. The function of CD28 has been established by previous studies. Monoclonal antibodies recognize 3 antigens, CD3 (OMIM Ref. No. 186790), CD2 (OMIM Ref. No. 186990), and CD28 (Tp44), that cause human T cells to proliferate in the presence of phorbol esters. Whereas CD3 appeared to be involved in transduction of the signal generated by antigen binding to the T-cell receptor, the role of the CD2 and CD28 antigens in physiologic proliferation was not understood. Aruffo and Seed (1987) isolated a cDNA clone encoding CD28 by a simple and highly efficient cloning strategy based on transient expression. In COS cells the CD28 encodes a highly glycosylated membrane protein with homology to the immunoglobulin superfamily. Animal model experiments lend further support to the function of CD28. CD28 undergoes tyrosine phosphorylation after interacting with its ligand, B7 (CD80; 112203). Phosphorylation of tyr173 (tyr170 in mouse) in the cytoplasmic domain of CD28 allows the recruitment of signaling proteins such as phosphatidylinositol 3-kinase (see OMIM Ref. No. PIK3R1; 171833), GRB2 (OMIM Ref. No. 108355), and GADS (GRAP2; 604518) via their SH2 domains. Okkenhaug et al. (2001) reconstituted CD28 knockout mice with transgenes encoding wildtype Cd28 or Cd28 carrying a tyr170-to-phe mutation. Mutant Cd28 did not bind to the SH2 domain of PIK3R1, resulting in diminished protein kinase B (OMIM Ref. No. 164730) activation. Mutant Cd28 was able to prevent the induction of anergy, to promote T-cell proliferation and interleukin-2 (IL2; 147680) secretion, and to provide B-cell help, but was unable to upregulate expression of the prosurvival protein BCLXL (OMIM Ref. No. 600039). The defect in BCLXL upregulation was correlated with increased susceptibility of the T cells to gamma radiation. Okkenhaug et al. (2001) suggested that other tyrosine residues or asn172 may be critical to functions not affected by the tyr170-to-phe mutation.

It is appreciated that the abovementioned animal model for CD28 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Aruffo, A.; Seed, B.: Molecular cloning of a CD28 cDNA by a high-efficiency COS cell expression system. Proc. Nat. Acad. Sci. 84:8573-8577, 1987; and Okkenhaug, K.; Wu, L.; Garza, K. M.; La Rose, J.; Khoo, W.; Odermatt, B.; Mak, T. W.; Ohashi, P. S.; Rottapel, R.: A point mutation in CD28 distinguishes proliferative signals from sur.

Further studies establishing the function and utilities of CD28 are found in John Hopkins OMIM database record ID 186760, and in sited publications numbered 5673-435 and 5674-5677 listed in the bibliography section hereinbelow, which are also hereby incorporated by reference. Insulin Receptor Substrate 1 (IRS1, Accession NM_005544) is another VGAM281 host target gene. IRS1 BINDING SITE is HOST TARGET binding site found in the 3' untranslated region of mRNA encoded by IRS1, corresponding to a HOST TARGET binding site such as BINDING SITE I, BINDING SITE II or BINDING SITE III. Table 2 illustrates the complementarity of the nucleotide sequences of IRS1 BINDING SITE, designated SEQ ID:12069, to the nucleotide sequence of VGAM281 RNA, herein designated VGAM RNA, also designated SEQ ID:2992.

Another function of VGAM281 is therefore inhibition of Insulin Receptor Substrate 1 (IRS1, Accession NM_005544), a gene which may mediate the control of various cellular processes by insulin. Accordingly, utilities of VGAM281 include diagnosis, prevention and treatment of diseases and clinical conditions associated with IRS1. The function of IRS1 has been established by previous studies. Sun et al. (1991) isolated cDNAs encoding a 160- to 185-kD phosphotyrosyl protein that is a substrate of the insulin receptor tyrosine kinase and a putative participant in insulin (INS; 176730) signaling. This protein, designated insulin receptor substrate-1 (IRS1), is found in a variety of insulin responsive cells and tissues. It exhibits no intrinsic enzyme activity but is believed to serve as a docking protein involved in binding and activating other signal transduction molecules after being phosphorylated on tyrosine by the insulin receptor kinase Almind et al. (1996) examined insulin-stimulated processes in a cultured myeloid progenitor cell stably overexpressing the insulin receptor when transfected with either wildtype human IRS1 or the gly972-to-arg common variant (numbering according to Nishiyama and Wands, 1992). They showed that the mutation in codon 972 of the IRS1 gene impairs insulin-stimulated signaling, especially along the phosphatidylinositol 3-kinase (OMIM Ref. No. 171834) pathway, and may contribute to insulin resistance in normal and diabetic populations. Animal model experiments lend further support to the function of IRS1. Clancy et al. (2001) found that mutation of chico extends fruit fly lifespan by up to 48% in homozygotes and 36% in heterozygotes. Extension of lifespan was not a result of impaired oogenesis in chico females, nor was it consistently correlated with increased stress resistance. The dwarf phenotype of chico homozygotes was also unnecessary for extension of lifespan. The role of insulin/IGF signaling in regulating animal aging is therefore evolutionarily conserved It is appreciated that the abovementioned animal model for IRS1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Esposito, D. L.; Mammarella, S.; Ranieri, A.; Loggia, F. D.; Capani, F.; Consoli, A.; Mariani-Costantini, R.; Caramia, F. G.; Cama, A.; Battista, P.: Deletion of gly723 in the insulin receptor substrate-1 of a patient with noninsulin-dependent diabetes mellitus. Hum. Mutat. 7:364-366, 1996; and Almind, K.; Inoue, G.; Pedersen, O.; Kahn, C. R.: A common amino acid polymorphism in insulin receptor substrate-1 causes impaired insulin signaling: evidence from transfection studies.

Further studies establishing the function and utilities of IRS1 are found in John Hopkins OMIM database record ID 147545, and in sited publications numbered 129-135, 445 and 4459-4472 listed in the bibliography section hereinbelow, which are also hereby incorporated by reference. Lymphoid Enhancer-binding Factor 1 (LEF1, Accession NM_016269) is another VGAM281 host target gene. LEF1 BINDING SITE is HOST TARGET binding site found in the 3' untranslated region of mRNA encoded by LEF1, corresponding to a HOST TARGET binding site such as BINDING SITE I, BINDING SITE II or BINDING SITE III. Table 2 illustrates the complementarity of the nucleotide sequences of LEF1 BINDING SITE, designated SEQ ID:18393, to the nucleotide sequence of VGAM281 RNA, herein designated VGAM RNA, also designated SEQ ID:2992.

Another function of VGAM281 is therefore inhibition of Lymphoid Enhancer-binding Factor 1 (LEF1, Accession NM_016269), a gene which plays an essential role in the formation of several organs and structures that require inductive tissue interactions. Accordingly, utilities of VGAM281 include diagnosis, prevention and treatment of diseases and clinical conditions associated with LEF1. The function of LEF1 and its association with various diseases and clinical conditions, has been established by previous studies, as described hereinabove with reference to VGAM200. Matrix Metalloproteinase 19 (MMP19, Accession NM_022790) is another VGAM281 host target gene. MMP19 BINDING SITE1 and MMP19 BINDING SITE2 are HOST TARGET binding sites found in untranslated regions of mRNA encoded by MMP19, corresponding to HOST TARGET binding sites such as BINDING SITE I, BINDING SITE II or BINDING SITE III. Table 2 illustrates the complementarity of the nucleotide sequences of MMP19 BINDING SITE1 and MMP19 BINDING SITE2, designated SEQ ID:23078 and SEQ ID:8270 respectively, to the nucleotide sequence of VGAM281 RNA, herein designated VGAM RNA, also designated SEQ ID:2992.

Another function of VGAM281 is therefore inhibition of Matrix Metalloproteinase 19 (MMP19, Accession NM_022790). Accordingly, utilities of VGAM281 include diagnosis, prevention and treatment of diseases and clinical conditions associated with MMP19. Echinoderm Microtubule Associated Protein Like 4 (EML4, Accession NM_019063) is another VGAM281 host target gene. EML4 BINDING SITE is HOST TARGET binding site found in the 3' untranslated region of mRNA encoded by EML4, corresponding to a HOST TARGET binding site such as BINDING SITE I, BINDING SITE II or BINDING SITE III. Table 2 illustrates the complementarity of the nucleotide sequences of EML4 BINDING SITE, designated SEQ ID:21143, to the nucleotide sequence of VGAM281 RNA, herein designated VGAM RNA, also designated SEQ ID:2992.

Another function of VGAM281 is therefore inhibition of Echinoderm Microtubule Associated Protein Like 4 (EML4, Accession NM_019063). Accordingly, utilities of VGAM281 include diagnosis, prevention and treatment of diseases and clinical conditions associated with EML4. FLJ22969 (Accession XM_044006) is another VGAM281 host target gene. FLJ22969 BINDING SITE is HOST TARGET binding site found in the 3' untranslated region of mRNA encoded by FLJ22969, corresponding to a HOST TARGET binding site such as BINDING SITE I, BINDING SITE II or BINDING SITE III. Table 2 illustrates the complementarity of the nucleotide sequences of FLJ22969 BINDING SITE, designated SEQ ID:34066, to the nucleotide sequence of VGAM281 RNA, herein designated VGAM RNA, also designated SEQ ID:2992.

Another function of VGAM281 is therefore inhibition of FLJ22969 (Accession XM_044006). Accordingly, utilities of VGAM281 include diagnosis, prevention and treatment of diseases and clinical conditions associated with FLJ22969. FLJ23153 (Accession NM_024636) is another VGAM281 host target gene. FLJ23153 BINDING SITE is HOST TAR- GET binding site found in the 3' untranslated region of mRNA encoded by FLJ23153, corresponding to a HOST TARGET binding site such as BINDING SITE I, BINDING SITE II or BINDING SITE III. Table 2 illustrates the complementarity of the nucleotide sequences of FLJ23153 BINDING SITE, designated SEQ ID:23906, to the nucleotide sequence of VGAM281 RNA, herein designated VGAM RNA, also designated SEQ ID:2992.

Another function of VGAM281 is therefore inhibition of FLJ23153 (Accession NM_024636). Accordingly, utilities of VGAM281 include diagnosis, prevention and treatment of diseases and clinical conditions associated with FLJ23153. FLJ30567 (Accession NM_145022) is another VGAM281 host target gene. FLJ30567 BINDING SITE is HOST TARGET binding site found in the 3' untranslated region of mRNA encoded by FLJ30567, corresponding to a HOST TARGET binding site such as BINDING SITE I, BINDING SITE II or BINDING SITE III. Table 2 illustrates the complementarity of the nucleotide sequences of FLJ30567 BINDING SITE, designated SEQ ID:29635, to the nucleotide sequence of VGAM281 RNA, herein designated VGAM RNA, also designated SEQ ID:2992.

Another function of VGAM281 is therefore inhibition of FLJ30567 (Accession NM_145022). Accordingly, utilities of VGAM281 include diagnosis, prevention and treatment of diseases and clinical conditions associated with FLJ30567. KIAA1946 (Accession XM_092459) is another VGAM281 host target gene. KIAA1946 BINDING SITE is HOST TARGET binding site found in the 3' untranslated region of mRNA encoded by KIAA1946, corresponding to a HOST TARGET binding site such as BINDING SITE I, BINDING SITE II or BINDING SITE III. Table 2 illustrates the complementarity of the nucleotide sequences of KIAA1946 BINDING SITE, designated SEQ ID:40122, to the nucleotide sequence of VGAM281 RNA, herein designated VGAM RNA, also designated SEQ ID:2992.

Another function of VGAM281 is therefore inhibition of KIAA1946 (Accession XM_092459). Accordingly, utilities of VGAM281 include diagnosis, prevention and treatment of diseases and clinical conditions associated with KIAA1946. Phosphodiesterase 11A (PDE11A, Accession NM_016953) is another VGAM281 host target gene. PDE11A BINDING SITE is HOST TARGET binding site found in the 3' untranslated region of mRNA encoded by PDE11A, corresponding to a HOST TARGET binding site such as BINDING SITE I, BINDING SITE II or BINDING SITE III. Table 2 illustrates the complementarity of the nucleotide sequences of PDE11A BINDING SITE, designated SEQ ID:18869, to the nucleotide sequence of VGAM281 RNA, herein designated VGAM RNA, also designated SEQ ID:2992.

Another function of VGAM281 is therefore inhibition of Phosphodiesterase 11A (PDE11A, Accession NM_016953). Accordingly, utilities of VGAM281 include diagnosis, prevention and treatment of diseases and clinical conditions associated with PDE11A. TUCAN (Accession NM_014959) is another VGAM281 host target gene. TUCAN BINDING SITE is HOST TARGET binding site found in the 3' untranslated region of mRNA encoded by TUCAN, corresponding to a HOST TARGET binding site such as BINDING SITE I, BINDING SITE II or BINDING SITE III. Table 2 illustrates the complementarity of the nucleotide sequences of TUCAN BINDING SITE, designated SEQ ID:17320, to the nucleotide sequence of VGAM281 RNA, herein designated VGAM RNA, also designated SEQ ID:2992.

Another function of VGAM281 is therefore inhibition of TUCAN (Accession NM_014959). Accordingly, utilities of VGAM281 include diagnosis, prevention and treatment of diseases and clinical conditions associated with TUCAN. LOC118851 (Accession XM_061180) is another VGAM281 host target gene. LOC118851 BINDING SITE is HOST TARGET binding site found in the 5' untranslated region of mRNA encoded by LOC118851, corresponding to a HOST TARGET binding site such as BINDING SITE I, BINDING SITE II or BINDING SITE III. Table 2 illustrates the complementarity of the nucleotide sequences of LOC118851 BINDING SITE, designated SEQ ID:37205, to the nucleotide sequence of VGAM281 RNA, herein designated VGAM RNA, also designated SEQ ID:2992.

Another function of VGAM281 is therefore inhibition of LOC118851 (Accession XM_061180). Accordingly, utilities of VGAM281 include diagnosis, prevention and treatment of diseases and clinical conditions associated with LOC118851. LOC144742 (Accession XM_084949) is another VGAM281 host target gene. LOC144742 BINDING SITE is HOST TARGET binding site found in the 5' untranslated region of mRNA encoded by LOC144742, corresponding to a HOST TARGET binding site such as BINDING SITE I, BINDING SITE II or BINDING SITE III. Table 2 illustrates the complementarity of the nucleotide sequences of LOC144742 BINDING SITE, designated SEQ ID:37778, to the nucleotide sequence of VGAM281 RNA, herein designated VGAM RNA, also designated SEQ ID:2992.

Another function of VGAM281 is therefore inhibition of LOC144742 (Accession XM_084949). Accordingly, utilities of VGAM281 include diagnosis, prevention and treatment of diseases and clinical conditions associated with LOC144742. LOC147353 (Accession XM_097227) is another VGAM281 host target gene. LOC147353 BINDING SITE is HOST TARGET binding site found in the 3' untranslated region of mRNA encoded by LOC147353, corresponding to a HOST TARGET binding site such as BINDING SITE I, BINDING SITE II or BINDING SITE III. Table 2 illustrates the complementarity of the nucleotide sequences of LOC147353 BINDING SITE, designated SEQ ID:40838, to the nucleotide sequence of VGAM281 RNA, herein designated VGAM RNA, also designated SEQ ID:2992.

Another function of VGAM281 is therefore inhibition of LOC147353 (Accession XM_097227). Accordingly, utilities of VGAM281 include diagnosis, prevention and treatment of diseases and clinical conditions associated with LOC147353. LOC221687 (Accession XM_166423) is another VGAM281 host target gene. LOC221687 BINDING SITE is HOST TARGET binding site found in the 3' untranslated region of mRNA encoded by LOC221687, corresponding to a HOST TARGET binding site such as BINDING SITE I, BINDING SITE II or BINDING SITE III. Table 2 illustrates the complementarity of the nucleotide sequences of LOC221687 BINDING SITE, designated SEQ ID:44301, to the nucleotide sequence of VGAM281 RNA, herein designated VGAM RNA, also designated SEQ ID:2992.

Another function of VGAM281 is therefore inhibition of LOC221687 (Accession XM_166423). Accordingly, utilities of VGAM281 include diagnosis, prevention and treatment of diseases and clinical conditions associated with LOC221687. FIG. 1 further provides a conceptual description of a novel bioinformatically detected viral gene of the present invention, referred to here as Viral Genomic Address Messenger 282 (VGAM282) viral gene, which modulates expression of respective host target genes thereof, the function and utility of which host target genes is known in the art.

VGAM282 is a novel bioinformatically detected regulatory, non protein coding, viral micro RNA (miRNA) gene. The method by which VGAM282 was detected is described hereinabove with reference to FIGS. 1-8.

VGAM282 gene, herein designated VGAM GENE, is a viral gene contained in the genome of Epiphyas Postvittana Nucleopolyhedrovirus. VGAM282 host target gene, herein designated VGAM HOST TARGET GENE, is a human gene contained in the human genome.

VGAM282 gene encodes a VGAM282 precursor RNA, herein designated VGAM PRECURSOR RNA. Similar to other miRNA genes, and unlike most ordinary genes, VGAM282 precursor RNA does not encode a protein. A nucleotide sequence identical or highly similar to the nucleotide sequence of VGAM282 precursor RNA is designated SEQ ID:268, and is provided hereinbelow with reference to the sequence listing part. Nucleotide sequence SEQ ID:268 is located at position 78903 relative to the genome of Epiphyas Postvittana Nucleopolyhedrovirus.

VGAM282 precursor RNA folds onto itself, forming VGAM282 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM282 folded precursor RNA into VGAM282 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM282 RNA is designated SEQ ID:2993, and is provided hereinbelow with reference to the sequence listing part.

VGAM282 host target gene, herein designated VGAM HOST TARGET GENE, encodes a corresponding messenger RNA, VGAM282 host target RNA, herein designated VGAM HOST TARGET RNA. VGAM282 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM282 RNA, herein designated VGAM RNA, binds complementarily to one or more host target binding sites located in untranslated regions of VGAM282 host target RNA, herein designated VGAM HOST TARGET RNA. This complementary binding is due to the fact that the nucleotide sequence of VGAM282 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM282 RNA, herein designated VGAM RNA, may have a different number of host target binding sites in untranslated regions of a VGAM282 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM282 RNA, herein designated VGAM RNA, to host target binding sites on VGAM282 host target RNA, herein designated VGAM HOST TARGET RNA, such as BINDING SITE I, BINDING SITE II and BINDING SITE III, inhibits translation of VGAM282 host target RNA into VGAM282 host target protein, herein designated VGAM HOST TARGET PROTEIN. VGAM host target protein is therefore outlined by a broken line.

It is appreciated that VGAM282 host target gene, herein designated VGAM HOST TARGET GENE, in fact represents a plurality of VGAM282 host target genes. The mRNA of each one of this plurality of VGAM282 host target genes comprises one or more host target binding sites, each having a nucleotide sequence which is at least partly complementary to VGAM282 RNA, herein designated VGAM RNA, and which when bound by VGAM282 RNA causes inhibition of translation of respective one or more VGAM282 host target proteins.

It is further appreciated by one skilled in the art that the mode of translational inhibition illustrated by FIG. 1 with specific reference to translational inhibition exerted by VGAM282 gene, herein designated VGAM GENE, on one or more VGAM282 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM282 is inhibition of expression of host target genes, as part of a novel viral mechanism of attacking a host. Accordingly, utilities of VGAM282 include diagnosis, prevention and treatment of viral infection by Epiphyas Postvittana Nucleopolyhedrovirus. Specific functions, and accordingly utilities, of VGAM282 correlate with, and may be deduced from, the identity of the host target genes which VGAM282 binds and inhibits, and the function of these host target genes, as elaborated hereinbelow.

Nucleotide sequences of the VGAM282 precursor RNA, herein designated VGAM PRECURSOR RNA, and of the 'diced' VGAM282 RNA, herein designated VGAM RNA, and a schematic representation of the secondary folding of VGAM282 folded precursor RNA, herein designated VGAM FOLDED PRECURSOR RNA, of VGAM282 are further described hereinbelow with reference to Table 1.

Nucleotide sequences of host target binding sites, such as BINDING SITE-I, BINDING SITE-II and BINDING SITE-III of FIG. 1, found on VGAM282 host target RNA, and schematic representation of the complementarity of each of these host target binding sites to VGAM282 RNA, herein designated VGAM RNA, are described hereinbelow with reference to Table 2.

As mentioned hereinabove with reference to FIG. 1, a function of VGAM282 gene, herein designated VGAM is inhibition of expression of VGAM282 target genes. It is appreciated that specific functions, and accordingly utilities, of VGAM282 correlate with, and may be deduced from, the identity of the target genes which VGAM282 binds and inhibits, and the function of these target genes, as elaborated hereinbelow.

Arachidonate 15-lipoxygenase (ALOX15, Accession NM_001140) is a VGAM282 host target gene. ALOX15 BINDING SITE is HOST TARGET binding site found in the 3' untranslated region of mRNA encoded by ALOX15, corresponding to a HOST TARGET binding site such as BINDING SITE I, BINDING SITE II or BINDING SITE III. Table 2 illustrates the complementarity of the nucleotide sequences of ALOX15 BINDING SITE, designated SEQ ID:6810, to the nucleotide sequence of VGAM282 RNA, herein designated VGAM RNA, also designated SEQ ID:2993.

A function of VGAM282 is therefore inhibition of Arachidonate 15-lipoxygenase (ALOX15, Accession NM_001140), a gene which converts arachidonic acid to 15s- hydroperoxyeicosatetraenoic acid. Accordingly, utilities of VGAM282 include diagnosis, prevention and treatment of diseases and clinical conditions associated with ALOX15. The function of ALOX15 has been established by previous studies. Yoshimoto et al. (1990) found that the amino acid sequence of human reticulocyte 15-lipoxygenase (Sigal et al., 1988) showed 86% identity with that of porcine leukocyte 12-lipoxygenase (OMIM Ref. No. 152391). Sigal et al. (1988) found 61% sequence similarity between 15-lipoxygenase and 5-lipoxygenase (OMIM Ref. No. 152390). This suggests that in the human 12-lipoxygenase is more closely related evolutionarily to 15-lipoxygenase than to 5-lipoxygenase, even though the comparisons are made between human and porcine enzymes. By PCR analysis of a human-hamster somatic hybrid DNA panel, Funk et al. (1992) demonstrated that genes for 12-lipoxygenase and 15-lipoxygenase are located on human chromosome 17, whereas the most unrelated lipoxygenase (5-lipoxygenase) was mapped to chromosome 10. Kelavkar and Badr (1999) stated that the ALOX15 gene maps to 17p13.3 in close proximity to the tumor-suppressor gene TP53 (OMIM Ref. No. 191170). The ALOX15 gene product is implicated in antiinflammation, membrane remodeling, and cancer development/metastasis. Kelavkar and Badr (1999) described experiments yielding data that supported the hypothesis that loss of the TP53 gene, or gain-of-function activities resulting from the expression of its mutant forms, regulates ALOX15 promoter activity in human and in mouse, albeit in directionally opposite manners. These studies defined a direct link between ALOX15 gene activity and an established tumor-suppressor gene located in close chromosomal proximity. Kelavkar and Badr (1999) referred to this as evidence that 15-lipoxygenase is a mutator gene.

Full details of the abovementioned studies are described in the following publications, the disclosure of which are hereby incorporated by reference:

Kelavkar, U. P.; Badr, K. F.: Effects of mutant p53 expression on human 15-lipoxygenase-promoter activity and murine 12/15-lipoxygenase gene expression: evidence that 15-lipoxygenase is a mutator gene. Proc. Nat. Acad. Sci. 96:4378-4383, 1999; and Yoshimoto, T.; Suzuki, H.; Yamamoto, S.; Takai, T.; Yokoyama, C.; Tanabe, T.: Cloning and sequence analysis of the cDNA for arachidonate 12-lipoxygenase of porcine leukocytes. Proc. Na.

Further studies establishing the function and utilities of ALOX15 are found in John Hopkins OMIM database record ID 152392, and in sited publications numbered 169 and 3430-3432 listed in the bibliography section hereinbelow, which are also hereby incorporated by reference. Deleted In Azoospermia (DAZ, Accession NM_004081) is another VGAM282 host target gene. DAZ BINDING SITE is HOST TARGET binding site found in the 3' untranslated region of mRNA encoded by DAZ, corresponding to a HOST TARGET binding site such as BINDING SITE I, BINDING SITE II or BINDING SITE III. Table 2 illustrates the complementarity of the nucleotide sequences of DAZ BINDING SITE, designated SEQ ID:10281, to the nucleotide sequence of VGAM282 RNA, herein designated VGAM RNA, also designated SEQ ID:2993.

Another function of VGAM282 is therefore inhibition of Deleted In Azoospermia (DAZ, Accession NM_004081), a gene which may play a role in the germ-cell-specific patterns of RNA splicing and storage. Accordingly, utilities of VGAM282 include diagnosis, prevention and treatment of diseases and clinical conditions associated with DAZ. The function of DAZ and its association with various diseases and clinical conditions, has been established by previous studies, as described hereinabove with reference to VGAM206. Solute Carrier Family 6 (neurotransmitter transporter, glycine), Member 5 (SLC6A5, Accession NM_004211) is another VGAM282 host target gene. SLC6A5 BINDING SITE is HOST TARGET binding site found in the 5' untranslated region of mRNA encoded by SLC6A5, corresponding to a HOST TARGET binding site such as BINDING SITE I, BINDING SITE II or BINDING SITE III. Table 2 illustrates the complementarity of the nucleotide sequences of SLC6A5 BINDING SITE, designated SEQ ID:10417, to the nucleotide sequence of VGAM282 RNA, herein designated VGAM RNA, also designated SEQ ID:2993.

Another function of VGAM282 is therefore inhibition of Solute Carrier Family 6 (neurotransmitter transporter, glycine), Member 5 (SLC6A5, Accession NM_004211), a gene which terminates the action of glycine by its high affinity sodium-dependent reuptake into presynaptic terminals. Accordingly, utilities of VGAM282 include diagnosis, prevention and treatment of diseases and clinical conditions associated with SLC6A5. The function of SLC6A5 has been established by previous studies. The amino acid glycine is a major inhibitory neurotransmitter in the spinal cord, brainstem, and retina, where it exerts its effects on the strychnine-sensitive glycine receptors. In addition, glycine acts as a coagonist with glutamate at the N-methyl-D-aspartate (NMDA) receptors (see OMIM Ref. No. 138252). The termination of action of glycine, like that of most other neurotransmitters, is mediated by rapid reuptake into the presynaptic terminal or surrounding glial cells. Glycine transporters are members of the sodium/chloride-dependent transporter family, which share 40 to 50% amino acid similarity and are characterized by 12 putative transmembrane regions. Liu et al. (1993) isolated a rat brain cDNA encoding a novel glycine transporter, which they called GlyT2. They found that GlyT2 differs from GlyT1 (OMIM Ref. No. 601019) in molecular structure, tissue specificity, and pharmacologic properties. By PCR of a human brain cDNA library with primers based on conserved regions of the rat GlyT2 gene, Morrow et al. (1998) cloned a cDNA corresponding to human GLYT2. The predicted 797-amino acid human protein is 94% identical to rat GlyT2. When expressed in mammalian cells, GLYT2 displayed high affinity glycine uptake. Northern blot analysis of central nervous system tissues revealed that the approximately 9.5-kb GLYT2 mRNA is expressed in medulla, and to a lesser extent in spinal cord and cerebellum. Morrow et al. (1998) stated that the previously characterized GLYT1 and GLYT2 localization patterns suggest that GLYT2 is responsible for the termination of neurotransmission at strychnine-sensitive glycinergic synapses, while the more widely expressed GLYT1 may play a role in regulation of glycine levels in NMDA receptor-mediated neurotransmission. Independently, Gallagher et al. (1999) isolated cDNAs encoding 3 isoforms of GLYT2

Full details of the abovementioned studies are described in the following publications, the disclosure of which are hereby incorporated by reference:

Liu, Q. R.; Lopez-Corcuera, B.; Mandiyan, S.; Nelson, H.; Nelson, N.: Cloning and expression of a spinal cord- and brain-specific glycine transporter with novel structural features. J. Biol. Chem. 268:22802-22808, 1993; and Morrow, J. A.; Collie, I. T.; Dunbar, D. R.; Walker, G. B.; Shahid, M.; Hill, D. R.: Molecular cloning and functional expression of the human glycine transporter GlyT2 and chromosomal l.

Further studies establishing the function and utilities of SLC6A5 are found in John Hopkins OMIM database record ID 604159, and in sited publications numbered 427-42 and 7938 listed in the bibliography section hereinbelow, which are also hereby incorporated by reference. Wolf-Hirschhorn Syndrome Candidate 1 (WHSC1, Accession NM_133332) is another VGAM282 host target gene. WHSC1 BINDING SITE1 through WHSC1 BINDING SITE3 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE3, designated SEQ ID:28450, SEQ ID:28467 and SEQ ID:17186 respectively, to the nucleotide sequence of VGAM282 RNA, herein designated VGAM RNA, also designated SEQ ID:2993.

Another function of VGAM282 is therefore inhibition of Wolf-Hirschhorn Syndrome Candidate 1 (WHSC1, Accession NM_133332), a gene which binds covalently to and repairs g/t mismatches. Accordingly, utilities of VGAM282 include diagnosis, prevention and treatment of diseases and clinical conditions associated with WHSC1. The function of WHSC1 and its association with various diseases and clinical conditions, has been established by previous studies, as described hereinabove with reference to VGAM200. LOC150280 (Accession XM_086846) is another VGAM282 host target gene. LOC150280 BINDING SITE is HOST TARGET binding site found in the 3' untranslated region of mRNA encoded by LOC150280, corresponding to a HOST TARGET binding site such as BINDING SITE I, BINDING SITE II or BINDING SITE III. Table 2 illustrates the complementarity of the nucleotide sequences of LOC150280 BINDING SITE, designated SEQ ID:38912, to the nucleotide sequence of VGAM282 RNA, herein designated VGAM RNA, also designated SEQ ID:2993.

Another function of VGAM282 is therefore inhibition of LOC150280 (Accession XM_086846). Accordingly, utilities of VGAM282 include diagnosis, prevention and treatment of diseases and clinical conditions associated with LOC150280. FIG. 1 further provides a conceptual description of a novel bioinformatically detected viral gene of the present invention, referred to here as Viral Genomic Address Messenger 283 (VGAM283) viral gene, which modulates expression of respective host target genes thereof, the function and utility of which host target genes is known in the art.

VGAM283 is a novel bioinformatically detected regulatory, non protein coding, viral micro RNA (miRNA) gene. The method by which VGAM283 was detected is described hereinabove with reference to FIGS. 1-8.

VGAM283 gene, herein designated VGAM GENE, is a viral gene contained in the genome of Epiphyas Postvittana Nucleopolyhedrovirus. VGAM283 host target gene, herein designated VGAM HOST TARGET GENE, is a human gene contained in the human genome.

VGAM283 gene encodes a VGAM283 precursor RNA, herein designated VGAM PRECURSOR RNA. Similar to other miRNA genes, and unlike most ordinary genes, VGAM283 precursor RNA does not encode a protein. A nucleotide sequence identical or highly similar to the nucleotide sequence of VGAM283 precursor RNA is designated SEQ ID:269, and is provided hereinbelow with reference to the sequence listing part. Nucleotide sequence SEQ ID:269 is located at position 1023 relative to the genome of Epiphyas Postvittana Nucleopolyhedrovirus.

VGAM283 precursor RNA folds onto itself, forming VGAM283 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM283 folded precursor RNA into VGAM283 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM283 RNA is designated SEQ ID:2994, and is provided hereinbelow with reference to the sequence listing part.

VGAM283 host target gene, herein designated VGAM HOST TARGET GENE, encodes a corresponding messenger RNA, VGAM283 host target RNA, herein designated VGAM HOST TARGET RNA. VGAM283 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM283 RNA, herein designated VGAM RNA, binds complementarily to one or more host target binding sites located in untranslated regions of VGAM283 host target RNA, herein designated VGAM HOST TARGET RNA. This complementary binding is due to the fact that the nucleotide sequence of VGAM283 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM283 RNA, herein designated VGAM RNA, may have a different number of host target binding sites in untranslated regions of a VGAM283 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM283 RNA, herein designated VGAM RNA, to host target binding sites on VGAM283 host target RNA, herein designated VGAM HOST TARGET RNA, such as BINDING SITE I, BINDING SITE II and BINDING SITE III, inhibits translation of VGAM283 host target RNA into VGAM283 host target protein, herein designated VGAM HOST TARGET PROTEIN. VGAM host target protein is therefore outlined by a broken line.

It is appreciated that VGAM283 host target gene, herein designated VGAM HOST TARGET GENE, in fact represents a plurality of VGAM283 host target genes. The mRNA of each one of this plurality of VGAM283 host target genes comprises one or more host target binding sites, each having a nucleotide sequence which is at least partly complementary to VGAM283 RNA, herein designated VGAM RNA, and which when bound by VGAM283 RNA causes inhibition of translation of respective one or more VGAM283 host target proteins.

It is further appreciated by one skilled in the art that the mode of translational inhibition illustrated by FIG. 1 with specific reference to translational inhibition exerted by VGAM283 gene, herein designated VGAM GENE, on one or more VGAM283 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM283 is inhibition of expression of host target genes, as part of a novel viral mechanism of attacking a host. Accordingly, utilities of VGAM283 include diagnosis, prevention and treatment of viral infection by Epiphyas Postvittana Nucleopolyhedrovirus. Specific functions, and accordingly utilities, of VGAM283 correlate with, and may be deduced from, the identity of the host target genes which VGAM283 binds and inhibits, and the function of these host target genes, as elaborated hereinbelow.

Nucleotide sequences of the VGAM283 precursor RNA, herein designated VGAM PRECURSOR RNA, and of the 'diced' VGAM283 RNA, herein designated VGAM RNA, and a schematic representation of the secondary folding of VGAM283 folded precursor RNA, herein designated VGAM FOLDED PRECURSOR RNA, of VGAM283 are further described hereinbelow with reference to Table 1.

Nucleotide sequences of host target binding sites, such as BINDING SITE-I, BINDING SITE-II and BINDING SITE-III of FIG. 1, found on VGAM283 host target RNA, and schematic representation of the complementarity of each of these host target binding sites to VGAM283 RNA, herein designated VGAM RNA, are described hereinbelow with reference to Table 2.

As mentioned hereinabove with reference to FIG. 1, a function of VGAM283 gene, herein designated VGAM is inhibition of expression of VGAM283 target genes. It is appreciated that specific functions, and accordingly utilities, of VGAM283 correlate with, and may be deduced from, the identity of the target genes which VGAM283 binds and inhibits, and the function of these target genes, as elaborated hereinbelow.

Dual Adaptor of Phosphotyrosine and 3-phosphoinositides (DAPP1, Accession NM_014395) is a VGAM283 host target gene. DAPP1 BINDING SITE is HOST TARGET binding site found in the 3' untranslated region of mRNA encoded by DAPP1, corresponding to a HOST TARGET binding site such as BINDING SITE I, BINDING SITE II or BINDING SITE III. Table 2 illustrates the complementarity of the nucleotide sequences of DAPP1 BINDING SITE, designated SEQ ID:15731, to the nucleotide sequence of VGAM283 RNA, herein designated VGAM RNA, also designated SEQ ID:2994.

A function of VGAM283 is therefore inhibition of Dual Adaptor of Phosphotyrosine and 3-phosphoinositides (DAPP1, Accession NM_014395), a gene which regulates the ras-cyclic amp pathway. Accordingly, utilities of VGAM283 include diagnosis, prevention and treatment of diseases and clinical conditions associated with DAPP1. The function of DAPP1 has been established by previous studies. By EST database searching for pleckstrin homology (PH) domain-containing proteins, followed by screening a universal cDNA library, Dowler et al. (1999) isolated a cDNA encoding DAPP1. Sequence analysis predicted that the 280-amino acid protein contains a potential myristoylation site (a glycine after the N-terminal methionine), an N-terminal SH2 domain, and a C-terminal PH domain with a PtdIns-interacting motif. The authors noted that APS (OMIM Ref. No. 605300) also has an SH2 domain and a PH domain but at opposite termini of the protein. PCR of cDNA libraries and Northern blot analysis revealed ubiquitous expression of 2.7-kb transcripts, with highest levels in placenta and lung. A protein-lipid overlay analysis indicated that the PH domain of DAPP1 interacts with physiologic enantiomers of PtdIns. Using suppression subtractive hybridization with follicular dendritic cell tester cDNA, Marshall et al. (2000) cloned BAM32 and a splice variant identical to DAPP1. In addition to the SH2 and PH domains noted by Dowler et al. (1999), Marshall et al. (2000) predicted the presence of a potential tyrosine phosphorylation site in BAM32. Northern blot analysis detected an abundant 2.9-kb transcript and a minor 4.4-kb transcript in all hemopoietic tissues, as well as in trachea and placenta. RT-PCR analysis revealed expression in all B-cell lines, but not in T-cell, epithelial cell, fibroblast, or myelocytic leukemia cell lines. Activation of B cells was found to increase BAM32 expression. Immunoblot analysis showed that stimulation also induces BAM32 association with PLCG2 (OMIM Ref. No. 600220) and tyrosine phosphorylation of a 36-kD protein. Confocal microscopy demonstrated a PI3K-dependent membrane localization of BAM32 after B-cell receptor (BCR) activation. Luciferase reporter analysis showed that expression of the PH domain of BAM32 inhibits BCR-induced activation of NFATC (see OMIM Ref. No. 600489).

Full details of the abovementioned studies are described in the following publications, the disclosure of which are hereby incorporated by reference:

Dowler, S.; Currie, R. A.; Downes, C. P.; Alessi, D. R.: DAPP1: a dual adaptor for phosphotyrosine and 3-phosphoinositides. Biochem. J. 342:7-12, 1999; and Marshall, A. J.; Niiro, H.; Lerner, C. G.; Yun, T. J.; Thomas, S.; Disteche, C. M.; Clark, E. A.: A novel B lymphocyte-associated adaptor protein, Bam32, regulates antigen receptor si.

Further studies establishing the function and utilities of DAPP1 are found in John Hopkins OMIM database record ID 605768, and in sited publications numbered 4506-4507 listed in the bibliography section hereinbelow, which are also hereby incorporated by reference. FIG. 1 further provides a conceptual description of a novel bioinformatically detected viral gene of the present invention, referred to here as Viral Genomic Address Messenger 284 (VGAM284) viral gene, which modulates expression of respective host target genes thereof, the function and utility of which host target genes is known in the art.

VGAM284 is a novel bioinformatically detected regulatory, non protein coding, viral micro RNA (miRNA) gene. The method by which VGAM284 was detected is described hereinabove with reference to FIGS. 1-8.

VGAM284 gene, herein designated VGAM GENE, is a viral gene contained in the genome of Epiphyas Postvittana Nucleopolyhedrovirus. VGAM284 host target gene, herein designated VGAM HOST TARGET GENE, is a human gene contained in the human genome.

VGAM284 gene encodes a VGAM284 precursor RNA, herein designated VGAM PRECURSOR RNA. Similar to other miRNA genes, and unlike most ordinary genes, VGAM284 precursor RNA does not encode a protein. A nucleotide sequence identical or highly similar to the nucleotide sequence of VGAM284 precursor RNA is designated SEQ ID:270, and is provided hereinbelow with reference to the sequence listing part. Nucleotide sequence SEQ ID:270 is located at position 5957 relative to the genome of Epiphyas Postvittana Nucleopolyhedrovirus.

VGAM284 precursor RNA folds onto itself, forming VGAM284 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM284 folded precursor RNA into VGAM284 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM284 RNA is designated SEQ ID:2995, and is provided hereinbelow with reference to the sequence listing part.

VGAM284 host target gene, herein designated VGAM HOST TARGET GENE, encodes a corresponding messenger RNA, VGAM284 host target RNA, herein designated VGAM HOST TARGET RNA. VGAM284 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM284 RNA, herein designated VGAM RNA, binds complementarily to one or more host target binding sites located in untranslated regions of VGAM284 host target RNA, herein designated VGAM HOST TARGET RNA. This complementary binding is due to the fact that the nucleotide sequence of VGAM284 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM284 RNA, herein designated VGAM RNA, may have a different number of host target binding sites in untranslated regions of a VGAM284 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM284 RNA, herein designated VGAM RNA, to host target binding sites on VGAM284 host target RNA, herein designated VGAM HOST TARGET RNA, such as BINDING SITE I, BINDING SITE II and BINDING SITE III, inhibits translation of VGAM284 host target RNA into VGAM284 host target protein, herein designated VGAM HOST TARGET PROTEIN. VGAM host target protein is therefore outlined by a broken line.

It is appreciated that VGAM284 host target gene, herein designated VGAM HOST TARGET GENE, in fact represents a plurality of VGAM284 host target genes. The mRNA of each one of this plurality of VGAM284 host target genes comprises one or more host target binding sites, each having a nucleotide sequence which is at least partly complementary to VGAM284 RNA, herein designated VGAM RNA, and which when bound by VGAM284 RNA causes inhibition of translation of respective one or more VGAM284 host target proteins.

It is further appreciated by one skilled in the art that the mode of translational inhibition illustrated by FIG. 1 with specific reference to translational inhibition exerted by VGAM284 gene, herein designated VGAM GENE, on one or more VGAM284 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM284 is inhibition of expression of host target genes, as part of a novel viral mechanism of attacking a host. Accordingly, utilities of VGAM284 include diagnosis, prevention and treatment of viral infection by Epiphyas Postvittana Nucleopolyhedrovirus. Specific functions, and accordingly utilities, of VGAM284 correlate with, and may be deduced from, the identity of the host target genes which VGAM284 binds and inhibits, and the function of these host target genes, as elaborated hereinbelow.

Nucleotide sequences of the VGAM284 precursor RNA, herein designated VGAM PRECURSOR RNA, and of the 'diced' VGAM284 RNA, herein designated VGAM RNA, and a schematic representation of the secondary folding of VGAM284 folded precursor RNA, herein designated VGAM FOLDED PRECURSOR RNA, of VGAM284 are further described hereinbelow with reference to Table 1.

Nucleotide sequences of host target binding sites, such as BINDING SITE-I, BINDING SITE-II and BINDING SITE-III of FIG. 1, found on VGAM284 host target RNA, and schematic representation of the complementarity of each of these host target binding sites to VGAM284 RNA, herein designated VGAM RNA, are described hereinbelow with reference to Table 2.

As mentioned hereinabove with reference to FIG. 1, a function of VGAM284 gene, herein designated VGAM is inhibition of expression of VGAM284 target genes. It is appreciated that specific functions, and accordingly utilities, of VGAM284 correlate with, and may be deduced from, the identity of the target genes which VGAM284 binds and inhibits, and the function of these target genes, as elaborated hereinbelow.

MGC12538 (Accession NM_032746) is a VGAM284 host target gene. MGC12538 BINDING SITE is HOST TARGET binding site found in the 3' untranslated region of mRNA encoded by MGC12538, corresponding to a HOST TARGET binding site such as BINDING SITE I, BINDING SITE II or BINDING SITE III. Table 2 illustrates the complementarity of the nucleotide sequences of MGC12538 BINDING SITE, designated SEQ ID:26479, to the nucleotide sequence of VGAM284 RNA, herein designated VGAM RNA, also designated SEQ ID:2995.

A function of VGAM284 is therefore inhibition of MGC12538 (Accession NM_032746). Accordingly, utilities of VGAM284 include diagnosis, prevention and treatment of diseases and clinical conditions associated with MGC12538. Nucleoporin 160 kDa (NUP160, Accession XM_113678) is another VGAM284 host target gene. NUP160 BINDING SITE is HOST TARGET binding site found in the 3' untranslated region of mRNA encoded by NUP160, corresponding to a HOST TARGET binding site such as BINDING SITE I, BINDING SITE II or BINDING SITE III. Table 2 illustrates the complementarity of the nucleotide sequences of NUP160 BINDING SITE, designated SEQ ID:42327, to the nucleotide sequence of VGAM284 RNA, herein designated VGAM RNA, also designated SEQ ID:2995.

Another function of VGAM284 is therefore inhibition of Nucleoporin 160kDa (NUP160, Accession XM_113678). Accordingly, utilities of VGAM284 include diagnosis, prevention and treatment of diseases and clinical conditions associated with NUP160. FIG. 1 further provides a conceptual description of a novel bioinformatically detected viral gene of the present invention, referred to here as Viral Genomic Address Messenger 285 (VGAM285) viral gene, which modulates expression of respective host target genes thereof, the function and utility of which host target genes is known in the art.

VGAM285 is a novel bioinformatically detected regulatory, non protein coding, viral micro RNA (miRNA) gene. The method by which VGAM285 was detected is described hereinabove with reference to FIGS. 1-8.

VGAM285 gene, herein designated VGAM GENE, is a viral gene contained in the genome of Epiphyas Postvittana Nucleopolyhedrovirus. VGAM285 host target gene, herein designated VGAM HOST TARGET GENE, is a human gene contained in the human genome.

VGAM285 gene encodes a VGAM285 precursor RNA, herein designated VGAM PRECURSOR RNA. Similar to other miRNA genes, and unlike most ordinary genes, VGAM285 precursor RNA does not encode a protein. A nucleotide sequence identical or highly similar to the nucleotide sequence of VGAM285 precursor RNA is designated SEQ ID:271, and is provided hereinbelow with reference to the sequence listing part. Nucleotide sequence SEQ ID:271 is located at position 58647 relative to the genome of Epiphyas Postvittana Nucleopolyhedrovirus.

VGAM285 precursor RNA folds onto itself, forming VGAM285 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM285 folded precursor RNA into VGAM285 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM285 RNA is designated SEQ ID:2996, and is provided hereinbelow with reference to the sequence listing part.

VGAM285 host target gene, herein designated VGAM HOST TARGET GENE, encodes a corresponding messenger RNA, VGAM285 host target RNA, herein designated VGAM HOST TARGET RNA. VGAM285 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM285 RNA, herein designated VGAM RNA, binds complementarily to one or more host target binding sites located in untranslated regions of VGAM285 host target RNA, herein designated VGAM HOST TARGET RNA. This complementary binding is due to the fact that the nucleotide sequence of VGAM285 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM285 RNA, herein designated VGAM RNA, may have a different number of host target binding sites in untranslated regions of a VGAM285 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM285 RNA, herein designated VGAM RNA, to host target binding sites on VGAM285 host target RNA, herein designated VGAM HOST TARGET RNA, such as BINDING SITE I, BINDING SITE II and BINDING SITE III, inhibits translation of VGAM285 host target RNA into VGAM285 host target protein, herein designated VGAM HOST TARGET PROTEIN. VGAM host target protein is therefore outlined by a broken line.

It is appreciated that VGAM285 host target gene, herein designated VGAM HOST TARGET GENE, in fact represents a plurality of VGAM285 host target genes. The mRNA of each one of this plurality of VGAM285 host target genes comprises one or more host target binding sites, each having a nucleotide sequence which is at least partly complementary to VGAM285 RNA, herein designated VGAM RNA, and which when bound by VGAM285 RNA causes inhibition of translation of respective one or more VGAM285 host target proteins.

It is further appreciated by one skilled in the art that the mode of translational inhibition illustrated by FIG. 1 with specific reference to translational inhibition exerted by VGAM285 gene, herein designated VGAM GENE, on one or more VGAM285 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM285 is inhibition of expression of host target genes, as part of a novel viral mechanism of attacking a host. Accordingly, utilities of VGAM285 include diagnosis, prevention and treatment of viral infection by Epiphyas Postvittana Nucleopolyhedrovirus. Specific functions, and accordingly utilities, of VGAM285 correlate with, and may be deduced from, the identity of the host target genes which VGAM285 binds and inhibits, and the function of these host target genes, as elaborated hereinbelow.

Nucleotide sequences of the VGAM285 precursor RNA, herein designated VGAM PRECURSOR RNA, and of the 'diced' VGAM285 RNA, herein designated VGAM RNA, and a schematic representation of the secondary folding of VGAM285 folded precursor RNA, herein designated VGAM FOLDED PRECURSOR RNA, of VGAM285 are further described hereinbelow with reference to Table 1.

Nucleotide sequences of host target binding sites, such as BINDING SITE-I, BINDING SITE-II and BINDING SITE-III of FIG. 1, found on VGAM285 host target RNA, and schematic representation of the complementarity of each of these host target binding sites to VGAM285 RNA, herein designated VGAM RNA, are described hereinbelow with reference to Table 2.

As mentioned hereinabove with reference to FIG. 1, a function of VGAM285 gene, herein designated VGAM is inhibition of expression of VGAM285 target genes. It is appreciated that specific functions, and accordingly utilities, of VGAM285 correlate with, and may be deduced from, the identity of the target genes which VGAM285 binds and inhibits, and the function of these target genes, as elaborated hereinbelow.

NEBL (Accession NM_006393) is a VGAM285 host target gene. NEBL BINDING SITE is HOST TARGET binding site found in the 3' untranslated region of mRNA encoded by NEBL, corresponding to a HOST TARGET binding site such as BINDING SITE I, BINDING SITE II or BINDING SITE III. Table 2 illustrates the complementarity of the nucleotide sequences of NEBL BINDING SITE, designated SEQ ID:13100, to the nucleotide sequence of VGAM285 RNA, herein designated VGAM RNA, also designated SEQ ID:2996.

A function of VGAM285 is therefore inhibition of NEBL (Accession NM_006393). Accordingly, utilities of VGAM285 include diagnosis, prevention and treatment of diseases and clinical conditions associated with NEBL.

FLJ12389 (Accession XM_015274) is another VGAM285 host target gene. FLJ12389 BINDING SITE is HOST TARGET binding site found in the 3" untranslated region of mRNA encoded by FLJ12389, corresponding to a HOST TARGET binding site such as BINDING SITE I, BINDING SITE II or BINDING SITE III. Table 2 illustrates the complementarity of the nucleotide sequences of FLJ12389 BINDING SITE, designated SEQ ID:30235, to the nucleotide sequence of VGAM285 RNA, herein designated VGAM RNA, also designated SEQ ID:2996.

Another function of VGAM285 is therefore inhibition of FLJ12389 (Accession XM_015274). Accordingly, utilities of VGAM285 include diagnosis, prevention and treatment of diseases and clinical conditions associated with FLJ12389.

FLJ20300 (Accession NM_017753) is another VGAM285 host target gene. FLJ20300 BINDING SITE is HOST TARGET binding site found in the 3' untranslated region of mRNA encoded by FLJ20300, corresponding to a HOST TARGET binding site such as BINDING SITE I, BINDING SITE II or BINDING SITE III. Table 2 illustrates the complementarity of the nucleotide sequences of FLJ20300 BINDING SITE, designated SEQ ID:19366, to the nucleotide sequence of VGAM285 RNA, herein designated VGAM RNA, also designated SEQ ID:2996.

Another function of VGAM285 is therefore inhibition of FLJ20300 (Accession NM_017753). Accordingly, utilities of VGAM285 include diagnosis, prevention and treatment of diseases and clinical conditions associated with FLJ20300.

LOC147054 (Accession XM_097172) is another VGAM285 host target gene. LOC147054 BINDING SITE is HOST TARGET binding site found in the 5' untranslated region of mRNA encoded by LOC147054, corresponding to a HOST TARGET binding site such as BINDING SITE I, BINDING SITE II or BINDING SITE III. Table 2 illustrates the complementarity of the nucleotide sequences of LOC147054 BINDING SITE, designated SEQ ID:40795, to the nucleotide sequence of VGAM285 RNA, herein designated VGAM RNA, also designated SEQ ID:2996.

Another function of VGAM285 is therefore inhibition of LOC147054 (Accession XM_097172). Accordingly, utilities of VGAM285 include diagnosis, prevention and treatment of diseases and clinical conditions associated with LOC147054.

FIG. 1 further provides a conceptual description of a novel bioinformatically detected viral gene of the present invention, referred to here as Viral Genomic Address Messenger 286 (VGAM286) viral gene, which modulates expression of respective host target genes thereof, the function and utility of which host target genes is known in the art.

VGAM286 is a novel bioinformatically detected regulatory, non protein coding, viral micro RNA (miRNA) gene. The method by which VGAM286 was detected is described hereinabove with reference to FIGS. 1-8.

VGAM286 gene, herein designated VGAM GENE, is a viral gene contained in the genome of Epiphyas Postvittana Nucleopolyhedrovirus. VGAM286 host target gene, herein designated VGAM HOST TARGET GENE, is a human gene contained in the human genome.

VGAM286 gene encodes a VGAM286 precursor RNA, herein designated VGAM PRECURSOR RNA. Similar to other miRNA genes, and unlike most ordinary genes, VGAM286 precursor RNA does not encode a protein. A nucleotide sequence identical or highly similar to the nucleotide sequence of VGAM286 precursor RNA is designated SEQ ID:272, and is provided hereinbelow with reference to the sequence listing part. Nucleotide sequence SEQ ID:272 is located at position 4528 relative to the genome of Epiphyas Postvittana Nucleopolyhedrovirus.

VGAM286 precursor RNA folds onto itself, forming VGAM286 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM286 folded precursor RNA into VGAM286 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM286 RNA is designated SEQ ID:2997, and is provided hereinbelow with reference to the sequence listing part.

VGAM286 host target gene, herein designated VGAM HOST TARGET GENE, encodes a corresponding messenger RNA, VGAM286 host target RNA, herein designated VGAM HOST TARGET RNA. VGAM286 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM286 RNA, herein designated VGAM RNA, binds complementarily to one or more host target binding sites located in untranslated regions of VGAM286 host target RNA, herein designated VGAM HOST TARGET RNA. This complementary binding is due to the fact that the nucleotide sequence of VGAM286 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM286 RNA, herein designated VGAM RNA, may have a different number of host target binding sites in untranslated regions of a VGAM286 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM286 RNA, herein designated VGAM RNA, to host target binding sites on VGAM286 host target RNA, herein designated VGAM HOST TARGET RNA, such as BINDING SITE I, BINDING SITE II and BINDING SITE III, inhibits translation of VGAM286 host target RNA into VGAM286 host target protein, herein designated VGAM HOST TARGET PROTEIN. VGAM host target protein is therefore outlined by a broken line.

It is appreciated that VGAM286 host target gene, herein designated VGAM HOST TARGET GENE, in fact represents a plurality of VGAM286 host target genes. The mRNA of each one of this plurality of VGAM286 host target genes comprises one or more host target binding sites, each having a nucleotide sequence which is at least partly complementary to VGAM286 RNA, herein designated VGAM RNA, and which when bound by VGAM286 RNA causes inhibition of translation of respective one or more VGAM286 host target proteins.

It is further appreciated by one skilled in the art that the mode of translational inhibition illustrated by FIG. 1 with specific reference to translational inhibition exerted by VGAM286 gene, herein designated VGAM GENE, on one or more VGAM286 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM286 is inhibition of expression of host target genes, as part of a novel viral mechanism of attacking a host. Accordingly, utilities of VGAM286 include diagnosis, prevention and treatment of viral infection by Epiphyas Postvittana Nucleopolyhedrovirus. Specific functions, and accordingly utilities, of VGAM286 correlate with, and may be deduced from, the identity of the host target genes which VGAM286 binds and inhibits, and the function of these host target genes, as elaborated hereinbelow.

Nucleotide sequences of the VGAM286 precursor RNA, herein designated VGAM PRECURSOR RNA, and of the 'diced' VGAM286 RNA, herein designated VGAM RNA, and a schematic representation of the secondary folding of VGAM286 folded precursor RNA, herein designated VGAM FOLDED PRECURSOR RNA, of VGAM286 are further described hereinbelow with reference to Table 1.

Nucleotide sequences of host target binding sites, such as BINDING SITE-I, BINDING SITE-II and BINDING SITE-III of FIG. 1, found on VGAM286 host target RNA, and schematic representation of the complementarity of each of these host target binding sites to VGAM286 RNA, herein designated VGAM RNA, are described hereinbelow with reference to Table 2.

As mentioned hereinabove with reference to FIG. 1, a function of VGAM286 gene, herein designated VGAM is inhibition of expression of VGAM286 target genes. It is appreciated that specific functions, and accordingly utilities, of VGAM286 correlate with, and may be deduced from, the identity of the target genes which VGAM286 binds and inhibits, and the function of these target genes, as elaborated hereinbelow.

Carcinoembryonic Antigen-related Cell Adhesion Molecule 6 (non-specific cross reacting antigen) (CEACAM6, Accession NM_002483) is a VGAM286 host target gene. CEACAM6 BINDING SITE is HOST TARGET binding site found in the 3' untranslated region of mRNA encoded by CEACAM6, corresponding to a HOST TARGET binding site such as BINDING SITE I, BINDING SITE II or BINDING SITE III. Table 2 illustrates the complementarity of the nucleotide sequences of CEACAM6 BINDING SITE, designated SEQ ID:8308, to the nucleotide sequence of VGAM286 RNA, herein designated VGAM RNA, also designated SEQ ID:2997.

A function of VGAM286 is therefore inhibition of Carcinoembryonic Antigen-related Cell Adhesion Molecule 6 (non-specific cross reacting antigen) (CEACAM6, Accession NM_002483), a gene which Non-specific cross reacting antigen (. Accordingly, utilities of VGAM286 include diagnosis, prevention and treatment of diseases and clinical conditions associated with CEACAM6. The function of CEACAM6 has been established by previous studies. Carcinoembryonic antigen (CEA; 114890) is one of the most widely used tumor markers in serum immunoassay determinations of carcinoma. An apparent lack of absolute cancer specificity for CEA probably results in part from the presence in normal and neoplastic tissues of antigens that share antigenic determinants with the 180-kD form of CEA. Barnett et al. (1988) presented sequences of a 'normal crossreacting antigen' (NCA) and showed that CEA and NCA, although closely related in sequence, are structurally and probably functionally distinct. Nomenclature: Beauchemin et al. (1999) provided a revised nomenclature for the CEA gene family. Based on this nomenclature, the CEA family is composed of the PSG subfamily (see OMIM Ref. No. 176392); the CEACAM subfamily, which includes CEACAM1 (BGP), CEACAM3 (CGM1), CEACAM4 (CGM7), CEACAM5 (CEA), CEACAM6 (NCA), CEACAM7 (CGM2), and CEACAM8 (CGM6); and the CEACAM pseudogene (CEACAMP) subfamily, CEACAMP1 through CEACAMP11, which had originally been named CGM8 through CGM18 (see OMIM Ref. No. 109770). The NCA gene was renamed CEACAM6.

Full details of the abovementioned studies are described in the following publications, the disclosure of which are hereby incorporated by reference:

Barnett, T.; Goebel, S. J.; Nothdurft, M. A.; Elting, J. J.: Carcinoembryonic antigen family: characterization of cDNAs coding for NCA and CEA and suggestion of nonrandom sequence variation in their conserved loop-domains. Genomics 3:59-66, 1988; and Beauchemin, N.; Draber, P.; Dveksler, G.; Gold, P.; Gray-Owen, S.; Grunert, F.; Hammarstrom, S.; Holmes, K. V.; Karlsson, A.; Kuroki, M.; Lin, S.-H.; Lucka, L.; and 13 others. Redefined.

Further studies establishing the function and utilities of CEACAM6 are found in John Hopkins OMIM database record ID 163980, and in sited publications numbered 4 and 2240-2242 listed in the bibliography section hereinbelow, which are also hereby incorporated by reference. Coagulation Factor C Homolog, Cochlin (Limulus polyphemus) (COCH, Accession NM_004086) is another VGAM286 host target gene. COCH BINDING SITE is HOST TARGET binding site found in the 3' untranslated region of mRNA encoded by COCH, corresponding to a HOST TARGET binding site such as BINDING SITE I, BINDING SITE II or BINDING SITE III. Table 2 illustrates the complementarity of the nucleotide sequences of COCH BINDING SITE, designated SEQ ID:10291, to the nucleotide sequence of VGAM286 RNA, herein designated VGAM RNA, also designated SEQ ID:2997.

Another function of VGAM286 is therefore inhibition of Coagulation Factor C Homolog, Cochlin (Limulus polyphemus) (COCH, Accession NM_004086). Accordingly, utilities of VGAM286 include diagnosis, prevention and treatment of diseases and clinical conditions associated with COCH. JJAZ1 (Accession NM_015355) is another VGAM286 host target gene. JJAZ1 BINDING SITE is HOST TARGET binding site found in the 3' untranslated region of mRNA encoded by JJAZ1, corresponding to a HOST TARGET binding site such as BINDING SITE I, BINDING SITE II or BINDING SITE III. Table 2 illustrates the complementarity of the nucleotide sequences of JJAZ1 BINDING SITE, designated SEQ ID:17653, to the nucleotide sequence of VGAM286 RNA, herein designated VGAM RNA, also designated SEQ ID:2997.

Another function of VGAM286 is therefore inhibition of JJAZ1 (Accession NM_015355), a gene which is a zinc finger protein. Accordingly, utilities of VGAM286 include diagnosis, prevention and treatment of diseases and clinical conditions associated with JJAZ1. The function of JJAZ1 and its association with various diseases and clinical conditions, has been established by previous studies, as described hereinabove with reference to VGAM231. KIAA1223 (Accession XM_048747) is another VGAM286 host target gene. KIAA1223 BINDING SITE is HOST TARGET binding site found in the 3' untranslated region of mRNA encoded by KIAA1223, corresponding to a HOST TARGET binding site such as BINDING SITE I, BINDING SITE II or BINDING SITE III. Table 2 illustrates the complementarity of the nucleotide sequences of KIAA1223 BINDING SITE, designated SEQ ID:35243, to the nucleotide sequence of VGAM286 RNA, herein designated VGAM RNA, also designated SEQ ID:2997.

Another function of VGAM286 is therefore inhibition of KIAA1223 (Accession XM_048747). Accordingly, utilities of VGAM286 include diagnosis, prevention and treatment of diseases and clinical conditions associated with KIAA1223. MGC4655 (Accession NM_033309) is another VGAM286 host target gene. MGC4655 BINDING SITE is HOST TARGET binding site found in the 3' untranslated region of mRNA encoded by MGC4655, corresponding to a HOST TARGET binding site such as BINDING SITE I, BINDING SITE II or BINDING SITE III. Table 2 illustrates the complementarity of the nucleotide sequences of MGC4655 BINDING SITE, designated SEQ ID:27144, to the nucleotide sequence of VGAM286 RNA, herein designated VGAM RNA, also designated SEQ ID:2997.

Another function of VGAM286 is therefore inhibition of MGC4655 (Accession NM_033309). Accordingly, utilities of VGAM286 include diagnosis, prevention and treatment of diseases and clinical conditions associated with MGC4655. R32184_3 (Accession NM_033420) is another VGAM286 host target gene. R32184_3 BINDING SITE is HOST TARGET binding site found in the 3' untranslated region of mRNA encoded by R32184_3, corresponding to a HOST TARGET binding site such as BINDING SITE I, BINDING SITE II or BINDING SITE III. Table 2 illustrates the complementarity of the nucleotide sequences of R32184_3 BINDING SITE, designated SEQ ID:27247, to the nucleotide sequence of VGAM286 RNA, herein designated VGAM RNA, also designated SEQ ID:2997.

Another function of VGAM286 is therefore inhibition of R32184_3 (Accession NM_033420). Accordingly, utilities of VGAM286 include diagnosis, prevention and treatment of diseases and clinical conditions associated with R32184_3. FIG. 1 further provides a conceptual description of a novel bioinformatically detected viral gene of the present invention, referred to here as Viral Genomic Address Messenger 287 (VGAM287) viral gene, which modulates expression of respective host target genes thereof, the function and utility of which host target genes is known in the art.

VGAM287 is a novel bioinformatically detected regulatory, non protein coding, viral micro RNA (miRNA) gene. The method by which VGAM287 was detected is described hereinabove with reference to FIGS. 1-8.

VGAM287 gene, herein designated VGAM GENE, is a viral gene contained in the genome of Epiphyas Postvittana Nucleopolyhedrovirus. VGAM287 host target gene, herein designated VGAM HOST TARGET GENE, is a human gene contained in the human genome.

VGAM287 gene encodes a VGAM287 precursor RNA, herein designated VGAM PRECURSOR RNA. Similar to other miRNA genes, and unlike most ordinary genes, VGAM287 precursor RNA does not encode a protein. A nucleotide sequence identical or highly similar to the nucleotide sequence of VGAM287 precursor RNA is designated SEQ ID:273, and is provided hereinbelow with reference to the sequence listing part. Nucleotide sequence SEQ ID:273 is located at position 89234 relative to the genome of Epiphyas Postvittana Nucleopolyhedrovirus.

VGAM287 precursor RNA folds onto itself, forming VGAM287 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM287 folded precursor RNA into VGAM287 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM287 RNA is designated SEQ ID:2998, and is provided hereinbelow with reference to the sequence listing part.

VGAM287 host target gene, herein designated VGAM HOST TARGET GENE, encodes a corresponding messenger RNA, VGAM287 host target RNA, herein designated VGAM HOST TARGET RNA. VGAM287 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM287 RNA, herein designated VGAM RNA, binds complementarily to one or more host target binding sites located in untranslated regions of VGAM287 host target RNA, herein designated VGAM HOST TARGET RNA. This complementary binding is due to the fact that the nucleotide sequence of VGAM287 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM287 RNA, herein designated VGAM RNA, may have a different number of host target binding sites in untranslated regions of a VGAM287 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM287 RNA, herein designated VGAM RNA, to host target binding sites on VGAM287 host target RNA, herein designated VGAM HOST TARGET RNA, such as BINDING SITE I, BINDING SITE II and BINDING SITE III, inhibits translation of VGAM287 host target RNA into VGAM287 host target protein, herein designated VGAM HOST TARGET PROTEIN. VGAM host target protein is therefore outlined by a broken line.

It is appreciated that VGAM287 host target gene, herein designated VGAM HOST TARGET GENE, in fact represents a plurality of VGAM287 host target genes. The mRNA of each one of this plurality of VGAM287 host target genes comprises one or more host target binding sites, each having a nucleotide sequence which is at least partly complementary to VGAM287 RNA, herein designated VGAM RNA, and which when bound by VGAM287 RNA causes inhibition of translation of respective one or more VGAM287 host target proteins.

It is further appreciated by one skilled in the art that the mode of translational inhibition illustrated by FIG. 1 with specific reference to translational inhibition exerted by VGAM287 gene, herein designated VGAM GENE, on one or more VGAM287 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM287 is inhibition of expression of host target genes, as part of a novel viral mechanism of attacking a host. Accordingly, utilities of VGAM287 include diagnosis, prevention and treatment of viral infection by Epiphyas Postvittana Nucleopolyhedrovirus. Specific functions, and accordingly utilities, of VGAM287 correlate with, and may be deduced from, the identity of the host target genes which VGAM287 binds and inhibits, and the function of these host target genes, as elaborated hereinbelow.

Nucleotide sequences of the VGAM287 precursor RNA, herein designated VGAM PRECURSOR RNA, and of the 'diced' VGAM287 RNA, herein designated VGAM RNA, and a schematic representation of the secondary folding of VGAM287 folded precursor RNA, herein designated VGAM FOLDED PRECURSOR RNA, of VGAM287 are further described hereinbelow with reference to Table 1.

Nucleotide sequences of host target binding sites, such as BINDING SITE-I, BINDING SITE-II and BINDING SITE-III of FIG. 1, found on VGAM287 host target RNA, and schematic representation of the complementarity of each of these host target binding sites to VGAM287 RNA, herein designated VGAM RNA, are described hereinbelow with reference to Table 2.

As mentioned hereinabove with reference to FIG. 1, a function of VGAM287 gene, herein designated VGAM is inhibition of expression of VGAM287 target genes. It is appreciated that specific functions, and accordingly utilities, of VGAM287 correlate with, and may be deduced from, the identity of the target genes which VGAM287 binds and inhibits, and the function of these target genes, as elaborated hereinbelow.

Amylo-1, 6-glucosidase, 4-alpha-glucanotransferase (glycogen debranching enzyme, glycogen storage disease type III) (AGL, Accession NM_000028) is a VGAM287 host target gene. AGL BINDING SITE1 through AGL BINDING SITE6 are HOST TARGET binding sites found in untranslated regions of mRNA encoded by AGL, corresponding to HOST TARGET binding sites such as BINDING SITE I, BINDING SITE II or BINDING SITE III. Table 2 illustrates the complementarity of the nucleotide sequences of AGL BINDING SITE1 through AGL BINDING SITE6, designated SEQ ID:5467, SEQ ID:6284, SEQ ID:6289, SEQ ID:6294, SEQ ID:6299 and SEQ ID:6306 respectively, to the nucleotide sequence of VGAM287 RNA, herein designated VGAM RNA, also designated SEQ ID:2998.

A function of VGAM287 is therefore inhibition of Amylo-1, 6-glucosidase, 4-alpha-glucanotransferase (glycogen debranching enzyme, glycogen storage disease type III) (AGL, Accession NM_000028). Accordingly, utilities of VGAM287 include diagnosis, prevention and treatment of diseases and clinical conditions associated with AGL. FIG. 1 further provides a conceptual description of a novel bioinformatically detected viral gene of the present invention, referred to here as Viral Genomic Address Messenger 288 (VGAM288) viral gene, which modulates expression of respective host target genes thereof, the function and utility of which host target genes is known in the art.

VGAM288 is a novel bioinformatically detected regulatory, non protein coding, viral micro RNA (miRNA) gene. The method by which VGAM288 was detected is described hereinabove with reference to FIGS. 1-8.

VGAM288 gene, herein designated VGAM GENE, is a viral gene contained in the genome of Epiphyas Postvittana Nucleopolyhedrovirus. VGAM288 host target gene, herein designated VGAM HOST TARGET GENE, is a human gene contained in the human genome.

VGAM288 gene encodes a VGAM288 precursor RNA, herein designated VGAM PRECURSOR RNA. Similar to other miRNA genes, and unlike most ordinary genes, VGAM288 precursor RNA does not encode a protein. A nucleotide sequence identical or highly similar to the nucleotide sequence of VGAM288 precursor RNA is designated SEQ ID:274, and is provided hereinbelow with reference to the sequence listing part. Nucleotide sequence SEQ ID:274 is located at position 54105 relative to the genome of Epiphyas Postvittana Nucleopolyhedrovirus.

VGAM288 precursor RNA folds onto itself, forming VGAM288 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM288 folded precursor RNA into VGAM288 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM288 RNA is designated SEQ ID:2999, and is provided hereinbelow with reference to the sequence listing part.

VGAM288 host target gene, herein designated VGAM HOST TARGET GENE, encodes a corresponding messenger RNA, VGAM288 host target RNA, herein designated VGAM HOST TARGET RNA. VGAM288 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM288 RNA, herein designated VGAM RNA, binds complementarily to one or more host target binding sites located in untranslated regions of VGAM288 host target RNA, herein designated VGAM HOST TARGET RNA. This complementary binding is due to the fact that the nucleotide sequence of VGAM288 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM288 RNA, herein designated VGAM RNA, may have a different number of host target binding sites in untranslated regions of a VGAM288 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM288 RNA, herein designated VGAM RNA, to host target binding sites on VGAM288 host target RNA, herein designated VGAM HOST TARGET RNA, such as BINDING SITE I, BINDING SITE II and BINDING SITE III, inhibits translation of VGAM288 host target RNA into VGAM288 host target protein, herein designated VGAM HOST TARGET PROTEIN. VGAM host target protein is therefore outlined by a broken line.

It is appreciated that VGAM288 host target gene, herein designated VGAM HOST TARGET GENE, in fact represents a plurality of VGAM288 host target genes. The mRNA of each one of this plurality of VGAM288 host target genes comprises one or more host target binding sites, each having a nucleotide sequence which is at least partly complementary to VGAM288 RNA, herein designated VGAM RNA, and which when bound by VGAM288 RNA causes inhibition of translation of respective one or more VGAM288 host target proteins.

It is further appreciated by one skilled in the art that the mode of translational inhibition illustrated by FIG. 1 with specific reference to translational inhibition exerted by VGAM288 gene, herein designated VGAM GENE, on one or more VGAM288 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM288 is inhibition of expression of host target genes, as part of a novel viral mechanism of attacking a host. Accordingly, utilities of VGAM288 include diagnosis, prevention and treatment of viral infection by Epiphyas Postvittana Nucleopolyhedrovirus. Specific functions, and accordingly utilities, of VGAM288 correlate with, and may be deduced from, the identity of the host target genes which VGAM288 binds and inhibits, and the function of these host target genes, as elaborated hereinbelow.

Nucleotide sequences of the VGAM288 precursor RNA, herein designated VGAM PRECURSOR RNA, and of the 'diced' VGAM288 RNA, herein designated VGAM RNA, and a schematic representation of the secondary folding of VGAM288 folded precursor RNA, herein designated VGAM FOLDED PRECURSOR RNA, of VGAM288 are further described hereinbelow with reference to Table 1.

Nucleotide sequences of host target binding sites, such as BINDING SITE-I, BINDING SITE-II and BINDING SITE-III of FIG. 1, found on VGAM288 host target RNA, and schematic representation of the complementarity of each of these host target binding sites to VGAM288 RNA, herein designated VGAM RNA, are described hereinbelow with reference to Table 2.

As mentioned hereinabove with reference to FIG. 1, a function of VGAM288 gene, herein designated VGAM is inhibition of expression of VGAM288 target genes. It is appreciated that specific functions, and accordingly utilities, of VGAM288 correlate with, and may be deduced from, the identity of the target genes which VGAM288 binds and inhibits, and the function of these target genes, as elaborated hereinbelow.

IL2-inducible T-cell Kinase (ITK, Accession NM_005546) is a VGAM288 host target gene. ITK BINDING SITE is HOST TARGET binding site found in the 3' untranslated region of mRNA encoded by ITK, corresponding to a HOST TARGET binding site such as BINDING SITE I, BINDING SITE II or BINDING SITE III. Table 2 illustrates the complementarity of the nucleotide sequences of ITK BINDING SITE, designated SEQ ID:12076, to the nucleotide sequence of VGAM288 RNA, herein designated VGAM RNA, also designated SEQ ID:2999.

A function of VGAM288 is therefore inhibition of IL2-inducible T-cell Kinase (ITK, Accession NM_005546), a gene which plays a role in t cell proliferation and differentiation. Accordingly, utilities of VGAM288 include diagnosis, prevention and treatment of diseases and clinical conditions associated with ITK. The function of ITK has been established by previous studies. Signal transduction through the T-cell receptor (TCR; OMIM Ref. No. 186880) and cytokine receptors on the surface of T lymphocytes occurs largely via tyrosine phosphorylation of intracellular substrates. Signal transduction is thought to occur via association of these receptors with intracellular protein tyrosine kinases. To identify unique T-cell tyrosine kinases, Gibson et al. (1993) used PCR-based cloning with degenerate oligonucleotides directed at highly conserved motifs of tyrosine kinase domains. In this way, they cloned the complete cDNA for a unique human tyrosine kinase that is expressed mainly in T lymphocytes and natural killer (NK) cells. The cDNA predicted an open reading frame of 1,866 bp encoding a protein with a predicted size of 72 kD, which was in keeping with its size on Western blotting. A single 6.2-kb mRNA and 72-kD protein were detected in T lymphocytes and NK-like cell lines, but were not detected in other cell lineages. Sequence comparisons suggested that the protein is probably the human homolog of a murine interleukin-2-inducible T-cell kinase (ITK). However, unlike ITK, the message and protein levels for the new entity did not vary markedly on stimulation of human IL-2 responsive T cells with IL-2. They referred to the gene and its protein product as EMT ('expressed mainly in T cells'). They concluded that EMT is a member of a new family of intracellular kinases that includes BPK (the kinase mutant in X-linked agammaglobulinemia, 300300). The expression of EMT message and protein in thymocytes and mature T cells, combined with its homology to BPK and its chromosomal localization, suggested that EMT may play a role in thymic ontogeny and growth regulation of mature T cells. Integrin adhesion receptors mediate critical interactions of T cells with other cells and extracellular matrix components during trafficking, as well as during antigen-specific recognition events in tissue. Phosphatidylinositol 3-kinase (PI3K; OMIM Ref. No. 601232) has a role in the regulation of integrin activity by CD3 (see OMIM Ref. No. 186790)-TCR and in the regulation of ITK. Woods et al. (2001) determined that TCR-mediated activation of beta-1 integrins (see OMIM Ref. No. ITGB1; 135630) requires activation of ITK and PI3K-dependent recruitment of ITK to detergent-insoluble glycosphingolipid-enriched microdomains (DIGs) via binding of the pleckstrin homology domain of ITK to the PI3K product PI(3,4,5)-P3. Likewise, activation of PI3K and LCK (OMIM Ref. No. 153390) via CD4 (OMIM Ref. No. 186940) coreceptor stimulation can initiate beta-1 integrin activation dependent on ITK function. CD4 stimulation, together with targeting of ITK to DIGs, also activates TCR-independent beta-1 integrin function. Changes in beta-1 integrin function mediated by TCR-induced activation of ITK are accompanied by ITK-dependent modulation of the actin cytoskeleton. Woods et al. (2001) concluded that TCR-mediated activation of beta-1 integrin involves membrane relocalization and activation of ITK via coordinate action of PI3K and an SRC family tyrosine kinase. Animal model experiments lend further support to the function of ITK. By homologous recombination, Schaeffer et al. (1999) disrupted the Rlk (TXK; 600058) gene in mice. Heterozygotes were completely normal. Homozygous null Rlk mice showed increased amounts of Itk mRNA. The authors hypothesized that upregulation of related Tec kinases may partially compensate for the lack of Rlk. Schaeffer et al. (1999) therefore generated Rlk -/- Itk -/- mice by interbreeding. Itk-deficient mice have reduced numbers of mature T cells, particularly CD4+ cells, causing a decreased CD4-to-CD8 ratio. Rlk -/- Itk -/- mutants, however, had normal T cell numbers. Both CD4+ and CD8+ cell numbers are increased relative to Itk -/- mice. The persistent abnormal ratio of CD4+ to CD8+ cells suggested an altered regulation of lymphoid development and homeostasis in the double mutants. The double mutants had marked defects in T-cell receptor responses including proliferation, cytokine production, and apoptosis in vitro and adaptive immune responses to Toxoplasma gondii in vivo. Molecular events immediately downstream from the T-cell receptor were intact in Rlk -/- Itk -/- cells, but intermediate events including inositol trisphosphate production, calcium mobilization, and mitogen-activated protein kinase activation were impaired, establishing Tec kinases as critical regulators of T-cell receptor signaling required for phospholipase C-gamma activation.

It is appreciated that the abovementioned animal model for ITK is acknowledged by those skilled in the art as a scientifically valid animal model, as can be further appreciated from the publications sited hereinbelow.

Full details of the abovementioned studies are described in the following publications, the disclosure of which are hereby incorporated by reference:

Schaeffer, E. M.; Debnath, J.; Yap, G.; McVicar, D.; Liao, X. C.; Littman, D. R.; Sher, A.; Varmus, H. E.; Lenardo, M. J.; Schwartzberg, P. L.: Requirement for Tec kinases Rlk and Itk in T cell receptor signaling and immunity. Science 284: 638-641, 1999; and Woods, M. L.; Kivens, W. J.; Adelsman, M. A.; Qiu, Y.; August, A.; Shimizu, Y.: A novel function for the Tec family tyrosine kinase Itk in activation of beta-1 integrins by the T-cell.

Further studies establishing the function and utilities of ITK are found in John Hopkins OMIM database record ID 186973, and in sited publications numbered 1133-1137 listed in the bibliography section hereinbelow, which are also hereby incorporated by reference. Melatonin Receptor 1A (MTNR1A, Accession NM_005958) is another VGAM288 host target gene. MTNR1A BINDING SITE is HOST TARGET binding site found in the 3' untranslated region of mRNA encoded by MTNR1A, corresponding to a HOST TARGET binding site such as BINDING SITE I, BINDING SITE II or BINDING SITE III. Table 2 illustrates the complementarity of the nucleotide sequences of MTNR1A BINDING SITE, designated SEQ ID:12582, to the nucleotide sequence of VGAM288 RNA, herein designated VGAM RNA, also designated SEQ ID:2999.

Another function of VGAM288 is therefore inhibition of Melatonin Receptor 1A (MTNR1A, Accession NM_005958), a gene which likely mediates the reproductive and circadian actions of melatonin. Accordingly, utilities of VGAM288 include diagnosis, prevention and treatment of diseases and clinical conditions associated with MTNR1A. The function of MTNR1A has been established by previous studies. Reppert and Weaver (1995) reviewed the hormonal properties of melatonin and the characteristics of the melatonin receptors. Brzezinski (1997) likewise gave a comprehensive review of the function of melatonin and its clinical implications. Sleep disruption, nightly restlessness, sundowning, and other circadian disturbances are frequently seen in Alzheimer disease (AD; 104300) patients. Since melatonin is the main endocrine message for circadian rhythmicity from the pineal, Liu et al. (1999) studied melatonin levels in the cerebrospinal fluid (CSF) of 85 AD patients and 82 age-matched controls. In old control subjects (older than 80 years of age), CSF melatonin levels were half those of control subjects 41 to 80 years of age. In AD patients the CSF melatonin levels were only one-fifth of those in control subjects. The authors did not find a diurnal rhythm in CSF melatonin levels in control subjects or AD patients Von Gall et al. (2002) demonstrated that cycling expression of the clock gene Period-1 (OMIM Ref. No. 602260) in rodent pituitary cells depends on the heterologous sensitization of the adenosine A2B receptor (OMIM Ref. No. 600446), which occurs through the nocturnal activation of melatonin mt1 receptors. Eliminating the impact of the neurohormone melatonin simultaneously suppresses the expression of Period-1 and evokes an increase in the release of pituitary prolactin. Von Gall et al. (2002) concluded that their observations expose a mechanism by which 2 convergent signals interact within a temporal dimension to establish high-amplitude, precise, and robust cycles of gene expression.

Full details of the abovementioned studies are described in the following publications, the disclosure of which are hereby incorporated by reference:

von Gall, C.; Garabette, M. L.; Kell, C. A.; Frenzel, S.; Dehghani, F.; Schumm-Draeger, P.-M.; Weaver, D. R.; Korf, H.-W.; Hastings, M. H.; Stehle, J. H.: Rhythmic gene expression in pituitary depends on heterologous sensitization by the neurohormone melatonin. Nature Neurosci. 5:234-238, 2002; and Weaver, D. R.; Rivkees, S. A.; Carlson, L. L.; Reppert, S. M.: Localization of melatonin receptors in mammalian brain. In: Klein, D. C.; Moore, R. Y.; Reppert, S. M.: Suprachiasmatic.

Further studies establishing the function and utilities of MTNR1A are found in John Hopkins OMIM database record ID 600665, and in sited publications numbered 8179-8183, 812 and 10227 listed in the bibliography section hereinbelow, which are also hereby incorporated by reference. Oligophrenin 1 (OPHN1, Accession NM_002547) is another VGAM288 host target gene. OPHN1 BINDING SITE is HOST TARGET binding site found in the 5' untranslated region of mRNA encoded by OPHN1, corresponding to a HOST TARGET binding site such as BINDING SITE I, BINDING SITE II or BINDING SITE III. Table 2 illustrates the complementarity of the nucleotide sequences of OPHN1 BINDING SITE, designated SEQ ID:8405, to the nucleotide sequence of VGAM288 RNA, herein designated VGAM RNA, also designated SEQ ID:2999.

Another function of VGAM288 is therefore inhibition of Oligophrenin 1 (OPHN1, Accession NM_002547). Accordingly, utilities of VGAM288 include diagnosis, prevention and treatment of diseases and clinical conditions associated with OPHN1. Recombination Activating Gene 1 (RAG1, Accession NM_000448) is another VGAM288 host target gene. RAG1 BINDING SITE is HOST TARGET binding site found in the 3' untranslated region of mRNA encoded by RAG1, corresponding to a HOST TARGET binding site such as BINDING SITE I, BINDING SITE II or BINDING SITE III. Table 2 illustrates the complementarity of the nucleotide sequences of RAG1 BINDING SITE, designated SEQ ID:6040, to the nucleotide sequence of VGAM288 RNA, herein designated VGAM RNA, also designated SEQ ID:2999.

Another function of VGAM288 is therefore inhibition of Recombination Activating Gene 1 (RAG1, Accession NM_000448). Accordingly, utilities of VGAM288 include diagnosis, prevention and treatment of diseases and clinical conditions associated with RAG1. Solute Carrier Family 18 (vesicular acetylcholine), Member 3 (SLC18A3, Accession NM_003055) is another VGAM288 host target gene. SLC18A3 BINDING SITE is HOST TARGET binding site found in the 5' untranslated region of mRNA encoded by SLC18A3, corresponding to a HOST TARGET binding site such as BINDING SITE I, BINDING SITE II or BINDING SITE III. Table 2 illustrates the complementarity of the nucleotide sequences of SLC18A3 BINDING SITE, designated SEQ ID:9019, to the nucleotide sequence of VGAM288 RNA, herein designated VGAM RNA, also designated SEQ ID:2999.

Another function of VGAM288 is therefore inhibition of Solute Carrier Family 18 (vesicular acetylcholine), Member 3 (SLC18A3, Accession NM_003055). Accordingly, utilities of VGAM288 include diagnosis, prevention and treatment of diseases and clinical conditions associated with SLC18A3. Aquaporin 10 (AQP10, Accession NM_080429) is another VGAM288 host target gene. AQP10 BINDING SITE is HOST TARGET binding site found in the 3' untranslated region of mRNA encoded by AQP10, corresponding to a HOST TARGET binding site such as BINDING SITE I, BINDING SITE II or BINDING SITE III. Table 2 illustrates the complementarity of the nucleotide sequences of AQP10 BINDING SITE, designated SEQ ID:27840, to the nucleotide sequence of VGAM288 RNA, herein designated VGAM RNA, also designated SEQ ID:2999.

Another function of VGAM288 is therefore inhibition of Aquaporin 10 (AQP10, Accession NM_080429). Accordingly, utilities of VGAM288 include diagnosis, prevention and treatment of diseases and clinical conditions associated with AQP10. BTB (POZ) Domain Containing 3 (BTBD3, Accession NM_014962) is another VGAM288 host target gene. BTBD3 BINDING SITE is HOST TARGET binding site found in the 3' untranslated region of mRNA encoded by BTBD3, corresponding to a HOST TARGET binding site such as BINDING SITE I, BINDING SITE II or BINDING SITE III. Table 2 illustrates the complementarity of the nucleotide sequences of BTBD3 BINDING SITE, designated SEQ ID:17341, to the nucleotide sequence of VGAM288 RNA, herein designated VGAM RNA, also designated SEQ ID:2999.

Another function of VGAM288 is therefore inhibition of BTB (POZ) Domain Containing 3 (BTBD3, Accession NM_014962). Accordingly, utilities of VGAM288 include diagnosis, prevention and treatment of diseases and clinical conditions associated with BTBD3. DRCTNNB1A (Accession NM_032581) is another VGAM288 host target gene. DRCTNNB1A BINDING SITE is HOST TARGET binding site found in the 3' untranslated region of mRNA encoded by DRCTNNB1A, corresponding to a HOST TARGET binding site such as BINDING SITE I, BINDING SITE II or BINDING SITE III. Table 2 illustrates the complementarity of the nucleotide sequences of DRCTNNB1A BINDING SITE, designated SEQ ID:26316, to the nucleotide sequence of VGAM288 RNA, herein designated VGAM RNA, also designated SEQ ID:2999.

Another function of VGAM288 is therefore inhibition of DRCTNNB1A (Accession NM_032581). Accordingly, utilities of VGAM288 include diagnosis, prevention and treatment of diseases and clinical conditions associated with DRCTNNB1A. FLJ10700 (Accession NM_018182) is another VGAM288 host target gene. FLJ10700 BINDING SITE is HOST TARGET binding site found in the 3' untranslated region of mRNA encoded by FLJ10700, corresponding to a HOST TARGET binding site such as BINDING SITE I, BINDING SITE II or BINDING SITE III. Table 2 illustrates the complementarity of the nucleotide sequences of FLJ10700 BINDING SITE, designated SEQ ID:20021, to the nucleotide sequence of VGAM288 RNA, herein designated VGAM RNA, also designated SEQ ID:2999.

Another function of VGAM288 is therefore inhibition of FLJ10700 (Accession NM_018182). Accordingly, utilities of VGAM288 include diagnosis, prevention and treatment of diseases and clinical conditions associated with FLJ10700. FLJ23053 (Accession NM_022907) is another VGAM288 host target gene. FLJ23053 BINDING SITE is HOST TARGET binding site found in the 3' untranslated region of mRNA encoded by FLJ23053, corresponding to a HOST TARGET binding site such as BINDING SITE I, BINDING SITE II or BINDING SITE III. Table 2 illustrates the complementarity of the nucleotide sequences of FLJ23053 BINDING SITE, designated SEQ ID:23207, to the nucleotide sequence of VGAM288 RNA, herein designated VGAM RNA, also designated SEQ ID:2999.

Another function of VGAM288 is therefore inhibition of FLJ23053 (Accession NM_022907). Accordingly, utilities of VGAM288 include diagnosis, prevention and treatment of diseases and clinical conditions associated with FLJ23053. FLJ30663 (Accession XM_086046) is another VGAM288 host target gene. FLJ30663 BINDING SITE is HOST TARGET binding site found in the 3' untranslated region of mRNA encoded by FLJ30663, corresponding to a HOST TARGET binding site such as BINDING SITE I, BINDING SITE II or BINDING SITE III. Table 2 illustrates the complementarity of the nucleotide sequences of FLJ30663 BINDING SITE, designated SEQ ID:38462, to the nucleotide sequence of VGAM288 RNA, herein designated VGAM RNA, also designated SEQ ID:2999.

Another function of VGAM288 is therefore inhibition of FLJ30663 (Accession XM_086046). Accordingly, utilities of VGAM288 include diagnosis, prevention and treatment of diseases and clinical conditions associated with FLJ30663. Glycoprotein V (platelet) (GP5, Accession NM_004488) is another VGAM288 host target gene. GP5 BINDING SITE is HOST TARGET binding site found in the 3' untranslated region of mRNA encoded by GP5, corresponding to a HOST TARGET binding site such as BINDING SITE I, BINDING SITE II or BINDING SITE III. Table 2 illustrates the complementarity of the nucleotide sequences of GP5 BINDING SITE, designated SEQ ID:10818, to the nucleotide sequence of VGAM288 RNA, herein designated VGAM RNA, also designated SEQ ID:2999.

Another function of VGAM288 is therefore inhibition of Glycoprotein V (platelet) (GP5, Accession NM_004488). Accordingly, utilities of VGAM288 include diagnosis, prevention and treatment of diseases and clinical conditions associated with GP5. Hairy/enhancer-of-split Related with YRPW Motif-like (HEYL, Accession NM_014571) is another VGAM288 host target gene. HEYL BINDING SITE is HOST TARGET binding site found in the 3' untranslated region of mRNA encoded by HEYL, corresponding to a HOST TARGET binding site such as BINDING SITE I, BINDING SITE II or BINDING SITE III. Table 2 illustrates the complementarity of the nucleotide sequences of HEYL BINDING SITE, designated SEQ ID:15931, to the nucleotide sequence of VGAM288 RNA, herein designated VGAM RNA, also designated SEQ ID:2999.

Another function of VGAM288 is therefore inhibition of Hairy/enhancer-of-split Related with YRPW Motif-like (HEYL, Accession NM_014571). Accordingly, utilities of VGAM288 include diagnosis, prevention and treatment of diseases and clinical conditions associated with HEYL. KIAA0254 (Accession NM_014758) is another VGAM288 host target gene. KIAA0254 BINDING SITE is HOST TARGET binding site found in the 3' untranslated region of mRNA encoded by KIAA0254, corresponding to a HOST TARGET binding site such as BINDING SITE I, BINDING SITE II or BINDING SITE III. Table 2 illustrates the complementarity of the nucleotide sequences of KIAA0254 BINDING SITE, designated SEQ ID:16507, to the nucleotide sequence of VGAM288 RNA, herein designated VGAM RNA, also designated SEQ ID:2999.

Another function of VGAM288 is therefore inhibition of KIAA0254 (Accession NM_014758). Accordingly, utilities of VGAM288 include diagnosis, prevention and treatment of diseases and clinical conditions associated with KIAA0254. KIAA0447 (Accession XM_049733) is another VGAM288 host target gene. KIAA0447 BINDING SITE is HOST TARGET binding site found in the 3' untranslated region of mRNA encoded by KIAA0447, corresponding to a HOST TARGET binding site such as BINDING SITE I, BINDING SITE II or BINDING SITE III. Table 2 illustrates the complementarity of the nucleotide sequences of KIAA0447 BINDING SITE, designated SEQ ID:35495, to the nucleotide sequence of VGAM288 RNA, herein designated VGAM RNA, also designated SEQ ID:2999.

Another function of VGAM288 is therefore inhibition of KIAA0447 (Accession XM_049733). Accordingly, utilities of VGAM288 include diagnosis, prevention and treatment of diseases and clinical conditions associated with KIAA0447. KIAA0547 (Accession NM_014793) is another VGAM288 host target gene. KIAA0547 BINDING SITE is HOST TARGET binding site found in the 3' untranslated region of mRNA encoded by KIAA0547, corresponding to a HOST TARGET binding site such as BINDING SITE I, BINDING SITE II or BINDING SITE III. Table 2 illustrates the complementarity of the nucleotide sequences of KIAA0547 BINDING SITE, designated SEQ ID:16696, to the nucleotide sequence of VGAM288 RNA, herein designated VGAM RNA, also designated SEQ ID:2999.

Another function of VGAM288 is therefore inhibition of KIAA0547 (Accession NM_014793). Accordingly, utilities of VGAM288 include diagnosis, prevention and treatment of diseases and clinical conditions associated with KIAA0547. KIAA0892 (Accession XM_048457) is another VGAM288 host target gene. KIAA0892 BINDING SITE is HOST TARGET binding site found in the 3' untranslated region of mRNA encoded by KIAA0892, corresponding to a HOST TARGET binding site such as BINDING SITE I, BINDING SITE II or BINDING SITE III. Table 2 illustrates the complementarity of the nucleotide sequences of KIAA0892 BINDING SITE, designated SEQ ID:35171, to the nucleotide sequence of VGAM288 RNA, herein designated VGAM RNA, also designated SEQ ID:2999.

Another function of VGAM288 is therefore inhibition of KIAA0892 (Accession XM_048457). Accordingly, utilities of VGAM288 include diagnosis, prevention and treatment of diseases and clinical conditions associated with KIAA0892. KIAA1223 (Accession XM_048747) is another VGAM288 host target gene. KIAA1223 BINDING SITE is HOST TARGET binding site found in the 3' untranslated region of mRNA encoded by KIAA1223, corresponding to a HOST TARGET binding site such as BINDING SITE I, BINDING SITE II or BINDING SITE III. Table 2 illustrates the complementarity of the nucleotide sequences of KIAA1223 BINDING SITE, designated SEQ ID:35249, to the nucleotide sequence of VGAM288 RNA, herein designated VGAM RNA, also designated SEQ ID:2999.

Another function of VGAM288 is therefore inhibition of KIAA1223 (Accession XM_048747). Accordingly, utilities of VGAM288 include diagnosis, prevention and treatment of diseases and clinical conditions associated with KIAA1223. KIAA1354 (Accession XM_027604) is another VGAM288 host target gene. KIAA1354 BINDING SITE is HOST TARGET binding site found in the 3' untranslated region of mRNA encoded by KIAA1354, corresponding to a HOST TARGET binding site such as BINDING SITE I, BINDING SITE II or BINDING SITE III. Table 2 illustrates the complementarity of the nucleotide sequences of KIAA1354 BINDING SITE, designated SEQ ID:30540, to the nucleotide sequence of VGAM288 RNA, herein designated VGAM RNA, also designated SEQ ID:2999.

Another function of VGAM288 is therefore inhibition of KIAA1354 (Accession XM_027604). Accordingly, utilities of VGAM288 include diagnosis, prevention and treatment of diseases and clinical conditions associated with KIAA1354. MGC14859 (Accession XM_030295) is another VGAM288 host target gene. MGC14859 BINDING SITE is HOST TARGET binding site found in the 3' untranslated region of mRNA encoded by MGC14859, corresponding to a HOST TARGET binding site such as BINDING SITE I, BINDING SITE II or BINDING SITE III. Table 2 illustrates the complementarity of the nucleotide sequences of MGC14859 BINDING SITE, designated SEQ ID:31006, to the nucleotide sequence of VGAM288 RNA, herein designated VGAM RNA, also designated SEQ ID:2999.

Another function of VGAM288 is therefore inhibition of MGC14859 (Accession XM_030295). Accordingly, utilities of VGAM288 include diagnosis, prevention and treatment of diseases and clinical conditions associated with MGC14859. Purinergic Receptor P2X, Ligand-gated Ion Channel, 1 (P2RX1, Accession XM_040635) is another VGAM288 host target gene. P2RX1 BINDING SITE is HOST TARGET binding site found in the 3' untranslated region of mRNA encoded by P2RX1, corresponding to a HOST TARGET binding site such as BINDING SITE I, BINDING SITE II or BINDING SITE III. Table 2 illustrates the complementarity of the nucleotide sequences of P2RX1 BINDING SITE, designated SEQ ID:33358, to the nucleotide sequence of VGAM288 RNA, herein designated VGAM RNA, also designated SEQ ID:2999.

Another function of VGAM288 is therefore inhibition of Purinergic Receptor P2X, Ligand-gated Ion Channel, 1 (P2RX1, Accession XM_040635). Accordingly, utilities of VGAM288 include diagnosis, prevention and treatment of diseases and clinical conditions associated with P2RX1. Sep.in 3 (SEPT3, Accession NM_019106) is another VGAM288 host target gene. SEPT3 BINDING SITE is HOST TARGET binding site found in the 3' untranslated region of mRNA encoded by SEPT3, corresponding to a HOST TARGET binding site such as BINDING SITE I, BINDING SITE II or BINDING SITE III. Table 2 illustrates the complementarity of the nucleotide sequences of SEPT3 BINDING SITE, designated SEQ ID:21184, to the nucleotide sequence of VGAM288 RNA, herein designated VGAM RNA, also designated SEQ ID:2999.

Another function of VGAM288 is therefore inhibition of Sep.in 3 (SEPT3, Accession NM_019106). Accordingly, utilities of VGAM288 include diagnosis, prevention and treatment of diseases and clinical conditions associated with SEPT3. LOC150095 (Accession XM_097805) is another VGAM288 host target gene. LOC150095 BINDING SITE is HOST TARGET binding site found in the 5' untranslated region of mRNA encoded by LOC150095, corresponding to a HOST TARGET binding site such as BINDING SITE I, BINDING SITE II or BINDING SITE III. Table 2 illustrates the complementarity of the nucleotide sequences of LOC150095 BINDING SITE, designated SEQ ID:41131, to the nucleotide sequence of VGAM288 RNA, herein designated VGAM RNA, also designated SEQ ID:2999.

Another function of VGAM288 is therefore inhibition of LOC150095 (Accession XM_097805). Accordingly, utilities of VGAM288 include diagnosis, prevention and treatment of diseases and clinical conditions associated with LOC150095. LOC163915 (Accession XM_099567) is another VGAM288 host target gene. LOC163915 BINDING SITE is HOST TARGET binding site found in the 5' untranslated region of mRNA encoded by LOC163915, corresponding to a HOST TARGET binding site such as BINDING SITE I, BINDING SITE II or BINDING SITE III. Table 2 illustrates the complementarity of the nucleotide sequences of LOC163915 BINDING SITE, designated SEQ ID:42100, to the nucleotide sequence of VGAM288 RNA, herein designated VGAM RNA, also designated SEQ ID:2999.

Another function of VGAM288 is therefore inhibition of LOC163915 (Accession XM_099567). Accordingly, utilities of VGAM288 include diagnosis, prevention and treatment of diseases and clinical conditions associated with LOC163915. LOC165568 (Accession XM_092674) is another VGAM288 host target gene. LOC165568 BINDING SITE is HOST TARGET binding site found in the 5' untranslated region of mRNA encoded by LOC165568, corresponding to a HOST TARGET binding site such as BINDING SITE I, BINDING SITE II or BINDING SITE III. Table 2 illustrates the complementarity of the nucleotide sequences of LOC165568 BINDING SITE, designated SEQ ID:40138, to the nucleotide sequence of VGAM288 RNA, herein designated VGAM RNA, also designated SEQ ID:2999.

Another function of VGAM288 is therefore inhibition of LOC165568 (Accession XM_092674). Accordingly, utilities of VGAM288 include diagnosis, prevention and treatment of diseases and clinical conditions associated with LOC165568. LOC197285 (Accession XM_113752) is another VGAM288 host target gene. LOC197285 BINDING SITE is HOST TARGET binding site found in the 3' untranslated region of mRNA encoded by LOC197285, corresponding to a HOST TARGET binding site such as BINDING SITE I, BINDING SITE II or BINDING SITE III. Table 2 illustrates the complementarity of the nucleotide sequences of LOC197285 BINDING SITE, designated SEQ ID:42413, to the nucleotide sequence of VGAM288 RNA, herein designated VGAM RNA, also designated SEQ ID:2999.

Another function of VGAM288 is therefore inhibition of LOC197285 (Accession XM_113752). Accordingly, utilities of VGAM288 include diagnosis, prevention and treatment of diseases and clinical conditions associated with LOC197285. LOC256997 (Accession XM_170900) is another VGAM288 host target gene. LOC256997 BINDING SITE is HOST TARGET binding site found in the 5' untranslated region of mRNA encoded by LOC256997, corresponding to a HOST TARGET binding site such as BINDING SITE I, BINDING SITE II or BINDING SITE III. Table 2 illustrates the complementarity of the nucleotide sequences of LOC256997 BINDING SITE, designated SEQ ID:45653, to the nucleotide sequence of VGAM288 RNA, herein designated VGAM RNA, also designated SEQ ID:2999.

Another function of VGAM288 is therefore inhibition of LOC256997 (Accession XM_170900). Accordingly, utilities of VGAM288 include diagnosis, prevention and treatment of diseases and clinical conditions associated with LOC256997. FIG. 1 further provides a conceptual description of a novel bioinformatically detected viral gene of the present invention, referred to here as Viral Genomic Address Messenger 289 (VGAM289) viral gene, which modulates expression of respective host target genes thereof, the function and utility of which host target genes is known in the art.

VGAM289 is a novel bioinformatically detected regulatory, non protein coding, viral micro RNA (miRNA) gene. The method by which VGAM289 was detected is described hereinabove with reference to FIGS. 1-8.

VGAM289 gene, herein designated VGAM GENE, is a viral gene contained in the genome of Epiphyas Postvittana Nucleopolyhedrovirus. VGAM289 host target gene, herein designated VGAM HOST TARGET GENE, is a human gene contained in the human genome.

VGAM289 gene encodes a VGAM289 precursor RNA, herein designated VGAM PRECURSOR RNA. Similar to other miRNA genes, and unlike most ordinary genes, VGAM289 precursor RNA does not encode a protein. A nucleotide sequence identical or highly similar to the nucleotide sequence of VGAM289 precursor RNA is designated SEQ ID:275, and is provided hereinbelow with reference to the sequence listing part. Nucleotide sequence SEQ ID:275 is located at position 113982 relative to the genome of Epiphyas Postvittana Nucleopolyhedrovirus.

VGAM289 precursor RNA folds onto itself, forming VGAM289 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM289 folded precursor RNA into VGAM289 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM289 RNA is designated SEQ ID:3000, and is provided hereinbelow with reference to the sequence listing part.

VGAM289 host target gene, herein designated VGAM HOST TARGET GENE, encodes a corresponding messenger RNA, VGAM289 host target RNA, herein designated VGAM HOST TARGET RNA. VGAM289 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM289 RNA, herein designated VGAM RNA, binds complementarily to one or more host target binding sites located in untranslated regions of VGAM289 host target RNA, herein designated VGAM HOST TARGET RNA. This complementary binding is due to the fact that the nucleotide sequence of VGAM289 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM289 RNA, herein designated VGAM RNA, may have a different number of host target binding sites in untranslated regions of a VGAM289 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM289 RNA, herein designated VGAM RNA, to host target binding sites on VGAM289 host target RNA, herein designated VGAM HOST TARGET RNA, such as BINDING SITE I, BINDING SITE II and BINDING SITE III, inhibits translation of VGAM289 host target RNA into VGAM289 host target protein, herein designated VGAM HOST TARGET PROTEIN. VGAM host target protein is therefore outlined by a broken line.

It is appreciated that VGAM289 host target gene, herein designated VGAM HOST TARGET GENE, in fact represents a plurality of VGAM289 host target genes. The mRNA of each one of this plurality of VGAM289 host target genes comprises one or more host target binding sites, each having a nucleotide sequence which is at least partly complementary to VGAM289 RNA, herein designated VGAM RNA, and which when bound by VGAM289 RNA causes inhibition of translation of respective one or more VGAM289 host target proteins.

It is further appreciated by one skilled in the art that the mode of translational inhibition illustrated by FIG. 1 with specific reference to translational inhibition exerted by VGAM289 gene, herein designated VGAM GENE, on one or more VGAM289 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM289 is inhibition of expression of host target genes, as part of a novel viral mechanism of attacking a host. Accordingly, utilities of VGAM289 include diagnosis, prevention and treatment of viral infection by Epiphyas Postvittana Nucleopolyhedrovirus. Specific functions, and accordingly utilities, of VGAM289 correlate with, and may be deduced from, the identity of the host target genes which VGAM289 binds and inhibits, and the function of these host target genes, as elaborated hereinbelow.

Nucleotide sequences of the VGAM289 precursor RNA, herein designated VGAM PRECURSOR RNA, and of the 'diced' VGAM289 RNA, herein designated VGAM RNA, and a schematic representation of the secondary folding of VGAM289 folded precursor RNA, herein designated VGAM FOLDED PRECURSOR RNA, of VGAM289 are further described hereinbelow with reference to Table 1.

Nucleotide sequences of host target binding sites, such as BINDING SITE-I, BINDING SITE-II and BINDING SITE-III of FIG. 1, found on VGAM289 host target RNA, and schematic representation of the complementarity of each of these host target binding sites to VGAM289 RNA, herein designated VGAM RNA, are described hereinbelow with reference to Table 2.

As mentioned hereinabove with reference to FIG. 1, a function of VGAM289 gene, herein designated VGAM is inhibition of expression of VGAM289 target genes. It is appreciated that specific functions, and accordingly utilities, of VGAM289 correlate with, and may be deduced from, the identity of the target genes which VGAM289 binds and inhibits, and the function of these target genes, as elaborated hereinbelow.

Chromosome X Open Reading Frame 6 (CXorf6, Accession NM_005491) is a VGAM289 host target gene. CXorf6 BINDING SITE is HOST TARGET binding site found in the 3' untranslated region of mRNA encoded by CXorf6, corresponding to a HOST TARGET binding site such as BINDING SITE I, BINDING SITE II or BINDING SITE III. Table 2 illustrates the complementarity of the nucleotide sequences of CXorf6 BINDING SITE, designated SEQ ID:11989, to the nucleotide sequence of VGAM289 RNA, herein designated VGAM RNA, also designated SEQ ID:3000.

A function of VGAM289 is therefore inhibition of Chromosome X Open Reading Frame 6 (CXorf6, Accession NM_005491). Accordingly, utilities of VGAM289 include diagnosis, prevention and treatment of diseases and clinical conditions associated with CXorf6. Heterogeneous Nuclear Ribonucleoprotein D-like (HNRPDL, Accession NM_005463) is another VGAM289 host target gene. HNRPDL BINDING SITE is HOST TARGET binding site found in the 3' untranslated region of mRNA encoded by HNRPDL, corresponding to a HOST TARGET binding site such as BINDING SITE I, BINDING SITE II or BINDING SITE III. Table 2 illustrates the complementarity of the nucleotide sequences of HNRPDL BINDING SITE, designated SEQ ID:11948, to the nucleotide sequence of VGAM289 RNA, herein designated VGAM RNA, also designated SEQ ID:3000.

Another function of VGAM289 is therefore inhibition of Heterogeneous Nuclear Ribonucleoprotein D-like (HNRPDL, Accession NM_005463), a gene which binds to rna molecules that contain au-rich elements. Accordingly, utilities of VGAM289 include diagnosis, prevention and treatment of diseases and clinical conditions associated with HNRPDL. The function of HNRPDL and its association with various diseases and clinical conditions, has been established by previous studies, as described hereinabove with reference to VGAM144. Solute Carrier Family 9 (sodium/hydrogen exchanger), Isoform 3 Regulatory Factor 1 (SLC9A3R1, Accession XM_046932) is another VGAM289 host target gene. SLC9A3R1 BINDING SITE is HOST TARGET binding site found in the 3' untranslated region of mRNA encoded by SLC9A3R1, corresponding to a HOST TARGET binding site such as BINDING SITE I, BINDING SITE II or BINDING SITE III. Table 2 illustrates the complementarity of the nucleotide sequences of SLC9A3R1 BINDING SITE, designated SEQ ID:34864, to the nucleotide sequence of VGAM289 RNA, herein designated VGAM RNA, also designated SEQ ID:3000.

Another function of VGAM289 is therefore inhibition of Solute Carrier Family 9 (sodium/hydrogen exchanger), Isoform 3 Regulatory Factor 1 (SLC9A3R1, Accession XM_046932), a gene which is the regulatory cofactor of the NHE3 (SLC9A3) sodium/hydrogen antiporter. Accordingly, utilities of VGAM289 include diagnosis, prevention and treatment of diseases and clinical conditions associated with SLC9A3R1. The function of SLC9A3R1 has been established by previous studies. Murthy et al. (1998) isolated SLC9A3R1, which they termed NHERF, by screening a fetal frontal cortex cDNA library using a yeast 2-hybrid system with merlin as bait. Northern blot analysis revealed that SLC9A3R1 is ubiquitously expressed, with highest levels in kidney, liver, and pancreas. Deletion and mutation analyses showed that SLC9A3R1 associates with the N terminus but not with the C terminus of merlin. SLC9A3R1 was also shown to bind to moesin and radixin at the N terminus, the region with the most homology to merlin. Using immunocytochemistry, Murthy et al. (1998) demonstrated that SLC9A3R1 colocalizes with moesin at the ruffling membrane, microvilli, and filopodia in HeLa cells Animal model experiments lend further support to the function of SLC9A3R1. Shenolikar et al. (2002) found that targeted disruption of the mouse Nherf1 gene eliminated Nherf1 expression in kidney and other tissues of the mutant mice without altering Nherf2 levels in these tissues. Heterozygous and homozygous deficient male mice maintained normal blood electrolytes but showed increased urinary excretion of phosphate when compared with homozygous wildtype animals. Although the overall levels of renal Nherf1 targets, Slc9a3 and sodium-phosphate transport-2 (Npt2; 182309), were unchanged in the mutant mice, immunocytochemistry showed that the Npt2 protein was aberrantly localized at internal sites in the renal proximal tubule cells. The mislocalization of Npt2 paralleled a reduction in the transporter protein in renal brush-border membranes isolated from the mutant mice. In contrast, Slc9a3 was appropriately localized at the apical surface of proximal tubules in both wildtype and mutant mice. These data suggested that NHERF1 plays a unique role in the apical targeting and/or trafficking of NPT2 in the mammalian kidney, a function not shared by NHERF2 or other renal PDZ proteins. Phosphate wasting seen in the Nherf1 homozygous null mice provided a novel experimental system for defining the role of PDZ adaptors in the hormonal control of ion transport and renal disease It is appreciated that the abovementioned animal model for SLC9A3R1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shenolikar, S.; Voltz, J. W.; Minkoff, C. M.; Wade, J. B.; Weinman, E. J.: Targeted disruption of the mouse NHERF-1 gene promotes internalization of proximal tubule sodium-phosphate cotransporter type IIa and renal phosphate wasting. Proc. Nat. Acad. Sci. 99:11470-11475, 2002; and Murthy, A.; Gonzalez-Agosti, C.; Cordero, E.; Pinney, D.; Candia, C.; Solomon, F.; Gusella, J.; Ramesh, V.: NHE-RF, a regulatory cofactor for Na (+)-H(+) exchange, is a common interactor f.

Further studies establishing the function and utilities of SLC9A3R1 are found in John Hopkins OMIM database record ID 604990, and in sited publications numbered 434 and 7098-7100 listed in the bibliography section hereinbelow, which are also hereby incorporated by reference. Zinc Finger Protein 36, C3H Type-like 1 (ZFP36L1, Accession NM_004926) is another VGAM289 host target gene. ZFP36L1 BINDING SITE is HOST TARGET binding site found in the 3' untranslated region of mRNA encoded by ZFP36L1, corresponding to a HOST TARGET binding site such as BINDING SITE I, BINDING SITE II or BINDING SITE III. Table 2 illustrates the complementarity of the nucleotide sequences of ZFP36L1 BINDING SITE, designated SEQ ID:11361, to the nucleotide sequence of VGAM289 RNA, herein designated VGAM RNA, also designated SEQ ID:3000.

Another function of VGAM289 is therefore inhibition of Zinc Finger Protein 36, C3H Type-like 1 (ZFP36L1, Accession NM_004926), a gene which is a regulatory protein involved in regulating the response to growth factors. Accordingly, utilities of VGAM289 include diagnosis, prevention and treatment of diseases and clinical conditions associated with ZFP36L1. The function of ZFP36L1 and its association with various diseases and clinical conditions, has been established by previous studies, as described hereinabove with reference to VGAM74. ARHGAP10 (Accession NM_020824) is another VGAM289 host target gene. ARHGAP10 BINDING SITE is HOST TARGET binding site found in the 3' untranslated region of mRNA encoded by ARHGAP10, corresponding to a HOST TARGET binding site such as BINDING SITE I, BINDING SITE II or BINDING SITE III. Table 2 illustrates the complementarity of the nucleotide sequences of ARHGAP10 BINDING SITE, designated SEQ ID:21888, to the nucleotide sequence of VGAM289 RNA, herein designated VGAM RNA, also designated SEQ ID:3000.

Another function of VGAM289 is therefore inhibition of ARHGAP10 (Accession NM_020824). Accordingly, utilities of VGAM289 include diagnosis, prevention and treatment of diseases and clinical conditions associated with ARHGAP10. GBTS1 (Accession NM_145173) is another VGAM289 host target gene. GBTS1 BINDING SITE is HOST TARGET binding site found in the 3' untranslated region of mRNA encoded by GBTS1, corresponding to a HOST TARGET binding site such as BINDING SITE I, BINDING SITE II or BINDING SITE III. Table 2 illustrates the complementarity of the nucleotide sequences of GBTS1 BINDING SITE, designated SEQ ID:29724, to the nucleotide sequence of VGAM289 RNA, herein designated VGAM RNA, also designated SEQ ID:3000.

Another function of VGAM289 is therefore inhibition of GBTS1 (Accession NM_145173). Accordingly, utilities of VGAM289 include diagnosis, prevention and treatment of diseases and clinical conditions associated with GBTS1. KIAA0547 (Accession NM_014793) is another VGAM289 host target gene. KIAA0547 BINDING SITE is HOST TARGET binding site found in the 3' untranslated region of mRNA encoded by KIAA0547, corresponding to a HOST TARGET binding site such as BINDING SITE I, BINDING SITE II or BINDING SITE III. Table 2 illustrates the complementarity of the nucleotide sequences of KIAA0547 BINDING SITE, designated SEQ ID:16694, to the nucleotide sequence of VGAM289 RNA, herein designated VGAM RNA, also designated SEQ ID:3000.

Another function of VGAM289 is therefore inhibition of KIAA0547 (Accession NM_014793). Accordingly, utilities of VGAM289 include diagnosis, prevention and treatment of diseases and clinical conditions associated with KIAA0547. MEGF10 (Accession NM_032446) is another VGAM289 host target gene. MEGF10 BINDING SITE is HOST TARGET binding site found in the 3' untranslated region of mRNA encoded by MEGF10, corresponding to a HOST TARGET binding site such as BINDING SITE I, BINDING SITE II or BINDING SITE III. Table 2 illustrates the complementarity of the nucleotide sequences of MEGF10 BINDING SITE, designated SEQ ID:26207, to the nucleotide sequence of VGAM289 RNA, herein designated VGAM RNA, also designated SEQ ID:3000.

Another function of VGAM289 is therefore inhibition of MEGF10 (Accession NM_032446). Accordingly, utilities of VGAM289 include diagnosis, prevention and treatment of diseases and clinical conditions associated with MEGF10. LOC146455 (Accession XM_085471) is another VGAM289 host target gene. LOC146455 BINDING SITE is HOST TARGET binding site found in the 3' untranslated region of mRNA encoded by LOC146455, corresponding to a HOST TARGET binding site such as BINDING SITE I, BINDING SITE II or BINDING SITE III. Table 2 illustrates the complementarity of the nucleotide sequences of LOC146455 BINDING SITE, designated SEQ ID:38154, to the nucleotide sequence of VGAM289 RNA, herein designated VGAM RNA, also designated SEQ ID:3000.

Another function of VGAM289 is therefore inhibition of LOC146455 (Accession XM_085471). Accordingly, utilities of VGAM289 include diagnosis, prevention and treatment of diseases and clinical conditions associated with LOC146455. LOC204084 (Accession XM_115181) is another VGAM289 host target gene. LOC204084 BINDING SITE is HOST TARGET binding site found in the 3' untranslated region of mRNA encoded by LOC204084, corresponding to a HOST TARGET binding site such as BINDING SITE I, BINDING SITE II or BINDING SITE III. Table 2 illustrates the complementarity of the nucleotide sequences of LOC204084 BINDING SITE, designated SEQ ID:43085, to the nucleotide sequence of VGAM289 RNA, herein designated VGAM RNA, also designated SEQ ID:3000.

Another function of VGAM289 is therefore inhibition of LOC204084 (Accession XM_115181). Accordingly, utilities of VGAM289 include diagnosis, prevention and treatment of diseases and clinical conditions associated with LOC204084. FIG. 1 further provides a conceptual description of a novel bioinformatically detected viral gene of the present invention, referred to here as Viral Genomic Address Messenger 290 (VGAM290) viral gene, which modulates expression of respective host target genes thereof, the function and utility of which host target genes is known in the art.

VGAM290 is a novel bioinformatically detected regulatory, non protein coding, viral micro RNA (miRNA) gene. The method by which VGAM290 was detected is described hereinabove with reference to FIGS. 1-8.

VGAM290 gene, herein designated VGAM GENE, is a viral gene contained in the genome of Epiphyas Postvittana Nucleopolyhedrovirus. VGAM290 host target gene, herein designated VGAM HOST TARGET GENE, is a human gene contained in the human genome.

VGAM290 gene encodes a VGAM290 precursor RNA, herein designated VGAM PRECURSOR RNA. Similar to other miRNA genes, and unlike most ordinary genes, VGAM290 precursor RNA does not encode a protein. A nucleotide sequence identical or highly similar to the nucleotide sequence of VGAM290 precursor RNA is designated SEQ ID:276, and is provided hereinbelow with reference to the sequence listing part. Nucleotide sequence SEQ ID:276 is located at position 108012 relative to the genome of Epiphyas Postvittana Nucleopolyhedrovirus.

VGAM290 precursor RNA folds onto itself, forming VGAM290 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM290 folded precursor RNA into VGAM290 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM290 RNA is designated SEQ ID:3001, and is provided hereinbelow with reference to the sequence listing part.

VGAM290 host target gene, herein designated VGAM HOST TARGET GENE, encodes a corresponding messenger RNA, VGAM290 host target RNA, herein designated VGAM HOST TARGET RNA. VGAM290 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM290 RNA, herein designated VGAM RNA, binds complementarily to one or more host target binding sites located in untranslated regions of VGAM290 host target RNA, herein designated VGAM HOST TARGET RNA. This complementary binding is due to the fact that the nucleotide sequence of VGAM290 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM290 RNA, herein designated VGAM RNA, may have a different number of host target binding sites in untranslated regions of a VGAM290 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM290 RNA, herein designated VGAM RNA, to host target binding sites on VGAM290 host target RNA, herein designated VGAM HOST TARGET RNA, such as BINDING SITE I, BINDING SITE II and BINDING SITE III, inhibits translation of VGAM290 host target RNA into VGAM290 host target protein, herein designated VGAM HOST TARGET PROTEIN. VGAM host target protein is therefore outlined by a broken line.

It is appreciated that VGAM290 host target gene, herein designated VGAM HOST TARGET GENE, in fact represents a plurality of VGAM290 host target genes. The mRNA of each one of this plurality of VGAM290 host target genes comprises one or more host target binding sites, each having a nucleotide sequence which is at least partly complementary to VGAM290 RNA, herein designated VGAM RNA, and which when bound by VGAM290 RNA causes inhibition of translation of respective one or more VGAM290 host target proteins.

It is further appreciated by one skilled in the art that the mode of translational inhibition illustrated by FIG. 1 with specific reference to translational inhibition exerted by VGAM290 gene, herein designated VGAM GENE, on one or more VGAM290 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM290 is inhibition of expression of host target genes, as part of a novel viral mechanism of attacking a host. Accordingly, utilities of VGAM290 include diagnosis, prevention and treatment of viral infection by Epiphyas Postvittana Nucleopolyhedrovirus. Specific functions, and accordingly utilities, of VGAM290 correlate with, and may be deduced from, the identity of the host target genes which VGAM290 binds and inhibits, and the function of these target genes, as elaborated hereinbelow.

Nucleotide sequences of the VGAM290 precursor RNA, herein designated VGAM PRECURSOR RNA, and of the 'diced' VGAM290 RNA, herein designated VGAM RNA, and a schematic representation of the secondary folding of VGAM290 folded precursor RNA, herein designated VGAM FOLDED PRECURSOR RNA, of VGAM290 are further described hereinbelow with reference to Table 1.

Nucleotide sequences of host target binding sites, such as BINDING SITE-I, BINDING SITE-II and BINDING SITE-III of FIG. 1, found on VGAM290 host target RNA, and schematic representation of the complementarity of each of these host target binding sites to VGAM290 RNA, herein designated VGAM RNA, are described hereinbelow with reference to Table 2.

As mentioned hereinabove with reference to FIG. 1, a function of VGAM290 gene, herein designated VGAM is inhibition of expression of VGAM290 target genes. It is appreciated that specific functions, and accordingly utilities, of VGAM290 correlate with, and may be deduced from, the identity of the target genes which VGAM290 binds and inhibits, and the function of these target genes, as elaborated hereinbelow.

Radixin (RDX, Accession NM_002906) is a VGAM290 host target gene. RDX BINDING SITE is HOST TARGET binding site found in the 3' untranslated region of mRNA encoded by RDX, corresponding to a HOST TARGET binding site such as BINDING SITE I, BINDING SITE II or BINDING SITE III. Table 2 illustrates the complementarity of the nucleotide sequences of RDX BINDING SITE, designated SEQ ID:8808, to the nucleotide sequence of VGAM290 RNA, herein designated VGAM RNA, also designated SEQ ID:3001.

A function of VGAM290 is therefore inhibition of Radixin (RDX, Accession NM_002906), a gene which plays a crucial role in the binding of the barbed end of actin filaments to the plasma membrane. Accordingly, utilities of VGAM290 include diagnosis, prevention and treatment of diseases and clinical conditions associated with RDX. The function of RDX has been established by previous studies. Radixin is a cytoskeletal protein that may be important in linking actin to the plasma membrane. Cloning of the murine and porcine radixin cDNAs demonstrated a protein highly homologous to ezrin (OMIM Ref. No. 123900) and moesin (OMIM Ref. No. 309845). Wilgenbus et al. (1993) cloned and sequenced the human radixin cDNA and found the predicted amino acid sequence for the human protein to be nearly identical to those predicted for radixin in the two other species. Animal model experiments lend further support to the function of RDX. The ezrin-radixin-moesin (ERM) family of proteins crosslink actin filaments and integral membrane proteins. Radixin (encoded by Rdx) is the dominant ERM protein in the liver of wildtype mice and is concentrated at bile canalicular membranes (BCM). Kikuchi et al. (2002) showed that Rdx -/- mice are normal at birth, but their serum concentrations of conjugated bilirubin begin to increase gradually around 4 weeks of age, and they show mild liver injury after 8 weeks. This phenotype is similar to human conjugated hyperbilirubinemia in Dubin-Johnson syndrome (OMIM Ref. No. 237500), which is caused by mutations in the ABCC2 gene (OMIM Ref. No. 601107), although Dubin-Johnson syndrome is not associated with overt liver injury. In wildtype mice, the protein product of the ABCC2 gene, multidrug resistance protein-2, or MRP2, concentrates at BCMs to secrete conjugated bilirubin into bile. In the BCMs of Rdx -/- mice, Mrp2 is decreased compared with other BCM proteins such as dipeptidyl peptidase IV (CD26; 102720) and P-glycoproteins. In vitro binding studies showed that radixin associates directly with the carboxy-terminal cytoplasmic domain of human MRP2. These findings indicated that radixin is required for secretion of conjugated bilirubin through its support of Mrp2 localization at BCMs.

It is appreciated that the abovementioned animal model for RDX is acknowledged by those skilled in the art as a scientifically valid animal model, as can be further appreciated from the publications sited hereinbelow.

Full details of the abovementioned studies are described in the following publications, the disclosure of which are hereby incorporated by reference:

Wilgenbus, K. K.; Milatovich, A.; Francke, U.; Furthmayr, H.: Molecular cloning, cDNA sequence, and chromosomal assignment of the human radixin gene and two dispersed pseudogenes. Genomics 16:199-206, 1993; and Kikuchi, S.; Hata, M.; Fukumoto, K.; Yamane, Y.; Matsui, T.; Tamura, A.; Yonemura, S.; Yamagishi, H.; Keppler, D.; Tsukita, S.; Tsukita, S.: Radixin deficiency causes conjugated hyperbi.

Further studies establishing the function and utilities of RDX are found in John Hopkins OMIM database record ID 179410, and in sited publications numbered 2716-2717 listed in the bibliography section hereinbelow, which are also hereby incorporated by reference. Kell Blood Group Precursor (McLeod phenotype) (XK, Accession NM_021083) is another VGAM290 host target gene. XK BINDING SITE is HOST TARGET binding site found in the 3' untranslated region of mRNA encoded by XK, corresponding to a HOST TARGET binding site such as BINDING SITE I, BINDING SITE II or BINDING SITE III. Table 2 illustrates the complementarity of the nucleotide sequences of XK BINDING SITE, designated SEQ ID:22062, to the nucleotide sequence of VGAM290 RNA, herein designated VGAM RNA, also designated SEQ ID:3001.

Another function of VGAM290 is therefore inhibition of Kell Blood Group Precursor (McLeod phenotype) (XK, Accession NM_021083). Accordingly, utilities of VGAM290 include diagnosis, prevention and treatment of diseases and clinical conditions associated with XK. FIG. 1 further provides a conceptual description of a novel bioinformatically detected viral gene of the present invention, referred to here as Viral Genomic Address Messenger 291 (VGAM291) viral gene, which modulates expression of respective host target genes thereof, the function and utility of which host target genes is known in the art.

VGAM291 is a novel bioinformatically detected regulatory, non protein coding, viral micro RNA (miRNA) gene. The method by which VGAM291 was detected is described hereinabove with reference to FIGS. 1-8.

VGAM291 gene, herein designated VGAM GENE, is a viral gene contained in the genome of Epiphyas Postvittana Nucleopolyhedrovirus. VGAM291 host target gene, herein designated VGAM HOST TARGET GENE, is a human gene contained in the human genome.

VGAM291 gene encodes a VGAM291 precursor RNA, herein designated VGAM PRECURSOR RNA. Similar to other miRNA genes, and unlike most ordinary genes, VGAM291 precursor RNA does not encode a protein. A nucleotide sequence identical or highly similar to the nucleotide sequence of VGAM291 precursor RNA is designated SEQ ID:277, and is provided hereinbelow with reference to the sequence listing part. Nucleotide sequence SEQ ID:277 is located at position 95193 relative to the genome of Epiphyas Postvittana Nucleopolyhedrovirus.

VGAM291 precursor RNA folds onto itself, forming VGAM291 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM291 folded precursor RNA into VGAM291 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM291 RNA is designated SEQ ID:3002, and is provided hereinbelow with reference to the sequence listing part.

VGAM291 host target gene, herein designated VGAM HOST TARGET GENE, encodes a corresponding messenger RNA, VGAM291 host target RNA, herein designated VGAM HOST TARGET RNA. VGAM291 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM291 RNA, herein designated VGAM RNA, binds complementarily to one or more host target binding sites located in untranslated regions of VGAM291 host target RNA, herein designated VGAM HOST TARGET RNA. This complementary binding is due to the fact that the nucleotide sequence of VGAM291 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM291 RNA, herein designated VGAM RNA, may have a different number of host target binding sites in untranslated regions of a VGAM291 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM291 RNA, herein designated VGAM RNA, to host target binding sites on VGAM291 host target RNA, herein designated VGAM HOST TARGET RNA, such as BINDING SITE I, BINDING SITE II and BINDING SITE III, inhibits translation of VGAM291 host target RNA into VGAM291 host target protein, herein designated VGAM HOST TARGET PROTEIN. VGAM host target protein is therefore outlined by a broken line.

It is appreciated that VGAM291 host target gene, herein designated VGAM HOST TARGET GENE, in fact represents a plurality of VGAM291 host target genes. The mRNA of each one of this plurality of VGAM291 host target genes comprises one or more host target binding sites, each having a nucleotide sequence which is at least partly complementary to VGAM291 RNA, herein designated VGAM RNA, and which when bound by VGAM291 RNA causes inhibition of translation of respective one or more VGAM291 host target proteins.

It is further appreciated by one skilled in the art that the mode of translational inhibition illustrated by FIG. 1 with specific reference to translational inhibition exerted by VGAM291 gene, herein designated VGAM GENE, on one or more VGAM291 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM291 is inhibition of expression of host target genes, as part of a novel viral mechanism of attacking a host. Accordingly, utilities of VGAM291 include diagnosis, prevention and treatment of viral infection by Epiphyas Postvittana Nucleopolyhedrovirus. Specific functions, and accordingly utilities, of VGAM291 correlate with, and may be deduced from, the identity of the host target genes which VGAM291 binds and inhibits, and the function of these host target genes, as elaborated hereinbelow.

Nucleotide sequences of the VGAM291 precursor RNA, herein designated VGAM PRECURSOR RNA, and of the 'diced' VGAM291 RNA, herein designated VGAM RNA, and a schematic representation of the secondary folding of VGAM291 folded precursor RNA, herein designated VGAM FOLDED PRECURSOR RNA, of VGAM291 are further described hereinbelow with reference to Table 1.

Nucleotide sequences of host target binding sites, such as BINDING SITE-I, BINDING SITE-II and BINDING SITE-III of FIG. 1, found on VGAM291 host target RNA, and schematic representation of the complementarity of each of these host target binding sites to VGAM291 RNA, herein designated VGAM RNA, are described hereinbelow with reference to Table 2.

As mentioned hereinabove with reference to FIG. 1, a function of VGAM291 gene, herein designated VGAM is inhibition of expression of VGAM291 target genes. It is appreciated that specific functions, and accordingly utilities, of VGAM291 correlate with, and may be deduced from, the identity of the target genes which VGAM291 binds and inhibits, and the function of these target genes, as elaborated hereinbelow.

Angiopoietin 1 (ANGPT1, Accession NM_139290) is a VGAM291 host target gene. ANGPT1 BINDING SITE is HOST TARGET binding site found in the 3' untranslated region of mRNA encoded by ANGPT1, corresponding to a HOST TARGET binding site such as BINDING SITE I, BINDING SITE II or BINDING SITE III. Table 2 illustrates the complementarity of the nucleotide sequences of ANGPT1 BINDING SITE, designated SEQ ID:29289, to the nucleotide sequence of VGAM291 RNA, herein designated VGAM RNA, also designated SEQ ID:3002.

A function of VGAM291 is therefore inhibition of Angiopoietin 1 (ANGPT1, Accession NM_139290), a gene which binds and activates tie2 receptor by inducing its tyrosine phosphorylation. Accordingly, utilities of VGAM291 include diagnosis, prevention and treatment of diseases and clinical conditions associated with ANGPT1. The function of ANGPT1 has been established by previous studies. By FISH and radiation hybrid analysis, Cheung et al. (1998) mapped the ANGPT1 gene to 8q22.3-q23. By FISH, Valenzuela et al. (1999) mapped the ANGPT1 gene to 8q22 in a region that shows homology of synteny to mouse chromosome 15, where they mapped the mouse Angpt1 gene. However, by indirect in situ PCR and FISH, Marziliano et al. (1999) mapped the Angpt1 gene in the mouse to chromosome 9E2. To explore the possibility that VEGF and angiopoietins collaborate during tumor angiogenesis, Holash et al. (1999) analyzed several different murine and human tumor models. The apparent association of tumor vessel regression, apoptosis, and disruption of endothelial cell interactions with support cells in rat C6 gliomas raised the possibility that blockade of the stabilizing action of Ang1 might be contributing to tumor vessel regression. Consistent with this possibility, Holash et al. (1999) noted that angiopoietin-1 was antiapoptotic for cultured endothelial cells and expression of its antagonist angiopoietin-2 was induced in the endothelium of co-opted tumor vessels before their regression. Diffuse angiopoietin-1 expression in human tumors resembled that seen in the rat model. Holash et al. (1999) suggested that a subset of tumors rapidly co-opts existing host vessels to form an initially well vascularized tumor mass. Perhaps as part of a host defense mechanism there is widespread regression of these initially co-opted vessels, leading to a secondarily avascular tumor and a massive tumor cell loss. However, the remaining tumor is ultimately rescued by robust angiogenesis at the tumor margin Animal model experiments lend further support to the function of ANGPT1. Suri et al. (1996) showed that mice engineered to lack angiopoietin-1 display angiogenic defects reminiscent of those previously seen in mice lacking Tie2, demonstrating that angiopoietin-1 is a primary physiologic ligand for Tie2 and that it has critical in vivo angiogenic actions that are distinct from vascular endothelial growth factor (VEGF; 192240) and that are not reflected in the classic in vitro assays used to characterize VEGF. They concluded that angiopoietin-1 appears to play a crucial role in mediating reciprocal interactions between the endothelium and surrounding matrix and mesenchyme.

It is appreciated that the abovementioned animal model for ANGPT1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Holash, J.; Maisonpierre, P. C.; Compton, D.; Boland, P.; Alexander, C. R.; Zagzag, D.; Yancopoulos, G. D.; Wiegand, S. J.: Vessel cooption, regression, and growth in tumors mediated by angiopoietins and VEGF. Science 284:1994-1998, 1999; and Suri, C.; Jones, P. F.; Patan, S.; Bartunkova, S.; Maisonpierre, P. C.; Davis, S.; Sato, T. N.; Yancopoulos, G. D.: Requisite role of angiopoietin-1, a ligand for the TIE2 receptor, du.

Further studies establishing the function and utilities of ANGPT1 are found in John Hopkins OMIM database record ID 601667, and in sited publications numbered 9394-9396, 10441, 9397-9400, 1045 and 10205 listed in the bibliography section hereinbelow, which are also hereby incorporated by reference. Solute Carrier Family 2 (facilitated glucose transporter), Member 3 (SLC2A3, Accession NM_006931) is another VGAM291 host target gene. SLC2A3 BINDING SITE is HOST TARGET binding site found in the 3' untranslated region of mRNA encoded by SLC2A3, corresponding to a HOST TARGET binding site such as BINDING SITE I, BINDING SITE II or BINDING SITE III. Table 2 illustrates the complementarity of the nucleotide sequences of SLC2A3 BINDING SITE, designated SEQ ID:13815, to the nucleotide sequence of VGAM291 RNA, herein designated VGAM RNA, also designated SEQ ID:3002.

Another function of VGAM291 is therefore inhibition of Solute Carrier Family 2 (facilitated glucose transporter), Member 3 (SLC2A3, Accession NM_006931), a gene which probably is a neuronal glucose transporter. Accordingly, utilities of VGAM291 include diagnosis, prevention and treatment of diseases and clinical conditions associated with SLC2A3. The function of SLC2A3 and its association with various diseases and clinical conditions, has been established by previous studies, as described hereinabove with reference to VGAM247. FLJ13110 (Accession NM_022912) is another VGAM291 host target gene. FLJ13110 BINDING SITE is HOST TARGET binding site found in the 3' untranslated region of mRNA encoded by FLJ13110, corresponding to a HOST TARGET binding site such as BINDING SITE I, BINDING SITE II or BINDING SITE III. Table 2 illustrates the complementarity of the nucleotide sequences of FLJ13110 BINDING SITE, designated SEQ ID:23219, to the nucleotide sequence of VGAM291 RNA, herein designated VGAM RNA, also designated SEQ ID:3002.

Another function of VGAM291 is therefore inhibition of FLJ13110 (Accession NM_022912). Accordingly, utilities of VGAM291 include diagnosis, prevention and treatment of diseases and clinical conditions associated with FLJ13110. FIG. 1 further provides a conceptual description of a novel bioinformatically detected viral gene of the present invention, referred to here as Viral Genomic Address Messenger 292 (VGAM292) viral gene, which modulates expression of respective host target genes thereof, the function and utility of which host target genes is known in the art.

VGAM292 is a novel bioinformatically detected regulatory, non protein coding, viral micro RNA (miRNA) gene. The method by which VGAM292 was detected is described hereinabove with reference to FIGS. 1-8.

VGAM292 gene, herein designated VGAM GENE, is a viral gene contained in the genome of Epiphyas Postvittana Nucleopolyhedrovirus. VGAM292 host target gene, herein designated VGAM HOST TARGET GENE, is a human gene contained in the human genome.

VGAM292 gene encodes a VGAM292 precursor RNA, herein designated VGAM PRECURSOR RNA. Similar to other miRNA genes, and unlike most ordinary genes, VGAM292 precursor RNA does not encode a protein. A nucleotide sequence identical or highly similar to the nucleotide sequence of VGAM292 precursor RNA is designated SEQ ID:278, and is provided hereinbelow with reference to the sequence listing part. Nucleotide sequence SEQ ID:278 is located at position 9896 relative to the genome of Epiphyas Postvittana Nucleopolyhedrovirus.

VGAM292 precursor RNA folds onto itself, forming VGAM292 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM292 folded precursor RNA into VGAM292 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM292 RNA is designated SEQ ID:3003, and is provided hereinbelow with reference to the sequence listing part.

VGAM292 host target gene, herein designated VGAM HOST TARGET GENE, encodes a corresponding messenger RNA, VGAM292 host target RNA, herein designated VGAM HOST TARGET RNA. VGAM292 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM292 RNA, herein designated VGAM RNA, binds complementarily to one or more host target binding sites located in untranslated regions of VGAM292 host target RNA, herein designated VGAM HOST TARGET RNA. This complementary binding is due to the fact that the nucleotide sequence of VGAM292 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM292 RNA, herein designated VGAM RNA, may have a different number of host target binding sites in untranslated regions of a VGAM292 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM292 RNA, herein designated VGAM RNA, to host target binding sites on VGAM292 host target RNA, herein designated VGAM HOST TARGET RNA, such as BINDING SITE I, BINDING SITE II and BINDING SITE III, inhibits translation of VGAM292 host target RNA into VGAM292 host target protein, herein designated VGAM HOST TARGET PROTEIN. VGAM host target protein is therefore outlined by a broken line.

It is appreciated that VGAM292 host target gene, herein designated VGAM HOST TARGET GENE, in fact represents a plurality of VGAM292 host target genes. The mRNA of each one of this plurality of VGAM292 host target genes comprises one or more host target binding sites, each having a nucleotide sequence which is at least partly complementary to VGAM292 RNA, herein designated VGAM RNA, and which when bound by VGAM292 RNA causes inhibition of translation of respective one or more VGAM292 host target proteins.

It is further appreciated by one skilled in the art that the mode of translational inhibition illustrated by FIG. 1 with specific reference to translational inhibition exerted by VGAM292 gene, herein designated VGAM GENE, on one or more VGAM292 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM292 is inhibition of expression of host target genes, as part of a novel viral mechanism of attacking a host. Accordingly, utilities of VGAM292 include diagnosis, prevention and treatment of viral infection by Epiphyas Postvittana Nucleopolyhedrovirus. Specific functions, and accordingly utilities, of VGAM292 correlate with, and may be deduced from, the identity of the host target genes which VGAM292 binds and inhibits, and the function of these host target genes, as elaborated hereinbelow.

Nucleotide sequences of the VGAM292 precursor RNA, herein designated VGAM PRECURSOR RNA, and of the 'diced' VGAM292 RNA, herein designated VGAM RNA, and a schematic representation of the secondary folding of VGAM292 folded precursor RNA, herein designated VGAM FOLDED PRECURSOR RNA, of VGAM292 are further described hereinbelow with reference to Table 1.

Nucleotide sequences of host target binding sites, such as BINDING SITE-I, BINDING SITE-II and BINDING SITE-III of FIG. 1, found on VGAM292 host target RNA, and schematic representation of the complementarity of each of these host target binding sites to VGAM292 RNA, herein designated VGAM RNA, are described hereinbelow with reference to Table 2.

As mentioned hereinabove with reference to FIG. 1, a function of VGAM292 gene, herein designated VGAM is inhibition of expression of VGAM292 target genes. It is appreciated that specific functions, and accordingly utilities, of VGAM292 correlate with, and may be deduced from, the identity of the target genes which VGAM292 binds and inhibits, and the function of these target genes, as elaborated hereinbelow.

Acidic Repeat Containing (ACRC, Accession NM_052957) is a VGAM292 host target gene. ACRC BINDING SITE is HOST TARGET binding site found in the 3' untranslated region of mRNA encoded by ACRC, corresponding to a HOST TARGET binding site such as BINDING SITE I, BINDING SITE II or BINDING SITE III. Table 2 illustrates the complementarity of the nucleotide sequences of ACRC BINDING SITE, designated SEQ ID:27517, to the nucleotide sequence of VGAM292 RNA, herein designated VGAM RNA, also designated SEQ ID:3003.

A function of VGAM292 is therefore inhibition of Acidic Repeat Containing (ACRC, Accession NM_052957). Accordingly, utilities of VGAM292 include diagnosis, prevention and treatment of diseases and clinical conditions associated with ACRC. Aldehyde Dehydrogenase 3 Family, Member A2 (ALDH3A2, Accession XM_045060) is another VGAM292 host target gene. ALDH3A2 BINDING SITE is HOST TARGET binding site found in the 3' untranslated region of mRNA encoded by ALDH3A2, corresponding to a HOST TARGET binding site such as BINDING SITE I, BINDING SITE II or BINDING SITE III. Table 2 illustrates the complementarity of the nucleotide sequences of ALDH3A2 BINDING SITE, designated SEQ ID:34340, to the nucleotide sequence of VGAM292 RNA, herein designated VGAM RNA, also designated SEQ ID:3003.

Another function of VGAM292 is therefore inhibition of Aldehyde Dehydrogenase 3 Family, Member A2 (ALDH3A2, Accession XM_045060). Accordingly, utilities of VGAM292 include diagnosis, prevention and treatment of diseases and clinical conditions associated with ALDH3A2. Forkhead Box F1 (FOXF1, Accession NM_001451) is another VGAM292 host target gene. FOXF1 BINDING SITE is HOST TARGET binding site found in the 3' untranslated region of mRNA encoded by FOXF1, corresponding to a HOST TARGET binding site such as BINDING SITE I, BINDING SITE II or BINDING SITE III. Table 2 illustrates the complementarity of the nucleotide sequences of FOXF1 BINDING SITE, designated SEQ ID:7183, to the nucleotide sequence of VGAM292 RNA, herein designated VGAM RNA, also designated SEQ ID:3003.

Another function of VGAM292 is therefore inhibition of Forkhead Box F1 (FOXF1, Accession NM_001451), a gene which is a probable transcription activator for a number of lung- specific genes. Accordingly, utilities of VGAM292 include diagnosis, prevention and treatment of diseases and clinical conditions associated with FOXF1. The function of FOXF1 has been established by previous studies. The forkhead genes are transcription factors distinguished by a characteristic 100-amino acid motif that was originally identified in Drosophila (see OMIM Ref. No. 164874). Pierrou et al. (1994) identified 7 human genes containing forkhead domains and designated them forkhead related activators (FREAC) 1 through 7. Northern blot analysis revealed that the FREAC1, or FKHL5, gene is expressed as a 2.6-kb mRNA in placenta and adult and fetal lung. Hellqvist et al. (1996) reported the FREAC1 cDNA sequence. The predicted 354-amino acid protein is nearly identical to FREAC2 (FKHL6; 603250) within a 112-residue region containing the forkhead domain and adjacent sequences, and within the C-terminal region. Using a reporter gene construct containing FREAC2 binding sequences in the promoter, Hellqvist et al. (1996) demonstrated that both FREAC1 and FREAC2 have C-terminal transcriptional activation domains. FREAC1/FREAC2 binding sequences are present in the promoters of several lung-specific genes, including CC10 (OMIM Ref. No. 192020) and SPB (SFTPB; 178640). While both FREAC1 and FREAC2 transactivated an SPB promoter construct, CC10 was activated only by FREAC1. CC10 activation occurred specifically in a lung cell line with Clara cell-like characteristics. Hellqvist et al. (1996) reported that the mouse HFH8 gene and FREAC1 share 90% nucleotide sequence identity. By resequencing of HFH8, these authors demonstrated that 5 frameshifts in the HFH8 sequence reported by Clevidence et al. (1994) were due to sequencing errors.

Full details of the abovementioned studies are described in the following publications, the disclosure of which are hereby incorporated by reference:

Clevidence, D. E.; Overdier, D. G.; Peterson, R. S.; Porcella, A.; Ye, H.; Paulson, K. E.; Costa, R. H.: Members of the HNF-3/forkhead family of transcription factors exhibit distinct cellular expression patterns in lung and regulate the surfactant protein B promoter. Dev. Biol. 166:195-209, 1994; and Hellqvist, M.; Mahlapuu, M.; Blixt, A.; Enerback, S.; Carlsson, P.: The human forkhead protein FREAC-2 contains two functionally redundant activation domains and interacts with TBP and.

Further studies establishing the function and utilities of FOXF1 are found in John Hopkins OMIM database record ID 601089, and in sited publications numbered 9456-9460 listed in the bibliography section hereinbelow, which are also hereby incorporated by reference. Growth Arrest-specific 11 (GAS11, Accession NM_001481) is another VGAM292 host target gene. GAS11 BINDING SITE is HOST TARGET binding site found in the 3' untranslated region of mRNA encoded by GAS11, corresponding to a HOST TARGET binding site such as BINDING SITE I, BINDING SITE II or BINDING SITE III. Table 2 illustrates the complementarity of the nucleotide sequences of GAS11 BINDING SITE, designated SEQ ID:7220, to the nucleotide sequence of VGAM292 RNA, herein designated VGAM RNA, also designated SEQ ID:3003.

Another function of VGAM292 is therefore inhibition of Growth Arrest-specific 11 (GAS11, Accession NM_001481). Accordingly, utilities of VGAM292 include diagnosis, prevention and treatment of diseases and clinical conditions associated with GAS11. NCSTN (Accession XM_057331) is another VGAM292 host target gene. NCSTN BINDING SITE is HOST TARGET binding site found in the 3' untranslated region of mRNA encoded by NCSTN, corresponding to a HOST TARGET binding site such as BINDING SITE I, BINDING SITE II or BINDING SITE III. Table 2 illustrates the complementarity of the nucleotide sequences of NCSTN BINDING SITE, designated SEQ ID:36507, to the nucleotide sequence of VGAM292 RNA, herein designated VGAM RNA, also designated SEQ ID:3003.

Another function of VGAM292 is therefore inhibition of NCSTN (Accession XM_057331), a gene which has a central role in presenilin-mediated processing of beta-amyloid precursor protein (beta-APP, MIM 104760) and some aspects of notch (MIM 190198)/glp-1 signaling in vivo. Accordingly, utilities of VGAM292 include diagnosis, prevention and treatment of diseases and clinical conditions associated with NCSTN. The function of NCSTN and its association with various diseases and clinical conditions, has been established by previous studies, as described hereinabove with reference to VGAM152. Prostaglandin-endoperoxide Synthase 2 (prostaglandin G/H synthase and cyclooxygenase) (PTGS2, Accession NM_000963) is another VGAM292 host target gene. PTGS2 BINDING SITE is HOST TARGET binding site found in the 3' untranslated region of mRNA encoded by PTGS2, corresponding to a HOST TARGET binding site such as BINDING SITE I, BINDING SITE II or BINDING SITE III. Table 2 illustrates the complementarity of the nucleotide sequences of PTGS2 BINDING SITE, designated SEQ ID:6683, to the nucleotide sequence of VGAM292 RNA, herein designated VGAM RNA, also designated SEQ ID:3003.

Another function of VGAM292 is therefore inhibition of Prostaglandin-endoperoxide Synthase 2 (prostaglandin G/H synthase and cyclooxygenase) (PTGS2, Accession NM_000963), a gene which may have a role as a major mediator of inflammation and/or a role for prostanoid signaling in activity-dependent plasticity. Accordingly, utilities of VGAM292 include diagnosis, prevention and treatment of diseases and clinical conditions associated with PTGS2. The function of PTGS2 has been established by previous studies. Inflammation causes the induction of COX2, leading to the release of prostanoids, which sensitize peripheral nociceptor terminals and produce localized pain hypersensitivity. Peripheral inflammation also generates pain hypersensitivity in neighboring uninjured tissue, because of the increased neuronal excitability in the spinal cord, and a syndrome comprising diffuse muscle and joint pain, fever, lethargy, and anorexia. Samad et al. (2001) showed that COX2 may be involved in central nervous system (CNS) responses, by finding a widespread induction of COX2 expression in spinal cord neurons and in other regions of the CNS, elevating prostaglandin E2 (PGE2) levels in the cerebrospinal fluid. The major inducer of central COX2 upregulation is IL1-beta in the CNS, and as basal phospholipase A2 (see OMIM Ref. No. 600522) activity in the CNS does not change with peripheral inflammation, COX2 levels must regulate central prostanoid production. In the rat, intraspinal administration of an interleukin-converting enzyme or COX2 inhibitor decreased inflammation-induced central PGE2 levels and mechanical hyperalgesia. Thus, Samad et al. (2001) concluded that preventing central prostanoid production by inhibiting the IL1-beta-mediated induction of COX2 in neurons or by inhibiting central COX2 activity reduces centrally generated inflammatory pain hypersensitivity. Animal model experiments lend further support to the function of PTGS2. Morham et al. (1995) noted that cyclooxygenase-2 (COX2) is induced at high levels in migratory and other responding cells by proinflammatory stimuli. COX2 is generally considered to be a mediator of inflammation. Its isoform, COX1, is constitutively expressed in most tissues and is thought to mediate 'housekeeping' functions. These 2 enzymes are therapeutic targets of the widely used nonsteroidal antiinflammatory drugs (OMIM Ref. No. NSAIDs). To investigate further the different physiologic roles of these isoforms, Morham et al. (1995) used homologous recombination to disrupt the mouse gene encoding COX2 (Ptgs2). Mice lacking COX2 were found to have normal inflammatory responses to treatments with tetradecanoyl phorbol acetate or arachidonic acid. However, they developed severe nephropathy and were susceptible to peritonitis.

It is appreciated that the abovementioned animal model for PTGS2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Morham, S. G.; Langenbach, R.; Loftin, C. D.; Tiano, H. F.; Vouloumanos, N.; Jennette, J. C.; Mahler, J. F.; Kluckman, K. D.; Ledford, A.; Lee, C. A.; Smithies, O. : Prostaglandin synthase 2 gene disruption causes severe renal pathology in the mouse. Cell 83:473-482, 1995; and Samad, T. A.; Moore, K. A.; Sapirstein, A.; Billet, S.; Allchorne, A.; Poole, S.; Bonventre, J. V.; Woolf, C. J.: Interleukin-1-beta-mediated induction of Cox-2 in the CNS contributes.

Further studies establishing the function and utilities of PTGS2 are found in John Hopkins OMIM database record ID 600262, and in sited publications numbered 7932, 10848-7934, 10849-7937, 8080-8086, 10841, 11170, 8090-809 and 10887 listed in the bibliography section hereinbelow, which are also hereby incorporated by reference. RNA Guanylyltransferase and 5'-phosphatase (RNGTT, Accession NM_003800) is another VGAM292 host target gene. RNGTT BINDING SITE is HOST TARGET binding site found in the 3' untranslated region of mRNA encoded by RNGTT, corresponding to a HOST TARGET binding site such as BINDING SITE I, BINDING SITE II or BINDING SITE III. Table 2 illustrates the complementarity of the nucleotide sequences of RNGTT BINDING SITE, designated SEQ ID:9896, to the nucleotide sequence of VGAM292 RNA, herein designated VGAM RNA, also designated SEQ ID:3003.

Another function of VGAM292 is therefore inhibition of RNA Guanylyltransferase and 5'-phosphatase (RNGTT, Accession NM_003800), a gene which is an MRNA capping enzyme; bifunctional enzyme containing both 5'-triphosphatase and mRNA guanylyltransferase activity. Accordingly, utilities of VGAM292 include diagnosis, prevention and treatment of diseases and clinical conditions associated with RNGTT. The function of RNGTT has been established by previous studies. Independently, both Tsukamoto et al. (1998) and Yamada-Okabe et al. (1998) cloned cDNAs encoding RNGTT, which they designated CAP1a and HCE1 (human capping enzyme-1), respectively. Using RT-PCR, Tsukamoto et al. (1998) demonstrated CAP1a expression in all human tissues tested. Yamada-Okabe et al. (1998) found that recombinant HCE1 protein displayed RNA 5-prime-triphosphatase and guanylyltransferase activities and formed a cap structure at the 5-prime-triphosphate end of RNA. These authors also identified HCE1A and HCE1B, alternatively spliced mRNAs encoding proteins lacking part of the C-terminal region. The shorter isoforms possessed only RNA 5-prime-triphosphatase activity. HCE1, but not HCE1A or HCE1B, complemented S. cerevisiae ceg1 and cet1 mutations. Yamada-Okabe et al. (1998) concluded that the N-terminal part of HCE1 is responsible for RNA 5-prime-triphosphatase activity and the C-terminal part is essential for guanylyltransferase activity. RT-PCR analysis indicated that the level of HCE1 mRNA was significantly higher than those of HCE1A and HCE1B.

Full details of the abovementioned studies are described in the following publications, the disclosure of which are hereby incorporated by reference:

Tsukamoto, T.; Shibagaki, Y.; Murakoshi, T.; Suzuki, M.; Nakamura, A.; Gotoh, H.; Mizumoto, K.: Cloning and characterization of two human cDNAs encoding the mRNA capping enzyme. Biochem. Biophys. Res. Commun. 243:101-108, 1998; and Yamada-Okabe, T.; Doi, R.; Shimmi, O.; Arisawa, M.; Yamada-Okabe, H.: Isolation and characterization of a human cDNA for mRNA 5-prime-capping enzyme. Nucleic Acids Res. 26:1700-1706, 1998.

Further studies establishing the function and utilities of RNGTT are found in John Hopkins OMIM database record ID 603512, and in sited publications numbered 1105-1108 listed in the bibliography section hereinbelow, which are also hereby incorporated by reference. ATPase, Class II, Type 9A (ATP9A, Accession XM_030577) is another VGAM292 host target gene. ATP9A BINDING SITE is HOST TARGET binding site found in the 3' untranslated region of mRNA encoded by ATP9A, corresponding to a HOST TARGET binding site such as BINDING SITE I, BINDING SITE II or BINDING SITE III. Table 2 illustrates the complementarity of the nucleotide sequences of ATP9A BINDING SITE, designated SEQ ID:31086, to the nucleotide sequence of VGAM292 RNA, herein designated VGAM RNA, also designated SEQ ID:3003.

Another function of VGAM292 is therefore inhibition of ATPase, Class II, Type 9A (ATP9A, Accession XM_030577). Accordingly, utilities of VGAM292 include diagnosis, prevention and treatment of diseases and clinical conditions associated with ATP9A. BDG-29 (Accession XM_051343) is another VGAM292 host target gene. BDG-29 BINDING SITE is HOST TARGET binding site found in the 3' untranslated region of mRNA encoded by BDG-29, corresponding to a HOST TARGET binding site such as BINDING SITE I, BINDING SITE II or BINDING SITE III. Table 2 illustrates the complementarity of the nucleotide sequences of BDG-29 BINDING SITE, designated SEQ ID:35814, to the nucleotide sequence of VGAM292 RNA, herein designated VGAM RNA, also designated SEQ ID:3003.

Another function of VGAM292 is therefore inhibition of BDG-29 (Accession XM_051343). Accordingly, utilities of VGAM292 include diagnosis, prevention and treatment of diseases and clinical conditions associated with BDG-29. CPR2 (Accession NM_030900) is another VGAM292 host target gene. CPR2 BINDING SITE is HOST TARGET binding site found in the 3' untranslated region of mRNA encoded by CPR2, corresponding to a HOST TARGET binding site such as BINDING SITE I, BINDING SITE II or BINDING SITE III. Table 2 illustrates the complementarity of the nucleotide sequences of CPR2 BINDING SITE, designated SEQ ID:25177, to the nucleotide sequence of VGAM292 RNA, herein designated VGAM RNA, also designated SEQ ID:3003.

Another function of VGAM292 is therefore inhibition of CPR2 (Accession NM_030900). Accordingly, utilities of VGAM292 include diagnosis, prevention and treatment of diseases and clinical conditions associated with CPR2. DKFZp761D221 (Accession NM_032291) is another VGAM292 host target gene. DKFZp761D221 BINDING SITE is HOST TARGET binding site found in the 3' untranslated region of mRNA encoded by DKFZp761D221, corresponding to a HOST TARGET binding site such as BINDING SITE I, BINDING SITE II or BINDING SITE III. Table 2 illustrates the complementarity of the nucleotide sequences of DKFZp761D221 BINDING SITE, designated SEQ ID:26057, to the nucleotide sequence of VGAM292 RNA, herein designated VGAM RNA, also designated SEQ ID:3003.

Another function of VGAM292 is therefore inhibition of DKFZp761D221 (Accession NM_032291). Accordingly, utilities of VGAM292 include diagnosis, prevention and treatment of diseases and clinical conditions associated with DKFZp761D221. Erythroblast Membrane-associated Protein (ERMAP, Accession NM_018538) is another VGAM292 host target gene. ERMAP BINDING SITE is HOST TARGET binding site found in the 3' untranslated region of mRNA encoded by ERMAP, corresponding to a HOST TARGET binding site such as BINDING SITE I, BINDING SITE II or BINDING SITE III. Table 2 illustrates the complementarity of the nucleotide sequences of ERMAP BINDING SITE, designated SEQ ID:20606, to the nucleotide sequence of VGAM292 RNA, herein designated VGAM RNA, also designated SEQ ID:3003.

Another function of VGAM292 is therefore inhibition of Erythroblast Membrane-associated Protein (ERMAP, Accession NM_018538). Accordingly, utilities of VGAM292 include diagnosis, prevention and treatment of diseases and clinical conditions associated with ERMAP. F-box Only Protein 5 (FBXO5, Accession NM_012177) is another VGAM292 host target gene. FBXO5 BINDING SITE is HOST TARGET binding site found in the 3' untranslated region of mRNA encoded by FBXO5, corresponding to a HOST TARGET binding site such as BINDING SITE I, BINDING SITE II or BINDING SITE III. Table 2 illustrates the complementarity of the nucleotide sequences of FBXO5 BINDING SITE, designated SEQ ID:14466, to the nucleotide sequence of VGAM292 RNA, herein designated VGAM RNA, also designated SEQ ID:3003.

Another function of VGAM292 is therefore inhibition of F-box Only Protein 5 (FBXO5, Accession NM_012177). Accordingly, utilities of VGAM292 include diagnosis, prevention and treatment of diseases and clinical conditions associated with FBXO5. FLJ10450 (Accession NM_018095) is another VGAM292 host target gene. FLJ10450 BINDING SITE is HOST TARGET binding site found in the 3' untranslated region of mRNA encoded by FLJ10450, corresponding to a HOST TARGET binding site such as BINDING SITE I, BINDING SITE II or BINDING SITE III. Table 2 illustrates the complementarity of the nucleotide sequences of FLJ10450 BINDING SITE, designated SEQ ID:19863, to the nucleotide sequence of VGAM292 RNA, herein designated VGAM RNA, also designated SEQ ID:3003.

Another function of VGAM292 is therefore inhibition of FLJ10450 (Accession NM_018095). Accordingly, utilities of VGAM292 include diagnosis, prevention and treatment of diseases and clinical conditions associated with FLJ10450. FLJ22009 (Accession XM_015700) is another VGAM292 host target gene. FLJ22009 BINDING SITE is HOST TARGET binding site found in the 3' untranslated region of mRNA encoded by FLJ22009, corresponding to a HOST TARGET binding site such as BINDING SITE I, BINDING SITE II or BINDING SITE III. Table 2 illustrates the complementarity of the nucleotide sequences of FLJ22009 BINDING SITE, designated SEQ ID:30244, to the nucleotide sequence of VGAM292 RNA, herein designated VGAM RNA, also designated SEQ ID:3003.

Another function of VGAM292 is therefore inhibition of FLJ22009 (Accession XM_015700). Accordingly, utilities of VGAM292 include diagnosis, prevention and treatment of diseases and clinical conditions associated with FLJ22009.

KIAA1204 (Accession XM_045011) is another VGAM292 host target gene. KIAA1204 BINDING SITE is HOST TARGET binding site found in the 3' untranslated region of mRNA encoded by KIAA1204, corresponding to a HOST TARGET binding site such as BINDING SITE I, BINDING SITE II or BINDING SITE III. Table 2 illustrates the complementarity of the nucleotide sequences of KIAA1204 BINDING SITE, designated SEQ ID:34316, to the nucleotide sequence of VGAM292 RNA, herein designated VGAM RNA, also designated SEQ ID:3003.

Another function of VGAM292 is therefore inhibition of KIAA1204 (Accession XM_045011). Accordingly, utilities of VGAM292 include diagnosis, prevention and treatment of diseases and clinical conditions associated with KIAA1204.

KIAA1458 (Accession XM_044434) is another VGAM292 host target gene. KIAA1458 BINDING SITE is HOST TARGET binding site found in the 3' untranslated region of mRNA encoded by KIAA1458, corresponding to a HOST TARGET binding site such as BINDING SITE I, BINDING SITE II or BINDING SITE III. Table 2 illustrates the complementarity of the nucleotide sequences of KIAA1458 BINDING SITE, designated SEQ ID:34206, to the nucleotide sequence of VGAM292 RNA, herein designated VGAM RNA, also designated SEQ ID:3003.

Another function of VGAM292 is therefore inhibition of KIAA1458 (Accession XM_044434). Accordingly, utilities of VGAM292 include diagnosis, prevention and treatment of diseases and clinical conditions associated with KIAA1458.

MGC24447 (Accession NM_138288) is another VGAM292 host target gene. MGC24447 BINDING SITE is HOST TARGET binding site found in the 3' untranslated region of mRNA encoded by MGC24447, corresponding to a HOST TARGET binding site such as BINDING SITE I, BINDING SITE II or BINDING SITE III. Table 2 illustrates the complementarity of the nucleotide sequences of MGC24447 BINDING SITE, designated SEQ ID:28702, to the nucleotide sequence of VGAM292 RNA, herein designated VGAM RNA, also designated SEQ ID:3003.

Another function of VGAM292 is therefore inhibition of MGC24447 (Accession NM_138288). Accordingly, utilities of VGAM292 include diagnosis, prevention and treatment of diseases and clinical conditions associated with MGC24447.

MST4 (Accession NM_016542) is another VGAM292 host target gene. MST4 BINDING SITE is HOST TARGET binding site found in the 3' untranslated region of mRNA encoded by MST4, corresponding to a HOST TARGET binding site such as BINDING SITE I, BINDING SITE II or BINDING SITE III. Table 2 illustrates the complementarity of the nucleotide sequences of MST4 BINDING SITE, designated SEQ ID:18610, to the nucleotide sequence of VGAM292 RNA, herein designated VGAM RNA, also designated SEQ ID:3003.

Another function of VGAM292 is therefore inhibition of MST4 (Accession NM_016542). Accordingly, utilities of VGAM292 include diagnosis, prevention and treatment of diseases and clinical conditions associated with MST4.

STRIN (Accession NM_016271) is another VGAM292 host target gene. STRIN BINDING SITE is HOST TARGET binding site found in the 3' untranslated region of mRNA encoded by STRIN, corresponding to a HOST TARGET binding site such as BINDING SITE I, BINDING SITE II or BINDING SITE III. Table 2 illustrates the complementarity of the nucleotide sequences of STRIN BINDING SITE, designated SEQ ID:18396, to the nucleotide sequence of VGAM292 RNA, herein designated VGAM RNA, also designated SEQ ID:3003.

Another function of VGAM292 is therefore inhibition of STRIN (Accession NM_016271). Accordingly, utilities of VGAM292 include diagnosis, prevention and treatment of diseases and clinical conditions associated with STRIN.

LOC145622 (Accession XM_085186) is another VGAM292 host target gene. LOC145622 BINDING SITE is HOST TARGET binding site found in the 3' untranslated region of mRNA encoded by LOC145622, corresponding to a HOST TARGET binding site such as BINDING SITE I, BINDING SITE II or BINDING SITE III. Table 2 illustrates the complementarity of the nucleotide sequences of LOC145622 BINDING SITE, designated SEQ ID:37912, to the nucleotide sequence of VGAM292 RNA, herein designated VGAM RNA, also designated SEQ ID:3003.

Another function of VGAM292 is therefore inhibition of LOC145622 (Accession XM_085186). Accordingly, utilities of VGAM292 include diagnosis, prevention and treatment of diseases and clinical conditions associated with LOC145622.

LOC219401 (Accession XM_166706) is another VGAM292 host target gene. LOC219401 BINDING SITE is HOST TARGET binding site found in the 5' untranslated region of mRNA encoded by LOC219401, corresponding to a HOST TARGET binding site such as BINDING SITE I, BINDING SITE II or BINDING SITE III. Table 2 illustrates the complementarity of the nucleotide sequences of LOC219401 BINDING SITE, designated SEQ ID:44596, to the nucleotide sequence of VGAM292 RNA, herein designated VGAM RNA, also designated SEQ ID:3003.

Another function of VGAM292 is therefore inhibition of LOC219401 (Accession XM_166706). Accordingly, utilities of VGAM292 include diagnosis, prevention and treatment of diseases and clinical conditions associated with LOC219401.

LOC257443 (Accession XM_171072) is another VGAM292 host target gene. LOC257443 BINDING SITE is HOST TARGET binding site found in the 3' untranslated region of mRNA encoded by LOC257443, corresponding to a HOST TARGET binding site such as BINDING SITE I, BINDING SITE II or BINDING SITE III. Table 2 illustrates the complementarity of the nucleotide sequences of LOC257443 BINDING SITE, designated SEQ ID:45874, to the nucleotide sequence of VGAM292 RNA, herein designated VGAM RNA, also designated SEQ ID:3003.

Another function of VGAM292 is therefore inhibition of LOC257443 (Accession XM_171072). Accordingly, utilities of VGAM292 include diagnosis, prevention and treatment of diseases and clinical conditions associated with LOC257443.

FIG. 1 further provides a conceptual description of a novel bioinformatically detected viral gene of the present invention, referred to here as Viral Genomic Address Messenger 293 (VGAM293) viral gene, which modulates expression of respective host target genes thereof, the function and utility of which host target genes is known in the art.

VGAM293 is a novel bioinformatically detected regulatory, non protein coding, viral micro RNA (miRNA) gene. The method by which VGAM293 was detected is described hereinabove with reference to FIGS. 1-8.

VGAM293 gene, herein designated VGAM GENE, is a viral gene contained in the genome of Epiphyas Postvittana Nucleopolyhedrovirus. VGAM293 host target gene, herein designated VGAM HOST TARGET GENE, is a human gene contained in the human genome.

VGAM293 gene encodes a VGAM293 precursor RNA, herein designated VGAM PRECURSOR RNA. Similar to other miRNA genes, and unlike most ordinary genes, VGAM293 precursor RNA does not encode a protein. A nucleotide sequence identical or highly similar to the nucleotide sequence of VGAM293 precursor RNA is designated SEQ ID:279, and is provided hereinbelow with reference to the sequence listing part. Nucleotide sequence SEQ ID:279 is located at position 23397 relative to the genome of Epiphyas Postvittana Nucleopolyhedrovirus.

VGAM293 precursor RNA folds onto itself, forming VGAM293 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM293 folded precursor RNA into VGAM293 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM293 RNA is designated SEQ ID:3004, and is provided hereinbelow with reference to the sequence listing part.

VGAM293 host target gene, herein designated VGAM HOST TARGET GENE, encodes a corresponding messenger RNA, VGAM293 host target RNA, herein designated VGAM HOST TARGET RNA. VGAM293 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM293 RNA, herein designated VGAM RNA, binds complementarily to one or more host target binding sites located in untranslated regions of VGAM293 host target RNA, herein designated VGAM HOST TARGET RNA. This complementary binding is due to the fact that the nucleotide sequence of VGAM293 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM293 RNA, herein designated VGAM RNA, may have a different number of host target binding sites in untranslated regions of a VGAM293 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM293 RNA, herein designated VGAM RNA, to host target binding sites on VGAM293 host target RNA, herein designated VGAM HOST TARGET RNA, such as BINDING SITE I, BINDING SITE II and BINDING SITE III, inhibits translation of VGAM293 host target RNA into VGAM293 host target protein, herein designated VGAM HOST TARGET PROTEIN. VGAM host target protein is therefore outlined by a broken line.

It is appreciated that VGAM293 host target gene, herein designated VGAM HOST TARGET GENE, in fact represents a plurality of VGAM293 host target genes. The mRNA of each one of this plurality of VGAM293 host target genes comprises one or more host target binding sites, each having a nucleotide sequence which is at least partly complementary to VGAM293 RNA, herein designated VGAM RNA, and which when bound by VGAM293 RNA causes inhibition of translation of respective one or more VGAM293 host target proteins.

It is further appreciated by one skilled in the art that the mode of translational inhibition illustrated by FIG. 1 with specific reference to translational inhibition exerted by VGAM293 gene, herein designated VGAM GENE, on one or more VGAM293 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM293 is inhibition of expression of host target genes, as part of a novel viral mechanism of attacking a host. Accordingly, utilities of VGAM293 include diagnosis, prevention and treatment of viral infection by Epiphyas Postvittana Nucleopolyhedrovirus. Specific functions, and accordingly utilities, of VGAM293 correlate with, and may be deduced from, the identity of the host target genes which VGAM293 binds and inhibits, and the function of these host target genes, as elaborated hereinbelow.

Nucleotide sequences of the VGAM293 precursor RNA, herein designated VGAM PRECURSOR RNA, and of the 'diced' VGAM293 RNA, herein designated VGAM RNA, and a schematic representation of the secondary folding of VGAM293 folded precursor RNA, herein designated VGAM FOLDED PRECURSOR RNA, of VGAM293 are further described hereinbelow with reference to Table 1.

Nucleotide sequences of host target binding sites, such as BINDING SITE-I, BINDING SITE-II and BINDING SITE-III of FIG. 1, found on VGAM293 host target RNA, and schematic representation of the complementarity of each of these host target binding sites to VGAM293 RNA, herein designated VGAM RNA, are described hereinbelow with reference to Table 2.

As mentioned hereinabove with reference to FIG. 1, a function of VGAM293 gene, herein designated VGAM is inhibition of expression of VGAM293 target genes. It is appreciated that specific functions, and accordingly utilities, of VGAM293 correlate with, and may be deduced from, the identity of the target genes which VGAM293 binds and inhibits, and the function of these target genes, as elaborated hereinbelow.

HTRA3 (Accession XM_114416) is a VGAM293 host target gene. HTRA3 BINDING SITE is HOST TARGET binding site found in the 3' untranslated region of mRNA encoded by HTRA3, corresponding to a HOST TARGET binding site such as BINDING SITE I, BINDING SITE II or BINDING SITE III. Table 2 illustrates the complementarity of the nucleotide sequences of HTRA3 BINDING SITE, designated SEQ ID:42944, to the nucleotide sequence of VGAM293 RNA, herein designated VGAM RNA, also designated SEQ ID:3004.

A function of VGAM293 is therefore inhibition of HTRA3 (Accession XM_114416). Accordingly, utilities of VGAM293 include diagnosis, prevention and treatment of diseases and clinical conditions associated with HTRA3. Kallmann Syndrome 1 Sequence (KAL1, Accession NM_000216) is another VGAM293 host target gene. KAL1 BINDING SITE is HOST TARGET binding site found in the 3' untranslated region of mRNA encoded by KAL1, corresponding to a HOST TARGET binding site such as BINDING SITE I, BINDING SITE II or BINDING SITE III. Table 2 illustrates the complementarity of the nucleotide sequences of KAL1 BINDING SITE, designated SEQ ID:5720, to the nucleotide sequence of VGAM293 RNA, herein designated VGAM RNA, also designated SEQ ID:3004.

Another function of VGAM293 is therefore inhibition of Kallmann Syndrome 1 Sequence (KAL1, Accession NM_000216). Accordingly, utilities of VGAM293 include diagnosis, prevention and treatment of diseases and clinical conditions associated with KAL1. Solute Carrier Family 6 (neurotransmitter transporter, betaine/GABA), Member 12 (SLC6A12, Accession NM_003044) is another VGAM293 host target gene. SLC6A12 BINDING SITE is HOST TARGET binding site found in the 3" untranslated region of mRNA encoded by SLC6A12, corresponding to a HOST TARGET binding site such as BINDING SITE I, BINDING SITE II or BINDING SITE III. Table 2 illustrates the complementarity of the nucleotide sequences of SLC6A12 BINDING SITE, designated SEQ ID:9011, to the nucleotide sequence of VGAM293 RNA, herein designated VGAM RNA, also designated SEQ ID:3004.

Another function of VGAM293 is therefore inhibition of Solute Carrier Family 6 (neurotransmitter transporter, betaine/GABA), Member 12 (SLC6A12, Accession NM_003044), a gene which transports betaine and gaba. Accordingly, utilities of VGAM293 include diagnosis, prevention and treatment of diseases and clinical conditions associated with SLC6A12. The function of SLC6A12 has been established by previous studies. Yamauchi et al. (1992) stated that Madin-Darby canine kidney (MDCK) cells accumulate betaine when cultured in hypertonic media. They isolated an MDCK cell cDNA encoding a renal betaine transporter and designated it BGT1. When expressed in Xenopus oocytes, the BGT1 protein exhibited chloride- and sodium-dependent transport of both betaine and the neurotransmitter GABA. Northern blot analysis revealed that BGT1 expression is limited to the canine kidney medulla and is induced in MDCK cells by hypertonicity. Using the canine BGT1 sequence, Rasola et al. (1995) isolated a cDNA from a kidney library encoding the human homolog. The predicted 614-amino acid human protein has the typical structure of neurotransmitter transporters, with 12 transmembrane domains and a large extracellular loop between the third and fourth transmembrane domains. Northern blot analysis indicated that BGT1 is expressed as several mRNAs in human kidney and other tissues. Borden et al. (1995) also isolated human BGT1 cDNAs and reported that the human protein shares 91% and 87% sequence identity with canine and mouse BGT1, respectively. Heterologous expression of human BGT1 in mammalian cells conferred high-affinity GABA uptake.

Full details of the abovementioned studies are described in the following publications, the disclosure of which are hereby incorporated by reference:

Yamauchi, A.; Uchida, S.; Kwon, H. M.; Preston, A. S.; Robey, R. B.; Garcia-Perez, A.; Burg, M. B.; Handler, J. S.: Cloning of a Na (+) and Cl (-)-dependent betaine transporter that is regulated by hypertonicity. J. Biol. Chem. 267:649-652, 1992; and Rasola, A.; Galietta, L. J. V.; Barone, V.; Romeo, G.; Bagnasco, S.: Molecular cloning and functional characterization of a GABA/betaine transporter from human kidney. FEBS Lett. 373:22.

Further studies establishing the function and utilities of SLC6A12 are found in John Hopkins OMIM database record ID 603080, and in sited publications numbered 1068-1070 listed in the bibliography section hereinbelow, which are also hereby incorporated by reference. Zinc Finger Protein 18 (KOX 11) (ZNF18, Accession XM_085596) is another VGAM293 host target gene. ZNF18 BINDING SITE is HOST TARGET binding site found in the 3' untranslated region of mRNA encoded by ZNF18, corresponding to a HOST TARGET binding site such as BINDING SITE I, BINDING SITE II or BINDING SITE III. Table 2 illustrates the complementarity of the nucleotide sequences of ZNF18 BINDING SITE, designated SEQ ID:38250, to the nucleotide sequence of VGAM293 RNA, herein designated VGAM RNA, also designated SEQ ID:3004.

Another function of VGAM293 is therefore inhibition of Zinc Finger Protein 18 (KOX 11) (ZNF18, Accession XM_085596). Accordingly, utilities of VGAM293 include diagnosis, prevention and treatment of diseases and clinical conditions associated with ZNF18. ABLIM (Accession NM_002313) is another VGAM293 host target gene. ABLIM BINDING SITE1 and ABLIM BINDING SITE2 are HOST TARGET binding sites found in untranslated regions of mRNA encoded by ABLIM, corresponding to HOST TARGET binding sites such as BINDING SITE I, BINDING SITE II or BINDING SITE III. Table 2 illustrates the complementarity of the nucleotide sequences of ABLIM BINDING SITE1 and ABLIM BINDING SITE2, designated SEQ ID:8120 and SEQ ID:13553 respectively, to the nucleotide sequence of VGAM293 RNA, herein designated VGAM RNA, also designated SEQ ID:3004.

Another function of VGAM293 is therefore inhibition of ABLIM (Accession NM_002313). Accordingly, utilities of VGAM293 include diagnosis, prevention and treatment of diseases and clinical conditions associated with ABLIM. ATPW (Accession NM_015684) is another VGAM293 host target gene. ATPW BINDING SITE is HOST TARGET binding site found in the 5' untranslated region of mRNA encoded by ATPW, corresponding to a HOST TARGET binding site such as BINDING SITE I, BINDING SITE II or BINDING SITE III. Table 2 illustrates the complementarity of the nucleotide sequences of ATPW BINDING SITE, designated SEQ ID:17909, to the nucleotide sequence of VGAM293 RNA, herein designated VGAM RNA, also designated SEQ ID:3004.

Another function of VGAM293 is therefore inhibition of ATPW (Accession NM_015684). Accordingly, utilities of VGAM293 include diagnosis, prevention and treatment of diseases and clinical conditions associated with ATPW. KIAA1371 (Accession XM_114371) is another VGAM293 host target gene. KIAA1371 BINDING SITE is HOST TARGET binding site found in the 3" untranslated region of mRNA encoded by KIAA1371, corresponding to a HOST TARGET binding site such as BINDING SITE I, BINDING SITE II or BINDING SITE III. Table 2 illustrates the complementarity of the nucleotide sequences of KIAA1371 BINDING SITE, designated SEQ ID:42906, to the nucleotide sequence of VGAM293 RNA, herein designated VGAM RNA, also designated SEQ ID:3004.

Another function of VGAM293 is therefore inhibition of KIAA1371 (Accession XM_114371). Accordingly, utilities of VGAM293 include diagnosis, prevention and treatment of diseases and clinical conditions associated with KIAA1371.

KIAA1462 (Accession XM_166132) is another VGAM293 host target gene. KIAA1462 BINDING SITE is HOST TARGET binding site found in the 3' untranslated region of mRNA encoded by KIAA1462, corresponding to a HOST TARGET binding site such as BINDING SITE I, BINDING SITE II or BINDING SITE III. Table 2 illustrates the complementarity of the nucleotide sequences of KIAA1462 BINDING SITE, designated SEQ ID:43922, to the nucleotide sequence of VGAM293 RNA, herein designated VGAM RNA, also designated SEQ ID:3004.

Another function of VGAM293 is therefore inhibition of KIAA1462 (Accession XM_166132). Accordingly, utilities of VGAM293 include diagnosis, prevention and treatment of diseases and clinical conditions associated with KIAA1462.

KIAA1643 (Accession XM_035371) is another VGAM293 host target gene. KIAA1643 BINDING SITE is HOST TARGET binding site found in the 3' untranslated region of mRNA encoded by KIAA1643, corresponding to a HOST TARGET binding site such as BINDING SITE I, BINDING SITE II or BINDING SITE III. Table 2 illustrates the complementarity of the nucleotide sequences of KIAA1643 BINDING SITE, designated SEQ ID:32238, to the nucleotide sequence of VGAM293 RNA, herein designated VGAM RNA, also designated SEQ ID:3004.

Another function of VGAM293 is therefore inhibition of KIAA1643 (Accession XM_035371). Accordingly, utilities of VGAM293 include diagnosis, prevention and treatment of diseases and clinical conditions associated with KIAA1643.

MGC13251 (Accession NM_032714) is another VGAM293 host target gene. MGC13251 BINDING SITE is HOST TARGET binding site found in the 3' untranslated region of mRNA encoded by MGC13251, corresponding to a HOST TARGET binding site such as BINDING SITE I, BINDING SITE II or BINDING SITE III. Table 2 illustrates the complementarity of the nucleotide sequences of MGC13251 BINDING SITE, designated SEQ ID:26437, to the nucleotide sequence of VGAM293 RNA, herein designated VGAM RNA, also designated SEQ ID:3004.

Another function of VGAM293 is therefore inhibition of MGC13251 (Accession NM_032714). Accordingly, utilities of VGAM293 include diagnosis, prevention and treatment of diseases and clinical conditions associated with MGC13251.

MGC15476 (Accession NM_145056) is another VGAM293 host target gene. MGC15476 BINDING SITE is HOST TARGET binding site found in the 3' untranslated region of mRNA encoded by MGC15476, corresponding to a HOST TARGET binding site such as BINDING SITE I, BINDING SITE II or BINDING SITE III. Table 2 illustrates the complementarity of the nucleotide sequences of MGC15476 BINDING SITE, designated SEQ ID:29690, to the nucleotide sequence of VGAM293 RNA, herein designated VGAM RNA, also designated SEQ ID:3004.

Another function of VGAM293 is therefore inhibition of MGC15476 (Accession NM_145056). Accordingly, utilities of VGAM293 include diagnosis, prevention and treatment of diseases and clinical conditions associated with MGC15476.

LOC114971 (Accession XM_054936) is another VGAM293 host target gene. LOC114971 BINDING SITE is HOST TARGET binding site found in the 3' untranslated region of mRNA encoded by LOC114971, corresponding to a HOST TARGET binding site such as BINDING SITE I, BINDING SITE II or BINDING SITE III. Table 2 illustrates the complementarity of the nucleotide sequences of LOC114971 BINDING SITE, designated SEQ ID:36210, to the nucleotide sequence of VGAM293 RNA, herein designated VGAM RNA, also designated SEQ ID:3004.

Another function of VGAM293 is therefore inhibition of LOC114971 (Accession XM_054936). Accordingly, utilities of VGAM293 include diagnosis, prevention and treatment of diseases and clinical conditions associated with LOC114971.

LOC144848 (Accession XM_056770) is another VGAM293 host target gene. LOC144848 BINDING SITE is HOST TARGET binding site found in the 3' untranslated region of mRNA encoded by LOC144848, corresponding to a HOST TARGET binding site such as BINDING SITE I, BINDING SITE II or BINDING SITE III. Table 2 illustrates the complementarity of the nucleotide sequences of LOC144848 BINDING SITE, designated SEQ ID:36423, to the nucleotide sequence of VGAM293 RNA, herein designated VGAM RNA, also designated SEQ ID:3004.

Another function of VGAM293 is therefore inhibition of LOC144848 (Accession XM_056770). Accordingly, utilities of VGAM293 include diagnosis, prevention and treatment of diseases and clinical conditions associated with LOC144848.

LOC201181 (Accession XM_113916) is another VGAM293 host target gene. LOC201181 BINDING SITE is HOST TARGET binding site found in the 5' untranslated region of mRNA encoded by LOC201181, corresponding to a HOST TARGET binding site such as BINDING SITE I, BINDING SITE II or BINDING SITE III. Table 2 illustrates the complementarity of the nucleotide sequences of LOC201181 BINDING SITE, designated SEQ ID:42534, to the nucleotide sequence of VGAM293 RNA, herein designated VGAM RNA, also designated SEQ ID:3004.

Another function of VGAM293 is therefore inhibition of LOC201181 (Accession XM_113916). Accordingly, utilities of VGAM293 include diagnosis, prevention and treatment of diseases and clinical conditions associated with LOC201181.

FIG. 1 further provides a conceptual description of a novel bioinformatically detected viral gene of the present invention, referred to here as Viral Genomic Address Messenger 294 (VGAM294) viral gene, which modulates expression of respective host target genes thereof, the function and utility of which host target genes is known in the art.

VGAM294 is a novel bioinformatically detected regulatory, non protein coding, viral micro RNA (miRNA) gene. The method by which VGAM294 was detected is described hereinabove with reference to FIGS. 1-8.

VGAM294 gene, herein designated VGAM GENE, is a viral gene contained in the genome of Epiphyas Postvittana Nucleopolyhedrovirus. VGAM294 host target gene, herein designated VGAM HOST TARGET GENE, is a human gene contained in the human genome.

VGAM294 gene encodes a VGAM294 precursor RNA, herein designated VGAM PRECURSOR RNA. Similar to other miRNA genes, and unlike most ordinary genes, VGAM294 precursor RNA does not encode a protein. A nucleotide sequence identical or highly similar to the nucleotide sequence of VGAM294 precursor RNA is designated SEQ ID:280, and is provided hereinbelow with reference to the sequence listing part. Nucleotide sequence SEQ ID:280 is located at position 77095 relative to the genome of Epiphyas Postvittana Nucleopolyhedrovirus.

VGAM294 precursor RNA folds onto itself, forming VGAM294 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM294 folded precursor RNA into VGAM294 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM294 RNA is designated SEQ ID:3005, and is provided hereinbelow with reference to the sequence listing part.

VGAM294 host target gene, herein designated VGAM HOST TARGET GENE, encodes a corresponding messenger RNA, VGAM294 host target RNA, herein designated VGAM HOST TARGET RNA. VGAM294 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM294 RNA, herein designated VGAM RNA, binds complementarily to one or more host target binding sites located in untranslated regions of VGAM294 host target RNA, herein designated VGAM HOST TARGET RNA. This complementary binding is due to the fact that the nucleotide sequence of VGAM294 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM294 RNA, herein designated VGAM RNA, may have a different number of host target binding sites in untranslated regions of a VGAM294 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM294 RNA, herein designated VGAM RNA, to host target binding sites on VGAM294 host target RNA, herein designated VGAM HOST TARGET RNA, such as BINDING SITE I, BINDING SITE II and BINDING SITE III, inhibits translation of VGAM294 host target RNA into VGAM294 host target protein, herein designated VGAM HOST TARGET PROTEIN. VGAM host target protein is therefore outlined by a broken line.

It is appreciated that VGAM294 host target gene, herein designated VGAM HOST TARGET GENE, in fact represents a plurality of VGAM294 host target genes. The mRNA of each one of this plurality of VGAM294 host target genes comprises one or more host target binding sites, each having a nucleotide sequence which is at least partly complementary to VGAM294 RNA, herein designated VGAM RNA, and which when bound by VGAM294 RNA causes inhibition of translation of respective one or more VGAM294 host target proteins.

It is further appreciated by one skilled in the art that the mode of translational inhibition illustrated by FIG. 1 with specific reference to translational inhibition exerted by VGAM294 gene, herein designated VGAM GENE, on one or more VGAM294 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM294 is inhibition of expression of host target genes, as part of a novel viral mechanism of attacking a host. Accordingly, utilities of VGAM294 include diagnosis, prevention and treatment of viral infection by Epiphyas Postvittana Nucleopolyhedrovirus. Specific functions, and accordingly utilities, of VGAM294 correlate with, and may be deduced from, the identity of the host target genes which VGAM294 binds and inhibits, and the function of these host target genes, as elaborated hereinbelow.

Nucleotide sequences of the VGAM294 precursor RNA, herein designated VGAM PRECURSOR RNA, and of the 'diced' VGAM294 RNA, herein designated VGAM RNA, and a schematic representation of the secondary folding of VGAM294 folded precursor RNA, herein designated VGAM FOLDED PRECURSOR RNA, of VGAM294 are further described hereinbelow with reference to Table 1.

Nucleotide sequences of host target binding sites, such as BINDING SITE-I, BINDING SITE-II and BINDING SITE-III of FIG. 1, found on VGAM294 host target RNA, and schematic representation of the complementarity of each of these host target binding sites to VGAM294 RNA, herein designated VGAM RNA, are described hereinbelow with reference to Table 2.

As mentioned hereinabove with reference to FIG. 1, a function of VGAM294 gene, herein designated VGAM is inhibition of expression of VGAM294 target genes. It is appreciated that specific functions, and accordingly utilities, of VGAM294 correlate with, and may be deduced from, the identity of the target genes which VGAM294 binds and inhibits, and the function of these target genes, as elaborated hereinbelow.

Interleukin 22 Receptor, Alpha 2 (IL22RA2, Accession NM_052962) is a VGAM294 host target gene. IL22RA2 BINDING SITE is HOST TARGET binding site found in the 3' untranslated region of mRNA encoded by IL22RA2, corresponding to a HOST TARGET binding site such as BINDING SITE I, BINDING SITE II or BINDING SITE III. Table 2 illustrates the complementarity of the nucleotide sequences of IL22RA2 BINDING SITE, designated SEQ ID:27523, to the nucleotide sequence of VGAM294 RNA, herein designated VGAM RNA, also designated SEQ ID:3005.

A function of VGAM294 is therefore inhibition of Interleukin 22 Receptor, Alpha 2 (IL22RA2, Accession NM_052962), a gene which induces the production of acute-phase reactants. Accordingly, utilities of VGAM294 include diagnosis, prevention and treatment of diseases and clinical conditions associated with IL22RA2. The function of IL22RA2 and its association with various diseases and clinical conditions, has been established by previous studies, as described hereinabove with reference to VGAM167. Solute Carrier Family 1 (glial high affinity glutamate transporter), Member 3 (SLC1A3, Accession NM_004172) is another VGAM294 host target gene. SLC1A3 BINDING SITE is HOST TARGET binding site found in the 3' untranslated region of mRNA encoded by SLC1A3, corresponding to a HOST TARGET binding site such as BINDING SITE I, BINDING SITE II or BINDING SITE III. Table 2 illustrates the complementarity of the nucleotide sequences of SLC1A3 BINDING SITE, designated SEQ ID:10384, to the nucleotide sequence of VGAM294 RNA, herein designated VGAM RNA, also designated SEQ ID:3005.

Another function of VGAM294 is therefore inhibition of Solute Carrier Family 1 (glial high affinity glutamate transporter), Member 3 (SLC1A3, Accession NM_004172), a gene which is a transporter molecule that regulates neurotransmitter concentrations at excitatory synapses of the mammalian cns. Accordingly, utilities of VGAM294 include diagnosis, prevention and treatment of diseases and clinical conditions associated with SLC1A3. The function of SLC1A3 has been established by previous studies. Kirschner et al. (1994) mapped the human EAAT1 gene to 5p13 by fluorescence in situ hybridization. They used interspecific backcross analysis to map the murine homolog to chromosome 15 in a region of homology to human 5p13. They commented that the EAAT1 locus may be related to the syndrome of microcephaly and mental retardation observed by Keppen et al. (1992) in association with interstitial deletion of distal band 5p13. In the retina, the glutamate transporter GLAST is expressed in Muller cells, whereas the glutamate transporter GLT1 is found only in cones and various types of bipolar cells. To investigate the functional role of this differential distribution of glutamate transporters, Harada et al. (1998) analyzed Glast and Glt1 mutant mice. In Glast-deficient mice, the electroretinogram b-wave and oscillatory potentials were reduced and retinal damage after ischemia was exacerbated, whereas Glt1-deficient mice showed almost normal electroretinograms and mildly increased retinal damage after ischemia. These results demonstrated that Glast is required for normal signal transmission between photoreceptors and bipolar cells and that both Glast and Glt1 play a neuroprotective role during ischemia in the retina.

Full details of the abovementioned studies are described in the following publications, the disclosure of which are hereby incorporated by reference:

Kirschner, M. A.; Arriza, J. L.; Copeland, N. G.; Gilbert, D. J.; Jenkins, N. A.; Magenis, E.; Amara, S. G.: The mouse and human excitatory amino acid transporter gene (EAAT1) maps to mouse chromosome 15 and a region of syntenic homology on human chromosome 5. Genomics 22:631-633, 1994; and Harada, T.; Harada, C.; Watanabe, M.; Inoue, Y.; Sakagawa, T.; Nakayama, N.; Sasaki, S.; Okuyama, S.; Watase, K.; Wada, K.; Tanaka, K.: Functions of the two glutamate transporters GLAST a.

Further studies establishing the function and utilities of SLC1A3 are found in John Hopkins OMIM database record ID 600111, and in sited publications numbered 2918-2924 listed in the bibliography section hereinbelow, which are also hereby incorporated by reference. Ubiquitin-conjugating Enzyme E2A (RAD6 homolog) (UBE2A, Accession NM_003336) is another VGAM294 host target gene. UBE2A BINDING SITE is HOST TARGET binding site found in the 3' untranslated region of mRNA encoded by UBE2A, corresponding to a HOST TARGET binding site such as BINDING SITE I, BINDING SITE II or BINDING SITE III. Table 2 illustrates the complementarity of the nucleotide sequences of UBE2A BINDING SITE, designated SEQ ID:9342, to the nucleotide sequence of VGAM294 RNA, herein designated VGAM RNA, also designated SEQ ID:3005.

Another function of VGAM294 is therefore inhibition of Ubiquitin-conjugating Enzyme E2A (RAD6 homolog) (UBE2A, Accession NM_003336), a gene which catalyzes the covalent attachment of ubiquitin to other proteins and is required for postreplication repair of uv-damaged dna. Accordingly, utilities of VGAM294 include diagnosis, prevention and treatment of diseases and clinical conditions associated with UBE2A. The function of UBE2A has been established by previous studies. As deduced from the pleiotropic phenotype of rad6 deletion mutants in Saccharomyces cerevisiae, the RAD6 protein plays an important role in various cellular processes. The protein is strongly conserved in eukaryotic evolution, a property that permitted Koken et al. (1991) to clone to human homologs by evolutionary walking using Schizosaccharomyces pombe and Drosophila melanogaster homologs as 'intermediates.' The human HHR6A and HHR6B proteins (HHR for human homolog of rad6) shared about 95% amino acid sequence identity with each other and about 70% amino acid sequence with their yeast counterparts, but notably lacked the acidic C-terminal domain, the occurrence of which seemed to be limited to S. cerevisiae rad6. By in situ hybridization with biotinylated probes, Koken et al. (1992) localized the RAD6A gene to Xq24-q25 and the RAD6B gene (OMIM Ref. No. 179095) to 5q23-q31. The assignment of RAD6A to the X chromosome was confirmed with an X-specific human-mouse/hamster somatic cell hybrid panel. This gene is also symbolized UBE2A (for ubiquitin-conjugating enzyme E2A).

Full details of the abovementioned studies are described in the following publications, the disclosure of which are hereby incorporated by reference:

Koken, M. H. M.; Reynolds, P.; Jaspers-Dekker, I.; Prakash, L.; Prakash, S.; Bootsma, D.; Hoeijmakers, J. H. J.: Structural and functional conservation of two human homologs of the yeast DNA repair gene RAD6. Proc. Nat. Acad. Sci. 88:8865-8869, 1991; and Koken, M. H. M.; Smit, E. M. E.; Jaspers-Dekker, I.; Oostra, B. A.; Hagemeijer, A.; Bootsma, D.; Hoeijmakers, J. H. J.: Localization of two human homologs, HHR6A and HHR6B, of the yeas.

Further studies establishing the function and utilities of UBE2A are found in John Hopkins OMIM database record ID 312180, and in sited publications numbered 8412 listed in the bibliography section hereinbelow, which are also hereby incorporated by reference. KIAA0193 (Accession NM_014766) is another VGAM294 host target gene. KIAA0193 BINDING SITE is HOST TARGET binding site found in the 3' untranslated region of mRNA encoded by KIAA0193, corresponding to a HOST TARGET binding site such as BINDING SITE I, BINDING SITE II or BINDING SITE III. Table 2 illustrates the complementarity of the nucleotide sequences of KIAA0193 BINDING SITE, designated SEQ ID:16545, to the nucleotide sequence of VGAM294 RNA, herein designated VGAM RNA, also designated SEQ ID:3005.

Another function of VGAM294 is therefore inhibition of KIAA0193 (Accession NM_014766). Accordingly, utilities of VGAM294 include diagnosis, prevention and treatment of diseases and clinical conditions associated with KIAA0193. KIAA0972 (Accession NM_014930) is another VGAM294 host target gene. KIAA0972 BINDING SITE is HOST TARGET binding site found in the 3' untranslated region of mRNA encoded by KIAA0972, corresponding to a HOST TARGET binding site such as BINDING SITE I, BINDING SITE II or BINDING SITE III. Table 2 illustrates the complementarity of the nucleotide sequences of KIAA0972 BINDING SITE, designated SEQ ID:17227, to the nucleotide sequence of VGAM294 RNA, herein designated VGAM RNA, also designated SEQ ID:3005.

Another function of VGAM294 is therefore inhibition of KIAA0972 (Accession NM_014930). Accordingly, utilities of VGAM294 include diagnosis, prevention and treatment of diseases and clinical conditions associated with KIAA0972.

LOC145231 (Accession XM_096740) is another VGAM294 host target gene. LOC145231 BINDING SITE is HOST TARGET binding site found in the 3' untranslated region of mRNA encoded by LOC145231, corresponding to a HOST TARGET binding site such as BINDING SITE I, BINDING SITE II or BINDING SITE III. Table 2 illustrates the complementarity of the nucleotide sequences of LOC145231 BINDING SITE, designated SEQ ID:40520, to the nucleotide sequence of VGAM294 RNA, herein designated VGAM RNA, also designated SEQ ID:3005.

Another function of VGAM294 is therefore inhibition of LOC145231 (Accession XM_096740). Accordingly, utilities of VGAM294 include diagnosis, prevention and treatment of diseases and clinical conditions associated with LOC145231. FIG. 1 further provides a conceptual description of a novel bioinformatically detected viral gene of the present invention, referred to here as Viral Genomic Address Messenger 295 (VGAM295) viral gene, which modulates expression of respective host target genes thereof, the function and utility of which host target genes is known in the art.

VGAM295 is a novel bioinformatically detected regulatory, non protein coding, viral micro RNA (miRNA) gene. The method by which VGAM295 was detected is described hereinabove with reference to FIGS. 1-8.

VGAM295 gene, herein designated VGAM GENE, is a viral gene contained in the genome of Epiphyas Postvittana Nucleopolyhedrovirus. VGAM295 host target gene, herein designated VGAM HOST TARGET GENE, is a human gene contained in the human genome.

VGAM295 gene encodes a VGAM295 precursor RNA, herein designated VGAM PRECURSOR RNA. Similar to other miRNA genes, and unlike most ordinary genes, VGAM295 precursor RNA does not encode a protein. A nucleotide sequence identical or highly similar to the nucleotide sequence of VGAM295 precursor RNA is designated SEQ ID:281, and is provided hereinbelow with reference to the sequence listing part. Nucleotide sequence SEQ ID:281 is located at position 83820 relative to the genome of Epiphyas Postvittana Nucleopolyhedrovirus.

VGAM295 precursor RNA folds onto itself, forming VGAM295 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM295 folded precursor RNA into VGAM295 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM295 RNA is designated SEQ ID:3006, and is provided hereinbelow with reference to the sequence listing part.

VGAM295 host target gene, herein designated VGAM HOST TARGET GENE, encodes a corresponding messenger RNA, VGAM295 host target RNA, herein designated VGAM HOST TARGET RNA. VGAM295 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM295 RNA, herein designated VGAM RNA, binds complementarily to one or more host target binding sites located in untranslated regions of VGAM295 host target RNA, herein designated VGAM HOST TARGET RNA. This complementary binding is due to the fact that the nucleotide sequence of VGAM295 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM295 RNA, herein designated VGAM RNA, may have a different number of host target binding sites in untranslated regions of a VGAM295 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM295 RNA, herein designated VGAM RNA, to host target binding sites on VGAM295 host target RNA, herein designated VGAM HOST TARGET RNA, such as BINDING SITE I, BINDING SITE II and BINDING SITE III, inhibits translation of VGAM295 host target RNA into VGAM295 host target protein, herein designated VGAM HOST TARGET PROTEIN. VGAM host target protein is therefore outlined by a broken line.

It is appreciated that VGAM295 host target gene, herein designated VGAM HOST TARGET GENE, in fact represents a plurality of VGAM295 host target genes. The mRNA of each one of this plurality of VGAM295 host target genes comprises one or more host target binding sites, each having a nucleotide sequence which is at least partly complementary to VGAM295 RNA, herein designated VGAM RNA, and which when bound by VGAM295 RNA causes inhibition of translation of respective one or more VGAM295 host target proteins.

It is further appreciated by one skilled in the art that the mode of translational inhibition illustrated by FIG. 1 with specific reference to translational inhibition exerted by VGAM295 gene, herein designated VGAM GENE, on one or more VGAM295 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM295 is inhibition of expression of host target genes, as part of a novel viral mechanism of attacking a host. Accordingly, utilities of VGAM295 include diagnosis, prevention and treatment of viral infection by Epiphyas Postvittana Nucleopolyhedrovirus. Specific functions, and accordingly utilities, of VGAM295 correlate with, and may be deduced from, the identity of the host target genes which VGAM295 binds and inhibits, and the function of these host target genes, as elaborated hereinbelow.

Nucleotide sequences of the VGAM295 precursor RNA, herein designated VGAM PRECURSOR RNA, and of the 'diced' VGAM295 RNA, herein designated VGAM RNA, and a schematic representation of the secondary folding of VGAM295 folded precursor RNA, herein designated VGAM FOLDED PRECURSOR RNA, of VGAM295 are further described hereinbelow with reference to Table 1.

Nucleotide sequences of host target binding sites, such as BINDING SITE-I, BINDING SITE-II and BINDING SITE-III of FIG. 1, found on VGAM295 host target RNA, and schematic representation of the complementarity of each of these host target binding sites to VGAM295 RNA, herein designated VGAM RNA, are described hereinbelow with reference to Table 2.

As mentioned hereinabove with reference to FIG. 1, a function of VGAM295 gene, herein designated VGAM is inhibition of expression of VGAM295 target genes. It is appreciated that specific functions, and accordingly utilities, of VGAM295 correlate with, and may be deduced from, the identity of the target genes which VGAM295 binds and inhibits, and the function of these target genes, as elaborated hereinbelow.

Adenylate Cyclase 7 (ADCY7, Accession NM_001114) is a VGAM295 host target gene. ADCY7 BINDING SITE is HOST TARGET binding site found in the 3' untranslated region of mRNA encoded by ADCY7, corresponding to a HOST TARGET binding site such as BINDING SITE I, BINDING SITE II or BINDING SITE III. Table 2 illustrates the complementarity of the nucleotide sequences of ADCY7 BINDING SITE, designated SEQ ID:6779, to the nucleotide sequence of VGAM295 RNA, herein designated VGAM RNA, also designated SEQ ID:3006.

A function of VGAM295 is therefore inhibition of Adenylate Cyclase 7 (ADCY7, Accession NM_001114), a gene which this a membrane-bound, ca (2+)-inhibitable adenylyl cyclase. Accordingly, utilities of VGAM295 include diagnosis, prevention and treatment of diseases and clinical conditions associated with ADCY7. The function of ADCY7 and its association with various diseases and clinical conditions, has been established by previous studies, as described hereinabove with reference to VGAM108. Junctophilin 2 (JPH2, Accession XM_170491) is another VGAM295 host target gene. JPH2 BINDING SITE is HOST TARGET binding site found in the 3' untranslated region of mRNA encoded by JPH2, corresponding to a HOST TARGET binding site such as BINDING SITE I, BINDING SITE II or BINDING SITE III. Table 2 illustrates the complementarity of the nucleotide sequences of JPH2 BINDING SITE, designated SEQ ID:45332, to the nucleotide sequence of VGAM295 RNA, herein designated VGAM RNA, also designated SEQ ID:3006.

Another function of VGAM295 is therefore inhibition of Junctophilin 2 (JPH2, Accession XM_170491), a gene which mediates cross talk between cell surface and intracellular ion channels. Accordingly, utilities of VGAM295 include diagnosis, prevention and treatment of diseases and clinical conditions associated with JPH2. The function of JPH2 has been established by previous studies. Junctional complexes between the plasma membrane (PM) and endoplasmic/sarcoplasmic reticulum (ER/SR) are a common feature of all excitable cell types and mediate cross talk between cell surface and intracellular ion channels. Takeshima et al. (2000) identified the junctophilins (JPs), a conserved family of proteins that are components of the junctional complexes. JPs are composed of a C-terminal hydrophobic segment spanning the ER/SR membrane and a remaining cytoplasmic domain that shows specific affinity for the PM. In mouse, there are at least 3 JP subtypes: Jp1, Jp2, and Jp3. By screening genomic DNA libraries, Nishi et al. (2000) isolated the human JP1 (OMIM Ref. No. 605266) and JP2 genes, and by screening a brain cDNA library, they isolated a cDNA encoding human JP3 (OMIM Ref. No. 605268). The JP2 gene encodes a deduced 696-amino acid protein. The human JPs share an overall sequence identity of 39%, and they share characteristic structural features with their rabbit and mouse counterparts. RNA blot hybridization indicated that the tissue-specific expression patterns of the JP genes in human are essentially the same as those in mouse; JP1 was expressed as a 4.5-kb transcript in skeletal muscle and at low levels in heart, JP2 was expressed as a 4.1-kb transcript in heart and skeletal muscle, and JP3 was expressed as a 4.6-kb transcript in brain. The protein-coding sequence is interrupted by 4 introns in each JP gene. By FISH, Nishi et al. (2000) mapped the JP2 gene to 20q12 and determined that the JP genes do not cluster on the human genome. Takeshima et al. (2000) showed that Jp2 is abundantly expressed in mouse heart, and mutant mice lacking Jp2 exhibited embryonic lethality. Cardiac myocytes from the mutant mice showed deficiency of the junctional membrane complexes and abnormal calcium transients. These results suggested that JPs are important components of junctional membrane complexes.

Full details of the abovementioned studies are described in the following publications, the disclosure of which are hereby incorporated by reference:

Nishi, M.; Mizushima, A.; Nakagawara, K.; Takeshima, H.: Characterization of human junctophilin subtype genes. Biochem. Biophys. Res. Commun. 273:920-927, 2000; and Takeshima, H.; Komazaki, S.; Nishi, M.; Iino, M.; Kangawa, K.: Junctophilins: a novel family of junctional membrane complex proteins. Molec. Cell 6:11-22, 2000.

Further studies establishing the function and utilities of JPH2 are found in John Hopkins OMIM database record ID 605267, and in sited publications numbered 5036-5037 listed in the bibliography section hereinbelow, which are also hereby incorporated by reference. DKFZP564O0423 (Accession XM_166254) is another VGAM295 host target gene. DKFZP564O0423 BINDING SITE is HOST TARGET binding site found in the 5' untranslated region of mRNA encoded by DKFZP564O0423, corresponding to a HOST TARGET binding site such as BINDING SITE I, BINDING SITE II or BINDING SITE III. Table 2 illustrates the complementarity of the nucleotide sequences of DKFZP564O0423 BINDING SITE, designated SEQ ID:44061, to the nucleotide sequence of VGAM295 RNA, herein designated VGAM RNA, also designated SEQ ID:3006.

Another function of VGAM295 is therefore inhibition of DKFZP564O0423 (Accession XM_166254). Accordingly, utilities of VGAM295 include diagnosis, prevention and treatment of diseases and clinical conditions associated with DKFZP564O0423. LOC124801 (Accession XM_058850) is another VGAM295 host target gene. LOC124801 BINDING SITE is HOST TARGET binding site found in the 3' untranslated region of mRNA encoded by LOC124801, corresponding to a HOST TARGET binding site such as BINDING SITE I, BINDING SITE II or BINDING SITE III. Table 2 illustrates the complementarity of the nucleotide sequences of LOC124801 BINDING SITE, designated SEQ ID:36763, to the nucleotide sequence of VGAM295 RNA, herein designated VGAM RNA, also designated SEQ ID:3006.

Another function of VGAM295 is therefore inhibition of LOC124801 (Accession XM_058850). Accordingly, utilities of VGAM295 include diagnosis, prevention and treatment of diseases and clinical conditions associated with LOC124801. LOC57086 (Accession NM_020351) is another VGAM295 host target gene. LOC57086 BINDING SITE is HOST TARGET binding site found in the 3' untranslated region of mRNA encoded by LOC57086, corresponding to a HOST TARGET binding site such as BINDING SITE I, BINDING SITE II or BINDING SITE III. Table 2 illustrates the complementarity of the nucleotide sequences of LOC57086 BINDING SITE, designated SEQ ID:21618, to the nucleotide sequence of VGAM295 RNA, herein designated VGAM RNA, also designated SEQ ID:3006.

Another function of VGAM295 is therefore inhibition of LOC57086 (Accession NM_020351). Accordingly, utilities of VGAM295 include diagnosis, prevention and treatment of diseases and clinical conditions associated with LOC57086. FIG. 1 further provides a conceptual description of a novel bioinformatically detected viral gene of the present invention, referred to here as Viral Genomic Address Messenger 296 (VGAM296) viral gene, which modulates expression of respective host target genes thereof, the function and utility of which host target genes is known in the art.

VGAM296 is a novel bioinformatically detected regulatory, non protein coding, viral micro RNA (miRNA) gene. The method by which VGAM296 was detected is described hereinabove with reference to FIGS. 1-8.

VGAM296 gene, herein designated VGAM GENE, is a viral gene contained in the genome of Epiphyas Postvittana Nucleopolyhedrovirus. VGAM296 host target gene, herein designated VGAM HOST TARGET GENE, is a human gene contained in the human genome.

VGAM296 gene encodes a VGAM296 precursor RNA, herein designated VGAM PRECURSOR RNA. Similar to other miRNA genes, and unlike most ordinary genes, VGAM296 precursor RNA does not encode a protein. A nucleotide sequence identical or highly similar to the nucleotide sequence of VGAM296 precursor RNA is designated SEQ ID:282, and is provided hereinbelow with reference to the sequence listing part. Nucleotide sequence SEQ ID:282 is located at position 80889 relative to the genome of Epiphyas Postvittana Nucleopolyhedrovirus.

VGAM296 precursor RNA folds onto itself, forming VGAM296 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or a partial inversed-reversed sequence of the nucleotide sequence of the second half thereof.

An enzyme complex designated DICER COMPLEX, 'dices' the VGAM296 folded precursor RNA into VGAM296 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM296 RNA is designated SEQ ID:3007, and is provided hereinbelow with reference to the sequence listing part.

VGAM296 host target gene, herein designated VGAM HOST TARGET GENE, encodes a corresponding messenger RNA, VGAM296 host target RNA, herein designated VGAM HOST TARGET RNA. VGAM296 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM296 RNA, herein designated VGAM RNA, binds complementarily to one or more host target binding sites located in untranslated regions of VGAM296 host target RNA, herein designated VGAM HOST TARGET RNA. This complementary binding is due to the fact that the nucleotide sequence of VGAM296 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM296 RNA, herein designated VGAM RNA, may have a different number of host target binding sites in untranslated regions of a VGAM296 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM296 RNA, herein designated VGAM RNA, to host target binding sites on VGAM296 host target RNA, herein designated VGAM HOST TARGET RNA, such as BINDING SITE I, BINDING SITE II and BINDING SITE III, inhibits translation of VGAM296 host target RNA into VGAM296 host target protein, herein designated VGAM HOST TARGET PROTEIN. VGAM host target protein is therefore outlined by a broken line.

It is appreciated that VGAM296 host target gene, herein designated VGAM HOST TARGET GENE, in fact represents a plurality of VGAM296 host target genes. The mRNA of each one of this plurality of VGAM296 host target genes comprises one or more host target binding sites, each having a nucleotide sequence which is at least partly complementary to VGAM296 RNA, herein designated VGAM RNA, and which when bound by VGAM296 RNA causes inhibition of translation of respective one or more VGAM296 host target proteins.

It is further appreciated by one skilled in the art that the mode of translational inhibition illustrated by FIG. 1 with specific reference to translational inhibition exerted by VGAM296 gene, herein designated VGAM GENE, on one or more VGAM296 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM296 is inhibition of expression of host target genes, as part of a novel viral mechanism of attacking a host. Accordingly, utilities of VGAM296 include diagnosis, prevention and treatment of viral infection by Epiphyas Postvittana Nucleopolyhedrovirus. Specific functions, and accordingly utilities, of VGAM296 correlate with, and may be deduced from, the identity of the host target genes which VGAM296 binds and inhibits, and the function of these host target genes, as elaborated hereinbelow.

Nucleotide sequences of the VGAM296 precursor RNA, herein designated VGAM PRECURSOR RNA, and of the 'diced' VGAM296 RNA, herein designated VGAM RNA, and a schematic representation of the secondary folding of VGAM296 folded precursor RNA, herein designated VGAM FOLDED PRECURSOR RNA, of VGAM296 are further described hereinbelow with reference to Table 1.

Nucleotide sequences of host target binding sites, such as BINDING SITE-I, BINDING SITE-II and BINDING SITE-III of FIG. 1, found on VGAM296 host target RNA, and schematic representation of the complementarity of each of these host target binding sites to VGAM296 RNA, herein designated VGAM RNA, are described hereinbelow with reference to Table 2.

As mentioned hereinabove with reference to FIG. 1, a function of VGAM296 gene, herein designated VGAM is inhibition of expression of VGAM296 target genes. It is appreciated that specific functions, and accordingly utilities, of VGAM296 correlate with, and may be deduced from, the identity of the target genes which VGAM296 binds and inhibits, and the function of these target genes, as elaborated hereinbelow.

Calcium Channel, Voltage-dependent, L Type, Alpha 1C Subunit (CACNA1C, Accession NM_000719) is a VGAM296 host target gene. CACNA1C BINDING SITE is HOST TARGET binding site found in the 5' untranslated region of mRNA encoded by CACNA1C, corresponding to a HOST TARGET binding site such as BINDING SITE I, BINDING SITE II or BINDING SITE III. Table 2 illustrates the complementarity of the nucleotide sequences of CACNA1C BINDING SITE, designated SEQ ID:6378, to the nucleotide sequence of VGAM296 RNA, herein designated VGAM RNA, also designated SEQ ID:3007.

A function of VGAM296 is therefore inhibition of Calcium Channel, Voltage-dependent, L Type, Alpha 1C Subunit (CACNA1C, Accession NM_000719), a gene which is alpha-1 subunit of DHP-sensitive calcium channels from cardiac muscle and the brain. Accordingly, utilities of VGAM296 include diagnosis, prevention and treatment of diseases and clinical conditions associated with CACNA1C. The function of CACNA1C and its association with various diseases and clinical conditions, has been established by previous studies, as described hereinabove with reference to VGAM182. Ubiquitin Specific Protease 6 (Tre-2 oncogene) (USP6, Accession XM_165948) is another VGAM296 host target gene. USP6 BINDING SITE is HOST TARGET binding site found in the 3' untranslated region of mRNA encoded by USP6, corresponding to a HOST TARGET binding site such as BINDING SITE I, BINDING SITE II or BINDING SITE III. Table 2 illustrates the complementarity of the nucleotide sequences of USP6 BINDING SITE, designated SEQ ID:43806, to the nucleotide sequence of VGAM296 RNA, herein designated VGAM RNA, also designated SEQ ID:3007.

Another function of VGAM296 is therefore inhibition of Ubiquitin Specific Protease 6 (Tre-2 oncogene) (USP6, Accession XM_165948), a gene which has an atp-independent isopeptidase activity, cleaving at the carboxyl terminus of the ubiquitin moiety. Accordingly, utilities of VGAM296 include diagnosis, prevention and treatment of diseases and clinical conditions associated with USP6. The function of USP6 has been established by previous studies. The TRE locus was first isolated from NIH 3T3 cells transfected with human Ewing sarcoma DNA (Nakamura et al., 1988). Huebner et al. (1988) found that the locus is discontinuous in human cells and is composed of 3 major genetic elements originating 5-prime to 3-prime from human chromosomes 5, 18, and 17. Nakamura et al. (1992) cloned transcripts from the chromosome 17 portion of TRE from a cDNA library of cytoplasmic poly (A) RNA from TRE-transfected NIH 3T3 tumor cells. They obtained a novel cDNA, the 5-prime part of which overlapped the TRE transcript, and named its locus of origin TRE2. The complete cDNA spans 8,201 bp and possesses an unusually long noncoding region and a translatable region with 2 open reading frames (ORF). In one cDNA clone, the presence of 2 insertion sequences suggested the possibility of alternative splicing. Transfection-tumorigenicity assays with the ORFs subcloned into expression vectors were positive for the ORF adjacent to the 5-prime noncoding region and negative for the second, downstream ORF. Analysis of the 786-amino acid sequence deduced from the 5-prime ORF predicted a highly hydrophilic protein with 2 charge clusters suggesting nucleic acid-binding properties. When used as a probe, the cloned sequence detected RNA transcripts in a wide variety of human cancer cells regardless of their lineage of origin from different tissues, but not in human cells from normal tissue. By chromosomal in situ hybridization, Nakamura et al. (1992) mapped the TRE2 gene to 17q11.

Full details of the abovementioned studies are described in the following publications, the disclosure of which are hereby incorporated by reference:

Huebner, K.; Cannizzaro, L. A.; Nakamura, T.; Hillova, J.; Mariage-Samson, R.; Hecht, F.; Hill, M.; Croce, C. M.: A rearranged transforming gene, tre, is made up of human sequences derived from chromosome regions 5q, 17q and 18q. Oncogene 3:449-455, 1988; and Nakamura, T.; Hillova, J.; Mariage-Samson, R.; Onno, M.; Huebner, K.; Cannizzaro, L. A.; Boghosian-Sell, L.; Croce, C. M.; Hill, M.: A novel transcriptional unit of the tre oncogene wid.

Further studies establishing the function and utilities of USP6 are found in John Hopkins OMIM database record ID 604334, and in sited publications numbered 4987-4989 listed in the bibliography section hereinbelow, which are also hereby incorporated by reference. Olfactomedin 3 (OLFM3, Accession XM_088951) is another VGAM296 host target gene. OLFM3 BINDING SITE is HOST TARGET binding site found in the 3' untranslated region of mRNA encoded by OLFM3, corresponding to a HOST TARGET binding site such as BINDING SITE I, BINDING SITE II or BINDING SITE III. Table 2 illustrates the complementarity of the nucleotide sequences of OLFM3 BINDING SITE, designated SEQ ID:39957, to the nucleotide sequence of VGAM296 RNA, herein designated VGAM RNA, also designated SEQ ID:3007.

Another function of VGAM296 is therefore inhibition of Olfactomedin 3 (OLFM3, Accession XM_088951). Accordingly, utilities of VGAM296 include diagnosis, prevention and treatment of diseases and clinical conditions associated with OLFM3. LOC256714 (Accession XM_172798) is another VGAM296 host target gene. LOC256714 BINDING SITE is HOST TARGET binding site found in the 3' untranslated region of mRNA encoded by LOC256714, corresponding to a HOST TARGET binding site such as BINDING SITE I, BINDING SITE II or BINDING SITE III. Table 2 illustrates the complementarity of the nucleotide sequences of LOC256714 BINDING SITE, designated SEQ ID:46081, to the nucleotide sequence of VGAM296 RNA, herein designated VGAM RNA, also designated SEQ ID:3007.

Another function of VGAM296 is therefore inhibition of LOC256714 (Accession XM_172798). Accordingly, utilities of VGAM296 include diagnosis, prevention and treatment of diseases and clinical conditions associated with LOC256714. FIG. 1 further provides a conceptual description of a novel bioinformatically detected viral gene of the present invention, referred to here as Viral Genomic Address Messenger 297

(VGAM297) viral gene, which modulates expression of respective host target genes thereof, the function and utility of which host target genes is known in the art.

VGAM297 is a novel bioinformatically detected regulatory, non protein coding, viral micro RNA (miRNA) gene. The method by which VGAM297 was detected is described hereinabove with reference to FIGS. 1-8.

VGAM297 gene, herein designated VGAM GENE, is a viral gene contained in the genome of Epiphyas Postvittana Nucleopolyhedrovirus. VGAM297 host target gene, herein designated VGAM HOST TARGET GENE, is a human gene contained in the human genome.

VGAM297 gene encodes a VGAM297 precursor RNA, herein designated VGAM PRECURSOR RNA. Similar to other miRNA genes, and unlike most ordinary genes, VGAM297 precursor RNA does not encode a protein. A nucleotide sequence identical or highly similar to the nucleotide sequence of VGAM297 precursor RNA is designated SEQ ID:283, and is provided hereinbelow with reference to the sequence listing part. Nucleotide sequence SEQ ID:283 is located at position 88463 relative to the genome of Epiphyas Postvittana Nucleopolyhedrovirus.

VGAM297 precursor RNA folds onto itself, forming VGAM297 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM297 folded precursor RNA into VGAM297 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM297 RNA is designated SEQ ID:3008, and is provided hereinbelow with reference to the sequence listing part.

VGAM297 host target gene, herein designated VGAM HOST TARGET GENE, encodes a corresponding messenger RNA, VGAM297 host target RNA, herein designated VGAM HOST TARGET RNA. VGAM297 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM297 RNA, herein designated VGAM RNA, binds complementarily to one or more host target binding sites located in untranslated regions of VGAM297 host target RNA, herein designated VGAM HOST TARGET RNA. This complementary binding is due to the fact that the nucleotide sequence of VGAM297 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM297 RNA, herein designated VGAM RNA, may have a different number of host target binding sites in untranslated regions of a VGAM297 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM297 RNA, herein designated VGAM RNA, to host target binding sites on VGAM297 host target RNA, herein designated VGAM HOST TARGET RNA, such as BINDING SITE I, BINDING SITE II and BINDING SITE III, inhibits translation of VGAM297 host target RNA into VGAM297 host target protein, herein designated VGAM HOST TARGET PROTEIN. VGAM host target protein is therefore outlined by a broken line.

It is appreciated that VGAM297 host target gene, herein designated VGAM HOST TARGET GENE, in fact represents a plurality of VGAM297 host target genes. The mRNA of each one of this plurality of VGAM297 host target genes comprises one or more host target binding sites, each having a nucleotide sequence which is at least partly complementary to VGAM297 RNA, herein designated VGAM RNA, and which when bound by VGAM297 RNA causes inhibition of translation of respective one or more VGAM297 host target proteins.

It is further appreciated by one skilled in the art that the mode of translational inhibition illustrated by FIG. 1 with specific reference to translational inhibition exerted by VGAM297 gene, herein designated VGAM GENE, on one or more VGAM297 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM297 is inhibition of expression of host target genes, as part of a novel viral mechanism of attacking a host. Accordingly, utilities of VGAM297 include diagnosis, prevention and treatment of viral infection by Epiphyas Postvittana Nucleopolyhedrovirus. Specific functions, and accordingly utilities, of VGAM297 correlate with, and may be deduced from, the identity of the host target genes which VGAM297 binds and inhibits, and the function of these host target genes, as elaborated hereinbelow.

Nucleotide sequences of the VGAM297 precursor RNA, herein designated VGAM PRECURSOR RNA, and of the 'diced' VGAM297 RNA, herein designated VGAM RNA, and a schematic representation of the secondary folding of VGAM297 folded precursor RNA, herein designated VGAM FOLDED PRECURSOR RNA, of VGAM297 are further described hereinbelow with reference to Table 1.

Nucleotide sequences of host target binding sites, such as BINDING SITE-I, BINDING SITE-II and BINDING SITE-III of FIG. 1, found on VGAM297 host target RNA, and schematic representation of the complementarity of each of these host target binding sites to VGAM297 RNA, herein designated VGAM RNA, are described hereinbelow with reference to Table 2.

As mentioned hereinabove with reference to FIG. 1, a function of VGAM297 gene, herein designated VGAM is inhibition of expression of VGAM297 target genes. It is appreciated that specific functions, and accordingly utilities, of VGAM297 correlate with, and may be deduced from, the identity of the target genes which VGAM297 binds and inhibits, and the function of these target genes, as elaborated hereinbelow.

Rho Guanine Nucleotide Exchange Factor (GEF) 7 (ARHGEF7, Accession NM_003899) is a VGAM297 host target gene. ARHGEF7 BINDING SITE is HOST TARGET binding site found in the 5' untranslated region of mRNA encoded by ARHGEF7, corresponding to a HOST TARGET binding site such as BINDING SITE I, BINDING SITE II or BINDING SITE III. Table 2 illustrates the complementarity of the nucleotide sequences of ARHGEF7 BINDING SITE, designated SEQ ID:9984, to the nucleotide sequence of VGAM297 RNA, herein designated VGAM RNA, also designated SEQ ID:3008.

A function of VGAM297 is therefore inhibition of Rho Guanine Nucleotide Exchange Factor (GEF) 7 (ARHGEF7, Accession NM_003899), a gene which acts as a rac1 guanine nucleotide exchange factor (gef) and can induce membrane ruffling. Accordingly, utilities of VGAM297 include diagnosis, prevention and treatment of diseases and clinical conditions associated with ARHGEF7. The function of ARHGEF7 has been established by previous studies. p21 (CDKN1A; 116899)-activated kinases, or PAKs (e.g., PAK1; 602590), bind to and are activated by Rho family GTPases, such as CDC42 (OMIM Ref. No. 116952) and RAC (see OMIM Ref. No. RAC1; 602048). PAKs are implicated in the regulation of gene expression, cytoskeletal architecture, and apoptosis. By screening rat tissue extracts for binding to PAK1, peptide microsequencing, and primer walking, Manser et al. (1998) isolated a rat cDNA encoding Pixb. Pixb is approximately 97% identical to the human cDNA KIAA0142 identified by Nagase et al. (1995). By screening a mouse thymus expression cDNA library, Oh et al. (1997) isolated a cDNA encoding p85SPR (85-kD, SH3 domain-containing, proline-rich protein), which is 93% identical to KIAA0142, or human PIXB. Using a yeast 2-hybrid screen with PAK3 (OMIM Ref. No. 300142) as bait, Bagrodia et al. (1998) also isolated PIXB, which they called COOL1, from a HeLa cell cDNA library. Sequence analysis predicted that the 646-amino acid PIXB protein contains an N-terminal SH3 domain, a Dbl-homology (DH) domain, a pleckstrin homology (PH) domain, 2 putative nuclear localization signals, 2 leucine zipper motifs, and a proline-rich region. Northern blot analysis by Manser et al. (1998) revealed ubiquitous expression of an approximately 4.4-kb transcript. By immunofluorescence microscopy, they showed that the SH3 domain of PIXB is required for recruitment of PAK1 to CDC42-driven focal complexes. Their functional analysis demonstrated that PIXB acts as a RAC1 guanine nucleotide exchange factor (GEF) and can induce membrane ruffling.

Full details of the abovementioned studies are described in the following publications, the disclosure of which are hereby incorporated by reference:

Bagrodia, S.; Taylor, S. J.; Jordon, K. A.; Van Aelst, L.; Cerione, R. A.: A novel regulator of p21-activated kinases. J. Biol. Chem. 273:23633-23636, 1998; and Manser, E.; Loo, T.-H.; Koh, C.-G.; Zhao, Z.-S.; Chen, X.-Q.; Tan, L.; Tan, I.; Leung, T.; Lim, L.: PAK kinases are directly coupled to the PIX family of nucleotide exchange factors. M.

Further studies establishing the function and utilities of ARHGEF7 are found in John Hopkins OMIM database record ID 605477, and in sited publications numbered 6977, 1081 and 10969 listed in the bibliography section hereinbelow, which are also hereby incorporated by reference. Colony Stimulating Factor 1 Receptor, Formerly McDonough Feline Sarcoma Viral (v-fms) Oncogene Homolog (CSF1R, Accession NM_005211) is another VGAM297 host target gene. CSF1R BINDING SITE is HOST TARGET binding site found in the 3" untranslated region of mRNA encoded by CSF1R, corresponding to a HOST TARGET binding site such as BINDING SITE I, BINDING SITE II or BINDING SITE III. Table 2 illustrates the complementarity of the nucleotide sequences of CSF1R BINDING SITE, designated SEQ ID:11710, to the nucleotide sequence of VGAM297 RNA, herein designated VGAM RNA, also designated SEQ ID:3008.

Another function of VGAM297 is therefore inhibition of Colony Stimulating Factor 1 Receptor, Formerly McDonough Feline Sarcoma Viral (v-fms) Oncogene Homolog (CSF1R, Accession NM_005211), a gene which is involved in regulation of growth and differentiation of myeloid cells. Accordingly, utilities of VGAM297 include diagnosis, prevention and treatment of diseases and clinical conditions associated with CSF1R. The function of CSF1R has been established by previous studies. The FMS oncogene was assigned to chromosome 5 by study of mouse-man somatic cell hybrids. The location was narrowed to 5q34 by the study of hamster-human cell hybrids with well-defined deletions of 5q (Groffen et al., 1984). The order on the long arm was found to be centromere--leuS--HEXB--EMTB--CFMS--CHR. By in situ hybridization, Le Beau et al. (1986) assigned FMS to 5q33 and GMCSF (OMIM Ref. No. 138960) to 5q23-q31. Both genes were deleted in the 5q- chromosome from bone marrow cells of 2 patients with refractory anemia and del (5)(q15q33.3). From study of other cases they concluded that FMS is located in band 5q33.2 or 5q33.3 rather than 5q34-q35 as reported earlier. The FMS oncogene is the same as the receptor for colony-stimulating factor-1, otherwise known as macrophage colony-stimulating factor (OMIM Ref. No. 120420). Kondo et al. (2000) showed that a clonogenic common lymphoid progenitor, a bone marrow-resident cell that gives rise exclusively to lymphocytes (T, B, and natural killer cells), can be redirected to the myeloid lineage by stimulation through exogenously expressed interleukin-2 receptor (OMIM Ref. No. 146710) and GMCSF receptor (138981, 306250). Analysis of mutants of the beta-chain of the IL2 receptor revealed that the granulocyte and monocyte differentiation signals are triggered by different cytoplasmic domains, showing that the signaling pathways responsible for these unique developmental outcomes are separable. Finally, Kondo et al. (2000) showed that the endogenous myelomonocytic cytokine receptors for GM-CSF and macrophage colony-stimulating factor (CSF1R) are expressed at low to moderate levels on the more primitive hematopoietic stem cells, are absent on common lymphoid progenitors, and are upregulated after myeloid lineage induction by IL2 (OMIM Ref. No. 147680). Kondo et al. (2000) concluded that cytokine signaling can regulate cell fate decisions and proposed that a critical step in lymphoid commitment is down regulation of cytokine receptors that drive myeloid cell development Full details of the abovementioned studies are described in the following publications, the disclosure of which are hereby incorporated by reference:

Le Beau, M. M.; Westbrook, C. A.; Diaz, M. O.; Larson, R. A.; Rowley, J. D.; Gasson, J. C.; Golde, D. W.; Sherr, C. J.: Evidence for the involvement of GM-CSF and FMS in the deletion (5q) in myeloid disorders. Science 231:984-987, 1986; and Kondo, M.; Scherer, D. C.; Miyamoto, T.; King, A. G.; Akashi, K.; Sugamura, K.; Weissman, I. L.: Cell-fate conversion of lymphoid-committed progenitors by instructive actions of cytoki.

Further studies establishing the function and utilities of CSF1R are found in John Hopkins OMIM database record ID 164770, and in sited publications numbered 5100-510 and 3818-3826 listed in the bibliography section hereinbelow, which are also hereby incorporated by reference. RAB27A, Member RAS Oncogene Family (RAB27A, Accession NM_004580) is another VGAM297 host target gene. RAB27A BINDING SITE is HOST TARGET binding site found in the 3' untranslated region of mRNA encoded by RAB27A, corresponding to a HOST TARGET binding site such as BINDING SITE I, BINDING SITE II or BINDING SITE III. Table 2 illustrates the complementarity of the nucleotide sequences of RAB27A BINDING SITE, designated SEQ ID:10929, to the nucleotide sequence of VGAM297 RNA, herein designated VGAM RNA, also designated SEQ ID:3008.

Another function of VGAM297 is therefore inhibition of RAB27A, Member RAS Oncogene Family (RAB27A, Accession NM_004580). Accordingly, utilities of VGAM297 include diagnosis, prevention and treatment of diseases and clinical conditions associated with RAB27A. Transmembrane, Prostate Androgen Induced RNA (TMEPAI, Accession NM_020182) is another VGAM297 host target gene. TMEPAI BINDING SITE is HOST TARGET binding site found in the 3" untranslated region of mRNA encoded by TMEPAI, corresponding to a HOST TARGET binding site such as BINDING SITE I, BINDING SITE II or BINDING SITE III. Table 2 illustrates the complementarity of the nucleotide sequences of TMEPAI BINDING SITE, designated SEQ ID:21406, to the nucleotide sequence of VGAM297 RNA, herein designated VGAM RNA, also designated SEQ ID:3008.

Another function of VGAM297 is therefore inhibition of Transmembrane, Prostate Androgen Induced RNA (TMEPAI, Accession NM_020182). Accordingly, utilities of VGAM297 include diagnosis, prevention and treatment of diseases and clinical conditions associated with TMEPAI. KIAA0367 (Accession XM_041018) is another VGAM297 host target gene. KIAA0367 BINDING SITE is HOST TARGET binding site found in the 3' untranslated region of mRNA encoded by KIAA0367, corresponding to a HOST TARGET binding site such as BINDING SITE I, BINDING SITE II or BINDING SITE III. Table 2 illustrates the complementarity of the nucleotide sequences of KIAA0367 BINDING SITE, designated SEQ ID:33424, to the nucleotide sequence of VGAM297 RNA, herein designated VGAM RNA, also designated SEQ ID:3008.

Another function of VGAM297 is therefore inhibition of KIAA0367 (Accession XM_041018). Accordingly, utilities of VGAM297 include diagnosis, prevention and treatment of diseases and clinical conditions associated with KIAA0367. KIAA0543 (Accession XM_044213) is another VGAM297 host target gene. KIAA0543 BINDING SITE is HOST TARGET binding site found in the 3' untranslated region of mRNA encoded by KIAA0543, corresponding to a HOST TARGET binding site such as BINDING SITE I, BINDING SITE II or BINDING SITE III. Table 2 illustrates the complementarity of the nucleotide sequences of KIAA0543 BINDING SITE, designated SEQ ID:34177, to the nucleotide sequence of VGAM297 RNA, herein designated VGAM RNA, also designated SEQ ID:3008.

Another function of VGAM297 is therefore inhibition of KIAA0543 (Accession XM_044213). Accordingly, utilities of VGAM297 include diagnosis, prevention and treatment of diseases and clinical conditions associated with KIAA0543. KIAA0794 (Accession XM_087353) is another VGAM297 host target gene. KIAA0794 BINDING SITE is HOST TARGET binding site found in the 3' untranslated region of mRNA encoded by KIAA0794, corresponding to a HOST TARGET binding site such as BINDING SITE I, BINDING SITE II or BINDING SITE III. Table 2 illustrates the complementarity of the nucleotide sequences of KIAA0794 BINDING SITE, designated SEQ ID:39179, to the nucleotide sequence of VGAM297 RNA, herein designated VGAM RNA, also designated SEQ ID:3008.

Another function of VGAM297 is therefore inhibition of KIAA0794 (Accession XM_087353). Accordingly, utilities of VGAM297 include diagnosis, prevention and treatment of diseases and clinical conditions associated with KIAA0794. KIAA1486 (Accession XM_041126) is another VGAM297 host target gene. KIAA1486 BINDING SITE is HOST TARGET binding site found in the 3' untranslated region of mRNA encoded by KIAA1486, corresponding to a HOST TARGET binding site such as BINDING SITE I, BINDING SITE II or BINDING SITE III. Table 2 illustrates the complementarity of the nucleotide sequences of KIAA1486 BINDING SITE, designated SEQ ID:33462, to the nucleotide sequence of VGAM297 RNA, herein designated VGAM RNA, also designated SEQ ID:3008.

Another function of VGAM297 is therefore inhibition of KIAA1486 (Accession XM_041126). Accordingly, utilities of VGAM297 include diagnosis, prevention and treatment of diseases and clinical conditions associated with KIAA1486. Small EDRK-rich Factor 2 (SERF2, Accession NM_005770) is another VGAM297 host target gene. SERF2 BINDING SITE is HOST TARGET binding site found in the 5' untranslated region of mRNA encoded by SERF2, corresponding to a HOST TARGET binding site such as BINDING SITE I, BINDING SITE II or BINDING SITE III. Table 2 illustrates the complementarity of the nucleotide sequences of SERF2 BINDING SITE, designated SEQ ID:12342, to the nucleotide sequence of VGAM297 RNA, herein designated VGAM RNA, also designated SEQ ID:3008.

Another function of VGAM297 is therefore inhibition of Small EDRK-rich Factor 2 (SERF2, Accession NM_005770). Accordingly, utilities of VGAM297 include diagnosis, prevention and treatment of diseases and clinical conditions associated with SERF2. LOC158987 (Accession XM_099015) is another VGAM297 host target gene. LOC158987 BINDING SITE is HOST TARGET binding site found in the 3' untranslated region of mRNA encoded by LOC158987, corresponding to a HOST TARGET binding site such as BINDING SITE I, BINDING SITE II or BINDING SITE III. Table 2 illustrates the complementarity of the nucleotide sequences of LOC158987 BINDING SITE, designated SEQ ID:42047, to the nucleotide sequence of VGAM297 RNA, herein designated VGAM RNA, also designated SEQ ID:3008.

Another function of VGAM297 is therefore inhibition of LOC158987 (Accession XM_099015). Accordingly, utilities of VGAM297 include diagnosis, prevention and treatment of diseases and clinical conditions associated with LOC158987. LOC165352 (Accession XM_103974) is another VGAM297 host target gene. LOC165352 BINDING SITE is HOST TARGET binding site found in the 5' untranslated region of mRNA encoded by LOC165352, corresponding to a HOST TARGET binding site such as BINDING SITE I, BINDING SITE II or BINDING SITE III. Table 2 illustrates the complementarity of the nucleotide sequences of LOC165352 BINDING SITE, designated SEQ ID:42157, to the nucleotide sequence of VGAM297 RNA, herein designated VGAM RNA, also designated SEQ ID:3008.

Another function of VGAM297 is therefore inhibition of LOC165352 (Accession XM_103974). Accordingly, utilities of VGAM297 include diagnosis, prevention and treatment of diseases and clinical conditions associated with LOC165352. LOC219649 (Accession XM_167562) is another VGAM297 host target gene. LOC219649 BINDING SITE is HOST TARGET binding site found in the 3' untranslated region of mRNA encoded by LOC219649, corresponding to a HOST TARGET binding site such as BINDING SITE I, BINDING SITE II or BINDING SITE III. Table 2 illustrates the complementarity of the nucleotide sequences of LOC219649 BINDING SITE, designated SEQ ID:44666, to the nucleotide sequence of VGAM297 RNA, herein designated VGAM RNA, also designated SEQ ID:3008.

Another function of VGAM297 is therefore inhibition of LOC219649 (Accession XM_167562). Accordingly, utilities of VGAM297 include diagnosis, prevention and treatment of diseases and clinical conditions associated with LOC219649.

LOC221692 (Accession XM_166420) is another VGAM297 host target gene. LOC221692 BINDING SITE is HOST TARGET binding site found in the 3' untranslated region of mRNA encoded by LOC221692, corresponding to a HOST TARGET binding site such as BINDING SITE I, BINDING SITE II or BINDING SITE III. Table 2 illustrates the complementarity of the nucleotide sequences of LOC221692 BINDING SITE, designated SEQ ID:44299, to the nucleotide sequence of VGAM297 RNA, herein designated VGAM RNA, also designated SEQ ID:3008.

Another function of VGAM297 is therefore inhibition of LOC221692 (Accession XM_166420). Accordingly, utilities of VGAM297 include diagnosis, prevention and treatment of diseases and clinical conditions associated with LOC221692.

LOC90826 (Accession XM_034321) is another VGAM297 host target gene. LOC90826 BINDING SITE is HOST TARGET binding site found in the 3' untranslated region of mRNA encoded by LOC90826, corresponding to a HOST TARGET binding site such as BINDING SITE I, BINDING SITE II or BINDING SITE III. Table 2 illustrates the complementarity of the nucleotide sequences of LOC90826 BINDING SITE, designated SEQ ID:32048, to the nucleotide sequence of VGAM297 RNA, herein designated VGAM RNA, also designated SEQ ID:3008.

Another function of VGAM297 is therefore inhibition of LOC90826 (Accession XM_034321). Accordingly, utilities of VGAM297 include diagnosis, prevention and treatment of diseases and clinical conditions associated with LOC90826.

FIG. 1 further provides a conceptual description of a novel bioinformatically detected viral gene of the present invention, referred to here as Viral Genomic Address Messenger 298 (VGAM298) viral gene, which modulates expression of respective host target genes thereof, the function and utility of which host target genes is known in the art.

VGAM298 is a novel bioinformatically detected regulatory, non protein coding, viral micro RNA (miRNA) gene. The method by which VGAM298 was detected is described hereinabove with reference to FIGS. 1-8.

VGAM298 gene, herein designated VGAM GENE, is a viral gene contained in the genome of Epiphyas Postvittana Nucleopolyhedrovirus. VGAM298 host target gene, herein designated VGAM HOST TARGET GENE, is a human gene contained in the human genome.

VGAM298 gene encodes a VGAM298 precursor RNA, herein designated VGAM PRECURSOR RNA. Similar to other miRNA genes, and unlike most ordinary genes, VGAM298 precursor RNA does not encode a protein. A nucleotide sequence identical or highly similar to the nucleotide sequence of VGAM298 precursor RNA is designated SEQ ID:284, and is provided hereinbelow with reference to the sequence listing part. Nucleotide sequence SEQ ID:284 is located at position 29595 relative to the genome of Epiphyas Postvittana Nucleopolyhedrovirus.

VGAM298 precursor RNA folds onto itself, forming VGAM298 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM298 folded precursor RNA into VGAM298 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM298 RNA is designated SEQ ID:3009, and is provided hereinbelow with reference to the sequence listing part.

VGAM298 host target gene, herein designated VGAM HOST TARGET GENE, encodes a corresponding messenger RNA, VGAM298 host target RNA, herein designated VGAM HOST TARGET RNA. VGAM298 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM298 RNA, herein designated VGAM RNA, binds complementarily to one or more host target binding sites located in untranslated regions of VGAM298 host target RNA, herein designated VGAM HOST TARGET RNA. This complementary binding is due to the fact that the nucleotide sequence of VGAM298 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM298 RNA, herein designated VGAM RNA, may have a different number of host target binding sites in untranslated regions of a VGAM298 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM298 RNA, herein designated VGAM RNA, to host target binding sites on VGAM298 host target RNA, herein designated VGAM HOST TARGET RNA, such as BINDING SITE I, BINDING SITE II and BINDING SITE III, inhibits translation of VGAM298 host target RNA into VGAM298 host target protein, herein designated VGAM HOST TARGET PROTEIN. VGAM host target protein is therefore outlined by a broken line.

It is appreciated that VGAM298 host target gene, herein designated VGAM HOST TARGET GENE, in fact represents a plurality of VGAM298 host target genes. The mRNA of each one of this plurality of VGAM298 host target genes comprises one or more host target binding sites, each having a nucleotide sequence which is at least partly complementary to VGAM298 RNA, herein designated VGAM RNA, and which when bound by VGAM298 RNA causes inhibition of translation of respective one or more VGAM298 host target proteins.

It is further appreciated by one skilled in the art that the mode of translational inhibition illustrated by FIG. 1 with specific reference to translational inhibition exerted by VGAM298 gene, herein designated VGAM GENE, on one or more VGAM298 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM298 is inhibition of expression of host target genes, as part of a novel viral mechanism of attacking a host. Accordingly, utilities of VGAM298 include diagnosis, prevention and treatment of viral infection by Epiphyas Postvittana Nucleopolyhedrovirus. Specific functions, and accordingly utilities, of VGAM298 correlate with, and may be deduced from, the identity of the host target genes which VGAM298 binds and inhibits, and the function of these host target genes, as elaborated hereinbelow.

Nucleotide sequences of the VGAM298 precursor RNA, herein designated VGAM PRECURSOR RNA, and of the 'diced' VGAM298 RNA, herein designated VGAM RNA, and a schematic representation of the secondary folding of VGAM298 folded precursor RNA, herein designated VGAM FOLDED PRECURSOR RNA, of VGAM298 are further described hereinbelow with reference to Table 1.

Nucleotide sequences of host target binding sites, such as BINDING SITE-I, BINDING SITE-II and BINDING SITE-III of FIG. 1, found on VGAM298 host target RNA, and schematic representation of the complementarity of each of these host target binding sites to VGAM298 RNA, herein designated VGAM RNA, are described hereinbelow with reference to Table 2.

As mentioned hereinabove with reference to FIG. 1, a function of VGAM298 gene, herein designated VGAM is inhibition of expression of VGAM298 target genes. It is appreciated that specific functions, and accordingly utilities, of VGAM298 correlate with, and may be deduced from, the identity of the target genes which VGAM298 binds and inhibits, and the function of these target genes, as elaborated hereinbelow.

CD3Z Antigen, Zeta Polypeptide (TiT3 complex) (CD3Z, Accession NM_000734) is a VGAM298 host target gene. CD3Z BINDING SITE is HOST TARGET binding site found in the 3' untranslated region of mRNA encoded by CD3Z, corresponding to a HOST TARGET binding site such as BINDING SITE I, BINDING SITE II or BINDING SITE III. Table 2 illustrates the complementarity of the nucleotide sequences of CD3Z BINDING SITE, designated SEQ ID:6390, to the nucleotide sequence of VGAM298 RNA, herein designated VGAM RNA, also designated SEQ ID:3009.

A function of VGAM298 is therefore inhibition of CD3Z Antigen, Zeta Polypeptide (TiT3 complex) (CD3Z, Accession NM_000734), a gene which may involve in assembly and expression of the tcr complex as well as signal transduction upon antigen triggering. Accordingly, utilities of VGAM298 include diagnosis, prevention and treatment of diseases and clinical conditions associated with CD3Z. The function of CD3Z and its association with various diseases and clinical conditions, has been established by previous studies, as described hereinabove with reference to VGAM167. Cytoplasmic Linker Associated Protein 1 (CLASP1, Accession XM_037105) is another VGAM298 host target gene. CLASP1 BINDING SITE is HOST TARGET binding site found in the 5' untranslated region of mRNA encoded by CLASP1, corresponding to a HOST TARGET binding site such as BINDING SITE I, BINDING SITE II or BINDING SITE III. Table 2 illustrates the complementarity of the nucleotide sequences of CLASP1 BINDING SITE, designated SEQ ID:32544, to the nucleotide sequence of VGAM298 RNA, herein designated VGAM RNA, also designated SEQ ID:3009.

Another function of VGAM298 is therefore inhibition of Cytoplasmic Linker Associated Protein 1 (CLASP1, Accession XM_037105), a gene which plays a role in the local regulation of microtubule dynamics. Accordingly, utilities of VGAM298 include diagnosis, prevention and treatment of diseases and clinical conditions associated with CLASP1. The function of CLASP1 has been established by previous studies. CLIP170 (OMIM Ref. No. 179838) and CLIP115 (OMIM Ref. No. 603432) are cytoplasmic linker proteins that associate specifically with the ends of growing microtubules and may act as anticatastrophe factors. Using a yeast 2-hybrid screen with an N-terminal region of CLIP115 as bait, followed by cDNA library screening, RACE analysis, and EST database searching, Akhmanova et al. (2001) identified mouse and human cDNAs encoding 2 CLIP-associated proteins, CLASP1 and CLASP2 (OMIM Ref. No. 605853). The CLASPs are homologous to a Drosophila microtubule-associated protein termed Orbit or Mast. CLASP1 is identical to the protein encoded by a partial cDNA, KIAA0622, identified by Ishikawa et al. (1998), although the KIAA0622 protein lacks the N-terminal 249 amino acids of the 1,538-amino acid CLASP1 protein reported by Akhmanova et al. (2001). CLASP2 shares approximately 75% identity with the KIAA0627 protein, which is encoded by a partial cDNA also identified by Ishikawa et al. (1998). There are several CLASP isoforms due to alternative splicing. Northern blot analysis of mouse tissues detected highest expression of Clasp1 in brain, heart, and testis, while Clasp2 mRNAs were enriched in the brain. The Clasp2-beta transcript appeared to be brain specific. By RT-PCR analysis, Ishikawa et al. (1998) detected ubiquitous expression of CLASP1, which they called KIAA0622. Akhmanova et al. (2001) showed that CLASPs bind CLIPs and microtubules, colocalize with the CLIPs at microtubule distal ends, and have microtubule-stabilizing effects in transfected cells. After serum induction, CLASPs relocalize to distal segments of microtubules at the leading edge of motile fibroblasts. Akhmanova et al. (2001) provided evidence that this asymmetric CLASP distribution is mediated by phosphatidylinositol 3-kinase (see OMIM Ref. No. 171834) and glycogen synthase kinase 3-beta (OMIM Ref. No. 605004). Antibody injections suggested that CLASP2 is required for the orientation of stabilized microtubules toward the leading edge. The authors proposed that CLASPs are involved in the local regulation of microtubule dynamics in response to positional cues.

Full details of the abovementioned studies are described in the following publications, the disclosure of which are hereby incorporated by reference:

Akhmanova, A.; Hoogenraad, C. C.; Drabek, K.; Stepanova, T.; Dortland, B.; Verkerk, T.; Vermeulen, W.; Burgering, B. M.; De Zeeuw, C. I.; Grosveld, F.; Galjart, N.: CLASPs are CLIP-115 and -170 associating proteins involved in the regional regulation of microtubule dynamics in motile fibroblasts. Cell 104:923-935, 2001; and Ishikawa, K.; Nagase, T.; Suyama, M.; Miyajima, N.; Tanaka, A.; Kotani, H.; Nomura, N.; Ohara, O.: Prediction of the coding sequences of unidentified human genes. X. The complete sequ.

Further studies establishing the function and utilities of CLASP1 are found in John Hopkins OMIM database record ID 605852, and in sited publications numbered 662 and 9440 listed in the bibliography section hereinbelow, which are also hereby incorporated by reference. Diacylglycerol O-acyltransferase Homolog 2 (mouse) (DGAT2, Accession NM_032564) is another VGAM298 host target gene. DGAT2 BINDING SITE is HOST TARGET binding site found in the 5' untranslated region of mRNA encoded by DGAT2, corresponding to a HOST TARGET binding site such as BINDING SITE I, BINDING SITE II or BINDING SITE III. Table 2 illustrates the complementarity of the nucleotide sequences of DGAT2 BINDING SITE, designated SEQ ID:26291, to the nucleotide sequence of VGAM298 RNA, herein designated VGAM RNA, also designated SEQ ID:3009.

Another function of VGAM298 is therefore inhibition of Diacylglycerol O-acyltransferase Homolog 2 (mouse) (DGAT2, Accession NM_032564). Accordingly, utilities of VGAM298 include diagnosis, prevention and treatment of diseases and clinical conditions associated with DGAT2. Dmx-like 1 (DMXL1, Accession NM_005509) is another VGAM298 host target gene. DMXL1 BINDING SITE is HOST TARGET binding site found in the 3' untranslated region of mRNA encoded by DMXL1, corresponding to a HOST TARGET binding site such as BINDING SITE I, BINDING SITE II or BINDING SITE III. Table 2 illustrates the complementarity of the nucleotide sequences of DMXL1 BINDING SITE, designated SEQ ID:12025, to the nucleotide sequence of VGAM298 RNA, herein designated VGAM RNA, also designated SEQ ID:3009.

Another function of VGAM298 is therefore inhibition of Dmx-like 1 (DMXL1, Accession NM_005509). Accordingly, utilities of VGAM298 include diagnosis, prevention and treatment of diseases and clinical conditions associated with DMXL1. Sorting Nexin 9 (SNX9, Accession NM_016224) is another VGAM298 host target gene. SNX9 BINDING SITE is HOST TARGET binding site found in the 3' untranslated region of mRNA encoded by SNX9, corresponding to a HOST TARGET binding site such as BINDING SITE I, BINDING SITE II or BINDING SITE III. Table 2 illustrates the complementarity of the nucleotide sequences of SNX9 BINDING SITE, designated SEQ ID:18327, to the nucleotide sequence of VGAM298 RNA, herein designated VGAM RNA, also designated SEQ ID:3009.

Another function of VGAM298 is therefore inhibition of Sorting Nexin 9 (SNX9, Accession NM_016224). Accordingly, utilities of VGAM298 include diagnosis, prevention and treatment of diseases and clinical conditions associated with SNX9. Unc-5 Homolog B (C. elegans) (UNC5C, Accession NM_003728) is another VGAM298 host target gene. UNC5C BINDING SITE is HOST TARGET binding site found in the 3' untranslated region of mRNA encoded by UNC5C, corresponding to a HOST TARGET binding site such as BINDING SITE I, BINDING SITE II or BINDING SITE III. Table 2 illustrates the complementarity of the nucleotide sequences of UNC5C BINDING SITE, designated SEQ ID:9818, to the nucleotide sequence of VGAM298 RNA, herein designated VGAM RNA, also designated SEQ ID:3009.

Another function of VGAM298 is therefore inhibition of Unc-5 Homolog B (C. elegans) (UNC5C, Accession NM_003728), a gene which is a putative receptor for netrin, which is involved in axon guidance. Accordingly, utilities of VGAM298 include diagnosis, prevention and treatment of diseases and clinical conditions associated with UNC5C. The function of UNC5C has been established by previous studies. Migration of neurons from proliferative zones to their functional sites is fundamental to the normal development of the central nervous system. Mice homozygous for the rostral cerebellar malformation (rcm) mutation exhibit cerebellar and midbrain defects, apparently as a result of abnormal neuronal migration. Ackerman et al. (1997) reported that in rcm-mutant mice, the cerebellum is smaller and has fewer folia than in wildtype, ectopic cerebellar cells are present in midbrain regions by 3 days after birth, and there are abnormalities in postnatal cerebellar-neuronal migration. The authors isolated cDNAs encoding the rcm protein (Rcm). Sequence analysis revealed that the predicted 931-amino acid mouse protein is a transmembrane protein that contains 2 immunoglobulin (Ig)-like domains and 2 type I thrombospondin (THBS1; 188060) motifs in the extracellular region. Ig and THBS1 domains are also found in the extracellular region of the C. elegans UNC5 transmembrane protein, and the C-terminal 865-amino acid region of Rcm is 30% identical to UNC5. Ackerman et al. (1997) stated that the UNC5 protein is essential for dorsal guidance of pioneer axons and for the movement of cells away from the netrin ligand. In the developing brain of vertebrates, netrin-1 (OMIM Ref. No. 601614) plays a role in both cell migration and axonal guidance. Leonardo et al. (1997) demonstrated that Rcm binds netrin-1 in vitro. Ackerman et al. (1997) concluded that Rcm and its ligand are important in critical migratory and/or cell-proliferation events during cerebellar development. Przyborski et al. (1998) found that disruption of the mouse rcm gene, also called the Unc5h3 gene, resulted in a failure of tangentially migrating granule cells to recognize the rostral boundary of the cerebellum. By searching an EST database for sequences related to the Unc5h3 gene, Ackerman and Knowles (1998) identified a partial human fetal brain cDNA encoding UNC5C, the human Unc5h3 homolog. Using 5-prime RACE, they cloned a cDNA corresponding to the entire UNC5C coding region. The predicted 931-amino acid human protein has the overall domain structure of UNC5 family proteins, and is 97% identical to Unc5h3. Northern blot analysis revealed that the 9.5-kb UNC5 mRNA is expressed in brain and heart, and at low levels in kidney.

Full details of the abovementioned studies are described in the following publications, the disclosure of which are hereby incorporated by reference:

Przyborski, S. A.; Knowles, B. B.; Ackerman, S. L.: Embryonic phenotype of Unc5h3 mutant mice suggests chemorepulsion during the formation of the rostral cerebellar boundary. Development 125:41-50, 1998; and Ackerman, S. L.; Knowles, B. B.: Cloning and mapping of the UNC5C gene to human chromosome 4q21-q23. Genomics 52:205-208, 1998.

Further studies establishing the function and utilities of UNC5C are found in John Hopkins OMIM database record ID 603610, and in sited publications numbered 2885-2889 listed in the bibliography section hereinbelow, which are also hereby incorporated by reference. UV Radiation Resistance Associated Gene (UVRAG, Accession NM_003369) is another VGAM298 host target gene. UVRAG BINDING SITE is HOST TARGET binding site found in the 3' untranslated region of mRNA encoded by UVRAG, corresponding to a HOST TARGET binding site such as BINDING SITE I, BINDING SITE II or BINDING SITE III. Table 2 illustrates the complementarity of the nucleotide sequences of UVRAG BINDING SITE, designated SEQ ID:9396, to the nucleotide sequence of VGAM298 RNA, herein designated VGAM RNA, also designated SEQ ID:3009.

Another function of VGAM298 is therefore inhibition of UV Radiation Resistance Associated Gene (UVRAG, Accession NM_003369). Accordingly, utilities of VGAM298 include diagnosis, prevention and treatment of diseases and clinical conditions associated with UVRAG. FLJ10097 (Accession XM_043653) is another VGAM298 host target gene. FLJ10097 BINDING SITE is HOST TARGET binding site found in the 3' untranslated region of mRNA encoded by FLJ10097, corresponding to a HOST TARGET binding site such as BINDING SITE I, BINDING SITE II or BINDING SITE III. Table 2 illustrates the complementarity of the nucleotide sequences of FLJ10097 BINDING SITE, designated SEQ ID:33990, to the nucleotide sequence of VGAM298 RNA, herein designated VGAM RNA, also designated SEQ ID:3009.

Another function of VGAM298 is therefore inhibition of FLJ10097 (Accession XM_043653). Accordingly, utilities of VGAM298 include diagnosis, prevention and treatment of diseases and clinical conditions associated with FLJ10097. FLJ23416 (Accession NM_032238) is another VGAM298 host target gene. FLJ23416 BINDING SITE is HOST TARGET binding site found in the 3' untranslated region of mRNA encoded by FLJ23416, corresponding to a HOST TARGET binding site such as BINDING SITE I, BINDING SITE II or BINDING SITE III. Table 2 illustrates the complementarity of the nucleotide sequences of FLJ23416 BINDING SITE, designated SEQ ID:25959, to the nucleotide sequence of VGAM298 RNA, herein designated VGAM RNA, also designated SEQ ID:3009.

Another function of VGAM298 is therefore inhibition of FLJ23416 (Accession NM_032238). Accordingly, utilities of VGAM298 include diagnosis, prevention and treatment of diseases and clinical conditions associated with FLJ23416. KIAA1317 (Accession XM_098368) is another VGAM298 host target gene. KIAA1317 BINDING SITE is HOST TARGET binding site found in the 5' untranslated region of mRNA encoded by KIAA1317, corresponding to a HOST TARGET binding site such as BINDING SITE I, BINDING SITE II or BINDING SITE III. Table 2 illustrates the complementarity of the nucleotide sequences of KIAA1317 BINDING SITE, designated SEQ ID:41620, to the nucleotide sequence of VGAM298 RNA, herein designated VGAM RNA, also designated SEQ ID:3009.

Another function of VGAM298 is therefore inhibition of KIAA1317 (Accession XM_098368). Accordingly, utilities of VGAM298 include diagnosis, prevention and treatment of diseases and clinical conditions associated with KIAA1317. NYD-SP29 (Accession XM_059085) is another VGAM298 host target gene. NYD-SP29 BINDING SITE is HOST TARGET binding site found in the 5' untranslated region of mRNA encoded by NYD-SP29, corresponding to a HOST TARGET binding site such as BINDING SITE I, BINDING SITE II or BINDING SITE III. Table 2 illustrates the complementarity of the nucleotide sequences of NYD-SP29 BINDING SITE, designated SEQ ID:36861, to the nucleotide sequence of VGAM298 RNA, herein designated VGAM RNA, also designated SEQ ID:3009.

Another function of VGAM298 is therefore inhibition of NYD-SP29 (Accession XM_059085). Accordingly, utilities of VGAM298 include diagnosis, prevention and treatment of diseases and clinical conditions associated with NYD-SP29. SSH2 (Accession XM_030846) is another VGAM298 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31175, to the nucleotide sequence of VGAM298 RNA, herein designated VGAM RNA, also designated SEQ ID:3009.

Another function of VGAM298 is therefore inhibition of SSH2 (Accession XM_030846). Accordingly, utilities of VGAM298 include diagnosis, prevention and treatment of diseases and clinical conditions associated with SSH2. FIG. 1 further provides a conceptual description of a novel bioinformatically detected viral gene of the present invention, referred to here as Viral Genomic Address Messenger 299 (VGAM299) viral gene, which modulates expression of respective host target genes thereof, the function and utility of which host target genes is known in the art.

VGAM299 is a novel bioinformatically detected regulatory, non protein coding, viral micro RNA (miRNA) gene. The method by which VGAM299 was detected is described hereinabove with reference to FIGS. 1-8.

VGAM299 gene, herein designated VGAM GENE, is a viral gene contained in the genome of Epiphyas Postvittana Nucleopolyhedrovirus. VGAM299 host target gene, herein designated VGAM HOST TARGET GENE, is a human gene contained in the human genome.

VGAM299 gene encodes a VGAM299 precursor RNA, herein designated VGAM PRECURSOR RNA. Similar to other miRNA genes, and unlike most ordinary genes, VGAM299 precursor RNA does not encode a protein. A nucleotide sequence identical or highly similar to the nucleotide sequence of VGAM299 precursor RNA is designated SEQ ID:285, and is provided hereinbelow with reference to the sequence listing part. Nucleotide sequence SEQ ID:285 is located at position 59096 relative to the genome of Epiphyas Postvittana Nucleopolyhedrovirus.

VGAM299 precursor RNA folds onto itself, forming VGAM299 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM299 folded precursor RNA into VGAM299 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM299 RNA is designated SEQ ID:3010, and is provided hereinbelow with reference to the sequence listing part.

VGAM299 host target gene, herein designated VGAM HOST TARGET GENE, encodes a corresponding messenger RNA, VGAM299 host target RNA, herein designated VGAM HOST TARGET RNA. VGAM299 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM299 RNA, herein designated VGAM RNA, binds complementarily to one or more host target binding sites located in untranslated regions of VGAM299 host target RNA, herein designated VGAM HOST TARGET RNA. This complementary binding is due to the fact that the nucleotide sequence of VGAM299 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM299 RNA, herein designated VGAM RNA, may have a different number of host target binding sites in untranslated regions of a VGAM299 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM299 RNA, herein designated VGAM RNA, to host target binding sites on VGAM299 host target RNA, herein designated VGAM HOST TARGET RNA, such as BINDING SITE I, BINDING SITE II and BINDING SITE III, inhibits translation of VGAM299 host target RNA into VGAM299 host target protein, herein designated VGAM HOST TARGET PROTEIN. VGAM host target protein is therefore outlined by a broken line.

It is appreciated that VGAM299 host target gene, herein designated VGAM HOST TARGET GENE, in fact represents a plurality of VGAM299 host target genes. The mRNA of each one of this plurality of VGAM299 host target genes comprises one or more host target binding sites, each having a nucleotide sequence which is at least partly complementary to VGAM299 RNA, herein designated VGAM RNA, and which when bound by VGAM299 RNA causes inhibition of translation of respective one or more VGAM299 host target proteins.

It is further appreciated by one skilled in the art that the mode of translational inhibition illustrated by FIG. 1 with specific reference to translational inhibition exerted by VGAM299 gene, herein designated VGAM GENE, on one or more VGAM299 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM299 is inhibition of expression of host target genes, as part of a novel viral mechanism of attacking a host. Accordingly, utilities of VGAM299 include diagnosis, prevention and treatment of viral infection by Epiphyas Postvittana Nucleopolyhedrovirus. Specific functions, and accordingly utilities, of VGAM299 correlate with, and may be deduced from, the identity of the host target genes which VGAM299 binds and inhibits, and the function of these host target genes, as elaborated hereinbelow.

Nucleotide sequences of the VGAM299 precursor RNA, herein designated VGAM PRECURSOR RNA, and of the 'diced' VGAM299 RNA, herein designated VGAM RNA, and a schematic representation of the secondary folding of VGAM299 folded precursor RNA, herein designated VGAM FOLDED PRECURSOR RNA, of VGAM299 are further described hereinbelow with reference to Table 1.

Nucleotide sequences of host target binding sites, such as BINDING SITE-I, BINDING SITE-II and BINDING SITE-III of FIG. 1, found on VGAM299 host target RNA, and schematic representation of the complementarity of each of these host target binding sites to VGAM299 RNA, herein designated VGAM RNA, are described hereinbelow with reference to Table 2.

As mentioned hereinabove with reference to FIG. 1, a function of VGAM299 gene, herein designated VGAM is inhibition of expression of VGAM299 target genes. It is appreciated that specific functions, and accordingly utilities, of VGAM299 correlate with, and may be deduced from, the identity of the target genes which VGAM299 binds and inhibits, and the function of these target genes, as elaborated hereinbelow.

Apolipoprotein L, 1 (APOL1, Accession NM_003661) is a VGAM299 host target gene. APOL1 BINDING SITE is HOST TARGET binding site found in the 3' untranslated region of mRNA encoded by APOL1, corresponding to a HOST TARGET binding site such as BINDING SITE I, BINDING SITE II or BINDING SITE III. Table 2 illustrates the complementarity of the nucleotide sequences of APOL1 BINDING SITE, designated SEQ ID:9735, to the nucleotide sequence of VGAM299 RNA, herein designated VGAM RNA, also designated SEQ ID:3010.

A function of VGAM299 is therefore inhibition of Apolipoprotein L, 1 (APOL1, Accession NM_003661), a gene which may participate in reverse cholesterol transport from peripheral cells to the liver. Accordingly, utilities of VGAM299 include diagnosis, prevention and treatment of diseases and clinical conditions associated with APOL1. The function of APOL1 and its association with various diseases and clinical conditions, has been established by previous studies, as described hereinabove with reference to VGAM235. ATP Synthase, H+ Transporting, Mitochondrial F1 Complex, Beta Polypeptide (ATP5B, Accession XM_006710) is another VGAM299 host target gene. ATP5B BINDING SITE is HOST TARGET binding site found in the 5' untranslated region of mRNA encoded by ATP5B, corresponding to a HOST TARGET binding site such as BINDING SITE I, BINDING SITE II or BINDING SITE III. Table 2 illustrates the complementarity of the nucleotide sequences of ATP5B BINDING SITE, designated SEQ ID:30007, to the nucleotide sequence of VGAM299 RNA, herein designated VGAM RNA, also designated SEQ ID:3010.

Another function of VGAM299 is therefore inhibition of ATP Synthase, H+ Transporting, Mitochondrial F1 Complex, Beta Polypeptide (ATP5B, Accession XM_006710). Accordingly, utilities of VGAM299 include diagnosis, prevention and treatment of diseases and clinical conditions associated with ATP5B. CAAX Box 1 (CXX1, Accession NM_003928) is another VGAM299 host target gene. CXX1 BINDING SITE is HOST TARGET binding site found in the 5' untranslated region of mRNA encoded by CXX1, corresponding to a HOST TARGET binding site such as BINDING SITE I, BINDING SITE II or BINDING SITE III. Table 2 illustrates the complementarity of the nucleotide sequences of CXX1 BINDING SITE, designated SEQ ID:10026, to the nucleotide sequence of VGAM299 RNA, herein designated VGAM RNA, also designated SEQ ID:3010.

Another function of VGAM299 is therefore inhibition of CAAX Box 1 (CXX1, Accession NM_003928). Accordingly, utilities of VGAM299 include diagnosis, prevention and treatment of diseases and clinical conditions associated with CXX1. 5-hydroxytryptamine (serotonin) Receptor 4 (HTR4, Accession NM_000870) is another VGAM299 host target gene. HTR4 BINDING SITE is HOST TARGET binding site found in the 3' untranslated region of mRNA encoded by HTR4, corresponding to a HOST TARGET binding site such as BINDING SITE I, BINDING SITE II or BINDING SITE III. Table 2 illustrates the complementarity of the nucleotide sequences of HTR4 BINDING SITE, designated SEQ ID:6543, to the nucleotide sequence of VGAM299 RNA, herein designated VGAM RNA, also designated SEQ ID:3010.

Another function of VGAM299 is therefore inhibition of 5-hydroxytryptamine (serotonin) Receptor 4 (HTR4, Accession NM_000870), a gene which mediates calcium channel currents. Accordingly, utilities of VGAM299 include diagnosis, prevention and treatment of diseases and clinical conditions associated with HTR4. The function of HTR4 and its association with various diseases and clinical conditions, has been established by previous studies, as described hereinabove with reference to VGAM65. Protein Phosphatase 1, Regulatory (inhibitor) Subunit 8 (PPP1R8, Accession NM_138558) is another VGAM299 host target gene. PPP1R8 BINDING SITE is HOST TARGET binding site found in the 5' untranslated region of mRNA encoded by PPP1R8, corresponding to a HOST TARGET binding site such as BINDING SITE I, BINDING SITE II or BINDING SITE III. Table 2 illustrates the complementarity of the nucleotide sequences of PPP1R8 BINDING SITE, designated SEQ ID:28859, to the nucleotide sequence of VGAM299 RNA, herein designated VGAM RNA, also designated SEQ ID:3010.

Another function of VGAM299 is therefore inhibition of Protein Phosphatase 1, Regulatory (inhibitor) Subunit 8 (PPP1R8, Accession NM_138558), a gene which is an inhibitor subunit of the major nuclear protein phosphatase-1 (pp-1). Accordingly, utilities of VGAM299 include diagnosis, prevention and treatment of diseases and clinical conditions associated with PPP1R8. The function of PPP1R8 and its association with various diseases and clinical conditions, has been established by previous studies, as described hereinabove with reference to VGAM101. Transcription Factor 19 (SC1) (TCF19, Accession XM_175167) is another VGAM299 host target gene. TCF19 BINDING SITE1 and TCF19 BINDING SITE2 are HOST TARGET binding sites found in untranslated regions of mRNA encoded by TCF19, corresponding to HOST TARGET binding sites such as BINDING SITE I, BINDING SITE II or BINDING SITE III. Table 2 illustrates the complementarity of the nucleotide sequences of TCF19 BINDING SITE1 and TCF19 BINDING SITE2, designated SEQ ID:46657 and SEQ ID:46706 respectively, to the nucleotide sequence of VGAM299 RNA, herein designated VGAM RNA, also designated SEQ ID:3010.

Another function of VGAM299 is therefore inhibition of Transcription Factor 19 (SC1) (TCF19, Accession XM_175167), a gene which plays an important role in the transcription of genes required for the later stages of cell cycle progression. Accordingly, utilities of VGAM299 include diagnosis, prevention and treatment of diseases and clinical conditions associated with TCF19. The function of TCF19 has been established by previous studies. Ku et al. (1991) cloned a growth-regulated cDNA by differential screening of a mouse 3T3 cell line library to identify transcripts induced by serum stimulation. Transcripts of the gene, designated SC1, were detectable beginning at about 8 hours after stimulation. The mouse cDNA was used to clone the human SC1 cDNA. The 2.6-kb cDNA encoded a deduced 359-amino acid polypeptide with features characteristic of transactivating factors. The gene was mapped by in situ hybridization to chromosome 6p21-p22. The bacterially expressed protein had the predicted size of 39 kD. Krishnan et al. (1995) mapped TCF19 with POU5F1 (OMIM Ref. No. 164177) to a 0.2-Mb region between HLAC (OMIM Ref. No. 142840) and the so-called S gene (OMIM Ref. No. 602593) at 6p21.3. POU5F1 and TCF19 are about 130 kb telomeric of HLAC and about 600 bp from each other.

Full details of the abovementioned studies are described in the following publications, the disclosure of which are hereby incorporated by reference:

Krishnan, B. R.; Jamry, I.; Chaplin, D. D.: Feature mapping of the HLA class I region: localization of the POU5F1 and TCF19 genes. Genomics 30:53-58, 1995; and Ku, D.-H.; Chang, C.; Koniecki, J.; Cannizzaro, L. A.; Boghosian-Sell, L.; Alder, H.; Baserga, R.: A new growth-regulated complementary DNA with the sequence of a putative trans-activ.

Further studies establishing the function and utilities of TCF19 are found in John Hopkins OMIM database record ID 600912, and in sited publications numbered 9610-9611 listed in the bibliography section hereinbelow, which are also hereby incorporated by reference. Tumor Necrosis Factor (ligand) Superfamily, Member 5 (hyper-IgM syndrome) (TNFSF5, Accession NM_000074) is another VGAM299 host target gene. TNFSF5 BINDING SITE is HOST TARGET binding site found in the 3' untranslated region of mRNA encoded by TNFSF5, corresponding to a HOST TARGET binding site such as BINDING SITE I, BINDING SITE II or BINDING SITE III. Table 2 illustrates the complementarity of the nucleotide sequences of TNFSF5 BINDING SITE, designated SEQ ID:5520, to the nucleotide sequence of VGAM299 RNA, herein designated VGAM RNA, also designated SEQ ID:3010.

Another function of VGAM299 is therefore inhibition of Tumor Necrosis Factor (ligand) Superfamily, Member 5 (hyper-IgM syndrome) (TNFSF5, Accession NM_000074). Accordingly, utilities of VGAM299 include diagnosis, prevention and treatment of diseases and clinical conditions associated with TNFSF5. Williams-Beuren Syndrome Chromosome Region 1 (WBSCR1, Accession NM_022170) is another VGAM299 host target gene. WBSCR1 BINDING SITE1 and WBSCR1 BINDING SITE2 are HOST TARGET binding sites found in untranslated regions of mRNA encoded by WBSCR1, corresponding to HOST TARGET binding sites such as BINDING SITE I, BINDING SITE II or BINDING SITE III. Table 2 illustrates the complementarity of the nucleotide sequences of WBSCR1 BINDING SITE1 and WBSCR1 BINDING SITE2, designated SEQ ID:22726 and SEQ ID:25709 respectively, to the nucleotide sequence of VGAM299 RNA, herein designated VGAM RNA, also designated SEQ ID:3010.

Another function of VGAM299 is therefore inhibition of Williams-Beuren Syndrome Chromosome Region 1 (WBSCR1, Accession NM_022170), a gene which stimulates protein translation. Accordingly, utilities of VGAM299 include diagnosis, prevention and treatment of diseases and clinical conditions associated with WBSCR1. The function of WBSCR1 and its association with various diseases and clinical conditions, has been established by previous studies, as described hereinabove with reference to VGAM110. Chromosome 7 Open Reading Frame 13 (C7orf13, Accession NM_032625) is another VGAM299 host target gene. C7orf13 BINDING SITE is HOST TARGET binding site found in the 3' untranslated region of mRNA encoded by C7orf13, corresponding to a HOST TARGET binding site such as BINDING SITE I, BINDING SITE II or BINDING SITE III. Table 2 illustrates the complementarity of the nucleotide sequences of C7orf13 BINDING SITE, designated SEQ ID:26341, to the nucleotide sequence of VGAM299 RNA, herein designated VGAM RNA, also designated SEQ ID:3010.

Another function of VGAM299 is therefore inhibition of Chromosome 7 Open Reading Frame 13 (C7orf13, Accession NM_032625). Accordingly, utilities of VGAM299 include diagnosis, prevention and treatment of diseases and clinical conditions associated with C7orf13. Calcium/calmodulin-dependent Protein Kinase Kinase 2, Beta (CAMKK2, Accession NM_006549) is another VGAM299 host target gene. CAMKK2 BINDING SITE is HOST TARGET binding site found in the 3' untranslated region of mRNA encoded by CAMKK2, corresponding to a HOST TARGET binding site such as BINDING SITE I, BINDING SITE II or BINDING SITE III. Table 2 illustrates the complementarity of the nucleotide sequences of CAMKK2 BINDING SITE, designated SEQ ID:13313, to the nucleotide sequence of VGAM299 RNA, herein designated VGAM RNA, also designated SEQ ID:3010.

Another function of VGAM299 is therefore inhibition of Calcium/calmodulin-dependent Protein Kinase Kinase 2, Beta (CAMKK2, Accession NM_006549). Accordingly, utilities of VGAM299 include diagnosis, prevention and treatment of diseases and clinical conditions associated with CAMKK2. DKFZP434K1772 (Accession XM_041936) is another VGAM299 host target gene. DKFZP434K1772 BINDING SITE is HOST TARGET binding site found in the 5' untranslated region of mRNA encoded by DKFZP434K1772, corresponding to a HOST TARGET binding site such as BINDING SITE I, BINDING SITE II or BINDING SITE III. Table 2 illustrates the complementarity of the nucleotide sequences of DKFZP434K1772 BINDING SITE, designated SEQ ID:33635, to the nucleotide sequence of VGAM299 RNA, herein designated VGAM RNA, also designated SEQ ID:3010.

Another function of VGAM299 is therefore inhibition of DKFZP434K1772 (Accession XM_041936). Accordingly, utilities of VGAM299 include diagnosis, prevention and treatment of diseases and clinical conditions associated with DKFZP434K1772. FLJ11850 (Accession NM_022741) is another VGAM299 host target gene. FLJ11850 BINDING SITE is HOST TARGET binding site found in the 3' untranslated region of mRNA encoded by FLJ11850, corresponding to a HOST TARGET binding site such as BINDING SITE I, BINDING SITE II or BINDING SITE III. Table 2 illustrates the complementarity of the nucleotide sequences of FLJ11850 BINDING SITE, designated SEQ ID:22952, to the nucleotide sequence of VGAM299 RNA, herein designated VGAM RNA, also designated SEQ ID:3010.

Another function of VGAM299 is therefore inhibition of FLJ11850 (Accession NM_022741). Accordingly, utilities of VGAM299 include diagnosis, prevention and treatment of diseases and clinical conditions associated with FLJ11850. FLJ12934 (Accession NM_022899) is another VGAM299 host target gene. FLJ12934 BINDING SITE is HOST TARGET binding site found in the 3' untranslated region of mRNA encoded by FLJ12934, corresponding to a HOST TARGET binding site such as BINDING SITE I, BINDING SITE II or BINDING SITE III. Table 2 illustrates the complementarity of the nucleotide sequences of FLJ12934 BINDING SITE, designated SEQ ID:23179, to the nucleotide sequence of VGAM299 RNA, herein designated VGAM RNA, also designated SEQ ID:3010.

Another function of VGAM299 is therefore inhibition of FLJ12934 (Accession NM_022899). Accordingly, utilities of VGAM299 include diagnosis, prevention and treatment of diseases and clinical conditions associated with FLJ12934. FLJ22795 (Accession NM_025084) is another VGAM299 host target gene. FLJ22795 BINDING SITE is HOST TARGET binding site found in the 3' untranslated region of mRNA encoded by FLJ22795, corresponding to a HOST TARGET binding site such as BINDING SITE I, BINDING SITE II or BINDING SITE III. Table 2 illustrates the complementarity of the nucleotide sequences of FLJ22795 BINDING SITE, designated SEQ ID:24691, to the nucleotide sequence of VGAM299 RNA, herein designated VGAM RNA, also designated SEQ ID:3010.

Another function of VGAM299 is therefore inhibition of FLJ22795 (Accession NM_025084). Accordingly, utilities of VGAM299 include diagnosis, prevention and treatment of diseases and clinical conditions associated with FLJ22795. Interleukin 14 (IL14, Accession XM_170924) is another VGAM299 host target gene. IL14 BINDING SITE is HOST TARGET binding site found in the 5' untranslated region of mRNA encoded by IL14, corresponding to a HOST TARGET binding site such as BINDING SITE I, BINDING SITE II or BINDING SITE III. Table 2 illustrates the complementarity of the nucleotide sequences of IL14 BINDING SITE, designated SEQ ID:45705, to the nucleotide sequence of VGAM299 RNA, herein designated VGAM RNA, also designated SEQ ID:3010.

Another function of VGAM299 is therefore inhibition of Interleukin 14 (IL14, Accession XM_170924). Accordingly, utilities of VGAM299 include diagnosis, prevention and treatment of diseases and clinical conditions associated with IL14. KIAA0161 (Accession NM_014746) is another VGAM299 host target gene. KIAA0161 BINDING SITE is HOST TARGET binding site found in the 3' untranslated region of mRNA encoded by KIAA0161, corresponding to a HOST TARGET binding site such as BINDING SITE I, BINDING SITE II or BINDING SITE III. Table 2 illustrates the complementarity of the nucleotide sequences of KIAA0161 BINDING SITE, designated SEQ ID:16434, to the nucleotide sequence of VGAM299 RNA, herein designated VGAM RNA, also designated SEQ ID:3010.

Another function of VGAM299 is therefore inhibition of KIAA0161 (Accession NM_014746). Accordingly, utilities of VGAM299 include diagnosis, prevention and treatment of diseases and clinical conditions associated with KIAA0161. KIAA0240 (Accession XM_166479) is another VGAM299 host target gene. KIAA0240 BINDING SITE is HOST TARGET binding site found in the 3' untranslated region of mRNA encoded by KIAA0240, corresponding to a HOST TARGET binding site such as BINDING SITE I, BINDING SITE II or BINDING SITE III. Table 2 illustrates the complementarity of the nucleotide sequences of KIAA0240 BINDING SITE, designated SEQ ID:44408, to the nucleotide sequence of VGAM299 RNA, herein designated VGAM RNA, also designated SEQ ID:3010.

Another function of VGAM299 is therefore inhibition of KIAA0240 (Accession XM_166479). Accordingly, utilities of VGAM299 include diagnosis, prevention and treatment of diseases and clinical conditions associated with KIAA0240. KIAA1340 (Accession XM_044836) is another VGAM299 host target gene. KIAA1340 BINDING SITE is HOST TARGET binding site found in the 3' untranslated region of mRNA encoded by KIAA1340, corresponding to a HOST TARGET binding site such as BINDING SITE I, BINDING SITE II or BINDING SITE III. Table 2 illustrates the complementarity of the nucleotide sequences of KIAA1340 BINDING SITE, designated SEQ ID:34300, to the nucleotide sequence of VGAM299 RNA, herein designated VGAM RNA, also designated SEQ ID:3010.

Another function of VGAM299 is therefore inhibition of KIAA1340 (Accession XM_044836). Accordingly, utilities of VGAM299 include diagnosis, prevention and treatment of diseases and clinical conditions associated with KIAA1340. KIAA1872 (Accession XM_031917) is another VGAM299 host target gene. KIAA1872 BINDING SITE is HOST TARGET binding site found in the 3' untranslated region of mRNA encoded by KIAA1872, corresponding to a HOST TARGET binding site such as BINDING SITE I, BINDING SITE II or BINDING SITE III. Table 2 illustrates the complementarity of the nucleotide sequences of KIAA1872 BINDING SITE, designated SEQ ID:31521, to the nucleotide sequence of VGAM299 RNA, herein designated VGAM RNA, also designated SEQ ID:3010.

Another function of VGAM299 is therefore inhibition of KIAA1872 (Accession XM_031917). Accordingly, utilities of VGAM299 include diagnosis, prevention and treatment of diseases and clinical conditions associated with KIAA1872. MGC4170 (Accession NM_024312) is another VGAM299 host target gene. MGC4170 BINDING SITE is HOST TARGET binding site found in the 5' untranslated region of mRNA encoded by MGC4170, corresponding to a HOST TARGET binding site such as BINDING SITE I, BINDING SITE II or BINDING SITE III. Table 2 illustrates the complementarity of the nucleotide sequences of MGC4170 BINDING SITE, designated SEQ ID:23606, to the nucleotide sequence of VGAM299 RNA, herein designated VGAM RNA, also designated SEQ ID:3010.

Another function of VGAM299 is therefore inhibition of MGC4170 (Accession NM_024312). Accordingly, utilities of VGAM299 include diagnosis, prevention and treatment of diseases and clinical conditions associated with MGC4170. Ring Finger Protein 40 (RNF40, Accession NM_014771) is another VGAM299 host target gene. RNF40 BINDING SITE is HOST TARGET binding site found in the 3' untranslated region of mRNA encoded by RNF40, corresponding to a HOST TARGET binding site such as BINDING SITE I, BINDING SITE II or BINDING SITE III. Table 2 illustrates the complementarity of the nucleotide sequences of RNF40 BINDING SITE, designated SEQ ID:16569, to the nucleotide sequence of VGAM299 RNA, herein designated VGAM RNA, also designated SEQ ID:3010.

Another function of VGAM299 is therefore inhibition of Ring Finger Protein 40 (RNF40, Accession NM_014771). Accordingly, utilities of VGAM299 include diagnosis, prevention and treatment of diseases and clinical conditions associated with RNF40. Serine Palmitoyltransferase, Long Chain Base Subunit 2 (SPTLC2, Accession NM_004863) is another VGAM299 host target gene. SPTLC2 BINDING SITE is HOST TARGET binding site found in the 3' untranslated region of mRNA encoded by SPTLC2, corresponding to a HOST TARGET binding site such as BINDING SITE I, BINDING SITE II or BINDING SITE III. Table 2 illustrates the complementarity of the nucleotide sequences of SPTLC2 BINDING SITE, designated SEQ ID:11287, to the nucleotide sequence of VGAM299 RNA, herein designated VGAM RNA, also designated SEQ ID:3010.

Another function of VGAM299 is therefore inhibition of Serine Palmitoyltransferase, Long Chain Base Subunit 2 (SPTLC2, Accession NM_004863). Accordingly, utilities of VGAM299 include diagnosis, prevention and treatment of diseases and clinical conditions associated with SPTLC2. Tumor Protein P53 Inducible Nuclear Protein 1 (TP53INP1, Accession XM_053740) is another VGAM299 host target gene. TP53INP1 BINDING SITE1 and TP53INP1 BINDING SITE2 are HOST TARGET binding sites found in untranslated regions of mRNA encoded by TP53INP1, corresponding to HOST TARGET binding sites such as BINDING SITE I, BINDING SITE II or BINDING SITE III. Table 2 illustrates the complementarity of the nucleotide sequences of TP53INP1 BINDING SITE1 and TP53INP1 BINDING SITE2, designated SEQ ID:36121 and SEQ ID:27112 respectively, to the nucleotide sequence of VGAM299 RNA, herein designated VGAM RNA, also designated SEQ ID:3010.

Another function of VGAM299 is therefore inhibition of Tumor Protein P53 Inducible Nuclear Protein 1 (TP53INP1, Accession XM_053740). Accordingly, utilities of VGAM299 include diagnosis, prevention and treatment of diseases and clinical conditions associated with TP53INP1. LOC145717 (Accession XM_039771) is another VGAM299 host target gene. LOC145717 BINDING SITE is HOST TARGET binding site found in the 3' untranslated region of mRNA encoded by LOC145717, corresponding to a HOST TARGET binding site such as BINDING SITE I, BINDING SITE II or BINDING SITE III. Table 2 illustrates the complementarity of the nucleotide sequences of LOC145717 BINDING SITE, designated SEQ ID:33193, to the nucleotide sequence of VGAM299 RNA, herein designated VGAM RNA, also designated SEQ ID:3010.

Another function of VGAM299 is therefore inhibition of LOC145717 (Accession XM_039771). Accordingly, utilities of VGAM299 include diagnosis, prevention and treatment of diseases and clinical conditions associated with LOC145717. LOC146488 (Accession XM_047748) is another VGAM299 host target gene. LOC146488 BINDING SITE is HOST TARGET binding site found in the 3' untranslated region of mRNA encoded by LOC146488, corresponding to a HOST TARGET binding site such as BINDING SITE I, BINDING SITE II or BINDING SITE III. Table 2 illustrates the complementarity of the nucleotide sequences of LOC146488 BINDING SITE, designated SEQ ID:35041, to the nucleotide sequence of VGAM299 RNA, herein designated VGAM RNA, also designated SEQ ID:3010.

Another function of VGAM299 is therefore inhibition of LOC146488 (Accession XM_047748). Accordingly, utilities of VGAM299 include diagnosis, prevention and treatment of diseases and clinical conditions associated with LOC146488. LOC148089 (Accession XM_086040) is another VGAM299 host target gene. LOC148089 BINDING SITE is HOST TARGET binding site found in the 3' untranslated region of mRNA encoded by LOC148089, corresponding to a HOST TARGET binding site such as BINDING SITE I, BINDING SITE II or BINDING SITE III. Table 2 illustrates the complementarity of the nucleotide sequences of LOC148089 BINDING SITE, designated SEQ ID:38453, to the nucleotide sequence of VGAM299 RNA, herein designated VGAM RNA, also designated SEQ ID:3010.

Another function of VGAM299 is therefore inhibition of LOC148089 (Accession XM_086040). Accordingly, utilities of VGAM299 include diagnosis, prevention and treatment of diseases and clinical conditions associated with LOC148089. LOC200772 (Accession XM_117275) is another VGAM299 host target gene. LOC200772 BINDING SITE is HOST TARGET binding site found in the 3' untranslated region of mRNA encoded by LOC200772, corresponding to a HOST TARGET binding site such as BINDING SITE I, BINDING SITE II or BINDING SITE III. Table 2 illustrates the complementarity of the nucleotide sequences of LOC200772 BINDING SITE, designated SEQ ID:43347, to the nucleotide sequence of VGAM299 RNA, herein designated VGAM RNA, also designated SEQ ID:3010.

Another function of VGAM299 is therefore inhibition of LOC200772 (Accession XM_117275). Accordingly, utilities of VGAM299 include diagnosis, prevention and treatment of diseases and clinical conditions associated with LOC200772. LOC220537 (Accession XM_165406) is another VGAM299 host target gene. LOC220537 BINDING SITE is HOST TARGET binding site found in the 3' untranslated region of mRNA encoded by LOC220537, corresponding to a HOST TARGET binding site such as BINDING SITE I, BINDING SITE II or BINDING SITE III. Table 2 illustrates the complementarity of the nucleotide sequences of LOC220537 BINDING SITE, designated SEQ ID:43624, to the nucleotide sequence of VGAM299 RNA, herein designated VGAM RNA, also designated SEQ ID:3010.

Another function of VGAM299 is therefore inhibition of LOC220537 (Accession XM_165406). Accordingly, utilities of VGAM299 include diagnosis, prevention and treatment of diseases and clinical conditions associated with LOC220537. LOC221882 (Accession XM_166507) is another VGAM299 host target gene. LOC221882 BINDING SITE is HOST TARGET binding site found in the 5' untranslated region of mRNA encoded by LOC221882, corresponding to a HOST TARGET binding site such as BINDING SITE I, BINDING SITE II or BINDING SITE III. Table 2 illustrates the complementarity of the nucleotide sequences of LOC221882 BINDING SITE, designated SEQ ID:44435, to the nucleotide sequence of VGAM299 RNA, herein designated VGAM RNA, also designated SEQ ID:3010.

Another function of VGAM299 is therefore inhibition of LOC221882 (Accession XM_166507). Accordingly, utilities of VGAM299 include diagnosis, prevention and treatment of diseases and clinical conditions associated with LOC221882. LOC253675 (Accession XM_172990) is another VGAM299 host target gene. LOC253675 BINDING SITE is HOST TARGET binding site found in the 3' untranslated region of mRNA encoded by LOC253675, corresponding to a HOST TARGET binding site such as BINDING SITE I, BINDING SITE II or BINDING SITE III. Table 2 illustrates the complementarity of the nucleotide sequences of LOC253675 BINDING SITE, designated SEQ ID:46266, to the nucleotide sequence of VGAM299 RNA, herein designated VGAM RNA, also designated SEQ ID:3010.

Another function of VGAM299 is therefore inhibition of LOC253675 (Accession XM_172990). Accordingly, utilities of VGAM299 include diagnosis, prevention and treatment of diseases and clinical conditions associated with LOC253675. LOC54466 (Accession NM_019003) is another VGAM299 host target gene. LOC54466 BINDING SITE is HOST TARGET binding site found in the 3' untranslated region of mRNA encoded by LOC54466, corresponding to a HOST TARGET binding site such as BINDING SITE I, BINDING SITE II or BINDING SITE III. Table 2 illustrates the complementarity of the nucleotide sequences of LOC54466 BINDING SITE, designated SEQ ID:21076, to the nucleotide sequence of VGAM299 RNA, herein designated VGAM RNA, also designated SEQ ID:3010.

Another function of VGAM299 is therefore inhibition of LOC54466 (Accession NM_019003). Accordingly, utilities of VGAM299 include diagnosis, prevention and treatment of diseases and clinical conditions associated with LOC54466. FIG. 1 further provides a conceptual description of a novel bioinformatically detected viral gene of the present invention, referred to here as Viral Genomic Address Messenger 300 (VGAM300) viral gene, which modulates expression of respective host target genes thereof, the function and utility of which host target genes is known in the art.

VGAM300 is a novel bioinformatically detected regulatory, non protein coding, viral micro RNA (miRNA) gene. The method by which VGAM300 was detected is described hereinabove with reference to FIGS. 1-8.

VGAM300 gene, herein designated VGAM GENE, is a viral gene contained in the genome of Epiphyas Postvittana Nucleopolyhedrovirus. VGAM300 host target gene, herein designated VGAM HOST TARGET GENE, is a human gene contained in the human genome.

VGAM300 gene encodes a VGAM300 precursor RNA, herein designated VGAM PRECURSOR RNA. Similar to other miRNA genes, and unlike most ordinary genes, VGAM300 precursor RNA does not encode a protein. A nucleotide sequence identical or highly similar to the nucleotide sequence of VGAM300 precursor RNA is designated SEQ ID:286, and is provided hereinbelow with reference to the sequence listing part. Nucleotide sequence SEQ ID:286 is located at position 99030 relative to the genome of Epiphyas Postvittana Nucleopolyhedrovirus.

VGAM300 precursor RNA folds onto itself, forming VGAM300 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM300 folded precursor RNA into VGAM300 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 41%) nucleotide sequence of VGAM300 RNA is designated SEQ ID:3011, and is provided hereinbelow with reference to the sequence listing part.

VGAM300 host target gene, herein designated VGAM HOST TARGET GENE, encodes a corresponding messenger RNA, VGAM300 host target RNA, herein designated VGAM HOST TARGET RNA. VGAM300 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM300 RNA, herein designated VGAM RNA, binds complementarily to one or more host target binding sites located in untranslated regions of VGAM300 host target RNA, herein designated VGAM HOST TARGET RNA. This complementary binding is due to the fact that the nucleotide sequence of VGAM300 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM300 RNA, herein designated VGAM RNA, may have a different number of host target binding sites in untranslated regions of a VGAM300 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM300 RNA, herein designated VGAM RNA, to host target binding sites on VGAM300 host target RNA, herein designated VGAM HOST TARGET RNA, such as BINDING SITE I, BINDING SITE II and BINDING SITE III, inhibits translation of VGAM300 host target RNA into VGAM300 host target protein, herein designated VGAM HOST TARGET PROTEIN. VGAM host target protein is therefore outlined by a broken line.

It is appreciated that VGAM300 host target gene, herein designated VGAM HOST TARGET GENE, in fact represents a plurality of VGAM300 host target genes. The mRNA of each one of this plurality of VGAM300 host target genes comprises one or more host target binding sites, each having a nucleotide sequence which is at least partly complementary to VGAM300 RNA, herein designated VGAM RNA, and which when bound by VGAM300 RNA causes inhibition of translation of respective one or more VGAM300 host target proteins.

It is further appreciated by one skilled in the art that the mode of translational inhibition illustrated by FIG. 1 with specific reference to translational inhibition exerted by VGAM300 gene, herein designated VGAM GENE, on one or more VGAM300 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM300 is inhibition of expression of host target genes, as part of a novel viral mechanism of attacking a host. Accordingly, utilities of VGAM300 include diagnosis, prevention and treatment of viral infection by Epiphyas Postvittana Nucleopolyhedrovirus. Specific functions, and accordingly utilities, of VGAM300 correlate with, and may be deduced from, the identity of the host target genes which VGAM300 binds and inhibits, and the function of these host target genes, as elaborated hereinbelow.

Nucleotide sequences of the VGAM300 precursor RNA, herein designated VGAM PRECURSOR RNA, and of the 'diced' VGAM300 RNA, herein designated VGAM RNA, and a schematic representation of the secondary folding of VGAM300 folded precursor RNA, herein designated VGAM FOLDED PRECURSOR RNA, of VGAM300 are further described hereinbelow with reference to Table 1.

Nucleotide sequences of host target binding sites, such as BINDING SITE-I, BINDING SITE-II and BINDING SITE-III of FIG. 1, found on VGAM300 host target RNA, and schematic representation of the complementarity of each of these host target binding sites to VGAM300 RNA, herein designated VGAM RNA, are described hereinbelow with reference to Table 2.

As mentioned hereinabove with reference to FIG. 1, a function of VGAM300 gene, herein designated VGAM is inhibition of expression of VGAM300 target genes. It is appreciated that specific functions, and accordingly utilities, of VGAM300 correlate with, and may be deduced from, the identity of the target genes which VGAM300 binds and inhibits, and the function of these target genes, as elaborated hereinbelow.

Excision Repair Cross-complementing Rodent Repair Deficiency, Complementation Group 5 (xeroderma pigmentosum, complementation group G (Cockayne syndrome)) (ERCC5, Accession NM_000123) is a VGAM300 host target gene. ERCC5 BINDING SITE is HOST TARGET binding site found in the 5' untranslated region of mRNA encoded by ERCC5, corresponding to a HOST TARGET binding site such as BINDING SITE I, BINDING SITE II or BINDING SITE III. Table 2 illustrates the complementarity of the nucleotide sequences of ERCC5 BINDING SITE, designated SEQ ID:5596, to the nucleotide sequence of VGAM300 RNA, herein designated VGAM RNA, also designated SEQ ID:3011.

A function of VGAM300 is therefore inhibition of Excision Repair Cross-complementing Rodent Repair Deficiency, Complementation Group 5 (xeroderma pigmentosum, complementation group G (Cockayne syndrome)) (ERCC5, Accession NM_000123), a gene which single-stranded dna endonuclease involved in dna excision repair. Accordingly, utilities of VGAM300 include diagnosis, prevention and treatment of diseases and clinical conditions associated with ERCC5. The function of ERCC5 has been established by previous studies. Hori et al. (1983) found that human chromosome 13 is involved in excision repair of UV-induced DNA damage. This was shown by studying somatic cell hybrids between a UV-sensitive mutant mouse cell line and normal human lymphocytes. The mouse line used had a defect that fell into complementation group I (of OMIM Ref. No. 278700). Siciliano (1987) found that UV-135 is the same as ERCM2; complementation of the two cell lines was not observed. Furthermore, ERCM2 is the same as ERCC5. Previously, 2 patients with a rare combined xeroderma pigmentosum/Cockayne syndrome phenotype were identified: one within XP complementation group B (OMIM Ref. No. 133540) and one within complementation group D (OMIM Ref. No. 126340). Vermeulen et al. (1993) reported genetic studies of 2 unrelated, severely affected patients with clinical characteristics of Cockayne syndrome but with a biochemical defect typical of xeroderma pigmentosum. By complementation analysis, using somatic cell fusion and nuclear microinjection of cloned repair genes, they assigned these 2 patients to XP complementation group G. Volker et al. (2001) described the assembly of the NER complex in normal and repair-deficient (xeroderma pigmentosum) human cells by employing a novel technique of local ultraviolet irradiation combined with fluorescent antibody labeling. The damage-recognition complex XPC (OMIM Ref. No. 278720)-HR23B (OMIM Ref. No. 600062) appeared to be essential for the recruitment of all subsequent NER factors in the preincision complex, including transcription repair factor TFIIH. The authors found that XPA associates relatively late, is required for anchoring of ERCC1-XPF, and may be essential for activation of the endonuclease activity of XPG. These findings identified XPC as the earliest known NER factor in the reaction mechanism, gave insight into the order of subsequent NER components, provided evidence for a dual role of XPA, and supported a concept of sequential assembly of repair proteins at the site of damage rather than a preassembled repairosome.

Full details of the abovementioned studies are described in the following publications, the disclosure of which are hereby incorporated by reference:

Hori, T.; Shiomi, T.; Sato, K.: Human chromosome 13 compensates a DNA repair defect in UV-sensitive mouse cells by mouse-human cell hybridization. Proc. Nat. Acad. Sci. 80:5655-5659, 1983; and Volker, M.; Mone, M. J.; Karmakar, P.; van Hoffen, A.; Schul, W.; Vermeulen, W.; Hoeijmakers, J. H. J.; van Driel, R.; van Zeeland, A. A.; Mullenders, L. H. F.: Sequential assembly of.

Further studies establishing the function and utilities of ERCC5 are found in John Hopkins OMIM database record ID 133530, and in sited publications numbered 3101, 11354-11355, 3102, 11356-11369, 11369-11373, 1875-1876, 3690, 369 and 3671-1880 listed in the bibliography section hereinbelow, which are also hereby incorporated by reference. Interleukin 8 Receptor, Alpha (IL8RA, Accession NM_000634) is another VGAM300 host target gene. IL8RA BINDING SITE is HOST TARGET binding site found in the 3' untranslated region of mRNA encoded by IL8RA, corresponding to a HOST TARGET binding site such as BINDING SITE I, BINDING SITE II or BINDING SITE III. Table 2 illustrates the complementarity of the nucleotide sequences of IL8RA BINDING SITE, designated SEQ ID:6268, to the nucleotide sequence of VGAM300 RNA, herein designated VGAM RNA, also designated SEQ ID:3011.

Another function of VGAM300 is therefore inhibition of Interleukin 8 Receptor, Alpha (IL8RA, Accession NM_000634), a gene which is the receptor to interleukin-8, which is a powerful neutrophils chemotactic factor. Accordingly, utilities of VGAM300 include diagnosis, prevention and treatment of diseases and clinical conditions associated with IL8RA. The function of IL8RA has been established by previous studies. Interleukin-8 (IL8; 146930) is a member of a family of pro-inflammatory cytokines. The best-characterized activities of IL8 include the chemoattraction and activation of neutrophils. Holmes et al. (1991) isolated a cDNA encoding an IL8 receptor from human neutrophils. The deduced amino acid sequence showed that the receptor is a member of the superfamily of receptors that couple to guanine nucleotide binding proteins (G proteins). The sequence is 29% identical to that of receptors for the other neutrophil chemoattractants, fMet-Leu-Phe and C5a. Morris et al. (1992) mapped the type 1 interleukin-8 receptor gene to 2q35; see type 2 interleukin-8 receptor (OMIM Ref. No. 146928) for further information on the two IL8R genes. Mollereau et al. (1993) assigned the high-affinity receptor gene to the same region by in situ hybridization. Lloyd et al. (1993) assigned both the IL8RA and the IL8RB gene to chromosome 2 by polymerase chain reaction amplification and by Southern analysis of a panel of human/rodent somatic cell hybrid DNAs. The IL8R genes were further localized by in situ hybridization to 2q35. Palter et al. (2001) characterized the IL8 system, which includes IL8, its receptors IL8RA and IL8RB, and its degradative enzyme aminopeptidase N (OMIM Ref. No. 151530), in the human fallopian tube by immunohistochemistry. IL8 was found in the human fallopian tube predominantly in the epithelial cells and was present in greater amounts in the distal compared with the proximal tube. IL8RA and IL8RB localized in the tube in similar patterns. Aminopeptidase N was found in tubal stromal tissue at the epithelial-stromal border and perivascularly. The authors concluded that the IL8 system may be an active component of tubal physiology and that aminopeptidase N may limit the systemic effects of epithelial IL8.

Full details of the abovementioned studies are described in the following publications, the disclosure of which are hereby incorporated by reference:

Morris, S. W.; Nelson, N.; Valentine, M. B.; Shapiro, D. N.; Look, A. T.; Kozlosky, C. J.; Beckmann, M. P.; Cerretti, D. P.: Assignment of the genes encoding human interleukin-8 receptor types 1 and 2 and an interleukin-8 receptor pseudogene to chromosome 2q35. Genomics 14:685-691, 1992; and Palter, S. F.; Mulayim, N.; Senturk, L.; Arici, A.: Interleukin-8 in the human fallopian tube. J. Clin. Endocr. Metab. 86:2660-2667, 2001.

Further studies establishing the function and utilities of IL8RA are found in John Hopkins OMIM database record ID 146929, and in sited publications numbered 391 and 295-297 listed in the bibliography section hereinbelow, which are also hereby incorporated by reference. Laminin, Alpha 4 (LAMA4, Accession NM_002290) is another VGAM300 host target gene. LAMA4 BINDING SITE is HOST TARGET binding site found in the 5' untranslated region of mRNA encoded by LAMA4, corresponding to a HOST TARGET binding site such as BINDING SITE I, BINDING SITE II or BINDING SITE III. Table 2 illustrates the complementarity of the nucleotide sequences of LAMA4 BINDING SITE, designated SEQ ID:8071, to the nucleotide sequence of VGAM300 RNA, herein designated VGAM RNA, also designated SEQ ID:3011.

Another function of VGAM300 is therefore inhibition of Laminin, Alpha 4 (LAMA4, Accession NM_002290), a gene which mediates the attachment, migration and organization of cells into tissues. Accordingly, utilities of VGAM300 include diagnosis, prevention and treatment of diseases and clinical conditions associated with LAMA4. The function of LAMA4 has been established by previous studies. Laminin, a multidomain glycoprotein, is the major noncollagenous constituent of basement membranes. It is composed of 3 non-identical chains: A (OMIM Ref. No. 150320), B1 (OMIM Ref. No. 150240), and B2 (OMIM Ref. No. 150290). The laminins form a cruciform structure consisting of 3 short arms, each of which is formed from different chains, and a long arm composed of all 3 chains. By screening a human keratinocyte cDNA library for type VII collagen sequences, Richards et al. (1994) isolated a new laminin alpha chain variant gene, LAMA4 (formerly called LAMA3). Northern blot analysis indicated that a cDNA encoding LAMA4 hybridized to a 6.45-kb mRNA, significantly smaller than the 9.5- to 10-kb mRNA of laminin A (Haaparanta et al., 1991). Using PCR on genomic DNA, flow-sorted chromosomes, and fluorescence in situ hybridization, Richards et al. (1994) localized the LAMA4 gene to human chromosome 6q21. In this abstract, the authors referred to the gene as LAMA3; in the related article, Richards et al. (1994) used the corrected symbol, LAMA4. Iivanainen et al. (1995) cloned the laminin alpha-4 cDNA by screening a fetal lung library with a PCR product generated from primers based on a partial laminin-like sequence reported by GenBank. The complete cDNA is approximately 6.2 kb long and encodes a predicted protein of 1,816 amino acids. The domain structure of the protein is similar to the alpha-3 chain (LAMA3, also called BM600), both of which resemble truncated versions of alpha-1 and alpha-2 in which approximately 1,200 residues at the amino end have been lost. Northern blots showed strong expression of the mRNA in adult heart, lung, ovary, small and large intestines, liver, and placenta.

Full details of the abovementioned studies are described in the following publications, the disclosure of which are hereby incorporated by reference:

Iivanainen, A.; Sainio, K.; Sariola, H.; Tryggvason, K.: Primary structure and expression of a novel human laminin alpha-4 chain. FEBS Lett. 365: 183-188, 1995; and Richards, A. J.; Al-Imara, L.; Carter, N. P.; Lloyd, J. C.; Leversha, M. A.; Pope, F. M.: Localization of the gene (LAMA4) to chromosome 6q21 and isolation of a partial cDNA encoding a.

Further studies establishing the function and utilities of LAMA4 are found in John Hopkins OMIM database record ID 600133, and in sited publications numbered 4368-1586 listed in the bibliography section hereinbelow, which are also hereby incorporated by reference. Prothymosin, Alpha (gene sequence 28) (PTMA, Accession NM_002823) is another VGAM300 host target gene. PTMA BINDING SITE is a HOST TARGET binding site found in the 5' untranslated region of mRNA encoded by PTMA, corresponding to a HOST TARGET binding site such as BINDING SITE I, BINDING SITE II or BINDING SITE III. Table 2 illustrates the complementarity of the nucleotide sequences of PTMA BINDING SITE, designated SEQ ID:8693, to the nucleotide sequence of VGAM300 RNA, herein designated VGAM RNA, also designated SEQ ID:3011.

Another function of VGAM300 is therefore inhibition of Prothymosin, Alpha (gene sequence 28) (PTMA, Accession NM_002823), a gene which may mediate immune function by conferring resistance to certain opportunistic infections. Accordingly, utilities of VGAM300 include diagnosis, prevention and treatment of diseases and clinical conditions associated with PTMA. The function of PTMA has been established by previous studies. The thymus gland produces several hormones or hormone-like substances which are derived from a polypeptide precursor containing (in the rat) 113 amino acids and known as prothymosin-alpha. A peptide containing 28 amino acid residues, named thymosin-alpha-1, was originally isolated from calf thymosin fraction 5 and shown to restore various aspects of immune function in several in vitro and in vivo test systems. Thymosin-alpha-1 was subsequently isolated from a similar fraction from human thymosin and reported to have the same amino acid sequence as bovine thymosin-alpha-1. Haritos et al. (1984) isolated from fresh rat thymus a larger polypeptide named prothymosin-alpha, which contains the thymosin-alpha-1 sequence at its NH2 terminus. Prothymosin-alpha has also been isolated from human thymus. Goodall et al. (1986) constructed a cDNA library from human spleen mRNA and screened for clones containing cDNAs coding for prothymosin-alpha. Eschenfeldt and Berger (1986) identified cDNA clones for human prothymosin-alpha in cDNA libraries from staphylococcal endotoxin A-stimulated normal human lymphocytes. The encoded protein was found to be highly acidic (54 residues out of 111) and shared over 90% sequence homology with rat prothymosin-alpha. The peptide hormone thymosin-alpha-1 appeared at positions 2-29 of the prothymosin-alpha amino acid sequence. Manrow et al. (1992) concluded that of the 6 members of the prothymosin-alpha gene family that have been cloned and sequenced, only one is functional. Szabo et al. (1993) isolated a genomic clone encoding PTMA and subcloned and sequenced the 5-prime regulatory region. They used the 5-prime flanking cloned probe to localize the prothymosin gene to human chromosome 2 by Southern analysis of somatic cell hybrids.

Full details of the abovementioned studies are described in the following publications, the disclosure of which are hereby incorporated by reference:

Haritos, A. A.; Goodall, G. J.; Horecker, B. L.: Prothymosin alpha: isolation and properties of the major immunoreactive form of thymosin alpha-1 in rat thymus. Proc. Nat. Acad. Sci. 81:1008-1011, 1984; and Manrow, R. E.; Leone, A.; Krug, M. S.; Eschenfeldt, W. H.; Berger, S. L.: The human prothymosin alpha gene family contains several processed pseudogenes lacking deleterious lesions. Ge.

Further studies establishing the function and utilities of PTMA are found in John Hopkins OMIM database record ID 188390, and in sited publications numbered 5697-5701 listed in the bibliography section hereinbelow, which are also hereby incorporated by reference. Protein Tyrosine Phosphatase, Receptor Type, O (PTPRO, Accession NM_030668) is another VGAM300 host target gene. PTPRO BINDING SITE1 through PTPRO BINDING SITE3 are HOST TARGET binding sites found in untranslated regions of mRNA encoded by PTPRO, corresponding to HOST TARGET binding sites such as BINDING SITE I, BINDING SITE II or BINDING SITE III. Table 2 illustrates the complementarity of the nucleotide sequences of PTPRO BINDING SITE1 through PTPRO BINDING SITE3, designated SEQ ID:25011, SEQ ID:25020 and SEQ ID:25030 respectively, to the nucleotide sequence of VGAM300 RNA, herein designated VGAM RNA, also designated SEQ ID:3011.

Another function of VGAM300 is therefore inhibition of Protein Tyrosine Phosphatase, Receptor Type, O (PTPRO, Accession NM_030668), a gene which may function as a cell contact receptor that mediates and controls cell-cell signals. Accordingly, utilities of VGAM300 include diagnosis, prevention and treatment of diseases and clinical conditions associated with PTPRO. The function of PTPRO and its association with various diseases and clinical conditions, has been established by previous studies, as described hereinabove with reference to VGAM140. C1q and Tumor Necrosis Factor Related Protein 4 (C1QTNF4, Accession NM_031909) is another VGAM300 host target gene. C1QTNF4 BINDING SITE is HOST TARGET binding site found in the 5' untranslated region of mRNA encoded by C1QTNF4, corresponding to a HOST TARGET binding site such as BINDING SITE I, BINDING SITE II or BINDING SITE III. Table 2 illustrates the complementarity of the nucleotide sequences of C1QTNF4 BINDING SITE, designated SEQ ID:25654, to the nucleotide sequence of VGAM300 RNA, herein designated VGAM RNA, also designated SEQ ID:3011.

Another function of VGAM300 is therefore inhibition of C1q and Tumor Necrosis Factor Related Protein 4 (C1QTNF4, Accession NM_031909). Accordingly, utilities of VGAM300 include diagnosis, prevention and treatment of diseases and clinical conditions associated with C1QTNF4. Cell Division Cycle Associated 4 (CDCA4, Accession NM_017955) is another VGAM300 host target gene. CDCA4 BINDING SITE is HOST TARGET binding site found in the 3' untranslated region of mRNA encoded by CDCA4, corresponding to a HOST TARGET binding site such as BINDING SITE I, BINDING SITE II or BINDING SITE III. Table 2 illustrates the complementarity of the nucleotide sequences of CDCA4 BINDING SITE, designated SEQ ID:19663, to the nucleotide sequence of VGAM300 RNA, herein designated VGAM RNA, also designated SEQ ID:3011.

Another function of VGAM300 is therefore inhibition of Cell Division Cycle Associated 4 (CDCA4, Accession NM_017955). Accordingly, utilities of VGAM300 include diagnosis, prevention and treatment of diseases and clinical conditions associated with CDCA4. KIAA0876 (Accession XM_035625) is another VGAM300 host target gene. KIAA0876 BINDING SITE is HOST TARGET binding site found in the 5' untranslated region of mRNA encoded by KIAA0876, corresponding to a HOST TARGET binding site such as BINDING SITE I, BINDING SITE II or BINDING SITE III. Table 2 illustrates the complementarity of the nucleotide sequences of KIAA0876 BINDING SITE, designated SEQ ID:32296, to the nucleotide sequence of VGAM300 RNA, herein designated VGAM RNA, also designated SEQ ID:3011.

Another function of VGAM300 is therefore inhibition of KIAA0876 (Accession XM_035625). Accordingly, utilities of VGAM300 include diagnosis, prevention and treatment of diseases and clinical conditions associated with KIAA0876.

KIAA1257 (Accession XM_031577) is another VGAM300 host target gene. KIAA1257 BINDING SITE is HOST TARGET binding site found in the 3' untranslated region of mRNA encoded by KIAA1257, corresponding to a HOST TARGET binding site such as BINDING SITE I, BINDING SITE II or BINDING SITE III. Table 2 illustrates the complementarity of the nucleotide sequences of KIAA1257 BINDING SITE, designated SEQ ID:31433, to the nucleotide sequence of VGAM300 RNA, herein designated VGAM RNA, also designated SEQ ID:3011.

Another function of VGAM300 is therefore inhibition of KIAA1257 (Accession XM_031577). Accordingly, utilities of VGAM300 include diagnosis, prevention and treatment of diseases and clinical conditions associated with KIAA1257. Kelch-like 6 (Drosophila) (KLHL6, Accession NM_130446) is another VGAM300 host target gene. KLHL6 BINDING SITE is HOST TARGET binding site found in the 3' untranslated region of mRNA encoded by KLHL6, corresponding to a HOST TARGET binding site such as BINDING SITE I, BINDING SITE II or BINDING SITE III. Table 2 illustrates the complementarity of the nucleotide sequences of KLHL6 BINDING SITE, designated SEQ ID:28210, to the nucleotide sequence of VGAM300 RNA, herein designated VGAM RNA, also designated SEQ ID:3011.

Another function of VGAM300 is therefore inhibition of Kelch-like 6 (Drosophila) (KLHL6, Accession NM_130446). Accordingly, utilities of VGAM300 include diagnosis, prevention and treatment of diseases and clinical conditions associated with KLHL6. MAD4 (Accession NM_006454) is another VGAM300 host target gene. MAD4 BINDING SITE is HOST TARGET binding site found in the 3' untranslated region of mRNA encoded by MAD4, corresponding to a HOST TARGET binding site such as BINDING SITE I, BINDING SITE II or BINDING SITE III. Table 2 illustrates the complementarity of the nucleotide sequences of MAD4 BINDING SITE, designated SEQ ID:13172, to the nucleotide sequence of VGAM300 RNA, herein designated VGAM RNA, also designated SEQ ID:3011.

Another function of VGAM300 is therefore inhibition of MAD4 (Accession NM_006454). Accordingly, utilities of VGAM300 include diagnosis, prevention and treatment of diseases and clinical conditions associated with MAD4. MGC13007 (Accession NM_032320) is another VGAM300 host target gene. MGC13007 BINDING SITE is HOST TARGET binding site found in the 5' untranslated region of mRNA encoded by MGC13007, corresponding to a HOST TARGET binding site such as BINDING SITE I, BINDING SITE II or BINDING SITE III. Table 2 illustrates the complementarity of the nucleotide sequences of MGC13007 BINDING SITE, designated SEQ ID:26121, to the nucleotide sequence of VGAM300 RNA, herein designated VGAM RNA, also designated SEQ ID:3011.

Another function of VGAM300 is therefore inhibition of MGC13007 (Accession NM_032320). Accordingly, utilities of VGAM300 include diagnosis, prevention and treatment of diseases and clinical conditions associated with MGC13007. MGC13251 (Accession NM_032714) is another VGAM300 host target gene. MGC13251 BINDING SITE is HOST TARGET binding site found in the 3' untranslated region of mRNA encoded by MGC13251, corresponding to a HOST TARGET binding site such as BINDING SITE I, BINDING SITE II or BINDING SITE III. Table 2 illustrates the complementarity of the nucleotide sequences of MGC13251 BINDING SITE, designated SEQ ID:26435, to the nucleotide sequence of VGAM300 RNA, herein designated VGAM RNA, also designated SEQ ID:3011.

Another function of VGAM300 is therefore inhibition of MGC13251 (Accession NM_032714). Accordingly, utilities of VGAM300 include diagnosis, prevention and treatment of diseases and clinical conditions associated with MGC13251. Mitochondrial Ribosomal Protein L20 (MRPL20, Accession NM_017971) is another VGAM300 host target gene. MRPL20 BINDING SITE is HOST TARGET binding site found in the 3' untranslated region of mRNA encoded by MRPL20, corresponding to a HOST TARGET binding site such as BINDING SITE I, BINDING SITE II or BINDING SITE III. Table 2 illustrates the complementarity of the nucleotide sequences of MRPL20 BINDING SITE, designated SEQ ID:19700, to the nucleotide sequence of VGAM300 RNA, herein designated VGAM RNA, also designated SEQ ID:3011.

Another function of VGAM300 is therefore inhibition of Mitochondrial Ribosomal Protein L20 (MRPL20, Accession NM_017971). Accordingly, utilities of VGAM300 include diagnosis, prevention and treatment of diseases and clinical conditions associated with MRPL20. PHACS (Accession NM_032592) is another VGAM300 host target gene. PHACS BINDING SITE is HOST TARGET binding site found in the 5' untranslated region of mRNA encoded by PHACS, corresponding to a HOST TARGET binding site such as BINDING SITE I, BINDING SITE II or BINDING SITE III. Table 2 illustrates the complementarity of the nucleotide sequences of PHACS BINDING SITE, designated SEQ ID:26324, to the nucleotide sequence of VGAM300 RNA, herein designated VGAM RNA, also designated SEQ ID:3011.

Another function of VGAM300 is therefore inhibition of PHACS (Accession NM_032592). Accordingly, utilities of VGAM300 include diagnosis, prevention and treatment of diseases and clinical conditions associated with PHACS. Protein Kinase, Lysine Deficient 2 (PRKWNK2, Accession XM_117531) is another VGAM300 host target gene. PRKWNK2 BINDING SITE is HOST TARGET binding site found in the 5' untranslated region of mRNA encoded by PRKWNK2, corresponding to a HOST TARGET binding site such as BINDING SITE I, BINDING SITE II or BINDING SITE III. Table 2 illustrates the complementarity of the nucleotide sequences of PRKWNK2 BINDING SITE, designated SEQ ID:43521, to the nucleotide sequence of VGAM300 RNA, herein designated VGAM RNA, also designated SEQ ID:3011.

Another function of VGAM300 is therefore inhibition of Protein Kinase, Lysine Deficient 2 (PRKWNK2, Accession XM_117531). Accordingly, utilities of VGAM300 include diagnosis, prevention and treatment of diseases and clinical conditions associated with PRKWNK2. SEC14-like 1 (S. cerevisiae) (SEC14L1, Accession NM_003003) is another VGAM300 host target gene. SEC14L1 BINDING SITE is HOST TARGET binding site found in the 3' untranslated region of mRNA encoded by SEC14L1, corresponding to a HOST TARGET binding site such as BINDING SITE I, BINDING SITE II or BINDING SITE III. Table 2 illustrates the complementarity of the nucleotide sequences of SEC14L1 BINDING SITE, designated SEQ ID:8906, to the nucleotide sequence of VGAM300 RNA, herein designated VGAM RNA, also designated SEQ ID:3011.

Another function of VGAM300 is therefore inhibition of SEC14-like 1 (S. cerevisiae) (SEC14L1, Accession NM_003003). Accordingly, utilities of VGAM300 include diagnosis, prevention and treatment of diseases and clinical conditions associated with SEC14L1. SEC8 (Accession NM_021807) is another VGAM300 host target gene. SEC8 BINDING SITE is HOST TARGET binding site found in the 3' untranslated region of mRNA encoded by SEC8, corresponding to a HOST TARGET binding site such as BINDING SITE I, BINDING SITE II or BINDING SITE III. Table 2 illustrates the complementarity of the nucleotide sequences of SEC8 BINDING SITE, designated SEQ ID:22361, to the nucleotide sequence of VGAM300 RNA, herein designated VGAM RNA, also designated SEQ ID:3011.

Another function of VGAM300 is therefore inhibition of SEC8 (Accession NM_021807). Accordingly, utilities of VGAM300 include diagnosis, prevention and treatment of diseases and clinical conditions associated with SEC8. Zinc Finger, DHHC Domain Containing 2 (ZDHHC2, Accession NM_016353) is another VGAM300 host target gene. ZDHHC2 BINDING SITE is HOST TARGET binding site found in the 5' untranslated region of mRNA encoded by ZDHHC2, corresponding to a HOST TARGET binding site such as BINDING SITE I, BINDING SITE II or BINDING SITE III. Table 2 illustrates the complementarity of the nucleotide sequences of ZDHHC2 BINDING SITE, designated SEQ ID:18487, to the nucleotide sequence of VGAM300 RNA, herein designated VGAM RNA, also designated SEQ ID:3011.

Another function of VGAM300 is therefore inhibition of Zinc Finger, DHHC Domain Containing 2 (ZDHHC2, Accession NM_016353). Accordingly, utilities of VGAM300 include diagnosis, prevention and treatment of diseases and clinical conditions associated with ZDHHC2. LOC145123 (Accession XM_041473) is another VGAM300 host target gene. LOC145123 BINDING SITE is HOST TARGET binding site found in the 5' untranslated region of mRNA encoded by LOC145123, corresponding to a HOST TARGET binding site such as BINDING SITE I, BINDING SITE II or BINDING SITE III. Table 2 illustrates the complementarity of the nucleotide sequences of LOC145123 BINDING SITE, designated SEQ ID:33534, to the nucleotide sequence of VGAM300 RNA, herein designated VGAM RNA, also designated SEQ ID:3011.

Another function of VGAM300 is therefore inhibition of LOC145123 (Accession XM_041473). Accordingly, utilities of VGAM300 include diagnosis, prevention and treatment of diseases and clinical conditions associated with LOC145123. LOC147229 (Accession XM_085742) is another VGAM300 host target gene. LOC147229 BINDING SITE is HOST TARGET binding site found in the 5' untranslated region of mRNA encoded by LOC147229, corresponding to a HOST TARGET binding site such as BINDING SITE I, BINDING SITE II or BINDING SITE III. Table 2 illustrates the complementarity of the nucleotide sequences of LOC147229 BINDING SITE, designated SEQ ID:38316, to the nucleotide sequence of VGAM300 RNA, herein designated VGAM RNA, also designated SEQ ID:3011.

Another function of VGAM300 is therefore inhibition of LOC147229 (Accession XM_085742). Accordingly, utilities of VGAM300 include diagnosis, prevention and treatment of diseases and clinical conditions associated with LOC147229. LOC151009 (Accession XM_097992) is another VGAM300 host target gene. LOC151009 BINDING SITE is HOST TARGET binding site found in the 5' untranslated region of mRNA encoded by LOC151009, corresponding to a HOST TARGET binding site such as BINDING SITE I, BINDING SITE II or BINDING SITE III. Table 2 illustrates the complementarity of the nucleotide sequences of LOC151009 BINDING SITE, designated SEQ ID:41291, to the nucleotide sequence of VGAM300 RNA, herein designated VGAM RNA, also designated SEQ ID:3011.

Another function of VGAM300 is therefore inhibition of LOC151009 (Accession XM_097992). Accordingly, utilities of VGAM300 include diagnosis, prevention and treatment of diseases and clinical conditions associated with LOC151009. LOC220058 (Accession XM_166258) is another VGAM300 host target gene. LOC220058 BINDING SITE is HOST TARGET binding site found in the 5' untranslated region of mRNA encoded by LOC220058, corresponding to a HOST TARGET binding site such as BINDING SITE I, BINDING SITE II or BINDING SITE III. Table 2 illustrates the complementarity of the nucleotide sequences of LOC220058 BINDING SITE, designated SEQ ID:44083, to the nucleotide sequence of VGAM300 RNA, herein designated VGAM RNA, also designated SEQ ID:3011.

Another function of VGAM300 is therefore inhibition of LOC220058 (Accession XM_166258). Accordingly, utilities of VGAM300 include diagnosis, prevention and treatment of diseases and clinical conditions associated with LOC220058. LOC254892 (Accession XM_170951) is another VGAM300 host target gene. LOC254892 BINDING SITE is HOST TARGET binding site found in the 5' untranslated region of mRNA encoded by LOC254892, corresponding to a HOST TARGET binding site such as BINDING SITE I, BINDING SITE II or BINDING SITE III. Table 2 illustrates the complementarity of the nucleotide sequences of LOC254892 BINDING SITE, designated SEQ ID:45737, to the nucleotide sequence of VGAM300 RNA, herein designated VGAM RNA, also designated SEQ ID:3011.

Another function of VGAM300 is therefore inhibition of LOC254892 (Accession XM_170951). Accordingly, utilities of VGAM300 include diagnosis, prevention and treatment of diseases and clinical conditions associated with LOC254892. FIG. 1 further provides a conceptual description of a novel bioinformatically detected viral gene of the present invention, referred to here as Viral Genomic Address Messenger 301 (VGAM301) viral gene, which modulates expression of respective host target genes thereof, the function and utility of which host target genes is known in the art.

VGAM301 is a novel bioinformatically detected regulatory, non protein coding, viral micro RNA (miRNA) gene. The method by which VGAM301 was detected is described hereinabove with reference to FIGS. 1-8.

VGAM301 gene, herein designated VGAM GENE, is a viral gene contained in the genome of Epiphyas Postvittana Nucleopolyhedrovirus. VGAM301 host target gene, herein designated VGAM HOST TARGET GENE, is a human gene contained in the human genome.

VGAM301 gene encodes a VGAM301 precursor RNA, herein designated VGAM PRECURSOR RNA. Similar to other miRNA genes, and unlike most ordinary genes, VGAM301 precursor RNA does not encode a protein. A nucleotide sequence identical or highly similar to the nucleotide sequence of VGAM301 precursor RNA is designated SEQ ID:287, and is provided hereinbelow with reference to the sequence listing part. Nucleotide sequence SEQ ID:287 is located at position 49379 relative to the genome of Epiphyas Postvittana Nucleopolyhedrovirus.

VGAM301 precursor RNA folds onto itself, forming VGAM301 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM301 folded precursor RNA into VGAM301 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM301 RNA is designated SEQ ID:3012, and is provided hereinbelow with reference to the sequence listing part.

VGAM301 host target gene, herein designated VGAM HOST TARGET GENE, encodes a corresponding messenger RNA, VGAM301 host target RNA, herein designated VGAM HOST TARGET RNA. VGAM301 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM301 RNA, herein designated VGAM RNA, binds complementarily to one or more host target binding sites located in untranslated regions of VGAM301 host target RNA, herein designated VGAM HOST TARGET RNA. This complementary binding is due to the fact that the nucleotide sequence of VGAM301 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM301 RNA, herein designated VGAM RNA, may have a different number of host target binding sites in untranslated regions of a VGAM301 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM301 RNA, herein designated VGAM RNA, to host target binding sites on VGAM301 host target RNA, herein designated VGAM HOST TARGET RNA, such as BINDING SITE I, BINDING SITE II and BINDING SITE III, inhibits translation of VGAM301 host target RNA into VGAM301 host target protein, herein designated VGAM HOST TARGET PROTEIN. VGAM host target protein is therefore outlined by a broken line.

It is appreciated that VGAM301 host target gene, herein designated VGAM HOST TARGET GENE, in fact represents a plurality of VGAM301 host target genes. The mRNA of each one of this plurality of VGAM301 host target genes comprises one or more host target binding sites, each having a nucleotide sequence which is at least partly complementary to VGAM301 RNA, herein designated VGAM RNA, and which when bound by VGAM301 RNA causes inhibition of translation of respective one or more VGAM301 host target proteins.

It is further appreciated by one skilled in the art that the mode of translational inhibition illustrated by FIG. 1 with specific reference to translational inhibition exerted by VGAM301 gene, herein designated VGAM GENE, on one or more VGAM301 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM301 is inhibition of expression of host target genes, as part of a novel viral mechanism of attacking a host. Accordingly, utilities of VGAM301 include diagnosis, prevention and treatment of viral infection by Epiphyas Postvittana Nucleopolyhedrovirus. Specific functions, and accordingly utilities, of VGAM301 correlate with, and may be deduced from, the identity of the host target genes which VGAM301 binds and inhibits, and the function of these host target genes, as elaborated hereinbelow.

Nucleotide sequences of the VGAM301 precursor RNA, herein designated VGAM PRECURSOR RNA, and of the 'diced' VGAM301 RNA, herein designated VGAM RNA, and a schematic representation of the secondary folding of VGAM301 folded precursor RNA, herein designated VGAM FOLDED PRECURSOR RNA, of VGAM301 are further described hereinbelow with reference to Table 1.

Nucleotide sequences of host target binding sites, such as BINDING SITE-I, BINDING SITE-II and BINDING SITE-III of FIG. 1, found on VGAM301 host target RNA, and schematic representation of the complementarity of each of these host target binding sites to VGAM301 RNA, herein designated VGAM RNA, are described hereinbelow with reference to Table 2.

As mentioned hereinabove with reference to FIG. 1, a function of VGAM301 gene, herein designated VGAM is inhibition of expression of VGAM301 target genes. It is appreciated that specific functions, and accordingly utilities, of VGAM301 correlate with, and may be deduced from, the identity of the target genes which VGAM301 binds and inhibits, and the function of these target genes, as elaborated hereinbelow.

FLJ14686 (Accession NM_032825) is a VGAM301 host target gene. FLJ14686 BINDING SITE is HOST TARGET binding site found in the 3' untranslated region of mRNA encoded by FLJ14686, corresponding to a HOST TARGET binding site such as BINDING SITE I, BINDING SITE II or BINDING SITE III. Table 2 illustrates the complementarity of the nucleotide sequences of FLJ14686 BINDING SITE, designated SEQ ID:26599, to the nucleotide sequence of VGAM301 RNA, herein designated VGAM RNA, also designated SEQ ID:3012.

A function of VGAM301 is therefore inhibition of FLJ14686 (Accession NM_032825). Accordingly, utilities of VGAM301 include diagnosis, prevention and treatment of diseases and clinical conditions associated with FLJ14686. HTMP10 (Accession NM_033207) is another VGAM301 host target gene. HTMP10 BINDING SITE is HOST TARGET binding site found in the 3' untranslated region of mRNA encoded by HTMP10, corresponding to a HOST TARGET binding site such as BINDING SITE I, BINDING SITE II or BINDING SITE III. Table 2 illustrates the complementarity of the nucleotide sequences of HTMP10 BINDING SITE, designated SEQ ID:27050, to the nucleotide sequence of VGAM301 RNA, herein designated VGAM RNA, also designated SEQ ID:3012.

Another function of VGAM301 is therefore inhibition of HTMP10 (Accession NM_033207). Accordingly, utilities of VGAM301 include diagnosis, prevention and treatment of diseases and clinical conditions associated with HTMP10. SEC14-like 1 (S. cerevisiae) (SEC14L1, Accession NM_003003) is another VGAM301 host target gene. SEC14L1 BINDING SITE is HOST TARGET binding site found in the 3' untranslated region of mRNA encoded by SEC14L1, corresponding to a HOST TARGET binding site such as BINDING SITE I, BINDING SITE II or BINDING SITE III. Table 2 illustrates the complementarity of the nucleotide sequences of SEC14L1 BINDING SITE, designated SEQ ID:8900, to the nucleotide sequence of VGAM301 RNA, herein designated VGAM RNA, also designated SEQ ID:3012.

Another function of VGAM301 is therefore inhibition of SEC14-like 1 (S. cerevisiae) (SEC14L1, Accession NM_003003). Accordingly, utilities of VGAM301 include diagnosis, prevention and treatment of diseases and clinical conditions associated with SEC14L1. LOC153688 (Accession XM_098416) is another VGAM301 host target gene. LOC153688 BINDING SITE is HOST TARGET binding site found in the 3' untranslated region of mRNA encoded by LOC153688, corresponding to a HOST TARGET binding site such as BINDING SITE I, BINDING SITE II or BINDING SITE III. Table 2 illustrates the complementarity of the nucleotide sequences of LOC153688 BINDING SITE, designated SEQ ID:41654, to the nucleotide sequence of VGAM301 RNA, herein designated VGAM RNA, also designated SEQ ID:3012.

Another function of VGAM301 is therefore inhibition of LOC153688 (Accession XM_098416). Accordingly, utilities of VGAM301 include diagnosis, prevention and treatment of diseases and clinical conditions associated with LOC153688.

FIG. 1 further provides a conceptual description of a novel bioinformatically detected viral gene of the present invention, referred to here as Viral Genomic Address Messenger 302 (VGAM302) viral gene, which modulates expression of respective host target genes thereof, the function and utility of which host target genes is known in the art.

VGAM302 is a novel bioinformatically detected regulatory, non protein coding, viral micro RNA (miRNA) gene. The method by which VGAM302 was detected is described hereinabove with reference to FIGS. 1-8.

VGAM302 gene, herein designated VGAM GENE, is a viral gene contained in the genome of Epiphyas Postvittana Nucleopolyhedrovirus. VGAM302 host target gene, herein designated VGAM HOST TARGET GENE, is a human gene contained in the human genome.

VGAM302 gene encodes a VGAM302 precursor RNA, herein designated VGAM PRECURSOR RNA. Similar to other miRNA genes, and unlike most ordinary genes, VGAM302 precursor RNA does not encode a protein. A nucleotide sequence identical or highly similar to the nucleotide sequence of VGAM302 precursor RNA is designated SEQ ID:288, and is provided hereinbelow with reference to the sequence listing part. Nucleotide sequence SEQ ID:288 is located at position 66246 relative to the genome of Epiphyas Postvittana Nucleopolyhedrovirus.

VGAM302 precursor RNA folds onto itself, forming VGAM302 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM302 folded precursor RNA into VGAM302 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM302 RNA is designated SEQ ID:3013, and is provided hereinbelow with reference to the sequence listing part.

VGAM302 host target gene, herein designated VGAM HOST TARGET GENE, encodes a corresponding messenger RNA, VGAM302 host target RNA, herein designated VGAM HOST TARGET RNA. VGAM302 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM302 RNA, herein designated VGAM RNA, binds complementarily to one or more host target binding sites located in untranslated regions of VGAM302 host target RNA, herein designated VGAM HOST TARGET RNA. This complementary binding is due to the fact that the nucleotide sequence of VGAM302 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM302 RNA, herein designated VGAM RNA, may have a different number of host target binding sites in untranslated regions of a VGAM302 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM302 RNA, herein designated VGAM RNA, to host target binding sites on VGAM302 host target RNA, herein designated VGAM HOST TARGET RNA, such as BINDING SITE I, BINDING SITE II and BINDING SITE III, inhibits translation of VGAM302 host target RNA into VGAM302 host target protein, herein designated VGAM HOST TARGET PROTEIN. VGAM host target protein is therefore outlined by a broken line.

It is appreciated that VGAM302 host target gene, herein designated VGAM HOST TARGET GENE, in fact represents a plurality of VGAM302 host target genes. The mRNA of each one of this plurality of VGAM302 host target genes comprises one or more host target binding sites, each having a nucleotide sequence which is at least partly complementary to VGAM302 RNA, herein designated VGAM RNA, and which when bound by VGAM302 RNA causes inhibition of translation of respective one or more VGAM302 host target proteins.

It is further appreciated by one skilled in the art that the mode of translational inhibition illustrated by FIG. 1 with specific reference to translational inhibition exerted by VGAM302 gene, herein designated VGAM GENE, on one or more VGAM302 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM302 is inhibition of expression of host target genes, as part of a novel viral mechanism of attacking a host. Accordingly, utilities of VGAM302 include diagnosis, prevention and treatment of viral infection by Epiphyas Postvittana Nucleopolyhedrovirus. Specific functions, and accordingly utilities, of VGAM302 correlate with, and may be deduced from, the identity of the host target genes which VGAM302 binds and inhibits, and the function of these host target genes, as elaborated hereinbelow.

Nucleotide sequences of the VGAM302 precursor RNA, herein designated VGAM PRECURSOR RNA, and of the 'diced' VGAM302 RNA, herein designated VGAM RNA, and a schematic representation of the secondary folding of VGAM302 folded precursor RNA, herein designated VGAM FOLDED PRECURSOR RNA, of VGAM302 are further described hereinbelow with reference to Table 1.

Nucleotide sequences of host target binding sites, such as BINDING SITE-I, BINDING SITE-II and BINDING SITE-III of FIG. 1, found on VGAM302 host target RNA, and schematic representation of the complementarity of each of these host target binding sites to VGAM302 RNA, herein designated VGAM RNA, are described hereinbelow with reference to Table 2.

As mentioned hereinabove with reference to FIG. 1, a function of VGAM302 gene, herein designated VGAM is inhibition of expression of VGAM302 target genes. It is appreciated that specific functions, and accordingly utilities, of VGAM302 correlate with, and may be deduced from, the identity of the target genes which VGAM302 binds and inhibits, and the function of these target genes, as elaborated hereinbelow.

Cholinergic Receptor, Muscarinic 1 (CHRM1, Accession XM_170669) is a VGAM302 host target gene. CHRM1 BINDING SITE is HOST TARGET binding site found in the 3' untranslated region of mRNA encoded by CHRM1, corresponding to a HOST TARGET binding site such as BINDING SITE I, BINDING SITE II or BINDING SITE III. Table 2 illustrates the complementarity of the nucleotide sequences of CHRM1 BINDING SITE, designated SEQ ID:45443, to the nucleotide sequence of VGAM302 RNA, herein designated VGAM RNA, also designated SEQ ID:3013.

A function of VGAM302 is therefore inhibition of Cholinergic Receptor, Muscarinic 1 (CHRM1, Accession XM_170669), a gene which mediates various cellular responses. Accordingly, utilities of VGAM302 include diagnosis, prevention and treatment of diseases and clinical conditions associated with CHRM1. The function of CHRM1 has been established by previous studies. Goyal (1989) stated that 5 distinct but related muscarinic receptors had been identified, with apparent molecular weights ranging from 51,452 to 66,127. These glycosylated proteins have single chains of 460 to 590 amino acids that are thought to span the plasma membrane 7 times, creating 4 extracellular domains, 7 helical hydrophobic transmembrane domains, and 4 intracellular domains. Each protein is the product of a different gene without introns in the coding sequence, and the amino acid sequences in the receptor subtypes are remarkably homologous among different animal species (Bonner et al., 1987; Peralta et al., 1987; Bonner et al., 1988; Liao et al., 1989). The nomenclature is confusing (Eglen and Whiting, 1986; Goyal, 1989). In structure and evolution, muscarinic receptors are quite distinct from their pharmacologic kin, the nicotinic receptors (see OMIM Ref. No. 100690, 100710, 100720, 100730). By means of analysis of somatic cell hybrids and by both isotopic and nonisotopic in situ hybridization, Bonner et al. (1991) assigned the CHRM1 gene to 11q12-q13. Courseaux et al. (1996) used a combination of methods to refine maps of the approximately 5-Mb region of 11q13 that includes MEN1 (OMIM Ref. No. 131100). They proposed the following gene order: cen--PGA--FTH1--UGB--AHNAK--ROM1--MDU1--CHRM1--COX8--EMK1--FKBP2--PLCB3--[PYGM, ZFM1]--FAU--CAPN1--[MLK3, RELA]--FOSL1--SEA--CFL1--tel.

Full details of the abovementioned studies are described in the following publications, the disclosure of which are hereby incorporated by reference:

Bonner, T. I.; Buckley, N. J.; Young, A. C.; Brann, M. R.: Identification of a family of muscarinic acetylcholine receptor genes. Science 237:527-532, 1987; and Bonner, T. I.; Modi, W. S.; Seuanez, H. N.; O'Brien, S. J.: Chromosomal mapping of five human genes encoding muscarinic acetylcholine receptors. (Abstract) Cytogenet. Cell Genet. 58:1.

Further studies establishing the function and utilities of CHRM1 are found in John Hopkins OMIM database record ID 118510, and in sited publications numbered 1269 and 3984-3658 listed in the bibliography section hereinbelow, which are also hereby incorporated by reference. Dishevelled Associated Activator of Morphogenesis 1 (DAAM1, Accession NM_014992) is another VGAM302 host target gene. DAAM1 BINDING SITE is HOST TARGET binding site found in the 3' untranslated region of mRNA encoded by DAAM1, corresponding to a HOST TARGET binding site such as BINDING SITE I, BINDING SITE II or BINDING SITE III. Table 2 illustrates the complementarity of the nucleotide sequences of DAAM1 BINDING SITE, designated SEQ ID:17366, to the nucleotide sequence of VGAM302 RNA, herein designated VGAM RNA, also designated SEQ ID:3013.

Another function of VGAM302 is therefore inhibition of Dishevelled Associated Activator of Morphogenesis 1 (DAAM1, Accession NM_014992), a gene which controls cell polarity and movement during development. Accordingly, utilities of VGAM302 include diagnosis, prevention and treatment of diseases and clinical conditions associated with DAAM1. The function of DAAM1 has been established by previous studies. By screening size-fractionated brain cDNA libraries for cDNAs with the potential to encode proteins larger than 50 kD, Ishikawa et al. (1998) identified a cDNA which they designated KIAA0666. KIAA0666 encodes a 1,085-amino acid protein predicted to function in cell division. It is 68% identical to the KIAA0381 protein (DAAM2; 606627). RT-PCR analysis detected expression of KIAA0666 in all tissues tested. Wnt (see OMIM Ref. No. 164975) signaling via the frizzled receptor (Fz; OMIM Ref. No. 600667) controls cell polarity and movement during development. Habas et al. (2001) reported that in human cells and during Xenopus embryogenesis, Wnt/Fz signaling activates the small GTPase Rho (OMIM Ref. No. 165390), a key regulator of cytoskeleton architecture. Wnt/Fz activation of Rho requires the cytoplasmic protein dishevelled (DVL; OMIM Ref. No. 601365) and a novel formin (see OMIM Ref. No. 136535) homology (FH) protein that they identified and named DAAM1. DAAM1 is a widely expressed protein that contains 1,078 amino acids and is identical to the KIAA0666 protein. Like other FH proteins, DAAM1 contains a central proline-rich FH1 domain and a more C-terminal FH2 domain. The authors showed that DAAM1 binds to both DVL and Rho and mediates Wnt-induced DVL-Rho complex formation. Inhibition or depletion of DAAM1 prevented Wnt/Fz activation of Rho and of Xenopus gastrulation, but did not prevent activation of beta-catenin (OMIM Ref. No. 116806) signaling.

Full details of the abovementioned studies are described in the following publications, the disclosure of which are hereby incorporated by reference:

Habas, R.; Kato, Y.; He, X.: Wnt/Frizzled activation of Rho regulates vertebrate gastrulation and requires a novel Formin homology protein Daam1. Cell 107:843-854, 2001; and Ishikawa, K.; Nagase, T.; Suyama, M.; Miyajima, N.; Tanaka, A.; Kotani, H.; Nomura, N.; Ohara, O.: Prediction of the coding sequences of unidentified human genes. X. The complete sequ.

Further studies establishing the function and utilities of DAAM1 are found in John Hopkins OMIM database record ID 606626, and in sited publications numbered 452 and 9440 listed in the bibliography section hereinbelow, which are also hereby incorporated by reference. Inositol 1,4,5-triphosphate Receptor, Type 2 (ITPR2, Accession NM_002223) is another VGAM302 host target gene. ITPR2 BINDING SITE is HOST TARGET binding site found in the 3' untranslated region of mRNA encoded by ITPR2, corresponding to a HOST TARGET binding site such as BINDING SITE I, BINDING SITE II or BINDING SITE III. Table 2 illustrates the complementarity of the nucleotide sequences of ITPR2 BINDING SITE, designated SEQ ID:7995, to the nucleotide sequence of VGAM302 RNA, herein designated VGAM RNA, also designated SEQ ID:3013.

Another function of VGAM302 is therefore inhibition of Inositol 1,4,5-triphosphate Receptor, Type 2 (ITPR2, Accession NM_002223). Accordingly, utilities of VGAM302 include diagnosis, prevention and treatment of diseases and clinical conditions associated with ITPR2. Neurocalcin Delta (NCALD, Accession NM_032041) is another VGAM302 host target gene. NCALD BINDING SITE is HOST TARGET binding site found in the 3' untranslated region of mRNA encoded by NCALD, corresponding to a HOST TARGET binding site such as BINDING SITE I, BINDING SITE II or BINDING SITE III. Table 2 illustrates the complementarity of the nucleotide sequences of NCALD BINDING SITE, designated SEQ ID:25748, to the nucleotide sequence of VGAM302 RNA, herein designated VGAM RNA, also designated SEQ ID:3013.

Another function of VGAM302 is therefore inhibition of Neurocalcin Delta (NCALD, Accession NM_032041). Accordingly, utilities of VGAM302 include diagnosis, prevention and treatment of diseases and clinical conditions associated with NCALD. Protein Phosphatase 2, Regulatory Subunit B (B56), Epsilon Isoform (PPP2R5E, Accession NM_006246) is another VGAM302 host target gene. PPP2R5E BINDING SITE is HOST TARGET binding site found in the 3' untranslated region of mRNA encoded by PPP2R5E, corresponding to a HOST TARGET binding site such as BINDING SITE I, BINDING SITE II or BINDING SITE III. Table 2 illustrates the complementarity of the nucleotide sequences of PPP2R5E BINDING SITE, designated SEQ ID:12924, to the nucleotide sequence of VGAM302 RNA, herein designated VGAM RNA, also designated SEQ ID:3013.

Another function of VGAM302 is therefore inhibition of Protein Phosphatase 2, Regulatory Subunit B (B56), Epsilon Isoform (PPP2R5E, Accession NM_006246), a gene which is a regulatory subunit of protein phosphatase 2A. Accordingly, utilities of VGAM302 include diagnosis, prevention and treatment of diseases and clinical conditions associated with PPP2R5E. The function of PPP2R5E has been established by previous studies. is a regulatory subunit of protein phosphatase 2A involving in cellular processes such as cell cycle progression, growth factor signaling, and cell transformation.

Full details of the abovementioned studies are described in the following publications, the disclosure of which are hereby incorporated by reference:

McCright, B.; Brothman, A. R.; Virshup, D. M.: Assignment of human protein phosphatase 2A regulatory subunit genes B56-alpha, B56-beta, B56-gamma, B56-delta, and B56-epsilon (PPP2R5A--PPP2R5E), highly expressed in muscle and brain, to chromosome regions 1q41, 11q12, 3p21, 6p21.1, and 7p11.2-to-p12. Genomics 36:168-170, 1996; and McCright, B.; Rivers, A. M.; Audlin, S.; Virshup, D. M.: The B56 family of protein phosphatase 2A (PP2A) regulatory subunits encodes differentiation-induced phosphoproteins that target.

Further studies establishing the function and utilities of PPP2R5E are found in John Hopkins OMIM database record ID 601647, and in sited publications numbered 668 and 8305 listed in the bibliography section hereinbelow, which are also hereby incorporated by reference. Ret Finger Protein (RFP, Accession NM_006510) is another VGAM302 host target gene. RFP BINDING SITE is HOST TARGET binding site found in the 3' untranslated region of mRNA encoded by RFP, corresponding to a HOST TARGET binding site such as BINDING SITE I, BINDING SITE II or BINDING SITE III. Table 2 illustrates the complementarity of the nucleotide sequences of RFP BINDING SITE, designated SEQ ID:13263, to the nucleotide sequence of VGAM302 RNA, herein designated VGAM RNA, also designated SEQ ID:3013.

Another function of VGAM302 is therefore inhibition of Ret Finger Protein (RFP, Accession NM_006510), a gene which involvels in transcriptional regulation and may act in male germ cell development. Accordingly, utilities of VGAM302 include diagnosis, prevention and treatment of diseases and clinical conditions associated with RFP. The function of RFP has been established by previous studies. Ret finger protein (RFP) is a DNA-binding protein associated with the nuclear matrix (Isomura et al., 1992). Szpirer et al. (1997) demonstrated that, although the RFP gene and a gene for an olfactory receptor (OLF89) both map to chromosome 6 less than 300 kb apart, the mouse homologs are located on 2 different chromosomes, namely 13 and 17, respectively. Thus the 2 genes delineate the breakpoint between 2 of the conserved synteny units on chromosome 6. Unit 1 (or UA) contains the major histocompatibility complex (MHC); unit 2 (or UB) contains the RFP gene. The mouse UA and UB regions are found on chromosome 17 and 13, respectively. The split at the UA/UB breakpoint must have occurred in the rodent lineage, before the mouse radiation, because the rat also shows nonsynteny of RFP and OLF89.

Full details of the abovementioned studies are described in the following publications, the disclosure of which are hereby incorporated by reference:

Isomura, T.; Tamiya-Koizumi, K.; Suzuki, M.; Yoshida, S.; Taniguchi, M.; Matsuyama, M.; Ishigaki, T.; Sakuma, S.; Takahashi, M.: RFP is a DNA binding protein associated with the nuclear matrix. Nucleic Acids Res. 20:5305-5310, 1992; and Szpirer, C.; Szpirer, J.; Riviere, M.; Tazi, R.; Pontarotti, P.: Mapping of the Olf89 and Rfp genes to the rat genome: comparison with the mouse and human and new insights into the evo.

Further studies establishing the function and utilities of RFP are found in John Hopkins OMIM database record ID 602165, and in sited publications numbered 6346-6347 listed in the bibliography section hereinbelow, which are also hereby incorporated by reference. Slit Homolog 2 (Drosophila) (SLIT2, Accession NM_004787) is another VGAM302 host target gene. SLIT2 BINDING SITE is HOST TARGET binding site found in the 5' untranslated region of mRNA encoded by SLIT2, corresponding to a HOST TARGET binding site such as BINDING SITE I, BINDING SITE II or BINDING SITE III. Table 2 illustrates the complementarity of the nucleotide sequences of SLIT2 BINDING SITE, designated SEQ ID:11192, to the nucleotide sequence of VGAM302 RNA, herein designated VGAM RNA, also designated SEQ ID:3013.

Another function of VGAM302 is therefore inhibition of Slit Homolog 2 (Drosophila) (SLIT2, Accession NM_004787). Accordingly, utilities of VGAM302 include diagnosis, prevention and treatment of diseases and clinical conditions associated with SLIT2. Son of Sevenless Homolog 2 (Drosophila) (SOS2, Accession XM_043720) is another VGAM302 host target gene. SOS2 BINDING SITE is HOST TARGET binding site found in the 3' untranslated region of mRNA encoded by SOS2, corresponding to a HOST TARGET binding site such as BINDING SITE I, BINDING SITE II or BINDING SITE III. Table 2 illustrates the complementarity of the nucleotide sequences of SOS2 BINDING SITE, designated SEQ ID:34001, to the nucleotide sequence of VGAM302 RNA, herein designated VGAM RNA, also designated SEQ ID:3013.

Another function of VGAM302 is therefore inhibition of Son of Sevenless Homolog 2 (Drosophila) (SOS2, Accession XM_043720). Accordingly, utilities of VGAM302 include diagnosis, prevention and treatment of diseases and clinical conditions associated with SOS2. Cdc42 Guanine Nucleotide Exchange Factor (GEF) 9 (ARHGEF9, Accession NM_015185) is another VGAM302 host target gene. ARHGEF9 BINDING SITE is HOST TARGET binding site found in the 3' untranslated region of mRNA encoded by ARHGEF9, corresponding to a HOST TARGET binding site such as BINDING SITE I, BINDING SITE II or BINDING SITE III. Table 2 illustrates the complementarity of the nucleotide sequences of ARHGEF9 BINDING SITE, designated SEQ ID:17543, to the nucleotide sequence of VGAM302 RNA, herein designated VGAM RNA, also designated SEQ ID:3013.

Another function of VGAM302 is therefore inhibition of Cdc42 Guanine Nucleotide Exchange Factor (GEF) 9 (ARHGEF9, Accession NM_015185). Accordingly, utilities of VGAM302 include diagnosis, prevention and treatment of diseases and clinical conditions associated with ARHGEF9. CIP29 (Accession NM_032364) is another VGAM302 host target gene. CIP29 BINDING SITE is HOST TARGET binding site found in the 3' untranslated region of mRNA encoded by CIP29, corresponding to a HOST TARGET binding site such as BINDING SITE I, BINDING SITE II or BINDING SITE III. Table 2 illustrates the complementarity of the nucleotide sequences of CIP29 BINDING SITE, designated SEQ ID:26150, to the nucleotide sequence of VGAM302 RNA, herein designated VGAM RNA, also designated SEQ ID:3013.

Another function of VGAM302 is therefore inhibition of CIP29 (Accession NM_032364). Accordingly, utilities of VGAM302 include diagnosis, prevention and treatment of diseases and clinical conditions associated with CIP29. DKFZP434N093 (Accession XM_086948) is another VGAM302 host target gene. DKFZP434N093 BINDING SITE is HOST TARGET binding site found in the 3' untranslated region of mRNA encoded by DKFZP434N093, corresponding to a HOST TARGET binding site such as BINDING SITE I, BINDING SITE II or BINDING SITE III. Table 2 illustrates the complementarity of the nucleotide sequences of DKFZP434N093 BINDING SITE, designated SEQ ID:38993, to the nucleotide sequence of VGAM302 RNA, herein designated VGAM RNA, also designated SEQ ID:3013.

Another function of VGAM302 is therefore inhibition of DKFZP434N093 (Accession XM_086948). Accordingly, utilities of VGAM302 include diagnosis, prevention and treatment of diseases and clinical conditions associated with DKFZP434N093. Potassium Channel, Subfamily K, Member 13 (KCNK13, Accession NM_022054) is another VGAM302 host target gene. KCNK13 BINDING SITE is HOST TARGET binding site found in the 3' untranslated region of mRNA encoded by KCNK13, corresponding to a HOST TARGET binding site such as BINDING SITE I, BINDING SITE II or BINDING SITE III. Table 2 illustrates the complementarity of the nucleotide sequences of KCNK13 BINDING SITE, designated SEQ ID:22593, to the nucleotide sequence of VGAM302 RNA, herein designated VGAM RNA, also designated SEQ ID:3013.

Another function of VGAM302 is therefore inhibition of Potassium Channel, Subfamily K, Member 13 (KCNK13, Accession NM_022054). Accordingly, utilities of VGAM302 include diagnosis, prevention and treatment of diseases and clinical conditions associated with KCNK13. KIAA0227 (Accession XM_027236) is another VGAM302 host target gene. KIAA0227 BINDING SITE is HOST TARGET binding site found in the 3' untranslated region of mRNA encoded by KIAA0227, corresponding to a HOST TARGET binding site such as BINDING SITE I, BINDING SITE II or BINDING SITE III. Table 2 illustrates the complementarity of the nucleotide sequences of KIAA0227 BINDING SITE, designated SEQ ID:30458, to the nucleotide sequence of VGAM302 RNA, herein designated VGAM RNA, also designated SEQ ID:3013.

Another function of VGAM302 is therefore inhibition of KIAA0227 (Accession XM_027236). Accordingly, utilities of VGAM302 include diagnosis, prevention and treatment of diseases and clinical conditions associated with KIAA0227. SENP7 (Accession NM_020654) is another VGAM302 host target gene. SENP7 BINDING SITE is HOST TARGET binding site found in the 3' untranslated region of mRNA encoded by SENP7, corresponding to a HOST TARGET binding site such as BINDING SITE I, BINDING SITE II or BINDING SITE III. Table 2 illustrates the complementarity of the nucleotide sequences of SENP7 BINDING SITE, designated SEQ ID:21824, to the nucleotide sequence of VGAM302 RNA, herein designated VGAM RNA, also designated SEQ ID:3013.

Another function of VGAM302 is therefore inhibition of SENP7 (Accession NM_020654). Accordingly, utilities of VGAM302 include diagnosis, prevention and treatment of diseases and clinical conditions associated with SENP7. LOC151414 (Accession XM_087197) is another VGAM302 host target gene. LOC151414 BINDING SITE is HOST TARGET binding site found in the 3' untranslated region of mRNA encoded by LOC151414, corresponding to a HOST TARGET binding site such as BINDING SITE I, BINDING SITE II or BINDING SITE III. Table 2 illustrates the complementarity of the nucleotide sequences of LOC151414 BINDING SITE, designated SEQ ID:39111, to the nucleotide sequence of VGAM302 RNA, herein designated VGAM RNA, also designated SEQ ID:3013.

Another function of VGAM302 is therefore inhibition of LOC151414 (Accession XM_087197). Accordingly, utilities of VGAM302 include diagnosis, prevention and treatment of diseases and clinical conditions associated with LOC151414. LOC253926 (Accession XM_170741) is another VGAM302 host target gene. LOC253926 BINDING SITE is HOST TARGET binding site found in the 5' untranslated region of mRNA encoded by LOC253926, corresponding to a HOST TARGET binding site such as BINDING SITE I, BINDING SITE II or BINDING SITE III. Table 2 illustrates the complementarity of the nucleotide sequences of LOC253926 BINDING SITE, designated SEQ ID:45501, to the nucleotide sequence of VGAM302 RNA, herein designated VGAM RNA, also designated SEQ ID:3013.

Another function of VGAM302 is therefore inhibition of LOC253926 (Accession XM_170741). Accordingly, utilities of VGAM302 include diagnosis, prevention and treatment of diseases and clinical conditions associated with LOC253926. LOC90826 (Accession XM_034321) is another VGAM302 host target gene. LOC90826 BINDING SITE is HOST TARGET binding site found in the 5' untranslated region of mRNA encoded by LOC90826, corresponding to a HOST TARGET binding site such as BINDING SITE I, BINDING SITE II or BINDING SITE III. Table 2 illustrates the complementarity of the nucleotide sequences of LOC90826 BINDING SITE, designated SEQ ID:32051, to the nucleotide sequence of VGAM302 RNA, herein designated VGAM RNA, also designated SEQ ID:3013.

Another function of VGAM302 is therefore inhibition of LOC90826 (Accession XM_034321). Accordingly, utilities of VGAM302 include diagnosis, prevention and treatment of diseases and clinical conditions associated with LOC90826. FIG. 1 further provides a conceptual description of a novel bioinformatically detected viral gene of the present invention, referred to here as Viral Genomic Address Messenger 303 (VGAM303) viral gene, which modulates expression of respective host target genes thereof, the function and utility of which host target genes is known in the art.

VGAM303 is a novel bioinformatically detected regulatory, non protein coding, viral micro RNA (miRNA) gene. The method by which VGAM303 was detected is described hereinabove with reference to FIGS. 1-8.

VGAM303 gene, herein designated VGAM GENE, is a viral gene contained in the genome of Epiphyas Postvittana Nucleopolyhedrovirus. VGAM303 host target gene, herein designated VGAM HOST TARGET GENE, is a human gene contained in the human genome.

VGAM303 gene encodes a VGAM303 precursor RNA, herein designated VGAM PRECURSOR RNA. Similar to other miRNA genes, and unlike most ordinary genes, VGAM303 precursor RNA does not encode a protein. A nucleotide sequence identical or highly similar to the nucleotide sequence of VGAM303 precursor RNA is designated SEQ ID:289, and is provided hereinbelow with reference to the sequence listing part. Nucleotide sequence SEQ ID:289 is located at position 103301 relative to the genome of Epiphyas Postvittana Nucleopolyhedrovirus.

VGAM303 precursor RNA folds onto itself, forming VGAM303 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM303 folded precursor RNA into VGAM303 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 42%) nucleotide sequence of VGAM303 RNA is designated SEQ ID:3014, and is provided hereinbelow with reference to the sequence listing part.

VGAM303 host target gene, herein designated VGAM HOST TARGET GENE, encodes a corresponding messenger RNA, VGAM303 host target RNA, herein designated VGAM HOST TARGET RNA. VGAM303 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM303 RNA, herein designated VGAM RNA, binds complementarily to one or more host target binding sites located in untranslated regions of VGAM303 host target RNA, herein designated VGAM HOST TARGET RNA. This complementary binding is due to the fact that the nucleotide sequence of VGAM303 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM303 RNA, herein designated VGAM RNA, may have a different number of host target binding sites in untranslated regions of a VGAM303 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM303 RNA, herein designated VGAM RNA, to host target binding sites on VGAM303 host target RNA, herein designated VGAM HOST TARGET RNA, such as BINDING SITE I, BINDING SITE II and BINDING SITE III, inhibits translation of VGAM303 host target RNA into VGAM303 host target protein, herein designated VGAM HOST TARGET PROTEIN. VGAM host target protein is therefore outlined by a broken line.

It is appreciated that VGAM303 host target gene, herein designated VGAM HOST TARGET GENE, in fact represents a plurality of VGAM303 host target genes. The mRNA of each one of this plurality of VGAM303 host target genes comprises one or more host target binding sites, each having a nucleotide sequence which is at least partly complementary to VGAM303 RNA, herein designated VGAM RNA, and which when bound by VGAM303 RNA causes inhibition of translation of respective one or more VGAM303 host target proteins.

It is further appreciated by one skilled in the art that the mode of translational inhibition illustrated by FIG. 1 with specific reference to translational inhibition exerted by VGAM303 gene, herein designated VGAM GENE, on one or more VGAM303 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM303 is inhibition of expression of host target genes, as part of a novel viral mechanism of attacking a host. Accordingly, utilities of VGAM303 include diagnosis, prevention and treatment of viral infection by Epiphyas Postvittana Nucleopolyhedrovirus. Specific functions, and accordingly utilities, of VGAM303 correlate with, and may be deduced from, the identity of the host target genes which VGAM303 binds and inhibits, and the function of these host target genes, as elaborated hereinbelow.

Nucleotide sequences of the VGAM303 precursor RNA, herein designated VGAM PRECURSOR RNA, and of the 'diced' VGAM303 RNA, herein designated VGAM RNA, and a schematic representation of the secondary folding of VGAM303 folded precursor RNA, herein designated VGAM FOLDED PRECURSOR RNA, of VGAM303 are further described hereinbelow with reference to Table 1.

Nucleotide sequences of host target binding sites, such as BINDING SITE-I, BINDING SITE-II and BINDING SITE-III of FIG. 1, found on VGAM303 host target RNA, and schematic representation of the complementarity of each of these host target binding sites to VGAM303 RNA, herein designated VGAM RNA, are described hereinbelow with reference to Table 2.

As mentioned hereinabove with reference to FIG. 1, a function of VGAM303 gene, herein designated VGAM is inhibition of expression of VGAM303 target genes. It is appreciated that specific functions, and accordingly utilities, of VGAM303 correlate with, and may be deduced from, the identity of the target genes which VGAM303 binds and inhibits, and the function of these target genes, as elaborated hereinbelow.

FLJ10579 (Accession NM_018145) is a VGAM303 host target gene. FLJ10579 BINDING SITE is HOST TARGET binding site found in the 3' untranslated region of mRNA encoded by FLJ10579, corresponding to a HOST TARGET binding site such as BINDING SITE I, BINDING SITE II or BINDING SITE III. Table 2 illustrates the complementarity of the nucleotide sequences of FLJ10579 BINDING SITE, designated SEQ ID:19942, to the nucleotide sequence of VGAM303 RNA, herein designated VGAM RNA, also designated SEQ ID:3014.

A function of VGAM303 is therefore inhibition of FLJ10579 (Accession NM_018145). Accordingly, utilities of VGAM303 include diagnosis, prevention and treatment of diseases and clinical conditions associated with FLJ10579. FIG. 1 further provides a conceptual description of a novel bioinformatically detected viral gene of the present invention, referred to here as Viral Genomic Address Messenger 304 (VGAM304) viral gene, which modulates expression of respective host target genes thereof, the function and utility of which host target genes is known in the art.

VGAM304 is a novel bioinformatically detected regulatory, non protein coding, viral micro RNA (miRNA) gene. The method by which VGAM304 was detected is described hereinabove with reference to FIGS. 1-8.

VGAM304 gene, herein designated VGAM GENE, is a viral gene contained in the genome of Equine Herpesvirus 4. VGAM304 host target gene, herein designated VGAM HOST TARGET GENE, is a human gene contained in the human genome.

VGAM304 gene encodes a VGAM304 precursor RNA, herein designated VGAM PRECURSOR RNA. Similar to other miRNA genes, and unlike most ordinary genes, VGAM304 precursor RNA does not encode a protein. A nucleotide sequence identical or highly similar to the nucleotide sequence of VGAM304 precursor RNA is designated SEQ ID:290, and is provided hereinbelow with reference to the sequence listing part. Nucleotide sequence SEQ ID:290 is located at position 86184 relative to the genome of Equine Herpesvirus 4.

VGAM304 precursor RNA folds onto itself, forming VGAM304 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM304 folded precursor RNA into VGAM304 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM304 RNA is designated SEQ ID:3015, and is provided hereinbelow with reference to the sequence listing part.

VGAM304 host target gene, herein designated VGAM HOST TARGET GENE, encodes a corresponding messenger RNA, VGAM304 host target RNA, herein designated VGAM HOST TARGET RNA. VGAM304 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM304 RNA, herein designated VGAM RNA, binds complementarily to one or more host target binding sites located in untranslated regions of VGAM304 host target RNA, herein designated VGAM HOST TARGET RNA. This complementary binding is due to the fact that the nucleotide sequence of VGAM304 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM304 RNA, herein designated VGAM RNA, may have a different number of host target binding sites in untranslated regions of a VGAM304 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM304 RNA, herein designated VGAM RNA, to host target binding sites on VGAM304 host target RNA, herein designated VGAM HOST TARGET RNA, such as BINDING SITE I, BINDING SITE II and BINDING SITE III, inhibits translation of VGAM304 host target RNA into VGAM304 host target protein, herein designated VGAM HOST TARGET PROTEIN. VGAM host target protein is therefore outlined by a broken line.

It is appreciated that VGAM304 host target gene, herein designated VGAM HOST TARGET GENE, in fact represents a plurality of VGAM304 host target genes. The mRNA of each one of this plurality of VGAM304 host target genes comprises one or more host target binding sites, each having a nucleotide sequence which is at least partly complementary to VGAM304 RNA, herein designated VGAM RNA, and which when bound by VGAM304 RNA causes inhibition of translation of respective one or more VGAM304 host target proteins.

It is further appreciated by one skilled in the art that the mode of translational inhibition illustrated by FIG. 1 with specific reference to translational inhibition exerted by VGAM304 gene, herein designated VGAM GENE, on one or more VGAM304 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM304 is inhibition of expression of host target genes, as part of a novel viral mechanism of attacking a host. Accordingly, utilities of VGAM304 include diagnosis, prevention and treatment of viral infection by Equine Herpesvirus 4. Specific functions, and accordingly utilities, of VGAM304 correlate with, and may be deduced from, the identity of the host target genes which VGAM304 binds and inhibits, and the function of these host target genes, as elaborated hereinbelow.

Nucleotide sequences of the VGAM304 precursor RNA, herein designated VGAM PRECURSOR RNA, and of the 'diced' VGAM304 RNA, herein designated VGAM RNA, and a schematic representation of the secondary folding of VGAM304 folded precursor RNA, herein designated VGAM FOLDED PRECURSOR RNA, of VGAM304 are further described hereinbelow with reference to Table 1.

Nucleotide sequences of host target binding sites, such as BINDING SITE-I, BINDING SITE-II and BINDING SITE-III of FIG. 1, found on VGAM304 host target RNA, and schematic representation of the complementarity of each of these host target binding sites to VGAM304 RNA, herein designated VGAM RNA, are described hereinbelow with reference to Table 2.

As mentioned hereinabove with reference to FIG. 1, a function of VGAM304 gene, herein designated VGAM is inhibition of expression of VGAM304 target genes. It is appreciated that specific functions, and accordingly utilities, of VGAM304 correlate with, and may be deduced from, the identity of the target genes which VGAM304 binds and inhibits, and the function of these target genes, as elaborated hereinbelow.

Bone Morphogenetic Protein 6 (BMP6, Accession NM_001718) is a VGAM304 host target gene. BMP6 BINDING SITE is HOST TARGET binding site found in the 3' untranslated region of mRNA encoded by BMP6, corresponding to a HOST TARGET binding site such as BINDING SITE I, BINDING SITE II or BINDING SITE III. Table 2 illustrates the complementarity of the nucleotide sequences of BMP6 BINDING SITE, designated SEQ ID:7452, to the nucleotide sequence of VGAM304 RNA, herein designated VGAM RNA, also designated SEQ ID:3015.

A function of VGAM304 is therefore inhibition of Bone Morphogenetic Protein 6 (BMP6, Accession NM_001718), a gene which induces cartilage and bone formation. Accordingly, utilities of VGAM304 include diagnosis, prevention and treatment of diseases and clinical conditions associated with BMP6. The function of BMP6 and its association with various diseases and clinical conditions, has been established by previous studies, as described hereinabove with reference to VGAM233. Collagen, Type XV, Alpha 1 (COL15A1, Accession NM_001855) is another VGAM304 host target gene. COL15A1 BINDING SITE is HOST TARGET binding site found in the 3" untranslated region of mRNA encoded by COL15A1, corresponding to a HOST TARGET binding site such as BINDING SITE I, BINDING SITE II or BINDING SITE III. Table 2 illustrates the complementarity of the nucleotide sequences of COL15A1 BINDING SITE, designated SEQ ID:7590, to the nucleotide sequence of VGAM304 RNA, herein designated VGAM RNA, also designated SEQ ID:3015.

Another function of VGAM304 is therefore inhibition of Collagen, Type XV, Alpha 1 (COL15A1, Accession NM_001855), a gene which may be involved in maintaining the structure of connective tissue. Accordingly, utilities of VGAM304 include diagnosis, prevention and treatment of diseases and clinical conditions associated with COL15A1. The function of COL15A1 has been established by previous studies. Undulin is a large glycoprotein of the interstitial extracellular matrix. It is restricted to dense and soft connective tissues and is associated with mature collagen fibrils (Schuppan et al., 1990). In SDS-polyacrylamide gels, undulin extracted from tissues has a molecular mass above 1,000 kD; under reducing conditions, it migrates as 270-, 190-, and 180-kD polypeptides By immunoscreening a human placenta cDNA expression library with antibodies against monkey undulin, Just et al. (1991) isolated 2 partial cDNAs, called UN1 and UN2, which encode the C-terminal portions of 2 undulin isoforms. The sequences of UN1 and UN2 are partly identical, and the authors suggested that they represent differentially spliced undulin transcripts. Northern blot analysis of human rhabdomyosarcoma cell poly (A) RNA using a probe specific for UN1 detected approximately 4.2-, 6.5-, and 8.5-kb transcripts; a probe specific for UN2 detected a single, approximately 5-kb transcript. The deduced polypeptides contain a differentially spliced von Willebrand factor (VWF; 193400) A domain and the type III homology domains found in fibronectin (OMIM Ref. No. 135600) and tenascin (OMIM Ref. No. 187380). Whereas UN1 has 7 complete and 1 truncated type III homology domains followed by a short proline-rich C-terminal segment, UN2 has 2 complete and 1 incomplete type III homologies followed by a unique acidic C-terminal domain. The authors stated that the mRNAs related to UN1 likely encode the major chains of the undulin molecule Full details of the abovementioned studies are described in the following publications, the disclosure of which are hereby incorporated by reference:

Schuppan, D.; Cantaluppi, M. C.; Becker, J.; Veit, A.; Bunte, T.; Troyer, D.; Schuppan, F.; Schmid, M.; Ackermann, R.; Hahn, E. G.: Undulin, an extracellular matrix glycoprotein associated with collagen fibrils. J. Biol. Chem. 265:8823-8832, 1990; and Just, M.; Herbst, H.; Hummel, M.; Durkop, H.; Tripier, D.; Stein, H.; Schuppan, D.: Undulin is a novel member of the fibronectin-tenascin family of extracellular matrix glycoproteins. J.

Further studies establishing the function and utilities of COL15A1 are found in John Hopkins OMIM database record ID 120325, and in sited publications numbered 12014-12025 listed in the bibliography section hereinbelow, which are also hereby incorporated by reference. Paired Box Gene 7 (PAX7, Accession NM_013945) is another VGAM304 host target gene. PAX7 BINDING SITE1 and PAX7 BINDING SITE2 are HOST TARGET binding sites found in untranslated regions of mRNA encoded by PAX7, corresponding to HOST TARGET binding sites such as BINDING SITE I, BINDING SITE II or BINDING SITE III. Table 2 illustrates the complementarity of the nucleotide sequences of PAX7 BINDING SITE1 and PAX7 BINDING SITE2, designated SEQ ID:15133 and SEQ ID:8445 respectively, to the nucleotide sequence of VGAM304 RNA, herein designated VGAM RNA, also designated SEQ ID:3015.

Another function of VGAM304 is therefore inhibition of Paired Box Gene 7 (PAX7, Accession NM_013945), a gene which involves in myogenesis. Accordingly, utilities of VGAM304 include diagnosis, prevention and treatment of diseases and clinical conditions associated with PAX7. The function of PAX7 has been established by previous studies. In a review of 28 published cases of the pediatric soft tissue cancer alveolar rhabdomyosarcoma (OMIM Ref. No. 268220), Whang-Peng et al. (1992) found a characteristic t (2;13)(q35; q14) translocation and a variant t (1;13)(p36; q14) translocation in 64% and 18% of the cases, respectively. Subsequent molecular biology studies demonstrated that these translocations fuse the PAX3 gene (OMIM Ref. No. 193500) on chromosome 2 or the PAX7 gene on chromosome 1 with the forkhead in rhabdomyosarcoma gene (OMIM Ref. No. 136533) on chromosome 13 to generate PAX3/FKHR or PAX7/FKHR fusion genes. These genes encode chimeric transcription factors which, in the case of PAX3/FKHR, was shown to activate excessively transcription from binding targets of the wildtype PAX3 transcription factor. Using FISH, RT-PCR, and quantitative Southern blot analyses, Barr et al. (1996) demonstrated that these fusion genes are amplified in 20% of fusion-positive tumors. In particular, they found in vivo amplification of these fusions in 1 of 22 PAX3/FKHR-positive cases and 5 of 7 PAX7/FKHR-positive cases. By representational difference analysis, Seale et al. (2000) isolated mouse Pax7 as a gene specifically expressed in cultured satellite cell-derived myoblasts. In situ hybridization revealed that Pax7 is also expressed in satellite cells residing in adult muscle. Cell culture and electron microscopic analysis showed a complete absence of satellite cells in Pax7 -/- skeletal muscle. Surprisingly, fluorescence-activated cell sorting analysis indicated that the proportion of muscle-derived stem cells was unaffected. Stem cells from Pax7 -/- muscle displayed an almost 10-fold increase in their ability to form hematopoietic colonies. These results demonstrated that satellite cells and muscle-derived stem cells represent distinct cell populations. Furthermore, these studies suggested that induction of Pax7 in muscle-derived stem cells induces satellite cell specification by restricting alternate developmental programs. Animal model experiments lend further support to the function of PAX7. By representational difference analysis, Seale et al. (2000) isolated mouse Pax7 as a gene specifically expressed in cultured satellite cell-derived myoblasts. In situ hybridization revealed that Pax7 is also expressed in satellite cells residing in adult muscle. Cell culture and electron microscopic analysis showed a complete absence of satellite cells in Pax7 -/- skeletal muscle. Surprisingly, fluorescence-activated cell sorting analysis indicated that the proportion of muscle-derived stem cells was unaffected. Stem cells from Pax7 -/- muscle displayed an almost 10-fold increase in their ability to form hematopoietic colonies. These results demonstrated that satellite cells and muscle-derived stem cells represent distinct cell populations. Furthermore, these studies suggested that induction of Pax7 in muscle-derived stem cells induces satellite cell specification by restricting alternate developmental programs.

It is appreciated that the abovementioned animal model for PAX7 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Barr, F. G.; Nauta, L. E.; Davis, R. J.; Schafer, B. W.; Nycum, L. M.; Biegel, J. A.: In vivo amplification of the PAX3-FKHR and PAX7-FKHR fusion genes in alveolar rhabdomyosarcoma. Hum. Molec. Genet. 5:15-21, 1996. ; and Seale, P.; Sabourin, L. A.; Girgis-Gabardo, A.; Mansouri, A.; Gruss, P.; Rudnicki, M. A.: Pax7 is required for the specification of myogenic satellite cells. Cell 102:777-786, 2000.

Further studies establishing the function and utilities of PAX7 are found in John Hopkins OMIM database record ID 167410, and in sited publications numbered 10719-10721, 10338, 10722-1072 and 10714 listed in the bibliography section hereinbelow, which are also hereby incorporated by reference. BCL2-like 1 (BCL2L1, Accession NM_138578) is another VGAM304 host target gene. BCL2L1 BINDING SITE is HOST TARGET binding site found in the 3' untranslated region of mRNA encoded by BCL2L1, corresponding to a HOST TARGET binding site such as BINDING SITE I, BINDING SITE II or BINDING SITE III. Table 2 illustrates the complementarity of the nucleotide sequences of BCL2L1 BINDING SITE, designated SEQ ID:28895, to the nucleotide sequence of VGAM304 RNA, herein designated VGAM RNA, also designated SEQ ID:3015.

Another function of VGAM304 is therefore inhibition of BCL2-like 1 (BCL2L1, Accession NM_138578). Accordingly, utilities of VGAM304 include diagnosis, prevention and treatment of diseases and clinical conditions associated with BCL2L1. Chromosome 20 Open Reading Frame 98 (C20orf98, Accession XM_049398) is another VGAM304 host target gene. C20orf98 BINDING SITE is HOST TARGET binding site found in the 3' untranslated region of mRNA encoded by C20orf98, corresponding to a HOST TARGET binding site such as BINDING SITE I, BINDING SITE II or BINDING SITE III. Table 2 illustrates the complementarity of the nucleotide sequences of C20orf98 BINDING SITE, designated SEQ ID:35413, to the nucleotide sequence of VGAM304 RNA, herein designated VGAM RNA, also designated SEQ ID:3015.

Another function of VGAM304 is therefore inhibition of Chromosome 20 Open Reading Frame 98 (C20orf98, Accession XM_049398). Accordingly, utilities of VGAM304 include diagnosis, prevention and treatment of diseases and clinical conditions associated with C20orf98. DKFZp547O146 (Accession NM_020224) is another VGAM304 host target gene. DKFZp547O146 BINDING SITE is HOST TARGET binding site found in the 5' untranslated region of mRNA encoded by DKFZp547O146, corresponding to a HOST TARGET binding site such as BINDING SITE I, BINDING SITE II or BINDING SITE III. Table 2 illustrates the complementarity of the nucleotide sequences of DKFZp547O146 BINDING SITE, designated SEQ ID:21484, to the nucleotide sequence of VGAM304 RNA, herein designated VGAM RNA, also designated SEQ ID:3015.

Another function of VGAM304 is therefore inhibition of DKFZp547O146 (Accession NM_020224). Accordingly, utilities of VGAM304 include diagnosis, prevention and treatment of diseases and clinical conditions associated with DKFZp547O146. FLJ11539 (Accession NM_024748) is another VGAM304 host target gene. FLJ11539 BINDING SITE is HOST TARGET binding site found in the 5' untranslated region of mRNA encoded by FLJ11539, corresponding to a HOST TARGET binding site such as BINDING SITE I, BINDING SITE II or BINDING SITE III. Table 2 illustrates the complementarity of the nucleotide sequences of FLJ11539 BINDING SITE, designated SEQ ID:24085, to the nucleotide sequence of VGAM304 RNA, herein designated VGAM RNA, also designated SEQ ID:3015.

Another function of VGAM304 is therefore inhibition of FLJ11539 (Accession NM_024748). Accordingly, utilities of VGAM304 include diagnosis, prevention and treatment of diseases and clinical conditions associated with FLJ11539. Suppression of Tumorigenicity 7 Like (ST7L, Accession NM_017744) is another VGAM304 host target gene. ST7L BINDING SITE1 through ST7L BINDING SITE3 are HOST TARGET binding sites found in untranslated regions of mRNA encoded by ST7L, corresponding to HOST TARGET binding sites such as BINDING SITE I, BINDING SITE II or BINDING SITE III. Table 2 illustrates the complementarity of the nucleotide sequences of ST7L BINDING SITE1 through ST7L BINDING SITE3, designated SEQ ID:19334, SEQ ID:28976 and SEQ ID:29206 respectively, to the nucleotide sequence of VGAM304 RNA, herein designated VGAM RNA, also designated SEQ ID:3015.

Another function of VGAM304 is therefore inhibition of Suppression of Tumorigenicity 7 Like (ST7L, Accession NM_017744). Accordingly, utilities of VGAM304 include diagnosis, prevention and treatment of diseases and clinical conditions associated with ST7L. Zinc Finger Protein 91 Homolog (mouse) (ZFP91, Accession NM_053023) is another VGAM304 host target gene. ZFP91 BINDING SITE is HOST TARGET binding site found in the 3' untranslated region of mRNA encoded by ZFP91, corresponding to a HOST TARGET binding site such as BINDING SITE I, BINDING SITE II or BINDING SITE III. Table 2 illustrates the complementarity of the nucleotide sequences of ZFP91 BINDING SITE, designated SEQ ID:27578, to the nucleotide sequence of VGAM304 RNA, herein designated VGAM RNA, also designated SEQ ID:3015.

Another function of VGAM304 is therefore inhibition of Zinc Finger Protein 91 Homolog (mouse) (ZFP91, Accession NM_053023). Accordingly, utilities of VGAM304 include diagnosis, prevention and treatment of diseases and clinical conditions associated with ZFP91. LOC150157 (Accession XM_097823) is another VGAM304 host target gene. LOC150157 BINDING SITE is HOST TARGET binding site found in the 5' untranslated region of mRNA encoded by LOC150157, corresponding to a HOST TARGET binding site such as BINDING SITE I, BINDING SITE II or BINDING SITE III. Table 2 illustrates the complementarity of the nucleotide sequences of LOC150157 BINDING SITE, designated SEQ ID:41142, to the nucleotide sequence of VGAM304 RNA, herein designated VGAM RNA, also designated SEQ ID:3015.

Another function of VGAM304 is therefore inhibition of LOC150157 (Accession XM_097823). Accordingly, utilities of VGAM304 include diagnosis, prevention and treatment of diseases and clinical conditions associated with LOC150157. FIG. 1 further provides a conceptual description of a novel bioinformatically detected viral gene of the present invention, referred to here as Viral Genomic Address Messenger 305 (VGAM305) viral gene, which modulates expression of respective host target genes thereof, the function and utility of which host target genes is known in the art.

VGAM305 is a novel bioinformatically detected regulatory, non protein coding, viral micro RNA (miRNA) gene. The method by which VGAM305 was detected is described hereinabove with reference to FIGS. 1-8.

VGAM305 gene, herein designated VGAM GENE, is a viral gene contained in the genome of Equine Herpesvirus 4. VGAM305 host target gene, herein designated VGAM HOST TARGET GENE, is a human gene contained in the human genome.

VGAM305 gene encodes a VGAM305 precursor RNA, herein designated VGAM PRECURSOR RNA. Similar to other miRNA genes, and unlike most ordinary genes, VGAM305 precursor RNA does not encode a protein. A nucleotide sequence identical or highly similar to the nucleotide sequence of VGAM305 precursor RNA is designated SEQ ID:291, and is provided hereinbelow with reference to the sequence listing part. Nucleotide sequence SEQ ID:291 is located at position 85065 relative to the genome of Equine Herpesvirus 4.

VGAM305 precursor RNA folds onto itself, forming VGAM305 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM305 folded precursor RNA into VGAM305 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM305 RNA is designated SEQ ID:3016, and is provided hereinbelow with reference to the sequence listing part.

VGAM305 host target gene, herein designated VGAM HOST TARGET GENE, encodes a corresponding messenger RNA, VGAM305 host target RNA, herein designated VGAM HOST TARGET RNA. VGAM305 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM305 RNA, herein designated VGAM RNA, binds complementarily to one or more host target binding sites located in untranslated regions of VGAM305 host target RNA, herein designated VGAM HOST TARGET RNA. This complementary binding is due to the fact that the nucleotide sequence of VGAM305 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM305 RNA, herein designated VGAM RNA, may have a different number of host target binding sites in untranslated regions of a VGAM305 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM305 RNA, herein designated VGAM RNA, to host target binding sites on VGAM305 host target RNA, herein designated VGAM HOST TARGET RNA, such as BINDING SITE I, BINDING SITE II and BINDING SITE III, inhibits translation of VGAM305 host target RNA into VGAM305 host target protein, herein designated VGAM HOST TARGET PROTEIN. VGAM host target protein is therefore outlined by a broken line.

It is appreciated that VGAM305 host target gene, herein designated VGAM HOST TARGET GENE, in fact represents a plurality of VGAM305 host target genes. The mRNA of each one of this plurality of VGAM305 host target genes comprises one or more host target binding sites, each having a nucleotide sequence which is at least partly complementary to VGAM305 RNA, herein designated VGAM RNA, and which when bound by VGAM305 RNA causes inhibition of translation of respective one or more VGAM305 host target proteins.

It is further appreciated by one skilled in the art that the mode of translational inhibition illustrated by FIG. 1 with specific reference to translational inhibition exerted by VGAM305 gene, herein designated VGAM GENE, on one or more VGAM305 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM305 is inhibition of expression of host target genes, as part of a novel viral mechanism of attacking a host. Accordingly, utilities of VGAM305 include diagnosis, prevention and treatment of viral infection by Equine Herpesvirus 4. Specific functions, and accordingly utilities, of VGAM305 correlate with, and may be deduced from, the identity of the host target genes which VGAM305 binds and inhibits, and the function of these host target genes, as elaborated hereinbelow.

Nucleotide sequences of the VGAM305 precursor RNA, herein designated VGAM PRECURSOR RNA, and of the 'diced' VGAM305 RNA, herein designated VGAM RNA, and a schematic representation of the secondary folding of VGAM305 folded precursor RNA, herein designated VGAM FOLDED PRECURSOR RNA, of VGAM305 are further described hereinbelow with reference to Table 1.

Nucleotide sequences of host target binding sites, such as BINDING SITE-I, BINDING SITE-II and BINDING SITE-III of FIG. 1, found on VGAM305 host target RNA, and schematic representation of the complementarity of each of these host target binding sites to VGAM305 RNA, herein designated VGAM RNA, are described hereinbelow with reference to Table 2.

As mentioned hereinabove with reference to FIG. 1, a function of VGAM305 gene, herein designated VGAM is inhibition of expression of VGAM305 target genes. It is appreciated that specific functions, and accordingly utilities, of VGAM305 correlate with, and may be deduced from, the identity of the target genes which VGAM305 binds and inhibits, and the function of these target genes, as elaborated hereinbelow.

CD5 Antigen (p56-62) (CD5, Accession NM_014207) is a VGAM305 host target gene. CD5 BINDING SITE is HOST TARGET binding site found in the 3' untranslated region of mRNA encoded by CD5, corresponding to a HOST TARGET binding site such as BINDING SITE I, BINDING SITE II or BINDING SITE III. Table 2 illustrates the complementarity of the nucleotide sequences of CD5 BINDING SITE, designated SEQ ID:15476, to the nucleotide sequence of VGAM305 RNA, herein designated VGAM RNA, also designated SEQ ID:3016.

A function of VGAM305 is therefore inhibition of CD5 Antigen (p56-62) (CD5, Accession NM_014207). Accordingly, utilities of VGAM305 include diagnosis, prevention and treatment of diseases and clinical conditions associated with CD5. LOC148930 (Accession XM_086369) is another VGAM305 host target gene. LOC148930 BINDING SITE is HOST TARGET binding site found in the 3' untranslated region of mRNA encoded by LOC148930, corresponding to a HOST TARGET binding site such as BINDING SITE I, BINDING SITE II or BINDING SITE III. Table 2 illustrates the complementarity of the nucleotide sequences of LOC148930 BINDING SITE, designated SEQ ID:38618, to the nucleotide sequence of VGAM305 RNA, herein designated VGAM RNA, also designated SEQ ID:3016.

Another function of VGAM305 is therefore inhibition of LOC148930 (Accession XM_086369). Accordingly, utilities of VGAM305 include diagnosis, prevention and treatment of diseases and clinical conditions associated with LOC148930. LOC158310 (Accession XM_098919) is another VGAM305 host target gene. LOC158310 BINDING SITE is HOST TARGET binding site found in the 5' untranslated region of mRNA encoded by LOC158310, corresponding to a HOST TARGET binding site such as BINDING SITE I, BINDING SITE II or BINDING SITE III. Table 2 illustrates the complementarity of the nucleotide sequences of LOC158310 BINDING SITE, designated SEQ ID:41944, to the nucleotide sequence of VGAM305 RNA, herein designated VGAM RNA, also designated SEQ ID:3016.

Another function of VGAM305 is therefore inhibition of LOC158310 (Accession XM_098919). Accordingly, utilities of VGAM305 include diagnosis, prevention and treatment of diseases and clinical conditions associated with LOC158310. LOC256950 (Accession XM_170922) is another VGAM305 host target gene. LOC256950 BINDING SITE is HOST TARGET binding site found in the 3' untranslated region of mRNA encoded by LOC256950, corresponding to a HOST TARGET binding site such as BINDING SITE I, BINDING SITE II or BINDING SITE III. Table 2 illustrates the complementarity of the nucleotide sequences of LOC256950 BINDING SITE, designated SEQ ID:45699, to the nucleotide sequence of VGAM305 RNA, herein designated VGAM RNA, also designated SEQ ID:3016.

Another function of VGAM305 is therefore inhibition of LOC256950 (Accession XM_170922). Accordingly, utilities of VGAM305 include diagnosis, prevention and treatment of diseases and clinical conditions associated with LOC256950.

FIG. 1 further provides a conceptual description of a novel bioinformatically detected viral gene of the present invention, referred to here as Viral Genomic Address Messenger 306 (VGAM306) viral gene, which modulates expression of respective host target genes thereof, the function and utility of which host target genes is known in the art.

VGAM306 is a novel bioinformatically detected regulatory, non protein coding, viral micro RNA (miRNA) gene. The method by which VGAM306 was detected is described hereinabove with reference to FIGS. 1-8.

VGAM306 gene, herein designated VGAM GENE, is a viral gene contained in the genome of Equine Herpesvirus 4. VGAM306 host target gene, herein designated VGAM HOST TARGET GENE, is a human gene contained in the human genome.

VGAM306 gene encodes a VGAM306 precursor RNA, herein designated VGAM PRECURSOR RNA. Similar to other miRNA genes, and unlike most ordinary genes, VGAM306 precursor RNA does not encode a protein. A nucleotide sequence identical or highly similar to the nucleotide sequence of VGAM306 precursor RNA is designated SEQ ID:292, and is provided hereinbelow with reference to the sequence listing part. Nucleotide sequence SEQ ID:292 is located at position 87168 relative to the genome of Equine Herpesvirus 4.

VGAM306 precursor RNA folds onto itself, forming VGAM306 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM306 folded precursor RNA into VGAM306 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM306 RNA is designated SEQ ID:3017, and is provided hereinbelow with reference to the sequence listing part.

VGAM306 host target gene, herein designated VGAM HOST TARGET GENE, encodes a corresponding messenger RNA, VGAM306 host target RNA, herein designated VGAM HOST TARGET RNA. VGAM306 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM306 RNA, herein designated VGAM RNA, binds complementarily to one or more host target binding sites located in untranslated regions of VGAM306 host target RNA, herein designated VGAM HOST TARGET RNA. This complementary binding is due to the fact that the nucleotide sequence of VGAM306 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM306 RNA, herein designated VGAM RNA, may have a different number of host target binding sites in untranslated regions of a VGAM306 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM306 RNA, herein designated VGAM RNA, to host target binding sites on VGAM306 host target RNA, herein designated VGAM HOST TARGET RNA, such as BINDING SITE I, BINDING SITE II and BINDING SITE III, inhibits translation of VGAM306 host target RNA into VGAM306 host target protein, herein designated VGAM HOST TARGET PROTEIN. VGAM host target protein is therefore outlined by a broken line.

It is appreciated that VGAM306 host target gene, herein designated VGAM HOST TARGET GENE, in fact represents a plurality of VGAM306 host target genes. The mRNA of each one of this plurality of VGAM306 host target genes comprises one or more host target binding sites, each having a nucleotide sequence which is at least partly complementary to VGAM306 RNA, herein designated VGAM RNA, and which when bound by VGAM306 RNA causes inhibition of translation of respective one or more VGAM306 host target proteins.

It is further appreciated by one skilled in the art that the mode of translational inhibition illustrated by FIG. 1 with specific reference to translational inhibition exerted by VGAM306 gene, herein designated VGAM GENE, on one or more VGAM306 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM306 is inhibition of expression of host target genes, as part of a novel viral mechanism of attacking a host. Accordingly, utilities of VGAM306 include diagnosis, prevention and treatment of viral infection by Equine Herpesvirus 4. Specific functions, and accordingly utilities, of VGAM306 correlate with, and may be deduced from, the identity of the host target genes which VGAM306 binds and inhibits, and the function of these host target genes, as elaborated hereinbelow.

Nucleotide sequences of the VGAM306 precursor RNA, herein designated VGAM PRECURSOR RNA, and of the 'diced' VGAM306 RNA, herein designated VGAM RNA, and a schematic representation of the secondary folding of VGAM306 folded precursor RNA, herein designated VGAM FOLDED PRECURSOR RNA, of VGAM306 are further described hereinbelow with reference to Table 1.

Nucleotide sequences of host target binding sites, such as BINDING SITE-I, BINDING SITE-II and BINDING SITE-III of FIG. 1, found on VGAM306 host target RNA, and schematic representation of the complementarity of each of these host target binding sites to VGAM306 RNA, herein designated VGAM RNA, are described hereinbelow with reference to Table 2.

As mentioned hereinabove with reference to FIG. 1, a function of VGAM306 gene, herein designated VGAM is inhibition of expression of VGAM306 target genes. It is appreciated that specific functions, and accordingly utilities, of VGAM306 correlate with, and may be deduced from, the identity of the target genes which VGAM306 binds and inhibits, and the function of these target genes, as elaborated hereinbelow.

CD28 Antigen (Tp44) (CD28, Accession NM_006139) is a VGAM306 host target gene. CD28 BINDING SITE is HOST TARGET binding site found in the 3' untranslated region of mRNA encoded by CD28, corresponding to a HOST TARGET binding site such as BINDING SITE I, BINDING SITE II or BINDING SITE III. Table 2 illustrates the complementarity of the nucleotide sequences of CD28 BINDING SITE, designated SEQ ID:12785, to the nucleotide sequence of VGAM306 RNA, herein designated VGAM RNA, also designated SEQ ID:3017.

A function of VGAM306 is therefore inhibition of CD28 Antigen (Tp44) (CD28, Accession NM_006139), a gene which possibly involved in t-cell activation. Accordingly, utilities of VGAM306 include diagnosis, prevention and treatment of diseases and clinical conditions associated with CD28. The function of CD28 and its association with various diseases and clinical conditions, has been established by previous studies, as described hereinabove with reference to VGAM281. Membrane Protein, Palmitoylated 5 (MAGUK p55 subfamily member 5) (MPP5, Accession NM_022474) is another VGAM306 host target gene. MPP5 BINDING SITE is HOST TARGET binding site found in the 3' untranslated region of mRNA encoded by MPP5, corresponding to a HOST TARGET binding site such as BINDING SITE I, BINDING SITE II or BINDING SITE III. Table 2 illustrates the complementarity of the nucleotide sequences of MPP5 BINDING SITE, designated SEQ ID:22840, to the nucleotide sequence of VGAM306 RNA, herein designated VGAM RNA, also designated SEQ ID:3017.

Another function of VGAM306 is therefore inhibition of Membrane Protein, Palmitoylated 5 (MAGUK p55 subfamily member 5) (MPP5, Accession NM_022474), a gene which may regulate transmembrane proteins that bind calcium, calmodulin, or nucleotides. Accordingly, utilities of VGAM306 include diagnosis, prevention and treatment of diseases and clinical conditions associated with MPP5. The function of MPP5 has been established by previous studies. Members of the peripheral membrane-associated guanylate kinase (MAGUK) family function in tumor suppression and receptor clustering by forming multiprotein complexes containing distinct sets of transmembrane, cytoskeletal, and cytoplasmic signaling proteins. All MAGUKs contain a PDZ-SH3-GUK core and are divided into 4 subfamilies, DLG-like (see OMIM Ref. No. DLG1; 601014), ZO1-like (see OMIM Ref. No. TJP1; 601009), p55-like (see OMIM Ref. No. MPP1; 305360), and LIN2-like (see OMIM Ref. No. CASK; 300172), based on their size and the presence of additional domains (Tseng et al., 2001). MPP5 is a member of the p55-like MAGUK subfamily. Kamberov et al. (2000) cloned and characterized the mouse Mpp5 and Mpp6 (OMIM Ref. No. 606959) genes, which they called Pals1 and Pals2, respectively. The Pals proteins bind to mouse Lin7 (OMIM Ref. No. 603380) through a region N-terminal to the PDZ domains. Roh et al. (2002) showed that Pals1 contains 2 Lin2 (OMIM Ref. No. 300172)/Lin7-binding domains, which they called L27 domains, N-terminal to the PDZ domain. The C-terminal L27 domain, L27C, binds Lin7, whereas the N-terminal L27 domain, L27N, targets Pals1 to tight junctions by binding to Patj (INAD; 603199) and to Crb1 (OMIM Ref. No. 604210).

Full details of the abovementioned studies are described in the following publications, the disclosure of which are hereby incorporated by reference:

Roh, M. H.; Makarova, O.; Liu, C.-J.; Shin, K.; Lee, S.; Laurinec, S.; Goyal, M.; Wiggins, R.; Margolis, B.: The Maguk protein, Pals1, functions as an adapter, linking mammalian homologues of Crumbs and Discs Lost. J. Cell Biol. 157:161-172, 2002; and Tseng, T.-C.; Marfatia, S. M.; Bryant, P. J.; Pack, S.; Zhuang, A.; O'Brien, J. E.; Lin, L.; Hanada, T.; Chishti, A. H.: VAM-1: a new member of the MAGUK family binds to human Veli-1.

Further studies establishing the function and utilities of MPP5 are found in John Hopkins OMIM database record ID 606958, and in sited publications numbered 513 and 7979-5140 listed in the bibliography section hereinbelow, which are also hereby incorporated by reference. Phosphoinositide-3-kinase, Class 2, Beta Polypeptide (PIK3C2B, Accession NM_002646) is another VGAM306 host target gene. PIK3C2B BINDING SITE is HOST TARGET binding site found in the 3' untranslated region of mRNA encoded by PIK3C2B, corresponding to a HOST TARGET binding site such as BINDING SITE I, BINDING SITE II or BINDING SITE III. Table 2 illustrates the complementarity of the nucleotide sequences of PIK3C2B BINDING SITE, designated SEQ ID:8510, to the nucleotide sequence of VGAM306 RNA, herein designated VGAM RNA, also designated SEQ ID:3017.

Another function of VGAM306 is therefore inhibition of Phosphoinositide-3-kinase, Class 2, Beta Polypeptide (PIK3C2B, Accession NM_002646). Accordingly, utilities of VGAM306 include diagnosis, prevention and treatment of diseases and clinical conditions associated with PIK3C2B. DKFZP727C091 (Accession XM_038689) is another VGAM306 host target gene. DKFZP727C091 BINDING SITE is HOST TARGET binding site found in the 5' untranslated region of mRNA encoded by DKFZP727C091, corresponding to a HOST TARGET binding site such as BINDING SITE I, BINDING SITE II or BINDING SITE III. Table 2 illustrates the complementarity of the nucleotide sequences of DKFZP727C091 BINDING SITE, designated SEQ ID:32908, to the nucleotide sequence of VGAM306 RNA, herein designated VGAM RNA, also designated SEQ ID:3017.

Another function of VGAM306 is therefore inhibition of DKFZP727C091 (Accession XM_038689). Accordingly, utilities of VGAM306 include diagnosis, prevention and treatment of diseases and clinical conditions associated with DKFZP727C091. Dickkopf Homolog 3 (Xenopus laevis) (DKK3, Accession NM_013253) is another VGAM306 host target gene. DKK3 BINDING SITE is HOST TARGET binding site found in the 3' untranslated region of mRNA encoded by DKK3, corresponding to a HOST TARGET binding site such as BINDING SITE I, BINDING SITE II or BINDING SITE III. Table 2 illustrates the complementarity of the nucleotide sequences of DKK3 BINDING SITE, designated SEQ ID:14924, to the nucleotide sequence of VGAM306 RNA, herein designated VGAM RNA, also designated SEQ ID:3017.

Another function of VGAM306 is therefore inhibition of Dickkopf Homolog 3 (Xenopus laevis) (DKK3, Accession NM_013253). Accordingly, utilities of VGAM306 include diagnosis, prevention and treatment of diseases and clinical conditions associated with DKK3. KIAA0323 (Accession XM_032634) is another VGAM306 host target gene. KIAA0323 BINDING SITE is HOST TARGET binding site found in the 3' untranslated region of mRNA encoded by KIAA0323, corresponding to a HOST TARGET binding site such as BINDING SITE I, BINDING SITE II or BINDING SITE III. Table 2 illustrates the complementarity of the nucleotide sequences of KIAA0323 BINDING SITE, designated SEQ ID:31698, to the nucleotide sequence of VGAM306 RNA, herein designated VGAM RNA, also designated SEQ ID:3017.

Another function of VGAM306 is therefore inhibition of KIAA0323 (Accession XM_032634). Accordingly, utilities of VGAM306 include diagnosis, prevention and treatment of diseases and clinical conditions associated with KIAA0323. KIAA1023 (Accession NM_017604) is another VGAM306 host target gene. KIAA1023 BINDING SITE is HOST TARGET binding site found in the 3' untranslated region of mRNA encoded by KIAA1023, corresponding to a HOST TARGET binding site such as BINDING SITE I, BINDING SITE II or BINDING SITE III. Table 2 illustrates the complementarity of the nucleotide sequences of KIAA1023 BINDING SITE, designated SEQ ID:19099, to the nucleotide sequence of VGAM306 RNA, herein designated VGAM RNA, also designated SEQ ID:3017.

Another function of VGAM306 is therefore inhibition of KIAA1023 (Accession NM_017604). Accordingly, utilities of VGAM306 include diagnosis, prevention and treatment of diseases and clinical conditions associated with KIAA1023. KIAA1196 (Accession XM_028968) is another VGAM306 host target gene. KIAA1196 BINDING SITE is HOST TARGET binding site found in the 3' untranslated region of mRNA encoded by KIAA1196, corresponding to a HOST TARGET binding site such as BINDING SITE I, BINDING SITE II or BINDING SITE III. Table 2 illustrates the complementarity of the nucleotide sequences of KIAA1196 BINDING SITE, designated SEQ ID:30824, to the nucleotide sequence of VGAM306 RNA, herein designated VGAM RNA, also designated SEQ ID:3017.

Another function of VGAM306 is therefore inhibition of KIAA1196 (Accession XM_028968). Accordingly, utilities of VGAM306 include diagnosis, prevention and treatment of diseases and clinical conditions associated with KIAA1196. LOC112817 (Accession NM_138413) is another VGAM306 host target gene. LOC112817 BINDING SITE is HOST TARGET binding site found in the 3' untranslated region of mRNA encoded by LOC112817, corresponding to a HOST TARGET binding site such as BINDING SITE I, BINDING SITE II or BINDING SITE III. Table 2 illustrates the complementarity of the nucleotide sequences of LOC112817 BINDING SITE, designated SEQ ID:28784, to the nucleotide sequence of VGAM306 RNA, herein designated VGAM RNA, also designated SEQ ID:3017.

Another function of VGAM306 is therefore inhibition of LOC112817 (Accession NM_138413). Accordingly, utilities of VGAM306 include diagnosis, prevention and treatment of diseases and clinical conditions associated with LOC112817. LOC253675 (Accession XM_172990) is another VGAM306 host target gene. LOC253675 BINDING SITE is HOST TARGET binding site found in the 3' untranslated region of mRNA encoded by LOC253675, corresponding to a HOST TARGET binding site such as BINDING SITE I, BINDING SITE II or BINDING SITE III. Table 2 illustrates the complementarity of the nucleotide sequences of LOC253675 BINDING SITE, designated SEQ ID:46269, to the nucleotide sequence of VGAM306 RNA, herein designated VGAM RNA, also designated SEQ ID:3017.

Another function of VGAM306 is therefore inhibition of LOC253675 (Accession XM_172990). Accordingly, utilities of VGAM306 include diagnosis, prevention and treatment of diseases and clinical conditions associated with LOC253675. FIG. 1 further provides a conceptual description of a novel bioinformatically detected viral gene of the present invention, referred to here as Viral Genomic Address Messenger 307 (VGAM307) viral gene, which modulates expression of respective host target genes thereof, the function and utility of which host target genes is known in the art.

VGAM307 is a novel bioinformatically detected regulatory, non protein coding, viral micro RNA (miRNA) gene. The method by which VGAM307 was detected is described hereinabove with reference to FIGS. 1-8.

VGAM307 gene, herein designated VGAM GENE, is a viral gene contained in the genome of Human Adenovirus E. VGAM307 host target gene, herein designated VGAM HOST TARGET GENE, is a human gene contained in the human genome.

VGAM307 gene encodes a VGAM307 precursor RNA, herein designated VGAM PRECURSOR RNA. Similar to other miRNA genes, and unlike most ordinary genes, VGAM307 precursor RNA does not encode a protein. A nucleotide sequence identical or highly similar to the nucleotide sequence of VGAM307 precursor RNA is designated SEQ ID:293, and is provided hereinbelow with reference to the sequence listing part. Nucleotide sequence SEQ ID:293 is located at position 1062 relative to the genome of Human Adenovirus E.

VGAM307 precursor RNA folds onto itself, forming VGAM307 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM307 folded precursor RNA into VGAM307 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM307 RNA is designated SEQ ID:3018, and is provided hereinbelow with reference to the sequence listing part.

VGAM307 host target gene, herein designated VGAM HOST TARGET GENE, encodes a corresponding messenger RNA, VGAM307 host target RNA, herein designated VGAM HOST TARGET RNA. VGAM307 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM307 RNA, herein designated VGAM RNA, binds complementarily to one or more host target binding sites located in untranslated regions of VGAM307 host target RNA, herein designated VGAM HOST TARGET RNA. This complementary binding is due to the fact that the nucleotide sequence of VGAM307 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM307 RNA, herein designated VGAM RNA, may have a different number of host target binding sites in untranslated regions of a VGAM307 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM307 RNA, herein designated VGAM RNA, to host target binding sites on VGAM307 host target RNA, herein designated VGAM HOST TARGET RNA, such as BINDING SITE I, BINDING SITE II and BINDING SITE III, inhibits translation of VGAM307 host target RNA into VGAM307 host target protein, herein designated VGAM HOST TARGET PROTEIN. VGAM host target protein is therefore outlined by a broken line.

It is appreciated that VGAM307 host target gene, herein designated VGAM HOST TARGET GENE, in fact represents a plurality of VGAM307 host target genes. The mRNA of each one of this plurality of VGAM307 host target genes comprises one or more host target binding sites, each having a nucleotide sequence which is at least partly complementary to VGAM307 RNA, herein designated VGAM RNA, and which when bound by VGAM307 RNA causes inhibition of translation of respective one or more VGAM307 host target proteins.

It is further appreciated by one skilled in the art that the mode of translational inhibition illustrated by FIG. 1 with specific reference to translational inhibition exerted by VGAM307 gene, herein designated VGAM GENE, on one or more VGAM307 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM307 is inhibition of expression of host target genes, as part of a novel viral mechanism of attacking a host. Accordingly, utilities of VGAM307 include diagnosis, prevention and treatment of viral infection by Human Adenovirus E. Specific functions, and accordingly utilities, of VGAM307 correlate with, and may be deduced from, the identity of the host target genes which VGAM307 binds and inhibits, and the function of these host target genes, as elaborated hereinbelow.

Nucleotide sequences of the VGAM307 precursor RNA, herein designated VGAM PRECURSOR RNA, and of the 'diced' VGAM307 RNA, herein designated VGAM RNA, and a schematic representation of the secondary folding of VGAM307 folded precursor RNA, herein designated VGAM FOLDED PRECURSOR RNA, of VGAM307 are further described hereinbelow with reference to Table 1.

Nucleotide sequences of host target binding sites, such as BINDING SITE-I, BINDING SITE-II and BINDING SITE-III of FIG. 1, found on VGAM307 host target RNA, and schematic representation of the complementarity of each of these host target binding sites to VGAM307 RNA, herein designated VGAM RNA, are described hereinbelow with reference to Table 2.

As mentioned hereinabove with reference to FIG. 1, a function of VGAM307 gene, herein designated VGAM is inhibition of expression of VGAM307 target genes. It is appreciated that specific functions, and accordingly utilities, of VGAM307 correlate with, and may be deduced from, the identity of the target genes which VGAM307 binds and inhibits, and the function of these target genes, as elaborated hereinbelow.

Eukaryotic Translation Initiation Factor 1A (EIF1A, Accession XM_114147) is a VGAM307 host target gene. EIF1A BINDING SITE is HOST TARGET binding site found in the 3' untranslated region of mRNA encoded by EIF1A, corresponding to a HOST TARGET binding site such as BINDING SITE I, BINDING SITE II or BINDING SITE III. Table 2 illustrates the complementarity of the nucleotide sequences of EIF1A BINDING SITE, designated SEQ ID:42717, to the nucleotide sequence of VGAM307 RNA, herein designated VGAM RNA, also designated SEQ ID:3018.

A function of VGAM307 is therefore inhibition of Eukaryotic Translation Initiation Factor 1A (EIF1A, Accession XM_114147), a gene which seems to be required for maximal rate of protein biosynthesis. Accordingly, utilities of VGAM307 include diagnosis, prevention and treatment of diseases and clinical conditions associated with EIF1A. The function of EIF1A and its association with various diseases and clinical conditions, has been established by previous studies, as described hereinabove with reference to VGAM120. DNA Cross-link Repair 1A (PSO2 homolog, S. cerevisiae) (DCLRE1A, Accession XM_044815) is another VGAM307 host target gene. DCLRE1A BINDING SITE is HOST TARGET binding site found in the 3' untranslated region of mRNA encoded by DCLRE1A, corresponding to a HOST TARGET binding site such as BINDING SITE I, BINDING SITE II or BINDING SITE III. Table 2 illustrates the complementarity of the nucleotide sequences of DCLRE1A BINDING SITE, designated SEQ ID:34279, to the nucleotide sequence of VGAM307 RNA, herein designated VGAM RNA, also designated SEQ ID:3018.

Another function of VGAM307 is therefore inhibition of DNA Cross-link Repair 1A (PSO2 homolog, S. cerevisiae) (DCLRE1A, Accession XM_044815). Accordingly, utilities of VGAM307 include diagnosis, prevention and treatment of diseases and clinical conditions associated with DCLRE1A. FLJ31737 (Accession NM_144984) is another VGAM307 host target gene. FLJ31737 BINDING SITE is HOST TARGET binding site found in the 3" untranslated region of mRNA encoded by FLJ31737, corresponding to a HOST TARGET binding site such as BINDING SITE I, BINDING SITE II or BINDING SITE III. Table 2 illustrates the complementarity of the nucleotide sequences of FLJ31737 BINDING SITE, designated SEQ ID:29588, to the nucleotide sequence of VGAM307 RNA, herein designated VGAM RNA, also designated SEQ ID:3018.

Another function of VGAM307 is therefore inhibition of FLJ31737 (Accession NM_144984). Accordingly, utilities of VGAM307 include diagnosis, prevention and treatment of diseases and clinical conditions associated with FLJ31737. LOC145134 (Accession XM_096722) is another VGAM307 host target gene. LOC145134 BINDING SITE is HOST TARGET binding site found in the 5' untranslated region of mRNA encoded by LOC145134, corresponding to a HOST TARGET binding site such as BINDING SITE I, BINDING SITE II or BINDING SITE III. Table 2 illustrates the complementarity of the nucleotide sequences of LOC145134 BINDING SITE, designated SEQ ID:40499, to the nucleotide sequence of VGAM307 RNA, herein designated VGAM RNA, also designated SEQ ID:3018.

Another function of VGAM307 is therefore inhibition of LOC145134 (Accession XM_096722). Accordingly, utilities of VGAM307 include diagnosis, prevention and treatment of diseases and clinical conditions associated with LOC145134. FIG. 1 further provides a conceptual description of a novel bioinformatically detected viral gene of the present invention, referred to here as Viral Genomic Address Messenger 308 (VGAM308) viral gene, which modulates expression of respective host target genes thereof, the function and utility of which host target genes is known in the art.

VGAM308 is a novel bioinformatically detected regulatory, non protein coding, viral micro RNA (miRNA) gene. The method by which VGAM308 was detected is described hereinabove with reference to FIGS. 1-8.

VGAM308 gene, herein designated VGAM GENE, is a viral gene contained in the genome of Paramecium Bursaria Chlorella Virus 1. VGAM308 host target gene, herein designated VGAM HOST TARGET GENE, is a human gene contained in the human genome.

VGAM308 gene encodes a VGAM308 precursor RNA, herein designated VGAM PRECURSOR RNA. Similar to other miRNA genes, and unlike most ordinary genes, VGAM308 precursor RNA does not encode a protein. A nucleotide sequence identical or highly similar to the nucleotide sequence of VGAM308 precursor RNA is designated SEQ ID:294, and is provided hereinbelow with reference to the sequence listing part. Nucleotide sequence SEQ ID:294 is located at position 260067 relative to the genome of Paramecium Bursaria Chlorella Virus 1.

VGAM308 precursor RNA folds onto itself, forming VGAM308 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM308 folded precursor RNA into VGAM308 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM308 RNA is designated SEQ ID:3019, and is provided hereinbelow with reference to the sequence listing part.

VGAM308 host target gene, herein designated VGAM HOST TARGET GENE, encodes a corresponding messenger RNA, VGAM308 host target RNA, herein designated VGAM HOST TARGET RNA. VGAM308 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM308 RNA, herein designated VGAM RNA, binds complementarily to one or more host target binding sites located in untranslated regions of VGAM308 host target RNA, herein designated VGAM HOST TARGET RNA. This complementary binding is due to the fact that the nucleotide sequence of VGAM308 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM308 RNA, herein designated VGAM RNA, may have a different number of host target binding sites in untranslated regions of a VGAM308 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM308 RNA, herein designated VGAM RNA, to host target binding sites on VGAM308 host target RNA, herein designated VGAM HOST TARGET RNA, such as BINDING SITE I, BINDING SITE II and BINDING SITE III, inhibits translation of VGAM308 host target RNA into VGAM308 host target protein, herein designated VGAM HOST TARGET PROTEIN. VGAM host target protein is therefore outlined by a broken line.

It is appreciated that VGAM308 host target gene, herein designated VGAM HOST TARGET GENE, in fact represents a plurality of VGAM308 host target genes. The mRNA of each one of this plurality of VGAM308 host target genes comprises one or more host target binding sites, each having a nucleotide sequence which is at least partly complementary to VGAM308 RNA, herein designated VGAM RNA, and which when bound by VGAM308 RNA causes inhibition of translation of respective one or more VGAM308 host target proteins.

It is further appreciated by one skilled in the art that the mode of translational inhibition illustrated by FIG. 1 with specific reference to translational inhibition exerted by VGAM308 gene, herein designated VGAM GENE, on one or more VGAM308 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM308 is inhibition of expression of host target genes, as part of a novel viral mechanism of attacking a host. Accordingly, utilities of VGAM308 include diagnosis, prevention and treatment of viral infection by Paramecium Bursaria Chlorella Virus 1. Specific functions, and accordingly utilities, of VGAM308 correlate with, and may be deduced from, the identity of the host target genes which VGAM308 binds and inhibits, and the function of these host target genes, as elaborated hereinbelow.

Nucleotide sequences of the VGAM308 precursor RNA, herein designated VGAM PRECURSOR RNA, and of the 'diced' VGAM308 RNA, herein designated VGAM RNA, and a schematic representation of the secondary folding of VGAM308 folded precursor RNA, herein designated VGAM FOLDED PRECURSOR RNA, of VGAM308 are further described hereinbelow with reference to Table 1.

Nucleotide sequences of host target binding sites, such as BINDING SITE-I, BINDING SITE-II and BINDING SITE-III of FIG. 1, found on VGAM308 host target RNA, and schematic representation of the complementarity of each of these host target binding sites to VGAM308 RNA, herein designated VGAM RNA, are described hereinbelow with reference to Table 2.

As mentioned hereinabove with reference to FIG. 1, a function of VGAM308 gene, herein designated VGAM is inhibition of expression of VGAM308 target genes. It is appreciated that specific functions, and accordingly utilities, of VGAM308 correlate with, and may be deduced from, the identity of the target genes which VGAM308 binds and inhibits, and the function of these target genes, as elaborated hereinbelow.

Transcription Factor 12 (HTF4, helix-loop-helix transcription factors 4) (TCF12, Accession NM_003205) is a VGAM308 host target gene. TCF12 BINDING SITE is HOST TARGET binding site found in the 3' untranslated region of mRNA encoded by TCF12, corresponding to a HOST TARGET binding site such as BINDING SITE I, BINDING SITE II or BINDING SITE III. Table 2 illustrates the complementarity of the nucleotide sequences of TCF12 BINDING SITE, designated SEQ ID:9202, to the nucleotide sequence of VGAM308 RNA, herein designated VGAM RNA, also designated SEQ ID:3019.

A function of VGAM308 is therefore inhibition of Transcription Factor 12 (HTF4, helix-loop-helix transcription factors 4) (TCF12, Accession NM_003205), a gene which may play important roles during development of the nervous system as well as in other organ systems. Accordingly, utilities of VGAM308 include diagnosis, prevention and treatment of diseases and clinical conditions associated with TCF12. The function of TCF12 has been established by previous studies. A partial cDNA for HTF4 was obtained by Zhang et al. (1991) which predicted a protein that is a member of the class A basic helix-loop-helix (bHLH) family. The same cDNA, designated HEB, was cloned by Hu et al. (1992). Based on studies of the mouse and chicken cDNAs, Zhang and Bina (1992) proposed that transcripts of HTF4 can be differentially spliced to yield distinct but related proteins which are evolutionarily similar to the products of the E2A gene, also known as transcription factor 3 (TCF3; 147141). In vitro assays have shown that HTF4 can form heterodimers with other bHLH proteins of class A (e.g., OMIM Ref. No. 147141) and class B (e.g., the myogenic factors; MYF3, 159970; MYF5, 159990; and MYF6, 159991), as well as the inhibitor of DNA binding (ID1; 600349) and stem cell leukemia hematopoietic transcription factor (TAL1; 187040). In DNA binding assays, complexes of HTF4 with the myogenic factors have a relatively high affinity for the E box motifs of the mE2 (OMIM Ref. No. CACGTG) and kappa E2/muE5 (OMIM Ref. No. CACCTG) types, whereas heterodimers of HTF4 and TAL1 interact poorly (Doyle et al., 1994). These results and those obtained from transient expression studies indicated to the authors that leukemogenesis caused by TAL1 might include a pathway where TAL1 would act as a negative regulator of gene expression by forming a complex with class A bHLH proteins. Zhang et al. (1995) used a panel of somatic cell hybrids to map HTF4 to chromosome 15. By fluorescence in situ hybridization, they further localized the gene to 15q21. By Northern blot analysis, Zhang et al. (1995) showed that TCF12 is expressed, at varying levels, in many human cell lines and tissues. High levels of transcription in Jurkat cells support the view that TCF12 gene products may play a central role in T cell regulation (Hu et al., 1992; Sawada and Littman, 1993; and Doyle et al., 1994), and detection of the mRNA in human heart and skeletal muscle supports a role for TCF12 in myogenesis.

Full details of the abovementioned studies are described in the following publications, the disclosure of which are hereby incorporated by reference:

Doyle, K.; Zhang, Y.; Baer, R.; Bina, M.: Distinguishable patterns of protein-DNA interactions involving complexes of basic helix-loop-helix proteins. J. Biol. Chem. 269:12099-12105, 1994; and Zhang, Y.; Flejter, W. L.; Barcroft, C. L.; Riviere, M.; Szpirer, J.; Szpirer, C.; Bina, M.: Localization of the human HTF4 transcription factors 4 gene (TCF12) to chromosome 15q21. C.

Further studies establishing the function and utilities of TCF12 are found in John Hopkins OMIM database record ID 600480, and in sited publications numbered 9519-9524 listed in the bibliography section hereinbelow, which are also hereby incorporated by reference. Butyrophilin, Subfamily 2, Member A1 (BTN2A1, Accession NM_078476) is another VGAM308 host target gene. BTN2A1 BINDING SITE is HOST TARGET binding site found in the 3' untranslated region of mRNA encoded by BTN2A1, corresponding to a HOST TARGET binding site such as BINDING SITE I, BINDING SITE II or BINDING SITE III. Table 2 illustrates the complementarity of the nucleotide sequences of BTN2A1 BINDING SITE, designated SEQ ID:27802, to the nucleotide sequence of VGAM308 RNA, herein designated VGAM RNA, also designated SEQ ID:3019.

Another function of VGAM308 is therefore inhibition of Butyrophilin, Subfamily 2, Member A1 (BTN2A1, Accession NM_078476). Accordingly, utilities of VGAM308 include diagnosis, prevention and treatment of diseases and clinical conditions associated with BTN2A1. PP35 (Accession NM_007016) is another VGAM308 host target gene. PP35 BINDING SITE is HOST TARGET binding site found in the 3' untranslated region of mRNA encoded by PP35, corresponding to a HOST TARGET binding site such as BINDING SITE I, BINDING SITE II or BINDING SITE III. Table 2 illustrates the complementarity of the nucleotide sequences of PP35 BINDING SITE, designated SEQ ID:13872, to the nucleotide sequence of VGAM308 RNA, herein designated VGAM RNA, also designated SEQ ID:3019.

Another function of VGAM308 is therefore inhibition of PP35 (Accession NM_007016). Accordingly, utilities of VGAM308 include diagnosis, prevention and treatment of diseases and clinical conditions associated with PP35. LOC159121 (Accession XM_099028) is another VGAM308 host target gene. LOC159121 BINDING SITE is HOST TARGET binding site found in the 3' untranslated region of mRNA encoded by LOC159121, corresponding to a HOST TARGET binding site such as BINDING SITE I, BINDING SITE II or BINDING SITE III. Table 2 illustrates the complementarity of the nucleotide sequences of LOC159121 BINDING SITE, designated SEQ ID:42062, to the nucleotide sequence of VGAM308 RNA, herein designated VGAM RNA, also designated SEQ ID:3019.

Another function of VGAM308 is therefore inhibition of LOC159121 (Accession XM_099028). Accordingly, utilities of VGAM308 include diagnosis, prevention and treatment of diseases and clinical conditions associated with LOC159121. FIG. 1 further provides a conceptual description of a novel bioinformatically detected viral gene of the present invention, referred to here as Viral Genomic Address Messenger 309 (VGAM309) viral gene, which modulates expression of respective host target genes thereof, the function and utility of which host target genes is known in the art.

VGAM309 is a novel bioinformatically detected regulatory, non protein coding, viral micro RNA (miRNA) gene. The method by which VGAM309 was detected is described hereinabove with reference to FIGS. 1-8.

VGAM309 gene, herein designated VGAM GENE, is a viral gene contained in the genome of Human Herpesvirus 6. VGAM309 host target gene, herein designated VGAM HOST TARGET GENE, is a human gene contained in the human genome.

VGAM309 gene encodes a VGAM309 precursor RNA, herein designated VGAM PRECURSOR RNA. Similar to other miRNA genes, and unlike most ordinary genes, VGAM309 precursor RNA does not encode a protein. A nucleotide sequence identical or highly similar to the nucleotide sequence of VGAM309 precursor RNA is designated SEQ ID:295, and is provided hereinbelow with reference to the sequence listing part. Nucleotide sequence SEQ ID:295 is located at position 15267 relative to the genome of Human Herpesvirus 6.

VGAM309 precursor RNA folds onto itself, forming VGAM309 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM309 folded precursor RNA into VGAM309 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM309 RNA is designated SEQ ID:3020, and is provided hereinbelow with reference to the sequence listing part.

VGAM309 host target gene, herein designated VGAM HOST TARGET GENE, encodes a corresponding messenger RNA, VGAM309 host target RNA, herein designated VGAM HOST TARGET RNA. VGAM309 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM309 RNA, herein designated VGAM RNA, binds complementarily to one or more host target binding sites located in untranslated regions of VGAM309 host target RNA, herein designated VGAM HOST TARGET RNA. This complementary binding is due to the fact that the nucleotide sequence of VGAM309 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM309 RNA, herein designated VGAM RNA, may have a different number of host target binding sites in untranslated regions of a VGAM309 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM309 RNA, herein designated VGAM RNA, to host target binding sites on VGAM309 host target RNA, herein designated VGAM HOST TARGET RNA, such as BINDING SITE I, BINDING SITE II and BINDING SITE III, inhibits translation of VGAM309 host target RNA into VGAM309 host target protein, herein designated VGAM HOST TARGET PROTEIN. VGAM host target protein is therefore outlined by a broken line.

It is appreciated that VGAM309 host target gene, herein designated VGAM HOST TARGET GENE, in fact represents a plurality of VGAM309 host target genes. The mRNA of each one of this plurality of VGAM309 host target genes comprises one or more host target binding sites, each having a nucleotide sequence which is at least partly complementary to VGAM309 RNA, herein designated VGAM RNA, and which when bound by VGAM309 RNA causes inhibition of translation of respective one or more VGAM309 host target proteins.

It is further appreciated by one skilled in the art that the mode of translational inhibition illustrated by FIG. 1 with specific reference to translational inhibition exerted by VGAM309 gene, herein designated VGAM GENE, on one or more VGAM309 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM309 is inhibition of expression of host target genes, as part of a novel viral mechanism of attacking a host. Accordingly, utilities of VGAM309 include diagnosis, prevention and treatment of viral infection by Human Herpesvirus 6. Specific functions, and accordingly utilities, of VGAM309 correlate with, and may be deduced from, the identity of the host target genes which VGAM309 binds and inhibits, and the function of these host target genes, as elaborated hereinbelow.

Nucleotide sequences of the VGAM309 precursor RNA, herein designated VGAM PRECURSOR RNA, and of the 'diced' VGAM309 RNA, herein designated VGAM RNA, and a schematic representation of the secondary folding of VGAM309 folded precursor RNA, herein designated VGAM FOLDED PRECURSOR RNA, of VGAM309 are further described hereinbelow with reference to Table 1.

Nucleotide sequences of host target binding sites, such as BINDING SITE-I, BINDING SITE-II and BINDING SITE-III of FIG. 1, found on VGAM309 host target RNA, and schematic representation of the complementarity of each of these host target binding sites to VGAM309 RNA, herein designated VGAM RNA, are described hereinbelow with reference to Table 2.

As mentioned hereinabove with reference to FIG. 1, a function of VGAM309 gene, herein designated VGAM is inhibition of expression of VGAM309 target genes. It is appreciated that specific functions, and accordingly utilities, of VGAM309 correlate with, and may be deduced from, the identity of the target genes which VGAM309 binds and inhibits, and the function of these target genes, as elaborated hereinbelow.

Frizzled Homolog 4 (Drosophila) (FZD4, Accession NM_012193) is a VGAM309 host target gene. FZD4 BINDING SITE is HOST TARGET binding site found in the 3' untranslated region of mRNA encoded by FZD4, corresponding to a HOST TARGET binding site such as BINDING SITE I, BINDING SITE II or BINDING SITE III. Table 2 illustrates the complementarity of the nucleotide sequences of FZD4 BINDING SITE, designated SEQ ID:14487, to the nucleotide sequence of VGAM309 RNA, herein designated VGAM RNA, also designated SEQ ID:3020.

A function of VGAM309 is therefore inhibition of Frizzled Homolog 4 (Drosophila) (FZD4, Accession NM_012193), a gene which may function in cell polarity, cell fate specification and cancer; similar to frizzled receptor family, has seven transmembrane domains. Accordingly, utilities of VGAM309 include diagnosis, prevention and treatment of diseases and clinical conditions associated with FZD4. The function of FZD4 has been established by previous studies. Members of the 'frizzled' (FZ) gene family (see OMIM Ref. No. 601766) encode 7-transmembrane domain proteins that are receptors for Wnt (see OMIM Ref. No. 164975) signaling proteins. By screening a human fetal lung cDNA library with an FZD4 cDNA fragment isolated from a human gastric cancer cDNA pool, Kirikoshi et al. (1999) obtained a full-length cDNA of FZD4. FZD4 encodes a deduced 537-amino acid protein that has a cysteine-rich domain in the N-terminal extracellular region, 2 cysteine residues in the second and third extracellular loops, 2 N-linked glycosylation extracellular sites, and the S/T-X-V motif in the C terminus. Amino acid sequence identity with other FZD proteins ranged from 39 to 52% in the N terminus to 42 to 69% in the transmembrane domains. Northern blot analysis revealed expression of a 7.7-kb transcript in large amounts in adult heart, skeletal muscle, ovary, and fetal kidney, in moderate amounts in adult liver, kidney, pancreas, spleen, and fetal lung, and in small amounts in placenta, adult lung, prostate, testis, colon, fetal brain, and liver. Expression was also strong in HeLa cells but not in several cancer cell lines. Familial exudative vitreoretinopathy (FEVR) is a hereditary ocular disorder characterized by a failure of peripheral retinal vascularization. Loci associated with FEVR map to 11q13-q23 (EVR1; 133780), Xp11.4 (EVR2; 305390), and 11p13-p12 (EVR3; 605750). In a large Canadian family of British descent, Robitaille et al. (2002) demonstrated linkage to 11q13-q23 for autosomal dominant FEVR and refined the disease locus to a genomic region spanning 1.55 Mb. The region contained the FZD4 gene, which they subjected to mutation search and identified in affected individuals a deletion of 6 nucleotides, 1479-1484, resulting in deletion of 2 highly conserved amino acids, met493 and trp494. In a second small family they found a deletion of 2 nucleotides, 1501-1502, that resulted in a frameshift at leu501, creating a stop codon at residue 533. Both mutations were located in exon 2 and altered the seventh transmembrane domain and the intracellular carboxy-terminal tail, respectively. No mutations in FZD4 were detected in 3 other small families with FEVR. Robitaille et al. (2002) presented data indicating that the changes in FZD4 in these families with autosomal dominant FEVR represented loss of function mutations.

Full details of the abovementioned studies are described in the following publications, the disclosure of which are hereby incorporated by reference:

Kirikoshi, H.; Sagara, N.; Koike, J.; Tanaka, K.; Sekihara, H.; Hirai, M.; Katoh, M.: Molecular cloning and characterization of human frizzled-4 on chromosome 11q14-q21. Biochem. Biophys. Res. Commun. 264:955-961, 1999; and Robitaille, J.; MacDonald, M. L. E.; Kaykas, A.; Sheldahl, L. C.; Zeisler, J.; Dube, M.-P.; Zhang, L.-H.; Singaraja, R. R.; Guernsey, D. L.; Zhang, B.; Siebert, L. F.; Hoskin-Mott, A.

Further studies establishing the function and utilities of FZD4 are found in John Hopkins OMIM database record ID 604579, and in sited publications numbered 493 and 4941 listed in the bibliography section hereinbelow, which are also hereby incorporated by reference. Neuropeptide Y Receptor Y2 (NPY2R, Accession NM_000910) is another VGAM309 host target gene. NPY2R BINDING SITE is HOST TARGET binding site found in the 3' untranslated region of mRNA encoded by NPY2R, corresponding to a HOST TARGET binding site such as BINDING SITE I, BINDING SITE II or BINDING SITE III. Table 2 illustrates the complementarity of the nucleotide sequences of NPY2R BINDING SITE, designated SEQ ID:6610, to the nucleotide sequence of VGAM309 RNA, herein designated VGAM RNA, also designated SEQ ID:3020.

Another function of VGAM309 is therefore inhibition of Neuropeptide Y Receptor Y2 (NPY2R, Accession NM_000910), a gene which stimulates intracellular calcium flux and may modulate psychomotor activity, food intake, endocrine secretion and vasoconstriction. Accordingly, utilities of VGAM309 include diagnosis, prevention and treatment of diseases and clinical conditions associated with NPY2R. The function of NPY2R has been established by previous studies. Neuropeptide Y (NPY) signals through a family of G protein-coupled receptors present in the brain and sympathetic neurons. At least 3 types of neuropeptide Y receptor have been defined on the basis of pharmacologic criteria, tissue distribution, and structure of the encoding gene; see 162641 and 162643. Rose et al. (1995) reported the expression cloning in COS cells of a cDNA for the human type 2 receptor, NPY2R. Transfected cells showed high affinity for NPY (OMIM Ref. No. 162640), peptide YY (PYY; 600781), and a fragment of NPY including amino acids 13 to 36. The predicted 381-amino acid protein has 7 transmembrane domains characteristic of G protein-coupled receptors and is only 31% identical to the human Y1 receptor (NPY1R; 162641). A 4-kb mRNA was detected on Northern blots of tissue samples from several regions of the nervous system. Gerald et al. (1995) cloned the cDNA corresponding to the human Y2 receptor from a human hippocampal cDNA expression library using a radiolabeled PYY-binding assay. They expressed the Y2 gene in COS-7 cells and performed a hormone-binding assay which showed that the Y2 receptor binds (from highest to lowest affinity) PYY, NPY, and pancreatic polypeptide (PP; 167780) hormones.

Full details of the abovementioned studies are described in the following publications, the disclosure of which are hereby incorporated by reference:

Gerald, C.; Walker, M. W.; Vaysse, P. J.-J.; He, C.; Branchek, T. A.; Weinshank, R. L.: Expression cloning and pharmacological characterization of a human hippocampal neuropeptide Y/peptide YY Y2 receptor subtype. J. Biol. Chem. 270: 26758-26761, 1995; and Rose, P. M.; Fernandes, P.; Lynch, J. S.; Frazier, S. T.; Fisher, S. M.; Kodukula, K.; Kienzle, B.; Seethala, R.: Cloning and functional expression of a cDNA encoding a human type 2 ne.

Further studies establishing the function and utilities of NPY2R are found in John Hopkins OMIM database record ID 162642, and in sited publications numbered 3220-322 and 3218 listed in the bibliography section hereinbelow, which are also hereby incorporated by reference.2'-5'-oligoadenylate Synthetase 3, 100 kDa (OAS3, Accession NM_006187) is another VGAM309 host target gene. OAS3 BINDING SITE is HOST TARGET binding site found in the 3' untranslated region of mRNA encoded by OAS3, corresponding to a HOST TARGET binding site such as BINDING SITE I, BINDING SITE II or BINDING SITE III. Table 2 illustrates the complementarity of the nucleotide sequences of OAS3 BINDING SITE, designated SEQ ID:12860, to the nucleotide sequence of VGAM309 RNA, herein designated VGAM RNA, also designated SEQ ID:3020.

Another function of VGAM309 is therefore inhibition of 2'-5'-oligoadenylate Synthetase 3, 100 kDa (OAS3, Accession NM_006187), a gene which may play a role in mediating resistance to virus infection, control of cell growth, differentiation, and apoptosis. Accordingly, utilities of VGAM309 include diagnosis, prevention and treatment of diseases and clinical conditions associated with OAS3. The function of OAS3 has been established by previous studies. The 2-prime, 5-prime oligoadenylate synthetases (OASs) are interferon-induced proteins characterized by their capacity to catalyze the synthesis of 2-prime,5-prime oligomers of adenosine (2-5As). See OAS1 (OMIM Ref. No. 164350). Hovanessian et al. (1987) found that interferon-treated human cells contain several OASs corresponding to proteins of 40 (OAS1), 46 (OAS1), 69 (OAS2; 603350), and 100 kD. Hovnanian et al. (1998) reported that the predicted OAS3, or p100, protein contains 3 adjacent OAS1-like domains. The domains share 44 to 60% protein sequence similarity with each other and 42 to 60% sequence identity with the conserved domain of OAS1. The authors noted that OAS1, OAS2, and OAS3 contain 1, 2, and 3 conserved OAS domains or units, respectively. Northern blot analysis revealed that OAS3 is expressed as a 7-kb interferon-induced mRNA in HeLa cells. By fluorescence in situ hybridization and by inclusion within mapped clones, Hovnanian et al. (1998) determined that the OAS1, OAS2, and OAS3 genes are clustered with a 130-kb region on 12q24.2.

Full details of the abovementioned studies are described in the following publications, the disclosure of which are hereby incorporated by reference:

Hovanessian, A. G.; Laurent, A. G.; Chebath, J.; Galabru, J.; Robert, N.; Svab, J. : Identification of 69-kd and 100-kd forms of 2-5A synthetase in interferon-treated human cells by specific monoclonal antibodies. EMBO J. 6: 1273-1280, 1987; and Hovnanian, A.; Rebouillat, D.; Mattei, M.-G.; Levy, E. R.; Marie, I.; Monaco, A. P.; Hovanessian, A. G.: The human 2-prime,5-prime-oligoadenylate synthetase locus is composed of three.

Further studies establishing the function and utilities of OAS3 are found in John Hopkins OMIM database record ID 603351, and in sited publications numbered 8009 listed in the bibliography section hereinbelow, which are also hereby incorporated by reference. DKFZP564O1664 (Accession NM_030800) is another VGAM309 host target gene. DKFZP564O1664 BINDING SITE is HOST TARGET binding site found in the 3' untranslated region of mRNA encoded by DKFZP564O1664, corresponding to a HOST TARGET binding site such as BINDING SITE I, BINDING SITE II or BINDING SITE III. Table 2 illustrates the complementarity of the nucleotide sequences of DKFZP564O1664 BINDING SITE, designated SEQ ID:25102, to the nucleotide sequence of VGAM309 RNA, herein designated VGAM RNA, also designated SEQ ID:3020.

Another function of VGAM309 is therefore inhibition of DKFZP564O1664 (Accession NM_030800). Accordingly, utilities of VGAM309 include diagnosis, prevention and treatment of diseases and clinical conditions associated with DKFZP564O1664. FLJ12800 (Accession NM_022903) is another VGAM309 host target gene. FLJ12800 BINDING SITE is HOST TARGET binding site found in the 3' untranslated region of mRNA encoded by FLJ12800, corresponding to a HOST TARGET binding site such as BINDING SITE I, BINDING SITE II or BINDING SITE III. Table 2 illustrates the complementarity of the nucleotide sequences of FLJ12800 BINDING SITE, designated SEQ ID:23194, to the nucleotide sequence of VGAM309 RNA, herein designated VGAM RNA, also designated SEQ ID:3020.

Another function of VGAM309 is therefore inhibition of FLJ12800 (Accession NM_022903). Accordingly, utilities of VGAM309 include diagnosis, prevention and treatment of diseases and clinical conditions associated with FLJ12800. FLJ21459 (Accession NM_024521) is another VGAM309 host target gene. FLJ21459 BINDING SITE is HOST TARGET binding site found in the 3' untranslated region of mRNA encoded by FLJ21459, corresponding to a HOST TARGET binding site such as BINDING SITE I, BINDING SITE II or BINDING SITE III. Table 2 illustrates the complementarity of the nucleotide sequences of FLJ21459 BINDING SITE, designated SEQ ID:23720, to the nucleotide sequence of VGAM309 RNA, herein designated VGAM RNA, also designated SEQ ID:3020.

Another function of VGAM309 is therefore inhibition of FLJ21459 (Accession NM_024521). Accordingly, utilities of VGAM309 include diagnosis, prevention and treatment of diseases and clinical conditions associated with FLJ21459. KIAA0329 (Accession NM_014844) is another VGAM309 host target gene. KIAA0329 BINDING SITE is HOST TARGET binding site found in the 3' untranslated region of mRNA encoded by KIAA0329, corresponding to a HOST TARGET binding site such as BINDING SITE I, BINDING SITE II or BINDING SITE III. Table 2 illustrates the complementarity of the nucleotide sequences of KIAA0329 BINDING SITE, designated SEQ ID:16878, to the nucleotide sequence of VGAM309 RNA, herein designated VGAM RNA, also designated SEQ ID:3020.

Another function of VGAM309 is therefore inhibition of KIAA0329 (Accession NM_014844). Accordingly, utilities of VGAM309 include diagnosis, prevention and treatment of diseases and clinical conditions associated with KIAA0329. KIAA1416 (Accession XM_098762) is another VGAM309 host target gene. KIAA1416 BINDING SITE is HOST TARGET binding site found in the 3' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41806, to the nucleotide sequence of VGAM309 RNA, herein designated VGAM RNA, also designated SEQ ID:3020.

Another function of VGAM309 is therefore inhibition of KIAA1416 (Accession XM_098762). Accordingly, utilities of VGAM309 include diagnosis, prevention and treatment of diseases and clinical conditions associated with KIAA1416. SDF1 (Accession XM_165565) is another VGAM309 host target gene. SDF1 BINDING SITE is HOST TARGET binding site found in the 3' untranslated region of mRNA encoded by SDF1, corresponding to a HOST TARGET binding site such as BINDING SITE I, BINDING SITE II or BINDING SITE III. Table 2 illustrates the complementarity of the nucleotide sequences of SDF1 BINDING SITE, designated SEQ ID:43688, to the nucleotide sequence of VGAM309 RNA, herein designated VGAM RNA, also designated SEQ ID:3020.

Another function of VGAM309 is therefore inhibition of SDF1 (Accession XM_165565). Accordingly, utilities of VGAM309 include diagnosis, prevention and treatment of diseases and clinical conditions associated with SDF1. LOC146667 (Accession XM_097044) is another VGAM309 host target gene. LOC146667 BINDING SITE is HOST TARGET binding site found in the 5' untranslated region of mRNA encoded by LOC146667, corresponding to a HOST TARGET binding site such as BINDING SITE I, BINDING SITE II or BINDING SITE III. Table 2 illustrates the complementarity of the nucleotide sequences of LOC146667 BINDING SITE, designated SEQ ID:40711, to the nucleotide sequence of VGAM309 RNA, herein designated VGAM RNA, also designated SEQ ID:3020.

Another function of VGAM309 is therefore inhibition of LOC146667 (Accession XM_097044). Accordingly, utilities of VGAM309 include diagnosis, prevention and treatment of diseases and clinical conditions associated with LOC146667. LOC153937 (Accession XM_087813) is another VGAM309 host target gene. LOC153937 BINDING SITE is HOST TARGET binding site found in the 3' untranslated region of mRNA encoded by LOC153937, corresponding to a HOST TARGET binding site such as BINDING SITE I, BINDING SITE II or BINDING SITE III. Table 2 illustrates the complementarity of the nucleotide sequences of LOC153937 BIND- ING SITE, designated SEQ ID:39446, to the nucleotide sequence of VGAM309 RNA, herein designated VGAM RNA, also designated SEQ ID:3020.

Another function of VGAM309 is therefore inhibition of LOC153937 (Accession XM_087813). Accordingly, utilities of VGAM309 include diagnosis, prevention and treatment of diseases and clinical conditions associated with LOC153937. LOC254057 (Accession XM_173085) is another VGAM309 host target gene. LOC254057 BINDING SITE is HOST TARGET binding site found in the 3' untranslated region of mRNA encoded by LOC254057, corresponding to a HOST TARGET binding site such as BINDING SITE I, BINDING SITE II or BINDING SITE III. Table 2 illustrates the complementarity of the nucleotide sequences of LOC254057 BINDING SITE, designated SEQ ID:46346, to the nucleotide sequence of VGAM309 RNA, herein designated VGAM RNA, also designated SEQ ID:3020.

Another function of VGAM309 is therefore inhibition of LOC254057 (Accession XM_173085). Accordingly, utilities of VGAM309 include diagnosis, prevention and treatment of diseases and clinical conditions associated with LOC254057. LOC91050 (Accession XM_035703) is another VGAM309 host target gene. LOC91050 BINDING SITE is HOST TARGET binding site found in the 3' untranslated region of mRNA encoded by LOC91050, corresponding to a HOST TARGET binding site such as BINDING SITE I, BINDING SITE II or BINDING SITE III. Table 2 illustrates the complementarity of the nucleotide sequences of LOC91050 BINDING SITE, designated SEQ ID:32336, to the nucleotide sequence of VGAM309 RNA, herein designated VGAM RNA, also designated SEQ ID:3020.

Another function of VGAM309 is therefore inhibition of LOC91050 (Accession XM_035703). Accordingly, utilities of VGAM309 include diagnosis, prevention and treatment of diseases and clinical conditions associated with LOC91050. FIG. 1 further provides a conceptual description of a novel bioinformatically detected viral gene of the present invention, referred to here as Viral Genomic Address Messenger 310 (VGAM310) viral gene, which modulates expression of respective host target genes thereof, the function and utility of which host target genes is known in the art.

VGAM310 is a novel bioinformatically detected regulatory, non protein coding, viral micro RNA (miRNA) gene. The method by which VGAM310 was detected is described hereinabove with reference to FIGS. 1-8.

VGAM310 gene, herein designated VGAM GENE, is a viral gene contained in the genome of Pothos Latent Virus. VGAM310 host target gene, herein designated VGAM HOST TARGET GENE, is a human gene contained in the human genome.

VGAM310 gene encodes a VGAM310 precursor RNA, herein designated VGAM PRECURSOR RNA. Similar to other miRNA genes, and unlike most ordinary genes, VGAM310 precursor RNA does not encode a protein. A nucleotide sequence identical or highly similar to the nucleotide sequence of VGAM310 precursor RNA is designated SEQ ID:296, and is provided hereinbelow with reference to the sequence listing part. Nucleotide sequence SEQ ID:296 is located at position 512 relative to the genome of Pothos Latent Virus.

VGAM310 precursor RNA folds onto itself, forming VGAM310 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM310 folded precursor RNA into VGAM310 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM310 RNA is designated SEQ ID:3021, and is provided hereinbelow with reference to the sequence listing part.

VGAM310 host target gene, herein designated VGAM HOST TARGET GENE, encodes a corresponding messenger RNA, VGAM310 host target RNA, herein designated VGAM HOST TARGET RNA. VGAM310 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM310 RNA, herein designated VGAM RNA, binds complementarily to one or more host target binding sites located in untranslated regions of VGAM310 host target RNA, herein designated VGAM HOST TARGET RNA. This complementary binding is due to the fact that the nucleotide sequence of VGAM310 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM310 RNA, herein designated VGAM RNA, may have a different number of host target binding sites in untranslated regions of a VGAM310 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM310 RNA, herein designated VGAM RNA, to host target binding sites on VGAM310 host target RNA, herein designated VGAM HOST TARGET RNA, such as BINDING SITE I, BINDING SITE II and BINDING SITE III, inhibits translation of VGAM310 host target RNA into VGAM310 host target protein, herein designated VGAM HOST TARGET PROTEIN. VGAM host target protein is therefore outlined by a broken line.

It is appreciated that VGAM310 host target gene, herein designated VGAM HOST TARGET GENE, in fact represents a plurality of VGAM310 host target genes. The mRNA of each one of this plurality of VGAM310 host target genes comprises one or more host target binding sites, each having a nucleotide sequence which is at least partly complementary to VGAM310 RNA, herein designated VGAM RNA, and which when bound by VGAM310 RNA causes inhibition of translation of respective one or more VGAM310 host target proteins.

It is further appreciated by one skilled in the art that the mode of translational inhibition illustrated by FIG. 1 with specific reference to translational inhibition exerted by VGAM310 gene, herein designated VGAM GENE, on one or more VGAM310 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM310 is inhibition of expression of host target genes, as part of a novel viral mechanism of attacking a host. Accordingly, utilities of VGAM310 include diagnosis, prevention and treatment of viral infection by Pothos Latent Virus. Specific functions, and accordingly utilities, of VGAM310 correlate with, and may be deduced from, the identity of the host target genes which VGAM310 binds and inhibits, and the function of these host target genes, as elaborated hereinbelow.

Nucleotide sequences of the VGAM310 precursor RNA, herein designated VGAM PRECURSOR RNA, and of the 'diced' VGAM310 RNA, herein designated VGAM RNA, and a schematic representation of the secondary folding of VGAM310 folded precursor RNA, herein designated VGAM FOLDED PRECURSOR RNA, of VGAM310 are further described hereinbelow with reference to Table 1.

Nucleotide sequences of host target binding sites, such as BINDING SITE-I, BINDING SITE-II and BINDING SITE-III of FIG. 1, found on VGAM310 host target RNA, and schematic representation of the complementarity of each of these host target binding sites to VGAM310 RNA, herein designated VGAM RNA, are described hereinbelow with reference to Table 2.

As mentioned hereinabove with reference to FIG. 1, a function of VGAM310 gene, herein designated VGAM is inhibition of expression of VGAM310 target genes. It is appreciated that specific functions, and accordingly utilities, of VGAM310 correlate with, and may be deduced from, the identity of the target genes which VGAM310 binds and inhibits, and the function of these target genes, as elaborated hereinbelow.

Inositol 1,4,5-triphosphate Receptor, Type 3 (ITPR3, Accession NM_002224) is a VGAM310 host target gene. ITPR3 BINDING SITE is HOST TARGET binding site found in the 3' untranslated region of mRNA encoded by ITPR3, corresponding to a HOST TARGET binding site such as BINDING SITE I, BINDING SITE II or BINDING SITE III. Table 2 illustrates the complementarity of the nucleotide sequences of ITPR3 BINDING SITE, designated SEQ ID:7996, to the nucleotide sequence of VGAM310 RNA, herein designated VGAM RNA, also designated SEQ ID:3021.

A function of VGAM310 is therefore inhibition of Inositol 1,4,5-triphosphate Receptor, Type 3 (ITPR3, Accession NM_002224), a gene which may be responsible for calcium release from intracellular stores. Accordingly, utilities of VGAM310 include diagnosis, prevention and treatment of diseases and clinical conditions associated with ITPR3. The function of ITPR3 has been established by previous studies. See 147265. Ozcelik et al. (1991) found that a cDNA probe for ITPR3 hybridized to DNA from hybrid cells containing human chromosome 6. In one hybrid that carried 6pter-p21, in the absence of an intact copy of this chromosome, hybridization was observed, thus mapping the gene to 6pter-p21. ITPR3 transduces many hormonal signals that regulate Ca (2+)-dependent processes in the intestinal epithelium. Maranto (1994) described complete sequence of the ITPR3 polypeptide (2,671 amino acids). Primary structure analysis indicated a pattern of conserved and variable regions, characteristic of the particular gene family. Immunocytochemical localization in the intestine was determined. Yamamoto-Hino et al. (1994) likewise mapped the ITPR3 gene to chromosome 6, specifically to 6p21, by isotopic in situ hybridization. They showed that the type 3 receptor was present in all hematopoietic and lymphoma cell lines tested Full details of the abovementioned studies are described in the following publications, the disclosure of which are hereby incorporated by reference:

Maranto, A. R.: Primary structure, ligand binding, and localization of the human type 3 inositol 1,4,5-trisphosphate receptor expressed in intestinal epithelium. J. Biol. Chem. 269:1222-1230, 1994; and Ozcelik, T.; Suedhof, T. C.; Francke, U.: The genes for inositol 1,4,5-triphosphate receptors 1 (ITPR1) and 3 (ITPR3) are localized on human chromosomes 3p and 6pter-p21, respectively.

Further studies establishing the function and utilities of ITPR3 are found in John Hopkins OMIM database record ID 147267, and in sited publications numbered 4821-4823 listed in the bibliography section hereinbelow, which are also hereby incorporated by reference. Microtubule-associated Protein, RP/EB Family, Member 2 (MAPRE2, Accession NM_014268) is another VGAM310 host target gene. MAPRE2 BINDING SITE is HOST TARGET binding site found in the 3' untranslated region of mRNA encoded by MAPRE2, corresponding to a HOST TARGET binding site such as BINDING SITE I, BINDING SITE II or BINDING SITE III. Table 2 illustrates the complementarity of the nucleotide sequences of MAPRE2 BINDING SITE, designated SEQ ID:15547, to the nucleotide sequence of VGAM310 RNA, herein designated VGAM RNA, also designated SEQ ID:3021.

Another function of VGAM310 is therefore inhibition of Microtubule-associated Protein, RP/EB Family, Member 2 (MAPRE2, Accession NM_014268), a gene which The functional inactivation of the APC gene product is a key event in colorectal tumorigenesis. Accordingly, utilities of VGAM310 include diagnosis, prevention and treatment of diseases and clinical conditions associated with MAPRE2. The function of MAPRE2 and its association with various diseases and clinical conditions, has been established by previous studies, as described hereinabove with reference to VGAM178. Ribosomal Protein L15 (RPL15, Accession NM_002948) is another VGAM310 host target gene. RPL15 BINDING SITE is HOST TARGET binding site found in the 3' untranslated region of mRNA encoded by RPL15, corresponding to a HOST TARGET binding site such as BINDING SITE I, BINDING SITE II or BINDING SITE III. Table 2 illustrates the complementarity of the nucleotide sequences of RPL15 BINDING SITE, designated SEQ ID:8859, to the nucleotide sequence of VGAM310 RNA, herein designated VGAM RNA, also designated SEQ ID:3021.

Another function of VGAM310 is therefore inhibition of Ribosomal Protein L15 (RPL15, Accession NM_002948). Accordingly, utilities of VGAM310 include diagnosis, prevention and treatment of diseases and clinical conditions associated with RPL15. FLJ10737 (Accession NM_018198) is another VGAM310 host target gene. FLJ10737 BINDING SITE is HOST TARGET binding site found in the 3' untranslated region of mRNA encoded by FLJ10737, corresponding to a HOST TARGET binding site such as BINDING SITE I, BINDING SITE II or BINDING SITE III. Table 2 illustrates the complementarity of the nucleotide sequences of FLJ10737 BINDING SITE, designated SEQ ID:20065, to the nucleotide sequence of VGAM310 RNA, herein designated VGAM RNA, also designated SEQ ID:3021.

Another function of VGAM310 is therefore inhibition of FLJ10737 (Accession NM_018198). Accordingly, utilities of VGAM310 include diagnosis, prevention and treatment of diseases and clinical conditions associated with FLJ10737. Hyaluronan Binding Protein 2 (HABP2, Accession NM_004132) is another VGAM310 host target gene. HABP2 BINDING SITE is HOST TARGET binding site found in the 3' untranslated region of mRNA encoded by HABP2, corresponding to a HOST TARGET binding site such as BINDING SITE I, BINDING SITE II or BINDING SITE III. Table 2 illustrates the complementarity of the nucleotide sequences of HABP2 BINDING SITE, designated SEQ ID:10343, to the nucleotide sequence of VGAM310 RNA, herein designated VGAM RNA, also designated SEQ ID:3021.

Another function of VGAM310 is therefore inhibition of Hyaluronan Binding Protein 2 (HABP2, Accession NM_004132). Accordingly, utilities of VGAM310 include diagnosis, prevention and treatment of diseases and clinical conditions associated with HABP2. KIAA0553 (Accession XM_045981) is another VGAM310 host target gene. KIAA0553 BINDING SITE is HOST TARGET binding site found in the 3' untranslated region of mRNA encoded by KIAA0553, corresponding to a HOST TARGET binding site such as BINDING SITE I, BINDING SITE II or BINDING SITE III. Table 2 illustrates the complementarity of the nucleotide sequences of KIAA0553 BINDING SITE, designated SEQ ID:34637, to the nucleotide sequence of VGAM310 RNA, herein designated VGAM RNA, also designated SEQ ID:3021.

Another function of VGAM310 is therefore inhibition of KIAA0553 (Accession XM_045981). Accordingly, utilities of VGAM310 include diagnosis, prevention and treatment of diseases and clinical conditions associated with KIAA0553. LOC221839 (Accession XM_166506) is another VGAM310 host target gene. LOC221839 BINDING SITE is HOST TARGET binding site found in the 5' untranslated region of mRNA encoded by LOC221839, corresponding to a HOST TARGET binding site such as BINDING SITE I, BINDING SITE II or BINDING SITE III. Table 2 illustrates the complementarity of the nucleotide sequences of LOC221839 BINDING SITE, designated SEQ ID:44432, to the nucleotide sequence of VGAM310 RNA, herein designated VGAM RNA, also designated SEQ ID:3021.

Another function of VGAM310 is therefore inhibition of LOC221839 (Accession XM_166506). Accordingly, utilities of VGAM310 include diagnosis, prevention and treatment of diseases and clinical conditions associated with LOC221839. LOC92305 (Accession NM_138385) is another VGAM310 host target gene. LOC92305 BINDING SITE is HOST TARGET binding site found in the 3' untranslated region of mRNA encoded by LOC92305, corresponding to a HOST TARGET binding site such as BINDING SITE I, BINDING SITE II or BINDING SITE III. Table 2 illustrates the complementarity of the nucleotide sequences of LOC92305 BINDING SITE, designated SEQ ID:28758, to the nucleotide sequence of VGAM310 RNA, herein designated VGAM RNA, also designated SEQ ID:3021.

Another function of VGAM310 is therefore inhibition of LOC92305 (Accession NM_138385). Accordingly, utilities of VGAM310 include diagnosis, prevention and treatment of diseases and clinical conditions associated with LOC92305. FIG. 1 further provides a conceptual description of a novel bioinformatically detected viral gene of the present invention, referred to here as Viral Genomic Address Messenger 311 (VGAM311) viral gene, which modulates expression of respective host target genes thereof, the function and utility of which host target genes is known in the art.

VGAM311 is a novel bioinformatically detected regulatory, non protein coding, viral micro RNA (miRNA) gene. The method by which VGAM311 was detected is described hereinabove with reference to FIGS. 1-8.

VGAM311 gene, herein designated VGAM GENE, is a viral gene contained in the genome of Pothos Latent Virus. VGAM311 host target gene, herein designated VGAM HOST TARGET GENE, is a human gene contained in the human genome.

VGAM311 gene encodes a VGAM311 precursor RNA, herein designated VGAM PRECURSOR RNA. Similar to other miRNA genes, and unlike most ordinary genes, VGAM311 precursor RNA does not encode a protein. A nucleotide sequence identical or highly similar to the nucleotide sequence of VGAM311 precursor RNA is designated SEQ ID:297, and is provided hereinbelow with reference to the sequence listing part. Nucleotide sequence SEQ ID:297 is located at position 2180 relative to the genome of Pothos Latent Virus.

VGAM311 precursor RNA folds onto itself, forming VGAM311 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM311 folded precursor RNA into VGAM311 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM311 RNA is designated SEQ ID:3022, and is provided hereinbelow with reference to the sequence listing part.

VGAM311 host target gene, herein designated VGAM HOST TARGET GENE, encodes a corresponding messenger RNA, VGAM311 host target RNA, herein designated VGAM HOST TARGET RNA. VGAM311 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM311 RNA, herein designated VGAM RNA, binds complementarily to one or more host target binding sites located in untranslated regions of VGAM311 host target RNA, herein designated VGAM HOST TARGET RNA. This complementary binding is due to the fact that the nucleotide sequence of VGAM311 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM311 RNA, herein designated VGAM RNA, may have a different number of host target binding sites in untranslated regions of a VGAM311 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM311 RNA, herein designated VGAM RNA, to host target binding sites on VGAM311 host target RNA, herein designated VGAM HOST TARGET RNA, such as BINDING SITE I, BINDING SITE II and BINDING SITE III, inhibits translation of VGAM311 host target RNA into VGAM311 host target protein, herein designated VGAM HOST TARGET PROTEIN. VGAM host target protein is therefore outlined by a broken line.

It is appreciated that VGAM311 host target gene, herein designated VGAM HOST TARGET GENE, in fact represents a plurality of VGAM311 host target genes. The mRNA of each one of this plurality of VGAM311 host target genes comprises one or more host target binding sites, each having a nucleotide sequence which is at least partly complementary to VGAM311 RNA, herein designated VGAM RNA, and which when bound by VGAM311 RNA causes inhibition of translation of respective one or more VGAM311 host target proteins.

It is further appreciated by one skilled in the art that the mode of translational inhibition illustrated by FIG. 1 with specific reference to translational inhibition exerted by VGAM311 gene, herein designated VGAM GENE, on one or more VGAM311 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM311 is inhibition of expression of host target genes, as part of a novel viral mechanism of attacking a host. Accordingly, utilities of VGAM311 include diagnosis, prevention and treatment of viral infection by Pothos Latent Virus. Specific functions, and accordingly utilities, of VGAM311 correlate with, and may be deduced from, the identity of the host target genes which VGAM311 binds and inhibits, and the function of these host target genes, as elaborated hereinbelow.

Nucleotide sequences of the VGAM311 precursor RNA, herein designated VGAM PRECURSOR RNA, and of the 'diced' VGAM311 RNA, herein designated VGAM RNA, and a schematic representation of the secondary folding of VGAM311 folded precursor RNA, herein designated VGAM FOLDED PRECURSOR RNA, of VGAM311 are further described hereinbelow with reference to Table 1.

Nucleotide sequences of host target binding sites, such as BINDING SITE-I, BINDING SITE-II and BINDING SITE-III of FIG. 1, found on VGAM311 host target RNA, and schematic representation of the complementarity of each of these host target binding sites to VGAM311 RNA, herein designated VGAM RNA, are described hereinbelow with reference to Table 2.

As mentioned hereinabove with reference to FIG. 1, a function of VGAM311 gene, herein designated VGAM is inhibition of expression of VGAM311 target genes. It is appreciated that specific functions, and accordingly utilities, of VGAM311 correlate with, and may be deduced from, the identity of the target genes which VGAM311 binds and inhibits, and the function of these target genes, as elaborated hereinbelow.

FLJ20276 (Accession NM_017738) is a VGAM311 host target gene. FLJ20276 BINDING SITE is HOST TARGET binding site found in the 3' untranslated region of mRNA encoded by FLJ20276, corresponding to a HOST TARGET binding site such as BINDING SITE I, BINDING SITE II or BINDING SITE III. Table 2 illustrates the complementarity of the nucleotide sequences of FLJ20276 BINDING SITE, designated SEQ ID:19329, to the nucleotide sequence of VGAM311 RNA, herein designated VGAM RNA, also designated SEQ ID:3022.

A function of VGAM311 is therefore inhibition of FLJ20276 (Accession NM_017738). Accordingly, utilities of VGAM311 include diagnosis, prevention and treatment of diseases and clinical conditions associated with FLJ20276. MIG (Accession NM_002416) is another VGAM311 host target gene. MIG BINDING SITE is HOST TARGET binding site found in the 3' untranslated region of mRNA encoded by MIG, corresponding to a HOST TARGET binding site such as BINDING SITE I, BINDING SITE II or BINDING SITE III. Table 2 illustrates the complementarity of the nucleotide sequences of MIG BINDING SITE, designated SEQ ID:8246, to the nucleotide sequence of VGAM311 RNA, herein designated VGAM RNA, also designated SEQ ID:3022.

Another function of VGAM311 is therefore inhibition of MIG (Accession NM_002416). Accordingly, utilities of VGAM311 include diagnosis, prevention and treatment of diseases and clinical conditions associated with MIG. PLPL (Accession NM_020181) is another VGAM311 host target gene. PLPL BINDING SITE is HOST TARGET binding site found in the 3' untranslated region of mRNA encoded by PLPL, corresponding to a HOST TARGET binding site such as BINDING SITE I, BINDING SITE II or BINDING SITE III. Table 2 illustrates the complementarity of the nucleotide sequences of PLPL BINDING SITE, designated SEQ ID:21398, to the nucleotide sequence of VGAM311 RNA, herein designated VGAM RNA, also designated SEQ ID:3022.

Another function of VGAM311 is therefore inhibition of PLPL (Accession NM_020181). Accordingly, utilities of VGAM311 include diagnosis, prevention and treatment of diseases and clinical conditions associated with PLPL. Small EDRK-rich Factor 1B (centromeric) (SERF1B, Accession NM_022978) is another VGAM311 host target gene. SERF1B BINDING SITE is HOST TARGET binding site found in the 3' untranslated region of mRNA encoded by SERF1B, corresponding to a HOST TARGET binding site such as BINDING SITE I, BINDING SITE II or BINDING SITE III. Table 2 illustrates the complementarity of the nucleotide sequences of SERF1B BINDING SITE, designated SEQ ID:23257, to the nucleotide sequence of VGAM311 RNA, herein designated VGAM RNA, also designated SEQ ID:3022.

Another function of VGAM311 is therefore inhibition of Small EDRK-rich Factor 1B (centromeric) (SERF1B, Accession NM_022978). Accordingly, utilities of VGAM311 include diagnosis, prevention and treatment of diseases and clinical conditions associated with SERF1B. Wingless-type MMTV Integration Site Family, Member 2B (WNT2B, Accession NM_024494) is another VGAM311 host target gene. WNT2B BINDING SITE1 and WNT2B BINDING SITE2 are HOST TARGET binding sites found in untranslated regions of mRNA encoded by WNT2B, corresponding to HOST TARGET binding sites such as BINDING SITE I, BINDING SITE II or BINDING SITE III. Table 2 illustrates the complementarity of the nucleotide sequences of WNT2B BINDING SITE1 and WNT2B BINDING SITE2, designated SEQ ID:23695 and SEQ ID:10394 respectively, to the nucleotide sequence of VGAM311 RNA, herein designated VGAM RNA, also designated SEQ ID:3022.

Another function of VGAM311 is therefore inhibition of Wingless-type MMTV Integration Site Family, Member 2B (WNT2B, Accession NM_024494). Accordingly, utilities of VGAM311 include diagnosis, prevention and treatment of diseases and clinical conditions associated with WNT2B. LOC203292 (Accession XM_117527) is another VGAM311 host target gene. LOC203292 BINDING SITE is HOST TARGET binding site found in the 3' untranslated region of mRNA encoded by LOC203292, corresponding to a HOST TARGET binding site such as BINDING SITE I, BINDING SITE II or BINDING SITE III. Table 2 illustrates the complementarity of the nucleotide sequences of LOC203292 BINDING SITE, designated SEQ ID:43502, to the nucleotide sequence of VGAM311 RNA, herein designated VGAM RNA, also designated SEQ ID:3022.

Another function of VGAM311 is therefore inhibition of LOC203292 (Accession XM_117527). Accordingly, utilities of VGAM311 include diagnosis, prevention and treatment of diseases and clinical conditions associated with LOC203292. LOC91813 (Accession XM_040862) is another VGAM311 host target gene. LOC91813 BINDING SITE is HOST TARGET binding site found in the 5' untranslated region of mRNA encoded by LOC91813, corresponding to a HOST TARGET binding site such as BINDING SITE I, BINDING SITE II or BINDING SITE III. Table 2 illustrates the complementarity of the nucleotide sequences of LOC91813 BINDING SITE, designated SEQ ID:33397, to the nucleotide sequence of VGAM311 RNA, herein designated VGAM RNA, also designated SEQ ID:3022.

Another function of VGAM311 is therefore inhibition of LOC91813 (Accession XM_040862). Accordingly, utilities of VGAM311 include diagnosis, prevention and treatment of diseases and clinical conditions associated with LOC91813. FIG. 1 further provides a conceptual description of a novel bioinformatically detected viral gene of the present invention, referred to here as Viral Genomic Address Messenger 312 (VGAM312) viral gene, which modulates expression of respective host target genes thereof, the function and utility of which host target genes is known in the art.

VGAM312 is a novel bioinformatically detected regulatory, non protein coding, viral micro RNA (miRNA) gene. The method by which VGAM312 was detected is described hereinabove with reference to FIGS. 1-8.

VGAM312 gene, herein designated VGAM GENE, is a viral gene contained in the genome of Pothos Latent Virus. VGAM312 host target gene, herein designated VGAM HOST TARGET GENE, is a human gene contained in the human genome.

VGAM312 gene encodes a VGAM312 precursor RNA, herein designated VGAM PRECURSOR RNA. Similar to other miRNA genes, and unlike most ordinary genes, VGAM312 precursor RNA does not encode a protein. A nucleotide sequence identical or highly similar to the nucleotide sequence of VGAM312 precursor RNA is designated SEQ ID:298, and is provided hereinbelow with reference to the sequence listing part. Nucleotide sequence SEQ ID:298 is located at position 791 relative to the genome of Pothos Latent Virus.

VGAM312 precursor RNA folds onto itself, forming VGAM312 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM312 folded precursor RNA into VGAM312 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM312 RNA is designated SEQ ID:3023, and is provided hereinbelow with reference to the sequence listing part.

VGAM312 host target gene, herein designated VGAM HOST TARGET GENE, encodes a corresponding messenger RNA, VGAM312 host target RNA, herein designated VGAM HOST TARGET RNA. VGAM312 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM312 RNA, herein designated VGAM RNA, binds complementarily to one or more host target binding sites located in untranslated regions of VGAM312 host target RNA, herein designated VGAM HOST TARGET RNA. This complementary binding is due to the fact that the nucleotide sequence of VGAM312 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM312 RNA, herein designated VGAM RNA, may have a different number of host target binding sites in untranslated regions of a VGAM312 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM312 RNA, herein designated VGAM RNA, to host target binding sites on VGAM312 host target RNA, herein designated VGAM HOST TARGET RNA, such as BINDING SITE I, BINDING SITE II and BINDING SITE III, inhibits translation of VGAM312 host target RNA into VGAM312 host target protein, herein designated VGAM HOST TARGET PROTEIN. VGAM host target protein is therefore outlined by a broken line.

It is appreciated that VGAM312 host target gene, herein designated VGAM HOST TARGET GENE, in fact represents a plurality of VGAM312 host target genes. The mRNA of each one of this plurality of VGAM312 host target genes comprises one or more host target binding sites, each having a nucleotide sequence which is at least partly complementary to VGAM312 RNA, herein designated VGAM RNA, and which when bound by VGAM312 RNA causes inhibition of translation of respective one or more VGAM312 host target proteins.

It is further appreciated by one skilled in the art that the mode of translational inhibition illustrated by FIG. 1 with specific reference to translational inhibition exerted by VGAM312 gene, herein designated VGAM GENE, on one or more VGAM312 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM312 is inhibition of expression of host target genes, as part of a novel viral mechanism of attacking a host. Accordingly, utilities of VGAM312 include diagnosis, prevention and treatment of viral infection by Pothos Latent Virus. Specific functions, and accordingly utilities, of VGAM312 correlate with, and may be deduced from, the identity of the host target genes which VGAM312 binds and inhibits, and the function of these host target genes, as elaborated hereinbelow.

Nucleotide sequences of the VGAM312 precursor RNA, herein designated VGAM PRECURSOR RNA, and of the 'diced' VGAM312 RNA, herein designated VGAM RNA, and a schematic representation of the secondary folding of VGAM312 folded precursor RNA, herein designated VGAM FOLDED PRECURSOR RNA, of VGAM312 are further described hereinbelow with reference to Table 1.

Nucleotide sequences of host target binding sites, such as BINDING SITE-I, BINDING SITE-II and BINDING SITE-III of FIG. 1, found on VGAM312 host target RNA, and schematic representation of the complementarity of each of these host target binding sites to VGAM312 RNA, herein designated VGAM RNA, are described hereinbelow with reference to Table 2.

As mentioned hereinabove with reference to FIG. 1, a function of VGAM312 gene, herein designated VGAM is inhibition of expression of VGAM312 target genes. It is appreciated that specific functions, and accordingly utilities, of VGAM312 correlate with, and may be deduced from, the identity of the target genes which VGAM312 binds and inhibits, and the function of these target genes, as elaborated hereinbelow.

D8S2298E (Accession NM_005671) is a VGAM312 host target gene. D8S2298E BINDING SITE is HOST TARGET binding site found in the 3' untranslated region of mRNA encoded by D8S2298E, corresponding to a HOST TARGET binding site such as BINDING SITE I, BINDING SITE II or BINDING SITE III. Table 2 illustrates the complementarity of the nucleotide sequences of D8S2298E BINDING SITE, designated SEQ ID:12230, to the nucleotide sequence of VGAM312 RNA, herein designated VGAM RNA, also designated SEQ ID:3023.

A function of VGAM312 is therefore inhibition of D8S2298E (Accession NM_005671). Accordingly, utilities of VGAM312 include diagnosis, prevention and treatment of diseases and clinical conditions associated with D8S2298E. LOC149182 (Accession XM_097605) is another VGAM312 host target gene. LOC149182 BINDING SITE is HOST TARGET binding site found in the 5' untranslated region of mRNA encoded by LOC149182, corresponding to a HOST TARGET binding site such as BINDING SITE I, BINDING SITE II or BINDING SITE III. Table 2 illustrates the complementarity of the nucleotide sequences of LOC149182 BINDING SITE, designated SEQ ID:40968, to the nucleotide sequence of VGAM312 RNA, herein designated VGAM RNA, also designated SEQ ID:3023.

Another function of VGAM312 is therefore inhibition of LOC149182 (Accession XM_097605). Accordingly, utilities of VGAM312 include diagnosis, prevention and treatment of diseases and clinical conditions associated with LOC149182. LOC51301 (Accession NM_016591) is another VGAM312 host target gene. LOC51301 BINDING SITE is HOST TARGET binding site found in the 5' untranslated region of mRNA encoded by LOC51301, corresponding to a HOST TARGET binding site such as BINDING SITE I, BINDING SITE II or BINDING SITE III. Table 2 illustrates the complementarity of the nucleotide sequences of LOC51301 BINDING SITE, designated SEQ ID:18673, to the nucleotide sequence of VGAM312 RNA, herein designated VGAM RNA, also designated SEQ ID:3023.

Another function of VGAM312 is therefore inhibition of LOC51301 (Accession NM_016591). Accordingly, utilities of VGAM312 include diagnosis, prevention and treatment of diseases and clinical conditions associated with LOC51301. FIG. 1 further provides a conceptual description of a novel bioinformatically detected viral gene of the present invention, referred to here as Viral Genomic Address Messenger 313 (VGAM313) viral gene, which modulates expression of respective host target genes thereof, the function and utility of which host target genes is known in the art.

VGAM313 is a novel bioinformatically detected regulatory, non protein coding, viral micro RNA (miRNA) gene. The method by which VGAM313 was detected is described hereinabove with reference to FIGS. 1-8.

VGAM313 gene, herein designated VGAM GENE, is a viral gene contained in the genome of Porcine Enteric Calicivirus. VGAM313 host target gene, herein designated VGAM HOST TARGET GENE, is a human gene contained in the human genome.

VGAM313 gene encodes a VGAM313 precursor RNA, herein designated VGAM PRECURSOR RNA. Similar to other miRNA genes, and unlike most ordinary genes, VGAM313 precursor RNA does not encode a protein. A nucleotide sequence identical or highly similar to the nucleotide sequence of VGAM313 precursor RNA is designated SEQ ID:299, and is provided hereinbelow with reference to the sequence listing part. Nucleotide sequence SEQ ID:299 is located at position 2578 relative to the genome of Porcine Enteric Calicivirus.

VGAM313 precursor RNA folds onto itself, forming VGAM313 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM313 folded precursor RNA into VGAM313 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 78%) nucleotide sequence of VGAM313 RNA is designated SEQ ID:3024, and is provided hereinbelow with reference to the sequence listing part.

VGAM313 host target gene, herein designated VGAM HOST TARGET GENE, encodes a corresponding messenger RNA, VGAM313 host target RNA, herein designated VGAM HOST TARGET RNA. VGAM313 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM313 RNA, herein designated VGAM RNA, binds complementarily to one or more host target binding sites located in untranslated regions of VGAM313 host target RNA, herein designated VGAM HOST TARGET RNA. This complementary binding is due to the fact that the nucleotide sequence of VGAM313 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM313 RNA, herein designated VGAM RNA, may have a different number of host target binding sites in untranslated regions of a VGAM313 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM313 RNA, herein designated VGAM RNA, to host target binding sites on VGAM313 host target RNA, herein designated VGAM HOST TARGET RNA, such as BINDING SITE I, BINDING SITE II and BINDING SITE III, inhibits translation of VGAM313 host target RNA into VGAM313 host target protein, herein designated VGAM HOST TARGET PROTEIN. VGAM host target protein is therefore outlined by a broken line.

It is appreciated that VGAM313 host target gene, herein designated VGAM HOST TARGET GENE, in fact represents a plurality of VGAM313 host target genes. The mRNA of each one of this plurality of VGAM313 host target genes comprises one or more host target binding sites, each having a nucleotide sequence which is at least partly complementary to VGAM313 RNA, herein designated VGAM RNA, and which when bound by VGAM313 RNA causes inhibition of translation of respective one or more VGAM313 host target proteins.

It is further appreciated by one skilled in the art that the mode of translational inhibition illustrated by FIG. 1 with specific reference to translational inhibition exerted by VGAM313 gene, herein designated VGAM GENE, on one or more VGAM313 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM313 is inhibition of expression of host target genes, as part of a novel viral mechanism of attacking a host. Accordingly, utilities of VGAM313 include diagnosis, prevention and treatment of viral infection by Porcine Enteric Calicivirus. Specific functions, and accordingly utilities, of VGAM313 correlate with, and may be deduced from, the identity of the host target genes which VGAM313 binds and inhibits, and the function of these host target genes, as elaborated hereinbelow.

Nucleotide sequences of the VGAM313 precursor RNA, herein designated VGAM PRECURSOR RNA, and of the 'diced' VGAM313 RNA, herein designated VGAM RNA, and a schematic representation of the secondary folding of VGAM313 folded precursor RNA, herein designated VGAM FOLDED PRECURSOR RNA, of VGAM313 are further described hereinbelow with reference to Table 1.

Nucleotide sequences of host target binding sites, such as BINDING SITE-I, BINDING SITE-II and BINDING SITE-III of FIG. 1, found on VGAM313 host target RNA, and schematic representation of the complementarity of each of these host target binding sites to VGAM313 RNA, herein designated VGAM RNA, are described hereinbelow with reference to Table 2.

As mentioned hereinabove with reference to FIG. 1, a function of VGAM313 gene, herein designated VGAM is inhibition of expression of VGAM313 target genes. It is appreciated that specific functions, and accordingly utilities, of VGAM313 correlate with, and may be deduced from, the identity of the target genes which VGAM313 binds and inhibits, and the function of these target genes, as elaborated hereinbelow.

PIAS3 (Accession NM_006099) is a VGAM313 host target gene. PIAS3 BINDING SITE is HOST TARGET binding site found in the 3' untranslated region of mRNA encoded by PIAS3, corresponding to a HOST TARGET binding site such as BINDING SITE I, BINDING SITE II or BINDING SITE III. Table 2 illustrates the complementarity of the nucleotide sequences of PIAS3 BINDING SITE, designated SEQ ID:12744, to the nucleotide sequence of VGAM313 RNA, herein designated VGAM RNA, also designated SEQ ID:3024.

A function of VGAM313 is therefore inhibition of PIAS3 (Accession NM_006099), a gene which specifically inhibits activated stat3 signaling by blocking its dna-binding activity. Accordingly, utilities of VGAM313 include diagnosis, prevention and treatment of diseases and clinical conditions associated with PIAS3. The function of PIAS3 has been established by previous studies. STAT proteins (e.g., STAT1, 600555) are latent cytoplasmic transcription factors that become activated by tyrosine phosphorylation in response to cytokine stimulation. Using PIAS1 (OMIM Ref. No. 603566), an inhibitor of activated STAT1, for EST database searches and cDNA library screening, Chung et al. (1997) identified PIAS3, an inhibitor of activated STAT3 (OMIM Ref. No. 102582). They found that PIAS3 has a molecular mass of about 68 kD. Ueki et al. (1999) independently isolated a PIAS3 cDNA encoding a deduced 619-amino acid protein that shares 83% sequence identity with mouse Pias3. PIAS3 also shares approximately 55% identity with PIAS1 and the PIASX proteins (OMIM Ref. No. 603567) and 39% identity with PIASY (OMIM Ref. No. 605989). Northern blot analysis detected wide expression of PIAS3 in human tissues Ueki et al. (1999) identified PIAS3 as an inhibitor of activated STAT3. Levy et al. (2002) found that PIAS3 binds microphthalmia-associated transcription factor (MITF; 156845), a key DNA-binding protein, in rat basophilic leukemia cells and mouse melanocytes. They observed direct binding of MITF by PIAS3 in coimmunoprecipitation and in vitro pull-down assays. Gel-shift assays showed that PIAS3 can block MITF DNA-binding activity, and cotransfection of MITF and PIAS3 in NIH 3T3 cells inhibited MITF-driven transcription activity. Interaction between PIAS3 and MITF was independent of STAT3 binding Full details of the abovementioned studies are described in the following publications, the disclosure of which are hereby incorporated by reference:

Chung, C. D.; Liao, J.; Liu, B.; Rao, X.; Jay, P.; Berta, P.; Shuai, K.: Specific inhibition of Stat3 signal transduction by PIAS3. Science 278: 1803-1805, 1997; and Ueki, N.; Seki, N.; Yano, K.; Saito, T.; Masuho, Y.; Muramatsu, M.: Isolation and chromosomal assignment of a human gene endoding protein inhibitor of activated STAT3 (PIAS3). J. Hum. Gene.

Further studies establishing the function and utilities of PIAS3 are found in John Hopkins OMIM database record ID 605987, and in sited publications numbered 234 and 4110-4111 listed in the bibliography section hereinbelow, which are also hereby incorporated by reference. Chromosome 20 Open Reading Frame 139 (C20orf139, Accession XM_097749) is another VGAM313 host target gene. C20orf139 BINDING SITE is HOST TARGET binding site found in the 5' untranslated region of mRNA encoded by C20orf139, corresponding to a HOST TARGET binding site such as BINDING SITE I, BINDING SITE II or BINDING SITE III. Table 2 illustrates the complementarity of the nucleotide sequences of C20orf139 BINDING SITE, designated SEQ ID:41106, to the nucleotide sequence of VGAM313 RNA, herein designated VGAM RNA, also designated SEQ ID:3024.

Another function of VGAM313 is therefore inhibition of Chromosome 20 Open Reading Frame 139 (C20orf139, Accession XM_097749). Accordingly, utilities of VGAM313 include diagnosis, prevention and treatment of diseases and clinical conditions associated with C20orf139. FLJ13322 (Accession NM_024722) is another VGAM313 host target gene. FLJ13322 BINDING SITE is HOST TARGET binding site found in the 5' untranslated region of mRNA encoded by FLJ13322, corresponding to a HOST TARGET binding site such as BINDING SITE I, BINDING SITE II or BINDING SITE III. Table 2 illustrates the complementarity of the nucleotide sequences of FLJ13322 BINDING SITE, designated SEQ ID:24060, to the nucleotide sequence of VGAM313 RNA, herein designated VGAM RNA, also designated SEQ ID:3024.

Another function of VGAM313 is therefore inhibition of FLJ13322 (Accession NM_024722). Accordingly, utilities of VGAM313 include diagnosis, prevention and treatment of diseases and clinical conditions associated with FLJ13322. KIAA0293 (Accession XM_027045) is another VGAM313 host target gene. KIAA0293 BINDING SITE is HOST TARGET binding site found in the 3' untranslated region of mRNA encoded by KIAA0293, corresponding to a HOST TARGET binding site such as BINDING SITE I, BINDING SITE II or BINDING SITE III. Table 2 illustrates the complementarity of the nucleotide sequences of KIAA0293 BINDING SITE, designated SEQ ID:30395, to the nucleotide sequence of VGAM313 RNA, herein designated VGAM RNA, also designated SEQ ID:3024.

Another function of VGAM313 is therefore inhibition of KIAA0293 (Accession XM_027045). Accordingly, utilities of VGAM313 include diagnosis, prevention and treatment of diseases and clinical conditions associated with KIAA0293. Neuropilin (NRP) and Tolloid (TLL)-like 1 (NETO1, Accession NM_138966) is another VGAM313 host target gene. NETO1 BINDING SITE is HOST TARGET binding site found in the 5' untranslated region of mRNA encoded by NETO1, corresponding to a HOST TARGET binding site such as BINDING SITE I, BINDING SITE II or BINDING SITE III. Table 2 illustrates the complementarity of the nucleotide sequences of NETO1 BINDING SITE, designated SEQ ID:29069, to the nucleotide sequence of VGAM313 RNA, herein designated VGAM RNA, also designated SEQ ID:3024.

Another function of VGAM313 is therefore inhibition of Neuropilin (NRP) and Tolloid (TLL)-like 1 (NETO1, Accession NM_138966). Accordingly, utilities of VGAM313 include diagnosis, prevention and treatment of diseases and clinical conditions associated with NETO1. LOC147229 (Accession XM_085742) is another VGAM313 host target gene. LOC147229 BINDING SITE is HOST TARGET binding site found in the 3' untranslated region of mRNA encoded by LOC147229, corresponding to a HOST TARGET binding site such as BINDING SITE I, BINDING SITE II or BINDING SITE III. Table 2 illustrates the complementarity of the nucleotide sequences of LOC147229 BINDING SITE, designated SEQ ID:38315, to the nucleotide sequence of VGAM313 RNA, herein designated VGAM RNA, also designated SEQ ID:3024.

Another function of VGAM313 is therefore inhibition of LOC147229 (Accession XM_085742). Accordingly, utilities of VGAM313 include diagnosis, prevention and treatment of diseases and clinical conditions associated with LOC147229. LOC149837 (Accession XM_097747) is another VGAM313 host target gene. LOC149837 BINDING SITE is HOST TARGET binding site found in the 3' untranslated region of mRNA encoded by LOC149837, corresponding to a HOST TARGET binding site such as BINDING SITE I, BINDING SITE II or BINDING SITE III. Table 2 illustrates the complementarity of the nucleotide sequences of LOC149837 BINDING SITE, designated SEQ ID:41096, to the nucleotide sequence of VGAM313 RNA, herein designated VGAM RNA, also designated SEQ ID:3024.

Another function of VGAM313 is therefore inhibition of LOC149837 (Accession XM_097747). Accordingly, utilities of VGAM313 include diagnosis, prevention and treatment of diseases and clinical conditions associated with LOC149837. LOC154214 (Accession XM_087876) is another VGAM313 host target gene. LOC154214 BINDING SITE is HOST TARGET binding site found in the 3' untranslated region of mRNA encoded by LOC154214, corresponding to a HOST TARGET binding site such as BINDING SITE I, BINDING SITE II or BINDING SITE III. Table 2 illustrates the complementarity of the nucleotide sequences of LOC154214 BINDING SITE, designated SEQ ID:39467, to the nucleotide sequence of VGAM313 RNA, herein designated VGAM RNA, also designated SEQ ID:3024.

Another function of VGAM313 is therefore inhibition of LOC154214 (Accession XM_087876). Accordingly, utilities of VGAM313 include diagnosis, prevention and treatment of diseases and clinical conditions associated with LOC154214. FIG. 1 further provides a conceptual description of a novel bioinformatically detected viral gene of the present invention, referred to here as Viral Genomic Address Messenger 314 (VGAM314) viral gene, which modulates expression of respective host target genes thereof, the function and utility of which host target genes is known in the art.

VGAM314 is a novel bioinformatically detected regulatory, non protein coding, viral micro RNA (miRNA) gene. The method by which VGAM314 was detected is described hereinabove with reference to FIGS. 1-8.

VGAM314 gene, herein designated VGAM GENE, is a viral gene contained in the genome of Murine Adenovirus A. VGAM314 host target gene, herein designated VGAM HOST TARGET GENE, is a human gene contained in the human genome.

VGAM314 gene encodes a VGAM314 precursor RNA, herein designated VGAM PRECURSOR RNA. Similar to other miRNA genes, and unlike most ordinary genes, VGAM314 precursor RNA does not encode a protein. A nucleotide sequence identical or highly similar to the nucleotide sequence of VGAM314 precursor RNA is designated SEQ ID:300, and is provided hereinbelow with reference to the sequence listing part. Nucleotide sequence SEQ ID:300 is located at position 20841 relative to the genome of Murine Adenovirus A.

VGAM314 precursor RNA folds onto itself, forming VGAM314 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM314 folded precursor RNA into VGAM314 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM314 RNA is designated SEQ ID:3025, and is provided hereinbelow with reference to the sequence listing part.

VGAM314 host target gene, herein designated VGAM HOST TARGET GENE, encodes a corresponding messenger RNA, VGAM314 host target RNA, herein designated VGAM HOST TARGET RNA. VGAM314 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM314 RNA, herein designated VGAM RNA, binds complementarily to one or more host target binding sites located in untranslated regions of VGAM314 host target RNA, herein designated VGAM HOST TARGET RNA. This complementary binding is due to the fact that the nucleotide sequence of VGAM314 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM314 RNA, herein designated VGAM RNA, may have a different number of host target binding sites in untranslated regions of a VGAM314 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM314 RNA, herein designated VGAM RNA, to host target binding sites on VGAM314 host target RNA, herein designated VGAM HOST TARGET RNA, such as BINDING SITE I, BINDING SITE II and BINDING SITE III, inhibits translation of VGAM314 host target RNA into VGAM314 host target protein, herein designated VGAM HOST TARGET PROTEIN. VGAM host target protein is therefore outlined by a broken line.

It is appreciated that VGAM314 host target gene, herein designated VGAM HOST TARGET GENE, in fact represents a plurality of VGAM314 host target genes. The mRNA of each one of this plurality of VGAM314 host target genes comprises one or more host target binding sites, each having a nucleotide sequence which is at least partly complementary to VGAM314 RNA, herein designated VGAM RNA, and which when bound by VGAM314 RNA causes inhibition of translation of respective one or more VGAM314 host target proteins.

It is further appreciated by one skilled in the art that the mode of translational inhibition illustrated by FIG. 1 with specific reference to translational inhibition exerted by VGAM314 gene, herein designated VGAM GENE, on one or more VGAM314 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM314 is inhibition of expression of host target genes, as part of a novel viral mechanism of attacking a host. Accordingly, utilities of VGAM314 include diagnosis, prevention and treatment of viral infection by Murine Adenovirus A. Specific functions, and accordingly utilities, of VGAM314 correlate with, and may be deduced from, the identity of the host target genes which VGAM314 binds and inhibits, and the function of these host target genes, as elaborated hereinbelow.

Nucleotide sequences of the VGAM314 precursor RNA, herein designated VGAM PRECURSOR RNA, and of the 'diced' VGAM314 RNA, herein designated VGAM RNA, and a schematic representation of the secondary folding of VGAM314 folded precursor RNA, herein designated VGAM FOLDED PRECURSOR RNA, of VGAM314 are further described hereinbelow with reference to Table 1.

Nucleotide sequences of host target binding sites, such as BINDING SITE-I, BINDING SITE-II and BINDING SITE-III of FIG. 1, found on VGAM314 host target RNA, and schematic representation of the complementarity of each of these host target binding sites to VGAM314 RNA, herein designated VGAM RNA, are described hereinbelow with reference to Table 2.

As mentioned hereinabove with reference to FIG. 1, a function of VGAM314 gene, herein designated VGAM is inhibition of expression of VGAM314 target genes. It is appreciated that specific functions, and accordingly utilities, of VGAM314 correlate with, and may be deduced from, the identity of the target genes which VGAM314 binds and inhibits, and the function of these target genes, as elaborated hereinbelow.

Male-specific Lethal 3-like 1 (Drosophila) (MSL3L1, Accession NM_006800) is a VGAM314 host target gene. MSL3L1 BINDING SITE is HOST TARGET binding site found in the 5' untranslated region of mRNA encoded by MSL3L1, corresponding to a HOST TARGET binding site such as BINDING SITE I, BINDING SITE II or BINDING SITE III. Table 2 illustrates the complementarity of the nucleotide sequences of MSL3L1 BINDING SITE, designated SEQ ID:13671, to the nucleotide sequence of VGAM314 RNA, herein designated VGAM RNA, also designated SEQ ID:3025.

A function of VGAM314 is therefore inhibition of Male-specific Lethal 3-like 1 (Drosophila) (MSL3L1, Accession NM_006800). Accordingly, utilities of VGAM314 include diagnosis, prevention and treatment of diseases and clinical conditions associated with MSL3L1. Metal-regulatory Transcription Factor 1 (MTF1, Accession NM_005955) is another VGAM314 host target gene. MTF1 BINDING SITE is HOST TARGET binding site found in the 3' untranslated region of mRNA encoded by MTF1, corresponding to a HOST TARGET binding site such as BINDING SITE I, BINDING SITE II or BINDING SITE III. Table 2 illustrates the complementarity of the nucleotide sequences of MTF1 BINDING SITE, designated SEQ ID:12581, to the nucleotide sequence of VGAM314 RNA, herein designated VGAM RNA, also designated SEQ ID:3025.

Another function of VGAM314 is therefore inhibition of Metal-regulatory Transcription Factor 1 (MTF1, Accession NM_005955). Accordingly, utilities of VGAM314 include diagnosis, prevention and treatment of diseases and clinical conditions associated with MTF1. Stearoyl-CoA Desaturase (delta-9-desaturase) (SCD, Accession NM_005063) is another VGAM314 host target gene. SCD BINDING SITE is HOST TARGET binding site found in the 3' untranslated region of mRNA encoded by SCD, corresponding to a HOST TARGET binding site such as BINDING SITE I, BINDING SITE II or BINDING SITE III. Table 2 illustrates the complementarity of the nucleotide sequences of SCD BINDING SITE, designated SEQ ID:11490, to the nucleotide sequence of VGAM314 RNA, herein designated VGAM RNA, also designated SEQ ID:3025.

Another function of VGAM314 is therefore inhibition of Stearoyl-CoA Desaturase (delta-9-desaturase) (SCD, Accession NM_005063), a gene which functions in the synthesis of unsaturated fatty acids. Accordingly, utilities of VGAM314 include diagnosis, prevention and treatment of diseases and clinical conditions associated with SCD. The function of SCD has been established by previous studies. Stearoyl-CoA desaturase (SCD; EC 1.14.99.5) is an iron-containing enzyme that catalyzes a rate-limiting step in the synthesis of unsaturated fatty acids. The principal product of SCD is oleic acid, which is formed by desaturation of stearic acid. The ratio of stearic acid to oleic acid has been implicated in the regulation of cell growth and differentiation through effects on cell-membrane fluidity and signal transduction (Zhang et al. (1999)). Thiede et al. (1986) isolated cDNAs encoding rat SCD. By RT-PCR of adipose tissue RNA with primers based on the sequence of rat SCD, Li et al. (1994) isolated a partial human SCD cDNA. Using RNase protection assays, the authors found that human SCD was expressed at higher levels in colon and esophageal carcinomas than in the counterpart normal tissues. Animal model experiments lend further support to the function of SCD. SCD is a central lipogenic enzyme catalyzing the synthesis of monounsaturated fatty acids, mainly oleate (C18:1) and palmitoleate (C16:1), which are components of membrane phospholipids, triglycerides, wax esters, and cholesterol esters. Several SCD isoforms (SCD1, -2, and -3) exist in the mouse. Ntambi et al. (2002) showed that mice with a targeted disruption of the SCD1 isoform had reduced body adiposity, increased insulin (OMIM Ref. No. 176730) sensitivity, and resistance to diet-induced weight gain. The protection from obesity involved increased energy expenditure and increased oxygen consumption. Compared with wildtype mice, the SCD1-/- mice had increased levels of plasma ketone bodies but reduced levels of plasma insulin and leptin. In these homozygous null mice, the expression of several genes of lipid oxidation was upregulated, whereas lipid synthesis genes were downregulated. These observations suggested that a consequence of SCD1 deficiency is an activation of lipid oxidation in addition to reduced triglyceride synthesis and storage.

It is appreciated that the abovementioned animal model for SCD is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ntambi, J. M.; Miyazaki, M.; Stoehr, J. P.; Lan, H.; Kendziorski, C. M.; Yandell, B. S.; Song, Y.; Cohen, P.; Friedman, J. M.; Attie, A. D.: Loss of stearoyl-CoA desaturase-1 function protects mice against adiposity. Proc. Nat. Acad. Sci. 99:11482-11486, 2002; and Zhang, L.; Ge, L.; Parimoo, S.; Stenn, K.; Prouty, S. M.: Human stearoyl-CoA desaturase: alternative transcripts generated from a single gene by usage of tandem polyadenylation sites.

Further studies establishing the function and utilities of SCD are found in John Hopkins OMIM database record ID 604031, and in sited publications numbered 317 and 7635-7639 listed in the bibliography section hereinbelow, which are also hereby incorporated by reference. Solute Carrier Family 26, Member 3 (SLC26A3, Accession NM_000111) is another VGAM314 host target gene. SLC26A3 BINDING SITE is HOST TARGET binding site found in the 5' untranslated region of mRNA encoded by SLC26A3, corresponding to a HOST TARGET binding site such as BINDING SITE I, BINDING SITE II or BINDING SITE III. Table 2 illustrates the complementarity of the nucleotide sequences of SLC26A3 BINDING SITE, designated SEQ ID:5576, to the nucleotide sequence of VGAM314 RNA, herein designated VGAM RNA, also designated SEQ ID:3025.

Another function of VGAM314 is therefore inhibition of Solute Carrier Family 26, Member 3 (SLC26A3, Accession NM_000111). Accordingly, utilities of VGAM314 include diagnosis, prevention and treatment of diseases and clinical conditions associated with SLC26A3. Staufen, RNA Binding Protein, Homolog 2 (Drosophila) (STAU2, Accession NM_014393) is another VGAM314 host target gene. STAU2 BINDING SITE is HOST TARGET binding site found in the 5' untranslated region of mRNA encoded by STAU2, corresponding to a HOST TARGET binding site such as BINDING SITE I, BINDING SITE II or BINDING SITE III. Table 2 illustrates the complementarity of the nucleotide sequences of STAU2 BINDING SITE, designated SEQ ID:15722, to the nucleotide sequence of VGAM314 RNA, herein designated VGAM RNA, also designated SEQ ID:3025.

Another function of VGAM314 is therefore inhibition of Staufen, RNA Binding Protein, Homolog 2 (Drosophila) (STAU2, Accession NM_014393). Accordingly, utilities of VGAM314 include diagnosis, prevention and treatment of diseases and clinical conditions associated with STAU2. Transient Receptor Potential Cation Channel, Subfamily M, Member 6 (TRPM6, Accession NM_017662) is another VGAM314 host target gene. TRPM6 BINDING SITE is HOST TARGET binding site found in the 3' untranslated region of mRNA encoded by TRPM6, corresponding to a HOST TARGET binding site such as BINDING SITE I, BINDING SITE II or BINDING SITE III. Table 2 illustrates the complementarity of the nucleotide sequences of TRPM6 BINDING SITE, designated SEQ ID:19201, to the nucleotide sequence of VGAM314 RNA, herein designated VGAM RNA, also designated SEQ ID:3025.

Another function of VGAM314 is therefore inhibition of Transient Receptor Potential Cation Channel, Subfamily M, Member 6 (TRPM6, Accession NM_017662), a gene which contains a predicted ion channel domain and a protein kinase domain. Accordingly, utilities of VGAM314 include diagnosis, prevention and treatment of diseases and clinical conditions associated with TRPM6. The function of TRPM6 and its association with various diseases and clinical conditions, has been established by previous studies, as described hereinabove with reference to VGAM173. DKFZP564O0423 (Accession XM_166254) is another VGAM314 host target gene. DKFZP564O0423 BINDING SITE is HOST TARGET binding site found in the 3' untranslated region of mRNA encoded by DKFZP564O0423, corresponding to a HOST TARGET binding site such as BINDING SITE I, BINDING SITE II or BINDING SITE III. Table 2 illustrates the complementarity of the nucleotide sequences of DKFZP564O0423 BINDING SITE, designated SEQ ID:44064, to the nucleotide sequence of VGAM314 RNA, herein designated VGAM RNA, also designated SEQ ID:3025.

Another function of VGAM314 is therefore inhibition of DKFZP564O0423 (Accession XM_166254). Accordingly, utilities of VGAM314 include diagnosis, prevention and treatment of diseases and clinical conditions associated with DKFZP564O0423. FLJ10688 (Accession NM_018179) is another VGAM314 host target gene. FLJ10688 BINDING SITE is HOST TARGET binding site found in the 5' untranslated region of mRNA encoded by FLJ10688, corresponding to a HOST TARGET binding site such as BINDING SITE I, BINDING SITE II or BINDING SITE III. Table 2 illustrates the complementarity of the nucleotide sequences of FLJ10688 BINDING SITE, designated SEQ ID:20013, to the nucleotide sequence of VGAM314 RNA, herein designated VGAM RNA, also designated SEQ ID:3025.

Another function of VGAM314 is therefore inhibition of FLJ10688 (Accession NM_018179). Accordingly, utilities of VGAM314 include diagnosis, prevention and treatment of diseases and clinical conditions associated with FLJ10688. FLJ12960 (Accession NM_024638) is another VGAM314 host target gene. FLJ12960 BINDING SITE is HOST TARGET binding site found in the 3' untranslated region of mRNA encoded by FLJ12960, corresponding to a HOST TARGET binding site such as BINDING SITE I, BINDING SITE II or BINDING SITE III. Table 2 illustrates the complementarity of the nucleotide sequences of FLJ12960 BINDING SITE, designated SEQ ID:23917, to the nucleotide sequence of VGAM314 RNA, herein designated VGAM RNA, also designated SEQ ID:3025.

Another function of VGAM314 is therefore inhibition of FLJ12960 (Accession NM_024638). Accordingly, utilities of VGAM314 include diagnosis, prevention and treatment of diseases and clinical conditions associated with FLJ12960. KIAA1668 (Accession XM_039236) is another VGAM314 host target gene. KIAA1668 BINDING SITE is HOST TARGET binding site found in the 3' untranslated region of mRNA encoded by KIAA1668, corresponding to a HOST TARGET binding site such as BINDING SITE I, BINDING SITE II or BINDING SITE III. Table 2 illustrates the complementarity of the nucleotide sequences of KIAA1668 BINDING SITE, designated SEQ ID:33027, to the nucleotide sequence of VGAM314 RNA, herein designated VGAM RNA, also designated SEQ ID:3025.

Another function of VGAM314 is therefore inhibition of KIAA1668 (Accession XM_039236). Accordingly, utilities of VGAM314 include diagnosis, prevention and treatment of diseases and clinical conditions associated with KIAA1668. MAD4 (Accession NM_006454) is another VGAM314 host target gene. MAD4 BINDING SITE is HOST TARGET binding site found in the 3' untranslated region of mRNA encoded by MAD4, corresponding to a HOST TARGET binding site such as BINDING SITE I, BINDING SITE II or BINDING SITE III. Table 2 illustrates the complementarity of the nucleotide sequences of MAD4 BINDING SITE, designated SEQ ID:13171, to the nucleotide sequence of VGAM314 RNA, herein designated VGAM RNA, also designated SEQ ID:3025.

Another function of VGAM314 is therefore inhibition of MAD4 (Accession NM_006454). Accordingly, utilities of VGAM314 include diagnosis, prevention and treatment of diseases and clinical conditions associated with MAD4. MGC4643 (Accession NM_032715) is another VGAM314 host target gene. MGC4643 BINDING SITE is HOST TARGET binding site found in the 3' untranslated region of mRNA encoded by MGC4643, corresponding to a HOST TARGET binding site such as BINDING SITE I, BINDING SITE II or BINDING SITE III. Table 2 illustrates the complementarity of the nucleotide sequences of MGC4643 BINDING SITE, designated SEQ ID:26440, to the nucleotide sequence of VGAM314 RNA, herein designated VGAM RNA, also designated SEQ ID:3025.

Another function of VGAM314 is therefore inhibition of MGC4643 (Accession NM_032715). Accordingly, utilities of VGAM314 include diagnosis, prevention and treatment of diseases and clinical conditions associated with MGC4643. WIRE (Accession XM_085731) is another VGAM314 host target gene. WIRE BINDING SITE is HOST TARGET binding site found in the 3" untranslated region of mRNA encoded by WIRE, corresponding to a HOST TARGET binding site such as BINDING SITE I, BINDING SITE II or BINDING SITE III. Table 2 illustrates the complementarity of the nucleotide sequences of WIRE BINDING SITE, designated SEQ ID:38314, to the nucleotide sequence of VGAM314 RNA, herein designated VGAM RNA, also designated SEQ ID:3025.

Another function of VGAM314 is therefore inhibition of WIRE (Accession XM_085731). Accordingly, utilities of VGAM314 include diagnosis, prevention and treatment of diseases and clinical conditions associated with WIRE. LOC125988 (Accession XM_058957) is another VGAM314 host target gene. LOC125988 BINDING SITE is HOST TARGET binding site found in the 5' untranslated region of mRNA encoded by LOC125988, corresponding to a HOST TARGET binding site such as BINDING SITE I, BINDING SITE II or BINDING SITE III. Table 2 illustrates the complementarity of the nucleotide sequences of LOC125988 BINDING SITE, designated SEQ ID:36803, to the nucleotide sequence of VGAM314 RNA, herein designated VGAM RNA, also designated SEQ ID:3025.

Another function of VGAM314 is therefore inhibition of LOC125988 (Accession XM_058957). Accordingly, utilities of VGAM314 include diagnosis, prevention and treatment of diseases and clinical conditions associated with LOC125988. LOC143451 (Accession XM_084521) is another VGAM314 host target gene. LOC143451 BINDING SITE is HOST TARGET binding site found in the 3' untranslated region of mRNA encoded by LOC143451, corresponding to a HOST TARGET binding site such as BINDING SITE I, BINDING SITE II or BINDING SITE III. Table 2 illustrates the complementarity of the nucleotide sequences of LOC143451 BINDING SITE, designated SEQ ID:37621, to the nucleotide sequence of VGAM314 RNA, herein designated VGAM RNA, also designated SEQ ID:3025.

Another function of VGAM314 is therefore inhibition of LOC143451 (Accession XM_084521). Accordingly, utilities of VGAM314 include diagnosis, prevention and treatment of diseases and clinical conditions associated with LOC143451.

LOC145125 (Accession XM_085025) is another VGAM314 host target gene. LOC145125 BINDING SITE is HOST TARGET binding site found in the 3' untranslated region of mRNA encoded by LOC145125, corresponding to a HOST TARGET binding site such as BINDING SITE I, BINDING SITE II or BINDING SITE III. Table 2 illustrates the complementarity of the nucleotide sequences of LOC145125 BINDING SITE, designated SEQ ID:37798, to the nucleotide sequence of VGAM314 RNA, herein designated VGAM RNA, also designated SEQ ID:3025.

Another function of VGAM314 is therefore inhibition of LOC145125 (Accession XM_085025). Accordingly, utilities of VGAM314 include diagnosis, prevention and treatment of diseases and clinical conditions associated with LOC145125. LOC148109 (Accession XM_086047) is another VGAM314 host target gene. LOC148109 BINDING SITE is HOST TARGET binding site found in the 5' untranslated region of mRNA encoded by LOC148109, corresponding to a HOST TARGET binding site such as BINDING SITE I, BINDING SITE II or BINDING SITE III. Table 2 illustrates the complementarity of the nucleotide sequences of LOC148109 BINDING SITE, designated SEQ ID:38463, to the nucleotide sequence of VGAM314 RNA, herein designated VGAM RNA, also designated SEQ ID:3025.

Another function of VGAM314 is therefore inhibition of LOC148109 (Accession XM_086047). Accordingly, utilities of VGAM314 include diagnosis, prevention and treatment of diseases and clinical conditions associated with LOC148109. LOC148696 (Accession XM_097505) is another VGAM314 host target gene. LOC148696 BINDING SITE is HOST TARGET binding site found in the 5' untranslated region of mRNA encoded by LOC148696, corresponding to a HOST TARGET binding site such as BINDING SITE I, BINDING SITE II or BINDING SITE III. Table 2 illustrates the complementarity of the nucleotide sequences of LOC148696 BINDING SITE, designated SEQ ID:40893, to the nucleotide sequence of VGAM314 RNA, herein designated VGAM RNA, also designated SEQ ID:3025.

Another function of VGAM314 is therefore inhibition of LOC148696 (Accession XM_097505). Accordingly, utilities of VGAM314 include diagnosis, prevention and treatment of diseases and clinical conditions associated with LOC148696. LOC149506 (Accession XM_097661) is another VGAM314 host target gene. LOC149506 BINDING SITE is HOST TARGET binding site found in the 3' untranslated region of mRNA encoded by LOC149506, corresponding to a HOST TARGET binding site such as BINDING SITE I, BINDING SITE II or BINDING SITE III. Table 2 illustrates the complementarity of the nucleotide sequences of LOC149506 BINDING SITE, designated SEQ ID:41009, to the nucleotide sequence of VGAM314 RNA, herein designated VGAM RNA, also designated SEQ ID:3025.

Another function of VGAM314 is therefore inhibition of LOC149506 (Accession XM_097661). Accordingly, utilities of VGAM314 include diagnosis, prevention and treatment of diseases and clinical conditions associated with LOC149506. LOC254440 (Accession XM_173126) is another VGAM314 host target gene. LOC254440 BINDING SITE is HOST TARGET binding site found in the 3' untranslated region of mRNA encoded by LOC254440, corresponding to a HOST TARGET binding site such as BINDING SITE I, BINDING SITE II or BINDING SITE III. Table 2 illustrates the complementarity of the nucleotide sequences of LOC254440 BINDING SITE, designated SEQ ID:46375, to the nucleotide sequence of VGAM314 RNA, herein designated VGAM RNA, also designated SEQ ID:3025.

Another function of VGAM314 is therefore inhibition of LOC254440 (Accession XM_173126). Accordingly, utilities of VGAM314 include diagnosis, prevention and treatment of diseases and clinical conditions associated with LOC254440. FIG. 1 further provides a conceptual description of a novel bioinformatically detected viral gene of the present invention, referred to here as Viral Genomic Address Messenger 315 (VGAM315) viral gene, which modulates expression of respective host target genes thereof, the function and utility of which host target genes is known in the art.

VGAM315 is a novel bioinformatically detected regulatory, non protein coding, viral micro RNA (miRNA) gene. The method by which VGAM315 was detected is described hereinabove with reference to FIGS. 1-8.

VGAM315 gene, herein designated VGAM GENE, is a viral gene contained in the genome of Cryphonectria Hypovirus 3. VGAM315 host target gene, herein designated VGAM HOST TARGET GENE, is a human gene contained in the human genome.

VGAM315 gene encodes a VGAM315 precursor RNA, herein designated VGAM PRECURSOR RNA. Similar to other miRNA genes, and unlike most ordinary genes, VGAM315 precursor RNA does not encode a protein. A nucleotide sequence identical or highly similar to the nucleotide sequence of VGAM315 precursor RNA is designated SEQ ID:301, and is provided hereinbelow with reference to the sequence listing part. Nucleotide sequence SEQ ID:301 is located at position 1554 relative to the genome of Cryphonectria Hypovirus 3.

VGAM315 precursor RNA folds onto itself, forming VGAM315 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM315 folded precursor RNA into VGAM315 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM315 RNA is designated SEQ ID:3026, and is provided hereinbelow with reference to the sequence listing part.

VGAM315 host target gene, herein designated VGAM HOST TARGET GENE, encodes a corresponding messenger RNA, VGAM315 host target RNA, herein designated VGAM HOST TARGET RNA. VGAM315 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM315 RNA, herein designated VGAM RNA, binds complementarily to one or more host target binding sites located in untranslated regions of VGAM315 host target RNA, herein designated VGAM HOST TARGET RNA. This complementary binding is due to the fact that the nucleotide sequence of VGAM315 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM315 RNA, herein designated VGAM RNA, may have a different number of host target binding sites in untranslated regions of a VGAM315 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM315 RNA, herein designated VGAM RNA, to host target binding sites on VGAM315 host target RNA, herein designated VGAM HOST TARGET RNA, such as BINDING SITE I, BINDING SITE II and BINDING SITE III, inhibits translation of VGAM315 host target RNA into VGAM315 host target protein, herein designated VGAM HOST TARGET PROTEIN. VGAM host target protein is therefore outlined by a broken line.

It is appreciated that VGAM315 host target gene, herein designated VGAM HOST TARGET GENE, in fact represents a plurality of VGAM315 host target genes. The mRNA of each one of this plurality of VGAM315 host target genes comprises one or more host target binding sites, each having a nucleotide sequence which is at least partly complementary to VGAM315 RNA, herein designated VGAM RNA, and which when bound by VGAM315 RNA causes inhibition of translation of respective one or more VGAM315 host target proteins.

It is further appreciated by one skilled in the art that the mode of translational inhibition illustrated by FIG. 1 with specific reference to translational inhibition exerted by VGAM315 gene, herein designated VGAM GENE, on one or more VGAM315 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM315 is inhibition of expression of host target genes, as part of a novel viral mechanism of attacking a host. Accordingly, utilities of VGAM315 include diagnosis, prevention and treatment of viral infection by Cryphonectria Hypovirus 3. Specific functions, and accordingly utilities, of VGAM315 correlate with, and may be deduced from, the identity of the host target genes which VGAM315 binds and inhibits, and the function of these host target genes, as elaborated hereinbelow.

Nucleotide sequences of the VGAM315 precursor RNA, herein designated VGAM PRECURSOR RNA, and of the 'diced' VGAM315 RNA, herein designated VGAM RNA, and a schematic representation of the secondary folding of VGAM315 folded precursor RNA, herein designated VGAM FOLDED PRECURSOR RNA, of VGAM315 are further described hereinbelow with reference to Table 1.

Nucleotide sequences of host target binding sites, such as BINDING SITE-I, BINDING SITE-II and BINDING SITE-III of FIG. 1, found on VGAM315 host target RNA, and schematic representation of the complementarity of each of these host target binding sites to VGAM315 RNA, herein designated VGAM RNA, are described hereinbelow with reference to Table 2.

As mentioned hereinabove with reference to FIG. 1, a function of VGAM315 gene, herein designated VGAM is inhibition of expression of VGAM315 target genes. It is appreciated that specific functions, and accordingly utilities, of VGAM315 correlate with, and may be deduced from, the identity of the target genes which VGAM315 binds and inhibits, and the function of these target genes, as elaborated hereinbelow.

G Protein-coupled Receptor, Family C, Group 5, Member B (GPRC5B, Accession NM_016235) is a VGAM315 host target gene. GPRC5B BINDING SITE is HOST TARGET binding site found in the 3' untranslated region of mRNA encoded by GPRC5B, corresponding to a HOST TARGET binding site such as BINDING SITE I, BINDING SITE II or BINDING SITE III. Table 2 illustrates the complementarity of the nucleotide sequences of GPRC5B BINDING SITE, designated SEQ ID:18352, to the nucleotide sequence of VGAM315 RNA, herein designated VGAM RNA, also designated SEQ ID:3026.

A function of VGAM315 is therefore inhibition of G Protein-coupled Receptor, Family C, Group 5, Member B (GPRC5B, Accession NM_016235), a gene which belongs to G protein-coupled receptor. Accordingly, utilities of VGAM315 include diagnosis, prevention and treatment of diseases and clinical conditions associated with GPRC5B. The function of GPRC5B and its association with various diseases and clinical conditions, has been established by previous studies, as described hereinabove with reference to VGAM131. Interleukin 20 Receptor, Alpha (IL20RA, Accession NM_014432) is another VGAM315 host target gene. IL20RA BINDING SITE is HOST TARGET binding site found in the 3' untranslated region of mRNA encoded by IL20RA, corresponding to a HOST TARGET binding site such as BINDING SITE I, BINDING SITE II or BINDING SITE III. Table 2 illustrates the complementarity of the nucleotide sequences of IL20RA BINDING SITE, designated SEQ ID:15791, to the nucleotide sequence of VGAM315 RNA, herein designated VGAM RNA, also designated SEQ ID:3026.

Another function of VGAM315 is therefore inhibition of Interleukin 20 Receptor, Alpha (IL20RA, Accession NM_014432), a gene which is the receptor for interleukin-20. Accordingly, utilities of VGAM315 include diagnosis, prevention and treatment of diseases and clinical conditions associated with IL20RA. The function of IL20RA has been established by previous studies. Blumberg et al. (2001) identified the receptor for interleukin-20 (IL20; 605619) as a heterodimer of 2 orphan class II cytokine receptor subunits, IL20RA, also called ZCYTOR7, and IL20RB (OMIM Ref. No. 605621), also called DIRS1. Binding assays using radiolabeled ligand demonstrated that IL20 bound to BHK transfectants expressing both IL20RA and IL20RB, but not to untransfected cells nor to transfectants expressing either receptor subunit alone. Binding of (125)I-labeled IL20 was eliminated in the presence of 100-fold excess of unlabeled IL20 but not in the presence of 100-fold excess of the unrelated cytokine, IL21 (OMIM Ref. No. 605384). The binding data revealed 88,000 IL20 receptors per cell, with a binding affinity of approximately 1.5 nM. Both receptor subunits were expressed in skin and were dramatically upregulated in psoriatic skin. Scott (2001) mapped the IL20RA gene to 6q23 based on sequence similarity between the IL20RA sequence (GenBank AF184971) and a genomic contig (GenBank NT_025741.1).

Full details of the abovementioned studies are described in the following publications, the disclosure of which are hereby incorporated by reference:

Blumberg, H.; Conklin, D.; Xu, W.; Grossmann, A.; Brender, T.; Carollo, S.; Eagan, M.; Foster, D.; Haldeman, B. A.; Hammond, A.; Haugen, H.; Jelinek, L.; and 14 others. Interleukin 20: discovery, receptor identification, and role in epidermal function. Cell 104:9-19, 2001; and Scott, A. F.: Personal Communication. Baltimore, Md., Mar. 13, 2001.

Further studies establishing the function and utilities of IL20RA are found in John Hopkins OMIM database record ID 605620, and in sited publications numbered 443 and 7005 listed in the bibliography section hereinbelow, which are also hereby incorporated by reference. Microtubule-associated Protein 1A (MAP1A, Accession NM_002373) is another VGAM315 host target gene. MAP1A BINDING SITE is HOST TARGET binding site found in the 3' untranslated region of mRNA encoded by MAP1A, corresponding to a HOST TARGET binding site such as BINDING SITE I, BINDING SITE II or BINDING SITE III. Table 2 illustrates the complementarity of the nucleotide sequences of MAP1A BINDING SITE, designated SEQ ID:8184, to the nucleotide sequence of VGAM315 RNA, herein designated VGAM RNA, also designated SEQ ID:3026.

Another function of VGAM315 is therefore inhibition of Microtubule-associated Protein 1A (MAP1A, Accession NM_002373), a gene which is a structural protein involved in the filamentous cross- bridging between microtubules and other skeletal elements. Accordingly, utilities of VGAM315 include diagnosis, prevention and treatment of diseases and clinical conditions associated with MAP1A. The function of MAP1A has been established by previous studies. Ikeda et al. (2002) identified the MAP1A gene as the 'modifier of tubby hearing-1' (moth1) QTL associated with hearing loss in tubby mutants on the C57BL/6J background. The Map1a cDNA derived from B6 contained 12 single-nucleotide differences which could lead to amino acid alterations and a difference in the length of a repeat in the open reading frame when compared with that found in the AKR strain. Ikeda et al. (2002) used a transgenic rescue experiment to verify that sequence polymorphisms were crucial for hearing loss phenotype and demonstrated that the polymorphisms changed the binding efficiency of MAP1A to PSD95 (OMIM Ref. No. 602887), a core component in the cytoarchitecture of synapses. This indicates that at least some of the observed polymorphisms are functionally important and that the hearing loss of C57BL/6J-tub/tub mice may be caused by impaired protein interactions involving MTAP1A Lien et al. (1994) completely cloned and sequenced the human MAP1B gene. By comparison of human MAP1B with sequence databases, they identified a MAP1B-related gene that is probably the human homolog of rat MAP1A. The human MAP1A gene is expressed at high levels in brain and spinal cord and at much lower levels in muscle Full details of the abovementioned studies are described in the following publications, the disclosure of which are hereby incorporated by reference:

Ikeda, A.; Zheng, Q. Y.; Zuberi, A. R.; Johnson, K. R.; Naggert, J. K.; Nishina, P. M.: Microtubule-associated protein 1A is a modifier of tubby hearing (moth1). Nature Genet. 30:401-405, 2002; and Lien, L. L.; Feener, C. A.; Fischbach, N.; Kunkel, L. M.: Cloning of human microtubule-associated protein 1B and the identification of a related gene on chromosome 15. Genomics 22:273-28.

Further studies establishing the function and utilities of MAP1A are found in John Hopkins OMIM database record ID 600178, and in sited publications numbered 8783, 1074 and 10749 listed in the bibliography section hereinbelow, which are also hereby incorporated by reference. Vacuolar Protein Sorting 26 (yeast) (VPS26, Accession NM_004896) is another VGAM315 host target gene. VPS26 BINDING SITE is HOST TARGET binding site found in the 3' untranslated region of mRNA encoded by VPS26, corresponding to a HOST TARGET binding site such as BINDING SITE I, BINDING SITE II or BINDING SITE III. Table 2 illustrates the complementarity of the nucleotide sequences of VPS26 BINDING SITE, designated SEQ ID:11326, to the nucleotide sequence of VGAM315 RNA, herein designated VGAM RNA, also designated SEQ ID:3026.

Another function of VGAM315 is therefore inhibition of Vacuolar Protein Sorting 26 (yeast) (VPS26, Accession NM_004896), a gene which is a sorting protein- ensures the proper delivery of organelle-specific proteins. Accordingly, utilities of VGAM315 include diagnosis, prevention and treatment of diseases and clinical conditions associated with VPS26. The function of VPS26 has been established by previous studies. Haft et al. (2000) used yeast 2-hybrid assays, mutation analysis, and expression in mammalian cells to define the binding interactions among VPS26 and other human orthologs of yeast vacuolar protein sorting proteins, VPS29 (OMIM Ref. No. 606932), SNX1 (OMIM Ref. No. 601272), and VPS35 (OMIM Ref. No. 606931). Their results are consistent with a model in which VPS26 is bound to VPS35 in a multimeric complex. Haft et al. (2000) identified a discrete domain within VPS35 that interacts with VPS26. Gel filtration chromatography of COS-7 cells showed that both recombinant and endogenous VPS proteins coelute as a 220- to 240-kD complex, and in the absence of VPS35, neither VPS26 nor VPS29 is found in the complex. By database searching with the S. cerevisiae and mouse Vps26p/HB58/PEP8 sequences as probe, Haft et al. (2000) identified a human VPS26 EST. The deduced 327-amino acid protein was predicted to be a soluble protein. Northern blot analysis of multiple human tissues revealed ubiquitous expression of a single transcript of about 3 kb. Highest expression was found in heart, skeletal muscle, kidney, liver, and placenta, with lower expression in brain, spleen, small intestine, and lung, and lowest expression in colon, thymus, and leukocytes.

Full details of the abovementioned studies are described in the following publications, the disclosure of which are hereby incorporated by reference:

Haft, C. R.; de la Luz Sierra, M.; Bafford, R.; Lesniak, M. A.; Barr, V. A.; Taylor, S. I.: Human orthologs of yeast vacuolar protein sorting proteins Vps26, 29, and 35: assembly into multimeric complexes. Molec. Biol. Cell 11:4105-4116, 2000; and Mao, M.; Fu, G.; Wu, J.-S.; Zhang, Q.-H.; Zhou, J.; Kan, L.-X.; Huang, Q.-H.; He, K.-L.; Gu, B.-W.; Han, Z.-G.; Shen, Y.; Gu, J.; Yu, Y.-P.; Xu, S.-H.; Wang, Y.-X.; Chen, S.-J.; Chen.

Further studies establishing the function and utilities of VPS26 are found in John Hopkins OMIM database record ID 605506, and in sited publications numbered 449 and 8801 listed in the bibliography section hereinbelow, which are also hereby incorporated by reference. Cadherin-like 22 (CDH22, Accession NM_021248) is another VGAM315 host target gene. CDH22 BINDING SITE is HOST TARGET binding site found in the 5' untranslated region of mRNA encoded by CDH22, corresponding to a HOST TARGET binding site such as BINDING SITE I, BINDING SITE II or BINDING SITE III. Table 2 illustrates the complementarity of the nucleotide sequences of CDH22 BINDING SITE, designated SEQ ID:22215, to the nucleotide sequence of VGAM315 RNA, herein designated VGAM RNA, also designated SEQ ID:3026.

Another function of VGAM315 is therefore inhibition of Cadherin-like 22 (CDH22, Accession NM_021248). Accordingly, utilities of VGAM315 include diagnosis, prevention and treatment of diseases and clinical conditions associated with CDH22. LOC124930 (Accession XM_058867) is another VGAM315 host target gene. LOC124930 BINDING SITE is HOST TARGET binding site found in the 3' untranslated region of mRNA encoded by LOC124930, corresponding to a HOST TARGET binding site such as BINDING SITE I, BINDING SITE II or BINDING SITE III. Table 2 illustrates the complementarity of the nucleotide sequences of LOC124930 BINDING SITE, designated SEQ ID:36769, to the nucleotide sequence of VGAM315 RNA, herein designated VGAM RNA, also designated SEQ ID:3026.

Another function of VGAM315 is therefore inhibition of LOC124930 (Accession XM_058867). Accordingly, utilities of VGAM315 include diagnosis, prevention and treatment of diseases and clinical conditions associated with LOC124930. LOC130074 (Accession XM_072228) is another VGAM315 host target gene. LOC130074 BINDING SITE is HOST TARGET binding site found in the 3' untranslated region of mRNA encoded by LOC130074, corresponding to a HOST TARGET binding site such as BINDING SITE I, BINDING SITE II or BINDING SITE III. Table 2 illustrates the complementarity of the nucleotide sequences of LOC130074 BINDING SITE, designated SEQ ID:37474, to the nucleotide sequence of VGAM315 RNA, herein designated VGAM RNA, also designated SEQ ID:3026.

Another function of VGAM315 is therefore inhibition of LOC130074 (Accession XM_072228). Accordingly, utilities of VGAM315 include diagnosis, prevention and treatment of diseases and clinical conditions associated with LOC130074. LOC133584 (Accession XM_059661) is another VGAM315 host target gene. LOC133584 BINDING SITE is HOST TARGET binding site found in the 5' untranslated region of mRNA encoded by LOC133584, corresponding to a HOST TARGET binding site such as BINDING SITE I, BINDING SITE II or BINDING SITE III. Table 2 illustrates the complementarity of the nucleotide sequences of LOC133584 BINDING SITE, designated SEQ ID:37046, to the nucleotide sequence of VGAM315 RNA, herein designated VGAM RNA, also designated SEQ ID:3026.

Another function of VGAM315 is therefore inhibition of LOC133584 (Accession XM_059661). Accordingly, utilities of VGAM315 include diagnosis, prevention and treatment of diseases and clinical conditions associated with LOC133584. LOC145216 (Accession XM_096730) is another VGAM315 host target gene. LOC145216 BINDING SITE is HOST TARGET binding site found in the 3' untranslated region of mRNA encoded by LOC145216, corresponding to a HOST TARGET binding site such as BINDING SITE I, BINDING SITE II or BINDING SITE III. Table 2 illustrates the complementarity of the nucleotide sequences of LOC145216 BINDING SITE, designated SEQ ID:40506, to the nucleotide sequence of VGAM315 RNA, herein designated VGAM RNA, also designated SEQ ID:3026.

Another function of VGAM315 is therefore inhibition of LOC145216 (Accession XM_096730). Accordingly, utilities of VGAM315 include diagnosis, prevention and treatment of diseases and clinical conditions associated with LOC145216. LOC199232 (Accession XM_114336) is another VGAM315 host target gene. LOC199232 BINDING SITE is HOST TARGET binding site found in the 3' untranslated region of mRNA encoded by LOC199232, corresponding to a HOST TARGET binding site such as BINDING SITE I, BINDING SITE II or BINDING SITE III. Table 2 illustrates the complementarity of the nucleotide sequences of LOC199232 BINDING SITE, designated SEQ ID:42880, to the nucleotide sequence of VGAM315 RNA, herein designated VGAM RNA, also designated SEQ ID:3026.

Another function of VGAM315 is therefore inhibition of LOC199232 (Accession XM_114336). Accordingly, utilities of VGAM315 include diagnosis, prevention and treatment of diseases and clinical conditions associated with LOC199232. LOC200933 (Accession XM_117294) is another VGAM315 host target gene. LOC200933 BINDING SITE is HOST TARGET binding site found in the 3' untranslated region of mRNA encoded by LOC200933, corresponding to a HOST TARGET binding site such as BINDING SITE I, BINDING SITE II or BINDING SITE III. Table 2 illustrates the complementarity of the nucleotide sequences of LOC200933 BINDING SITE, designated SEQ ID:43362, to the nucleotide sequence of VGAM315 RNA, herein designated VGAM RNA, also designated SEQ ID:3026.

Another function of VGAM315 is therefore inhibition of LOC200933 (Accession XM_117294). Accordingly, utilities of VGAM315 include diagnosis, prevention and treatment of diseases and clinical conditions associated with LOC200933. LOC92249 (Accession XM_043814) is another VGAM315 host target gene. LOC92249 BINDING SITE is HOST TARGET binding site found in the 3' untranslated region of mRNA encoded by LOC92249, corresponding to a HOST TARGET binding site such as BINDING SITE I, BINDING SITE II or BINDING SITE III. Table 2 illustrates the complementarity of the nucleotide sequences of LOC92249 BINDING SITE, designated SEQ ID:34022, to the nucleotide sequence of VGAM315 RNA, herein designated VGAM RNA, also designated SEQ ID:3026.

Another function of VGAM315 is therefore inhibition of LOC92249 (Accession XM_043814). Accordingly, utilities of VGAM315 include diagnosis, prevention and treatment of diseases and clinical conditions associated with LOC92249. FIG. 1 further provides a conceptual description of a novel bioinformatically detected viral gene of the present invention, referred to here as Viral Genomic Address Messenger 316 (VGAM316) viral gene, which modulates expression of respective host target genes thereof, the function and utility of which host target genes is known in the art.

VGAM316 is a novel bioinformatically detected regulatory, non protein coding, viral micro RNA (miRNA) gene. The method by which VGAM316 was detected is described hereinabove with reference to FIGS. 1-8.

VGAM316 gene, herein designated VGAM GENE, is a viral gene contained in the genome of Cryphonectria Hypovirus 3. VGAM316 host target gene, herein designated VGAM HOST TARGET GENE, is a human gene contained in the human genome.

VGAM316 gene encodes a VGAM316 precursor RNA, herein designated VGAM PRECURSOR RNA. Similar to other miRNA genes, and unlike most ordinary genes, VGAM316 precursor RNA does not encode a protein. A nucleotide sequence identical or highly similar to the nucleotide sequence of VGAM316 precursor RNA is designated SEQ ID:302, and is provided hereinbelow with reference to the sequence listing part. Nucleotide sequence SEQ ID:302 is located at position 6108 relative to the genome of Cryphonectria Hypovirus 3.

VGAM316 precursor RNA folds onto itself, forming VGAM316 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM316 folded precursor RNA into VGAM316 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM316 RNA is designated SEQ ID:3027, and is provided hereinbelow with reference to the sequence listing part.

VGAM316 host target gene, herein designated VGAM HOST TARGET GENE, encodes a corresponding messenger RNA, VGAM316 host target RNA, herein designated VGAM HOST TARGET RNA. VGAM316 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM316 RNA, herein designated VGAM RNA, binds complementarily to one or more host target binding sites located in untranslated regions of VGAM316 host target RNA, herein designated VGAM HOST TARGET RNA. This complementary binding is due to the fact that the nucleotide sequence of VGAM316 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM316 RNA, herein designated VGAM RNA, may have a different number of host target binding sites in untranslated regions of a VGAM316 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM316 RNA, herein designated VGAM RNA, to host target binding sites on VGAM316 host target RNA, herein designated VGAM HOST TARGET RNA, such as BINDING SITE I, BINDING SITE II and BINDING SITE III, inhibits translation of VGAM316 host target RNA into VGAM316 host target protein, herein designated VGAM HOST TARGET PROTEIN. VGAM host target protein is therefore outlined by a broken line.

It is appreciated that VGAM316 host target gene, herein designated VGAM HOST TARGET GENE, in fact represents a plurality of VGAM316 host target genes. The mRNA of each one of this plurality of VGAM316 host target genes comprises one or more host target binding sites, each having a nucleotide sequence which is at least partly complementary to VGAM316 RNA, herein designated VGAM RNA, and which when bound by VGAM316 RNA causes inhibition of translation of respective one or more VGAM316 host target proteins.

It is further appreciated by one skilled in the art that the mode of translational inhibition illustrated by FIG. 1 with specific reference to translational inhibition exerted by VGAM316 gene, herein designated VGAM GENE, on one or more VGAM316 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM316 is inhibition of expression of host target genes, as part of a novel viral mechanism of attacking a host. Accordingly, utilities of VGAM316 include diagnosis, prevention and treatment of viral infection by Cryphonectria Hypovirus 3. Specific functions, and accordingly utilities, of VGAM316 correlate with, and may be deduced from, the identity of the host target genes which VGAM316 binds and inhibits, and the function of these host target genes, as elaborated hereinbelow.

Nucleotide sequences of the VGAM316 precursor RNA, herein designated VGAM PRECURSOR RNA, and of the 'diced' VGAM316 RNA, herein designated VGAM RNA, and a schematic representation of the secondary folding of VGAM316 folded precursor RNA, herein designated VGAM FOLDED PRECURSOR RNA, of VGAM316 are further described hereinbelow with reference to Table 1.

Nucleotide sequences of host target binding sites, such as BINDING SITE-I, BINDING SITE-II and BINDING SITE-III of FIG. 1, found on VGAM316 host target RNA, and schematic representation of the complementarity of each of these host target binding sites to VGAM316 RNA, herein designated VGAM RNA, are described hereinbelow with reference to Table 2.

As mentioned hereinabove with reference to FIG. 1, a function of VGAM316 gene, herein designated VGAM is inhibition of expression of VGAM316 target genes. It is appreciated that specific functions, and accordingly utilities, of VGAM316 correlate with, and may be deduced from, the identity of the target genes which VGAM316 binds and inhibits, and the function of these target genes, as elaborated hereinbelow.

Adaptor-related Protein Complex 1, Gamma 1 Subunit (AP1G1, Accession NM_001128) is a VGAM316 host target gene. AP1G1 BINDING SITE is HOST TARGET binding site found in the 3' untranslated region of mRNA encoded by AP1G1, corresponding to a HOST TARGET binding site such as BINDING SITE I, BINDING SITE II or BINDING SITE III. Table 2 illustrates the complementarity of the nucleotide sequences of AP1G1 BINDING SITE, designated SEQ ID:6800, to the nucleotide sequence of VGAM316 RNA, herein designated VGAM RNA, also designated SEQ ID:3027.

A function of VGAM316 is therefore inhibition of Adaptor-related Protein Complex 1, Gamma 1 Subunit (AP1G1, Accession NM_001128), a gene which promotes the formation of clathrin-coated pits and vesicles. Accordingly, utilities of VGAM316 include diagnosis, prevention and treatment of diseases and clinical conditions associated with AP1G1. The function of AP1G1 has been established by previous studies. Adaptins are important components of heterotetrameric adaptor complexes (APs) whose role is to promote the formation of clathrin-coated pits and vesicles. The AP-1 adaptor, localized at the trans-Golgi network, is composed of 2 approximately 100-kD subunits, beta-prime-adaptin (OMIM Ref. No. 600157) and gamma-adaptin; 1 medium subunit, AP47 (OMIM Ref. No. 603535); and 1 small subunit, AP19 (OMIM Ref. No. 603531). By screening a human fetal brain library with a mouse gamma-adaptin cDNA, Peyrard et al. (1998) isolated cDNAs encoding human gamma-adaptin. The predicted 825-amino acid protein shares 99% identity with mouse gamma-adaptin. Northern blot analysis revealed that gamma-adaptin was expressed as a 7.5-kb transcript in all human tissues tested. An additional 4.4-kb mRNA was present in most tissues, and an 8.5-kb mRNA was detected in pancreas and peripheral blood leukocytes Full details of the abovementioned studies are described in the following publications, the disclosure of which are hereby incorporated by reference:

Doray, B.; Ghosh, P.; Griffith, J.; Geuze, H. J.; Kornfeld, S.: Cooperation of GGAs and AP-1 in packaging MPRs at the trans-Golgi network. Science 297: 1700-1703, 2002; and Peyrard, M.; Parveneh, S.; Lagercrantz, S.; Ekman, M.; Fransson, I.; Sahlen, S.; Dumanski, J. P.: Cloning, expression pattern, and chromosomal assignment to 16q23 of the human gamma-a.

Further studies establishing the function and utilities of AP1G1 are found in John Hopkins OMIM database record ID 603533, and in sited publications numbered 12596 listed in the bibliography section hereinbelow, which are also hereby incorporated by reference. Cold Autoinflammatory Syndrome 1 (CIAS1, Accession NM_004895) is another VGAM316 host target gene. CIAS1 BINDING SITE is HOST TARGET binding site found in the 5' untranslated region of mRNA encoded by CIAS1, corresponding to a HOST TARGET binding site such as BINDING SITE I, BINDING SITE II or BINDING SITE III. Table 2 illustrates the complementarity of the nucleotide sequences of CIAS1 BINDING SITE, designated SEQ ID:11321, to the nucleotide sequence of VGAM316 RNA, herein designated VGAM RNA, also designated SEQ ID:3027.

Another function of VGAM316 is therefore inhibition of Cold Autoinflammatory Syndrome 1 (CIAS1, Accession NM_004895), a gene which may mediate protein-protein interactions; contains a leucine rich repeat. Accordingly, utilities of VGAM316 include diagnosis, prevention and treatment of diseases and clinical conditions associated with CIAS1. The function of CIAS1 has been established by previous studies. In a positional cloning effort to identify the gene mutated in familial cold autoinflammatory syndrome and Muckle-Wells syndrome, both of which map to 1q44, Hoffman et al. (2001) cloned and characterized the CIAS1 gene, so named for 'cold-induced autoinflammatory syndrome.' The full-length cDNA corresponds to a 9-exon gene encoding an open reading frame of 3,105 basepairs with 2 potential start codons in exon 1, with the second start codon meeting more Kozak criteria, and a stop codon at exon 9. Northern blot analysis identified a broad mRNA band of approximately 4 kb expressed at a low level in peripheral blood leukocytes; little or no expression was detectable in other tissues. Further analysis revealed extensive alternative splicing of exons 4 through 8 that resulted in mRNAs ranging from 3,315 to 4,170 bp, consistent with the Northern blot analysis. The predicted protein encoded by the first splice form of CIAS1 (exons 1-3, 5, and 7-9), called cryopyrin, consists of 920 amino acids with a size of 105.7 kD and a PI of 6.16. The protein sequence contains several distinct motifs including a pyrin domain in the amino terminus (amino acids 13 through 83), a central nucleotide-binding site (NACHT subfamily) domain in exon 3 (amino acids 217 to 533), and a C-terminal leucine-rich repeat domain containing 7 leucine-rich repeats (amino acids 697 through 920). No nuclear localization signals were identified and no clear transmembrane regions were found. The largest protein potentially encoded by the 9 exons of CIAS1 consists of 1,034 amino acids with a size of 117.9 kD and 11 C-terminal leucine-rich repeats. Hoffman et al. (2001) suggested that cryopyrin is a signaling protein involved in the regulation of apoptosis. Dode et al. (2002) identified CIAS1 mutations, all located in exon 3, in 9 unrelated families with MWS and in 3 unrelated families with familial cold urticaria (FCU), originating from France, England, and Algeria. Five mutations were novel. The R260W mutation (606416.0005) was identified in 2 families with MWS and in 2 families with FCU, of different ethnic origins, thereby demonstrating that a single CIAS1 mutation may cause both syndromes. This result indicated that modifier genes are involved in determining either an MWS or an FCU phenotype. The finding of the G569R mutation (606416.0006) in asymptomatic individuals further emphasized the importance of a modifier gene (or genes) in determining disease phenotype. The authors suggested that identification of modifiers was likely to have significant therapeutic implications for these severe diseases.

Full details of the abovementioned studies are described in the following publications, the disclosure of which are hereby incorporated by reference:

Dode, C.; Le Du, N.; Cuisset, L.; Letourneur, F.; Berthelot, J.-M.; Vaudour, G.; Meyrier, A.; Watts, R. A.; Scott, D. G. I.; Nicholls, A.; Granel, B.; Frances, C.; Garcier, F.; Edery, P.; Boulinguez, S.; Domergues, J.-P.; Delpech, M.; Grateau, G.: New mutations of CIAS1 that are responsible for Muckle-Wells syndrome and familial cold urticaria: a novel mutation underlies both syndromes. Am. J. Hum. Genet. 70:1498-1506, 2002; and Hoffman, H. M.; Mueller, J. L.; Broide, D. H.; Wanderer, A. A.; Kolodner, R. D.: Mutation of a new gene encoding a putative pyrin-like protein causes familial cold autoinflammatory syn.

Further studies establishing the function and utilities of CIAS1 are found in John Hopkins OMIM database record ID 606416, and in sited publications numbered 6762-6763, 120 and 8801 listed in the bibliography section hereinbelow, which are also hereby incorporated by reference. Coagulation Factor II (thrombin) Receptor (F2R, Accession NM_001992) is another VGAM316 host target gene. F2R BINDING SITE is HOST TARGET binding site found in the 3' untranslated region of mRNA encoded by F2R, corresponding to a HOST TARGET binding site such as BINDING SITE I, BINDING SITE II or BINDING SITE III. Table 2 illustrates the complementarity of the nucleotide sequences of F2R BINDING SITE, designated SEQ ID:7721, to the nucleotide sequence of VGAM316 RNA, herein designated VGAM RNA, also designated SEQ ID:3027.

Another function of VGAM316 is therefore inhibition of Coagulation Factor II (thrombin) Receptor (F2R, Accession NM_001992), a gene which Thrombin receptor; G protein-coupled receptor involved in platelet activation. Accordingly, utilities of VGAM316 include diagnosis, prevention and treatment of diseases and clinical conditions associated with F2R. The function of F2R and its association with various diseases and clinical conditions, has been established by previous studies, as described hereinabove with reference to VGAM140. LIM Domain Kinase 1 (LIMK1, Accession NM_016735) is another VGAM316 host target gene. LIMK1 BINDING SITE is HOST TARGET binding site found in the 3' untranslated region of mRNA encoded by LIMK1, corresponding to a HOST TARGET binding site such as BINDING SITE I, BINDING SITE II or BINDING SITE III. Table 2 illustrates the complementarity of the nucleotide sequences of LIMK1 BINDING SITE, designated SEQ ID:18793, to the nucleotide sequence of VGAM316 RNA, herein designated VGAM RNA, also designated SEQ ID:3027.

Another function of VGAM316 is therefore inhibition of LIM Domain Kinase 1 (LIMK1, Accession NM_016735). Accordingly, utilities of VGAM316 include diagnosis, prevention and treatment of diseases and clinical conditions associated with LIMK1. Microtubule-associated Protein 1B (MAP1B, Accession NM_005909) is another VGAM316 host target gene. MAP1B BINDING SITE1 and MAP1B BINDING SITE2 are HOST TARGET binding sites found in untranslated regions of mRNA encoded by MAP1B, corresponding to HOST TARGET binding sites such as BINDING SITE I, BINDING SITE II or BINDING SITE III. Table 2 illustrates the complementarity of the nucleotide sequences of MAP1B BINDING SITE1 and MAP1B BINDING SITE2, designated SEQ ID:12535 and SEQ ID:25712 respectively, to the nucleotide sequence of VGAM316 RNA, herein designated VGAM RNA, also designated SEQ ID:3027.

Another function of VGAM316 is therefore inhibition of Microtubule-associated Protein 1B (MAP1B, Accession NM_005909), a gene which may have a role in neuronal plasticity and brain development. Accordingly, utilities of VGAM316 include diagnosis, prevention and treatment of diseases and clinical conditions associated with MAP1B. The function of MAP1B has been established by previous studies. Using a polyclonal antiserum directed against the C-terminal domain of dystrophin, Lien et al. (1991) isolated a cDNA clone encoding an antigenically crossreactive protein, microtubule-associated protein 1B (MAP1B). By in situ hybridization, the gene was mapped to 5q13 in proximity to the spinal muscular atrophy (SMA; 253300) locus. Genetic linkage analysis of SMA families using a human dinucleotide repeat polymorphism just 3-prime of the MAP1B gene has shown tight linkage to SMA mutations. These mapping data, together with the postulated role of MAP1B in neuronal morphogenesis and its localization in anterior horn motor neurons, suggest a possible association with SMA. The maximum lod score between SMA and MAP1B for combined sexes was 20.24 at a recombination fraction of 0.02. The 2 recombinants between MAP1B and SMA might appear to eliminate the possibility of an etiologic relationship between MAP1B and SMA. However, there is likely to be nonallelic heterogeneity, particularly among chronic cases of SMA. If MAP1B were indeed the SMA locus, it would be expected to be recombinant in families that have mutations at another locus. MAP1B was found to be the closest marker distal to the locus for SMA; its 5-prime end was oriented toward the centromere (Wirth et al., 1993). Hammarback et al. (1991) found that LC1, one of the 3 light chains that makes up the MAP1B complex, is encoded within the 3-prime end of the MAP1B heavy chain gene. Their data suggested that the heavy chain and light chain 1 are produced by proteolytic processing of a precursor polypeptide. Lien et al. (1994) completely cloned and sequenced the human MAP1B gene. The expressed protein showed 91% overall identity with rat and mouse MAP1B. The gene has 7 exons; the third exon contains sequence not represented in mouse or rat MAP1B. This sequence, labeled 3A, is present at the 5-prime end of an alternative transcript that is expressed at approximately one-tenth the level of the full-length transcript. Neuronal microtubules are considered to have a role in dendrite and axon formation. Different portions of the developing and adult brain microtubules are associated with different microtubule-associated proteins. MAP1B is expressed in different portions of the brain and may have a role in neuronal plasticity and brain development. Edelmann et al. (1996) generated mice that carry an insertion in MAP1B by gene-targeting methods. Mice homozygous for the modification died during embryogenesis. The heterozygotes exhibited a spectrum of phenotypes including slower growth rates, lack of visual acuity in one or both eyes, and motor system abnormalities. Histochemical analysis of the severely affected mice revealed that their Purkinje cell dendritic processes were abnormal, did not react with MAP1B antibodies, and showed reduced staining with MAP1A (OMIM Ref. No. 600178) antibodies. Similar histologic and immunochemical changes were observed in the olfactory bulb, hippocampus, and retina, providing a basis for the observed phenotypes Full details of the abovementioned studies are described in the following publications, the disclosure of which are hereby incorporated by reference:

Lien, L. L.; Feener, C. A.; Fischbach, N.; Kunkel, L. M.: Cloning of human microtubule-associated protein 1B and the identification of a related gene on chromosome 15. Genomics 22:273-280, 1994; and Edelmann, W.; Zervas, M.; Costello, P.; Roback. L.; Fischer, I.; Hammarback, J. A.; Cowan, N.; Davies, P.; Wainer, B.; Kucherlapati, R.: Neuronal abnormalities in microtubule-associated pr.

Further studies establishing the function and utilities of MAP1B are found in John Hopkins OMIM database record ID 157129, and in sited publications numbered 10746-10751 listed in the bibliography section hereinbelow, which are also hereby incorporated by reference. Matrix Metalloproteinase 25 (MMP25, Accession NM_022468) is another VGAM316 host target gene. MMP25 BINDING SITE is HOST TARGET binding site found in the 3' untranslated region of mRNA encoded by MMP25, corresponding to a HOST TARGET binding site such as BINDING SITE I, BINDING SITE II or BINDING SITE III. Table 2 illustrates the complementarity of the nucleotide sequences of MMP25 BINDING SITE, designated SEQ ID:22819, to the nucleotide sequence of VGAM316 RNA, herein designated VGAM RNA, also designated SEQ ID:3027.

Another function of VGAM316 is therefore inhibition of Matrix Metalloproteinase 25 (MMP25, Accession NM_022468). Accordingly, utilities of VGAM316 include diagnosis, prevention and treatment of diseases and clinical conditions associated with MMP25. Myosin IA (MYO1A, Accession NM_005379) is another VGAM316 host target gene. MYO1A BINDING SITE is HOST TARGET binding site found in the 5' untranslated region of mRNA encoded by MYO1A, corresponding to a HOST TARGET binding site such as BINDING SITE I, BINDING SITE II or BINDING SITE III. Table 2 illustrates the complementarity of the nucleotide sequences of MYO1A BINDING SITE, designated SEQ ID:11861, to the nucleotide sequence of VGAM316 RNA, herein designated VGAM RNA, also designated SEQ ID:3027.

Another function of VGAM316 is therefore inhibition of Myosin IA (MYO1A, Accession NM_005379), a gene which is involved in directing the movement of organelles along actin filaments (potential). Accordingly, utilities of VGAM316 include diagnosis, prevention and treatment of diseases and clinical conditions associated with MYO1A. The function of MYO1A has been established by previous studies. Myosins are molecular motors that, upon interaction with actin filaments, utilize energy from ATP hydrolysis to generate mechanical force. Phylogenetic analysis of the myosin motor domains identified 11 distinct classes, 7 of which are expressed in vertebrates (reviewed by Mooseker and Cheney, 1995). These 7 vertebrate myosin classes include conventional myosin (myosin II) and 6 less well characterized unconventional myosin classes, myosins I, V (see OMIM Ref. No. 160777), VI (OMIM Ref. No. 600970), VII (see OMIM Ref. No. 276903), IX, and X (OMIM Ref. No. 601481). Each myosin has a conserved N-terminal motor domain (25 to 40% identical at the amino acid level) that contains both ATP-binding and actin-binding sequences. Following the motor domain is a light-chain-binding 'neck' region containing 1-6 copies of a repeat element, the IQ motif, that serves as a binding site for calmodulin (OMIM Ref. No. 114180) or other members of the EF-hand superfamily of calcium-binding proteins. At the C-terminus, each myosin class has a distinct tail domain that serves in dimerization, membrane binding, protein binding, and/or enzymatic activities and targets each myosin to its particular subcellular location (Hasson et al., 1996). By interspecific mouse backcross mapping, Hasson et al. (1996) localized the Myo1a gene to mouse chromosome 10 which predicted a location of the human homolog on 12q13. By fluorescence in situ hybridization, they demonstrated that the human MYO1A gene is located on 12q13-q15.

Full details of the abovementioned studies are described in the following publications, the disclosure of which are hereby incorporated by reference:

Hasson, T.; Skowron, J. F.; Gilbert, D. J.; Avraham, K. B.; Perry, W. L.; Bement, W. M.; Anderson, B. L.; Sherr, E. H.; Chen, Z.-Y.; Greene, L. A.; Ward, D. C.; Corey, D. P.; Mooseker, M. S.; Copeland, N. G.; Jenkins, N. A.: Mapping of unconventional myosins in mouse and human. Genomics 36:431-439, 1996; and Mooseker, M. S.; Cheney, R. E.: Unconventional myosins. Annu. Rev. Cell Dev. Biol. 11:633-675, 1995.

Further studies establishing the function and utilities of MYO1A are found in John Hopkins OMIM database record ID 601478, and in sited publications numbered 7027 listed in the bibliography section hereinbelow, which are also hereby incorporated by reference. Optic Atrophy 1 (autosomal dominant) (OPA1, Accession NM_130833) is another VGAM316 host target gene. OPA1 BINDING SITE1 through OPA1 BINDING SITE5 are HOST TARGET binding sites found in untranslated regions of mRNA encoded by OPA1, corresponding to HOST TARGET binding sites such as BINDING SITE I, BINDING SITE II or BINDING SITE III. Table 2 illustrates the complementarity of the nucleotide sequences of OPA1 BINDING SITE1 through OPA1 BINDING SITE5, designated SEQ ID:28326, SEQ ID:28334, SEQ ID:28342, SEQ ID:28350 and SEQ ID:28358 respectively, to the nucleotide sequence of VGAM316 RNA, herein designated VGAM RNA, also designated SEQ ID:3027.

Another function of VGAM316 is therefore inhibition of Optic Atrophy 1 (autosomal dominant) (OPA1, Accession NM_130833). Accordingly, utilities of VGAM316 include diagnosis, prevention and treatment of diseases and clinical conditions associated with OPA1. Chromosome 21 Open Reading Frame 25 (C21orf25, Accession XM_032945) is another VGAM316 host target gene. C21orf25 BINDING SITE is HOST TARGET binding site found in the 3' untranslated region of mRNA encoded by C21orf25, corresponding to a HOST TARGET binding site such as BINDING SITE I, BINDING SITE II or BINDING SITE III. Table 2 illustrates the complementarity of the nucleotide sequences of C21orf25 BINDING SITE, designated SEQ ID:31795, to the nucleotide sequence of VGAM316 RNA, herein designated VGAM RNA, also designated SEQ ID:3027.

Another function of VGAM316 is therefore inhibition of Chromosome 21 Open Reading Frame 25 (C21orf25, Accession XM_032945). Accordingly, utilities of VGAM316 include diagnosis, prevention and treatment of diseases and clinical conditions associated with C21orf25. Cerebellin 1 Precursor (CBLN1, Accession NM_004352) is another VGAM316 host target gene. CBLN1 BINDING SITE is HOST TARGET binding site found in the 3' untranslated region of mRNA encoded by CBLN1, corresponding to a HOST TARGET binding site such as BINDING SITE I, BINDING SITE II or BINDING SITE III. Table 2 illustrates the complementarity of the nucleotide sequences of CBLN1 BINDING SITE, designated SEQ ID:10556, to the nucleotide sequence of VGAM316 RNA, herein designated VGAM RNA, also designated SEQ ID:3027.

Another function of VGAM316 is therefore inhibition of Cerebellin 1 Precursor (CBLN1, Accession NM_004352). Accordingly, utilities of VGAM316 include diagnosis, prevention and treatment of diseases and clinical conditions associated with CBLN1. Cellular Repressor of E1A-stimulated Genes (CREG, Accession NM_003851) is another VGAM316 host target gene. CREG BINDING SITE is HOST TARGET binding site found in the 3' untranslated region of mRNA encoded by CREG, corresponding to a HOST TARGET binding site such as BINDING SITE I, BINDING SITE II or BINDING SITE III. Table 2 illustrates the complementarity of the nucleotide sequences of CREG BINDING SITE, designated SEQ ID:9945, to the nucleotide sequence of VGAM316 RNA, herein designated VGAM RNA, also designated SEQ ID:3027.

Another function of VGAM316 is therefore inhibition of Cellular Repressor of E1A-stimulated Genes (CREG, Accession NM_003851). Accordingly, utilities of VGAM316 include diagnosis, prevention and treatment of diseases and clinical conditions associated with CREG. FLJ10724 (Accession NM_018194) is another VGAM316 host target gene. FLJ10724 BINDING SITE is HOST TARGET binding site found in the 3' untranslated region of mRNA encoded by FLJ10724, corresponding to a HOST TARGET binding site such as BINDING SITE I, BINDING SITE II or BINDING SITE III. Table 2 illustrates the complementarity of the nucleotide sequences of FLJ10724 BINDING SITE, designated SEQ ID:20051, to the nucleotide sequence of VGAM316 RNA, herein designated VGAM RNA, also designated SEQ ID:3027.

Another function of VGAM316 is therefore inhibition of FLJ10724 (Accession NM_018194). Accordingly, utilities of VGAM316 include diagnosis, prevention and treatment of diseases and clinical conditions associated with FLJ10724. FLJ14011 (Accession NM_022103) is another VGAM316 host target gene. FLJ14011 BINDING SITE is HOST TARGET binding site found in the 5' untranslated region of mRNA encoded by FLJ14011, corresponding to a HOST TARGET binding site such as BINDING SITE I, BINDING SITE II or BINDING SITE III. Table 2 illustrates the complementarity of the nucleotide sequences of FLJ14011 BINDING SITE, designated SEQ ID:22648, to the nucleotide sequence of VGAM316 RNA, herein designated VGAM RNA, also designated SEQ ID:3027.

Another function of VGAM316 is therefore inhibition of FLJ14011 (Accession NM_022103). Accordingly, utilities of VGAM316 include diagnosis, prevention and treatment of diseases and clinical conditions associated with FLJ14011. FLJ23510 (Accession NM_024720) is another VGAM316 host target gene. FLJ23510 BINDING SITE is HOST TARGET binding site found in the 3' untranslated region of mRNA encoded by FLJ23510, corresponding to a HOST TARGET binding site such as BINDING SITE I, BINDING SITE II or BINDING SITE III. Table 2 illustrates the complementarity of the nucleotide sequences of FLJ23510 BINDING SITE, designated SEQ ID:24055, to the nucleotide sequence of VGAM316 RNA, herein designated VGAM RNA, also designated SEQ ID:3027.

Another function of VGAM316 is therefore inhibition of FLJ23510 (Accession NM_024720). Accordingly, utilities of VGAM316 include diagnosis, prevention and treatment of diseases and clinical conditions associated with FLJ23510. Interleukin 1 Receptor Accessory Protein-like 1 (IL1RAPL1, Accession NM_014271) is another VGAM316 host target gene. IL1RAPL1 BINDING SITE is HOST TARGET binding site found in the 3' untranslated region of mRNA encoded by IL1RAPL1, corresponding to a HOST TARGET binding site such as BINDING SITE I, BINDING SITE II or BINDING SITE III. Table 2 illustrates the complementarity of the nucleotide sequences of IL1RAPL1 BINDING SITE, designated SEQ ID:15550, to the nucleotide sequence of VGAM316 RNA, herein designated VGAM RNA, also designated SEQ ID:3027.

Another function of VGAM316 is therefore inhibition of Interleukin 1 Receptor Accessory Protein-like 1 (IL1RAPL1, Accession NM_014271). Accordingly, utilities of VGAM316 include diagnosis, prevention and treatment of diseases and clinical conditions associated with IL1RAPL1. KIAA0455 (Accession XM_051785) is another VGAM316 host target gene. KIAA0455 BINDING SITE is HOST TARGET binding site found in the 3' untranslated region of mRNA encoded by KIAA0455, corresponding to a HOST TARGET binding site such as BINDING SITE I, BINDING SITE II or BINDING SITE III. Table 2 illustrates the complementarity of the nucleotide sequences of KIAA0455 BINDING SITE, designated SEQ ID:35882, to the nucleotide sequence of VGAM316 RNA, herein designated VGAM RNA, also designated SEQ ID:3027.

Another function of VGAM316 is therefore inhibition of KIAA0455 (Accession XM_051785). Accordingly, utilities of VGAM316 include diagnosis, prevention and treatment of diseases and clinical conditions associated with KIAA0455. KIAA0945 (Accession NM_014952) is another VGAM316 host target gene. KIAA0945 BINDING SITE is HOST TARGET binding site found in the 3' untranslated region of mRNA encoded by KIAA0945, corresponding to a HOST TARGET binding site such as BINDING SITE I, BINDING SITE II or BINDING SITE III. Table 2 illustrates the complementarity of the nucleotide sequences of KIAA0945 BINDING SITE, designated SEQ ID:17289, to the nucleotide sequence of VGAM316 RNA, herein designated VGAM RNA, also designated SEQ ID:3027.

Another function of VGAM316 is therefore inhibition of KIAA0945 (Accession NM_014952). Accordingly, utilities of VGAM316 include diagnosis, prevention and treatment of diseases and clinical conditions associated with KIAA0945. NECL1 (Accession NM_021189) is another VGAM316 host target gene. NECL1 BINDING SITE is HOST TARGET binding site found in the 3' untranslated region of mRNA encoded by NECL1, corresponding to a HOST TARGET binding site such as BINDING SITE I, BINDING SITE II or BINDING SITE III. Table 2 illustrates the complementarity of the nucleotide sequences of NECL1 BINDING SITE, designated SEQ ID:22167, to the nucleotide sequence of VGAM316 RNA, herein designated VGAM RNA, also designated SEQ ID:3027.

Another function of VGAM316 is therefore inhibition of NECL1 (Accession NM_021189). Accordingly, utilities of VGAM316 include diagnosis, prevention and treatment of diseases and clinical conditions associated with NECL1. P311 (Accession NM_004772) is another VGAM316 host target gene. P311 BINDING SITE is HOST TARGET binding site found in the 3' untranslated region of mRNA encoded by P311, corresponding to a HOST TARGET binding site such as BINDING SITE I, BINDING SITE II or BINDING SITE III. Table 2 illustrates the complementarity of the nucleotide sequences of P311 BINDING SITE, designated SEQ ID:11162, to the nucleotide sequence of VGAM316 RNA, herein designated VGAM RNA, also designated SEQ ID:3027.

Another function of VGAM316 is therefore inhibition of P311 (Accession NM_004772). Accordingly, utilities of VGAM316 include diagnosis, prevention and treatment of diseases and clinical conditions associated with P311. RAB10, Member RAS Oncogene Family (RAB10, Accession XM_097979) is another VGAM316 host target gene. RAB10 BINDING SITE is HOST TARGET binding site found in the 5' untranslated region of mRNA encoded by RAB10, corresponding to a HOST TARGET binding site such as BINDING SITE I, BINDING SITE II or BINDING SITE III. Table 2 illustrates the complementarity of the nucleotide sequences of RAB10 BINDING SITE, designated SEQ ID:41280, to the nucleotide sequence of VGAM316 RNA, herein designated VGAM RNA, also designated SEQ ID:3027.

Another function of VGAM316 is therefore inhibition of RAB10, Member RAS Oncogene Family (RAB10, Accession XM_097979). Accordingly, utilities of VGAM316 include diagnosis, prevention and treatment of diseases and clinical conditions associated with RAB10. SR-BP1 (Accession NM_005866) is another VGAM316 host target gene. SR-BP1 BINDING SITE is HOST TARGET binding site found in the 3' untranslated region of mRNA encoded by SR-BP1, corresponding to a HOST TARGET binding site such as BINDING SITE I, BINDING SITE II or BINDING SITE III. Table 2 illustrates the complementarity of the nucleotide sequences of SR-BP1 BINDING SITE, designated SEQ ID:12486, to the nucleotide sequence of VGAM316 RNA, herein designated VGAM RNA, also designated SEQ ID:3027.

Another function of VGAM316 is therefore inhibition of SR-BP1 (Accession NM_005866). Accordingly, utilities of VGAM316 include diagnosis, prevention and treatment of diseases and clinical conditions associated with SR-BP1. Transducer of ERBB2, 2 (TOB2, Accession XM_170995) is another VGAM316 host target gene. TOB2 BINDING SITE is HOST TARGET binding site found in the 3' untranslated region of mRNA encoded by TOB2, corresponding to a HOST TARGET binding site such as BINDING SITE I, BINDING SITE II or BINDING SITE III. Table 2 illustrates the complementarity of the nucleotide sequences of TOB2 BINDING SITE, designated SEQ ID:45759, to the nucleotide sequence of VGAM316 RNA, herein designated VGAM RNA, also designated SEQ ID:3027.

Another function of VGAM316 is therefore inhibition of Transducer of ERBB2, 2 (TOB2, Accession XM_170995). Accordingly, utilities of VGAM316 include diagnosis, prevention and treatment of diseases and clinical conditions associated with TOB2. Zinc Finger, DHHC Domain Containing 3 (ZDHHC3, Accession NM_016598) is another VGAM316 host target gene. ZDHHC3 BINDING SITE is HOST TARGET binding site found in the 3' untranslated region of mRNA encoded by ZDHHC3, corresponding to a HOST TARGET binding site such as BINDING SITE I, BINDING SITE II or BINDING SITE III. Table 2 illustrates the complementarity of the nucleotide sequences of ZDHHC3 BINDING SITE, designated SEQ ID:18687, to the nucleotide sequence of VGAM316 RNA, herein designated VGAM RNA, also designated SEQ ID:3027.

Another function of VGAM316 is therefore inhibition of Zinc Finger, DHHC Domain Containing 3 (ZDHHC3, Accession NM_016598). Accordingly, utilities of VGAM316 include diagnosis, prevention and treatment of diseases and clinical conditions associated with ZDHHC3. LOC115265 (Accession XM_055596) is another VGAM316 host target gene. LOC115265 BINDING SITE is HOST TARGET binding site found in the 3' untranslated region of mRNA encoded by LOC115265, corresponding to a HOST TARGET binding site such as BINDING SITE I, BINDING SITE II or BINDING SITE III. Table 2 illustrates the complementarity of the nucleotide sequences of LOC115265 BINDING SITE, designated SEQ ID:36308, to the nucleotide sequence of VGAM316 RNA, herein designated VGAM RNA, also designated SEQ ID:3027.

Another function of VGAM316 is therefore inhibition of LOC115265 (Accession XM_055596). Accordingly, utilities of VGAM316 include diagnosis, prevention and treatment of diseases and clinical conditions associated with LOC115265. LOC145719 (Accession XM_096848) is another VGAM316 host target gene. LOC145719 BINDING SITE is HOST TARGET binding site found in the 3' untranslated region of mRNA encoded by LOC145719, corresponding to a HOST TARGET binding site such as BINDING SITE I, BINDING SITE II or BINDING SITE III. Table 2 illustrates the complementarity of the nucleotide sequences of LOC145719 BINDING SITE, designated SEQ ID:40569, to the nucleotide sequence of VGAM316 RNA, herein designated VGAM RNA, also designated SEQ ID:3027.

Another function of VGAM316 is therefore inhibition of LOC145719 (Accession XM_096848). Accordingly, utilities of VGAM316 include diagnosis, prevention and treatment of diseases and clinical conditions associated with LOC145719. LOC145720 (Accession XM_096846) is another VGAM316 host target gene. LOC145720 BINDING SITE is HOST TARGET binding site found in the 3' untranslated region of mRNA encoded by LOC145720, corresponding to a HOST TARGET binding site such as BINDING SITE I, BINDING SITE II or BINDING SITE III. Table 2 illustrates the complementarity of the nucleotide sequences of LOC145720 BINDING SITE, designated SEQ ID:40559, to the nucleotide sequence of VGAM316 RNA, herein designated VGAM RNA, also designated SEQ ID:3027.

Another function of VGAM316 is therefore inhibition of LOC145720 (Accession XM_096846). Accordingly, utilities of VGAM316 include diagnosis, prevention and treatment of diseases and clinical conditions associated with LOC145720. LOC147671 (Accession XM_085844) is another VGAM316 host target gene. LOC147671 BINDING SITE is HOST TARGET binding site found in the 3' untranslated region of mRNA encoded by LOC147671, corresponding to a HOST TARGET binding site such as BINDING SITE I, BINDING SITE II or BINDING SITE III. Table 2 illustrates the complementarity of the nucleotide sequences of LOC147671 BINDING SITE, designated SEQ ID:38374, to the nucleotide sequence of VGAM316 RNA, herein designated VGAM RNA, also designated SEQ ID:3027.

Another function of VGAM316 is therefore inhibition of LOC147671 (Accession XM_085844). Accordingly, utilities of VGAM316 include diagnosis, prevention and treatment of diseases and clinical conditions associated with LOC147671. LOC148137 (Accession NM_144692) is another VGAM316 host target gene. LOC148137 BINDING SITE is HOST TARGET binding site found in the 3' untranslated region of mRNA encoded by LOC148137, corresponding to a HOST TARGET binding site such as BINDING SITE I, BINDING SITE II or BINDING SITE III. Table 2 illustrates the complementarity of the nucleotide sequences of LOC148137 BINDING SITE, designated SEQ ID:29518, to the nucleotide sequence of VGAM316 RNA, herein designated VGAM RNA, also designated SEQ ID:3027.

Another function of VGAM316 is therefore inhibition of LOC148137 (Accession NM_144692). Accordingly, utilities of VGAM316 include diagnosis, prevention and treatment of diseases and clinical conditions associated with LOC148137. LOC150295 (Accession XM_097868) is another VGAM316 host target gene. LOC150295 BINDING SITE is HOST TARGET binding site found in the 3' untranslated region of mRNA encoded by LOC150295, corresponding to a HOST TARGET binding site such as BINDING SITE I, BINDING SITE II or BINDING SITE III. Table 2 illustrates the complementarity of the nucleotide sequences of LOC150295 BINDING SITE, designated SEQ ID:41179, to the nucleotide sequence of VGAM316 RNA, herein designated VGAM RNA, also designated SEQ ID:3027.

Another function of VGAM316 is therefore inhibition of LOC150295 (Accession XM_097868). Accordingly, utilities of VGAM316 include diagnosis, prevention and treatment of diseases and clinical conditions associated with LOC150295. LOC197117 (Accession XM_116989) is another VGAM316 host target gene. LOC197117 BINDING SITE is HOST TARGET binding site found in the 3' untranslated region of mRNA encoded by LOC197117, corresponding to a HOST TARGET binding site such as BINDING SITE I, BINDING SITE II or BINDING SITE III. Table 2 illustrates the complementarity of the nucleotide sequences of LOC197117 BINDING SITE, designated SEQ ID:43192, to the nucleotide sequence of VGAM316 RNA, herein designated VGAM RNA, also designated SEQ ID:3027.

Another function of VGAM316 is therefore inhibition of LOC197117 (Accession XM_116989). Accordingly, utilities of VGAM316 include diagnosis, prevention and treatment of diseases and clinical conditions associated with LOC197117. LOC221755 (Accession XM_166465) is another VGAM316 host target gene. LOC221755 BINDING SITE is HOST TARGET binding site found in the 3' untranslated region of mRNA encoded by LOC221755, corresponding to a HOST TARGET binding site such as BINDING SITE I, BINDING SITE II or BINDING SITE III. Table 2 illustrates the complementarity of the nucleotide sequences of LOC221755 BINDING SITE, designated SEQ ID:44385, to the nucleotide sequence of VGAM316 RNA, herein designated VGAM RNA, also designated SEQ ID:3027.

Another function of VGAM316 is therefore inhibition of LOC221755 (Accession XM_166465). Accordingly, utilities of VGAM316 include diagnosis, prevention and treatment of diseases and clinical conditions associated with LOC221755. LOC254020 (Accession XM_171198) is another VGAM316 host target gene. LOC254020 BINDING SITE is HOST TARGET binding site found in the 5' untranslated region of mRNA encoded by LOC254020, corresponding to a HOST TARGET binding site such as BINDING SITE I, BINDING SITE II or BINDING SITE III. Table 2 illustrates the complementarity of the nucleotide sequences of LOC254020 BINDING SITE, designated SEQ ID:45987, to the nucleotide sequence of VGAM316 RNA, herein designated VGAM RNA, also designated SEQ ID:3027.

Another function of VGAM316 is therefore inhibition of LOC254020 (Accession XM_171198). Accordingly, utilities of VGAM316 include diagnosis, prevention and treatment of diseases and clinical conditions associated with LOC254020. LOC91250 (Accession XM_037135) is another VGAM316 host target gene. LOC91250 BINDING SITE is HOST TARGET binding site found in the 5' untranslated region of mRNA encoded by LOC91250, corresponding to a HOST TARGET binding site such as BINDING SITE I, BINDING SITE II or BINDING SITE III. Table 2 illustrates the complementarity of the nucleotide sequences of LOC91250 BINDING SITE, designated SEQ ID:32547, to the nucleotide sequence of VGAM316 RNA, herein designated VGAM RNA, also designated SEQ ID:3027.

Another function of VGAM316 is therefore inhibition of LOC91250 (Accession XM_037135). Accordingly, utilities of VGAM316 include diagnosis, prevention and treatment of diseases and clinical conditions associated with LOC91250. LOC92539 (Accession XM_045632) is another VGAM316 host target gene. LOC92539 BINDING SITE is HOST TARGET binding site found in the 5' untranslated region of mRNA encoded by LOC92539, corresponding to a HOST TARGET binding site such as BINDING SITE I, BINDING SITE II or BINDING SITE III. Table 2 illustrates the complementarity of the nucleotide sequences of LOC92539 BINDING SITE, designated SEQ ID:34494, to the nucleotide sequence of VGAM316 RNA, herein designated VGAM RNA, also designated SEQ ID:3027.

Another function of VGAM316 is therefore inhibition of LOC92539 (Accession XM_045632). Accordingly, utilities of VGAM316 include diagnosis, prevention and treatment of diseases and clinical conditions associated with LOC92539. FIG. 1 further provides a conceptual description of a novel bioinformatically detected viral gene of the present invention, referred to here as Viral Genomic Address Messenger 317 (VGAM317) viral gene, which modulates expression of respective host target genes thereof, the function and utility of which host target genes is known in the art.

VGAM317 is a novel bioinformatically detected regulatory, non protein coding, viral micro RNA (miRNA) gene. The method by which VGAM317 was detected is described hereinabove with reference to FIGS. 1-8.

VGAM317 gene, herein designated VGAM GENE, is a viral gene contained in the genome of Cryphonectria Hypovirus 3. VGAM317 host target gene, herein designated VGAM HOST TARGET GENE, is a human gene contained in the human genome.

VGAM317 gene encodes a VGAM317 precursor RNA, herein designated VGAM PRECURSOR RNA. Similar to other miRNA genes, and unlike most ordinary genes, VGAM317 precursor RNA does not encode a protein. A nucleotide sequence identical or highly similar to the nucleotide sequence of VGAM317 precursor RNA is designated SEQ ID:303, and is provided hereinbelow with reference to the sequence listing part. Nucleotide sequence SEQ ID:303 is located at position 1398 relative to the genome of Cryphonectria Hypovirus 3.

VGAM317 precursor RNA folds onto itself, forming VGAM317 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM317 folded precursor RNA into VGAM317 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM317 RNA is designated SEQ ID:3028, and is provided hereinbelow with reference to the sequence listing part.

VGAM317 host target gene, herein designated VGAM HOST TARGET GENE, encodes a corresponding messenger RNA, VGAM317 host target RNA, herein designated VGAM HOST TARGET RNA. VGAM317 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM317 RNA, herein designated VGAM RNA, binds complementarily to one or more host target binding sites located in untranslated regions of VGAM317 host target RNA, herein designated VGAM HOST TARGET RNA. This complementary binding is due to the fact that the nucleotide sequence of VGAM317 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM317 RNA, herein designated VGAM RNA, may have a different number of host target binding sites in untranslated regions of a VGAM317 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM317 RNA, herein designated VGAM RNA, to host target binding sites on VGAM317 host target RNA, herein designated VGAM HOST TARGET RNA, such as BINDING SITE I, BINDING SITE II and BINDING SITE III, inhibits translation of VGAM317 host target RNA into VGAM317 host target protein, herein designated VGAM HOST TARGET PROTEIN. VGAM host target protein is therefore outlined by a broken line.

It is appreciated that VGAM317 host target gene, herein designated VGAM HOST TARGET GENE, in fact represents a plurality of VGAM317 host target genes. The mRNA of each one of this plurality of VGAM317 host target genes comprises one or more host target binding sites, each having a nucleotide sequence which is at least partly complementary to VGAM317 RNA, herein designated VGAM RNA, and which when bound by VGAM317 RNA causes inhibition of translation of respective one or more VGAM317 host target proteins.

It is further appreciated by one skilled in the art that the mode of translational inhibition illustrated by FIG. 1 with specific reference to translational inhibition exerted by VGAM317 gene, herein designated VGAM GENE, on one or more VGAM317 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM317 is inhibition of expression of host target genes, as part of a novel viral mechanism of attacking a host. Accordingly, utilities of VGAM317 include diagnosis, prevention and treatment of viral infection by Cryphonectria Hypovirus 3. Specific functions, and accordingly utilities, of VGAM317 correlate with, and may be deduced from, the identity of the host target genes which VGAM317 binds and inhibits, and the function of these host target genes, as elaborated hereinbelow.

Nucleotide sequences of the VGAM317 precursor RNA, herein designated VGAM PRECURSOR RNA, and of the 'diced' VGAM317 RNA, herein designated VGAM RNA, and a schematic representation of the secondary folding of VGAM317 folded precursor RNA, herein designated VGAM FOLDED PRECURSOR RNA, of VGAM317 are further described hereinbelow with reference to Table 1.

Nucleotide sequences of host target binding sites, such as BINDING SITE-I, BINDING SITE-II and BINDING SITE-III of FIG. 1, found on VGAM317 host target RNA, and schematic representation of the complementarity of each of these host target binding sites to VGAM317 RNA, herein designated VGAM RNA, are described hereinbelow with reference to Table 2.

As mentioned hereinabove with reference to FIG. 1, a function of VGAM317 gene, herein designated VGAM is inhibition of expression of VGAM317 target genes. It is appreciated that specific functions, and accordingly utilities, of VGAM317 correlate with, and may be deduced from, the identity of the target genes which VGAM317 binds and inhibits, and the function of these target genes, as elaborated hereinbelow.

Suppressor of Cytokine Signaling 5 (SOCS5, Accession NM_014011) is a VGAM317 host target gene. SOCS5 BINDING SITE is HOST TARGET binding site found in the 3' untranslated region of mRNA encoded by SOCS5, corresponding to a HOST TARGET binding site such as BINDING SITE I, BINDING SITE II or BINDING SITE III. Table 2 illustrates the complementarity of the nucleotide sequences of SOCS5 BINDING SITE, designated SEQ ID:15224, to the nucleotide sequence of VGAM317 RNA, herein designated VGAM RNA, also designated SEQ ID:3028.

A function of VGAM317 is therefore inhibition of Suppressor of Cytokine Signaling 5 (SOCS5, Accession NM_014011). Accordingly, utilities of VGAM317 include diagnosis, prevention and treatment of diseases and clinical conditions associated with SOCS5. DKFZp434F1719 (Accession NM_032248) is another VGAM317 host target gene. DKFZp434F1719 BINDING SITE is HOST TARGET binding site found in the 3' untranslated region of mRNA encoded by DKFZp434F1719, corresponding to a HOST TARGET binding site such as BINDING SITE I, BINDING SITE II or BINDING SITE III. Table 2 illustrates the complementarity of the nucleotide sequences of DKFZp434F1719 BINDING SITE, designated SEQ ID:25989, to the nucleotide sequence of VGAM317 RNA, herein designated VGAM RNA, also designated SEQ ID:3028.

Another function of VGAM317 is therefore inhibition of DKFZp434F1719 (Accession NM_032248). Accordingly, utilities of VGAM317 include diagnosis, prevention and treatment of diseases and clinical conditions associated with DKFZp434F1719. KIAA0841 (Accession XM_049237) is another VGAM317 host target gene. KIAA0841 BINDING SITE is HOST TARGET binding site found in the 3' untranslated region of mRNA encoded by KIAA0841, corresponding to a HOST TARGET binding site such as BINDING SITE I, BINDING SITE II or BINDING SITE III. Table 2 illustrates the complementarity of the nucleotide sequences of KIAA0841 BINDING SITE, designated SEQ ID:35358, to the nucleotide sequence of VGAM317 RNA, herein designated VGAM RNA, also designated SEQ ID:3028.

Another function of VGAM317 is therefore inhibition of KIAA0841 (Accession XM_049237). Accordingly, utilities of VGAM317 include diagnosis, prevention and treatment of diseases and clinical conditions associated with KIAA0841. KIAA1317 (Accession XM_098368) is another VGAM317 host target gene. KIAA1317 BINDING SITE is HOST TARGET binding site found in the 3' untranslated region of mRNA encoded by KIAA1317, corresponding to a HOST TARGET binding site such as BINDING SITE I, BINDING SITE II or BINDING SITE III. Table 2 illustrates the complementarity of the nucleotide sequences of KIAA1317 BINDING SITE, designated SEQ ID:41625, to the nucleotide sequence of VGAM317 RNA, herein designated VGAM RNA, also designated SEQ ID:3028.

Another function of VGAM317 is therefore inhibition of KIAA1317 (Accession XM_098368). Accordingly, utilities of VGAM317 include diagnosis, prevention and treatment of diseases and clinical conditions associated with KIAA1317. KIAA1546 (Accession XM_042301) is another VGAM317 host target gene. KIAA1546 BINDING SITE is HOST TARGET binding site found in the 3' untranslated region of mRNA encoded by KIAA1546, corresponding to a HOST TARGET binding site such as BINDING SITE I, BINDING SITE II or BINDING SITE III. Table 2 illustrates the complementarity of the nucleotide sequences of KIAA1546 BINDING SITE, designated SEQ ID:33713, to the nucleotide sequence of VGAM317 RNA, herein designated VGAM RNA, also designated SEQ ID:3028.

Another function of VGAM317 is therefore inhibition of KIAA1546 (Accession XM_042301). Accordingly, utilities of VGAM317 include diagnosis, prevention and treatment of diseases and clinical conditions associated with KIAA1546. Mesoderm Development Candidate 2 (MESDC2, Accession XM_051854) is another VGAM317 host target gene. MESDC2 BINDING SITE is HOST TARGET binding site found in the 3' untranslated region of mRNA encoded by MESDC2, corresponding to a HOST TARGET binding site such as BINDING SITE I, BINDING SITE II or BINDING SITE III. Table 2 illustrates the complementarity of the nucleotide sequences of MESDC2 BINDING SITE, designated SEQ ID:35889, to the nucleotide sequence of VGAM317 RNA, herein designated VGAM RNA, also designated SEQ ID:3028.

Another function of VGAM317 is therefore inhibition of Mesoderm Development Candidate 2 (MESDC2, Accession XM_051854). Accordingly, utilities of VGAM317 include diagnosis, prevention and treatment of diseases and clinical conditions associated with MESDC2. LOC163479 (Accession XM_088925) is another VGAM317 host target gene. LOC163479 BINDING SITE is HOST TARGET binding site found in the 5' untranslated region of mRNA encoded by LOC163479, corresponding to a HOST TARGET binding site such as BINDING SITE I, BINDING SITE II or BINDING SITE III. Table 2 illustrates the complementarity of the nucleotide sequences of LOC163479 BINDING SITE, designated SEQ ID:39956, to the nucleotide sequence of VGAM317 RNA, herein designated VGAM RNA, also designated SEQ ID:3028.

Another function of VGAM317 is therefore inhibition of LOC163479 (Accession XM_088925). Accordingly, utilities of VGAM317 include diagnosis, prevention and treatment of diseases and clinical conditions associated with LOC163479. LOC51696 (Accession NM_016217) is another VGAM317 host target gene. LOC51696 BINDING SITE is HOST TAR- GET binding site found in the 3' untranslated region of mRNA encoded by LOC51696, corresponding to a HOST TARGET binding site such as BINDING SITE I, BINDING SITE II or BINDING SITE III. Table 2 illustrates the complementarity of the nucleotide sequences of LOC51696 BINDING SITE, designated SEQ ID:18309, to the nucleotide sequence of VGAM317 RNA, herein designated VGAM RNA, also designated SEQ ID:3028.

Another function of VGAM317 is therefore inhibition of LOC51696 (Accession NM_016217). Accordingly, utilities of VGAM317 include diagnosis, prevention and treatment of diseases and clinical conditions associated with LOC51696. FIG. 1 further provides a conceptual description of a novel bioinformatically detected viral gene of the present invention, referred to here as Viral Genomic Address Messenger 318 (VGAM318) viral gene, which modulates expression of respective host target genes thereof, the function and utility of which host target genes is known in the art.

VGAM318 is a novel bioinformatically detected regulatory, non protein coding, viral micro RNA (miRNA) gene. The method by which VGAM318 was detected is described hereinabove with reference to FIGS. 1-8.

VGAM318 gene, herein designated VGAM GENE, is a viral gene contained in the genome of Cryphonectria Hypovirus 3. VGAM318 host target gene, herein designated VGAM HOST TARGET GENE, is a human gene contained in the human genome.

VGAM318 gene encodes a VGAM318 precursor RNA, herein designated VGAM PRECURSOR RNA. Similar to other miRNA genes, and unlike most ordinary genes, VGAM318 precursor RNA does not encode a protein. A nucleotide sequence identical or highly similar to the nucleotide sequence of VGAM318 precursor RNA is designated SEQ ID:304, and is provided hereinbelow with reference to the sequence listing part. Nucleotide sequence SEQ ID:304 is located at position 739 relative to the genome of Cryphonectria Hypovirus 3.

VGAM318 precursor RNA folds onto itself, forming VGAM318 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM318 folded precursor RNA into VGAM318 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM318 RNA is designated SEQ ID:3029, and is provided hereinbelow with reference to the sequence listing part.

VGAM318 host target gene, herein designated VGAM HOST TARGET GENE, encodes a corresponding messenger RNA, VGAM318 host target RNA, herein designated VGAM HOST TARGET RNA. VGAM318 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM318 RNA, herein designated VGAM RNA, binds complementarily to one or more host target binding sites located in untranslated regions of VGAM318 host target RNA, herein designated VGAM HOST TARGET RNA. This complementary binding is due to the fact that the nucleotide sequence of VGAM318 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM318 RNA, herein designated VGAM RNA, may have a different number of host target binding sites in untranslated regions of a VGAM318 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM318 RNA, herein designated VGAM RNA, to host target binding sites on VGAM318 host target RNA, herein designated VGAM HOST TARGET RNA, such as BINDING SITE I, BINDING SITE II and BINDING SITE III, inhibits translation of VGAM318 host target RNA into VGAM318 host target protein, herein designated VGAM HOST TARGET PROTEIN. VGAM host target protein is therefore outlined by a broken line.

It is appreciated that VGAM318 host target gene, herein designated VGAM HOST TARGET GENE, in fact represents a plurality of VGAM318 host target genes. The mRNA of each one of this plurality of VGAM318 host target genes comprises one or more host target binding sites, each having a nucleotide sequence which is at least partly complementary to VGAM318 RNA, herein designated VGAM RNA, and which when bound by VGAM318 RNA causes inhibition of translation of respective one or more VGAM318 host target proteins.

It is further appreciated by one skilled in the art that the mode of translational inhibition illustrated by FIG. 1 with specific reference to translational inhibition exerted by VGAM318 gene, herein designated VGAM GENE, on one or more VGAM318 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM318 is inhibition of expression of host target genes, as part of a novel viral mechanism of attacking a host. Accordingly, utilities of VGAM318 include diagnosis, prevention and treatment of viral infection by Cryphonectria Hypovirus 3. Specific functions, and accordingly utilities, of VGAM318 correlate with, and may be deduced from, the identity of the host target genes which VGAM318 binds and inhibits, and the function of these host target genes, as elaborated hereinbelow.

Nucleotide sequences of the VGAM318 precursor RNA, herein designated VGAM PRECURSOR RNA, and of the 'diced' VGAM318 RNA, herein designated VGAM RNA, and a schematic representation of the secondary folding of VGAM318 folded precursor RNA, herein designated VGAM FOLDED PRECURSOR RNA, of VGAM318 are further described hereinbelow with reference to Table 1.

Nucleotide sequences of host target binding sites, such as BINDING SITE-I, BINDING SITE-II and BINDING SITE-III of FIG. 1, found on VGAM318 host target RNA, and schematic representation of the complementarity of each of these host target binding sites to VGAM318 RNA, herein designated VGAM RNA, are described hereinbelow with reference to Table 2.

As mentioned hereinabove with reference to FIG. 1, a function of VGAM318 gene, herein designated VGAM is inhibition of expression of VGAM318 target genes. It is appreciated that specific functions, and accordingly utilities, of VGAM318 correlate with, and may be deduced from, the identity of the target genes which VGAM318 binds and inhibits, and the function of these target genes, as elaborated hereinbelow.

Phosphoinositide-3-kinase, Regulatory Subunit, Polypeptide 3 (p55, gamma) (PIK3R3, Accession XM_027982) is a VGAM318 host target gene. PIK3R3 BINDING SITE is HOST TARGET binding site found in the 3' untranslated region of mRNA encoded by PIK3R3, corresponding to a HOST TARGET binding site such as BINDING SITE I, BINDING SITE II or BINDING SITE III. Table 2 illustrates the complementarity of the nucleotide sequences of PIK3R3 BINDING SITE, designated SEQ ID:30607, to the nucleotide sequence of VGAM318 RNA, herein designated VGAM RNA, also designated SEQ ID:3029.

A function of VGAM318 is therefore inhibition of Phosphoinositide-3-kinase, Regulatory Subunit, Polypeptide 3 (p55, gamma) (PIK3R3, Accession XM_027982). Accordingly, utilities of VGAM318 include diagnosis, prevention and treatment of diseases and clinical conditions associated with PIK3R3. FLJ11342 (Accession NM_018394) is another VGAM318 host target gene. FLJ11342 BINDING SITE is HOST TARGET binding site found in the 3' untranslated region of mRNA encoded by FLJ11342, corresponding to a HOST TARGET binding site such as BINDING SITE I, BINDING SITE II or BINDING SITE III. Table 2 illustrates the complementarity of the nucleotide sequences of FLJ11342 BINDING SITE, designated SEQ ID:20432, to the nucleotide sequence of VGAM318 RNA, herein designated VGAM RNA, also designated SEQ ID:3029.

Another function of VGAM318 is therefore inhibition of FLJ11342 (Accession NM_018394). Accordingly, utilities of VGAM318 include diagnosis, prevention and treatment of diseases and clinical conditions associated with FLJ11342. KIAA0397 (Accession XM_029438) is another VGAM318 host target gene. KIAA0397 BINDING SITE is HOST TARGET binding site found in the 3' untranslated region of mRNA encoded by KIAA0397, corresponding to a HOST TARGET binding site such as BINDING SITE I, BINDING SITE II or BINDING SITE III. Table 2 illustrates the complementarity of the nucleotide sequences of KIAA0397 BINDING SITE, designated SEQ ID:30893, to the nucleotide sequence of VGAM318 RNA, herein designated VGAM RNA, also designated SEQ ID:3029.

Another function of VGAM318 is therefore inhibition of KIAA0397 (Accession XM_029438). Accordingly, utilities of VGAM318 include diagnosis, prevention and treatment of diseases and clinical conditions associated with KIAA0397. LOC149146 (Accession XM_086441) is another VGAM318 host target gene. LOC149146 BINDING SITE is HOST TARGET binding site found in the 5' untranslated region of mRNA encoded by LOC149146, corresponding to a HOST TARGET binding site such as BINDING SITE I, BINDING SITE II or BINDING SITE III. Table 2 illustrates the complementarity of the nucleotide sequences of LOC149146 BINDING SITE, designated SEQ ID:38655, to the nucleotide sequence of VGAM318 RNA, herein designated VGAM RNA, also designated SEQ ID:3029.

Another function of VGAM318 is therefore inhibition of LOC149146 (Accession XM_086441). Accordingly, utilities of VGAM318 include diagnosis, prevention and treatment of diseases and clinical conditions associated with LOC149146. LOC164684 (Accession XM_092926) is another VGAM318 host target gene. LOC164684 BINDING SITE is HOST TARGET binding site found in the 3' untranslated region of mRNA encoded by LOC164684, corresponding to a HOST TARGET binding site such as BINDING SITE I, BINDING SITE II or BINDING SITE III. Table 2 illustrates the complementarity of the nucleotide sequences of LOC164684 BINDING SITE, designated SEQ ID:40158, to the nucleotide sequence of VGAM318 RNA, herein designated VGAM RNA, also designated SEQ ID:3029.

Another function of VGAM318 is therefore inhibition of LOC164684 (Accession XM_092926). Accordingly, utilities of VGAM318 include diagnosis, prevention and treatment of diseases and clinical conditions associated with LOC164684. LOC200563 (Accession XM_117251) is another VGAM318 host target gene. LOC200563 BINDING SITE is HOST TARGET binding site found in the 5' untranslated region of mRNA encoded by LOC200563, corresponding to a HOST TARGET binding site such as BINDING SITE I, BINDING SITE II or BINDING SITE III. Table 2 illustrates the complementarity of the nucleotide sequences of LOC200563 BINDING SITE, designated SEQ ID:43320, to the nucleotide sequence of VGAM318 RNA, herein designated VGAM RNA, also designated SEQ ID:3029.

Another function of VGAM318 is therefore inhibition of LOC200563 (Accession XM_117251). Accordingly, utilities of VGAM318 include diagnosis, prevention and treatment of diseases and clinical conditions associated with LOC200563. LOC253832 (Accession XM_170739) is another VGAM318 host target gene. LOC253832 BINDING SITE is HOST TARGET binding site found in the 3' untranslated region of mRNA encoded by LOC253832, corresponding to a HOST TARGET binding site such as BINDING SITE I, BINDING SITE II or BINDING SITE III. Table 2 illustrates the complementarity of the nucleotide sequences of LOC253832 BINDING SITE, designated SEQ ID:45498, to the nucleotide sequence of VGAM318 RNA, herein designated VGAM RNA, also designated SEQ ID:3029.

Another function of VGAM318 is therefore inhibition of LOC253832 (Accession XM_170739). Accordingly, utilities of VGAM318 include diagnosis, prevention and treatment of diseases and clinical conditions associated with LOC253832. FIG. 1 further provides a conceptual description of a novel bioinformatically detected viral gene of the present invention, referred to here as Viral Genomic Address Messenger 319 (VGAM319) viral gene, which modulates expression of respective host target genes thereof, the function and utility of which host target genes is known in the art.

VGAM319 is a novel bioinformatically detected regulatory, non protein coding, viral micro RNA (miRNA) gene. The method by which VGAM319 was detected is described hereinabove with reference to FIGS. 1-8.

VGAM319 gene, herein designated VGAM GENE, is a viral gene contained in the genome of Myxoma Virus. VGAM319 host target gene, herein designated VGAM HOST TARGET GENE, is a human gene contained in the human genome.

VGAM319 gene encodes a VGAM319 precursor RNA, herein designated VGAM PRECURSOR RNA. Similar to other miRNA genes, and unlike most ordinary genes, VGAM319 precursor RNA does not encode a protein. A nucleotide sequence identical or highly similar to the nucleotide sequence of VGAM319 precursor RNA is designated SEQ ID:305, and is provided hereinbelow with reference to the sequence listing part. Nucleotide sequence SEQ ID:305 is located at position 46864 relative to the genome of Myxoma Virus.

VGAM319 precursor RNA folds onto itself, forming VGAM319 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM319 folded precursor RNA into VGAM319 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM319 RNA is designated SEQ ID:3030, and is provided hereinbelow with reference to the sequence listing part.

VGAM319 host target gene, herein designated VGAM HOST TARGET GENE, encodes a corresponding messenger RNA, VGAM319 host target RNA, herein designated VGAM HOST TARGET RNA. VGAM319 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM319 RNA, herein designated VGAM RNA, binds complementarily to one or more host target binding sites located in untranslated regions of VGAM319 host target RNA, herein designated VGAM HOST TARGET RNA. This complementary binding is due to the fact that the nucleotide sequence of VGAM319 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM319 RNA, herein designated VGAM RNA, may have a different number of host target binding sites in untranslated regions of a VGAM319 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM319 RNA, herein designated VGAM RNA, to host target binding sites on VGAM319 host target RNA, herein designated VGAM HOST TARGET RNA, such as BINDING SITE I, BINDING SITE II and BINDING SITE III, inhibits translation of VGAM319 host target RNA into VGAM319 host target protein, herein designated VGAM HOST TARGET PROTEIN. VGAM host target protein is therefore outlined by a broken line.

It is appreciated that VGAM319 host target gene, herein designated VGAM HOST TARGET GENE, in fact represents a plurality of VGAM319 host target genes. The mRNA of each one of this plurality of VGAM319 host target genes comprises one or more host target binding sites, each having a nucleotide sequence which is at least partly complementary to VGAM319 RNA, herein designated VGAM RNA, and which when bound by VGAM319 RNA causes inhibition of translation of respective one or more VGAM319 host target proteins.

It is further appreciated by one skilled in the art that the mode of translational inhibition illustrated by FIG. 1 with specific reference to translational inhibition exerted by VGAM319 gene, herein designated VGAM GENE, on one or more VGAM319 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM319 is inhibition of expression of host target genes, as part of a novel viral mechanism of attacking a host. Accordingly, utilities of VGAM319 include diagnosis, prevention and treatment of viral infection by Myxoma Virus. Specific functions, and accordingly utilities, of VGAM319 correlate with, and may be deduced from, the identity of the host target genes which VGAM319 binds and inhibits, and the function of these host target genes, as elaborated hereinbelow.

Nucleotide sequences of the VGAM319 precursor RNA, herein designated VGAM PRECURSOR RNA, and of the 'diced' VGAM319 RNA, herein designated VGAM RNA, and a schematic representation of the secondary folding of VGAM319 folded precursor RNA, herein designated VGAM FOLDED PRECURSOR RNA, of VGAM319 are further described hereinbelow with reference to Table 1.

Nucleotide sequences of host target binding sites, such as BINDING SITE-I, BINDING SITE-II and BINDING SITE-III of FIG. 1, found on VGAM319 host target RNA, and schematic representation of the complementarity of each of these host target binding sites to VGAM319 RNA, herein designated VGAM RNA, are described hereinbelow with reference to Table 2.

As mentioned hereinabove with reference to FIG. 1, a function of VGAM319 gene, herein designated VGAM is inhibition of expression of VGAM319 target genes. It is appreciated that specific functions, and accordingly utilities, of VGAM319 correlate with, and may be deduced from, the identity of the target genes which VGAM319 binds and inhibits, and the function of these target genes, as elaborated hereinbelow.

Leptin (obesity homolog, mouse) (LEP, Accession NM_000230) is a VGAM319 host target gene. LEP BINDING SITE is HOST TARGET binding site found in the 3' untranslated region of mRNA encoded by LEP, corresponding to a HOST TARGET binding site such as BINDING SITE I, BINDING SITE II or BINDING SITE III. Table 2 illustrates the complementarity of the nucleotide sequences of LEP BINDING SITE, designated SEQ ID:5734, to the nucleotide sequence of VGAM319 RNA, herein designated VGAM RNA, also designated SEQ ID:3030.

A function of VGAM319 is therefore inhibition of Leptin (obesity homolog, mouse) (LEP, Accession NM_000230).

Accordingly, utilities of VGAM319 include diagnosis, prevention and treatment of diseases and clinical conditions associated with LEP. FLJ20051 (Accession NM_019087) is another VGAM319 host target gene. FLJ20051 BINDING SITE is HOST TARGET binding site found in the 3' untranslated region of mRNA encoded by FLJ20051, corresponding to a HOST TARGET binding site such as BINDING SITE I, BINDING SITE II or BINDING SITE III. Table 2 illustrates the complementarity of the nucleotide sequences of FLJ20051 BINDING SITE, designated SEQ ID:21161, to the nucleotide sequence of VGAM319 RNA, herein designated VGAM RNA, also designated SEQ ID:3030.

Another function of VGAM319 is therefore inhibition of FLJ20051 (Accession NM_019087). Accordingly, utilities of VGAM319 include diagnosis, prevention and treatment of diseases and clinical conditions associated with FLJ20051. Integrin, Beta 5 (ITGB5, Accession XM_003029) is another VGAM319 host target gene. ITGB5 BINDING SITE is HOST TARGET binding site found in the 3' untranslated region of mRNA encoded by ITGB5, corresponding to a HOST TARGET binding site such as BINDING SITE I, BINDING SITE II or BINDING SITE III. Table 2 illustrates the complementarity of the nucleotide sequences of ITGB5 BINDING SITE, designated SEQ ID:29922, to the nucleotide sequence of VGAM319 RNA, herein designated VGAM RNA, also designated SEQ ID:3030.

Another function of VGAM319 is therefore inhibition of Integrin, Beta 5 (ITGB5, Accession XM_003029). Accordingly, utilities of VGAM319 include diagnosis, prevention and treatment of diseases and clinical conditions associated with ITGB5. KIAA1784 (Accession XM_036660) is another VGAM319 host target gene. KIAA1784 BINDING SITE is HOST TARGET binding site found in the 3' untranslated region of mRNA encoded by KIAA1784, corresponding to a HOST TARGET binding site such as BINDING SITE I, BINDING SITE II or BINDING SITE III. Table 2 illustrates the complementarity of the nucleotide sequences of KIAA1784 BINDING SITE, designated SEQ ID:32483, to the nucleotide sequence of VGAM319 RNA, herein designated VGAM RNA, also designated SEQ ID:3030.

Another function of VGAM319 is therefore inhibition of KIAA1784 (Accession XM_036660). Accordingly, utilities of VGAM319 include diagnosis, prevention and treatment of diseases and clinical conditions associated with KIAA1784. MAIL (Accession NM_031419) is another VGAM319 host target gene. MAIL BINDING SITE is HOST TARGET binding site found in the 3" untranslated region of mRNA encoded by MAIL, corresponding to a HOST TARGET binding site such as BINDING SITE I, BINDING SITE II or BINDING SITE III. Table 2 illustrates the complementarity of the nucleotide sequences of MAIL BINDING SITE, designated SEQ ID:25404, to the nucleotide sequence of VGAM319 RNA, herein designated VGAM RNA, also designated SEQ ID:3030.

Another function of VGAM319 is therefore inhibition of MAIL (Accession NM_031419). Accordingly, utilities of VGAM319 include diagnosis, prevention and treatment of diseases and clinical conditions associated with MAIL. SDS3 (Accession XM_045014) is another VGAM319 host target gene. SDS3 BINDING SITE is HOST TARGET binding site found in the 3' untranslated region of mRNA encoded by SDS3, corresponding to a HOST TARGET binding site such as BINDING SITE I, BINDING SITE II or BINDING SITE III. Table 2 illustrates the complementarity of the nucleotide sequences of SDS3 BINDING SITE, designated SEQ ID:34321, to the nucleotide sequence of VGAM319 RNA, herein designated VGAM RNA, also designated SEQ ID:3030.

Another function of VGAM319 is therefore inhibition of SDS3 (Accession XM_045014). Accordingly, utilities of VGAM319 include diagnosis, prevention and treatment of diseases and clinical conditions associated with SDS3. FIG. 1 further provides a conceptual description of a novel bioinformatically detected viral gene of the present invention, referred to here as Viral Genomic Address Messenger 320 (VGAM320) viral gene, which modulates expression of respective host target genes thereof, the function and utility of which host target genes is known in the art.

VGAM320 is a novel bioinformatically detected regulatory, non protein coding, viral micro RNA (miRNA) gene. The method by which VGAM320 was detected is described hereinabove with reference to FIGS. 1-8.

VGAM320 gene, herein designated VGAM GENE, is a viral gene contained in the genome of Myxoma Virus. VGAM320 host target gene, herein designated VGAM HOST TARGET GENE, is a human gene contained in the human genome.

VGAM320 gene encodes a VGAM320 precursor RNA, herein designated VGAM PRECURSOR RNA. Similar to other miRNA genes, and unlike most ordinary genes, VGAM320 precursor RNA does not encode a protein. A nucleotide sequence identical or highly similar to the nucleotide sequence of VGAM320 precursor RNA is designated SEQ ID:306, and is provided hereinbelow with reference to the sequence listing part. Nucleotide sequence SEQ ID:306 is located at position 46583 relative to the genome of Myxoma Virus.

VGAM320 precursor RNA folds onto itself, forming VGAM320 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM320 folded precursor RNA into VGAM320 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM320 RNA is designated SEQ ID:3031, and is provided hereinbelow with reference to the sequence listing part.

VGAM320 host target gene, herein designated VGAM HOST TARGET GENE, encodes a corresponding messenger RNA, VGAM320 host target RNA, herein designated VGAM HOST TARGET RNA. VGAM320 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM320 RNA, herein designated VGAM RNA, binds complementarily to one or more host target binding sites located in untranslated regions of VGAM320 host target RNA, herein designated VGAM HOST TARGET RNA. This complementary binding is due to the fact that the nucleotide sequence of VGAM320 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM320 RNA, herein designated VGAM RNA, may have a different number of host target binding sites in untranslated regions of a VGAM320 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM320 RNA, herein designated VGAM RNA, to host target binding sites on VGAM320 host target RNA, herein designated VGAM HOST TARGET RNA, such as BINDING SITE I, BINDING SITE II and BINDING SITE III, inhibits translation of VGAM320 host target RNA into VGAM320 host target protein, herein designated VGAM HOST TARGET PROTEIN. VGAM host target protein is therefore outlined by a broken line.

It is appreciated that VGAM320 host target gene, herein designated VGAM HOST TARGET GENE, in fact represents a plurality of VGAM320 host target genes. The mRNA of each one of this plurality of VGAM320 host target genes comprises one or more host target binding sites, each having a nucleotide sequence which is at least partly complementary to VGAM320 RNA, herein designated VGAM RNA, and which when bound by VGAM320 RNA causes inhibition of translation of respective one or more VGAM320 host target proteins.

It is further appreciated by one skilled in the art that the mode of translational inhibition illustrated by FIG. 1 with specific reference to translational inhibition exerted by VGAM320 gene, herein designated VGAM GENE, on one or more VGAM320 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM320 is inhibition of expression of host target genes, as part of a novel viral mechanism of attacking a host. Accordingly, utilities of VGAM320 include diagnosis, prevention and treatment of viral infection by Myxoma Virus. Specific functions, and accordingly utilities, of VGAM320 correlate with, and may be deduced from, the identity of the host target genes which VGAM320 binds and inhibits, and the function of these host target genes, as elaborated hereinbelow.

Nucleotide sequences of the VGAM320 precursor RNA, herein designated VGAM PRECURSOR RNA, and of the 'diced' VGAM320 RNA, herein designated VGAM RNA, and a schematic representation of the secondary folding of VGAM320 folded precursor RNA, herein designated VGAM FOLDED PRECURSOR RNA, of VGAM320 are further described hereinbelow with reference to Table 1.

Nucleotide sequences of host target binding sites, such as BINDING SITE-I, BINDING SITE-II and BINDING SITE-III of FIG. 1, found on VGAM320 host target RNA, and schematic representation of the complementarity of each of these host target binding sites to VGAM320 RNA, herein designated VGAM RNA, are described hereinbelow with reference to Table 2.

As mentioned hereinabove with reference to FIG. 1, a function of VGAM320 gene, herein designated VGAM is inhibition of expression of VGAM320 target genes. It is appreciated that specific functions, and accordingly utilities, of VGAM320 correlate with, and may be deduced from, the identity of the target genes which VGAM320 binds and inhibits, and the function of these target genes, as elaborated hereinbelow.

GRB2-associated Binding Protein 2 (GAB2, Accession NM_012296) is a VGAM320 host target gene. GAB2 BINDING SITE1 and GAB2 BINDING SITE2 are HOST TARGET binding sites found in untranslated regions of mRNA encoded by GAB2, corresponding to HOST TARGET binding sites such as BINDING SITE I, BINDING SITE II or BINDING SITE III. Table 2 illustrates the complementarity of the nucleotide sequences of GAB2 BINDING SITE1 and GAB2 BINDING SITE2, designated SEQ ID:14646 and SEQ ID:27842 respectively, to the nucleotide sequence of VGAM320 RNA, herein designated VGAM RNA, also designated SEQ ID:3031.

A function of VGAM320 is therefore inhibition of GRB2-associated Binding Protein 2 (GAB2, Accession NM_012296), a gene which act as adapters for transmitting various signals. Accordingly, utilities of VGAM320 include diagnosis, prevention and treatment of diseases and clinical conditions associated with GAB2. The function of GAB2 and its association with various diseases and clinical conditions, has been established by previous studies, as described hereinabove with reference to VGAM53. FLJ13612 (Accession NM_025202) is another VGAM320 host target gene. FLJ13612 BINDING SITE is HOST TARGET binding site found in the 3' untranslated region of mRNA encoded by FLJ13612, corresponding to a HOST TARGET binding site such as BINDING SITE I, BINDING SITE II or BINDING SITE III. Table 2 illustrates the complementarity of the nucleotide sequences of FLJ13612 BINDING SITE, designated SEQ ID:24863, to the nucleotide sequence of VGAM320 RNA, herein designated VGAM RNA, also designated SEQ ID:3031.

Another function of VGAM320 is therefore inhibition of FLJ13612 (Accession NM_025202). Accordingly, utilities of VGAM320 include diagnosis, prevention and treatment of diseases and clinical conditions associated with FLJ13612. FIG. 1 further provides a conceptual description of a novel bioinformatically detected viral gene of the present invention, referred to here as Viral Genomic Address Messenger 321 (VGAM321) viral gene, which modulates expression of respective host target genes thereof, the function and utility of which host target genes is known in the art.

VGAM321 is a novel bioinformatically detected regulatory, non protein coding, viral micro RNA (miRNA) gene. The method by which VGAM321 was detected is described hereinabove with reference to FIGS. 1-8.

VGAM321 gene, herein designated VGAM GENE, is a viral gene contained in the genome of Myxoma Virus. VGAM321 host target gene, herein designated VGAM HOST TARGET GENE, is a human gene contained in the human genome.

VGAM321 gene encodes a VGAM321 precursor RNA, herein designated VGAM PRECURSOR RNA. Similar to other miRNA genes, and unlike most ordinary genes, VGAM321 precursor RNA does not encode a protein. A nucleotide sequence identical or highly similar to the nucleotide sequence of VGAM321 precursor RNA is designated SEQ ID:307, and is provided hereinbelow with reference to the sequence listing part. Nucleotide sequence SEQ ID:307 is located at position 52219 relative to the genome of Myxoma Virus.

VGAM321 precursor RNA folds onto itself, forming VGAM321 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM321 folded precursor RNA into VGAM321 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 87%) nucleotide sequence of VGAM321 RNA is designated SEQ ID:3032, and is provided hereinbelow with reference to the sequence listing part.

VGAM321 host target gene, herein designated VGAM HOST TARGET GENE, encodes a corresponding messenger RNA, VGAM321 host target RNA, herein designated VGAM HOST TARGET RNA. VGAM321 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM321 RNA, herein designated VGAM RNA, binds complementarily to one or more host target binding sites located in untranslated regions of VGAM321 host target RNA, herein designated VGAM HOST TARGET RNA. This complementary binding is due to the fact that the nucleotide sequence of VGAM321 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM321 RNA, herein designated VGAM RNA, may have a different number of host target binding sites in untranslated regions of a VGAM321 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM321 RNA, herein designated VGAM RNA, to host target binding sites on VGAM321 host target RNA, herein designated VGAM HOST TARGET RNA, such as BINDING SITE I, BINDING SITE II and BINDING SITE III, inhibits translation of VGAM321 host target RNA into VGAM321 host target protein, herein designated VGAM HOST TARGET PROTEIN. VGAM host target protein is therefore outlined by a broken line.

It is appreciated that VGAM321 host target gene, herein designated VGAM HOST TARGET GENE, in fact represents a plurality of VGAM321 host target genes. The mRNA of each one of this plurality of VGAM321 host target genes comprises one or more host target binding sites, each having a nucleotide sequence which is at least partly complementary to VGAM321 RNA, herein designated VGAM RNA, and which when bound by VGAM321 RNA causes inhibition of translation of respective one or more VGAM321 host target proteins.

It is further appreciated by one skilled in the art that the mode of translational inhibition illustrated by FIG. 1 with specific reference to translational inhibition exerted by VGAM321 gene, herein designated VGAM GENE, on one or more VGAM321 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM321 is inhibition of expression of host target genes, as part of a novel viral mechanism of attacking a host. Accordingly, utilities of VGAM321 include diagnosis, prevention and treatment of viral infection by Myxoma Virus. Specific functions, and accordingly utilities, of VGAM321 correlate with, and may be deduced from, the identity of the host target genes which VGAM321 binds and inhibits, and the function of these host target genes, as elaborated hereinbelow.

Nucleotide sequences of the VGAM321 precursor RNA, herein designated VGAM PRECURSOR RNA, and of the 'diced' VGAM321 RNA, herein designated VGAM RNA, and a schematic representation of the secondary folding of VGAM321 folded precursor RNA, herein designated VGAM FOLDED PRECURSOR RNA, of VGAM321 are further described hereinbelow with reference to Table 1.

Nucleotide sequences of host target binding sites, such as BINDING SITE-I, BINDING SITE-II and BINDING SITE-III of FIG. 1, found on VGAM321 host target RNA, and schematic representation of the complementarity of each of these host target binding sites to VGAM321 RNA, herein designated VGAM RNA, are described hereinbelow with reference to Table 2.

As mentioned hereinabove with reference to FIG. 1, a function of VGAM321 gene, herein designated VGAM is inhibition of expression of VGAM321 target genes. It is appreciated that specific functions, and accordingly utilities, of VGAM321 correlate with, and may be deduced from, the identity of the target genes which VGAM321 binds and inhibits, and the function of these target genes, as elaborated hereinbelow.

Dishevelled Associated Activator of Morphogenesis 2 (DAAM2, Accession XM_166434) is a VGAM321 host target gene. DAAM2 BINDING SITE is HOST TARGET binding site found in the 3' untranslated region of mRNA encoded by DAAM2, corresponding to a HOST TARGET binding site such as BINDING SITE I, BINDING SITE II or BINDING SITE III. Table 2 illustrates the complementarity of the nucleotide sequences of DAAM2 BINDING SITE, designated SEQ ID:44328, to the nucleotide sequence of VGAM321 RNA, herein designated VGAM RNA, also designated SEQ ID:3032.

A function of VGAM321 is therefore inhibition of Dishevelled Associated Activator of Morphogenesis 2 (DAAM2, Accession XM_166434), a gene which controls cell polarity and movement during development. Accordingly, utilities of VGAM321 include diagnosis, prevention and treatment of diseases and clinical conditions associated with DAAM2. The function of DAAM2 and its association with various diseases and clinical conditions, has been established by previous studies, as described hereinabove with reference to VGAM247. Estrogen-related Receptor Beta Like 1 (ESRRBL1, Accession NM_018010) is another VGAM321 host target gene. ESRRBL1 BINDING SITE is HOST TARGET binding site found in the 3' untranslated region of mRNA encoded by ESRRBL1, corresponding to a HOST TARGET binding site such as BINDING SITE I, BINDING SITE II or BINDING SITE III. Table 2 illustrates the complementarity of the nucleotide sequences of ESRRBL1 BINDING SITE, designated SEQ ID:19742, to the nucleotide sequence of VGAM321 RNA, herein designated VGAM RNA, also designated SEQ ID:3032.

Another function of VGAM321 is therefore inhibition of Estrogen-related Receptor Beta Like 1 (ESRRBL1, Accession NM_018010). Accordingly, utilities of VGAM321 include diagnosis, prevention and treatment of diseases and clinical conditions associated with ESRRBL1. Baculoviral IAP Repeat-containing 2 (BIRC2, Accession XM_040717) is another VGAM321 host target gene. BIRC2 BINDING SITE is HOST TARGET binding site found in the 5' untranslated region of mRNA encoded by BIRC2, corresponding to a HOST TARGET binding site such as BINDING SITE I, BINDING SITE II or BINDING SITE III. Table 2 illustrates the complementarity of the nucleotide sequences of BIRC2 BINDING SITE, designated SEQ ID:33371, to the nucleotide sequence of VGAM321 RNA, herein designated VGAM RNA, also designated SEQ ID:3032.

Another function of VGAM321 is therefore inhibition of Baculoviral IAP Repeat-containing 2 (BIRC2, Accession XM_040717). Accordingly, utilities of VGAM321 include diagnosis, prevention and treatment of diseases and clinical conditions associated with BIRC2. Chromobox Homolog 3 (HP1 gamma homolog, Drosophila) (CBX3, Accession NM_007276) is another VGAM321 host target gene. CBX3 BINDING SITE1 and CBX3 BINDING SITE2 are HOST TARGET binding sites found in untranslated regions of mRNA encoded by CBX3, corresponding to HOST TARGET binding sites such as BINDING SITE I, BINDING SITE II or BINDING SITE III. Table 2 illustrates the complementarity of the nucleotide sequences of CBX3 BINDING SITE1 and CBX3 BINDING SITE2, designated SEQ ID:14140 and SEQ ID:18660 respectively, to the nucleotide sequence of VGAM321 RNA, herein designated VGAM RNA, also designated SEQ ID:3032.

Another function of VGAM321 is therefore inhibition of Chromobox Homolog 3 (HP1 gamma homolog, Drosophila) (CBX3, Accession NM_007276). Accordingly, utilities of VGAM321 include diagnosis, prevention and treatment of diseases and clinical conditions associated with CBX3. KIAA1715 (Accession XM_042834) is another VGAM321 host target gene. KIAA1715 BINDING SITE is HOST TARGET binding site found in the 3' untranslated region of mRNA encoded by KIAA1715, corresponding to a HOST TARGET binding site such as BINDING SITE I, BINDING SITE II or BINDING SITE III. Table 2 illustrates the complementarity of the nucleotide sequences of KIAA1715 BINDING SITE, designated SEQ ID:33789, to the nucleotide sequence of VGAM321 RNA, herein designated VGAM RNA, also designated SEQ ID:3032.

Another function of VGAM321 is therefore inhibition of KIAA1715 (Accession XM_042834). Accordingly, utilities of VGAM321 include diagnosis, prevention and treatment of diseases and clinical conditions associated with KIAA1715. MFN1 (Accession NM_017927) is another VGAM321 host target gene. MFN1 BINDING SITE is HOST TARGET binding site found in the 3' untranslated region of mRNA encoded by MFN1, corresponding to a HOST TARGET binding site such as BINDING SITE I, BINDING SITE II or BINDING SITE III. Table 2 illustrates the complementarity of the nucleotide sequences of MFN1 BINDING SITE, designated SEQ ID:19602, to the nucleotide sequence of VGAM321 RNA, herein designated VGAM RNA, also designated SEQ ID:3032.

Another function of VGAM321 is therefore inhibition of MFN1 (Accession NM_017927). Accordingly, utilities of VGAM321 include diagnosis, prevention and treatment of diseases and clinical conditions associated with MFN1. Rab11-FIP2 (Accession NM_014904) is another VGAM321 host target gene. Rab11-FIP2 BINDING SITE is HOST TARGET binding site found in the 3' untranslated region of mRNA encoded by Rab11-FIP2, corresponding to a HOST TARGET binding site such as BINDING SITE I, BINDING SITE II or BINDING SITE III. Table 2 illustrates the complementarity of the nucleotide sequences of Rab11-FIP2 BINDING SITE, designated SEQ ID:17095, to the nucleotide sequence of VGAM321 RNA, herein designated VGAM RNA, also designated SEQ ID:3032.

Another function of VGAM321 is therefore inhibition of Rab11-FIP2 (Accession NM_014904). Accordingly, utilities of VGAM321 include diagnosis, prevention and treatment of diseases and clinical conditions associated with Rab11-FIP2. SNRK (Accession NM_017719) is another VGAM321 host target gene. SNRK BINDING SITE is HOST TARGET binding site found in the 3' untranslated region of mRNA encoded by SNRK, corresponding to a HOST TARGET binding site such as BINDING SITE I, BINDING SITE II or BINDING SITE III. Table 2 illustrates the complementarity of the nucleotide sequences of SNRK BINDING SITE, designated SEQ ID:19310, to the nucleotide sequence of VGAM321 RNA, herein designated VGAM RNA, also designated SEQ ID:3032.

Another function of VGAM321 is therefore inhibition of SNRK (Accession NM_017719). Accordingly, utilities of VGAM321 include diagnosis, prevention and treatment of diseases and clinical conditions associated with SNRK. LOC155434 (Accession XM_098723) is another VGAM321 host target gene. LOC155434 BINDING SITE is HOST TARGET binding site found in the 3' untranslated region of mRNA encoded by LOC155434, corresponding to a HOST TARGET binding site such as BINDING SITE I, BINDING SITE II or BINDING SITE III. Table 2 illustrates the complementarity of the nucleotide sequences of LOC155434 BINDING SITE, designated SEQ ID:41770, to the nucleotide sequence of VGAM321 RNA, herein designated VGAM RNA, also designated SEQ ID:3032.

Another function of VGAM321 is therefore inhibition of LOC155434 (Accession XM_098723). Accordingly, utilities of VGAM321 include diagnosis, prevention and treatment of diseases and clinical conditions associated with LOC155434. LOC158563 (Accession XM_088606) is another VGAM321 host target gene. LOC158563 BINDING SITE is HOST TARGET binding site found in the 3' untranslated region of mRNA encoded by LOC158563, corresponding to a HOST TARGET binding site such as BINDING SITE I, BINDING SITE II or BINDING SITE III. Table 2 illustrates the complementarity of the nucleotide sequences of LOC158563 BINDING SITE, designated SEQ ID:39867, to the nucleotide sequence of VGAM321 RNA, herein designated VGAM RNA, also designated SEQ ID:3032.

Another function of VGAM321 is therefore inhibition of LOC158563 (Accession XM_088606). Accordingly, utilities of VGAM321 include diagnosis, prevention and treatment of diseases and clinical conditions associated with LOC158563. LOC257358 (Accession XM_173138) is another VGAM321 host target gene. LOC257358 BINDING SITE is HOST TARGET binding site found in the 3' untranslated region of mRNA encoded by LOC257358, corresponding to a HOST TARGET binding site such as BINDING SITE I, BINDING SITE II or BINDING SITE III. Table 2 illustrates the complementarity of the nucleotide sequences of LOC257358 BINDING SITE, designated SEQ ID:46387, to the nucleotide sequence of VGAM321 RNA, herein designated VGAM RNA, also designated SEQ ID:3032.

Another function of VGAM321 is therefore inhibition of LOC257358 (Accession XM_173138). Accordingly, utilities of VGAM321 include diagnosis, prevention and treatment of diseases and clinical conditions associated with LOC257358. LOC91660 (Accession XM_039902) is another VGAM321 host target gene. LOC91660 BINDING SITE is HOST TARGET binding site found in the 5' untranslated region of mRNA encoded by LOC91660, corresponding to a HOST TARGET binding site such as BINDING SITE I, BINDING SITE II or BINDING SITE III. Table 2 illustrates the complementarity of the nucleotide sequences of LOC91660 BINDING SITE, designated SEQ ID:33206, to the nucleotide sequence of VGAM321 RNA, herein designated VGAM RNA, also designated SEQ ID:3032.

Another function of VGAM321 is therefore inhibition of LOC91660 (Accession XM_039902). Accordingly, utilities of VGAM321 include diagnosis, prevention and treatment of diseases and clinical conditions associated with LOC91660. FIG. 1 further provides a conceptual description of a novel bioinformatically detected viral gene of the present invention, referred to here as Viral Genomic Address Messenger 322 (VGAM322) viral gene, which modulates expression of respective host target genes thereof, the function and utility of which host target genes is known in the art.

VGAM322 is a novel bioinformatically detected regulatory, non protein coding, viral micro RNA (miRNA) gene. The method by which VGAM322 was detected is described hereinabove with reference to FIGS. 1-8.

VGAM322 gene, herein designated VGAM GENE, is a viral gene contained in the genome of Myxoma Virus. VGAM322 host target gene, herein designated VGAM HOST TARGET GENE, is a human gene contained in the human genome.

VGAM322 gene encodes a VGAM322 precursor RNA, herein designated VGAM PRECURSOR RNA. Similar to other miRNA genes, and unlike most ordinary genes, VGAM322 precursor RNA does not encode a protein. A nucleotide sequence identical or highly similar to the nucleotide sequence of VGAM322 precursor RNA is designated SEQ ID:308, and is provided hereinbelow with reference to the sequence listing part. Nucleotide sequence SEQ ID:308 is located at position 88846 relative to the genome of Myxoma Virus.

VGAM322 precursor RNA folds onto itself, forming VGAM322 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM322 folded precursor RNA into VGAM322 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM322 RNA is designated SEQ ID:3033, and is provided hereinbelow with reference to the sequence listing part.

VGAM322 host target gene, herein designated VGAM HOST TARGET GENE, encodes a corresponding messenger RNA, VGAM322 host target RNA, herein designated VGAM HOST TARGET RNA. VGAM322 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM322 RNA, herein designated VGAM RNA, binds complementarily to one or more host target binding sites located in untranslated regions of VGAM322 host target RNA, herein designated VGAM HOST TARGET RNA. This complementary binding is due to the fact that the nucleotide sequence of VGAM322 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM322 RNA, herein designated VGAM RNA, may have a different number of host target binding sites in untranslated regions of a VGAM322 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM322 RNA, herein designated VGAM RNA, to host target binding sites on VGAM322 host target RNA, herein designated VGAM HOST TARGET RNA, such as BINDING SITE I, BINDING SITE II and BINDING SITE III, inhibits translation of VGAM322 host target RNA into VGAM322 host target protein, herein designated VGAM HOST TARGET PROTEIN. VGAM host target protein is therefore outlined by a broken line.

It is appreciated that VGAM322 host target gene, herein designated VGAM HOST TARGET GENE, in fact represents a plurality of VGAM322 host target genes. The mRNA of each one of this plurality of VGAM322 host target genes comprises one or more host target binding sites, each having a nucleotide sequence which is at least partly complementary to VGAM322 RNA, herein designated VGAM RNA, and which when bound by VGAM322 RNA causes inhibition of translation of respective one or more VGAM322 host target proteins.

It is further appreciated by one skilled in the art that the mode of translational inhibition illustrated by FIG. 1 with specific reference to translational inhibition exerted by VGAM322 gene, herein designated VGAM GENE, on one or more VGAM322 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM322 is inhibition of expression of host target genes, as part of a novel viral mechanism of attacking a host. Accordingly, utilities of VGAM322 include diagnosis, prevention and treatment of viral infection by Myxoma Virus. Specific functions, and accordingly utilities, of VGAM322 correlate with, and may be deduced from, the identity of the host target genes which VGAM322 binds and inhibits, and the function of these host target genes, as elaborated hereinbelow.

Nucleotide sequences of the VGAM322 precursor RNA, herein designated VGAM PRECURSOR RNA, and of the 'diced' VGAM322 RNA, herein designated VGAM RNA, and a schematic representation of the secondary folding of VGAM322 folded precursor RNA, herein designated VGAM FOLDED PRECURSOR RNA, of VGAM322 are further described hereinbelow with reference to Table 1.

Nucleotide sequences of host target binding sites, such as BINDING SITE-I, BINDING SITE-II and BINDING SITE-III of FIG. 1, found on VGAM322 host target RNA, and schematic representation of the complementarity of each of these host target binding sites to VGAM322 RNA, herein designated VGAM RNA, are described hereinbelow with reference to Table 2.

As mentioned hereinabove with reference to FIG. 1, a function of VGAM322 gene, herein designated VGAM is inhibition of expression of VGAM322 target genes. It is appreciated that specific functions, and accordingly utilities, of VGAM322 correlate with, and may be deduced from, the identity of the target genes which VGAM322 binds and inhibits, and the function of these target genes, as elaborated hereinbelow.

LY95 (Accession NM_004828) is a VGAM322 host target gene. LY95 BINDING SITE is HOST TARGET binding site found in the 5' untranslated region of mRNA encoded by LY95, corresponding to a HOST TARGET binding site such as BINDING SITE I, BINDING SITE II or BINDING SITE III. Table 2 illustrates the complementarity of the nucleotide sequences of LY95 BINDING SITE, designated SEQ ID:11241, to the nucleotide sequence of VGAM322 RNA, herein designated VGAM RNA, also designated SEQ ID:3033.

A function of VGAM322 is therefore inhibition of LY95 (Accession NM_004828). Accordingly, utilities of VGAM322 include diagnosis, prevention and treatment of diseases and clinical conditions associated with LY95. Reelin (RELN, Accession XM_168628) is another VGAM322 host target gene. RELN BINDING SITE is HOST TARGET binding site found in the 3' untranslated region of mRNA encoded by RELN, corresponding to a HOST TARGET binding site such as BINDING SITE I, BINDING SITE II or BINDING SITE III. Table 2 illustrates the complementarity of the nucleotide sequences of RELN BINDING SITE, designated SEQ ID:45283, to the nucleotide sequence of VGAM322 RNA, herein designated VGAM RNA, also designated SEQ ID:3033.

Another function of VGAM322 is therefore inhibition of Reelin (RELN, Accession XM_168628), a gene which regulates microtubule function in neurons and neuronal migration. Accordingly, utilities of VGAM322 include diagnosis, prevention and treatment of diseases and clinical conditions associated with RELN. The function of RELN and its association with various diseases and clinical conditions, has been established by previous studies, as described hereinabove with reference to VGAM35. LHX6 (Accession NM_014368) is another VGAM322 host target gene. LHX6 BINDING SITE is HOST TARGET binding site found in the 3' untranslated region of mRNA encoded by LHX6, corresponding to a HOST TARGET binding site such as BINDING SITE I, BINDING SITE II or BINDING SITE III. Table 2 illustrates the complementarity of the nucleotide sequences of LHX6 BINDING SITE, designated SEQ ID:15699, to the nucleotide sequence of VGAM322 RNA, herein designated VGAM RNA, also designated SEQ ID:3033.

Another function of VGAM322 is therefore inhibition of LHX6 (Accession NM_014368). Accordingly, utilities of VGAM322 include diagnosis, prevention and treatment of diseases and clinical conditions associated with LHX6. RAB40A, Member RAS Oncogene Family (RAB40A, Accession XM_088733) is another VGAM322 host target gene. RAB40A BINDING SITE is HOST TARGET binding site found in the 5' untranslated region of mRNA encoded by RAB40A, corresponding to a HOST TARGET binding site such as BINDING SITE I, BINDING SITE II or BINDING SITE III. Table 2 illustrates the complementarity of the nucleotide sequences of RAB40A BINDING SITE, designated SEQ ID:39925, to the nucleotide sequence of VGAM322 RNA, herein designated VGAM RNA, also designated SEQ ID:3033.

Another function of VGAM322 is therefore inhibition of RAB40A, Member RAS Oncogene Family (RAB40A, Accession XM_088733). Accordingly, utilities of VGAM322 include diagnosis, prevention and treatment of diseases and clinical conditions associated with RAB40A. LOC116113 (Accession XM_166413) is another VGAM322 host target gene. LOC116113 BINDING SITE is HOST TARGET binding site found in the 3' untranslated region of mRNA encoded by LOC116113, corresponding to a HOST TARGET binding site such as BINDING SITE I, BINDING SITE II or BINDING SITE III. Table 2 illustrates the complementarity of the nucleotide sequences of LOC116113 BINDING SITE, designated SEQ ID:44288, to the nucleotide sequence of VGAM322 RNA, herein designated VGAM RNA, also designated SEQ ID:3033.

Another function of VGAM322 is therefore inhibition of LOC116113 (Accession XM_166413). Accordingly, utilities of VGAM322 include diagnosis, prevention and treatment of diseases and clinical conditions associated with LOC116113. LOC200107 (Accession XM_114121) is another VGAM322 host target gene. LOC200107 BINDING SITE is HOST TARGET binding site found in the 5' untranslated region of mRNA encoded by LOC200107, corresponding to a HOST TARGET binding site such as BINDING SITE I, BINDING SITE II or BINDING SITE III. Table 2 illustrates the complementarity of the nucleotide sequences of LOC200107 BINDING SITE, designated SEQ ID:42708, to the nucleotide sequence of VGAM322 RNA, herein designated VGAM RNA, also designated SEQ ID:3033.

Another function of VGAM322 is therefore inhibition of LOC200107 (Accession XM_114121). Accordingly, utilities of VGAM322 include diagnosis, prevention and treatment of diseases and clinical conditions associated with LOC200107. LOC206426 (Accession XM_116505) is another VGAM322 host target gene. LOC206426 BINDING SITE is HOST TARGET binding site found in the 3' untranslated region of mRNA encoded by LOC206426, corresponding to a HOST TARGET binding site such as BINDING SITE I, BINDING SITE II or BINDING SITE III. Table 2 illustrates the complementarity of the nucleotide sequences of LOC206426 BINDING SITE, designated SEQ ID:43114, to the nucleotide sequence of VGAM322 RNA, herein designated VGAM RNA, also designated SEQ ID:3033.

Another function of VGAM322 is therefore inhibition of LOC206426 (Accession XM_116505). Accordingly, utilities of VGAM322 include diagnosis, prevention and treatment of diseases and clinical conditions associated with LOC206426. LOC257017 (Accession XM_173227) is another VGAM322 host target gene. LOC257017 BINDING SITE is HOST TARGET binding site found in the 5' untranslated region of mRNA encoded by LOC257017, corresponding to a HOST TARGET binding site such as BINDING SITE I, BINDING SITE II or BINDING SITE III. Table 2 illustrates the complementarity of the nucleotide sequences of LOC257017 BINDING SITE, designated SEQ ID:46497, to the nucleotide sequence of VGAM322 RNA, herein designated VGAM RNA, also designated SEQ ID:3033.

Another function of VGAM322 is therefore inhibition of LOC257017 (Accession XM_173227). Accordingly, utilities of VGAM322 include diagnosis, prevention and treatment of diseases and clinical conditions associated with LOC257017. FIG. 1 further provides a conceptual description of a novel bioinformatically detected viral gene of the present invention, referred to here as Viral Genomic Address Messenger 323 (VGAM323) viral gene, which modulates expression of respective host target genes thereof, the function and utility of which host target genes is known in the art.

VGAM323 is a novel bioinformatically detected regulatory, non protein coding, viral micro RNA (miRNA) gene. The method by which VGAM323 was detected is described hereinabove with reference to FIGS. 1-8.

VGAM323 gene, herein designated VGAM GENE, is a viral gene contained in the genome of Myxoma Virus. VGAM323 host target gene, herein designated VGAM HOST TARGET GENE, is a human gene contained in the human genome.

VGAM323 gene encodes a VGAM323 precursor RNA, herein designated VGAM PRECURSOR RNA. Similar to other miRNA genes, and unlike most ordinary genes, VGAM323 precursor RNA does not encode a protein. A nucleotide sequence identical or highly similar to the nucleotide sequence of VGAM323 precursor RNA is designated SEQ ID:309, and is provided hereinbelow with reference to the sequence listing part. Nucleotide sequence SEQ ID:309 is located at position 145414 relative to the genome of Myxoma Virus.

VGAM323 precursor RNA folds onto itself, forming VGAM323 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM323 folded precursor RNA into VGAM323 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM323 RNA is designated SEQ ID:3034, and is provided hereinbelow with reference to the sequence listing part.

VGAM323 host target gene, herein designated VGAM HOST TARGET GENE, encodes a corresponding messenger RNA, VGAM323 host target RNA, herein designated VGAM HOST TARGET RNA. VGAM323 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM323 RNA, herein designated VGAM RNA, binds complementarily to one or more host target binding sites located in untranslated regions of VGAM323 host target RNA, herein designated VGAM HOST TARGET RNA. This complementary binding is due to the fact that the nucleotide sequence of VGAM323 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM323 RNA, herein designated VGAM RNA, may have a different number of host target binding sites in untranslated regions of a VGAM323 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM323 RNA, herein designated VGAM RNA, to host target binding sites on VGAM323 host target RNA, herein designated VGAM HOST TARGET RNA, such as BINDING SITE I, BINDING SITE II and BINDING SITE III, inhibits translation of VGAM323 host target RNA into VGAM323 host target protein, herein designated VGAM HOST TARGET PROTEIN. VGAM host target protein is therefore outlined by a broken line.

It is appreciated that VGAM323 host target gene, herein designated VGAM HOST TARGET GENE, in fact represents a plurality of VGAM323 host target genes. The mRNA of each one of this plurality of VGAM323 host target genes comprises one or more host target binding sites, each having a nucleotide sequence which is at least partly complementary to VGAM323 RNA, herein designated VGAM RNA, and which when bound by VGAM323 RNA causes inhibition of translation of respective one or more VGAM323 host target proteins.

It is further appreciated by one skilled in the art that the mode of translational inhibition illustrated by FIG. 1 with specific reference to translational inhibition exerted by VGAM323 gene, herein designated VGAM GENE, on one or more VGAM323 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM323 is inhibition of expression of host target genes, as part of a novel viral mechanism of attacking a host. Accordingly, utilities of VGAM323 include diagnosis, prevention and treatment of viral infection by Myxoma Virus. Specific functions, and accordingly utilities, of VGAM323 correlate with, and may be deduced from, the identity of the host target genes which VGAM323 binds and inhibits, and the function of these host target genes, as elaborated hereinbelow.

Nucleotide sequences of the VGAM323 precursor RNA, herein designated VGAM PRECURSOR RNA, and of the 'diced' VGAM323 RNA, herein designated VGAM RNA, and a schematic representation of the secondary folding of VGAM323 folded precursor RNA, herein designated VGAM FOLDED PRECURSOR RNA, of VGAM323 are further described hereinbelow with reference to Table 1.

Nucleotide sequences of host target binding sites, such as BINDING SITE-I, BINDING SITE-II and BINDING SITE-III of FIG. 1, found on VGAM323 host target RNA, and schematic representation of the complementarity of each of these host target binding sites to VGAM323 RNA, herein designated VGAM RNA, are described hereinbelow with reference to Table 2.

As mentioned hereinabove with reference to FIG. 1, a function of VGAM323 gene, herein designated VGAM is inhibition of expression of VGAM323 target genes. It is appreciated that specific functions, and accordingly utilities, of VGAM323 correlate with, and may be deduced from, the identity of the target genes which VGAM323 binds and inhibits, and the function of these target genes, as elaborated hereinbelow.

Adenosine Deaminase, RNA-specific (ADAR, Accession NM_001111) is a VGAM323 host target gene. ADAR BINDING SITE1 through ADAR BINDING SITE3 are HOST TARGET binding sites found in untranslated regions of mRNA encoded by ADAR, corresponding to HOST TARGET binding sites such as BINDING SITE I, BINDING SITE II or BINDING SITE III. Table 2 illustrates the complementarity of the nucleotide sequences of ADAR BINDING SITE1 through ADAR BINDING SITE3, designated SEQ ID:6776, SEQ ID:17962 and SEQ ID:17969 respectively, to the nucleotide sequence of VGAM323 RNA, herein designated VGAM RNA, also designated SEQ ID:3034.

A function of VGAM323 is therefore inhibition of Adenosine Deaminase, RNA-specific (ADAR, Accession NM_001111), a gene which converts adenosine to inosine in double-stranded RNA. Accordingly, utilities of VGAM323 include diagnosis, prevention and treatment of diseases and clinical conditions associated with ADAR. The function of ADAR has been established by previous studies. Double-stranded RNA-specific adenosine deaminase (DSRAD) was identified as a developmentally regulated dsRNA unwinding activity in early antisense experiments with Xenopus oocytes (Bass and Weintraub, 1988). The enzyme converts adenosine to inosine in dsRNA, which destabilizes the dsRNA helix. The RNA modifying activity of DSRAD is important for various functions. Among these are site-specific RNA editing of transcripts of the glutamate receptors (see OMIM Ref. No. 138248), which are channels for the neurotransmitter L-glutamate in the brain. DSRAD also functions to modify viral RNA genomes and may be responsible for hypermutation of certain negative-stranded viruses, such as measles, which may result in lethal measles inclusion body encephalitis (Weier et al., 1995). By fluorescence in situ hybridization, Weier et al. (1995) mapped the DSRAD gene to 1q21.1-q21.2, centromeric to the marker D1S1705. Wang et al. (1995) mapped the DRADA gene to 1q21 by fluorescence in situ hybridization. By FISH, Weier et al. (2000) mapped the mouse homolog (Adar) to chromosome 3F2. Animal model experiments lend further support to the function of ADAR. Wang et al. (2000) knocked out the Adar1 gene in mice by targeted disruption and found that heterozygosity for the Adar1 knockout causes embryonic lethality.

It is appreciated that the abovementioned animal model for ADAR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Weier, H.-U. G.; George, C. X.; Greulich, K. M.; Samuel, C. E.: The interferon-inducible, double-stranded RNA-specific adenosine deaminase gene (DSRAD) maps to human chromosome 1q21.1-21.2. Genomics 30:372-375, 1995; and Wang, Q.; Khillan, J.; Gadue, P.; Nishikura, K.: Requirement of the RNA editing deaminase ADAR1 gene for embryonic erythropoiesis. Science 290:1765-1768, 2000.

Further studies establishing the function and utilities of ADAR are found in John Hopkins OMIM database record ID 601059, and in sited publications numbered 7151-7158 listed in the bibliography section hereinbelow, which are also hereby incorporated by reference. Nitric Oxide Synthase 1 (neuronal) (NOS1, Accession NM_000620) is another VGAM323 host target gene. NOS1 BINDING SITE is HOST TARGET binding site found in the 5' untranslated region of mRNA encoded by NOS1, corresponding to a HOST TARGET binding site such as BINDING SITE I, BINDING SITE II or BINDING SITE III. Table 2 illustrates the complementarity of the nucleotide sequences of NOS1 BINDING SITE, designated SEQ ID:6229, to the nucleotide sequence of VGAM323 RNA, herein designated VGAM RNA, also designated SEQ ID:3034.

Another function of VGAM323 is therefore inhibition of Nitric Oxide Synthase 1 (neuronal) (NOS1, Accession NM_000620), a gene which produces nitric oxide (no) which is a messenger molecule with diverse functions throughout the body. Accordingly, utilities of VGAM323 include diagnosis, prevention and treatment of diseases and clinical conditions associated with NOS1. The function of NOS1 has been established by previous studies. Bredt et al. (1991) cloned a cDNA for the neuronal form of nitric oxide (NO) synthase and studied its expression. The only mammalian protein with close sequence similarity was cytochrome P450 reductase. Magee et al. (1996) used PCR to clone a novel form of neuronal NOS from rat penile RNA. This NOS cDNA was termed PnNOS for 'penile neuronal NOS.' Sequencing revealed that the PnNOS cDNA was identical to rat cerebellar neuronal NOS1 except for a 102-bp insertion in PnNOS, indicating that PnNOS is a novel isoform. PCR of a human penile cDNA library confirmed that this insert is present in human DNA at the same location. Repetition of RT-PCR showed PnNOS to be the only form of NOS1 expressed in rat penis, urethra, prostate, and skeletal muscle. The PnNOS form was also present in rat cerebellum, liver, and pelvic plexus, although less abundantly than the shorter isoform. The authors postulated that PnNOS may be responsible for the synthesis of nitric oxide during penile erection and may be involved in control of the tone of the urethra, prostate, and bladder. Animal model experiments lend further support to the function of NOS1. Mice with targeted disruption of neuronal NO synthase display grossly normal appearance, locomotor activity, breeding, long-term potentiation, and long-term depression. NOS1-deficient mice are resistant to neural stroke damage following middle cerebral artery ligation. Nelson et al. (1995) reported a large increase in aggressive behavior and excessive, inappropriate sexual behavior in NOS1 'knockout' mice. Initial observations indicated that male NOS1-deficient mice engaged in chronic aggressive behavior, not apparent among NOS1-deficient female mice or wildtype male or female mice housed together. Relevance of the observations to human behavior was suggested.

It is appreciated that the abovementioned animal model for NOS1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Magee, T.; Fuentes, A. M.; Garban, H.; Rajavashisth, T.; Marquez, D.; Rodriguez, J. A.; Rajfer, J.; Gonzalez-Cadavid, N. F.: Cloning of a novel neuronal nitric oxide synthase expressed in penis and lower urinary tract. Biochem. Biophys. Res. Commun. 226:145-151, 1996; and Nelson, R. J.; Demas, G. E.; Huang, P. L.; Fishman, M. C.; Dawson, V. L.; Dawson, T. M.; Snyder, S. H.: Behavioural abnormalities in male mice lacking neuronal nitric oxide synthase. N.

Further studies establishing the function and utilities of NOS1 are found in John Hopkins OMIM database record ID 163731, and in sited publications numbered 11031-1864, 1854, 1865, 327 and 2729-2731 listed in the bibliography section hereinbelow, which are also hereby incorporated by reference. Protein Phosphatase 3 (formerly 2B), Regulatory Subunit B, 19 kDa, Alpha Isoform (calcineurin B, type I) (PPP3R1, Accession XM_084103) is another VGAM323 host target gene. PPP3R1 BINDING SITE is HOST TARGET binding site found in the 3' untranslated region of mRNA encoded by PPP3R1, corresponding to a HOST TARGET binding site such as BINDING SITE I, BINDING SITE II or BINDING SITE III. Table 2 illustrates the complementarity of the nucleotide sequences of PPP3R1 BINDING SITE, designated SEQ ID:37531, to the nucleotide sequence of VGAM323 RNA, herein designated VGAM RNA, also designated SEQ ID:3034.

Another function of VGAM323 is therefore inhibition of Protein Phosphatase 3 (formerly 2B), Regulatory Subunit B, 19 kDa, Alpha Isoform (calcineurin B, type I) (PPP3R1, Accession XM_084103), a gene which is a regulatory subunit of calcineurim, a calcium-dependent, calmodulin stimulated protein phosphatase 3. Accordingly, utilities of VGAM323 include diagnosis, prevention and treatment of diseases and clinical conditions associated with PPP3R1. The function of PPP3R1 has been established by previous studies. Calcineurin, a calmodulin-regulated protein phosphatase, is found in the cells of all eukaryotes ranging from yeast to mammals. Wang et al. (1996) described this heterodimeric protein as having a 19-kD Ca (2+)-binding regulatory subunit, calcineurin B, and a 58- to 59-kD catalytic subunit, calcineurin A. One gene encodes calcineurin B in all tissues except testis, and it is highly conserved at the level of both protein and DNA sequences in eukaryotes. In contrast, there are 2 major isoforms, alpha (OMIM Ref. No. 114105) and beta (OMIM Ref. No. 114106), of calcineurin A encoded by separate genes located on different human chromosomes. A third isoform, A-gamma (OMIM Ref. No. 114107), is unique to testis. Additional diversity of calcineurin A is created by alternative splicing of mRNAs. Calcineurin is especially abundant in brain where it constitutes 1% of total protein. Animal model experiments lend further support to the function of PPP3R1. Using conditional gene-targeting techniques, Zeng et al. (2001) created mice in which Cnb1 activity was disrupted specifically in the adult forebrain. At hippocampal Schaffer collateral-CA1 synapses, long-term depression (LTD) was significantly diminished, and there was a significant shift in the LTD/long-term potentiation (LTP) modification threshold in mutant mice. Although performance was normal in hippocampus-dependent reference memory tasks, including contextual fear conditioning and the Morris water maze, the mutant mice were impaired in hippocampus-dependent working and episodic-like memory tasks, including the delayed matching-to-place task and the radial maze task. These results defined a critical role for calcineurin in bidirectional synaptic plasticity and suggested a novel mechanistic distinction between working/episodic-like memory and reference memory.

It is appreciated that the abovementioned animal model for PPP3R1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Zeng, H.; Chattarji, S.; Barbarosie, M.; Rondi-Reig, L.; Philpot, B. D.; Miyakawa, T.; Bear, M. F.; Tonegawa, S.: Forebrain-specific calcineurin knockout selectively impairs bidirectional synaptic plasticity and working/episodic-like memory. Cell 107:617-629, 2001; and Wang, M. G.; Yi, H.; Guerini, D.; Klee, C. B.; McBride, O. W.: Calcineurin A alpha (PPP3CA), calcineurin A beta (PPP3CB) and calcineurin B (PPP3R1) are located on human chromosomes 4.

Further studies establishing the function and utilities of PPP3R1 are found in John Hopkins OMIM database record ID 601302, and in sited publications numbered 6507-6509 listed in the bibliography section hereinbelow, which are also hereby incorporated by reference. Splicing Factor, Arginine/serine-rich 1 (splicing factor 2, alternate splicing factor) (SFRS1, Accession NM_006924) is another VGAM323 host target gene. SFRS1 BINDING SITE is HOST TARGET binding site found in the 3' untranslated region of mRNA encoded by SFRS1, corresponding to a HOST TARGET binding site such as BINDING SITE I, BINDING SITE II or BINDING SITE III. Table 2 illustrates the complementarity of the nucleotide sequences of SFRS1 BINDING SITE, designated SEQ ID:13800, to the nucleotide sequence of VGAM323 RNA, herein designated VGAM RNA, also designated SEQ ID:3034.

Another function of VGAM323 is therefore inhibition of Splicing Factor, Arginine/serine-rich 1 (splicing factor 2, alternate splicing factor) (SFRS1, Accession NM_006924), a gene which plays an essential role in pre-mRNA splicing. Accordingly, utilities of VGAM323 include diagnosis, prevention and treatment of diseases and clinical conditions associated with SFRS1. The function of SFRS1 has been established by previous studies. Alternative mRNA splicing plays an important role in development and differentiation; many transcripts are spliced differently in distinct cell types and tissues. Bermingham et al. (1995) stated that while examples of alternatively spliced transcripts are found, relatively little is known about the mechanisms involved in regulating the use of alternative splice sites. Both constitutive and alternative splicing occurs on spliceosomes, which are complex particles composed of small nuclear ribonucleoproteins (OMIM Ref. No. snRNPs) and non-snRNP proteins. The SR family of non-snRNP splicing factors is characterized by the presence of an RNA recognition motif and a serine- and arginine-rich (SR) domain. SR proteins are required at early stages of spliceosome assembly, have distinct but overlapping specificities for different pre-mRNAs, and can alter splice site choice. These observations suggested SR proteins may be involved in the regulation of alternative splicing in vivo. Two of the SR proteins have been extensively characterized: ASF/SF2 (for 'alternative splicing factor/splicing factor-2') and SC35 (for 'splicing component, 35-kD'). The genes encoding these 2 factors are designated SFRS1 and SFRS2 (OMIM Ref. No. 600813), respectively. Krainer et al. (1991) had previously isolated a human cDNA for the pre-mRNA splicing factor referred to as SF2p33, which was later designated SFRS1. Other SR proteins include SFRS4 (OMIM Ref. No. 601940), SFRS5 (OMIM Ref. No. 600914), SFRS6 (OMIM Ref. No. 601944), and SFRS8 (OMIM Ref. No. 601945). Pollard et al. (2000) sought to determine if the nuclear concentrations of the trans-acting splicing regulators SF2/ASF and HNRNPA1 (OMIM Ref. No. 164017) and its splice variant, HNRNPA1B, are fundamental in regulating the expression of specific protein isoforms derived from alternative splicing of single pre-mRNA transcripts. SF2/ASF and HNRNPA1/A1B expression was determined in paired upper (OMIM Ref. No. corpus) and lower segment myometrial samples taken from individual women at term or during spontaneous labor and compared with nonpregnant control samples using specific monoclonal antibodies. SF2/ASF levels were substantially increased in the lower uterine region, and this was associated with a parallel decrease in levels of HNRNPA1/A1B during gestation. Conversely, the opposite pattern was observed within the upper uterine region during pregnancy, where HNRNPA1/A1B was significantly upregulated and SF2/ASF levels were much lower than those found in the lower uterine segment. The authors concluded that differential expression of HNRNPA1/A1B and SF2/ASF in the upper and lower uterine segments may have a primary role in defining the formation of specific myometrial protein species associated with the known contractile and relaxatory properties of these regions before and during parturition.

Full details of the abovementioned studies are described in the following publications, the disclosure of which are hereby incorporated by reference:

Bermingham, J. R., Jr.; Arden, K. C.; Naumova, A. K.; Sapienza, C.; Viars, C. S.; Fu, X.-D.; Khotz, J.; Manley, J. L.; Rosenfeld, M. G.: Chromosomal localization of mouse and human genes encoding the splicing factors ASF/SF2 (SFRS1) and SC-35 (SFRS2). Genomics 29:70-79, 1995; and Pollard, A. J.; Sparey, C.; Robson, S. C.; Krainer, A. R.; Europe-Finner, G. N.: Spatio-temporal expression of the trans-acting splicing factors SF2/ASF and heterogeneous ribonuclear prote.

Further studies establishing the function and utilities of SFRS1 are found in John Hopkins OMIM database record ID 600812, and in sited publications numbered 7138, 172 and 7139 listed in the bibliography section hereinbelow, which are also hereby incorporated by reference. A Kinase (PRKA) Anchor Protein 6 (AKAP6, Accession NM_004274) is another VGAM323 host target gene. AKAP6 BINDING SITE is HOST TARGET binding site found in the 3' untranslated region of mRNA encoded by AKAP6, corresponding to a HOST TARGET binding site such as BINDING SITE I, BINDING SITE II or BINDING SITE III. Table 2 illustrates the complementarity of the nucleotide sequences of AKAP6 BINDING SITE, designated SEQ ID:10491, to the nucleotide sequence of VGAM323 RNA, herein designated VGAM RNA, also designated SEQ ID:3034.

Another function of VGAM323 is therefore inhibition of A Kinase (PRKA) Anchor Protein 6 (AKAP6, Accession NM_004274). Accordingly, utilities of VGAM323 include diagnosis, prevention and treatment of diseases and clinical conditions associated with AKAP6. KIAA1843 (Accession XM_030838) is another VGAM323 host target gene. KIAA1843 BINDING SITE is HOST TARGET binding site found in the 3' untranslated region of mRNA encoded by KIAA1843, corresponding to a HOST TARGET binding site such as BINDING SITE I, BINDING SITE II or BINDING SITE III. Table 2 illustrates the complementarity of the nucleotide sequences of KIAA1843 BINDING SITE, designated SEQ ID:31163, to the nucleotide sequence of VGAM323 RNA, herein designated VGAM RNA, also designated SEQ ID:3034.

Another function of VGAM323 is therefore inhibition of KIAA1843 (Accession XM_030838). Accordingly, utilities of VGAM323 include diagnosis, prevention and treatment of diseases and clinical conditions associated with KIAA1843. P37NB (Accession NM_005824) is another VGAM323 host target gene. P37NB BINDING SITE is HOST TARGET binding site found in the 5' untranslated region of mRNA encoded by P37NB, corresponding to a HOST TARGET binding site such as BINDING SITE I, BINDING SITE II or BINDING SITE III. Table 2 illustrates the complementarity of the nucleotide sequences of P37NB BINDING SITE, designated SEQ ID:12437, to the nucleotide sequence of VGAM323 RNA, herein designated VGAM RNA, also designated SEQ ID:3034.

Another function of VGAM323 is therefore inhibition of P37NB (Accession NM_005824). Accordingly, utilities of VGAM323 include diagnosis, prevention and treatment of diseases and clinical conditions associated with P37NB. Solute Carrier Family 37 (glycerol-3-phosphate transporter), Member 1 (SLC37A1, Accession NM_018964) is another VGAM323 host target gene. SLC37A1 BINDING SITE is HOST TARGET binding site found in the 3' untranslated region of mRNA encoded by SLC37A1, corresponding to a HOST TARGET binding site such as BINDING SITE I, BINDING SITE II or BINDING SITE III. Table 2 illustrates the complementarity of the nucleotide sequences of SLC37A1 BINDING SITE, designated SEQ ID:21036, to the nucleotide sequence of VGAM323 RNA, herein designated VGAM RNA, also designated SEQ ID:3034.

Another function of VGAM323 is therefore inhibition of Solute Carrier Family 37 (glycerol-3-phosphate transporter), Member 1 (SLC37A1, Accession NM_018964). Accordingly, utilities of VGAM323 include diagnosis, prevention and treatment of diseases and clinical conditions associated with SLC37A1. LOC256502 (Accession XM_170546) is another VGAM323 host target gene. LOC256502 BINDING SITE is HOST TARGET binding site found in the 3' untranslated region of mRNA encoded by LOC256502, corresponding to a HOST TARGET binding site such as BINDING SITE I, BINDING SITE II or BINDING SITE III. Table 2 illustrates the complementarity of the nucleotide sequences of LOC256502 BINDING SITE, designated SEQ ID:45366, to the nucleotide sequence of VGAM323 RNA, herein designated VGAM RNA, also designated SEQ ID:3034.

Another function of VGAM323 is therefore inhibition of LOC256502 (Accession XM_170546). Accordingly, utilities of VGAM323 include diagnosis, prevention and treatment of diseases and clinical conditions associated with LOC256502. FIG. 1 further provides a conceptual description of a novel bioinformatically detected viral gene of the present invention, referred to here as Viral Genomic Address Messenger 324 (VGAM324) viral gene, which modulates expression of respective host target genes thereof, the function and utility of which host target genes is known in the art.

VGAM324 is a novel bioinformatically detected regulatory, non protein coding, viral micro RNA (miRNA) gene. The method by which VGAM324 was detected is described hereinabove with reference to FIGS. 1-8.

VGAM324 gene, herein designated VGAM GENE, is a viral gene contained in the genome of Rabbit Fibroma Virus. VGAM324 host target gene, herein designated VGAM HOST TARGET GENE, is a human gene contained in the human genome.

VGAM324 gene encodes a VGAM324 precursor RNA, herein designated VGAM PRECURSOR RNA. Similar to other miRNA genes, and unlike most ordinary genes, VGAM324 precursor RNA does not encode a protein. A nucleotide sequence identical or highly similar to the nucleotide sequence of VGAM324 precursor RNA is designated SEQ ID:310, and is provided hereinbelow with reference to the sequence listing part. Nucleotide sequence SEQ ID:310 is located at position 65828 relative to the genome of Rabbit Fibroma Virus.

VGAM324 precursor RNA folds onto itself, forming VGAM324 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM324 folded precursor RNA into VGAM324 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM324 RNA is designated SEQ ID:3035, and is provided hereinbelow with reference to the sequence listing part.

VGAM324 host target gene, herein designated VGAM HOST TARGET GENE, encodes a corresponding messenger RNA, VGAM324 host target RNA, herein designated VGAM HOST TARGET RNA. VGAM324 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM324 RNA, herein designated VGAM RNA, binds complementarily to one or more host target binding sites located in untranslated regions of VGAM324 host target RNA, herein designated VGAM HOST TARGET RNA. This complementary binding is due to the fact that the nucleotide sequence of VGAM324 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM324 RNA, herein designated VGAM RNA, may have a different number of host target binding sites in untranslated regions of a VGAM324 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM324 RNA, herein designated VGAM RNA, to host target binding sites on VGAM324 host target RNA, herein designated VGAM HOST TARGET RNA, such as BINDING SITE I, BINDING SITE II and BINDING SITE III, inhibits translation of VGAM324 host target RNA into VGAM324 host target protein, herein designated VGAM HOST TARGET PROTEIN. VGAM host target protein is therefore outlined by a broken line.

It is appreciated that VGAM324 host target gene, herein designated VGAM HOST TARGET GENE, in fact represents a plurality of VGAM324 host target genes. The mRNA of each one of this plurality of VGAM324 host target genes comprises one or more host target binding sites, each having a nucleotide sequence which is at least partly complementary to VGAM324 RNA, herein designated VGAM RNA, and which when bound by VGAM324 RNA causes inhibition of translation of respective one or more VGAM324 host target proteins.

It is further appreciated by one skilled in the art that the mode of translational inhibition illustrated by FIG. 1 with specific reference to translational inhibition exerted by VGAM324 gene, herein designated VGAM GENE, on one or more VGAM324 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM324 is inhibition of expression of host target genes, as part of a novel viral mechanism of attacking a host. Accordingly, utilities of VGAM324 include diagnosis, prevention and treatment of viral infection by Rabbit Fibroma Virus. Specific functions, and accordingly utilities, of VGAM324 correlate with, and may be deduced from, the identity of the host target genes which VGAM324 binds and inhibits, and the function of these host target genes, as elaborated hereinbelow.

Nucleotide sequences of the VGAM324 precursor RNA, herein designated VGAM PRECURSOR RNA, and of the 'diced' VGAM324 RNA, herein designated VGAM RNA, and a schematic representation of the secondary folding of VGAM324 folded precursor RNA, herein designated VGAM FOLDED PRECURSOR RNA, of VGAM324 are further described hereinbelow with reference to Table 1.

Nucleotide sequences of host target binding sites, such as BINDING SITE-I, BINDING SITE-II and BINDING SITE-III of FIG. 1, found on VGAM324 host target RNA, and schematic representation of the complementarity of each of these host target binding sites to VGAM324 RNA, herein designated VGAM RNA, are described hereinbelow with reference to Table 2.

As mentioned hereinabove with reference to FIG. 1, a function of VGAM324 gene, herein designated VGAM is inhibition of expression of VGAM324 target genes. It is appreciated that specific functions, and accordingly utilities, of VGAM324 correlate with, and may be deduced from, the identity of the target genes which VGAM324 binds and inhibits, and the function of these target genes, as elaborated hereinbelow.

Collagen, Type IV, Alpha 3 (Goodpasture antigen) (COL4A3, Accession NM_000091) is a VGAM324 host target gene. COL4A3 BINDING SITE1 through COL4A3 BINDING SITE3 are HOST TARGET binding sites found in untranslated regions of mRNA encoded by COL4A3, corresponding to HOST TARGET binding sites such as BINDING SITE I, BINDING SITE II or BINDING SITE III. Table 2 illustrates the complementarity of the nucleotide sequences of COL4A3 BINDING SITE1 through COL4A3 BINDING SITE3, designated SEQ ID:5545, SEQ ID:25352 and SEQ ID:25358 respectively, to the nucleotide sequence of VGAM324 RNA, herein designated VGAM RNA, also designated SEQ ID:3035.

A function of VGAM324 is therefore inhibition of Collagen, Type IV, Alpha 3 (Goodpasture antigen) (COL4A3, Accession NM_000091). Accordingly, utilities of VGAM324 include diagnosis, prevention and treatment of diseases and clinical conditions associated with COL4A3. Period Homolog 3 (Drosophila) (PER3, Accession NM_016831) is another VGAM324 host target gene. PER3 BINDING SITE is HOST TARGET binding site found in the 3' untranslated region of mRNA encoded by PER3, corresponding to a HOST TARGET binding site such as BINDING SITE I, BINDING SITE II or BINDING SITE III. Table 2 illustrates the complementarity of the nucleotide sequences of PER3 BINDING SITE, designated SEQ ID:18820, to the nucleotide sequence of VGAM324 RNA, herein designated VGAM RNA, also designated SEQ ID:3035.

Another function of VGAM324 is therefore inhibition of Period Homolog 3 (Drosophila) (PER3, Accession NM_016831). Accordingly, utilities of VGAM324 include diagnosis, prevention and treatment of diseases and clinical conditions associated with PER3. Yes-associated Protein 1, 65 kDa (YAP1, Accession NM_006106) is another VGAM324 host target gene. YAP1 BINDING SITE is HOST TARGET binding site found in the 3' untranslated region of mRNA encoded by YAP1, corresponding to a HOST TARGET binding site such as BINDING SITE I, BINDING SITE II or BINDING SITE III. Table 2 illustrates the complementarity of the nucleotide sequences of YAP1 BINDING SITE, designated SEQ ID:12752, to the nucleotide sequence of VGAM324 RNA, herein designated VGAM RNA, also designated SEQ ID:3035.

Another function of VGAM324 is therefore inhibition of Yes-associated Protein 1, 65 kDa (YAP1, Accession NM_006106). Accordingly, utilities of VGAM324 include diagnosis, prevention and treatment of diseases and clinical conditions associated with YAP1. LOC201627 (Accession XM_114353) is another VGAM324 host target gene. LOC201627 BINDING SITE is HOST TARGET binding site found in the 3' untranslated region of mRNA encoded by LOC201627, corresponding to a HOST TARGET binding site such as BINDING SITE I, BINDING SITE II or BINDING SITE III. Table 2 illustrates the complementarity of the nucleotide sequences of LOC201627 BINDING SITE, designated SEQ ID:42894, to the nucleotide sequence of VGAM324 RNA, herein designated VGAM RNA, also designated SEQ ID:3035.

Another function of VGAM324 is therefore inhibition of LOC201627 (Accession XM_114353). Accordingly, utilities of VGAM324 include diagnosis, prevention and treatment of diseases and clinical conditions associated with LOC201627. FIG. 1 further provides a conceptual description of a novel bioinformatically detected viral gene of the present invention, referred to here as Viral Genomic Address Messenger 325 (VGAM325) viral gene, which modulates expression of respective host target genes thereof, the function and utility of which host target genes is known in the art.

VGAM325 is a novel bioinformatically detected regulatory, non protein coding, viral micro RNA (miRNA) gene. The method by which VGAM325 was detected is described hereinabove with reference to FIGS. 1-8.

VGAM325 gene, herein designated VGAM GENE, is a viral gene contained in the genome of Rabbit Fibroma Virus. VGAM325 host target gene, herein designated VGAM HOST TARGET GENE, is a human gene contained in the human genome.

VGAM325 gene encodes a VGAM325 precursor RNA, herein designated VGAM PRECURSOR RNA. Similar to other miRNA genes, and unlike most ordinary genes, VGAM325 precursor RNA does not encode a protein. A nucleotide sequence identical or highly similar to the nucleotide sequence of VGAM325 precursor RNA is designated SEQ ID:311, and is provided hereinbelow with reference to the sequence listing part. Nucleotide sequence SEQ ID:311 is located at position 66316 relative to the genome of Rabbit Fibroma Virus.

VGAM325 precursor RNA folds onto itself, forming VGAM325 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM325 folded precursor RNA into VGAM325 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM325 RNA is designated SEQ ID:3036, and is provided hereinbelow with reference to the sequence listing part.

VGAM325 host target gene, herein designated VGAM HOST TARGET GENE, encodes a corresponding messenger RNA, VGAM325 host target RNA, herein designated VGAM HOST TARGET RNA. VGAM325 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM325 RNA, herein designated VGAM RNA, binds complementarily to one or more host target binding sites located in untranslated regions of VGAM325 host target RNA, herein designated VGAM HOST TARGET RNA. This complementary binding is due to the fact that the nucleotide sequence of VGAM325 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM325 RNA, herein designated VGAM RNA, may have a different number of host target binding sites in untranslated regions of a VGAM325 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM325 RNA, herein designated VGAM RNA, to host target binding sites on VGAM325 host target RNA, herein designated VGAM HOST TARGET RNA, such as BINDING SITE I, BINDING SITE II and BINDING SITE III, inhibits translation of VGAM325 host target RNA into VGAM325 host target protein, herein designated VGAM HOST TARGET PROTEIN.

VGAM host target protein is therefore outlined by a broken line.

It is appreciated that VGAM325 host target gene, herein designated VGAM HOST TARGET GENE, in fact represents a plurality of VGAM325 host target genes. The mRNA of each one of this plurality of VGAM325 host target genes comprises one or more host target binding sites, each having a nucleotide sequence which is at least partly complementary to VGAM325 RNA, herein designated VGAM RNA, and which when bound by VGAM325 RNA causes inhibition of translation of respective one or more VGAM325 host target proteins.

It is further appreciated by one skilled in the art that the mode of translational inhibition illustrated by FIG. 1 with specific reference to translational inhibition exerted by VGAM325 gene, herein designated VGAM GENE, on one or more VGAM325 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM325 is inhibition of expression of host target genes, as part of a novel viral mechanism of attacking a host. Accordingly, utilities of VGAM325 include diagnosis, prevention and treatment of viral infection by Rabbit Fibroma Virus. Specific functions, and accordingly utilities, of VGAM325 correlate with, and may be deduced from, the identity of the host target genes which VGAM325 binds and inhibits, and the function of these host target genes, as elaborated hereinbelow.

Nucleotide sequences of the VGAM325 precursor RNA, herein designated VGAM PRECURSOR RNA, and of the 'diced' VGAM325 RNA, herein designated VGAM RNA, and a schematic representation of the secondary folding of VGAM325 folded precursor RNA, herein designated VGAM FOLDED PRECURSOR RNA, of VGAM325 are further described hereinbelow with reference to Table 1.

Nucleotide sequences of host target binding sites, such as BINDING SITE-I, BINDING SITE-II and BINDING SITE-III of FIG. 1, found on VGAM325 host target RNA, and schematic representation of the complementarity of each of these host target binding sites to VGAM325 RNA, herein designated VGAM RNA, are described hereinbelow with reference to Table 2.

As mentioned hereinabove with reference to FIG. 1, a function of VGAM325 gene, herein designated VGAM is inhibition of expression of VGAM325 target genes. It is appreciated that specific functions, and accordingly utilities, of VGAM325 correlate with, and may be deduced from, the identity of the target genes which VGAM325 binds and inhibits, and the function of these target genes, as elaborated hereinbelow.

ABLIM (Accession NM_002313) is a VGAM325 host target gene. ABLIM BINDING SITE1 and ABLIM BINDING SITE2 are HOST TARGET binding sites found in untranslated regions of mRNA encoded by ABLIM, corresponding to HOST TARGET binding sites such as BINDING SITE I, BINDING SITE II or BINDING SITE III. Table 2 illustrates the complementarity of the nucleotide sequences of ABLIM BINDING SITE1 and ABLIM BINDING SITE2, designated SEQ ID:8122 and SEQ ID:13555 respectively, to the nucleotide sequence of VGAM325 RNA, herein designated VGAM RNA, also designated SEQ ID:3036.

A function of VGAM325 is therefore inhibition of ABLIM (Accession NM_002313). Accordingly, utilities of VGAM325 include diagnosis, prevention and treatment of diseases and clinical conditions associated with ABLIM. MGC13007 (Accession NM_032320) is another VGAM325 host target gene. MGC13007 BINDING SITE is HOST TARGET binding site found in the 5'' untranslated region of mRNA encoded by MGC13007, corresponding to a HOST TARGET binding site such as BINDING SITE I, BINDING SITE II or BINDING SITE III. Table 2 illustrates the complementarity of the nucleotide sequences of MGC13007 BINDING SITE, designated SEQ ID:26123, to the nucleotide sequence of VGAM325 RNA, herein designated VGAM RNA, also designated SEQ ID:3036.

Another function of VGAM325 is therefore inhibition of MGC13007 (Accession NM_032320). Accordingly, utilities of VGAM325 include diagnosis, prevention and treatment of diseases and clinical conditions associated with MGC13007. Ubiquitin Specific Protease 20 (USP20, Accession NM_006676) is another VGAM325 host target gene. USP20 BINDING SITE is HOST TARGET binding site found in the 3' untranslated region of mRNA encoded by USP20, corresponding to a HOST TARGET binding site such as BINDING SITE I, BINDING SITE II or BINDING SITE III. Table 2 illustrates the complementarity of the nucleotide sequences of USP20 BINDING SITE, designated SEQ ID:13504, to the nucleotide sequence of VGAM325 RNA, herein designated VGAM RNA, also designated SEQ ID:3036.

Another function of VGAM325 is therefore inhibition of Ubiquitin Specific Protease 20 (USP20, Accession NM_006676). Accordingly, utilities of VGAM325 include diagnosis, prevention and treatment of diseases and clinical conditions associated with USP20. LOC144811 (Accession XM_096681) is another VGAM325 host target gene. LOC144811 BINDING SITE is HOST TARGET binding site found in the 3' untranslated region of mRNA encoded by LOC144811, corresponding to a HOST TARGET binding site such as BINDING SITE I, BINDING SITE II or BINDING SITE III. Table 2 illustrates the complementarity of the nucleotide sequences of LOC144811 BINDING SITE, designated SEQ ID:40455, to the nucleotide sequence of VGAM325 RNA, herein designated VGAM RNA, also designated SEQ ID:3036.

Another function of VGAM325 is therefore inhibition of LOC144811 (Accession XM_096681). Accordingly, utilities of VGAM325 include diagnosis, prevention and treatment of diseases and clinical conditions associated with LOC144811. LOC92235 (Accession XM_043739) is another VGAM325 host target gene. LOC92235 BINDING SITE is HOST TARGET binding site found in the 5' untranslated region of mRNA encoded by LOC92235, corresponding to a HOST TARGET binding site such as BINDING SITE I, BINDING SITE II or BINDING SITE III. Table 2 illustrates the complementarity of the nucleotide sequences of LOC92235 BINDING SITE, designated SEQ ID:34012, to the nucleotide sequence of VGAM325 RNA, herein designated VGAM RNA, also designated SEQ ID:3036.

Another function of VGAM325 is therefore inhibition of LOC92235 (Accession XM_043739). Accordingly, utilities of VGAM325 include diagnosis, prevention and treatment of diseases and clinical conditions associated with LOC92235. FIG. 1 further provides a conceptual description of a novel bioinformatically detected viral gene of the present invention, referred to here as Viral Genomic Address Messenger 326

(VGAM326) viral gene, which modulates expression of respective host target genes thereof, the function and utility of which host target genes is known in the art.

VGAM326 is a novel bioinformatically detected regulatory, non protein coding, viral micro RNA (miRNA) gene. The method by which VGAM326 was detected is described hereinabove with reference to FIGS. 1-8.

VGAM326 gene, herein designated VGAM GENE, is a viral gene contained in the genome of Rabbit Fibroma Virus. VGAM326 host target gene, herein designated VGAM HOST TARGET GENE, is a human gene contained in the human genome.

VGAM326 gene encodes a VGAM326 precursor RNA, herein designated VGAM PRECURSOR RNA. Similar to other miRNA genes, and unlike most ordinary genes, VGAM326 precursor RNA does not encode a protein. A nucleotide sequence identical or highly similar to the nucleotide sequence of VGAM326 precursor RNA is designated SEQ ID:312, and is provided hereinbelow with reference to the sequence listing part. Nucleotide sequence SEQ ID:312 is located at position 66122 relative to the genome of Rabbit Fibroma Virus.

VGAM326 precursor RNA folds onto itself, forming VGAM326 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM326 folded precursor RNA into VGAM326 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM326 RNA is designated SEQ ID:3037, and is provided hereinbelow with reference to the sequence listing part.

VGAM326 host target gene, herein designated VGAM HOST TARGET GENE, encodes a corresponding messenger RNA, VGAM326 host target RNA, herein designated VGAM HOST TARGET RNA. VGAM326 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM326 RNA, herein designated VGAM RNA, binds complementarily to one or more host target binding sites located in untranslated regions of VGAM326 host target RNA, herein designated VGAM HOST TARGET RNA. This complementary binding is due to the fact that the nucleotide sequence of VGAM326 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM326 RNA, herein designated VGAM RNA, may have a different number of host target binding sites in untranslated regions of a VGAM326 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM326 RNA, herein designated VGAM RNA, to host target binding sites on VGAM326 host target RNA, herein designated VGAM HOST TARGET RNA, such as BINDING SITE I, BINDING SITE II and BINDING SITE III, inhibits translation of VGAM326 host target RNA into VGAM326 host target protein, herein designated VGAM HOST TARGET PROTEIN. VGAM host target protein is therefore outlined by a broken line.

It is appreciated that VGAM326 host target gene, herein designated VGAM HOST TARGET GENE, in fact represents a plurality of VGAM326 host target genes. The mRNA of each one of this plurality of VGAM326 host target genes comprises one or more host target binding sites, each having a nucleotide sequence which is at least partly complementary to VGAM326 RNA, herein designated VGAM RNA, and which when bound by VGAM326 RNA causes inhibition of translation of respective one or more VGAM326 host target proteins.

It is further appreciated by one skilled in the art that the mode of translational inhibition illustrated by FIG. 1 with specific reference to translational inhibition exerted by VGAM326 gene, herein designated VGAM GENE, on one or more VGAM326 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM326 is inhibition of expression of host target genes, as part of a novel viral mechanism of attacking a host. Accordingly, utilities of VGAM326 include diagnosis, prevention and treatment of viral infection by Rabbit Fibroma Virus. Specific functions, and accordingly utilities, of VGAM326 correlate with, and may be deduced from, the identity of the host target genes which VGAM326 binds and inhibits, and the function of these host target genes, as elaborated hereinbelow.

Nucleotide sequences of the VGAM326 precursor RNA, herein designated VGAM PRECURSOR RNA, and of the 'diced' VGAM326 RNA, herein designated VGAM RNA, and a schematic representation of the secondary folding of VGAM326 folded precursor RNA, herein designated VGAM FOLDED PRECURSOR RNA, of VGAM326 are further described hereinbelow with reference to Table 1.

Nucleotide sequences of host target binding sites, such as BINDING SITE-I, BINDING SITE-II and BINDING SITE-III of FIG. 1, found on VGAM326 host target RNA, and schematic representation of the complementarity of each of these host target binding sites to VGAM326 RNA, herein designated VGAM RNA, are described hereinbelow with reference to Table 2.

As mentioned hereinabove with reference to FIG. 1, a function of VGAM326 gene, herein designated VGAM is inhibition of expression of VGAM326 target genes. It is appreciated that specific functions, and accordingly utilities, of VGAM326 correlate with, and may be deduced from, the identity of the target genes which VGAM326 binds and inhibits, and the function of these target genes, as elaborated hereinbelow.

Activin A Receptor, Type I (ACVR1, Accession NM_001105) is a VGAM326 host target gene. ACVR1 BINDING SITE is HOST TARGET binding site found in the 3' untranslated region of mRNA encoded by ACVR1, corresponding to a HOST TARGET binding site such as BINDING SITE I, BINDING SITE II or BINDING SITE III. Table 2 illustrates the complementarity of the nucleotide sequences of ACVR1 BINDING SITE, designated SEQ ID:6764, to the nucleotide sequence of VGAM326 RNA, herein designated VGAM RNA, also designated SEQ ID:3037.

A function of VGAM326 is therefore inhibition of Activin A Receptor, Type I (ACVR1, Accession NM_001105), a gene which Activin receptor-like kinase; similar to activin, TGF-beta, and C. elegans daf-1 receptors. Accordingly, utilities of VGAM326 include diagnosis, prevention and treatment of diseases and clinical conditions associated with ACVR1. The function of ACVR1 and its association with various diseases and clinical conditions, has been established by previous studies, as described hereinabove with reference to VGAM217. BTG Family, Member 2 (BTG2, Accession NM_006763) is another VGAM326 host target gene. BTG2 BINDING SITE is HOST TARGET binding site found in the 3' untranslated region of mRNA encoded by BTG2, corresponding to a HOST TARGET binding site such as BINDING SITE I, BINDING SITE II or BINDING SITE III. Table 2 illustrates the complementarity of the nucleotide sequences of BTG2 BINDING SITE, designated SEQ ID:13630, to the nucleotide sequence of VGAM326 RNA, herein designated VGAM RNA, also designated SEQ ID:3037.

Another function of VGAM326 is therefore inhibition of BTG Family, Member 2 (BTG2, Accession NM_006763). Accordingly, utilities of VGAM326 include diagnosis, prevention and treatment of diseases and clinical conditions associated with BTG2. Ceroid-lipofuscinosis, Neuronal 2, Late Infantile (Jansky-Bielschowsky disease) (CLN2, Accession NM_000391) is another VGAM326 host target gene. CLN2 BINDING SITE is HOST TARGET binding site found in the 3' untranslated region of mRNA encoded by CLN2, corresponding to a HOST TARGET binding site such as BINDING SITE I, BINDING SITE II or BINDING SITE III. Table 2 illustrates the complementarity of the nucleotide sequences of CLN2 BINDING SITE, designated SEQ ID:5968, to the nucleotide sequence of VGAM326 RNA, herein designated VGAM RNA, also designated SEQ ID:3037.

Another function of VGAM326 is therefore inhibition of Ceroid-lipofuscinosis, Neuronal 2, Late Infantile (Jansky-Bielschowsky disease) (CLN2, Accession NM_000391). Accordingly, utilities of VGAM326 include diagnosis, prevention and treatment of diseases and clinical conditions associated with CLN2. Diaphanous Homolog 2 (Drosophila) (DIAPH2, Accession NM_006729) is another VGAM326 host target gene. DIAPH2 BINDING SITE is HOST TARGET binding site found in the 3' untranslated region of mRNA encoded by DIAPH2, corresponding to a HOST TARGET binding site such as BINDING SITE I, BINDING SITE II or BINDING SITE III. Table 2 illustrates the complementarity of the nucleotide sequences of DIAPH2 BINDING SITE, designated SEQ ID:13563, to the nucleotide sequence of VGAM326 RNA, herein designated VGAM RNA, also designated SEQ ID:3037.

Another function of VGAM326 is therefore inhibition of Diaphanous Homolog 2 (Drosophila) (DIAPH2, Accession NM_006729), a gene which may affect in oogenesis. Accordingly, utilities of VGAM326 include diagnosis, prevention and treatment of diseases and clinical conditions associated with DIAPH2. The function of DIAPH2 and its association with various diseases and clinical conditions, has been established by previous studies, as described hereinabove with reference to VGAM129. Forkhead Box D2 (FOXD2, Accession NM_004474) is another VGAM326 host target gene. FOXD2 BINDING SITE is HOST TARGET binding site found in the 3' untranslated region of mRNA encoded by FOXD2, corresponding to a HOST TARGET binding site such as BINDING SITE I, BINDING SITE II or BINDING SITE III. Table 2 illustrates the complementarity of the nucleotide sequences of FOXD2 BINDING SITE, designated SEQ ID:10789, to the nucleotide sequence of VGAM326 RNA, herein designated VGAM RNA, also designated SEQ ID:3037.

Another function of VGAM326 is therefore inhibition of Forkhead Box D2 (FOXD2, Accession NM_004474). Accordingly, utilities of VGAM326 include diagnosis, prevention and treatment of diseases and clinical conditions associated with FOXD2. Glutaminase (GLS, Accession NM_014905) is another VGAM326 host target gene. GLS BINDING SITE is HOST TARGET binding site found in the 3' untranslated region of mRNA encoded by GLS, corresponding to a HOST TARGET binding site such as BINDING SITE I, BINDING SITE II or BINDING SITE III. Table 2 illustrates the complementarity of the nucleotide sequences of GLS BINDING SITE, designated SEQ ID:17106, to the nucleotide sequence of VGAM326 RNA, herein designated VGAM RNA, also designated SEQ ID:3037.

Another function of VGAM326 is therefore inhibition of Glutaminase (GLS, Accession NM_014905). Accordingly, utilities of VGAM326 include diagnosis, prevention and treatment of diseases and clinical conditions associated with GLS. Glycoprotein M6A (GPM6A, Accession NM_005277) is another VGAM326 host target gene. GPM6A BINDING SITE is HOST TARGET binding site found in the 3' untranslated region of mRNA encoded by GPM6A, corresponding to a HOST TARGET binding site such as BINDING SITE I, BINDING SITE II or BINDING SITE III. Table 2 illustrates the complementarity of the nucleotide sequences of GPM6A BINDING SITE, designated SEQ ID:11781, to the nucleotide sequence of VGAM326 RNA, herein designated VGAM RNA, also designated SEQ ID:3037.

Another function of VGAM326 is therefore inhibition of Glycoprotein M6A (GPM6A, Accession NM_005277), a gene which may play a role in neuronal development. Accordingly, utilities of VGAM326 include diagnosis, prevention and treatment of diseases and clinical conditions associated with GPM6A. The function of GPM6A has been established by previous studies. Yan et al. (1993) used monoclonal antibodies raised against antigens in mouse brain fractions to isolate 2 related cDNAs from an expression library. The cDNAs, which they designated M6a and M6b (OMIM Ref. No. 300051), are highly similar to the myelin proteolipid protein (OMIM Ref. No. 300401) and are expressed during early development of the mouse central nervous system (CNS). Olinsky et al. (1996) found that the M6a gene (GPM6A) is expressed only in neurons. They obtained partial human genomic and cDNA clones for M6a and mapped the gene to 4q34 by fluorescence in situ hybridization. M6, a cell surface glycoprotein mainly expressed on neurons in the murine CNS, plays significant roles in neural cell adhesion and some aspects of neurite growth (Lagenaur et al., 1992). Shimizu et al. (1996) isolated a human cDNA that is highly homologous to the murine gene, symbolized Gpm6, that encodes M6. The human gene, GPM6A, contains an open reading frame of 834 nucleotides encoding a peptide of 278 amino acids. Northern blot analysis revealed specific expression in human brain. By radiation hybrid mapping, Shimizu et al. (1996) assigned the GPM6A gene to 4q33-q34.

Full details of the abovementioned studies are described in the following publications, the disclosure of which are hereby incorporated by reference:

Shimizu, F.; Watanabe, T. K.; Fujiwara, T.; Takahashi, E.; Nakamura, Y.; Maekawa, H.: Isolation and mapping of the human glycoprotein M6 gene (GPM6A) to 4q33-to-q34. Cytogenet. Cell Genet. 74:138-139, 1996; and Yan, Y.; Lagenaur, C.; Narayanan, V.: Molecular cloning of M6: identification of a PLP/DM20 gene family. Neuron 11:423-431, 1993.

Further studies establishing the function and utilities of GPM6A are found in John Hopkins OMIM database record ID 601275, and in sited publications numbered 986 and 9863 listed in the bibliography section hereinbelow, which are also hereby incorporated by reference.5-hydroxytryptamine (serotonin) Receptor 6 (HTR6, Accession NM_000871) is another VGAM326 host target gene. HTR6 BINDING SITE is HOST TARGET binding site found in the 5' untranslated region of mRNA encoded by HTR6, corresponding to a HOST TARGET binding site such as BINDING SITE I, BINDING SITE II or BINDING SITE III. Table 2 illustrates the complementarity of the nucleotide sequences of HTR6 BINDING SITE, designated SEQ ID:6549, to the nucleotide sequence of VGAM326 RNA, herein designated VGAM RNA, also designated SEQ ID:3037.

Another function of VGAM326 is therefore inhibition of 5-hydroxytryptamine (serotonin) Receptor 6 (HTR6, Accession NM_000871), a gene which stimulates adenylate cyclase. Accordingly, utilities of VGAM326 include diagnosis, prevention and treatment of diseases and clinical conditions associated with HTR6. The function of HTR6 has been established by previous studies. Rees et al. (1994) identified a serotonin receptor subtype, HTR5A, that appeared to be expressed uniquely in the central nervous system. Schanen et al. (1996) used PCR analysis of somatic cell hybrid panels and a collection of chromosome 7-specific YAC clones to map HTR5A to 7q36.1.

Full details of the abovementioned studies are described in the following publications, the disclosure of which are hereby incorporated by reference:

Rees, S.; den Daas, I.; Foord, S.; Goodson, S.; Bull, D.; Kilpatrick, G.; Lee, M.: Cloning and characterisation of the human 5-HT5A serotonin receptor. FEBS Lett. 355:242-246, 1994; and Schanen, N. C.; Scherer, S. W.; Tsui, L.-C.; Francke, U.: Assignment of the 5-hydroxytryptamine (serotonin) receptor 5A gene (HTR5A) to human chromosome band 7q36.1. Cytogenet. Cell Ge.

Further studies establishing the function and utilities of HTR6 are found in John Hopkins OMIM database record ID 601109, and in sited publications numbered 10246 listed in the bibliography section hereinbelow, which are also hereby incorporated by reference. Interleukin 12 Receptor, Beta 2 (IL12RB2, Accession NM_001559) is another VGAM326 host target gene. IL12RB2 BINDING SITE is HOST TARGET binding site found in the 3' untranslated region of mRNA encoded by IL12RB2, corresponding to a HOST TARGET binding site such as BINDING SITE I, BINDING SITE II or BINDING SITE III. Table 2 illustrates the complementarity of the nucleotide sequences of IL12RB2 BINDING SITE, designated SEQ ID:7280, to the nucleotide sequence of VGAM326 RNA, herein designated VGAM RNA, also designated SEQ ID:3037.

Another function of VGAM326 is therefore inhibition of Interleukin 12 Receptor, Beta 2 (IL12RB2, Accession NM_001559), a gene which is involved in il-12 transduction. binds to il-12 with a low affinity. Accordingly, utilities of VGAM326 include diagnosis, prevention and treatment of diseases and clinical conditions associated with IL12RB2. The function of IL12RB2 has been established by previous studies. Chua et al. (1994) and Presky et al. (1996) identified 2 subunits of the interleukin-12 (IL12; 161560) receptor complex designated beta-1 (OMIM Ref. No. 601604) and beta-2, respectively. Presky et al. (1996) identified IL12RB2 cDNA from a human phytohemagglutinin-activated lymphoblast library. It is an 862-amino acid type I transmembrane protein with a 595-amino acid-long extracellular domain and a cytoplasmic tail of 216 amino acids that contains 3 tyrosine residues. A cDNA encoding the mouse homolog was also isolated. The human and mouse proteins show 68% amino acid sequence identity. When expressed in COS-7 cells, IL12RB2 exists as a disulfide-linked oligomer with an apparent monomeric molecular weight of 130 kD. Functional studies indicated that high affinity IL12R is composed of at least 2 beta-type cytokine receptor subunits, each independently exhibiting low affinity for IL12 IL12RB1 is constitutively expressed on both Th1 and Th2 lymphocytes. IL12RB2 is expressed more strongly on Th1 cells, however, and can be induced by antigen receptor triggering or by IL12 and alpha-interferon (IFNA; 147660). Using RT-PCR analysis, Kim et al. (2001) showed that IL12RB2 expression was high in lesions of tuberculoid (i.e., M. leprae-resistant) leprosy (see OMIM Ref. No. 246300) patients but not in lesions of lepromatous (i.e., low-resistance) patients. IL12RB1 expression was similar in both groups. Flow cytometric analysis demonstrated that tuberculoid patient T cells responded with increased expression of IL12RB1 and IL12RB2 to M. leprae antigen stimulation, whereas lepromatous patients upregulated expression of IL12RB1 but not IL12RB2. EMSA, supershift, and Western blot analyses indicated that IL12 stimulation induced STAT4 phosphorylation and STAT4-DNA binding in tuberculoid but not lepromatous patients. The defect in lepromatous patients was specific to M. leprae in that they upregulated both IL12RB1 and IL12RB2 in response to M. tuberculosis and activated the STAT4 pathway. ELISA analysis showed that production of IFNG (OMIM Ref. No. 147570) correlated with IL12RB2 expression in the leprosy patients. Kim et al. (2001) proposed that the Th response to antigen determines IL12RB2 expression and function in the generation of cell-mediated immunity to microbial infection Full details of the abovementioned studies are described in the following publications, the disclosure of which are hereby incorporated by reference:

Presky, D. H.; Yang, H.; Minetti, L. J.; Chua, A. O.; Nabavi, N.; Wu, C.-Y.; Gately, M. K.; Gubler, U.: A functional interleukin 12 receptor complex is composed of two beta-type cytokine receptor subunits. Proc. Nat. Acad. Sci. 93:14002-14007, 1996; and Kim, J.; Uyemura, K.; Van Dyke, M. K.; Legaspi, A. J.; Rea, T. H.; Shuai, K.; Modlin, R. L.: A role for IL-12 receptor expression and signal transduction in host defense in leprosy. J.

Further studies establishing the function and utilities of IL12RB2 are found in John Hopkins OMIM database record ID 601642, and in sited publications numbered 4894, 6685-668 and 8854-8855 listed in the bibliography section hereinbelow, which are also hereby incorporated by reference. Leukocyte-associated Ig-like Receptor 1 (LAIR1, Accession NM_002287) is another VGAM326 host target gene. LAIR1

BINDING SITE1 and LAIR1 BINDING SITE2 are HOST TARGET binding sites found in untranslated regions of mRNA encoded by LAIR1, corresponding to HOST TARGET binding sites such as BINDING SITE I, BINDING SITE II or BINDING SITE III. Table 2 illustrates the complementarity of the nucleotide sequences of LAIR1 BINDING SITE1 and LAIR1 BINDING SITE2, designated SEQ ID:8068 and SEQ ID:22322 respectively, to the nucleotide sequence of VGAM326 RNA, herein designated VGAM RNA, also designated SEQ ID:3037.

Another function of VGAM326 is therefore inhibition of Leukocyte-associated Ig-like Receptor 1 (LAIR1, Accession NM_002287), a gene which Inhibitory receptor that represses cytotoxicity of natural killer cells and of T cell clones that lack CD28; contains an immunoglobulin-like domain. Accordingly, utilities of VGAM326 include diagnosis, prevention and treatment of diseases and clinical conditions associated with LAIR1. The function of LAIR1 has been established by previous studies. Natural killer (NK) cells are a subpopulation of lymphocytes capable of lysing transformed and virus-infected cells without apparent presensitization. Inhibitory receptors present on NK cells prevent excessive inflammatory responses and autoimmunity by binding major histocompatibility complex (MHC) expressed on target cells, resulting in the NK cells selectively killing only targets that lack MHC on their surface. Two families of human NK cell inhibitory receptors are the killer cell inhibitory receptors of the immunoglobulin superfamily and the NKG2 receptors (e.g., KLRC1; 161555) of the C-type lectin superfamily. All of these inhibitory receptors possess cytoplasmic tails with immune receptor tyrosine-based inhibitory motifs (ITIMs), which bind to the SH2 domain of certain phosphatases upon phosphorylation, leading to the down regulation of cell activation. To identify molecules involved in the negative signaling of NK cells, Meyaard et al. (1997) immunized mice with a human NK cell clone and screened antibodies for the capacity to inhibit NK cell-mediated lysis of Fc receptor (FcR)-bearing targets. They isolated a monoclonal antibody that recognized LAIR1. They found that FcR crosslinking of LAIR1 was required to deliver the negative signal and that it led to inhibition of cytotoxicity even in the presence of strong positive signals. Both the SH2-containing tyrosine phosphatases SHP1 (PTPN6; 176883) and SHP2 (PTPN11; 176876) associated with tyrosine-phosphorylated LAIR1. LAIR1 does not appear to recognize class I human leukocyte antigens (HLAs). LAIR1 was expressed on the majority of human peripheral blood mononuclear leukocytes examined Using flow cytometry to screen cell lines with a LAIR1 fusion protein, Meyaard et al. (2001) identified a LAIR1 ligand on colon carcinoma cell lines. By expression cloning from a colon carcinoma cDNA library, they showed that the LAIR1 ligand is identical to EPCAM (TACSTD1; 185535). EPCAM also binds LAIR2 (OMIM Ref. No. 602993), which is 84% homologous to LAIR1 in its Ig domain. Mutation analysis determined that EPCAM interacts with the LAIRs through its first EGF-like repeat. Flow cytometry and immunohistochemical analysis demonstrated LAIR1 expression in intestinal intraepithelial cells, in close proximity to cells expressing EPCAM. Meyaard et al. (2001) proposed that EPCAM, through its interaction with the LAIR1 inhibitory receptor, is involved in preventing excessive inflammatory responses in regions, such as intestine, with high antigen exposure Full details of the abovementioned studies are described in the following publications, the disclosure of which are hereby incorporated by reference:

Sathish, J. G.; Johnson, K. G.; Fuller, K. J.; LeRoy, F. G.; Meyaard, L.; Sims, M. J.; Matthews, R. J.: Constitutive association of SHP-1 with leukocyte-associated Ig-like receptor-1 in human T cells. J. Immun. 166:1763-1770, 2001; and Xu, M.; Zhao, R.; Zhao, Z. J.: Identification and characterization of leukocyte-associated Ig-like receptor-1 as a major anchor protein of tyrosine phosphatase SHP-1 in hematopoietic c.

Further studies establishing the function and utilities of LAIR1 are found in John Hopkins OMIM database record ID 602992, and in sited publications numbered 689, 540 and 5407-5408 listed in the bibliography section hereinbelow, which are also hereby incorporated by reference. Phospholipase A2 Receptor 1, 180 kDa (PLA2R1, Accession NM_007366) is another VGAM326 host target gene. PLA2R1 BINDING SITE is HOST TARGET binding site found in the 3' untranslated region of mRNA encoded by PLA2R1, corresponding to a HOST TARGET binding site such as BINDING SITE I, BINDING SITE II or BINDING SITE III. Table 2 illustrates the complementarity of the nucleotide sequences of PLA2R1 BINDING SITE, designated SEQ ID:14295, to the nucleotide sequence of VGAM326 RNA, herein designated VGAM RNA, also designated SEQ ID:3037.

Another function of VGAM326 is therefore inhibition of Phospholipase A2 Receptor 1, 180 kDa (PLA2R1, Accession NM_007366). Accordingly, utilities of VGAM326 include diagnosis, prevention and treatment of diseases and clinical conditions associated with PLA2R1. Suppressor of Cytokine Signaling 5 (SOCS5, Accession NM_014011) is another VGAM326 host target gene. SOCS5 BINDING SITE is HOST TARGET binding site found in the 3' untranslated region of mRNA encoded by SOCS5, corresponding to a HOST TARGET binding site such as BINDING SITE I, BINDING SITE II or BINDING SITE III. Table 2 illustrates the complementarity of the nucleotide sequences of SOCS5 BINDING SITE, designated SEQ ID:15225, to the nucleotide sequence of VGAM326 RNA, herein designated VGAM RNA, also designated SEQ ID:3037.

Another function of VGAM326 is therefore inhibition of Suppressor of Cytokine Signaling 5 (SOCS5, Accession NM_014011). Accordingly, utilities of VGAM326 include diagnosis, prevention and treatment of diseases and clinical conditions associated with SOCS5. Transcription Factor-like 4 (TCFL4, Accession XM_032817) is another VGAM326 host target gene. TCFL4 BINDING SITE is HOST TARGET binding site found in the 3' untranslated region of mRNA encoded by TCFL4, corresponding to a HOST TARGET binding site such as BINDING SITE I, BINDING SITE II or BINDING SITE III. Table 2 illustrates the complementarity of the nucleotide sequences of TCFL4 BINDING SITE, designated SEQ ID:31769, to the nucleotide sequence of VGAM326 RNA, herein designated VGAM RNA, also designated SEQ ID:3037.

Another function of VGAM326 is therefore inhibition of Transcription Factor-like 4 (TCFL4, Accession XM_032817), a gene which interacts with Mad and represses transcription by recruiting the Sin3A-histone deacetylase corepressor complex. Accordingly, utilities of VGAM326 include diagnosis, prevention and treatment of diseases and clinical conditions associated with TCFL4. The function of TCFL4 and its association with various diseases and clinical conditions, has been established by previous studies, as described hereinabove with reference to VGAM172. Activity-dependent Neuroprotector (ADNP, Accession NM_015339) is another VGAM326 host target gene. ADNP BINDING SITE is HOST TARGET binding site found in the 3' untranslated region of mRNA encoded by ADNP, corresponding to a HOST TARGET binding site such as BIND- ING SITE I, BINDING SITE II or BINDING SITE III. Table 2 illustrates the complementarity of the nucleotide sequences of ADNP BINDING SITE, designated SEQ ID:17647, to the nucleotide sequence of VGAM326 RNA, herein designated VGAM RNA, also designated SEQ ID:3037.

Another function of VGAM326 is therefore inhibition of Activity-dependent Neuroprotector (ADNP, Accession NM_015339). Accordingly, utilities of VGAM326 include diagnosis, prevention and treatment of diseases and clinical conditions associated with ADNP. Ac-like Transposable Element (ALTE, Accession NM_004729) is another VGAM326 host target gene. ALTE BINDING SITE is HOST TARGET binding site found in the 3' untranslated region of mRNA encoded by ALTE, corresponding to a HOST TARGET binding site such as BINDING SITE I, BINDING SITE II or BINDING SITE III. Table 2 illustrates the complementarity of the nucleotide sequences of ALTE BINDING SITE, designated SEQ ID:11105, to the nucleotide sequence of VGAM326 RNA, herein designated VGAM RNA, also designated SEQ ID:3037.

Another function of VGAM326 is therefore inhibition of Ac-like Transposable Element (ALTE, Accession NM_004729). Accordingly, utilities of VGAM326 include diagnosis, prevention and treatment of diseases and clinical conditions associated with ALTE. Centaurin, Alpha 2 (CENTA2, Accession NM_018404) is another VGAM326 host target gene. CENTA2 BINDING SITE is HOST TARGET binding site found in the 3' untranslated region of mRNA encoded by CENTA2, corresponding to a HOST TARGET binding site such as BINDING SITE I, BINDING SITE II or BINDING SITE III. Table 2 illustrates the complementarity of the nucleotide sequences of CENTA2 BINDING SITE, designated SEQ ID:20444, to the nucleotide sequence of VGAM326 RNA, herein designated VGAM RNA, also designated SEQ ID:3037.

Another function of VGAM326 is therefore inhibition of Centaurin, Alpha 2 (CENTA2, Accession NM_018404). Accordingly, utilities of VGAM326 include diagnosis, prevention and treatment of diseases and clinical conditions associated with CENTA2. DKFZP434B172 (Accession XM_046264) is another VGAM326 host target gene. DKFZP434B172 BINDING SITE is HOST TARGET binding site found in the 3' untranslated region of mRNA encoded by DKFZP434B172, corresponding to a HOST TARGET binding site such as BINDING SITE I, BINDING SITE II or BINDING SITE III. Table 2 illustrates the complementarity of the nucleotide sequences of DKFZP434B172 BINDING SITE, designated SEQ ID:34702, to the nucleotide sequence of VGAM326 RNA, herein designated VGAM RNA, also designated SEQ ID:3037.

Another function of VGAM326 is therefore inhibition of DKFZP434B172 (Accession XM_046264). Accordingly, utilities of VGAM326 include diagnosis, prevention and treatment of diseases and clinical conditions associated with DKFZP434B172. DKFZp586G0123 (Accession XM_170914) is another VGAM326 host target gene. DKFZp586G0123 BINDING SITE is HOST TARGET binding site found in the 5' untranslated region of mRNA encoded by DKFZp586G0123, corresponding to a HOST TARGET binding site such as BINDING SITE I, BINDING SITE II or BINDING SITE III. Table 2 illustrates the complementarity of the nucleotide sequences of DKFZp586G0123 BINDING SITE, designated SEQ ID:45693, to the nucleotide sequence of VGAM326 RNA, herein designated VGAM RNA, also designated SEQ ID:3037.

Another function of VGAM326 is therefore inhibition of DKFZp586G0123 (Accession XM_170914). Accordingly, utilities of VGAM326 include diagnosis, prevention and treatment of diseases and clinical conditions associated with DKFZp586G0123. Ecotropic Viral Integration Site 5 (EVI5, Accession NM_005665) is another VGAM326 host target gene. EVI5 BINDING SITE is HOST TARGET binding site found in the 3' untranslated region of mRNA encoded by EVI5, corresponding to a HOST TARGET binding site such as BINDING SITE I, BINDING SITE II or BINDING SITE III. Table 2 illustrates the complementarity of the nucleotide sequences of EVI5 BINDING SITE, designated SEQ ID:12213, to the nucleotide sequence of VGAM326 RNA, herein designated VGAM RNA, also designated SEQ ID:3037.

Another function of VGAM326 is therefore inhibition of Ecotropic Viral Integration Site 5 (EVI5, Accession NM_005665). Accordingly, utilities of VGAM326 include diagnosis, prevention and treatment of diseases and clinical conditions associated with EVI5. FLJ14280 (Accession NM_024886) is another VGAM326 host target gene. FLJ14280 BINDING SITE is HOST TARGET binding site found in the 3' untranslated region of mRNA encoded by FLJ14280, corresponding to a HOST TARGET binding site such as BINDING SITE I, BINDING SITE II or BINDING SITE III. Table 2 illustrates the complementarity of the nucleotide sequences of FLJ14280 BINDING SITE, designated SEQ ID:24340, to the nucleotide sequence of VGAM326 RNA, herein designated VGAM RNA, also designated SEQ ID:3037.

Another function of VGAM326 is therefore inhibition of FLJ14280 (Accession NM_024886). Accordingly, utilities of VGAM326 include diagnosis, prevention and treatment of diseases and clinical conditions associated with FLJ14280. FLJ22127 (Accession NM_022775) is another VGAM326 host target gene. FLJ22127 BINDING SITE is HOST TARGET binding site found in the 3' untranslated region of mRNA encoded by FLJ22127, corresponding to a HOST TARGET binding site such as BINDING SITE I, BINDING SITE II or BINDING SITE III. Table 2 illustrates the complementarity of the nucleotide sequences of FLJ22127 BINDING SITE, designated SEQ ID:23042, to the nucleotide sequence of VGAM326 RNA, herein designated VGAM RNA, also designated SEQ ID:3037.

Another function of VGAM326 is therefore inhibition of FLJ22127 (Accession NM_022775). Accordingly, utilities of VGAM326 include diagnosis, prevention and treatment of diseases and clinical conditions associated with FLJ22127. FLJ30681 (Accession XM_166291) is another VGAM326 host target gene. FLJ30681 BINDING SITE is HOST TARGET binding site found in the 3' untranslated region of mRNA encoded by FLJ30681, corresponding to a HOST TARGET binding site such as BINDING SITE I, BINDING SITE II or BINDING SITE III. Table 2 illustrates the complementarity of the nucleotide sequences of FLJ30681 BINDING SITE, designated SEQ ID:44107, to the nucleotide sequence of VGAM326 RNA, herein designated VGAM RNA, also designated SEQ ID:3037.

Another function of VGAM326 is therefore inhibition of FLJ30681 (Accession XM_166291). Accordingly, utilities of VGAM326 include diagnosis, prevention and treatment of diseases and clinical conditions associated with FLJ30681. KIAA1831 (Accession XM_033366) is another VGAM326 host target gene. KIAA1831 BINDING SITE is HOST TARGET binding site found in the 3' untranslated region of mRNA encoded by KIAA1831, corresponding to a HOST TARGET binding site such as BINDING SITE I, BINDING SITE II or BINDING SITE III. Table 2 illustrates the complementarity of the nucleotide sequences of KIAA1831 BIND- ING SITE, designated SEQ ID:31902, to the nucleotide sequence of VGAM326 RNA, herein designated VGAM RNA, also designated SEQ ID:3037.

Another function of VGAM326 is therefore inhibition of KIAA1831 (Accession XM_033366). Accordingly, utilities of VGAM326 include diagnosis, prevention and treatment of diseases and clinical conditions associated with KIAA1831. KIAA1854 (Accession XM_049884) is another VGAM326 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35534, to the nucleotide sequence of VGAM326 RNA, herein designated VGAM RNA, also designated SEQ ID:3037.

Another function of VGAM326 is therefore inhibition of KIAA1854 (Accession XM_049884). Accordingly, utilities of VGAM326 include diagnosis, prevention and treatment of diseases and clinical conditions associated with KIAA1854. LBP-9 (Accession NM_014553) is another VGAM326 host target gene. LBP-9 BINDING SITE is HOST TARGET binding site found in the 3' untranslated region of mRNA encoded by LBP-9, corresponding to a HOST TARGET binding site such as BINDING SITE I, BINDING SITE II or BINDING SITE III. Table 2 illustrates the complementarity of the nucleotide sequences of LBP-9 BINDING SITE, designated SEQ ID:15875, to the nucleotide sequence of VGAM326 RNA, herein designated VGAM RNA, also designated SEQ ID:3037.

Another function of VGAM326 is therefore inhibition of LBP-9 (Accession NM_014553). Accordingly, utilities of VGAM326 include diagnosis, prevention and treatment of diseases and clinical conditions associated with LBP-9. Microtubule-actin Crosslinking Factor 1 (MACF1, Accession NM_012090) is another VGAM326 host target gene. MACF1 BINDING SITE is HOST TARGET binding site found in the 3' untranslated region of mRNA encoded by MACF1, corresponding to a HOST TARGET binding site such as BINDING SITE I, BINDING SITE II or BINDING SITE III. Table 2 illustrates the complementarity of the nucleotide sequences of MACF1 BINDING SITE, designated SEQ ID:14380, to the nucleotide sequence of VGAM326 RNA, herein designated VGAM RNA, also designated SEQ ID:3037.

Another function of VGAM326 is therefore inhibition of Microtubule-actin Crosslinking Factor 1 (MACF1, Accession NM_012090). Accordingly, utilities of VGAM326 include diagnosis, prevention and treatment of diseases and clinical conditions associated with MACF1. PR Domain Containing 15 (PRDM15, Accession XM_029600) is another VGAM326 host target gene. PRDM15 BINDING SITE is HOST TARGET binding site found in the 3' untranslated region of mRNA encoded by PRDM15, corresponding to a HOST TARGET binding site such as BINDING SITE I, BINDING SITE II or BINDING SITE III. Table 2 illustrates the complementarity of the nucleotide sequences of PRDM15 BINDING SITE, designated SEQ ID:30916, to the nucleotide sequence of VGAM326 RNA, herein designated VGAM RNA, also designated SEQ ID:3037.

Another function of VGAM326 is therefore inhibition of PR Domain Containing 15 (PRDM15, Accession XM_029600). Accordingly, utilities of VGAM326 include diagnosis, prevention and treatment of diseases and clinical conditions associated with PRDM15. PRO1386 (Accession NM_031269) is another VGAM326 host target gene. PRO1386 BINDING SITE is HOST TARGET binding site found in the 5' untranslated region of mRNA encoded by PRO1386, corresponding to a HOST TARGET binding site such as BINDING SITE I, BINDING SITE II or BINDING SITE III. Table 2 illustrates the complementarity of the nucleotide sequences of PRO1386 BINDING SITE, designated SEQ ID:25288, to the nucleotide sequence of VGAM326 RNA, herein designated VGAM RNA, also designated SEQ ID:3037.

Another function of VGAM326 is therefore inhibition of PRO1386 (Accession NM_031269). Accordingly, utilities of VGAM326 include diagnosis, prevention and treatment of diseases and clinical conditions associated with PRO1386. SCDGF-B (Accession NM_025208) is another VGAM326 host target gene. SCDGF-B BINDING SITE1 and SCDGF-B BINDING SITE2 are HOST TARGET binding sites found in untranslated regions of mRNA encoded by SCDGF-B, corresponding to HOST TARGET binding sites such as BINDING SITE I, BINDING SITE II or BINDING SITE III. Table 2 illustrates the complementarity of the nucleotide sequences of SCDGF-B BINDING SITE1 and SCDGF-B BINDING SITE2, designated SEQ ID:24880 and SEQ ID:26982 respectively, to the nucleotide sequence of VGAM326 RNA, herein designated VGAM RNA, also designated SEQ ID:3037.

Another function of VGAM326 is therefore inhibition of SCDGF-B (Accession NM_025208). Accordingly, utilities of VGAM326 include diagnosis, prevention and treatment of diseases and clinical conditions associated with SCDGF-B. TUSP (Accession NM_020245) is another VGAM326 host target gene. TUSP BINDING SITE is HOST TARGET binding site found in the 3' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21522, to the nucleotide sequence of VGAM326 RNA, herein designated VGAM RNA, also designated SEQ ID:3037.

Another function of VGAM326 is therefore inhibition of TUSP (Accession NM_020245). Accordingly, utilities of VGAM326 include diagnosis, prevention and treatment of diseases and clinical conditions associated with TUSP. LOC124222 (Accession XM_058784) is another VGAM326 host target gene. LOC124222 BINDING SITE is HOST TARGET binding site found in the 3' untranslated region of mRNA encoded by LOC124222, corresponding to a HOST TARGET binding site such as BINDING SITE I, BINDING SITE II or BINDING SITE III. Table 2 illustrates the complementarity of the nucleotide sequences of LOC124222 BINDING SITE, designated SEQ ID:36742, to the nucleotide sequence of VGAM326 RNA, herein designated VGAM RNA, also designated SEQ ID:3037.

Another function of VGAM326 is therefore inhibition of LOC124222 (Accession XM_058784). Accordingly, utilities of VGAM326 include diagnosis, prevention and treatment of diseases and clinical conditions associated with LOC124222. LOC139422 (Accession XM_066687) is another VGAM326 host target gene. LOC139422 BINDING SITE is HOST TARGET binding site found in the 5' untranslated region of mRNA encoded by LOC139422, corresponding to a HOST TARGET binding site such as BINDING SITE I, BINDING SITE II or BINDING SITE III. Table 2 illustrates the complementarity of the nucleotide sequences of LOC139422 BINDING SITE, designated SEQ ID:37343, to the nucleotide sequence of VGAM326 RNA, herein designated VGAM RNA, also designated SEQ ID:3037.

Another function of VGAM326 is therefore inhibition of LOC139422 (Accession XM_066687). Accordingly, utilities of VGAM326 include diagnosis, prevention and treatment of diseases and clinical conditions associated with LOC139422.

LOC145871 (Accession XM_096897) is another VGAM326 host target gene. LOC145871 BINDING SITE is HOST TARGET binding site found in the 5' untranslated region of mRNA encoded by LOC145871, corresponding to a HOST TARGET binding site such as BINDING SITE I, BINDING SITE II or BINDING SITE III. Table 2 illustrates the complementarity of the nucleotide sequences of LOC145871 BINDING SITE, designated SEQ ID:40621, to the nucleotide sequence of VGAM326 RNA, herein designated VGAM RNA, also designated SEQ ID:3037.

Another function of VGAM326 is therefore inhibition of LOC145871 (Accession XM_096897). Accordingly, utilities of VGAM326 include diagnosis, prevention and treatment of diseases and clinical conditions associated with LOC145871.

LOC148394 (Accession XM_097460) is another VGAM326 host target gene. LOC148394 BINDING SITE is HOST TARGET binding site found in the 5' untranslated region of mRNA encoded by LOC148394, corresponding to a HOST TARGET binding site such as BINDING SITE I, BINDING SITE II or BINDING SITE III. Table 2 illustrates the complementarity of the nucleotide sequences of LOC148394 BINDING SITE, designated SEQ ID:40881, to the nucleotide sequence of VGAM326 RNA, herein designated VGAM RNA, also designated SEQ ID:3037.

Another function of VGAM326 is therefore inhibition of LOC148394 (Accession XM_097460). Accordingly, utilities of VGAM326 include diagnosis, prevention and treatment of diseases and clinical conditions associated with LOC148394.

LOC148534 (Accession XM_086222) is another VGAM326 host target gene. LOC148534 BINDING SITE is HOST TARGET binding site found in the 3' untranslated region of mRNA encoded by LOC148534, corresponding to a HOST TARGET binding site such as BINDING SITE I, BINDING SITE II or BINDING SITE III. Table 2 illustrates the complementarity of the nucleotide sequences of LOC148534 BINDING SITE, designated SEQ ID:38548, to the nucleotide sequence of VGAM326 RNA, herein designated VGAM RNA, also designated SEQ ID:3037.

Another function of VGAM326 is therefore inhibition of LOC148534 (Accession XM_086222). Accordingly, utilities of VGAM326 include diagnosis, prevention and treatment of diseases and clinical conditions associated with LOC148534.

LOC148697 (Accession XM_086276) is another VGAM326 host target gene. LOC148697 BINDING SITE is HOST TARGET binding site found in the 3' untranslated region of mRNA encoded by LOC148697, corresponding to a HOST TARGET binding site such as BINDING SITE I, BINDING SITE II or BINDING SITE III. Table 2 illustrates the complementarity of the nucleotide sequences of LOC148697 BINDING SITE, designated SEQ ID:38574, to the nucleotide sequence of VGAM326 RNA, herein designated VGAM RNA, also designated SEQ ID:3037.

Another function of VGAM326 is therefore inhibition of LOC148697 (Accession XM_086276). Accordingly, utilities of VGAM326 include diagnosis, prevention and treatment of diseases and clinical conditions associated with LOC148697.

LOC164714 (Accession XM_104657) is another VGAM326 host target gene. LOC164714 BINDING SITE is HOST TARGET binding site found in the 3' untranslated region of mRNA encoded by LOC164714, corresponding to a HOST TARGET binding site such as BINDING SITE I, BINDING SITE II or BINDING SITE III. Table 2 illustrates the complementarity of the nucleotide sequences of LOC164714 BINDING SITE, designated SEQ ID:42179, to the nucleotide sequence of VGAM326 RNA, herein designated VGAM RNA, also designated SEQ ID:3037.

Another function of VGAM326 is therefore inhibition of LOC164714 (Accession XM_104657). Accordingly, utilities of VGAM326 include diagnosis, prevention and treatment of diseases and clinical conditions associated with LOC164714.

LOC199858 (Accession XM_114040) is another VGAM326 host target gene. LOC199858 BINDING SITE is HOST TARGET binding site found in the 3' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42640, to the nucleotide sequence of VGAM326 RNA, herein designated VGAM RNA, also designated SEQ ID:3037.

Another function of VGAM326 is therefore inhibition of LOC199858 (Accession XM_114040). Accordingly, utilities of VGAM326 include diagnosis, prevention and treatment of diseases and clinical conditions associated with LOC199858.

LOC200982 (Accession XM_117305) is another VGAM326 host target gene. LOC200982 BINDING SITE is HOST TARGET binding site found in the 3' untranslated region of mRNA encoded by LOC200982, corresponding to a HOST TARGET binding site such as BINDING SITE I, BINDING SITE II or BINDING SITE III. Table 2 illustrates the complementarity of the nucleotide sequences of LOC200982 BINDING SITE, designated SEQ ID:43377, to the nucleotide sequence of VGAM326 RNA, herein designated VGAM RNA, also designated SEQ ID:3037.

Another function of VGAM326 is therefore inhibition of LOC200982 (Accession XM_117305). Accordingly, utilities of VGAM326 include diagnosis, prevention and treatment of diseases and clinical conditions associated with LOC200982.

LOC255714 (Accession XM_172861) is another VGAM326 host target gene. LOC255714 BINDING SITE is HOST TARGET binding site found in the 5' untranslated region of mRNA encoded by LOC255714, corresponding to a HOST TARGET binding site such as BINDING SITE I, BINDING SITE II or BINDING SITE III. Table 2 illustrates the complementarity of the nucleotide sequences of LOC255714 BINDING SITE, designated SEQ ID:46141, to the nucleotide sequence of VGAM326 RNA, herein designated VGAM RNA, also designated SEQ ID:3037.

Another function of VGAM326 is therefore inhibition of LOC255714 (Accession XM_172861). Accordingly, utilities of VGAM326 include diagnosis, prevention and treatment of diseases and clinical conditions associated with LOC255714.

LOC57228 (Accession NM_020467) is another VGAM326 host target gene. LOC57228 BINDING SITE is HOST TARGET binding site found in the 5' untranslated region of mRNA encoded by LOC57228, corresponding to a HOST TARGET binding site such as BINDING SITE I, BINDING SITE II or BINDING SITE III. Table 2 illustrates the complementarity of the nucleotide sequences of LOC57228 BINDING SITE, designated SEQ ID:21707, to the nucleotide sequence of VGAM326 RNA, herein designated VGAM RNA, also designated SEQ ID:3037.

Another function of VGAM326 is therefore inhibition of LOC57228 (Accession NM_020467). Accordingly, utilities of VGAM326 include diagnosis, prevention and treatment of diseases and clinical conditions associated with LOC57228.

LOC91531 (Accession XM_038998) is another VGAM326 host target gene. LOC91531 BINDING SITE is HOST TARGET binding site found in the 5' untranslated region of mRNA encoded by LOC91531, corresponding to a HOST TARGET binding site such as BINDING SITE I, BINDING SITE II or BINDING SITE III. Table 2 illustrates the complementarity of the nucleotide sequences of LOC91531 BINDING SITE, designated SEQ ID:32973, to the nucleotide sequence of VGAM326 RNA, herein designated VGAM RNA, also designated SEQ ID:3037.

Another function of VGAM326 is therefore inhibition of LOC91531 (Accession XM_038998). Accordingly, utilities of VGAM326 include diagnosis, prevention and treatment of diseases and clinical conditions associated with LOC91531. FIG. 1 further provides a conceptual description of a novel bioinformatically detected viral gene of the present invention, referred to here as Viral Genomic Address Messenger 327 (VGAM327) viral gene, which modulates expression of respective host target genes thereof, the function and utility of which host target genes is known in the art.

VGAM327 is a novel bioinformatically detected regulatory, non protein coding, viral micro RNA (miRNA) gene. The method by which VGAM327 was detected is described hereinabove with reference to FIGS. 1-8.

VGAM327 gene, herein designated VGAM GENE, is a viral gene contained in the genome of Rabbit Fibroma Virus. VGAM327 host target gene, herein designated VGAM HOST TARGET GENE, is a human gene contained in the human genome.

VGAM327 gene encodes a VGAM327 precursor RNA, herein designated VGAM PRECURSOR RNA. Similar to other miRNA genes, and unlike most ordinary genes, VGAM327 precursor RNA does not encode a protein. A nucleotide sequence identical or highly similar to the nucleotide sequence of VGAM327 precursor RNA is designated SEQ ID:313, and is provided hereinbelow with reference to the sequence listing part. Nucleotide sequence SEQ ID:313 is located at position 66535 relative to the genome of Rabbit Fibroma Virus.

VGAM327 precursor RNA folds onto itself, forming VGAM327 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM327 folded precursor RNA into VGAM327 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM327 RNA is designated SEQ ID:3038, and is provided hereinbelow with reference to the sequence listing part.

VGAM327 host target gene, herein designated VGAM HOST TARGET GENE, encodes a corresponding messenger RNA, VGAM327 host target RNA, herein designated VGAM HOST TARGET RNA. VGAM327 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM327 RNA, herein designated VGAM RNA, binds complementarily to one or more host target binding sites located in untranslated regions of VGAM327 host target RNA, herein designated VGAM HOST TARGET RNA. This complementary binding is due to the fact that the nucleotide sequence of VGAM327 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM327 RNA, herein designated VGAM RNA, may have a different number of host target binding sites in untranslated regions of a VGAM327 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM327 RNA, herein designated VGAM RNA, to host target binding sites on VGAM327 host target RNA, herein designated VGAM HOST TARGET RNA, such as BINDING SITE I, BINDING SITE II and BINDING SITE III, inhibits translation of VGAM327 host target RNA into VGAM327 host target protein, herein designated VGAM HOST TARGET PROTEIN. VGAM host target protein is therefore outlined by a broken line.

It is appreciated that VGAM327 host target gene, herein designated VGAM HOST TARGET GENE, in fact represents a plurality of VGAM327 host target genes. The mRNA of each one of this plurality of VGAM327 host target genes comprises one or more host target binding sites, each having a nucleotide sequence which is at least partly complementary to VGAM327 RNA, herein designated VGAM RNA, and which when bound by VGAM327 RNA causes inhibition of translation of respective one or more VGAM327 host target proteins.

It is further appreciated by one skilled in the art that the mode of translational inhibition illustrated by FIG. 1 with specific reference to translational inhibition exerted by VGAM327 gene, herein designated VGAM GENE, on one or more VGAM327 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM327 is inhibition of expression of host target genes, as part of a novel viral mechanism of attacking a host. Accordingly, utilities of VGAM327 include diagnosis, prevention and treatment of viral infection by Rabbit Fibroma Virus. Specific functions, and accordingly utilities, of VGAM327 correlate with, and may be deduced from, the identity of the host target genes which VGAM327 binds and inhibits, and the function of these host target genes, as elaborated hereinbelow.

Nucleotide sequences of the VGAM327 precursor RNA, herein designated VGAM PRECURSOR RNA, and of the 'diced' VGAM327 RNA, herein designated VGAM RNA, and a schematic representation of the secondary folding of VGAM327 folded precursor RNA, herein designated VGAM FOLDED PRECURSOR RNA, of VGAM327 are further described hereinbelow with reference to Table 1.

Nucleotide sequences of host target binding sites, such as BINDING SITE-I, BINDING SITE-II and BINDING SITE-III of FIG. 1, found on VGAM327 host target RNA, and schematic representation of the complementarity of each of these host target binding sites to VGAM327 RNA, herein designated VGAM RNA, are described hereinbelow with reference to Table 2.

As mentioned hereinabove with reference to FIG. 1, a function of VGAM327 gene, herein designated VGAM is inhibition of expression of VGAM327 target genes. It is appreciated that specific functions, and accordingly utilities, of VGAM327 correlate with, and may be deduced from, the identity of the target genes which VGAM327 binds and inhibits, and the function of these target genes, as elaborated hereinbelow.

Endometrial Bleeding Associated Factor (left-right determination, factor A; transforming growth factor beta superfamily) (EBAF, Accession XM_037302) is a VGAM327 host target gene. EBAF BINDING SITE is HOST TARGET binding site found in the 3' untranslated region of mRNA encoded by EBAF, corresponding to a HOST TARGET binding site such as BINDING SITE I, BINDING SITE II or BINDING SITE III. Table 2 illustrates the complementarity of the nucleotide sequences of EBAF BINDING SITE, designated SEQ ID:32609, to the nucleotide sequence of VGAM327 RNA, herein designated VGAM RNA, also designated SEQ ID:3038.

A function of VGAM327 is therefore inhibition of Endometrial Bleeding Associated Factor (left-right determination, factor A; transforming growth factor beta superfamily) (EBAF, Accession XM_037302), a gene which LEFT-RIGHT AXIS MALFORMATIONS. Accordingly, utilities of VGAM327 include diagnosis, prevention and treatment of diseases and clinical conditions associated with EBAF. The function of EBAF and its association with various diseases and clinical conditions, has been established by previous studies, as described hereinabove with reference to VGAM93. N-ethylmaleimide-sensitive Factor Attachment Protein, Beta (NAPB, Accession XM_046652) is another VGAM327 host target gene. NAPB BINDING SITE is HOST TARGET binding site found in the 3' untranslated region of mRNA encoded by NAPB, corresponding to a HOST TARGET binding site such as BINDING SITE I, BINDING SITE II or BINDING SITE III. Table 2 illustrates the complementarity of the nucleotide sequences of NAPB BINDING SITE, designated SEQ ID:34766, to the nucleotide sequence of VGAM327 RNA, herein designated VGAM RNA, also designated SEQ ID:3038.

Another function of VGAM327 is therefore inhibition of N-ethylmaleimide-sensitive Factor Attachment Protein, Beta (NAPB, Accession XM_046652). Accordingly, utilities of VGAM327 include diagnosis, prevention and treatment of diseases and clinical conditions associated with NAPB. Protein Tyrosine Phosphatase, Non-receptor Type 1 (PTPN1, Accession NM_002827) is another VGAM327 host target gene. PTPN1 BINDING SITE is HOST TARGET binding site found in the 3' untranslated region of mRNA encoded by PTPN1, corresponding to a HOST TARGET binding site such as BINDING SITE I, BINDING SITE II or BINDING SITE III. Table 2 illustrates the complementarity of the nucleotide sequences of PTPN1 BINDING SITE, designated SEQ ID:8701, to the nucleotide sequence of VGAM327 RNA, herein designated VGAM RNA, also designated SEQ ID:3038.

Another function of VGAM327 is therefore inhibition of Protein Tyrosine Phosphatase, Non-receptor Type 1 (PTPN1, Accession NM_002827), a gene which is a non-receptor type 1 protein tyrosine phosphatase and inhibits insulin signaling. Accordingly, utilities of VGAM327 include diagnosis, prevention and treatment of diseases and clinical conditions associated with PTPN1. The function of PTPN1 has been established by previous studies. PTP1B inhibits insulin signaling and, when overexpressed, plays a role in insulin resistance (Ahmad et al., 1997). In the 3-prime untranslated region of the PTP1B gene, Di Paola et al. (2002) identified a 1484insG variation (176885.0001) that, in 2 different populations, was associated with several features of insulin resistance. Similar data were obtained in a family-based association study by use of sib pairs discordant for genotype (Gu et al., 2000). Subjects carrying the 1484insG variant showed PTP1B mRNA overexpression in skeletal muscle. PTP1B mRNA stability was significantly higher in human embryonic kidney cells transfected with 1484insG PTP1B as compared with those transfected with wildtype PTP1B. The data indicated that the 1484insG allele causes PTP1B overexpression and plays a role in insulin resistance. Therefore, individuals carrying the 1484insG variant might particularly benefit from PTP1B inhibitors in the treatment of insulin resistance (Kennedy and Ramachandran, 2000). Animal model experiments lend further support to the function of PTPN1. Elchebly et al. (1999) generated PTP1B-deficient mice by targeted disruption of the mouse homolog of the PTP1B gene. Mice were phenotypically and pathologically normal and had normal life span. In the fed state, homozygous mutant mice had slightly lower blood glucose concentrations, and half the circulating insulin concentrations, of wildtype littermates. The enhanced insulin sensitivity of PTP1B-deficient mice was also evident in glucose- and insulin-tolerance tests. After insulin injection, deficient mice showed increased phosphorylation of the insulin receptor in liver and muscle tissue compared to wildtype mice. On a high-fat diet, PTP1B-deficient mice were resistant to weight gain and remained insulin sensitive, while wildtype mice rapidly gained weight and became insulin resistant. These results suggested a major role for PTP1B in modulation of insulin sensitivity and fuel metabolism. The authors proposed PTP1B as a potential therapeutic target for the treatment of type 2 diabetes and obesity.

It is appreciated that the abovementioned animal model for PTPN1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Elchebly, M.; Payette, P.; Michaliszyn, E.; Cromlish, W.; Collins, S.; Loy, A. L.; Normandin, D.; Cheng, A.; Himms-Hagen, J.; Chan, C.-C.; Ramachandran, C.; Gresser, M. J.; Tremblay, M. L.; Kennedy, B. P.: Increased insulin sensitivity and obesity resistance in mice lacking the protein tyrosine phosphatase-1B gene. Science 283:1544-1548, 1999; and Di Paola, R.; Frittitta, L.; Miscio, G.; Bozzali, M.; Baratta, R.; Centra, M.; Spampinato, D.; Santagati, M. G.; Ercolino, T.; Cisternino, C.; Soccio, T. Mastroianno, S.; Tassi, V.; Alm.

Further studies establishing the function and utilities of PTPN1 are found in John Hopkins OMIM database record ID 176885, and in sited publications numbered 10896-10899, 10698-10575, 10890, 1057 and 10579 listed in the bibliography section hereinbelow, which are also hereby incorporated by reference. KIAA0960 (Accession XM_166543) is another VGAM327 host target gene. KIAA0960 BINDING SITE is HOST TARGET binding site found in the 3' untranslated region of mRNA encoded by KIAA0960, corresponding to a HOST TARGET binding site such as BINDING SITE I, BINDING SITE II or BINDING SITE III. Table 2 illustrates the complementarity of the nucleotide sequences of KIAA0960 BINDING SITE, designated SEQ ID:44514, to the nucleotide sequence of VGAM327 RNA, herein designated VGAM RNA, also designated SEQ ID:3038.

Another function of VGAM327 is therefore inhibition of KIAA0960 (Accession XM_166543). Accordingly, utilities of VGAM327 include diagnosis, prevention and treatment of diseases and clinical conditions associated with KIAA0960. LOC158187 (Accession XM_098892) is another VGAM327 host target gene. LOC158187 BINDING SITE is HOST TARGET binding site found in the 3' untranslated region of mRNA encoded by LOC158187, corresponding to a HOST TARGET binding site such as BINDING SITE I, BINDING SITE II or BINDING SITE III. Table 2 illustrates the complementarity of the nucleotide sequences of LOC158187 BINDING SITE, designated SEQ ID:41920, to the nucleotide sequence of VGAM327 RNA, herein designated VGAM RNA, also designated SEQ ID:3038.

Another function of VGAM327 is therefore inhibition of LOC158187 (Accession XM_098892). Accordingly, utilities of VGAM327 include diagnosis, prevention and treatment of diseases and clinical conditions associated with LOC158187. LOC90620 (Accession XM_032986) is another VGAM327 host target gene. LOC90620 BINDING SITE is HOST TARGET binding site found in the 5' untranslated region of mRNA encoded by LOC90620, corresponding to a HOST TARGET binding site such as BINDING SITE I, BINDING SITE II or BINDING SITE III. Table 2 illustrates the complementarity of the nucleotide sequences of LOC90620 BINDING SITE, designated SEQ ID:31805, to the nucleotide sequence of VGAM327 RNA, herein designated VGAM RNA, also designated SEQ ID:3038.

Another function of VGAM327 is therefore inhibition of LOC90620 (Accession XM_032986). Accordingly, utilities of VGAM327 include diagnosis, prevention and treatment of diseases and clinical conditions associated with LOC90620. FIG. 1 further provides a conceptual description of a novel bioinformatically detected viral gene of the present invention, referred to here as Viral Genomic Address Messenger 328 (VGAM328) viral gene, which modulates expression of respective host target genes thereof, the function and utility of which host target genes is known in the art.

VGAM328 is a novel bioinformatically detected regulatory, non protein coding, viral micro RNA (miRNA) gene. The method by which VGAM328 was detected is described hereinabove with reference to FIGS. 1-8.

VGAM328 gene, herein designated VGAM GENE, is a viral gene contained in the genome of Rabbit Fibroma Virus. VGAM328 host target gene, herein designated VGAM HOST TARGET GENE, is a human gene contained in the human genome.

VGAM328 gene encodes a VGAM328 precursor RNA, herein designated VGAM PRECURSOR RNA. Similar to other miRNA genes, and unlike most ordinary genes, VGAM328 precursor RNA does not encode a protein. A nucleotide sequence identical or highly similar to the nucleotide sequence of VGAM328 precursor RNA is designated SEQ ID:314, and is provided hereinbelow with reference to the sequence listing part. Nucleotide sequence SEQ ID:314 is located at position 68066 relative to the genome of Rabbit Fibroma Virus.

VGAM328 precursor RNA folds onto itself, forming VGAM328 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM328 folded precursor RNA into VGAM328 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM328 RNA is designated SEQ ID:3039, and is provided hereinbelow with reference to the sequence listing part.

VGAM328 host target gene, herein designated VGAM HOST TARGET GENE, encodes a corresponding messenger RNA, VGAM328 host target RNA, herein designated VGAM HOST TARGET RNA. VGAM328 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM328 RNA, herein designated VGAM RNA, binds complementarily to one or more host target binding sites located in untranslated regions of VGAM328 host target RNA, herein designated VGAM HOST TARGET RNA. This complementary binding is due to the fact that the nucleotide sequence of VGAM328 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM328 RNA, herein designated VGAM RNA, may have a different number of host target binding sites in untranslated regions of a VGAM328 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM328 RNA, herein designated VGAM RNA, to host target binding sites on VGAM328 host target RNA, herein designated VGAM HOST TARGET RNA, such as BINDING SITE I, BINDING SITE II and BINDING SITE III, inhibits translation of VGAM328 host target RNA into VGAM328 host target protein, herein designated VGAM HOST TARGET PROTEIN. VGAM host target protein is therefore outlined by a broken line.

It is appreciated that VGAM328 host target gene, herein designated VGAM HOST TARGET GENE, in fact represents a plurality of VGAM328 host target genes. The mRNA of each one of this plurality of VGAM328 host target genes comprises one or more host target binding sites, each having a nucleotide sequence which is at least partly complementary to VGAM328 RNA, herein designated VGAM RNA, and which when bound by VGAM328 RNA causes inhibition of translation of respective one or more VGAM328 host target proteins.

It is further appreciated by one skilled in the art that the mode of translational inhibition illustrated by FIG. 1 with specific reference to translational inhibition exerted by VGAM328 gene, herein designated VGAM GENE, on one or more VGAM328 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM328 is inhibition of expression of host target genes, as part of a novel viral mechanism of attacking a host. Accordingly, utilities of VGAM328 include diagnosis, prevention and treatment of viral infection by Rabbit Fibroma Virus. Specific functions, and accordingly utilities, of VGAM328 correlate with, and may be deduced from, the identity of the host target genes which VGAM328 binds and inhibits, and the function of these host target genes, as elaborated hereinbelow.

Nucleotide sequences of the VGAM328 precursor RNA, herein designated VGAM PRECURSOR RNA, and of the 'diced' VGAM328 RNA, herein designated VGAM RNA, and a schematic representation of the secondary folding of VGAM328 folded precursor RNA, herein designated VGAM FOLDED PRECURSOR RNA, of VGAM328 are further described hereinbelow with reference to Table 1.

Nucleotide sequences of host target binding sites, such as BINDING SITE-I, BINDING SITE-II and BINDING SITE-III of FIG. 1, found on VGAM328 host target RNA, and schematic representation of the complementarity of each of these host target binding sites to VGAM328 RNA, herein designated VGAM RNA, are described hereinbelow with reference to Table 2.

As mentioned hereinabove with reference to FIG. 1, a function of VGAM328 gene, herein designated VGAM is inhibition of expression of VGAM328 target genes. It is appreciated that specific functions, and accordingly utilities, of VGAM328 correlate with, and may be deduced from, the identity of the target genes which VGAM328 binds and inhibits, and the function of these target genes, as elaborated hereinbelow.

Chemokine (C-X3-C motif) Receptor 1 (CX3CR1, Accession XM_047502) is a VGAM328 host target gene. CX3CR1 BINDING SITE is HOST TARGET binding site found in the 3' untranslated region of mRNA encoded by CX3CR1, corresponding to a HOST TARGET binding site such as BINDING SITE I, BINDING SITE II or BINDING SITE III. Table 2 illustrates the complementarity of the nucleotide sequences of CX3CR1 BINDING SITE, designated SEQ ID:34973, to the nucleotide sequence of VGAM328 RNA, herein designated VGAM RNA, also designated SEQ ID:3039.

A function of VGAM328 is therefore inhibition of Chemokine (C-X3-C motif) Receptor 1 (CX3CR1, Accession XM_047502), a gene which mediates both the adhesive and migratory functions of fractalkine. Accordingly, utilities of VGAM328 include diagnosis, prevention and treatment of diseases and clinical conditions associated with CX3CR1. The function of CX3CR1 and its association with various diseases and clinical conditions, has been established by previous studies, as described hereinabove with reference to VGAM25. Endoglin (Osler-Rendu-Weber syndrome 1) (ENG, Accession NM_000118) is another VGAM328 host target gene. ENG BINDING SITE is HOST TARGET binding site found in the 5' untranslated region of mRNA encoded by ENG, corresponding to a HOST TARGET binding site such as BINDING SITE I, BINDING SITE II or BINDING SITE III. Table 2 illustrates the complementarity of the nucleotide sequences of ENG BINDING SITE, designated SEQ ID:5589, to the nucleotide sequence of VGAM328 RNA, herein designated VGAM RNA, also designated SEQ ID:3039.

Another function of VGAM328 is therefore inhibition of Endoglin (Osler-Rendu-Weber syndrome 1) (ENG, Accession NM_000118). Accordingly, utilities of VGAM328 include diagnosis, prevention and treatment of diseases and clinical conditions associated with ENG. Myeloid/lymphoid Or Mixed-lineage Leukemia (trithorax homolog, Drosophila); Translocated To, 3 (MLLT3, Accession NM_004529) is another VGAM328 host target gene. MLLT3 BINDING SITE is HOST TARGET binding site found in the 3' untranslated region of mRNA encoded by MLLT3, corresponding to a HOST TARGET binding site such as BINDING SITE I, BINDING SITE II or BINDING SITE III. Table 2 illustrates the complementarity of the nucleotide sequences of MLLT3 BINDING SITE, designated SEQ ID:10866, to the nucleotide sequence of VGAM328 RNA, herein designated VGAM RNA, also designated SEQ ID:3039.

Another function of VGAM328 is therefore inhibition of Myeloid/lymphoid Or Mixed-lineage Leukemia (trithorax homolog, Drosophila); Translocated To, 3 (MLLT3, Accession NM_004529), a gene which is Serine and proline rich protein. Accordingly, utilities of VGAM328 include diagnosis, prevention and treatment of diseases and clinical conditions associated with MLLT3. The function of MLLT3 and its association with various diseases and clinical conditions, has been established by previous studies, as described hereinabove with reference to VGAM67. Transforming Growth Factor, Alpha (TGFA, Accession NM_003236) is another VGAM328 host target gene. TGFA BINDING SITE is HOST TARGET binding site found in the 3' untranslated region of mRNA encoded by TGFA, corresponding to a HOST TARGET binding site such as BINDING SITE I, BINDING SITE II or BINDING SITE III. Table 2 illustrates the complementarity of the nucleotide sequences of TGFA BINDING SITE, designated SEQ ID:9230, to the nucleotide sequence of VGAM328 RNA, herein designated VGAM RNA, also designated SEQ ID:3039.

Another function of VGAM328 is therefore inhibition of Transforming Growth Factor, Alpha (TGFA, Accession NM_003236), a gene which is able to bind to the egf receptor and to act synergistically with tgf beta to promote anchorage-independent cell proliferation in soft agar. Accordingly, utilities of VGAM328 include diagnosis, prevention and treatment of diseases and clinical conditions associated with TGFA. The function of TGFA has been established by previous studies. Ellis et al. (1987) presented evidence that TGFA plays a role in certain paraneoplastic manifestations of melanoma: the sign of Leser-Trelat (the sudden appearance of, or increase in the number and size of, seborrheic keratoses), acanthosis nigricans, and eruptive acrochordons (sudden onset of multiple skin tags). Fernandez-Larrea et al. (1999) used the 2-hybrid screen to identify pro-TGF-alpha cytoplasmic domain-binding proteins, which they referred to as TACIPs (pro-TGF-alpha cytoplasmic domain-interacting proteins), involved in the trafficking of pro-TGF-alpha. They cloned 2 such proteins, which they designated TACIP1 (OMIM Ref. No. 601017) and TACIP18 (OMIM Ref. No. 602217). The circadian clock in the suprachiasmatic nucleus is thought to drive daily rhythms of behavior by secreting factors that act locally within the hypothalamus. In a systematic screen, Kramer et al. (2001) identified TGFA as a likely suprachiasmatic nucleus inhibitor of locomotion. TGFA is expressed rhythmically in the suprachiasmatic nucleus, and when infused into the third ventricle it reversibly inhibited locomotor activity and disrupted circadian sleep-wake cycles. These actions were mediated by EGF receptors on neurons in the hypothalamic subparaventricular zone. Mice with a hypomorphic EGF receptor mutation exhibited excessive daytime locomotor activity and failed to suppress activity when exposed to light. Kramer et al. (2001) concluded that their results implicate EGF receptor signaling in the daily control of locomotor activity. They identified a neural circuit in the hypothalamus that likely mediates the regulation of behavior both by the suprachiasmatic nucleus and the retina using TGFA and EGF receptors in the retinohypothalamic tract.

Full details of the abovementioned studies are described in the following publications, the disclosure of which are hereby incorporated by reference:

Fernandez-Larrea, J.; Merlos-Suarez, A.; Urena, J. M.; Baselga, J.; Arribas, J.: A role for a PDZ protein in the early secretory pathway for the targeting of proTGF-alpha to the cell surface. Molec. Cell 3:423-433, 1999; and Kramer, A.; Yang, F.-C.; Snodgrass, P.; Li, X.; Scammell, T. E.; Davis, F. C.; Weitz, C. J.: Regulation of daily locomotor activity and sleep by hypothalamic EGF receptor signaling. S.

Further studies establishing the function and utilities of TGFA are found in John Hopkins OMIM database record ID 190170, and in sited publications numbered 2705-2709, 37 and 2710-2712 listed in the bibliography section hereinbelow, which are also hereby incorporated by reference. FLJ10388 (Accession NM_018082) is another VGAM328 host target gene. FLJ10388 BINDING SITE is HOST TARGET binding site found in the 3' untranslated region of mRNA encoded by FLJ10388, corresponding to a HOST TARGET binding site such as BINDING SITE I, BINDING SITE II or BINDING SITE III. Table 2 illustrates the complementarity of the nucleotide sequences of FLJ10388 BINDING SITE, designated SEQ ID:19841, to the nucleotide sequence of VGAM328 RNA, herein designated VGAM RNA, also designated SEQ ID:3039.

Another function of VGAM328 is therefore inhibition of FLJ10388 (Accession NM_018082). Accordingly, utilities of VGAM328 include diagnosis, prevention and treatment of diseases and clinical conditions associated with FLJ10388. HT002 (Accession NM_014066) is another VGAM328 host target gene. HT002 BINDING SITE is HOST TARGET binding site found in the 3' untranslated region of mRNA encoded by HT002, corresponding to a HOST TARGET binding site such as BINDING SITE I, BINDING SITE II or BINDING SITE III. Table 2 illustrates the complementarity of the nucleotide sequences of HT002 BINDING SITE, designated SEQ ID:15278, to the nucleotide sequence of VGAM328 RNA, herein designated VGAM RNA, also designated SEQ ID:3039.

Another function of VGAM328 is therefore inhibition of HT002 (Accession NM_014066). Accordingly, utilities of VGAM328 include diagnosis, prevention and treatment of diseases and clinical conditions associated with HT002. KIAA1831 (Accession XM_033366) is another VGAM328 host target gene. KIAA1831 BINDING SITE is HOST TARGET binding site found in the 3' untranslated region of mRNA encoded by KIAA1831, corresponding to a HOST TARGET binding site such as BINDING SITE I, BINDING SITE II or BINDING SITE III. Table 2 illustrates the complementarity of the nucleotide sequences of KIAA1831 BINDING SITE, designated SEQ ID:31901, to the nucleotide sequence of VGAM328 RNA, herein designated VGAM RNA, also designated SEQ ID:3039.

Another function of VGAM328 is therefore inhibition of KIAA1831 (Accession XM_033366). Accordingly, utilities of VGAM328 include diagnosis, prevention and treatment of diseases and clinical conditions associated with KIAA1831. MGC3251 (Accession NM_032016) is another VGAM328 host target gene. MGC3251 BINDING SITE is HOST TARGET binding site found in the 3' untranslated region of mRNA encoded by MGC3251, corresponding to a HOST TARGET binding site such as BINDING SITE I, BINDING SITE II or BINDING SITE III. Table 2 illustrates the complementarity of the nucleotide sequences of MGC3251 BINDING SITE, designated SEQ ID:25730, to the nucleotide sequence of VGAM328 RNA, herein designated VGAM RNA, also designated SEQ ID:3039.

Another function of VGAM328 is therefore inhibition of MGC3251 (Accession NM_032016). Accordingly, utilities of VGAM328 include diagnosis, prevention and treatment of diseases and clinical conditions associated with MGC3251. LOC149134 (Accession XM_097594) is another VGAM328 host target gene. LOC149134 BINDING SITE is HOST TARGET binding site found in the 5' untranslated region of mRNA encoded by LOC149134, corresponding to a HOST TARGET binding site such as BINDING SITE I, BINDING SITE II or BINDING SITE III. Table 2 illustrates the complementarity of the nucleotide sequences of LOC149134 BINDING SITE, designated SEQ ID:40956, to the nucleotide sequence of VGAM328 RNA, herein designated VGAM RNA, also designated SEQ ID:3039.

Another function of VGAM328 is therefore inhibition of LOC149134 (Accession XM_097594). Accordingly, utilities of VGAM328 include diagnosis, prevention and treatment of diseases and clinical conditions associated with LOC149134. LOC220074 (Accession NM_145309) is another VGAM328 host target gene. LOC220074 BINDING SITE is HOST TARGET binding site found in the 3' untranslated region of mRNA encoded by LOC220074, corresponding to a HOST TARGET binding site such as BINDING SITE I, BINDING SITE II or BINDING SITE III. Table 2 illustrates the complementarity of the nucleotide sequences of LOC220074 BINDING SITE, designated SEQ ID:29824, to the nucleotide sequence of VGAM328 RNA, herein designated VGAM RNA, also designated SEQ ID:3039.

Another function of VGAM328 is therefore inhibition of LOC220074 (Accession NM_145309). Accordingly, utilities of VGAM328 include diagnosis, prevention and treatment of diseases and clinical conditions associated with LOC220074. FIG. 1 further provides a conceptual description of a novel bioinformatically detected viral gene of the present invention, referred to here as Viral Genomic Address Messenger 329 (VGAM329) viral gene, which modulates expression of respective host target genes thereof, the function and utility of which host target genes is known in the art.

VGAM329 is a novel bioinformatically detected regulatory, non protein coding, viral micro RNA (miRNA) gene. The method by which VGAM329 was detected is described hereinabove with reference to FIGS. 1-8.

VGAM329 gene, herein designated VGAM GENE, is a viral gene contained in the genome of Rabbit Fibroma Virus. VGAM329 host target gene, herein designated VGAM HOST TARGET GENE, is a human gene contained in the human genome.

VGAM329 gene encodes a VGAM329 precursor RNA, herein designated VGAM PRECURSOR RNA. Similar to other miRNA genes, and unlike most ordinary genes, VGAM329 precursor RNA does not encode a protein. A nucleotide sequence identical or highly similar to the nucleotide sequence of VGAM329 precursor RNA is designated SEQ ID:315, and is provided hereinbelow with reference to the sequence listing part. Nucleotide sequence SEQ ID:315 is located at position 76498 relative to the genome of Rabbit Fibroma Virus.

VGAM329 precursor RNA folds onto itself, forming VGAM329 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM329 folded precursor RNA into VGAM329 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM329 RNA is designated SEQ ID:3040, and is provided hereinbelow with reference to the sequence listing part.

VGAM329 host target gene, herein designated VGAM HOST TARGET GENE, encodes a corresponding messenger RNA, VGAM329 host target RNA, herein designated VGAM HOST TARGET RNA. VGAM329 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM329 RNA, herein designated VGAM RNA, binds complementarily to one or more host target binding sites located in untranslated regions of VGAM329 host target RNA, herein designated VGAM HOST TARGET RNA. This complementary binding is due to the fact that the nucleotide sequence of VGAM329 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM329 RNA, herein designated VGAM RNA, may have a different number of host target binding sites in untranslated regions of a VGAM329 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM329 RNA, herein designated VGAM RNA, to host target binding sites on VGAM329 host target RNA, herein designated VGAM HOST TARGET RNA, such as BINDING SITE I, BINDING SITE II and BINDING SITE III, inhibits translation of VGAM329 host target RNA into VGAM329 host target protein, herein designated VGAM HOST TARGET PROTEIN. VGAM host target protein is therefore outlined by a broken line.

It is appreciated that VGAM329 host target gene, herein designated VGAM HOST TARGET GENE, in fact represents a plurality of VGAM329 host target genes. The mRNA of each one of this plurality of VGAM329 host target genes comprises one or more host target binding sites, each having a nucleotide sequence which is at least partly complementary to VGAM329 RNA, herein designated VGAM RNA, and which when bound by VGAM329 RNA causes inhibition of translation of respective one or more VGAM329 host target proteins.

It is further appreciated by one skilled in the art that the mode of translational inhibition illustrated by FIG. 1 with specific reference to translational inhibition exerted by VGAM329 gene, herein designated VGAM GENE, on one or more VGAM329 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM329 is inhibition of expression of host target genes, as part of a novel viral mechanism of attacking a host. Accordingly, utilities of VGAM329 include diagnosis, prevention and treatment of viral infection by Rabbit Fibroma Virus. Specific functions, and accordingly utilities, of VGAM329 correlate with, and may be deduced from, the identity of the host target genes which VGAM329 binds and inhibits, and the function of these host target genes, as elaborated hereinbelow.

Nucleotide sequences of the VGAM329 precursor RNA, herein designated VGAM PRECURSOR RNA, and of the 'diced' VGAM329 RNA, herein designated VGAM RNA, and a schematic representation of the secondary folding of VGAM329 folded precursor RNA, herein designated VGAM FOLDED PRECURSOR RNA, of VGAM329 are further described hereinbelow with reference to Table 1.

Nucleotide sequences of host target binding sites, such as BINDING SITE-I, BINDING SITE-II and BINDING SITE-III of FIG. 1, found on VGAM329 host target RNA, and schematic representation of the complementarity of each of these host target binding sites to VGAM329 RNA, herein designated VGAM RNA, are described hereinbelow with reference to Table 2.

As mentioned hereinabove with reference to FIG. 1, a function of VGAM329 gene, herein designated VGAM is inhibition of expression of VGAM329 target genes. It is appreciated that specific functions, and accordingly utilities, of VGAM329 correlate with, and may be deduced from, the identity of the target genes which VGAM329 binds and inhibits, and the function of these target genes, as elaborated hereinbelow.

Adaptor-related Protein Complex 1, Gamma 1 Subunit (AP1G1, Accession NM_001128) is a VGAM329 host target gene. AP1G1 BINDING SITE is HOST TARGET binding site found in the 3' untranslated region of mRNA encoded by AP1G1, corresponding to a HOST TARGET binding site such as BINDING SITE I, BINDING SITE II or BINDING SITE III. Table 2 illustrates the complementarity of the nucleotide sequences of AP1G1 BINDING SITE, designated SEQ ID:6802, to the nucleotide sequence of VGAM329 RNA, herein designated VGAM RNA, also designated SEQ ID:3040.

A function of VGAM329 is therefore inhibition of Adaptor-related Protein Complex 1, Gamma 1 Subunit (AP1G1, Accession NM_001128), a gene which promotes the formation of clathrin-coated pits and vesicles. Accordingly, utilities of VGAM329 include diagnosis, prevention and treatment of diseases and clinical conditions associated with AP1G1. The function of AP1G1 and its association with various diseases and clinical conditions, has been established by previous studies, as described hereinabove with reference to VGAM316. B-cell CLL/lymphoma 11B (zinc finger protein) (BCL11B, Accession NM_022898) is another VGAM329 host target gene. BCL11B BINDING SITE is HOST TARGET binding site found in the 3' untranslated region of mRNA encoded by BCL11B, corresponding to a HOST TARGET binding site such as BINDING SITE I, BINDING SITE II or BINDING SITE III. Table 2 illustrates the complementarity of the nucleotide sequences of BCL11B BINDING SITE, designated SEQ ID:23170, to the nucleotide sequence of VGAM329 RNA, herein designated VGAM RNA, also designated SEQ ID:3040.

Another function of VGAM329 is therefore inhibition of B-cell CLL/lymphoma 11B (zinc finger protein) (BCL11B, Accession NM_022898). Accordingly, utilities of VGAM329 include diagnosis, prevention and treatment of diseases and clinical conditions associated with BCL11B. Calcium Channel, Voltage-dependent, L Type, Alpha 1C Subunit (CACNA1C, Accession NM_000719) is another VGAM329 host target gene. CACNA1C BINDING SITE is HOST TARGET binding site found in the 3' untranslated region of mRNA encoded by CACNA1C, corresponding to a HOST TARGET binding site such as BINDING SITE I, BINDING SITE II or BINDING SITE III. Table 2 illustrates the complementarity of the nucleotide sequences of CACNA1C BINDING SITE, designated SEQ ID:6382, to the nucleotide sequence of VGAM329 RNA, herein designated VGAM RNA, also designated SEQ ID:3040.

Another function of VGAM329 is therefore inhibition of Calcium Channel, Voltage-dependent, L Type, Alpha 1C Subunit (CACNA1C, Accession NM_000719), a gene which is alpha-1 subunit of DHP-sensitive calcium channels from cardiac muscle and the brain. Accordingly, utilities of VGAM329 include diagnosis, prevention and treatment of diseases and clinical conditions associated with CACNA1C. The function of CACNA1C and its association with various diseases and clinical conditions, has been established by previous studies, as described hereinabove with reference to VGAM182. Centrosomal Protein 2 (CEP2, Accession NM_007186) is another VGAM329 host target gene. CEP2 BINDING SITE is HOST TARGET binding site found in the 5' untranslated region of mRNA encoded by CEP2, corresponding to a HOST TARGET binding site such as BINDING SITE I, BINDING SITE II or BINDING SITE III. Table 2 illustrates the complementarity of the nucleotide sequences of CEP2 BINDING SITE, designated SEQ ID:14044, to the nucleotide sequence of VGAM329 RNA, herein designated VGAM RNA, also designated SEQ ID:3040.

Another function of VGAM329 is therefore inhibition of Centrosomal Protein 2 (CEP2, Accession NM_007186), a gene which interacts with TC10 and CDC42. Accordingly, utilities of VGAM329 include diagnosis, prevention and treatment of diseases and clinical conditions associated with CEP2. The function of CEP2 has been established by previous studies. Using a yeast 2-hybrid screen on a mouse embryo cDNA library with TC10 (OMIM Ref. No. 605857) as the bait, followed by EST database searching, Joberty et al. (1999) identified cDNAs encoding human and mouse BORG1 (CEP2), BORG2 (CEP3; 606133), BORG3 (CEP5), BORG4 (CEP4; 605468), and BORG5 (CEP1). Sequence analysis predicted that the 210-amino acid BORG1 protein contains a CRIB motif followed by a conserved 12-residue BORG homology-1 (BH1) domain in its N terminus; an 11-amino acid BH2 domain in its central region; and a 22-residue BH3 domain in its C terminus. Northern blot analysis detected ubiquitous but variable expression of 1.8- and 2.0-kb BORG1 transcripts, with high levels in heart and low levels in pancreas and liver. By binding analysis, Joberty et al. (1999) confirmed that BORG1 interacts with TC10 and CDC42. Immunofluorescence microscopy demonstrated cytoplasmic expression of BORG1. BORG1 expression caused no dramatic changes in cell shape and a reduced abundance of stress fibers. Coexpression of BORG1 with CDC42 resulted in cells showing a 'porcupine' phenotype characterized by an abundance of actin-filled spikes. By EST database searching with CEP1 as the probe, Hirsch et al. (2001) identified cDNAs encoding several CEPs, including CEP2. They referred to the BH2 and BH3 domains as CI and CII, respectively, and considered the BH1 domain to be part of an extended CRIB motif. Hirsch et al. (2001) proposed that these motifs are potential signaling domains. Fluorescence microscopy demonstrated cytoplasmic and membrane expression of CEP2 in keratinocytes, with notable localization in a perinuclear cytoplasmic compartment Full details of the abovementioned studies are described in the following publications, the disclosure of which are hereby incorporated by reference:

Hirsch, D. S.; Pirone, D. M.; Burbelo, P. D.: A new family of Cdc42 effector proteins, CEPs, function in fibroblast and epithelial cell shape changes. J. Biol. Chem. 276:875-883, 2001; and Joberty, G.; Perlungher, R. R.; Macara, I. G.: The Borgs, a new family of Cdc42 and TC10 GTPase-interacting proteins. Molec. Cell. Biol. 19: 6585-6597, 1999.

Further studies establishing the function and utilities of CEP2 are found in John Hopkins OMIM database record ID 606132, and in sited publications numbered 6641-664 and 6471 listed in the bibliography section hereinbelow, which are also hereby incorporated by reference. Chromodomain Helicase DNA Binding Protein 2 (CHD2, Accession NM_001271) is another VGAM329 host target gene. CHD2 BINDING SITE is HOST TARGET binding site found in the 3' untranslated region of mRNA encoded by CHD2, corresponding to a HOST TARGET binding site such as BINDING SITE I, BINDING SITE II or BINDING SITE III. Table 2 illustrates the complementarity of the nucleotide sequences of CHD2 BINDING SITE, designated SEQ ID:6937, to the nucleotide sequence of VGAM329 RNA, herein designated VGAM RNA, also designated SEQ ID:3040.

Another function of VGAM329 is therefore inhibition of Chromodomain Helicase DNA Binding Protein 2 (CHD2, Accession NM_001271). Accordingly, utilities of VGAM329 include diagnosis, prevention and treatment of diseases and clinical conditions associated with CHD2. Disrupted In Schizophrenia 1 (DISC1, Accession NM_018662) is another VGAM329 host target gene. DISC1 BINDING SITE is HOST TARGET binding site found in the 3' untranslated region of mRNA encoded by DISC1, corresponding to a HOST TARGET binding site such as BINDING SITE I, BINDING SITE II or BINDING SITE III. Table 2 illustrates the complementarity of the nucleotide sequences of DISC1 BINDING SITE, designated SEQ ID:20737, to the nucleotide sequence of VGAM329 RNA, herein designated VGAM RNA, also designated SEQ ID:3040.

Another function of VGAM329 is therefore inhibition of Disrupted In Schizophrenia 1 (DISC1, Accession NM_018662), a gene which has globular N-terminal domain (s) and a helical C-terminal domain. Accordingly, utilities of VGAM329 include diagnosis, prevention and treatment of diseases and clinical conditions associated with DISC1. The function of DISC1 and its association with various diseases and clinical conditions, has been established by previous studies, as described hereinabove with reference to VGAM74. Eukaryotic Translation Initiation Factor 2C, 1 (EIF2C1, Accession NM_012199) is another VGAM329 host target gene. EIF2C1 BINDING SITE is HOST TARGET binding site found in the 3' untranslated region of mRNA encoded by EIF2C1, corresponding to a HOST TARGET binding site such as BINDING SITE I, BINDING SITE II or BINDING SITE III. Table 2 illustrates the complementarity of the nucleotide sequences of EIF2C1 BINDING SITE, designated SEQ ID:14506, to the nucleotide sequence of VGAM329 RNA, herein designated VGAM RNA, also designated SEQ ID:3040.

Another function of VGAM329 is therefore inhibition of Eukaryotic Translation Initiation Factor 2C, 1 (EIF2C1, Accession NM_012199), a gene which plays an important role in the eukaryotic peptide chain initiation process. Accordingly, utilities of VGAM329 include diagnosis, prevention and treatment of diseases and clinical conditions associated with EIF2C1. The function of EIF2C1 and its association with various diseases and clinical conditions, has been established by previous studies, as described hereinabove with reference to VGAM118. Ficolin (collagen/fibrinogen domain containing) 3 (Hakata antigen) (FCN3, Accession NM_003665) is another VGAM329 host target gene. FCN3 BINDING SITE1 and FCN3 BINDING SITE2 are HOST TARGET binding sites found in untranslated regions of mRNA encoded by FCN3, corresponding to HOST TARGET binding sites such as BINDING SITE I, BINDING SITE II or BINDING SITE III. Table 2 illustrates the complementarity of the nucleotide sequences of FCN3 BINDING SITE1 and FCN3 BINDING SITE2, designated SEQ ID:9745 and SEQ ID:9746 respectively, to the nucleotide sequence of VGAM329 RNA, herein designated VGAM RNA, also designated SEQ ID:3040.

Another function of VGAM329 is therefore inhibition of Ficolin (collagen/fibrinogen domain containing) 3 (Hakata antigen) (FCN3, Accession NM_003665). Accordingly, utilities of VGAM329 include diagnosis, prevention and treatment of diseases and clinical conditions associated with FCN3. Matrix Metalloproteinase 14 (membrane-inserted) (MMP14, Accession NM_004995) is another VGAM329 host target gene. MMP14 BINDING SITE is HOST TARGET binding site found in the 3' untranslated region of mRNA encoded by MMP14, corresponding to a HOST TARGET binding site such as BINDING SITE I, BINDING SITE II or BINDING SITE III. Table 2 illustrates the complementarity of the nucleotide sequences of MMP14 BINDING SITE, designated SEQ ID:11436, to the nucleotide sequence of VGAM329 RNA, herein designated VGAM RNA, also designated SEQ ID:3040.

Another function of VGAM329 is therefore inhibition of Matrix Metalloproteinase 14 (membrane-inserted) (MMP14, Accession NM_004995). Accordingly, utilities of VGAM329 include diagnosis, prevention and treatment of diseases and clinical conditions associated with MMP14. Membrane-spanning 4-domains, Subfamily A, Member 4 (MS4A4A, Accession NM_024021) is another VGAM329 host target gene. MS4A4A BINDING SITE is HOST TARGET binding site found in the 3' untranslated region of mRNA encoded by MS4A4A, corresponding to a HOST TARGET binding site such as BINDING SITE I, BINDING SITE II or BINDING SITE III. Table 2 illustrates the complementarity of the nucleotide sequences of MS4A4A BINDING SITE, designated SEQ ID:23450, to the nucleotide sequence of VGAM329 RNA, herein designated VGAM RNA, also designated SEQ ID:3040.

Another function of VGAM329 is therefore inhibition of Membrane-spanning 4-domains, Subfamily A, Member 4 (MS4A4A, Accession NM_024021), a gene which binds to the fc region of immunoglobulins epsilon. high affinity receptor. initiating the allergic response. Accordingly, utilities of VGAM329 include diagnosis, prevention and treatment of diseases and clinical conditions associated with MS4A4A. The function of MS4A4A has been established by previous studies. By EST database searching for homologs of CD20 (MS4A1; 112210), Ishibashi et al. (2001) isolated a cDNA encoding MS4A4A, which they called MS4A4. The deduced 205-amino acid protein has a conserved phosphorylation site at the intracellular loop. Northern blot analysis revealed weak expression in mouse colon and intestine but detected no expression in human tissues. Liang and Tedder (2001) also obtained a cDNA encoding MS4A4A. The predicted 220-amino acid protein is more than 40% identical to its mouse homologs. PCR analysis detected variable expression of MS4A4A in cDNA from multiple hemopoietic cell lines.

Full details of the abovementioned studies are described in the following publications, the disclosure of which are hereby incorporated by reference:

Ishibashi, K.; Suzuki, M.; Sasaki, S.; Imai, M.: Identification of a new multigene four-transmembrane family (MS4A) related to CD20, HTm4 and beta subunit of the high-affinity IgE receptor. Gene 264:87-93, 2001; and Liang, Y.; Tedder, T. F.: Identification of a CD20-, Fc-epsilon-RI-beta-related gene family: sixteen new MS4A family members expressed in human and mouse. Genomics 72:119-127, 2001.

Further studies establishing the function and utilities of MS4A4A are found in John Hopkins OMIM database record ID 606547, and in sited publications numbered 4538-4539 listed in the bibliography section hereinbelow, which are also hereby incorporated by reference. Neogenin Homolog 1 (chicken) (NEO1, Accession NM_002499) is another VGAM329 host target gene. NEO1 BINDING SITE is HOST TARGET binding site found in the 3' untranslated region of mRNA encoded by NEO1, corresponding to a HOST TARGET binding site such as BINDING SITE I, BINDING SITE II or BINDING SITE III. Table 2 illustrates the complementarity of the nucleotide sequences of NEO1 BINDING SITE, designated SEQ ID:8320, to the nucleotide sequence of VGAM329 RNA, herein designated VGAM RNA, also designated SEQ ID:3040.

Another function of VGAM329 is therefore inhibition of Neogenin Homolog 1 (chicken) (NEO1, Accession NM_002499), a gene which regulates the transition of undifferentiated proliferating cells to their differentiated state. Accordingly, utilities of VGAM329 include diagnosis, prevention and treatment of diseases and clinical conditions associated with NEO1. The function of NEO1 has been established by previous studies. Vielmetter et al. (1994) identified a protein with roughly 50% amino acid identity to DCC (OMIM Ref. No. 120470); it showed a dynamic pattern of expression in the developing nervous system and gastrointestinal tract of the chicken. They termed this protein neogenin. Specifically, neogenin was induced in neural cells immediately before cell cycle withdrawal and terminal differentiation. Meyerhardt et al. (1997) cloned the human neogenin gene (symbolized NGN by them) and explored its possible role in cancer. They found cDNAs for 2 alternatively spliced forms of NGN, encoding proteins of 1,461 and 1,408 amino acids. By fluorescence in situ hybridization (FISH) they localized NGN in 15q22, a region infrequently affected by alterations in cancer. NGN transcripts of about 7.5 and 5.5 kb were detected in all adult tissues studied. In contrast to the frequent loss of DCC expression in cancers, no alterations in NGN expression were observed in more than 50 cancers studied, including glioblastoma, medulloblastoma, neuroblastoma, colorectal, breast, cervical, and pancreatic cancer cell lines, and xenografts. Based on their sequence conservation and similar expression during development, Meyerhardt et al. (1997) concluded that DCC and NGN may have related functions; however, the chromosomal location and ubiquitous expression of NGN in various human tumors suggested it is infrequently altered in cancer. Vielmetter et al. (1997) also cloned and characterized human neogenin, and symbolized the gene NEO1. They mapped NEO1 to 15q22.3-q23 by FISH.

Full details of the abovementioned studies are described in the following publications, the disclosure of which are hereby incorporated by reference:

Meyerhardt, J. A.; Look, A. T.; Bigner, S. H.; Fearon, E. R.: Identification and characterization of neogenin, a DCC-related gene. Oncogene 14:1129-1136, 1997; and Vielmetter, J.; Kayyem, J. F.; Roman, J. M.; Dreyer, W. J.: Neogenin, an avian cell surface protein expressed during terminal neuronal differentiation, is closely related to the human.

Further studies establishing the function and utilities of NEO1 are found in John Hopkins OMIM database record ID 601907, and in sited publications numbered 8889-8891 listed in the bibliography section hereinbelow, which are also hereby incorporated by reference. Promyelocytic Leukemia (PML, Accession NM_033240) is another VGAM329 host target gene. PML BINDING SITE1 and PML BINDING SITE2 are HOST TARGET binding sites found in untranslated regions of mRNA encoded by PML, corresponding to HOST TARGET binding sites such as BINDING SITE I, BINDING SITE II or BINDING SITE III. Table 2 illustrates the complementarity of the nucleotide sequences of PML BINDING SITE1 and PML BINDING SITE2, designated SEQ ID:27081 and SEQ ID:27085 respectively, to the nucleotide sequence of VGAM329 RNA, herein designated VGAM RNA, also designated SEQ ID:3040.

Another function of VGAM329 is therefore inhibition of Promyelocytic Leukemia (PML, Accession NM_033240). Accordingly, utilities of VGAM329 include diagnosis, prevention and treatment of diseases and clinical conditions associated with PML. Signal Transducer and Activator of Transcription 3 (acute-phase response factor) (STAT3, Accession NM_003150) is another VGAM329 host target gene. STAT3 BINDING SITE1 and STAT3 BINDING SITE2 are HOST TARGET binding sites found in untranslated regions of mRNA encoded by STAT3, corresponding to HOST TARGET binding sites such as BINDING SITE I, BINDING SITE II or BINDING SITE III. Table 2 illustrates the complementarity of the nucleotide sequences of STAT3 BINDING SITE1 and STAT3 BINDING SITE2, designated SEQ ID:9122 and SEQ ID:29269 respectively, to the nucleotide sequence of VGAM329 RNA, herein designated VGAM RNA, also designated SEQ ID:3040.

Another function of VGAM329 is therefore inhibition of Signal Transducer and Activator of Transcription 3 (acute-phase response factor) (STAT3, Accession NM_003150), a gene which carries out a dual function: signal transduction and activation of transcription. Accordingly, utilities of VGAM329 include diagnosis, prevention and treatment of diseases and clinical conditions associated with STAT3. The function of STAT3 has been established by previous studies. Akira et al. (1994) purified acute-phase response factor (APRF), also designated STAT3, and cloned the cDNA. At the amino acid level, APRF exhibited 52.5% overall homology with p91, a component of the interferon (IFN)-stimulated gene factor-3 complexes. Also see STAT1 (OMIM Ref. No. 600555). Caldenhoven et al. (1996) reported the cloning of a cDNA encoding a variant of the transcription factor STAT3, designated STAT3-beta, that was isolated by screening an eosinophil cDNA library. Compared to wildtype STAT3, STAT3-beta lacks an internal domain of 50 bp located near the C terminus. This splice product is a naturally occurring isoform of STAT3 and encodes an 80-kD protein. Animal model experiments lend further support to the function of STAT3. Alternative splicing of the STAT3 gene produces 2 isoforms, STAT3-alpha and a dominant-negative variant, STAT3-beta. In STAT3-beta, the 55 C-terminal residues of STAT3-alpha, spanning the intrinsic transactivation domain, are replaced by 7 distinct residues. Yoo et al. (2002) generated Stat3-beta-deficient mice by gene targeting. Despite intact expression and phosphorylation of Stat3-alpha, overall Stat3 activity was impaired in Stat3-beta -/- cells. Global comparison of transcription in Stat3-beta +/+ and Stat3-beta -/- cells revealed stable differences. Stat3-beta-deficient mice exhibited diminished recovery from endotoxic shock and hyperresponsiveness of a subset of endotoxin-inducible genes in liver. The hepatic response to endotoxin in wildtype mice was accompanied by a transient increase in the ratio of Stat3-beta to Stat3-alpha. These findings indicated a critical role for Stat3-beta in the control of systemic inflammation.

It is appreciated that the abovementioned animal model for STAT3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Caldenhoven, E.; van Dijk, T. B.; Solari, R.; Armstrong, J.; Raaijmakers, J. A. M.; Lammers, J.-W. J.; Koenderman, L.; de Groot, R. P.: STAT3-beta, a splice variant of transcription factor STAT3, is a dominant negative regulator of transcription. J. Biol. Chem. 271:13221-13227, 1996; and Yoo, J.-Y.; Huso, D. L.; Nathans, D.; Desiderio, S.: Specific ablation of Stat3-beta distorts the pattern of Stat3-responsive gene expression and impairs recovery from endotoxic shock.

Further studies establishing the function and utilities of STAT3 are found in John Hopkins OMIM database record ID 102582, and in sited publications numbered 2339-2343, 3613, 3381, 360 and 9453 listed in the bibliography section hereinbelow, which are also hereby incorporated by reference. CCCTC-binding Factor (zinc finger protein)-like (CTCFL, Accession XM_092717) is another VGAM329 host target gene. CTCFL BINDING SITE is HOST TARGET binding site found in the 3' untranslated region of mRNA encoded by CTCFL, corresponding to a HOST TARGET binding site such as BINDING SITE I, BINDING SITE II or BINDING SITE III. Table 2 illustrates the complementarity of the nucleotide sequences of CTCFL BINDING SITE, designated SEQ ID:40139, to the nucleotide sequence of VGAM329 RNA, herein designated VGAM RNA, also designated SEQ ID:3040.

Another function of VGAM329 is therefore inhibition of CCCTC-binding Factor (zinc finger protein)-like (CTCFL, Accession XM_092717). Accordingly, utilities of VGAM329 include diagnosis, prevention and treatment of diseases and clinical conditions associated with CTCFL. CYB5-M (Accession XM_170554) is another VGAM329 host target gene. CYB5-M BINDING SITE1 and CYB5-M BINDING SITE2 are HOST TARGET binding sites found in untranslated regions of mRNA encoded by CYB5-M, corresponding to HOST TARGET binding sites such as BINDING SITE I, BINDING SITE II or BINDING SITE III. Table 2 illustrates the complementarity of the nucleotide sequences of CYB5-M BINDING SITE1 and CYB5-M BINDING SITE2, designated SEQ ID:45378 and SEQ ID:24952 respectively, to the nucleotide sequence of VGAM329 RNA, herein designated VGAM RNA, also designated SEQ ID:3040.

Another function of VGAM329 is therefore inhibition of CYB5-M (Accession XM_170554). Accordingly, utilities of VGAM329 include diagnosis, prevention and treatment of diseases and clinical conditions associated with CYB5-M. Dual Specificity Phosphatase 14 (DUSP14, Accession NM_007026) is another VGAM329 host target gene. DUSP14 BINDING SITE is HOST TARGET binding site found in the 3' untranslated region of mRNA encoded by DUSP14, corresponding to a HOST TARGET binding site such as BINDING SITE I, BINDING SITE II or BINDING SITE III. Table 2 illustrates the complementarity of the nucleotide sequences of DUSP14 BINDING SITE, designated SEQ ID:13884, to the nucleotide sequence of VGAM329 RNA, herein designated VGAM RNA, also designated SEQ ID:3040.

Another function of VGAM329 is therefore inhibition of Dual Specificity Phosphatase 14 (DUSP14, Accession NM_007026). Accordingly, utilities of VGAM329 include diagnosis, prevention and treatment of diseases and clinical conditions associated with DUSP14. Epiregulin (EREG, Accession NM_001432) is another VGAM329 host target gene. EREG BINDING SITE is HOST TARGET binding site found in the 3' untranslated region of mRNA encoded by EREG, corresponding to a HOST TARGET binding site such as BINDING SITE I, BINDING SITE II or BINDING SITE III. Table 2 illustrates the complementarity of the nucleotide sequences of EREG BINDING SITE, designated SEQ ID:7157, to the nucleotide sequence of VGAM329 RNA, herein designated VGAM RNA, also designated SEQ ID:3040.

Another function of VGAM329 is therefore inhibition of Epiregulin (EREG, Accession NM_001432). Accordingly, utilities of VGAM329 include diagnosis, prevention and treatment of diseases and clinical conditions associated with EREG. FLJ10276 (Accession NM_018045) is another VGAM329 host target gene. FLJ10276 BINDING SITE is HOST TARGET binding site found in the 3' untranslated region of mRNA encoded by FLJ10276, corresponding to a HOST TARGET binding site such as BINDING SITE I, BINDING SITE II or BINDING SITE III. Table 2 illustrates the complementarity of the nucleotide sequences of FLJ10276 BINDING SITE, designated SEQ ID:19793, to the nucleotide sequence of VGAM329 RNA, herein designated VGAM RNA, also designated SEQ ID:3040.

Another function of VGAM329 is therefore inhibition of FLJ10276 (Accession NM_018045). Accordingly, utilities of VGAM329 include diagnosis, prevention and treatment of diseases and clinical conditions associated with FLJ10276. FLJ10315 (Accession NM_018056) is another VGAM329 host target gene. FLJ10315 BINDING SITE is HOST TARGET binding site found in the 5' untranslated region of mRNA encoded by FLJ10315, corresponding to a HOST TARGET binding site such as BINDING SITE I, BINDING SITE II or BINDING SITE III. Table 2 illustrates the complementarity of the nucleotide sequences of FLJ10315 BINDING SITE, designated SEQ ID:19819, to the nucleotide sequence of VGAM329 RNA, herein designated VGAM RNA, also designated SEQ ID:3040.

Another function of VGAM329 is therefore inhibition of FLJ10315 (Accession NM_018056). Accordingly, utilities of VGAM329 include diagnosis, prevention and treatment of diseases and clinical conditions associated with FLJ10315. FLJ10811 (Accession NM_018228) is another VGAM329 host target gene. FLJ10811 BINDING SITE is HOST TARGET binding site found in the 3' untranslated region of mRNA encoded by FLJ10811, corresponding to a HOST TARGET binding site such as BINDING SITE I, BINDING SITE II or BINDING SITE III. Table 2 illustrates the complementarity of the nucleotide sequences of FLJ10811 BINDING SITE, designated SEQ ID:20166, to the nucleotide sequence of VGAM329 RNA, herein designated VGAM RNA, also designated SEQ ID:3040.

Another function of VGAM329 is therefore inhibition of FLJ10811 (Accession NM_018228). Accordingly, utilities of VGAM329 include diagnosis, prevention and treatment of diseases and clinical conditions associated with FLJ10811. FLJ11336 (Accession NM_018393) is another VGAM329 host target gene. FLJ11336 BINDING SITE is HOST TARGET binding site found in the 5' untranslated region of mRNA encoded by FLJ11336, corresponding to a HOST TARGET binding site such as BINDING SITE I, BINDING SITE II or BINDING SITE III. Table 2 illustrates the complementarity of the nucleotide sequences of FLJ11336 BINDING SITE, designated SEQ ID:20431, to the nucleotide sequence of VGAM329 RNA, herein designated VGAM RNA, also designated SEQ ID:3040.

Another function of VGAM329 is therefore inhibition of FLJ11336 (Accession NM_018393). Accordingly, utilities of VGAM329 include diagnosis, prevention and treatment of diseases and clinical conditions associated with FLJ11336. FLJ21865 (Accession NM_022759) is another VGAM329 host target gene. FLJ21865 BINDING SITE is HOST TARGET binding site found in the 3' untranslated region of mRNA encoded by FLJ21865, corresponding to a HOST TARGET binding site such as BINDING SITE I, BINDING SITE II or BINDING SITE III. Table 2 illustrates the complementarity of the nucleotide sequences of FLJ21865 BINDING SITE, designated SEQ ID:23002, to the nucleotide sequence of VGAM329 RNA, herein designated VGAM RNA, also designated SEQ ID:3040.

Another function of VGAM329 is therefore inhibition of FLJ21865 (Accession NM_022759). Accordingly, utilities of VGAM329 include diagnosis, prevention and treatment of diseases and clinical conditions associated with FLJ21865. FLJ23360 (Accession NM_023076) is another VGAM329 host target gene. FLJ23360 BINDING SITE is HOST TARGET binding site found in the 3' untranslated region of mRNA encoded by FLJ23360, corresponding to a HOST TARGET binding site such as BINDING SITE I, BINDING SITE II or BINDING SITE III. Table 2 illustrates the complementarity of the nucleotide sequences of FLJ23360 BINDING SITE, designated SEQ ID:23335, to the nucleotide sequence of VGAM329 RNA, herein designated VGAM RNA, also designated SEQ ID:3040.

Another function of VGAM329 is therefore inhibition of FLJ23360 (Accession NM_023076). Accordingly, utilities of VGAM329 include diagnosis, prevention and treatment of diseases and clinical conditions associated with FLJ23360. Histidine Triad Nucleotide Binding Protein 3 (HINT3, Accession NM_138571) is another VGAM329 host target gene. HINT3 BINDING SITE is HOST TARGET binding site found in the 3' untranslated region of mRNA encoded by HINT3, corresponding to a HOST TARGET binding site such as BINDING SITE I, BINDING SITE II or BINDING SITE III. Table 2 illustrates the complementarity of the nucleotide sequences of HINT3 BINDING SITE, designated SEQ ID:28879, to the nucleotide sequence of VGAM329 RNA, herein designated VGAM RNA, also designated SEQ ID:3040.

Another function of VGAM329 is therefore inhibition of Histidine Triad Nucleotide Binding Protein 3 (HINT3, Accession NM_138571). Accordingly, utilities of VGAM329 include diagnosis, prevention and treatment of diseases and clinical conditions associated with HINT3. KIAA0630 (Accession XM_114729) is another VGAM329 host target gene. KIAA0630 BINDING SITE is HOST TARGET binding site found in the 5' untranslated region of mRNA encoded by KIAA0630, corresponding to a HOST TARGET binding site such as BINDING SITE I, BINDING SITE II or BINDING SITE III. Table 2 illustrates the complementarity of the nucleotide sequences of KIAA0630 BINDING SITE, designated SEQ ID:43064, to the nucleotide sequence of VGAM329 RNA, herein designated VGAM RNA, also designated SEQ ID:3040.

Another function of VGAM329 is therefore inhibition of KIAA0630 (Accession XM_114729). Accordingly, utilities of VGAM329 include diagnosis, prevention and treatment of diseases and clinical conditions associated with KIAA0630. KIAA0712 (Accession NM_014715) is another VGAM329 host target gene. KIAA0712 BINDING SITE is HOST TARGET binding site found in the 3' untranslated region of mRNA encoded by KIAA0712, corresponding to a HOST TARGET binding site such as BINDING SITE I, BINDING SITE II or BINDING SITE III. Table 2 illustrates the complementarity of the nucleotide sequences of KIAA0712 BINDING SITE, designated SEQ ID:16267, to the nucleotide sequence of VGAM329 RNA, herein designated VGAM RNA, also designated SEQ ID:3040.

Another function of VGAM329 is therefore inhibition of KIAA0712 (Accession NM_014715). Accordingly, utilities of VGAM329 include diagnosis, prevention and treatment of diseases and clinical conditions associated with KIAA0712. KIAA0855 (Accession NM_015003) is another VGAM329 host target gene. KIAA0855 BINDING SITE is HOST TARGET binding site found in the 3' untranslated region of mRNA encoded by KIAA0855, corresponding to a HOST TARGET binding site such as BINDING SITE I, BINDING SITE II or BINDING SITE III. Table 2 illustrates the complementarity of the nucleotide sequences of KIAA0855 BINDING SITE, designated SEQ ID:17373, to the nucleotide sequence of VGAM329 RNA, herein designated VGAM RNA, also designated SEQ ID:3040.

Another function of VGAM329 is therefore inhibition of KIAA0855 (Accession NM_015003). Accordingly, utilities of VGAM329 include diagnosis, prevention and treatment of diseases and clinical conditions associated with KIAA0855. KIAA1001 (Accession NM_014960) is another VGAM329 host target gene. KIAA1001 BINDING SITE is HOST TARGET binding site found in the 3' untranslated region of mRNA encoded by KIAA1001, corresponding to a HOST TARGET binding site such as BINDING SITE I, BINDING SITE II or BINDING SITE III. Table 2 illustrates the complementarity of the nucleotide sequences of KIAA1001 BINDING SITE, designated SEQ ID:17329, to the nucleotide sequence of VGAM329 RNA, herein designated VGAM RNA, also designated SEQ ID:3040.

Another function of VGAM329 is therefore inhibition of KIAA1001 (Accession NM_014960). Accordingly, utilities of VGAM329 include diagnosis, prevention and treatment of diseases and clinical conditions associated with KIAA1001. KIAA1018 (Accession NM_014967) is another VGAM329 host target gene. KIAA1018 BINDING SITE is HOST TARGET binding site found in the 3' untranslated region of mRNA encoded by KIAA1018, corresponding to a HOST TARGET binding site such as BINDING SITE I, BINDING SITE II or BINDING SITE III. Table 2 illustrates the complementarity of the nucleotide sequences of KIAA1018 BINDING SITE, designated SEQ ID:17357, to the nucleotide sequence of VGAM329 RNA, herein designated VGAM RNA, also designated SEQ ID:3040.

Another function of VGAM329 is therefore inhibition of KIAA1018 (Accession NM_014967). Accordingly, utilities of VGAM329 include diagnosis, prevention and treatment of diseases and clinical conditions associated with KIAA1018. KIAA1884 (Accession XM_055539) is another VGAM329 host target gene. KIAA1884 BINDING SITE is HOST TARGET binding site found in the 3' untranslated region of mRNA encoded by KIAA1884, corresponding to a HOST TARGET binding site such as BINDING SITE I, BINDING SITE II or BINDING SITE III. Table 2 illustrates the complementarity of the nucleotide sequences of KIAA1884 BINDING SITE, designated SEQ ID:36298, to the nucleotide sequence of VGAM329 RNA, herein designated VGAM RNA, also designated SEQ ID:3040.

Another function of VGAM329 is therefore inhibition of KIAA1884 (Accession XM_055539). Accordingly, utilities of VGAM329 include diagnosis, prevention and treatment of diseases and clinical conditions associated with KIAA1884. MacGAP (Accession NM_033515) is another VGAM329 host target gene. MacGAP BINDING SITE is HOST TARGET binding site found in the 3' untranslated region of mRNA encoded by MacGAP, corresponding to a HOST TARGET binding site such as BINDING SITE I, BINDING SITE II or BINDING SITE III. Table 2 illustrates the complementarity of the nucleotide sequences of MacGAP BINDING SITE, designated SEQ ID:27292, to the nucleotide sequence of VGAM329 RNA, herein designated VGAM RNA, also designated SEQ ID:3040.

Another function of VGAM329 is therefore inhibition of MacGAP (Accession NM_033515). Accordingly, utilities of VGAM329 include diagnosis, prevention and treatment of diseases and clinical conditions associated with MacGAP. Phosphatidylinositol-4-phosphate 5-kinase, Type I, Gamma (PIP5K1C, Accession XM_047620) is another VGAM329 host target gene. PIP5K1C BINDING SITE is HOST TARGET binding site found in the 3' untranslated region of mRNA encoded by PIP5K1C, corresponding to a HOST TARGET binding site such as BINDING SITE I, BINDING SITE II or BINDING SITE III. Table 2 illustrates the complementarity of the nucleotide sequences of PIP5K1C BINDING SITE, designated SEQ ID:35018, to the nucleotide sequence of VGAM329 RNA, herein designated VGAM RNA, also designated SEQ ID:3040.

Another function of VGAM329 is therefore inhibition of Phosphatidylinositol-4-phosphate 5-kinase, Type I, Gamma (PIP5K1C, Accession XM_047620). Accordingly, utilities of VGAM329 include diagnosis, prevention and treatment of diseases and clinical conditions associated with PIP5K1C. PRO1855 (Accession NM_018509) is another VGAM329 host target gene. PRO1855 BINDING SITE is HOST TARGET binding site found in the 3' untranslated region of mRNA encoded by PRO1855, corresponding to a HOST TARGET binding site such as BINDING SITE I, BINDING SITE II or BINDING SITE III. Table 2 illustrates the complementarity of the nucleotide sequences of PRO1855 BINDING SITE, designated SEQ ID:20577, to the nucleotide sequence of VGAM329 RNA, herein designated VGAM RNA, also designated SEQ ID:3040.

Another function of VGAM329 is therefore inhibition of PRO1855 (Accession NM_018509). Accordingly, utilities of VGAM329 include diagnosis, prevention and treatment of diseases and clinical conditions associated with PRO1855. RPH3A (Accession NM_014954) is another VGAM329 host target gene. RPH3A BINDING SITE is HOST TARGET binding site found in the 3' untranslated region of mRNA encoded by RPH3A, corresponding to a HOST TARGET binding site such as BINDING SITE I, BINDING SITE II or BINDING SITE III. Table 2 illustrates the complementarity of the nucleotide sequences of RPH3A BINDING SITE, designated SEQ ID:17309, to the nucleotide sequence of VGAM329 RNA, herein designated VGAM RNA, also designated SEQ ID:3040.

Another function of VGAM329 is therefore inhibition of RPH3A (Accession NM_014954). Accordingly, utilities of VGAM329 include diagnosis, prevention and treatment of diseases and clinical conditions associated with RPH3A. T-box 19 (TBX19, Accession NM_005149) is another VGAM329 host target gene. TBX19 BINDING SITE is HOST TARGET binding site found in the 3' untranslated region of mRNA encoded by TBX19, corresponding to a HOST TARGET binding site such as BINDING SITE I, BINDING SITE II or BINDING SITE III. Table 2 illustrates the complementarity of the nucleotide sequences of TBX19 BINDING SITE, designated SEQ ID:11625, to the nucleotide sequence of VGAM329 RNA, herein designated VGAM RNA, also designated SEQ ID:3040.

Another function of VGAM329 is therefore inhibition of T-box 19 (TBX19, Accession NM_005149). Accordingly, utilities of VGAM329 include diagnosis, prevention and treatment of diseases and clinical conditions associated with TBX19. Tripartite Motif-containing 4 (TRIM4, Accession NM_033017) is another VGAM329 host target gene. TRIM4 BINDING SITE is HOST TARGET binding site found in the 3' untranslated region of mRNA encoded by TRIM4, corresponding to a HOST TARGET binding site such as BINDING SITE I, BINDING SITE II or BINDING SITE III. Table 2 illustrates the complementarity of the nucleotide sequences of TRIM4 BINDING SITE, designated SEQ ID:26905, to the nucleotide sequence of VGAM329 RNA, herein designated VGAM RNA, also designated SEQ ID:3040.

Another function of VGAM329 is therefore inhibition of Tripartite Motif-containing 4 (TRIM4, Accession NM_033017). Accordingly, utilities of VGAM329 include diagnosis, prevention and treatment of diseases and clinical conditions associated with TRIM4. LOC116228 (Accession XM_057659) is another VGAM329 host target gene. LOC116228 BINDING SITE is HOST TARGET binding site found in the 3' untranslated region of mRNA encoded by LOC116228, corresponding to a HOST TARGET binding site such as BINDING SITE I, BINDING SITE II or BINDING SITE III. Table 2 illustrates the complementarity of the nucleotide sequences of LOC116228 BINDING SITE, designated SEQ ID:36536, to the nucleotide sequence of VGAM329 RNA, herein designated VGAM RNA, also designated SEQ ID:3040.

Another function of VGAM329 is therefore inhibition of LOC116228 (Accession XM_057659). Accordingly, utilities of VGAM329 include diagnosis, prevention and treatment of diseases and clinical conditions associated with LOC116228. LOC134145 (Accession XM_059691) is another VGAM329 host target gene. LOC134145 BINDING SITE is HOST TARGET binding site found in the 3' untranslated region of mRNA encoded by LOC134145, corresponding to a HOST TARGET binding site such as BINDING SITE I, BINDING SITE II or BINDING SITE III. Table 2 illustrates the complementarity of the nucleotide sequences of LOC134145 BINDING SITE, designated SEQ ID:37061, to the nucleotide sequence of VGAM329 RNA, herein designated VGAM RNA, also designated SEQ ID:3040.

Another function of VGAM329 is therefore inhibition of LOC134145 (Accession XM_059691). Accordingly, utilities of VGAM329 include diagnosis, prevention and treatment of diseases and clinical conditions associated with LOC134145. LOC145980 (Accession XM_096914) is another VGAM329 host target gene. LOC145980 BINDING SITE is HOST TARGET binding site found in the 5' untranslated region of mRNA encoded by LOC145980, corresponding to a HOST TARGET binding site such as BINDING SITE I, BINDING SITE II or BINDING SITE III. Table 2 illustrates the complementarity of the nucleotide sequences of LOC145980 BINDING SITE, designated SEQ ID:40649, to the nucleotide sequence of VGAM329 RNA, herein designated VGAM RNA, also designated SEQ ID:3040.

Another function of VGAM329 is therefore inhibition of LOC145980 (Accession XM_096914). Accordingly, utilities of VGAM329 include diagnosis, prevention and treatment of diseases and clinical conditions associated with LOC145980. LOC145988 (Accession XM_085290) is another VGAM329 host target gene. LOC145988 BINDING SITE is HOST TARGET binding site found in the 3' untranslated region of mRNA encoded by LOC145988, corresponding to a HOST TARGET binding site such as BINDING SITE I, BINDING SITE II or BINDING SITE III. Table 2 illustrates the complementarity of the nucleotide sequences of LOC145988 BINDING SITE, designated SEQ ID:38037, to the nucleotide sequence of VGAM329 RNA, herein designated VGAM RNA, also designated SEQ ID:3040.

Another function of VGAM329 is therefore inhibition of LOC145988 (Accession XM_085290). Accordingly, utilities of VGAM329 include diagnosis, prevention and treatment of diseases and clinical conditions associated with LOC145988. LOC146901 (Accession XM_097121) is another VGAM329 host target gene. LOC146901 BINDING SITE is HOST TARGET binding site found in the 3' untranslated region of mRNA encoded by LOC146901, corresponding to a HOST TARGET binding site such as BINDING SITE I, BINDING SITE II or BINDING SITE III. Table 2 illustrates the complementarity of the nucleotide sequences of LOC146901 BINDING SITE, designated SEQ ID:40763, to the nucleotide sequence of VGAM329 RNA, herein designated VGAM RNA, also designated SEQ ID:3040.

Another function of VGAM329 is therefore inhibition of LOC146901 (Accession XM_097121). Accordingly, utilities of VGAM329 include diagnosis, prevention and treatment of diseases and clinical conditions associated with LOC146901. LOC150166 (Accession XM_097824) is another VGAM329 host target gene. LOC150166 BINDING SITE is HOST TARGET binding site found in the 5' untranslated region of mRNA encoded by LOC150166, corresponding to a HOST TARGET binding site such as BINDING SITE I, BINDING SITE II or BINDING SITE III. Table 2 illustrates the complementarity of the nucleotide sequences of LOC150166 BINDING SITE, designated SEQ ID:41147, to the nucleotide sequence of VGAM329 RNA, herein designated VGAM RNA, also designated SEQ ID:3040.

Another function of VGAM329 is therefore inhibition of LOC150166 (Accession XM_097824). Accordingly, utilities of VGAM329 include diagnosis, prevention and treatment of diseases and clinical conditions associated with LOC150166. LOC151429 (Accession XM_098059) is another VGAM329 host target gene. LOC151429 BINDING SITE is HOST TARGET binding site found in the 3' untranslated region of mRNA encoded by LOC151429, corresponding to a HOST TARGET binding site such as BINDING SITE I, BINDING SITE II or BINDING SITE III. Table 2 illustrates the complementarity of the nucleotide sequences of LOC151429 BINDING SITE, designated SEQ ID:41345, to the nucleotide sequence of VGAM329 RNA, herein designated VGAM RNA, also designated SEQ ID:3040.

Another function of VGAM329 is therefore inhibition of LOC151429 (Accession XM_098059). Accordingly, utilities of VGAM329 include diagnosis, prevention and treatment of diseases and clinical conditions associated with LOC151429. LOC162333 (Accession XM_102591) is another VGAM329 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42142, to the nucleotide sequence of VGAM329 RNA, herein designated VGAM RNA, also designated SEQ ID:3040.

Another function of VGAM329 is therefore inhibition of LOC162333 (Accession XM_102591). Accordingly, utilities of VGAM329 include diagnosis, prevention and treatment of diseases and clinical conditions associated with LOC162333. LOC199920 (Accession XM_114056) is another VGAM329 host target gene. LOC199920 BINDING SITE is HOST TARGET binding site found in the 5' untranslated region of mRNA encoded by LOC199920, corresponding to a HOST TARGET binding site such as BINDING SITE I, BINDING SITE II or BINDING SITE III. Table 2 illustrates the complementarity of the nucleotide sequences of LOC199920 BINDING SITE, designated SEQ ID:42660, to the nucleotide sequence of VGAM329 RNA, herein designated VGAM RNA, also designated SEQ ID:3040.

Another function of VGAM329 is therefore inhibition of LOC199920 (Accession XM_114056). Accordingly, utilities of VGAM329 include diagnosis, prevention and treatment of diseases and clinical conditions associated with LOC199920. LOC200734 (Accession XM_114286) is another VGAM329 host target gene. LOC200734 BINDING SITE1 and LOC200734 BINDING SITE2 are HOST TARGET binding sites found in untranslated regions of mRNA encoded by LOC200734, corresponding to HOST TARGET binding sites such as BINDING SITE I, BINDING SITE II or BINDING SITE III. Table 2 illustrates the complementarity of the nucleotide sequences of LOC200734 BINDING SITE1 and LOC200734 BINDING SITE2, designated SEQ ID:42843 and SEQ ID:42844 respectively, to the nucleotide sequence of VGAM329 RNA, herein designated VGAM RNA, also designated SEQ ID:3040.

Another function of VGAM329 is therefore inhibition of LOC200734 (Accession XM_114286). Accordingly, utilities of VGAM329 include diagnosis, prevention and treatment of diseases and clinical conditions associated with LOC200734. LOC51337 (Accession NM_016647) is another VGAM329 host target gene. LOC51337 BINDING SITE is HOST TARGET binding site found in the 3' untranslated region of mRNA encoded by LOC51337, corresponding to a HOST TARGET binding site such as BINDING SITE I, BINDING SITE II or BINDING SITE III. Table 2 illustrates the complementarity of the nucleotide sequences of LOC51337 BINDING SITE, designated SEQ ID:18764, to the nucleotide sequence of VGAM329 RNA, herein designated VGAM RNA, also designated SEQ ID:3040.

Another function of VGAM329 is therefore inhibition of LOC51337 (Accession NM_016647). Accordingly, utilities of VGAM329 include diagnosis, prevention and treatment of diseases and clinical conditions associated with LOC51337.

LOC83690 (Accession NM_031461) is another VGAM329 host target gene. LOC83690 BINDING SITE is HOST TARGET binding site found in the 3' untranslated region of mRNA encoded by LOC83690, corresponding to a HOST TARGET binding site such as BINDING SITE I, BINDING SITE II or BINDING SITE III. Table 2 illustrates the complementarity of the nucleotide sequences of LOC83690 BINDING SITE, designated SEQ ID:25486, to the nucleotide sequence of VGAM329 RNA, herein designated VGAM RNA, also designated SEQ ID:3040.

Another function of VGAM329 is therefore inhibition of LOC83690 (Accession NM_031461). Accordingly, utilities of VGAM329 include diagnosis, prevention and treatment of diseases and clinical conditions associated with LOC83690. LOC90917 (Accession XM_034861) is another VGAM329 host target gene. LOC90917 BINDING SITE is HOST TARGET binding site found in the 5' untranslated region of mRNA encoded by LOC90917, corresponding to a HOST TARGET binding site such as BINDING SITE I, BINDING SITE II or BINDING SITE III. Table 2 illustrates the complementarity of the nucleotide sequences of LOC90917 BINDING SITE, designated SEQ ID:32171, to the nucleotide sequence of VGAM329 RNA, herein designated VGAM RNA, also designated SEQ ID:3040.

Another function of VGAM329 is therefore inhibition of LOC90917 (Accession XM_034861). Accordingly, utilities of VGAM329 include diagnosis, prevention and treatment of diseases and clinical conditions associated with LOC90917. LOC91149 (Accession XM_036480) is another VGAM329 host target gene. LOC91149 BINDING SITE is HOST TARGET binding site found in the 3' untranslated region of mRNA encoded by LOC91149, corresponding to a HOST TARGET binding site such as BINDING SITE I, BINDING SITE II or BINDING SITE III. Table 2 illustrates the complementarity of the nucleotide sequences of LOC91149 BINDING SITE, designated SEQ ID:32460, to the nucleotide sequence of VGAM329 RNA, herein designated VGAM RNA, also designated SEQ ID:3040.

Another function of VGAM329 is therefore inhibition of LOC91149 (Accession XM_036480). Accordingly, utilities of VGAM329 include diagnosis, prevention and treatment of diseases and clinical conditions associated with LOC91149. LOC92568 (Accession XM_045852) is another VGAM329 host target gene. LOC92568 BINDING SITE is HOST TARGET binding site found in the 3' untranslated region of mRNA encoded by LOC92568, corresponding to a HOST TARGET binding site such as BINDING SITE I, BINDING SITE II or BINDING SITE III. Table 2 illustrates the complementarity of the nucleotide sequences of LOC92568 BINDING SITE, designated SEQ ID:34581, to the nucleotide sequence of VGAM329 RNA, herein designated VGAM RNA, also designated SEQ ID:3040.

Another function of VGAM329 is therefore inhibition of LOC92568 (Accession XM_045852). Accordingly, utilities of VGAM329 include diagnosis, prevention and treatment of diseases and clinical conditions associated with LOC92568. FIG. 1 further provides a conceptual description of a novel bioinformatically detected viral gene of the present invention, referred to here as Viral Genomic Address Messenger 330 (VGAM330) viral gene, which modulates expression of respective host target genes thereof, the function and utility of which host target genes is known in the art.

VGAM330 is a novel bioinformatically detected regulatory, non protein coding, viral micro RNA (miRNA) gene. The method by which VGAM330 was detected is described hereinabove with reference to FIGS. 1-8.

VGAM330 gene, herein designated VGAM GENE, is a viral gene contained in the genome of Human Herpesvirus 5. VGAM330 host target gene, herein designated VGAM HOST TARGET GENE, is a human gene contained in the human genome.

VGAM330 gene encodes a VGAM330 precursor RNA, herein designated VGAM PRECURSOR RNA. Similar to other miRNA genes, and unlike most ordinary genes, VGAM330 precursor RNA does not encode a protein. A nucleotide sequence identical or highly similar to the nucleotide sequence of VGAM330 precursor RNA is designated SEQ ID:316, and is provided hereinbelow with reference to the sequence listing part. Nucleotide sequence SEQ ID:316 is located at position 43800 relative to the genome of Human Herpesvirus 5.

VGAM330 precursor RNA folds onto itself, forming VGAM330 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM330 folded precursor RNA into VGAM330 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM330 RNA is designated SEQ ID:3041, and is provided hereinbelow with reference to the sequence listing part.

VGAM330 host target gene, herein designated VGAM HOST TARGET GENE, encodes a corresponding messenger RNA, VGAM330 host target RNA, herein designated VGAM HOST TARGET RNA. VGAM330 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM330 RNA, herein designated VGAM RNA, binds complementarily to one or more host target binding sites located in untranslated regions of VGAM330 host target RNA, herein designated VGAM HOST TARGET RNA. This complementary binding is due to the fact that the nucleotide sequence of VGAM330 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM330 RNA, herein designated VGAM RNA, may have a different number of host target binding sites in untranslated regions of a VGAM330 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM330 RNA, herein designated VGAM RNA, to host target binding sites on VGAM330 host target RNA, herein designated VGAM HOST TARGET RNA, such as BINDING SITE I, BINDING SITE II and BINDING SITE III, inhibits translation of VGAM330 host target RNA into VGAM330 host target protein, herein designated VGAM HOST TARGET PROTEIN. VGAM host target protein is therefore outlined by a broken line.

It is appreciated that VGAM330 host target gene, herein designated VGAM HOST TARGET GENE, in fact represents a plurality of VGAM330 host target genes. The mRNA of each one of this plurality of VGAM330 host target genes comprises one or more host target binding sites, each having a nucleotide sequence which is at least partly complementary to VGAM330 RNA, herein designated VGAM RNA, and which when bound by VGAM330 RNA causes inhibition of translation of respective one or more VGAM330 host target proteins.

It is further appreciated by one skilled in the art that the mode of translational inhibition illustrated by FIG. 1 with specific reference to translational inhibition exerted by VGAM330 gene, herein designated VGAM GENE, on one or more VGAM330 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM330 is inhibition of expression of host target genes, as part of a novel viral mechanism of attacking a host. Accordingly, utilities of VGAM330 include diagnosis, prevention and treatment of viral infection by Human Herpesvirus 5. Specific functions, and accordingly utilities, of VGAM330 correlate with, and may be deduced from, the identity of the host target genes which VGAM330 binds and inhibits, and the function of these host target genes, as elaborated hereinbelow.

Nucleotide sequences of the VGAM330 precursor RNA, herein designated VGAM PRECURSOR RNA, and of the 'diced' VGAM330 RNA, herein designated VGAM RNA, and a schematic representation of the secondary folding of VGAM330 folded precursor RNA, herein designated VGAM FOLDED PRECURSOR RNA, of VGAM330 are further described hereinbelow with reference to Table 1.

Nucleotide sequences of host target binding sites, such as BINDING SITE-I, BINDING SITE-II and BINDING SITE-III of FIG. 1, found on VGAM330 host target RNA, and schematic representation of the complementarity of each of these host target binding sites to VGAM330 RNA, herein designated VGAM RNA, are described hereinbelow with reference to Table 2.

As mentioned hereinabove with reference to FIG. 1, a function of VGAM330 gene, herein designated VGAM is inhibition of expression of VGAM330 target genes. It is appreciated that specific functions, and accordingly utilities, of VGAM330 correlate with, and may be deduced from, the identity of the target genes which VGAM330 binds and inhibits, and the function of these target genes, as elaborated hereinbelow.

Cyclin D1 (PRAD1: parathyroid adenomatosis 1) (CCND1, Accession NM_053056) is a VGAM330 host target gene. CCND1 BINDING SITE is HOST TARGET binding site found in the 3' untranslated region of mRNA encoded by CCND1, corresponding to a HOST TARGET binding site such as BINDING SITE I, BINDING SITE II or BINDING SITE III. Table 2 illustrates the complementarity of the nucleotide sequences of CCND1 BINDING SITE, designated SEQ ID:27600, to the nucleotide sequence of VGAM330 RNA, herein designated VGAM RNA, also designated SEQ ID:3041.

A function of VGAM330 is therefore inhibition of Cyclin D1 (PRAD1: parathyroid adenomatosis 1) (CCND1, Accession NM_053056), a gene which is involved in the control of cell cycle and is required for Schwann cell proliferation to proceed normally during Wallerian degeneration. Accordingly, utilities of VGAM330 include diagnosis, prevention and treatment of diseases and clinical conditions associated with CCND1. The function of CCND1 and its association with various diseases and clinical conditions, has been established by previous studies, as described hereinabove with reference to VGAM220. Centromere Protein A, 17 kDa (CENPA, Accession NM_001809) is another VGAM330 host target gene. CENPA BINDING SITE is HOST TARGET binding site found in the 3' untranslated region of mRNA encoded by CENPA, corresponding to a HOST TARGET binding site such as BINDING SITE I, BINDING SITE II or BINDING SITE III. Table 2 illustrates the complementarity of the nucleotide sequences of CENPA BINDING SITE, designated SEQ ID:7559, to the nucleotide sequence of VGAM330 RNA, herein designated VGAM RNA, also designated SEQ ID:3041.

Another function of VGAM330 is therefore inhibition of Centromere Protein A, 17 kDa (CENPA, Accession NM_001809), a gene which is a component of a modified nucleosome or nucleosome-like structure. Accordingly, utilities of VGAM330 include diagnosis, prevention and treatment of diseases and clinical conditions associated with CENPA. The function of CENPA has been established by previous studies. CENPA is a 17-kD centromere protein that was identified along with CENPB and CENPC (OMIM Ref. No. 117141) using centromere-specific autoantibodies from CREST (see OMIM Ref. No. 181750) patients. Palmer et al. (1991) purified CENPA protein from bull sperm nuclei and obtained a partial amino acid sequence. They found that some CENPA sequences are highly similar to regions of histone H3. Sullivan et al. (1994) cloned a bovine CENPA cDNA by RT-PCR using primers based on the bovine CENPA protein sequence. By screening a human endothelial cell cDNA library with the bovine cDNA, they isolated a human CENPA cDNA. The C-terminal region of the predicted 140-amino acid human protein shares 62% amino acid identity with that of histone H3.1. Epitope-tagged CENPA protein colocalized with centromeres when expressed in HeLa cells. The centromere-targeting signals of CENPA are located within the histone H3-homologous region. Sullivan et al. (1994) suggested that CENPA is a component of a modified nucleosome or nucleosome-like structure in which it replaces 1 or both copies of conventional histone H3 in the (H3-H4)2 tetrameric core of the nucleosome particle. Animal model experiments lend further support to the function of CENPA. Using gene targeting, Howman et al. (2000) disrupted the mouse Cenpa gene and demonstrated that the gene is essential. Heterozygous mice were healthy and fertile, whereas null mutants failed to survive beyond 6.5 days postconception. Affected embryos showed severe mitotic problems, including micronuclei and macronuclei formation, nuclear bridging and blebbing, and chromatin fragmentation and hypercondensation. Immunofluorescence analysis of cells at day 5.5 revealed complete Cenpa depletion, diffuse Cenpb foci, absence of discrete Cenpc signal on centromeres, and dispersion of Cenpb and Cenpc throughout the nucleus. These results suggested that Cenpa is essential for kinetochore targeting of Cenpc and plays an early role in organizing centromeric chromatin at interphase. The evidence was consistent with the proposal of a critical epigenetic function for CENPA in marking a chromosomal region for centromere formation.

It is appreciated that the abovementioned animal model for CENPA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Palmer, D. K.; O'Day, K.; Trong, H. L.; Charbonneau, H.; Margolis, R. L.: Purification of the centromere-specific protein CENP-A and demonstration that it is a distinctive histone. Proc. Nat. Acad. Sci. 88:3734-3738, 1991; and Sullivan, K. F.; Hechenberger, M.; Masri, K.: Human CENP-A contains a histone H3 related histone fold domain that is required for targeting to the centromere. J. Cell Biol. 127:581-59.

Further studies establishing the function and utilities of CENPA are found in John Hopkins OMIM database record ID 117139, and in sited publications numbered 4666-4670 listed in the bibliography section hereinbelow, which are also hereby incorporated by reference. Dihydropyrimidine Dehydrogenase (DPYD, Accession XM_017469) is another VGAM330 host target gene. DPYD BINDING SITE is HOST TARGET binding site found in the 3' untranslated region of mRNA encoded by DPYD, corresponding to a HOST TARGET binding site such as BINDING SITE I, BINDING SITE II or BINDING SITE III. Table 2 illustrates the complementarity of the nucleotide sequences of DPYD BINDING SITE, designated SEQ ID:30316, to the nucleotide sequence of VGAM330 RNA, herein designated VGAM RNA, also designated SEQ ID:3041.

Another function of VGAM330 is therefore inhibition of Dihydropyrimidine Dehydrogenase (DPYD, Accession XM_017469). Accordingly, utilities of VGAM330 include diagnosis, prevention and treatment of diseases and clinical conditions associated with DPYD. EGF-like-domain, Multiple 4 (EGFL4, Accession XM_029883) is another VGAM330 host target gene. EGFL4 BINDING SITE is HOST TARGET binding site found in the 5' untranslated region of mRNA encoded by EGFL4, corresponding to a HOST TARGET binding site such as BINDING SITE I, BINDING SITE II or BINDING SITE III. Table 2 illustrates the complementarity of the nucleotide sequences of EGFL4 BINDING SITE, designated SEQ ID:30968, to the nucleotide sequence of VGAM330 RNA, herein designated VGAM RNA, also designated SEQ ID:3041.

Another function of VGAM330 is therefore inhibition of EGF-like-domain, Multiple 4 (EGFL4, Accession XM_029883). Accordingly, utilities of VGAM330 include diagnosis, prevention and treatment of diseases and clinical conditions associated with EGFL4. Homeo Box D4 (HOXD4, Accession NM_014621) is another VGAM330 host target gene. HOXD4 BINDING SITE is HOST TARGET binding site found in the 3' untranslated region of mRNA encoded by HOXD4, corresponding to a HOST TARGET binding site such as BINDING SITE I, BINDING SITE II or BINDING SITE III. Table 2 illustrates the complementarity of the nucleotide sequences of HOXD4 BINDING SITE, designated SEQ ID:15977, to the nucleotide sequence of VGAM330 RNA, herein designated VGAM RNA, also designated SEQ ID:3041.

Another function of VGAM330 is therefore inhibition of Homeo Box D4 (HOXD4, Accession NM_014621), a gene which is part of a developmental regulatory system. Accordingly, utilities of VGAM330 include diagnosis, prevention and treatment of diseases and clinical conditions associated with HOXD4. The function of HOXD4 has been established by previous studies. See HOXD3 (OMIM Ref. No. 142980). The homologous mouse gene was at first designated a Hox-5 gene. HOX4 genes, other than the one subsequently designated HOX4A, were initially considered to be members of a different cluster of genes called HOX5. Oliver et al. (1989) found by study of interspecific somatic cell hybrids that the cluster of so-called HOX5 genes map to human chromosome 2. By in situ hybridization, they found that the localization was 2q31-q32 with a peak of grains at 2q32.3. This gene is also called HOXD4, as a member of the HOXD gene cluster on 2q31. Mavilio et al. (1986) described the HOXD4 gene, but designated it homeo box X. Northern blot analysis detected multiple embryonic transcripts, which were differentially expressed in spinal cord, brain, backbone rudiments, limb buds, and heart in 5- to 9-week-old human embryos and fetuses in a striking organ- and stage-specific pattern. On the basis of these observations, Mavilio et al. (1986) suggested that in early mammalian development, homeo box genes may exert a wide spectrum of control functions in a variety of organs and body parts in addition to the spinal cord.

Full details of the abovementioned studies are described in the following publications, the disclosure of which are hereby incorporated by reference:

Mavilio, F.; Simeone, A.; Giampaolo, A.; Faiella, A.; Zappavigna, V.; Acampora, D.; Poiana, G.; Russo, G.; Peschle, C.; Boncinelli, E.: Differential and stage-related expression in embryonic tissues of a new human homoeobox gene. Nature 324:664-668, 1986; and Oliver, G.; Sidell, N.; Fiske, W.; Heinzmann, C.; Mohandas, T.; Sparkes, R. S.; De Robertis, E. M.: Complementary homeo protein gradients in developing limb buds. Genes Dev. 3:641-650.

Further studies establishing the function and utilities of HOXD4 are found in John Hopkins OMIM database record ID 142981, and in sited publications numbered 3188-318 and 3187 listed in the bibliography section hereinbelow, which are also hereby incorporated by reference. WD Repeat Domain 1 (WDR1, Accession NM_017491) is another VGAM330 host target gene. WDR1 BINDING SITE is HOST TARGET binding site found in the 3' untranslated region of mRNA encoded by WDR1, corresponding to a HOST TARGET binding site such as BINDING SITE I, BINDING SITE II or BINDING SITE III. Table 2 illustrates the complementarity of the nucleotide sequences of WDR1 BINDING SITE, designated SEQ ID:18954, to the nucleotide sequence of VGAM330 RNA, herein designated VGAM RNA, also designated SEQ ID:3041.

Another function of VGAM330 is therefore inhibition of WD Repeat Domain 1 (WDR1, Accession NM_017491). Accordingly, utilities of VGAM330 include diagnosis, prevention and treatment of diseases and clinical conditions associated with WDR1. AFAP (Accession NM_021638) is another VGAM330 host target gene. AFAP BINDING SITE is HOST TARGET binding site found in the 3' untranslated region of mRNA encoded by AFAP, corresponding to a HOST TARGET binding site such as BINDING SITE I, BINDING SITE II or BINDING SITE III. Table 2 illustrates the complementarity of the nucleotide sequences of AFAP BINDING SITE, designated SEQ ID:22290, to the nucleotide sequence of VGAM330 RNA, herein designated VGAM RNA, also designated SEQ ID:3041.

Another function of VGAM330 is therefore inhibition of AFAP (Accession NM_021638). Accordingly, utilities of VGAM330 include diagnosis, prevention and treatment of diseases and clinical conditions associated with AFAP. Rho Guanine Nucleotide Exchange Factor (GEF) 15 (ARHGEF15, Accession NM_014958) is another VGAM330 host target gene. ARHGEF15 BINDING SITE is HOST TARGET binding site found in the 3' untranslated region of mRNA encoded by ARHGEF15, corresponding to a HOST TARGET binding site such as BINDING SITE I, BINDING SITE II or BINDING SITE III. Table 2 illustrates the complementarity of the nucleotide sequences of ARHGEF15 BINDING SITE, designated SEQ ID:17315, to the nucleotide sequence of VGAM330 RNA, herein designated VGAM RNA, also designated SEQ ID:3041.

Another function of VGAM330 is therefore inhibition of Rho Guanine Nucleotide Exchange Factor (GEF) 15 (ARHGEF15, Accession NM_014958). Accordingly, utilities of VGAM330 include diagnosis, prevention and treatment of diseases and clinical conditions associated with ARHGEF15. Activating Transcription Factor 3 (ATF3, Accession NM_004024) is another VGAM330 host target gene. ATF3 BINDING SITE is HOST TARGET binding site found in the 3' untranslated region of mRNA encoded by ATF3, corresponding to a HOST TARGET binding site such as BINDING SITE I, BINDING SITE II or BINDING SITE III. Table 2 illustrates the complementarity of the nucleotide sequences of ATF3 BINDING SITE, designated SEQ ID:10241, to the nucleotide sequence of VGAM330 RNA, herein designated VGAM RNA, also designated SEQ ID:3041.

Another function of VGAM330 is therefore inhibition of Activating Transcription Factor 3 (ATF3, Accession NM_004024). Accordingly, utilities of VGAM330 include diagnosis, prevention and treatment of diseases and clinical conditions associated with ATF3. FLJ12409 (Accession NM_025105) is another VGAM330 host target gene. FLJ12409 BINDING SITE is HOST TARGET binding site found in the 3' untranslated region of mRNA encoded by FLJ12409, corresponding to a HOST TARGET binding site such as BINDING SITE I, BINDING SITE II or BINDING SITE III. Table 2 illustrates the complementarity of the nucleotide sequences of FLJ12409 BINDING SITE, designated SEQ ID:24752, to the nucleotide sequence of VGAM330 RNA, herein designated VGAM RNA, also designated SEQ ID:3041.

Another function of VGAM330 is therefore inhibition of FLJ12409 (Accession NM_025105). Accordingly, utilities of VGAM330 include diagnosis, prevention and treatment of diseases and clinical conditions associated with FLJ12409. FLJ12783 (Accession NM_031426) is another VGAM330 host target gene. FLJ12783 BINDING SITE is HOST TARGET binding site found in the 3' untranslated region of mRNA encoded by FLJ12783, corresponding to a HOST TARGET binding site such as BINDING SITE I, BINDING SITE II or BINDING SITE III. Table 2 illustrates the complementarity of the nucleotide sequences of FLJ12783 BINDING SITE, designated SEQ ID:25420, to the nucleotide sequence of VGAM330 RNA, herein designated VGAM RNA, also designated SEQ ID:3041.

Another function of VGAM330 is therefore inhibition of FLJ12783 (Accession NM_031426). Accordingly, utilities of VGAM330 include diagnosis, prevention and treatment of diseases and clinical conditions associated with FLJ12783. FLJ12910 (Accession NM_024573) is another VGAM330 host target gene. FLJ12910 BINDING SITE is HOST TARGET binding site found in the 5' untranslated region of mRNA encoded by FLJ12910, corresponding to a HOST TARGET binding site such as BINDING SITE I, BINDING SITE II or BINDING SITE III. Table 2 illustrates the complementarity of the nucleotide sequences of FLJ12910 BINDING SITE, designated SEQ ID:23800, to the nucleotide sequence of VGAM330 RNA, herein designated VGAM RNA, also designated SEQ ID:3041.

Another function of VGAM330 is therefore inhibition of FLJ12910 (Accession NM_024573). Accordingly, utilities of VGAM330 include diagnosis, prevention and treatment of diseases and clinical conditions associated with FLJ12910. FLJ14251 (Accession NM_024881) is another VGAM330 host target gene. FLJ14251 BINDING SITE is HOST TARGET binding site found in the 3' untranslated region of mRNA encoded by FLJ14251, corresponding to a HOST TARGET binding site such as BINDING SITE I, BINDING SITE II or BINDING SITE III. Table 2 illustrates the complementarity of the nucleotide sequences of FLJ14251 BINDING SITE, designated SEQ ID:24325, to the nucleotide sequence of VGAM330 RNA, herein designated VGAM RNA, also designated SEQ ID:3041.

Another function of VGAM330 is therefore inhibition of FLJ14251 (Accession NM_024881). Accordingly, utilities of VGAM330 include diagnosis, prevention and treatment of diseases and clinical conditions associated with FLJ14251. FLJ20315 (Accession NM_017763) is another VGAM330 host target gene. FLJ20315 BINDING SITE is HOST TARGET binding site found in the 5' untranslated region of mRNA encoded by FLJ20315, corresponding to a HOST TARGET binding site such as BINDING SITE I, BINDING SITE II or BINDING SITE III. Table 2 illustrates the complementarity of the nucleotide sequences of FLJ20315 BINDING SITE, designated SEQ ID:19380, to the nucleotide sequence of VGAM330 RNA, herein designated VGAM RNA, also designated SEQ ID:3041.

Another function of VGAM330 is therefore inhibition of FLJ20315 (Accession NM_017763). Accordingly, utilities of VGAM330 include diagnosis, prevention and treatment of diseases and clinical conditions associated with FLJ20315. FLJ21162 (Accession NM_024873) is another VGAM330 host target gene. FLJ21162 BINDING SITE is HOST TARGET binding site found in the 3' untranslated region of mRNA encoded by FLJ21162, corresponding to a HOST TARGET binding site such as BINDING SITE I, BINDING SITE II or BINDING SITE III. Table 2 illustrates the complementarity of the nucleotide sequences of FLJ21162 BINDING SITE, designated SEQ ID:24307, to the nucleotide sequence of VGAM330 RNA, herein designated VGAM RNA, also designated SEQ ID:3041.

Another function of VGAM330 is therefore inhibition of FLJ21162 (Accession NM_024873). Accordingly, utilities of VGAM330 include diagnosis, prevention and treatment of diseases and clinical conditions associated with FLJ21162. FLJ23342 (Accession NM_024631) is another VGAM330 host target gene. FLJ23342 BINDING SITE is HOST TARGET binding site found in the 3' untranslated region of mRNA encoded by FLJ23342, corresponding to a HOST TARGET binding site such as BINDING SITE I, BINDING SITE II or BINDING SITE III. Table 2 illustrates the complementarity of the nucleotide sequences of FLJ23342 BINDING SITE, designated SEQ ID:23898, to the nucleotide sequence of VGAM330 RNA, herein designated VGAM RNA, also designated SEQ ID:3041.

Another function of VGAM330 is therefore inhibition of FLJ23342 (Accession NM_024631). Accordingly, utilities of VGAM330 include diagnosis, prevention and treatment of diseases and clinical conditions associated with FLJ23342. HH114 (Accession NM_032499) is another VGAM330 host target gene. HH114 BINDING SITE is HOST TARGET binding site found in the 3' untranslated region of mRNA encoded by HH114, corresponding to a HOST TARGET binding site such as BINDING SITE I, BINDING SITE II or BINDING SITE III. Table 2 illustrates the complementarity of the nucleotide sequences of HH114 BINDING SITE, designated SEQ ID:26251, to the nucleotide sequence of VGAM330 RNA, herein designated VGAM RNA, also designated SEQ ID:3041.

Another function of VGAM330 is therefore inhibition of HH114 (Accession NM_032499). Accordingly, utilities of VGAM330 include diagnosis, prevention and treatment of diseases and clinical conditions associated with HH114. KIAA0798 (Accession NM_014650) is another VGAM330 host target gene. KIAA0798 BINDING SITE is HOST TARGET binding site found in the 3' untranslated region of mRNA encoded by KIAA0798, corresponding to a HOST TARGET binding site such as BINDING SITE I, BINDING SITE II or BINDING SITE III. Table 2 illustrates the complementarity of the nucleotide sequences of KIAA0798 BINDING SITE, designated SEQ ID:16072, to the nucleotide sequence of VGAM330 RNA, herein designated VGAM RNA, also designated SEQ ID:3041.

Another function of VGAM330 is therefore inhibition of KIAA0798 (Accession NM_014650). Accordingly, utilities of VGAM330 include diagnosis, prevention and treatment of diseases and clinical conditions associated with KIAA0798. Mannosidase, Beta A, Lysosomal-like (MANBAL, Accession NM_022077) is another VGAM330 host target gene. MANBAL BINDING SITE is HOST TARGET binding site found in the 3' untranslated region of mRNA encoded by MANBAL, corresponding to a HOST TARGET binding site such as BINDING SITE I, BINDING SITE II or BINDING SITE III. Table 2 illustrates the complementarity of the nucleotide sequences of MANBAL BINDING SITE, designated SEQ ID:22621, to the nucleotide sequence of VGAM330 RNA, herein designated VGAM RNA, also designated SEQ ID:3041.

Another function of VGAM330 is therefore inhibition of Mannosidase, Beta A, Lysosomal-like (MANBAL, Accession NM_022077). Accordingly, utilities of VGAM330 include diagnosis, prevention and treatment of diseases and clinical conditions associated with MANBAL. Opiate Receptor-like 1 (OPRL1, Accession NM_000913) is another VGAM330 host target gene. OPRL1 BINDING SITE is HOST TARGET binding site found in the 3' untranslated region of mRNA encoded by OPRL1, corresponding to a HOST TARGET binding site such as BINDING SITE I, BINDING SITE II or BINDING SITE III. Table 2 illustrates the complementarity of the nucleotide sequences of OPRL1 BINDING SITE, designated SEQ ID:6616, to the nucleotide sequence of VGAM330 RNA, herein designated VGAM RNA, also designated SEQ ID:3041.

Another function of VGAM330 is therefore inhibition of Opiate Receptor-like 1 (OPRL1, Accession NM_000913). Accordingly, utilities of VGAM330 include diagnosis, prevention and treatment of diseases and clinical conditions associated with OPRL1. Solute Carrier Family 17 (sodium-dependent inorganic phosphate cotransporter), Member 6 (SLC17A6, Accession NM_020346) is another VGAM330 host target gene. SLC17A6 BINDING SITE is HOST TARGET binding site found in the 3" untranslated region of mRNA encoded by SLC17A6, corresponding to a HOST TARGET binding site such as BINDING SITE I, BINDING SITE II or BINDING SITE III. Table 2 illustrates the complementarity of the nucleotide sequences of SLC17A6 BINDING SITE, designated SEQ ID:21595, to the nucleotide sequence of VGAM330 RNA, herein designated VGAM RNA, also designated SEQ ID:3041.

Another function of VGAM330 is therefore inhibition of Solute Carrier Family 17 (sodium-dependent inorganic phosphate cotransporter), Member 6 (SLC17A6, Accession NM_020346). Accordingly, utilities of VGAM330 include diagnosis, prevention and treatment of diseases and clinical conditions associated with SLC17A6. LOC139221 (Accession XM_066558) is another VGAM330 host target gene. LOC139221 BINDING SITE is HOST TARGET binding site found in the 3' untranslated region of mRNA encoded by LOC139221, corresponding to a HOST TARGET binding site such as BINDING SITE I, BINDING SITE II or BINDING SITE III. Table 2 illustrates the complementarity of the nucleotide sequences of LOC139221 BINDING SITE, designated SEQ ID:37331, to the nucleotide sequence of VGAM330 RNA, herein designated VGAM RNA, also designated SEQ ID:3041.

Another function of VGAM330 is therefore inhibition of LOC139221 (Accession XM_066558). Accordingly, utilities of VGAM330 include diagnosis, prevention and treatment of diseases and clinical conditions associated with LOC139221. LOC145844 (Accession XM_085255) is another VGAM330 host target gene. LOC145844 BINDING SITE is HOST TARGET binding site found in the 3' untranslated region of mRNA encoded by LOC145844, corresponding to a HOST TARGET binding site such as BINDING SITE I, BINDING SITE II or BINDING SITE III. Table 2 illustrates the complementarity of the nucleotide sequences of LOC145844 BINDING SITE, designated SEQ ID:37999, to the nucleotide sequence of VGAM330 RNA, herein designated VGAM RNA, also designated SEQ ID:3041.

Another function of VGAM330 is therefore inhibition of LOC145844 (Accession XM_085255). Accordingly, utilities of VGAM330 include diagnosis, prevention and treatment of diseases and clinical conditions associated with LOC145844. LOC150290 (Accession XM_086863) is another VGAM330 host target gene. LOC150290 BINDING SITE is HOST TARGET binding site found in the 5' untranslated region of mRNA encoded by LOC150290, corresponding to a HOST TARGET binding site such as BINDING SITE I, BINDING SITE II or BINDING SITE III. Table 2 illustrates the complementarity of the nucleotide sequences of LOC150290 BINDING SITE, designated SEQ ID:38933, to the nucleotide sequence of VGAM330 RNA, herein designated VGAM RNA, also designated SEQ ID:3041.

Another function of VGAM330 is therefore inhibition of LOC150290 (Accession XM_086863). Accordingly, utilities of VGAM330 include diagnosis, prevention and treatment of diseases and clinical conditions associated with LOC150290. LOC164382 (Accession XM_104390) is another VGAM330 host target gene. LOC164382 BINDING SITE is HOST TARGET binding site found in the 3' untranslated region of mRNA encoded by LOC164382, corresponding to a HOST TARGET binding site such as BINDING SITE I, BINDING SITE II or BINDING SITE III. Table 2 illustrates the complementarity of the nucleotide sequences of LOC164382 BINDING SITE, designated SEQ ID:42161, to the nucleotide sequence of VGAM330 RNA, herein designated VGAM RNA, also designated SEQ ID:3041.

Another function of VGAM330 is therefore inhibition of LOC164382 (Accession XM_104390). Accordingly, utilities of VGAM330 include diagnosis, prevention and treatment of diseases and clinical conditions associated with LOC164382. LOC203350 (Accession XM_117536) is another VGAM330 host target gene. LOC203350 BINDING SITE is HOST TARGET binding site found in the 3' untranslated region of mRNA encoded by LOC203350, corresponding to a HOST TARGET binding site such as BINDING SITE I, BINDING SITE II or BINDING SITE III. Table 2 illustrates the complementarity of the nucleotide sequences of LOC203350 BINDING SITE, designated SEQ ID:43528, to the nucleotide sequence of VGAM330 RNA, herein designated VGAM RNA, also designated SEQ ID:3041.

Another function of VGAM330 is therefore inhibition of LOC203350 (Accession XM_117536). Accordingly, utilities of VGAM330 include diagnosis, prevention and treatment of diseases and clinical conditions associated with LOC203350. LOC221362 (Accession XM_168093) is another VGAM330 host target gene. LOC221362 BINDING SITE is HOST TARGET binding site found in the 3' untranslated region of mRNA encoded by LOC221362, corresponding to a HOST TARGET binding site such as BINDING SITE I, BINDING SITE II or BINDING SITE III. Table 2 illustrates the complementarity of the nucleotide sequences of LOC221362 BINDING SITE, designated SEQ ID:45021, to the nucleotide sequence of VGAM330 RNA, herein designated VGAM RNA, also designated SEQ ID:3041.

Another function of VGAM330 is therefore inhibition of LOC221362 (Accession XM_168093). Accordingly, utilities of VGAM330 include diagnosis, prevention and treatment of diseases and clinical conditions associated with LOC221362. LOC222060 (Accession XM_168427) is another VGAM330 host target gene. LOC222060 BINDING SITE is HOST TARGET binding site found in the 5' untranslated region of mRNA encoded by LOC222060, corresponding to a HOST TARGET binding site such as BINDING SITE I, BINDING SITE II or BINDING SITE III. Table 2 illustrates the complementarity of the nucleotide sequences of LOC222060 BINDING SITE, designated SEQ ID:45157, to the nucleotide sequence of VGAM330 RNA, herein designated VGAM RNA, also designated SEQ ID:3041.

Another function of VGAM330 is therefore inhibition of LOC222060 (Accession XM_168427). Accordingly, utilities of VGAM330 include diagnosis, prevention and treatment of diseases and clinical conditions associated with LOC222060. LOC254413 (Accession XM_173141) is another VGAM330 host target gene. LOC254413 BINDING SITE is HOST TARGET binding site found in the 5' untranslated region of mRNA encoded by LOC254413, corresponding to a HOST TARGET binding site such as BINDING SITE I, BINDING SITE II or BINDING SITE III. Table 2 illustrates the complementarity of the nucleotide sequences of LOC254413 BINDING SITE, designated SEQ ID:46396, to the nucleotide sequence of VGAM330 RNA, herein designated VGAM RNA, also designated SEQ ID:3041.

Another function of VGAM330 is therefore inhibition of LOC254413 (Accession XM_173141). Accordingly, utilities of VGAM330 include diagnosis, prevention and treatment of diseases and clinical conditions associated with LOC254413. LOC92573 (Accession XM_045884) is another VGAM330 host target gene. LOC92573 BINDING SITE is HOST TARGET binding site found in the 5' untranslated region of mRNA encoded by LOC92573, corresponding to a HOST TARGET binding site such as BINDING SITE I, BINDING SITE II or BINDING SITE III. Table 2 illustrates the complementarity of the nucleotide sequences of LOC92573 BINDING SITE, designated SEQ ID:34601, to the nucleotide sequence of VGAM330 RNA, herein designated VGAM RNA, also designated SEQ ID:3041.

Another function of VGAM330 is therefore inhibition of LOC92573 (Accession XM_045884). Accordingly, utilities of VGAM330 include diagnosis, prevention and treatment of diseases and clinical conditions associated with LOC92573. FIG. 1 further provides a conceptual description of a novel bioinformatically detected viral gene of the present invention, referred to here as Viral Genomic Address Messenger 331 (VGAM331) viral gene, which modulates expression of respective host target genes thereof, the function and utility of which host target genes is known in the art.

VGAM331 is a novel bioinformatically detected regulatory, non protein coding, viral micro RNA (miRNA) gene. The method by which VGAM331 was detected is described hereinabove with reference to FIGS. 1-8.

VGAM331 gene, herein designated VGAM GENE, is a viral gene contained in the genome of Human Herpesvirus 5. VGAM331 host target gene, herein designated VGAM HOST TARGET GENE, is a human gene contained in the human genome.

VGAM331 gene encodes a VGAM331 precursor RNA, herein designated VGAM PRECURSOR RNA. Similar to other miRNA genes, and unlike most ordinary genes, VGAM331 precursor RNA does not encode a protein. A nucleotide sequence identical or highly similar to the nucleotide sequence of VGAM331 precursor RNA is designated SEQ ID:317, and is provided hereinbelow with reference to the sequence listing part. Nucleotide sequence SEQ ID:317 is located at position 113291 relative to the genome of Human Herpesvirus 5.

VGAM331 precursor RNA folds onto itself, forming VGAM331 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM331 folded precursor RNA into VGAM331 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM331 RNA is designated SEQ ID:3042, and is provided hereinbelow with reference to the sequence listing part.

VGAM331 host target gene, herein designated VGAM HOST TARGET GENE, encodes a corresponding messenger RNA, VGAM331 host target RNA, herein designated VGAM HOST TARGET RNA. VGAM331 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM331 RNA, herein designated VGAM RNA, binds complementarily to one or more host target binding sites located in untranslated regions of VGAM331 host target RNA, herein designated VGAM HOST TARGET RNA. This complementary binding is due to the fact that the nucleotide sequence of VGAM331 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM331 RNA, herein designated VGAM RNA, may have a different number of host target binding sites in untranslated regions of a VGAM331 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM331 RNA, herein designated VGAM RNA, to host target binding sites on VGAM331 host target RNA, herein designated VGAM HOST TARGET RNA, such as BINDING SITE I, BINDING SITE II and BINDING SITE III, inhibits translation of VGAM331 host target RNA into VGAM331 host target protein, herein designated VGAM HOST TARGET PROTEIN. VGAM host target protein is therefore outlined by a broken line.

It is appreciated that VGAM331 host target gene, herein designated VGAM HOST TARGET GENE, in fact represents a plurality of VGAM331 host target genes. The mRNA of each one of this plurality of VGAM331 host target genes comprises one or more host target binding sites, each having a nucleotide sequence which is at least partly complementary to VGAM331 RNA, herein designated VGAM RNA, and which when bound by VGAM331 RNA causes inhibition of translation of respective one or more VGAM331 host target proteins.

It is further appreciated by one skilled in the art that the mode of translational inhibition illustrated by FIG. 1 with specific reference to translational inhibition exerted by VGAM331 gene, herein designated VGAM GENE, on one or more VGAM331 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM331 is inhibition of expression of host target genes, as part of a novel viral mechanism of attacking a host. Accordingly, utilities of VGAM331 include diagnosis, prevention and treatment of viral infection by Human Herpesvirus 5. Specific functions, and accordingly utilities, of VGAM331 correlate with, and may be deduced from, the identity of the host target genes which VGAM331 binds and inhibits, and the function of these host target genes, as elaborated hereinbelow.

Nucleotide sequences of the VGAM331 precursor RNA, herein designated VGAM PRECURSOR RNA, and of the 'diced' VGAM331 RNA, herein designated VGAM RNA, and a schematic representation of the secondary folding of VGAM331 folded precursor RNA, herein designated VGAM FOLDED PRECURSOR RNA, of VGAM331 are further described hereinbelow with reference to Table 1.

Nucleotide sequences of host target binding sites, such as BINDING SITE-I, BINDING SITE-II and BINDING SITE-III of FIG. 1, found on VGAM331 host target RNA, and schematic representation of the complementarity of each of these host target binding sites to VGAM331 RNA, herein designated VGAM RNA, are described hereinbelow with reference to Table 2.

As mentioned hereinabove with reference to FIG. 1, a function of VGAM331 gene, herein designated VGAM is inhibition of expression of VGAM331 target genes. It is appreciated that specific functions, and accordingly utilities, of VGAM331 correlate with, and may be deduced from, the identity of the target genes which VGAM331 binds and inhibits, and the function of these target genes, as elaborated hereinbelow.

BTB and CNC Homology 1, Basic Leucine Zipper Transcription Factor 2 (BACH2, Accession NM_021813) is a VGAM331 host target gene. BACH2 BINDING SITE is HOST TARGET binding site found in the 3' untranslated region of mRNA encoded by BACH2, corresponding to a HOST TARGET binding site such as BINDING SITE I, BINDING SITE II or BINDING SITE III. Table 2 illustrates the complementarity of the nucleotide sequences of BACH2 BINDING SITE, designated SEQ ID:22381, to the nucleotide sequence of VGAM331 RNA, herein designated VGAM RNA, also designated SEQ ID:3042.

A function of VGAM331 is therefore inhibition of BTB and CNC Homology 1, Basic Leucine Zipper Transcription Factor 2 (BACH2, Accession NM_021813), a gene which acts as repressor or activator, binds to maf recognition elements. Accordingly, utilities of VGAM331 include diagnosis, prevention and treatment of diseases and clinical conditions associated with BACH2. The function of BACH2 has been established by previous studies. By screening a K562 erythroleukemia cell line with mouse Bach2 cDNA as the probe, Sasaki et al. (2000) isolated a cDNA encoding BACH2. The deduced 841-amino acid protein is 89.5% identical to mouse Bach2, with 97% identity shared in the BTB and bZip functional domains and 94% identity shared in the serine-rich region. Northern blot analysis revealed expression of an approximately 11.0-kb BACH2 transcript restricted to thymus, spleen, and leukocytes; low levels were also detected in small intestine and brain. Sasaki et al. (2000) found mRNA and protein expression primarily in B-lymphoid rather than other hematopoietic cell lines. RT-PCR analysis showed that BACH2, like mouse Bach2, is expressed in primary B cells at the progenitor, precursor, immature, and mature B-cell stages. Mouse Bach2 is not expressed in plasma cells (Muto et al., 1998). Gel shift analysis showed that when overexpressed, BACH2 binds to MAF recognition elements (MARE). Overexpression also resulted in a loss of clonogenic activity. Southern blot analysis determined that BACH2 is a single-copy gene. BACH2/CA-1 microsatellite analysis indicated that loss of heterozygosity occurred in 5 of 25 non-Hodgkin lymphoma (OMIM Ref. No. 605027) patients.

Full details of the abovementioned studies are described in the following publications, the disclosure of which are hereby incorporated by reference:

Sasaki, S.; Ito, E.; Toki, T.; Maekawa, T.; Kanezaki, R.; Umenai, T.; Muto, A.; Nagai, H.; Kinoshita, T.; Yamamoto, M.; Inazawa, J.; Taketo, M. M.; Nakahata, T.; Igarashi, K.; Yokoyama, M.: Cloning and expression of human B cell-specific transcription factor BACH2 mapped to chromosome 6q15. Oncogene 19:3739-3749, 2000; and Muto, A.; Hoshino, H.; Madisen, L.; Yanai, N.; Obinata, M.; Karasuyama, H.; Hayashi, N.; Nakauchi, H.; Yamamoto, M.; Groudine, M.; Igarashi, K.: Identification of Bach2 as a B-cell-spe.

Further studies establishing the function and utilities of BACH2 are found in John Hopkins OMIM database record ID 605394, and in sited publications numbered 731 and 7312 listed in the bibliography section hereinbelow, which are also hereby incorporated by reference. Caspase 2, Apoptosis-related Cysteine Protease (neural precursor cell expressed, developmentally down-regulated 2) (CASP2, Accession NM_032982) is another VGAM331 host target gene. CASP2 BINDING SITE1 through CASP2 BINDING SITE4 are HOST TARGET binding sites found in untranslated regions of mRNA encoded by CASP2, corresponding to HOST TARGET binding sites such as BINDING SITE I, BINDING SITE II or BINDING SITE III. Table 2 illustrates the complementarity of the nucleotide sequences of CASP2 BINDING SITE1 through CASP2 BINDING SITE4, designated SEQ ID:26855, SEQ ID:26860, SEQ ID:26865 and SEQ ID:6892 respectively, to the nucleotide sequence of VGAM331 RNA, herein designated VGAM RNA, also designated SEQ ID:3042.

Another function of VGAM331 is therefore inhibition of Caspase 2, Apoptosis-related Cysteine Protease (neural precursor cell expressed, developmentally down-regulated 2) (CASP2, Accession NM_032982), a gene which involves in the activation cascade of caspases responsible for apoptosis execution. Accordingly, utilities of VGAM331 include diagnosis, prevention and treatment of diseases and clinical conditions associated with CASP2. The function of CASP2 and its association with various diseases and clinical conditions, has been established by previous studies, as described hereinabove with reference to VGAM148. H3 Histone, Family 3B (H3.3B) (H3F3B, Accession NM_005324) is another VGAM331 host target gene. H3F3B BINDING SITE is HOST TARGET binding site found in the 3' untranslated region of mRNA encoded by H3F3B, corresponding to a HOST TARGET binding site such as BINDING SITE I, BINDING SITE II or BINDING SITE III. Table 2 illustrates the complementarity of the nucleotide sequences of H3F3B BINDING SITE, designated SEQ ID:11797, to the nucleotide sequence of VGAM331 RNA, herein designated VGAM RNA, also designated SEQ ID:3042.

Another function of VGAM331 is therefore inhibition of H3 Histone, Family 3B (H3.3B) (H3F3B, Accession NM_005324). Accordingly, utilities of VGAM331 include diagnosis, prevention and treatment of diseases and clinical conditions associated with H3F3B. Insulin-like Growth Factor 2 Receptor (IGF2R, Accession NM_000876) is another VGAM331 host target gene. IGF2R BINDING SITE is HOST TARGET binding site found in the 3' untranslated region of mRNA encoded by IGF2R, corresponding to a HOST TARGET binding site such as BINDING SITE I, BINDING SITE II or BINDING SITE III. Table 2 illustrates the complementarity of the nucleotide sequences of IGF2R BINDING SITE, designated SEQ ID:6559, to the nucleotide sequence of VGAM331 RNA, herein designated VGAM RNA, also designated SEQ ID:3042.

Another function of VGAM331 is therefore inhibition of Insulin-like Growth Factor 2 Receptor (IGF2R, Accession NM_000876), a gene which transport of phosphorylated lysosomal enzymes from the golgi complex and the cell surface to lysosomes. lysosomal enzymes bearing phosphomannosyl residues bind specifically to mannose-6-phosphate receptors in the golgi apparatus and the resulting receptor-ligand complex is transported to an acidic prelyosomal compartment where the low ph mediates the dissociation of the complex. this receptor also binds insulin growth factor ii. Accordingly, utilities of VGAM331 include diagnosis, prevention and treatment of diseases and clinical conditions associated with IGF2R. The function of IGF2R and its association with various diseases and clinical conditions, has been established by previous studies, as described hereinabove with reference to VGAM209. Src Homology Three (SH3) and Cysteine Rich Domain (STAC, Accession NM_003149) is another VGAM331 host target gene. STAC BINDING SITE is HOST TARGET binding site found in the 3' untranslated region of mRNA encoded by STAC, corresponding to a HOST TARGET binding site such as BINDING SITE I, BINDING SITE II or BINDING SITE III. Table 2 illustrates the complementarity of the nucleotide sequences of STAC BINDING SITE, designated SEQ ID:9121, to the nucleotide sequence of VGAM331 RNA, herein designated VGAM RNA, also designated SEQ ID:3042.

Another function of VGAM331 is therefore inhibition of Src Homology Three (SH3) and Cysteine Rich Domain (STAC, Accession NM_003149), a gene which is probably involved in a neuron-specific signal transduction. Accordingly, utilities of VGAM331 include diagnosis, prevention and treatment of diseases and clinical conditions associated with STAC. The function of STAC has been established by previous studies. RLGS-M (restriction landmark genomic scanning using methylation-sensitive endonuclease) is a method for scanning the methylation status of large sections of a genome. Using RLGS-M to scan mouse brain genomic DNA from various developmental stages, Suzuki et al. (1996) found a tissue-specific gel spot whose intensity changed developmentally. The gene corresponding to this spot, which they termed Stac (for Src homology 3 and cysteine-rich domains), encodes a predicted 403-amino acid protein. The mouse Stac gene was used to clone human STAC from a fetal brain cDNA library. The predicted 402-amino acid STAC protein is 83% identical to that of mouse. Suzuki et al. (1996) noted that cysteine-rich and SH3 domains are frequently found in signal transduction proteins, and suggested that STAC may play a role in the neuron-specific signal transduction pathway. Kawai et al. (1998) mapped the human STAC gene to 3p24-p22 using PCR of a radiation hybrid panel. The mouse Stac gene was mapped by interspecific backcross analysis to the distal portion of chromosome 9, in a region syntenic with human chromosome 3p21.

Full details of the abovementioned studies are described in the following publications, the disclosure of which are hereby incorporated by reference:

Kawai, J.; Suzuki, H.; Hara, A.; Hirose, K.; Watanabe, S.: Human and mouse chromosomal mapping of Stac, a neuron-specific protein with an SH3 domain. Genomics 47:140-142, 1998; and Suzuki, H.; Kawai, J.; Taga, C.; Yaoi, T.; Hara, A.; Hirose, K.; Hayashizaki, Y.; Watanabe, S.: Stac, a novel neuron-specific protein with cysteine-rich and SH3 domains. Biochem. Bioph.

Further studies establishing the function and utilities of STAC are found in John Hopkins OMIM database record ID 602317, and in sited publications numbered 6297-6298 listed in the bibliography section hereinbelow, which are also hereby incorporated by reference. Zinc Finger Protein 264 (ZNF264, Accession NM_003417) is another VGAM331 host target gene. ZNF264 BINDING SITE is HOST TARGET binding site found in the 3' untranslated region of mRNA encoded by ZNF264, corresponding to a HOST TARGET binding site such as BINDING SITE I, BINDING SITE II or BINDING SITE III. Table 2 illustrates the complementarity of the nucleotide sequences of ZNF264 BINDING SITE, designated SEQ ID:9462, to the nucleotide sequence of VGAM331 RNA, herein designated VGAM RNA, also designated SEQ ID:3042.

Another function of VGAM331 is therefore inhibition of Zinc Finger Protein 264 (ZNF264, Accession NM_003417). Accordingly, utilities of VGAM331 include diagnosis, prevention and treatment of diseases and clinical conditions associated with ZNF264. Butyrophilin, Subfamily 3, Member A1 (BTN3A1, Accession NM_007048) is another VGAM331 host target gene. BTN3A1 BINDING SITE is HOST TARGET binding site found in the 3' untranslated region of mRNA encoded by BTN3A1, corresponding to a HOST TARGET binding site such as BINDING SITE I, BINDING SITE II or BINDING SITE III. Table 2 illustrates the complementarity of the nucleotide sequences of BTN3A1 BINDING SITE, designated SEQ ID:13922, to the nucleotide sequence of VGAM331 RNA, herein designated VGAM RNA, also designated SEQ ID:3042.

Another function of VGAM331 is therefore inhibition of Butyrophilin, Subfamily 3, Member A1 (BTN3A1, Accession NM_007048). Accordingly, utilities of VGAM331 include diagnosis, prevention and treatment of diseases and clinical conditions associated with BTN3A1. Chromosome 13 Open Reading Frame 1 (C13orf1, Accession NM_020456) is another VGAM331 host target gene. C13orf1 BINDING SITE is HOST TARGET binding site found in the 3' untranslated region of mRNA encoded by C13orf1, corresponding to a HOST TARGET binding site such as BINDING SITE I, BINDING SITE II or BINDING SITE III. Table 2 illustrates the complementarity of the nucleotide sequences of C13orf1 BINDING SITE, designated SEQ ID:21694, to the nucleotide sequence of VGAM331 RNA, herein designated VGAM RNA, also designated SEQ ID:3042.

Another function of VGAM331 is therefore inhibition of Chromosome 13 Open Reading Frame 1 (C13orf1, Accession NM_020456). Accordingly, utilities of VGAM331 include diagnosis, prevention and treatment of diseases and clinical conditions associated with C13orf1. Cyclin M1 (CNNM1, Accession NM_020348) is another VGAM331 host target gene. CNNM1 BINDING SITE is HOST TARGET binding site found in the 3' untranslated region of mRNA encoded by CNNM1, corresponding to a HOST TARGET binding site such as BINDING SITE I, BINDING SITE II or BINDING SITE III. Table 2 illustrates the complementarity of the nucleotide sequences of CNNM1 BINDING SITE, designated SEQ ID:21613, to the nucleotide sequence of VGAM331 RNA, herein designated VGAM RNA, also designated SEQ ID:3042.

Another function of VGAM331 is therefore inhibition of Cyclin M1 (CNNM1, Accession NM_020348). Accordingly, utilities of VGAM331 include diagnosis, prevention and treatment of diseases and clinical conditions associated with CNNM1. FLJ12960 (Accession NM_024638) is another VGAM331 host target gene. FLJ12960 BINDING SITE is HOST TARGET binding site found in the 3' untranslated region of mRNA encoded by FLJ12960, corresponding to a HOST TARGET binding site such as BINDING SITE I, BINDING SITE II or BINDING SITE III. Table 2 illustrates the complementarity of the nucleotide sequences of FLJ12960 BINDING SITE, designated SEQ ID:23920, to the nucleotide sequence of VGAM331 RNA, herein designated VGAM RNA, also designated SEQ ID:3042.

Another function of VGAM331 is therefore inhibition of FLJ12960 (Accession NM_024638). Accordingly, utilities of VGAM331 include diagnosis, prevention and treatment of diseases and clinical conditions associated with FLJ12960. FLJ20813 (Accession NM_017961) is another VGAM331 host target gene. FLJ20813 BINDING SITE is HOST TARGET binding site found in the 3' untranslated region of mRNA encoded by FLJ20813, corresponding to a HOST TARGET binding site such as BINDING SITE I, BINDING SITE II or BINDING SITE III. Table 2 illustrates the complementarity of the nucleotide sequences of FLJ20813 BINDING SITE, designated SEQ ID:19679, to the nucleotide sequence of VGAM331 RNA, herein designated VGAM RNA, also designated SEQ ID:3042.

Another function of VGAM331 is therefore inhibition of FLJ20813 (Accession NM_017961). Accordingly, utilities of VGAM331 include diagnosis, prevention and treatment of diseases and clinical conditions associated with FLJ20813.

FLJ31101 (Accession NM_017964) is another VGAM331 host target gene. FLJ31101 BINDING SITE is HOST TARGET binding site found in the 3' untranslated region of mRNA encoded by FLJ31101, corresponding to a HOST TARGET binding site such as BINDING SITE I, BINDING SITE II or BINDING SITE III. Table 2 illustrates the complementarity of the nucleotide sequences of FLJ31101 BINDING SITE, designated SEQ ID:19686, to the nucleotide sequence of VGAM331 RNA, herein designated VGAM RNA, also designated SEQ ID:3042.

Another function of VGAM331 is therefore inhibition of FLJ31101 (Accession NM_017964). Accordingly, utilities of VGAM331 include diagnosis, prevention and treatment of diseases and clinical conditions associated with FLJ31101. General Transcription Factor IIE, Polypeptide 1, Alpha 56kDa (GTF2E1, Accession NM_005513) is another VGAM331 host target gene. GTF2E1 BINDING SITE is HOST TARGET binding site found in the 3' untranslated region of mRNA encoded by GTF2E1, corresponding to a HOST TARGET binding site such as BINDING SITE I, BINDING SITE II or BINDING SITE III. Table 2 illustrates the complementarity of the nucleotide sequences of GTF2E1 BINDING SITE, designated SEQ ID:12037, to the nucleotide sequence of VGAM331 RNA, herein designated VGAM RNA, also designated SEQ ID:3042.

Another function of VGAM331 is therefore inhibition of General Transcription Factor IIE, Polypeptide 1, Alpha 56 kDa (GTF2E1, Accession NM_005513). Accordingly, utilities of VGAM331 include diagnosis, prevention and treatment of diseases and clinical conditions associated with GTF2E1. HSPC065 (Accession NM_014157) is another VGAM331 host target gene. HSPC065 BINDING SITE is HOST TARGET binding site found in the 3' untranslated region of mRNA encoded by HSPC065, corresponding to a HOST TARGET binding site such as BINDING SITE I, BINDING SITE II or BINDING SITE III. Table 2 illustrates the complementarity of the nucleotide sequences of HSPC065 BINDING SITE, designated SEQ ID:15455, to the nucleotide sequence of VGAM331 RNA, herein designated VGAM RNA, also designated SEQ ID:3042.

Another function of VGAM331 is therefore inhibition of HSPC065 (Accession NM_014157). Accordingly, utilities of VGAM331 include diagnosis, prevention and treatment of diseases and clinical conditions associated with HSPC065. KIAA0450 (Accession NM_014638) is another VGAM331 host target gene. KIAA0450 BINDING SITE is HOST TARGET binding site found in the 5' untranslated region of mRNA encoded by KIAA0450, corresponding to a HOST TARGET binding site such as BINDING SITE I, BINDING SITE II or BINDING SITE III. Table 2 illustrates the complementarity of the nucleotide sequences of KIAA0450 BINDING SITE, designated SEQ ID:16037, to the nucleotide sequence of VGAM331 RNA, herein designated VGAM RNA, also designated SEQ ID:3042.

Another function of VGAM331 is therefore inhibition of KIAA0450 (Accession NM_014638). Accordingly, utilities of VGAM331 include diagnosis, prevention and treatment of diseases and clinical conditions associated with KIAA0450. KIAA1143 (Accession XM_044014) is another VGAM331 host target gene. KIAA1143 BINDING SITE is HOST TARGET binding site found in the 3' untranslated region of mRNA encoded by KIAA1143, corresponding to a HOST TARGET binding site such as BINDING SITE I, BINDING SITE II or BINDING SITE III. Table 2 illustrates the complementarity of the nucleotide sequences of KIAA1143 BINDING SITE, designated SEQ ID:34077, to the nucleotide sequence of VGAM331 RNA, herein designated VGAM RNA, also designated SEQ ID:3042.

Another function of VGAM331 is therefore inhibition of KIAA1143 (Accession XM_044014). Accordingly, utilities of VGAM331 include diagnosis, prevention and treatment of diseases and clinical conditions associated with KIAA1143. PRO0365 (Accession NM_014126) is another VGAM331 host target gene. PRO0365 BINDING SITE is HOST TARGET binding site found in the 5' untranslated region of mRNA encoded by PRO0365, corresponding to a HOST TARGET binding site such as BINDING SITE I, BINDING SITE II or BINDING SITE III. Table 2 illustrates the complementarity of the nucleotide sequences of PRO0365 BINDING SITE, designated SEQ ID:15390, to the nucleotide sequence of VGAM331 RNA, herein designated VGAM RNA, also designated SEQ ID:3042.

Another function of VGAM331 is therefore inhibition of PRO0365 (Accession NM_014126). Accordingly, utilities of VGAM331 include diagnosis, prevention and treatment of diseases and clinical conditions associated with PRO0365. RAB33B, Member RAS Oncogene Family (RAB33B, Accession NM_031296) is another VGAM331 host target gene. RAB33B BINDING SITE is HOST TARGET binding site found in the 3' untranslated region of mRNA encoded by RAB33B, corresponding to a HOST TARGET binding site such as BINDING SITE I, BINDING SITE II or BINDING SITE III. Table 2 illustrates the complementarity of the nucleotide sequences of RAB33B BINDING SITE, designated SEQ ID:25332, to the nucleotide sequence of VGAM331 RNA, herein designated VGAM RNA, also designated SEQ ID:3042.

Another function of VGAM331 is therefore inhibition of RAB33B, Member RAS Oncogene Family (RAB33B, Accession NM_031296). Accordingly, utilities of VGAM331 include diagnosis, prevention and treatment of diseases and clinical conditions associated with RAB33B. TUCAN (Accession NM_014959) is another VGAM331 host target gene. TUCAN BINDING SITE is HOST TARGET binding site found in the 3' untranslated region of mRNA encoded by TUCAN, corresponding to a HOST TARGET binding site such as BINDING SITE I, BINDING SITE II or BINDING SITE III. Table 2 illustrates the complementarity of the nucleotide sequences of TUCAN BINDING SITE, designated SEQ ID:17319, to the nucleotide sequence of VGAM331 RNA, herein designated VGAM RNA, also designated SEQ ID:3042.

Another function of VGAM331 is therefore inhibition of TUCAN (Accession NM_014959). Accordingly, utilities of VGAM331 include diagnosis, prevention and treatment of diseases and clinical conditions associated with TUCAN. LOC130535 (Accession XM_072244) is another VGAM331 host target gene. LOC130535 BINDING SITE is HOST TARGET binding site found in the 3' untranslated region of mRNA encoded by LOC130535, corresponding to a HOST TARGET binding site such as BINDING SITE I, BINDING SITE II or BINDING SITE III. Table 2 illustrates the complementarity of the nucleotide sequences of LOC130535 BINDING SITE, designated SEQ ID:37478, to the nucleotide sequence of VGAM331 RNA, herein designated VGAM RNA, also designated SEQ ID:3042.

Another function of VGAM331 is therefore inhibition of LOC130535 (Accession XM_072244). Accordingly, utilities of VGAM331 include diagnosis, prevention and treatment of diseases and clinical conditions associated with LOC130535. LOC143879 (Accession XM_084666) is another VGAM331 host target gene. LOC143879 BINDING SITE is HOST TARGET binding site found in the 5' untranslated region of mRNA encoded by LOC143879, corresponding to a HOST TARGET binding site such as BINDING SITE I, BINDING SITE II or BINDING SITE III. Table 2 illustrates the complementarity of the nucleotide sequences of LOC143879 BINDING SITE, designated SEQ ID:37660, to the nucleotide sequence of VGAM331 RNA, herein designated VGAM RNA, also designated SEQ ID:3042.

Another function of VGAM331 is therefore inhibition of LOC143879 (Accession XM_084666). Accordingly, utilities of VGAM331 include diagnosis, prevention and treatment of diseases and clinical conditions associated with LOC143879. LOC146854 (Accession XM_085618) is another VGAM331 host target gene. LOC146854 BINDING SITE is HOST TARGET binding site found in the 5' untranslated region of mRNA encoded by LOC146854, corresponding to a HOST TARGET binding site such as BINDING SITE I, BINDING SITE II or BINDING SITE III. Table 2 illustrates the complementarity of the nucleotide sequences of LOC146854 BINDING SITE, designated SEQ ID:38255, to the nucleotide sequence of VGAM331 RNA, herein designated VGAM RNA, also designated SEQ ID:3042.

Another function of VGAM331 is therefore inhibition of LOC146854 (Accession XM_085618). Accordingly, utilities of VGAM331 include diagnosis, prevention and treatment of diseases and clinical conditions associated with LOC146854. LOC146909 (Accession XM_085634) is another VGAM331 host target gene. LOC146909 BINDING SITE is HOST TARGET binding site found in the 3' untranslated region of mRNA encoded by LOC146909, corresponding to a HOST TARGET binding site such as BINDING SITE I, BINDING SITE II or BINDING SITE III. Table 2 illustrates the complementarity of the nucleotide sequences of LOC146909 BINDING SITE, designated SEQ ID:38269, to the nucleotide sequence of VGAM331 RNA, herein designated VGAM RNA, also designated SEQ ID:3042.

Another function of VGAM331 is therefore inhibition of LOC146909 (Accession XM_085634). Accordingly, utilities of VGAM331 include diagnosis, prevention and treatment of diseases and clinical conditions associated with LOC146909. LOC169693 (Accession XM_108998) is another VGAM331 host target gene. LOC169693 BINDING SITE is HOST TARGET binding site found in the 3' untranslated region of mRNA encoded by LOC169693, corresponding to a HOST TARGET binding site such as BINDING SITE I, BINDING SITE II or BINDING SITE III. Table 2 illustrates the complementarity of the nucleotide sequences of LOC169693 BINDING SITE, designated SEQ ID:42208, to the nucleotide sequence of VGAM331 RNA, herein designated VGAM RNA, also designated SEQ ID:3042.

Another function of VGAM331 is therefore inhibition of LOC169693 (Accession XM_108998). Accordingly, utilities of VGAM331 include diagnosis, prevention and treatment of diseases and clinical conditions associated with LOC169693. LOC200014 (Accession XM_114087) is another VGAM331 host target gene. LOC200014 BINDING SITE is HOST TARGET binding site found in the 3' untranslated region of mRNA encoded by LOC200014, corresponding to a HOST TARGET binding site such as BINDING SITE I, BINDING SITE II or BINDING SITE III. Table 2 illustrates the complementarity of the nucleotide sequences of LOC200014 BINDING SITE, designated SEQ ID:42694, to the nucleotide sequence of VGAM331 RNA, herein designated VGAM RNA, also designated SEQ ID:3042.

Another function of VGAM331 is therefore inhibition of LOC200014 (Accession XM_114087). Accordingly, utilities of VGAM331 include diagnosis, prevention and treatment of diseases and clinical conditions associated with LOC200014.

LOC55893 (Accession NM_018660) is another VGAM331 host target gene. LOC55893 BINDING SITE is HOST TARGET binding site found in the 5' untranslated region of mRNA encoded by LOC55893, corresponding to a HOST TARGET binding site such as BINDING SITE I, BINDING SITE II or BINDING SITE III. Table 2 illustrates the complementarity of the nucleotide sequences of LOC55893 BINDING SITE, designated SEQ ID:20731, to the nucleotide sequence of VGAM331 RNA, herein designated VGAM RNA, also designated SEQ ID:3042.

Another function of VGAM331 is therefore inhibition of LOC55893 (Accession NM_018660). Accordingly, utilities of VGAM331 include diagnosis, prevention and treatment of diseases and clinical conditions associated with LOC55893. LOC89919 (Accession XM_027244) is another VGAM331 host target gene. LOC89919 BINDING SITE is HOST TARGET binding site found in the 3' untranslated region of mRNA encoded by LOC89919, corresponding to a HOST TARGET binding site such as BINDING SITE I, BINDING SITE II or BINDING SITE III. Table 2 illustrates the complementarity of the nucleotide sequences of LOC89919 BINDING SITE, designated SEQ ID:30465, to the nucleotide sequence of VGAM331 RNA, herein designated VGAM RNA, also designated SEQ ID:3042.

Another function of VGAM331 is therefore inhibition of LOC89919 (Accession XM_027244). Accordingly, utilities of VGAM331 include diagnosis, prevention and treatment of diseases and clinical conditions associated with LOC89919. FIG. 1 further provides a conceptual description of a novel bioinformatically detected viral gene of the present invention, referred to here as Viral Genomic Address Messenger 332 (VGAM332) viral gene, which modulates expression of respective host target genes thereof, the function and utility of which host target genes is known in the art.

VGAM332 is a novel bioinformatically detected regulatory, non protein coding, viral micro RNA (miRNA) gene. The method by which VGAM332 was detected is described hereinabove with reference to FIGS. 1-8.

VGAM332 gene, herein designated VGAM GENE, is a viral gene contained in the genome of Human Herpesvirus 3. VGAM332 host target gene, herein designated VGAM HOST TARGET GENE, is a human gene contained in the human genome.

VGAM332 gene encodes a VGAM332 precursor RNA, herein designated VGAM PRECURSOR RNA. Similar to other miRNA genes, and unlike most ordinary genes, VGAM332 precursor RNA does not encode a protein. A nucleotide sequence identical or highly similar to the nucleotide sequence of VGAM332 precursor RNA is designated SEQ ID:318, and is provided hereinbelow with reference to the sequence listing part. Nucleotide sequence SEQ ID:318 is located at position 86054 relative to the genome of Human Herpesvirus 3.

VGAM332 precursor RNA folds onto itself, forming VGAM332 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM332 folded precursor RNA into VGAM332 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM332 RNA is designated SEQ ID:3043, and is provided hereinbelow with reference to the sequence listing part.

VGAM332 host target gene, herein designated VGAM HOST TARGET GENE, encodes a corresponding messenger RNA, VGAM332 host target RNA, herein designated VGAM HOST TARGET RNA. VGAM332 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM332 RNA, herein designated VGAM RNA, binds complementarily to one or more host target binding sites located in untranslated regions of VGAM332 host target RNA, herein designated VGAM HOST TARGET RNA. This complementary binding is due to the fact that the nucleotide sequence of VGAM332 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM332 RNA, herein designated VGAM RNA, may have a different number of host target binding sites in untranslated regions of a VGAM332 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM332 RNA, herein designated VGAM RNA, to host target binding sites on VGAM332 host target RNA, herein designated VGAM HOST TARGET RNA, such as BINDING SITE I, BINDING SITE II and BINDING SITE III, inhibits translation of VGAM332 host target RNA into VGAM332 host target protein, herein designated VGAM HOST TARGET PROTEIN. VGAM host target protein is therefore outlined by a broken line.

It is appreciated that VGAM332 host target gene, herein designated VGAM HOST TARGET GENE, in fact represents a plurality of VGAM332 host target genes. The mRNA of each one of this plurality of VGAM332 host target genes comprises one or more host target binding sites, each having a nucleotide sequence which is at least partly complementary to VGAM332 RNA, herein designated VGAM RNA, and which when bound by VGAM332 RNA causes inhibition of translation of respective one or more VGAM332 host target proteins.

It is further appreciated by one skilled in the art that the mode of translational inhibition illustrated by FIG. 1 with specific reference to translational inhibition exerted by VGAM332 gene, herein designated VGAM GENE, on one or more VGAM332 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM332 is inhibition of expression of host target genes, as part of a novel viral mechanism of attacking a host. Accordingly, utilities of VGAM332 include diagnosis, prevention and treatment of viral infection by Human Herpesvirus 3. Specific functions, and accordingly utilities, of VGAM332 correlate with, and may be deduced from, the identity of the host target genes which VGAM332 binds and inhibits, and the function of these host target genes, as elaborated hereinbelow.

Nucleotide sequences of the VGAM332 precursor RNA, herein designated VGAM PRECURSOR RNA, and of the 'diced' VGAM332 RNA, herein designated VGAM RNA, and a schematic representation of the secondary folding of VGAM332 folded precursor RNA, herein designated VGAM FOLDED PRECURSOR RNA, of VGAM332 are further described hereinbelow with reference to Table 1.

Nucleotide sequences of host target binding sites, such as BINDING SITE-I, BINDING SITE-II and BINDING SITE-III of FIG. 1, found on VGAM332 host target RNA, and schematic representation of the complementarity of each of these host target binding sites to VGAM332 RNA, herein designated VGAM RNA, are described hereinbelow with reference to Table 2.

As mentioned hereinabove with reference to FIG. 1, a function of VGAM332 gene, herein designated VGAM is inhibition of expression of VGAM332 target genes. It is appreciated that specific functions, and accordingly utilities, of VGAM332 correlate with, and may be deduced from, the identity of the target genes which VGAM332 binds and inhibits, and the function of these target genes, as elaborated hereinbelow.

LOC56926 (Accession XM_052629) is a VGAM332 host target gene. LOC56926 BINDING SITE is HOST TARGET binding site found in the 5' untranslated region of mRNA encoded by LOC56926, corresponding to a HOST TARGET binding site such as BINDING SITE I, BINDING SITE II or BINDING SITE III. Table 2 illustrates the complementarity of the nucleotide sequences of LOC56926 BINDING SITE, designated SEQ ID:36041, to the nucleotide sequence of VGAM332 RNA, herein designated VGAM RNA, also designated SEQ ID:3043.

A function of VGAM332 is therefore inhibition of LOC56926 (Accession XM_052629). Accordingly, utilities of VGAM332 include diagnosis, prevention and treatment of diseases and clinical conditions associated with LOC56926. FIG. 1 further provides a conceptual description of a novel bioinformatically detected viral gene of the present invention, referred to here as Viral Genomic Address Messenger 333 (VGAM333) viral gene, which modulates expression of respective host target genes thereof, the function and utility of which host target genes is known in the art.

VGAM333 is a novel bioinformatically detected regulatory, non protein coding, viral micro RNA (miRNA) gene. The method by which VGAM333 was detected is described hereinabove with reference to FIGS. 1-8.

VGAM333 gene, herein designated VGAM GENE, is a viral gene contained in the genome of Human Herpesvirus 3. VGAM333 host target gene, herein designated VGAM HOST TARGET GENE, is a human gene contained in the human genome.

VGAM333 gene encodes a VGAM333 precursor RNA, herein designated VGAM PRECURSOR RNA. Similar to other miRNA genes, and unlike most ordinary genes, VGAM333 precursor RNA does not encode a protein. A nucleotide sequence identical or highly similar to the nucleotide sequence of VGAM333 precursor RNA is designated SEQ ID:319, and is provided hereinbelow with reference to the sequence listing part. Nucleotide sequence SEQ ID:319 is located at position 97703 relative to the genome of Human Herpesvirus 3.

VGAM333 precursor RNA folds onto itself, forming VGAM333 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM333 folded precursor RNA into VGAM333 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM333 RNA is designated SEQ ID:3044, and is provided hereinbelow with reference to the sequence listing part.

VGAM333 host target gene, herein designated VGAM HOST TARGET GENE, encodes a corresponding messenger RNA, VGAM333 host target RNA, herein designated VGAM HOST TARGET RNA. VGAM333 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM333 RNA, herein designated VGAM RNA, binds complementarily to one or more host target binding sites located in untranslated regions of VGAM333 host target RNA, herein designated VGAM HOST TARGET RNA. This complementary binding is due to the fact that the nucleotide sequence of VGAM333 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM333 RNA, herein designated VGAM RNA, may have a different number of host target binding sites in untranslated regions of a VGAM333 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM333 RNA, herein designated VGAM RNA, to host target binding sites on VGAM333 host target RNA, herein designated VGAM HOST TARGET RNA, such as BINDING SITE I, BINDING SITE II and BINDING SITE III, inhibits translation of VGAM333 host target RNA into VGAM333 host target protein, herein designated VGAM HOST TARGET PROTEIN. VGAM host target protein is therefore outlined by a broken line.

It is appreciated that VGAM333 host target gene, herein designated VGAM HOST TARGET GENE, in fact represents a plurality of VGAM333 host target genes. The mRNA of each one of this plurality of VGAM333 host target genes comprises one or more host target binding sites, each having a nucleotide sequence which is at least partly complementary to VGAM333 RNA, herein designated VGAM RNA, and which when bound by VGAM333 RNA causes inhibition of translation of respective one or more VGAM333 host target proteins.

It is further appreciated by one skilled in the art that the mode of translational inhibition illustrated by FIG. 1 with specific reference to translational inhibition exerted by VGAM333 gene, herein designated VGAM GENE, on one or more VGAM333 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM333 is inhibition of expression of host target genes, as part of a novel viral mechanism of attacking a host. Accordingly, utilities of VGAM333 include diagnosis, prevention and treatment of viral infection by Human Herpesvirus 3. Specific functions, and accordingly utilities, of VGAM333 correlate with, and may be deduced from, the identity of the host target genes which VGAM333 binds and inhibits, and the function of these host target genes, as elaborated hereinbelow.

Nucleotide sequences of the VGAM333 precursor RNA, herein designated VGAM PRECURSOR RNA, and of the 'diced' VGAM333 RNA, herein designated VGAM RNA, and a schematic representation of the secondary folding of VGAM333 folded precursor RNA, herein designated VGAM FOLDED PRECURSOR RNA, of VGAM333 are further described hereinbelow with reference to Table 1.

Nucleotide sequences of host target binding sites, such as BINDING SITE-I, BINDING SITE-II and BINDING SITE-III of FIG. 1, found on VGAM333 host target RNA, and schematic representation of the complementarity of each of these host target binding sites to VGAM333 RNA, herein designated VGAM RNA, are described hereinbelow with reference to Table 2.

As mentioned hereinabove with reference to FIG. 1, a function of VGAM333 gene, herein designated VGAM is inhibition of expression of VGAM333 target genes. It is appreciated that specific functions, and accordingly utilities, of VGAM333 correlate with, and may be deduced from, the identity of the target genes which VGAM333 binds and inhibits, and the function of these target genes, as elaborated hereinbelow.

GR6 (Accession NM_007354) is a VGAM333 host target gene. GR6 BINDING SITE is HOST TARGET binding site found in the 3' untranslated region of mRNA encoded by GR6, corresponding to a HOST TARGET binding site such as BINDING SITE I, BINDING SITE II or BINDING SITE III. Table 2 illustrates the complementarity of the nucleotide sequences of GR6 BINDING SITE, designated SEQ ID:14278, to the nucleotide sequence of VGAM333 RNA, herein designated VGAM RNA, also designated SEQ ID:3044.

A function of VGAM333 is therefore inhibition of GR6 (Accession NM_007354). Accordingly, utilities of VGAM333 include diagnosis, prevention and treatment of diseases and clinical conditions associated with GR6. Interleukin Enhancer Binding Factor 3, 90 kDa (ILF3, Accession NM_004516) is another VGAM333 host target gene. ILF3 BINDING SITE is HOST TARGET binding site found in the 3' untranslated region of mRNA encoded by ILF3, corresponding to a HOST TARGET binding site such as BINDING SITE I, BINDING SITE II or BINDING SITE III. Table 2 illustrates the complementarity of the nucleotide sequences of ILF3 BINDING SITE, designated SEQ ID:10845, to the nucleotide sequence of VGAM333 RNA, herein designated VGAM RNA, also designated SEQ ID:3044.

Another function of VGAM333 is therefore inhibition of Interleukin Enhancer Binding Factor 3, 90 kDa (ILF3, Accession NM_004516). Accordingly, utilities of VGAM333 include diagnosis, prevention and treatment of diseases and clinical conditions associated with ILF3. KIAA1841 (Accession XM_087056) is another VGAM333 host target gene. KIAA1841 BINDING SITE is HOST TARGET binding site found in the 3' untranslated region of mRNA encoded by KIAA1841, corresponding to a HOST TARGET binding site such as BINDING SITE I, BINDING SITE II or BINDING SITE III. Table 2 illustrates the complementarity of the nucleotide sequences of KIAA1841 BINDING SITE, designated SEQ ID:39027, to the nucleotide sequence of VGAM333 RNA, herein designated VGAM RNA, also designated SEQ ID:3044.

Another function of VGAM333 is therefore inhibition of KIAA1841 (Accession XM_087056). Accordingly, utilities of VGAM333 include diagnosis, prevention and treatment of diseases and clinical conditions associated with KIAA1841. pcnp (Accession NM_020357) is another VGAM333 host target gene. pcnp BINDING SITE is HOST TARGET binding site found in the 3" untranslated region of mRNA encoded by pcnp, corresponding to a HOST TARGET binding site such as BINDING SITE I, BINDING SITE II or BINDING SITE III. Table 2 illustrates the complementarity of the nucleotide sequences of pcnp BINDING SITE, designated SEQ ID:21625, to the nucleotide sequence of VGAM333 RNA, herein designated VGAM RNA, also designated SEQ ID:3044.

Another function of VGAM333 is therefore inhibition of pcnp (Accession NM_020357). Accordingly, utilities of VGAM333 include diagnosis, prevention and treatment of diseases and clinical conditions associated with pcnp. Wingless-type MMTV Integration Site Family, Member 16 (WNT16, Accession NM_057168) is another VGAM333 host target gene. WNT16 BINDING SITE1 and WNT16 BINDING SITE2 are HOST TARGET binding sites found in untranslated regions of mRNA encoded by WNT16, corresponding to HOST TARGET binding sites such as BINDING SITE I, BINDING SITE II or BINDING SITE III. Table 2 illustrates the complementarity of the nucleotide sequences of WNT16 BINDING SITE1 and WNT16 BINDING SITE2, designated SEQ ID:27673 and SEQ ID:18169 respectively, to the nucleotide sequence of VGAM333 RNA, herein designated VGAM RNA, also designated SEQ ID:3044.

Another function of VGAM333 is therefore inhibition of Wingless-type MMTV Integration Site Family, Member 16 (WNT16, Accession NM_057168). Accordingly, utilities of VGAM333 include diagnosis, prevention and treatment of diseases and clinical conditions associated with WNT16. LOC139770 (Accession XM_060053) is another VGAM333 host target gene. LOC139770 BINDING SITE is HOST TARGET binding site found in the 3' untranslated region of mRNA encoded by LOC139770, corresponding to a HOST TARGET binding site such as BINDING SITE I, BINDING SITE II or BINDING SITE III. Table 2 illustrates the complementarity of the nucleotide sequences of LOC139770 BINDING SITE, designated SEQ ID:37147, to the nucleotide sequence of VGAM333 RNA, herein designated VGAM RNA, also designated SEQ ID:3044.

Another function of VGAM333 is therefore inhibition of LOC139770 (Accession XM_060053). Accordingly, utilities of VGAM333 include diagnosis, prevention and treatment of diseases and clinical conditions associated with LOC139770. FIG. 1 further provides a conceptual description of a novel bioinformatically detected viral gene of the present invention, referred to here as Viral Genomic Address Messenger 334 (VGAM334) viral gene, which modulates expression of respective host target genes thereof, the function and utility of which host target genes is known in the art.

VGAM334 is a novel bioinformatically detected regulatory, non protein coding, viral micro RNA (miRNA) gene. The method by which VGAM334 was detected is described hereinabove with reference to FIGS. 1-8.

VGAM334 gene, herein designated VGAM GENE, is a viral gene contained in the genome of Human Herpesvirus 3. VGAM334 host target gene, herein designated VGAM HOST TARGET GENE, is a human gene contained in the human genome.

VGAM334 gene encodes a VGAM334 precursor RNA, herein designated VGAM PRECURSOR RNA. Similar to other miRNA genes, and unlike most ordinary genes, VGAM334 precursor RNA does not encode a protein. A nucleotide sequence identical or highly similar to the nucleotide sequence of VGAM334 precursor RNA is designated SEQ ID:320, and is provided hereinbelow with reference to the sequence listing part. Nucleotide sequence SEQ ID:320 is located at position 97885 relative to the genome of Human Herpesvirus 3.

VGAM334 precursor RNA folds onto itself, forming VGAM334 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM334 folded precursor RNA into VGAM334 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 86%) nucleotide sequence of VGAM334 RNA is designated SEQ ID:3045, and is provided hereinbelow with reference to the sequence listing part.

VGAM334 host target gene, herein designated VGAM HOST TARGET GENE, encodes a corresponding messenger RNA, VGAM334 host target RNA, herein designated VGAM HOST TARGET RNA. VGAM334 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM334 RNA, herein designated VGAM RNA, binds complementarily to one or more host target binding sites located in untranslated regions of VGAM334 host target RNA, herein designated VGAM HOST TARGET RNA. This complementary binding is due to the fact that the nucleotide sequence of VGAM334 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM334 RNA, herein designated VGAM RNA, may have a different number of host target binding sites in untranslated regions of a VGAM334 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM334 RNA, herein designated VGAM RNA, to host target binding sites on VGAM334 host target RNA, herein designated VGAM HOST TARGET RNA, such as BINDING SITE I, BINDING SITE II and BINDING SITE III, inhibits translation of VGAM334 host target RNA into VGAM334 host target protein, herein designated VGAM HOST TARGET PROTEIN. VGAM host target protein is therefore outlined by a broken line.

It is appreciated that VGAM334 host target gene, herein designated VGAM HOST TARGET GENE, in fact represents a plurality of VGAM334 host target genes. The mRNA of each one of this plurality of VGAM334 host target genes comprises one or more host target binding sites, each having a nucleotide sequence which is at least partly complementary to VGAM334 RNA, herein designated VGAM RNA, and which when bound by VGAM334 RNA causes inhibition of translation of respective one or more VGAM334 host target proteins.

It is further appreciated by one skilled in the art that the mode of translational inhibition illustrated by FIG. 1 with specific reference to translational inhibition exerted by VGAM334 gene, herein designated VGAM GENE, on one or more VGAM334 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM334 is inhibition of expression of host target genes, as part of a novel viral mechanism of attacking a host. Accordingly, utilities of VGAM334 include diagnosis, prevention and treatment of viral infection by Human Herpesvirus 3. Specific functions, and accordingly utilities, of VGAM334 correlate with, and may be deduced from, the identity of the host target genes which VGAM334 binds and inhibits, and the function of these target genes, as elaborated hereinbelow.

Nucleotide sequences of the VGAM334 precursor RNA, herein designated VGAM PRECURSOR RNA, and of the 'diced' VGAM334 RNA, herein designated VGAM RNA, and a schematic representation of the secondary folding of VGAM334 folded precursor RNA, herein designated VGAM FOLDED PRECURSOR RNA, of VGAM334 are further described hereinbelow with reference to Table 1.

Nucleotide sequences of host target binding sites, such as BINDING SITE-I, BINDING SITE-II and BINDING SITE-III of FIG. 1, found on VGAM334 host target RNA, and schematic representation of the complementarity of each of these host target binding sites to VGAM334 RNA, herein designated VGAM RNA, are described hereinbelow with reference to Table 2.

As mentioned hereinabove with reference to FIG. 1, a function of VGAM334 gene, herein designated VGAM is inhibition of expression of VGAM334 target genes. It is appreciated that specific functions, and accordingly utilities, of VGAM334 correlate with, and may be deduced from, the identity of the target genes which VGAM334 binds and inhibits, and the function of these target genes, as elaborated hereinbelow.

ATPase, Class I, Type 8B, Member 2 (ATP8B2, Accession XM_036933) is a VGAM334 host target gene. ATP8B2 BINDING SITE is HOST TARGET binding site found in the 3' untranslated region of mRNA encoded by ATP8B2, corresponding to a HOST TARGET binding site such as BINDING SITE I, BINDING SITE II or BINDING SITE III. Table 2 illustrates the complementarity of the nucleotide sequences of ATP8B2 BINDING SITE, designated SEQ ID:32518, to the nucleotide sequence of VGAM334 RNA, herein designated VGAM RNA, also designated SEQ ID:3045.

A function of VGAM334 is therefore inhibition of ATPase, Class I, Type 8B, Member 2 (ATP8B2, Accession XM_036933). Accordingly, utilities of VGAM334 include diagnosis, prevention and treatment of diseases and clinical conditions associated with ATP8B2. Very Low Density Lipoprotein Receptor (VLDLR, Accession XM_045386) is another VGAM334 host target gene. VLDLR BINDING SITE is HOST TARGET binding site found in the 3' untranslated region of mRNA encoded by VLDLR, corresponding to a HOST TARGET binding site such as BINDING SITE I, BINDING SITE II or BINDING SITE III. Table 2 illustrates the complementarity of the nucleotide sequences of VLDLR BINDING SITE, designated SEQ ID:34449, to the nucleotide sequence of VGAM334 RNA, herein designated VGAM RNA, also designated SEQ ID:3045.

Another function of VGAM334 is therefore inhibition of Very Low Density Lipoprotein Receptor (VLDLR, Accession XM_045386), a gene which may play a crucial role in triglyceride metabolism. Accordingly, utilities of VGAM334 include diagnosis, prevention and treatment of diseases and clinical conditions associated with VLDLR. The function of VLDLR and its association with various diseases and clinical conditions, has been established by previous studies, as described hereinabove with reference to VGAM103. KIAA1026 (Accession XM_048825) is another VGAM334 host target gene. KIAA1026 BINDING SITE is HOST TARGET binding site found in the 3' untranslated region of mRNA encoded by KIAA1026, corresponding to a HOST TARGET binding site such as BINDING SITE I, BINDING SITE II or BINDING SITE III. Table 2 illustrates the complementarity of the nucleotide sequences of KIAA1026 BINDING SITE, designated SEQ ID:35273, to the nucleotide sequence of VGAM334 RNA, herein designated VGAM RNA, also designated SEQ ID:3045.

Another function of VGAM334 is therefore inhibition of KIAA1026 (Accession XM_048825). Accordingly, utilities of VGAM334 include diagnosis, prevention and treatment of diseases and clinical conditions associated with KIAA1026. LOC135818 (Accession XM_059804) is another VGAM334 host target gene. LOC135818 BINDING SITE is HOST TARGET binding site found in the 3' untranslated region of mRNA encoded by LOC135818, corresponding to a HOST TARGET binding site such as BINDING SITE I, BINDING SITE II or BINDING SITE III. Table 2 illustrates the complementarity of the nucleotide sequences of LOC135818 BINDING SITE, designated SEQ ID:37094, to the nucleotide sequence of VGAM334 RNA, herein designated VGAM RNA, also designated SEQ ID:3045.

Another function of VGAM334 is therefore inhibition of LOC135818 (Accession XM_059804). Accordingly, utilities of VGAM334 include diagnosis, prevention and treatment of diseases and clinical conditions associated with LOC135818. FIG. 1 further provides a conceptual description of a novel bioinformatically detected viral gene of the present invention, referred to here as Viral Genomic Address Messenger 335 (VGAM335) viral gene, which modulates expression of respective host target genes thereof, the function and utility of which host target genes is known in the art.

VGAM335 is a novel bioinformatically detected regulatory, non protein coding, viral micro RNA (miRNA) gene. The method by which VGAM335 was detected is described hereinabove with reference to FIGS. 1-8.

VGAM335 gene, herein designated VGAM GENE, is a viral gene contained in the genome of Saimiriine Herpesvirus 2. VGAM335 host target gene, herein designated VGAM HOST TARGET GENE, is a human gene contained in the human genome.

VGAM335 gene encodes a VGAM335 precursor RNA, herein designated VGAM PRECURSOR RNA. Similar to other miRNA genes, and unlike most ordinary genes, VGAM335 precursor RNA does not encode a protein. A nucleotide sequence identical or highly similar to the nucleotide sequence of VGAM335 precursor RNA is designated SEQ ID:321, and is provided hereinbelow with reference to the sequence listing part. Nucleotide sequence SEQ ID:321 is located at position 23128 relative to the genome of Saimiriine Herpesvirus 2.

VGAM335 precursor RNA folds onto itself, forming VGAM335 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM335 folded precursor RNA into VGAM335 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM335 RNA is designated SEQ ID:3046, and is provided hereinbelow with reference to the sequence listing part.

VGAM335 host target gene, herein designated VGAM HOST TARGET GENE, encodes a corresponding messenger RNA, VGAM335 host target RNA, herein designated VGAM HOST TARGET RNA. VGAM335 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM335 RNA, herein designated VGAM RNA, binds complementarily to one or more host target binding sites located in untranslated regions of VGAM335 host target RNA, herein designated VGAM HOST TARGET RNA. This complementary binding is due to the fact that the nucleotide sequence of VGAM335 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM335 RNA, herein designated VGAM RNA, may have a different number of host target binding sites in untranslated regions of a VGAM335 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM335 RNA, herein designated VGAM RNA, to host target binding sites on VGAM335 host target RNA, herein designated VGAM HOST TARGET RNA, such as BINDING SITE I, BINDING SITE II and BINDING SITE III, inhibits translation of VGAM335 host target RNA into VGAM335 host target protein, herein designated VGAM HOST TARGET PROTEIN. VGAM host target protein is therefore outlined by a broken line.

It is appreciated that VGAM335 host target gene, herein designated VGAM HOST TARGET GENE, in fact represents a plurality of VGAM335 host target genes. The mRNA of each one of this plurality of VGAM335 host target genes comprises one or more host target binding sites, each having a nucleotide sequence which is at least partly complementary to VGAM335 RNA, herein designated VGAM RNA, and which when bound by VGAM335 RNA causes inhibition of translation of respective one or more VGAM335 host target proteins.

It is further appreciated by one skilled in the art that the mode of translational inhibition illustrated by FIG. 1 with specific reference to translational inhibition exerted by VGAM335 gene, herein designated VGAM GENE, on one or more VGAM335 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM335 is inhibition of expression of host target genes, as part of a novel viral mechanism of attacking a host. Accordingly, utilities of VGAM335 include diagnosis, prevention and treatment of viral infection by Saimiriine Herpesvirus 2. Specific functions, and accordingly utilities, of VGAM335 correlate with, and may be deduced from, the identity of the host target genes which VGAM335 binds and inhibits, and the function of these host target genes, as elaborated hereinbelow.

Nucleotide sequences of the VGAM335 precursor RNA, herein designated VGAM PRECURSOR RNA, and of the 'diced' VGAM335 RNA, herein designated VGAM RNA, and a schematic representation of the secondary folding of VGAM335 folded precursor RNA, herein designated VGAM FOLDED PRECURSOR RNA, of VGAM335 are further described hereinbelow with reference to Table 1.

Nucleotide sequences of host target binding sites, such as BINDING SITE-I, BINDING SITE-II and BINDING SITE-III of FIG. 1, found on VGAM335 host target RNA, and schematic representation of the complementarity of each of these host target binding sites to VGAM335 RNA, herein designated VGAM RNA, are described hereinbelow with reference to Table 2.

As mentioned hereinabove with reference to FIG. 1, a function of VGAM335 gene, herein designated VGAM is inhibition of expression of VGAM335 target genes. It is appreciated that specific functions, and accordingly utilities, of VGAM335 correlate with, and may be deduced from, the identity of the target genes which VGAM335 binds and inhibits, and the function of these target genes, as elaborated hereinbelow.

Cytochrome P450, Subfamily I (aromatic compound-inducible), Polypeptide 1 (CYP1A1, Accession NM_000499) is a VGAM335 host target gene. CYP1A1 BINDING SITE is HOST TARGET binding site found in the 3' untranslated region of mRNA encoded by CYP1A1, corresponding to a HOST TARGET binding site such as BINDING SITE I, BINDING SITE II or BINDING SITE III. Table 2 illustrates the complementarity of the nucleotide sequences of CYP1A1 BINDING SITE, designated SEQ ID:6114, to the nucleotide sequence of VGAM335 RNA, herein designated VGAM RNA, also designated SEQ ID:3046.

A function of VGAM335 is therefore inhibition of Cytochrome P450, Subfamily I (aromatic compound-inducible), Polypeptide 1 (CYP1A1, Accession NM_000499), a gene which intervenes in an NADPH-dependent electron transport pathway. Accordingly, utilities of VGAM335 include diagnosis, prevention and treatment of diseases and clinical conditions associated with CYP1A1. The function of CYP1A1 has been established by previous studies. Polycyclic aromatic hydrocarbons (PAHs) generated from the combustion of fossil fuels, and aromatic amines, which are present in cigarette smoke and other environmental media, present 2 classic environmental carcinogens. Perera (1997) reviewed evidence on variation and susceptibility to the effects of these carcinogens. CYP1A1 encodes a phase I cytochrome P450 enzyme that metabolizes PAHs such as benzo[a]pyrene (BP). About 10% of Caucasians have a highly inducible form of the enzyme that is associated with an increased risk of lung cancer in smokers. Although not all studies have been positive, in Japanese and certain Caucasian populations, increased lung cancer risk was correlated with 1 or both CYP1A1 polymorphisms: the so called MSPI polymorphism and the closely-linked exon 7 (isoleucine-valine) polymorphism (Kawajiri et al., 1996; Nakachi et al., 1991; Xu et al., 1996). The greatest incremental lung cancer risk from the 'susceptible' CYP1A1 genotype was seen in light smokers (7 times the risk of light smokers without the genotype), whereas heavy smokers with this genotype had less than twice the risk of heavy smokers without the genotype. The proposed mechanism for the increased risk is higher CYP1A1 inducibility or enhanced catalytic activity of the valine-type CYP1A1 enzyme. Consistent with these mechanisms, Mooney et al. (1997) found that U. S. smoking volunteers with the exon 7 mutation had more PAH-DNA adducts in their white blood cells than did smokers without the variant. Perera (1997) stated that PAH-DNA adducts were also elevated in cord blood and placenta of newborns with the CYP1A1 MSP1 polymorphism, which suggested that the genetic polymorphism may increase risk from transplacental PAH exposure. In lung tissue of adults, adduct concentration correlated with CYP1A1 expression or enzyme activity. Perera (1997) noted that lung tumors of Japanese smokers were found to be significantly more likely to have p53 (OMIM Ref. No. 191170) mutations if they had the susceptible CYP1A1 genotype. A failure to demonstrate genetic susceptibility through CYP1A1 polymorphism when exposure to the environmental carcinogen is heavy is observed with some other polymorphisms and carcinogenic exposures. It is possible that at higher exposures, the effects of the genetic traits are overwhelmed by the environmental insults. Numerous studies have shown that maternal cigarette smoking during pregnancy is associated with reduced birthweight and increased risk of low birthweight, defined as weight less than 2,500 g. Maternal cigarette smoking has thus been identified as the single largest modifiable risk factor for intrauterine growth restriction in developed countries. However, not all women who smoke cigarettes during pregnancy have low-birth-weight infants. Wang et al. (2002) studied whether the association between maternal cigarette smoking and infant birthweight differs by polymorphisms of 2 maternal metabolic genes: CYP1A1 and GSTT1 (OMIM Ref. No. 600436). The CYP1A1 polymorphism was the Msp1 polymorphism (AA vs Aa and aa); the GSTT1 polymorphism was present versus absent. Wang et al. (2002) found that regardless of genotype, continuous maternal smoking during pregnancy was associated with a mean reduction of 377 g in birthweight. They found that for the CYP1A1 genotype, the estimated reduction in birthweight was 252 g for the AA genotype group, but was 520 g for the Aa/aa genotype group. For the GSTT1 genotype, they found the estimated reduction in birthweight was 285 g and 642 g for the present and absent genotype groups, respectively. When both CYP1A1 and GSTT1 genotypes were considered, Wang et al. (2002) found the greatest reduction in birthweight among smoking mothers with the CYP1A1 Aa/aa and GSTT1 absent genotypes. Among mothers who had not smoked during their pregnancy or during the 3 months prior to their pregnancy, genotype did not independently confer an adverse effect. Animal model experiments lend further support to the function of CYP1A1. Thum and Borlak (2000) investigated the gene expression of major human cytochrome P450 genes in various regions of explanted hearts from 6 patients with dilated cardiomyopathy and 1 with transposition of the arterial trunk and 2 samples of normal heart. mRNA for cytochrome 1A1 was predominantly expressed in the right ventricle. A strong correlation between tissue-specific gene expression and enzyme activity was found. Thum and Borlak (2000) concluded that their findings showed that expression of genes for cytochrome P450 monooxgenases and verapamil metabolism are found predominantly in the right side of the heart, and suggested that this observation may explain the lack of efficacy of certain cardioselective drugs.

It is appreciated that the abovementioned animal model for CYP1A1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Corchero, J.; Pimprale, S.; Kimura, S.; Gonzalez, F. J.: Organization of the CYP1A cluster on human chromosome 15: implications for gene regulation. Pharmacogenetics 11:1-6, 2001; and Petersen, D. D.; McKinney, C. E.; Ikeya, K.; Smith, H. H.; Bale, A. E.; McBride, O. W.; Nebert, D. W.: Human CYP1A1 gene: cosegregation of the enzyme inducibility phenotype and an RFL.

Further studies establishing the function and utilities of CYP1A1 are found in John Hopkins OMIM database record ID 108330, and in sited publications numbered 12082-12087, 788, 848-852, 11777-861, 12760, 12761-86 and 3429-869 listed in the bibliography section hereinbelow, which are also hereby incorporated by reference. Protein Phosphatase 2, Regulatory Subunit B (B56), Gamma Isoform (PPP2R5C, Accession NM_002719) is another VGAM335 host target gene. PPP2R5C BINDING SITE is HOST TARGET binding site found in the 3' untranslated region of mRNA encoded by PPP2R5C, corresponding to a HOST TARGET binding site such as BINDING SITE I, BINDING SITE II or BINDING SITE III. Table 2 illustrates the complementarity of the nucleotide sequences of PPP2R5C BINDING SITE, designated SEQ ID:8588, to the nucleotide sequence of VGAM335 RNA, herein designated VGAM RNA, also designated SEQ ID:3046.

Another function of VGAM335 is therefore inhibition of Protein Phosphatase 2, Regulatory Subunit B (B56), Gamma Isoform (PPP2R5C, Accession NM_002719), a gene which is a regulatory subunit of protein phosphatase 2A. Accordingly, utilities of VGAM335 include diagnosis, prevention and treatment of diseases and clinical conditions associated with PPP2R5C. The function of PPP2R5C has been established by previous studies. Protein phosphorylation is a regulatory mechanism commonly employed in cellular processes such as cell cycle progression, growth factor signaling, and cell transformation. Protein phosphatase 2A (PP2A), a heterotrimeric serine/threonine phosphatase, has been implicated in a variety of regulatory processes including cell growth and division, muscle contraction, and gene transcription. PP2A is a trimeric enzyme composed of a catalytic subunit (OMIM Ref. No. 176915), a structural subunit, and any of several different regulatory subunits which control its specificity. One family of related PP2A regulatory subunits is designated the B56 family and contains at least 5 different members (McCright and Virshup (1995)). The alpha (OMIM Ref. No. 601643) and gamma subunits are expressed at highest levels in skeletal and cardiac muscle. Both the delta (OMIM Ref. No. 601646) and gamma subunits encode nuclear phosphoproteins and at least 3 splice variants of the gamma subunit have been reported. The longest gamma isoform is a phosphoprotein, but the shortest is not.

Full details of the abovementioned studies are described in the following publications, the disclosure of which are hereby incorporated by reference:

McCright, B.; Brothman, A. R.; Virshup, D. M.: Assignment of human protein phosphatase 2A regulatory subunit genes B56-alpha, B56-beta, B56-gamma, B56-delta, and B56-epsilon (PPP2R5A--PPP2R5E), highly expressed in muscle and brain, to chromosome regions 1q41, 11q12, 3p21, 6p21.1, and 7p11.2-to-p12. Genomics 36:168-170, 1996; and McCright, B.; Virshup, D. M.: Identification of a new family of protein phosphatase 2A regulatory subunits. J. Biol. Chem. 270:26123-26128, 1995.

Further studies establishing the function and utilities of PPP2R5C are found in John Hopkins OMIM database record ID 601645, and in sited publications numbered 6687-668 and 6554 listed in the bibliography section hereinbelow, which are also hereby incorporated by reference. ALDH9 (Accession NM_000696) is another VGAM335 host target gene. ALDH9 BINDING SITE is HOST TARGET binding site found in the 3' untranslated region of mRNA encoded by ALDH9, corresponding to a HOST TARGET binding site such as BINDING SITE I, BINDING SITE II or BINDING SITE III. Table 2 illustrates the complementarity of the nucleotide sequences of ALDH9 BINDING SITE, designated SEQ ID:6360, to the nucleotide sequence of VGAM335 RNA, herein designated VGAM RNA, also designated SEQ ID:3046.

Another function of VGAM335 is therefore inhibition of ALDH9 (Accession NM_000696). Accordingly, utilities of VGAM335 include diagnosis, prevention and treatment of diseases and clinical conditions associated with ALDH9. Basic Helix-loop-helix Domain Containing, Class B, 2 (BHLHB2, Accession NM_003670) is another VGAM335 host target gene. BHLHB2 BINDING SITE is HOST TARGET binding site found in the 3' untranslated region of mRNA encoded by BHLHB2, corresponding to a HOST TARGET binding site such as BINDING SITE I, BINDING SITE II or BINDING SITE III. Table 2 illustrates the complementarity of the nucleotide sequences of BHLHB2 BINDING SITE, designated SEQ ID:9753, to the nucleotide sequence of VGAM335 RNA, herein designated VGAM RNA, also designated SEQ ID:3046.

Another function of VGAM335 is therefore inhibition of Basic Helix-loop-helix Domain Containing, Class B, 2 (BHLHB2, Accession NM_003670). Accordingly, utilities of VGAM335 include diagnosis, prevention and treatment of diseases and clinical conditions associated with BHLHB2. Chromosome 21 Open Reading Frame 41 (C21orf41, Accession NM_138332) is another VGAM335 host target gene. C21orf41 BINDING SITE is HOST TARGET binding site found in the 3' untranslated region of mRNA encoded by C21orf41, corresponding to a HOST TARGET binding site such as BINDING SITE I, BINDING SITE II or BINDING SITE III. Table 2 illustrates the complementarity of the nucleotide sequences of C21orf41 BINDING SITE, designated SEQ ID:28732, to the nucleotide sequence of VGAM335 RNA, herein designated VGAM RNA, also designated SEQ ID:3046.

Another function of VGAM335 is therefore inhibition of Chromosome 21 Open Reading Frame 41 (C21orf41, Accession NM_138332). Accordingly, utilities of VGAM335 include diagnosis, prevention and treatment of diseases and clinical conditions associated with C21orf41. DKFZP564D206 (Accession XM_166501) is another VGAM335 host target gene. DKFZP564D206 BINDING SITE is HOST TARGET binding site found in the 3' untranslated region of mRNA encoded by DKFZP564D206, corresponding to a HOST TARGET binding site such as BINDING SITE I, BINDING SITE II or BINDING SITE III. Table 2 illustrates the complementarity of the nucleotide sequences of DKFZP564D206 BINDING SITE, designated SEQ ID:44428, to the nucleotide sequence of VGAM335 RNA, herein designated VGAM RNA, also designated SEQ ID:3046.

Another function of VGAM335 is therefore inhibition of DKFZP564D206 (Accession XM_166501). Accordingly, utilities of VGAM335 include diagnosis, prevention and treatment of diseases and clinical conditions associated with DKFZP564D206. DKFZP761D0211 (Accession NM_032039) is another VGAM335 host target gene. DKFZP761D0211 BINDING SITE is HOST TARGET binding site found in the 3' untranslated region of mRNA encoded by DKFZP761D0211, corresponding to a HOST TARGET binding site such as BINDING SITE I, BINDING SITE II or BINDING SITE III. Table 2 illustrates the complementarity of the nucleotide sequences of DKFZP761D0211 BINDING SITE, designated SEQ ID:25737, to the nucleotide sequence of VGAM335 RNA, herein designated VGAM RNA, also designated SEQ ID:3046.

Another function of VGAM335 is therefore inhibition of DKFZP761D0211 (Accession NM_032039). Accordingly, utilities of VGAM335 include diagnosis, prevention and treatment of diseases and clinical conditions associated with DKFZP761D0211. FLJ12649 (Accession NM_024597) is another VGAM335 host target gene. FLJ12649 BINDING SITE is HOST TARGET binding site found in the 3' untranslated region of mRNA encoded by FLJ12649, corresponding to a HOST TARGET binding site such as BINDING SITE I, BINDING SITE II or BINDING SITE III. Table 2 illustrates the complementarity of the nucleotide sequences of FLJ12649 BINDING SITE, designated SEQ ID:23834, to the nucleotide sequence of VGAM335 RNA, herein designated VGAM RNA, also designated SEQ ID:3046.

Another function of VGAM335 is therefore inhibition of FLJ12649 (Accession NM_024597). Accordingly, utilities of VGAM335 include diagnosis, prevention and treatment of diseases and clinical conditions associated with FLJ12649. FLJ13441 (Accession NM_023924) is another VGAM335 host target gene. FLJ13441 BINDING SITE is HOST TARGET binding site found in the 3' untranslated region of mRNA encoded by FLJ13441, corresponding to a HOST TARGET binding site such as BINDING SITE I, BINDING SITE II or BINDING SITE III. Table 2 illustrates the complementarity of the nucleotide sequences of FLJ13441 BINDING SITE, designated SEQ ID:23399, to the nucleotide sequence of VGAM335 RNA, herein designated VGAM RNA, also designated SEQ ID:3046.

Another function of VGAM335 is therefore inhibition of FLJ13441 (Accession NM_023924). Accordingly, utilities of VGAM335 include diagnosis, prevention and treatment of diseases and clinical conditions associated with FLJ13441. MGC2306 (Accession NM_032638) is another VGAM335 host target gene. MGC2306 BINDING SITE is HOST TARGET binding site found in the 3' untranslated region of mRNA encoded by MGC2306, corresponding to a HOST TARGET binding site such as BINDING SITE I, BINDING SITE II or BINDING SITE III. Table 2 illustrates the complementarity of the nucleotide sequences of MGC2306 BINDING SITE, designated SEQ ID:26357, to the nucleotide sequence of VGAM335 RNA, herein designated VGAM RNA, also designated SEQ ID:3046.

Another function of VGAM335 is therefore inhibition of MGC2306 (Accession NM_032638). Accordingly, utilities of VGAM335 include diagnosis, prevention and treatment of diseases and clinical conditions associated with MGC2306. MGC26684 (Accession NM_144568) is another VGAM335 host target gene. MGC26684 BINDING SITE is HOST TARGET binding site found in the 3' untranslated region of mRNA encoded by MGC26684, corresponding to a HOST TARGET binding site such as BINDING SITE I, BINDING SITE II or BINDING SITE III. Table 2 illustrates the complementarity of the nucleotide sequences of MGC26684 BINDING SITE, designated SEQ ID:29372, to the nucleotide sequence of VGAM335 RNA, herein designated VGAM RNA, also designated SEQ ID:3046.

Another function of VGAM335 is therefore inhibition of MGC26684 (Accession NM_144568). Accordingly, utilities of VGAM335 include diagnosis, prevention and treatment of diseases and clinical conditions associated with MGC26684. SCYA28 (Accession NM_019846) is another VGAM335 host target gene. SCYA28 BINDING SITE is HOST TARGET binding site found in the 3' untranslated region of mRNA encoded by SCYA28, corresponding to a HOST TARGET binding site such as BINDING SITE I, BINDING SITE II or BINDING SITE III. Table 2 illustrates the complementarity of the nucleotide sequences of SCYA28 BINDING SITE, designated SEQ ID:21250, to the nucleotide sequence of VGAM335 RNA, herein designated VGAM RNA, also designated SEQ ID:3046.

Another function of VGAM335 is therefore inhibition of SCYA28 (Accession NM_019846). Accordingly, utilities of VGAM335 include diagnosis, prevention and treatment of diseases and clinical conditions associated with SCYA28. LOC152627 (Accession XM_087495) is another VGAM335 host target gene. LOC152627 BINDING SITE is HOST TARGET binding site found in the 5' untranslated region of mRNA encoded by LOC152627, corresponding to a HOST TARGET binding site such as BINDING SITE I, BINDING SITE II or BINDING SITE III. Table 2 illustrates the complementarity of the nucleotide sequences of LOC152627 BINDING SITE, designated SEQ ID:39298, to the nucleotide sequence of VGAM335 RNA, herein designated VGAM RNA, also designated SEQ ID:3046.

Another function of VGAM335 is therefore inhibition of LOC152627 (Accession XM_087495). Accordingly, utilities of VGAM335 include diagnosis, prevention and treatment of diseases and clinical conditions associated with LOC152627. LOC153937 (Accession XM_087813) is another VGAM335 host target gene. LOC153937 BINDING SITE is HOST TARGET binding site found in the 5' untranslated region of mRNA encoded by LOC153937, corresponding to a HOST TARGET binding site such as BINDING SITE I, BINDING SITE II or BINDING SITE III. Table 2 illustrates the complementarity of the nucleotide sequences of LOC153937 BINDING SITE, designated SEQ ID:39448, to the nucleotide sequence of VGAM335 RNA, herein designated VGAM RNA, also designated SEQ ID:3046.

Another function of VGAM335 is therefore inhibition of LOC153937 (Accession XM_087813). Accordingly, utilities of VGAM335 include diagnosis, prevention and treatment of diseases and clinical conditions associated with LOC153937. LOC200609 (Accession XM_117256) is another VGAM335 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43335, to the nucleotide sequence of VGAM335 RNA, herein designated VGAM RNA, also designated SEQ ID:3046.

Another function of VGAM335 is therefore inhibition of LOC200609 (Accession XM_117256). Accordingly, utilities of VGAM335 include diagnosis, prevention and treatment of diseases and clinical conditions associated with LOC200609. LOC92249 (Accession XM_043814) is another VGAM335 host target gene. LOC92249 BINDING SITE is HOST TARGET binding site found in the 3' untranslated region of mRNA encoded by LOC92249, corresponding to a HOST TARGET binding site such as BINDING SITE I, BINDING SITE II or BINDING SITE III. Table 2 illustrates the complementarity of the nucleotide sequences of LOC92249 BINDING SITE, designated SEQ ID:34025, to the nucleotide sequence of VGAM335 RNA, herein designated VGAM RNA, also designated SEQ ID:3046.

Another function of VGAM335 is therefore inhibition of LOC92249 (Accession XM_043814). Accordingly, utilities of VGAM335 include diagnosis, prevention and treatment of diseases and clinical conditions associated with LOC92249. FIG. 1 further provides a conceptual description of a novel bioinformatically detected viral gene of the present invention, referred to here as Viral Genomic Address Messenger 336 (VGAM336) viral gene, which modulates expression of respective host target genes thereof, the function and utility of which host target genes is known in the art.

VGAM336 is a novel bioinformatically detected regulatory, non protein coding, viral micro RNA (miRNA) gene. The method by which VGAM336 was detected is described hereinabove with reference to FIGS. 1-8.

VGAM336 gene, herein designated VGAM GENE, is a viral gene contained in the genome of Saimiriine Herpesvirus 2. VGAM336 host target gene, herein designated VGAM HOST TARGET GENE, is a human gene contained in the human genome.

VGAM336 gene encodes a VGAM336 precursor RNA, herein designated VGAM PRECURSOR RNA. Similar to other miRNA genes, and unlike most ordinary genes, VGAM336 precursor RNA does not encode a protein. A nucleotide sequence identical or highly similar to the nucleotide sequence of VGAM336 precursor RNA is designated SEQ ID:322, and is provided hereinbelow with reference to the sequence listing part. Nucleotide sequence SEQ ID:322 is located at position 23007 relative to the genome of Saimiriine Herpesvirus 2.

VGAM336 precursor RNA folds onto itself, forming VGAM336 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM336 folded precursor RNA into VGAM336 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM336 RNA is designated SEQ ID:3047, and is provided hereinbelow with reference to the sequence listing part.

VGAM336 host target gene, herein designated VGAM HOST TARGET GENE, encodes a corresponding messenger RNA, VGAM336 host target RNA, herein designated VGAM HOST TARGET RNA. VGAM336 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM336 RNA, herein designated VGAM RNA, binds complementarily to one or more host target binding sites located in untranslated regions of VGAM336 host target RNA, herein designated VGAM HOST TARGET RNA. This complementary binding is due to the fact that the nucleotide sequence of VGAM336 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM336 RNA, herein designated VGAM RNA, may have a different number of host target binding sites in untranslated regions of a VGAM336 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM336 RNA, herein designated VGAM RNA, to host target binding sites on VGAM336 host target RNA, herein designated VGAM HOST TARGET RNA, such as BINDING SITE I, BINDING SITE II and BINDING SITE III, inhibits translation of VGAM336 host target RNA into VGAM336 host target protein, herein designated VGAM HOST TARGET PROTEIN. VGAM host target protein is therefore outlined by a broken line.

It is appreciated that VGAM336 host target gene, herein designated VGAM HOST TARGET GENE, in fact represents a plurality of VGAM336 host target genes. The mRNA of each one of this plurality of VGAM336 host target genes comprises one or more host target binding sites, each having a nucleotide sequence which is at least partly complementary to VGAM336 RNA, herein designated VGAM RNA, and which when bound by VGAM336 RNA causes inhibition of translation of respective one or more VGAM336 host target proteins.

It is further appreciated by one skilled in the art that the mode of translational inhibition illustrated by FIG. 1 with specific reference to translational inhibition exerted by VGAM336 gene, herein designated VGAM GENE, on one or more VGAM336 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM336 is inhibition of expression of host target genes, as part of a novel viral mechanism of attacking a host. Accordingly, utilities of VGAM336 include diagnosis, prevention and treatment of viral infection by Saimiriine Herpesvirus 2. Specific functions, and accordingly utilities, of VGAM336 correlate with, and may be deduced from, the identity of the host target genes which VGAM336 binds and inhibits, and the function of these host target genes, as elaborated hereinbelow.

Nucleotide sequences of the VGAM336 precursor RNA, herein designated VGAM PRECURSOR RNA, and of the 'diced' VGAM336 RNA, herein designated VGAM RNA, and a schematic representation of the secondary folding of VGAM336 folded precursor RNA, herein designated VGAM FOLDED PRECURSOR RNA, of VGAM336 are further described hereinbelow with reference to Table 1.

Nucleotide sequences of host target binding sites, such as BINDING SITE-I, BINDING SITE-II and BINDING SITE-III of FIG. 1, found on VGAM336 host target RNA, and schematic representation of the complementarity of each of these host target binding sites to VGAM336 RNA, herein designated VGAM RNA, are described hereinbelow with reference to Table 2.

As mentioned hereinabove with reference to FIG. 1, a function of VGAM336 gene, herein designated VGAM is inhibition of expression of VGAM336 target genes. It is appreciated that specific functions, and accordingly utilities, of VGAM336 correlate with, and may be deduced from, the identity of the target genes which VGAM336 binds and inhibits, and the function of these target genes, as elaborated hereinbelow.

ATP-binding Cassette, Sub-family A (ABC1), Member 3 (ABCA3, Accession NM_001089) is a VGAM336 host target gene. ABCA3 BINDING SITE is HOST TARGET binding site found in the 5' untranslated region of mRNA encoded by ABCA3, corresponding to a HOST TARGET binding site such as BINDING SITE I, BINDING SITE II or BINDING SITE III. Table 2 illustrates the complementarity of the nucleotide sequences of ABCA3 BINDING SITE, designated SEQ ID:6745, to the nucleotide sequence of VGAM336 RNA, herein designated VGAM RNA, also designated SEQ ID:3047.

A function of VGAM336 is therefore inhibition of ATP-binding Cassette, Sub-family A (ABC1), Member 3 (ABCA3, Accession NM_001089), a gene which may be a transporter, may act as an efflux pump for chemotherapeutics drugs. Accordingly, utilities of VGAM336 include diagnosis, prevention and treatment of diseases and clinical conditions associated with ABCA3. The function of ABCA3 has been established by previous studies. Klugbauer and Hofmann (1996) isolated cDNA clones encoding a novel protein they designated ABC-C from a human medullary thyroid cancer cell line. ABC-C has typical structural features of the ABC transporter family (see OMIM Ref. No. 600046). They determined that the transporter consists of a 1,704-amino acid polypeptide with 2 homologous repeats, each harboring 6 putative transmembrane helices and an ATP-binding cassette motif. The ABC-C protein showed approximately 50% homology with the MRP1 (OMIM Ref. No. 158343) protein. Klugbauer and Hofmann (1996) mapped the ABC-C gene (also symbolized ABC3) to chromosome 16p13.3 by comparison with an identical cDNA clone mapping to that chromosomal region. They noted that the ABC-C gene and the gene encoding MRP1 map within the same chromosomal band. Wu and Horvitz (1998) found that the C. elegans protein ced-7 is homologous to human ABC3. Ced-7 functions in the engulfment of cell corpses during programmed cell death, is broadly expressed during embryogenesis, and is localized to the plasma membrane. Mosaic analysis revealed that ced-7 functions in both dying cells and engulfing cells during the engulfment process. Wu and Horvitz (1998) proposed that ced-7 functions to translocate molecules that mediate homotypic adhesion between the cell surfaces of the dying and engulfing cells. They also suggested that ABC3 may be functionally similar and that the molecular mechanism underlying cell corpse engulfment during programmed cell death may be conserved from nematodes to mammals.

Full details of the abovementioned studies are described in the following publications, the disclosure of which are hereby incorporated by reference:

Klugbauer, N.; Hofmann, F.: Primary structure of a novel ABC transporter with a chromosomal localization on the band encoding the multidrug resistance-associated protein. FEBS Lett. 391:61-65, 1996; and Wu, Y.-C.; Horvitz, H. R.: The C. elegans cell corpse engulfment gene ced-7 encodes a protein similar to ABC transporters. Cell 93:951-960, 1998.

Further studies establishing the function and utilities of ABCA3 are found in John Hopkins OMIM database record ID 601615, and in sited publications numbered 1246-1248 listed in the bibliography section hereinbelow, which are also hereby incorporated by reference. Brain and Acute Leukemia, Cytoplasmic (BAALC, Accession NM_024812) is another VGAM336 host target gene. BAALC BINDING SITE is HOST TARGET binding site found in the 5' untranslated region of mRNA encoded by BAALC, corresponding to a HOST TARGET binding site such as BINDING SITE I, BINDING SITE II or BINDING SITE III. Table 2 illustrates the complementarity of the nucleotide sequences of BAALC BINDING SITE, designated SEQ ID:24193, to the nucleotide sequence of VGAM336 RNA, herein designated VGAM RNA, also designated SEQ ID:3047.

Another function of VGAM336 is therefore inhibition of Brain and Acute Leukemia, Cytoplasmic (BAALC, Accession NM_024812). Accordingly, utilities of VGAM336 include diagnosis, prevention and treatment of diseases and clinical conditions associated with BAALC. Coagulation Factor VII (serum prothrombin conversion accelerator) (F7, Accession NM_000131) is another VGAM336 host target gene. F7 BINDING SITE1 and F7 BINDING SITE2 are HOST TARGET binding sites found in untranslated regions of mRNA encoded by F7, corresponding to HOST TARGET binding sites such as BINDING SITE I, BINDING SITE II or BINDING SITE III. Table 2 illustrates the complementarity of the nucleotide sequences of F7 BINDING SITE1 and F7 BINDING SITE2, designated SEQ ID:5609 and SEQ ID:21238 respectively, to the nucleotide sequence of VGAM336 RNA, herein designated VGAM RNA, also designated SEQ ID:3047.

Another function of VGAM336 is therefore inhibition of Coagulation Factor VII (serum prothrombin conversion accelerator) (F7, Accession NM_000131). Accordingly, utilities of VGAM336 include diagnosis, prevention and treatment of diseases and clinical conditions associated with F7. Lymphoid Enhancer-binding Factor 1 (LEF1, Accession NM_016269) is another VGAM336 host target gene. LEF1 BINDING SITE is HOST TARGET binding site found in the 3' untranslated region of mRNA encoded by LEF1, corresponding to a HOST TARGET binding site such as BINDING SITE I, BINDING SITE II or BINDING SITE III. Table 2 illustrates the complementarity of the nucleotide sequences of LEF1 BINDING SITE, designated SEQ ID:18390, to the nucleotide sequence of VGAM336 RNA, herein designated VGAM RNA, also designated SEQ ID:3047.

Another function of VGAM336 is therefore inhibition of Lymphoid Enhancer-binding Factor 1 (LEF1, Accession NM_016269), a gene which plays an essential role in the formation of several organs and structures that require inductive tissue interactions. Accordingly, utilities of VGAM336 include diagnosis, prevention and treatment of diseases and clinical conditions associated with LEF1. The function of LEF1 and its association with various diseases and clinical conditions, has been established by previous studies, as described hereinabove with reference to VGAM200. Nuclear Receptor Subfamily 1, Group I, Member 2 (NR1I2, Accession NM_003889) is another VGAM336 host target gene. NR1I2 BINDING SITE is HOST TARGET binding site found in the 5' untranslated region of mRNA encoded by NR1I2, corresponding to a HOST TARGET binding site such as BINDING SITE I, BINDING SITE II or BINDING SITE III. Table 2 illustrates the complementarity of the nucleotide sequences of NR1I2 BINDING SITE, designated SEQ ID:9971, to the nucleotide sequence of VGAM336 RNA, herein designated VGAM RNA, also designated SEQ ID:3047.

Another function of VGAM336 is therefore inhibition of Nuclear Receptor Subfamily 1, Group I, Member 2 (NR1I2, Accession NM_003889), a gene which binds to a response element in the cyp3a4 gene promoter and activates its expression in response to a wide variety of endobiotics and xenobiotics. Accordingly, utilities of VGAM336 include diagnosis, prevention and treatment of diseases and clinical conditions associated with NR1I2. The function of NR1I2 has been established by previous studies. Lehmann et al. (1998) identified a nuclear receptor, termed PXR, that binds to the rifampicin/dexamethasone response element in the CYP3A4 (OMIM Ref. No. 124010) promoter as a heterodimer with the 9-cis retinoic acid receptor RXR (see OMIM Ref. No. 180245). The human PXR is related to the mouse Pxr1, which they had cloned and shown to be activated by dexamethasone, pregnenolone 16-alpha-carbonitrile (PCN), and other compounds known to induce expression of the CYP3A1 gene, the predominant form of CYP3A in rat liver and intestine. Lehmann et al. (1998) isolated PXR clones from a human liver cDNA library. Amino acid sequence comparison showed that human PXR shared 96% and 76% sequence identity with mouse Pxr1 in the DNA-binding and ligand-binding domains, respectively. Initiation of translation at a CUG initiation codon would yield a protein of 434 amino acids. Northern blot analysis detected most abundant expression in liver, colon, and small intestine; transcripts of 2.6, 4.3, and 5 kb were present in each of these tissues. Lehmann et al. (1998) provided several lines of evidence indicating that human PXR serves as a key transcriptional regulator of the CYP3A4 gene. Animal model experiments lend further support to the function of NR1I2. The induction of CYP3A enzymes is species-specific and believed to involve 1 or more cellular factors, or receptor-like xenosensors. Xie et al. (2000) identified one such factor as the nuclear receptor Pxr and its human homolog SXR. Xie et al. (2000) showed that targeted disruption of the mouse Pxr gene abolished induction of CYP3A by prototypic inducers such as dexamethasone or pregnenolone-16-alpha-carbonitrile. In Pxr-null mice carrying a transgene for an activated form of human SXR, there was constitutive upregulation of CYP3A gene expression and enhanced protection against toxic xenobiotic compounds. Xie et al. (2000) demonstrated that species origin of the receptor, rather than the promoter structure of the CYP3A genes, dictates the species-specific pattern of CYP3A inducibility. Thus, they could generate 'human Ized' transgenic mice that were responsive to human-specific inducers such as the antibiotic rifampicin. Xie et al. (2000) concluded that the SXR/Pxr genes encode the primary species-specific xenosensors that mediate the adaptive hepatic response, and may represent the critical biochemical mechanism of human xenoprotection.

It is appreciated that the abovementioned animal model for NR1I2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lehmann, J. M.; McKee, D. D.; Watson, M. A.; Willson, T. M.; Moore, J. T.; Kliewer, S. A.: The human orphan nuclear receptor PXR is activated by compounds that regulate CYP3A4 gene expression and cause drug interactions. J. Clin. Invest. 102:1016-1023, 1998; and Xie, W.; Barwick, J. L.; Downes, M.; Blumberg, B.; Simon, C. M.; Nelson, M. C.; Neuschwander-Tetri, B. A.; Brunt, E. M.; Guzelian, P. S.; Evans, R. M.: human Ized xenobiotic response in.

Further studies establishing the function and utilities of NR1I2 are found in John Hopkins OMIM database record ID 603065, and in sited publications numbered 8483-8484, 3423, 3882, 848 and 8577 listed in the bibliography section hereinbelow, which are also hereby incorporated by reference. Solute Carrier Family 21 (prostaglandin transporter), Member 2 (SLC21A2, Accession NM_005630) is another VGAM336 host target gene. SLC21A2 BINDING SITE is HOST TARGET binding site found in the 3' untranslated region of mRNA encoded by SLC21A2, corresponding to a HOST TARGET binding site such as BINDING SITE I, BINDING SITE II or BINDING SITE III. Table 2 illustrates the complementarity of the nucleotide sequences of SLC21A2 BINDING SITE, designated SEQ ID:12156, to the nucleotide sequence of VGAM336 RNA, herein designated VGAM RNA, also designated SEQ ID:3047.

Another function of VGAM336 is therefore inhibition of Solute Carrier Family 21 (prostaglandin transporter), Member 2 (SLC21A2, Accession NM_005630), a gene which is a Prostaglandin transporter. Accordingly, utilities of VGAM336 include diagnosis, prevention and treatment of diseases and clinical conditions associated with SLC21A2. The function of SLC21A2 and its association with various diseases and clinical conditions, has been established by previous studies, as described hereinabove with reference to VGAM83. BCAA (Accession NM_016374) is another VGAM336 host target gene. BCAA BINDING SITE is HOST TARGET binding site found in the 3' untranslated region of mRNA encoded by BCAA, corresponding to a HOST TARGET binding site such as BINDING SITE I, BINDING SITE II or BINDING SITE III. Table 2 illustrates the complementarity of the nucleotide sequences of BCAA BINDING SITE, designated SEQ ID:18513, to the nucleotide sequence of VGAM336 RNA, herein designated VGAM RNA, also designated SEQ ID:3047.

Another function of VGAM336 is therefore inhibition of BCAA (Accession NM_016374). Accordingly, utilities of VGAM336 include diagnosis, prevention and treatment of diseases and clinical conditions associated with BCAA. Chromosome 20 Open Reading Frame 139 (C20orf139, Accession XM_097749) is another VGAM336 host target gene. C20orf139 BINDING SITE is HOST TARGET binding site found in the 3' untranslated region of mRNA encoded by C20orf139, corresponding to a HOST TARGET binding site such as BINDING SITE I, BINDING SITE II or BINDING SITE III. Table 2 illustrates the complementarity of the nucleotide sequences of C20orf139 BINDING SITE, designated SEQ ID:41104, to the nucleotide sequence of VGAM336 RNA, herein designated VGAM RNA, also designated SEQ ID:3047.

Another function of VGAM336 is therefore inhibition of Chromosome 20 Open Reading Frame 139 (C20orf139, Accession XM_097749). Accordingly, utilities of VGAM336 include diagnosis, prevention and treatment of diseases and clinical conditions associated with C20orf139. Carbohydrate (chondroitin 6) Sulfotransferase 3 (CHST3, Accession NM_004273) is another VGAM336 host target gene. CHST3 BINDING SITE is HOST TARGET binding site found in the 3' untranslated region of mRNA encoded by CHST3, corresponding to a HOST TARGET binding site such as BINDING SITE I, BINDING SITE II or BINDING SITE III. Table 2 illustrates the complementarity of the nucleotide sequences of CHST3 BINDING SITE, designated SEQ ID:10486, to the nucleotide sequence of VGAM336 RNA, herein designated VGAM RNA, also designated SEQ ID:3047.

Another function of VGAM336 is therefore inhibition of Carbohydrate (chondroitin 6) Sulfotransferase 3 (CHST3, Accession NM_004273). Accordingly, utilities of VGAM336 include diagnosis, prevention and treatment of diseases and clinical conditions associated with CHST3. DKFZP434D146 (Accession NM_015595) is another VGAM336 host target gene. DKFZP434D146 BINDING SITE is HOST TARGET binding site found in the 3' untranslated region of mRNA encoded by DKFZP434D146, corresponding to a HOST TARGET binding site such as BINDING SITE I, BINDING SITE II or BINDING SITE III. Table 2 illustrates the complementarity of the nucleotide sequences of DKFZP434D146 BINDING SITE, designated SEQ ID:17872, to the nucleotide sequence of VGAM336 RNA, herein designated VGAM RNA, also designated SEQ ID:3047.

Another function of VGAM336 is therefore inhibition of DKFZP434D146 (Accession NM_015595). Accordingly, utilities of VGAM336 include diagnosis, prevention and treatment of diseases and clinical conditions associated with DKFZP434D146. DKFZP434H132 (Accession NM_015492) is another VGAM336 host target gene. DKFZP434H132 BINDING SITE is HOST TARGET binding site found in the 3' untranslated region of mRNA encoded by DKFZP434H132, corresponding to a HOST TARGET binding site such as BINDING SITE I, BINDING SITE II or BINDING SITE III. Table 2 illustrates the complementarity of the nucleotide sequences of DKFZP434H132 BINDING SITE, designated SEQ ID:17761, to the nucleotide sequence of VGAM336 RNA, herein designated VGAM RNA, also designated SEQ ID:3047.

Another function of VGAM336 is therefore inhibition of DKFZP434H132 (Accession NM_015492). Accordingly, utilities of VGAM336 include diagnosis, prevention and treatment of diseases and clinical conditions associated with DKFZP434H132. FLJ13902 (Accession NM_024653) is another VGAM336 host target gene. FLJ13902 BINDING SITE is HOST TARGET binding site found in the 3' untranslated region of mRNA encoded by FLJ13902, corresponding to a HOST TARGET binding site such as BINDING SITE I, BINDING SITE II or BINDING SITE III. Table 2 illustrates the complementarity of the nucleotide sequences of FLJ13902 BINDING SITE, designated SEQ ID:23951, to the nucleotide sequence of VGAM336 RNA, herein designated VGAM RNA, also designated SEQ ID:3047.

Another function of VGAM336 is therefore inhibition of FLJ13902 (Accession NM_024653). Accordingly, utilities of VGAM336 include diagnosis, prevention and treatment of diseases and clinical conditions associated with FLJ13902. FLJ14936 (Accession NM_032284) is another VGAM336 host target gene. FLJ14936 BINDING SITE is HOST TARGET binding site found in the 3' untranslated region of mRNA encoded by FLJ14936, corresponding to a HOST TARGET binding site such as BINDING SITE I, BINDING SITE II or BINDING SITE III. Table 2 illustrates the complementarity of the nucleotide sequences of FLJ14936 BINDING SITE, designated SEQ ID:26042, to the nucleotide sequence of VGAM336 RNA, herein designated VGAM RNA, also designated SEQ ID:3047.

Another function of VGAM336 is therefore inhibition of FLJ14936 (Accession NM_032284). Accordingly, utilities of VGAM336 include diagnosis, prevention and treatment of diseases and clinical conditions associated with FLJ14936. FLJ20337 (Accession NM_017772) is another VGAM336 host target gene. FLJ20337 BINDING SITE is HOST TARGET binding site found in the 3' untranslated region of mRNA encoded by FLJ20337, corresponding to a HOST TARGET binding site such as BINDING SITE I, BINDING SITE II or BINDING SITE III. Table 2 illustrates the complementarity of the nucleotide sequences of FLJ20337 BINDING SITE, designated SEQ ID:19392, to the nucleotide sequence of VGAM336 RNA, herein designated VGAM RNA, also designated SEQ ID:3047.

Another function of VGAM336 is therefore inhibition of FLJ20337 (Accession NM_017772). Accordingly, utilities of VGAM336 include diagnosis, prevention and treatment of diseases and clinical conditions associated with FLJ20337. FLJ20689 (Accession NM_017972) is another VGAM336 host target gene. FLJ20689 BINDING SITE1 and FLJ20689 BINDING SITE2 are HOST TARGET binding sites found in untranslated regions of mRNA encoded by FLJ20689, corresponding to HOST TARGET binding sites such as BINDING SITE I, BINDING SITE II or BINDING SITE III. Table 2 illustrates the complementarity of the nucleotide sequences of FLJ20689 BINDING SITE1 and FLJ20689 BINDING SITE2, designated SEQ ID:19702 and SEQ ID:19598 respectively, to the nucleotide sequence of VGAM336 RNA, herein designated VGAM RNA, also designated SEQ ID:3047.

Another function of VGAM336 is therefore inhibition of FLJ20689 (Accession NM_017972). Accordingly, utilities of VGAM336 include diagnosis, prevention and treatment of diseases and clinical conditions associated with FLJ20689. LBP-9 (Accession NM_014553) is another VGAM336 host target gene. LBP-9 BINDING SITE is HOST TARGET binding site found in the 3' untranslated region of mRNA encoded by LBP-9, corresponding to a HOST TARGET binding site such as BINDING SITE I, BINDING SITE II or BINDING SITE III. Table 2 illustrates the complementarity of the nucleotide sequences of LBP-9 BINDING SITE, designated SEQ ID:15877, to the nucleotide sequence of VGAM336 RNA, herein designated VGAM RNA, also designated SEQ ID:3047.

Another function of VGAM336 is therefore inhibition of LBP-9 (Accession NM_014553). Accordingly, utilities of VGAM336 include diagnosis, prevention and treatment of diseases and clinical conditions associated with LBP-9. MGC26684 (Accession NM_144568) is another VGAM336 host target gene. MGC26684 BINDING SITE is HOST TARGET binding site found in the 3' untranslated region of mRNA encoded by MGC26684, corresponding to a HOST TARGET binding site such as BINDING SITE I, BINDING SITE II or BINDING SITE III. Table 2 illustrates the complementarity of the nucleotide sequences of MGC26684 BINDING SITE, designated SEQ ID:29371, to the nucleotide sequence of VGAM336 RNA, herein designated VGAM RNA, also designated SEQ ID:3047.

Another function of VGAM336 is therefore inhibition of MGC26684 (Accession NM_144568). Accordingly, utilities of VGAM336 include diagnosis, prevention and treatment of diseases and clinical conditions associated with MGC26684. MGC26744 (Accession NM_144645) is another VGAM336 host target gene. MGC26744 BINDING SITE is HOST TARGET binding site found in the 5' untranslated region of mRNA encoded by MGC26744, corresponding to a HOST TARGET binding site such as BINDING SITE I, BINDING SITE II or BINDING SITE III. Table 2 illustrates the complementarity of the nucleotide sequences of MGC26744 BINDING SITE, designated SEQ ID:29471, to the nucleotide sequence of VGAM336 RNA, herein designated VGAM RNA, also designated SEQ ID:3047.

Another function of VGAM336 is therefore inhibition of MGC26744 (Accession NM_144645). Accordingly, utilities of VGAM336 include diagnosis, prevention and treatment of diseases and clinical conditions associated with MGC26744. Protein Regulator of Cytokinesis 1 (PRC1, Accession NM_003981) is another VGAM336 host target gene. PRC1 BINDING SITE is HOST TARGET binding site found in the 3' untranslated region of mRNA encoded by PRC1, corresponding to a HOST TARGET binding site such as BINDING SITE I, BINDING SITE II or BINDING SITE III. Table 2 illustrates the complementarity of the nucleotide sequences of PRC1 BINDING SITE, designated SEQ ID:10119, to the nucleotide sequence of VGAM336 RNA, herein designated VGAM RNA, also designated SEQ ID:3047.

Another function of VGAM336 is therefore inhibition of Protein Regulator of Cytokinesis 1 (PRC1, Accession NM_003981). Accordingly, utilities of VGAM336 include diagnosis, prevention and treatment of diseases and clinical conditions associated with PRC1. Solute Carrier Family 11 (proton-coupled divalent metal ion transporters), Member 2 (SLC11A2, Accession NM_000617) is another VGAM336 host target gene. SLC11A2 BINDING SITE is HOST TARGET binding site found in the 3" untranslated region of mRNA encoded by SLC11A2, corresponding to a HOST TARGET binding site such as BINDING SITE I, BINDING SITE II or BINDING SITE III. Table 2 illustrates the complementarity of the nucleotide sequences of SLC11A2 BINDING SITE, designated SEQ ID:6222, to the nucleotide sequence of VGAM336 RNA, herein designated VGAM RNA, also designated SEQ ID:3047.

Another function of VGAM336 is therefore inhibition of Solute Carrier Family 11 (proton-coupled divalent metal ion transporters), Member 2 (SLC11A2, Accession NM_000617). Accordingly, utilities of VGAM336 include diagnosis, prevention and treatment of diseases and clinical conditions associated with SLC11A2. VRP (Accession NM_007063) is another VGAM336 host target gene. VRP BINDING SITE is HOST TARGET binding site found in the 5' untranslated region of mRNA encoded by VRP, corresponding to a HOST TARGET binding site such as BINDING SITE I, BINDING SITE II or BINDING SITE III. Table 2 illustrates the complementarity of the nucleotide sequences of VRP BINDING SITE, designated SEQ ID:13925, to the nucleotide sequence of VGAM336 RNA, herein designated VGAM RNA, also designated SEQ ID:3047.

Another function of VGAM336 is therefore inhibition of VRP (Accession NM_007063). Accordingly, utilities of VGAM336 include diagnosis, prevention and treatment of diseases and clinical conditions associated with VRP. LOC112840 (Accession NM_080666) is another VGAM336 host target gene. LOC112840 BINDING SITE is HOST TARGET binding site found in the 3' untranslated region of mRNA encoded by LOC112840, corresponding to a HOST TARGET binding site such as BINDING SITE I, BINDING SITE II or BINDING SITE III. Table 2 illustrates the complementarity of the nucleotide sequences of LOC112840 BINDING SITE, designated SEQ ID:27955, to the nucleotide sequence of VGAM336 RNA, herein designated VGAM RNA, also designated SEQ ID:3047.

Another function of VGAM336 is therefore inhibition of LOC112840 (Accession NM_080666). Accordingly, utilities of VGAM336 include diagnosis, prevention and treatment of diseases and clinical conditions associated with LOC112840. LOC122970 (Accession XM_058672) is another VGAM336 host target gene. LOC122970 BINDING SITE is HOST TARGET binding site found in the 5' untranslated region of mRNA encoded by LOC122970, corresponding to a HOST TARGET binding site such as BINDING SITE I, BINDING SITE II or BINDING SITE III. Table 2 illustrates the complementarity of the nucleotide sequences of LOC122970 BINDING SITE, designated SEQ ID:36713, to the nucleotide sequence of VGAM336 RNA, herein designated VGAM RNA, also designated SEQ ID:3047.

Another function of VGAM336 is therefore inhibition of LOC122970 (Accession XM_058672). Accordingly, utilities of VGAM336 include diagnosis, prevention and treatment of diseases and clinical conditions associated with LOC122970. LOC145955 (Accession XM_096912) is another VGAM336 host target gene. LOC145955 BINDING SITE is HOST TARGET binding site found in the 5' untranslated region of mRNA encoded by LOC145955, corresponding to a HOST TARGET binding site such as BINDING SITE I, BINDING SITE II or BINDING SITE III. Table 2 illustrates the complementarity of the nucleotide sequences of LOC145955 BINDING SITE, designated SEQ ID:40641, to the nucleotide sequence of VGAM336 RNA, herein designated VGAM RNA, also designated SEQ ID:3047.

Another function of VGAM336 is therefore inhibition of LOC145955 (Accession XM_096912). Accordingly, utilities of VGAM336 include diagnosis, prevention and treatment of diseases and clinical conditions associated with LOC145955. LOC146481 (Accession XM_085484) is another VGAM336 host target gene. LOC146481 BINDING SITE is HOST TARGET binding site found in the 3' untranslated region of mRNA encoded by LOC146481, corresponding to a HOST TARGET binding site such as BINDING SITE I, BINDING SITE II or BINDING SITE III. Table 2 illustrates the complementarity of the nucleotide sequences of LOC146481 BINDING SITE, designated SEQ ID:38174, to the nucleotide sequence of VGAM336 RNA, herein designated VGAM RNA, also designated SEQ ID:3047.

Another function of VGAM336 is therefore inhibition of LOC146481 (Accession XM_085484). Accordingly, utilities of VGAM336 include diagnosis, prevention and treatment of diseases and clinical conditions associated with LOC146481. LOC146957 (Accession XM_085652) is another VGAM336 host target gene. LOC146957 BINDING SITE is HOST TARGET binding site found in the 3' untranslated region of mRNA encoded by LOC146957, corresponding to a HOST TARGET binding site such as BINDING SITE I, BINDING SITE II or BINDING SITE III. Table 2 illustrates the complementarity of the nucleotide sequences of LOC146957 BINDING SITE, designated SEQ ID:38280, to the nucleotide sequence of VGAM336 RNA, herein designated VGAM RNA, also designated SEQ ID:3047.

Another function of VGAM336 is therefore inhibition of LOC146957 (Accession XM_085652). Accordingly, utilities of VGAM336 include diagnosis, prevention and treatment of diseases and clinical conditions associated with LOC146957. LOC204084 (Accession XM_115181) is another VGAM336 host target gene. LOC204084 BINDING SITE is HOST TARGET binding site found in the 5' untranslated region of mRNA encoded by LOC204084, corresponding to a HOST TARGET binding site such as BINDING SITE I, BINDING SITE II or BINDING SITE III. Table 2 illustrates the complementarity of the nucleotide sequences of LOC204084 BINDING SITE, designated SEQ ID:43083, to the nucleotide sequence of VGAM336 RNA, herein designated VGAM RNA, also designated SEQ ID:3047.

Another function of VGAM336 is therefore inhibition of LOC204084 (Accession XM_115181). Accordingly, utilities of VGAM336 include diagnosis, prevention and treatment of diseases and clinical conditions associated with LOC204084. LOC253841 (Accession XM_172811) is another VGAM336 host target gene. LOC253841 BINDING SITE is HOST TARGET binding site found in the 5' untranslated region of mRNA encoded by LOC253841, corresponding to a HOST TARGET binding site such as BINDING SITE I, BINDING SITE II or BINDING SITE III. Table 2 illustrates the complementarity of the nucleotide sequences of LOC253841 BINDING SITE, designated SEQ ID:46091, to the nucleotide sequence of VGAM336 RNA, herein designated VGAM RNA, also designated SEQ ID:3047.

Another function of VGAM336 is therefore inhibition of LOC253841 (Accession XM_172811). Accordingly, utilities of VGAM336 include diagnosis, prevention and treatment of diseases and clinical conditions associated with LOC253841. LOC254173 (Accession XM_173022) is another VGAM336 host target gene. LOC254173 BINDING SITE is HOST TARGET binding site found in the 3' untranslated region of mRNA encoded by LOC254173, corresponding to a HOST TARGET binding site such as BINDING SITE I, BINDING SITE II or BINDING SITE III. Table 2 illustrates the complementarity of the nucleotide sequences of LOC254173 BINDING SITE, designated SEQ ID:46287, to the nucleotide sequence of VGAM336 RNA, herein designated VGAM RNA, also designated SEQ ID:3047.

Another function of VGAM336 is therefore inhibition of LOC254173 (Accession XM_173022). Accordingly, utilities of VGAM336 include diagnosis, prevention and treatment of diseases and clinical conditions associated with LOC254173.

FIG. 1 further provides a conceptual description of a novel bioinformatically detected viral gene of the present invention, referred to here as Viral Genomic Address Messenger 337 (VGAM337) viral gene, which modulates expression of respective host target genes thereof, the function and utility of which host target genes is known in the art.

VGAM337 is a novel bioinformatically detected regulatory, non protein coding, viral micro RNA (miRNA) gene. The method by which VGAM337 was detected is described hereinabove with reference to FIGS. 1-8.

VGAM337 gene, herein designated VGAM GENE, is a viral gene contained in the genome of Saimiriine Herpesvirus 2. VGAM337 host target gene, herein designated VGAM HOST TARGET GENE, is a human gene contained in the human genome.

VGAM337 gene encodes a VGAM337 precursor RNA, herein designated VGAM PRECURSOR RNA. Similar to other miRNA genes, and unlike most ordinary genes, VGAM337 precursor RNA does not encode a protein. A nucleotide sequence identical or highly similar to the nucleotide sequence of VGAM337 precursor RNA is designated SEQ ID:323, and is provided hereinbelow with reference to the sequence listing part. Nucleotide sequence SEQ ID:323 is located at position 22516 relative to the genome of Saimiriine Herpesvirus 2.

VGAM337 precursor RNA folds onto itself, forming VGAM337 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM337 folded precursor RNA into VGAM337 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM337 RNA is designated SEQ ID:3048, and is provided hereinbelow with reference to the sequence listing part.

VGAM337 host target gene, herein designated VGAM HOST TARGET GENE, encodes a corresponding messenger RNA, VGAM337 host target RNA, herein designated VGAM HOST TARGET RNA. VGAM337 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM337 RNA, herein designated VGAM RNA, binds complementarily to one or more host target binding sites located in untranslated regions of VGAM337 host target RNA, herein designated VGAM HOST TARGET RNA. This complementary binding is due to the fact that the nucleotide sequence of VGAM337 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM337 RNA, herein designated VGAM RNA, may have a different number of host target binding sites in untranslated regions of a VGAM337 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM337 RNA, herein designated VGAM RNA, to host target binding sites on VGAM337 host target RNA, herein designated VGAM HOST TARGET RNA, such as BINDING SITE I, BINDING SITE II and BINDING SITE III, inhibits translation of VGAM337 host target RNA into VGAM337 host target protein, herein designated VGAM HOST TARGET PROTEIN. VGAM host target protein is therefore outlined by a broken line.

It is appreciated that VGAM337 host target gene, herein designated VGAM HOST TARGET GENE, in fact represents a plurality of VGAM337 host target genes. The mRNA of each one of this plurality of VGAM337 host target genes comprises one or more host target binding sites, each having a nucleotide sequence which is at least partly complementary to VGAM337 RNA, herein designated VGAM RNA, and which when bound by VGAM337 RNA causes inhibition of translation of respective one or more VGAM337 host target proteins.

It is further appreciated by one skilled in the art that the mode of translational inhibition illustrated by FIG. 1 with specific reference to translational inhibition exerted by VGAM337 gene, herein designated VGAM GENE, on one or more VGAM337 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM337 is inhibition of expression of host target genes, as part of a novel viral mechanism of attacking a host. Accordingly, utilities of VGAM337 include diagnosis, prevention and treatment of viral infection by Saimiriine Herpesvirus 2. Specific functions, and accordingly utilities, of VGAM337 correlate with, and may be deduced from, the identity of the host target genes which VGAM337 binds and inhibits, and the function of these host target genes, as elaborated hereinbelow.

Nucleotide sequences of the VGAM337 precursor RNA, herein designated VGAM PRECURSOR RNA, and of the 'diced' VGAM337 RNA, herein designated VGAM RNA, and a schematic representation of the secondary folding of VGAM337 folded precursor RNA, herein designated VGAM FOLDED PRECURSOR RNA, of VGAM337 are further described hereinbelow with reference to Table 1.

Nucleotide sequences of host target binding sites, such as BINDING SITE-I, BINDING SITE-II and BINDING SITE-III of FIG. 1, found on VGAM337 host target RNA, and schematic representation of the complementarity of each of these host target binding sites to VGAM337 RNA, herein designated VGAM RNA, are described hereinbelow with reference to Table 2.

As mentioned hereinabove with reference to FIG. 1, a function of VGAM337 gene, herein designated VGAM is inhibition of expression of VGAM337 target genes. It is appreciated that specific functions, and accordingly utilities, of VGAM337 correlate with, and may be deduced from, the identity of the target genes which VGAM337 binds and inhibits, and the function of these target genes, as elaborated hereinbelow.

Copine III (CPNE3, Accession NM_003909) is a VGAM337 host target gene. CPNE3 BINDING SITE is HOST TARGET binding site found in the 3' untranslated region of mRNA encoded by CPNE3, corresponding to a HOST TARGET binding site such as BINDING SITE I, BINDING SITE II or BINDING SITE III. Table 2 illustrates the complementarity of the nucleotide sequences of CPNE3 BINDING SITE, designated SEQ ID:9997, to the nucleotide sequence of VGAM337 RNA, herein designated VGAM RNA, also designated SEQ ID:3048.

A function of VGAM337 is therefore inhibition of Copine III (CPNE3, Accession NM_003909), a gene which may function in membrane trafficking. Accordingly, utilities of VGAM337 include diagnosis, prevention and treatment of diseases and clinical conditions associated with CPNE3. The function of CPNE3 and its association with various diseases and clinical conditions, has been established by previous studies, as described hereinabove with reference to VGAM28. Dystonia 1, Torsion (autosomal dominant; torsin A) (DYT1, Accession NM_000113) is another VGAM337 host target gene. DYT1 BINDING SITE is HOST TARGET binding site found in the 3' untranslated region of mRNA encoded by DYT1, corresponding to a HOST TARGET binding site such as BINDING SITE I, BINDING SITE II or BINDING SITE III. Table 2 illustrates the complementarity of the nucleotide sequences of DYT1 BINDING SITE, designated SEQ ID:5577, to the nucleotide sequence of VGAM337 RNA, herein designated VGAM RNA, also designated SEQ ID:3048.

Another function of VGAM337 is therefore inhibition of Dystonia 1, Torsion (autosomal dominant; torsin A) (DYT1, Accession NM_000113). Accordingly, utilities of VGAM337 include diagnosis, prevention and treatment of diseases and clinical conditions associated with DYT1. UDP-N-acetyl-alpha-D-galactosamine:(N-acetylneuraminyl)-galactosylglucosylceramide N-acetylgalactosaminyltransferase (GalNAc-T) (GALGT, Accession NM_001478) is another VGAM337 host target gene. GALGT BINDING SITE is HOST TARGET binding site found in the 3' untranslated region of mRNA encoded by GALGT, corresponding to a HOST TARGET binding site such as BINDING SITE I, BINDING SITE II or BINDING SITE III. Table 2 illustrates the complementarity of the nucleotide sequences of GALGT BINDING SITE, designated SEQ ID:7214, to the nucleotide sequence of VGAM337 RNA, herein designated VGAM RNA, also designated SEQ ID:3048.

Another function of VGAM337 is therefore inhibition of UDP-N-acetyl-alpha-D-galactosamine:(N-acetylneuraminyl)-galactosylglucosylceramide N-acetylgalactosaminyltransferase (GalNAc-T) (GALGT, Accession NM_001478), a gene which is involved in the biosynthesis of gangliosides gm2, gd2 and ga2. Accordingly, utilities of VGAM337 include diagnosis, prevention and treatment of diseases and clinical conditions associated with GALGT. The function of GALGT and its association with various diseases and clinical conditions, has been established by previous studies, as described hereinabove with reference to VGAM179. Reticulon 1 (RTN1, Accession NM_021136) is another VGAM337 host target gene. RTN1 BINDING SITE is HOST TARGET binding site found in the 3' untranslated region of mRNA encoded by RTN1, corresponding to a HOST TARGET binding site such as BINDING SITE I, BINDING SITE II or BINDING SITE III. Table 2 illustrates the complementarity of the nucleotide sequences of RTN1 BINDING SITE, designated SEQ ID:22110, to the nucleotide sequence of VGAM337 RNA, herein designated VGAM RNA, also designated SEQ ID:3048.

Another function of VGAM337 is therefore inhibition of Reticulon 1 (RTN1, Accession NM_021136), a gene which may be involved in neuroendocrine secretion or in membrane - membrane trafficking in neuroendocrine cells. Accordingly, utilities of VGAM337 include diagnosis, prevention and treatment of diseases and clinical conditions associated with RTN1. The function of RTN1 has been established by previous studies. Roebroek et al. (1993) described the cloning of a gene that encodes a group of neuroendocrine-specific proteins and which they designated NSP. The original cDNA was identified by screening an expression library of the small-cell lung cancer (SCLC) NCI-H82 cell line with antibodies to the previously identified proteins. The gene can produce 3 different transcripts (3.4, 2.3, and 1.8 kb), which are identical at their 3-prime ends but have unique amino termini. The common carboxyl-terminal region contains 2 large hydrophobic domains. The largest cDNA (NSP-A) produces a 135-kD (776-amino acid) protein which is rich in proline and serine residues and contains multiple potential phosphorylation sites. NSP-B and NSP-C have predicted reading frames of 356 and 208 amino acids, respectively. The B transcript is found only in the NCI-H82 cell line. NSP-specific antibodies showed that the proteins are localized to membranes of the endoplasmic reticulum (Senden et al., 1994), leading to their proposed designation as 'reticulons.' Immunohistochemical studies in the rat (van de Velde et al., 1994) showed the presence of NSP-A protein in many regions of the brain. NSP-A or -C transcripts were found in 18 different SCLC lines but not in any of 11 nonendocrine non-SCLCs (van de Velde et al., 1994). Kools et al. (1994) mapped the human NSP gene to 14q21-q22 by fluorescence in situ hybridization Roebroek et al. (1996) found that the NSP exons are dispersed over a genomic region of about 275 kb. The genomic organization explained the generation of NSP mRNA variants encoding NSP protein isoforms. Multiple promoters rather than alternative splicing of internal exons seemed to be involved in this diversity. Comparison of NSP genomic and cDNA sequences with databank nucleotide sequences resulted in the discovery of other human members of this novel family of reticulon encoding genes Full details of the abovementioned studies are described in the following publications, the disclosure of which are hereby incorporated by reference:

van de Velde, H. J. K.; Roebroek, A. J. M.; van Leeuwen, F. W.; Van de Ven, W. J. M.: Molecular analysis of expression in rat brain of NSP-A, a novel neuroendocrine-specific protein of the endoplasmic reticulum. Molec. Brain Res. 23:81-92, 1994; and Roebroek, A. J. M.; Ayoubi, T. A. Y.; van de Velde, H. J. K.; Schoenmakers, E. F. P. M.; Pauli, I. G. L.; Van de Ven, W. J. M.: Genomic organization of the human NSP gene, prototype of a.

Further studies establishing the function and utilities of RTN1 are found in John Hopkins OMIM database record ID 600865, and in sited publications numbered 7016-7021 listed in the bibliography section hereinbelow, which are also hereby incorporated by reference. Secreted Frizzled-related Protein 1 (SFRP1, Accession NM_003012) is another VGAM337 host target gene. SFRP1 BINDING SITE is HOST TARGET binding site found in the 3' untranslated region of mRNA encoded by SFRP1, corresponding to a HOST TARGET binding site such as BINDING SITE I, BINDING SITE II or BINDING SITE III. Table 2 illustrates the complementarity of the nucleotide sequences of SFRP1 BINDING SITE, designated SEQ ID:8934, to the nucleotide sequence of VGAM337 RNA, herein designated VGAM RNA, also designated SEQ ID:3048.

Another function of VGAM337 is therefore inhibition of Secreted Frizzled-related Protein 1 (SFRP1, Accession NM_003012), a gene which is a receptor for wnt proteins that may have an anti-apoptotic function. Accordingly, utilities of VGAM337 include diagnosis, prevention and treatment of diseases and clinical conditions associated with SFRP1. The function of SFRP1 and its association with various diseases and clinical conditions, has been established by previous studies, as described hereinabove with reference to VGAM250. Calneuron 1 (CALN1, Accession NM_031468) is another VGAM337 host target gene. CALN1 BINDING SITE is HOST TARGET binding site found in the 3' untranslated region of mRNA encoded by CALN1, corresponding to a HOST TARGET binding site such as BINDING SITE I, BINDING SITE II or BINDING SITE III. Table 2 illustrates the complementarity of the nucleotide sequences of CALN1 BINDING SITE, designated SEQ ID:25514, to the nucleotide sequence of VGAM337 RNA, herein designated VGAM RNA, also designated SEQ ID:3048.

Another function of VGAM337 is therefore inhibition of Calneuron 1 (CALN1, Accession NM_031468). Accordingly, utilities of VGAM337 include diagnosis, prevention and treatment of diseases and clinical conditions associated with CALN1. DNAM-1 (Accession NM_006566) is another VGAM337 host target gene. DNAM-1 BINDING SITE is HOST TARGET binding site found in the 3' untranslated region of mRNA encoded by DNAM-1, corresponding to a HOST TARGET binding site such as BINDING SITE I, BINDING SITE II or BINDING SITE III. Table 2 illustrates the complementarity of the nucleotide sequences of DNAM-1 BINDING SITE, designated SEQ ID:13341, to the nucleotide sequence of VGAM337 RNA, herein designated VGAM RNA, also designated SEQ ID:3048.

Another function of VGAM337 is therefore inhibition of DNAM-1 (Accession NM_006566). Accordingly, utilities of VGAM337 include diagnosis, prevention and treatment of diseases and clinical conditions associated with DNAM-1. EZFIT (Accession NM_021216) is another VGAM337 host target gene. EZFIT BINDING SITE is HOST TARGET binding site found in the 3" untranslated region of mRNA encoded by EZFIT, corresponding to a HOST TARGET binding site such as BINDING SITE I, BINDING SITE II or BINDING SITE III. Table 2 illustrates the complementarity of the nucleotide sequences of EZFIT BINDING SITE, designated SEQ ID:22198, to the nucleotide sequence of VGAM337 RNA, herein designated VGAM RNA, also designated SEQ ID:3048.

Another function of VGAM337 is therefore inhibition of EZFIT (Accession NM_021216). Accordingly, utilities of VGAM337 include diagnosis, prevention and treatment of diseases and clinical conditions associated with EZFIT. KIAA1500 (Accession XM_034353) is another VGAM337 host target gene. KIAA1500 BINDING SITE is HOST TARGET binding site found in the 3' untranslated region of mRNA encoded by KIAA1500, corresponding to a HOST TARGET binding site such as BINDING SITE I, BINDING SITE II or BINDING SITE III. Table 2 illustrates the complementarity of the nucleotide sequences of KIAA1500 BINDING SITE, designated SEQ ID:32065, to the nucleotide sequence of VGAM337 RNA, herein designated VGAM RNA, also designated SEQ ID:3048.

Another function of VGAM337 is therefore inhibition of KIAA1500 (Accession XM_034353). Accordingly, utilities of VGAM337 include diagnosis, prevention and treatment of diseases and clinical conditions associated with KIAA1500. SEF (Accession XM_045300) is another VGAM337 host target gene. SEF BINDING SITE is HOST TARGET binding site found in the 3" untranslated region of mRNA encoded by SEF, corresponding to a HOST TARGET binding site such as BINDING SITE I, BINDING SITE II or BINDING SITE III. Table 2 illustrates the complementarity of the nucleotide sequences of SEF BINDING SITE, designated SEQ ID:34426, to the nucleotide sequence of VGAM337 RNA, herein designated VGAM RNA, also designated SEQ ID:3048.

Another function of VGAM337 is therefore inhibition of SEF (Accession XM_045300). Accordingly, utilities of VGAM337 include diagnosis, prevention and treatment of diseases and clinical conditions associated with SEF. Seizure Related 6 Homolog (mouse) (SEZ6, Accession XM_058869) is another VGAM337 host target gene. SEZ6 BINDING SITE is HOST TARGET binding site found in the 5' untranslated region of mRNA encoded by SEZ6, corresponding to a HOST TARGET binding site such as BINDING SITE I, BINDING SITE II or BINDING SITE III. Table 2 illustrates the complementarity of the nucleotide sequences of SEZ6 BINDING SITE, designated SEQ ID:36773, to the nucleotide sequence of VGAM337 RNA, herein designated VGAM RNA, also designated SEQ ID:3048.

Another function of VGAM337 is therefore inhibition of Seizure Related 6 Homolog (mouse) (SEZ6, Accession XM_058869). Accordingly, utilities of VGAM337 include diagnosis, prevention and treatment of diseases and clinical conditions associated with SEZ6. LOC221477 (Accession XM_166397) is another VGAM337 host target gene. LOC221477 BINDING SITE is HOST TARGET binding site found in the 3' untranslated region of mRNA encoded by LOC221477, corresponding to a HOST TARGET binding site such as BINDING SITE I, BINDING SITE II or BINDING SITE III. Table 2 illustrates the complementarity of the nucleotide sequences of LOC221477 BINDING SITE, designated SEQ ID:44260, to the nucleotide sequence of VGAM337 RNA, herein designated VGAM RNA, also designated SEQ ID:3048.

Another function of VGAM337 is therefore inhibition of LOC221477 (Accession XM_166397). Accordingly, utilities of VGAM337 include diagnosis, prevention and treatment of diseases and clinical conditions associated with LOC221477. LOC50999 (Accession NM_016040) is another VGAM337 host target gene. LOC50999 BINDING SITE is HOST TARGET binding site found in the 3' untranslated region of mRNA encoded by LOC50999, corresponding to a HOST TARGET binding site such as BINDING SITE I, BINDING SITE II or BINDING SITE III. Table 2 illustrates the complementarity of the nucleotide sequences of LOC50999 BINDING SITE, designated SEQ ID:18116, to the nucleotide sequence of VGAM337 RNA, herein designated VGAM RNA, also designated SEQ ID:3048.

Another function of VGAM337 is therefore inhibition of LOC50999 (Accession NM_016040). Accordingly, utilities of VGAM337 include diagnosis, prevention and treatment of diseases and clinical conditions associated with LOC50999. FIG. 1 further provides a conceptual description of a novel bioinformatically detected viral gene of the present invention, referred to here as Viral Genomic Address Messenger 338 (VGAM338) viral gene, which modulates expression of respective host target genes thereof, the function and utility of which host target genes is known in the art.

VGAM338 is a novel bioinformatically detected regulatory, non protein coding, viral micro RNA (miRNA) gene. The method by which VGAM338 was detected is described hereinabove with reference to FIGS. 1-8.

VGAM338 gene, herein designated VGAM GENE, is a viral gene contained in the genome of Saimiriine Herpesvirus 2. VGAM338 host target gene, herein designated VGAM HOST TARGET GENE, is a human gene contained in the human genome.

VGAM338 gene encodes a VGAM338 precursor RNA, herein designated VGAM PRECURSOR RNA. Similar to other miRNA genes, and unlike most ordinary genes, VGAM338 precursor RNA does not encode a protein. A nucleotide sequence identical or highly similar to the nucleotide sequence of VGAM338 precursor RNA is designated SEQ ID:324, and is provided hereinbelow with reference to the sequence listing part. Nucleotide sequence SEQ ID:324 is located at position 21425 relative to the genome of Saimiriine Herpesvirus 2.

VGAM338 precursor RNA folds onto itself, forming VGAM338 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM338 folded precursor RNA into VGAM338 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM338 RNA is designated SEQ ID:3049, and is provided hereinbelow with reference to the sequence listing part.

VGAM338 host target gene, herein designated VGAM HOST TARGET GENE, encodes a corresponding messenger RNA, VGAM338 host target RNA, herein designated VGAM HOST TARGET RNA. VGAM338 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM338 RNA, herein designated VGAM RNA, binds complementarily to one or more host target binding sites located in untranslated regions of VGAM338 host target RNA, herein designated VGAM HOST TARGET RNA. This complementary binding is due to the fact that the nucleotide sequence of VGAM338 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM338 RNA, herein designated VGAM RNA, may have a different number of host target binding sites in untranslated regions of a VGAM338 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM338 RNA, herein designated VGAM RNA, to host target binding sites on VGAM338 host target RNA, herein designated VGAM HOST TARGET RNA, such as BINDING SITE I, BINDING SITE II and BINDING SITE III, inhibits translation of VGAM338 host target RNA into VGAM338 host target protein, herein designated VGAM HOST TARGET PROTEIN. VGAM host target protein is therefore outlined by a broken line.

It is appreciated that VGAM338 host target gene, herein designated VGAM HOST TARGET GENE, in fact represents a plurality of VGAM338 host target genes. The mRNA of each one of this plurality of VGAM338 host target genes comprises one or more host target binding sites, each having a nucleotide sequence which is at least partly complementary to VGAM338 RNA, herein designated VGAM RNA, and which when bound by VGAM338 RNA causes inhibition of translation of respective one or more VGAM338 host target proteins.

It is further appreciated by one skilled in the art that the mode of translational inhibition illustrated by FIG. 1 with specific reference to translational inhibition exerted by VGAM338 gene, herein designated VGAM GENE, on one or more VGAM338 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM338 is inhibition of expression of host target genes, as part of a novel viral mechanism of attacking a host. Accordingly, utilities of VGAM338 include diagnosis, prevention and treatment of viral infection by Saimiriine Herpesvirus 2. Specific functions, and accordingly utilities, of VGAM338 correlate with, and may be deduced from, the identity of the host target genes which VGAM338 binds and inhibits, and the function of these host target genes, as elaborated hereinbelow.

Nucleotide sequences of the VGAM338 precursor RNA, herein designated VGAM PRECURSOR RNA, and of the 'diced' VGAM338 RNA, herein designated VGAM RNA, and a schematic representation of the secondary folding of VGAM338 folded precursor RNA, herein designated VGAM FOLDED PRECURSOR RNA, of VGAM338 are further described hereinbelow with reference to Table 1.

Nucleotide sequences of host target binding sites, such as BINDING SITE-I, BINDING SITE-II and BINDING SITE-III of FIG. 1, found on VGAM338 host target RNA, and schematic representation of the complementarity of each of these host target binding sites to VGAM338 RNA, herein designated VGAM RNA, are described hereinbelow with reference to Table 2.

As mentioned hereinabove with reference to FIG. 1, a function of VGAM338 gene, herein designated VGAM is inhibition of expression of VGAM338 target genes. It is appreciated that specific functions, and accordingly utilities, of VGAM338 correlate with, and may be deduced from, the identity of the target genes which VGAM338 binds and inhibits, and the function of these target genes, as elaborated hereinbelow.

Nuclear Transcription Factor Y, Gamma (NFYC, Accession NM_014223) is a VGAM338 host target gene. NFYC BINDING SITE is HOST TARGET binding site found in the 3' untranslated region of mRNA encoded by NFYC, corresponding to a HOST TARGET binding site such as BINDING SITE I, BINDING SITE II or BINDING SITE III. Table 2 illustrates the complementarity of the nucleotide sequences of NFYC BINDING SITE, designated SEQ ID:15492, to the nucleotide sequence of VGAM338 RNA, herein designated VGAM RNA, also designated SEQ ID:3049.

A function of VGAM338 is therefore inhibition of Nuclear Transcription Factor Y, Gamma (NFYC, Accession NM_014223). Accordingly, utilities of VGAM338 include diagnosis, prevention and treatment of diseases and clinical conditions associated with NFYC. KIAA0042 (Accession NM_014875) is another VGAM338 host target gene. KIAA0042 BINDING SITE is HOST TARGET binding site found in the 3' untranslated region of mRNA encoded by KIAA0042, corresponding to a HOST TARGET binding site such as BINDING SITE I, BINDING SITE II or BINDING SITE III. Table 2 illustrates the complementarity of the nucleotide sequences of KIAA0042 BINDING SITE, designated SEQ ID:17014, to the nucleotide sequence of VGAM338 RNA, herein designated VGAM RNA, also designated SEQ ID:3049.

Another function of VGAM338 is therefore inhibition of KIAA0042 (Accession NM_014875). Accordingly, utilities of VGAM338 include diagnosis, prevention and treatment of diseases and clinical conditions associated with KIAA0042. KIAA0322 (Accession XM_166591) is another VGAM338 host target gene. KIAA0322 BINDING SITE is HOST TARGET binding site found in the 3' untranslated region of mRNA encoded by KIAA0322, corresponding to a HOST TARGET binding site such as BINDING SITE I, BINDING SITE II or BINDING SITE III. Table 2 illustrates the complementarity of the nucleotide sequences of KIAA0322 BINDING SITE, designated SEQ ID:44559, to the nucleotide sequence of VGAM338 RNA, herein designated VGAM RNA, also designated SEQ ID:3049.

Another function of VGAM338 is therefore inhibition of KIAA0322 (Accession XM_166591). Accordingly, utilities of VGAM338 include diagnosis, prevention and treatment of diseases and clinical conditions associated with KIAA0322. LOC115400 (Accession XM_055880) is another VGAM338 host target gene. LOC115400 BINDING SITE is HOST TARGET binding site found in the 5' untranslated region of mRNA encoded by LOC115400, corresponding to a HOST TARGET binding site such as BINDING SITE I, BINDING SITE II or BINDING SITE III. Table 2 illustrates the complementarity of the nucleotide sequences of LOC115400 BINDING SITE, designated SEQ ID:36348, to the nucleotide sequence of VGAM338 RNA, herein designated VGAM RNA, also designated SEQ ID:3049.

Another function of VGAM338 is therefore inhibition of LOC115400 (Accession XM_055880). Accordingly, utilities of VGAM338 include diagnosis, prevention and treatment of diseases and clinical conditions associated with LOC115400. LOC51701 (Accession NM_016231) is another VGAM338 host target gene. LOC51701 BINDING SITE is HOST TARGET binding site found in the 3' untranslated region of mRNA encoded by LOC51701, corresponding to a HOST TARGET binding site such as BINDING SITE I, BINDING SITE II or BINDING SITE III. Table 2 illustrates the complementarity of the nucleotide sequences of LOC51701 BINDING SITE, designated SEQ ID:18346, to the nucleotide sequence of VGAM338 RNA, herein designated VGAM RNA, also designated SEQ ID:3049.

Another function of VGAM338 is therefore inhibition of LOC51701 (Accession NM_016231). Accordingly, utilities of VGAM338 include diagnosis, prevention and treatment of diseases and clinical conditions associated with LOC51701. FIG. 1 further provides a conceptual description of a novel bioinformatically detected viral gene of the present invention, referred to here as Viral Genomic Address Messenger 339 (VGAM339) viral gene, which modulates expression of respective host target genes thereof, the function and utility of which host target genes is known in the art.

VGAM339 is a novel bioinformatically detected regulatory, non protein coding, viral micro RNA (miRNA) gene. The method by which VGAM339 was detected is described hereinabove with reference to FIGS. 1-8.

VGAM339 gene, herein designated VGAM GENE, is a viral gene contained in the genome of Saimiriine Herpesvirus 2. VGAM339 host target gene, herein designated VGAM HOST TARGET GENE, is a human gene contained in the human genome.

VGAM339 gene encodes a VGAM339 precursor RNA, herein designated VGAM PRECURSOR RNA. Similar to other miRNA genes, and unlike most ordinary genes, VGAM339 precursor RNA does not encode a protein. A nucleotide sequence identical or highly similar to the nucleotide sequence of VGAM339 precursor RNA is designated SEQ ID:325, and is provided hereinbelow with reference to the sequence listing part. Nucleotide sequence SEQ ID:325 is located at position 22382 relative to the genome of Saimiriine Herpesvirus 2.

VGAM339 precursor RNA folds onto itself, forming VGAM339 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM339 folded precursor RNA into VGAM339 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM339 RNA is designated SEQ ID:3050, and is provided hereinbelow with reference to the sequence listing part.

VGAM339 host target gene, herein designated VGAM HOST TARGET GENE, encodes a corresponding messenger RNA, VGAM339 host target RNA, herein designated VGAM HOST TARGET RNA. VGAM339 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM339 RNA, herein designated VGAM RNA, binds complementarily to one or more host target binding sites located in untranslated regions of VGAM339 host target RNA, herein designated VGAM HOST TARGET RNA. This complementary binding is due to the fact that the nucleotide sequence of VGAM339 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM339 RNA, herein designated VGAM RNA, may have a different number of host target binding sites in untranslated regions of a VGAM339 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM339 RNA, herein designated VGAM RNA, to host target binding sites on VGAM339 host target RNA, herein designated VGAM HOST TARGET RNA, such as BINDING SITE I, BINDING SITE II and BINDING SITE III, inhibits translation of VGAM339 host target RNA into VGAM339 host target protein, herein designated VGAM HOST TARGET PROTEIN. VGAM host target protein is therefore outlined by a broken line.

It is appreciated that VGAM339 host target gene, herein designated VGAM HOST TARGET GENE, in fact represents a plurality of VGAM339 host target genes. The mRNA of each one of this plurality of VGAM339 host target genes comprises one or more host target binding sites, each having a nucleotide sequence which is at least partly complementary to VGAM339 RNA, herein designated VGAM RNA, and which when bound by VGAM339 RNA causes inhibition of translation of respective one or more VGAM339 host target proteins.

It is further appreciated by one skilled in the art that the mode of translational inhibition illustrated by FIG. 1 with specific reference to translational inhibition exerted by VGAM339 gene, herein designated VGAM GENE, on one or more VGAM339 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM339 is inhibition of expression of host target genes, as part of a novel viral mechanism of attacking a host. Accordingly, utilities of VGAM339 include diagnosis, prevention and treatment of viral infection by Saimiriine Herpesvirus 2. Specific functions, and accordingly utilities, of VGAM339 correlate with, and may be deduced from, the identity of the host target genes which VGAM339 binds and inhibits, and the function of these host target genes, as elaborated hereinbelow.

Nucleotide sequences of the VGAM339 precursor RNA, herein designated VGAM PRECURSOR RNA, and of the 'diced' VGAM339 RNA, herein designated VGAM RNA, and a schematic representation of the secondary folding of VGAM339 folded precursor RNA, herein designated VGAM FOLDED PRECURSOR RNA, of VGAM339 are further described hereinbelow with reference to Table 1.

Nucleotide sequences of host target binding sites, such as BINDING SITE-I, BINDING SITE-II and BINDING SITE-III of FIG. 1, found on VGAM339 host target RNA, and schematic representation of the complementarity of each of these host target binding sites to VGAM339 RNA, herein designated VGAM RNA, are described hereinbelow with reference to Table 2.

As mentioned hereinabove with reference to FIG. 1, a function of VGAM339 gene, herein designated VGAM is inhibition of expression of VGAM339 target genes. It is appreciated that specific functions, and accordingly utilities, of VGAM339 correlate with, and may be deduced from, the identity of the target genes which VGAM339 binds and inhibits, and the function of these target genes, as elaborated hereinbelow.

Potassium Voltage-gated Channel, KQT-like Subfamily, Member 1 (KCNQ1, Accession NM_000218) is a VGAM339 host target gene. KCNQ1 BINDING SITE is HOST TARGET binding site found in the 3' untranslated region of mRNA encoded by KCNQ1, corresponding to a HOST TARGET binding site such as BINDING SITE I, BINDING SITE II or BINDING SITE III. Table 2 illustrates the complementarity of the nucleotide sequences of KCNQ1 BINDING SITE, designated SEQ ID:5723, to the nucleotide sequence of VGAM339 RNA, herein designated VGAM RNA, also designated SEQ ID:3050.

A function of VGAM339 is therefore inhibition of Potassium Voltage-gated Channel, KQT-like Subfamily, Member 1 (KCNQ1, Accession NM_000218), a gene which probably important in cardiac repolarization. associates with kcne1 (mink) to form the i (ks) cardiac potassium current. elicits a rapidly activating, k(+)-selective outward current. muscarinic agonist oxotremorine-m strongly suppresses kcnq1/kcne1 current in cho cells in which cloned kcnq1/kcne1 channels were coexpressed with m1 muscarinic receptors. may associate also with kcne3 (mirp2) to form the potassium channel that is important for cyclic amp-stimulated intestinal secretion of chloride io TISSUE:abondantly expressed in heart, pancreas, prostate, kidney, small intestine and peripheral blood leukocytes. less abondant in placenta, lung, spleen, colon, thymus, testis and ovaries. Accordingly, utilities of VGAM339 include diagnosis, prevention and treatment of diseases and clinical conditions associated with KCNQ1. The function of KCNQ1 has been established by previous studies. Congenital long QT syndrome (LQTS) is electrocardiographically characterized by a prolonged QT interval and polymorphic ventricular arrhythmias (torsade de pointes). These cardiac arrhythmias may result in recurrent syncopes, seizure, or sudden death. Mutation in the KCNQ1 gene can cause either Romano-Ward syndrome or Jervell and Lange-Nielsen syndrome (OMIM Ref. No. 220400). The candidate gene approach had been used to identify genes responsible for long QT syndrome on chromosome 7 (OMIM Ref. No. 152427) and chromosome 3 (OMIM Ref. No. 600163). Wang et al. (1996) used positional cloning methods to establish a gene, which they called KVLQT1, as the chromosome 11-linked LQT1 gene. KVLQT1 is strongly expressed in the heart and codes a protein with structural features of a voltage-gated potassium channel. The longest open reading frame of the KVLQT1 cDNA spans 1,645 bp. The authors found KVLQT1 mutations in affected members of 16 arrhythmia families, including 1 intragenic deletion and 10 different missense mutations (e.g., 192500.0001). Marx et al. (2002) demonstrated that beta-adrenergic receptor modulation of the slow outward potassium ion current (I-KS) requires targeting of cAMP-dependent protein kinase A (OMIM Ref. No. 188830) and protein phosphatase 1 (PP1; e.g., 176875) to KCNQ1 through the targeting protein yotiao (OMIM Ref. No. 604001). Yotiao binds to KCNQ1 by a leucine zipper motif, which is disrupted by an LQTS mutation (KCNQ1-

G589D; 192500.0029). Identification of the KCNQ1 macromolecular complex provides a mechanism for sympathetic nervous system modulation of cardiac action potential duration through I-KS. Animal model experiments lend further support to the function of KCNQ1. To produce a mouse model for Jervell and Lange-Nielsen syndrome, Casimiro et al. (2001) generated a line of transgenic mice that had a targeted disruption in the Kcnq1 gene. Behavioral analysis demonstrated that the homozygous null mice were deaf and exhibited a shaker-waltzer phenotype. Histologic analysis of the inner ear structures of these mice showed gross morphologic anomalies because of drastic reduction in the volume of endolymph. ECGs recorded from the null mice demonstrated abnormal T- and P-wave morphologies and prolongation of the QT and JT intervals when measured in vivo, but not in isolated hearts. These changes were indicative of cardiac repolarization defects that appear to be induced by extracardiac signals.

It is appreciated that the abovementioned animal model for KCNQ1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Marx, S. O.; Kurokawa, J.; Reiken, S.; Motoike, H.; d'Armiento, J.; Marks, A. R.; Kass, R. S.: Requirement of a macromolecular signaling complex for beta adrenergic receptor modulation of the KCNQ1-KCNE1 potassium channel. Science 295:496-499, 2002; and Casimiro, M. C.; Knollmann, B. C.; Ebert, S. N.; Vary, J. C., Jr.; Greene, A. E.; Franz, M. R.; Grinberg, A.; Huang, S. P.; Pfeifer, K.: Targeted disruption of the Kcnq1 gene produces.

Further studies establishing the function and utilities of KCNQ1 are found in John Hopkins OMIM database record ID 192500, and in sited publications numbered 5747-5749, 10835-5774, 1498, 2199-2200, 1497, 1499-1513, 10836-1522, 5777, 6058-6061, 2209, 2210, 6062-6067, 10837-6075, 2216, 6076-781, 4332-78 and 2222 listed in the bibliography section hereinbelow, which are also hereby incorporated by reference. Prostaglandin I2 (prostacyclin) Synthase (PTGIS, Accession NM_000961) is another VGAM339 host target gene. PTGIS BINDING SITE is HOST TARGET binding site found in the 3' untranslated region of mRNA encoded by PTGIS, corresponding to a HOST TARGET binding site such as BINDING SITE I, BINDING SITE II or BINDING SITE III. Table 2 illustrates the complementarity of the nucleotide sequences of PTGIS BINDING SITE, designated SEQ ID:6667, to the nucleotide sequence of VGAM339 RNA, herein designated VGAM RNA, also designated SEQ ID:3050.

Another function of VGAM339 is therefore inhibition of Prostaglandin I2 (prostacyclin) Synthase (PTGIS, Accession NM_000961), a gene which catalyzes the isomerization of prostaglandin h2 to prostacyclin (= prostaglandin i2). Accordingly, utilities of VGAM339 include diagnosis, prevention and treatment of diseases and clinical conditions associated with PTGIS. The function of PTGIS and its association with various diseases and clinical conditions, has been established by previous studies, as described hereinabove with reference to VGAM206. HSPC065 (Accession NM_014157) is another VGAM339 host target gene. HSPC065 BINDING SITE is HOST TARGET binding site found in the 3' untranslated region of mRNA encoded by HSPC065, corresponding to a HOST TARGET binding site such as BINDING SITE I, BINDING SITE II or BINDING SITE III. Table 2 illustrates the complementarity of the nucleotide sequences of HSPC065 BINDING SITE, designated SEQ ID:15450, to the nucleotide sequence of VGAM339 RNA, herein designated VGAM RNA, also designated SEQ ID:3050.

Another function of VGAM339 is therefore inhibition of HSPC065 (Accession NM_014157). Accordingly, utilities of VGAM339 include diagnosis, prevention and treatment of diseases and clinical conditions associated with HSPC065. LOC148760 (Accession XM_097514) is another VGAM339 host target gene. LOC148760 BINDING SITE is HOST TARGET binding site found in the 3' untranslated region of mRNA encoded by LOC148760, corresponding to a HOST TARGET binding site such as BINDING SITE I, BINDING SITE II or BINDING SITE III. Table 2 illustrates the complementarity of the nucleotide sequences of LOC148760 BINDING SITE, designated SEQ ID:40898, to the nucleotide sequence of VGAM339 RNA, herein designated VGAM RNA, also designated SEQ ID:3050.

Another function of VGAM339 is therefore inhibition of LOC148760 (Accession XM_097514). Accordingly, utilities of VGAM339 include diagnosis, prevention and treatment of diseases and clinical conditions associated with LOC148760. LOC221773 (Accession XM_165802) is another VGAM339 host target gene. LOC221773 BINDING SITE is HOST TARGET binding site found in the 3' untranslated region of mRNA encoded by LOC221773, corresponding to a HOST TARGET binding site such as BINDING SITE I, BINDING SITE II or BINDING SITE III. Table 2 illustrates the complementarity of the nucleotide sequences of LOC221773 BINDING SITE, designated SEQ ID:43761, to the nucleotide sequence of VGAM339 RNA, herein designated VGAM RNA, also designated SEQ ID:3050.

Another function of VGAM339 is therefore inhibition of LOC221773 (Accession XM_165802). Accordingly, utilities of VGAM339 include diagnosis, prevention and treatment of diseases and clinical conditions associated with LOC221773. LOC51696 (Accession NM_016217) is another VGAM339 host target gene. LOC51696 BINDING SITE is HOST TARGET binding site found in the 3' untranslated region of mRNA encoded by LOC51696, corresponding to a HOST TARGET binding site such as BINDING SITE I, BINDING SITE II or BINDING SITE III. Table 2 illustrates the complementarity of the nucleotide sequences of LOC51696 BINDING SITE, designated SEQ ID:18310, to the nucleotide sequence of VGAM339 RNA, herein designated VGAM RNA, also designated SEQ ID:3050.

Another function of VGAM339 is therefore inhibition of LOC51696 (Accession NM_016217). Accordingly, utilities of VGAM339 include diagnosis, prevention and treatment of diseases and clinical conditions associated with LOC51696. FIG. 1 further provides a conceptual description of a novel bioinformatically detected viral gene of the present invention, referred to here as Viral Genomic Address Messenger 340 (VGAM340) viral gene, which modulates expression of respective host target genes thereof, the function and utility of which host target genes is known in the art.

VGAM340 is a novel bioinformatically detected regulatory, non protein coding, viral micro RNA (miRNA) gene. The method by which VGAM340 was detected is described hereinabove with reference to FIGS. 1-8.

VGAM340 gene, herein designated VGAM GENE, is a viral gene contained in the genome of Tobacco Mosaic Virus. VGAM340 host target gene, herein designated VGAM HOST TARGET GENE, is a human gene contained in the human genome.

VGAM340 gene encodes a VGAM340 precursor RNA, herein designated VGAM PRECURSOR RNA. Similar to other miRNA genes, and unlike most ordinary genes, VGAM340 precursor RNA does not encode a protein. A nucleotide sequence identical or highly similar to the nucleotide sequence of VGAM340 precursor RNA is designated SEQ ID:326, and is provided hereinbelow with reference to the sequence listing part. Nucleotide sequence SEQ ID:326 is located at position 3101 relative to the genome of Tobacco Mosaic Virus.

VGAM340 precursor RNA folds onto itself, forming VGAM340 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM340 folded precursor RNA into VGAM340 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM340 RNA is designated SEQ ID:3051, and is provided hereinbelow with reference to the sequence listing part.

VGAM340 host target gene, herein designated VGAM HOST TARGET GENE, encodes a corresponding messenger RNA, VGAM340 host target RNA, herein designated VGAM HOST TARGET RNA. VGAM340 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM340 RNA, herein designated VGAM RNA, binds complementarily to one or more host target binding sites located in untranslated regions of VGAM340 host target RNA, herein designated VGAM HOST TARGET RNA. This complementary binding is due to the fact that the nucleotide sequence of VGAM340 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM340 RNA, herein designated VGAM RNA, may have a different number of host target binding sites in untranslated regions of a VGAM340 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM340 RNA, herein designated VGAM RNA, to host target binding sites on VGAM340 host target RNA, herein designated VGAM HOST TARGET RNA, such as BINDING SITE I, BINDING SITE II and BINDING SITE III, inhibits translation of VGAM340 host target RNA into VGAM340 host target protein, herein designated VGAM HOST TARGET PROTEIN. VGAM host target protein is therefore outlined by a broken line.

It is appreciated that VGAM340 host target gene, herein designated VGAM HOST TARGET GENE, in fact represents a plurality of VGAM340 host target genes. The mRNA of each one of this plurality of VGAM340 host target genes comprises one or more host target binding sites, each having a nucleotide sequence which is at least partly complementary to VGAM340 RNA, herein designated VGAM RNA, and which when bound by VGAM340 RNA causes inhibition of translation of respective one or more VGAM340 host target proteins.

It is further appreciated by one skilled in the art that the mode of translational inhibition illustrated by FIG. 1 with specific reference to translational inhibition exerted by VGAM340 gene, herein designated VGAM GENE, on one or more VGAM340 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM340 is inhibition of expression of host target genes, as part of a novel viral mechanism of attacking a host. Accordingly, utilities of VGAM340 include diagnosis, prevention and treatment of viral infection by Tobacco Mosaic Virus. Specific functions, and accordingly utilities, of VGAM340 correlate with, and may be deduced from, the identity of the host target genes which VGAM340 binds and inhibits, and the function of these host target genes, as elaborated hereinbelow.

Nucleotide sequences of the VGAM340 precursor RNA, herein designated VGAM PRECURSOR RNA, and of the 'diced' VGAM340 RNA, herein designated VGAM RNA, and a schematic representation of the secondary folding of VGAM340 folded precursor RNA, herein designated VGAM FOLDED PRECURSOR RNA, of VGAM340 are further described hereinbelow with reference to Table 1.

Nucleotide sequences of host target binding sites, such as BINDING SITE-I, BINDING SITE-II and BINDING SITE-III of FIG. 1, found on VGAM340 host target RNA, and schematic representation of the complementarity of each of these host target binding sites to VGAM340 RNA, herein designated VGAM RNA, are described hereinbelow with reference to Table 2.

As mentioned hereinabove with reference to FIG. 1, a function of VGAM340 gene, herein designated VGAM is inhibition of expression of VGAM340 target genes. It is appreciated that specific functions, and accordingly utilities, of VGAM340 correlate with, and may be deduced from, the identity of the target genes which VGAM340 binds and inhibits, and the function of these target genes, as elaborated hereinbelow.

Aquaporin 6, Kidney Specific (AQP6, Accession NM_053286) is a VGAM340 host target gene. AQP6 BINDING SITE is HOST TARGET binding site found in the 5' untranslated region of mRNA encoded by AQP6, corresponding to a HOST TARGET binding site such as BINDING SITE I, BINDING SITE II or BINDING SITE III. Table 2 illustrates the complementarity of the nucleotide sequences of AQP6 BINDING SITE, designated SEQ ID:27610, to the nucleotide sequence of VGAM340 RNA, herein designated VGAM RNA, also designated SEQ ID:3051.

A function of VGAM340 is therefore inhibition of Aquaporin 6, Kidney Specific (AQP6, Accession NM_053286), a gene which participates in distinct physiologic function such as glomerular filtration, tubular endocytosis, and acid-base metabolism. Accordingly, utilities of VGAM340 include diagnosis, prevention and treatment of diseases and clinical conditions associated with AQP6. The function of AQP6 has been established by previous studies. Ma et al. (1997), who referred to this gene as aquaporin-6 (AQP6), demonstrated that, among the 7 human aquaporins cloned to that time (AQPs 0 to 6), the genes encoding the 4 most closely related aquaporins all mapped to 12q13: AQP0, AQP2, AQP5 (OMIM Ref. No. 600442), and AQP6. To construct a physical map and identify novel aquaporin gene members of this cluster, Ma et al. (1997) screened a human CEPH B YAC library by PCR using primers derived from exon 4 of the AQP2 and AQP0 genes. A YAC clone with 200 kb of human DNA was isolated an analyzed. Primary pulsed field gel electrophoresis and Southern blot analysis indicated the presence of AQP2, AQP5, and AQP6 genes, but not AQP0. Restriction mapping and PCR analysis yielded a precise physical map in which the 3 aquaporin genes spanned only approximately 27 kb with the order, transcription orientation, and spacer length as follows: 5-prime--AQP2--5 kb spacer--AQP5--7 kb spacer--AQP6--3-prime. Yasui et al. (1999) showed that AQP6 is localized exclusively in intracellular membranes in renal epithelia. Sequential ultracentrifugation of rat kidney homogenates confirmed that AQP6 resides predominantly in vesicular fractions, and immunohistochemical and immunoelectron microscopic studies confirmed that more than 98% of AQP6 is located in intracellular membrane vesicles. In glomeruli, AQP6 is present in membrane vesicles within podocyte cell bodies and foot processes. In proximal tubules, AQP6 is also abundant in membrane vesicles within the subapical compartment of segment 2 and segment 3 cells, but was not detected in the brush border or basolateral membranes. In collecting duct, AQP6 resides in intracellular membrane vesicles in apical, mid, and basolateral cytoplasm of type A intercalated cells, but was not observed in the plasma membrane. Unlike other members of the AQP family, the unique distribution in intracellular membrane vesicles in multiple types of renal epithelia indicated that AQP6 is not simply involved in transcellular fluid absorption. These studies predicted that AQP6 participates in distinct physiologic function such as glomerular filtration, tubular endocytosis, and acid-base metabolism.

Full details of the abovementioned studies are described in the following publications, the disclosure of which are hereby incorporated by reference:

Ma, T.; Yang, B.; Umenishi, F.; Verkman, A. S.: Closely spaced tandem arrangement of AQP2, AQP5, and AQP6 genes in a 27-kilobase segment at chromosome locus 12q13. Genomics 43:387-389, 1997; and Yasui, M.; Kwon, T.-H.; Knepper, M. A.; Nielsen, S.; Agre, P.: Aquaporin-6: an intracellular vesicle water channel protein in renal epithelia. Proc. Nat. Acad. Sci. 96:5808-5813, 1999.

Further studies establishing the function and utilities of AQP6 are found in John Hopkins OMIM database record ID 601383, and in sited publications numbered 717 and 7178 listed in the bibliography section hereinbelow, which are also hereby incorporated by reference. Microtubule-associated Protein, RP/EB Family, Member 3 (MAPRE3, Accession NM_012326) is another VGAM340 host target gene. MAPRE3 BINDING SITE is HOST TARGET binding site found in the 3' untranslated region of mRNA encoded by MAPRE3, corresponding to a HOST TARGET binding site such as BINDING SITE I, BINDING SITE II or BINDING SITE III. Table 2 illustrates the complementarity of the nucleotide sequences of MAPRE3 BINDING SITE, designated SEQ ID:14717, to the nucleotide sequence of VGAM340 RNA, herein designated VGAM RNA, also designated SEQ ID:3051.

Another function of VGAM340 is therefore inhibition of Microtubule-associated Protein, RP/EB Family, Member 3 (MAPRE3, Accession NM_012326), a gene which interact with cytoplasmic microtubules, and with the adenomatous polyposis coli. Accordingly, utilities of VGAM340 include diagnosis, prevention and treatment of diseases and clinical conditions associated with MAPRE3. The function of MAPRE3 has been established by previous studies. EB1 family proteins (e.g., MAPRE1; 603108) interact with cytoplasmic microtubules in interphase cells, with mitotic spindles, and with the adenomatous polyposis coli (APC; 175100) tumor suppressor gene. Using a yeast 2-hybrid screen with the C terminus of APC-like (APCL) as bait, Nakagawa et al. (2000) isolated a cDNA encoding MAPRE3, which they termed EB3. The predicted 282-amino acid protein is 54% identical to MAPRE1. Northern blot analysis revealed expression of a 2.2-kb transcript predominantly in brain and muscle. GST pull-down analysis determined that a homologous region in the C termini of APC and APCL binds to MAPRE3. Immunofluorescence and confocal microscopy demonstrated that MAPRE3 is localized in the microtubule network and colocalizes with APCL in the perinucleus and microtubule network. By EST database searching, RT-PCR, and screening a fetal brain cDNA library, Su and Qi (2001) isolated a cDNA encoding a protein identical to the EB3 protein reported by Nakagawa et al. (2000), which they termed EBF3, and an alternative transcript encoding a 266-amino acid protein. RT-PCR and Western blot analyses indicated that both transcripts are ubiquitously expressed. Genomic sequence analysis showed that there are most likely 3 MAPRE genes: MAPRE1 encodes EB1; MAPRE2 (OMIM Ref. No. 605789) encodes RP1 and the EB2 fragment; and MAPRE3 encodes EBF3 and the fragment RP3. MAPRE3, like MAPRE1 and MAPRE2, contains 7 exons, but the coding region of MAPRE3 spans only 4.2 kb due to relatively short introns. Western blot analysis detected expression of both isoforms as approximately 32-kD proteins in most cell lines tested. Binding analysis determined that both isoforms interact with APC. By FISH, Nakagawa et al. (2000) mapped the MAPRE3 gene to 2p23.3-p23.1. Using radiation hybrid analysis, Su and Qi (2001) mapped the MAPRE3 gene to 2p23.3-p23.2, where it is closely linked and proximal to the ketohexokinase gene (OMIM Ref. No. 229800).

Full details of the abovementioned studies are described in the following publications, the disclosure of which are hereby incorporated by reference:

Nakagawa, H.; Koyama, K.; Murata, Y.; Morito, M.; Akiyama, T.; Nakamura, Y.: EB3, a novel member of the EB1 family preferentially expressed in the central nervous system, binds to a CNS-specific APC homologue. Oncogene 19:210-216, 2000; and Su, L.-K.; Qi, Y.: Characterization of human MAPRE genes and their proteins. Genomics 71:143-149, 2001.

Further studies establishing the function and utilities of MAPRE3 are found in John Hopkins OMIM database record ID 605788, and in sited publications numbered 628 and 8578 listed in the bibliography section hereinbelow, which are also hereby incorporated by reference. RAB23, Member RAS Oncogene Family (RAB23, Accession NM_016277) is another VGAM340 host target gene. RAB23 BINDING SITE is HOST TARGET binding site found in the 3' untranslated region of mRNA encoded by RAB23, corresponding to a HOST TARGET binding site such as BINDING SITE I, BINDING SITE II or BINDING SITE III. Table 2 illustrates the complementarity of the nucleotide sequences of RAB23 BINDING SITE, designated SEQ ID:18401, to the nucleotide sequence of VGAM340 RNA, herein designated VGAM RNA, also designated SEQ ID:3051.

Another function of VGAM340 is therefore inhibition of RAB23, Member RAS Oncogene Family (RAB23, Accession NM_016277), a gene which is involved in the regulation of intracellular membrane trafficking. Accordingly, utilities of VGAM340 include diagnosis, prevention and treatment of diseases and clinical conditions associated with RAB23. The function of RAB23 has been established by previous studies. Rab proteins are small GTPases of the Ras superfamily involved in the regulation of intracellular membrane trafficking. For additional background information on Rab proteins, see 179508. The RAB23 gene encodes an essential negative regulator of the Sonic hedgehog (SHH; 600725) signaling pathway Animal model experiments lend further support to the function of RAB23. Mouse embryos homozygous for mutations in the 'open brain' (opb) gene die during the second half of gestation, with an open neural tube in the head and spinal cord, abnormal somites, polydactyly, and poorly developed eyes. The opb1 allele encodes a lys-to-ter mutation at codon 39; the opb2 allele encodes an arg-to-ter mutation at codon 80. These alleles would lack the domains required for guanine nucleotide and Rab effector binding and are therefore null alleles.

It is appreciated that the abovementioned animal model for RAB23 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Eggenschwiler, J. T.; Espinoza, E.; Anderson, K. V.: Rab23 is an essential negative regulator of the mouse Sonic hedgehog signalling pathway. Nature 412: 194-198, 2001; and Zhang, Q.-H.; Ye, M.; Wu, X.-Y.; Ren, S.-X.; Zhao, M.; Zhao, C.-J.; Fu, G.; Shen, Y.; Fan, H.-Y.; Lu, G.; Zhong, M.; Xu, X.-R.; and 9 others: Cloning and functional analysis of cDNAs w.

Further studies establishing the function and utilities of RAB23 are found in John Hopkins OMIM database record ID 606144, and in sited publications numbered 6472-6473 listed in the bibliography section hereinbelow, which are also hereby incorporated by reference. Apolipoprotein L, 4 (APOL4, Accession NM_030643) is another VGAM340 host target gene. APOL4 BINDING SITE is HOST TARGET binding site found in the 3' untranslated region of mRNA encoded by APOL4, corresponding to a HOST TARGET binding site such as BINDING SITE I, BINDING SITE II or BINDING SITE III. Table 2 illustrates the complementarity of the nucleotide sequences of APOL4 BINDING SITE, designated SEQ ID:24976, to the nucleotide sequence of VGAM340 RNA, herein designated VGAM RNA, also designated SEQ ID:3051.

Another function of VGAM340 is therefore inhibition of Apolipoprotein L, 4 (APOL4, Accession NM_030643). Accordingly, utilities of VGAM340 include diagnosis, prevention and treatment of diseases and clinical conditions associated with APOL4. DKFZP564G092 (Accession NM_015601) is another VGAM340 host target gene. DKFZP564G092 BINDING SITE is HOST TARGET binding site found in the 5' untranslated region of mRNA encoded by DKFZP564G092, corresponding to a HOST TARGET binding site such as BINDING SITE I, BINDING SITE II or BINDING SITE III. Table 2 illustrates the complementarity of the nucleotide sequences of DKFZP564G092 BINDING SITE, designated SEQ ID:17876, to the nucleotide sequence of VGAM340 RNA, herein designated VGAM RNA, also designated SEQ ID:3051.

Another function of VGAM340 is therefore inhibition of DKFZP564G092 (Accession NM_015601). Accordingly, utilities of VGAM340 include diagnosis, prevention and treatment of diseases and clinical conditions associated with DKFZP564G092. FLJ00001 (Accession XM_088525) is another VGAM340 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39771, to the nucleotide sequence of VGAM340 RNA, herein designated VGAM RNA, also designated SEQ ID:3051.

Another function of VGAM340 is therefore inhibition of FLJ00001 (Accession XM_088525). Accordingly, utilities of VGAM340 include diagnosis, prevention and treatment of diseases and clinical conditions associated with FLJ00001. FLJ10846 (Accession NM_018241) is another VGAM340 host target gene. FLJ10846 BINDING SITE is HOST TARGET binding site found in the 3' untranslated region of mRNA encoded by FLJ10846, corresponding to a HOST TARGET binding site such as BINDING SITE I, BINDING SITE II or BINDING SITE III. Table 2 illustrates the complementarity of the nucleotide sequences of FLJ10846 BINDING SITE, designated SEQ ID:20200, to the nucleotide sequence of VGAM340 RNA, herein designated VGAM RNA, also designated SEQ ID:3051.

Another function of VGAM340 is therefore inhibition of FLJ10846 (Accession NM_018241). Accordingly, utilities of VGAM340 include diagnosis, prevention and treatment of diseases and clinical conditions associated with FLJ10846. FLJ11539 (Accession NM_024748) is another VGAM340 host target gene. FLJ11539 BINDING SITE is HOST TARGET binding site found in the 3' untranslated region of mRNA encoded by FLJ11539, corresponding to a HOST TARGET binding site such as BINDING SITE I, BINDING SITE II or BINDING SITE III. Table 2 illustrates the complementarity of the nucleotide sequences of FLJ11539 BINDING SITE, designated SEQ ID:24088, to the nucleotide sequence of VGAM340 RNA, herein designated VGAM RNA, also designated SEQ ID:3051.

Another function of VGAM340 is therefore inhibition of FLJ11539 (Accession NM_024748). Accordingly, utilities of VGAM340 include diagnosis, prevention and treatment of diseases and clinical conditions associated with FLJ11539. Golgi Associated, Gamma Adaptin Ear Containing, ARF Binding Protein 2 (GGA2, Accession NM_138640) is another VGAM340 host target gene. GGA2 BINDING SITE1 and GGA2 BINDING SITE2 are HOST TARGET binding sites found in untranslated regions of mRNA encoded by GGA2, corresponding to HOST TARGET binding sites such as BINDING SITE I, BINDING SITE II or BINDING SITE III. Table 2 illustrates the complementarity of the nucleotide sequences of GGA2 BINDING SITE1 and GGA2 BINDING SITE2, designated SEQ ID:28922 and SEQ ID:17401 respectively, to the nucleotide sequence of VGAM340 RNA, herein designated VGAM RNA, also designated SEQ ID:3051.

Another function of VGAM340 is therefore inhibition of Golgi Associated, Gamma Adaptin Ear Containing, ARF Binding Protein 2 (GGA2, Accession NM_138640). Accordingly, utilities of VGAM340 include diagnosis, prevention and treatment of diseases and clinical conditions associated with GGA2. KIAA1546 (Accession XM_042301) is another VGAM340 host target gene. KIAA1546 BINDING SITE is HOST TARGET binding site found in the 3' untranslated region of mRNA encoded by KIAA1546, corresponding to a HOST TARGET binding site such as BINDING SITE I, BINDING SITE II or BINDING SITE III. Table 2 illustrates the complementarity of the nucleotide sequences of KIAA1546 BINDING SITE, designated SEQ ID:33712, to the nucleotide sequence of VGAM340 RNA, herein designated VGAM RNA, also designated SEQ ID:3051.

Another function of VGAM340 is therefore inhibition of KIAA1546 (Accession XM_042301). Accordingly, utilities of VGAM340 include diagnosis, prevention and treatment of diseases and clinical conditions associated with KIAA1546. Lysyl Oxidase-like 4 (LOXL4, Accession NM_032211) is another VGAM340 host target gene. LOXL4 BINDING SITE is HOST TARGET binding site found in the 3' untranslated region of mRNA encoded by LOXL4, corresponding to a HOST TARGET binding site such as BINDING SITE I, BINDING SITE II or BINDING SITE III. Table 2 illustrates the complementarity of the nucleotide sequences of LOXL4 BINDING SITE, designated SEQ ID:25928, to the nucleotide sequence of VGAM340 RNA, herein designated VGAM RNA, also designated SEQ ID:3051.

Another function of VGAM340 is therefore inhibition of Lysyl Oxidase-like 4 (LOXL4, Accession NM_032211). Accordingly, utilities of VGAM340 include diagnosis, prevention and treatment of diseases and clinical conditions associated with LOXL4. Serine/threonine Kinase 17b (apoptosis-inducing) (STK17B, Accession NM_004226) is another VGAM340 host target gene. STK17B BINDING SITE is HOST TARGET binding site found in the 5' untranslated region of mRNA encoded by STK17B, corresponding to a HOST TARGET binding site such as BINDING SITE I, BINDING SITE II or BINDING SITE III. Table 2 illustrates the complementarity of the nucleotide sequences of STK17B BINDING SITE, designated SEQ ID:10421, to the nucleotide sequence of VGAM340 RNA, herein designated VGAM RNA, also designated SEQ ID:3051.

Another function of VGAM340 is therefore inhibition of Serine/threonine Kinase 17b (apoptosis-inducing) (STK17B, Accession NM_004226). Accordingly, utilities of VGAM340 include diagnosis, prevention and treatment of diseases and clinical conditions associated with STK17B. TUSP (Accession NM_020245) is another VGAM340 host target gene. TUSP BINDING SITE is HOST TARGET binding site found in the 5' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21518, to the nucleotide sequence of VGAM340 RNA, herein designated VGAM RNA, also designated SEQ ID:3051.

Another function of VGAM340 is therefore inhibition of TUSP (Accession NM_020245). Accordingly, utilities of VGAM340 include diagnosis, prevention and treatment of diseases and clinical conditions associated with TUSP. LOC169611 (Accession XM_095809) is another VGAM340 host target gene. LOC169611 BINDING SITE is HOST TARGET binding site found in the 3' untranslated region of mRNA encoded by LOC169611, corresponding to a HOST TARGET binding site such as BINDING SITE I, BINDING SITE II or BINDING SITE III. Table 2 illustrates the complementarity of the nucleotide sequences of LOC169611 BINDING SITE, designated SEQ ID:40285, to the nucleotide sequence of VGAM340 RNA, herein designated VGAM RNA, also designated SEQ ID:3051.

Another function of VGAM340 is therefore inhibition of LOC169611 (Accession XM_095809). Accordingly, utilities of VGAM340 include diagnosis, prevention and treatment of diseases and clinical conditions associated with LOC169611. FIG. 1 further provides a conceptual description of a novel bioinformatically detected viral gene of the present invention, referred to here as Viral Genomic Address Messenger 341 (VGAM341) viral gene, which modulates expression of respective host target genes thereof, the function and utility of which host target genes is known in the art.

VGAM341 is a novel bioinformatically detected regulatory, non protein coding, viral micro RNA (miRNA) gene. The method by which VGAM341 was detected is described hereinabove with reference to FIGS. 1-8.

VGAM341 gene, herein designated VGAM GENE, is a viral gene contained in the genome of Tobacco Mosaic Virus. VGAM341 host target gene, herein designated VGAM HOST TARGET GENE, is a human gene contained in the human genome.

VGAM341 gene encodes a VGAM341 precursor RNA, herein designated VGAM PRECURSOR RNA. Similar to other miRNA genes, and unlike most ordinary genes, VGAM341 precursor RNA does not encode a protein. A nucleotide sequence identical or highly similar to the nucleotide sequence of VGAM341 precursor RNA is designated SEQ ID:327, and is provided hereinbelow with reference to the sequence listing part. Nucleotide sequence SEQ ID:327 is located at position 2648 relative to the genome of Tobacco Mosaic Virus.

VGAM341 precursor RNA folds onto itself, forming VGAM341 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM341 folded precursor RNA into VGAM341 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM341 RNA is designated SEQ ID:3052, and is provided hereinbelow with reference to the sequence listing part.

VGAM341 host target gene, herein designated VGAM HOST TARGET GENE, encodes a corresponding messenger RNA, VGAM341 host target RNA, herein designated VGAM HOST TARGET RNA. VGAM341 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM341 RNA, herein designated VGAM RNA, binds complementarily to one or more host target binding sites located in untranslated regions of VGAM341 host target RNA, herein designated VGAM HOST TARGET RNA. This complementary binding is due to the fact that the nucleotide sequence of VGAM341 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM341 RNA, herein designated VGAM RNA, may have a different number of host target binding sites in untranslated regions of a VGAM341 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM341 RNA, herein designated VGAM RNA, to host target binding sites on VGAM341 host target RNA, herein designated VGAM HOST TARGET RNA, such as BINDING SITE I, BINDING SITE II and BINDING SITE III, inhibits translation of VGAM341 host target RNA into VGAM341 host target protein, herein designated VGAM HOST TARGET PROTEIN. VGAM host target protein is therefore outlined by a broken line.

It is appreciated that VGAM341 host target gene, herein designated VGAM HOST TARGET GENE, in fact represents a plurality of VGAM341 host target genes. The mRNA of each one of this plurality of VGAM341 host target genes comprises one or more host target binding sites, each having a nucleotide sequence which is at least partly complementary to VGAM341 RNA, herein designated VGAM RNA, and which when bound by VGAM341 RNA causes inhibition of translation of respective one or more VGAM341 host target proteins.

It is further appreciated by one skilled in the art that the mode of translational inhibition illustrated by FIG. 1 with specific reference to translational inhibition exerted by VGAM341 gene, herein designated VGAM GENE, on one or more VGAM341 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM341 is inhibition of expression of host target genes, as part of a novel viral mechanism of attacking a host. Accordingly, utilities of VGAM341 include diagnosis, prevention and treatment of viral infection by Tobacco Mosaic Virus. Specific functions, and accordingly utilities, of VGAM341 correlate with, and may be deduced from, the identity of the host target genes which VGAM341 binds and inhibits, and the function of these target genes, as elaborated hereinbelow.

Nucleotide sequences of the VGAM341 precursor RNA, herein designated VGAM PRECURSOR RNA, and of the 'diced' VGAM341 RNA, herein designated VGAM RNA, and a schematic representation of the secondary folding of VGAM341 folded precursor RNA, herein designated VGAM FOLDED PRECURSOR RNA, of VGAM341 are further described hereinbelow with reference to Table 1.

Nucleotide sequences of host target binding sites, such as BINDING SITE-I, BINDING SITE-II and BINDING SITE-III of FIG. 1, found on VGAM341 host target RNA, and schematic representation of the complementarity of each of these host target binding sites to VGAM341 RNA, herein designated VGAM RNA, are described hereinbelow with reference to Table 2.

As mentioned hereinabove with reference to FIG. 1, a function of VGAM341 gene, herein designated VGAM is inhibition of expression of VGAM341 target genes. It is appreciated that specific functions, and accordingly utilities, of VGAM341 correlate with, and may be deduced from, the identity of the target genes which VGAM341 binds and inhibits, and the function of these target genes, as elaborated hereinbelow.

GRB2-associated Binding Protein 2 (GAB2, Accession NM_012296) is a VGAM341 host target gene. GAB2 BINDING SITE is HOST TARGET binding site found in the 5' untranslated region of mRNA encoded by GAB2, corresponding to a HOST TARGET binding site such as BINDING SITE I, BINDING SITE II or BINDING SITE III. Table 2 illustrates the complementarity of the nucleotide sequences of GAB2 BINDING SITE, designated SEQ ID:14649, to the nucleotide sequence of VGAM341 RNA, herein designated VGAM RNA, also designated SEQ ID:3052.

A function of VGAM341 is therefore inhibition of GRB2-associated Binding Protein 2 (GAB2, Accession NM_012296), a gene which act as adapters for transmitting various signals. Accordingly, utilities of VGAM341 include diagnosis, prevention and treatment of diseases and clinical conditions associated with GAB2. The function of GAB2 and its association with various diseases and clinical conditions, has been established by previous studies, as described hereinabove with reference to VGAM53. Growth Hormone Receptor (GHR, Accession NM_000163) is another VGAM341 host target gene. GHR BINDING SITE is HOST TARGET binding site found in the 3' untranslated region of mRNA encoded by GHR, corresponding to a HOST TARGET binding site such as BINDING SITE I, BINDING SITE II or BINDING SITE III. Table 2 illustrates the complementarity of the nucleotide sequences of GHR BINDING SITE, designated SEQ ID:5674, to the nucleotide sequence of VGAM341 RNA, herein designated VGAM RNA, also designated SEQ ID:3052.

Another function of VGAM341 is therefore inhibition of Growth Hormone Receptor (GHR, Accession NM_000163). Accordingly, utilities of VGAM341 include diagnosis, prevention and treatment of diseases and clinical conditions associated with GHR. Gap Junction Protein, Alpha 1, 43 kDa (connexin 43) (GJA1, Accession NM_000165) is another VGAM341 host target gene. GJA1 BINDING SITE is HOST TARGET binding site found in the 3' untranslated region of mRNA encoded by GJA1, corresponding to a HOST TARGET binding site such as BINDING SITE I, BINDING SITE II or BINDING SITE III. Table 2 illustrates the complementarity of the nucleotide sequences of GJA1 BINDING SITE, designated SEQ ID:5681, to the nucleotide sequence of VGAM341 RNA, herein designated VGAM RNA, also designated SEQ ID:3052.

Another function of VGAM341 is therefore inhibition of Gap Junction Protein, Alpha 1, 43 kDa (connexin 43) (GJA1, Accession NM_000165), a gene which may act in synchronizing heart contraction and embryonic development. Accordingly, utilities of VGAM341 include diagnosis, prevention and treatment of diseases and clinical conditions associated with GJA1. The function of GJA1 has been established by previous studies. The migration of lymphocytes from the circulation into tissues involves a number of adhesion molecules and the expression of new molecules. Gap junctions facilitate cell-to-cell adhesion and provide pathways for direct intercellular communication. Oviedo-Orta et al. (2000) noted that GJA1 is expressed in a number of lymphoid organs. By RT-PCR, Western blot, and flow cytometric analyses, they showed that lymphocytes express GJA1 and GJA5 (OMIM Ref. No. 121013), but not GJB2 (OMIM Ref. No. 121011), GJB1 (OMIM Ref. No. 304040), GJA4 (OMIM Ref. No. 121012), or GJA7; GJA5 expression was restricted to tonsillar T and B lymphocytes. Flow cytometric analysis showed that GJA1 and GJA5 expression increases after mitogenic stimulation. Extracellular connexin mimetic peptide blocked dye transfer between lymphocyte subpopulations, and gap junction inhibitors decreased the production of IgM in cocultured T and B lymphocytes. The results identified gap junction proteins as important cell surface components that modulate immune responses. Animal model experiments lend further support to the function of GJA1. By targeted mutagenesis of connexin-43, Reaume et al. (1995) showed that its absence was compatible with survival of mouse embryos to term, even though cell lines mutant in Cx43 showed reduced dye coupling in vitro as assessed by injection of carboxyfluorescein. The latter test indicated a reduction, but not complete absence, of junctional communication. However, mutant embryos died at birth as a result of a failure in pulmonary gas exchange caused by a swelling and blockage of the right ventricular outflow tract from the heart. Reaume et al. (1995) interpreted this finding as indicating that Cx43 plays an essential role in heart development but that there is functional compensation among connexins in other parts of the developing fetus.

It is appreciated that the abovementioned animal model for GJA1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Oviedo-Orta, E.; Hoy, T.; Evans, W. H.: Intercellular communication in the immune system: differential expression of connexin40 and 43, and perturbation of gap junction channel functions in peripheral blood and tonsil human lymphocyte subpopulations. Immunology 99:578-590, 2000; and Reaume, A. G.; de Sousa, P. A.; Kulkarni, S.; Langille, B. L.; Zhu, D.; Davies, T. C.; Juneja, S. C.; Kidder, G. M.; Rossant, J.: Cardiac malformation in neonatal mice lacking connex.

Further studies establishing the function and utilities of GJA1 are found in John Hopkins OMIM database record ID 121014, and in sited publications numbered 11845-11850, 11978, 136-139, 12142-142, 11843-145, 145-14 and 11839 listed in the bibliography section hereinbelow, which are also hereby incorporated by reference. Host Cell Factor C1 (VP16-accessory protein) (HCFC1, Accession XM_048390) is another VGAM341 host target gene. HCFC1 BINDING SITE is HOST TARGET binding site found in the 3' untranslated region of mRNA encoded by HCFC1, corresponding to a HOST TARGET binding site such as BINDING SITE I, BINDING SITE II or BINDING SITE III. Table 2 illustrates the complementarity of the nucleotide sequences of HCFC1 BINDING SITE, designated SEQ ID:35156, to the nucleotide sequence of VGAM341 RNA, herein designated VGAM RNA, also designated SEQ ID:3052.

Another function of VGAM341 is therefore inhibition of Host Cell Factor C1 (VP16-accessory protein) (HCFC1, Accession XM_048390), a gene which is host cell factor, has a role in cell proliferation and can form a complex with HSV VP16. Accordingly, utilities of VGAM341 include diagnosis, prevention and treatment of diseases and clinical conditions associated with HCFC1. The function of HCFC1 has been established by previous studies. By fluorescence in situ hybridization and somatic cell hybrid analysis, Wilson et al. (1995) mapped the HCFC1 gene to Xq28. YAC and cosmid mapping localized the HCFC1 gene within 100 kb distal of the V2R gene (OMIM Ref. No. 304800) and adjacent to the renin-binding protein gene (OMIM Ref. No. 312420). HCF transcripts and protein are most abundant in fetal and placental tissues and cell lines, suggesting a role in cell proliferation. In adults, HCF protein is abundant in the kidney, but not in the brain, a site of latent herpes simplex virus (HSV) infection and a site where HCF levels may influence progression of HSV infection. Zoppe et al. (1996) reported the complete sequence of the HCFC1 gene, including 2 kb of the 5-prime-flanking region and 5.9 kb of the first intron. In addition to the detection of many putative binding sites for known DNA binding proteins, a highly conserved 17-bp sequence was found to be present 6 times at regular intervals in the 5-prime region of the gene. This motif is capable of binding the transcription factor Yin/Yang 1 (YY1) as well as another unidentified factor, suggesting that HCFC1 expression is regulated by the interaction of these factors.

Full details of the abovementioned studies are described in the following publications, the disclosure of which are hereby incorporated by reference:

Wilson, A. C.; Parrish, J. E.; Massa, H. F.; Nelson, D. L.; Trask, B. J.; Herr, W.: The gene encoding the VP16-accessory protein HCF (HCFC1) resides in human Xq28 and is highly expressed in fetal tissues and the adult kidney. Genomics 25:462-468, 1995; and Zoppe, M.; Frattini, A.; Faranda, S.; Vezzoni, P.: The complete sequence of the host cell factor 1 (HCFC1) gene and its promoter: a role for YY1 transcription factor in the regulation o.

Further studies establishing the function and utilities of HCFC1 are found in John Hopkins OMIM database record ID 300019, and in sited publications numbered 7265-7270 listed in the bibliography section hereinbelow, which are also hereby incorporated by reference. Neurotrophic Tyrosine Kinase, Receptor, Type 2 (NTRK2, Accession NM_006180) is another VGAM341 host target gene. NTRK2 BINDING SITE is HOST TARGET binding site found in the 3' untranslated region of mRNA encoded by NTRK2, corresponding to a HOST TARGET binding site such as BINDING SITE I, BINDING SITE II or BINDING SITE III. Table 2 illustrates the complementarity of the nucleotide sequences of NTRK2 BINDING SITE, designated SEQ ID:12850, to the nucleotide sequence of VGAM341 RNA, herein designated VGAM RNA, also designated SEQ ID:3052.

Another function of VGAM341 is therefore inhibition of Neurotrophic Tyrosine Kinase, Receptor, Type 2 (NTRK2, Accession NM_006180), a gene which is involved in the development and/or maintenance of the nervous system. Accordingly, utilities of VGAM341 include diagnosis, prevention and treatment of diseases and clinical conditions associated with NTRK2. The function of NTRK2 has been established by previous studies. Nakagawara et al. (1995) isolated cDNAs spanning the entire coding region of both human full-length and truncated forms of TRKB from human brain cDNA libraries. The full-length TRKB coded for a protein of 822 amino acid residues. The putative mature peptide sequence was 49% and 55% homologous to human NTRK1 and NTRK3, respectively. Nine of 13 cysteine residues, 4 of 12 N-glycosylation sites in the extracellular domain, and 10 of 13 tyrosine residues in the intracellular domain are conserved among NTRK1, NTRK2, and NTRK3. Two major sizes of NTRK2 transcripts were expressed in human brain. Animal model experiments lend further support to the function of NTRK2. To study the function of TRKB in the cerebellum, Rico et al. (2002) deleted the Trkb gene in mouse cerebellar precursors by Wnt1-driven Cre-mediated recombination. Despite the absence of Trkb, the mature cerebellum of mutant mice appeared similar to that of wildtype, with all types of cells present in normal numbers and positions. Granule and Purkinje cell dendrites appeared normal, and the former had typical numbers of excitatory synapses. By contrast, inhibitory interneurons were strongly affected. Although present in normal number, inhibitory interneurons exhibited reduced amounts of GABAergic markers and developed reduced numbers of GABAergic boutons and synaptic specializations. Thus, Rico et al. (2002) concluded that TRKB is essential to the development of GABAergic neurons and regulates synapse formation in addition to its role in the development of axon terminals.

It is appreciated that the abovementioned animal model for NTRK2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Nakagawara, A.; Liu, X.-G.; Ikegaki, N.; White, P. S.; Yamashiro, D. J.; Nycum, L. M.; Biegel, J. A.; Brodeur, G. M.: Cloning and chromosomal localization of the human TRK-B tyrosine kinase receptor gene (NTRK2). Genomics 25:538-546, 1995; and Rico, B.; Xu, B.; Reichardt, L. F.: TrkB receptor signaling is required for establishment of GABAergic synapses in the cerebellum. Nature Neurosci. 5:225-233, 2002.

Further studies establishing the function and utilities of NTRK2 are found in John Hopkins OMIM database record ID 600456, and in sited publications numbered 1939-1940, 1942, 12375-161 and 12342 listed in the bibliography section hereinbelow, which are also hereby incorporated by reference. Proteasome (prosome, macropain) 26S Subunit, Non-ATPase, 5 (PSMD5, Accession NM_005047) is another VGAM341 host target gene. PSMD5 BINDING SITE is HOST TARGET binding site found in the 3' untranslated region of mRNA encoded by PSMD5, corresponding to a HOST TARGET binding site such as BINDING SITE I, BINDING SITE II or BINDING SITE III. Table 2 illustrates the complementarity of the nucleotide sequences of PSMD5 BINDING SITE, designated SEQ ID:11480, to the nucleotide sequence of VGAM341 RNA, herein designated VGAM RNA, also designated SEQ ID:3052.

Another function of VGAM341 is therefore inhibition of Proteasome (prosome, macropain) 26S Subunit, Non-ATPase, 5 (PSMD5, Accession NM_005047), a gene which is the non-ATPase subunit 5 of the 26S proteasome (prosome macropain). Accordingly, utilities of VGAM341 include diagnosis, prevention and treatment of diseases and clinical conditions associated with PSMD5. The function of PSMD5 has been established by previous studies. The covalent attachment of ubiquitin to proteins produces substrates for the 26S ATP-dependent protease. This enzyme is composed of the multicatalytic protease, or proteasome, and a regulatory ATPase complex. Both the multicatalytic protease and the regulatory complex are multisubunit structures that associate in the presence of ATP to form the 26S enzyme. Deveraux et al. (1994) identified a 50-kD subunit of the regulatory complex, which they called subunit 5 (S5) based upon its relative mobility on SDS-polyacrylamide gels. Deveraux et al. (1995) demonstrated that 2 distinct subunits of the 26S protease migrate as 50-kD proteins, and thus, S5 represents 2 proteins, which the authors termed S5A (PSMD4; 601648) and S5B, also called PSMD5. Deveraux et al. (1995) sequenced peptides from the PSMD5 subunit of the human red blood cell 26S protease. Using the amino acid sequence, they isolated human cDNAs comprising a full-length PSMD5 cDNA. The deduced 505-amino acid PSMD5 protein is enriched in leucine residues, particularly in the N-terminal region. PSMD5 contains 9 dileucine repeats and a sequence, NPNY, similar to the tyrosine-based motifs. Dileucine repeats and tyrosine-based motifs are thought to contribute to internalization and/or targeting. PSMD5 has a calculated molecular mass of 56 kD and focuses at pH 5.3 on 2-dimensional gels. Recombinant PSMD5 did not bind to ubiquitin polymers. By sequencing cDNAs randomly selected from a cDNA library derived from a human immature myeloid cell line, Nomura et al. (1994) isolated a partial cDNA encoding PSMD5, which they called KIAA0072. Northern blot analysis detected PSMD5 expression in a wide variety of human tissues, with the highest expression in lung and skeletal muscle. Deveraux et al. (1995) noted that the nucleotide sequence of the KIAA0072 cDNA is identical to the corresponding nucleotide sequence of the S5B cDNA.

Full details of the abovementioned studies are described in the following publications, the disclosure of which are hereby incorporated by reference:

Deveraux, Q.; Jensen, C.; Rechsteiner, M.: Molecular cloning and expression of a 26 S protease subunit enriched in dileucine repeats. J. Biol. Chem. 270:23726-23729, 1995; and Deveraux, Q.; Ustrell, V.; Pickart, C.; Rechsteiner, M.: A 26 S protease subunit that binds ubiquitin conjugates. J. Biol. Chem. 269:7059-7061, 1994.

Further studies establishing the function and utilities of PSMD5 are found in John Hopkins OMIM database record ID 604452, and in sited publications numbered 6555-655 and 2255 listed in the bibliography section hereinbelow, which are also hereby incorporated by reference. Retinal Degeneration, Slow (retinitis pigmentosa 7) (RDS, Accession NM_000322) is another VGAM341 host target gene. RDS BINDING SITE is HOST TARGET binding site found in the 3" untranslated region of mRNA encoded by RDS, corresponding to a HOST TARGET binding site such as BINDING SITE I, BINDING SITE II or BINDING SITE III. Table 2 illustrates the complementarity of the nucleotide sequences of RDS BINDING SITE, designated SEQ ID:5864, to the nucleotide sequence of VGAM341 RNA, herein designated VGAM RNA, also designated SEQ ID:3052.

Another function of VGAM341 is therefore inhibition of Retinal Degeneration, Slow (retinitis pigmentosa 7) (RDS, Accession NM_000322), a gene which may function as an adhesion molecule involved in stabilization and compaction of outer segment disks or in the maintenance of the curvature of the rim. Accordingly, utilities of VGAM341 include diagnosis, prevention and treatment of diseases and clinical conditions associated with RDS. The function of RDS has been established by previous studies. In mammals, most cyanide is converted to thiocyanate by the mitochondrial enzyme thiosulfate sulfurtransferase. Cagianut et al. (1981) found much reduced activity of this enzyme in the livers of 2 males with Leber optic atrophy (OMIM Ref. No. 535000) from a well-studied Swiss family with 5 symptomatic persons in 4 generations. Nikoskelainen (1984) could not confirm the reported low activity of rhodanese in Leber patients. Whitehouse et al. (1989) studied rhodanese isozymes in liver biopsies from 3 subjects with Leber optic neuropathy. No qualitative abnormality and no deficiency could be found, thus excluding the hypothesis of rhodanese deficiency. By screening a human fetal liver cDNA expression library with a monoclonal antibody against bovine liver rhodanese, Aita et al. (1997) cloned a RDS cDNA. Northern blotting showed that the RDS gene is expressed as a 1.3-kb mRNA. It encodes a predicted 297-amino acid protein that is approximately 90% identical to rodent and bovine Rds. Transient expression of the RDS cDNA in E. coli and in mammalian cells resulted in significantly increased rhodanese activity. Animal model experiments lend further support to the function of RDS.

It is appreciated that the abovementioned animal model for RDS is acknowledged by those skilled in the art as a scientifically valid animal model, as can be further appreciated from the publications sited hereinbelow.

Full details of the abovementioned studies are described in the following publications, the disclosure of which are hereby incorporated by reference:

Whitehouse, D. B.; Poole, C. J. M.; Kind, P. R. N.; Hopkinson, D. A.: Rhodanese isozymes in three subjects with Leber's optic neuropathy. J. Med. Genet. 26: 113-115, 1989; and Aita, N.; Ishii, K.; Akamatsu, Y.; Ogasawara, Y.; Tanabe, S.: Cloning and expression of human liver rhodanese cDNA. Biochem. Biophys. Res. Commun. 231:56-60, 1997.

Further studies establishing the function and utilities of RDS are found in John Hopkins OMIM database record ID 180370, and in sited publications numbered 2552-255 and 11874-2558 listed in the bibliography section hereinbelow, which are also hereby incorporated by reference. Transmembrane, Prostate Androgen Induced RNA (TMEPAI, Accession NM_020182) is another VGAM341 host target gene. TMEPAI BINDING SITE is HOST TARGET binding site found in the 3' untranslated region of mRNA encoded by TMEPAI, corresponding to a HOST TARGET binding site such as BINDING SITE I, BINDING SITE II or BINDING SITE III. Table 2 illustrates the complementarity of the nucleotide sequences of TMEPAI BINDING SITE, designated SEQ ID:21408, to the nucleotide sequence of VGAM341 RNA, herein designated VGAM RNA, also designated SEQ ID:3052.

Another function of VGAM341 is therefore inhibition of Transmembrane, Prostate Androgen Induced RNA (TMEPAI, Accession NM_020182). Accordingly, utilities of VGAM341 include diagnosis, prevention and treatment of diseases and clinical conditions associated with TMEPAI. Tripartite Motif-containing 9 (TRIM9, Accession NM_015163) is another VGAM341 host target gene. TRIM9 BINDING SITE is HOST TARGET binding site found in the 3' untranslated region of mRNA encoded by TRIM9, corresponding to a HOST TARGET binding site such as BINDING SITE I, BINDING SITE II or BINDING SITE III. Table 2 illustrates the complementarity of the nucleotide sequences of TRIM9 BINDING SITE, designated SEQ ID:17513, to the nucleotide sequence of VGAM341 RNA, herein designated VGAM RNA, also designated SEQ ID:3052.

Another function of VGAM341 is therefore inhibition of Tripartite Motif-containing 9 (TRIM9, Accession NM_015163), a gene which may function as a positive regulator for mannosylphosphate transferase and is required to mediate mannosylphosphate transfer in both the core and outer chain portions of n-linked. oligosaccharides. Accordingly, utilities of VGAM341 include diagnosis, prevention and treatment of diseases and clinical conditions associated with TRIM9. The function of TRIM9 and its association with various diseases and clinical conditions, has been established by previous studies, as described hereinabove with reference to VGAM74. Blepharophimosis, Epicanthus Inversus and Ptosis, Candidate 1 (BPESC1, Accession NM_021812) is another VGAM341 host target gene. BPESC1 BINDING SITE is HOST TARGET binding site found in the 3' untranslated region of mRNA encoded by BPESC1, corresponding to a HOST TARGET binding site such as BINDING SITE I, BINDING SITE II or BINDING SITE III. Table 2 illustrates the complementarity of the nucleotide sequences of BPESC1 BINDING SITE, designated SEQ ID:22375, to the nucleotide sequence of VGAM341 RNA, herein designated VGAM RNA, also designated SEQ ID:3052.

Another function of VGAM341 is therefore inhibition of Blepharophimosis, Epicanthus Inversus and Ptosis, Candidate 1 (BPESC1, Accession NM_021812). Accordingly, utilities of VGAM341 include diagnosis, prevention and treatment of diseases and clinical conditions associated with BPESC1. Chromosome 1 Open Reading Frame 22 (C1orf22, Accession NM_025191) is another VGAM341 host target gene. C1orf22 BINDING SITE is HOST TARGET binding site found in the 3' untranslated region of mRNA encoded by C1orf22, corresponding to a HOST TARGET binding site such as BINDING SITE I, BINDING SITE II or BINDING SITE III. Table 2 illustrates the complementarity of the nucleotide sequences of C1orf22 BINDING SITE, designated SEQ ID:24836, to the nucleotide sequence of VGAM341 RNA, herein designated VGAM RNA, also designated SEQ ID:3052.

Another function of VGAM341 is therefore inhibition of Chromosome 1 Open Reading Frame 22 (C1orf22, Accession NM_025191). Accordingly, utilities of VGAM341 include diagnosis, prevention and treatment of diseases and clinical conditions associated with C1orf22. FLJ14075 (Accession NM_024894) is another VGAM341 host target gene. FLJ14075 BINDING SITE is HOST TARGET binding site found in the 3' untranslated region of mRNA encoded by FLJ14075, corresponding to a HOST TARGET binding site such as BINDING SITE I, BINDING SITE II or BINDING SITE III. Table 2 illustrates the complementarity of the nucleotide sequences of FLJ14075 BINDING SITE, designated SEQ ID:24375, to the nucleotide sequence of VGAM341 RNA, herein designated VGAM RNA, also designated SEQ ID:3052.

Another function of VGAM341 is therefore inhibition of FLJ14075 (Accession NM_024894). Accordingly, utilities of VGAM341 include diagnosis, prevention and treatment of diseases and clinical conditions associated with FLJ14075. KIAA0852 (Accession NM_014941) is another VGAM341 host target gene. KIAA0852 BINDING SITE is HOST TARGET binding site found in the 5' untranslated region of mRNA encoded by KIAA0852, corresponding to a HOST TARGET binding site such as BINDING SITE I, BINDING SITE II or BINDING SITE III. Table 2 illustrates the complementarity of the nucleotide sequences of KIAA0852 BINDING SITE, designated SEQ ID:17249, to the nucleotide sequence of VGAM341 RNA, herein designated VGAM RNA, also designated SEQ ID:3052.

Another function of VGAM341 is therefore inhibition of KIAA0852 (Accession NM_014941). Accordingly, utilities of VGAM341 include diagnosis, prevention and treatment of diseases and clinical conditions associated with KIAA0852. KIAA1203 (Accession XM_049683) is another VGAM341 host target gene. KIAA1203 BINDING SITE is HOST TARGET binding site found in the 3' untranslated region of mRNA encoded by KIAA1203, corresponding to a HOST TARGET binding site such as BINDING SITE I, BINDING SITE II or BINDING SITE III. Table 2 illustrates the complementarity of the nucleotide sequences of KIAA1203 BINDING SITE, designated SEQ ID:35469, to the nucleotide sequence of VGAM341 RNA, herein designated VGAM RNA, also designated SEQ ID:3052.

Another function of VGAM341 is therefore inhibition of KIAA1203 (Accession XM_049683). Accordingly, utilities of VGAM341 include diagnosis, prevention and treatment of diseases and clinical conditions associated with KIAA1203. Mitogen-activated Protein Kinase Kinase Kinase 2 (MAP3K2, Accession NM_006609) is another VGAM341 host target gene. MAP3K2 BINDING SITE is HOST TARGET binding site found in the 3' untranslated region of mRNA encoded by MAP3K2, corresponding to a HOST TARGET binding site such as BINDING SITE I, BINDING SITE II or BINDING SITE III. Table 2 illustrates the complementarity of the nucleotide sequences of MAP3K2 BINDING SITE, designated SEQ ID:13387, to the nucleotide sequence of VGAM341 RNA, herein designated VGAM RNA, also designated SEQ ID:3052.

Another function of VGAM341 is therefore inhibition of Mitogen-activated Protein Kinase Kinase Kinase 2 (MAP3K2, Accession NM_006609). Accordingly, utilities of VGAM341 include diagnosis, prevention and treatment of diseases and clinical conditions associated with MAP3K2. Roundabout Homolog 4, Magic Roundabout (Drosophila) (ROBO4, Accession NM_019055) is another VGAM341 host target gene. ROBO4 BINDING SITE is HOST TARGET binding site found in the 3' untranslated region of mRNA encoded by ROBO4, corresponding to a HOST TARGET binding site such as BINDING SITE I, BINDING SITE II or BINDING SITE III. Table 2 illustrates the complementarity of the nucleotide sequences of ROBO4 BINDING SITE, designated SEQ ID:21136, to the nucleotide sequence of VGAM341 RNA, herein designated VGAM RNA, also designated SEQ ID:3052.

Another function of VGAM341 is therefore inhibition of Roundabout Homolog 4, Magic Roundabout (Drosophila) (ROBO4, Accession NM_019055). Accordingly, utilities of VGAM341 include diagnosis, prevention and treatment of diseases and clinical conditions associated with ROBO4. SE70-2 (Accession NM_022118) is another VGAM341 host target gene. SE70-2 BINDING SITE is HOST TARGET binding site found in the 5' untranslated region of mRNA encoded by SE70-2, corresponding to a HOST TARGET binding site such as BINDING SITE I, BINDING SITE II or BINDING SITE III. Table 2 illustrates the complementarity of the nucleotide sequences of SE70-2 BINDING SITE, designated SEQ ID:22665, to the nucleotide sequence of VGAM341 RNA, herein designated VGAM RNA, also designated SEQ ID:3052.

Another function of VGAM341 is therefore inhibition of SE70-2 (Accession NM_022118). Accordingly, utilities of VGAM341 include diagnosis, prevention and treatment of diseases and clinical conditions associated with SE70-2. TTY7 (Accession NM_031926) is another VGAM341 host target gene. TTY7 BINDING SITE is HOST TARGET binding site found in the 3' untranslated region of mRNA encoded by TTY7, corresponding to a HOST TARGET binding site such as BINDING SITE I, BINDING SITE II or BINDING SITE III. Table 2 illustrates the complementarity of the nucleotide sequences of TTY7 BINDING SITE, designated SEQ ID:25674, to the nucleotide sequence of VGAM341 RNA, herein designated VGAM RNA, also designated SEQ ID:3052.

Another function of VGAM341 is therefore inhibition of TTY7 (Accession NM_031926). Accordingly, utilities of VGAM341 include diagnosis, prevention and treatment of diseases and clinical conditions associated with TTY7. LOC130074 (Accession XM_072228) is another VGAM341 host target gene. LOC130074 BINDING SITE is HOST TARGET binding site found in the 3' untranslated region of mRNA encoded by LOC130074, corresponding to a HOST TARGET binding site such as BINDING SITE I, BINDING SITE II or BINDING SITE III. Table 2 illustrates the complementarity of the nucleotide sequences of LOC130074 BINDING SITE, designated SEQ ID:37472, to the nucleotide sequence of VGAM341 RNA, herein designated VGAM RNA, also designated SEQ ID:3052.

Another function of VGAM341 is therefore inhibition of LOC130074 (Accession XM_072228). Accordingly, utilities of VGAM341 include diagnosis, prevention and treatment of diseases and clinical conditions associated with LOC130074. LOC152457 (Accession XM_087476) is another VGAM341 host target gene. LOC152457 BINDING SITE is HOST TARGET binding site found in the 3' untranslated region of mRNA encoded by LOC152457, corresponding to a HOST TARGET binding site such as BINDING SITE I, BINDING SITE II or BINDING SITE III. Table 2 illustrates the complementarity of the nucleotide sequences of LOC152457 BINDING SITE, designated SEQ ID:39278, to the nucleotide sequence of VGAM341 RNA, herein designated VGAM RNA, also designated SEQ ID:3052.

Another function of VGAM341 is therefore inhibition of LOC152457 (Accession XM_087476). Accordingly, utilities of VGAM341 include diagnosis, prevention and treatment of diseases and clinical conditions associated with LOC152457. LOC170106 (Accession XM_093106) is another VGAM341 host target gene. LOC170106 BINDING SITE is HOST TARGET binding site found in the 5' untranslated region of mRNA encoded by LOC170106, corresponding to a HOST TARGET binding site such as BINDING SITE I, BINDING SITE II or BINDING SITE III. Table 2 illustrates the complementarity of the nucleotide sequences of LOC170106 BINDING SITE, designated SEQ ID:40174, to the nucleotide sequence of VGAM341 RNA, herein designated VGAM RNA, also designated SEQ ID:3052.

Another function of VGAM341 is therefore inhibition of LOC170106 (Accession XM_093106). Accordingly, utilities of VGAM341 include diagnosis, prevention and treatment of diseases and clinical conditions associated with LOC170106. LOC200860 (Accession XM_117289) is another VGAM341 host target gene. LOC200860 BINDING SITE is HOST TARGET binding site found in the 3' untranslated region of mRNA encoded by LOC200860, corresponding to a HOST TARGET binding site such as BINDING SITE I, BINDING SITE II or BINDING SITE III. Table 2 illustrates the complementarity of the nucleotide sequences of LOC200860 BINDING SITE, designated SEQ ID:43358, to the nucleotide sequence of VGAM341 RNA, herein designated VGAM RNA, also designated SEQ ID:3052.

Another function of VGAM341 is therefore inhibition of LOC200860 (Accession XM_117289). Accordingly, utilities of VGAM341 include diagnosis, prevention and treatment of diseases and clinical conditions associated with LOC200860. LOC221300 (Accession XM_166322) is another VGAM341 host target gene. LOC221300 BINDING SITE is HOST TARGET binding site found in the 3' untranslated region of mRNA encoded by LOC221300, corresponding to a HOST TARGET binding site such as BINDING SITE I, BINDING SITE II or BINDING SITE III. Table 2 illustrates the complementarity of the nucleotide sequences of LOC221300 BINDING SITE, designated SEQ ID:44149, to the nucleotide sequence of VGAM341 RNA, herein designated VGAM RNA, also designated SEQ ID:3052.

Another function of VGAM341 is therefore inhibition of LOC221300 (Accession XM_166322). Accordingly, utilities of VGAM341 include diagnosis, prevention and treatment of diseases and clinical conditions associated with LOC221300.

LOC90161 (Accession XM_029551) is another VGAM341 host target gene. LOC90161 BINDING SITE is HOST TARGET binding site found in the 3' untranslated region of mRNA encoded by LOC90161, corresponding to a HOST TARGET binding site such as BINDING SITE I, BINDING SITE II or BINDING SITE III. Table 2 illustrates the complementarity of the nucleotide sequences of LOC90161 BINDING SITE, designated SEQ ID:30903, to the nucleotide sequence of VGAM341 RNA, herein designated VGAM RNA, also designated SEQ ID:3052.

Another function of VGAM341 is therefore inhibition of LOC90161 (Accession XM_029551). Accordingly, utilities of VGAM341 include diagnosis, prevention and treatment of diseases and clinical conditions associated with LOC90161. FIG. 1 further provides a conceptual description of a novel bioinformatically detected viral gene of the present invention, referred to here as Viral Genomic Address Messenger 342 (VGAM342) viral gene, which modulates expression of respective host target genes thereof, the function and utility of which host target genes is known in the art.

VGAM342 is a novel bioinformatically detected regulatory, non protein coding, viral micro RNA (miRNA) gene. The method by which VGAM342 was detected is described hereinabove with reference to FIGS. 1-8.

VGAM342 gene, herein designated VGAM GENE, is a viral gene contained in the genome of Tobacco Mosaic Virus. VGAM342 host target gene, herein designated VGAM HOST TARGET GENE, is a human gene contained in the human genome.

VGAM342 gene encodes a VGAM342 precursor RNA, herein designated VGAM PRECURSOR RNA. Similar to other miRNA genes, and unlike most ordinary genes, VGAM342 precursor RNA does not encode a protein. A nucleotide sequence identical or highly similar to the nucleotide sequence of VGAM342 precursor RNA is designated SEQ ID:328, and is provided hereinbelow with reference to the sequence listing part. Nucleotide sequence SEQ ID:328 is located at position 3311 relative to the genome of Tobacco Mosaic Virus.

VGAM342 precursor RNA folds onto itself, forming VGAM342 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM342 folded precursor RNA into VGAM342 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM342 RNA is designated SEQ ID:3053, and is provided hereinbelow with reference to the sequence listing part.

VGAM342 host target gene, herein designated VGAM HOST TARGET GENE, encodes a corresponding messenger RNA, VGAM342 host target RNA, herein designated VGAM HOST TARGET RNA. VGAM342 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM342 RNA, herein designated VGAM RNA, binds complementarily to one or more host target binding sites located in untranslated regions of VGAM342 host target RNA, herein designated VGAM HOST TARGET RNA. This complementary binding is due to the fact that the nucleotide sequence of VGAM342 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM342 RNA, herein designated VGAM RNA, may have a different number of host target binding sites in untranslated regions of a VGAM342 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM342 RNA, herein designated VGAM RNA, to host target binding sites on VGAM342 host target RNA, herein designated VGAM HOST TARGET RNA, such as BINDING SITE I, BINDING SITE II and BINDING SITE III, inhibits translation of VGAM342 host target RNA into VGAM342 host target protein, herein designated VGAM HOST TARGET PROTEIN. VGAM host target protein is therefore outlined by a broken line.

It is appreciated that VGAM342 host target gene, herein designated VGAM HOST TARGET GENE, in fact represents a plurality of VGAM342 host target genes. The mRNA of each one of this plurality of VGAM342 host target genes comprises one or more host target binding sites, each having a nucleotide sequence which is at least partly complementary to VGAM342 RNA, herein designated VGAM RNA, and which when bound by VGAM342 RNA causes inhibition of translation of respective one or more VGAM342 host target proteins.

It is further appreciated by one skilled in the art that the mode of translational inhibition illustrated by FIG. 1 with specific reference to translational inhibition exerted by VGAM342 gene, herein designated VGAM GENE, on one or more VGAM342 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM342 is inhibition of expression of host target genes, as part of a novel viral mechanism of attacking a host. Accordingly, utilities of VGAM342 include diagnosis, prevention and treatment of viral infection by Tobacco Mosaic Virus. Specific functions, and accordingly utilities, of VGAM342 correlate with, and may be deduced from, the identity of the host target genes which VGAM342 binds and inhibits, and the function of these host target genes, as elaborated hereinbelow.

Nucleotide sequences of the VGAM342 precursor RNA, herein designated VGAM PRECURSOR RNA, and of the 'diced' VGAM342 RNA, herein designated VGAM RNA, and a schematic representation of the secondary folding of VGAM342 folded precursor RNA, herein designated VGAM FOLDED PRECURSOR RNA, of VGAM342 are further described hereinbelow with reference to Table 1.

Nucleotide sequences of host target binding sites, such as BINDING SITE-I, BINDING SITE-II and BINDING SITE-III of FIG. 1, found on VGAM342 host target RNA, and schematic representation of the complementarity of each of these host target binding sites to VGAM342 RNA, herein designated VGAM RNA, are described hereinbelow with reference to Table 2.

As mentioned hereinabove with reference to FIG. 1, a function of VGAM342 gene, herein designated VGAM is inhibition of expression of VGAM342 target genes. It is appreciated that specific functions, and accordingly utilities, of VGAM342 correlate with, and may be deduced from, the identity of the target genes which VGAM342 binds and inhibits, and the function of these target genes, as elaborated hereinbelow.

Membrane Protein, Palmitoylated 2 (MAGUK p55 subfamily member 2) (MPP2, Accession XM_008355) is a VGAM342 host target gene. MPP2 BINDING SITE is HOST TARGET binding site found in the 3' untranslated region of mRNA encoded by MPP2, corresponding to a HOST TARGET binding site such as BINDING SITE I, BINDING SITE II or BINDING SITE III. Table 2 illustrates the complementarity of the nucleotide sequences of MPP2 BINDING SITE, designated SEQ ID:30078, to the nucleotide sequence of VGAM342 RNA, herein designated VGAM RNA, also designated SEQ ID:3053.

A function of VGAM342 is therefore inhibition of Membrane Protein, Palmitoylated 2 (MAGUK p55 subfamily member 2) (MPP2, Accession XM_008355). Accordingly, utilities of VGAM342 include diagnosis, prevention and treatment of diseases and clinical conditions associated with MPP2. RPP30 (Accession NM_006413) is another VGAM342 host target gene. RPP30 BINDING SITE is HOST TARGET binding site found in the 5' untranslated region of mRNA encoded by RPP30, corresponding to a HOST TARGET binding site such as BINDING SITE I, BINDING SITE II or BINDING SITE III. Table 2 illustrates the complementarity of the nucleotide sequences of RPP30 BINDING SITE, designated SEQ ID:13121, to the nucleotide sequence of VGAM342 RNA, herein designated VGAM RNA, also designated SEQ ID:3053.

Another function of VGAM342 is therefore inhibition of RPP30 (Accession NM_006413), a gene which is a component of ribonuclease p that processes 5' ends of precursor tRNAs. Accordingly, utilities of VGAM342 include diagnosis, prevention and treatment of diseases and clinical conditions associated with RPP30. The function of RPP30 and its association with various diseases and clinical conditions, has been established by previous studies, as described hereinabove with reference to VGAM230. Tumor-associated Calcium Signal Transducer 2 (TACSTD2, Accession NM_002353) is another VGAM342 host target gene. TACSTD2 BINDING SITE is HOST TARGET binding site found in the 3' untranslated region of mRNA encoded by TACSTD2, corresponding to a HOST TARGET binding site such as BINDING SITE I, BINDING SITE II or BINDING SITE III. Table 2 illustrates the complementarity of the nucleotide sequences of TACSTD2 BINDING SITE, designated SEQ ID:8158, to the nucleotide sequence of VGAM342 RNA, herein designated VGAM RNA, also designated SEQ ID:3053.

Another function of VGAM342 is therefore inhibition of Tumor-associated Calcium Signal Transducer 2 (TACSTD2, Accession NM_002353), a gene which belongs to ga733 tumor-associated antigen gene family and may function as growth factor receptors. Accordingly, utilities of VGAM342 include diagnosis, prevention and treatment of diseases and clinical conditions associated with TACSTD2. The function of TACSTD2 and its association with various diseases and clinical conditions, has been established by previous studies, as described hereinabove with reference to VGAM210. Glutamate Receptor, Ionotropic, N-methyl-D-aspartate 3A (GRIN3A, Accession NM_133445) is another VGAM342 host target gene. GRIN3A BINDING SITE is HOST TARGET binding site found in the 3' untranslated region of mRNA encoded by GRIN3A, corresponding to a HOST TARGET binding site such as BINDING SITE I, BINDING SITE II or BINDING SITE III. Table 2 illustrates the complementarity of the nucleotide sequences of GRIN3A BINDING SITE, designated SEQ ID:28529, to the nucleotide sequence of VGAM342 RNA, herein designated VGAM RNA, also designated SEQ ID:3053.

Another function of VGAM342 is therefore inhibition of Glutamate Receptor, Ionotropic, N-methyl-D-aspartate 3A (GRIN3A, Accession NM_133445). Accordingly, utilities of VGAM342 include diagnosis, prevention and treatment of diseases and clinical conditions associated with GRIN3A. P5-1 (Accession NM_006674) is another VGAM342 host target gene. P5-1 BINDING SITE is HOST TARGET binding site found in the 3" untranslated region of mRNA encoded by P5-1, corresponding to a HOST TARGET binding site such as BINDING SITE I, BINDING SITE II or BINDING SITE III. Table 2 illustrates the complementarity of the nucleotide sequences of P5-1 BINDING SITE, designated SEQ ID:13494, to the nucleotide sequence of VGAM342 RNA, herein designated VGAM RNA, also designated SEQ ID:3053.

Another function of VGAM342 is therefore inhibition of P5-1 (Accession NM_006674). Accordingly, utilities of VGAM342 include diagnosis, prevention and treatment of diseases and clinical conditions associated with P5-1. POLD3 (Accession XM_166243) is another VGAM342 host target gene. POLD3 BINDING SITE is HOST TARGET binding site found in the 3' untranslated region of mRNA encoded by POLD3, corresponding to a HOST TARGET binding site such as BINDING SITE I, BINDING SITE II or BINDING SITE III. Table 2 illustrates the complementarity of the nucleotide sequences of POLD3 BINDING SITE, designated SEQ ID:44054, to the nucleotide sequence of VGAM342 RNA, herein designated VGAM RNA, also designated SEQ ID:3053.

Another function of VGAM342 is therefore inhibition of POLD3 (Accession XM_166243). Accordingly, utilities of VGAM342 include diagnosis, prevention and treatment of diseases and clinical conditions associated with POLD3. LOC147639 (Accession XM_085822) is another VGAM342 host target gene. LOC147639 BINDING SITE is HOST TARGET binding site found in the 3' untranslated region of mRNA encoded by LOC147639, corresponding to a HOST TARGET binding site such as BINDING SITE I, BINDING SITE II or BINDING SITE III. Table 2 illustrates the complementarity of the nucleotide sequences of LOC147639 BINDING SITE, designated SEQ ID:38347, to the nucleotide sequence of VGAM342 RNA, herein designated VGAM RNA, also designated SEQ ID:3053.

Another function of VGAM342 is therefore inhibition of LOC147639 (Accession XM_085822). Accordingly, utilities of VGAM342 include diagnosis, prevention and treatment of diseases and clinical conditions associated with LOC147639. LOC154282 (Accession XM_098505) is another VGAM342 host target gene. LOC154282 BINDING SITE is HOST TARGET binding site found in the 3' untranslated region of mRNA encoded by LOC154282, corresponding to a HOST TARGET binding site such as BINDING SITE I, BINDING SITE II or BINDING SITE III. Table 2 illustrates the complementarity of the nucleotide sequences of LOC154282 BINDING SITE, designated SEQ ID:41696, to the nucleotide sequence of VGAM342 RNA, herein designated VGAM RNA, also designated SEQ ID:3053.

Another function of VGAM342 is therefore inhibition of LOC154282 (Accession XM_098505). Accordingly, utilities of VGAM342 include diagnosis, prevention and treatment of diseases and clinical conditions associated with LOC154282. FIG. 1 further provides a conceptual description of a novel bioinformatically detected viral gene of the present invention, referred to here as Viral Genomic Address Messenger 343 (VGAM343) viral gene, which modulates expression of respective host target genes thereof, the function and utility of which host target genes is known in the art.

VGAM343 is a novel bioinformatically detected regulatory, non protein coding, viral micro RNA (miRNA) gene. The method by which VGAM343 was detected is described hereinabove with reference to FIGS. 1-8.

VGAM343 gene, herein designated VGAM GENE, is a viral gene contained in the genome of Tobacco Mosaic Virus. VGAM343 host target gene, herein designated VGAM HOST TARGET GENE, is a human gene contained in the human genome.

VGAM343 gene encodes a VGAM343 precursor RNA, herein designated VGAM PRECURSOR RNA. Similar to other miRNA genes, and unlike most ordinary genes, VGAM343 precursor RNA does not encode a protein. A nucleotide sequence identical or highly similar to the nucleotide sequence of VGAM343 precursor RNA is designated SEQ ID:329, and is provided hereinbelow with reference to the sequence listing part. Nucleotide sequence SEQ ID:329 is located at position 1903 relative to the genome of Tobacco Mosaic Virus.

VGAM343 precursor RNA folds onto itself, forming VGAM343 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM343 folded precursor RNA into VGAM343 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM343 RNA is designated SEQ ID:3054, and is provided hereinbelow with reference to the sequence listing part.

VGAM343 host target gene, herein designated VGAM HOST TARGET GENE, encodes a corresponding messenger RNA, VGAM343 host target RNA, herein designated VGAM HOST TARGET RNA. VGAM343 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM343 RNA, herein designated VGAM RNA, binds complementarily to one or more host target binding sites located in untranslated regions of VGAM343 host target RNA, herein designated VGAM HOST TARGET RNA. This complementary binding is due to the fact that the nucleotide sequence of VGAM343 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM343 RNA, herein designated VGAM RNA, may have a different number of host target binding sites in untranslated regions of a VGAM343 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM343 RNA, herein designated VGAM RNA, to host target binding sites on VGAM343 host target RNA, herein designated VGAM HOST TARGET RNA, such as BINDING SITE I, BINDING SITE II and BINDING SITE III, inhibits translation of VGAM343 host target RNA into VGAM343 host target protein, herein designated VGAM HOST TARGET PROTEIN. VGAM host target protein is therefore outlined by a broken line.

It is appreciated that VGAM343 host target gene, herein designated VGAM HOST TARGET GENE, in fact represents a plurality of VGAM343 host target genes. The mRNA of each one of this plurality of VGAM343 host target genes comprises one or more host target binding sites, each having a nucleotide sequence which is at least partly complementary to VGAM343 RNA, herein designated VGAM RNA, and which when bound by VGAM343 RNA causes inhibition of translation of respective one or more VGAM343 host target proteins.

It is further appreciated by one skilled in the art that the mode of translational inhibition illustrated by FIG. 1 with specific reference to translational inhibition exerted by VGAM343 gene, herein designated VGAM GENE, on one or more VGAM343 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM343 is inhibition of expression of host target genes, as part of a novel viral mechanism of attacking a host. Accordingly, utilities of VGAM343 include diagnosis, prevention and treatment of viral infection by Tobacco Mosaic Virus. Specific functions, and accordingly utilities, of VGAM343 correlate with, and may be deduced from, the identity of the host target genes which VGAM343 binds and inhibits, and the function of these host target genes, as elaborated hereinbelow.

Nucleotide sequences of the VGAM343 precursor RNA, herein designated VGAM PRECURSOR RNA, and of the 'diced' VGAM343 RNA, herein designated VGAM RNA, and a schematic representation of the secondary folding of VGAM343 folded precursor RNA, herein designated VGAM FOLDED PRECURSOR RNA, of VGAM343 are further described hereinbelow with reference to Table 1.

Nucleotide sequences of host target binding sites, such as BINDING SITE-I, BINDING SITE-II and BINDING SITE-III of FIG. 1, found on VGAM343 host target RNA, and schematic representation of the complementarity of each of these host target binding sites to VGAM343 RNA, herein designated VGAM RNA, are described hereinbelow with reference to Table 2.

As mentioned hereinabove with reference to FIG. 1, a function of VGAM343 gene, herein designated VGAM is inhibition of expression of VGAM343 target genes. It is appreciated that specific functions, and accordingly utilities, of VGAM343 correlate with, and may be deduced from, the identity of the target genes which VGAM343 binds and inhibits, and the function of these target genes, as elaborated hereinbelow.

Immediate Early Response 5 (IER5, Accession NM_016545) is a VGAM343 host target gene. IER5 BINDING SITE is HOST TARGET binding site found in the 3' untranslated region of mRNA encoded by IER5, corresponding to a HOST TARGET binding site such as BINDING SITE I, BINDING SITE II or BINDING SITE III. Table 2 illustrates the complementarity of the nucleotide sequences of IER5 BINDING SITE, designated SEQ ID:18611, to the nucleotide sequence of VGAM343 RNA, herein designated VGAM RNA, also designated SEQ ID:3054.

A function of VGAM343 is therefore inhibition of Immediate Early Response 5 (IER5, Accession NM_016545), a gene which may play an important role in mediating the cellular response to mitogenic signals. Accordingly, utilities of VGAM343 include diagnosis, prevention and treatment of diseases and clinical conditions associated with IER5. The function of IER5 has been established by previous studies. Williams et al. (1999) cloned a novel member of the slow-kinetics immediate-early response gene family, designated Ier5, from a mouse brain cDNA library. Mouse Ier5 encodes a deduced 308-amino acid protein with a predicted molecular mass of 31.9 kD. The N-terminal 49 amino acids show 57% sequence identity with those of the Ier2 protein. Ier5 contains 3 potential nuclear targeting signals, a possible PEST sequence, which suggests rapid protein degradation, and several potential phosphorylation sites. Northern blot analysis of total cellular RNA from serum-starved NIH 3T3 cells showed no detectable transcription in quiescent cells, but detected a single transcript within 30 minutes after exposure to serum. Transcription was also stimulated by the growth factors TPA (OMIM Ref. No. 173370), FGF (see OMIM Ref. No. 131220), and PDGF (see OMIM Ref. No. 173430), and did not appear to be dependent on protein kinase C (see OMIM Ref. No. 176960) activity. Williams et al. (1999) identified 2 possible Ets-1 sites, a number of potential Sp1 sites, and 3 potential AP1-binding sites in the promoter region of the mouse Ier5 gene. The IER5 genes in human S and mice are highly homologous to their counterpart in zebrafish. In all of these organisms, IER5 is an intronless gene (Gottgens et al., 2002). The International Radiation Hybrid Mapping Consortium mapped the IER5 gene to chromosome 1 (stSG23644).

Full details of the abovementioned studies are described in the following publications, the disclosure of which are hereby incorporated by reference:

Gottgens, B.; Barton, L. M.; Chapman, M. A.; Sinclair, A. M.; Knudsen, B.; Grafham, D.; Gilbert, J. G. R.; Rogers, J.; Bentley, D. R.; Green, A. R.: Transcriptional regulation of the stem cell leukemia gene (SCL)--comparative analysis of five vertebrate SCL loci. Genome Res. 12:749-759, 2002; and Williams, M.; Lyu, M.-S.; Yang, Y.-L.; Lin, E. P.; Dunbrack, R.; Birren, B.; Cunningham, J.; Hunter, K.: Ier5, a novel member of the slow-kinetics immediate-early genes. Genomics 55:3.

Further studies establishing the function and utilities of IER5 are found in John Hopkins OMIM database record ID 607177, and in sited publications numbered 251 and 5542 listed in the bibliography section hereinbelow, which are also hereby incorporated by reference. LOC149535 (Accession XM_086567) is another VGAM343 host target gene. LOC149535 BINDING SITE is HOST TARGET binding site found in the 3' untranslated region of mRNA encoded by LOC149535, corresponding to a HOST TARGET binding site such as BINDING SITE I, BINDING SITE II or BINDING SITE III. Table 2 illustrates the complementarity of the nucleotide sequences of LOC149535 BINDING SITE, designated SEQ ID:38770, to the nucleotide sequence of VGAM343 RNA, herein designated VGAM RNA, also designated SEQ ID:3054.

Another function of VGAM343 is therefore inhibition of LOC149535 (Accession XM_086567). Accordingly, utilities of VGAM343 include diagnosis, prevention and treatment of diseases and clinical conditions associated with LOC149535. FIG. 1 further provides a conceptual description of a novel bioinformatically detected viral gene of the present invention, referred to here as Viral Genomic Address Messenger 344 (VGAM344) viral gene, which modulates expression of respective host target genes thereof, the function and utility of which host target genes is known in the art.

VGAM344 is a novel bioinformatically detected regulatory, non protein coding, viral micro RNA (miRNA) gene. The method by which VGAM344 was detected is described hereinabove with reference to FIGS. 1-8.

VGAM344 gene, herein designated VGAM GENE, is a viral gene contained in the genome of Tobacco Mosaic Virus. VGAM344 host target gene, herein designated VGAM HOST TARGET GENE, is a human gene contained in the human genome.

VGAM344 gene encodes a VGAM344 precursor RNA, herein designated VGAM PRECURSOR RNA. Similar to other miRNA genes, and unlike most ordinary genes, VGAM344 precursor RNA does not encode a protein. A nucleotide sequence identical or highly similar to the nucleotide sequence of VGAM344 precursor RNA is designated SEQ ID:330, and is provided hereinbelow with reference to the sequence listing part. Nucleotide sequence SEQ ID:330 is located at position 2117 relative to the genome of Tobacco Mosaic Virus.

VGAM344 precursor RNA folds onto itself, forming VGAM344 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM344 folded precursor RNA into VGAM344 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM344 RNA is designated SEQ ID:3055, and is provided hereinbelow with reference to the sequence listing part.

VGAM344 host target gene, herein designated VGAM HOST TARGET GENE, encodes a corresponding messenger RNA, VGAM344 host target RNA, herein designated VGAM HOST TARGET RNA. VGAM344 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM344 RNA, herein designated VGAM RNA, binds complementarily to one or more host target binding sites located in untranslated regions of VGAM344 host target RNA, herein designated VGAM HOST TARGET RNA. This complementary binding is due to the fact that the nucleotide sequence of VGAM344 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM344 RNA, herein designated VGAM RNA, may have a different number of host target binding sites in untranslated regions of a VGAM344 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM344 RNA, herein designated VGAM RNA, to host target binding sites on VGAM344 host target RNA, herein designated VGAM HOST TARGET RNA, such as BINDING SITE I, BINDING SITE II and BINDING SITE III, inhibits translation of VGAM344 host target RNA into VGAM344 host target protein, herein designated VGAM HOST TARGET PROTEIN. VGAM host target protein is therefore outlined by a broken line.

It is appreciated that VGAM344 host target gene, herein designated VGAM HOST TARGET GENE, in fact represents a plurality of VGAM344 host target genes. The mRNA of each one of this plurality of VGAM344 host target genes comprises one or more host target binding sites, each having a nucleotide sequence which is at least partly complementary to VGAM344 RNA, herein designated VGAM RNA, and which when bound by VGAM344 RNA causes inhibition of translation of respective one or more VGAM344 host target proteins.

It is further appreciated by one skilled in the art that the mode of translational inhibition illustrated by FIG. 1 with specific reference to translational inhibition exerted by VGAM344 gene, herein designated VGAM GENE, on one or more VGAM344 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM344 is inhibition of expression of host target genes, as part of a novel viral mechanism of attacking a host. Accordingly, utilities of VGAM344 include diagnosis, prevention and treatment of viral infection by Tobacco Mosaic Virus. Specific functions, and accordingly utilities, of VGAM344 correlate with, and may be deduced from, the identity of the host target genes which VGAM344 binds and inhibits, and the function of these host target genes, as elaborated hereinbelow.

Nucleotide sequences of the VGAM344 precursor RNA, herein designated VGAM PRECURSOR RNA, and of the 'diced' VGAM344 RNA, herein designated VGAM RNA, and a schematic representation of the secondary folding of VGAM344 folded precursor RNA, herein designated VGAM FOLDED PRECURSOR RNA, of VGAM344 are further described hereinbelow with reference to Table 1.

Nucleotide sequences of host target binding sites, such as BINDING SITE-I, BINDING SITE-II and BINDING SITE-III of FIG. 1, found on VGAM344 host target RNA, and schematic representation of the complementarity of each of these host target binding sites to VGAM344 RNA, herein designated VGAM RNA, are described hereinbelow with reference to Table 2.

As mentioned hereinabove with reference to FIG. 1, a function of VGAM344 gene, herein designated VGAM is inhibition of expression of VGAM344 target genes. It is appreciated that specific functions, and accordingly utilities, of VGAM344 correlate with, and may be deduced from, the identity of the target genes which VGAM344 binds and inhibits, and the function of these target genes, as elaborated hereinbelow.

Fms-related Tyrosine Kinase 1 (vascular endothelial growth factor/vascular permeability factor receptor) (FLT1, Accession NM_002019) is a VGAM344 host target gene. FLT1 BINDING SITE is HOST TARGET binding site found in the 3' untranslated region of mRNA encoded by FLT1, corresponding to a HOST TARGET binding site such as BINDING SITE I, BINDING SITE II or BINDING SITE III. Table 2 illustrates the complementarity of the nucleotide sequences of FLT1 BINDING SITE, designated SEQ ID:7766, to the nucleotide sequence of VGAM344 RNA, herein designated VGAM RNA, also designated SEQ ID:3055.

A function of VGAM344 is therefore inhibition of Fms-related Tyrosine Kinase 1 (vascular endothelial growth factor/vascular permeability factor receptor) (FLT1, Accession NM_002019). Accordingly, utilities of VGAM344 include diagnosis, prevention and treatment of diseases and clinical conditions associated with FLT1. Bladder Cancer Associated Protein (BLCAP, Accession NM_006698) is another VGAM344 host target gene. BLCAP BINDING SITE is HOST TARGET binding site found in the 3' untranslated region of mRNA encoded by BLCAP, corresponding to a HOST TARGET binding site such as BINDING SITE I, BINDING SITE II or BINDING SITE III. Table 2 illustrates the complementarity of the nucleotide sequences of BLCAP BINDING SITE, designated SEQ ID:13518, to the nucleotide sequence of VGAM344 RNA, herein designated VGAM RNA, also designated SEQ ID:3055.

Another function of VGAM344 is therefore inhibition of Bladder Cancer Associated Protein (BLCAP, Accession NM_006698). Accordingly, utilities of VGAM344 include diagnosis, prevention and treatment of diseases and clinical conditions associated with BLCAP. KIAA0711 (Accession NM_014867) is another VGAM344 host target gene. KIAA0711 BINDING SITE is HOST TARGET binding site found in the 3' untranslated region of mRNA encoded by KIAA0711, corresponding to a HOST TARGET binding site such as BINDING SITE I, BINDING SITE II or BINDING SITE III. Table 2 illustrates the complementarity of the nucleotide sequences of KIAA0711 BINDING SITE, designated SEQ ID:16954, to the nucleotide sequence of VGAM344 RNA, herein designated VGAM RNA, also designated SEQ ID:3055.

Another function of VGAM344 is therefore inhibition of KIAA0711 (Accession NM_014867). Accordingly, utilities of VGAM344 include diagnosis, prevention and treatment of diseases and clinical conditions associated with KIAA0711. LOC135293 (Accession XM_072402) is another VGAM344 host target gene. LOC135293 BINDING SITE is HOST TARGET binding site found in the 3' untranslated region of mRNA encoded by LOC135293, corresponding to a HOST TARGET binding site such as BINDING SITE I, BINDING SITE II or BINDING SITE III. Table 2 illustrates the complementarity of the nucleotide sequences of LOC135293 BINDING SITE, designated SEQ ID:37491, to the nucleotide sequence of VGAM344 RNA, herein designated VGAM RNA, also designated SEQ ID:3055.

Another function of VGAM344 is therefore inhibition of LOC135293 (Accession XM_072402). Accordingly, utilities of VGAM344 include diagnosis, prevention and treatment of diseases and clinical conditions associated with LOC135293. LOC222962 (Accession XM_167291) is another VGAM344 host target gene. LOC222962 BINDING SITE is HOST TARGET binding site found in the 3' untranslated region of mRNA encoded by LOC222962, corresponding to a HOST TARGET binding site such as BINDING SITE I, BINDING SITE II or BINDING SITE III. Table 2 illustrates the complementarity of the nucleotide sequences of LOC222962 BINDING SITE, designated SEQ ID:44625, to the nucleotide sequence of VGAM344 RNA, herein designated VGAM RNA, also designated SEQ ID:3055.

Another function of VGAM344 is therefore inhibition of LOC222962 (Accession XM_167291). Accordingly, utilities of VGAM344 include diagnosis, prevention and treatment of diseases and clinical conditions associated with LOC222962. LOC92973 (Accession XM_048529) is another VGAM344 host target gene. LOC92973 BINDING SITE is HOST TARGET binding site found in the 5' untranslated region of mRNA encoded by LOC92973, corresponding to a HOST TARGET binding site such as BINDING SITE I, BINDING SITE II or BINDING SITE III. Table 2 illustrates the complementarity of the nucleotide sequences of LOC92973 BINDING SITE, designated SEQ ID:35183, to the nucleotide sequence of VGAM344 RNA, herein designated VGAM RNA, also designated SEQ ID:3055.

Another function of VGAM344 is therefore inhibition of LOC92973 (Accession XM_048529). Accordingly, utilities of VGAM344 include diagnosis, prevention and treatment of diseases and clinical conditions associated with LOC92973. FIG. 1 further provides a conceptual description of a novel bioinformatically detected viral gene of the present invention, referred to here as Viral Genomic Address Messenger 345 (VGAM345) viral gene, which modulates expression of respective host target genes thereof, the function and utility of which host target genes is known in the art.

VGAM345 is a novel bioinformatically detected regulatory, non protein coding, viral micro RNA (miRNA) gene. The method by which VGAM345 was detected is described hereinabove with reference to FIGS. 1-8.

VGAM345 gene, herein designated VGAM GENE, is a viral gene contained in the genome of Human Adenovirus C. VGAM345 host target gene, herein designated VGAM HOST TARGET GENE, is a human gene contained in the human genome.

VGAM345 gene encodes a VGAM345 precursor RNA, herein designated VGAM PRECURSOR RNA. Similar to other miRNA genes, and unlike most ordinary genes, VGAM345 precursor RNA does not encode a protein. A nucleotide sequence identical or highly similar to the nucleotide sequence of VGAM345 precursor RNA is designated SEQ ID:331, and is provided hereinbelow with reference to the sequence listing part. Nucleotide sequence SEQ ID:331 is located at position 19970 relative to the genome of Human Adenovirus C.

VGAM345 precursor RNA folds onto itself, forming VGAM345 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM345 folded precursor RNA into VGAM345 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM345 RNA is designated SEQ ID:3056, and is provided hereinbelow with reference to the sequence listing part.

VGAM345 host target gene, herein designated VGAM HOST TARGET GENE, encodes a corresponding messenger RNA, VGAM345 host target RNA, herein designated VGAM HOST TARGET RNA. VGAM345 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM345 RNA, herein designated VGAM RNA, binds complementarily to one or more host target binding sites located in untranslated regions of VGAM345 host target RNA, herein designated VGAM HOST TARGET RNA. This complementary binding is due to the fact that the nucleotide sequence of VGAM345 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM345 RNA, herein designated VGAM RNA, may have a different number of host target binding sites in untranslated regions of a VGAM345 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM345 RNA, herein designated VGAM RNA, to host target binding sites on VGAM345 host target RNA, herein designated VGAM HOST TARGET RNA, such as BINDING SITE I, BINDING SITE II and BINDING SITE III, inhibits translation of VGAM345 host target RNA into VGAM345 host target protein, herein designated VGAM HOST TARGET PROTEIN.

VGAM host target protein is therefore outlined by a broken line.

It is appreciated that VGAM345 host target gene, herein designated VGAM HOST TARGET GENE, in fact represents a plurality of VGAM345 host target genes. The mRNA of each one of this plurality of VGAM345 host target genes comprises one or more host target binding sites, each having a nucleotide sequence which is at least partly complementary to VGAM345 RNA, herein designated VGAM RNA, and which when bound by VGAM345 RNA causes inhibition of translation of respective one or more VGAM345 host target proteins.

It is further appreciated by one skilled in the art that the mode of translational inhibition illustrated by FIG. 1 with specific reference to translational inhibition exerted by VGAM345 gene, herein designated VGAM GENE, on one or more VGAM345 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM345 is inhibition of expression of host target genes, as part of a novel viral mechanism of attacking a host. Accordingly, utilities of VGAM345 include diagnosis, prevention and treatment of viral infection by Human Adenovirus C. Specific functions, and accordingly utilities, of VGAM345 correlate with, and may be deduced from, the identity of the host target genes which VGAM345 binds and inhibits, and the function of these host target genes, as elaborated hereinbelow.

Nucleotide sequences of the VGAM345 precursor RNA, herein designated VGAM PRECURSOR RNA, and of the 'diced' VGAM345 RNA, herein designated VGAM RNA, and a schematic representation of the secondary folding of VGAM345 folded precursor RNA, herein designated VGAM FOLDED PRECURSOR RNA, of VGAM345 are further described hereinbelow with reference to Table 1.

Nucleotide sequences of host target binding sites, such as BINDING SITE-I, BINDING SITE-II and BINDING SITE-III of FIG. 1, found on VGAM345 host target RNA, and schematic representation of the complementarity of each of these host target binding sites to VGAM345 RNA, herein designated VGAM RNA, are described hereinbelow with reference to Table 2.

As mentioned hereinabove with reference to FIG. 1, a function of VGAM345 gene, herein designated VGAM is inhibition of expression of VGAM345 target genes. It is appreciated that specific functions, and accordingly utilities, of VGAM345 correlate with, and may be deduced from, the identity of the target genes which VGAM345 binds and inhibits, and the function of these target genes, as elaborated hereinbelow.

Aryl-hydrocarbon Receptor Nuclear Translocator 2 (ARNT2, Accession NM_014862) is a VGAM345 host target gene. ARNT2 BINDING SITE is HOST TARGET binding site found in the 3' untranslated region of mRNA encoded by ARNT2, corresponding to a HOST TARGET binding site such as BINDING SITE I, BINDING SITE II or BINDING SITE III. Table 2 illustrates the complementarity of the nucleotide sequences of ARNT2 BINDING SITE, designated SEQ ID:16933, to the nucleotide sequence of VGAM345 RNA, herein designated VGAM RNA, also designated SEQ ID:3056.

A function of VGAM345 is therefore inhibition of Aryl-hydrocarbon Receptor Nuclear Translocator 2 (ARNT2, Accession NM_014862), a gene which specifically recognizes the xenobiotic response element (xre). Accordingly, utilities of VGAM345 include diagnosis, prevention and treatment of diseases and clinical conditions associated with ARNT2. The function of ARNT2 has been established by previous studies. Hirose et al. (1996) determined that Arnt2 interacts with mouse AhR and Sim as efficiently as Arnt and that the Arnt2-AhR complex recognizes and specifically binds the xenobiotic responsive element (XRE) sequence. In DNA transfection experiments, Arnt2 rescued XRE-driven reporter gene activity in Arnt mutant cells. RNA blot analysis detected restricted expression of Arnt2 in the brains and kidneys of adult mice, in contrast to the ubiquitous expression of Arnt. In situ hybridization experiments demonstrated expression of Arnt2 exclusively in the dorsal region of the spinal cord and branchial arch-1, whereas Arnt expression was broadly distributed in the ventral portion of the mesodermal and endodermal tissues. Animal model experiments lend further support to the function of ARNT2. To assess the role of ARNT2 in development and determine functional overlap with ARNT, Keith et al. (2001) generated a targeted null mutation of the murine Arnt2 locus. Arnt2 -/- embryos died perinatally and exhibited impaired hypothalamic development, phenotypes previously observed for a targeted mutation in the murine Sim1 gene and consistent with the proposal by Michaud et al. (2000) that Arnt2 and Sim1 form an essential heterodimer in vivo. In addition, cultured Arnt2 -/- neurons displayed decreased hypoxic induction of HIF1A target genes, demonstrating formally that ARNT2/HIF1A complexes regulate oxygen-responsive genes. Finally, a strong genetic interaction between Arnt and Arnt2 mutations was observed, indicating that either gene can fulfill essential functions in a dose-dependent manner before embryonic day 8.5. These results demonstrated that Arnt and Arnt2 have both unique and overlapping essential functions in embryonic development.

It is appreciated that the abovementioned animal model for ARNT2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hirose, K.; Morita, M.; Ema, M.; Mimura, J.; Hamada, H.; Fujii, H.; Saijo, Y.; Gotoh, O.; Sogawa, K.; Fujii-Kuriyama, Y.: cDNA cloning and tissue-specific expression of a novel basic helix-loop-helix/PAS factor (Arnt2) with close sequence similarity to the aryl hydrocarbon receptor nuclear translocator (Arnt). Molec. Cell. Biol. 16:1706-1713, 1996; and Keith, B.; Adelman, D. M.; Simon, M. C.: Targeted mutation of the murine arylhydrocarbon receptor nuclear translocator 2 (Arnt2) gene reveals partial redundancy with Arnt. Proc. Nat. Ac.

Further studies establishing the function and utilities of ARNT2 are found in John Hopkins OMIM database record ID 606036, and in sited publications numbered 6445-644 and 957 listed in the bibliography section hereinbelow, which are also hereby incorporated by reference. RalA Binding Protein 1 (RALBP1, Accession NM_006788) is another VGAM345 host target gene. RALBP1 BINDING SITE is HOST TARGET binding site found in the 3' untranslated region of mRNA encoded by RALBP1, corresponding to a HOST TARGET binding site such as BINDING SITE I, BINDING SITE II or BINDING SITE III. Table 2 illustrates the complementarity of the nucleotide sequences of RALBP1 BINDING SITE, designated SEQ ID:13657, to the nucleotide sequence of VGAM345 RNA, herein designated VGAM RNA, also designated SEQ ID:3056.

Another function of VGAM345 is therefore inhibition of RalA Binding Protein 1 (RALBP1, Accession NM_006788), a gene which plays a role in signal transduction and catalyzes the transport of glutathione conjugates and xenobiotics. Accordingly, utilities of VGAM345 include diagnosis, prevention and treatment of diseases and clinical conditions associated with RALBP1. The function of RALBP1 has been established by previous studies. Small G proteins have GDP-bound inactive and GTP-bound active forms; RAL proteins (e.g., RALA; 179550) shift from the inactive to the active state through the actions of RALGDS (OMIM Ref. No. 601619). RALGDS interacts with the active form of RAS (see OMIM Ref. No. HRAS; 190020). Using a mutant form of RALA lacking the C-terminal 27 amino acids as bait in a yeast 2-hybrid screen of a Jurkat cDNA library, followed by 5-prime RACE and screening skeletal muscle and placenta cDNA libraries, Jullien-Flores et al. (1995) obtained a cDNA encoding RALBP1, which they termed RLIP76. The deduced 655-amino acid protein is homologous in the central region to proteins bearing a CDC42 (OMIM Ref. No. 116952)/RHO (see OMIM Ref. No. 165390)/RAC (see OMIM Ref. No. RAC1; 602048) GTPase-activating protein (GAP) activity, such as BCR (see OMIM Ref. No. 151410). Sequence analysis predicted that RALBP1 has an N-terminal alpha-helical region, the GAP-like region, the RAL-binding region, and the C-terminal region. Binding analysis showed that RALBP1 interacts with RALA and RALB (OMIM Ref. No. 179551) but with no other GTPase except RAC1. Northern blot analysis detected ubiquitous, low-level expression of RALBP1.

Full details of the abovementioned studies are described in the following publications, the disclosure of which are hereby incorporated by reference:

Awasthi, S.; Cheng, J.; Singhal, S. S.; Saini, M. K.; Pandya, U.; Pikula, S.; Bandorowicz-Pikula, J.; Singh, S. V.; Zimniak, P.; Awasthi, Y. C.: Novel function of human RLIP76: ATP-dependent transport of glutathione conjugates and doxorubicin. Biochemistry 39:9327-9334, 2000; and Jullien-Flores, V.; Dorseuil, O.; Romero, R.; Letourneur, F.; Saragosti, S.; Berger, R.; Tavitian, A.; Gacon, G.; Camonis, J. H.: Bridging Ral GTPase to Rho pathways: RLIP76, a Ral ef.

Further studies establishing the function and utilities of RALBP1 are found in John Hopkins OMIM database record ID 605801, and in sited publications numbered 737-738 listed in the bibliography section hereinbelow, which are also hereby incorporated by reference. CSR1 (Accession NM_016240) is another VGAM345 host target gene. CSR1 BINDING SITE is HOST TARGET binding site found in the 3' untranslated region of mRNA encoded by CSR1, corresponding to a HOST TARGET binding site such as BINDING SITE I, BINDING SITE II or BINDING SITE III. Table 2 illustrates the complementarity of the nucleotide sequences of CSR1 BINDING SITE, designated SEQ ID:18356, to the nucleotide sequence of VGAM345 RNA, herein designated VGAM RNA, also designated SEQ ID:3056.

Another function of VGAM345 is therefore inhibition of CSR1 (Accession NM_016240). Accordingly, utilities of VGAM345 include diagnosis, prevention and treatment of diseases and clinical conditions associated with CSR1. KIAA0601 (Accession XM_031267) is another VGAM345 host target gene. KIAA0601 BINDING SITE is HOST TARGET binding site found in the 3' untranslated region of mRNA encoded by KIAA0601, corresponding to a HOST TARGET binding site such as BINDING SITE I, BINDING SITE II or BINDING SITE III. Table 2 illustrates the complementarity of the nucleotide sequences of KIAA0601 BINDING SITE, designated SEQ ID:31326, to the nucleotide sequence of VGAM345 RNA, herein designated VGAM RNA, also designated SEQ ID:3056.

Another function of VGAM345 is therefore inhibition of KIAA0601 (Accession XM_031267). Accordingly, utilities of VGAM345 include diagnosis, prevention and treatment of diseases and clinical conditions associated with KIAA0601. KIAA1505 (Accession XM_168469) is another VGAM345 host target gene. KIAA1505 BINDING SITE is HOST TARGET binding site found in the 5' untranslated region of mRNA encoded by KIAA1505, corresponding to a HOST TARGET binding site such as BINDING SITE I, BINDING SITE II or BINDING SITE III. Table 2 illustrates the complementarity of the nucleotide sequences of KIAA1505 BINDING SITE, designated SEQ ID:45193, to the nucleotide sequence of VGAM345 RNA, herein designated VGAM RNA, also designated SEQ ID:3056.

Another function of VGAM345 is therefore inhibition of KIAA1505 (Accession XM_168469). Accordingly, utilities of VGAM345 include diagnosis, prevention and treatment of diseases and clinical conditions associated with KIAA1505. MR (Accession NM_031212) is another VGAM345 host target gene. MR BINDING SITE is HOST TARGET binding site found in the 5' untranslated region of mRNA encoded by MR, corresponding to a HOST TARGET binding site such as BINDING SITE I, BINDING SITE II or BINDING SITE III. Table 2 illustrates the complementarity of the nucleotide sequences of MR BINDING SITE, designated SEQ ID:25256, to the nucleotide sequence of VGAM345 RNA, herein designated VGAM RNA, also designated SEQ ID:3056.

Another function of VGAM345 is therefore inhibition of MR (Accession NM_031212). Accordingly, utilities of VGAM345 include diagnosis, prevention and treatment of diseases and clinical conditions associated with MR. PTK6 Protein Tyrosine Kinase 6 (PTK6, Accession NM_005975) is another VGAM345 host target gene. PTK6 BINDING SITE is HOST TARGET binding site found in the 5' untranslated region of mRNA encoded by PTK6, corresponding to a HOST TARGET binding site such as BINDING SITE I, BINDING SITE II or BINDING SITE III. Table 2 illustrates the complementarity of the nucleotide sequences of PTK6 BINDING SITE, designated SEQ ID:12596, to the nucleotide sequence of VGAM345 RNA, herein designated VGAM RNA, also designated SEQ ID:3056.

Another function of VGAM345 is therefore inhibition of PTK6 Protein Tyrosine Kinase 6 (PTK6, Accession NM_005975). Accordingly, utilities of VGAM345 include diagnosis, prevention and treatment of diseases and clinical conditions associated with PTK6. Serine Palmitoyltransferase, Long Chain Base Subunit 2 (SPTLC2, Accession NM_004863) is another VGAM345 host target gene. SPTLC2 BINDING SITE is HOST TARGET binding site found in the 3' untranslated region of mRNA encoded by SPTLC2, corresponding to a HOST TARGET binding site such as BINDING SITE I, BINDING SITE II or BINDING SITE III. Table 2 illustrates the complementarity of the nucleotide sequences of SPTLC2 BINDING SITE, designated SEQ ID:11272, to the nucleotide sequence of VGAM345 RNA, herein designated VGAM RNA, also designated SEQ ID:3056.

Another function of VGAM345 is therefore inhibition of Serine Palmitoyltransferase, Long Chain Base Subunit 2 (SPTLC2, Accession NM_004863). Accordingly, utilities of VGAM345 include diagnosis, prevention and treatment of diseases and clinical conditions associated with SPTLC2. UBX Domain Containing 2 (UBXD2, Accession XM_043196) is another VGAM345 host target gene. UBXD2 BINDING SITE is HOST TARGET binding site found in the 3' untranslated region of mRNA encoded by UBXD2, corresponding to a HOST TARGET binding site such as BINDING SITE I, BINDING SITE II or BINDING SITE III. Table 2 illustrates the complementarity of the nucleotide sequences of UBXD2 BINDING SITE, designated SEQ ID:33912, to the nucleotide sequence of VGAM345 RNA, herein designated VGAM RNA, also designated SEQ ID:3056.

Another function of VGAM345 is therefore inhibition of UBX Domain Containing 2 (UBXD2, Accession XM_043196). Accordingly, utilities of VGAM345 include diagnosis, prevention and treatment of diseases and clinical conditions associated with UBXD2. LOC112868 (Accession XM_053402) is another VGAM345 host target gene. LOC112868 BINDING SITE is HOST TARGET binding site found in the 3' untranslated region of mRNA encoded by LOC112868, corresponding to a HOST TARGET binding site such as BINDING SITE I, BINDING SITE II or BINDING SITE III. Table 2 illustrates the complementarity of the nucleotide sequences of LOC112868 BINDING SITE, designated SEQ ID:36075, to the nucleotide sequence of VGAM345 RNA, herein designated VGAM RNA, also designated SEQ ID:3056.

Another function of VGAM345 is therefore inhibition of LOC112868 (Accession XM_053402). Accordingly, utilities of VGAM345 include diagnosis, prevention and treatment of diseases and clinical conditions associated with LOC112868. LOC256176 (Accession XM_172889) is another VGAM345 host target gene. LOC256176 BINDING SITE is HOST TARGET binding site found in the 5' untranslated region of mRNA encoded by LOC256176, corresponding to a HOST TARGET binding site such as BINDING SITE I, BINDING SITE II or BINDING SITE III. Table 2 illustrates the complementarity of the nucleotide sequences of LOC256176 BINDING SITE, designated SEQ ID:46169, to the nucleotide sequence of VGAM345 RNA, herein designated VGAM RNA, also designated SEQ ID:3056.

Another function of VGAM345 is therefore inhibition of LOC256176 (Accession XM_172889). Accordingly, utilities of VGAM345 include diagnosis, prevention and treatment of diseases and clinical conditions associated with LOC256176. FIG. 1 further provides a conceptual description of a novel bioinformatically detected viral gene of the present invention, referred to here as Viral Genomic Address Messenger 346 (VGAM346) viral gene, which modulates expression of respective host target genes thereof, the function and utility of which host target genes is known in the art.

VGAM346 is a novel bioinformatically detected regulatory, non protein coding, viral micro RNA (miRNA) gene. The method by which VGAM346 was detected is described hereinabove with reference to FIGS. 1-8.

VGAM346 gene, herein designated VGAM GENE, is a viral gene contained in the genome of Black Beetle Virus. VGAM346 host target gene, herein designated VGAM HOST TARGET GENE, is a human gene contained in the human genome.

VGAM346 gene encodes a VGAM346 precursor RNA, herein designated VGAM PRECURSOR RNA. Similar to other miRNA genes, and unlike most ordinary genes, VGAM346 precursor RNA does not encode a protein. A nucleotide sequence identical or highly similar to the nucleotide sequence of VGAM346 precursor RNA is designated SEQ ID:332, and is provided hereinbelow with reference to the sequence listing part. Nucleotide sequence SEQ ID:332 is located at position 1124 relative to the genome of Black Beetle Virus.

VGAM346 precursor RNA folds onto itself, forming VGAM346 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM346 folded precursor RNA into VGAM346 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM346 RNA is designated SEQ ID:3057, and is provided hereinbelow with reference to the sequence listing part.

VGAM346 host target gene, herein designated VGAM HOST TARGET GENE, encodes a corresponding messenger RNA, VGAM346 host target RNA, herein designated VGAM HOST TARGET RNA. VGAM346 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM346 RNA, herein designated VGAM RNA, binds complementarily to one or more host target binding sites located in untranslated regions of VGAM346 host target RNA, herein designated VGAM HOST TARGET RNA. This complementary binding is due to the fact that the nucleotide sequence of VGAM346 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM346 RNA, herein designated VGAM RNA, may have a different number of host target binding sites in untranslated regions of a VGAM346 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM346 RNA, herein designated VGAM RNA, to host target binding sites on VGAM346 host target RNA, herein designated VGAM HOST TARGET RNA, such as BINDING SITE I, BINDING SITE II and BINDING SITE III, inhibits translation of VGAM346 host target RNA into VGAM346 host target protein, herein designated VGAM HOST TARGET PROTEIN. VGAM host target protein is therefore outlined by a broken line.

It is appreciated that VGAM346 host target gene, herein designated VGAM HOST TARGET GENE, in fact represents a plurality of VGAM346 host target genes. The mRNA of each one of this plurality of VGAM346 host target genes comprises one or more host target binding sites, each having a nucleotide sequence which is at least partly complementary to VGAM346 RNA, herein designated VGAM RNA, and which when bound by VGAM346 RNA causes inhibition of translation of respective one or more VGAM346 host target proteins.

It is further appreciated by one skilled in the art that the mode of translational inhibition illustrated by FIG. 1 with specific reference to translational inhibition exerted by VGAM346 gene, herein designated VGAM GENE, on one or more VGAM346 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM346 is inhibition of expression of host target genes, as part of a novel viral mechanism of attacking a host. Accordingly, utilities of VGAM346 include diagnosis, prevention and treatment of viral infection by Black Beetle Virus. Specific functions, and accordingly utilities, of VGAM346 correlate with, and may be deduced from, the identity of the host target genes which VGAM346 binds and inhibits, and the function of these host target genes, as elaborated hereinbelow.

Nucleotide sequences of the VGAM346 precursor RNA, herein designated VGAM PRECURSOR RNA, and of the 'diced' VGAM346 RNA, herein designated VGAM RNA, and a schematic representation of the secondary folding of VGAM346 folded precursor RNA, herein designated VGAM FOLDED PRECURSOR RNA, of VGAM346 are further described hereinbelow with reference to Table 1.

Nucleotide sequences of host target binding sites, such as BINDING SITE-I, BINDING SITE-II and BINDING SITE-III of FIG. 1, found on VGAM346 host target RNA, and schematic representation of the complementarity of each of these host target binding sites to VGAM346 RNA, herein designated VGAM RNA, are described hereinbelow with reference to Table 2.

As mentioned hereinabove with reference to FIG. 1, a function of VGAM346 gene, herein designated VGAM is inhibition of expression of VGAM346 target genes. It is appreciated that specific functions, and accordingly utilities, of VGAM346 correlate with, and may be deduced from, the identity of the target genes which VGAM346 binds and inhibits, and the function of these target genes, as elaborated hereinbelow.

Myosin ID (MYO1D, Accession XM_050041) is a VGAM346 host target gene. MYO1D BINDING SITE is HOST TARGET binding site found in the 3' untranslated region of mRNA encoded by MYO1D, corresponding to a HOST TARGET binding site such as BINDING SITE I, BINDING SITE II or BINDING SITE III. Table 2 illustrates the complementarity of the nucleotide sequences of MYO1D BINDING SITE, designated SEQ ID:35548, to the nucleotide sequence of VGAM346 RNA, herein designated VGAM RNA, also designated SEQ ID:3057.

A function of VGAM346 is therefore inhibition of Myosin ID (MYO1D, Accession XM_050041), a gene which is an unconventional myosin. Accordingly, utilities of VGAM346 include diagnosis, prevention and treatment of diseases and clinical conditions associated with MYO1D. The function of MYO1D and its association with various diseases and clinical conditions, has been established by previous studies, as described hereinabove with reference to VGAM126. Osteoglycin (osteoinductive factor, mimecan) (OGN, Accession NM_024416) is another VGAM346 host target gene. OGN BINDING SITE1 through OGN BINDING SITE3 are HOST TARGET binding sites found in untranslated regions of mRNA encoded by OGN, corresponding to HOST TARGET binding sites such as BINDING SITE I, BINDING SITE II or BINDING SITE III. Table 2 illustrates the complementarity of the nucleotide sequences of OGN BINDING SITE1 through OGN BINDING SITE3, designated SEQ ID:23655, SEQ ID:26899 and SEQ ID:15275 respectively, to the nucleotide sequence of VGAM346 RNA, herein designated VGAM RNA, also designated SEQ ID:3057.

Another function of VGAM346 is therefore inhibition of Osteoglycin (osteoinductive factor, mimecan) (OGN, Accession NM_024416), a gene which induces ectopic bone formation in conjunction with transforming growth factor beta. Accordingly, utilities of VGAM346 include diagnosis, prevention and treatment of diseases and clinical conditions associated with OGN. The function of OGN has been established by previous studies. Bovine osteoinductive factor (OIF) induces ectopic bone formation in conjunction with TGFB1 (OMIM Ref. No. 190180) or TGFB2 (OMIM Ref. No. 190220) (Bentz et al., 1989). Using primers based on the sequence of purified bovine OIF, Madisen et al. (1990) isolated a human OIF cDNA clone by RT-PCR of osteosarcoma cell mRNA. The human gene encodes a predicted 298-amino acid precursor protein that is processed into a 103-amino acid mature protein with 96% identity to the bovine protein. On Northern blots, 3 OIF mRNAs are found exclusively in 2 human osteosarcoma cell lines. By FISH, Tasheva et al. (2000) mapped the mimecan gene to 9q22. Pellegata et al. (2000) cloned the human OGN gene and mapped it to a region approximately 1.1 Mb telomeric of WI-532 and approximately 700 kb centromeric of D9S197 in 9q22.31.

Full details of the abovementioned studies are described in the following publications, the disclosure of which are hereby incorporated by reference:

Madisen, L.; Neubauer, M.; Plowman, G.; Rosen, D.; Segarini, P.; Dasch, J.; Thompson, A.; Ziman, J.; Bentz, H.; Purchio, A. F.: Molecular cloning of a novel bone-forming compound: osteoinductive factor. DNA Cell Biol. 9:303-309, 1990; and Pellegata, N. S.; Dieguez-Lucena, J. L.; Joensuu, T.; Lau, S.; Montgomery, K. T.; Krahe, R.; Kivela, T.; Kucherlapati, R.; Forsius, H.; de la Chapelle, A.: Mutations in KERA, encoding.

Further studies establishing the function and utilities of OGN are found in John Hopkins OMIM database record ID 602383, and in sited publications numbered 5605-5606, 340 and 5861 listed in the bibliography section hereinbelow, which are also hereby incorporated by reference. FLJ30058 (Accession NM_144967) is another VGAM346 host target gene. FLJ30058 BINDING SITE is HOST TARGET binding site found in the 3' untranslated region of mRNA encoded by FLJ30058, corresponding to a HOST TARGET binding site such as BINDING SITE I, BINDING SITE II or BINDING SITE III. Table 2 illustrates the complementarity of the nucleotide sequences of FLJ30058 BINDING SITE, designated SEQ ID:29581, to the nucleotide sequence of VGAM346 RNA, herein designated VGAM RNA, also designated SEQ ID:3057.

Another function of VGAM346 is therefore inhibition of FLJ30058 (Accession NM_144967). Accordingly, utilities of VGAM346 include diagnosis, prevention and treatment of diseases and clinical conditions associated with FLJ30058. KIAA0903 (Accession XM_049251) is another VGAM346 host target gene. KIAA0903 BINDING SITE is HOST TARGET binding site found in the 3' untranslated region of mRNA encoded by KIAA0903, corresponding to a HOST TARGET binding site such as BINDING SITE I, BINDING SITE II or BINDING SITE III. Table 2 illustrates the complementarity of the nucleotide sequences of KIAA0903 BINDING SITE, designated SEQ ID:35370, to the nucleotide sequence of VGAM346 RNA, herein designated VGAM RNA, also designated SEQ ID:3057.

Another function of VGAM346 is therefore inhibition of KIAA0903 (Accession XM_049251). Accordingly, utilities of VGAM346 include diagnosis, prevention and treatment of diseases and clinical conditions associated with KIAA0903. MNAB (Accession NM_018835) is another VGAM346 host target gene. MNAB BINDING SITE is HOST TARGET binding site found in the 5" untranslated region of mRNA encoded by MNAB, corresponding to a HOST TARGET binding site such as BINDING SITE I, BINDING SITE II or BINDING SITE III. Table 2 illustrates the complementarity of the nucleotide sequences of MNAB BINDING SITE, designated SEQ ID:20822, to the nucleotide sequence of VGAM346 RNA, herein designated VGAM RNA, also designated SEQ ID:3057.

Another function of VGAM346 is therefore inhibition of MNAB (Accession NM_018835). Accordingly, utilities of VGAM346 include diagnosis, prevention and treatment of diseases and clinical conditions associated with MNAB. SCYD1 (Accession XM_165650) is another VGAM346 host target gene. SCYD1 BINDING SITE is HOST TARGET binding site found in the 3' untranslated region of mRNA encoded by SCYD1, corresponding to a HOST TARGET binding site such as BINDING SITE I, BINDING SITE II or BINDING SITE III. Table 2 illustrates the complementarity of the nucleotide sequences of SCYD1 BINDING SITE, designated SEQ ID:43714, to the nucleotide sequence of VGAM346 RNA, herein designated VGAM RNA, also designated SEQ ID:3057.

Another function of VGAM346 is therefore inhibition of SCYD1 (Accession XM_165650). Accordingly, utilities of VGAM346 include diagnosis, prevention and treatment of diseases and clinical conditions associated with SCYD1. LOC146445 (Accession XM_096999) is another VGAM346 host target gene. LOC146445 BINDING SITE is HOST TARGET binding site found in the 3' untranslated region of mRNA encoded by LOC146445, corresponding to a HOST TARGET binding site such as BINDING SITE I, BINDING SITE II or BINDING SITE III. Table 2 illustrates the complementarity of the nucleotide sequences of LOC146445 BINDING SITE, designated SEQ ID:40700, to the nucleotide sequence of VGAM346 RNA, herein designated VGAM RNA, also designated SEQ ID:3057.

Another function of VGAM346 is therefore inhibition of LOC146445 (Accession XM_096999). Accordingly, utilities of VGAM346 include diagnosis, prevention and treatment of diseases and clinical conditions associated with LOC146445. LOC221103 (Accession XM_167758) is another VGAM346 host target gene. LOC221103 BINDING SITE is HOST TARGET binding site found in the 5' untranslated region of mRNA encoded by LOC221103, corresponding to a HOST TARGET binding site such as BINDING SITE I, BINDING SITE II or BINDING SITE III. Table 2 illustrates the complementarity of the nucleotide sequences of LOC221103 BINDING SITE, designated SEQ ID:44780, to the nucleotide sequence of VGAM346 RNA, herein designated VGAM RNA, also designated SEQ ID:3057.

Another function of VGAM346 is therefore inhibition of LOC221103 (Accession XM_167758). Accordingly, utilities of VGAM346 include diagnosis, prevention and treatment of diseases and clinical conditions associated with LOC221103. FIG. 1 further provides a conceptual description of a novel bioinformatically detected viral gene of the present invention, referred to here as Viral Genomic Address Messenger 347 (VGAM347) viral gene, which modulates expression of respective host target genes thereof, the function and utility of which host target genes is known in the art.

VGAM347 is a novel bioinformatically detected regulatory, non protein coding, viral micro RNA (miRNA) gene. The method by which VGAM347 was detected is described hereinabove with reference to FIGS. 1-8.

VGAM347 gene, herein designated VGAM GENE, is a viral gene contained in the genome of Black Beetle Virus. VGAM347 host target gene, herein designated VGAM HOST TARGET GENE, is a human gene contained in the human genome.

VGAM347 gene encodes a VGAM347 precursor RNA, herein designated VGAM PRECURSOR RNA. Similar to other miRNA genes, and unlike most ordinary genes, VGAM347 precursor RNA does not encode a protein. A nucleotide sequence identical or highly similar to the nucleotide sequence of VGAM347 precursor RNA is designated SEQ ID:333, and is provided hereinbelow with reference to the sequence listing part. Nucleotide sequence SEQ ID:333 is located at position 1731 relative to the genome of Black Beetle Virus.

VGAM347 precursor RNA folds onto itself, forming VGAM347 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM347 folded precursor RNA into VGAM347 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM347 RNA is designated SEQ ID:3058, and is provided hereinbelow with reference to the sequence listing part.

VGAM347 host target gene, herein designated VGAM HOST TARGET GENE, encodes a corresponding messenger RNA, VGAM347 host target RNA, herein designated VGAM HOST TARGET RNA. VGAM347 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM347 RNA, herein designated VGAM RNA, binds complementarily to one or more host target binding sites located in untranslated regions of VGAM347 host target RNA, herein designated VGAM HOST TARGET RNA. This complementary binding is due to the fact that the nucleotide sequence of VGAM347 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM347 RNA, herein designated VGAM RNA, may have a different number of host target binding sites in untranslated regions of a VGAM347 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM347 RNA, herein designated VGAM RNA, to host target binding sites on VGAM347 host target RNA, herein designated VGAM HOST TARGET RNA, such as BINDING SITE I, BINDING SITE II and BINDING SITE III, inhibits translation of VGAM347 host target RNA into VGAM347 host target protein, herein designated VGAM HOST TARGET PROTEIN. VGAM host target protein is therefore outlined by a broken line.

It is appreciated that VGAM347 host target gene, herein designated VGAM HOST TARGET GENE, in fact represents a plurality of VGAM347 host target genes. The mRNA of each one of this plurality of VGAM347 host target genes comprises one or more host target binding sites, each having a nucleotide sequence which is at least partly complementary to VGAM347 RNA, herein designated VGAM RNA, and which when bound by VGAM347 RNA causes inhibition of translation of respective one or more VGAM347 host target proteins.

It is further appreciated by one skilled in the art that the mode of translational inhibition illustrated by FIG. 1 with specific reference to translational inhibition exerted by VGAM347 gene, herein designated VGAM GENE, on one or more VGAM347 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM347 is inhibition of expression of host target genes, as part of a novel viral mechanism of attacking a host. Accordingly, utilities of VGAM347 include diagnosis, prevention and treatment of viral infection by Black Beetle Virus. Specific functions, and accordingly utilities, of VGAM347 correlate with, and may be deduced from, the identity of the host target genes which VGAM347 binds and inhibits, and the function of these host target genes, as elaborated hereinbelow.

Nucleotide sequences of the VGAM347 precursor RNA, herein designated VGAM PRECURSOR RNA, and of the 'diced' VGAM347 RNA, herein designated VGAM RNA, and a schematic representation of the secondary folding of VGAM347 folded precursor RNA, herein designated VGAM FOLDED PRECURSOR RNA, of VGAM347 are further described hereinbelow with reference to Table 1.

Nucleotide sequences of host target binding sites, such as BINDING SITE-I, BINDING SITE-II and BINDING SITE-III of FIG. 1, found on VGAM347 host target RNA, and schematic representation of the complementarity of each of these host target binding sites to VGAM347 RNA, herein designated VGAM RNA, are described hereinbelow with reference to Table 2.

As mentioned hereinabove with reference to FIG. 1, a function of VGAM347 gene, herein designated VGAM is inhibition of expression of VGAM347 target genes. It is appreciated that specific functions, and accordingly utilities, of VGAM347 correlate with, and may be deduced from, the identity of the target genes which VGAM347 binds and inhibits, and the function of these target genes, as elaborated hereinbelow.

Protein Tyrosine Phosphatase, Non-receptor Type 2 (PTPN2, Accession NM_002828) is a VGAM347 host target gene. PTPN2 BINDING SITE is HOST TARGET binding site found in the 3' untranslated region of mRNA encoded by PTPN2, corresponding to a HOST TARGET binding site such as BINDING SITE I, BINDING SITE II or BINDING SITE III. Table 2 illustrates the complementarity of the nucleotide sequences of PTPN2 BINDING SITE, designated SEQ ID:8705, to the nucleotide sequence of VGAM347 RNA, herein designated VGAM RNA, also designated SEQ ID:3058.

A function of VGAM347 is therefore inhibition of Protein Tyrosine Phosphatase, Non-receptor Type 2 (PTPN2, Accession NM_002828). Accordingly, utilities of VGAM347 include diagnosis, prevention and treatment of diseases and clinical conditions associated with PTPN2. Chromosome 20 Open Reading Frame 108 (C20orf108, Accession NM_080821) is another VGAM347 host target gene. C20orf108 BINDING SITE is HOST TARGET binding site found in the 3' untranslated region of mRNA encoded by C20orf108, corresponding to a HOST TARGET binding site such as BINDING SITE I, BINDING SITE II or BINDING SITE III. Table 2 illustrates the complementarity of the nucleotide sequences of C20orf108 BINDING SITE, designated SEQ ID:28081, to the nucleotide sequence of VGAM347 RNA, herein designated VGAM RNA, also designated SEQ ID:3058.

Another function of VGAM347 is therefore inhibition of Chromosome 20 Open Reading Frame 108 (C20orf108, Accession NM_080821). Accordingly, utilities of VGAM347 include diagnosis, prevention and treatment of diseases and clinical conditions associated with C20orf108. KIAA0884 (Accession XM_046660) is another VGAM347 host target gene. KIAA0884 BINDING SITE is HOST TARGET binding site found in the 3' untranslated region of mRNA encoded by KIAA0884, corresponding to a HOST TARGET binding site such as BINDING SITE I, BINDING SITE II or BINDING SITE III. Table 2 illustrates the complementarity of the nucleotide sequences of KIAA0884 BINDING SITE, designated SEQ ID:34773, to the nucleotide sequence of VGAM347 RNA, herein designated VGAM RNA, also designated SEQ ID:3058.

Another function of VGAM347 is therefore inhibition of KIAA0884 (Accession XM_046660). Accordingly, utilities of VGAM347 include diagnosis, prevention and treatment of diseases and clinical conditions associated with KIAA0884. Protein Phosphatase 1, Regulatory (inhibitor) Subunit 16B (PPP1R16B, Accession XM_028840) is another VGAM347 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30765, to the nucleotide sequence of VGAM347 RNA, herein designated VGAM RNA, also designated SEQ ID:3058.

Another function of VGAM347 is therefore inhibition of Protein Phosphatase 1, Regulatory (inhibitor) Subunit 16B (PPP1R16B, Accession XM_028840). Accordingly, utilities of VGAM347 include diagnosis, prevention and treatment of diseases and clinical conditions associated with PPP1R16B. LOC144100 (Accession XM_084732) is another VGAM347 host target gene. LOC144100 BINDING SITE is HOST TARGET binding site found in the 3' untranslated region of mRNA encoded by LOC144100, corresponding to a HOST TARGET binding site such as BINDING SITE I, BINDING SITE II or BINDING SITE III. Table 2 illustrates the complementarity of the nucleotide sequences of LOC144100 BINDING SITE, designated SEQ ID:37676, to the nucleotide sequence of VGAM347 RNA, herein designated VGAM RNA, also designated SEQ ID:3058.

Another function of VGAM347 is therefore inhibition of LOC144100 (Accession XM_084732). Accordingly, utilities of VGAM347 include diagnosis, prevention and treatment of diseases and clinical conditions associated with LOC144100. LOC145138 (Accession XM_096724) is another VGAM347 host target gene. LOC145138 BINDING SITE is HOST TARGET binding site found in the 5' untranslated region of mRNA encoded by LOC145138, corresponding to a HOST TARGET binding site such as BINDING SITE I, BINDING SITE II or BINDING SITE III. Table 2 illustrates the complementarity of the nucleotide sequences of LOC145138 BINDING SITE, designated SEQ ID:40503, to the nucleotide sequence of VGAM347 RNA, herein designated VGAM RNA, also designated SEQ ID:3058.

Another function of VGAM347 is therefore inhibition of LOC145138 (Accession XM_096724). Accordingly, utilities of VGAM347 include diagnosis, prevention and treatment of diseases and clinical conditions associated with LOC145138. LOC151234 (Accession XM_087136) is another VGAM347 host target gene. LOC151234 BINDING SITE is HOST TARGET binding site found in the 3' untranslated region of mRNA encoded by LOC151234, corresponding to a HOST TARGET binding site such as BINDING SITE I, BINDING SITE II or BINDING SITE III. Table 2 illustrates the complementarity of the nucleotide sequences of LOC151234 BINDING SITE, designated SEQ ID:39079, to the nucleotide sequence of VGAM347 RNA, herein designated VGAM RNA, also designated SEQ ID:3058.

Another function of VGAM347 is therefore inhibition of LOC151234 (Accession XM_087136). Accordingly, utilities of VGAM347 include diagnosis, prevention and treatment of diseases and clinical conditions associated with LOC151234. FIG. 1 further provides a conceptual description of a novel bioinformatically detected viral gene of the present invention, referred to here as Viral Genomic Address Messenger 348 (VGAM348) viral gene, which modulates expression of respective host target genes thereof, the function and utility of which host target genes is known in the art.

VGAM348 is a novel bioinformatically detected regulatory, non protein coding, viral micro RNA (miRNA) gene. The method by which VGAM348 was detected is described hereinabove with reference to FIGS. 1-8.

VGAM348 gene, herein designated VGAM GENE, is a viral gene contained in the genome of Human Enterovirus C. VGAM348 host target gene, herein designated VGAM HOST TARGET GENE, is a human gene contained in the human genome.

VGAM348 gene encodes a VGAM348 precursor RNA, herein designated VGAM PRECURSOR RNA. Similar to other miRNA genes, and unlike most ordinary genes, VGAM348 precursor RNA does not encode a protein. A nucleotide sequence identical or highly similar to the nucleotide sequence of VGAM348 precursor RNA is designated SEQ ID:334, and is provided hereinbelow with reference to the sequence listing part. Nucleotide sequence SEQ ID:334 is located at position 5074 relative to the genome of Human Enterovirus C.

VGAM348 precursor RNA folds onto itself, forming VGAM348 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM348 folded precursor RNA into VGAM348 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM348 RNA is designated SEQ ID:3059, and is provided hereinbelow with reference to the sequence listing part.

VGAM348 host target gene, herein designated VGAM HOST TARGET GENE, encodes a corresponding messenger RNA, VGAM348 host target RNA, herein designated VGAM HOST TARGET RNA. VGAM348 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM348 RNA, herein designated VGAM RNA, binds complementarily to one or more host target binding sites located in untranslated regions of VGAM348 host target RNA, herein designated VGAM HOST TARGET RNA. This complementary binding is due to the fact that the nucleotide sequence of VGAM348 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM348 RNA, herein designated VGAM RNA, may have a different number of host target binding sites in untranslated regions of a VGAM348 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM348 RNA, herein designated VGAM RNA, to host target binding sites on VGAM348 host target RNA, herein designated VGAM HOST TARGET RNA, such as BINDING SITE I, BINDING SITE II and BINDING SITE III, inhibits translation of VGAM348 host target RNA into VGAM348 host target protein, herein designated VGAM HOST TARGET PROTEIN. VGAM host target protein is therefore outlined by a broken line.

It is appreciated that VGAM348 host target gene, herein designated VGAM HOST TARGET GENE, in fact represents a plurality of VGAM348 host target genes. The mRNA of each one of this plurality of VGAM348 host target genes comprises one or more host target binding sites, each having a nucleotide sequence which is at least partly complementary to VGAM348 RNA, herein designated VGAM RNA, and which when bound by VGAM348 RNA causes inhibition of translation of respective one or more VGAM348 host target proteins.

It is further appreciated by one skilled in the art that the mode of translational inhibition illustrated by FIG. 1 with specific reference to translational inhibition exerted by VGAM348 gene, herein designated VGAM GENE, on one or more VGAM348 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM348 is inhibition of expression of host target genes, as part of a novel viral mechanism of attacking a host. Accordingly, utilities of VGAM348 include diagnosis, prevention and treatment of viral infection by Human Enterovirus C. Specific functions, and accordingly utilities, of VGAM348 correlate with, and may be deduced from, the identity of the host target genes which VGAM348 binds and inhibits, and the function of these host target genes, as elaborated hereinbelow.

Nucleotide sequences of the VGAM348 precursor RNA, herein designated VGAM PRECURSOR RNA, and of the 'diced' VGAM348 RNA, herein designated VGAM RNA, and a schematic representation of the secondary folding of VGAM348 folded precursor RNA, herein designated VGAM FOLDED PRECURSOR RNA, of VGAM348 are further described hereinbelow with reference to Table 1.

Nucleotide sequences of host target binding sites, such as BINDING SITE-I, BINDING SITE-II and BINDING SITE-III of FIG. 1, found on VGAM348 host target RNA, and schematic representation of the complementarity of each of these host target binding sites to VGAM348 RNA, herein designated VGAM RNA, are described hereinbelow with reference to Table 2.

As mentioned hereinabove with reference to FIG. 1, a function of VGAM348 gene, herein designated VGAM is inhibition of expression of VGAM348 target genes. It is appreciated that specific functions, and accordingly utilities, of VGAM348 correlate with, and may be deduced from, the identity of the target genes which VGAM348 binds and inhibits, and the function of these target genes, as elaborated hereinbelow.

KIAA0828 (Accession XM_088105) is a VGAM348 host target gene. KIAA0828 BINDING SITE is HOST TARGET binding site found in the 3' untranslated region of mRNA encoded by KIAA0828, corresponding to a HOST TARGET binding site such as BINDING SITE I, BINDING SITE II or BINDING SITE III. Table 2 illustrates the complementarity of the nucleotide sequences of KIAA0828 BINDING SITE, designated SEQ ID:39517, to the nucleotide sequence of VGAM348 RNA, herein designated VGAM RNA, also designated SEQ ID:3059.

A function of VGAM348 is therefore inhibition of KIAA0828 (Accession XM_088105). Accordingly, utilities of VGAM348 include diagnosis, prevention and treatment of diseases and clinical conditions associated with KIAA0828. LOC157909 (Accession XM_088419) is another VGAM348 host target gene. LOC157909 BINDING SITE is HOST TARGET binding site found in the 5' untranslated region of mRNA encoded by LOC157909, corresponding to a HOST TARGET binding site such as BINDING SITE I, BINDING SITE II or BINDING SITE III. Table 2 illustrates the complementarity of the nucleotide sequences of LOC157909 BINDING SITE, designated SEQ ID:39678, to the nucleotide sequence of VGAM348 RNA, herein designated VGAM RNA, also designated SEQ ID:3059.

Another function of VGAM348 is therefore inhibition of LOC157909 (Accession XM_088419). Accordingly, utilities of VGAM348 include diagnosis, prevention and treatment of diseases and clinical conditions associated with LOC157909. FIG. 1 further provides a conceptual description of a novel bioinformatically detected viral gene of the present invention, referred to here as Viral Genomic Address Messenger 349 (VGAM349) viral gene, which modulates expression of respective host target genes thereof, the function and utility of which host target genes is known in the art.

VGAM349 is a novel bioinformatically detected regulatory, non protein coding, viral micro RNA (miRNA) gene. The method by which VGAM349 was detected is described hereinabove with reference to FIGS. 1-8.

VGAM349 gene, herein designated VGAM GENE, is a viral gene contained in the genome of Human Enterovirus C. VGAM349 host target gene, herein designated VGAM HOST TARGET GENE, is a human gene contained in the human genome.

VGAM349 gene encodes a VGAM349 precursor RNA, herein designated VGAM PRECURSOR RNA. Similar to other miRNA genes, and unlike most ordinary genes, VGAM349 precursor RNA does not encode a protein. A nucleotide sequence identical or highly similar to the nucleotide sequence of VGAM349 precursor RNA is designated SEQ ID:335, and is provided hereinbelow with reference to the sequence listing part. Nucleotide sequence SEQ ID:335 is located at position 7103 relative to the genome of Human Enterovirus C.

VGAM349 precursor RNA folds onto itself, forming VGAM349 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM349 folded precursor RNA into VGAM349 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM349 RNA is designated SEQ ID:3060, and is provided hereinbelow with reference to the sequence listing part.

VGAM349 host target gene, herein designated VGAM HOST TARGET GENE, encodes a corresponding messenger RNA, VGAM349 host target RNA, herein designated VGAM HOST TARGET RNA. VGAM349 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM349 RNA, herein designated VGAM RNA, binds complementarily to one or more host target binding sites located in untranslated regions of VGAM349 host target RNA, herein designated VGAM HOST TARGET RNA. This complementary binding is due to the fact that the nucleotide sequence of VGAM349 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM349 RNA, herein designated VGAM RNA, may have a different number of host target binding sites in untranslated regions of a VGAM349 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM349 RNA, herein designated VGAM RNA, to host target binding sites on VGAM349 host target RNA, herein designated VGAM HOST TARGET RNA, such as BINDING SITE I, BINDING SITE II and BINDING SITE III, inhibits translation of VGAM349 host target RNA into VGAM349 host target protein, herein designated VGAM HOST TARGET PROTEIN. VGAM host target protein is therefore outlined by a broken line.

It is appreciated that VGAM349 host target gene, herein designated VGAM HOST TARGET GENE, in fact represents a plurality of VGAM349 host target genes. The mRNA of each one of this plurality of VGAM349 host target genes comprises one or more host target binding sites, each having a nucleotide sequence which is at least partly complementary to VGAM349 RNA, herein designated VGAM RNA, and which when bound by VGAM349 RNA causes inhibition of translation of respective one or more VGAM349 host target proteins.

It is further appreciated by one skilled in the art that the mode of translational inhibition illustrated by FIG. 1 with specific reference to translational inhibition exerted by VGAM349 gene, herein designated VGAM GENE, on one or more VGAM349 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM349 is inhibition of expression of host target genes, as part of a novel viral mechanism of attacking a host. Accordingly, utilities of VGAM349 include diagnosis, prevention and treatment of viral infection by Human Enterovirus C. Specific functions, and accordingly utilities, of VGAM349 correlate with, and may be deduced from, the identity of the host target genes which VGAM349 binds and inhibits, and the function of these host target genes, as elaborated hereinbelow.

Nucleotide sequences of the VGAM349 precursor RNA, herein designated VGAM PRECURSOR RNA, and of the 'diced' VGAM349 RNA, herein designated VGAM RNA, and a schematic representation of the secondary folding of VGAM349 folded precursor RNA, herein designated VGAM FOLDED PRECURSOR RNA, of VGAM349 are further described hereinbelow with reference to Table 1.

Nucleotide sequences of host target binding sites, such as BINDING SITE-I, BINDING SITE-II and BINDING SITE-III of FIG. 1, found on VGAM349 host target RNA, and schematic representation of the complementarity of each of these host target binding sites to VGAM349 RNA, herein designated VGAM RNA, are described hereinbelow with reference to Table 2.

As mentioned hereinabove with reference to FIG. 1, a function of VGAM349 gene, herein designated VGAM is inhibition of expression of VGAM349 target genes. It is appreciated that specific functions, and accordingly utilities, of VGAM349 correlate with, and may be deduced from, the identity of the target genes which VGAM349 binds and inhibits, and the function of these target genes, as elaborated hereinbelow.

Isocitrate Dehydrogenase 3 (NAD+) Alpha (IDH3A, Accession NM_005530) is a VGAM349 host target gene. IDH3A BINDING SITE is HOST TARGET binding site found in the 3' untranslated region of mRNA encoded by IDH3A, corresponding to a HOST TARGET binding site such as BINDING SITE I, BINDING SITE II or BINDING SITE III. Table 2 illustrates the complementarity of the nucleotide sequences of IDH3A BINDING SITE, designated SEQ ID:12053, to the nucleotide sequence of VGAM349 RNA, herein designated VGAM RNA, also designated SEQ ID:3060.

A function of VGAM349 is therefore inhibition of Isocitrate Dehydrogenase 3 (NAD+) Alpha (IDH3A, Accession NM_005530), a gene which decarboxylates isocitrate into alpha-ketoglutarate in the TCA cycle. Accordingly, utilities of VGAM349 include diagnosis, prevention and treatment of diseases and clinical conditions associated with IDH3A. The function of IDH3A has been established by previous studies. Isocitrate dehydrogenases (EC 1.1.1.4.1 and EC 1.1.1.42) catalyze the oxidative decarboxylation of isocitrate into alpha-ketoglutarate. Thus, they are key enzymes in the tricarboxylic acid (TCA) cycle. In mammalian tissues, 3 kinds of isoenzymes exist, cytosolic NADP(+)-specific IDH (OMIM Ref. No. 147700), mitochondrial NADP(+)-specific IDH (OMIM Ref. No. 147650), and mitochondrial NAD(+)-specific IDH (IDH3). Among the mammalian IDH isoenzymes, IDH3 is thought to play a major role in isocitrate decarboxylation in the TCA cycle, since its activity is regulated by numerous allosteric regulators. IDH3, purified to homogeneity from pig heart, is a heterotetramer of the 2-alpha, 1-beta, and 1-gamma subunits, while NADP(+)-specific IDH found in either mitochondria or cytosol is a homodimer. Kim et al. (1995) characterized the cDNA clone for the alpha subunit (IDH3A), which encodes a mature protein with 339 amino acids (36,640 Da). Kim et al. (1995) had found that the human IDH3A sequence showed 44 and 30% amino acid identity to the monkey IDH3G (OMIM Ref. No. 602017) and bovine IDH2 (OMIM Ref. No. 147650) genes, respectively. Preliminary data using fluorescence in situ hybridization (FISH) supported the assignment to 15q26.1. By FISH, Huh et al. (1996) mapped the IDH3A gene to 15q25.1-q25.2

Full details of the abovementioned studies are described in the following publications, the disclosure of which are hereby incorporated by reference:

Huh, T.-L.; Kim, Y.-O.; Oh, I.-U.; Song, B. J.; Inazawa, J.: Assignment of the human mitochondrial NAD(+)-specific isocitrate dehydrogenase alpha subunit (IDH3A) gene to 15q25.1-q25.2 by in situ hybridization. Genomics 31:295-296, 1996; and Kim, Y.-O.; Oh, I.-U.; Park, H.-S.; Jeng, J.; Song, B. J.; Huh, T.-L.: Characterization of a cDNA clone for human NAD(+)-specific isocitrate dehydrogenase alpha-subunit and structural c.

Further studies establishing the function and utilities of IDH3A are found in John Hopkins OMIM database record ID 601149, and in sited publications numbered 7539-7540 listed in the bibliography section hereinbelow, which are also hereby incorporated by reference. Lipin 1 (LPIN1, Accession XM_041136) is another VGAM349 host target gene. LPIN1 BINDING SITE is HOST TARGET binding site found in the 3' untranslated region of mRNA encoded by LPIN1, corresponding to a HOST TARGET binding site such as BINDING SITE I, BINDING SITE II or BINDING SITE III. Table 2 illustrates the complementarity of the nucleotide sequences of LPIN1 BINDING SITE, designated SEQ ID:33470, to the nucleotide sequence of VGAM349 RNA, herein designated VGAM RNA, also designated SEQ ID:3060.

Another function of VGAM349 is therefore inhibition of Lipin 1 (LPIN1, Accession XM_041136), a gene which is involved in adipocyte differentiation (by similarity). Accordingly, utilities of VGAM349 include diagnosis, prevention and treatment of diseases and clinical conditions associated with LPIN1. The function of LPIN1 and its association with various diseases and clinical conditions, has been established by previous studies, as described hereinabove with reference to VGAM35. LIM Domain Containing Preferred Translocation Partner In Lipoma (LPP, Accession NM_005578) is another VGAM349 host target gene. LPP BINDING SITE is HOST TARGET binding site found in the 5" untranslated region of mRNA encoded by LPP, corresponding to a HOST TARGET binding site such as BINDING SITE I, BINDING SITE II or BINDING SITE III. Table 2 illustrates the complementarity of the nucleotide sequences of LPP BINDING SITE, designated SEQ ID:12108, to the nucleotide sequence of VGAM349 RNA, herein designated VGAM RNA, also designated SEQ ID:3060.

Another function of VGAM349 is therefore inhibition of LIM Domain Containing Preferred Translocation Partner In Lipoma (LPP, Accession NM_005578). Accordingly, utilities of VGAM349 include diagnosis, prevention and treatment of diseases and clinical conditions associated with LPP. Retinoschisis (X-linked, juvenile) 1 (RS1, Accession NM_000330) is another VGAM349 host target gene. RS1 BINDING SITE is HOST TARGET binding site found in the 3' untranslated region of mRNA encoded by RS1, corresponding to a HOST TARGET binding site such as BINDING SITE I, BINDING SITE II or BINDING SITE III. Table 2 illustrates the complementarity of the nucleotide sequences of RS1 BINDING SITE, designated SEQ ID:5879, to the nucleotide sequence of VGAM349 RNA, herein designated VGAM RNA, also designated SEQ ID:3060.

Another function of VGAM349 is therefore inhibition of Retinoschisis (X-linked, juvenile) 1 (RS1, Accession NM_000330). Accordingly, utilities of VGAM349 include diagnosis, prevention and treatment of diseases and clinical conditions associated with RS1. Retinoid X Receptor, Alpha (RXRA, Accession NM_002957) is another VGAM349 host target gene. RXRA BINDING SITE is HOST TARGET binding site found in the 3' untranslated region of mRNA encoded by RXRA, corresponding to a HOST TARGET binding site such as BINDING SITE I, BINDING SITE II or BINDING SITE III. Table 2 illustrates the complementarity of the nucleotide sequences of RXRA BINDING SITE, designated SEQ ID:8873, to the nucleotide sequence of VGAM349 RNA, herein designated VGAM RNA, also designated SEQ ID:3060.

Another function of VGAM349 is therefore inhibition of Retinoid X Receptor, Alpha (RXRA, Accession NM_002957), a gene which activates genes required for vitamin A metabolism, binds 9-cis retinoic acid. Accordingly, utilities of VGAM349 include diagnosis, prevention and treatment of diseases and clinical conditions associated with RXRA. The function of RXRA has been established by previous studies. Retinoic acid has been implicated in many aspects of vertebrate development and homeostasis. Its effects are mediated by specific nuclear receptor proteins that are members of the steroid and thyroid hormone receptor superfamily of transcriptional regulators. In addition to the high affinity retinoic acid receptors termed alpha (RARA; 180240), beta (RARB; 180220), and gamma (RARG; 180190), Mangelsdorf et al. (1990, 1991) identified a distinct nuclear receptor referred to as retinoid X receptor alpha. This receptor differs from the other 3 RARs within the ligand-binding domain and is incapable of high affinity binding of retinoic acid itself. The retinoic acid, thyroid hormone, and vitamin D receptors, as well as the retinoid X receptor, activate transcription from response elements containing 2 or more degenerate copies of the consensus motif AGGTCA. Heyman et al. (1992) presented evidence that 9-cis retinoic acid is a high affinity ligand for RXRA. McNamara et al. (2001) reported a hormone-dependent interaction of the nuclear receptors RARA and RXRA with CLOCK (OMIM Ref. No. 601851) and MOP4 (OMIM Ref. No. 603347). They found that these interactions negatively regulate CLOCK-BMAL1 (OMIM Ref. No. 602550) and MOP4-BMAL1 heterodimer-mediated transcriptional activation of clock gene expression in vascular cells. MOP4 exhibited a robust rhythm in the vasculature, and retinoic acid could phase shift PER2 (OMIM Ref. No. 603426) mRNA rhythmicity in vivo and in serum-induced smooth muscle cells in vitro, providing a molecular mechanism for hormonal control of clock gene expression. McNamara et al. (2001) proposed that circadian or periodic availability of nuclear hormones may play a critical role in resetting a peripheral vascular clock. Using RFLVs in interspecific backcross mice, Hoopes et al. (1992) mapped mouse genomic loci Rxra, Rxrb, and Rxrg to chromosome 2 near the centromere, to the H-2 region of chromosome 17, and to distal chromosome 1 in tight linkage with the Pbx (OMIM Ref. No. 176310) gene, respectively. Jones et al. (1993) mapped the RXRA gene to chromosome 9 by using PCR on a panel of somatic cell hybrids. A cosmid clone was isolated using the RXRA PCR product, and this was used to localize the gene further by fluorescence in situ hybridization to 9q34, distal to the dopamine beta-hydroxylase gene (DBH; 223360). The mapping position was confirmed by PCR on a panel of translocation hybrids. By pairwise hybridization of an RXRA cosmid and reference markers in fluorescence in situ hybridization, Almasan et al. (1994) refined the localization to 9q34.3. Fusion of PML (OMIM Ref. No. 102578) and TIF1A (OMIM Ref. No. 603406) to RARA and BRAF (OMIM Ref. No. 164757), respectively, results in the production of PML-RAR-alpha and TIF1-alpha-B-RAF (T18) oncoproteins. Zhong et al. (1999) showed that PML, TIF1-alpha, and RXR-alpha/RAR-alpha function together in a retinoic acid-dependent transcription complex. Zhong et al. (1999) found that PML acts as a ligand-dependent coactivator of RXR-alpha/RARA-alpha. T18, similar to PML-RAR-alpha, disrupts the retinoic acid-dependent activity of this complex in a dominant-negative manner, resulting in a growth advantage. PML-RAR-alpha was the first example of an oncoprotein generated by the fusion of 2 molecules participating in the same pathway, specifically the fusion of a transcription factor to one of its own cofactors. Since the PML and RAR-alpha pathways converge at the transcriptional level, there is no need for a double-dominant-negative product to explain the pathogenesis of acute promyelocytic leukemia, or APL. Germain et al. (2002) showed that RXR can bind ligand and recruit coactivators as a heterodimer with apo-retinoic acid receptor (apo-RAR). However, in the usual cellular environment corepressors do not dissociate and they prohibit coactivator access because coregulator binding is mutually exclusive Animal model experiments lend further support to the function of RXRA. Li et al. (2000) developed an efficient technique to create spatiotemporally controlled somatic mutations of the Rxr-alpha gene in the mouse. Li et al. (2000) used tamoxifen-inducible Cre-ER(T) recombinases to ablate RXR-alpha selectively in adult mouse keratinocytes. In 6 to 7 weeks after the first tamoxifen treatment, alopecia developed in the ventral region of pro-mutant mice. At 12 to 16 weeks after treatment, large regions of ventral skin and smaller regions of dorsal skin were hairless. Cysts became visible under the skin surface and these enlarged and spread all over the body with time. At 16 weeks after treatment, hairless regions showed hair follicle degeneration, resulting in utriculi and dermal cysts. Keratin 6 (OMIM Ref. No. 148041), which is usually expressed only in hair follicle outer root sheath, was also expressed in hyperproliferative interfollicular epidermis, indicating abnormal keratinocyte terminal differentiation. All abnormalities were less severe, and/or appeared later, in males than in females. Li et al. (2000) found that RXR-beta (OMIM Ref. No. 180246) expression in adult skin is several-fold higher in males than in females. Study of tamoxifen-treated RXR-alpha/RXR-beta compound mutants demonstrated that RXR-beta can partially compensate for a loss of RXR-alpha function. Also, in accordance with a larger amount of RXR-beta in adult male skin, the functional redundancy was more pronounced in males than in females, as RXR-alpha/beta double mutant males and females were similarly affected, unlike the single mutants. De Urquiza et al. (2000) identified docosahexaenoic acid (DHA), a long-chain polyunsaturated fatty acid that is highly enriched in the adult mammalian brain, as the natural ligand for the retinoic X receptor in mouse brain. Claudel et al. (2001) analyzed the effects of activation of RXR and some of its heterodimers in apolipoprotein E -/- mice, a well-established animal model of atherosclerosis. An RXR agonist drastically reduced the development of atherosclerosis. In addition, a ligand for the peroxisome proliferator-activated receptor PPAR-gamma and a dual agonist of both PPAR-alpha and PPAR-gamma had moderate inhibitory effects. Both RXR and LXR agonists induced ATP-binding cassette protein-1 (ABC1) expression and stimulated ABC1-mediated cholesterol efflux from macrophages from wildtype, but not from LXRA or LXRB (OMIM Ref. No. 600380), double -/- mice. Hence, activation of ABC1-mediated cholesterol efflux by the RXR/LXR heterodimer may contribute to the beneficial effects of rexinoids on atherosclerosis and warrant further evaluation of RXR/LXR agonists in prevention and treatment of atherosclerosis.

It is appreciated that the abovementioned animal model for RXRA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Claudel, T.; Leibowitz, M. D.; Fievet, C.; Tailleux, A.; Wagner, B.; Repa, J. J.; Torpier, G.; Lobaccaro, J.-M.; Paterniti, J. R.; Mangelsdorf, D. J.; Heyman, R. A.; Auwerx, J.: Reduction of atherosclerosis in apolipoprotein E knockout mice by activation of the retinoid X receptor. Proc. Nat. Acad. Sci. 98:2610-2615, 2001; and Germain, P.; Iyer, J.; Zechel, C.; Gronemeyer, H.: Co-regulator recruitment and the mechanism of retinoic acid receptor synergy. Nature 415:187-192, 2002.

Further studies establishing the function and utilities of RXRA are found in John Hopkins OMIM database record ID 180245, and in sited publications numbered 2726-2728, 5934-5935, 2724, 5936-5943, 2725, 5944-5945, 594 and 11302 listed in the bibliography section hereinbelow, which are also hereby incorporated by reference. Chromosome 6 Open Reading Frame 32 (C6orf32, Accession NM_015864) is another VGAM349 host target gene. C6orf32 BINDING SITE is HOST TARGET binding site found in the 5' untranslated region of mRNA encoded by C6orf32, corresponding to a HOST TARGET binding site such as BINDING SITE I, BINDING SITE II or BINDING SITE III. Table 2 illustrates the complementarity of the nucleotide sequences of C6orf32 BINDING SITE, designated SEQ ID:17994, to the nucleotide sequence of VGAM349 RNA, herein designated VGAM RNA, also designated SEQ ID:3060.

Another function of VGAM349 is therefore inhibition of Chromosome 6 Open Reading Frame 32 (C6orf32, Accession NM_015864). Accordingly, utilities of VGAM349 include diagnosis, prevention and treatment of diseases and clinical conditions associated with C6orf32. FLJ12221 (Accession XM_031342) is another VGAM349 host target gene. FLJ12221 BINDING SITE is HOST TARGET binding site found in the 3' untranslated region of mRNA encoded by FLJ12221, corresponding to a HOST TARGET binding site such as BINDING SITE I, BINDING SITE II or BINDING SITE III. Table 2 illustrates the complementarity of the nucleotide sequences of FLJ12221 BINDING SITE, designated SEQ ID:31346, to the nucleotide sequence of VGAM349 RNA, herein designated VGAM RNA, also designated SEQ ID:3060.

Another function of VGAM349 is therefore inhibition of FLJ12221 (Accession XM_031342). Accordingly, utilities of VGAM349 include diagnosis, prevention and treatment of diseases and clinical conditions associated with FLJ12221. FLJ20986 (Accession NM_024524) is another VGAM349 host target gene. FLJ20986 BINDING SITE is HOST TARGET binding site found in the 5' untranslated region of mRNA encoded by FLJ20986, corresponding to a HOST TARGET binding site such as BINDING SITE I, BINDING SITE II or BINDING SITE III. Table 2 illustrates the complementarity of the nucleotide sequences of FLJ20986 BINDING SITE, designated SEQ ID:23731, to the nucleotide sequence of VGAM349 RNA, herein designated VGAM RNA, also designated SEQ ID:3060.

Another function of VGAM349 is therefore inhibition of FLJ20986 (Accession NM_024524). Accordingly, utilities of VGAM349 include diagnosis, prevention and treatment of diseases and clinical conditions associated with FLJ20986. HUMAGCGB (Accession NM_013286) is another VGAM349 host target gene. HUMAGCGB BINDING SITE is HOST TARGET binding site found in the 5' untranslated region of mRNA encoded by HUMAGCGB, corresponding to a HOST TARGET binding site such as BINDING SITE I, BINDING SITE II or BINDING SITE III. Table 2 illustrates the complementarity of the nucleotide sequences of HUMAGCGB BINDING SITE, designated SEQ ID:14957, to the nucleotide sequence of VGAM349 RNA, herein designated VGAM RNA, also designated SEQ ID:3060.

Another function of VGAM349 is therefore inhibition of HUMAGCGB (Accession NM_013286). Accordingly, utilities of VGAM349 include diagnosis, prevention and treatment of diseases and clinical conditions associated with HUMAGCGB. KIAA0831 (Accession NM_014924) is another VGAM349 host target gene. KIAA0831 BINDING SITE is HOST TARGET binding site found in the 3' untranslated region of mRNA encoded by KIAA0831, corresponding to a HOST TARGET binding site such as BINDING SITE I, BINDING SITE II or BINDING SITE III. Table 2 illustrates the complementarity of the nucleotide sequences of KIAA0831 BINDING SITE, designated SEQ ID:17211, to the nucleotide sequence of VGAM349 RNA, herein designated VGAM RNA, also designated SEQ ID:3060.

Another function of VGAM349 is therefore inhibition of KIAA0831 (Accession NM_014924). Accordingly, utilities of VGAM349 include diagnosis, prevention and treatment of diseases and clinical conditions associated with KIAA0831. LOC129607 (Accession XM_059368) is another VGAM349 host target gene. LOC129607 BINDING SITE is HOST TARGET binding site found in the 3' untranslated region of mRNA encoded by LOC129607, corresponding to a HOST TARGET binding site such as BINDING SITE I, BINDING SITE II or BINDING SITE III. Table 2 illustrates the complementarity of the nucleotide sequences of LOC129607 BINDING SITE, designated SEQ ID:36973, to the nucleotide sequence of VGAM349 RNA, herein designated VGAM RNA, also designated SEQ ID:3060.

Another function of VGAM349 is therefore inhibition of LOC129607 (Accession XM_059368). Accordingly, utilities of VGAM349 include diagnosis, prevention and treatment of diseases and clinical conditions associated with LOC129607. LOC150819 (Accession XM_097954) is another VGAM349 host target gene. LOC150819 BINDING SITE is HOST TARGET binding site found in the 5' untranslated region of mRNA encoded by LOC150819, corresponding to a HOST TARGET binding site such as BINDING SITE I, BINDING SITE II or BINDING SITE III. Table 2 illustrates the complementarity of the nucleotide sequences of LOC150819 BINDING SITE, designated SEQ ID:41246, to the nucleotide sequence of VGAM349 RNA, herein designated VGAM RNA, also designated SEQ ID:3060.

Another function of VGAM349 is therefore inhibition of LOC150819 (Accession XM_097954). Accordingly, utilities of VGAM349 include diagnosis, prevention and treatment of diseases and clinical conditions associated with LOC150819. LOC152905 (Accession XM_017966) is another VGAM349 host target gene. LOC152905 BINDING SITE is HOST TARGET binding site found in the 3' untranslated region of mRNA encoded by LOC152905, corresponding to a HOST TARGET binding site such as BINDING SITE I, BINDING SITE II or BINDING SITE III. Table 2 illustrates the complementarity of the nucleotide sequences of LOC152905 BINDING SITE, designated SEQ ID:30334, to the nucleotide sequence of VGAM349 RNA, herein designated VGAM RNA, also designated SEQ ID:3060.

Another function of VGAM349 is therefore inhibition of LOC152905 (Accession XM_017966). Accordingly, utilities of VGAM349 include diagnosis, prevention and treatment of diseases and clinical conditions associated with LOC152905. FIG. 1 further provides a conceptual description of a novel bioinformatically detected viral gene of the present invention, referred to here as Viral Genomic Address Messenger 350 (VGAM350) viral gene, which modulates expression of respective host target genes thereof, the function and utility of which host target genes is known in the art.

VGAM350 is a novel bioinformatically detected regulatory, non protein coding, viral micro RNA (miRNA) gene. The method by which VGAM350 was detected is described hereinabove with reference to FIGS. 1-8.

VGAM350 gene, herein designated VGAM GENE, is a viral gene contained in the genome of Avian Infectious Bronchitis Virus. VGAM350 host target gene, herein designated VGAM HOST TARGET GENE, is a human gene contained in the human genome.

VGAM350 gene encodes a VGAM350 precursor RNA, herein designated VGAM PRECURSOR RNA. Similar to other miRNA genes, and unlike most ordinary genes, VGAM350 precursor RNA does not encode a protein. A nucleotide sequence identical or highly similar to the nucleotide sequence of VGAM350 precursor RNA is designated SEQ ID:336, and is provided hereinbelow with reference to the sequence listing part. Nucleotide sequence SEQ ID:336 is located at position 2089 relative to the genome of Avian Infectious Bronchitis Virus.

VGAM350 precursor RNA folds onto itself, forming VGAM350 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM350 folded precursor RNA into VGAM350 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM350 RNA is designated SEQ ID:3061, and is provided hereinbelow with reference to the sequence listing part.

VGAM350 host target gene, herein designated VGAM HOST TARGET GENE, encodes a corresponding messenger RNA, VGAM350 host target RNA, herein designated VGAM HOST TARGET RNA. VGAM350 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM350 RNA, herein designated VGAM RNA, binds complementarily to one or more host target binding sites located in untranslated regions of VGAM350 host target RNA, herein designated VGAM HOST TARGET RNA. This complementary binding is due to the fact that the nucleotide sequence of VGAM350 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM350 RNA, herein designated VGAM RNA, may have a different number of host target binding sites in untranslated regions of a VGAM350 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM350 RNA, herein designated VGAM RNA, to host target binding sites on VGAM350 host target RNA, herein designated VGAM HOST TARGET RNA, such as BINDING SITE I, BINDING SITE II and BINDING SITE III, inhibits translation of VGAM350 host target RNA into VGAM350 host target protein, herein designated VGAM HOST TARGET PROTEIN. VGAM host target protein is therefore outlined by a broken line.

It is appreciated that VGAM350 host target gene, herein designated VGAM HOST TARGET GENE, in fact represents a plurality of VGAM350 host target genes. The mRNA of each one of this plurality of VGAM350 host target genes comprises one or more host target binding sites, each having a nucleotide sequence which is at least partly complementary to VGAM350 RNA, herein designated VGAM RNA, and which when bound by VGAM350 RNA causes inhibition of translation of respective one or more VGAM350 host target proteins.

It is further appreciated by one skilled in the art that the mode of translational inhibition illustrated by FIG. 1 with specific reference to translational inhibition exerted by VGAM350 gene, herein designated VGAM GENE, on one or more VGAM350 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM350 is inhibition of expression of host target genes, as part of a novel viral mechanism of attacking a host. Accordingly, utilities of VGAM350 include diagnosis, prevention and treatment of viral infection by Avian Infectious Bronchitis Virus. Specific functions, and accordingly utilities, of VGAM350 correlate with, and may be deduced from, the identity of the host target genes which VGAM350 binds and inhibits, and the function of these host target genes, as elaborated hereinbelow.

Nucleotide sequences of the VGAM350 precursor RNA, herein designated VGAM PRECURSOR RNA, and of the 'diced' VGAM350 RNA, herein designated VGAM RNA, and a schematic representation of the secondary folding of VGAM350 folded precursor RNA, herein designated VGAM FOLDED PRECURSOR RNA, of VGAM350 are further described hereinbelow with reference to Table 1.

Nucleotide sequences of host target binding sites, such as BINDING SITE-I, BINDING SITE-II and BINDING SITE-III of FIG. 1, found on VGAM350 host target RNA, and schematic representation of the complementarity of each of these host target binding sites to VGAM350 RNA, herein designated VGAM RNA, are described hereinbelow with reference to Table 2.

As mentioned hereinabove with reference to FIG. 1, a function of VGAM350 gene, herein designated VGAM is inhibition of expression of VGAM350 target genes. It is appreciated that specific functions, and accordingly utilities, of VGAM350 correlate with, and may be deduced from, the identity of the target genes which VGAM350 binds and inhibits, and the function of these target genes, as elaborated hereinbelow.

Coagulation Factor II (thrombin) Receptor-like 3 (F2RL3, Accession NM_003950) is a VGAM350 host target gene. F2RL3 BINDING SITE is HOST TARGET binding site found in the 3' untranslated region of mRNA encoded by F2RL3, corresponding to a HOST TARGET binding site such as BINDING SITE I, BINDING SITE II or BINDING SITE III. Table 2 illustrates the complementarity of the nucleotide sequences of F2RL3 BINDING SITE, designated SEQ ID:10078, to the nucleotide sequence of VGAM350 RNA, herein designated VGAM RNA, also designated SEQ ID:3061.

A function of VGAM350 is therefore inhibition of Coagulation Factor II (thrombin) Receptor-like 3 (F2RL3, Accession NM_003950), a gene which Protease-activated receptor 4; G protein-coupled receptor that increases phosphoinositide hydrolysis. Accordingly, utilities of VGAM350 include diagnosis, prevention and treatment of diseases and clinical conditions associated with F2RL3. The function of F2RL3 and its association with various diseases and clinical conditions, has been established by previous studies, as described hereinabove with reference to VGAM193. Sorting Nexin 6 (SNX6, Accession NM_021249) is another VGAM350 host target gene. SNX6 BINDING SITE is HOST TARGET binding site found in the 5' untranslated region of mRNA encoded by SNX6, corresponding to a HOST TARGET binding site such as BINDING SITE I, BINDING SITE II or BINDING SITE III. Table 2 illustrates the complementarity of the nucleotide sequences of SNX6 BINDING SITE, designated SEQ ID:22216, to the nucleotide sequence of VGAM350 RNA, herein designated VGAM RNA, also designated SEQ ID:3061.

Another function of VGAM350 is therefore inhibition of Sorting Nexin 6 (SNX6, Accession NM_021249). Accordingly, utilities of VGAM350 include diagnosis, prevention and treatment of diseases and clinical conditions associated with SNX6. TIA1 Cytotoxic Granule-associated RNA Binding Protein-like 1 (TIAL1, Accession NM_022333) is another VGAM350 host target gene. TIAL1 BINDING SITE is HOST TARGET binding site found in the 3' untranslated region of mRNA encoded by TIAL1, corresponding to a HOST TARGET binding site such as BINDING SITE I, BINDING SITE II or BINDING SITE III. Table 2 illustrates the complementarity of the nucleotide sequences of TIAL1 BINDING SITE, designated SEQ ID:22740, to the nucleotide sequence of VGAM350 RNA, herein designated VGAM RNA, also designated SEQ ID:3061.

Another function of VGAM350 is therefore inhibition of TIA1 Cytotoxic Granule-associated RNA Binding Protein-like 1 (TIAL1, Accession NM_022333), a gene which possesses nucleolytic activity against cytotoxic lymphocyte target cells. Accordingly, utilities of VGAM350 include diagnosis, prevention and treatment of diseases and clinical conditions associated with TIAL1. The function of TIAL1 has been established by previous studies. Cytotoxic lymphocytes can induce target cells to activate apoptosis. Central to this autolytic pathway is the activation of an endogenous endonuclease that degrades target cell DNA. By screening a human phytohemagglutinin-activated T-cell cDNA library with a TIA1 (OMIM Ref. No. 603518) cDNA, Kawakami et al. (1992) cloned a cDNA encoding TIA1-related protein (TIAR). Both TIAR and TIA1 are members of a family of RNA-binding proteins containing 3 RNA-binding domains and a C-terminal auxiliary domain. Like TIA1, TIAR possesses a lysosome-targeting motif in its C-terminal auxiliary domain, suggesting that TIAR is also a cytotoxic granule-associated protein. The authors demonstrated that TIAR binds specifically to poly (A) homopolymers, fragments DNA in permeabilized target cells, and is expressed in a wide variety of hematopoietic and nonhematopoietic cell types. Using a Southwestern approach to identify proteins capable of binding to the T cluster of the platelet factor-4 (PF4; 173460) promoter, Doi et al. (1997) isolated a human erythroleukemia (HEL) cell cDNA encoding an isoform of TIAL1, which they called TCBP. This deduced 265-amino acid isoform differs from the isoform identified by Kawakami et al. (1992) at the C terminus, where a hydrophobic sequence replaces the lysosome-targeting motif. Doi et al. (1997) demonstrated that TCBP specifically binds to the T cluster and the proximal T-rich region of the PF4 promoter in vitro and that TCBP reduces gene expression from the PF4 promoter. TCBP mRNA expression was reduced when HEL cells were induced to differentiate to megakaryocytes.

Full details of the abovementioned studies are described in the following publications, the disclosure of which are hereby incorporated by reference:

Kawakami, A.; Tian, Q.; Duan, X.; Streuli, M.; Schlossman, S. F.; Anderson, P.: Identification and functional characterization of a TIA-1-related nucleolysin. Proc. Nat. Acad. Sci. 89:8681-8685, 1992; and Doi, T.; Minami, T.; Itoh, M.; Aburatani, H.; Kawabe, Y.; Kodama, T.; Kondo, N.; Satoh, Y.; Asayama, T.; Imanishi, T.: An alternative form of nucleolysin binds to a T-cluster DNA in t.

Further studies establishing the function and utilities of TIAL1 are found in John Hopkins OMIM database record ID 603413, and in sited publications numbered 5294-5295 listed in the bibliography section hereinbelow, which are also hereby incorporated by reference. Tumor Necrosis Factor (ligand) Superfamily, Member 15 (TNFSF15, Accession NM_005118) is another VGAM350 host target gene. TNFSF15 BINDING SITE is HOST TARGET binding site found in the 5' untranslated region of mRNA encoded by TNFSF15, corresponding to a HOST TARGET binding site such as BINDING SITE I, BINDING SITE II or BINDING SITE III. Table 2 illustrates the complementarity of the nucleotide sequences of TNFSF15 BINDING SITE, designated SEQ ID:11597, to the nucleotide sequence of VGAM350 RNA, herein designated VGAM RNA, also designated SEQ ID:3061.

Another function of VGAM350 is therefore inhibition of Tumor Necrosis Factor (ligand) Superfamily, Member 15 (TNFSF15, Accession NM_005118), a gene which acts as an autocrine factor to induce apoptosis in endothelial cells. Accordingly, utilities of VGAM350 include diagnosis, prevention and treatment of diseases and clinical conditions associated with TNFSF15. The function of TNFSF15 has been established by previous studies. Zhai et al. (1999) found that expression of a recombinant soluble form of VEGI inhibited the growth of colon carcinomas in mice, and the tumors expressing the soluble VEGI had markedly reduced vascularization. Conditioned media from cells expressing soluble VEGI dramatically inhibited proliferation of bovine aortic endothelial cells. Zhai et al. (1999) concluded that VEGI is an angiogenesis inhibitor that functions in part by directly inhibiting endothelial cell proliferation. Yue et al. (1999) reported that TL1 causes endothelial cell apoptosis via activation of the stress protein kinases SAPK/JNK (see OMIM Ref. No. 601158) and p38 MAPK (see OMIM Ref. No. 600289) and the caspases, primarily caspase-3 (OMIM Ref. No. 600636). By functional analysis, Migone et al. (2002) showed that TL1A, but not TL1, induces nuclear factor kappa-B (NFKB; OMIM Ref. No. 164011) activation in cells expressing DR3. Exposure of T lymphocytes, but not other cells, to TL1A enhanced IL2 receptor-alpha (IL2RA; 147730) and IL2 receptor-beta (IL2RB; 146710) expression on these cells, increased proliferation in response to IL2 (OMIM Ref. No. 147680), and induced secretion of IFNG and granulocyte-macrophage colony-stimulating factor (GMCSF, or CSF2; 138960), but not other cytokines, especially in the presence of anti-CD28 (OMIM Ref. No. 186760) costimulation. Exposure of an erythroleukemic cell line (TF-1), but not activated T cells, to TL1A induced caspase activation and cell death, particularly when protein synthesis was inhibited. Migone et al. (2002) showed that treatment of mice with recombinant TL1A strongly enhanced graft-versus-host reactivity, consistent with DR3 being mainly expressed on activated T cells.

Full details of the abovementioned studies are described in the following publications, the disclosure of which are hereby incorporated by reference:

Yue, T.-L.; Ni, J.; Romanic, A. M.; Gu, J.-L.; Keller, P.; Wang, C.; Kumar, S.; Yu, G.; Hart, T. K.; Wang, X.; Xia, Z.; DeWolf, W. E., Jr.; Feuerstein, G. Z.: TL1, a novel tumor necrosis factor-like cytokine, induces apoptosis in endothelial cells: involvement of activation of stress protein kinases (stress-activated protein kinase and p38 mitogen-activated protein kinase) and caspase-3-like protease. J. Biol. Chem. 274:1479-1486, 1999; and Zhai, Y.; Ni, J.; Jiang, G.-W.; Lu, J.; Xing, L.; Lincoln, C.; Carter, K. C.; Janat, F.; Kozak, D.; Xu, S.; Rojas, L.; Aggarwal, B. B.; Ruben, S.; Li, L.-Y.; Gentz, R.; Yu, G.-L.: VEGI.

Further studies establishing the function and utilities of TNFSF15 are found in John Hopkins OMIM database record ID 604052, and in sited publications numbered 232 and 8584 listed in the bibliography section hereinbelow, which are also hereby incorporated by reference. Calneuron 1 (CALN1, Accession NM_031468) is another VGAM350 host target gene. CALN1 BINDING SITE is HOST TARGET binding site found in the 3' untranslated region of mRNA encoded by CALN1, corresponding to a HOST TARGET binding site such as BINDING SITE I, BINDING SITE II or BINDING SITE III. Table 2 illustrates the complementarity of the nucleotide sequences of CALN1 BINDING SITE, designated SEQ ID:25509, to the nucleotide sequence of VGAM350 RNA, herein designated VGAM RNA, also designated SEQ ID:3061.

Another function of VGAM350 is therefore inhibition of Calneuron 1 (CALN1, Accession NM_031468). Accordingly, utilities of VGAM350 include diagnosis, prevention and treatment of diseases and clinical conditions associated with CALN1. FLJ11053 (Accession XM_114194) is another VGAM350 host target gene. FLJ11053 BINDING SITE is HOST TARGET binding site found in the 3' untranslated region of mRNA encoded by FLJ11053, corresponding to a HOST TARGET binding site such as BINDING SITE I, BINDING SITE II or BINDING SITE III. Table 2 illustrates the complementarity of the nucleotide sequences of FLJ11053 BINDING SITE, designated SEQ ID:42775, to the nucleotide sequence of VGAM350 RNA, herein designated VGAM RNA, also designated SEQ ID:3061.

Another function of VGAM350 is therefore inhibition of FLJ11053 (Accession XM_114194). Accordingly, utilities of VGAM350 include diagnosis, prevention and treatment of diseases and clinical conditions associated with FLJ11053. FLJ11273 (Accession NM_018374) is another VGAM350 host target gene. FLJ11273 BINDING SITE is HOST TARGET binding site found in the 3' untranslated region of mRNA encoded by FLJ11273, corresponding to a HOST TARGET binding site such as BINDING SITE I, BINDING SITE II or BINDING SITE III. Table 2 illustrates the complementarity of the nucleotide sequences of FLJ11273 BINDING SITE, designated SEQ ID:20391, to the nucleotide sequence of VGAM350 RNA, herein designated VGAM RNA, also designated SEQ ID:3061.

Another function of VGAM350 is therefore inhibition of FLJ11273 (Accession NM_018374). Accordingly, utilities of VGAM350 include diagnosis, prevention and treatment of diseases and clinical conditions associated with FLJ11273. FLJ12700 (Accession NM_024910) is another VGAM350 host target gene. FLJ12700 BINDING SITE is HOST TARGET binding site found in the 3' untranslated region of mRNA encoded by FLJ12700, corresponding to a HOST TARGET binding site such as BINDING SITE I, BINDING SITE II or BINDING SITE III. Table 2 illustrates the complementarity of the nucleotide sequences of FLJ12700 BINDING SITE, designated SEQ ID:24411, to the nucleotide sequence of VGAM350 RNA, herein designated VGAM RNA, also designated SEQ ID:3061.

Another function of VGAM350 is therefore inhibition of FLJ12700 (Accession NM_024910). Accordingly, utilities of VGAM350 include diagnosis, prevention and treatment of diseases and clinical conditions associated with FLJ12700. FLJ21736 (Accession NM_024922) is another VGAM350 host target gene. FLJ21736 BINDING SITE is HOST TARGET binding site found in the 3' untranslated region of mRNA encoded by FLJ21736, corresponding to a HOST TARGET binding site such as BINDING SITE I, BINDING SITE II or BINDING SITE III. Table 2 illustrates the complementarity of the nucleotide sequences of FLJ21736 BINDING SITE, designated SEQ ID:24456, to the nucleotide sequence of VGAM350 RNA, herein designated VGAM RNA, also designated SEQ ID:3061.

Another function of VGAM350 is therefore inhibition of FLJ21736 (Accession NM_024922). Accordingly, utilities of VGAM350 include diagnosis, prevention and treatment of diseases and clinical conditions associated with FLJ21736. Golgi Autoantigen, Golgin Subfamily A, 3 (GOLGA3, Accession NM_005895) is another VGAM350 host target gene. GOLGA3 BINDING SITE is HOST TARGET binding site found in the 3' untranslated region of mRNA encoded by GOLGA3, corresponding to a HOST TARGET binding site such as BINDING SITE I, BINDING SITE II or BINDING SITE III. Table 2 illustrates the complementarity of the nucleotide sequences of GOLGA3 BINDING SITE, designated SEQ ID:12513, to the nucleotide sequence of VGAM350 RNA, herein designated VGAM RNA, also designated SEQ ID:3061.

Another function of VGAM350 is therefore inhibition of Golgi Autoantigen, Golgin Subfamily A, 3 (GOLGA3, Accession NM_005895). Accordingly, utilities of VGAM350 include diagnosis, prevention and treatment of diseases and clinical conditions associated with GOLGA3. G Protein-coupled Receptor 64 (GPR64, Accession NM_005756) is another VGAM350 host target gene. GPR64 BINDING SITE is HOST TARGET binding site found in the 3' untranslated region of mRNA encoded by GPR64, corresponding to a HOST TARGET binding site such as BINDING SITE I, BINDING SITE II or BINDING SITE III. Table 2 illustrates the complementarity of the nucleotide sequences of GPR64 BINDING SITE, designated SEQ ID:12314, to the nucleotide sequence of VGAM350 RNA, herein designated VGAM RNA, also designated SEQ ID:3061.

Another function of VGAM350 is therefore inhibition of G Protein-coupled Receptor 64 (GPR64, Accession NM_005756). Accordingly, utilities of VGAM350 include diagnosis, prevention and treatment of diseases and clinical conditions associated with GPR64. Hemogen (HEMGN, Accession NM_018437) is another VGAM350 host target gene. HEMGN BINDING SITE is HOST TARGET binding site found in the 5' untranslated region of mRNA encoded by HEMGN, corresponding to a HOST TARGET binding site such as BINDING SITE I, BINDING SITE II or BINDING SITE III. Table 2 illustrates the complementarity of the nucleotide sequences of HEMGN BINDING SITE, designated SEQ ID:20498, to the nucleotide sequence of VGAM350 RNA, herein designated VGAM RNA, also designated SEQ ID:3061.

Another function of VGAM350 is therefore inhibition of Hemogen (HEMGN, Accession NM_018437). Accordingly, utilities of VGAM350 include diagnosis, prevention and treatment of diseases and clinical conditions associated with HEMGN. KIAA1200 (Accession XM_031054) is another VGAM350 host target gene. KIAA1200 BINDING SITE is HOST TARGET binding site found in the 3' untranslated region of mRNA encoded by KIAA1200, corresponding to a HOST TARGET binding site such as BINDING SITE I, BINDING SITE II or BINDING SITE III. Table 2 illustrates the complementarity of the nucleotide sequences of KIAA1200 BINDING SITE, designated SEQ ID:31260, to the nucleotide sequence of VGAM350 RNA, herein designated VGAM RNA, also designated SEQ ID:3061.

Another function of VGAM350 is therefore inhibition of KIAA1200 (Accession XM_031054). Accordingly, utilities of VGAM350 include diagnosis, prevention and treatment of diseases and clinical conditions associated with KIAA1200. KIAA1456 (Accession XM_040100) is another VGAM350 host target gene. KIAA1456 BINDING SITE is HOST TARGET binding site found in the 3' untranslated region of mRNA encoded by KIAA1456, corresponding to a HOST TARGET binding site such as BINDING SITE I, BINDING SITE II or BINDING SITE III. Table 2 illustrates the complementarity of the nucleotide sequences of KIAA1456 BINDING SITE, designated SEQ ID:33260, to the nucleotide sequence of VGAM350 RNA, herein designated VGAM RNA, also designated SEQ ID:3061.

Another function of VGAM350 is therefore inhibition of KIAA1456 (Accession XM_040100). Accordingly, utilities of VGAM350 include diagnosis, prevention and treatment of diseases and clinical conditions associated with KIAA1456. KIAA1494 (Accession XM_043561) is another VGAM350 host target gene. KIAA1494 BINDING SITE is HOST TARGET binding site found in the 3' untranslated region of mRNA encoded by KIAA1494, corresponding to a HOST TARGET binding site such as BINDING SITE I, BINDING SITE II or BINDING SITE III. Table 2 illustrates the complementarity of the nucleotide sequences of KIAA1494 BINDING SITE, designated SEQ ID:33960, to the nucleotide sequence of VGAM350 RNA, herein designated VGAM RNA, also designated SEQ ID:3061.

Another function of VGAM350 is therefore inhibition of KIAA1494 (Accession XM_043561). Accordingly, utilities of VGAM350 include diagnosis, prevention and treatment of diseases and clinical conditions associated with KIAA1494. KIAA1508 (Accession XM_030209) is another VGAM350 host target gene. KIAA1508 BINDING SITE is HOST TARGET binding site found in the 3' untranslated region of mRNA encoded by KIAA1508, corresponding to a HOST TARGET binding site such as BINDING SITE I, BINDING SITE II or BINDING SITE III. Table 2 illustrates the complementarity of the nucleotide sequences of KIAA1508 BINDING SITE, designated SEQ ID:30992, to the nucleotide sequence of VGAM350 RNA, herein designated VGAM RNA, also designated SEQ ID:3061.

Another function of VGAM350 is therefore inhibition of KIAA1508 (Accession XM_030209). Accordingly, utilities of VGAM350 include diagnosis, prevention and treatment of diseases and clinical conditions associated with KIAA1508. MGC5338 (Accession NM_024062) is another VGAM350 host target gene. MGC5338 BINDING SITE is HOST TARGET binding site found in the 5' untranslated region of mRNA encoded by MGC5338, corresponding to a HOST TARGET binding site such as BINDING SITE I, BINDING SITE II or BINDING SITE III. Table 2 illustrates the complementarity of the nucleotide sequences of MGC5338 BINDING SITE, designated SEQ ID:23497, to the nucleotide sequence of VGAM350 RNA, herein designated VGAM RNA, also designated SEQ ID:3061.

Another function of VGAM350 is therefore inhibition of MGC5338 (Accession NM_024062). Accordingly, utilities of VGAM350 include diagnosis, prevention and treatment of diseases and clinical conditions associated with MGC5338. NIFU (Accession XM_041081) is another VGAM350 host target gene. NIFU BINDING SITE is HOST TARGET binding site found in the 5" untranslated region of mRNA encoded by NIFU, corresponding to a HOST TARGET binding site such as BINDING SITE I, BINDING SITE II or BINDING SITE III. Table 2 illustrates the complementarity of the nucleotide sequences of NIFU BINDING SITE, designated SEQ ID:33435, to the nucleotide sequence of VGAM350 RNA, herein designated VGAM RNA, also designated SEQ ID:3061.

Another function of VGAM350 is therefore inhibition of NIFU (Accession XM_041081). Accordingly, utilities of VGAM350 include diagnosis, prevention and treatment of diseases and clinical conditions associated with NIFU. PB1 (Accession NM_018165) is another VGAM350 host target gene. PB1 BINDING SITE is HOST TARGET binding site found in the 3' untranslated region of mRNA encoded by PB1, corresponding to a HOST TARGET binding site such as BINDING SITE I, BINDING SITE II or BINDING SITE III. Table 2 illustrates the complementarity of the nucleotide sequences of PB1 BINDING SITE, designated SEQ ID:19977, to the nucleotide sequence of VGAM350 RNA, herein designated VGAM RNA, also designated SEQ ID:3061.

Another function of VGAM350 is therefore inhibition of PB1 (Accession NM_018165). Accordingly, utilities of VGAM350 include diagnosis, prevention and treatment of diseases and clinical conditions associated with PB1. TA-PP2C (Accession NM_139283) is another VGAM350 host target gene. TA-PP2C BINDING SITE is HOST TARGET binding site found in the 3' untranslated region of mRNA encoded by TA-PP2C, corresponding to a HOST TARGET binding site such as BINDING SITE I, BINDING SITE II or BINDING SITE III. Table 2 illustrates the complementarity of the nucleotide sequences of TA-PP2C BINDING SITE, designated SEQ ID:29280, to the nucleotide sequence of VGAM350 RNA, herein designated VGAM RNA, also designated SEQ ID:3061.

Another function of VGAM350 is therefore inhibition of TA-PP2C (Accession NM_139283). Accordingly, utilities of VGAM350 include diagnosis, prevention and treatment of diseases and clinical conditions associated with TA-PP2C. LOC128989 (Accession XM_059310) is another VGAM350 host target gene. LOC128989 BINDING SITE is HOST TARGET binding site found in the 3' untranslated region of mRNA encoded by LOC128989, corresponding to a HOST TARGET binding site such as BINDING SITE I, BINDING SITE II or BINDING SITE III. Table 2 illustrates the complementarity of the nucleotide sequences of LOC128989 BINDING SITE, designated SEQ ID:36937, to the nucleotide sequence of VGAM350 RNA, herein designated VGAM RNA, also designated SEQ ID:3061.

Another function of VGAM350 is therefore inhibition of LOC128989 (Accession XM_059310). Accordingly, utilities of VGAM350 include diagnosis, prevention and treatment of diseases and clinical conditions associated with LOC128989. LOC150577 (Accession XM_097918) is another VGAM350 host target gene. LOC150577 BINDING SITE is HOST TARGET binding site found in the 3' untranslated region of mRNA encoded by LOC150577, corresponding to a HOST TARGET binding site such as BINDING SITE I, BINDING SITE II or BINDING SITE III. Table 2 illustrates the complementarity of the nucleotide sequences of LOC150577 BINDING SITE, designated SEQ ID:41214, to the nucleotide sequence of VGAM350 RNA, herein designated VGAM RNA, also designated SEQ ID:3061.

Another function of VGAM350 is therefore inhibition of LOC150577 (Accession XM_097918). Accordingly, utilities of VGAM350 include diagnosis, prevention and treatment of diseases and clinical conditions associated with LOC150577. LOC256950 (Accession XM_170922) is another VGAM350 host target gene. LOC256950 BINDING SITE is HOST TARGET binding site found in the 3' untranslated region of mRNA encoded by LOC256950, corresponding to a HOST TARGET binding site such as BINDING SITE I, BINDING SITE II or BINDING SITE III. Table 2 illustrates the complementarity of the nucleotide sequences of LOC256950 BINDING SITE, designated SEQ ID:45700, to the nucleotide sequence of VGAM350 RNA, herein designated VGAM RNA, also designated SEQ ID:3061.

Another function of VGAM350 is therefore inhibition of LOC256950 (Accession XM_170922). Accordingly, utilities of VGAM350 include diagnosis, prevention and treatment of diseases and clinical conditions associated with LOC256950. LOC91263 (Accession XM_037264) is another VGAM350 host target gene. LOC91263 BINDING SITE is HOST TARGET binding site found in the 5' untranslated region of mRNA encoded by LOC91263, corresponding to a HOST TARGET binding site such as BINDING SITE I, BINDING SITE II or BINDING SITE III. Table 2 illustrates the complementarity of the nucleotide sequences of LOC91263 BINDING SITE, designated SEQ ID:32593, to the nucleotide sequence of VGAM350 RNA, herein designated VGAM RNA, also designated SEQ ID:3061.

Another function of VGAM350 is therefore inhibition of LOC91263 (Accession XM_037264). Accordingly, utilities of VGAM350 include diagnosis, prevention and treatment of diseases and clinical conditions associated with LOC91263. LOC91628 (Accession XM_039701) is another VGAM350 host target gene. LOC91628 BINDING SITE is HOST TARGET binding site found in the 3' untranslated region of mRNA encoded by LOC91628, corresponding to a HOST TARGET binding site such as BINDING SITE I, BINDING SITE II or BINDING SITE III. Table 2 illustrates the complementarity of the nucleotide sequences of LOC91628 BINDING SITE, designated SEQ ID:33161, to the nucleotide sequence of VGAM350 RNA, herein designated VGAM RNA, also designated SEQ ID:3061.

Another function of VGAM350 is therefore inhibition of LOC91628 (Accession XM_039701). Accordingly, utilities of VGAM350 include diagnosis, prevention and treatment of diseases and clinical conditions associated with LOC91628.

FIG. 1 further provides a conceptual description of a novel bioinformatically detected viral gene of the present invention, referred to here as Viral Genomic Address Messenger 351 (VGAM351) viral gene, which modulates expression of respective host target genes thereof, the function and utility of which host target genes is known in the art.

VGAM351 is a novel bioinformatically detected regulatory, non protein coding, viral micro RNA (miRNA) gene.

The method by which VGAM351 was detected is described hereinabove with reference to FIGS. 1-8.

VGAM351 gene, herein designated VGAM GENE, is a viral gene contained in the genome of Avian Infectious Bronchitis Virus. VGAM351 host target gene, herein designated VGAM HOST TARGET GENE, is a human gene contained in the human genome.

VGAM351 gene encodes a VGAM351 precursor RNA, herein designated VGAM PRECURSOR RNA. Similar to other miRNA genes, and unlike most ordinary genes, VGAM351 precursor RNA does not encode a protein. A nucleotide sequence identical or highly similar to the nucleotide sequence of VGAM351 precursor RNA is designated SEQ ID:337, and is provided hereinbelow with reference to the sequence listing part. Nucleotide sequence SEQ ID:337 is located at position 8232 relative to the genome of Avian Infectious Bronchitis Virus.

VGAM351 precursor RNA folds onto itself, forming VGAM351 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM351 folded precursor RNA into VGAM351 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM351 RNA is designated SEQ ID:3062, and is provided hereinbelow with reference to the sequence listing part.

VGAM351 host target gene, herein designated VGAM HOST TARGET GENE, encodes a corresponding messenger RNA, VGAM351 host target RNA, herein designated VGAM HOST TARGET RNA. VGAM351 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM351 RNA, herein designated VGAM RNA, binds complementarily to one or more host target binding sites located in untranslated regions of VGAM351 host target RNA, herein designated VGAM HOST TARGET RNA. This complementary binding is due to the fact that the nucleotide sequence of VGAM351 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM351 RNA, herein designated VGAM RNA, may have a different number of host target binding sites in untranslated regions of a VGAM351 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM351 RNA, herein designated VGAM RNA, to host target binding sites on VGAM351 host target RNA, herein designated VGAM HOST TARGET RNA, such as BINDING SITE I, BINDING SITE II and BINDING SITE III, inhibits translation of VGAM351 host target RNA into VGAM351 host target protein, herein designated VGAM HOST TARGET PROTEIN. VGAM host target protein is therefore outlined by a broken line.

It is appreciated that VGAM351 host target gene, herein designated VGAM HOST TARGET GENE, in fact represents a plurality of VGAM351 host target genes. The mRNA of each one of this plurality of VGAM351 host target genes comprises one or more host target binding sites, each having a nucleotide sequence which is at least partly complementary to VGAM351 RNA, herein designated VGAM RNA, and which when bound by VGAM351 RNA causes inhibition of translation of respective one or more VGAM351 host target proteins.

It is further appreciated by one skilled in the art that the mode of translational inhibition illustrated by FIG. 1 with specific reference to translational inhibition exerted by VGAM351 gene, herein designated VGAM GENE, on one or more VGAM351 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM351 is inhibition of expression of host target genes, as part of a novel viral mechanism of attacking a host. Accordingly, utilities of VGAM351 include diagnosis, prevention and treatment of viral infection by Avian Infectious Bronchitis Virus. Specific functions, and accordingly utilities, of VGAM351 correlate with, and may be deduced from, the identity of the host target genes which VGAM351 binds and inhibits, and the function of these host target genes, as elaborated hereinbelow.

Nucleotide sequences of the VGAM351 precursor RNA, herein designated VGAM PRECURSOR RNA, and of the 'diced' VGAM351 RNA, herein designated VGAM RNA, and a schematic representation of the secondary folding of VGAM351 folded precursor RNA, herein designated VGAM FOLDED PRECURSOR RNA, of VGAM351 are further described hereinbelow with reference to Table 1.

Nucleotide sequences of host target binding sites, such as BINDING SITE-I, BINDING SITE-II and BINDING SITE-III of FIG. 1, found on VGAM351 host target RNA, and schematic representation of the complementarity of each of these host target binding sites to VGAM351 RNA, herein designated VGAM RNA, are described hereinbelow with reference to Table 2.

As mentioned hereinabove with reference to FIG. 1, a function of VGAM351 gene, herein designated VGAM is inhibition of expression of VGAM351 target genes. It is appreciated that specific functions, and accordingly utilities, of VGAM351 correlate with, and may be deduced from, the identity of the target genes which VGAM351 binds and inhibits, and the function of these target genes, as elaborated hereinbelow.

Neuroblastoma RAS Viral (v-ras) Oncogene Homolog (NRAS, Accession NM_002524) is a VGAM351 host target gene. NRAS BINDING SITE is HOST TARGET binding site found in the 3' untranslated region of mRNA encoded by NRAS, corresponding to a HOST TARGET binding site such as BINDING SITE I, BINDING SITE II or BINDING SITE III. Table 2 illustrates the complementarity of the nucleotide sequences of NRAS BINDING SITE, designated SEQ ID:8359, to the nucleotide sequence of VGAM351 RNA, herein designated VGAM RNA, also designated SEQ ID:3062.

A function of VGAM351 is therefore inhibition of Neuroblastoma RAS Viral (v-ras) Oncogene Homolog (NRAS, Accession NM_002524), a gene which ras proteins bind gdp/gtp and possess intrinsic gtpase activity. Accordingly, utilities of VGAM351 include diagnosis, prevention and treatment of diseases and clinical conditions associated with NRAS. The function of NRAS has been established by previous studies. Hall et al. (1983) cloned an oncogene, which they termed N-RAS, from 2 human sarcoma cell lines, HT1080 and RD, and showed that it is a member of the RAS gene family; that it is encoded by a gene on chromosome 1; and that the same gene is activated in HL60, a promyelocytic leukemia line. Hall et al. (1983) settled on the designation NRAS 'after consultation with Wigler and with Weinberg.' De Martinville et al. (1984) assigned NRAS to 1p31-cen. By in situ hybridization, Davis et al. (1983) assigned the NRAS gene to the short arm of chromosome 1. A concentration of grains was observed just above the centromere in band 1p13. They commented on the wide dispersion of the oncogenes in the RAS family; each of the 5 mapped to date was on a separate chromosome. Ryan et al. (1983) confirmed assignment of HRAS (OMIM Ref. No. 190020) to chromosome 11, KRAS2 (OMIM Ref. No. 190070) to chromosome 12, and NRAS1 to chromosome 1. Addendum in proof indicated that the same laboratory had assigned NRAS1 to 1p21-cen. The NRAS oncogene is distinct from the SK oncogene (OMIM Ref. No. 164780) in several characteristics (Balazs, 1983) and has a different location on chromosome 1. By somatic cell hybrid studies and by in situ hybridization, Rabin et al. (1984) assigned the NRAS gene to 1p11-p13. By in situ hybridization, Popescu et al. (1985) also assigned the NRAS locus to 1p11-p13. Povey et al. (1985) reviewed the conflicting evidence on the site of NRAS on 1p. They found evidence favoring both 1p22 and 1p12-p11. Dracopoli and Meisler (1990) concluded from linkage analysis and pulsed field gel electrophoresis that TSHB (OMIM Ref. No. 188540), NGFB (OMIM Ref. No. 162030), and NRAS form a tightly linked gene cluster located in the same chromosomal band. Their location proximal to the AMY2B gene in 1p21 and close linkage to the alpha-satellite centromeric repeat D1Z5 provided strong evidence that the correct assignment for these 3 loci is 1p13 and not 1p22. Mitchell et al. (1995) localized NRAS to 1p13.2 and CD2 (OMIM Ref. No. 186990) and NGFB to 1p13.1. They concluded that the order is as follows: cen--CD2--NGFB--NRAS--tel. Using the allele-specific amplification method (ARMS), a highly sensitive 1-stage allele-specific PCR, Bezieau et al. (2001) evaluated the incidence of NRAS- and KRAS2-activating mutations (in codons 12, 13, and 61) in 62 patients with monoclonal gammopathy of undetermined significance (MGUS), multiple myeloma (MM), or primary plasma cell leukemia (PPCL), and in human myeloma cell lines (HMCL). Mutations in one or the other gene, or in both, were found in 54.5% of MM patients at diagnosis (but in 81% at the time of relapse), 50% of PPCL patients, and 50% of 16 HMCL patients. In contrast, the occurrence of such mutations was very low in MGUS and indolent MM (12.5%). KRAS2 mutations were always more frequent than NRAS mutations. Bezieau et al. (2001) concluded that these early mutations may play a major role in the oncogenesis of multiple myeloid myeloma and primary plasma cell leukemia.

Full details of the abovementioned studies are described in the following publications, the disclosure of which are hereby incorporated by reference:

Bezieau, S.; Devilder, M.-C.; Avet-Loiseau, H.; Mellerin, M.-P.; Puthier, D.; Pennarun, E.; Rapp, M.-J.; Harousseau, J.-L.; Moisan, J.-P.; Bataille, R.: High incidence of N and K-Ras activating mutations in multiple myeloma and primary plasma cell leukemia at diagnosis. Hum. Mutat. 18:212-224, 2001; and Mitchell, E. L. D.; Jones, D.; White, G. R. M.; Varley, J. M.; Santibanez Koref, M. F.: Determination of the gene order of the three loci CD2, NGFB, and NRAS at human chromosome band.

Further studies establishing the function and utilities of NRAS are found in John Hopkins OMIM database record ID 164790, and in sited publications numbered 2257-2263, 12417-2266, 2238-2239, 2267-227 and 12743-12744 listed in the bibliography section hereinbelow, which are also hereby incorporated by reference. LOC154739 (Accession XM_098602) is another VGAM351 host target gene. LOC154739 BINDING SITE is HOST TARGET binding site found in the 5' untranslated region of mRNA encoded by LOC154739, corresponding to a HOST TARGET binding site such as BINDING SITE I, BINDING SITE II or BINDING SITE III. Table 2 illustrates the complementarity of the nucleotide sequences of LOC154739 BINDING SITE, designated SEQ ID:41714, to the nucleotide sequence of VGAM351 RNA, herein designated VGAM RNA, also designated SEQ ID:3062.

Another function of VGAM351 is therefore inhibition of LOC154739 (Accession XM_098602). Accordingly, utilities of VGAM351 include diagnosis, prevention and treatment of diseases and clinical conditions associated with LOC154739. LOC203276 (Accession XM_117523) is another VGAM351 host target gene. LOC203276 BINDING SITE is HOST TARGET binding site found in the 3' untranslated region of mRNA encoded by LOC203276, corresponding to a HOST TARGET binding site such as BINDING SITE I, BINDING SITE II or BINDING SITE III. Table 2 illustrates the complementarity of the nucleotide sequences of LOC203276 BINDING SITE, designated SEQ ID:43481, to the nucleotide sequence of VGAM351 RNA, herein designated VGAM RNA, also designated SEQ ID:3062.

Another function of VGAM351 is therefore inhibition of LOC203276 (Accession XM_117523). Accordingly, utilities of VGAM351 include diagnosis, prevention and treatment of diseases and clinical conditions associated with LOC203276. LOC203305 (Accession XM_117529) is another VGAM351 host target gene. LOC203305 BINDING SITE is HOST TARGET binding site found in the 3' untranslated region of mRNA encoded by LOC203305, corresponding to a HOST TARGET binding site such as BINDING SITE I, BINDING SITE II or BINDING SITE III. Table 2 illustrates the complementarity of the nucleotide sequences of LOC203305 BINDING SITE, designated SEQ ID:43505, to the nucleotide sequence of VGAM351 RNA, herein designated VGAM RNA, also designated SEQ ID:3062.

Another function of VGAM351 is therefore inhibition of LOC203305 (Accession XM_117529). Accordingly, utilities of VGAM351 include diagnosis, prevention and treatment of diseases and clinical conditions associated with LOC203305. LOC254243 (Accession XM_173233) is another VGAM351 host target gene. LOC254243 BINDING SITE is HOST TARGET binding site found in the 3' untranslated region of mRNA encoded by LOC254243, corresponding to a HOST TARGET binding site such as BINDING SITE I, BINDING SITE II or BINDING SITE III. Table 2 illustrates the complementarity of the nucleotide sequences of LOC254243 BINDING SITE, designated SEQ ID:46507, to the nucleotide sequence of VGAM351 RNA, herein designated VGAM RNA, also designated SEQ ID:3062.

Another function of VGAM351 is therefore inhibition of LOC254243 (Accession XM_173233). Accordingly, utilities of VGAM351 include diagnosis, prevention and treatment of diseases and clinical conditions associated with LOC254243. LOC255870 (Accession XM_170628) is another VGAM351 host target gene. LOC255870 BINDING SITE is HOST TARGET binding site found in the 3' untranslated region of mRNA encoded by LOC255870, corresponding to a HOST TARGET binding site such as BINDING SITE I, BINDING SITE II or BINDING SITE III. Table 2 illustrates the complementarity of the nucleotide sequences of LOC255870 BINDING SITE, designated SEQ ID:45405, to the nucleotide sequence of VGAM351 RNA, herein designated VGAM RNA, also designated SEQ ID:3062.

Another function of VGAM351 is therefore inhibition of LOC255870 (Accession XM_170628). Accordingly, utilities of VGAM351 include diagnosis, prevention and treatment of diseases and clinical conditions associated with LOC255870. LOC90038 (Accession XM_028305) is another VGAM351 host target gene. LOC90038 BINDING SITE is HOST TARGET binding site found in the 3' untranslated region of mRNA encoded by LOC90038, corresponding to a HOST TARGET binding site such as BINDING SITE I, BINDING SITE II or BINDING SITE III. Table 2 illustrates the complementarity of the nucleotide sequences of LOC90038 BINDING SITE, designated SEQ ID:30644, to the nucleotide sequence of VGAM351 RNA, herein designated VGAM RNA, also designated SEQ ID:3062.

Another function of VGAM351 is therefore inhibition of LOC90038 (Accession XM_028305). Accordingly, utilities of VGAM351 include diagnosis, prevention and treatment of diseases and clinical conditions associated with LOC90038. FIG. 1 further provides a conceptual description of a novel bioinformatically detected viral gene of the present invention, referred to here as Viral Genomic Address Messenger 352 (VGAM352) viral gene, which modulates expression of respective host target genes thereof, the function and utility of which host target genes is known in the art.

VGAM352 is a novel bioinformatically detected regulatory, non protein coding, viral micro RNA (miRNA) gene. The method by which VGAM352 was detected is described hereinabove with reference to FIGS. 1-8.

VGAM352 gene, herein designated VGAM GENE, is a viral gene contained in the genome of Avian Infectious Bronchitis Virus. VGAM352 host target gene, herein designated VGAM HOST TARGET GENE, is a human gene contained in the human genome.

VGAM352 gene encodes a VGAM352 precursor RNA, herein designated VGAM PRECURSOR RNA. Similar to other miRNA genes, and unlike most ordinary genes, VGAM352 precursor RNA does not encode a protein. A nucleotide sequence identical or highly similar to the nucleotide sequence of VGAM352 precursor RNA is designated SEQ ID:338, and is provided hereinbelow with reference to the sequence listing part. Nucleotide sequence SEQ ID:338 is located at position 4158 relative to the genome of Avian Infectious Bronchitis Virus.

VGAM352 precursor RNA folds onto itself, forming VGAM352 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM352 folded precursor RNA into VGAM352 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM352 RNA is designated SEQ ID:3063, and is provided hereinbelow with reference to the sequence listing part.

VGAM352 host target gene, herein designated VGAM HOST TARGET GENE, encodes a corresponding messenger RNA, VGAM352 host target RNA, herein designated VGAM HOST TARGET RNA. VGAM352 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM352 RNA, herein designated VGAM RNA, binds complementarily to one or more host target binding sites located in untranslated regions of VGAM352 host target RNA, herein designated VGAM HOST TARGET RNA. This complementary binding is due to the fact that the nucleotide sequence of VGAM352 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM352 RNA, herein designated VGAM RNA, may have a different number of host target binding sites in untranslated regions of a VGAM352 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM352 RNA, herein designated VGAM RNA, to host target binding sites on VGAM352 host target RNA, herein designated VGAM HOST TARGET RNA, such as BINDING SITE I, BINDING SITE II and BINDING SITE III, inhibits translation of VGAM352 host target RNA into VGAM352 host target protein, herein designated VGAM HOST TARGET PROTEIN. VGAM host target protein is therefore outlined by a broken line.

It is appreciated that VGAM352 host target gene, herein designated VGAM HOST TARGET GENE, in fact represents a plurality of VGAM352 host target genes. The mRNA of each one of this plurality of VGAM352 host target genes comprises one or more host target binding sites, each having a nucleotide sequence which is at least partly complementary to VGAM352 RNA, herein designated VGAM RNA, and which when bound by VGAM352 RNA causes inhibition of translation of respective one or more VGAM352 host target proteins.

It is further appreciated by one skilled in the art that the mode of translational inhibition illustrated by FIG. 1 with specific reference to translational inhibition exerted by VGAM352 gene, herein designated VGAM GENE, on one or more VGAM352 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM352 is inhibition of expression of host target genes, as part of a novel viral mechanism of attacking a host. Accordingly, utilities of VGAM352 include diagnosis, prevention and treatment of viral infection by Avian Infectious Bronchitis Virus. Specific functions, and accordingly utilities, of VGAM352 correlate with, and may be deduced from, the identity of the host target genes which VGAM352 binds and inhibits, and the function of these host target genes, as elaborated hereinbelow.

Nucleotide sequences of the VGAM352 precursor RNA, herein designated VGAM PRECURSOR RNA, and of the 'diced' VGAM352 RNA, herein designated VGAM RNA, and a schematic representation of the secondary folding of VGAM352 folded precursor RNA, herein designated VGAM FOLDED PRECURSOR RNA, of VGAM352 are further described hereinbelow with reference to Table 1.

Nucleotide sequences of host target binding sites, such as BINDING SITE-I, BINDING SITE-II and BINDING SITE-III of FIG. 1, found on VGAM352 host target RNA, and schematic representation of the complementarity of each of these host target binding sites to VGAM352 RNA, herein designated VGAM RNA, are described hereinbelow with reference to Table 2.

As mentioned hereinabove with reference to FIG. 1, a function of VGAM352 gene, herein designated VGAM is inhibition of expression of VGAM352 target genes. It is appreciated that specific functions, and accordingly utilities, of VGAM352 correlate with, and may be deduced from, the identity of the target genes which VGAM352 binds and inhibits, and the function of these target genes, as elaborated hereinbelow.

AXL Receptor Tyrosine Kinase (AXL, Accession NM_001699) is a VGAM352 host target gene. AXL BINDING SITE1 and AXL BINDING SITE2 are HOST TARGET binding sites found in untranslated regions of mRNA encoded by AXL, corresponding to HOST TARGET binding sites such as BINDING SITE I, BINDING SITE II or BINDING SITE III. Table 2 illustrates the complementarity of the nucleotide sequences of AXL BINDING SITE1 and AXL BINDING SITE2, designated SEQ ID:7425 and SEQ ID:22446 respectively, to the nucleotide sequence of VGAM352 RNA, herein designated VGAM RNA, also designated SEQ ID:3063.

A function of VGAM352 is therefore inhibition of AXL Receptor Tyrosine Kinase (AXL, Accession NM_001699). Accordingly, utilities of VGAM352 include diagnosis, prevention and treatment of diseases and clinical conditions associated with AXL. FLJ20972 (Accession NM_025030) is another VGAM352 host target gene. FLJ20972 BINDING SITE is HOST TARGET binding site found in the 3' untranslated region of mRNA encoded by FLJ20972, corresponding to a HOST TARGET binding site such as BINDING SITE I, BINDING SITE II or BINDING SITE III. Table 2 illustrates the complementarity of the nucleotide sequences of FLJ20972 BINDING SITE, designated SEQ ID:24627, to the nucleotide sequence of VGAM352 RNA, herein designated VGAM RNA, also designated SEQ ID:3063.

Another function of VGAM352 is therefore inhibition of FLJ20972 (Accession NM_025030). Accordingly, utilities of VGAM352 include diagnosis, prevention and treatment of diseases and clinical conditions associated with FLJ20972. LOC200399 (Accession XM_114226) is another VGAM352 host target gene. LOC200399 BINDING SITE is HOST TARGET binding site found in the 5' untranslated region of mRNA encoded by LOC200399, corresponding to a HOST TARGET binding site such as BINDING SITE I, BINDING SITE II or BINDING SITE III. Table 2 illustrates the complementarity of the nucleotide sequences of LOC200399 BINDING SITE, designated SEQ ID:42812, to the nucleotide sequence of VGAM352 RNA, herein designated VGAM RNA, also designated SEQ ID:3063.

Another function of VGAM352 is therefore inhibition of LOC200399 (Accession XM_114226). Accordingly, utilities of VGAM352 include diagnosis, prevention and treatment of diseases and clinical conditions associated with LOC200399. LOC90786 (Accession XM_034127) is another VGAM352 host target gene. LOC90786 BINDING SITE is HOST TARGET binding site found in the 5' untranslated region of mRNA encoded by LOC90786, corresponding to a HOST TARGET binding site such as BINDING SITE I, BINDING SITE II or BINDING SITE III. Table 2 illustrates the complementarity of the nucleotide sequences of LOC90786 BINDING SITE, designated SEQ ID:32013, to the nucleotide sequence of VGAM352 RNA, herein designated VGAM RNA, also designated SEQ ID:3063.

Another function of VGAM352 is therefore inhibition of LOC90786 (Accession XM_034127). Accordingly, utilities of VGAM352 include diagnosis, prevention and treatment of diseases and clinical conditions associated with LOC90786. LOC92267 (Accession XM_043979) is another VGAM352 host target gene. LOC92267 BINDING SITE is HOST TARGET binding site found in the 5' untranslated region of mRNA encoded by LOC92267, corresponding to a HOST TARGET binding site such as BINDING SITE I, BINDING SITE II or BINDING SITE III. Table 2 illustrates the complementarity of the nucleotide sequences of LOC92267 BINDING SITE, designated SEQ ID:34057, to the nucleotide sequence of VGAM352 RNA, herein designated VGAM RNA, also designated SEQ ID:3063.

Another function of VGAM352 is therefore inhibition of LOC92267 (Accession XM_043979). Accordingly, utilities of VGAM352 include diagnosis, prevention and treatment of diseases and clinical conditions associated with LOC92267. FIG. 1 further provides a conceptual description of a novel bioinformatically detected viral gene of the present invention, referred to here as Viral Genomic Address Messenger 353 (VGAM353) viral gene, which modulates expression of respective host target genes thereof, the function and utility of which host target genes is known in the art.

VGAM353 is a novel bioinformatically detected regulatory, non protein coding, viral micro RNA (miRNA) gene. The method by which VGAM353 was detected is described hereinabove with reference to FIGS. 1-8.

VGAM353 gene, herein designated VGAM GENE, is a viral gene contained in the genome of Avian Infectious Bronchitis Virus. VGAM353 host target gene, herein designated VGAM HOST TARGET GENE, is a human gene contained in the human genome.

VGAM353 gene encodes a VGAM353 precursor RNA, herein designated VGAM PRECURSOR RNA. Similar to other miRNA genes, and unlike most ordinary genes, VGAM353 precursor RNA does not encode a protein. A nucleotide sequence identical or highly similar to the nucleotide sequence of VGAM353 precursor RNA is designated SEQ ID:339, and is provided hereinbelow with reference to the sequence listing part. Nucleotide sequence SEQ ID:339 is located at position 6850 relative to the genome of Avian Infectious Bronchitis Virus.

VGAM353 precursor RNA folds onto itself, forming VGAM353 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM353 folded precursor RNA into VGAM353 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM353 RNA is designated SEQ ID:3064, and is provided hereinbelow with reference to the sequence listing part.

VGAM353 host target gene, herein designated VGAM HOST TARGET GENE, encodes a corresponding messenger RNA, VGAM353 host target RNA, herein designated VGAM HOST TARGET RNA. VGAM353 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM353 RNA, herein designated VGAM RNA, binds complementarily to one or more host target binding sites located in untranslated regions of VGAM353 host target RNA, herein designated VGAM HOST TARGET RNA. This complementary binding is due to the fact that the nucleotide sequence of VGAM353 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM353 RNA, herein designated VGAM RNA, may have a different number of host target binding sites in untranslated regions of a VGAM353 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM353 RNA, herein designated VGAM RNA, to host target binding sites on VGAM353 host target RNA, herein designated VGAM HOST TARGET RNA, such as BINDING SITE I, BINDING SITE II and BINDING SITE III, inhibits translation of VGAM353 host target RNA into VGAM353 host target protein, herein designated VGAM HOST TARGET PROTEIN. VGAM host target protein is therefore outlined by a broken line.

It is appreciated that VGAM353 host target gene, herein designated VGAM HOST TARGET GENE, in fact represents a plurality of VGAM353 host target genes. The mRNA of each one of this plurality of VGAM353 host target genes comprises one or more host target binding sites, each having a nucleotide sequence which is at least partly complementary to VGAM353 RNA, herein designated VGAM RNA, and which when bound by VGAM353 RNA causes inhibition of translation of respective one or more VGAM353 host target proteins.

It is further appreciated by one skilled in the art that the mode of translational inhibition illustrated by FIG. 1 with specific reference to translational inhibition exerted by VGAM353 gene, herein designated VGAM GENE, on one or more VGAM353 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM353 is inhibition of expression of host target genes, as part of a novel viral mechanism of attacking a host. Accordingly, utilities of VGAM353 include diagnosis, prevention and treatment of viral infection by Avian Infectious Bronchitis Virus. Specific functions, and accordingly utilities, of VGAM353 correlate with, and may be deduced from, the identity of the host target genes which VGAM353 binds and inhibits, and the function of these host target genes, as elaborated hereinbelow.

Nucleotide sequences of the VGAM353 precursor RNA, herein designated VGAM PRECURSOR RNA, and of the 'diced' VGAM353 RNA, herein designated VGAM RNA, and a schematic representation of the secondary folding of VGAM353 folded precursor RNA, herein designated VGAM FOLDED PRECURSOR RNA, of VGAM353 are further described hereinbelow with reference to Table 1.

Nucleotide sequences of host target binding sites, such as BINDING SITE-I, BINDING SITE-II and BINDING SITE-III of FIG. 1, found on VGAM353 host target RNA, and schematic representation of the complementarity of each of these host target binding sites to VGAM353 RNA, herein designated VGAM RNA, are described hereinbelow with reference to Table 2.

As mentioned hereinabove with reference to FIG. 1, a function of VGAM353 gene, herein designated VGAM is inhibition of expression of VGAM353 target genes. It is appreciated that specific functions, and accordingly utilities, of VGAM353 correlate with, and may be deduced from, the identity of the target genes which VGAM353 binds and inhibits, and the function of these target genes, as elaborated hereinbelow.

Golgi Associated, Gamma Adaptin Ear Containing, ARF Binding Protein 3 (GGA3, Accession NM_014001) is a VGAM353 host target gene. GGA3 BINDING SITE1 and GGA3 BINDING SITE2 are HOST TARGET binding sites found in untranslated regions of mRNA encoded by GGA3, corresponding to HOST TARGET binding sites such as BINDING SITE I, BINDING SITE II or BINDING SITE III. Table 2 illustrates the complementarity of the nucleotide sequences of GGA3 BINDING SITE1 and GGA3 BINDING SITE2, designated SEQ ID:15197 and SEQ ID:28900 respectively, to the nucleotide sequence of VGAM353 RNA, herein designated VGAM RNA, also designated SEQ ID:3064.

A function of VGAM353 is therefore inhibition of Golgi Associated, Gamma Adaptin Ear Containing, ARF Binding Protein 3 (GGA3, Accession NM_014001), a gene which may play a role in the regulation of membrane traffic through the trans-golgi network. Accordingly, utilities of VGAM353 include diagnosis, prevention and treatment of diseases and clinical conditions associated with GGA3. The function of GGA3 has been established by previous studies. For general information on cloning and function of the GGA family, see the entry for GGA1 (OMIM Ref. No. 606004).

Full details of the abovementioned studies are described in the following publications, the disclosure of which are hereby incorporated by reference:

Doray, B.; Ghosh, P.; Griffith, J.; Geuze, H. J.; Kornfeld, S.: Cooperation of GGAs and AP-1 in packaging MPRs at the trans-Golgi network. Science 297: 1700-1703, 2002; and Hirst, J.; Lui, W. W. Y.; Bright, N. A.; Totty, N.; Seaman, M. N. J.; Robinson, M. S.: A family of proteins with gamma-adaptin and VHS domains that facilitate trafficking between the.

Further studies establishing the function and utilities of GGA3 are found in John Hopkins OMIM database record ID 606006, and in sited publications numbered 4436, 1259 and 10969 listed in the bibliography section hereinbelow, which are also hereby incorporated by reference. Chromosome 20 Open Reading Frame 106 (C20orf106, Accession NM_080824) is another VGAM353 host target gene. C20orf106 BINDING SITE is HOST TARGET binding site found in the 3' untranslated region of mRNA encoded by C20orf106, corresponding to a HOST TARGET binding site such as BINDING SITE I, BINDING SITE II or BINDING SITE III. Table 2 illustrates the complementarity of the nucleotide sequences of C20orf106 BINDING SITE, designated SEQ ID:28091, to the nucleotide sequence of VGAM353 RNA, herein designated VGAM RNA, also designated SEQ ID:3064.

Another function of VGAM353 is therefore inhibition of Chromosome 20 Open Reading Frame 106 (C20orf106, Accession NM_080824). Accordingly, utilities of VGAM353 include diagnosis, prevention and treatment of diseases and clinical conditions associated with C20orf106. Epiregulin (EREG, Accession NM_001432) is another VGAM353 host target gene. EREG BINDING SITE is HOST TARGET binding site found in the 3" untranslated region of mRNA encoded by EREG, corresponding to a HOST TARGET binding site such as BINDING SITE I, BINDING SITE II or BINDING SITE III. Table 2 illustrates the complementarity of the nucleotide sequences of EREG BINDING SITE, designated SEQ ID:7155, to the nucleotide sequence of VGAM353 RNA, herein designated VGAM RNA, also designated SEQ ID:3064.

Another function of VGAM353 is therefore inhibition of Epiregulin (EREG, Accession NM_001432). Accordingly, utilities of VGAM353 include diagnosis, prevention and treatment of diseases and clinical conditions associated with EREG. KIAA1046 (Accession NM_014928) is another VGAM353 host target gene. KIAA1046 BINDING SITE is HOST TARGET binding site found in the 5' untranslated region of mRNA encoded by KIAA1046, corresponding to a HOST TARGET binding site such as BINDING SITE I, BINDING SITE II or BINDING SITE III. Table 2 illustrates the complementarity of the nucleotide sequences of KIAA1046 BINDING SITE, designated SEQ ID:17217, to the nucleotide sequence of VGAM353 RNA, herein designated VGAM RNA, also designated SEQ ID:3064.

Another function of VGAM353 is therefore inhibition of KIAA1046 (Accession NM_014928). Accordingly, utilities of VGAM353 include diagnosis, prevention and treatment of diseases and clinical conditions associated with KIAA1046. Mitochondrial Ribosomal Protein L20 (MRPL20, Accession NM_017971) is another VGAM353 host target gene. MRPL20 BINDING SITE is HOST TARGET binding site found in the 3' untranslated region of mRNA encoded by MRPL20, corresponding to a HOST TARGET binding site such as BINDING SITE I, BINDING SITE II or BINDING SITE III. Table 2 illustrates the complementarity of the nucleotide sequences of MRPL20 BINDING SITE, designated SEQ ID:19698, to the nucleotide sequence of VGAM353 RNA, herein designated VGAM RNA, also designated SEQ ID:3064.

Another function of VGAM353 is therefore inhibition of Mitochondrial Ribosomal Protein L20 (MRPL20, Accession NM_017971). Accordingly, utilities of VGAM353 include diagnosis, prevention and treatment of diseases and clinical conditions associated with MRPL20. NTT73 (Accession NM_018057) is another VGAM353 host target gene. NTT73 BINDING SITE is HOST TARGET binding site found in the 5' untranslated region of mRNA encoded by NTT73, corresponding to a HOST TARGET binding site such as BINDING SITE I, BINDING SITE II or BINDING SITE III. Table 2 illustrates the complementarity of the nucleotide sequences of NTT73 BINDING SITE, designated SEQ ID:19824, to the nucleotide sequence of VGAM353 RNA, herein designated VGAM RNA, also designated SEQ ID:3064.

Another function of VGAM353 is therefore inhibition of NTT73 (Accession NM_018057). Accordingly, utilities of VGAM353 include diagnosis, prevention and treatment of diseases and clinical conditions associated with NTT73. Protein O-fucosyltransferase 1 (POFUT1, Accession XM_047011) is another VGAM353 host target gene. POFUT1 BINDING SITE is HOST TARGET binding site found in the 3' untranslated region of mRNA encoded by POFUT1, corresponding to a HOST TARGET binding site such as BINDING SITE I, BINDING SITE II or BINDING SITE III. Table 2 illustrates the complementarity of the nucleotide sequences of POFUT1 BINDING SITE, designated SEQ ID:34884, to the nucleotide sequence of VGAM353 RNA, herein designated VGAM RNA, also designated SEQ ID:3064.

Another function of VGAM353 is therefore inhibition of Protein O-fucosyltransferase 1 (POFUT1, Accession XM_047011). Accordingly, utilities of VGAM353 include diagnosis, prevention and treatment of diseases and clinical conditions associated with POFUT1. LOC146237 (Accession XM_096954) is another VGAM353 host target gene. LOC146237 BINDING SITE is HOST TARGET binding site found in the 3' untranslated region of mRNA encoded by LOC146237, corresponding to a HOST TARGET binding site such as BINDING SITE I, BINDING SITE II or BINDING SITE III. Table 2 illustrates the complementarity of the nucleotide sequences of LOC146237 BINDING SITE, designated SEQ ID:40664, to the nucleotide sequence of VGAM353 RNA, herein designated VGAM RNA, also designated SEQ ID:3064.

Another function of VGAM353 is therefore inhibition of LOC146237 (Accession XM_096954). Accordingly, utilities of VGAM353 include diagnosis, prevention and treatment of diseases and clinical conditions associated with LOC146237. LOC148562 (Accession XM_086240) is another VGAM353 host target gene. LOC148562 BINDING SITE is HOST TARGET binding site found in the 3' untranslated region of mRNA encoded by LOC148562, corresponding to a HOST TARGET binding site such as BINDING SITE I, BINDING SITE II or BINDING SITE III. Table 2 illustrates the complementarity of the nucleotide sequences of LOC148562 BINDING SITE, designated SEQ ID:38566, to the nucleotide sequence of VGAM353 RNA, herein designated VGAM RNA, also designated SEQ ID:3064.

Another function of VGAM353 is therefore inhibition of LOC148562 (Accession XM_086240). Accordingly, utilities of VGAM353 include diagnosis, prevention and treatment of diseases and clinical conditions associated with LOC148562. LOC200197 (Accession XM_114148) is another VGAM353 host target gene. LOC200197 BINDING SITE is HOST TARGET binding site found in the 3' untranslated region of mRNA encoded by LOC200197, corresponding to a HOST TARGET binding site such as BINDING SITE I, BINDING SITE II or BINDING SITE III. Table 2 illustrates the complementarity of the nucleotide sequences of LOC200197 BINDING SITE, designated SEQ ID:42732, to the nucleotide sequence of VGAM353 RNA, herein designated VGAM RNA, also designated SEQ ID:3064.

Another function of VGAM353 is therefore inhibition of LOC200197 (Accession XM_114148). Accordingly, utilities of VGAM353 include diagnosis, prevention and treatment of diseases and clinical conditions associated with LOC200197. FIG. 1 further provides a conceptual description of a novel bioinformatically detected viral gene of the present invention, referred to here as Viral Genomic Address Messenger 354 (VGAM354) viral gene, which modulates expression of respective host target genes thereof, the function and utility of which host target genes is known in the art.

VGAM354 is a novel bioinformatically detected regulatory, non protein coding, viral micro RNA (miRNA) gene. The method by which VGAM354 was detected is described hereinabove with reference to FIGS. 1-8.

VGAM354 gene, herein designated VGAM GENE, is a viral gene contained in the genome of Avian Infectious Bronchitis Virus. VGAM354 host target gene, herein designated VGAM HOST TARGET GENE, is a human gene contained in the human genome.

VGAM354 gene encodes a VGAM354 precursor RNA, herein designated VGAM PRECURSOR RNA. Similar to other miRNA genes, and unlike most ordinary genes, VGAM354 precursor RNA does not encode a protein. A nucleotide sequence identical or highly similar to the nucleotide sequence of VGAM354 precursor RNA is designated SEQ ID:340, and is provided hereinbelow with reference to the sequence listing part. Nucleotide sequence SEQ ID:340 is located at position 7380 relative to the genome of Avian Infectious Bronchitis Virus.

VGAM354 precursor RNA folds onto itself, forming VGAM354 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM354 folded precursor RNA into VGAM354 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM354 RNA is designated SEQ ID:3065, and is provided hereinbelow with reference to the sequence listing part.

VGAM354 host target gene, herein designated VGAM HOST TARGET GENE, encodes a corresponding messenger RNA, VGAM354 host target RNA, herein designated VGAM HOST TARGET RNA. VGAM354 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM354 RNA, herein designated VGAM RNA, binds complementarily to one or more host target binding sites located in untranslated regions of VGAM354 host target RNA, herein designated VGAM HOST TARGET RNA. This complementary binding is due to the fact that the nucleotide sequence of VGAM354 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM354 RNA, herein designated VGAM RNA, may have a different number of host target binding sites in untranslated regions of a VGAM354 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM354 RNA, herein designated VGAM RNA, to host target binding sites on VGAM354 host target RNA, herein designated VGAM HOST TARGET RNA, such as BINDING SITE I, BINDING SITE II and BINDING SITE III, inhibits translation of VGAM354 host target RNA into VGAM354 host target protein, herein designated VGAM HOST TARGET PROTEIN. VGAM host target protein is therefore outlined by a broken line.

It is appreciated that VGAM354 host target gene, herein designated VGAM HOST TARGET GENE, in fact represents a plurality of VGAM354 host target genes. The mRNA of each one of this plurality of VGAM354 host target genes comprises one or more host target binding sites, each having a nucleotide sequence which is at least partly complementary to VGAM354 RNA, herein designated VGAM RNA, and which when bound by VGAM354 RNA causes inhibition of translation of respective one or more VGAM354 host target proteins.

It is further appreciated by one skilled in the art that the mode of translational inhibition illustrated by FIG. 1 with specific reference to translational inhibition exerted by VGAM354 gene, herein designated VGAM GENE, on one or more VGAM354 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM354 is inhibition of expression of host target genes, as part of a novel viral mechanism of attacking a host. Accordingly, utilities of VGAM354 include diagnosis, prevention and treatment of viral infection by Avian Infectious Bronchitis Virus. Specific functions, and accordingly utilities, of VGAM354 correlate with, and may be deduced from, the identity of the host target genes which VGAM354 binds and inhibits, and the function of these host target genes, as elaborated hereinbelow.

Nucleotide sequences of the VGAM354 precursor RNA, herein designated VGAM PRECURSOR RNA, and of the 'diced' VGAM354 RNA, herein designated VGAM RNA, and a schematic representation of the secondary folding of VGAM354 folded precursor RNA, herein designated VGAM FOLDED PRECURSOR RNA, of VGAM354 are further described hereinbelow with reference to Table 1.

Nucleotide sequences of host target binding sites, such as BINDING SITE-I, BINDING SITE-II and BINDING SITE-III of FIG. 1, found on VGAM354 host target RNA, and schematic representation of the complementarity of each of these host target binding sites to VGAM354 RNA, herein designated VGAM RNA, are described hereinbelow with reference to Table 2.

As mentioned hereinabove with reference to FIG. 1, a function of VGAM354 gene, herein designated VGAM is inhibition of expression of VGAM354 target genes. It is appreciated that specific functions, and accordingly utilities, of VGAM354 correlate with, and may be deduced from, the identity of the target genes which VGAM354 binds and inhibits, and the function of these target genes, as elaborated hereinbelow.

Myotubularin Related Protein 2 (MTMR2, Accession NM_016156) is a VGAM354 host target gene. MTMR2 BINDING SITE is HOST TARGET binding site found in the 3' untranslated region of mRNA encoded by MTMR2, corresponding to a HOST TARGET binding site such as BINDING SITE I, BINDING SITE II or BINDING SITE III. Table 2 illustrates the complementarity of the nucleotide sequences of MTMR2 BINDING SITE, designated SEQ ID:18242, to the nucleotide sequence of VGAM354 RNA, herein designated VGAM RNA, also designated SEQ ID:3065.

A function of VGAM354 is therefore inhibition of Myotubularin Related Protein 2 (MTMR2, Accession NM_016156). Accordingly, utilities of VGAM354 include diagnosis, prevention and treatment of diseases and clinical conditions associated with MTMR2. Baculoviral IAP Repeat-containing 1 (BIRC1, Accession NM_004536) is another VGAM354 host target gene. BIRC1 BINDING SITE is HOST TARGET binding site found in the 3' untranslated region of mRNA encoded by BIRC1, corresponding to a HOST TARGET binding site such as BINDING SITE I, BINDING SITE II or BINDING SITE III. Table 2 illustrates the complementarity of the nucleotide sequences of BIRC1 BINDING SITE, designated SEQ ID:10880, to the nucleotide sequence of VGAM354 RNA, herein designated VGAM RNA, also designated SEQ ID:3065.

Another function of VGAM354 is therefore inhibition of Baculoviral IAP Repeat-containing 1 (BIRC1, Accession NM_004536). Accordingly, utilities of VGAM354 include diagnosis, prevention and treatment of diseases and clinical conditions associated with BIRC1. Death-associated Protein Kinase 2 (DAPK2, Accession NM_014326) is another VGAM354 host target gene. DAPK2 BINDING SITE is HOST TARGET binding site found in the 3' untranslated region of mRNA encoded by DAPK2, corresponding to a HOST TARGET binding site such as BINDING SITE I, BINDING SITE II or BINDING SITE III. Table 2 illustrates the complementarity of the nucleotide sequences of DAPK2 BINDING SITE, designated SEQ ID:15633, to the nucleotide sequence of VGAM354 RNA, herein designated VGAM RNA, also designated SEQ ID:3065.

Another function of VGAM354 is therefore inhibition of Death-associated Protein Kinase 2 (DAPK2, Accession NM_014326). Accordingly, utilities of VGAM354 include diagnosis, prevention and treatment of diseases and clinical conditions associated with DAPK2. FLJ20128 (Accession NM_017679) is another VGAM354 host target gene. FLJ20128 BINDING SITE is HOST TARGET binding site found in the 3' untranslated region of mRNA encoded by FLJ20128, corresponding to a HOST TARGET binding site such as BINDING SITE I, BINDING SITE II or BINDING SITE III. Table 2 illustrates the complementarity of the nucleotide sequences of FLJ20128 BINDING SITE, designated SEQ ID:19221, to the nucleotide sequence of VGAM354 RNA, herein designated VGAM RNA, also designated SEQ ID:3065.

Another function of VGAM354 is therefore inhibition of FLJ20128 (Accession NM_017679). Accordingly, utilities of VGAM354 include diagnosis, prevention and treatment of diseases and clinical conditions associated with FLJ20128. Olfactory Receptor, Family 2, Subfamily C, Member 3 (OR2C3, Accession XM_060575) is another VGAM354 host target gene. OR2C3 BINDING SITE is HOST TARGET binding site found in the 3' untranslated region of mRNA encoded by OR2C3, corresponding to a HOST TARGET binding site such as BINDING SITE I, BINDING SITE II or BINDING SITE III. Table 2 illustrates the complementarity of the nucleotide sequences of OR2C3 BINDING SITE, designated SEQ ID:37174, to the nucleotide sequence of VGAM354 RNA, herein designated VGAM RNA, also designated SEQ ID:3065.

Another function of VGAM354 is therefore inhibition of Olfactory Receptor, Family 2, Subfamily C, Member 3 (OR2C3, Accession XM_060575). Accordingly, utilities of VGAM354 include diagnosis, prevention and treatment of diseases and clinical conditions associated with OR2C3. RAP2B, Member of RAS Oncogene Family (RAP2B, Accession XM_171061) is another VGAM354 host target gene. RAP2B BINDING SITE is HOST TARGET binding site found in the 3' untranslated region of mRNA encoded by RAP2B, corresponding to a HOST TARGET binding site such as BINDING SITE I, BINDING SITE II or BINDING SITE III. Table 2 illustrates the complementarity of the nucleotide sequences of RAP2B BINDING SITE, designated SEQ ID:45859, to the nucleotide sequence of VGAM354 RNA, herein designated VGAM RNA, also designated SEQ ID:3065.

Another function of VGAM354 is therefore inhibition of RAP2B, Member of RAS Oncogene Family (RAP2B, Accession XM_171061). Accordingly, utilities of VGAM354 include diagnosis, prevention and treatment of diseases and clinical conditions associated with RAP2B. RODH-4 (Accession NM_003708) is another VGAM354 host target gene. RODH-4 BINDING SITE is HOST TARGET binding site found in the 3' untranslated region of mRNA encoded by RODH-4, corresponding to a HOST TARGET binding site such as BINDING SITE I, BINDING SITE II or BINDING SITE III. Table 2 illustrates the complementarity of the nucleotide sequences of RODH-4 BINDING SITE, designated SEQ ID:9806, to the nucleotide sequence of VGAM354 RNA, herein designated VGAM RNA, also designated SEQ ID:3065.

Another function of VGAM354 is therefore inhibition of RODH-4 (Accession NM_003708). Accordingly, utilities of VGAM354 include diagnosis, prevention and treatment of diseases and clinical conditions associated with RODH-4. LOC151742 (Accession NM_139245) is another VGAM354 host target gene. LOC151742 BINDING SITE is HOST TARGET binding site found in the 3' untranslated region of mRNA encoded by LOC151742, corresponding to a HOST TARGET binding site such as BINDING SITE I, BINDING SITE II or BINDING SITE III. Table 2 illustrates the complementarity of the nucleotide sequences of LOC151742 BINDING SITE, designated SEQ ID:29241, to the nucleotide sequence of VGAM354 RNA, herein designated VGAM RNA, also designated SEQ ID:3065.

Another function of VGAM354 is therefore inhibition of LOC151742 (Accession NM_139245). Accordingly, utilities of VGAM354 include diagnosis, prevention and treatment of diseases and clinical conditions associated with LOC151742. LOC219529 (Accession XM_167563) is another VGAM354 host target gene. LOC219529 BINDING SITE is HOST TARGET binding site found in the 3' untranslated region of mRNA encoded by LOC219529, corresponding to a HOST TARGET binding site such as BINDING SITE I, BINDING SITE II or BINDING SITE III. Table 2 illustrates the complementarity of the nucleotide sequences of LOC219529 BINDING SITE, designated SEQ ID:44675, to the nucleotide sequence of VGAM354 RNA, herein designated VGAM RNA, also designated SEQ ID:3065.

Another function of VGAM354 is therefore inhibition of LOC219529 (Accession XM_167563). Accordingly, utilities of VGAM354 include diagnosis, prevention and treatment of diseases and clinical conditions associated with LOC219529. LOC90459 (Accession XM_031826) is another VGAM354 host target gene. LOC90459 BINDING SITE is HOST TARGET binding site found in the 3' untranslated region of mRNA encoded by LOC90459, corresponding to a HOST TARGET binding site such as BINDING SITE I, BINDING SITE II or BINDING SITE III. Table 2 illustrates the complementarity of the nucleotide sequences of LOC90459 BINDING SITE, designated SEQ ID:31491, to the nucleotide sequence of VGAM354 RNA, herein designated VGAM RNA, also designated SEQ ID:3065.

Another function of VGAM354 is therefore inhibition of LOC90459 (Accession XM_031826). Accordingly, utilities of VGAM354 include diagnosis, prevention and treatment of diseases and clinical conditions associated with LOC90459. FIG. 1 further provides a conceptual description of a novel bioinformatically detected viral gene of the present invention, referred to here as Viral Genomic Address Messenger 355 (VGAM355) viral gene, which modulates expression of respective host target genes thereof, the function and utility of which host target genes is known in the art.

VGAM355 is a novel bioinformatically detected regulatory, non protein coding, viral micro RNA (miRNA) gene. The method by which VGAM355 was detected is described hereinabove with reference to FIGS. 1-8.

VGAM355 gene, herein designated VGAM GENE, is a viral gene contained in the genome of Avian Infectious Bronchitis Virus. VGAM355 host target gene, herein designated VGAM HOST TARGET GENE, is a human gene contained in the human genome.

VGAM355 gene encodes a VGAM355 precursor RNA, herein designated VGAM PRECURSOR RNA. Similar to other miRNA genes, and unlike most ordinary genes, VGAM355 precursor RNA does not encode a protein. A nucleotide sequence identical or highly similar to the nucleotide sequence of VGAM355 precursor RNA is designated SEQ ID:341, and is provided hereinbelow with reference to the sequence listing part. Nucleotide sequence SEQ ID:341 is located at position 931 relative to the genome of Avian Infectious Bronchitis Virus.

VGAM355 precursor RNA folds onto itself, forming VGAM355 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM355 folded precursor RNA into VGAM355 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM355 RNA is designated SEQ ID:3066, and is provided hereinbelow with reference to the sequence listing part.

VGAM355 host target gene, herein designated VGAM HOST TARGET GENE, encodes a corresponding messenger RNA, VGAM355 host target RNA, herein designated VGAM HOST TARGET RNA. VGAM355 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM355 RNA, herein designated VGAM RNA, binds complementarily to one or more host target binding sites located in untranslated regions of VGAM355 host target RNA, herein designated VGAM HOST TARGET RNA. This complementary binding is due to the fact that the nucleotide sequence of VGAM355 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM355 RNA, herein designated VGAM RNA, may have a different number of host target binding sites in untranslated regions of a VGAM355 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM355 RNA, herein designated VGAM RNA, to host target binding sites on VGAM355 host target RNA, herein designated VGAM HOST TARGET RNA, such as BINDING SITE I, BINDING SITE II and BINDING SITE III, inhibits translation of VGAM355 host target RNA into VGAM355 host target protein, herein designated VGAM HOST TARGET PROTEIN. VGAM host target protein is therefore outlined by a broken line.

It is appreciated that VGAM355 host target gene, herein designated VGAM HOST TARGET GENE, in fact represents a plurality of VGAM355 host target genes. The mRNA of each one of this plurality of VGAM355 host target genes comprises one or more host target binding sites, each having a nucleotide sequence which is at least partly complementary to VGAM355 RNA, herein designated VGAM RNA, and which when bound by VGAM355 RNA causes inhibition of translation of respective one or more VGAM355 host target proteins.

It is further appreciated by one skilled in the art that the mode of translational inhibition illustrated by FIG. 1 with specific reference to translational inhibition exerted by VGAM355 gene, herein designated VGAM GENE, on one or more VGAM355 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM355 is inhibition of expression of host target genes, as part of a novel viral mechanism of attacking a host. Accordingly, utilities of VGAM355 include diagnosis, prevention and treatment of viral infection by Avian Infectious Bronchitis Virus. Specific functions, and accordingly utilities, of VGAM355 correlate with, and may be deduced from, the identity of the host target genes which VGAM355 binds and inhibits, and the function of these host target genes, as elaborated hereinbelow.

Nucleotide sequences of the VGAM355 precursor RNA, herein designated VGAM PRECURSOR RNA, and of the 'diced' VGAM355 RNA, herein designated VGAM RNA, and a schematic representation of the secondary folding of VGAM355 folded precursor RNA, herein designated VGAM FOLDED PRECURSOR RNA, of VGAM355 are further described hereinbelow with reference to Table 1.

Nucleotide sequences of host target binding sites, such as BINDING SITE-I, BINDING SITE-II and BINDING SITE-III of FIG. 1, found on VGAM355 host target RNA, and schematic representation of the complementarity of each of these host target binding sites to VGAM355 RNA, herein designated VGAM RNA, are described hereinbelow with reference to Table 2.

As mentioned hereinabove with reference to FIG. 1, a function of VGAM355 gene, herein designated VGAM is inhibition of expression of VGAM355 target genes. It is appreciated that specific functions, and accordingly utilities, of VGAM355 correlate with, and may be deduced from, the identity of the target genes which VGAM355 binds and inhibits, and the function of these target genes, as elaborated hereinbelow.

B-cell CLL/lymphoma 7A (BCL7A, Accession NM_020993) is a VGAM355 host target gene. BCL7A BINDING SITE is HOST TARGET binding site found in the 3' untranslated region of mRNA encoded by BCL7A, corresponding to a HOST TARGET binding site such as BINDING SITE I, BINDING SITE II or BINDING SITE III. Table 2 illustrates the complementarity of the nucleotide sequences of BCL7A BINDING SITE, designated SEQ ID:21987, to the nucleotide sequence of VGAM355 RNA, herein designated VGAM RNA, also designated SEQ ID:3066.

A function of VGAM355 is therefore inhibition of B-cell CLL/lymphoma 7A (BCL7A, Accession NM_020993). Accordingly, utilities of VGAM355 include diagnosis, prevention and treatment of diseases and clinical conditions associated with BCL7A. Macrophage Scavenger Receptor 1 (MSR1, Accession NM_138715) is another VGAM355 host target gene. MSR1 BINDING SITE1 and MSR1 BINDING SITE2 are HOST TARGET binding sites found in untranslated regions of mRNA encoded by MSR1, corresponding to HOST TARGET binding sites such as BINDING SITE I, BINDING SITE II or BINDING SITE III. Table 2 illustrates the complementarity of the nucleotide sequences of MSR1 BINDING SITE1 and MSR1 BINDING SITE2, designated SEQ ID:28961 and SEQ ID:28963 respectively, to the nucleotide sequence of VGAM355 RNA, herein designated VGAM RNA, also designated SEQ ID:3066.

Another function of VGAM355 is therefore inhibition of Macrophage Scavenger Receptor 1 (MSR1, Accession NM_138715), a gene which plays a role in endocytosis of macromolecules. Accordingly, utilities of VGAM355 include diagnosis, prevention and treatment of diseases and clinical conditions associated with MSR1. The function of MSR1 and its association with various diseases and clinical conditions, has been established by previous studies, as described hereinabove with reference to VGAM176. Vacuolar Protein Sorting 41 (yeast) (VPS41, Accession NM_014396) is another VGAM355 host target gene. VPS41 BINDING SITE is HOST TARGET binding site found in the 3' untranslated region of mRNA encoded by VPS41, corresponding to a HOST TARGET binding site such as BINDING SITE I, BINDING SITE II or BINDING SITE III. Table 2 illustrates the complementarity of the nucleotide sequences of VPS41 BINDING SITE, designated SEQ ID:15736, to the nucleotide sequence of VGAM355 RNA, herein designated VGAM RNA, also designated SEQ ID:3066.

Another function of VGAM355 is therefore inhibition of Vacuolar Protein Sorting 41 (yeast) (VPS41, Accession NM_014396). Accordingly, utilities of VGAM355 include diagnosis, prevention and treatment of diseases and clinical conditions associated with VPS41. KIAA1538 (Accession XM_049474) is another VGAM355 host target gene. KIAA1538 BINDING SITE is HOST TARGET binding site found in the 3' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35435, to the nucleotide sequence of VGAM355 RNA, herein designated VGAM RNA, also designated SEQ ID:3066.

Another function of VGAM355 is therefore inhibition of KIAA1538 (Accession XM_049474). Accordingly, utilities of VGAM355 include diagnosis, prevention and treatment of diseases and clinical conditions associated with KIAA1538. KIAA1712 (Accession XM_041497) is another VGAM355 host target gene. KIAA1712 BINDING SITE is HOST TARGET binding site found in the 3' untranslated region of mRNA encoded by KIAA1712, corresponding to a HOST TARGET binding site such as BINDING SITE I, BINDING SITE II or BINDING SITE III. Table 2 illustrates the complementarity of the nucleotide sequences of KIAA1712 BINDING SITE, designated SEQ ID:33538, to the nucleotide sequence of VGAM355 RNA, herein designated VGAM RNA, also designated SEQ ID:3066.

Another function of VGAM355 is therefore inhibition of KIAA1712 (Accession XM_041497). Accordingly, utilities of VGAM355 include diagnosis, prevention and treatment of diseases and clinical conditions associated with KIAA1712. KIAA1906 (Accession XM_055095) is another VGAM355 host target gene. KIAA1906 BINDING SITE is HOST TARGET binding site found in the 3' untranslated region of mRNA encoded by KIAA1906, corresponding to a HOST TARGET binding site such as BINDING SITE I, BINDING SITE II or BINDING SITE III. Table 2 illustrates the complementarity of the nucleotide sequences of KIAA1906 BINDING SITE, designated SEQ ID:36232, to the nucleotide sequence of VGAM355 RNA, herein designated VGAM RNA, also designated SEQ ID:3066.

Another function of VGAM355 is therefore inhibition of KIAA1906 (Accession XM_055095). Accordingly, utilities of VGAM355 include diagnosis, prevention and treatment of diseases and clinical conditions associated with KIAA1906. Paternally Expressed 10 (PEG10, Accession NM_015068) is another VGAM355 host target gene. PEG10 BINDING SITE is HOST TARGET binding site found in the 3' untranslated region of mRNA encoded by PEG10, corresponding to a HOST TARGET binding site such as BINDING SITE I, BINDING SITE II or BINDING SITE III. Table 2 illustrates the complementarity of the nucleotide sequences of PEG10 BINDING SITE, designated SEQ ID:17426, to the nucleotide sequence of VGAM355 RNA, herein designated VGAM RNA, also designated SEQ ID:3066.

Another function of VGAM355 is therefore inhibition of Paternally Expressed 10 (PEG10, Accession NM_015068). Accordingly, utilities of VGAM355 include diagnosis, prevention and treatment of diseases and clinical conditions associated with PEG10. Solute Carrier Family 2 (facilitated glucose transporter), Member 10 (SLC2A10, Accession NM_030777) is another VGAM355 host target gene. SLC2A10 BINDING SITE is HOST TARGET binding site found in the 3' untranslated region of mRNA encoded by SLC2A10, corresponding to a HOST TARGET binding site such as BINDING SITE I, BINDING SITE II or BINDING SITE III. Table 2 illustrates the complementarity of the nucleotide sequences of SLC2A10 BINDING SITE, designated SEQ ID:25064, to the nucleotide sequence of VGAM355 RNA, herein designated VGAM RNA, also designated SEQ ID:3066.

Another function of VGAM355 is therefore inhibition of Solute Carrier Family 2 (facilitated glucose transporter), Member 10 (SLC2A10, Accession NM_030777). Accordingly, utilities of VGAM355 include diagnosis, prevention and treatment of diseases and clinical conditions associated with SLC2A10. LOC143153 (Accession XM_084440) is another VGAM355 host target gene. LOC143153 BINDING SITE is HOST TARGET binding site found in the 3' untranslated region of mRNA encoded by LOC143153, corresponding to a HOST TARGET binding site such as BINDING SITE I, BINDING SITE II or BINDING SITE III. Table 2 illustrates the complementarity of the nucleotide sequences of LOC143153 BINDING SITE, designated SEQ ID:37582, to the nucleotide sequence of VGAM355 RNA, herein designated VGAM RNA, also designated SEQ ID:3066.

Another function of VGAM355 is therefore inhibition of LOC143153 (Accession XM_084440). Accordingly, utilities of VGAM355 include diagnosis, prevention and treatment of diseases and clinical conditions associated with LOC143153. LOC143154 (Accession XM_084441) is another VGAM355 host target gene. LOC143154 BINDING SITE is HOST TARGET binding site found in the 3' untranslated region of mRNA encoded by LOC143154, corresponding to a HOST TARGET binding site such as BINDING SITE I, BINDING SITE II or BINDING SITE III. Table 2 illustrates the complementarity of the nucleotide sequences of LOC143154 BINDING SITE, designated SEQ ID:37588, to the nucleotide sequence of VGAM355 RNA, herein designated VGAM RNA, also designated SEQ ID:3066.

Another function of VGAM355 is therefore inhibition of LOC143154 (Accession XM_084441). Accordingly, utilities of VGAM355 include diagnosis, prevention and treatment of diseases and clinical conditions associated with LOC143154. LOC144289 (Accession XM_096565) is another VGAM355 host target gene. LOC144289 BINDING SITE is HOST TARGET binding site found in the 5' untranslated region of mRNA encoded by LOC144289, corresponding to a HOST TARGET binding site such as BINDING SITE I, BINDING SITE II or BINDING SITE III. Table 2 illustrates the complementarity of the nucleotide sequences of LOC144289 BINDING SITE, designated SEQ ID:40398, to the nucleotide sequence of VGAM355 RNA, herein designated VGAM RNA, also designated SEQ ID:3066.

Another function of VGAM355 is therefore inhibition of LOC144289 (Accession XM_096565). Accordingly, utilities of VGAM355 include diagnosis, prevention and treatment of diseases and clinical conditions associated with LOC144289. LOC219294 (Accession XM_167566) is another VGAM355 host target gene. LOC219294 BINDING SITE is HOST TARGET binding site found in the 3' untranslated region of mRNA encoded by LOC219294, corresponding to a HOST TARGET binding site such as BINDING SITE I, BINDING SITE II or BINDING SITE III. Table 2 illustrates the complementarity of the nucleotide sequences of LOC219294 BINDING SITE, designated SEQ ID:44689, to the nucleotide sequence of VGAM355 RNA, herein designated VGAM RNA, also designated SEQ ID:3066.

Another function of VGAM355 is therefore inhibition of LOC219294 (Accession XM_167566). Accordingly, utilities of VGAM355 include diagnosis, prevention and treatment of diseases and clinical conditions associated with LOC219294. LOC219295 (Accession XM_167565) is another VGAM355 host target gene. LOC219295 BINDING SITE is HOST TARGET binding site found in the 3' untranslated region of mRNA encoded by LOC219295, corresponding to a HOST TARGET binding site such as BINDING SITE I, BINDING SITE II or BINDING SITE III. Table 2 illustrates the complementarity of the nucleotide sequences of LOC219295 BINDING SITE, designated SEQ ID:44683, to the nucleotide sequence of VGAM355 RNA, herein designated VGAM RNA, also designated SEQ ID:3066.

Another function of VGAM355 is therefore inhibition of LOC219295 (Accession XM_167565). Accordingly, utilities of VGAM355 include diagnosis, prevention and treatment of diseases and clinical conditions associated with LOC219295. LOC91170 (Accession XM_036612) is another VGAM355 host target gene. LOC91170 BINDING SITE is HOST TARGET binding site found in the 3' untranslated region of mRNA encoded by LOC91170, corresponding to a HOST TARGET binding site such as BINDING SITE I, BINDING SITE II or BINDING SITE III. Table 2 illustrates the complementarity of the nucleotide sequences of LOC91170 BINDING SITE, designated SEQ ID:32479, to the nucleotide sequence of VGAM355 RNA, herein designated VGAM RNA, also designated SEQ ID:3066.

Another function of VGAM355 is therefore inhibition of LOC91170 (Accession XM_036612). Accordingly, utilities of VGAM355 include diagnosis, prevention and treatment of diseases and clinical conditions associated with LOC91170. FIG. 1 further provides a conceptual description of a novel bioinformatically detected viral gene of the present invention, referred to here as Viral Genomic Address Messenger 356 (VGAM356) viral gene, which modulates expression of respective host target genes thereof, the function and utility of which host target genes is known in the art.

VGAM356 is a novel bioinformatically detected regulatory, non protein coding, viral micro RNA (miRNA) gene. The method by which VGAM356 was detected is described hereinabove with reference to FIGS. 1-8.

VGAM356 gene, herein designated VGAM GENE, is a viral gene contained in the genome of Avian Infectious Bronchitis Virus. VGAM356 host target gene, herein designated VGAM HOST TARGET GENE, is a human gene contained in the human genome.

VGAM356 gene encodes a VGAM356 precursor RNA, herein designated VGAM PRECURSOR RNA. Similar to other miRNA genes, and unlike most ordinary genes, VGAM356 precursor RNA does not encode a protein. A nucleotide sequence identical or highly similar to the nucleotide sequence of VGAM356 precursor RNA is designated SEQ ID:342, and is provided hereinbelow with reference to the sequence listing part. Nucleotide sequence SEQ ID:342 is located at position 6336 relative to the genome of Avian Infectious Bronchitis Virus.

VGAM356 precursor RNA folds onto itself, forming VGAM356 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM356 folded precursor RNA into VGAM356 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM356 RNA is designated SEQ ID:3067, and is provided hereinbelow with reference to the sequence listing part.

VGAM356 host target gene, herein designated VGAM HOST TARGET GENE, encodes a corresponding messenger RNA, VGAM356 host target RNA, herein designated VGAM HOST TARGET RNA. VGAM356 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM356 RNA, herein designated VGAM RNA, binds complementarily to one or more host target binding sites located in untranslated regions of VGAM356 host target RNA, herein designated VGAM HOST TARGET RNA. This complementary binding is due to the fact that the nucleotide sequence of VGAM356 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM356 RNA, herein designated VGAM RNA, may have a different number of host target binding sites in untranslated regions of a VGAM356 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM356 RNA, herein designated VGAM RNA, to host target binding sites on VGAM356 host target RNA, herein designated VGAM HOST TARGET RNA, such as BINDING SITE I, BINDING SITE II and BINDING SITE III, inhibits translation of VGAM356 host target RNA into VGAM356 host target protein, herein designated VGAM HOST TARGET PROTEIN. VGAM host target protein is therefore outlined by a broken line.

It is appreciated that VGAM356 host target gene, herein designated VGAM HOST TARGET GENE, in fact represents a plurality of VGAM356 host target genes. The mRNA of each one of this plurality of VGAM356 host target genes comprises one or more host target binding sites, each having a nucleotide sequence which is at least partly complementary to VGAM356 RNA, herein designated VGAM RNA, and which when bound by VGAM356 RNA causes inhibition of translation of respective one or more VGAM356 host target proteins.

It is further appreciated by one skilled in the art that the mode of translational inhibition illustrated by FIG. 1 with specific reference to translational inhibition exerted by VGAM356 gene, herein designated VGAM GENE, on one or more VGAM356 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM356 is inhibition of expression of host target genes, as part of a novel viral mechanism of attacking a host. Accordingly, utilities of VGAM356 include diagnosis, prevention and treatment of viral infection by Avian Infectious Bronchitis Virus. Specific functions, and accordingly utilities, of VGAM356 correlate with, and may be deduced from, the identity of the host target genes which VGAM356 binds and inhibits, and the function of these host target genes, as elaborated hereinbelow.

Nucleotide sequences of the VGAM356 precursor RNA, herein designated VGAM PRECURSOR RNA, and of the 'diced' VGAM356 RNA, herein designated VGAM RNA, and a schematic representation of the secondary folding of VGAM356 folded precursor RNA, herein designated VGAM FOLDED PRECURSOR RNA, of VGAM356 are further described hereinbelow with reference to Table 1.

Nucleotide sequences of host target binding sites, such as BINDING SITE-I, BINDING SITE-II and BINDING SITE-III of FIG. 1, found on VGAM356 host target RNA, and schematic representation of the complementarity of each of these host target binding sites to VGAM356 RNA, herein designated VGAM RNA, are described hereinbelow with reference to Table 2.

As mentioned hereinabove with reference to FIG. 1, a function of VGAM356 gene, herein designated VGAM is inhibition of expression of VGAM356 target genes. It is appreciated that specific functions, and accordingly utilities, of VGAM356 correlate with, and may be deduced from, the identity of the target genes which VGAM356 binds and inhibits, and the function of these target genes, as elaborated hereinbelow.

CDC-like Kinase 2 (CLK2, Accession NM_001291) is a VGAM356 host target gene. CLK2 BINDING SITE is HOST TARGET binding site found in the 3' untranslated region of mRNA encoded by CLK2, corresponding to a HOST TARGET binding site such as BINDING SITE I, BINDING SITE II or BINDING SITE III. Table 2 illustrates the complementarity of the nucleotide sequences of CLK2 BINDING SITE, designated SEQ ID:6971, to the nucleotide sequence of VGAM356 RNA, herein designated VGAM RNA, also designated SEQ ID:3067.

A function of VGAM356 is therefore inhibition of CDC-like Kinase 2 (CLK2, Accession NM_001291), a gene which catalyzes the phosphorylation of proteins. Accordingly, utilities of VGAM356 include diagnosis, prevention and treatment of diseases and clinical conditions associated with CLK2. The function of CLK2 has been established by previous studies. The protein kinases are a family of enzymes that catalyze the phosphorylation of proteins and are classified according to the amino acid that acts as the phosphate acceptor. Hanes et al. (1994) cloned human ovarian follicle cDNAs encoding the novel serine/threonine kinase CLK2 based on their high sequence identity to human and mouse protein kinase CLK1 (CLK; 601951) cDNAs. The authors identified 2 alternative CLK2 cDNAs of different lengths that represent differentially spliced CLK2 transcripts; these mRNAs coexist at varying ratios in human prostate, testis, leukocytes, and muscle. The longer CLK2 cDNA encodes a predicted 499-amino acid protein that has a nonconserved N-terminal domain, a highly conserved C-terminal kinase domain, and multiple potential phosphorylation sites. This CLK2 isoform has 61% and 56% sequence identity with the CLK3 (OMIM Ref. No. 602990) and CLK1 proteins, respectively. The shorter cDNA contains an internal deletion corresponding to an 88-bp exon, resulting in a predicted 139-amino acid protein that lacks the kinase domain. Southern blot analysis of human genomic DNA suggested that CLK2 is a single-copy gene. Nothwang et al. (2001) reported a translocation t (1;19) (q21.3; q13.2) in a female with mental retardation, ataxia, and atrophy of the brain. Sequence analysis of the breakpoints revealed an Alu repeat-mediated mechanism of recombination that led to truncation of CLK2 and PAFAH1B3 (OMIM Ref. No. 603074), the gene product of which interacts with LIS1 (OMIM Ref. No. 601545) as part of the heterotrimeric G protein complex PAFAH1B. One expressed fusion gene encoded the first 136 amino acids of PAFAH1B3, followed by the complete CLK2 protein. Truncated PAFAH1B3 protein lost its potential to interact with LIS1, whereas CLK2 activity was conserved within the fusion protein. These data emphasized the importance of PAFAH1B in brain development and function.

Full details of the abovementioned studies are described in the following publications, the disclosure of which are hereby incorporated by reference:

Hanes, J.; von der Kammer, H.; Klaudiny, J.; Scheit, K. H.: Characterization by cDNA cloning of two new human protein kinases: evidence by sequence comparison of a new family of mammalian protein kinases. J. Molec. Biol. 244:665-672, 1994; and Nothwang, H. G.; Kim, H. G.; Aoki, J.; Geisterfer, M.; Kubart, S.; Wegner, R. D.; van Moers, A.; Ashworth, L. K.; Haaf, T.; Bell, J.; Arai, H.; Tommerup, N.; Ropers, H. H.; Wirth, J..

Further studies establishing the function and utilities of CLK2 are found in John Hopkins OMIM database record ID 602989, and in sited publications numbered 669 and 6700 listed in the bibliography section hereinbelow, which are also hereby incorporated by reference. Eukaryotic Translation Initiation Factor 2C, 1 (EIF2C1, Accession NM_012199) is another VGAM356 host target gene. EIF2C1 BINDING SITE is HOST TARGET binding site found in the 3' untranslated region of mRNA encoded by EIF2C1, corresponding to a HOST TARGET binding site such as BINDING SITE I, BINDING SITE II or BINDING SITE III. Table 2 illustrates the complementarity of the nucleotide sequences of EIF2C1 BINDING SITE, designated SEQ ID:14498, to the nucleotide sequence of VGAM356 RNA, herein designated VGAM RNA, also designated SEQ ID:3067.

Another function of VGAM356 is therefore inhibition of Eukaryotic Translation Initiation Factor 2C, 1 (EIF2C1, Accession NM_012199), a gene which plays an important role in the eukaryotic peptide chain initiation process. Accordingly, utilities of VGAM356 include diagnosis, prevention and treatment of diseases and clinical conditions associated with EIF2C1. The function of EIF2C1 and its association with various diseases and clinical conditions, has been established by previous studies, as described hereinabove with reference to VGAM118. Fms-related Tyrosine Kinase 1 (vascular endothelial growth factor/vascular permeability factor receptor) (FLT1, Accession NM_002019) is another VGAM356 host target gene. FLT1 BINDING SITE is HOST TARGET binding site found in the 3' untranslated region of mRNA encoded by FLT1, corresponding to a HOST TARGET binding site such as BINDING SITE I, BINDING SITE II or BINDING SITE III. Table 2 illustrates the complementarity of the nucleotide sequences of FLT1 BINDING SITE, designated SEQ ID:7762, to the nucleotide sequence of VGAM356 RNA, herein designated VGAM RNA, also designated SEQ ID:3067.

Another function of VGAM356 is therefore inhibition of Fms-related Tyrosine Kinase 1 (vascular endothelial growth factor/vascular permeability factor receptor) (FLT1, Accession NM_002019). Accordingly, utilities of VGAM356 include diagnosis, prevention and treatment of diseases and clinical conditions associated with FLT1. Homeo Box D4 (HOXD4, Accession NM_014621) is another VGAM356 host target gene. HOXD4 BINDING SITE is HOST TARGET binding site found in the 3' untranslated region of mRNA encoded by HOXD4, corresponding to a HOST TARGET binding site such as BINDING SITE I, BINDING SITE II or BINDING SITE III. Table 2 illustrates the complementarity of the nucleotide sequences of HOXD4 BINDING SITE, designated SEQ ID:15976, to the nucleotide sequence of VGAM356 RNA, herein designated VGAM RNA, also designated SEQ ID:3067.

Another function of VGAM356 is therefore inhibition of Homeo Box D4 (HOXD4, Accession NM_014621), a gene which is part of a developmental regulatory system. Accordingly, utilities of VGAM356 include diagnosis, prevention and treatment of diseases and clinical conditions associated with HOXD4. The function of HOXD4 and its association with various diseases and clinical conditions, has been established by previous studies, as described hereinabove with reference to VGAM330. Myelin Oligodendrocyte Glycoprotein (MOG, Accession NM_002433) is another VGAM356 host target gene. MOG BINDING SITE is HOST TARGET binding site found in the 3' untranslated region of mRNA encoded by MOG, corresponding to a HOST TARGET binding site such as BINDING SITE I, BINDING SITE II or BINDING SITE III. Table 2 illustrates the complementarity of the nucleotide sequences of MOG BINDING SITE, designated SEQ ID:8277, to the nucleotide sequence of VGAM356 RNA, herein designated VGAM RNA, also designated SEQ ID:3067.

Another function of VGAM356 is therefore inhibition of Myelin Oligodendrocyte Glycoprotein (MOG, Accession NM_002433). Accordingly, utilities of VGAM356 include diagnosis, prevention and treatment of diseases and clinical conditions associated with MOG. Sal-like 2 (Drosophila) (SALL2, Accession XM_033473) is another VGAM356 host target gene. SALL2 BINDING SITE is HOST TARGET binding site found in the 3' untranslated region of mRNA encoded by SALL2, corresponding to a HOST TARGET binding site such as BINDING SITE I, BINDING SITE II or BINDING SITE III. Table 2 illustrates the complementarity of the nucleotide sequences of SALL2 BINDING SITE, designated SEQ ID:31934, to the nucleotide sequence of VGAM356 RNA, herein designated VGAM RNA, also designated SEQ ID:3067.

Another function of VGAM356 is therefore inhibition of Sal-like 2 (Drosophila) (SALL2, Accession XM_033473). Accordingly, utilities of VGAM356 include diagnosis, prevention and treatment of diseases and clinical conditions associated with SALL2. Chromosome 20 Open Reading Frame 130 (C20orf130, Accession XM_029741) is another VGAM356 host target gene. C20orf130 BINDING SITE is HOST TARGET binding site found in the 3' untranslated region of mRNA encoded by C20orf130, corresponding to a HOST TARGET binding site such as BINDING SITE I, BINDING SITE II or BINDING SITE III. Table 2 illustrates the complementarity of the nucleotide sequences of C20orf130 BINDING SITE, designated SEQ ID:30933, to the nucleotide sequence of VGAM356 RNA, herein designated VGAM RNA, also designated SEQ ID:3067.

Another function of VGAM356 is therefore inhibition of Chromosome 20 Open Reading Frame 130 (C20orf130, Accession XM_029741). Accordingly, utilities of VGAM356 include diagnosis, prevention and treatment of diseases and clinical conditions associated with C20orf130. Chromosome 8 Open Reading Frame 17 (C8orf17, Accession NM_020237) is another VGAM356 host target gene. C8orf17 BINDING SITE is HOST TARGET binding site found in the 3' untranslated region of mRNA encoded by C8orf17, corresponding to a HOST TARGET binding site such as BINDING SITE I, BINDING SITE II or BINDING SITE III. Table 2 illustrates the complementarity of the nucleotide sequences of C8orf17 BINDING SITE, designated SEQ ID:21505, to the nucleotide sequence of VGAM356 RNA, herein designated VGAM RNA, also designated SEQ ID:3067.

Another function of VGAM356 is therefore inhibition of Chromosome 8 Open Reading Frame 17 (C8orf17, Accession NM_020237). Accordingly, utilities of VGAM356 include diagnosis, prevention and treatment of diseases and clinical conditions associated with C8orf17. Calcium/calmodulin-dependent Protein Kinase Kinase 2, Beta (CAMKK2, Accession NM_006549) is another VGAM356 host target gene. CAMKK2 BINDING SITE is HOST TARGET binding site found in the 5' untranslated region of mRNA encoded by CAMKK2, corresponding to a HOST TARGET binding site such as BINDING SITE I, BINDING SITE II or BINDING SITE III. Table 2 illustrates the complementarity of the nucleotide sequences of CAMKK2 BINDING SITE, designated SEQ ID:13308, to the nucleotide sequence of VGAM356 RNA, herein designated VGAM RNA, also designated SEQ ID:3067.

Another function of VGAM356 is therefore inhibition of Calcium/calmodulin-dependent Protein Kinase Kinase 2, Beta (CAMKK2, Accession NM_006549). Accordingly, utilities of VGAM356 include diagnosis, prevention and treatment of diseases and clinical conditions associated with CAMKK2. DIM1 (Accession NM_006701) is another VGAM356 host target gene. DIM1 BINDING SITE is HOST TARGET binding site found in the 3' untranslated region of mRNA encoded by DIM1, corresponding to a HOST TARGET binding site such as BINDING SITE I, BINDING SITE II or BINDING SITE III. Table 2 illustrates the complementarity of the nucleotide sequences of DIM1 BINDING SITE, designated SEQ ID:13524, to the nucleotide sequence of VGAM356 RNA, herein designated VGAM RNA, also designated SEQ ID:3067.

Another function of VGAM356 is therefore inhibition of DIM1 (Accession NM_006701). Accordingly, utilities of VGAM356 include diagnosis, prevention and treatment of diseases and clinical conditions associated with DIM1. Elongation of Very Long Chain Fatty Acids (FEN1/Elo2, SUR4/Elo3, yeast)-like 2 (ELOVL2, Accession NM_017770) is another VGAM356 host target gene. ELOVL2 BINDING SITE is HOST TARGET binding site found in the 3' untranslated region of mRNA encoded by ELOVL2, corresponding to a HOST TARGET binding site such as BINDING SITE I, BINDING SITE II or BINDING SITE III. Table 2 illustrates the complementarity of the nucleotide sequences of ELOVL2 BINDING SITE, designated SEQ ID:19386, to the nucleotide sequence of VGAM356 RNA, herein designated VGAM RNA, also designated SEQ ID:3067.

Another function of VGAM356 is therefore inhibition of Elongation of Very Long Chain Fatty Acids (FEN1/Elo2, SUR4/Elo3, yeast)-like 2 (ELOVL2, Accession NM_017770). Accordingly, utilities of VGAM356 include diagnosis, prevention and treatment of diseases and clinical conditions associated with ELOVL2. FLJ14440 (Accession NM_032784) is another VGAM356 host target gene. FLJ14440 BINDING SITE is HOST TARGET binding site found in the 3' untranslated region of mRNA encoded by FLJ14440, corresponding to a HOST TARGET binding site such as BINDING SITE I, BINDING SITE II or BINDING SITE III. Table 2 illustrates the complementarity of the nucleotide sequences of FLJ14440 BINDING SITE, designated SEQ ID:26530, to the nucleotide sequence of VGAM356 RNA, herein designated VGAM RNA, also designated SEQ ID:3067.

Another function of VGAM356 is therefore inhibition of FLJ14440 (Accession NM_032784). Accordingly, utilities of VGAM356 include diagnosis, prevention and treatment of diseases and clinical conditions associated with FLJ14440. FLJ21687 (Accession NM_024859) is another VGAM356 host target gene. FLJ21687 BINDING SITE is HOST TARGET binding site found in the 3' untranslated region of mRNA encoded by FLJ21687, corresponding to a HOST TARGET binding site such as BINDING SITE I, BINDING SITE II or BINDING SITE III. Table 2 illustrates the complementarity of the nucleotide sequences of FLJ21687 BINDING SITE, designated SEQ ID:24288, to the nucleotide sequence of VGAM356 RNA, herein designated VGAM RNA, also designated SEQ ID:3067.

Another function of VGAM356 is therefore inhibition of FLJ21687 (Accession NM_024859). Accordingly, utilities of VGAM356 include diagnosis, prevention and treatment of diseases and clinical conditions associated with FLJ21687. KIAA0798 (Accession NM_014650) is another VGAM356 host target gene. KIAA0798 BINDING SITE is HOST TARGET binding site found in the 3' untranslated region of mRNA encoded by KIAA0798, corresponding to a HOST TARGET binding site such as BINDING SITE I, BINDING SITE II or BINDING SITE III. Table 2 illustrates the complementarity of the nucleotide sequences of KIAA0798 BINDING SITE, designated SEQ ID:16065, to the nucleotide sequence of VGAM356 RNA, herein designated VGAM RNA, also designated SEQ ID:3067.

Another function of VGAM356 is therefore inhibition of KIAA0798 (Accession NM_014650). Accordingly, utilities of VGAM356 include diagnosis, prevention and treatment of diseases and clinical conditions associated with KIAA0798. KIAA1404 (Accession XM_030494) is another VGAM356 host target gene. KIAA1404 BINDING SITE is HOST TARGET binding site found in the 3' untranslated region of mRNA encoded by KIAA1404, corresponding to a HOST TARGET binding site such as BINDING SITE I, BINDING SITE II or BINDING SITE III. Table 2 illustrates the complementarity of the nucleotide sequences of KIAA1404 BIND- ING SITE, designated SEQ ID:31047, to the nucleotide sequence of VGAM356 RNA, herein designated VGAM RNA, also designated SEQ ID:3067.

Another function of VGAM356 is therefore inhibition of KIAA1404 (Accession XM_030494). Accordingly, utilities of VGAM356 include diagnosis, prevention and treatment of diseases and clinical conditions associated with KIAA1404. KIAA1456 (Accession XM_040100) is another VGAM356 host target gene. KIAA1456 BINDING SITE is HOST TARGET binding site found in the 3' untranslated region of mRNA encoded by KIAA1456, corresponding to a HOST TARGET binding site such as BINDING SITE I, BINDING SITE II or BINDING SITE III. Table 2 illustrates the complementarity of the nucleotide sequences of KIAA1456 BINDING SITE, designated SEQ ID:33261, to the nucleotide sequence of VGAM356 RNA, herein designated VGAM RNA, also designated SEQ ID:3067.

Another function of VGAM356 is therefore inhibition of KIAA1456 (Accession XM_040100). Accordingly, utilities of VGAM356 include diagnosis, prevention and treatment of diseases and clinical conditions associated with KIAA1456. KIAA1580 (Accession XM_045271) is another VGAM356 host target gene. KIAA1580 BINDING SITE is HOST TARGET binding site found in the 5' untranslated region of mRNA encoded by KIAA1580, corresponding to a HOST TARGET binding site such as BINDING SITE I, BINDING SITE II or BINDING SITE III. Table 2 illustrates the complementarity of the nucleotide sequences of KIAA1580 BINDING SITE, designated SEQ ID:34404, to the nucleotide sequence of VGAM356 RNA, herein designated VGAM RNA, also designated SEQ ID:3067.

Another function of VGAM356 is therefore inhibition of KIAA1580 (Accession XM_045271). Accordingly, utilities of VGAM356 include diagnosis, prevention and treatment of diseases and clinical conditions associated with KIAA1580. KIAA1950 (Accession XM_166532) is another VGAM356 host target gene. KIAA1950 BINDING SITE is HOST TARGET binding site found in the 3' untranslated region of mRNA encoded by KIAA1950, corresponding to a HOST TARGET binding site such as BINDING SITE I, BINDING SITE II or BINDING SITE III. Table 2 illustrates the complementarity of the nucleotide sequences of KIAA1950 BINDING SITE, designated SEQ ID:44482, to the nucleotide sequence of VGAM356 RNA, herein designated VGAM RNA, also designated SEQ ID:3067.

Another function of VGAM356 is therefore inhibition of KIAA1950 (Accession XM_166532). Accordingly, utilities of VGAM356 include diagnosis, prevention and treatment of diseases and clinical conditions associated with KIAA1950. MYLE (Accession NM_014015) is another VGAM356 host target gene. MYLE BINDING SITE is HOST TARGET binding site found in the 3" untranslated region of mRNA encoded by MYLE, corresponding to a HOST TARGET binding site such as BINDING SITE I, BINDING SITE II or BINDING SITE III. Table 2 illustrates the complementarity of the nucleotide sequences of MYLE BINDING SITE, designated SEQ ID:15233, to the nucleotide sequence of VGAM356 RNA, herein designated VGAM RNA, also designated SEQ ID:3067.

Another function of VGAM356 is therefore inhibition of MYLE (Accession NM_014015). Accordingly, utilities of VGAM356 include diagnosis, prevention and treatment of diseases and clinical conditions associated with MYLE. Peptidyl Arginine Deiminase, Type I (PADI1, Accession XM_030498) is another VGAM356 host target gene. PADI1 BINDING SITE is HOST TARGET binding site found in the 3' untranslated region of mRNA encoded by PADI1, corresponding to a HOST TARGET binding site such as BINDING SITE I, BINDING SITE II or BINDING SITE III. Table 2 illustrates the complementarity of the nucleotide sequences of PADI1 BINDING SITE, designated SEQ ID:31053, to the nucleotide sequence of VGAM356 RNA, herein designated VGAM RNA, also designated SEQ ID:3067.

Another function of VGAM356 is therefore inhibition of Peptidyl Arginine Deiminase, Type I (PADI1, Accession XM_030498). Accordingly, utilities of VGAM356 include diagnosis, prevention and treatment of diseases and clinical conditions associated with PADI1. Solute Carrier Family 17 (sodium-dependent inorganic phosphate cotransporter), Member 6 (SLC17A6, Accession NM_020346) is another VGAM356 host target gene. SLC17A6 BINDING SITE is HOST TARGET binding site found in the 3' untranslated region of mRNA encoded by SLC17A6, corresponding to a HOST TARGET binding site such as BINDING SITE I, BINDING SITE II or BINDING SITE III. Table 2 illustrates the complementarity of the nucleotide sequences of SLC17A6 BINDING SITE, designated SEQ ID:21594, to the nucleotide sequence of VGAM356 RNA, herein designated VGAM RNA, also designated SEQ ID:3067.

Another function of VGAM356 is therefore inhibition of Solute Carrier Family 17 (sodium-dependent inorganic phosphate cotransporter), Member 6 (SLC17A6, Accession NM_020346). Accordingly, utilities of VGAM356 include diagnosis, prevention and treatment of diseases and clinical conditions associated with SLC17A6. LOC116411 (Accession XM_058095) is another VGAM356 host target gene. LOC116411 BINDING SITE is HOST TARGET binding site found in the 5' untranslated region of mRNA encoded by LOC116411, corresponding to a HOST TARGET binding site such as BINDING SITE I, BINDING SITE II or BINDING SITE III. Table 2 illustrates the complementarity of the nucleotide sequences of LOC116411 BINDING SITE, designated SEQ ID:36564, to the nucleotide sequence of VGAM356 RNA, herein designated VGAM RNA, also designated SEQ ID:3067.

Another function of VGAM356 is therefore inhibition of LOC116411 (Accession XM_058095). Accordingly, utilities of VGAM356 include diagnosis, prevention and treatment of diseases and clinical conditions associated with LOC116411. LOC143308 (Accession XM_096411) is another VGAM356 host target gene. LOC143308 BINDING SITE is HOST TARGET binding site found in the 5' untranslated region of mRNA encoded by LOC143308, corresponding to a HOST TARGET binding site such as BINDING SITE I, BINDING SITE II or BINDING SITE III. Table 2 illustrates the complementarity of the nucleotide sequences of LOC143308 BINDING SITE, designated SEQ ID:40346, to the nucleotide sequence of VGAM356 RNA, herein designated VGAM RNA, also designated SEQ ID:3067.

Another function of VGAM356 is therefore inhibition of LOC143308 (Accession XM_096411). Accordingly, utilities of VGAM356 include diagnosis, prevention and treatment of diseases and clinical conditions associated with LOC143308. LOC145384 (Accession XM_085128) is another VGAM356 host target gene. LOC145384 BINDING SITE is HOST TARGET binding site found in the 3' untranslated region of mRNA encoded by LOC145384, corresponding to a HOST TARGET binding site such as BINDING SITE I, BINDING SITE II or BINDING SITE III. Table 2 illustrates the complementarity of the nucleotide sequences of LOC145384 BINDING SITE, designated SEQ ID:37860, to the nucleotide sequence of VGAM356 RNA, herein designated VGAM RNA, also designated SEQ ID:3067.

Another function of VGAM356 is therefore inhibition of LOC145384 (Accession XM_085128). Accordingly, utilities of VGAM356 include diagnosis, prevention and treatment of diseases and clinical conditions associated with LOC145384. LOC85479 (Accession NM_033105) is another VGAM356 host target gene. LOC85479 BINDING SITE is HOST TARGET binding site found in the 5' untranslated region of mRNA encoded by LOC85479, corresponding to a HOST TARGET binding site such as BINDING SITE I, BINDING SITE II or BINDING SITE III. Table 2 illustrates the complementarity of the nucleotide sequences of LOC85479 BINDING SITE, designated SEQ ID:26956, to the nucleotide sequence of VGAM356 RNA, herein designated VGAM RNA, also designated SEQ ID:3067.

Another function of VGAM356 is therefore inhibition of LOC85479 (Accession NM_033105). Accordingly, utilities of VGAM356 include diagnosis, prevention and treatment of diseases and clinical conditions associated with LOC85479. FIG. 1 further provides a conceptual description of a novel bioinformatically detected viral gene of the present invention, referred to here as Viral Genomic Address Messenger 357 (VGAM357) viral gene, which modulates expression of respective host target genes thereof, the function and utility of which host target genes is known in the art.

VGAM357 is a novel bioinformatically detected regulatory, non protein coding, viral micro RNA (miRNA) gene. The method by which VGAM357 was detected is described hereinabove with reference to FIGS. 1-8.

VGAM357 gene, herein designated VGAM GENE, is a viral gene contained in the genome of Avian Infectious Bronchitis Virus. VGAM357 host target gene, herein designated VGAM HOST TARGET GENE, is a human gene contained in the human genome.

VGAM357 gene encodes a VGAM357 precursor RNA, herein designated VGAM PRECURSOR RNA. Similar to other miRNA genes, and unlike most ordinary genes, VGAM357 precursor RNA does not encode a protein. A nucleotide sequence identical or highly similar to the nucleotide sequence of VGAM357 precursor RNA is designated SEQ ID:343, and is provided hereinbelow with reference to the sequence listing part. Nucleotide sequence SEQ ID:343 is located at position 1864 relative to the genome of Avian Infectious Bronchitis Virus.

VGAM357 precursor RNA folds onto itself, forming VGAM357 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM357 folded precursor RNA into VGAM357 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM357 RNA is designated SEQ ID:3068, and is provided hereinbelow with reference to the sequence listing part.

VGAM357 host target gene, herein designated VGAM HOST TARGET GENE, encodes a corresponding messenger RNA, VGAM357 host target RNA, herein designated VGAM HOST TARGET RNA. VGAM357 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM357 RNA, herein designated VGAM RNA, binds complementarily to one or more host target binding sites located in untranslated regions of VGAM357 host target RNA, herein designated VGAM HOST TARGET RNA. This complementary binding is due to the fact that the nucleotide sequence of VGAM357 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM357 RNA, herein designated VGAM RNA, may have a different number of host target binding sites in untranslated regions of a VGAM357 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM357 RNA, herein designated VGAM RNA, to host target binding sites on VGAM357 host target RNA, herein designated VGAM HOST TARGET RNA, such as BINDING SITE I, BINDING SITE II and BINDING SITE III, inhibits translation of VGAM357 host target RNA into VGAM357 host target protein, herein designated VGAM HOST TARGET PROTEIN. VGAM host target protein is therefore outlined by a broken line.

It is appreciated that VGAM357 host target gene, herein designated VGAM HOST TARGET GENE, in fact represents a plurality of VGAM357 host target genes. The mRNA of each one of this plurality of VGAM357 host target genes comprises one or more host target binding sites, each having a nucleotide sequence which is at least partly complementary to VGAM357 RNA, herein designated VGAM RNA, and which when bound by VGAM357 RNA causes inhibition of translation of respective one or more VGAM357 host target proteins.

It is further appreciated by one skilled in the art that the mode of translational inhibition illustrated by FIG. 1 with specific reference to translational inhibition exerted by VGAM357 gene, herein designated VGAM GENE, on one or more VGAM357 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM357 is inhibition of expression of host target genes, as part of a novel viral mechanism of attacking a host. Accordingly, utilities of VGAM357 include diagnosis, prevention and treatment of viral infection by Avian Infectious Bronchitis Virus. Specific functions, and accordingly utilities, of VGAM357 correlate with, and may be deduced from, the identity of the host target genes which VGAM357 binds and inhibits, and the function of these host target genes, as elaborated hereinbelow.

Nucleotide sequences of the VGAM357 precursor RNA, herein designated VGAM PRECURSOR RNA, and of the 'diced' VGAM357 RNA, herein designated VGAM RNA, and a schematic representation of the secondary folding of VGAM357 folded precursor RNA, herein designated VGAM FOLDED PRECURSOR RNA, of VGAM357 are further described hereinbelow with reference to Table 1.

Nucleotide sequences of host target binding sites, such as BINDING SITE-I, BINDING SITE-II and BINDING SITE-III of FIG. 1, found on VGAM357 host target RNA, and schematic representation of the complementarity of each of these host target binding sites to VGAM357 RNA, herein designated VGAM RNA, are described hereinbelow with reference to Table 2.

As mentioned hereinabove with reference to FIG. 1, a function of VGAM357 gene, herein designated VGAM is inhibition of expression of VGAM357 target genes. It is appreciated that specific functions, and accordingly utilities, of VGAM357 correlate with, and may be deduced from, the identity of the target genes which VGAM357 binds and inhibits, and the function of these target genes, as elaborated hereinbelow.

AAT1 (Accession XM_087415) is a VGAM357 host target gene. AAT1 BINDING SITE is HOST TARGET binding site found in the 3' untranslated region of mRNA encoded by AAT1, corresponding to a HOST TARGET binding site such as BINDING SITE I, BINDING SITE II or BINDING SITE III. Table 2 illustrates the complementarity of the nucleotide sequences of AAT1 BINDING SITE, designated SEQ ID:39226, to the nucleotide sequence of VGAM357 RNA, herein designated VGAM RNA, also designated SEQ ID:3068.

A function of VGAM357 is therefore inhibition of AAT1 (Accession XM_087415), a gene which linkage between A1BG and Lutheran blood group . Accordingly, utilities of VGAM357 include diagnosis, prevention and treatment of diseases and clinical conditions associated with AAT1. The function of AAT1 has been established by previous studies. The complete amino acid sequence of alpha-1B-glycoprotein, a plasma protein of unknown function, was determined by Ishioka et al. (1986). Sequence homology to immunoglobulins was recognized. Alpha-1B-glycoprotein is present in normal adult plasma at an average concentration of 22 mg/dl. Gahne et al. (1987) observed genetic polymorphism of A1B using one-dimensional horizontal polyacrylamide gel electrophoresis followed by Western blotting with specific antiserum. Three different phenotypes, designated 1-1, 1-2, and 2-2, were observed. Family data supported the hypothesis that the three phenotypes are determined by 2 codominant alleles at an autosomal locus. In pigs the homologous locus is linked to malignant hyperthermia (OMIM Ref. No. 145600). Several other linkages in pigs and in horses suggest that human chromosomes 19, 6, and 1 are 'candidate chromosomes' for bearing the human A1B. Juneja et al. (1988) found a higher degree of A1B polymorphism in American blacks than in Caucasian populations. They described new alleles. Eiberg et al. (1989) reported exclusion data for localization of the alpha-1B-glycoprotein gene polymorphism. Eiberg et al. (1989) found linkage between A1BG and Lutheran blood group (OMIM Ref. No. 111150); lod=3.06 at theta=0.05 in males, and lod=1.42 at theta=0.10 in females. They suggested that the most likely order of genes on chromosome 19 is C3--SE--LU--A1BG.

Full details of the abovementioned studies are described in the following publications, the disclosure of which are hereby incorporated by reference:

Ishioka, N.; Takahashi, N.; Putnam, F. W.: Amino acid sequence of human plasma alpha-1B-glycoprotein: homology to the immunoglobulin supergene family. Proc. Nat. Acad. Sci. 83:2363-2367, 1986; and Eiberg, H.; Bisgaard, M. L.; Mohr, J.: Linkage between alpha-1-B-glycoprotein (A1BG) and Lutheran (LU) red blood group system: assignment to chromosome 19: new genetic variants of A1BG.

Further studies establishing the function and utilities of AAT1 are found in John Hopkins OMIM database record ID 607086, and in sited publications numbered 5560-5561 listed in the bibliography section hereinbelow, which are also hereby incorporated by reference. Fatty-acid-Coenzyme A Ligase, Long-chain 5 (FACL5, Accession XM_034424) is another VGAM357 host target gene. FACL5 BINDING SITE is HOST TARGET binding site found in the 3' untranslated region of mRNA encoded by FACL5, corresponding to a HOST TARGET binding site such as BINDING SITE I, BINDING SITE II or BINDING SITE III. Table 2 illustrates the complementarity of the nucleotide sequences of FACL5 BINDING SITE, designated SEQ ID:32106, to the nucleotide sequence of VGAM357 RNA, herein designated VGAM RNA, also designated SEQ ID:3068.

Another function of VGAM357 is therefore inhibition of Fatty-acid-Coenzyme A Ligase, Long-chain 5 (FACL5, Accession XM_034424), a gene which may be involved in fatty acid metabolism; contains an AMP-binding domain. Accordingly, utilities of VGAM357 include diagnosis, prevention and treatment of diseases and clinical conditions associated with FACL5. The function of FACL5 has been established by previous studies. Acyl-CoA synthetase (ACS; EC 6.2.1.3) catalyzes the formation of acyl-CoA from fatty acid, ATP, and CoA. This reaction is essential in mammalian fatty acid metabolism. In addition, ACS mediates the transportation of fatty acids into cells by cooperating with the fatty acid transporter protein (FATP; 600691). Oikawa et al. (1998) cloned rat Acs5 and found that it is highly expressed in proliferating 3T3-L1 cells. By screening a liver cDNA library with rat ACS5 as the probe, Yamashita et al. (2000) isolated a cDNA encoding human ACS5. The deduced 683-amino acid protein shares approximately 80% amino acid identity with the rat sequence. Northern blot analysis detected 2 major ACS5 transcripts of 2.5 and 3.7 kb in a wide range of tissues, with highest expression in uterus and spleen. Markedly increased levels of ACS5 transcripts were detected in a glioma line and in primary gliomas of grade IV malignancy, while ACS5 expression was found to be low in normal brain. Yamashita et al. (2000) found that cultured glioma cells infected with an adenovirus encoding ACS5 displayed induced cell growth on exposure to palmitate. Consistent with the induction of cell growth, the virus-infected cells displayed induced uptake of palmitate. These results demonstrated a novel fatty acid-induced glioma cell growth mediated by ACS5.

Full details of the abovementioned studies are described in the following publications, the disclosure of which are hereby incorporated by reference:

Oikawa, E.; Iijima, H.; Suzuki, T.; Sasano, H.; Sato, H.; Kamataki, A.; Nagura, H.; Kang, M. J.; Fujino, T.; Suzuki, H.; Yamamoto, T. T.: A novel acyl-CoA synthetase, ACS5, expressed in intestinal epithelial cells and proliferating preadipocytes. J. Biochem. 124:679-685, 1998; and Yamashita, Y.; Kumabe, T.; Cho, Y.-Y.; Watanabe, M.; Kawagishi, J.; Yoshimoto, T.; Fujino, T.; Kang, M.-J.; Yamamoto, T. T.: Fatty acid induced glioma cell growth is mediated by the a.

Further studies establishing the function and utilities of FACL5 are found in John Hopkins OMIM database record ID 605677, and in sited publications numbered 968-969 listed in the bibliography section hereinbelow, which are also hereby incorporated by reference. Protein Tyrosine Phosphatase, Receptor Type, C (PTPRC, Accession NM_080921) is another VGAM357 host target gene. PTPRC BINDING SITE1 and PTPRC BINDING SITE2 are HOST TARGET binding sites found in untranslated regions of mRNA encoded by PTPRC, corresponding to HOST TARGET binding sites such as BINDING SITE I, BINDING SITE II or BINDING SITE III. Table 2 illustrates the complementarity of the nucleotide sequences of PTPRC BINDING SITE1 and PTPRC BINDING SITE2, designated SEQ ID:28143 and SEQ ID:8717 respectively, to the nucleotide sequence of VGAM357 RNA, herein designated VGAM RNA, also designated SEQ ID:3068.

Another function of VGAM357 is therefore inhibition of Protein Tyrosine Phosphatase, Receptor Type, C (PTPRC, Accession NM_080921). Accordingly, utilities of VGAM357 include diagnosis, prevention and treatment of diseases and clinical conditions associated with PTPRC. Basic Leucine Zipper and W2 Domains 1 (BZW1, Accession NM_014670) is another VGAM357 host target gene. BZW1 BINDING SITE is HOST TARGET binding site found in the 3' untranslated region of mRNA encoded by BZW1, corresponding to a HOST TARGET binding site such as BINDING SITE I, BINDING SITE II or BINDING SITE III. Table 2 illustrates the complementarity of the nucleotide sequences of BZW1 BINDING SITE, designated SEQ ID:16127, to the nucleotide sequence of VGAM357 RNA, herein designated VGAM RNA, also designated SEQ ID:3068.

Another function of VGAM357 is therefore inhibition of Basic Leucine Zipper and W2 Domains 1 (BZW1, Accession NM_014670). Accordingly, utilities of VGAM357 include diagnosis, prevention and treatment of diseases and clinical conditions associated with BZW1. Ectonucleotide Pyrophosphatase/phosphodiesterase 4 (putative function) (ENPP4, Accession NM_014936) is another VGAM357 host target gene. ENPP4 BINDING SITE is HOST TARGET binding site found in the 3' untranslated region of mRNA encoded by ENPP4, corresponding to a HOST TARGET binding site such as BINDING SITE I, BINDING SITE II or BINDING SITE III. Table 2 illustrates the complementarity of the nucleotide sequences of ENPP4 BINDING SITE, designated SEQ ID:17238, to the nucleotide sequence of VGAM357 RNA, herein designated VGAM RNA, also designated SEQ ID:3068.

Another function of VGAM357 is therefore inhibition of Ectonucleotide Pyrophosphatase/phosphodiesterase 4 (putative function) (ENPP4, Accession NM_014936). Accordingly, utilities of VGAM357 include diagnosis, prevention and treatment of diseases and clinical conditions associated with ENPP4. FLJ23056 (Accession NM_024582) is another VGAM357 host target gene. FLJ23056 BINDING SITE is HOST TARGET binding site found in the 3' untranslated region of mRNA encoded by FLJ23056, corresponding to a HOST TARGET binding site such as BINDING SITE I, BINDING SITE II or BINDING SITE III. Table 2 illustrates the complementarity of the nucleotide sequences of FLJ23056 BINDING SITE, designated SEQ ID:23806, to the nucleotide sequence of VGAM357 RNA, herein designated VGAM RNA, also designated SEQ ID:3068.

Another function of VGAM357 is therefore inhibition of FLJ23056 (Accession NM_024582). Accordingly, utilities of VGAM357 include diagnosis, prevention and treatment of diseases and clinical conditions associated with FLJ23056. NUCKS (Accession NM_022731) is another VGAM357 host target gene. NUCKS BINDING SITE is HOST TARGET binding site found in the 3" untranslated region of mRNA encoded by NUCKS, corresponding to a HOST TARGET binding site such as BINDING SITE I, BINDING SITE II or BINDING SITE III. Table 2 illustrates the complementarity of the nucleotide sequences of NUCKS BINDING SITE, designated SEQ ID:22935, to the nucleotide sequence of VGAM357 RNA, herein designated VGAM RNA, also designated SEQ ID:3068.

Another function of VGAM357 is therefore inhibition of NUCKS (Accession NM_022731). Accordingly, utilities of VGAM357 include diagnosis, prevention and treatment of diseases and clinical conditions associated with NUCKS. TSP-NY (Accession NM_032573) is another VGAM357 host target gene. TSP-NY BINDING SITE is HOST TARGET binding site found in the 3' untranslated region of mRNA encoded by TSP-NY, corresponding to a HOST TARGET binding site such as BINDING SITE I, BINDING SITE II or BINDING SITE III. Table 2 illustrates the complementarity of the nucleotide sequences of TSP-NY BINDING SITE, designated SEQ ID:26302, to the nucleotide sequence of VGAM357 RNA, herein designated VGAM RNA, also designated SEQ ID:3068.

Another function of VGAM357 is therefore inhibition of TSP-NY (Accession NM_032573). Accordingly, utilities of VGAM357 include diagnosis, prevention and treatment of diseases and clinical conditions associated with TSP-NY. LOC151098 (Accession XM_087096) is another VGAM357 host target gene. LOC151098 BINDING SITE is HOST TARGET binding site found in the 5' untranslated region of mRNA encoded by LOC151098, corresponding to a HOST TARGET binding site such as BINDING SITE I, BINDING SITE II or BINDING SITE III. Table 2 illustrates the complementarity of the nucleotide sequences of LOC151098 BINDING SITE, designated SEQ ID:39048, to the nucleotide sequence of VGAM357 RNA, herein designated VGAM RNA, also designated SEQ ID:3068.

Another function of VGAM357 is therefore inhibition of LOC151098 (Accession XM_087096). Accordingly, utilities of VGAM357 include diagnosis, prevention and treatment of diseases and clinical conditions associated with LOC151098. LOC151579 (Accession XM_045290) is another VGAM357 host target gene. LOC151579 BINDING SITE is HOST TARGET binding site found in the 3' untranslated region of mRNA encoded by LOC151579, corresponding to a HOST TARGET binding site such as BINDING SITE I, BINDING SITE II or BINDING SITE III. Table 2 illustrates the complementarity of the nucleotide sequences of LOC151579 BINDING SITE, designated SEQ ID:34421, to the nucleotide sequence of VGAM357 RNA, herein designated VGAM RNA, also designated SEQ ID:3068.

Another function of VGAM357 is therefore inhibition of LOC151579 (Accession XM_045290). Accordingly, utilities of VGAM357 include diagnosis, prevention and treatment of diseases and clinical conditions associated with LOC151579. LOC158476 (Accession XM_098955) is another VGAM357 host target gene. LOC158476 BINDING SITE is HOST TARGET binding site found in the 3' untranslated region of mRNA encoded by LOC158476, corresponding to a HOST TARGET binding site such as BINDING SITE I, BINDING SITE II or BINDING SITE III. Table 2 illustrates the complementarity of the nucleotide sequences of LOC158476 BINDING SITE, designated SEQ ID:41995, to the nucleotide sequence of VGAM357 RNA, herein designated VGAM RNA, also designated SEQ ID:3068.

Another function of VGAM357 is therefore inhibition of LOC158476 (Accession XM_098955). Accordingly, utilities of VGAM357 include diagnosis, prevention and treatment of diseases and clinical conditions associated with LOC158476. LOC200982 (Accession XM_117305) is another VGAM357 host target gene. LOC200982 BINDING SITE is HOST TARGET binding site found in the 3' untranslated region of mRNA encoded by LOC200982, corresponding to a HOST TARGET binding site such as BINDING SITE I, BINDING SITE II or BINDING SITE III. Table 2 illustrates the complementarity of the nucleotide sequences of LOC200982 BINDING SITE, designated SEQ ID:43370, to the nucleotide sequence of VGAM357 RNA, herein designated VGAM RNA, also designated SEQ ID:3068.

Another function of VGAM357 is therefore inhibition of LOC200982 (Accession XM_117305). Accordingly, utilities of VGAM357 include diagnosis, prevention and treatment of diseases and clinical conditions associated with LOC200982. LOC201516 (Accession XM_113974) is another VGAM357 host target gene. LOC201516 BINDING SITE is HOST TARGET binding site found in the 5' untranslated region of mRNA encoded by LOC201516, corresponding to a HOST TARGET binding site such as BINDING SITE I, BINDING SITE II or BINDING SITE III. Table 2 illustrates the complementarity of the nucleotide sequences of LOC201516 BINDING SITE, designated SEQ ID:42581, to the nucleotide sequence of VGAM357 RNA, herein designated VGAM RNA, also designated SEQ ID:3068.

Another function of VGAM357 is therefore inhibition of LOC201516 (Accession XM_113974). Accordingly, utilities of VGAM357 include diagnosis, prevention and treatment of diseases and clinical conditions associated with LOC201516. LOC90593 (Accession XM_032815) is another VGAM357 host target gene. LOC90593 BINDING SITE is HOST TARGET binding site found in the 3' untranslated region of mRNA encoded by LOC90593, corresponding to a HOST TARGET binding site such as BINDING SITE I, BINDING SITE II or BINDING SITE III. Table 2 illustrates the complementarity of the nucleotide sequences of LOC90593 BINDING SITE, designated SEQ ID:31762, to the nucleotide sequence of VGAM357 RNA, herein designated VGAM RNA, also designated SEQ ID:3068.

Another function of VGAM357 is therefore inhibition of LOC90593 (Accession XM_032815). Accordingly, utilities of VGAM357 include diagnosis, prevention and treatment of diseases and clinical conditions associated with LOC90593. FIG. 1 further provides a conceptual description of a novel bioinformatically detected viral gene of the present invention, referred to here as Viral Genomic Address Messenger 358 (VGAM358) viral gene, which modulates expression of respective host target genes thereof, the function and utility of which host target genes is known in the art.

VGAM358 is a novel bioinformatically detected regulatory, non protein coding, viral micro RNA (miRNA) gene. The method by which VGAM358 was detected is described hereinabove with reference to FIGS. 1-8.

VGAM358 gene, herein designated VGAM GENE, is a viral gene contained in the genome of Avian Infectious Bronchitis Virus. VGAM358 host target gene, herein designated VGAM HOST TARGET GENE, is a human gene contained in the human genome.

VGAM358 gene encodes a VGAM358 precursor RNA, herein designated VGAM PRECURSOR RNA. Similar to other miRNA genes, and unlike most ordinary genes, VGAM358 precursor RNA does not encode a protein. A nucleotide sequence identical or highly similar to the nucleotide sequence of VGAM358 precursor RNA is designated SEQ ID:344, and is provided hereinbelow with reference to the sequence listing part. Nucleotide sequence SEQ ID:344 is located at position 10172 relative to the genome of Avian Infectious Bronchitis Virus.

VGAM358 precursor RNA folds onto itself, forming VGAM358 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM358 folded precursor RNA into VGAM358 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM358 RNA is designated SEQ ID:3069, and is provided hereinbelow with reference to the sequence listing part.

VGAM358 host target gene, herein designated VGAM HOST TARGET GENE, encodes a corresponding messenger RNA, VGAM358 host target RNA, herein designated VGAM HOST TARGET RNA. VGAM358 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM358 RNA, herein designated VGAM RNA, binds complementarily to one or more host target binding sites located in untranslated regions of VGAM358 host target RNA, herein designated VGAM HOST TARGET RNA. This complementary binding is due to the fact that the nucleotide sequence of VGAM358 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM358 RNA, herein designated VGAM RNA, may have a different number of host target binding sites in untranslated regions of a VGAM358 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM358 RNA, herein designated VGAM RNA, to host target binding sites on VGAM358 host target RNA, herein designated VGAM HOST TARGET RNA, such as BINDING SITE I, BINDING SITE II and BINDING SITE III, inhibits translation of VGAM358 host target RNA into VGAM358 host target protein, herein designated VGAM HOST TARGET PROTEIN. VGAM host target protein is therefore outlined by a broken line.

It is appreciated that VGAM358 host target gene, herein designated VGAM HOST TARGET GENE, in fact represents a plurality of VGAM358 host target genes. The mRNA of each one of this plurality of VGAM358 host target genes comprises one or more host target binding sites, each having a nucleotide sequence which is at least partly complementary to VGAM358 RNA, herein designated VGAM RNA, and which when bound by VGAM358 RNA causes inhibition of translation of respective one or more VGAM358 host target proteins.

It is further appreciated by one skilled in the art that the mode of translational inhibition illustrated by FIG. 1 with specific reference to translational inhibition exerted by VGAM358 gene, herein designated VGAM GENE, on one or more VGAM358 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM358 is inhibition of expression of host target genes, as part of a novel viral mechanism of attacking a host. Accordingly, utilities of VGAM358 include diagnosis, prevention and treatment of viral infection by Avian Infectious Bronchitis Virus. Specific functions, and accordingly utilities, of VGAM358 correlate with, and may be deduced from, the identity of the host target genes which VGAM358 binds and inhibits, and the function of these host target genes, as elaborated hereinbelow.

Nucleotide sequences of the VGAM358 precursor RNA, herein designated VGAM PRECURSOR RNA, and of the 'diced' VGAM358 RNA, herein designated VGAM RNA, and a schematic representation of the secondary folding of VGAM358 folded precursor RNA, herein designated VGAM FOLDED PRECURSOR RNA, of VGAM358 are further described hereinbelow with reference to Table 1.

Nucleotide sequences of host target binding sites, such as BINDING SITE-I, BINDING SITE-II and BINDING SITE-III of FIG. 1, found on VGAM358 host target RNA, and schematic representation of the complementarity of each of these host target binding sites to VGAM358 RNA, herein designated VGAM RNA, are described hereinbelow with reference to Table 2.

As mentioned hereinabove with reference to FIG. 1, a function of VGAM358 gene, herein designated VGAM is inhibition of expression of VGAM358 target genes. It is appreciated that specific functions, and accordingly utilities, of VGAM358 correlate with, and may be deduced from, the identity of the target genes which VGAM358 binds and inhibits, and the function of these target genes, as elaborated hereinbelow.

DKFZp547C176 (Accession XM_040799) is a VGAM358 host target gene. DKFZp547C176 BINDING SITE is HOST TARGET binding site found in the 3' untranslated region of mRNA encoded by DKFZp547C176, corresponding to a HOST TARGET binding site such as BINDING SITE I, BINDING SITE II or BINDING SITE III. Table 2 illustrates the complementarity of the nucleotide sequences of DKFZp547C176 BINDING SITE, designated SEQ ID:33382, to the nucleotide sequence of VGAM358 RNA, herein designated VGAM RNA, also designated SEQ ID:3069.

A function of VGAM358 is therefore inhibition of DKFZp547C176 (Accession XM_040799). Accordingly, utilities of VGAM358 include diagnosis, prevention and treatment of diseases and clinical conditions associated with DKFZp547C176. FLJ12806 (Accession NM_022831) is another VGAM358 host target gene. FLJ12806 BINDING SITE is HOST TARGET binding site found in the 3' untranslated region of mRNA encoded by FLJ12806, corresponding to a HOST TARGET binding site such as BINDING SITE I, BINDING SITE II or BINDING SITE III. Table 2 illustrates the complementarity of the nucleotide sequences of FLJ12806 BINDING SITE, designated SEQ ID:23111, to the nucleotide sequence of VGAM358 RNA, herein designated VGAM RNA, also designated SEQ ID:3069.

Another function of VGAM358 is therefore inhibition of FLJ12806 (Accession NM_022831). Accordingly, utilities of VGAM358 include diagnosis, prevention and treatment of diseases and clinical conditions associated with FLJ12806. LOC222160 (Accession XM_168431) is another VGAM358 host target gene. LOC222160 BINDING SITE is HOST TARGET binding site found in the 5' untranslated region of mRNA encoded by LOC222160, corresponding to a HOST TARGET binding site such as BINDING SITE I, BINDING SITE II or BINDING SITE III. Table 2 illustrates the complementarity of the nucleotide sequences of LOC222160 BINDING SITE, designated SEQ ID:45166, to the nucleotide sequence of VGAM358 RNA, herein designated VGAM RNA, also designated SEQ ID:3069.

Another function of VGAM358 is therefore inhibition of LOC222160 (Accession XM_168431). Accordingly, utilities of VGAM358 include diagnosis, prevention and treatment of diseases and clinical conditions associated with LOC222160. LOC51696 (Accession NM_016217) is another VGAM358 host target gene. LOC51696 BINDING SITE is HOST TARGET binding site found in the 3' untranslated region of mRNA encoded by LOC51696, corresponding to a HOST TARGET binding site such as BINDING SITE I, BINDING SITE II or BINDING SITE III. Table 2 illustrates the complementarity of the nucleotide sequences of LOC51696 BINDING SITE, designated SEQ ID:18304, to the nucleotide sequence of VGAM358 RNA, herein designated VGAM RNA, also designated SEQ ID:3069.

Another function of VGAM358 is therefore inhibition of LOC51696 (Accession NM_016217). Accordingly, utilities of VGAM358 include diagnosis, prevention and treatment of diseases and clinical conditions associated with LOC51696.

FIG. 1 further provides a conceptual description of a novel bioinformatically detected viral gene of the present invention, referred to here as Viral Genomic Address Messenger 359 (VGAM359) viral gene, which modulates expression of respective host target genes thereof, the function and utility of which host target genes is known in the art.

VGAM359 is a novel bioinformatically detected regulatory, non protein coding, viral micro RNA (miRNA) gene. The method by which VGAM359 was detected is described hereinabove with reference to FIGS. 1-8.

VGAM359 gene, herein designated VGAM GENE, is a viral gene contained in the genome of Avian Infectious Bronchitis Virus. VGAM359 host target gene, herein designated VGAM HOST TARGET GENE, is a human gene contained in the human genome.

VGAM359 gene encodes a VGAM359 precursor RNA, herein designated VGAM PRECURSOR RNA. Similar to other miRNA genes, and unlike most ordinary genes, VGAM359 precursor RNA does not encode a protein. A nucleotide sequence identical or highly similar to the nucleotide sequence of VGAM359 precursor RNA is designated SEQ ID:345, and is provided hereinbelow with reference to the sequence listing part. Nucleotide sequence SEQ ID:345 is located at position 9184 relative to the genome of Avian Infectious Bronchitis Virus.

VGAM359 precursor RNA folds onto itself, forming VGAM359 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM359 folded precursor RNA into VGAM359 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM359 RNA is designated SEQ ID:3070, and is provided hereinbelow with reference to the sequence listing part.

VGAM359 host target gene, herein designated VGAM HOST TARGET GENE, encodes a corresponding messenger RNA, VGAM359 host target RNA, herein designated VGAM HOST TARGET RNA. VGAM359 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM359 RNA, herein designated VGAM RNA, binds complementarily to one or more host target binding sites located in untranslated regions of VGAM359 host target RNA, herein designated VGAM HOST TARGET RNA. This complementary binding is due to the fact that the nucleotide sequence of VGAM359 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM359 RNA, herein designated VGAM RNA, may have a different number of host target binding sites in untranslated regions of a VGAM359 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM359 RNA, herein designated VGAM RNA, to host target binding sites on VGAM359 host target RNA, herein designated VGAM HOST TARGET RNA, such as BINDING SITE I, BINDING SITE II and BINDING SITE III, inhibits translation of VGAM359 host target RNA into VGAM359 host target protein, herein designated VGAM HOST TARGET PROTEIN. VGAM host target protein is therefore outlined by a broken line.

It is appreciated that VGAM359 host target gene, herein designated VGAM HOST TARGET GENE, in fact represents a plurality of VGAM359 host target genes. The mRNA of each one of this plurality of VGAM359 host target genes comprises one or more host target binding sites, each having a nucleotide sequence which is at least partly complementary to VGAM359 RNA, herein designated VGAM RNA, and which when bound by VGAM359 RNA causes inhibition of translation of respective one or more VGAM359 host target proteins.

It is further appreciated by one skilled in the art that the mode of translational inhibition illustrated by FIG. 1 with specific reference to translational inhibition exerted by VGAM359 gene, herein designated VGAM GENE, on one or more VGAM359 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM359 is inhibition of expression of host target genes, as part of a novel viral mechanism of attacking a host. Accordingly, utilities of VGAM359 include diagnosis, prevention and treatment of viral infection by Avian Infectious Bronchitis Virus. Specific functions, and accordingly utilities, of VGAM359 correlate with, and may be deduced from, the identity of the host target genes which VGAM359 binds and inhibits, and the function of these host target genes, as elaborated hereinbelow.

Nucleotide sequences of the VGAM359 precursor RNA, herein designated VGAM PRECURSOR RNA, and of the 'diced' VGAM359 RNA, herein designated VGAM RNA, and a schematic representation of the secondary folding of VGAM359 folded precursor RNA, herein designated VGAM FOLDED PRECURSOR RNA, of VGAM359 are further described hereinbelow with reference to Table 1.

Nucleotide sequences of host target binding sites, such as BINDING SITE-I, BINDING SITE-II and BINDING SITE-III of FIG. 1, found on VGAM359 host target RNA, and schematic representation of the complementarity of each of these host target binding sites to VGAM359 RNA, herein designated VGAM RNA, are described hereinbelow with reference to Table 2.

As mentioned hereinabove with reference to FIG. 1, a function of VGAM359 gene, herein designated VGAM is inhibition of expression of VGAM359 target genes. It is appreciated that specific functions, and accordingly utilities, of VGAM359 correlate with, and may be deduced from, the identity of the target genes which VGAM359 binds and inhibits, and the function of these target genes, as elaborated hereinbelow.

Estrogen-related Receptor Gamma (ESRRG, Accession XM_039053) is a VGAM359 host target gene. ESRRG BINDING SITE is HOST TARGET binding site found in the 3' untranslated region of mRNA encoded by ESRRG, corresponding to a HOST TARGET binding site such as BINDING SITE I, BINDING SITE II or BINDING SITE III. Table 2 illustrates the complementarity of the nucleotide sequences of ESRRG BINDING SITE, designated SEQ ID:32994, to the nucleotide sequence of VGAM359 RNA, herein designated VGAM RNA, also designated SEQ ID:3070.

A function of VGAM359 is therefore inhibition of Estrogen-related Receptor Gamma (ESRRG, Accession XM_039053), a gene which Estrogen-related receptor gamma. Accordingly, utilities of VGAM359 include diagnosis, prevention and treatment of diseases and clinical conditions associated with ESRRG. The function of ESRRG has been established by previous studies. Members of the nuclear receptor superfamily are important regulators of development, cell proliferation, and physiology. During an analysis of the critical region of type IIa Usher syndrome (USH2A; 276901) at 1q41, Eudy et al. (1998) constructed a cDNA contig of ESRRG. Northern blot analysis detected a 5.5-kb ESRRG transcript in a variety of human adult and fetal tissues, with the highest level in fetal brain. The predicted 436-amino acid ESRRG protein, which is a member of the steroid/thyroid/retinoid receptor superfamily, is 76% identical to the orphan receptor ESRRB (OMIM Ref. No. 602167) and 63% identical to ESRRA (OMIM Ref. No. 601998). Heard et al. (2000) reported that the ESRRG mRNA is highly alternatively spliced at the 5-prime end, giving rise to a number of tissue-specific RNA species, some of which encode protein isoforms differing in the N-terminal region. Like ESRRA and ESRRB, ESRRG binds as a monomer to an ERR-alpha response element (ERRE). Hong et al. (1999) identified mouse Esrrg, which they called Err3, by yeast 2-hybrid screening using the transcriptional coactivator GRIP1 (OMIM Ref. No. 604597) as bait. The putative full-length mouse Err3 contains 458 amino acids and is closely related to Err1 and Err2. All ERR family members share an almost identical DNA-binding domain, which shares 68% amino acid identity with that of estrogen receptor. Expression of Err3 in adult mouse was restricted; highest expression was observed in heart, kidney, and brain. In mouse embryo, no expression was observed at day 7, and highest expression occurred around days 11 to 15. Although Err3 is more closely related to Err2 than to Err1, the expression pattern for Err3 was similar to that of Err1 and distinct from that for Err2, suggesting a unique role for Err3 in development. Eudy et al. (1998) mapped the ESRRG gene to the USH2A critical region on chromosome 1q41.

Full details of the abovementioned studies are described in the following publications, the disclosure of which are hereby incorporated by reference:

Heard, D. J.; Norby, P. L.; Holloway, J.; Vissing, H.: Human ERR-gamma, a third member of the estrogen receptor-related receptor (ERR) subfamily of orphan nuclear receptors: tissue-specific isoforms are expressed during development in the adult. Molec. Endocr. 14:382-392, 2000; and Eudy, J. D.; Yao, S.; Weston, M. D.; Ma-Edmonds, M.; Talmadge, C. B.; Cheng, J. J.; Kimberling, W. J.; Sumegi, J.: Isolation of a gene encoding a novel member of the nuclear receptor s.

Further studies establishing the function and utilities of ESRRG are found in John Hopkins OMIM database record ID 602969, and in sited publications numbered 8478-847 and 8539-8540 listed in the bibliography section hereinbelow, which are also hereby incorporated by reference. C1q and Tumor Necrosis Factor Related Protein 2 (C1QTNF2, Accession NM_031908) is another VGAM359 host target gene. C1QTNF2 BINDING SITE is HOST TARGET binding site found in the 3' untranslated region of mRNA encoded by C1QTNF2, corresponding to a HOST TARGET binding site such as BINDING SITE I, BINDING SITE II or BINDING SITE III. Table 2 illustrates the complementarity of the nucleotide sequences of C1QTNF2 BINDING SITE, designated SEQ ID:25650, to the nucleotide sequence of VGAM359 RNA, herein designated VGAM RNA, also designated SEQ ID:3070.

Another function of VGAM359 is therefore inhibition of C1q and Tumor Necrosis Factor Related Protein 2 (C1QTNF2, Accession NM_031908). Accordingly, utilities of VGAM359 include diagnosis, prevention and treatment of diseases and clinical conditions associated with C1QTNF2. FLJ32865 (Accession NM_144613) is another VGAM359 host target gene. FLJ32865 BINDING SITE is HOST TARGET binding site found in the 3' untranslated region of mRNA encoded by FLJ32865, corresponding to a HOST TARGET binding site such as BINDING SITE I, BINDING SITE II or BINDING SITE III. Table 2 illustrates the complementarity of the nucleotide sequences of FLJ32865 BINDING SITE, designated SEQ ID:29423, to the nucleotide sequence of VGAM359 RNA, herein designated VGAM RNA, also designated SEQ ID:3070.

Another function of VGAM359 is therefore inhibition of FLJ32865 (Accession NM_144613). Accordingly, utilities of VGAM359 include diagnosis, prevention and treatment of diseases and clinical conditions associated with FLJ32865. Junctional Adhesion Molecule 1 (JAM1, Accession NM_144502) is another VGAM359 host target gene. JAM1 BINDING SITE1 through JAM1 BINDING SITE4 are HOST TARGET binding sites found in untranslated regions of mRNA encoded by JAM1, corresponding to HOST TARGET binding sites such as BINDING SITE I, BINDING SITE II or BINDING SITE III. Table 2 illustrates the complementarity of the nucleotide sequences of JAM1 BINDING SITE1 through JAM1 BINDING SITE4, designated SEQ ID:29324, SEQ ID:29344, SEQ ID:29333 and SEQ ID:18857 respectively, to the nucleotide sequence of VGAM359 RNA, herein designated VGAM RNA, also designated SEQ ID:3070.

Another function of VGAM359 is therefore inhibition of Junctional Adhesion Molecule 1 (JAM1, Accession NM_144502). Accordingly, utilities of VGAM359 include diagnosis, prevention and treatment of diseases and clinical conditions associated with JAM1. LOC201627 (Accession XM_114353) is another VGAM359 host target gene. LOC201627 BINDING SITE is HOST TARGET binding site found in the 3' untranslated region of mRNA encoded by LOC201627, corresponding to a HOST TARGET binding site such as BINDING SITE I, BINDING SITE II or BINDING SITE III. Table 2 illustrates the complementarity of the nucleotide sequences of LOC201627 BINDING SITE, designated SEQ ID:42896, to the nucleotide sequence of VGAM359 RNA, herein designated VGAM RNA, also designated SEQ ID:3070.

Another function of VGAM359 is therefore inhibition of LOC201627 (Accession XM_114353). Accordingly, utilities of VGAM359 include diagnosis, prevention and treatment of diseases and clinical conditions associated with LOC201627. FIG. 1 further provides a conceptual description of a novel bioinformatically detected viral gene of the present invention, referred to here as Viral Genomic Address Messenger 360 (VGAM360) viral gene, which modulates expression of respective host target genes thereof, the function and utility of which host target genes is known in the art.

VGAM360 is a novel bioinformatically detected regulatory, non protein coding, viral micro RNA (miRNA) gene. The method by which VGAM360 was detected is described hereinabove with reference to FIGS. 1-8.

VGAM360 gene, herein designated VGAM GENE, is a viral gene contained in the genome of Avian Infectious Bronchitis Virus. VGAM360 host target gene, herein designated VGAM HOST TARGET GENE, is a human gene contained in the human genome.

VGAM360 gene encodes a VGAM360 precursor RNA, herein designated VGAM PRECURSOR RNA. Similar to other miRNA genes, and unlike most ordinary genes, VGAM360 precursor RNA does not encode a protein. A nucleotide sequence identical or highly similar to the nucleotide sequence of VGAM360 precursor RNA is designated SEQ ID:346, and is provided hereinbelow with reference to the sequence listing part. Nucleotide sequence SEQ ID:346 is located at position 11848 relative to the genome of Avian Infectious Bronchitis Virus.

VGAM360 precursor RNA folds onto itself, forming VGAM360 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM360 folded precursor RNA into VGAM360 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM360 RNA is designated SEQ ID:3071, and is provided hereinbelow with reference to the sequence listing part.

VGAM360 host target gene, herein designated VGAM HOST TARGET GENE, encodes a corresponding messenger RNA, VGAM360 host target RNA, herein designated VGAM HOST TARGET RNA. VGAM360 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM360 RNA, herein designated VGAM RNA, binds complementarily to one or more host target binding sites located in untranslated regions of VGAM360 host target RNA, herein designated VGAM HOST TARGET RNA. This complementary binding is due to the fact that the nucleotide sequence of VGAM360 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM360 RNA, herein designated VGAM RNA, may have a different number of host target binding sites in untranslated regions of a VGAM360 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM360 RNA, herein designated VGAM RNA, to host target binding sites on VGAM360 host target RNA, herein designated VGAM HOST TARGET RNA, such as BINDING SITE I, BINDING SITE II and BINDING SITE III, inhibits translation of VGAM360 host target RNA into VGAM360 host target protein, herein designated VGAM HOST TARGET PROTEIN. VGAM host target protein is therefore outlined by a broken line.

It is appreciated that VGAM360 host target gene, herein designated VGAM HOST TARGET GENE, in fact represents a plurality of VGAM360 host target genes. The mRNA of each one of this plurality of VGAM360 host target genes comprises one or more host target binding sites, each having a nucleotide sequence which is at least partly complementary to VGAM360 RNA, herein designated VGAM RNA, and which when bound by VGAM360 RNA causes inhibition of translation of respective one or more VGAM360 host target proteins.

It is further appreciated by one skilled in the art that the mode of translational inhibition illustrated by FIG. 1 with specific reference to translational inhibition exerted by VGAM360 gene, herein designated VGAM GENE, on one or more VGAM360 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM360 is inhibition of expression of host target genes, as part of a novel viral mechanism of attacking a host. Accordingly, utilities of VGAM360 include diagnosis, prevention and treatment of viral infection by Avian Infectious Bronchitis Virus. Specific functions, and accordingly utilities, of VGAM360 correlate with, and may be deduced from, the identity of the host target genes which VGAM360 binds and inhibits, and the function of these host target genes, as elaborated hereinbelow.

Nucleotide sequences of the VGAM360 precursor RNA, herein designated VGAM PRECURSOR RNA, and of the 'diced' VGAM360 RNA, herein designated VGAM RNA, and a schematic representation of the secondary folding of VGAM360 folded precursor RNA, herein designated VGAM FOLDED PRECURSOR RNA, of VGAM360 are further described hereinbelow with reference to Table 1.

Nucleotide sequences of host target binding sites, such as BINDING SITE-I, BINDING SITE-II and BINDING SITE-III of FIG. 1, found on VGAM360 host target RNA, and schematic representation of the complementarity of each of these host target binding sites to VGAM360 RNA, herein designated VGAM RNA, are described hereinbelow with reference to Table 2.

As mentioned hereinabove with reference to FIG. 1, a function of VGAM360 gene, herein designated VGAM is inhibition of expression of VGAM360 target genes. It is appreciated that specific functions, and accordingly utilities, of VGAM360 correlate with, and may be deduced from, the identity of the target genes which VGAM360 binds and inhibits, and the function of these target genes, as elaborated hereinbelow.

Neuronal Cell Adhesion Molecule (NRCAM, Accession NM_005010) is a VGAM360 host target gene. NRCAM BINDING SITE is HOST TARGET binding site found in the 3' untranslated region of mRNA encoded by NRCAM, corresponding to a HOST TARGET binding site such as BINDING SITE I, BINDING SITE II or BINDING SITE III. Table 2 illustrates the complementarity of the nucleotide sequences of NRCAM BINDING SITE, designated SEQ ID:11447, to the nucleotide sequence of VGAM360 RNA, herein designated VGAM RNA, also designated SEQ ID:3071.

A function of VGAM360 is therefore inhibition of Neuronal Cell Adhesion Molecule (NRCAM, Accession NM_005010), a gene which functions as a cell surface protein and belongs to the immunoglobulin superfamily. Accordingly, utilities of VGAM360 include diagnosis, prevention and treatment of diseases and clinical conditions associated with NRCAM. The function of NRCAM and its association with various diseases and clinical conditions, has been established by previous studies, as described hereinabove with reference to VGAM268. UPF3A (Accession NM_023011) is another VGAM360 host target gene. UPF3A BINDING SITE1 and UPF3A BINDING SITE2 are HOST TARGET binding sites found in untranslated regions of mRNA encoded by UPF3A, corresponding to HOST TARGET binding sites such as BINDING SITE I, BINDING SITE II or BINDING SITE III. Table 2 illustrates the complementarity of the nucleotide sequences of UPF3A BINDING SITE1 and UPF3A BINDING SITE2, designated SEQ ID:23276 and SEQ ID:27987 respectively, to the nucleotide sequence of VGAM360 RNA, herein designated VGAM RNA, also designated SEQ ID:3071.

Another function of VGAM360 is therefore inhibition of UPF3A (Accession NM_023011), a gene which facilitates the export of spliced mRNAs by recruiting mRNA export proteins. Accordingly, utilities of VGAM360 include diagnosis, prevention and treatment of diseases and clinical conditions associated with UPF3A. The function of UPF3A has been established by previous studies. Using comparative genomics and RACE, Serin et al. (2001) isolated cDNAs encoding UPF3A, which they called UPF3, and UPF3B, which they called UPF3X. UPF3A encodes a 452-amino acid protein and a 420-amino acid splice variant. Northern blot analysis revealed expression of 2.1- and 2.4-kb UPF3A transcripts in HeLa cells. By immunoprecipitation and immunoblot analyses of nucleoplasmic fractions, Kim et al. (2001) showed that UPF3A and UPF3B are associated in an RNase-resistant manner with Y14 (RBM8A; 605313), as well as with the mRNA export factors ALY (OMIM Ref. No. 604171) and TAP (NXF1; 602647), in mRNA-protein complexes. UPF3 proteins appeared to bind immediately upstream of exon-exon junctions. Kim et al. (2001) concluded that UPF3 proteins facilitate the export of spliced mRNAs by recruiting mRNA export proteins. They proposed that UPF3 functions in NMD and travels with the mRNA to the cytoplasm, where a leading translating ribosome displaces the UPF3-Y14 complexes from the mRNA.

Full details of the abovementioned studies are described in the following publications, the disclosure of which are hereby incorporated by reference:

Serin, G.; Gersappe, A.; Black, J. D.; Aronoff, R.; Maquat, L. E.: Identification and characterization of human orthologues to Saccharomyces cerevisiae Upf2 protein and Upf3 protein (Caenorhabditis elegans SMG-4). Molec. Cell. Biol. 21:209-223, 2001; and Kim, V. N.; Kataoka, N.; Dreyfuss, G.: Role of the nonsense-mediated decay factor hUpf3 in the splicing-dependent exon-exon junction complex. Science 293:1832-1836, 2001.

Further studies establishing the function and utilities of UPF3A are found in John Hopkins OMIM database record ID 605530, and in sited publications numbered 9142-9145 listed in the bibliography section hereinbelow, which are also hereby incorporated by reference. LOC163882 (Accession XM_089211) is another VGAM360 host target gene. LOC163882 BINDING SITE is HOST TARGET binding site found in the 3' untranslated region of mRNA encoded by LOC163882, corresponding to a HOST TARGET binding site such as BINDING SITE I, BINDING SITE II or BINDING SITE III. Table 2 illustrates the complementarity of the nucleotide sequences of LOC163882 BINDING SITE, designated SEQ ID:39969, to the nucleotide sequence of VGAM360 RNA, herein designated VGAM RNA, also designated SEQ ID:3071.

Another function of VGAM360 is therefore inhibition of LOC163882 (Accession XM_089211). Accordingly, utilities of VGAM360 include diagnosis, prevention and treatment of diseases and clinical conditions associated with LOC163882. FIG. 1 further provides a conceptual description of a novel bioinformatically detected viral gene of the present invention, referred to here as Viral Genomic Address Messenger 361 (VGAM361) viral gene, which modulates expression of respective host target genes thereof, the function and utility of which host target genes is known in the art.

VGAM361 is a novel bioinformatically detected regulatory, non protein coding, viral micro RNA (miRNA) gene. The method by which VGAM361 was detected is described hereinabove with reference to FIGS. 1-8.

VGAM361 gene, herein designated VGAM GENE, is a viral gene contained in the genome of Avian Infectious Bronchitis Virus. VGAM361 host target gene, herein designated VGAM HOST TARGET GENE, is a human gene contained in the human genome.

VGAM361 gene encodes a VGAM361 precursor RNA, herein designated VGAM PRECURSOR RNA. Similar to other miRNA genes, and unlike most ordinary genes, VGAM361 precursor RNA does not encode a protein. A nucleotide sequence identical or highly similar to the nucleotide sequence of VGAM361 precursor RNA is designated SEQ ID:347, and is provided hereinbelow with reference to the sequence listing part. Nucleotide sequence SEQ ID:347 is located at position 6715 relative to the genome of Avian Infectious Bronchitis Virus.

VGAM361 precursor RNA folds onto itself, forming VGAM361 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM361 folded precursor RNA into VGAM361 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM361 RNA is designated SEQ ID:3072, and is provided hereinbelow with reference to the sequence listing part.

VGAM361 host target gene, herein designated VGAM HOST TARGET GENE, encodes a corresponding messenger RNA, VGAM361 host target RNA, herein designated VGAM HOST TARGET RNA. VGAM361 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM361 RNA, herein designated VGAM RNA, binds complementarily to one or more host target binding sites located in untranslated regions of VGAM361 host target RNA, herein designated VGAM HOST TARGET RNA. This complementary binding is due to the fact that the nucleotide sequence of VGAM361 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM361 RNA, herein designated VGAM RNA, may have a different number of host target binding sites in untranslated regions of a VGAM361 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM361 RNA, herein designated VGAM RNA, to host target binding sites on VGAM361 host target RNA, herein designated VGAM HOST TARGET RNA, such as BINDING SITE I, BINDING SITE II and BINDING SITE III, inhibits translation of VGAM361 host target RNA into VGAM361 host target protein, herein designated VGAM HOST TARGET PROTEIN. VGAM host target protein is therefore outlined by a broken line.

It is appreciated that VGAM361 host target gene, herein designated VGAM HOST TARGET GENE, in fact represents a plurality of VGAM361 host target genes. The mRNA of each one of this plurality of VGAM361 host target genes comprises one or more host target binding sites, each having a nucleotide sequence which is at least partly complementary to VGAM361 RNA, herein designated VGAM RNA, and which when bound by VGAM361 RNA causes inhibition of translation of respective one or more VGAM361 host target proteins.

It is further appreciated by one skilled in the art that the mode of translational inhibition illustrated by FIG. 1 with specific reference to translational inhibition exerted by VGAM361 gene, herein designated VGAM GENE, on one or more VGAM361 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM361 is inhibition of expression of host target genes, as part of a novel viral mechanism of attacking a host. Accordingly, utilities of VGAM361 include diagnosis, prevention and treatment of viral infection by Avian Infectious Bronchitis Virus. Specific functions, and accordingly utilities, of VGAM361 correlate with, and may be deduced from, the identity of the host target genes which VGAM361 binds and inhibits, and the function of these host target genes, as elaborated hereinbelow.

Nucleotide sequences of the VGAM361 precursor RNA, herein designated VGAM PRECURSOR RNA, and of the 'diced' VGAM361 RNA, herein designated VGAM RNA, and a schematic representation of the secondary folding of VGAM361 folded precursor RNA, herein designated VGAM FOLDED PRECURSOR RNA, of VGAM361 are further described hereinbelow with reference to Table 1.

Nucleotide sequences of host target binding sites, such as BINDING SITE-I, BINDING SITE-II and BINDING SITE-III of FIG. 1, found on VGAM361 host target RNA, and schematic representation of the complementarity of each of these host target binding sites to VGAM361 RNA, herein designated VGAM RNA, are described hereinbelow with reference to Table 2.

As mentioned hereinabove with reference to FIG. 1, a function of VGAM361 gene, herein designated VGAM is inhibition of expression of VGAM361 target genes. It is appreciated that specific functions, and accordingly utilities, of VGAM361 correlate with, and may be deduced from, the identity of the target genes which VGAM361 binds and inhibits, and the function of these target genes, as elaborated hereinbelow.

LOC149465 (Accession XM_086543) is a VGAM361 host target gene. LOC149465 BINDING SITE is HOST TARGET binding site found in the 3' untranslated region of mRNA encoded by LOC149465, corresponding to a HOST TARGET binding site such as BINDING SITE I, BINDING SITE II or BINDING SITE III. Table 2 illustrates the complementarity of the nucleotide sequences of LOC149465 BINDING SITE, designated SEQ ID:38759, to the nucleotide sequence of VGAM361 RNA, herein designated VGAM RNA, also designated SEQ ID:3072.

A function of VGAM361 is therefore inhibition of LOC149465 (Accession XM_086543). Accordingly, utilities of VGAM361 include diagnosis, prevention and treatment of diseases and clinical conditions associated with LOC149465.

LOC90591 (Accession XM_032811) is another VGAM361 host target gene. LOC90591 BINDING SITE is HOST TARGET binding site found in the 3' untranslated region of mRNA encoded by LOC90591, corresponding to a HOST TARGET binding site such as BINDING SITE I, BINDING SITE II or BINDING SITE III. Table 2 illustrates the complementarity of the nucleotide sequences of LOC90591 BINDING SITE, designated SEQ ID:31758, to the nucleotide sequence of VGAM361 RNA, herein designated VGAM RNA, also designated SEQ ID:3072.

Another function of VGAM361 is therefore inhibition of LOC90591 (Accession XM_032811). Accordingly, utilities of VGAM361 include diagnosis, prevention and treatment of diseases and clinical conditions associated with LOC90591.

FIG. 1 further provides a conceptual description of a novel bioinformatically detected viral gene of the present invention, referred to here as Viral Genomic Address Messenger 362 (VGAM362) viral gene, which modulates expression of respective host target genes thereof, the function and utility of which host target genes is known in the art.

VGAM362 is a novel bioinformatically detected regulatory, non protein coding, viral micro RNA (miRNA) gene. The method by which VGAM362 was detected is described hereinabove with reference to FIGS. 1-8.

VGAM362 gene, herein designated VGAM GENE, is a viral gene contained in the genome of Avian Infectious Bronchitis Virus. VGAM362 host target gene, herein designated VGAM HOST TARGET GENE, is a human gene contained in the human genome.

VGAM362 gene encodes a VGAM362 precursor RNA, herein designated VGAM PRECURSOR RNA. Similar to other miRNA genes, and unlike most ordinary genes, VGAM362 precursor RNA does not encode a protein. A nucleotide sequence identical or highly similar to the nucleotide sequence of VGAM362 precursor RNA is designated SEQ ID:348, and is provided hereinbelow with reference to the sequence listing part. Nucleotide sequence SEQ ID:348 is located at position 4697 relative to the genome of Avian Infectious Bronchitis Virus.

VGAM362 precursor RNA folds onto itself, forming VGAM362 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM362 folded precursor RNA into VGAM362 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM362 RNA is designated SEQ ID:3073, and is provided hereinbelow with reference to the sequence listing part.

VGAM362 host target gene, herein designated VGAM HOST TARGET GENE, encodes a corresponding messenger RNA, VGAM362 host target RNA, herein designated VGAM HOST TARGET RNA. VGAM362 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM362 RNA, herein designated VGAM RNA, binds complementarily to one or more host target binding sites located in untranslated regions of VGAM362 host target RNA, herein designated VGAM HOST TARGET RNA. This complementary binding is due to the fact that the nucleotide sequence of VGAM362 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM362 RNA, herein designated VGAM RNA, may have a different number of host target binding sites in untranslated regions of a VGAM362 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM362 RNA, herein designated VGAM RNA, to host target binding sites on VGAM362 host target RNA, herein designated VGAM HOST TARGET RNA, such as BINDING SITE I, BINDING SITE II and BINDING SITE III, inhibits translation of VGAM362 host target RNA into VGAM362 host target protein, herein designated VGAM HOST TARGET PROTEIN. VGAM host target protein is therefore outlined by a broken line.

It is appreciated that VGAM362 host target gene, herein designated VGAM HOST TARGET GENE, in fact represents a plurality of VGAM362 host target genes. The mRNA of each one of this plurality of VGAM362 host target genes comprises one or more host target binding sites, each having a nucleotide sequence which is at least partly complementary to VGAM362 RNA, herein designated VGAM RNA, and which when bound by VGAM362 RNA causes inhibition of translation of respective one or more VGAM362 host target proteins.

It is further appreciated by one skilled in the art that the mode of translational inhibition illustrated by FIG. 1 with specific reference to translational inhibition exerted by VGAM362 gene, herein designated VGAM GENE, on one or more VGAM362 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM362 is inhibition of expression of host target genes, as part of a novel viral mechanism of attacking a host. Accordingly, utilities of VGAM362 include diagnosis, prevention and treatment of viral infection by Avian Infectious Bronchitis Virus. Specific functions, and accordingly utilities, of VGAM362 correlate with, and may be deduced from, the identity of the host target genes which VGAM362 binds and inhibits, and the function of these host target genes, as elaborated hereinbelow.

Nucleotide sequences of the VGAM362 precursor RNA, herein designated VGAM PRECURSOR RNA, and of the 'diced' VGAM362 RNA, herein designated VGAM RNA, and a schematic representation of the secondary folding of VGAM362 folded precursor RNA, herein designated VGAM FOLDED PRECURSOR RNA, of VGAM362 are further described hereinbelow with reference to Table 1.

Nucleotide sequences of host target binding sites, such as BINDING SITE-I, BINDING SITE-II and BINDING SITE-III of FIG. 1, found on VGAM362 host target RNA, and schematic representation of the complementarity of each of these host target binding sites to VGAM362 RNA, herein designated VGAM RNA, are described hereinbelow with reference to Table 2.

As mentioned hereinabove with reference to FIG. 1, a function of VGAM362 gene, herein designated VGAM is inhibition of expression of VGAM362 target genes. It is appreciated that specific functions, and accordingly utilities, of VGAM362 correlate with, and may be deduced from, the identity of the target genes which VGAM362 binds and inhibits, and the function of these target genes, as elaborated hereinbelow.

GNE (Accession NM_005476) is a VGAM362 host target gene. GNE BINDING SITE is HOST TARGET binding site found in the 3' untranslated region of mRNA encoded by GNE, corresponding to a HOST TARGET binding site such as BINDING SITE I, BINDING SITE II or BINDING SITE III. Table 2 illustrates the complementarity of the nucleotide sequences of GNE BINDING SITE, designated SEQ ID:11976, to the nucleotide sequence of VGAM362 RNA, herein designated VGAM RNA, also designated SEQ ID:3073.

A function of VGAM362 is therefore inhibition of GNE (Accession NM_005476), a gene which has roles in sialic acid biosynthesis and regulates cell surface sialylation. Accordingly, utilities of VGAM362 include diagnosis, prevention and treatment of diseases and clinical conditions associated with GNE. The function of GNE has been established by previous studies. Keppler et al. (1999) determined that UDP-GlcNAc 2-epimerase activity is rate-limiting for the biosynthesis of sialic acid and is required for sialylation in hematopoietic cells. The activity of the enzyme can be controlled at the transcriptional level and can affect the sialylation and function of specific cell surface molecules expressed on B cells and myeloid cells. In a Genbank submission (AJ238764), these authors reported the sequence of a human UDP-GlcNAc 2-epimerase cDNA. Animal model experiments lend further support to the function of GNE. Schwarzkopf et al. (2002) reported that inactivation of GNE (which is bifunctional and is the key enzyme of sialic acid biosynthesis) by gene targeting in mice caused early embryonic lethality, thereby emphasizing the fundamental role of the enzyme and sialylation during development. The need of the enzyme for a defined sialylation process is exemplified by the polysialylation of the neural cell adhesion molecule in embryonic stem cells.

It is appreciated that the abovementioned animal model for GNE is acknowledged by those skilled in the art as a scientifically valid animal model, as can be further appreciated from the publications sited hereinbelow.

Full details of the abovementioned studies are described in the following publications, the disclosure of which are hereby incorporated by reference:

Keppler, O. T.; Hinderlich, S.; Langner, J.; Schwartz-Albiez, R.; Reutter, W.; Pawlita, M.: UDP-GlcNAc 2-epimerase: a regulator of cell surface sialylation. Science 284:1372-1376, 1999; and Schwarzkopf, M.; Knobeloch, K.-P.; Rohde, E.; Hinderlich, S.; Wiechens, N.; Lucka, L.; Horak, I.; Reutter, W.; Horstkorte, R.: Sialylation is essential for early development in mice.

Further studies establishing the function and utilities of GNE are found in John Hopkins OMIM database record ID 603824, and in sited publications numbered 7516-5179, 7929-5181, 1662-1663, 5167-5168, 1664, 5182, 1139 and 11407 listed in the bibliography section hereinbelow, which are also hereby incorporated by reference. Membrane-spanning 4-domains, Subfamily A, Member 1 (MS4A1, Accession NM_000139) is another VGAM362 host target gene. MS4A1 BINDING SITE is HOST TARGET binding site found in the 3' untranslated region of mRNA encoded by MS4A1, corresponding to a HOST TARGET binding site such as BINDING SITE I, BINDING SITE II or BINDING SITE III. Table 2 illustrates the complementarity of the nucleotide sequences of MS4A1 BINDING SITE, designated SEQ ID:5631, to the nucleotide sequence of VGAM362 RNA, herein designated VGAM RNA, also designated SEQ ID:3073.

Another function of VGAM362 is therefore inhibition of Membrane-spanning 4-domains, Subfamily A, Member 1 (MS4A1, Accession NM_000139), a gene which may be involved in the regulation of b-cell activation and proliferation. Accordingly, utilities of VGAM362 include diagnosis, prevention and treatment of diseases and clinical conditions associated with MS4A1. The function of MS4A1 has been established by previous studies. B1, also known as CD20 or MS4A1, is a human B-lymphocyte surface molecule that is widely expressed during B-cell ontogeny, from early pre-B-cell developmental stages until final differentiation into plasma cells. Functional studies using monoclonal antibodies have shown that antibody binding to B1 inhibits B-cell proliferation caused by mitogens and inhibits B-cell differentiation. Tedder et al. (1988) described the primary structure of CD20. Tedder et al. (1989) showed that the CD20 gene is 16 kb long and contains 8 exons. Using in situ hybridization and Southern blotting of hybrid cell DNA, Tedder et al. (1989) showed that the CD20 gene is located on 11q12-q13. This localization places the CD20 gene near the site of the t (11; 14)(q13; q32) translocation that is found in a subgroup of B-cell malignancies; see 151400. The CD20 gene was found to lie on the centromeric side of BCL1 (OMIM Ref. No. 168461) and to be separated from BCL1 by at least 50 kb of DNA. The proximal location of CD20 was indicated by the fact that it is not translocated to chromosome 14 in the translocation. It must be located between the centromere of chromosome 11 and the 3-prime end of BCL1. Szepetowski et al. (1993) studied amplification of the BCL1 region in breast cancer to map genes in the 11q13 band. CD20 was the most proximal of 13 genes located centromeric to BCL1 and was in the same group as CD5, PGA4 (OMIM Ref. No. 169720), and FTH1 (OMIM Ref. No. 134770). Distal to this cluster was a group of 3 genes, COX8 (OMIM Ref. No. 123870), PYGM (OMIM Ref. No. 232600), and SEA (OMIM Ref. No. 165110), of which the most proximal was COX8.

Full details of the abovementioned studies are described in the following publications, the disclosure of which are hereby incorporated by reference:

Szepetowski, P.; Perucca-Lostanlen, D.; Gaudray, P.: Mapping genes according to their amplification status in tumor cells: contribution to the map of 11q13. Genomics 16:745-750, 1993; and Tedder, T. F.; Klejman, G.; Schlossman, S. F.; Saito, H.: Structure of the gene encoding the human B lymphocyte differentiation antigen CD20 (B1). J. Immun. 142:2560-2568, 1989.

Further studies establishing the function and utilities of MS4A1 are found in John Hopkins OMIM database record ID 112210, and in sited publications numbered 455 and 4552-4554 listed in the bibliography section hereinbelow, which are also hereby incorporated by reference. Tissue Inhibitor of Metalloproteinase 3 (Sorsby fundus dystrophy, pseudoinflammatory) (TIMP3, Accession NM_000362) is another VGAM362 host target gene. TIMP3 BINDING SITE is HOST TARGET binding site found in the 3' untranslated region of mRNA encoded by TIMP3, corresponding to a HOST TARGET binding site such as BINDING SITE I, BINDING SITE II or BINDING SITE III. Table 2 illustrates the complementarity of the nucleotide sequences of TIMP3 BINDING SITE, designated SEQ ID:5935, to the nucleotide sequence of VGAM362 RNA, herein designated VGAM RNA, also designated SEQ ID:3073.

Another function of VGAM362 is therefore inhibition of Tissue Inhibitor of Metalloproteinase 3 (Sorsby fundus dystrophy, pseudoinflammatory) (TIMP3, Accession NM_000362). Accordingly, utilities of VGAM362 include diagnosis, prevention and treatment of diseases and clinical conditions associated with TIMP3. Transient Receptor Potential Cation Channel, Subfamily C, Member 5 (TRPC5, Accession NM_012471) is another VGAM362 host target gene. TRPC5 BINDING SITE is HOST TARGET binding site found in the 3' untranslated region of mRNA encoded by TRPC5, corresponding to a HOST TARGET binding site such as BINDING SITE I, BINDING SITE II or BINDING SITE III. Table 2 illustrates the complementarity of the nucleotide sequences of TRPC5 BINDING SITE, designated SEQ ID:14851, to the nucleotide sequence of VGAM362 RNA, herein designated VGAM RNA, also designated SEQ ID:3073.

Another function of VGAM362 is therefore inhibition of Transient Receptor Potential Cation Channel, Subfamily C, Member 5 (TRPC5, Accession NM_012471). Accordingly, utilities of VGAM362 include diagnosis, prevention and treatment of diseases and clinical conditions associated with TRPC5. FLJ10511 (Accession NM_018120) is another VGAM362 host target gene. FLJ10511 BINDING SITE is HOST TARGET binding site found in the 5' untranslated region of mRNA encoded by FLJ10511, corresponding to a HOST TARGET binding site such as BINDING SITE I, BINDING SITE II or BINDING SITE III. Table 2 illustrates the complementarity of the nucleotide sequences of FLJ10511 BINDING SITE, designated SEQ ID:19900, to the nucleotide sequence of VGAM362 RNA, herein designated VGAM RNA, also designated SEQ ID:3073.

Another function of VGAM362 is therefore inhibition of FLJ10511 (Accession NM_018120). Accordingly, utilities of VGAM362 include diagnosis, prevention and treatment of diseases and clinical conditions associated with FLJ10511. IL-17RE (Accession NM_144640) is another VGAM362 host target gene. IL-17RE BINDING SITE is HOST TARGET binding site found in the 3' untranslated region of mRNA encoded by IL-17RE, corresponding to a HOST TARGET binding site such as BINDING SITE I, BINDING SITE II or BINDING SITE III. Table 2 illustrates the complementarity of the nucleotide sequences of IL-17RE BINDING SITE, designated SEQ ID:29465, to the nucleotide sequence of VGAM362 RNA, herein designated VGAM RNA, also designated SEQ ID:3073.

Another function of VGAM362 is therefore inhibition of IL-17RE (Accession NM_144640). Accordingly, utilities of VGAM362 include diagnosis, prevention and treatment of diseases and clinical conditions associated with IL-17RE. LOC150848 (Accession XM_097959) is another VGAM362 host target gene. LOC150848 BINDING SITE is HOST TARGET binding site found in the 3' untranslated region of mRNA encoded by LOC150848, corresponding to a HOST TARGET binding site such as BINDING SITE I, BINDING SITE II or BINDING SITE III. Table 2 illustrates the complementarity of the nucleotide sequences of LOC150848 BINDING SITE, designated SEQ ID:41258, to the nucleotide sequence of VGAM362 RNA, herein designated VGAM RNA, also designated SEQ ID:3073.

Another function of VGAM362 is therefore inhibition of LOC150848 (Accession XM_097959). Accordingly, utilities of VGAM362 include diagnosis, prevention and treatment of diseases and clinical conditions associated with LOC150848. LOC253868 (Accession XM_170975) is another VGAM362 host target gene. LOC253868 BINDING SITE is HOST TARGET binding site found in the 3' untranslated region of mRNA encoded by LOC253868, corresponding to a HOST TARGET binding site such as BINDING SITE I, BINDING SITE II or BINDING SITE III. Table 2 illustrates the complementarity of the nucleotide sequences of LOC253868 BINDING SITE, designated SEQ ID:45746, to the nucleotide sequence of VGAM362 RNA, herein designated VGAM RNA, also designated SEQ ID:3073.

Another function of VGAM362 is therefore inhibition of LOC253868 (Accession XM_170975). Accordingly, utilities of VGAM362 include diagnosis, prevention and treatment of diseases and clinical conditions associated with LOC253868. LOC257465 (Accession XM_088384) is another VGAM362 host target gene. LOC257465 BINDING SITE is HOST TARGET binding site found in the 3' untranslated region of mRNA encoded by LOC257465, corresponding to a HOST TARGET binding site such as BINDING SITE I, BINDING SITE II or BINDING SITE III. Table 2 illustrates the complementarity of the nucleotide sequences of LOC257465 BINDING SITE, designated SEQ ID:39667, to the nucleotide sequence of VGAM362 RNA, herein designated VGAM RNA, also designated SEQ ID:3073.

Another function of VGAM362 is therefore inhibition of LOC257465 (Accession XM_088384). Accordingly, utilities of VGAM362 include diagnosis, prevention and treatment of diseases and clinical conditions associated with LOC257465. LOC93206 (Accession XM_049838) is another VGAM362 host target gene. LOC93206 BINDING SITE is HOST TARGET binding site found in the 3' untranslated region of mRNA encoded by LOC93206, corresponding to a HOST TARGET binding site such as BINDING SITE I, BINDING SITE II or BINDING SITE III. Table 2 illustrates the complementarity of the nucleotide sequences of LOC93206 BINDING SITE, designated SEQ ID:35519, to the nucleotide sequence of VGAM362 RNA, herein designated VGAM RNA, also designated SEQ ID:3073.

Another function of VGAM362 is therefore inhibition of LOC93206 (Accession XM_049838). Accordingly, utilities of VGAM362 include diagnosis, prevention and treatment of diseases and clinical conditions associated with LOC93206. FIG. 1 further provides a conceptual description of a novel bioinformatically detected viral gene of the present invention, referred to here as Viral Genomic Address Messenger 363 (VGAM363) viral gene, which modulates expression of respective host target genes thereof, the function and utility of which host target genes is known in the art.

VGAM363 is a novel bioinformatically detected regulatory, non protein coding, viral micro RNA (miRNA) gene. The method by which VGAM363 was detected is described hereinabove with reference to FIGS. 1-8.

VGAM363 gene, herein designated VGAM GENE, is a viral gene contained in the genome of Avian Infectious Bronchitis Virus. VGAM363 host target gene, herein designated VGAM HOST TARGET GENE, is a human gene contained in the human genome.

VGAM363 gene encodes a VGAM363 precursor RNA, herein designated VGAM PRECURSOR RNA. Similar to other miRNA genes, and unlike most ordinary genes, VGAM363 precursor RNA does not encode a protein. A nucleotide sequence identical or highly similar to the nucleotide sequence of VGAM363 precursor RNA is designated SEQ ID:349, and is provided hereinbelow with reference to the sequence listing part. Nucleotide sequence SEQ ID:349 is located at position 5806 relative to the genome of Avian Infectious Bronchitis Virus.

VGAM363 precursor RNA folds onto itself, forming VGAM363 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM363 folded precursor RNA into VGAM363 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM363 RNA is designated SEQ ID:3074, and is provided hereinbelow with reference to the sequence listing part.

VGAM363 host target gene, herein designated VGAM HOST TARGET GENE, encodes a corresponding messenger RNA, VGAM363 host target RNA, herein designated VGAM HOST TARGET RNA. VGAM363 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM363 RNA, herein designated VGAM RNA, binds complementarily to one or more host target binding sites located in untranslated regions of VGAM363 host target RNA, herein designated VGAM HOST TARGET RNA. This complementary binding is due to the fact that the nucleotide sequence of VGAM363 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM363 RNA, herein designated VGAM RNA, may have a different number of host target binding sites in untranslated regions of a VGAM363 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM363 RNA, herein designated VGAM RNA, to host target binding sites on VGAM363 host target RNA, herein designated VGAM HOST TARGET RNA, such as BINDING SITE I, BINDING SITE II and BINDING SITE III, inhibits translation of VGAM363 host target RNA into VGAM363 host target protein, herein designated VGAM HOST TARGET PROTEIN. VGAM host target protein is therefore outlined by a broken line.

It is appreciated that VGAM363 host target gene, herein designated VGAM HOST TARGET GENE, in fact represents a plurality of VGAM363 host target genes. The mRNA of each one of this plurality of VGAM363 host target genes comprises one or more host target binding sites, each having a nucleotide sequence which is at least partly complementary to VGAM363 RNA, herein designated VGAM RNA, and which when bound by VGAM363 RNA causes inhibition of translation of respective one or more VGAM363 host target proteins.

It is further appreciated by one skilled in the art that the mode of translational inhibition illustrated by FIG. 1 with specific reference to translational inhibition exerted by VGAM363 gene, herein designated VGAM GENE, on one or more VGAM363 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM363 is inhibition of expression of host target genes, as part of a novel viral mechanism of attacking a host. Accordingly, utilities of VGAM363 include diagnosis, prevention and treatment of viral infection by Avian Infectious Bronchitis Virus. Specific functions, and accordingly utilities, of VGAM363 correlate with, and may be deduced from, the identity of the host target genes which VGAM363 binds and inhibits, and the function of these host target genes, as elaborated hereinbelow.

Nucleotide sequences of the VGAM363 precursor RNA, herein designated VGAM PRECURSOR RNA, and of the 'diced' VGAM363 RNA, herein designated VGAM RNA, and a schematic representation of the secondary folding of VGAM363 folded precursor RNA, herein designated VGAM FOLDED PRECURSOR RNA, of VGAM363 are further described hereinbelow with reference to Table 1.

Nucleotide sequences of host target binding sites, such as BINDING SITE-I, BINDING SITE-II and BINDING SITE-III of FIG. 1, found on VGAM363 host target RNA, and schematic representation of the complementarity of each of these host target binding sites to VGAM363 RNA, herein designated VGAM RNA, are described hereinbelow with reference to Table 2.

As mentioned hereinabove with reference to FIG. 1, a function of VGAM363 gene, herein designated VGAM is inhibition of expression of VGAM363 target genes. It is appreciated that specific functions, and accordingly utilities, of VGAM363 correlate with, and may be deduced from, the identity of the target genes which VGAM363 binds and inhibits, and the function of these target genes, as elaborated hereinbelow.

EGF-like-domain, Multiple 5 (EGFL5, Accession XM_098838) is a VGAM363 host target gene. EGFL5 BINDING SITE is HOST TARGET binding site found in the 5' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41874, to the nucleotide sequence of VGAM363 RNA, herein designated VGAM RNA, also designated SEQ ID:3074.

A function of VGAM363 is therefore inhibition of EGF-like-domain, Multiple 5 (EGFL5, Accession XM_098838). Accordingly, utilities of VGAM363 include diagnosis, prevention and treatment of diseases and clinical conditions associated with EGFL5. Outer Dense Fiber of Sperm Tails 2 (ODF2, Accession NM_002540) is another VGAM363 host target gene. ODF2 BINDING SITE is HOST TARGET binding site found in the 5' untranslated region of mRNA encoded by ODF2, corresponding to a HOST TARGET binding site such as BINDING SITE I, BINDING SITE II or BINDING SITE III. Table 2 illustrates the complementarity of the nucleotide sequences of ODF2 BINDING SITE, designated SEQ ID:8384, to the nucleotide sequence of VGAM363 RNA, herein designated VGAM RNA, also designated SEQ ID:3074.

Another function of VGAM363 is therefore inhibition of Outer Dense Fiber of Sperm Tails 2 (ODF2, Accession NM_002540), a gene which is very strongly similar to rat Odf2. Accordingly, utilities of VGAM363 include diagnosis, prevention and treatment of diseases and clinical conditions associated with ODF2. The function of ODF2 has been established by previous studies. See ODF1 (OMIM Ref. No. 182878). Brohmann et al. (1997) used antibodies against Odf proteins to screen a rat testis expression library and isolated the rat Odf2 gene. Sequence analysis revealed that the protein has an overall alpha-helical structure with 2 regions identical to the dimerization region of a leucine zipper motif. Brohmann et al. (1997) documented Odf2 cDNAs with 3 different 5-prime end sequences, presumed to be the result of alternative splicing. They found expression of the rat gene only in testis. The EST database contains several human cDNA sequences which are closely related to rat Odf2, suggesting that a human homolog exists (Scott, 1997). These human cDNA sequences were derived from testis, epididymis, and fetal brain libraries. Shao et al. (1997) used a yeast 2-hybrid screening with the leucine zipper region of ODF1 (ODF27; Shao and van der Hoorn, 1996) as bait to isolate rat testis-specific proteins that could interact with ODF27. They demonstrated that one of the novel genes isolated encoded the 84-kD ODF protein ODF2.

Full details of the abovementioned studies are described in the following publications, the disclosure of which are hereby incorporated by reference:

Brohmann, H.; Pinnecke, S.; Hoyer-Fender, S.: Identification and characterization of new cDNAs encoding outer dense fiber proteins of rat sperm. J. Biol. Chem. 272:10327-10332, 1997; and Shao, X.; Tarnasky, H. A.; Schalles, U.; Oko, R.; van der Hoorn, F. A.: Interactional cloning of the 84-kDa major outer dense fiber protein Odf84: leucine zippers mediate associations.

Further studies establishing the function and utilities of ODF2 are found in John Hopkins OMIM database record ID 602015, and in sited publications numbered 5928-593 and 5706-5707 listed in the bibliography section hereinbelow, which are also hereby incorporated by reference. Testis Derived Transcript (3 LIM domains) (TES, Accession XM_050430) is another VGAM363 host target gene. TES BINDING SITE is HOST TARGET binding site found in the 3' untranslated region of mRNA encoded by TES, corresponding to a HOST TARGET binding site such as BINDING SITE I, BINDING SITE II or BINDING SITE III. Table 2 illustrates the complementarity of the nucleotide sequences of TES BINDING SITE, designated SEQ ID:35631, to the nucleotide sequence of VGAM363 RNA, herein designated VGAM RNA, also designated SEQ ID:3074.

Another function of VGAM363 is therefore inhibition of Testis Derived Transcript (3 LIM domains) (TES, Accession XM_050430), a gene which acts as a tumor suppressor. Accordingly, utilities of VGAM363 include diagnosis, prevention and treatment of diseases and clinical conditions associated with TES. The function of TES has been established by previous studies. By construction and sequencing of a BAC contig within the FRA7G region at 7q31.2, Tatarelli et al. (2000) identified a novel gene which they called TESTIN because of its homology to mouse testin. They isolated 3 human isoforms. Isoforms 1 and 2, which use exon 1a and differ in their 3-prime UTR, contain 7 exons and encode a deduced 421-amino acid protein with a calculated molecular mass of 48 kD. Isoform 3, which uses exon 1b, encodes a deduced 412-amino acid protein with a calculated molecular mass of 47 kD. Each of the isoforms contains 3 LIM domains in the C terminus and shows 89% and 35% sequence identity with the mouse and C. elegans homologs, respectively. Human TESTIN contains 7 putative functional sites:4 phosphorylation sites, a glycosylation site, a myristylation site, and a cytochrome C heme-binding site. Northern blot analysis of normal human tissues demonstrated ubiquitous expression of an approximately 2.8-kb TESTIN transcript, which apparently corresponded to isoforms 2 and 3. An approximately 1.5-kb transcript, corresponding to isoform 1, was expressed at significantly higher levels in testis than in other tissues. FRA7G is a common aphidicolin-inducible fragile site at 7q31.2 showing loss of heterozygosity in human malignancies. Tatarelli et al. (2000) noted that a relationship between LIM proteins and cancer had been observed in several studies. By RT-PCR analysis, they found lack of TESTIN expression in 22% of cancer cell lines and 44% of the cell lines derived from hematologic malignancies. They determined that in most of these cases the inactivation of TESTIN expression was due to methylation of a CpG island. Analysis of the TESTIN coding region in 26 tumor cell lines revealed 3 missense mutations. The authors thus suggested that TESTIN may represent a tumor suppressor gene. Tobias et al. (2001) also cloned and characterized human TESTIN, which they called TES. Mutation analysis of the coding TES exons in 21 human-derived cell lines revealed the presence of a frameshift mutation in 1 allele in a breast cancer cell line. Methylation of the CpG island at the 5-prime end of TES appeared to be a remarkably frequent finding, occurring in 7 of 10 ovarian carcinomas and in each of 30 tumor-derived cell lines tested. Moreover, forced expression of TES in HeLa or OVCAR5 cells resulted in a profound reduction in growth potential, as determined by the colony formation assay. Tobias et al. (2001) suggested that TES is a tumor suppressor gene that is inactivated primarily by transcriptional silencing resulting from CpG island methylation.

Full details of the abovementioned studies are described in the following publications, the disclosure of which are hereby incorporated by reference:

Tatarelli, C.; Linnenbach, A.; Mimori, K.; Croce, C. M.: Characterization of the human TESTIN gene localized in the FRA7G region at 7q31.2. Genomics 68:1-12, 2000; and Tobias, E. S.; Hurlstone, A. F. L.; MacKenzie, E.; McFarlane, R.; Black, D. M.: The TES gene at 7q31.1 is methylated in tumours and encodes a novel growth-suppressing LIM domain prote.

Further studies establishing the function and utilities of TES are found in John Hopkins OMIM database record ID 606085, and in sited publications numbered 6120-6121 listed in the bibliography section hereinbelow, which are also hereby incorporated by reference. Tropomodulin 3 (ubiquitous) (TMOD3, Accession NM_014547) is another VGAM363 host target gene. TMOD3 BINDING SITE is HOST TARGET binding site found in the 3' untranslated region of mRNA encoded by TMOD3, corresponding to a HOST TARGET binding site such as BINDING SITE I, BINDING SITE II or BINDING SITE III. Table 2 illustrates the complementarity of the nucleotide sequences of TMOD3 BINDING SITE, designated SEQ ID:15857, to the nucleotide sequence of VGAM363 RNA, herein designated VGAM RNA, also designated SEQ ID:3074.

Another function of VGAM363 is therefore inhibition of Tropomodulin 3 (ubiquitous) (TMOD3, Accession NM_014547). Accordingly, utilities of VGAM363 include diagnosis, prevention and treatment of diseases and clinical conditions associated with TMOD3. CNIL (Accession NM_005776) is another VGAM363 host target gene. CNIL BINDING SITE is HOST TARGET binding site found in the 3' untranslated region of mRNA encoded by CNIL, corresponding to a HOST TARGET binding site such as BINDING SITE I, BINDING SITE II or BINDING SITE III. Table 2 illustrates the complementarity of the nucleotide sequences of CNIL BINDING SITE, designated SEQ ID:12355, to the nucleotide sequence of VGAM363 RNA, herein designated VGAM RNA, also designated SEQ ID:3074.

Another function of VGAM363 is therefore inhibition of CNIL (Accession NM_005776). Accordingly, utilities of VGAM363 include diagnosis, prevention and treatment of diseases and clinical conditions associated with CNIL. DKFZP564I0422 (Accession NM_031435) is another VGAM363 host target gene. DKFZP564I0422 BINDING SITE is HOST TARGET binding site found in the 3' untranslated region of mRNA encoded by DKFZP564I0422, corresponding to a HOST TARGET binding site such as BINDING SITE I, BINDING SITE II or BINDING SITE III. Table 2 illustrates the complementarity of the nucleotide sequences of DKFZP564I0422 BINDING SITE, designated SEQ ID:25431, to the nucleotide sequence of VGAM363 RNA, herein designated VGAM RNA, also designated SEQ ID:3074.

Another function of VGAM363 is therefore inhibition of DKFZP564I0422 (Accession NM_031435). Accordingly, utilities of VGAM363 include diagnosis, prevention and treatment of diseases and clinical conditions associated with DKFZP564I0422. HT014 (Accession NM_020362) is another VGAM363 host target gene. HT014 BINDING SITE is HOST TARGET binding site found in the 3' untranslated region of mRNA encoded by HT014, corresponding to a HOST TARGET binding site such as BINDING SITE I, BINDING SITE II or BINDING SITE III. Table 2 illustrates the complementarity of the nucleotide sequences of HT014 BINDING SITE, designated SEQ ID:21634, to the nucleotide sequence of VGAM363 RNA, herein designated VGAM RNA, also designated SEQ ID:3074.

Another function of VGAM363 is therefore inhibition of HT014 (Accession NM_020362). Accordingly, utilities of VGAM363 include diagnosis, prevention and treatment of diseases and clinical conditions associated with HT014. KIAA0193 (Accession NM_014766) is another VGAM363 host target gene. KIAA0193 BINDING SITE is HOST TARGET binding site found in the 3' untranslated region of mRNA encoded by KIAA0193, corresponding to a HOST TARGET binding site such as BINDING SITE I, BINDING SITE II or BINDING SITE III. Table 2 illustrates the complementarity of the nucleotide sequences of KIAA0193 BINDING SITE, designated SEQ ID:16540, to the nucleotide sequence of VGAM363 RNA, herein designated VGAM RNA, also designated SEQ ID:3074.

Another function of VGAM363 is therefore inhibition of KIAA0193 (Accession NM_014766). Accordingly, utilities of VGAM363 include diagnosis, prevention and treatment of diseases and clinical conditions associated with KIAA0193. KIAA0276 (Accession XM_048199) is another VGAM363 host target gene. KIAA0276 BINDING SITE is HOST TARGET binding site found in the 3' untranslated region of mRNA encoded by KIAA0276, corresponding to a HOST TARGET binding site such as BINDING SITE I, BINDING SITE II or BINDING SITE III. Table 2 illustrates the complementarity of the nucleotide sequences of KIAA0276 BINDING SITE, designated SEQ ID:35135, to the nucleotide sequence of VGAM363 RNA, herein designated VGAM RNA, also designated SEQ ID:3074.

Another function of VGAM363 is therefore inhibition of KIAA0276 (Accession XM_048199). Accordingly, utilities of VGAM363 include diagnosis, prevention and treatment of diseases and clinical conditions associated with KIAA0276. LOC115073 (Accession XM_055193) is another VGAM363 host target gene. LOC115073 BINDING SITE is HOST TARGET binding site found in the 3' untranslated region of mRNA encoded by LOC115073, corresponding to a HOST TARGET binding site such as BINDING SITE I, BINDING SITE II or BINDING SITE III. Table 2 illustrates the complementarity of the nucleotide sequences of LOC115073 BINDING SITE, designated SEQ ID:36237, to the nucleotide sequence of VGAM363 RNA, herein designated VGAM RNA, also designated SEQ ID:3074.

Another function of VGAM363 is therefore inhibition of LOC115073 (Accession XM_055193). Accordingly, utilities of VGAM363 include diagnosis, prevention and treatment of diseases and clinical conditions associated with LOC115073. FIG. 1 further provides a conceptual description of a novel bioinformatically detected viral gene of the present invention, referred to here as Viral Genomic Address Messenger 364 (VGAM364) viral gene, which modulates expression of respective host target genes thereof, the function and utility of which host target genes is known in the art.

VGAM364 is a novel bioinformatically detected regulatory, non protein coding, viral micro RNA (miRNA) gene. The method by which VGAM364 was detected is described hereinabove with reference to FIGS. 1-8.

VGAM364 gene, herein designated VGAM GENE, is a viral gene contained in the genome of Avian Infectious Bronchitis Virus. VGAM364 host target gene, herein designated VGAM HOST TARGET GENE, is a human gene contained in the human genome.

VGAM364 gene encodes a VGAM364 precursor RNA, herein designated VGAM PRECURSOR RNA. Similar to other miRNA genes, and unlike most ordinary genes, VGAM364 precursor RNA does not encode a protein. A nucleotide sequence identical or highly similar to the nucleotide sequence of VGAM364 precursor RNA is designated SEQ ID:350, and is provided hereinbelow with reference to the sequence listing part. Nucleotide sequence SEQ ID:350 is located at position 10866 relative to the genome of Avian Infectious Bronchitis Virus.

VGAM364 precursor RNA folds onto itself, forming VGAM364 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM364 folded precursor RNA into VGAM364 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM364 RNA is designated SEQ ID:3075, and is provided hereinbelow with reference to the sequence listing part.

VGAM364 host target gene, herein designated VGAM HOST TARGET GENE, encodes a corresponding messenger RNA, VGAM364 host target RNA, herein designated VGAM HOST TARGET RNA. VGAM364 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM364 RNA, herein designated VGAM RNA, binds complementarily to one or more host target binding sites located in untranslated regions of VGAM364 host target RNA, herein designated VGAM HOST TARGET RNA. This complementary binding is due to the fact that the nucleotide sequence of VGAM364 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM364 RNA, herein designated VGAM RNA, may have a different number of host target binding sites in untranslated regions of a VGAM364 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM364 RNA, herein designated VGAM RNA, to host target binding sites on VGAM364 host target RNA, herein designated VGAM HOST TARGET RNA, such as BINDING SITE I, BINDING SITE II and BINDING SITE III, inhibits translation of VGAM364 host target RNA into VGAM364 host target protein, herein designated VGAM HOST TARGET PROTEIN. VGAM host target protein is therefore outlined by a broken line.

It is appreciated that VGAM364 host target gene, herein designated VGAM HOST TARGET GENE, in fact represents a plurality of VGAM364 host target genes. The mRNA of each one of this plurality of VGAM364 host target genes comprises one or more host target binding sites, each having a nucleotide sequence which is at least partly complementary to VGAM364 RNA, herein designated VGAM RNA, and which when bound by VGAM364 RNA causes inhibition of translation of respective one or more VGAM364 host target proteins.

It is further appreciated by one skilled in the art that the mode of translational inhibition illustrated by FIG. 1 with specific reference to translational inhibition exerted by VGAM364 gene, herein designated VGAM GENE, on one or more VGAM364 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM364 is inhibition of expression of host target genes, as part of a novel viral mechanism of attacking a host. Accordingly, utilities of VGAM364 include diagnosis, prevention and treatment of viral infection by Avian Infectious Bronchitis Virus. Specific functions, and accordingly utilities, of VGAM364 correlate with, and may be deduced from, the identity of the host target genes which VGAM364 binds and inhibits, and the function of these host target genes, as elaborated hereinbelow.

Nucleotide sequences of the VGAM364 precursor RNA, herein designated VGAM PRECURSOR RNA, and of the 'diced' VGAM364 RNA, herein designated VGAM RNA, and a schematic representation of the secondary folding of VGAM364 folded precursor RNA, herein designated VGAM FOLDED PRECURSOR RNA, of VGAM364 are further described hereinbelow with reference to Table 1.

Nucleotide sequences of host target binding sites, such as BINDING SITE-I, BINDING SITE-II and BINDING SITE-III of FIG. 1, found on VGAM364 host target RNA, and schematic representation of the complementarity of each of these host target binding sites to VGAM364 RNA, herein designated VGAM RNA, are described hereinbelow with reference to Table 2.

As mentioned hereinabove with reference to FIG. 1, a function of VGAM364 gene, herein designated VGAM is inhibition of expression of VGAM364 target genes. It is appreciated that specific functions, and accordingly utilities, of VGAM364 correlate with, and may be deduced from, the identity of the target genes which VGAM364 binds and inhibits, and the function of these target genes, as elaborated hereinbelow.

PSR (Accession XM_036784) is a VGAM364 host target gene. PSR BINDING SITE is HOST TARGET binding site found in the 3' untranslated region of mRNA encoded by PSR, corresponding to a HOST TARGET binding site such as BINDING SITE I, BINDING SITE II or BINDING SITE III. Table 2 illustrates the complementarity of the nucleotide sequences of PSR BINDING SITE, designated SEQ ID:32503, to the nucleotide sequence of VGAM364 RNA, herein designated VGAM RNA, also designated SEQ ID:3075.

A function of VGAM364 is therefore inhibition of PSR (Accession XM_036784). Accordingly, utilities of VGAM364 include diagnosis, prevention and treatment of diseases and clinical conditions associated with PSR. Retinoic Acid Induced 17 (RAI17, Accession XM_166091) is another VGAM364 host target gene. RAI17 BINDING SITE is HOST TARGET binding site found in the 3' untranslated region of mRNA encoded by RAI17, corresponding to a HOST TARGET binding site such as BINDING SITE I, BINDING SITE II or BINDING SITE III. Table 2 illustrates the complementarity of the nucleotide sequences of RAI17 BINDING SITE, designated SEQ ID:43859, to the nucleotide sequence of VGAM364 RNA, herein designated VGAM RNA, also designated SEQ ID:3075.

Another function of VGAM364 is therefore inhibition of Retinoic Acid Induced 17 (RAI17, Accession XM_166091). Accordingly, utilities of VGAM364 include diagnosis, prevention and treatment of diseases and clinical conditions associated with RAI17. SEC24 Related Gene Family, Member A (S. cerevisiae) (SEC24A, Accession XM_094581) is another VGAM364 host target gene. SEC24A BINDING SITE is HOST TARGET binding site found in the 3' untranslated region of mRNA encoded by SEC24A, corresponding to a HOST TARGET binding site such as BINDING SITE I, BINDING SITE II or BINDING SITE III. Table 2 illustrates the complementarity of the nucleotide sequences of SEC24A BINDING SITE, designated SEQ ID:40233, to the nucleotide sequence of VGAM364 RNA, herein designated VGAM RNA, also designated SEQ ID:3075.

Another function of VGAM364 is therefore inhibition of SEC24 Related Gene Family, Member A (S. cerevisiae) (SEC24A, Accession XM_094581). Accordingly, utilities of VGAM364 include diagnosis, prevention and treatment of diseases and clinical conditions associated with SEC24A. LOC255565 (Accession XM_170811) is another VGAM364 host target gene. LOC255565 BINDING SITE is HOST TARGET binding site found in the 5' untranslated region of mRNA encoded by LOC255565, corresponding to a HOST TARGET binding site such as BINDING SITE I, BINDING SITE II or BINDING SITE III. Table 2 illustrates the complementarity of the nucleotide sequences of LOC255565 BINDING SITE, designated SEQ ID:45589, to the nucleotide sequence of VGAM364 RNA, herein designated VGAM RNA, also designated SEQ ID:3075.

Another function of VGAM364 is therefore inhibition of LOC255565 (Accession XM_170811). Accordingly, utilities of VGAM364 include diagnosis, prevention and treatment of diseases and clinical conditions associated with LOC255565. LOC256512 (Accession XM_171470) is another VGAM364 host target gene. LOC256512 BINDING SITE is HOST TARGET binding site found in the 5' untranslated region of mRNA encoded by LOC256512, corresponding to a HOST TARGET binding site such as BINDING SITE I, BINDING SITE II or BINDING SITE III. Table 2 illustrates the complementarity of the nucleotide sequences of LOC256512 BINDING SITE, designated SEQ ID:46047, to the nucleotide sequence of VGAM364 RNA, herein designated VGAM RNA, also designated SEQ ID:3075.

Another function of VGAM364 is therefore inhibition of LOC256512 (Accession XM_171470). Accordingly, utilities of VGAM364 include diagnosis, prevention and treatment of diseases and clinical conditions associated with LOC256512.

LOC93166 (Accession XM_049619) is another VGAM364 host target gene. LOC93166 BINDING SITE is HOST TARGET binding site found in the 5' untranslated region of mRNA encoded by LOC93166, corresponding to a HOST TARGET binding site such as BINDING SITE I, BINDING SITE II or BINDING SITE III. Table 2 illustrates the complementarity of the nucleotide sequences of LOC93166 BINDING SITE, designated SEQ ID:35459, to the nucleotide sequence of VGAM364 RNA, herein designated VGAM RNA, also designated SEQ ID:3075.

Another function of VGAM364 is therefore inhibition of LOC93166 (Accession XM_049619). Accordingly, utilities of VGAM364 include diagnosis, prevention and treatment of diseases and clinical conditions associated with LOC93166. FIG. 1 further provides a conceptual description of a novel bioinformatically detected viral gene of the present invention, referred to here as Viral Genomic Address Messenger 365 (VGAM365) viral gene, which modulates expression of respective host target genes thereof, the function and utility of which host target genes is known in the art.

VGAM365 is a novel bioinformatically detected regulatory, non protein coding, viral micro RNA (miRNA) gene. The method by which VGAM365 was detected is described hereinabove with reference to FIGS. 1-8.

VGAM365 gene, herein designated VGAM GENE, is a viral gene contained in the genome of Avian Infectious Bronchitis Virus. VGAM365 host target gene, herein designated VGAM HOST TARGET GENE, is a human gene contained in the human genome.

VGAM365 gene encodes a VGAM365 precursor RNA, herein designated VGAM PRECURSOR RNA. Similar to other miRNA genes, and unlike most ordinary genes, VGAM365 precursor RNA does not encode a protein. A nucleotide sequence identical or highly similar to the nucleotide sequence of VGAM365 precursor RNA is designated SEQ ID:351, and is provided hereinbelow with reference to the sequence listing part. Nucleotide sequence SEQ ID:351 is located at position 21704 relative to the genome of Avian Infectious Bronchitis Virus.

VGAM365 precursor RNA folds onto itself, forming VGAM365 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM365 folded precursor RNA into VGAM365 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM365 RNA is designated SEQ ID:3076, and is provided hereinbelow with reference to the sequence listing part.

VGAM365 host target gene, herein designated VGAM HOST TARGET GENE, encodes a corresponding messenger RNA, VGAM365 host target RNA, herein designated VGAM HOST TARGET RNA. VGAM365 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM365 RNA, herein designated VGAM RNA, binds complementarily to one or more host target binding sites located in untranslated regions of VGAM365 host target RNA, herein designated VGAM HOST TARGET RNA. This complementary binding is due to the fact that the nucleotide sequence of VGAM365 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM365 RNA, herein designated VGAM RNA, may have a different number of host target binding sites in untranslated regions of a VGAM365 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM365 RNA, herein designated VGAM RNA, to host target binding sites on VGAM365 host target RNA, herein designated VGAM HOST TARGET RNA, such as BINDING SITE I, BINDING SITE II and BINDING SITE III, inhibits translation of VGAM365 host target RNA into VGAM365 host target protein, herein designated VGAM HOST TARGET PROTEIN. VGAM host target protein is therefore outlined by a broken line.

It is appreciated that VGAM365 host target gene, herein designated VGAM HOST TARGET GENE, in fact represents a plurality of VGAM365 host target genes. The mRNA of each one of this plurality of VGAM365 host target genes comprises one or more host target binding sites, each having a nucleotide sequence which is at least partly complementary to VGAM365 RNA, herein designated VGAM RNA, and which when bound by VGAM365 RNA causes inhibition of translation of respective one or more VGAM365 host target proteins.

It is further appreciated by one skilled in the art that the mode of translational inhibition illustrated by FIG. 1 with specific reference to translational inhibition exerted by VGAM365 gene, herein designated VGAM GENE, on one or more VGAM365 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM365 is inhibition of expression of host target genes, as part of a novel viral mechanism of attacking a host. Accordingly, utilities of VGAM365 include diagnosis, prevention and treatment of viral infection by Avian Infectious Bronchitis Virus. Specific functions, and accordingly utilities, of VGAM365 correlate with, and may be deduced from, the identity of the host target genes which VGAM365 binds and inhibits, and the function of these host target genes, as elaborated hereinbelow.

Nucleotide sequences of the VGAM365 precursor RNA, herein designated VGAM PRECURSOR RNA, and of the 'diced' VGAM365 RNA, herein designated VGAM RNA, and a schematic representation of the secondary folding of VGAM365 folded precursor RNA, herein designated VGAM FOLDED PRECURSOR RNA, of VGAM365 are further described hereinbelow with reference to Table 1.

Nucleotide sequences of host target binding sites, such as BINDING SITE-I, BINDING SITE-II and BINDING SITE-III of FIG. 1, found on VGAM365 host target RNA, and schematic representation of the complementarity of each of these host target binding sites to VGAM365 RNA, herein designated VGAM RNA, are described hereinbelow with reference to Table 2.

As mentioned hereinabove with reference to FIG. 1, a function of VGAM365 gene, herein designated VGAM is inhibition of expression of VGAM365 target genes. It is appreciated that specific functions, and accordingly utilities, of VGAM365 correlate with, and may be deduced from, the identity of the target genes which VGAM365 binds and inhibits, and the function of these target genes, as elaborated hereinbelow.

Chromosome 20 Open Reading Frame 21 (C20orf21, Accession NM_017798) is a VGAM365 host target gene. C20orf21 BINDING SITE is HOST TARGET binding site found in the 3' untranslated region of mRNA encoded by C20orf21, corresponding to a HOST TARGET binding site such as BINDING SITE I, BINDING SITE II or BINDING SITE III. Table 2 illustrates the complementarity of the nucleotide sequences of C20orf21 BINDING SITE, designated SEQ ID:19442, to the nucleotide sequence of VGAM365 RNA, herein designated VGAM RNA, also designated SEQ ID:3076.

A function of VGAM365 is therefore inhibition of Chromosome 20 Open Reading Frame 21 (C20orf21, Accession NM_017798). Accordingly, utilities of VGAM365 include diagnosis, prevention and treatment of diseases and clinical conditions associated with C20orf21. G Protein-coupled Receptor Kinase-interactor 2 (GIT2, Accession NM_014776) is another VGAM365 host target gene. GIT2 BINDING SITE1 through GIT2 BINDING SITE3 are HOST TARGET binding sites found in untranslated regions of mRNA encoded by GIT2, corresponding to HOST TARGET binding sites such as BINDING SITE I, BINDING SITE II or BINDING SITE III. Table 2 illustrates the complementarity of the nucleotide sequences of GIT2 BINDING SITE1 through GIT2 BINDING SITE3, designated SEQ ID:16595, SEQ ID:27677 and SEQ ID:27690 respectively, to the nucleotide sequence of VGAM365 RNA, herein designated VGAM RNA, also designated SEQ ID:3076.

Another function of VGAM365 is therefore inhibition of G Protein-coupled Receptor Kinase-interactor 2 (GIT2, Accession NM_014776). Accordingly, utilities of VGAM365 include diagnosis, prevention and treatment of diseases and clinical conditions associated with GIT2. MO25 (Accession NM_016289) is another VGAM365 host target gene. MO25 BINDING SITE is HOST TARGET binding site found in the 3' untranslated region of mRNA encoded by MO25, corresponding to a HOST TARGET binding site such as BINDING SITE I, BINDING SITE II or BINDING SITE III. Table 2 illustrates the complementarity of the nucleotide sequences of MO25 BINDING SITE, designated SEQ ID:18412, to the nucleotide sequence of VGAM365 RNA, herein designated VGAM RNA, also designated SEQ ID:3076.

Another function of VGAM365 is therefore inhibition of MO25 (Accession NM_016289). Accordingly, utilities of VGAM365 include diagnosis, prevention and treatment of diseases and clinical conditions associated with MO25. FIG. 1 further provides a conceptual description of a novel bioinformatically detected viral gene of the present invention, referred to here as Viral Genomic Address Messenger 366 (VGAM366) viral gene, which modulates expression of respective host target genes thereof, the function and utility of which host target genes is known in the art.

VGAM366 is a novel bioinformatically detected regulatory, non protein coding, viral micro RNA (miRNA) gene. The method by which VGAM366 was detected is described hereinabove with reference to FIGS. 1-8.

VGAM366 gene, herein designated VGAM GENE, is a viral gene contained in the genome of Avian Infectious Bronchitis Virus. VGAM366 host target gene, herein designated VGAM HOST TARGET GENE, is a human gene contained in the human genome.

VGAM366 gene encodes a VGAM366 precursor RNA, herein designated VGAM PRECURSOR RNA. Similar to other miRNA genes, and unlike most ordinary genes, VGAM366 precursor RNA does not encode a protein. A nucleotide sequence identical or highly similar to the nucleotide sequence of VGAM366 precursor RNA is designated SEQ ID:352, and is provided hereinbelow with reference to the sequence listing part. Nucleotide sequence SEQ ID:352 is located at position 23096 relative to the genome of Avian Infectious Bronchitis Virus.

VGAM366 precursor RNA folds onto itself, forming VGAM366 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM366 folded precursor RNA into VGAM366 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM366 RNA is designated SEQ ID:3077, and is provided hereinbelow with reference to the sequence listing part.

VGAM366 host target gene, herein designated VGAM HOST TARGET GENE, encodes a corresponding messenger RNA, VGAM366 host target RNA, herein designated VGAM HOST TARGET RNA. VGAM366 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM366 RNA, herein designated VGAM RNA, binds complementarily to one or more host target binding sites located in untranslated regions of VGAM366 host target RNA, herein designated VGAM HOST TARGET RNA. This complementary binding is due to the fact that the nucleotide sequence of VGAM366 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM366 RNA, herein designated VGAM RNA, may have a different number of host target binding sites in untranslated regions of a VGAM366 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM366 RNA, herein designated VGAM RNA, to host target binding sites on VGAM366 host target RNA, herein designated VGAM HOST TARGET RNA, such as BINDING SITE I, BINDING SITE II and BINDING SITE III, inhibits translation of VGAM366 host target RNA into VGAM366 host target protein, herein designated VGAM HOST TARGET PROTEIN. VGAM host target protein is therefore outlined by a broken line.

It is appreciated that VGAM366 host target gene, herein designated VGAM HOST TARGET GENE, in fact represents a plurality of VGAM366 host target genes. The mRNA of each one of this plurality of VGAM366 host target genes comprises one or more host target binding sites, each having a nucleotide sequence which is at least partly complementary to VGAM366 RNA, herein designated VGAM RNA, and which when bound by VGAM366 RNA causes inhibition of translation of respective one or more VGAM366 host target proteins.

It is further appreciated by one skilled in the art that the mode of translational inhibition illustrated by FIG. 1 with specific reference to translational inhibition exerted by VGAM366 gene, herein designated VGAM GENE, on one or more VGAM366 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM366 is inhibition of expression of host target genes, as part of a novel viral mechanism of attacking a host. Accordingly, utilities of VGAM366 include diagnosis, prevention and treatment of viral infection by Avian Infectious Bronchitis Virus. Specific functions, and accordingly utilities, of VGAM366 correlate with, and may be deduced from, the identity of the host target genes which VGAM366 binds and inhibits, and the function of these target genes, as elaborated hereinbelow.

Nucleotide sequences of the VGAM366 precursor RNA, herein designated VGAM PRECURSOR RNA, and of the 'diced' VGAM366 RNA, herein designated VGAM RNA, and a schematic representation of the secondary folding of VGAM366 folded precursor RNA, herein designated VGAM FOLDED PRECURSOR RNA, of VGAM366 are further described hereinbelow with reference to Table 1.

Nucleotide sequences of host target binding sites, such as BINDING SITE-I, BINDING SITE-II and BINDING SITE-III of FIG. 1, found on VGAM366 host target RNA, and schematic representation of the complementarity of each of these host target binding sites to VGAM366 RNA, herein designated VGAM RNA, are described hereinbelow with reference to Table 2.

As mentioned hereinabove with reference to FIG. 1, a function of VGAM366 gene, herein designated VGAM is inhibition of expression of VGAM366 target genes. It is appreciated that specific functions, and accordingly utilities, of VGAM366 correlate with, and may be deduced from, the identity of the target genes which VGAM366 binds and inhibits, and the function of these target genes, as elaborated hereinbelow.

Secretory Carrier Membrane Protein 1 (SCAMP1, Accession NM_004866) is a VGAM366 host target gene. SCAMP1 BINDING SITE is HOST TARGET binding site found in the 3' untranslated region of mRNA encoded by SCAMP1, corresponding to a HOST TARGET binding site such as BINDING SITE I, BINDING SITE II or BINDING SITE III. Table 2 illustrates the complementarity of the nucleotide sequences of SCAMP1 BINDING SITE, designated SEQ ID:11291, to the nucleotide sequence of VGAM366 RNA, herein designated VGAM RNA, also designated SEQ ID:3077.

A function of VGAM366 is therefore inhibition of Secretory Carrier Membrane Protein 1 (SCAMP1, Accession NM_004866), a gene which functions in post-golgi recycling pathways and acts as a recycling carrier to the cell surface. Accordingly, utilities of VGAM366 include diagnosis, prevention and treatment of diseases and clinical conditions associated with SCAMP1. The function of SCAMP1 has been established by previous studies. Brand and Castle (1993) cloned SCAMP1, which they called SCAMP37, from a rat brain cDNA library. By screening a HeLa cell cDNA library with the rat cDNA as probe, Singleton et al. (1997) cloned human SCAMP1. They also identified 2 other paralogs, SCAMP2 (OMIM Ref. No. 606912) and SCAMP3 (OMIM Ref. No. 606913), from the HeLa cell library. SCAMP1 encodes a deduced 338-amino acid protein with a calculated molecular mass of 38 kD. The protein shares structural features with SCAMP2 and SCAMP3, including a leucine zipper-like segment, a proline-rich element, an extended central core that includes 4 putative transmembrane domains, a polar segment, and an alanine-rich C terminus. SCAMP1 shares 54% and 57% overall sequence identity with SCAMP2 and SCAMP3, respectively, and 98% identity with the rat homolog. The most divergent regions are in the N terminus. Northern blot analysis detected a 3.3-kb SCAMP1 transcript in all tissues examined, with highest expression in heart, brain, skeletal muscle, and pancreas, intermediate levels in placenta and liver, and low expression in lung and kidney. Immunofluorescent localization in HeLa cells showed punctate staining enriched in the perinuclear compartment and partial colocalization with SCAMP2 and SCAMP3.

Full details of the abovementioned studies are described in the following publications, the disclosure of which are hereby incorporated by reference:

Brand, S. H.; Castle, J. D.: SCAMP-37, a new marker within the general cell surface recycling system. EMBO J. 12:3753-3761, 1993; and Singleton, D. R.; Wu, T. T.; Castle, J. D.: Three mammalian SCAMPs (secretory carrier membrane proteins) are highly related products of distinct genes having similar subcellular distrib.

Further studies establishing the function and utilities of SCAMP1 are found in John Hopkins OMIM database record ID 606911, and in sited publications numbered 513 and 8801 listed in the bibliography section hereinbelow, which are also hereby incorporated by reference. Bladder Cancer Associated Protein (BLCAP, Accession NM_006698) is another VGAM366 host target gene. BLCAP BINDING SITE is HOST TARGET binding site found in the 5' untranslated region of mRNA encoded by BLCAP, corresponding to a HOST TARGET binding site such as BINDING SITE I, BINDING SITE II or BINDING SITE III. Table 2 illustrates the complementarity of the nucleotide sequences of BLCAP BINDING SITE, designated SEQ ID:13521, to the nucleotide sequence of VGAM366 RNA, herein designated VGAM RNA, also designated SEQ ID:3077.

Another function of VGAM366 is therefore inhibition of Bladder Cancer Associated Protein (BLCAP, Accession NM_006698). Accordingly, utilities of VGAM366 include diagnosis, prevention and treatment of diseases and clinical conditions associated with BLCAP. Chromosome 20 Open Reading Frame 108 (C20orf108, Accession NM_080821) is another VGAM366 host target gene. C20orf108 BINDING SITE is HOST TARGET binding site found in the 3' untranslated region of mRNA encoded by C20orf108, corresponding to a HOST TARGET binding site such as BINDING SITE I, BINDING SITE II or BINDING SITE III. Table 2 illustrates the complementarity of the nucleotide sequences of C20orf108 BINDING SITE, designated SEQ ID:28082, to the nucleotide sequence of VGAM366 RNA, herein designated VGAM RNA, also designated SEQ ID:3077.

Another function of VGAM366 is therefore inhibition of Chromosome 20 Open Reading Frame 108 (C20orf108, Accession NM_080821). Accordingly, utilities of VGAM366 include diagnosis, prevention and treatment of diseases and clinical conditions associated with C20orf108. FLJ32332 (Accession NM_144641) is another VGAM366 host target gene. FLJ32332 BINDING SITE is HOST TARGET binding site found in the 3' untranslated region of mRNA encoded by FLJ32332, corresponding to a HOST TARGET binding site such as BINDING SITE I, BINDING SITE II or BINDING SITE III. Table 2 illustrates the complementarity of the nucleotide sequences of FLJ32332 BINDING SITE, designated SEQ ID:29467, to the nucleotide sequence of VGAM366 RNA, herein designated VGAM RNA, also designated SEQ ID:3077.

Another function of VGAM366 is therefore inhibition of FLJ32332 (Accession NM_144641). Accordingly, utilities of VGAM366 include diagnosis, prevention and treatment of diseases and clinical conditions associated with FLJ32332. KIAA0350 (Accession XM_028332) is another VGAM366 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30662, to the nucleotide sequence of VGAM366 RNA, herein designated VGAM RNA, also designated SEQ ID:3077.

Another function of VGAM366 is therefore inhibition of KIAA0350 (Accession XM_028332). Accordingly, utilities of VGAM366 include diagnosis, prevention and treatment of diseases and clinical conditions associated with KIAA0350. KIAA0515 (Accession XM_033380) is another VGAM366 host target gene. KIAA0515 BINDING SITE is HOST TARGET binding site found in the 3' untranslated region of mRNA encoded by KIAA0515, corresponding to a HOST TARGET binding site such as BINDING SITE I, BINDING SITE II or BINDING SITE III. Table 2 illustrates the complementarity of the nucleotide sequences of KIAA0515 BINDING SITE, designated SEQ ID:31921, to the nucleotide sequence of VGAM366 RNA, herein designated VGAM RNA, also designated SEQ ID:3077.

Another function of VGAM366 is therefore inhibition of KIAA0515 (Accession XM_033380). Accordingly, utilities of VGAM366 include diagnosis, prevention and treatment of diseases and clinical conditions associated with KIAA0515. LOC221405 (Accession XM_168138) is another VGAM366 host target gene. LOC221405 BINDING SITE is HOST TARGET binding site found in the 3' untranslated region of mRNA encoded by LOC221405, corresponding to a HOST TARGET binding site such as BINDING SITE I, BINDING SITE II or BINDING SITE III. Table 2 illustrates the complementarity of the nucleotide sequences of LOC221405 BINDING SITE, designated SEQ ID:45067, to the nucleotide sequence of VGAM366 RNA, herein designated VGAM RNA, also designated SEQ ID:3077.

Another function of VGAM366 is therefore inhibition of LOC221405 (Accession XM_168138). Accordingly, utilities of VGAM366 include diagnosis, prevention and treatment of diseases and clinical conditions associated with LOC221405.

FIG. 1 further provides a conceptual description of a novel bioinformatically detected viral gene of the present invention, referred to here as Viral Genomic Address Messenger 367 (VGAM367) viral gene, which modulates expression of respective host target genes thereof, the function and utility of which host target genes is known in the art.

VGAM367 is a novel bioinformatically detected regulatory, non protein coding, viral micro RNA (miRNA) gene. The method by which VGAM367 was detected is described hereinabove with reference to FIGS. 1-8.

VGAM367 gene, herein designated VGAM GENE, is a viral gene contained in the genome of Avian Infectious Bronchitis Virus. VGAM367 host target gene, herein designated VGAM HOST TARGET GENE, is a human gene contained in the human genome.

VGAM367 gene encodes a VGAM367 precursor RNA, herein designated VGAM PRECURSOR RNA. Similar to other miRNA genes, and unlike most ordinary genes, VGAM367 precursor RNA does not encode a protein. A nucleotide sequence identical or highly similar to the nucleotide sequence of VGAM367 precursor RNA is designated SEQ ID:353, and is provided hereinbelow with reference to the sequence listing part. Nucleotide sequence SEQ ID:353 is located at position 22094 relative to the genome of Avian Infectious Bronchitis Virus.

VGAM367 precursor RNA folds onto itself, forming VGAM367 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM367 folded precursor RNA into VGAM367 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM367 RNA is designated SEQ ID:3078, and is provided hereinbelow with reference to the sequence listing part.

VGAM367 host target gene, herein designated VGAM HOST TARGET GENE, encodes a corresponding messenger RNA, VGAM367 host target RNA, herein designated VGAM HOST TARGET RNA. VGAM367 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM367 RNA, herein designated VGAM RNA, binds complementarily to one or more host target binding sites located in untranslated regions of VGAM367 host target RNA, herein designated VGAM HOST TARGET RNA. This complementary binding is due to the fact that the nucleotide sequence of VGAM367 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM367 RNA, herein designated VGAM RNA, may have a different number of host target binding sites in untranslated regions of a VGAM367 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM367 RNA, herein designated VGAM RNA, to host target binding sites on VGAM367 host target RNA, herein designated VGAM HOST TARGET RNA, such as BINDING SITE I, BINDING SITE II and BINDING SITE III, inhibits translation of VGAM367 host target RNA into VGAM367 host target protein, herein designated VGAM HOST TARGET PROTEIN. VGAM host target protein is therefore outlined by a broken line.

It is appreciated that VGAM367 host target gene, herein designated VGAM HOST TARGET GENE, in fact represents a plurality of VGAM367 host target genes. The mRNA of each one of this plurality of VGAM367 host target genes comprises one or more host target binding sites, each having a nucleotide sequence which is at least partly complementary to VGAM367 RNA, herein designated VGAM RNA, and which when bound by VGAM367 RNA causes inhibition of translation of respective one or more VGAM367 host target proteins.

It is further appreciated by one skilled in the art that the mode of translational inhibition illustrated by FIG. 1 with specific reference to translational inhibition exerted by VGAM367 gene, herein designated VGAM GENE, on one or more VGAM367 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM367 is inhibition of expression of host target genes, as part of a novel viral mechanism of attacking a host. Accordingly, utilities of VGAM367 include diagnosis, prevention and treatment of viral infection by Avian Infectious Bronchitis Virus. Specific functions, and accordingly utilities, of VGAM367 correlate with, and may be deduced from, the identity of the host target genes which VGAM367 binds and inhibits, and the function of these host target genes, as elaborated hereinbelow.

Nucleotide sequences of the VGAM367 precursor RNA, herein designated VGAM PRECURSOR RNA, and of the 'diced' VGAM367 RNA, herein designated VGAM RNA, and a schematic representation of the secondary folding of VGAM367 folded precursor RNA, herein designated VGAM FOLDED PRECURSOR RNA, of VGAM367 are further described hereinbelow with reference to Table 1.

Nucleotide sequences of host target binding sites, such as BINDING SITE-I, BINDING SITE-II and BINDING SITE-III of FIG. 1, found on VGAM367 host target RNA, and schematic representation of the complementarity of each of these host target binding sites to VGAM367 RNA, herein designated VGAM RNA, are described hereinbelow with reference to Table 2.

As mentioned hereinabove with reference to FIG. 1, a function of VGAM367 gene, herein designated VGAM is inhibition of expression of VGAM367 target genes. It is appreciated that specific functions, and accordingly utilities, of VGAM367 correlate with, and may be deduced from, the identity of the target genes which VGAM367 binds and inhibits, and the function of these target genes, as elaborated hereinbelow.

Cyclin F (CCNF, Accession NM_001761) is a VGAM367 host target gene. CCNF BINDING SITE is HOST TARGET binding site found in the 3' untranslated region of mRNA encoded by CCNF, corresponding to a HOST TARGET binding site such as BINDING SITE I, BINDING SITE II or BINDING SITE III. Table 2 illustrates the complementarity of the nucleotide sequences of CCNF BINDING SITE, designated SEQ ID:7525, to the nucleotide sequence of VGAM367 RNA, herein designated VGAM RNA, also designated SEQ ID:3078.

A function of VGAM367 is therefore inhibition of Cyclin F (CCNF, Accession NM_001761), a gene which likely to be involved in the control of the cell cycle during s phase and g2. Accordingly, utilities of VGAM367 include diagnosis, prevention and treatment of diseases and clinical conditions associated with CCNF. The function of CCNF has been established by previous studies. While searching in the 16p13.3 region for candidate genes for autosomal dominant polycystic kidney disease (PKD1; 173900), Kraus et al. (1994) identified a new member of the cyclin family. They characterized the transcript by sequencing, determination of exon/intron boundaries, and Northern blot analysis. Cyclin F is related to cyclins A (CCNA; 123835) and B (CCNB; 123836) by sequence, but its function is unknown. Cyclin F is the largest known human cyclin. Obermayr et al. (1995) mapped the gene to mouse chromosome 17 by analysis of hamster/mouse or human/mouse somatic cell hybrids containing Robertsonian translocations. For more accurate mapping, they used the BXD recombinant inbred strain system. Bai et al. (1996) determined that SKP1 (OMIM Ref. No. 601434) binds to CCNF, SKP2 (OMIM Ref. No. 601436), and potentially to other regulatory proteins that may be involved in ubiquitin proteolysis. Binding occurs through a novel motif, termed the F box. The F box contains about 40 residues and, in approximately half of the F-box proteins identified by Bai et al. (1996), it was associated with leucine-rich regions (LRRs), as in SKP2, or with WD40 repeats, as in BTRC (OMIM Ref. No. 603482). The F-box only proteins, including CCNF, contain no other recognizable motifs.

Full details of the abovementioned studies are described in the following publications, the disclosure of which are hereby incorporated by reference:

Kraus, B.; Pohlschmidt, M.; Leung, A. L. S.; Germino, G. G.; Snarey, A.; Schneider, M. C.; Reeders, S. T.; Frischauf, A.-M.: A novel cyclin gene (CCNF) in the region of the polycystic kidney disease gene (PKD1). Genomics 24:27-33, 1994; and Bai, C.; Sen, P.; Hofmann, K.; Ma, L.; Goebl, M.; Harper, J. W.; Elledge, S. J.: SKP1 connects cell cycle regulators to the ubiquitin proteolysis machinery through a novel motif, the F-.

Further studies establishing the function and utilities of CCNF are found in John Hopkins OMIM database record ID 600227, and in sited publications numbered 7551-7553 listed in the bibliography section hereinbelow, which are also hereby incorporated by reference. Disrupted In Renal Carcinoma 1 (DIRC1, Accession NM_052952) is another VGAM367 host target gene. DIRC1 BINDING SITE is HOST TARGET binding site found in the 3' untranslated region of mRNA encoded by DIRC1, corresponding to a HOST TARGET binding site such as BINDING SITE I, BINDING SITE II or BINDING SITE III. Table 2 illustrates the complementarity of the nucleotide sequences of DIRC1 BINDING SITE, designated SEQ ID:27508, to the nucleotide sequence of VGAM367 RNA, herein designated VGAM RNA, also designated SEQ ID:3078.

Another function of VGAM367 is therefore inhibition of Disrupted In Renal Carcinoma 1 (DIRC1, Accession NM_052952), a gene which disrupted in renal carcinoma. Accordingly, utilities of VGAM367 include diagnosis, prevention and treatment of diseases and clinical conditions associated with DIRC1. The function of DIRC1 has been established by previous studies. Podolski et al. (2001) described a reciprocal, balanced, constitutional chromosome translocation, t (2;3)(q33; q21), that is associated with familial clear cell renal cancer. By standard positional cloning strategies, Druck et al. (2001) isolated a gene disrupted by the chromosome 2 breakpoint. The gene, designated DIRC1 (disrupted in renal cancer-1), was disrupted between exons 1 and 2 by the familial translocation. The 1.5-kb DIRC1 mRNA encoded an 11-kD predicted protein of 104 amino acids. RT-PCR analysis detected low-level expression of DIRC1 in adult placenta, testis, ovary, and prostate, and in fetal kidney, spleen, and skeletal muscle. Two familial tumors showed loss of the derivative chromosome 3, as observed in a Dutch kindred with t (2;3)-associated renal cancers in a Dutch family; see 602773. Druck et al. (2001) concluded that further studies were necessary to determine if inactivation of the DIRC1 gene contributes to the development of familial cancers.

Full details of the abovementioned studies are described in the following publications, the disclosure of which are hereby incorporated by reference:

Druck, T.; Podolski, J.; Byrski, T.; Wyrwicz, L.; Zajaczek, S.; Kata, G.; Borowka, A.; Lubinski, J.; Huebner, K.: The DIRC1 gene at chromosome 2q33 spans a familial RCC-associated t (2;3)(q33; q21) chromosome translocation. J. Hum. Genet. 46:583-589, 2001; and Podolski, J.; Zajaczek, S.; Byrski, T.; Druck, T.; Zimonjic, D. B.; Popescu, N. C.; Lubinski, J.; Huebner, K.: Characterization of a familial RCC-associated t (2;3)(q33; q21) chromosome.

Further studies establishing the function and utilities of DIRC1 are found in John Hopkins OMIM database record ID 606423, and in sited publications numbered 4541-4542 listed in the bibliography section hereinbelow, which are also hereby incorporated by reference. KIAA0022 (Accession NM_014880) is another VGAM367 host target gene. KIAA0022 BINDING SITE is HOST TARGET binding site found in the 3' untranslated region of mRNA encoded by KIAA0022, corresponding to a HOST TARGET binding site such as BINDING SITE I, BINDING SITE II or BINDING SITE III. Table 2 illustrates the complementarity of the nucleotide sequences of KIAA0022 BINDING SITE, designated SEQ ID:17028, to the nucleotide sequence of VGAM367 RNA, herein designated VGAM RNA, also designated SEQ ID:3078.

Another function of VGAM367 is therefore inhibition of KIAA0022 (Accession NM_014880). Accordingly, utilities of VGAM367 include diagnosis, prevention and treatment of diseases and clinical conditions associated with KIAA0022. KIAA0265 (Accession XM_045954) is another VGAM367 host target gene. KIAA0265 BINDING SITE is HOST TARGET binding site found in the 3' untranslated region of mRNA encoded by KIAA0265, corresponding to a HOST TARGET binding site such as BINDING SITE I, BINDING SITE II or BINDING SITE III. Table 2 illustrates the complementarity of the nucleotide sequences of KIAA0265 BINDING SITE, designated SEQ ID:34625, to the nucleotide sequence of VGAM367 RNA, herein designated VGAM RNA, also designated SEQ ID:3078.

Another function of VGAM367 is therefore inhibition of KIAA0265 (Accession XM_045954). Accordingly, utilities of VGAM367 include diagnosis, prevention and treatment of diseases and clinical conditions associated with KIAA0265. KIAA0352 (Accession NM_014830) is another VGAM367 host target gene. KIAA0352 BINDING SITE is HOST TARGET binding site found in the 3' untranslated region of mRNA encoded by KIAA0352, corresponding to a HOST TARGET binding site such as BINDING SITE I, BINDING SITE II or BINDING SITE III. Table 2 illustrates the complementarity of the nucleotide sequences of KIAA0352 BINDING SITE, designated SEQ ID:16822, to the nucleotide sequence of VGAM367 RNA, herein designated VGAM RNA, also designated SEQ ID:3078.

Another function of VGAM367 is therefore inhibition of KIAA0352 (Accession NM_014830). Accordingly, utilities of VGAM367 include diagnosis, prevention and treatment of diseases and clinical conditions associated with KIAA0352. KIAA1040 (Accession XM_051091) is another VGAM367 host target gene. KIAA1040 BINDING SITE is HOST TARGET binding site found in the 3' untranslated region of mRNA encoded by KIAA1040, corresponding to a HOST TARGET binding site such as BINDING SITE I, BINDING SITE II or BINDING SITE III. Table 2 illustrates the complementarity of the nucleotide sequences of KIAA1040 BINDING SITE, designated SEQ ID:35744, to the nucleotide sequence of VGAM367 RNA, herein designated VGAM RNA, also designated SEQ ID:3078.

Another function of VGAM367 is therefore inhibition of KIAA1040 (Accession XM_051091). Accordingly, utilities of VGAM367 include diagnosis, prevention and treatment of diseases and clinical conditions associated with KIAA1040. KIAA1093 (Accession XM_039385) is another VGAM367 host target gene. KIAA1093 BINDING SITE is HOST TARGET binding site found in the 5' untranslated region of mRNA encoded by KIAA1093, corresponding to a HOST TARGET binding site such as BINDING SITE I, BINDING SITE II or BINDING SITE III. Table 2 illustrates the complementarity of the nucleotide sequences of KIAA1093 BINDING SITE, designated SEQ ID:33064, to the nucleotide sequence of VGAM367 RNA, herein designated VGAM RNA, also designated SEQ ID:3078.

Another function of VGAM367 is therefore inhibition of KIAA1093 (Accession XM_039385). Accordingly, utilities of VGAM367 include diagnosis, prevention and treatment of diseases and clinical conditions associated with KIAA1093. PFTAIRE Protein Kinase 1 (PFTK1, Accession NM_012395) is another VGAM367 host target gene. PFTK1 BINDING SITE is HOST TARGET binding site found in the 3' untranslated region of mRNA encoded by PFTK1, corresponding to a HOST TARGET binding site such as BIND- ING SITE I, BINDING SITE II or BINDING SITE III. Table 2 illustrates the complementarity of the nucleotide sequences of PFTK1 BINDING SITE, designated SEQ ID:14754, to the nucleotide sequence of VGAM367 RNA, herein designated VGAM RNA, also designated SEQ ID:3078.

Another function of VGAM367 is therefore inhibition of PFTAIRE Protein Kinase 1 (PFTK1, Accession NM_012395). Accordingly, utilities of VGAM367 include diagnosis, prevention and treatment of diseases and clinical conditions associated with PFTK1. LOC150468 (Accession XM_086926) is another VGAM367 host target gene. LOC150468 BINDING SITE is HOST TARGET binding site found in the 5' untranslated region of mRNA encoded by LOC150468, corresponding to a HOST TARGET binding site such as BINDING SITE I, BINDING SITE II or BINDING SITE III. Table 2 illustrates the complementarity of the nucleotide sequences of LOC150468 BINDING SITE, designated SEQ ID:38975, to the nucleotide sequence of VGAM367 RNA, herein designated VGAM RNA, also designated SEQ ID:3078.

Another function of VGAM367 is therefore inhibition of LOC150468 (Accession XM_086926). Accordingly, utilities of VGAM367 include diagnosis, prevention and treatment of diseases and clinical conditions associated with LOC150468. LOC158314 (Accession XM_098920) is another VGAM367 host target gene. LOC158314 BINDING SITE is HOST TARGET binding site found in the 3' untranslated region of mRNA encoded by LOC158314, corresponding to a HOST TARGET binding site such as BINDING SITE I, BINDING SITE II or BINDING SITE III. Table 2 illustrates the complementarity of the nucleotide sequences of LOC158314 BINDING SITE, designated SEQ ID:41954, to the nucleotide sequence of VGAM367 RNA, herein designated VGAM RNA, also designated SEQ ID:3078.

Another function of VGAM367 is therefore inhibition of LOC158314 (Accession XM_098920). Accordingly, utilities of VGAM367 include diagnosis, prevention and treatment of diseases and clinical conditions associated with LOC158314. FIG. 1 further provides a conceptual description of a novel bioinformatically detected viral gene of the present invention, referred to here as Viral Genomic Address Messenger 368 (VGAM368) viral gene, which modulates expression of respective host target genes thereof, the function and utility of which host target genes is known in the art.

VGAM368 is a novel bioinformatically detected regulatory, non protein coding, viral micro RNA (miRNA) gene. The method by which VGAM368 was detected is described hereinabove with reference to FIGS. 1-8.

VGAM368 gene, herein designated VGAM GENE, is a viral gene contained in the genome of Avian Infectious Bronchitis Virus. VGAM368 host target gene, herein designated VGAM HOST TARGET GENE, is a human gene contained in the human genome.

VGAM368 gene encodes a VGAM368 precursor RNA, herein designated VGAM PRECURSOR RNA. Similar to other miRNA genes, and unlike most ordinary genes, VGAM368 precursor RNA does not encode a protein. A nucleotide sequence identical or highly similar to the nucleotide sequence of VGAM368 precursor RNA is designated SEQ ID:354, and is provided hereinbelow with reference to the sequence listing part. Nucleotide sequence SEQ ID:354 is located at position 22912 relative to the genome of Avian Infectious Bronchitis Virus.

VGAM368 precursor RNA folds onto itself, forming VGAM368 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM368 folded precursor RNA into VGAM368 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM368 RNA is designated SEQ ID:3079, and is provided hereinbelow with reference to the sequence listing part.

VGAM368 host target gene, herein designated VGAM HOST TARGET GENE, encodes a corresponding messenger RNA, VGAM368 host target RNA, herein designated VGAM HOST TARGET RNA. VGAM368 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM368 RNA, herein designated VGAM RNA, binds complementarily to one or more host target binding sites located in untranslated regions of VGAM368 host target RNA, herein designated VGAM HOST TARGET RNA. This complementary binding is due to the fact that the nucleotide sequence of VGAM368 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM368 RNA, herein designated VGAM RNA, may have a different number of host target binding sites in untranslated regions of a VGAM368 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM368 RNA, herein designated VGAM RNA, to host target binding sites on VGAM368 host target RNA, herein designated VGAM HOST TARGET RNA, such as BINDING SITE I, BINDING SITE II and BINDING SITE III, inhibits translation of VGAM368 host target RNA into VGAM368 host target protein, herein designated VGAM HOST TARGET PROTEIN. VGAM host target protein is therefore outlined by a broken line.

It is appreciated that VGAM368 host target gene, herein designated VGAM HOST TARGET GENE, in fact represents a plurality of VGAM368 host target genes. The mRNA of each one of this plurality of VGAM368 host target genes comprises one or more host target binding sites, each having a nucleotide sequence which is at least partly complementary to VGAM368 RNA, herein designated VGAM RNA, and which when bound by VGAM368 RNA causes inhibition of translation of respective one or more VGAM368 host target proteins.

It is further appreciated by one skilled in the art that the mode of translational inhibition illustrated by FIG. 1 with specific reference to translational inhibition exerted by VGAM368 gene, herein designated VGAM GENE, on one or more VGAM368 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM368 is inhibition of expression of host target genes, as part of a novel viral mechanism of attacking a host. Accordingly, utilities of VGAM368 include diagnosis, prevention and treatment of viral infection by Avian Infectious Bronchitis Virus. Specific functions, and accordingly utilities, of VGAM368 correlate with, and may be deduced from, the identity of the host target genes which VGAM368 binds and inhibits, and the function of these host target genes, as elaborated hereinbelow.

Nucleotide sequences of the VGAM368 precursor RNA, herein designated VGAM PRECURSOR RNA, and of the 'diced' VGAM368 RNA, herein designated VGAM RNA, and a schematic representation of the secondary folding of VGAM368 folded precursor RNA, herein designated VGAM FOLDED PRECURSOR RNA, of VGAM368 are further described hereinbelow with reference to Table 1.

Nucleotide sequences of host target binding sites, such as BINDING SITE-I, BINDING SITE-II and BINDING SITE-III of FIG. 1, found on VGAM368 host target RNA, and schematic representation of the complementarity of each of these host target binding sites to VGAM368 RNA, herein designated VGAM RNA, are described hereinbelow with reference to Table 2.

As mentioned hereinabove with reference to FIG. 1, a function of VGAM368 gene, herein designated VGAM is inhibition of expression of VGAM368 target genes. It is appreciated that specific functions, and accordingly utilities, of VGAM368 correlate with, and may be deduced from, the identity of the target genes which VGAM368 binds and inhibits, and the function of these target genes, as elaborated hereinbelow.

Aryl Hydrocarbon Receptor (AHR, Accession NM_001621) is a VGAM368 host target gene. AHR BINDING SITE is HOST TARGET binding site found in the 3" untranslated region of mRNA encoded by AHR, corresponding to a HOST TARGET binding site such as BINDING SITE I, BINDING SITE II or BINDING SITE III. Table 2 illustrates the complementarity of the nucleotide sequences of AHR BINDING SITE, designated SEQ ID:7337, to the nucleotide sequence of VGAM368 RNA, herein designated VGAM RNA, also designated SEQ ID:3079.

A function of VGAM368 is therefore inhibition of Aryl Hydrocarbon Receptor (AHR, Accession NM_001621), a gene which plays a role in modulating carcinogenesis through the induction of xenobiotic-metabolizing enzymes. Accordingly, utilities of VGAM368 include diagnosis, prevention and treatment of diseases and clinical conditions associated with AHR. The function of AHR has been established by previous studies. Halogenated aromatic hydrocarbons, represented by 2,3,7,8-tetrachlorodibenzo-p-dioxin (TCDD), are environmental pollutants that are produced by minor side-reactions in chemical manufacturing processes and by combustion of waste materials. These chemicals cause potent and pleiotropic toxicity, including teratogenesis, immune suppression, epithelial disorders, and tumor production in experimental animals. At the molecular level, aldehyde dehydrogenase, quinone reductase, and various drug-metabolizing enzymes are induced by the chemicals in some cultured cells and some tissues of experimental animals. All these biologic effects are thought to be mediated by an intracellular aryl hydrocarbon receptor (AHR). By fluorescence in situ hybridization and by DNA blot hybridization using human/mouse or human/Chinese hamster hybrid cell DNAs, Ema et al. (1994) assigned the AHR gene to 7p21. By use of PCR analysis of somatic cell hybrids and fluorescence in situ hybridization of metaphase cells, Le Beau et al. (1994) localized the AHR gene to 7p21-p15. Micka et al. (1997) localized the AHR gene to 7p15 using fluorescence in situ hybridization. Performing linkage analysis in a 3-generation family, they showed with good probability that the high CYP1A1 (OMIM Ref. No. 108330) inducibility phenotype segregates with the 7p15 region. Animal model experiments lend further support to the function of AHR. To determine whether the aryl hydrocarbon receptor plays a role in modulating carcinogenesis through the induction of xenobiotic-metabolizing enzymes, Shimizu et al. (2000) studied Ahr-deficient mice exposed to benzo (a) pyrene, a widely distributed environmental carcinogen.

It is appreciated that the abovementioned animal model for AHR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ema, M.; Matsushita, N.; Sogawa, K.; Ariyama, T.; Inazawa, J.; Nemoto, T.; Ota, M.; Oshimura, M.; Fujii-Kuriyama, Y.: Human arylhydrocarbon receptor: functional expression and chromosomal assignment to 7p21. J. Biochem. 116:845-851, 1994; and Shimizu, Y.; Nakatsuru, Y.; Ichinose, M.; Takahashi, Y.; Kume, H.; Mimura, J.; Fujii-Kuriyama, Y.; Ishikawa, T.: Benzo[a]pyrene carcinogenicity is lost in mice lacking the aryl hydrocar.

Further studies establishing the function and utilities of AHR are found in John Hopkins OMIM database record ID 600253, and in sited publications numbered 8279-8281, 771 and 8282-8283 listed in the bibliography section hereinbelow, which are also hereby incorporated by reference. Astrotactin (ASTN, Accession XM_045113) is another VGAM368 host target gene. ASTN BINDING SITE is HOST TARGET binding site found in the 3' untranslated region of mRNA encoded by ASTN, corresponding to a HOST TARGET binding site such as BINDING SITE I, BINDING SITE II or BINDING SITE III. Table 2 illustrates the complementarity of the nucleotide sequences of ASTN BINDING SITE, designated SEQ ID:34363, to the nucleotide sequence of VGAM368 RNA, herein designated VGAM RNA, also designated SEQ ID:3079.

Another function of VGAM368 is therefore inhibition of Astrotactin (ASTN, Accession XM_045113). Accordingly, utilities of VGAM368 include diagnosis, prevention and treatment of diseases and clinical conditions associated with ASTN. Estrogen-related Receptor Beta Like 1 (ESRRBL1, Accession NM_018010) is another VGAM368 host target gene. ESRRBL1 BINDING SITE is HOST TARGET binding site found in the 3' untranslated region of mRNA encoded by ESRRBL1, corresponding to a HOST TARGET binding site such as BINDING SITE I, BINDING SITE II or BINDING SITE III. Table 2 illustrates the complementarity of the nucleotide sequences of ESRRBL1 BINDING SITE, designated SEQ ID:19740, to the nucleotide sequence of VGAM368

RNA, herein designated VGAM RNA, also designated SEQ ID:3079.

Another function of VGAM368 is therefore inhibition of Estrogen-related Receptor Beta Like 1 (ESRRBL1, Accession NM_018010). Accordingly, utilities of VGAM368 include diagnosis, prevention and treatment of diseases and clinical conditions associated with ESRRBL1. Guanylate Cyclase 1, Soluble, Alpha 3 (GUCY1A3, Accession XM_032838) is another VGAM368 host target gene. GUCY1A3 BINDING SITE is HOST TARGET binding site found in the 5' untranslated region of mRNA encoded by GUCY1A3, corresponding to a HOST TARGET binding site such as BINDING SITE I, BINDING SITE II or BINDING SITE III. Table 2 illustrates the complementarity of the nucleotide sequences of GUCY1A3 BINDING SITE, designated SEQ ID:31778, to the nucleotide sequence of VGAM368 RNA, herein designated VGAM RNA, also designated SEQ ID:3079.

Another function of VGAM368 is therefore inhibition of Guanylate Cyclase 1, Soluble, Alpha 3 (GUCY1A3, Accession XM_032838), a gene which is alpha 1 (alpha 3) subunit of soluble guanylate cyclase and forms a heterodimer with GUCY1B3 that converts GTP to cGMP. Accordingly, utilities of VGAM368 include diagnosis, prevention and treatment of diseases and clinical conditions associated with GUCY1A3. The function of GUCY1A3 and its association with various diseases and clinical conditions, has been established by previous studies, as described hereinabove with reference to VGAM206. L-3-hydroxyacyl-Coenzyme A Dehydrogenase, Short Chain (HADHSC, Accession NM_005327) is another VGAM368 host target gene. HADHSC BINDING SITE is HOST TARGET binding site found in the 3' untranslated region of mRNA encoded by HADHSC, corresponding to a HOST TARGET binding site such as BINDING SITE I, BINDING SITE II or BINDING SITE III. Table 2 illustrates the complementarity of the nucleotide sequences of HADHSC BINDING SITE, designated SEQ ID:11799, to the nucleotide sequence of VGAM368 RNA, herein designated VGAM RNA, also designated SEQ ID:3079.

Another function of VGAM368 is therefore inhibition of L-3-hydroxyacyl-Coenzyme A Dehydrogenase, Short Chain (HADHSC, Accession NM_005327). Accordingly, utilities of VGAM368 include diagnosis, prevention and treatment of diseases and clinical conditions associated with HADHSC. Interleukin 24 (IL24, Accession NM_006850) is another VGAM368 host target gene. IL24 BINDING SITE is HOST TARGET binding site found in the 3' untranslated region of mRNA encoded by IL24, corresponding to a HOST TARGET binding site such as BINDING SITE I, BINDING SITE II or BINDING SITE III. Table 2 illustrates the complementarity of the nucleotide sequences of IL24 BINDING SITE, designated SEQ ID:13720, to the nucleotide sequence of VGAM368 RNA, herein designated VGAM RNA, also designated SEQ ID:3079.

Another function of VGAM368 is therefore inhibition of Interleukin 24 (IL24, Accession NM_006850), a gene which may contribute to terminal cell differentiation. Accordingly, utilities of VGAM368 include diagnosis, prevention and treatment of diseases and clinical conditions associated with IL24. The function of IL24 and its association with various diseases and clinical conditions, has been established by previous studies, as described hereinabove with reference to VGAM258. Phosphatase and Tensin Homolog (mutated in multiple advanced cancers 1) (PTEN, Accession NM_000314) is another VGAM368 host target gene. PTEN BINDING SITE is HOST TARGET binding site found in the 3' untranslated region of mRNA encoded by PTEN, corresponding to a HOST TARGET binding site such as BINDING SITE I, BINDING SITE II or BINDING SITE III. Table 2 illustrates the complementarity of the nucleotide sequences of PTEN BINDING SITE, designated SEQ ID:5858, to the nucleotide sequence of VGAM368 RNA, herein designated VGAM RNA, also designated SEQ ID:3079.

Another function of VGAM368 is therefore inhibition of Phosphatase and Tensin Homolog (mutated in multiple advanced cancers 1) (PTEN, Accession NM_000314). Accordingly, utilities of VGAM368 include diagnosis, prevention and treatment of diseases and clinical conditions associated with PTEN. Retinoic Acid Receptor, Beta (RARB, Accession NM_016152) is another VGAM368 host target gene. RARB BINDING SITE1 and RARB BINDING SITE2 are HOST TARGET binding sites found in untranslated regions of mRNA encoded by RARB, corresponding to HOST TARGET binding sites such as BINDING SITE I, BINDING SITE II or BINDING SITE III. Table 2 illustrates the complementarity of the nucleotide sequences of RARB BINDING SITE1 and RARB BINDING SITE2, designated SEQ ID:18236 and SEQ ID:6692 respectively, to the nucleotide sequence of VGAM368 RNA, herein designated VGAM RNA, also designated SEQ ID:3079.

Another function of VGAM368 is therefore inhibition of Retinoic Acid Receptor, Beta (RARB, Accession NM_016152), a gene which is one member of the steroid/thyroid hormone receptor family of ligand-activated transcription factors. Accordingly, utilities of VGAM368 include diagnosis, prevention and treatment of diseases and clinical conditions associated with RARB. The function of RARB and its association with various diseases and clinical conditions, has been established by previous studies, as described hereinabove with reference to VGAM179. A Kinase (PRKA) Anchor Protein 11 (AKAP11, Accession NM_016248) is another VGAM368 host target gene. AKAP11 BINDING SITE is HOST TARGET binding site found in the 3' untranslated region of mRNA encoded by AKAP11, corresponding to a HOST TARGET binding site such as BINDING SITE I, BINDING SITE II or BINDING SITE III. Table 2 illustrates the complementarity of the nucleotide sequences of AKAP11 BINDING SITE, designated SEQ ID:18366, to the nucleotide sequence of VGAM368 RNA, herein designated VGAM RNA, also designated SEQ ID:3079.

Another function of VGAM368 is therefore inhibition of A Kinase (PRKA) Anchor Protein 11 (AKAP11, Accession NM_016248). Accordingly, utilities of VGAM368 include diagnosis, prevention and treatment of diseases and clinical conditions associated with AKAP11. BMF (Accession NM_033503) is another VGAM368 host target gene. BMF BINDING SITE is HOST TARGET binding site found in the 3' untranslated region of mRNA encoded by BMF, corresponding to a HOST TARGET binding site such as BINDING SITE I, BINDING SITE II or BINDING SITE III. Table 2 illustrates the complementarity of the nucleotide sequences of BMF BINDING SITE, designated SEQ ID:27281, to the nucleotide sequence of VGAM368 RNA, herein designated VGAM RNA, also designated SEQ ID:3079.

Another function of VGAM368 is therefore inhibition of BMF (Accession NM_033503). Accordingly, utilities of VGAM368 include diagnosis, prevention and treatment of diseases and clinical conditions associated with BMF. C1q and Tumor Necrosis Factor Related Protein 7 (C1QTNF7, Accession NM_031911) is another VGAM368 host target gene. C1QTNF7 BINDING SITE is HOST TARGET binding site found in the 3' untranslated region of mRNA encoded by C1QTNF7, corresponding to a HOST TARGET binding site such as BINDING SITE I, BINDING SITE II or BINDING SITE III. Table 2 illustrates the complementarity of the nucleotide sequences of C1QTNF7 BINDING SITE, designated SEQ ID:25667, to the nucleotide sequence of VGAM368 RNA, herein designated VGAM RNA, also designated SEQ ID:3079.

Another function of VGAM368 is therefore inhibition of C1q and Tumor Necrosis Factor Related Protein 7 (C1QTNF7, Accession NM_031911). Accordingly, utilities of VGAM368 include diagnosis, prevention and treatment of diseases and clinical conditions associated with C1QTNF7. Chromosome 6 Open Reading Frame 37 (C6orf37, Accession XM_041375) is another VGAM368 host target gene. C6orf37 BINDING SITE is HOST TARGET binding site found in the 3" untranslated region of mRNA encoded by C6orf37, corresponding to a HOST TARGET binding site such as BINDING SITE I, BINDING SITE II or BINDING SITE III. Table 2 illustrates the complementarity of the nucleotide sequences of C6orf37 BINDING SITE, designated SEQ ID:33513, to the nucleotide sequence of VGAM368 RNA, herein designated VGAM RNA, also designated SEQ ID:3079.

Another function of VGAM368 is therefore inhibition of Chromosome 6 Open Reading Frame 37 (C6orf37, Accession XM_041375). Accordingly, utilities of VGAM368 include diagnosis, prevention and treatment of diseases and clinical conditions associated with C6orf37. Claudin 1 (CLDN1, Accession NM_021101) is another VGAM368 host target gene. CLDN1 BINDING SITE is HOST TARGET binding site found in the 3' untranslated region of mRNA encoded by CLDN1, corresponding to a HOST TARGET binding site such as BINDING SITE I, BINDING SITE II or BINDING SITE III. Table 2 illustrates the complementarity of the nucleotide sequences of CLDN1 BINDING SITE, designated SEQ ID:22082, to the nucleotide sequence of VGAM368 RNA, herein designated VGAM RNA, also designated SEQ ID:3079.

Another function of VGAM368 is therefore inhibition of Claudin 1 (CLDN1, Accession NM_021101). Accordingly, utilities of VGAM368 include diagnosis, prevention and treatment of diseases and clinical conditions associated with CLDN1. DKFZP434K0427 (Accession NM_032148) is another VGAM368 host target gene. DKFZP434K0427 BINDING SITE is HOST TARGET binding site found in the 5' untranslated region of mRNA encoded by DKFZP434K0427, corresponding to a HOST TARGET binding site such as BINDING SITE I, BINDING SITE II or BINDING SITE III. Table 2 illustrates the complementarity of the nucleotide sequences of DKFZP434K0427 BINDING SITE, designated SEQ ID:25840, to the nucleotide sequence of VGAM368 RNA, herein designated VGAM RNA, also designated SEQ ID:3079.

Another function of VGAM368 is therefore inhibition of DKFZP434K0427 (Accession NM_032148). Accordingly, utilities of VGAM368 include diagnosis, prevention and treatment of diseases and clinical conditions associated with DKFZP434K0427. DKFZP586P0123 (Accession XM_170681) is another VGAM368 host target gene. DKFZP586P0123 BINDING SITE is HOST TARGET binding site found in the 5' untranslated region of mRNA encoded by DKFZP586P0123, corresponding to a HOST TARGET binding site such as BINDING SITE I, BINDING SITE II or BINDING SITE III. Table 2 illustrates the complementarity of the nucleotide sequences of DKFZP586P0123 BINDING SITE, designated SEQ ID:45465, to the nucleotide sequence of VGAM368 RNA, herein designated VGAM RNA, also designated SEQ ID:3079.

Another function of VGAM368 is therefore inhibition of DKFZP586P0123 (Accession XM_170681). Accordingly, utilities of VGAM368 include diagnosis, prevention and treatment of diseases and clinical conditions associated with DKFZP586P0123. FLJ10283 (Accession NM_018046) is another VGAM368 host target gene. FLJ10283 BINDING SITE is HOST TARGET binding site found in the 5' untranslated region of mRNA encoded by FLJ10283, corresponding to a HOST TARGET binding site such as BINDING SITE I, BINDING SITE II or BINDING SITE III. Table 2 illustrates the complementarity of the nucleotide sequences of FLJ10283 BINDING SITE, designated SEQ ID:19795, to the nucleotide sequence of VGAM368 RNA, herein designated VGAM RNA, also designated SEQ ID:3079.

Another function of VGAM368 is therefore inhibition of FLJ10283 (Accession NM_018046). Accordingly, utilities of VGAM368 include diagnosis, prevention and treatment of diseases and clinical conditions associated with FLJ10283. FLJ10525 (Accession NM_018126) is another VGAM368 host target gene. FLJ10525 BINDING SITE is HOST TARGET binding site found in the 3' untranslated region of mRNA encoded by FLJ10525, corresponding to a HOST TARGET binding site such as BINDING SITE I, BINDING SITE II or BINDING SITE III. Table 2 illustrates the complementarity of the nucleotide sequences of FLJ10525 BINDING SITE, designated SEQ ID:19914, to the nucleotide sequence of VGAM368 RNA, herein designated VGAM RNA, also designated SEQ ID:3079.

Another function of VGAM368 is therefore inhibition of FLJ10525 (Accession NM_018126). Accordingly, utilities of VGAM368 include diagnosis, prevention and treatment of diseases and clinical conditions associated with FLJ10525. KIAA0410 (Accession NM_014778) is another VGAM368 host target gene. KIAA0410 BINDING SITE is HOST TARGET binding site found in the 3' untranslated region of mRNA encoded by KIAA0410, corresponding to a HOST TARGET binding site such as BINDING SITE I, BINDING SITE II or BINDING SITE III. Table 2 illustrates the complementarity of the nucleotide sequences of KIAA0410 BINDING SITE, designated SEQ ID:16615, to the nucleotide sequence of VGAM368 RNA, herein designated VGAM RNA, also designated SEQ ID:3079.

Another function of VGAM368 is therefore inhibition of KIAA0410 (Accession NM_014778). Accordingly, utilities of VGAM368 include diagnosis, prevention and treatment of diseases and clinical conditions associated with KIAA0410. MGC16384 (Accession NM_053048) is another VGAM368 host target gene. MGC16384 BINDING SITE is HOST TARGET binding site found in the 3' untranslated region of mRNA encoded by MGC16384, corresponding to a HOST TARGET binding site such as BINDING SITE I, BINDING SITE II or BINDING SITE III. Table 2 illustrates the complementarity of the nucleotide sequences of MGC16384 BINDING SITE, designated SEQ ID:27595, to the nucleotide sequence of VGAM368 RNA, herein designated VGAM RNA, also designated SEQ ID:3079.

Another function of VGAM368 is therefore inhibition of MGC16384 (Accession NM_053048). Accordingly, utilities of VGAM368 include diagnosis, prevention and treatment of diseases and clinical conditions associated with MGC16384. SAE1 (Accession NM_005500) is another VGAM368 host target gene. SAE1 BINDING SITE is HOST TARGET binding site found in the 3' untranslated region of mRNA encoded by SAE1, corresponding to a HOST TARGET binding site such as BINDING SITE I, BINDING SITE II or BINDING SITE III. Table 2 illustrates the complementarity of the nucleotide sequences of SAE1 BINDING SITE, designated SEQ ID:12003, to the nucleotide sequence of VGAM368 RNA, herein designated VGAM RNA, also designated SEQ ID:3079.

Another function of VGAM368 is therefore inhibition of SAE1 (Accession NM_005500). Accordingly, utilities of VGAM368 include diagnosis, prevention and treatment of diseases and clinical conditions associated with SAE1. SDS3 (Accession XM_045014) is another VGAM368 host target gene. SDS3 BINDING SITE is HOST TARGET binding site found in the 3' untranslated region of mRNA encoded by SDS3, corresponding to a HOST TARGET binding site such as BINDING SITE I, BINDING SITE II or BINDING SITE III. Table 2 illustrates the complementarity of the nucleotide sequences of SDS3 BINDING SITE, designated SEQ ID:34320, to the nucleotide sequence of VGAM368 RNA, herein designated VGAM RNA, also designated SEQ ID:3079.

Another function of VGAM368 is therefore inhibition of SDS3 (Accession XM_045014). Accordingly, utilities of VGAM368 include diagnosis, prevention and treatment of diseases and clinical conditions associated with SDS3. Sema Domain, Immunoglobulin Domain (Ig), Transmembrane Domain (TM) and Short Cytoplasmic Domain, (semaphorin) 4G (SEMA4G, Accession XM_170638) is another VGAM368 host target gene. SEMA4G BINDING SITE is HOST TARGET binding site found in the 5' untranslated region of mRNA encoded by SEMA4G, corresponding to a HOST TARGET binding site such as BINDING SITE I, BINDING SITE II or BINDING SITE III. Table 2 illustrates the complementarity of the nucleotide sequences of SEMA4G BINDING SITE, designated SEQ ID:45414, to the nucleotide sequence of VGAM368 RNA, herein designated VGAM RNA, also designated SEQ ID:3079.

Another function of VGAM368 is therefore inhibition of Sema Domain, Immunoglobulin Domain (Ig), Transmembrane Domain (TM) and Short Cytoplasmic Domain, (semaphorin) 4G (SEMA4G, Accession XM_170638). Accordingly, utilities of VGAM368 include diagnosis, prevention and treatment of diseases and clinical conditions associated with SEMA4G. LOC113115 (Accession NM_138419) is another VGAM368 host target gene. LOC113115 BINDING SITE is HOST TARGET binding site found in the 5' untranslated region of mRNA encoded by LOC113115, corresponding to a HOST TARGET binding site such as BINDING SITE I, BINDING SITE II or BINDING SITE III. Table 2 illustrates the complementarity of the nucleotide sequences of LOC113115 BINDING SITE, designated SEQ ID:28789, to the nucleotide sequence of VGAM368 RNA, herein designated VGAM RNA, also designated SEQ ID:3079.

Another function of VGAM368 is therefore inhibition of LOC113115 (Accession NM_138419). Accordingly, utilities of VGAM368 include diagnosis, prevention and treatment of diseases and clinical conditions associated with LOC113115. LOC125228 (Accession XM_058913) is another VGAM368 host target gene. LOC125228 BINDING SITE is HOST TARGET binding site found in the 3' untranslated region of mRNA encoded by LOC125228, corresponding to a HOST TARGET binding site such as BINDING SITE I, BINDING SITE II or BINDING SITE III. Table 2 illustrates the complementarity of the nucleotide sequences of LOC125228 BINDING SITE, designated SEQ ID:36791, to the nucleotide sequence of VGAM368 RNA, herein designated VGAM RNA, also designated SEQ ID:3079.

Another function of VGAM368 is therefore inhibition of LOC125228 (Accession XM_058913). Accordingly, utilities of VGAM368 include diagnosis, prevention and treatment of diseases and clinical conditions associated with LOC125228. LOC144848 (Accession XM_056770) is another VGAM368 host target gene. LOC144848 BINDING SITE is HOST TARGET binding site found in the 3' untranslated region of mRNA encoded by LOC144848, corresponding to a HOST TARGET binding site such as BINDING SITE I, BINDING SITE II or BINDING SITE III. Table 2 illustrates the complementarity of the nucleotide sequences of LOC144848 BINDING SITE, designated SEQ ID:36422, to the nucleotide sequence of VGAM368 RNA, herein designated VGAM RNA, also designated SEQ ID:3079.

Another function of VGAM368 is therefore inhibition of LOC144848 (Accession XM_056770). Accordingly, utilities of VGAM368 include diagnosis, prevention and treatment of diseases and clinical conditions associated with LOC144848. LOC145622 (Accession XM_085186) is another VGAM368 host target gene. LOC145622 BINDING SITE is HOST TARGET binding site found in the 5' untranslated region of mRNA encoded by LOC145622, corresponding to a HOST TARGET binding site such as BINDING SITE I, BINDING SITE II or BINDING SITE III. Table 2 illustrates the complementarity of the nucleotide sequences of LOC145622 BINDING SITE, designated SEQ ID:37913, to the nucleotide sequence of VGAM368 RNA, herein designated VGAM RNA, also designated SEQ ID:3079.

Another function of VGAM368 is therefore inhibition of LOC145622 (Accession XM_085186). Accordingly, utilities of VGAM368 include diagnosis, prevention and treatment of diseases and clinical conditions associated with LOC145622. LOC151996 (Accession XM_098151) is another VGAM368 host target gene. LOC151996 BINDING SITE is HOST TARGET binding site found in the 5' untranslated region of mRNA encoded by LOC151996, corresponding to a HOST TARGET binding site such as BINDING SITE I, BINDING SITE II or BINDING SITE III. Table 2 illustrates the complementarity of the nucleotide sequences of LOC151996 BINDING SITE, designated SEQ ID:41415, to the nucleotide sequence of VGAM368 RNA, herein designated VGAM RNA, also designated SEQ ID:3079.

Another function of VGAM368 is therefore inhibition of LOC151996 (Accession XM_098151). Accordingly, utilities of VGAM368 include diagnosis, prevention and treatment of diseases and clinical conditions associated with LOC151996. LOC157273 (Accession XM_098743) is another VGAM368 host target gene. LOC157273 BINDING SITE is HOST TARGET binding site found in the 3' untranslated region of mRNA encoded by LOC157273, corresponding to a HOST TARGET binding site such as BINDING SITE I, BINDING SITE II or BINDING SITE III. Table 2 illustrates the complementarity of the nucleotide sequences of LOC157273 BINDING SITE, designated SEQ ID:41780, to the nucleotide sequence of VGAM368 RNA, herein designated VGAM RNA, also designated SEQ ID:3079.

Another function of VGAM368 is therefore inhibition of LOC157273 (Accession XM_098743). Accordingly, utilities of VGAM368 include diagnosis, prevention and treatment of diseases and clinical conditions associated with LOC157273. LOC160897 (Accession XM_090573) is another VGAM368 host target gene. LOC160897 BINDING SITE is HOST TARGET binding site found in the 3' untranslated region of mRNA encoded by LOC160897, corresponding to a HOST TARGET binding site such as BINDING SITE I, BINDING SITE II or BINDING SITE III. Table 2 illustrates the complementarity of the nucleotide sequences of LOC160897 BINDING SITE, designated SEQ ID:40010, to the nucleotide sequence of VGAM368 RNA, herein designated VGAM RNA, also designated SEQ ID:3079.

Another function of VGAM368 is therefore inhibition of LOC160897 (Accession XM_090573). Accordingly, utilities of VGAM368 include diagnosis, prevention and treatment of diseases and clinical conditions associated with LOC160897. LOC200347 (Accession XM_114219) is another VGAM368 host target gene. LOC200347 BINDING SITE is HOST TARGET binding site found in the 5' untranslated region of mRNA encoded by LOC200347, corresponding to a HOST TARGET binding site such as BINDING SITE I, BINDING SITE II or BINDING SITE III. Table 2 illustrates the complementarity of the nucleotide sequences of LOC200347 BINDING SITE, designated SEQ ID:42807, to the nucleotide sequence of VGAM368 RNA, herein designated VGAM RNA, also designated SEQ ID:3079.

Another function of VGAM368 is therefore inhibition of LOC200347 (Accession XM_114219). Accordingly, utilities of VGAM368 include diagnosis, prevention and treatment of diseases and clinical conditions associated with LOC200347. LOC220729 (Accession XM_049575) is another VGAM368 host target gene. LOC220729 BINDING SITE is HOST TARGET binding site found in the 3' untranslated region of mRNA encoded by LOC220729, corresponding to a HOST TARGET binding site such as BINDING SITE I, BINDING SITE II or BINDING SITE III. Table 2 illustrates the complementarity of the nucleotide sequences of LOC220729 BINDING SITE, designated SEQ ID:35448, to the nucleotide sequence of VGAM368 RNA, herein designated VGAM RNA, also designated SEQ ID:3079.

Another function of VGAM368 is therefore inhibition of LOC220729 (Accession XM_049575). Accordingly, utilities of VGAM368 include diagnosis, prevention and treatment of diseases and clinical conditions associated with LOC220729. LOC256337 (Accession XM_170643) is another VGAM368 host target gene. LOC256337 BINDING SITE is HOST TARGET binding site found in the 3' untranslated region of mRNA encoded by LOC256337, corresponding to a HOST TARGET binding site such as BINDING SITE I, BINDING SITE II or BINDING SITE III. Table 2 illustrates the complementarity of the nucleotide sequences of LOC256337 BINDING SITE, designated SEQ ID:45419, to the nucleotide sequence of VGAM368 RNA, herein designated VGAM RNA, also designated SEQ ID:3079.

Another function of VGAM368 is therefore inhibition of LOC256337 (Accession XM_170643). Accordingly, utilities of VGAM368 include diagnosis, prevention and treatment of diseases and clinical conditions associated with LOC256337. LOC90342 (Accession XM_031009) is another VGAM368 host target gene. LOC90342 BINDING SITE is HOST TARGET binding site found in the 5' untranslated region of mRNA encoded by LOC90342, corresponding to a HOST TARGET binding site such as BINDING SITE I, BINDING SITE II or BINDING SITE III. Table 2 illustrates the complementarity of the nucleotide sequences of LOC90342 BINDING SITE, designated SEQ ID:31256, to the nucleotide sequence of VGAM368 RNA, herein designated VGAM RNA, also designated SEQ ID:3079.

Another function of VGAM368 is therefore inhibition of LOC90342 (Accession XM_031009). Accordingly, utilities of VGAM368 include diagnosis, prevention and treatment of diseases and clinical conditions associated with LOC90342. LOC96810 (Accession XM_047273) is another VGAM368 host target gene. LOC96810 BINDING SITE is HOST TARGET binding site found in the 3' untranslated region of mRNA encoded by LOC96810, corresponding to a HOST TARGET binding site such as BINDING SITE I, BINDING SITE II or BINDING SITE III. Table 2 illustrates the complementarity of the nucleotide sequences of LOC96810 BINDING SITE, designated SEQ ID:34926, to the nucleotide sequence of VGAM368 RNA, herein designated VGAM RNA, also designated SEQ ID:3079.

Another function of VGAM368 is therefore inhibition of LOC96810 (Accession XM_047273). Accordingly, utilities of VGAM368 include diagnosis, prevention and treatment of diseases and clinical conditions associated with LOC96810. FIG. 1 further provides a conceptual description of a novel bioinformatically detected viral gene of the present invention, referred to here as Viral Genomic Address Messenger 369 (VGAM369) viral gene, which modulates expression of respective host target genes thereof, the function and utility of which host target genes is known in the art.

VGAM369 is a novel bioinformatically detected regulatory, non protein coding, viral micro RNA (miRNA) gene. The method by which VGAM369 was detected is described hereinabove with reference to FIGS. 1-8.

VGAM369 gene, herein designated VGAM GENE, is a viral gene contained in the genome of Avian Infectious Bronchitis Virus. VGAM369 host target gene, herein designated VGAM HOST TARGET GENE, is a human gene contained in the human genome.

VGAM369 gene encodes a VGAM369 precursor RNA, herein designated VGAM PRECURSOR RNA. Similar to other miRNA genes, and unlike most ordinary genes, VGAM369 precursor RNA does not encode a protein. A nucleotide sequence identical or highly similar to the nucleotide sequence of VGAM369 precursor RNA is designated SEQ ID:355, and is provided hereinbelow with reference to the sequence listing part. Nucleotide sequence SEQ ID:355 is located at position 16684 relative to the genome of Avian Infectious Bronchitis Virus.

VGAM369 precursor RNA folds onto itself, forming VGAM369 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM369 folded precursor RNA into VGAM369 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM369 RNA is designated SEQ ID:3080, and is provided hereinbelow with reference to the sequence listing part.

VGAM369 host target gene, herein designated VGAM HOST TARGET GENE, encodes a corresponding messenger RNA, VGAM369 host target RNA, herein designated VGAM HOST TARGET RNA. VGAM369 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM369 RNA, herein designated VGAM RNA, binds complementarily to one or more host target binding sites located in untranslated regions of VGAM369 host target RNA, herein designated VGAM HOST TARGET RNA. This complementary binding is due to the fact that the nucleotide sequence of VGAM369 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM369 RNA, herein designated VGAM RNA, may have a different number of host target binding sites in untranslated regions of a VGAM369 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM369 RNA, herein designated VGAM RNA, to host target binding sites on VGAM369 host target RNA, herein designated VGAM HOST TARGET RNA, such as BINDING SITE I, BINDING SITE II and BINDING SITE III, inhibits translation of VGAM369 host target RNA into VGAM369 host target protein, herein designated VGAM HOST TARGET PROTEIN. VGAM host target protein is therefore outlined by a broken line.

It is appreciated that VGAM369 host target gene, herein designated VGAM HOST TARGET GENE, in fact represents a plurality of VGAM369 host target genes. The mRNA of each one of this plurality of VGAM369 host target genes comprises one or more host target binding sites, each having a nucleotide sequence which is at least partly complementary to VGAM369 RNA, herein designated VGAM RNA, and which when bound by VGAM369 RNA causes inhibition of translation of respective one or more VGAM369 host target proteins.

It is further appreciated by one skilled in the art that the mode of translational inhibition illustrated by FIG. 1 with specific reference to translational inhibition exerted by VGAM369 gene, herein designated VGAM GENE, on one or more VGAM369 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM369 is inhibition of expression of host target genes, as part of a novel viral mechanism of attacking a host. Accordingly, utilities of VGAM369 include diagnosis, prevention and treatment of viral infection by Avian Infectious Bronchitis Virus. Specific functions, and accordingly utilities, of VGAM369 correlate with, and may be deduced from, the identity of the host target genes which VGAM369 binds and inhibits, and the function of these host target genes, as elaborated hereinbelow.

Nucleotide sequences of the VGAM369 precursor RNA, herein designated VGAM PRECURSOR RNA, and of the 'diced' VGAM369 RNA, herein designated VGAM RNA, and a schematic representation of the secondary folding of VGAM369 folded precursor RNA, herein designated VGAM FOLDED PRECURSOR RNA, of VGAM369 are further described hereinbelow with reference to Table 1.

Nucleotide sequences of host target binding sites, such as BINDING SITE-I, BINDING SITE-II and BINDING SITE-III of FIG. 1, found on VGAM369 host target RNA, and schematic representation of the complementarity of each of these host target binding sites to VGAM369 RNA, herein designated VGAM RNA, are described hereinbelow with reference to Table 2.

As mentioned hereinabove with reference to FIG. 1, a function of VGAM369 gene, herein designated VGAM is inhibition of expression of VGAM369 target genes. It is appreciated that specific functions, and accordingly utilities, of VGAM369 correlate with, and may be deduced from, the identity of the target genes which VGAM369 binds and inhibits, and the function of these target genes, as elaborated hereinbelow.

Cullin 3 (CUL3, Accession NM_003590) is a VGAM369 host target gene. CUL3 BINDING SITE is HOST TARGET binding site found in the 3' untranslated region of mRNA encoded by CUL3, corresponding to a HOST TARGET binding site such as BINDING SITE I, BINDING SITE II or BINDING SITE III. Table 2 illustrates the complementarity of the nucleotide sequences of CUL3 BINDING SITE, designated SEQ ID:9645, to the nucleotide sequence of VGAM369 RNA, herein designated VGAM RNA, also designated SEQ ID:3080.

A function of VGAM369 is therefore inhibition of Cullin 3 (CUL3, Accession NM_003590), a gene which may target other proteins for ubiquitin-dependent proteolysis. Accordingly, utilities of VGAM369 include diagnosis, prevention and treatment of diseases and clinical conditions associated with CUL3. The function of CUL3 and its association with various diseases and clinical conditions, has been established by previous studies, as described hereinabove with reference to VGAM143. Dihydropyrimidinase-like 3 (DPYSL3, Accession NM_001387) is another VGAM369 host target gene. DPYSL3 BINDING SITE is HOST TARGET binding site found in the 3' untranslated region of mRNA encoded by DPYSL3, corresponding to a HOST TARGET binding site such as BINDING SITE I, BINDING SITE II or BINDING SITE III. Table 2 illustrates the complementarity of the nucleotide sequences of DPYSL3 BINDING SITE, designated SEQ ID:7071, to the nucleotide sequence of VGAM369 RNA, herein designated VGAM RNA, also designated SEQ ID:3080.

Another function of VGAM369 is therefore inhibition of Dihydropyrimidinase-like 3 (DPYSL3, Accession NM_001387), a gene which is a member of the dihydropyrimidinase family. Accordingly, utilities of VGAM369 include diagnosis, prevention and treatment of diseases and clinical conditions associated with DPYSL3. The function of DPYSL3 and its association with various diseases and clinical conditions, has been established by previous studies, as described hereinabove with reference to VGAM24. Nuclear Factor (erythroid-derived 2)-like 1 (NFE2L1, Accession NM_003204) is another VGAM369 host target gene. NFE2L1 BINDING SITE is HOST TARGET binding site found in the 3' untranslated region of mRNA encoded by NFE2L1, corresponding to a HOST TARGET binding site such as BINDING SITE I, BINDING SITE II or BINDING SITE III. Table 2 illustrates the complementarity of the nucleotide sequences of NFE2L1 BINDING SITE, designated SEQ ID:9196, to the nucleotide sequence of VGAM369 RNA, herein designated VGAM RNA, also designated SEQ ID:3080.

Another function of VGAM369 is therefore inhibition of Nuclear Factor (erythroid-derived 2)-like 1 (NFE2L1, Accession NM_003204), a gene which may regulate expression of ferritin genes. Accordingly, utilities of VGAM369 include diagnosis, prevention and treatment of diseases and clinical conditions associated with NFE2L1. The function of NFE2L1 has been established by previous studies. Chan et al. (1993) devised a complementation assay in yeast to clone mammalian transcription activators and used it to identify a distinct human bZIP transcription factor, NFE2L1, which they designated NRF1 (NFE2-related factor-1) because of its similarities to NFE2 (OMIM Ref. No. 601490). Chan et al. (1995) showed that the NFE2L1 gene encodes a 742-amino acid protein with a different molecular weight than either the p45 subunit (NFE2) or the Maf protein subunit (MafF, MafG (OMIM Ref. No. 602020), or MafK (OMIM Ref. No. 600197)) of nuclear factor erythroid-2. Chan et al. (1993) found that NFE2L1 activates transcription via NFE2-binding sites in yeast cells. The ubiquitous expression pattern of NFE2L1 and the range of promoters containing the NFE2-binding motif suggested that this gene may play a role in the regulation of heme synthesis and ferritin genes Animal model experiments lend further support to the function of NFE2L1. To determine the function of Nrf1, Chan et al. (1998) disrupted the mouse gene by homologous recombination. Heterozygous Nfr1 mutant mice developed normally, were fertile, and showed no obvious abnormalities. Mice homozygous for the Nrf1 mutation suffered from anemia as a result of abnormal fetal liver erythropoiesis and died in utero at mid-late gestation. The authors did not detect defects in globin gene expression. Abnormal red cell production appeared to result from a defect in the fetal liver microenvironment specific for erythroid cells. Chan et al. (1998) suggested that target genes regulated by Nrf1 play an essential role during fetal liver hematopoiesis.

It is appreciated that the abovementioned animal model for NFE2L1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chan, J. Y.; Kwong, M.; Lu, R.; Chang, J.; Wang, B.; Yen, T. S. B.; Kan, Y. W.: Targeted disruption of the ubiquitous CNC-bZIP transcription factor, Nrf-1, results in anemia and embryonic lethality in mice. EMBO J. 17:1779-1787, 1998; and Chan, J. Y.; Han, X.-L.; Kan, Y. W.: Cloning of Nrf1, an NF-E2-related transcription factor, by genetic selection in yeast. Proc. Nat. Acad. Sci. 90: 11371-11375, 1993.

Further studies establishing the function and utilities of NFE2L1 are found in John Hopkins OMIM database record ID 163260, and in sited publications numbered 10585-10591 listed in the bibliography section hereinbelow, which are also hereby incorporated by reference. Single-minded Homolog 2 (Drosophila) (SIM2, Accession NM_005069) is another VGAM369 host target gene. SIM2 BINDING SITE is HOST TARGET binding site found in the 3' untranslated region of mRNA encoded by SIM2, corresponding to a HOST TARGET binding site such as BINDING SITE I, BINDING SITE II or BINDING SITE III. Table 2 illustrates the complementarity of the nucleotide sequences of SIM2 BINDING SITE, designated SEQ ID:11517, to the nucleotide sequence of VGAM369 RNA, herein designated VGAM RNA, also designated SEQ ID:3080.

Another function of VGAM369 is therefore inhibition of Single-minded Homolog 2 (Drosophila) (SIM2, Accession NM_005069), a gene which may be a master gene of cns development. Accordingly, utilities of VGAM369 include diagnosis, prevention and treatment of diseases and clinical conditions associated with SIM2. The function of SIM2 has been established by previous studies. Dahmane et al. (1995) noted that many features of Down syndrome might result from the overdosage of only a few genes located in the DCR around the 21q22.2 subband. To search for these genes, cosmids mapping to this region were isolated by Dahmane et al. (1995) and used for trapping exons. One of the trapped exons obtained had a sequence very similar to part of the Drosophila sim gene. Mapping data indicated that this exonic sequence is present only in the DCR in the human genome. Hybridization of this exonic sequence with human fetal kidney polyadenylated RNA revealed 2 transcripts of 6 and 4.3 kb. In situ hybridization of a probe derived from this exon with human and rat fetuses showed that the corresponding gene is expressed during early fetal life in the central nervous system and in other tissues, including the facial, skeletal, palate, and vertebra primordia. The expression pattern of this gene suggested to the authors that it may be involved in the pathogenesis of some of the morphologic features and brain anomalies of Down syndrome. Animal model experiments lend further support to the function of SIM2. Chrast et al. (2000) created a bacterial artificial chromosome transgenic mice with 1 or 2 additional copies of mouse Sim2. The transgene was expressed in the same spatial pattern as the endogenous gene. The mice developed normally, were fertile, and did not show detectable histopathologic abnormalities. However, detailed analysis of their behavior revealed anxiety-related/reduced exploratory behavior and sensitivity to pain, phenotypes similar to those also present in other partial trisomy 16 mouse models of DS. The authors suggested that overexpression of SIM2 may contribute to the DS behavioral phenotype.

It is appreciated that the abovementioned animal model for SIM2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Dahmane, N.; Charron, G.; Lopes, C.; Yaspo, M.-L.; Maunoury, C.; Decorte, L.; Sinet, P.-M.; Bloch, B.; Delabar, J.-M.: Down syndrome-critical region contains a gene homologous to Drosophila sim expressed during rat and human central nervous system development. Proc. Nat. Acad. Sci. 92:9191-9195, 1995; and Chrast, R.; Scott, H. S.; Madani, R.; Huber, L.; Wolfer, D. P.; Prinz, M.; Aguzzi, A.; Lipp, H.-P.; Antonarakis, S. E.: Mice trisomic for a bacterial artificial chromosome with the sin.

Further studies establishing the function and utilities of SIM2 are found in John Hopkins OMIM database record ID 600892, and in sited publications numbered 9290-929 and 9296 listed in the bibliography section hereinbelow, which are also hereby incorporated by reference. SORCS1 (Accession NM_052918) is another VGAM369 host target gene. SORCS1 BINDING SITE is HOST TARGET binding site found in the 3' untranslated region of mRNA encoded by SORCS1, corresponding to a HOST TARGET binding site such as BINDING SITE I, BINDING SITE II or BINDING SITE III. Table 2 illustrates the complementarity of the nucleotide sequences of SORCS1 BINDING SITE, designated SEQ ID:27483, to the nucleotide sequence of VGAM369 RNA, herein designated VGAM RNA, also designated SEQ ID:3080.

Another function of VGAM369 is therefore inhibition of SORCS1 (Accession NM_052918). Accordingly, utilities of VGAM369 include diagnosis, prevention and treatment of diseases and clinical conditions associated with SORCS1. TNF Receptor-associated Factor 1 (TRAF1, Accession NM_005658) is another VGAM369 host target gene. TRAF1

BINDING SITE is HOST TARGET binding site found in the 3' untranslated region of mRNA encoded by TRAF1, corresponding to a HOST TARGET binding site such as BINDING SITE I, BINDING SITE II or BINDING SITE III. Table 2 illustrates the complementarity of the nucleotide sequences of TRAF1 BINDING SITE, designated SEQ ID:12198, to the nucleotide sequence of VGAM369 RNA, herein designated VGAM RNA, also designated SEQ ID:3080.

Another function of VGAM369 is therefore inhibition of TNF Receptor-associated Factor 1 (TRAF1, Accession NM_005658), a gene which signal transducer associated with the cytoplasmic domain of the 75 kda tumor necrosis factor receptor (tnf-r2). Accordingly, utilities of VGAM369 include diagnosis, prevention and treatment of diseases and clinical conditions associated with TRAF1. The function of TRAF1 and its association with various diseases and clinical conditions, has been established by previous studies, as described hereinabove with reference to VGAM250. Vinculin (VCL, Accession NM_003373) is another VGAM369 host target gene. VCL BINDING SITE1 and VCL BINDING SITE2 are HOST TARGET binding sites found in untranslated regions of mRNA encoded by VCL, corresponding to HOST TARGET binding sites such as BINDING SITE I, BINDING SITE II or BINDING SITE III. Table 2 illustrates the complementarity of the nucleotide sequences of VCL BINDING SITE1 and VCL BINDING SITE2, designated SEQ ID:9402 and SEQ ID:15191 respectively, to the nucleotide sequence of VGAM369 RNA, herein designated VGAM RNA, also designated SEQ ID:3080.

Another function of VGAM369 is therefore inhibition of Vinculin (VCL, Accession NM_003373). Accordingly, utilities of VGAM369 include diagnosis, prevention and treatment of diseases and clinical conditions associated with VCL. FLJ20273 (Accession NM_019027) is another VGAM369 host target gene. FLJ20273 BINDING SITE is HOST TARGET binding site found in the 3' untranslated region of mRNA encoded by FLJ20273, corresponding to a HOST TARGET binding site such as BINDING SITE I, BINDING SITE II or BINDING SITE III. Table 2 illustrates the complementarity of the nucleotide sequences of FLJ20273 BINDING SITE, designated SEQ ID:21115, to the nucleotide sequence of VGAM369 RNA, herein designated VGAM RNA, also designated SEQ ID:3080.

Another function of VGAM369 is therefore inhibition of FLJ20273 (Accession NM_019027). Accordingly, utilities of VGAM369 include diagnosis, prevention and treatment of diseases and clinical conditions associated with FLJ20273. FLJ21865 (Accession NM_022759) is another VGAM369 host target gene. FLJ21865 BINDING SITE is HOST TARGET binding site found in the 3' untranslated region of mRNA encoded by FLJ21865, corresponding to a HOST TARGET binding site such as BINDING SITE I, BINDING SITE II or BINDING SITE III. Table 2 illustrates the complementarity of the nucleotide sequences of FLJ21865 BINDING SITE, designated SEQ ID:23001, to the nucleotide sequence of VGAM369 RNA, herein designated VGAM RNA, also designated SEQ ID:3080.

Another function of VGAM369 is therefore inhibition of FLJ21865 (Accession NM_022759). Accordingly, utilities of VGAM369 include diagnosis, prevention and treatment of diseases and clinical conditions associated with FLJ21865. G Protein-coupled Receptor Kinase-interactor 1 (GIT1, Accession NM_014030) is another VGAM369 host target gene. GIT1 BINDING SITE is HOST TARGET binding site found in the 3' untranslated region of mRNA encoded by GIT1, corresponding to a HOST TARGET binding site such as BINDING SITE I, BINDING SITE II or BINDING SITE III. Table 2 illustrates the complementarity of the nucleotide sequences of GIT1 BINDING SITE, designated SEQ ID:15258, to the nucleotide sequence of VGAM369 RNA, herein designated VGAM RNA, also designated SEQ ID:3080.

Another function of VGAM369 is therefore inhibition of G Protein-coupled Receptor Kinase-interactor 1 (GIT1, Accession NM_014030). Accordingly, utilities of VGAM369 include diagnosis, prevention and treatment of diseases and clinical conditions associated with GIT1. KIAA0210 (Accession NM_014744) is another VGAM369 host target gene. KIAA0210 BINDING SITE is HOST TARGET binding site found in the 3' untranslated region of mRNA encoded by KIAA0210, corresponding to a HOST TARGET binding site such as BINDING SITE I, BINDING SITE II or BINDING SITE III. Table 2 illustrates the complementarity of the nucleotide sequences of KIAA0210 BINDING SITE, designated SEQ ID:16421, to the nucleotide sequence of VGAM369 RNA, herein designated VGAM RNA, also designated SEQ ID:3080.

Another function of VGAM369 is therefore inhibition of KIAA0210 (Accession NM_014744). Accordingly, utilities of VGAM369 include diagnosis, prevention and treatment of diseases and clinical conditions associated with KIAA0210. KIAA0336 (Accession NM_014635) is another VGAM369 host target gene. KIAA0336 BINDING SITE is HOST TARGET binding site found in the 3' untranslated region of mRNA encoded by KIAA0336, corresponding to a HOST TARGET binding site such as BINDING SITE I, BINDING SITE II or BINDING SITE III. Table 2 illustrates the complementarity of the nucleotide sequences of KIAA0336 BINDING SITE, designated SEQ ID:16011, to the nucleotide sequence of VGAM369 RNA, herein designated VGAM RNA, also designated SEQ ID:3080.

Another function of VGAM369 is therefore inhibition of KIAA0336 (Accession NM_014635). Accordingly, utilities of VGAM369 include diagnosis, prevention and treatment of diseases and clinical conditions associated with KIAA0336. KIAA1130 (Accession XM_031104) is another VGAM369 host target gene. KIAA1130 BINDING SITE is HOST TARGET binding site found in the 3' untranslated region of mRNA encoded by KIAA1130, corresponding to a HOST TARGET binding site such as BINDING SITE I, BINDING SITE II or BINDING SITE III. Table 2 illustrates the complementarity of the nucleotide sequences of KIAA1130 BINDING SITE, designated SEQ ID:31287, to the nucleotide sequence of VGAM369 RNA, herein designated VGAM RNA, also designated SEQ ID:3080.

Another function of VGAM369 is therefore inhibition of KIAA1130 (Accession XM_031104). Accordingly, utilities of VGAM369 include diagnosis, prevention and treatment of diseases and clinical conditions associated with KIAA1130. KIAA1831 (Accession XM_033366) is another VGAM369 host target gene. KIAA1831 BINDING SITE is HOST TARGET binding site found in the 5' untranslated region of mRNA encoded by KIAA1831, corresponding to a HOST TARGET binding site such as BINDING SITE I, BINDING SITE II or BINDING SITE III. Table 2 illustrates the complementarity of the nucleotide sequences of KIAA1831 BINDING SITE, designated SEQ ID:31907, to the nucleotide sequence of VGAM369 RNA, herein designated VGAM RNA, also designated SEQ ID:3080.

Another function of VGAM369 is therefore inhibition of KIAA1831 (Accession XM_033366). Accordingly, utilities of VGAM369 include diagnosis, prevention and treatment of diseases and clinical conditions associated with KIAA1831. MCJ (Accession NM_013238) is another VGAM369 host target gene. MCJ BINDING SITE is HOST TARGET binding site found in the 5" untranslated region of mRNA encoded by MCJ, corresponding to a HOST TARGET binding site such as BINDING SITE I, BINDING SITE II or BINDING SITE III. Table 2 illustrates the complementarity of the nucleotide sequences of MCJ BINDING SITE, designated SEQ ID:14899, to the nucleotide sequence of VGAM369 RNA, herein designated VGAM RNA, also designated SEQ ID:3080.

Another function of VGAM369 is therefore inhibition of MCJ (Accession NM_013238). Accordingly, utilities of VGAM369 include diagnosis, prevention and treatment of diseases and clinical conditions associated with MCJ. Rabip4R (Accession NM_017987) is another VGAM369 host target gene. Rabip4R BINDING SITE is HOST TARGET binding site found in the 3' untranslated region of mRNA encoded by Rabip4R, corresponding to a HOST TARGET binding site such as BINDING SITE I, BINDING SITE II or BINDING SITE III. Table 2 illustrates the complementarity of the nucleotide sequences of Rabip4R BINDING SITE, designated SEQ ID:19717, to the nucleotide sequence of VGAM369 RNA, herein designated VGAM RNA, also designated SEQ ID:3080.

Another function of VGAM369 is therefore inhibition of Rabip4R (Accession NM_017987). Accordingly, utilities of VGAM369 include diagnosis, prevention and treatment of diseases and clinical conditions associated with Rabip4R. Spi-B Transcription Factor (Spi-1/PU.1 related) (SPIB, Accession NM_003121) is another VGAM369 host target gene. SPIB BINDING SITE is HOST TARGET binding site found in the 3' untranslated region of mRNA encoded by SPIB, corresponding to a HOST TARGET binding site such as BINDING SITE I, BINDING SITE II or BINDING SITE III. Table 2 illustrates the complementarity of the nucleotide sequences of SPIB BINDING SITE, designated SEQ ID:9093, to the nucleotide sequence of VGAM369 RNA, herein designated VGAM RNA, also designated SEQ ID:3080.

Another function of VGAM369 is therefore inhibition of Spi-B Transcription Factor (Spi-1/PU.1 related) (SPIB, Accession NM_003121). Accordingly, utilities of VGAM369 include diagnosis, prevention and treatment of diseases and clinical conditions associated with SPIB. Ubinuclein 1 (UBN1, Accession NM_016936) is another VGAM369 host target gene. UBN1 BINDING SITE is HOST TARGET binding site found in the 3' untranslated region of mRNA encoded by UBN1, corresponding to a HOST TARGET binding site such as BINDING SITE I, BINDING SITE II or BINDING SITE III. Table 2 illustrates the complementarity of the nucleotide sequences of UBN1 BINDING SITE, designated SEQ ID:18854, to the nucleotide sequence of VGAM369 RNA, herein designated VGAM RNA, also designated SEQ ID:3080.

Another function of VGAM369 is therefore inhibition of Ubinuclein 1 (UBN1, Accession NM_016936). Accordingly, utilities of VGAM369 include diagnosis, prevention and treatment of diseases and clinical conditions associated with UBN1. LOC145368 (Accession XM_085112) is another VGAM369 host target gene. LOC145368 BINDING SITE is HOST TARGET binding site found in the 5' untranslated region of mRNA encoded by LOC145368, corresponding to a HOST TARGET binding site such as BINDING SITE I, BINDING SITE II or BINDING SITE III. Table 2 illustrates the complementarity of the nucleotide sequences of LOC145368 BINDING SITE, designated SEQ ID:37830, to the nucleotide sequence of VGAM369 RNA, herein designated VGAM RNA, also designated SEQ ID:3080.

Another function of VGAM369 is therefore inhibition of LOC145368 (Accession XM_085112). Accordingly, utilities of VGAM369 include diagnosis, prevention and treatment of diseases and clinical conditions associated with LOC145368. LOC150423 (Accession XM_086912) is another VGAM369 host target gene. LOC150423 BINDING SITE is HOST TARGET binding site found in the 5' untranslated region of mRNA encoded by LOC150423, corresponding to a HOST TARGET binding site such as BINDING SITE I, BINDING SITE II or BINDING SITE III. Table 2 illustrates the complementarity of the nucleotide sequences of LOC150423 BINDING SITE, designated SEQ ID:38970, to the nucleotide sequence of VGAM369 RNA, herein designated VGAM RNA, also designated SEQ ID:3080.

Another function of VGAM369 is therefore inhibition of LOC150423 (Accession XM_086912). Accordingly, utilities of VGAM369 include diagnosis, prevention and treatment of diseases and clinical conditions associated with LOC150423. LOC153232 (Accession XM_098331) is another VGAM369 host target gene. LOC153232 BINDING SITE is HOST TARGET binding site found in the 5' untranslated region of mRNA encoded by LOC153232, corresponding to a HOST TARGET binding site such as BINDING SITE I, BINDING SITE II or BINDING SITE III. Table 2 illustrates the complementarity of the nucleotide sequences of LOC153232 BINDING SITE, designated SEQ ID:41597, to the nucleotide sequence of VGAM369 RNA, herein designated VGAM RNA, also designated SEQ ID:3080.

Another function of VGAM369 is therefore inhibition of LOC153232 (Accession XM_098331). Accordingly, utilities of VGAM369 include diagnosis, prevention and treatment of diseases and clinical conditions associated with LOC153232. LOC221486 (Accession XM_165760) is another VGAM369 host target gene. LOC221486 BINDING SITE is HOST TARGET binding site found in the 3' untranslated region of mRNA encoded by LOC221486, corresponding to a HOST TARGET binding site such as BINDING SITE I, BINDING SITE II or BINDING SITE III. Table 2 illustrates the complementarity of the nucleotide sequences of LOC221486 BINDING SITE, designated SEQ ID:43746, to the nucleotide sequence of VGAM369 RNA, herein designated VGAM RNA, also designated SEQ ID:3080.

Another function of VGAM369 is therefore inhibition of LOC221486 (Accession XM_165760). Accordingly, utilities of VGAM369 include diagnosis, prevention and treatment of diseases and clinical conditions associated with LOC221486. LOC256310 (Accession XM_172813) is another VGAM369 host target gene. LOC256310 BINDING SITE is HOST TARGET binding site found in the 5' untranslated region of mRNA encoded by LOC256310, corresponding to a HOST TARGET binding site such as BINDING SITE I, BINDING SITE II or BINDING SITE III. Table 2 illustrates the complementarity of the nucleotide sequences of LOC256310 BINDING SITE, designated SEQ ID:46096, to the nucleotide sequence of VGAM369 RNA, herein designated VGAM RNA, also designated SEQ ID:3080.

Another function of VGAM369 is therefore inhibition of LOC256310 (Accession XM_172813). Accordingly, utilities of VGAM369 include diagnosis, prevention and treatment of diseases and clinical conditions associated with LOC256310. FIG. 1 further provides a conceptual description of a novel bioinformatically detected viral gene of the present invention, referred to here as Viral Genomic Address Messenger 370 (VGAM370) viral gene, which modulates expression of respective host target genes thereof, the function and utility of which host target genes is known in the art.

VGAM370 is a novel bioinformatically detected regulatory, non protein coding, viral micro RNA (miRNA) gene. The method by which VGAM370 was detected is described hereinabove with reference to FIGS. 1-8.

VGAM370 gene, herein designated VGAM GENE, is a viral gene contained in the genome of Avian Infectious Bronchitis Virus. VGAM370 host target gene, herein designated VGAM HOST TARGET GENE, is a human gene contained in the human genome.

VGAM370 gene encodes a VGAM370 precursor RNA, herein designated VGAM PRECURSOR RNA. Similar to other miRNA genes, and unlike most ordinary genes, VGAM370 precursor RNA does not encode a protein. A nucleotide sequence identical or highly similar to the nucleotide sequence of VGAM370 precursor RNA is designated SEQ ID:356, and is provided hereinbelow with reference to the sequence listing part. Nucleotide sequence SEQ ID:356 is located at position 17287 relative to the genome of Avian Infectious Bronchitis Virus.

VGAM370 precursor RNA folds onto itself, forming VGAM370 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM370 folded precursor RNA into VGAM370 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM370 RNA is designated SEQ ID:3081, and is provided hereinbelow with reference to the sequence listing part.

VGAM370 host target gene, herein designated VGAM HOST TARGET GENE, encodes a corresponding messenger RNA, VGAM370 host target RNA, herein designated VGAM HOST TARGET RNA. VGAM370 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM370 RNA, herein designated VGAM RNA, binds complementarily to one or more host target binding sites located in untranslated regions of VGAM370 host target RNA, herein designated VGAM HOST TARGET RNA. This complementary binding is due to the fact that the nucleotide sequence of VGAM370 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM370 RNA, herein designated VGAM RNA, may have a different number of host target binding sites in untranslated regions of a VGAM370 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM370 RNA, herein designated VGAM RNA, to host target binding sites on VGAM370 host target RNA, herein designated VGAM HOST TARGET RNA, such as BINDING SITE I, BINDING SITE II and BINDING SITE III, inhibits translation of VGAM370 host target RNA into VGAM370 host target protein, herein designated VGAM HOST TARGET PROTEIN. VGAM host target protein is therefore outlined by a broken line.

It is appreciated that VGAM370 host target gene, herein designated VGAM HOST TARGET GENE, in fact represents a plurality of VGAM370 host target genes. The mRNA of each one of this plurality of VGAM370 host target genes comprises one or more host target binding sites, each having a nucleotide sequence which is at least partly complementary to VGAM370 RNA, herein designated VGAM RNA, and which when bound by VGAM370 RNA causes inhibition of translation of respective one or more VGAM370 host target proteins.

It is further appreciated by one skilled in the art that the mode of translational inhibition illustrated by FIG. 1 with specific reference to translational inhibition exerted by VGAM370 gene, herein designated VGAM GENE, on one or more VGAM370 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM370 is inhibition of expression of host target genes, as part of a novel viral mechanism of attacking a host. Accordingly, utilities of VGAM370 include diagnosis, prevention and treatment of viral infection by Avian Infectious Bronchitis Virus. Specific functions, and accordingly utilities, of VGAM370 correlate with, and may be deduced from, the identity of the host target genes which VGAM370 binds and inhibits, and the function of these host target genes, as elaborated hereinbelow.

Nucleotide sequences of the VGAM370 precursor RNA, herein designated VGAM PRECURSOR RNA, and of the 'diced' VGAM370 RNA, herein designated VGAM RNA, and a schematic representation of the secondary folding of VGAM370 folded precursor RNA, herein designated VGAM FOLDED PRECURSOR RNA, of VGAM370 are further described hereinbelow with reference to Table 1.

Nucleotide sequences of host target binding sites, such as BINDING SITE-I, BINDING SITE-II and BINDING SITE-III of FIG. 1, found on VGAM370 host target RNA, and schematic representation of the complementarity of each of these host target binding sites to VGAM370 RNA, herein designated VGAM RNA, are described hereinbelow with reference to Table 2.

As mentioned hereinabove with reference to FIG. 1, a function of VGAM370 gene, herein designated VGAM is inhibition of expression of VGAM370 target genes. It is appreciated that specific functions, and accordingly utilities, of VGAM370 correlate with, and may be deduced from, the identity of the target genes which VGAM370 binds and inhibits, and the function of these target genes, as elaborated hereinbelow.

N-ethylmaleimide-sensitive Factor (NSF, Accession XM_032173) is a VGAM370 host target gene. NSF BINDING SITE is HOST TARGET binding site found in the 3' untranslated region of mRNA encoded by NSF, corresponding to a HOST TARGET binding site such as BINDING SITE I, BINDING SITE II or BINDING SITE III. Table 2 illustrates the complementarity of the nucleotide sequences of NSF BINDING SITE, designated SEQ ID:31586, to the nucleotide sequence of VGAM370 RNA, herein designated VGAM RNA, also designated SEQ ID:3081.

A function of VGAM370 is therefore inhibition of N-ethylmaleimide-sensitive Factor (NSF, Accession XM_032173), a gene which catalyzes the fusion of transport vesicles within the golgi cisternae. Accordingly, utilities of VGAM370 include diagnosis, prevention and treatment of diseases and clinical conditions associated with NSF. The function of NSF has been established by previous studies. The process of vesicle targeting and fusion in the secretory and endocytic pathways has been described by the SNAREs hypothesis (Rothman, 1994). This proposes that vesicles dock with specific target membranes by binding to membrane-specific SNAREs (soluble N-ethylmaleimide-sensitive factors attachment protein receptors). Hoyle et al. (1996) noted that targeting specificity is also affected by the Rabs, a group of small soluble GTPases. After the vesicle has bound to the target membrane, the SNARE multimer is joined by the soluble SNAP proteins and N-ethylmaleimide-sensitive factor (NSF). The resulting large complex is thought to allow membrane fusion and the ATPase activity of the NSF appears to be essential for the process. Hoyle et al. (1996) stated that while many of different SNAREs, Rabs, and SNAPs are involved in membrane fusion, there is only 1 NSF, and the SNARE hypothesis describes NSF-dependent fusion. Mammalian N-ethylmaleimide-sensitive protein was first described by Glick and Rothman (1987) as the protein that restored the ability of Golgi membranes that had been inactivated with the reagent N-ethylmaleimide to re-engage in vesicular transport. The NSF gene was subsequently cloned from Chinese hamster cells by Block et al. (1988) and Wilson et al. (1989). NSF is a member of the AAA (ATPases associated with diverse cellular activities) gene family. Hoyle et al. (1996) stated that the genes are most related throughout the approximately 200-amino acid domain (the AAA domain) that binds ATP; however, the family is notable not only for its conservation but also for diverse functions of its proteins in eukaryotic cells. The family can be subdivided into those with either 1 or 2 ATP-binding domains. NSF is a 2-domain member of the AAA family. Valosin-containing protein (OMIM Ref. No. 601023), which is also involved in membrane fusion, is another 2-AAA domain protein.

Full details of the abovementioned studies are described in the following publications, the disclosure of which are hereby incorporated by reference:

Glick, B. S.; Rothman, J. E.: Possible role for fatty acyl-coenzyme A in intracellular protein transport. Nature 326: 309-312, 1987; and Hoyle, J.; Phelan, J. P.; Bermingham, N.; Fisher, E. M. C.: Localization of human and mouse N-ethylmaleimide-sensitive factor (NSF) gene: a two-domain member of the AAA family that is i.

Further studies establishing the function and utilities of NSF are found in John Hopkins OMIM database record ID 601633, and in sited publications numbered 2808-281 and 12358-2812 listed in the bibliography section hereinbelow, which are also hereby incorporated by reference. Mitochondrial Ribosomal Protein L20 (MRPL20, Accession NM_017971) is another VGAM370 host target gene. MRPL20 BINDING SITE is HOST TARGET binding site found in the 3' untranslated region of mRNA encoded by MRPL20, corresponding to a HOST TARGET binding site such as BINDING SITE I, BINDING SITE II or BINDING SITE III. Table 2 illustrates the complementarity of the nucleotide sequences of MRPL20 BINDING SITE, designated SEQ ID:19699, to the nucleotide sequence of VGAM370 RNA, herein designated VGAM RNA, also designated SEQ ID:3081.

Another function of VGAM370 is therefore inhibition of Mitochondrial Ribosomal Protein L20 (MRPL20, Accession NM_017971). Accordingly, utilities of VGAM370 include diagnosis, prevention and treatment of diseases and clinical conditions associated with MRPL20. NUCKS (Accession NM_022731) is another VGAM370 host target gene. NUCKS BINDING SITE is HOST TARGET binding site found in the 3' untranslated region of mRNA encoded by NUCKS, corresponding to a HOST TARGET binding site such as BINDING SITE I, BINDING SITE II or BINDING SITE III. Table 2 illustrates the complementarity of the nucleotide sequences of NUCKS BINDING SITE, designated SEQ ID:22936, to the nucleotide sequence of VGAM370 RNA, herein designated VGAM RNA, also designated SEQ ID:3081.

Another function of VGAM370 is therefore inhibition of NUCKS (Accession NM_022731). Accordingly, utilities of VGAM370 include diagnosis, prevention and treatment of diseases and clinical conditions associated with NUCKS. LOC146138 (Accession XM_096938) is another VGAM370 host target gene. LOC146138 BINDING SITE is HOST TARGET binding site found in the 3' untranslated region of mRNA encoded by LOC146138, corresponding to a HOST TARGET binding site such as BINDING SITE I, BINDING SITE II or BINDING SITE III. Table 2 illustrates the complementarity of the nucleotide sequences of LOC146138 BINDING SITE, designated SEQ ID:40659, to the nucleotide sequence of VGAM370 RNA, herein designated VGAM RNA, also designated SEQ ID:3081.

Another function of VGAM370 is therefore inhibition of LOC146138 (Accession XM_096938). Accordingly, utilities of VGAM370 include diagnosis, prevention and treatment of diseases and clinical conditions associated with LOC146138. LOC254250 (Accession XM_173093) is another VGAM370 host target gene. LOC254250 BINDING SITE is HOST TARGET binding site found in the 5' untranslated region of mRNA encoded by LOC254250, corresponding to a HOST TARGET binding site such as BINDING SITE I, BINDING SITE II or BINDING SITE III. Table 2 illustrates the complementarity of the nucleotide sequences of LOC254250 BINDING SITE, designated SEQ ID:46356, to the nucleotide sequence of VGAM370 RNA, herein designated VGAM RNA, also designated SEQ ID:3081.

Another function of VGAM370 is therefore inhibition of LOC254250 (Accession XM_173093). Accordingly, utilities of VGAM370 include diagnosis, prevention and treatment of diseases and clinical conditions associated with LOC254250. FIG. 1 further provides a conceptual description of a novel bioinformatically detected viral gene of the present invention, referred to here as Viral Genomic Address Messenger 371 (VGAM371) viral gene, which modulates expression of respective host target genes thereof, the function and utility of which host target genes is known in the art.

VGAM371 is a novel bioinformatically detected regulatory, non protein coding, viral micro RNA (miRNA) gene. The method by which VGAM371 was detected is described hereinabove with reference to FIGS. 1-8.

VGAM371 gene, herein designated VGAM GENE, is a viral gene contained in the genome of Avian Infectious Bronchitis Virus. VGAM371 host target gene, herein designated VGAM HOST TARGET GENE, is a human gene contained in the human genome.

VGAM371 gene encodes a VGAM371 precursor RNA, herein designated VGAM PRECURSOR RNA. Similar to other miRNA genes, and unlike most ordinary genes, VGAM371 precursor RNA does not encode a protein. A nucleotide sequence identical or highly similar to the nucleotide sequence of VGAM371 precursor RNA is designated SEQ ID:357, and is provided hereinbelow with reference to the sequence listing part. Nucleotide sequence SEQ ID:357 is located at position 16829 relative to the genome of Avian Infectious Bronchitis Virus.

VGAM371 precursor RNA folds onto itself, forming VGAM371 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM371 folded precursor RNA into VGAM371 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM371 RNA is designated SEQ ID:3082, and is provided hereinbelow with reference to the sequence listing part.

VGAM371 host target gene, herein designated VGAM HOST TARGET GENE, encodes a corresponding messenger RNA, VGAM371 host target RNA, herein designated VGAM HOST TARGET RNA. VGAM371 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM371 RNA, herein designated VGAM RNA, binds complementarily to one or more host target binding sites located in untranslated regions of VGAM371 host target RNA, herein designated VGAM HOST TARGET RNA. This complementary binding is due to the fact that the nucleotide sequence of VGAM371 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM371 RNA, herein designated VGAM RNA, may have a different number of host target binding sites in untranslated regions of a VGAM371 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM371 RNA, herein designated VGAM RNA, to host target binding sites on VGAM371 host target RNA, herein designated VGAM HOST TARGET RNA, such as BINDING SITE I, BINDING SITE II and BINDING SITE III, inhibits translation of VGAM371 host target RNA into VGAM371 host target protein, herein designated VGAM HOST TARGET PROTEIN. VGAM host target protein is therefore outlined by a broken line.

It is appreciated that VGAM371 host target gene, herein designated VGAM HOST TARGET GENE, in fact represents a plurality of VGAM371 host target genes. The mRNA of each one of this plurality of VGAM371 host target genes comprises one or more host target binding sites, each having a nucleotide sequence which is at least partly complementary to VGAM371 RNA, herein designated VGAM RNA, and which when bound by VGAM371 RNA causes inhibition of translation of respective one or more VGAM371 host target proteins.

It is further appreciated by one skilled in the art that the mode of translational inhibition illustrated by FIG. 1 with specific reference to translational inhibition exerted by VGAM371 gene, herein designated VGAM GENE, on one or more VGAM371 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM371 is inhibition of expression of host target genes, as part of a novel viral mechanism of attacking a host. Accordingly, utilities of VGAM371 include diagnosis, prevention and treatment of viral infection by Avian Infectious Bronchitis Virus. Specific functions, and accordingly utilities, of VGAM371 correlate with, and may be deduced from, the identity of the host target genes which VGAM371 binds and inhibits, and the function of these host target genes, as elaborated hereinbelow.

Nucleotide sequences of the VGAM371 precursor RNA, herein designated VGAM PRECURSOR RNA, and of the 'diced' VGAM371 RNA, herein designated VGAM RNA, and a schematic representation of the secondary folding of VGAM371 folded precursor RNA, herein designated VGAM FOLDED PRECURSOR RNA, of VGAM371 are further described hereinbelow with reference to Table 1.

Nucleotide sequences of host target binding sites, such as BINDING SITE-I, BINDING SITE-II and BINDING SITE-III of FIG. 1, found on VGAM371 host target RNA, and schematic representation of the complementarity of each of these host target binding sites to VGAM371 RNA, herein designated VGAM RNA, are described hereinbelow with reference to Table 2.

As mentioned hereinabove with reference to FIG. 1, a function of VGAM371 gene, herein designated VGAM is inhibition of expression of VGAM371 target genes. It is appreciated that specific functions, and accordingly utilities, of VGAM371 correlate with, and may be deduced from, the identity of the target genes which VGAM371 binds and inhibits, and the function of these target genes, as elaborated hereinbelow.

SRGAP2 (Accession XM_059095) is a VGAM371 host target gene. SRGAP2 BINDING SITE is HOST TARGET binding site found in the 3' untranslated region of mRNA encoded by SRGAP2, corresponding to a HOST TARGET binding site such as BINDING SITE I, BINDING SITE II or BINDING SITE III. Table 2 illustrates the complementarity of the nucleotide sequences of SRGAP2 BINDING SITE, designated SEQ ID:36877, to the nucleotide sequence of VGAM371 RNA, herein designated VGAM RNA, also designated SEQ ID:3082.

A function of VGAM371 is therefore inhibition of SRGAP2 (Accession XM_059095). Accordingly, utilities of VGAM371 include diagnosis, prevention and treatment of diseases and clinical conditions associated with SRGAP2. ADAMTS-like 1 (ADAMTSL1, Accession NM_139264) is another VGAM371 host target gene. ADAMTSL1 BINDING SITE is HOST TARGET binding site found in the 3' untranslated region of mRNA encoded by ADAMTSL1, corresponding to a HOST TARGET binding site such as BINDING SITE I, BINDING SITE II or BINDING SITE III. Table 2 illustrates the complementarity of the nucleotide sequences of ADAMTSL1 BINDING SITE, designated SEQ ID:29253, to the nucleotide sequence of VGAM371 RNA, herein designated VGAM RNA, also designated SEQ ID:3082.

Another function of VGAM371 is therefore inhibition of ADAMTS-like 1 (ADAMTSL1, Accession NM_139264). Accordingly, utilities of VGAM371 include diagnosis, prevention and treatment of diseases and clinical conditions associated with ADAMTSL1. Carbohydrate (chondroitin 6) Sulfotransferase 3 (CHST3, Accession NM_004273) is another VGAM371 host target gene. CHST3 BINDING SITE is HOST TARGET binding site found in the 3' untranslated region of mRNA encoded by CHST3, corresponding to a HOST TARGET binding site such as BINDING SITE I, BINDING SITE II or BINDING SITE III. Table 2 illustrates the complementarity of the nucleotide sequences of CHST3 BINDING SITE, designated SEQ ID:10472, to the nucleotide sequence of VGAM371 RNA, herein designated VGAM RNA, also designated SEQ ID:3082.

Another function of VGAM371 is therefore inhibition of Carbohydrate (chondroitin 6) Sulfotransferase 3 (CHST3, Accession NM_004273). Accordingly, utilities of VGAM371 include diagnosis, prevention and treatment of diseases and clinical conditions associated with CHST3. KIAA1344 (Accession XM_051699) is another VGAM371 host target gene. KIAA1344 BINDING SITE is HOST TARGET binding site found in the 3" untranslated region of mRNA encoded by KIAA1344, corresponding to a HOST TARGET binding site such as BINDING SITE I, BINDING SITE II or BINDING SITE III. Table 2 illustrates the complementarity of the nucleotide sequences of KIAA1344 BINDING SITE, designated SEQ ID:35868, to the nucleotide sequence of VGAM371 RNA, herein designated VGAM RNA, also designated SEQ ID:3082.

Another function of VGAM371 is therefore inhibition of KIAA1344 (Accession XM_051699). Accordingly, utilities of VGAM371 include diagnosis, prevention and treatment of diseases and clinical conditions associated with KIAA1344. FIG. 1 further provides a conceptual description of a novel bioinformatically detected viral gene of the present invention, referred to here as Viral Genomic Address Messenger 372 (VGAM372) viral gene, which modulates expression of respective host target genes thereof, the function and utility of which host target genes is known in the art.

VGAM372 is a novel bioinformatically detected regulatory, non protein coding, viral micro RNA (miRNA) gene. The method by which VGAM372 was detected is described hereinabove with reference to FIGS. 1-8.

VGAM372 gene, herein designated VGAM GENE, is a viral gene contained in the genome of Avian Infectious Bronchitis Virus. VGAM372 host target gene, herein designated VGAM HOST TARGET GENE, is a human gene contained in the human genome.

VGAM372 gene encodes a VGAM372 precursor RNA, herein designated VGAM PRECURSOR RNA. Similar to other miRNA genes, and unlike most ordinary genes, VGAM372 precursor RNA does not encode a protein. A nucleotide sequence identical or highly similar to the nucleotide sequence of VGAM372 precursor RNA is designated SEQ ID:358, and is provided hereinbelow with reference to the sequence listing part. Nucleotide sequence SEQ ID:358 is located at position 11416 relative to the genome of Avian Infectious Bronchitis Virus.

VGAM372 precursor RNA folds onto itself, forming VGAM372 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM372 folded precursor RNA into VGAM372 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM372 RNA is designated SEQ ID:3083, and is provided hereinbelow with reference to the sequence listing part.

VGAM372 host target gene, herein designated VGAM HOST TARGET GENE, encodes a corresponding messenger RNA, VGAM372 host target RNA, herein designated VGAM HOST TARGET RNA. VGAM372 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM372 RNA, herein designated VGAM RNA, binds complementarily to one or more host target binding sites located in untranslated regions of VGAM372 host target RNA, herein designated VGAM HOST TARGET RNA. This complementary binding is due to the fact that the nucleotide sequence of VGAM372 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM372 RNA, herein designated VGAM RNA, may have a different number of host target binding sites in untranslated regions of a VGAM372 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM372 RNA, herein designated VGAM RNA, to host target binding sites on VGAM372 host target RNA, herein designated VGAM HOST TARGET RNA, such as BINDING SITE I, BINDING SITE II and BINDING SITE III, inhibits translation of VGAM372 host target RNA into VGAM372 host target protein, herein designated VGAM HOST TARGET PROTEIN.

VGAM host target protein is therefore outlined by a broken line.

It is appreciated that VGAM372 host target gene, herein designated VGAM HOST TARGET GENE, in fact represents a plurality of VGAM372 host target genes. The mRNA of each one of this plurality of VGAM372 host target genes comprises one or more host target binding sites, each having a nucleotide sequence which is at least partly complementary to VGAM372 RNA, herein designated VGAM RNA, and which when bound by VGAM372 RNA causes inhibition of translation of respective one or more VGAM372 host target proteins.

It is further appreciated by one skilled in the art that the mode of translational inhibition illustrated by FIG. 1 with specific reference to translational inhibition exerted by VGAM372 gene, herein designated VGAM GENE, on one or more VGAM372 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM372 is inhibition of expression of host target genes, as part of a novel viral mechanism of attacking a host. Accordingly, utilities of VGAM372 include diagnosis, prevention and treatment of viral infection by Avian Infectious Bronchitis Virus. Specific functions, and accordingly utilities, of VGAM372 correlate with, and may be deduced from, the identity of the host target genes which VGAM372 binds and inhibits, and the function of these host target genes, as elaborated hereinbelow.

Nucleotide sequences of the VGAM372 precursor RNA, herein designated VGAM PRECURSOR RNA, and of the 'diced' VGAM372 RNA, herein designated VGAM RNA, and a schematic representation of the secondary folding of VGAM372 folded precursor RNA, herein designated VGAM FOLDED PRECURSOR RNA, of VGAM372 are further described hereinbelow with reference to Table 1.

Nucleotide sequences of host target binding sites, such as BINDING SITE-I, BINDING SITE-II and BINDING SITE-III of FIG. 1, found on VGAM372 host target RNA, and schematic representation of the complementarity of each of these host target binding sites to VGAM372 RNA, herein designated VGAM RNA, are described hereinbelow with reference to Table 2.

As mentioned hereinabove with reference to FIG. 1, a function of VGAM372 gene, herein designated VGAM is inhibition of expression of VGAM372 target genes. It is appreciated that specific functions, and accordingly utilities, of VGAM372 correlate with, and may be deduced from, the identity of the target genes which VGAM372 binds and inhibits, and the function of these target genes, as elaborated hereinbelow.

Annexin A8 (ANXA8, Accession NM_001630) is a VGAM372 host target gene. ANXA8 BINDING SITE is HOST TARGET binding site found in the 3' untranslated region of mRNA encoded by ANXA8, corresponding to a HOST TARGET binding site such as BINDING SITE I, BINDING SITE II or BINDING SITE III. Table 2 illustrates the complementarity of the nucleotide sequences of ANXA8 BINDING SITE, designated SEQ ID:7339, to the nucleotide sequence of VGAM372 RNA, herein designated VGAM RNA, also designated SEQ ID:3083.

A function of VGAM372 is therefore inhibition of Annexin A8 (ANXA8, Accession NM_001630), a gene which acts as an indirect inhibitor of the thromboplastin-specific complex, which is involved in the blood coagulation cascade. Accordingly, utilities of VGAM372 include diagnosis, prevention and treatment of diseases and clinical conditions associated with ANXA8. The function of ANXA8 has been established by previous studies. Human annexin VIII was originally identified by Hauptmann et al. (1989) from a 2-kb cDNA transcript containing an open reading frame that encoded a 327-amino acid protein termed vascular anticoagulant beta. It is a minor annexin (see OMIM Ref. No. ANXA2; 151740) in human placenta and shows restricted expression in lung endothelia, skin, liver, and kidney. The gene is selectively overexpressed in acute myelocytic leukemia (Chang et al., 1992). Affected human promyelocytes contain a nonrandom chromosomal translocation breakpoint involving chromosomes 15 and 17 and creating 2 hybrid mRNA fusion products and chimeric proteins. These involve the retinoic acid receptor alpha locus (RARA; 180240) on 17q12 and the promyelocytic leukemia locus (PML; 102578) on 15q22. Chambers et al. (1992) mapped the ANXA8 gene to 10q11.2 by fluorescence in situ hybridization, thus excluding its direct involvement in the breakpoint region. However, strong overexpression of annexin VIII in this disorder could be repressed by retinoic acid-induced expression of the RARA gene product Full details of the abovementioned studies are described in the following publications, the disclosure of which are hereby incorporated by reference:

Chang, K.-S.; Wang, G.; Freireich, E. J.; Daly, M.; Naylor, S. L.; Trujillo, J. M.; Stass, S. A.: Specific expression of the annexin VIII gene in acute promyelocytic leukemia. Blood 79:1802-1810, 1992; and Sarkar, A.; Yang, P.; Fan, Y.-H.; Mu, Z. M.; Hauptmann, R.; Adolf, G. R.; Stass, S. A.; Chang, K.-S.: Regulation of the expression of annexin VIII in acute promyelocytic leukemia. Blood.

Further studies establishing the function and utilities of ANXA8 are found in John Hopkins OMIM database record ID 602396, and in sited publications numbered 5902-5904, 484 and 5905 listed in the bibliography section hereinbelow, which are also hereby incorporated by reference. Inositol Polyphosphate-5-phosphatase, 75 kDa (INPP5B, Accession XM_170949) is another VGAM372 host target gene. INPP5B BINDING SITE is HOST TARGET binding site found in the 3' untranslated region of mRNA encoded by INPP5B, corresponding to a HOST TARGET binding site such as BINDING SITE I, BINDING SITE II or BINDING SITE III. Table 2 illustrates the complementarity of the nucleotide sequences of INPP5B BINDING SITE, designated SEQ ID:45734, to the nucleotide sequence of VGAM372 RNA, herein designated VGAM RNA, also designated SEQ ID:3083.

Another function of VGAM372 is therefore inhibition of Inositol Polyphosphate-5-phosphatase, 75 kDa (INPP5B, Accession XM_170949), a gene which hydrolyzes the calcium-mobilizing second messenger ins (1,4,5) p3. Accordingly, utilities of VGAM372 include diagnosis, prevention and treatment of diseases and clinical conditions associated with INPP5B. The function of INPP5B and its association with various diseases and clinical conditions, has been established by previous studies, as described hereinabove with reference to VGAM50. N-ethylmaleimide-sensitive Factor (NSF, Accession XM_032173) is another VGAM372 host target gene. NSF BINDING SITE is HOST TARGET binding site found in the 3' untranslated region of mRNA encoded by NSF, corresponding to a HOST TARGET binding site such as BINDING SITE I, BINDING SITE II or BINDING SITE III. Table 2 illustrates the complementarity of the nucleotide sequences of NSF BINDING SITE, designated SEQ ID:31588, to the nucleotide sequence of VGAM372 RNA, herein designated VGAM RNA, also designated SEQ ID:3083.

Another function of VGAM372 is therefore inhibition of N-ethylmaleimide-sensitive Factor (NSF, Accession XM_032173), a gene which catalyzes the fusion of transport vesicles within the golgi cisternae. Accordingly, utilities of VGAM372 include diagnosis, prevention and treatment of diseases and clinical conditions associated with NSF. The function of NSF and its association with various diseases and clinical conditions, has been established by previous studies, as described hereinabove with reference to VGAM370. Chromosome 13 Open Reading Frame 1 (C13orf1, Accession NM_020456) is another VGAM372 host target gene. C13orf1 BINDING SITE is HOST TARGET binding site found in the 3' untranslated region of mRNA encoded by C13orf1, corresponding to a HOST TARGET binding site such as BINDING SITE I, BINDING SITE II or BINDING SITE III. Table 2 illustrates the complementarity of the nucleotide sequences of C13orf1 BINDING SITE, designated SEQ ID:21690, to the nucleotide sequence of VGAM372 RNA, herein designated VGAM RNA, also designated SEQ ID:3083.

Another function of VGAM372 is therefore inhibition of Chromosome 13 Open Reading Frame 1 (C13orf1, Accession NM_020456). Accordingly, utilities of VGAM372 include diagnosis, prevention and treatment of diseases and clinical conditions associated with C13orf1. MGC12972 (Accession NM_032683) is another VGAM372 host target gene. MGC12972 BINDING SITE is HOST TARGET binding site found in the 3' untranslated region of mRNA encoded by MGC12972, corresponding to a HOST TARGET binding site such as BINDING SITE I, BINDING SITE II or BINDING SITE III. Table 2 illustrates the complementarity of the nucleotide sequences of MGC12972 BINDING SITE, designated SEQ ID:26405, to the nucleotide sequence of VGAM372 RNA, herein designated VGAM RNA, also designated SEQ ID:3083.

Another function of VGAM372 is therefore inhibition of MGC12972 (Accession NM_032683). Accordingly, utilities of VGAM372 include diagnosis, prevention and treatment of diseases and clinical conditions associated with MGC12972. Paternally Expressed 10 (PEG10, Accession NM_015068) is another VGAM372 host target gene. PEG10 BINDING SITE is HOST TARGET binding site found in the 3' untranslated region of mRNA encoded by PEG10, corresponding to a HOST TARGET binding site such as BINDING SITE I, BINDING SITE II or BINDING SITE III. Table 2 illustrates the complementarity of the nucleotide sequences of PEG10 BINDING SITE, designated SEQ ID:17429, to the nucleotide sequence of VGAM372 RNA, herein designated VGAM RNA, also designated SEQ ID:3083.

Another function of VGAM372 is therefore inhibition of Paternally Expressed 10 (PEG10, Accession NM_015068). Accordingly, utilities of VGAM372 include diagnosis, prevention and treatment of diseases and clinical conditions associated with PEG10. LOC142972 (Accession XM_036593) is another VGAM372 host target gene. LOC142972 BINDING SITE is HOST TARGET binding site found in the 3' untranslated region of mRNA encoded by LOC142972, corresponding to a HOST TARGET binding site such as BINDING SITE I, BINDING SITE II or BINDING SITE III. Table 2 illustrates the complementarity of the nucleotide sequences of LOC142972 BINDING SITE, designated SEQ ID:32476, to the nucleotide sequence of VGAM372 RNA, herein designated VGAM RNA, also designated SEQ ID:3083.

Another function of VGAM372 is therefore inhibition of LOC142972 (Accession XM_036593). Accordingly, utilities of VGAM372 include diagnosis, prevention and treatment of diseases and clinical conditions associated with LOC142972. LOC92140 (Accession XM_043070) is another VGAM372 host target gene. LOC92140 BINDING SITE is HOST TARGET binding site found in the 3' untranslated region of mRNA encoded by LOC92140, corresponding to a HOST TARGET binding site such as BINDING SITE I, BINDING SITE II or BINDING SITE III. Table 2 illustrates the complementarity of the nucleotide sequences of LOC92140 BINDING SITE, designated SEQ ID:33889, to the nucleotide sequence of VGAM372 RNA, herein designated VGAM RNA, also designated SEQ ID:3083.

Another function of VGAM372 is therefore inhibition of LOC92140 (Accession XM_043070). Accordingly, utilities of VGAM372 include diagnosis, prevention and treatment of diseases and clinical conditions associated with LOC92140. FIG. 1 further provides a conceptual description of a novel bioinformatically detected viral gene of the present invention, referred to here as Viral Genomic Address Messenger 373 (VGAM373) viral gene, which modulates expression of respective host target genes thereof, the function and utility of which host target genes is known in the art.

VGAM373 is a novel bioinformatically detected regulatory, non protein coding, viral micro RNA (miRNA) gene. The method by which VGAM373 was detected is described hereinabove with reference to FIGS. 1-8.

VGAM373 gene, herein designated VGAM GENE, is a viral gene contained in the genome of Avian Infectious Bronchitis Virus. VGAM373 host target gene, herein designated VGAM HOST TARGET GENE, is a human gene contained in the human genome.

VGAM373 gene encodes a VGAM373 precursor RNA, herein designated VGAM PRECURSOR RNA. Similar to other miRNA genes, and unlike most ordinary genes, VGAM373 precursor RNA does not encode a protein. A nucleotide sequence identical or highly similar to the nucleotide sequence of VGAM373 precursor RNA is designated SEQ ID:359, and is provided hereinbelow with reference to the sequence listing part. Nucleotide sequence SEQ ID:359 is located at position 14350 relative to the genome of Avian Infectious Bronchitis Virus.

VGAM373 precursor RNA folds onto itself, forming VGAM373 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM373 folded precursor RNA into VGAM373 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM373 RNA is designated SEQ ID:3084, and is provided hereinbelow with reference to the sequence listing part.

VGAM373 host target gene, herein designated VGAM HOST TARGET GENE, encodes a corresponding messenger RNA, VGAM373 host target RNA, herein designated VGAM HOST TARGET RNA. VGAM373 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM373 RNA, herein designated VGAM RNA, binds complementarily to one or more host target binding sites located in untranslated regions of VGAM373 host target RNA, herein designated VGAM HOST TARGET RNA. This complementary binding is due to the fact that the nucleotide sequence of VGAM373 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM373 RNA, herein designated VGAM RNA, may have a different number of host target binding sites in untranslated regions of a VGAM373 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM373 RNA, herein designated VGAM RNA, to host target binding sites on VGAM373 host target RNA, herein designated VGAM HOST TARGET RNA, such as BINDING SITE I, BINDING SITE II and BINDING SITE III, inhibits translation of VGAM373 host target RNA into VGAM373 host target protein, herein designated VGAM HOST TARGET PROTEIN. VGAM host target protein is therefore outlined by a broken line.

It is appreciated that VGAM373 host target gene, herein designated VGAM HOST TARGET GENE, in fact represents a plurality of VGAM373 host target genes. The mRNA of each one of this plurality of VGAM373 host target genes comprises one or more host target binding sites, each having a nucleotide sequence which is at least partly complementary to VGAM373 RNA, herein designated VGAM RNA, and which when bound by VGAM373 RNA causes inhibition of translation of respective one or more VGAM373 host target proteins.

It is further appreciated by one skilled in the art that the mode of translational inhibition illustrated by FIG. 1 with specific reference to translational inhibition exerted by VGAM373 gene, herein designated VGAM GENE, on one or more VGAM373 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM373 is inhibition of expression of host target genes, as part of a novel viral mechanism of attacking a host. Accordingly, utilities of VGAM373 include diagnosis, prevention and treatment of viral infection by Avian Infectious Bronchitis Virus. Specific functions, and accordingly utilities, of VGAM373 correlate with, and may be deduced from, the identity of the host target genes which VGAM373 binds and inhibits, and the function of these host target genes, as elaborated hereinbelow.

Nucleotide sequences of the VGAM373 precursor RNA, herein designated VGAM PRECURSOR RNA, and of the 'diced' VGAM373 RNA, herein designated VGAM RNA, and a schematic representation of the secondary folding of VGAM373 folded precursor RNA, herein designated VGAM FOLDED PRECURSOR RNA, of VGAM373 are further described hereinbelow with reference to Table 1.

Nucleotide sequences of host target binding sites, such as BINDING SITE-I, BINDING SITE-II and BINDING SITE-III of FIG. 1, found on VGAM373 host target RNA, and schematic representation of the complementarity of each of these host target binding sites to VGAM373 RNA, herein designated VGAM RNA, are described hereinbelow with reference to Table 2.

As mentioned hereinabove with reference to FIG. 1, a function of VGAM373 gene, herein designated VGAM is inhibition of expression of VGAM373 target genes. It is appreciated that specific functions, and accordingly utilities, of VGAM373 correlate with, and may be deduced from, the identity of the target genes which VGAM373 binds and inhibits, and the function of these target genes, as elaborated hereinbelow.

Potassium Inwardly-rectifying Channel, Subfamily J, Member 15 (KCNJ15, Accession NM_002243) is a VGAM373 host target gene. KCNJ15 BINDING SITE is HOST TARGET binding site found in the 3' untranslated region of mRNA encoded by KCNJ15, corresponding to a HOST TARGET binding site such as BINDING SITE I, BINDING SITE II or BINDING SITE III. Table 2 illustrates the complementarity of the nucleotide sequences of KCNJ15 BINDING SITE, designated SEQ ID:8031, to the nucleotide sequence of VGAM373 RNA, herein designated VGAM RNA, also designated SEQ ID:3084.

A function of VGAM373 is therefore inhibition of Potassium Inwardly-rectifying Channel, Subfamily J, Member 15 (KCNJ15, Accession NM_002243). Accordingly, utilities of VGAM373 include diagnosis, prevention and treatment of diseases and clinical conditions associated with KCNJ15. Cyclin M1 (CNNM1, Accession NM_020348) is another VGAM373 host target gene. CNNM1 BINDING SITE is HOST TARGET binding site found in the 3' untranslated region of mRNA encoded by CNNM1, corresponding to a HOST TARGET binding site such as BINDING SITE I, BINDING SITE II or BINDING SITE III. Table 2 illustrates the complementarity of the nucleotide sequences of CNNM1 BINDING SITE, designated SEQ ID:21605, to the nucleotide sequence of VGAM373 RNA, herein designated VGAM RNA, also designated SEQ ID:3084.

Another function of VGAM373 is therefore inhibition of Cyclin M1 (CNNM1, Accession NM_020348). Accordingly, utilities of VGAM373 include diagnosis, prevention and treatment of diseases and clinical conditions associated with CNNM1. DKFZp761N1114 (Accession XM_086327) is another VGAM373 host target gene. DKFZp761N1114 BINDING SITE is HOST TARGET binding site found in the 3' untranslated region of mRNA encoded by DKFZp761N1114, corresponding to a HOST TARGET binding site such as BINDING SITE I, BINDING SITE II or BINDING SITE III. Table 2 illustrates the complementarity of the nucleotide sequences of DKFZp761N1114 BINDING SITE, designated SEQ ID:38606, to the nucleotide sequence of VGAM373 RNA, herein designated VGAM RNA, also designated SEQ ID:3084.

Another function of VGAM373 is therefore inhibition of DKFZp761N1114 (Accession XM_086327). Accordingly, utilities of VGAM373 include diagnosis, prevention and treatment of diseases and clinical conditions associated with DKFZp761N1114. KIAA0323 (Accession XM_032634) is another VGAM373 host target gene. KIAA0323 BINDING SITE is HOST TARGET binding site found in the 3' untranslated region of mRNA encoded by KIAA0323, corresponding to a HOST TARGET binding site such as BINDING SITE I, BINDING SITE II or BINDING SITE III. Table 2 illustrates the complementarity of the nucleotide sequences of KIAA0323 BINDING SITE, designated SEQ ID:31688, to the nucleotide sequence of VGAM373 RNA, herein designated VGAM RNA, also designated SEQ ID:3084.

Another function of VGAM373 is therefore inhibition of KIAA0323 (Accession XM_032634). Accordingly, utilities of VGAM373 include diagnosis, prevention and treatment of diseases and clinical conditions associated with KIAA0323. KIAA0848 (Accession NM_014926) is another VGAM373 host target gene. KIAA0848 BINDING SITE is HOST TARGET binding site found in the 3' untranslated region of mRNA encoded by KIAA0848, corresponding to a HOST TARGET binding site such as BINDING SITE I, BINDING SITE II or BINDING SITE III. Table 2 illustrates the complementarity of the nucleotide sequences of KIAA0848 BINDING SITE, designated SEQ ID:17213, to the nucleotide sequence of VGAM373 RNA, herein designated VGAM RNA, also designated SEQ ID:3084.

Another function of VGAM373 is therefore inhibition of KIAA0848 (Accession NM_014926). Accordingly, utilities of VGAM373 include diagnosis, prevention and treatment of diseases and clinical conditions associated with KIAA0848. KIAA1200 (Accession XM_031054) is another VGAM373 host target gene. KIAA1200 BINDING SITE is HOST TARGET binding site found in the 3' untranslated region of mRNA encoded by KIAA1200, corresponding to a HOST TARGET binding site such as BINDING SITE I, BINDING SITE II or BINDING SITE III. Table 2 illustrates the complementarity of the nucleotide sequences of KIAA1200 BINDING SITE, designated SEQ ID:31262, to the nucleotide sequence of VGAM373 RNA, herein designated VGAM RNA, also designated SEQ ID:3084.

Another function of VGAM373 is therefore inhibition of KIAA1200 (Accession XM_031054). Accordingly, utilities of VGAM373 include diagnosis, prevention and treatment of diseases and clinical conditions associated with KIAA1200. Mitogen-activated Protein Kinase 11 (MAPK11, Accession NM_002751) is another VGAM373 host target gene. MAPK11 BINDING SITE is HOST TARGET binding site found in the 3' untranslated region of mRNA encoded by MAPK11, corresponding to a HOST TARGET binding site such as BINDING SITE I, BINDING SITE II or BINDING SITE III. Table 2 illustrates the complementarity of the nucleotide sequences of MAPK11 BINDING SITE, designated SEQ ID:8627, to the nucleotide sequence of VGAM373 RNA, herein designated VGAM RNA, also designated SEQ ID:3084.

Another function of VGAM373 is therefore inhibition of Mitogen-activated Protein Kinase 11 (MAPK11, Accession NM_002751). Accordingly, utilities of VGAM373 include diagnosis, prevention and treatment of diseases and clinical conditions associated with MAPK11. LOC133418 (Accession XM_059649) is another VGAM373 host target gene. LOC133418 BINDING SITE is HOST TARGET binding site found in the 3' untranslated region of mRNA encoded by LOC133418, corresponding to a HOST TARGET binding site such as BINDING SITE I, BINDING SITE II or BINDING SITE III. Table 2 illustrates the complementarity of the nucleotide sequences of LOC133418 BINDING SITE, designated SEQ ID:37041, to the nucleotide sequence of VGAM373 RNA, herein designated VGAM RNA, also designated SEQ ID:3084.

Another function of VGAM373 is therefore inhibition of LOC133418 (Accession XM_059649). Accordingly, utilities of VGAM373 include diagnosis, prevention and treatment of diseases and clinical conditions associated with LOC133418. LOC153338 (Accession XM_098361) is another VGAM373 host target gene. LOC153338 BINDING SITE is HOST TARGET binding site found in the 5' untranslated region of mRNA encoded by LOC153338, corresponding to a HOST TARGET binding site such as BINDING SITE I, BINDING SITE II or BINDING SITE III. Table 2 illustrates the complementarity of the nucleotide sequences of LOC153338 BINDING SITE, designated SEQ ID:41609, to the nucleotide sequence of VGAM373 RNA, herein designated VGAM RNA, also designated SEQ ID:3084.

Another function of VGAM373 is therefore inhibition of LOC153338 (Accession XM_098361). Accordingly, utilities of VGAM373 include diagnosis, prevention and treatment of diseases and clinical conditions associated with LOC153338. LOC255098 (Accession XM_170912) is another VGAM373 host target gene. LOC255098 BINDING SITE is HOST TARGET binding site found in the 3' untranslated region of mRNA encoded by LOC255098, corresponding to a HOST TARGET binding site such as BINDING SITE I, BINDING SITE II or BINDING SITE III. Table 2 illustrates the complementarity of the nucleotide sequences of LOC255098 BINDING SITE, designated SEQ ID:45689, to the nucleotide sequence of VGAM373 RNA, herein designated VGAM RNA, also designated SEQ ID:3084.

Another function of VGAM373 is therefore inhibition of LOC255098 (Accession XM_170912). Accordingly, utilities of VGAM373 include diagnosis, prevention and treatment of diseases and clinical conditions associated with LOC255098. FIG. 1 further provides a conceptual description of a novel bioinformatically detected viral gene of the present invention, referred to here as Viral Genomic Address Messenger 374 (VGAM374) viral gene, which modulates expression of respective host target genes thereof, the function and utility of which host target genes is known in the art.

VGAM374 is a novel bioinformatically detected regulatory, non protein coding, viral micro RNA (miRNA) gene. The method by which VGAM374 was detected is described hereinabove with reference to FIGS. 1-8.

VGAM374 gene, herein designated VGAM GENE, is a viral gene contained in the genome of Avian Infectious Bronchitis Virus. VGAM374 host target gene, herein designated VGAM HOST TARGET GENE, is a human gene contained in the human genome.

VGAM374 gene encodes a VGAM374 precursor RNA, herein designated VGAM PRECURSOR RNA. Similar to other miRNA genes, and unlike most ordinary genes, VGAM374 precursor RNA does not encode a protein. A nucleotide sequence identical or highly similar to the nucleotide sequence of VGAM374 precursor RNA is designated SEQ ID:360, and is provided hereinbelow with reference to the sequence listing part. Nucleotide sequence SEQ ID:360 is located at position 13667 relative to the genome of Avian Infectious Bronchitis Virus.

VGAM374 precursor RNA folds onto itself, forming VGAM374 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM374 folded precursor RNA into VGAM374 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM374 RNA is designated SEQ ID:3085, and is provided hereinbelow with reference to the sequence listing part.

VGAM374 host target gene, herein designated VGAM HOST TARGET GENE, encodes a corresponding messenger RNA, VGAM374 host target RNA, herein designated VGAM HOST TARGET RNA. VGAM374 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM374 RNA, herein designated VGAM RNA, binds complementarily to one or more host target binding sites located in untranslated regions of VGAM374 host target RNA, herein designated VGAM HOST TARGET RNA. This complementary binding is due to the fact that the nucleotide sequence of VGAM374 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM374 RNA, herein designated VGAM RNA, may have a different number of host target binding sites in untranslated regions of a VGAM374 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM374 RNA, herein designated VGAM RNA, to host target binding sites on VGAM374 host target RNA, herein designated VGAM HOST TARGET RNA, such as BINDING SITE I, BINDING SITE II and BINDING SITE III, inhibits translation of VGAM374 host target RNA into VGAM374 host target protein, herein designated VGAM HOST TARGET PROTEIN. VGAM host target protein is therefore outlined by a broken line.

It is appreciated that VGAM374 host target gene, herein designated VGAM HOST TARGET GENE, in fact represents a plurality of VGAM374 host target genes. The mRNA of each one of this plurality of VGAM374 host target genes comprises one or more host target binding sites, each having a nucleotide sequence which is at least partly complementary to VGAM374 RNA, herein designated VGAM RNA, and which when bound by VGAM374 RNA causes inhibition of translation of respective one or more VGAM374 host target proteins.

It is further appreciated by one skilled in the art that the mode of translational inhibition illustrated by FIG. 1 with specific reference to translational inhibition exerted by VGAM374 gene, herein designated VGAM GENE, on one or more VGAM374 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM374 is inhibition of expression of host target genes, as part of a novel viral mechanism of attacking a host. Accordingly, utilities of VGAM374 include diagnosis, prevention and treatment of viral infection by Avian Infectious Bronchitis Virus. Specific functions, and accordingly utilities, of VGAM374 correlate with, and may be deduced from, the identity of the host target genes which VGAM374 binds and inhibits, and the function of these host target genes, as elaborated hereinbelow.

Nucleotide sequences of the VGAM374 precursor RNA, herein designated VGAM PRECURSOR RNA, and of the 'diced' VGAM374 RNA, herein designated VGAM RNA, and a schematic representation of the secondary folding of VGAM374 folded precursor RNA, herein designated VGAM FOLDED PRECURSOR RNA, of VGAM374 are further described hereinbelow with reference to Table 1.

Nucleotide sequences of host target binding sites, such as BINDING SITE-I, BINDING SITE-II and BINDING SITE-III of FIG. 1, found on VGAM374 host target RNA, and schematic representation of the complementarity of each of these host target binding sites to VGAM374 RNA, herein designated VGAM RNA, are described hereinbelow with reference to Table 2.

As mentioned hereinabove with reference to FIG. 1, a function of VGAM374 gene, herein designated VGAM is inhibition of expression of VGAM374 target genes. It is appreciated that specific functions, and accordingly utilities, of VGAM374 correlate with, and may be deduced from, the identity of the target genes which VGAM374 binds and inhibits, and the function of these target genes, as elaborated hereinbelow.

Acid Phosphatase 1, Soluble (ACP1, Accession NM_004300) is a VGAM374 host target gene. ACP1 BINDING SITE1 and ACP1 BINDING SITE2 are HOST TARGET binding sites found in untranslated regions of mRNA encoded by ACP1, corresponding to HOST TARGET binding sites such as BINDING SITE I, BINDING SITE II or BINDING SITE III. Table 2 illustrates the complementarity of the nucleotide sequences of ACP1 BINDING SITE1 and ACP1 BINDING SITE2, designated SEQ ID:10510 and SEQ ID:13960 respectively, to the nucleotide sequence of VGAM374 RNA, herein designated VGAM RNA, also designated SEQ ID:3085.

A function of VGAM374 is therefore inhibition of Acid Phosphatase 1, Soluble (ACP1, Accession NM_004300), a gene which as demonstrated in starch-gel electrophoresis. Accordingly, utilities of VGAM374 include diagnosis, prevention and treatment of diseases and clinical conditions associated with ACP1. The function of ACP1 and its association with various diseases and clinical conditions, has been established by previous studies, as described hereinabove with reference to VGAM179. Heparanase (HPSE, Accession NM_006665) is another VGAM374 host target gene. HPSE BINDING SITE is HOST TARGET binding site found in the 3' untranslated region of mRNA encoded by HPSE, corresponding to a HOST TARGET binding site such as BINDING SITE I, BINDING SITE II or BINDING SITE III. Table 2 illustrates the complementarity of the nucleotide sequences of HPSE BINDING SITE, designated SEQ ID:13480, to the nucleotide sequence of VGAM374 RNA, herein designated VGAM RNA, also designated SEQ ID:3085.

Another function of VGAM374 is therefore inhibition of Heparanase (HPSE, Accession NM_006665), a gene which is an endoglycosidase that cleaves heparan sulfate. Accordingly, utilities of VGAM374 include diagnosis, prevention and treatment of diseases and clinical conditions associated with HPSE. The function of HPSE has been established by previous studies. Heparanase is an endoglycosidase that cleaves heparan sulfate, an important component of the extracellular matrix and vascular basal laminar. The degradation of heparan sulfate by heparanase is a key step in the extravasation of tumor cells and migrating leukocytes, but is also important in physiologic processes including angiogenesis, wound healing, and smooth muscle proliferation. By sequential affinity chromatography of SV40-transformed embryonic lung fibroblasts, Toyoshima and Nakajima (1999) purified a 50-kD protein with heparanase activity. Hulett et al. (1999) and Vlodavsky et al. (1999) applied similar strategies to platelets and placenta, respectively. By searching EST databases, all 3 groups identified cDNAs encoding a 543-amino acid heparanase protein (HPSE) with 6 potential N-glycosylation sites. The protein also has putative hydrophobic stretches suggestive of signal peptides and a transmembrane protein (Hulett et al., 1999). Northern blot analysis revealed expression of a 2-kb transcript in placenta but not in heart, brain, lung, liver, skeletal muscle, kidney, or pancreas. A 4.4-kb transcript is expressed at low levels in all tissues. Both transcripts are expressed equivalently in peripheral blood leukocytes, spleen, lymph node, bone marrow, fetal liver, and thymus (Hulett et al., 1999; Kussie et al., 1999). Functional analyses revealed that expression correlates with heparanase activity (Toyoshima and Nakajima, 1999; Vlodavsky et al. (1999); Hulett et al., 1999). RT/PCR, in situ hybridization, and functional analyses demonstrated a correlation of gene expression and heparanase activity with increased metastatic potential in breast cancer tissues and cell lines (Vlodavsky et al., 1999).

Full details of the abovementioned studies are described in the following publications, the disclosure of which are hereby incorporated by reference:

Baker, E.; Crawford, J.; Sutherland, G. R.; Freeman, C.; Parish, C. R.; Hulett, M. D.: Human HPA endoglycosidase heparanase. Chromosome Res. 7:319 only, 1999; and Hulett, M. D.; Freeman, C.; Hamdorf, B. J.; Baker, R. T.; Harris, M. J.; Parish, C. R.: Cloning of mammalian heparanase, an important enzyme in tumor invasion and metastasis. Nature M.

Further studies establishing the function and utilities of HPSE are found in John Hopkins OMIM database record ID 604724, and in sited publications numbered 4994-4998 listed in the bibliography section hereinbelow, which are also hereby incorporated by reference. Selectin L (lymphocyte adhesion molecule 1) (SELL, Accession NM_000655) is another VGAM374 host target gene. SELL BINDING SITE is HOST TARGET binding site found in the 3' untranslated region of mRNA encoded by SELL, corresponding to a HOST TARGET binding site such as BINDING SITE I, BINDING SITE II or BINDING SITE III. Table 2 illustrates the complementarity of the nucleotide sequences of SELL BINDING SITE, designated SEQ ID:6316, to the nucleotide sequence of VGAM374 RNA, herein designated VGAM RNA, also designated SEQ ID:3085.

Another function of VGAM374 is therefore inhibition of Selectin L (lymphocyte adhesion molecule 1) (SELL, Accession NM_000655), a gene which is a cell surface adhesion protein. Accordingly, utilities of VGAM374 include diagnosis, prevention and treatment of diseases and clinical conditions associated with SELL. The function of SELL has been established by previous studies. This glycoprotein was first identified in the mouse as the Mel-14 antigen, a lymph node homing receptor (Lnhr) also found on neutrophils and monocytes, by Lasky et al. (1989). In addition to lymphocyte homing, this molecule may play a role in neutrophil adhesion to endothelium at sites of inflammation. The human counterpart was referred to as the LEU8/TQ1 antigen. The human homolog of mouse lymph node homing receptor was cloned by Siegelman and Weissman (1989). Disteche et al. (1989) and Tedder et al. (1989) mapped the LYAM1 gene to 1q23-q25 by in situ hybridization. The gene for another member of the adhesion molecule family, SELP (OMIM Ref. No. 173610), is located in this same area. Indeed, Watson et al. (1990) demonstrated that these 2 genes and that for endothelial leukocyte adhesion molecule-1 (SELE; 131210) map to the same 300-kb segment. Furthermore, Watson et al. (1990) found that these 3 genes are closely situated on distal mouse chromosome 1 which is syntenic with human chromosome 1q; in 428 meiotic events, no crossovers were identified among these 3 genes and the gene for coagulation factor V (OMIM Ref. No. 227400). Dowbenko et al. (1991) also mapped the gene to a region of mouse chromosome 1, very near a site previously shown to contain the genes for the family of complement regulatory proteins. They found, furthermore, a correspondence between the domains of the protein and the coding exons of the gene. In the course of constructing a physical map of 1q, Oakey et al. (1992) positioned LYAM between ELAM and SELP and gave the location of all 3, as well as of F5 (OMIM Ref. No. 227400), as 1q23-q25.

Full details of the abovementioned studies are described in the following publications, the disclosure of which are hereby incorporated by reference:

Lasky, L. A.; Singer, M. S.; Yednock, T. A.; Dowbenko, D.; Fennie, C.; Rodriguez, H.; Nguyen, T.; Stachel, S.; Rosen, S. D.: Cloning of a lymphocyte homing receptor reveals a lectin domain. Cell 56:1045-1055, 1989; and Oakey, R. J.; Watson, M. L.; Seldin, M. F.: Construction of a physical map on mouse and human chromosome 1: comparison of 13 Mb of mouse and 11 Mb of human DNA. Hum. Molec. Genet. 1:6.

Further studies establishing the function and utilities of SELL are found in John Hopkins OMIM database record ID 153240, and in sited publications numbered 11805, 11353, 11503-11504, 3934, 11505-1150 and 11810 listed in the bibliography section hereinbelow, which are also hereby incorporated by reference. FLJ10287 (Accession NM_019083) is another VGAM374 host target gene. FLJ10287 BINDING SITE is HOST TARGET binding site found in the 3' untranslated region of mRNA encoded by FLJ10287, corresponding to a HOST TARGET binding site such as BINDING SITE I, BINDING SITE II or BINDING SITE III. Table 2 illustrates the complementarity of the nucleotide sequences of FLJ10287 BINDING SITE, designated SEQ ID:21154, to the nucleotide sequence of VGAM374 RNA, herein designated VGAM RNA, also designated SEQ ID:3085.

Another function of VGAM374 is therefore inhibition of FLJ10287 (Accession NM_019083). Accordingly, utilities of VGAM374 include diagnosis, prevention and treatment of diseases and clinical conditions associated with FLJ10287. Frequently Rearranged In Advanced T-cell Lymphomas (FRAT1, Accession NM_005479) is another VGAM374 host target gene. FRAT1 BINDING SITE is HOST TARGET binding site found in the 3' untranslated region of mRNA encoded by FRAT1, corresponding to a HOST TARGET binding site such as BINDING SITE I, BINDING SITE II or BINDING SITE III. Table 2 illustrates the complementarity of the nucleotide sequences of FRAT1 BINDING SITE, designated SEQ ID:11982, to the nucleotide sequence of VGAM374 RNA, herein designated VGAM RNA, also designated SEQ ID:3085.

Another function of VGAM374 is therefore inhibition of Frequently Rearranged In Advanced T-cell Lymphomas (FRAT1, Accession NM_005479). Accordingly, utilities of VGAM374 include diagnosis, prevention and treatment of diseases and clinical conditions associated with FRAT1. KIAA1143 (Accession XM_044014) is another VGAM374 host target gene. KIAA1143 BINDING SITE is HOST TARGET binding site found in the 3' untranslated region of mRNA encoded by KIAA1143, corresponding to a HOST TARGET binding site such as BINDING SITE I, BINDING SITE II or BINDING SITE III. Table 2 illustrates the complementarity of the nucleotide sequences of KIAA1143 BINDING SITE, designated SEQ ID:34070, to the nucleotide sequence of VGAM374 RNA, herein designated VGAM RNA, also designated SEQ ID:3085.

Another function of VGAM374 is therefore inhibition of KIAA1143 (Accession XM_044014). Accordingly, utilities of VGAM374 include diagnosis, prevention and treatment of diseases and clinical conditions associated with KIAA1143. KIAA1283 (Accession XM_050563) is another VGAM374 host target gene. KIAA1283 BINDING SITE is HOST TARGET binding site found in the 5' untranslated region of mRNA encoded by KIAA1283, corresponding to a HOST TARGET binding site such as BINDING SITE I, BINDING SITE II or BINDING SITE III. Table 2 illustrates the complementarity of the nucleotide sequences of KIAA1283 BINDING SITE, designated SEQ ID:35662, to the nucleotide sequence of VGAM374 RNA, herein designated VGAM RNA, also designated SEQ ID:3085.

Another function of VGAM374 is therefore inhibition of KIAA1283 (Accession XM_050563). Accordingly, utilities of VGAM374 include diagnosis, prevention and treatment of diseases and clinical conditions associated with KIAA1283. KIAA1719 (Accession XM_042936) is another VGAM374 host target gene. KIAA1719 BINDING SITE is HOST TARGET binding site found in the 3' untranslated region of mRNA encoded by KIAA1719, corresponding to a HOST TARGET binding site such as BINDING SITE I, BINDING SITE II or BINDING SITE III. Table 2 illustrates the complementarity of the nucleotide sequences of KIAA1719 BINDING SITE, designated SEQ ID:33816, to the nucleotide sequence of VGAM374 RNA, herein designated VGAM RNA, also designated SEQ ID:3085.

Another function of VGAM374 is therefore inhibition of KIAA1719 (Accession XM_042936). Accordingly, utilities of VGAM374 include diagnosis, prevention and treatment of diseases and clinical conditions associated with KIAA1719. LIM and SH3 Protein 1 (LASP1, Accession NM_006148) is another VGAM374 host target gene. LASP1 BINDING SITE is HOST TARGET binding site found in the 3' untranslated region of mRNA encoded by LASP1, corresponding to a HOST TARGET binding site such as BINDING SITE I, BINDING SITE II or BINDING SITE III. Table 2 illustrates the complementarity of the nucleotide sequences of LASP1 BINDING SITE, designated SEQ ID:12802, to the nucleotide sequence of VGAM374 RNA, herein designated VGAM RNA, also designated SEQ ID:3085.

Another function of VGAM374 is therefore inhibition of LIM and SH3 Protein 1 (LASP1, Accession NM_006148). Accordingly, utilities of VGAM374 include diagnosis, prevention and treatment of diseases and clinical conditions associated with LASP1. MGC4707 (Accession NM_024113) is another VGAM374 host target gene. MGC4707 BINDING SITE is HOST TARGET binding site found in the 3' untranslated region of mRNA encoded by MGC4707, corresponding to a HOST TARGET binding site such as BINDING SITE I, BINDING SITE II or BINDING SITE III. Table 2 illustrates the complementarity of the nucleotide sequences of MGC4707 BINDING SITE, designated SEQ ID:23564, to the nucleotide sequence of VGAM374 RNA, herein designated VGAM RNA, also designated SEQ ID:3085.

Another function of VGAM374 is therefore inhibition of MGC4707 (Accession NM_024113). Accordingly, utilities of VGAM374 include diagnosis, prevention and treatment of diseases and clinical conditions associated with MGC4707. LOC150139 (Accession XM_086794) is another VGAM374 host target gene. LOC150139 BINDING SITE is HOST TARGET binding site found in the 3' untranslated region of mRNA encoded by LOC150139, corresponding to a HOST TARGET binding site such as BINDING SITE I, BINDING SITE II or BINDING SITE III. Table 2 illustrates the complementarity of the nucleotide sequences of LOC150139 BINDING SITE, designated SEQ ID:38860, to the nucleotide sequence of VGAM374 RNA, herein designated VGAM RNA, also designated SEQ ID:3085.

Another function of VGAM374 is therefore inhibition of LOC150139 (Accession XM_086794). Accordingly, utilities of VGAM374 include diagnosis, prevention and treatment of diseases and clinical conditions associated with LOC150139. FIG. 1 further provides a conceptual description of a novel bioinformatically detected viral gene of the present invention, referred to here as Viral Genomic Address Messenger 375 (VGAM375) viral gene, which modulates expression of respective host target genes thereof, the function and utility of which host target genes is known in the art.

VGAM375 is a novel bioinformatically detected regulatory, non protein coding, viral micro RNA (miRNA) gene. The method by which VGAM375 was detected is described hereinabove with reference to FIGS. 1-8.

VGAM375 gene, herein designated VGAM GENE, is a viral gene contained in the genome of Avian Infectious Bronchitis Virus. VGAM375 host target gene, herein designated VGAM HOST TARGET GENE, is a human gene contained in the human genome.

VGAM375 gene encodes a VGAM375 precursor RNA, herein designated VGAM PRECURSOR RNA. Similar to other miRNA genes, and unlike most ordinary genes, VGAM375 precursor RNA does not encode a protein. A nucleotide sequence identical or highly similar to the nucleotide sequence of VGAM375 precursor RNA is designated SEQ ID:361, and is provided hereinbelow with reference to the sequence listing part. Nucleotide sequence SEQ ID:361 is located at position 19796 relative to the genome of Avian Infectious Bronchitis Virus.

VGAM375 precursor RNA folds onto itself, forming VGAM375 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM375 folded precursor RNA into VGAM375 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM375 RNA is designated SEQ ID:3086, and is provided hereinbelow with reference to the sequence listing part.

VGAM375 host target gene, herein designated VGAM HOST TARGET GENE, encodes a corresponding messenger RNA, VGAM375 host target RNA, herein designated VGAM HOST TARGET RNA. VGAM375 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM375 RNA, herein designated VGAM RNA, binds complementarily to one or more host target binding sites located in untranslated regions of VGAM375 host target RNA, herein designated VGAM HOST TARGET RNA. This complementary binding is due to the fact that the nucleotide sequence of VGAM375 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM375 RNA, herein designated VGAM RNA, may have a different number of host target binding sites in untranslated regions of a VGAM375 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM375 RNA, herein designated VGAM RNA, to host target binding sites on VGAM375 host target RNA, herein designated VGAM HOST TARGET RNA, such as BINDING SITE I, BINDING SITE II and BINDING SITE III, inhibits translation of VGAM375 host target RNA into VGAM375 host target protein, herein designated VGAM HOST TARGET PROTEIN. VGAM host target protein is therefore outlined by a broken line.

It is appreciated that VGAM375 host target gene, herein designated VGAM HOST TARGET GENE, in fact represents a plurality of VGAM375 host target genes. The mRNA of each one of this plurality of VGAM375 host target genes comprises one or more host target binding sites, each having a nucleotide sequence which is at least partly complementary to VGAM375 RNA, herein designated VGAM RNA, and which when bound by VGAM375 RNA causes inhibition of translation of respective one or more VGAM375 host target proteins.

It is further appreciated by one skilled in the art that the mode of translational inhibition illustrated by FIG. 1 with specific reference to translational inhibition exerted by VGAM375 gene, herein designated VGAM GENE, on one or more VGAM375 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM375 is inhibition of expression of host target genes, as part of a novel viral mechanism of attacking a host. Accordingly, utilities of VGAM375 include diagnosis, prevention and treatment of viral infection by Avian Infectious Bronchitis Virus. Specific functions, and accordingly utilities, of VGAM375 correlate with, and may be deduced from, the identity of the host target genes which VGAM375 binds and inhibits, and the function of these host target genes, as elaborated hereinbelow.

Nucleotide sequences of the VGAM375 precursor RNA, herein designated VGAM PRECURSOR RNA, and of the 'diced' VGAM375 RNA, herein designated VGAM RNA, and a schematic representation of the secondary folding of VGAM375 folded precursor RNA, herein designated VGAM FOLDED PRECURSOR RNA, of VGAM375 are further described hereinbelow with reference to Table 1.

Nucleotide sequences of host target binding sites, such as BINDING SITE-I, BINDING SITE-II and BINDING SITE-III of FIG. 1, found on VGAM375 host target RNA, and schematic representation of the complementarity of each of these host target binding sites to VGAM375 RNA, herein designated VGAM RNA, are described hereinbelow with reference to Table 2.

As mentioned hereinabove with reference to FIG. 1, a function of VGAM375 gene, herein designated VGAM is inhibition of expression of VGAM375 target genes. It is appreciated that specific functions, and accordingly utilities, of VGAM375 correlate with, and may be deduced from, the identity of the target genes which VGAM375 binds and inhibits, and the function of these target genes, as elaborated hereinbelow.

Nuclear Receptor Subfamily 5, Group A, Member 2 (NR5A2, Accession NM_003822) is a VGAM375 host target gene. NR5A2 BINDING SITE is HOST TARGET binding site found in the 3' untranslated region of mRNA encoded by NR5A2, corresponding to a HOST TARGET binding site such as BINDING SITE I, BINDING SITE II or BINDING SITE III. Table 2 illustrates the complementarity of the nucleotide sequences of NR5A2 BINDING SITE, designated SEQ ID:9916, to the nucleotide sequence of VGAM375 RNA, herein designated VGAM RNA, also designated SEQ ID:3086.

A function of VGAM375 is therefore inhibition of Nuclear Receptor Subfamily 5, Group A, Member 2 (NR5A2, Accession NM_003822), a gene which is a member of nuclear receptor superfamily of trancriptional activators and activates the hepatitis B virus (HBV) promoter. Accordingly, utilities of VGAM375 include diagnosis, prevention and treatment of diseases and clinical conditions associated with NR5A2. The function of NR5A2 has been established by previous studies. By means of yeast one-hybrid screening of a liver cDNA library, Li et al. (1998) cloned a cDNA encoding a novel hepatocyte transcription factor, which they called HB1F for human B1-binding factor. The deduced 495-amino acid protein, which has a molecular mass of 54 kD, belongs to the fushi tarazu factor-1 (OMIM Ref. No. FTZ-F1) subfamily of orphan nuclear receptors and is closely related to steroidogenic factor-1 (SF1; 184757), another member of this subfamily. HB1F contains a DNA-binding domain with 2 zinc finger motifs, an FTZ-F1 box, and a ligand-binding domain. Northern blot analysis revealed that HB1F is expressed in liver, pancreas, and lung as a 5.2-kb transcript. An additional transcript of 3.8 kb was present in hepatoma cells HepG2. The authors identified 2 HB1F isoforms which differ in their A/B region. HB1F specifically binds and activates viral hepatitis B enhancer II, an essential element for the liver-specific regulation of hepatitis B virus gene expression. Cholesterol 7-alpha-hydroxylase is the first and rate-limiting enzyme in a pathway through which cholesterol is metabolized to bile acids. The gene encoding cholesterol 7-alpha-hydroxylase, CYP7A (OMIM Ref. No. 118455), is expressed exclusively in the liver. Overexpression of CYP7A in hamsters results in reduction of serum cholesterol levels, suggesting that the enzyme plays a central role in cholesterol homeostasis. Nitta et al. (1999) reported the identification of a liver-specific transcription factor that binds to the promoter of the human CYP7A gene. They designated this factor CPF for 'CYP7A promoter-binding factor' and identified it as a human homolog of the Drosophila orphan nuclear receptor fushi tarazu F1 (OMIM Ref. No. Ftz-F1). Nitta et al. (1999) isolated a CPF cDNA encoding a 495-amino acid protein from a human liver cDNA library. They found evidence for 2 CPF variants derived from alternative splicing. Northern blot analysis detected enriched expression in pancreas and liver, with a low level of expression in heart and lung. Mutation of the CPF binding site within the CYP7A promoter abolished liver-specific expression of the gene in transient transfection assays. Cotransfection of a CPF expression plasmid and a CYP7A reporter gene resulted in specific induction of CYP7A-directed transcription. These observations suggested that CPF is a key regulator of human CYP7A gene expression in the liver.

Full details of the abovementioned studies are described in the following publications, the disclosure of which are hereby incorporated by reference:

Li, M.; Xie, Y.-H.; Kong, Y.-Y.; Wu, X.; Zhu, L.; Wang, Y.: Cloning and characterization of a novel human hepatocyte transcription factor, hB1F, which binds and activates enhancer II of hepatitis B virus. J. Biol. Chem. 273: 29022-29031, 1998; and Nitta, M.; Ku, S.; Brown, C.; Okamoto, A. Y.; Shan, B.: CPF: an orphan nuclear receptor that regulates liver-specific expression of the human cholesterol 7-alpha-hydroxylase gene. Proc.

Further studies establishing the function and utilities of NR5A2 are found in John Hopkins OMIM database record ID 604453, and in sited publications numbered 4762, 12136, 594 and 12138 listed in the bibliography section hereinbelow, which are also hereby incorporated by reference. CXYorf1 (Accession XM_088704) is another VGAM375 host target gene. CXYorf1 BINDING SITE is HOST TARGET binding site found in the 5' untranslated region of mRNA encoded by CXYorf1, corresponding to a HOST TARGET binding site such as BINDING SITE I, BINDING SITE II or BINDING SITE III. Table 2 illustrates the complementarity of the nucleotide sequences of CXYorf1 BINDING SITE, designated SEQ ID:39908, to the nucleotide sequence of VGAM375 RNA, herein designated VGAM RNA, also designated SEQ ID:3086.

Another function of VGAM375 is therefore inhibition of CXYorf1 (Accession XM_088704). Accordingly, utilities of VGAM375 include diagnosis, prevention and treatment of diseases and clinical conditions associated with CXYorf1. DKFZP434L0718 (Accession NM_032139) is another VGAM375 host target gene. DKFZP434L0718 BINDING SITE is HOST TARGET binding site found in the 3' untranslated region of mRNA encoded by DKFZP434L0718, corresponding to a HOST TARGET binding site such as BINDING SITE I, BINDING SITE II or BINDING SITE III. Table 2 illustrates the complementarity of the nucleotide sequences of DKFZP434L0718 BINDING SITE, designated SEQ ID:25820, to the nucleotide sequence of VGAM375 RNA, herein designated VGAM RNA, also designated SEQ ID:3086.

Another function of VGAM375 is therefore inhibition of DKFZP434L0718 (Accession NM_032139). Accordingly, utilities of VGAM375 include diagnosis, prevention and treatment of diseases and clinical conditions associated with DKFZP434L0718. FLJ21302 (Accession NM_022901) is another VGAM375 host target gene. FLJ21302 BINDING SITE is HOST TARGET binding site found in the 3' untranslated region of mRNA encoded by FLJ21302, corresponding to a HOST TARGET binding site such as BINDING SITE I, BINDING SITE II or BINDING SITE III. Table 2 illustrates the complementarity of the nucleotide sequences of FLJ21302 BINDING SITE, designated SEQ ID:23183, to the nucleotide sequence of VGAM375 RNA, herein designated VGAM RNA, also designated SEQ ID:3086.

Another function of VGAM375 is therefore inhibition of FLJ21302 (Accession NM_022901). Accordingly, utilities of VGAM375 include diagnosis, prevention and treatment of diseases and clinical conditions associated with FLJ21302. LOC200093 (Accession XM_032184) is another VGAM375 host target gene. LOC200093 BINDING SITE is HOST TARGET binding site found in the 5' untranslated region of mRNA encoded by LOC200093, corresponding to a HOST TARGET binding site such as BINDING SITE I, BINDING SITE II or BINDING SITE III. Table 2 illustrates the complementarity of the nucleotide sequences of LOC200093 BINDING SITE, designated SEQ ID:31600, to the nucleotide sequence of VGAM375 RNA, herein designated VGAM RNA, also designated SEQ ID:3086.

Another function of VGAM375 is therefore inhibition of LOC200093 (Accession XM_032184). Accordingly, utilities of VGAM375 include diagnosis, prevention and treatment of diseases and clinical conditions associated with LOC200093. LOC91040 (Accession XM_035641) is another VGAM375 host target gene. LOC91040 BINDING SITE is HOST TARGET binding site found in the 5' untranslated region of mRNA encoded by LOC91040, corresponding to a HOST TARGET binding site such as BINDING SITE I, BINDING SITE II or BINDING SITE III. Table 2 illustrates the complementarity of the nucleotide sequences of LOC91040 BINDING SITE, designated SEQ ID:32317, to the nucleotide sequence of VGAM375 RNA, herein designated VGAM RNA, also designated SEQ ID:3086.

Another function of VGAM375 is therefore inhibition of LOC91040 (Accession XM_035641). Accordingly, utilities of VGAM375 include diagnosis, prevention and treatment of diseases and clinical conditions associated with LOC91040. FIG. 1 further provides a conceptual description of a novel bioinformatically detected viral gene of the present invention, referred to here as Viral Genomic Address Messenger 376 (VGAM376) viral gene, which modulates expression of respective host target genes thereof, the function and utility of which host target genes is known in the art.

VGAM376 is a novel bioinformatically detected regulatory, non protein coding, viral micro RNA (miRNA) gene. The method by which VGAM376 was detected is described hereinabove with reference to FIGS. 1-8.

VGAM376 gene, herein designated VGAM GENE, is a viral gene contained in the genome of Eggplant Mosaic Virus.

VGAM376 host target gene, herein designated VGAM HOST TARGET GENE, is a human gene contained in the human genome.

VGAM376 gene encodes a VGAM376 precursor RNA, herein designated VGAM PRECURSOR RNA. Similar to other miRNA genes, and unlike most ordinary genes, VGAM376 precursor RNA does not encode a protein. A nucleotide sequence identical or highly similar to the nucleotide sequence of VGAM376 precursor RNA is designated SEQ ID:362, and is provided hereinbelow with reference to the sequence listing part. Nucleotide sequence SEQ ID:362 is located at position 1184 relative to the genome of Eggplant Mosaic Virus.

VGAM376 precursor RNA folds onto itself, forming VGAM376 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM376 folded precursor RNA into VGAM376 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM376 RNA is designated SEQ ID:3087, and is provided hereinbelow with reference to the sequence listing part.

VGAM376 host target gene, herein designated VGAM HOST TARGET GENE, encodes a corresponding messenger RNA, VGAM376 host target RNA, herein designated VGAM HOST TARGET RNA. VGAM376 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM376 RNA, herein designated VGAM RNA, binds complementarily to one or more host target binding sites located in untranslated regions of VGAM376 host target RNA, herein designated VGAM HOST TARGET RNA. This complementary binding is due to the fact that the nucleotide sequence of VGAM376 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM376 RNA, herein designated VGAM RNA, may have a different number of host target binding sites in untranslated regions of a VGAM376 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM376 RNA, herein designated VGAM RNA, to host target binding sites on VGAM376 host target RNA, herein designated VGAM HOST TARGET RNA, such as BINDING SITE I, BINDING SITE II and BINDING SITE III, inhibits translation of VGAM376 host target RNA into VGAM376 host target protein, herein designated VGAM HOST TARGET PROTEIN. VGAM host target protein is therefore outlined by a broken line.

It is appreciated that VGAM376 host target gene, herein designated VGAM HOST TARGET GENE, in fact represents a plurality of VGAM376 host target genes. The mRNA of each one of this plurality of VGAM376 host target genes comprises one or more host target binding sites, each having a nucleotide sequence which is at least partly complementary to VGAM376 RNA, herein designated VGAM RNA, and which when bound by VGAM376 RNA causes inhibition of translation of respective one or more VGAM376 host target proteins.

It is further appreciated by one skilled in the art that the mode of translational inhibition illustrated by FIG. 1 with specific reference to translational inhibition exerted by VGAM376 gene, herein designated VGAM GENE, on one or more VGAM376 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM376 is inhibition of expression of host target genes, as part of a novel viral mechanism of attacking a host. Accordingly, utilities of VGAM376 include diagnosis, prevention and treatment of viral infection by Eggplant Mosaic Virus. Specific functions, and accordingly utilities, of VGAM376 correlate with, and may be deduced from, the identity of the host target genes which VGAM376 binds and inhibits, and the function of these host target genes, as elaborated hereinbelow.

Nucleotide sequences of the VGAM376 precursor RNA, herein designated VGAM PRECURSOR RNA, and of the 'diced' VGAM376 RNA, herein designated VGAM RNA, and a schematic representation of the secondary folding of VGAM376 folded precursor RNA, herein designated VGAM FOLDED PRECURSOR RNA, of VGAM376 are further described hereinbelow with reference to Table 1.

Nucleotide sequences of host target binding sites, such as BINDING SITE-I, BINDING SITE-II and BINDING SITE-III of FIG. 1, found on VGAM376 host target RNA, and schematic representation of the complementarity of each of these host target binding sites to VGAM376 RNA, herein designated VGAM RNA, are described hereinbelow with reference to Table 2.

As mentioned hereinabove with reference to FIG. 1, a function of VGAM376 gene, herein designated VGAM is inhibition of expression of VGAM376 target genes. It is appreciated that specific functions, and accordingly utilities, of VGAM376 correlate with, and may be deduced from, the identity of the target genes which VGAM376 binds and inhibits, and the function of these target genes, as elaborated hereinbelow.

G Protein-coupled Receptor 48 (GPR48, Accession NM_018490) is a VGAM376 host target gene. GPR48 BINDING SITE is HOST TARGET binding site found in the 5' untranslated region of mRNA encoded by GPR48, corresponding to a HOST TARGET binding site such as BINDING SITE I, BINDING SITE II or BINDING SITE III. Table 2 illustrates the complementarity of the nucleotide sequences of GPR48 BINDING SITE, designated SEQ ID:20550, to the nucleotide sequence of VGAM376 RNA, herein designated VGAM RNA, also designated SEQ ID:3087.

A function of VGAM376 is therefore inhibition of G Protein-coupled Receptor 48 (GPR48, Accession NM_018490), a gene which binds to follicle-stimulating hormone and thyroid-stimulating hormone. Accordingly, utilities of VGAM376 include diagnosis, prevention and treatment of diseases and clinical conditions associated with GPR48. The function of GPR48 has been established by previous studies. By EST database searching with known GPCRs as queries, Hsu et al. (1998) identified ESTs encoding transmembrane domains 4 and 5 of human GPR48, which they called LGR4. By RT-PCR and repeated screening of a rat ovary cDNA library, they isolated a full-length cDNA encoding rat Lgr4. Sequence analysis predicted that the 951-amino acid rat Lgr4 protein contains a signal peptide; N- and C-flanking cysteine-rich sequences separated by 17 LRRs; 5 potential N-glycosylation sites; a transmembrane region; and a 145-residue cytoplasmic tail with multiple phosphorylation sites and a conserved potential protein kinase A (see OMIM Ref. No. 176911) phosphorylation site. Northern blot analysis of human tissues detected a 5.5-kb LGR4 transcript in multiple steroidogenic tissues and in a number of other tissues. Functional analysis showed that expression of a chimeric receptor composed of the extracellular domain of luteinizing hormone receptor (OMIM Ref. No. 152790) with the transmembrane and cytoplasmic domains of Lgr4 resulted in binding of hCG (OMIM Ref. No. 118860) but no increase in basal production of cAMP, suggesting that LGR4 may signal through another mechanism. Loh et al. (2001) cloned human GPR48. Like rat Lgr4, the deduced human GPR48 protein has 951 amino acids and a similar structure. Northern blot analysis detected wide expression of GPR48 that was highest in pancreas. Within brain, highest expression of GPR48 was in hippocampus and amygdala. Expression of Gpr48 in mouse embryos occurred as early as embryonic day 7 and peaked at day 15.

Full details of the abovementioned studies are described in the following publications, the disclosure of which are hereby incorporated by reference:

Hsu, S. Y.; Liang, S.-G.; Hsueh, A. J. W.: Characterization of two LGR genes homologous to gonadotropin and thyrotropin receptors with extracellular leucine-rich repeats and a G protein-coupled, seven-transmembrane region. Molec. Endocr. 12: 1830-1845, 1998; and Loh, E. D.; Broussard, S. R.; Kolakowski, L. F.: Molecular characterization of a novel glycoprotein hormone G-protein-coupled receptor. Biochem. Biophys. Res. Commun. 282: 757-764, 2001.

Further studies establishing the function and utilities of GPR48 are found in John Hopkins OMIM database record ID 606666, and in sited publications numbered 6451-6453 listed in the bibliography section hereinbelow, which are also hereby incorporated by reference. Mature T-cell Proliferation 1 (MTCP1, Accession NM_014221) is another VGAM376 host target gene. MTCP1 BINDING SITE is HOST TARGET binding site found in the 5' untranslated region of mRNA encoded by MTCP1, corresponding to a HOST TARGET binding site such as BINDING SITE I, BINDING SITE II or BINDING SITE III. Table 2 illustrates the complementarity of the nucleotide sequences of MTCP1 BINDING SITE, designated SEQ ID:15487, to the nucleotide sequence of VGAM376 RNA, herein designated VGAM RNA, also designated SEQ ID:3087.

Another function of VGAM376 is therefore inhibition of Mature T-cell Proliferation 1 (MTCP1, Accession NM_014221). Accordingly, utilities of VGAM376 include diagnosis, prevention and treatment of diseases and clinical conditions associated with MTCP1. Nuclear Protein, Ataxia-telangiectasia Locus (NPAT, Accession XM_040846) is another VGAM376 host target gene. NPAT BINDING SITE is HOST TARGET binding site found in the 3' untranslated region of mRNA encoded by NPAT, corresponding to a HOST TARGET binding site such as BINDING SITE I, BINDING SITE II or BINDING SITE III. Table 2 illustrates the complementarity of the nucleotide sequences of NPAT BINDING SITE, designated SEQ ID:33386, to the nucleotide sequence of VGAM376 RNA, herein designated VGAM RNA, also designated SEQ ID:3087.

Another function of VGAM376 is therefore inhibition of Nuclear Protein, Ataxia-telangiectasia Locus (NPAT, Accession XM_040846), a gene which is expressed in all tissues. Accordingly, utilities of VGAM376 include diagnosis, prevention and treatment of diseases and clinical conditions associated with NPAT. The function of NPAT has been established by previous studies. From the region of the ataxia-telangiectasia gene (ATM; 208900) on 11q22-q23, Imai et al. (1996) identified a new gene, which they designated NPAT. The gene lies only 0.5 kb from the 5-prime end of the ATM gene and is transcribed in the opposite direction as ATM. The gene encodes a 1,427-amino acid protein containing nuclear localization signals and target sites for phosphorylation by cyclin-dependent protein kinases associated with E2F (see OMIM Ref. No. 189971). NPAT has a calculated molecular mass of 154,300 Da. It is relatively serine and threonine rich. The mRNA of NPAT was detected in all human tissues examined and its genomic sequence was strongly conserved through eukaryotes, suggesting that the NPAT gene may be essential for cell maintenance, i.e., a housekeeping gene. Imai et al. (1996) proposed that the promoter region may be shared by ATM and NPAT and that each gene may influence the expression of the other. They stated that they had identified no mutations of NPAT in 8 Japanese ataxia-telangiectasia patients. Byrd et al. (1996) identified a gene, which they designated E14, as a novel open reading frame in close proximity to the 5-prime end of the ATM gene. The E14 gene is transcribed divergently from a promoter region that it shares with ATM. The authors estimated that the complete E14 gene is more than 55 kb in length. They described its exon/intron boundaries; exon 13 is 1,653 bp long and comprises over a third of the coding sequence. Byrd et al. (1996) found that the gene is ubiquitously expressed. They detected 3 mRNA species: the most abundant transcript was 6.25 kb and the less abundant transcripts were 8.8 kb and 5.3 kb. They proposed that the 2 most abundant species resulted from the use of alternative poly (A) signals. Byrd et al. (1996) reported that serine and threonine residues comprise 21% of the E14 protein. Their studies demonstrated that the E14/ATM intergenic region functions as a bidirectional promoter. From studies of 5 ataxia-telangiectasia patients, Byrd et al. (1996) obtained no evidence for mutations in the E14 coding or promoter regions.

Full details of the abovementioned studies are described in the following publications, the disclosure of which are hereby incorporated by reference:

Byrd, P. J.; Cooper, P. R.; Stankovic, T.; Kullar, H. S.; Watts, G. D. J.; Robinson, P. J.; Taylor, M. R.: A gene transcribed from the bidirectional ATM promoter coding for a serine rich protein: amino acid sequence, structure and expression studies. Hum. Molec. Genet. 5:1785-1791, 1996; and Imai, T.; Yamauchi, M.; Seki, N.; Sugawara, T.; Saito, T.; Matsuda, Y.; Ito, H.; Nagase, T.; Nomura, N.; Hori, T.: Identification and characterization of a new gene physically linked t.

Further studies establishing the function and utilities of NPAT are found in John Hopkins OMIM database record ID 601448, and in sited publications numbered 9637, 9638-9641, 132 and 1352 listed in the bibliography section hereinbelow, which are also hereby incorporated by reference. Solute Carrier Family 12 (potassium/chloride transporters), Member 7 (SLC12A7, Accession NM_006598) is another VGAM376 host target gene. SLC12A7 BINDING SITE is HOST TARGET binding site found in the 3" untranslated region of mRNA encoded by SLC12A7, corresponding to a HOST TARGET binding site such as BINDING SITE I, BINDING SITE II or BINDING SITE III. Table 2 illustrates the complementarity of the nucleotide sequences of SLC12A7 BINDING SITE, designated SEQ ID:13376, to the nucleotide sequence of VGAM376 RNA, herein designated VGAM RNA, also designated SEQ ID:3087.

Another function of VGAM376 is therefore inhibition of Solute Carrier Family 12 (potassium/chloride transporters), Member 7 (SLC12A7, Accession NM_006598), a gene which is a potassium/chloride-cotransporter. Accordingly, utilities of VGAM376 include diagnosis, prevention and treatment of diseases and clinical conditions associated with SLC12A7. The function of SLC12A7 and its association with various diseases and clinical conditions, has been established by previous studies, as described hereinabove with reference to VGAM200. Wingless-type MMTV Integration Site Family, Member 3A (WNT3A, Accession NM_033131) is another VGAM376 host target gene. WNT3A BINDING SITE is HOST TARGET binding site found in the 3' untranslated region of mRNA encoded by WNT3A, corresponding to a HOST TARGET binding site such as BINDING SITE I, BINDING SITE II or BINDING SITE III. Table 2 illustrates the complementarity of the nucleotide sequences of WNT3A BINDING SITE, designated SEQ ID:26975, to the nucleotide sequence of VGAM376 RNA, herein designated VGAM RNA, also designated SEQ ID:3087.

Another function of VGAM376 is therefore inhibition of Wingless-type MMTV Integration Site Family, Member 3A (WNT3A, Accession NM_033131). Accordingly, utilities of VGAM376 include diagnosis, prevention and treatment of diseases and clinical conditions associated with WNT3A. Bladder Cancer Associated Protein (BLCAP, Accession NM_006698) is another VGAM376 host target gene. BLCAP BINDING SITE is HOST TARGET binding site found in the 3' untranslated region of mRNA encoded by BLCAP, corresponding to a HOST TARGET binding site such as BINDING SITE I, BINDING SITE II or BINDING SITE III. Table 2 illustrates the complementarity of the nucleotide sequences of BLCAP BINDING SITE, designated SEQ ID:13522, to the nucleotide sequence of VGAM376 RNA, herein designated VGAM RNA, also designated SEQ ID:3087.

Another function of VGAM376 is therefore inhibition of Bladder Cancer Associated Protein (BLCAP, Accession NM_006698). Accordingly, utilities of VGAM376 include diagnosis, prevention and treatment of diseases and clinical conditions associated with BLCAP. Calcium Binding Protein 5 (CABP5, Accession NM_019855) is another VGAM376 host target gene. CABP5 BINDING SITE is HOST TARGET binding site found in the 3' untranslated region of mRNA encoded by CABP5, corresponding to a HOST TARGET binding site such as BINDING SITE I, BINDING SITE II or BINDING SITE III. Table 2 illustrates the complementarity of the nucleotide sequences of CABP5 BINDING SITE, designated SEQ ID:21260, to the nucleotide sequence of VGAM376 RNA, herein designated VGAM RNA, also designated SEQ ID:3087.

Another function of VGAM376 is therefore inhibition of Calcium Binding Protein 5 (CABP5, Accession NM_019855). Accordingly, utilities of VGAM376 include diagnosis, prevention and treatment of diseases and clinical conditions associated with CABP5. FLJ12425 (Accession XM_098290) is another VGAM376 host target gene. FLJ12425 BINDING SITE is HOST TARGET binding site found in the 3' untranslated region of mRNA encoded by FLJ12425, corresponding to a HOST TARGET binding site such as BINDING SITE I, BINDING SITE II or BINDING SITE III. Table 2 illustrates the complementarity of the nucleotide sequences of FLJ12425 BINDING SITE, designated SEQ ID:41564, to the nucleotide sequence of VGAM376 RNA, herein designated VGAM RNA, also designated SEQ ID:3087.

Another function of VGAM376 is therefore inhibition of FLJ12425 (Accession XM_098290). Accordingly, utilities of VGAM376 include diagnosis, prevention and treatment of diseases and clinical conditions associated with FLJ12425. KIAA1981 (Accession XM_114000) is another VGAM376 host target gene. KIAA1981 BINDING SITE is HOST TARGET binding site found in the 3' untranslated region of mRNA encoded by KIAA1981, corresponding to a HOST TARGET binding site such as BINDING SITE I, BINDING SITE II or BINDING SITE III. Table 2 illustrates the complementarity of the nucleotide sequences of KIAA1981 BINDING SITE, designated SEQ ID:42610, to the nucleotide sequence of VGAM376 RNA, herein designated VGAM RNA, also designated SEQ ID:3087.

Another function of VGAM376 is therefore inhibition of KIAA1981 (Accession XM_114000). Accordingly, utilities of VGAM376 include diagnosis, prevention and treatment of diseases and clinical conditions associated with KIAA1981. PSR (Accession XM_036784) is another VGAM376 host target gene. PSR BINDING SITE is HOST TARGET binding site found in the 3" untranslated region of mRNA encoded by PSR, corresponding to a HOST TARGET binding site such as BINDING SITE I, BINDING SITE II or BINDING SITE III. Table 2 illustrates the complementarity of the nucleotide sequences of PSR BINDING SITE, designated SEQ ID:32502, to the nucleotide sequence of VGAM376 RNA, herein designated VGAM RNA, also designated SEQ ID:3087.

Another function of VGAM376 is therefore inhibition of PSR (Accession XM_036784). Accordingly, utilities of VGAM376 include diagnosis, prevention and treatment of diseases and clinical conditions associated with PSR. SCYB11 (Accession XM_113426) is another VGAM376 host target gene. SCYB11 BINDING SITE is HOST TARGET binding site found in the 3' untranslated region of mRNA encoded by SCYB11, corresponding to a HOST TARGET binding site such as BINDING SITE I, BINDING SITE II or BINDING SITE III. Table 2 illustrates the complementarity of the nucleotide sequences of SCYB11 BINDING SITE, designated SEQ ID:42260, to the nucleotide sequence of VGAM376 RNA, herein designated VGAM RNA, also designated SEQ ID:3087.

Another function of VGAM376 is therefore inhibition of SCYB11 (Accession XM_113426). Accordingly, utilities of VGAM376 include diagnosis, prevention and treatment of diseases and clinical conditions associated with SCYB11. SMOC2 (Accession XM_051452) is another VGAM376 host target gene. SMOC2 BINDING SITE is HOST TARGET binding site found in the 5' untranslated region of mRNA encoded by SMOC2, corresponding to a HOST TARGET binding site such as BINDING SITE I, BINDING SITE II or BINDING SITE III. Table 2 illustrates the complementarity of the nucleotide sequences of SMOC2 BINDING SITE, designated SEQ ID:35836, to the nucleotide sequence of VGAM376 RNA, herein designated VGAM RNA, also designated SEQ ID:3087.

Another function of VGAM376 is therefore inhibition of SMOC2 (Accession XM_051452). Accordingly, utilities of VGAM376 include diagnosis, prevention and treatment of diseases and clinical conditions associated with SMOC2. Signal Transducer and Activator of Transcription 2, 113 kDa (STAT2, Accession NM_005419) is another VGAM376 host target gene. STAT2 BINDING SITE is HOST TARGET binding site found in the 3' untranslated region of mRNA encoded by STAT2, corresponding to a HOST TARGET binding site such as BINDING SITE I, BINDING SITE II or BINDING SITE III. Table 2 illustrates the complementarity of the nucleotide sequences of STAT2 BINDING SITE, designated SEQ ID:11893, to the nucleotide sequence of VGAM376 RNA, herein designated VGAM RNA, also designated SEQ ID:3087.

Another function of VGAM376 is therefore inhibition of Signal Transducer and Activator of Transcription 2, 113 kDa (STAT2, Accession NM_005419). Accordingly, utilities of VGAM376 include diagnosis, prevention and treatment of diseases and clinical conditions associated with STAT2. VI (Accession NM_013443) is another VGAM376 host target gene. VI BINDING SITE is HOST TARGET binding site found in the 3' untranslated region of mRNA encoded by VI, corresponding to a HOST TARGET binding site such as BINDING SITE I, BINDING SITE II or BINDING SITE III. Table 2 illustrates the complementarity of the nucleotide sequences of VI BINDING SITE, designated SEQ ID:15109, to the nucleotide sequence of VGAM376 RNA, herein designated VGAM RNA, also designated SEQ ID:3087.

Another function of VGAM376 is therefore inhibition of VI (Accession NM_013443). Accordingly, utilities of VGAM376 include diagnosis, prevention and treatment of diseases and clinical conditions associated with VI. Zinc Finger Protein 238 (ZNF238, Accession NM_006352) is another VGAM376 host target gene. ZNF238 BINDING SITE is HOST TARGET binding site found in the 3' untranslated region of mRNA encoded by ZNF238, corresponding to a HOST TARGET binding site such as BINDING SITE I, BINDING SITE II or BINDING SITE III. Table 2 illustrates the complementarity of the nucleotide sequences of ZNF238 BINDING SITE, designated SEQ ID:13047, to the nucleotide sequence of VGAM376 RNA, herein designated VGAM RNA, also designated SEQ ID:3087.

Another function of VGAM376 is therefore inhibition of Zinc Finger Protein 238 (ZNF238, Accession NM_006352). Accordingly, utilities of VGAM376 include diagnosis, prevention and treatment of diseases and clinical conditions associated with ZNF238. LOC125228 (Accession XM_058913) is another VGAM376 host target gene. LOC125228 BINDING SITE is HOST TARGET binding site found in the 5' untranslated region of mRNA encoded by LOC125228, corresponding to a HOST TARGET binding site such as BINDING SITE I, BINDING SITE II or BINDING SITE III. Table 2 illustrates the complementarity of the nucleotide sequences of LOC125228 BINDING SITE, designated SEQ ID:36793, to the nucleotide sequence of VGAM376 RNA, herein designated VGAM RNA, also designated SEQ ID:3087.

Another function of VGAM376 is therefore inhibition of LOC125228 (Accession XM_058913). Accordingly, utilities of VGAM376 include diagnosis, prevention and treatment of diseases and clinical conditions associated with LOC125228. LOC147671 (Accession XM_085844) is another VGAM376 host target gene. LOC147671 BINDING SITE is HOST TARGET binding site found in the 3' untranslated region of mRNA encoded by LOC147671, corresponding to a HOST TARGET binding site such as BINDING SITE I, BINDING SITE II or BINDING SITE III. Table 2 illustrates the complementarity of the nucleotide sequences of LOC147671 BINDING SITE, designated SEQ ID:38378, to the nucleotide sequence of VGAM376 RNA, herein designated VGAM RNA, also designated SEQ ID:3087.

Another function of VGAM376 is therefore inhibition of LOC147671 (Accession XM_085844). Accordingly, utilities of VGAM376 include diagnosis, prevention and treatment of diseases and clinical conditions associated with LOC147671. LOC158563 (Accession XM_088606) is another VGAM376 host target gene. LOC158563 BINDING SITE is HOST TARGET binding site found in the 3' untranslated region of mRNA encoded by LOC158563, corresponding to a HOST TARGET binding site such as BINDING SITE I, BINDING SITE II or BINDING SITE III. Table 2 illustrates the complementarity of the nucleotide sequences of LOC158563 BINDING SITE, designated SEQ ID:39869, to the nucleotide sequence of VGAM376 RNA, herein designated VGAM RNA, also designated SEQ ID:3087.

Another function of VGAM376 is therefore inhibition of LOC158563 (Accession XM_088606). Accordingly, utilities of VGAM376 include diagnosis, prevention and treatment of diseases and clinical conditions associated with LOC158563. LOC197285 (Accession XM_113752) is another VGAM376 host target gene. LOC197285 BINDING SITE is HOST TARGET binding site found in the 3' untranslated region of mRNA encoded by LOC197285, corresponding to a HOST TARGET binding site such as BINDING SITE I, BINDING SITE II or BINDING SITE III. Table 2 illustrates the complementarity of the nucleotide sequences of LOC197285 BINDING SITE, designated SEQ ID:42416, to the nucleotide sequence of VGAM376 RNA, herein designated VGAM RNA, also designated SEQ ID:3087.

Another function of VGAM376 is therefore inhibition of LOC197285 (Accession XM_113752). Accordingly, utilities of VGAM376 include diagnosis, prevention and treatment of diseases and clinical conditions associated with LOC197285. LOC221839 (Accession XM_166506) is another VGAM376 host target gene. LOC221839 BINDING SITE is HOST TARGET binding site found in the 5' untranslated region of mRNA encoded by LOC221839, corresponding to a HOST TARGET binding site such as BINDING SITE I, BINDING SITE II or BINDING SITE III. Table 2 illustrates the complementarity of the nucleotide sequences of LOC221839 BINDING SITE, designated SEQ ID:44431, to the nucleotide sequence of VGAM376 RNA, herein designated VGAM RNA, also designated SEQ ID:3087.

Another function of VGAM376 is therefore inhibition of LOC221839 (Accession XM_166506). Accordingly, utilities of VGAM376 include diagnosis, prevention and treatment of diseases and clinical conditions associated with LOC221839. LOC90092 (Accession XM_028862) is another VGAM376 host target gene. LOC90092 BINDING SITE is HOST TARGET binding site found in the 3' untranslated region of mRNA encoded by LOC90092, corresponding to a HOST TARGET binding site such as BINDING SITE I, BINDING SITE II or BINDING SITE III. Table 2 illustrates the complementarity of the nucleotide sequences of LOC90092 BINDING SITE, designated SEQ ID:30790, to the nucleotide sequence of VGAM376 RNA, herein designated VGAM RNA, also designated SEQ ID:3087.

Another function of VGAM376 is therefore inhibition of LOC90092 (Accession XM_028862). Accordingly, utilities of VGAM376 include diagnosis, prevention and treatment of diseases and clinical conditions associated with LOC90092. LOC91252 (Accession XM_037173) is another VGAM376 host target gene. LOC91252 BINDING SITE is HOST TARGET binding site found in the 3' untranslated region of mRNA encoded by LOC91252, corresponding to a HOST TARGET binding site such as BINDING SITE I, BINDING SITE II or BINDING SITE III. Table 2 illustrates the complementarity of the nucleotide sequences of LOC91252 BINDING SITE, designated SEQ ID:32555, to the nucleotide sequence of VGAM376 RNA, herein designated VGAM RNA, also designated SEQ ID:3087.

Another function of VGAM376 is therefore inhibition of LOC91252 (Accession XM_037173). Accordingly, utilities of VGAM376 include diagnosis, prevention and treatment of diseases and clinical conditions associated with LOC91252. LOC91960 (Accession XM_041872) is another VGAM376 host target gene. LOC91960 BINDING SITE is HOST TARGET binding site found in the 5' untranslated region of mRNA encoded by LOC91960, corresponding to a HOST TARGET binding site such as BINDING SITE I, BINDING SITE II or BINDING SITE III. Table 2 illustrates the complementarity of the nucleotide sequences of LOC91960 BINDING SITE, designated SEQ ID:33615, to the nucleotide sequence of VGAM376 RNA, herein designated VGAM RNA, also designated SEQ ID:3087.

Another function of VGAM376 is therefore inhibition of LOC91960 (Accession XM_041872). Accordingly, utilities of VGAM376 include diagnosis, prevention and treatment of diseases and clinical conditions associated with LOC91960. FIG. 1 further provides a conceptual description of a novel bioinformatically detected viral gene of the present invention, referred to here as Viral Genomic Address Messenger 377 (VGAM377) viral gene, which modulates expression of respective host target genes thereof, the function and utility of which host target genes is known in the art.

VGAM377 is a novel bioinformatically detected regulatory, non protein coding, viral micro RNA (miRNA) gene. The method by which VGAM377 was detected is described hereinabove with reference to FIGS. 1-8.

VGAM377 gene, herein designated VGAM GENE, is a viral gene contained in the genome of Eggplant Mosaic Virus. VGAM377 host target gene, herein designated VGAM HOST TARGET GENE, is a human gene contained in the human genome.

VGAM377 gene encodes a VGAM377 precursor RNA, herein designated VGAM PRECURSOR RNA. Similar to other miRNA genes, and unlike most ordinary genes, VGAM377 precursor RNA does not encode a protein. A nucleotide sequence identical or highly similar to the nucleotide sequence of VGAM377 precursor RNA is designated SEQ ID:363, and is provided hereinbelow with reference to the sequence listing part. Nucleotide sequence SEQ ID:363 is located at position 2809 relative to the genome of Eggplant Mosaic Virus.

VGAM377 precursor RNA folds onto itself, forming VGAM377 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM377 folded precursor RNA into VGAM377 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM377 RNA is designated SEQ ID:3088, and is provided hereinbelow with reference to the sequence listing part.

VGAM377 host target gene, herein designated VGAM HOST TARGET GENE, encodes a corresponding messenger RNA, VGAM377 host target RNA, herein designated VGAM HOST TARGET RNA. VGAM377 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM377 RNA, herein designated VGAM RNA, binds complementarily to one or more host target binding sites located in untranslated regions of VGAM377 host target RNA, herein designated VGAM HOST TARGET RNA. This complementary binding is due to the fact that the nucleotide sequence of VGAM377 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM377 RNA, herein designated VGAM RNA, may have a different number of host target binding sites in untranslated regions of a VGAM377 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM377 RNA, herein designated VGAM RNA, to host target binding sites on VGAM377 host target RNA, herein designated VGAM HOST TARGET RNA, such as BINDING SITE I, BINDING SITE II and BINDING SITE III, inhibits translation of VGAM377 host target RNA into VGAM377 host target protein, herein designated VGAM HOST TARGET PROTEIN. VGAM host target protein is therefore outlined by a broken line.

It is appreciated that VGAM377 host target gene, herein designated VGAM HOST TARGET GENE, in fact represents a plurality of VGAM377 host target genes. The mRNA of each one of this plurality of VGAM377 host target genes comprises one or more host target binding sites, each having a nucleotide sequence which is at least partly complementary to VGAM377 RNA, herein designated VGAM RNA, and which when bound by VGAM377 RNA causes inhibition of translation of respective one or more VGAM377 host target proteins.

It is further appreciated by one skilled in the art that the mode of translational inhibition illustrated by FIG. 1 with specific reference to translational inhibition exerted by VGAM377 gene, herein designated VGAM GENE, on one or more VGAM377 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM377 is inhibition of expression of host target genes, as part of a novel viral mechanism of attacking a host. Accordingly, utilities of VGAM377 include diagnosis, prevention and treatment of viral infection by Eggplant Mosaic Virus. Specific functions, and accordingly utilities, of VGAM377 correlate with, and may be deduced from, the identity of the host target genes which VGAM377 binds and inhibits, and the function of these host target genes, as elaborated hereinbelow.

Nucleotide sequences of the VGAM377 precursor RNA, herein designated VGAM PRECURSOR RNA, and of the 'diced' VGAM377 RNA, herein designated VGAM RNA, and a schematic representation of the secondary folding of VGAM377 folded precursor RNA, herein designated VGAM FOLDED PRECURSOR RNA, of VGAM377 are further described hereinbelow with reference to Table 1.

Nucleotide sequences of host target binding sites, such as BINDING SITE-I, BINDING SITE-II and BINDING SITE-III of FIG. 1, found on VGAM377 host target RNA, and schematic representation of the complementarity of each of these host target binding sites to VGAM377 RNA, herein designated VGAM RNA, are described hereinbelow with reference to Table 2.

As mentioned hereinabove with reference to FIG. 1, a function of VGAM377 gene, herein designated VGAM is inhibition of expression of VGAM377 target genes. It is appreciated that specific functions, and accordingly utilities, of VGAM377 correlate with, and may be deduced from, the identity of the target genes which VGAM377 binds and inhibits, and the function of these target genes, as elaborated hereinbelow.

D12S2489E (Accession NM_007360) is a VGAM377 host target gene. D12S2489E BINDING SITE is HOST TARGET binding site found in the 3' untranslated region of mRNA encoded by D12S2489E, corresponding to a HOST TARGET binding site such as BINDING SITE I, BINDING SITE II or BINDING SITE III. Table 2 illustrates the complementarity of the nucleotide sequences of D12S2489E BINDING SITE, designated SEQ ID:14291, to the nucleotide sequence of VGAM377 RNA, herein designated VGAM RNA, also designated SEQ ID:3088.

A function of VGAM377 is therefore inhibition of D12S2489E (Accession NM_007360), a gene which interacts in the inhibition and activation of NK cells. Accordingly, utilities of VGAM377 include diagnosis, prevention and treatment of diseases and clinical conditions associated with D12S2489E. The function of D12S2489E and its association with various diseases and clinical conditions, has been established by previous studies, as described hereinabove with reference to VGAM156. Peroxisome Biogenesis Factor 10 (PEX10, Accession NM_002617) is another VGAM377 host target gene. PEX10 BINDING SITE is HOST TARGET binding site found in the 3' untranslated region of mRNA encoded by PEX10, corresponding to a HOST TARGET binding site such as BINDING SITE I, BINDING SITE II or BINDING SITE III. Table 2 illustrates the complementarity of the nucleotide sequences of PEX10 BINDING SITE, designated SEQ ID:8480, to the nucleotide sequence of VGAM377 RNA, herein designated VGAM RNA, also designated SEQ ID:3088.

Another function of VGAM377 is therefore inhibition of Peroxisome Biogenesis Factor 10 (PEX10, Accession NM_002617). Accordingly, utilities of VGAM377 include diagnosis, prevention and treatment of diseases and clinical conditions associated with PEX10. Syntrophin, Beta 1 (dystrophin-associated protein A1, 59 kDa, basic component 1) (SNTB1, Accession NM_021021) is another VGAM377 host target gene. SNTB1 BINDING SITE is HOST TARGET binding site found in the 3' untranslated region of mRNA encoded by SNTB1, corresponding to a HOST TARGET binding site such as BINDING SITE I, BINDING SITE II or BINDING SITE III. Table 2 illustrates the complementarity of the nucleotide sequences of SNTB1 BINDING SITE, designated SEQ ID:22013, to the nucleotide sequence of VGAM377 RNA, herein designated VGAM RNA, also designated SEQ ID:3088.

Another function of VGAM377 is therefore inhibition of Syntrophin, Beta 1 (dystrophin-associated protein A1, 59 kDa, basic component 1) (SNTB1, Accession NM_021021). Accordingly, utilities of VGAM377 include diagnosis, prevention and treatment of diseases and clinical conditions associated with SNTB1. Cleavage and Polyadenylation Specific Factor 2, 100 kDa (CPSF2, Accession XM_029311) is another VGAM377 host target gene. CPSF2 BINDING SITE is HOST TARGET binding site found in the 3' untranslated region of mRNA encoded by CPSF2, corresponding to a HOST TARGET binding site such as BINDING SITE I, BINDING SITE II or BINDING SITE III. Table 2 illustrates the complementarity of the nucleotide sequences of CPSF2 BINDING SITE, designated SEQ ID:30861, to the nucleotide sequence of VGAM377 RNA, herein designated VGAM RNA, also designated SEQ ID:3088.

Another function of VGAM377 is therefore inhibition of Cleavage and Polyadenylation Specific Factor 2, 100 kDa (CPSF2, Accession XM_029311). Accordingly, utilities of VGAM377 include diagnosis, prevention and treatment of diseases and clinical conditions associated with CPSF2. KIAA1183 (Accession XM_031307) is another VGAM377 host target gene. KIAA1183 BINDING SITE is HOST TARGET binding site found in the 3' untranslated region of mRNA encoded by KIAA1183, corresponding to a HOST TARGET binding site such as BINDING SITE I, BINDING SITE II or BINDING SITE III. Table 2 illustrates the complementarity of the nucleotide sequences of KIAA1183 BINDING SITE, designated SEQ ID:31337, to the nucleotide sequence of VGAM377 RNA, herein designated VGAM RNA, also designated SEQ ID:3088.

Another function of VGAM377 is therefore inhibition of KIAA1183 (Accession XM_031307). Accordingly, utilities of VGAM377 include diagnosis, prevention and treatment of diseases and clinical conditions associated with KIAA1183. Mitogen-activated Protein Kinase 6 (MAPK6, Accession NM_002748) is another VGAM377 host target gene. MAPK6 BINDING SITE is HOST TARGET binding site found in the 3' untranslated region of mRNA encoded by MAPK6, corresponding to a HOST TARGET binding site such as BINDING SITE I, BINDING SITE II or BINDING SITE III. Table 2 illustrates the complementarity of the nucleotide sequences of MAPK6 BINDING SITE, designated SEQ ID:8626, to the nucleotide sequence of VGAM377 RNA, herein designated VGAM RNA, also designated SEQ ID:3088.

Another function of VGAM377 is therefore inhibition of Mitogen-activated Protein Kinase 6 (MAPK6, Accession NM_002748). Accordingly, utilities of VGAM377 include diagnosis, prevention and treatment of diseases and clinical conditions associated with MAPK6. MGC21636 (Accession NM_145032) is another VGAM377 host target gene. MGC21636 BINDING SITE is HOST TARGET binding site found in the 5' untranslated region of mRNA encoded by MGC21636, corresponding to a HOST TARGET binding site such as BINDING SITE I, BINDING SITE II or BINDING SITE III. Table 2 illustrates the complementarity of the nucleotide sequences of MGC21636 BINDING SITE, designated SEQ ID:29647, to the nucleotide sequence of VGAM377 RNA, herein designated VGAM RNA, also designated SEQ ID:3088.

Another function of VGAM377 is therefore inhibition of MGC21636 (Accession NM_145032). Accordingly, utilities of VGAM377 include diagnosis, prevention and treatment of diseases and clinical conditions associated with MGC21636. POPX1 (Accession NM_014906) is another VGAM377 host target gene. POPX1 BINDING SITE is HOST TARGET binding site found in the 3' untranslated region of mRNA encoded by POPX1, corresponding to a HOST TARGET binding site such as BINDING SITE I, BINDING SITE II or BINDING SITE III. Table 2 illustrates the complementarity of the nucleotide sequences of POPX1 BINDING SITE, designated SEQ ID:17119, to the nucleotide sequence of VGAM377 RNA, herein designated VGAM RNA, also designated SEQ ID:3088.

Another function of VGAM377 is therefore inhibition of POPX1 (Accession NM_014906). Accordingly, utilities of VGAM377 include diagnosis, prevention and treatment of diseases and clinical conditions associated with POPX1. WD Repeat Domain 9 (WDR9, Accession NM_018963) is another VGAM377 host target gene. WDR9 BINDING SITE is HOST TARGET binding site found in the 3' untranslated region of mRNA encoded by WDR9, corresponding to a HOST TARGET binding site such as BINDING SITE I, BINDING SITE II or BINDING SITE III. Table 2 illustrates the complementarity of the nucleotide sequences of WDR9 BINDING SITE, designated SEQ ID:21032, to the nucleotide sequence of VGAM377 RNA, herein designated VGAM RNA, also designated SEQ ID:3088.

Another function of VGAM377 is therefore inhibition of WD Repeat Domain 9 (WDR9, Accession NM_018963). Accordingly, utilities of VGAM377 include diagnosis, prevention and treatment of diseases and clinical conditions associated with WDR9. LOC170217 (Accession XM_093185) is another VGAM377 host target gene. LOC170217 BINDING SITE is HOST TARGET binding site found in the 5' untranslated region of mRNA encoded by LOC170217, corresponding to a HOST TARGET binding site such as BINDING SITE I, BINDING SITE II or BINDING SITE III. Table 2 illustrates the complementarity of the nucleotide sequences of LOC170217 BINDING SITE, designated SEQ ID:40178, to the nucleotide sequence of VGAM377 RNA, herein designated VGAM RNA, also designated SEQ ID:3088.

Another function of VGAM377 is therefore inhibition of LOC170217 (Accession XM_093185). Accordingly, utilities of VGAM377 include diagnosis, prevention and treatment of diseases and clinical conditions associated with LOC170217. LOC170218 (Accession XM_093186) is another VGAM377 host target gene. LOC170218 BINDING SITE is HOST TARGET binding site found in the 5' untranslated region of mRNA encoded by LOC170218, corresponding to a HOST TARGET binding site such as BINDING SITE I, BINDING SITE II or BINDING SITE III. Table 2 illustrates the complementarity of the nucleotide sequences of LOC170218 BINDING SITE, designated SEQ ID:40180, to the nucleotide sequence of VGAM377 RNA, herein designated VGAM RNA, also designated SEQ ID:3088.

Another function of VGAM377 is therefore inhibition of LOC170218 (Accession XM_093186). Accordingly, utilities of VGAM377 include diagnosis, prevention and treatment of diseases and clinical conditions associated with LOC170218. LOC170372 (Accession XM_084317) is another VGAM377 host target gene. LOC170372 BINDING SITE is HOST TARGET binding site found in the 3' untranslated region of mRNA encoded by LOC170372, corresponding to a HOST TARGET binding site such as BINDING SITE I, BINDING SITE II or BINDING SITE III. Table 2 illustrates the complementarity of the nucleotide sequences of LOC170372 BINDING SITE, designated SEQ ID:37539, to the nucleotide sequence of VGAM377 RNA, herein designated VGAM RNA, also designated SEQ ID:3088.

Another function of VGAM377 is therefore inhibition of LOC170372 (Accession XM_084317). Accordingly, utilities of VGAM377 include diagnosis, prevention and treatment of diseases and clinical conditions associated with LOC170372. LOC219914 (Accession XM_167788) is another VGAM377 host target gene. LOC219914 BINDING SITE is HOST TARGET binding site found in the 5' untranslated region of mRNA encoded by LOC219914, corresponding to a HOST TARGET binding site such as BINDING SITE I, BINDING SITE II or BINDING SITE III. Table 2 illustrates the complementarity of the nucleotide sequences of LOC219914 BINDING SITE, designated SEQ ID:44814, to the nucleotide sequence of VGAM377 RNA, herein designated VGAM RNA, also designated SEQ ID:3088.

Another function of VGAM377 is therefore inhibition of LOC219914 (Accession XM_167788). Accordingly, utilities of VGAM377 include diagnosis, prevention and treatment of diseases and clinical conditions associated with LOC219914. LOC91750 (Accession XM_040376) is another VGAM377 host target gene. LOC91750 BINDING SITE is HOST TARGET binding site found in the 3' untranslated region of mRNA encoded by LOC91750, corresponding to a HOST TARGET binding site such as BINDING SITE I, BINDING SITE II or BINDING SITE III. Table 2 illustrates the complementarity of the nucleotide sequences of LOC91750 BINDING SITE, designated SEQ ID:33288, to the nucleotide sequence of VGAM377 RNA, herein designated VGAM RNA, also designated SEQ ID:3088.

Another function of VGAM377 is therefore inhibition of LOC91750 (Accession XM_040376). Accordingly, utilities of VGAM377 include diagnosis, prevention and treatment of diseases and clinical conditions associated with LOC91750. LOC92096 (Accession XM_042812) is another VGAM377 host target gene. LOC92096 BINDING SITE is HOST TARGET binding site found in the 3' untranslated region of mRNA encoded by LOC92096, corresponding to a HOST TARGET binding site such as BINDING SITE I, BINDING SITE II or BINDING SITE III. Table 2 illustrates the complementarity of the nucleotide sequences of LOC92096 BINDING SITE, designated SEQ ID:33775, to the nucleotide sequence of VGAM377 RNA, herein designated VGAM RNA, also designated SEQ ID:3088.

Another function of VGAM377 is therefore inhibition of LOC92096 (Accession XM_042812). Accordingly, utilities of VGAM377 include diagnosis, prevention and treatment of diseases and clinical conditions associated with LOC92096. FIG. 1 further provides a conceptual description of a novel bioinformatically detected viral gene of the present invention, referred to here as Viral Genomic Address Messenger 378 (VGAM378) viral gene, which modulates expression of respective host target genes thereof, the function and utility of which host target genes is known in the art.

VGAM378 is a novel bioinformatically detected regulatory, non protein coding, viral micro RNA (miRNA) gene. The method by which VGAM378 was detected is described hereinabove with reference to FIGS. 1-8.

VGAM378 gene, herein designated VGAM GENE, is a viral gene contained in the genome of Feline Immunodeficiency Virus. VGAM378 host target gene, herein designated VGAM HOST TARGET GENE, is a human gene contained in the human genome.

VGAM378 gene encodes a VGAM378 precursor RNA, herein designated VGAM PRECURSOR RNA. Similar to other miRNA genes, and unlike most ordinary genes, VGAM378 precursor RNA does not encode a protein. A nucleotide sequence identical or highly similar to the nucleotide sequence of VGAM378 precursor RNA is designated SEQ ID:364, and is provided hereinbelow with reference to the sequence listing part. Nucleotide sequence SEQ ID:364 is located at position 7329 relative to the genome of Feline Immunodeficiency Virus.

VGAM378 precursor RNA folds onto itself, forming VGAM378 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM378 folded precursor RNA into VGAM378 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM378 RNA is designated SEQ ID:3089, and is provided hereinbelow with reference to the sequence listing part.

VGAM378 host target gene, herein designated VGAM HOST TARGET GENE, encodes a corresponding messenger RNA, VGAM378 host target RNA, herein designated VGAM HOST TARGET RNA. VGAM378 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM378 RNA, herein designated VGAM RNA, binds complementarily to one or more host target binding sites located in untranslated regions of VGAM378 host target RNA, herein designated VGAM HOST TARGET RNA. This complementary binding is due to the fact that the nucleotide sequence of VGAM378 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM378 RNA, herein designated VGAM RNA, may have a different number of host target binding sites in untranslated regions of a VGAM378 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM378 RNA, herein designated VGAM RNA, to host target binding sites on VGAM378 host target RNA, herein designated VGAM HOST TARGET RNA, such as BINDING SITE I, BINDING SITE II and BINDING SITE III, inhibits translation of VGAM378 host target RNA into VGAM378 host target protein, herein designated VGAM HOST TARGET PROTEIN. VGAM host target protein is therefore outlined by a broken line.

It is appreciated that VGAM378 host target gene, herein designated VGAM HOST TARGET GENE, in fact represents a plurality of VGAM378 host target genes. The mRNA of each one of this plurality of VGAM378 host target genes comprises one or more host target binding sites, each having a nucleotide sequence which is at least partly complementary to VGAM378 RNA, herein designated VGAM RNA, and which when bound by VGAM378 RNA causes inhibition of translation of respective one or more VGAM378 host target proteins.

It is further appreciated by one skilled in the art that the mode of translational inhibition illustrated by FIG. 1 with specific reference to translational inhibition exerted by VGAM378 gene, herein designated VGAM GENE, on one or more VGAM378 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM378 is inhibition of expression of host target genes, as part of a novel viral mechanism of attacking a host. Accordingly, utilities of VGAM378 include diagnosis, prevention and treatment of viral infection by Feline Immunodeficiency Virus. Specific functions, and accordingly utilities, of VGAM378 correlate with, and may be deduced from, the identity of the host target genes which VGAM378 binds and inhibits, and the function of these host target genes, as elaborated hereinbelow.

Nucleotide sequences of the VGAM378 precursor RNA, herein designated VGAM PRECURSOR RNA, and of the 'diced' VGAM378 RNA, herein designated VGAM RNA, and a schematic representation of the secondary folding of VGAM378 folded precursor RNA, herein designated VGAM FOLDED PRECURSOR RNA, of VGAM378 are further described hereinbelow with reference to Table 1.

Nucleotide sequences of host target binding sites, such as BINDING SITE-I, BINDING SITE-II and BINDING SITE-III of FIG. 1, found on VGAM378 host target RNA, and schematic representation of the complementarity of each of these host target binding sites to VGAM378 RNA, herein designated VGAM RNA, are described hereinbelow with reference to Table 2.

As mentioned hereinabove with reference to FIG. 1, a function of VGAM378 gene, herein designated VGAM is inhibition of expression of VGAM378 target genes. It is appreciated that specific functions, and accordingly utilities, of VGAM378 correlate with, and may be deduced from, the identity of the target genes which VGAM378 binds and inhibits, and the function of these target genes, as elaborated hereinbelow.

IMPACT (Accession NM_018439) is a VGAM378 host target gene. IMPACT BINDING SITE is HOST TARGET binding site found in the 3' untranslated region of mRNA encoded by IMPACT, corresponding to a HOST TARGET binding site such as BINDING SITE I, BINDING SITE II or BINDING SITE III. Table 2 illustrates the complementarity of the nucleotide sequences of IMPACT BINDING SITE, designated SEQ ID:20501, to the nucleotide sequence of VGAM378 RNA, herein designated VGAM RNA, also designated SEQ ID:3089.

A function of VGAM378 is therefore inhibition of IMPACT (Accession NM_018439). Accordingly, utilities of VGAM378 include diagnosis, prevention and treatment of diseases and clinical conditions associated with IMPACT. FIG. 1 further provides a conceptual description of a novel bioinformatically detected viral gene of the present invention, referred to here as Viral Genomic Address Messenger 379 (VGAM379) viral gene, which modulates expression of respective host target genes thereof, the function and utility of which host target genes is known in the art.

VGAM379 is a novel bioinformatically detected regulatory, non protein coding, viral micro RNA (miRNA) gene. The method by which VGAM379 was detected is described hereinabove with reference to FIGS. 1-8.

VGAM379 gene, herein designated VGAM GENE, is a viral gene contained in the genome of Feline Immunodeficiency Virus. VGAM379 host target gene, herein designated VGAM HOST TARGET GENE, is a human gene contained in the human genome.

VGAM379 gene encodes a VGAM379 precursor RNA, herein designated VGAM PRECURSOR RNA. Similar to other miRNA genes, and unlike most ordinary genes, VGAM379 precursor RNA does not encode a protein. A nucleotide sequence identical or highly similar to the nucleotide sequence of VGAM379 precursor RNA is designated SEQ ID:365, and is provided hereinbelow with reference to the sequence listing part. Nucleotide sequence SEQ ID:365 is located at position 7178 relative to the genome of Feline Immunodeficiency Virus.

VGAM379 precursor RNA folds onto itself, forming VGAM379 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM379 folded precursor RNA into VGAM379 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM379 RNA is designated SEQ ID:3090, and is provided hereinbelow with reference to the sequence listing part.

VGAM379 host target gene, herein designated VGAM HOST TARGET GENE, encodes a corresponding messenger RNA, VGAM379 host target RNA, herein designated VGAM HOST TARGET RNA. VGAM379 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM379 RNA, herein designated VGAM RNA, binds complementarily to one or more host target binding sites located in untranslated regions of VGAM379 host target RNA, herein designated VGAM HOST TARGET RNA. This complementary binding is due to the fact that the nucleotide sequence of VGAM379 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM379 RNA, herein designated VGAM RNA, may have a different number of host target binding sites in untranslated regions of a VGAM379 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM379 RNA, herein designated VGAM RNA, to host target binding sites on VGAM379 host target RNA, herein designated VGAM HOST TARGET RNA, such as BINDING SITE I, BINDING SITE II and BINDING SITE III, inhibits translation of VGAM379 host target RNA into VGAM379 host target protein, herein designated VGAM HOST TARGET PROTEIN. VGAM host target protein is therefore outlined by a broken line.

It is appreciated that VGAM379 host target gene, herein designated VGAM HOST TARGET GENE, in fact represents a plurality of VGAM379 host target genes. The mRNA of each one of this plurality of VGAM379 host target genes comprises one or more host target binding sites, each having a nucleotide sequence which is at least partly complementary to VGAM379 RNA, herein designated VGAM RNA, and which when bound by VGAM379 RNA causes inhibition of translation of respective one or more VGAM379 host target proteins.

It is further appreciated by one skilled in the art that the mode of translational inhibition illustrated by FIG. 1 with specific reference to translational inhibition exerted by VGAM379 gene, herein designated VGAM GENE, on one or more VGAM379 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM379 is inhibition of expression of host target genes, as part of a novel viral mechanism of attacking a host. Accordingly, utilities of VGAM379 include diagnosis, prevention and treatment of viral infection by Feline Immunodeficiency Virus. Specific functions, and accordingly utilities, of VGAM379 correlate with, and may be deduced from, the identity of the host target genes which VGAM379 binds and inhibits, and the function of these host target genes, as elaborated hereinbelow.

Nucleotide sequences of the VGAM379 precursor RNA, herein designated VGAM PRECURSOR RNA, and of the 'diced' VGAM379 RNA, herein designated VGAM RNA, and a schematic representation of the secondary folding of VGAM379 folded precursor RNA, herein designated VGAM FOLDED PRECURSOR RNA, of VGAM379 are further described hereinbelow with reference to Table 1.

Nucleotide sequences of host target binding sites, such as BINDING SITE-I, BINDING SITE-II and BINDING SITE-III of FIG. 1, found on VGAM379 host target RNA, and schematic representation of the complementarity of each of these host target binding sites to VGAM379 RNA, herein designated VGAM RNA, are described hereinbelow with reference to Table 2.

As mentioned hereinabove with reference to FIG. 1, a function of VGAM379 gene, herein designated VGAM is inhibition of expression of VGAM379 target genes. It is appreciated that specific functions, and accordingly utilities, of VGAM379 correlate with, and may be deduced from, the identity of the target genes which VGAM379 binds and inhibits, and the function of these target genes, as elaborated hereinbelow.

Guanylate Cyclase 1, Soluble, Beta 2 (GUCY1B2, Accession NM_004129) is a VGAM379 host target gene. GUCY1B2 BINDING SITE is HOST TARGET binding site found in the 3' untranslated region of mRNA encoded by GUCY1B2, corresponding to a HOST TARGET binding site such as BINDING SITE I, BINDING SITE II or BINDING SITE III. Table 2 illustrates the complementarity of the nucleotide sequences of GUCY1B2 BINDING SITE, designated SEQ ID:10335, to the nucleotide sequence of VGAM379 RNA, herein designated VGAM RNA, also designated SEQ ID:3090.

A function of VGAM379 is therefore inhibition of Guanylate Cyclase 1, Soluble, Beta 2 (GUCY1B2, Accession NM_004129), a gene which is beta 2 subunit of soluble guanylate cyclase which converts GTP into the second messenger cGMP and plays a major role in the cardiovascular system as a receptor for nitric oxide. Accordingly, utilities of VGAM379 include diagnosis, prevention and treatment of diseases and clinical conditions associated with GUCY1B2. The function of GUCY1B2 has been established by previous studies. Nitric oxide-sensitive guanylyl cyclase (EC 4.6.1.2) is a heterodimeric enzyme consisting of an alpha and a beta subunit. The enzyme converts GTP into the second messenger cGMP and plays a major role in the cardiovascular system as a receptor for nitric oxide. Yuen et al. (1990) isolated rat cDNAs encoding a guanylyl cyclase beta-subunit that they designated GCS-beta-2. The predicted 682-amino acid rat protein shares 27% identity with rat GCS-beta-1 (GUCY1B3; 139397). Unlike other guanylyl cyclases, GCS-beta-2 contains an 86-amino acid C-terminal extension with a consensus sequence for isoprenylation/carboxymethylation. Northern blot analysis indicated that GCS-beta-2 is expressed at higher levels in rat kidney and liver, whereas GCS-beta-1 is preferentially expressed in lung and brain. By PCR with primers based on the sequence of rat GCS-beta-2, Behrends et al. (1999) isolated a partial human heart GUCY1B2 cDNA. By fluorescence in situ hybridization and by linkage, Behrends et al. (1999) mapped the GUCY1B2 gene to 13q14.3. By in situ hybridization, Malterer et al. (1999) confirmed the assignment of the GUCY1B2 gene to 13q14.2-q14.3.

Full details of the abovementioned studies are described in the following publications, the disclosure of which are hereby incorporated by reference:

Yuen, P. S. T.; Potter, L. R.; Garbers, D. L.: A new form of guanylyl cyclase is preferentially expressed in rat kidney. Biochemistry 29:10872-10878, 1990; and Behrends, S.; Kazmierczak, B.; Steenpass, A.; Knauf, B.; Bullerdiek, J.; Scholz, H.; Eiberg, H.: Assignment of GUCY1B2, the gene coding for the beta-2 subunit of human guanylyl cyclase.

Further studies establishing the function and utilities of GUCY1B2 are found in John Hopkins OMIM database record ID 603695, and in sited publications numbered 4954-4956 listed in the bibliography section hereinbelow, which are also hereby incorporated by reference. Myotubularin Related Protein 8 (MTMR8, Accession NM_015458) is another VGAM379 host target gene. MTMR8 BINDING SITE is HOST TARGET binding site found in the 3' untranslated region of mRNA encoded by MTMR8, corresponding to a HOST TARGET binding site such as BINDING SITE I, BINDING SITE II or BINDING SITE III. Table 2 illustrates the complementarity of the nucleotide sequences of MTMR8 BINDING SITE, designated SEQ ID:17744, to the nucleotide sequence of VGAM379 RNA, herein designated VGAM RNA, also designated SEQ ID:3090.

Another function of VGAM379 is therefore inhibition of Myotubularin Related Protein 8 (MTMR8, Accession NM_015458), a gene which could be a tyrosine-phosphatase. Accordingly, utilities of VGAM379 include diagnosis, prevention and treatment of diseases and clinical conditions associated with MTMR8. The function of MTMR8 has been established by previous studies. MTMR8 encodes a myotubularin-related protein that, unlike most other members of the myotubularin-related protein family, has no dual-specificity phosphatase domain.

Full details of the abovementioned studies are described in the following publications, the disclosure of which are hereby incorporated by reference:

Appel, S.; Filter, M.; Reis, A.; Hennies, H. C.; Bergheim, A.; Ogilvie, E.; Arndt, S.; Simmons, A.; Lovett, M.; Hide, W.; Ramsay, M.; Reichwald, K.; Zimmermann, W.; Rosenthal, A.: Physical and transcriptional map of the critical region for keratolytic winter erythema (KWE) on chromosome 8p22-p23 between D8S550 and D8S1759. Europ. J. Hum. Genet. 10:17-25, 2002; and Appel, S.; Reichwald, K.; Zimmermann, W.; Reis, A.; Rosenthal, A.; Hennies, H. C. : Identification and localization of a new human myotubularin-related protein gene, MTMR8, on 8p22-p23.

Further studies establishing the function and utilities of MTMR8 are found in John Hopkins OMIM database record ID 606260, and in sited publications numbered 11474-90 and 1264 listed in the bibliography section hereinbelow, which are also hereby incorporated by reference.5-methyltetrahydrofolate-homocysteine Methyltransferase (MTR, Accession NM_000254) is another VGAM379 host target gene. MTR BINDING SITE is HOST TARGET binding site found in the 3' untranslated region of mRNA encoded by MTR, corresponding to a HOST TARGET binding site such as BINDING SITE I, BINDING SITE II or BINDING SITE III. Table 2 illustrates the complementarity of the nucleotide sequences of MTR BINDING SITE, designated SEQ ID:5797, to the nucleotide sequence of VGAM379 RNA, herein designated VGAM RNA, also designated SEQ ID:3090.

Another function of VGAM379 is therefore inhibition of 5-methyltetrahydrofolate-homocysteine Methyltransferase (MTR, Accession NM_000254). Accordingly, utilities of VGAM379 include diagnosis, prevention and treatment of diseases and clinical conditions associated with MTR. RNTRE (Accession NM_014688) is another VGAM379 host target gene. RNTRE BINDING SITE is HOST TARGET binding site found in the 3' untranslated region of mRNA encoded by RNTRE, corresponding to a HOST TARGET binding site such as BINDING SITE I, BINDING SITE II or BINDING SITE III. Table 2 illustrates the complementarity of the nucleotide sequences of RNTRE BINDING SITE, designated SEQ ID:16190, to the nucleotide sequence of VGAM379 RNA, herein designated VGAM RNA, also designated SEQ ID:3090.

Another function of VGAM379 is therefore inhibition of RNTRE (Accession NM_014688), a gene which may be involved in cell proliferation. Accordingly, utilities of VGAM379 include diagnosis, prevention and treatment of diseases and clinical conditions associated with RNTRE. The function of RNTRE has been established by previous studies. Matoskova et al. (1996) demonstrated that the product of the RNTRE gene is a 97- to 100-kD protein that stably associates in vivo and in vitro with EPS8 via the SH3 domain of the latter. In vitro, RNTRE displayed remarkable preference for binding to the SH3 domain of EPS8, compared with 8 other SH3s. A C-terminal truncated mutant of RNTRE was able to confer proliferative advantage and reduced serum requirement to NIH3T3 fibroblasts, suggesting a role for RNTRE in cell proliferation. Epidermal growth factor receptor (EGFR; 131550) signaling involves small GTPases of the Rho family, and EGFR trafficking involves small GTPases of the Rab family. Lanzetti et al. (2000) reported that the EPS8 protein connects these signaling pathways. EPS8 is a substrate of EGFR that is held in a complex with SOS1 (OMIM Ref. No. 182530) by the adaptor protein E3B1 (OMIM Ref. No. 603050), thereby mediating activation of RAC (OMIM Ref. No. 602048). Through its SH3 domain, EPS8 interacts with RNTRE. Lanzetti et al. (2000) showed that RNTRE is a RAB5 (OMIM Ref. No. 179512) GTPase-activating protein (GAP) whose activity is regulated by EGFR. By entering in a complex with EPS8, RNTRE acts on RAB5 and inhibits internalization of the EGFR. Furthermore, RNTRE diverts EPS8 from its RAC-activating function, resulting in the attenuation of RAC signaling. Thus, depending on its state of association with E3B1 or RNTRE, EPS8 participates in both EGFR signaling through RAC and EGFR trafficking through RAB5. Lanzetti et al. (2000) showed that 2 arginine residues (arg106 and arg150 of RNTRE) are highly conserved in TRH domains. In addition, an aspartate residue (asp147 of RNTRE) is invariant. Mutations of any of these residues to alanine resulted in proteins that were unable to display GAP activity on RAB5.

Full details of the abovementioned studies are described in the following publications, the disclosure of which are hereby incorporated by reference:

Lanzetti, L.; Rybin, V.; Malabarba, M. G.; Christoforidis, S.; Scita, G.; Zerial, M.; Di Fiore, P. P.: The Eps8 protein coordinates EGF receptor signalling through Rac and trafficking through Rab5. Nature 408:374-377, 2000; and Matoskova, B.; Wong, W. T.; Seki, N.; Nagase, T.; Nomura, N.; Robbins, K. C.; Di Fiore, P. P.: RN-tre identifies a family of tre-related proteins displaying a novel potential protein bind.

Further studies establishing the function and utilities of RNTRE are found in John Hopkins OMIM database record ID 605405, and in sited publications numbered 375, 7417-741 and 8361 listed in the bibliography section hereinbelow, which are also hereby incorporated by reference. RP42 (Accession NM_020640) is another VGAM379 host target gene. RP42 BINDING SITE is HOST TARGET binding site found in the 3' untranslated region of mRNA encoded by RP42, corresponding to a HOST TARGET binding site such as BINDING SITE I, BINDING SITE II or BINDING SITE III. Table 2 illustrates the complementarity of the nucleotide sequences of RP42 BINDING SITE, designated SEQ ID:21804, to the nucleotide sequence of VGAM379 RNA, herein designated VGAM RNA, also designated SEQ ID:3090.

Another function of VGAM379 is therefore inhibition of RP42 (Accession NM_020640), a gene which not clear yet. Accordingly, utilities of VGAM379 include diagnosis, prevention and treatment of diseases and clinical conditions associated with RP42. The function of RP42 and its association with various diseases and clinical conditions, has been established by previous studies, as described hereinabove with reference to VGAM47. Secreted Frizzled-related Protein 1 (SFRP1, Accession NM_003012) is another VGAM379 host target gene. SFRP1 BINDING SITE is HOST TARGET binding site found in the 3' untranslated region of mRNA encoded by SFRP1, corresponding to a HOST TARGET binding site such as BINDING SITE I, BINDING SITE II or BINDING SITE III. Table 2 illustrates the complementarity of the nucleotide sequences of SFRP1 BINDING SITE, designated SEQ ID:8933, to the nucleotide sequence of VGAM379 RNA, herein designated VGAM RNA, also designated SEQ ID:3090.

Another function of VGAM379 is therefore inhibition of Secreted Frizzled-related Protein 1 (SFRP1, Accession NM_003012), a gene which is a receptor for wnt proteins that may have an anti-apoptotic function. Accordingly, utilities of VGAM379 include diagnosis, prevention and treatment of diseases and clinical conditions associated with SFRP1. The function of SFRP1 and its association with various diseases and clinical conditions, has been established by previous studies, as described hereinabove with reference to VGAM250. Splicing Factor, Arginine/serine-rich 1 (splicing factor 2, alternate splicing factor) (SFRS1, Accession NM_006924) is another VGAM379 host target gene. SFRS1 BINDING SITE is HOST TARGET binding site found in the 3' untranslated region of mRNA encoded by SFRS1, corresponding to a HOST TARGET binding site such as BINDING SITE I, BINDING SITE II or BINDING SITE III. Table 2 illustrates the complementarity of the nucleotide sequences of SFRS1 BINDING SITE, designated SEQ ID:13804, to the nucleotide sequence of VGAM379 RNA, herein designated VGAM RNA, also designated SEQ ID:3090.

Another function of VGAM379 is therefore inhibition of Splicing Factor, Arginine/serine-rich 1 (splicing factor 2, alternate splicing factor) (SFRS1, Accession NM_006924), a gene which plays an essential role in pre-mRNA splicing. Accordingly, utilities of VGAM379 include diagnosis, prevention and treatment of diseases and clinical conditions associated with SFRS1. The function of SFRS1 and its association with various diseases and clinical conditions, has been established by previous studies, as described hereinabove with reference to VGAM323. Transcription Factor AP-2 Gamma (activating enhancer binding protein 2 gamma) (TFAP2C, Accession NM_003222) is another VGAM379 host target gene. TFAP2C BINDING SITE is HOST TARGET binding site found in the 3' untranslated region of mRNA encoded by TFAP2C, corresponding to a HOST TARGET binding site such as BINDING SITE I, BINDING SITE II or BINDING SITE III. Table 2 illustrates the complementarity of the nucleotide sequences of TFAP2C BINDING SITE, designated SEQ ID:9222, to the nucleotide sequence of VGAM379 RNA, herein designated VGAM RNA, also designated SEQ ID:3090.

Another function of VGAM379 is therefore inhibition of Transcription Factor AP-2 Gamma (activating enhancer binding protein 2 gamma) (TFAP2C, Accession NM_003222), a gene which is a sequence-specific dna-binding protein that interacts with inducible viral and cellular enhancer elements to regulate transcription of selected genes. Accordingly, utilities of VGAM379 include diagnosis, prevention and treatment of diseases and clinical conditions associated with TFAP2C. The function of TFAP2C has been established by previous studies. Families of related transcription factors are often expressed in the same cell lineages but at different times or sites in the developing embryo. The AP-2 family appears to regulate the expression of genes required for development of tissues of ectodermal origin such as neural crest and skin (Williamson et al., 1996). AP-2 may also be involved in the overexpression of c-erbB-2 (OMIM Ref. No. 164870) in human breast cancer cells (Bosher et al., 1995). Williamson et al. (1996) isolated an AP-2-related cDNA. The predicted protein differs from AP-2-alpha (OMIM Ref. No. 107580) and -beta (OMIM Ref. No. 601601) in the N-terminal activation domain, but is 75 to 85% conserved within the DNA-binding and dimerization domains. All 3 gene products (AP-2-alpha, -beta, and -gamma) bind the GCCNNNGGC motif. Williamson et al. (1996) also obtained a genomic clone for AP-2-gamma (designated TFAP2C). They showed it to have a similar gene structure to TFAP2A and mapped it by fluorescence in situ hybridization to 20q13.2. A mouse genomic clone was used to map the mouse Tcfap2c locus to 2H3-4.

Full details of the abovementioned studies are described in the following publications, the disclosure of which are hereby incorporated by reference:

Bosher, J. M.; Williams, T.; Hurst, H. C.: The developmentally regulated transcription factor AP-2 is involved in c-erbB-2 overexpression in human mammary carcinoma. Proc. Nat. Acad. Sci. 92:744-747, 1995; and Williamson, J. A.; Bosher, J. M.; Skinner, A.; Sheer, D.; Williams, T.; Hurst, H. C.: Chromosomal mapping of the human and mouse homologues of two new members of the AP-2 family of tra.

Further studies establishing the function and utilities of TFAP2C are found in John Hopkins OMIM database record ID 601602, and in sited publications numbered 9340 listed in the bibliography section hereinbelow, which are also hereby incorporated by reference. FLJ20054 (Accession NM_019049) is another VGAM379 host target gene. FLJ20054 BINDING SITE is HOST TARGET binding site found in the 3' untranslated region of mRNA encoded by FLJ20054, corresponding to a HOST TARGET binding site such as BINDING SITE I, BINDING SITE II or BINDING SITE III. Table 2 illustrates the complementarity of the nucleotide sequences of FLJ20054 BINDING SITE, designated SEQ ID:21130, to the nucleotide sequence of VGAM379 RNA, herein designated VGAM RNA, also designated SEQ ID:3090.

Another function of VGAM379 is therefore inhibition of FLJ20054 (Accession NM_019049). Accordingly, utilities of VGAM379 include diagnosis, prevention and treatment of diseases and clinical conditions associated with FLJ20054. HRD1 (Accession XM_045498) is another VGAM379 host target gene. HRD1 BINDING SITE is HOST TARGET binding site found in the 3' untranslated region of mRNA encoded by HRD1, corresponding to a HOST TARGET binding site such as BINDING SITE I, BINDING SITE II or BINDING SITE III. Table 2 illustrates the complementarity of the nucleotide sequences of HRD1 BINDING SITE, designated SEQ ID:34469, to the nucleotide sequence of VGAM379 RNA, herein designated VGAM RNA, also designated SEQ ID:3090.

Another function of VGAM379 is therefore inhibition of HRD1 (Accession XM_045498). Accordingly, utilities of VGAM379 include diagnosis, prevention and treatment of diseases and clinical conditions associated with HRD1. p21 (CDKN1A)-activated Kinase 7 (PAK7, Accession XM_045653) is another VGAM379 host target gene. PAK7 BINDING SITE is HOST TARGET binding site found in the 3' untranslated region of mRNA encoded by PAK7, corresponding to a HOST TARGET binding site such as BINDING SITE I, BINDING SITE II or BINDING SITE III. Table 2 illustrates the complementarity of the nucleotide sequences of PAK7 BINDING SITE, designated SEQ ID:34510, to the nucleotide sequence of VGAM379 RNA, herein designated VGAM RNA, also designated SEQ ID:3090.

Another function of VGAM379 is therefore inhibition of p21(CDKN1A)-activated Kinase 7 (PAK7, Accession XM_045653). Accordingly, utilities of VGAM379 include diagnosis, prevention and treatment of diseases and clinical conditions associated with PAK7. R3H Domain (binds single-stranded nucleic acids) Containing (R3HDM, Accession NM_015361) is another VGAM379 host target gene. R3HDM BINDING SITE is HOST TARGET binding site found in the 3' untranslated region of mRNA encoded by R3HDM, corresponding to a HOST TARGET binding site such as BINDING SITE I, BINDING SITE II or BINDING SITE III. Table 2 illustrates the complementarity of the nucleotide sequences of R3HDM BINDING SITE, designated SEQ ID:17659, to the nucleotide sequence of VGAM379 RNA, herein designated VGAM RNA, also designated SEQ ID:3090.

Another function of VGAM379 is therefore inhibition of R3H Domain (binds single-stranded nucleic acids) Containing (R3HDM, Accession NM_015361). Accordingly, utilities of VGAM379 include diagnosis, prevention and treatment of diseases and clinical conditions associated with R3HDM. LOC146229 (Accession XM_085387) is another VGAM379 host target gene. LOC146229 BINDING SITE is HOST TARGET binding site found in the 3' untranslated region of mRNA encoded by LOC146229, corresponding to a HOST TARGET binding site such as BINDING SITE I, BINDING SITE II or BINDING SITE III. Table 2 illustrates the complementarity of the nucleotide sequences of LOC146229 BINDING SITE, designated SEQ ID:38114, to the nucleotide sequence of VGAM379 RNA, herein designated VGAM RNA, also designated SEQ ID:3090.

Another function of VGAM379 is therefore inhibition of LOC146229 (Accession XM_085387). Accordingly, utilities of VGAM379 include diagnosis, prevention and treatment of diseases and clinical conditions associated with LOC146229. FIG. 1 further provides a conceptual description of a novel bioinformatically detected viral gene of the present invention, referred to here as Viral Genomic Address Messenger 380 (VGAM380) viral gene, which modulates expression of respective host target genes thereof, the function and utility of which host target genes is known in the art.

VGAM380 is a novel bioinformatically detected regulatory, non protein coding, viral micro RNA (miRNA) gene. The method by which VGAM380 was detected is described hereinabove with reference to FIGS. 1-8.

VGAM380 gene, herein designated VGAM GENE, is a viral gene contained in the genome of Feline Immunodeficiency Virus. VGAM380 host target gene, herein designated VGAM HOST TARGET GENE, is a human gene contained in the human genome.

VGAM380 gene encodes a VGAM380 precursor RNA, herein designated VGAM PRECURSOR RNA. Similar to other miRNA genes, and unlike most ordinary genes, VGAM380 precursor RNA does not encode a protein. A nucleotide sequence identical or highly similar to the nucleotide sequence of VGAM380 precursor RNA is designated SEQ ID:366, and is provided hereinbelow with reference to the sequence listing part. Nucleotide sequence SEQ ID:366 is located at position 8388 relative to the genome of Feline Immunodeficiency Virus.

VGAM380 precursor RNA folds onto itself, forming VGAM380 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM380 folded precursor RNA into VGAM380 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM380 RNA is designated SEQ ID:3091, and is provided hereinbelow with reference to the sequence listing part.

VGAM380 host target gene, herein designated VGAM HOST TARGET GENE, encodes a corresponding messenger RNA, VGAM380 host target RNA, herein designated VGAM HOST TARGET RNA. VGAM380 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM380 RNA, herein designated VGAM RNA, binds complementarily to one or more host target binding sites located in untranslated regions of VGAM380 host target RNA, herein designated VGAM HOST TARGET RNA. This complementary binding is due to the fact that the nucleotide sequence of VGAM380 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM380 RNA, herein designated VGAM RNA, may have a different number of host target binding sites in untranslated regions of a VGAM380 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM380 RNA, herein designated VGAM RNA, to host target binding sites on VGAM380 host target RNA, herein designated VGAM HOST TARGET RNA, such as BINDING SITE I, BINDING SITE II and BINDING SITE III, inhibits translation of VGAM380 host target RNA into VGAM380 host target protein, herein designated VGAM HOST TARGET PROTEIN. VGAM host target protein is therefore outlined by a broken line.

It is appreciated that VGAM380 host target gene, herein designated VGAM HOST TARGET GENE, in fact represents a plurality of VGAM380 host target genes. The mRNA of each one of this plurality of VGAM380 host target genes comprises one or more host target binding sites, each having a nucleotide sequence which is at least partly complementary to VGAM380 RNA, herein designated VGAM RNA, and which when bound by VGAM380 RNA causes inhibition of translation of respective one or more VGAM380 host target proteins.

It is further appreciated by one skilled in the art that the mode of translational inhibition illustrated by FIG. 1 with specific reference to translational inhibition exerted by VGAM380 gene, herein designated VGAM GENE, on one or more VGAM380 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM380 is inhibition of expression of host target genes, as part of a novel viral mechanism of attacking a host. Accordingly, utilities of VGAM380 include diagnosis, prevention and treatment of viral infection by Feline Immunodeficiency Virus. Specific functions, and accordingly utilities, of VGAM380 correlate with, and may be deduced from, the identity of the host target genes which VGAM380 binds and inhibits, and the function of these host target genes, as elaborated hereinbelow.

Nucleotide sequences of the VGAM380 precursor RNA, herein designated VGAM PRECURSOR RNA, and of the 'diced' VGAM380 RNA, herein designated VGAM RNA, and a schematic representation of the secondary folding of VGAM380 folded precursor RNA, herein designated VGAM FOLDED PRECURSOR RNA, of VGAM380 are further described hereinbelow with reference to Table 1.

Nucleotide sequences of host target binding sites, such as BINDING SITE-I, BINDING SITE-II and BINDING SITE-III of FIG. 1, found on VGAM380 host target RNA, and schematic representation of the complementarity of each of these host target binding sites to VGAM380 RNA, herein designated VGAM RNA, are described hereinbelow with reference to Table 2.

As mentioned hereinabove with reference to FIG. 1, a function of VGAM380 gene, herein designated VGAM is inhibition of expression of VGAM380 target genes. It is appreciated that specific functions, and accordingly utilities, of VGAM380 correlate with, and may be deduced from, the identity of the target genes which VGAM380 binds and inhibits, and the function of these target genes, as elaborated hereinbelow.

Clathrin, Heavy Polypeptide (Hc) (CLTC, Accession NM_004859) is a VGAM380 host target gene. CLTC BINDING SITE is HOST TARGET binding site found in the 3' untranslated region of mRNA encoded by CLTC, corresponding to a HOST TARGET binding site such as BINDING SITE I, BINDING SITE II or BINDING SITE III. Table 2 illustrates the complementarity of the nucleotide sequences of CLTC BINDING SITE, designated SEQ ID:11268, to the nucleotide sequence of VGAM380 RNA, herein designated VGAM RNA, also designated SEQ ID:3091.

A function of VGAM380 is therefore inhibition of Clathrin, Heavy Polypeptide (Hc) (CLTC, Accession NM_004859). Accordingly, utilities of VGAM380 include diagnosis, prevention and treatment of diseases and clinical conditions associated with CLTC. Sperm Associated Antigen 6 (SPAG6, Accession NM_012443) is another VGAM380 host target gene. SPAG6 BINDING SITE is HOST TARGET binding site found in the 3' untranslated region of mRNA encoded by SPAG6, corresponding to a HOST TARGET binding site such as BINDING SITE I, BINDING SITE II or BINDING SITE III. Table 2 illustrates the complementarity of the nucleotide sequences of SPAG6 BINDING SITE, designated SEQ ID:14818, to the nucleotide sequence of VGAM380 RNA, herein designated VGAM RNA, also designated SEQ ID:3091.

Another function of VGAM380 is therefore inhibition of Sperm Associated Antigen 6 (SPAG6, Accession NM_012443). Accordingly, utilities of VGAM380 include diagnosis, prevention and treatment of diseases and clinical conditions associated with SPAG6. Zinc Finger Protein 144 (Mel-18) (ZNF144, Accession NM_007144) is another VGAM380 host target gene. ZNF144 BINDING SITE is HOST TARGET binding site found in the 3' untranslated region of mRNA encoded by ZNF144, corresponding to a HOST TARGET binding site such as BINDING SITE I, BINDING SITE II or BINDING SITE III. Table 2 illustrates the complementarity of the nucleotide sequences of ZNF144 BINDING SITE, designated SEQ ID:13990, to the nucleotide sequence of VGAM380 RNA, herein designated VGAM RNA, also designated SEQ ID:3091.

Another function of VGAM380 is therefore inhibition of Zinc Finger Protein 144 (Mel-18) (ZNF144, Accession NM_007144), a gene which is a transcriptional repressor and may play a role in the control of cell proliferation. Accordingly, utilities of VGAM380 include diagnosis, prevention and treatment of diseases and clinical conditions associated with ZNF144. The function of ZNF144 has been established by previous studies. Ishida et al. (1993) isolated the human homolog of Mel18. The deduced human protein contains 344 amino acids with a RING-finger motif, a helix-loop-helix (HLH)-like structure, and a pro/ser-rich region. The MEL18 gene is conserved among vertebrates. Its mRNA is expressed at high levels in placenta, lung, and kidney, and at lower levels in liver, pancreas, and skeletal muscle Full details of the abovementioned studies are described in the following publications, the disclosure of which are hereby incorporated by reference:

Tagawa, M.; Sakamoto, T.; Shigemoto, K.; Matsubara, H.; Tamura, Y.; Ito, T.; Nakamura, I.; Okitsu, A.; Imai, K.; Taniguchi, M.: Expression of novel DNA-binding protein with zinc finger structure in various tumor cells. J. Biol. Chem. 265: 20021-20026, 1990; and Ishida, A.; Asano, H.; Hasegawa, M.; Koseki, H.; Ono, T.; Yoshida, M. C.; Taniguchi, M.; Kanno, M.: Cloning and chromosome mapping of the human Mel-18 gene which encodes a DNA-binding pr.

Further studies establishing the function and utilities of ZNF144 are found in John Hopkins OMIM database record ID 600346, and in sited publications numbered 8284-828 and 8292 listed in the bibliography section hereinbelow, which are also hereby incorporated by reference. LOC114971 (Accession XM_054936) is another VGAM380 host target gene. LOC114971 BINDING SITE is HOST TARGET binding site found in the 3' untranslated region of mRNA encoded by LOC114971, corresponding to a HOST TARGET binding site such as BINDING SITE I, BINDING SITE II or BINDING SITE III. Table 2 illustrates the complementarity of the nucleotide sequences of LOC114971 BINDING SITE, designated SEQ ID:36204, to the nucleotide sequence of VGAM380 RNA, herein designated VGAM RNA, also designated SEQ ID:3091.

Another function of VGAM380 is therefore inhibition of LOC114971 (Accession XM_054936). Accordingly, utilities of VGAM380 include diagnosis, prevention and treatment of diseases and clinical conditions associated with LOC114971. FIG. 1 further provides a conceptual description of a novel bioinformatically detected viral gene of the present invention, referred to here as Viral Genomic Address Messenger 381 (VGAM381) viral gene, which modulates expression of respective host target genes thereof, the function and utility of which host target genes is known in the art.

VGAM381 is a novel bioinformatically detected regulatory, non protein coding, viral micro RNA (miRNA) gene. The method by which VGAM381 was detected is described hereinabove with reference to FIGS. 1-8.

VGAM381 gene, herein designated VGAM GENE, is a viral gene contained in the genome of Feline Immunodeficiency Virus. VGAM381 host target gene, herein designated VGAM HOST TARGET GENE, is a human gene contained in the human genome.

VGAM381 gene encodes a VGAM381 precursor RNA, herein designated VGAM PRECURSOR RNA. Similar to other miRNA genes, and unlike most ordinary genes, VGAM381 precursor RNA does not encode a protein. A nucleotide sequence identical or highly similar to the nucleotide sequence of VGAM381 precursor RNA is designated SEQ ID:367, and is provided hereinbelow with reference to the sequence listing part. Nucleotide sequence SEQ ID:367 is located at position 8564 relative to the genome of Feline Immunodeficiency Virus.

VGAM381 precursor RNA folds onto itself, forming VGAM381 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM381 folded precursor RNA into VGAM381 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM381 RNA is designated SEQ ID:3092, and is provided hereinbelow with reference to the sequence listing part.

VGAM381 host target gene, herein designated VGAM HOST TARGET GENE, encodes a corresponding messenger RNA, VGAM381 host target RNA, herein designated VGAM HOST TARGET RNA. VGAM381 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM381 RNA, herein designated VGAM RNA, binds complementarily to one or more host target binding sites located in untranslated regions of VGAM381 host target RNA, herein designated VGAM HOST TARGET RNA. This complementary binding is due to the fact that the nucleotide sequence of VGAM381 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM381 RNA, herein designated VGAM RNA, may have a different number of host target binding sites in untranslated regions of a VGAM381 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM381 RNA, herein designated VGAM RNA, to host target binding sites on VGAM381 host target RNA, herein designated VGAM HOST TARGET RNA, such as BINDING SITE I, BINDING SITE II and BINDING SITE III, inhibits translation of VGAM381 host target RNA into VGAM381 host target protein, herein designated VGAM HOST TARGET PROTEIN. VGAM host target protein is therefore outlined by a broken line.

It is appreciated that VGAM381 host target gene, herein designated VGAM HOST TARGET GENE, in fact represents a plurality of VGAM381 host target genes. The mRNA of each one of this plurality of VGAM381 host target genes comprises one or more host target binding sites, each having a nucleotide sequence which is at least partly complementary to VGAM381 RNA, herein designated VGAM RNA, and which when bound by VGAM381 RNA causes inhibition of translation of respective one or more VGAM381 host target proteins.

It is further appreciated by one skilled in the art that the mode of translational inhibition illustrated by FIG. 1 with specific reference to translational inhibition exerted by VGAM381 gene, herein designated VGAM GENE, on one or more VGAM381 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM381 is inhibition of expression of host target genes, as part of a novel viral mechanism of attacking a host. Accordingly, utilities of VGAM381 include diagnosis, prevention and treatment of viral infection by Feline Immunodeficiency Virus. Specific functions, and accordingly utilities, of VGAM381 correlate with, and may be deduced from, the identity of the host target genes which VGAM381 binds and inhibits, and the function of these target genes, as elaborated hereinbelow.

Nucleotide sequences of the VGAM381 precursor RNA, herein designated VGAM PRECURSOR RNA, and of the 'diced' VGAM381 RNA, herein designated VGAM RNA, and a schematic representation of the secondary folding of VGAM381 folded precursor RNA, herein designated VGAM FOLDED PRECURSOR RNA, of VGAM381 are further described hereinbelow with reference to Table 1.

Nucleotide sequences of host target binding sites, such as BINDING SITE-I, BINDING SITE-II and BINDING SITE-III of FIG. 1, found on VGAM381 host target RNA, and schematic representation of the complementarity of each of these host target binding sites to VGAM381 RNA, herein designated VGAM RNA, are described hereinbelow with reference to Table 2.

As mentioned hereinabove with reference to FIG. 1, a function of VGAM381 gene, herein designated VGAM is inhibition of expression of VGAM381 target genes. It is appreciated that specific functions, and accordingly utilities, of VGAM381 correlate with, and may be deduced from, the identity of the target genes which VGAM381 binds and inhibits, and the function of these target genes, as elaborated hereinbelow.

Angiotensinogen (serine (or cysteine) Proteinase Inhibitor, Clade A (alpha-1 antiproteinase, antitrypsin), Member 8) (AGT, Accession NM_000029) is a VGAM381 host target gene. AGT BINDING SITE is HOST TARGET binding site found in the 3' untranslated region of mRNA encoded by AGT, corresponding to a HOST TARGET binding site such as BINDING SITE I, BINDING SITE II or BINDING SITE III. Table 2 illustrates the complementarity of the nucleotide sequences of AGT BINDING SITE, designated SEQ ID:5469, to the nucleotide sequence of VGAM381 RNA, herein designated VGAM RNA, also designated SEQ ID:3092.

A function of VGAM381 is therefore inhibition of Angiotensinogen (serine (or cysteine) Proteinase Inhibitor, Clade A (alpha-1 antiproteinase, antitrypsin), Member 8) (AGT, Accession NM_000029). Accordingly, utilities of VGAM381 include diagnosis, prevention and treatment of diseases and clinical conditions associated with AGT. Asialoglycoprotein Receptor 2 (ASGR2, Accession NM_080912) is another VGAM381 host target gene. ASGR2 BINDING SITE is HOST TARGET binding site found in the 5' untranslated region of mRNA encoded by ASGR2, corresponding to a HOST TARGET binding site such as BINDING SITE I, BINDING SITE II or BINDING SITE III. Table 2 illustrates the complementarity of the nucleotide sequences of ASGR2 BINDING SITE, designated SEQ ID:28129, to the nucleotide sequence of VGAM381 RNA, herein designated VGAM RNA, also designated SEQ ID:3092.

Another function of VGAM381 is therefore inhibition of Asialoglycoprotein Receptor 2 (ASGR2, Accession NM_080912). Accordingly, utilities of VGAM381 include diagnosis, prevention and treatment of diseases and clinical conditions associated with ASGR2. AXIN1 Up-regulated 1 (AXUD1, Accession NM_033027) is another VGAM381 host target gene. AXUD1 BINDING SITE is HOST TARGET binding site found in the 3' untranslated region of mRNA encoded by AXUD1, corresponding to a HOST TARGET binding site such as BINDING SITE I, BINDING SITE II or BINDING SITE III. Table 2 illustrates the complementarity of the nucleotide sequences of AXUD1 BINDING SITE, designated SEQ ID:26919, to the nucleotide sequence of VGAM381 RNA, herein designated VGAM RNA, also designated SEQ ID:3092.

Another function of VGAM381 is therefore inhibition of AXIN1 Up-regulated 1 (AXUD1, Accession NM_033027). Accordingly, utilities of VGAM381 include diagnosis, prevention and treatment of diseases and clinical conditions associated with AXUD1. Chromosome 20 Open Reading Frame 1 (C20orf1, Accession NM_012112) is another VGAM381 host target gene. C20orf1 BINDING SITE is HOST TARGET binding site found in the 3' untranslated region of mRNA encoded by C20orf1, corresponding to a HOST TARGET binding site such as BINDING SITE I, BINDING SITE II or BINDING SITE III. Table 2 illustrates the complementarity of the nucleotide sequences of C20orf1 BINDING SITE, designated SEQ ID:14427, to the nucleotide sequence of VGAM381 RNA, herein designated VGAM RNA, also designated SEQ ID:3092.

Another function of VGAM381 is therefore inhibition of Chromosome 20 Open Reading Frame 1 (C20orf1, Accession NM_012112), a gene which is a nuclear proliferation-associated protein. Accordingly, utilities of VGAM381 include diagnosis, prevention and treatment of diseases and clinical conditions associated with C20orf1. The function of C20orf1 has been established by previous studies. Heidebrecht et al. (1997) determined that p100 is a nuclear proliferation-associated protein whose expression is restricted to cell cycle phases S, G2, and M. Using an mRNA differential display technique, Manda et al. (1999) isolated 2 novel cDNAs, SPON2 (OMIM Ref. No. 605918) and C20ORF1, which they designated differentially expressed in cancerous and noncancerous lung cells-1 (DIL1) and -2 (DIL2), respectively. The full-length C20ORF1 cDNA encodes a 747-amino acid protein with a putative ATP/GTP-binding site motif. RT-PCR analysis demonstrated strong expression of C20ORF1 in lung carcinoma cell lines. Northern blot analysis detected expression in fetal lung but not in adult lung. C20ORF1 expression was also found in adult placenta, skeletal muscle, thymus, testis, and small intestine and in fetal brain, liver, and kidney, By fluorescence in situ hybridization, Zhang et al. (1999) mapped the C20ORF1 gene to chromosome 20q11.2.

Full details of the abovementioned studies are described in the following publications, the disclosure of which are hereby incorporated by reference:

Manda, R.; Kohno, T.; Matsuno, Y.; Takenoshita, S.; Kuwano, H.; Yokota, J.: Identification of genes (SPON2 and C20orf2) differentially expressed between cancerous and noncancerous lung cells by mRNA differential display. Genomics 61:5-14, 1999; and Heidebrecht, H. J.; Buck, F.; Steinmann, J.; Sprenger, R.; Wacker, H. H.; Parwaresch, R.: p100: a novel proliferation-associated nuclear protein specifically restricted to cell cycle p.

Further studies establishing the function and utilities of C20orf1 are found in John Hopkins OMIM database record ID 605917, and in sited publications numbered 97 and 6436-6437 listed in the bibliography section hereinbelow, which are also hereby incorporated by reference. CD4 Antigen (p55) (CD4, Accession NM_000616) is another VGAM381 host target gene. CD4 BINDING SITE is HOST TARGET binding site found in the 3' untranslated region of mRNA encoded by CD4, corresponding to a HOST TARGET binding site such as BINDING SITE I, BINDING SITE II or BINDING SITE III. Table 2 illustrates the complementarity of the nucleotide sequences of CD4 BINDING SITE, designated SEQ ID:6217, to the nucleotide sequence of VGAM381 RNA, herein designated VGAM RNA, also designated SEQ ID:3092.

Another function of VGAM381 is therefore inhibition of CD4 Antigen (p55) (CD4, Accession NM_000616), a gene which is T-cell surface glycoprotein and has role in cell-cell interactions and may act in signal transduction. Accordingly, utilities of VGAM381 include diagnosis, prevention and treatment of diseases and clinical conditions associated with CD4. The function of CD4 has been established by previous studies. In transgenic mice carrying the human CD4 gene, Buttini et al. (1998) found that human CD4 is expressed on microglia, the resident mononuclear phagocytes of brain. Normally there is no neuronal damage. Activation of brain microglia by peripheral immune challenges elicited neurodegeneration in human CD4 mice but not in nontransgenic controls. In postmortem brain tissues from AIDS patients with opportunistic infections, but without typical HIV encephalitis, human CD4 expression correlated with neurodegeneration. Buttini et al. (1998) concluded that human CD4 may function as an important mediator of indirect neuronal damage in infectious and immune-mediated diseases of the central nervous system (CNS). The important role of human CD4 expression on microglia/macrophages creates a pathogenetic link between the immune system and the CNS. Animal model experiments lend further support to the function of CD4. In transgenic mice carrying the human CD4 gene, Buttini et al. (1998) found that human CD4 is expressed on microglia, the resident mononuclear phagocytes of brain. Normally there is no neuronal damage. Activation of brain microglia by peripheral immune challenges elicited neurodegeneration in human CD4 mice but not in nontransgenic controls. In postmortem brain tissues from AIDS patients with opportunistic infections, but without typical HIV encephalitis, human CD4 expression correlated with neurodegeneration. Buttini et al. (1998) concluded that human CD4 may function as an important mediator of indirect neuronal damage in infectious and immune-mediated diseases of the central nervous system (CNS). The important role of human CD4 expression on microglia/macrophages creates a pathogenetic link between the immune system and the CNS.

It is appreciated that the abovementioned animal model for CD4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Buttini, M.; Westland, C. E.; Masliah, E.; Yafeh, A. M.; Wyss-Coray, T.; Mucke, L. : Novel role of human CD4 molecule identified in neurodegeneration. Nature Med. 4:441-446, 1998; and Krummel, M. F.; Sjaastad, M. D.; Wulfing, C.; Davis, M. M.: Differential clustering of CD4 and CD3-zeta during T cell recognition. Science 289: 1349-1352, 2000.

Further studies establishing the function and utilities of CD4 are found in John Hopkins OMIM database record ID 186940, and in sited publications numbered 10551-10558, 5690, 10559-10562, 5691, 6036, 10563-10566, 983 and 10960-10031 listed in the bibliography section hereinbelow, which are also hereby incorporated by reference. Early Growth Response 1 (EGR1, Accession NM_001964) is another VGAM381 host target gene. EGR1 BINDING SITE is HOST TARGET binding site found in the 3' untranslated region of mRNA encoded by EGR1, corresponding to a HOST TARGET binding site such as BINDING SITE I, BINDING SITE II or BINDING SITE III. Table 2 illustrates the complementarity of the nucleotide sequences of EGR1 BINDING SITE, designated SEQ ID:7691, to the nucleotide sequence of VGAM381 RNA, herein designated VGAM RNA, also designated SEQ ID:3092.

Another function of VGAM381 is therefore inhibition of Early Growth Response 1 (EGR1, Accession NM_001964). Accordingly, utilities of VGAM381 include diagnosis, prevention and treatment of diseases and clinical conditions associated with EGR1. ELK1, Member of ETS Oncogene Family (ELK1, Accession NM_005229) is another VGAM381 host target gene. ELK1 BINDING SITE is HOST TARGET binding site found in the 3' untranslated region of mRNA encoded by ELK1, corresponding to a HOST TARGET binding site such as BINDING SITE I, BINDING SITE II or BINDING SITE III. Table 2 illustrates the complementarity of the nucleotide sequences of ELK1 BINDING SITE, designated SEQ ID:11728, to the nucleotide sequence of VGAM381 RNA, herein designated VGAM RNA, also designated SEQ ID:3092.

Another function of VGAM381 is therefore inhibition of ELK1, Member of ETS Oncogene Family (ELK1, Accession NM_005229), a gene which stimulates transcription. can form a ternary complex with the serum response factor and the ets and srf motifs of the fos serum response element. Accordingly, utilities of VGAM381 include diagnosis, prevention and treatment of diseases and clinical conditions associated with ELK1. The function of ELK1 and its association with various diseases and clinical conditions, has been established by previous studies, as described hereinabove with reference to VGAM178. V-erb-a Erythroblastic Leukemia Viral Oncogene Homolog 4 (avian) (ERBB4, Accession NM_005235) is another VGAM381 host target gene. ERBB4 BINDING SITE is HOST TARGET binding site found in the 3' untranslated region of mRNA encoded by ERBB4, corresponding to a HOST TARGET binding site such as BINDING SITE I, BINDING SITE II or BINDING SITE III. Table 2 illustrates the complementarity of the nucleotide sequences of ERBB4 BINDING SITE, designated SEQ ID:11744, to the nucleotide sequence of VGAM381 RNA, herein designated VGAM RNA, also designated SEQ ID:3092.

Another function of VGAM381 is therefore inhibition of V-erb-a Erythroblastic Leukemia Viral Oncogene Homolog 4 (avian) (ERBB4, Accession NM_005235), a gene which may function in growth/differentiation of normal and transformed cells. Accordingly, utilities of VGAM381 include diagnosis, prevention and treatment of diseases and clinical conditions associated with ERBB4. The function of ERBB4 has been established by previous studies. The HER4/ERBB4 gene is a member of the type I receptor tyrosine kinase subfamily that includes EGFR (OMIM Ref. No. 131550), ERBB2 (OMIM Ref. No. 164870), and ERBB3 (OMIM Ref. No. 190151). It encodes a receptor for NDF/heregulin (OMIM Ref. No. 142445). Neuregulins and their receptors, the ERBB protein tyrosine kinases, are essential for neuronal development. Huang et al. (2000) reported that ERBB4 is enriched in the postsynaptic density and associates with PSD95 (OMIM Ref. No. 602887). Heterologous expression of PSD95 enhanced NRG (OMIM Ref. No. 142445) activation of ERBB4 and MAP kinase (see OMIM Ref. No. 176948). Conversely, inhibiting expression of PSD95 in neurons attenuated NRG-mediated activation of MAP kinase. PSD95 formed a ternary complex with 2 molecules of ERBB4, suggesting that PSD95 facilitates ERBB4 dimerization. Finally, NRG suppressed induction of long-term potentiation in the hippocampal CA1 region without affecting basal synaptic transmission. Thus, NRG signaling may be synaptic and regulated by PSD95. Huang et al. (2000) concluded that a role of NRG signaling in the adult central nervous system may be modulation of synaptic plasticity. ERBB4 is a transmembrane receptor tyrosine kinase that regulates cell proliferation and differentiation. After binding its ligand heregulin or activation of protein kinase C (see OMIM Ref. No. 176960) by TPA, the ERBB4 ectodomain is cleaved by a metalloprotease. Ni et al. (2001) reported a subsequent cleavage by gamma-secretase that releases the ERBB4 intracellular domain from the membrane and facilitates its translocation to the nucleus. Gamma-secretase cleavage was prevented by chemical inhibitors or a dominant-negative presenilin (OMIM Ref. No. 104311). Inhibition of gamma-secretase also prevented growth inhibition by heregulin. Ni et al. (2001) concluded that gamma-secretase cleavage of ERBB4 may represent another mechanism for receptor tyrosine kinase-mediated signaling. Using human cDNA probes in fluorescence in situ hybridization, Zimonjic et al. (1995) mapped the ERBB4 gene to 2q33.3-q34. The finding established that the ERBB4 gene, like the related EGFR, ERBB2, and ERBB3 genes, is located in close proximity to homeobox and collagen gene loci. Animal model experiments lend further support to the function of ERBB4. ErbB4 -/- mouse embryos develop trigeminal ganglion and geniculate/cochleovestibular ganglia that are displaced toward each other and show axonal misprojections (Gassmann et al., 1995). Golding et al. (2000) found that these morphologic changes correlate with aberrant migration of a subpopulation of hindbrain-derived cranial neural crest cells. The aberrant migration is also accompanied by an apparent down regulation of HoxB2 (OMIM Ref. No. 142967) gene expression.

It is appreciated that the abovementioned animal model for ERBB4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Huang, Y. Z.; Won, S.; Ali, D. W.; Wang, Q.; Tanowitz, M.; Du, Q. S.; Pelkey, K. A.; Yang, D. J.; Xiong, W. C.; Salter, M. W.; Mei, L.: Regulation of neuregulin signaling by PSD-95 interacting with ErbB4 at CNS synapses. Neuron 26:443-455, 2000; and Golding, J. P.; Trainor, P.; Krumlauf, R.; Gassmann, M.: Defects in pathfinding by cranial neural crest cells in mice lacking the neuregulin receptor ErbB4. Nature Cell Biol. 2:103-10.

Further studies establishing the function and utilities of ERBB4 are found in John Hopkins OMIM database record ID 600543, and in sited publications numbered 7868-7869, 1157 and 11576 listed in the bibliography section hereinbelow, which are also hereby incorporated by reference. Growth Factor Independent 1 (GFI1, Accession NM_005263) is another VGAM381 host target gene. GFI1 BINDING SITE is HOST TARGET binding site found in the 3' untranslated region of mRNA encoded by GFI1, corresponding to a HOST TARGET binding site such as BINDING SITE I, BINDING SITE II or BINDING SITE III. Table 2 illustrates the complementarity of the nucleotide sequences of GFI1 BINDING SITE, designated SEQ ID:11769, to the nucleotide sequence of VGAM381 RNA, herein designated VGAM RNA, also designated SEQ ID:3092.

Another function of VGAM381 is therefore inhibition of Growth Factor Independent 1 (GFI1, Accession NM_005263). Accordingly, utilities of VGAM381 include diagnosis, prevention and treatment of diseases and clinical conditions associated with GFI1. Guanine Nucleotide Binding Protein (G protein), Beta Polypeptide 1 (GNB1, Accession NM_002074) is another VGAM381 host target gene. GNB1 BINDING SITE is HOST TARGET binding site found in the 3' untranslated region of mRNA encoded by GNB1, corresponding to a HOST TARGET binding site such as BINDING SITE I, BINDING SITE II or BINDING SITE III. Table 2 illustrates the complementarity of the nucleotide sequences of GNB1 BINDING SITE, designated SEQ ID:7850, to the nucleotide sequence of VGAM381 RNA, herein designated VGAM RNA, also designated SEQ ID:3092.

Another function of VGAM381 is therefore inhibition of Guanine Nucleotide Binding Protein (G protein), Beta Polypeptide 1 (GNB1, Accession NM_002074). Accordingly, utilities of VGAM381 include diagnosis, prevention and treatment of diseases and clinical conditions associated with GNB1. Hepatic Leukemia Factor (HLF, Accession NM_002126) is another VGAM381 host target gene. HLF BINDING SITE is HOST TARGET binding site found in the 3' untranslated region of mRNA encoded by HLF, corresponding to a HOST TARGET binding site such as BINDING SITE I, BINDING SITE II or BINDING SITE III. Table 2 illustrates the complementarity of the nucleotide sequences of HLF BINDING SITE, designated SEQ ID:7903, to the nucleotide sequence of VGAM381 RNA, herein designated VGAM RNA, also designated SEQ ID:3092.

Another function of VGAM381 is therefore inhibition of Hepatic Leukemia Factor (HLF, Accession NM_002126). Accordingly, utilities of VGAM381 include diagnosis, prevention and treatment of diseases and clinical conditions associated with HLF. High-mobility Group Nucleosome Binding Domain 1 (HMGN1, Accession NM_004965) is another VGAM381 host target gene. HMGN1 BINDING SITE is HOST TARGET binding site found in the 3' untranslated region of mRNA encoded by HMGN1, corresponding to a HOST TARGET binding site such as BINDING SITE I, BINDING SITE II or BINDING SITE III. Table 2 illustrates the complementarity of the nucleotide sequences of HMGN1 BINDING SITE, designated SEQ ID:11412, to the nucleotide sequence of VGAM381 RNA, herein designated VGAM RNA, also designated SEQ ID:3092.

Another function of VGAM381 is therefore inhibition of High-mobility Group Nucleosome Binding Domain 1 (HMGN1, Accession NM_004965), a gene which binds to the inner side of the nucleosomal DNA and involves in transcriptional regulation. Accordingly, utilities of VGAM381 include diagnosis, prevention and treatment of diseases and clinical conditions associated with HMGN1. The function of HMGN1 has been established by previous studies. See 163910. Chromosomal protein HMG14 and its close analog HMG17 (OMIM Ref. No. 163910) bind to the inner side of the nucleosomal DNA, potentially altering the interaction between the DNA and the histone octamer. The 2 proteins may be involved in the process that maintains transcribable genes in a unique chromatin conformation. Their ubiquitous distribution, relative abundance, and high evolutionary conservation of the DNA-binding domain of the HMG-14 family of proteins, suggest that they may be involved in an important cellular function. The human HMG14 multigene family is 1 of the largest retropseudogene families known. However, Landsman et al. (1989) found only a single genomic clone selected with a cDNA, thus suggesting that the human genome contains few and perhaps only 1 functional gene. The gene was found to comprise 6 exons ranging in size from 30 to 839 bp, 2 of which code for the entire DNA binding site of the protein and have several features typical of 'housekeeping' genes. Using human-rodent somatic cell hybrids, Landsman et al. (1989) localized the HMG14 gene to human chromosome 21. They detected a RFLP useful for further analysis and mapping. Comparison with the human and chicken HMG17 genes showed that all contain 6 exons; all have exons of similar size; all have 5-prime regions highly enriched in GC residues; and all have features typical of housekeeping genes. Petersen et al. (1990) used a GT dinucleotide repeat as a polymorphic marker in linkage analysis to demonstrate that the HMG14 locus is close to the ETS2 gene in band 21q22.3. By in situ hybridization, Pash et al. (1990) confirmed the assignment to 21q22.3. Furthermore, they analyzed the expression of the HMG14 gene in mouse embryos trisomic for chromosome 16 and found that trisomy 16 embryos had approximately 1.5 times more HMG14 mRNA and protein than their normal littermates. Pash et al. (1990) suggested that this nucleosomal binding protein may confer distinct properties to the chromatin structure of transcriptionally active genes and therefore may be a contributing factor in the development of Down syndrome. Since HMG14 is preferentially associated with transcriptionally active chromatin, Ding et al. (1994) assessed its effect on transcription by RNA polymerase II. They found that HMG14 enhanced transcription on chromatin templates but not on DNA templates. These findings suggested that the association of HMG14 with nucleosomes is part of the cellular process involved in the generation of transcriptionally active chromatin.

Full details of the abovementioned studies are described in the following publications, the disclosure of which are hereby incorporated by reference:

Ding, H.-F.; Rimsky, S.; Batson, S. C.; Bustin, M.; Hansen, U.: Stimulation of RNA polymerase II elongation by chromosomal protein HMG-14. Science 265:796-799, 1994; and Landsman, D.; McBride, O. W.; Soares, N.; Crippa, M. P.; Srikantha, T.; Bustin, M.: Chromosomal protein HMG-14: identification, characterization, and chromosome localization of a functi.

Further studies establishing the function and utilities of HMGN1 are found in John Hopkins OMIM database record ID 163920, and in sited publications numbered 3019-3022 listed in the bibliography section hereinbelow, which are also hereby incorporated by reference. Hormonally Upregulated Neu-associated Kinase (HUNK, Accession NM_014586) is another VGAM381 host target gene. HUNK BINDING SITE is HOST TARGET binding site found in the 3' untranslated region of mRNA encoded by HUNK, corresponding to a HOST TARGET binding site such as BINDING SITE I, BINDING SITE II or BINDING SITE III. Table 2 illustrates the complementarity of the nucleotide sequences of HUNK BINDING SITE, designated SEQ ID:15948, to the nucleotide sequence of VGAM381 RNA, herein designated VGAM RNA, also designated SEQ ID:3092.

Another function of VGAM381 is therefore inhibition of Hormonally Upregulated Neu-associated Kinase (HUNK, Accession NM_014586). Accordingly, utilities of VGAM381 include diagnosis, prevention and treatment of diseases and clinical conditions associated with HUNK. Myosin IC (MYO1C, Accession XM_028385) is another VGAM381 host target gene. MYO1C BINDING SITE is HOST TARGET binding site found in the 3' untranslated region of mRNA encoded by MYO1C, corresponding to a HOST TARGET binding site such as BINDING SITE I, BINDING SITE II or BINDING SITE III. Table 2 illustrates the complementarity of the nucleotide sequences of MYO1C BINDING SITE, designated SEQ ID:30696, to the nucleotide sequence of VGAM381 RNA, herein designated VGAM RNA, also designated SEQ ID:3092.

Another function of VGAM381 is therefore inhibition of Myosin IC (MYO1C, Accession XM_028385), a gene which participates in adaptation in hair cells. Accordingly, utilities of VGAM381 include diagnosis, prevention and treatment of diseases and clinical conditions associated with MYO1C. The function of MYO1C has been established by previous studies. MYO1C, also known as myosin I-beta and MYR2, was thought to mediate the slow component of adaptation by hair cells, the sensory cells of the inner ear. To test this hypothesis, Holt et al. (2002) mutated tyr61 of MYO1C to gly, conferring susceptibility to inhibition by N6-modified ADP analogs. They expressed the mutant MYO1C in utricular hair cells of transgenic mice, delivered an ADP analog through a whole-cell recording pipette, and found that the analog rapidly blocked adaptation to positive and negative deflections in transgenic cells but not in wildtype cells. The speed and specificity of inhibition suggested that MYO1C participates in adaptation in hair cells.

Full details of the abovementioned studies are described in the following publications, the disclosure of which are hereby incorporated by reference:

Crozet, F.; Amraoui, A. E.; Blanchard, S.; Lenoir, M.; Ripoll, C.; Vago, P.; Hamel, C.; Fizames, C.; Levi-Acobas, F.; Depetris, D.; Mattei, M.-G.; Weil, D.; Pujol, R.; Petit, C.: Cloning of the genes encoding two murine and human cochlear unconventional type I myosins. Genomics 40:332-341, 1997; and Holt, J. R.; Gillespie, S. K. H.; Provance, D. W., Jr.; Shah, K.; Shokat, K. M.; Corey, D. P.; Mercer, J. A.; Gillespie, P. G.: A chemical-genetic strategy implicates myosin-1c in adap.

Further studies establishing the function and utilities of MYO1C are found in John Hopkins OMIM database record ID 606538, and in sited publications numbered 6515 listed in the bibliography section hereinbelow, which are also hereby incorporated by reference. Paired Mesoderm Homeo Box 1 (PMX1, Accession NM_022716) is another VGAM381 host target gene. PMX1 BINDING SITE1 and PMX1 BINDING SITE2 are HOST TARGET binding sites found in untranslated regions of mRNA encoded by PMX1, corresponding to HOST TARGET binding sites such as BINDING SITE I, BINDING SITE II or BINDING SITE III. Table 2 illustrates the complementarity of the nucleotide sequences of PMX1 BINDING SITE1 and PMX1 BINDING SITE2, designated SEQ ID:22914 and SEQ ID:13779 respectively, to the nucleotide sequence of VGAM381 RNA, herein designated VGAM RNA, also designated SEQ ID:3092.

Another function of VGAM381 is therefore inhibition of Paired Mesoderm Homeo Box 1 (PMX1, Accession NM_022716), a gene which acts as a transcriptional regulator of muscle creatine kinase. Accordingly, utilities of VGAM381 include diagnosis, prevention and treatment of diseases and clinical conditions associated with PMX1. The function of PMX1 has been established by previous studies. Homeo box genes are expressed in specific temporal and spatial patterns and function as transcriptional regulators of developmental processes. The murine homeo box gene Pmx (paired mesoderm homeo box), previously called K-2 and mHox, is expressed in a mesodermally restricted pattern in embryos and most abundantly in cardiac, skeletal, and smooth muscle tissues in adults (Kern et al., 1994). Grueneberg et al. (1992) cloned the homologous human gene. By means of interspecific backcross analysis, Kern et al. (1994) determined that the Pmx gene is located on mouse chromosome 1, approximately 3.3 cM distal to the Gsh-4 homeo box locus. The gene contains at least 5 exons spanning a minimum of 60 kb of genomic DNA, making this the largest known murine homeo box gene. The homologous human gene may map to 1q inasmuch as this region is syntenic with the region of mouse chromosome 1 where Pmx is located. Norris et al. (2000) mapped the human PRRX1 gene to 1q23 by fluorescence in situ hybridization.

Full details of the abovementioned studies are described in the following publications, the disclosure of which are hereby incorporated by reference:

Grueneberg, D. A.; Natesan, S.; Alexandre, C.; Gilman, M. Z.: Human and Drosophila homeodomain proteins that enhance the DNA-binding activity of serum response factor. Science 257:1089-1095, 1992; and Norris, R. A.; Scott, K. K.; Moore, C. S.; Stetten, G.; Brown, C. R.; Jabs, E. W.; Wulfsberg, E. A.; Yu, J.; Kern, M. J.: Human PRRX1 and PRRX2 genes: cloning, expression, genomic localiz.

Further studies establishing the function and utilities of PMX1 are found in John Hopkins OMIM database record ID 167420, and in sited publications numbered 10955-10959 listed in the bibliography section hereinbelow, which are also hereby incorporated by reference. SWI/SNF Related, Matrix Associated, Actin Dependent Regulator of Chromatin, Subfamily D, Member 1 (SMARCD1, Accession NM_139071) is another VGAM381 host target gene. SMARCD1 BINDING SITE1 and SMARCD1 BINDING SITE2 are HOST TARGET binding sites found in untranslated regions of mRNA encoded by SMARCD1, corresponding to HOST TARGET binding sites such as BINDING SITE I, BINDING SITE II or BINDING SITE III. Table 2 illustrates the complementarity of the nucleotide sequences of SMARCD1 BINDING SITE1 and SMARCD1 BINDING SITE2, designated SEQ ID:29142 and SEQ ID:9044 respectively, to the nucleotide sequence of VGAM381 RNA, herein designated VGAM RNA, also designated SEQ ID:3092.

Another function of VGAM381 is therefore inhibition of SWI/SNF Related, Matrix Associated, Actin Dependent Regulator of Chromatin, Subfamily D, Member 1 (SMARCD1, Accession NM_139071), a gene which is involved in chromatin assembly and remodeling. Accordingly, utilities of VGAM381 include diagnosis, prevention and treatment of diseases and clinical conditions associated with SMARCD1. The function of SMARCD1 and its association with various diseases and clinical conditions, has been established by previous studies, as described hereinabove with reference to VGAM152. Ubiquitin-conjugating Enzyme E2L 3 (UBE2L3, Accession NM_003347) is another VGAM381 host target gene. UBE2L3 BINDING SITE is HOST TARGET binding site found in the 3' untranslated region of mRNA encoded by UBE2L3, corresponding to a HOST TARGET binding site such as BINDING SITE I, BINDING SITE II or BINDING SITE III. Table 2 illustrates the complementarity of the nucleotide sequences of UBE2L3 BINDING SITE, designated SEQ ID:9359, to the nucleotide sequence of VGAM381 RNA, herein designated VGAM RNA, also designated SEQ ID:3092.

Another function of VGAM381 is therefore inhibition of Ubiquitin-conjugating Enzyme E2L 3 (UBE2L3, Accession NM_003347), a gene which catalyzes the covalent attachment of ubiquitin to other proteins. Accordingly, utilities of VGAM381 include diagnosis, prevention and treatment of diseases and clinical conditions associated with UBE2L3. The function of UBE2L3 and its association with various diseases and clinical conditions, has been established by previous studies, as described hereinabove with reference to VGAM215. Wingless-type MMTV Integration Site Family, Member 1 (WNT1, Accession NM_005430) is another VGAM381 host target gene. WNT1 BINDING SITE is HOST TARGET binding site found in the 3' untranslated region of mRNA encoded by WNT1, corresponding to a HOST TARGET binding site such as BINDING SITE I, BINDING SITE II or BINDING SITE III. Table 2 illustrates the complementarity of the nucleotide sequences of WNT1 BINDING SITE, designated SEQ ID:11896, to the nucleotide sequence of VGAM381 RNA, herein designated VGAM RNA, also designated SEQ ID:3092.

Another function of VGAM381 is therefore inhibition of Wingless-type MMTV Integration Site Family, Member 1 (WNT1, Accession NM_005430), a gene which may have a role in development of the central nervous system. Accordingly, utilities of VGAM381 include diagnosis, prevention and treatment of diseases and clinical conditions associated with WNT1. The function of WNT1 has been established by previous studies. Int oncogenes, including Int1, were first identified as targets for insertional activation by the mouse mammary tumor virus (MMTV) in mammary carcinomas. Int2 (see OMIM Ref. No. 164950) and Int3 (see OMIM Ref. No. 164951) are fundamentally unrelated genes; the similarity in nomenclature is based on the criterion of being a target for MMTV insertion mutation. Nusse et al. (1991) proposed that the INT1 gene be termed WNT1 (pronounced 'wint 1'), because it was both an INT gene and a homolog of the Drosophila 'wingless' gene. The WNTs are a family of secreted glycoproteins that have been shown to be involved in a variety of developmental processes in many organisms. The prototype of the family is the Drosophila protein 'wingless' which acts as a segment polarity gene during embryogenesis and later participates in pattern formation of other body parts. Gavin et al. (1990) isolated 7 murine Wnt family members; Wolda and Moon (1992) isolated 7 Xenopus Wnt family members. McMahon (1992) discussed the Wnt family of developmental regulators, with particular reference to mouse mammary gland and the development of mouse mammary tumors. INT1 has a highly specific (both temporal and spatial) pattern of expression in fetal brain and spinal cord from 9- to 10-day-old mouse embryos but has been demonstrated to be expressed in only 1 adult tissue, postmyotic spermatids. The Drosophila homolog of INT1 is 'wingless,' a segment-polarity gene. Indirect evidence that INT1 is secreted and that the product of 'wingless' is a diffusible gene product suggests that these proteins are secreted growth factors. By analyzing human genome draft sequence, Kirikoshi et al. (2001) determined that WNT1 is encoded by 4 exons and is clustered with WNT10B (OMIM Ref. No. 601906) in a head-to-head manner within an interval of less than 7 kb. They discussed possibilities for the origin of WNT gene clusters through duplication of an ancestral WNT gene cluster Animal model experiments lend further support to the function of WNT1. Tsukamoto et al. (1988) generated transgenic mice ectopically expressing Wnt1 RNA at high levels in mammary and salivary glands of male and female mice and in male reproductive organs. The mammary glands of males and virgin females were grossly hyperplastic compared with those of nontransgenic littermates. Tsukamoto et al. (1988) observed mammary and (less frequently) salivary adenocarcinomas in these animals at rates indicating that transcriptional activation of Wnt1 and associated hyperplasia are initiating events in multistep carcinogenesis. Thomas and Capecchi (1990) explored the function of int1 in the mouse by disrupting one of the 2 int1 alleles in mouse embryo-derived stem cells using positive-negative selection. This cell line was then used to generate a chimeric mouse that transmitted the mutant allele to its progeny. Mice heterozygous for the null mutation were normal and fertile, whereas mice homozygous for the mutation exhibited a range of phenotypes from death before birth to survival with severe ataxia. Examination of homozygous mice at several stages of embryogenesis showed severe abnormalities in the development of the mesencephalon and metencephalon, indicating a prominent role for the int1 protein in the induction of the mesencephalon and cerebellum.

It is appreciated that the abovementioned animal model for WNT1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kirikoshi, H.; Sekihara, H.; Katoh, M.: WNT10A and WNT6, clustered in human chromosome 2q35 region with head-to-tail manner, are strongly coexpressed in SW480 cells. Biochem. Biophys. Res. Commun. 283:798-805, 2001; and Wolda, S. L.; Moon, R. T.: Cloning and developmental expression in Xenopus laevis of seven additional members of the Wnt family. Oncogene 7:1941-1947, 1992.

Further studies establishing the function and utilities of WNT1 are found in John Hopkins OMIM database record ID 164820, and in sited publications numbered 12746-12753, 882, 1724, 3475-172 and 3972 listed in the bibliography section hereinbelow, which are also hereby incorporated by reference. Zic Family Member 1 (odd-paired homolog, Drosophila) (ZIC1, Accession NM_003412) is another VGAM381 host target gene. ZIC1 BINDING SITE is HOST TARGET binding site found in the 5' untranslated region of mRNA encoded by ZIC1, corresponding to a HOST TARGET binding site such as BINDING SITE I, BINDING SITE II or BINDING SITE III. Table 2 illustrates the complementarity of the nucleotide sequences of ZIC1 BINDING SITE, designated SEQ ID:9447, to the nucleotide sequence of VGAM381 RNA, herein designated VGAM RNA, also designated SEQ ID:3092.

Another function of VGAM381 is therefore inhibition of Zic Family Member 1 (odd-paired homolog, Drosophila) (ZIC1, Accession NM_003412), a gene which may play a role in cerebellar development. Accordingly, utilities of VGAM381 include diagnosis, prevention and treatment of diseases and clinical conditions associated with ZIC1. The function of ZIC1 has been established by previous studies. mouse cerebellum and is highly homologous to the Drosophila pair-rule gene Opa. To clarify the mechanism for the development of the human cerebellum and the possible involvement of ZIC in human nervous system diseases, Yokota et al. (1996) isolated human ZIC cDNA and examined its expression by using monoclonal antibody against recombinant ZIC protein. The nucleotide sequence of human ZIC cDNA is 85% homologous to that the mouse zic gene. Its putative amino acid sequence is highly conserved (more than 99%) except for substitution of only 2 amino acid residues. By fluorescence in situ hybridization, Yokota et al. (1996) mapped the human ZIC gene to 3q24. The human ZIC protein was immunohistochemically detected in the nuclei of the cerebellar granule cell lineage from the progenitor cells of the external germinal layer to the postmigrated cells of the internal granular layer. Furthermore, ZIC protein was detected in medulloblastoma (26 of 29 cases), whereas none of 70 other tumors examined, including primitive neuroectodermal tumors, expressed this protein. These findings suggested that ZIC is a potential biomarker for medulloblastoma as well as the human cerebellar granule cell lineage.

Full details of the abovementioned studies are described in the following publications, the disclosure of which are hereby incorporated by reference:

Aruga, J.; Yokota, N.; Hashimoto, M.; Furuichi, T.; Fukuda, M.; Mikoshiba, K.: A novel zinc finger protein, Zic, is involved in neurogenesis, especially in the cell lineage of cerebellar granule cells. J. Neurochem. 63:1880-1890, 1994; and Yokota, N.; Aruga, J.; Takai, S.; Yamada, K.; Hamazaki, M.; Iwase, T.; Sugimura, H.; Mikoshiba, K.: Predominant expression of human Zic in cerebellar granule cell lineage and medulloblasto.

Further studies establishing the function and utilities of ZIC1 are found in John Hopkins OMIM database record ID 600470, and in sited publications numbered 7734-7736 listed in the bibliography section hereinbelow, which are also hereby incorporated by reference. DKFZp547G183 (Accession NM_018705) is another VGAM381 host target gene. DKFZp547G183 BINDING SITE is HOST TARGET binding site found in the 3' untranslated region of mRNA encoded by DKFZp547G183, corresponding to a HOST TARGET binding site such as BINDING SITE I, BINDING SITE II or BINDING SITE III. Table 2 illustrates the complementarity of the nucleotide sequences of DKFZp547G183 BINDING SITE, designated SEQ ID:20788, to the nucleotide sequence of VGAM381 RNA, herein designated VGAM RNA, also designated SEQ ID:3092.

Another function of VGAM381 is therefore inhibition of DKFZp547G183 (Accession NM_018705). Accordingly, utilities of VGAM381 include diagnosis, prevention and treatment of diseases and clinical conditions associated with DKFZp547G183. FLJ12783 (Accession NM_031426) is another VGAM381 host target gene. FLJ12783 BINDING SITE is HOST TARGET binding site found in the 3' untranslated region of mRNA encoded by FLJ12783, corresponding to a HOST TARGET binding site such as BINDING SITE I, BINDING SITE II or BINDING SITE III. Table 2 illustrates the complementarity of the nucleotide sequences of FLJ12783 BINDING SITE, designated SEQ ID:25416, to the nucleotide sequence of VGAM381 RNA, herein designated VGAM RNA, also designated SEQ ID:3092.

Another function of VGAM381 is therefore inhibition of FLJ12783 (Accession NM_031426). Accordingly, utilities of VGAM381 include diagnosis, prevention and treatment of diseases and clinical conditions associated with FLJ12783. FLJ13102 (Accession NM_024887) is another VGAM381 host target gene. FLJ13102 BINDING SITE is HOST TARGET binding site found in the 3' untranslated region of mRNA encoded by FLJ13102, corresponding to a HOST TARGET binding site such as BINDING SITE I, BINDING SITE II or BINDING SITE III. Table 2 illustrates the complementarity of the nucleotide sequences of FLJ13102 BINDING SITE, designated SEQ ID:24342, to the nucleotide sequence of VGAM381 RNA, herein designated VGAM RNA, also designated SEQ ID:3092.

Another function of VGAM381 is therefore inhibition of FLJ13102 (Accession NM_024887). Accordingly, utilities of VGAM381 include diagnosis, prevention and treatment of diseases and clinical conditions associated with FLJ13102. FLJ13848 (Accession NM_024771) is another VGAM381 host target gene. FLJ13848 BINDING SITE is HOST TARGET binding site found in the 3' untranslated region of mRNA encoded by FLJ13848, corresponding to a HOST TARGET binding site such as BINDING SITE I, BINDING SITE II or BINDING SITE III. Table 2 illustrates the complementarity of the nucleotide sequences of FLJ13848 BINDING SITE, designated SEQ ID:24133, to the nucleotide sequence of VGAM381 RNA, herein designated VGAM RNA, also designated SEQ ID:3092.

Another function of VGAM381 is therefore inhibition of FLJ13848 (Accession NM_024771). Accordingly, utilities of VGAM381 include diagnosis, prevention and treatment of diseases and clinical conditions associated with FLJ13848. FLJ13993 (Accession XM_017638) is another VGAM381 host target gene. FLJ13993 BINDING SITE is HOST TARGET binding site found in the 3' untranslated region of mRNA encoded by FLJ13993, corresponding to a HOST TARGET binding site such as BINDING SITE I, BINDING SITE II or BINDING SITE III. Table 2 illustrates the complementarity of the nucleotide sequences of FLJ13993 BINDING SITE, designated SEQ ID:30328, to the nucleotide sequence of VGAM381 RNA, herein designated VGAM RNA, also designated SEQ ID:3092.

Another function of VGAM381 is therefore inhibition of FLJ13993 (Accession XM_017638). Accordingly, utilities of VGAM381 include diagnosis, prevention and treatment of diseases and clinical conditions associated with FLJ13993. FLJ22944 (Accession NM_025145) is another VGAM381 host target gene. FLJ22944 BINDING SITE is HOST TARGET binding site found in the 3' untranslated region of mRNA encoded by FLJ22944, corresponding to a HOST TARGET binding site such as BINDING SITE I, BINDING SITE II or BINDING SITE III. Table 2 illustrates the complementarity of the nucleotide sequences of FLJ22944 BINDING SITE, designated SEQ ID:24785, to the nucleotide sequence of VGAM381 RNA, herein designated VGAM RNA, also designated SEQ ID:3092.

Another function of VGAM381 is therefore inhibition of FLJ22944 (Accession NM_025145). Accordingly, utilities of VGAM381 include diagnosis, prevention and treatment of diseases and clinical conditions associated with FLJ22944. FLJ32334 (Accession NM_144565) is another VGAM381 host target gene. FLJ32334 BINDING SITE is HOST TARGET binding site found in the 3' untranslated region of mRNA encoded by FLJ32334, corresponding to a HOST TARGET binding site such as BINDING SITE I, BINDING SITE II or BINDING SITE III. Table 2 illustrates the complementarity of the nucleotide sequences of FLJ32334 BINDING SITE, designated SEQ ID:29370, to the nucleotide sequence of VGAM381 RNA, herein designated VGAM RNA, also designated SEQ ID:3092.

Another function of VGAM381 is therefore inhibition of FLJ32334 (Accession NM_144565). Accordingly, utilities of VGAM381 include diagnosis, prevention and treatment of diseases and clinical conditions associated with FLJ32334. GTP Binding Protein 2 (GTPBP2, Accession NM_019096) is another VGAM381 host target gene. GTPBP2 BINDING SITE is HOST TARGET binding site found in the 3' untranslated region of mRNA encoded by GTPBP2, corresponding to a HOST TARGET binding site such as BINDING SITE I, BINDING SITE II or BINDING SITE III. Table 2 illustrates the complementarity of the nucleotide sequences of GTPBP2 BINDING SITE, designated SEQ ID:21172, to the nucleotide sequence of VGAM381 RNA, herein designated VGAM RNA, also designated SEQ ID:3092.

Another function of VGAM381 is therefore inhibition of GTP Binding Protein 2 (GTPBP2, Accession NM_019096). Accordingly, utilities of VGAM381 include diagnosis, prevention and treatment of diseases and clinical conditions associated with GTPBP2. HSPC065 (Accession NM_014157) is another VGAM381 host target gene. HSPC065 BINDING SITE is HOST TARGET binding site found in the 3' untranslated region of mRNA encoded by HSPC065, corresponding to a HOST TARGET binding site such as BINDING SITE I, BINDING SITE II or BINDING SITE III. Table 2 illustrates the complementarity of the nucleotide sequences of HSPC065 BINDING SITE, designated SEQ ID:15449, to the nucleotide sequence of VGAM381 RNA, herein designated VGAM RNA, also designated SEQ ID:3092.

Another function of VGAM381 is therefore inhibition of HSPC065 (Accession NM_014157). Accordingly, utilities of VGAM381 include diagnosis, prevention and treatment of diseases and clinical conditions associated with HSPC065. IMPACT (Accession NM_018439) is another VGAM381 host target gene. IMPACT BINDING SITE is HOST TARGET binding site found in the 3" untranslated region of mRNA encoded by IMPACT, corresponding to a HOST TARGET binding site such as BINDING SITE I, BINDING SITE II or BINDING SITE III. Table 2 illustrates the complementarity of the nucleotide sequences of IMPACT BINDING SITE, designated SEQ ID:20502, to the nucleotide sequence of VGAM381 RNA, herein designated VGAM RNA, also designated SEQ ID:3092.

Another function of VGAM381 is therefore inhibition of IMPACT (Accession NM_018439). Accordingly, utilities of VGAM381 include diagnosis, prevention and treatment of diseases and clinical conditions associated with IMPACT. KIAA0258 (Accession NM_014785) is another VGAM381 host target gene. KIAA0258 BINDING SITE is HOST TARGET binding site found in the 3' untranslated region of mRNA encoded by KIAA0258, corresponding to a HOST TARGET binding site such as BINDING SITE I, BINDING SITE II or BINDING SITE III. Table 2 illustrates the complementarity of the nucleotide sequences of KIAA0258 BINDING SITE, designated SEQ ID:16643, to the nucleotide sequence of VGAM381 RNA, herein designated VGAM RNA, also designated SEQ ID:3092.

Another function of VGAM381 is therefore inhibition of KIAA0258 (Accession NM_014785). Accordingly, utilities of VGAM381 include diagnosis, prevention and treatment of diseases and clinical conditions associated with KIAA0258. KIAA0853 (Accession NM_015070) is another VGAM381 host target gene. KIAA0853 BINDING SITE is HOST TARGET binding site found in the 3' untranslated region of mRNA encoded by KIAA0853, corresponding to a HOST TARGET binding site such as BINDING SITE I, BINDING SITE II or BINDING SITE III. Table 2 illustrates the complementarity of the nucleotide sequences of KIAA0853 BINDING SITE, designated SEQ ID:17436, to the nucleotide sequence of VGAM381 RNA, herein designated VGAM RNA, also designated SEQ ID:3092.

Another function of VGAM381 is therefore inhibition of KIAA0853 (Accession NM_015070). Accordingly, utilities of VGAM381 include diagnosis, prevention and treatment of diseases and clinical conditions associated with KIAA0853. KIAA1111 (Accession XM_171233) is another VGAM381 host target gene. KIAA1111 BINDING SITE is HOST TARGET binding site found in the 3' untranslated region of mRNA encoded by KIAA1111, corresponding to a HOST TARGET binding site such as BINDING SITE I, BINDING SITE II or BINDING SITE III. Table 2 illustrates the complementarity of the nucleotide sequences of KIAA1111 BINDING SITE, designated SEQ ID:46019, to the nucleotide sequence of VGAM381 RNA, herein designated VGAM RNA, also designated SEQ ID:3092.

Another function of VGAM381 is therefore inhibition of KIAA1111 (Accession XM_171233). Accordingly, utilities of VGAM381 include diagnosis, prevention and treatment of diseases and clinical conditions associated with KIAA1111. KIAA1854 (Accession XM_049884) is another VGAM381 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35521, to the nucleotide sequence of VGAM381 RNA, herein designated VGAM RNA, also designated SEQ ID:3092.

Another function of VGAM381 is therefore inhibition of KIAA1854 (Accession XM_049884). Accordingly, utilities of VGAM381 include diagnosis, prevention and treatment of diseases and clinical conditions associated with KIAA1854. KIAA1887 (Accession XM_084801) is another VGAM381 host target gene. KIAA1887 BINDING SITE is HOST TARGET binding site found in the 5' untranslated region of mRNA encoded by KIAA1887, corresponding to a HOST TARGET binding site such as BINDING SITE I, BINDING SITE II or BINDING SITE III. Table 2 illustrates the complementarity of the nucleotide sequences of KIAA1887 BINDING SITE, designated SEQ ID:37714, to the nucleotide sequence of VGAM381 RNA, herein designated VGAM RNA, also designated SEQ ID:3092.

Another function of VGAM381 is therefore inhibition of KIAA1887 (Accession XM_084801). Accordingly, utilities of VGAM381 include diagnosis, prevention and treatment of diseases and clinical conditions associated with KIAA1887. MGC17330 (Accession NM_052880) is another VGAM381 host target gene. MGC17330 BINDING SITE is HOST TARGET binding site found in the 3' untranslated region of mRNA encoded by MGC17330, corresponding to a HOST TARGET binding site such as BINDING SITE I, BINDING SITE II or BINDING SITE III. Table 2 illustrates the complementarity of the nucleotide sequences of MGC17330 BINDING SITE, designated SEQ ID:27460, to the nucleotide sequence of VGAM381 RNA, herein designated VGAM RNA, also designated SEQ ID:3092.

Another function of VGAM381 is therefore inhibition of MGC17330 (Accession NM_052880). Accordingly, utilities of VGAM381 include diagnosis, prevention and treatment of diseases and clinical conditions associated with MGC17330. MGC2541 (Accession NM_080670) is another VGAM381 host target gene. MGC2541 BINDING SITE is HOST TARGET binding site found in the 3' untranslated region of mRNA encoded by MGC2541, corresponding to a HOST TARGET binding site such as BINDING SITE I, BINDING SITE II or BINDING SITE III. Table 2 illustrates the complementarity of the nucleotide sequences of MGC2541 BINDING SITE, designated SEQ ID:27965, to the nucleotide sequence of VGAM381 RNA, herein designated VGAM RNA, also designated SEQ ID:3092.

Another function of VGAM381 is therefore inhibition of MGC2541 (Accession NM_080670). Accordingly, utilities of VGAM381 include diagnosis, prevention and treatment of diseases and clinical conditions associated with MGC2541. P66 (Accession NM_020699) is another VGAM381 host target gene. P66 BINDING SITE is HOST TARGET binding site found in the 3' untranslated region of mRNA encoded by P66, corresponding to a HOST TARGET binding site such as BINDING SITE I, BINDING SITE II or BINDING SITE III. Table 2 illustrates the complementarity of the nucleotide sequences of P66 BINDING SITE, designated SEQ ID:21842, to the nucleotide sequence of VGAM381 RNA, herein designated VGAM RNA, also designated SEQ ID:3092.

Another function of VGAM381 is therefore inhibition of P66 (Accession NM_020699). Accordingly, utilities of VGAM381 include diagnosis, prevention and treatment of diseases and clinical conditions associated with P66. Serine/threonine Kinase 38 Like (STK38L, Accession XM_044823) is another VGAM381 host target gene. STK38L BINDING SITE is HOST TARGET binding site found in the 3' untranslated region of mRNA encoded by STK38L, corresponding to a HOST TARGET binding site such as BINDING SITE I, BINDING SITE II or BINDING SITE III. Table 2 illustrates the complementarity of the nucleotide sequences of STK38L BINDING SITE, designated SEQ ID:34288, to the nucleotide sequence of VGAM381 RNA, herein designated VGAM RNA, also designated SEQ ID:3092.

Another function of VGAM381 is therefore inhibition of Serine/threonine Kinase 38 Like (STK38L, Accession XM_044823). Accordingly, utilities of VGAM381 include diagnosis, prevention and treatment of diseases and clinical conditions associated with STK38L. LOC112868 (Accession XM_053402) is another VGAM381 host target gene. LOC112868 BINDING SITE is HOST TARGET binding site found in the 5' untranslated region of mRNA encoded by LOC112868, corresponding to a HOST TARGET binding site such as BINDING SITE I, BINDING SITE II or BINDING SITE III. Table 2 illustrates the complementarity of the nucleotide sequences of LOC112868 BINDING SITE, designated SEQ ID:36076, to the nucleotide sequence of VGAM381 RNA, herein designated VGAM RNA, also designated SEQ ID:3092.

Another function of VGAM381 is therefore inhibition of LOC112868 (Accession XM_053402). Accordingly, utilities of VGAM381 include diagnosis, prevention and treatment of diseases and clinical conditions associated with LOC112868.

LOC126528 (Accession XM_059052) is another VGAM381 host target gene. LOC126528 BINDING SITE is HOST TARGET binding site found in the 5' untranslated region of mRNA encoded by LOC126528, corresponding to a HOST TARGET binding site such as BINDING SITE I, BINDING SITE II or BINDING SITE III. Table 2 illustrates the complementarity of the nucleotide sequences of LOC126528 BINDING SITE, designated SEQ ID:36845, to the nucleotide sequence of VGAM381 RNA, herein designated VGAM RNA, also designated SEQ ID:3092.

Another function of VGAM381 is therefore inhibition of LOC126528 (Accession XM_059052). Accordingly, utilities of VGAM381 include diagnosis, prevention and treatment of diseases and clinical conditions associated with LOC126528.

LOC126661 (Accession XM_059061) is another VGAM381 host target gene. LOC126661 BINDING SITE is HOST TARGET binding site found in the 5' untranslated region of mRNA encoded by LOC126661, corresponding to a HOST TARGET binding site such as BINDING SITE I, BINDING SITE II or BINDING SITE III. Table 2 illustrates the complementarity of the nucleotide sequences of LOC126661 BINDING SITE, designated SEQ ID:36849, to the nucleotide sequence of VGAM381 RNA, herein designated VGAM RNA, also designated SEQ ID:3092.

Another function of VGAM381 is therefore inhibition of LOC126661 (Accession XM_059061). Accordingly, utilities of VGAM381 include diagnosis, prevention and treatment of diseases and clinical conditions associated with LOC126661.

LOC127534 (Accession XM_060532) is another VGAM381 host target gene. LOC127534 BINDING SITE is HOST TARGET binding site found in the 3' untranslated region of mRNA encoded by LOC127534, corresponding to a HOST TARGET binding site such as BINDING SITE I, BINDING SITE II or BINDING SITE III. Table 2 illustrates the complementarity of the nucleotide sequences of LOC127534 BINDING SITE, designated SEQ ID:37166, to the nucleotide sequence of VGAM381 RNA, herein designated VGAM RNA, also designated SEQ ID:3092.

Another function of VGAM381 is therefore inhibition of LOC127534 (Accession XM_060532). Accordingly, utilities of VGAM381 include diagnosis, prevention and treatment of diseases and clinical conditions associated with LOC127534.

LOC144100 (Accession XM_084732) is another VGAM381 host target gene. LOC144100 BINDING SITE is HOST TARGET binding site found in the 3' untranslated region of mRNA encoded by LOC144100, corresponding to a HOST TARGET binding site such as BINDING SITE I, BINDING SITE II or BINDING SITE III. Table 2 illustrates the complementarity of the nucleotide sequences of LOC144100 BINDING SITE, designated SEQ ID:37677, to the nucleotide sequence of VGAM381 RNA, herein designated VGAM RNA, also designated SEQ ID:3092.

Another function of VGAM381 is therefore inhibition of LOC144100 (Accession XM_084732). Accordingly, utilities of VGAM381 include diagnosis, prevention and treatment of diseases and clinical conditions associated with LOC144100.

LOC144289 (Accession XM_096565) is another VGAM381 host target gene. LOC144289 BINDING SITE is HOST TARGET binding site found in the 5' untranslated region of mRNA encoded by LOC144289, corresponding to a HOST TARGET binding site such as BINDING SITE I, BINDING SITE II or BINDING SITE III. Table 2 illustrates the complementarity of the nucleotide sequences of LOC144289 BINDING SITE, designated SEQ ID:40397, to the nucleotide sequence of VGAM381 RNA, herein designated VGAM RNA, also designated SEQ ID:3092.

Another function of VGAM381 is therefore inhibition of LOC144289 (Accession XM_096565). Accordingly, utilities of VGAM381 include diagnosis, prevention and treatment of diseases and clinical conditions associated with LOC144289.

LOC145468 (Accession XM_057874) is another VGAM381 host target gene. LOC145468 BINDING SITE is HOST TARGET binding site found in the 3' untranslated region of mRNA encoded by LOC145468, corresponding to a HOST TARGET binding site such as BINDING SITE I, BINDING SITE II or BINDING SITE III. Table 2 illustrates the complementarity of the nucleotide sequences of LOC145468 BINDING SITE, designated SEQ ID:36547, to the nucleotide sequence of VGAM381 RNA, herein designated VGAM RNA, also designated SEQ ID:3092.

Another function of VGAM381 is therefore inhibition of LOC145468 (Accession XM_057874). Accordingly, utilities of VGAM381 include diagnosis, prevention and treatment of diseases and clinical conditions associated with LOC145468.

LOC145854 (Accession XM_085259) is another VGAM381 host target gene. LOC145854 BINDING SITE is HOST TARGET binding site found in the 3' untranslated region of mRNA encoded by LOC145854, corresponding to a HOST TARGET binding site such as BINDING SITE I, BINDING SITE II or BINDING SITE III. Table 2 illustrates the complementarity of the nucleotide sequences of LOC145854 BINDING SITE, designated SEQ ID:38005, to the nucleotide sequence of VGAM381 RNA, herein designated VGAM RNA, also designated SEQ ID:3092.

Another function of VGAM381 is therefore inhibition of LOC145854 (Accession XM_085259). Accordingly, utilities of VGAM381 include diagnosis, prevention and treatment of diseases and clinical conditions associated with LOC145854.

LOC150150 (Accession XM_097820) is another VGAM381 host target gene. LOC150150 BINDING SITE is HOST TARGET binding site found in the 5' untranslated region of mRNA encoded by LOC150150, corresponding to a HOST TARGET binding site such as BINDING SITE I, BINDING SITE II or BINDING SITE III. Table 2 illustrates the complementarity of the nucleotide sequences of LOC150150 BINDING SITE, designated SEQ ID:41135, to the nucleotide sequence of VGAM381 RNA, herein designated VGAM RNA, also designated SEQ ID:3092.

Another function of VGAM381 is therefore inhibition of LOC150150 (Accession XM_097820). Accordingly, utilities of VGAM381 include diagnosis, prevention and treatment of diseases and clinical conditions associated with LOC150150.

LOC150155 (Accession XM_047977) is another VGAM381 host target gene. LOC150155 BINDING SITE is HOST TARGET binding site found in the 3' untranslated region of mRNA encoded by LOC150155, corresponding to a HOST TARGET binding site such as BINDING SITE I, BINDING SITE II or BINDING SITE III. Table 2 illustrates the complementarity of the nucleotide sequences of LOC150155 BINDING SITE, designated SEQ ID:35088, to the nucleotide sequence of VGAM381 RNA, herein designated VGAM RNA, also designated SEQ ID:3092.

Another function of VGAM381 is therefore inhibition of LOC150155 (Accession XM_047977). Accordingly, utilities of VGAM381 include diagnosis, prevention and treatment of diseases and clinical conditions associated with LOC150155.

LOC150299 (Accession XM_097869) is another VGAM381 host target gene. LOC150299 BINDING SITE is HOST TARGET binding site found in the 3' untranslated region of mRNA encoded by LOC150299, corresponding to a HOST TARGET binding site such as BINDING SITE I, BINDING SITE II or BINDING SITE III. Table 2 illustrates the complementarity of the nucleotide sequences of LOC150299 BINDING SITE, designated SEQ ID:41180, to the nucleotide sequence of VGAM381 RNA, herein designated VGAM RNA, also designated SEQ ID:3092.

Another function of VGAM381 is therefore inhibition of LOC150299 (Accession XM_097869). Accordingly, utilities of VGAM381 include diagnosis, prevention and treatment of diseases and clinical conditions associated with LOC150299. LOC158956 (Accession XM_039450) is another VGAM381 host target gene. LOC158956 BINDING SITE is HOST TARGET binding site found in the 3' untranslated region of mRNA encoded by LOC158956, corresponding to a HOST TARGET binding site such as BINDING SITE I, BINDING SITE II or BINDING SITE III. Table 2 illustrates the complementarity of the nucleotide sequences of LOC158956 BINDING SITE, designated SEQ ID:33096, to the nucleotide sequence of VGAM381 RNA, herein designated VGAM RNA, also designated SEQ ID:3092.

Another function of VGAM381 is therefore inhibition of LOC158956 (Accession XM_039450). Accordingly, utilities of VGAM381 include diagnosis, prevention and treatment of diseases and clinical conditions associated with LOC158956. LOC163412 (Accession XM_088868) is another VGAM381 host target gene. LOC163412 BINDING SITE is HOST TARGET binding site found in the 5' untranslated region of mRNA encoded by LOC163412, corresponding to a HOST TARGET binding site such as BINDING SITE I, BINDING SITE II or BINDING SITE III. Table 2 illustrates the complementarity of the nucleotide sequences of LOC163412 BINDING SITE, designated SEQ ID:39949, to the nucleotide sequence of VGAM381 RNA, herein designated VGAM RNA, also designated SEQ ID:3092.

Another function of VGAM381 is therefore inhibition of LOC163412 (Accession XM_088868). Accordingly, utilities of VGAM381 include diagnosis, prevention and treatment of diseases and clinical conditions associated with LOC163412. LOC256222 (Accession XM_173177) is another VGAM381 host target gene. LOC256222 BINDING SITE is HOST TARGET binding site found in the 5' untranslated region of mRNA encoded by LOC256222, corresponding to a HOST TARGET binding site such as BINDING SITE I, BINDING SITE II or BINDING SITE III. Table 2 illustrates the complementarity of the nucleotide sequences of LOC256222 BINDING SITE, designated SEQ ID:46425, to the nucleotide sequence of VGAM381 RNA, herein designated VGAM RNA, also designated SEQ ID:3092.

Another function of VGAM381 is therefore inhibition of LOC256222 (Accession XM_173177). Accordingly, utilities of VGAM381 include diagnosis, prevention and treatment of diseases and clinical conditions associated with LOC256222. LOC51170 (Accession NM_016245) is another VGAM381 host target gene. LOC51170 BINDING SITE is HOST TARGET binding site found in the 3' untranslated region of mRNA encoded by LOC51170, corresponding to a HOST TARGET binding site such as BINDING SITE I, BINDING SITE II or BINDING SITE III. Table 2 illustrates the complementarity of the nucleotide sequences of LOC51170 BINDING SITE, designated SEQ ID:18362, to the nucleotide sequence of VGAM381 RNA, herein designated VGAM RNA, also designated SEQ ID:3092.

Another function of VGAM381 is therefore inhibition of LOC51170 (Accession NM_016245). Accordingly, utilities of VGAM381 include diagnosis, prevention and treatment of diseases and clinical conditions associated with LOC51170. LOC90288 (Accession XM_030669) is another VGAM381 host target gene. LOC90288 BINDING SITE is HOST TARGET binding site found in the 3' untranslated region of mRNA encoded by LOC90288, corresponding to a HOST TARGET binding site such as BINDING SITE I, BINDING SITE II or BINDING SITE III. Table 2 illustrates the complementarity of the nucleotide sequences of LOC90288 BINDING SITE, designated SEQ ID:31114, to the nucleotide sequence of VGAM381 RNA, herein designated VGAM RNA, also designated SEQ ID:3092.

Another function of VGAM381 is therefore inhibition of LOC90288 (Accession XM_030669). Accordingly, utilities of VGAM381 include diagnosis, prevention and treatment of diseases and clinical conditions associated with LOC90288. FIG. 1 further provides a conceptual description of a novel bioinformatically detected viral gene of the present invention, referred to here as Viral Genomic Address Messenger 382 (VGAM382) viral gene, which modulates expression of respective host target genes thereof, the function and utility of which host target genes is known in the art.

VGAM382 is a novel bioinformatically detected regulatory, non protein coding, viral micro RNA (miRNA) gene. The method by which VGAM382 was detected is described hereinabove with reference to FIGS. 1-8.

VGAM382 gene, herein designated VGAM GENE, is a viral gene contained in the genome of Hepatitis A Virus. VGAM382 host target gene, herein designated VGAM HOST TARGET GENE, is a human gene contained in the human genome.

VGAM382 gene encodes a VGAM382 precursor RNA, herein designated VGAM PRECURSOR RNA. Similar to other miRNA genes, and unlike most ordinary genes, VGAM382 precursor RNA does not encode a protein. A nucleotide sequence identical or highly similar to the nucleotide sequence of VGAM382 precursor RNA is designated SEQ ID:368, and is provided hereinbelow with reference to the sequence listing part. Nucleotide sequence SEQ ID:368 is located at position 4814 relative to the genome of Hepatitis A Virus.

VGAM382 precursor RNA folds onto itself, forming VGAM382 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM382 folded precursor RNA into VGAM382 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM382 RNA is designated SEQ ID:3093, and is provided hereinbelow with reference to the sequence listing part.

VGAM382 host target gene, herein designated VGAM HOST TARGET GENE, encodes a corresponding messenger RNA, VGAM382 host target RNA, herein designated VGAM HOST TARGET RNA. VGAM382 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM382 RNA, herein designated VGAM RNA, binds complementarily to one or more host target binding sites located in untranslated regions of VGAM382 host target RNA, herein designated VGAM HOST TARGET RNA. This complementary binding is due to the fact that the nucleotide sequence of VGAM382 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM382 RNA, herein designated VGAM RNA, may have a different number of host target binding sites in untranslated regions of a VGAM382 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM382 RNA, herein designated VGAM RNA, to host target binding sites on VGAM382 host target RNA, herein designated VGAM HOST TARGET RNA, such as BINDING SITE I, BINDING SITE II and BINDING SITE III, inhibits translation of VGAM382 host target RNA into VGAM382 host target protein, herein designated VGAM HOST TARGET PROTEIN. VGAM host target protein is therefore outlined by a broken line.

It is appreciated that VGAM382 host target gene, herein designated VGAM HOST TARGET GENE, in fact represents a plurality of VGAM382 host target genes. The mRNA of each one of this plurality of VGAM382 host target genes comprises one or more host target binding sites, each having a nucleotide sequence which is at least partly complementary to VGAM382 RNA, herein designated VGAM RNA, and which when bound by VGAM382 RNA causes inhibition of translation of respective one or more VGAM382 host target proteins.

It is further appreciated by one skilled in the art that the mode of translational inhibition illustrated by FIG. 1 with specific reference to translational inhibition exerted by VGAM382 gene, herein designated VGAM GENE, on one or more VGAM382 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM382 is inhibition of expression of host target genes, as part of a novel viral mechanism of attacking a host. Accordingly, utilities of VGAM382 include diagnosis, prevention and treatment of viral infection by Hepatitis A Virus. Specific functions, and accordingly utilities, of VGAM382 correlate with, and may be deduced from, the identity of the host target genes which VGAM382 binds and inhibits, and the function of these host target genes, as elaborated hereinbelow.

Nucleotide sequences of the VGAM382 precursor RNA, herein designated VGAM PRECURSOR RNA, and of the 'diced' VGAM382 RNA, herein designated VGAM RNA, and a schematic representation of the secondary folding of VGAM382 folded precursor RNA, herein designated VGAM FOLDED PRECURSOR RNA, of VGAM382 are further described hereinbelow with reference to Table 1.

Nucleotide sequences of host target binding sites, such as BINDING SITE-I, BINDING SITE-II and BINDING SITE-III of FIG. 1, found on VGAM382 host target RNA, and schematic representation of the complementarity of each of these host target binding sites to VGAM382 RNA, herein designated VGAM RNA, are described hereinbelow with reference to Table 2.

As mentioned hereinabove with reference to FIG. 1, a function of VGAM382 gene, herein designated VGAM is inhibition of expression of VGAM382 target genes. It is appreciated that specific functions, and accordingly utilities, of VGAM382 correlate with, and may be deduced from, the identity of the target genes which VGAM382 binds and inhibits, and the function of these target genes, as elaborated hereinbelow.

Protein Tyrosine Phosphatase, Receptor Type, C (PTPRC, Accession NM_080923) is a VGAM382 host target gene. PTPRC BINDING SITE1 through PTPRC BINDING SITE3 are HOST TARGET binding sites found in untranslated regions of mRNA encoded by PTPRC, corresponding to HOST TARGET binding sites such as BINDING SITE I, BINDING SITE II or BINDING SITE III. Table 2 illustrates the complementarity of the nucleotide sequences of PTPRC BINDING SITE1 through PTPRC BINDING SITE3, designated SEQ ID:28150, SEQ ID:8719 and SEQ ID:28145 respectively, to the nucleotide sequence of VGAM382 RNA, herein designated VGAM RNA, also designated SEQ ID:3093.

A function of VGAM382 is therefore inhibition of Protein Tyrosine Phosphatase, Receptor Type, C (PTPRC, Accession NM_080923). Accordingly, utilities of VGAM382 include diagnosis, prevention and treatment of diseases and clinical conditions associated with PTPRC. FIG. 1 further provides a conceptual description of a novel bioinformatically detected viral gene of the present invention, referred to here as Viral Genomic Address Messenger 383 (VGAM383) viral gene, which modulates expression of respective host target genes thereof, the function and utility of which host target genes is known in the art.

VGAM383 is a novel bioinformatically detected regulatory, non protein coding, viral micro RNA (miRNA) gene. The method by which VGAM383 was detected is described hereinabove with reference to FIGS. 1-8.

VGAM383 gene, herein designated VGAM GENE, is a viral gene contained in the genome of Hepatitis A Virus. VGAM383 host target gene, herein designated VGAM HOST TARGET GENE, is a human gene contained in the human genome.

VGAM383 gene encodes a VGAM383 precursor RNA, herein designated VGAM PRECURSOR RNA. Similar to other miRNA genes, and unlike most ordinary genes, VGAM383 precursor RNA does not encode a protein. A nucleotide sequence identical or highly similar to the nucleotide sequence of VGAM383 precursor RNA is designated SEQ ID:369, and is provided hereinbelow with reference to the sequence listing part. Nucleotide sequence SEQ ID:369 is located at position 6678 relative to the genome of Hepatitis A Virus.

VGAM383 precursor RNA folds onto itself, forming VGAM383 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM383 folded precursor RNA into VGAM383 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM383 RNA is designated SEQ ID:3094, and is provided hereinbelow with reference to the sequence listing part.

VGAM383 host target gene, herein designated VGAM HOST TARGET GENE, encodes a corresponding messenger RNA, VGAM383 host target RNA, herein designated VGAM HOST TARGET RNA. VGAM383 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM383 RNA, herein designated VGAM RNA, binds complementarily to one or more host target binding sites located in untranslated regions of VGAM383 host target RNA, herein designated VGAM HOST TARGET RNA. This complementary binding is due to the fact that the nucleotide sequence of VGAM383 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM383 RNA, herein designated VGAM RNA, may have a different number of host target binding sites in untranslated regions of a VGAM383 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM383 RNA, herein designated VGAM RNA, to host target binding sites on VGAM383 host target RNA, herein designated VGAM HOST TARGET RNA, such as BINDING SITE I, BINDING SITE II and BINDING SITE III, inhibits translation of VGAM383 host target RNA into VGAM383 host target protein, herein designated VGAM HOST TARGET PROTEIN. VGAM host target protein is therefore outlined by a broken line.

It is appreciated that VGAM383 host target gene, herein designated VGAM HOST TARGET GENE, in fact represents a plurality of VGAM383 host target genes. The mRNA of each one of this plurality of VGAM383 host target genes comprises one or more host target binding sites, each having a nucleotide sequence which is at least partly complementary to VGAM383 RNA, herein designated VGAM RNA, and which when bound by VGAM383 RNA causes inhibition of translation of respective one or more VGAM383 host target proteins.

It is further appreciated by one skilled in the art that the mode of translational inhibition illustrated by FIG. 1 with specific reference to translational inhibition exerted by VGAM383 gene, herein designated VGAM GENE, on one or more VGAM383 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM383 is inhibition of expression of host target genes, as part of a novel viral mechanism of attacking a host. Accordingly, utilities of VGAM383 include diagnosis, prevention and treatment of viral infection by Hepatitis A Virus. Specific functions, and accordingly utilities, of VGAM383 correlate with, and may be deduced from, the identity of the host target genes which VGAM383 binds and inhibits, and the function of these host target genes, as elaborated hereinbelow.

Nucleotide sequences of the VGAM383 precursor RNA, herein designated VGAM PRECURSOR RNA, and of the 'diced' VGAM383 RNA, herein designated VGAM RNA, and a schematic representation of the secondary folding of VGAM383 folded precursor RNA, herein designated VGAM FOLDED PRECURSOR RNA, of VGAM383 are further described hereinbelow with reference to Table 1.

Nucleotide sequences of host target binding sites, such as BINDING SITE-I, BINDING SITE-II and BINDING SITE-III of FIG. 1, found on VGAM383 host target RNA, and schematic representation of the complementarity of each of these host target binding sites to VGAM383 RNA, herein designated VGAM RNA, are described hereinbelow with reference to Table 2.

As mentioned hereinabove with reference to FIG. 1, a function of VGAM383 gene, herein designated VGAM is inhibition of expression of VGAM383 target genes. It is appreciated that specific functions, and accordingly utilities, of VGAM383 correlate with, and may be deduced from, the identity of the target genes which VGAM383 binds and inhibits, and the function of these target genes, as elaborated hereinbelow.

Kinesin Family Member 5C (KIF5C, Accession NM_004522) is a VGAM383 host target gene. KIF5C BINDING SITE is HOST TARGET binding site found in the 3' untranslated region of mRNA encoded by KIF5C, corresponding to a HOST TARGET binding site such as BINDING SITE I, BINDING SITE II or BINDING SITE III. Table 2 illustrates the complementarity of the nucleotide sequences of KIF5C BINDING SITE, designated SEQ ID:10859, to the nucleotide sequence of VGAM383 RNA, herein designated VGAM RNA, also designated SEQ ID:3094.

A function of VGAM383 is therefore inhibition of Kinesin Family Member 5C (KIF5C, Accession NM_004522). Accordingly, utilities of VGAM383 include diagnosis, prevention and treatment of diseases and clinical conditions associated with KIF5C. Membrane Cofactor Protein (CD46, trophoblast-lymphocyte cross-reactive antigen) (MCP, Accession NM_002389) is another VGAM383 host target gene. MCP BINDING SITE is HOST TARGET binding site found in the 3' untranslated region of mRNA encoded by MCP, corresponding to a HOST TARGET binding site such as BINDING SITE I, BINDING SITE II or BINDING SITE III. Table 2 illustrates the complementarity of the nucleotide sequences of MCP BINDING SITE, designated SEQ ID:8204, to the nucleotide sequence of VGAM383 RNA, herein designated VGAM RNA, also designated SEQ ID:3094.

Another function of VGAM383 is therefore inhibition of Membrane Cofactor Protein (CD46, trophoblast-lymphocyte cross-reactive antigen) (MCP, Accession NM_002389), a gene which may be involved in the regulation of complement activation. Accordingly, utilities of VGAM383 include diagnosis, prevention and treatment of diseases and clinical conditions associated with MCP. The function of MCP has been established by previous studies. MCP, a C3B/C4B-binding molecule of the complement system with cofactor activity for the I-dependent cleavage of C3B and C4B, is widely distributed in white blood cells, platelets, epithelial cells, and fibroblasts. Lublin et al. (1988) purified MCP from a human T-cell line and determined the sequence of the N-terminal 24 amino acids. An oligonucleotide probe was used to identify a clone from a human monocyte cDNA library. The deduced full-length MCP consists of a 34-amino acid signal peptide and a 350-amino acid mature protein. The protein has, beginning at the N terminus, 4 cysteine-rich repeating units (short consensus repeats, or SCRs) of about 60 amino acids each that match the consensus sequence found in a multigene family of complement regulatory proteins: CR1 (OMIM Ref. No. 120620), CR2 (OMIM Ref. No. 120650), C4BP (OMIM Ref. No. 120830), FH (OMIM Ref. No. 134370), and DAF (OMIM Ref. No. 125240). Immediately C-terminal of the SCRs is a serine/threonine/proline (STP)-rich region, a likely area for extensive O-glycosylation. MCP also has a transmembrane domain, a basic amino acid anchor, and a cytoplasmic tail. Purcell et al. (1991) and Post et al. (1991) identified 4 and 6 isoforms of MCP, respectively. Post et al. (1991) demonstrated that the 6 isoforms vary in having 1 of 2 cytoplasmic tails and by having either all 3 STP regions (termed A, B, and C) or only STP-BC or STP-C. They showed that the STP-C isoforms are expressed as 45- to 55-kD proteins, the STP-BC isoforms are expressed as 55- to 65-kD proteins, and the STP-ABC isoforms are expressed as 65- to 75-kD proteins. The 65- to 75-kD variants were not expressed on peripheral blood cells or cell lines. Post et al. (1991) concluded that the presence of the B region of the STP area, which is richer in O-linked sugars, determines the expression of the 2 broad protein species. They also noted that up to 4 different forms of MCP are expressed on a single cell. Lublin et al. (1988) localized MCP to 1q31-q41 by Southern analysis of human-rodent somatic cell hybrid DNA and by in situ hybridization. This was the sixth member of this multigene family that had been assigned to this region of the genome. Bora et al. (1989) demonstrated that the MCP gene is on the same 1,250-kb NotI fragment that contains CR1, CR2, DAF, and C4BP and maps within 100 kb of the 3-prime end of the CR1 gene. The order of the genes appears to be that just indicated, with MCP preceding the other 4 genes. Animal model experiments lend further support to the function of MCP. Marie et al. (2002) studied mice transgenic for human CD46 isoforms differing in their STP regions and in the length of their cytoplasmic domains. Mice expressing the 16-amino acid cytoplasmic tail variant, dubbed CD46-1, inhibited the T cell-mediated contact hypersensitivity reaction, whereas those expression the 23-residue cytoplasmic tail variant, termed CD46-2, increased it. CD46 stimulation or costimulation resulted in decreased cytotoxic activity and IL2 production, but increased proliferation and IL10 production, in CD46-1 transgenic mice. The effects were reversed in CD46-2 mice.

It is appreciated that the abovementioned animal model for MCP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lublin, D. M.; Liszewski, M. K.; Post, T. W.; Arce, M. A.; LeBeau, M. M.; Rebentisch, M. B.; Lemons, R. S.; Seya, T.; Atkinson, J. P.: Molecular cloning and chromosomal localization of human complement membrane cofactor protein (MCP): evidence for inclusion in the multigene family of complement-regulatory proteins. J. Exp. Med. 168:181-194, 1988; and Post, T. W.; Liszewski, M. K.; Adams, E. M.; Tedja, I.; Miller, E. A.; Atkinson, J. P.: Membrane cofactor protein of the complement system: alternative splicing of serine/threonine/prol.

Further studies establishing the function and utilities of MCP are found in John Hopkins OMIM database record ID 120920, and in sited publications numbered 347-356 listed in the bibliography section hereinbelow, which are also hereby incorporated by reference. Src-like-adaptor (SLA, Accession NM_006748) is another VGAM383 host target gene. SLA BINDING SITE is HOST TARGET binding site found in the 3' untranslated region of mRNA encoded by SLA, corresponding to a HOST TARGET binding site such as BINDING SITE I, BINDING SITE II or BINDING SITE III. Table 2 illustrates the complementarity of the nucleotide sequences of SLA BINDING SITE, designated SEQ ID:13596, to the nucleotide sequence of VGAM383 RNA, herein designated VGAM RNA, also designated SEQ ID:3094.

Another function of VGAM383 is therefore inhibition of Src-like-adaptor (SLA, Accession NM_006748), a gene which is a negative regulator of T-cell receptor signaling. Accordingly, utilities of VGAM383 include diagnosis, prevention and treatment of diseases and clinical conditions associated with SLA. The function of SLA has been established by previous studies. Pandey et al. (1995) isolated a mouse cDNA using the 2-hybrid system to screen for molecules that interact with the cytoplasmic domain of Eck, a mouse receptor protein kinase (OMIM Ref. No. 176946). The predicted 281-amino acid protein has both SH3 and SH2 adaptor motifs similar to those in the Src family of nonreceptor tyrosine kinases but had no catalytic domain. The protein was named Slap (Src-like adaptor protein) by the authors. Recombinant Slap was shown to bind to activated Eck receptor tyrosine kinase. Angrist et al. (1995) cloned a cDNA for the putative human homolog of the gene, symbolized SLA. The predicted protein has 87% overall identity to the mouse sequence. Sosinowski et al. (2000) showed that SLA is a negative regulator of T-cell receptor signaling. Holland et al. (2001) demonstrated that SLA and SLA2 (OMIM Ref. No. 606577) are both involved in downregulating T and B cell-mediated responses.

Full details of the abovementioned studies are described in the following publications, the disclosure of which are hereby incorporated by reference:

Angrist, M.; Wells, D. E.; Chakravarti, A.; Pandey, A.: Chromosomal localization of the mouse Src-like adapter protein (Slap) gene and its putative human homolog SLA. Genomics 30:623-625, 1995; and Sosinowski, T.; Pandey, A.; Dixit, V. M.; Weiss, A.: Src-like adaptor protein (SLAP) is a negative regulator of T cell receptor signaling. J. Exp. Med. 191:463-474, 2000.

Further studies establishing the function and utilities of SLA are found in John Hopkins OMIM database record ID 601099, and in sited publications numbered 9491-949 and 9826 listed in the bibliography section hereinbelow, which are also hereby incorporated by reference. SORCS1 (Accession NM_052918) is another VGAM383 host target gene.

SORCS1 BINDING SITE is HOST TARGET binding site found in the 3' untranslated region of mRNA encoded by SORCS1, corresponding to a HOST TARGET binding site such as BINDING SITE I, BINDING SITE II or BINDING SITE III. Table 2 illustrates the complementarity of the nucleotide sequences of SORCS1 BINDING SITE, designated SEQ ID:27481, to the nucleotide sequence of VGAM383 RNA, herein designated VGAM RNA, also designated SEQ ID:3094.

Another function of VGAM383 is therefore inhibition of SORCS1 (Accession NM_052918). Accordingly, utilities of VGAM383 include diagnosis, prevention and treatment of diseases and clinical conditions associated with SORCS1. Tumor Necrosis Factor, Alpha-induced Protein 1 (endothelial) (TNFAIP1, Accession NM_021137) is another VGAM383 host target gene. TNFAIP1 BINDING SITE is HOST TARGET binding site found in the 3' untranslated region of mRNA encoded by TNFAIP1, corresponding to a HOST TARGET binding site such as BINDING SITE I, BINDING SITE II or BINDING SITE III. Table 2 illustrates the complementarity of the nucleotide sequences of TNFAIP1 BINDING SITE, designated SEQ ID:22111, to the nucleotide sequence of VGAM383 RNA, herein designated VGAM RNA, also designated SEQ ID:3094.

Another function of VGAM383 is therefore inhibition of Tumor Necrosis Factor, Alpha-induced Protein 1 (endothelial) (TNFAIP1, Accession NM_021137). Accordingly, utilities of VGAM383 include diagnosis, prevention and treatment of diseases and clinical conditions associated with TNFAIP1. Aminoadipate-semialdehyde Dehydrogenase-phosphopantetheinyl Transferase (AASDHPPT, Accession NM_015423) is another VGAM383 host target gene. AASDHPPT BINDING SITE is HOST TARGET binding site found in the 3' untranslated region of mRNA encoded by AASDHPPT, corresponding to a HOST TARGET binding site such as BINDING SITE I, BINDING SITE II or BINDING SITE III. Table 2 illustrates the complementarity of the nucleotide sequences of AASDHPPT BINDING SITE, designated SEQ ID:17724, to the nucleotide sequence of VGAM383 RNA, herein designated VGAM RNA, also designated SEQ ID:3094.

Another function of VGAM383 is therefore inhibition of Aminoadipate-semialdehyde Dehydrogenase-phosphopantetheinyl Transferase (AASDHPPT, Accession NM_015423). Accordingly, utilities of VGAM383 include diagnosis, prevention and treatment of diseases and clinical conditions associated with AASDHPPT. DDM36 (Accession NM_020962) is another VGAM383 host target gene. DDM36 BINDING SITE is HOST TARGET binding site found in the 3' untranslated region of mRNA encoded by DDM36, corresponding to a HOST TARGET binding site such as BINDING SITE I, BINDING SITE II or BINDING SITE III. Table 2 illustrates the complementarity of the nucleotide sequences of DDM36 BINDING SITE, designated SEQ ID:21954, to the nucleotide sequence of VGAM383 RNA, herein designated VGAM RNA, also designated SEQ ID:3094.

Another function of VGAM383 is therefore inhibition of DDM36 (Accession NM_020962). Accordingly, utilities of VGAM383 include diagnosis, prevention and treatment of diseases and clinical conditions associated with DDM36. FLJ10853 (Accession NM_018246) is another VGAM383 host target gene. FLJ10853 BINDING SITE is HOST TARGET binding site found in the 3' untranslated region of mRNA encoded by FLJ10853, corresponding to a HOST TARGET binding site such as BINDING SITE I, BINDING SITE II or BINDING SITE III. Table 2 illustrates the complementarity of the nucleotide sequences of FLJ10853 BINDING SITE, designated SEQ ID:20213, to the nucleotide sequence of VGAM383 RNA, herein designated VGAM RNA, also designated SEQ ID:3094.

Another function of VGAM383 is therefore inhibition of FLJ10853 (Accession NM_018246). Accordingly, utilities of VGAM383 include diagnosis, prevention and treatment of diseases and clinical conditions associated with FLJ10853. FLJ14146 (Accession NM_024709) is another VGAM383 host target gene. FLJ14146 BINDING SITE is HOST TARGET binding site found in the 3' untranslated region of mRNA encoded by FLJ14146, corresponding to a HOST TARGET binding site such as BINDING SITE I, BINDING SITE II or BINDING SITE III. Table 2 illustrates the complementarity of the nucleotide sequences of FLJ14146 BINDING SITE, designated SEQ ID:24035, to the nucleotide sequence of VGAM383 RNA, herein designated VGAM RNA, also designated SEQ ID:3094.

Another function of VGAM383 is therefore inhibition of FLJ14146 (Accession NM_024709). Accordingly, utilities of VGAM383 include diagnosis, prevention and treatment of diseases and clinical conditions associated with FLJ14146. KIAA0534 (Accession XM_049349) is another VGAM383 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35380, to the nucleotide sequence of VGAM383 RNA, herein designated VGAM RNA, also designated SEQ ID:3094.

Another function of VGAM383 is therefore inhibition of KIAA0534 (Accession XM_049349). Accordingly, utilities of VGAM383 include diagnosis, prevention and treatment of diseases and clinical conditions associated with KIAA0534. KIAA1918 (Accession XM_054951) is another VGAM383 host target gene. KIAA1918 BINDING SITE is HOST TARGET binding site found in the 3' untranslated region of mRNA encoded by KIAA1918, corresponding to a HOST TARGET binding site such as BINDING SITE I, BINDING SITE II or BINDING SITE III. Table 2 illustrates the complementarity of the nucleotide sequences of KIAA1918 BINDING SITE, designated SEQ ID:36213, to the nucleotide sequence of VGAM383 RNA, herein designated VGAM RNA, also designated SEQ ID:3094.

Another function of VGAM383 is therefore inhibition of KIAA1918 (Accession XM_054951). Accordingly, utilities of VGAM383 include diagnosis, prevention and treatment of diseases and clinical conditions associated with KIAA1918. Myosin 5C (MYO5C, Accession NM_018728) is another VGAM383 host target gene. MYO5C BINDING SITE is HOST TARGET binding site found in the 3' untranslated region of mRNA encoded by MYO5C, corresponding to a HOST TARGET binding site such as BINDING SITE I, BINDING SITE II or BINDING SITE III. Table 2 illustrates the complementarity of the nucleotide sequences of MYO5C BINDING SITE, designated SEQ ID:20818, to the nucleotide sequence of VGAM383 RNA, herein designated VGAM RNA, also designated SEQ ID:3094.

Another function of VGAM383 is therefore inhibition of Myosin 5C (MYO5C, Accession NM_018728). Accordingly, utilities of VGAM383 include diagnosis, prevention and treatment of diseases and clinical conditions associated with MYO5C. Sema Domain, Immunoglobulin Domain (Ig), Transmembrane Domain (TM) and Short Cytoplasmic Domain, (semaphorin) 4G (SEMA4G, Accession XM_170638) is another VGAM383 host target gene. SEMA4G BINDING SITE is HOST TARGET binding site found in the 5' untranslated region of mRNA encoded by SEMA4G, corresponding to a HOST TARGET binding site such as BINDING SITE I, BINDING SITE II or BINDING SITE III. Table 2 illustrates the complementarity of the nucleotide sequences of SEMA4G BINDING SITE, designated SEQ ID:45409, to the nucleotide sequence of VGAM383 RNA, herein designated VGAM RNA, also designated SEQ ID:3094.

Another function of VGAM383 is therefore inhibition of Sema Domain, Immunoglobulin Domain (Ig), Transmembrane Domain (TM) and Short Cytoplasmic Domain, (semaphorin) 4G (SEMA4G, Accession XM_170638). Accordingly, utilities of VGAM383 include diagnosis, prevention and treatment of diseases and clinical conditions associated with SEMA4G. LOC152580 (Accession XM_098240) is another VGAM383 host target gene. LOC152580 BINDING SITE is HOST TARGET binding site found in the 5' untranslated region of mRNA encoded by LOC152580, corresponding to a HOST TARGET binding site such as BINDING SITE I, BINDING SITE II or BINDING SITE III. Table 2 illustrates the complementarity of the nucleotide sequences of LOC152580 BINDING SITE, designated SEQ ID:41522, to the nucleotide sequence of VGAM383 RNA, herein designated VGAM RNA, also designated SEQ ID:3094.

Another function of VGAM383 is therefore inhibition of LOC152580 (Accession XM_098240). Accordingly, utilities of VGAM383 include diagnosis, prevention and treatment of diseases and clinical conditions associated with LOC152580. LOC91660 (Accession XM_039902) is another VGAM383 host target gene. LOC91660 BINDING SITE1 and LOC91660 BINDING SITE2 are HOST TARGET binding sites found in untranslated regions of mRNA encoded by LOC91660, corresponding to HOST TARGET binding sites such as BINDING SITE I, BINDING SITE II or BINDING SITE III. Table 2 illustrates the complementarity of the nucleotide sequences of LOC91660 BINDING SITE1 and LOC91660 BINDING SITE2, designated SEQ ID:33207 and SEQ ID:33210 respectively, to the nucleotide sequence of VGAM383 RNA, herein designated VGAM RNA, also designated SEQ ID:3094.

Another function of VGAM383 is therefore inhibition of LOC91660 (Accession XM_039902). Accordingly, utilities of VGAM383 include diagnosis, prevention and treatment of diseases and clinical conditions associated with LOC91660. G Protein-coupled Receptor Kinase-interactor 2 (GIT2, Accession NM_014776) is another VGAM384 host target gene. GIT2 BINDING SITE1 through GIT2 BINDING SITE3 are HOST TARGET binding sites found in untranslated regions of mRNA encoded by GIT2, corresponding to HOST TARGET binding sites such as BINDING SITE I, BINDING SITE II or BINDING SITE III. Table 2 illustrates the complementarity of the nucleotide sequences of GIT2 BINDING SITE1 through GIT2 BINDING SITE3, designated SEQ ID:16601, SEQ ID:27683 and SEQ ID:27696 respectively, to the nucleotide sequence of VGAM384 RNA, herein designated VGAM RNA, also designated SEQ ID:3095.

Another function of VGAM384 is therefore inhibition of G Protein-coupled Receptor Kinase-interactor 2 (GIT2, Accession NM_014776). Accordingly, utilities of VGAM384 include diagnosis, prevention and treatment of diseases and clinical conditions associated with GIT2. LOC154282 (Accession XM_098505) is another VGAM384 host target gene. LOC154282 BINDING SITE is HOST TARGET binding site found in the 3' untranslated region of mRNA encoded by LOC154282, corresponding to a HOST TARGET binding site such as BINDING SITE I, BINDING SITE II or BINDING SITE III. Table 2 illustrates the complementarity of the nucleotide sequences of LOC154282 BINDING SITE, designated SEQ ID:41697, to the nucleotide sequence of VGAM384 RNA, herein designated VGAM RNA, also designated SEQ ID:3095.

Another function of VGAM384 is therefore inhibition of LOC154282 (Accession XM_098505). Accordingly, utilities of VGAM384 include diagnosis, prevention and treatment of diseases and clinical conditions associated with LOC154282. FIG. 1 further provides a conceptual description of a novel bioinformatically detected viral gene of the present invention, referred to here as Viral Genomic Address Messenger 385 (VGAM385) viral gene, which modulates expression of respective host target genes thereof, the function and utility of which host target genes is known in the art.

VGAM385 is a novel bioinformatically detected regulatory, non protein coding, viral micro RNA (miRNA) gene. The method by which VGAM385 was detected is described hereinabove with reference to FIGS. 1-8.

VGAM385 gene, herein designated VGAM GENE, is a viral gene contained in the genome of Hepatitis A Virus. VGAM385 host target gene, herein designated VGAM HOST TARGET GENE, is a human gene contained in the human genome.

VGAM385 gene encodes a VGAM385 precursor RNA, herein designated VGAM PRECURSOR RNA. Similar to other miRNA genes, and unlike most ordinary genes, VGAM385 precursor RNA does not encode a protein. A nucleotide sequence identical or highly similar to the nucleotide sequence of VGAM385 precursor RNA is designated SEQ ID:371, and is provided hereinbelow with reference to the sequence listing part. Nucleotide sequence SEQ ID:371 is located at position 3807 relative to the genome of Hepatitis A Virus.

VGAM385 precursor RNA folds onto itself, forming VGAM385 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM385 folded precursor RNA into VGAM385 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM385 RNA is designated SEQ ID:3096, and is provided hereinbelow with reference to the sequence listing part.

VGAM385 host target gene, herein designated VGAM HOST TARGET GENE, encodes a corresponding messenger RNA, VGAM385 host target RNA, herein designated VGAM HOST TARGET RNA. VGAM385 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM385 RNA, herein designated VGAM RNA, binds complementarily to one or more host target binding sites located in untranslated regions of VGAM385 host target RNA, herein designated VGAM HOST TARGET RNA. This complementary binding is due to the fact that the nucleotide sequence of VGAM385 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM385 RNA, herein designated VGAM RNA, may have a different number of host target binding sites in untranslated regions of a VGAM385 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM385 RNA, herein designated VGAM RNA, to host target binding sites on VGAM385 host target RNA, herein designated VGAM HOST TARGET RNA, such as BINDING SITE I, BINDING SITE II and BINDING SITE III, inhibits translation of VGAM385 host target RNA into VGAM385 host target protein, herein designated VGAM HOST TARGET PROTEIN. VGAM host target protein is therefore outlined by a broken line.

It is appreciated that VGAM385 host target gene, herein designated VGAM HOST TARGET GENE, in fact represents a plurality of VGAM385 host target genes. The mRNA of each one of this plurality of VGAM385 host target genes comprises one or more host target binding sites, each having a nucleotide sequence which is at least partly complementary to VGAM385 RNA, herein designated VGAM RNA, and which when bound by VGAM385 RNA causes inhibition of translation of respective one or more VGAM385 host target proteins.

It is further appreciated by one skilled in the art that the mode of translational inhibition illustrated by FIG. 1 with specific reference to translational inhibition exerted by VGAM385 gene, herein designated VGAM GENE, on one or more VGAM385 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM385 is inhibition of expression of host target genes, as part of a novel viral mechanism of attacking a host. Accordingly, utilities of VGAM385 include diagnosis, prevention and treatment of viral infection by Hepatitis A Virus. Specific functions, and accordingly utilities, of VGAM385 correlate with, and may be deduced from, the identity of the host target genes which VGAM385 binds and inhibits, and the function of these host target genes, as elaborated hereinbelow.

Nucleotide sequences of the VGAM385 precursor RNA, herein designated VGAM PRECURSOR RNA, and of the 'diced' VGAM385 RNA, herein designated VGAM RNA, and a schematic representation of the secondary folding of VGAM385 folded precursor RNA, herein designated VGAM FOLDED PRECURSOR RNA, of VGAM385 are further described hereinbelow with reference to Table 1.

Nucleotide sequences of host target binding sites, such as BINDING SITE-I, BINDING SITE-II and BINDING SITE-III of FIG. 1, found on VGAM385 host target RNA, and schematic representation of the complementarity of each of these host target binding sites to VGAM385 RNA, herein designated VGAM RNA, are described hereinbelow with reference to Table 2.

As mentioned hereinabove with reference to FIG. 1, a function of VGAM385 gene, herein designated VGAM is inhibition of expression of VGAM385 target genes. It is appreciated that specific functions, and accordingly utilities, of VGAM385 correlate with, and may be deduced from, the identity of the target genes which VGAM385 binds and inhibits, and the function of these target genes, as elaborated hereinbelow.

Lipase A, Lysosomal Acid, Cholesterol Esterase (Wolman disease) (LIPA, Accession NM_000235) is a VGAM385 host target gene. LIPA BINDING SITE is HOST TARGET binding site found in the 3' untranslated region of mRNA encoded by LIPA, corresponding to a HOST TARGET binding site such as BINDING SITE I, BINDING SITE II or BINDING SITE III. Table 2 illustrates the complementarity of the nucleotide sequences of LIPA BINDING SITE, designated SEQ ID:5745, to the nucleotide sequence of VGAM385 RNA, herein designated VGAM RNA, also designated SEQ ID:3096.

A function of VGAM385 is therefore inhibition of Lipase A, Lysosomal Acid, Cholesterol Esterase (Wolman disease) (LIPA, Accession NM_000235). Accordingly, utilities of VGAM385 include diagnosis, prevention and treatment of diseases and clinical conditions associated with LIPA. DKFZP434E2135 (Accession NM_030804) is another VGAM385 host target gene. DKFZP434E2135 BINDING SITE is HOST TARGET binding site found in the 3' untranslated region of mRNA encoded by DKFZP434E2135, corresponding to a HOST TARGET binding site such as BINDING SITE I, BINDING SITE II or BINDING SITE III. Table 2 illustrates the complementarity of the nucleotide sequences of DKFZP434E2135 BINDING SITE, designated SEQ ID:25113, to the nucleotide sequence of VGAM385 RNA, herein designated VGAM RNA, also designated SEQ ID:3096.

Another function of VGAM385 is therefore inhibition of DKFZP434E2135 (Accession NM_030804). Accordingly, utilities of VGAM385 include diagnosis, prevention and treatment of diseases and clinical conditions associated with DKFZP434E2135. FLJ10232 (Accession NM_018033) is another VGAM385 host target gene. FLJ10232 BINDING SITE is HOST TARGET binding site found in the 3' untranslated region of mRNA encoded by FLJ10232, corresponding to a HOST TARGET binding site such as BINDING SITE I, BINDING SITE II or BINDING SITE III. Table 2 illustrates the complementarity of the nucleotide sequences of FLJ10232 BINDING SITE, designated SEQ ID:19773, to the nucleotide sequence of VGAM385 RNA, herein designated VGAM RNA, also designated SEQ ID:3096.

Another function of VGAM385 is therefore inhibition of FLJ10232 (Accession NM_018033). Accordingly, utilities of VGAM385 include diagnosis, prevention and treatment of diseases and clinical conditions associated with FLJ10232. FLJ10687 (Accession NM_018178) is another VGAM385 host target gene. FLJ10687 BINDING SITE is HOST TARGET binding site found in the 3' untranslated region of mRNA encoded by FLJ10687, corresponding to a HOST TARGET binding site such as BINDING SITE I, BINDING SITE II or BINDING SITE III. Table 2 illustrates the complementarity of the nucleotide sequences of FLJ10687 BINDING SITE, designated SEQ ID:20007, to the nucleotide sequence of VGAM385 RNA, herein designated VGAM RNA, also designated SEQ ID:3096.

Another function of VGAM385 is therefore inhibition of FLJ10687 (Accession NM_018178). Accordingly, utilities of VGAM385 include diagnosis, prevention and treatment of diseases and clinical conditions associated with FLJ10687. FLJ10813 (Accession NM_018229) is another VGAM385 host target gene. FLJ10813 BINDING SITE is HOST TARGET binding site found in the 3' untranslated region of mRNA encoded by FLJ10813, corresponding to a HOST TARGET binding site such as BINDING SITE I, BINDING SITE II or BINDING SITE III. Table 2 illustrates the complementarity of the nucleotide sequences of FLJ10813 BINDING SITE, designated SEQ ID:20167, to the nucleotide sequence of VGAM385 RNA, herein designated VGAM RNA, also designated SEQ ID:3096.

Another function of VGAM385 is therefore inhibition of FLJ10813 (Accession NM_018229). Accordingly, utilities of VGAM385 include diagnosis, prevention and treatment of diseases and clinical conditions associated with FLJ10813. FLJ13912 (Accession NM_022770) is another VGAM385 host target gene. FLJ13912 BINDING SITE is HOST TARGET binding site found in the 3' untranslated region of mRNA encoded by FLJ13912, corresponding to a HOST TARGET binding site such as BINDING SITE I, BINDING SITE II or BINDING SITE III. Table 2 illustrates the complementarity of the nucleotide sequences of FLJ13912 BINDING SITE, designated SEQ ID:23027, to the nucleotide sequence of VGAM385 RNA, herein designated VGAM RNA, also designated SEQ ID:3096.

Another function of VGAM385 is therefore inhibition of FLJ13912 (Accession NM_022770). Accordingly, utilities of VGAM385 include diagnosis, prevention and treatment of diseases and clinical conditions associated with FLJ13912. FLJ20519 (Accession NM_017860) is another VGAM385 host target gene. FLJ20519 BINDING SITE is HOST TARGET binding site found in the 3' untranslated region of mRNA encoded by FLJ20519, corresponding to a HOST TARGET binding site such as BINDING SITE I, BINDING SITE II or BINDING SITE III. Table 2 illustrates the complementarity of the nucleotide sequences of FLJ20519 BINDING SITE, designated SEQ ID:19537, to the nucleotide sequence of VGAM385 RNA, herein designated VGAM RNA, also designated SEQ ID:3096.

Another function of VGAM385 is therefore inhibition of FLJ20519 (Accession NM_017860). Accordingly, utilities of VGAM385 include diagnosis, prevention and treatment of diseases and clinical conditions associated with FLJ20519. KIAA0217 (Accession XM_040265) is another VGAM385 host target gene. KIAA0217 BINDING SITE is HOST TARGET binding site found in the 3' untranslated region of mRNA encoded by KIAA0217, corresponding to a HOST TARGET binding site such as BINDING SITE I, BINDING SITE II or BINDING SITE III. Table 2 illustrates the complementarity of the nucleotide sequences of KIAA0217 BINDING SITE, designated SEQ ID:33276, to the nucleotide sequence of VGAM385 RNA, herein designated VGAM RNA, also designated SEQ ID:3096.

Another function of VGAM385 is therefore inhibition of KIAA0217 (Accession XM_040265). Accordingly, utilities of VGAM385 include diagnosis, prevention and treatment of diseases and clinical conditions associated with KIAA0217. KIAA0417 (Accession XM_048898) is another VGAM385 host target gene. KIAA0417 BINDING SITE is HOST TARGET binding site found in the 3' untranslated region of mRNA encoded by KIAA0417, corresponding to a HOST TARGET binding site such as BINDING SITE I, BINDING SITE II or BINDING SITE III. Table 2 illustrates the complementarity of the nucleotide sequences of KIAA0417 BINDING SITE, designated SEQ ID:35287, to the nucleotide sequence of VGAM385 RNA, herein designated VGAM RNA, also designated SEQ ID:3096.

Another function of VGAM385 is therefore inhibition of KIAA0417 (Accession XM_048898). Accordingly, utilities of VGAM385 include diagnosis, prevention and treatment of diseases and clinical conditions associated with KIAA0417. KIAA0451 (Accession NM_014826) is another VGAM385 host target gene. KIAA0451 BINDING SITE is HOST TARGET binding site found in the 5' untranslated region of mRNA encoded by KIAA0451, corresponding to a HOST TARGET binding site such as BINDING SITE I, BINDING SITE II or BINDING SITE III. Table 2 illustrates the complementarity of the nucleotide sequences of KIAA0451 BINDING SITE, designated SEQ ID:16806, to the nucleotide sequence of VGAM385 RNA, herein designated VGAM RNA, also designated SEQ ID:3096.

Another function of VGAM385 is therefore inhibition of KIAA0451 (Accession NM_014826). Accordingly, utilities of VGAM385 include diagnosis, prevention and treatment of diseases and clinical conditions associated with KIAA0451. KIAA1500 (Accession XM_034353) is another VGAM385 host target gene. KIAA1500 BINDING SITE is HOST TARGET binding site found in the 3' untranslated region of mRNA encoded by KIAA1500, corresponding to a HOST TARGET binding site such as BINDING SITE I, BINDING SITE II or BINDING SITE III. Table 2 illustrates the complementarity of the nucleotide sequences of KIAA1500 BINDING SITE, designated SEQ ID:32066, to the nucleotide sequence of VGAM385 RNA, herein designated VGAM RNA, also designated SEQ ID:3096.

Another function of VGAM385 is therefore inhibition of KIAA1500 (Accession XM_034353). Accordingly, utilities of VGAM385 include diagnosis, prevention and treatment of diseases and clinical conditions associated with KIAA1500. Oculomedin (OCLM, Accession NM_022375) is another VGAM385 host target gene. OCLM BINDING SITE is HOST TARGET binding site found in the 5' untranslated region of mRNA encoded by OCLM, corresponding to a HOST TARGET binding site such as BINDING SITE I, BINDING SITE II or BINDING SITE III. Table 2 illustrates the complementarity of the nucleotide sequences of OCLM BINDING SITE, designated SEQ ID:22762, to the nucleotide sequence of VGAM385 RNA, herein designated VGAM RNA, also designated SEQ ID:3096.

Another function of VGAM385 is therefore inhibition of Oculomedin (OCLM, Accession NM_022375). Accordingly, utilities of VGAM385 include diagnosis, prevention and treatment of diseases and clinical conditions associated with OCLM. LOC151475 (Accession XM_098063) is another VGAM385 host target gene. LOC151475 BINDING SITE is HOST TARGET binding site found in the 5' untranslated region of mRNA encoded by LOC151475, corresponding to a HOST TARGET binding site such as BINDING SITE I, BINDING SITE II or BINDING SITE III. Table 2 illustrates the complementarity of the nucleotide sequences of LOC151475 BINDING SITE, designated SEQ ID:41357, to the nucleotide sequence of VGAM385 RNA, herein designated VGAM RNA, also designated SEQ ID:3096.

Another function of VGAM385 is therefore inhibition of LOC151475 (Accession XM_098063). Accordingly, utilities of VGAM385 include diagnosis, prevention and treatment of diseases and clinical conditions associated with LOC151475. FIG. 1 further provides a conceptual description of a novel bioinformatically detected viral gene of the present invention, referred to here as Viral Genomic Address Messenger 386 (VGAM386) viral gene, which modulates expression of respective host target genes thereof, the function and utility of which host target genes is known in the art.

VGAM386 is a novel bioinformatically detected regulatory, non protein coding, viral micro RNA (miRNA) gene. The method by which VGAM386 was detected is described hereinabove with reference to FIGS. 1-8.

VGAM386 gene, herein designated VGAM GENE, is a viral gene contained in the genome of Hepatitis A Virus. VGAM386 host target gene, herein designated VGAM HOST TARGET GENE, is a human gene contained in the human genome.

VGAM386 gene encodes a VGAM386 precursor RNA, herein designated VGAM PRECURSOR RNA. Similar to other miRNA genes, and unlike most ordinary genes, VGAM386 precursor RNA does not encode a protein. A nucleotide sequence identical or highly similar to the nucleotide sequence of VGAM386 precursor RNA is designated SEQ ID:372, and is provided hereinbelow with reference to the sequence listing part. Nucleotide sequence SEQ ID:372 is located at position 1168 relative to the genome of Hepatitis A Virus.

VGAM386 precursor RNA folds onto itself, forming VGAM386 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM386 folded precursor RNA into VGAM386 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM386 RNA is designated SEQ ID:3097, and is provided hereinbelow with reference to the sequence listing part.

VGAM386 host target gene, herein designated VGAM HOST TARGET GENE, encodes a corresponding messenger RNA, VGAM386 host target RNA, herein designated VGAM HOST TARGET RNA. VGAM386 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM386 RNA, herein designated VGAM RNA, binds complementarily to one or more host target binding sites located in untranslated regions of VGAM386 host target RNA, herein designated VGAM HOST TARGET RNA. This complementary binding is due to the fact that the nucleotide sequence of VGAM386 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM386 RNA, herein designated VGAM RNA, may have a different number of host target binding sites in untranslated regions of a VGAM386 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM386 RNA, herein designated VGAM RNA, to host target binding sites on VGAM386 host target RNA, herein designated VGAM HOST TARGET RNA, such as BINDING SITE I, BINDING SITE II and BINDING SITE III, inhibits translation of VGAM386 host target RNA into VGAM386 host target protein, herein designated VGAM HOST TARGET PROTEIN. VGAM host target protein is therefore outlined by a broken line.

It is appreciated that VGAM386 host target gene, herein designated VGAM HOST TARGET GENE, in fact represents a plurality of VGAM386 host target genes. The mRNA of each one of this plurality of VGAM386 host target genes comprises one or more host target binding sites, each having a nucleotide sequence which is at least partly complementary to VGAM386 RNA, herein designated VGAM RNA, and which when bound by VGAM386 RNA causes inhibition of translation of respective one or more VGAM386 host target proteins.

It is further appreciated by one skilled in the art that the mode of translational inhibition illustrated by FIG. 1 with specific reference to translational inhibition exerted by VGAM386 gene, herein designated VGAM GENE, on one or more VGAM386 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM386 is inhibition of expression of host target genes, as part of a novel viral mechanism of attacking a host. Accordingly, utilities of VGAM386 include diagnosis, prevention and treatment of viral infection by Hepatitis A Virus. Specific functions, and accordingly utilities, of VGAM386 correlate with, and may be deduced from, the identity of the host target genes which VGAM386 binds and inhibits, and the function of these host target genes, as elaborated hereinbelow.

Nucleotide sequences of the VGAM386 precursor RNA, herein designated VGAM PRECURSOR RNA, and of the 'diced' VGAM386 RNA, herein designated VGAM RNA, and a schematic representation of the secondary folding of VGAM386 folded precursor RNA, herein designated VGAM FOLDED PRECURSOR RNA, of VGAM386 are further described hereinbelow with reference to Table 1.

Nucleotide sequences of host target binding sites, such as BINDING SITE-I, BINDING SITE-II and BINDING SITE-III of FIG. 1, found on VGAM386 host target RNA, and schematic representation of the complementarity of each of these host target binding sites to VGAM386 RNA, herein designated VGAM RNA, are described hereinbelow with reference to Table 2.

As mentioned hereinabove with reference to FIG. 1, a function of VGAM386 gene, herein designated VGAM is inhibition of expression of VGAM386 target genes. It is appreciated that specific functions, and accordingly utilities, of VGAM386 correlate with, and may be deduced from, the identity of the target genes which VGAM386 binds and inhibits, and the function of these target genes, as elaborated hereinbelow.

Estrogen-related Receptor Beta Like 1 (ESRRBL1, Accession NM_018010) is a VGAM386 host target gene. ESRRBL1 BINDING SITE is HOST TARGET binding site found in the 3' untranslated region of mRNA encoded by ESRRBL1, corresponding to a HOST TARGET binding site such as BINDING SITE I, BINDING SITE II or BINDING SITE III. Table 2 illustrates the complementarity of the nucleotide sequences of ESRRBL1 BINDING SITE, designated SEQ ID:19739, to the nucleotide sequence of VGAM386 RNA, herein designated VGAM RNA, also designated SEQ ID:3097.

A function of VGAM386 is therefore inhibition of Estrogen-related Receptor Beta Like 1 (ESRRBL1, Accession NM_018010). Accordingly, utilities of VGAM386 include diagnosis, prevention and treatment of diseases and clinical conditions associated with ESRRBL1. Growth Differentiation Factor 8 (GDF8, Accession NM_005259) is another VGAM386 host target gene. GDF8 BINDING SITE is HOST TARGET binding site found in the 3' untranslated region of mRNA encoded by GDF8, corresponding to a HOST TARGET binding site such as BINDING SITE I, BINDING SITE II or BINDING SITE III. Table 2 illustrates the complementarity of the nucleotide sequences of GDF8 BINDING SITE, designated SEQ ID:11766, to the nucleotide sequence of VGAM386 RNA, herein designated VGAM RNA, also designated SEQ ID:3097.

Another function of VGAM386 is therefore inhibition of Growth Differentiation Factor 8 (GDF8, Accession NM_005259), a gene which acts specifically as a negative regulator of skeletal muscle growth. Accordingly, utilities of VGAM386 include diagnosis, prevention and treatment of diseases and clinical conditions associated with GDF8. The function of GDF8 has been established by previous studies. The transforming growth factor-beta superfamily encompasses a large number of growth and differentiation factors that play important roles in regulating embryonic development and in maintaining tissue homeostasis in adult animals. GDF8, or myostatin, is a member of this superfamily with a role in the control and maintenance of skeletal muscle mass. Animal model experiments lend further support to the function of GDF8. To determine the biologic function of Gdf8, McPherron et al. (1997) disrupted the Gdf8 gene by gene targeting in mice. Gdf8-null animals were significantly larger than wildtype animals and showed a large and widespread increase in skeletal muscle mass. Individual muscles of mutant animals weighed 2 to 3 times more than those of wildtype animals, and the increase in mass appeared to result from a combination of muscle cell hyperplasia and hypertrophy. McPherron et al. (1997) suggested that Gdf8 functions specifically as a negative regulator of skeletal muscle growth. Lin et al. (2002) observed increased skeletal muscle mass in their myostatin-null mouse model compared to wildtype animals as early as 4 weeks of age. In addition, the mutant mice showed reduced production and secretion of leptin (OMIM Ref. No. 164160) which was associated with reduced fat deposition. The reduced adipogenesis in the knockout mice suggested that myostatin is involved in regulating adiposity as well as muscularity.

It is appreciated that the abovementioned animal model for GDF8 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gonzalez-Cadavid, N. F.; Taylor, W. E.; Yarasheski, K.; Sinha-Hikim, I.; Ma, K.; Ezzat, S.; Shen, R.; Lalani, R.; Asa, S.; Mamita, M.; Nair, G.; Arver, S.; Bhasin, S.: Organization of the human myostatin gene and expression in healthy men and HIV-infected men with muscle wasting. Proc. Nat. Acad. Sci. 95:14938-14943, 1998; and Lin, J.; Arnold, H. B.; Della-Fera, M. A.; Azain, M. J.; Hartzell, D. L.; Baile, C. A.: Myostatin knockout in mice increases myogenesis and decreases adipogenesis. Biochem. Biophys. Res.

Further studies establishing the function and utilities of GDF8 are found in John Hopkins OMIM database record ID 601788, and in sited publications numbered 1280-1283, 8868-8869, 421 and 9109-5789 listed in the bibliography section hereinbelow, which are also hereby incorporated by reference. Heparan Sulfate (glucosamine) 3-O-sulfotransferase 4 (HS3ST4, Accession XM_056254) is another VGAM386 host target gene. HS3ST4 BINDING SITE is HOST TARGET binding site found in the 3' untranslated region of mRNA encoded by HS3ST4, corresponding to a HOST TARGET binding site such as BINDING SITE I, BINDING SITE II or BINDING SITE III. Table 2 illustrates the complementarity of the nucleotide sequences of HS3ST4 BINDING SITE, designated SEQ ID:36369, to the nucleotide sequence of VGAM386 RNA, herein designated VGAM RNA, also designated SEQ ID:3097.

Another function of VGAM386 is therefore inhibition of Heparan Sulfate (glucosamine) 3-O-sulfotransferase 4 (HS3ST4, Accession XM_056254). Accordingly, utilities of VGAM386 include diagnosis, prevention and treatment of diseases and clinical conditions associated with HS3ST4. MADS Box Transcription Enhancer Factor 2, Polypeptide C (myocyte enhancer factor 2C) (MEF2C, Accession NM_002397) is another VGAM386 host target gene. MEF2C BINDING SITE is HOST TARGET binding site found in the 3' untranslated region of mRNA encoded by MEF2C, corresponding to a HOST TARGET binding site such as BINDING SITE I, BINDING SITE II or BINDING SITE III. Table 2 illustrates the complementarity of the nucleotide sequences of MEF2C BINDING SITE, designated SEQ ID:8211, to the nucleotide sequence of VGAM386 RNA, herein designated VGAM RNA, also designated SEQ ID:3097.

Another function of VGAM386 is therefore inhibition of MADS Box Transcription Enhancer Factor 2, Polypeptide C (myocyte enhancer factor 2C) (MEF2C, Accession NM_002397), a gene which regulates muscle-specific and mitogen-inducible genes. Accordingly, utilities of VGAM386 include diagnosis, prevention and treatment of diseases and clinical conditions associated with MEF2C. The function of MEF2C has been established by previous studies. The MEF2 family of regulatory proteins are, like the myogenic basic helix-loop-helix proteins (e.g., 159970), involved in myogenesis; see MEF2A (OMIM Ref. No. 600660). McDermott et al. (1993) cloned a member of the MEF2 family of proteins from a human skeletal muscle cDNA library using a fragment of the MEF2A cDNA as a probe. Transcripts of MEF2C were found in the skeletal muscle and brain. Alternative splice variants were found, 1 of which was unique to the brain. Leifer et al. (1993) found that the brain form was expressed by neurons in particular layers of the cerebral cortex and that expression declined during postnatal development. The skeletal isoform of the cDNA encodes a 465-amino acid protein with conserved MADS and MEF2 domains. Like the other MEF2 gene products, MEF2C has both DNA binding and trans-activating activities indistinguishable from other members of the family. MEF2C, however, is induced late during myogenic differentiation and has a strict tissue-specific pattern of expression not seen in MEF2A or MEF2B. Breitbart et al. (1993) suggested that, while MEF2A may be involved in induction of muscle differentiation, MEF2C may be involved with maintenance of the differentiated state. CREB-binding protein (CBP; 600140)/p300 (OMIM Ref. No. 602700) and p300/CBP-associated factor (PCAF; 602203) are coactivators for MEF2C during differentiation. Chen et al. (2000) showed that NCOA2 mediates the coactivation of MEF2C-dependent transcription through interaction with the MADS box domain of MEF2C. They proposed a model of cooperative interaction between NCOA2, myogenin (MYOG; 159980), and MEF2C in the regulation of muscle-specific gene expression. During mammalian development, electrical activity promotes the calcium-dependent survival of neurons that have made appropriate synaptic connections. Mao et al. (1999) showed that calcium influx into cerebellar neurons triggers the activation of the MKK6 (OMIM Ref. No. 601254)-p38 MAP kinase (OMIM Ref. No. 600289) cascade and that the p38 MAP kinase then phosphorylates and activates MEF2s. Once activated by this calcium-dependent p38 MAP kinase signaling pathway, MEF2 can regulate the expression of genes that are critical for survival of newly differentiated neurons. These findings demonstrated that MEF2 is a calcium-regulated transcription factor and defined a function for MEF2 during nervous system development that is distinct from previously well-characterized functions of MEF2 during muscle differentiation. Martin et al. (1994) mapped Mef2 to mouse chromosome 13. By fluorescence in situ hybridization, Krainc et al. (1995) mapped human MEF2C to 5q14, a region with homology of synteny to the mouse location. Members of the MEF2 family of MADs-box transcription factors bind to an A-T-rich DNA sequence associated with muscle-specific genes. The murine MEF2C gene is expressed in heart precursor cells before formation of the linear heart tube. In mice homozygous for a known mutation of MEF2C, Lin et al. (1997) found that the heart tube did not undergo looping morphogenesis, the future right ventricle did not form, and a subset of cardiac muscle genes was not expressed. The absence of the right ventricular region of the mutant correlated with down regulation of the dHAND gene, which encodes a basic helix-loop-helix transcription factor required for cardiac morphogenesis. The authors concluded that MEF2C is an essential regulator of cardiac morphogenesis and right ventricular development.

Full details of the abovementioned studies are described in the following publications, the disclosure of which are hereby incorporated by reference:

Breitbart, R. E.; Liang, C.; Smoot, L. B.; Laheru, D. A.; Mahdavi, V.; Nadal-Ginard, B.: A fourth human MEF2 transcription factor, hMEF2D, is an early marker of the myogenic lineage. Development 118:1095-1106, 1993; and Chen, S. L.; Dowhan, D. H.; Hosking, B. M.; Muscat, G. E. O.: The steroid receptor coactivator, GRIP-1, is necessary for MEF-2C-dependent gene expression and skeletal muscle differenti.

Further studies establishing the function and utilities of MEF2C are found in John Hopkins OMIM database record ID 600662, and in sited publications numbered 8293, 8303-8304, 7159, 8295-829 and 7243 listed in the bibliography section hereinbelow, which are also hereby incorporated by reference. SIP (Accession NM_014412) is another VGAM386 host target gene. SIP BINDING SITE is HOST TARGET binding site found in the 3' untranslated region of mRNA encoded by SIP, corresponding to a HOST TARGET binding site such as BINDING SITE I, BINDING SITE II or BINDING SITE III. Table 2 illustrates the complementarity of the nucleotide sequences of SIP BINDING SITE, designated SEQ ID:15757, to the nucleotide sequence of VGAM386 RNA, herein designated VGAM RNA, also designated SEQ ID:3097.

Another function of VGAM386 is therefore inhibition of SIP (Accession NM_014412). Accordingly, utilities of VGAM386 include diagnosis, prevention and treatment of diseases and clinical conditions associated with SIP. DKFZp434C0328 (Accession NM_017577) is another VGAM386 host target gene. DKFZp434C0328 BINDING SITE is HOST TARGET binding site found in the 3' untranslated region of mRNA encoded by DKFZp434C0328, corresponding to a HOST TARGET binding site such as BINDING SITE I, BINDING SITE II or BINDING SITE III. Table 2 illustrates the complementarity of the nucleotide sequences of DKFZp434C0328 BINDING SITE, designated SEQ ID:19013, to the nucleotide sequence of VGAM386 RNA, herein designated VGAM RNA, also designated SEQ ID:3097.

Another function of VGAM386 is therefore inhibition of DKFZp434C0328 (Accession NM_017577). Accordingly, utilities of VGAM386 include diagnosis, prevention and treatment of diseases and clinical conditions associated with DKFZp434C0328. FLJ10307 (Accession NM_018053) is another VGAM386 host target gene. FLJ10307 BINDING SITE is HOST TARGET binding site found in the 3' untranslated region of mRNA encoded by FLJ10307, corresponding to a HOST TARGET binding site such as BINDING SITE I, BINDING SITE II or BINDING SITE III. Table 2 illustrates the complementarity of the nucleotide sequences of FLJ10307 BINDING SITE, designated SEQ ID:19813, to the nucleotide sequence of VGAM386 RNA, herein designated VGAM RNA, also designated SEQ ID:3097.

Another function of VGAM386 is therefore inhibition of FLJ10307 (Accession NM_018053). Accordingly, utilities of VGAM386 include diagnosis, prevention and treatment of diseases and clinical conditions associated with FLJ10307. KIAA0237 (Accession NM_014747) is another VGAM386 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16437, to the nucleotide sequence of VGAM386 RNA, herein designated VGAM RNA, also designated SEQ ID:3097.

Another function of VGAM386 is therefore inhibition of KIAA0237 (Accession NM_014747). Accordingly, utilities of VGAM386 include diagnosis, prevention and treatment of diseases and clinical conditions associated with KIAA0237. KIAA1466 (Accession XM_050285) is another VGAM386 host target gene. KIAA1466 BINDING SITE is HOST TARGET binding site found in the 3' untranslated region of mRNA encoded by KIAA1466, corresponding to a HOST TARGET binding site such as BINDING SITE I, BINDING SITE II or BINDING SITE III. Table 2 illustrates the complementarity of the nucleotide sequences of KIAA1466 BINDING SITE, designated SEQ ID:35602, to the nucleotide sequence of VGAM386 RNA, herein designated VGAM RNA, also designated SEQ ID:3097.

Another function of VGAM386 is therefore inhibition of KIAA1466 (Accession XM_050285). Accordingly, utilities of VGAM386 include diagnosis, prevention and treatment of diseases and clinical conditions associated with KIAA1466.

Kv6.3 (Accession NM_133490) is another VGAM386 host target gene. Kv6.3 BINDING SITE is HOST TARGET binding site found in the 3' untranslated region of mRNA encoded by Kv6.3, corresponding to a HOST TARGET binding site such as BINDING SITE I, BINDING SITE II or BINDING SITE III. Table 2 illustrates the complementarity of the nucleotide sequences of Kv6.3 BINDING SITE, designated SEQ ID:28563, to the nucleotide sequence of VGAM386 RNA, herein designated VGAM RNA, also designated SEQ ID:3097.

Another function of VGAM386 is therefore inhibition of Kv6.3 (Accession NM_133490). Accordingly, utilities of VGAM386 include diagnosis, prevention and treatment of diseases and clinical conditions associated with Kv6.3. LOC145566 (Accession XM_085174) is another VGAM386 host target gene. LOC145566 BINDING SITE is HOST TARGET binding site found in the 5' untranslated region of mRNA encoded by LOC145566, corresponding to a HOST TARGET binding site such as BINDING SITE I, BINDING SITE II or BINDING SITE III. Table 2 illustrates the complementarity of the nucleotide sequences of LOC145566 BINDING SITE, designated SEQ ID:37898, to the nucleotide sequence of VGAM386 RNA, herein designated VGAM RNA, also designated SEQ ID:3097.

Another function of VGAM386 is therefore inhibition of LOC145566 (Accession XM_085174). Accordingly, utilities of VGAM386 include diagnosis, prevention and treatment of diseases and clinical conditions associated with LOC145566. LOC220766 (Accession XM_165471) is another VGAM386 host target gene. LOC220766 BINDING SITE is HOST TARGET binding site found in the 5' untranslated region of mRNA encoded by LOC220766, corresponding to a HOST TARGET binding site such as BINDING SITE I, BINDING SITE II or BINDING SITE III. Table 2 illustrates the complementarity of the nucleotide sequences of LOC220766 BINDING SITE, designated SEQ ID:43653, to the nucleotide sequence of VGAM386 RNA, herein designated VGAM RNA, also designated SEQ ID:3097.

Another function of VGAM386 is therefore inhibition of LOC220766 (Accession XM_165471). Accordingly, utilities of VGAM386 include diagnosis, prevention and treatment of diseases and clinical conditions associated with LOC220766. LOC253959 (Accession XM_170749) is another VGAM386 host target gene. LOC253959 BINDING SITE is HOST TARGET binding site found in the 5' untranslated region of mRNA encoded by LOC253959, corresponding to a HOST TARGET binding site such as BINDING SITE I, BINDING SITE II or BINDING SITE III. Table 2 illustrates the complementarity of the nucleotide sequences of LOC253959 BINDING SITE, designated SEQ ID:45507, to the nucleotide sequence of VGAM386 RNA, herein designated VGAM RNA, also designated SEQ ID:3097.

Another function of VGAM386 is therefore inhibition of LOC253959 (Accession XM_170749). Accordingly, utilities of VGAM386 include diagnosis, prevention and treatment of diseases and clinical conditions associated with LOC253959. LOC257438 (Accession XM_168338) is another VGAM386 host target gene. LOC257438 BINDING SITE is HOST TARGET binding site found in the 3' untranslated region of mRNA encoded by LOC257438, corresponding to a HOST TARGET binding site such as BINDING SITE I, BINDING SITE II or BINDING SITE III. Table 2 illustrates the complementarity of the nucleotide sequences of LOC257438 BINDING SITE, designated SEQ ID:45107, to the nucleotide sequence of VGAM386 RNA, herein designated VGAM RNA, also designated SEQ ID:3097.

Another function of VGAM386 is therefore inhibition of LOC257438 (Accession XM_168338). Accordingly, utilities of VGAM386 include diagnosis, prevention and treatment of diseases and clinical conditions associated with LOC257438. LOC91012 (Accession XM_035503) is another VGAM386 host target gene. LOC91012 BINDING SITE is HOST TARGET binding site found in the 5' untranslated region of mRNA encoded by LOC91012, corresponding to a HOST TARGET binding site such as BINDING SITE I, BINDING SITE II or BINDING SITE III. Table 2 illustrates the complementarity of the nucleotide sequences of LOC91012 BINDING SITE, designated SEQ ID:32283, to the nucleotide sequence of VGAM386 RNA, herein designated VGAM RNA, also designated SEQ ID:3097.

Another function of VGAM386 is therefore inhibition of LOC91012 (Accession XM_035503). Accordingly, utilities of VGAM386 include diagnosis, prevention and treatment of diseases and clinical conditions associated with LOC91012. FIG. 1 further provides a conceptual description of a novel bioinformatically detected viral gene of the present invention, referred to here as Viral Genomic Address Messenger 387 (VGAM387) viral gene, which modulates expression of respective host target genes thereof, the function and utility of which host target genes is known in the art.

VGAM387 is a novel bioinformatically detected regulatory, non protein coding, viral micro RNA (miRNA) gene. The method by which VGAM387 was detected is described hereinabove with reference to FIGS. 1-8.

VGAM387 gene, herein designated VGAM GENE, is a viral gene contained in the genome of Equine Herpesvirus 1. VGAM387 host target gene, herein designated VGAM HOST TARGET GENE, is a human gene contained in the human genome.

VGAM387 gene encodes a VGAM387 precursor RNA, herein designated VGAM PRECURSOR RNA. Similar to other miRNA genes, and unlike most ordinary genes, VGAM387 precursor RNA does not encode a protein. A nucleotide sequence identical or highly similar to the nucleotide sequence of VGAM387 precursor RNA is designated SEQ ID:373, and is provided hereinbelow with reference to the sequence listing part. Nucleotide sequence SEQ ID:373 is located at position 97453 relative to the genome of Equine Herpesvirus 1.

VGAM387 precursor RNA folds onto itself, forming VGAM387 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM387 folded precursor RNA into VGAM387 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM387 RNA is designated SEQ ID:3098, and is provided hereinbelow with reference to the sequence listing part.

VGAM387 host target gene, herein designated VGAM HOST TARGET GENE, encodes a corresponding messenger RNA, VGAM387 host target RNA, herein designated VGAM HOST TARGET RNA. VGAM387 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM387 RNA, herein designated VGAM RNA, binds complementarily to one or more host target binding sites located in untranslated regions of VGAM387 host target RNA, herein designated VGAM HOST TARGET RNA. This complementary binding is due to the fact that the nucleotide sequence of VGAM387 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM387 RNA, herein designated VGAM RNA, may have a different number of host target binding sites in untranslated regions of a VGAM387 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM387 RNA, herein designated VGAM RNA, to host target binding sites on VGAM387 host target RNA, herein designated VGAM HOST TARGET RNA, such as BINDING SITE I, BINDING SITE II and BINDING SITE III, inhibits translation of VGAM387 host target RNA into VGAM387 host target protein, herein designated VGAM HOST TARGET PROTEIN. VGAM host target protein is therefore outlined by a broken line.

It is appreciated that VGAM387 host target gene, herein designated VGAM HOST TARGET GENE, in fact represents a plurality of VGAM387 host target genes. The mRNA of each one of this plurality of VGAM387 host target genes comprises one or more host target binding sites, each having a nucleotide sequence which is at least partly complementary to VGAM387 RNA, herein designated VGAM RNA, and which when bound by VGAM387 RNA causes inhibition of translation of respective one or more VGAM387 host target proteins.

It is further appreciated by one skilled in the art that the mode of translational inhibition illustrated by FIG. 1 with specific reference to translational inhibition exerted by VGAM387 gene, herein designated VGAM GENE, on one or more VGAM387 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM387 is inhibition of expression of host target genes, as part of a novel viral mechanism of attacking a host. Accordingly, utilities of VGAM387 include diagnosis, prevention and treatment of viral infection by Equine Herpesvirus 1. Specific functions, and accordingly utilities, of VGAM387 correlate with, and may be deduced from, the identity of the host target genes which VGAM387 binds and inhibits, and the function of these host target genes, as elaborated hereinbelow.

Nucleotide sequences of the VGAM387 precursor RNA, herein designated VGAM PRECURSOR RNA, and of the 'diced' VGAM387 RNA, herein designated VGAM RNA, and a schematic representation of the secondary folding of VGAM387 folded precursor RNA, herein designated VGAM FOLDED PRECURSOR RNA, of VGAM387 are further described hereinbelow with reference to Table 1.

Nucleotide sequences of host target binding sites, such as BINDING SITE-I, BINDING SITE-II and BINDING SITE-III of FIG. 1, found on VGAM387 host target RNA, and schematic representation of the complementarity of each of these host target binding sites to VGAM387 RNA, herein designated VGAM RNA, are described hereinbelow with reference to Table 2.

As mentioned hereinabove with reference to FIG. 1, a function of VGAM387 gene, herein designated VGAM is inhibition of expression of VGAM387 target genes. It is appreciated that specific functions, and accordingly utilities, of VGAM387 correlate with, and may be deduced from, the identity of the target genes which VGAM387 binds and inhibits, and the function of these target genes, as elaborated hereinbelow.

A Disintegrin and Metalloproteinase Domain 11 (ADAM11, Accession NM_002390) is a VGAM387 host target gene. ADAM11 BINDING SITE1 and ADAM11 BINDING SITE2 are HOST TARGET binding sites found in untranslated regions of mRNA encoded by ADAM11, corresponding to HOST TARGET binding sites such as BINDING SITE I, BINDING SITE II or BINDING SITE III. Table 2 illustrates the complementarity of the nucleotide sequences of ADAM11 BINDING SITE1 and ADAM11 BINDING SITE2, designated SEQ ID:8206 and SEQ ID:22239 respectively, to the nucleotide sequence of VGAM387 RNA, herein designated VGAM RNA, also designated SEQ ID:3098.

A function of VGAM387 is therefore inhibition of A Disintegrin and Metalloproteinase Domain 11 (ADAM11, Accession NM_002390), a gene which Member of the ADAM family of zinc metalloproteases. Accordingly, utilities of VGAM387 include diagnosis, prevention and treatment of diseases and clinical conditions associated with ADAM11. The function of ADAM11 has been established by previous studies. From chromosomal region 17q21.3, where a tumor suppressor gene for breast and ovarian cancers is thought to reside, Emi et al. (1993) isolated a novel gene from a cosmid clone that showed somatic rearrangements in 2 breast cancers. The gene encoded a 524-amino acid metalloproteinase-like, disintegrin-like, and cysteine-rich (MDC) protein with sequence similarity to members of the snake-venom metalloprotease/disintegrin family and guinea-pig sperm-surface protein PH-30 (OMIM Ref. No. 601533). These proteins have been implicated in cell-cell or cell-extracellular matrix interactions. Rearrangements in both tumors involved multiple exons and disrupted the coding region of the gene. Sagane et al. (1998) noted that MDC is a member of the cellular disintegrin, or ADAM (a disintegrin and metalloproteinase), family. See ADAM20 (OMIM Ref. No. 603712). They isolated cDNAs encoding 2 related human proteins, MDC2 (OMIM Ref. No. 603709) and MDC3 (OMIM Ref. No. 603710). Northern blot analysis revealed that, like the MDC2 and MDC3 mRNAs, the 5-kb MDC transcript was expressed predominantly in brain.

Full details of the abovementioned studies are described in the following publications, the disclosure of which are hereby incorporated by reference:

Emi, M.; Katagiri, T.; Harada, Y.; Saito, H.; Inazawa, J.; Ito, I.; Kasumi, F.; Nakamura, Y.: A novel metalloprotease/disintegrin-like gene at 17q21.3 is somatically rearranged in two primary breast cancers. Nature Genet. 5:151-157, 1993; and Sagane, K.; Ohya, Y.; Hasegawa, Y.; Tanaka, I.: Metalloproteinase-like, disintegrin-like, cysteine-rich proteins MDC2 and MDC3: novel human cellular disintegrins highly expressed in the.

Further studies establishing the function and utilities of ADAM11 are found in John Hopkins OMIM database record ID 155120, and in sited publications numbered 11102-1110 and 11444 listed in the bibliography section hereinbelow, which are also hereby incorporated by reference. FIG. 1 further provides a conceptual description of a novel bioinformatically detected viral gene of the present invention, referred to here as Viral Genomic Address Messenger 388 (VGAM388) viral gene, which modulates expression of respective host target genes thereof, the function and utility of which host target genes is known in the art.

VGAM388 is a novel bioinformatically detected regulatory, non protein coding, viral micro RNA (miRNA) gene. The method by which VGAM388 was detected is described hereinabove with reference to FIGS. 1-8.

VGAM388 gene, herein designated VGAM GENE, is a viral gene contained in the genome of Equine Herpesvirus 1. VGAM388 host target gene, herein designated VGAM HOST TARGET GENE, is a human gene contained in the human genome.

VGAM388 gene encodes a VGAM388 precursor RNA, herein designated VGAM PRECURSOR RNA. Similar to other miRNA genes, and unlike most ordinary genes, VGAM388 precursor RNA does not encode a protein. A nucleotide sequence identical or highly similar to the nucleotide sequence of VGAM388 precursor RNA is designated SEQ ID:374, and is provided hereinbelow with reference to the sequence listing part. Nucleotide sequence SEQ ID:374 is located at position 97176 relative to the genome of Equine Herpesvirus 1.

VGAM388 precursor RNA folds onto itself, forming VGAM388 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM388 folded precursor RNA into VGAM388 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 68%) nucleotide sequence of VGAM388 RNA is designated SEQ ID:3099, and is provided hereinbelow with reference to the sequence listing part.

VGAM388 host target gene, herein designated VGAM HOST TARGET GENE, encodes a corresponding messenger RNA, VGAM388 host target RNA, herein designated VGAM HOST TARGET RNA. VGAM388 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM388 RNA, herein designated VGAM RNA, binds complementarily to one or more host target binding sites located in untranslated regions of VGAM388 host target RNA, herein designated VGAM HOST TARGET RNA. This complementary binding is due to the fact that the nucleotide sequence of VGAM388 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM388 RNA, herein designated VGAM RNA, may have a different number of host target binding sites in untranslated regions of a VGAM388 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM388 RNA, herein designated VGAM RNA, to host target binding sites on VGAM388 host target RNA, herein designated VGAM HOST TARGET RNA, such as BINDING SITE I, BINDING SITE II and BINDING SITE III, inhibits translation of VGAM388 host target RNA into VGAM388 host target protein, herein designated VGAM HOST TARGET PROTEIN. VGAM host target protein is therefore outlined by a broken line.

It is appreciated that VGAM388 host target gene, herein designated VGAM HOST TARGET GENE, in fact represents a plurality of VGAM388 host target genes. The mRNA of each one of this plurality of VGAM388 host target genes comprises one or more host target binding sites, each having a nucleotide sequence which is at least partly complementary to VGAM388 RNA, herein designated VGAM RNA, and which when bound by VGAM388 RNA causes inhibition of translation of respective one or more VGAM388 host target proteins.

It is further appreciated by one skilled in the art that the mode of translational inhibition illustrated by FIG. 1 with specific reference to translational inhibition exerted by VGAM388 gene, herein designated VGAM GENE, on one or more VGAM388 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM388 is inhibition of expression of host target genes, as part of a novel viral mechanism of attacking a host. Accordingly, utilities of VGAM388 include diagnosis, prevention and treatment of viral infection by Equine Herpesvirus 1. Specific functions, and accordingly utilities, of VGAM388 correlate with, and may be deduced from, the identity of the host target genes which VGAM388 binds and inhibits, and the function of these host target genes, as elaborated hereinbelow.

Nucleotide sequences of the VGAM388 precursor RNA, herein designated VGAM PRECURSOR RNA, and of the 'diced' VGAM388 RNA, herein designated VGAM RNA, and a schematic representation of the secondary folding of VGAM388 folded precursor RNA, herein designated VGAM FOLDED PRECURSOR RNA, of VGAM388 are further described hereinbelow with reference to Table 1.

Nucleotide sequences of host target binding sites, such as BINDING SITE-I, BINDING SITE-II and BINDING SITE-III of FIG. 1, found on VGAM388 host target RNA, and schematic representation of the complementarity of each of these host target binding sites to VGAM388 RNA, herein designated VGAM RNA, are described hereinbelow with reference to Table 2.

As mentioned hereinabove with reference to FIG. 1, a function of VGAM388 gene, herein designated VGAM is inhibition of expression of VGAM388 target genes. It is appreciated that specific functions, and accordingly utilities, of VGAM388 correlate with, and may be deduced from, the identity of the target genes which VGAM388 binds and inhibits, and the function of these target genes, as elaborated hereinbelow.

Leucine-rich Repeat-containing 2 (LRRC2, Accession NM_024512) is a VGAM388 host target gene. LRRC2 BINDING SITE is HOST TARGET binding site found in the 5' untranslated region of mRNA encoded by LRRC2, corresponding to a HOST TARGET binding site such as BINDING SITE I, BINDING SITE II or BINDING SITE III. Table 2 illustrates the complementarity of the nucleotide sequences of LRRC2 BINDING SITE, designated SEQ ID:23704, to the nucleotide sequence of VGAM388 RNA, herein designated VGAM RNA, also designated SEQ ID:3099.

A function of VGAM388 is therefore inhibition of Leucine-rich Repeat-containing 2 (LRRC2, Accession NM_024512). Accordingly, utilities of VGAM388 include diagnosis, prevention and treatment of diseases and clinical conditions associated with LRRC2. FIG. 1 further provides a conceptual description of a novel bioinformatically detected viral gene of the present invention, referred to here as Viral Genomic Address Messenger 389 (VGAM389) viral gene, which modulates expression of respective host target genes thereof, the function and utility of which host target genes is known in the art.

VGAM389 is a novel bioinformatically detected regulatory, non protein coding, viral micro RNA (miRNA) gene. The method by which VGAM389 was detected is described hereinabove with reference to FIGS. 1-8.

VGAM389 gene, herein designated VGAM GENE, is a viral gene contained in the genome of Equine Herpesvirus 1. VGAM389 host target gene, herein designated VGAM HOST TARGET GENE, is a human gene contained in the human genome.

VGAM389 gene encodes a VGAM389 precursor RNA, herein designated VGAM PRECURSOR RNA. Similar to other miRNA genes, and unlike most ordinary genes, VGAM389 precursor RNA does not encode a protein. A nucleotide sequence identical or highly similar to the nucleotide sequence of VGAM389 precursor RNA is designated SEQ ID:375, and is provided hereinbelow with reference to the sequence listing part. Nucleotide sequence SEQ ID:375 is located at position 99186 relative to the genome of Equine Herpesvirus 1.

VGAM389 precursor RNA folds onto itself, forming VGAM389 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM389 folded precursor RNA into VGAM389 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM389 RNA is designated SEQ ID:3100, and is provided hereinbelow with reference to the sequence listing part.

VGAM389 host target gene, herein designated VGAM HOST TARGET GENE, encodes a corresponding messenger RNA, VGAM389 host target RNA, herein designated VGAM HOST TARGET RNA. VGAM389 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM389 RNA, herein designated VGAM RNA, binds complementarily to one or more host target binding sites located in untranslated regions of VGAM389 host target RNA, herein designated VGAM HOST TARGET RNA. This complementary binding is due to the fact that the nucleotide sequence of VGAM389 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM389 RNA, herein designated VGAM RNA, may have a different number of host target binding sites in untranslated regions of a VGAM389 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM389 RNA, herein designated VGAM RNA, to host target binding sites on VGAM389 host target RNA, herein designated VGAM HOST TARGET RNA, such as BINDING SITE I, BINDING SITE II and BINDING SITE III, inhibits translation of VGAM389 host target RNA into VGAM389 host target protein, herein designated VGAM HOST TARGET PROTEIN. VGAM host target protein is therefore outlined by a broken line.

It is appreciated that VGAM389 host target gene, herein designated VGAM HOST TARGET GENE, in fact represents a plurality of VGAM389 host target genes. The mRNA of each one of this plurality of VGAM389 host target genes comprises one or more host target binding sites, each having a nucleotide sequence which is at least partly complementary to VGAM389 RNA, herein designated VGAM RNA, and which when bound by VGAM389 RNA causes inhibition of translation of respective one or more VGAM389 host target proteins.

It is further appreciated by one skilled in the art that the mode of translational inhibition illustrated by FIG. 1 with specific reference to translational inhibition exerted by VGAM389 gene, herein designated VGAM GENE, on one or more VGAM389 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM389 is inhibition of expression of host target genes, as part of a novel viral mechanism of attacking a host. Accordingly, utilities of VGAM389 include diagnosis, prevention and treatment of viral infection by Equine Herpesvirus 1. Specific functions, and accordingly utilities, of VGAM389 correlate with, and may be deduced from, the identity of the host target genes which VGAM389 binds and inhibits, and the function of these host target genes, as elaborated hereinbelow.

Nucleotide sequences of the VGAM389 precursor RNA, herein designated VGAM PRECURSOR RNA, and of the 'diced' VGAM389 RNA, herein designated VGAM RNA, and a schematic representation of the secondary folding of VGAM389 folded precursor RNA, herein designated VGAM FOLDED PRECURSOR RNA, of VGAM389 are further described hereinbelow with reference to Table 1.

Nucleotide sequences of host target binding sites, such as BINDING SITE-I, BINDING SITE-II and BINDING SITE-III of FIG. 1, found on VGAM389 host target RNA, and schematic representation of the complementarity of each of these host target binding sites to VGAM389 RNA, herein designated VGAM RNA, are described hereinbelow with reference to Table 2.

As mentioned hereinabove with reference to FIG. 1, a function of VGAM389 gene, herein designated VGAM is inhibition of expression of VGAM389 target genes. It is appreciated that specific functions, and accordingly utilities, of VGAM389 correlate with, and may be deduced from, the identity of the target genes which VGAM389 binds and inhibits, and the function of these target genes, as elaborated hereinbelow.

ATPase, Ca++ Transporting, Cardiac Muscle, Slow Twitch 2 (ATP2A2, Accession NM_001681) is a VGAM389 host target gene. ATP2A2 BINDING SITE is HOST TARGET binding site found in the 3' untranslated region of mRNA encoded by ATP2A2, corresponding to a HOST TARGET binding site such as BINDING SITE I, BINDING SITE II or BINDING SITE III. Table 2 illustrates the complementarity of the nucleotide sequences of ATP2A2 BINDING SITE, designated SEQ ID:7400, to the nucleotide sequence of VGAM389 RNA, herein designated VGAM RNA, also designated SEQ ID:3100.

A function of VGAM389 is therefore inhibition of ATPase, Ca++ Transporting, Cardiac Muscle, Slow Twitch 2 (ATP2A2, Accession NM_001681). Accordingly, utilities of VGAM389 include diagnosis, prevention and treatment of diseases and clinical conditions associated with ATP2A2. Guanine Nucleotide Binding Protein (G protein), Beta Polypeptide 2 (GNB2, Accession NM_005273) is another VGAM389 host target gene. GNB2 BINDING SITE is HOST TARGET binding site found in the 5' untranslated region of mRNA encoded by GNB2, corresponding to a HOST TARGET binding site such as BINDING SITE I, BINDING SITE II or BINDING SITE III. Table 2 illustrates the complementarity of the nucleotide sequences of GNB2 BINDING SITE, designated SEQ ID:11777, to the nucleotide sequence of VGAM389 RNA, herein designated VGAM RNA, also designated SEQ ID:3100.

Another function of VGAM389 is therefore inhibition of Guanine Nucleotide Binding Protein (G protein), Beta Polypeptide 2 (GNB2, Accession NM_005273). Accordingly, utilities of VGAM389 include diagnosis, prevention and treatment of diseases and clinical conditions associated with GNB2. Histone Deacetylase 4 (HDAC4, Accession NM_006037) is another VGAM389 host target gene. HDAC4 BINDING SITE is HOST TARGET binding site found in the 3' untranslated region of mRNA encoded by HDAC4, corresponding to a HOST TARGET binding site such as BINDING SITE I, BINDING SITE II or BINDING SITE III. Table 2 illustrates the complementarity of the nucleotide sequences of HDAC4 BINDING SITE, designated SEQ ID:12660, to the nucleotide sequence of VGAM389 RNA, herein designated VGAM RNA, also designated SEQ ID:3100.

Another function of VGAM389 is therefore inhibition of Histone Deacetylase 4 (HDAC4, Accession NM_006037), a gene which is responsible for the deacetylation of lysine residues on the n-terminal part of the core histones and may mediate transcriptional regulation. Accordingly, utilities of VGAM389 include diagnosis, prevention and treatment of diseases and clinical conditions associated with HDAC4. The function of HDAC4 and its association with various diseases and clinical conditions, has been established by previous studies, as described hereinabove with reference to VGAM264. FLJ20699 (Accession NM_017931) is another VGAM389 host target gene. FLJ20699 BINDING SITE is HOST TARGET binding site found in the 3' untranslated region of mRNA encoded by FLJ20699, corresponding to a HOST TARGET binding site such as BINDING SITE I, BINDING SITE II or BINDING SITE III. Table 2 illustrates the complementarity of the nucleotide sequences of FLJ20699 BINDING SITE, designated SEQ ID:19618, to the nucleotide sequence of VGAM389 RNA, herein designated VGAM RNA, also designated SEQ ID:3100.

Another function of VGAM389 is therefore inhibition of FLJ20699 (Accession NM_017931). Accordingly, utilities of VGAM389 include diagnosis, prevention and treatment of diseases and clinical conditions associated with FLJ20699. MGC15937 (Accession NM_080661) is another VGAM389 host target gene. MGC15937 BINDING SITE is HOST TARGET binding site found in the 5' untranslated region of mRNA encoded by MGC15937, corresponding to a HOST TARGET binding site such as BINDING SITE I, BINDING SITE II or BINDING SITE III. Table 2 illustrates the complementarity of the nucleotide sequences of MGC15937 BINDING SITE, designated SEQ ID:27948, to the nucleotide sequence of VGAM389 RNA, herein designated VGAM RNA, also designated SEQ ID:3100.

Another function of VGAM389 is therefore inhibition of MGC15937 (Accession NM_080661). Accordingly, utilities of VGAM389 include diagnosis, prevention and treatment of diseases and clinical conditions associated with MGC15937. FIG. 1 further provides a conceptual description of a novel bioinformatically detected viral gene of the present invention, referred to here as Viral Genomic Address Messenger 390 (VGAM390) viral gene, which modulates expression of respective host target genes thereof, the function and utility of which host target genes is known in the art.

VGAM390 is a novel bioinformatically detected regulatory, non protein coding, viral micro RNA (miRNA) gene. The method by which VGAM390 was detected is described hereinabove with reference to FIGS. 1-8.

VGAM390 gene, herein designated VGAM GENE, is a viral gene contained in the genome of Equine Herpesvirus 1.

VGAM390 host target gene, herein designated VGAM HOST TARGET GENE, is a human gene contained in the human genome.

VGAM390 gene encodes a VGAM390 precursor RNA, herein designated VGAM PRECURSOR RNA. Similar to other miRNA genes, and unlike most ordinary genes, VGAM390 precursor RNA does not encode a protein. A nucleotide sequence identical or highly similar to the nucleotide sequence of VGAM390 precursor RNA is designated SEQ ID:376, and is provided hereinbelow with reference to the sequence listing part. Nucleotide sequence SEQ ID:376 is located at position 98078 relative to the genome of Equine Herpesvirus 1.

VGAM390 precursor RNA folds onto itself, forming VGAM390 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM390 folded precursor RNA into VGAM390 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM390 RNA is designated SEQ ID:3101, and is provided hereinbelow with reference to the sequence listing part.

VGAM390 host target gene, herein designated VGAM HOST TARGET GENE, encodes a corresponding messenger RNA, VGAM390 host target RNA, herein designated VGAM HOST TARGET RNA. VGAM390 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM390 RNA, herein designated VGAM RNA, binds complementarily to one or more host target binding sites located in untranslated regions of VGAM390 host target RNA, herein designated VGAM HOST TARGET RNA. This complementary binding is due to the fact that the nucleotide sequence of VGAM390 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM390 RNA, herein designated VGAM RNA, may have a different number of host target binding sites in untranslated regions of a VGAM390 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM390 RNA, herein designated VGAM RNA, to host target binding sites on VGAM390 host target RNA, herein designated VGAM HOST TARGET RNA, such as BINDING SITE I, BINDING SITE II and BINDING SITE III, inhibits translation of VGAM390 host target RNA into VGAM390 host target protein, herein designated VGAM HOST TARGET PROTEIN. VGAM host target protein is therefore outlined by a broken line.

It is appreciated that VGAM390 host target gene, herein designated VGAM HOST TARGET GENE, in fact represents a plurality of VGAM390 host target genes. The mRNA of each one of this plurality of VGAM390 host target genes comprises one or more host target binding sites, each having a nucleotide sequence which is at least partly complementary to VGAM390 RNA, herein designated VGAM RNA, and which when bound by VGAM390 RNA causes inhibition of translation of respective one or more VGAM390 host target proteins.

It is further appreciated by one skilled in the art that the mode of translational inhibition illustrated by FIG. 1 with specific reference to translational inhibition exerted by VGAM390 gene, herein designated VGAM GENE, on one or more VGAM390 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM390 is inhibition of expression of host target genes, as part of a novel viral mechanism of attacking a host. Accordingly, utilities of VGAM390 include diagnosis, prevention and treatment of viral infection by Equine Herpesvirus 1. Specific functions, and accordingly utilities, of VGAM390 correlate with, and may be deduced from, the identity of the host target genes which VGAM390 binds and inhibits, and the function of these host target genes, as elaborated hereinbelow.

Nucleotide sequences of the VGAM390 precursor RNA, herein designated VGAM PRECURSOR RNA, and of the 'diced' VGAM390 RNA, herein designated VGAM RNA, and a schematic representation of the secondary folding of VGAM390 folded precursor RNA, herein designated VGAM FOLDED PRECURSOR RNA, of VGAM390 are further described hereinbelow with reference to Table 1.

Nucleotide sequences of host target binding sites, such as BINDING SITE-I, BINDING SITE-II and BINDING SITE-III of FIG. 1, found on VGAM390 host target RNA, and schematic representation of the complementarity of each of these host target binding sites to VGAM390 RNA, herein designated VGAM RNA, are described hereinbelow with reference to Table 2.

As mentioned hereinabove with reference to FIG. 1, a function of VGAM390 gene, herein designated VGAM is inhibition of expression of VGAM390 target genes. It is appreciated that specific functions, and accordingly utilities, of VGAM390 correlate with, and may be deduced from, the identity of the target genes which VGAM390 binds and inhibits, and the function of these target genes, as elaborated hereinbelow.

Alkaline Phosphatase, Placental-like 2 (ALPPL2, Accession XM_044139) is a VGAM390 host target gene. ALPPL2 BINDING SITE is HOST TARGET binding site found in the 3' untranslated region of mRNA encoded by ALPPL2, corresponding to a HOST TARGET binding site such as BINDING SITE I, BINDING SITE II or BINDING SITE III. Table 2 illustrates the complementarity of the nucleotide sequences of ALPPL2 BINDING SITE, designated SEQ ID:34139, to the nucleotide sequence of VGAM390 RNA, herein designated VGAM RNA, also designated SEQ ID:3101.

A function of VGAM390 is therefore inhibition of Alkaline Phosphatase, Placental-like 2 (ALPPL2, Accession XM_044139). Accordingly, utilities of VGAM390 include diagnosis, prevention and treatment of diseases and clinical conditions associated with ALPPL2. Ephrin-B1 (EFNB1, Accession NM_004429) is another VGAM390 host target gene. EFNB1 BINDING SITE is HOST TARGET binding site found in the 3' untranslated region of mRNA encoded by EFNB1, corresponding to a HOST TARGET binding site such as BINDING SITE I, BINDING SITE II or BINDING SITE III. Table 2 illustrates the complementarity of the nucleotide sequences of EFNB1 BINDING SITE, designated SEQ ID:10708, to the nucleotide sequence of VGAM390 RNA, herein designated VGAM RNA, also designated SEQ ID:3101.

Another function of VGAM390 is therefore inhibition of Ephrin-B1 (EFNB1, Accession NM_004429), a gene which is a transmembrane ligand of Eph-related receptor tyrosine kinases, has a role in cell adhesion. Accordingly, utilities of VGAM390 include diagnosis, prevention and treatment of diseases and clinical conditions associated with EFNB1. The function of EFNB1 has been established by previous studies. Bohme et al. (1996) presented evidence that LERK2 is a functional ligand of the EPH-related kinase HEK2 (EPHB3; 601839). They reported that coincubation of HEK2- and LERK2-expressing cells induces cell-cell adhesion and aggregation. Palmer et al. (2002) showed that SRC family kinases, or SFKs (see OMIM Ref. No. SRC; 190090), are positive regulators of ephrin-B phosphorylation and phosphotyrosine-mediated reverse signaling. EphB receptor engagement of ephrin-B caused rapid recruitment of SFKs to ephrin-B expression domains and transient SFK activation. With delayed kinetics, ephrin-B ligands recruited the cytoplasmic PDZ domain-containing protein tyrosine phosphatase PTPBL (see OMIM Ref. No. 600267) and were dephosphorylated. These data suggested the presence of a switch mechanism that allows a shift from phosphotyrosine-/SFK-dependent signaling to PDZ-dependent signaling.

Full details of the abovementioned studies are described in the following publications, the disclosure of which are hereby incorporated by reference:

Bohme, B.; VandenBos, T.; Cerretti, D. P.; Park, L. S.; Holtrich, U.; Rubsamen-Waigmann, H.; Strebhardt, K.: Cell-cell adhesion mediated by binding of membrane-anchored ligand LERK-2 to the EPH-related receptor human embryonal kinase 2 promotes tyrosine kinase activity. J. Biol. Chem. 271:24747-24752, 1996; and Palmer, A.; Zimmer, M.; Erdmann, K. S.; Eulenburg, V.; Porthin, A.; Heumann, R.; Deutsch, U.; Klein, R.: EphrinB phosphorylation and reverse signaling: regulation by Src kinases and PTP.

Further studies establishing the function and utilities of EFNB1 are found in John Hopkins OMIM database record ID 300035, and in sited publications numbered 8710-8713 listed in the bibliography section hereinbelow, which are also hereby incorporated by reference.8-oxoguanine DNA Glycosylase (OGG1, Accession NM_016819) is another VGAM390 host target gene. OGG1 BINDING SITE1 through OGG1 BINDING SITE3 are HOST TARGET binding sites found in untranslated regions of mRNA encoded by OGG1, corresponding to HOST TARGET binding sites such as BINDING SITE I, BINDING SITE II or BINDING SITE III. Table 2 illustrates the complementarity of the nucleotide sequences of OGG1 BINDING SITE1 through OGG1 BINDING SITE3, designated SEQ ID:18809, SEQ ID:8392 and SEQ ID:18814 respectively, to the nucleotide sequence of VGAM390 RNA, herein designated VGAM RNA, also designated SEQ ID:3101.

Another function of VGAM390 is therefore inhibition of 8-oxoguanine DNA Glycosylase (OGG1, Accession NM_016819), a gene which is involved in base excision DNA repair and removal of 8-oxyguanine. Accordingly, utilities of VGAM390 include diagnosis, prevention and treatment of diseases and clinical conditions associated with OGG1. The function of OGG1 has been established by previous studies. The major mutagenic base lesion in DNA caused by exposure to reactive oxygen species is 8-oxoguanine. This damaged base is excised by a DNA glycosylase with an associated lyase activity for chain cleavage. Lu et al. (1997), Aburatani et al. (1997), Bjoras et al. (1997), Rosenquist et al. (1997), Radicella et al. (1997), and Roldan-Arjona et al. (1997) cloned human cDNAs with partial sequence homology to the yeast 8-oxoguanine DNA glycosylase (OGG1) gene. Radicella et al. (1997) found that the predicted protein has 345 amino acids and a calculated molecular mass of 39 kD. Roldan-Arjona et al. (1997), who called the enzyme 8-hydroxyguanine DNA glycosylase, estimated their 424-amino acid predicted human enzyme to have a size of 47 kD. They showed that it releases free 8-hydroxyguanine from oxidized DNA and introduces a chain break in a double-stranded oligonucleotide specifically at an 8-hydroxyguanine residue base-paired with cytosine. Expression of the human protein in a DNA repair-deficient E. coli strain partly suppressed its spontaneous mutator phenotype. Radicella et al. (1997) showed that when the human coding sequence was expressed in a yeast strain mutant in Ogg1, it was able to complement the spontaneous mutator phenotype. Arai et al. (1997) also cloned the human OGG1 gene and, by Northern blotting, showed that the gene is ubiquitously expressed in a variety of human organs. By fluorescence in situ hybridization, Roldan-Arjona et al. (1997) and Radicella et al. (1997) mapped the human OGG1 gene to 3p25 (3p25.3-p25.2). By the same method, Arai et al. (1997) mapped the OGG1 gene to 3p26.2. By radiation hybrid analysis, Ishida et al. (1999) mapped the gene to 3p26, proximal to the VHL gene (OMIM Ref. No. 193300).

Full details of the abovementioned studies are described in the following publications, the disclosure of which are hereby incorporated by reference:

Radicella, J. P.; Dherin, C.; Desmaze, C.; Fox, M. S.; Boiteux, S.: Cloning and characterization of hOGG1, a human homolog of the OGG1 gene of Saccharomyces cerevisiae. Proc. Nat. Acad. Sci. 94:8010-8015, 1997; and Roldan-Arjona, T.; Wei, Y.-F.; Carter, K. C.; Klungland, A.; Anselmino, C.; Wang, R.-P.; Augustus, M.; Lindahl, T.: Molecular cloning and functional expression of a human cDNA encodin.

Further studies establishing the function and utilities of OGG1 are found in John Hopkins OMIM database record ID 601982, and in sited publications numbered 1214-1222, 887 and 8892-8893 listed in the bibliography section hereinbelow, which are also hereby incorporated by reference. KIAA1193 (Accession XM_041843) is another VGAM390 host target gene. KIAA1193 BINDING SITE is HOST TARGET binding site found in the 3" untranslated region of mRNA encoded by KIAA1193, corresponding to a HOST TARGET binding site such as BINDING SITE I, BINDING SITE II or BINDING SITE III. Table 2 illustrates the complementarity of the nucleotide sequences of KIAA1193 BINDING SITE, designated SEQ ID:33581, to the nucleotide sequence of VGAM390 RNA, herein designated VGAM RNA, also designated SEQ ID:3101.

Another function of VGAM390 is therefore inhibition of KIAA1193 (Accession XM_041843). Accordingly, utilities of VGAM390 include diagnosis, prevention and treatment of diseases and clinical conditions associated with KIAA1193. MGC2835 (Accession NM_024072) is another VGAM390 host target gene. MGC2835 BINDING SITE is HOST TARGET binding site found in the 3' untranslated region of mRNA encoded by MGC2835, corresponding to a HOST TARGET binding site such as BINDING SITE I, BINDING SITE II or BINDING SITE III. Table 2 illustrates the complementarity of the nucleotide sequences of MGC2835 BINDING SITE, designated SEQ ID:23505, to the nucleotide sequence of VGAM390 RNA, herein designated VGAM RNA, also designated SEQ ID:3101.

Another function of VGAM390 is therefore inhibition of MGC2835 (Accession NM_024072). Accordingly, utilities of VGAM390 include diagnosis, prevention and treatment of diseases and clinical conditions associated with MGC2835. LOC124044 (Accession XM_071871) is another VGAM390 host target gene. LOC124044 BINDING SITE is HOST TARGET binding site found in the 3' untranslated region of mRNA encoded by LOC124044, corresponding to a HOST TARGET binding site such as BINDING SITE I, BINDING SITE II or BINDING SITE III. Table 2 illustrates the complementarity of the nucleotide sequences of LOC124044 BINDING SITE, designated SEQ ID:37431, to the nucleotide sequence of VGAM390 RNA, herein designated VGAM RNA, also designated SEQ ID:3101.

Another function of VGAM390 is therefore inhibition of LOC124044 (Accession XM_071871). Accordingly, utilities of VGAM390 include diagnosis, prevention and treatment of diseases and clinical conditions associated with LOC124044. LOC256158 (Accession XM_175125) is another VGAM390 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46628, to the nucleotide sequence of VGAM390 RNA, herein designated VGAM RNA, also designated SEQ ID:3101.

Another function of VGAM390 is therefore inhibition of LOC256158 (Accession XM_175125). Accordingly, utilities of VGAM390 include diagnosis, prevention and treatment of diseases and clinical conditions associated with LOC256158. FIG. 1 further provides a conceptual description of a novel bioinformatically detected viral gene of the present invention, referred to here as Viral Genomic Address Messenger 391 (VGAM391) viral gene, which modulates expression of respective host target genes thereof, the function and utility of which host target genes is known in the art.

VGAM391 is a novel bioinformatically detected regulatory, non protein coding, viral micro RNA (miRNA) gene. The method by which VGAM391 was detected is described hereinabove with reference to FIGS. 1-8.

VGAM391 gene, herein designated VGAM GENE, is a viral gene contained in the genome of Equine Herpesvirus 1. VGAM391 host target gene, herein designated VGAM HOST TARGET GENE, is a human gene contained in the human genome.

VGAM391 gene encodes a VGAM391 precursor RNA, herein designated VGAM PRECURSOR RNA. Similar to other miRNA genes, and unlike most ordinary genes, VGAM391 precursor RNA does not encode a protein. A nucleotide sequence identical or highly similar to the nucleotide sequence of VGAM391 precursor RNA is designated SEQ ID:377, and is provided hereinbelow with reference to the sequence listing part. Nucleotide sequence SEQ ID:377 is located at position 98356 relative to the genome of Equine Herpesvirus 1.

VGAM391 precursor RNA folds onto itself, forming VGAM391 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM391 folded precursor RNA into VGAM391 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM391 RNA is designated SEQ ID:3102, and is provided hereinbelow with reference to the sequence listing part.

VGAM391 host target gene, herein designated VGAM HOST TARGET GENE, encodes a corresponding messenger RNA, VGAM391 host target RNA, herein designated VGAM HOST TARGET RNA. VGAM391 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM391 RNA, herein designated VGAM RNA, binds complementarily to one or more host target binding sites located in untranslated regions of VGAM391 host target RNA, herein designated VGAM HOST TARGET RNA. This complementary binding is due to the fact that the nucleotide sequence of VGAM391 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM391 RNA, herein designated VGAM RNA, may have a different number of host target binding sites in untranslated regions of a VGAM391 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM391 RNA, herein designated VGAM RNA, to host target binding sites on VGAM391 host target RNA, herein designated VGAM HOST TARGET RNA, such as BINDING SITE I, BINDING SITE II and BINDING SITE III, inhibits translation of VGAM391 host target RNA into VGAM391 host target protein, herein designated VGAM HOST TARGET PROTEIN. VGAM host target protein is therefore outlined by a broken line.

It is appreciated that VGAM391 host target gene, herein designated VGAM HOST TARGET GENE, in fact represents a plurality of VGAM391 host target genes. The mRNA of each one of this plurality of VGAM391 host target genes comprises one or more host target binding sites, each having a nucleotide sequence which is at least partly complementary to VGAM391 RNA, herein designated VGAM RNA, and which when bound by VGAM391 RNA causes inhibition of translation of respective one or more VGAM391 host target proteins.

It is further appreciated by one skilled in the art that the mode of translational inhibition illustrated by FIG. 1 with specific reference to translational inhibition exerted by VGAM391 gene, herein designated VGAM GENE, on one or more VGAM391 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM391 is inhibition of expression of host target genes, as part of a novel viral mechanism of attacking a host. Accordingly, utilities of VGAM391 include diagnosis, prevention and treatment of viral infection by Equine Herpesvirus 1. Specific functions, and accordingly utilities, of VGAM391 correlate with, and may be deduced from, the identity of the host target genes which VGAM391 binds and inhibits, and the function of these host target genes, as elaborated hereinbelow.

Nucleotide sequences of the VGAM391 precursor RNA, herein designated VGAM PRECURSOR RNA, and of the 'diced' VGAM391 RNA, herein designated VGAM RNA, and a schematic representation of the secondary folding of VGAM391 folded precursor RNA, herein designated VGAM FOLDED PRECURSOR RNA, of VGAM391 are further described hereinbelow with reference to Table 1.

Nucleotide sequences of host target binding sites, such as BINDING SITE-I, BINDING SITE-II and BINDING SITE-III of FIG. 1, found on VGAM391 host target RNA, and schematic representation of the complementarity of each of these host target binding sites to VGAM391 RNA, herein designated VGAM RNA, are described hereinbelow with reference to Table 2.

As mentioned hereinabove with reference to FIG. 1, a function of VGAM391 gene, herein designated VGAM is inhibition of expression of VGAM391 target genes. It is appreciated that specific functions, and accordingly utilities, of VGAM391 correlate with, and may be deduced from, the identity of the target genes which VGAM391 binds and inhibits, and the function of these target genes, as elaborated hereinbelow.

Chemokine (C-X3-C motif) Receptor 1 (CX3CR1, Accession XM_047502) is a VGAM391 host target gene. CX3CR1 BINDING SITE is HOST TARGET binding site found in the 3' untranslated region of mRNA encoded by CX3CR1, corresponding to a HOST TARGET binding site such as BINDING SITE I, BINDING SITE II or BINDING SITE III. Table 2 illustrates the complementarity of the nucleotide sequences of CX3CR1 BINDING SITE, designated SEQ ID:34981, to the nucleotide sequence of VGAM391 RNA, herein designated VGAM RNA, also designated SEQ ID:3102.

A function of VGAM391 is therefore inhibition of Chemokine (C-X3-C motif) Receptor 1 (CX3CR1, Accession XM_047502), a gene which mediates both the adhesive and migratory functions of fractalkine. Accordingly, utilities of VGAM391 include diagnosis, prevention and treatment of diseases and clinical conditions associated with CX3CR1. The function of CX3CR1 and its association with various diseases and clinical conditions, has been established by previous studies, as described hereinabove with reference to VGAM25. Tripartite Motif-containing 14 (TRIM14, Accession NM_014788) is another VGAM391 host target gene. TRIM14 BINDING SITE is HOST TARGET binding site found in the 3' untranslated region of mRNA encoded by TRIM14, corresponding to a HOST TARGET binding site such as BINDING SITE I, BINDING SITE II or BINDING SITE III. Table 2 illustrates the complementarity of the nucleotide sequences of TRIM14 BINDING SITE, designated SEQ ID:16667, to the nucleotide sequence of VGAM391 RNA, herein designated VGAM RNA, also designated SEQ ID:3102.

Another function of VGAM391 is therefore inhibition of Tripartite Motif-containing 14 (TRIM14, Accession NM_014788), a gene which is composed of 3 zinc-binding domains and is involved in development and cell growth. Accordingly, utilities of VGAM391 include diagnosis, prevention and treatment of diseases and clinical conditions associated with TRIM14. The function of TRIM14 and its association with various diseases and clinical conditions, has been established by previous studies, as described hereinabove with reference to VGAM180. Amyloid Beta (A4) Precursor Protein-binding, Family A, Member 2 Binding Protein (APBA2BP, Accession NM_031232) is another VGAM391 host target gene. APBA2BP BINDING SITE is HOST TARGET binding site found in the 3' untranslated region of mRNA encoded by APBA2BP, corresponding to a HOST TARGET binding site such as BINDING SITE I, BINDING SITE II or BINDING SITE III. Table 2 illustrates the complementarity of the nucleotide sequences of APBA2BP BINDING SITE, designated SEQ ID:25278, to the nucleotide sequence of VGAM391 RNA, herein designated VGAM RNA, also designated SEQ ID:3102.

Another function of VGAM391 is therefore inhibition of Amyloid Beta (A4) Precursor Protein-binding, Family A, Member 2 Binding Protein (APBA2BP, Accession NM_031232). Accordingly, utilities of VGAM391 include diagnosis, prevention and treatment of diseases and clinical conditions associated with APBA2BP. FLJ13241 (Accession NM_025088) is another VGAM391 host target gene. FLJ13241 BINDING SITE is HOST TARGET binding site found in the 3' untranslated region of mRNA encoded by FLJ13241, corresponding to a HOST TARGET binding site such as BINDING SITE I, BINDING SITE II or BINDING SITE III. Table 2 illustrates the complementarity of the nucleotide sequences of FLJ13241 BINDING SITE, designated SEQ ID:24711, to the nucleotide sequence of VGAM391 RNA, herein designated VGAM RNA, also designated SEQ ID:3102.

Another function of VGAM391 is therefore inhibition of FLJ13241 (Accession NM_025088). Accordingly, utilities of VGAM391 include diagnosis, prevention and treatment of diseases and clinical conditions associated with FLJ13241. KIAA0914 (Accession NM_014883) is another VGAM391 host target gene. KIAA0914 BINDING SITE is HOST TARGET binding site found in the 5' untranslated region of mRNA encoded by KIAA0914, corresponding to a HOST TARGET binding site such as BINDING SITE I, BINDING SITE II or BINDING SITE III. Table 2 illustrates the complementarity of the nucleotide sequences of KIAA0914 BINDING SITE, designated SEQ ID:17037, to the nucleotide sequence of VGAM391 RNA, herein designated VGAM RNA, also designated SEQ ID:3102.

Another function of VGAM391 is therefore inhibition of KIAA0914 (Accession NM_014883). Accordingly, utilities of VGAM391 include diagnosis, prevention and treatment of diseases and clinical conditions associated with KIAA0914. KIAA1796 (Accession XM_166146) is another VGAM391 host target gene. KIAA1796 BINDING SITE is HOST TARGET binding site found in the 5' untranslated region of mRNA encoded by KIAA1796, corresponding to a HOST TARGET binding site such as BINDING SITE I, BINDING SITE II or BINDING SITE III. Table 2 illustrates the complementarity of the nucleotide sequences of KIAA1796 BINDING SITE, designated SEQ ID:43966, to the nucleotide sequence of VGAM391 RNA, herein designated VGAM RNA, also designated SEQ ID:3102.

Another function of VGAM391 is therefore inhibition of KIAA1796 (Accession XM_166146). Accordingly, utilities of VGAM391 include diagnosis, prevention and treatment of diseases and clinical conditions associated with KIAA1796. Sep.in 3 (SEPT3, Accession NM_019106) is another VGAM391 host target gene. SEPT3 BINDING SITE is HOST TARGET binding site found in the 3' untranslated region of mRNA encoded by SEPT3, corresponding to a HOST TARGET binding site such as BINDING SITE I, BINDING SITE II or BINDING SITE III. Table 2 illustrates the complementarity of the nucleotide sequences of SEPT3 BINDING SITE, designated SEQ ID:21181, to the nucleotide sequence of VGAM391 RNA, herein designated VGAM RNA, also designated SEQ ID:3102.

Another function of VGAM391 is therefore inhibition of Sep.in 3 (SEPT3, Accession NM_019106). Accordingly, utilities of VGAM391 include diagnosis, prevention and treatment of diseases and clinical conditions associated with SEPT3. LOC116437 (Accession XM_058185) is another VGAM391 host target gene. LOC116437 BINDING SITE is HOST TARGET binding site found in the 3' untranslated region of mRNA encoded by LOC116437, corresponding to a HOST TARGET binding site such as BINDING SITE I, BINDING SITE II or BINDING SITE III. Table 2 illustrates the complementarity of the nucleotide sequences of LOC116437 BINDING SITE, designated SEQ ID:36583, to the nucleotide sequence of VGAM391 RNA, herein designated VGAM RNA, also designated SEQ ID:3102.

Another function of VGAM391 is therefore inhibition of LOC116437 (Accession XM_058185). Accordingly, utilities of VGAM391 include diagnosis, prevention and treatment of diseases and clinical conditions associated with LOC116437. LOC222134 (Accession XM_168432) is another VGAM391 host target gene. LOC222134 BINDING SITE is HOST TARGET binding site found in the 5' untranslated region of mRNA encoded by LOC222134, corresponding to a HOST TARGET binding site such as BINDING SITE I, BINDING SITE II or BINDING SITE III. Table 2 illustrates the complementarity of the nucleotide sequences of LOC222134 BINDING SITE, designated SEQ ID:45172, to the nucleotide sequence of VGAM391 RNA, herein designated VGAM RNA, also designated SEQ ID:3102.

Another function of VGAM391 is therefore inhibition of LOC222134 (Accession XM_168432). Accordingly, utilities of VGAM391 include diagnosis, prevention and treatment of diseases and clinical conditions associated with LOC222134. FIG. 1 further provides a conceptual description of a novel bioinformatically detected viral gene of the present invention, referred to here as Viral Genomic Address Messenger 392 (VGAM392) viral gene, which modulates expression of respective host target genes thereof, the function and utility of which host target genes is known in the art.

VGAM392 is a novel bioinformatically detected regulatory, non protein coding, viral micro RNA (miRNA) gene. The method by which VGAM392 was detected is described hereinabove with reference to FIGS. 1-8.

VGAM392 gene, herein designated VGAM GENE, is a viral gene contained in the genome of Equine Herpesvirus 1. VGAM392 host target gene, herein designated VGAM HOST TARGET GENE, is a human gene contained in the human genome.

VGAM392 gene encodes a VGAM392 precursor RNA, herein designated VGAM PRECURSOR RNA. Similar to other miRNA genes, and unlike most ordinary genes, VGAM392 precursor RNA does not encode a protein. A nucleotide sequence identical or highly similar to the nucleotide sequence of VGAM392 precursor RNA is designated SEQ ID:378, and is provided hereinbelow with reference to the sequence listing part. Nucleotide sequence SEQ ID:378 is located at position 104567 relative to the genome of Equine Herpesvirus 1.

VGAM392 precursor RNA folds onto itself, forming VGAM392 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM392 folded precursor RNA into VGAM392 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM392 RNA is designated SEQ ID:3103, and is provided hereinbelow with reference to the sequence listing part.

VGAM392 host target gene, herein designated VGAM HOST TARGET GENE, encodes a corresponding messenger RNA, VGAM392 host target RNA, herein designated VGAM HOST TARGET RNA. VGAM392 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM392 RNA, herein designated VGAM RNA, binds complementarily to one or more host target binding sites located in untranslated regions of VGAM392 host target RNA, herein designated VGAM HOST TARGET RNA. This complementary binding is due to the fact that the nucleotide sequence of VGAM392 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM392 RNA, herein designated VGAM RNA, may have a different number of host target binding sites in untranslated regions of a VGAM392 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM392 RNA, herein designated VGAM RNA, to host target binding sites on VGAM392 host target RNA, herein designated VGAM HOST TARGET RNA, such as BINDING SITE I, BINDING SITE II and BINDING SITE III, inhibits translation of VGAM392 host target RNA into VGAM392 host target protein, herein designated VGAM HOST TARGET PROTEIN. VGAM host target protein is therefore outlined by a broken line.

It is appreciated that VGAM392 host target gene, herein designated VGAM HOST TARGET GENE, in fact represents a plurality of VGAM392 host target genes. The mRNA of each one of this plurality of VGAM392 host target genes comprises one or more host target binding sites, each having a nucleotide sequence which is at least partly complementary to VGAM392 RNA, herein designated VGAM RNA, and which when bound by VGAM392 RNA causes inhibition of translation of respective one or more VGAM392 host target proteins.

It is further appreciated by one skilled in the art that the mode of translational inhibition illustrated by FIG. 1 with specific reference to translational inhibition exerted by VGAM392 gene, herein designated VGAM GENE, on one or more VGAM392 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM392 is inhibition of expression of host target genes, as part of a novel viral mechanism of attacking a host. Accordingly, utilities of VGAM392 include diagnosis, prevention and treatment of viral infection by Equine Herpesvirus 1. Specific functions, and accordingly utilities, of VGAM392 correlate with, and may be deduced from, the identity of the host target genes which VGAM392 binds and inhibits, and the function of these host target genes, as elaborated hereinbelow.

Nucleotide sequences of the VGAM392 precursor RNA, herein designated VGAM PRECURSOR RNA, and of the 'diced' VGAM392 RNA, herein designated VGAM RNA, and a schematic representation of the secondary folding of VGAM392 folded precursor RNA, herein designated VGAM FOLDED PRECURSOR RNA, of VGAM392 are further described hereinbelow with reference to Table 1.

Nucleotide sequences of host target binding sites, such as BINDING SITE-I, BINDING SITE-II and BINDING SITE-III of FIG. 1, found on VGAM392 host target RNA, and schematic representation of the complementarity of each of these host target binding sites to VGAM392 RNA, herein designated VGAM RNA, are described hereinbelow with reference to Table 2.

As mentioned hereinabove with reference to FIG. 1, a function of VGAM392 gene, herein designated VGAM is inhibition of expression of VGAM392 target genes. It is appreciated that specific functions, and accordingly utilities, of VGAM392 correlate with, and may be deduced from, the identity of the target genes which VGAM392 binds and inhibits, and the function of these target genes, as elaborated hereinbelow.

LOC125704 (Accession XM_058931) is a VGAM392 host target gene. LOC125704 BINDING SITE is HOST TARGET binding site found in the 3' untranslated region of mRNA encoded by LOC125704, corresponding to a HOST TARGET binding site such as BINDING SITE I, BINDING SITE II or BINDING SITE III. Table 2 illustrates the complementarity of the nucleotide sequences of LOC125704 BINDING SITE, designated SEQ ID:36799, to the nucleotide sequence of VGAM392 RNA, herein designated VGAM RNA, also designated SEQ ID:3103.

A function of VGAM392 is therefore inhibition of LOC125704 (Accession XM_058931). Accordingly, utilities of VGAM392 include diagnosis, prevention and treatment of diseases and clinical conditions associated with LOC125704.

FIG. 1 further provides a conceptual description of a novel bioinformatically detected viral gene of the present invention, referred to here as Viral Genomic Address Messenger 393 (VGAM393) viral gene, which modulates expression of respective host target genes thereof, the function and utility of which host target genes is known in the art.

VGAM393 is a novel bioinformatically detected regulatory, non protein coding, viral micro RNA (miRNA) gene. The method by which VGAM393 was detected is described hereinabove with reference to FIGS. 1-8.

VGAM393 gene, herein designated VGAM GENE, is a viral gene contained in the genome of Cryphonectria Hypovirus 1. VGAM393 host target gene, herein designated VGAM HOST TARGET GENE, is a human gene contained in the human genome.

VGAM393 gene encodes a VGAM393 precursor RNA, herein designated VGAM PRECURSOR RNA. Similar to other miRNA genes, and unlike most ordinary genes, VGAM393 precursor RNA does not encode a protein. A nucleotide sequence identical or highly similar to the nucleotide sequence of VGAM393 precursor RNA is designated SEQ ID:379, and is provided hereinbelow with reference to the sequence listing part. Nucleotide sequence SEQ ID:379 is located at position 4681 relative to the genome of Cryphonectria Hypovirus 1.

VGAM393 precursor RNA folds onto itself, forming VGAM393 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM393 folded precursor RNA into VGAM393 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM393 RNA is designated SEQ ID:3104, and is provided hereinbelow with reference to the sequence listing part.

VGAM393 host target gene, herein designated VGAM HOST TARGET GENE, encodes a corresponding messenger RNA, VGAM393 host target RNA, herein designated VGAM HOST TARGET RNA. VGAM393 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM393 RNA, herein designated VGAM RNA, binds complementarily to one or more host target binding sites located in untranslated regions of VGAM393 host target RNA, herein designated VGAM HOST TARGET RNA. This complementary binding is due to the fact that the nucleotide sequence of VGAM393 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM393 RNA, herein designated VGAM RNA, may have a different number of host target binding sites in untranslated regions of a VGAM393 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM393 RNA, herein designated VGAM RNA, to host target binding sites on VGAM393 host target RNA, herein designated VGAM HOST TARGET RNA, such as BINDING SITE I, BINDING SITE II and BINDING SITE III, inhibits translation of VGAM393 host target RNA into VGAM393 host target protein, herein designated VGAM HOST TARGET PROTEIN. VGAM host target protein is therefore outlined by a broken line.

It is appreciated that VGAM393 host target gene, herein designated VGAM HOST TARGET GENE, in fact represents a plurality of VGAM393 host target genes. The mRNA of each one of this plurality of VGAM393 host target genes comprises one or more host target binding sites, each having a nucleotide sequence which is at least partly complementary to VGAM393 RNA, herein designated VGAM RNA, and which when bound by VGAM393 RNA causes inhibition of translation of respective one or more VGAM393 host target proteins.

It is further appreciated by one skilled in the art that the mode of translational inhibition illustrated by FIG. 1 with specific reference to translational inhibition exerted by VGAM393 gene, herein designated VGAM GENE, on one or more VGAM393 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM393 is inhibition of expression of host target genes, as part of a novel viral mechanism of attacking a host. Accordingly, utilities of VGAM393 include diagnosis, prevention and treatment of viral infection by Cryphonectria Hypovirus 1. Specific functions, and accordingly utilities, of VGAM393 correlate with, and may be deduced from, the identity of the host target genes which VGAM393 binds and inhibits, and the function of these host target genes, as elaborated hereinbelow.

Nucleotide sequences of the VGAM393 precursor RNA, herein designated VGAM PRECURSOR RNA, and of the 'diced' VGAM393 RNA, herein designated VGAM RNA, and a schematic representation of the secondary folding of VGAM393 folded precursor RNA, herein designated VGAM FOLDED PRECURSOR RNA, of VGAM393 are further described hereinbelow with reference to Table 1.

Nucleotide sequences of host target binding sites, such as BINDING SITE-I, BINDING SITE-II and BINDING SITE-III of FIG. 1, found on VGAM393 host target RNA, and schematic representation of the complementarity of each of these host target binding sites to VGAM393 RNA, herein designated VGAM RNA, are described hereinbelow with reference to Table 2.

As mentioned hereinabove with reference to FIG. 1, a function of VGAM393 gene, herein designated VGAM is inhibition of expression of VGAM393 target genes. It is appreciated that specific functions, and accordingly utilities, of VGAM393 correlate with, and may be deduced from, the identity of the target genes which VGAM393 binds and inhibits, and the function of these target genes, as elaborated hereinbelow.

AS3 (Accession NM_015928) is a VGAM393 host target gene. AS3 BINDING SITE is HOST TARGET binding site found in the 3' untranslated region of mRNA encoded by AS3, corresponding to a HOST TARGET binding site such as BINDING SITE I, BINDING SITE II or BINDING SITE III. Table 2 illustrates the complementarity of the nucleotide sequences of AS3 BINDING SITE, designated SEQ ID:18048, to the nucleotide sequence of VGAM393 RNA, herein designated VGAM RNA, also designated SEQ ID:3104.

A function of VGAM393 is therefore inhibition of AS3 (Accession NM_015928), a gene which inhibits cell proloferation. Accordingly, utilities of VGAM393 include diagnosis, prevention and treatment of diseases and clinical conditions associated with AS3. The function of AS3 has been established by previous studies. In the prostate of adult mammals, most epithelial cells are in a state of proliferative quiescence. Androgens regulate this effect by inducing cell cycle arrest in the G0/G1 phase. Geck et al. (2000) identified potential mediators of this androgen-induced proliferative shutoff by means of subtractive cDNA libraries. The expression pattern of one of these sequences, designated AS3, strongly correlated with the expression of the androgen-induced proliferative shutoff both temporally and dosewise. The AS3 gene is upregulated during androgen-induced proliferative shutoff and induces cell proliferation arrest when expressed in a retrovirus transduced model. The deduced 1,391-amino acid AS3 protein has putative transactivating features, protein-protein interaction motifs (coiled coil and leucine zipper), and DNA-binding domains, suggesting that AS3 is a transcription factor. AS3 also has a protein-kinase motif, suggesting that it may act by phosphorylating a target protein. Geck et al. (1999) demonstrated that the transcript of the AS3 gene has 34 exons spanning approximately 200 kb of genomic DNA. By homology searching in GenBank, they demonstrated that the AS3 gene lies on 13q12-q13, downstream of the breast cancer susceptibility gene BRCA2 (OMIM Ref. No. 600185) and centromeric to the retinoblastoma (RB1; 180200) locus. Geck et al. (2001) presented data on the location of the AS3 gene in relation to BRCA2 and pointed out that the D13S171 marker, which had been widely used as an intragenic marker of BRCA2, is actually located in the center of the 200-kb AS3 gene. The microsatellite instability of the S171 marker links the AS3 gene to a variety of cancers.

Full details of the abovementioned studies are described in the following publications, the disclosure of which are hereby incorporated by reference:

Geck, P.; Sonnenschein, C.; Soto, A. M.: The D13S171 marker, misannotated to BRCA2, links the AS3 gene to various cancers. (Letter) Am. J. Hum. Genet. 69:461-463, 2001; and Geck, P.; Szelei, J.; Jimenez, J.; Sonnenschein, C.; Soto, A. M.: Early gene expression during androgen-induced inhibition of proliferation of prostate cancer cells: a new suppressor.

Further studies establishing the function and utilities of AS3 are found in John Hopkins OMIM database record ID 605333, and in sited publications numbered 4791-2307 listed in the bibliography section hereinbelow, which are also hereby incorporated by reference. Citron (rho-interacting, serine/threonine kinase 21) (CIT, Accession XM_045786) is another VGAM393 host target gene. CIT BINDING SITE is HOST TARGET binding site found in the 5' untranslated region of mRNA encoded by CIT, corresponding to a HOST TARGET binding site such as BINDING SITE I, BINDING SITE II or BINDING SITE III. Table 2 illustrates the complementarity of the nucleotide sequences of CIT BINDING SITE, designated SEQ ID:34561, to the nucleotide sequence of VGAM393 RNA, herein designated VGAM RNA, also designated SEQ ID:3104.

Another function of VGAM393 is therefore inhibition of Citron (rho-interacting, serine/threonine kinase 21) (CIT, Accession XM_045786), a gene which is increased several-fold by coexpression of constitutively active Rho . Accordingly, utilities of VGAM393 include diagnosis, prevention and treatment of diseases and clinical conditions associated with CIT. The function of CIT has been established by previous studies. Activated Rho GTPases (see OMIM Ref. No. 602924) trigger distinctive kinase cascades. In particular, ROCK (see OMIM Ref. No. ROCK1, 601702) binds to Rho, and its kinase activity is moderately stimulated by this association. The citron molecule (Madaule et al., 1995), a specific interactor of Rho and Rac (see OMIM Ref. No. 602048), shares a significant degree of structural homology with ROCK; however, its lack of a kinase domain raised the question of its biologic function. By PCR of a mouse primary keratinocyte cDNA library, Di Cunto et al. (1998) identified a novel serine/threonine kinase, CRIK (citron Rho-interacting kinase), belonging to the myotonic dystrophy kinase (see OMIM Ref. No. 605377) family. CRIK can be expressed as at least 2 isoforms, one of which encompasses the previously reported form of citron in almost its entirety. The long form of CRIK is a 240-kD protein in which the kinase domain is followed by the sequence of citron. The short form, CRIK-SK (short kinase), is an approximately 54-kD protein that consists mostly of the kinase domain. CRIK and CRIK-SK proteins are capable of phosphorylating exogenous substrates as well as of autophosphorylation, when tested by in vitro kinase assays after expression into COS-7 cells. CRIK kinase activity is increased several-fold by coexpression of constitutively active Rho, while active Rac has more limited effects. Kinase activity of the endogenous CRIK is indicated by in vitro kinase assays after immunoprecipitation with antibodies recognizing the citron moiety of the protein. When expressed in keratinocytes, full-length CRIK, but not CRIK-SK, localizes into corpuscular cytoplasmic structures and elicits recruitment of actin into these structures. The previously reported Rho-associated kinases ROCK1 and ROCK2 (OMIM Ref. No. 604002) are ubiquitously expressed. Northern blot analysis of mouse tissues revealed a restricted pattern of expression limited to keratinocytes, brain, spleen, lung, kidney, and an especially strong signal in testis. No expression was detectable in heart, liver, or skeletal muscle. The CRIK protein contains a kinase domain, a coiled-coil domain, a leucine-rich domain, a Rho-Rac binding domain, a zinc finger region, a pleckstrin homology domain, and a putative SH3-binding domain. Di Cunto et al. (1998) reported cloning the human homolog of the CRIK kinase domain. They stated that the human homolog of citron is contained within a PAC clone (GenBank AC002563) mapping to chromosome 12q. Animal model experiments lend further support to the function of CIT. Di Cunto et al. (2000) generated mice deficient in citron kinase by targeted disruption. Citron-K -/- mice grow at slower rates, are severely ataxic, and die before adulthood as a consequence of fatal seizures. Their brains display defective neurogenesis, with dramatic depletion of microneurons in the olfactory bulb, hippocampus, and cerebellum. These abnormalities arise during development of the central nervous system due to altered cytokinesis and massive apoptosis. Di Cunto et al. (2000) concluded that citron-K is essential for cytokinesis in vivo, in specific neuronal precursors only. Moreover, they suggested a novel molecular mechanism for a subset of human malformation syndromes of the central nervous system.

It is appreciated that the abovementioned animal model for CIT is acknowledged by those skilled in the art as a scientifically valid animal model, as can be further appreciated from the publications sited hereinbelow.

Full details of the abovementioned studies are described in the following publications, the disclosure of which are hereby incorporated by reference:

Di Cunto, F.; Imarisio, S.; Hirsch, E.; Broccoli, V.; Bulfone, A.; Migheli, A.; Atzori, C.; Turco, E.; Triolo, R.; Dotto, G. P.; Silengo, L.; Altruda, F.: Defective neurogenesis in citron kinase knockout mice by altered cytokinesis and massive apoptosis. Neuron 28:115-127, 2000; and Madaule, P.; Furuyashiki, T.; Reid, T.; Ishizaki, T.; Watanabe, G.; Morii, N.; Narumiya, S.: A novel partner for the GTP-bound forms of rho and rac. FEBS Lett. 377:243-248, 1995.

Further studies establishing the function and utilities of CIT are found in John Hopkins OMIM database record ID 605629, and in sited publications numbered 6960-696 and 8593 listed in the bibliography section hereinbelow, which are also hereby incorporated by reference. Fragile X Mental Retardation 1 (FMR1, Accession NM_002024) is another VGAM393 host target gene. FMR1 BINDING SITE is HOST TARGET binding site found in the 3' untranslated region of mRNA encoded by FMR1, corresponding to a HOST TARGET binding site such as BINDING SITE I, BINDING SITE II or BINDING SITE III. Table 2 illustrates the complementarity of the nucleotide sequences of FMR1 BINDING SITE, designated SEQ ID:7774, to the nucleotide sequence of VGAM393 RNA, herein designated VGAM RNA, also designated SEQ ID:3104.

Another function of VGAM393 is therefore inhibition of Fragile X Mental Retardation 1 (FMR1, Accession NM_002024). Accordingly, utilities of VGAM393 include diagnosis, prevention and treatment of diseases and clinical conditions associated with FMR1. Radixin (RDX, Accession NM_002906) is another VGAM393 host target gene. RDX BINDING SITE is HOST TARGET binding site found in the 3' untranslated region of mRNA encoded by RDX, corresponding to a HOST TARGET binding site such as BINDING SITE I, BINDING SITE II or BINDING SITE III. Table 2 illustrates the complementarity of the nucleotide sequences of RDX BINDING SITE, designated SEQ ID:8807, to the nucleotide sequence of VGAM393 RNA, herein designated VGAM RNA, also designated SEQ ID:3104.

Another function of VGAM393 is therefore inhibition of Radixin (RDX, Accession NM_002906), a gene which plays a crucial role in the binding of the barbed end of actin filaments to the plasma membrane. Accordingly, utilities of VGAM393 include diagnosis, prevention and treatment of diseases and clinical conditions associated with RDX. The function of RDX and its association with various diseases and clinical conditions, has been established by previous studies, as described hereinabove with reference to VGAM290. Chromosome 20 Open Reading Frame 130 (C20orf130, Accession XM_029741) is another VGAM393 host target gene. C20orf130 BINDING SITE is HOST TARGET binding site found in the 5' untranslated region of mRNA encoded by C20orf130, corresponding to a HOST TARGET binding site such as BINDING SITE I, BINDING SITE II or BINDING SITE III. Table 2 illustrates the complementarity of the nucleotide sequences of C20orf130 BINDING SITE, designated SEQ ID:30935, to the nucleotide sequence of VGAM393 RNA, herein designated VGAM RNA, also designated SEQ ID:3104.

Another function of VGAM393 is therefore inhibition of Chromosome 20 Open Reading Frame 130 (C20orf130, Accession XM_029741). Accordingly, utilities of VGAM393 include diagnosis, prevention and treatment of diseases and clinical conditions associated with C20orf130. CDK5 Regulatory Subunit Associated Protein 3 (CDK5RAP3, Accession NM_025197) is another VGAM393 host target gene. CDK5RAP3 BINDING SITE is HOST TARGET binding site found in the 5" untranslated region of mRNA encoded by CDK5RAP3, corresponding to a HOST TARGET binding site such as BINDING SITE I, BINDING SITE II or BINDING SITE III. Table 2 illustrates the complementarity of the nucleotide sequences of CDK5RAP3 BINDING SITE, designated SEQ ID:24853, to the nucleotide sequence of VGAM393 RNA, herein designated VGAM RNA, also designated SEQ ID:3104.

Another function of VGAM393 is therefore inhibition of CDK5 Regulatory Subunit Associated Protein 3 (CDK5RAP3, Accession NM_025197). Accordingly, utilities of VGAM393 include diagnosis, prevention and treatment of diseases and clinical conditions associated with CDK5RAP3. CXYorf1 (Accession XM_088704) is another VGAM393 host target gene. CXYorf1 BINDING SITE is HOST TARGET binding site found in the 5' untranslated region of mRNA encoded by CXYorf1, corresponding to a HOST TARGET binding site such as BINDING SITE I, BINDING SITE II or BINDING SITE III. Table 2 illustrates the complementarity of the nucleotide sequences of CXYorf1 BINDING SITE, designated SEQ ID:39902, to the nucleotide sequence of VGAM393 RNA, herein designated VGAM RNA, also designated SEQ ID:3104.

Another function of VGAM393 is therefore inhibition of CXYorf1 (Accession XM_088704). Accordingly, utilities of VGAM393 include diagnosis, prevention and treatment of diseases and clinical conditions associated with CXYorf1. FLJ12704 (Accession NM_024998) is another VGAM393 host target gene. FLJ12704 BINDING SITE is HOST TARGET binding site found in the 3' untranslated region of mRNA encoded by FLJ12704, corresponding to a HOST TARGET binding site such as BINDING SITE I, BINDING SITE II or BINDING SITE III. Table 2 illustrates the complementarity of the nucleotide sequences of FLJ12704 BINDING SITE, designated SEQ ID:24562, to the nucleotide sequence of VGAM393 RNA, herein designated VGAM RNA, also designated SEQ ID:3104.

Another function of VGAM393 is therefore inhibition of FLJ12704 (Accession NM_024998). Accordingly, utilities of VGAM393 include diagnosis, prevention and treatment of diseases and clinical conditions associated with FLJ12704. HCA4 (Accession XM_085287) is another VGAM393 host target gene. HCA4 BINDING SITE is HOST TARGET binding site found in the 3' untranslated region of mRNA encoded by HCA4, corresponding to a HOST TARGET binding site such as BINDING SITE I, BINDING SITE II or BINDING SITE III. Table 2 illustrates the complementarity of the nucleotide sequences of HCA4 BINDING SITE, designated SEQ ID:38026, to the nucleotide sequence of VGAM393 RNA, herein designated VGAM RNA, also designated SEQ ID:3104.

Another function of VGAM393 is therefore inhibition of HCA4 (Accession XM_085287). Accordingly, utilities of VGAM393 include diagnosis, prevention and treatment of diseases and clinical conditions associated with HCA4. KIAA0427 (Accession NM_014772) is another VGAM393 host target gene. KIAA0427 BINDING SITE is HOST TARGET binding site found in the 3' untranslated region of mRNA encoded by KIAA0427, corresponding to a HOST TARGET binding site such as BINDING SITE I, BINDING SITE II or BINDING SITE III. Table 2 illustrates the complementarity of the nucleotide sequences of KIAA0427 BINDING SITE, designated SEQ ID:16576, to the nucleotide sequence of VGAM393 RNA, herein designated VGAM RNA, also designated SEQ ID:3104.

Another function of VGAM393 is therefore inhibition of KIAA0427 (Accession NM_014772). Accordingly, utilities of VGAM393 include diagnosis, prevention and treatment of diseases and clinical conditions associated with KIAA0427. MSTP028 (Accession NM_031954) is another VGAM393 host target gene. MSTP028 BINDING SITE is HOST TARGET binding site found in the 3' untranslated region of mRNA encoded by MSTP028, corresponding to a HOST TARGET binding site such as BINDING SITE I, BINDING SITE II or BINDING SITE III. Table 2 illustrates the complementarity of the nucleotide sequences of MSTP028 BINDING SITE, designated SEQ ID:25695, to the nucleotide sequence of VGAM393 RNA, herein designated VGAM RNA, also designated SEQ ID:3104.

Another function of VGAM393 is therefore inhibition of MSTP028 (Accession NM_031954). Accordingly, utilities of VGAM393 include diagnosis, prevention and treatment of diseases and clinical conditions associated with MSTP028. LOC120939 (Accession XM_073688) is another VGAM393 host target gene. LOC120939 BINDING SITE is HOST TARGET binding site found in the 5' untranslated region of mRNA encoded by LOC120939, corresponding to a HOST TARGET binding site such as BINDING SITE I, BINDING SITE II or BINDING SITE III. Table 2 illustrates the complementarity of the nucleotide sequences of LOC120939 BINDING SITE, designated SEQ ID:37514, to the nucleotide sequence of VGAM393 RNA, herein designated VGAM RNA, also designated SEQ ID:3104.

Another function of VGAM393 is therefore inhibition of LOC120939 (Accession XM_073688). Accordingly, utilities of VGAM393 include diagnosis, prevention and treatment of diseases and clinical conditions associated with LOC120939. LOC149301 (Accession XM_086480) is another VGAM393 host target gene. LOC149301 BINDING SITE is HOST TARGET binding site found in the 3' untranslated region of mRNA encoded by LOC149301, corresponding to a HOST TARGET binding site such as BINDING SITE I, BINDING SITE II or BINDING SITE III. Table 2 illustrates the complementarity of the nucleotide sequences of LOC149301 BIND- ING SITE, designated SEQ ID:38688, to the nucleotide sequence of VGAM393 RNA, herein designated VGAM RNA, also designated SEQ ID:3104.

Another function of VGAM393 is therefore inhibition of LOC149301 (Accession XM_086480). Accordingly, utilities of VGAM393 include diagnosis, prevention and treatment of diseases and clinical conditions associated with LOC149301. LOC152274 (Accession XM_087418) is another VGAM393 host target gene. LOC152274 BINDING SITE is HOST TARGET binding site found in the 3' untranslated region of mRNA encoded by LOC152274, corresponding to a HOST TARGET binding site such as BINDING SITE I, BINDING SITE II or BINDING SITE III. Table 2 illustrates the complementarity of the nucleotide sequences of LOC152274 BINDING SITE, designated SEQ ID:39229, to the nucleotide sequence of VGAM393 RNA, herein designated VGAM RNA, also designated SEQ ID:3104.

Another function of VGAM393 is therefore inhibition of LOC152274 (Accession XM_087418). Accordingly, utilities of VGAM393 include diagnosis, prevention and treatment of diseases and clinical conditions associated with LOC152274. LOC200093 (Accession XM_032184) is another VGAM393 host target gene. LOC200093 BINDING SITE is HOST TARGET binding site found in the 5' untranslated region of mRNA encoded by LOC200093, corresponding to a HOST TARGET binding site such as BINDING SITE I, BINDING SITE II or BINDING SITE III. Table 2 illustrates the complementarity of the nucleotide sequences of LOC200093 BINDING SITE, designated SEQ ID:31594, to the nucleotide sequence of VGAM393 RNA, herein designated VGAM RNA, also designated SEQ ID:3104.

Another function of VGAM393 is therefore inhibition of LOC200093 (Accession XM_032184). Accordingly, utilities of VGAM393 include diagnosis, prevention and treatment of diseases and clinical conditions associated with LOC200093. FIG. 1 further provides a conceptual description of a novel bioinformatically detected viral gene of the present invention, referred to here as Viral Genomic Address Messenger 394 (VGAM394) viral gene, which modulates expression of respective host target genes thereof, the function and utility of which host target genes is known in the art.

VGAM394 is a novel bioinformatically detected regulatory, non protein coding, viral micro RNA (miRNA) gene. The method by which VGAM394 was detected is described hereinabove with reference to FIGS. 1-8.

VGAM394 gene, herein designated VGAM GENE, is a viral gene contained in the genome of Cryphonectria Hypovirus 1. VGAM394 host target gene, herein designated VGAM HOST TARGET GENE, is a human gene contained in the human genome.

VGAM394 gene encodes a VGAM394 precursor RNA, herein designated VGAM PRECURSOR RNA. Similar to other miRNA genes, and unlike most ordinary genes, VGAM394 precursor RNA does not encode a protein. A nucleotide sequence identical or highly similar to the nucleotide sequence of VGAM394 precursor RNA is designated SEQ ID:380, and is provided hereinbelow with reference to the sequence listing part. Nucleotide sequence SEQ ID:380 is located at position 4060 relative to the genome of Cryphonectria Hypovirus 1.

VGAM394 precursor RNA folds onto itself, forming VGAM394 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM394 folded precursor RNA into VGAM394 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM394 RNA is designated SEQ ID:3105, and is provided hereinbelow with reference to the sequence listing part.

VGAM394 host target gene, herein designated VGAM HOST TARGET GENE, encodes a corresponding messenger RNA, VGAM394 host target RNA, herein designated VGAM HOST TARGET RNA. VGAM394 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM394 RNA, herein designated VGAM RNA, binds complementarily to one or more host target binding sites located in untranslated regions of VGAM394 host target RNA, herein designated VGAM HOST TARGET RNA. This complementary binding is due to the fact that the nucleotide sequence of VGAM394 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM394 RNA, herein designated VGAM RNA, may have a different number of host target binding sites in untranslated regions of a VGAM394 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM394 RNA, herein designated VGAM RNA, to host target binding sites on VGAM394 host target RNA, herein designated VGAM HOST TARGET RNA, such as BINDING SITE I, BINDING SITE II and BINDING SITE III, inhibits translation of VGAM394 host target RNA into VGAM394 host target protein, herein designated VGAM HOST TARGET PROTEIN. VGAM host target protein is therefore outlined by a broken line.

It is appreciated that VGAM394 host target gene, herein designated VGAM HOST TARGET GENE, in fact represents a plurality of VGAM394 host target genes. The mRNA of each one of this plurality of VGAM394 host target genes comprises one or more host target binding sites, each having a nucleotide sequence which is at least partly complementary to VGAM394 RNA, herein designated VGAM RNA, and which when bound by VGAM394 RNA causes inhibition of translation of respective one or more VGAM394 host target proteins.

It is further appreciated by one skilled in the art that the mode of translational inhibition illustrated by FIG. 1 with specific reference to translational inhibition exerted by VGAM394 gene, herein designated VGAM GENE, on one or more VGAM394 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM394 is inhibition of expression of host target genes, as part of a novel viral mechanism of attacking a host. Accordingly, utilities of VGAM394 include diagnosis, prevention and treatment of viral infection by Cryphonectria Hypovirus 1. Specific functions, and accordingly utilities, of VGAM394 correlate with, and may be deduced from, the identity of the host target genes which VGAM394 binds and inhibits, and the function of these host target genes, as elaborated hereinbelow.

Nucleotide sequences of the VGAM394 precursor RNA, herein designated VGAM PRECURSOR RNA, and of the 'diced' VGAM394 RNA, herein designated VGAM RNA, and a schematic representation of the secondary folding of VGAM394 folded precursor RNA, herein designated VGAM FOLDED PRECURSOR RNA, of VGAM394 are further described hereinbelow with reference to Table 1.

Nucleotide sequences of host target binding sites, such as BINDING SITE-I, BINDING SITE-II and BINDING SITE-III of FIG. 1, found on VGAM394 host target RNA, and schematic representation of the complementarity of each of these host target binding sites to VGAM394 RNA, herein designated VGAM RNA, are described hereinbelow with reference to Table 2.

As mentioned hereinabove with reference to FIG. 1, a function of VGAM394 gene, herein designated VGAM is inhibition of expression of VGAM394 target genes. It is appreciated that specific functions, and accordingly utilities, of VGAM394 correlate with, and may be deduced from, the identity of the target genes which VGAM394 binds and inhibits, and the function of these target genes, as elaborated hereinbelow.

Aryl-hydrocarbon Receptor Nuclear Translocator 2 (ARNT2, Accession NM_014862) is a VGAM394 host target gene. ARNT2 BINDING SITE is HOST TARGET binding site found in the 3' untranslated region of mRNA encoded by ARNT2, corresponding to a HOST TARGET binding site such as BINDING SITE I, BINDING SITE II or BINDING SITE III. Table 2 illustrates the complementarity of the nucleotide sequences of ARNT2 BINDING SITE, designated SEQ ID:16935, to the nucleotide sequence of VGAM394 RNA, herein designated VGAM RNA, also designated SEQ ID:3105.

A function of VGAM394 is therefore inhibition of Aryl-hydrocarbon Receptor Nuclear Translocator 2 (ARNT2, Accession NM_014862), a gene which specifically recognizes the xenobiotic response element (xre). Accordingly, utilities of VGAM394 include diagnosis, prevention and treatment of diseases and clinical conditions associated with ARNT2. The function of ARNT2 and its association with various diseases and clinical conditions, has been established by previous studies, as described hereinabove with reference to VGAM345. CRACC (Accession NM_021181) is another VGAM394 host target gene. CRACC BINDING SITE is HOST TARGET binding site found in the 3' untranslated region of mRNA encoded by CRACC, corresponding to a HOST TARGET binding site such as BINDING SITE I, BINDING SITE II or BINDING SITE III. Table 2 illustrates the complementarity of the nucleotide sequences of CRACC BINDING SITE, designated SEQ ID:22155, to the nucleotide sequence of VGAM394 RNA, herein designated VGAM RNA, also designated SEQ ID:3105.

Another function of VGAM394 is therefore inhibition of CRACC (Accession NM_021181), a gene which may participate in adhesion reactions between t lymphocytes and accessory cells. Accordingly, utilities of VGAM394 include diagnosis, prevention and treatment of diseases and clinical conditions associated with CRACC. The function of CRACC and its association with various diseases and clinical conditions, has been established by previous studies, as described hereinabove with reference to VGAM26. DNA Fragmentation Factor, 40 kDa, Beta Polypeptide (caspase-activated DNase) (DFFB, Accession XM_113366) is another VGAM394 host target gene. DFFB BINDING SITE is HOST TARGET binding site found in the 3' untranslated region of mRNA encoded by DFFB, corresponding to a HOST TARGET binding site such as BINDING SITE I, BINDING SITE II or BINDING SITE III. Table 2 illustrates the complementarity of the nucleotide sequences of DFFB BINDING SITE, designated SEQ ID:42241, to the nucleotide sequence of VGAM394 RNA, herein designated VGAM RNA, also designated SEQ ID:3105.

Another function of VGAM394 is therefore inhibition of DNA Fragmentation Factor, 40 kDa, Beta Polypeptide (caspase-activated DNase) (DFFB, Accession XM_113366), a gene which induces DNA fragmentation and chromatin condensation during apoptosis. Accordingly, utilities of VGAM394 include diagnosis, prevention and treatment of diseases and clinical conditions associated with DFFB. The function of DFFB and its association with various diseases and clinical conditions, has been established by previous studies, as described hereinabove with reference to VGAM74. Glucose-6-phosphatase, Transport (glucose-6-phosphate) Protein 1 (G6PT1, Accession NM_001467) is another VGAM394 host target gene. G6PT1 BINDING SITE is HOST TARGET binding site found in the 5' untranslated region of mRNA encoded by G6PT1, corresponding to a HOST TARGET binding site such as BINDING SITE I, BINDING SITE II or BINDING SITE III. Table 2 illustrates the complementarity of the nucleotide sequences of G6PT1 BINDING SITE, designated SEQ ID:7201, to the nucleotide sequence of VGAM394 RNA, herein designated VGAM RNA, also designated SEQ ID:3105.

Another function of VGAM394 is therefore inhibition of Glucose-6-phosphatase, Transport (glucose-6-phosphate) Protein 1 (G6PT1, Accession NM_001467). Accordingly, utilities of VGAM394 include diagnosis, prevention and treatment of diseases and clinical conditions associated with G6PT1. Huntingtin (Huntington disease) (HD, Accession NM_002111) is another VGAM394 host target gene. HD BINDING SITE is HOST TARGET binding site found in the 3' untranslated region of mRNA encoded by HD, corresponding to a HOST TARGET binding site such as BINDING SITE I, BINDING SITE II or BINDING SITE III. Table 2 illustrates the complementarity of the nucleotide sequences of HD BINDING SITE, designated SEQ ID:7894, to the nucleotide sequence of VGAM394 RNA, herein designated VGAM RNA, also designated SEQ ID:3105.

Another function of VGAM394 is therefore inhibition of Huntingtin (Huntington disease) (HD, Accession NM_002111). Accordingly, utilities of VGAM394 include diagnosis, prevention and treatment of diseases and clinical conditions associated with HD. Vinculin (VCL, Accession NM_003373) is another VGAM394 host target gene. VCL BINDING SITE1 and VCL BINDING SITE2 are HOST TARGET binding sites found in untranslated regions of mRNA encoded by VCL, corresponding to HOST TARGET binding sites such as BINDING SITE I, BINDING SITE II or BINDING SITE III. Table 2 illustrates the complementarity of the nucleotide sequences of VCL BINDING SITE1 and VCL BINDING SITE2, designated SEQ ID:9407 and SEQ ID:15196 respectively, to the nucleotide sequence of VGAM394 RNA, herein designated VGAM RNA, also designated SEQ ID:3105.

Another function of VGAM394 is therefore inhibition of Vinculin (VCL, Accession NM_003373). Accordingly, utilities of VGAM394 include diagnosis, prevention and treatment of diseases and clinical conditions associated with VCL. FLJ10815 (Accession NM_018231) is another VGAM394 host target gene. FLJ10815 BINDING SITE is HOST TARGET binding site found in the 3' untranslated region of mRNA encoded by FLJ10815, corresponding to a HOST TARGET binding site such as BINDING SITE I, BINDING SITE II or BINDING SITE III. Table 2 illustrates the complementarity of the nucleotide sequences of FLJ10815 BINDING SITE, designated SEQ ID:20171, to the nucleotide sequence of VGAM394 RNA, herein designated VGAM RNA, also designated SEQ ID:3105.

Another function of VGAM394 is therefore inhibition of FLJ10815 (Accession NM_018231). Accordingly, utilities of VGAM394 include diagnosis, prevention and treatment of diseases and clinical conditions associated with FLJ10815. FLJ20320 (Accession NM_017765) is another VGAM394 host target gene. FLJ20320 BINDING SITE is HOST TARGET binding site found in the 3' untranslated region of mRNA encoded by FLJ20320, corresponding to a HOST TARGET binding site such as BINDING SITE I, BINDING SITE II or BINDING SITE III. Table 2 illustrates the complementarity of the nucleotide sequences of FLJ20320 BINDING SITE, designated SEQ ID:19382, to the nucleotide sequence of VGAM394 RNA, herein designated VGAM RNA, also designated SEQ ID:3105.

Another function of VGAM394 is therefore inhibition of FLJ20320 (Accession NM_017765). Accordingly, utilities of VGAM394 include diagnosis, prevention and treatment of diseases and clinical conditions associated with FLJ20320. FLJ23191 (Accession NM_024574) is another VGAM394 host target gene. FLJ23191 BINDING SITE is HOST TARGET binding site found in the 5' untranslated region of mRNA encoded by FLJ23191, corresponding to a HOST TARGET binding site such as BINDING SITE I, BINDING SITE II or BINDING SITE III. Table 2 illustrates the complementarity of the nucleotide sequences of FLJ23191 BINDING SITE, designated SEQ ID:23802, to the nucleotide sequence of VGAM394 RNA, herein designated VGAM RNA, also designated SEQ ID:3105.

Another function of VGAM394 is therefore inhibition of FLJ23191 (Accession NM_024574). Accordingly, utilities of VGAM394 include diagnosis, prevention and treatment of diseases and clinical conditions associated with FLJ23191. KIAA0449 (Accession NM_017596) is another VGAM394 host target gene. KIAA0449 BINDING SITE is HOST TARGET binding site found in the 3' untranslated region of mRNA encoded by KIAA0449, corresponding to a HOST TARGET binding site such as BINDING SITE I, BINDING SITE II or BINDING SITE III. Table 2 illustrates the complementarity of the nucleotide sequences of KIAA0449 BINDING SITE, designated SEQ ID:19050, to the nucleotide sequence of VGAM394 RNA, herein designated VGAM RNA, also designated SEQ ID:3105.

Another function of VGAM394 is therefore inhibition of KIAA0449 (Accession NM_017596). Accordingly, utilities of VGAM394 include diagnosis, prevention and treatment of diseases and clinical conditions associated with KIAA0449. TIP47 (Accession NM_005817) is another VGAM394 host target gene. TIP47 BINDING SITE is HOST TARGET binding site found in the 3' untranslated region of mRNA encoded by TIP47, corresponding to a HOST TARGET binding site such as BINDING SITE I, BINDING SITE II or BINDING SITE III. Table 2 illustrates the complementarity of the nucleotide sequences of TIP47 BINDING SITE, designated SEQ ID:12417, to the nucleotide sequence of VGAM394 RNA, herein designated VGAM RNA, also designated SEQ ID:3105.

Another function of VGAM394 is therefore inhibition of TIP47 (Accession NM_005817). Accordingly, utilities of VGAM394 include diagnosis, prevention and treatment of diseases and clinical conditions associated with TIP47. LOC145757 (Accession XM_085227) is another VGAM394 host target gene. LOC145757 BINDING SITE is HOST TARGET binding site found in the 5' untranslated region of mRNA encoded by LOC145757, corresponding to a HOST TARGET binding site such as BINDING SITE I, BINDING SITE II or BINDING SITE III. Table 2 illustrates the complementarity of the nucleotide sequences of LOC145757 BINDING SITE, designated SEQ ID:37969, to the nucleotide sequence of VGAM394 RNA, herein designated VGAM RNA, also designated SEQ ID:3105.

Another function of VGAM394 is therefore inhibition of LOC145757 (Accession XM_085227). Accordingly, utilities of VGAM394 include diagnosis, prevention and treatment of diseases and clinical conditions associated with LOC145757. LOC146481 (Accession XM_085484) is another VGAM394 host target gene. LOC146481 BINDING SITE is HOST TARGET binding site found in the 3' untranslated region of mRNA encoded by LOC146481, corresponding to a HOST TARGET binding site such as BINDING SITE I, BINDING SITE II or BINDING SITE III. Table 2 illustrates the complementarity of the nucleotide sequences of LOC146481 BINDING SITE, designated SEQ ID:38176, to the nucleotide sequence of VGAM394 RNA, herein designated VGAM RNA, also designated SEQ ID:3105.

Another function of VGAM394 is therefore inhibition of LOC146481 (Accession XM_085484). Accordingly, utilities of VGAM394 include diagnosis, prevention and treatment of diseases and clinical conditions associated with LOC146481. LOC90333 (Accession XM_030958) is another VGAM394 host target gene. LOC90333 BINDING SITE is HOST TARGET binding site found in the 3' untranslated region of mRNA encoded by LOC90333, corresponding to a HOST TARGET binding site such as BINDING SITE I, BINDING SITE II or BINDING SITE III. Table 2 illustrates the complementarity of the nucleotide sequences of LOC90333 BINDING SITE, designated SEQ ID:31224, to the nucleotide sequence of VGAM394 RNA, herein designated VGAM RNA, also designated SEQ ID:3105.

Another function of VGAM394 is therefore inhibition of LOC90333 (Accession XM_030958). Accordingly, utilities of VGAM394 include diagnosis, prevention and treatment of diseases and clinical conditions associated with LOC90333. FIG. 1 further provides a conceptual description of a novel bioinformatically detected viral gene of the present invention, referred to here as Viral Genomic Address Messenger 395 (VGAM395) viral gene, which modulates expression of respective host target genes thereof, the function and utility of which host target genes is known in the art.

VGAM395 is a novel bioinformatically detected regulatory, non protein coding, viral micro RNA (miRNA) gene. The method by which VGAM395 was detected is described hereinabove with reference to FIGS. 1-8.

VGAM395 gene, herein designated VGAM GENE, is a viral gene contained in the genome of Cryphonectria Hypovirus 1. VGAM395 host target gene, herein designated VGAM HOST TARGET GENE, is a human gene contained in the human genome.

VGAM395 gene encodes a VGAM395 precursor RNA, herein designated VGAM PRECURSOR RNA. Similar to other miRNA genes, and unlike most ordinary genes, VGAM395 precursor RNA does not encode a protein. A nucleotide sequence identical or highly similar to the nucleotide sequence of VGAM395 precursor RNA is designated SEQ ID:381, and is provided hereinbelow with reference to the sequence listing part. Nucleotide sequence SEQ ID:381 is located at position 9833 relative to the genome of Cryphonectria Hypovirus 1.

VGAM395 precursor RNA folds onto itself, forming VGAM395 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM395 folded precursor RNA into VGAM395 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM395 RNA is designated SEQ ID:3106, and is provided hereinbelow with reference to the sequence listing part.

VGAM395 host target gene, herein designated VGAM HOST TARGET GENE, encodes a corresponding messenger RNA, VGAM395 host target RNA, herein designated VGAM HOST TARGET RNA. VGAM395 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM395 RNA, herein designated VGAM RNA, binds complementarily to one or more host target binding sites located in untranslated regions of VGAM395 host target RNA, herein designated VGAM HOST TARGET RNA. This complementary binding is due to the fact that the nucleotide sequence of VGAM395 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM395 RNA, herein designated VGAM RNA, may have a different number of host target binding sites in untranslated regions of a VGAM395 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM395 RNA, herein designated VGAM RNA, to host target binding sites on VGAM395 host target RNA, herein designated VGAM HOST TARGET RNA, such as BINDING SITE I, BINDING SITE II and BINDING SITE III, inhibits translation of VGAM395 host target RNA into VGAM395 host target protein, herein designated VGAM HOST TARGET PROTEIN. VGAM host target protein is therefore outlined by a broken line.

It is appreciated that VGAM395 host target gene, herein designated VGAM HOST TARGET GENE, in fact represents a plurality of VGAM395 host target genes. The mRNA of each one of this plurality of VGAM395 host target genes comprises one or more host target binding sites, each having a nucleotide sequence which is at least partly complementary to VGAM395 RNA, herein designated VGAM RNA, and which when bound by VGAM395 RNA causes inhibition of translation of respective one or more VGAM395 host target proteins.

It is further appreciated by one skilled in the art that the mode of translational inhibition illustrated by FIG. 1 with specific reference to translational inhibition exerted by VGAM395 gene, herein designated VGAM GENE, on one or more VGAM395 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM395 is inhibition of expression of host target genes, as part of a novel viral mechanism of attacking a host. Accordingly, utilities of VGAM395 include diagnosis, prevention and treatment of viral infection by Cryphonectria Hypovirus 1. Specific functions, and accordingly utilities, of VGAM395 correlate with, and may be deduced from, the identity of the host target genes which VGAM395 binds and inhibits, and the function of these host target genes, as elaborated hereinbelow.

Nucleotide sequences of the VGAM395 precursor RNA, herein designated VGAM PRECURSOR RNA, and of the 'diced' VGAM395 RNA, herein designated VGAM RNA, and a schematic representation of the secondary folding of VGAM395 folded precursor RNA, herein designated VGAM FOLDED PRECURSOR RNA, of VGAM395 are further described hereinbelow with reference to Table 1.

Nucleotide sequences of host target binding sites, such as BINDING SITE-I, BINDING SITE-II and BINDING SITE-III of FIG. 1, found on VGAM395 host target RNA, and schematic representation of the complementarity of each of these host target binding sites to VGAM395 RNA, herein designated VGAM RNA, are described hereinbelow with reference to Table 2.

As mentioned hereinabove with reference to FIG. 1, a function of VGAM395 gene, herein designated VGAM is inhibition of expression of VGAM395 target genes. It is appreciated that specific functions, and accordingly utilities, of VGAM395 correlate with, and may be deduced from, the identity of the target genes which VGAM395 binds and inhibits, and the function of these target genes, as elaborated hereinbelow.

G Protein-coupled Receptor Kinase-interactor 2 (GIT2, Accession NM_014776) is a VGAM395 host target gene. GIT2 BINDING SITE1 through GIT2 BINDING SITE3 are HOST TARGET binding sites found in untranslated regions of mRNA encoded by GIT2, corresponding to HOST TAR- GET binding sites such as BINDING SITE I, BINDING SITE II or BINDING SITE III. Table 2 illustrates the complementarity of the nucleotide sequences of GIT2 BINDING SITE1 through GIT2 BINDING SITE3, designated SEQ ID:16606, SEQ ID:27688 and SEQ ID:27701 respectively, to the nucleotide sequence of VGAM395 RNA, herein designated VGAM RNA, also designated SEQ ID:3106.

A function of VGAM395 is therefore inhibition of G Protein-coupled Receptor Kinase-interactor 2 (GIT2, Accession NM_014776). Accordingly, utilities of VGAM395 include diagnosis, prevention and treatment of diseases and clinical conditions associated with GIT2. Zinc Finger Protein 36, C3H Type-like 2 (ZFP36L2, Accession NM_006887) is another VGAM395 host target gene. ZFP36L2 BINDING SITE is HOST TARGET binding site found in the 3' untranslated region of mRNA encoded by ZFP36L2, corresponding to a HOST TARGET binding site such as BINDING SITE I, BINDING SITE II or BINDING SITE III. Table 2 illustrates the complementarity of the nucleotide sequences of ZFP36L2 BINDING SITE, designated SEQ ID:13752, to the nucleotide sequence of VGAM395 RNA, herein designated VGAM RNA, also designated SEQ ID:3106.

Another function of VGAM395 is therefore inhibition of Zinc Finger Protein 36, C3H Type-like 2 (ZFP36L2, Accession NM_006887). Accordingly, utilities of VGAM395 include diagnosis, prevention and treatment of diseases and clinical conditions associated with ZFP36L2. FIG. 1 further provides a conceptual description of a novel bioinformatically detected viral gene of the present invention, referred to here as Viral Genomic Address Messenger 396 (VGAM396) viral gene, which modulates expression of respective host target genes thereof, the function and utility of which host target genes is known in the art.

VGAM396 is a novel bioinformatically detected regulatory, non protein coding, viral micro RNA (miRNA) gene. The method by which VGAM396 was detected is described hereinabove with reference to FIGS. 1-8.

VGAM396 gene, herein designated VGAM GENE, is a viral gene contained in the genome of Cryphonectria Hypovirus 1. VGAM396 host target gene, herein designated VGAM HOST TARGET GENE, is a human gene contained in the human genome.

VGAM396 gene encodes a VGAM396 precursor RNA, herein designated VGAM PRECURSOR RNA. Similar to other miRNA genes, and unlike most ordinary genes, VGAM396 precursor RNA does not encode a protein. A nucleotide sequence identical or highly similar to the nucleotide sequence of VGAM396 precursor RNA is designated SEQ ID:382, and is provided hereinbelow with reference to the sequence listing part. Nucleotide sequence SEQ ID:382 is located at position 2659 relative to the genome of Cryphonectria Hypovirus 1.

VGAM396 precursor RNA folds onto itself, forming VGAM396 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM396 folded precursor RNA into VGAM396 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM396 RNA is designated SEQ ID:3107, and is provided hereinbelow with reference to the sequence listing part.

VGAM396 host target gene, herein designated VGAM HOST TARGET GENE, encodes a corresponding messenger RNA, VGAM396 host target RNA, herein designated VGAM HOST TARGET RNA. VGAM396 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM396 RNA, herein designated VGAM RNA, binds complementarily to one or more host target binding sites located in untranslated regions of VGAM396 host target RNA, herein designated VGAM HOST TARGET RNA. This complementary binding is due to the fact that the nucleotide sequence of VGAM396 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM396 RNA, herein designated VGAM RNA, may have a different number of host target binding sites in untranslated regions of a VGAM396 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM396 RNA, herein designated VGAM RNA, to host target binding sites on VGAM396 host target RNA, herein designated VGAM HOST TARGET RNA, such as BINDING SITE I, BINDING SITE II and BINDING SITE III, inhibits translation of VGAM396 host target RNA into VGAM396 host target protein, herein designated VGAM HOST TARGET PROTEIN. VGAM host target protein is therefore outlined by a broken line.

It is appreciated that VGAM396 host target gene, herein designated VGAM HOST TARGET GENE, in fact represents a plurality of VGAM396 host target genes. The mRNA of each one of this plurality of VGAM396 host target genes comprises one or more host target binding sites, each having a nucleotide sequence which is at least partly complementary to VGAM396 RNA, herein designated VGAM RNA, and which when bound by VGAM396 RNA causes inhibition of translation of respective one or more VGAM396 host target proteins.

It is further appreciated by one skilled in the art that the mode of translational inhibition illustrated by FIG. 1 with specific reference to translational inhibition exerted by VGAM396 gene, herein designated VGAM GENE, on one or more VGAM396 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM396 is inhibition of expression of host target genes, as part of a novel viral mechanism of attacking a host. Accordingly, utilities of VGAM396 include diagnosis, prevention and treatment of viral infection by Cryphonectria Hypovirus 1. Specific functions, and accordingly utilities, of VGAM396 correlate with, and may be deduced from, the identity of the host target genes which VGAM396 binds and inhibits, and the function of these host target genes, as elaborated hereinbelow.

Nucleotide sequences of the VGAM396 precursor RNA, herein designated VGAM PRECURSOR RNA, and of the 'diced' VGAM396 RNA, herein designated VGAM RNA, and a schematic representation of the secondary folding of VGAM396 folded precursor RNA, herein designated VGAM FOLDED PRECURSOR RNA, of VGAM396 are further described hereinbelow with reference to Table 1.

Nucleotide sequences of host target binding sites, such as BINDING SITE-I, BINDING SITE-II and BINDING SITE-III of FIG. 1, found on VGAM396 host target RNA, and schematic representation of the complementarity of each of these host target binding sites to VGAM396 RNA, herein designated VGAM RNA, are described hereinbelow with reference to Table 2.

As mentioned hereinabove with reference to FIG. 1, a function of VGAM396 gene, herein designated VGAM is inhibition of expression of VGAM396 target genes. It is appreciated that specific functions, and accordingly utilities, of VGAM396 correlate with, and may be deduced from, the identity of the target genes which VGAM396 binds and inhibits, and the function of these target genes, as elaborated hereinbelow.

Thy-1 Cell Surface Antigen (THY1, Accession NM_006288) is a VGAM396 host target gene. THY1 BINDING SITE is HOST TARGET binding site found in the 3' untranslated region of mRNA encoded by THY1, corresponding to a HOST TARGET binding site such as BINDING SITE I, BINDING SITE II or BINDING SITE III. Table 2 illustrates the complementarity of the nucleotide sequences of THY1 BINDING SITE, designated SEQ ID:12975, to the nucleotide sequence of VGAM396 RNA, herein designated VGAM RNA, also designated SEQ ID:3107.

A function of VGAM396 is therefore inhibition of Thy-1 Cell Surface Antigen (THY1, Accession NM_006288), a gene which plays a role in cell-cell or cell-ligand interactions during synaptogenesis. Accordingly, utilities of VGAM396 include diagnosis, prevention and treatment of diseases and clinical conditions associated with THY1. The function of THY1 has been established by previous studies. Thy-1 is the designation for a major cell surface glycoprotein characteristic to T cells, as first defined in the mouse and rat (Raff, 1971; Letarte-Muirhead et al., 1975). The Thy-1 glycoproteins are constituents of thymocytes and neurons and probably are involved in cell-cell interactions. The putative human homolog of Thy-1 of the mouse is called K117. The human homolog of the rodent antigen was studied by Ades et al. (1980). Using a monoclonal antibody, McKenzie and Fabre (1981) studied the tissue distribution of the antigen. By use of a gene clone in somatic cell hybrids, Seki et al. (1985) assigned the THY1 gene to chromosome 11. Van den Elsen et al. (1985) predicted that the human Thy-1 homolog maps to chromosome 11 because that is where they found T3D (OMIM Ref. No. 186790) to map and in the mouse T3D and Thy-1 map to chromosome 9 along with certain other loci that are on human 11q. A multigene family is a group of homologous genes with similar function. A supergene family is a set of multigene families and single genes related by sequence (implying common ancestry) but not necessarily related in function. Hood et al. (1985) refer to the immunoglobulin supergene family which includes Thy-1, poly-Ig receptor, heavy, kappa and lambda immunoglobulins, Lyt-2 (T8), alpha and beta chains of T-cell antigen receptor and the closely homologous gamma chain, class I MHC antigen, beta-2-microglobulin, and the alpha and beta chains of class II MHC antigens. Thy-1 is structurally the simplest of these, consisting of a single immunoglobulin homology unit that is either intermediate between V and C or somewhat more similar to a V homology unit (Williams and Gagnon, 1982). The Thy-1 glycoprotein is also exceptional in that it is on the cell surface as a free homology unit and apparently does not associate either with itself or with other polypeptides. Its role in immune response is unclear. It is expressed on fibroblasts and brain cells in addition to some T cells. The significant role of Thy-1 in developing nervous tissue (Morris, 1985) may be of relevance to disorders such as ataxia-telangiectasia (OMIM Ref. No. 208900) that combine neurologic and immunologic defects. By somatic cell and in situ hybridization, van Rijs et al. (1985) localized the gene to 11q23-11q24. Rettig et al. (1985) assigned the gene to 11q13-qter, by Southern analysis of DNA from hybrid cells containing rearranged chromosomes 11. HGM7 gave the regional assignment as 11q22.3. Tunnacliffe and McGuire (1990) constructed a physical map of 11q23 by pulsed field gel electrophoresis and showed that THY1 lies in 11q23.3 as the most telomeric of a group of 6 genes: cen--CD3E--CD3D--CD3G--PBGD--CBL2--THY1--qter. Greenspan and O'Brien (1989) showed in the mouse that a factor secreted by nonneuronal accessory cells of dorsal root ganglion cultures stimulates neurite outgrowth in neonatal sympathetic ganglion neurons. They presented evidence that this is identical to Thy-1. It is this function in separate tissues that might explain pleiotropic manifestations of some syndromes such as ataxia-telangiectasia (OMIM Ref. No. 208900) or cartilage-hair hypoplasia (OMIM Ref. No. 250250).

Full details of the abovementioned studies are described in the following publications, the disclosure of which are hereby incorporated by reference:

Morris, R.: Thy-1 in developing nervous tissue. Dev. Neurosci. 7: 133-160, 1985; and Greenspan, R. J.; O'Brien, M. C.: Genetic evidence for the role of Thy-1 in neurite outgrowth in the mouse. J. Neurogenet. 5:25-36, 1989.

Further studies establishing the function and utilities of THY1 are found in John Hopkins OMIM database record ID 188230, and in sited publications numbered 9685-9690, 10262-9700, 88 and 10082-10084 listed in the bibliography section hereinbelow, which are also hereby incorporated by reference. DKFZp547I224 (Accession NM_020221) is another VGAM396 host target gene. DKFZp547I224 BINDING SITE is HOST TARGET binding site found in the 5' untranslated region of mRNA encoded by DKFZp547I224, corresponding to a HOST TARGET binding site such as BINDING SITE I, BINDING SITE II or BINDING SITE III. Table 2 illustrates the complementarity of the nucleotide sequences of DKFZp547I224 BINDING SITE, designated SEQ ID:21471, to the nucleotide sequence of VGAM396 RNA, herein designated VGAM RNA, also designated SEQ ID:3107.

Another function of VGAM396 is therefore inhibition of DKFZp547I224 (Accession NM_020221). Accordingly, utilities of VGAM396 include diagnosis, prevention and treatment of diseases and clinical conditions associated with DKFZp547I224. GTP Binding Protein 5 (putative) (GT- PBP5, Accession XM_037206) is another VGAM396 host target gene. GTPBP5 BINDING SITE is HOST TARGET binding site found in the 3' untranslated region of mRNA encoded by GTPBP5, corresponding to a HOST TARGET binding site such as BINDING SITE I, BINDING SITE II or BINDING SITE III. Table 2 illustrates the complementarity of the nucleotide sequences of GTPBP5 BINDING SITE, designated SEQ ID:32576, to the nucleotide sequence of VGAM396 RNA, herein designated VGAM RNA, also designated SEQ ID:3107.

Another function of VGAM396 is therefore inhibition of GTP Binding Protein 5 (putative) (GTPBP5, Accession XM_037206). Accordingly, utilities of VGAM396 include diagnosis, prevention and treatment of diseases and clinical conditions associated with GTPBP5. LOC145845 (Accession XM_096884) is another VGAM396 host target gene. LOC145845 BINDING SITE is HOST TARGET binding site found in the 3' untranslated region of mRNA encoded by LOC145845, corresponding to a HOST TARGET binding site such as BINDING SITE I, BINDING SITE II or BINDING SITE III. Table 2 illustrates the complementarity of the nucleotide sequences of LOC145845 BINDING SITE, designated SEQ ID:40615, to the nucleotide sequence of VGAM396 RNA, herein designated VGAM RNA, also designated SEQ ID:3107.

Another function of VGAM396 is therefore inhibition of LOC145845 (Accession XM_096884). Accordingly, utilities of VGAM396 include diagnosis, prevention and treatment of diseases and clinical conditions associated with LOC145845. FIG. 1 further provides a conceptual description of a novel bioinformatically detected viral gene of the present invention, referred to here as Viral Genomic Address Messenger 397 (VGAM397) viral gene, which modulates expression of respective host target genes thereof, the function and utility of which host target genes is known in the art.

VGAM397 is a novel bioinformatically detected regulatory, non protein coding, viral micro RNA (miRNA) gene. The method by which VGAM397 was detected is described hereinabove with reference to FIGS. 1-8.

VGAM397 gene, herein designated VGAM GENE, is a viral gene contained in the genome of Cryphonectria Hypovirus 1. VGAM397 host target gene, herein designated VGAM HOST TARGET GENE, is a human gene contained in the human genome.

VGAM397 gene encodes a VGAM397 precursor RNA, herein designated VGAM PRECURSOR RNA. Similar to other miRNA genes, and unlike most ordinary genes, VGAM397 precursor RNA does not encode a protein. A nucleotide sequence identical or highly similar to the nucleotide sequence of VGAM397 precursor RNA is designated SEQ ID:383, and is provided hereinbelow with reference to the sequence listing part. Nucleotide sequence SEQ ID:383 is located at position 5663 relative to the genome of Cryphonectria Hypovirus 1.

VGAM397 precursor RNA folds onto itself, forming VGAM397 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM397 folded precursor RNA into VGAM397 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM397 RNA is designated SEQ ID:3108, and is provided hereinbelow with reference to the sequence listing part.

VGAM397 host target gene, herein designated VGAM HOST TARGET GENE, encodes a corresponding messenger RNA, VGAM397 host target RNA, herein designated VGAM HOST TARGET RNA. VGAM397 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM397 RNA, herein designated VGAM RNA, binds complementarily to one or more host target binding sites located in untranslated regions of VGAM397 host target RNA, herein designated VGAM HOST TARGET RNA. This complementary binding is due to the fact that the nucleotide sequence of VGAM397 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM397 RNA, herein designated VGAM RNA, may have a different number of host target binding sites in untranslated regions of a VGAM397 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM397 RNA, herein designated VGAM RNA, to host target binding sites on VGAM397 host target RNA, herein designated VGAM HOST TARGET RNA, such as BINDING SITE I, BINDING SITE II and BINDING SITE III, inhibits translation of VGAM397 host target RNA into VGAM397 host target protein, herein designated VGAM HOST TARGET PROTEIN. VGAM host target protein is therefore outlined by a broken line.

It is appreciated that VGAM397 host target gene, herein designated VGAM HOST TARGET GENE, in fact represents a plurality of VGAM397 host target genes. The mRNA of each one of this plurality of VGAM397 host target genes comprises one or more host target binding sites, each having a nucleotide sequence which is at least partly complementary to VGAM397 RNA, herein designated VGAM RNA, and which when bound by VGAM397 RNA causes inhibition of translation of respective one or more VGAM397 host target proteins.

It is further appreciated by one skilled in the art that the mode of translational inhibition illustrated by FIG. 1 with specific reference to translational inhibition exerted by VGAM397 gene, herein designated VGAM GENE, on one or more VGAM397 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM397 is inhibition of expression of host target genes, as part of a novel viral mechanism of attacking a host. Accordingly, utilities of VGAM397 include diagnosis, prevention and treatment of viral infection by Cryphonectria Hypovirus 1. Specific functions, and accordingly utilities, of VGAM397 correlate with, and may be deduced from, the identity of the host target genes which VGAM397 binds and inhibits, and the function of these host target genes, as elaborated hereinbelow.

Nucleotide sequences of the VGAM397 precursor RNA, herein designated VGAM PRECURSOR RNA, and of the 'diced' VGAM397 RNA, herein designated VGAM RNA, and a schematic representation of the secondary folding of VGAM397 folded precursor RNA, herein designated VGAM FOLDED PRECURSOR RNA, of VGAM397 are further described hereinbelow with reference to Table 1.

Nucleotide sequences of host target binding sites, such as BINDING SITE-I, BINDING SITE-II and BINDING SITE-III of FIG. 1, found on VGAM397 host target RNA, and schematic representation of the complementarity of each of these host target binding sites to VGAM397 RNA, herein designated VGAM RNA, are described hereinbelow with reference to Table 2.

As mentioned hereinabove with reference to FIG. 1, a function of VGAM397 gene, herein designated VGAM is inhibition of expression of VGAM397 target genes. It is appreciated that specific functions, and accordingly utilities, of VGAM397 correlate with, and may be deduced from, the identity of the target genes which VGAM397 binds and inhibits, and the function of these target genes, as elaborated hereinbelow.

Solute Carrier Family 22 (organic cation transporter), Member 1-like Antisense (SLC22A1LS, Accession NM_007105) is a VGAM397 host target gene. SLC22A1LS BINDING SITE is HOST TARGET binding site found in the 5' untranslated region of mRNA encoded by SLC22A1LS, corresponding to a HOST TARGET binding site such as BINDING SITE I, BINDING SITE II or BINDING SITE III. Table 2 illustrates the complementarity of the nucleotide sequences of SLC22A1LS BINDING SITE, designated SEQ ID:13962, to the nucleotide sequence of VGAM397 RNA, herein designated VGAM RNA, also designated SEQ ID:3108.

A function of VGAM397 is therefore inhibition of Solute Carrier Family 22 (organic cation transporter), Member 1-like Antisense (SLC22A1LS, Accession NM_007105), a gene which may function in the regulation of the ORCTL2 gene. Accordingly, utilities of VGAM397 include diagnosis, prevention and treatment of diseases and clinical conditions associated with SLC22A1LS. The function of SLC22A1LS has been established by previous studies. Human chromosomal band 11p15.5 has been shown to contain genes involved in the development of several pediatric and adult tumors and in Beckwith-Wiedemann syndrome (BWS; 130650). Several genes in this region, including IGF2 (OMIM Ref. No. 147470), H19 (OMIM Ref. No. 103280), CDKN1C (OMIM Ref. No. 600856), IPL (TSSC3; 602131), and KVLQT1 (OMIM Ref. No. 192500), are known to undergo genomic imprinting. By genomic sequencing of overlapping PAC clones from 11p15.5, followed by the identification of matching ESTs, Cooper et al. (1998) identified the organic-cation transporter-like-2 (ORCTL2; 602631) and ORCTL2-antisense (ORCTL2S) (GenBank AF037066) genes. Northern blot analysis indicated that these genes are predominantly expressed in fetal and adult liver and kidney. The ORCTL2 and ORCTL2S genes overlap in their 5-prime regions in divergent orientations, with the first exon of ORCTL2S sharing 31 bp with the second exon of ORCTL2. The ORCTL2S gene contains 4 exons spread over approximately 12 kb. It may have multiple transcription start sites or promoters. The largest open reading frame within the full-length ORCTL2S cDNA isolated by the authors encodes a putative 253-amino acid protein. Since ORCTL2S showed no significant similarity to DNA or protein sequences in the databases and lacks good matches to the Kozak and polyadenylation consensus sequences, Cooper et al. (1998) suggested that the ORCTL2S gene may not be translated and may function in the regulation of the ORCTL2 gene. The authors were unable to determine if the ORCTL2S gene is imprinted. They did not detect disease-associated mutations in the ORCTL2S genes of 62 Wilms tumor (WT; 194071) patients or 10 BWS patients By genomic analysis of a 170-kb region at 11p15.5 between loci D11S601 and D11S679, Schwienbacher et al. (1998) identified 6 genes: NAP2 (OMIM Ref. No. 601651), CDKN1C, KVLQT1, BWR1A (ORCTL2, or SLC22A1L), BWR1B, and BWR1C (TSSC3), with BWR designating 'Beckwith-Wiedemann region.' Schwienbacher et al. (1998) cloned the full-length BWR1B cDNA from a human fetal liver cDNA library. The open reading frame encoded a protein of 253 amino acids with no significant homology to known proteins or motifs. Northern blot analysis revealed that the gene is expressed as a 1.2- to 1.3-kb mRNA most abundant in gastrointestinal tissues, but also detectable in kidney and placenta.

Full details of the abovementioned studies are described in the following publications, the disclosure of which are hereby incorporated by reference:

Cooper, P. R.; Smilinich, N. J.; Day, C. D.; Nowak, N. J.; Reid, L. H.; Pearsall, R. S.; Reece, M.; Prawitt, D.; Landers, J.; Housman, D. E.; Winterpacht, A.; Zabel, B. U.; Pelletier, J.; Weissman, B. E.; Shows, T. B.; Higgins, M. J.: Divergently transcribed overlapping genes expressed in liver and kidney and located in the 11p15.5 imprinted domain. Genomics 49:38-51, 1998; and Schwienbacher, C.; Sabbioni, S.; Campi, M.; Veronese, A.; Bernardi, G.; Menegatti, A.; Hatada, I.; Mukai, T.; Ohashi, H.; Barbanti-Brodano, G; Croce, C. M.; Negrini, M.: Transcriptional ma.

Further studies establishing the function and utilities of SLC22A1LS are found in John Hopkins OMIM database record ID 603240, and in sited publications numbered 8748 listed in the bibliography section hereinbelow, which are also hereby incorporated by reference. Rho/rac Guanine Nucleotide Exchange Factor (GEF) 2 (ARHGEF2, Accession NM_004723) is another VGAM397 host target gene. ARHGEF2 BINDING SITE is HOST TARGET binding site found in the 3' untranslated region of mRNA encoded by ARHGEF2, corresponding to a HOST TARGET binding site such as BINDING SITE I, BINDING SITE II or BINDING SITE III. Table 2 illustrates the complementarity of the nucleotide sequences of ARHGEF2 BINDING SITE, designated SEQ ID:11091, to the nucleotide sequence of VGAM397 RNA, herein designated VGAM RNA, also designated SEQ ID:3108.

Another function of VGAM397 is therefore inhibition of Rho/rac Guanine Nucleotide Exchange Factor (GEF) 2 (ARHGEF2, Accession NM_004723). Accordingly, utilities of VGAM397 include diagnosis, prevention and treatment of diseases and clinical conditions associated with ARHGEF2. FLJ12681 (Accession NM_022773) is another VGAM397 host target gene. FLJ12681 BINDING SITE is HOST TAR- GET binding site found in the 3" untranslated region of mRNA encoded by FLJ12681, corresponding to a HOST TARGET binding site such as BINDING SITE I, BINDING SITE II or BINDING SITE III. Table 2 illustrates the complementarity of the nucleotide sequences of FLJ12681 BINDING SITE, designated SEQ ID:23035, to the nucleotide sequence of VGAM397 RNA, herein designated VGAM RNA, also designated SEQ ID:3108.

Another function of VGAM397 is therefore inhibition of FLJ12681 (Accession NM_022773). Accordingly, utilities of VGAM397 include diagnosis, prevention and treatment of diseases and clinical conditions associated with FLJ12681. FLJ30213 (Accession NM_145008) is another VGAM397 host target gene. FLJ30213 BINDING SITE is HOST TARGET binding site found in the 3' untranslated region of mRNA encoded by FLJ30213, corresponding to a HOST TARGET binding site such as BINDING SITE I, BINDING SITE II or BINDING SITE III. Table 2 illustrates the complementarity of the nucleotide sequences of FLJ30213 BINDING SITE, designated SEQ ID:29608, to the nucleotide sequence of VGAM397 RNA, herein designated VGAM RNA, also designated SEQ ID:3108.

Another function of VGAM397 is therefore inhibition of FLJ30213 (Accession NM_145008). Accordingly, utilities of VGAM397 include diagnosis, prevention and treatment of diseases and clinical conditions associated with FLJ30213. LOC153688 (Accession XM_098416) is another VGAM397 host target gene. LOC153688 BINDING SITE is HOST TARGET binding site found in the 3' untranslated region of mRNA encoded by LOC153688, corresponding to a HOST TARGET binding site such as BINDING SITE I, BINDING SITE II or BINDING SITE III. Table 2 illustrates the complementarity of the nucleotide sequences of LOC153688 BINDING SITE, designated SEQ ID:41651, to the nucleotide sequence of VGAM397 RNA, herein designated VGAM RNA, also designated SEQ ID:3108.

Another function of VGAM397 is therefore inhibition of LOC153688 (Accession XM_098416). Accordingly, utilities of VGAM397 include diagnosis, prevention and treatment of diseases and clinical conditions associated with LOC153688. LOC222066 (Accession XM_166582) is another VGAM397 host target gene. LOC222066 BINDING SITE is HOST TARGET binding site found in the 3' untranslated region of mRNA encoded by LOC222066, corresponding to a HOST TARGET binding site such as BINDING SITE I, BINDING SITE II or BINDING SITE III. Table 2 illustrates the complementarity of the nucleotide sequences of LOC222066 BINDING SITE, designated SEQ ID:44552, to the nucleotide sequence of VGAM397 RNA, herein designated VGAM RNA, also designated SEQ ID:3108.

Another function of VGAM397 is therefore inhibition of LOC222066 (Accession XM_166582). Accordingly, utilities of VGAM397 include diagnosis, prevention and treatment of diseases and clinical conditions associated with LOC222066. LOC91464 (Accession XM_038589) is another VGAM397 host target gene. LOC91464 BINDING SITE is HOST TARGET binding site found in the 5' untranslated region of mRNA encoded by LOC91464, corresponding to a HOST TARGET binding site such as BINDING SITE I, BINDING SITE II or BINDING SITE III. Table 2 illustrates the complementarity of the nucleotide sequences of LOC91464 BINDING SITE, designated SEQ ID:32871, to the nucleotide sequence of VGAM397 RNA, herein designated VGAM RNA, also designated SEQ ID:3108.

Another function of VGAM397 is therefore inhibition of LOC91464 (Accession XM_038589). Accordingly, utilities of VGAM397 include diagnosis, prevention and treatment of diseases and clinical conditions associated with LOC91464.

FIG. 1 further provides a conceptual description of a novel bioinformatically detected viral gene of the present invention, referred to here as Viral Genomic Address Messenger 398 (VGAM398) viral gene, which modulates expression of respective host target genes thereof, the function and utility of which host target genes is known in the art.

VGAM398 is a novel bioinformatically detected regulatory, non protein coding, viral micro RNA (miRNA) gene. The method by which VGAM398 was detected is described hereinabove with reference to FIGS. 1-8.

VGAM398 gene, herein designated VGAM GENE, is a viral gene contained in the genome of Cryphonectria Hypovirus 1. VGAM398 host target gene, herein designated VGAM HOST TARGET GENE, is a human gene contained in the human genome.

VGAM398 gene encodes a VGAM398 precursor RNA, herein designated VGAM PRECURSOR RNA. Similar to other miRNA genes, and unlike most ordinary genes, VGAM398 precursor RNA does not encode a protein. A nucleotide sequence identical or highly similar to the nucleotide sequence of VGAM398 precursor RNA is designated SEQ ID:384, and is provided hereinbelow with reference to the sequence listing part. Nucleotide sequence SEQ ID:384 is located at position 5176 relative to the genome of Cryphonectria Hypovirus 1.

VGAM398 precursor RNA folds onto itself, forming VGAM398 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM398 folded precursor RNA into VGAM398 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM398 RNA is designated SEQ ID:3109, and is provided hereinbelow with reference to the sequence listing part.

VGAM398 host target gene, herein designated VGAM HOST TARGET GENE, encodes a corresponding messenger RNA, VGAM398 host target RNA, herein designated VGAM HOST TARGET RNA. VGAM398 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM398 RNA, herein designated VGAM RNA, binds complementarily to one or more host target binding sites located in untranslated regions of VGAM398 host target RNA, herein designated VGAM HOST TARGET RNA. This complementary binding is due to the fact that the nucleotide sequence of VGAM398 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM398 RNA, herein designated VGAM RNA, may have a different number of host target binding sites in untranslated regions of a VGAM398 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM398 RNA, herein designated VGAM RNA, to host target binding sites on VGAM398 host target RNA, herein designated VGAM HOST TARGET RNA, such as BINDING SITE I, BINDING SITE II and BINDING SITE III, inhibits translation of VGAM398 host target RNA into VGAM398 host target protein, herein designated VGAM HOST TARGET PROTEIN. VGAM host target protein is therefore outlined by a broken line.

It is appreciated that VGAM398 host target gene, herein designated VGAM HOST TARGET GENE, in fact represents a plurality of VGAM398 host target genes. The mRNA of each one of this plurality of VGAM398 host target genes comprises one or more host target binding sites, each having a nucleotide sequence which is at least partly complementary to VGAM398 RNA, herein designated VGAM RNA, and which when bound by VGAM398 RNA causes inhibition of translation of respective one or more VGAM398 host target proteins.

It is further appreciated by one skilled in the art that the mode of translational inhibition illustrated by FIG. 1 with specific reference to translational inhibition exerted by VGAM398 gene, herein designated VGAM GENE, on one or more VGAM398 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM398 is inhibition of expression of host target genes, as part of a novel viral mechanism of attacking a host. Accordingly, utilities of VGAM398 include diagnosis, prevention and treatment of viral infection by Cryphonectria Hypovirus 1. Specific functions, and accordingly utilities, of VGAM398 correlate with, and may be deduced from, the identity of the host target genes which VGAM398 binds and inhibits, and the function of these host target genes, as elaborated hereinbelow.

Nucleotide sequences of the VGAM398 precursor RNA, herein designated VGAM PRECURSOR RNA, and of the 'diced' VGAM398 RNA, herein designated VGAM RNA, and a schematic representation of the secondary folding of VGAM398 folded precursor RNA, herein designated VGAM FOLDED PRECURSOR RNA, of VGAM398 are further described hereinbelow with reference to Table 1.

Nucleotide sequences of host target binding sites, such as BINDING SITE-I, BINDING SITE-II and BINDING SITE-III of FIG. 1, found on VGAM398 host target RNA, and schematic representation of the complementarity of each of these host target binding sites to VGAM398 RNA, herein designated VGAM RNA, are described hereinbelow with reference to Table 2.

As mentioned hereinabove with reference to FIG. 1, a function of VGAM398 gene, herein designated VGAM is inhibition of expression of VGAM398 target genes. It is appreciated that specific functions, and accordingly utilities, of VGAM398 correlate with, and may be deduced from, the identity of the target genes which VGAM398 binds and inhibits, and the function of these target genes, as elaborated hereinbelow.

Cytochrome P450, Subfamily 46 (cholesterol 24-hydroxylase) (CYP46, Accession NM_006668) is a VGAM398 host target gene. CYP46 BINDING SITE is HOST TARGET binding site found in the 3' untranslated region of mRNA encoded by CYP46, corresponding to a HOST TARGET binding site such as BINDING SITE I, BINDING SITE II or BINDING SITE III. Table 2 illustrates the complementarity of the nucleotide sequences of CYP46 BINDING SITE, designated SEQ ID:13483, to the nucleotide sequence of VGAM398 RNA, herein designated VGAM RNA, also designated SEQ ID:3109.

A function of VGAM398 is therefore inhibition of Cytochrome P450, Subfamily 46 (cholesterol 24-hydroxylase) (CYP46, Accession NM_006668). Accordingly, utilities of VGAM398 include diagnosis, prevention and treatment of diseases and clinical conditions associated with CYP46. RalA Binding Protein 1 (RALBP1, Accession NM_006788) is another VGAM398 host target gene. RALBP1 BINDING SITE is HOST TARGET binding site found in the 3' untranslated region of mRNA encoded by RALBP1, corresponding to a HOST TARGET binding site such as BINDING SITE I, BINDING SITE II or BINDING SITE III. Table 2 illustrates the complementarity of the nucleotide sequences of RALBP1 BINDING SITE, designated SEQ ID:13663, to the nucleotide sequence of VGAM398 RNA, herein designated VGAM RNA, also designated SEQ ID:3109.

Another function of VGAM398 is therefore inhibition of RalA Binding Protein 1 (RALBP1, Accession NM_006788), a gene which plays a role in signal transduction and catalyzes the transport of glutathione conjugates and xenobiotics. Accordingly, utilities of VGAM398 include diagnosis, prevention and treatment of diseases and clinical conditions associated with RALBP1. The function of RALBP1 and its association with various diseases and clinical conditions, has been established by previous studies, as described hereinabove with reference to VGAM345. Chromosome 22 Open Reading Frame 19 (C22orf19, Accession NM_003678) is another VGAM398 host target gene. C22orf19 BINDING SITE is HOST TARGET binding site found in the 3' untranslated region of mRNA encoded by C22orf19, corresponding to a HOST TARGET binding site such as BINDING SITE I, BINDING SITE II or BINDING SITE III. Table 2 illustrates the complementarity of the nucleotide sequences of C22orf19 BINDING SITE, designated SEQ ID:9775, to the nucleotide sequence of VGAM398 RNA, herein designated VGAM RNA, also designated SEQ ID:3109.

Another function of VGAM398 is therefore inhibition of Chromosome 22 Open Reading Frame 19 (C22orf19, Accession NM_003678). Accordingly, utilities of VGAM398 include diagnosis, prevention and treatment of diseases and clinical conditions associated with C22orf19. FIG. 1 further provides a conceptual description of a novel bioinformatically detected viral gene of the present invention, referred to here as Viral Genomic Address Messenger 399 (VGAM399) viral gene, which modulates expression of respective host target genes thereof, the function and utility of which host target genes is known in the art.

VGAM399 is a novel bioinformatically detected regulatory, non protein coding, viral micro RNA (miRNA) gene. The method by which VGAM399 was detected is described hereinabove with reference to FIGS. 1-8.

VGAM399 gene, herein designated VGAM GENE, is a viral gene contained in the genome of Cryphonectria Hypovirus 1. VGAM399 host target gene, herein designated VGAM HOST TARGET GENE, is a human gene contained in the human genome.

VGAM399 gene encodes a VGAM399 precursor RNA, herein designated VGAM PRECURSOR RNA. Similar to other miRNA genes, and unlike most ordinary genes, VGAM399 precursor RNA does not encode a protein. A nucleotide sequence identical or highly similar to the nucleotide sequence of VGAM399 precursor RNA is designated SEQ ID:385, and is provided hereinbelow with reference to the sequence listing part. Nucleotide sequence SEQ ID:385 is located at position 2559 relative to the genome of Cryphonectria Hypovirus 1.

VGAM399 precursor RNA folds onto itself, forming VGAM399 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM399 folded precursor RNA into VGAM399 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM399 RNA is designated SEQ ID:3110, and is provided hereinbelow with reference to the sequence listing part.

VGAM399 host target gene, herein designated VGAM HOST TARGET GENE, encodes a corresponding messenger RNA, VGAM399 host target RNA, herein designated VGAM HOST TARGET RNA. VGAM399 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM399 RNA, herein designated VGAM RNA, binds complementarily to one or more host target binding sites located in untranslated regions of VGAM399 host target RNA, herein designated VGAM HOST TARGET RNA. This complementary binding is due to the fact that the nucleotide sequence of VGAM399 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM399 RNA, herein designated VGAM RNA, may have a different number of host target binding sites in untranslated regions of a VGAM399 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM399 RNA, herein designated VGAM RNA, to host target binding sites on VGAM399 host target RNA, herein designated VGAM HOST TARGET RNA, such as BINDING SITE I, BINDING SITE II and BINDING SITE III, inhibits translation of VGAM399 host target RNA into VGAM399 host target protein, herein designated VGAM HOST TARGET PROTEIN. VGAM host target protein is therefore outlined by a broken line.

It is appreciated that VGAM399 host target gene, herein designated VGAM HOST TARGET GENE, in fact represents a plurality of VGAM399 host target genes. The mRNA of each one of this plurality of VGAM399 host target genes comprises one or more host target binding sites, each having a nucleotide sequence which is at least partly complementary to VGAM399 RNA, herein designated VGAM RNA, and which when bound by VGAM399 RNA causes inhibition of translation of respective one or more VGAM399 host target proteins.

It is further appreciated by one skilled in the art that the mode of translational inhibition illustrated by FIG. 1 with specific reference to translational inhibition exerted by VGAM399 gene, herein designated VGAM GENE, on one or more VGAM399 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM399 is inhibition of expression of host target genes, as part of a novel viral mechanism of attacking a host. Accordingly, utilities of VGAM399 include diagnosis, prevention and treatment of viral infection by Cryphonectria Hypovirus 1. Specific functions, and accordingly utilities, of VGAM399 correlate with, and may be deduced from, the identity of the host target genes which VGAM399 binds and inhibits, and the function of these host target genes, as elaborated hereinbelow.

Nucleotide sequences of the VGAM399 precursor RNA, herein designated VGAM PRECURSOR RNA, and of the 'diced' VGAM399 RNA, herein designated VGAM RNA, and a schematic representation of the secondary folding of VGAM399 folded precursor RNA, herein designated VGAM FOLDED PRECURSOR RNA, of VGAM399 are further described hereinbelow with reference to Table 1.

Nucleotide sequences of host target binding sites, such as BINDING SITE-I, BINDING SITE-II and BINDING SITE-III of FIG. 1, found on VGAM399 host target RNA, and schematic representation of the complementarity of each of these host target binding sites to VGAM399 RNA, herein designated VGAM RNA, are described hereinbelow with reference to Table 2.

As mentioned hereinabove with reference to FIG. 1, a function of VGAM399 gene, herein designated VGAM is inhibition of expression of VGAM399 target genes. It is appreciated that specific functions, and accordingly utilities, of VGAM399 correlate with, and may be deduced from, the identity of the target genes which VGAM399 binds and inhibits, and the function of these target genes, as elaborated hereinbelow.

Deleted In Azoospermia-like (DAZL, Accession XM_042839) is a VGAM399 host target gene. DAZL BINDING SITE is HOST TARGET binding site found in the 3' untranslated region of mRNA encoded by DAZL, corresponding to a HOST TARGET binding site such as BIND- ING SITE I, BINDING SITE II or BINDING SITE III. Table 2 illustrates the complementarity of the nucleotide sequences of DAZL BINDING SITE, designated SEQ ID:33802, to the nucleotide sequence of VGAM399 RNA, herein designated VGAM RNA, also designated SEQ ID:3110.

A function of VGAM399 is therefore inhibition of Deleted In Azoospermia-like (DAZL, Accession XM_042839), a gene which may be essential for gametogenesis. Accordingly, utilities of VGAM399 include diagnosis, prevention and treatment of diseases and clinical conditions associated with DAZL. The function of DAZL and its association with various diseases and clinical conditions, has been established by previous studies, as described hereinabove with reference to VGAM206. Exonuclease 1 (EXO1, Accession NM_130398) is another VGAM399 host target gene. EXO1 BINDING SITE is HOST TARGET binding site found in the 5' untranslated region of mRNA encoded by EXO1, corresponding to a HOST TARGET binding site such as BINDING SITE I, BINDING SITE II or BINDING SITE III. Table 2 illustrates the complementarity of the nucleotide sequences of EXO1 BINDING SITE, designated SEQ ID:28181, to the nucleotide sequence of VGAM399 RNA, herein designated VGAM RNA, also designated SEQ ID:3110.

Another function of VGAM399 is therefore inhibition of Exonuclease 1 (EXO1, Accession NM_130398), a gene which excise and replace mismatched segments. Accordingly, utilities of VGAM399 include diagnosis, prevention and treatment of diseases and clinical conditions associated with EXO1. The function of EXO1 has been established by previous studies. Mutation rates in normal cells are low due to the existence of DNA repair systems in which exonucleases, endonucleases, and helicases excise and replace mismatched segments. By searching an EST database for homologs of the yeast Exo1 gene, Wilson et al. (1998) identified a cDNA encoding human EXO1, which they termed HEX1. Sequence analysis predicted that the 803-amino acid human protein, which is 26% identical to the yeast protein, contains 2 potential nuclear localization signals, one in its central region and the other in its C-terminal region. Functional analysis indicated that EXO1 has exonuclease activity with a 5-prime-to-3-prime polarity. Northern blot analysis revealed high expression of an approximately 4.0-kb transcript in fetal liver and adult bone marrow, with low levels in other tissues, suggesting that EXO1 may function prominently in DNA metabolic processes occurring during stem cell differentiation. Schmutte et al. (1998) cloned EXO1, which they predicted encodes an 846-amino acid protein. GST pull-down analysis determined that EXO1 interacts with MSH2 (OMIM Ref. No. 120435), which is involved in susceptibility to familial nonpolyposis colon cancer. Tishkoff et al. (1998) cloned EXO1 and showed that it encodes 2 splice variants, EXO1A and EXO1B, that share the first 802 residues and have C-terminal extensions of 1 and 44 amino acids, respectively. Northern blot analysis detected wide expression of a 3.0-kb transcript, with significantly higher expression in testis, and elevated expression in thymus, colon, and placenta. By FISH, Wilson et al. (1998) mapped the EXO1 gene to 1q42-q43.

Full details of the abovementioned studies are described in the following publications, the disclosure of which are hereby incorporated by reference:

Wilson, D. M., III; Carney, J. P.; Coleman, M. A.; Adamson, A. W.; Christensen, M.; Lamerdin, J. E.: Hex1: a new human Rad2 nuclease family member with homology to yeast exonuclease 1. Nucleic Acids Res. 26:3762-3768, 1998; and Tishkoff, D. X.; Amin, N. S.; Viars, C. S.; Arden, K. C.; Kolodner, R. D.: Identification of a human gene encoding a homologue of Saccharomyces cerevisiae EXO1, an exonuclease implicate.

Further studies establishing the function and utilities of EXO1 are found in John Hopkins OMIM database record ID 606063, and in sited publications numbered 6903-6906 listed in the bibliography section hereinbelow, which are also hereby incorporated by reference. Folate Receptor 1 (adult) (FOLR1, Accession NM_016730) is another VGAM399 host target gene. FOLR1 BINDING SITE is HOST TARGET binding site found in the 5' untranslated region of mRNA encoded by FOLR1, corresponding to a HOST TARGET binding site such as BINDING SITE I, BINDING SITE II or BINDING SITE III. Table 2 illustrates the complementarity of the nucleotide sequences of FOLR1 BINDING SITE, designated SEQ ID:18782, to the nucleotide sequence of VGAM399 RNA, herein designated VGAM RNA, also designated SEQ ID:3110.

Another function of VGAM399 is therefore inhibition of Folate Receptor 1 (adult) (FOLR1, Accession NM_016730), a gene which binds and initiates transport of folate and methotrexate. Accordingly, utilities of VGAM399 include diagnosis, prevention and treatment of diseases and clinical conditions associated with FOLR1. The function of FOLR1 has been established by previous studies. To identify cellular entry factors employed by the Marburg (MBG) virus, Chan et al. (2001) used noninfectible cells transduced with an expression library and challenged them with a selectable pseudotype virus packaged by MBG glycoproteins. A cDNA encoding FOLR1 was recovered from cells exhibiting reconstitution of viral entry. A FOLR1 cDNA was also recovered in a similar strategy employing Ebola (EBO) pseudotypes. FOLR1 expression in Jurkat cells facilitated MBG or EBO entry, and FR-blocking reagents inhibited infection by MBG or EBO. Finally, FOLR1 bound cells expressing MBG or EBO glycoproteins and mediated syncytia formation triggered by MBG glycoproteins. The authors concluded that FOLR1 is a significant cofactor for cellular entry for MBG and EBO viruses. Animal model experiments lend further support to the function of FOLR1. Periconceptional folic acid supplementation reduces the occurrence of several human congenital malformations, including craniofacial, heart, and neural tube defects (Czeizel and Dudas, 1992; Werler et al., 1993; Shaw et al., 1994). Although the underlying mechanism is unknown, there may be a maternal-to-fetal folate transport defect or an inherent fetal biochemical disorder that is neutralized by supplementation. To determine whether folic acid-binding protein-1 is involved in maternal-to-fetal folate transport, Piedrahita et al. (1999) inactivated the gene (symbolized Folbp1 in that species) in mice. They also produced mice lacking Folbp2 (FOLR2; 136425), another member of the folate receptor family that is GPI-anchored but binds folate poorly. Folbp2 -/- embryos developed normally, but Folbp1 -/- embryos had severe morphogenetic abnormalities and died in utero by embryonic day 10. Supplementing pregnant Folbp1 +/- dams with folinic acid reversed this phenotype in nullizygous pups. The results suggested that Folbp1 has a critical role in folate homeostasis during development, and that functional defects in the human homolog, FOLR1, may contribute to similar defects in human S.

It is appreciated that the abovementioned animal model for FOLR1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chan, S. Y.; Empig, C. J.; Welte, F. J.; Speck, R. F.; Schmaljohn, A.; Kreisberg, J. F.; Goldsmith, M. A.: Folate receptor-alpha is a cofactor for cellular entry by Marburg and Ebola viruses. Cell 106:117-126, 2001; and Piedrahita, J. A.; Oetama, B.; Bennett, G. D.; van Waes, J.; Kamen, B. A.; Richardson, J.; Lacey, S. W.; Anderson, R. G. W.; Finnell, R. H.: Mice lacking the folic acid-binding protei.

Further studies establishing the function and utilities of FOLR1 are found in John Hopkins OMIM database record ID 136430, and in sited publications numbered 11715-11717, 11877-11881, 3591, 359 and 11714-3595 listed in the bibliography section hereinbelow, which are also hereby incorporated by reference. Protein Phosphatase 2 (formerly 2A), Catalytic Subunit, Alpha Isoform (PPP2CA, Accession NM_002715) is another VGAM399 host target gene. PPP2CA BINDING SITE is HOST TARGET binding site found in the 3' untranslated region of mRNA encoded by PPP2CA, corresponding to a HOST TARGET binding site such as BINDING SITE I, BINDING SITE II or BINDING SITE III. Table 2 illustrates the complementarity of the nucleotide sequences of PPP2CA BINDING SITE, designated SEQ ID:8581, to the nucleotide sequence of VGAM399 RNA, herein designated VGAM RNA, also designated SEQ ID:3110.

Another function of VGAM399 is therefore inhibition of Protein Phosphatase 2 (formerly 2A), Catalytic Subunit, Alpha Isoform (PPP2CA, Accession NM_002715), a gene which plays a role in the regulation of most major metabolic pathways. Accordingly, utilities of VGAM399 include diagnosis, prevention and treatment of diseases and clinical conditions associated with PPP2CA. The function of PPP2CA has been established by previous studies. Protein phosphorylation, a crucial posttranslational modification step controlling many diverse cellular functions, is dependent on the opposing actions of protein kinases and protein phosphatases. The enzyme protein phosphatase 2A is 1 of 4 major protein phosphatases identified in the cytosol of eukaryotic cells which are responsible for the dephosphorylation of serine and threonine residues in proteins. Although all 4 protein phosphatases, PP1, PP2A, PP2B, and PP2C, have overlapping substrate specificities in vitro, they can be distinguished by the use of inhibitor proteins and by their dependence on metal ions. PP1 is inhibited by nanomolar concentrations of 2 thermostable proteins, inhibitor 1 and inhibitor 2, whereas the type 2 phosphatases are unaffected by these inhibitors. The type 2 phosphatases can be distinguished by how their activity is regulated: PP2A activity is independent of metal ions, PP2B is activated by Ca (2+)/calmodulin, and PP2C is activated by Mg (2+) (Cohen and Cohen, 1989). Protein phosphatase 2A appears to play a role in the regulation of most major metabolic pathways, as well as translation, transcription, and control of transition from G2 to the M phase of the cell cycle. PP2A may function as either a tumor promoter or tumor suppressor, depending on the cell type or the transforming agent. The mammalian enzyme can be isolated as a catalytic subunit of 36 kD complexed to 1 regulatory subunit of 65 kD and to another regulatory subunit of varying molecular mass, depending on the tissue and the separation technique used. Two isoforms of the catalytic subunit of PP2A, alpha and beta (OMIM Ref. No. 176916), are demonstrable in many mammalian species. The structures of these catalytic subunits show the highest evolutionary conservation of all known enzymes, supporting the idea that they may serve crucial functions. Stone et al. (1988) isolated the human cDNA for the PPP2CA subunit from lung and lung fibroblast libraries. The cDNA encodes a 309-amino acid polypeptide. Groves et al. (1999) reported that the crystal structure of the PPP2CA subunit at 2.3-angstrom resolution revealed the conformation of its 15 tandemly repeated 'heat' sequences, degenerate motifs of 39 amino acids present in a variety of proteins, including huntingtin (OMIM Ref. No. 143100) and importin-beta (see OMIM Ref. No. 602738). Individual motifs are composed of a pair of antiparallel alpha-helices that assemble in a mainly linear, repetitive fashion to form an elongated molecule characterized by a double layer of alpha-helices. The protein interaction interface is formed from the intrarepeat turns that are aligned to form a continuous ridge.

Full details of the abovementioned studies are described in the following publications, the disclosure of which are hereby incorporated by reference:

Cohen, P.; Cohen, P. T. W.: Protein phosphatases come of age. J. Biol. Chem. 264:21435-21438, 1989; and Groves, M. R.; Hanlon, N.; Turowski, P.; Hemmings, B. A.; Barford, D.: The structure of the protein phosphatase 2A PR65/A subunit reveals the conformation of its 15 tandemly repeated HE.

Further studies establishing the function and utilities of PPP2CA are found in John Hopkins OMIM database record ID 176915, and in sited publications numbered 2522-2525 listed in the bibliography section hereinbelow, which are also hereby incorporated by reference. TAR (HIV) RNA Binding Protein 2 (TARBP2, Accession NM_134324) is another VGAM399 host target gene. TARBP2 BINDING SITE is HOST TARGET binding site found in the 3' untranslated region of mRNA encoded by TARBP2, corresponding to a HOST TARGET binding site such as BINDING SITE I, BINDING SITE II or BINDING SITE III. Table 2 illustrates the complementarity of the nucleotide sequences of TARBP2 BINDING SITE, designated SEQ ID:28626, to the nucleotide sequence of VGAM399 RNA, herein designated VGAM RNA, also designated SEQ ID:3110.

Another function of VGAM399 is therefore inhibition of TAR (HIV) RNA Binding Protein 2 (TARBP2, Accession NM_134324), a gene which is involved in the regulation of HIV replication. Accordingly, utilities of VGAM399 include diagnosis, prevention and treatment of diseases and clinical conditions associated with TARBP2. The function of TARBP2 and its association with various diseases and clinical conditions, has been established by previous studies, as described hereinabove with reference to VGAM95. FLJ20136 (Accession NM_017684) is another VGAM399 host target gene. FLJ20136 BINDING SITE is HOST TARGET binding site found in the 3' untranslated region of mRNA encoded by FLJ20136, corresponding to a HOST TARGET binding site such as BINDING SITE I, BINDING SITE II or BINDING SITE III. Table 2 illustrates the complementarity of the nucleotide sequences of FLJ20136 BINDING SITE, designated SEQ ID:19233, to the nucleotide sequence of VGAM399 RNA, herein designated VGAM RNA, also designated SEQ ID:3110.

Another function of VGAM399 is therefore inhibition of FLJ20136 (Accession NM_017684). Accordingly, utilities of VGAM399 include diagnosis, prevention and treatment of diseases and clinical conditions associated with FLJ20136. KIAA0433 (Accession NM_015216) is another VGAM399 host target gene. KIAA0433 BINDING SITE is HOST TARGET binding site found in the 3' untranslated region of mRNA encoded by KIAA0433, corresponding to a HOST TARGET binding site such as BINDING SITE I, BINDING SITE II or BINDING SITE III. Table 2 illustrates the complementarity of the nucleotide sequences of KIAA0433 BINDING SITE, designated SEQ ID:17545, to the nucleotide sequence of VGAM399 RNA, herein designated VGAM RNA, also designated SEQ ID:3110.

Another function of VGAM399 is therefore inhibition of KIAA0433 (Accession NM_015216). Accordingly, utilities of VGAM399 include diagnosis, prevention and treatment of diseases and clinical conditions associated with KIAA0433. KIAA0446 (Accession XM_044155) is another VGAM399 host target gene. KIAA0446 BINDING SITE is HOST TARGET binding site found in the 3' untranslated region of mRNA encoded by KIAA0446, corresponding to a HOST TARGET binding site such as BINDING SITE I, BINDING SITE II or BINDING SITE III. Table 2 illustrates the complementarity of the nucleotide sequences of KIAA0446 BINDING SITE, designated SEQ ID:34143, to the nucleotide sequence of VGAM399 RNA, herein designated VGAM RNA, also designated SEQ ID:3110.

Another function of VGAM399 is therefore inhibition of KIAA0446 (Accession XM_044155). Accordingly, utilities of VGAM399 include diagnosis, prevention and treatment of diseases and clinical conditions associated with KIAA0446. KIAA1826 (Accession XM_040784) is another VGAM399 host target gene. KIAA1826 BINDING SITE is HOST TARGET binding site found in the 5' untranslated region of mRNA encoded by KIAA1826, corresponding to a HOST TARGET binding site such as BINDING SITE I, BINDING SITE II or BINDING SITE III. Table 2 illustrates the complementarity of the nucleotide sequences of KIAA1826 BINDING SITE, designated SEQ ID:33375, to the nucleotide sequence of VGAM399 RNA, herein designated VGAM RNA, also designated SEQ ID:3110.

Another function of VGAM399 is therefore inhibition of KIAA1826 (Accession XM_040784). Accordingly, utilities of VGAM399 include diagnosis, prevention and treatment of diseases and clinical conditions associated with KIAA1826. Kinesin Family Member 13B (KIF13B, Accession XM_096266) is another VGAM399 host target gene. KIF13B BINDING SITE1 and KIF13B BINDING SITE2 are HOST TARGET binding sites found in untranslated regions of mRNA encoded by KIF13B, corresponding to HOST TARGET binding sites such as BINDING SITE I, BINDING SITE II or BINDING SITE III. Table 2 illustrates the complementarity of the nucleotide sequences of KIF13B BINDING SITE1 and KIF13B BINDING SITE2, designated SEQ ID:40309 and SEQ ID:17581 respectively, to the nucleotide sequence of VGAM399 RNA, herein designated VGAM RNA, also designated SEQ ID:3110.

Another function of VGAM399 is therefore inhibition of Kinesin Family Member 13B (KIF13B, Accession XM_096266). Accordingly, utilities of VGAM399 include diagnosis, prevention and treatment of diseases and clinical conditions associated with KIF13B. LOC253675 (Accession XM_172990) is another VGAM399 host target gene. LOC253675 BINDING SITE is HOST TARGET binding site found in the 5' untranslated region of mRNA encoded by LOC253675, corresponding to a HOST TARGET binding site such as BINDING SITE I, BINDING SITE II or BINDING SITE III. Table 2 illustrates the complementarity of the nucleotide sequences of LOC253675 BINDING SITE, designated SEQ ID:46262, to the nucleotide sequence of VGAM399 RNA, herein designated VGAM RNA, also designated SEQ ID:3110.

Another function of VGAM399 is therefore inhibition of LOC253675 (Accession XM_172990). Accordingly, utilities of VGAM399 include diagnosis, prevention and treatment of diseases and clinical conditions associated with LOC253675. LOC255919 (Accession XM_170794) is another VGAM399 host target gene. LOC255919 BINDING SITE is HOST TARGET binding site found in the 3' untranslated region of mRNA encoded by LOC255919, corresponding to a HOST TARGET binding site such as BINDING SITE I, BINDING SITE II or BINDING SITE III. Table 2 illustrates the complementarity of the nucleotide sequences of LOC255919 BINDING SITE, designated SEQ ID:45557, to the nucleotide sequence of VGAM399 RNA, herein designated VGAM RNA, also designated SEQ ID:3110.

Another function of VGAM399 is therefore inhibition of LOC255919 (Accession XM_170794). Accordingly, utilities of VGAM399 include diagnosis, prevention and treatment of diseases and clinical conditions associated with LOC255919. LOC91012 (Accession XM_035503) is another VGAM399 host target gene. LOC91012 BINDING SITE is HOST TARGET binding site found in the 5' untranslated region of mRNA encoded by LOC91012, corresponding to a HOST TARGET binding site such as BINDING SITE I, BINDING SITE II or BINDING SITE III. Table 2 illustrates the complementarity of the nucleotide sequences of LOC91012 BINDING SITE, designated SEQ ID:32279, to the nucleotide sequence of VGAM399 RNA, herein designated VGAM RNA, also designated SEQ ID:3110.

Another function of VGAM399 is therefore inhibition of LOC91012 (Accession XM_035503). Accordingly, utilities of VGAM399 include diagnosis, prevention and treatment of diseases and clinical conditions associated with LOC91012. LOC92539 (Accession XM_045632) is another VGAM399 host target gene. LOC92539 BINDING SITE is HOST TARGET binding site found in the 3' untranslated region of mRNA encoded by LOC92539, corresponding to a HOST TARGET binding site such as BINDING SITE I, BINDING SITE II or BINDING SITE III. Table 2 illustrates the complementarity of the nucleotide sequences of LOC92539 BINDING SITE, designated SEQ ID:34496, to the nucleotide sequence of VGAM399 RNA, herein designated VGAM RNA, also designated SEQ ID:3110.

Another function of VGAM399 is therefore inhibition of LOC92539 (Accession XM_045632). Accordingly, utilities of VGAM399 include diagnosis, prevention and treatment of diseases and clinical conditions associated with LOC92539. FIG. 1 further provides a conceptual description of a novel bioinformatically detected viral gene of the present invention, referred to here as Viral Genomic Address Messenger 400 (VGAM400) viral gene, which modulates expression of respective host target genes thereof, the function and utility of which host target genes is known in the art.

VGAM400 is a novel bioinformatically detected regulatory, non protein coding, viral micro RNA (miRNA) gene. The method by which VGAM400 was detected is described hereinabove with reference to FIGS. 1-8.

VGAM400 gene, herein designated VGAM GENE, is a viral gene contained in the genome of Cryphonectria Hypovirus 1. VGAM400 host target gene, herein designated VGAM HOST TARGET GENE, is a human gene contained in the human genome.

VGAM400 gene encodes a VGAM400 precursor RNA, herein designated VGAM PRECURSOR RNA. Similar to other miRNA genes, and unlike most ordinary genes, VGAM400 precursor RNA does not encode a protein. A nucleotide sequence identical or highly similar to the nucleotide sequence of VGAM400 precursor RNA is designated SEQ ID:386, and is provided hereinbelow with reference to the sequence listing part. Nucleotide sequence SEQ ID:386 is located at position 4214 relative to the genome of Cryphonectria Hypovirus 1.

VGAM400 precursor RNA folds onto itself, forming VGAM400 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM400 folded precursor RNA into VGAM400 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM400 RNA is designated SEQ ID:3111, and is provided hereinbelow with reference to the sequence listing part.

VGAM400 host target gene, herein designated VGAM HOST TARGET GENE, encodes a corresponding messenger RNA, VGAM400 host target RNA, herein designated VGAM HOST TARGET RNA. VGAM400 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM400 RNA, herein designated VGAM RNA, binds complementarily to one or more host target binding sites located in untranslated regions of VGAM400 host target RNA, herein designated VGAM HOST TARGET RNA. This complementary binding is due to the fact that the nucleotide sequence of VGAM400 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM400 RNA, herein designated VGAM RNA, may have a different number of host target binding sites in untranslated regions of a VGAM400 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM400 RNA, herein designated VGAM RNA, to host target binding sites on VGAM400 host target RNA, herein designated VGAM HOST TARGET RNA, such as BINDING SITE I, BINDING SITE II and BINDING SITE III, inhibits translation of VGAM400 host target RNA into VGAM400 host target protein, herein designated VGAM HOST TARGET PROTEIN. VGAM host target protein is therefore outlined by a broken line.

It is appreciated that VGAM400 host target gene, herein designated VGAM HOST TARGET GENE, in fact represents a plurality of VGAM400 host target genes. The mRNA of each one of this plurality of VGAM400 host target genes comprises one or more host target binding sites, each having a nucleotide sequence which is at least partly complementary to VGAM400 RNA, herein designated VGAM RNA, and which when bound by VGAM400 RNA causes inhibition of translation of respective one or more VGAM400 host target proteins.

It is further appreciated by one skilled in the art that the mode of translational inhibition illustrated by FIG. 1 with specific reference to translational inhibition exerted by VGAM400 gene, herein designated VGAM GENE, on one or more VGAM400 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM400 is inhibition of expression of host target genes, as part of a novel viral mechanism of attacking a host. Accordingly, utilities of VGAM400 include diagnosis, prevention and treatment of viral infection by Cryphonectria Hypovirus 1. Specific functions, and accordingly utilities, of VGAM400 correlate with, and may be deduced from, the identity of the host target genes which VGAM400 binds and inhibits, and the function of these host target genes, as elaborated hereinbelow.

Nucleotide sequences of the VGAM400 precursor RNA, herein designated VGAM PRECURSOR RNA, and of the 'diced' VGAM400 RNA, herein designated VGAM RNA, and a schematic representation of the secondary folding of VGAM400 folded precursor RNA, herein designated VGAM FOLDED PRECURSOR RNA, of VGAM400 are further described hereinbelow with reference to Table 1.

Nucleotide sequences of host target binding sites, such as BINDING SITE-I, BINDING SITE-II and BINDING SITE-III of FIG. 1, found on VGAM400 host target RNA, and schematic representation of the complementarity of each of these host target binding sites to VGAM400 RNA, herein designated VGAM RNA, are described hereinbelow with reference to Table 2.

As mentioned hereinabove with reference to FIG. 1, a function of VGAM400 gene, herein designated VGAM is inhibition of expression of VGAM400 target genes. It is appreciated that specific functions, and accordingly utilities, of VGAM400 correlate with, and may be deduced from, the identity of the target genes which VGAM400 binds and inhibits, and the function of these target genes, as elaborated hereinbelow.

Collagen, Type IV, Alpha 6 (COL4A6, Accession NM_001847) is a VGAM400 host target gene. COL4A6 BINDING SITE1 and COL4A6 BINDING SITE2 are HOST TARGET binding sites found in untranslated regions of mRNA encoded by COL4A6, corresponding to HOST TARGET binding sites such as BINDING SITE I, BINDING SITE II or BINDING SITE III. Table 2 illustrates the complementarity of the nucleotide sequences of COL4A6 BINDING SITE1 and COL4A6 BINDING SITE2, designated SEQ ID:7581 and SEQ ID:27357 respectively, to the nucleotide sequence of VGAM400 RNA, herein designated VGAM RNA, also designated SEQ ID:3111.

A function of VGAM400 is therefore inhibition of Collagen, Type IV, Alpha 6 (COL4A6, Accession NM_001847). Accordingly, utilities of VGAM400 include diagnosis, prevention and treatment of diseases and clinical conditions associated with COL4A6. LOC154084 (Accession XM_098468) is another VGAM400 host target gene. LOC154084 BINDING SITE is HOST TARGET binding site found in the 5' untranslated region of mRNA encoded by LOC154084, corresponding to a HOST TARGET binding site such as BINDING SITE I, BINDING SITE II or BINDING SITE III. Table 2 illustrates the complementarity of the nucleotide sequences of LOC154084 BINDING SITE, designated SEQ ID:41684, to the nucleotide sequence of VGAM400 RNA, herein designated VGAM RNA, also designated SEQ ID:3111.

Another function of VGAM400 is therefore inhibition of LOC154084 (Accession XM_098468). Accordingly, utilities of VGAM400 include diagnosis, prevention and treatment of diseases and clinical conditions associated with LOC154084. FIG. 1 further provides a conceptual description of a novel bioinformatically detected viral gene of the present invention, referred to here as Viral Genomic Address Messenger 401 (VGAM401) viral gene, which modulates expression of respective host target genes thereof, the function and utility of which host target genes is known in the art.

VGAM401 is a novel bioinformatically detected regulatory, non protein coding, viral micro RNA (miRNA) gene. The method by which VGAM401 was detected is described hereinabove with reference to FIGS. 1-8.

VGAM401 gene, herein designated VGAM GENE, is a viral gene contained in the genome of Cryphonectria Hypovirus 1. VGAM401 host target gene, herein designated VGAM HOST TARGET GENE, is a human gene contained in the human genome.

VGAM401 gene encodes a VGAM401 precursor RNA, herein designated VGAM PRECURSOR RNA. Similar to other miRNA genes, and unlike most ordinary genes, VGAM401 precursor RNA does not encode a protein. A nucleotide sequence identical or highly similar to the nucleotide sequence of VGAM401 precursor RNA is designated SEQ ID:387, and is provided hereinbelow with reference to the sequence listing part. Nucleotide sequence SEQ ID:387 is located at position 11685 relative to the genome of Cryphonectria Hypovirus 1.

VGAM401 precursor RNA folds onto itself, forming VGAM401 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM401 folded precursor RNA into VGAM401 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM401 RNA is designated SEQ ID:3112, and is provided hereinbelow with reference to the sequence listing part.

VGAM401 host target gene, herein designated VGAM HOST TARGET GENE, encodes a corresponding messenger RNA, VGAM401 host target RNA, herein designated VGAM HOST TARGET RNA. VGAM401 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM401 RNA, herein designated VGAM RNA, binds complementarily to one or more host target binding sites located in untranslated regions of VGAM401 host target RNA, herein designated VGAM HOST TARGET RNA. This complementary binding is due to the fact that the nucleotide sequence of VGAM401 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM401 RNA, herein designated VGAM RNA, may have a different number of host target binding sites in untranslated regions of a VGAM401 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM401 RNA, herein designated VGAM RNA, to host target binding sites on VGAM401 host target RNA, herein designated VGAM HOST TARGET RNA, such as BINDING SITE I, BINDING SITE II and BINDING SITE III, inhibits translation of VGAM401 host target RNA into VGAM401 host target protein, herein designated VGAM HOST TARGET PROTEIN. VGAM host target protein is therefore outlined by a broken line.

It is appreciated that VGAM401 host target gene, herein designated VGAM HOST TARGET GENE, in fact represents a plurality of VGAM401 host target genes. The mRNA of each one of this plurality of VGAM401 host target genes comprises one or more host target binding sites, each having a nucleotide sequence which is at least partly complementary to VGAM401 RNA, herein designated VGAM RNA, and which when bound by VGAM401 RNA causes inhibition of translation of respective one or more VGAM401 host target proteins.

It is further appreciated by one skilled in the art that the mode of translational inhibition illustrated by FIG. 1 with specific reference to translational inhibition exerted by VGAM401 gene, herein designated VGAM GENE, on one or more VGAM401 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM401 is inhibition of expression of host target genes, as part of a novel viral mechanism of attacking a host. Accordingly, utilities of VGAM401 include diagnosis, prevention and treatment of viral infection by Cryphonectria Hypovirus 1. Specific functions, and accordingly utilities, of VGAM401 correlate with, and may be deduced from, the identity of the host target genes which VGAM401 binds and inhibits, and the function of these host target genes, as elaborated hereinbelow.

Nucleotide sequences of the VGAM401 precursor RNA, herein designated VGAM PRECURSOR RNA, and of the 'diced' VGAM401 RNA, herein designated VGAM RNA, and a schematic representation of the secondary folding of VGAM401 folded precursor RNA, herein designated VGAM FOLDED PRECURSOR RNA, of VGAM401 are further described hereinbelow with reference to Table 1.

Nucleotide sequences of host target binding sites, such as BINDING SITE-I, BINDING SITE-II and BINDING SITE-III of FIG. 1, found on VGAM401 host target RNA, and schematic representation of the complementarity of each of these host target binding sites to VGAM401 RNA, herein designated VGAM RNA, are described hereinbelow with reference to Table 2.

As mentioned hereinabove with reference to FIG. 1, a function of VGAM401 gene, herein designated VGAM is inhibition of expression of VGAM401 target genes. It is appreciated that specific functions, and accordingly utilities, of VGAM401 correlate with, and may be deduced from, the identity of the target genes which VGAM401 binds and inhibits, and the function of these target genes, as elaborated hereinbelow.

V-akt Murine Thymoma Viral Oncogene Homolog 1 (AKT1, Accession NM_005163) is a VGAM401 host target gene. AKT1 BINDING SITE is HOST TARGET binding site found in the 3' untranslated region of mRNA encoded by AKT1, corresponding to a HOST TARGET binding site such as BINDING SITE I, BINDING SITE II or BINDING SITE III. Table 2 illustrates the complementarity of the nucleotide sequences of AKT1 BINDING SITE, designated SEQ ID:11654, to the nucleotide sequence of VGAM401 RNA, herein designated VGAM RNA, also designated SEQ ID:3112.

A function of VGAM401 is therefore inhibition of V-akt Murine Thymoma Viral Oncogene Homolog 1 (AKT1, Accession NM_005163), a gene which Serine-threonine protein kinase. Accordingly, utilities of VGAM401 include diagnosis, prevention and treatment of diseases and clinical conditions associated with AKT1. The function of AKT1 and its association with various diseases and clinical conditions, has been established by previous studies, as described hereinabove with reference to VGAM188. ATPase, Cu++ Transporting, Alpha Polypeptide (Menkes syndrome) (ATP7A, Accession NM_000052) is another VGAM401 host target gene. ATP7A BINDING SITE is HOST TARGET binding site found in the 3' untranslated region of mRNA encoded by ATP7A, corresponding to a HOST TARGET binding site such as BINDING SITE I, BINDING SITE II or BINDING SITE III. Table 2 illustrates the complementarity of the nucleotide sequences of ATP7A BINDING SITE, designated SEQ ID:5501, to the nucleotide sequence of VGAM401 RNA, herein designated VGAM RNA, also designated SEQ ID:3112.

Another function of VGAM401 is therefore inhibition of ATPase, Cu++ Transporting, Alpha Polypeptide (Menkes syndrome) (ATP7A, Accession NM_000052). Accordingly, utilities of VGAM401 include diagnosis, prevention and treatment of diseases and clinical conditions associated with ATP7A. Cas-Br-M (murine) Ecotropic Retroviral Transforming Sequence B (CBLB, Accession NM_004351) is another VGAM401 host target gene. CBLB BINDING SITE is HOST TARGET binding site found in the 5' untranslated region of mRNA encoded by CBLB, corresponding to a HOST TARGET binding site such as BINDING SITE I, BINDING SITE II or BINDING SITE III. Table 2 illustrates the complementarity of the nucleotide sequences of CBLB BINDING SITE, designated SEQ ID:10553, to the nucleotide sequence of VGAM401 RNA, herein designated VGAM RNA, also designated SEQ ID:3112.

Another function of VGAM401 is therefore inhibition of Cas-Br-M (murine) Ecotropic Retroviral Transforming Sequence B (CBLB, Accession NM_004351), a gene which SH3 binding protein with similarity to human CBL; interacts and regulates signal transduction proteins. Accordingly, utilities of VGAM401 include diagnosis, prevention and treatment of diseases and clinical conditions associated with CBLB. The function of CBLB has been established by previous studies. The autoimmune disease type 1 diabetes mellitus, also known as insulin-dependent diabetes mellitus (IDDM; 222100), has a multifactorial etiology. The major histocompatibility complex (MHC) has been identified as a major susceptibility locus in the disease and its animal models. The Komeda diabetes-prone (KDP) rat is a spontaneous animal model of human type 1 diabetes (Komeda et al., 1998) in which the major susceptibility locus Iddm/kdp1 accounts, in combination with MHC, for most of the genetic predisposition to diabetes. Yokoi et al. (2002) reported positional cloning of Iddm/kdp1 and identification of a nonsense mutation in Cblb. Lymphocytes of the KDP rat infiltrate pancreatic islets and several tissues including thyroid gland and kidney, indicating autoimmunity. Similar findings in Cblb-deficient mice are caused by enhanced T-cell activation. Transgenic complementation with wildtype Cblb significantly suppressed development of the KDP phenotype. Thus, Cblb functions as a negative regulator of autoimmunity and Cblb is a major susceptibility gene for type 1 diabetes in the rat. Yokoi et al. (2002) concluded that impairment of the Cblb signaling pathway may contribute to human autoimmune diseases, including type 1 diabetes. Animal model experiments lend further support to the function of CBLB. Bachmaier et al. (2000) generated mice deficient in CBLB by targeted disruption. At 6 months of age, these mice, which were maintained under specific pathogen-free conditions, exhibited a huge mass in submandibular salivary glands which resulted from accumulations of T and B cells and lymphoid neoorganogenesis. Mononuclear cells also accumulated in and damaged multiple organs and tissues, although the enlargement was only slight in spleen and lymph nodes. In CBLB +/- mice, the authors detected minor infiltration in only the submandibular salivary glands and kidneys. Measurement of a number of in vitro parameters demonstrated hyperproliferation of T and B cells as well as hyperproduction of IL2 but not of IFNG (OMIM Ref. No. 147570) or TNFA (OMIM Ref. No. 191160).

It is appreciated that the abovementioned animal model for CBLB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Yokoi, N.; Komeda, K.; Wang, H.-Y.; Yano, H.; Kitada, K.; Saitoh, Y.; Seino, Y.; Yasuda, K.; Serikawa, T.; Seino, S.: Cblb is a major susceptibility gene for rat type 1 diabetes mellitus. Nature Genet. 31:391-394, 2002; and Bachmaier, K.; Krawczyk, C.; Kozieradzki, I.; Kong, Y.-Y.; Sasaki, T.; Oliveira-dos-Santos, A.; Mariathasan, S.; Bouchard, D.; Wakeham, A.; Itie, A.; Le, J.; Ohashi, P. S.; Sarosi, I.

Further studies establishing the function and utilities of CBLB are found in John Hopkins OMIM database record ID 604491, and in sited publications numbered 4751-4755 listed in the bibliography section hereinbelow, which are also hereby incorporated by reference. Optic Atrophy 1 (autosomal dominant) (OPA1, Accession NM_130833) is another VGAM401 host target gene. OPA1 BINDING SITE1 through OPA1 BINDING SITE5 are HOST TARGET binding sites found in untranslated regions of mRNA encoded by OPA1, corresponding to HOST TARGET binding sites such as BINDING SITE I, BINDING SITE II or BINDING SITE III. Table 2 illustrates the complementarity of the nucleotide sequences of OPA1 BINDING SITE1 through OPA1 BINDING SITE5, designated SEQ ID:28325, SEQ ID:28333, SEQ ID:28341, SEQ ID:28349 and SEQ ID:28357 respectively, to the nucleotide sequence of VGAM401 RNA, herein designated VGAM RNA, also designated SEQ ID:3112.

Another function of VGAM401 is therefore inhibition of Optic Atrophy 1 (autosomal dominant) (OPA1, Accession NM_130833). Accordingly, utilities of VGAM401 include diagnosis, prevention and treatment of diseases and clinical conditions associated with OPA1. DKFZP434P1750 (Accession NM_015527) is another VGAM401 host target gene. DKFZP434P1750 BINDING SITE is HOST TARGET binding site found in the 3' untranslated region of mRNA encoded by DKFZP434P1750, corresponding to a HOST TARGET binding site such as BINDING SITE I, BINDING SITE II or BINDING SITE III. Table 2 illustrates the complementarity of the nucleotide sequences of DKFZP434P1750 BINDING SITE, designated SEQ ID:17794, to the nucleotide sequence of VGAM401 RNA, herein designated VGAM RNA, also designated SEQ ID:3112.

Another function of VGAM401 is therefore inhibition of DKFZP434P1750 (Accession NM_015527). Accordingly, utilities of VGAM401 include diagnosis, prevention and treatment of diseases and clinical conditions associated with DKFZP434P1750. HCA3 (Accession NM_138703) is another VGAM401 host target gene. HCA3 BINDING SITE is HOST TARGET binding site found in the 5' untranslated region of mRNA encoded by HCA3, corresponding to a HOST TARGET binding site such as BINDING SITE I, BINDING SITE II or BINDING SITE III. Table 2 illustrates the complementarity of the nucleotide sequences of HCA3 BINDING SITE, designated SEQ ID:28951, to the nucleotide sequence of VGAM401 RNA, herein designated VGAM RNA, also designated SEQ ID:3112.

Another function of VGAM401 is therefore inhibition of HCA3 (Accession NM_138703). Accordingly, utilities of VGAM401 include diagnosis, prevention and treatment of diseases and clinical conditions associated with HCA3. KIAA0876 (Accession XM_035625) is another VGAM401 host target gene. KIAA0876 BINDING SITE is HOST TARGET binding site found in the 3' untranslated region of mRNA encoded by KIAA0876, corresponding to a HOST TARGET binding site such as BINDING SITE I, BINDING SITE II or BINDING SITE III. Table 2 illustrates the complementarity of the nucleotide sequences of KIAA0876 BINDING SITE, designated SEQ ID:32300, to the nucleotide sequence of VGAM401 RNA, herein designated VGAM RNA, also designated SEQ ID:3112.

Another function of VGAM401 is therefore inhibition of KIAA0876 (Accession XM_035625). Accordingly, utilities of VGAM401 include diagnosis, prevention and treatment of diseases and clinical conditions associated with KIAA0876. MGC12981 (Accession NM_032357) is another VGAM401 host target gene. MGC12981 BINDING SITE is HOST TARGET binding site found in the 3' untranslated region of mRNA encoded by MGC12981, corresponding to a HOST TARGET binding site such as BINDING SITE I, BINDING SITE II or BINDING SITE III. Table 2 illustrates the complementarity of the nucleotide sequences of MGC12981 BINDING SITE, designated SEQ ID:26143, to the nucleotide sequence of VGAM401 RNA, herein designated VGAM RNA, also designated SEQ ID:3112.

Another function of VGAM401 is therefore inhibition of MGC12981 (Accession NM_032357). Accordingly, utilities of VGAM401 include diagnosis, prevention and treatment of diseases and clinical conditions associated with MGC12981. NAG14 (Accession NM_022143) is another VGAM401 host target gene. NAG14 BINDING SITE is HOST TARGET binding site found in the 3' untranslated region of mRNA encoded by NAG14, corresponding to a HOST TARGET binding site such as BINDING SITE I, BINDING SITE II or BINDING SITE III. Table 2 illustrates the complementarity of the nucleotide sequences of NAG14 BINDING SITE, designated SEQ ID:22706, to the nucleotide sequence of VGAM401 RNA, herein designated VGAM RNA, also designated SEQ ID:3112.

Another function of VGAM401 is therefore inhibition of NAG14 (Accession NM_022143). Accordingly, utilities of VGAM401 include diagnosis, prevention and treatment of diseases and clinical conditions associated with NAG14. Suppression of Tumorigenicity 7 Like (ST7L, Accession NM_138727) is another VGAM401 host target gene. ST7L BINDING SITE1 through ST7L BINDING SITE3 are HOST TARGET binding sites found in untranslated regions of mRNA encoded by ST7L, corresponding to HOST TARGET binding sites such as BINDING SITE I, BINDING SITE II or BINDING SITE III. Table 2 illustrates the complementarity of the nucleotide sequences of ST7L BINDING SITE1 through ST7L BINDING SITE3, designated SEQ ID:28979, SEQ ID:29210 and SEQ ID:19337 respectively, to the nucleotide sequence of VGAM401 RNA, herein designated VGAM RNA, also designated SEQ ID:3112.

Another function of VGAM401 is therefore inhibition of Suppression of Tumorigenicity 7 Like (ST7L, Accession NM_138727). Accordingly, utilities of VGAM401 include diagnosis, prevention and treatment of diseases and clinical conditions associated with ST7L. LOC90593 (Accession XM_032815) is another VGAM401 host target gene. LOC90593 BINDING SITE is HOST TARGET binding site found in the 3' untranslated region of mRNA encoded by LOC90593, corresponding to a HOST TARGET binding site such as BINDING SITE I, BINDING SITE II or BINDING SITE III. Table 2 illustrates the complementarity of the nucleotide sequences of LOC90593 BINDING SITE, designated SEQ ID:31766, to the nucleotide sequence of VGAM401 RNA, herein designated VGAM RNA, also designated SEQ ID:3112.

Another function of VGAM401 is therefore inhibition of LOC90593 (Accession XM_032815). Accordingly, utilities of VGAM401 include diagnosis, prevention and treatment of diseases and clinical conditions associated with LOC90593. FIG. 1 further provides a conceptual description of a novel bioinformatically detected viral gene of the present invention, referred to here as Viral Genomic Address Messenger 402 (VGAM402) viral gene, which modulates expression of respective host target genes thereof, the function and utility of which host target genes is known in the art.

VGAM402 is a novel bioinformatically detected regulatory, non protein coding, viral micro RNA (miRNA) gene. The method by which VGAM402 was detected is described hereinabove with reference to FIGS. 1-8.

VGAM402 gene, herein designated VGAM GENE, is a viral gene contained in the genome of Cryphonectria Hypovirus 1. VGAM402 host target gene, herein designated VGAM HOST TARGET GENE, is a human gene contained in the human genome.

VGAM402 gene encodes a VGAM402 precursor RNA, herein designated VGAM PRECURSOR RNA. Similar to other miRNA genes, and unlike most ordinary genes, VGAM402 precursor RNA does not encode a protein. A nucleotide sequence identical or highly similar to the nucleotide sequence of VGAM402 precursor RNA is designated SEQ ID:388, and is provided hereinbelow with reference to the sequence listing part. Nucleotide sequence SEQ ID:388 is located at position 6807 relative to the genome of Cryphonectria Hypovirus 1.

VGAM402 precursor RNA folds onto itself, forming VGAM402 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM402 folded precursor RNA into VGAM402 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM402 RNA is designated SEQ ID:3113, and is provided hereinbelow with reference to the sequence listing part.

VGAM402 host target gene, herein designated VGAM HOST TARGET GENE, encodes a corresponding messenger RNA, VGAM402 host target RNA, herein designated VGAM HOST TARGET RNA. VGAM402 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM402 RNA, herein designated VGAM RNA, binds complementarily to one or more host target binding sites located in untranslated regions of VGAM402 host target RNA, herein designated VGAM HOST TARGET RNA. This complementary binding is due to the fact that the nucleotide sequence of VGAM402 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM402 RNA, herein designated VGAM RNA, may have a different number of host target binding sites in untranslated regions of a VGAM402 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM402 RNA, herein designated VGAM RNA, to host target binding sites on VGAM402 host target RNA, herein designated VGAM HOST TARGET RNA, such as BINDING SITE I, BINDING SITE II and BINDING SITE III, inhibits translation of VGAM402 host target RNA into VGAM402 host target protein, herein designated VGAM HOST TARGET PROTEIN. VGAM host target protein is therefore outlined by a broken line.

It is appreciated that VGAM402 host target gene, herein designated VGAM HOST TARGET GENE, in fact represents a plurality of VGAM402 host target genes. The mRNA of each one of this plurality of VGAM402 host target genes comprises one or more host target binding sites, each having a nucleotide sequence which is at least partly complementary to VGAM402 RNA, herein designated VGAM RNA, and which when bound by VGAM402 RNA causes inhibition of translation of respective one or more VGAM402 host target proteins.

It is further appreciated by one skilled in the art that the mode of translational inhibition illustrated by FIG. 1 with specific reference to translational inhibition exerted by VGAM402 gene, herein designated VGAM GENE, on one or more VGAM402 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM402 is inhibition of expression of host target genes, as part of a novel viral mechanism of attacking a host. Accordingly, utilities of VGAM402 include diagnosis, prevention and treatment of viral infection by Cryphonectria Hypovirus 1. Specific functions, and accordingly utilities, of VGAM402 correlate with, and may be deduced from, the identity of the host target genes which VGAM402 binds and inhibits, and the function of these host target genes, as elaborated hereinbelow.

Nucleotide sequences of the VGAM402 precursor RNA, herein designated VGAM PRECURSOR RNA, and of the 'diced' VGAM402 RNA, herein designated VGAM RNA, and a schematic representation of the secondary folding of VGAM402 folded precursor RNA, herein designated VGAM FOLDED PRECURSOR RNA, of VGAM402 are further described hereinbelow with reference to Table 1.

Nucleotide sequences of host target binding sites, such as BINDING SITE-I, BINDING SITE-II and BINDING SITE-III of FIG. 1, found on VGAM402 host target RNA, and schematic representation of the complementarity of each of these host target binding sites to VGAM402 RNA, herein designated VGAM RNA, are described hereinbelow with reference to Table 2.

As mentioned hereinabove with reference to FIG. 1, a function of VGAM402 gene, herein designated VGAM is inhibition of expression of VGAM402 target genes. It is appreciated that specific functions, and accordingly utilities, of VGAM402 correlate with, and may be deduced from, the identity of the target genes which VGAM402 binds and inhibits, and the function of these target genes, as elaborated hereinbelow.

HUS1 Checkpoint Homolog (S. pombe) (HUS1, Accession XM_165873) is a VGAM402 host target gene. HUS1 BINDING SITE is HOST TARGET binding site found in the 3' untranslated region of mRNA encoded by HUS1, corresponding to a HOST TARGET binding site such as BINDING SITE I, BINDING SITE II or BINDING SITE III. Table 2 illustrates the complementarity of the nucleotide sequences of HUS1 BINDING SITE, designated SEQ ID:43790, to the nucleotide sequence of VGAM402 RNA, herein designated VGAM RNA, also designated SEQ ID:3113.

A function of VGAM402 is therefore inhibition of HUS1 Checkpoint Homolog (S. pombe) (HUS1, Accession XM_165873), a gene which May form DNA damage-responsive protein complex. Accordingly, utilities of VGAM402 include diagnosis, prevention and treatment of diseases and clinical conditions associated with HUS1. The function of HUS1 and its association with various diseases and clinical conditions, has been established by previous studies, as described hereinabove with reference to VGAM228. N-myc Downstream Regulated Gene 1 (NDRG1, Accession XM_005243) is another VGAM402 host target gene. NDRG1 BINDING SITE is HOST TARGET binding site found in the 3' untranslated region of mRNA encoded by NDRG1, corresponding to a HOST TARGET binding site such as BINDING SITE I, BINDING SITE II or BINDING SITE III. Table 2 illustrates the complementarity of the nucleotide sequences of NDRG1 BINDING SITE, designated SEQ ID:29970, to the nucleotide sequence of VGAM402 RNA, herein designated VGAM RNA, also designated SEQ ID:3113.

Another function of VGAM402 is therefore inhibition of N-myc Downstream Regulated Gene 1 (NDRG1, Accession XM_005243), a gene which may have a growth inhibitory role. Accordingly, utilities of VGAM402 include diagnosis, prevention and treatment of diseases and clinical conditions associated with NDRG1. The function of NDRG1 and its association with various diseases and clinical conditions, has been established by previous studies, as described hereinabove with reference to VGAM144. HSPC138 (Accession NM_016401) is another VGAM402 host target gene. HSPC138 BINDING SITE is HOST TARGET binding site found in the 5' untranslated region of mRNA encoded by HSPC138, corresponding to a HOST TARGET binding site such as BINDING SITE I, BINDING SITE II or BINDING SITE III. Table 2 illustrates the complementarity of the nucleotide sequences of HSPC138 BINDING SITE, designated SEQ ID:18538, to the nucleotide sequence of VGAM402 RNA, herein designated VGAM RNA, also designated SEQ ID:3113.

Another function of VGAM402 is therefore inhibition of HSPC138 (Accession NM_016401). Accordingly, utilities of VGAM402 include diagnosis, prevention and treatment of diseases and clinical conditions associated with HSPC138. HSPC251 (Accession NM_016505) is another VGAM402 host target gene. HSPC251 BINDING SITE is HOST TARGET binding site found in the 3' untranslated region of mRNA encoded by HSPC251, corresponding to a HOST TARGET binding site such as BINDING SITE I, BINDING SITE II or BINDING SITE III. Table 2 illustrates the complementarity of the nucleotide sequences of HSPC251 BINDING SITE, designated SEQ ID:18584, to the nucleotide sequence of VGAM402 RNA, herein designated VGAM RNA, also designated SEQ ID:3113.

Another function of VGAM402 is therefore inhibition of HSPC251 (Accession NM_016505). Accordingly, utilities of VGAM402 include diagnosis, prevention and treatment of diseases and clinical conditions associated with HSPC251. IDN3 (Accession NM_133433) is another VGAM402 host target gene. IDN3 BINDING SITE is HOST TARGET binding site found in the 3' untranslated region of mRNA encoded by IDN3, corresponding to a HOST TARGET binding site such as BINDING SITE I, BINDING SITE II or BINDING SITE III. Table 2 illustrates the complementarity of the nucleotide sequences of IDN3 BINDING SITE, designated SEQ ID:28512, to the nucleotide sequence of VGAM402 RNA, herein designated VGAM RNA, also designated SEQ ID:3113.

Another function of VGAM402 is therefore inhibition of IDN3 (Accession NM_133433). Accordingly, utilities of VGAM402 include diagnosis, prevention and treatment of diseases and clinical conditions associated with IDN3. KIAA0284 (Accession XM_032235) is another VGAM402 host target gene. KIAA0284 BINDING SITE is HOST TARGET binding site found in the 3' untranslated region of mRNA encoded by KIAA0284, corresponding to a HOST TARGET binding site such as BINDING SITE I, BINDING SITE II or BINDING SITE III. Table 2 illustrates the complementarity of the nucleotide sequences of KIAA0284 BINDING SITE, designated SEQ ID:31620, to the nucleotide sequence of VGAM402 RNA, herein designated VGAM RNA, also designated SEQ ID:3113.

Another function of VGAM402 is therefore inhibition of KIAA0284 (Accession XM_032235). Accordingly, utilities of VGAM402 include diagnosis, prevention and treatment of diseases and clinical conditions associated with KIAA0284. KIAA0844 (Accession NM_014951) is another VGAM402 host target gene. KIAA0844 BINDING SITE is HOST TARGET binding site found in the 3' untranslated region of mRNA encoded by KIAA0844, corresponding to a HOST TARGET binding site such as BINDING SITE I, BINDING SITE II or BINDING SITE III. Table 2 illustrates the complementarity of the nucleotide sequences of KIAA0844 BINDING SITE, designated SEQ ID:17285, to the nucleotide sequence of VGAM402 RNA, herein designated VGAM RNA, also designated SEQ ID:3113.

Another function of VGAM402 is therefore inhibition of KIAA0844 (Accession NM_014951). Accordingly, utilities of VGAM402 include diagnosis, prevention and treatment of diseases and clinical conditions associated with KIAA0844. KIAA1068 (Accession NM_015332) is another VGAM402 host target gene. KIAA1068 BINDING SITE is HOST TARGET binding site found in the 3' untranslated region of mRNA encoded by KIAA1068, corresponding to a HOST TARGET binding site such as BINDING SITE I, BINDING SITE II or BINDING SITE III. Table 2 illustrates the complementarity of the nucleotide sequences of KIAA1068 BINDING SITE, designated SEQ ID:17645, to the nucleotide sequence of VGAM402 RNA, herein designated VGAM RNA, also designated SEQ ID:3113.

Another function of VGAM402 is therefore inhibition of KIAA1068 (Accession NM_015332). Accordingly, utilities of VGAM402 include diagnosis, prevention and treatment of diseases and clinical conditions associated with KIAA1068. KIAA1169 (Accession NM_017901) is another VGAM402 host target gene. KIAA1169 BINDING SITE is HOST TARGET binding site found in the 5' untranslated region of mRNA encoded by KIAA1169, corresponding to a HOST TARGET binding site such as BINDING SITE I, BINDING SITE II or BINDING SITE III. Table 2 illustrates the complementarity of the nucleotide sequences of KIAA1169 BINDING SITE, designated SEQ ID:19566, to the nucleotide sequence of VGAM402 RNA, herein designated VGAM RNA, also designated SEQ ID:3113.

Another function of VGAM402 is therefore inhibition of KIAA1169 (Accession NM_017901). Accordingly, utilities of VGAM402 include diagnosis, prevention and treatment of diseases and clinical conditions associated with KIAA1169. KIAA1305 (Accession NM_025081) is another VGAM402 host target gene. KIAA1305 BINDING SITE is HOST TARGET binding site found in the 3' untranslated region of mRNA encoded by KIAA1305, corresponding to a HOST TARGET binding site such as BINDING SITE I, BINDING SITE II or BINDING SITE III. Table 2 illustrates the complementarity of the nucleotide sequences of KIAA1305 BINDING SITE, designated SEQ ID:24682, to the nucleotide sequence of VGAM402 RNA, herein designated VGAM RNA, also designated SEQ ID:3113.

Another function of VGAM402 is therefore inhibition of KIAA1305 (Accession NM_025081). Accordingly, utilities of VGAM402 include diagnosis, prevention and treatment of diseases and clinical conditions associated with KIAA1305. KIAA1881 (Accession XM_170901) is another VGAM402 host target gene. KIAA1881 BINDING SITE is HOST TARGET binding site found in the 3' untranslated region of mRNA encoded by KIAA1881, corresponding to a HOST TARGET binding site such as BINDING SITE I, BINDING SITE II or BINDING SITE III. Table 2 illustrates the complementarity of the nucleotide sequences of KIAA1881 BINDING SITE, designated SEQ ID:45656, to the nucleotide sequence of VGAM402 RNA, herein designated VGAM RNA, also designated SEQ ID:3113.

Another function of VGAM402 is therefore inhibition of KIAA1881 (Accession XM_170901). Accordingly, utilities of VGAM402 include diagnosis, prevention and treatment of diseases and clinical conditions associated with KIAA1881. KIAA1932 (Accession XM_055900) is another VGAM402 host target gene. KIAA1932 BINDING SITE is HOST TARGET binding site found in the 3' untranslated region of mRNA encoded by KIAA1932, corresponding to a HOST TARGET binding site such as BINDING SITE I, BINDING SITE II or BINDING SITE III. Table 2 illustrates the complementarity of the nucleotide sequences of KIAA1932 BINDING SITE, designated SEQ ID:36351, to the nucleotide sequence of VGAM402 RNA, herein designated VGAM RNA, also designated SEQ ID:3113.

Another function of VGAM402 is therefore inhibition of KIAA1932 (Accession XM_055900). Accordingly, utilities of VGAM402 include diagnosis, prevention and treatment of diseases and clinical conditions associated with KIAA1932. PB1 (Accession NM_018165) is another VGAM402 host target gene. PB1 BINDING SITE is HOST TARGET binding site found in the 3' untranslated region of mRNA encoded by PB1, corresponding to a HOST TARGET binding site such as BINDING SITE I, BINDING SITE II or BINDING SITE III. Table 2 illustrates the complementarity of the nucleotide sequences of PB1 BINDING SITE, designated SEQ ID:19983, to the nucleotide sequence of VGAM402 RNA, herein designated VGAM RNA, also designated SEQ ID:3113.

Another function of VGAM402 is therefore inhibition of PB1 (Accession NM_018165). Accordingly, utilities of VGAM402 include diagnosis, prevention and treatment of diseases and clinical conditions associated with PB1. Zinc Finger, DHHC Domain Containing 8 (ZDHHC8, Accession XM_033828) is another VGAM402 host target gene. ZDHHC8 BINDING SITE is HOST TARGET binding site found in the 3' untranslated region of mRNA encoded by ZDHHC8, corresponding to a HOST TARGET binding site such as BINDING SITE I, BINDING SITE II or BINDING SITE III. Table 2 illustrates the complementarity of the nucleotide sequences of ZDHHC8 BINDING SITE, designated SEQ ID:31963, to the nucleotide sequence of VGAM402 RNA, herein designated VGAM RNA, also designated SEQ ID:3113.

Another function of VGAM402 is therefore inhibition of Zinc Finger, DHHC Domain Containing 8 (ZDHHC8, Accession XM_033828). Accordingly, utilities of VGAM402 include diagnosis, prevention and treatment of diseases and clinical conditions associated with ZDHHC8. LOC145547 (Accession XM_085167) is another VGAM402 host target gene. LOC145547 BINDING SITE is HOST TARGET binding site found in the 3' untranslated region of mRNA encoded by LOC145547, corresponding to a HOST TARGET binding site such as BINDING SITE I, BINDING SITE II or BINDING SITE III. Table 2 illustrates the complementarity of the nucleotide sequences of LOC145547 BINDING SITE, designated SEQ ID:37892, to the nucleotide sequence of VGAM402 RNA, herein designated VGAM RNA, also designated SEQ ID:3113.

Another function of VGAM402 is therefore inhibition of LOC145547 (Accession XM_085167). Accordingly, utilities of VGAM402 include diagnosis, prevention and treatment of diseases and clinical conditions associated with LOC145547. LOC152765 (Accession XM_087519) is another VGAM402 host target gene. LOC152765 BINDING SITE is HOST TARGET binding site found in the 5' untranslated region of mRNA encoded by LOC152765, corresponding to a HOST TARGET binding site such as BINDING SITE I, BINDING SITE II or BINDING SITE III. Table 2 illustrates the complementarity of the nucleotide sequences of LOC152765 BINDING SITE, designated SEQ ID:39314, to the nucleotide sequence of VGAM402 RNA, herein designated VGAM RNA, also designated SEQ ID:3113.

Another function of VGAM402 is therefore inhibition of LOC152765 (Accession XM_087519). Accordingly, utilities of VGAM402 include diagnosis, prevention and treatment of diseases and clinical conditions associated with LOC152765. LOC161635 (Accession XM_172921) is another VGAM402 host target gene. LOC161635 BINDING SITE is HOST TARGET binding site found in the 5' untranslated region of mRNA encoded by LOC161635, corresponding to a HOST TARGET binding site such as BINDING SITE I, BINDING SITE II or BINDING SITE III. Table 2 illustrates the complementarity of the nucleotide sequences of LOC161635 BINDING SITE, designated SEQ ID:46185, to the nucleotide sequence of VGAM402 RNA, herein designated VGAM RNA, also designated SEQ ID:3113.

Another function of VGAM402 is therefore inhibition of LOC161635 (Accession XM_172921). Accordingly, utilities of VGAM402 include diagnosis, prevention and treatment of diseases and clinical conditions associated with LOC161635. LOC253842 (Accession XM_173230) is another VGAM402 host target gene. LOC253842 BINDING SITE is HOST TARGET binding site found in the 3' untranslated region of mRNA encoded by LOC253842, corresponding to a HOST TARGET binding site such as BINDING SITE I, BINDING SITE II or BINDING SITE III. Table 2 illustrates the complementarity of the nucleotide sequences of LOC253842 BINDING SITE, designated SEQ ID:46504, to the nucleotide sequence of VGAM402 RNA, herein designated VGAM RNA, also designated SEQ ID:3113.

Another function of VGAM402 is therefore inhibition of LOC253842 (Accession XM_173230). Accordingly, utilities of VGAM402 include diagnosis, prevention and treatment of diseases and clinical conditions associated with LOC253842. LOC91149 (Accession XM_036480) is another VGAM402 host target gene. LOC91149 BINDING SITE is HOST TARGET binding site found in the 3' untranslated region of mRNA encoded by LOC91149, corresponding to a HOST TARGET binding site such as BINDING SITE I, BINDING SITE II or BINDING SITE III. Table 2 illustrates the complementarity of the nucleotide sequences of LOC91149 BINDING SITE, designated SEQ ID:32452, to the nucleotide sequence of VGAM402 RNA, herein designated VGAM RNA, also designated SEQ ID:3113.

Another function of VGAM402 is therefore inhibition of LOC91149 (Accession XM_036480). Accordingly, utilities of VGAM402 include diagnosis, prevention and treatment of diseases and clinical conditions associated with LOC91149. FIG. 1 further provides a conceptual description of a novel bioinformatically detected viral gene of the present invention, referred to here as Viral Genomic Address Messenger 403 (VGAM403) viral gene, which modulates expression of respective host target genes thereof, the function and utility of which host target genes is known in the art.

VGAM403 is a novel bioinformatically detected regulatory, non protein coding, viral micro RNA (miRNA) gene.

The method by which VGAM403 was detected is described hereinabove with reference to FIGS. 1-8.

VGAM403 gene, herein designated VGAM GENE, is a viral gene contained in the genome of Cryphonectria Hypovirus 1. VGAM403 host target gene, herein designated VGAM HOST TARGET GENE, is a human gene contained in the human genome.

VGAM403 gene encodes a VGAM403 precursor RNA, herein designated VGAM PRECURSOR RNA. Similar to other miRNA genes, and unlike most ordinary genes, VGAM403 precursor RNA does not encode a protein. A nucleotide sequence identical or highly similar to the nucleotide sequence of VGAM403 precursor RNA is designated SEQ ID:389, and is provided hereinbelow with reference to the sequence listing part. Nucleotide sequence SEQ ID:389 is located at position 9304 relative to the genome of Cryphonectria Hypovirus 1.

VGAM403 precursor RNA folds onto itself, forming VGAM403 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM403 folded precursor RNA into VGAM403 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM403 RNA is designated SEQ ID:3114, and is provided hereinbelow with reference to the sequence listing part.

VGAM403 host target gene, herein designated VGAM HOST TARGET GENE, encodes a corresponding messenger RNA, VGAM403 host target RNA, herein designated VGAM HOST TARGET RNA. VGAM403 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM403 RNA, herein designated VGAM RNA, binds complementarily to one or more host target binding sites located in untranslated regions of VGAM403 host target RNA, herein designated VGAM HOST TARGET RNA. This complementary binding is due to the fact that the nucleotide sequence of VGAM403 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM403 RNA, herein designated VGAM RNA, may have a different number of host target binding sites in untranslated regions of a VGAM403 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM403 RNA, herein designated VGAM RNA, to host target binding sites on VGAM403 host target RNA, herein designated VGAM HOST TARGET RNA, such as BINDING SITE I, BINDING SITE II and BINDING SITE III, inhibits translation of VGAM403 host target RNA into VGAM403 host target protein, herein designated VGAM HOST TARGET PROTEIN. VGAM host target protein is therefore outlined by a broken line.

It is appreciated that VGAM403 host target gene, herein designated VGAM HOST TARGET GENE, in fact represents a plurality of VGAM403 host target genes. The mRNA of each one of this plurality of VGAM403 host target genes comprises one or more host target binding sites, each having a nucleotide sequence which is at least partly complementary to VGAM403 RNA, herein designated VGAM RNA, and which when bound by VGAM403 RNA causes inhibition of translation of respective one or more VGAM403 host target proteins.

It is further appreciated by one skilled in the art that the mode of translational inhibition illustrated by FIG. 1 with specific reference to translational inhibition exerted by VGAM403 gene, herein designated VGAM GENE, on one or more VGAM403 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM403 is inhibition of expression of host target genes, as part of a novel viral mechanism of attacking a host. Accordingly, utilities of VGAM403 include diagnosis, prevention and treatment of viral infection by Cryphonectria Hypovirus 1. Specific functions, and accordingly utilities, of VGAM403 correlate with, and may be deduced from, the identity of the host target genes which VGAM403 binds and inhibits, and the function of these host target genes, as elaborated hereinbelow.

Nucleotide sequences of the VGAM403 precursor RNA, herein designated VGAM PRECURSOR RNA, and of the 'diced' VGAM403 RNA, herein designated VGAM RNA, and a schematic representation of the secondary folding of VGAM403 folded precursor RNA, herein designated VGAM FOLDED PRECURSOR RNA, of VGAM403 are further described hereinbelow with reference to Table 1.

Nucleotide sequences of host target binding sites, such as BINDING SITE-I, BINDING SITE-II and BINDING SITE-III of FIG. 1, found on VGAM403 host target RNA, and schematic representation of the complementarity of each of these host target binding sites to VGAM403 RNA, herein designated VGAM RNA, are described hereinbelow with reference to Table 2.

As mentioned hereinabove with reference to FIG. 1, a function of VGAM403 gene, herein designated VGAM is inhibition of expression of VGAM403 target genes. It is appreciated that specific functions, and accordingly utilities, of VGAM403 correlate with, and may be deduced from, the identity of the target genes which VGAM403 binds and inhibits, and the function of these target genes, as elaborated hereinbelow.

Cyclin-dependent Kinase 5, Regulatory Subunit 2 (p39) (CDK5R2, Accession NM_003936) is a VGAM403 host target gene. CDK5R2 BINDING SITE is HOST TARGET binding site found in the 3' untranslated region of mRNA encoded by CDK5R2, corresponding to a HOST TARGET binding site such as BINDING SITE I, BINDING SITE II or BINDING SITE III. Table 2 illustrates the complementarity of the nucleotide sequences of CDK5R2 BINDING SITE, designated SEQ ID:10044, to the nucleotide sequence of VGAM403 RNA, herein designated VGAM RNA, also designated SEQ ID:3114.

A function of VGAM403 is therefore inhibition of Cyclin-dependent Kinase 5, Regulatory Subunit 2 (p39) (CDK5R2, Accession NM_003936), a gene which acts as a regulatory subunit for the cyclin-dependent CDK5. Accordingly, utilities of VGAM403 include diagnosis, prevention and treatment of diseases and clinical conditions associated with CDK5R2. The function of CDK5R2 has been established by previous studies. Neuronal CDC2 (OMIM Ref. No. 116940)-like kinase is a heterodimer of CDK5 (OMIM Ref. No. 123831) and p25(nck5a), a neuron-specific 25-kD regulatory subunit derived proteolytically from NCK5A (neuronal CDK5 activator; 603460). By screening a human hippocampus library with a bovine Nck5a cDNA, Tang et al. (1995) isolated cDNAs encoding NCK5AI, a distinct NCK5A isoform. They also referred to the protein as p39(OMIM Ref. No. nck5ai) based on its calculated molecular mass of 39 kD. The predicted 367-amino acid p39(OMIM Ref. No. nck5ai) protein shares 57% sequence identity with human NCK5A. As does p25(nck5a), a 30-kD truncated form of p39(OMIM Ref. No. nck5ai) activated both recombinant and native CDK5 in vitro. Northern blot analysis of rat tissues indicated that both Nck5A and p39(OMIM Ref. No. nck5ai) are expressed exclusively in brain. In situ hybridization to rat brain sections revealed that p39(OMIM Ref. No. nck5ai) mRNA was highly expressed in the CA1 to CA3 zone of hippocampal formation, an area highly enriched in neurons. There was no expression in the fimbria hippocampi, where glial cells predominate. Tang et al. (1995) concluded that p39(OMIM Ref. No. nck5ai) shares many common characteristics with NCK5A, including CDK5-activating activity and brain- and neuron-specific expression. Nilden et al. (1998) identified Cdk5r2, the mouse gene homologous to human p39(OMIM Ref. No. nck5ai). The coding region of Cdk5r2 is contained within a single exon. The predicted mouse and human proteins are 95% identical.

Full details of the abovementioned studies are described in the following publications, the disclosure of which are hereby incorporated by reference:

Muravenko, O. V.; Gizatullin, R. Z.; Protopopov, A. I.; Kashuba, V. I.; Zabarovsky, E. R.; Zelenin, A. V.: Assignment of CDK5R2 coding for the cyclin-dependent kinase 5, regulatory subunit 2 (NCK5AI protein) to human chromosome band 2q35 by fluorescent in situ hybridization. Cytogenet. Cell Genet. 89:160-161, 2000; and Tang, D.; Yeung, J.; Lee, K-Y.; Matsushita, M.; Matsui, H.; Tomizawa, K.; Hatase, O.; Wang, J. H.: An isoform of the neuronal cyclin-dependent kinase 5 (Cdk5) activator. J. Biol. Chem.

Further studies establishing the function and utilities of CDK5R2 are found in John Hopkins OMIM database record ID 603764, and in sited publications numbered 7950-7952 listed in the bibliography section hereinbelow, which are also hereby incorporated by reference. Winged-helix Nude (WHN, Accession NM_003593) is another VGAM403 host target gene. WHN BINDING SITE is HOST TARGET binding site found in the 3' untranslated region of mRNA encoded by WHN, corresponding to a HOST TARGET binding site such as BINDING SITE I, BINDING SITE II or BINDING SITE III. Table 2 illustrates the complementarity of the nucleotide sequences of WHN BINDING SITE, designated SEQ ID:9651, to the nucleotide sequence of VGAM403 RNA, herein designated VGAM RNA, also designated SEQ ID:3114.

Another function of VGAM403 is therefore inhibition of Winged-helix Nude (WHN, Accession NM_003593), a gene which plays a role in transcriptional regulation. Accordingly, utilities of VGAM403 include diagnosis, prevention and treatment of diseases and clinical conditions associated with WHN. The function of WHN has been established by previous studies. In 2 sisters with T-cell immunodeficiency, congenital alopecia, and nail dystrophy (OMIM Ref. No. 601705), Frank et al. (1999) identified a homozygous nonsense mutation in the WHN gene. In mammals, whn expression occurs in epithelial cells of the thymus as well as specific cells of the hair follicle. In the human, WHN is expressed in the differentiating cells of the hair follicle precortex and the innermost cell layer of the outer root sheath. Expression in the thymus was not determine. Animal model experiments lend further support to the function of WHN. Mutations at the ‘nude’ locus of mice and rats disrupt normal hair growth and thymus development, causing nude mice and rats to be immune-deficient. Nehls et al. (1994) showed that a gene designated whn, located in the region of mouse chromosome 11 known to contain the nude locus, encodes a new member of the winged-helix domain family of transcription factors. The predicted protein is 648 amino acids long. The whn gene was disrupted on the mouse and rat nude alleles. Mutant transcripts did not encode the characteristic DNA-binding domain, strongly suggesting that the whn gene is the nude gene. Mutations in winged-helix domain genes cause homeotic transformations in Drosophila and distort cell-fate decisions during vulval development in C. elegans. The whn gene was thus the first member of this class of genes to be implicated in a specific developmental defect in vertebrates It is appreciated that the abovementioned animal model for WHN is acknowledged by those skilled in the art as a scientifically valid animal model, as can be further appreciated from the publications sited hereinbelow.

Full details of the abovementioned studies are described in the following publications, the disclosure of which are hereby incorporated by reference:

Frank, J.; Pignata, C.; Panteleyev, A. A.; Prowse, D. M.; Baden, H.; Weiner, L.; Gaetaniello, L.; Ahmad, W.; Pozzi, N.; Caerhalmi-Friedman, P. B.; Aita, V. M.; Uyttendaele, H.; Gordon, D.; Ott, J.; Brissette, J. L.; Christiano, A. M.: Exposing the human nude phenotype. Nature 398:473-474, 1999; and Nehls, M.; Pfeifer, D.; Schorpp, M.; Hedrich, H.; Boehm, T.: New member of the winged-helix protein family disrupted in mouse and rat nude mutations. Nature 372:103-107, 1994.

Further studies establishing the function and utilities of WHN are found in John Hopkins OMIM database record ID 600838, and in sited publications numbered 9595-9600 listed in the bibliography section hereinbelow, which are also hereby incorporated by reference. Apolipoprotein L, 4 (APOL4, Accession NM_030643) is another VGAM403 host target gene. APOL4 BINDING SITE is HOST TARGET binding site found in the 3' untranslated region of mRNA encoded by APOL4, corresponding to a HOST TARGET binding site such as BINDING SITE I, BINDING SITE II or BINDING SITE III. Table 2 illustrates the complementarity of the nucleotide sequences of APOL4 BINDING SITE, designated SEQ ID:24980, to the nucleotide sequence of VGAM403 RNA, herein designated VGAM RNA, also designated SEQ ID:3114.

Another function of VGAM403 is therefore inhibition of Apolipoprotein L, 4 (APOL4, Accession NM_030643). Accordingly, utilities of VGAM403 include diagnosis, prevention and treatment of diseases and clinical conditions associated with APOL4. DCOHM (Accession NM_032151) is another VGAM403 host target gene. DCOHM BINDING SITE is HOST TARGET binding site found in the 3' untranslated region of mRNA encoded by DCOHM, corresponding to a HOST TARGET binding site such as BINDING SITE I, BINDING SITE II or BINDING SITE III. Table 2 illustrates the complementarity of the nucleotide sequences of DCOHM BINDING SITE, designated SEQ ID:25849, to the nucleotide sequence of VGAM403 RNA, herein designated VGAM RNA, also designated SEQ ID:3114.

Another function of VGAM403 is therefore inhibition of DCOHM (Accession NM_032151). Accordingly, utilities of VGAM403 include diagnosis, prevention and treatment of diseases and clinical conditions associated with DCOHM. FLJ22028 (Accession NM_024854) is another VGAM403 host target gene. FLJ22028 BINDING SITE is HOST TARGET binding site found in the 3" untranslated region of mRNA encoded by FLJ22028, corresponding to a HOST TARGET binding site such as BINDING SITE I, BINDING SITE II or BINDING SITE III. Table 2 illustrates the complementarity of the nucleotide sequences of FLJ22028 BINDING SITE, designated SEQ ID:24287, to the nucleotide sequence of VGAM403 RNA, herein designated VGAM RNA, also designated SEQ ID:3114.

Another function of VGAM403 is therefore inhibition of FLJ22028 (Accession NM_024854). Accordingly, utilities of VGAM403 include diagnosis, prevention and treatment of diseases and clinical conditions associated with FLJ22028. KIAA0441 (Accession NM_014797) is another VGAM403 host target gene. KIAA0441 BINDING SITE is HOST TARGET binding site found in the 3' untranslated region of mRNA encoded by KIAA0441, corresponding to a HOST TARGET binding site such as BINDING SITE I, BINDING SITE II or BINDING SITE III. Table 2 illustrates the complementarity of the nucleotide sequences of KIAA0441 BINDING SITE, designated SEQ ID:16716, to the nucleotide sequence of VGAM403 RNA, herein designated VGAM RNA, also designated SEQ ID:3114.

Another function of VGAM403 is therefore inhibition of KIAA0441 (Accession NM_014797). Accordingly, utilities of VGAM403 include diagnosis, prevention and treatment of diseases and clinical conditions associated with KIAA0441. Ring Finger Protein 34 (RNF34, Accession NM_025126) is another VGAM403 host target gene. RNF34 BINDING SITE is HOST TARGET binding site found in the 3' untranslated region of mRNA encoded by RNF34, corresponding to a HOST TARGET binding site such as BINDING SITE I, BINDING SITE II or BINDING SITE III. Table 2 illustrates the complementarity of the nucleotide sequences of RNF34 BINDING SITE, designated SEQ ID:24770, to the nucleotide sequence of VGAM403 RNA, herein designated VGAM RNA, also designated SEQ ID:3114.

Another function of VGAM403 is therefore inhibition of Ring Finger Protein 34 (RNF34, Accession NM_025126). Accordingly, utilities of VGAM403 include diagnosis, prevention and treatment of diseases and clinical conditions associated with RNF34. Syntaxin 12 (STX12, Accession XM_039018) is another VGAM403 host target gene. STX12 BINDING SITE is HOST TARGET binding site found in the 3' untranslated region of mRNA encoded by STX12, corresponding to a HOST TARGET binding site such as BINDING SITE I, BINDING SITE II or BINDING SITE III. Table 2 illustrates the complementarity of the nucleotide sequences of STX12 BINDING SITE, designated SEQ ID:32984, to the nucleotide sequence of VGAM403 RNA, herein designated VGAM RNA, also designated SEQ ID:3114.

Another function of VGAM403 is therefore inhibition of Syntaxin 12 (STX12, Accession XM_039018). Accordingly, utilities of VGAM403 include diagnosis, prevention and treatment of diseases and clinical conditions associated with STX12. LOC146733 (Accession XM_097076) is another VGAM403 host target gene. LOC146733 BINDING SITE is HOST TARGET binding site found in the 5' untranslated region of mRNA encoded by LOC146733, corresponding to a HOST TARGET binding site such as BINDING SITE I, BINDING SITE II or BINDING SITE III. Table 2 illustrates the complementarity of the nucleotide sequences of LOC146733 BINDING SITE, designated SEQ ID:40725, to the nucleotide sequence of VGAM403 RNA, herein designated VGAM RNA, also designated SEQ ID:3114.

Another function of VGAM403 is therefore inhibition of LOC146733 (Accession XM_097076). Accordingly, utilities of VGAM403 include diagnosis, prevention and treatment of diseases and clinical conditions associated with LOC146733. LOC219686 (Accession XM_165544) is another VGAM403 host target gene. LOC219686 BINDING SITE is HOST TARGET binding site found in the 3' untranslated region of mRNA encoded by LOC219686, corresponding to a HOST TARGET binding site such as BINDING SITE I, BINDING SITE II or BINDING SITE III. Table 2 illustrates the complementarity of the nucleotide sequences of LOC219686 BINDING SITE, designated SEQ ID:43678, to the nucleotide sequence of VGAM403 RNA, herein designated VGAM RNA, also designated SEQ ID:3114.

Another function of VGAM403 is therefore inhibition of LOC219686 (Accession XM_165544). Accordingly, utilities of VGAM403 include diagnosis, prevention and treatment of diseases and clinical conditions associated with LOC219686. FIG. 1 further provides a conceptual description of a novel bioinformatically detected viral gene of the present invention, referred to here as Viral Genomic Address Messenger 404 (VGAM404) viral gene, which modulates expression of respective host target genes thereof, the function and utility of which host target genes is known in the art.

VGAM404 is a novel bioinformatically detected regulatory, non protein coding, viral micro RNA (miRNA) gene. The method by which VGAM404 was detected is described hereinabove with reference to FIGS. 1-8.

VGAM404 gene, herein designated VGAM GENE, is a viral gene contained in the genome of Cryphonectria Hypovirus 1. VGAM404 host target gene, herein designated VGAM HOST TARGET GENE, is a human gene contained in the human genome.

VGAM404 gene encodes a VGAM404 precursor RNA, herein designated VGAM PRECURSOR RNA. Similar to other miRNA genes, and unlike most ordinary genes, VGAM404 precursor RNA does not encode a protein. A nucleotide sequence identical or highly similar to the nucleotide sequence of VGAM404 precursor RNA is designated SEQ ID:390, and is provided hereinbelow with reference to the sequence listing part. Nucleotide sequence SEQ ID:390 is located at position 7366 relative to the genome of Cryphonectria Hypovirus 1.

VGAM404 precursor RNA folds onto itself, forming VGAM404 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM404 folded precursor RNA into VGAM404 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM404 RNA is designated SEQ ID:3115, and is provided hereinbelow with reference to the sequence listing part.

VGAM404 host target gene, herein designated VGAM HOST TARGET GENE, encodes a corresponding messenger RNA, VGAM404 host target RNA, herein designated VGAM HOST TARGET RNA. VGAM404 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM404 RNA, herein designated VGAM RNA, binds complementarily to one or more host target binding sites located in untranslated regions of VGAM404 host target RNA, herein designated VGAM HOST TARGET RNA. This complementary binding is due to the fact that the nucleotide sequence of VGAM404 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM404 RNA, herein designated VGAM RNA, may have a different number of host target binding sites in untranslated regions of a VGAM404 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM404 RNA, herein designated VGAM RNA, to host target binding sites on VGAM404 host target RNA, herein designated VGAM HOST TARGET RNA, such as BINDING SITE I, BINDING SITE II and BINDING SITE III, inhibits translation of VGAM404 host target RNA into VGAM404 host target protein, herein designated VGAM HOST TARGET PROTEIN. VGAM host target protein is therefore outlined by a broken line.

It is appreciated that VGAM404 host target gene, herein designated VGAM HOST TARGET GENE, in fact represents a plurality of VGAM404 host target genes. The mRNA of each one of this plurality of VGAM404 host target genes comprises one or more host target binding sites, each having a nucleotide sequence which is at least partly complementary to VGAM404 RNA, herein designated VGAM RNA, and which when bound by VGAM404 RNA causes inhibition of translation of respective one or more VGAM404 host target proteins.

It is further appreciated by one skilled in the art that the mode of translational inhibition illustrated by FIG. 1 with specific reference to translational inhibition exerted by VGAM404 gene, herein designated VGAM GENE, on one or more VGAM404 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM404 is inhibition of expression of host target genes, as part of a novel viral mechanism of attacking a host. Accordingly, utilities of VGAM404 include diagnosis, prevention and treatment of viral infection by Cryphonectria Hypovirus 1. Specific functions, and accordingly utilities, of VGAM404 correlate with, and may be deduced from, the identity of the host target genes which VGAM404 binds and inhibits, and the function of these host target genes, as elaborated hereinbelow.

Nucleotide sequences of the VGAM404 precursor RNA, herein designated VGAM PRECURSOR RNA, and of the 'diced' VGAM404 RNA, herein designated VGAM RNA, and a schematic representation of the secondary folding of VGAM404 folded precursor RNA, herein designated VGAM FOLDED PRECURSOR RNA, of VGAM404 are further described hereinbelow with reference to Table 1.

Nucleotide sequences of host target binding sites, such as BINDING SITE-I, BINDING SITE-II and BINDING SITE-III of FIG. 1, found on VGAM404 host target RNA, and schematic representation of the complementarity of each of these host target binding sites to VGAM404 RNA, herein designated VGAM RNA, are described hereinbelow with reference to Table 2.

As mentioned hereinabove with reference to FIG. 1, a function of VGAM404 gene, herein designated VGAM is inhibition of expression of VGAM404 target genes. It is appreciated that specific functions, and accordingly utilities, of VGAM404 correlate with, and may be deduced from, the identity of the target genes which VGAM404 binds and inhibits, and the function of these target genes, as elaborated hereinbelow.

F-box and Leucine-rich Repeat Protein 11 (FBXL11, Accession NM_012308) is a VGAM404 host target gene. FBXL11 BINDING SITE is HOST TARGET binding site found in the 3' untranslated region of mRNA encoded by FBXL11, corresponding to a HOST TARGET binding site such as BINDING SITE I, BINDING SITE II or BINDING SITE III. Table 2 illustrates the complementarity of the nucleotide sequences of FBXL11 BINDING SITE, designated SEQ ID:14680, to the nucleotide sequence of VGAM404 RNA, herein designated VGAM RNA, also designated SEQ ID:3115.

A function of VGAM404 is therefore inhibition of F-box and Leucine-rich Repeat Protein 11 (FBXL11, Accession NM_012308), a gene which are BTB/POZ domain-containing zinc finger proteins implicated in oncogenesis. Accordingly, utilities of VGAM404 include diagnosis, prevention and treatment of diseases and clinical conditions associated with FBXL11. The function of FBXL11 has been established by previous studies. The F box, named after cyclin F (CCNF; 600227), in which it was originally observed, is an approximately 40-amino acid motif that binds SKP1 (OMIM Ref. No. 601434). F-box proteins are components of modular E3 ubiquitin protein ligases called SCFs (SKP1, OMIM Ref. No. 603134), F-box proteins), which function in phosphorylation-dependent ubiquitination. Using a yeast 2-hybrid screen with SKP1 as bait, followed by searching sequence databases, Winston et al. (1999) and Cenciarelli et al. (1999) identified 33 mammalian and 26 human F-box proteins, respectively. These contained C termini with leucine-rich repeats (FBXLs, e.g., SKP2 (OMIM Ref. No. 601436)), WD40 domains (FBXWs, e.g., BTRCP (OMIM Ref. No. 603482)), or no recognizable motifs (FBXOs, e.g., CCNF). By searching sequence databases, Ilyin et al. (2000) identified a cDNA encoding FBXL11, which they referred to as FBL7. They predicted that FBXL11, which is identical to the 496-amino acid KIAA1004 protein reported by Nagase et al. (1999), contains at least 6 highly degenerated leucine-rich repeats. By RT-PCR analysis, Nagase et al. (1999) detected ubiquitous expression of FBXL11, with highest levels in brain, testis, and ovary, followed by lung; lowest expression was in pancreas. Within brain, expression was highest in cerebellum and subthalamic nuclei. The International Radiation Hybrid Mapping Consortium mapped the FBXL11 gene to chromosome 11 (sts-Z40471).

Full details of the abovementioned studies are described in the following publications, the disclosure of which are hereby incorporated by reference:

Ilyin, G. P.; Rialland, M.; Pigeon, C.; Guguen-Guillouzo, C.: cDNA cloning and expression analysis of new members of the mammalian F-box protein family. Genomics 67:40-47, 2000; and Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human ge.

Further studies establishing the function and utilities of FBXL11 are found in John Hopkins OMIM database record ID 605657, and in sited publications numbered 409, 827 and 8593 listed in the bibliography section hereinbelow, which are also hereby incorporated by reference. UDP-N-acetyl-alpha-D-galactosamine:polypeptide N-acetylgalactosaminyltransferase 1 (GalNAc-T1) (GALNT1, Accession NM_020474) is another VGAM404 host target gene. GALNT1 BINDING SITE is HOST TARGET binding site found in the 3' untranslated region of mRNA encoded by GALNT1, corresponding to a HOST TARGET binding site such as BINDING SITE I, BINDING SITE II or BINDING SITE III. Table 2 illustrates the complementarity of the nucleotide sequences of GALNT1 BINDING SITE, designated SEQ ID:21723, to the nucleotide sequence of VGAM404 RNA, herein designated VGAM RNA, also designated SEQ ID:3115.

Another function of VGAM404 is therefore inhibition of UDP-N-acetyl-alpha-D-galactosamine:polypeptide N-acetylgalactosaminyltransferase 1 (GalNAc-T1) (GALNT1, Accession NM_020474), a gene which transfers an N-acetyl galactosamine (GalNAc) to a serine or threonine residue in the first step of O-linked oligosaccharide biosynthesis. Accordingly, utilities of VGAM404 include diagnosis, prevention and treatment of diseases and clinical conditions associated with GALNT1. The function of GALNT1 and its association with various diseases and clinical conditions, has been established by previous studies, as described hereinabove with reference to VGAM120. Rab Geranylgeranyltransferase, Alpha Subunit (RABGGTA, Accession NM_004581) is another VGAM404 host target gene. RABGGTA BINDING SITE is HOST TARGET binding site found in the 5' untranslated region of mRNA encoded by RABGGTA, corresponding to a HOST TARGET binding site such as BINDING SITE I, BINDING SITE II or BINDING SITE III. Table 2 illustrates the complementarity of the nucleotide sequences of RABGGTA BINDING SITE, designated SEQ ID:10930, to the nucleotide sequence of VGAM404 RNA, herein designated VGAM RNA, also designated SEQ ID:3115.

Another function of VGAM404 is therefore inhibition of Rab Geranylgeranyltransferase, Alpha Subunit (RABGGTA, Accession NM_004581), a gene which is the alpha subunit of geranylgeranyl transferase. Accordingly, utilities of VGAM404 include diagnosis, prevention and treatment of diseases and clinical conditions associated with RABGGTA. The function of RABGGTA has been established by previous studies. Van Bokhoven et al. (1996) cloned the human RABGGTA gene from a fetal brain library. The gene encodes a 567-amino acid polypeptide. Homology to the transglutaminase gene, TGM1 (OMIM Ref. No. 190195), which maps to 14q11, indicated that this subunit was located on the same chromosomal band; Southern blot analysis confirmed this locus. Van Bokhoven et al. (1996) found that the 3-prime end of the RABGGTA cDNA sequence overlaps the promoter region of TGM1. Further analysis revealed that the RABGGTA and TGM1 genes are located only 2 kb apart in head-to-tail tandem arrangement; however, these 2 genes are not likely to be functionally related. Animal model experiments lend further support to the function of RABGGTA. Mice homozygous for 'gunmetal' (gm), a spontaneous, recessive mutation, have prolonged bleeding caused by defects in platelets and megakaryocytes (Swank et al., 1993; Novak et al., 1995). These mice also have macrothrombocytopenia and reduced platelet alpha- and delta-granule contents (storage pool deficiency, SPD). Megakaryocytes, the progenitors of platelets, are more plentiful in gm mice, but have abnormal intracellular membranes, increased emperipolesis (the active movement of 1 cell through another), and decreased platelet synthesis. In addition, gm homozygotes have partial cutaneous albinism, the feature that gives the mutation its name. Detter et al. (2000) noted that the phenotype resembles human gray platelet syndrome (GPS; 139090) and platelet alpha- and delta-SPD (OMIM Ref. No. 185050).

It is appreciated that the abovementioned animal model for RABGGTA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Detter, J. C.; Zhang, Q.; Mules, E. H.; Novak, E. K.; Mishra, V. S.; Li, W.; McMurtrie, E. B.; Tchernev, V. T.; Wallace, M. R.; Seabra, M. C.; Swank, R. T.; Kingsmore, S. F.: Rab geranylgeranyl transferase alpha mutation in the gunmetal mouse reduces Rab prenylation and platelet synthesis. Proc. Nat. Acad. Sci. 97:4144-4149, 2000; and van Bokhoven, H.; Rawson, R. B.; Merkx, G. F. M.; Cremers, F. P. M.; Seabra, M. C. : cDNA cloning and chromosomal localization of the genes encoding the alpha- and beta-subunits of huma.

Further studies establishing the function and utilities of RABGGTA are found in John Hopkins OMIM database record ID 601905, and in sited publications numbered 8883-8884, 1187-118 and 8885 listed in the bibliography section hereinbelow, which are also hereby incorporated by reference. Regulator of G-protein Signalling 3 (RGS3, Accession NM_021106) is another VGAM404 host target gene. RGS3 BINDING SITE is HOST TARGET binding site found in the 5' untranslated region of mRNA encoded by RGS3, corresponding to a HOST TARGET binding site such as BINDING SITE I, BINDING SITE II or BINDING SITE III. Table 2 illustrates the complementarity of the nucleotide sequences of RGS3 BINDING SITE, designated SEQ ID:22087, to the nucleotide sequence of VGAM404 RNA, herein designated VGAM RNA, also designated SEQ ID:3115.

Another function of VGAM404 is therefore inhibition of Regulator of G-protein Signalling 3 (RGS3, Accession NM_021106), a gene which negatively regulates G protein-coupled receptor signalling. Accordingly, utilities of VGAM404 include diagnosis, prevention and treatment of diseases and clinical conditions associated with RGS3. The function of RGS3 has been established by previous studies. Chatterjee et al. (1997) stated that 17 mammalian RGS members had been identified by cloning or by comparison to expressed sequence tags (ESTs). They studied RGS3, the largest member of the RGS family to date. They found that the coding region of the human RGS3 gene spans 14.7 kb and contains 6 exons; the 5-prime untranslated region spans 3.2 kb and contains 2 exons. The RGS domain, conserved among all RGS proteins, is encoded by 3 exons, while the unique N-terminal domain of RGS3 is encoded by a single exon. Comparison of the locations of the intron-exon boundaries of the human RGS3 gene to those of the human RGS2 gene revealed a remarkable similarity. Using 5-prime-RACE analysis, they mapped the transcription start site 517 bp upstream of the translation start site. Many potential regulatory elements were identified in the 5-prime flanking region. By screening a mouse embryonic cDNA library using the yeast 2-hybrid system with the cytoplasmic domain of ephrin-B2 (EFNB2; 600527) as bait, Lu et al. (2001) isolated cDNAs encoding a cytoplasmic protein they designated Pdz-Rgs3. Pdz-Rgs3 binds ephrin-B2 through a PDZ domain, and it has an RGS domain. The human homolog of Pdz-Rgs3, RGS3, had been described as a shorter sequence (Druey et al., 1996). Pdz-Rgs3 can mediate signaling from the ephrin-B cytoplasmic tail. The authors showed that SDF1 (OMIM Ref. No. 600835), a chemokine with a G protein-coupled receptor, and BDNF (OMIM Ref. No. 113505) are chemoattractants for cerebellar granule cells, and that SDF1 chemoattraction is selectively inhibited by soluble ephrin-B receptor (see OMIM Ref. No. 602757). This inhibition could be blocked by a truncated Pdz-Rgs3 protein lacking the RGS domain.

Full details of the abovementioned studies are described in the following publications, the disclosure of which are hereby incorporated by reference:

Druey, K. M.; Blumer, K. J.; Kang, V. H.; Kehrl, J. H.: Inhibition of G-protein-mediated MAP kinase activation by a new mammalian gene family. Nature 379:742-746, 1996; and Chatterjee, T. K.; Eapen, A.; Kanis, A. B.; Fisher, R. A.: Genomic organization, 5-prime-flanking region, and chromosomal localization of the human RGS3 gene. Genomics 45:429-433, 1997.

Further studies establishing the function and utilities of RGS3 are found in John Hopkins OMIM database record ID 602189, and in sited publications numbered 5845-584 and 12564 listed in the bibliography section hereinbelow, which are also hereby incorporated by reference. DKFZP434H132 (Accession XM_057020) is another VGAM404 host target gene. DKFZP434H132 BINDING SITE is HOST TARGET binding site found in the 5' untranslated region of mRNA encoded by DKFZP434H132, corresponding to a HOST TARGET binding site such as BINDING SITE I, BINDING SITE II or BINDING SITE III. Table 2 illustrates the complementarity of the nucleotide sequences of DKFZP434H132 BINDING SITE, designated SEQ ID:36446, to the nucleotide sequence of VGAM404 RNA, herein designated VGAM RNA, also designated SEQ ID:3115.

Another function of VGAM404 is therefore inhibition of DKFZP434H132 (Accession XM_057020). Accordingly, utilities of VGAM404 include diagnosis, prevention and treatment of diseases and clinical conditions associated with DKFZP434H132. KIAA1600 (Accession XM_049351) is another VGAM404 host target gene. KIAA1600 BINDING SITE is HOST TARGET binding site found in the 3' untranslated region of mRNA encoded by KIAA1600, corresponding to a HOST TARGET binding site such as BINDING SITE I, BINDING SITE II or BINDING SITE III. Table 2 illustrates the complementarity of the nucleotide sequences of KIAA1600 BINDING SITE, designated SEQ ID:35392, to the nucleotide sequence of VGAM404 RNA, herein designated VGAM RNA, also designated SEQ ID:3115.

Another function of VGAM404 is therefore inhibition of KIAA1600 (Accession XM_049351). Accordingly, utilities of VGAM404 include diagnosis, prevention and treatment of diseases and clinical conditions associated with KIAA1600. MGC2628 (Accession NM_024076) is another VGAM404 host target gene. MGC2628 BINDING SITE is HOST TARGET binding site found in the 3' untranslated region of mRNA encoded by MGC2628, corresponding to a HOST TARGET binding site such as BINDING SITE I, BINDING SITE II or BINDING SITE III. Table 2 illustrates the complementarity of the nucleotide sequences of MGC2628 BINDING SITE, designated SEQ ID:23508, to the nucleotide sequence of VGAM404 RNA, herein designated VGAM RNA, also designated SEQ ID:3115.

Another function of VGAM404 is therefore inhibition of MGC2628 (Accession NM_024076). Accordingly, utilities of VGAM404 include diagnosis, prevention and treatment of diseases and clinical conditions associated with MGC2628. Oxysterol Binding Protein-like 3 (OSBPL3, Accession NM_015550) is another VGAM404 host target gene. OSBPL3 BINDING SITE is HOST TARGET binding site found in the 3' untranslated region of mRNA encoded by OSBPL3, corresponding to a HOST TARGET binding site such as BINDING SITE I, BINDING SITE II or BINDING SITE III. Table 2 illustrates the complementarity of the nucleotide sequences of OSBPL3 BINDING SITE, designated SEQ ID:17815, to the nucleotide sequence of VGAM404 RNA, herein designated VGAM RNA, also designated SEQ ID:3115.

Another function of VGAM404 is therefore inhibition of Oxysterol Binding Protein-like 3 (OSBPL3, Accession NM_015550). Accordingly, utilities of VGAM404 include diagnosis, prevention and treatment of diseases and clinical conditions associated with OSBPL3. Synaptotagmin XII (SYT12, Accession XM_170657) is another VGAM404 host target gene. SYT12 BINDING SITE is HOST TARGET binding site found in the 3' untranslated region of mRNA encoded by SYT12, corresponding to a HOST TARGET binding site such as BINDING SITE I, BINDING SITE II or BINDING SITE III. Table 2 illustrates the complementarity of the nucleotide sequences of SYT12 BINDING SITE, designated SEQ ID:45431, to the nucleotide sequence of VGAM404 RNA, herein designated VGAM RNA, also designated SEQ ID:3115.

Another function of VGAM404 is therefore inhibition of Synaptotagmin XII (SYT12, Accession XM_170657). Accordingly, utilities of VGAM404 include diagnosis, prevention and treatment of diseases and clinical conditions associated with SYT12. LOC124976 (Accession XM_058879) is another VGAM404 host target gene. LOC124976 BINDING SITE is HOST TARGET binding site found in the 3' untranslated region of mRNA encoded by LOC124976, corresponding to a HOST TARGET binding site such as BINDING SITE I, BINDING SITE II or BINDING SITE III. Table 2 illustrates the complementarity of the nucleotide sequences of LOC124976 BINDING SITE, designated SEQ ID:36782, to the nucleotide sequence of VGAM404 RNA, herein designated VGAM RNA, also designated SEQ ID:3115.

Another function of VGAM404 is therefore inhibition of LOC124976 (Accession XM_058879). Accordingly, utilities of VGAM404 include diagnosis, prevention and treatment of diseases and clinical conditions associated with LOC124976. LOC148114 (Accession XM_086050) is another VGAM404 host target gene. LOC148114 BINDING SITE is HOST TARGET binding site found in the 5' untranslated region of mRNA encoded by LOC148114, corresponding to a HOST TARGET binding site such as BINDING SITE I, BINDING SITE II or BINDING SITE III. Table 2 illustrates the complementarity of the nucleotide sequences of LOC148114 BINDING SITE, designated SEQ ID:38465, to the nucleotide sequence of VGAM404 RNA, herein designated VGAM RNA, also designated SEQ ID:3115.

Another function of VGAM404 is therefore inhibition of LOC148114 (Accession XM_086050). Accordingly, utilities of VGAM404 include diagnosis, prevention and treatment of diseases and clinical conditions associated with LOC148114. LOC254428 (Accession XM_170932) is another VGAM404 host target gene. LOC254428 BINDING SITE is HOST TARGET binding site found in the 3' untranslated region of mRNA encoded by LOC254428, corresponding to a HOST TARGET binding site such as BINDING SITE I, BINDING SITE II or BINDING SITE III. Table 2 illustrates the complementarity of the nucleotide sequences of LOC254428 BINDING SITE, designated SEQ ID:45715, to the nucleotide sequence of VGAM404 RNA, herein designated VGAM RNA, also designated SEQ ID:3115.

Another function of VGAM404 is therefore inhibition of LOC254428 (Accession XM_170932). Accordingly, utilities of VGAM404 include diagnosis, prevention and treatment of diseases and clinical conditions associated with LOC254428. LOC254945 (Accession XM_173038) is another VGAM404 host target gene. LOC254945 BINDING SITE is HOST TARGET binding site found in the 5' untranslated region of mRNA encoded by LOC254945, corresponding to a HOST TARGET binding site such as BINDING SITE I, BINDING SITE II or BINDING SITE III. Table 2 illustrates the complementarity of the nucleotide sequences of LOC254945 BINDING SITE, designated SEQ ID:46304, to the nucleotide sequence of VGAM404 RNA, herein designated VGAM RNA, also designated SEQ ID:3115.

Another function of VGAM404 is therefore inhibition of LOC254945 (Accession XM_173038). Accordingly, utilities of VGAM404 include diagnosis, prevention and treatment of diseases and clinical conditions associated with LOC254945. FIG. 1 further provides a conceptual description of a novel bioinformatically detected viral gene of the present invention, referred to here as Viral Genomic Address Messenger 405 (VGAM405) viral gene, which modulates expression of respective host target genes thereof, the function and utility of which host target genes is known in the art.

VGAM405 is a novel bioinformatically detected regulatory, non protein coding, viral micro RNA (miRNA) gene. The method by which VGAM405 was detected is described hereinabove with reference to FIGS. 1-8.

VGAM405 gene, herein designated VGAM GENE, is a viral gene contained in the genome of Cryphonectria Hypovirus 1. VGAM405 host target gene, herein designated VGAM HOST TARGET GENE, is a human gene contained in the human genome.

VGAM405 gene encodes a VGAM405 precursor RNA, herein designated VGAM PRECURSOR RNA. Similar to other miRNA genes, and unlike most ordinary genes, VGAM405 precursor RNA does not encode a protein. A nucleotide sequence identical or highly similar to the nucleotide sequence of VGAM405 precursor RNA is designated SEQ ID:391, and is provided hereinbelow with reference to the sequence listing part. Nucleotide sequence SEQ ID:391 is located at position 3539 relative to the genome of Cryphonectria Hypovirus 1.

VGAM405 precursor RNA folds onto itself, forming VGAM405 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM405 folded precursor RNA into VGAM405 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM405 RNA is designated SEQ ID:3116, and is provided hereinbelow with reference to the sequence listing part.

VGAM405 host target gene, herein designated VGAM HOST TARGET GENE, encodes a corresponding messenger RNA, VGAM405 host target RNA, herein designated VGAM HOST TARGET RNA. VGAM405 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM405 RNA, herein designated VGAM RNA, binds complementarily to one or more host target binding sites located in untranslated regions of VGAM405 host target RNA, herein designated VGAM HOST TARGET RNA. This complementary binding is due to the fact that the nucleotide sequence of VGAM405 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM405 RNA, herein designated VGAM RNA, may have a different number of host target binding sites in untranslated regions of a VGAM405 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM405 RNA, herein designated VGAM RNA, to host target binding sites on VGAM405 host target RNA, herein designated VGAM HOST TARGET RNA, such as BINDING SITE I, BINDING SITE II and BINDING SITE III, inhibits translation of VGAM405 host target RNA into VGAM405 host target protein, herein designated VGAM HOST TARGET PROTEIN. VGAM host target protein is therefore outlined by a broken line.

It is appreciated that VGAM405 host target gene, herein designated VGAM HOST TARGET GENE, in fact represents a plurality of VGAM405 host target genes. The mRNA of each one of this plurality of VGAM405 host target genes comprises one or more host target binding sites, each having a nucleotide sequence which is at least partly complementary to VGAM405 RNA, herein designated VGAM RNA, and which when bound by VGAM405 RNA causes inhibition of translation of respective one or more VGAM405 host target proteins.

It is further appreciated by one skilled in the art that the mode of translational inhibition illustrated by FIG. 1 with specific reference to translational inhibition exerted by VGAM405 gene, herein designated VGAM GENE, on one or more VGAM405 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM405 is inhibition of expression of host target genes, as part of a novel viral mechanism of attacking a host. Accordingly, utilities of VGAM405 include diagnosis, prevention and treatment of viral infection by Cryphonectria Hypovirus 1. Specific functions, and accordingly utilities, of VGAM405 correlate with, and may be deduced from, the identity of the host target genes which VGAM405 binds and inhibits, and the function of these host target genes, as elaborated hereinbelow.

Nucleotide sequences of the VGAM405 precursor RNA, herein designated VGAM PRECURSOR RNA, and of the 'diced' VGAM405 RNA, herein designated VGAM RNA, and a schematic representation of the secondary folding of VGAM405 folded precursor RNA, herein designated VGAM FOLDED PRECURSOR RNA, of VGAM405 are further described hereinbelow with reference to Table 1.

Nucleotide sequences of host target binding sites, such as BINDING SITE-I, BINDING SITE-II and BINDING SITE-III of FIG. 1, found on VGAM405 host target RNA, and schematic representation of the complementarity of each of these host target binding sites to VGAM405 RNA, herein designated VGAM RNA, are described hereinbelow with reference to Table 2.

As mentioned hereinabove with reference to FIG. 1, a function of VGAM405 gene, herein designated VGAM is inhibition of expression of VGAM405 target genes. It is appreciated that specific functions, and accordingly utilities, of VGAM405 correlate with, and may be deduced from, the identity of the target genes which VGAM405 binds and inhibits, and the function of these target genes, as elaborated hereinbelow.

TOSO (Accession NM_005449) is a VGAM405 host target gene. TOSO BINDING SITE is HOST TARGET binding site found in the 5' untranslated region of mRNA encoded by TOSO, corresponding to a HOST TARGET binding site such as BINDING SITE I, BINDING SITE II or BINDING SITE III. Table 2 illustrates the complementarity of the nucleotide sequences of TOSO BINDING SITE, designated SEQ ID:11935, to the nucleotide sequence of VGAM405 RNA, herein designated VGAM RNA, also designated SEQ ID:3116.

A function of VGAM405 is therefore inhibition of TOSO (Accession NM_005449). Accordingly, utilities of VGAM405 include diagnosis, prevention and treatment of diseases and clinical conditions associated with TOSO. LOC152283 (Accession XM_098196) is another VGAM405 host target gene. LOC152283 BINDING SITE is HOST TARGET binding site found in the 5' untranslated region of mRNA encoded by LOC152283, corresponding to a HOST TARGET binding site such as BINDING SITE I, BINDING SITE II or BINDING SITE III. Table 2 illustrates the complementarity of the nucleotide sequences of LOC152283 BINDING SITE, designated SEQ ID:41484, to the nucleotide sequence of VGAM405 RNA, herein designated VGAM RNA, also designated SEQ ID:3116.

Another function of VGAM405 is therefore inhibition of LOC152283 (Accession XM_098196). Accordingly, utilities of VGAM405 include diagnosis, prevention and treatment of diseases and clinical conditions associated with LOC152283. LOC255002 (Accession XM_172994) is another VGAM405 host target gene. LOC255002 BINDING SITE is HOST TARGET binding site found in the 5' untranslated region of mRNA encoded by LOC255002, corresponding to a HOST TARGET binding site such as BINDING SITE I, BINDING SITE II or BINDING SITE III. Table 2 illustrates the complementarity of the nucleotide sequences of LOC255002 BINDING SITE, designated SEQ ID:46270, to the nucleotide sequence of VGAM405 RNA, herein designated VGAM RNA, also designated SEQ ID:3116.

Another function of VGAM405 is therefore inhibition of LOC255002 (Accession XM_172994). Accordingly, utilities of VGAM405 include diagnosis, prevention and treatment of diseases and clinical conditions associated with LOC255002. LOC92017 (Accession XM_042234) is another VGAM405 host target gene. LOC92017 BINDING SITE is HOST TARGET binding site found in the 5' untranslated region of mRNA encoded by LOC92017, corresponding to a HOST TARGET binding site such as BINDING SITE I, BINDING SITE II or BINDING SITE III. Table 2 illustrates the complementarity of the nucleotide sequences of LOC92017 BINDING SITE, designated SEQ ID:33707, to the nucleotide sequence of VGAM405 RNA, herein designated VGAM RNA, also designated SEQ ID:3116.

Another function of VGAM405 is therefore inhibition of LOC92017 (Accession XM_042234). Accordingly, utilities of VGAM405 include diagnosis, prevention and treatment of diseases and clinical conditions associated with LOC92017. FIG. 1 further provides a conceptual description of a novel bioinformatically detected viral gene of the present invention, referred to here as Viral Genomic Address Messenger 406 (VGAM406) viral gene, which modulates expression of respective host target genes thereof, the function and utility of which host target genes is known in the art.

VGAM406 is a novel bioinformatically detected regulatory, non protein coding, viral micro RNA (miRNA) gene. The method by which VGAM406 was detected is described hereinabove with reference to FIGS. 1-8.

VGAM406 gene, herein designated VGAM GENE, is a viral gene contained in the genome of Cryphonectria Hypovirus 1. VGAM406 host target gene, herein designated VGAM HOST TARGET GENE, is a human gene contained in the human genome.

VGAM406 gene encodes a VGAM406 precursor RNA, herein designated VGAM PRECURSOR RNA. Similar to other miRNA genes, and unlike most ordinary genes, VGAM406 precursor RNA does not encode a protein. A nucleotide sequence identical or highly similar to the nucleotide sequence of VGAM406 precursor RNA is designated SEQ ID:392, and is provided hereinbelow with reference to the sequence listing part. Nucleotide sequence SEQ ID:392 is located at position 3878 relative to the genome of Cryphonectria Hypovirus 1.

VGAM406 precursor RNA folds onto itself, forming VGAM406 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM406 folded precursor RNA into VGAM406 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM406 RNA is designated SEQ ID:3117, and is provided hereinbelow with reference to the sequence listing part.

VGAM406 host target gene, herein designated VGAM HOST TARGET GENE, encodes a corresponding messenger RNA, VGAM406 host target RNA, herein designated VGAM HOST TARGET RNA. VGAM406 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM406 RNA, herein designated VGAM RNA, binds complementarily to one or more host target binding sites located in untranslated regions of VGAM406 host target RNA, herein designated VGAM HOST TARGET RNA. This complementary binding is due to the fact that the nucleotide sequence of VGAM406 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM406 RNA, herein designated VGAM RNA, may have a different number of host target binding sites in untranslated regions of a VGAM406 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM406 RNA, herein designated VGAM RNA, to host target binding sites on VGAM406 host target RNA, herein designated VGAM HOST TARGET RNA, such as BINDING SITE I, BINDING SITE II and BINDING SITE III, inhibits translation of VGAM406 host target RNA into VGAM406 host target protein, herein designated VGAM HOST TARGET PROTEIN. VGAM host target protein is therefore outlined by a broken line.

It is appreciated that VGAM406 host target gene, herein designated VGAM HOST TARGET GENE, in fact represents a plurality of VGAM406 host target genes. The mRNA of each one of this plurality of VGAM406 host target genes comprises one or more host target binding sites, each having a nucleotide sequence which is at least partly complementary to VGAM406 RNA, herein designated VGAM RNA, and which when bound by VGAM406 RNA causes inhibition of translation of respective one or more VGAM406 host target proteins.

It is further appreciated by one skilled in the art that the mode of translational inhibition illustrated by FIG. 1 with specific reference to translational inhibition exerted by VGAM406 gene, herein designated VGAM GENE, on one or more VGAM406 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM406 is inhibition of expression of host target genes, as part of a novel viral mechanism of attacking a host. Accordingly, utilities of VGAM406 include diagnosis, prevention and treatment of viral infection by Cryphonectria Hypovirus 1. Specific functions, and accordingly utilities, of VGAM406 correlate with, and may be deduced from, the identity of the host target genes which VGAM406 binds and inhibits, and the function of these host target genes, as elaborated hereinbelow.

Nucleotide sequences of the VGAM406 precursor RNA, herein designated VGAM PRECURSOR RNA, and of the 'diced' VGAM406 RNA, herein designated VGAM RNA, and a schematic representation of the secondary folding of VGAM406 folded precursor RNA, herein designated VGAM FOLDED PRECURSOR RNA, of VGAM406 are further described hereinbelow with reference to Table 1.

Nucleotide sequences of host target binding sites, such as BINDING SITE-I, BINDING SITE-II and BINDING SITE-III of FIG. 1, found on VGAM406 host target RNA, and schematic representation of the complementarity of each of these host target binding sites to VGAM406 RNA, herein designated VGAM RNA, are described hereinbelow with reference to Table 2.

As mentioned hereinabove with reference to FIG. 1, a function of VGAM406 gene, herein designated VGAM is inhibition of expression of VGAM406 target genes. It is appreciated that specific functions, and accordingly utilities, of VGAM406 correlate with, and may be deduced from, the identity of the target genes which VGAM406 binds and inhibits, and the function of these target genes, as elaborated hereinbelow.

Deleted In Lung and Esophageal Cancer 1 (DLEC1, Accession NM_007338) is a VGAM406 host target gene. DLEC1 BINDING SITE is HOST TARGET binding site found in the 3' untranslated region of mRNA encoded by DLEC1, corresponding to a HOST TARGET binding site such as BINDING SITE I, BINDING SITE II or BINDING SITE III. Table 2 illustrates the complementarity of the nucleotide sequences of DLEC1 BINDING SITE, designated SEQ ID:14270, to the nucleotide sequence of VGAM406 RNA, herein designated VGAM RNA, also designated SEQ ID:3117.

A function of VGAM406 is therefore inhibition of Deleted In Lung and Esophageal Cancer 1 (DLEC1, Accession NM_007338). Accordingly, utilities of VGAM406 include diagnosis, prevention and treatment of diseases and clinical conditions associated with DLEC1. Estrogen-related Receptor Beta (ESRRB, Accession XM_041087) is another VGAM406 host target gene. ESRRB BINDING SITE is HOST TARGET binding site found in the 5" untranslated region of mRNA encoded by ESRRB, corresponding to a HOST TARGET binding site such as BINDING SITE I, BINDING SITE II or BINDING SITE III. Table 2 illustrates the complementarity of the nucleotide sequences of ESRRB BINDING SITE, designated SEQ ID:33438, to the nucleotide sequence of VGAM406 RNA, herein designated VGAM RNA, also designated SEQ ID:3117.

Another function of VGAM406 is therefore inhibition of Estrogen-related Receptor Beta (ESRRB, Accession XM_041087), a gene which Estrogen-related receptor beta; member of the nuclear hormone receptor family. Accordingly, utilities of VGAM406 include diagnosis, prevention and treatment of diseases and clinical conditions associated with ESRRB. The function of ESRRB has been established by previous studies. See estrogen-related receptor-alpha (ESRRA; 601998). Giguere et al. (1988) first identified ESRRB as a gene whose product is similar to the estrogen receptor (OMIM Ref. No. 133430). Sladek et al. (1997) mapped ESRRB to 14q24.3 by fluorescence in situ hybridization. Luo et al. (1997) demonstrated that mouse Esrrb plays an essential role in placental development: homozygous null Esrrb mutants die in midgestation due to abnormal development of the chorion and defective diploid trophoblast proliferation. Its embryonic lethal phenotype prevented the identification of potential roles for ESRRB in postnatal physiology.

Full details of the abovementioned studies are described in the following publications, the disclosure of which are hereby incorporated by reference:

Luo, J.; Sladek, R.; Bader, J. A.; Matthyssen, A.; Rossant, J.; Giguere, V.: Placental abnormalities in mouse embryos lacking orphan nuclear receptor ERR-beta. Nature 388:778-782, 1997; and Sladek, R.; Beatty, B.; Squire, J.; Copeland, N. G.; Gilbert, D. J.; Jenkins, N. A.; Giguere, V.: Chromosomal mapping of the human and murine orphan receptors ERR-alpha (ESRRA) and ERR.

Further studies establishing the function and utilities of ESRRB are found in John Hopkins OMIM database record ID 602167, and in sited publications numbered 94 and 6348 listed in the bibliography section hereinbelow, which are also hereby incorporated by reference. Kruppel-like Factor 4 (gut) (KLF4, Accession NM_004235) is another VGAM406 host target gene. KLF4 BINDING SITE is HOST TARGET binding site found in the 5' untranslated region of mRNA encoded by KLF4, corresponding to a HOST TARGET binding site such as BINDING SITE I, BINDING SITE II or BINDING SITE III. Table 2 illustrates the complementarity of the nucleotide sequences of KLF4 BINDING SITE, designated SEQ ID:10429, to the nucleotide sequence of VGAM406 RNA, herein designated VGAM RNA, also designated SEQ ID:3117.

Another function of VGAM406 is therefore inhibition of Kruppel-like Factor 4 (gut) (KLF4, Accession NM_004235), a gene which may be involved in the differentiation of epithelial cells and may also function in the development of the skeleton and kidney. Accordingly, utilities of VGAM406 include diagnosis, prevention and treatment of diseases and clinical conditions associated with KLF4. The function of KLF4 has been established by previous studies. Shields et al. (1996) cloned a mouse cDNA, which they named gut-enriched Kruppel-like factor (Gklf), that encodes a member of the Kruppel family of transcription factors. Immunofluorescence revealed that Gklf is localized to the nucleus and is found at highest levels in growth-arrested cells. Shields et al. (1996) found that transfection of Gklf into COS-1 cells causes an inhibition of DNA synthesis. In the mouse, the authors found that Gklf mRNA is most abundant in the colon and is also expressed in the testis, lung, and small intestine. Garrett-Sinha et al. (1996) identified a novel zinc finger protein whose mRNA is expressed at high levels in the epidermal layer of the skin and in epithelial cells in the tongue, palate, esophagus, stomach, and colon of newborn mice. They named the protein EZF for 'epithelial zinc finger.' By screening a human umbilical vein endothelial cell cDNA library with a cDNA encoding the C-terminal zinc finger region of EKLF (KLF1; 600599), Yet et al. (1998) isolated a cDNA encoding KLF4, which they called EZF. The predicted 470-amino acid KLF4 protein has a proline- and serine-rich N terminus and contains 3 C2H2 Kruppel-type zinc fingers at the C terminus. KLF4 also contains a potential nuclear localization signal. The human KLF4 protein shares 91% sequence identity with mouse Ezf. Recombinant KLF4 bound specifically to a probe containing the CACCC core sequence in gel mobility shift assays. In contrast to other members of the EKLF family, which are transcriptional activators, KLF4 functioned as a transcriptional repressor in transient transfection studies. The authors identified both the repression domain and the activation domain within KLF4. Northern blot analysis detected a 3.5-kb KLF4 transcript in RNA from both human umbilical vein endothelial cells and human aortic endothelial cells. By radiation hybrid mapping, Yet et al. (1998) mapped the human KLF4 gene to 9q31. Garrett-Sinha et al. (1996) mapped the mouse EZF gene to chromosome 4, in close proximity to the thioredoxin gene (OMIM Ref. No. 187700). Animal model experiments lend further support to the function of KLF4. Located at the interface between body and environment, the epidermis must protect the body against toxic agents and dehydration, and protect itself against physical and mechanical stresses. Acquired just before birth and at the last stage of epidermal differentiation, the skin's proteinaceous/lipid barrier creates a surface seal essential for protecting animals against microbial infections and dehydration. Segre et al. (1999) showed that Kruppel-like factor-4 (KLF4), highly expressed in the differentiating layers of epidermis, is both vital to and selective for barrier acquisition. Klf4 -/- mice die shortly after birth due to loss of skin barrier function, as measured by penetration of external dyes and rapid loss of body fluids. The defect was not corrected by grafting of Klf4 -/- skin onto nude mice. Loss of the barrier occurred without morphologic or biochemical alterations to the well-known structural features of epidermis that are essential for mechanical integrity. Instead, late-stage differentiation structures were selectively perturbed, including the cornified envelope, a likely scaffold for lipid organization. Using suppressive hybridization, Segre et al. (1999) identified 3 transcripts encoding cornified envelope proteins with altered expression in the absence of Klf4. Sprr2a (OMIM Ref. No. 182267) was one, this being the only epidermal gene whose promoter is known to possess a functional Klf4 binding site. These studies provide a new insight into transcriptional governance of barrier function, and pave the way for unraveling the molecular events that orchestrate this essential process It is appreciated that the abovementioned animal model for KLF4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Garrett-Sinha, L. A.; Eberspaecher, H.; Seldin, M. F.; de Crombrugghe, B.: A gene for a novel zinc-finger protein expressed in differentiated epithelial cells and transiently in certain mesenchymal cells. J. Biol. Chem. 271:31384-31390, 1996; and

Segre, J. A.; Bauer, C.; Fuchs, E.: Klf4 is a transcription factor required for establishing the barrier function of the skin. Nature Genet. 22:356-360, 1999.

Further studies establishing the function and utilities of KLF4 are found in John Hopkins OMIM database record ID 602253, and in sited publications numbered 926-929 listed in the bibliography section hereinbelow, which are also hereby incorporated by reference. Neurotensin Receptor 1 (high affinity) (NTSR1, Accession NM_002531) is another VGAM406 host target gene. NTSR1 BINDING SITE is HOST TARGET binding site found in the 3' untranslated region of mRNA encoded by NTSR1, corresponding to a HOST TARGET binding site such as BINDING SITE I, BINDING SITE II or BINDING SITE III. Table 2 illustrates the complementarity of the nucleotide sequences of NTSR1 BINDING SITE, designated SEQ ID:8367, to the nucleotide sequence of VGAM406 RNA, herein designated VGAM RNA, also designated SEQ ID:3117.

Another function of VGAM406 is therefore inhibition of Neurotensin Receptor 1 (high affinity) (NTSR1, Accession NM_002531), a gene which is associated with g proteins that activate a phosphatidylinositol- calcium second messenger system. Accordingly, utilities of VGAM406 include diagnosis, prevention and treatment of diseases and clinical conditions associated with NTSR1. The function of NTSR1 and its association with various diseases and clinical conditions, has been established by previous studies, as described hereinabove with reference to VGAM200. Phospholipase A2, Group IID (PLA2G2D, Accession NM_012400) is another VGAM406 host target gene. PLA2G2D BINDING SITE is HOST TARGET binding site found in the 3' untranslated region of mRNA encoded by PLA2G2D, corresponding to a HOST TARGET binding site such as BINDING SITE I, BINDING SITE II or BINDING SITE III. Table 2 illustrates the complementarity of the nucleotide sequences of PLA2G2D BINDING SITE, designated SEQ ID:14768, to the nucleotide sequence of VGAM406 RNA, herein designated VGAM RNA, also designated SEQ ID:3117.

Another function of VGAM406 is therefore inhibition of Phospholipase A2, Group IID (PLA2G2D, Accession NM_012400), a gene which is involved in phospholipid digestion, remodeling of cell membranes, and host defense, as well as pathophysiologic processes. Accordingly, utilities of VGAM406 include diagnosis, prevention and treatment of diseases and clinical conditions associated with PLA2G2D. The function of PLA2G2D and its association with various diseases and clinical conditions, has been established by previous studies, as described hereinabove with reference to VGAM74. Recombination Activating Gene 2 (RAG2, Accession XM_089839) is another VGAM406 host target gene. RAG2 BINDING SITE is HOST TARGET binding site found in the 3' untranslated region of mRNA encoded by RAG2, corresponding to a HOST TARGET binding site such as BINDING SITE I, BINDING SITE II or BINDING SITE III. Table 2 illustrates the complementarity of the nucleotide sequences of RAG2 BINDING SITE, designated SEQ ID:39987, to the nucleotide sequence of VGAM406 RNA, herein designated VGAM RNA, also designated SEQ ID:3117.

Another function of VGAM406 is therefore inhibition of Recombination Activating Gene 2 (RAG2, Accession XM_089839). Accordingly, utilities of VGAM406 include diagnosis, prevention and treatment of diseases and clinical conditions associated with RAG2. SORCS2 (Accession NM_020777) is another VGAM406 host target gene. SORCS2 BINDING SITE is HOST TARGET binding site found in the 3' untranslated region of mRNA encoded by SORCS2, corresponding to a HOST TARGET binding site such as BINDING SITE I, BINDING SITE II or BINDING SITE III. Table 2 illustrates the complementarity of the nucleotide sequences of SORCS2 BINDING SITE, designated SEQ ID:21874, to the nucleotide sequence of VGAM406 RNA, herein designated VGAM RNA, also designated SEQ ID:3117.

Another function of VGAM406 is therefore inhibition of SORCS2 (Accession NM_020777). Accordingly, utilities of VGAM406 include diagnosis, prevention and treatment of diseases and clinical conditions associated with SORCS2. TEM5 (Accession NM_032777) is another VGAM406 host target gene. TEM5 BINDING SITE is HOST TARGET binding site found in the 3' untranslated region of mRNA encoded by TEM5, corresponding to a HOST TARGET binding site such as BINDING SITE I, BINDING SITE II or BINDING SITE III. Table 2 illustrates the complementarity of the nucleotide sequences of TEM5 BINDING SITE, designated SEQ ID:26520, to the nucleotide sequence of VGAM406 RNA, herein designated VGAM RNA, also designated SEQ ID:3117.

Another function of VGAM406 is therefore inhibition of TEM5 (Accession NM_032777), a gene which involves in development of midline glia and commissural axon pathways. Accordingly, utilities of VGAM406 include diagnosis, prevention and treatment of diseases and clinical conditions associated with TEM5. The function of TEM5 has been established by previous studies. Using serial analysis of gene expression (SAGE), St Croix et al. (2000) identified partial cDNAs corresponding to several tumor endothelial markers (TEMs) that displayed elevated expression during tumor angiogenesis. Among the genes they identified was TEM5. Using database searches and 5-prime RACE, Carson-Walter et al. (2001) derived sequences covering the entire TEM5 coding region, which encodes a predicted 7-pass transmembrane protein of 1,331 amino acids. The N-terminal extracellular region contains 4 simple leucine-rich repeats (LRRs), a C-terminal LRR, an immunoglobulin-type domain, a hormone receptor domain, and a putative G protein-coupled receptor (GPCR) proteolysis site domain typical of class II family members and required for endogenous proteolysis. Based on sequence analysis and hydrophobicity plots, Carson-Walter et al. (2001) hypothesized that TEM5 may be a member of the GPCR superfamily involved in transmitting signals across the cell membrane. The mouse ortholog of TEM5 shares 87% amino acid identity with the human protein. In situ hybridization analysis of human colorectal cancer by Carson-Walter et al. (2001) revealed that TEM5 was expressed clearly in the endothelial cells of the tumor stroma but not in the endothelial cells of normal colonic tissue. The authors used in situ hybridization to examine Tem5 expression in murine tumors, embryos, and adult tissues. They detected Tem5 in the vasculature of developing embryonic liver and brain as well as in the vessels of transplanted syngeneic and human tumors. In various normal adult mouse tissues, Carson-Walter et al. (2001) detected weak Tem5 expression only in a small fraction of the vessels of brain, heart, intestine, lung, skeletal muscle, and pancreas.

Full details of the abovementioned studies are described in the following publications, the disclosure of which are hereby incorporated by reference:

Carson-Walter, E. B.; Watkins, D. N.; Nanda, A.; Vogelstein, B.; Kinzler, K. W.; St. Croix, B.: Cell surface tumor endothelial markers are conserved in mice and human S. Cancer Res. 61:6649-6655, 2001; and St. Croix, B.; Rago, C.; Velculescu, V.; Traverso, G.; Romans, K. E.; Montgomery, E.; Lal, A.; Riggins, G. J.; Lengauer, C.; Vogelstein, B.; Kinzler, K. W.: Genes expressed in human tu.

Further studies establishing the function and utilities of TEM5 are found in John Hopkins OMIM database record ID 606823, and in sited publications numbered 689 and 6907 listed in the bibliography section hereinbelow, which are also hereby incorporated by reference. UDP-Gal:betaGlcNAc Beta 1,3-galactosyltransferase, Polypeptide 1 (B3GALT1, Accession NM_020981) is another VGAM406 host target gene. B3GALT1 BINDING SITE is HOST TARGET binding site found in the 5' untranslated region of mRNA encoded by B3GALT1, corresponding to a HOST TARGET binding site such as BINDING SITE I, BINDING SITE II or BINDING SITE III. Table 2 illustrates the complementarity of the nucleotide sequences of B3GALT1 BINDING SITE, designated SEQ ID:21972, to the nucleotide sequence of VGAM406 RNA, herein designated VGAM RNA, also designated SEQ ID:3117.

Another function of VGAM406 is therefore inhibition of UDP-Gal:betaGlcNAc Beta 1,3-galactosyltransferase, Polypeptide 1 (B3GALT1, Accession NM_020981). Accordingly, utilities of VGAM406 include diagnosis, prevention and treatment of diseases and clinical conditions associated with B3GALT1. FLJ23816 (Accession NM_144655) is another VGAM406 host target gene. FLJ23816 BINDING SITE is HOST TARGET binding site found in the 5' untranslated region of mRNA encoded by FLJ23816, corresponding to a HOST TARGET binding site such as BINDING SITE I, BINDING SITE II or BINDING SITE III. Table 2 illustrates the complementarity of the nucleotide sequences of FLJ23816 BINDING SITE, designated SEQ ID:29478, to the nucleotide sequence of VGAM406 RNA, herein designated VGAM RNA, also designated SEQ ID:3117.

Another function of VGAM406 is therefore inhibition of FLJ23816 (Accession NM_144655). Accordingly, utilities of VGAM406 include diagnosis, prevention and treatment of diseases and clinical conditions associated with FLJ23816. FLJ31737 (Accession NM_144984) is another VGAM406 host target gene. FLJ31737 BINDING SITE is HOST TARGET binding site found in the 3' untranslated region of mRNA encoded by FLJ31737, corresponding to a HOST TARGET binding site such as BINDING SITE I, BINDING SITE II or BINDING SITE III. Table 2 illustrates the complementarity of the nucleotide sequences of FLJ31737 BINDING SITE, designated SEQ ID:29589, to the nucleotide sequence of VGAM406 RNA, herein designated VGAM RNA, also designated SEQ ID:3117.

Another function of VGAM406 is therefore inhibition of FLJ31737 (Accession NM_144984). Accordingly, utilities of VGAM406 include diagnosis, prevention and treatment of diseases and clinical conditions associated with FLJ31737. GLTP (Accession NM_016433) is another VGAM406 host target gene. GLTP BINDING SITE is HOST TARGET binding site found in the 3" untranslated region of mRNA encoded by GLTP, corresponding to a HOST TARGET binding site such as BINDING SITE I, BINDING SITE II or BINDING SITE III. Table 2 illustrates the complementarity of the nucleotide sequences of GLTP BINDING SITE, designated SEQ ID:18556, to the nucleotide sequence of VGAM406 RNA, herein designated VGAM RNA, also designated SEQ ID:3117.

Another function of VGAM406 is therefore inhibition of GLTP (Accession NM_016433). Accordingly, utilities of VGAM406 include diagnosis, prevention and treatment of diseases and clinical conditions associated with GLTP. KIAA0828 (Accession XM_088105) is another VGAM406 host target gene. KIAA0828 BINDING SITE is HOST TARGET binding site found in the 3" untranslated region of mRNA encoded by KIAA0828, corresponding to a HOST TARGET binding site such as BINDING SITE I, BINDING SITE II or BINDING SITE III. Table 2 illustrates the complementarity of the nucleotide sequences of KIAA0828 BINDING SITE, designated SEQ ID:39515, to the nucleotide sequence of VGAM406 RNA, herein designated VGAM RNA, also designated SEQ ID:3117.

Another function of VGAM406 is therefore inhibition of KIAA0828 (Accession XM_088105). Accordingly, utilities of VGAM406 include diagnosis, prevention and treatment of diseases and clinical conditions associated with KIAA0828. Pleiomorphic Adenoma Gene-like 2 (PLAGL2, Accession XM_047007) is another VGAM406 host target gene. PLAGL2 BINDING SITE is HOST TARGET binding site found in the 3' untranslated region of mRNA encoded by PLAGL2, corresponding to a HOST TARGET binding site such as BINDING SITE I, BINDING SITE II or BINDING SITE III. Table 2 illustrates the complementarity of the nucleotide sequences of PLAGL2 BINDING SITE, designated SEQ ID:34875, to the nucleotide sequence of VGAM406 RNA, herein designated VGAM RNA, also designated SEQ ID:3117.

Another function of VGAM406 is therefore inhibition of Pleiomorphic Adenoma Gene-like 2 (PLAGL2, Accession XM_047007). Accordingly, utilities of VGAM406 include diagnosis, prevention and treatment of diseases and clinical conditions associated with PLAGL2. RASD Family, Member 2 (RASD2, Accession NM_014310) is another VGAM406 host target gene. RASD2 BINDING SITE is HOST TARGET binding site found in the 3' untranslated region of mRNA encoded by RASD2, corresponding to a HOST TARGET binding site such as BINDING SITE I, BINDING SITE II or BINDING SITE III. Table 2 illustrates the complementarity of the nucleotide sequences of RASD2 BINDING SITE, designated SEQ ID:15607, to the nucleotide sequence of VGAM406 RNA, herein designated VGAM RNA, also designated SEQ ID:3117.

Another function of VGAM406 is therefore inhibition of RASD Family, Member 2 (RASD2, Accession NM_014310). Accordingly, utilities of VGAM406 include diagnosis, prevention and treatment of diseases and clinical conditions associated with RASD2. LOC200205 (Accession XM_114152) is another VGAM406 host target gene. LOC200205 BINDING SITE is HOST TARGET binding site found in the 3' untranslated region of mRNA encoded by LOC200205, corresponding to a HOST TARGET binding site such as BINDING SITE I, BINDING SITE II or BINDING SITE III. Table 2 illustrates the complementarity of the nucleotide sequences of LOC200205 BINDING SITE, designated SEQ ID:42737, to the nucleotide sequence of VGAM406 RNA, herein designated VGAM RNA, also designated SEQ ID:3117.

Another function of VGAM406 is therefore inhibition of LOC200205 (Accession XM_114152). Accordingly, utilities of VGAM406 include diagnosis, prevention and treatment of diseases and clinical conditions associated with LOC200205. LOC204084 (Accession XM_115181) is another VGAM406 host target gene. LOC204084 BINDING SITE is HOST TARGET binding site found in the 5' untranslated region of mRNA encoded by LOC204084, corresponding to a HOST TARGET binding site such as BINDING SITE I, BINDING SITE II or BINDING SITE III. Table 2 illustrates the complementarity of the nucleotide sequences of LOC204084 BINDING SITE, designated SEQ ID:43084, to the nucleotide sequence of VGAM406 RNA, herein designated VGAM RNA, also designated SEQ ID:3117.

Another function of VGAM406 is therefore inhibition of LOC204084 (Accession XM_115181). Accordingly, utilities of VGAM406 include diagnosis, prevention and treatment of diseases and clinical conditions associated with LOC204084. LOC221632 (Accession XM_168117) is another VGAM406 host target gene. LOC221632 BINDING SITE is HOST TARGET binding site found in the 3' untranslated region of mRNA encoded by LOC221632, corresponding to a HOST TARGET binding site such as BINDING SITE I, BINDING SITE II or BINDING SITE III. Table 2 illustrates the complementarity of the nucleotide sequences of LOC221632 BINDING SITE, designated SEQ ID:45036, to the nucleotide sequence of VGAM406 RNA, herein designated VGAM RNA, also designated SEQ ID:3117.

Another function of VGAM406 is therefore inhibition of LOC221632 (Accession XM_168117). Accordingly, utilities of VGAM406 include diagnosis, prevention and treatment of diseases and clinical conditions associated with LOC221632. LOC90768 (Accession XM_033986) is another VGAM406 host target gene. LOC90768 BINDING SITE is HOST TARGET binding site found in the 3' untranslated region of mRNA encoded by LOC90768, corresponding to a HOST TARGET binding site such as BINDING SITE I, BINDING SITE II or BINDING SITE III. Table 2 illustrates the complementarity of the nucleotide sequences of LOC90768 BINDING SITE, designated SEQ ID:31985, to the nucleotide sequence of VGAM406 RNA, herein designated VGAM RNA, also designated SEQ ID:3117.

Another function of VGAM406 is therefore inhibition of LOC90768 (Accession XM_033986). Accordingly, utilities of VGAM406 include diagnosis, prevention and treatment of diseases and clinical conditions associated with LOC90768. FIG. 1 further provides a conceptual description of a novel bioinformatically detected viral gene of the present invention, referred to here as Viral Genomic Address Messenger 407 (VGAM407) viral gene, which modulates expression of respective host target genes thereof, the function and utility of which host target genes is known in the art.

VGAM407 is a novel bioinformatically detected regulatory, non protein coding, viral micro RNA (miRNA) gene. The method by which VGAM407 was detected is described hereinabove with reference to FIGS. 1-8.

VGAM407 gene, herein designated VGAM GENE, is a viral gene contained in the genome of Melon Necrotic Spot Virus. VGAM407 host target gene, herein designated VGAM HOST TARGET GENE, is a human gene contained in the human genome.

VGAM407 gene encodes a VGAM407 precursor RNA, herein designated VGAM PRECURSOR RNA. Similar to other miRNA genes, and unlike most ordinary genes, VGAM407 precursor RNA does not encode a protein. A nucleotide sequence identical or highly similar to the nucleotide sequence of VGAM407 precursor RNA is designated SEQ ID:393, and is provided hereinbelow with reference to the sequence listing part. Nucleotide sequence SEQ ID:393 is located at position 1162 relative to the genome of Melon Necrotic Spot Virus.

VGAM407 precursor RNA folds onto itself, forming VGAM407 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM407 folded precursor RNA into VGAM407 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM407 RNA is designated SEQ ID:3118, and is provided hereinbelow with reference to the sequence listing part.

VGAM407 host target gene, herein designated VGAM HOST TARGET GENE, encodes a corresponding messenger RNA, VGAM407 host target RNA, herein designated VGAM HOST TARGET RNA. VGAM407 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM407 RNA, herein designated VGAM RNA, binds complementarily to one or more host target binding sites located in untranslated regions of VGAM407 host target RNA, herein designated VGAM HOST TARGET RNA. This complementary binding is due to the fact that the nucleotide sequence of VGAM407 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM407 RNA, herein designated VGAM RNA, may have a different number of host target binding sites in untranslated regions of a VGAM407 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM407 RNA, herein designated VGAM RNA, to host target binding sites on VGAM407 host target RNA, herein designated VGAM HOST TARGET RNA, such as BINDING SITE I, BINDING SITE II and BINDING SITE III, inhibits translation of VGAM407 host target RNA into VGAM407 host target protein, herein designated VGAM HOST TARGET PROTEIN. VGAM host target protein is therefore outlined by a broken line.

It is appreciated that VGAM407 host target gene, herein designated VGAM HOST TARGET GENE, in fact represents a plurality of VGAM407 host target genes. The mRNA of each one of this plurality of VGAM407 host target genes comprises one or more host target binding sites, each having a nucleotide sequence which is at least partly complementary to VGAM407 RNA, herein designated VGAM RNA, and which when bound by VGAM407 RNA causes inhibition of translation of respective one or more VGAM407 host target proteins.

It is further appreciated by one skilled in the art that the mode of translational inhibition illustrated by FIG. 1 with specific reference to translational inhibition exerted by VGAM407 gene, herein designated VGAM GENE, on one or more VGAM407 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM407 is inhibition of expression of host target genes, as part of a novel viral mechanism of attacking a host. Accordingly, utilities of VGAM407 include diagnosis, prevention and treatment of viral infection by Melon Necrotic Spot Virus. Specific functions, and accordingly utilities, of VGAM407 correlate with, and may be deduced from, the identity of the host target genes which VGAM407 binds and inhibits, and the function of these host target genes, as elaborated hereinbelow.

Nucleotide sequences of the VGAM407 precursor RNA, herein designated VGAM PRECURSOR RNA, and of the 'diced' VGAM407 RNA, herein designated VGAM RNA, and a schematic representation of the secondary folding of VGAM407 folded precursor RNA, herein designated VGAM FOLDED PRECURSOR RNA, of VGAM407 are further described hereinbelow with reference to Table 1.

Nucleotide sequences of host target binding sites, such as BINDING SITE-I, BINDING SITE-II and BINDING SITE-III of FIG. 1, found on VGAM407 host target RNA, and schematic representation of the complementarity of each of these host target binding sites to VGAM407 RNA, herein designated VGAM RNA, are described hereinbelow with reference to Table 2.

As mentioned hereinabove with reference to FIG. 1, a function of VGAM407 gene, herein designated VGAM is inhibition of expression of VGAM407 target genes. It is appreciated that specific functions, and accordingly utilities, of VGAM407 correlate with, and may be deduced from, the identity of the target genes which VGAM407 binds and inhibits, and the function of these target genes, as elaborated hereinbelow.

Paired Box Gene 2 (PAX2, Accession NM_003987) is a VGAM407 host target gene. PAX2 BINDING SITE1 and PAX2 BINDING SITE2 are HOST TARGET binding sites found in untranslated regions of mRNA encoded by PAX2, corresponding to HOST TARGET binding sites such as BINDING SITE I, BINDING SITE II or BINDING SITE III. Table 2 illustrates the complementarity of the nucleotide sequences of PAX2 BINDING SITE1 and PAX2 BINDING SITE2, designated SEQ ID:10137 and SEQ ID:10143 respectively, to the nucleotide sequence of VGAM407 RNA, herein designated VGAM RNA, also designated SEQ ID:3118.

A function of VGAM407 is therefore inhibition of Paired Box Gene 2 (PAX2, Accession NM_003987), a gene which involves in kidney cell differentiation. Accordingly, utilities of VGAM407 include diagnosis, prevention and treatment of diseases and clinical conditions associated with PAX2. The function of PAX2 has been established by previous studies. Sanyanusin et al. (1996) obtained the complete genomic structure of the human PAX2 gene. They described 5 genomic lambda clones containing human PAX2 gene sequences, 4 of which had previously been reported by them (Sanyanusin et al., 1995). The fifth clone, which included exons 7 and 8, was obtained by Sanyanusin et al. (1996) from a subgenomic lambda cDNA library of size-fractionated EcoRI fragments ranging in size from 6 to 8 kb. Sequencing and restriction mapping of these clones showed that the human PAX2 gene is composed of 12 exons spanning approximately 70 kb. They also found 2 alternatively spliced exons corresponding to exon 10 (Ward et al., 1994) and a 69-bp inserted sequence that they designated as exon 6. The 69-bp insert is homologous to a 69-bp insert reported in the murine Pax2 gene by Dressler et al. (1990). Sanyanusin et al. (1996) identified a (CA) n dinucleotide repeat polymorphism in PAX2 which they mapped immediately upstream of exon 9. The PAX2 gene is expressed in primitive cells of the kidney, ureter, eye, ear, and central nervous system. Based on the known expression pattern of PAX2, Sanyanusin et al. (1995) predicted that the phenotype caused by mutations of PAX2 would probably consist of autosomal dominant eye malformations, sensorineural hearing loss, and renal hypoplasia. Pursuing this suspicion, they found deletion of a single nucleotide in exon 5 of the PAX2 gene (167409.0001) in a father and 3 of his 5 sons who had optic nerve colobomas, renal hypoplasia, mild proteinuria, and vesicoureteral reflux. The nucleotide deletion caused a frameshift in the conserved octapeptide sequence. The phenotype was similar to that of Krd mutant mice which lack a portion of chromosome 19 that is homologous to human 10q24 and includes the Pax2 gene. These mice have reduced thickness of the renal cortex, a reduced number of glomeruli at birth, and reduced amplitudes on electroretinogram. In the Krd mouse, the deletion of chromosome 19 was transgene-induced (Keller et al., 1994). Coloboma of the optic nerve with renal disease (OMIM Ref. No. 120330) is a recognized syndrome. Renal dysplasia and retinal aplasia are combined in the Loken-Senior syndrome (OMIM Ref. No. 266900). Ocular abnormalities occur also with familial juvenile nephronophthisis (OMIM Ref. No. 256100), but that disorder maps to chromosome 2. Animal model experiments lend further support to the function of PAX2. To determine the direct effects of PAX2 mutations on kidney development, fetal kidneys of mice carrying a Pax2(1Neu) mutation were examined. At embryonic day 15 (E15), heterozygous mutant kidneys were approximately 60% the size of those of wild-type littermates, and the number of nephrons was strikingly reduced. Heterozygous mutant mice showed increased apoptotic cell death during fetal kidney development, but the increased apoptosis was not associated with random stochastic inactivation of Pax2 expression in mutant kidneys; Pax2 was shown to be biallelically expressed during kidney development. The findings supported the conclusion that heterozygous mutations of the PAX2 gene are associated with increased apoptosis and reduced branching of the ureteric bud, due to reduced PAX2 dosage during a critical window in kidney development.

It is appreciated that the abovementioned animal model for PAX2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sanyanusin, P.; Schimmenti, L. A.; McNoe, L. A.; Ward, T. A.; Pierpont, M. E. M.; Sullivan, M. J.; Dobyns, W. B.; Eccles, M. R.: Mutation of the PAX2 gene in a family with optic nerve colobomas, renal anomalies and vesicoureteral reflux. Nature Genet. 9:358-364, 1995; and Porteous, S.; Torban, E.; Cho, N.-P.; Cunliffe, H.; Chua, L.; McNoe, L.; Ward, T.; Souza, C.; Gus, P.; Giugliani, R.; Sato, T.; Yun, K.; Favor, J.; Sicotte, M.; Goodyer, P.; Eccles, M.

Further studies establishing the function and utilities of PAX2 are found in John Hopkins OMIM database record ID 167409, and in sited publications numbered 10331-10334, 10339-10338, 593 and 10708-10718 listed in the bibliography section hereinbelow, which are also hereby incorporated by reference. KIAA0397 (Accession XM_029438) is another VGAM407 host target gene. KIAA0397 BINDING SITE is HOST TARGET binding site found in the 5' untranslated region of mRNA encoded by KIAA0397, corresponding to a HOST TARGET binding site such as BINDING SITE I, BINDING SITE II or BINDING SITE III. Table 2 illustrates the complementarity of the nucleotide sequences of KIAA0397 BINDING SITE, designated SEQ ID:30895, to the nucleotide sequence of VGAM407 RNA, herein designated VGAM RNA, also designated SEQ ID:3118.

Another function of VGAM407 is therefore inhibition of KIAA0397 (Accession XM_029438). Accordingly, utilities of VGAM407 include diagnosis, prevention and treatment of diseases and clinical conditions associated with KIAA0397. KIAA1036 (Accession NM_014909) is another VGAM407 host target gene. KIAA1036 BINDING SITE is HOST TARGET binding site found in the 3' untranslated region of mRNA encoded by KIAA1036, corresponding to a HOST TARGET binding site such as BINDING SITE I, BINDING SITE II or BINDING SITE III. Table 2 illustrates the complementarity of the nucleotide sequences of KIAA1036 BINDING SITE, designated SEQ ID:17123, to the nucleotide sequence of VGAM407 RNA, herein designated VGAM RNA, also designated SEQ ID:3118.

Another function of VGAM407 is therefore inhibition of KIAA1036 (Accession NM_014909). Accordingly, utilities of VGAM407 include diagnosis, prevention and treatment of diseases and clinical conditions associated with KIAA1036. Mitogen-activated Protein Kinase 8 Interacting Protein 2 (MAPK8IP2, Accession NM_016431) is another VGAM407 host target gene. MAPK8IP2 BINDING SITE1 through MAPK8IP2 BINDING SITE3 are HOST TARGET binding sites found in untranslated regions of mRNA encoded by MAPK8IP2, corresponding to HOST TARGET binding sites such as BINDING SITE I, BINDING SITE II or BINDING SITE III. Table 2 illustrates the complementarity of the nucleotide sequences of MAPK8IP2 BINDING SITE1 through MAPK8IP2 BINDING SITE3, designated SEQ ID:18551, SEQ ID:14703 and SEQ ID:29154 respectively, to the nucleotide sequence of VGAM407 RNA, herein designated VGAM RNA, also designated SEQ ID:3118.

Another function of VGAM407 is therefore inhibition of Mitogen-activated Protein Kinase 8 Interacting Protein 2 (MAPK8IP2, Accession NM_016431). Accordingly, utilities of VGAM407 include diagnosis, prevention and treatment of diseases and clinical conditions associated with MAPK8IP2. LOC159121 (Accession XM_099028) is another VGAM407 host target gene. LOC159121 BINDING SITE is HOST TARGET binding site found in the 5' untranslated region of mRNA encoded by LOC159121, corresponding to a HOST TARGET binding site such as BINDING SITE I, BINDING SITE II or BINDING SITE III. Table 2 illustrates the complementarity of the nucleotide sequences of LOC159121 BINDING SITE, designated SEQ ID:42066, to the nucleotide sequence of VGAM407 RNA, herein designated VGAM RNA, also designated SEQ ID:3118.

Another function of VGAM407 is therefore inhibition of LOC159121 (Accession XM_099028). Accordingly, utilities of VGAM407 include diagnosis, prevention and treatment of diseases and clinical conditions associated with LOC159121. LOC163682 (Accession XM_099402) is another VGAM407 host target gene. LOC163682 BINDING SITE is HOST TARGET binding site found in the 5' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42099, to the nucleotide sequence of VGAM407 RNA, herein designated VGAM RNA, also designated SEQ ID:3118.

Another function of VGAM407 is therefore inhibition of LOC163682 (Accession XM_099402). Accordingly, utilities of VGAM407 include diagnosis, prevention and treatment of diseases and clinical conditions associated with LOC163682. LOC51068 (Accession NM_015938) is another VGAM407 host target gene. LOC51068 BINDING SITE is HOST TARGET binding site found in the 3' untranslated region of mRNA encoded by LOC51068, corresponding to a HOST TARGET binding site such as BINDING SITE I, BINDING SITE II or BINDING SITE III. Table 2 illustrates the complementarity of the nucleotide sequences of LOC51068 BINDING SITE, designated SEQ ID:18059, to the nucleotide sequence of VGAM407 RNA, herein designated VGAM RNA, also designated SEQ ID:3118.

Another function of VGAM407 is therefore inhibition of LOC51068 (Accession NM_015938). Accordingly, utilities of VGAM407 include diagnosis, prevention and treatment of diseases and clinical conditions associated with LOC51068. LOC92335 (Accession XM_044379) is another VGAM407 host target gene. LOC92335 BINDING SITE is HOST TARGET binding site found in the 3' untranslated region of mRNA encoded by LOC92335, corresponding to a HOST TARGET binding site such as BINDING SITE I, BINDING SITE II or BINDING SITE III. Table 2 illustrates the complementarity of the nucleotide sequences of LOC92335 BINDING SITE, designated SEQ ID:34192, to the nucleotide sequence of VGAM407 RNA, herein designated VGAM RNA, also designated SEQ ID:3118.

Another function of VGAM407 is therefore inhibition of LOC92335 (Accession XM_044379). Accordingly, utilities of VGAM407 include diagnosis, prevention and treatment of diseases and clinical conditions associated with LOC92335. FIG. 1 further provides a conceptual description of a novel bioinformatically detected viral gene of the present invention, referred to here as Viral Genomic Address Messenger 408 (VGAM408) viral gene, which modulates expression of respective host target genes thereof, the function and utility of which host target genes is known in the art.

VGAM408 is a novel bioinformatically detected regulatory, non protein coding, viral micro RNA (miRNA) gene. The method by which VGAM408 was detected is described hereinabove with reference to FIGS. 1-8.

VGAM408 gene, herein designated VGAM GENE, is a viral gene contained in the genome of Melon Necrotic Spot Virus. VGAM408 host target gene, herein designated VGAM HOST TARGET GENE, is a human gene contained in the human genome.

VGAM408 gene encodes a VGAM408 precursor RNA, herein designated VGAM PRECURSOR RNA. Similar to other miRNA genes, and unlike most ordinary genes, VGAM408 precursor RNA does not encode a protein. A nucleotide sequence identical or highly similar to the nucleotide sequence of VGAM408 precursor RNA is designated SEQ ID:394, and is provided hereinbelow with reference to the sequence listing part. Nucleotide sequence SEQ ID:394 is located at position 266 relative to the genome of Melon Necrotic Spot Virus.

VGAM408 precursor RNA folds onto itself, forming VGAM408 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM408 folded precursor RNA into VGAM408 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM408 RNA is designated SEQ ID:3119, and is provided hereinbelow with reference to the sequence listing part.

VGAM408 host target gene, herein designated VGAM HOST TARGET GENE, encodes a corresponding messenger RNA, VGAM408 host target RNA, herein designated VGAM HOST TARGET RNA. VGAM408 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM408 RNA, herein designated VGAM RNA, binds complementarily to one or more host target binding sites located in untranslated regions of VGAM408 host target RNA, herein designated VGAM HOST TARGET RNA. This complementary binding is due to the fact that the nucleotide sequence of VGAM408 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM408 RNA, herein designated VGAM RNA, may have a different number of host target binding sites in untranslated regions of a VGAM408 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM408 RNA, herein designated VGAM RNA, to host target binding sites on VGAM408 host target RNA, herein designated VGAM HOST TARGET RNA, such as BINDING SITE I, BINDING SITE II and BINDING SITE III, inhibits translation of VGAM408 host target RNA into VGAM408 host target protein, herein designated VGAM HOST TARGET PROTEIN. VGAM host target protein is therefore outlined by a broken line.

It is appreciated that VGAM408 host target gene, herein designated VGAM HOST TARGET GENE, in fact represents a plurality of VGAM408 host target genes. The mRNA of each one of this plurality of VGAM408 host target genes comprises one or more host target binding sites, each having a nucleotide sequence which is at least partly complementary to VGAM408 RNA, herein designated VGAM RNA, and which when bound by VGAM408 RNA causes inhibition of translation of respective one or more VGAM408 host target proteins.

It is further appreciated by one skilled in the art that the mode of translational inhibition illustrated by FIG. 1 with specific reference to translational inhibition exerted by VGAM408 gene, herein designated VGAM GENE, on one or more VGAM408 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM408 is inhibition of expression of host target genes, as part of a novel viral mechanism of attacking a host. Accordingly, utilities of VGAM408 include diagnosis, prevention and treatment of viral infection by Melon Necrotic Spot Virus. Specific functions, and accordingly utilities, of VGAM408 correlate with, and may be deduced from, the identity of the host target genes which VGAM408 binds and inhibits, and the function of these host target genes, as elaborated hereinbelow.

Nucleotide sequences of the VGAM408 precursor RNA, herein designated VGAM PRECURSOR RNA, and of the 'diced' VGAM408 RNA, herein designated VGAM RNA, and a schematic representation of the secondary folding of VGAM408 folded precursor RNA, herein designated VGAM FOLDED PRECURSOR RNA, of VGAM408 are further described hereinbelow with reference to Table 1.

Nucleotide sequences of host target binding sites, such as BINDING SITE-I, BINDING SITE-II and BINDING SITE-III of FIG. 1, found on VGAM408 host target RNA, and schematic representation of the complementarity of each of these host target binding sites to VGAM408 RNA, herein designated VGAM RNA, are described hereinbelow with reference to Table 2.

As mentioned hereinabove with reference to FIG. 1, a function of VGAM408 gene, herein designated VGAM is inhibition of expression of VGAM408 target genes. It is appreciated that specific functions, and accordingly utilities, of VGAM408 correlate with, and may be deduced from, the identity of the target genes which VGAM408 binds and inhibits, and the function of these target genes, as elaborated hereinbelow.

A Kinase (PRKA) Anchor Protein 6 (AKAP6, Accession NM_004274) is a VGAM408 host target gene. AKAP6 BINDING SITE is HOST TARGET binding site found in the 3' untranslated region of mRNA encoded by AKAP6, corresponding to a HOST TARGET binding site such as BINDING SITE I, BINDING SITE II or BINDING SITE III. Table 2 illustrates the complementarity of the nucleotide sequences of AKAP6 BINDING SITE, designated SEQ ID:10488, to the nucleotide sequence of VGAM408 RNA, herein designated VGAM RNA, also designated SEQ ID:3119.

A function of VGAM408 is therefore inhibition of A Kinase (PRKA) Anchor Protein 6 (AKAP6, Accession NM_004274). Accordingly, utilities of VGAM408 include diagnosis, prevention and treatment of diseases and clinical conditions associated with AKAP6. Rho Guanine Nucleotide Exchange Factor (GEF) 11 (ARHGEF11, Accession NM_014784) is another VGAM408 host target gene. ARHGEF11 BINDING SITE is HOST TARGET binding site found in the 5' untranslated region of mRNA encoded by ARHGEF11, corresponding to a HOST TARGET binding site such as BINDING SITE I, BINDING SITE II or BINDING SITE III. Table 2 illustrates the complementarity of the nucleotide sequences of ARHGEF11 BINDING SITE, designated SEQ ID:16638, to the nucleotide sequence of VGAM408 RNA, herein designated VGAM RNA, also designated SEQ ID:3119.

Another function of VGAM408 is therefore inhibition of Rho Guanine Nucleotide Exchange Factor (GEF) 11 (ARHGEF11, Accession NM_014784). Accordingly, utilities of VGAM408 include diagnosis, prevention and treatment of diseases and clinical conditions associated with ARHGEF11.

LOC149157 (Accession XM_086442) is another VGAM408 host target gene. LOC149157 BINDING SITE is HOST TARGET binding site found in the 3' untranslated region of mRNA encoded by LOC149157, corresponding to a HOST TARGET binding site such as BINDING SITE I, BINDING SITE II or BINDING SITE III. Table 2 illustrates the complementarity of the nucleotide sequences of LOC149157 BINDING SITE, designated SEQ ID:38657, to the nucleotide sequence of VGAM408 RNA, herein designated VGAM RNA, also designated SEQ ID:3119.

Another function of VGAM408 is therefore inhibition of LOC149157 (Accession XM_086442). Accordingly, utilities of VGAM408 include diagnosis, prevention and treatment of diseases and clinical conditions associated with LOC149157.

FIG. 1 further provides a conceptual description of a novel bioinformatically detected viral gene of the present invention, referred to here as Viral Genomic Address Messenger 409 (VGAM409) viral gene, which modulates expression of respective host target genes thereof, the function and utility of which host target genes is known in the art.

VGAM409 is a novel bioinformatically detected regulatory, non protein coding, viral micro RNA (miRNA) gene. The method by which VGAM409 was detected is described hereinabove with reference to FIGS. 1-8.

VGAM409 gene, herein designated VGAM GENE, is a viral gene contained in the genome of Melon Necrotic Spot Virus. VGAM409 host target gene, herein designated VGAM HOST TARGET GENE, is a human gene contained in the human genome.

VGAM409 gene encodes a VGAM409 precursor RNA, herein designated VGAM PRECURSOR RNA. Similar to other miRNA genes, and unlike most ordinary genes, VGAM409 precursor RNA does not encode a protein. A nucleotide sequence identical or highly similar to the nucleotide sequence of VGAM409 precursor RNA is designated SEQ ID:395, and is provided hereinbelow with reference to the sequence listing part. Nucleotide sequence SEQ ID:395 is located at position 894 relative to the genome of Melon Necrotic Spot Virus.

VGAM409 precursor RNA folds onto itself, forming VGAM409 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM409 folded precursor RNA into VGAM409 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM409 RNA is designated SEQ ID:3120, and is provided hereinbelow with reference to the sequence listing part.

VGAM409 host target gene, herein designated VGAM HOST TARGET GENE, encodes a corresponding messenger RNA, VGAM409 host target RNA, herein designated VGAM HOST TARGET RNA. VGAM409 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM409 RNA, herein designated VGAM RNA, binds complementarily to one or more host target binding sites located in untranslated regions of VGAM409 host target RNA, herein designated VGAM HOST TARGET RNA. This complementary binding is due to the fact that the nucleotide sequence of VGAM409 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM409 RNA, herein designated VGAM RNA, may have a different number of host target binding sites in untranslated regions of a VGAM409 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM409 RNA, herein designated VGAM RNA, to host target binding sites on VGAM409 host target RNA, herein designated VGAM HOST TARGET RNA, such as BINDING SITE I, BINDING SITE II and BINDING SITE III, inhibits translation of VGAM409 host target RNA into VGAM409 host target protein, herein designated VGAM HOST TARGET PROTEIN. VGAM host target protein is therefore outlined by a broken line.

It is appreciated that VGAM409 host target gene, herein designated VGAM HOST TARGET GENE, in fact represents a plurality of VGAM409 host target genes. The mRNA of each one of this plurality of VGAM409 host target genes comprises one or more host target binding sites, each having a nucleotide sequence which is at least partly complementary to VGAM409 RNA, herein designated VGAM RNA, and which when bound by VGAM409 RNA causes inhibition of translation of respective one or more VGAM409 host target proteins.

It is further appreciated by one skilled in the art that the mode of translational inhibition illustrated by FIG. 1 with specific reference to translational inhibition exerted by VGAM409 gene, herein designated VGAM GENE, on one or more VGAM409 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM409 is inhibition of expression of host target genes, as part of a novel viral mechanism of attacking a host. Accordingly, utilities of VGAM409 include diagnosis, prevention and treatment of viral infection by Melon Necrotic Spot Virus. Specific functions, and accordingly utilities, of VGAM409 correlate with, and may be deduced from, the identity of the host target genes which VGAM409 binds and inhibits, and the function of these host target genes, as elaborated hereinbelow.

Nucleotide sequences of the VGAM409 precursor RNA, herein designated VGAM PRECURSOR RNA, and of the 'diced' VGAM409 RNA, herein designated VGAM RNA, and a schematic representation of the secondary folding of VGAM409 folded precursor RNA, herein designated VGAM FOLDED PRECURSOR RNA, of VGAM409 are further described hereinbelow with reference to Table 1.

Nucleotide sequences of host target binding sites, such as BINDING SITE-I, BINDING SITE-II and BINDING SITE-III of FIG. 1, found on VGAM409 host target RNA, and schematic representation of the complementarity of each of these host target binding sites to VGAM409 RNA, herein designated VGAM RNA, are described hereinbelow with reference to Table 2.

As mentioned hereinabove with reference to FIG. 1, a function of VGAM409 gene, herein designated VGAM is inhibition of expression of VGAM409 target genes. It is appreciated that specific functions, and accordingly utilities, of VGAM409 correlate with, and may be deduced from, the identity of the target genes which VGAM409 binds and inhibits, and the function of these target genes, as elaborated hereinbelow.

FCRH1 (Accession NM_052938) is a VGAM409 host target gene. FCRH1 BINDING SITE is HOST TARGET binding site found in the 3' untranslated region of mRNA encoded by FCRH1, corresponding to a HOST TARGET binding site such as BINDING SITE I, BINDING SITE II or BINDING SITE III. Table 2 illustrates the complementarity of the nucleotide sequences of FCRH1 BINDING SITE, designated SEQ ID:27498, to the nucleotide sequence of VGAM409 RNA, herein designated VGAM RNA, also designated SEQ ID:3120.

A function of VGAM409 is therefore inhibition of FCRH1 (Accession NM_052938). Accordingly, utilities of VGAM409 include diagnosis, prevention and treatment of diseases and clinical conditions associated with FCRH1. SRY (sex determining region Y)-box 4 (SOX4, Accession NM_003107) is another VGAM409 host target gene. SOX4 BINDING SITE is HOST TARGET binding site found in the 3' untranslated region of mRNA encoded by SOX4, corresponding to a HOST TARGET binding site such as BINDING SITE I, BINDING SITE II or BINDING SITE III. Table 2 illustrates the complementarity of the nucleotide sequences of SOX4 BINDING SITE, designated SEQ ID:9073, to the nucleotide sequence of VGAM409 RNA, herein designated VGAM RNA, also designated SEQ ID:3120.

Another function of VGAM409 is therefore inhibition of SRY (sex determining region Y)-box 4 (SOX4, Accession NM_003107), a gene which binds with high affinity to the t-cell enhancer motif 5'-aacaaag-3' motif. Accordingly, utilities of VGAM409 include diagnosis, prevention and treatment of diseases and clinical conditions associated with SOX4. The function of SOX4 has been established by previous studies. SOX4 from both human and mouse was shown by van de Wetering et al. (1993) to be expressed primarily in T and pre-B lymphocyte cell lines. They also showed that the mouse Sox4 protein binds with high affinity to the (A/T)(A/T)CAAAG motif found in several T-cell specific enhancers. By transient expression of chimeric Sox4 constructs, van de Wetering et al. (1993) showed that Sox4 has separable DNA-binding and transactivation domains. The authors concluded that SOX4 is a lymphocyte-specific transcriptional activator. Using a yeast 2-hybrid screen, Geijsen et al. (2001) identified the mouse transcriptional factor Sox4 as a binding partner for syntenin (SDCBP; 602217) but not for interleukin-5 receptor-alpha (IL5RA; 147851), which interacts with the PDZ domains of syntenin. The syntenin-Sox4 interaction occurs outside of the PDZ domains of syntenin. Luciferase reporter analysis and fluorescence microscopy showed that IL5 (OMIM Ref. No. 147850), but not IL3 (OMIM Ref. No. 147740), induces cytoplasmic and nuclear expression of syntenin and, in a syntenin- and cytoplasmic IL5RA-dependent manner, of Sox4. Geijsen et al. (2001) concluded that syntenin acts as an adaptor molecule in the IL5RA-mediated activation of SOX4. They also noted that mice lacking either Il5ra or Sox4 have defects in B-cell developmen Full details of the abovementioned studies are described in the following publications, the disclosure of which are hereby incorporated by reference:

Geijsen, N.; Uings, I. J.; Pals, C.; Armstrong, J.; McKinnon, M.; Raaijmakers, J. A. M.; Lammers, J.-W. J.; Koenderman, L.; Coffer, P. J.: Cytokine-specific transcriptional regulation through an IL-5R-alpha interacting protein. Science 293:1136-1138, 2001; and Suzuki, T.; Shen, H.; Akagi, K.; Morse, H. C., III; Malley, J. D.; Naiman, D. Q.; Jenkins, N. A.; Copeland, N. G.: New genes involved in cancer identified by retroviral tagging. Nature.

Further studies establishing the function and utilities of SOX4 are found in John Hopkins OMIM database record ID 184430, and in sited publications numbered 12406-12408, 346 and 12409-12413 listed in the bibliography section hereinbelow, which are also hereby incorporated by reference. Timeless Homolog (Drosophila) (TIMELESS, Accession NM_003920) is another VGAM409 host target gene. TIMELESS BINDING SITE is HOST TARGET binding site found in the 3' untranslated region of mRNA encoded by TIMELESS, corresponding to a HOST TARGET binding site such as BINDING SITE I, BINDING SITE II or BINDING SITE III. Table 2 illustrates the complementarity of the nucleotide sequences of TIMELESS BINDING SITE, designated SEQ ID:10005, to the nucleotide sequence of VGAM409 RNA, herein designated VGAM RNA, also designated SEQ ID:3120.

Another function of VGAM409 is therefore inhibition of Timeless Homolog (Drosophila) (TIMELESS, Accession NM_003920), a gene which involves in circadian oscillation autoregulation. Accordingly, utilities of VGAM409 include diagnosis, prevention and treatment of diseases and clinical conditions associated with TIMELESS. The function of TIMELESS has been established by previous studies. Cellular pacemakers located in the suprachiasmatic nucleus (SCN) of the anterior hypothalamus control circadian rhythms. In Drosophila, a central clock mechanism involves the dynamic regulation of 2 genes, 'period' (per; OMIM Ref. No. 602260) and 'timeless' (tim), which physically interact and participate in an intracellular transcriptional/translational feedback loop. The transcription of per and tim is positively regulated by the Clock (OMIM Ref. No. 601851) and BMAL1 (OMIM Ref. No. 602550) proteins, which form heterodimers. By searching EST databases, Sangoram et al. (1998), Zylka et al. (1998), and Koike et al. (1998) identified cDNAs corresponding to human (TIM) and mouse (Tim) homologs of Drosophila timeless. Sangoram et al. (1998) reported that the predicted 1,208-amino acid human protein is 84% identical to mouse Tim. The mammalian proteins share 4 regions of homology with Drosophila tim, including regions involved in nuclear localization, protein-protein interaction with PER, and cytoplasmic localization. Northern blot analysis revealed that TIM was expressed as a 4.5-kb mRNA in all human tissues tested, with the highest levels in placenta, pancreas, thymus, and testis. In situ hybridization indicated that unlike those of Drosophila, mouse Tim transcript levels do not oscillate in the SCN or in the retina. Sangoram et al. (1998) demonstrated that human TIM interacts with Drosophila per, mouse PER1, and mouse PER2 (see OMIM Ref. No. 603426) in vitro. When expressed in Drosophila cells, TIM mimicked a Drosophila tim cellular function by interacting with Drosophila per and translocating into the nucleus. In addition, when expressed in mammalian cells, human TIM and mouse PER1 specifically inhibited CLOCK-BMAL1-induced transactivation of the mouse PER1 promoter. These authors concluded that TIM and Tim are the mammalian orthologs of Drosophila tim. In contrast, Zylka et al. (1998) were unable to detect mouse Per-Tim interactions in yeast 2-hybrid assays. They found an array of interactions between the various mouse Per proteins, and suggested that Per-Per interactions have replaced the function of Per-Tim dimers in the molecular workings of the mammalian circadian clock.

Full details of the abovementioned studies are described in the following publications, the disclosure of which are hereby incorporated by reference:

Sangoram, A. M.; Saez, L.; Antoch, M. P.; Gekakis, N.; Staknis, D.; Whiteley, A.; Fruechte, E. M.; Vitaterna, M. H.; Shimomura, K.; King, D. P.; Young, M. W.; Weitz, C. J.; Takahashi, J. S.: Mammalian circadian autoregulatory loop: a timeless ortholog and mPer1 interact and negatively regulate CLOCK-BMAL1-induced transcription. Neuron 21:1101-1113, 1998; and Zylka, M. J.; Shearman, L. P.; Levine, J. D.; Jin, X.; Weaver, D. R.; Reppert, S. M.: Molecular analysis of mammalian timeless. Neuron 21:1115-1122, 1998.

Further studies establishing the function and utilities of TIMELESS are found in John Hopkins OMIM database record ID 603887, and in sited publications numbered 7627-7629 listed in the bibliography section hereinbelow, which are also hereby incorporated by reference. FLJ10508 (Accession NM_018118) is another VGAM409 host target gene. FLJ10508 BINDING SITE is HOST TARGET binding site found in the 5' untranslated region of mRNA encoded by FLJ10508, corresponding to a HOST TARGET binding site such as BINDING SITE I, BINDING SITE II or BINDING SITE III. Table 2 illustrates the complementarity of the nucleotide sequences of FLJ10508 BINDING SITE, designated SEQ ID:19889, to the nucleotide sequence of VGAM409 RNA, herein designated VGAM RNA, also designated SEQ ID:3120.

Another function of VGAM409 is therefore inhibition of FLJ10508 (Accession NM_018118). Accordingly, utilities of VGAM409 include diagnosis, prevention and treatment of diseases and clinical conditions associated with FLJ10508. FLJ10724 (Accession NM_018194) is another VGAM409 host target gene. FLJ10724 BINDING SITE is HOST TARGET binding site found in the 3' untranslated region of mRNA encoded by FLJ10724, corresponding to a HOST TARGET binding site such as BINDING SITE I, BINDING SITE II or BINDING SITE III. Table 2 illustrates the complementarity of the nucleotide sequences of FLJ10724 BINDING SITE, designated SEQ ID:20054, to the nucleotide sequence of VGAM409 RNA, herein designated VGAM RNA, also designated SEQ ID:3120.

Another function of VGAM409 is therefore inhibition of FLJ10724 (Accession NM_018194). Accordingly, utilities of VGAM409 include diagnosis, prevention and treatment of diseases and clinical conditions associated with FLJ10724. FLJ11320 (Accession NM_018389) is another VGAM409 host target gene. FLJ11320 BINDING SITE is HOST TARGET binding site found in the 3' untranslated region of mRNA encoded by FLJ11320, corresponding to a HOST TARGET binding site such as BINDING SITE I, BINDING SITE II or BINDING SITE III. Table 2 illustrates the complementarity of the nucleotide sequences of FLJ11320 BINDING SITE, designated SEQ ID:20425, to the nucleotide sequence of VGAM409 RNA, herein designated VGAM RNA, also designated SEQ ID:3120.

Another function of VGAM409 is therefore inhibition of FLJ11320 (Accession NM_018389). Accordingly, utilities of VGAM409 include diagnosis, prevention and treatment of diseases and clinical conditions associated with FLJ11320. FLJ13912 (Accession NM_022770) is another VGAM409 host target gene. FLJ13912 BINDING SITE is HOST TARGET binding site found in the 3' untranslated region of mRNA encoded by FLJ13912, corresponding to a HOST TARGET binding site such as BINDING SITE I, BINDING SITE II or BINDING SITE III. Table 2 illustrates the complementarity of the nucleotide sequences of FLJ13912 BINDING SITE, designated SEQ ID:23026, to the nucleotide sequence of VGAM409 RNA, herein designated VGAM RNA, also designated SEQ ID:3120.

Another function of VGAM409 is therefore inhibition of FLJ13912 (Accession NM_022770). Accordingly, utilities of VGAM409 include diagnosis, prevention and treatment of diseases and clinical conditions associated with FLJ13912. FLJ32356 (Accession NM_144671) is another VGAM409 host target gene. FLJ32356 BINDING SITE is HOST TARGET binding site found in the 3' untranslated region of mRNA encoded by FLJ32356, corresponding to a HOST TARGET binding site such as BINDING SITE I, BINDING SITE II or BINDING SITE III. Table 2 illustrates the complementarity of the nucleotide sequences of FLJ32356 BINDING SITE, designated SEQ ID:29492, to the nucleotide sequence of VGAM409 RNA, herein designated VGAM RNA, also designated SEQ ID:3120.

Another function of VGAM409 is therefore inhibition of FLJ32356 (Accession NM_144671). Accordingly, utilities of VGAM409 include diagnosis, prevention and treatment of diseases and clinical conditions associated with FLJ32356. Nudix (nucleoside diphosphate linked moiety X)-type Motif 11 (NUDT11, Accession XM_010230) is another VGAM409 host target gene. NUDT11 BINDING SITE is HOST TARGET binding site found in the 3' untranslated region of mRNA encoded by NUDT11, corresponding to a HOST TARGET binding site such as BINDING SITE I, BINDING SITE II or BINDING SITE III. Table 2 illustrates the complementarity of the nucleotide sequences of NUDT11 BINDING SITE, designated SEQ ID:30139, to the nucleotide sequence of VGAM409 RNA, herein designated VGAM RNA, also designated SEQ ID:3120.

Another function of VGAM409 is therefore inhibition of Nudix (nucleoside diphosphate linked moiety X)-type Motif 11 (NUDT11, Accession XM_010230). Accordingly, utilities of VGAM409 include diagnosis, prevention and treatment of diseases and clinical conditions associated with NUDT11. LOC256997 (Accession XM_170900) is another VGAM409 host target gene. LOC256997 BINDING SITE is HOST TARGET binding site found in the 5' untranslated region of mRNA encoded by LOC256997, corresponding to a HOST TARGET binding site such as BINDING SITE I, BINDING SITE II or BINDING SITE III. Table 2 illustrates the complementarity of the nucleotide sequences of LOC256997 BINDING SITE, designated SEQ ID:45651, to the nucleotide sequence of VGAM409 RNA, herein designated VGAM RNA, also designated SEQ ID:3120.

Another function of VGAM409 is therefore inhibition of LOC256997 (Accession XM_170900). Accordingly, utilities of VGAM409 include diagnosis, prevention and treatment of diseases and clinical conditions associated with LOC256997. FIG. 1 further provides a conceptual description of a novel bioinformatically detected viral gene of the present invention, referred to here as Viral Genomic Address Messenger 410 (VGAM410) viral gene, which modulates expression of respective host target genes thereof, the function and utility of which host target genes is known in the art.

VGAM410 is a novel bioinformatically detected regulatory, non protein coding, viral micro RNA (miRNA) gene. The method by which VGAM410 was detected is described hereinabove with reference to FIGS. 1-8.

VGAM410 gene, herein designated VGAM GENE, is a viral gene contained in the genome of O'nyong-nyong Virus. VGAM410 host target gene, herein designated VGAM HOST TARGET GENE, is a human gene contained in the human genome.

VGAM410 gene encodes a VGAM410 precursor RNA, herein designated VGAM PRECURSOR RNA. Similar to other miRNA genes, and unlike most ordinary genes, VGAM410 precursor RNA does not encode a protein. A nucleotide sequence identical or highly similar to the nucleotide sequence of VGAM410 precursor RNA is designated SEQ ID:396, and is provided hereinbelow with reference to the sequence listing part. Nucleotide sequence SEQ ID:396 is located at position 5873 relative to the genome of O'nyong-nyong Virus.

VGAM410 precursor RNA folds onto itself, forming VGAM410 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM410 folded precursor RNA into VGAM410 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM410 RNA is designated SEQ ID:3121, and is provided hereinbelow with reference to the sequence listing part.

VGAM410 host target gene, herein designated VGAM HOST TARGET GENE, encodes a corresponding messenger RNA, VGAM410 host target RNA, herein designated VGAM HOST TARGET RNA. VGAM410 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM410 RNA, herein designated VGAM RNA, binds complementarily to one or more host target binding sites located in untranslated regions of VGAM410 host target RNA, herein designated VGAM HOST TARGET RNA. This complementary binding is due to the fact that the nucleotide sequence of VGAM410 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM410 RNA, herein designated VGAM RNA, may have a different number of host target binding sites in untranslated regions of a VGAM410 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM410 RNA, herein designated VGAM RNA, to host target binding sites on VGAM410 host target RNA, herein designated VGAM HOST TARGET RNA, such as BINDING SITE I, BINDING SITE II and BINDING SITE III, inhibits translation of VGAM410 host target RNA into VGAM410 host target protein, herein designated VGAM HOST TARGET PROTEIN. VGAM host target protein is therefore outlined by a broken line.

It is appreciated that VGAM410 host target gene, herein designated VGAM HOST TARGET GENE, in fact represents a plurality of VGAM410 host target genes. The mRNA of each one of this plurality of VGAM410 host target genes comprises one or more host target binding sites, each having a nucleotide sequence which is at least partly complementary to VGAM410 RNA, herein designated VGAM RNA, and which when bound by VGAM410 RNA causes inhibition of translation of respective one or more VGAM410 host target proteins.

It is further appreciated by one skilled in the art that the mode of translational inhibition illustrated by FIG. 1 with specific reference to translational inhibition exerted by VGAM410 gene, herein designated VGAM GENE, on one or more VGAM410 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM410 is inhibition of expression of host target genes, as part of a novel viral mechanism of attacking a host. Accordingly, utilities of VGAM410 include diagnosis, prevention and treatment of viral infection by O'nyong-nyong Virus. Specific functions, and accordingly utilities, of VGAM410 correlate with, and may be deduced from, the identity of the host target genes which VGAM410 binds and inhibits, and the function of these host target genes, as elaborated hereinbelow.

Nucleotide sequences of the VGAM410 precursor RNA, herein designated VGAM PRECURSOR RNA, and of the 'diced' VGAM410 RNA, herein designated VGAM RNA, and a schematic representation of the secondary folding of VGAM410 folded precursor RNA, herein designated VGAM FOLDED PRECURSOR RNA, of VGAM410 are further described hereinbelow with reference to Table 1.

Nucleotide sequences of host target binding sites, such as BINDING SITE-I, BINDING SITE-II and BINDING SITE-III of FIG. 1, found on VGAM410 host target RNA, and schematic representation of the complementarity of each of these host target binding sites to VGAM410 RNA, herein designated VGAM RNA, are described hereinbelow with reference to Table 2.

As mentioned hereinabove with reference to FIG. 1, a function of VGAM410 gene, herein designated VGAM is inhibition of expression of VGAM410 target genes. It is appreciated that specific functions, and accordingly utilities, of VGAM410 correlate with, and may be deduced from, the identity of the target genes which VGAM410 binds and inhibits, and the function of these target genes, as elaborated hereinbelow.

Carbohydrate (keratan sulfate Gal-6) Sulfotransferase 1 (CHST1, Accession NM_003654) is a VGAM410 host target gene. CHST1 BINDING SITE is HOST TARGET binding site found in the 5' untranslated region of mRNA encoded by CHST1, corresponding to a HOST TARGET binding site such as BINDING SITE I, BINDING SITE II or BINDING SITE III. Table 2 illustrates the complementarity of the nucleotide sequences of CHST1 BINDING SITE, designated SEQ ID:9729, to the nucleotide sequence of VGAM410 RNA, herein designated VGAM RNA, also designated SEQ ID:3121.

A function of VGAM410 is therefore inhibition of Carbohydrate (keratan sulfate Gal-6) Sulfotransferase 1 (CHST1, Accession NM_003654), a gene which may play a role in keratan sulfate biosynthesis in brain and cornea. Accordingly, utilities of VGAM410 include diagnosis, prevention and treatment of diseases and clinical conditions associated with CHST1. The function of CHST1 has been established by previous studies. The keratan sulfate proteoglycans lumican and keratocan are the major proteoglycans in the cornea and are thought to play an important role in corneal transparency. Sulfation appears to be important for the biologic function of keratan sulfate, because undersulfated keratan sulfate is synthesized in patients with macular corneal dystrophy (see OMIM Ref. No. 217800). Keratan sulfate bears sulfate groups on both N-acetylglucosamine (OMIM Ref. No. GlcNAc) and galactose residues. Fukuta et al. (1997) stated that C6ST (chondroitin 6-sulfotransferase; 603799) catalyzes sulfation of chondroitin and keratan sulfate. However, in developing cornea, keratan sulfate is actively synthesized while chondroitin 6-sulfate synthesis is minimal, suggesting that a different sulfotransferase is present in cornea with specificity towards keratan sulfate. By screening a human fetal brain library with a chick C6ST cDNA, Fukuta et al. (1997) isolated cDNAs encoding C6ST and keratan sulfate gal-6-sulfotransferase (KSGal6ST). Northern blot analysis revealed that the 2.8-kb KSGal6ST mRNA was expressed in human brain and in chick brain and cornea. A slightly larger and less abundant transcript was observed in human skeletal muscle. The predicted 411-amino acid KSGal6ST shares 37% sequence identity with chick C6ST. When the KSGal6ST cDNA was expressed in COS-7 cells, keratan sulfate sulfotransferase activity increased, but C6ST activity did not. In vitro, the partially purified KSGal6ST protein showed substrate specificity towards keratan sulfate; KSGal6ST could not utilize chondroitin as an acceptor. Fukuta et al. (1997) concluded that KSGal6ST may participate in the biosynthesis of keratan sulfate in the brain and cornea. Independently, Mazany et al. (1998) cloned genomic DNA and cDNAs corresponding to CHST1, which they called C6ST. These authors found that stable expression of the CHST1 cDNA in CHO cells increased both C6ST and keratan sulfate sulfotransferase activities. Mazany et al. (1998) suggested that the distinct pattern of CHST1 enzyme activity observed by Fukuta et al. (1997) may be due to differences between the mammalian cell lines used by the 2 groups to express the enzyme.

Full details of the abovementioned studies are described in the following publications, the disclosure of which are hereby incorporated by reference:

Iida, A.; Saito, S.; Sekine, A.; Mishima, C.; Kitamura, Y.; Kondo, K.; Harigae, S.; Osawa, S.; Nakamura, Y.: Catalog of 77 single-nucleotide polymorphisms (SNPs) in the carbohydrate sulfotransferase 1 (CHST1) and carbohydrate sulfotransferase 3 (CHST3) genes. J. Hum. Genet. 47:14-19, 2002; and Mazany, K. D.; Peng, T.; Watson, C. E.; Tabas, I.; Williams, K. J.: Human chondroitin 6-sulfotransferase: cloning, gene structure, and chromosomal localization. Biochim. Biophys. Acta.

Further studies establishing the function and utilities of CHST1 are found in John Hopkins OMIM database record ID 603797, and in sited publications numbered 994-996 listed in the bibliography section hereinbelow, which are also hereby incorporated by reference. FLJ11539 (Accession NM_024748) is another VGAM410 host target gene. FLJ11539 BINDING SITE is HOST TARGET binding site found in the 3' untranslated region of mRNA encoded by FLJ11539, corresponding to a HOST TARGET binding site such as BINDING SITE I, BINDING SITE II or BINDING SITE III. Table 2 illustrates the complementarity of the nucleotide sequences of FLJ11539 BINDING SITE, designated SEQ ID:24084, to the nucleotide sequence of VGAM410 RNA, herein designated VGAM RNA, also designated SEQ ID:3121.

Another function of VGAM410 is therefore inhibition of FLJ11539 (Accession NM_024748). Accordingly, utilities of VGAM410 include diagnosis, prevention and treatment of diseases and clinical conditions associated with FLJ11539. FLJ23511 (Accession NM_032239) is another VGAM410 host target gene. FLJ23511 BINDING SITE is HOST TARGET binding site found in the 3' untranslated region of mRNA encoded by FLJ23511, corresponding to a HOST TARGET binding site such as BINDING SITE I, BINDING SITE II or BINDING SITE III. Table 2 illustrates the complementarity of the nucleotide sequences of FLJ23511 BINDING SITE, designated SEQ ID:25964, to the nucleotide sequence of VGAM410 RNA, herein designated VGAM RNA, also designated SEQ ID:3121.

Another function of VGAM410 is therefore inhibition of FLJ23511 (Accession NM_032239). Accordingly, utilities of VGAM410 include diagnosis, prevention and treatment of diseases and clinical conditions associated with FLJ23511. PRO1866 (Accession NM_018510) is another VGAM410 host target gene. PRO1866 BINDING SITE is HOST TARGET binding site found in the 5' untranslated region of mRNA encoded by PRO1866, corresponding to a HOST TARGET binding site such as BINDING SITE I, BINDING SITE II or BINDING SITE III. Table 2 illustrates the complementarity of the nucleotide sequences of PRO1866 BINDING SITE, designated SEQ ID:20578, to the nucleotide sequence of VGAM410 RNA, herein designated VGAM RNA, also designated SEQ ID:3121.

Another function of VGAM410 is therefore inhibition of PRO1866 (Accession NM_018510). Accordingly, utilities of VGAM410 include diagnosis, prevention and treatment of diseases and clinical conditions associated with PRO1866. FIG. 1 further provides a conceptual description of a novel bioinformatically detected viral gene of the present invention, referred to here as Viral Genomic Address Messenger 411 (VGAM411) viral gene, which modulates expression of respective host target genes thereof, the function and utility of which host target genes is known in the art.

VGAM411 is a novel bioinformatically detected regulatory, non protein coding, viral micro RNA (miRNA) gene. The method by which VGAM411 was detected is described hereinabove with reference to FIGS. 1-8.

VGAM411 gene, herein designated VGAM GENE, is a viral gene contained in the genome of Igbo Ora Virus. VGAM411 host target gene, herein designated VGAM HOST TARGET GENE, is a human gene contained in the human genome.

VGAM411 gene encodes a VGAM411 precursor RNA, herein designated VGAM PRECURSOR RNA. Similar to other miRNA genes, and unlike most ordinary genes, VGAM411 precursor RNA does not encode a protein. A nucleotide sequence identical or highly similar to the nucleotide sequence of VGAM411 precursor RNA is designated SEQ ID:397, and is provided hereinbelow with reference to the sequence listing part. Nucleotide sequence SEQ ID:397 is located at position 3184 relative to the genome of Igbo Ora Virus.

VGAM411 precursor RNA folds onto itself, forming VGAM411 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM411 folded precursor RNA into VGAM411 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM411 RNA is designated SEQ ID:3122, and is provided hereinbelow with reference to the sequence listing part.

VGAM411 host target gene, herein designated VGAM HOST TARGET GENE, encodes a corresponding messenger RNA, VGAM411 host target RNA, herein designated VGAM HOST TARGET RNA. VGAM411 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM411 RNA, herein designated VGAM RNA, binds complementarily to one or more host target binding sites located in untranslated regions of VGAM411 host target RNA, herein designated VGAM HOST TARGET RNA. This complementary binding is due to the fact that the nucleotide sequence of VGAM411 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM411 RNA, herein designated VGAM RNA, may have a different number of host target binding sites in untranslated regions of a VGAM411 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM411 RNA, herein designated VGAM RNA, to host target binding sites on VGAM411 host target RNA, herein designated VGAM HOST TARGET RNA, such as BINDING SITE I, BINDING SITE II and BINDING SITE III, inhibits translation of VGAM411 host target RNA into VGAM411 host target protein, herein designated VGAM HOST TARGET PROTEIN. VGAM host target protein is therefore outlined by a broken line.

It is appreciated that VGAM411 host target gene, herein designated VGAM HOST TARGET GENE, in fact represents a plurality of VGAM411 host target genes. The mRNA of each one of this plurality of VGAM411 host target genes comprises one or more host target binding sites, each having a nucleotide sequence which is at least partly complementary to VGAM411 RNA, herein designated VGAM RNA, and which when bound by VGAM411 RNA causes inhibition of translation of respective one or more VGAM411 host target proteins.

It is further appreciated by one skilled in the art that the mode of translational inhibition illustrated by FIG. 1 with specific reference to translational inhibition exerted by VGAM411 gene, herein designated VGAM GENE, on one or more VGAM411 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM411 is inhibition of expression of host target genes, as part of a novel viral mechanism of attacking a host. Accordingly, utilities of VGAM411 include diagnosis, prevention and treatment of viral infection by Igbo Ora Virus. Specific functions, and accordingly utilities, of VGAM411 correlate with, and may be deduced from, the identity of the host target genes which VGAM411 binds and inhibits, and the function of these host target genes, as elaborated hereinbelow.

Nucleotide sequences of the VGAM411 precursor RNA, herein designated VGAM PRECURSOR RNA, and of the 'diced' VGAM411 RNA, herein designated VGAM RNA, and a schematic representation of the secondary folding of VGAM411 folded precursor RNA, herein designated VGAM FOLDED PRECURSOR RNA, of VGAM411 are further described hereinbelow with reference to Table 1.

Nucleotide sequences of host target binding sites, such as BINDING SITE-I, BINDING SITE-II and BINDING SITE-III of FIG. 1, found on VGAM411 host target RNA, and schematic representation of the complementarity of each of these host target binding sites to VGAM411 RNA, herein designated VGAM RNA, are described hereinbelow with reference to Table 2.

As mentioned hereinabove with reference to FIG. 1, a function of VGAM411 gene, herein designated VGAM is inhibition of expression of VGAM411 target genes. It is appreciated that specific functions, and accordingly utilities, of VGAM411 correlate with, and may be deduced from, the identity of the target genes which VGAM411 binds and inhibits, and the function of these target genes, as elaborated hereinbelow.

Nuclear Mitotic Apparatus Protein 1 (NUMA1, Accession XM_167853) is a VGAM411 host target gene. NUMA1 BINDING SITE is HOST TARGET binding site found in the 3' untranslated region of mRNA encoded by NUMA1, corresponding to a HOST TARGET binding site such as BIND- ING SITE I, BINDING SITE II or BINDING SITE III. Table 2 illustrates the complementarity of the nucleotide sequences of NUMA1 BINDING SITE, designated SEQ ID:44881, to the nucleotide sequence of VGAM411 RNA, herein designated VGAM RNA, also designated SEQ ID:3122.

A function of VGAM411 is therefore inhibition of Nuclear Mitotic Apparatus Protein 1 (NUMA1, Accession XM_167853), a gene which is nuclear mitotic apparatus protein. Accordingly, utilities of VGAM411 include diagnosis, prevention and treatment of diseases and clinical conditions associated with NUMA1. The function of NUMA1 and its association with various diseases and clinical conditions, has been established by previous studies, as described hereinabove with reference to VGAM192. FLJ14642 (Accession NM_032818) is another VGAM411 host target gene. FLJ14642 BINDING SITE is HOST TARGET binding site found in the 3' untranslated region of mRNA encoded by FLJ14642, corresponding to a HOST TARGET binding site such as BINDING SITE I, BINDING SITE II or BINDING SITE III. Table 2 illustrates the complementarity of the nucleotide sequences of FLJ14642 BINDING SITE, designated SEQ ID:26595, to the nucleotide sequence of VGAM411 RNA, herein designated VGAM RNA, also designated SEQ ID:3122.

Another function of VGAM411 is therefore inhibition of FLJ14642 (Accession NM_032818). Accordingly, utilities of VGAM411 include diagnosis, prevention and treatment of diseases and clinical conditions associated with FLJ14642. KIAA1084 (Accession NM_014910) is another VGAM411 host target gene. KIAA1084 BINDING SITE is HOST TARGET binding site found in the 3' untranslated region of mRNA encoded by KIAA1084, corresponding to a HOST TARGET binding site such as BINDING SITE I, BINDING SITE II or BINDING SITE III. Table 2 illustrates the complementarity of the nucleotide sequences of KIAA1084 BINDING SITE, designated SEQ ID:17139, to the nucleotide sequence of VGAM411 RNA, herein designated VGAM RNA, also designated SEQ ID:3122.

Another function of VGAM411 is therefore inhibition of KIAA1084 (Accession NM_014910). Accordingly, utilities of VGAM411 include diagnosis, prevention and treatment of diseases and clinical conditions associated with KIAA1084. FIG. 1 further provides a conceptual description of a novel bioinformatically detected viral gene of the present invention, referred to here as Viral Genomic Address Messenger 412 (VGAM412) viral gene, which modulates expression of respective host target genes thereof, the function and utility of which host target genes is known in the art.

VGAM412 is a novel bioinformatically detected regulatory, non protein coding, viral micro RNA (miRNA) gene. The method by which VGAM412 was detected is described hereinabove with reference to FIGS. 1-8.

VGAM412 gene, herein designated VGAM GENE, is a viral gene contained in the genome of O'nyong-nyong Virus. VGAM412 host target gene, herein designated VGAM HOST TARGET GENE, is a human gene contained in the human genome.

VGAM412 gene encodes a VGAM412 precursor RNA, herein designated VGAM PRECURSOR RNA. Similar to other miRNA genes, and unlike most ordinary genes, VGAM412 precursor RNA does not encode a protein. A nucleotide sequence identical or highly similar to the nucleotide sequence of VGAM412 precursor RNA is designated SEQ ID:398, and is provided hereinbelow with reference to the sequence listing part. Nucleotide sequence SEQ ID:398 is located at position 4500 relative to the genome of O'nyong-nyong Virus.

VGAM412 precursor RNA folds onto itself, forming VGAM412 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM412 folded precursor RNA into VGAM412 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM412 RNA is designated SEQ ID:3123, and is provided hereinbelow with reference to the sequence listing part.

VGAM412 host target gene, herein designated VGAM HOST TARGET GENE, encodes a corresponding messenger RNA, VGAM412 host target RNA, herein designated VGAM HOST TARGET RNA. VGAM412 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM412 RNA, herein designated VGAM RNA, binds complementarily to one or more host target binding sites located in untranslated regions of VGAM412 host target RNA, herein designated VGAM HOST TARGET RNA. This complementary binding is due to the fact that the nucleotide sequence of VGAM412 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM412 RNA, herein designated VGAM RNA, may have a different number of host target binding sites in untranslated regions of a VGAM412 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM412 RNA, herein designated VGAM RNA, to host target binding sites on VGAM412 host target RNA, herein designated VGAM HOST TARGET RNA, such as BINDING SITE I, BINDING SITE II and BINDING SITE III, inhibits translation of VGAM412 host target RNA into VGAM412 host target protein, herein designated VGAM HOST TARGET PROTEIN. VGAM host target protein is therefore outlined by a broken line.

It is appreciated that VGAM412 host target gene, herein designated VGAM HOST TARGET GENE, in fact represents a plurality of VGAM412 host target genes. The mRNA of each one of this plurality of VGAM412 host target genes comprises one or more host target binding sites, each having a nucleotide sequence which is at least partly complementary to VGAM412 RNA, herein designated VGAM RNA, and which when bound by VGAM412 RNA causes inhibition of translation of respective one or more VGAM412 host target proteins.

It is further appreciated by one skilled in the art that the mode of translational inhibition illustrated by FIG. 1 with specific reference to translational inhibition exerted by VGAM412 gene, herein designated VGAM GENE, on one or more VGAM412 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM412 is inhibition of expression of host target genes, as part of a novel viral mechanism of attacking a host. Accordingly, utilities of VGAM412 include diagnosis, prevention and treatment of viral infection by O'nyong-nyong Virus. Specific functions, and accordingly utilities, of VGAM412 correlate with, and may be deduced from, the identity of the host target genes which VGAM412 binds and inhibits, and the function of these host target genes, as elaborated hereinbelow.

Nucleotide sequences of the VGAM412 precursor RNA, herein designated VGAM PRECURSOR RNA, and of the 'diced' VGAM412 RNA, herein designated VGAM RNA, and a schematic representation of the secondary folding of VGAM412 folded precursor RNA, herein designated VGAM FOLDED PRECURSOR RNA, of VGAM412 are further described hereinbelow with reference to Table 1.

Nucleotide sequences of host target binding sites, such as BINDING SITE-I, BINDING SITE-II and BINDING SITE-III of FIG. 1, found on VGAM412 host target RNA, and schematic representation of the complementarity of each of these host target binding sites to VGAM412 RNA, herein designated VGAM RNA, are described hereinbelow with reference to Table 2.

As mentioned hereinabove with reference to FIG. 1, a function of VGAM412 gene, herein designated VGAM is inhibition of expression of VGAM412 target genes. It is appreciated that specific functions, and accordingly utilities, of VGAM412 correlate with, and may be deduced from, the identity of the target genes which VGAM412 binds and inhibits, and the function of these target genes, as elaborated hereinbelow.

Deafness, Autosomal Dominant 5 (DFNA5, Accession NM_004403) is a VGAM412 host target gene. DFNA5 BINDING SITE is HOST TARGET binding site found in the 3' untranslated region of mRNA encoded by DFNA5, corresponding to a HOST TARGET binding site such as BINDING SITE I, BINDING SITE II or BINDING SITE III. Table 2 illustrates the complementarity of the nucleotide sequences of DFNA5 BINDING SITE, designated SEQ ID:10655, to the nucleotide sequence of VGAM412 RNA, herein designated VGAM RNA, also designated SEQ ID:3123.

A function of VGAM412 is therefore inhibition of Deafness, Autosomal Dominant 5 (DFNA5, Accession NM_004403). Accordingly, utilities of VGAM412 include diagnosis, prevention and treatment of diseases and clinical conditions associated with DFNA5. ATPase, H+ Transporting, Lysosomal 56/58 kDa, V1 Subunit B, Isoform 2 (ATP6V1B2, Accession NM_001693) is another VGAM412 host target gene. ATP6V1B2 BINDING SITE is HOST TARGET binding site found in the 3" untranslated region of mRNA encoded by ATP6V1B2, corresponding to a HOST TARGET binding site such as BINDING SITE I, BINDING SITE II or BINDING SITE III. Table 2 illustrates the complementarity of the nucleotide sequences of ATP6V1B2 BINDING SITE, designated SEQ ID:7413, to the nucleotide sequence of VGAM412 RNA, herein designated VGAM RNA, also designated SEQ ID:3123.

Another function of VGAM412 is therefore inhibition of ATPase, H+ Transporting, Lysosomal 56/58 kDa, V1 Subunit B, Isoform 2 (ATP6V1B2, Accession NM_001693). Accordingly, utilities of VGAM412 include diagnosis, prevention and treatment of diseases and clinical conditions associated with ATP6V1B2. FLJ11053 (Accession XM_114194) is another VGAM412 host target gene. FLJ11053 BINDING SITE is HOST TARGET binding site found in the 3' untranslated region of mRNA encoded by FLJ11053, corresponding to a HOST TARGET binding site such as BINDING SITE I, BINDING SITE II or BINDING SITE III. Table 2 illustrates the complementarity of the nucleotide sequences of FLJ11053 BINDING SITE, designated SEQ ID:42778, to the nucleotide sequence of VGAM412 RNA, herein designated VGAM RNA, also designated SEQ ID:3123.

Another function of VGAM412 is therefore inhibition of FLJ11053 (Accession XM_114194). Accordingly, utilities of VGAM412 include diagnosis, prevention and treatment of diseases and clinical conditions associated with FLJ11053. KIAA0478 (Accession NM_014870) is another VGAM412 host target gene. KIAA0478 BINDING SITE is HOST TARGET binding site found in the 3' untranslated region of mRNA encoded by KIAA0478, corresponding to a HOST TARGET binding site such as BINDING SITE I, BINDING SITE II or BINDING SITE III. Table 2 illustrates the complementarity of the nucleotide sequences of KIAA0478 BINDING SITE, designated SEQ ID:16988, to the nucleotide sequence of VGAM412 RNA, herein designated VGAM RNA, also designated SEQ ID:3123.

Another function of VGAM412 is therefore inhibition of KIAA0478 (Accession NM_014870). Accordingly, utilities of VGAM412 include diagnosis, prevention and treatment of diseases and clinical conditions associated with KIAA0478. KIAA1404 (Accession XM_030494) is another VGAM412 host target gene. KIAA1404 BINDING SITE is HOST TARGET binding site found in the 3' untranslated region of mRNA encoded by KIAA1404, corresponding to a HOST TARGET binding site such as BINDING SITE I, BINDING SITE II or BINDING SITE III. Table 2 illustrates the complementarity of the nucleotide sequences of KIAA1404 BINDING SITE, designated SEQ ID:31052, to the nucleotide sequence of VGAM412 RNA, herein designated VGAM RNA, also designated SEQ ID:3123.

Another function of VGAM412 is therefore inhibition of KIAA1404 (Accession XM_030494). Accordingly, utilities of VGAM412 include diagnosis, prevention and treatment of diseases and clinical conditions associated with KIAA1404. LanC Lantibiotic Synthetase Component C-like 2 (bacterial) (LANCL2, Accession NM_018697) is another VGAM412 host target gene. LANCL2 BINDING SITE is HOST TARGET binding site found in the 3' untranslated region of mRNA encoded by LANCL2, corresponding to a HOST TARGET binding site such as BINDING SITE I, BINDING SITE II or BINDING SITE III. Table 2 illustrates the complementarity of the nucleotide sequences of LANCL2 BINDING SITE, designated SEQ ID:20780, to the nucleotide sequence of VGAM412 RNA, herein designated VGAM RNA, also designated SEQ ID:3123.

Another function of VGAM412 is therefore inhibition of LanC Lantibiotic Synthetase Component C-like 2 (bacterial) (LANCL2, Accession NM_018697). Accordingly, utilities of VGAM412 include diagnosis, prevention and treatment of diseases and clinical conditions associated with LANCL2.

OS-9 (Accession NM_006812) is another VGAM412 host target gene. OS-9 BINDING SITE is HOST TARGET binding site found in the 3' untranslated region of mRNA encoded by OS-9, corresponding to a HOST TARGET binding site such as BINDING SITE I, BINDING SITE II or BINDING SITE III. Table 2 illustrates the complementarity of the nucleotide sequences of OS-9 BINDING SITE, designated SEQ ID:13682, to the nucleotide sequence of VGAM412 RNA, herein designated VGAM RNA, also designated SEQ ID:3123.

Another function of VGAM412 is therefore inhibition of OS-9 (Accession NM_006812). Accordingly, utilities of VGAM412 include diagnosis, prevention and treatment of diseases and clinical conditions associated with OS-9. PRO1483 (Accession NM_018582) is another VGAM412 host target gene. PRO1483 BINDING SITE is HOST TARGET binding site found in the 5' untranslated region of mRNA encoded by PRO1483, corresponding to a HOST TARGET binding site such as BINDING SITE I, BINDING SITE II or BINDING SITE III. Table 2 illustrates the complementarity of the nucleotide sequences of PRO1483 BINDING SITE, designated SEQ ID:20660, to the nucleotide sequence of VGAM412 RNA, herein designated VGAM RNA, also designated SEQ ID:3123.

Another function of VGAM412 is therefore inhibition of PRO1483 (Accession NM_018582). Accordingly, utilities of VGAM412 include diagnosis, prevention and treatment of diseases and clinical conditions associated with PRO1483. RASD Family, Member 2 (RASD2, Accession NM_014310) is another VGAM412 host target gene. RASD2 BINDING SITE is HOST TARGET binding site found in the 3' untranslated region of mRNA encoded by RASD2, corresponding to a HOST TARGET binding site such as BINDING SITE I, BINDING SITE II or BINDING SITE III. Table 2 illustrates the complementarity of the nucleotide sequences of RASD2 BINDING SITE, designated SEQ ID:15604, to the nucleotide sequence of VGAM412 RNA, herein designated VGAM RNA, also designated SEQ ID:3123.

Another function of VGAM412 is therefore inhibition of RASD Family, Member 2 (RASD2, Accession NM_014310). Accordingly, utilities of VGAM412 include diagnosis, prevention and treatment of diseases and clinical conditions associated with RASD2. LOC132332 (Accession XM_072306) is another VGAM412 host target gene. LOC132332 BINDING SITE is HOST TARGET binding site found in the 3' untranslated region of mRNA encoded by LOC132332, corresponding to a HOST TARGET binding site such as BINDING SITE I, BINDING SITE II or BINDING SITE III. Table 2 illustrates the complementarity of the nucleotide sequences of LOC132332 BINDING SITE, designated SEQ ID:37486, to the nucleotide sequence of VGAM412 RNA, herein designated VGAM RNA, also designated SEQ ID:3123.

Another function of VGAM412 is therefore inhibition of LOC132332 (Accession XM_072306). Accordingly, utilities of VGAM412 include diagnosis, prevention and treatment of diseases and clinical conditions associated with LOC132332. LOC92148 (Accession XM_043160) is another VGAM412 host target gene. LOC92148 BINDING SITE is HOST TARGET binding site found in the 5' untranslated region of mRNA encoded by LOC92148, corresponding to a HOST TARGET binding site such as BINDING SITE I, BINDING SITE II or BINDING SITE III. Table 2 illustrates the complementarity of the nucleotide sequences of LOC92148 BINDING SITE, designated SEQ ID:33910, to the nucleotide sequence of VGAM412 RNA, herein designated VGAM RNA, also designated SEQ ID:3123.

Another function of VGAM412 is therefore inhibition of LOC92148 (Accession XM_043160). Accordingly, utilities of VGAM412 include diagnosis, prevention and treatment of diseases and clinical conditions associated with LOC92148. FIG. 1 further provides a conceptual description of a novel bioinformatically detected viral gene of the present invention, referred to here as Viral Genomic Address Messenger 413 (VGAM413) viral gene, which modulates expression of respective host target genes thereof, the function and utility of which host target genes is known in the art.

VGAM413 is a novel bioinformatically detected regulatory, non protein coding, viral micro RNA (miRNA) gene. The method by which VGAM413 was detected is described hereinabove with reference to FIGS. 1-8.

VGAM413 gene, herein designated VGAM GENE, is a viral gene contained in the genome of Pepper Mottle Virus. VGAM413 host target gene, herein designated VGAM HOST TARGET GENE, is a human gene contained in the human genome.

VGAM413 gene encodes a VGAM413 precursor RNA, herein designated VGAM PRECURSOR RNA. Similar to other miRNA genes, and unlike most ordinary genes, VGAM413 precursor RNA does not encode a protein. A nucleotide sequence identical or highly similar to the nucleotide sequence of VGAM413 precursor RNA is designated SEQ ID:399, and is provided hereinbelow with reference to the sequence listing part. Nucleotide sequence SEQ ID:399 is located at position 7131 relative to the genome of Pepper Mottle Virus.

VGAM413 precursor RNA folds onto itself, forming VGAM413 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM413 folded precursor RNA into VGAM413 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 70%) nucleotide sequence of VGAM413 RNA is designated SEQ ID:3124, and is provided hereinbelow with reference to the sequence listing part.

VGAM413 host target gene, herein designated VGAM HOST TARGET GENE, encodes a corresponding messenger RNA, VGAM413 host target RNA, herein designated VGAM HOST TARGET RNA. VGAM413 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM413 RNA, herein designated VGAM RNA, binds complementarily to one or more host target binding sites located in untranslated regions of VGAM413 host target RNA, herein designated VGAM HOST TARGET RNA. This complementary binding is due to the fact that the nucleotide sequence of VGAM413 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM413 RNA, herein designated VGAM RNA, may have a different number of host target binding sites in untranslated regions of a VGAM413 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM413 RNA, herein designated VGAM RNA, to host target binding sites on VGAM413 host target RNA, herein designated VGAM HOST TARGET RNA, such as BINDING SITE I, BINDING SITE II and BINDING SITE III, inhibits translation of VGAM413 host target RNA into VGAM413 host target protein, herein designated VGAM HOST TARGET PROTEIN. VGAM host target protein is therefore outlined by a broken line.

It is appreciated that VGAM413 host target gene, herein designated VGAM HOST TARGET GENE, in fact represents a plurality of VGAM413 host target genes. The mRNA of each one of this plurality of VGAM413 host target genes comprises one or more host target binding sites, each having a nucleotide sequence which is at least partly complementary to VGAM413 RNA, herein designated VGAM RNA, and which when bound by VGAM413 RNA causes inhibition of translation of respective one or more VGAM413 host target proteins.

It is further appreciated by one skilled in the art that the mode of translational inhibition illustrated by FIG. 1 with specific reference to translational inhibition exerted by VGAM413 gene, herein designated VGAM GENE, on one or more VGAM413 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM413 is inhibition of expression of host target genes, as part of a novel viral mechanism of attacking a host. Accordingly, utilities of VGAM413 include diagnosis, prevention and treatment of viral infection by Pepper Mottle Virus. Specific functions, and accordingly utilities, of VGAM413 correlate with, and may be deduced from, the identity of the host target genes which VGAM413 binds and inhibits, and the function of these target genes, as elaborated hereinbelow.

Nucleotide sequences of the VGAM413 precursor RNA, herein designated VGAM PRECURSOR RNA, and of the 'diced' VGAM413 RNA, herein designated VGAM RNA, and a schematic representation of the secondary folding of VGAM413 folded precursor RNA, herein designated VGAM FOLDED PRECURSOR RNA, of VGAM413 are further described hereinbelow with reference to Table 1.

Nucleotide sequences of host target binding sites, such as BINDING SITE-I, BINDING SITE-II and BINDING SITE-III of FIG. 1, found on VGAM413 host target RNA, and schematic representation of the complementarity of each of these host target binding sites to VGAM413 RNA, herein designated VGAM RNA, are described hereinbelow with reference to Table 2.

As mentioned hereinabove with reference to FIG. 1, a function of VGAM413 gene, herein designated VGAM is inhibition of expression of VGAM413 target genes. It is appreciated that specific functions, and accordingly utilities, of VGAM413 correlate with, and may be deduced from, the identity of the target genes which VGAM413 binds and inhibits, and the function of these target genes, as elaborated hereinbelow.

Eukaryotic Translation Initiation Factor 2C, 1 (EIF2C1, Accession NM_012199) is a VGAM413 host target gene. EIF2C1 BINDING SITE is HOST TARGET binding site found in the 3' untranslated region of mRNA encoded by EIF2C1, corresponding to a HOST TARGET binding site such as BINDING SITE I, BINDING SITE II or BINDING SITE III. Table 2 illustrates the complementarity of the nucleotide sequences of EIF2C1 BINDING SITE, designated SEQ ID:14502, to the nucleotide sequence of VGAM413 RNA, herein designated VGAM RNA, also designated SEQ ID:3124.

A function of VGAM413 is therefore inhibition of Eukaryotic Translation Initiation Factor 2C, 1 (EIF2C1, Accession NM_012199), a gene which plays an important role in the eukaryotic peptide chain initiation process. Accordingly, utilities of VGAM413 include diagnosis, prevention and treatment of diseases and clinical conditions associated with EIF2C1. The function of EIF2C1 and its association with various diseases and clinical conditions, has been established by previous studies, as described hereinabove with reference to VGAM118. G Protein-coupled Receptor 81 (GPR81, Accession NM_032554) is another VGAM413 host target gene. GPR81 BINDING SITE is HOST TARGET binding site found in the 3' untranslated region of mRNA encoded by GPR81, corresponding to a HOST TARGET binding site such as BINDING SITE I, BINDING SITE II or BINDING SITE III. Table 2 illustrates the complementarity of the nucleotide sequences of GPR81 BINDING SITE, designated SEQ ID:26282, to the nucleotide sequence of VGAM413 RNA, herein designated VGAM RNA, also designated SEQ ID:3124.

Another function of VGAM413 is therefore inhibition of G Protein-coupled Receptor 81 (GPR81, Accession NM_032554). Accordingly, utilities of VGAM413 include diagnosis, prevention and treatment of diseases and clinical conditions associated with GPR81. Potassium Voltage-gated Channel, Shaker-related Subfamily, Member 5 (KCNA5, Accession XM_006988) is another VGAM413 host target gene. KCNA5 BINDING SITE is HOST TARGET binding site found in the 3' untranslated region of mRNA encoded by KCNA5, corresponding to a HOST TARGET binding site such as BINDING SITE I, BINDING SITE II or BINDING SITE III. Table 2 illustrates the complementarity of the nucleotide sequences of KCNA5 BINDING SITE, designated SEQ ID:30028, to the nucleotide sequence of VGAM413 RNA, herein designated VGAM RNA, also designated SEQ ID:3124.

Another function of VGAM413 is therefore inhibition of Potassium Voltage-gated Channel, Shaker-related Subfamily, Member 5 (KCNA5, Accession XM_006988), a gene which mediates the voltage-dependent potassium ion permeability of excitable membranes. Accordingly, utilities of VGAM413 include diagnosis, prevention and treatment of diseases and clinical conditions associated with KCNA5. The function of KCNA5 has been established by previous studies. Potassium channels play an important role in the regulation of pancreatic beta cells in response to glucose and the sulfonylurea oral hypoglycemic agents. Philipson et al. (1991) used a rat brain potassium channel probe to screen a human insulinoma cDNA library for clones encoding voltage-gated potassium channels. They isolated a series of cDNA clones which were then used to isolate and sequence a potassium channel gene, designated PCN1. Microinjection of synthetic RNA encoding PCN1 was accomplished in order to determine the electrophysiologic characteristics of the protein. These experiments demonstrated that the PCN1 potassium channel has the electrophysiologic characteristics of delayed-rectifier type channels. Tamkun et al. (1991) isolated human heart cDNAs encoding PCN1, which they called HK2, and HK1 (KCNA4; 176266). They reported that the predicted 605-amino acid HK2 protein shares the characteristics of voltage-gated potassium channels, with 6 potential membrane-spanning domains and a positively charged region in the fourth membrane-spanning domain. Northern blot analysis revealed that HK2 is expressed as a major 2.5- and a minor 1.5-kb mRNA in human atrium and ventricle. By study of somatic cell hybrids, McPherson et al. (1991) mapped a Shaker-related potassium voltage-gated channel gene to chromosome 12. Designated here KCNA5, the gene was identified with probe Kv1 from the rat. By multipoint linkage analysis of 8 CEPH families, Phromchotikul et al. (1993) mapped the KCNA5 gene to 12p and determined its position relative to 4 DNA markers. Using interspecific backcrosses between Mus musculus and Mus spretus, Klocke et al. (1993) mapped the Kcna5 gene to a cluster with the Kcna1 and Kcna6 (OMIM Ref. No. 176257) genes and the mouse homolog of TPI1 (OMIM Ref. No. 190450). Since TPI1 is located on band 12p13 in the human, the 3 K(+)-channel genes was predicted to be in the same band. Curran et al. (1992) mapped the KCNA5 gene, which they erroneously referred to as the KCNA1 gene, to chromosome 12 by use of human-rodent somatic cell panels and narrowed the localization to the distal short arm by in situ hybridization. Linkage studies had shown a maximum lod score of 2.72 at a recombination fraction of 0.05 between KCNA5 and the von Willebrand locus (VWF; 193400). Albrecht et al. (1995) determined that a 300-kb cluster on chromosome 12p13 contains the human KCNA6, KCNA1, and KCNA5 genes arranged in tandem Full details of the abovementioned studies are described in the following publications, the disclosure of which are hereby incorporated by reference:

Albrecht, B.; Weber, K.; Pongs, O.: Characterization of a voltage-activated K-channel gene cluster on human chromosome 12p13. Receptors Channels 3:213-220, 1995; and Curran, M. E.; Landes, G. M.; Keating, M. T.: Molecular cloning, characterization, and genomic localization of a human potassium channel gene. Genomics 12:729-737, 1992.

Further studies establishing the function and utilities of KCNA5 are found in John Hopkins OMIM database record ID 176267, and in sited publications numbered 10288, 10291, 1092 and 10939 listed in the bibliography section hereinbelow, which are also hereby incorporated by reference. Lipin 1 (LPIN1, Accession XM_041136) is another VGAM413 host target gene. LPIN1 BINDING SITE is HOST TARGET binding site found in the 3' untranslated region of mRNA encoded by LPIN1, corresponding to a HOST TARGET binding site such as BINDING SITE I, BINDING SITE II or BINDING SITE III. Table 2 illustrates the complementarity of the nucleotide sequences of LPIN1 BINDING SITE, designated SEQ ID:33467, to the nucleotide sequence of VGAM413 RNA, herein designated VGAM RNA, also designated SEQ ID:3124.

Another function of VGAM413 is therefore inhibition of Lipin 1 (LPIN1, Accession XM_041136), a gene which is involved in adipocyte differenciation (by similarity). Accordingly, utilities of VGAM413 include diagnosis, prevention and treatment of diseases and clinical conditions associated with LPIN1. The function of LPIN1 and its association with various diseases and clinical conditions, has been established by previous studies, as described hereinabove with reference to VGAM35. Pleiomorphic Adenoma Gene 1 (PLAG1, Accession NM_002655) is another VGAM413 host target gene. PLAG1 BINDING SITE is HOST TARGET binding site found in the 3' untranslated region of mRNA encoded by PLAG1, corresponding to a HOST TARGET binding site such as BINDING SITE I, BINDING SITE II or BINDING SITE III. Table 2 illustrates the complementarity of the nucleotide sequences of PLAG1 BINDING SITE, designated SEQ ID:8520, to the nucleotide sequence of VGAM413 RNA, herein designated VGAM RNA, also designated SEQ ID:3124.

Another function of VGAM413 is therefore inhibition of Pleiomorphic Adenoma Gene 1 (PLAG1, Accession NM_002655), a gene which contains a zinc finger domain. Accordingly, utilities of VGAM413 include diagnosis, prevention and treatment of diseases and clinical conditions associated with PLAG1. The function of PLAG1 and its association with various diseases and clinical conditions, has been established by previous studies, as described hereinabove with reference to VGAM29. Tyrosine 3-monooxygenase/tryptophan 5-monooxygenase Activation Protein, Gamma Polypeptide (YWHAG, Accession NM_012479) is another VGAM413 host target gene. YWHAG BINDING SITE is HOST TARGET binding site found in the 3' untranslated region of mRNA encoded by YWHAG, corresponding to a HOST TARGET binding site such as BINDING SITE I, BINDING SITE II or BINDING SITE III. Table 2 illustrates the complementarity of the nucleotide sequences of YWHAG BINDING SITE, designated SEQ ID:14855, to the nucleotide sequence of VGAM413 RNA, herein designated VGAM RNA, also designated SEQ ID:3124.

Another function of VGAM413 is therefore inhibition of Tyrosine 3-monooxygenase/tryptophan 5-monooxygenase Activation Protein, Gamma Polypeptide (YWHAG, Accession NM_012479), a gene which mediates mitogenic signals of PDGF in vascular smooth muscle cells. Accordingly, utilities of VGAM413 include diagnosis, prevention and treatment of diseases and clinical conditions associated with YWHAG. The function of YWHAG and its association with various diseases and clinical conditions, has been established by previous studies, as described hereinabove with reference to VGAM180. Chromosome 1 Open Reading Frame 22 (C1orf22, Accession NM_025191) is another VGAM413 host target gene. C1orf22 BINDING SITE is HOST TARGET binding site found in the 3' untranslated region of mRNA encoded by C1orf22, corresponding to a HOST TARGET binding site such as BINDING SITE I, BINDING SITE II or BINDING SITE III. Table 2 illustrates the complementarity of the nucleotide sequences of C1orf22 BINDING SITE, designated SEQ ID:24837, to the nucleotide sequence of VGAM413 RNA, herein designated VGAM RNA, also designated SEQ ID:3124.

Another function of VGAM413 is therefore inhibition of Chromosome 1 Open Reading Frame 22 (C1orf22, Accession NM_025191). Accordingly, utilities of VGAM413 include diagnosis, prevention and treatment of diseases and clinical conditions associated with C1orf22. FLJ10246 (Accession NM_018038) is another VGAM413 host target gene. FLJ10246 BINDING SITE is HOST TARGET binding site found in the 3' untranslated region of mRNA encoded by FLJ10246, corresponding to a HOST TARGET binding site such as BINDING SITE I, BINDING SITE II or BINDING SITE III. Table 2 illustrates the complementarity of the nucleotide sequences of FLJ10246 BINDING SITE, designated SEQ ID:19785, to the nucleotide sequence of VGAM413 RNA, herein designated VGAM RNA, also designated SEQ ID:3124.

Another function of VGAM413 is therefore inhibition of FLJ10246 (Accession NM_018038). Accordingly, utilities of VGAM413 include diagnosis, prevention and treatment of diseases and clinical conditions associated with FLJ10246. FLJ10276 (Accession NM_018045) is another VGAM413 host target gene. FLJ10276 BINDING SITE is HOST TARGET binding site found in the 3' untranslated region of mRNA encoded by FLJ10276, corresponding to a HOST TARGET binding site such as BINDING SITE I, BINDING SITE II or BINDING SITE III. Table 2 illustrates the complementarity of the nucleotide sequences of FLJ10276 BINDING SITE, designated SEQ ID:19791, to the nucleotide sequence of VGAM413 RNA, herein designated VGAM RNA, also designated SEQ ID:3124.

Another function of VGAM413 is therefore inhibition of FLJ10276 (Accession NM_018045). Accordingly, utilities of VGAM413 include diagnosis, prevention and treatment of diseases and clinical conditions associated with FLJ10276. FLJ12700 (Accession NM_024910) is another VGAM413 host target gene. FLJ12700 BINDING SITE is HOST TARGET binding site found in the 3' untranslated region of mRNA encoded by FLJ12700, corresponding to a HOST TARGET binding site such as BINDING SITE I, BINDING SITE II or BINDING SITE III. Table 2 illustrates the complementarity of the nucleotide sequences of FLJ12700 BINDING SITE, designated SEQ ID:24415, to the nucleotide sequence of VGAM413 RNA, herein designated VGAM RNA, also designated SEQ ID:3124.

Another function of VGAM413 is therefore inhibition of FLJ12700 (Accession NM_024910). Accordingly, utilities of VGAM413 include diagnosis, prevention and treatment of diseases and clinical conditions associated with FLJ12700. G2 (Accession XM_039515) is another VGAM413 host target gene. G2 BINDING SITE is HOST TARGET binding site found in the 3' untranslated region of mRNA encoded by G2, corresponding to a HOST TARGET binding site such as BINDING SITE I, BINDING SITE II or BINDING SITE III. Table 2 illustrates the complementarity of the nucleotide sequences of G2 BINDING SITE, designated SEQ ID:33112, to the nucleotide sequence of VGAM413 RNA, herein designated VGAM RNA, also designated SEQ ID:3124.

Another function of VGAM413 is therefore inhibition of G2 (Accession XM_039515). Accordingly, utilities of VGAM413 include diagnosis, prevention and treatment of diseases and clinical conditions associated with G2. KIAA1655 (Accession XM_039442) is another VGAM413 host target gene. KIAA1655 BINDING SITE is HOST TARGET binding site found in the 3' untranslated region of mRNA encoded by KIAA1655, corresponding to a HOST TARGET binding site such as BINDING SITE I, BINDING SITE II or BINDING SITE III. Table 2 illustrates the complementarity of the nucleotide sequences of KIAA1655 BINDING SITE, designated SEQ ID:33087, to the nucleotide sequence of VGAM413 RNA, herein designated VGAM RNA, also designated SEQ ID:3124.

Another function of VGAM413 is therefore inhibition of KIAA1655 (Accession XM_039442). Accordingly, utilities of VGAM413 include diagnosis, prevention and treatment of diseases and clinical conditions associated with KIAA1655. Molybdenum Cofactor Synthesis 3 (MOCS3, Accession NM_014484) is another VGAM413 host target gene. MOCS3 BINDING SITE is HOST TARGET binding site found in the 3' untranslated region of mRNA encoded by MOCS3, corresponding to a HOST TARGET binding site such as BINDING SITE I, BINDING SITE II or BINDING SITE III. Table 2 illustrates the complementarity of the nucleotide sequences of MOCS3 BINDING SITE, designated SEQ ID:15829, to the nucleotide sequence of VGAM413 RNA, herein designated VGAM RNA, also designated SEQ ID:3124.

Another function of VGAM413 is therefore inhibition of Molybdenum Cofactor Synthesis 3 (MOCS3, Accession NM_014484). Accordingly, utilities of VGAM413 include diagnosis, prevention and treatment of diseases and clinical conditions associated with MOCS3. P66 (Accession NM_020699) is another VGAM413 host target gene. P66 BINDING SITE is HOST TARGET binding site found in the 3' untranslated region of mRNA encoded by P66, corresponding to a HOST TARGET binding site such as BINDING SITE I, BINDING SITE II or BINDING SITE III. Table 2 illustrates the complementarity of the nucleotide sequences of P66 BINDING SITE, designated SEQ ID:21843, to the nucleotide sequence of VGAM413 RNA, herein designated VGAM RNA, also designated SEQ ID:3124.

Another function of VGAM413 is therefore inhibition of P66 (Accession NM_020699). Accordingly, utilities of VGAM413 include diagnosis, prevention and treatment of diseases and clinical conditions associated with P66. PRO0529 (Accession NM_014074) is another VGAM413 host target gene. PRO0529 BINDING SITE is HOST TARGET binding site found in the 5' untranslated region of mRNA encoded by PRO0529, corresponding to a HOST TARGET binding site such as BINDING SITE I, BINDING SITE II or BINDING SITE III. Table 2 illustrates the complementarity of the nucleotide sequences of PRO0529 BINDING SITE, designated SEQ ID:15301, to the nucleotide sequence of VGAM413 RNA, herein designated VGAM RNA, also designated SEQ ID:3124.

Another function of VGAM413 is therefore inhibition of PRO0529 (Accession NM_014074). Accordingly, utilities of VGAM413 include diagnosis, prevention and treatment of diseases and clinical conditions associated with PRO0529. RA-GEF-2 (Accession NM_016340) is another VGAM413 host target gene. RA-GEF-2 BINDING SITE is HOST TARGET binding site found in the 3' untranslated region of mRNA encoded by RA-GEF-2, corresponding to a HOST TARGET binding site such as BINDING SITE I, BINDING SITE II or BINDING SITE III. Table 2 illustrates the complementarity of the nucleotide sequences of RA-GEF-2 BINDING SITE, designated SEQ ID:18465, to the nucleotide sequence of VGAM413 RNA, herein designated VGAM RNA, also designated SEQ ID:3124.

Another function of VGAM413 is therefore inhibition of RA-GEF-2 (Accession NM_016340). Accordingly, utilities of VGAM413 include diagnosis, prevention and treatment of diseases and clinical conditions associated with RA-GEF-2. Zinc Finger Protein 17 (HPF3, KOX 10) (ZNF17, Accession XM_091895) is another VGAM413 host target gene. ZNF17 BINDING SITE is HOST TARGET binding site found in the 3' untranslated region of mRNA encoded by ZNF17, corresponding to a HOST TARGET binding site such as BINDING SITE I, BINDING SITE II or BINDING SITE III. Table 2 illustrates the complementarity of the nucleotide sequences of ZNF17 BINDING SITE, designated SEQ ID:40067, to the nucleotide sequence of VGAM413 RNA, herein designated VGAM RNA, also designated SEQ ID:3124.

Another function of VGAM413 is therefore inhibition of Zinc Finger Protein 17 (HPF3, KOX 10) (ZNF17, Accession XM_091895). Accordingly, utilities of VGAM413 include diagnosis, prevention and treatment of diseases and clinical conditions associated with ZNF17. LOC128077 (Accession XM_059208) is another VGAM413 host target gene. LOC128077 BINDING SITE is HOST TARGET binding site found in the 3' untranslated region of mRNA encoded by LOC128077, corresponding to a HOST TARGET binding site such as BINDING SITE I, BINDING SITE II or BINDING SITE III. Table 2 illustrates the complementarity of the nucleotide sequences of LOC128077 BINDING SITE, designated SEQ ID:36916, to the nucleotide sequence of VGAM413 RNA, herein designated VGAM RNA, also designated SEQ ID:3124.

Another function of VGAM413 is therefore inhibition of LOC128077 (Accession XM_059208). Accordingly, utilities of VGAM413 include diagnosis, prevention and treatment of diseases and clinical conditions associated with LOC128077. LOC149127 (Accession XM_097584) is another VGAM413 host target gene. LOC149127 BINDING SITE is HOST TARGET binding site found in the 3' untranslated region of mRNA encoded by LOC149127, corresponding to a HOST TARGET binding site such as BINDING SITE I, BINDING SITE II or BINDING SITE III. Table 2 illustrates the complementarity of the nucleotide sequences of LOC149127 BINDING SITE, designated SEQ ID:40949, to the nucleotide sequence of VGAM413 RNA, herein designated VGAM RNA, also designated SEQ ID:3124.

Another function of VGAM413 is therefore inhibition of LOC149127 (Accession XM_097584). Accordingly, utilities of VGAM413 include diagnosis, prevention and treatment of diseases and clinical conditions associated with LOC149127. LOC150630 (Accession XM_097931) is another VGAM413 host target gene. LOC150630 BINDING SITE is HOST TARGET binding site found in the 5' untranslated region of mRNA encoded by LOC150630, corresponding to a HOST TARGET binding site such as BINDING SITE I, BINDING SITE II or BINDING SITE III. Table 2 illustrates the complementarity of the nucleotide sequences of LOC150630 BINDING SITE, designated SEQ ID:41239, to the nucleotide sequence of VGAM413 RNA, herein designated VGAM RNA, also designated SEQ ID:3124.

Another function of VGAM413 is therefore inhibition of LOC150630 (Accession XM_097931). Accordingly, utilities of VGAM413 include diagnosis, prevention and treatment of diseases and clinical conditions associated with LOC150630. LOC169021 (Accession XM_095459) is another VGAM413 host target gene. LOC169021 BINDING SITE is HOST TARGET binding site found in the 5' untranslated region of mRNA encoded by LOC169021, corresponding to a HOST TARGET binding site such as BINDING SITE I, BINDING SITE II or BINDING SITE III. Table 2 illustrates the complementarity of the nucleotide sequences of LOC169021 BINDING SITE, designated SEQ ID:40258, to the nucleotide sequence of VGAM413 RNA, herein designated VGAM RNA, also designated SEQ ID:3124.

Another function of VGAM413 is therefore inhibition of LOC169021 (Accession XM_095459). Accordingly, utilities of VGAM413 include diagnosis, prevention and treatment of diseases and clinical conditions associated with LOC169021. LOC221687 (Accession XM_166423) is another VGAM413 host target gene. LOC221687 BINDING SITE is HOST TARGET binding site found in the 3' untranslated region of mRNA encoded by LOC221687, corresponding to a HOST TARGET binding site such as BINDING SITE I, BINDING SITE II or BINDING SITE III. Table 2 illustrates the complementarity of the nucleotide sequences of LOC221687 BINDING SITE, designated SEQ ID:44306, to the nucleotide sequence of VGAM413 RNA, herein designated VGAM RNA, also designated SEQ ID:3124.

Another function of VGAM413 is therefore inhibition of LOC221687 (Accession XM_166423). Accordingly, utilities of VGAM413 include diagnosis, prevention and treatment of diseases and clinical conditions associated with LOC221687. FIG. 1 further provides a conceptual description of a novel bioinformatically detected viral gene of the present invention, referred to here as Viral Genomic Address Messenger 414 (VGAM414) viral gene, which modulates expression of respective host target genes thereof, the function and utility of which host target genes is known in the art.

VGAM414 is a novel bioinformatically detected regulatory, non protein coding, viral micro RNA (miRNA) gene. The method by which VGAM414 was detected is described hereinabove with reference to FIGS. 1-8.

VGAM414 gene, herein designated VGAM GENE, is a viral gene contained in the genome of Pepper Mottle Virus. VGAM414 host target gene, herein designated VGAM HOST TARGET GENE, is a human gene contained in the human genome.

VGAM414 gene encodes a VGAM414 precursor RNA, herein designated VGAM PRECURSOR RNA. Similar to other miRNA genes, and unlike most ordinary genes, VGAM414 precursor RNA does not encode a protein. A nucleotide sequence identical or highly similar to the nucleotide sequence of VGAM414 precursor RNA is designated SEQ ID:400, and is provided hereinbelow with reference to the sequence listing part. Nucleotide sequence SEQ ID:400 is located at position 8752 relative to the genome of Pepper Mottle Virus.

VGAM414 precursor RNA folds onto itself, forming VGAM414 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM414 folded precursor RNA into VGAM414 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM414 RNA is designated SEQ ID:3125, and is provided hereinbelow with reference to the sequence listing part.

VGAM414 host target gene, herein designated VGAM HOST TARGET GENE, encodes a corresponding messenger RNA, VGAM414 host target RNA, herein designated VGAM HOST TARGET RNA. VGAM414 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM414 RNA, herein designated VGAM RNA, binds complementarily to one or more host target binding sites located in untranslated regions of VGAM414 host target RNA, herein designated VGAM HOST TARGET RNA. This complementary binding is due to the fact that the nucleotide sequence of VGAM414 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM414 RNA, herein designated VGAM RNA, may have a different number of host target binding sites in untranslated regions of a VGAM414 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM414 RNA, herein designated VGAM RNA, to host target binding sites on VGAM414 host target RNA, herein designated VGAM HOST TARGET RNA, such as BINDING SITE I, BINDING SITE II and BINDING SITE III, inhibits translation of VGAM414 host target RNA into VGAM414 host target protein, herein designated VGAM HOST TARGET PROTEIN. VGAM host target protein is therefore outlined by a broken line.

It is appreciated that VGAM414 host target gene, herein designated VGAM HOST TARGET GENE, in fact represents a plurality of VGAM414 host target genes. The mRNA of each one of this plurality of VGAM414 host target genes comprises one or more host target binding sites, each having a nucleotide sequence which is at least partly complementary to VGAM414 RNA, herein designated VGAM RNA, and which when bound by VGAM414 RNA causes inhibition of translation of respective one or more VGAM414 host target proteins.

It is further appreciated by one skilled in the art that the mode of translational inhibition illustrated by FIG. 1 with specific reference to translational inhibition exerted by VGAM414 gene, herein designated VGAM GENE, on one or more VGAM414 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM414 is inhibition of expression of host target genes, as part of a novel viral mechanism of attacking a host. Accordingly, utilities of VGAM414 include diagnosis, prevention and treatment of viral infection by Pepper Mottle Virus. Specific functions, and accordingly utilities, of VGAM414 correlate with, and may be deduced from, the identity of the host target genes which VGAM414 binds and inhibits, and the function of these host target genes, as elaborated hereinbelow.

Nucleotide sequences of the VGAM414 precursor RNA, herein designated VGAM PRECURSOR RNA, and of the 'diced' VGAM414 RNA, herein designated VGAM RNA, and a schematic representation of the secondary folding of VGAM414 folded precursor RNA, herein designated VGAM FOLDED PRECURSOR RNA, of VGAM414 are further described hereinbelow with reference to Table 1.

Nucleotide sequences of host target binding sites, such as BINDING SITE-I, BINDING SITE-II and BINDING SITE-III of FIG. 1, found on VGAM414 host target RNA, and schematic representation of the complementarity of each of these host target binding sites to VGAM414 RNA, herein designated VGAM RNA, are described hereinbelow with reference to Table 2.

As mentioned hereinabove with reference to FIG. 1, a function of VGAM414 gene, herein designated VGAM is inhibition of expression of VGAM414 target genes. It is appreciated that specific functions, and accordingly utilities, of VGAM414 correlate with, and may be deduced from, the identity of the target genes which VGAM414 binds and inhibits, and the function of these target genes, as elaborated hereinbelow.

Aldehyde Dehydrogenase 1 Family, Member B1 (ALDH1B1, Accession NM_000692) is a VGAM414 host target gene. ALDH1B1 BINDING SITE is HOST TARGET binding site found in the 3' untranslated region of mRNA encoded by ALDH1B1, corresponding to a HOST TARGET binding site such as BINDING SITE I, BINDING SITE II or BINDING SITE III. Table 2 illustrates the complementarity of the nucleotide sequences of ALDH1B1 BINDING SITE, designated SEQ ID:6346, to the nucleotide sequence of VGAM414 RNA, herein designated VGAM RNA, also designated SEQ ID:3125.

A function of VGAM414 is therefore inhibition of Aldehyde Dehydrogenase 1 Family, Member B1 (ALDH1B1, Accession NM_000692). Accordingly, utilities of VGAM414 include diagnosis, prevention and treatment of diseases and clinical conditions associated with ALDH1B1. Cytochrome P450, Subfamily VIIA (cholesterol 7 alpha-monooxygenase), Polypeptide 1 (CYP7A1, Accession NM_000780) is another VGAM414 host target gene. CYP7A1 BINDING SITE is HOST TARGET binding site found in the 3' untranslated region of mRNA encoded by CYP7A1, corresponding to a HOST TARGET binding site such as BINDING SITE I, BINDING SITE II or BINDING SITE III. Table 2 illustrates the complementarity of the nucleotide sequences of CYP7A1 BINDING SITE, designated SEQ ID:6421, to the nucleotide sequence of VGAM414 RNA, herein designated VGAM RNA, also designated SEQ ID:3125.

Another function of VGAM414 is therefore inhibition of Cytochrome P450, Subfamily VIIA (cholesterol 7 alpha-monooxygenase), Polypeptide 1 (CYP7A1, Accession NM_000780), a gene which functions in cholesterol and bile acid metabolism . Accordingly, utilities of VGAM414 include diagnosis, prevention and treatment of diseases and clinical conditions associated with CYP7A1. The function of CYP7A1 has been established by previous studies. In an elegant series of experiments designed to understand the effect of retinoid X receptor (RXR; OMIM Ref. No. 180245) activation on cholesterol balance, Repa et al. (2000) treated animals with the rexinoid LG268. Animals treated with rexinoid exhibited marked changes in cholesterol balance, including inhibition of cholesterol absorption and repressed bile acid synthesis. Studies with receptor-selective agonists revealed that oxysterol receptors (LXRs, OMIM Ref. No. 602423 and 600380) and the bile acid receptor, FXR (OMIM Ref. No. 603826), are the RXR heterodimeric partners that mediate these effects by regulating expression of the reverse-cholesterol transporter, ABC1 (OMIM Ref. No. 600046), and the rate-limiting enzyme of bile acid synthesis, CYP7A1, respectively. These RXR heterodimers serve as key regulators in cholesterol homeostasis by governing reverse cholesterol transport from peripheral tissues, bile acid synthesis in liver, and cholesterol absorption in intestine. Activation of RXR/LXR heterodimers inhibits cholesterol absorption by upregulation of ABC1 expression in the small intestine. Activation of RXR/FXR heterodimers represses CYP7A1 expression and bile acid production, leading to a failure to solubilize and absorb cholesterol. Studies have shown that RXR/FXR-mediated repression of CYP7A1 is dominant over RXR/LXR-mediated induction of CYP7A1, which explains why the rexinoid represses rather than activates CYP7A1 (Lu et al., 2000). Activation of the LXR signaling pathway results in the upregulation of ABC1 in peripheral cells, including macrophages, to efflux free cholesterol for transport back to the liver through high density lipoprotein, where it is converted to bile acids by the LXR-mediated increase in CYP7A1 expression. Secretion of biliary cholesterol in the presence of increased bile acid pools normally results in enhanced reabsorption of cholesterol; however, with the increased expression of ABC1 and efflux of cholesterol back into the lumen, there is a reduction in cholesterol absorption and net excretion of cholesterol and bile acid. Rexinoids therefore offer a novel class of agents for treating elevated cholesterol. Agellon et al. (2002) found that wildtype mice and mice transgenic for human CYP7A1 respond differently to cholesterol feeding. Cholesterol feeding stimulated Cyp7a1 mRNA abundance and enzymatic activity in wildtype mice, but repressed human CYP7A1 mRNA and activity in transgenic mice. In transfected hepatoma cells, cholesterol increased mouse Cyp7a1 gene promoter activity, but had no effect on the human CYYP7A1 gene promoter. By electrophoretic mobility shift assays, Agellon et al. (2002) found interaction of LXR:RXR with the mouse promoter, but no binding to the human promoter.

Full details of the abovementioned studies are described in the following publications, the disclosure of which are hereby incorporated by reference:

Lu, T. T.; Makishima, M.; Repa, J. J.; Schoonjans, K.; Kerr, T. A.; Auwerx, J.; Mangelsdorf, D. J.: Molecular basis for feedback regulation of bile acid synthesis by nuclear receptors. Molec. Cell 6:507-515, 2000; and Agellon, L. B.; Drover, V. A. B.; Cheema, S. K.; Gbaguidi, G. F.; Walsh, A.: Dietary cholesterol fails to stimulate the human cholesterol 7-alpha-hydroxylase gene (CYP7A1) in transgeni.

Further studies establishing the function and utilities of CYP7A1 are found in John Hopkins OMIM database record ID 118455, and in sited publications numbered 12131-12136, 5941, 12137-12140, 594 and 12141 listed in the bibliography section hereinbelow, which are also hereby incorporated by reference. Engrailed Homolog 2 (EN2, Accession NM_001427) is another VGAM414 host target gene. EN2 BINDING SITE is HOST TARGET binding site found in the 3' untranslated region of mRNA encoded by EN2, corresponding to a HOST TARGET binding site such as BINDING SITE I, BINDING SITE II or BINDING SITE III. Table 2 illustrates the complementarity of the nucleotide sequences of EN2 BINDING SITE, designated SEQ ID:7147, to the nucleotide sequence of VGAM414 RNA, herein designated VGAM RNA, also designated SEQ ID:3125.

Another function of VGAM414 is therefore inhibition of Engrailed Homolog 2 (EN2, Accession NM_001427), a gene which may be required for normal cerebellar development; a homeobox protein, very strongly similar to murine En2. Accordingly, utilities of VGAM414 include diagnosis, prevention and treatment of diseases and clinical conditions associated with EN2. The function of EN2 and its association with various diseases and clinical conditions, has been established by previous studies, as described hereinabove with reference to VGAM232. Glutamate Dehydrogenase 1 (GLUD1, Accession NM_005271) is another VGAM414 host target gene. GLUD1 BINDING SITE is HOST TARGET binding site found in the 3' untranslated region of mRNA encoded by GLUD1, corresponding to a HOST TARGET binding site such as BINDING SITE I, BINDING SITE II or BINDING SITE III. Table 2 illustrates the complementarity of the nucleotide sequences of GLUD1 BINDING SITE, designated SEQ ID:11775, to the nucleotide sequence of VGAM414 RNA, herein designated VGAM RNA, also designated SEQ ID:3125.

Another function of VGAM414 is therefore inhibition of Glutamate Dehydrogenase 1 (GLUD1, Accession NM_005271). Accordingly, utilities of VGAM414 include diagnosis, prevention and treatment of diseases and clinical conditions associated with GLUD1. Outer Dense Fiber of Sperm Tails 2 (ODF2, Accession NM_002540) is another VGAM414 host target gene. ODF2 BINDING SITE is HOST TARGET binding site found in the 5' untranslated region of mRNA encoded by ODF2, corresponding to a HOST TARGET binding site such as BINDING SITE I, BINDING SITE II or BINDING SITE III. Table 2 illustrates the complementarity of the nucleotide sequences of ODF2 BINDING SITE, designated SEQ ID:8388, to the nucleotide sequence of VGAM414 RNA, herein designated VGAM RNA, also designated SEQ ID:3125.

Another function of VGAM414 is therefore inhibition of Outer Dense Fiber of Sperm Tails 2 (ODF2, Accession NM_002540), a gene which is very strongly similar to rat Odf2. Accordingly, utilities of VGAM414 include diagnosis, prevention and treatment of diseases and clinical conditions associated with ODF2. The function of ODF2 and its association with various diseases and clinical conditions, has been established by previous studies, as described hereinabove with reference to VGAM363. Single-minded Homolog 2 (Drosophila) (SIM2, Accession NM_009586) is another VGAM414 host target gene. SIM2 BINDING SITE is HOST TARGET binding site found in the 3' untranslated region of mRNA encoded by SIM2, corresponding to a HOST TARGET binding site such as BINDING SITE I, BINDING SITE II or BINDING SITE III. Table 2 illustrates the complementarity of the nucleotide sequences of SIM2 BINDING SITE, designated SEQ ID:14314, to the nucleotide sequence of VGAM414 RNA, herein designated VGAM RNA, also designated SEQ ID:3125.

Another function of VGAM414 is therefore inhibition of Single-minded Homolog 2 (Drosophila) (SIM2, Accession NM_009586), a gene which may be a master gene of cns development. Accordingly, utilities of VGAM414 include diagnosis, prevention and treatment of diseases and clinical conditions associated with SIM2. The function of SIM2 and its association with various diseases and clinical conditions, has been established by previous studies, as described hereinabove with reference to VGAM369. Zinc Finger Protein 278 (ZNF278, Accession NM_032050) is another VGAM414 host target gene. ZNF278 BINDING SITE1 through ZNF278 BINDING SITE3 are HOST TARGET binding sites found in untranslated regions of mRNA encoded by ZNF278, corresponding to HOST TARGET binding sites such as BINDING SITE I, BINDING SITE II or BINDING SITE III. Table 2 illustrates the complementarity of the nucleotide sequences of ZNF278 BINDING SITE1 through ZNF278 BINDING SITE3, designated SEQ ID:25771, SEQ ID:25780 and SEQ ID:15622 respectively, to the nucleotide sequence of VGAM414 RNA, herein designated VGAM RNA, also designated SEQ ID:3125.

Another function of VGAM414 is therefore inhibition of Zinc Finger Protein 278 (ZNF278, Accession NM_032050), a gene which represses basal transcription as well as RNF4-mediated activation. Accordingly, utilities of VGAM414 include diagnosis, prevention and treatment of diseases and clinical conditions associated with ZNF278. The function of ZNF278 has been established by previous studies. By chromatographic and coimmunoprecipitation analyses, Fedele et al. (2000) showed that ZNF278 interacts with RNF4 both in vitro and in vivo. The authors found that the POZ domain is responsible for repression of basal transcription as well as repression of RNF4-mediated activation. Immunofluorescence analysis demonstrated that ZNF278 colocalizes with RNF4 in the nuclear matrix Full details of the abovementioned studies are described in the following publications, the disclosure of which are hereby incorporated by reference:

Fedele, M.; Benvenuto, G.; Pero, R.; Majello, B.; Battista, S.; Lembo, F.; Vollono, E.; Day, P. M.; Santoro, M.; Lania, L.; Bruni, C. B.; Fusco, A.; Chiariotti, L.: A novel member of the BTB/POZ family, PATZ, associates with the RNF4 RING finger protein and acts as a transcriptional repressor. J. Biol. Chem. 275:7894-7901, 2000; and Mastrangelo, T.; Modena, P.; Tornielli, S.; Bullrich, F.; Testi, M. A.; Mezzelani, A.; Radice, P.; Azzarelli, A.; Pilotti, S.; Croce, C. M.; Pierotti, M. A.; Sozzi, G. : A novel zinc finge.

Further studies establishing the function and utilities of ZNF278 are found in John Hopkins OMIM database record ID 605165, and in sited publications numbered 4395-439 and 3660 listed in the bibliography section hereinbelow, which are also hereby incorporated by reference. FLJ20373 (Accession NM_017792) is another VGAM414 host target gene. FLJ20373 BINDING SITE is HOST TARGET binding site found in the 3' untranslated region of mRNA encoded by FLJ20373, corresponding to a HOST TARGET binding site such as BINDING SITE I, BINDING SITE II or BINDING SITE III. Table 2 illustrates the complementarity of the nucleotide sequences of FLJ20373 BINDING SITE, designated SEQ ID:19426, to the nucleotide sequence of VGAM414 RNA, herein designated VGAM RNA, also designated SEQ ID:3125.

Another function of VGAM414 is therefore inhibition of FLJ20373 (Accession NM_017792). Accordingly, utilities of VGAM414 include diagnosis, prevention and treatment of diseases and clinical conditions associated with FLJ20373. Serine Palmitoyltransferase, Long Chain Base Subunit 2 (SPTLC2, Accession NM_004863) is another VGAM414 host target gene. SPTLC2 BINDING SITE is HOST TARGET binding site found in the 3' untranslated region of mRNA encoded by SPTLC2, corresponding to a HOST TARGET binding site such as BINDING SITE I, BINDING SITE II or BINDING SITE III. Table 2 illustrates the complementarity of the nucleotide sequences of SPTLC2 BINDING SITE, designated SEQ ID:11274, to the nucleotide sequence of VGAM414 RNA, herein designated VGAM RNA, also designated SEQ ID:3125.

Another function of VGAM414 is therefore inhibition of Serine Palmitoyltransferase, Long Chain Base Subunit 2 (SPTLC2, Accession NM_004863). Accordingly, utilities of VGAM414 include diagnosis, prevention and treatment of diseases and clinical conditions associated with SPTLC2. LOC91170 (Accession XM_036612) is another VGAM414 host target gene. LOC91170 BINDING SITE is HOST TARGET binding site found in the 5' untranslated region of mRNA encoded by LOC91170, corresponding to a HOST TARGET binding site such as BINDING SITE I, BINDING SITE II or BINDING SITE III. Table 2 illustrates the complementarity of the nucleotide sequences of LOC91170 BINDING SITE, designated SEQ ID:32481, to the nucleotide sequence of VGAM414 RNA, herein designated VGAM RNA, also designated SEQ ID:3125.

Another function of VGAM414 is therefore inhibition of LOC91170 (Accession XM_036612). Accordingly, utilities of VGAM414 include diagnosis, prevention and treatment of diseases and clinical conditions associated with LOC91170. FIG. 1 further provides a conceptual description of a novel bioinformatically detected viral gene of the present invention, referred to here as Viral Genomic Address Messenger 415 (VGAM415) viral gene, which modulates expression of respective host target genes thereof, the function and utility of which host target genes is known in the art.

VGAM415 is a novel bioinformatically detected regulatory, non protein coding, viral micro RNA (miRNA) gene. The method by which VGAM415 was detected is described hereinabove with reference to FIGS. 1-8.

VGAM415 gene, herein designated VGAM GENE, is a viral gene contained in the genome of Pepper Mottle Virus. VGAM415 host target gene, herein designated VGAM HOST TARGET GENE, is a human gene contained in the human genome.

VGAM415 gene encodes a VGAM415 precursor RNA, herein designated VGAM PRECURSOR RNA. Similar to other miRNA genes, and unlike most ordinary genes, VGAM415 precursor RNA does not encode a protein. A nucleotide sequence identical or highly similar to the nucleotide sequence of VGAM415 precursor RNA is designated SEQ ID:401, and is provided hereinbelow with reference to the sequence listing part. Nucleotide sequence SEQ ID:401 is located at position 792 relative to the genome of Pepper Mottle Virus.

VGAM415 precursor RNA folds onto itself, forming VGAM415 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM415 folded precursor RNA into VGAM415 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM415 RNA is designated SEQ ID:3126, and is provided hereinbelow with reference to the sequence listing part.

VGAM415 host target gene, herein designated VGAM HOST TARGET GENE, encodes a corresponding messenger RNA, VGAM415 host target RNA, herein designated VGAM HOST TARGET RNA. VGAM415 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM415 RNA, herein designated VGAM RNA, binds complementarily to one or more host target binding sites located in untranslated regions of VGAM415 host target RNA, herein designated VGAM HOST TARGET RNA. This complementary binding is due to the fact that the nucleotide sequence of VGAM415 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM415 RNA, herein designated VGAM RNA, may have a different number of host target binding sites in untranslated regions of a VGAM415 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM415 RNA, herein designated VGAM RNA, to host target binding sites on VGAM415 host target RNA, herein designated VGAM HOST TARGET RNA, such as BINDING SITE I, BINDING SITE II and BINDING SITE III, inhibits translation of VGAM415 host target RNA into VGAM415 host target protein, herein designated VGAM HOST TARGET PROTEIN. VGAM host target protein is therefore outlined by a broken line.

It is appreciated that VGAM415 host target gene, herein designated VGAM HOST TARGET GENE, in fact represents a plurality of VGAM415 host target genes. The mRNA of each one of this plurality of VGAM415 host target genes comprises one or more host target binding sites, each having a nucleotide sequence which is at least partly complementary to VGAM415 RNA, herein designated VGAM RNA, and which when bound by VGAM415 RNA causes inhibition of translation of respective one or more VGAM415 host target proteins.

It is further appreciated by one skilled in the art that the mode of translational inhibition illustrated by FIG. 1 with specific reference to translational inhibition exerted by VGAM415 gene, herein designated VGAM GENE, on one or more VGAM415 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM415 is inhibition of expression of host target genes, as part of a novel viral mechanism of attacking a host. Accordingly, utilities of VGAM415 include diagnosis, prevention and treatment of viral infection by Pepper Mottle Virus. Specific functions, and accordingly utilities, of VGAM415 correlate with, and may be deduced from, the identity of the host target genes which VGAM415 binds and inhibits, and the function of these target genes, as elaborated hereinbelow.

Nucleotide sequences of the VGAM415 precursor RNA, herein designated VGAM PRECURSOR RNA, and of the 'diced' VGAM415 RNA, herein designated VGAM RNA, and a schematic representation of the secondary folding of VGAM415 folded precursor RNA, herein designated VGAM FOLDED PRECURSOR RNA, of VGAM415 are further described hereinbelow with reference to Table 1.

Nucleotide sequences of host target binding sites, such as BINDING SITE-I, BINDING SITE-II and BINDING SITE-III of FIG. 1, found on VGAM415 host target RNA, and schematic representation of the complementarity of each of these host target binding sites to VGAM415 RNA, herein designated VGAM RNA, are described hereinbelow with reference to Table 2.

As mentioned hereinabove with reference to FIG. 1, a function of VGAM415 gene, herein designated VGAM is inhibition of expression of VGAM415 target genes. It is appreciated that specific functions, and accordingly utilities, of VGAM415 correlate with, and may be deduced from, the identity of the target genes which VGAM415 binds and inhibits, and the function of these target genes, as elaborated hereinbelow.

EGF-like-domain, Multiple 4 (EGFL4, Accession XM_029883) is a VGAM415 host target gene. EGFL4 BINDING SITE is HOST TARGET binding site found in the 3' untranslated region of mRNA encoded by EGFL4, corresponding to a HOST TARGET binding site such as BINDING SITE I, BINDING SITE II or BINDING SITE III. Table 2 illustrates the complementarity of the nucleotide sequences of EGFL4 BINDING SITE, designated SEQ ID:30962, to the nucleotide sequence of VGAM415 RNA, herein designated VGAM RNA, also designated SEQ ID:3126.

A function of VGAM415 is therefore inhibition of EGF-like-domain, Multiple 4 (EGFL4, Accession XM_029883). Accordingly, utilities of VGAM415 include diagnosis, prevention and treatment of diseases and clinical conditions associated with EGFL4. Neuronal Cell Adhesion Molecule (NRCAM, Accession NM_005010) is another VGAM415 host target gene. NRCAM BINDING SITE is HOST TARGET binding site found in the 3' untranslated region of mRNA encoded by NRCAM, corresponding to a HOST TARGET binding site such as BINDING SITE I, BINDING SITE II or BINDING SITE III. Table 2 illustrates the complementarity of the nucleotide sequences of NRCAM BINDING SITE, designated SEQ ID:11446, to the nucleotide sequence of VGAM415 RNA, herein designated VGAM RNA, also designated SEQ ID:3126.

Another function of VGAM415 is therefore inhibition of Neuronal Cell Adhesion Molecule (NRCAM, Accession NM_005010), a gene which functions as a cell surface protein and belongs to the immunoglobulin superfamily. Accordingly, utilities of VGAM415 include diagnosis, prevention and treatment of diseases and clinical conditions associated with NRCAM. The function of NRCAM and its association with various diseases and clinical conditions, has been established by previous studies, as described hereinabove with reference to VGAM268. ARPP-21 (Accession NM_016300) is another VGAM415 host target gene. ARPP-21 BINDING SITE is HOST TARGET binding site found in the 3' untranslated region of mRNA encoded by ARPP-21, corresponding to a HOST TARGET binding site such as BINDING SITE I, BINDING SITE II or BINDING SITE III. Table 2 illustrates the complementarity of the nucleotide sequences of ARPP-21 BINDING SITE, designated SEQ ID:18419, to the nucleotide sequence of VGAM415 RNA, herein designated VGAM RNA, also designated SEQ ID:3126.

Another function of VGAM415 is therefore inhibition of ARPP-21 (Accession NM_016300). Accordingly, utilities of VGAM415 include diagnosis, prevention and treatment of diseases and clinical conditions associated with ARPP-21. UDP-GlcNAc:betaGal Beta-1,3-N-acetylglucosaminyltransferase 7 (B3GNT7, Accession XM_048735) is another VGAM415 host target gene. B3GNT7 BINDING SITE is HOST TARGET binding site found in the 3' untranslated region of mRNA encoded by B3GNT7, corresponding to a HOST TARGET binding site such as BINDING SITE I, BINDING SITE II or BINDING SITE III. Table 2 illustrates the complementarity of the nucleotide sequences of B3GNT7

BINDING SITE, designated SEQ ID:35237, to the nucleotide sequence of VGAM415 RNA, herein designated VGAM RNA, also designated SEQ ID:3126.

Another function of VGAM415 is therefore inhibition of UDP-GlcNAc:betaGal Beta-1,3-N-acetylglucosaminyl-transferase 7 (B3GNT7, Accession XM_048735). Accordingly, utilities of VGAM415 include diagnosis, prevention and treatment of diseases and clinical conditions associated with B3GNT7. FLJ11722 (Accession NM_024970) is another VGAM415 host target gene. FLJ11722 BINDING SITE is HOST TARGET binding site found in the 3' untranslated region of mRNA encoded by FLJ11722, corresponding to a HOST TARGET binding site such as BINDING SITE I, BINDING SITE II or BINDING SITE III. Table 2 illustrates the complementarity of the nucleotide sequences of FLJ11722 BINDING SITE, designated SEQ ID:24519, to the nucleotide sequence of VGAM415 RNA, herein designated VGAM RNA, also designated SEQ ID:3126.

Another function of VGAM415 is therefore inhibition of FLJ11722 (Accession NM_024970). Accordingly, utilities of VGAM415 include diagnosis, prevention and treatment of diseases and clinical conditions associated with FLJ11722. FLJ20006 (Accession NM_017618) is another VGAM415 host target gene. FLJ20006 BINDING SITE is HOST TARGET binding site found in the 3' untranslated region of mRNA encoded by FLJ20006, corresponding to a HOST TARGET binding site such as BINDING SITE I, BINDING SITE II or BINDING SITE III. Table 2 illustrates the complementarity of the nucleotide sequences of FLJ20006 BINDING SITE, designated SEQ ID:19118, to the nucleotide sequence of VGAM415 RNA, herein designated VGAM RNA, also designated SEQ ID:3126.

Another function of VGAM415 is therefore inhibition of FLJ20006 (Accession NM_017618). Accordingly, utilities of VGAM415 include diagnosis, prevention and treatment of diseases and clinical conditions associated with FLJ20006. FLJ20958 (Accession NM_022102) is another VGAM415 host target gene. FLJ20958 BINDING SITE is HOST TARGET binding site found in the 3' untranslated region of mRNA encoded by FLJ20958, corresponding to a HOST TARGET binding site such as BINDING SITE I, BINDING SITE II or BINDING SITE III. Table 2 illustrates the complementarity of the nucleotide sequences of FLJ20958 BINDING SITE, designated SEQ ID:22645, to the nucleotide sequence of VGAM415 RNA, herein designated VGAM RNA, also designated SEQ ID:3126.

Another function of VGAM415 is therefore inhibition of FLJ20958 (Accession NM_022102). Accordingly, utilities of VGAM415 include diagnosis, prevention and treatment of diseases and clinical conditions associated with FLJ20958. GLTP (Accession NM_016433) is another VGAM415 host target gene. GLTP BINDING SITE is HOST TARGET binding site found in the 3" untranslated region of mRNA encoded by GLTP, corresponding to a HOST TARGET binding site such as BINDING SITE I, BINDING SITE II or BINDING SITE III. Table 2 illustrates the complementarity of the nucleotide sequences of GLTP BINDING SITE, designated SEQ ID:18554, to the nucleotide sequence of VGAM415 RNA, herein designated VGAM RNA, also designated SEQ ID:3126.

Another function of VGAM415 is therefore inhibition of GLTP (Accession NM_016433). Accordingly, utilities of VGAM415 include diagnosis, prevention and treatment of diseases and clinical conditions associated with GLTP. KIAA1001 (Accession NM_014960) is another VGAM415 host target gene. KIAA1001 BINDING SITE is HOST TARGET binding site found in the 3" untranslated region of mRNA encoded by KIAA1001, corresponding to a HOST TARGET binding site such as BINDING SITE I, BINDING SITE II or BINDING SITE III. Table 2 illustrates the complementarity of the nucleotide sequences of KIAA1001 BINDING SITE, designated SEQ ID:17323, to the nucleotide sequence of VGAM415 RNA, herein designated VGAM RNA, also designated SEQ ID:3126.

Another function of VGAM415 is therefore inhibition of KIAA1001 (Accession NM_014960). Accordingly, utilities of VGAM415 include diagnosis, prevention and treatment of diseases and clinical conditions associated with KIAA1001. KIAA1160 (Accession NM_020701) is another VGAM415 host target gene. KIAA1160 BINDING SITE is HOST TARGET binding site found in the 3' untranslated region of mRNA encoded by KIAA1160, corresponding to a HOST TARGET binding site such as BINDING SITE I, BINDING SITE II or BINDING SITE III. Table 2 illustrates the complementarity of the nucleotide sequences of KIAA1160 BINDING SITE, designated SEQ ID:21850, to the nucleotide sequence of VGAM415 RNA, herein designated VGAM RNA, also designated SEQ ID:3126.

Another function of VGAM415 is therefore inhibition of KIAA1160 (Accession NM_020701). Accordingly, utilities of VGAM415 include diagnosis, prevention and treatment of diseases and clinical conditions associated with KIAA1160. KIAA1430 (Accession XM_087593) is another VGAM415 host target gene. KIAA1430 BINDING SITE is HOST TARGET binding site found in the 3' untranslated region of mRNA encoded by KIAA1430, corresponding to a HOST TARGET binding site such as BINDING SITE I, BINDING SITE II or BINDING SITE III. Table 2 illustrates the complementarity of the nucleotide sequences of KIAA1430 BINDING SITE, designated SEQ ID:39356, to the nucleotide sequence of VGAM415 RNA, herein designated VGAM RNA, also designated SEQ ID:3126.

Another function of VGAM415 is therefore inhibition of KIAA1430 (Accession XM_087593). Accordingly, utilities of VGAM415 include diagnosis, prevention and treatment of diseases and clinical conditions associated with KIAA1430. LRP15 (Accession NM_052953) is another VGAM415 host target gene. LRP15 BINDING SITE is HOST TARGET binding site found in the 5' untranslated region of mRNA encoded by LRP15, corresponding to a HOST TARGET binding site such as BINDING SITE I, BINDING SITE II or BINDING SITE III. Table 2 illustrates the complementarity of the nucleotide sequences of LRP15 BINDING SITE, designated SEQ ID:27509, to the nucleotide sequence of VGAM415 RNA, herein designated VGAM RNA, also designated SEQ ID:3126.

Another function of VGAM415 is therefore inhibition of LRP15 (Accession NM_052953). Accordingly, utilities of VGAM415 include diagnosis, prevention and treatment of diseases and clinical conditions associated with LRP15. PTD002 (Accession NM_016144) is another VGAM415 host target gene. PTD002 BINDING SITE is HOST TARGET binding site found in the 3' untranslated region of mRNA encoded by PTD002, corresponding to a HOST TARGET binding site such as BINDING SITE I, BINDING SITE II or BINDING SITE III. Table 2 illustrates the complementarity of the nucleotide sequences of PTD002 BINDING SITE, designated SEQ ID:18227, to the nucleotide sequence of VGAM415 RNA, herein designated VGAM RNA, also designated SEQ ID:3126.

Another function of VGAM415 is therefore inhibition of PTD002 (Accession NM_016144). Accordingly, utilities of VGAM415 include diagnosis, prevention and treatment of diseases and clinical conditions associated with PTD002.

LOC120400 (Accession XM_061971) is another VGAM415 host target gene. LOC120400 BINDING SITE is HOST TARGET binding site found in the 5' untranslated region of mRNA encoded by LOC120400, corresponding to a HOST TARGET binding site such as BINDING SITE I, BINDING SITE II or BINDING SITE III. Table 2 illustrates the complementarity of the nucleotide sequences of LOC120400 BINDING SITE, designated SEQ ID:37219, to the nucleotide sequence of VGAM415 RNA, herein designated VGAM RNA, also designated SEQ ID:3126.

Another function of VGAM415 is therefore inhibition of LOC120400 (Accession XM_061971). Accordingly, utilities of VGAM415 include diagnosis, prevention and treatment of diseases and clinical conditions associated with LOC120400. LOC221399 (Accession XM_168134) is another VGAM415 host target gene. LOC221399 BINDING SITE is HOST TARGET binding site found in the 5' untranslated region of mRNA encoded by LOC221399, corresponding to a HOST TARGET binding site such as BINDING SITE I, BINDING SITE II or BINDING SITE III. Table 2 illustrates the complementarity of the nucleotide sequences of LOC221399 BINDING SITE, designated SEQ ID:45047, to the nucleotide sequence of VGAM415 RNA, herein designated VGAM RNA, also designated SEQ ID:3126.

Another function of VGAM415 is therefore inhibition of LOC221399 (Accession XM_168134). Accordingly, utilities of VGAM415 include diagnosis, prevention and treatment of diseases and clinical conditions associated with LOC221399. FIG. 1 further provides a conceptual description of a novel bioinformatically detected viral gene of the present invention, referred to here as Viral Genomic Address Messenger 416 (VGAM416) viral gene, which modulates expression of respective host target genes thereof, the function and utility of which host target genes is known in the art.

VGAM416 is a novel bioinformatically detected regulatory, non protein coding, viral micro RNA (miRNA) gene. The method by which VGAM416 was detected is described hereinabove with reference to FIGS. 1-8.

VGAM416 gene, herein designated VGAM GENE, is a viral gene contained in the genome of Pepper Mottle Virus. VGAM416 host target gene, herein designated VGAM HOST TARGET GENE, is a human gene contained in the human genome.

VGAM416 gene encodes a VGAM416 precursor RNA, herein designated VGAM PRECURSOR RNA. Similar to other miRNA genes, and unlike most ordinary genes, VGAM416 precursor RNA does not encode a protein. A nucleotide sequence identical or highly similar to the nucleotide sequence of VGAM416 precursor RNA is designated SEQ ID:402, and is provided hereinbelow with reference to the sequence listing part. Nucleotide sequence SEQ ID:402 is located at position 7262 relative to the genome of Pepper Mottle Virus.

VGAM416 precursor RNA folds onto itself, forming VGAM416 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM416 folded precursor RNA into VGAM416 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM416 RNA is designated SEQ ID:3127, and is provided hereinbelow with reference to the sequence listing part.

VGAM416 host target gene, herein designated VGAM HOST TARGET GENE, encodes a corresponding messenger RNA, VGAM416 host target RNA, herein designated VGAM HOST TARGET RNA. VGAM416 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM416 RNA, herein designated VGAM RNA, binds complementarily to one or more host target binding sites located in untranslated regions of VGAM416 host target RNA, herein designated VGAM HOST TARGET RNA. This complementary binding is due to the fact that the nucleotide sequence of VGAM416 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM416 RNA, herein designated VGAM RNA, may have a different number of host target binding sites in untranslated regions of a VGAM416 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM416 RNA, herein designated VGAM RNA, to host target binding sites on VGAM416 host target RNA, herein designated VGAM HOST TARGET RNA, such as BINDING SITE I, BINDING SITE II and BINDING SITE III, inhibits translation of VGAM416 host target RNA into VGAM416 host target protein, herein designated VGAM HOST TARGET PROTEIN. VGAM host target protein is therefore outlined by a broken line.

It is appreciated that VGAM416 host target gene, herein designated VGAM HOST TARGET GENE, in fact represents a plurality of VGAM416 host target genes. The mRNA of each one of this plurality of VGAM416 host target genes comprises one or more host target binding sites, each having a nucleotide sequence which is at least partly complementary to VGAM416 RNA, herein designated VGAM RNA, and which when bound by VGAM416 RNA causes inhibition of translation of respective one or more VGAM416 host target proteins.

It is further appreciated by one skilled in the art that the mode of translational inhibition illustrated by FIG. 1 with specific reference to translational inhibition exerted by VGAM416 gene, herein designated VGAM GENE, on one or more VGAM416 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM416 is inhibition of expression of host target genes, as part of a novel viral mechanism of attacking a host. Accordingly, utilities of VGAM416 include diagnosis, prevention and treatment of viral infection by Pepper Mottle Virus. Specific functions, and accordingly utilities, of VGAM416 correlate with, and may be deduced from, the identity of the host target genes which VGAM416 binds and inhibits, and the function of these host target genes, as elaborated hereinbelow.

Nucleotide sequences of the VGAM416 precursor RNA, herein designated VGAM PRECURSOR RNA, and of the 'diced' VGAM416 RNA, herein designated VGAM RNA, and a schematic representation of the secondary folding of VGAM416 folded precursor RNA, herein designated VGAM FOLDED PRECURSOR RNA, of VGAM416 are further described hereinbelow with reference to Table 1.

Nucleotide sequences of host target binding sites, such as BINDING SITE-I, BINDING SITE-II and BINDING SITE-III of FIG. 1, found on VGAM416 host target RNA, and schematic representation of the complementarity of each of these host target binding sites to VGAM416 RNA, herein designated VGAM RNA, are described hereinbelow with reference to Table 2.

As mentioned hereinabove with reference to FIG. 1, a function of VGAM416 gene, herein designated VGAM is inhibition of expression of VGAM416 target genes. It is appreciated that specific functions, and accordingly utilities, of VGAM416 correlate with, and may be deduced from, the identity of the target genes which VGAM416 binds and inhibits, and the function of these target genes, as elaborated hereinbelow.

Filamin B, Beta (actin binding protein 278) (FLNB, Accession XM_030806) is a VGAM416 host target gene. FLNB BINDING SITE is HOST TARGET binding site found in the 3' untranslated region of mRNA encoded by FLNB, corresponding to a HOST TARGET binding site such as BINDING SITE I, BINDING SITE II or BINDING SITE III. Table 2 illustrates the complementarity of the nucleotide sequences of FLNB BINDING SITE, designated SEQ ID:31139, to the nucleotide sequence of VGAM416 RNA, herein designated VGAM RNA, also designated SEQ ID:3127.

A function of VGAM416 is therefore inhibition of Filamin B, Beta (actin binding protein 278) (FLNB, Accession XM_030806), a gene which Filamin B, beta; binds actin, interacts with cytoplasmic domain of Ibalpha. Accordingly, utilities of VGAM416 include diagnosis, prevention and treatment of diseases and clinical conditions associated with FLNB. The function of FLNB has been established by previous studies. The platelet GpIb complex (see OMIM Ref. No. 138720) mediates the adherence of platelets at the site of vascular injury through the binding of GpIb-alpha (OMIM Ref. No. 231200) to subendothelial von Willebrand factor (VWF; 193400). In platelets, the GpIb complex is tightly bound to the actin cytoskeleton via an interaction of GpIb-alpha with ABP280 (filamin A; 300017). Using a yeast 2-hybrid screen with the cytoplasmic tail of GpIb-alpha as bait, Takafuta et al. (1998) isolated partial cDNAs encoding a novel filamin homolog that they designated beta-filamin. They used the partial cDNAs to screen a placenta library and recovered additional cDNAs corresponding to the entire beta-filamin coding region. Like ABP280, the predicted 2,602-amino acid protein contains an N-terminal actin-binding domain, a backbone of 24 tandem repeats, and 2 hinge regions. Excluding the unique first hinge region of beta-filamin, the sequences of beta-filamin and ABP280 are 70% identical. Antibodies against beta-filamin detected a 280-kD protein on Western blots of human umbilical vein endothelial cell (HUVEC) extracts and stained normal human endothelial cells in culture and in situ. Using antigen-capture ELISA, Takafuta et al. (1998) found that beta-filamin associates with GpIb-alpha in both platelets and HUVEC extracts. They determined that the GpIb-alpha-binding domain in beta-filamin is in repeats 17-20, a region that corresponds to the GpIb-alpha-binding domain in ABP280. Northern blot analysis revealed that beta-filamin is expressed as 2 approximately 9.5-kb mRNAs in many adult tissues. The 2 different transcripts appear to result from use of alternative polyadenylation signals. Takafuta et al. (1998) concluded that beta-filamin is a new member of the filamin family that may have significance for GpIb-alpha function in endothelial cells and platelets. Independently, Xu et al. (1998) isolated cDNAs encoding beta-filamin, which they referred to as ABP278. These authors also identified alternatively spliced mRNAs encoding ABP276, a beta-filamin isoform missing the first hinge region. RT-PCR analysis indicated that the 2 isoforms were expressed at different relative levels in various human tissues. The addition of thyroid-stimulating hormone (TSH; OMIM Ref. No. 188530) to cultured thyroid follicular cells induces rapid and profound disruption of actin microfilaments. Using serum from a Graves disease (OMIM Ref. No. 275000) patient, Leedman et al. (1993) identified a thyroid cDNA encoding TABP (truncated actin-binding protein), a predicted 195-amino acid protein with homology to the C terminus of ABP280. Both Xu et al. (1998) and Takafuta et al. (1998) considered TABP to be a truncated form of beta-filamin. Mutations in the presenilin genes PS1 (OMIM Ref. No. 104311) and PS2 (OMIM Ref. No. 600759) account for approximately 50% of early-onset familial Alzheimer disease (AD; 104300). Zhang et al. (1998) identified beta-filamin as filamin homolog 1 (FH1), a filamin-related protein that interacts with the loop regions of PS1 and PS2. A monoclonal antibody recognizing both ABP280 and FH1 bound to blood vessels and astrocytes in the normal brain. In the brains of AD patients, Zhang et al. (1998) observed staining also in neurofibrillary tangles, neuropil threads, and dystrophic neurites within some senile plaques. The authors stated that detection of these presenilin-interacting proteins in these brain structures suggests that ABP280 and FH1 may be involved in the development of AD and that interactions between presenilins and ABP280/FH1 may be functionally significant. Takafuta et al. (1998) noted that the FH1 sequence is identical to the C-terminal 291 amino acids of beta-filamin except for 2 residues, making it very likely that FH1 represents the C-terminal region of beta-filamin. By analysis of somatic cell hybrids, Zhang et al. (1998) mapped the FH1 gene to chromosome 3. Takafuta et al. (1998) refined the map position to 3p21.1-p14.3 based on inclusion of a previously mapped STS within the beta-filamin sequence. By FISH, Brocker et al. (1999) assigned the FLNB gene to 3p14.3. Chakarova et al. (2000) mapped FLNB to 3p14 by radiation hybrid analysis.

Full details of the abovementioned studies are described in the following publications, the disclosure of which are hereby incorporated by reference:

Brocker, F.; Bardenheuer, W.; Vieten, L.; Julicher, K.; Werner, N.; Marquitan, G.; Michael, D.; Opalka, B.; Schutte, J.: Assignment of human filamin gene FLNB to human chromosome band 3p14.3 and identification of YACs containing the complete FLNB transcribed region. Cytogenet. Cell Genet. 85:267-268, 1999; and Chakarova, C.; Wehnert, M. S.; Uhl, K.; Sakthivel, S.; Vosberg, H.-P.; van der Ven, P. F. M.; Furst, D. O.: Genomic structure and fine mapping of the two human filamin gene paralogues.

Further studies establishing the function and utilities of FLNB are found in John Hopkins OMIM database record ID 603381, and in sited publications numbered 7501, 750 and 5281-5282 listed in the bibliography section hereinbelow, which are also hereby incorporated by reference. LOC143310 (Accession XM_084485) is another VGAM416 host target gene. LOC143310 BINDING SITE is HOST TARGET binding site found in the 3' untranslated region of mRNA encoded by LOC143310, corresponding to a HOST TARGET binding site such as BINDING SITE I, BINDING SITE II or BINDING SITE III. Table 2 illustrates the complementarity of the nucleotide sequences of LOC143310 BINDING SITE, designated SEQ ID:37606, to the nucleotide sequence of VGAM416 RNA, herein designated VGAM RNA, also designated SEQ ID:3127.

Another function of VGAM416 is therefore inhibition of LOC143310 (Accession XM_084485). Accordingly, utilities of VGAM416 include diagnosis, prevention and treatment of diseases and clinical conditions associated with LOC143310. LOC92719 (Accession XM_046853) is another VGAM416 host target gene. LOC92719 BINDING SITE is HOST TARGET binding site found in the 3' untranslated region of mRNA encoded by LOC92719, corresponding to a HOST TARGET binding site such as BINDING SITE I, BINDING SITE II or BINDING SITE III. Table 2 illustrates the complementarity of the nucleotide sequences of LOC92719 BINDING SITE, designated SEQ ID:34847, to the nucleotide sequence of VGAM416 RNA, herein designated VGAM RNA, also designated SEQ ID:3127.

Another function of VGAM416 is therefore inhibition of LOC92719 (Accession XM_046853). Accordingly, utilities of VGAM416 include diagnosis, prevention and treatment of diseases and clinical conditions associated with LOC92719.

FIG. 1 further provides a conceptual description of a novel bioinformatically detected viral gene of the present invention, referred to here as Viral Genomic Address Messenger 417 (VGAM417) viral gene, which modulates expression of respective host target genes thereof, the function and utility of which host target genes is known in the art.

VGAM417 is a novel bioinformatically detected regulatory, non protein coding, viral micro RNA (miRNA) gene. The method by which VGAM417 was detected is described hereinabove with reference to FIGS. 1-8.

VGAM417 gene, herein designated VGAM GENE, is a viral gene contained in the genome of Pepper Mottle Virus. VGAM417 host target gene, herein designated VGAM HOST TARGET GENE, is a human gene contained in the human genome.

VGAM417 gene encodes a VGAM417 precursor RNA, herein designated VGAM PRECURSOR RNA. Similar to other miRNA genes, and unlike most ordinary genes, VGAM417 precursor RNA does not encode a protein. A nucleotide sequence identical or highly similar to the nucleotide sequence of VGAM417 precursor RNA is designated SEQ ID:403, and is provided hereinbelow with reference to the sequence listing part. Nucleotide sequence SEQ ID:403 is located at position 8444 relative to the genome of Pepper Mottle Virus.

VGAM417 precursor RNA folds onto itself, forming VGAM417 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM417 folded precursor RNA into VGAM417 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 47%) nucleotide sequence of VGAM417 RNA is designated SEQ ID:3128, and is provided hereinbelow with reference to the sequence listing part.

VGAM417 host target gene, herein designated VGAM HOST TARGET GENE, encodes a corresponding messenger RNA, VGAM417 host target RNA, herein designated VGAM HOST TARGET RNA. VGAM417 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM417 RNA, herein designated VGAM RNA, binds complementarily to one or more host target binding sites located in untranslated regions of VGAM417 host target RNA, herein designated VGAM HOST TARGET RNA. This complementary binding is due to the fact that the nucleotide sequence of VGAM417 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM417 RNA, herein designated VGAM RNA, may have a different number of host target binding sites in untranslated regions of a VGAM417 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM417 RNA, herein designated VGAM RNA, to host target binding sites on VGAM417 host target RNA, herein designated VGAM HOST TARGET RNA, such as BINDING SITE I, BINDING SITE II and BINDING SITE III, inhibits translation of VGAM417 host target RNA into VGAM417 host target protein, herein designated VGAM HOST TARGET PROTEIN. VGAM host target protein is therefore outlined by a broken line.

It is appreciated that VGAM417 host target gene, herein designated VGAM HOST TARGET GENE, in fact represents a plurality of VGAM417 host target genes. The mRNA of each one of this plurality of VGAM417 host target genes comprises one or more host target binding sites, each having a nucleotide sequence which is at least partly complementary to VGAM417 RNA, herein designated VGAM RNA, and which when bound by VGAM417 RNA causes inhibition of translation of respective one or more VGAM417 host target proteins.

It is further appreciated by one skilled in the art that the mode of translational inhibition illustrated by FIG. 1 with specific reference to translational inhibition exerted by VGAM417 gene, herein designated VGAM GENE, on one or more VGAM417 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM417 is inhibition of expression of host target genes, as part of a novel viral mechanism of attacking a host. Accordingly, utilities of VGAM417 include diagnosis, prevention and treatment of viral infection by Pepper Mottle Virus. Specific functions, and accordingly utilities, of VGAM417 correlate with, and may be deduced from, the identity of the host target genes which VGAM417 binds and inhibits, and the function of these host target genes, as elaborated hereinbelow.

Nucleotide sequences of the VGAM417 precursor RNA, herein designated VGAM PRECURSOR RNA, and of the 'diced' VGAM417 RNA, herein designated VGAM RNA, and a schematic representation of the secondary folding of VGAM417 folded precursor RNA, herein designated VGAM FOLDED PRECURSOR RNA, of VGAM417 are further described hereinbelow with reference to Table 1.

Nucleotide sequences of host target binding sites, such as BINDING SITE-I, BINDING SITE-II and BINDING SITE-III of FIG. 1, found on VGAM417 host target RNA, and schematic representation of the complementarity of each of these host target binding sites to VGAM417 RNA, herein designated VGAM RNA, are described hereinbelow with reference to Table 2.

As mentioned hereinabove with reference to FIG. 1, a function of VGAM417 gene, herein designated VGAM is inhibition of expression of VGAM417 target genes. It is appreciated that specific functions, and accordingly utilities, of VGAM417 correlate with, and may be deduced from, the identity of the target genes which VGAM417 binds and inhibits, and the function of these target genes, as elaborated hereinbelow.

Calpain 10 (CAPN10, Accession NM_023089) is a VGAM417 host target gene. CAPN10 BINDING SITE1 and CAPN10 BINDING SITE2 are HOST TARGET binding sites found in untranslated regions of mRNA encoded by CAPN10, corresponding to HOST TARGET binding sites such as BINDING SITE I, BINDING SITE II or BINDING SITE III. Table 2 illustrates the complementarity of the nucleotide sequences of CAPN10 BINDING SITE1 and CAPN10 BINDING SITE2, designated SEQ ID:23358 and SEQ ID:23357 respectively, to the nucleotide sequence of VGAM417 RNA, herein designated VGAM RNA, also designated SEQ ID:3128.

A function of VGAM417 is therefore inhibition of Calpain 10 (CAPN10, Accession NM_023089), a gene which catalyzes limited proteolysis of substrates involved in cytoskeletal remodelling and signal tranduction. Accordingly, utilities of VGAM417 include diagnosis, prevention and treatment of diseases and clinical conditions associated with CAPN10. The function of CAPN10 and its association with various diseases and clinical conditions, has been established by previous studies, as described hereinabove with reference to VGAM247. RAB11A, Member RAS Oncogene Family (RAB11A, Accession NM_004663) is another VGAM417 host target gene. RAB11A BINDING SITE is HOST TARGET binding site found in the 3' untranslated region of mRNA encoded by RAB11A, corresponding to a HOST TARGET binding site such as BINDING SITE I, BINDING SITE II or BINDING SITE III. Table 2 illustrates the complementarity of the nucleotide sequences of RAB11A BINDING SITE, designated SEQ ID:11033, to the nucleotide sequence of VGAM417 RNA, herein designated VGAM RNA, also designated SEQ ID:3128.

Another function of VGAM417 is therefore inhibition of RAB11A, Member RAS Oncogene Family (RAB11A, Accession NM_004663). Accordingly, utilities of VGAM417 include diagnosis, prevention and treatment of diseases and clinical conditions associated with RAB11A. DEAD/H (Asp-Glu-Ala-Asp/His) Box Polypeptide 28 (DDX28, Accession NM_018380) is another VGAM417 host target gene. DDX28 BINDING SITE is HOST TARGET binding site found in the 5' untranslated region of mRNA encoded by DDX28, corresponding to a HOST TARGET binding site such as BINDING SITE I, BINDING SITE II or BINDING SITE III. Table 2 illustrates the complementarity of the nucleotide sequences of DDX28 BINDING SITE, designated SEQ ID:20407, to the nucleotide sequence of VGAM417 RNA, herein designated VGAM RNA, also designated SEQ ID:3128.

Another function of VGAM417 is therefore inhibition of DEAD/H (Asp-Glu-Ala-Asp/His) Box Polypeptide 28 (DDX28, Accession NM_018380). Accordingly, utilities of VGAM417 include diagnosis, prevention and treatment of diseases and clinical conditions associated with DDX28. FLJ11608 (Accession NM_024557) is another VGAM417 host target gene. FLJ11608 BINDING SITE is HOST TARGET binding site found in the 3" untranslated region of mRNA encoded by FLJ11608, corresponding to a HOST TARGET binding site such as BINDING SITE I, BINDING SITE II or BINDING SITE III. Table 2 illustrates the complementarity of the nucleotide sequences of FLJ11608 BINDING SITE, designated SEQ ID:23775, to the nucleotide sequence of VGAM417 RNA, herein designated VGAM RNA, also designated SEQ ID:3128.

Another function of VGAM417 is therefore inhibition of FLJ11608 (Accession NM_024557). Accordingly, utilities of VGAM417 include diagnosis, prevention and treatment of diseases and clinical conditions associated with FLJ11608. HGC6.1.1 (Accession NM_014354) is another VGAM417 host target gene. HGC6.1.1 BINDING SITE is HOST TARGET binding site found in the 3' untranslated region of mRNA encoded by HGC6.1.1, corresponding to a HOST TARGET binding site such as BINDING SITE I, BINDING SITE II or BINDING SITE III. Table 2 illustrates the complementarity of the nucleotide sequences of HGC6.1.1 BINDING SITE, designated SEQ ID:15683, to the nucleotide sequence of VGAM417 RNA, herein designated VGAM RNA, also designated SEQ ID:3128.

Another function of VGAM417 is therefore inhibition of HGC6.1.1 (Accession NM_014354). Accordingly, utilities of VGAM417 include diagnosis, prevention and treatment of diseases and clinical conditions associated with HGC6.1.1. KIAA0417 (Accession XM_048898) is another VGAM417 host target gene. KIAA0417 BINDING SITE is HOST TARGET binding site found in the 3' untranslated region of mRNA encoded by KIAA0417, corresponding to a HOST TARGET binding site such as BINDING SITE I, BINDING SITE II or BINDING SITE III. Table 2 illustrates the complementarity of the nucleotide sequences of KIAA0417 BINDING SITE, designated SEQ ID:35293, to the nucleotide sequence of VGAM417 RNA, herein designated VGAM RNA, also designated SEQ ID:3128.

Another function of VGAM417 is therefore inhibition of KIAA0417 (Accession XM_048898). Accordingly, utilities of VGAM417 include diagnosis, prevention and treatment of diseases and clinical conditions associated with KIAA0417. KIAA0766 (Accession NM_014805) is another VGAM417 host target gene. KIAA0766 BINDING SITE is HOST TARGET binding site found in the 3' untranslated region of mRNA encoded by KIAA0766, corresponding to a HOST TARGET binding site such as BINDING SITE I, BINDING SITE II or BINDING SITE III. Table 2 illustrates the complementarity of the nucleotide sequences of KIAA0766 BINDING SITE, designated SEQ ID:16742, to the nucleotide sequence of VGAM417 RNA, herein designated VGAM RNA, also designated SEQ ID:3128.

Another function of VGAM417 is therefore inhibition of KIAA0766 (Accession NM_014805). Accordingly, utilities of VGAM417 include diagnosis, prevention and treatment of diseases and clinical conditions associated with KIAA0766. LOC146733 (Accession XM_097076) is another VGAM417 host target gene. LOC146733 BINDING SITE is HOST TARGET binding site found in the 5' untranslated region of mRNA encoded by LOC146733, corresponding to a HOST TARGET binding site such as BINDING SITE I, BINDING SITE II or BINDING SITE III. Table 2 illustrates the complementarity of the nucleotide sequences of LOC146733 BINDING SITE, designated SEQ ID:40726, to the nucleotide sequence of VGAM417 RNA, herein designated VGAM RNA, also designated SEQ ID:3128.

Another function of VGAM417 is therefore inhibition of LOC146733 (Accession XM_097076). Accordingly, utilities of VGAM417 include diagnosis, prevention and treatment of diseases and clinical conditions associated with LOC146733. LOC254431 (Accession XM_173024) is another VGAM417 host target gene. LOC254431 BINDING SITE is HOST TARGET binding site found in the 5' untranslated region of mRNA encoded by LOC254431, corresponding to a HOST TARGET binding site such as BINDING SITE I, BINDING SITE II or BINDING SITE III. Table 2 illustrates the complementarity of the nucleotide sequences of LOC254431 BINDING SITE, designated SEQ ID:46289, to the nucleotide sequence of VGAM417 RNA, herein designated VGAM RNA, also designated SEQ ID:3128.

Another function of VGAM417 is therefore inhibition of LOC254431 (Accession XM_173024). Accordingly, utilities of VGAM417 include diagnosis, prevention and treatment of diseases and clinical conditions associated with LOC254431. LOC92539 (Accession XM_045632) is another VGAM417 host target gene. LOC92539 BINDING SITE is HOST TARGET binding site found in the 5' untranslated region of mRNA encoded by LOC92539, corresponding to a HOST TARGET binding site such as BINDING SITE I, BINDING SITE II or BINDING SITE III. Table 2 illustrates the complementarity of the nucleotide sequences of LOC92539 BINDING SITE, designated SEQ ID:34498, to the nucleotide sequence of VGAM417 RNA, herein designated VGAM RNA, also designated SEQ ID:3128.

Another function of VGAM417 is therefore inhibition of LOC92539 (Accession XM_045632). Accordingly, utilities of VGAM417 include diagnosis, prevention and treatment of diseases and clinical conditions associated with LOC92539. FIG. 1 further provides a conceptual description of a novel bioinformatically detected viral gene of the present invention, referred to here as Viral Genomic Address Messenger 418 (VGAM418) viral gene, which modulates expression of respective host target genes thereof, the function and utility of which host target genes is known in the art.

VGAM418 is a novel bioinformatically detected regulatory, non protein coding, viral micro RNA (miRNA) gene. The method by which VGAM418 was detected is described hereinabove with reference to FIGS. 1-8.

VGAM418 gene, herein designated VGAM GENE, is a viral gene contained in the genome of Pepper Mottle Virus. VGAM418 host target gene, herein designated VGAM HOST TARGET GENE, is a human gene contained in the human genome.

VGAM418 gene encodes a VGAM418 precursor RNA, herein designated VGAM PRECURSOR RNA. Similar to other miRNA genes, and unlike most ordinary genes, VGAM418 precursor RNA does not encode a protein. A nucleotide sequence identical or highly similar to the nucleotide sequence of VGAM418 precursor RNA is designated SEQ ID:404, and is provided hereinbelow with reference to the sequence listing part. Nucleotide sequence SEQ ID:404 is located at position 4033 relative to the genome of Pepper Mottle Virus.

VGAM418 precursor RNA folds onto itself, forming VGAM418 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM418 folded precursor RNA into VGAM418 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM418 RNA is designated SEQ ID:3129, and is provided hereinbelow with reference to the sequence listing part.

VGAM418 host target gene, herein designated VGAM HOST TARGET GENE, encodes a corresponding messenger RNA, VGAM418 host target RNA, herein designated VGAM HOST TARGET RNA. VGAM418 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM418 RNA, herein designated VGAM RNA, binds complementarily to one or more host target binding sites located in untranslated regions of VGAM418 host target RNA, herein designated VGAM HOST TARGET RNA. This complementary binding is due to the fact that the nucleotide sequence of VGAM418 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM418 RNA, herein designated VGAM RNA, may have a different number of host target binding sites in untranslated regions of a VGAM418 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM418 RNA, herein designated VGAM RNA, to host target binding sites on VGAM418 host target RNA, herein designated VGAM HOST TARGET RNA, such as BINDING SITE I, BINDING SITE II and BINDING SITE III, inhibits translation of VGAM418 host target RNA into VGAM418 host target protein, herein designated VGAM HOST TARGET PROTEIN. VGAM host target protein is therefore outlined by a broken line.

It is appreciated that VGAM418 host target gene, herein designated VGAM HOST TARGET GENE, in fact represents a plurality of VGAM418 host target genes. The mRNA of each one of this plurality of VGAM418 host target genes comprises one or more host target binding sites, each having a nucleotide sequence which is at least partly complementary to VGAM418 RNA, herein designated VGAM RNA, and which when bound by VGAM418 RNA causes inhibition of translation of respective one or more VGAM418 host target proteins.

It is further appreciated by one skilled in the art that the mode of translational inhibition illustrated by FIG. 1 with specific reference to translational inhibition exerted by VGAM418 gene, herein designated VGAM GENE, on one or more VGAM418 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM418 is inhibition of expression of host target genes, as part of a novel viral mechanism of attacking a host. Accordingly, utilities of VGAM418 include diagnosis, prevention and treatment of viral infection by Pepper Mottle Virus. Specific functions, and accordingly utilities, of VGAM418 correlate with, and may be deduced from, the identity of the host target genes which VGAM418 binds and inhibits, and the function of these host target genes, as elaborated hereinbelow.

Nucleotide sequences of the VGAM418 precursor RNA, herein designated VGAM PRECURSOR RNA, and of the 'diced' VGAM418 RNA, herein designated VGAM RNA, and a schematic representation of the secondary folding of VGAM418 folded precursor RNA, herein designated VGAM FOLDED PRECURSOR RNA, of VGAM418 are further described hereinbelow with reference to Table 1.

Nucleotide sequences of host target binding sites, such as BINDING SITE-I, BINDING SITE-II and BINDING SITE-III of FIG. 1, found on VGAM418 host target RNA, and schematic representation of the complementarity of each of these host target binding sites to VGAM418 RNA, herein designated VGAM RNA, are described hereinbelow with reference to Table 2.

As mentioned hereinabove with reference to FIG. 1, a function of VGAM418 gene, herein designated VGAM is inhibition of expression of VGAM418 target genes. It is appreciated that specific functions, and accordingly utilities, of VGAM418 correlate with, and may be deduced from, the identity of the target genes which VGAM418 binds and inhibits, and the function of these target genes, as elaborated hereinbelow.

Lymphocyte Cytosolic Protein 1 (L-plastin) (LCP1, Accession NM_002298) is a VGAM418 host target gene. LCP1 BINDING SITE is HOST TARGET binding site found in the 3' untranslated region of mRNA encoded by LCP1, corresponding to a HOST TARGET binding site such as BINDING SITE I, BINDING SITE II or BINDING SITE III. Table 2 illustrates the complementarity of the nucleotide sequences of LCP1 BINDING SITE, designated SEQ ID:8082, to the nucleotide sequence of VGAM418 RNA, herein designated VGAM RNA, also designated SEQ ID:3129.

A function of VGAM418 is therefore inhibition of Lymphocyte Cytosolic Protein 1 (L-plastin) (LCP1, Accession NM_002298), a gene which is involved in t cell antigen receptor mediated signaling. Accordingly, utilities of VGAM418 include diagnosis, prevention and treatment of diseases and clinical conditions associated with LCP1. The function of LCP1 has been established by previous studies. Hamaguchi et al. (1982) described a genetic polymorphism of a major human lymphocyte cytosolic protein (LCP) of molecular weight 64,000, detected in PHA-stimulated peripheral blood lymphocytes by high-resolution 2-dimensional electrophoresis (O'Farrell, 1975; Klose, 1975). Three different phenotypes determined by 2 common alleles at a single locus were found. In Japanese, the frequency of the 2 alleles was 0.936 and 0.064, respectively. The polypeptide was not detected in HeLa cells, fibroblasts, red cells, serum, or cerebrum. Traces were found in liver, kidney and skeletal muscle. (Hamaguchi et al. (1982) demonstrated polymorphism in 3 others of about 100 polypeptides. The 4 were all cytosolic and since they were separated by isoelectric focusing, they are all charge variants. The molecular weights of the 3 other polymorphic lymphocyte cytosol polypeptides were 40, 49, and 100 kD; see 174880. This stands in contrast to the restricted genetic variability in fibroblast polypeptides (Walton et al., 1979; McConkey et al., 1979; Giometti and Anderson, 1981).) Data on gene frequencies of allelic variants were tabulated by Roychoudhury and Nei (1988). Kondo et al. (1985) assigned the LCP1 gene to 13q14.1-q14.2 by the deletion/dosage method. They studied a patient with trisomy 13 who had 1.5 times the normal amount of protein, a patient with retinoblastoma and deletion of 13q12.3-q21.2 who had half the normal amount of protein, and a patient with retinoblastoma and deletion of 13q14.1-q31.2 who had lost the father's allele and had half the normal amount of protein (Kondo et al., 1985). Close linkage to ESD (OMIM Ref. No. 133280) was indicated by a maximum lod score of 4.221 at zero recombination. As part of an undertaking to map by genetic linkage human lymphocyte proteins that are genetically polymorphic in isoelectric point, Goldman et al. (1991) mapped the LCP1 gene to a site near the ESD locus on chromosome 13 by studies in 9 families from the CEPH collection. The proteins in the immortalized lymphocyte cell lines were analyzed by 2-dimensional electrophoresis. Murayama et al. (1993) demonstrated that L-plastin and LCP1 are identical and mapped the gene to 13q14.3. Lin et al. (1988) isolated partial cDNAs encoding L-plastin and T-plastin (OMIM Ref. No. 300131) from a transformed human fibroblast cDNA library. Northern blot analysis revealed that L-plastin is expressed as a 3.7-kb mRNA in leukocytes, transformed fibroblasts, and a diverse array of human tumor cell lines. Zu et al. (1990) reported that L-plastin is identical to p65, an interleukin-2 (IL2; 147680)-stimulated phosphoprotein found in human T cells. Zu et al. (1990) isolated p65 cDNAs from a human T-lymphocyte cDNA library. The predicted 627-amino acid p65 protein contains 2 EF-hand calcium-binding domains, a calmodulin-binding site, and 2 tandem repeats of an actin-binding domain. Lin et al. (1993) reported that both the L-plastin and T-plastin genes contain 16 exons and span approximately 90 kb. Lin et al. (1997) found that the human and murine L-plastin promoters are highly homologous and function equally well in either human or murine leukocytes. The LAZ3 gene (BCL6; 109565) on 3q27 is nonrandomly disrupted in B-cell non-Hodgkin lymphoma by chromosomal translocations. Galiegue-Zouitina et al. (1999) identified the L-plastin gene as a novel LAZ3 partner in chimeric transcripts resulting from a t (3;13)(q27; q14) translocation in 2 cases of B-cell lymphoma. As a consequence of the translocation, the 5-prime regulatory region of each gene was exchanged, creating both LCP1-LAZ3 and reciprocal LAZ3-LCP1 fusion transcripts in one case, and only an LCP1-LAZ3 fusion transcript in the other.

Full details of the abovementioned studies are described in the following publications, the disclosure of which are hereby incorporated by reference:

Galiegue-Zouitina, S.; Quief, S.; Hildebrand, M.-P.; Denis, C.; Detourmignies, L.; Lai, J.-L.; Kerckaert, J.-P.: Nonrandom fusion of L-plastin (LCP1) and LAZ3 (BCL6) genes by t (3;13)(q27; q14) chromosome translocation in two cases of B-cell non-Hodgkin lymphoma. Genes Chromosomes Cancer 26:97-105, 1999; and Lin, C.-S.; Park, T.; Chen, Z. P.; Leavitt, J.: Human plastin genes: comparative gene structure, chromosome location, and differential expression in normal and neoplastic cells. J. Bi.

Further studies establishing the function and utilities of LCP1 are found in John Hopkins OMIM database record ID 153430, and in sited publications numbered 607-608, 3850-616, 652-658, 1165 and 3780-662 listed in the bibliography section hereinbelow, which are also hereby incorporated by reference. SON DNA Binding Protein (SON, Accession NM_058183) is another VGAM418 host target gene. SON BINDING SITE1 and SON BINDING SITE2 are HOST TARGET binding sites found in untranslated regions of mRNA encoded by SON, corresponding to HOST TARGET binding sites such as BINDING SITE I, BINDING SITE II or BINDING SITE III. Table 2 illustrates the complementarity of the nucleotide sequences of SON BINDING SITE1 and SON BINDING SITE2, designated SEQ ID:27745 and SEQ ID:29041 respectively, to the nucleotide sequence of VGAM418 RNA, herein designated VGAM RNA, also designated SEQ ID:3129.

Another function of VGAM418 is therefore inhibition of SON DNA Binding Protein (SON, Accession NM_058183). Accordingly, utilities of VGAM418 include diagnosis, prevention and treatment of diseases and clinical conditions associated with SON. SH3 Domain Binding Glutamic Acid-rich Protein Like 2 (SH3BGRL2, Accession NM_031469) is another VGAM418 host target gene. SH3BGRL2 BINDING SITE is HOST TARGET binding site found in the 3' untranslated region of mRNA encoded by SH3BGRL2, corresponding to a HOST TARGET binding site such as BINDING SITE I, BINDING SITE II or BINDING SITE III. Table 2 illustrates the complementarity of the nucleotide sequences of SH3BGRL2 BINDING SITE, designated SEQ ID:25531, to the nucleotide sequence of VGAM418 RNA, herein designated VGAM RNA, also designated SEQ ID:3129.

Another function of VGAM418 is therefore inhibition of SH3 Domain Binding Glutamic Acid-rich Protein Like 2 (SH3BGRL2, Accession NM_031469). Accordingly, utilities of VGAM418 include diagnosis, prevention and treatment of diseases and clinical conditions associated with SH3BGRL2. LOC138389 (Accession XM_072534) is another VGAM418 host target gene. LOC138389 BINDING SITE is HOST TARGET binding site found in the 5' untranslated region of mRNA encoded by LOC138389, corresponding to a HOST TARGET binding site such as BINDING SITE I, BINDING SITE II or BINDING SITE III. Table 2 illustrates the complementarity of the nucleotide sequences of LOC138389 BINDING SITE, designated SEQ ID:37504, to the nucleotide sequence of VGAM418 RNA, herein designated VGAM RNA, also designated SEQ ID:3129.

Another function of VGAM418 is therefore inhibition of LOC138389 (Accession XM_072534). Accordingly, utilities of VGAM418 include diagnosis, prevention and treatment of diseases and clinical conditions associated with LOC138389. LOC90246 (Accession XM_030283) is another VGAM418 host target gene. LOC90246 BINDING SITE is HOST TARGET binding site found in the 3' untranslated region of mRNA encoded by LOC90246, corresponding to a HOST TARGET binding site such as BINDING SITE I, BINDING SITE II or BINDING SITE III. Table 2 illustrates the complementarity of the nucleotide sequences of LOC90246 BINDING SITE, designated SEQ ID:30999, to the nucleotide sequence of VGAM418 RNA, herein designated VGAM RNA, also designated SEQ ID:3129.

Another function of VGAM418 is therefore inhibition of LOC90246 (Accession XM_030283). Accordingly, utilities of VGAM418 include diagnosis, prevention and treatment of diseases and clinical conditions associated with LOC90246. FIG. 1 further provides a conceptual description of a novel bioinformatically detected viral gene of the present invention, referred to here as Viral Genomic Address Messenger 419 (VGAM419) viral gene, which modulates expression of respective host target genes thereof, the function and utility of which host target genes is known in the art.

VGAM419 is a novel bioinformatically detected regulatory, non protein coding, viral micro RNA (miRNA) gene. The method by which VGAM419 was detected is described hereinabove with reference to FIGS. 1-8.

VGAM419 gene, herein designated VGAM GENE, is a viral gene contained in the genome of Pepper Mottle Virus. VGAM419 host target gene, herein designated VGAM HOST TARGET GENE, is a human gene contained in the human genome.

VGAM419 gene encodes a VGAM419 precursor RNA, herein designated VGAM PRECURSOR RNA. Similar to other miRNA genes, and unlike most ordinary genes, VGAM419 precursor RNA does not encode a protein. A nucleotide sequence identical or highly similar to the nucleotide sequence of VGAM419 precursor RNA is designated SEQ ID:405, and is provided hereinbelow with reference to the sequence listing part. Nucleotide sequence SEQ ID:405 is located at position 6952 relative to the genome of Pepper Mottle Virus.

VGAM419 precursor RNA folds onto itself, forming VGAM419 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM419 folded precursor RNA into VGAM419 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM419 RNA is designated SEQ ID:3130, and is provided hereinbelow with reference to the sequence listing part.

VGAM419 host target gene, herein designated VGAM HOST TARGET GENE, encodes a corresponding messenger RNA, VGAM419 host target RNA, herein designated VGAM HOST TARGET RNA. VGAM419 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM419 RNA, herein designated VGAM RNA, binds complementarily to one or more host target binding sites located in untranslated regions of VGAM419 host target RNA, herein designated VGAM HOST TARGET RNA. This complementary binding is due to the fact that the nucleotide sequence of VGAM419 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM419 RNA, herein designated VGAM RNA, may have a different number of host target binding sites in untranslated regions of a VGAM419 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM419 RNA, herein designated VGAM RNA, to host target binding sites on VGAM419 host target RNA, herein designated VGAM HOST TARGET RNA, such as BINDING SITE I, BINDING SITE II and BINDING SITE III, inhibits translation of VGAM419 host target RNA into VGAM419 host target protein, herein designated VGAM HOST TARGET PROTEIN. VGAM host target protein is therefore outlined by a broken line.

It is appreciated that VGAM419 host target gene, herein designated VGAM HOST TARGET GENE, in fact represents a plurality of VGAM419 host target genes. The mRNA of each one of this plurality of VGAM419 host target genes comprises one or more host target binding sites, each having a nucleotide sequence which is at least partly complementary to VGAM419 RNA, herein designated VGAM RNA, and which when bound by VGAM419 RNA causes inhibition of translation of respective one or more VGAM419 host target proteins.

It is further appreciated by one skilled in the art that the mode of translational inhibition illustrated by FIG. 1 with specific reference to translational inhibition exerted by VGAM419 gene, herein designated VGAM GENE, on one or more VGAM419 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM419 is inhibition of expression of host target genes, as part of a novel viral mechanism of attacking a host. Accordingly, utilities of VGAM419 include diagnosis, prevention and treatment of viral infection by Pepper Mottle Virus. Specific functions, and accordingly utilities, of VGAM419 correlate with, and may be deduced from, the identity of the host target genes which VGAM419 binds and inhibits, and the function of these host target genes, as elaborated hereinbelow.

Nucleotide sequences of the VGAM419 precursor RNA, herein designated VGAM PRECURSOR RNA, and of the 'diced' VGAM419 RNA, herein designated VGAM RNA, and a schematic representation of the secondary folding of VGAM419 folded precursor RNA, herein designated VGAM FOLDED PRECURSOR RNA, of VGAM419 are further described hereinbelow with reference to Table 1.

Nucleotide sequences of host target binding sites, such as BINDING SITE-I, BINDING SITE-II and BINDING SITE-III of FIG. 1, found on VGAM419 host target RNA, and schematic representation of the complementarity of each of these host target binding sites to VGAM419 RNA, herein designated VGAM RNA, are described hereinbelow with reference to Table 2.

As mentioned hereinabove with reference to FIG. 1, a function of VGAM419 gene, herein designated VGAM is inhibition of expression of VGAM419 target genes. It is appreciated that specific functions, and accordingly utilities, of VGAM419 correlate with, and may be deduced from, the identity of the target genes which VGAM419 binds and inhibits, and the function of these target genes, as elaborated hereinbelow.

AXL Receptor Tyrosine Kinase (AXL, Accession NM_021913) is a VGAM419 host target gene. AXL BINDING SITE1 and AXL BINDING SITE2 are HOST TARGET binding sites found in untranslated regions of mRNA encoded by AXL, corresponding to HOST TARGET binding sites such as BINDING SITE I, BINDING SITE II or BINDING SITE III. Table 2 illustrates the complementarity of the nucleotide sequences of AXL BINDING SITE1 and AXL BINDING SITE2, designated SEQ ID:22442 and SEQ ID:7421 respectively, to the nucleotide sequence of VGAM419 RNA, herein designated VGAM RNA, also designated SEQ ID:3130.

A function of VGAM419 is therefore inhibition of AXL Receptor Tyrosine Kinase (AXL, Accession NM_021913). Accordingly, utilities of VGAM419 include diagnosis, prevention and treatment of diseases and clinical conditions associated with AXL. Betaine-homocysteine Methyltransferase 2 (BHMT2, Accession NM_017614) is another VGAM419 host target gene. BHMT2 BINDING SITE is HOST TARGET binding site found in the 3' untranslated region of mRNA encoded by BHMT2, corresponding to a HOST TARGET binding site such as BINDING SITE I, BINDING SITE II or BINDING SITE III. Table 2 illustrates the complementarity of the nucleotide sequences of BHMT2 BINDING SITE, designated SEQ ID:19117, to the nucleotide sequence of VGAM419 RNA, herein designated VGAM RNA, also designated SEQ ID:3130.

Another function of VGAM419 is therefore inhibition of Betaine-homocysteine Methyltransferase 2 (BHMT2, Accession NM_017614). Accordingly, utilities of VGAM419 include diagnosis, prevention and treatment of diseases and clinical conditions associated with BHMT2. Carbohydrate Kinase-like (CARKL, Accession NM_013276) is another VGAM419 host target gene. CARKL BINDING SITE is HOST TARGET binding site found in the 3' untranslated region of mRNA encoded by CARKL, corresponding to a HOST TARGET binding site such as BINDING SITE I, BINDING SITE II or BINDING SITE III. Table 2 illustrates the complementarity of the nucleotide sequences of CARKL BINDING SITE, designated SEQ ID:14940, to the nucleotide sequence of VGAM419 RNA, herein designated VGAM RNA, also designated SEQ ID:3130.

Another function of VGAM419 is therefore inhibition of Carbohydrate Kinase-like (CARKL, Accession NM_013276), a gene which is a putative carbohydrate kinase and may be a modifier for the cystinosis phenotype. Accordingly, utilities of VGAM419 include diagnosis, prevention and treatment of diseases and clinical conditions associated with CARKL. The function of CARKL has been established by previous studies. Touchman et al. (2000) sequenced 200 kb surrounding the gene encoding cystinosin (CTNS; 606272), which is mutated in nephropathic cystinosis (OMIM Ref. No. 219800), on chromosome 17p13. They found that genomic sequence in this region matched known ESTs. Using PCR primers to amplify a human fetal kidney cDNA library, the authors cloned a cDNA, which they designated CARKL (carbohydrate kinase-like), encoding a deduced 478-amino acid protein. The CARKL protein contains motifs showing weak similarity to 2 domains of the FGGY family of carbohydrate kinases. It does not appear to contain a signal sequence, suggesting that it is localized in the cytoplasm. Northern blot analysis detected expression of a 3.9-kb CARKL transcript predominantly in liver, kidney, and pancreas, with weaker expression in heart, placenta, brain, and lung. Additionally, a 2.7-kb transcript was detected in liver and, to a lesser extent, in heart. By sequence analysis, Touchman et al. (2000) determined that the CARKL gene maps within the telomeric end of a 57-kb segment on 17p13 that is commonly deleted in cystinosis. They hypothesized that CARKL may be a modifier for the cystinosis phenotype.

Full details of the abovementioned studies are described in the following publications, the disclosure of which are hereby incorporated by reference:

Touchman, J. W.; Anikster, Y.; Dietrich, N. L.; Braden Maduro, V. V.; McDowell, G.; Shotelersuk, V.; Bouffard, G. G.; Beckstrom-Sternberg, S. M.; Gahl, W. A.; Green, E. D.: The genomic region encompassing the nephropathic cystinosis gene (CTNS): complete sequencing of a 200-kb segment and discovery of a novel gene within the common cystinosis-causing deletion. Genome Res. 10:165-173, 2000; and Phornphutkul, C.; Anikster, Y.; Huizing, M.; Braun, P.; Brodie, C.; Chou, J. Y.; Gahl, W. A.: The promoter of a lysosomal membrane transporter gene, CTNS, binds Sp-1, shares sequences.

Further studies establishing the function and utilities of CARKL are found in John Hopkins OMIM database record ID 605060, and in sited publications numbered 503 and 9434 listed in the bibliography section hereinbelow, which are also hereby incorporated by reference. Glutaminase (GLS, Accession NM_014905) is another VGAM419 host target gene. GLS BINDING SITE is HOST TARGET binding site found in the 3' untranslated region of mRNA encoded by GLS, corresponding to a HOST TARGET binding site such as BINDING SITE I, BINDING SITE II or BINDING SITE III. Table 2 illustrates the complementarity of the nucleotide sequences of GLS BINDING SITE, designated SEQ ID:17112, to the nucleotide sequence of VGAM419 RNA, herein designated VGAM RNA, also designated SEQ ID:3130.

Another function of VGAM419 is therefore inhibition of Glutaminase (GLS, Accession NM_014905). Accordingly, utilities of VGAM419 include diagnosis, prevention and treatment of diseases and clinical conditions associated with GLS. Potassium Voltage-gated Channel, Delayed-rectifier, Subfamily S, Member 2 (KCNS2, Accession XM_043106) is another VGAM419 host target gene. KCNS2 BINDING SITE is HOST TARGET binding site found in the 3' untranslated region of mRNA encoded by KCNS2, corresponding to a HOST TARGET binding site such as BINDING SITE I, BINDING SITE II or BINDING SITE III. Table 2 illustrates the complementarity of the nucleotide sequences of KCNS2 BINDING SITE, designated SEQ ID:33896, to the nucleotide sequence of VGAM419 RNA, herein designated VGAM RNA, also designated SEQ ID:3130.

Another function of VGAM419 is therefore inhibition of Potassium Voltage-gated Channel, Delayed-rectifier, Subfamily S, Member 2 (KCNS2, Accession XM_043106), a gene which mediates the voltage-dependent potassium ion permeability of excitable membranes. Accordingly, utilities of VGAM419 include diagnosis, prevention and treatment of diseases and clinical conditions associated with KCNS2. The function of KCNS2 has been established by previous studies. See KCNS1 (OMIM Ref. No. 602905). By searching an expressed sequence tag (EST) database with the peptide sequence of the silent Kv8.1 alpha subunit, Salinas et al. (1997) identified human cDNAs encoding KCNS2, which they called Kv9.2. Using these ESTs, the authors isolated a mouse Kcns2 cDNA from a brain cDNA library. The predicted 477-amino acid Kcns2 protein has all of the structural characteristics of an outward rectifier Kv alpha subunit, namely 6 transmembrane domains, a transmembrane region with 5 positively charged amino acids, and a conserved pore-forming region. Several putative phosphorylation sites are located in the cytoplasmic regions. Northern blot analysis showed that Kcns2 is expressed only in the brain. In situ hybridization detected high levels of Kcns2 mRNA in the olfactory bulb, cerebral cortex, hippocampal formation, habenula, basolateral amygdaloid nuclei, and cerebellum; expression was also found in the retina and spinal cord. Salinas et al. (1997) demonstrated that Kcns2 does not have potassium channel activity by itself but can modulate the activities of the Kv2.1 (see OMIM Ref. No. KCNB1; 600397) and Kv2.2 alpha subunits. By fluorescence in situ hybridization and radiation hybrid mapping, Banfi et al. (1996) mapped an EST (GenBank R19352) corresponding to the human KCNS2 gene (Salinas et al., 1997) to 8q22.

Full details of the abovementioned studies are described in the following publications, the disclosure of which are hereby incorporated by reference:

Banfi, S.; Borsani, G.; Rossi, E.; Bernard, L.; Guffanti, A.; Rubboli, F.; Marchitiello, A.; Giglio, S.; Coluccia, E.; Zollo, M.; Zuffardi, O.; Ballabio, A.: Identification and mapping of human cDNAs homologous to Drosophila mutant genes through EST database searching. Nature Genet. 13:167-174, 1996; and Salinas, M.; Duprat, F.; Heurteaux, C.; Hugnot, J.-P.; Lazdunski, M.: New modulatory alpha subunits for mammalian Shab K(+) channels. J. Biol. Chem. 272:24371-24379, 1997.

Further studies establishing the function and utilities of KCNS2 are found in John Hopkins OMIM database record ID 602906, and in sited publications numbered 6021 listed in the bibliography section hereinbelow, which are also hereby incorporated by reference. Moesin (MSN, Accession XM_013042) is another VGAM419 host target gene. MSN BINDING SITE is HOST TARGET binding site found in the 3' untranslated region of mRNA encoded by MSN, corresponding to a HOST TARGET binding site such as BINDING SITE I, BINDING SITE II or BINDING SITE III. Table 2 illustrates the complementarity of the nucleotide sequences of MSN BINDING SITE, designated SEQ ID:30230, to the nucleotide sequence of VGAM419 RNA, herein designated VGAM RNA, also designated SEQ ID:3130.

Another function of VGAM419 is therefore inhibition of Moesin (MSN, Accession XM_013042), a gene which may have a role linking the cytoskeleton to the plasma membrane. Accordingly, utilities of VGAM419 include diagnosis, prevention and treatment of diseases and clinical conditions associated with MSN. The function of MSN and its association with various diseases and clinical conditions, has been established by previous studies, as described hereinabove with reference to VGAM248. Neural Retina Leucine Zipper (NRL, Accession NM_006177) is another VGAM419 host target gene. NRL BINDING SITE is HOST TARGET binding site found in the 3' untranslated region of mRNA encoded by NRL, corresponding to a HOST TARGET binding site such as BINDING SITE I, BINDING SITE II or BINDING SITE III. Table 2 illustrates the complementarity of the nucleotide sequences of NRL BINDING SITE, designated SEQ ID:12839, to the nucleotide sequence of VGAM419 RNA, herein designated VGAM RNA, also designated SEQ ID:3130.

Another function of VGAM419 is therefore inhibition of Neural Retina Leucine Zipper (NRL, Accession NM_006177), a gene which has a basic motif and a leucine zipper domain similar to jun and fos. Accordingly, utilities of VGAM419 include diagnosis, prevention and treatment of diseases and clinical conditions associated with NRL. The function of NRL has been established by previous studies. Farjo et al. (1997) determined the complete sequence of the human NRL gene, identified a polymorphic (CA) n repeat (identical to D14S64) within an NRL-containing cosmid, and refined the location of the NRL gene by linkage analysis. Since a locus for autosomal recessive retinitis pigmentosa was thought to map to 14q11 in Sardinian families (Wright et al., 1995), and because mutations in rhodopsin (OMIM Ref. No. 180380), a gene regulated by the NRL protein, cause RP, NRL was considered a valid candidate gene for retinopathies. In a panel of patients representing independent families with inherited retinal degeneration, Farjo et al. (1997) sequenced genomic PCR products of the NRL gene and of the rhodopsin-NRL response element. No causative mutations were identified. Animal model experiments lend further support to the function of NRL. Mears et al. (2001) generated mice with deletion of the NRL gene. Nrl -/- mice had complete loss of rod function and supernormal cone function, mediated by S cones. The photoreceptors in the Nrl -/- retina had cone-like nuclear morphology and short, sparse outer segments with abnormal disks. Analysis of retinal gene expression confirmed the apparent functional transformation of rods into S cones in the Nrl -/- retina. Mears et al. (2001) suggested that NRL acts as a molecular switch during rod-cell development by directly modulating rod-specific genes while simultaneously inhibiting the S-cone pathway through the activation of NR2E3 (OMIM Ref. No. 604485).

It is appreciated that the abovementioned animal model for NRL is acknowledged by those skilled in the art as a scientifically valid animal model, as can be further appreciated from the publications sited hereinbelow.

Full details of the abovementioned studies are described in the following publications, the disclosure of which are hereby incorporated by reference:

Farjo, Q.; Jackson, A.; Pieke-Dahl, S.; Scott, K.; Kimberling, W. J.; Sieving, P. A.; Richards, J. E.; Swaroop, A.: Human bZIP transcription factor gene NRL: structure, genomic sequence, and fine linkage mapping at 14q11.2 and negative mutation analysis in patients with retinal degeneration. Genomics 45:395-401, 1997; and Mears, A. J.; Kondo, M.; Swain, P. K.; Takada, Y.; Bush, R. A.; Saunders, T. L.; Sieving, P. A.; Swaroop, A.: Nrl is required for rod photoreceptor development. Nature Genet. 29:447-45.

Further studies establishing the function and utilities of NRL are found in John Hopkins OMIM database record ID 162080, and in sited publications numbered 12720-12730 listed in the bibliography section hereinbelow, which are also hereby incorporated by reference. Phosphorylase Kinase, Beta (PHKB, Accession NM_000293) is another VGAM419 host target gene. PHKB BINDING SITE is HOST TARGET binding site found in the 3' untranslated region of mRNA encoded by PHKB, corresponding to a HOST TARGET binding site such as BINDING SITE I, BINDING SITE II or BINDING SITE III. Table 2 illustrates the complementarity of the nucleotide sequences of PHKB BINDING SITE, designated SEQ ID:5838, to the nucleotide sequence of VGAM419 RNA, herein designated VGAM RNA, also designated SEQ ID:3130.

Another function of VGAM419 is therefore inhibition of Phosphorylase Kinase, Beta (PHKB, Accession NM_000293). Accordingly, utilities of VGAM419 include diagnosis, prevention and treatment of diseases and clinical conditions associated with PHKB. RAN Binding Protein 9 (RANBP9, Accession NM_005493) is another VGAM419 host target gene. RANBP9 BINDING SITE is HOST TARGET binding site found in the 5' untranslated region of mRNA encoded by RANBP9, corresponding to a HOST TARGET binding site such as BINDING SITE I, BINDING SITE II or BINDING SITE III. Table 2 illustrates the complementarity of the nucleotide sequences of RANBP9 BINDING SITE, designated SEQ ID:11996, to the nucleotide sequence of VGAM419 RNA, herein designated VGAM RNA, also designated SEQ ID:3130.

Another function of VGAM419 is therefore inhibition of RAN Binding Protein 9 (RANBP9, Accession NM_005493), a gene which is involved in microtubule nucleation. Accordingly, utilities of VGAM419 include diagnosis, prevention and treatment of diseases and clinical conditions associated with RANBP9. The function of RANBP9 has been established by previous studies. With the 2-hybrid method using human RAN (OMIM Ref. No. 601179) as bait, Nakamura et al. (1998) isolated a novel human protein with a molecular mass of 55 kD, which they called RANBPM. The cDNA is 2.8 kb in length and encodes a protein of 500 amino acid residues. Mouse, hamster, and human RANBPM are identical. The C-terminal half of the S. cerevisiae gene YGL227w is 30% identical to RANBPM. Immunoblotting analysis using antibodies against RANBPM revealed that RANBPM was localized within the centrosome throughout the cell cycle. Overexpression of RANBPM produced multiple spots which were colocalized with gamma-tubulin (OMIM Ref. No. 191135) and acted as ectopic microtubule nucleation sites, resulting in a reorganization of the microtubule network. RANBPM cosedimented with centrosomal fractions by sucrose-density gradient centrifugation. Microtubule aster formation was inhibited by both anti-RANBPM antibodies and nonhydrolyzable RAN-GTP (see OMIM Ref. No. 602362). RANBPM specifically interacted with RAN-GTP in a 2-hybrid assay. RANBPM is localized within the central part of microtubule asters. Nakamura et al. (1998) demonstrated that RANBPM is involved in microtubule nucleation, and suggested that RAN regulates the centrosome through RANBPM. Nishitani et al. (2001) determined that the 55-kD RANBP9 is a truncated protein. They cloned the full-length RANBP9 cDNA by PCR from a HeLa cell library and found that it encodes a deduced 729-amino acid protein with a calculated molecular mass of 79 kD. RANBP9 contains long stretches of proline within the N terminus, and a glutamine stretch following the first proline stretch. Human and mouse RANBP9 share greater than 96% sequence identity. Western blot analysis of transfected cells revealed a protein with an apparent molecular mass of 90 kD. Unlike the truncated protein, the full-length protein does not show localization within centrosomes, but localizes within the perinuclear region or the nucleus. In mitotic COS-7 cells transfected with RANBP9, fluorescence was observed throughout the cell.

Full details of the abovementioned studies are described in the following publications, the disclosure of which are hereby incorporated by reference:

Nakamura, M.; Masuda, H.; Horii, J.; Kuma, K.; Yokoyama, N.; Ohba, T.; Nishitani, H.; Miyata, T.; Tanaka, M.; Nishimoto, T.: When overexpressed, a novel centrosomal protein, RanBPM, causes ectopic microtubule nucleation similar to gamma-tubulin. J. Cell Biol. 143:1041-1052, 1998; and Nishitani, H.; Hirose, E.; Uchimura, Y.; Nakamura,; M.; Umeda, M.; Nishii, K.; Mori, N.; Nishimoto, T.: Full-sized RanBPM cDNA encodes a protein possessing a long stretch of proline and.

Further studies establishing the function and utilities of RANBP9 are found in John Hopkins OMIM database record ID 603854, and in sited publications numbered 7420-7421 listed in the bibliography section hereinbelow, which are also hereby incorporated by reference. SMG1 (Accession NM_015092) is another VGAM419 host target gene. SMG1 BINDING SITE is HOST TARGET binding site found in the 3' untranslated region of mRNA encoded by SMG1, corresponding to a HOST TARGET binding site such as BINDING SITE I, BINDING SITE II or BINDING SITE III. Table 2 illustrates the complementarity of the nucleotide sequences of SMG1 BINDING SITE, designated SEQ ID:17481, to the nucleotide sequence of VGAM419 RNA, herein designated VGAM RNA, also designated SEQ ID:3130.

Another function of VGAM419 is therefore inhibition of SMG1 (Accession NM_015092), a gene which acts as the target for the cell-cycle arrest and immunosuppressive effects. Accordingly, utilities of VGAM419 include diagnosis, prevention and treatment of diseases and clinical conditions associated with SMG1. The function of SMG1 has been established by previous studies. Denning et al. (2001) found that immunoprecipitates of human kidney cells transfected with wildtype SMG1 were active in autophosphorylation assays and in assays using a general phospho-acceptor as substrate. SMG1 also exhibited a strong preference for Mn2+ over Mg2+ and was inhibited by nanomolar concentrations of wortmannin, similar to findings for other PIK-related kinases. It was not inhibited by rapamycin despite the presence of a putative rapamycin-binding domain. Yamashita et al. (2001) found that both the 400-kD and 430-kD SMG1 proteins immunoprecipitated from HeLa cell lysates were capable of autophosphorylation. By mutation analysis, they determined that asp2331 is required for the intrinsic autophosphorylation activity. They also found that overexpression of SMG1, but not of a kinase-inactive point mutant, caused phosphorylation of specific serine residues in the C-terminal SQ motifs of UPF1/SMG2 (RENT1; 601430), a member of the mRNA surveillance complex. Using coexpression and immunoprecipitation assays, they determined that SMG1 associates with other components of the mRNA surveillance complex, UPF2 (OMIM Ref. No. 605529) and UPF3A (OMIM Ref. No. 605530). Wortmannin and caffeine were found to inhibit the kinase activity of SMG1, whereas staurosporine and rapamycin did not. Inhibitors of SMG1 induced the accumulation of truncated p53 in human cancer cell lines.

Full details of the abovementioned studies are described in the following publications, the disclosure of which are hereby incorporated by reference:

Denning, G.; Jamieson, L.; Maquat, L. E.; Thompson, E. A.; Fields, A. P.: Cloning of a novel phosphatidylinositol kinase-related kinase: characterization of the human SMG-1 RNA surveillance protein. J. Biol. Chem. 276:22709-22714, 2001; and Yamashita, A.; Ohnishi, T.; Kashima, I.; Taya, Y.; Ohno, S.: Human SMG-1, a novel phosphatidylinositol 3-kinase-related protein kinase, associates with components of the mRNA surveillan.

Further studies establishing the function and utilities of SMG1 are found in John Hopkins OMIM database record ID 607032, and in sited publications numbered 5386-5387, 110 and 5137 listed in the bibliography section hereinbelow, which are also hereby incorporated by reference. Tumor Necrosis Factor (ligand) Superfamily, Member 15 (TNFSF15, Accession NM_005118) is another VGAM419 host target gene. TNFSF15 BINDING SITE is HOST TARGET binding site found in the 3' untranslated region of mRNA encoded by TNFSF15, corresponding to a HOST TARGET binding site such as BINDING SITE I, BINDING SITE II or BINDING SITE III. Table 2 illustrates the complementarity of the nucleotide sequences of TNFSF15 BINDING SITE, designated SEQ ID:11602, to the nucleotide sequence of VGAM419 RNA, herein designated VGAM RNA, also designated SEQ ID:3130.

Another function of VGAM419 is therefore inhibition of Tumor Necrosis Factor (ligand) Superfamily, Member 15 (TNFSF15, Accession NM_005118), a gene which acts as an autocrine factor to induce apoptosis in endothelial cells. Accordingly, utilities of VGAM419 include diagnosis, prevention and treatment of diseases and clinical conditions associated with TNFSF15. The function of TNFSF15 and its association with various diseases and clinical conditions, has been established by previous studies, as described hereinabove with reference to VGAM350. Vanin 1 (VNN1, Accession NM_004666) is another VGAM419 host target gene. VNN1 BINDING SITE is HOST TARGET binding site found in the 3' untranslated region of mRNA encoded by VNN1, corresponding to a HOST TARGET binding site such as BINDING SITE I, BINDING SITE II or BINDING SITE III. Table 2 illustrates the complementarity of the nucleotide sequences of VNN1 BINDING SITE, designated SEQ ID:11039, to the nucleotide sequence of VGAM419 RNA, herein designated VGAM RNA, also designated SEQ ID:3130.

Another function of VGAM419 is therefore inhibition of Vanin 1 (VNN1, Accession NM_004666), a gene which may regulate steps in thymus homing and play a role in mammalian sexual development. Accordingly, utilities of VGAM419 include diagnosis, prevention and treatment of diseases and clinical conditions associated with VNN1. The function of VNN1 has been established by previous studies. Hematopoietic precursor cells migrate to the thymus, where they differentiate into mature T lymphocytes. Aurrand-Lions et al. (1996) reported the cDNA cloning and functional analysis of mouse vanin-1 (vascular noninflammatory molecule-1), a novel cell surface molecule that is involved in the thymus homing of bone marrow cells. Vanin-1 is a glycosylphosphatidylinositol (GPI)-anchored molecule expressed by perivascular thymic stromal cells. Antibody against vanin-1 blocked thymus colonization by hematopoietic progenitor cells in both short- and long-term assays and interfered with lymphostromal cell adhesion. The authors suggested that vanin-1 regulates late adhesion steps of thymus homing under physiologic, noninflammatory conditions. The mammalian sex-determining pathway is controlled by the presence or absence of SRY (OMIM Ref. No. 480000) expression in the embryonic gonad. To identify additional sex-determining or gonadal differentiation genes, Grimmond et al. (2000) screened for genes exhibiting sexually dimorphic patterns of expression in the mouse gonad at 12.5 and 13.5 days postcoitum, after overt gonad differentiation, by comparing complex cDNA probes derived from male and female gonadal tissue at these stages on microarrays constructed from a normalized urogenital ridge library. Using in situ hybridization analysis, they determined that mouse protease nexin-1 (OMIM Ref. No. 177010) and Vnn1 exhibit male-specific expression prior to overt gonadal differentiation and are detected in the somatic portion of the developing gonad, suggesting to the authors a possible direct link to the testis-determining pathway for both genes.

Full details of the abovementioned studies are described in the following publications, the disclosure of which are hereby incorporated by reference:

Aurrand-Lions, M.; Galland, F.; Bazin, H.; Zakharyev, V. M.; Imhof, B. A.; Naquet, P.: Vanin-1, a novel GPI-linked perivascular molecule involved in thymus homing. Immunity 5:391-405, 1996; and Grimmond, S.; Van Hateren, N.; Siggers, P.; Arkell, R.; Larder, R.; Soares, M. B.; de Fatima Bonaldo, M.; Smith, L.; Tymowska-Lalanne, Z.; Wells, C.; Greenfield, A.: Sexually dimorphic ex.

Further studies establishing the function and utilities of VNN1 are found in John Hopkins OMIM database record ID 603570, and in sited publications numbered 5355-5356, 1 and 5357-5358 listed in the bibliography section hereinbelow, which are also hereby incorporated by reference. AP1 Gamma Subunit Binding Protein 1 (AP1GBP1, Accession NM_080551) is another VGAM419 host target gene. AP1GBP1 BINDING SITE is HOST TARGET binding site found in the 3' untranslated region of mRNA encoded by AP1GBP1, corresponding to a HOST TARGET binding site such as BINDING SITE I, BINDING SITE II or BINDING SITE III. Table 2 illustrates the complementarity of the nucleotide sequences of AP1GBP1 BINDING SITE, designated SEQ ID:27881, to the nucleotide sequence of VGAM419 RNA, herein designated VGAM RNA, also designated SEQ ID:3130.

Another function of VGAM419 is therefore inhibition of AP1 Gamma Subunit Binding Protein 1 (AP1GBP1, Accession NM_080551). Accordingly, utilities of VGAM419 include diagnosis, prevention and treatment of diseases and clinical conditions associated with AP1GBP1. BC022889 (Accession XM_096964) is another VGAM419 host target gene. BC022889 BINDING SITE is HOST TARGET binding site found in the 5' untranslated region of mRNA encoded by BC022889, corresponding to a HOST TARGET binding site such as BINDING SITE I, BINDING SITE II or BINDING SITE III. Table 2 illustrates the complementarity of the nucleotide sequences of BC022889 BINDING SITE, designated SEQ ID:40687, to the nucleotide sequence of VGAM419 RNA, herein designated VGAM RNA, also designated SEQ ID:3130.

Another function of VGAM419 is therefore inhibition of BC022889 (Accession XM_096964). Accordingly, utilities of VGAM419 include diagnosis, prevention and treatment of diseases and clinical conditions associated with BC022889. C1q and Tumor Necrosis Factor Related Protein 2 (C1QTNF2, Accession NM_031908) is another VGAM419 host target gene. C1QTNF2 BINDING SITE is HOST TARGET binding site found in the 3' untranslated region of mRNA encoded by C1QTNF2, corresponding to a HOST TARGET binding site such as BINDING SITE I, BINDING SITE II or BINDING SITE III. Table 2 illustrates the complementarity of the nucleotide sequences of C1QTNF2 BINDING SITE, designated SEQ ID:25653, to the nucleotide sequence of VGAM419 RNA, herein designated VGAM RNA, also designated SEQ ID:3130.

Another function of VGAM419 is therefore inhibition of C1q and Tumor Necrosis Factor Related Protein 2 (C1QTNF2, Accession NM_031908). Accordingly, utilities of VGAM419 include diagnosis, prevention and treatment of diseases and clinical conditions associated with C1QTNF2. Chromosome 20 Open Reading Frame 12 (C20orf12, Accession NM_018152) is another VGAM419 host target gene. C20orf12 BINDING SITE is HOST TARGET binding site found in the 3" untranslated region of mRNA encoded by C20orf12, corresponding to a HOST TARGET binding site such as BINDING SITE I, BINDING SITE II or BINDING SITE III. Table 2 illustrates the complementarity of the nucleotide sequences of C20orf12 BINDING SITE, designated SEQ ID:19962, to the nucleotide sequence of VGAM419 RNA, herein designated VGAM RNA, also designated SEQ ID:3130.

Another function of VGAM419 is therefore inhibition of Chromosome 20 Open Reading Frame 12 (C20orf12, Accession NM_018152). Accordingly, utilities of VGAM419 include diagnosis, prevention and treatment of diseases and clinical conditions associated with C20orf12. Chromosome 20 Open Reading Frame 177 (C20orf177, Accession XM_030726) is another VGAM419 host target gene. C20orf177 BINDING SITE is HOST TARGET binding site found in the 3' untranslated region of mRNA encoded by C20orf177, corresponding to a HOST TARGET binding site such as BINDING SITE I, BINDING SITE II or BINDING SITE III. Table 2 illustrates the complementarity of the nucleotide sequences of C20orf177 BINDING SITE, designated SEQ ID:31130, to the nucleotide sequence of VGAM419 RNA, herein designated VGAM RNA, also designated SEQ ID:3130.

Another function of VGAM419 is therefore inhibition of Chromosome 20 Open Reading Frame 177 (C20orf177, Accession XM_030726). Accordingly, utilities of VGAM419 include diagnosis, prevention and treatment of diseases and clinical conditions associated with C20orf177. Cullin 4A (CUL4A, Accession NM_003589) is another VGAM419 host target gene. CUL4A BINDING SITE is HOST TARGET binding site found in the 3' untranslated region of mRNA encoded by CUL4A, corresponding to a HOST TARGET binding site such as BINDING SITE I, BINDING SITE II or BINDING SITE III. Table 2 illustrates the complementarity of the nucleotide sequences of CUL4A BINDING SITE, designated SEQ ID:9642, to the nucleotide sequence of VGAM419 RNA, herein designated VGAM RNA, also designated SEQ ID:3130.

Another function of VGAM419 is therefore inhibition of Cullin 4A (CUL4A, Accession NM_003589). Accordingly, utilities of VGAM419 include diagnosis, prevention and treatment of diseases and clinical conditions associated with CUL4A. Deiodinase, Iodothyronine, Type II (DIO2, Accession NM_013989) is another VGAM419 host target gene. DIO2 BINDING SITE1 and DIO2 BINDING SITE2 are HOST TARGET binding sites found in untranslated regions of mRNA encoded by DIO2, corresponding to HOST TARGET binding sites such as BINDING SITE I, BINDING SITE II or BINDING SITE III. Table 2 illustrates the complementarity of the nucleotide sequences of DIO2 BINDING SITE1 and DIO2 BINDING SITE2, designated SEQ ID:15172 and SEQ ID:6461 respectively, to the nucleotide sequence of VGAM419 RNA, herein designated VGAM RNA, also designated SEQ ID:3130.

Another function of VGAM419 is therefore inhibition of Deiodinase, Iodothyronine, Type II (DIO2, Accession NM_013989). Accordingly, utilities of VGAM419 include diagnosis, prevention and treatment of diseases and clinical conditions associated with DIO2. FLJ12660 (Accession NM_025152) is another VGAM419 host target gene. FLJ12660 BINDING SITE is HOST TARGET binding site found in the 3' untranslated region of mRNA encoded by FLJ12660, corresponding to a HOST TARGET binding site such as BINDING SITE I, BINDING SITE II or BINDING SITE III. Table 2 illustrates the complementarity of the nucleotide sequences of FLJ12660 BINDING SITE, designated SEQ ID:24788, to the nucleotide sequence of VGAM419 RNA, herein designated VGAM RNA, also designated SEQ ID:3130.

Another function of VGAM419 is therefore inhibition of FLJ12660 (Accession NM_025152). Accordingly, utilities of VGAM419 include diagnosis, prevention and treatment of diseases and clinical conditions associated with FLJ12660. FLJ12876 (Accession NM_022754) is another VGAM419 host target gene. FLJ12876 BINDING SITE is HOST TARGET binding site found in the 3' untranslated region of mRNA encoded by FLJ12876, corresponding to a HOST TARGET binding site such as BINDING SITE I, BINDING SITE II or BINDING SITE III. Table 2 illustrates the complementarity of the nucleotide sequences of FLJ12876 BINDING SITE, designated SEQ ID:22988, to the nucleotide sequence of VGAM419 RNA, herein designated VGAM RNA, also designated SEQ ID:3130.

Another function of VGAM419 is therefore inhibition of FLJ12876 (Accession NM_022754). Accordingly, utilities of VGAM419 include diagnosis, prevention and treatment of diseases and clinical conditions associated with FLJ12876. FLJ20006 (Accession NM_017618) is another VGAM419 host target gene. FLJ20006 BINDING SITE is HOST TARGET binding site found in the 3' untranslated region of mRNA encoded by FLJ20006, corresponding to a HOST TARGET binding site such as BINDING SITE I, BINDING SITE II or BINDING SITE III. Table 2 illustrates the complementarity of the nucleotide sequences of FLJ20006 BINDING SITE, designated SEQ ID:19120, to the nucleotide sequence of VGAM419 RNA, herein designated VGAM RNA, also designated SEQ ID:3130.

Another function of VGAM419 is therefore inhibition of FLJ20006 (Accession NM_017618). Accordingly, utilities of VGAM419 include diagnosis, prevention and treatment of diseases and clinical conditions associated with FLJ20006. FLJ21240 (Accession NM_024847) is another VGAM419 host target gene. FLJ21240 BINDING SITE is HOST TARGET binding site found in the 3' untranslated region of mRNA encoded by FLJ21240, corresponding to a HOST TARGET binding site such as BINDING SITE I, BINDING SITE II or BINDING SITE III. Table 2 illustrates the complementarity of the nucleotide sequences of FLJ21240 BINDING SITE, designated SEQ ID:24281, to the nucleotide sequence of VGAM419 RNA, herein designated VGAM RNA, also designated SEQ ID:3130.

Another function of VGAM419 is therefore inhibition of FLJ21240 (Accession NM_024847). Accordingly, utilities of VGAM419 include diagnosis, prevention and treatment of diseases and clinical conditions associated with FLJ21240. KIAA0255 (Accession NM_014742) is another VGAM419 host target gene. KIAA0255 BINDING SITE is HOST TARGET binding site found in the 3' untranslated region of mRNA encoded by KIAA0255, corresponding to a HOST TARGET binding site such as BINDING SITE I, BINDING SITE II or BINDING SITE III. Table 2 illustrates the complementarity of the nucleotide sequences of KIAA0255 BINDING SITE, designated SEQ ID:16414, to the nucleotide sequence of VGAM419 RNA, herein designated VGAM RNA, also designated SEQ ID:3130.

Another function of VGAM419 is therefore inhibition of KIAA0255 (Accession NM_014742). Accordingly, utilities of VGAM419 include diagnosis, prevention and treatment of diseases and clinical conditions associated with KIAA0255. KIAA0268 (Accession XM_046126) is another VGAM419 host target gene. KIAA0268 BINDING SITE is HOST TARGET binding site found in the 3' untranslated region of mRNA encoded by KIAA0268, corresponding to a HOST TARGET binding site such as BINDING SITE I, BINDING SITE II or BINDING SITE III. Table 2 illustrates the complementarity of the nucleotide sequences of KIAA0268 BINDING SITE, designated SEQ ID:34689, to the nucleotide sequence of VGAM419 RNA, herein designated VGAM RNA, also designated SEQ ID:3130.

Another function of VGAM419 is therefore inhibition of KIAA0268 (Accession XM_046126). Accordingly, utilities of VGAM419 include diagnosis, prevention and treatment of diseases and clinical conditions associated with KIAA0268. KIAA1126 (Accession XM_050325) is another VGAM419 host target gene. KIAA1126 BINDING SITE is HOST TARGET binding site found in the 3' untranslated region of mRNA encoded by KIAA1126, corresponding to a HOST TARGET binding site such as BINDING SITE I, BINDING SITE II or BINDING SITE III. Table 2 illustrates the complementarity of the nucleotide sequences of KIAA1126 BINDING SITE, designated SEQ ID:35612, to the nucleotide sequence of VGAM419 RNA, herein designated VGAM RNA, also designated SEQ ID:3130.

Another function of VGAM419 is therefore inhibition of KIAA1126 (Accession XM_050325). Accordingly, utilities of VGAM419 include diagnosis, prevention and treatment of diseases and clinical conditions associated with KIAA1126. KIAA1473 (Accession XM_047550) is another VGAM419 host target gene. KIAA1473 BINDING SITE is HOST TARGET binding site found in the 3' untranslated region of mRNA encoded by KIAA1473, corresponding to a HOST TARGET binding site such as BINDING SITE I, BINDING SITE II or BINDING SITE III. Table 2 illustrates the complementarity of the nucleotide sequences of KIAA1473 BINDING SITE, designated SEQ ID:34998, to the nucleotide sequence of VGAM419 RNA, herein designated VGAM RNA, also designated SEQ ID:3130.

Another function of VGAM419 is therefore inhibition of KIAA1473 (Accession XM_047550). Accordingly, utilities of VGAM419 include diagnosis, prevention and treatment of diseases and clinical conditions associated with KIAA1473. KIAA1649 (Accession XM_040095) is another VGAM419 host target gene. KIAA1649 BINDING SITE1 and KIAA1649 BINDING SITE2 are HOST TARGET binding sites found in untranslated regions of mRNA encoded by KIAA1649, corresponding to HOST TARGET binding sites such as BINDING SITE I, BINDING SITE II or BINDING SITE III. Table 2 illustrates the complementarity of the nucleotide sequences of KIAA1649 BINDING SITE1 and KIAA1649 BINDING SITE2, designated SEQ ID:33255 and SEQ ID:26103 respectively, to the nucleotide sequence of VGAM419 RNA, herein designated VGAM RNA, also designated SEQ ID:3130.

Another function of VGAM419 is therefore inhibition of KIAA1649 (Accession XM_040095). Accordingly, utilities of VGAM419 include diagnosis, prevention and treatment of diseases and clinical conditions associated with KIAA1649. Mitochondrial Ribosomal Protein L35 (MRPL35, Accession NM_016622) is another VGAM419 host target gene. MRPL35 BINDING SITE is HOST TARGET binding site found in the 3' untranslated region of mRNA encoded by MRPL35, corresponding to a HOST TARGET binding site such as BINDING SITE I, BINDING SITE II or BINDING SITE III. Table 2 illustrates the complementarity of the nucleotide sequences of MRPL35 BINDING SITE, designated SEQ ID:18734, to the nucleotide sequence of VGAM419 RNA, herein designated VGAM RNA, also designated SEQ ID:3130.

Another function of VGAM419 is therefore inhibition of Mitochondrial Ribosomal Protein L35 (MRPL35, Accession NM_016622). Accordingly, utilities of VGAM419 include diagnosis, prevention and treatment of diseases and clinical conditions associated with MRPL35. PDZ Domain Containing 2 (PDZD2, Accession XM_087705) is another VGAM419 host target gene. PDZD2 BINDING SITE is HOST TARGET binding site found in the 3' untranslated region of mRNA encoded by PDZD2, corresponding to a HOST TARGET binding site such as BINDING SITE I, BINDING SITE II or BINDING SITE III. Table 2 illustrates the complementarity of the nucleotide sequences of PDZD2 BINDING SITE, designated SEQ ID:39399, to the nucleotide sequence of VGAM419 RNA, herein designated VGAM RNA, also designated SEQ ID:3130.

Another function of VGAM419 is therefore inhibition of PDZ Domain Containing 2 (PDZD2, Accession XM_087705). Accordingly, utilities of VGAM419 include diagnosis, prevention and treatment of diseases and clinical conditions associated with PDZD2. PRO0478 (Accession NM_014129) is another VGAM419 host target gene. PRO0478 BINDING SITE is HOST TARGET binding site found in the 5' untranslated region of mRNA encoded by PRO0478, corresponding to a HOST TARGET binding site such as BINDING SITE I, BINDING SITE II or BINDING SITE III. Table 2 illustrates the complementarity of the nucleotide sequences of PRO0478 BINDING SITE, designated SEQ ID:15398, to the nucleotide sequence of VGAM419 RNA, herein designated VGAM RNA, also designated SEQ ID:3130.

Another function of VGAM419 is therefore inhibition of PRO0478 (Accession NM_014129). Accordingly, utilities of VGAM419 include diagnosis, prevention and treatment of diseases and clinical conditions associated with PRO0478. SARM (Accession NM_015077) is another VGAM419 host target gene. SARM BINDING SITE is HOST TARGET binding site found in the 3" untranslated region of mRNA encoded by SARM, corresponding to a HOST TARGET binding site such as BINDING SITE I, BINDING SITE II or BINDING SITE III. Table 2 illustrates the complementarity of the nucleotide sequences of SARM BINDING SITE, designated SEQ ID:17452, to the nucleotide sequence of VGAM419 RNA, herein designated VGAM RNA, also designated SEQ ID:3130.

Another function of VGAM419 is therefore inhibition of SARM (Accession NM_015077). Accordingly, utilities of VGAM419 include diagnosis, prevention and treatment of diseases and clinical conditions associated with SARM. Sperm Specific Antigen 2 (SSFA2, Accession XM_057458) is another VGAM419 host target gene. SSFA2 BINDING SITE is HOST TARGET binding site found in the 3' untranslated region of mRNA encoded by SSFA2, corresponding to a HOST TARGET binding site such as BINDING SITE I, BINDING SITE II or BINDING SITE III. Table 2 illustrates the complementarity of the nucleotide sequences of SSFA2 BINDING SITE, designated SEQ ID:36515, to the nucleotide sequence of VGAM419 RNA, herein designated VGAM RNA, also designated SEQ ID:3130.

Another function of VGAM419 is therefore inhibition of Sperm Specific Antigen 2 (SSFA2, Accession XM_057458). Accordingly, utilities of VGAM419 include diagnosis, prevention and treatment of diseases and clinical conditions associated with SSFA2. Tripartite Motif-containing 22 (TRIM22, Accession NM_006074) is another VGAM419 host target gene. TRIM22 BINDING SITE is HOST TARGET binding site found in the 3' untranslated region of mRNA encoded by TRIM22, corresponding to a HOST TARGET binding site such as BINDING SITE I, BINDING SITE II or BINDING SITE III. Table 2 illustrates the complementarity of the nucleotide sequences of TRIM22 BINDING SITE, designated SEQ ID:12719, to the nucleotide sequence of VGAM419 RNA, herein designated VGAM RNA, also designated SEQ ID:3130.

Another function of VGAM419 is therefore inhibition of Tripartite Motif-containing 22 (TRIM22, Accession NM_006074). Accordingly, utilities of VGAM419 include diagnosis, prevention and treatment of diseases and clinical conditions associated with TRIM22. Zinc Finger Protein 347 (ZNF347, Accession NM_032584) is another VGAM419 host target gene. ZNF347 BINDING SITE is HOST TARGET binding site found in the 3' untranslated region of mRNA encoded by ZNF347, corresponding to a HOST TARGET binding site such as BINDING SITE I, BINDING SITE II or BINDING SITE III. Table 2 illustrates the complementarity of the nucleotide sequences of ZNF347 BINDING SITE, designated SEQ ID:26320, to the nucleotide sequence of VGAM419 RNA, herein designated VGAM RNA, also designated SEQ ID:3130.

Another function of VGAM419 is therefore inhibition of Zinc Finger Protein 347 (ZNF347, Accession NM_032584). Accordingly, utilities of VGAM419 include diagnosis, prevention and treatment of diseases and clinical conditions associated with ZNF347. LOC119504 (Accession XM_058400) is another VGAM419 host target gene. LOC119504 BINDING SITE is HOST TARGET binding site found in the 5' untranslated region of mRNA encoded by LOC119504, corresponding to a HOST TARGET binding site such as BINDING SITE I, BINDING SITE II or BINDING SITE III. Table 2 illustrates the complementarity of the nucleotide sequences of LOC119504 BINDING SITE, designated SEQ ID:36616, to the nucleotide sequence of VGAM419 RNA, herein designated VGAM RNA, also designated SEQ ID:3130.

Another function of VGAM419 is therefore inhibition of LOC119504 (Accession XM_058400). Accordingly, utilities of VGAM419 include diagnosis, prevention and treatment of diseases and clinical conditions associated with LOC119504. LOC126382 (Accession XM_072027) is another VGAM419 host target gene. LOC126382 BINDING SITE is HOST TARGET binding site found in the 5' untranslated region of mRNA encoded by LOC126382, corresponding to a HOST TARGET binding site such as BINDING SITE I, BINDING SITE II or BINDING SITE III. Table 2 illustrates the complementarity of the nucleotide sequences of LOC126382 BINDING SITE, designated SEQ ID:37456, to the nucleotide sequence of VGAM419 RNA, herein designated VGAM RNA, also designated SEQ ID:3130.

Another function of VGAM419 is therefore inhibition of LOC126382 (Accession XM_072027). Accordingly, utilities of VGAM419 include diagnosis, prevention and treatment of diseases and clinical conditions associated with LOC126382. LOC128977 (Accession XM_059313) is another VGAM419 host target gene. LOC128977 BINDING SITE is HOST TARGET binding site found in the 3' untranslated region of mRNA encoded by LOC128977, corresponding to a HOST TARGET binding site such as BINDING SITE I, BINDING SITE II or BINDING SITE III. Table 2 illustrates the complementarity of the nucleotide sequences of LOC128977 BINDING SITE, designated SEQ ID:36948, to the nucleotide sequence of VGAM419 RNA, herein designated VGAM RNA, also designated SEQ ID:3130.

Another function of VGAM419 is therefore inhibition of LOC128977 (Accession XM_059313). Accordingly, utilities of VGAM419 include diagnosis, prevention and treatment of diseases and clinical conditions associated with LOC128977. LOC131744 (Accession XM_067529) is another VGAM419 host target gene. LOC131744 BINDING SITE is HOST TARGET binding site found in the 3' untranslated region of mRNA encoded by LOC131744, corresponding to a HOST TARGET binding site such as BINDING SITE I, BINDING SITE II or BINDING SITE III. Table 2 illustrates the complementarity of the nucleotide sequences of LOC131744 BINDING SITE, designated SEQ ID:37359, to the nucleotide sequence of VGAM419 RNA, herein designated VGAM RNA, also designated SEQ ID:3130.

Another function of VGAM419 is therefore inhibition of LOC131744 (Accession XM_067529). Accordingly, utilities of VGAM419 include diagnosis, prevention and treatment of diseases and clinical conditions associated with LOC131744. LOC144465 (Accession XM_084874) is another VGAM419 host target gene. LOC144465 BINDING SITE is HOST TARGET binding site found in the 3' untranslated region of mRNA encoded by LOC144465, corresponding to a HOST TARGET binding site such as BINDING SITE I, BINDING SITE II or BINDING SITE III. Table 2 illustrates the complementarity of the nucleotide sequences of LOC144465 BINDING SITE, designated SEQ ID:37753, to the nucleotide sequence of VGAM419 RNA, herein designated VGAM RNA, also designated SEQ ID:3130.

Another function of VGAM419 is therefore inhibition of LOC144465 (Accession XM_084874). Accordingly, utilities of VGAM419 include diagnosis, prevention and treatment of diseases and clinical conditions associated with LOC144465. LOC145216 (Accession XM_096730) is another VGAM419 host target gene. LOC145216 BINDING SITE is HOST TARGET binding site found in the 3' untranslated region of mRNA encoded by LOC145216, corresponding to a HOST TARGET binding site such as BINDING SITE I, BINDING SITE II or BINDING SITE III. Table 2 illustrates the complementarity of the nucleotide sequences of LOC145216 BINDING SITE, designated SEQ ID:40510, to the nucleotide sequence of VGAM419 RNA, herein designated VGAM RNA, also designated SEQ ID:3130.

Another function of VGAM419 is therefore inhibition of LOC145216 (Accession XM_096730). Accordingly, utilities of VGAM419 include diagnosis, prevention and treatment of diseases and clinical conditions associated with LOC145216. LOC148894 (Accession XM_097542) is another VGAM419 host target gene. LOC148894 BINDING SITE is HOST TARGET binding site found in the 5' untranslated region of mRNA encoded by LOC148894, corresponding to a HOST TARGET binding site such as BINDING SITE I, BINDING SITE II or BINDING SITE III. Table 2 illustrates the complementarity of the nucleotide sequences of LOC148894 BINDING SITE, designated SEQ ID:40921, to the nucleotide sequence of VGAM419 RNA, herein designated VGAM RNA, also designated SEQ ID:3130.

Another function of VGAM419 is therefore inhibition of LOC148894 (Accession XM_097542). Accordingly, utilities of VGAM419 include diagnosis, prevention and treatment of diseases and clinical conditions associated with LOC148894. LOC148932 (Accession XM_086372) is another VGAM419 host target gene. LOC148932 BINDING SITE is HOST TARGET binding site found in the 3' untranslated region of mRNA encoded by LOC148932, corresponding to a HOST TARGET binding site such as BINDING SITE I, BINDING SITE II or BINDING SITE III. Table 2 illustrates the complementarity of the nucleotide sequences of LOC148932 BINDING SITE, designated SEQ ID:38625, to the nucleotide sequence of VGAM419 RNA, herein designated VGAM RNA, also designated SEQ ID:3130.

Another function of VGAM419 is therefore inhibition of LOC148932 (Accession XM_086372). Accordingly, utilities of VGAM419 include diagnosis, prevention and treatment of diseases and clinical conditions associated with LOC148932. LOC149113 (Accession XM_086425) is another VGAM419 host target gene. LOC149113 BINDING SITE is HOST TARGET binding site found in the 3' untranslated region of mRNA encoded by LOC149113, corresponding to a HOST TARGET binding site such as BINDING SITE I, BINDING SITE II or BINDING SITE III. Table 2 illustrates the complementarity of the nucleotide sequences of LOC149113 BINDING SITE, designated SEQ ID:38642, to the nucleotide sequence of VGAM419 RNA, herein designated VGAM RNA, also designated SEQ ID:3130.

Another function of VGAM419 is therefore inhibition of LOC149113 (Accession XM_086425). Accordingly, utilities of VGAM419 include diagnosis, prevention and treatment of diseases and clinical conditions associated with LOC149113. LOC150630 (Accession XM_097931) is another VGAM419 host target gene. LOC150630 BINDING SITE is HOST TARGET binding site found in the 3' untranslated region of mRNA encoded by LOC150630, corresponding to a HOST TARGET binding site such as BINDING SITE I, BINDING SITE II or BINDING SITE III. Table 2 illustrates the complementarity of the nucleotide sequences of LOC150630 BINDING SITE, designated SEQ ID:41244, to the nucleotide sequence of VGAM419 RNA, herein designated VGAM RNA, also designated SEQ ID:3130.

Another function of VGAM419 is therefore inhibition of LOC150630 (Accession XM_097931). Accordingly, utilities of VGAM419 include diagnosis, prevention and treatment of diseases and clinical conditions associated with LOC150630. LOC154403 (Accession XM_087919) is another VGAM419 host target gene. LOC154403 BINDING SITE is HOST TARGET binding site found in the 3' untranslated region of mRNA encoded by LOC154403, corresponding to a HOST TARGET binding site such as BINDING SITE I, BINDING SITE II or BINDING SITE III. Table 2 illustrates the complementarity of the nucleotide sequences of LOC154403 BINDING SITE, designated SEQ ID:39470, to the nucleotide sequence of VGAM419 RNA, herein designated VGAM RNA, also designated SEQ ID:3130.

Another function of VGAM419 is therefore inhibition of LOC154403 (Accession XM_087919). Accordingly, utilities of VGAM419 include diagnosis, prevention and treatment of diseases and clinical conditions associated with LOC154403. LOC154992 (Accession XM_088106) is another VGAM419 host target gene. LOC154992 BINDING SITE is HOST TARGET binding site found in the 3' untranslated region of mRNA encoded by LOC154992, corresponding to a HOST TARGET binding site such as BINDING SITE I, BINDING SITE II or BINDING SITE III. Table 2 illustrates the complementarity of the nucleotide sequences of LOC154992 BINDING SITE, designated SEQ ID:39520, to the nucleotide sequence of VGAM419 RNA, herein designated VGAM RNA, also designated SEQ ID:3130.

Another function of VGAM419 is therefore inhibition of LOC154992 (Accession XM_088106). Accordingly, utilities of VGAM419 include diagnosis, prevention and treatment of diseases and clinical conditions associated with LOC154992. LOC196812 (Accession XM_116868) is another VGAM419 host target gene. LOC196812 BINDING SITE is HOST TARGET binding site found in the 3' untranslated region of mRNA encoded by LOC196812, corresponding to a HOST TARGET binding site such as BINDING SITE I, BINDING SITE II or BINDING SITE III. Table 2 illustrates the complementarity of the nucleotide sequences of LOC196812 BINDING SITE, designated SEQ ID:43140, to the nucleotide sequence of VGAM419 RNA, herein designated VGAM RNA, also designated SEQ ID:3130.

Another function of VGAM419 is therefore inhibition of LOC196812 (Accession XM_116868). Accordingly, utilities of VGAM419 include diagnosis, prevention and treatment of diseases and clinical conditions associated with LOC196812. LOC199858 (Accession XM_114040) is another VGAM419 host target gene. LOC199858 BINDING SITE is HOST TARGET binding site found in the 5' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42643, to the nucleotide sequence of VGAM419 RNA, herein designated VGAM RNA, also designated SEQ ID:3130.

Another function of VGAM419 is therefore inhibition of LOC199858 (Accession XM_114040). Accordingly, utilities of VGAM419 include diagnosis, prevention and treatment of diseases and clinical conditions associated with LOC199858. LOC201868 (Accession XM_114393) is another VGAM419 host target gene. LOC201868 BINDING SITE is HOST TARGET binding site found in the 3' untranslated region of mRNA encoded by LOC201868, corresponding to a HOST TARGET binding site such as BINDING SITE I, BINDING SITE II or BINDING SITE III. Table 2 illustrates the complementarity of the nucleotide sequences of LOC201868 BINDING SITE, designated SEQ ID:42923, to the nucleotide sequence of VGAM419 RNA, herein designated VGAM RNA, also designated SEQ ID:3130.

Another function of VGAM419 is therefore inhibition of LOC201868 (Accession XM_114393). Accordingly, utilities of VGAM419 include diagnosis, prevention and treatment of diseases and clinical conditions associated with LOC201868. LOC201911 (Accession XM_117339) is another VGAM419 host target gene. LOC201911 BINDING SITE is HOST TARGET binding site found in the 3' untranslated region of mRNA encoded by LOC201911, corresponding to a HOST TARGET binding site such as BINDING SITE I, BINDING SITE II or BINDING SITE III. Table 2 illustrates the complementarity of the nucleotide sequences of LOC201911 BINDING SITE, designated SEQ ID:43391, to the nucleotide sequence of VGAM419 RNA, herein designated VGAM RNA, also designated SEQ ID:3130.

Another function of VGAM419 is therefore inhibition of LOC201911 (Accession XM_117339). Accordingly, utilities of VGAM419 include diagnosis, prevention and treatment of diseases and clinical conditions associated with LOC201911. LOC219722 (Accession XM_167593) is another VGAM419 host target gene. LOC219722 BINDING SITE is HOST TARGET binding site found in the 5' untranslated region of mRNA encoded by LOC219722, corresponding to a HOST TARGET binding site such as BINDING SITE I, BINDING SITE II or BINDING SITE III. Table 2 illustrates the complementarity of the nucleotide sequences of LOC219722 BINDING SITE, designated SEQ ID:44713, to the nucleotide sequence of VGAM419 RNA, herein designated VGAM RNA, also designated SEQ ID:3130.

Another function of VGAM419 is therefore inhibition of LOC219722 (Accession XM_167593). Accordingly, utilities of VGAM419 include diagnosis, prevention and treatment of diseases and clinical conditions associated with LOC219722. LOC221431 (Accession XM_166380) is another VGAM419 host target gene. LOC221431 BINDING SITE is HOST TARGET binding site found in the 3' untranslated region of mRNA encoded by LOC221431, corresponding to a HOST TARGET binding site such as BINDING SITE I, BINDING SITE II or BINDING SITE III. Table 2 illustrates the complementarity of the nucleotide sequences of LOC221431 BINDING SITE, designated SEQ ID:44226, to the nucleotide sequence of VGAM419 RNA, herein designated VGAM RNA, also designated SEQ ID:3130.

Another function of VGAM419 is therefore inhibition of LOC221431 (Accession XM_166380). Accordingly, utilities of VGAM419 include diagnosis, prevention and treatment of diseases and clinical conditions associated with LOC221431. LOC254531 (Accession XM_170773) is another VGAM419 host target gene. LOC254531 BINDING SITE is HOST TARGET binding site found in the 5' untranslated region of mRNA encoded by LOC254531, corresponding to a HOST TARGET binding site such as BINDING SITE I, BINDING SITE II or BINDING SITE III. Table 2 illustrates the complementarity of the nucleotide sequences of LOC254531 BINDING SITE, designated SEQ ID:45541, to the nucleotide sequence of VGAM419 RNA, herein designated VGAM RNA, also designated SEQ ID:3130.

Another function of VGAM419 is therefore inhibition of LOC254531 (Accession XM_170773). Accordingly, utilities of VGAM419 include diagnosis, prevention and treatment of diseases and clinical conditions associated with LOC254531. LOC90594 (Accession XM_032820) is another VGAM419 host target gene. LOC90594 BINDING SITE is HOST TARGET binding site found in the 3' untranslated region of mRNA encoded by LOC90594, corresponding to a HOST TARGET binding site such as BINDING SITE I, BINDING SITE II or BINDING SITE III. Table 2 illustrates the complementarity of the nucleotide sequences of LOC90594 BINDING SITE, designated SEQ ID:31775, to the nucleotide sequence of VGAM419 RNA, herein designated VGAM RNA, also designated SEQ ID:3130.

Another function of VGAM419 is therefore inhibition of LOC90594 (Accession XM_032820). Accordingly, utilities of VGAM419 include diagnosis, prevention and treatment of diseases and clinical conditions associated with LOC90594. LOC90918 (Accession XM_034863) is another VGAM419 host target gene. LOC90918 BINDING SITE is HOST TARGET binding site found in the 5' untranslated region of mRNA encoded by LOC90918, corresponding to a HOST TARGET binding site such as BINDING SITE I, BINDING SITE II or BINDING SITE III. Table 2 illustrates the complementarity of the nucleotide sequences of LOC90918 BINDING SITE, designated SEQ ID:32178, to the nucleotide sequence of VGAM419 RNA, herein designated VGAM RNA, also designated SEQ ID:3130.

Another function of VGAM419 is therefore inhibition of LOC90918 (Accession XM_034863). Accordingly, utilities of VGAM419 include diagnosis, prevention and treatment of diseases and clinical conditions associated with LOC90918. FIG. 1 further provides a conceptual description of a novel bioinformatically detected viral gene of the present invention, referred to here as Viral Genomic Address Messenger 420 (VGAM420) viral gene, which modulates expression of respective host target genes thereof, the function and utility of which host target genes is known in the art.

VGAM420 is a novel bioinformatically detected regulatory, non protein coding, viral micro RNA (miRNA) gene. The method by which VGAM420 was detected is described hereinabove with reference to FIGS. 1-8.

VGAM420 gene, herein designated VGAM GENE, is a viral gene contained in the genome of Human Papillomavirus Type 39. VGAM420 host target gene, herein designated VGAM HOST TARGET GENE, is a human gene contained in the human genome.

VGAM420 gene encodes a VGAM420 precursor RNA, herein designated VGAM PRECURSOR RNA. Similar to other miRNA genes, and unlike most ordinary genes, VGAM420 precursor RNA does not encode a protein. A nucleotide sequence identical or highly similar to the nucleotide sequence of VGAM420 precursor RNA is designated SEQ ID:406, and is provided hereinbelow with reference to the sequence listing part. Nucleotide sequence SEQ ID:406 is located at position 5287 relative to the genome of Human Papillomavirus Type 39.

VGAM420 precursor RNA folds onto itself, forming VGAM420 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM420 folded precursor RNA into VGAM420 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM420 RNA is designated SEQ ID:3131, and is provided hereinbelow with reference to the sequence listing part.

VGAM420 host target gene, herein designated VGAM HOST TARGET GENE, encodes a corresponding messenger RNA, VGAM420 host target RNA, herein designated VGAM HOST TARGET RNA. VGAM420 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM420 RNA, herein designated VGAM RNA, binds complementarily to one or more host target binding sites located in untranslated regions of VGAM420 host target RNA, herein designated VGAM HOST TARGET RNA. This complementary binding is due to the fact that the nucleotide sequence of VGAM420 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM420 RNA, herein designated VGAM RNA, may have a different number of host target binding sites in untranslated regions of a VGAM420 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM420 RNA, herein designated VGAM RNA, to host target binding sites on VGAM420 host target RNA, herein designated VGAM HOST TARGET RNA, such as BINDING SITE I, BINDING SITE II and BINDING SITE III, inhibits translation of VGAM420 host target RNA into VGAM420 host target protein, herein designated VGAM HOST TARGET PROTEIN. VGAM host target protein is therefore outlined by a broken line.

It is appreciated that VGAM420 host target gene, herein designated VGAM HOST TARGET GENE, in fact represents a plurality of VGAM420 host target genes. The mRNA of each one of this plurality of VGAM420 host target genes comprises one or more host target binding sites, each having a nucleotide sequence which is at least partly complementary to VGAM420 RNA, herein designated VGAM RNA, and which when bound by VGAM420 RNA causes inhibition of translation of respective one or more VGAM420 host target proteins.

It is further appreciated by one skilled in the art that the mode of translational inhibition illustrated by FIG. 1 with specific reference to translational inhibition exerted by VGAM420 gene, herein designated VGAM GENE, on one or more VGAM420 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM420 is inhibition of expression of host target genes, as part of a novel viral mechanism of attacking a host. Accordingly, utilities of VGAM420 include diagnosis, prevention and treatment of viral infection by Human Papillomavirus Type 39. Specific functions, and accordingly utilities, of VGAM420 correlate with, and may be deduced from, the identity of the host target genes which VGAM420 binds and inhibits, and the function of these host target genes, as elaborated hereinbelow.

Nucleotide sequences of the VGAM420 precursor RNA, herein designated VGAM PRECURSOR RNA, and of the 'diced' VGAM420 RNA, herein designated VGAM RNA, and a schematic representation of the secondary folding of VGAM420 folded precursor RNA, herein designated VGAM FOLDED PRECURSOR RNA, of VGAM420 are further described hereinbelow with reference to Table 1.

Nucleotide sequences of host target binding sites, such as BINDING SITE-I, BINDING SITE-II and BINDING SITE-III of FIG. 1, found on VGAM420 host target RNA, and schematic representation of the complementarity of each of these host target binding sites to VGAM420 RNA, herein designated VGAM RNA, are described hereinbelow with reference to Table 2.

As mentioned hereinabove with reference to FIG. 1, a function of VGAM420 gene, herein designated VGAM is inhibition of expression of VGAM420 target genes. It is appreciated that specific functions, and accordingly utilities, of VGAM420 correlate with, and may be deduced from, the identity of the target genes which VGAM420 binds and inhibits, and the function of these target genes, as elaborated hereinbelow.

Contactin 3 (plasmacytoma associated) (CNTN3, Accession XM_039627) is a VGAM420 host target gene. CNTN3 BINDING SITE is HOST TARGET binding site found in the 3' untranslated region of mRNA encoded by CNTN3, corresponding to a HOST TARGET binding site such as BINDING SITE I, BINDING SITE II or BINDING SITE III. Table 2 illustrates the complementarity of the nucleotide sequences of CNTN3 BINDING SITE, designated SEQ ID:33131, to the nucleotide sequence of VGAM420 RNA, herein designated VGAM RNA, also designated SEQ ID:3131.

A function of VGAM420 is therefore inhibition of Contactin 3 (plasmacytoma associated) (CNTN3, Accession XM_039627), a gene which may play a role in the initial growth and guidance of axons. Accordingly, utilities of VGAM420 include diagnosis, prevention and treatment of diseases and clinical conditions associated with CNTN3. The function of CNTN3 has been established by previous studies. Pang, a mouse gene encoding a neuronal adhesion molecule, was isolated as a plasmacytoma-specific transcript using an RT-PCR-based strategy in an attempt to isolate Myc-like genes in murine plasmacytomas (Connelly et al., 1994). Pang is a member of the immunoglobulin/fibronectin superfamily of adhesion molecules; its closest relatives, TAG1 (OMIM Ref. No. 190197) and contactin 1 (OMIM Ref. No. 600016), promote axon growth and migration. The normal site of Pang expression is the brain, where it is detected as 4.0- and 6.1-kb RNAs on Northern blots; Pang is not detected in other normal tissues. Abnormally sized Pang transcripts were uniquely found in murine plasmacytomas, where it is ectopically activated by intracisternal A-type particle long terminal repeats. Mock et al. (1996) mapped the Pang gene to mouse chromosome 6 by somatic cell hybrid analysis and further positioned it on the chromosome between Wnt7a and Pcp1. Southern blot analysis of human-rodent somatic cell hybrids together with predictions from the mouse map location indicated that human PANG is located at 3p26

Full details of the abovementioned studies are described in the following publications, the disclosure of which are hereby incorporated by reference:

Connelly, M. A.; Grady, R. C.; Mushinski, J. F.; Marcu, K. B.: PANG, a gene encoding a neuronal glycoprotein, is ectopically activated by intracisternal A-type particle long terminal repeats in murine plasmacytomas. Proc. Nat. Acad. Sci. 91:1337-1341, 1994; and Mock, B. A.; Connelly, M. A.; McBride, O. W.; Kozak, C. A.; Marcu, K. B.: Plasmacytoma-associated neuronal glycoprotein, Pang, maps to mouse chromosome 6 and human chromosome 3. Genomic.

Further studies establishing the function and utilities of CNTN3 are found in John Hopkins OMIM database record ID 601325, and in sited publications numbered 9388-9389 listed in the bibliography section hereinbelow, which are also hereby incorporated by reference. Heme Oxygenase (decycling) 1 (HMOX1, Accession NM_002133) is another VGAM420 host target gene. HMOX1 BINDING SITE is HOST TARGET binding site found in the 3' untranslated region of mRNA encoded by HMOX1, corresponding to a HOST TARGET binding site such as BINDING SITE I, BINDING SITE II or BINDING SITE III. Table 2 illustrates the complementarity of the nucleotide sequences of HMOX1 BINDING SITE, designated SEQ ID:7909, to the nucleotide sequence of VGAM420 RNA, herein designated VGAM RNA, also designated SEQ ID:3131.

Another function of VGAM420 is therefore inhibition of Heme Oxygenase (decycling) 1 (HMOX1, Accession NM_002133). Accordingly, utilities of VGAM420 include diagnosis, prevention and treatment of diseases and clinical conditions associated with HMOX1. Nuclear Receptor Coactivator 4 (NCOA4, Accession NM_005437) is another VGAM420 host target gene. NCOA4 BINDING SITE is HOST TARGET binding site found in the 3' untranslated region of mRNA encoded by NCOA4, corresponding to a HOST TARGET binding site such as BINDING SITE I, BINDING SITE II or BINDING SITE III. Table 2 illustrates the complementarity of the nucleotide sequences of NCOA4 BINDING SITE, designated SEQ ID:11921, to the nucleotide sequence of VGAM420 RNA, herein designated VGAM RNA, also designated SEQ ID:3131.

Another function of VGAM420 is therefore inhibition of Nuclear Receptor Coactivator 4 (NCOA4, Accession NM_005437), a gene which Binds and activates androgen receptor (AR) in ligand-dependent manner. Accordingly, utilities of VGAM420 include diagnosis, prevention and treatment of diseases and clinical conditions associated with NCOA4. The function of NCOA4 has been established by previous studies. The PTC3 oncogene (RET/PTC3) is an activated form of the RET proto-oncogene (OMIM Ref. No. 164761), which is frequently rearranged in papillary thyroid carcinoma (OMIM Ref. No. 188550). RET/PTC3 results from a structural rearrangement between the ELE1 and RET genes (Bongarzone et al., 1994), and has been observed in both sporadic and radiation-associated post-Chernobyl papillary thyroid carcinoma. To understand the molecular basis that predisposes RET and ELE1 genes to be recurrent targets of 'illegitimate' recombination, Bongarzone et al. (1997) examined the genomic regions containing the ELE1/RET breakpoints in 6 Italian sporadic, RET/PTC3-positive tumors and 3 radiation-associated tumors from children living in areas contaminated by the Chernobyl accident; the latter tumors also expressed RET/PTC3 oncogene. They found that the breakpoints in both genes clustered in regions that they designated ELE1-bcr (OMIM Ref. No. 1.8 kb) and RET-bcr (OMIM Ref. No. 1.9 kb). In all sporadic tumors and in 1 post-Chernobyl tumor, the ELE1/RET recombination corresponded with short sequences of homology (3 to 7 bp) between the 2 rearranging genes. In addition, Bongarzone et al. (1997) observed an interesting distribution of the post-Chernobyl breakpoints in ELE1-bcr located within an Alu element, or between 2 close Alu elements, and always in AT-rich regions. In the case of the ELE1/RET fusion gene, the 5-prime end of ELE1 is fused to the tyrosine kinase portion of the RET gene. See 601985 for discussion of the PTC1 chimeric oncogene. Androgen receptor (AR; 313700) is a transcriptional factor that belongs to the steroid receptor superfamily based on its structural similarities. Yeh and Chang (1996) noted that members of this family are characterized by 3 major structural regions: a variable amino-terminal domain, a highly conserved cysteine-rich DNA-binding domain, and a carboxyl-terminal ligand-binding domain. When bound to androgens and a cis-acting androgen-responsive element, AR can up- or down-regulate the expression of androgen target genes through a complicated process that may require other adaptors or coactivators. The fundamental issue in the regulation of steroid hormones is the question of how specific transcription can be achieved in vivo when several receptors, such as AR, glucocorticoid receptor (OMIM Ref. No. 138040), and progesterone receptor (OMIM Ref. No. 607311) can recognize the same DNA sequence. It had been speculated that some accessory factors may selectively interact with the androgen receptor to determine the specificity of AR target gene activation. Using a yeast 2-hybrid system, Yeh and Chang (1996) cloned and characterized a specific AR coactivator. They designated the coactivator ARA(70). The cDNA they isolated encodes a 614-amino acid polypeptide with a predicted molecular weight of 70 kD. The predicted protein shares 99% homology with that encoded by a cDNA clone called RET-fused gene (RFG) that was isolated previously from human thyroid by Santoro et al. (1994). Yeh and Chang (1996) showed that ARA(70) is a ligand-dependent AR-associated protein which functions in human prostate cancer cells as an activator to enhance AR transcriptional activity 10-fold in the presence of dihydrotestosterone or testosterone, but not hydroxyflutamide. ARA(70) induced only slightly the transcriptional activity of other steroid receptors such as estrogen receptor (OMIM Ref. No. 133430) in human prostate cancer cells.

Full details of the abovementioned studies are described in the following publications, the disclosure of which are hereby incorporated by reference:

Bongarzone, I.; Butti, M. G.; Fugazzola, L.; Pacini, F.; Pinchera, A.; Vorontsova, T. V.; Demidchik, E. P.; Pierotti, M. A.: Comparison of the breakpoint regions of ELE1 and RET genes involved in the generation of RET/PTC3 oncogene in sporadic and in radiation-associated papillary thyroid carcinomas. Genomics 42: 252-259, 1997; and Lim, H. N.; Hawkins, J. R.; Hughes, I. A.: Genetic evidence to exclude the androgen receptor co-factor, ARA70 (NCOA4) as a candidate gene for the causation of undermasculinised genital.

Further studies establishing the function and utilities of NCOA4 are found in John Hopkins OMIM database record ID 601984, and in sited publications numbered 10594-8896 listed in the bibliography section hereinbelow, which are also hereby incorporated by reference. Neurogenic Differentiation 1 (NEUROD1, Accession NM_002500) is another VGAM420 host target gene. NEUROD1 BINDING SITE is HOST TARGET binding site found in the 3' untranslated region of mRNA encoded by NEUROD1, corresponding to a HOST TARGET binding site such as BINDING SITE I, BINDING SITE II or BINDING SITE III. Table 2 illustrates the complementarity of the nucleotide sequences of NEUROD1 BINDING SITE, designated SEQ ID:8322, to the nucleotide sequence of VGAM420 RNA, herein designated VGAM RNA, also designated SEQ ID:3131.

Another function of VGAM420 is therefore inhibition of Neurogenic Differentiation 1 (NEUROD1, Accession NM_002500), a gene which acts as a differentiation factor during neurogenesis. Accordingly, utilities of VGAM420 include diagnosis, prevention and treatment of diseases and clinical conditions associated with NEUROD1. The function of NEUROD1 and its association with various diseases and clinical conditions, has been established by previous studies, as described hereinabove with reference to VGAM130. Phosphodiesterase 4D, CAMP-specific (phosphodiesterase E3 dunce homolog, Drosophila) (PDE4D, Accession XM_056815) is another VGAM420 host target gene. PDE4D BINDING SITE is HOST TARGET binding site found in the 3' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36424, to the nucleotide sequence of VGAM420 RNA, herein designated VGAM RNA, also designated SEQ ID:3131.

Another function of VGAM420 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM420 include diagnosis, prevention and treatment of diseases and clinical conditions associated with PDE4D. The function of PDE4D and its association with various diseases and clinical conditions, has been established by previous studies, as described hereinabove with reference to VGAM180. Apolipoprotein L, 6 (APOL6, Accession NM_030641) is another VGAM420 host target gene. APOL6 BINDING SITE is HOST TARGET binding site found in the 3' untranslated region of mRNA encoded by APOL6, corresponding to a HOST TARGET binding site such as BINDING SITE I, BINDING SITE II or BINDING SITE III. Table 2 illustrates the complementarity of the nucleotide sequences of APOL6 BINDING SITE, designated SEQ ID:24973, to the nucleotide sequence of VGAM420 RNA, herein designated VGAM RNA, also designated SEQ ID:3131.

Another function of VGAM420 is therefore inhibition of Apolipoprotein L, 6 (APOL6, Accession NM_030641). Accordingly, utilities of VGAM420 include diagnosis, prevention and treatment of diseases and clinical conditions associated with APOL6. DKFZP761L0424 (Accession XM_166112) is another VGAM420 host target gene. DKFZP761L0424 BINDING SITE is HOST TARGET binding site found in the 3' untranslated region of mRNA encoded by DKFZP761L0424, corresponding to a HOST TARGET binding site such as BINDING SITE I, BINDING SITE II or BINDING SITE III. Table 2 illustrates the complementarity of the nucleotide sequences of DKFZP761L0424 BINDING SITE, designated SEQ ID:43891, to the nucleotide sequence of VGAM420 RNA, herein designated VGAM RNA, also designated SEQ ID:3131.

Another function of VGAM420 is therefore inhibition of DKFZP761L0424 (Accession XM_166112). Accordingly, utilities of VGAM420 include diagnosis, prevention and treatment of diseases and clinical conditions associated with DKFZP761L0424. FLJ20312 (Accession NM_017761) is another VGAM420 host target gene. FLJ20312 BINDING SITE is HOST TARGET binding site found in the 3' untranslated region of mRNA encoded by FLJ20312, corresponding to a HOST TARGET binding site such as BINDING SITE I, BINDING SITE II or BINDING SITE III. Table 2 illustrates the complementarity of the nucleotide sequences of FLJ20312 BINDING SITE, designated SEQ ID:19372, to the nucleotide sequence of VGAM420 RNA, herein designated VGAM RNA, also designated SEQ ID:3131.

Another function of VGAM420 is therefore inhibition of FLJ20312 (Accession NM_017761). Accordingly, utilities of VGAM420 include diagnosis, prevention and treatment of diseases and clinical conditions associated with FLJ20312. KIAA1950 (Accession XM_166532) is another VGAM420 host target gene. KIAA1950 BINDING SITE is HOST TARGET binding site found in the 3' untranslated region of mRNA encoded by KIAA1950, corresponding to a HOST TARGET binding site such as BINDING SITE I, BINDING SITE II or BINDING SITE III. Table 2 illustrates the complementarity of the nucleotide sequences of KIAA1950 BINDING SITE, designated SEQ ID:44481, to the nucleotide sequence of VGAM420 RNA, herein designated VGAM RNA, also designated SEQ ID:3131.

Another function of VGAM420 is therefore inhibition of KIAA1950 (Accession XM_166532). Accordingly, utilities of VGAM420 include diagnosis, prevention and treatment of diseases and clinical conditions associated with KIAA1950. MGC5391 (Accession NM_032740) is another VGAM420 host target gene. MGC5391 BINDING SITE is HOST TARGET binding site found in the 3' untranslated region of mRNA encoded by MGC5391, corresponding to a HOST TARGET binding site such as BINDING SITE I, BINDING SITE II or BINDING SITE III. Table 2 illustrates the complementarity of the nucleotide sequences of MGC5391 BINDING SITE, designated SEQ ID:26470, to the nucleotide sequence of VGAM420 RNA, herein designated VGAM RNA, also designated SEQ ID:3131.

Another function of VGAM420 is therefore inhibition of MGC5391 (Accession NM_032740). Accordingly, utilities of VGAM420 include diagnosis, prevention and treatment of diseases and clinical conditions associated with MGC5391. RING1 and YY1 Binding Protein (RYBP, Accession XM_002853) is another VGAM420 host target gene. RYBP BINDING SITE is HOST TARGET binding site found in the 5' untranslated region of mRNA encoded by RYBP, corresponding to a HOST TARGET binding site such as BINDING SITE I, BINDING SITE II or BINDING SITE III. Table 2 illustrates the complementarity of the nucleotide sequences of RYBP BINDING SITE, designated SEQ ID:29907, to the nucleotide sequence of VGAM420 RNA, herein designated VGAM RNA, also designated SEQ ID:3131.

Another function of VGAM420 is therefore inhibition of RING1 and YY1 Binding Protein (RYBP, Accession XM_002853). Accordingly, utilities of VGAM420 include diagnosis, prevention and treatment of diseases and clinical conditions associated with RYBP. LOC255533 (Accession XM_173073) is another VGAM420 host target gene. LOC255533 BINDING SITE is HOST TARGET binding site found in the 5' untranslated region of mRNA encoded by LOC255533, corresponding to a HOST TARGET binding site such as BINDING SITE I, BINDING SITE II or BINDING SITE III. Table 2 illustrates the complementarity of the nucleotide sequences of LOC255533 BINDING SITE, designated SEQ ID:46328, to the nucleotide sequence of VGAM420 RNA, herein designated VGAM RNA, also designated SEQ ID:3131.

Another function of VGAM420 is therefore inhibition of LOC255533 (Accession XM_173073). Accordingly, utilities of VGAM420 include diagnosis, prevention and treatment of diseases and clinical conditions associated with LOC255533. FIG. 1 further provides a conceptual description of a novel bioinformatically detected viral gene of the present invention, referred to here as Viral Genomic Address Messenger 421 (VGAM421) viral gene, which modulates expression of respective host target genes thereof, the function and utility of which host target genes is known in the art.

VGAM421 is a novel bioinformatically detected regulatory, non protein coding, viral micro RNA (miRNA) gene. The method by which VGAM421 was detected is described hereinabove with reference to FIGS. 1-8.

VGAM421 gene, herein designated VGAM GENE, is a viral gene contained in the genome of Human Papillomavirus Type 39. VGAM421 host target gene, herein designated VGAM HOST TARGET GENE, is a human gene contained in the human genome.

VGAM421 gene encodes a VGAM421 precursor RNA, herein designated VGAM PRECURSOR RNA. Similar to other miRNA genes, and unlike most ordinary genes, VGAM421 precursor RNA does not encode a protein. A nucleotide sequence identical or highly similar to the nucleotide sequence of VGAM421 precursor RNA is designated SEQ ID:407, and is provided hereinbelow with reference to the sequence listing part. Nucleotide sequence SEQ ID:407 is located at position 4323 relative to the genome of Human Papillomavirus Type 39.

VGAM421 precursor RNA folds onto itself, forming VGAM421 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM421 folded precursor RNA into VGAM421 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM421 RNA is designated SEQ ID:3132, and is provided hereinbelow with reference to the sequence listing part.

VGAM421 host target gene, herein designated VGAM HOST TARGET GENE, encodes a corresponding messenger RNA, VGAM421 host target RNA, herein designated VGAM HOST TARGET RNA. VGAM421 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM421 RNA, herein designated VGAM RNA, binds complementarily to one or more host target binding sites located in untranslated regions of VGAM421 host target RNA, herein designated VGAM HOST TARGET RNA. This complementary binding is due to the fact that the nucleotide sequence of VGAM421 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM421 RNA, herein designated VGAM RNA, may have a different number of host target binding sites in untranslated regions of a VGAM421 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM421 RNA, herein designated VGAM RNA, to host target binding sites on VGAM421 host target RNA, herein designated VGAM HOST TARGET RNA, such as BINDING SITE I, BINDING SITE II and BINDING SITE III, inhibits translation of VGAM421 host target RNA into VGAM421 host target protein, herein designated VGAM HOST TARGET PROTEIN. VGAM host target protein is therefore outlined by a broken line.

It is appreciated that VGAM421 host target gene, herein designated VGAM HOST TARGET GENE, in fact represents a plurality of VGAM421 host target genes. The mRNA of each one of this plurality of VGAM421 host target genes comprises one or more host target binding sites, each having a nucleotide sequence which is at least partly complementary to VGAM421 RNA, herein designated VGAM RNA, and which when bound by VGAM421 RNA causes inhibition of translation of respective one or more VGAM421 host target proteins.

It is further appreciated by one skilled in the art that the mode of translational inhibition illustrated by FIG. 1 with specific reference to translational inhibition exerted by VGAM421 gene, herein designated VGAM GENE, on one or more VGAM421 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM421 is inhibition of expression of host target genes, as part of a novel viral mechanism of attacking a host. Accordingly, utilities of VGAM421 include diagnosis, prevention and treatment of viral infection by Human Papillomavirus Type 39. Specific functions, and accordingly utilities, of VGAM421 correlate with, and may be deduced from, the identity of the host target genes which VGAM421 binds and inhibits, and the function of these host target genes, as elaborated hereinbelow.

Nucleotide sequences of the VGAM421 precursor RNA, herein designated VGAM PRECURSOR RNA, and of the 'diced' VGAM421 RNA, herein designated VGAM RNA, and a schematic representation of the secondary folding of VGAM421 folded precursor RNA, herein designated VGAM FOLDED PRECURSOR RNA, of VGAM421 are further described hereinbelow with reference to Table 1.

Nucleotide sequences of host target binding sites, such as BINDING SITE-I, BINDING SITE-II and BINDING SITE-III of FIG. 1, found on VGAM421 host target RNA, and schematic representation of the complementarity of each of these host target binding sites to VGAM421 RNA, herein designated VGAM RNA, are described hereinbelow with reference to Table 2.

As mentioned hereinabove with reference to FIG. 1, a function of VGAM421 gene, herein designated VGAM is inhibition of expression of VGAM421 target genes. It is appreciated that specific functions, and accordingly utilities, of VGAM421 correlate with, and may be deduced from, the identity of the target genes which VGAM421 binds and inhibits, and the function of these target genes, as elaborated hereinbelow.

MADS Box Transcription Enhancer Factor 2, Polypeptide C (myocyte enhancer factor 2C) (MEF2C, Accession NM_002397) is a VGAM421 host target gene. MEF2C BINDING SITE is HOST TARGET binding site found in the 3" untranslated region of mRNA encoded by MEF2C, corresponding to a HOST TARGET binding site such as BINDING SITE I, BINDING SITE II or BINDING SITE III. Table 2 illustrates the complementarity of the nucleotide sequences of MEF2C BINDING SITE, designated SEQ ID:8210, to the nucleotide sequence of VGAM421 RNA, herein designated VGAM RNA, also designated SEQ ID:3132.

A function of VGAM421 is therefore inhibition of MADS Box Transcription Enhancer Factor 2, Polypeptide C (myocyte enhancer factor 2C) (MEF2C, Accession NM_002397), a gene which regulates muscle-specific and mitogen-inducible genes. Accordingly, utilities of VGAM421 include diagnosis, prevention and treatment of diseases and clinical conditions associated with MEF2C. The function of MEF2C and its association with various diseases and clinical conditions, has been established by previous studies, as described hereinabove with reference to VGAM386. Sal-like 1 (Drosophila) (SALL1, Accession NM_002968) is another VGAM421 host target gene. SALL1 BINDING SITE is HOST TARGET binding site found in the 3' untranslated region of mRNA encoded by SALL1, corresponding to a HOST TARGET binding site such as BINDING SITE I, BINDING SITE II or BINDING SITE III. Table 2 illustrates the complementarity of the nucleotide sequences of SALL1 BINDING SITE, designated SEQ ID:8880, to the nucleotide sequence of VGAM421 RNA, herein designated VGAM RNA, also designated SEQ ID:3132.

Another function of VGAM421 is therefore inhibition of Sal-like 1 (Drosophila) (SALL1, Accession NM_002968). Accordingly, utilities of VGAM421 include diagnosis, prevention and treatment of diseases and clinical conditions associated with SALL1. Enabled Homolog (Drosophila) (ENAH, Accession NM_018212) is another VGAM421 host target gene. ENAH BINDING SITE is HOST TARGET binding site found in the 3' untranslated region of mRNA encoded by ENAH, corresponding to a HOST TARGET binding site such as BINDING SITE I, BINDING SITE II or BINDING SITE III. Table 2 illustrates the complementarity of the nucleotide sequences of ENAH BINDING SITE, designated SEQ ID:20126, to the nucleotide sequence of VGAM421 RNA, herein designated VGAM RNA, also designated SEQ ID:3132.

Another function of VGAM421 is therefore inhibition of Enabled Homolog (Drosophila) (ENAH, Accession NM_018212). Accordingly, utilities of VGAM421 include diagnosis, prevention and treatment of diseases and clinical conditions associated with ENAH. KIAA0556 (Accession XM_044632) is another VGAM421 host target gene. KIAA0556 BINDING SITE is HOST TARGET binding site found in the 3' untranslated region of mRNA encoded by KIAA0556, corresponding to a HOST TARGET binding site such as BINDING SITE I, BINDING SITE II or BINDING SITE III. Table 2 illustrates the complementarity of the nucleotide sequences of KIAA0556 BINDING SITE, designated SEQ ID:34249, to the nucleotide sequence of VGAM421 RNA, herein designated VGAM RNA, also designated SEQ ID:3132.

Another function of VGAM421 is therefore inhibition of KIAA0556 (Accession XM_044632). Accordingly, utilities of VGAM421 include diagnosis, prevention and treatment of diseases and clinical conditions associated with KIAA0556. KIAA0648 (Accession XM_094043) is another VGAM421 host target gene. KIAA0648 BINDING SITE is HOST TARGET binding site found in the 3' untranslated region of mRNA encoded by KIAA0648, corresponding to a HOST TARGET binding site such as BINDING SITE I, BINDING SITE II or BINDING SITE III. Table 2 illustrates the complementarity of the nucleotide sequences of KIAA0648 BINDING SITE, designated SEQ ID:40220, to the nucleotide sequence of VGAM421 RNA, herein designated VGAM RNA, also designated SEQ ID:3132.

Another function of VGAM421 is therefore inhibition of KIAA0648 (Accession XM_094043). Accordingly, utilities of VGAM421 include diagnosis, prevention and treatment of diseases and clinical conditions associated with KIAA0648. LOC143465 (Accession XM_096430) is another VGAM421 host target gene. LOC143465 BINDING SITE is HOST TARGET binding site found in the 5' untranslated region of mRNA encoded by LOC143465, corresponding to a HOST TARGET binding site such as BINDING SITE I, BINDING SITE II or BINDING SITE III. Table 2 illustrates the complementarity of the nucleotide sequences of LOC143465 BINDING SITE, designated SEQ ID:40361, to the nucleotide sequence of VGAM421 RNA, herein designated VGAM RNA, also designated SEQ ID:3132.

Another function of VGAM421 is therefore inhibition of LOC143465 (Accession XM_096430). Accordingly, utilities of VGAM421 include diagnosis, prevention and treatment of diseases and clinical conditions associated with LOC143465. LOC147599 (Accession XM_097253) is another VGAM421 host target gene. LOC147599 BINDING SITE is HOST TARGET binding site found in the 3' untranslated region of mRNA encoded by LOC147599, corresponding to a HOST TARGET binding site such as BINDING SITE I, BINDING SITE II or BINDING SITE III. Table 2 illustrates the complementarity of the nucleotide sequences of LOC147599 BINDING SITE, designated SEQ ID:40847, to the nucleotide sequence of VGAM421 RNA, herein designated VGAM RNA, also designated SEQ ID:3132.

Another function of VGAM421 is therefore inhibition of LOC147599 (Accession XM_097253). Accordingly, utilities of VGAM421 include diagnosis, prevention and treatment of diseases and clinical conditions associated with LOC147599. FIG. 1 further provides a conceptual description of a novel bioinformatically detected viral gene of the present invention, referred to here as Viral Genomic Address Messenger 422 (VGAM422) viral gene, which modulates expression of respective host target genes thereof, the function and utility of which host target genes is known in the art.

VGAM422 is a novel bioinformatically detected regulatory, non protein coding, viral micro RNA (miRNA) gene. The method by which VGAM422 was detected is described hereinabove with reference to FIGS. 1-8.

VGAM422 gene, herein designated VGAM GENE, is a viral gene contained in the genome of Canine Parvovirus. VGAM422 host target gene, herein designated VGAM HOST TARGET GENE, is a human gene contained in the human genome.

VGAM422 gene encodes a VGAM422 precursor RNA, herein designated VGAM PRECURSOR RNA. Similar to other miRNA genes, and unlike most ordinary genes, VGAM422 precursor RNA does not encode a protein. A nucleotide sequence identical or highly similar to the nucleotide sequence of VGAM422 precursor RNA is designated SEQ ID:408, and is provided hereinbelow with reference to the sequence listing part. Nucleotide sequence SEQ ID:408 is located at position 1869 relative to the genome of Canine Parvovirus.

VGAM422 precursor RNA folds onto itself, forming VGAM422 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM422 folded precursor RNA into VGAM422 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM422 RNA is designated SEQ ID:3133, and is provided hereinbelow with reference to the sequence listing part.

VGAM422 host target gene, herein designated VGAM HOST TARGET GENE, encodes a corresponding messenger RNA, VGAM422 host target RNA, herein designated VGAM HOST TARGET RNA. VGAM422 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM422 RNA, herein designated VGAM RNA, binds complementarily to one or more host target binding sites located in untranslated regions of VGAM422 host target RNA, herein designated VGAM HOST TARGET RNA. This complementary binding is due to the fact that the nucleotide sequence of VGAM422 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM422 RNA, herein designated VGAM RNA, may have a different number of host target binding sites in untranslated regions of a VGAM422 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM422 RNA, herein designated VGAM RNA, to host target binding sites on VGAM422 host target RNA, herein designated VGAM HOST TARGET RNA, such as BINDING SITE I, BINDING SITE II and BINDING SITE III, inhibits translation of VGAM422 host target RNA into VGAM422 host target protein, herein designated VGAM HOST TARGET PROTEIN. VGAM host target protein is therefore outlined by a broken line.

It is appreciated that VGAM422 host target gene, herein designated VGAM HOST TARGET GENE, in fact represents a plurality of VGAM422 host target genes. The mRNA of each one of this plurality of VGAM422 host target genes comprises one or more host target binding sites, each having a nucleotide sequence which is at least partly complementary to VGAM422 RNA, herein designated VGAM RNA, and which when bound by VGAM422 RNA causes inhibition of translation of respective one or more VGAM422 host target proteins.

It is further appreciated by one skilled in the art that the mode of translational inhibition illustrated by FIG. 1 with specific reference to translational inhibition exerted by VGAM422 gene, herein designated VGAM GENE, on one or more VGAM422 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM422 is inhibition of expression of host target genes, as part of a novel viral mechanism of attacking a host. Accordingly, utilities of VGAM422 include diagnosis, prevention and treatment of viral infection by Canine Parvovirus. Specific functions, and accordingly utilities, of VGAM422 correlate with, and may be deduced from, the identity of the host target genes which VGAM422 binds and inhibits, and the function of these host target genes, as elaborated hereinbelow.

Nucleotide sequences of the VGAM422 precursor RNA, herein designated VGAM PRECURSOR RNA, and of the 'diced' VGAM422 RNA, herein designated VGAM RNA, and a schematic representation of the secondary folding of VGAM422 folded precursor RNA, herein designated VGAM FOLDED PRECURSOR RNA, of VGAM422 are further described hereinbelow with reference to Table 1.

Nucleotide sequences of host target binding sites, such as BINDING SITE-I, BINDING SITE-II and BINDING SITE-III of FIG. 1, found on VGAM422 host target RNA, and schematic representation of the complementarity of each of these host target binding sites to VGAM422 RNA, herein designated VGAM RNA, are described hereinbelow with reference to Table 2.

As mentioned hereinabove with reference to FIG. 1, a function of VGAM422 gene, herein designated VGAM is inhibition of expression of VGAM422 target genes. It is appreciated that specific functions, and accordingly utilities, of VGAM422 correlate with, and may be deduced from, the identity of the target genes which VGAM422 binds and inhibits, and the function of these target genes, as elaborated hereinbelow.

Pumilio Homolog 1 (Drosophila) (PUM1, Accession NM_014676) is a VGAM422 host target gene. PUM1 BINDING SITE is HOST TARGET binding site found in the 3' untranslated region of mRNA encoded by PUM1, corresponding to a HOST TARGET binding site such as BINDING SITE I, BINDING SITE II or BINDING SITE III. Table 2 illustrates the complementarity of the nucleotide sequences of PUM1 BINDING SITE, designated SEQ ID:16147, to the nucleotide sequence of VGAM422 RNA, herein designated VGAM RNA, also designated SEQ ID:3133.

A function of VGAM422 is therefore inhibition of Pumilio Homolog 1 (Drosophila) (PUM1, Accession NM_014676), a gene which is a human homolog of the Drosophila Pumilio protein. Accordingly, utilities of VGAM422 include diagnosis, prevention and treatment of diseases and clinical conditions associated with PUM1. The function of PUM1 has been established by previous studies. By sequencing cDNAs randomly selected from a cDNA library derived from the human immature myeloid cell line KG-1, Nagase et al. (1995) isolated a cDNA encoding PUM1, a human homolog of the Drosophila Pumilio protein, which they designated KIAA0099. The predicted 1,186-amino acid KIAA0099 protein is 42.1% identical to Drosophila Pumilio over an 875-amino acid region. Northern blot analysis detected expression of KIAA0099 in all tissues tested. Wang et al. (2002) determined the structure of the RNA-binding domain of human PUM1 bound to a high-affinity RNA ligand. The RNA binds the concave surface of the molecule, where each of the protein's 8 repeats makes contact with a different RNA base via 3 amino acid side chains at conserved positions. Wang et al. (2002) mutated these 3 side chains in 1 repeat, thereby altering the sequence specificity of PUM1. They concluded that the high affinity and specificity of the PUM homology domain for RNA is achieved using multiple copies of a simple repeated motif.

Full details of the abovementioned studies are described in the following publications, the disclosure of which are hereby incorporated by reference:

Nagase, T; Miyajima, N; Tanaka, A.; Sazuka, T.; Seki, N.; Sato, S.; Tabata, S.; Ishikawa, K.; Kawarabayashi, Y.; Kotani, H.; Nomura, N.: Prediction of the coding sequences of unidentified human genes. III. The coding sequences of 40 new genes (KIAA0081-KIAA0120) deduced by analysis of cDNA clones from human cell line KG-1. DNA Res. 2:37-43, 1995; and Wang, X.; McLachlan, J.; Zamore, P. D.; Hall, T. M. T.: Modular recognition of RNA by a human pumilio-homology domain. Cell 110:501-512, 2002.

Further studies establishing the function and utilities of PUM1 are found in John Hopkins OMIM database record ID 607204, and in sited publications numbered 6726 listed in the bibliography section hereinbelow, which are also hereby incorporated by reference. SRY (sex determining region Y)-box 13 (SOX13, Accession NM_005686) is another VGAM422 host target gene. SOX13 BINDING SITE is HOST TARGET binding site found in the 3' untranslated region of mRNA encoded by SOX13, corresponding to a HOST TARGET binding site such as BINDING SITE I, BINDING SITE II or BINDING SITE III. Table 2 illustrates the complementarity of the nucleotide sequences of SOX13 BINDING SITE, designated SEQ ID:12241, to the nucleotide sequence of VGAM422 RNA, herein designated VGAM RNA, also designated SEQ ID:3133.

Another function of VGAM422 is therefore inhibition of SRY (sex determining region Y)-box 13 (SOX13, Accession NM_005686). Accordingly, utilities of VGAM422 include diagnosis, prevention and treatment of diseases and clinical conditions associated with SOX13. Down Syndrome Critical Region Gene 1-like 1 (DSCR1L1, Accession NM_005822) is another VGAM422 host target gene. DSCR1L1 BINDING SITE is HOST TARGET binding site found in the 3' untranslated region of mRNA encoded by DSCR1L1, corresponding to a HOST TARGET binding site such as BINDING SITE I, BINDING SITE II or BINDING SITE III. Table 2 illustrates the complementarity of the nucleotide sequences of DSCR1L1 BINDING SITE, designated SEQ ID:12428, to the nucleotide sequence of VGAM422 RNA, herein designated VGAM RNA, also designated SEQ ID:3133.

Another function of VGAM422 is therefore inhibition of Down Syndrome Critical Region Gene 1-like 1 (DSCR1L1, Accession NM_005822). Accordingly, utilities of VGAM422 include diagnosis, prevention and treatment of diseases and clinical conditions associated with DSCR1L1. FIG. 1 further provides a conceptual description of a novel bioinformatically detected viral gene of the present invention, referred to here as Viral Genomic Address Messenger 423 (VGAM423) viral gene, which modulates expression of respective host target genes thereof, the function and utility of which host target genes is known in the art.

VGAM423 is a novel bioinformatically detected regulatory, non protein coding, viral micro RNA (miRNA) gene. The method by which VGAM423 was detected is described hereinabove with reference to FIGS. 1-8.

VGAM423 gene, herein designated VGAM GENE, is a viral gene contained in the genome of Canine Parvovirus. VGAM423 host target gene, herein designated VGAM HOST TARGET GENE, is a human gene contained in the human genome.

VGAM423 gene encodes a VGAM423 precursor RNA, herein designated VGAM PRECURSOR RNA. Similar to other miRNA genes, and unlike most ordinary genes, VGAM423 precursor RNA does not encode a protein. A nucleotide sequence identical or highly similar to the nucleotide sequence of VGAM423 precursor RNA is designated SEQ ID:409, and is provided hereinbelow with reference to the sequence listing part. Nucleotide sequence SEQ ID:409 is located at position 1298 relative to the genome of Canine Parvovirus.

VGAM423 precursor RNA folds onto itself, forming VGAM423 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM423 folded precursor RNA into VGAM423 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM423 RNA is designated SEQ ID:3134, and is provided hereinbelow with reference to the sequence listing part.

VGAM423 host target gene, herein designated VGAM HOST TARGET GENE, encodes a corresponding messenger RNA, VGAM423 host target RNA, herein designated VGAM HOST TARGET RNA. VGAM423 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM423 RNA, herein designated VGAM RNA, binds complementarily to one or more host target binding sites located in untranslated regions of VGAM423 host target RNA, herein designated VGAM HOST TARGET RNA. This complementary binding is due to the fact that the nucleotide sequence of VGAM423 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM423 RNA, herein designated VGAM RNA, may have a different number of host target binding sites in untranslated regions of a VGAM423 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM423 RNA, herein designated VGAM RNA, to host target binding sites on VGAM423 host target RNA, herein designated VGAM HOST TARGET RNA, such as BINDING SITE I, BINDING SITE II and BINDING SITE III, inhibits translation of VGAM423 host target RNA into VGAM423 host target protein, herein designated VGAM HOST TARGET PROTEIN. VGAM host target protein is therefore outlined by a broken line.

It is appreciated that VGAM423 host target gene, herein designated VGAM HOST TARGET GENE, in fact represents a plurality of VGAM423 host target genes. The mRNA of each one of this plurality of VGAM423 host target genes comprises one or more host target binding sites, each having a nucleotide sequence which is at least partly complementary to VGAM423 RNA, herein designated VGAM RNA, and which when bound by VGAM423 RNA causes inhibition of translation of respective one or more VGAM423 host target proteins.

It is further appreciated by one skilled in the art that the mode of translational inhibition illustrated by FIG. 1 with specific reference to translational inhibition exerted by VGAM423 gene, herein designated VGAM GENE, on one or more VGAM423 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM423 is inhibition of expression of host target genes, as part of a novel viral mechanism of attacking a host. Accordingly, utilities of VGAM423 include diagnosis, prevention and treatment of viral infection by Canine Parvovirus. Specific functions, and accordingly utilities, of VGAM423 correlate with, and may be deduced from, the identity of the host target genes which VGAM423 binds and inhibits, and the function of these host target genes, as elaborated hereinbelow.

Nucleotide sequences of the VGAM423 precursor RNA, herein designated VGAM PRECURSOR RNA, and of the 'diced' VGAM423 RNA, herein designated VGAM RNA, and a schematic representation of the secondary folding of VGAM423 folded precursor RNA, herein designated VGAM FOLDED PRECURSOR RNA, of VGAM423 are further described hereinbelow with reference to Table 1.

Nucleotide sequences of host target binding sites, such as BINDING SITE-I, BINDING SITE-II and BINDING SITE-III of FIG. 1, found on VGAM423 host target RNA, and schematic representation of the complementarity of each of these host target binding sites to VGAM423 RNA, herein designated VGAM RNA, are described hereinbelow with reference to Table 2.

As mentioned hereinabove with reference to FIG. 1, a function of VGAM423 gene, herein designated VGAM is inhibition of expression of VGAM423 target genes. It is appreciated that specific functions, and accordingly utilities, of VGAM423 correlate with, and may be deduced from, the identity of the target genes which VGAM423 binds and inhibits, and the function of these target genes, as elaborated hereinbelow.

Component of Oligomeric Golgi Complex 6 (COG6, Accession XM_053233) is a VGAM423 host target gene. COG6 BINDING SITE is HOST TARGET binding site found in the 3' untranslated region of mRNA encoded by COG6, corresponding to a HOST TARGET binding site such as BINDING SITE I, BINDING SITE II or BINDING SITE III. Table 2 illustrates the complementarity of the nucleotide sequences of COG6 BINDING SITE, designated SEQ ID:36067, to the nucleotide sequence of VGAM423 RNA, herein designated VGAM RNA, also designated SEQ ID:3134.

A function of VGAM423 is therefore inhibition of Component of Oligomeric Golgi Complex 6 (COG6, Accession XM_053233), a gene which is critical for the structure and function of the Golgi apparatus. Accordingly, utilities of VGAM423 include diagnosis, prevention and treatment of diseases and clinical conditions associated with COG6. The function of COG6 has been established by previous studies. Multiprotein complexes are key determinants of Golgi apparatus structure and its capacity for intracellular transport and glycoprotein modification. Several complexes have been identified, including the Golgi transport complex (GTC), the LDLC complex, which is involved in glycosylation reactions, and the SEC34 complex, which is involved in vesicular transport. These 3 complexes are identical and have been termed the conserved oligomeric Golgi (COG) complex, which includes COG6 (Ungar et al., 2002). By SDS-PAGE analysis of bovine brain cytosol, Ungar et al. (2002) identified the 8 subunits of the COG complex. Immunofluorescence microscopy demonstrated that COG1 (LDLB; 606973) colocalizes with COG7 (OMIM Ref. No. 606978), as well as with COG3 (OMIM Ref. No. 606975) and COG5 (OMIM Ref. No. 606821), with a Golgi marker in a perinuclear distribution. Immunoprecipitation analysis showed that all COG subunits interact with COG2 (LDLC; 606974). Ungar et al. (2002) concluded that the COG complex is critical for the structure and function of the Golgi apparatus and can influence intracellular membrane trafficking.

Full details of the abovementioned studies are described in the following publications, the disclosure of which are hereby incorporated by reference:

Ungar, D.; Oka, T.; Brittle, E. E.; Vasile, E.; Lupashin, V. V.; Chatterton, J. E.; Heuser, J. E.; Krieger, M.; Waters, M. G.: Characterization of a mammalian Golgi-localized protein complex, COG, that is required for normal Golgi morphology and function. J. Cell Biol. 157:405-415, 2002; and Hirosawa, M.; Nagase, T.; Ishikawa, K.; Kikuno, R.; Nomura, N.; Ohara, O.: Characterization of cDNA clones selected by the GeneMark analysis from size-fractionated cDNA libraries from.

Further studies establishing the function and utilities of COG6 are found in John Hopkins OMIM database record ID 606977, and in sited publications numbered 7480 listed in the bibliography section hereinbelow, which are also hereby incorporated by reference. Protocadherin 19 (PCDH19, Accession XM_033173) is another VGAM423 host target gene. PCDH19 BINDING SITE is HOST TARGET binding site found in the 3' untranslated region of mRNA encoded by PCDH19, corresponding to a HOST TARGET binding site such as BINDING SITE I, BINDING SITE II or BINDING SITE III. Table 2 illustrates the complementarity of the nucleotide sequences of PCDH19 BINDING SITE, designated SEQ ID:31860, to the nucleotide sequence of VGAM423 RNA, herein designated VGAM RNA, also designated SEQ ID:3134.

Another function of VGAM423 is therefore inhibition of Protocadherin 19 (PCDH19, Accession XM_033173). Accordingly, utilities of VGAM423 include diagnosis, prevention and treatment of diseases and clinical conditions associated with PCDH19. LOC146108 (Accession XM_085322) is another VGAM423 host target gene. LOC146108 BINDING SITE is HOST TARGET binding site found in the 3' untranslated region of mRNA encoded by LOC146108, corresponding to a HOST TARGET binding site such as BINDING SITE I, BINDING SITE II or BINDING SITE III. Table 2 illustrates the complementarity of the nucleotide sequences of LOC146108 BINDING SITE, designated SEQ ID:38064, to the nucleotide sequence of VGAM423 RNA, herein designated VGAM RNA, also designated SEQ ID:3134.

Another function of VGAM423 is therefore inhibition of LOC146108 (Accession XM_085322). Accordingly, utilities of VGAM423 include diagnosis, prevention and treatment of diseases and clinical conditions associated with LOC146108. LOC151126 (Accession XM_087103) is another VGAM423 host target gene. LOC151126 BINDING SITE is HOST TARGET binding site found in the 3' untranslated region of mRNA encoded by LOC151126, corresponding to a HOST TARGET binding site such as BINDING SITE I, BINDING SITE II or BINDING SITE III. Table 2 illustrates the complementarity of the nucleotide sequences of LOC151126 BINDING SITE, designated SEQ ID:39058, to the nucleotide sequence of VGAM423 RNA, herein designated VGAM RNA, also designated SEQ ID:3134.

Another function of VGAM423 is therefore inhibition of LOC151126 (Accession XM_087103). Accordingly, utilities of VGAM423 include diagnosis, prevention and treatment of diseases and clinical conditions associated with LOC151126.

FIG. 1 further provides a conceptual description of a novel bioinformatically detected viral gene of the present invention, referred to here as Viral Genomic Address Messenger 424 (VGAM424) viral gene, which modulates expression of respective host target genes thereof, the function and utility of which host target genes is known in the art.

VGAM424 is a novel bioinformatically detected regulatory, non protein coding, viral micro RNA (miRNA) gene. The method by which VGAM424 was detected is described hereinabove with reference to FIGS. 1-8.

VGAM424 gene, herein designated VGAM GENE, is a viral gene contained in the genome of Rabies Virus. VGAM424 host target gene, herein designated VGAM HOST TARGET GENE, is a human gene contained in the human genome.

VGAM424 gene encodes a VGAM424 precursor RNA, herein designated VGAM PRECURSOR RNA. Similar to other miRNA genes, and unlike most ordinary genes, VGAM424 precursor RNA does not encode a protein. A nucleotide sequence identical or highly similar to the nucleotide sequence of VGAM424 precursor RNA is designated SEQ ID:410, and is provided hereinbelow with reference to the sequence listing part. Nucleotide sequence SEQ ID:410 is located at position 5883 relative to the genome of Rabies Virus.

VGAM424 precursor RNA folds onto itself, forming VGAM424 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM424 folded precursor RNA into VGAM424 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM424 RNA is designated SEQ ID:3135, and is provided hereinbelow with reference to the sequence listing part.

VGAM424 host target gene, herein designated VGAM HOST TARGET GENE, encodes a corresponding messenger RNA, VGAM424 host target RNA, herein designated VGAM HOST TARGET RNA. VGAM424 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM424 RNA, herein designated VGAM RNA, binds complementarily to one or more host target binding sites located in untranslated regions of VGAM424 host target RNA, herein designated VGAM HOST TARGET RNA. This complementary binding is due to the fact that the nucleotide sequence of VGAM424 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM424 RNA, herein designated VGAM RNA, may have a different number of host target binding sites in untranslated regions of a VGAM424 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM424 RNA, herein designated VGAM RNA, to host target binding sites on VGAM424 host target RNA, herein designated VGAM HOST TARGET RNA, such as BINDING SITE I, BINDING SITE II and BINDING SITE III, inhibits translation of VGAM424 host target RNA into VGAM424 host target protein, herein designated VGAM HOST TARGET PROTEIN. VGAM host target protein is therefore outlined by a broken line.

It is appreciated that VGAM424 host target gene, herein designated VGAM HOST TARGET GENE, in fact represents a plurality of VGAM424 host target genes. The mRNA of each one of this plurality of VGAM424 host target genes comprises one or more host target binding sites, each having a nucleotide sequence which is at least partly complementary to VGAM424 RNA, herein designated VGAM RNA, and which when bound by VGAM424 RNA causes inhibition of translation of respective one or more VGAM424 host target proteins.

It is further appreciated by one skilled in the art that the mode of translational inhibition illustrated by FIG. 1 with specific reference to translational inhibition exerted by VGAM424 gene, herein designated VGAM GENE, on one or more VGAM424 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM424 is inhibition of expression of host target genes, as part of a novel viral mechanism of attacking a host. Accordingly, utilities of VGAM424 include diagnosis, prevention and treatment of viral infection by Rabies Virus. Specific functions, and accordingly utilities, of VGAM424 correlate with, and may be deduced from, the identity of the host target genes which VGAM424 binds and inhibits, and the function of these host target genes, as elaborated hereinbelow.

Nucleotide sequences of the VGAM424 precursor RNA, herein designated VGAM PRECURSOR RNA, and of the 'diced' VGAM424 RNA, herein designated VGAM RNA, and a schematic representation of the secondary folding of VGAM424 folded precursor RNA, herein designated VGAM FOLDED PRECURSOR RNA, of VGAM424 are further described hereinbelow with reference to Table 1.

Nucleotide sequences of host target binding sites, such as BINDING SITE-I, BINDING SITE-II and BINDING SITE-III of FIG. 1, found on VGAM424 host target RNA, and schematic representation of the complementarity of each of these host target binding sites to VGAM424 RNA, herein designated VGAM RNA, are described hereinbelow with reference to Table 2.

As mentioned hereinabove with reference to FIG. 1, a function of VGAM424 gene, herein designated VGAM is inhibition of expression of VGAM424 target genes. It is appreciated that specific functions, and accordingly utilities, of VGAM424 correlate with, and may be deduced from, the identity of the target genes which VGAM424 binds and inhibits, and the function of these target genes, as elaborated hereinbelow.

SUV39H2 (Accession NM_024670) is a VGAM424 host target gene. SUV39H2 BINDING SITE is HOST TARGET binding site found in the 3' untranslated region of mRNA encoded by SUV39H2, corresponding to a HOST TARGET binding site such as BINDING SITE I, BINDING SITE II or BINDING SITE III. Table 2 illustrates the complementarity of the nucleotide sequences of SUV39H2 BINDING SITE, designated SEQ ID:23974, to the nucleotide sequence of VGAM424 RNA, herein designated VGAM RNA, also designated SEQ ID:3135.

A function of VGAM424 is therefore inhibition of SUV39H2 (Accession NM_024670), a gene which is involved in gene repression and the modification of position-effect- variegation. Accordingly, utilities of VGAM424 include diagnosis, prevention and treatment of diseases and clinical conditions associated with SUV39H2. The function of SUV39H2 has been established by previous studies. O'Carroll et al. (2000) isolated and characterized a murine gene, Suv39h2, that encodes an H3 histone (see OMIM Ref. No. 601128) methyltransferase (OMIM Ref. No. HMTase) with 59% identity to Suv39h1 (OMIM Ref. No. 300254). Although both Suv39h loci displayed overlapping expression profiles during mouse embryogenesis, Suv39h2 transcripts remained specifically expressed in adult testes. Immunolocalization of the Suv39h2 protein during spermatogenesis indicated enriched distribution at the heterochromatin from the leptotene to the round spermatid stage. Moreover, Suv39h2 specifically accumulated with chromatin of the sex chromosomes (XY body), which undergo transcriptional silencing during the first meiotic prophase. These data were consistent with redundant enzymatic roles for Suv39h1 and Suv39h2 during mouse development and suggested an additional function of the Suv39h2 HMTase in organizing meiotic heterochromatin that may even impart an epigenetic imprint to the male germline. Animal model experiments lend further support to the function of SUV39H2. Peters et al. (2001) generated mice deficient for either Suv39h1 or Suv39h2. These animals displayed normal viability and fertility and did not exhibit apparent phenotypes. The authors subsequently intercrossed Suv39h1 -/- and Suv39h2 -/- mice to generate compound Suv39h mutants that were then used to derive Suv39h double-null mice (Suv39h1 -/- and Suv39h2 -/-). These mice displayed severely impaired viability and chromosomal instabilities that were associated with an increased tumor risk and perturbed chromosome interactions during male meiosis. These data suggested a crucial role for pericentric H3 histone-lys9 methylation in protecting genome stability and defined the Suv39h HMTases as important epigenetic regulators for mammalian development.

It is appreciated that the abovementioned animal model for SUV39H2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

O'Carroll, D.; Scherthan, H.; Peters, A. H. F. M.; Opravil, S.; Haynes, A. R.; Laible, G.; Rea, S.; Schmid, M.; Lebersorger, A.; Jerratsch, M.; Sattler, L.; Mattei, M. G.; Denny, P.; Brown, S. D. M.; Schweizer, D.; Jenuwein, T.: Isolation and characterization of Suv39h2, a second histone H3 methyltransferase gene that displays testis-specific expression. Molec. Cell. Biol. 20:9423-9433, 2000; and Peters, A. H. F. M.; O'Carroll, D.; Scherthan, H.; Mechtler, K.; Sauer, S.; Schofer, C.; Weipoltshammer, K.; Pagani, M.; Lachner, M.; Kohlmaier, A.; Opravil, S.; Doyle, M.; Sibilia, M.

Further studies establishing the function and utilities of SUV39H2 are found in John Hopkins OMIM database record ID 606503, and in sited publications numbered 610 and 9071 listed in the bibliography section hereinbelow, which are also hereby incorporated by reference. FLJ13340 (Accession NM_057175) is another VGAM424 host target gene. FLJ13340 BINDING SITE is HOST TARGET binding site found in the 3' untranslated region of mRNA encoded by FLJ13340, corresponding to a HOST TARGET binding site such as BINDING SITE I, BINDING SITE II or BINDING SITE III. Table 2 illustrates the complementarity of the nucleotide sequences of FLJ13340 BINDING SITE, designated SEQ ID:27704, to the nucleotide sequence of VGAM424 RNA, herein designated VGAM RNA, also designated SEQ ID:3135.

Another function of VGAM424 is therefore inhibition of FLJ13340 (Accession NM_057175). Accordingly, utilities of VGAM424 include diagnosis, prevention and treatment of diseases and clinical conditions associated with FLJ13340. TBDN100 (Accession NM_025085) is another VGAM424 host target gene. TBDN100 BINDING SITE is HOST TARGET binding site found in the 3' untranslated region of mRNA encoded by TBDN100, corresponding to a HOST TARGET binding site such as BINDING SITE I, BINDING SITE II or BINDING SITE III. Table 2 illustrates the complementarity of the nucleotide sequences of TBDN100 BINDING SITE, designated SEQ ID:24693, to the nucleotide sequence of VGAM424 RNA, herein designated VGAM RNA, also designated SEQ ID:3135.

Another function of VGAM424 is therefore inhibition of TBDN100 (Accession NM_025085). Accordingly, utilities of VGAM424 include diagnosis, prevention and treatment of diseases and clinical conditions associated with TBDN100. Yes-associated Protein 1, 65 kDa (YAP1, Accession NM_006106) is another VGAM424 host target gene. YAP1 BINDING SITE is HOST TARGET binding site found in the 3' untranslated region of mRNA encoded by YAP1, corresponding to a HOST TARGET binding site such as BINDING SITE I, BINDING SITE II or BINDING SITE III. Table 2 illustrates the complementarity of the nucleotide sequences of YAP1 BINDING SITE, designated SEQ ID:12749, to the nucleotide sequence of VGAM424 RNA, herein designated VGAM RNA, also designated SEQ ID:3135.

Another function of VGAM424 is therefore inhibition of Yes-associated Protein 1, 65 kDa (YAP1, Accession NM_006106). Accordingly, utilities of VGAM424 include diagnosis, prevention and treatment of diseases and clinical conditions associated with YAP1. LOC143153 (Accession XM_084440) is another VGAM424 host target gene. LOC143153 BINDING SITE is HOST TARGET binding site found in the 3' untranslated region of mRNA encoded by LOC143153, corresponding to a HOST TARGET binding site such as BINDING SITE I, BINDING SITE II or BINDING SITE III. Table 2 illustrates the complementarity of the nucleotide sequences of LOC143153 BINDING SITE, designated SEQ ID:37577, to the nucleotide sequence of VGAM424 RNA, herein designated VGAM RNA, also designated SEQ ID:3135.

Another function of VGAM424 is therefore inhibition of LOC143153 (Accession XM_084440). Accordingly, utilities of VGAM424 include diagnosis, prevention and treatment of diseases and clinical conditions associated with LOC143153. LOC143154 (Accession XM_084441) is another VGAM424 host target gene. LOC143154 BINDING SITE is HOST TARGET binding site found in the 3' untranslated region of mRNA encoded by LOC143154, corresponding to a HOST TARGET binding site such as BINDING SITE I, BINDING SITE II or BINDING SITE III. Table 2 illustrates the complementarity of the nucleotide sequences of LOC143154 BINDING SITE, designated SEQ ID:37584, to the nucleotide sequence of VGAM424 RNA, herein designated VGAM RNA, also designated SEQ ID:3135.

Another function of VGAM424 is therefore inhibition of LOC143154 (Accession XM_084441). Accordingly, utilities of VGAM424 include diagnosis, prevention and treatment of diseases and clinical conditions associated with LOC143154. LOC144571 (Accession XM_096630) is another VGAM424 host target gene. LOC144571 BINDING SITE is HOST TARGET binding site found in the 3' untranslated region of mRNA encoded by LOC144571, corresponding to a HOST TARGET binding site such as BINDING SITE I, BINDING SITE II or BINDING SITE III. Table 2 illustrates the complementarity of the nucleotide sequences of LOC144571 BINDING SITE, designated SEQ ID:40440, to the nucleotide sequence of VGAM424 RNA, herein designated VGAM RNA, also designated SEQ ID:3135.

Another function of VGAM424 is therefore inhibition of LOC144571 (Accession XM_096630). Accordingly, utilities of VGAM424 include diagnosis, prevention and treatment of diseases and clinical conditions associated with LOC144571. LOC146346 (Accession XM_085430) is another VGAM424 host target gene. LOC146346 BINDING SITE is HOST TARGET binding site found in the 5' untranslated region of mRNA encoded by LOC146346, corresponding to a HOST TARGET binding site such as BINDING SITE I, BINDING SITE II or BINDING SITE III. Table 2 illustrates the complementarity of the nucleotide sequences of LOC146346 BINDING SITE, designated SEQ ID:38137, to the nucleotide sequence of VGAM424 RNA, herein designated VGAM RNA, also designated SEQ ID:3135.

Another function of VGAM424 is therefore inhibition of LOC146346 (Accession XM_085430). Accordingly, utilities of VGAM424 include diagnosis, prevention and treatment of diseases and clinical conditions associated with LOC146346. LOC219294 (Accession XM_167566) is another VGAM424 host target gene. LOC219294 BINDING SITE is HOST TARGET binding site found in the 3' untranslated region of mRNA encoded by LOC219294, corresponding to a HOST TARGET binding site such as BINDING SITE I, BINDING SITE II or BINDING SITE III. Table 2 illustrates the complementarity of the nucleotide sequences of LOC219294 BINDING SITE, designated SEQ ID:44685, to the nucleotide sequence of VGAM424 RNA, herein designated VGAM RNA, also designated SEQ ID:3135.

Another function of VGAM424 is therefore inhibition of LOC219294 (Accession XM_167566). Accordingly, utilities of VGAM424 include diagnosis, prevention and treatment of diseases and clinical conditions associated with LOC219294.

LOC219295 (Accession XM_167565) is another VGAM424 host target gene. LOC219295 BINDING SITE is HOST TARGET binding site found in the 3' untranslated region of mRNA encoded by LOC219295, corresponding to a HOST TARGET binding site such as BINDING SITE I, BINDING SITE II or BINDING SITE III. Table 2 illustrates the complementarity of the nucleotide sequences of LOC219295 BINDING SITE, designated SEQ ID:44680, to the nucleotide sequence of VGAM424 RNA, herein designated VGAM RNA, also designated SEQ ID:3135.

Another function of VGAM424 is therefore inhibition of LOC219295 (Accession XM_167565). Accordingly, utilities of VGAM424 include diagnosis, prevention and treatment of diseases and clinical conditions associated with LOC219295. LOC219790 (Accession XM_166124) is another VGAM424 host target gene. LOC219790 BINDING SITE is HOST TARGET binding site found in the 3' untranslated region of mRNA encoded by LOC219790, corresponding to a HOST TARGET binding site such as BINDING SITE I, BINDING SITE II or BINDING SITE III. Table 2 illustrates the complementarity of the nucleotide sequences of LOC219790 BINDING SITE, designated SEQ ID:43904, to the nucleotide sequence of VGAM424 RNA, herein designated VGAM RNA, also designated SEQ ID:3135.

Another function of VGAM424 is therefore inhibition of LOC219790 (Accession XM_166124). Accordingly, utilities of VGAM424 include diagnosis, prevention and treatment of diseases and clinical conditions associated with LOC219790. LOC221687 (Accession XM_166423) is another VGAM424 host target gene. LOC221687 BINDING SITE is HOST TARGET binding site found in the 3' untranslated region of mRNA encoded by LOC221687, corresponding to a HOST TARGET binding site such as BINDING SITE I, BINDING SITE II or BINDING SITE III. Table 2 illustrates the complementarity of the nucleotide sequences of LOC221687 BINDING SITE, designated SEQ ID:44303, to the nucleotide sequence of VGAM424 RNA, herein designated VGAM RNA, also designated SEQ ID:3135.

Another function of VGAM424 is therefore inhibition of LOC221687 (Accession XM_166423). Accordingly, utilities of VGAM424 include diagnosis, prevention and treatment of diseases and clinical conditions associated with LOC221687. LOC83690 (Accession NM_031461) is another VGAM424 host target gene. LOC83690 BINDING SITE is HOST TARGET binding site found in the 3' untranslated region of mRNA encoded by LOC83690, corresponding to a HOST TARGET binding site such as BINDING SITE I, BINDING SITE II or BINDING SITE III. Table 2 illustrates the complementarity of the nucleotide sequences of LOC83690 BINDING SITE, designated SEQ ID:25483, to the nucleotide sequence of VGAM424 RNA, herein designated VGAM RNA, also designated SEQ ID:3135.

Another function of VGAM424 is therefore inhibition of LOC83690 (Accession NM_031461). Accordingly, utilities of VGAM424 include diagnosis, prevention and treatment of diseases and clinical conditions associated with LOC83690. FIG. 1 further provides a conceptual description of a novel bioinformatically detected viral gene of the present invention, referred to here as Viral Genomic Address Messenger 425 (VGAM425) viral gene, which modulates expression of respective host target genes thereof, the function and utility of which host target genes is known in the art.

VGAM425 is a novel bioinformatically detected regulatory, non protein coding, viral micro RNA (miRNA) gene. The method by which VGAM425 was detected is described hereinabove with reference to FIGS. 1-8.

VGAM425 gene, herein designated VGAM GENE, is a viral gene contained in the genome of Rabies Virus. VGAM425 host target gene, herein designated VGAM HOST TARGET GENE, is a human gene contained in the human genome.

VGAM425 gene encodes a VGAM425 precursor RNA, herein designated VGAM PRECURSOR RNA. Similar to other miRNA genes, and unlike most ordinary genes, VGAM425 precursor RNA does not encode a protein. A nucleotide sequence identical or highly similar to the nucleotide sequence of VGAM425 precursor RNA is designated SEQ ID:411, and is provided hereinbelow with reference to the sequence listing part. Nucleotide sequence SEQ ID:411 is located at position 8963 relative to the genome of Rabies Virus.

VGAM425 precursor RNA folds onto itself, forming VGAM425 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM425 folded precursor RNA into VGAM425 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM425 RNA is designated SEQ ID:3136, and is provided hereinbelow with reference to the sequence listing part.

VGAM425 host target gene, herein designated VGAM HOST TARGET GENE, encodes a corresponding messenger RNA, VGAM425 host target RNA, herein designated VGAM HOST TARGET RNA. VGAM425 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM425 RNA, herein designated VGAM RNA, binds complementarily to one or more host target binding sites located in untranslated regions of VGAM425 host target RNA, herein designated VGAM HOST TARGET RNA. This complementary binding is due to the fact that the nucleotide sequence of VGAM425 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM425 RNA, herein designated VGAM RNA, may have a different number of host target binding sites in untranslated regions of a VGAM425 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM425 RNA, herein designated VGAM RNA, to host target binding sites on VGAM425 host target RNA, herein designated VGAM HOST TARGET RNA, such as BINDING SITE I, BINDING SITE II and BINDING SITE III, inhibits translation of VGAM425 host target RNA into VGAM425 host target protein, herein designated VGAM HOST TARGET PROTEIN. VGAM host target protein is therefore outlined by a broken line.

It is appreciated that VGAM425 host target gene, herein designated VGAM HOST TARGET GENE, in fact represents a plurality of VGAM425 host target genes. The mRNA of each one of this plurality of VGAM425 host target genes comprises one or more host target binding sites, each having a nucleotide sequence which is at least partly complementary to VGAM425 RNA, herein designated VGAM RNA, and which when bound by VGAM425 RNA causes inhibition of translation of respective one or more VGAM425 host target proteins.

It is further appreciated by one skilled in the art that the mode of translational inhibition illustrated by FIG. 1 with specific reference to translational inhibition exerted by VGAM425 gene, herein designated VGAM GENE, on one or more VGAM425 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM425 is inhibition of expression of host target genes, as part of a novel viral mechanism of attacking a host. Accordingly, utilities of VGAM425 include diagnosis, prevention and treatment of viral infection by Rabies Virus. Specific functions, and accordingly utilities, of VGAM425 correlate with, and may be deduced from, the identity of the host target genes which VGAM425 binds and inhibits, and the function of these host target genes, as elaborated hereinbelow.

Nucleotide sequences of the VGAM425 precursor RNA, herein designated VGAM PRECURSOR RNA, and of the 'diced' VGAM425 RNA, herein designated VGAM RNA, and a schematic representation of the secondary folding of VGAM425 folded precursor RNA, herein designated VGAM FOLDED PRECURSOR RNA, of VGAM425 are further described hereinbelow with reference to Table 1.

Nucleotide sequences of host target binding sites, such as BINDING SITE-I, BINDING SITE-II and BINDING SITE-III of FIG. 1, found on VGAM425 host target RNA, and schematic representation of the complementarity of each of these host target binding sites to VGAM425 RNA, herein designated VGAM RNA, are described hereinbelow with reference to Table 2.

As mentioned hereinabove with reference to FIG. 1, a function of VGAM425 gene, herein designated VGAM is inhibition of expression of VGAM425 target genes. It is appreciated that specific functions, and accordingly utilities, of VGAM425 correlate with, and may be deduced from, the identity of the target genes which VGAM425 binds and inhibits, and the function of these target genes, as elaborated hereinbelow.

Amyloid Beta (A4) Precursor Protein-binding, Family B, Member 2 (Fe65-like) (APBB2, Accession XM_051782) is a VGAM425 host target gene. APBB2 BINDING SITE is HOST TARGET binding site found in the 3' untranslated region of mRNA encoded by APBB2, corresponding to a HOST TARGET binding site such as BINDING SITE I, BINDING SITE II or BINDING SITE III. Table 2 illustrates the complementarity of the nucleotide sequences of APBB2 BINDING SITE, designated SEQ ID:35879, to the nucleotide sequence of VGAM425 RNA, herein designated VGAM RNA, also designated SEQ ID:3136.

A function of VGAM425 is therefore inhibition of Amyloid Beta (A4) Precursor Protein-binding, Family B, Member 2 (Fe65-like) (APBB2, Accession XM_051782), a gene which Interacts with beta-amyloid precursor protein and with APLP2. Accordingly, utilities of VGAM425 include diagnosis, prevention and treatment of diseases and clinical conditions associated with APBB2. The function of APBB2 has been established by previous studies. The cytoplasmic domain of the Alzheimer disease locus amyloid protein precursor (APP; 107640) binds 4 human phosphotyrosine-binding (PTB) proteins; see APBA1 (OMIM Ref. No. 602414). By use of a yeast 2-hybrid screening of a human brain cDNA library, McLoughlin and Miller (1996) identified 3 of these proteins: the human homolog of Fe65 (APBB1; 602709), an Fe65-like sequence (APBB2), and an X11-like sequence (APBA2; 602712). From a human fetal brain cDNA library, Guenette et al. (1996) also cloned APBB2 based on its interaction with the carboxy terminus of APP. They showed that the APBB2 protein interacts with another amyloid protein precursor, APLP2 (OMIM Ref. No. 104776), but not with APLP1 (OMIM Ref. No. 104775). The APBB2 gene encodes a 730-amino acid polypeptide that is 51% identical to rat Fe65. Northern blot analysis revealed that APBB2 has widespread expression in human tissues. By use of a radiation hybrid panel, Blanco et al. (1998) mapped the human APBB2 gene to chromosome 4, between the markers D4S405 (OMIM Ref. No. 4.6 cR) and D4S496 (10.1 cR).

Full details of the abovementioned studies are described in the following publications, the disclosure of which are hereby incorporated by reference:

Blanco, G.; Irving, N. G.; Brown, S. D. M.; Miller, C. C. J.; McLoughlin, D. M.: Mapping of the human and murine X11-like genes (APBA2 and Apba2), the murine Fe65 gene (Apbb1), and the human Fe65-like gene (APBB2): genes encoding phosphotyrosine-binding domain proteins that interact with the Alzheimer's disease amyloid precursor protein. Mammalian Genome 9:473-475, 1998; and Guenette, S. Y.; Chen, J.; Jondro, P. D.; Tanzi, R. E.: Association of a novel human FE65-like protein with the cytoplasmic domain of the beta-amyloid precursor protein. Proc. Nat. Acad.

Further studies establishing the function and utilities of APBB2 are found in John Hopkins OMIM database record ID 602710, and in sited publications numbered 101 and 1119 listed in the bibliography section hereinbelow, which are also hereby incorporated by reference. Neuronal Cell Adhesion Molecule (NRCAM, Accession NM_005010) is another VGAM425 host target gene. NRCAM BINDING SITE is HOST TARGET binding site found in the 3' untranslated region of mRNA encoded by NRCAM, corresponding to a HOST TARGET binding site such as BINDING SITE I, BINDING SITE II or BINDING SITE III. Table 2 illustrates the complementarity of the nucleotide sequences of NRCAM BINDING SITE, designated SEQ ID:11451, to the nucleotide sequence of VGAM425 RNA, herein designated VGAM RNA, also designated SEQ ID:3136.

Another function of VGAM425 is therefore inhibition of Neuronal Cell Adhesion Molecule (NRCAM, Accession NM_005010), a gene which functions as a cell surface protein and belongs to the immunoglobulin superfamily. Accordingly, utilities of VGAM425 include diagnosis, prevention and treatment of diseases and clinical conditions associated with NRCAM. The function of NRCAM and its association with various diseases and clinical conditions, has been established by previous studies, as described hereinabove with reference to VGAM268. Protein Tyrosine Phosphatase, Non-receptor Type 18 (brain-derived) (PTPN18, Accession NM_014369) is another VGAM425 host target gene. PTPN18 BINDING SITE is HOST TARGET binding site found in the 3' untranslated region of mRNA encoded by PTPN18, corresponding to a HOST TARGET binding site such as BINDING SITE I, BINDING SITE II or BINDING SITE III. Table 2 illustrates the complementarity of the nucleotide sequences of PTPN18 BINDING SITE, designated SEQ ID:15703, to the nucleotide sequence of VGAM425 RNA, herein designated VGAM RNA, also designated SEQ ID:3136.

Another function of VGAM425 is therefore inhibition of Protein Tyrosine Phosphatase, Non-receptor Type 18 (brain-derived) (PTPN18, Accession NM_014369). Accordingly, utilities of VGAM425 include diagnosis, prevention and treatment of diseases and clinical conditions associated with PTPN18. KIAA1598 (Accession NM_018330) is another VGAM425 host target gene. KIAA1598 BINDING SITE is HOST TARGET binding site found in the 3' untranslated region of mRNA encoded by KIAA1598, corresponding to a HOST TARGET binding site such as BINDING SITE I, BINDING SITE II or BINDING SITE III. Table 2 illustrates the complementarity of the nucleotide sequences of KIAA1598 BINDING SITE, designated SEQ ID:20329, to the nucleotide sequence of VGAM425 RNA, herein designated VGAM RNA, also designated SEQ ID:3136.

Another function of VGAM425 is therefore inhibition of KIAA1598 (Accession NM_018330). Accordingly, utilities of VGAM425 include diagnosis, prevention and treatment of diseases and clinical conditions associated with KIAA1598. LOC196500 (Accession XM_113734) is another VGAM425 host target gene. LOC196500 BINDING SITE is HOST TARGET binding site found in the 3' untranslated region of mRNA encoded by LOC196500, corresponding to a HOST TARGET binding site such as BINDING SITE I, BINDING SITE II or BINDING SITE III. Table 2 illustrates the complementarity of the nucleotide sequences of LOC196500 BINDING SITE, designated SEQ ID:42390, to the nucleotide sequence of VGAM425 RNA, herein designated VGAM RNA, also designated SEQ ID:3136.

Another function of VGAM425 is therefore inhibition of LOC196500 (Accession XM_113734). Accordingly, utilities of VGAM425 include diagnosis, prevention and treatment of diseases and clinical conditions associated with LOC196500. LOC219855 (Accession XM_166184) is another VGAM425 host target gene. LOC219855 BINDING SITE is HOST TARGET binding site found in the 3' untranslated region of mRNA encoded by LOC219855, corresponding to a HOST TARGET binding site such as BINDING SITE I, BINDING SITE II or BINDING SITE III. Table 2 illustrates the complementarity of the nucleotide sequences of LOC219855 BINDING SITE, designated SEQ ID:43996, to the nucleotide sequence of VGAM425 RNA, herein designated VGAM RNA, also designated SEQ ID:3136.

Another function of VGAM425 is therefore inhibition of LOC219855 (Accession XM_166184). Accordingly, utilities of VGAM425 include diagnosis, prevention and treatment of diseases and clinical conditions associated with LOC219855. LOC221814 (Accession XM_168226) is another VGAM425 host target gene. LOC221814 BINDING SITE is HOST TARGET binding site found in the 5' untranslated region of mRNA encoded by LOC221814, corresponding to a HOST TARGET binding site such as BINDING SITE I, BINDING SITE II or BINDING SITE III. Table 2 illustrates the complementarity of the nucleotide sequences of LOC221814 BINDING SITE, designated SEQ ID:45092, to the nucleotide sequence of VGAM425 RNA, herein designated VGAM RNA, also designated SEQ ID:3136.

Another function of VGAM425 is therefore inhibition of LOC221814 (Accession XM_168226). Accordingly, utilities of VGAM425 include diagnosis, prevention and treatment of diseases and clinical conditions associated with LOC221814. FIG. 1 further provides a conceptual description of a novel bioinformatically detected viral gene of the present invention, referred to here as Viral Genomic Address Messenger 426 (VGAM426) viral gene, which modulates expression of respective host target genes thereof, the function and utility of which host target genes is known in the art.

VGAM426 is a novel bioinformatically detected regulatory, non protein coding, viral micro RNA (miRNA) gene. The method by which VGAM426 was detected is described hereinabove with reference to FIGS. 1-8.

VGAM426 gene, herein designated VGAM GENE, is a viral gene contained in the genome of Rabies Virus. VGAM426 host target gene, herein designated VGAM HOST TARGET GENE, is a human gene contained in the human genome.

VGAM426 gene encodes a VGAM426 precursor RNA, herein designated VGAM PRECURSOR RNA. Similar to other miRNA genes, and unlike most ordinary genes, VGAM426 precursor RNA does not encode a protein. A nucleotide sequence identical or highly similar to the nucleotide sequence of VGAM426 precursor RNA is designated SEQ ID:412, and is provided hereinbelow with reference to the sequence listing part. Nucleotide sequence SEQ ID:412 is located at position 5774 relative to the genome of Rabies Virus.

VGAM426 precursor RNA folds onto itself, forming VGAM426 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM426 folded precursor RNA into VGAM426 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM426 RNA is designated SEQ ID:3137, and is provided hereinbelow with reference to the sequence listing part.

VGAM426 host target gene, herein designated VGAM HOST TARGET GENE, encodes a corresponding messenger RNA, VGAM426 host target RNA, herein designated VGAM HOST TARGET RNA. VGAM426 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM426 RNA, herein designated VGAM RNA, binds complementarily to one or more host target binding sites located in untranslated regions of VGAM426 host target RNA, herein designated VGAM HOST TARGET RNA. This complementary binding is due to the fact that the nucleotide sequence of VGAM426 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM426 RNA, herein designated VGAM RNA, may have a different number of host target binding sites in untranslated regions of a VGAM426 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM426 RNA, herein designated VGAM RNA, to host target binding sites on VGAM426 host target RNA, herein designated VGAM HOST TARGET RNA, such as BINDING SITE I, BINDING SITE II and BINDING SITE III, inhibits translation of VGAM426 host target RNA into VGAM426 host target protein, herein designated VGAM HOST TARGET PROTEIN. VGAM host target protein is therefore outlined by a broken line.

It is appreciated that VGAM426 host target gene, herein designated VGAM HOST TARGET GENE, in fact represents a plurality of VGAM426 host target genes. The mRNA of each one of this plurality of VGAM426 host target genes comprises one or more host target binding sites, each having a nucleotide sequence which is at least partly complementary to VGAM426 RNA, herein designated VGAM RNA, and which when bound by VGAM426 RNA causes inhibition of translation of respective one or more VGAM426 host target proteins.

It is further appreciated by one skilled in the art that the mode of translational inhibition illustrated by FIG. 1 with specific reference to translational inhibition exerted by VGAM426 gene, herein designated VGAM GENE, on one or more VGAM426 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM426 is inhibition of expression of host target genes, as part of a novel viral mechanism of attacking a host. Accordingly, utilities of VGAM426 include diagnosis, prevention and treatment of viral infection by Rabies Virus. Specific functions, and accordingly utilities, of VGAM426 correlate with, and may be deduced from, the identity of the host target genes which VGAM426 binds and inhibits, and the function of these host target genes, as elaborated hereinbelow.

Nucleotide sequences of the VGAM426 precursor RNA, herein designated VGAM PRECURSOR RNA, and of the 'diced' VGAM426 RNA, herein designated VGAM RNA, and a schematic representation of the secondary folding of VGAM426 folded precursor RNA, herein designated VGAM FOLDED PRECURSOR RNA, of VGAM426 are further described hereinbelow with reference to Table 1.

Nucleotide sequences of host target binding sites, such as BINDING SITE-I, BINDING SITE-II and BINDING SITE-III of FIG. 1, found on VGAM426 host target RNA, and schematic representation of the complementarity of each of these host target binding sites to VGAM426 RNA, herein designated VGAM RNA, are described hereinbelow with reference to Table 2.

As mentioned hereinabove with reference to FIG. 1, a function of VGAM426 gene, herein designated VGAM is inhibition of expression of VGAM426 target genes. It is appreciated that specific functions, and accordingly utilities, of VGAM426 correlate with, and may be deduced from, the identity of the target genes which VGAM426 binds and inhibits, and the function of these target genes, as elaborated hereinbelow.

Calsequestrin 2 (cardiac muscle) (CASQ2, Accession NM_001232) is a VGAM426 host target gene. CASQ2 BINDING SITE is HOST TARGET binding site found in the 3' untranslated region of mRNA encoded by CASQ2, corresponding to a HOST TARGET binding site such as BINDING SITE I, BINDING SITE II or BINDING SITE III. Table 2 illustrates the complementarity of the nucleotide sequences of CASQ2 BINDING SITE, designated SEQ ID:6904, to the nucleotide sequence of VGAM426 RNA, herein designated VGAM RNA, also designated SEQ ID:3137.

A function of VGAM426 is therefore inhibition of Calsequestrin 2 (cardiac muscle) (CASQ2, Accession NM_001232). Accordingly, utilities of VGAM426 include diagnosis, prevention and treatment of diseases and clinical conditions associated with CASQ2. NIMA (never in mitosis gene a)-related Kinase 6 (NEK6, Accession NM_014397) is another VGAM426 host target gene. NEK6 BINDING SITE is HOST TARGET binding site found in the 3' untranslated region of mRNA encoded by NEK6, corresponding to a HOST TARGET binding site such as BINDING SITE I, BINDING SITE II or BINDING SITE III. Table 2 illustrates the complementarity of the nucleotide sequences of NEK6 BINDING SITE, designated SEQ ID:15740, to the nucleotide sequence of VGAM426 RNA, herein designated VGAM RNA, also designated SEQ ID:3137.

Another function of VGAM426 is therefore inhibition of NIMA (never in mitosis gene a)-related Kinase 6 (NEK6, Accession NM_014397), a gene which regulates nuclear and cytoplasmic aspects of the mitotic cycle. Accordingly, utilities of VGAM426 include diagnosis, prevention and treatment of diseases and clinical conditions associated with NEK6. The function of NEK6 has been established by previous studies. The Aspergillus nidulans 'never in mitosis A' (NIMA) gene encodes a serine/threonine kinase that controls initiation of mitosis. NIMA-related kinases (NEKs) are a group of protein kinases that are homologous to NIMA. Evidence suggests that NEKs perform functions similar to those of NIMA. Li et al. (1999) reported the cloning of a human liver cDNA encoding NEK6. Kimura and Okano (2001) determined that NEK6 and NEK7 (OMIM Ref. No. 606848) share 77% amino acid identity. By Northern blot analysis, Li et al. (1999) detected 1.6-, 2.6-, and 9.5-kb NEK6 transcripts. The 1.6-kb transcript was expressed at highest levels in liver and placenta. By RT-PCR, Kimura and Okano (2001) found expression of NEK6 in all tissues examined.

Full details of the abovementioned studies are described in the following publications, the disclosure of which are hereby incorporated by reference:

Kimura, M.; Okano, Y.: Identification and assignment of the human NIMA-related protein kinase 7 gene (NEK7) to human chromosome 1q31.3. Cytogenet. Cell Genet. 94:33-38, 2001; and Li, M. Z.; Yu, L.; Liu, Q.; Chu, J. Y.; Zhao, S. Y.: Assignment of NEK6, a NIMA-related gene, to human chromosome 9q33.3-q34.11 by radiation hybrid mapping. Cytogenet. Cell Genet. 87.

Further studies establishing the function and utilities of NEK6 are found in John Hopkins OMIM database record ID 604884, and in sited publications numbered 6947-6948 listed in the bibliography section hereinbelow, which are also hereby incorporated by reference. Protein Kinase, CGMP-dependent, Type II (PRKG2, Accession NM_006259) is another VGAM426 host target gene. PRKG2 BINDING SITE is HOST TARGET binding site found in the 3' untranslated region of mRNA encoded by PRKG2, corresponding to a HOST TARGET binding site such as BINDING SITE I, BINDING SITE II or BINDING SITE III. Table 2 illustrates the complementarity of the nucleotide sequences of PRKG2 BINDING SITE, designated SEQ ID:12942, to the nucleotide sequence of VGAM426 RNA, herein designated VGAM RNA, also designated SEQ ID:3137.

Another function of VGAM426 is therefore inhibition of Protein Kinase, CGMP-dependent, Type II (PRKG2, Accession NM_006259), a gene which regulate a great variety of functions, including smooth muscle relaxation, neuronal excitability, and epithelial electrolyte transport. Accordingly, utilities of VGAM426 include diagnosis, prevention and treatment of diseases and clinical conditions associated with PRKG2. The function of PRKG2 and its association with various diseases and clinical conditions, has been established by previous studies, as described hereinabove with reference to VGAM16. Winged-helix Nude (WHN, Accession NM_003593) is another VGAM426 host target gene. WHN BINDING SITE is HOST TARGET binding site found in the 3' untranslated region of mRNA encoded by WHN, corresponding to a HOST TARGET binding site such as BINDING SITE I, BINDING SITE II or BINDING SITE III. Table 2 illustrates the complementarity of the nucleotide sequences of WHN BINDING SITE, designated SEQ ID:9648, to the nucleotide sequence of VGAM426 RNA, herein designated VGAM RNA, also designated SEQ ID:3137.

Another function of VGAM426 is therefore inhibition of Winged-helix Nude (WHN, Accession NM_003593), a gene which plays a role in transcriptional regulation. Accordingly, utilities of VGAM426 include diagnosis, prevention and treatment of diseases and clinical conditions associated with WHN. The function of WHN and its association with various diseases and clinical conditions, has been established by previous studies, as described hereinabove with reference to VGAM403. Allantoicase (ALLC, Accession NM_018436) is another VGAM426 host target gene. ALLC BINDING SITE is HOST TARGET binding site found in the 5" untranslated region of mRNA encoded by ALLC, corresponding to a HOST TARGET binding site such as BINDING SITE I, BINDING SITE II or BINDING SITE III. Table 2 illustrates the complementarity of the nucleotide sequences of ALLC BINDING SITE, designated SEQ ID:20497, to the nucleotide sequence of VGAM426 RNA, herein designated VGAM RNA, also designated SEQ ID:3137.

Another function of VGAM426 is therefore inhibition of Allantoicase (ALLC, Accession NM_018436). Accordingly, utilities of VGAM426 include diagnosis, prevention and treatment of diseases and clinical conditions associated with ALLC. E74-like Factor 1 (ets domain transcription factor) (ELF1, Accession XM_049376) is another VGAM426 host target gene. ELF1 BINDING SITE is HOST TARGET binding site found in the 3' untranslated region of mRNA encoded by ELF1, corresponding to a HOST TARGET binding site such as BINDING SITE I, BINDING SITE II or BINDING SITE III. Table 2 illustrates the complementarity of the nucleotide sequences of ELF1 BINDING SITE, designated SEQ ID:35402, to the nucleotide sequence of VGAM426 RNA, herein designated VGAM RNA, also designated SEQ ID:3137.

Another function of VGAM426 is therefore inhibition of E74-like Factor 1 (ets domain transcription factor) (ELF1, Accession XM_049376). Accordingly, utilities of VGAM426 include diagnosis, prevention and treatment of diseases and clinical conditions associated with ELF1. Epsin 3 (EPN3, Accession NM_017957) is another VGAM426 host target gene. EPN3 BINDING SITE is HOST TARGET binding site found in the 5' untranslated region of mRNA encoded by EPN3, corresponding to a HOST TARGET binding site such as BINDING SITE I, BINDING SITE II or BINDING SITE III. Table 2 illustrates the complementarity of the nucleotide sequences of EPN3 BINDING SITE, designated SEQ ID:19668, to the nucleotide sequence of VGAM426 RNA, herein designated VGAM RNA, also designated SEQ ID:3137.

Another function of VGAM426 is therefore inhibition of Epsin 3 (EPN3, Accession NM_017957). Accordingly, utilities of VGAM426 include diagnosis, prevention and treatment of diseases and clinical conditions associated with EPN3. FLJ11806 (Accession NM_024824) is another VGAM426 host target gene. FLJ11806 BINDING SITE is HOST TARGET binding site found in the 5' untranslated region of mRNA encoded by FLJ11806, corresponding to a HOST TARGET binding site such as BINDING SITE I, BINDING SITE II or BINDING SITE III. Table 2 illustrates the complementarity of the nucleotide sequences of FLJ11806 BINDING SITE, designated SEQ ID:24216, to the nucleotide sequence of VGAM426 RNA, herein designated VGAM RNA, also designated SEQ ID:3137.

Another function of VGAM426 is therefore inhibition of FLJ11806 (Accession NM_024824). Accordingly, utilities of VGAM426 include diagnosis, prevention and treatment of diseases and clinical conditions associated with FLJ11806. FLJ20294 (Accession NM_017749) is another VGAM426 host target gene. FLJ20294 BINDING SITE is HOST TARGET binding site found in the 3' untranslated region of mRNA encoded by FLJ20294, corresponding to a HOST TARGET binding site such as BINDING SITE I, BINDING SITE II or BINDING SITE III. Table 2 illustrates the complementarity of the nucleotide sequences of FLJ20294 BINDING SITE, designated SEQ ID:19343, to the nucleotide sequence of VGAM426 RNA, herein designated VGAM RNA, also designated SEQ ID:3137.

Another function of VGAM426 is therefore inhibition of FLJ20294 (Accession NM_017749). Accordingly, utilities of VGAM426 include diagnosis, prevention and treatment of diseases and clinical conditions associated with FLJ20294. FLJ23462 (Accession NM_024843) is another VGAM426 host target gene. FLJ23462 BINDING SITE is HOST TARGET binding site found in the 3' untranslated region of mRNA encoded by FLJ23462, corresponding to a HOST TARGET binding site such as BINDING SITE I, BINDING SITE II or BINDING SITE III. Table 2 illustrates the complementarity of the nucleotide sequences of FLJ23462 BINDING SITE, designated SEQ ID:24264, to the nucleotide sequence of VGAM426 RNA, herein designated VGAM RNA, also designated SEQ ID:3137.

Another function of VGAM426 is therefore inhibition of FLJ23462 (Accession NM_024843). Accordingly, utilities of VGAM426 include diagnosis, prevention and treatment of diseases and clinical conditions associated with FLJ23462. KIAA1202 (Accession XM_050478) is another VGAM426 host target gene. KIAA1202 BINDING SITE is HOST TARGET binding site found in the 3' untranslated region of mRNA encoded by KIAA1202, corresponding to a HOST TARGET binding site such as BINDING SITE I, BINDING SITE II or BINDING SITE III. Table 2 illustrates the complementarity of the nucleotide sequences of KIAA1202 BINDING SITE, designated SEQ ID:35639, to the nucleotide sequence of VGAM426 RNA, herein designated VGAM RNA, also designated SEQ ID:3137.

Another function of VGAM426 is therefore inhibition of KIAA1202 (Accession XM_050478). Accordingly, utilities of VGAM426 include diagnosis, prevention and treatment of diseases and clinical conditions associated with KIAA1202. MGC2452 (Accession NM_032644) is another VGAM426 host target gene. MGC2452 BINDING SITE is HOST TARGET binding site found in the 5' untranslated region of mRNA encoded by MGC2452, corresponding to a HOST TARGET binding site such as BINDING SITE I, BINDING SITE II or BINDING SITE III. Table 2 illustrates the complementarity of the nucleotide sequences of MGC2452 BINDING SITE, designated SEQ ID:26374, to the nucleotide sequence of VGAM426 RNA, herein designated VGAM RNA, also designated SEQ ID:3137.

Another function of VGAM426 is therefore inhibition of MGC2452 (Accession NM_032644). Accordingly, utilities of VGAM426 include diagnosis, prevention and treatment of diseases and clinical conditions associated with MGC2452. P115 (Accession NM_003715) is another VGAM426 host target gene. P115 BINDING SITE is HOST TARGET binding site found in the 3' untranslated region of mRNA encoded by P115, corresponding to a HOST TARGET binding site such as BINDING SITE I, BINDING SITE II or BINDING SITE III. Table 2 illustrates the complementarity of the nucleotide sequences of P115 BINDING SITE, designated SEQ ID:9812, to the nucleotide sequence of VGAM426 RNA, herein designated VGAM RNA, also designated SEQ ID:3137.

Another function of VGAM426 is therefore inhibition of P115 (Accession NM_003715). Accordingly, utilities of VGAM426 include diagnosis, prevention and treatment of diseases and clinical conditions associated with P115. Signal Sequence Receptor, Alpha (translocon-associated protein alpha) (SSR1, Accession NM_003144) is another VGAM426 host target gene. SSR1 BINDING SITE is HOST TARGET binding site found in the 3' untranslated region of mRNA encoded by SSR1, corresponding to a HOST TARGET binding site such as BINDING SITE I, BINDING SITE II or BINDING SITE III. Table 2 illustrates the complementarity of the nucleotide sequences of SSR1 BINDING SITE, designated SEQ ID:9115, to the nucleotide sequence of VGAM426 RNA, herein designated VGAM RNA, also designated SEQ ID:3137.

Another function of VGAM426 is therefore inhibition of Signal Sequence Receptor, Alpha (translocon-associated protein alpha) (SSR1, Accession NM_003144). Accordingly, utilities of VGAM426 include diagnosis, prevention and treatment of diseases and clinical conditions associated with SSR1. Testis Specific, 14 (TSGA14, Accession NM_018718) is another VGAM426 host target gene. TSGA14 BINDING SITE is HOST TARGET binding site found in the 3' untranslated region of mRNA encoded by TSGA14, corresponding to a HOST TARGET binding site such as BINDING SITE I, BINDING SITE II or BINDING SITE III. Table 2 illustrates the complementarity of the nucleotide sequences of TSGA14 BINDING SITE, designated SEQ ID:20795, to the nucleotide sequence of VGAM426 RNA, herein designated VGAM RNA, also designated SEQ ID:3137.

Another function of VGAM426 is therefore inhibition of Testis Specific, 14 (TSGA14, Accession NM_018718). Accordingly, utilities of VGAM426 include diagnosis, prevention and treatment of diseases and clinical conditions associated with TSGA14. LOC146337 (Accession XM_096982) is another VGAM426 host target gene. LOC146337 BINDING SITE is HOST TARGET binding site found in the 3' untranslated region of mRNA encoded by LOC146337, corresponding to a HOST TARGET binding site such as BINDING SITE I, BINDING SITE II or BINDING SITE III. Table 2 illustrates the complementarity of the nucleotide sequences of LOC146337 BINDING SITE, designated SEQ ID:40692, to the nucleotide sequence of VGAM426 RNA, herein designated VGAM RNA, also designated SEQ ID:3137.

Another function of VGAM426 is therefore inhibition of LOC146337 (Accession XM_096982). Accordingly, utilities of VGAM426 include diagnosis, prevention and treatment of diseases and clinical conditions associated with LOC146337. FIG. 1 further provides a conceptual description of a novel bioinformatically detected viral gene of the present invention, referred to here as Viral Genomic Address Messenger 427 (VGAM427) viral gene, which modulates expression of respective host target genes thereof, the function and utility of which host target genes is known in the art.

VGAM427 is a novel bioinformatically detected regulatory, non protein coding, viral micro RNA (miRNA) gene. The method by which VGAM427 was detected is described hereinabove with reference to FIGS. 1-8.

VGAM427 gene, herein designated VGAM GENE, is a viral gene contained in the genome of Rabies Virus. VGAM427 host target gene, herein designated VGAM HOST TARGET GENE, is a human gene contained in the human genome.

VGAM427 gene encodes a VGAM427 precursor RNA, herein designated VGAM PRECURSOR RNA. Similar to other miRNA genes, and unlike most ordinary genes, VGAM427 precursor RNA does not encode a protein. A nucleotide sequence identical or highly similar to the nucleotide sequence of VGAM427 precursor RNA is designated SEQ ID:413, and is provided hereinbelow with reference to the sequence listing part. Nucleotide sequence SEQ ID:413 is located at position 5539 relative to the genome of Rabies Virus.

VGAM427 precursor RNA folds onto itself, forming VGAM427 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM427 folded precursor RNA into VGAM427 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM427 RNA is designated SEQ ID:3138, and is provided hereinbelow with reference to the sequence listing part.

VGAM427 host target gene, herein designated VGAM HOST TARGET GENE, encodes a corresponding messenger RNA, VGAM427 host target RNA, herein designated VGAM HOST TARGET RNA. VGAM427 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM427 RNA, herein designated VGAM RNA, binds complementarily to one or more host target binding sites located in untranslated regions of VGAM427 host target RNA, herein designated VGAM HOST TARGET RNA. This complementary binding is due to the fact that the nucleotide sequence of VGAM427 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM427 RNA, herein designated VGAM RNA, may have a different number of host target binding sites in untranslated regions of a VGAM427 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM427 RNA, herein designated VGAM RNA, to host target binding sites on VGAM427 host target RNA, herein designated VGAM HOST TARGET RNA, such as BINDING SITE I, BINDING SITE II and BINDING SITE III, inhibits translation of VGAM427 host target RNA into VGAM427 host target protein, herein designated VGAM HOST TARGET PROTEIN. VGAM host target protein is therefore outlined by a broken line.

It is appreciated that VGAM427 host target gene, herein designated VGAM HOST TARGET GENE, in fact represents a plurality of VGAM427 host target genes. The mRNA of each one of this plurality of VGAM427 host target genes comprises one or more host target binding sites, each having a nucleotide sequence which is at least partly complementary to VGAM427 RNA, herein designated VGAM RNA, and which when bound by VGAM427 RNA causes inhibition of translation of respective one or more VGAM427 host target proteins.

It is further appreciated by one skilled in the art that the mode of translational inhibition illustrated by FIG. 1 with specific reference to translational inhibition exerted by VGAM427 gene, herein designated VGAM GENE, on one or more VGAM427 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM427 is inhibition of expression of host target genes, as part of a novel viral mechanism of attacking a host. Accordingly, utilities of VGAM427 include diagnosis, prevention and treatment of viral infection by Rabies Virus. Specific functions, and accordingly utilities, of VGAM427 correlate with, and may be deduced from, the identity of the host target genes which VGAM427 binds and inhibits, and the function of these host target genes, as elaborated hereinbelow.

Nucleotide sequences of the VGAM427 precursor RNA, herein designated VGAM PRECURSOR RNA, and of the 'diced' VGAM427 RNA, herein designated VGAM RNA, and a schematic representation of the secondary folding of VGAM427 folded precursor RNA, herein designated VGAM FOLDED PRECURSOR RNA, of VGAM427 are further described hereinbelow with reference to Table 1.

Nucleotide sequences of host target binding sites, such as BINDING SITE-I, BINDING SITE-II and BINDING SITE-III of FIG. 1, found on VGAM427 host target RNA, and schematic representation of the complementarity of each of these host target binding sites to VGAM427 RNA, herein designated VGAM RNA, are described hereinbelow with reference to Table 2.

As mentioned hereinabove with reference to FIG. 1, a function of VGAM427 gene, herein designated VGAM is inhibition of expression of VGAM427 target genes. It is appreciated that specific functions, and accordingly utilities, of VGAM427 correlate with, and may be deduced from, the identity of the target genes which VGAM427 binds and inhibits, and the function of these target genes, as elaborated hereinbelow.

Aldehyde Dehydrogenase 3 Family, Member A2 (ALDH3A2, Accession XM_045060) is a VGAM427 host target gene. ALDH3A2 BINDING SITE is HOST TARGET binding site found in the 3' untranslated region of mRNA encoded by ALDH3A2, corresponding to a HOST TARGET binding site such as BINDING SITE I, BINDING SITE II or BINDING SITE III. Table 2 illustrates the complementarity of the nucleotide sequences of ALDH3A2 BINDING SITE, designated SEQ ID:34339, to the nucleotide sequence of VGAM427 RNA, herein designated VGAM RNA, also designated SEQ ID:3138.

A function of VGAM427 is therefore inhibition of Aldehyde Dehydrogenase 3 Family, Member A2 (ALDH3A2, Accession XM_045060). Accordingly, utilities of VGAM427 include diagnosis, prevention and treatment of diseases and clinical conditions associated with ALDH3A2. Calnexin (CANX, Accession XM_113469) is another VGAM427 host target gene. CANX BINDING SITE is HOST TARGET binding site found in the 3' untranslated region of mRNA encoded by CANX, corresponding to a HOST TARGET binding site such as BINDING SITE I, BINDING SITE II or BINDING SITE III. Table 2 illustrates the complementarity of the nucleotide sequences of CANX BINDING SITE, designated SEQ ID:42275, to the nucleotide sequence of VGAM427 RNA, herein designated VGAM RNA, also designated SEQ ID:3138.

Another function of VGAM427 is therefore inhibition of Calnexin (CANX, Accession XM_113469), a gene which may function as a chaperone in the endoplasmic reticulum, involved in the secretion of proteins from the ER to the outer cellular membrane. Accordingly, utilities of VGAM427 include diagnosis, prevention and treatment of diseases and clinical conditions associated with CANX. The function of CANX and its association with various diseases and clinical conditions, has been established by previous studies, as described hereinabove with reference to VGAM116. Integrin, Beta 1 (fibronectin receptor, beta polypeptide, antigen CD29 includes MDF2, MSK12) (ITGB1, Accession NM_002211) is another VGAM427 host target gene. ITGB1 BINDING SITE is HOST TARGET binding site found in the 3' untranslated region of mRNA encoded by ITGB1, corresponding to a HOST TARGET binding site such as BINDING SITE I, BINDING SITE II or BINDING SITE III. Table 2 illustrates the complementarity of the nucleotide sequences of ITGB1 BINDING SITE, designated SEQ ID:7976, to the nucleotide sequence of VGAM427 RNA, herein designated VGAM RNA, also designated SEQ ID:3138.

Another function of VGAM427 is therefore inhibition of Integrin, Beta 1 (fibronectin receptor, beta polypeptide, antigen CD29 includes MDF2, MSK12) (ITGB1, Accession NM_002211), a gene which acts as a fibronectin receptor. Accordingly, utilities of VGAM427 include diagnosis, prevention and treatment of diseases and clinical conditions associated with ITGB1. The function of ITGB1 has been established by previous studies. See 135620. The fibronectin receptors contain a beta subunit that appears to be analogous to band 3 of integrin (Pytela et al., 1986; Johansson et al., 1987). Hynes (1987) proposed that there are 3 subfamilies within the family of human adhesion protein receptor heterodimers based upon the number of different beta subunits. The other 2 subfamilies are the platelet and the endothelial cell heterodimers, which use GP IIIa (OMIM Ref. No. 173470), and the leukocyte heterodimers, which contain a 95,000 Da beta subunit that is homologous to GP IIIa but is clearly a different protein (OMIM Ref. No. 116920). Zhang et al. (1988) examined human-mouse hybrid cells by indirect immunofluorescence with a monoclonal antibody that recognizes the beta subunit of the human fibronectin receptor. Cells that expressed the antigen at their surface were sorted by FACS and karyotyped. The findings, strengthened by isozyme analysis of markers for chromosomes 9 and 10, suggested that the beta subunit is located on 10p By examining the cation dependence of JAM2 (OMIM Ref. No. 606870) adhesion to a T-cell line, Cunningham et al. (2002) identified a manganese-enhanced binding component indicative of integrin involvement. Using neutralizing integrin antibodies, they showed that the manganese-enhanced binding component was due to an interaction between JAM2 and ITGA4/ITGB1. However, the interaction was only enabled following prior adhesion of JAM2 to JAM3 (OMIM Ref. No. 606871). Cunningham et al. (2002) determined that the engagement of all these ligands occurs through a nonacidic residue in an Ig-like fold of JAM2. An inhibitor of ITGA4, TBC772, attenuated the manganese-enhanced binding Animal model experiments lend further support to the function of ITGB1. Graus-Porta et al. (2001) used Cre/Lox-mediated recombination to generate mice with an Itgb1-null allele in the precursors of neurons and glia, thereby inactivating all beta-1-class integrin receptors in the nervous system. The mice died prematurely after birth with severe brain malformations. Using histologic sections of brains at varying ages, Graus-Porta et al. (2001) observed that cortical hemispheres and cerebellar folia fuse, and cortical laminae are perturbed in the knockout mice. These defects result from disorganization of the cortical marginal zone, where Graus-Porta et al. (2001) hypothesized that beta-1-class integrins regulate glial endfeet anchorage, meningeal basement membrane remodeling, and formation of the Cajal-Retzius cell layer. Graus-Porta et al. (2001) concluded that beta-1-class integrins are not essential for neuron-glia interactions and neuronal migration during corticogenesis. They noted that the phenotype of the beta-1-deficient mice resembles pathologic changes observed in human cortical dysplasias, suggesting that defective integrin-mediated signal transduction contributes to the development of some of these diseases It is appreciated that the abovementioned animal model for ITGB1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Zhang, Y.; Saison, M.; Spaepen, M.; De Strooper, B.; Van Leuven, F.; David, G.; Van den Berghe, H.; Cassiman, J.-J.: Mapping of human fibronectin receptor beta subunit gene to chromosome 10. Somat. Cell Molec. Genet. 14:99-104, 1988; and Graus-Porta, D.; Blaess, S.; Senften, M.; Littlewood-Evans, A.; Damsky, C.; Huang, Z.; Orban, P.; Klein, R.; Schittny, J. C.; Muller, U.: Beta-1-class integrins regulate the development.

Further studies establishing the function and utilities of ITGB1 are found in John Hopkins OMIM database record ID 135630, and in sited publications numbered 3340-335 and 3463 listed in the bibliography section hereinbelow, which are also hereby incorporated by reference. Phosphatidylinositol-4-phosphate 5-kinase, Type I, Alpha (PIP5K1A, Accession NM_003557) is another VGAM427 host target gene. PIP5K1A BINDING SITE is HOST TARGET binding site found in the 3' untranslated region of mRNA encoded by PIP5K1A, corresponding to a HOST TARGET binding site such as BINDING SITE I, BINDING SITE II or BINDING SITE III. Table 2 illustrates the complementarity of the nucleotide sequences of PIP5K1A BINDING SITE, designated SEQ ID:9601, to the nucleotide sequence of VGAM427 RNA, herein designated VGAM RNA, also designated SEQ ID:3138.

Another function of VGAM427 is therefore inhibition of Phosphatidylinositol-4-phosphate 5-kinase, Type I, Alpha (PIP5K1A, Accession NM_003557), a gene which is responsible for the synthesis of PtdIns (4,5)P2. Accordingly, utilities of VGAM427 include diagnosis, prevention and treatment of diseases and clinical conditions associated with PIP5K1A. The function of PIP5K1A has been established by previous studies. By searching sequence databases with peptide sequences obtained from the 68-kD type I PIP5K purified from bovine erythrocytes, Loijens and Anderson (1996) identified a human EST encoding PIP5K1A, which they called PIP5KI-alpha. They screened a human fetal brain cDNA library and isolated full-length PIP5K1A cDNAs. The deduced 549-amino acid protein has the conserved kinase homology domain of PIP5K family members. Within this domain, PIP5K1A shows 83% and 35% amino acid identity with PIP5K1B (OMIM Ref. No. 602745) and PIP5K2A (OMIM Ref. No. 603140), respectively. Overall, the PIP5K1A and PIP5K1B proteins are 64% identical. Recombinant PIP5K1A expressed in bacteria had a molecular mass of approximately 66.3 kD by Western blot analysis. The authors isolated additional PIP5K1A cDNAs which they suggested represent splicing isoforms. Northern blot analysis detected a major 4.2-kb PIP5K1A transcript which had a wide tissue distribution. Using deletion mutant analysis, Ishihara et al. (1998) identified an approximately 380-amino acid minimal core sequence of mouse Pip5k1a that was sufficient for phosphatidylinositol 4-phosphate kinase activity. Overexpression of mouse Pip5k1a in COS7 cells induced an increase in short actin fibers and a decrease in actin stress fibers.

Full details of the abovementioned studies are described in the following publications, the disclosure of which are hereby incorporated by reference:

Loijens, J. C.; Anderson, R. A.: Type I phosphatidylinositol-4-phosphate 5-kinases are distinct members of this novel lipid kinase family. J. Biol. Chem. 271:32937-32943, 1996; and Xie, Y.; Zhu, L.; Zhao, G.: Assignment of type I phosphatidylinositol-4-phosphate 5-kinase (PIP5K1A) to human chromosome bands 1q22-q24 by in situ hybridization. Cytogenet. Cell Genet.

Further studies establishing the function and utilities of PIP5K1A are found in John Hopkins OMIM database record ID 603275, and in sited publications numbered 8741-5068 listed in the bibliography section hereinbelow, which are also hereby incorporated by reference. Usher Syndrome 3A (USH3A, Accession NM_052995) is another VGAM427 host target gene. USH3A BINDING SITE is HOST TARGET binding site found in the 3' untranslated region of mRNA encoded by USH3A, corresponding to a HOST TARGET binding site such as BINDING SITE I, BINDING SITE II or BINDING SITE III. Table 2 illustrates the complementarity of the nucleotide sequences of USH3A BINDING SITE, designated SEQ ID:27559, to the nucleotide sequence of VGAM427 RNA, herein designated VGAM RNA, also designated SEQ ID:3138.

Another function of VGAM427 is therefore inhibition of Usher Syndrome 3A (USH3A, Accession NM_052995). Accordingly, utilities of VGAM427 include diagnosis, prevention and treatment of diseases and clinical conditions associated with USH3A. Zinc Finger Protein 189 (ZNF189, Accession NM_003452) is another VGAM427 host target gene. ZNF189 BINDING SITE is HOST TARGET binding site found in the 3' untranslated region of mRNA encoded by ZNF189, corresponding to a HOST TARGET binding site such as BINDING SITE I, BINDING SITE II or BINDING SITE III. Table 2 illustrates the complementarity of the nucleotide sequences of ZNF189 BINDING SITE, designated SEQ ID:9503, to the nucleotide sequence of VGAM427 RNA, herein designated VGAM RNA, also designated SEQ ID:3138.

Another function of VGAM427 is therefore inhibition of Zinc Finger Protein 189 (ZNF189, Accession NM_003452). Accordingly, utilities of VGAM427 include diagnosis, prevention and treatment of diseases and clinical conditions associated with ZNF189. FLJ10546 (Accession XM_002989) is another VGAM427 host target gene. FLJ10546 BINDING SITE is HOST TARGET binding site found in the 5' untranslated region of mRNA encoded by FLJ10546, corresponding to a HOST TARGET binding site such as BINDING SITE I, BINDING SITE II or BINDING SITE III. Table 2 illustrates the complementarity of the nucleotide sequences of FLJ10546 BINDING SITE, designated SEQ ID:29911, to the nucleotide sequence of VGAM427 RNA, herein designated VGAM RNA, also designated SEQ ID:3138.

Another function of VGAM427 is therefore inhibition of FLJ10546 (Accession XM_002989). Accordingly, utilities of VGAM427 include diagnosis, prevention and treatment of diseases and clinical conditions associated with FLJ10546. FLJ23563 (Accession XM_041701) is another VGAM427 host target gene. FLJ23563 BINDING SITE is HOST TARGET binding site found in the 3' untranslated region of mRNA encoded by FLJ23563, corresponding to a HOST TARGET binding site such as BINDING SITE I, BINDING SITE II or BINDING SITE III. Table 2 illustrates the complementarity of the nucleotide sequences of FLJ23563 BINDING SITE, designated SEQ ID:33558, to the nucleotide sequence of VGAM427 RNA, herein designated VGAM RNA, also designated SEQ ID:3138.

Another function of VGAM427 is therefore inhibition of FLJ23563 (Accession XM_041701). Accordingly, utilities of VGAM427 include diagnosis, prevention and treatment of diseases and clinical conditions associated with FLJ23563. LOC115294 (Accession XM_054302) is another VGAM427 host target gene. LOC115294 BINDING SITE is HOST TARGET binding site found in the 3' untranslated region of mRNA encoded by LOC115294, corresponding to a HOST TARGET binding site such as BINDING SITE I, BINDING SITE II or BINDING SITE III. Table 2 illustrates the complementarity of the nucleotide sequences of LOC115294 BINDING SITE, designated SEQ ID:36142, to the nucleotide sequence of VGAM427 RNA, herein designated VGAM RNA, also designated SEQ ID:3138.

Another function of VGAM427 is therefore inhibition of LOC115294 (Accession XM_054302). Accordingly, utilities of VGAM427 include diagnosis, prevention and treatment of diseases and clinical conditions associated with LOC115294. LOC150606 (Accession XM_097928) is another VGAM427 host target gene. LOC150606 BINDING SITE is HOST TARGET binding site found in the 3' untranslated region of mRNA encoded by LOC150606, corresponding to a HOST TARGET binding site such as BINDING SITE I, BINDING SITE II or BINDING SITE III. Table 2 illustrates the complementarity of the nucleotide sequences of LOC150606 BINDING SITE, designated SEQ ID:41233, to the nucleotide sequence of VGAM427 RNA, herein designated VGAM RNA, also designated SEQ ID:3138.

Another function of VGAM427 is therefore inhibition of LOC150606 (Accession XM_097928). Accordingly, utilities of VGAM427 include diagnosis, prevention and treatment of diseases and clinical conditions associated with LOC150606. LOC206426 (Accession XM_116505) is another VGAM427 host target gene. LOC206426 BINDING SITE is HOST TARGET binding site found in the 3' untranslated region of mRNA encoded by LOC206426, corresponding to a HOST TARGET binding site such as BINDING SITE I, BINDING SITE II or BINDING SITE III. Table 2 illustrates the complementarity of the nucleotide sequences of LOC206426 BINDING SITE, designated SEQ ID:43113, to the nucleotide sequence of VGAM427 RNA, herein designated VGAM RNA, also designated SEQ ID:3138.

Another function of VGAM427 is therefore inhibition of LOC206426 (Accession XM_116505). Accordingly, utilities of VGAM427 include diagnosis, prevention and treatment of diseases and clinical conditions associated with LOC206426. LOC55901 (Accession NM_018676) is another VGAM427 host target gene. LOC55901 BINDING SITE is HOST TARGET binding site found in the 5' untranslated region of mRNA encoded by LOC55901, corresponding to a HOST TARGET binding site such as BINDING SITE I, BINDING SITE II or BINDING SITE III. Table 2 illustrates the complementarity of the nucleotide sequences of LOC55901 BINDING SITE, designated SEQ ID:20749, to the nucleotide sequence of VGAM427 RNA, herein designated VGAM RNA, also designated SEQ ID:3138.

Another function of VGAM427 is therefore inhibition of LOC55901 (Accession NM_018676). Accordingly, utilities of VGAM427 include diagnosis, prevention and treatment of diseases and clinical conditions associated with LOC55901. FIG. 1 further provides a conceptual description of a novel bioinformatically detected viral gene of the present invention, referred to here as Viral Genomic Address Messenger 428 (VGAM428) viral gene, which modulates expression of respective host target genes thereof, the function and utility of which host target genes is known in the art.

VGAM428 is a novel bioinformatically detected regulatory, non protein coding, viral micro RNA (miRNA) gene. The method by which VGAM428 was detected is described hereinabove with reference to FIGS. 1-8.

VGAM428 gene, herein designated VGAM GENE, is a viral gene contained in the genome of Rabies Virus. VGAM428 host target gene, herein designated VGAM HOST TARGET GENE, is a human gene contained in the human genome.

VGAM428 gene encodes a VGAM428 precursor RNA, herein designated VGAM PRECURSOR RNA. Similar to other miRNA genes, and unlike most ordinary genes, VGAM428 precursor RNA does not encode a protein. A nucleotide sequence identical or highly similar to the nucleotide sequence of VGAM428 precursor RNA is designated SEQ ID:414, and is provided hereinbelow with reference to the sequence listing part. Nucleotide sequence SEQ ID:414 is located at position 6617 relative to the genome of Rabies Virus.

VGAM428 precursor RNA folds onto itself, forming VGAM428 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM428 folded precursor RNA into VGAM428 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM428 RNA is designated SEQ ID:3139, and is provided hereinbelow with reference to the sequence listing part.

VGAM428 host target gene, herein designated VGAM HOST TARGET GENE, encodes a corresponding messenger RNA, VGAM428 host target RNA, herein designated VGAM HOST TARGET RNA. VGAM428 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM428 RNA, herein designated VGAM RNA, binds complementarily to one or more host target binding sites located in untranslated regions of VGAM428 host target RNA, herein designated VGAM HOST TARGET RNA. This complementary binding is due to the fact that the nucleotide sequence of VGAM428 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM428 RNA, herein designated VGAM RNA, may have a different number of host target binding sites in untranslated regions of a VGAM428 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM428 RNA, herein designated VGAM RNA, to host target binding sites on VGAM428 host target RNA, herein designated VGAM HOST TARGET RNA, such as BINDING SITE I, BINDING SITE II and BINDING SITE III, inhibits translation of VGAM428 host target RNA into VGAM428 host target protein, herein designated VGAM HOST TARGET PROTEIN. VGAM host target protein is therefore outlined by a broken line.

It is appreciated that VGAM428 host target gene, herein designated VGAM HOST TARGET GENE, in fact represents a plurality of VGAM428 host target genes. The mRNA of each one of this plurality of VGAM428 host target genes comprises one or more host target binding sites, each having a nucleotide sequence which is at least partly complementary to VGAM428 RNA, herein designated VGAM RNA, and which when bound by VGAM428 RNA causes inhibition of translation of respective one or more VGAM428 host target proteins.

It is further appreciated by one skilled in the art that the mode of translational inhibition illustrated by FIG. 1 with specific reference to translational inhibition exerted by VGAM428 gene, herein designated VGAM GENE, on one or more VGAM428 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM428 is inhibition of expression of host target genes, as part of a novel viral mechanism of attacking a host. Accordingly, utilities of VGAM428 include diagnosis, prevention and treatment of viral infection by Rabies Virus. Specific functions, and accordingly utilities, of VGAM428 correlate with, and may be deduced from, the identity of the host target genes which VGAM428 binds and inhibits, and the function of these host target genes, as elaborated hereinbelow.

Nucleotide sequences of the VGAM428 precursor RNA, herein designated VGAM PRECURSOR RNA, and of the 'diced' VGAM428 RNA, herein designated VGAM RNA, and a schematic representation of the secondary folding of VGAM428 folded precursor RNA, herein designated VGAM FOLDED PRECURSOR RNA, of VGAM428 are further described hereinbelow with reference to Table 1.

Nucleotide sequences of host target binding sites, such as BINDING SITE-I, BINDING SITE-II and BINDING SITE-III of FIG. 1, found on VGAM428 host target RNA, and schematic representation of the complementarity of each of these host target binding sites to VGAM428 RNA, herein designated VGAM RNA, are described hereinbelow with reference to Table 2.

As mentioned hereinabove with reference to FIG. 1, a function of VGAM428 gene, herein designated VGAM is inhibition of expression of VGAM428 target genes. It is appreciated that specific functions, and accordingly utilities, of VGAM428 correlate with, and may be deduced from, the identity of the target genes which VGAM428 binds and inhibits, and the function of these target genes, as elaborated hereinbelow.

Paired Mesoderm Homeo Box 1 (PMX1, Accession NM_006902) is a VGAM428 host target gene. PMX1 BINDING SITE1 and PMX1 BINDING SITE2 are HOST TARGET binding sites found in untranslated regions of mRNA encoded by PMX1, corresponding to HOST TARGET binding sites such as BINDING SITE I, BINDING SITE II or BINDING SITE III. Table 2 illustrates the complementarity of the nucleotide sequences of PMX1 BINDING SITE1 and PMX1 BINDING SITE2, designated SEQ ID:13782 and SEQ ID:22917 respectively, to the nucleotide sequence of VGAM428 RNA, herein designated VGAM RNA, also designated SEQ ID:3139.

A function of VGAM428 is therefore inhibition of Paired Mesoderm Homeo Box 1 (PMX1, Accession NM_006902), a gene which acts as a transcriptional regulator of muscle creatine kinase. Accordingly, utilities of VGAM428 include diagnosis, prevention and treatment of diseases and clinical conditions associated with PMX1. The function of PMX1 and its association with various diseases and clinical conditions, has been established by previous studies, as described hereinabove with reference to VGAM381. DIS3 (Accession NM_014953) is another VGAM428 host target gene. DIS3 BINDING SITE is HOST TARGET binding site found in the 3' untranslated region of mRNA encoded by DIS3, corresponding to a HOST TARGET binding site such as BINDING SITE I, BINDING SITE II or BINDING SITE III. Table 2 illustrates the complementarity of the nucleotide sequences of DIS3 BINDING SITE, designated SEQ ID:17299, to the nucleotide sequence of VGAM428 RNA, herein designated VGAM RNA, also designated SEQ ID:3139.

Another function of VGAM428 is therefore inhibition of DIS3 (Accession NM_014953). Accordingly, utilities of VGAM428 include diagnosis, prevention and treatment of diseases and clinical conditions associated with DIS3. FLJ22329 (Accession NM_024656) is another VGAM428 host target gene. FLJ22329 BINDING SITE is HOST TARGET binding site found in the 3' untranslated region of mRNA encoded by FLJ22329, corresponding to a HOST TARGET binding site such as BINDING SITE I, BINDING SITE II or BINDING SITE III. Table 2 illustrates the complementarity of the nucleotide sequences of FLJ22329 BINDING SITE, designated SEQ ID:23957, to the nucleotide sequence of VGAM428 RNA, herein designated VGAM RNA, also designated SEQ ID:3139.

Another function of VGAM428 is therefore inhibition of FLJ22329 (Accession NM_024656). Accordingly, utilities of VGAM428 include diagnosis, prevention and treatment of diseases and clinical conditions associated with FLJ22329. LEC3 (Accession NM_015236) is another VGAM428 host target gene. LEC3 BINDING SITE is HOST TARGET binding site found in the 3' untranslated region of mRNA encoded by LEC3, corresponding to a HOST TARGET binding site such as BINDING SITE I, BINDING SITE II or BINDING SITE III. Table 2 illustrates the complementarity of the nucleotide sequences of LEC3 BINDING SITE, designated SEQ ID:17571, to the nucleotide sequence of VGAM428 RNA, herein designated VGAM RNA, also designated SEQ ID:3139.

Another function of VGAM428 is therefore inhibition of LEC3 (Accession NM_015236). Accordingly, utilities of VGAM428 include diagnosis, prevention and treatment of diseases and clinical conditions associated with LEC3. SP192 (Accession NM_021639) is another VGAM428 host target gene. SP192 BINDING SITE is HOST TARGET binding site found in the 5' untranslated region of mRNA encoded by SP192, corresponding to a HOST TARGET binding site such as BINDING SITE I, BINDING SITE II or BINDING SITE III. Table 2 illustrates the complementarity of the nucleotide sequences of SP192 BINDING SITE, designated SEQ ID:22298, to the nucleotide sequence of VGAM428 RNA, herein designated VGAM RNA, also designated SEQ ID:3139.

Another function of VGAM428 is therefore inhibition of SP192 (Accession NM_021639). Accordingly, utilities of VGAM428 include diagnosis, prevention and treatment of diseases and clinical conditions associated with SP192. LOC144667 (Accession XM_096648) is another VGAM428 host target gene. LOC144667 BINDING SITE is HOST TARGET binding site found in the 3' untranslated region of mRNA encoded by LOC144667, corresponding to a HOST TARGET binding site such as BINDING SITE I, BINDING SITE II or BINDING SITE III. Table 2 illustrates the complementarity of the nucleotide sequences of LOC144667 BINDING SITE, designated SEQ ID:40451, to the nucleotide sequence of VGAM428 RNA, herein designated VGAM RNA, also designated SEQ ID:3139.

Another function of VGAM428 is therefore inhibition of LOC144667 (Accession XM_096648). Accordingly, utilities of VGAM428 include diagnosis, prevention and treatment of diseases and clinical conditions associated with LOC144667. LOC151996 (Accession XM_098151) is another VGAM428 host target gene. LOC151996 BINDING SITE is HOST TARGET binding site found in the 5' untranslated region of mRNA encoded by LOC151996, corresponding to a HOST TARGET binding site such as BINDING SITE I, BINDING SITE II or BINDING SITE III. Table 2 illustrates the complementarity of the nucleotide sequences of LOC151996 BINDING SITE, designated SEQ ID:41416, to the nucleotide sequence of VGAM428 RNA, herein designated VGAM RNA, also designated SEQ ID:3139.

Another function of VGAM428 is therefore inhibition of LOC151996 (Accession XM_098151). Accordingly, utilities of VGAM428 include diagnosis, prevention and treatment of diseases and clinical conditions associated with LOC151996. LOC256113 (Accession XM_172989) is another VGAM428 host target gene. LOC256113 BINDING SITE is HOST TARGET binding site found in the 5' untranslated region of mRNA encoded by LOC256113, corresponding to a HOST TARGET binding site such as BINDING SITE I, BINDING SITE II or BINDING SITE III. Table 2 illustrates the complementarity of the nucleotide sequences of LOC256113 BINDING SITE, designated SEQ ID:46260, to the nucleotide sequence of VGAM428 RNA, herein designated VGAM RNA, also designated SEQ ID:3139.

Another function of VGAM428 is therefore inhibition of LOC256113 (Accession XM_172989). Accordingly, utilities of VGAM428 include diagnosis, prevention and treatment of diseases and clinical conditions associated with LOC256113. FIG. 1 further provides a conceptual description of a novel bioinformatically detected viral gene of the present invention, referred to here as Viral Genomic Address Messenger 429 (VGAM429) viral gene, which modulates expression of respective host target genes thereof, the function and utility of which host target genes is known in the art.

VGAM429 is a novel bioinformatically detected regulatory, non protein coding, viral micro RNA (miRNA) gene. The method by which VGAM429 was detected is described hereinabove with reference to FIGS. 1-8.

VGAM429 gene, herein designated VGAM GENE, is a viral gene contained in the genome of Rabbit Hemorrhagic Disease Virus. VGAM429 host target gene, herein designated VGAM HOST TARGET GENE, is a human gene contained in the human genome.

VGAM429 gene encodes a VGAM429 precursor RNA, herein designated VGAM PRECURSOR RNA. Similar to other miRNA genes, and unlike most ordinary genes, VGAM429 precursor RNA does not encode a protein. A nucleotide sequence identical or highly similar to the nucleotide sequence of VGAM429 precursor RNA is designated SEQ ID:415, and is provided hereinbelow with reference to the sequence listing part. Nucleotide sequence SEQ ID:415 is located at position 4010 relative to the genome of Rabbit Hemorrhagic Disease Virus.

VGAM429 precursor RNA folds onto itself, forming VGAM429 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM429 folded precursor RNA into VGAM429 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM429 RNA is designated SEQ ID:3140, and is provided hereinbelow with reference to the sequence listing part.

VGAM429 host target gene, herein designated VGAM HOST TARGET GENE, encodes a corresponding messenger RNA, VGAM429 host target RNA, herein designated VGAM HOST TARGET RNA. VGAM429 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM429 RNA, herein designated VGAM RNA, binds complementarily to one or more host target binding sites located in untranslated regions of VGAM429 host target RNA, herein designated VGAM HOST TARGET RNA. This complementary binding is due to the fact that the nucleotide sequence of VGAM429 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM429 RNA, herein designated VGAM RNA, may have a different number of host target binding sites in untranslated regions of a VGAM429 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM429 RNA, herein designated VGAM RNA, to host target binding sites on VGAM429 host target RNA, herein designated VGAM HOST TARGET RNA, such as BINDING SITE I, BINDING SITE II and BINDING SITE III, inhibits translation of VGAM429 host target RNA into VGAM429 host target protein, herein designated VGAM HOST TARGET PROTEIN. VGAM host target protein is therefore outlined by a broken line.

It is appreciated that VGAM429 host target gene, herein designated VGAM HOST TARGET GENE, in fact represents a plurality of VGAM429 host target genes. The mRNA of each one of this plurality of VGAM429 host target genes comprises one or more host target binding sites, each having a nucleotide sequence which is at least partly complementary to VGAM429 RNA, herein designated VGAM RNA, and which when bound by VGAM429 RNA causes inhibition of translation of respective one or more VGAM429 host target proteins.

It is further appreciated by one skilled in the art that the mode of translational inhibition illustrated by FIG. 1 with specific reference to translational inhibition exerted by VGAM429 gene, herein designated VGAM GENE, on one or more VGAM429 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM429 is inhibition of expression of host target genes, as part of a novel viral mechanism of attacking a host. Accordingly, utilities of VGAM429 include diagnosis, prevention and treatment of viral infection by Rabbit Hemorrhagic Disease Virus. Specific functions, and accordingly utilities, of VGAM429 correlate with, and may be deduced from, the identity of the host target genes which VGAM429 binds and inhibits, and the function of these host target genes, as elaborated hereinbelow.

Nucleotide sequences of the VGAM429 precursor RNA, herein designated VGAM PRECURSOR RNA, and of the 'diced' VGAM429 RNA, herein designated VGAM RNA, and a schematic representation of the secondary folding of VGAM429 folded precursor RNA, herein designated VGAM FOLDED PRECURSOR RNA, of VGAM429 are further described hereinbelow with reference to Table 1.

Nucleotide sequences of host target binding sites, such as BINDING SITE-I, BINDING SITE-II and BINDING SITE-III of FIG. 1, found on VGAM429 host target RNA, and schematic representation of the complementarity of each of these host target binding sites to VGAM429 RNA, herein designated VGAM RNA, are described hereinbelow with reference to Table 2.

As mentioned hereinabove with reference to FIG. 1, a function of VGAM429 gene, herein designated VGAM is inhibition of expression of VGAM429 target genes. It is appreciated that specific functions, and accordingly utilities, of VGAM429 correlate with, and may be deduced from, the identity of the target genes which VGAM429 binds and inhibits, and the function of these target genes, as elaborated hereinbelow.

Angiopoietin 1 (ANGPT1, Accession NM_001146) is a VGAM429 host target gene. ANGPT1 BINDING SITE1 and ANGPT1 BINDING SITE2 are HOST TARGET binding sites found in untranslated regions of mRNA encoded by ANGPT1, corresponding to HOST TARGET binding sites such as BINDING SITE I, BINDING SITE II or BINDING SITE III. Table 2 illustrates the complementarity of the nucleotide sequences of ANGPT1 BINDING SITE1 and ANGPT1 BINDING SITE2, designated SEQ ID:6815 and SEQ ID:29290 respectively, to the nucleotide sequence of VGAM429 RNA, herein designated VGAM RNA, also designated SEQ ID:3140.

A function of VGAM429 is therefore inhibition of Angiopoietin 1 (ANGPT1, Accession NM_001146), a gene which binds and activates tie2 receptor by inducing its tyrosine phosphorylation. Accordingly, utilities of VGAM429 include diagnosis, prevention and treatment of diseases and clinical conditions associated with ANGPT1.

The function of ANGPT1 and its association with various diseases and clinical conditions, has been established by previous studies, as described hereinabove with reference to VGAM291. Retinoblastoma Binding Protein 9 (RBBP9, Accession XM_046553) is another VGAM429 host target gene. RBBP9 BINDING SITE is HOST TARGET binding site found in the 3' untranslated region of mRNA encoded by RBBP9, corresponding to a HOST TARGET binding site such as BINDING SITE I, BINDING SITE II or BINDING SITE III. Table 2 illustrates the complementarity of the nucleotide sequences of RBBP9 BINDING SITE, designated SEQ ID:34743, to the nucleotide sequence of VGAM429 RNA, herein designated VGAM RNA, also designated SEQ ID:3140.

Another function of VGAM429 is therefore inhibition of Retinoblastoma Binding Protein 9 (RBBP9, Accession XM_046553). Accordingly, utilities of VGAM429 include diagnosis, prevention and treatment of diseases and clinical conditions associated with RBBP9. Ubiquitin Specific Protease 11 (USP11, Accession NM_004651) is another VGAM429 host target gene. USP11 BINDING SITE is HOST TARGET binding site found in the 5' untranslated region of mRNA encoded by USP11, corresponding to a HOST TARGET binding site such as BINDING SITE I, BINDING SITE II or BINDING SITE III. Table 2 illustrates the complementarity of the nucleotide sequences of USP11 BINDING SITE, designated SEQ ID:11021, to the nucleotide sequence of VGAM429 RNA, herein designated VGAM RNA, also designated SEQ ID:3140.

Another function of VGAM429 is therefore inhibition of Ubiquitin Specific Protease 11 (USP11, Accession NM_004651), a gene which removes ubiquitin from ubiquitin-conjugated proteins. Accordingly, utilities of VGAM429 include diagnosis, prevention and treatment of diseases and clinical conditions associated with USP11. The function of USP11 has been established by previous studies. Swanson et al. (1996) used a differential hybridization screen to isolate a novel cDNA from a human retina library. The cDNA encodes a protein of 690 amino acids and has strong homology to the proteins encoded by a variety of ubiquitin hydrolases (p values ranging between 2.4e-265 and 1.4e-13). Swanson et al. (1996) reviewed the role of ubiquitination in protein degradation and presented evidence that disturbances in protein processing and turnover can lead to retinal degeneration. They noted that there are at least 4 X-linked retinal diseases that map to a region within or overlapping the UHX1 interval. They cited evidence indicating that ubiquitin hydrolases play a role in oncogenesis (oncogenes and tumor suppressor gene products are degraded in ubiquitin-dependent pathways) and that the region of loss of heterozygosity in ovarian cancer lies within the mapping interval defined for UHX1. Swanson et al. (1996) mapped the structural gene encoding this cDNA, which they designated UHX1, to Xp21.2-p11.2 by somatic cell hybridization. Stoddart et al. (1999) mapped the UHX1 gene to Xp11.3 by inclusion within a YAC contig Full details of the abovementioned studies are described in the following publications, the disclosure of which are hereby incorporated by reference:

Swanson, D. A.; Freund, C. L.; Ploder, L.; McInnes, R. R.; Valle, D.: A ubiquitin C-terminal hydrolase gene on the proximal short arm of the X chromosome: implications for X-linked retinal disorders. Hum. Molec. Genet. 5:533-538, 1996; and Stoddart, K. L.; Jermak, C.; Nagaraja, R.; Schlessinger, D.; Bech-Hansen, N. T.: Physical map covering a 2 Mb region in human Xp11.3 distal to DX6849. Gene 227:111-116, 1999.

Further studies establishing the function and utilities of USP11 are found in John Hopkins OMIM database record ID 300050, and in sited publications numbered 8997-8998 listed in the bibliography section hereinbelow, which are also hereby incorporated by reference. DKFZP564O0463 (Accession NM_014156) is another VGAM429 host target gene. DKFZP564O0463 BINDING SITE is HOST TARGET binding site found in the 3' untranslated region of mRNA encoded by DKFZP564O0463, corresponding to a HOST TARGET binding site such as BINDING SITE I, BINDING SITE II or BINDING SITE III. Table 2 illustrates the complementarity of the nucleotide sequences of DKFZP564O0463 BINDING SITE, designated SEQ ID:15444, to the nucleotide sequence of VGAM429 RNA, herein designated VGAM RNA, also designated SEQ ID:3140.

Another function of VGAM429 is therefore inhibition of DKFZP564O0463 (Accession NM_014156). Accordingly, utilities of VGAM429 include diagnosis, prevention and treatment of diseases and clinical conditions associated with DKFZP564O0463. E74-like Factor 4 (ets domain transcription factor) (ELF4, Accession NM_001421) is another VGAM429 host target gene. ELF4 BINDING SITE is HOST TARGET binding site found in the 5' untranslated region of mRNA encoded by ELF4, corresponding to a HOST TARGET binding site such as BINDING SITE I, BINDING SITE II or BINDING SITE III. Table 2 illustrates the complementarity of the nucleotide sequences of ELF4 BINDING SITE, designated SEQ ID:7125, to the nucleotide sequence of VGAM429 RNA, herein designated VGAM RNA, also designated SEQ ID:3140.

Another function of VGAM429 is therefore inhibition of E74-like Factor 4 (ets domain transcription factor) (ELF4, Accession NM_001421). Accordingly, utilities of VGAM429 include diagnosis, prevention and treatment of diseases and clinical conditions associated with ELF4. FLJ20716 (Accession NM_017938) is another VGAM429 host target gene. FLJ20716 BINDING SITE is HOST TARGET binding site found in the 3" untranslated region of mRNA encoded by FLJ20716, corresponding to a HOST TARGET binding site such as BINDING SITE I, BINDING SITE II or BINDING SITE III. Table 2 illustrates the complementarity of the nucleotide sequences of FLJ20716 BINDING SITE, designated SEQ ID:19632, to the nucleotide sequence of VGAM429 RNA, herein designated VGAM RNA, also designated SEQ ID:3140.

Another function of VGAM429 is therefore inhibition of FLJ20716 (Accession NM_017938). Accordingly, utilities of VGAM429 include diagnosis, prevention and treatment of diseases and clinical conditions associated with FLJ20716. HCC-4 (Accession NM_138611) is another VGAM429 host target gene. HCC-4 BINDING SITE is HOST TARGET binding site found in the 3' untranslated region of mRNA encoded by HCC-4, corresponding to a HOST TARGET binding site such as BINDING SITE I, BINDING SITE II or BINDING SITE III. Table 2 illustrates the complementarity of the nucleotide sequences of HCC-4 BINDING SITE, designated SEQ ID:28898, to the nucleotide sequence of VGAM429 RNA, herein designated VGAM RNA, also designated SEQ ID:3140.

Another function of VGAM429 is therefore inhibition of HCC-4 (Accession NM_138611). Accordingly, utilities of VGAM429 include diagnosis, prevention and treatment of diseases and clinical conditions associated with HCC-4. IKKE (Accession NM_014002) is another VGAM429 host target gene. IKKE BINDING SITE is HOST TARGET binding site found in the 3' untranslated region of mRNA encoded by IKKE, corresponding to a HOST TARGET binding site such as BINDING SITE I, BINDING SITE II or BINDING SITE III. Table 2 illustrates the complementarity of the nucleotide sequences of IKKE BINDING SITE, designated SEQ ID:15205, to the nucleotide sequence of VGAM429 RNA, herein designated VGAM RNA, also designated SEQ ID:3140.

Another function of VGAM429 is therefore inhibition of IKKE (Accession NM_014002). Accordingly, utilities of VGAM429 include diagnosis, prevention and treatment of diseases and clinical conditions associated with IKKE. KIAA0794 (Accession XM_087353) is another VGAM429 host target gene. KIAA0794 BINDING SITE is HOST TARGET binding site found in the 3" untranslated region of mRNA encoded by KIAA0794, corresponding to a HOST TARGET binding site such as BINDING SITE I, BINDING SITE II or BINDING SITE III. Table 2 illustrates the complementarity of the nucleotide sequences of KIAA0794 BINDING SITE, designated SEQ ID:39183, to the nucleotide sequence of VGAM429 RNA, herein designated VGAM RNA, also designated SEQ ID:3140.

Another function of VGAM429 is therefore inhibition of KIAA0794 (Accession XM_087353). Accordingly, utilities of VGAM429 include diagnosis, prevention and treatment of diseases and clinical conditions associated with KIAA0794. KIAA1522 (Accession XM_036299) is another VGAM429 host target gene. KIAA1522 BINDING SITE is HOST TARGET binding site found in the 3' untranslated region of mRNA encoded by KIAA1522, corresponding to a HOST TARGET binding site such as BINDING SITE I, BINDING SITE II or BINDING SITE III. Table 2 illustrates the complementarity of the nucleotide sequences of KIAA1522 BINDING SITE, designated SEQ ID:32420, to the nucleotide sequence of VGAM429 RNA, herein designated VGAM RNA, also designated SEQ ID:3140.

Another function of VGAM429 is therefore inhibition of KIAA1522 (Accession XM_036299). Accordingly, utilities of VGAM429 include diagnosis, prevention and treatment of diseases and clinical conditions associated with KIAA1522. LOC146315 (Accession XM_027576) is another VGAM429 host target gene. LOC146315 BINDING SITE is HOST TARGET binding site found in the 5' untranslated region of mRNA encoded by LOC146315, corresponding to a HOST TARGET binding site such as BINDING SITE I, BINDING SITE II or BINDING SITE III. Table 2 illustrates the complementarity of the nucleotide sequences of LOC146315 BINDING SITE, designated SEQ ID:30534, to the nucleotide sequence of VGAM429 RNA, herein designated VGAM RNA, also designated SEQ ID:3140.

Another function of VGAM429 is therefore inhibition of LOC146315 (Accession XM_027576). Accordingly, utilities of VGAM429 include diagnosis, prevention and treatment of diseases and clinical conditions associated with LOC146315. LOC146515 (Accession XM_085493) is another VGAM429 host target gene. LOC146515 BINDING SITE is HOST TARGET binding site found in the 5' untranslated region of mRNA encoded by LOC146515, corresponding to a HOST TARGET binding site such as BINDING SITE I, BINDING SITE II or BINDING SITE III. Table 2 illustrates the complementarity of the nucleotide sequences of LOC146515 BINDING SITE, designated SEQ ID:38195, to the nucleotide sequence of VGAM429 RNA, herein designated VGAM RNA, also designated SEQ ID:3140.

Another function of VGAM429 is therefore inhibition of LOC146515 (Accession XM_085493). Accordingly, utilities of VGAM429 include diagnosis, prevention and treatment of diseases and clinical conditions associated with LOC146515. LOC221025 (Accession XM_167644) is another VGAM429 host target gene. LOC221025 BINDING SITE is HOST TARGET binding site found in the 3' untranslated region of mRNA encoded by LOC221025, corresponding to a HOST TARGET binding site such as BINDING SITE I, BINDING SITE II or BINDING SITE III. Table 2 illustrates the complementarity of the nucleotide sequences of LOC221025 BINDING SITE, designated SEQ ID:44746, to the nucleotide sequence of VGAM429 RNA, herein designated VGAM RNA, also designated SEQ ID:3140.

Another function of VGAM429 is therefore inhibition of LOC221025 (Accession XM_167644). Accordingly, utilities of VGAM429 include diagnosis, prevention and treatment of diseases and clinical conditions associated with LOC221025. LOC92661 (Accession XM_046465) is another VGAM429 host target gene. LOC92661 BINDING SITE is HOST TARGET binding site found in the 3' untranslated region of mRNA encoded by LOC92661, corresponding to a HOST TARGET binding site such as BINDING SITE I, BINDING SITE II or BINDING SITE III. Table 2 illustrates the complementarity of the nucleotide sequences of LOC92661 BINDING SITE, designated SEQ ID:34726, to the nucleotide sequence of VGAM429 RNA, herein designated VGAM RNA, also designated SEQ ID:3140.

Another function of VGAM429 is therefore inhibition of LOC92661 (Accession XM_046465). Accordingly, utilities of VGAM429 include diagnosis, prevention and treatment of diseases and clinical conditions associated with LOC92661. FIG. 1 further provides a conceptual description of a novel bioinformatically detected viral gene of the present invention, referred to here as Viral Genomic Address Messenger 430 (VGAM430) viral gene, which modulates expression of respective host target genes thereof, the function and utility of which host target genes is known in the art.

VGAM430 is a novel bioinformatically detected regulatory, non protein coding, viral micro RNA (miRNA) gene. The method by which VGAM430 was detected is described hereinabove with reference to FIGS. 1-8.

VGAM430 gene, herein designated VGAM GENE, is a viral gene contained in the genome of Rabbit Hemorrhagic Disease Virus. VGAM430 host target gene, herein designated VGAM HOST TARGET GENE, is a human gene contained in the human genome.

VGAM430 gene encodes a VGAM430 precursor RNA, herein designated VGAM PRECURSOR RNA. Similar to other miRNA genes, and unlike most ordinary genes, VGAM430 precursor RNA does not encode a protein. A nucleotide sequence identical or highly similar to the nucleotide sequence of VGAM430 precursor RNA is designated SEQ ID:416, and is provided hereinbelow with reference to the sequence listing part. Nucleotide sequence SEQ ID:416 is located at position 6133 relative to the genome of Rabbit Hemorrhagic Disease Virus.

VGAM430 precursor RNA folds onto itself, forming VGAM430 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM430 folded precursor RNA into VGAM430 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM430 RNA is designated SEQ ID:3141, and is provided hereinbelow with reference to the sequence listing part.

VGAM430 host target gene, herein designated VGAM HOST TARGET GENE, encodes a corresponding messenger RNA, VGAM430 host target RNA, herein designated VGAM HOST TARGET RNA. VGAM430 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM430 RNA, herein designated VGAM RNA, binds complementarily to one or more host target binding sites located in untranslated regions of VGAM430 host target RNA, herein designated VGAM HOST TARGET RNA. This complementary binding is due to the fact that the nucleotide sequence of VGAM430 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM430 RNA, herein designated VGAM RNA, may have a different number of host target binding sites in untranslated regions of a VGAM430 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM430 RNA, herein designated VGAM RNA, to host target binding sites on VGAM430 host target RNA, herein designated VGAM HOST TARGET RNA, such as BINDING SITE I, BINDING SITE II and BINDING SITE III, inhibits translation of VGAM430 host target RNA into VGAM430 host target protein, herein designated VGAM HOST TARGET PROTEIN. VGAM host target protein is therefore outlined by a broken line.

It is appreciated that VGAM430 host target gene, herein designated VGAM HOST TARGET GENE, in fact represents a plurality of VGAM430 host target genes. The mRNA of each one of this plurality of VGAM430 host target genes comprises one or more host target binding sites, each having a nucleotide sequence which is at least partly complementary to VGAM430 RNA, herein designated VGAM RNA, and which when bound by VGAM430 RNA causes inhibition of translation of respective one or more VGAM430 host target proteins.

It is further appreciated by one skilled in the art that the mode of translational inhibition illustrated by FIG. 1 with specific reference to translational inhibition exerted by VGAM430 gene, herein designated VGAM GENE, on one or more VGAM430 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM430 is inhibition of expression of host target genes, as part of a novel viral mechanism of attacking a host. Accordingly, utilities of VGAM430 include diagnosis, prevention and treatment of viral infection by Rabbit Hemorrhagic Disease Virus. Specific functions, and accordingly utilities, of VGAM430 correlate with, and may be deduced from, the identity of the host target genes which VGAM430 binds and inhibits, and the function of these host target genes, as elaborated hereinbelow.

Nucleotide sequences of the VGAM430 precursor RNA, herein designated VGAM PRECURSOR RNA, and of the 'diced' VGAM430 RNA, herein designated VGAM RNA, and a schematic representation of the secondary folding of VGAM430 folded precursor RNA, herein designated VGAM FOLDED PRECURSOR RNA, of VGAM430 are further described hereinbelow with reference to Table 1.

Nucleotide sequences of host target binding sites, such as BINDING SITE-I, BINDING SITE-II and BINDING SITE-III of FIG. 1, found on VGAM430 host target RNA, and schematic representation of the complementarity of each of these host target binding sites to VGAM430 RNA, herein designated VGAM RNA, are described hereinbelow with reference to Table 2.

As mentioned hereinabove with reference to FIG. 1, a function of VGAM430 gene, herein designated VGAM is inhibition of expression of VGAM430 target genes. It is appreciated that specific functions, and accordingly utilities, of VGAM430 correlate with, and may be deduced from, the identity of the target genes which VGAM430 binds and inhibits, and the function of these target genes, as elaborated hereinbelow.

Adenosine A3 Receptor (ADORA3, Accession NM_000677) is a VGAM430 host target gene. ADORA3 BINDING SITE is HOST TARGET binding site found in the 5' untranslated region of mRNA encoded by ADORA3, corresponding to a HOST TARGET binding site such as BINDING SITE I, BINDING SITE II or BINDING SITE III. Table 2 illustrates the complementarity of the nucleotide sequences of ADORA3 BINDING SITE, designated SEQ ID:6333, to the nucleotide sequence of VGAM430 RNA, herein designated VGAM RNA, also designated SEQ ID:3141.

A function of VGAM430 is therefore inhibition of Adenosine A3 Receptor (ADORA3, Accession NM_000677), a gene which the activity of this receptor is mediated by g proteins which inhibits adenylyl cyclase. Accordingly, utilities of VGAM430 include diagnosis, prevention and treatment of diseases and clinical conditions associated with ADORA3. The function of ADORA3 has been established by previous studies. There are 3 types of adenosine receptors, each of which contains 7 transmembrane domains and interacts with G proteins. The A1 receptors inhibit adenylate cyclase while the type A2 receptors stimulate activity. Each adenosine receptor has a specific pattern of ligand binding and a unique tissue distribution (Zhao et al., 1995). The A3 adenosine receptor was cloned from rat brain (Zhou et al., 1992) and human heart (Sajjadi and Firestein, 1993). The rat A3 receptor protein is about 50 to 60% identical to the A1 and A2 receptors and has been shown to be an inhibitor of adenylate cyclase activity. By interspecific backcross analysis, Wilkie et al. (1993) localized the adenosine A3 receptor to chromosome 3 in the mouse, suggesting a human chromosomal localization of 1p13 from known mouse/human linkage homologies. Zhao et al. (1995) also mapped the A3 receptor by interspecific backcross analysis to mouse chromosome 3. This prediction was confirmed by Monitto et al. (1995), who mapped the ADORA3 gene to human 1p at a distance between 8 and 17 cM from the centromere. PCR amplification of DNAs from a human/rodent somatic cell hybrid mapping panel was followed by PCR analysis of pooled YAC DNA. From the marker content of the YAC, the gene was thought to map to 1p21-p13.

Full details of the abovementioned studies are described in the following publications, the disclosure of which are hereby incorporated by reference:

Zhao, Z.; Ravid, S.; Ravid, K.: Chromosomal mapping of the mouse A3 adenosine receptor gene, Adora3. Genomics 30:118-119, 1995; and Monitto, C. L.; Levitt, R. C.; DiSilvestre, D.; Holroyd, K. J.: Localization of the A(3) adenosine receptor gene (ADORA3) to human chromosome 1p. Genomics 26:637-638, 1995.

Further studies establishing the function and utilities of ADORA3 are found in John Hopkins OMIM database record ID 600445, and in sited publications numbered 10222-1022 and 11892-10226 listed in the bibliography section hereinbelow, which are also hereby incorporated by reference. BCL2-antagonist/killer 1 (BAK1, Accession XM_166333) is another VGAM430 host target gene. BAK1 BINDING SITE is HOST TARGET binding site found in the 3' untranslated region of mRNA encoded by BAK1, corresponding to a HOST TARGET binding site such as BINDING SITE I, BINDING SITE II or BINDING SITE III. Table 2 illustrates the complementarity of the nucleotide sequences of BAK1 BINDING SITE, designated SEQ ID:44176, to the nucleotide sequence of VGAM430 RNA, herein designated VGAM RNA, also designated SEQ ID:3141.

Another function of VGAM430 is therefore inhibition of BCL2-antagonist/killer 1 (BAK1, Accession XM_166333), a gene which accelerates programmed cell death by binding to, and antagonizing the a repressor bcl-2. Accordingly, utilities of VGAM430 include diagnosis, prevention and treatment of diseases and clinical conditions associated with BAK1. The function of BAK1 has been established by previous studies. The BCL2 oncogene (OMIM Ref. No. 151430), which is activated in follicular lymphomas, functions as a potent suppressor of apoptosis under diverse conditions. Chittenden et al. (1995) and Kiefer et al. (1995) described the cDNA cloning and functional analysis of a new BCL2 homolog, BAK, which promotes cell death and counteracts the protection from apoptosis provided by BCL2. Moreover, Chittenden et al. (1995) found that enforced expression of BAK induced rapid and extensive apoptosis of serum-deprived fibroblasts. This suggested that BAK may be directly involved in activating the cell death machinery. Kiefer et al. (1995) pointed out that, like BAX (OMIM Ref. No. 600040), the BAK gene product primarily enhances apoptotic cell death following an appropriate stimulus. Unlike BAX, however, BAK can inhibit cell death in an Epstein-Barr virus-transformed cell line. The caspase-activated form of BID (OMIM Ref. No. 601997), tBID, triggers the homooligomerization of multidomain conserved proapoptotic family members BAK or BAX, resulting in the release of cytochrome c from mitochondria. Wei et al. (2001) found that cells lacking both BAK and BAX, but not cells lacking only one of these components, are completely resistant to tBID-induced cytochrome c release and apoptosis. Moreover, doubly deficient cells are resistant to multiple apoptotic stimuli that act through disruption of mitochondrial function: staurosporine, ultraviolet radiation, growth factor deprivation, etoposide, and the endoplasmic reticulum stress stimuli thapsigargin and tunicamycin. Thus, Wei et al. (2001) concluded that activation of a 'multidomain' proapoptotic member, BAK or BAX, appears to be an essential gateway to mitochondrial dysfunction required for cell death in response to diverse stimuli. Animal model experiments lend further support to the function of BAK1. Proapoptotic Bcl2 family members have been proposed to play a central role in regulating apoptosis, yet mice lacking Bax display limited phenotypic abnormalities. Lindsten et al. (2000) found that Bak -/- mice were developmentally normal and reproductively fit and failed to develop any age-related disorders. However, when Bak-deficient mice were mated to Bax-deficient mice to create mice lacking both genes, the majority of Bax-/- Bak-/- animals died perinatally, with fewer than 10% surviving into adulthood. Bax-/- Bak-/- mice displayed multiple developmental defects, including persistence of interdigital webs, an imperforate vaginal canal, and accumulation of excess cells within both the central nervous and hematopoietic systems. Thus, the authors concluded that Bax and Bak have overlapping roles in the regulation of apoptosis during mammalian development and tissue homeostasis.

It is appreciated that the abovementioned animal model for BAK1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chittenden, T.; Harrington, E. A.; O'Connor, R.; Flemington, C.; Lutz, R. J.; Evan, G. I.; Guild, B. C.: Induction of apoptosis by the Bcl-2 homologue Bak. Nature 374:733-736, 1995; and Lindsten, T.; Ross, A. J.; King, A.; Zong, W.-X.; Rathmell, J. C.; Shiels, H. A.; Ulrich, E.; Waymire, K. G.; Mahar, P.; Frauwirth, K.; Chen, Y.; Wei, M.; and 9 others. The combined fu.

Further studies establishing the function and utilities of BAK1 are found in John Hopkins OMIM database record ID 600516, and in sited publications numbered 7163-7165, 7712, 812 and 7714 listed in the bibliography section hereinbelow, which are also hereby incorporated by reference. Biglycan (BGN, Accession NM_001711) is another VGAM430 host target gene. BGN BINDING SITE is HOST TARGET binding site found in the 3" untranslated region of mRNA encoded by BGN, corresponding to a HOST TARGET binding site such as BINDING SITE I, BINDING SITE II or BINDING SITE III. Table 2 illustrates the complementarity of the nucleotide sequences of BGN BINDING SITE, designated SEQ ID:7438, to the nucleotide sequence of VGAM430 RNA, herein designated VGAM RNA, also designated SEQ ID:3141.

Another function of VGAM430 is therefore inhibition of Biglycan (BGN, Accession NM_001711), a gene which is involved in collagen fiber assembly. Accordingly, utilities of VGAM430 include diagnosis, prevention and treatment of diseases and clinical conditions associated with BGN. The function of BGN has been established by previous studies. Biglycan, or proteoglycan-I (PG-I), and decorin, or proteoglycan-II (OMIM Ref. No. 125255) are related but distinct small proteoglycans found in many connective tissues. The sequence of the cDNAs encoding the core proteins indicate that the 2 proteins are composed predominantly of a series of 12 tandem repeats of a nominal 24-residue consensus sequence (Fisher et al., 1989). Biglycan is a single-copy gene about 6 kb in length. By Southern analysis of a panel of human-rodent somatic cell hybrid DNAs with cDNA probes, McBride et al. (1990) demonstrated that BGN is located on the X chromosome. By examining hybrids containing spontaneous breaks or well-characterized translocations, they showed that BGN is in the segment Xq13-qter. Fisher et al.

(1991) found that the BGN gene consists of 8 exons including one that encodes the 5-prime untranslated region of the mRNA. The gene promoter lacked both a CAAT and TATA box that was rich in GC content. By in situ hybridization, they localized the gene to Xq27-qter. Traupe et al. (1992) narrowed the assignment to Xq28 in a region proximal to the red/green cone pigment genes (303800, 303900), G6PD (OMIM Ref. No. 305900), and factor VIII (OMIM Ref. No. 306700), and distal to GABRA3 (OMIM Ref. No. 305660). Since the biglycan gene maps to the region where, by comparative gene mapping, one would expect to find the gene for X-linked dominant chondrodysplasia punctata (CDPX2; 302960), it became a candidate gene for that disorder. To test this possibility, Das et al. (1994) analyzed patient samples for mutations in the biglycan gene by SSCP analysis. The small size of the biglycan gene and the availability of its sequence and intron/exon structure (Fisher et al., 1991) made its analysis as a candidate gene relatively straightforward. No mutations were found in 7 unrelated females with chondrodysplasia punctata, 2 of whom had a positive family history and all of whom were clinically consistent with the X-linked dominant form of the disease. Das et al. (1994) excluded biglycan as the site of the mutation in 2 other disorders that mapped to the same region of the X chromosome. No mutations were found in 9 unrelated patients with dyskeratosis congenita (DKC; 305000), 3 of whom had a family history indicative of X-linked inheritance. Similarly, no mutations were found in the biglycan gene in 8 unrelated females with incontinentia pigmenti (IP2; 308300); 1 had a positive family history and 7 represented sporadic cases. Animal model experiments lend further support to the function of BGN. In vitro studies indicate that biglycan may function in connective tissue metabolism by binding to collagen fibrils and TGF-beta (OMIM Ref. No. 190180), and may promote neuronal survival. To study the role of biglycan in vivo, Xu et al. (1998) generated Bgn-deficient mice. Although apparently normal at birth, these mice displayed a phenotype characterized by reduced growth rate and decreased bone mass. This may be the first report in which deficiency of a noncollagenous extracellular matrix (ECM) protein leads to a skeletal phenotype that is marked by low bone mass that becomes more obvious with age. These mice may serve as an animal model to study the role of ECM proteins in osteoporosis.

It is appreciated that the abovementioned animal model for BGN is acknowledged by those skilled in the art as a scientifically valid animal model, as can be further appreciated from the publications sited hereinbelow.

Full details of the abovementioned studies are described in the following publications, the disclosure of which are hereby incorporated by reference:

Fisher, L. W.; Termine, J. D.; Young, M. F.: Deduced-protein sequence of bone small proteoglycan I (biglycan) shows homology with proteoglycan II (decorin) and several nonconnective tissue proteins in a variety of species. J. Biol. Chem. 264: 4571-4576, 1989; and Xu, T.; Bianco, P.; Fisher, L. W.; Longenecker, G.; Smith, E.; Goldstein, S.; Bonadio, J.; Boskey, A.; Heegaard, A.-M.; Sommer, B.; Satomura, K.; Dominguez, P.; Zhao, C.; Kulkarni, A. B.

Further studies establishing the function and utilities of BGN are found in John Hopkins OMIM database record ID 301870, and in sited publications numbered 9168-9176 listed in the bibliography section hereinbelow, which are also hereby incorporated by reference. Contactin 2 (axonal) (CNTN2, Accession NM_005076) is another VGAM430 host target gene. CNTN2 BINDING SITE is HOST TARGET binding site found in the 3' untranslated region of mRNA encoded by CNTN2, corresponding to a HOST TARGET binding site such as BINDING SITE I, BINDING SITE II or BINDING SITE III. Table 2 illustrates the complementarity of the nucleotide sequences of CNTN2 BINDING SITE, designated SEQ ID:11524, to the nucleotide sequence of VGAM430 RNA, herein designated VGAM RNA, also designated SEQ ID:3141.

Another function of VGAM430 is therefore inhibition of Contactin 2 (axonal) (CNTN2, Accession NM_005076), a gene which may play a role in axonal growth and cell adhesion. Accordingly, utilities of VGAM430 include diagnosis, prevention and treatment of diseases and clinical conditions associated with CNTN2. The function of CNTN2 and its association with various diseases and clinical conditions, has been established by previous studies, as described hereinabove with reference to VGAM259. E2F Transcription Factor 1 (E2F1, Accession XM_097772) is another VGAM430 host target gene. E2F1 BINDING SITE is HOST TARGET binding site found in the 3' untranslated region of mRNA encoded by E2F1, corresponding to a HOST TARGET binding site such as BINDING SITE I, BINDING SITE II or BINDING SITE III. Table 2 illustrates the complementarity of the nucleotide sequences of E2F1 BINDING SITE, designated SEQ ID:41120, to the nucleotide sequence of VGAM430 RNA, herein designated VGAM RNA, also designated SEQ ID:3141.

Another function of VGAM430 is therefore inhibition of E2F Transcription Factor 1 (E2F1, Accession XM_097772), a gene which involved in cell cycle regulation, mediates G1 arrest when bound to Rb. Accordingly, utilities of VGAM430 include diagnosis, prevention and treatment of diseases and clinical conditions associated with E2F1. The function of E2F1 has been established by previous studies. A variety of experimental findings point to the transcription factor E2F as a critical determinant of the G1/S-phase transition during the mammalian cell cycle, serving to activate the transcription of a group of genes that encode proteins necessary for DNA replication. In addition, E2F activity appears to be directly regulated by the action of retinoblastoma protein, and indirectly regulated through the action of G1 cyclins and associated kinases. Ohtani et al. (1995) showed that the accumulation of G1 cyclins is regulated by E2F1. E2F binding sites are found in both the cyclin E (OMIM Ref. No. 123837) and cyclin D1 (OMIM Ref. No. 168461) promoters. Both promoters are activated by E2F gene products, and at least for cyclin E, the E2F sites contribute to cell cycle-dependent control. They found that the endogenous cyclin E gene is activated following expression of the E2F1 product encoded by a recombinant adenovirus vector. Results were interpreted to suggest the involvement of E2F1 and cyclin E in an autoregulatory loop that governs the accumulation of critical activities affecting the progression of cells through G1. Animal model experiments lend further support to the function of E2F1. The retinoblastoma tumor suppressor protein is a transcriptional repressor that regulates gene expression by physically associating with transcription factors such as members of the E2F family. To address the function of E2F1 and the RB/E2F1 complex in vivo, Yamasaki et al. (1996) and Field et al. (1996) produced mice homozygous for a nonfunctional E2F1 allele. Both groups found that mice lacking E2F1 are viable and fertile. However, Yamasaki et al. (1996) found that they show testicular atrophy and exocrine gland dysplasia, and develop a broad and unusual spectrum of tumors. Although overexpression of E2F1 in tissue culture cells can stimulate cell proliferation and be oncogenic, loss of E2F1 in mice resulted in tumorigenesis, demonstrating that E2F1 also functions as a tumor suppressor. Field et al. (1996) found that E2F1 -/- mice exhibit a defect in T-lymphocyte development, leading to an excess of mature T cells due to a maturation stage-specific defect in thymocyte apoptosis. They also observed aberrant cell proliferation. Weinberg (1996) suggested that the findings of these 2 groups indicate that E2F1 satisfies the definition of a tumor suppressor gene.

It is appreciated that the abovementioned animal model for E2F1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ohtani, K.; DeGregori, J.; Nevins, J. R.: Regulation of the cyclin E gene by transcription factor E2F1. Proc. Nat. Acad. Sci. 92:12146-12150, 1995; and Yamasaki, L.; Jacks, T.; Bronson, R.; Goillot, E.; Harlow, E.; Dyson, N. J.: Tumor induction and tissue atrophy in mice lacking E2F-1. Cell 85:537-548, 1996.

Further studies establishing the function and utilities of E2F1 are found in John Hopkins OMIM database record ID 189971, and in sited publications numbered 9706-9716, 758-76 and 765-767 listed in the bibliography section hereinbelow, which are also hereby incorporated by reference. Fucosyltransferase 6 (alpha (1,3) Fucosyltransferase) (FUT6, Accession NM_000150) is another VGAM430 host target gene. FUT6 BINDING SITE is HOST TARGET binding site found in the 3' untranslated region of mRNA encoded by FUT6, corresponding to a HOST TARGET binding site such as BINDING SITE I, BINDING SITE II or BINDING SITE III. Table 2 illustrates the complementarity of the nucleotide sequences of FUT6 BINDING SITE, designated SEQ ID:5652, to the nucleotide sequence of VGAM430 RNA, herein designated VGAM RNA, also designated SEQ ID:3141.

Another function of VGAM430 is therefore inhibition of Fucosyltransferase 6 (alpha (1,3) Fucosyltransferase) (FUT6, Accession NM_000150), a gene which is involved in the biosynthesis of the e-selectin ligand, sialyl-lewis x. catalyzes the transfer of fucose from gdp-beta-fucose to alpha-2,3 sialylated substrates. Accordingly, utilities of VGAM430 include diagnosis, prevention and treatment of diseases and clinical conditions associated with FUT6. The function of FUT6 and its association with various diseases and clinical conditions, has been established by previous studies, as described hereinabove with reference to VGAM194. GRAF (Accession NM_015071) is another VGAM430 host target gene. GRAF BINDING SITE is HOST TARGET binding site found in the 3' untranslated region of mRNA encoded by GRAF, corresponding to a HOST TARGET binding site such as BINDING SITE I, BINDING SITE II or BINDING SITE III. Table 2 illustrates the complementarity of the nucleotide sequences of GRAF BINDING SITE, designated SEQ ID:17447, to the nucleotide sequence of VGAM430 RNA, herein designated VGAM RNA, also designated SEQ ID:3141.

Another function of VGAM430 is therefore inhibition of GRAF (Accession NM_015071), a gene which ia a GTPase activating protein for p21-rac. Accordingly, utilities of VGAM430 include diagnosis, prevention and treatment of diseases and clinical conditions associated with GRAF. The function of GRAF has been established by previous studies. Borkhardt et al. (2000) stated that mutual translocations involving 11q23 in acute leukemias had been demonstrated to show fusion between the mixed lineage leukemia (MLL; 159555) gene and a variety of different partner genes to a total of 23. The detection of a unique t (5;11)(q31; q23) in an infant with juvenile myelomonocytic leukemia and an MLL gene rearrangement provided an opportunity to clone another MLL fusion partner gene. By cloning the breakpoints in this translocation, Borkhardt et al. (2000) recovered a member of the GTPase-activating protein (GAP) family, which they identified as the human homolog of the avian GRAF gene (Hildebrand et al., 1996). Ishikawa et al. (1998) cloned a GRAF cDNA, which they designated KIAA0621, from a human brain cDNA library and found that it encodes a deduced 753-amino acid protein with a molecular mass of 87 kD. Hildebrand et al. (1996) determined that the GRAF gene is highly homologous to the BCR gene (OMIM Ref. No. 151410), which is also involved in a leukemia-associated translocation. The avian GRAF protein binds to the C-terminal domain of pp125(FAK), one of the tyrosine kinases predicted to be a critical component of the integrin signaling transduction pathway, in an SH3 domain-dependent manner and stimulates the GTPase activity of the GTP-binding protein RhoA. Thus, GRAF acts as a negative regulator of RhoA.

Full details of the abovementioned studies are described in the following publications, the disclosure of which are hereby incorporated by reference:

Borkhardt, A.; Bojesen, S.; Haas, O. A.; Fuchs, U.; Bartelheimer, D.; Loncarevic, I. F.; Bohle, R. M.; Harbott, J.; Repp, R.; Jaeger, U.; Viehmann, S.; Henn, T.; Korth, P.; Scharr, D.; Lampert, F.: The human GRAF gene is fused to MLL in a unique t (5;11)(q31; q23) and both alleles are disrupted in three cases of myelodysplastic syndrome/acute myeloid leukemia with a deletion 5q. Proc. Nat. Acad. Sci. 97:9168-9173, 2000; and Hildebrand, J. D.; Taylor, J. M.; Parsons, T. J.: An SH3 domain-containing GTPase-activating protein for Rho and Cdc42 associates with focal adhesion kinase. Molec. Cell. Biol. 16:31.

Further studies establishing the function and utilities of GRAF are found in John Hopkins OMIM database record ID 605370, and in sited publications numbered 449 and 9440 listed in the bibliography section hereinbelow, which are also hereby incorporated by reference. Hyperpolarization Activated Cyclic Nucleotide-gated Potassium Channel 4 (HCN4, Accession NM_005477) is another VGAM430 host target gene. HCN4 BINDING SITE is HOST TARGET binding site found in the 3' untranslated region of mRNA encoded by HCN4, corresponding to a HOST TARGET binding site such as BINDING SITE I, BINDING SITE II or BINDING SITE III. Table 2 illustrates the complementarity of the nucleotide sequences of HCN4 BINDING SITE, designated SEQ ID:11980, to the nucleotide sequence of VGAM430 RNA, herein designated VGAM RNA, also designated SEQ ID:3141.

Another function of VGAM430 is therefore inhibition of Hyperpolarization Activated Cyclic Nucleotide-gated Potassium Channel 4 (HCN4, Accession NM_005477), a gene which is hyperpolarization activated cyclic nucleotide-gated cation channel 4 and may act as a pacemaker channel in the heart. Accordingly, utilities of VGAM430 include diagnosis, prevention and treatment of diseases and clinical conditions associated with HCN4. The function of HCN4 has been established by previous studies. Seifert et al. (1999) demonstrated that heterologous expression of HCN4 produced channels of unusually slow kinetics of activation and inactivation. The mean potential of half-maximal activation was -75.2 mV. The characteristic expression pattern and the sluggish gating suggested to Seifert et al. (1999) that HCN4 controls the rhythmic activity in both thalamocortical neurons and pacemaker cells of the heart. The strong hybridization with testis mRNA further suggested to Seifert et al.

(1999) that HCN4 is also expressed in mature spermatozoa or their precursor cells. In this respect, HCN4 may represent the mammalian equivalent of the HCN channel in the flagellum of sea urchin spermatozoa (Gauss et al., 1998). Seifert et al. (1999) proposed that both the sea urchin channel and the human HCN4 may be involved in the generation of rhythmic activity that controls the waveform of flagellar beating. Sour taste is initiated by protons acting at receptor proteins or channels. Stevens et al. (2001) examined the effects of sour stimuli on taste cells in slices of vallate papilla from rat. From a subset of cells, Stevens et al. (2001) identified a hyperpolarization-activated current that was enhanced by sour stimulation at the taste pore. This current resembled I(h) found in neurons and cardiomyocytes, a current carried by members of the family of hyperpolarization-activated and cyclic-nucleotide-gated (HCN) channels. Stevens et al. (2001) showed by in situ hybridization and immunohistochemistry that HCN1 and HCN4 are expressed in a subset of taste cells. By contrast, gustducin (OMIM Ref. No. 139395), the G protein involved in bitter and sweet taste, was not expressed in these cells. Stevens et al. (2001) concluded that HCN channels are gated by extracellular protons and may act as receptors for sour taste.

Full details of the abovementioned studies are described in the following publications, the disclosure of which are hereby incorporated by reference:

Seifert, R.; Scholten, A.; Gauss, R.; Mincheva, A.; Lichter, P.; Kaupp, U. B.: Molecular characterization of a slowly gating human hyperpolarization-activated channel predominantly expressed in thalamus, heart, and testis. Proc. Nat. Acad. Sci. 96:9391-9396, 1999; and Stevens, D. R.; Seifert, R.; Bufe, B.; Muller, F.; Kremmer, E.; Gauss, R.; Meyerhof, W.; Kaupp, U. B.; Lindemann, B.: Hyperpolarization-activated channels HCN1 and HCN4 mediate respons.

Further studies establishing the function and utilities of HCN4 are found in John Hopkins OMIM database record ID 605206, and in sited publications numbered 6813, 765 and 7657 listed in the bibliography section hereinbelow, which are also hereby incorporated by reference. MAP-kinase Activating Death Domain (MADD, Accession NM_003682) is another VGAM430 host target gene. MADD BINDING SITE1 through MADD BINDING SITE6 are HOST TARGET binding sites found in untranslated regions of mRNA encoded by MADD, corresponding to HOST TARGET binding sites such as BINDING SITE I, BINDING SITE II or BINDING SITE III. Table 2 illustrates the complementarity of the nucleotide sequences of MADD BINDING SITE1 through MADD BINDING SITE6, designated SEQ ID:9787, SEQ ID:28252, SEQ ID:28257, SEQ ID:28236, SEQ ID:28242 and SEQ ID:28247 respectively, to the nucleotide sequence of VGAM430 RNA, herein designated VGAM RNA, also designated SEQ ID:3141.

Another function of VGAM430 is therefore inhibition of MAP-kinase Activating Death Domain (MADD, Accession NM_003682), a gene which may regulate two different pathways for neural activities.interacts with the type-1 tumor necrosis factor receptor (TNFR1); death domain-containing protein. Accordingly, utilities of VGAM430 include diagnosis, prevention and treatment of diseases and clinical conditions associated with MADD. The function of MADD has been established by previous studies. Chow and Lee (1996) reported the cDNA sequence of DENN, a novel human gene that is differentially expressed in normal and neoplastic cells (hence, the symbol DENN). Northern blot analysis revealed differential levels of expression of a 6.5-kb DENN transcript in malignant cell lines compared to normal human tissues, where expression was highest in fetal brain and kidney and in adult testis, ovary, brain, and heart. In fetal liver and in several human cancer cell lines, the authors identified cDNAs representing alternative transcripts of DENN that harbor a deletion of 129 bp encoding 43 amino acids. Present within the serine- and leucine-rich DENN gene product is an arginyl-glycyl-aspartic acid (RGD) cellular adhesion motif and a leucine zipper-like motif. Using the yeast interaction trap system to identify proteins that interact with the death domain of the type 1 tumor necrosis factor receptor (TNFR1; 191190), Schievella et al. (1997) isolated cDNAs encoding 'MAP kinase-activating death domain' (MADD) protein. Immunoblotting of immunoprecipitated proteins from various human cell lines detected an approximately 200-kD MADD protein. The deduced 1,588-amino acid MADD protein contains a C-terminal death domain. The MADD protein associates with TNFR1 through a death domain-death domain interaction. Overexpression of MADD activated the mitogen-activated protein (MAP) kinase ERK2 (OMIM Ref. No. 176948), and expression of the MADD death domain stimulated both the ERK2 and JNK1 (OMIM Ref. No. 601158) MAP kinases and induced the phosphorylation of cytosolic phospholipase A2 (OMIM Ref. No. 600522). The authors suggested that MADD links TNFR1 with MAP kinase activation and arachidonic acid release. Chow et al. (1998) stated that the DENN and MADD cDNAs and proteins are virtually identical. They found that the DENN gene spans at least 28 kb and is composed of 15 exons, ranging in size from 73 to 1,230 bp, and 14 introns, varying from about 170 bp to 5.3 kb. From genomic studies, they traced the alternative splicing of a 129-bp fragment to an alternative 5-prime donor site involving exon 7. The deduced longer DENN isoform has 1,587 amino acids. Western blot analysis of human MOLT-4 T-lymphoblastic leukemic cell proteins detected a doublet consisting of 138- and 142-kD polypeptides. The authors found the DENN protein concentrated predominantly in the cytosolic compartment of MOLT-4 cells but was restricted to the nuclear compartment of PLC/PRF/5 hepatoma cells Full details of the abovementioned studies are described in the following publications, the disclosure of which are hereby incorporated by reference:

Chow, V. T. K.; Lim, K. M.; Lim, D.: The human DENN gene: genomic organization, alternative splicing, and localization to chromosome 11p11.21-p11.22. Genome 41:543-552, 1998; and Schievella, A. R.; Chen, J. H.; Graham, J. R.; Lin, L.-L.: MADD, a novel death domain protein that interacts with the type 1 tumor necrosis factor receptor and activates mitogen-activa.

Further studies establishing the function and utilities of MADD are found in John Hopkins OMIM database record ID 603584, and in sited publications numbered 5841-584 and 1178 listed in the bibliography section hereinbelow, which are also hereby incorporated by reference. Arginyl Aminopeptidase (aminopeptidase B)-like 1 (RNPEPL1, Accession NM_018226) is another VGAM430 host target gene. RNPEPL1 BINDING SITE is HOST TARGET binding site found in the 3' untranslated region of mRNA encoded by RNPEPL1, corresponding to a HOST TARGET binding site such as BINDING SITE I, BINDING SITE II or BINDING SITE III. Table 2 illustrates the complementarity of the nucleotide sequences of RNPEPL1 BINDING SITE, designated SEQ ID:20160, to the nucleotide sequence of VGAM430 RNA, herein designated VGAM RNA, also designated SEQ ID:3141.

Another function of VGAM430 is therefore inhibition of Arginyl Aminopeptidase (aminopeptidase B)-like 1 (RN- PEPL1, Accession NM_018226). Accordingly, utilities of VGAM430 include diagnosis, prevention and treatment of diseases and clinical conditions associated with RNPEPL1. SH3-domain Binding Protein 2 (SH3BP2, Accession NM_003023) is another VGAM430 host target gene. SH3BP2 BINDING SITE is HOST TARGET binding site found in the 3' untranslated region of mRNA encoded by SH3BP2, corresponding to a HOST TARGET binding site such as BINDING SITE I, BINDING SITE II or BINDING SITE III. Table 2 illustrates the complementarity of the nucleotide sequences of SH3BP2 BINDING SITE, designated SEQ ID:8954, to the nucleotide sequence of VGAM430 RNA, herein designated VGAM RNA, also designated SEQ ID:3141.

Another function of VGAM430 is therefore inhibition of SH3-domain Binding Protein 2 (SH3BP2, Accession NM_003023). Accordingly, utilities of VGAM430 include diagnosis, prevention and treatment of diseases and clinical conditions associated with SH3BP2. Solute Carrier Family 7 (cationic amino acid transporter, y+ system), Member 5 (SLC7A5, Accession NM_003486) is another VGAM430 host target gene. SLC7A5 BINDING SITE is HOST TARGET binding site found in the 3' untranslated region of mRNA encoded by SLC7A5, corresponding to a HOST TARGET binding site such as BINDING SITE I, BINDING SITE II or BINDING SITE III. Table 2 illustrates the complementarity of the nucleotide sequences of SLC7A5 BINDING SITE, designated SEQ ID:9579, to the nucleotide sequence of VGAM430 RNA, herein designated VGAM RNA, also designated SEQ ID:3141.

Another function of VGAM430 is therefore inhibition of Solute Carrier Family 7 (cationic amino acid transporter, y+ system), Member 5 (SLC7A5, Accession NM_003486), a gene which mediates transport of large and small neutral amino acids. Accordingly, utilities of VGAM430 include diagnosis, prevention and treatment of diseases and clinical conditions associated with SLC7A5. The function of SLC7A5 has been established by previous studies. Gaugitsch et al. (1992) cloned a partial human E16 cDNA sequence that was expressed in activated lymphocytes. It was cloned by virtue of its AUUUA rapid degradation signal. Kanai et al. (1998) used expression cloning to isolate a rat cDNA termed LAT1. They showed that LAT1 encoded a protein necessary for system L amino acid transport, thought to be a major route by which cells import large neutral amino acids with branched or aromatic side chains. Mastroberardino et al. (1998) identified the human E16 protein (AF077866) as the first light chain of 4F2 (OMIM Ref. No. 158070), a cell surface glycoprotein, and showed that the resulting heterodimeric complex mediates L-type amino acid transport. Maglott et al. (1994) mapped a gene fragment, EST00889 (OMIM Ref. No. M78741), to chromosome 16 (D16S469E). The map position was refined to 16q24.3 by use of a panel of mouse/human somatic cell hybrids. Maglott et al. (1994) showed that the gene is expressed abundantly in adult lung and liver, and is also expressed in human brain, thymus, retina, and some other tissues.

Full details of the abovementioned studies are described in the following publications, the disclosure of which are hereby incorporated by reference:

Mastroberardino, L.; Spindler, B.; Pfeiffer, R.; Skelly, P. J.; Lofling, J.; Shoemaker, C. B.; Verrey, F.: Amino-acid transport by heterodimers of 4F2hc/CD98 and members of a permease family. Nature 395:288-291, 1998; and Maglott, D. R.; Durkin, A. S.; Lane, S. A.; Callen, D. F.; Feldblyum, T. V.; Nierman, W. C.: The gene for membrane protein E16 (D16S469E) maps to human chromosome 16q24.3 and is expressed.

Further studies establishing the function and utilities of SLC7A5 are found in John Hopkins OMIM database record ID 600182, and in sited publications numbered 7345-734 and 8109 listed in the bibliography section hereinbelow, which are also hereby incorporated by reference. Transient Receptor Potential Cation Channel, Subfamily M, Member 8 (TRPM8, Accession NM_024080) is another VGAM430 host target gene. TRPM8 BINDING SITE is HOST TARGET binding site found in the 3' untranslated region of mRNA encoded by TRPM8, corresponding to a HOST TARGET binding site such as BINDING SITE I, BINDING SITE II or BINDING SITE III. Table 2 illustrates the complementarity of the nucleotide sequences of TRPM8 BINDING SITE, designated SEQ ID:23516, to the nucleotide sequence of VGAM430 RNA, herein designated VGAM RNA, also designated SEQ ID:3141.

Another function of VGAM430 is therefore inhibition of Transient Receptor Potential Cation Channel, Subfamily M, Member 8 (TRPM8, Accession NM_024080), a gene which is thought to form a receptor-activated calcium permeant cation channel. Accordingly, utilities of VGAM430 include diagnosis, prevention and treatment of diseases and clinical conditions associated with TRPM8. The function of TRPM8 and its association with various diseases and clinical conditions, has been established by previous studies, as described hereinabove with reference to VGAM201. Usher Syndrome 3A (USH3A, Accession NM_052995) is another VGAM430 host target gene. USH3A BINDING SITE is HOST TARGET binding site found in the 3' untranslated region of mRNA encoded by USH3A, corresponding to a HOST TARGET binding site such as BINDING SITE I, BINDING SITE II or BINDING SITE III. Table 2 illustrates the complementarity of the nucleotide sequences of USH3A BINDING SITE, designated SEQ ID:27561, to the nucleotide sequence of VGAM430 RNA, herein designated VGAM RNA, also designated SEQ ID:3141.

Another function of VGAM430 is therefore inhibition of Usher Syndrome 3A (USH3A, Accession NM_052995). Accordingly, utilities of VGAM430 include diagnosis, prevention and treatment of diseases and clinical conditions associated with USH3A. Xenotropic and Polytropic Retrovirus Receptor (XPR1, Accession NM_004736) is another VGAM430 host target gene. XPR1 BINDING SITE is HOST TARGET binding site found in the 3' untranslated region of mRNA encoded by XPR1, corresponding to a HOST TARGET binding site such as BINDING SITE I, BINDING SITE II or BINDING SITE III. Table 2 illustrates the complementarity of the nucleotide sequences of XPR1 BINDING SITE, designated SEQ ID:11124, to the nucleotide sequence of VGAM430 RNA, herein designated VGAM RNA, also designated SEQ ID:3141.

Another function of VGAM430 is therefore inhibition of Xenotropic and Polytropic Retrovirus Receptor (XPR1, Accession NM_004736), a gene which is a putative G protein-coupled receptor and a target for xenotropic and polytropic murine leukemia retroviruses. Accordingly, utilities of VGAM430 include diagnosis, prevention and treatment of diseases and clinical conditions associated with XPR1. The function of XPR1 has been established by previous studies. There are 4 classes of murine leukemia virus (MLV): xenotropic (X), ecotropic (E), amphotropic (A), and polytropic (P). X- and E-MLV cannot exogenously infect mouse cells and are inherited as part of the mouse genome. While X-MLV can infect other mammalian species but not cells from laboratory mice, A- (see OMIM Ref. No. SLC20A2; 158378) and P-MLV can infect mouse and other species. See Levy (1999) for a review of MLVs. By cloning a human T-lymphocyte cDNA library into a retroviral vector, transducing the library into naturally X-MLV-resistant mouse fibroblasts, and PCR amplification, Tailor et al. (1999) isolated a cDNA encoding XPR1. Expression of XPR1 in mouse and hamster MLV-resistant fibroblasts rendered the cells susceptible to both X- and P-MLV. The deduced 696-amino acid XPR1 protein contains 8 or 9 potential membrane-spanning regions, 7 potential N-glycosylation sites, and 7 dileucines that may stimulate endocytosis via clathrin-coated pits. Northern blot analysis detected a 4.5-kb XPR1 transcript in all tissues tested, with highest expression in pancreas, kidney, placenta, hematopoietic tissues, and heart, and lowest expression in skeletal muscle. Expression of XPR1 was greater in fetal liver than adult liver. A 9.5-kb XPR1 transcript was also detected in all tissues tested except liver and bone marrow.

Full details of the abovementioned studies are described in the following publications, the disclosure of which are hereby incorporated by reference:

Levy, J. A.: Xenotropism: the elusive viral receptor finally uncovered. Proc. Nat. Acad. Sci. 96:802-804, 1999; and Tailor, C. S.; Nouri, A.; Lee, C. G.; Kozak, C.; Kabat, D.: Cloning and characterization of a cell surface receptor for xenotropic and polytropic murine leukemia viruses. Proc. Nat. Aca.

Further studies establishing the function and utilities of XPR1 are found in John Hopkins OMIM database record ID 605237, and in sited publications numbered 7484-7487 listed in the bibliography section hereinbelow, which are also hereby incorporated by reference. AF311304 (Accession NM_031214) is another VGAM430 host target gene. AF311304 BINDING SITE is HOST TARGET binding site found in the 3' untranslated region of mRNA encoded by AF311304, corresponding to a HOST TARGET binding site such as BINDING SITE I, BINDING SITE II or BINDING SITE III. Table 2 illustrates the complementarity of the nucleotide sequences of AF311304 BINDING SITE, designated SEQ ID:25262, to the nucleotide sequence of VGAM430 RNA, herein designated VGAM RNA, also designated SEQ ID:3141.

Another function of VGAM430 is therefore inhibition of AF311304 (Accession NM_031214). Accordingly, utilities of VGAM430 include diagnosis, prevention and treatment of diseases and clinical conditions associated with AF311304. DKFZP566G1424 (Accession XM_097771) is another VGAM430 host target gene. DKFZP566G1424 BINDING SITE is HOST TARGET binding site found in the 5' untranslated region of mRNA encoded by DKFZP566G1424, corresponding to a HOST TARGET binding site such as BINDING SITE I, BINDING SITE II or BINDING SITE III. Table 2 illustrates the complementarity of the nucleotide sequences of DKFZP566G1424 BINDING SITE, designated SEQ ID:41115, to the nucleotide sequence of VGAM430 RNA, herein designated VGAM RNA, also designated SEQ ID:3141.

Another function of VGAM430 is therefore inhibition of DKFZP566G1424 (Accession XM_097771). Accordingly, utilities of VGAM430 include diagnosis, prevention and treatment of diseases and clinical conditions associated with DKFZP566G1424. FBX30 (Accession NM_033182) is another VGAM430 host target gene. FBX30 BINDING SITE is HOST TARGET binding site found in the 3' untranslated region of mRNA encoded by FBX30, corresponding to a HOST TARGET binding site such as BINDING SITE I, BINDING SITE II or BINDING SITE III. Table 2 illustrates the complementarity of the nucleotide sequences of FBX30 BINDING SITE, designated SEQ ID:27044, to the nucleotide sequence of VGAM430 RNA, herein designated VGAM RNA, also designated SEQ ID:3141.

Another function of VGAM430 is therefore inhibition of FBX30 (Accession NM_033182). Accordingly, utilities of VGAM430 include diagnosis, prevention and treatment of diseases and clinical conditions associated with FBX30. FLJ12242 (Accession NM_024681) is another VGAM430 host target gene. FLJ12242 BINDING SITE is HOST TARGET binding site found in the 3' untranslated region of mRNA encoded by FLJ12242, corresponding to a HOST TARGET binding site such as BINDING SITE I, BINDING SITE II or BINDING SITE III. Table 2 illustrates the complementarity of the nucleotide sequences of FLJ12242 BINDING SITE, designated SEQ ID:23995, to the nucleotide sequence of VGAM430 RNA, herein designated VGAM RNA, also designated SEQ ID:3141.

Another function of VGAM430 is therefore inhibition of FLJ12242 (Accession NM_024681). Accordingly, utilities of VGAM430 include diagnosis, prevention and treatment of diseases and clinical conditions associated with FLJ12242. FLJ20294 (Accession NM_017749) is another VGAM430 host target gene. FLJ20294 BINDING SITE is HOST TARGET binding site found in the 3' untranslated region of mRNA encoded by FLJ20294, corresponding to a HOST TARGET binding site such as BINDING SITE I, BINDING SITE II or BINDING SITE III. Table 2 illustrates the complementarity of the nucleotide sequences of FLJ20294 BINDING SITE, designated SEQ ID:19354, to the nucleotide sequence of VGAM430 RNA, herein designated VGAM RNA, also designated SEQ ID:3141.

Another function of VGAM430 is therefore inhibition of FLJ20294 (Accession NM_017749). Accordingly, utilities of VGAM430 include diagnosis, prevention and treatment of diseases and clinical conditions associated with FLJ20294. FLJ21742 (Accession NM_032207) is another VGAM430 host target gene. FLJ21742 BINDING SITE is HOST TARGET binding site found in the 3' untranslated region of mRNA encoded by FLJ21742, corresponding to a HOST TARGET binding site such as BINDING SITE I, BINDING SITE II or BINDING SITE III. Table 2 illustrates the complementarity of the nucleotide sequences of FLJ21742 BINDING SITE, designated SEQ ID:25914, to the nucleotide sequence of VGAM430 RNA, herein designated VGAM RNA, also designated SEQ ID:3141.

Another function of VGAM430 is therefore inhibition of FLJ21742 (Accession NM_032207). Accordingly, utilities of VGAM430 include diagnosis, prevention and treatment of diseases and clinical conditions associated with FLJ21742. FLJ22215 (Accession XM_173021) is another VGAM430 host target gene. FLJ22215 BINDING SITE is HOST TARGET binding site found in the 3' untranslated region of mRNA encoded by FLJ22215, corresponding to a HOST TARGET binding site such as BINDING SITE I, BINDING SITE II or BINDING SITE III. Table 2 illustrates the complementarity of the nucleotide sequences of FLJ22215 BINDING SITE, designated SEQ ID:46284, to the nucleotide sequence of VGAM430 RNA, herein designated VGAM RNA, also designated SEQ ID:3141.

Another function of VGAM430 is therefore inhibition of FLJ22215 (Accession XM_173021). Accordingly, utilities of VGAM430 include diagnosis, prevention and treatment of diseases and clinical conditions associated with FLJ22215. HEMK (Accession NM_016173) is another VGAM430 host target gene. HEMK BINDING SITE is HOST TARGET binding site found in the 3" untranslated region of mRNA encoded by HEMK, corresponding to a HOST TARGET binding site such as BINDING SITE I, BINDING SITE II or BINDING SITE III. Table 2 illustrates the complementarity of the nucleotide sequences of HEMK BINDING SITE, designated SEQ ID:18269, to the nucleotide sequence of VGAM430 RNA, herein designated VGAM RNA, also designated SEQ ID:3141.

Another function of VGAM430 is therefore inhibition of HEMK (Accession NM_016173). Accordingly, utilities of VGAM430 include diagnosis, prevention and treatment of diseases and clinical conditions associated with HEMK. KIAA0182 (Accession XM_050495) is another VGAM430 host target gene. KIAA0182 BINDING SITE is HOST TARGET binding site found in the 3" untranslated region of mRNA encoded by KIAA0182, corresponding to a HOST TARGET binding site such as BINDING SITE I, BINDING SITE II or BINDING SITE III. Table 2 illustrates the complementarity of the nucleotide sequences of KIAA0182 BINDING SITE, designated SEQ ID:35648, to the nucleotide sequence of VGAM430 RNA, herein designated VGAM RNA, also designated SEQ ID:3141.

Another function of VGAM430 is therefore inhibition of KIAA0182 (Accession XM_050495). Accordingly, utilities of VGAM430 include diagnosis, prevention and treatment of diseases and clinical conditions associated with KIAA0182. KIAA0323 (Accession XM_032634) is another VGAM430 host target gene. KIAA0323 BINDING SITE is HOST TARGET binding site found in the 3' untranslated region of mRNA encoded by KIAA0323, corresponding to a HOST TARGET binding site such as BINDING SITE I, BINDING SITE II or BINDING SITE III. Table 2 illustrates the complementarity of the nucleotide sequences of KIAA0323 BINDING SITE, designated SEQ ID:31690, to the nucleotide sequence of VGAM430 RNA, herein designated VGAM RNA, also designated SEQ ID:3141.

Another function of VGAM430 is therefore inhibition of KIAA0323 (Accession XM_032634). Accordingly, utilities of VGAM430 include diagnosis, prevention and treatment of diseases and clinical conditions associated with KIAA0323. KIAA0415 (Accession XM_166527) is another VGAM430 host target gene. KIAA0415 BINDING SITE is HOST TARGET binding site found in the 3' untranslated region of mRNA encoded by KIAA0415, corresponding to a HOST TARGET binding site such as BINDING SITE I, BINDING SITE II or BINDING SITE III. Table 2 illustrates the complementarity of the nucleotide sequences of KIAA0415 BINDING SITE, designated SEQ ID:44479, to the nucleotide sequence of VGAM430 RNA, herein designated VGAM RNA, also designated SEQ ID:3141.

Another function of VGAM430 is therefore inhibition of KIAA0415 (Accession XM_166527). Accordingly, utilities of VGAM430 include diagnosis, prevention and treatment of diseases and clinical conditions associated with KIAA0415. KIAA0420 (Accession XM_032693) is another VGAM430 host target gene. KIAA0420 BINDING SITE is HOST TARGET binding site found in the 3' untranslated region of mRNA encoded by KIAA0420, corresponding to a HOST TARGET binding site such as BINDING SITE I, BINDING SITE II or BINDING SITE III. Table 2 illustrates the complementarity of the nucleotide sequences of KIAA0420 BINDING SITE, designated SEQ ID:31732, to the nucleotide sequence of VGAM430 RNA, herein designated VGAM RNA, also designated SEQ ID:3141.

Another function of VGAM430 is therefore inhibition of KIAA0420 (Accession XM_032693). Accordingly, utilities of VGAM430 include diagnosis, prevention and treatment of diseases and clinical conditions associated with KIAA0420. KIAA0556 (Accession XM_044632) is another VGAM430 host target gene. KIAA0556 BINDING SITE is HOST TARGET binding site found in the 3' untranslated region of mRNA encoded by KIAA0556, corresponding to a HOST TARGET binding site such as BINDING SITE I, BINDING SITE II or BINDING SITE III. Table 2 illustrates the complementarity of the nucleotide sequences of KIAA0556 BINDING SITE, designated SEQ ID:34250, to the nucleotide sequence of VGAM430 RNA, herein designated VGAM RNA, also designated SEQ ID:3141.

Another function of VGAM430 is therefore inhibition of KIAA0556 (Accession XM_044632). Accordingly, utilities of VGAM430 include diagnosis, prevention and treatment of diseases and clinical conditions associated with KIAA0556. KIAA1950 (Accession XM_166532) is another VGAM430 host target gene. KIAA1950 BINDING SITE is HOST TARGET binding site found in the 3' untranslated region of mRNA encoded by KIAA1950, corresponding to a HOST TARGET binding site such as BINDING SITE I, BINDING SITE II or BINDING SITE III. Table 2 illustrates the complementarity of the nucleotide sequences of KIAA1950 BINDING SITE, designated SEQ ID:44490, to the nucleotide sequence of VGAM430 RNA, herein designated VGAM RNA, also designated SEQ ID:3141.

Another function of VGAM430 is therefore inhibition of KIAA1950 (Accession XM_166532). Accordingly, utilities of VGAM430 include diagnosis, prevention and treatment of diseases and clinical conditions associated with KIAA1950. KRT6IRS (Accession NM_033448) is another VGAM430 host target gene. KRT6IRS BINDING SITE is HOST TARGET binding site found in the 3' untranslated region of mRNA encoded by KRT6IRS, corresponding to a HOST TARGET binding site such as BINDING SITE I, BINDING SITE II or BINDING SITE III. Table 2 illustrates the complementarity of the nucleotide sequences of KRT6IRS BINDING SITE, designated SEQ ID:27253, to the nucleotide sequence of VGAM430 RNA, herein designated VGAM RNA, also designated SEQ ID:3141.

Another function of VGAM430 is therefore inhibition of KRT6IRS (Accession NM_033448). Accordingly, utilities of VGAM430 include diagnosis, prevention and treatment of diseases and clinical conditions associated with KRT6IRS. Matrin 3 (MATR3, Accession NM_018834) is another VGAM430 host target gene. MATR3 BINDING SITE is HOST TARGET binding site found in the 3' untranslated region of mRNA encoded by MATR3, corresponding to a HOST TARGET binding site such as BINDING SITE I, BINDING SITE II or BINDING SITE III. Table 2 illustrates the complementarity of the nucleotide sequences of MATR3 BINDING SITE, designated SEQ ID:20820, to the nucleotide sequence of VGAM430 RNA, herein designated VGAM RNA, also designated SEQ ID:3141.

Another function of VGAM430 is therefore inhibition of Matrin 3 (MATR3, Accession NM_018834). Accordingly, utilities of VGAM430 include diagnosis, prevention and treatment of diseases and clinical conditions associated with MATR3. MGC35558 (Accession NM_145013) is another VGAM430 host target gene. MGC35558 BINDING SITE is HOST TARGET binding site found in the 3' untranslated region of mRNA encoded by MGC35558, corresponding to a HOST TARGET binding site such as BINDING SITE I, BINDING SITE II or BINDING SITE III. Table 2 illustrates the complementarity of the nucleotide sequences of MGC35558 BINDING SITE, designated SEQ ID:29620, to the nucleotide sequence of VGAM430 RNA, herein designated VGAM RNA, also designated SEQ ID:3141.

Another function of VGAM430 is therefore inhibition of MGC35558 (Accession NM_145013). Accordingly, utilities of VGAM430 include diagnosis, prevention and treatment of diseases and clinical conditions associated with MGC35558. MGC4415 (Accession NM_031484) is another VGAM430 host target gene. MGC4415 BINDING SITE is HOST TARGET binding site found in the 3' untranslated region of mRNA encoded by MGC4415, corresponding to a HOST TARGET binding site such as BINDING SITE I, BINDING SITE II or BINDING SITE III. Table 2 illustrates the complementarity of the nucleotide sequences of MGC4415 BINDING SITE, designated SEQ ID:25572, to the nucleotide sequence of VGAM430 RNA, herein designated VGAM RNA, also designated SEQ ID:3141.

Another function of VGAM430 is therefore inhibition of MGC4415 (Accession NM_031484). Accordingly, utilities of VGAM430 include diagnosis, prevention and treatment of diseases and clinical conditions associated with MGC4415. RAB3A Interacting Protein (rabin3)-like 1 (RAB3IL1, Accession NM_013401) is another VGAM430 host target gene. RAB3IL1 BINDING SITE is HOST TARGET binding site found in the 3' untranslated region of mRNA encoded by RAB3IL1, corresponding to a HOST TARGET binding site such as BINDING SITE I, BINDING SITE II or BINDING SITE III. Table 2 illustrates the complementarity of the nucleotide sequences of RAB3IL1 BINDING SITE, designated SEQ ID:15064, to the nucleotide sequence of VGAM430 RNA, herein designated VGAM RNA, also designated SEQ ID:3141.

Another function of VGAM430 is therefore inhibition of RAB3A Interacting Protein (rabin3)-like 1 (RAB3IL1, Accession NM_013401). Accordingly, utilities of VGAM430 include diagnosis, prevention and treatment of diseases and clinical conditions associated with RAB3IL1. Splicing Factor, Arginine/serine-rich 5 (SFRS5, Accession NM_006925) is another VGAM430 host target gene. SFRS5 BINDING SITE is HOST TARGET binding site found in the 3' untranslated region of mRNA encoded by SFRS5, corresponding to a HOST TARGET binding site such as BINDING SITE I, BINDING SITE II or BINDING SITE III. Table 2 illustrates the complementarity of the nucleotide sequences of SFRS5 BINDING SITE, designated SEQ ID:13806, to the nucleotide sequence of VGAM430 RNA, herein designated VGAM RNA, also designated SEQ ID:3141.

Another function of VGAM430 is therefore inhibition of Splicing Factor, Arginine/serine-rich 5 (SFRS5, Accession NM_006925). Accordingly, utilities of VGAM430 include diagnosis, prevention and treatment of diseases and clinical conditions associated with SFRS5. TAF5-like RNA Polymerase II, P300/CBP-associated Factor (PCAF)-associated Factor, 65 kDa (TAF5L, Accession NM_014409) is another VGAM430 host target gene. TAF5L BINDING SITE is HOST TARGET binding site found in the 3" untranslated region of mRNA encoded by TAF5L, corresponding to a HOST TARGET binding site such as BINDING SITE I, BINDING SITE II or BINDING SITE III. Table 2 illustrates the complementarity of the nucleotide sequences of TAF5L BINDING SITE, designated SEQ ID:15752, to the nucleotide sequence of VGAM430 RNA, herein designated VGAM RNA, also designated SEQ ID:3141.

Another function of VGAM430 is therefore inhibition of TAF5-like RNA Polymerase II, P300/CBP-associated Factor (PCAF)-associated Factor, 65 kDa (TAF5L, Accession NM_014409). Accordingly, utilities of VGAM430 include diagnosis, prevention and treatment of diseases and clinical conditions associated with TAF5L. LOC150157 (Accession XM_097823) is another VGAM430 host target gene. LOC150157 BINDING SITE is HOST TARGET binding site found in the 5' untranslated region of mRNA encoded by LOC150157, corresponding to a HOST TARGET binding site such as BINDING SITE I, BINDING SITE II or BINDING SITE III. Table 2 illustrates the complementarity of the nucleotide sequences of LOC150157 BINDING SITE, designated SEQ ID:41146, to the nucleotide sequence of VGAM430 RNA, herein designated VGAM RNA, also designated SEQ ID:3141.

Another function of VGAM430 is therefore inhibition of LOC150157 (Accession XM_097823). Accordingly, utilities of VGAM430 include diagnosis, prevention and treatment of diseases and clinical conditions associated with LOC150157. LOC152756 (Accession XM_098262) is another VGAM430 host target gene. LOC152756 BINDING SITE is HOST TARGET binding site found in the 3' untranslated region of mRNA encoded by LOC152756, corresponding to a HOST TARGET binding site such as BINDING SITE I, BINDING SITE II or BINDING SITE III. Table 2 illustrates the complementarity of the nucleotide sequences of LOC152756 BINDING SITE, designated SEQ ID:41552, to the nucleotide sequence of VGAM430 RNA, herein designated VGAM RNA, also designated SEQ ID:3141.

Another function of VGAM430 is therefore inhibition of LOC152756 (Accession XM_098262). Accordingly, utilities of VGAM430 include diagnosis, prevention and treatment of diseases and clinical conditions associated with LOC152756. LOC196890 (Accession XM_116951) is another VGAM430 host target gene. LOC196890 BINDING SITE is HOST TARGET binding site found in the 5' untranslated region of mRNA encoded by LOC196890, corresponding to a HOST TARGET binding site such as BINDING SITE I, BINDING SITE II or BINDING SITE III. Table 2 illustrates the complementarity of the nucleotide sequences of LOC196890 BINDING SITE, designated SEQ ID:43157, to the nucleotide sequence of VGAM430 RNA, herein designated VGAM RNA, also designated SEQ ID:3141.

Another function of VGAM430 is therefore inhibition of LOC196890 (Accession XM_116951). Accordingly, utilities of VGAM430 include diagnosis, prevention and treatment of diseases and clinical conditions associated with LOC196890. LOC202934 (Accession XM_117486) is another VGAM430 host target gene. LOC202934 BINDING SITE is HOST TARGET binding site found in the 3' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43466, to the nucleotide sequence of VGAM430 RNA, herein designated VGAM RNA, also designated SEQ ID:3141.

Another function of VGAM430 is therefore inhibition of LOC202934 (Accession XM_117486). Accordingly, utilities of VGAM430 include diagnosis, prevention and treatment of diseases and clinical conditions associated with LOC202934. LOC253675 (Accession XM_172990) is another VGAM430 host target gene. LOC253675 BINDING SITE is HOST TARGET binding site found in the 3' untranslated region of mRNA encoded by LOC253675, corresponding to a HOST TARGET binding site such as BINDING SITE I, BINDING SITE II or BINDING SITE III. Table 2 illustrates the complementarity of the nucleotide sequences of LOC253675 BINDING SITE, designated SEQ ID:46268, to the nucleotide sequence of VGAM430 RNA, herein designated VGAM RNA, also designated SEQ ID:3141.

Another function of VGAM430 is therefore inhibition of LOC253675 (Accession XM_172990). Accordingly, utilities of VGAM430 include diagnosis, prevention and treatment of diseases and clinical conditions associated with LOC253675.

LOC255465 (Accession XM_173206) is another VGAM430 host target gene. LOC255465 BINDING SITE is HOST TARGET binding site found in the 3' untranslated region of mRNA encoded by LOC255465, corresponding to a HOST TARGET binding site such as BINDING SITE I, BINDING SITE II or BINDING SITE III. Table 2 illustrates the complementarity of the nucleotide sequences of LOC255465 BINDING SITE, designated SEQ ID:46458, to the nucleotide sequence of VGAM430 RNA, herein designated VGAM RNA, also designated SEQ ID:3141.

Another function of VGAM430 is therefore inhibition of LOC255465 (Accession XM_173206). Accordingly, utilities of VGAM430 include diagnosis, prevention and treatment of diseases and clinical conditions associated with LOC255465.

LOC257354 (Accession XM_170810) is another VGAM430 host target gene. LOC257354 BINDING SITE is HOST TARGET binding site found in the 3' untranslated region of mRNA encoded by LOC257354, corresponding to a HOST TARGET binding site such as BINDING SITE I, BINDING SITE II or BINDING SITE III. Table 2 illustrates the complementarity of the nucleotide sequences of LOC257354 BINDING SITE, designated SEQ ID:45585, to the nucleotide sequence of VGAM430 RNA, herein designated VGAM RNA, also designated SEQ ID:3141.

Another function of VGAM430 is therefore inhibition of LOC257354 (Accession XM_170810). Accordingly, utilities of VGAM430 include diagnosis, prevention and treatment of diseases and clinical conditions associated with LOC257354.

LOC90075 (Accession XM_028742) is another VGAM430 host target gene. LOC90075 BINDING SITE is HOST TARGET binding site found in the 5' untranslated region of mRNA encoded by LOC90075, corresponding to a HOST TARGET binding site such as BINDING SITE I, BINDING SITE II or BINDING SITE III. Table 2 illustrates the complementarity of the nucleotide sequences of LOC90075 BINDING SITE, designated SEQ ID:30741, to the nucleotide sequence of VGAM430 RNA, herein designated VGAM RNA, also designated SEQ ID:3141.

Another function of VGAM430 is therefore inhibition of LOC90075 (Accession XM_028742). Accordingly, utilities of VGAM430 include diagnosis, prevention and treatment of diseases and clinical conditions associated with LOC90075.

LOC90362 (Accession XM_031163) is another VGAM430 host target gene. LOC90362 BINDING SITE is HOST TARGET binding site found in the 5' untranslated region of mRNA encoded by LOC90362, corresponding to a HOST TARGET binding site such as BINDING SITE I, BINDING SITE II or BINDING SITE III. Table 2 illustrates the complementarity of the nucleotide sequences of LOC90362 BINDING SITE, designated SEQ ID:31297, to the nucleotide sequence of VGAM430 RNA, herein designated VGAM RNA, also designated SEQ ID:3141.

Another function of VGAM430 is therefore inhibition of LOC90362 (Accession XM_031163). Accordingly, utilities of VGAM430 include diagnosis, prevention and treatment of diseases and clinical conditions associated with LOC90362.

LOC91461 (Accession XM_038576) is another VGAM430 host target gene. LOC91461 BINDING SITE is HOST TARGET binding site found in the 3' untranslated region of mRNA encoded by LOC91461, corresponding to a HOST TARGET binding site such as BINDING SITE I, BINDING SITE II or BINDING SITE III. Table 2 illustrates the complementarity of the nucleotide sequences of LOC91461 BINDING SITE, designated SEQ ID:32870, to the nucleotide sequence of VGAM430 RNA, herein designated VGAM RNA, also designated SEQ ID:3141.

Another function of VGAM430 is therefore inhibition of LOC91461 (Accession XM_038576). Accordingly, utilities of VGAM430 include diagnosis, prevention and treatment of diseases and clinical conditions associated with LOC91461.

LOC93259 (Accession XM_050105) is another VGAM430 host target gene. LOC93259 BINDING SITE is HOST TARGET binding site found in the 5' untranslated region of mRNA encoded by LOC93259, corresponding to a HOST TARGET binding site such as BINDING SITE I, BINDING SITE II or BINDING SITE III. Table 2 illustrates the complementarity of the nucleotide sequences of LOC93259 BINDING SITE, designated SEQ ID:35557, to the nucleotide sequence of VGAM430 RNA, herein designated VGAM RNA, also designated SEQ ID:3141.

Another function of VGAM430 is therefore inhibition of LOC93259 (Accession XM_050105). Accordingly, utilities of VGAM430 include diagnosis, prevention and treatment of diseases and clinical conditions associated with LOC93259.

FIG. 1 further provides a conceptual description of a novel bioinformatically detected viral gene of the present invention, referred to here as Viral Genomic Address Messenger 431 (VGAM431) viral gene, which modulates expression of respective host target genes thereof, the function and utility of which host target genes is known in the art.

VGAM431 is a novel bioinformatically detected regulatory, non protein coding, viral micro RNA (miRNA) gene. The method by which VGAM431 was detected is described hereinabove with reference to FIGS. 1-8.

VGAM431 gene, herein designated VGAM GENE, is a viral gene contained in the genome of Rabbit Hemorrhagic Disease Virus. VGAM431 host target gene, herein designated VGAM HOST TARGET GENE, is a human gene contained in the human genome.

VGAM431 gene encodes a VGAM431 precursor RNA, herein designated VGAM PRECURSOR RNA. Similar to other miRNA genes, and unlike most ordinary genes, VGAM431 precursor RNA does not encode a protein. A nucleotide sequence identical or highly similar to the nucleotide sequence of VGAM431 precursor RNA is designated SEQ ID:417, and is provided hereinbelow with reference to the sequence listing part. Nucleotide sequence SEQ ID:417 is located at position 3819 relative to the genome of Rabbit Hemorrhagic Disease Virus.

VGAM431 precursor RNA folds onto itself, forming VGAM431 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM431 folded precursor RNA into VGAM431 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM431 RNA is designated SEQ ID:3142, and is provided hereinbelow with reference to the sequence listing part.

VGAM431 host target gene, herein designated VGAM HOST TARGET GENE, encodes a corresponding messenger RNA, VGAM431 host target RNA, herein designated VGAM HOST TARGET RNA. VGAM431 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM431 RNA, herein designated VGAM RNA, binds complementarily to one or more host target binding sites located in untranslated regions of VGAM431 host target RNA, herein designated VGAM HOST TARGET RNA. This complementary binding is due to the fact that the nucleotide sequence of VGAM431 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM431 RNA, herein designated VGAM RNA, may have a different number of host target binding sites in untranslated regions of a VGAM431 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM431 RNA, herein designated VGAM RNA, to host target binding sites on VGAM431 host target RNA, herein designated VGAM HOST TARGET RNA, such as BINDING SITE I, BINDING SITE II and BINDING SITE III, inhibits translation of VGAM431 host target RNA into VGAM431 host target protein, herein designated VGAM HOST TARGET PROTEIN. VGAM host target protein is therefore outlined by a broken line.

It is appreciated that VGAM431 host target gene, herein designated VGAM HOST TARGET GENE, in fact represents a plurality of VGAM431 host target genes. The mRNA of each one of this plurality of VGAM431 host target genes comprises one or more host target binding sites, each having a nucleotide sequence which is at least partly complementary to VGAM431 RNA, herein designated VGAM RNA, and which when bound by VGAM431 RNA causes inhibition of translation of respective one or more VGAM431 host target proteins.

It is further appreciated by one skilled in the art that the mode of translational inhibition illustrated by FIG. 1 with specific reference to translational inhibition exerted by VGAM431 gene, herein designated VGAM GENE, on one or more VGAM431 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM431 is inhibition of expression of host target genes, as part of a novel viral mechanism of attacking a host. Accordingly, utilities of VGAM431 include diagnosis, prevention and treatment of viral infection by Rabbit Hemorrhagic Disease Virus. Specific functions, and accordingly utilities, of VGAM431 correlate with, and may be deduced from, the identity of the host target genes which VGAM431 binds and inhibits, and the function of these host target genes, as elaborated hereinbelow.

Nucleotide sequences of the VGAM431 precursor RNA, herein designated VGAM PRECURSOR RNA, and of the 'diced' VGAM431 RNA, herein designated VGAM RNA, and a schematic representation of the secondary folding of VGAM431 folded precursor RNA, herein designated VGAM FOLDED PRECURSOR RNA, of VGAM431 are further described hereinbelow with reference to Table 1.

Nucleotide sequences of host target binding sites, such as BINDING SITE-I, BINDING SITE-II and BINDING SITE-III of FIG. 1, found on VGAM431 host target RNA, and schematic representation of the complementarity of each of these host target binding sites to VGAM431 RNA, herein designated VGAM RNA, are described hereinbelow with reference to Table 2.

As mentioned hereinabove with reference to FIG. 1, a function of VGAM431 gene, herein designated VGAM is inhibition of expression of VGAM431 target genes. It is appreciated that specific functions, and accordingly utilities, of VGAM431 correlate with, and may be deduced from, the identity of the target genes which VGAM431 binds and inhibits, and the function of these target genes, as elaborated hereinbelow.

BCL2-like 2 (BCL2L2, Accession NM_004050) is a VGAM431 host target gene. BCL2L2 BINDING SITE is HOST TARGET binding site found in the 3' untranslated region of mRNA encoded by BCL2L2, corresponding to a HOST TARGET binding site such as BINDING SITE I, BINDING SITE II or BINDING SITE III. Table 2 illustrates the complementarity of the nucleotide sequences of BCL2L2 BINDING SITE, designated SEQ ID:10261, to the nucleotide sequence of VGAM431 RNA, herein designated VGAM RNA, also designated SEQ ID:3142.

A function of VGAM431 is therefore inhibition of BCL2-like 2 (BCL2L2, Accession NM_004050), a gene which promotes cell survival. Accordingly, utilities of VGAM431 include diagnosis, prevention and treatment of diseases and clinical conditions associated with BCL2L2. The function of BCL2L2 has been established by previous studies. Gibson et al. (1996) used degenerate PCR to clone a novel BCL2 homolog which they denoted BCLW. The gene encodes a 193-amino acid polypeptide. Gibson et al. (1996) also isolated the mouse BCLW gene; its amino acid sequence is 99% identical to that of the human gene. Mouse BCLW is expressed as a 3.7-kb mRNA in a variety of tissues, with highest expression in brain, colon, and salivary gland. In mouse hematopoietic cell lines, BCLW is expressed in myeloid cells and to a lesser extent in lymphoid cells. Like BCL2, expressed BCLW promotes cell survival under a variety of cytotoxic conditions. Gibson et al. (1996) used fluorescence in situ hybridization to map the BCLW gene to human chromosome 14q11.2-q12. Animal model experiments lend further support to the function of BCL2L2. To identify genes required for mammalian spermatogenesis, Ross et al. (1998) screened lines of mutant mice created using a retroviral gene-trap system for male infertility. Homozygous ROSA41 male mice exhibited sterility associated with progressive testicular degeneration. Germ cell defects were first observed at 19 days postnatal. Spermatogenesis was blocked during late spermiogenesis in young adults. Gradual depletion of all stages of germ cells resulted in a Sertoli-cell-only phenotype by approximately 6 months of age. Subsequently, almost all Sertoli cells were lost from the seminiferous tubules, and the Leydig cell population was reduced. Molecular analysis indicated that the gene mutated in these mice is BCLW, a death-protecting member of the Bcl2 family.

The mutant allele of Bclw in ROSA41 did not produce a Bclw polypeptide. Expression of Bclw in the testis appeared to be restricted to elongating spermatids and Sertoli cells.

It is appreciated that the abovementioned animal model for BCL2L2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gibson, L.; Holmgreen, S. P.; Huang, D. C. S.; Bernard, O.; Copeland, N. G.; Jenkins, N. A.; Sutherland, G. R.; Baker, E.; Adams, J. M.; Cory, S.: bcl-w, a novel member of the bcl-2 family, promotes cell survival. Oncogene 13:665-675, 1996; and Ross, A. J.; Waymire, K. G.; Moss, J. E.; Parlow, A. F.; Skinner, M. K.; Russell, L. D.; MacGregor, G. R.: Testicular degeneration in Bclw-deficient mice. Nature Genet. 18:251-256, 199.

Further studies establishing the function and utilities of BCL2L2 are found in John Hopkins OMIM database record ID 601931, and in sited publications numbered 6256-6257 listed in the bibliography section hereinbelow, which are also hereby incorporated by reference. Reserved (C8orf13, Accession XM_088377) is another VGAM431 host target gene. C8orf13 BINDING SITE is HOST TARGET binding site found in the 3' untranslated region of mRNA encoded by C8orf13, corresponding to a HOST TARGET binding site such as BINDING SITE I, BINDING SITE II or BINDING SITE III. Table 2 illustrates the complementarity of the nucleotide sequences of C8orf13 BINDING SITE, designated SEQ ID:39655, to the nucleotide sequence of VGAM431 RNA, herein designated VGAM RNA, also designated SEQ ID:3142.

Another function of VGAM431 is therefore inhibition of Reserved (C8orf13, Accession XM_088377). Accordingly, utilities of VGAM431 include diagnosis, prevention and treatment of diseases and clinical conditions associated with C8orf13. Opiate Receptor-like 1 (OPRL1, Accession NM_000913) is another VGAM431 host target gene. OPRL1 BINDING SITE is HOST TARGET binding site found in the 3' untranslated region of mRNA encoded by OPRL1, corresponding to a HOST TARGET binding site such as BINDING SITE I, BINDING SITE II or BINDING SITE III. Table 2 illustrates the complementarity of the nucleotide sequences of OPRL1 BINDING SITE, designated SEQ ID:6613, to the nucleotide sequence of VGAM431 RNA, herein designated VGAM RNA, also designated SEQ ID:3142.

Another function of VGAM431 is therefore inhibition of Opiate Receptor-like 1 (OPRL1, Accession NM_000913). Accordingly, utilities of VGAM431 include diagnosis, prevention and treatment of diseases and clinical conditions associated with OPRL1. FIG. 1 further provides a conceptual description of a novel bioinformatically detected viral gene of the present invention, referred to here as Viral Genomic Address Messenger 432 (VGAM432) viral gene, which modulates expression of respective host target genes thereof, the function and utility of which host target genes is known in the art.

VGAM432 is a novel bioinformatically detected regulatory, non protein coding, viral micro RNA (miRNA) gene. The method by which VGAM432 was detected is described hereinabove with reference to FIGS. 1-8.

VGAM432 gene, herein designated VGAM GENE, is a viral gene contained in the genome of Rabbit Hemorrhagic Disease Virus. VGAM432 host target gene, herein designated VGAM HOST TARGET GENE, is a human gene contained in the human genome.

VGAM432 gene encodes a VGAM432 precursor RNA, herein designated VGAM PRECURSOR RNA. Similar to other miRNA genes, and unlike most ordinary genes, VGAM432 precursor RNA does not encode a protein. A nucleotide sequence identical or highly similar to the nucleotide sequence of VGAM432 precursor RNA is designated SEQ ID:418, and is provided hereinbelow with reference to the sequence listing part. Nucleotide sequence SEQ ID:418 is located at position 3603 relative to the genome of Rabbit Hemorrhagic Disease Virus.

VGAM432 precursor RNA folds onto itself, forming VGAM432 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM432 folded precursor RNA into VGAM432 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM432 RNA is designated SEQ ID:3143, and is provided hereinbelow with reference to the sequence listing part.

VGAM432 host target gene, herein designated VGAM HOST TARGET GENE, encodes a corresponding messenger RNA, VGAM432 host target RNA, herein designated VGAM HOST TARGET RNA. VGAM432 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM432 RNA, herein designated VGAM RNA, binds complementarily to one or more host target binding sites located in untranslated regions of VGAM432 host target RNA, herein designated VGAM HOST TARGET RNA. This complementary binding is due to the fact that the nucleotide sequence of VGAM432 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM432 RNA, herein designated VGAM RNA, may have a different number of host target binding sites in untranslated regions of a VGAM432 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM432 RNA, herein designated VGAM RNA, to host target binding sites on VGAM432 host target RNA, herein designated VGAM HOST TARGET RNA, such as BINDING SITE I, BINDING SITE II and BINDING SITE III, inhibits translation of VGAM432 host target RNA into VGAM432 host target protein, herein designated VGAM HOST TARGET PROTEIN.

VGAM host target protein is therefore outlined by a broken line.

It is appreciated that VGAM432 host target gene, herein designated VGAM HOST TARGET GENE, in fact represents a plurality of VGAM432 host target genes. The mRNA of each one of this plurality of VGAM432 host target genes comprises one or more host target binding sites, each having a nucleotide sequence which is at least partly complementary to VGAM432 RNA, herein designated VGAM RNA, and which when bound by VGAM432 RNA causes inhibition of translation of respective one or more VGAM432 host target proteins.

It is further appreciated by one skilled in the art that the mode of translational inhibition illustrated by FIG. 1 with specific reference to translational inhibition exerted by VGAM432 gene, herein designated VGAM GENE, on one or more VGAM432 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM432 is inhibition of expression of host target genes, as part of a novel viral mechanism of attacking a host. Accordingly, utilities of VGAM432 include diagnosis, prevention and treatment of viral infection by Rabbit Hemorrhagic Disease Virus. Specific functions, and accordingly utilities, of VGAM432 correlate with, and may be deduced from, the identity of the host target genes which VGAM432 binds and inhibits, and the function of these host target genes, as elaborated hereinbelow.

Nucleotide sequences of the VGAM432 precursor RNA, herein designated VGAM PRECURSOR RNA, and of the 'diced' VGAM432 RNA, herein designated VGAM RNA, and a schematic representation of the secondary folding of VGAM432 folded precursor RNA, herein designated VGAM FOLDED PRECURSOR RNA, of VGAM432 are further described hereinbelow with reference to Table 1.

Nucleotide sequences of host target binding sites, such as BINDING SITE-I, BINDING SITE-II and BINDING SITE-III of FIG. 1, found on VGAM432 host target RNA, and schematic representation of the complementarity of each of these host target binding sites to VGAM432 RNA, herein designated VGAM RNA, are described hereinbelow with reference to Table 2.

As mentioned hereinabove with reference to FIG. 1, a function of VGAM432 gene, herein designated VGAM is inhibition of expression of VGAM432 target genes. It is appreciated that specific functions, and accordingly utilities, of VGAM432 correlate with, and may be deduced from, the identity of the target genes which VGAM432 binds and inhibits, and the function of these target genes, as elaborated hereinbelow.

Cadherin, EGF LAG Seven-pass G-type Receptor 2 (flamingo homolog, Drosophila) (CELSR2, Accession NM_001408) is a VGAM432 host target gene. CELSR2 BINDING SITE is HOST TARGET binding site found in the 3' untranslated region of mRNA encoded by CELSR2, corresponding to a HOST TARGET binding site such as BINDING SITE I, BINDING SITE II or BINDING SITE III. Table 2 illustrates the complementarity of the nucleotide sequences of CELSR2 BINDING SITE, designated SEQ ID:7109, to the nucleotide sequence of VGAM432 RNA, herein designated VGAM RNA, also designated SEQ ID:3143.

A function of VGAM432 is therefore inhibition of Cadherin, EGF LAG Seven-pass G-type Receptor 2 (flamingo homolog, Drosophila) (CELSR2, Accession NM_001408), a gene which is a calcium dependent cell adhesion protein. Accordingly, utilities of VGAM432 include diagnosis, prevention and treatment of diseases and clinical conditions associated with CELSR2. The function of CELSR2 has been established by previous studies. The domain that characterizes epidermal growth factor (EGF; 131530) consists of approximately 50 amino acids with 3 disulfide bonds. EGF-like domains are believed to play a critical role in a number of extracellular events, including cell adhesion and receptor-ligand interactions. Proteins with EGF-like domains often consist of more than 1,000 amino acids, have multiple copies of the EGF-like domain, and contain additional domains known to be involved in specific protein-protein interactions. To identify proteins containing EGF-like domains, Nakayama et al. (1998) searched a database of long cDNA sequences randomly selected from a human brain cDNA library for those that encode an EGF-like motif. They identified several partial cDNAs encoding novel proteins with EGF-like domains, such as EGFL2, which they named MEGF3. The predicted partial EGFL2 protein has at least 5 cadherin motifs, 6 EGF-like domains, 2 laminin G domains (see OMIM Ref. No. 601033), 7 transmembrane domains, and a cytoplasmic proline-rich sequence. Human EGFL2 appears to have a domain structure identical to that of rat Megf2 (OMIM Ref. No. 604264), whose complete coding sequence was also isolated by the authors. Northern blot analysis detected rat Megf3 expression in several regions of the brain.

Full details of the abovementioned studies are described in the following publications, the disclosure of which are hereby incorporated by reference:

Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human genes. VI. The coding sequences of 80 new genes (KIAA0201-KIAA0280) deduced by analysis of cDNA clones from cell line KG-1 and brain. DNA Res. 3:321-329, 1996; and Nakayama, M.; Nakajima, D.; Nagase, T.; Nomura, N.; Seki, N.; Ohara, O.: Identification of high-molecular-weight proteins with multiple EGF-like motifs by motif-trap screening. Genomic.

Further studies establishing the function and utilities of CELSR2 are found in John Hopkins OMIM database record ID 604265, and in sited publications numbered 9379 listed in the bibliography section hereinbelow, which are also hereby incorporated by reference. Egl Nine Homolog 2 (C. elegans) (EGLN2, Accession NM_080732) is another VGAM432 host target gene. EGLN2 BINDING SITE is HOST TARGET binding site found in the 5' untranslated region of mRNA encoded by EGLN2, corresponding to a HOST TARGET binding site such as BINDING SITE I, BINDING SITE II or BINDING SITE III. Table 2 illustrates the complementarity of the nucleotide sequences of EGLN2 BINDING SITE, designated SEQ ID:28022, to the nucleotide sequence of VGAM432 RNA, herein designated VGAM RNA, also designated SEQ ID:3143.

Another function of VGAM432 is therefore inhibition of Egl Nine Homolog 2 (C. elegans) (EGLN2, Accession NM_080732), a gene which is an essential component of the pathway. Accordingly, utilities of VGAM432 include diagnosis, prevention and treatment of diseases and clinical conditions associated with EGLN2. The function of EGLN2 has been established by previous studies. In cultured mammalian cells, Bruick and McKnight (2001) found that the inappropriate accumulation of HIF caused by forced expression of the HIF1-alpha subunit under normoxic conditions was attenuated by coexpression of HPH. Suppression of HPH in cultured Drosophila melanogaster cells by RNA interference resulted in elevated expression of the hypoxia-inducible gene LDH (see OMIM Ref. No. 150000) under normoxic conditions. Bruick and McKnight (2001) concluded that HPH is an essential component of the pathway through which cells sense oxygen. HIF is a transcriptional complex that plays a central role in mammalian oxygen homeostasis. Posttranslational modification by prolyl hydroxylation is a key regulatory event that targets HIF-alpha (HIF1; 603348) subunits for proteasomal destruction via the von Hippel-Lindau (VHL; 193300) ubiquitylation complex. Epstein et al. (2001) defined a conserved HIF-VHL-prolyl hydroxylase pathway in C. elegans and identified Egl9 as a dioxygenase that regulates HIF by prolyl hydroxylation. In mammalian cells, they showed that the HIF-prolyl hydroxylases are represented by 3 proteins with a conserved 2-histidine-1-carboxylate iron coordination motif at the catalytic site. The genes encoding these proteins were cloned and termed PHD1, PHD2 (OMIM Ref. No. 606425), and PHD3 (OMIM Ref. No. 606426) by the authors. Direct modulation of recombinant enzyme activity by graded hypoxia, iron chelation, and cobaltous ions mirrored the characteristics of HIF induction in vivo, fulfilling requirements for these enzymes being oxygen sensors that regulate HIF.

Full details of the abovementioned studies are described in the following publications, the disclosure of which are hereby incorporated by reference:

Bruick, R. K.; McKnight, S. L.: A conserved family of prolyl-4-hydroxylases that modify HIF. Science 294:1337-1340, 2001; and Epstein, A. C. R.; Gleadle, J. M.; McNeill, L. A.; Hewitson, K. S.; O'Rourke, J.; Mole, D. R.; Mukherji, M.; Metzen, E.; Wilson, M. I.; Dhanda, A.; Tian, Y.-M.; Masson, N.; Hamilton, D.

Further studies establishing the function and utilities of EGLN2 are found in John Hopkins OMIM database record ID 606424, and in sited publications numbered 4543-4544 listed in the bibliography section hereinbelow, which are also hereby incorporated by reference. Frizzled Homolog 1 (Drosophila) (FZD1, Accession NM_003505) is another VGAM432 host target gene. FZD1 BINDING SITE is HOST TARGET binding site found in the 3' untranslated region of mRNA encoded by FZD1, corresponding to a HOST TARGET binding site such as BINDING SITE I, BINDING SITE II or BINDING SITE III. Table 2 illustrates the complementarity of the nucleotide sequences of FZD1 BINDING SITE, designated SEQ ID:9594, to the nucleotide sequence of VGAM432 RNA, herein designated VGAM RNA, also designated SEQ ID:3143.

Another function of VGAM432 is therefore inhibition of Frizzled Homolog 1 (Drosophila) (FZD1, Accession NM_003505), a gene which may be involved in bone resorption; strongly similar to rat Fzd. Accordingly, utilities of VGAM432 include diagnosis, prevention and treatment of diseases and clinical conditions associated with FZD1. The function of FZD1 has been established by previous studies. Members of the 'frizzled' (Fz) gene family encode 7-transmembrane domain proteins that are receptors for Wnt (see OMIM Ref. No. 164975) signaling proteins. See 601766. Liu et al. (2001) constructed a chimeric receptor with the ligand-binding and transmembrane segments from the beta-2-adrenergic receptor (OMIM Ref. No. 109690) and the cytoplasmic domains from rat frizzled-1. Stimulation of mouse F9 clones expressing the chimera with the beta-adrenergic agonist isoproterenol stimulated stabilization of beta-catenin (OMIM Ref. No. 116806), activation of a beta-catenin-sensitive promoter, and formation of primitive endoderm. The response was blocked by inactivation of pertussis toxin-sensitive, heterotrimeric G proteins, and by depletion of G-alpha-q (OMIM Ref. No. 600998) and G-alpha-o (OMIM Ref. No. 139311). Thus, Liu et al. (2001) concluded that G proteins are elements of Wnt/frizzled-1 signaling to the beta-catenin-lymphoid-enhancer factor (LEF)-T-cell factor (Tcf) pathway.

Full details of the abovementioned studies are described in the following publications, the disclosure of which are hereby incorporated by reference:

Liu, T.; DeCostanzo, A. J.; Liu, X.; Wang, H.; Hallagan, S.; Moon, R. T.; Malbon, C. C.: G protein signaling from activated rat frizzled-1 to the beta-catenin-Lef-Tcf pathway. Science 292:1718-1722, 2001; and Sagara, N.; Toda, G.; Hirai, M.; Terada, M.; Katoh, M.: Molecular cloning, differential expression, and chromosomal localization of human frizzled-1, frizzled-2, and frizzled-7. Bioch.

Further studies establishing the function and utilities of FZD1 are found in John Hopkins OMIM database record ID 603408, and in sited publications numbered 5301-5302 listed in the bibliography section hereinbelow, which are also hereby incorporated by reference. ATP6V1EL2 (Accession NM_080653) is another VGAM432 host target gene. ATP6V1EL2 BINDING SITE is HOST TARGET binding site found in the 5' untranslated region of mRNA encoded by ATP6V1EL2, corresponding to a HOST TARGET binding site such as BINDING SITE I, BINDING SITE II or BINDING SITE III. Table 2 illustrates the complementarity of the nucleotide sequences of ATP6V1EL2 BINDING SITE, designated SEQ ID:27941, to the nucleotide sequence of VGAM432 RNA, herein designated VGAM RNA, also designated SEQ ID:3143.

Another function of VGAM432 is therefore inhibition of ATP6V1EL2 (Accession NM_080653). Accordingly, utilities of VGAM432 include diagnosis, prevention and treatment of diseases and clinical conditions associated with ATP6V1EL2. FLJ00001 (Accession XM_088525) is another VGAM432 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39789, to the nucleotide sequence of VGAM432 RNA, herein designated VGAM RNA, also designated SEQ ID:3143.

Another function of VGAM432 is therefore inhibition of FLJ00001 (Accession XM_088525). Accordingly, utilities of VGAM432 include diagnosis, prevention and treatment of diseases and clinical conditions associated with FLJ00001. KIAA0628 (Accession NM_014789) is another VGAM432 host target gene. KIAA0628 BINDING SITE is HOST TARGET binding site found in the 3' untranslated region of mRNA encoded by KIAA0628, corresponding to a HOST TARGET binding site such as BINDING SITE I, BINDING SITE II or BINDING SITE III. Table 2 illustrates the complementarity of the nucleotide sequences of KIAA0628 BINDING SITE, designated SEQ ID:16676, to the nucleotide sequence of VGAM432 RNA, herein designated VGAM RNA, also designated SEQ ID:3143.

Another function of VGAM432 is therefore inhibition of KIAA0628 (Accession NM_014789). Accordingly, utilities of VGAM432 include diagnosis, prevention and treatment of diseases and clinical conditions associated with KIAA0628.

KIAA0652 (Accession NM_014741) is another VGAM432 host target gene. KIAA0652 BINDING SITE is HOST TARGET binding site found in the 3' untranslated region of mRNA encoded by KIAA0652, corresponding to a HOST TARGET binding site such as BINDING SITE I, BINDING SITE II or BINDING SITE III. Table 2 illustrates the complementarity of the nucleotide sequences of KIAA0652 BINDING SITE, designated SEQ ID:16411, to the nucleotide sequence of VGAM432 RNA, herein designated VGAM RNA, also designated SEQ ID:3143.

Another function of VGAM432 is therefore inhibition of KIAA0652 (Accession NM_014741). Accordingly, utilities of VGAM432 include diagnosis, prevention and treatment of diseases and clinical conditions associated with KIAA0652. KIAA1389 (Accession XM_045839) is another VGAM432 host target gene. KIAA1389 BINDING SITE is HOST TARGET binding site found in the 3' untranslated region of mRNA encoded by KIAA1389, corresponding to a HOST TARGET binding site such as BINDING SITE I, BINDING SITE II or BINDING SITE III. Table 2 illustrates the complementarity of the nucleotide sequences of KIAA1389 BINDING SITE, designated SEQ ID:34570, to the nucleotide sequence of VGAM432 RNA, herein designated VGAM RNA, also designated SEQ ID:3143.

Another function of VGAM432 is therefore inhibition of KIAA1389 (Accession XM_045839). Accordingly, utilities of VGAM432 include diagnosis, prevention and treatment of diseases and clinical conditions associated with KIAA1389. KIAA1889 (Accession XM_056298) is another VGAM432 host target gene. KIAA1889 BINDING SITE is HOST TARGET binding site found in the 3' untranslated region of mRNA encoded by KIAA1889, corresponding to a HOST TARGET binding site such as BINDING SITE I, BINDING SITE II or BINDING SITE III. Table 2 illustrates the complementarity of the nucleotide sequences of KIAA1889 BINDING SITE, designated SEQ ID:36390, to the nucleotide sequence of VGAM432 RNA, herein designated VGAM RNA, also designated SEQ ID:3143.

Another function of VGAM432 is therefore inhibition of KIAA1889 (Accession XM_056298). Accordingly, utilities of VGAM432 include diagnosis, prevention and treatment of diseases and clinical conditions associated with KIAA1889. MGC29654 (Accession XM_039448) is another VGAM432 host target gene. MGC29654 BINDING SITE is HOST TARGET binding site found in the 5' untranslated region of mRNA encoded by MGC29654, corresponding to a HOST TARGET binding site such as BINDING SITE I, BINDING SITE II or BINDING SITE III. Table 2 illustrates the complementarity of the nucleotide sequences of MGC29654 BINDING SITE, designated SEQ ID:33094, to the nucleotide sequence of VGAM432 RNA, herein designated VGAM RNA, also designated SEQ ID:3143.

Another function of VGAM432 is therefore inhibition of MGC29654 (Accession XM_039448). Accordingly, utilities of VGAM432 include diagnosis, prevention and treatment of diseases and clinical conditions associated with MGC29654. FIG. 1 further provides a conceptual description of a novel bioinformatically detected viral gene of the present invention, referred to here as Viral Genomic Address Messenger 433 (VGAM433) viral gene, which modulates expression of respective host target genes thereof, the function and utility of which host target genes is known in the art.

VGAM433 is a novel bioinformatically detected regulatory, non protein coding, viral micro RNA (miRNA) gene. The method by which VGAM433 was detected is described hereinabove with reference to FIGS. 1-8.

VGAM433 gene, herein designated VGAM GENE, is a viral gene contained in the genome of Rabbit Hemorrhagic Disease Virus. VGAM433 host target gene, herein designated VGAM HOST TARGET GENE, is a human gene contained in the human genome.

VGAM433 gene encodes a VGAM433 precursor RNA, herein designated VGAM PRECURSOR RNA. Similar to other miRNA genes, and unlike most ordinary genes, VGAM433 precursor RNA does not encode a protein. A nucleotide sequence identical or highly similar to the nucleotide sequence of VGAM433 precursor RNA is designated SEQ ID:419, and is provided hereinbelow with reference to the sequence listing part. Nucleotide sequence SEQ ID:419 is located at position 1022 relative to the genome of Rabbit Hemorrhagic Disease Virus.

VGAM433 precursor RNA folds onto itself, forming VGAM433 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM433 folded precursor RNA into VGAM433 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 43%) nucleotide sequence of VGAM433 RNA is designated SEQ ID:3144, and is provided hereinbelow with reference to the sequence listing part.

VGAM433 host target gene, herein designated VGAM HOST TARGET GENE, encodes a corresponding messenger RNA, VGAM433 host target RNA, herein designated VGAM HOST TARGET RNA. VGAM433 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM433 RNA, herein designated VGAM RNA, binds complementarily to one or more host target binding sites located in untranslated regions of VGAM433 host target RNA, herein designated VGAM HOST TARGET RNA. This complementary binding is due to the fact that the nucleotide sequence of VGAM433 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM433 RNA, herein designated VGAM RNA, may have a different number of host target binding sites in untranslated regions of a VGAM433 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM433 RNA, herein designated VGAM RNA, to host target binding sites on VGAM433 host target RNA, herein designated VGAM HOST TARGET RNA, such as BINDING SITE I, BINDING SITE II and BINDING SITE III, inhibits translation of VGAM433 host target RNA into VGAM433 host target protein, herein designated VGAM HOST TARGET PROTEIN. VGAM host target protein is therefore outlined by a broken line.

It is appreciated that VGAM433 host target gene, herein designated VGAM HOST TARGET GENE, in fact represents a plurality of VGAM433 host target genes. The mRNA of each one of this plurality of VGAM433 host target genes comprises one or more host target binding sites, each having a nucleotide sequence which is at least partly complementary to VGAM433 RNA, herein designated VGAM RNA, and which when bound by VGAM433 RNA causes inhibition of translation of respective one or more VGAM433 host target proteins.

It is further appreciated by one skilled in the art that the mode of translational inhibition illustrated by FIG. 1 with specific reference to translational inhibition exerted by VGAM433 gene, herein designated VGAM GENE, on one or more VGAM433 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM433 is inhibition of expression of host target genes, as part of a novel viral mechanism of attacking a host. Accordingly, utilities of VGAM433 include diagnosis, prevention and treatment of viral infection by Rabbit Hemorrhagic Disease Virus. Specific functions, and accordingly utilities, of VGAM433 correlate with, and may be deduced from, the identity of the host target genes which VGAM433 binds and inhibits, and the function of these host target genes, as elaborated hereinbelow.

Nucleotide sequences of the VGAM433 precursor RNA, herein designated VGAM PRECURSOR RNA, and of the ‘diced’ VGAM433 RNA, herein designated VGAM RNA, and a schematic representation of the secondary folding of VGAM433 folded precursor RNA, herein designated VGAM FOLDED PRECURSOR RNA, of VGAM433 are further described hereinbelow with reference to Table 1.

Nucleotide sequences of host target binding sites, such as BINDING SITE-I, BINDING SITE-II and BINDING SITE-III of FIG. 1, found on VGAM433 host target RNA, and schematic representation of the complementarity of each of these host target binding sites to VGAM433 RNA, herein designated VGAM RNA, are described hereinbelow with reference to Table 2.

As mentioned hereinabove with reference to FIG. 1, a function of VGAM433 gene, herein designated VGAM is inhibition of expression of VGAM433 target genes. It is appreciated that specific functions, and accordingly utilities, of VGAM433 correlate with, and may be deduced from, the identity of the target genes which VGAM433 binds and inhibits, and the function of these target genes, as elaborated hereinbelow.

B-cell CLL/lymphoma 10 (BCL10, Accession NM_003921) is a VGAM433 host target gene. BCL10 BINDING SITE is HOST TARGET binding site found in the 3' untranslated region of mRNA encoded by BCL10, corresponding to a HOST TARGET binding site such as BINDING SITE I, BINDING SITE II or BINDING SITE III. Table 2 illustrates the complementarity of the nucleotide sequences of BCL10 BINDING SITE, designated SEQ ID:10007, to the nucleotide sequence of VGAM433 RNA, herein designated VGAM RNA, also designated SEQ ID:3144.

A function of VGAM433 is therefore inhibition of B-cell CLL/lymphoma 10 (BCL10, Accession NM_003921), a gene which is a positive regulator of lymphocyte proliferation, NF-kappaB activator. Accordingly, utilities of VGAM433 include diagnosis, prevention and treatment of diseases and clinical conditions associated with BCL10. The function of BCL10 has been established by previous studies. B-cell lymphomas of mucosa-associated lymphoid tissue (MALT lymphomas) are the most common form of lymphoma arising in extranodal sites, in most cases arising in the gastric mucosa (Isaacson and Spencer, 1995). Cytogenetic studies of low-grade malignant MALT lymphoma identified abnormalities of chromosome 1p22, in particular translocation t (1;14)(p22; q32), as uncommon but recurrent events (Wotherspoon et al., 1992). Willis et al. (1999) cloned a t (1;14)(p22; q32) translocation breakpoint from a case of low-grade MALT lymphoma and identified a recurrent breakpoint upstream of the promoter of a novel gene, BCL10. The BCL10 gene encodes a predicted protein of 233 amino acids and is a cellular homolog of the equine herpesvirus-2 gene (E10); both contain an amino-terminal caspase recruitment domain (CARD) homologous to that found in several apoptotic molecules. BCL10 was found to be expressed as a transcript of 4.2 kb in all normal and malignant tissues examined. BCL10 and E10 activated nuclear factor kappa-B (NFKB; 164011) but caused apoptosis of 293 cells. BCL10 expressed in a MALT lymphoma exhibited a frameshift mutation resulting in truncation distal to the CARD. Truncated BCL10 activated NFKB but did not induce apoptosis. Wildtype BCL10 suppressed transformation, whereas mutant forms had lost this activity and displayed gain-of-function transforming activity. Animal model experiments lend further support to the function of BCL10. Ruland et al. (2001) showed that one-third of Bcl10 -/- mouse embryos developed exencephaly, leading to embryonic lethality. Surprisingly, Bcl10 -/- cells retained susceptibility to various apoptotic stimuli in vivo and in vitro. However, surviving Bcl10 -/- mice were severely immunodeficient, and Bcl10 -/- lymphocytes were defective in antigen receptor or phorbol myristate acetate (PMA)/ionomycin-induced activation. Early tyrosine phosphorylation, mitogen-activated protein kinase (MAPK; OMIM Ref. No. 604921) and activator protein-1 (AP1; 165160) activation, and calcium signaling were normal in mutant lymphocytes, but antigen receptor-induced NFKB activation was absent. Thus, the authors concluded that BCL10 functions as a positive regulator of lymphocyte proliferation that specifically connects antigen receptor signaling in B and T cells to NFKB activation.

It is appreciated that the abovementioned animal model for BCL10 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Willis, T. G.; Jadayel, D. M.; Du, M.-Q.; Peng, H.; Perry, A. R.; Abdul-Rauf, M.; Price, H.; Karran, L.; Majekodunmi, O.;

Wlodarska, I.; Pan, L.; Crook, T.; Hamoudi, R.; Isaacson, P. G.; Dyer, M. J. S.: Bcl10 is involved in t (1;14)(p22; q32) of MALT B cell lymphoma and mutated in multiple tumor types Cell 96:35-45, 1999; and Ruland, J.; Duncan, G. S.; Elia, A.; del Barco Barrantes, I.; Nguyen, L.; Plyte, S.; Millar, D. G.; Bouchard, D.; Wakeham, A.; Ohashi, P. S.; Mak, T. W.: Bcl10 is a positive regulator.

Further studies establishing the function and utilities of BCL10 are found in John Hopkins OMIM database record ID 603517, and in sited publications numbered 11497-8668 listed in the bibliography section hereinbelow, which are also hereby incorporated by reference. Leucine-zipper-like Transcriptional Regulator, 1 (LZTR1, Accession NM_006767) is another VGAM433 host target gene. LZTR1 BINDING SITE is HOST TARGET binding site found in the 3' untranslated region of mRNA encoded by LZTR1, corresponding to a HOST TARGET binding site such as BINDING SITE I, BINDING SITE II or BINDING SITE III. Table 2 illustrates the complementarity of the nucleotide sequences of LZTR1 BINDING SITE, designated SEQ ID:13642, to the nucleotide sequence of VGAM433 RNA, herein designated VGAM RNA, also designated SEQ ID:3144.

Another function of VGAM433 is therefore inhibition of Leucine-zipper-like Transcriptional Regulator, 1 (LZTR1, Accession NM_006767). Accordingly, utilities of VGAM433 include diagnosis, prevention and treatment of diseases and clinical conditions associated with LZTR1. Protocadherin 11 X-linked (PCDH11X, Accession NM_032968) is another VGAM433 host target gene. PCDH11X BINDING SITE1 and PCDH11X BINDING SITE2 are HOST TARGET binding sites found in untranslated regions of mRNA encoded by PCDH11X, corresponding to HOST TARGET binding sites such as BINDING SITE I, BINDING SITE II or BINDING SITE III. Table 2 illustrates the complementarity of the nucleotide sequences of PCDH11X BINDING SITE1 and PCDH11X BINDING SITE2, designated SEQ ID:26793 and SEQ ID:26808 respectively, to the nucleotide sequence of VGAM433 RNA, herein designated VGAM RNA, also designated SEQ ID:3144.

Another function of VGAM433 is therefore inhibition of Protocadherin 11 X-linked (PCDH11X, Accession NM_032968), a gene which is thought to play a fundamental role in cell-cell recognition essential for the segmental development and function of the central nervous system. Accordingly, utilities of VGAM433 include diagnosis, prevention and treatment of diseases and clinical conditions associated with PCDH11X. The function of PCDH11X has been established by previous studies. The protocadherins are a subfamily of calcium-dependent cell adhesion and recognition proteins of the cadherin superfamily. They are particularly prevalent in the central nervous system. By database searching with a human PCDH7 (OMIM Ref. No. 602988) cDNA probe, Yoshida and Sugano (1999) identified a homologous mRNA from infant brain. They found the same sequence on a genomic clone of chromosome X, within the X-Y homology region at Xp21.3. By RT-PCR using fetal brain, they identified a cDNA, PCDH11, which they called PCDHX, encoding a deduced 1,021-amino acid protein. Sequence analysis predicted a 25-amino acid signal peptide, an extracellular portion with 7 cadherin repeats, a 24-amino acid transmembrane stretch, and a 10-amino acid cytoplasmic domain with homology to PCDH1 (OMIM Ref. No. 603626) and PCDH7. Yoshida and Sugano (1999) also identified a splice variant, termed PCDHXb, by EST database searches. Northern blot analysis revealed expression of an approximately 6.0-kb transcript in human and mouse fetal brain. Using STS analysis, Yoshida and Sugano (1999) mapped the PCDH11 gene to the X-Y homology region at chromosome Xq21.3 that is homologous to Yp11.1. Blanco et al. (2000) mapped the PCDH11 gene to Xq21.3, within the X-Y homologous region, using detailed YAC and PAC contigs and fine STS marker order.

Full details of the abovementioned studies are described in the following publications, the disclosure of which are hereby incorporated by reference:

Yoshida, K.; Sugano, S.: Identification of a novel protocadherin gene (PCDH11) on the human XY homology region in Xq21.3. Genomics 62:540-543, 1999; and Yoshida, K.; Sugano, S.: Identification of a novel protocadherin gene (PCDH11) on the human XY homology region in Xq21.3. Genomics 62:540-543, 1999.

Further studies establishing the function and utilities of PCDH11X are found in John Hopkins OMIM database record ID 300246, and in sited publications numbered 9161-916 and 9178 listed in the bibliography section hereinbelow, which are also hereby incorporated by reference. RAB1A, Member RAS Oncogene Family (RAB1A, Accession XM_046674) is another VGAM433 host target gene. RAB1A BINDING SITE is HOST TARGET binding site found in the 3" untranslated region of mRNA encoded by RAB1A, corresponding to a HOST TARGET binding site such as BINDING SITE I, BINDING SITE II or BINDING SITE III. Table 2 illustrates the complementarity of the nucleotide sequences of RAB1A BINDING SITE, designated SEQ ID:34791, to the nucleotide sequence of VGAM433 RNA, herein designated VGAM RNA, also designated SEQ ID:3144.

Another function of VGAM433 is therefore inhibition of RAB1A, Member RAS Oncogene Family (RAB1A, Accession XM_046674), a gene which is involved in vesicle transport. Accordingly, utilities of VGAM433 include diagnosis, prevention and treatment of diseases and clinical conditions associated with RAB1A. The function of RAB1A has been established by previous studies. RAB proteins have been postulated to regulate the targeting and fusion of membranous vesicles during organelle assembly and transport. RAB proteins undergo regulated exchange of GTP for GDP, and they slowly hydrolyze the bound GTP in a reaction that is thought to regulate the timing and unidirectional nature of these assembly events. All of the known RAB proteins terminate in sequences such as cys-X-cys (e.g., RAB3A, 179490), cys-cys (e.g., RAB1A), or a closely related sequence, and all are believed to be geranylgeranylated. From a human pheochromocytoma cDNA library, Zahraoui et al. (1989) isolated 7 cDNA clones corresponding to genes encoding the Ras-associated GTP-binding proteins. See RAB5A (OMIM Ref. No. 179512). The predicted 205-amino acid human and rat RAB1 proteins are identical and share 75% identity with YPT1, the S. cerevisiae homolog. Northern blot analysis revealed that the RAB1 gene was expressed as a major (OMIM Ref. No. 2.7 kb) and a minor (OMIM Ref. No. 1.7 kb) mRNA in a human fibroblast cell line. The 'wobbler' spinal muscular atrophy gene (wr) maps to proximal mouse chromosome 11, tightly linked to Rab1 and Glns-ps1, an intronless pseudogene of the glutamine synthetase gene (OMIM Ref. No. 138290). Wedemeyer et al. (1996) used these markers to construct a 1.3-Mb YAC contig of the Rab1 region on mouse chromosome 11. Two overlapping YACS were identified that contained a 150-kb region of human chromosome 2p, comprising the RAB1 locus as well as a newly discovered STS (OMIM Ref. No. AHY1.1) and a trapped exon (OMIM Ref. No. ETG1.1). The region was mapped to 2p14-p13.4 using somatic cell hybrids and a radiation hybrid panel, thus extending a known region of conserved synteny between mouse chromosome 11 and human 2p. The gene for limb-girdle muscular dystrophy type 2B (LGMD2B; 253601) maps to 2p16-p13. The authors noted that conservation between the mouse Rab1 and human RAB1 regions will be helpful in identifying candidate genes for the 'wobbler' spinal muscular atrophy and in clarifying a possible relationship between wr and LGMD2B.

Full details of the abovementioned studies are described in the following publications, the disclosure of which are hereby incorporated by reference:

Allan, B. B.; Moyer, B. D.; Balch, W. E.: Rab1 recruitment of p115 into a cis-SNARE complex: programming budding COPII vesicles for fusion. Science 289:444-448, 2000; and Wedemeyer, N.; Lengeling, A.; Ronsiek, M.; Korthaus, D.; Baer, K.; Wuttke, M.; Jockusch, H.: YAC contigs of the Rab1 and wobbler (wr) spinal muscular atrophy gene region on proximal mo.

Further studies establishing the function and utilities of RAB1A are found in John Hopkins OMIM database record ID 179508, and in sited publications numbered 2537-253 and 2722 listed in the bibliography section hereinbelow, which are also hereby incorporated by reference. Thromboxane A2 Receptor (TBXA2R, Accession NM_001060) is another VGAM433 host target gene. TBXA2R BINDING SITE is HOST TARGET binding site found in the 3' untranslated region of mRNA encoded by TBXA2R, corresponding to a HOST TARGET binding site such as BINDING SITE I, BINDING SITE II or BINDING SITE III. Table 2 illustrates the complementarity of the nucleotide sequences of TBXA2R BINDING SITE, designated SEQ ID:6727, to the nucleotide sequence of VGAM433 RNA, herein designated VGAM RNA, also designated SEQ ID:3144.

Another function of VGAM433 is therefore inhibition of Thromboxane A2 Receptor (TBXA2R, Accession NM_001060), a gene which activates Ca2+-activated chloride channels; stimulates platelet aggregation and smooth muscle constriction. Accordingly, utilities of VGAM433 include diagnosis, prevention and treatment of diseases and clinical conditions associated with TBXA2R. The function of TBXA2R has been established by previous studies. Thromboxane A2 (TXA2), an arachidonate metabolite, is a potent stimulator of platelet aggregation and a constrictor of vascular and respiratory smooth muscles. It has been implicated as a mediator in diseases such as myocardial infarction, stroke, and bronchial asthma. Ushikubi et al. (1989) purified the cell surface receptor for TXA2, using a stable analog of TXA2. Using an oligonucleotide probe corresponding to its partial amino acid sequence, Hirata et al. (1991) obtained a cDNA encoding the receptor from human placenta and a partial cDNA clone from cultured human megakaryocytic leukemia cells. The placenta cDNA encoded a protein of 343 amino acids with 7 putative transmembrane domains. The protein expressed in COS-7 cells bound drugs with affinities identical to those of the platelet receptor, and that expressed in Xenopus oocytes opened calcium-ion-activated chloride channels on agonist stimulation. Northern blot analysis and nucleotide sequences of the 2 clones suggested that an identical form of thromboxane A2 receptor is present in platelets and vascular tissues. Animal model experiments lend further support to the function of TBXA2R. The actions of TXA2 are mediated by G protein-coupled thromboxane-prostanoid (TP) receptors. TP receptors have been implicated in the pathogenesis of cardiovascular diseases. To investigate the physiologic functions of TP receptors, Thomas et al. (1998) generated TP receptor-deficient mice by gene targeting. Tp -/- animals reproduced and survived in expected numbers, and their major organ systems were normal. Thromboxane agonist binding could not be detected in tissues from Tp -/- mice. Bleeding times were prolonged in these mice and their platelets did not aggregate after exposure to TXA2 agonists. Aggregation responses after collagen stimulation were also delayed, although ADP-stimulated aggregation was normal. In summary, Tp -/- mice had a mild bleeding disorder and altered vascular responses to TXA2 and arachidonic acid. Their studies suggested that most of the recognized functions of TXA2 are mediated by the single known Tp gene locus.

It is appreciated that the abovementioned animal model for TBXA2R is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hirata, M.; Hayashi, Y.; Ushikubi, F.; Yokota, Y.; Kageyama, R.; Nakanishi, S.; Narumiya, S.: Cloning and expression of cDNA for a human thromboxane A2 receptor. Nature 349:617-620, 1991; and Thomas, D. W.; Mannon, R. B.; Mannon, P. J.; Latour, A.; Oliver, J. A.; Hoffman, M.; Smithies, O.; Koller, B. H.; Coffman, T. M.: Coagulation defects and altered hemodynamic responses.

Further studies establishing the function and utilities of TBXA2R are found in John Hopkins OMIM database record ID 188070, and in sited publications numbered 9654, 10839-9657, 9678-9679, 10598, 1084 and 9684-9683 listed in the bibliography section hereinbelow, which are also hereby incorporated by reference. Chromosome 21 Open Reading Frame 18 (C21orf18, Accession NM_017438) is another VGAM433 host target gene. C21orf18 BINDING SITE is HOST TARGET binding site found in the 3' untranslated region of mRNA encoded by C21orf18, corresponding to a HOST TARGET binding site such as BINDING SITE I, BINDING SITE II or BINDING SITE III. Table 2 illustrates the complementarity of the nucleotide sequences of C21orf18 BINDING SITE, designated SEQ ID:18898, to the nucleotide sequence of VGAM433 RNA, herein designated VGAM RNA, also designated SEQ ID:3144.

Another function of VGAM433 is therefore inhibition of Chromosome 21 Open Reading Frame 18 (C21orf18, Accession NM_017438). Accordingly, utilities of VGAM433 include diagnosis, prevention and treatment of diseases and clinical conditions associated with C21orf18. Caspase 9, Apoptosis-related Cysteine Protease (CASP9, Accession NM_001229) is another VGAM433 host target gene. CASP9 BINDING SITE is HOST TARGET binding site found in the 3' untranslated region of mRNA encoded by CASP9, corresponding to a HOST TARGET binding site such as BINDING SITE I, BINDING SITE II or BINDING SITE III. Table 2 illustrates the complementarity of the nucleotide sequences of CASP9 BINDING SITE, designated SEQ ID:6899, to the nucleotide sequence of VGAM433 RNA, herein designated VGAM RNA, also designated SEQ ID:3144.

Another function of VGAM433 is therefore inhibition of Caspase 9, Apoptosis-related Cysteine Protease (CASP9, Accession NM_001229). Accordingly, utilities of VGAM433 include diagnosis, prevention and treatment of diseases and clinical conditions associated with CASP9. FLJ20813 (Accession NM_017961) is another VGAM433 host target gene. FLJ20813 BINDING SITE is HOST TARGET binding site found in the 3' untranslated region of mRNA encoded by FLJ20813, corresponding to a HOST TARGET binding site such as BINDING SITE I, BINDING SITE II or BINDING SITE III. Table 2 illustrates the complementarity of the nucleotide sequences of FLJ20813 BINDING SITE, designated SEQ ID:19680, to the nucleotide sequence of VGAM433 RNA, herein designated VGAM RNA, also designated SEQ ID:3144.

Another function of VGAM433 is therefore inhibition of FLJ20813 (Accession NM_017961). Accordingly, utilities of VGAM433 include diagnosis, prevention and treatment of diseases and clinical conditions associated with FLJ20813. G Protein-coupled Receptor 64 (GPR64, Accession NM_005756) is another VGAM433 host target gene. GPR64 BINDING SITE is HOST TARGET binding site found in the 3' untranslated region of mRNA encoded by GPR64, corresponding to a HOST TARGET binding site such as BINDING SITE I, BINDING SITE II or BINDING SITE III. Table 2 illustrates the complementarity of the nucleotide sequences of GPR64 BINDING SITE, designated SEQ ID:12316, to the nucleotide sequence of VGAM433 RNA, herein designated VGAM RNA, also designated SEQ ID:3144.

Another function of VGAM433 is therefore inhibition of G Protein-coupled Receptor 64 (GPR64, Accession NM_005756). Accordingly, utilities of VGAM433 include diagnosis, prevention and treatment of diseases and clinical conditions associated with GPR64. HTGN29 (Accession NM_020199) is another VGAM433 host target gene. HTGN29 BINDING SITE is HOST TARGET binding site found in the 3' untranslated region of mRNA encoded by HTGN29, corresponding to a HOST TARGET binding site such as BINDING SITE I, BINDING SITE II or BINDING SITE III. Table 2 illustrates the complementarity of the nucleotide sequences of HTGN29 BINDING SITE, designated SEQ ID:21433, to the nucleotide sequence of VGAM433 RNA, herein designated VGAM RNA, also designated SEQ ID:3144.

Another function of VGAM433 is therefore inhibition of HTGN29 (Accession NM_020199). Accordingly, utilities of VGAM433 include diagnosis, prevention and treatment of diseases and clinical conditions associated with HTGN29. KIAA0352 (Accession NM_014830) is another VGAM433 host target gene. KIAA0352 BINDING SITE is HOST TARGET binding site found in the 3' untranslated region of mRNA encoded by KIAA0352, corresponding to a HOST TARGET binding site such as BINDING SITE I, BINDING SITE II or BINDING SITE III. Table 2 illustrates the complementarity of the nucleotide sequences of KIAA0352 BINDING SITE, designated SEQ ID:16827, to the nucleotide sequence of VGAM433 RNA, herein designated VGAM RNA, also designated SEQ ID:3144.

Another function of VGAM433 is therefore inhibition of KIAA0352 (Accession NM_014830). Accordingly, utilities of VGAM433 include diagnosis, prevention and treatment of diseases and clinical conditions associated with KIAA0352. KIAA0757 (Accession NM_006038) is another VGAM433 host target gene. KIAA0757 BINDING SITE is HOST TARGET binding site found in the 3' untranslated region of mRNA encoded by KIAA0757, corresponding to a HOST TARGET binding site such as BINDING SITE I, BINDING SITE II or BINDING SITE III. Table 2 illustrates the complementarity of the nucleotide sequences of KIAA0757 BINDING SITE, designated SEQ ID:12672, to the nucleotide sequence of VGAM433 RNA, herein designated VGAM RNA, also designated SEQ ID:3144.

Another function of VGAM433 is therefore inhibition of KIAA0757 (Accession NM_006038). Accordingly, utilities of VGAM433 include diagnosis, prevention and treatment of diseases and clinical conditions associated with KIAA0757. KIAA1796 (Accession XM_166146) is another VGAM433 host target gene. KIAA1796 BINDING SITE is HOST TARGET binding site found in the 3' untranslated region of mRNA encoded by KIAA1796, corresponding to a HOST TARGET binding site such as BINDING SITE I, BINDING SITE II or BINDING SITE III. Table 2 illustrates the complementarity of the nucleotide sequences of KIAA1796 BINDING SITE, designated SEQ ID:43967, to the nucleotide sequence of VGAM433 RNA, herein designated VGAM RNA, also designated SEQ ID:3144.

Another function of VGAM433 is therefore inhibition of KIAA1796 (Accession XM_166146). Accordingly, utilities of VGAM433 include diagnosis, prevention and treatment of diseases and clinical conditions associated with KIAA1796. RNO2 (Accession NM_033297) is another VGAM433 host target gene. RNO2 BINDING SITE is HOST TARGET binding site found in the 5' untranslated region of mRNA encoded by RNO2, corresponding to a HOST TARGET binding site such as BINDING SITE I, BINDING SITE II or BINDING SITE III. Table 2 illustrates the complementarity of the nucleotide sequences of RNO2 BINDING SITE, designated SEQ ID:27127, to the nucleotide sequence of VGAM433 RNA, herein designated VGAM RNA, also designated SEQ ID:3144.

Another function of VGAM433 is therefore inhibition of RNO2 (Accession NM_033297). Accordingly, utilities of VGAM433 include diagnosis, prevention and treatment of diseases and clinical conditions associated with RNO2. Zinc Finger Protein 17 (HPF3, KOX 10) (ZNF17, Accession XM_091895) is another VGAM433 host target gene. ZNF17 BINDING SITE is HOST TARGET binding site found in the 3' untranslated region of mRNA encoded by ZNF17, corresponding to a HOST TARGET binding site such as BINDING SITE I, BINDING SITE II or BINDING SITE III. Table 2 illustrates the complementarity of the nucleotide sequences of ZNF17 BINDING SITE, designated SEQ ID:40066, to the nucleotide sequence of VGAM433 RNA, herein designated VGAM RNA, also designated SEQ ID:3144.

Another function of VGAM433 is therefore inhibition of Zinc Finger Protein 17 (HPF3, KOX 10) (ZNF17, Accession XM_091895). Accordingly, utilities of VGAM433 include diagnosis, prevention and treatment of diseases and clinical conditions associated with ZNF17. LOC145601 (Accession XM_096816) is another VGAM433 host target gene. LOC145601 BINDING SITE is HOST TARGET binding site found in the 3' untranslated region of mRNA encoded by LOC145601, corresponding to a HOST TARGET binding site such as BINDING SITE I, BINDING SITE II or BINDING SITE III. Table 2 illustrates the complementarity of the nucleotide sequences of LOC145601 BINDING SITE, designated SEQ ID:40540, to the nucleotide sequence of VGAM433 RNA, herein designated VGAM RNA, also designated SEQ ID:3144.

Another function of VGAM433 is therefore inhibition of LOC145601 (Accession XM_096816). Accordingly, utilities of VGAM433 include diagnosis, prevention and treatment of diseases and clinical conditions associated with LOC145601. LOC155340 (Accession XM_055725) is another VGAM433 host target gene. LOC155340 BINDING SITE is HOST TARGET binding site found in the 5' untranslated region of mRNA encoded by LOC155340, corresponding to a HOST TARGET binding site such as BINDING SITE I, BINDING SITE II or BINDING SITE III. Table 2 illustrates the complementarity of the nucleotide sequences of LOC155340 BINDING SITE, designated SEQ ID:36319, to the nucleotide sequence of VGAM433 RNA, herein designated VGAM RNA, also designated SEQ ID:3144.

Another function of VGAM433 is therefore inhibition of LOC155340 (Accession XM_055725). Accordingly, utilities of VGAM433 include diagnosis, prevention and treatment of diseases and clinical conditions associated with LOC155340. LOC256598 (Accession XM_172816) is another VGAM433 host target gene. LOC256598 BINDING SITE is HOST TARGET binding site found in the 5' untranslated region of mRNA encoded by LOC256598, corresponding to a HOST TARGET binding site such as BINDING SITE I, BINDING SITE II or BINDING SITE III. Table 2 illustrates the complementarity of the nucleotide sequences of LOC256598 BINDING SITE, designated SEQ ID:46099, to the nucleotide sequence of VGAM433 RNA, herein designated VGAM RNA, also designated SEQ ID:3144.

Another function of VGAM433 is therefore inhibition of LOC256598 (Accession XM_172816). Accordingly, utilities of VGAM433 include diagnosis, prevention and treatment of diseases and clinical conditions associated with LOC256598. LOC257463 (Accession XM_048605) is another VGAM433 host target gene. LOC257463 BINDING SITE is HOST TARGET binding site found in the 3' untranslated region of mRNA encoded by LOC257463, corresponding to a HOST TARGET binding site such as BINDING SITE I, BINDING SITE II or BINDING SITE III. Table 2 illustrates the complementarity of the nucleotide sequences of LOC257463 BINDING SITE, designated SEQ ID:35207, to the nucleotide sequence of VGAM433 RNA, herein designated VGAM RNA, also designated SEQ ID:3144.

Another function of VGAM433 is therefore inhibition of LOC257463 (Accession XM_048605). Accordingly, utilities of VGAM433 include diagnosis, prevention and treatment of diseases and clinical conditions associated with LOC257463. LOC83693 (Accession NM_031463) is another VGAM433 host target gene. LOC83693 BINDING SITE is HOST TARGET binding site found in the 3' untranslated region of mRNA encoded by LOC83693, corresponding to a HOST TARGET binding site such as BINDING SITE I, BINDING SITE II or BINDING SITE III. Table 2 illustrates the complementarity of the nucleotide sequences of LOC83693 BINDING SITE, designated SEQ ID:25497, to the nucleotide sequence of VGAM433 RNA, herein designated VGAM RNA, also designated SEQ ID:3144.

Another function of VGAM433 is therefore inhibition of LOC83693 (Accession NM_031463). Accordingly, utilities of VGAM433 include diagnosis, prevention and treatment of diseases and clinical conditions associated with LOC83693. FIG. 1 further provides a conceptual description of a novel bioinformatically detected viral gene of the present invention, referred to here as Viral Genomic Address Messenger 434 (VGAM434) viral gene, which modulates expression of respective host target genes thereof, the function and utility of which host target genes is known in the art.

VGAM434 is a novel bioinformatically detected regulatory, non protein coding, viral micro RNA (miRNA) gene. The method by which VGAM434 was detected is described hereinabove with reference to FIGS. 1-8.

VGAM434 gene, herein designated VGAM GENE, is a viral gene contained in the genome of Sendai Virus. VGAM434 host target gene, herein designated VGAM HOST TARGET GENE, is a human gene contained in the human genome.

VGAM434 gene encodes a VGAM434 precursor RNA, herein designated VGAM PRECURSOR RNA. Similar to other miRNA genes, and unlike most ordinary genes, VGAM434 precursor RNA does not encode a protein. A nucleotide sequence identical or highly similar to the nucleotide sequence of VGAM434 precursor RNA is designated SEQ ID:420, and is provided hereinbelow with reference to the sequence listing part. Nucleotide sequence SEQ ID:420 is located at position 14005 relative to the genome of Sendai Virus.

VGAM434 precursor RNA folds onto itself, forming VGAM434 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM434 folded precursor RNA into VGAM434 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM434 RNA is designated SEQ ID:3145, and is provided hereinbelow with reference to the sequence listing part.

VGAM434 host target gene, herein designated VGAM HOST TARGET GENE, encodes a corresponding messenger RNA, VGAM434 host target RNA, herein designated VGAM HOST TARGET RNA. VGAM434 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM434 RNA, herein designated VGAM RNA, binds complementarily to one or more host target binding sites located in untranslated regions of VGAM434 host target RNA, herein designated VGAM HOST TARGET RNA. This complementary binding is due to the fact that the nucleotide sequence of VGAM434 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM434 RNA, herein designated VGAM RNA, may have a different number of host target binding sites in untranslated regions of a VGAM434 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM434 RNA, herein designated VGAM RNA, to host target binding sites on VGAM434 host target RNA, herein designated VGAM HOST TARGET RNA, such as BINDING SITE I, BINDING SITE II and BINDING SITE III, inhibits translation of VGAM434 host target RNA into VGAM434 host target protein, herein designated VGAM HOST TARGET PROTEIN. VGAM host target protein is therefore outlined by a broken line.

It is appreciated that VGAM434 host target gene, herein designated VGAM HOST TARGET GENE, in fact represents a plurality of VGAM434 host target genes. The mRNA of each one of this plurality of VGAM434 host target genes comprises one or more host target binding sites, each having a nucleotide sequence which is at least partly complementary to VGAM434 RNA, herein designated VGAM RNA, and which when bound by VGAM434 RNA causes inhibition of translation of respective one or more VGAM434 host target proteins.

It is further appreciated by one skilled in the art that the mode of translational inhibition illustrated by FIG. 1 with specific reference to translational inhibition exerted by VGAM434 gene, herein designated VGAM GENE, on one or more VGAM434 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM434 is inhibition of expression of host target genes, as part of a novel viral mechanism of attacking a host. Accordingly, utilities of VGAM434 include diagnosis, prevention and treatment of viral infection by Sendai Virus. Specific functions, and accordingly utilities, of VGAM434 correlate with, and may be deduced from, the identity of the host target genes which VGAM434 binds and inhibits, and the function of these host target genes, as elaborated hereinbelow.

Nucleotide sequences of the VGAM434 precursor RNA, herein designated VGAM PRECURSOR RNA, and of the 'diced' VGAM434 RNA, herein designated VGAM RNA, and a schematic representation of the secondary folding of VGAM434 folded precursor RNA, herein designated VGAM FOLDED PRECURSOR RNA, of VGAM434 are further described hereinbelow with reference to Table 1.

Nucleotide sequences of host target binding sites, such as BINDING SITE-I, BINDING SITE-II and BINDING SITE-III of FIG. 1, found on VGAM434 host target RNA, and schematic representation of the complementarity of each of these host target binding sites to VGAM434 RNA, herein designated VGAM RNA, are described hereinbelow with reference to Table 2.

As mentioned hereinabove with reference to FIG. 1, a function of VGAM434 gene, herein designated VGAM is inhibition of expression of VGAM434 target genes. It is appreciated that specific functions, and accordingly utilities, of VGAM434 correlate with, and may be deduced from, the identity of the target genes which VGAM434 binds and inhibits, and the function of these target genes, as elaborated hereinbelow.

KIAA0441 (Accession NM_014797) is a VGAM434 host target gene. KIAA0441 BINDING SITE is HOST TARGET binding site found in the 3' untranslated region of mRNA encoded by KIAA0441, corresponding to a HOST TARGET binding site such as BINDING SITE I, BINDING SITE II or BINDING SITE III. Table 2 illustrates the complementarity of the nucleotide sequences of KIAA0441 BINDING SITE, designated SEQ ID:16712, to the nucleotide sequence of VGAM434 RNA, herein designated VGAM RNA, also designated SEQ ID:3145.

A function of VGAM434 is therefore inhibition of KIAA0441 (Accession NM_014797). Accordingly, utilities of VGAM434 include diagnosis, prevention and treatment of diseases and clinical conditions associated with KIAA0441. KIAA0555 (Accession NM_014790) is another VGAM434 host target gene. KIAA0555 BINDING SITE is HOST TARGET binding site found in the 3' untranslated region of mRNA encoded by KIAA0555, corresponding to a HOST TARGET binding site such as BINDING SITE I, BINDING SITE II or BINDING SITE III. Table 2 illustrates the complementarity of the nucleotide sequences of KIAA0555 BINDING SITE, designated SEQ ID:16679, to the nucleotide sequence of VGAM434 RNA, herein designated VGAM RNA, also designated SEQ ID:3145.

Another function of VGAM434 is therefore inhibition of KIAA0555 (Accession NM_014790). Accordingly, utilities of VGAM434 include diagnosis, prevention and treatment of diseases and clinical conditions associated with KIAA0555. Rab11-FIP2 (Accession NM_014904) is another VGAM434 host target gene. Rab11-FIP2 BINDING SITE is HOST TARGET binding site found in the 3' untranslated region of mRNA encoded by Rab11-FIP2, corresponding to a HOST TARGET binding site such as BINDING SITE I, BINDING SITE II or BINDING SITE III. Table 2 illustrates the complementarity of the nucleotide sequences of Rab11-FIP2 BINDING SITE, designated SEQ ID:17103, to the nucleotide sequence of VGAM434 RNA, herein designated VGAM RNA, also designated SEQ ID:3145.

Another function of VGAM434 is therefore inhibition of Rab11-FIP2 (Accession NM_014904). Accordingly, utilities of VGAM434 include diagnosis, prevention and treatment of diseases and clinical conditions associated with Rab11-FIP2. LOC152992 (Accession XM_087575) is another VGAM434 host target gene. LOC152992 BINDING SITE is HOST TARGET binding site found in the 3' untranslated region of mRNA encoded by LOC152992, corresponding to a HOST TARGET binding site such as BINDING SITE I, BINDING SITE II or BINDING SITE III. Table 2 illustrates the complementarity of the nucleotide sequences of LOC152992 BINDING SITE, designated SEQ ID:39348, to the nucleotide sequence of VGAM434 RNA, herein designated VGAM RNA, also designated SEQ ID:3145.

Another function of VGAM434 is therefore inhibition of LOC152992 (Accession XM_087575). Accordingly, utilities of VGAM434 include diagnosis, prevention and treatment of diseases and clinical conditions associated with LOC152992. LOC221830 (Accession XM_166508) is another VGAM434 host target gene. LOC221830 BINDING SITE is HOST TARGET binding site found in the 3' untranslated region of mRNA encoded by LOC221830, corresponding to a HOST TARGET binding site such as BINDING SITE I, BINDING SITE II or BINDING SITE III. Table 2 illustrates the complementarity of the nucleotide sequences of LOC221830 BINDING SITE, designated SEQ ID:44438, to the nucleotide sequence of VGAM434 RNA, herein designated VGAM RNA, also designated SEQ ID:3145.

Another function of VGAM434 is therefore inhibition of LOC221830 (Accession XM_166508). Accordingly, utilities of VGAM434 include diagnosis, prevention and treatment of diseases and clinical conditions associated with LOC221830. FIG. 1 further provides a conceptual description of a novel bioinformatically detected viral gene of the present invention, referred to here as Viral Genomic Address Messenger 435 (VGAM435) viral gene, which modulates expression of respective host target genes thereof, the function and utility of which host target genes is known in the art.

VGAM435 is a novel bioinformatically detected regulatory, non protein coding, viral micro RNA (miRNA) gene. The method by which VGAM435 was detected is described hereinabove with reference to FIGS. 1-8.

VGAM435 gene, herein designated VGAM GENE, is a viral gene contained in the genome of Sendai Virus. VGAM435 host target gene, herein designated VGAM HOST TARGET GENE, is a human gene contained in the human genome.

VGAM435 gene encodes a VGAM435 precursor RNA, herein designated VGAM PRECURSOR RNA. Similar to other miRNA genes, and unlike most ordinary genes, VGAM435 precursor RNA does not encode a protein. A nucleotide sequence identical or highly similar to the nucleotide sequence of VGAM435 precursor RNA is designated SEQ ID:421, and is provided hereinbelow with reference to the sequence listing part. Nucleotide sequence SEQ ID:421 is located at position 11483 relative to the genome of Sendai Virus.

VGAM435 precursor RNA folds onto itself, forming VGAM435 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM435 folded precursor RNA into VGAM435 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM435 RNA is designated SEQ ID:3146, and is provided hereinbelow with reference to the sequence listing part.

VGAM435 host target gene, herein designated VGAM HOST TARGET GENE, encodes a corresponding messenger RNA, VGAM435 host target RNA, herein designated VGAM HOST TARGET RNA. VGAM435 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM435 RNA, herein designated VGAM RNA, binds complementarily to one or more host target binding sites located in untranslated regions of VGAM435 host target RNA, herein designated VGAM HOST TARGET RNA. This complementary binding is due to the fact that the nucleotide sequence of VGAM435 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM435 RNA, herein designated VGAM RNA, may have a different number of host target binding sites in untranslated regions of a VGAM435 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM435 RNA, herein designated VGAM RNA, to host target binding sites on VGAM435 host target RNA, herein designated VGAM HOST TARGET RNA, such as BINDING SITE I, BINDING SITE II and BINDING SITE III, inhibits translation of VGAM435 host target RNA into VGAM435 host target protein, herein designated VGAM HOST TARGET PROTEIN. VGAM host target protein is therefore outlined by a broken line.

It is appreciated that VGAM435 host target gene, herein designated VGAM HOST TARGET GENE, in fact represents a plurality of VGAM435 host target genes. The mRNA of each one of this plurality of VGAM435 host target genes comprises one or more host target binding sites, each having a nucleotide sequence which is at least partly complementary to VGAM435 RNA, herein designated VGAM RNA, and which when bound by VGAM435 RNA causes inhibition of translation of respective one or more VGAM435 host target proteins.

It is further appreciated by one skilled in the art that the mode of translational inhibition illustrated by FIG. 1 with specific reference to translational inhibition exerted by VGAM435 gene, herein designated VGAM GENE, on one or more VGAM435 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM435 is inhibition of expression of host target genes, as part of a novel viral mechanism of attacking a host. Accordingly, utilities of VGAM435 include diagnosis, prevention and treatment of viral infection by Sendai Virus. Specific functions, and accordingly utilities, of VGAM435 correlate with, and may be deduced from, the identity of the host target genes which VGAM435 binds and inhibits, and the function of these host target genes, as elaborated hereinbelow.

Nucleotide sequences of the VGAM435 precursor RNA, herein designated VGAM PRECURSOR RNA, and of the 'diced' VGAM435 RNA, herein designated VGAM RNA, and a schematic representation of the secondary folding of VGAM435 folded precursor RNA, herein designated VGAM FOLDED PRECURSOR RNA, of VGAM435 are further described hereinbelow with reference to Table 1.

Nucleotide sequences of host target binding sites, such as BINDING SITE-I, BINDING SITE-II and BINDING SITE-III of FIG. 1, found on VGAM435 host target RNA, and schematic representation of the complementarity of each of these host target binding sites to VGAM435 RNA, herein designated VGAM RNA, are described hereinbelow with reference to Table 2.

As mentioned hereinabove with reference to FIG. 1, a function of VGAM435 gene, herein designated VGAM is inhibition of expression of VGAM435 target genes. It is appreciated that specific functions, and accordingly utilities, of VGAM435 correlate with, and may be deduced from, the identity of the target genes which VGAM435 binds and inhibits, and the function of these target genes, as elaborated hereinbelow.

Rho GDP Dissociation Inhibitor (GDI) Alpha (ARHGDIA, Accession NM_004309) is a VGAM435 host target gene. ARHGDIA BINDING SITE is HOST TARGET binding site found in the 3' untranslated region of mRNA encoded by ARHGDIA, corresponding to a HOST TARGET binding site such as BINDING SITE I, BINDING SITE II or BINDING SITE III. Table 2 illustrates the complementarity of the nucleotide sequences of ARHGDIA BINDING SITE, designated SEQ ID:10514, to the nucleotide sequence of VGAM435 RNA, herein designated VGAM RNA, also designated SEQ ID:3146.

A function of VGAM435 is therefore inhibition of Rho GDP Dissociation Inhibitor (GDI) Alpha (ARHGDIA, Accession NM_004309), a gene which is a small guanine nucleotide exchange (GTP/GDP) factor. Accordingly, utilities of VGAM435 include diagnosis, prevention and treatment of diseases and clinical conditions associated with ARHGDIA. The function of ARHGDIA has been established by previous studies. Ras-related homologs (ARHs), also called Rho genes, belong to the RAS gene superfamily encoding small guanine nucleotide exchange (GTP/GDP) factors. The ARH proteins may be kept in the inactive, GDP-bound state by interaction with GDP dissociation inhibitors (GDIAs). By screening a transformed amnion cell library with an ARHGDIB (OMIM Ref. No. 602843) cDNA, Leffers et al. (1993) isolated cDNAs encoding ARHGDIA. They found that ARHGDIA corresponded to a protein in the keratinocyte 2-dimensional-gel protein database known as IEF (isoelectric focusing) 8118. By 2-dimensional gel electrophoresis, the predicted 204-amino acid protein had a pI of 4.74 and migrated at 29 kD. The amino acid sequences of human and bovine ARHGDIA are 97% identical. Leffers et al. (1993) found that the ARHGDIA gene contains 6 exons. Northern blot analysis revealed that ARHGDIA was expressed in all cell lines and tissues tested. Overexpression of ARHGDIB in mammalian cells caused them to 'round up' and disrupted the actin cytoskeleton, mimicking the phenotypic changes associated with inactivation of Rho proteins. Wagner et al. (1997) demonstrated by fluorescence in situ hybridization that the GDIA1 gene maps to 17q25.3. The assignment was confirmed by the use of a new somatic cell hybrid panel for 17q.

Full details of the abovementioned studies are described in the following publications, the disclosure of which are hereby incorporated by reference:

Leffers, H.; Nielsen, M. S.; Andersen, A. H.; Honore, B.; Madsen, P.; Vandekerckhove, J.; Celis, J. E.: Identification of two human rho GDP dissociation inhibitor proteins whose overexpression leads to disruption of the actin cytoskeleton. Exp. Cell Res. 209:165-174, 1993; and Wagner, T.; Tommerup, N.; Wirth, J.; Leffers, H.; Zimmer, J.; Back, E.; Weissenbach, J.; Scherer, G.: A somatic cell hybrid panel for distal 17q: GDIA1 maps to 17q25.3. Cytogenet. Cell.

Further studies establishing the function and utilities of ARHGDIA are found in John Hopkins OMIM database record ID 601925, and in sited publications numbered 5814-5815 listed in the bibliography section hereinbelow, which are also hereby incorporated by reference. Corticotropin Releasing Hormone Receptor 1 (CRHR1, Accession NM_004382) is another VGAM435 host target gene. CRHR1 BINDING SITE is HOST TARGET binding site found in the 3' untranslated region of mRNA encoded by CRHR1, corresponding to a HOST TARGET binding site such as BINDING SITE I, BINDING SITE II or BINDING SITE III. Table 2 illustrates the complementarity of the nucleotide sequences of CRHR1 BINDING SITE, designated SEQ ID:10607, to the nucleotide sequence of VGAM435 RNA, herein designated VGAM RNA, also designated SEQ ID:3146.

Another function of VGAM435 is therefore inhibition of Corticotropin Releasing Hormone Receptor 1 (CRHR1, Accession NM_004382), a gene which likely mediates physiological and behavioral response to stress. Accordingly, utilities of VGAM435 include diagnosis, prevention and treatment of diseases and clinical conditions associated with CRHR1. The function of CRHR1 has been established by previous studies. Grammatopoulos et al. (1998) studied the expression of CRHR1 in human myometrium. They used RT-PCR, fluorescence in situ hybridization, and immunofluorescence to identify and localize the 4 subtypes, 1-alpha, 1-beta, 2-alpha, and the variant C, of CRHR1. The CRHR1 subtypes in myometrium exhibited differential expression patterns; in human pregnant myometrium at term, all 4 receptor subtypes were expressed, whereas only the 1-alpha and 1-beta receptor subtypes were found in the nonpregnant myometrium. The authors concluded that CRHR1 acting via different receptor subtypes is able to exert different actions on the myometrium in the pregnant state compared to the nonpregnant state. Furthermore, in the pregnant human uterus, receptors were localized in both smooth muscle and fibroblasts, suggesting that CRHR1 expression plays an important modulatory role in myometrial and possibly in cervical function Leproult et al. (2001) examined the effects of bright light on the profiles of hormones known to be affected by sleep deprivation (TSH; OMIM Ref. No. 188540) or involved in behavioral activation (cortisol). The early morning transition from dim to bright light suppressed melatonin secretion, induced an immediate, greater than 50% elevation of cortisol levels, and limited the deterioration of alertness normally associated with overnight sleep deprivation. No effect was detected on TSH profiles. The authors concluded that these data unambiguously demonstrate an effect of light on the corticotropic axis that is dependent on time of day Animal model experiments lend further support to the function of CRHR1. Sillaber et al. (2002) studied Crhr1 -/- mice generated by Timpl et al. (1998). In homozygous mutant mice, stress leads to enhanced and progressively increasing alcohol intake. The effect of repeated stress on alcohol drinking behavior appeared with a delay and persisted throughout life. It was associated with an upregulation of the N-methyl-D-aspartate receptor subunit NR2B (OMIM Ref. No. 138252). Sillaber et al. (2002) concluded that alterations in the CRHR1 gene and adaptional changes in NR2B subunits may constitute a genetic risk factor for stress-induced alcohol drinking and alcoholism It is appreciated that the abovementioned animal model for CRHR1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Leproult, R.; Colecchia, E. F.; L'Hermite-Baleriaux, M.; Van Cauter, E.: Transition from dim to bright light in the morning induces an immediate elevation of cortisol levels. J. Clin. Endocr. Metab. 86:151-157, 2001; and Sillaber, I.; Rammes, G.; Zimmermann, S.; Mahal, B.; Zieglgansberger, W.; Wurst, W.; Holsboer, F.; Spanagel, R.: Enhanced and delayed stress-induced alcohol drinking in mice lacking fu.

Further studies establishing the function and utilities of CRHR1 are found in John Hopkins OMIM database record ID 122561, and in sited publications numbered 2034-1988, 264 and 2660-2663 listed in the bibliography section hereinbelow, which are also hereby incorporated by reference. C-myc Binding Protein (MYCBP, Accession NM_012333) is another VGAM435 host target gene. MYCBP BINDING SITE is HOST TARGET binding site found in the 3' untranslated region of mRNA encoded by MYCBP, corresponding to a HOST TARGET binding site such as BINDING SITE I, BINDING SITE II or BINDING SITE III. Table 2 illustrates the complementarity of the nucleotide sequences of MYCBP BINDING SITE, designated SEQ ID:14723, to the nucleotide sequence of VGAM435 RNA, herein designated VGAM RNA, also designated SEQ ID:3146.

Another function of VGAM435 is therefore inhibition of C-myc Binding Protein (MYCBP, Accession NM_012333), a gene which binds c-Myc stimulating the activation of E-boxdependent transcription. Accordingly, utilities of VGAM435 include diagnosis, prevention and treatment of diseases and clinical conditions associated with MYCBP. The function of MYCBP has been established by previous studies. To assess the molecular function of MYC-binding protein, Furusawa et al. (2001) performed a 2-hybrid screening of cDNAs encoding AMY1-binding proteins, with AMY1 as a bait using a human HeLa cDNA library. They found a clone encoding AKAP149 (AKAP1; 602449). AMY1 was found to bind in vitro and in vivo to the regulatory subunit II-binding region of AKAP1 and S-AKAP84, a splicing variant of AKAP149 expressed in the testis. AMY1 was expressed postmeiotically in the testis, as was also S-AKAP84. AMY1 was localized in the mitochondria of HeLa and sperm in association with AKAP149 and S-AKAP84, respectively. These results suggested that AMY1 plays a role in spermatogenesis.

Full details of the abovementioned studies are described in the following publications, the disclosure of which are hereby incorporated by reference:

Furusawa, M.; Ohnishi, T.; Taira, T.; Iguchi-Ariga, S. M. M.; Ariga, H.: AMY-1, a c-Myc-binding protein, is localized in the mitochondria of sperm by association with S-AKAP84, an anchor protein of cAMP-dependent protein kinase. J. Biol. Chem. 276:36647-36651, 2001; and Taira, T.; Maeda, J.; Onishi, T.; Kitaura, H.; Yoshida, S.; Kato, H.; Ikeda, M.; Tamai, K.; Iguchi-Ariga, S. M. M.; Ariga, H.: AMY-1, a novel C-MYC binding protein that stimulates tra.

Further studies establishing the function and utilities of MYCBP are found in John Hopkins OMIM database record ID 606535, and in sited publications numbered 6466-6467 listed in the bibliography section hereinbelow, which are also hereby incorporated by reference. Protein Phosphatase 2A, Regulatory Subunit B' (PR 53) (PPP2R4, Accession XM_026944) is another VGAM435 host target gene. PPP2R4 BINDING SITE is HOST TARGET binding site found in the 3' untranslated region of mRNA encoded by PPP2R4, corresponding to a HOST TARGET binding site such as BINDING SITE I, BINDING SITE II or BINDING SITE III. Table 2 illustrates the complementarity of the nucleotide sequences of PPP2R4 BINDING SITE, designated SEQ ID:30374, to the nucleotide sequence of VGAM435 RNA, herein designated VGAM RNA, also designated SEQ ID:3146.

Another function of VGAM435 is therefore inhibition of Protein Phosphatase 2A, Regulatory Subunit B' (PR 53) (PPP2R4, Accession XM_026944), a gene which is a regulatory subunit of protein phosphatase 2A. Accordingly, utilities of VGAM435 include diagnosis, prevention and treatment of diseases and clinical conditions associated with PPP2R4. The function of PPP2R4 has been established by previous studies. McCright et al. (1996) stated that PP2A contains a 36-kD catalytic C subunit (OMIM Ref. No. 176915) and a 65-kD structural/regulatory A subunit. Association of this dimeric core of PP2A with a third regulatory subunit (PR54, PR55, PR72, PR74, PR130, etc.) results in the formation of a specific trimeric holoenzyme. The PPP2R4 gene (which the authors symbolized PTPA) encodes a specific phosphotyrosyl phosphatase activator of the dimeric form of protein phosphatase 2A. Van Hoof et al. (1995) demonstrated that human PTPA is encoded by a single-copy gene composed of 10 exons and 9 introns with a total length of about 60 kb. The 5-prime flanking sequence of the transcription start site was analyzed for its potential as a promoter. This region lacks a TATA sequence in the appropriate position relative to the transcription start. However, this region is very GC-rich and contains four Sp1 sites (SP1; 189906) upstream of the transcription start site, a feature common to many TATA-less promoters. Based on homology with DNA-binding consensus sequences of transcription factors, Van Hoof et al. (1995) identified several additional putative transcription factor binding sites in the promoter region. Transfection experiments with a construct containing the PTPA promoter region inserted 5-prime of a luciferase reporter gene demonstrated that the 5-prime flanking sequence of the PTPA gene indeed has promoter activity that seems to be cell-line dependent. By fluorescence in situ hybridization, Van Hoof et al. (1995) mapped the PTPA gene to 9q34. Fluorescence in situ analysis of metaphase chromosomes of patients bearing the Philadelphia chromosome indicated that PTPA is positioned centromeric of ABL1 (OMIM Ref. No. 189980) and probably is not involved in chronic myeloid leukemia.

Full details of the abovementioned studies are described in the following publications, the disclosure of which are hereby incorporated by reference:

McCright, B.; Rivers, A. M.; Audlin, S.; Virshup, D. M.: The B56 family of protein phosphatase 2A (PP2A) regulatory subunits encodes differentiation-induced phosphoproteins that target PP2A to both nucleus and cytoplasm. J. Biol. Chem. 271:22081-22089, 1996; and Van Hoof, C.; Aly, M. S.; Garcia, A.; Cayla, X.; Cassiman, J. J.; Merlevede, W.; Goris, J.: Structure and chromosomal localization of the human gene of the phosphotyrosyl phosphatase a.

Further studies establishing the function and utilities of PPP2R4 are found in John Hopkins OMIM database record ID 600756, and in sited publications numbered 8305-8306 listed in the bibliography section hereinbelow, which are also hereby incorporated by reference. Chromosome 5 Open Reading Frame 4 (C5orf4, Accession NM_032385) is another VGAM435 host target gene. C5orf4 BINDING SITE is HOST TARGET binding site found in the 3' untranslated region of mRNA encoded by C5orf4, corresponding to a HOST TARGET binding site such as BINDING SITE I, BINDING SITE II or BINDING SITE III. Table 2 illustrates the complementarity of the nucleotide sequences of C5orf4 BINDING SITE, designated SEQ ID:26179, to the nucleotide sequence of VGAM435 RNA, herein designated VGAM RNA, also designated SEQ ID:3146.

Another function of VGAM435 is therefore inhibition of Chromosome 5 Open Reading Frame 4 (C5orf4, Accession NM_032385). Accordingly, utilities of VGAM435 include diagnosis, prevention and treatment of diseases and clinical conditions associated with C5orf4. Dynein, Axonemal, Light Polypeptide 4 (DNAL4, Accession NM_005740) is another VGAM435 host target gene. DNAL4 BINDING SITE is HOST TARGET binding site found in the 3' untranslated region of mRNA encoded by DNAL4, corresponding to a HOST TARGET binding site such as BINDING SITE I, BINDING SITE II or BINDING SITE III. Table 2 illustrates the complementarity of the nucleotide sequences of DNAL4 BINDING SITE, designated SEQ ID:12306, to the nucleotide sequence of VGAM435 RNA, herein designated VGAM RNA, also designated SEQ ID:3146.

Another function of VGAM435 is therefore inhibition of Dynein, Axonemal, Light Polypeptide 4 (DNAL4, Accession NM_005740). Accordingly, utilities of VGAM435 include diagnosis, prevention and treatment of diseases and clinical conditions associated with DNAL4. Huntingtin-associated Protein Interacting Protein (duo) (HAPIP, Accession NM_003947) is another VGAM435 host target gene. HAPIP BINDING SITE is HOST TARGET binding site found in the 3' untranslated region of mRNA encoded by HAPIP, corresponding to a HOST TARGET binding site such as BIND- ING SITE I, BINDING SITE II or BINDING SITE III. Table 2 illustrates the complementarity of the nucleotide sequences of HAPIP BINDING SITE, designated SEQ ID:10067, to the nucleotide sequence of VGAM435 RNA, herein designated VGAM RNA, also designated SEQ ID:3146.

Another function of VGAM435 is therefore inhibition of Huntingtin-associated Protein Interacting Protein (duo) (HAPIP, Accession NM_003947). Accordingly, utilities of VGAM435 include diagnosis, prevention and treatment of diseases and clinical conditions associated with HAPIP. MGC15416 (Accession NM_138418) is another VGAM435 host target gene. MGC15416 BINDING SITE is HOST TARGET binding site found in the 3' untranslated region of mRNA encoded by MGC15416, corresponding to a HOST TARGET binding site such as BINDING SITE I, BINDING SITE II or BINDING SITE III. Table 2 illustrates the complementarity of the nucleotide sequences of MGC15416 BINDING SITE, designated SEQ ID:28787, to the nucleotide sequence of VGAM435 RNA, herein designated VGAM RNA, also designated SEQ ID:3146.

Another function of VGAM435 is therefore inhibition of MGC15416 (Accession NM_138418). Accordingly, utilities of VGAM435 include diagnosis, prevention and treatment of diseases and clinical conditions associated with MGC15416. Solute Carrier Family 25, (mitochondrial carrier), Member 18 (SLC25A18, Accession NM_031481) is another VGAM435 host target gene. SLC25A18 BINDING SITE is HOST TARGET binding site found in the 3' untranslated region of mRNA encoded by SLC25A18, corresponding to a HOST TARGET binding site such as BINDING SITE I, BINDING SITE II or BINDING SITE III. Table 2 illustrates the complementarity of the nucleotide sequences of SLC25A18 BINDING SITE, designated SEQ ID:25561, to the nucleotide sequence of VGAM435 RNA, herein designated VGAM RNA, also designated SEQ ID:3146.

Another function of VGAM435 is therefore inhibition of Solute Carrier Family 25, (mitochondrial carrier), Member 18 (SLC25A18, Accession NM_031481). Accordingly, utilities of VGAM435 include diagnosis, prevention and treatment of diseases and clinical conditions associated with SLC25A18. Solute Carrier Family 39 (zinc transporter), Member 3 (SLC39A3, Accession NM_144564) is another VGAM435 host target gene. SLC39A3 BINDING SITE is HOST TARGET binding site found in the 3' untranslated region of mRNA encoded by SLC39A3, corresponding to a HOST TARGET binding site such as BINDING SITE I, BINDING SITE II or BINDING SITE III. Table 2 illustrates the complementarity of the nucleotide sequences of SLC39A3 BINDING SITE, designated SEQ ID:29356, to the nucleotide sequence of VGAM435 RNA, herein designated VGAM RNA, also designated SEQ ID:3146.

Another function of VGAM435 is therefore inhibition of Solute Carrier Family 39 (zinc transporter), Member 3 (SLC39A3, Accession NM_144564). Accordingly, utilities of VGAM435 include diagnosis, prevention and treatment of diseases and clinical conditions associated with SLC39A3. LOC127534 (Accession XM_060532) is another VGAM435 host target gene. LOC127534 BINDING SITE is HOST TARGET binding site found in the 3' untranslated region of mRNA encoded by LOC127534, corresponding to a HOST TARGET binding site such as BINDING SITE I, BINDING SITE II or BINDING SITE III. Table 2 illustrates the complementarity of the nucleotide sequences of LOC127534 BINDING SITE, designated SEQ ID:37165, to the nucleotide sequence of VGAM435 RNA, herein designated VGAM RNA, also designated SEQ ID:3146.

Another function of VGAM435 is therefore inhibition of LOC127534 (Accession XM_060532). Accordingly, utilities of VGAM435 include diagnosis, prevention and treatment of diseases and clinical conditions associated with LOC127534. LOC132617 (Accession XM_067939) is another VGAM435 host target gene. LOC132617 BINDING SITE is HOST TARGET binding site found in the 5' untranslated region of mRNA encoded by LOC132617, corresponding to a HOST TARGET binding site such as BINDING SITE I, BINDING SITE II or BINDING SITE III. Table 2 illustrates the complementarity of the nucleotide sequences of LOC132617 BINDING SITE, designated SEQ ID:37370, to the nucleotide sequence of VGAM435 RNA, herein designated VGAM RNA, also designated SEQ ID:3146.

Another function of VGAM435 is therefore inhibition of LOC132617 (Accession XM_067939). Accordingly, utilities of VGAM435 include diagnosis, prevention and treatment of diseases and clinical conditions associated with LOC132617. LOC91040 (Accession XM_035641) is another VGAM435 host target gene. LOC91040 BINDING SITE is HOST TARGET binding site found in the 5' untranslated region of mRNA encoded by LOC91040, corresponding to a HOST TARGET binding site such as BINDING SITE I, BINDING SITE II or BINDING SITE III. Table 2 illustrates the complementarity of the nucleotide sequences of LOC91040 BINDING SITE, designated SEQ ID:32314, to the nucleotide sequence of VGAM435 RNA, herein designated VGAM RNA, also designated SEQ ID:3146.

Another function of VGAM435 is therefore inhibition of LOC91040 (Accession XM_035641). Accordingly, utilities of VGAM435 include diagnosis, prevention and treatment of diseases and clinical conditions associated with LOC91040. FIG. 1 further provides a conceptual description of a novel bioinformatically detected viral gene of the present invention, referred to here as Viral Genomic Address Messenger 436 (VGAM436) viral gene, which modulates expression of respective host target genes thereof, the function and utility of which host target genes is known in the art.

VGAM436 is a novel bioinformatically detected regulatory, non protein coding, viral micro RNA (miRNA) gene. The method by which VGAM436 was detected is described hereinabove with reference to FIGS. 1-8.

VGAM436 gene, herein designated VGAM GENE, is a viral gene contained in the genome of Sendai Virus. VGAM436 host target gene, herein designated VGAM HOST TARGET GENE, is a human gene contained in the human genome.

VGAM436 gene encodes a VGAM436 precursor RNA, herein designated VGAM PRECURSOR RNA. Similar to other miRNA genes, and unlike most ordinary genes, VGAM436 precursor RNA does not encode a protein. A nucleotide sequence identical or highly similar to the nucleotide sequence of VGAM436 precursor RNA is designated SEQ ID:422, and is provided hereinbelow with reference to the sequence listing part. Nucleotide sequence SEQ ID:422 is located at position 14126 relative to the genome of Sendai Virus.

VGAM436 precursor RNA folds onto itself, forming VGAM436 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM436 folded precursor RNA into VGAM436 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM436 RNA is designated SEQ ID:3147, and is provided hereinbelow with reference to the sequence listing part.

VGAM436 host target gene, herein designated VGAM HOST TARGET GENE, encodes a corresponding messenger RNA, VGAM436 host target RNA, herein designated VGAM HOST TARGET RNA. VGAM436 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM436 RNA, herein designated VGAM RNA, binds complementarily to one or more host target binding sites located in untranslated regions of VGAM436 host target RNA, herein designated VGAM HOST TARGET RNA. This complementary binding is due to the fact that the nucleotide sequence of VGAM436 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM436 RNA, herein designated VGAM RNA, may have a different number of host target binding sites in untranslated regions of a VGAM436 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM436 RNA, herein designated VGAM RNA, to host target binding sites on VGAM436 host target RNA, herein designated VGAM HOST TARGET RNA, such as BINDING SITE I, BINDING SITE II and BINDING SITE III, inhibits translation of VGAM436 host target RNA into VGAM436 host target protein, herein designated VGAM HOST TARGET PROTEIN. VGAM host target protein is therefore outlined by a broken line.

It is appreciated that VGAM436 host target gene, herein designated VGAM HOST TARGET GENE, in fact represents a plurality of VGAM436 host target genes. The mRNA of each one of this plurality of VGAM436 host target genes comprises one or more host target binding sites, each having a nucleotide sequence which is at least partly complementary to VGAM436 RNA, herein designated VGAM RNA, and which when bound by VGAM436 RNA causes inhibition of translation of respective one or more VGAM436 host target proteins.

It is further appreciated by one skilled in the art that the mode of translational inhibition illustrated by FIG. 1 with specific reference to translational inhibition exerted by VGAM436 gene, herein designated VGAM GENE, on one or more VGAM436 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM436 is inhibition of expression of host target genes, as part of a novel viral mechanism of attacking a host. Accordingly, utilities of VGAM436 include diagnosis, prevention and treatment of viral infection by Sendai Virus. Specific functions, and accordingly utilities, of VGAM436 correlate with, and may be deduced from, the identity of the host target genes which VGAM436 binds and inhibits, and the function of these host target genes, as elaborated hereinbelow.

Nucleotide sequences of the VGAM436 precursor RNA, herein designated VGAM PRECURSOR RNA, and of the 'diced' VGAM436 RNA, herein designated VGAM RNA, and a schematic representation of the secondary folding of VGAM436 folded precursor RNA, herein designated VGAM FOLDED PRECURSOR RNA, of VGAM436 are further described hereinbelow with reference to Table 1.

Nucleotide sequences of host target binding sites, such as BINDING SITE-I, BINDING SITE-II and BINDING SITE-III of FIG. 1, found on VGAM436 host target RNA, and schematic representation of the complementarity of each of these host target binding sites to VGAM436 RNA, herein designated VGAM RNA, are described hereinbelow with reference to Table 2.

As mentioned hereinabove with reference to FIG. 1, a function of VGAM436 gene, herein designated VGAM is inhibition of expression of VGAM436 target genes. It is appreciated that specific functions, and accordingly utilities, of VGAM436 correlate with, and may be deduced from, the identity of the target genes which VGAM436 binds and inhibits, and the function of these target genes, as elaborated hereinbelow.

PAG (Accession NM_018440) is a VGAM436 host target gene. PAG BINDING SITE is HOST TARGET binding site found in the 3' untranslated region of mRNA encoded by PAG, corresponding to a HOST TARGET binding site such as BINDING SITE I, BINDING SITE II or BINDING SITE III. Table 2 illustrates the complementarity of the nucleotide sequences of PAG BINDING SITE, designated SEQ ID:20508, to the nucleotide sequence of VGAM436 RNA, herein designated VGAM RNA, also designated SEQ ID:3147.

A function of VGAM436 is therefore inhibition of PAG (Accession NM_018440). Accordingly, utilities of VGAM436 include diagnosis, prevention and treatment of diseases and clinical conditions associated with PAG. Chromosome 20 Open Reading Frame 50 (C20orf50, Accession XM_046437) is another VGAM436 host target gene. C20orf50 BINDING SITE is HOST TARGET binding site found in the 5' untranslated region of mRNA encoded by C20orf50, corresponding to a HOST TARGET binding site such as BINDING SITE I, BINDING SITE II or BINDING SITE III. Table 2 illustrates the complementarity of the nucleotide sequences of C20orf50 BINDING SITE, designated SEQ ID:34717, to the nucleotide sequence of VGAM436 RNA, herein designated VGAM RNA, also designated SEQ ID:3147.

Another function of VGAM436 is therefore inhibition of Chromosome 20 Open Reading Frame 50 (C20orf50, Accession XM_046437). Accordingly, utilities of VGAM436 include diagnosis, prevention and treatment of diseases and clinical conditions associated with C20orf50. KIAA1336 (Accession XM_051306) is another VGAM436 host target gene. KIAA1336 BINDING SITE is HOST TARGET binding site found in the 3' untranslated region of mRNA encoded by KIAA1336, corresponding to a HOST TARGET binding site such as BINDING SITE I, BINDING SITE II or BINDING SITE III. Table 2 illustrates the complementarity of the nucleotide sequences of KIAA1336 BINDING SITE, designated SEQ ID:35802, to the nucleotide sequence of VGAM436 RNA, herein designated VGAM RNA, also designated SEQ ID:3147.

Another function of VGAM436 is therefore inhibition of KIAA1336 (Accession XM_051306). Accordingly, utilities of VGAM436 include diagnosis, prevention and treatment of diseases and clinical conditions associated with KIAA1336. PR Domain Containing 10 (PRDM10, Accession NM_020228) is another VGAM436 host target gene. PRDM10 BINDING SITE is HOST TARGET binding site found in the 3' untranslated region of mRNA encoded by PRDM10, corresponding to a HOST TARGET binding site such as BINDING SITE I, BINDING SITE II or BINDING SITE III. Table 2 illustrates the complementarity of the nucleotide sequences of PRDM10 BINDING SITE, designated SEQ ID:21498, to the nucleotide sequence of VGAM436 RNA, herein designated VGAM RNA, also designated SEQ ID:3147.

Another function of VGAM436 is therefore inhibition of PR Domain Containing 10 (PRDM10, Accession NM_020228). Accordingly, utilities of VGAM436 include diagnosis, prevention and treatment of diseases and clinical conditions associated with PRDM10. Tuftelin Interacting Protein 11 (TFIP11, Accession NM_012143) is another VGAM436 host target gene. TFIP11 BINDING SITE is HOST TARGET binding site found in the 3' untranslated region of mRNA encoded by TFIP11, corresponding to a HOST TARGET binding site such as BINDING SITE I, BINDING SITE II or BINDING SITE III. Table 2 illustrates the complementarity of the nucleotide sequences of TFIP11 BINDING SITE, designated SEQ ID:14450, to the nucleotide sequence of VGAM436 RNA, herein designated VGAM RNA, also designated SEQ ID:3147.

Another function of VGAM436 is therefore inhibition of Tuftelin Interacting Protein 11 (TFIP11, Accession NM_012143). Accordingly, utilities of VGAM436 include diagnosis, prevention and treatment of diseases and clinical conditions associated with TFIP11. LOC158364 (Accession XM_088546) is another VGAM436 host target gene. LOC158364 BINDING SITE is HOST TARGET binding site found in the 5' untranslated region of mRNA encoded by LOC158364, corresponding to a HOST TARGET binding site such as BINDING SITE I, BINDING SITE II or BINDING SITE III. Table 2 illustrates the complementarity of the nucleotide sequences of LOC158364 BINDING SITE, designated SEQ ID:39814, to the nucleotide sequence of VGAM436 RNA, herein designated VGAM RNA, also designated SEQ ID:3147.

Another function of VGAM436 is therefore inhibition of LOC158364 (Accession XM_088546). Accordingly, utilities of VGAM436 include diagnosis, prevention and treatment of diseases and clinical conditions associated with LOC158364. LOC253613 (Accession XM_171225) is another VGAM436 host target gene. LOC253613 BINDING SITE is HOST TARGET binding site found in the 5' untranslated region of mRNA encoded by LOC253613, corresponding to a HOST TARGET binding site such as BINDING SITE I, BINDING SITE II or BINDING SITE III. Table 2 illustrates the complementarity of the nucleotide sequences of LOC253613 BINDING SITE, designated SEQ ID:46010, to the nucleotide sequence of VGAM436 RNA, herein designated VGAM RNA, also designated SEQ ID:3147.

Another function of VGAM436 is therefore inhibition of LOC253613 (Accession XM_171225). Accordingly, utilities of VGAM436 include diagnosis, prevention and treatment of diseases and clinical conditions associated with LOC253613. FIG. 1 further provides a conceptual description of a novel bioinformatically detected viral gene of the present invention, referred to here as Viral Genomic Address Messenger 437 (VGAM437) viral gene, which modulates expression of respective host target genes thereof, the function and utility of which host target genes is known in the art.

VGAM437 is a novel bioinformatically detected regulatory, non protein coding, viral micro RNA (miRNA) gene. The method by which VGAM437 was detected is described hereinabove with reference to FIGS. 1-8.

VGAM437 gene, herein designated VGAM GENE, is a viral gene contained in the genome of Tomato Bushy Stunt Virus. VGAM437 host target gene, herein designated VGAM HOST TARGET GENE, is a human gene contained in the human genome.

VGAM437 gene encodes a VGAM437 precursor RNA, herein designated VGAM PRECURSOR RNA. Similar to other miRNA genes, and unlike most ordinary genes, VGAM437 precursor RNA does not encode a protein. A nucleotide sequence identical or highly similar to the nucleotide sequence of VGAM437 precursor RNA is designated SEQ ID:423, and is provided hereinbelow with reference to the sequence listing part. Nucleotide sequence SEQ ID:423 is located at position 3049 relative to the genome of Tomato Bushy Stunt Virus.

VGAM437 precursor RNA folds onto itself, forming VGAM437 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM437 folded precursor RNA into VGAM437 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM437 RNA is designated SEQ ID:3148, and is provided hereinbelow with reference to the sequence listing part.

VGAM437 host target gene, herein designated VGAM HOST TARGET GENE, encodes a corresponding messenger RNA, VGAM437 host target RNA, herein designated VGAM HOST TARGET RNA. VGAM437 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM437 RNA, herein designated VGAM RNA, binds complementarily to one or more host target binding sites located in untranslated regions of VGAM437 host target RNA, herein designated VGAM HOST TARGET RNA. This complementary binding is due to the fact that the nucleotide sequence of VGAM437 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM437 RNA, herein designated VGAM RNA, may have a different number of host target binding sites in untranslated regions of a VGAM437 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM437 RNA, herein designated VGAM RNA, to host target binding sites on VGAM437 host target RNA, herein designated VGAM HOST TARGET RNA, such as BINDING SITE I, BINDING SITE II and BINDING SITE III, inhibits translation of VGAM437 host target RNA into VGAM437 host target protein, herein designated VGAM HOST TARGET PROTEIN. VGAM host target protein is therefore outlined by a broken line.

It is appreciated that VGAM437 host target gene, herein designated VGAM HOST TARGET GENE, in fact represents a plurality of VGAM437 host target genes. The mRNA of each one of this plurality of VGAM437 host target genes comprises one or more host target binding sites, each having a nucleotide sequence which is at least partly complementary to VGAM437 RNA, herein designated VGAM RNA, and which when bound by VGAM437 RNA causes inhibition of translation of respective one or more VGAM437 host target proteins.

It is further appreciated by one skilled in the art that the mode of translational inhibition illustrated by FIG. 1 with specific reference to translational inhibition exerted by VGAM437 gene, herein designated VGAM GENE, on one or more VGAM437 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM437 is inhibition of expression of host target genes, as part of a novel viral mechanism of attacking a host. Accordingly, utilities of VGAM437 include diagnosis, prevention and treatment of viral infection by Tomato Bushy Stunt Virus. Specific functions, and accordingly utilities, of VGAM437 correlate with, and may be deduced from, the identity of the host target genes which VGAM437 binds and inhibits, and the function of these host target genes, as elaborated hereinbelow.

Nucleotide sequences of the VGAM437 precursor RNA, herein designated VGAM PRECURSOR RNA, and of the 'diced' VGAM437 RNA, herein designated VGAM RNA, and a schematic representation of the secondary folding of VGAM437 folded precursor RNA, herein designated VGAM FOLDED PRECURSOR RNA, of VGAM437 are further described hereinbelow with reference to Table 1.

Nucleotide sequences of host target binding sites, such as BINDING SITE-I, BINDING SITE-II and BINDING SITE-III of FIG. 1, found on VGAM437 host target RNA, and schematic representation of the complementarity of each of these host target binding sites to VGAM437 RNA, herein designated VGAM RNA, are described hereinbelow with reference to Table 2.

As mentioned hereinabove with reference to FIG. 1, a function of VGAM437 gene, herein designated VGAM is inhibition of expression of VGAM437 target genes. It is appreciated that specific functions, and accordingly utilities, of VGAM437 correlate with, and may be deduced from, the identity of the target genes which VGAM437 binds and inhibits, and the function of these target genes, as elaborated hereinbelow.

Sulfotransferase Family, Cytosolic, 1C, Member 1 (SULT1C1, Accession NM_001056) is a VGAM437 host target gene. SULT1C1 BINDING SITE is HOST TARGET binding site found in the 3' untranslated region of mRNA encoded by SULT1C1, corresponding to a HOST TARGET binding site such as BINDING SITE I, BINDING SITE II or BINDING SITE III. Table 2 illustrates the complementarity of the nucleotide sequences of SULT1C1 BINDING SITE, designated SEQ ID:6721, to the nucleotide sequence of VGAM437 RNA, herein designated VGAM RNA, also designated SEQ ID:3148.

A function of VGAM437 is therefore inhibition of Sulfotransferase Family, Cytosolic, 1C, Member 1 (SULT1C1, Accession NM_001056). Accordingly, utilities of VGAM437 include diagnosis, prevention and treatment of diseases and clinical conditions associated with SULT1C1. HRIHFB2436 (Accession NM_014345) is another VGAM437 host target gene. HRIHFB2436 BINDING SITE is HOST TARGET binding site found in the 5' untranslated region of mRNA encoded by HRIHFB2436, corresponding to a HOST TARGET binding site such as BINDING SITE I, BINDING SITE II or BINDING SITE III. Table 2 illustrates the complementarity of the nucleotide sequences of HRIHFB2436 BINDING SITE, designated SEQ ID:15667, to the nucleotide sequence of VGAM437 RNA, herein designated VGAM RNA, also designated SEQ ID:3148.

Another function of VGAM437 is therefore inhibition of HRIHFB2436 (Accession NM_014345). Accordingly, utilities of VGAM437 include diagnosis, prevention and treatment of diseases and clinical conditions associated with HRIHFB2436. LOC139065 (Accession XM_066456) is another VGAM437 host target gene. LOC139065 BINDING SITE is HOST TARGET binding site found in the 5' untranslated region of mRNA encoded by LOC139065, corresponding to a HOST TARGET binding site such as BINDING SITE I, BINDING SITE II or BINDING SITE III. Table 2 illustrates the complementarity of the nucleotide sequences of LOC139065 BINDING SITE, designated SEQ ID:37327, to the nucleotide sequence of VGAM437 RNA, herein designated VGAM RNA, also designated SEQ ID:3148.

Another function of VGAM437 is therefore inhibition of LOC139065 (Accession XM_066456). Accordingly, utilities of VGAM437 include diagnosis, prevention and treatment of diseases and clinical conditions associated with LOC139065. LOC151584 (Accession XM_098089) is another VGAM437 host target gene. LOC151584 BINDING SITE is HOST TARGET binding site found in the 3' untranslated region of mRNA encoded by LOC151584, corresponding to a HOST TARGET binding site such as BINDING SITE I, BINDING SITE II or BINDING SITE III. Table 2 illustrates the complementarity of the nucleotide sequences of LOC151584 BINDING SITE, designated SEQ ID:41375, to the nucleotide sequence of VGAM437 RNA, herein designated VGAM RNA, also designated SEQ ID:3148.

Another function of VGAM437 is therefore inhibition of LOC151584 (Accession XM_098089). Accordingly, utilities of VGAM437 include diagnosis, prevention and treatment of diseases and clinical conditions associated with LOC151584. LOC222166 (Accession XM_168425) is another VGAM437 host target gene. LOC222166 BINDING SITE is HOST TARGET binding site found in the 3' untranslated region of mRNA encoded by LOC222166, corresponding to a HOST TARGET binding site such as BINDING SITE I, BINDING SITE II or BINDING SITE III. Table 2 illustrates the complementarity of the nucleotide sequences of LOC222166 BINDING SITE, designated SEQ ID:45155, to the nucleotide sequence of VGAM437 RNA, herein designated VGAM RNA, also designated SEQ ID:3148.

Another function of VGAM437 is therefore inhibition of LOC222166 (Accession XM_168425). Accordingly, utilities of VGAM437 include diagnosis, prevention and treatment of diseases and clinical conditions associated with LOC222166. FIG. 1 further provides a conceptual description of a novel bioinformatically detected viral gene of the present invention, referred to here as Viral Genomic Address Messenger 438 (VGAM438) viral gene, which modulates expression of respective host target genes thereof, the function and utility of which host target genes is known in the art.

VGAM438 is a novel bioinformatically detected regulatory, non protein coding, viral micro RNA (miRNA) gene. The method by which VGAM438 was detected is described hereinabove with reference to FIGS. 1-8.

VGAM438 gene, herein designated VGAM GENE, is a viral gene contained in the genome of Tomato Bushy Stunt Virus. VGAM438 host target gene, herein designated VGAM HOST TARGET GENE, is a human gene contained in the human genome.

VGAM438 gene encodes a VGAM438 precursor RNA, herein designated VGAM PRECURSOR RNA. Similar to other miRNA genes, and unlike most ordinary genes, VGAM438 precursor RNA does not encode a protein. A nucleotide sequence identical or highly similar to the nucleotide sequence of VGAM438 precursor RNA is designated SEQ ID:424, and is provided hereinbelow with reference to the sequence listing part. Nucleotide sequence SEQ ID:424 is located at position 3276 relative to the genome of Tomato Bushy Stunt Virus.

VGAM438 precursor RNA folds onto itself, forming VGAM438 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM438 folded precursor RNA into VGAM438 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM438 RNA is designated SEQ ID:3149, and is provided hereinbelow with reference to the sequence listing part.

VGAM438 host target gene, herein designated VGAM HOST TARGET GENE, encodes a corresponding messenger RNA, VGAM438 host target RNA, herein designated VGAM HOST TARGET RNA. VGAM438 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM438 RNA, herein designated VGAM RNA, binds complementarily to one or more host target binding sites located in untranslated regions of VGAM438 host target RNA, herein designated VGAM HOST TARGET RNA. This complementary binding is due to the fact that the nucleotide sequence of VGAM438 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM438 RNA, herein designated VGAM RNA, may have a different number of host target binding sites in untranslated regions of a VGAM438 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM438 RNA, herein designated VGAM RNA, to host target binding sites on VGAM438 host target RNA, herein designated VGAM HOST TARGET RNA, such as BINDING SITE I, BINDING SITE II and BINDING SITE III, inhibits translation of VGAM438 host target RNA into VGAM438 host target protein, herein designated VGAM HOST TARGET PROTEIN. VGAM host target protein is therefore outlined by a broken line.

It is appreciated that VGAM438 host target gene, herein designated VGAM HOST TARGET GENE, in fact represents a plurality of VGAM438 host target genes. The mRNA of each one of this plurality of VGAM438 host target genes comprises one or more host target binding sites, each having a nucleotide sequence which is at least partly complementary to VGAM438 RNA, herein designated VGAM RNA, and which when bound by VGAM438 RNA causes inhibition of translation of respective one or more VGAM438 host target proteins.

It is further appreciated by one skilled in the art that the mode of translational inhibition illustrated by FIG. 1 with specific reference to translational inhibition exerted by VGAM438 gene, herein designated VGAM GENE, on one or more VGAM438 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM438 is inhibition of expression of host target genes, as part of a novel viral mechanism of attacking a host. Accordingly, utilities of VGAM438 include diagnosis, prevention and treatment of viral infection by Tomato Bushy Stunt Virus. Specific functions, and accordingly utilities, of VGAM438 correlate with, and may be deduced from, the identity of the host target genes which VGAM438 binds and inhibits, and the function of these host target genes, as elaborated hereinbelow.

Nucleotide sequences of the VGAM438 precursor RNA, herein designated VGAM PRECURSOR RNA, and of the 'diced' VGAM438 RNA, herein designated VGAM RNA, and a schematic representation of the secondary folding of VGAM438 folded precursor RNA, herein designated VGAM FOLDED PRECURSOR RNA, of VGAM438 are further described hereinbelow with reference to Table 1.

Nucleotide sequences of host target binding sites, such as BINDING SITE-I, BINDING SITE-II and BINDING SITE-III of FIG. 1, found on VGAM438 host target RNA, and schematic representation of the complementarity of each of these host target binding sites to VGAM438 RNA, herein designated VGAM RNA, are described hereinbelow with reference to Table 2.

As mentioned hereinabove with reference to FIG. 1, a function of VGAM438 gene, herein designated VGAM is inhibition of expression of VGAM438 target genes. It is appreciated that specific functions, and accordingly utilities, of VGAM438 correlate with, and may be deduced from, the identity of the target genes which VGAM438 binds and inhibits, and the function of these target genes, as elaborated hereinbelow.

Alcohol Dehydrogenase 5 (class III), Chi Polypeptide (ADH5, Accession NM_000671) is a VGAM438 host target gene. ADH5 BINDING SITE is HOST TARGET binding site found in the 3' untranslated region of mRNA encoded by ADH5, corresponding to a HOST TARGET binding site such as BINDING SITE I, BINDING SITE II or BINDING SITE III. Table 2 illustrates the complementarity of the nucleotide sequences of ADH5 BINDING SITE, designated SEQ ID:6323, to the nucleotide sequence of VGAM438 RNA, herein designated VGAM RNA, also designated SEQ ID:3149.

A function of VGAM438 is therefore inhibition of Alcohol Dehydrogenase 5 (class III), Chi Polypeptide (ADH5, Accession NM_000671), a gene which oxidizes ethanol and activated by fatty acids. It oxidizes ethanol very poorly. Accordingly, utilities of VGAM438 include diagnosis, prevention and treatment of diseases and clinical conditions associated with ADH5. The function of ADH5 has been established by previous studies. See 103720. Adinolfi et al. (1984) purified the chi isozyme of ADH (EC 1.1.1.1) from human liver and used it to raise immune sera. Its immunologic properties suggested that it has no structural similarity to either class I (ADH1, ADH2, ADH3) or class II (ADH4) isozymes. The chi isozyme was found in most human tissues including fetal specimens of 16 weeks gestational age and showed a preference for long chain primary alcohols with a double bond in the beta position. Adinolfi et al. (1984) concluded that the locus, designated ADH5, has a separate evolutionary origin from other ADH genes. (The class I ADH isozymes are virtually indistinguishable immunologically; the genes that determine them presumably originated by gene duplication.) Class III or chi ADH has specificity for complex alcohols of high molecular weight such as cinnamyl alcohol. Beisswenger et al. (1985) showed that ADH-chi is the only ADH isozyme in brain. It oxidizes ethanol very poorly; its function in brain is unknown. Since its gene is expressed constitutively in somatic cell hybrids, Carlock et al. (1985) could assign the locus to chromosome 4, specifically 4q21-q25, by analysis of gene products in starch gel electrophoresis. Smith (1986) gave the regional assignment as 4q21-q24. Goldman et al. (1989) isolated and sequenced a full-length cDNA for the class III alcohol dehydrogenase ADH5. By analysis of human/hamster hybrid cell lines, ADH5 was mapped to chromosome 4 where other ADH genes have been located, including class I genes and a class II gene, all of which metabolize ethanol, and the unusual class III ADH, which does not. Analysis of mouse/hamster hybrid cell lines showed that the corresponding gene maps to mouse chromosome 3, which carries the other murine ADH genes. The sequence of ADH5 indicated that it is about equidistant between class I and class II ADHs. In contrast to other ADHs whose expression is more restricted, class III ADH was found to be expressed ubiquitously in human and rodent tissues. Giri et al. (1989) also mapped the gene to mouse chromosome 3. Matsuo and Yokoyama (1990) demonstrated a processed pseudogene derived from the ADH5 gene. Engeland et al. (1993) reported the kinetic characterization of human class III ADH altered at position 115 to asp and to ala by in vitro mutagenesis. The results indicated that the arg115 residue is a component of the binding site for activating fatty acids and is critical for the binding of S-hydroxymethylglutathione in glutathione-dependent formaldehyde dehydrogenase activity.

Full details of the abovementioned studies are described in the following publications, the disclosure of which are hereby incorporated by reference:

Matsuo, Y.; Yokoyama, S.: Cloning and sequencing of a processed pseudogene derived from a human class III alcohol dehydrogenase gene. Am. J. Hum. Genet. 46:85-91, 1990; and Engeland, K.; Hoog, J.-O.; Holmquist, B.; Estonius, M.; Jornvall, H.; Vallee, B. L.: Mutation of arg-115 of human class III alcohol dehydrogenase: a binding site required for formaldehy.

Further studies establishing the function and utilities of ADH5 are found in John Hopkins OMIM database record ID 103710, and in sited publications numbered 811-818 listed in the bibliography section hereinbelow, which are also hereby incorporated by reference. Endoglin (Osler-Rendu-Weber syndrome 1) (ENG, Accession NM_000118) is another VGAM438 host target gene. ENG BINDING SITE is HOST TARGET binding site found in the 3' untranslated region of mRNA encoded by ENG, corresponding to a HOST TARGET binding site such as BINDING SITE I, BINDING SITE II or BINDING SITE III. Table 2 illustrates the complementarity of the nucleotide sequences of ENG BINDING SITE, designated SEQ ID:5590, to the nucleotide sequence of VGAM438 RNA, herein designated VGAM RNA, also designated SEQ ID:3149.

Another function of VGAM438 is therefore inhibition of Endoglin (Osler-Rendu-Weber syndrome 1) (ENG, Accession NM_000118). Accordingly, utilities of VGAM438 include diagnosis, prevention and treatment of diseases and clinical conditions associated with ENG. Protein Phosphatase 4, Regulatory Subunit 2 (PPP4R2, Accession NM_019853) is another VGAM438 host target gene. PPP4R2 BINDING SITE is HOST TARGET binding site found in the 5' untranslated region of mRNA encoded by PPP4R2, corresponding to a HOST TARGET binding site such as BINDING SITE I, BINDING SITE II or BINDING SITE III. Table 2 illustrates the complementarity of the nucleotide sequences of PPP4R2 BINDING SITE, designated SEQ ID:21256, to the nucleotide sequence of VGAM438 RNA, herein designated VGAM RNA, also designated SEQ ID:3149.

Another function of VGAM438 is therefore inhibition of Protein Phosphatase 4, Regulatory Subunit 2 (PPP4R2, Accession NM_019853). Accordingly, utilities of VGAM438 include diagnosis, prevention and treatment of diseases and clinical conditions associated with PPP4R2. LOC200854 (Accession XM_113396) is another VGAM438 host target gene. LOC200854 BINDING SITE is HOST TARGET binding site found in the 5' untranslated region of mRNA encoded by LOC200854, corresponding to a HOST TARGET binding site such as BINDING SITE I, BINDING SITE II or BINDING SITE III. Table 2 illustrates the complementarity of the nucleotide sequences of LOC200854 BINDING SITE, designated SEQ ID:42252, to the nucleotide sequence of VGAM438 RNA, herein designated VGAM RNA, also designated SEQ ID:3149.

Another function of VGAM438 is therefore inhibition of LOC200854 (Accession XM_113396). Accordingly, utilities of VGAM438 include diagnosis, prevention and treatment of diseases and clinical conditions associated with LOC200854. LOC253187 (Accession XM_173139) is another VGAM438 host target gene. LOC253187 BINDING SITE is HOST TARGET binding site found in the 5' untranslated region of mRNA encoded by LOC253187, corresponding to a HOST TARGET binding site such as BINDING SITE I, BINDING SITE II or BINDING SITE III. Table 2 illustrates the complementarity of the nucleotide sequences of LOC253187 BINDING SITE, designated SEQ ID:46392, to the nucleotide sequence of VGAM438 RNA, herein designated VGAM RNA, also designated SEQ ID:3149.

Another function of VGAM438 is therefore inhibition of LOC253187 (Accession XM_173139). Accordingly, utilities of VGAM438 include diagnosis, prevention and treatment of diseases and clinical conditions associated with LOC253187. FIG. 1 further provides a conceptual description of a novel bioinformatically detected viral gene of the present invention, referred to here as Viral Genomic Address Messenger 439 (VGAM439) viral gene, which modulates expression of respective host target genes thereof, the function and utility of which host target genes is known in the art.

VGAM439 is a novel bioinformatically detected regulatory, non protein coding, viral micro RNA (miRNA) gene. The method by which VGAM439 was detected is described hereinabove with reference to FIGS. 1-8.

VGAM439 gene, herein designated VGAM GENE, is a viral gene contained in the genome of Tomato Bushy Stunt Virus. VGAM439 host target gene, herein designated VGAM HOST TARGET GENE, is a human gene contained in the human genome.

VGAM439 gene encodes a VGAM439 precursor RNA, herein designated VGAM PRECURSOR RNA. Similar to other miRNA genes, and unlike most ordinary genes, VGAM439 precursor RNA does not encode a protein. A nucleotide sequence identical or highly similar to the nucleotide sequence of VGAM439 precursor RNA is designated SEQ ID:425, and is provided hereinbelow with reference to the sequence listing part. Nucleotide sequence SEQ ID:425 is located at position 2898 relative to the genome of Tomato Bushy Stunt Virus.

VGAM439 precursor RNA folds onto itself, forming VGAM439 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM439 folded precursor RNA into VGAM439 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM439 RNA is designated SEQ ID:3150, and is provided hereinbelow with reference to the sequence listing part.

VGAM439 host target gene, herein designated VGAM HOST TARGET GENE, encodes a corresponding messenger RNA, VGAM439 host target RNA, herein designated VGAM HOST TARGET RNA. VGAM439 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM439 RNA, herein designated VGAM RNA, binds complementarily to one or more host target binding sites located in untranslated regions of VGAM439 host target RNA, herein designated VGAM HOST TARGET RNA. This complementary binding is due to the fact that the nucleotide sequence of VGAM439 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM439 RNA, herein designated VGAM RNA, may have a different number of host target binding sites in untranslated regions of a VGAM439 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM439 RNA, herein designated VGAM RNA, to host target binding sites on VGAM439 host target RNA, herein designated VGAM HOST TARGET RNA, such as BINDING SITE I, BINDING SITE II and BINDING SITE III, inhibits translation of VGAM439 host target RNA into VGAM439 host target protein, herein designated VGAM HOST TARGET PROTEIN. VGAM host target protein is therefore outlined by a broken line.

It is appreciated that VGAM439 host target gene, herein designated VGAM HOST TARGET GENE, in fact represents a plurality of VGAM439 host target genes. The mRNA of each one of this plurality of VGAM439 host target genes comprises one or more host target binding sites, each having a nucleotide sequence which is at least partly complementary to VGAM439 RNA, herein designated VGAM RNA, and which when bound by VGAM439 RNA causes inhibition of translation of respective one or more VGAM439 host target proteins.

It is further appreciated by one skilled in the art that the mode of translational inhibition illustrated by FIG. 1 with specific reference to translational inhibition exerted by VGAM439 gene, herein designated VGAM GENE, on one or more VGAM439 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM439 is inhibition of expression of host target genes, as part of a novel viral mechanism of attacking a host. Accordingly, utilities of VGAM439 include diagnosis, prevention and treatment of viral infection by Tomato Bushy Stunt Virus. Specific functions, and accordingly utilities, of VGAM439 correlate with, and may be deduced from, the identity of the host target genes which VGAM439 binds and inhibits, and the function of these host target genes, as elaborated hereinbelow.

Nucleotide sequences of the VGAM439 precursor RNA, herein designated VGAM PRECURSOR RNA, and of the 'diced' VGAM439 RNA, herein designated VGAM RNA, and a schematic representation of the secondary folding of VGAM439 folded precursor RNA, herein designated VGAM FOLDED PRECURSOR RNA, of VGAM439 are further described hereinbelow with reference to Table 1.

Nucleotide sequences of host target binding sites, such as BINDING SITE-I, BINDING SITE-II and BINDING SITE-III of FIG. 1, found on VGAM439 host target RNA, and schematic representation of the complementarity of each of these host target binding sites to VGAM439 RNA, herein designated VGAM RNA, are described hereinbelow with reference to Table 2.

As mentioned hereinabove with reference to FIG. 1, a function of VGAM439 gene, herein designated VGAM is inhibition of expression of VGAM439 target genes. It is appreciated that specific functions, and accordingly utilities, of VGAM439 correlate with, and may be deduced from, the identity of the target genes which VGAM439 binds and inhibits, and the function of these target genes, as elaborated hereinbelow.

GAC1 (Accession NM_006338) is a VGAM439 host target gene. GAC1 BINDING SITE is HOST TARGET binding site found in the 3' untranslated region of mRNA encoded by GAC1, corresponding to a HOST TARGET binding site such as BINDING SITE I, BINDING SITE II or BINDING SITE III. Table 2 illustrates the complementarity of the nucleotide sequences of GAC1 BINDING SITE, designated SEQ ID:13039, to the nucleotide sequence of VGAM439 RNA, herein designated VGAM RNA, also designated SEQ ID:3150.

A function of VGAM439 is therefore inhibition of GAC1 (Accession NM_006338). Accordingly, utilities of VGAM439 include diagnosis, prevention and treatment of diseases and clinical conditions associated with GAC1. GRAF (Accession NM_015071) is another VGAM439 host target gene. GRAF BINDING SITE is HOST TARGET binding site found in the 3' untranslated region of mRNA encoded by GRAF, corresponding to a HOST TARGET binding site such as BINDING SITE I, BINDING SITE II or BINDING SITE III. Table 2 illustrates the complementarity of the nucleotide sequences of GRAF BINDING SITE, designated SEQ ID:17446, to the nucleotide sequence of VGAM439 RNA, herein designated VGAM RNA, also designated SEQ ID:3150.

Another function of VGAM439 is therefore inhibition of GRAF (Accession NM_015071), a gene which ia a GTPase activating protein for p21-rac. Accordingly, utilities of VGAM439 include diagnosis, prevention and treatment of diseases and clinical conditions associated with GRAF. The function of GRAF and its association with various diseases and clinical conditions, has been established by previous studies, as described hereinabove with reference to VGAM430. Nuclear Factor I/B (NFIB, Accession NM_005596) is another VGAM439 host target gene. NFIB BINDING SITE is HOST TARGET binding site found in the 3' untranslated region of mRNA encoded by NFIB, corresponding to a HOST TARGET binding site such as BINDING SITE I, BINDING SITE II or BINDING SITE III. Table 2 illustrates the complementarity of the nucleotide sequences of NFIB BINDING SITE, designated SEQ ID:12121, to the nucleotide sequence of VGAM439 RNA, herein designated VGAM RNA, also designated SEQ ID:3150.

Another function of VGAM439 is therefore inhibition of Nuclear Factor I/B (NFIB, Accession NM_005596), a gene which recognizes and binds the palindromic sequence 5'-ttggcnnnnngccaa-3' present in viral and cellular promoters. Accordingly, utilities of VGAM439 include diagnosis, prevention and treatment of diseases and clinical conditions associated with NFIB. The function of NFIB and its association with various diseases and clinical conditions, has been established by previous studies, as described hereinabove with reference to VGAM100. SMG1 (Accession NM_015092) is another VGAM439 host target gene. SMG1 BINDING SITE is HOST TARGET binding site found in the 3' untranslated region of mRNA encoded by SMG1, corresponding to a HOST TARGET binding site such as BINDING SITE I, BINDING SITE II or BINDING SITE III. Table 2 illustrates the complementarity of the nucleotide sequences of SMG1 BINDING SITE, designated SEQ ID:17478, to the nucleotide sequence of VGAM439 RNA, herein designated VGAM RNA, also designated SEQ ID:3150.

Another function of VGAM439 is therefore inhibition of SMG1 (Accession NM_015092), a gene which acts as the target for the cell-cycle arrest and immunosuppressive effects. Accordingly, utilities of VGAM439 include diagnosis, prevention and treatment of diseases and clinical conditions associated with SMG1. The function of SMG1 and its association with various diseases and clinical conditions, has been established by previous studies, as described hereinabove with reference to VGAM419. Bromodomain Containing 4 (BRD4, Accession NM_058243) is another VGAM439 host target gene. BRD4 BINDING SITE is HOST TARGET binding site found in the 3' untranslated region of mRNA encoded by BRD4, corresponding to a HOST TARGET binding site such as BINDING SITE I, BINDING SITE II or BINDING SITE III. Table 2 illustrates the complementarity of the nucleotide sequences of BRD4 BINDING SITE, designated SEQ ID:27775, to the nucleotide sequence of VGAM439 RNA, herein designated VGAM RNA, also designated SEQ ID:3150.

Another function of VGAM439 is therefore inhibition of Bromodomain Containing 4 (BRD4, Accession NM_058243). Accordingly, utilities of VGAM439 include diagnosis, prevention and treatment of diseases and clinical conditions associated with BRD4. Aspartyl-tRNA Synthetase (DARS, Accession NM_001349) is another VGAM439 host target gene. DARS BINDING SITE is HOST TARGET binding site found in the 3' untranslated region of mRNA encoded by DARS, corresponding to a HOST TARGET binding site such as BINDING SITE I, BINDING SITE II or BINDING SITE III. Table 2 illustrates the complementarity of the nucleotide sequences of DARS BINDING SITE, designated SEQ ID:7030, to the nucleotide sequence of VGAM439 RNA, herein designated VGAM RNA, also designated SEQ ID:3150.

Another function of VGAM439 is therefore inhibition of Aspartyl-tRNA Synthetase (DARS, Accession NM_001349). Accordingly, utilities of VGAM439 include diagnosis, prevention and treatment of diseases and clinical conditions associated with DARS. FLJ14641 (Accession NM_032817) is another VGAM439 host target gene.

FLJ14641 BINDING SITE is HOST TARGET binding site found in the 3' untranslated region of mRNA encoded by FLJ14641, corresponding to a HOST TARGET binding site such as BINDING SITE I, BINDING SITE II or BINDING SITE III. Table 2 illustrates the complementarity of the nucleotide sequences of FLJ14641 BINDING SITE, designated SEQ ID:26590, to the nucleotide sequence of VGAM439 RNA, herein designated VGAM RNA, also designated SEQ ID:3150.

Another function of VGAM439 is therefore inhibition of FLJ14641 (Accession NM_032817). Accordingly, utilities of VGAM439 include diagnosis, prevention and treatment of diseases and clinical conditions associated with FLJ14641. KIAA1056 (Accession NM_014894) is another VGAM439 host target gene. KIAA1056 BINDING SITE is HOST TARGET binding site found in the 3' untranslated region of mRNA encoded by KIAA1056, corresponding to a HOST TARGET binding site such as BINDING SITE I, BINDING SITE II or BINDING SITE III. Table 2 illustrates the complementarity of the nucleotide sequences of KIAA1056 BINDING SITE, designated SEQ ID:17049, to the nucleotide sequence of VGAM439 RNA, herein designated VGAM RNA, also designated SEQ ID:3150.

Another function of VGAM439 is therefore inhibition of KIAA1056 (Accession NM_014894). Accordingly, utilities of VGAM439 include diagnosis, prevention and treatment of diseases and clinical conditions associated with KIAA1056. KIAA1854 (Accession XM_049884) is another VGAM439 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35520, to the nucleotide sequence of VGAM439 RNA, herein designated VGAM RNA, also designated SEQ ID:3150.

Another function of VGAM439 is therefore inhibition of KIAA1854 (Accession XM_049884). Accordingly, utilities of VGAM439 include diagnosis, prevention and treatment of diseases and clinical conditions associated with KIAA1854. MGC15631 (Accession NM_032753) is another VGAM439 host target gene. MGC15631 BINDING SITE is HOST TARGET binding site found in the 3' untranslated region of mRNA encoded by MGC15631, corresponding to a HOST TARGET binding site such as BINDING SITE I, BINDING SITE II or BINDING SITE III. Table 2 illustrates the complementarity of the nucleotide sequences of MGC15631 BINDING SITE, designated SEQ ID:26488, to the nucleotide sequence of VGAM439 RNA, herein designated VGAM RNA, also designated SEQ ID:3150.

Another function of VGAM439 is therefore inhibition of MGC15631 (Accession NM_032753). Accordingly, utilities of VGAM439 include diagnosis, prevention and treatment of diseases and clinical conditions associated with MGC15631. SAM Domain and HD Domain 1 (SAMHD1, Accession XM_028704) is another VGAM439 host target gene. SAMHD1 BINDING SITE is HOST TARGET binding site found in the 3' untranslated region of mRNA encoded by SAMHD1, corresponding to a HOST TARGET binding site such as BINDING SITE I, BINDING SITE II or BINDING SITE III. Table 2 illustrates the complementarity of the nucleotide sequences of SAMHD1 BINDING SITE, designated SEQ ID:30736, to the nucleotide sequence of VGAM439 RNA, herein designated VGAM RNA, also designated SEQ ID:3150.

Another function of VGAM439 is therefore inhibition of SAM Domain and HD Domain 1 (SAMHD1, Accession XM_028704). Accordingly, utilities of VGAM439 include diagnosis, prevention and treatment of diseases and clinical conditions associated with SAMHD1. Williams-Beuren Syndrome Chromosome Region 23 (WBSCR23, Accession NM_025042) is another VGAM439 host target gene. WBSCR23 BINDING SITE is HOST TARGET binding site found in the 5' untranslated region of mRNA encoded by WBSCR23, corresponding to a HOST TARGET binding site such as BINDING SITE I, BINDING SITE II or BINDING SITE III. Table 2 illustrates the complementarity of the nucleotide sequences of WBSCR23 BINDING SITE, designated SEQ ID:24639, to the nucleotide sequence of VGAM439 RNA, herein designated VGAM RNA, also designated SEQ ID:3150.

Another function of VGAM439 is therefore inhibition of Williams-Beuren Syndrome Chromosome Region 23 (WBSCR23, Accession NM_025042). Accordingly, utilities of VGAM439 include diagnosis, prevention and treatment of diseases and clinical conditions associated with WBSCR23. LOC162333 (Accession XM_102591) is another VGAM439 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42136, to the nucleotide sequence of VGAM439 RNA, herein designated VGAM RNA, also designated SEQ ID:3150.

Another function of VGAM439 is therefore inhibition of LOC162333 (Accession XM_102591). Accordingly, utilities of VGAM439 include diagnosis, prevention and treatment of diseases and clinical conditions associated with LOC162333. LOC220003 (Accession XM_166230) is another VGAM439 host target gene. LOC220003 BINDING SITE is HOST TARGET binding site found in the 5' untranslated region of mRNA encoded by LOC220003, corresponding to a HOST TARGET binding site such as BINDING SITE I, BINDING SITE II or BINDING SITE III. Table 2 illustrates the complementarity of the nucleotide sequences of LOC220003 BINDING SITE, designated SEQ ID:44051, to the nucleotide sequence of VGAM439 RNA, herein designated VGAM RNA, also designated SEQ ID:3150.

Another function of VGAM439 is therefore inhibition of LOC220003 (Accession XM_166230). Accordingly, utilities of VGAM439 include diagnosis, prevention and treatment of diseases and clinical conditions associated with LOC220003. FIG. 1 further provides a conceptual description of a novel bioinformatically detected viral gene of the present invention, referred to here as Viral Genomic Address Messenger 440 (VGAM440) viral gene, which modulates expression of respective host target genes thereof, the function and utility of which host target genes is known in the art.

VGAM440 is a novel bioinformatically detected regulatory, non protein coding, viral micro RNA (miRNA) gene. The method by which VGAM440 was detected is described hereinabove with reference to FIGS. 1-8.

VGAM440 gene, herein designated VGAM GENE, is a viral gene contained in the genome of Vaccinia Virus. VGAM440 host target gene, herein designated VGAM HOST TARGET GENE, is a human gene contained in the human genome.

VGAM440 gene encodes a VGAM440 precursor RNA, herein designated VGAM PRECURSOR RNA. Similar to other miRNA genes, and unlike most ordinary genes, VGAM440 precursor RNA does not encode a protein. A nucleotide sequence identical or highly similar to the nucleotide sequence of VGAM440 precursor RNA is designated SEQ ID:426, and is provided hereinbelow with reference to the sequence listing part. Nucleotide sequence SEQ ID:426 is located at position 22113 relative to the genome of Vaccinia Virus.

VGAM440 precursor RNA folds onto itself, forming VGAM440 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM440 folded precursor RNA into VGAM440 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM440 RNA is designated SEQ ID:3151, and is provided hereinbelow with reference to the sequence listing part.

VGAM440 host target gene, herein designated VGAM HOST TARGET GENE, encodes a corresponding messenger RNA, VGAM440 host target RNA, herein designated VGAM HOST TARGET RNA. VGAM440 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM440 RNA, herein designated VGAM RNA, binds complementarily to one or more host target binding sites located in untranslated regions of VGAM440 host target RNA, herein designated VGAM HOST TARGET RNA. This complementary binding is due to the fact that the nucleotide sequence of VGAM440 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM440 RNA, herein designated VGAM RNA, may have a different number of host target binding sites in untranslated regions of a VGAM440 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM440 RNA, herein designated VGAM RNA, to host target binding sites on VGAM440 host target RNA, herein designated VGAM HOST TARGET RNA, such as BINDING SITE I, BINDING SITE II and BINDING SITE III, inhibits translation of VGAM440 host target RNA into VGAM440 host target protein, herein designated VGAM HOST TARGET PROTEIN. VGAM host target protein is therefore outlined by a broken line.

It is appreciated that VGAM440 host target gene, herein designated VGAM HOST TARGET GENE, in fact represents a plurality of VGAM440 host target genes. The mRNA of each one of this plurality of VGAM440 host target genes comprises one or more host target binding sites, each having a nucleotide sequence which is at least partly complementary to VGAM440 RNA, herein designated VGAM RNA, and which when bound by VGAM440 RNA causes inhibition of translation of respective one or more VGAM440 host target proteins.

It is further appreciated by one skilled in the art that the mode of translational inhibition illustrated by FIG. 1 with specific reference to translational inhibition exerted by VGAM440 gene, herein designated VGAM GENE, on one or more VGAM440 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM440 is inhibition of expression of host target genes, as part of a novel viral mechanism of attacking a host. Accordingly, utilities of VGAM440 include diagnosis, prevention and treatment of viral infection by Vaccinia Virus. Specific functions, and accordingly utilities, of VGAM440 correlate with, and may be deduced from, the identity of the host target genes which VGAM440 binds and inhibits, and the function of these host target genes, as elaborated hereinbelow.

Nucleotide sequences of the VGAM440 precursor RNA, herein designated VGAM PRECURSOR RNA, and of the 'diced' VGAM440 RNA, herein designated VGAM RNA, and a schematic representation of the secondary folding of VGAM440 folded precursor RNA, herein designated VGAM FOLDED PRECURSOR RNA, of VGAM440 are further described hereinbelow with reference to Table 1.

Nucleotide sequences of host target binding sites, such as BINDING SITE-I, BINDING SITE-II and BINDING SITE-III of FIG. 1, found on VGAM440 host target RNA, and schematic representation of the complementarity of each of these host target binding sites to VGAM440 RNA, herein designated VGAM RNA, are described hereinbelow with reference to Table 2.

As mentioned hereinabove with reference to FIG. 1, a function of VGAM440 gene, herein designated VGAM is inhibition of expression of VGAM440 target genes. It is appreciated that specific functions, and accordingly utilities, of VGAM440 correlate with, and may be deduced from, the identity of the target genes which VGAM440 binds and inhibits, and the function of these target genes, as elaborated hereinbelow.

Autocrine Motility Factor Receptor (AMFR, Accession NM_138958) is a VGAM440 host target gene. AMFR BINDING SITE is HOST TARGET binding site found in the 3' untranslated region of mRNA encoded by AMFR, corresponding to a HOST TARGET binding site such as BINDING SITE I, BINDING SITE II or BINDING SITE III. Table 2 illustrates the complementarity of the nucleotide sequences of AMFR BINDING SITE, designated SEQ ID:29066, to the nucleotide sequence of VGAM440 RNA, herein designated VGAM RNA, also designated SEQ ID:3151.

A function of VGAM440 is therefore inhibition of Autocrine Motility Factor Receptor (AMFR, Accession NM_138958), a gene which acts to stimulate migration of fibrosarcoma cells. Accordingly, utilities of VGAM440 include diagnosis, prevention and treatment of diseases and clinical conditions associated with AMFR. The function of AMFR has been established by previous studies. Autocrine motility factor (AMF; 172400) is a protein secreted by tumor cells that stimulates tumor motility. Its receptor is a 78-kD glycoprotein (gp78). Watanabe et al. (1991) cloned the AMFR cDNA. The gene encodes a 323-amino acid polypeptide that has a single transmembrane domain and several putative glycosylation sites. The protein sequence has some homology to human tumor protein p53 (OMIM Ref. No. 191170). Hirono et al. (1996) used immunohistochemistry to examine the expression of AMFR in gastric cancer specimens. The level of expression was associated with the pathologic stage and grade of tumor penetration. Positive AMFR expression was significantly associated with poor prognosis.

Full details of the abovementioned studies are described in the following publications, the disclosure of which are hereby incorporated by reference:

Hirono, Y.; Fushida, S.; Yonemura, Y.; Yamamoto, H.; Watanabe, H.; Raz, A.: Expression of autocrine motility factor receptor correlates with disease progression in human gastric cancer. Brit. J. Cancer 74:2003-2007, 1996.; and Watanabe, H.; Carmi, P.; Hogan, V.; Raz, T.; Silletti, S.; Nabi, I. R.; Raz, A.: Purification of human tumor cell autocrine motility factor and molecular cloning of its receptor. J. Bio.

Further studies establishing the function and utilities of AMFR are found in John Hopkins OMIM database record ID 603243, and in sited publications numbered 1079-1082 listed in the bibliography section hereinbelow, which are also hereby incorporated by reference. Chromogranin A (parathyroid secretory protein 1) (CHGA, Accession NM_001275) is another VGAM440 host target gene. CHGA BINDING SITE is HOST TARGET binding site found in the 5' untranslated region of mRNA encoded by CHGA, corresponding to a HOST TARGET binding site such as BINDING SITE I, BINDING SITE II or BINDING SITE III. Table 2 illustrates the complementarity of the nucleotide sequences of CHGA BINDING SITE, designated SEQ ID:6939, to the nucleotide sequence of VGAM440 RNA, herein designated VGAM RNA, also designated SEQ ID:3151.

Another function of VGAM440 is therefore inhibition of Chromogranin A (parathyroid secretory protein 1) (CHGA, Accession NM_001275), a gene which regulates dense-core secretory granule biogenesis and hormone sequestration . Accordingly, utilities of VGAM440 include diagnosis, prevention and treatment of diseases and clinical conditions associated with CHGA. The function of CHGA has been established by previous studies. Kim et al. (2001) presented evidence that regulation of dense-core secretory granule biogenesis and hormone secretion in endocrine cells is dependent on CGA. down regulation of CGA expression in a neuroendocrine cell line, PC12, by antisense RNAs led to profound loss of dense-core secretory granules, impairment of regulated secretion of a transfected prohormone, and reduction of secretory granule proteins. Transfection of bovine Cga into a CGA-deficient PC12 clone rescued the regulated secretory phenotype. Stable transfection of CGA into a CGA-deficient pituitary cell line, 6T3, which lacks a regulated secretory pathway, restored regulated secretion. Overexpression of CGA induced dense-core granules, immunoreactive for CGA, in nonendocrine fibroblast CV-1 cells. Kim et al. (2001) concluded that CGA is an 'on/off' switch that alone is sufficient to drive dense-core secretory granule biogenesis and hormone sequestration in endocrine cells. Granberg et al. (1999) measured CgA in 36 patients with type I multiple endocrine neoplasia (MEN1; 131100), of whom 9 lacked pancreatic involvement, 20 had biochemical evidence of pancreatic endocrine tumors, and 7 displayed radiologically detectable pancreatic tumors. CgA was also analyzed in 25 patients with sporadic pancreatic endocrine tumors, 39 subjects with inflammatory bowel disease, 7 patients harboring nonendocrine pancreatic disease, and 19 healthy controls. Of the MEN1 patients without pancreatic involvement, 4 of 9 (44%) had elevated CgA. Furthermore, 60% with biochemically unequivocal tumors and all with a radiologically visible tumor showed elevations. All 25 patients with sporadic pancreatic endocrine tumors had increased CgA, as did 28% of patients with inflammatory bowel disease and 57% with nonendocrine pancreatic disease. Granberg et al. (1999) concluded that nonendocrine diseases can cause elevations of CgA, and its spontaneous variation can be considerable. While plasma CgA is the most sensitive of the basal markers for neuroendocrine tumors, the authors felt that it could not replace other established measures when screening for early pancreatic involvement in MEN1.

Full details of the abovementioned studies are described in the following publications, the disclosure of which are hereby incorporated by reference:

Granberg, D.; Stridsberg, M.; Seensalu, R.; Eriksson, B.; Lundqvist, G.; Oberg, K.; Skogseid, B.: Plasma chromogranin A in patients with multiple endocrine neoplasia type 1. J. Clin. Endocr. Metab. 84:2712-2717, 1999; and Kim, T.; Tao-Cheng, J.-H.; Eiden, L. E.; Loh, Y. P.: Chromogranin A, an 'on/off' switch controlling dense-core secretory granule biogenesis. Cell 106:499-509, 2001.

Further studies establishing the function and utilities of CHGA are found in John Hopkins OMIM database record ID 118910, and in sited publications numbered 12299-1230 and 790-259 listed in the bibliography section hereinbelow, which are also hereby incorporated by reference. FLJ10842 (Accession NM_018238) is another VGAM440 host target gene. FLJ10842 BINDING SITE is HOST TARGET binding site found in the 3' untranslated region of mRNA encoded by FLJ10842, corresponding to a HOST TARGET binding site such as BINDING SITE I, BINDING SITE II or BINDING SITE III. Table 2 illustrates the complementarity of the nucleotide sequences of FLJ10842 BINDING SITE, designated SEQ ID:20187, to the nucleotide sequence of VGAM440 RNA, herein designated VGAM RNA, also designated SEQ ID:3151.

Another function of VGAM440 is therefore inhibition of FLJ10842 (Accession NM_018238). Accordingly, utilities of VGAM440 include diagnosis, prevention and treatment of diseases and clinical conditions associated with FLJ10842. FLJ22969 (Accession XM_044006) is another VGAM440 host target gene. FLJ22969 BINDING SITE is HOST TARGET binding site found in the 3' untranslated region of mRNA encoded by FLJ22969, corresponding to a HOST TARGET binding site such as BINDING SITE I, BINDING SITE II or BINDING SITE III. Table 2 illustrates the complementarity of the nucleotide sequences of FLJ22969 BINDING SITE, designated SEQ ID:34067, to the nucleotide sequence of VGAM440 RNA, herein designated VGAM RNA, also designated SEQ ID:3151.

Another function of VGAM440 is therefore inhibition of FLJ22969 (Accession XM_044006). Accordingly, utilities of VGAM440 include diagnosis, prevention and treatment of diseases and clinical conditions associated with FLJ22969. FLJ23510 (Accession NM_024720) is another VGAM440 host target gene. FLJ23510 BINDING SITE is HOST TARGET binding site found in the 5' untranslated region of mRNA encoded by FLJ23510, corresponding to a HOST TARGET binding site such as BINDING SITE I, BINDING SITE II or BINDING SITE III. Table 2 illustrates the complementarity of the nucleotide sequences of FLJ23510 BINDING SITE, designated SEQ ID:24052, to the nucleotide sequence of VGAM440 RNA, herein designated VGAM RNA, also designated SEQ ID:3151.

Another function of VGAM440 is therefore inhibition of FLJ23510 (Accession NM_024720). Accordingly, utilities of VGAM440 include diagnosis, prevention and treatment of diseases and clinical conditions associated with FLJ23510. FLJ23519 (Accession NM_032240) is another VGAM440 host target gene. FLJ23519 BINDING SITE is HOST TARGET binding site found in the 3' untranslated region of mRNA encoded by FLJ23519, corresponding to a HOST TARGET binding site such as BINDING SITE I, BINDING SITE II or BINDING SITE III. Table 2 illustrates the complementarity of the nucleotide sequences of FLJ23519 BINDING SITE, designated SEQ ID:25971, to the nucleotide sequence of VGAM440 RNA, herein designated VGAM RNA, also designated SEQ ID:3151.

Another function of VGAM440 is therefore inhibition of FLJ23519 (Accession NM_032240). Accordingly, utilities of VGAM440 include diagnosis, prevention and treatment of diseases and clinical conditions associated with FLJ23519. KIAA0961 (Accession NM_014898) is another VGAM440 host target gene. KIAA0961 BINDING SITE is HOST TARGET binding site found in the 3' untranslated region of mRNA encoded by KIAA0961, corresponding to a HOST TARGET binding site such as BINDING SITE I, BINDING SITE II or BINDING SITE III. Table 2 illustrates the complementarity of the nucleotide sequences of KIAA0961 BINDING SITE, designated SEQ ID:17071, to the nucleotide sequence of VGAM440 RNA, herein designated VGAM RNA, also designated SEQ ID:3151.

Another function of VGAM440 is therefore inhibition of KIAA0961 (Accession NM_014898). Accordingly, utilities of VGAM440 include diagnosis, prevention and treatment of diseases and clinical conditions associated with KIAA0961. KIAA1265 (Accession XM_047707) is another VGAM440 host target gene. KIAA1265 BINDING SITE is HOST TARGET binding site found in the 3' untranslated region of mRNA encoded by KIAA1265, corresponding to a HOST TARGET binding site such as BINDING SITE I, BINDING SITE II or BINDING SITE III. Table 2 illustrates the complementarity of the nucleotide sequences of KIAA1265 BINDING SITE, designated SEQ ID:35034, to the nucleotide sequence of VGAM440 RNA, herein designated VGAM RNA, also designated SEQ ID:3151.

Another function of VGAM440 is therefore inhibition of KIAA1265 (Accession XM_047707). Accordingly, utilities of VGAM440 include diagnosis, prevention and treatment of diseases and clinical conditions associated with KIAA1265. Solute Carrier Family 6 (neurotransmitter transporter), Member 14 (SLC6A14, Accession NM_007231) is another VGAM440 host target gene. SLC6A14 BINDING SITE is HOST TARGET binding site found in the 3' untranslated region of mRNA encoded by SLC6A14, corresponding to a HOST TARGET binding site such as BINDING SITE I, BINDING SITE II or BINDING SITE III. Table 2 illustrates the complementarity of the nucleotide sequences of SLC6A14 BINDING SITE, designated SEQ ID:14100, to the nucleotide sequence of VGAM440 RNA, herein designated VGAM RNA, also designated SEQ ID:3151.

Another function of VGAM440 is therefore inhibition of Solute Carrier Family 6 (neurotransmitter transporter), Member 14 (SLC6A14, Accession NM_007231). Accordingly, utilities of VGAM440 include diagnosis, prevention and treatment of diseases and clinical conditions associated with SLC6A14. Tumor Protein P53 Inducible Nuclear Protein 1 (TP53INP1, Accession XM_053740) is another VGAM440 host target gene. TP53INP1 BINDING SITE1 and TP53INP1 BINDING SITE2 are HOST TARGET binding sites found in untranslated regions of mRNA encoded by TP53INP1, corresponding to HOST TARGET binding sites such as BINDING SITE I, BINDING SITE II or BINDING SITE III. Table 2 illustrates the complementarity of the nucleotide sequences of TP53INP1 BINDING SITE1 and TP53INP1 BINDING SITE2, designated SEQ ID:36114 and SEQ ID:27103 respectively, to the nucleotide sequence of VGAM440 RNA, herein designated VGAM RNA, also designated SEQ ID:3151.

Another function of VGAM440 is therefore inhibition of Tumor Protein P53 Inducible Nuclear Protein 1 (TP53INP1, Accession XM_053740). Accordingly, utilities of VGAM440 include diagnosis, prevention and treatment of diseases and clinical conditions associated with TP53INP1. LOC147429 (Accession XM_085793) is another VGAM440 host target gene. LOC147429 BINDING SITE is HOST TARGET binding site found in the 3' untranslated region of mRNA encoded by LOC147429, corresponding to a HOST TARGET binding site such as BINDING SITE I, BINDING SITE II or BINDING SITE III. Table 2 illustrates the complementarity of the nucleotide sequences of LOC147429 BINDING SITE, designated SEQ ID:38335, to the nucleotide sequence of VGAM440 RNA, herein designated VGAM RNA, also designated SEQ ID:3151.

Another function of VGAM440 is therefore inhibition of LOC147429 (Accession XM_085793). Accordingly, utilities of VGAM440 include diagnosis, prevention and treatment of diseases and clinical conditions associated with LOC147429. LOC154007 (Accession XM_087824) is another VGAM440 host target gene. LOC154007 BINDING SITE is HOST TARGET binding site found in the 3' untranslated region of mRNA encoded by LOC154007, corresponding to a HOST TARGET binding site such as BINDING SITE I, BINDING SITE II or BINDING SITE III. Table 2 illustrates the complementarity of the nucleotide sequences of LOC154007 BINDING SITE, designated SEQ ID:39455, to the nucleotide sequence of VGAM440 RNA, herein designated VGAM RNA, also designated SEQ ID:3151.

Another function of VGAM440 is therefore inhibition of LOC154007 (Accession XM_087824). Accordingly, utilities of VGAM440 include diagnosis, prevention and treatment of diseases and clinical conditions associated with LOC154007. LOC196337 (Accession XM_113696) is another VGAM440 host target gene. LOC196337 BINDING SITE is HOST TARGET binding site found in the 5' untranslated region of mRNA encoded by LOC196337, corresponding to a HOST TARGET binding site such as BINDING SITE I, BINDING SITE II or BINDING SITE III. Table 2 illustrates the complementarity of the nucleotide sequences of LOC196337 BINDING SITE, designated SEQ ID:42358, to the nucleotide sequence of VGAM440 RNA, herein designated VGAM RNA, also designated SEQ ID:3151.

Another function of VGAM440 is therefore inhibition of LOC196337 (Accession XM_113696). Accordingly, utilities of VGAM440 include diagnosis, prevention and treatment of diseases and clinical conditions associated with LOC196337. LOC200197 (Accession XM_114148) is another VGAM440 host target gene. LOC200197 BINDING SITE is HOST TARGET binding site found in the 3' untranslated region of mRNA encoded by LOC200197, corresponding to a HOST TARGET binding site such as BINDING SITE I, BINDING SITE II or BINDING SITE III. Table 2 illustrates the complementarity of the nucleotide sequences of LOC200197 BIND- ING SITE, designated SEQ ID:42730, to the nucleotide sequence of VGAM440 RNA, herein designated VGAM RNA, also designated SEQ ID:3151.

Another function of VGAM440 is therefore inhibition of LOC200197 (Accession XM_114148). Accordingly, utilities of VGAM440 include diagnosis, prevention and treatment of diseases and clinical conditions associated with LOC200197. LOC200681 (Accession XM_117260) is another VGAM440 host target gene. LOC200681 BINDING SITE is HOST TARGET binding site found in the 5' untranslated region of mRNA encoded by LOC200681, corresponding to a HOST TARGET binding site such as BINDING SITE I, BINDING SITE II or BINDING SITE III. Table 2 illustrates the complementarity of the nucleotide sequences of LOC200681 BINDING SITE, designated SEQ ID:43341, to the nucleotide sequence of VGAM440 RNA, herein designated VGAM RNA, also designated SEQ ID:3151.

Another function of VGAM440 is therefore inhibition of LOC200681 (Accession XM_117260). Accordingly, utilities of VGAM440 include diagnosis, prevention and treatment of diseases and clinical conditions associated with LOC200681. LOC221583 (Accession XM_166396) is another VGAM440 host target gene. LOC221583 BINDING SITE is HOST TARGET binding site found in the 5' untranslated region of mRNA encoded by LOC221583, corresponding to a HOST TARGET binding site such as BINDING SITE I, BINDING SITE II or BINDING SITE III. Table 2 illustrates the complementarity of the nucleotide sequences of LOC221583 BINDING SITE, designated SEQ ID:44245, to the nucleotide sequence of VGAM440 RNA, herein designated VGAM RNA, also designated SEQ ID:3151.

Another function of VGAM440 is therefore inhibition of LOC221583 (Accession XM_166396). Accordingly, utilities of VGAM440 include diagnosis, prevention and treatment of diseases and clinical conditions associated with LOC221583. LOC51301 (Accession NM_016591) is another VGAM440 host target gene. LOC51301 BINDING SITE is HOST TARGET binding site found in the 3' untranslated region of mRNA encoded by LOC51301, corresponding to a HOST TARGET binding site such as BINDING SITE I, BINDING SITE II or BINDING SITE III. Table 2 illustrates the complementarity of the nucleotide sequences of LOC51301 BINDING SITE, designated SEQ ID:18670, to the nucleotide sequence of VGAM440 RNA, herein designated VGAM RNA, also designated SEQ ID:3151.

Another function of VGAM440 is therefore inhibition of LOC51301 (Accession NM_016591). Accordingly, utilities of VGAM440 include diagnosis, prevention and treatment of diseases and clinical conditions associated with LOC51301. FIG. 1 further provides a conceptual description of a novel bioinformatically detected viral gene of the present invention, referred to here as Viral Genomic Address Messenger 441 (VGAM441) viral gene, which modulates expression of respective host target genes thereof, the function and utility of which host target genes is known in the art.

VGAM441 is a novel bioinformatically detected regulatory, non protein coding, viral micro RNA (miRNA) gene. The method by which VGAM441 was detected is described hereinabove with reference to FIGS. 1-8.

VGAM441 gene, herein designated VGAM GENE, is a viral gene contained in the genome of Vaccinia Virus. VGAM441 host target gene, herein designated VGAM HOST TARGET GENE, is a human gene contained in the human genome.

VGAM441 gene encodes a VGAM441 precursor RNA, herein designated VGAM PRECURSOR RNA. Similar to other miRNA genes, and unlike most ordinary genes, VGAM441 precursor RNA does not encode a protein. A nucleotide sequence identical or highly similar to the nucleotide sequence of VGAM441 precursor RNA is designated SEQ ID:427, and is provided hereinbelow with reference to the sequence listing part. Nucleotide sequence SEQ ID:427 is located at position 78448 relative to the genome of Vaccinia Virus.

VGAM441 precursor RNA folds onto itself, forming VGAM441 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM441 folded precursor RNA into VGAM441 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 92%) nucleotide sequence of VGAM441 RNA is designated SEQ ID:3152, and is provided hereinbelow with reference to the sequence listing part.

VGAM441 host target gene, herein designated VGAM HOST TARGET GENE, encodes a corresponding messenger RNA, VGAM441 host target RNA, herein designated VGAM HOST TARGET RNA. VGAM441 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM441 RNA, herein designated VGAM RNA, binds complementarily to one or more host target binding sites located in untranslated regions of VGAM441 host target RNA, herein designated VGAM HOST TARGET RNA. This complementary binding is due to the fact that the nucleotide sequence of VGAM441 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM441 RNA, herein designated VGAM RNA, may have a different number of host target binding sites in untranslated regions of a VGAM441 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM441 RNA, herein designated VGAM RNA, to host target binding sites on VGAM441 host target RNA, herein designated VGAM HOST TARGET RNA, such as BINDING SITE I, BINDING SITE II and BINDING SITE III, inhibits translation of VGAM441 host target RNA into VGAM441 host target protein, herein designated VGAM HOST TARGET PROTEIN. VGAM host target protein is therefore outlined by a broken line.

It is appreciated that VGAM441 host target gene, herein designated VGAM HOST TARGET GENE, in fact represents a plurality of VGAM441 host target genes. The mRNA of each one of this plurality of VGAM441 host target genes comprises one or more host target binding sites, each having a nucleotide sequence which is at least partly complementary to VGAM441 RNA, herein designated VGAM RNA, and which when bound by VGAM441 RNA causes inhibition of translation of respective one or more VGAM441 host target proteins.

It is further appreciated by one skilled in the art that the mode of translational inhibition illustrated by FIG. 1 with specific reference to translational inhibition exerted by VGAM441 gene, herein designated VGAM GENE, on one or more VGAM441 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM441 is inhibition of expression of host target genes, as part of a novel viral mechanism of attacking a host. Accordingly, utilities of VGAM441 include diagnosis, prevention and treatment of viral infection by Vaccinia Virus. Specific functions, and accordingly utilities, of VGAM441 correlate with, and may be deduced from, the identity of the host target genes which VGAM441 binds and inhibits, and the function of these host target genes, as elaborated hereinbelow.

Nucleotide sequences of the VGAM441 precursor RNA, herein designated VGAM PRECURSOR RNA, and of the 'diced' VGAM441 RNA, herein designated VGAM RNA, and a schematic representation of the secondary folding of VGAM441 folded precursor RNA, herein designated VGAM FOLDED PRECURSOR RNA, of VGAM441 are further described hereinbelow with reference to Table 1.

Nucleotide sequences of host target binding sites, such as BINDING SITE-I, BINDING SITE-II and BINDING SITE-III of FIG. 1, found on VGAM441 host target RNA, and schematic representation of the complementarity of each of these host target binding sites to VGAM441 RNA, herein designated VGAM RNA, are described hereinbelow with reference to Table 2.

As mentioned hereinabove with reference to FIG. 1, a function of VGAM441 gene, herein designated VGAM is inhibition of expression of VGAM441 target genes. It is appreciated that specific functions, and accordingly utilities, of VGAM441 correlate with, and may be deduced from, the identity of the target genes which VGAM441 binds and inhibits, and the function of these target genes, as elaborated hereinbelow.

Cyclin T2 (CCNT2, Accession NM_058241) is a VGAM441 host target gene. CCNT2 BINDING SITE is HOST TARGET binding site found in the 3' untranslated region of mRNA encoded by CCNT2, corresponding to a HOST TARGET binding site such as BINDING SITE I, BINDING SITE II or BINDING SITE III. Table 2 illustrates the complementarity of the nucleotide sequences of CCNT2 BINDING SITE, designated SEQ ID:27770, to the nucleotide sequence of VGAM441 RNA, herein designated VGAM RNA, also designated SEQ ID:3152.

A function of VGAM441 is therefore inhibition of Cyclin T2 (CCNT2, Accession NM_058241), a gene which is a regulatory subunit of the cyclin-dependent kinase pair (cdk9/cyclin t) complex. Accordingly, utilities of VGAM441 include diagnosis, prevention and treatment of diseases and clinical conditions associated with CCNT2. The function of CCNT2 and its association with various diseases and clinical conditions, has been established by previous studies, as described hereinabove with reference to VGAM159. Endothelin Receptor Type A (EDNRA, Accession XM_034331) is another VGAM441 host target gene. EDNRA BINDING SITE is HOST TARGET binding site found in the 3' untranslated region of mRNA encoded by EDNRA, corresponding to a HOST TARGET binding site such as BINDING SITE I, BINDING SITE II or BINDING SITE III. Table 2 illustrates the complementarity of the nucleotide sequences of EDNRA BINDING SITE, designated SEQ ID:32056, to the nucleotide sequence of VGAM441 RNA, herein designated VGAM RNA, also designated SEQ ID:3152.

Another function of VGAM441 is therefore inhibition of Endothelin Receptor Type A (EDNRA, Accession XM_034331), a gene which binds endothelins, and induces intracellular calcium flux and arachidonic acid accumulation. Accordingly, utilities of VGAM441 include diagnosis, prevention and treatment of diseases and clinical conditions associated with EDNRA. The function of EDNRA has been established by previous studies. See 131244. The endothelin receptor with highest affinity for ET1 (OMIM Ref. No. 131240) has been called ETA. Cyr et al. (1991) isolated a cDNA clone of a human endothelin receptor from a placental cDNA library. The deduced amino acid sequence was 94% identical to the bovine endothelin ETA receptor and was judged to represent the human homolog. They assigned the ETRA gene to chromosome 4 by analysis of its segregation pattern in rodent/human hybrids. Hosoda et al. (1992) isolated and characterized the gene for the human endothelin-A receptor. Southern blot analyses demonstrated that it is present in single copy. The gene spans more than 40 kb and contains 8 exons and 7 introns. The transcription start site, determined by primer extension experiments, was 502 bp upstream of the methionine initiation codon. Using human/rodent somatic hybrid cell DNAs, Hosoda et al. (1992) also assigned the gene to chromosome 4. Northern blot analyses demonstrated a 4.3-kb mRNA in a wide variety of human tissues with the highest level in the aorta and a substantial level in cultured human mesangial cells. Endothelin-1 inhibits active Na-K transport by as much as 50% in the renal tubule and other tissues (Zeidel et al., 1989). Okafor and Delamere (2001) noted that the presence of low levels of ET1 in aqueous humor combined with the potential for release of ET1 from ciliary processes suggested that the crystalline lens could be exposed to ET1 in vivo. They studied the influence of ET1 on active Na-K transport in the porcine lens. Their results suggested that ET1 inhibited active lens Na-K transport by activating EDNRA and EDNRB. Activation of the ET receptors also caused an increase in cytoplasmic calcium concentration in cultured lens epithelial cells. Both responses to ET1 appear to have a tyrosine kinase step.

Full details of the abovementioned studies are described in the following publications, the disclosure of which are hereby incorporated by reference:

Hosoda, K.; Nakao, K.; Tamura, N.; Arai, H.; Ogawa, Y.; Suga, S.; Nakanishi, S.; Imura, H.: Organization, structure, chromosomal assignment, and expression of the gene encoding the human endothelin-A receptor. J. Biol. Chem. 267: 18797-18804, 1992; and Okafor, M. C.; Delamere, N. A.: The inhibitory influence of endothelin on active sodium-potassium transport in porcine lens. Invest. Ophthal. Vis. Sci. 42: 1018-1023, 2001.

Further studies establishing the function and utilities of EDNRA are found in John Hopkins OMIM database record ID 131243, and in sited publications numbered 12215-4038, 2278, 228 and 4039 listed in the bibliography section hereinbelow, which are also hereby incorporated by reference. Growth Factor Receptor-bound Protein 10 (GRB10, Accession NM_005311) is another VGAM441 host target gene. GRB10 BINDING SITE is HOST TARGET binding site found in the 3' untranslated region of mRNA encoded by GRB10, corresponding to a HOST TARGET binding site such as BINDING SITE I, BINDING SITE II or BINDING SITE III. Table 2 illustrates the complementarity of the nucleotide sequences of GRB10 BINDING SITE, designated SEQ ID:11785, to the nucleotide sequence of VGAM441 RNA, herein designated VGAM RNA, also designated SEQ ID:3152.

Another function of VGAM441 is therefore inhibition of Growth Factor Receptor-bound Protein 10 (GRB10, Accession NM_005311), a gene which plays a functional role in insulin and IGF-I signaling. Accordingly, utilities of VGAM441 include diagnosis, prevention and treatment of diseases and clinical conditions associated with GRB10. The function of GRB10 has been established by previous studies. Src homology region 2 (SH2) domain proteins bind to autophosphorylated growth factor receptors after activation of the receptors by ligand. By screening an NIH 3T3 library with the epidermal growth factor receptor (EGFR; 131550) by use of the CORT technique (Skolnik et al., 1991), Ooi et al. (1995) cloned and characterized mouse Grb10. Grb10 undergoes serine but not tyrosine phosphorylation after EGF treatment and binds poorly to the EGFR, suggesting that another protein binds the EGFR in vivo. Ooi et al. (1995) mapped the mouse Grb10 gene to chromosome 11. By using the yeast 2-hybrid system to identify proteins that interact with the cytoplasmic tyrosine kinase domain of the insulin receptor (INSR; 147670), Liu and Roth (1995) isolated a GRB10 cDNA from HeLa cells. The cDNA, called GRB-IR by them, encodes a predicted 548-amino acid protein containing an SH2 domain and an incomplete pleckstrin-homology (PH) domain. RT-PCR showed that the GRB10 gene is alternatively spliced, producing transcripts that encode proteins either with or without a 46-amino acid stretch that contains part of the PH domain. The SH2 and PH domains of the human GRB10 protein are 99% and 84% identical, respectively, to those of mouse Grb10. Northern blot analysis showed that the GRB10 gene is expressed as 2.2-, 5.0-, and 6.5-kb transcripts, predominantly in skeletal muscle and pancreas. Western blot analysis of HeLa cell lysates detected 50-, 65-, and 68-kD proteins. GRB10 binds with high affinity to autophosphorylated INSR in vitro. After treatment of cells with insulin (INS; 176730), GRB10 forms complexes with INSR. The formation of this complex inhibits the insulin-induced increase in phosphorylation of IRS1 (OMIM Ref. No. 147545) and a 60-kD GTPase-activating protein (GAP)-associated protein, suggesting that GRB10 inhibits or redirects the INSR signaling pathway.

Full details of the abovementioned studies are described in the following publications, the disclosure of which are hereby incorporated by reference:

Liu, F.; Roth, R. A.: Grb-IR: a SH2-domain-containing protein that binds to the insulin receptor and inhibits its function. Proc. Nat. Acad. Sci. 92: 10287-10291, 1995; and Ooi, J.; Yajnik, V.; Immanuel, D.; Gordon, M.; Moskow, J. J.; Buchberg, A. M.; Margolis, B.: The cloning of Grb10 reveals a new family of SH2 domain proteins. Oncogene 10:1621-1630, 1.

Further studies establishing the function and utilities of GRB10 are found in John Hopkins OMIM database record ID 601523, and in sited publications numbered 6526, 6527-6528, 1809, 6529-6530, 1810-181 and 6531 listed in the bibliography section hereinbelow, which are also hereby incorporated by reference.5-hydroxytryptamine (serotonin) Receptor 4 (HTR4, Accession NM_000870) is another VGAM441 host target gene. HTR4 BINDING SITE is HOST TARGET binding site found in the 3' untranslated region of mRNA encoded by HTR4, corresponding to a HOST TARGET binding site such as BINDING SITE I, BINDING SITE II or BINDING SITE III. Table 2 illustrates the complementarity of the nucleotide sequences of HTR4 BINDING SITE, designated SEQ ID:6540, to the nucleotide sequence of VGAM441 RNA, herein designated VGAM RNA, also designated SEQ ID:3152.

Another function of VGAM441 is therefore inhibition of 5-hydroxytryptamine (serotonin) Receptor 4 (HTR4, Accession NM_000870), a gene which mediates calcium channel currents. Accordingly, utilities of VGAM441 include diagnosis, prevention and treatment of diseases and clinical conditions associated with HTR4. The function of HTR4 and its association with various diseases and clinical conditions, has been established by previous studies, as described hereinabove with reference to VGAM65. Jagged 1 (Alagille syndrome) (JAG1, Accession NM_000214) is another VGAM441 host target gene. JAG1 BINDING SITE is HOST TARGET binding site found in the 3' untranslated region of mRNA encoded by JAG1, corresponding to a HOST TARGET binding site such as BINDING SITE I, BINDING SITE II or BINDING SITE III. Table 2 illustrates the complementarity of the nucleotide sequences of JAG1 BINDING SITE, designated SEQ ID:5712, to the nucleotide sequence of VGAM441 RNA, herein designated VGAM RNA, also designated SEQ ID:3152.

Another function of VGAM441 is therefore inhibition of Jagged 1 (Alagille syndrome) (JAG1, Accession NM_000214). Accordingly, utilities of VGAM441 include diagnosis, prevention and treatment of diseases and clinical conditions associated with JAG1. DKFZP434P1750 (Accession NM_015527) is another VGAM441 host target gene. DKFZP434P1750 BINDING SITE is HOST TARGET binding site found in the 3' untranslated region of mRNA encoded by DKFZP434P1750, corresponding to a HOST TARGET binding site such as BINDING SITE I, BINDING SITE II or BINDING SITE III. Table 2 illustrates the complementarity of the nucleotide sequences of DKFZP434P1750 BINDING SITE, designated SEQ ID:17793, to the nucleotide sequence of VGAM441 RNA, herein designated VGAM RNA, also designated SEQ ID:3152.

Another function of VGAM441 is therefore inhibition of DKFZP434P1750 (Accession NM_015527). Accordingly, utilities of VGAM441 include diagnosis, prevention and treatment of diseases and clinical conditions associated with DKFZP434P1750. NCUBE1 (Accession NM_016021) is another VGAM441 host target gene. NCUBE1 BINDING SITE is HOST TARGET binding site found in the 3' untranslated region of mRNA encoded by NCUBE1, corresponding to a HOST TARGET binding site such as BINDING SITE I, BINDING SITE II or BINDING SITE III. Table 2 illustrates the complementarity of the nucleotide sequences of NCUBE1 BINDING SITE, designated SEQ ID:18094, to the nucleotide sequence of VGAM441 RNA, herein designated VGAM RNA, also designated SEQ ID:3152.

Another function of VGAM441 is therefore inhibition of NCUBE1 (Accession NM_016021). Accordingly, utilities of VGAM441 include diagnosis, prevention and treatment of diseases and clinical conditions associated with NCUBE1. NS1-BP (Accession XM_051877) is another VGAM441 host target gene. NS1-BP BINDING SITE is HOST TARGET binding site found in the 3' untranslated region of mRNA encoded by NS1-BP, corresponding to a HOST TARGET binding site such as BINDING SITE I, BINDING SITE II or BINDING SITE III. Table 2 illustrates the complementarity of the nucleotide sequences of NS1-BP BINDING SITE, designated SEQ ID:35914, to the nucleotide sequence of VGAM441 RNA, herein designated VGAM RNA, also designated SEQ ID:3152.

Another function of VGAM441 is therefore inhibition of NS1-BP (Accession XM_051877). Accordingly, utilities of VGAM441 include diagnosis, prevention and treatment of diseases and clinical conditions associated with NS1-BP. LOC132720 (Accession XM_059597) is another VGAM441 host target gene. LOC132720 BINDING SITE is HOST TARGET binding site found in the 3' untranslated region of mRNA encoded by LOC132720, corresponding to a HOST TARGET binding site such as BINDING SITE I, BINDING SITE II or BINDING SITE III. Table 2 illustrates the complementarity of the nucleotide sequences of LOC132720 BINDING SITE, designated SEQ ID:37028, to the nucleotide sequence of VGAM441 RNA, herein designated VGAM RNA, also designated SEQ ID:3152.

Another function of VGAM441 is therefore inhibition of LOC132720 (Accession XM_059597). Accordingly, utilities of VGAM441 include diagnosis, prevention and treatment of diseases and clinical conditions associated with LOC132720. LOC146957 (Accession XM_085652) is another VGAM441 host target gene. LOC146957 BINDING SITE is HOST TARGET binding site found in the 3' untranslated region of mRNA encoded by LOC146957, corresponding to a HOST TARGET binding site such as BINDING SITE I, BINDING SITE II or BINDING SITE III. Table 2 illustrates the complementarity of the nucleotide sequences of LOC146957 BINDING SITE, designated SEQ ID:38283, to the nucleotide sequence of VGAM441 RNA, herein designated VGAM RNA, also designated SEQ ID:3152.

Another function of VGAM441 is therefore inhibition of LOC146957 (Accession XM_085652). Accordingly, utilities of VGAM441 include diagnosis, prevention and treatment of diseases and clinical conditions associated with LOC146957. LOC158014 (Accession XM_088442) is another VGAM441 host target gene. LOC158014 BINDING SITE is HOST TARGET binding site found in the 5' untranslated region of mRNA encoded by LOC158014, corresponding to a HOST TARGET binding site such as BINDING SITE I, BINDING SITE II or BINDING SITE III. Table 2 illustrates the complementarity of the nucleotide sequences of LOC158014 BINDING SITE, designated SEQ ID:39688, to the nucleotide sequence of VGAM441 RNA, herein designated VGAM RNA, also designated SEQ ID:3152.

Another function of VGAM441 is therefore inhibition of LOC158014 (Accession XM_088442). Accordingly, utilities of VGAM441 include diagnosis, prevention and treatment of diseases and clinical conditions associated with LOC158014. LOC51339 (Accession NM_016651) is another VGAM441 host target gene. LOC51339 BINDING SITE is HOST TARGET binding site found in the 3' untranslated region of mRNA encoded by LOC51339, corresponding to a HOST TARGET binding site such as BINDING SITE I, BINDING SITE II or BINDING SITE III. Table 2 illustrates the complementarity of the nucleotide sequences of LOC51339 BINDING SITE, designated SEQ ID:18770, to the nucleotide sequence of VGAM441 RNA, herein designated VGAM RNA, also designated SEQ ID:3152.

Another function of VGAM441 is therefore inhibition of LOC51339 (Accession NM_016651). Accordingly, utilities of VGAM441 include diagnosis, prevention and treatment of diseases and clinical conditions associated with LOC51339. FIG. 1 further provides a conceptual description of a novel bioinformatically detected viral gene of the present invention, referred to here as Viral Genomic Address Messenger 442 (VGAM442) viral gene, which modulates expression of respective host target genes thereof, the function and utility of which host target genes is known in the art.

VGAM442 is a novel bioinformatically detected regulatory, non protein coding, viral micro RNA (miRNA) gene. The method by which VGAM442 was detected is described hereinabove with reference to FIGS. 1-8.

VGAM442 gene, herein designated VGAM GENE, is a viral gene contained in the genome of Vaccinia Virus. VGAM442 host target gene, herein designated VGAM HOST TARGET GENE, is a human gene contained in the human genome.

VGAM442 gene encodes a VGAM442 precursor RNA, herein designated VGAM PRECURSOR RNA. Similar to other miRNA genes, and unlike most ordinary genes, VGAM442 precursor RNA does not encode a protein. A nucleotide sequence identical or highly similar to the nucleotide sequence of VGAM442 precursor RNA is designated SEQ ID:428, and is provided hereinbelow with reference to the sequence listing part. Nucleotide sequence SEQ ID:428 is located at position 78761 relative to the genome of Vaccinia Virus.

VGAM442 precursor RNA folds onto itself, forming VGAM442 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM442 folded precursor RNA into VGAM442 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM442 RNA is designated SEQ ID:3153, and is provided hereinbelow with reference to the sequence listing part.

VGAM442 host target gene, herein designated VGAM HOST TARGET GENE, encodes a corresponding messenger RNA, VGAM442 host target RNA, herein designated VGAM HOST TARGET RNA. VGAM442 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM442 RNA, herein designated VGAM RNA, binds complementarily to one or more host target binding sites located in untranslated regions of VGAM442 host target RNA, herein designated VGAM HOST TARGET RNA. This complementary binding is due to the fact that the nucleotide sequence of VGAM442 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM442 RNA, herein designated VGAM RNA, may have a different number of host target binding sites in untranslated regions of a VGAM442 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM442 RNA, herein designated VGAM RNA, to host target binding sites on VGAM442 host target RNA, herein designated VGAM HOST TARGET RNA, such as BINDING SITE I, BINDING SITE II and BINDING SITE III, inhibits translation of VGAM442 host target RNA into VGAM442 host target protein, herein designated VGAM HOST TARGET PROTEIN. VGAM host target protein is therefore outlined by a broken line.

It is appreciated that VGAM442 host target gene, herein designated VGAM HOST TARGET GENE, in fact represents a plurality of VGAM442 host target genes. The mRNA of each one of this plurality of VGAM442 host target genes comprises one or more host binding sites, each having a nucleotide sequence which is at least partly complementary to VGAM442 RNA, herein designated VGAM RNA, and which when bound by VGAM442 RNA causes inhibition of translation of respective one or more VGAM442 host target proteins.

It is further appreciated by one skilled in the art that the mode of translational inhibition illustrated by FIG. 1 with specific reference to translational inhibition exerted by VGAM442 gene, herein designated VGAM GENE, on one or more VGAM442 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM442 is inhibition of expression of host target genes, as part of a novel viral mechanism of attacking a host. Accordingly, utilities of VGAM442 include diagnosis, prevention and treatment of viral infection by Vaccinia Virus. Specific functions, and accordingly utilities, of VGAM442 correlate with, and may be deduced from, the identity of the host target genes which VGAM442 binds and inhibits, and the function of these host target genes, as elaborated hereinbelow.

Nucleotide sequences of the VGAM442 precursor RNA, herein designated VGAM PRECURSOR RNA, and of the 'diced' VGAM442 RNA, herein designated VGAM RNA, and a schematic representation of the secondary folding of VGAM442 folded precursor RNA, herein designated VGAM FOLDED PRECURSOR RNA, of VGAM442 are further described hereinbelow with reference to Table 1.

Nucleotide sequences of host target binding sites, such as BINDING SITE-I, BINDING SITE-II and BINDING SITE-III of FIG. 1, found on VGAM442 host target RNA, and schematic representation of the complementarity of each of these host target binding sites to VGAM442 RNA, herein designated VGAM RNA, are described hereinbelow with reference to Table 2.

As mentioned hereinabove with reference to FIG. 1, a function of VGAM442 gene, herein designated VGAM is inhibition of expression of VGAM442 target genes. It is appreciated that specific functions, and accordingly utilities, of VGAM442 correlate with, and may be deduced from, the identity of the target genes which VGAM442 binds and inhibits, and the function of these target genes, as elaborated hereinbelow.

Kallmann Syndrome 1 Sequence (KAL1, Accession NM_000216) is a VGAM442 host target gene. KAL1 BINDING SITE is HOST TARGET binding site found in the 3' untranslated region of mRNA encoded by KAL1, corresponding to a HOST TARGET binding site such as BINDING SITE I, BINDING SITE II or BINDING SITE III. Table 2 illustrates the complementarity of the nucleotide sequences of KAL1 BINDING SITE, designated SEQ ID:5719, to the nucleotide sequence of VGAM442 RNA, herein designated VGAM RNA, also designated SEQ ID:3153.

A function of VGAM442 is therefore inhibition of Kallmann Syndrome 1 Sequence (KAL1, Accession NM_000216). Accordingly, utilities of VGAM442 include diagnosis, prevention and treatment of diseases and clinical conditions associated with KAL1. Synaptotagmin IV (SYT4, Accession XM_031162) is another VGAM442 host target gene. SYT4 BINDING SITE is HOST TARGET binding site found in the 3' untranslated region of mRNA encoded by SYT4, corresponding to a HOST TARGET binding site such as BINDING SITE I, BINDING SITE II or BINDING SITE III. Table 2 illustrates the complementarity of the nucleotide sequences of SYT4 BINDING SITE, designated SEQ ID:31292, to the nucleotide sequence of VGAM442 RNA, herein designated VGAM RNA, also designated SEQ ID:3153.

Another function of VGAM442 is therefore inhibition of Synaptotagmin IV (SYT4, Accession XM_031162), a gene which may be involved in ca2+-dependent exocytosis of secretory vesicles or may serve as ca2+ sensors in the process of vesicular trafficking and exocytosis. Accordingly, utilities of VGAM442 include diagnosis, prevention and treatment of diseases and clinical conditions associated with SYT4. The function of SYT4 and its association with various diseases and clinical conditions, has been established by previous studies, as described hereinabove with reference to VGAM200. KIAA0895 (Accession XM_166573) is another VGAM442 host target gene. KIAA0895 BINDING SITE is HOST TARGET binding site found in the 3' untranslated region of mRNA encoded by KIAA0895, corresponding to a HOST TARGET binding site such as BINDING SITE I, BINDING SITE II or BINDING SITE III. Table 2 illustrates the complementarity of the nucleotide sequences of KIAA0895 BINDING SITE, designated SEQ ID:44544, to the nucleotide sequence of VGAM442 RNA, herein designated VGAM RNA, also designated SEQ ID:3153.

Another function of VGAM442 is therefore inhibition of KIAA0895 (Accession XM_166573). Accordingly, utilities of VGAM442 include diagnosis, prevention and treatment of diseases and clinical conditions associated with KIAA0895. LOC161589 (Accession XM_090991) is another VGAM442 host target gene. LOC161589 BINDING SITE is HOST TARGET binding site found in the 5' untranslated region of mRNA encoded by LOC161589, corresponding to a HOST TARGET binding site such as BINDING SITE I, BINDING SITE II or BINDING SITE III. Table 2 illustrates the complementarity of the nucleotide sequences of LOC161589 BINDING SITE, designated SEQ ID:40024, to the nucleotide sequence of VGAM442 RNA, herein designated VGAM RNA, also designated SEQ ID:3153.

Another function of VGAM442 is therefore inhibition of LOC161589 (Accession XM_090991). Accordingly, utilities of VGAM442 include diagnosis, prevention and treatment of diseases and clinical conditions associated with LOC161589. FIG. 1 further provides a conceptual description of a novel bioinformatically detected viral gene of the present invention, referred to here as Viral Genomic Address Messenger 443 (VGAM443) viral gene, which modulates expression of respective host target genes thereof, the function and utility of which host target genes is known in the art.

VGAM443 is a novel bioinformatically detected regulatory, non protein coding, viral micro RNA (miRNA) gene. The method by which VGAM443 was detected is described hereinabove with reference to FIGS. 1-8.

VGAM443 gene, herein designated VGAM GENE, is a viral gene contained in the genome of Vaccinia Virus. VGAM443 host target gene, herein designated VGAM HOST TARGET GENE, is a human gene contained in the human genome.

VGAM443 gene encodes a VGAM443 precursor RNA, herein designated VGAM PRECURSOR RNA. Similar to other miRNA genes, and unlike most ordinary genes, VGAM443 precursor RNA does not encode a protein. A nucleotide sequence identical or highly similar to the nucleotide sequence of VGAM443 precursor RNA is designated SEQ ID:429, and is provided hereinbelow with reference to the sequence listing part. Nucleotide sequence SEQ ID:429 is located at position 81960 relative to the genome of Vaccinia Virus.

VGAM443 precursor RNA folds onto itself, forming VGAM443 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM443 folded precursor RNA into VGAM443 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM443 RNA is designated SEQ ID:3154, and is provided hereinbelow with reference to the sequence listing part.

VGAM443 host target gene, herein designated VGAM HOST TARGET GENE, encodes a corresponding messenger RNA, VGAM443 host target RNA, herein designated VGAM HOST TARGET RNA. VGAM443 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM443 RNA, herein designated VGAM RNA, binds complementarily to one or more host target binding sites located in untranslated regions of VGAM443 host target RNA, herein designated VGAM HOST TARGET RNA. This complementary binding is due to the fact that the nucleotide sequence of VGAM443 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM443 RNA, herein designated VGAM RNA, may have a different number of host target binding sites in untranslated regions of a VGAM443 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM443 RNA, herein designated VGAM RNA, to host target binding sites on VGAM443 host target RNA, herein designated VGAM HOST TARGET RNA, such as BINDING SITE I, BINDING SITE II and BINDING SITE III, inhibits translation of VGAM443 host target RNA into VGAM443 host target protein, herein designated VGAM HOST TARGET PROTEIN. VGAM host target protein is therefore outlined by a broken line.

It is appreciated that VGAM443 host target gene, herein designated VGAM HOST TARGET GENE, in fact represents a plurality of VGAM443 host target genes. The mRNA of each one of this plurality of VGAM443 host target genes comprises one or more host target binding sites, each having a nucleotide sequence which is at least partly complementary to VGAM443 RNA, herein designated VGAM RNA, and which when bound by VGAM443 RNA causes inhibition of translation of respective one or more VGAM443 host target proteins.

It is further appreciated by one skilled in the art that the mode of translational inhibition illustrated by FIG. 1 with specific reference to translational inhibition exerted by VGAM443 gene, herein designated VGAM GENE, on one or more VGAM443 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM443 is inhibition of expression of host target genes, as part of a novel viral mechanism of attacking a host. Accordingly, utilities of VGAM443 include diagnosis, prevention and treatment of viral infection by Vaccinia Virus. Specific functions, and accordingly utilities, of VGAM443 correlate with, and may be deduced from, the identity of the host target genes which VGAM443 binds and inhibits, and the function of these host target genes, as elaborated hereinbelow.

Nucleotide sequences of the VGAM443 precursor RNA, herein designated VGAM PRECURSOR RNA, and of the 'diced' VGAM443 RNA, herein designated VGAM RNA, and a schematic representation of the secondary folding of VGAM443 folded precursor RNA, herein designated VGAM FOLDED PRECURSOR RNA, of VGAM443 are further described hereinbelow with reference to Table 1.

Nucleotide sequences of host target binding sites, such as BINDING SITE-I, BINDING SITE-II and BINDING SITE-III of FIG. 1, found on VGAM443 host target RNA, and schematic representation of the complementarity of each of these host target binding sites to VGAM443 RNA, herein designated VGAM RNA, are described hereinbelow with reference to Table 2.

As mentioned hereinabove with reference to FIG. 1, a function of VGAM443 gene, herein designated VGAM is inhibition of expression of VGAM443 target genes. It is appreciated that specific functions, and accordingly utilities, of VGAM443 correlate with, and may be deduced from, the identity of the target genes which VGAM443 binds and inhibits, and the function of these target genes, as elaborated hereinbelow.

2',3'-cyclic Nucleotide 3' Phosphodiesterase (CNP, Accession NM_033133) is a VGAM443 host target gene. CNP BINDING SITE is HOST TARGET binding site found in the 3' untranslated region of mRNA encoded by CNP, corresponding to a HOST TARGET binding site such as BINDING SITE I, BINDING SITE II or BINDING SITE III. Table 2 illustrates the complementarity of the nucleotide sequences of CNP BINDING SITE, designated SEQ ID:26976, to the nucleotide sequence of VGAM443 RNA, herein designated VGAM RNA, also designated SEQ ID:3154.

A function of VGAM443 is therefore inhibition of 2',3'-cyclic Nucleotide 3' Phosphodiesterase (CNP, Accession NM_033133), a gene which can link tubulin to membranes and may regulate cytoplasmic microtubule distribution. Accordingly, utilities of VGAM443 include diagnosis, prevention and treatment of diseases and clinical conditions associated with CNP. The function of CNP has been established by previous studies. Cyclic nucleotide phosphodiesterase is a useful marker of myelin. CNPase is a membrane-bound enzyme found at high concentrations in central nervous system myelin and in the outer segments of photoreceptors in the retina (Vogel and Thompson, 1988). Two proteins with CNP activity are known to exist in brain and lymphoid tissues. They appear to be the products of distinct but related mRNA species. Kurihara et al. (1990) showed that the 2 gene products can arise by translation of 2 mRNAs alternatively spliced from a single transcript. In bovine and human brain, there appears to be a single species of mRNA (Vogel and Thompson, 1988), and the bovine brain and retinal forms of the enzyme appear to be identical in sequence Bifulco et al. (2002) demonstrated that CNP is firmly associated with tubulin (OMIM Ref. No. 602529) from brain tissue and thyroid cells. They showed that CNP acts as a microtubule-associated protein in promoting microtubule assembly. This activity was found to reside in the C terminus of the enzyme. The authors concluded that CNP is a membrane-bound microtubule-associated protein that can link tubulin to membranes and may regulate cytoplasmic microtubule distribution Full details of the abovementioned studies are described in the following publications, the disclosure of which are hereby incorporated by reference:

Vogel, U. S.; Thompson, R. J.: Molecular structure, localization, and possible functions of the myelin-associated enzyme 2-prime,3-prime-cyclic nucleotide 3-prime-phosphodiesterase. J. Neurochem. 50:1667-1677, 1988; and Bifulco, M.; Laezza, C.; Stingo, S.; Wolff, J.:2-prime,3-prime-cyclic nucleotide 3-prime-phosphodiesterase: a membrane-bound, microtubule-associated protein and membrane anchor for tub.

Further studies establishing the function and utilities of CNP are found in John Hopkins OMIM database record ID 123830, and in sited publications numbered 4336-4337, 4334-4335, 4330-433 and 4338-4340 listed in the bibliography section hereinbelow, which are also hereby incorporated by reference. Nuclear Receptor Coactivator 4 (NCOA4, Accession NM_005437) is another VGAM443 host target gene. NCOA4 BINDING SITE is HOST TARGET binding site found in the 3' untranslated region of mRNA encoded by NCOA4, corresponding to a HOST TARGET binding site such as BINDING SITE I, BINDING SITE II or BINDING SITE III. Table 2 illustrates the complementarity of the nucleotide sequences of NCOA4 BINDING SITE, designated SEQ ID:11922, to the nucleotide sequence of VGAM443 RNA, herein designated VGAM RNA, also designated SEQ ID:3154.

Another function of VGAM443 is therefore inhibition of Nuclear Receptor Coactivator 4 (NCOA4, Accession NM_005437), a gene which Binds and activates androgen receptor (AR) in ligand-dependent manner. Accordingly, utilities of VGAM443 include diagnosis, prevention and treatment of diseases and clinical conditions associated with NCOA4. The function of NCOA4 and its association with various diseases and clinical conditions, has been established by previous studies, as described hereinabove with reference to VGAM420. Transcription Factor Binding to IGHM Enhancer 3 (TFE3, Accession NM_006521) is another VGAM443 host target gene. TFE3 BINDING SITE is HOST TARGET binding site found in the 3' untranslated region of mRNA encoded by TFE3, corresponding to a HOST TARGET binding site such as BINDING SITE I, BINDING SITE II or BINDING SITE III. Table 2 illustrates the complementarity of the nucleotide sequences of TFE3 BINDING SITE, designated SEQ ID:13274, to the nucleotide sequence of VGAM443 RNA, herein designated VGAM RNA, also designated SEQ ID:3154.

Another function of VGAM443 is therefore inhibition of Transcription Factor Binding to IGHM Enhancer 3 (TFE3, Accession NM_006521), a gene which is a positive-acting transcription factor that binds to the immunoglobulin enchancer mue3 motif. Accordingly, utilities of VGAM443 include diagnosis, prevention and treatment of diseases and clinical conditions associated with TFE3. The function of TFE3 has been established by previous studies. TFE3, a member of the helix-loop-helix family of transcription factors, binds to the mu-E3 motif of the immunoglobulin heavy-chain enhancer and is expressed in many cell types. Henthorn et al. (1991) localized the TFE3 gene to the proximal short arm of the X chromosome using a somatic cell hybrid panel. A frequent RsaI RFLP detected by the TFE3 cDNA was found and used to confirm this location by linkage analysis, which placed TFE3 near markers in Xp11.22. In the course of high-resolution comparative mapping of the proximal region of the mouse X chromosome, Blair et al. (1995) mapped the Tfe3 gene to the same region as the Gata1 gene (OMIM Ref. No. 305371). Heimann et al. (2001) identified the ASPSCR1 gene, which they called RCC17, partnered with TFE3 in two 5-year-old Belgian girls of African origin in whom papillary renal cell carcinomas carried the translocation t (X;17) (p11.2; q25). In both patients, the t (X;17) fused the N terminal region of RCC17 to the C terminal region of TFE3 including the bHLH DNA-binding domain and the leucine zipper dimerization domain. The reciprocal fusion transcript TFE3/RCC17 was also expressed.

Full details of the abovementioned studies are described in the following publications, the disclosure of which are hereby incorporated by reference:

Heimann, P.; El Housni, H.; Ogur, G.; Weterman, M. A. J.; Petty, E. M.; Vassart, G.: Fusion of a novel gene, RCC17, to the TFE3 gene in t (X;17)(p11.2; q25.3)-bearing papillary renal cell carcinomas. Cancer Res. 61: 4130-4135, 2001; and Blair, H. J.; Ho, M.; Monaco, A. P.; Fisher, S.; Craig, I. W.; Boyd, Y.: High-resolution comparative mapping of the proximal region of the mouse X chromosome. Genomics 28:305-310, 199.

Further studies establishing the function and utilities of TFE3 are found in John Hopkins OMIM database record ID 314310, and in sited publications numbered 6569, 8207-8212, 1553, 8213-821 and 10617 listed in the bibliography section hereinbelow, which are also hereby incorporated by reference. Vacuolar Protein Sorting 26 (yeast) (VPS26, Accession NM_004896) is another VGAM443 host target gene. VPS26 BINDING SITE is HOST TARGET binding site found in the 3' untranslated region of mRNA encoded by VPS26, corresponding to a HOST TARGET binding site such as BINDING SITE I, BINDING SITE II or BINDING SITE III. Table 2 illustrates the complementarity of the nucleotide sequences of VPS26 BINDING SITE, designated SEQ ID:11329, to the nucleotide sequence of VGAM443 RNA, herein designated VGAM RNA, also designated SEQ ID:3154.

Another function of VGAM443 is therefore inhibition of Vacuolar Protein Sorting 26 (yeast) (VPS26, Accession NM_004896), a gene which is a sorting protein- ensures the proper delivery of organelle-specific proteins. Accordingly, utilities of VGAM443 include diagnosis, prevention and treatment of diseases and clinical conditions associated with VPS26. The function of VPS26 and its association with various diseases and clinical conditions, has been established by previous studies, as described hereinabove with reference to VGAM315. Caspase Recruitment Domain Family, Member 6 (CARD6, Accession NM_032587) is another VGAM443 host target gene. CARD6 BINDING SITE is HOST TARGET binding site found in the 3' untranslated region of mRNA encoded by CARD6, corresponding to a HOST TARGET binding site such as BINDING SITE I, BINDING SITE II or BINDING SITE III. Table 2 illustrates the complementarity of the nucleotide sequences of CARD6 BINDING SITE, designated SEQ ID:26322, to the nucleotide sequence of VGAM443 RNA, herein designated VGAM RNA, also designated SEQ ID:3154.

Another function of VGAM443 is therefore inhibition of Caspase Recruitment Domain Family, Member 6 (CARD6, Accession NM_032587). Accordingly, utilities of VGAM443 include diagnosis, prevention and treatment of diseases and clinical conditions associated with CARD6. DKFZp761K1423 (Accession NM_018422) is another VGAM443 host target gene. DKFZp761K1423 BINDING SITE is HOST TARGET binding site found in the 5' untranslated region of mRNA encoded by DKFZp761K1423, corresponding to a HOST TARGET binding site such as BINDING SITE I, BINDING SITE II or BINDING SITE III. Table 2 illustrates the complementarity of the nucleotide sequences of DKFZp761K1423 BINDING SITE, designated SEQ ID:20475, to the nucleotide sequence of VGAM443 RNA, herein designated VGAM RNA, also designated SEQ ID:3154.

Another function of VGAM443 is therefore inhibition of DKFZp761K1423 (Accession NM_018422). Accordingly, utilities of VGAM443 include diagnosis, prevention and treatment of diseases and clinical conditions associated with DKFZp761K1423. KIAA0090 (Accession XM_114045) is another VGAM443 host target gene. KIAA0090 BINDING SITE is HOST TARGET binding site found in the 3' untranslated region of mRNA encoded by KIAA0090, corresponding to a HOST TARGET binding site such as BINDING SITE I, BINDING SITE II or BINDING SITE III. Table 2 illustrates the complementarity of the nucleotide sequences of KIAA0090 BINDING SITE, designated SEQ ID:42655, to the nucleotide sequence of VGAM443 RNA, herein designated VGAM RNA, also designated SEQ ID:3154.

Another function of VGAM443 is therefore inhibition of KIAA0090 (Accession XM_114045). Accordingly, utilities of VGAM443 include diagnosis, prevention and treatment of diseases and clinical conditions associated with KIAA0090. KIAA0543 (Accession XM_044213) is another VGAM443 host target gene. KIAA0543 BINDING SITE is HOST TARGET binding site found in the 3' untranslated region of mRNA encoded by KIAA0543, corresponding to a HOST TARGET binding site such as BINDING SITE I, BINDING SITE II or BINDING SITE III. Table 2 illustrates the complementarity of the nucleotide sequences of KIAA0543 BINDING SITE, designated SEQ ID:34180, to the nucleotide sequence of VGAM443 RNA, herein designated VGAM RNA, also designated SEQ ID:3154.

Another function of VGAM443 is therefore inhibition of KIAA0543 (Accession XM_044213). Accordingly, utilities of VGAM443 include diagnosis, prevention and treatment of diseases and clinical conditions associated with KIAA0543. Lymphocyte Antigen 75 (LY75, Accession NM_002349) is another VGAM443 host target gene. LY75 BINDING SITE is HOST TARGET binding site found in the 3' untranslated region of mRNA encoded by LY75, corresponding to a HOST TARGET binding site such as BINDING SITE I, BINDING SITE II or BINDING SITE III. Table 2 illustrates the complementarity of the nucleotide sequences of LY75 BINDING SITE, designated SEQ ID:8152, to the nucleotide sequence of VGAM443 RNA, herein designated VGAM RNA, also designated SEQ ID:3154.

Another function of VGAM443 is therefore inhibition of Lymphocyte Antigen 75 (LY75, Accession NM_002349). Accordingly, utilities of VGAM443 include diagnosis, prevention and treatment of diseases and clinical conditions associated with LY75. LOC146179 (Accession XM_085354) is another VGAM443 host target gene. LOC146179 BINDING SITE is HOST TARGET binding site found in the 5' untranslated region of mRNA encoded by LOC146179, corresponding to a HOST TARGET binding site such as BINDING SITE I, BINDING SITE II or BINDING SITE III. Table 2 illustrates the complementarity of the nucleotide sequences of LOC146179 BINDING SITE, designated SEQ ID:38077, to the nucleotide sequence of VGAM443 RNA, herein designated VGAM RNA, also designated SEQ ID:3154.

Another function of VGAM443 is therefore inhibition of LOC146179 (Accession XM_085354). Accordingly, utilities of VGAM443 include diagnosis, prevention and treatment of diseases and clinical conditions associated with LOC146179. LOC221399 (Accession XM_168134) is another VGAM443 host target gene. LOC221399 BINDING SITE is HOST TARGET binding site found in the 5' untranslated region of mRNA encoded by LOC221399, corresponding to a HOST TARGET binding site such as BINDING SITE I, BINDING SITE II or BINDING SITE III. Table 2 illustrates the complementarity of the nucleotide sequences of LOC221399 BINDING SITE, designated SEQ ID:45053, to the nucleotide sequence of VGAM443 RNA, herein designated VGAM RNA, also designated SEQ ID:3154.

Another function of VGAM443 is therefore inhibition of LOC221399 (Accession XM_168134). Accordingly, utilities of VGAM443 include diagnosis, prevention and treatment of diseases and clinical conditions associated with LOC221399.

FIG. 1 further provides a conceptual description of a novel bioinformatically detected viral gene of the present invention, referred to here as Viral Genomic Address Messenger 444 (VGAM444) viral gene, which modulates expression of respective host target genes thereof, the function and utility of which host target genes is known in the art.

VGAM444 is a novel bioinformatically detected regulatory, non protein coding, viral micro RNA (miRNA) gene. The method by which VGAM444 was detected is described hereinabove with reference to FIGS. 1-8.

VGAM444 gene, herein designated VGAM GENE, is a viral gene contained in the genome of Vaccinia Virus. VGAM444 host target gene, herein designated VGAM HOST TARGET GENE, is a human gene contained in the human genome.

VGAM444 gene encodes a VGAM444 precursor RNA, herein designated VGAM PRECURSOR RNA. Similar to other miRNA genes, and unlike most ordinary genes, VGAM444 precursor RNA does not encode a protein. A nucleotide sequence identical or highly similar to the nucleotide sequence of VGAM444 precursor RNA is designated SEQ ID:430, and is provided hereinbelow with reference to the sequence listing part. Nucleotide sequence SEQ ID:430 is located at position 81204 relative to the genome of Vaccinia Virus.

VGAM444 precursor RNA folds onto itself, forming VGAM444 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM444 folded precursor RNA into VGAM444 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM444 RNA is designated SEQ ID:3155, and is provided hereinbelow with reference to the sequence listing part.

VGAM444 host target gene, herein designated VGAM HOST TARGET GENE, encodes a corresponding messenger RNA, VGAM444 host target RNA, herein designated VGAM HOST TARGET RNA. VGAM444 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM444 RNA, herein designated VGAM RNA, binds complementarily to one or more host target binding sites located in untranslated regions of VGAM444 host target RNA, herein designated VGAM HOST TARGET RNA. This complementary binding is due to the fact that the nucleotide sequence of VGAM444 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM444 RNA, herein designated VGAM RNA, may have a different number of host target binding sites in untranslated regions of a VGAM444 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM444 RNA, herein designated VGAM RNA, to host target binding sites on VGAM444 host target RNA, herein designated VGAM HOST TARGET RNA, such as BINDING SITE I, BINDING SITE II and BINDING SITE III, inhibits translation of VGAM444 host target RNA into VGAM444 host target protein, herein designated VGAM HOST TARGET PROTEIN. VGAM host target protein is therefore outlined by a broken line.

It is appreciated that VGAM444 host target gene, herein designated VGAM HOST TARGET GENE, in fact represents a plurality of VGAM444 host target genes. The mRNA of each one of this plurality of VGAM444 host target genes comprises one or more host target binding sites, each having a nucleotide sequence which is at least partly complementary to VGAM444 RNA, herein designated VGAM RNA, and which when bound by VGAM444 RNA causes inhibition of translation of respective one or more VGAM444 host target proteins.

It is further appreciated by one skilled in the art that the mode of translational inhibition illustrated by FIG. 1 with specific reference to translational inhibition exerted by VGAM444 gene, herein designated VGAM GENE, on one or more VGAM444 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM444 is inhibition of expression of host target genes, as part of a novel viral mechanism of attacking a host. Accordingly, utilities of VGAM444 include diagnosis, prevention and treatment of viral infection by Vaccinia Virus. Specific functions, and accordingly utilities, of VGAM444 correlate with, and may be deduced from, the identity of the host target genes which VGAM444 binds and inhibits, and the function of these host target genes, as elaborated hereinbelow.

Nucleotide sequences of the VGAM444 precursor RNA, herein designated VGAM PRECURSOR RNA, and of the 'diced' VGAM444 RNA, herein designated VGAM RNA, and a schematic representation of the secondary folding of VGAM444 folded precursor RNA, herein designated VGAM FOLDED PRECURSOR RNA, of VGAM444 are further described hereinbelow with reference to Table 1.

Nucleotide sequences of host target binding sites, such as BINDING SITE-I, BINDING SITE-II and BINDING SITE-III of FIG. 1, found on VGAM444 host target RNA, and schematic representation of the complementarity of each of these host target binding sites to VGAM444 RNA, herein designated VGAM RNA, are described hereinbelow with reference to Table 2.

As mentioned hereinabove with reference to FIG. 1, a function of VGAM444 gene, herein designated VGAM is inhibition of expression of VGAM444 target genes. It is appreciated that specific functions, and accordingly utilities, of VGAM444 correlate with, and may be deduced from, the identity of the target genes which VGAM444 binds and inhibits, and the function of these target genes, as elaborated hereinbelow.

Discs, Large (Drosophila) Homolog 5 (DLG5, Accession XM_096398) is a VGAM444 host target gene. DLG5 BINDING SITE is HOST TARGET binding site found in the 5' untranslated region of mRNA encoded by DLG5, corresponding to a HOST TARGET binding site such as BINDING SITE I, BINDING SITE II or BINDING SITE III. Table 2 illustrates the complementarity of the nucleotide sequences of DLG5 BINDING SITE, designated SEQ ID:40336, to the nucleotide sequence of VGAM444 RNA, herein designated VGAM RNA, also designated SEQ ID:3155.

A function of VGAM444 is therefore inhibition of Discs, Large (Drosophila) Homolog 5 (DLG5, Accession XM_096398), a gene which may transmit extracellular signals to inhibit cell proliferation. Accordingly, utilities of VGAM444 include diagnosis, prevention and treatment of diseases and clinical conditions associated with DLG5. The function of DLG5 has been established by previous studies. Vertebrate homologs of the Drosophila discs large (dlg) gene are members of the MAGUK (membrane-associated guanylate kinase) family. See 602887. MAGUK proteins contain PDZ motifs, an SH3 domain, and a guanylate kinase (GUK)-homologous region. Both the PDZ and GUK domains are thought to contribute to protein-protein interactions. By searching an EST database for sequences related to Drosophila dlg, Nakamura et al. (1998) identified cDNAs encoding a novel human homolog. Northern blot analysis revealed that the 9.4-kb transcript was highly expressed in placenta and prostate, as well as in several other tissues, leading the authors to designate the gene PDLG (placenta and prostate DLG). An additional 8.8-kb PDLG mRNA was detected in thyroid. The predicted 859-amino acid PDLG protein contains 3 PDZ domains, an SH3 domain, and a GUK region. PDLG is 45% and 40% identical to DLG1 (OMIM Ref. No. 601014) and Drosophila dlg, respectively. Western blot analysis of extracts of human prostate tissue and various cell lines showed that PDLG has an apparent molecular mass of 105 kD. Immunofluorescence experiments indicated that PDLG is localized at the plasma membrane and cytoplasm, and is expressed in the gland epithelial cells of normal prostate tissue but not in prostate cell lines. Using a yeast 2-hybrid screen, Nakamura et al. (1998) determined that PDLG interacts with the GUK domain of p55 (MPP1; 305360), a palmitoylated erythrocyte membrane MAGUK protein. The authors suggested that PDLG and p55 form a heteromeric MAGUK complex at the plasma membrane and cluster various intracellular molecules to play roles in maintaining the structure of epithelial cells and transmitting extracellular signals to the membrane and cytoskeleton. Independently, Nagase et al. (1998) identified KIAA0583, a DLG5 cDNA. By radiation hybrid analysis, they mapped the DLG5 gene to chromosome 10. Using the same technique, Nakamura et al. (1998) refined the localization of the DLG5 gene to 10q23.

Full details of the abovementioned studies are described in the following publications, the disclosure of which are hereby incorporated by reference:

Nagase, T.; Ishikawa, K.; Miyajima, N.; Tanaka, A.; Kotani, H.; Nomura, N.; Ohara, O.: Prediction of the coding sequences of unidentified human genes. IX. The complete sequences of 100 new cDNA clones from brain which can code for large proteins in vitro. DNA Res. 5:31-39, 1998; and Nakamura, H.; Sudo, T.; Tsuiki, H.; Miyake, H.; Morisaki, T.; Sasaki, J.; Masuko, N.; Kochi, M.; Ushio, Y.; Saya, H.: Identification of a novel human homolog of the Drosophila dlg, P-d.

Further studies establishing the function and utilities of DLG5 are found in John Hopkins OMIM database record ID 604090, and in sited publications numbered 6735 listed in the bibliography section hereinbelow, which are also hereby incorporated by reference. Fc Fragment of IgG, Low Affinity IIa, Receptor For (CD32) (FCGR2A, Accession XM_086483) is another VGAM444 host target gene. FCGR2A BINDING SITE is HOST TARGET binding site found in the 3" untranslated region of mRNA encoded by FCGR2A, corresponding to a HOST TARGET binding site such as BINDING SITE I, BINDING SITE II or BINDING SITE III. Table 2 illustrates the complementarity of the nucleotide sequences of FCGR2A BINDING SITE, designated SEQ ID:38699, to the nucleotide sequence of VGAM444 RNA, herein designated VGAM RNA, also designated SEQ ID:3155.

Another function of VGAM444 is therefore inhibition of Fc Fragment of IgG, Low Affinity IIa, Receptor For (CD32) (FCGR2A, Accession XM_086483), a gene which binds IgG immune complexes; member of the immunoglobulin superfamily. Accordingly, utilities of VGAM444 include diagnosis, prevention and treatment of diseases and clinical conditions associated with FCGR2A. The function of FCGR2A has been established by previous studies. Receptors for the Fc portion of IgG play an essential role in the protection of the organism against foreign antigens by removing antigen-antibody complexes from the circulation. Receptors are present on monocytes, macrophages, neutrophils, natural killer (NK) cells, and T and B lymphocytes, and they participate in diverse functions such as phagocytosis of immune complexes and modulation of antibody production by B cells. Hibbs et al. (1988) isolated cDNA clones for the FcGR gene by cross-species hybridization by probing cDNA libraries with a low-affinity FcGR beta-1 cDNA clone from mouse, as well as a pool of oligonucleotides constructed from the nucleotide sequence of this FcGR. Analysis of the amino acid sequence predicted from cDNA clones indicated that the human FcGR protein is synthesized with a 34-amino acid leader and that the mature protein is composed of 281 amino acids. The extracellular region of this FcGR was divided into 2 domains, which were very similar to each other and to the corresponding regions of both mouse alpha and beta FcGRs and showed a clear relationship to immunoglobulin variable regions. Grundy et al. (1988) mapped the immunoglobulin Fc receptor II and Fc receptor III genes to chromosome 1 by means of spot-blot analysis of sorted chromosomes. By hybridizing each probe to human DNA digested with 8 different 'rare-cutting' restriction enzymes and separated by pulsed field gel electrophoresis, Grundy et al. (1988) showed that the 2 genes mapped to the same fragment, the smallest of which was 250 kb long. Peltz et al. (1989) showed physical linkage of the 2 genes within a maximum distance of 200 kb. The conclusion on the basis of Southern and in situ data of Grundy et al. (1989) that there are three 8- to 10-kb Fc-gamma-RII loci per haploid genome was confirmed by Qiu et al. (1990), who named the genes A, A-prime, and B to reflect their homology and presumed evolution. Lebo et al. (1991) noted that occasionally these 3 genes, which lie within a 200-kb region, could be resolved in individual metaphase chromatids by multicolor fluorescence in situ hybridization. By in situ hybridization, Sammartino et al. (1988) assigned the IGFR2 gene to 1q23-q24. In the course of constructing a physical map of human 1q21-q23, Oakey et al. (1992) placed FCGR2A in that region, close to MPP (OMIM Ref. No. 159440) and APOA2 (OMIM Ref. No. 107670). The homologous gene in the mouse, Ly-17, maps to mouse chromosome 1 (Hibbs et al., 1985). See review by Unkeless (1989).

Full details of the abovementioned studies are described in the following publications, the disclosure of which are hereby incorporated by reference:

Peltz, G. A.; Grundy, H. O.; Lebo, R. V.; Yssel, H.; Barsh, G. S.; Moore, K. W.: Human Fc-gamma-RIII: cloning, expression, and identification of the chromosomal locus of two Fc receptors for IgG. Proc. Nat. Acad. Sci. 86:1013-1017, 1989; and Salmon, J. E.; Millard, S.; Schachter, L. A.; Arnett, F. C.; Ginzler, E. M.; Gourley, M. F.; Ramsey-Goldman, R.; Peterson, M. G. E.; Kimberly, R. P.: Fc-gamma-RIIA alleles are heritabl.

Further studies establishing the function and utilities of FCGR2A are found in John Hopkins OMIM database record ID 146790, and in sited publications numbered 392 and 3930-3940 listed in the bibliography section hereinbelow, which are also hereby incorporated by reference. Lysophospholipase I (LYPLA1, Accession NM_006330) is another VGAM444 host target gene. LYPLA1 BINDING SITE is HOST TARGET binding site found in the 3' untranslated region of mRNA encoded by LYPLA1, corresponding to a HOST TARGET binding site such as BINDING SITE I, BINDING SITE II or BINDING SITE III. Table 2 illustrates the complementarity of the nucleotide sequences of LYPLA1 BINDING SITE, designated SEQ ID:13027, to the nucleotide sequence of VGAM444 RNA, herein designated VGAM RNA, also designated SEQ ID:3155.

Another function of VGAM444 is therefore inhibition of Lysophospholipase I (LYPLA1, Accession NM_006330). Accordingly, utilities of VGAM444 include diagnosis, prevention and treatment of diseases and clinical conditions associated with LYPLA1. Prodynorphin (PDYN, Accession NM_024411) is another VGAM444 host target gene. PDYN BINDING SITE is HOST TARGET binding site found in the 3' untranslated region of mRNA encoded by PDYN, corresponding to a HOST TARGET binding site such as BINDING SITE I, BINDING SITE II or BINDING SITE III. Table 2 illustrates the complementarity of the nucleotide sequences of PDYN BINDING SITE, designated SEQ ID:23652, to the nucleotide sequence of VGAM444 RNA, herein designated VGAM RNA, also designated SEQ ID:3155.

Another function of VGAM444 is therefore inhibition of Prodynorphin (PDYN, Accession NM_024411), a gene which is an opioid peptide acting on the kappa-receptor. Accordingly, utilities of VGAM444 include diagnosis, prevention and treatment of diseases and clinical conditions associated with PDYN. The function of PDYN has been established by previous studies. Horikawa et al. (1983) cloned a human genomic DNA segment containing the preproenkephalin B gene. From studies of the gene for porcine preproenkephalin B, it is known to contain the determinants for neoendorphin, dynorphin, and leumorphin (containing rimorphin in its amino-terminus). These opioid peptides, each with a leucine-enkephalin structure, act on the kappa-receptor. The structural organization of the gene resembles that of the genes encoding the other opioid peptide precursors, preproenkephalin A (OMIM Ref. No. 131330) and preproopiomelanocortin (OMIM Ref. No. 176830). Litt et al. (1987, 1988) assigned the PDYN gene to human chromosome 20 by Southern blot analysis of DNAs from a rodent-human somatic cell hybrid panel. In situ hybridization to metaphase chromosomes confirmed this assignment and indicated the regional localization to be 20pter-p12. Summar et al. (1990) demonstrated very close linkage of PDYN with ARVP (OMIM Ref. No. 192340) and OT (OMIM Ref. No. 167050); no recombinants were found with a lod score of 5.2. This cluster of genes appears to be located about 15 cM distal to D20S5, which is located near the middle of the short arm at 20p12.21. In connection with this close proximity of the genes, it is noteworthy that the ARVP and PDYN peptides are coexcreted in the same neurosecretory granules of some pituitary axons and that increased transcription of both genes occurs with osmotic stimulation. Temporal lobe epilepsy is a common, heterogeneous epilepsy syndrome with both environmental and genetic factors playing a role in its etiology (Berkovic et al., 1996; Cendes et al., 1998). Ottman et al. (1995) localized a gene for partial epilepsy with auditory features (OMIM Ref. No. 600512) to 10q; by a positional candidate gene approach, Kalachikov et al. (2002) found that mutations in the LGI1 gene are responsible for this form of temporal lobe epilepsy. Stogmann et al. (2002) performed a case control association study in 155 patients with nonlesional temporal lobe epilepsy and 202 controls, and found that the PDYN promoter low-expression L alleles (1 or 2 repeats) conferred an increased risk for temporal lobe epilepsy in patients with a family history for seizures. Irrespective of the familial background, L homozygotes displayed a higher risk for secondarily generalized seizures and status epilepticus.

Full details of the abovementioned studies are described in the following publications, the disclosure of which are hereby incorporated by reference:

Summar, M. L.; Phillips, J. A., III; Battey, J.; Castiglione, C. M.; Kidd, K. K.; Maness, K. J.; Weiffenbach, B.; Gravius, T. C.: Linkage relationships of human arginine vasopressin-neurophysin-II and oxytocin-neurophysin-I to prodynorphin and other loci on chromosome 20. Molec. Endocr. 4:947-950, 1990; and Stogmann, E.; Zimprich, A.; Baumgartner, C.; Aull-Watschinger, S.; Hollt, V.; Zimprich, F.: A functional polymorphism in the prodynorphin gene promoter is associated with temporal lobe.

Further studies establishing the function and utilities of PDYN are found in John Hopkins OMIM database record ID 131340, and in sited publications numbered 3568-3570, 4227-356 and 4571-4574 listed in the bibliography section hereinbelow, which are also hereby incorporated by reference. V-ski Sarcoma Viral Oncogene Homolog (avian) (SKI, Accession NM_003036) is another VGAM444 host target gene. SKI BINDING SITE is HOST TARGET binding site found in the 3' untranslated region of mRNA encoded by SKI, corresponding to a HOST TARGET binding site such as BINDING SITE I, BINDING SITE II or BINDING SITE III. Table 2 illustrates the complementarity of the nucleotide sequences of SKI BINDING SITE, designated SEQ ID:8988, to the nucleotide sequence of VGAM444 RNA, herein designated VGAM RNA, also designated SEQ ID:3155.

Another function of VGAM444 is therefore inhibition of V-ski Sarcoma Viral Oncogene Homolog (avian) (SKI, Accession NM_003036). Accordingly, utilities of VGAM444 include diagnosis, prevention and treatment of diseases and clinical conditions associated with SKI. KIAA0652 (Accession NM_014741) is another VGAM444 host target gene. KIAA0652 BINDING SITE is HOST TARGET binding site found in the 3' untranslated region of mRNA encoded by KIAA0652, corresponding to a HOST TARGET binding site such as BINDING SITE I, BINDING SITE II or BINDING SITE III. Table 2 illustrates the complementarity of the nucleotide sequences of KIAA0652 BINDING SITE, designated SEQ ID:16408, to the nucleotide sequence of VGAM444 RNA, herein designated VGAM RNA, also designated SEQ ID:3155.

Another function of VGAM444 is therefore inhibition of KIAA0652 (Accession NM_014741). Accordingly, utilities of VGAM444 include diagnosis, prevention and treatment of diseases and clinical conditions associated with KIAA0652. MGC2452 (Accession NM_032644) is another VGAM444 host target gene. MGC2452 BINDING SITE is HOST TARGET binding site found in the 5' untranslated region of mRNA encoded by MGC2452, corresponding to a HOST TARGET binding site such as BINDING SITE I, BINDING SITE II or BINDING SITE III. Table 2 illustrates the complementarity of the nucleotide sequences of MGC2452 BINDING SITE, designated SEQ ID:26369, to the nucleotide sequence of VGAM444 RNA, herein designated VGAM RNA, also designated SEQ ID:3155.

Another function of VGAM444 is therefore inhibition of MGC2452 (Accession NM_032644). Accordingly, utilities of VGAM444 include diagnosis, prevention and treatment of diseases and clinical conditions associated with MGC2452. Phospholipase A2, Group VI (cytosolic, calcium-independent) (PLA2G6, Accession XM_039248) is another VGAM444 host target gene. PLA2G6 BINDING SITE is HOST TARGET binding site found in the 3' untranslated region of mRNA encoded by PLA2G6, corresponding to a HOST TARGET binding site such as BINDING SITE I, BINDING SITE II or BINDING SITE III. Table 2 illustrates the complementarity of the nucleotide sequences of PLA2G6 BINDING SITE, designated SEQ ID:33029, to the nucleotide sequence of VGAM444 RNA, herein designated VGAM RNA, also designated SEQ ID:3155.

Another function of VGAM444 is therefore inhibition of Phospholipase A2, Group VI (cytosolic, calcium-independent) (PLA2G6, Accession XM_039248). Accordingly, utilities of VGAM444 include diagnosis, prevention and treatment of diseases and clinical conditions associated with PLA2G6. LOC145447 (Accession XM_085133) is another VGAM444 host target gene. LOC145447 BINDING SITE is HOST TARGET binding site found in the 5' untranslated region of mRNA encoded by LOC145447, corresponding to a HOST TARGET binding site such as BINDING SITE I, BINDING SITE II or BINDING SITE III. Table 2 illustrates the complementarity of the nucleotide sequences of LOC145447 BINDING SITE, designated SEQ ID:37861, to the nucleotide sequence of VGAM444 RNA, herein designated VGAM RNA, also designated SEQ ID:3155.

Another function of VGAM444 is therefore inhibition of LOC145447 (Accession XM_085133). Accordingly, utilities of VGAM444 include diagnosis, prevention and treatment of diseases and clinical conditions associated with LOC145447. LOC149711 (Accession XM_097720) is another VGAM444 host target gene. LOC149711 BINDING SITE is HOST TARGET binding site found in the 5' untranslated region of mRNA encoded by LOC149711, corresponding to a HOST TARGET binding site such as BINDING SITE I, BINDING SITE II or BINDING SITE III. Table 2 illustrates the complementarity of the nucleotide sequences of LOC149711 BINDING SITE, designated SEQ ID:41071, to the nucleotide sequence of VGAM444 RNA, herein designated VGAM RNA, also designated SEQ ID:3155.

Another function of VGAM444 is therefore inhibition of LOC149711 (Accession XM_097720). Accordingly, utilities of VGAM444 include diagnosis, prevention and treatment of diseases and clinical conditions associated with LOC149711. LOC253786 (Accession XM_173109) is another VGAM444 host target gene. LOC253786 BINDING SITE is HOST TARGET binding site found in the 3' untranslated region of mRNA encoded by LOC253786, corresponding to a HOST TARGET binding site such as BINDING SITE I, BINDING SITE II or BINDING SITE III. Table 2 illustrates the complementarity of the nucleotide sequences of LOC253786 BINDING SITE, designated SEQ ID:46363, to the nucleotide sequence of VGAM444 RNA, herein designated VGAM RNA, also designated SEQ ID:3155.

Another function of VGAM444 is therefore inhibition of LOC253786 (Accession XM_173109). Accordingly, utilities of VGAM444 include diagnosis, prevention and treatment of diseases and clinical conditions associated with LOC253786. FIG. 1 further provides a conceptual description of a novel bioinformatically detected viral gene of the present invention, referred to here as Viral Genomic Address Messenger 445 (VGAM445) viral gene, which modulates expression of respective host target genes thereof, the function and utility of which host target genes is known in the art.

VGAM445 is a novel bioinformatically detected regulatory, non protein coding, viral micro RNA (miRNA) gene. The method by which VGAM445 was detected is described hereinabove with reference to FIGS. 1-8.

VGAM445 gene, herein designated VGAM GENE, is a viral gene contained in the genome of Human Papillomavirus Type 17. VGAM445 host target gene, herein designated VGAM HOST TARGET GENE, is a human gene contained in the human genome.

VGAM445 gene encodes a VGAM445 precursor RNA, herein designated VGAM PRECURSOR RNA. Similar to other miRNA genes, and unlike most ordinary genes, VGAM445 precursor RNA does not encode a protein. A nucleotide sequence identical or highly similar to the nucleotide sequence of VGAM445 precursor RNA is designated SEQ ID:431, and is provided hereinbelow with reference to the sequence listing part. Nucleotide sequence SEQ ID:431 is located at position 358 relative to the genome of Human Papillomavirus Type 17.

VGAM445 precursor RNA folds onto itself, forming VGAM445 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM445 folded precursor RNA into VGAM445 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM445 RNA is designated SEQ ID:3156, and is provided hereinbelow with reference to the sequence listing part.

VGAM445 host target gene, herein designated VGAM HOST TARGET GENE, encodes a corresponding messenger RNA, VGAM445 host target RNA, herein designated VGAM HOST TARGET RNA. VGAM445 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM445 RNA, herein designated VGAM RNA, binds complementarily to one or more host target binding sites located in untranslated regions of VGAM445 host target RNA, herein designated VGAM HOST TARGET RNA. This complementary binding is due to the fact that the nucleotide sequence of VGAM445 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM445 RNA, herein designated VGAM RNA, may have a different number of host target binding sites in untranslated regions of a VGAM445 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM445 RNA, herein designated VGAM RNA, to host target binding sites on VGAM445 host target RNA, herein designated VGAM HOST TARGET RNA, such as BINDING SITE I, BINDING SITE II and BINDING SITE III, inhibits translation of VGAM445 host target RNA into VGAM445 host target protein, herein designated VGAM HOST TARGET PROTEIN. VGAM host target protein is therefore outlined by a broken line.

It is appreciated that VGAM445 host target gene, herein designated VGAM HOST TARGET GENE, in fact represents a plurality of VGAM445 host target genes. The mRNA of each one of this plurality of VGAM445 host target genes comprises one or more host target binding sites, each having a nucleotide sequence which is at least partly complementary to VGAM445 RNA, herein designated VGAM RNA, and which when bound by VGAM445 RNA causes inhibition of translation of respective one or more VGAM445 host target proteins.

It is further appreciated by one skilled in the art that the mode of translational inhibition illustrated by FIG. 1 with specific reference to translational inhibition exerted by VGAM445 gene, herein designated VGAM GENE, on one or more VGAM445 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM445 is inhibition of expression of host target genes, as part of a novel viral mechanism of attacking a host. Accordingly, utilities of VGAM445 include diagnosis, prevention and treatment of viral infection by Human Papillomavirus Type 17. Specific functions, and accordingly utilities, of VGAM445 correlate with, and may be deduced from, the identity of the host target genes which VGAM445 binds and inhibits, and the function of these host target genes, as elaborated hereinbelow.

Nucleotide sequences of the VGAM445 precursor RNA, herein designated VGAM PRECURSOR RNA, and of the 'diced' VGAM445 RNA, herein designated VGAM RNA, and a schematic representation of the secondary folding of VGAM445 folded precursor RNA, herein designated VGAM FOLDED PRECURSOR RNA, of VGAM445 are further described hereinbelow with reference to Table 1.

Nucleotide sequences of host target binding sites, such as BINDING SITE-I, BINDING SITE-II and BINDING SITE-III of FIG. 1, found on VGAM445 host target RNA, and schematic representation of the complementarity of each of these host target binding sites to VGAM445 RNA, herein designated VGAM RNA, are described hereinbelow with reference to Table 2.

As mentioned hereinabove with reference to FIG. 1, a function of VGAM445 gene, herein designated VGAM is inhibition of expression of VGAM445 target genes. It is appreciated that specific functions, and accordingly utilities, of VGAM445 correlate with, and may be deduced from, the identity of the target genes which VGAM445 binds and inhibits, and the function of these target genes, as elaborated hereinbelow.

Annexin A4 (ANXA4, Accession XM_031596) is a VGAM445 host target gene. ANXA4 BINDING SITE is HOST TARGET binding site found in the 3' untranslated region of mRNA encoded by ANXA4, corresponding to a HOST TARGET binding site such as BINDING SITE I, BINDING SITE II or BINDING SITE III. Table 2 illustrates the complementarity of the nucleotide sequences of ANXA4 BINDING SITE, designated SEQ ID:31444, to the nucleotide sequence of VGAM445 RNA, herein designated VGAM RNA, also designated SEQ ID:3156.

A function of VGAM445 is therefore inhibition of Annexin A4 (ANXA4, Accession XM_031596), a gene which inhibits phospholipase_A2 activity. Accordingly, utilities of VGAM445 include diagnosis, prevention and treatment of diseases and clinical conditions associated with ANXA4. The function of ANXA4 has been established by previous studies. The annexins, or lipocortins, are a family of calcium-dependent phospholipid-binding proteins whose normal function is uncertain. Annexin IV, otherwise known as placental anticoagulant protein II, was 1 of the 4 annexins isolated from human placenta on the basis of their in vitro anticoagulant activity. Grundmann et al. (1988) reported a cDNA clone for annexin IV. Hauptmann et al. (1989) showed that annexin IV has 45 to 59% identity with other members of the annexin family. By PCR analysis of somatic cell hybrids and in situ hybridization with a cDNA probe, Tait et al. (1992) mapped the human ANXA4 gene to 2p13. Genomic Southern blotting with a cDNA probe indicated a gene size of 18- to 56-kb. DNA sequence analysis demonstrated a single intron with exon-intron boundaries in exactly the same position as in the mouse annexin I and annexin II genes. Barrow et al. (1994) demonstrated that the Anxa4 gene is located on mouse chromosome 6 in a region of conserved synteny with human chromosome 2

Full details of the abovementioned studies are described in the following publications, the disclosure of which are hereby incorporated by reference:

Barrow, L. L.; Simin, K.; Jones, J. M.; Lee, D. C.; Meisler, M. H.: Conserved linkage of early growth response 4, annexin 4, and transforming growth factor alpha on mouse chromosome 6. Genomics 19:388-390, 1994; and Grundmann, U.; Amann, E.; Abel, K.-J.; Kupper, H. A.: Isolation and expression of cDNA coding for a new member of the phospholipase A2 inhibitor family. Behring Inst. Mitt. 82:59-67.

Further studies establishing the function and utilities of ANXA4 are found in John Hopkins OMIM database record ID 106491, and in sited publications numbered 11668-4844 listed in the bibliography section hereinbelow, which are also hereby incorporated by reference. Adenomatosis Polyposis Coli (APC, Accession NM_000038) is another VGAM445 host target gene. APC BINDING SITE is HOST TARGET binding site found in the 3' untranslated region of mRNA encoded by APC, corresponding to a HOST TARGET binding site such as BINDING SITE I, BINDING SITE II or BINDING SITE III. Table 2 illustrates the complementarity of the nucleotide sequences of APC BINDING SITE, designated SEQ ID:5480, to the nucleotide sequence of VGAM445 RNA, herein designated VGAM RNA, also designated SEQ ID:3156.

Another function of VGAM445 is therefore inhibition of Adenomatosis Polyposis Coli (APC, Accession NM_000038). Accordingly, utilities of VGAM445 include diagnosis, prevention and treatment of diseases and clinical conditions associated with APC. Centaurin, Delta 1 (CENTD1, Accession NM_139182) is another VGAM445 host target gene. CENTD1 BINDING SITE1 and CENTD1 BINDING SITE2 are HOST TARGET binding sites found in untranslated regions of mRNA encoded by CENTD1, corresponding to HOST TARGET binding sites such as BINDING SITE I, BINDING SITE II or BINDING SITE III. Table 2 illustrates the complementarity of the nucleotide sequences of CENTD1 BINDING SITE1 and CENTD1 BINDING SITE2, designated SEQ ID:29197 and SEQ ID:17560 respectively, to the nucleotide sequence of VGAM445 RNA, herein designated VGAM RNA, also designated SEQ ID:3156.

Another function of VGAM445 is therefore inhibition of Centaurin, Delta 1 (CENTD1, Accession NM_139182), a gene which is nvolved in cell signaling/communication. Accordingly, utilities of VGAM445 include diagnosis, prevention and treatment of diseases and clinical conditions associated with CENTD1. The function of CENTD1 has been established by previous studies. By screening brain cDNAs for the potential to encode proteins that are at least 50 kD, Nagase et al. (1998) identified a partial cDNA encoding CENTD1, which they called KIAA0580. The protein was predicted to be involved in cell signaling/communication. RT-PCR analysis detected expression of KIAA0580 in all tissues tested except skeletal muscle. By searching sequence databases, followed by 5-prime RACE, Miura et al. (2002) obtained full-length cDNAs encoding CENTD1 and CENTD2 (OMIM Ref. No. 606646), which they called ARAP2 and ARAP1, respectively. Like ARAP1, the 1,704-amino acid ARAP2 protein contains ARF-GAP (see OMIM Ref. No. 103180), RHO-GAP (see OMIM Ref. No. 602732), ankyrin repeat (see OMIM Ref. No. 605787), RAS (OMIM Ref. No. 190020)-associating, and 5 pleckstrin (OMIM Ref. No. 173570) homology (PH) domains. However, unlike ARAP1, ARAP2 also has a sterile alpha motif (SAM) domain like that found in EphA receptor (see OMIM Ref. No. 179610) and a region of homology to the switch-2 domain of RAB13 (OMIM Ref. No. 602672). The RHO-GAP domain of ARAP2 lacks the predicted catalytic arginine and is therefore unlikely to have RHO-GAP activity. Northern blot analysis showed that ARAP2 is much more variably expressed than ARAP1. The highest ARAP2 expression levels were in brain, thymus, spleen, kidney, peripheral blood leukocytes, lymph node, spinal cord, and thyroid. Two messages at 7.5 and 11 kb were found in brain, and 7.5- and 8.5-kb messages were found in thymus, spleen, kidney, peripheral blood leukocytes, and lymph node. Of the hematopoietic tissues examined, only bone marrow did not show ARAP2 expression.

Full details of the abovementioned studies are described in the following publications, the disclosure of which are hereby incorporated by reference:

Miura, K.; Jacques, K. M.; Stauffer, S.; Kubosaki, A.; Zhu, K.; Hirsch, D. S.; Resau, J.; Zheng, Y.; Randazzo, P. A.: ARAP1: a point of convergence for Arf and Rho signaling. Molec. Cell 9:109-119, 2002; and Nagase, T.; Ishikawa, K.; Miyajima, N.; Tanaka, A.; Kotani, H.; Nomura, N.; Ohara, O.: Prediction of the coding sequences of unidentified human genes. IX. The complete sequences of 10.

Further studies establishing the function and utilities of CENTD1 are found in John Hopkins OMIM database record ID 606645, and in sited publications numbered 612 and 6735 listed in the bibliography section hereinbelow, which are also hereby incorporated by reference. Guanine Nucleotide Binding Protein (G protein), Beta Polypeptide 1 (GNB1, Accession NM_002074) is another VGAM445 host target gene. GNB1 BINDING SITE is HOST TARGET binding site found in the 3' untranslated region of mRNA encoded by GNB1, corresponding to a HOST TARGET binding site such as BINDING SITE I, BINDING SITE II or BINDING SITE III. Table 2 illustrates the complementarity of the nucleotide sequences of GNB1 BINDING SITE, designated SEQ ID:7847, to the nucleotide sequence of VGAM445 RNA, herein designated VGAM RNA, also designated SEQ ID:3156.

Another function of VGAM445 is therefore inhibition of Guanine Nucleotide Binding Protein (G protein), Beta Polypeptide 1 (GNB1, Accession NM_002074). Accordingly, utilities of VGAM445 include diagnosis, prevention and treatment of diseases and clinical conditions associated with GNB1. Janus Kinase 2 (a protein tyrosine kinase) (JAK2, Accession NM_004972) is another VGAM445 host target gene. JAK2 BINDING SITE is HOST TARGET binding site found in the 3' untranslated region of mRNA encoded by JAK2, corresponding to a HOST TARGET binding site such as BINDING SITE I, BINDING SITE II or BINDING SITE III. Table 2 illustrates the complementarity of the nucleotide sequences of JAK2 BINDING SITE, designated SEQ ID:11416, to the nucleotide sequence of VGAM445 RNA, herein designated VGAM RNA, also designated SEQ ID:3156.

Another function of VGAM445 is therefore inhibition of Janus Kinase 2 (a protein tyrosine kinase) (JAK2, Accession NM_004972), a gene which tyrosine kinase of the non-receptor type, involved in interleukin 3 signal transduction. Accordingly, utilities of VGAM445 include diagnosis, prevention and treatment of diseases and clinical conditions associated with JAK2. The function of JAK2 has been established by previous studies. JAK2 kinase is a member of a family of tyrosine kinases involved in cytokine receptor signaling. See 147795 for background information on Janus kinases In addition to its role as a kidney cytokine regulating hematopoiesis, erythropoietin (OMIM Ref. No. 133170) is also produced in the brain after oxidative or nitrosative stress. The transcription factor HIF1 (OMIM Ref. No. 603348) upregulates erythropoietin following hypoxic stimuli. Digicaylioglu and Lipton (2001) demonstrated that preconditioning with erythropoietin protects neurons in models of ischemic and degenerative damage due to excitotoxins and consequent generation of free radicals, including nitric oxide. Activation of neuronal erythropoietin receptors (EPOR; 133171) prevents apoptosis induced by NMDA or nitric oxide by triggering crosstalk between the signaling pathways JAK2 and NFKB (see OMIM Ref. No. 164011). Digicaylioglu and Lipton (2001) demonstrated that erythropoietin receptor-mediated activation of JAK2 leads to phosphorylation of the inhibitor of NFKB (I-kappa-B-alpha; 164008), subsequent nuclear translocation of the transcription factor NFKB, and NFKB-dependent transcription of neuroprotective genes. Transfection of cerebrocortical neurons with a dominant interfering form of JAK2 or an I-kappa-B-alpha superrepressor blocks erythropoietin-mediated prevention of neuronal apoptosis. Thus, neuronal erythropoietin receptors activate a neuroprotective pathway that is distinct from previously well characterized JAK and NFKB functions. Moreover, this erythropoietin effect may underlie neuroprotection mediated by hypoxic-ischemic preconditioning. Huang et al. (2001) showed that JAK2, and more specifically just its intact N-terminal domain, binds to EPOR in the endoplasmic reticulum and promotes its cell surface expression. This interaction was specific, as JAK1 had no effect. Residues 32 to 58 of the JAK2 JH7 domain were required for EPOR surface expression. Alanine scanning mutagenesis of the EPOR membrane proximal region revealed 2 modes of EPOR-JAK2 interaction. A continuous block of EPOR residues was required for functional, ligand-independent binding to JAK2 and cell surface receptor expression, whereas 4 specific residues were essential in switching on prebound JAK2 after ligand binding. Thus, in addition to its kinase activity required for cytokine receptor signaling, JAK is also an essential subunit required for surface expression of cytokine receptors. Animal model experiments lend further support to the function of JAK2. Neubauer et al. (1998) also performed a targeted inactivation of Jak2 in mice. Jak2 -/- embryos were anemic and died around day 12.5 postcoitum. Primitive erythrocytes were found, but definitive erythropoiesis was absent. Compared to erythropoietin receptor-deficient mice, the phenotype of Jak2 deficiency was more severe. Fetal liver BFU-E and CFU-E colonies were completely absent. However, multilineage hematopoietic stem cells (CD34-low, c-kit-pos) were found, and B lymphopoiesis appeared intact. In contrast to IFN-alpha stimulation, Jak2 -/- cells did not respond to IFN-gamma. Jak2 -/- embryonic stem cells were competent for LIF signaling. These data also demonstrated that Jak2 has pivotal functions for signal transduction of a set of cytokine receptors required in definitive erythropoiesis It is appreciated that the abovementioned animal model for JAK2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Neubauer, H.; Cumano, A.; Muller, M.; Wu, H.; Huffstadt, U.; Pfeffer, K.: Jak2 deficiency defines an essential developmental checkpoint in definitive hematopoiesis. Cell 93:397-409, 1998; and Digicaylioglu, M.; Lipton, S. A.: Erythropoietin-mediated neuroprotection involves cross-talk between Jak2 and NF-kappa-B signalling cascades. Nature 412:641-647, 2001.

Further studies establishing the function and utilities of JAK2 are found in John Hopkins OMIM database record ID 147796, and in sited publications numbered 11678, 11675, 11679-11681, 1167 and 11682-11684 listed in the bibliography section hereinbelow, which are also hereby incorporated by reference. Junctional Adhesion Molecule 3 (JAM3, Accession NM_032801) is another VGAM445 host target gene. JAM3 BINDING SITE is HOST TARGET binding site found in the 3' untranslated region of mRNA encoded by JAM3, corresponding to a HOST TARGET binding site such as BINDING SITE I, BINDING SITE II or BINDING SITE III. Table 2 illustrates the complementarity of the nucleotide sequences of JAM3 BINDING SITE, designated SEQ ID:26552, to the nucleotide sequence of VGAM445 RNA, herein designated VGAM RNA, also designated SEQ ID:3156.

Another function of VGAM445 is therefore inhibition of Junctional Adhesion Molecule 3 (JAM3, Accession NM_032801), a gene which is a member of the junctional adhesion molecule protein family. Accordingly, utilities of VGAM445 include diagnosis, prevention and treatment of diseases and clinical conditions associated with JAM3. The function of JAM3 and its association with various diseases and clinical conditions, has been established by previous studies, as described hereinabove with reference to VGAM200. Pyrimidinergic Receptor P2Y, G-protein Coupled, 6 (P2RY6, Accession NM_004154) is another VGAM445 host target gene. P2RY6 BINDING SITE is HOST TARGET binding site found in the 3' untranslated region of mRNA encoded by P2RY6, corresponding to a HOST TARGET binding site such as BINDING SITE I, BINDING SITE II or BINDING SITE III. Table 2 illustrates the complementarity of the nucleotide sequences of P2RY6 BINDING SITE, designated SEQ ID:10352, to the nucleotide sequence of VGAM445 RNA, herein designated VGAM RNA, also designated SEQ ID:3156.

Another function of VGAM445 is therefore inhibition of Pyrimidinergic Receptor P2Y, G-protein Coupled, 6 (P2RY6, Accession NM_004154), a gene which mediates cellular responses to nucleotides. Accordingly, utilities of VGAM445 include diagnosis, prevention and treatment of diseases and clinical conditions associated with P2RY6. The function of P2RY6 has been established by previous studies. Chang et al. (1995) discovered the first receptor of the P2Y6 type in rat. The human ortholog was identified by Communi et al. (1996). Maier et al. (1997) identified 3 isoforms of P2Y6 cDNA. Two contained the same contiguous open reading frames, but differed in their 5-prime untranslated regions and may, therefore, originate by alternative splicing; the third represented a pseudogene. Analysis of P2Y receptor subtype expression in human bone and 2 osteoblastic cell lines by RT-PCR showed that all known human P2Y receptor subtypes were expressed: P2Y1 (P2RY1; 601167), P2Y2, P2Y4, P2Y6, and P2Y7 (OMIM Ref. No. 601531). In contrast, analysis of brain-derived cell lines suggested that a selective expression of P2Y receptor subtypes occurs in brain tissue. By somatic cell hybridization, Pidlaoan et al. (1997) mapped the P2RY6 gene to 11q13.3-q13.5. By fluorescence in situ hybridization and by sequence tagged site (STS) mapping using the National Center for Biotechnology Information (NCBI) database, Somers et al. (1997) mapped the P2RY6 gene to 11q13.5, between polymorphic markers D11S1314 and D11S916. Further NCBI database analysis of the P2Y purinoceptor genes revealed that P2RY2 (OMIM Ref. No. 600041) maps within less than 4 cM of P2RY6. This was the first chromosomal clustering of this gene family to be described. By phylogenetic analysis of the P2Y purinoceptor family, Somers et al. (1997) demonstrated the presence of 5 evolutionary branches and suggested the occurrence of an ancient gene duplication event.

Full details of the abovementioned studies are described in the following publications, the disclosure of which are hereby incorporated by reference:

Communi, D.; Parmentier, M.; Boeynaems, J.-M.: Cloning, functional expression and tissue distribution of the human P2Y6 receptor. Biochem. Biophys. Res. Commun. 222:303-308, 1996; and Maier, R.; Glatz, A.; Mosbacher, J.; Bilbe, G.: Cloning of P2Y6 cDNAs and identification of a pseudogene: comparison of P2Y receptor subtype expression in bone and brain tissues. Bioch.

Further studies establishing the function and utilities of P2RY6 are found in John Hopkins OMIM database record ID 602451, and in sited publications numbered 6319-632 and 7718 listed in the bibliography section hereinbelow, which are also hereby incorporated by reference. Protein Kinase (cAMP-dependent, catalytic) Inhibitor Alpha (PKIA, Accession NM_006823) is another VGAM445 host target gene.

PKIA BINDING SITE is HOST TARGET binding site found in the 3' untranslated region of mRNA encoded by PKIA, corresponding to a HOST TARGET binding site such as BINDING SITE I, BINDING SITE II or BINDING SITE III. Table 2 illustrates the complementarity of the nucleotide sequences of PKIA BINDING SITE, designated SEQ ID:13698, to the nucleotide sequence of VGAM445 RNA, herein designated VGAM RNA, also designated SEQ ID:3156.

Another function of VGAM445 is therefore inhibition of Protein Kinase (cAMP-dependent, catalytic) Inhibitor Alpha (PKIA, Accession NM_006823). Accordingly, utilities of VGAM445 include diagnosis, prevention and treatment of diseases and clinical conditions associated with PKIA. Retinoblastoma Binding Protein 5 (RBBP5, Accession NM_005057) is another VGAM445 host target gene. RBBP5 BINDING SITE is HOST TARGET binding site found in the 3' untranslated region of mRNA encoded by RBBP5, corresponding to a HOST TARGET binding site such as BINDING SITE I, BINDING SITE II or BINDING SITE III. Table 2 illustrates the complementarity of the nucleotide sequences of RBBP5 BINDING SITE, designated SEQ ID:11484, to the nucleotide sequence of VGAM445 RNA, herein designated VGAM RNA, also designated SEQ ID:3156.

Another function of VGAM445 is therefore inhibition of Retinoblastoma Binding Protein 5 (RBBP5, Accession NM_005057). Accordingly, utilities of VGAM445 include diagnosis, prevention and treatment of diseases and clinical conditions associated with RBBP5. Amyotrophic Lateral Sclerosis 2 (juvenile) Chromosome Region, Candidate 3 (ALS2CR3, Accession NM_015049) is another VGAM445 host target gene. ALS2CR3 BINDING SITE is HOST TARGET binding site found in the 3' untranslated region of mRNA encoded by ALS2CR3, corresponding to a HOST TARGET binding site such as BINDING SITE I, BINDING SITE II or BINDING SITE III. Table 2 illustrates the complementarity of the nucleotide sequences of ALS2CR3 BINDING SITE, designated SEQ ID:17408, to the nucleotide sequence of VGAM445 RNA, herein designated VGAM RNA, also designated SEQ ID:3156.

Another function of VGAM445 is therefore inhibition of Amyotrophic Lateral Sclerosis 2 (juvenile) Chromosome Region, Candidate 3 (ALS2CR3, Accession NM_015049). Accordingly, utilities of VGAM445 include diagnosis, prevention and treatment of diseases and clinical conditions associated with ALS2CR3. DKFZp566D133 (Accession XM_050005) is another VGAM445 host target gene. DKFZp566D133 BINDING SITE is HOST TARGET binding site found in the 3' untranslated region of mRNA encoded by DKFZp566D133, corresponding to a HOST TARGET binding site such as BINDING SITE I, BINDING SITE II or BINDING SITE III. Table 2 illustrates the complementarity of the nucleotide sequences of DKFZp566D133 BINDING SITE, designated SEQ ID:35543, to the nucleotide sequence of VGAM445 RNA, herein designated VGAM RNA, also designated SEQ ID:3156.

Another function of VGAM445 is therefore inhibition of DKFZp566D133 (Accession XM_050005). Accordingly, utilities of VGAM445 include diagnosis, prevention and treatment of diseases and clinical conditions associated with DKFZp566D133. DKFZp761O0113 (Accession NM_018409) is another VGAM445 host target gene. DKFZp761O0113 BINDING SITE is HOST TARGET binding site found in the 5' untranslated region of mRNA encoded by DKFZp761O0113, corresponding to a HOST TARGET binding site such as BINDING SITE I, BINDING SITE II or BINDING SITE III. Table 2 illustrates the complementarity of the nucleotide sequences of DKFZp761O0113 BINDING SITE, designated SEQ ID:20445, to the nucleotide sequence of VGAM445 RNA, herein designated VGAM RNA, also designated SEQ ID:3156.

Another function of VGAM445 is therefore inhibition of DKFZp761O0113 (Accession NM_018409). Accordingly, utilities of VGAM445 include diagnosis, prevention and treatment of diseases and clinical conditions associated with DKFZp761O0113. FLJ10330 (Accession NM_018061) is another VGAM445 host target gene. FLJ10330 BINDING SITE is HOST TARGET binding site found in the 3' untranslated region of mRNA encoded by FLJ10330, corresponding to a HOST TARGET binding site such as BINDING SITE I, BINDING SITE II or BINDING SITE III. Table 2 illustrates the complementarity of the nucleotide sequences of FLJ10330 BINDING SITE, designated SEQ ID:19830, to the nucleotide sequence of VGAM445 RNA, herein designated VGAM RNA, also designated SEQ ID:3156.

Another function of VGAM445 is therefore inhibition of FLJ10330 (Accession NM_018061). Accordingly, utilities of VGAM445 include diagnosis, prevention and treatment of diseases and clinical conditions associated with FLJ10330. FLJ10525 (Accession NM_018126) is another VGAM445 host target gene. FLJ10525 BINDING SITE is HOST TARGET binding site found in the 3' untranslated region of mRNA encoded by FLJ10525, corresponding to a HOST TARGET binding site such as BINDING SITE I, BINDING SITE II or BINDING SITE III. Table 2 illustrates the complementarity of the nucleotide sequences of FLJ10525 BINDING SITE, designated SEQ ID:19913, to the nucleotide sequence of VGAM445 RNA, herein designated VGAM RNA, also designated SEQ ID:3156.

Another function of VGAM445 is therefore inhibition of FLJ10525 (Accession NM_018126). Accordingly, utilities of VGAM445 include diagnosis, prevention and treatment of diseases and clinical conditions associated with FLJ10525. FLJ14457 (Accession NM_032788) is another VGAM445 host target gene. FLJ14457 BINDING SITE is HOST TARGET binding site found in the 3' untranslated region of mRNA encoded by FLJ14457, corresponding to a HOST TARGET binding site such as BINDING SITE I, BINDING SITE II or BINDING SITE III. Table 2 illustrates the complementarity of the nucleotide sequences of FLJ14457 BINDING SITE, designated SEQ ID:26541, to the nucleotide sequence of VGAM445 RNA, herein designated VGAM RNA, also designated SEQ ID:3156.

Another function of VGAM445 is therefore inhibition of FLJ14457 (Accession NM_032788). Accordingly, utilities of VGAM445 include diagnosis, prevention and treatment of diseases and clinical conditions associated with FLJ14457. FLJ20273 (Accession NM_019027) is another VGAM445 host target gene. FLJ20273 BINDING SITE is HOST TARGET binding site found in the 3' untranslated region of mRNA encoded by FLJ20273, corresponding to a HOST TARGET binding site such as BINDING SITE I, BINDING SITE II or BINDING SITE III. Table 2 illustrates the complementarity of the nucleotide sequences of FLJ20273 BINDING SITE, designated SEQ ID:21112, to the nucleotide sequence of VGAM445 RNA, herein designated VGAM RNA, also designated SEQ ID:3156.

Another function of VGAM445 is therefore inhibition of FLJ20273 (Accession NM_019027). Accordingly, utilities of VGAM445 include diagnosis, prevention and treatment of diseases and clinical conditions associated with FLJ20273. FLJ20986 (Accession NM_024524) is another VGAM445 host target gene. FLJ20986 BINDING SITE is HOST TARGET binding site found in the 3' untranslated region of mRNA encoded by FLJ20986, corresponding to a HOST TARGET binding site such as BINDING SITE I, BINDING SITE II or BINDING SITE III. Table 2 illustrates the complementarity of the nucleotide sequences of FLJ20986 BINDING SITE, designated SEQ ID:23726, to the nucleotide sequence of VGAM445 RNA, herein designated VGAM RNA, also designated SEQ ID:3156.

Another function of VGAM445 is therefore inhibition of FLJ20986 (Accession NM_024524). Accordingly, utilities of VGAM445 include diagnosis, prevention and treatment of diseases and clinical conditions associated with FLJ20986. KIAA0408 (Accession NM_014702) is another VGAM445 host target gene. KIAA0408 BINDING SITE is HOST TARGET binding site found in the 3' untranslated region of mRNA encoded by KIAA0408, corresponding to a HOST TARGET binding site such as BINDING SITE I, BINDING SITE II or BINDING SITE III. Table 2 illustrates the complementarity of the nucleotide sequences of KIAA0408 BINDING SITE, designated SEQ ID:16230, to the nucleotide sequence of VGAM445 RNA, herein designated VGAM RNA, also designated SEQ ID:3156.

Another function of VGAM445 is therefore inhibition of KIAA0408 (Accession NM_014702). Accordingly, utilities of VGAM445 include diagnosis, prevention and treatment of diseases and clinical conditions associated with KIAA0408. KIAA0676 (Accession NM_015043) is another VGAM445 host target gene. KIAA0676 BINDING SITE is HOST TARGET binding site found in the 3' untranslated region of mRNA encoded by KIAA0676, corresponding to a HOST TARGET binding site such as BINDING SITE I, BINDING SITE II or BINDING SITE III. Table 2 illustrates the complementarity of the nucleotide sequences of KIAA0676 BINDING SITE, designated SEQ ID:17392, to the nucleotide sequence of VGAM445 RNA, herein designated VGAM RNA, also designated SEQ ID:3156.

Another function of VGAM445 is therefore inhibition of KIAA0676 (Accession NM_015043). Accordingly, utilities of VGAM445 include diagnosis, prevention and treatment of diseases and clinical conditions associated with KIAA0676. KIAA0844 (Accession NM_014951) is another VGAM445 host target gene. KIAA0844 BINDING SITE is HOST TARGET binding site found in the 3' untranslated region of mRNA encoded by KIAA0844, corresponding to a HOST TARGET binding site such as BINDING SITE I, BINDING SITE II or BINDING SITE III. Table 2 illustrates the complementarity of the nucleotide sequences of KIAA0844 BINDING SITE, designated SEQ ID:17282, to the nucleotide sequence of VGAM445 RNA, herein designated VGAM RNA, also designated SEQ ID:3156.

Another function of VGAM445 is therefore inhibition of KIAA0844 (Accession NM_014951). Accordingly, utilities of VGAM445 include diagnosis, prevention and treatment of diseases and clinical conditions associated with KIAA0844. KIAA1327 (Accession XM_051146) is another VGAM445 host target gene. KIAA1327 BINDING SITE is HOST TARGET binding site found in the 3' untranslated region of mRNA encoded by KIAA1327, corresponding to a HOST TARGET binding site such as BINDING SITE I, BINDING SITE II or BINDING SITE III. Table 2 illustrates the complementarity of the nucleotide sequences of KIAA1327 BINDING SITE, designated SEQ ID:35761, to the nucleotide sequence of VGAM445 RNA, herein designated VGAM RNA, also designated SEQ ID:3156.

Another function of VGAM445 is therefore inhibition of KIAA1327 (Accession XM_051146). Accordingly, utilities of VGAM445 include diagnosis, prevention and treatment of diseases and clinical conditions associated with KIAA1327. KIAA1500 (Accession XM_034353) is another VGAM445 host target gene. KIAA1500 BINDING SITE is HOST TARGET binding site found in the 3' untranslated region of mRNA encoded by KIAA1500, corresponding to a HOST TARGET binding site such as BINDING SITE I, BINDING SITE II or BINDING SITE III. Table 2 illustrates the complementarity of the nucleotide sequences of KIAA1500 BINDING SITE, designated SEQ ID:32063, to the nucleotide sequence of VGAM445 RNA, herein designated VGAM RNA, also designated SEQ ID:3156.

Another function of VGAM445 is therefore inhibition of KIAA1500 (Accession XM_034353). Accordingly, utilities of VGAM445 include diagnosis, prevention and treatment of diseases and clinical conditions associated with KIAA1500. KIAA1617 (Accession XM_166140) is another VGAM445 host target gene. KIAA1617 BINDING SITE is HOST TARGET binding site found in the 3' untranslated region of mRNA encoded by KIAA1617, corresponding to a HOST TARGET binding site such as BINDING SITE I, BINDING SITE II or BINDING SITE III. Table 2 illustrates the complementarity of the nucleotide sequences of KIAA1617 BINDING SITE, designated SEQ ID:43940, to the nucleotide sequence of VGAM445 RNA, herein designated VGAM RNA, also designated SEQ ID:3156.

Another function of VGAM445 is therefore inhibition of KIAA1617 (Accession XM_166140). Accordingly, utilities of VGAM445 include diagnosis, prevention and treatment of diseases and clinical conditions associated with KIAA1617. KIAA1826 (Accession XM_040784) is another VGAM445 host target gene. KIAA1826 BINDING SITE is HOST TARGET binding site found in the 3' untranslated region of mRNA encoded by KIAA1826, corresponding to a HOST TARGET binding site such as BINDING SITE I, BINDING SITE II or BINDING SITE III. Table 2 illustrates the complementarity of the nucleotide sequences of KIAA1826 BINDING SITE, designated SEQ ID:33374, to the nucleotide sequence of VGAM445 RNA, herein designated VGAM RNA, also designated SEQ ID:3156.

Another function of VGAM445 is therefore inhibition of KIAA1826 (Accession XM_040784). Accordingly, utilities of VGAM445 include diagnosis, prevention and treatment of diseases and clinical conditions associated with KIAA1826. MGC4737 (Accession NM_031466) is another VGAM445 host target gene. MGC4737 BINDING SITE is HOST TARGET binding site found in the 5' untranslated region of mRNA encoded by MGC4737, corresponding to a HOST TARGET binding site such as BINDING SITE I, BINDING SITE II or BINDING SITE III. Table 2 illustrates the complementarity of the nucleotide sequences of MGC4737 BINDING SITE, designated SEQ ID:25503, to the nucleotide sequence of VGAM445 RNA, herein designated VGAM RNA, also designated SEQ ID:3156.

Another function of VGAM445 is therefore inhibition of MGC4737 (Accession NM_031466). Accordingly, utilities of VGAM445 include diagnosis, prevention and treatment of diseases and clinical conditions associated with MGC4737. NDRG Family Member 4 (NDRG4, Accession NM_020465) is another VGAM445 host target gene. NDRG4 BINDING SITE1 and NDRG4 BINDING SITE2 are HOST TARGET binding sites found in untranslated regions of mRNA encoded by NDRG4, corresponding to HOST TARGET binding sites such as BINDING SITE I, BINDING SITE II or BINDING SITE III. Table 2 illustrates the complementarity of the nucleotide sequences of NDRG4 BINDING SITE1 and NDRG4 BINDING SITE2, designated SEQ ID:21695 and SEQ ID:23210 respectively, to the nucleotide sequence of VGAM445 RNA, herein designated VGAM RNA, also designated SEQ ID:3156.

Another function of VGAM445 is therefore inhibition of NDRG Family Member 4 (NDRG4, Accession NM_020465). Accordingly, utilities of VGAM445 include diagnosis, prevention and treatment of diseases and clinical conditions associated with NDRG4. SMOC1 (Accession NM_022137) is another VGAM445 host target gene. SMOC1 BINDING SITE is HOST TARGET binding site found in the 3' untranslated region of mRNA encoded by SMOC1, corresponding to a HOST TARGET binding site such as BINDING SITE I, BINDING SITE II or BINDING SITE III. Table 2 illustrates the complementarity of the nucleotide sequences of SMOC1 BINDING SITE, designated SEQ ID:22698, to the nucleotide sequence of VGAM445 RNA, herein designated VGAM RNA, also designated SEQ ID:3156.

Another function of VGAM445 is therefore inhibition of SMOC1 (Accession NM_022137). Accordingly, utilities of VGAM445 include diagnosis, prevention and treatment of diseases and clinical conditions associated with SMOC1. Signal Sequence Receptor, Gamma (translocon-associated protein gamma) (SSR3, Accession NM_007107) is another VGAM445 host target gene. SSR3 BINDING SITE is HOST TARGET binding site found in the 3' untranslated region of mRNA encoded by SSR3, corresponding to a HOST TARGET binding site such as BINDING SITE I, BINDING SITE II or BINDING SITE III. Table 2 illustrates the complementarity of the nucleotide sequences of SSR3 BINDING SITE, designated SEQ ID:13968, to the nucleotide sequence of VGAM445 RNA, herein designated VGAM RNA, also designated SEQ ID:3156.

Another function of VGAM445 is therefore inhibition of Signal Sequence Receptor, Gamma (translocon-associated protein gamma) (SSR3, Accession NM_007107). Accordingly, utilities of VGAM445 include diagnosis, prevention and treatment of diseases and clinical conditions associated with SSR3. Ubiquitin Specific Protease 22 (USP22, Accession XM_042698) is another VGAM445 host target gene. USP22 BINDING SITE is HOST TARGET binding site found in the 3' untranslated region of mRNA encoded by USP22, corresponding to a HOST TARGET binding site such as BINDING SITE I, BINDING SITE II or BINDING SITE III. Table 2 illustrates the complementarity of the nucleotide sequences of USP22 BINDING SITE, designated SEQ ID:33749, to the nucleotide sequence of VGAM445 RNA, herein designated VGAM RNA, also designated SEQ ID:3156.

Another function of VGAM445 is therefore inhibition of Ubiquitin Specific Protease 22 (USP22, Accession XM_042698). Accordingly, utilities of VGAM445 include diagnosis, prevention and treatment of diseases and clinical conditions associated with USP22. Yes-associated Protein 1, 65 kDa (YAP1, Accession NM_006106) is another VGAM445 host target gene. YAP1 BINDING SITE is HOST TARGET binding site found in the 3' untranslated region of mRNA encoded by YAP1, corresponding to a HOST TARGET binding site such as BINDING SITE I, BINDING SITE II or BINDING SITE III. Table 2 illustrates the complementarity of the nucleotide sequences of YAP1 BINDING SITE, designated SEQ ID:12747, to the nucleotide sequence of VGAM445 RNA, herein designated VGAM RNA, also designated SEQ ID:3156.

Another function of VGAM445 is therefore inhibition of Yes-associated Protein 1, 65 kDa (YAP1, Accession NM_006106). Accordingly, utilities of VGAM445 include diagnosis, prevention and treatment of diseases and clinical conditions associated with YAP1. LOC147358 (Accession XM_011089) is another VGAM445 host target gene. LOC147358 BINDING SITE is HOST TARGET binding site found in the 5' untranslated region of mRNA encoded by LOC147358, corresponding to a HOST TARGET binding site such as BINDING SITE I, BINDING SITE II or BINDING SITE III. Table 2 illustrates the complementarity of the nucleotide sequences of LOC147358 BINDING SITE, designated SEQ ID:30166, to the nucleotide sequence of VGAM445 RNA, herein designated VGAM RNA, also designated SEQ ID:3156.

Another function of VGAM445 is therefore inhibition of LOC147358 (Accession XM_011089). Accordingly, utilities of VGAM445 include diagnosis, prevention and treatment of diseases and clinical conditions associated with LOC147358. LOC151647 (Accession XM_087261) is another VGAM445 host target gene. LOC151647 BINDING SITE is HOST TARGET binding site found in the 3' untranslated region of mRNA encoded by LOC151647, corresponding to a HOST TARGET binding site such as BINDING SITE I, BINDING SITE II or BINDING SITE III. Table 2 illustrates the complementarity of the nucleotide sequences of LOC151647 BINDING SITE, designated SEQ ID:39153, to the nucleotide sequence of VGAM445 RNA, herein designated VGAM RNA, also designated SEQ ID:3156.

Another function of VGAM445 is therefore inhibition of LOC151647 (Accession XM_087261). Accordingly, utilities of VGAM445 include diagnosis, prevention and treatment of diseases and clinical conditions associated with LOC151647. LOC163255 (Accession XM_092121) is another VGAM445 host target gene. LOC163255 BINDING SITE1 through LOC163255 BINDING SITE3 are HOST TARGET binding sites found in untranslated regions of mRNA encoded by LOC163255, corresponding to HOST TARGET binding sites such as BINDING SITE I, BINDING SITE II or BINDING SITE III. Table 2 illustrates the complementarity of the nucleotide sequences of LOC163255 BINDING SITE1 through LOC163255 BINDING SITE3, designated SEQ ID:40105, SEQ ID:40106 and SEQ ID:40104 respectively, to the nucleotide sequence of VGAM445 RNA, herein designated VGAM RNA, also designated SEQ ID:3156.

Another function of VGAM445 is therefore inhibition of LOC163255 (Accession XM_092121). Accordingly, utilities of VGAM445 include diagnosis, prevention and treatment of diseases and clinical conditions associated with LOC163255. LOC201164 (Accession XM_113904) is another VGAM445 host target gene. LOC201164 BINDING SITE is HOST TARGET binding site found in the 3' untranslated region of mRNA encoded by LOC201164, corresponding to a HOST TARGET binding site such as BINDING SITE I, BINDING SITE II or BINDING SITE III. Table 2 illustrates the complementarity of the nucleotide sequences of LOC201164 BINDING SITE, designated SEQ ID:42526, to the nucleotide sequence of VGAM445 RNA, herein designated VGAM RNA, also designated SEQ ID:3156.

Another function of VGAM445 is therefore inhibition of LOC201164 (Accession XM_113904). Accordingly, utilities of VGAM445 include diagnosis, prevention and treatment of diseases and clinical conditions associated with LOC201164. LOC201895 (Accession XM_114396) is another VGAM445 host target gene. LOC201895 BINDING SITE is HOST TARGET binding site found in the 3' untranslated region of mRNA encoded by LOC201895, corresponding to a HOST TARGET binding site such as BINDING SITE I, BINDING SITE II or BINDING SITE III. Table 2 illustrates the complementarity of the nucleotide sequences of LOC201895 BINDING SITE, designated SEQ ID:42925, to the nucleotide sequence of VGAM445 RNA, herein designated VGAM RNA, also designated SEQ ID:3156.

Another function of VGAM445 is therefore inhibition of LOC201895 (Accession XM_114396). Accordingly, utilities of VGAM445 include diagnosis, prevention and treatment of diseases and clinical conditions associated with LOC201895. LOC203523 (Accession XM_114713) is another VGAM445 host target gene. LOC203523 BINDING SITE is HOST TARGET binding site found in the 3' untranslated region of mRNA encoded by LOC203523, corresponding to a HOST TARGET binding site such as BINDING SITE I, BINDING SITE II or BINDING SITE III. Table 2 illustrates the complementarity of the nucleotide sequences of LOC203523 BINDING SITE, designated SEQ ID:43052, to the nucleotide sequence of VGAM445 RNA, herein designated VGAM RNA, also designated SEQ ID:3156.

Another function of VGAM445 is therefore inhibition of LOC203523 (Accession XM_114713). Accordingly, utilities of VGAM445 include diagnosis, prevention and treatment of diseases and clinical conditions associated with LOC203523. LOC219690 (Accession XM_167572) is another VGAM445 host target gene. LOC219690 BINDING SITE is HOST TARGET binding site found in the 3' untranslated region of mRNA encoded by LOC219690, corresponding to a HOST TARGET binding site such as BINDING SITE I, BINDING SITE II or BINDING SITE III. Table 2 illustrates the complementarity of the nucleotide sequences of LOC219690 BINDING SITE, designated SEQ ID:44704, to the nucleotide sequence of VGAM445 RNA, herein designated VGAM RNA, also designated SEQ ID:3156.

Another function of VGAM445 is therefore inhibition of LOC219690 (Accession XM_167572). Accordingly, utilities of VGAM445 include diagnosis, prevention and treatment of diseases and clinical conditions associated with LOC219690. LOC253959 (Accession XM_170749) is another VGAM445 host target gene. LOC253959 BINDING SITE is HOST TARGET binding site found in the 3' untranslated region of mRNA encoded by LOC253959, corresponding to a HOST TARGET binding site such as BINDING SITE I, BINDING SITE II or BINDING SITE III. Table 2 illustrates the complementarity of the nucleotide sequences of LOC253959 BINDING SITE, designated SEQ ID:45509, to the nucleotide sequence of VGAM445 RNA, herein designated VGAM RNA, also designated SEQ ID:3156.

Another function of VGAM445 is therefore inhibition of LOC253959 (Accession XM_170749). Accordingly, utilities of VGAM445 include diagnosis, prevention and treatment of diseases and clinical conditions associated with LOC253959. FIG. 1 further provides a conceptual description of a novel bioinformatically detected viral gene of the present invention, referred to here as Viral Genomic Address Messenger 446 (VGAM446) viral gene, which modulates expression of respective host target genes thereof, the function and utility of which host target genes is known in the art.

VGAM446 is a novel bioinformatically detected regulatory, non protein coding, viral micro RNA (miRNA) gene. The method by which VGAM446 was detected is described hereinabove with reference to FIGS. 1-8.

VGAM446 gene, herein designated VGAM GENE, is a viral gene contained in the genome of Human Papillomavirus Type 17. VGAM446 host target gene, herein designated VGAM HOST TARGET GENE, is a human gene contained in the human genome.

VGAM446 gene encodes a VGAM446 precursor RNA, herein designated VGAM PRECURSOR RNA. Similar to other miRNA genes, and unlike most ordinary genes, VGAM446 precursor RNA does not encode a protein. A nucleotide sequence identical or highly similar to the nucleotide sequence of VGAM446 precursor RNA is designated SEQ ID:432, and is provided hereinbelow with reference to the sequence listing part. Nucleotide sequence SEQ ID:432 is located at position 437 relative to the genome of Human Papillomavirus Type 17.

VGAM446 precursor RNA folds onto itself, forming VGAM446 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM446 folded precursor RNA into VGAM446 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM446 RNA is designated SEQ ID:3157, and is provided hereinbelow with reference to the sequence listing part.

VGAM446 host target gene, herein designated VGAM HOST TARGET GENE, encodes a corresponding messenger RNA, VGAM446 host target RNA, herein designated VGAM HOST TARGET RNA. VGAM446 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM446 RNA, herein designated VGAM RNA, binds complementarily to one or more host target binding sites located in untranslated regions of VGAM446 host target RNA, herein designated VGAM HOST TARGET RNA. This complementary binding is due to the fact that the nucleotide sequence of VGAM446 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM446 RNA, herein designated VGAM RNA, may have a different number of host target binding sites in untranslated regions of a VGAM446 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM446 RNA, herein designated VGAM RNA, to host target binding sites on VGAM446 host target RNA, herein designated VGAM HOST TARGET RNA, such as BINDING SITE I, BINDING SITE II and BINDING SITE III, inhibits translation of VGAM446 host target RNA into VGAM446 host target protein, herein designated VGAM HOST TARGET PROTEIN. VGAM host target protein is therefore outlined by a broken line.

It is appreciated that VGAM446 host target gene, herein designated VGAM HOST TARGET GENE, in fact represents a plurality of VGAM446 host target genes. The mRNA of each one of this plurality of VGAM446 host target genes comprises one or more host target binding sites, each having a nucleotide sequence which is at least partly complementary to VGAM446 RNA, herein designated VGAM RNA, and which when bound by VGAM446 RNA causes inhibition of translation of respective one or more VGAM446 host target proteins.

It is further appreciated by one skilled in the art that the mode of translational inhibition illustrated by FIG. 1 with specific reference to translational inhibition exerted by VGAM446 gene, herein designated VGAM GENE, on one or more VGAM446 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM446 is inhibition of expression of host target genes, as part of a novel viral mechanism of attacking a host. Accordingly, utilities of VGAM446 include diagnosis, prevention and treatment of viral infection by Human Papillomavirus Type 17. Specific functions, and accordingly utilities, of VGAM446 correlate with, and may be deduced from, the identity of the host target genes which VGAM446 binds and inhibits, and the function of these host target genes, as elaborated hereinbelow.

Nucleotide sequences of the VGAM446 precursor RNA, herein designated VGAM PRECURSOR RNA, and of the 'diced' VGAM446 RNA, herein designated VGAM RNA, and a schematic representation of the secondary folding of VGAM446 folded precursor RNA, herein designated VGAM FOLDED PRECURSOR RNA, of VGAM446 are further described hereinbelow with reference to Table 1.

Nucleotide sequences of host target binding sites, such as BINDING SITE-I, BINDING SITE-II and BINDING SITE-III of FIG. 1, found on VGAM446 host target RNA, and schematic representation of the complementarity of each of these host target binding sites to VGAM446 RNA, herein designated VGAM RNA, are described hereinbelow with reference to Table 2.

As mentioned hereinabove with reference to FIG. 1, a function of VGAM446 gene, herein designated VGAM is inhibition of expression of VGAM446 target genes. It is appreciated that specific functions, and accordingly utilities, of VGAM446 correlate with, and may be deduced from, the identity of the target genes which VGAM446 binds and inhibits, and the function of these target genes, as elaborated hereinbelow.

Transmembrane Protein 2 (TMEM2, Accession NM_013390) is a VGAM446 host target gene. TMEM2 BINDING SITE is HOST TARGET binding site found in the 3' untranslated region of mRNA encoded by TMEM2, corresponding to a HOST TARGET binding site such as BINDING SITE I, BINDING SITE II or BINDING SITE III. Table 2 illustrates the complementarity of the nucleotide sequences of TMEM2 BINDING SITE, designated SEQ ID:15041, to the nucleotide sequence of VGAM446 RNA, herein designated VGAM RNA, also designated SEQ ID:3157.

A function of VGAM446 is therefore inhibition of Transmembrane Protein 2 (TMEM2, Accession NM_013390). Accordingly, utilities of VGAM446 include diagnosis, prevention and treatment of diseases and clinical conditions associated with TMEM2. KIAA0660 (Accession NM_012297) is another VGAM446 host target gene. KIAA0660 BINDING SITE is HOST TARGET binding site found in the 3' untranslated region of mRNA encoded by KIAA0660, corresponding to a HOST TARGET binding site such as BINDING SITE I, BINDING SITE II or BINDING SITE III. Table 2 illustrates the complementarity of the nucleotide sequences of KIAA0660 BINDING SITE, designated SEQ ID:14659, to the nucleotide sequence of VGAM446 RNA, herein designated VGAM RNA, also designated SEQ ID:3157.

Another function of VGAM446 is therefore inhibition of KIAA0660 (Accession NM_012297). Accordingly, utilities of VGAM446 include diagnosis, prevention and treatment of diseases and clinical conditions associated with KIAA0660. LOC219940 (Accession XM_167791) is another VGAM446 host target gene. LOC219940 BINDING SITE is HOST TARGET binding site found in the 5' untranslated region of mRNA encoded by LOC219940, corresponding to a HOST TARGET binding site such as BINDING SITE I, BINDING SITE II or BINDING SITE III. Table 2 illustrates the complementarity of the nucleotide sequences of LOC219940 BINDING SITE, designated SEQ ID:44832, to the nucleotide sequence of VGAM446 RNA, herein designated VGAM RNA, also designated SEQ ID:3157.

Another function of VGAM446 is therefore inhibition of LOC219940 (Accession XM_167791). Accordingly, utilities of VGAM446 include diagnosis, prevention and treatment of diseases and clinical conditions associated with LOC219940. LOC90750 (Accession XM_033868) is another VGAM446 host target gene. LOC90750 BINDING SITE is HOST TARGET binding site found in the 3' untranslated region of mRNA encoded by LOC90750, corresponding to a HOST TARGET binding site such as BINDING SITE I, BINDING SITE II or BINDING SITE III. Table 2 illustrates the complementarity of the nucleotide sequences of LOC90750 BINDING SITE, designated SEQ ID:31967, to the nucleotide sequence of VGAM446 RNA, herein designated VGAM RNA, also designated SEQ ID:3157.

Another function of VGAM446 is therefore inhibition of LOC90750 (Accession XM_033868). Accordingly, utilities of VGAM446 include diagnosis, prevention and treatment of diseases and clinical conditions associated with LOC90750. FIG. 1 further provides a conceptual description of a novel bioinformatically detected viral gene of the present invention, referred to here as Viral Genomic Address Messenger 447 (VGAM447) viral gene, which modulates expression of respective host target genes thereof, the function and utility of which host target genes is known in the art.

VGAM447 is a novel bioinformatically detected regulatory, non protein coding, viral micro RNA (miRNA) gene. The method by which VGAM447 was detected is described hereinabove with reference to FIGS. 1-8.

VGAM447 gene, herein designated VGAM GENE, is a viral gene contained in the genome of Human Papillomavirus Type 40. VGAM447 host target gene, herein designated VGAM HOST TARGET GENE, is a human gene contained in the human genome.

VGAM447 gene encodes a VGAM447 precursor RNA, herein designated VGAM PRECURSOR RNA. Similar to other miRNA genes, and unlike most ordinary genes, VGAM447 precursor RNA does not encode a protein. A nucleotide sequence identical or highly similar to the nucleotide sequence of VGAM447 precursor RNA is designated SEQ ID:433, and is provided hereinbelow with reference to the sequence listing part. Nucleotide sequence SEQ ID:433 is located at position 1456 relative to the genome of Human Papillomavirus Type 40.

VGAM447 precursor RNA folds onto itself, forming VGAM447 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM447 folded precursor RNA into VGAM447 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM447 RNA is designated SEQ ID:3158, and is provided hereinbelow with reference to the sequence listing part.

VGAM447 host target gene, herein designated VGAM HOST TARGET GENE, encodes a corresponding messenger RNA, VGAM447 host target RNA, herein designated VGAM HOST TARGET RNA. VGAM447 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM447 RNA, herein designated VGAM RNA, binds complementarily to one or more host target binding sites located in untranslated regions of VGAM447 host target RNA, herein designated VGAM HOST TARGET RNA. This complementary binding is due to the fact that the nucleotide sequence of VGAM447 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM447 RNA, herein designated VGAM RNA, may have a different number of host target binding sites in untranslated regions of a VGAM447 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM447 RNA, herein designated VGAM RNA, to host target binding sites on VGAM447 host target RNA, herein designated VGAM HOST TARGET RNA, such as BINDING SITE I, BINDING SITE II and BINDING SITE III, inhibits translation of VGAM447 host target RNA into VGAM447 host target protein, herein designated VGAM HOST TARGET PROTEIN. VGAM host target protein is therefore outlined by a broken line.

It is appreciated that VGAM447 host target gene, herein designated VGAM HOST TARGET GENE, in fact represents a plurality of VGAM447 host target genes. The mRNA of each one of this plurality of VGAM447 host target genes comprises one or more host target binding sites, each having a nucleotide sequence which is at least partly complementary to VGAM447 RNA, herein designated VGAM RNA, and which when bound by VGAM447 RNA causes inhibition of translation of respective one or more VGAM447 host target proteins.

It is further appreciated by one skilled in the art that the mode of translational inhibition illustrated by FIG. 1 with specific reference to translational inhibition exerted by VGAM447 gene, herein designated VGAM GENE, on one or more VGAM447 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM447 is inhibition of expression of host target genes, as part of a novel viral mechanism of attacking a host. Accordingly, utilities of VGAM447 include diagnosis, prevention and treatment of viral infection by Human Papillomavirus Type 40. Specific functions, and accordingly utilities, of VGAM447 correlate with, and may be deduced from, the identity of the host target genes which VGAM447 binds and inhibits, and the function of these host target genes, as elaborated hereinbelow.

Nucleotide sequences of the VGAM447 precursor RNA, herein designated VGAM PRECURSOR RNA, and of the 'diced' VGAM447 RNA, herein designated VGAM RNA, and a schematic representation of the secondary folding of VGAM447 folded precursor RNA, herein designated VGAM FOLDED PRECURSOR RNA, of VGAM447 are further described hereinbelow with reference to Table 1.

Nucleotide sequences of host target binding sites, such as BINDING SITE-I, BINDING SITE-II and BINDING SITE-III of FIG. 1, found on VGAM447 host target RNA, and schematic representation of the complementarity of each of these host target binding sites to VGAM447 RNA, herein designated VGAM RNA, are described hereinbelow with reference to Table 2.

As mentioned hereinabove with reference to FIG. 1, a function of VGAM447 gene, herein designated VGAM is inhibition of expression of VGAM447 target genes. It is appreciated that specific functions, and accordingly utilities, of VGAM447 correlate with, and may be deduced from, the identity of the target genes which VGAM447 binds and inhibits, and the function of these target genes, as elaborated hereinbelow.

ATPase, Na+/K+ Transporting, Alpha 2 (+) Polypeptide (ATP1A2, Accession NM_000702) is a VGAM447 host target gene. ATP1A2 BINDING SITE is HOST TARGET binding site found in the 3' untranslated region of mRNA encoded by ATP1A2, corresponding to a HOST TARGET binding site such as BINDING SITE I, BINDING SITE II or BINDING SITE III. Table 2 illustrates the complementarity of the nucleotide sequences of ATP1A2 BINDING SITE, designated SEQ ID:6363, to the nucleotide sequence of VGAM447 RNA, herein designated VGAM RNA, also designated SEQ ID:3158.

A function of VGAM447 is therefore inhibition of ATPase, Na+/K+ Transporting, Alpha 2 (+) Polypeptide (ATP1A2, Accession NM_000702). Accordingly, utilities of VGAM447 include diagnosis, prevention and treatment of diseases and clinical conditions associated with ATP1A2. DNA (cytosine-5-)-methyltransferase 3-like (DNMT3L, Accession NM_013369) is another VGAM447 host target gene. DNMT3L BINDING SITE is HOST TARGET binding site found in the 5' untranslated region of mRNA encoded by DNMT3L, corresponding to a HOST TARGET binding site such as BINDING SITE I, BINDING SITE II or BINDING SITE III. Table 2 illustrates the complementarity of the nucleotide sequences of DNMT3L BINDING SITE, designated SEQ ID:15015, to the nucleotide sequence of VGAM447 RNA, herein designated VGAM RNA, also designated SEQ ID:3158.

Another function of VGAM447 is therefore inhibition of DNA (cytosine-5-)-methyltransferase 3-like (DNMT3L, Accession NM_013369), a gene which plays a role in de novo methylation of CpG islands. Accordingly, utilities of VGAM447 include diagnosis, prevention and treatment of diseases and clinical conditions associated with DNMT3L. The function of DNMT3L has been established by previous studies. By database analysis, PCR with specific primers based on predicted and trapped exon sequences, and screening of testis, fetal liver, placenta, and thymus mRNA and cDNA libraries, Aapola et al. (2000) isolated a cDNA encoding DNMT3L. Sequence analysis predicted that the 387-amino acid protein contains a cysteine-rich region with a novel ADD (for ATRX (OMIM Ref. No. 300032), DNMT3, and DNMT3L) C2-C2 zinc finger motif near an imperfect PHD zinc finger with C4-C4. RT-PCR analysis detected highest expression of DNMT3L in testis, followed by ovary, thymus, and fetal thymus. Northern blot analysis failed to detected expression of DNMT3L. By genomic sequence analysis, Aapola et al. (2000) determined that the DNMT3L gene contains 12 exons and spans 16 kb. The translation initiation codon is in exon 2. The authors detected a splice variant lacking exon 8. Animal model experiments lend further support to the function of DNMT3L. By disrupting homologous recombination in mouse embryonic stem cells, Bourc'his et al. (2001) generated viable but sterile mice with mutated Dnmt3l (termed Dnmt3lG) in which male testes had severe hypogonadism and a Sertoli cell-only phenotype. The heterozygous offspring of females with Dnmt3lG failed to develop past 9.5 days postcoitum due to embryonic rather than uterine defects. Bisulfite genomic sequence analysis of the differentially methylated region (DMR) of imprinted and maternally repressed genes such as Snrpn (OMIM Ref. No. 182279) detected undermethylation of oocytes from Dnmt3lG homozygous females, showing that Dnmt3l is required for the establishment of maternal methylation imprints. Heterozygous embryos from Dnmt3lG homozygotes displayed biallelic expression of genes that are normally expressed only from the allele of paternal origin. Bourc'his et al. (2001) concluded that DNMT3L is required specifically for the establishment of genomic imprints but is dispensable for their propagation, and it is essential for the de novo methylation of single-copy DNA sequences. The authors proposed that DNMT3L is likely to function as a regulator of methylation at imprinted loci rather than a DNA cytosine methyltransferase because of a lack of catalytic motifs in its sequence.

It is appreciated that the abovementioned animal model for DNMT3L is acknowledged by those skilled in the art as a scientifically valid animal model, as can be further appreciated from the publications sited hereinbelow.

Full details of the abovementioned studies are described in the following publications, the disclosure of which are hereby incorporated by reference:

Aapola, U.; Shibuya, K.; Scott, H. S.; Ollila, J.; Vihinen, M.; Heino, M.; Shintani, A.; Kawasaki, K.; Minoshima, S.; Krohn, K.; Antonarakis, S. E.; Shimizu, N.; Kudoh, J.; Peterson, P.: Isolation and initial characterization of a novel zinc finger gene, DNMT3L, on 21q22.3, related to the cysteine-5-methyltransferase 3 gene family. Genomics 65:293-298, 2000; and Bourc'his, D.; Xu, G.-L.; Lin, C.-S.; Bollman, B.; Bestor, T. H.: Dnmt3L and the establishment of maternal genomic imprints. Science 294:2536-2539, 2001.

Further studies establishing the function and utilities of DNMT3L are found in John Hopkins OMIM database record ID 606588, and in sited publications numbered 6277-6278 listed in the bibliography section hereinbelow, which are also hereby incorporated by reference. DXS1283E (Accession XM_047871) is another VGAM447 host target gene. DXS1283E BINDING SITE is HOST TARGET binding site found in the 3' untranslated region of mRNA encoded by DXS1283E, corresponding to a HOST TARGET binding site such as BINDING SITE I, BINDING SITE II or BINDING SITE III. Table 2 illustrates the complementarity of the nucleotide sequences of DXS1283E BINDING SITE, designated SEQ ID:35062, to the nucleotide sequence of VGAM447 RNA, herein designated VGAM RNA, also designated SEQ ID:3158.

Another function of VGAM447 is therefore inhibition of DXS1283E (Accession XM_047871). Accordingly, utilities of VGAM447 include diagnosis, prevention and treatment of diseases and clinical conditions associated with DXS1283E. Neuronal Pentraxin I (NPTX1, Accession NM_002522) is another VGAM447 host target gene. NPTX1 BINDING SITE is HOST TARGET binding site found in the 3' untranslated region of mRNA encoded by NPTX1, corresponding to a HOST TARGET binding site such as BINDING SITE I, BINDING SITE II or BINDING SITE III. Table 2 illustrates the complementarity of the nucleotide sequences of NPTX1 BINDING SITE, designated SEQ ID:8351, to the nucleotide sequence of VGAM447 RNA, herein designated VGAM RNA, also designated SEQ ID:3158.

Another function of VGAM447 is therefore inhibition of Neuronal Pentraxin I (NPTX1, Accession NM_002522), a gene which may be involved in synaptic uptake of extracellular material and is very strongly similar to rat NP1. Accordingly, utilities of VGAM447 include diagnosis, prevention and treatment of diseases and clinical conditions associated with NPTX1. The function of NPTX1 and its association with various diseases and clinical conditions, has been established by previous studies, as described hereinabove with reference to VGAM111. FLJ12057 (Accession NM_024768) is another VGAM447 host target gene. FLJ12057 BINDING SITE is HOST TARGET binding site found in the 5' untranslated region of mRNA encoded by FLJ12057, corresponding to a HOST TARGET binding site such as BINDING SITE I, BINDING SITE II or BINDING SITE III. Table 2 illustrates the complementarity of the nucleotide sequences of FLJ12057 BINDING SITE, designated SEQ ID:24123, to the nucleotide sequence of VGAM447 RNA, herein designated VGAM RNA, also designated SEQ ID:3158.

Another function of VGAM447 is therefore inhibition of FLJ12057 (Accession NM_024768). Accordingly, utilities of VGAM447 include diagnosis, prevention and treatment of diseases and clinical conditions associated with FLJ12057. FLJ14075 (Accession NM_024894) is another VGAM447 host target gene. FLJ14075 BINDING SITE is HOST TARGET binding site found in the 3' untranslated region of mRNA encoded by FLJ14075, corresponding to a HOST TARGET binding site such as BINDING SITE I, BINDING SITE II or BINDING SITE III. Table 2 illustrates the complementarity of the nucleotide sequences of FLJ14075 BINDING SITE, designated SEQ ID:24374, to the nucleotide sequence of VGAM447 RNA, herein designated VGAM RNA, also designated SEQ ID:3158.

Another function of VGAM447 is therefore inhibition of FLJ14075 (Accession NM_024894). Accordingly, utilities of VGAM447 include diagnosis, prevention and treatment of diseases and clinical conditions associated with FLJ14075. SCAM-1 (Accession NM_005775) is another VGAM447 host target gene. SCAM-1 BINDING SITE is HOST TARGET binding site found in the 3' untranslated region of mRNA encoded by SCAM-1, corresponding to a HOST TARGET binding site such as BINDING SITE I, BINDING SITE II or BINDING SITE III. Table 2 illustrates the complementarity of the nucleotide sequences of SCAM-1 BINDING SITE, designated SEQ ID:12349, to the nucleotide sequence of VGAM447 RNA, herein designated VGAM RNA, also designated SEQ ID:3158.

Another function of VGAM447 is therefore inhibition of SCAM-1 (Accession NM_005775). Accordingly, utilities of VGAM447 include diagnosis, prevention and treatment of diseases and clinical conditions associated with SCAM-1. LOC138639 (Accession XM_059988) is another VGAM447 host target gene. LOC138639 BINDING SITE is HOST TARGET binding site found in the 3' untranslated region of mRNA encoded by LOC138639, corresponding to a HOST TARGET binding site such as BINDING SITE I, BINDING SITE II or BINDING SITE III. Table 2 illustrates the complementarity of the nucleotide sequences of LOC138639 BINDING SITE, designated SEQ ID:37138, to the nucleotide sequence of VGAM447 RNA, herein designated VGAM RNA, also designated SEQ ID:3158.

Another function of VGAM447 is therefore inhibition of LOC138639 (Accession XM_059988). Accordingly, utilities of VGAM447 include diagnosis, prevention and treatment of diseases and clinical conditions associated with LOC138639. FIG. 1 further provides a conceptual description of a novel bioinformatically detected viral gene of the present invention, referred to here as Viral Genomic Address Messenger 448 (VGAM448) viral gene, which modulates expression of respective host target genes thereof, the function and utility of which host target genes is known in the art.

VGAM448 is a novel bioinformatically detected regulatory, non protein coding, viral micro RNA (miRNA) gene. The method by which VGAM448 was detected is described hereinabove with reference to FIGS. 1-8.

VGAM448 gene, herein designated VGAM GENE, is a viral gene contained in the genome of Human Papillomavirus Type 40. VGAM448 host target gene, herein designated VGAM HOST TARGET GENE, is a human gene contained in the human genome.

VGAM448 gene encodes a VGAM448 precursor RNA, herein designated VGAM PRECURSOR RNA. Similar to other miRNA genes, and unlike most ordinary genes, VGAM448 precursor RNA does not encode a protein. A nucleotide sequence identical or highly similar to the nucleotide sequence of VGAM448 precursor RNA is designated SEQ ID:434, and is provided hereinbelow with reference to the sequence listing part. Nucleotide sequence SEQ ID:434 is located at position 2267 relative to the genome of Human Papillomavirus Type 40.

VGAM448 precursor RNA folds onto itself, forming VGAM448 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM448 folded precursor RNA into VGAM448 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 69%) nucleotide sequence of VGAM448 RNA is designated SEQ ID:3159, and is provided hereinbelow with reference to the sequence listing part.

VGAM448 host target gene, herein designated VGAM HOST TARGET GENE, encodes a corresponding messenger RNA, VGAM448 host target RNA, herein designated VGAM HOST TARGET RNA. VGAM448 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM448 RNA, herein designated VGAM RNA, binds complementarily to one or more host target binding sites located in untranslated regions of VGAM448 host target RNA, herein designated VGAM HOST TARGET RNA. This complementary binding is due to the fact that the nucleotide sequence of VGAM448 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM448 RNA, herein designated VGAM RNA, may have a different number of host target binding sites in untranslated regions of a VGAM448 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM448 RNA, herein designated VGAM RNA, to host target binding sites on VGAM448 host target RNA, herein designated VGAM HOST TARGET RNA, such as BINDING SITE I, BINDING SITE II and BINDING SITE III, inhibits translation of VGAM448 host target RNA into VGAM448 host target protein, herein designated VGAM HOST TARGET PROTEIN. VGAM host target protein is therefore outlined by a broken line.

It is appreciated that VGAM448 host target gene, herein designated VGAM HOST TARGET GENE, in fact represents a plurality of VGAM448 host target genes. The mRNA of each one of this plurality of VGAM448 host target genes comprises one or more host target binding sites, each having a nucleotide sequence which is at least partly complementary to VGAM448 RNA, herein designated VGAM RNA, and which when bound by VGAM448 RNA causes inhibition of translation of respective one or more VGAM448 host target proteins.

It is further appreciated by one skilled in the art that the mode of translational inhibition illustrated by FIG. 1 with specific reference to translational inhibition exerted by VGAM448 gene, herein designated VGAM GENE, on one or more VGAM448 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM448 is inhibition of expression of host target genes, as part of a novel viral mechanism of attacking a host. Accordingly, utilities of VGAM448 include diagnosis, prevention and treatment of viral infection by Human Papillomavirus Type 40. Specific functions, and accordingly utilities, of VGAM448 correlate with, and may be deduced from, the identity of the host target genes which VGAM448 binds and inhibits, and the function of these host target genes, as elaborated hereinbelow.

Nucleotide sequences of the VGAM448 precursor RNA, herein designated VGAM PRECURSOR RNA, and of the 'diced' VGAM448 RNA, herein designated VGAM RNA, and a schematic representation of the secondary folding of VGAM448 folded precursor RNA, herein designated VGAM FOLDED PRECURSOR RNA, of VGAM448 are further described hereinbelow with reference to Table 1.

Nucleotide sequences of host target binding sites, such as BINDING SITE-I, BINDING SITE-II and BINDING SITE-III of FIG. 1, found on VGAM448 host target RNA, and schematic representation of the complementarity of each of these host target binding sites to VGAM448 RNA, herein designated VGAM RNA, are described hereinbelow with reference to Table 2.

As mentioned hereinabove with reference to FIG. 1, a function of VGAM448 gene, herein designated VGAM is inhibition of expression of VGAM448 target genes. It is appreciated that specific functions, and accordingly utilities, of VGAM448 correlate with, and may be deduced from, the identity of the target genes which VGAM448 binds and inhibits, and the function of these target genes, as elaborated hereinbelow.

G Protein-coupled Receptor 30 (GPR30, Accession NM_001505) is a VGAM448 host target gene. GPR30 BINDING SITE is HOST TARGET binding site found in the 5' untranslated region of mRNA encoded by GPR30, corresponding to a HOST TARGET binding site such as BINDING SITE I, BINDING SITE II or BINDING SITE III. Table 2 illustrates the complementarity of the nucleotide sequences of GPR30 BINDING SITE, designated SEQ ID:7253, to the nucleotide sequence of VGAM448 RNA, herein designated VGAM RNA, also designated SEQ ID:3159.

A function of VGAM448 is therefore inhibition of G Protein-coupled Receptor 30 (GPR30, Accession NM_001505), a gene which receives chemical signals in cell communication in both CNS and peripheral tissues. Accordingly, utilities of VGAM448 include diagnosis, prevention and treatment of diseases and clinical conditions associated with GPR30. The function of GPR30 and its association with various diseases and clinical conditions, has been established by previous studies, as described hereinabove with reference to VGAM171. FLJ11273 (Accession NM_018374) is another VGAM448 host target gene. FLJ11273 BINDING SITE is HOST TARGET binding site found in the 3' untranslated region of mRNA encoded by FLJ11273, corresponding to a HOST TARGET binding site such as BINDING SITE I, BINDING SITE II or BINDING SITE III. Table 2 illustrates the complementarity of the nucleotide sequences of FLJ11273 BINDING SITE, designated SEQ ID:20393, to the nucleotide sequence of VGAM448 RNA, herein designated VGAM RNA, also designated SEQ ID:3159.

Another function of VGAM448 is therefore inhibition of FLJ11273 (Accession NM_018374). Accordingly, utilities of VGAM448 include diagnosis, prevention and treatment of diseases and clinical conditions associated with FLJ11273. FLJ12650 (Accession NM_024522) is another VGAM448 host target gene. FLJ12650 BINDING SITE is HOST TARGET binding site found in the 3' untranslated region of mRNA encoded by FLJ12650, corresponding to a HOST TARGET binding site such as BINDING SITE I, BINDING SITE II or BINDING SITE III. Table 2 illustrates the complementarity of the nucleotide sequences of FLJ12650 BINDING SITE, designated SEQ ID:23721, to the nucleotide sequence of VGAM448 RNA, herein designated VGAM RNA, also designated SEQ ID:3159.

Another function of VGAM448 is therefore inhibition of FLJ12650 (Accession NM_024522). Accordingly, utilities of VGAM448 include diagnosis, prevention and treatment of diseases and clinical conditions associated with FLJ12650. KIAA0090 (Accession XM_114045) is another VGAM448 host target gene. KIAA0090 BINDING SITE is HOST TARGET binding site found in the 3' untranslated region of mRNA encoded by KIAA0090, corresponding to a HOST TARGET binding site such as BINDING SITE I, BINDING SITE II or BINDING SITE III. Table 2 illustrates the complementarity of the nucleotide sequences of KIAA0090 BINDING SITE, designated SEQ ID:42648, to the nucleotide sequence of VGAM448 RNA, herein designated VGAM RNA, also designated SEQ ID:3159.

Another function of VGAM448 is therefore inhibition of KIAA0090 (Accession XM_114045). Accordingly, utilities of VGAM448 include diagnosis, prevention and treatment of diseases and clinical conditions associated with KIAA0090. LOC124045 (Accession XM_071873) is another VGAM448 host target gene. LOC124045 BINDING SITE1 through LOC124045 BINDING SITE4 are HOST TARGET binding sites found in untranslated regions of mRNA encoded by LOC124045, corresponding to HOST TARGET binding sites such as BINDING SITE I, BINDING SITE II or BINDING SITE III. Table 2 illustrates the complementarity of the nucleotide sequences of LOC124045 BINDING SITE1 through LOC124045 BINDING SITE4, designated SEQ ID:37435, SEQ ID:37436, SEQ ID:37437 and SEQ ID:37438 respectively, to the nucleotide sequence of VGAM448 RNA, herein designated VGAM RNA, also designated SEQ ID:3159.

Another function of VGAM448 is therefore inhibition of LOC124045 (Accession XM_071873). Accordingly, utilities of VGAM448 include diagnosis, prevention and treatment of diseases and clinical conditions associated with LOC124045. FIG. 1 further provides a conceptual description of a novel bioinformatically detected viral gene of the present invention, referred to here as Viral Genomic Address Messenger 449 (VGAM449) viral gene, which modulates expression of respective host target genes thereof, the function and utility of which host target genes is known in the art.

VGAM449 is a novel bioinformatically detected regulatory, non protein coding, viral micro RNA (miRNA) gene. The method by which VGAM449 was detected is described hereinabove with reference to FIGS. 1-8.

VGAM449 gene, herein designated VGAM GENE, is a viral gene contained in the genome of Human Papillomavirus Type 7. VGAM449 host target gene, herein designated VGAM HOST TARGET GENE, is a human gene contained in the human genome.

VGAM449 gene encodes a VGAM449 precursor RNA, herein designated VGAM PRECURSOR RNA. Similar to other miRNA genes, and unlike most ordinary genes, VGAM449 precursor RNA does not encode a protein. A nucleotide sequence identical or highly similar to the nucleotide sequence of VGAM449 precursor RNA is designated SEQ ID:435, and is provided hereinbelow with reference to the sequence listing part. Nucleotide sequence SEQ ID:435 is located at position 5002 relative to the genome of Human Papillomavirus Type 7.

VGAM449 precursor RNA folds onto itself, forming VGAM449 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM449 folded precursor RNA into VGAM449 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 86%) nucleotide sequence of VGAM449 RNA is designated SEQ ID:3160, and is provided hereinbelow with reference to the sequence listing part.

VGAM449 host target gene, herein designated VGAM HOST TARGET GENE, encodes a corresponding messenger RNA, VGAM449 host target RNA, herein designated VGAM HOST TARGET RNA. VGAM449 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM449 RNA, herein designated VGAM RNA, binds complementarily to one or more host target binding sites located in untranslated regions of VGAM449 host target RNA, herein designated VGAM HOST TARGET RNA. This complementary binding is due to the fact that the nucleotide sequence of VGAM449 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM449 RNA, herein designated VGAM RNA, may have a different number of host target binding sites in untranslated regions of a VGAM449 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM449 RNA, herein designated VGAM RNA, to host target binding sites on VGAM449 host target RNA, herein designated VGAM HOST TARGET RNA, such as BINDING SITE I, BINDING SITE II and BINDING SITE III, inhibits translation of VGAM449 host target RNA into VGAM449 host target protein, herein designated VGAM HOST TARGET PROTEIN. VGAM host target protein is therefore outlined by a broken line.

It is appreciated that VGAM449 host target gene, herein designated VGAM HOST TARGET GENE, in fact represents a plurality of VGAM449 host target genes. The mRNA of each one of this plurality of VGAM449 host target genes comprises one or more host target binding sites, each having a nucleotide sequence which is at least partly complementary to VGAM449 RNA, herein designated VGAM RNA, and which when bound by VGAM449 RNA causes inhibition of translation of respective one or more VGAM449 host target proteins.

It is further appreciated by one skilled in the art that the mode of translational inhibition illustrated by FIG. 1 with specific reference to translational inhibition exerted by VGAM449 gene, herein designated VGAM GENE, on one or more VGAM449 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM449 is inhibition of expression of host target genes, as part of a novel viral mechanism of attacking a host. Accordingly, utilities of VGAM449 include diagnosis, prevention and treatment of viral infection by Human Papillomavirus Type 7. Specific functions, and accordingly utilities, of VGAM449 correlate with, and may be deduced from, the identity of the host target genes which VGAM449 binds and inhibits, and the function of these host target genes, as elaborated hereinbelow.

Nucleotide sequences of the VGAM449 precursor RNA, herein designated VGAM PRECURSOR RNA, and of the 'diced' VGAM449 RNA, herein designated VGAM RNA, and a schematic representation of the secondary folding of VGAM449 folded precursor RNA, herein designated VGAM FOLDED PRECURSOR RNA, of VGAM449 are further described hereinbelow with reference to Table 1.

Nucleotide sequences of host target binding sites, such as BINDING SITE-I, BINDING SITE-II and BINDING SITE-III of FIG. 1, found on VGAM449 host target RNA, and schematic representation of the complementarity of each of these host target binding sites to VGAM449 RNA, herein designated VGAM RNA, are described hereinbelow with reference to Table 2.

As mentioned hereinabove with reference to FIG. 1, a function of VGAM449 gene, herein designated VGAM is inhibition of expression of VGAM449 target genes. It is appreciated that specific functions, and accordingly utilities, of VGAM449 correlate with, and may be deduced from, the identity of the target genes which VGAM449 binds and inhibits, and the function of these target genes, as elaborated hereinbelow.

Acyl-Coenzyme A Dehydrogenase, Long Chain (ACADL, Accession NM_001608) is a VGAM449 host target gene. ACADL BINDING SITE is HOST TARGET binding site found in the 3' untranslated region of mRNA encoded by ACADL, corresponding to a HOST TARGET binding site such as BINDING SITE I, BINDING SITE II or BINDING SITE III. Table 2 illustrates the complementarity of the nucleotide sequences of ACADL BINDING SITE, designated SEQ ID:7311, to the nucleotide sequence of VGAM449 RNA, herein designated VGAM RNA, also designated SEQ ID:3160.

A function of VGAM449 is therefore inhibition of Acyl-Coenzyme A Dehydrogenase, Long Chain (ACADL, Accession NM_001608). Accordingly, utilities of VGAM449 include diagnosis, prevention and treatment of diseases and clinical conditions associated with ACADL. Potassium Voltage-gated Channel, Shal-related Subfamily, Member 2 (KCND2, Accession NM_012281) is another VGAM449 host target gene. KCND2 BINDING SITE is HOST TARGET binding site found in the 3' untranslated region of mRNA encoded by KCND2, corresponding to a HOST TARGET binding site such as BINDING SITE I, BINDING SITE II or BINDING SITE III. Table 2 illustrates the complementarity of the nucleotide sequences of KCND2 BINDING SITE, designated SEQ ID:14606, to the nucleotide sequence of VGAM449 RNA, herein designated VGAM RNA, also designated SEQ ID:3160.

Another function of VGAM449 is therefore inhibition of Potassium Voltage-gated Channel, Shal-related Subfamily, Member 2 (KCND2, Accession NM_012281), a gene which is prominent in the repolarization phase of the action potential. Accordingly, utilities of VGAM449 include diagnosis, prevention and treatment of diseases and clinical conditions associated with KCND2. The function of KCND2 has been established by previous studies. Kv4 (KCND) proteins form voltage-activated A-type potassium ion channels and are prominent in the repolarization phase of the action potential. Zhu et al. (1999) cloned the cDNA encoding KCND2. The deduced 630-amino acid protein shares 99% sequence identity with the rat homolog and contains multiple potential phosphorylation sites as well as a membrane-spanning core region, including a P domain with the potassium channel signature GYGD, flanked by cytoplasmic hydrophilic N and C termini. Isbrandt et al. (2000) determined that KCND2 shares 60% identity and 71% homology with the KCND1 (OMIM Ref. No. 300281) and KCND3L (OMIM Ref. No. 605411) sequences, with the least conservation at the C terminus. By Northern blot analysis, Zhu et al. (1999) and Isbrandt et al. (2000) detected expression of a 6.8-kb transcript only in brain, particularly in the amygdala, caudate nucleus, cerebellum, hippocampus, substantia nigra, and thalamus. Heterologous expression determined that KCND2 mediates a rapidly inactivating, A-type outward potassium current which is not under the control of the N terminus as it is in Shaker channels (Zhu et al., 1999). Postma et al. (2000) resolved the intron-exon boundaries and flanking intron sequences of the KCND2 gene and found that it contains 6 exons. Zhu et al. (1999) mapped the KCND2 gene to chromosome 7q31-q32 by FISH. By radiation hybrid analysis, Postma et al. (2000) mapped the gene to 7q31

Full details of the abovementioned studies are described in the following publications, the disclosure of which are hereby incorporated by reference:

Isbrandt, D.; Leicher, T.; Waldschutz, R.; Zhu, X.; Luhmann, U.; Michel, U.; Sauter, K.; Pongs, O.: Gene structures and expression profiles of three human KCND (Kv4) potassium channels mediating A-type currents I(to) and I(sa). Genomics 64: 144-154, 2000; and Postma, A. V.; Bezzina, C. R.; de Vries, J. F.; Wilde, A. A. M.; Moorman, A. F. M.; Mannens, M. M. A. M.: Genomic organisation and chromosomal localisation of two members of the KCND i.

Further studies establishing the function and utilities of KCND2 are found in John Hopkins OMIM database record ID 605410, and in sited publications numbered 10996-4783 listed in the bibliography section hereinbelow, which are also hereby incorporated by reference. LNK (Accession NM_005475) is another VGAM449 host target gene. LNK BINDING SITE is HOST TARGET binding site found in the 3' untranslated region of mRNA encoded by LNK, corresponding to a HOST TARGET binding site such as BINDING SITE I, BINDING SITE II or BINDING SITE III. Table 2 illustrates the complementarity of the nucleotide sequences of LNK BINDING SITE, designated SEQ ID:11969, to the nucleotide sequence of VGAM449 RNA, herein designated VGAM RNA, also designated SEQ ID:3160.

Another function of VGAM449 is therefore inhibition of LNK (Accession NM_005475), a gene which links T-cell receptor activation signal to phospholipase c-gamma-1, grb-2 and phosphatidylinositol 3-kinase (by similarity). Accordingly, utilities of VGAM449 include diagnosis, prevention and treatment of diseases and clinical conditions associated with LNK. The function of LNK and its association with various diseases and clinical conditions, has been established by previous studies, as described hereinabove with reference to VGAM115. Retinoic Acid Receptor, Beta (RARB, Accession NM_000965) is another VGAM449 host target gene. RARB BINDING SITE1 and RARB BINDING SITE2 are HOST TARGET binding sites found in untranslated regions of mRNA encoded by RARB, corresponding to HOST TARGET binding sites such as BINDING SITE I, BINDING SITE II or BINDING SITE III. Table 2 illustrates the complementarity of the nucleotide sequences of RARB BINDING SITE1 and RARB BINDING SITE2, designated SEQ ID:6694 and SEQ ID:18240 respectively, to the nucleotide sequence of VGAM449 RNA, herein designated VGAM RNA, also designated SEQ ID:3160.

Another function of VGAM449 is therefore inhibition of Retinoic Acid Receptor, Beta (RARB, Accession NM_000965), a gene which is one member of the steroid/thyroid hormone receptor family of ligand-activated transcription factors. Accordingly, utilities of VGAM449 include diagnosis, prevention and treatment of diseases and clinical conditions associated with RARB. The function of RARB and its association with various diseases and clinical conditions, has been established by previous studies, as described hereinabove with reference to VGAM179. Cyclin M1 (CNNM1, Accession NM_020348) is another VGAM449 host target gene. CNNM1 BINDING SITE is HOST TARGET binding site found in the 3' untranslated region of mRNA encoded by CNNM1, corresponding to a HOST TARGET binding site such as BINDING SITE I, BINDING SITE II or BINDING SITE III. Table 2 illustrates the complementarity of the nucleotide sequences of CNNM1 BINDING SITE, designated SEQ ID:21609, to the nucleotide sequence of VGAM449 RNA, herein designated VGAM RNA, also designated SEQ ID:3160.

Another function of VGAM449 is therefore inhibition of Cyclin M1 (CNNM1, Accession NM_020348). Accordingly, utilities of VGAM449 include diagnosis, prevention and treatment of diseases and clinical conditions associated with CNNM1. FLJ11181 (Accession NM_018350) is another VGAM449 host target gene. FLJ11181 BINDING SITE is HOST TARGET binding site found in the 5' untranslated region of mRNA encoded by FLJ11181, corresponding to a HOST TARGET binding site such as BINDING SITE I, BINDING SITE II or BINDING SITE III. Table 2 illustrates the complementarity of the nucleotide sequences of FLJ11181 BINDING SITE, designated SEQ ID:20363, to the nucleotide sequence of VGAM449 RNA, herein designated VGAM RNA, also designated SEQ ID:3160.

Another function of VGAM449 is therefore inhibition of FLJ11181 (Accession NM_018350). Accordingly, utilities of VGAM449 include diagnosis, prevention and treatment of diseases and clinical conditions associated with FLJ11181.

FLJ13576 (Accession NM_022484) is another VGAM449 host target gene. FLJ13576 BINDING SITE is HOST TARGET binding site found in the 5' untranslated region of mRNA encoded by FLJ13576, corresponding to a HOST TARGET binding site such as BINDING SITE I, BINDING SITE II or BINDING SITE III. Table 2 illustrates the complementarity of the nucleotide sequences of FLJ13576 BINDING SITE, designated SEQ ID:22862, to the nucleotide sequence of VGAM449 RNA, herein designated VGAM RNA, also designated SEQ ID:3160.

Another function of VGAM449 is therefore inhibition of FLJ13576 (Accession NM_022484). Accordingly, utilities of VGAM449 include diagnosis, prevention and treatment of diseases and clinical conditions associated with FLJ13576. FLJ20079 (Accession NM_017656) is another VGAM449 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19165, to the nucleotide sequence of VGAM449 RNA, herein designated VGAM RNA, also designated SEQ ID:3160.

Another function of VGAM449 is therefore inhibition of FLJ20079 (Accession NM_017656). Accordingly, utilities of VGAM449 include diagnosis, prevention and treatment of diseases and clinical conditions associated with FLJ20079. KIAA1163 (Accession XM_086231) is another VGAM449 host target gene. KIAA1163 BINDING SITE is HOST TARGET binding site found in the 3' untranslated region of mRNA encoded by KIAA1163, corresponding to a HOST TARGET binding site such as BINDING SITE I, BINDING SITE II or BINDING SITE III. Table 2 illustrates the complementarity of the nucleotide sequences of KIAA1163 BINDING SITE, designated SEQ ID:38555, to the nucleotide sequence of VGAM449 RNA, herein designated VGAM RNA, also designated SEQ ID:3160.

Another function of VGAM449 is therefore inhibition of KIAA1163 (Accession XM_086231). Accordingly, utilities of VGAM449 include diagnosis, prevention and treatment of diseases and clinical conditions associated with KIAA1163. KIAA1189 (Accession XM_050508) is another VGAM449 host target gene. KIAA1189 BINDING SITE is HOST TARGET binding site found in the 3' untranslated region of mRNA encoded by KIAA1189, corresponding to a HOST TARGET binding site such as BINDING SITE I, BINDING SITE II or BINDING SITE III. Table 2 illustrates the complementarity of the nucleotide sequences of KIAA1189 BINDING SITE, designated SEQ ID:35649, to the nucleotide sequence of VGAM449 RNA, herein designated VGAM RNA, also designated SEQ ID:3160.

Another function of VGAM449 is therefore inhibition of KIAA1189 (Accession XM_050508). Accordingly, utilities of VGAM449 include diagnosis, prevention and treatment of diseases and clinical conditions associated with KIAA1189. LOC148166 (Accession XM_086077) is another VGAM449 host target gene. LOC148166 BINDING SITE is HOST TARGET binding site found in the 5' untranslated region of mRNA encoded by LOC148166, corresponding to a HOST TARGET binding site such as BINDING SITE I, BINDING SITE II or BINDING SITE III. Table 2 illustrates the complementarity of the nucleotide sequences of LOC148166 BINDING SITE, designated SEQ ID:38478, to the nucleotide sequence of VGAM449 RNA, herein designated VGAM RNA, also designated SEQ ID:3160.

Another function of VGAM449 is therefore inhibition of LOC148166 (Accession XM_086077). Accordingly, utilities of VGAM449 include diagnosis, prevention and treatment of diseases and clinical conditions associated with LOC148166. LOC150596 (Accession XM_086957) is another VGAM449 host target gene. LOC150596 BINDING SITE is HOST TARGET binding site found in the 3' untranslated region of mRNA encoded by LOC150596, corresponding to a HOST TARGET binding site such as BINDING SITE I, BINDING SITE II or BINDING SITE III. Table 2 illustrates the complementarity of the nucleotide sequences of LOC150596 BINDING SITE, designated SEQ ID:38994, to the nucleotide sequence of VGAM449 RNA, herein designated VGAM RNA, also designated SEQ ID:3160.

Another function of VGAM449 is therefore inhibition of LOC150596 (Accession XM_086957). Accordingly, utilities of VGAM449 include diagnosis, prevention and treatment of diseases and clinical conditions associated with LOC150596. FIG. 1 further provides a conceptual description of a novel bioinformatically detected viral gene of the present invention, referred to here as Viral Genomic Address Messenger 450 (VGAM450) viral gene, which modulates expression of respective host target genes thereof, the function and utility of which host target genes is known in the art.

VGAM450 is a novel bioinformatically detected regulatory, non protein coding, viral micro RNA (miRNA) gene. The method by which VGAM450 was detected is described hereinabove with reference to FIGS. 1-8.

VGAM450 gene, herein designated VGAM GENE, is a viral gene contained in the genome of Cardamine Chlorotic Fleck Virus. VGAM450 host target gene, herein designated VGAM HOST TARGET GENE, is a human gene contained in the human genome.

VGAM450 gene encodes a VGAM450 precursor RNA, herein designated VGAM PRECURSOR RNA. Similar to other miRNA genes, and unlike most ordinary genes, VGAM450 precursor RNA does not encode a protein. A nucleotide sequence identical or highly similar to the nucleotide sequence of VGAM450 precursor RNA is designated SEQ ID:436, and is provided hereinbelow with reference to the sequence listing part. Nucleotide sequence SEQ ID:436 is located at position 43 relative to the genome of Cardamine Chlorotic Fleck Virus.

VGAM450 precursor RNA folds onto itself, forming VGAM450 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM450 folded precursor RNA into VGAM450 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM450 RNA is designated SEQ ID:3161, and is provided hereinbelow with reference to the sequence listing part.

VGAM450 host target gene, herein designated VGAM HOST TARGET GENE, encodes a corresponding messenger RNA, VGAM450 host target RNA, herein designated VGAM HOST TARGET RNA. VGAM450 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM450 RNA, herein designated VGAM RNA, binds complementarily to one or more host target binding sites located in untranslated regions of VGAM450 host target RNA, herein designated VGAM HOST TARGET RNA. This complementary binding is due to the fact that the nucleotide sequence of VGAM450 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM450 RNA, herein designated VGAM RNA, may have a different number of host target binding sites in untranslated regions of a VGAM450 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM450 RNA, herein designated VGAM RNA, to host target binding sites on VGAM450 host target RNA, herein designated VGAM HOST TARGET RNA, such as BINDING SITE I, BINDING SITE II and BINDING SITE III, inhibits translation of VGAM450 host target RNA into VGAM450 host target protein, herein designated VGAM HOST TARGET PROTEIN. VGAM host target protein is therefore outlined by a broken line.

It is appreciated that VGAM450 host target gene, herein designated VGAM HOST TARGET GENE, in fact represents a plurality of VGAM450 host target genes. The mRNA of each one of this plurality of VGAM450 host target genes comprises one or more host target binding sites, each having a nucleotide sequence which is at least partly complementary to VGAM450 RNA, herein designated VGAM RNA, and which when bound by VGAM450 RNA causes inhibition of translation of respective one or more VGAM450 host target proteins.

It is further appreciated by one skilled in the art that the mode of translational inhibition illustrated by FIG. 1 with specific reference to translational inhibition exerted by VGAM450 gene, herein designated VGAM GENE, on one or more VGAM450 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM450 is inhibition of expression of host target genes, as part of a novel viral mechanism of attacking a host. Accordingly, utilities of VGAM450 include diagnosis, prevention and treatment of viral infection by Cardamine Chlorotic Fleck Virus. Specific functions, and accordingly utilities, of VGAM450 correlate with, and may be deduced from, the identity of the host target genes which VGAM450 binds and inhibits, and the function of these host target genes, as elaborated hereinbelow.

Nucleotide sequences of the VGAM450 precursor RNA, herein designated VGAM PRECURSOR RNA, and of the 'diced' VGAM450 RNA, herein designated VGAM RNA, and a schematic representation of the secondary folding of VGAM450 folded precursor RNA, herein designated VGAM FOLDED PRECURSOR RNA, of VGAM450 are further described hereinbelow with reference to Table 1.

Nucleotide sequences of host target binding sites, such as BINDING SITE-I, BINDING SITE-II and BINDING SITE-III of FIG. 1, found on VGAM450 host target RNA, and schematic representation of the complementarity of each of these host target binding sites to VGAM450 RNA, herein designated VGAM RNA, are described hereinbelow with reference to Table 2.

As mentioned hereinabove with reference to FIG. 1, a function of VGAM450 gene, herein designated VGAM is inhibition of expression of VGAM450 target genes. It is appreciated that specific functions, and accordingly utilities, of VGAM450 correlate with, and may be deduced from, the identity of the target genes which VGAM450 binds and inhibits, and the function of these target genes, as elaborated hereinbelow.

Collagen, Type V, Alpha 1 (COL5A1, Accession NM_000093) is a VGAM450 host target gene. COL5A1 BINDING SITE is HOST TARGET binding site found in the 5' untranslated region of mRNA encoded by COL5A1, corresponding to a HOST TARGET binding site such as BINDING SITE I, BINDING SITE II or BINDING SITE III. Table 2 illustrates the complementarity of the nucleotide sequences of COL5A1 BINDING SITE, designated SEQ ID:5556, to the nucleotide sequence of VGAM450 RNA, herein designated VGAM RNA, also designated SEQ ID:3161.

A function of VGAM450 is therefore inhibition of Collagen, Type V, Alpha 1 (COL5A1, Accession NM_000093). Accordingly, utilities of VGAM450 include diagnosis, prevention and treatment of diseases and clinical conditions associated with COL5A1. Interleukin 2 Receptor, Beta (IL2RB, Accession NM_000878) is another VGAM450 host target gene. IL2RB BINDING SITE is HOST TARGET binding site found in the 3' untranslated region of mRNA encoded by IL2RB, corresponding to a HOST TARGET binding site such as BINDING SITE I, BINDING SITE II or BINDING SITE III. Table 2 illustrates the complementarity of the nucleotide sequences of IL2RB BINDING SITE, designated SEQ ID:6574, to the nucleotide sequence of VGAM450 RNA, herein designated VGAM RNA, also designated SEQ ID:3161.

Another function of VGAM450 is therefore inhibition of Interleukin 2 Receptor, Beta (IL2RB, Accession NM_000878), a gene which is involved in receptor mediated endocytosis and transduces the mitogenic signals of il-2. Accordingly, utilities of VGAM450 include diagnosis, prevention and treatment of diseases and clinical conditions associated with IL2RB. The function of IL2RB has been established by previous studies. Kondo et al. (2000) showed that a clonogenic common lymphoid progenitor, a bone marrow-resident cell that gives rise exclusively to lymphocytes (T, B, and natural killer cells), can be redirected to the myeloid lineage by stimulation through exogenously expressed interleukin-2 receptor and GMCSF receptor (138981, 306250). Analysis of mutants of the beta chain of the IL2 receptor revealed that the granulocyte and monocyte differentiation signals are triggered by different cytoplasmic domains, showing that the signaling pathways responsible for these unique developmental outcomes are separable. Finally, Kondo et al. (2000) showed that the endogenous myelomonocytic cytokine receptors for GM-CSF and macrophage colony-stimulating factor (CSF1R; 164770) are expressed at low to moderate levels on the more primitive hematopoietic stem cells, are absent on common lymphoid progenitors, and are upregulated after myeloid lineage induction by IL2 (OMIM Ref. No. 147680). Kondo et al. (2000) concluded that cytokine signaling can regulate cell fate decisions and proposed that a critical step in lymphoid commitment is down regulation of cytokine receptors that drive myeloid cell development Yang et al. (2001) analyzed T-cell subsets and levels of cytokine IL2 and soluble IL2 receptor in the peripheral blood of patients with normal pressure glaucoma (NPG; 606657) and primary open angle glaucoma (POAG; 137760) and compared them to age-matched controls. They found increased frequency of CD8+/HLA-DR+ lymphocytes in patients with NPG and increased CD3+/CD8+ lymphocytes in both NPG and POAG patients. CD5+ lymphocytes were higher only in POAG patients. The mean concentration of soluble IL2R was higher in NPG and POAG patients than in controls although the IL2 concentration was similar in patients and controls. The authors concluded that the immune system might play an important role in initiation or progression of glaucomatous optic neuropathy in some patients Animal model experiments lend further support to the function of IL2RB. Suzuki et al. (1995) generated mice defective in Il2rb expression by insertion of a neomycin resistance cassette into the IL2RB gene at exon 6, which encodes a region of the extracellular domain proximal to the transmembrane region. Mice from 2 independent embryonic stem cell lines were separately bred homozygous for the defect, with both lineages showing identical gross appearances. The mice showed normal growth until approximately 3 weeks after birth. After 4 weeks of age, they were generally smaller than normal or heterozygous littermates and had abnormal appearances characterized by fuzzy hair, slow movement, and fully developed external genitals. Death occurred at approximately 12 weeks. In mice lacking the IL2R beta chain, T cells were shown to be spontaneously activated, resulting in exhaustive differentiation of B cells into plasma cells and the appearance of high serum concentrations of immunoglobulins G1 and E, as well as autoantibodies that cause hemolytic anemia. Marked infiltrated granulocytopoiesis was also apparent. Depletion of CD4+ T cells in mutant mice rescued B cells without reversion of granulocyte abnormalities. T cells did not proliferate in response to polyclonal activators, nor could antigen-specific immune responses be elicited. Thus, Suzuki et al. (1995) concluded that Il2rb is required to keep the activation programs of T cells under control, to maintain homeostasis, and to prevent autoimmunity It is appreciated that the abovementioned animal model for IL2RB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kondo, M.; Scherer, D. C.; Miyamoto, T.; King, A. G.; Akashi, K.; Sugamura, K.; Weissman, I. L.: Cell-fate conversion of lymphoid-committed progenitors by instructive actions of cytokines. Nature 407:383-386, 2000; and Suzuki, H.; Kundig, T. M.; Furlonger, C.; Wakeham, A.; Timms, E.; Matsuyama, T.; Schmits, R.; Simard, J. J. L.; Ohashi, P. S.; Griesser, H.; Taniguchi, T.; Paige, C. J.; Mak, T. W.: De.

Further studies establishing the function and utilities of IL2RB are found in John Hopkins OMIM database record ID 146710, and in sited publications numbered 11979, 12006-12008, 4333, 12009-1201 and 386 listed in the bibliography section hereinbelow, which are also hereby incorporated by reference. Nijmegen Breakage Syndrome 1 (nibrin) (NBS1, Accession XM_045343) is another VGAM450 host target gene. NBS1 BINDING SITE is HOST TARGET binding site found in the 3' untranslated region of mRNA encoded by NBS1, corresponding to a HOST TARGET binding site such as BINDING SITE I, BINDING SITE II or BINDING SITE III. Table 2 illustrates the complementarity of the nucleotide sequences of NBS1 BINDING SITE, designated SEQ ID:34438, to the nucleotide sequence of VGAM450 RNA, herein designated VGAM RNA, also designated SEQ ID:3161.

Another function of VGAM450 is therefore inhibition of Nijmegen Breakage Syndrome 1 (nibrin) (NBS1, Accession XM_045343), a gene which may be involved in repair of DNA double-strand breaks. Accordingly, utilities of VGAM450 include diagnosis, prevention and treatment of diseases and clinical conditions associated with NBS1. The function of NBS1 has been established by previous studies. Nijmegen breakage syndrome (NBS; 251260) is an autosomal recessive chromosomal instability syndrome characterized by microcephaly, growth retardation, immunodeficiency, and cancer predisposition. Cells from NBS patients are hypersensitive to ionizing radiation with cytogenetic features indistinguishable from those of ataxia-telangiectasia (AT; 208900). Varon et al. (1998) described the positional cloning of a gene encoding a novel protein, termed nibrin, that mapped within a 300-kb NBS critical interval on chromosome 8q21. The gene, designated NBS1, spans over 50 kb and contains 16 exons. Northern blot analysis revealed mRNA transcripts of 2.4 and 4.4 kb in all tissues examined. The predicted 754-amino acid protein contains 2 domains found in cell cycle checkpoint proteins, a forkhead-associated domain and an adjacent breast cancer carboxy-terminal domain. Varon et al. (1998) identified a truncating 5-bp deletion (602667.0001) in the majority of NBS patients studied, all of whom carried a conserved marker haplotype. Five additional truncating mutations were identified in patients with other distinct haplotypes. The domains found in nibrin and the NBS phenotype suggest that this disorder is caused by defective responses to DNA double-strand breaks (DSB). Animal model experiments lend further support to the function of NBS1. Zhu et al. (2001) generated mice deficient in NBS1 by targeted disruption. Nbs1 -/- mice suffered early embryonic lethality and had poorly developed embryonic and extraembryonic tissues. Blastocysts showed greatly diminished expansion of the inner cell mass in culture, suggesting that NBS1 mediates essential functions during proliferation in the absence of externally induced damage. Zhu et al. (2001) concluded that the complex phenotypes observed in NBS patients and cell lines may not result from a complete inactivation of NBS1 but may instead result from hypomorphic truncation mutations compatible with cell viability.

It is appreciated that the abovementioned animal model for NBS1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Varon, R.; Vissinga, C.; Platzer, M.; Cerosaletti, K. M.; Chrzanowska, K. H.; Saar, K.; Beckmann, G.; Seemanova, E.; Cooper, P. R.; Nowak, N. J.; Stumm, M.; Weemaes, C. M. R.; Gatti, R. A.; Wilson, R. K.; Digweed, M.; Rosenthal, A.; Sperling, K.; Concannon, P.; Reis, A.: Nibrin, a novel DNA double-strand break repair protein, is mutated in Nijmegen breakage syndrome. Cell 93:467-476, 1998; and Zhu, J.; Petersen, S.; Tessarollo, L.; Nussenzweig, A.: Targeted disruption of the Nijmegen breakage syndrome gene NBS1 leads to early embryonic lethality in mice. Curr. Biol. 11:105.

Further studies establishing the function and utilities of NBS1 are found in John Hopkins OMIM database record ID 602667, and in sited publications numbered 5918, 9233, 1551, 5919-5923, 9131, 8755-8756, 9438, 8757-8759, 714 and 8747 listed in the bibliography section hereinbelow, which are also hereby incorporated by reference. Platelet-activating Factor Receptor (PTAFR, Accession NM_000952) is another VGAM450 host target gene. PTAFR BINDING SITE is HOST TARGET binding site found in the 3' untranslated region of mRNA encoded by PTAFR, corresponding to a HOST TARGET binding site such as BINDING SITE I, BINDING SITE II or BINDING SITE III. Table 2 illustrates the complementarity of the nucleotide sequences of PTAFR BINDING SITE, designated SEQ ID:6658, to the nucleotide sequence of VGAM450 RNA, herein designated VGAM RNA, also designated SEQ ID:3161.

Another function of VGAM450 is therefore inhibition of Platelet-activating Factor Receptor (PTAFR, Accession NM_000952), a gene which is a platelet-activating factor receptor. Accordingly, utilities of VGAM450 include diagnosis, prevention and treatment of diseases and clinical conditions associated with PTAFR. The function of PTAFR has been established by previous studies. Platelet-activating factor (PAF) has been implicated as a mediator in diverse pathologic processes, such as allergy, asthma, septic shock, arterial thrombosis, and inflammatory processes (Prescott et al., 1990). PAF is a phospholipid (1-0-alkyl-2-acetyl-sn-glycero-3-phosphorylcholine) and exerts its various effects via specific cell surface receptors that bind PAF with high affinity. Using a guinea pig probe, Seyfried et al. (1992) isolated the gene for human PAF receptor (PTAFR). The coding sequence contains no introns. The encoded protein is highly homologous to the guinea pig PAF receptor (82% identity) and contains 7 putative transmembrane domains. The PAF receptor therefore appears to be a member of the G protein-coupled family of receptors and exhibits significant similarity to many members of this family. By analysis of rodent/human somatic cell hybrids, Seyfried et al. (1992) concluded that the PTAFR gene is located on human chromosome 1. Chase et al. (1996) used fluorescence in situ hybridization to localize PTAFR to 1p35-p34.3.

Full details of the abovementioned studies are described in the following publications, the disclosure of which are hereby incorporated by reference:

Prescott, S. M.; Zimmerman, G. A.; McIntyre, T. M.: Platelet-activating factor. J. Biol. Chem. 265:17381-17384, 1990; and Seyfried, C. E.; Schweickart, V. L.; Godiska, R.; Gray, P. W.: The human platelet-activating factor receptor gene (PTAFR) contains no introns and maps to chromosome 1. Genomics 13:832.

Further studies establishing the function and utilities of PTAFR are found in John Hopkins OMIM database record ID 173393, and in sited publications numbered 3523-3525 listed in the bibliography section hereinbelow, which are also hereby incorporated by reference. AF020591 (Accession NM_014480) is another VGAM450 host target gene. AF020591 BINDING SITE is HOST TARGET binding site found in the 3' untranslated region of mRNA encoded by AF020591, corresponding to a HOST TARGET binding site such as BINDING SITE I, BINDING SITE II or BINDING SITE III. Table 2 illustrates the complementarity of the nucleotide sequences of AF020591 BINDING SITE, designated SEQ ID:15826, to the nucleotide sequence of VGAM450 RNA, herein designated VGAM RNA, also designated SEQ ID:3161.

Another function of VGAM450 is therefore inhibition of AF020591 (Accession NM_014480). Accordingly, utilities of VGAM450 include diagnosis, prevention and treatment of diseases and clinical conditions associated with AF020591. Inositol 1,3,4-triphosphate 5/6 Kinase (ITPK1, Accession NM_014216) is another VGAM450 host target gene. ITPK1 BINDING SITE is HOST TARGET binding site found in the 5' untranslated region of mRNA encoded by ITPK1, corresponding to a HOST TARGET binding site such as BINDING SITE I, BINDING SITE II or BINDING SITE III. Table 2 illustrates the complementarity of the nucleotide sequences of ITPK1 BINDING SITE, designated SEQ ID:15481, to the nucleotide sequence of VGAM450 RNA, herein designated VGAM RNA, also designated SEQ ID:3161.

Another function of VGAM450 is therefore inhibition of Inositol 1,3,4-triphosphate 5/6 Kinase (ITPK1, Accession NM_014216). Accordingly, utilities of VGAM450 include diagnosis, prevention and treatment of diseases and clinical conditions associated with ITPK1. Phosphodiesterase 4D Interacting Protein (myomegalin) (PDE4DIP, Accession NM_014644) is another VGAM450 host target gene. PDE4DIP BINDING SITE is HOST TARGET binding site found in the 3' untranslated region of mRNA encoded by PDE4DIP, corresponding to a HOST TARGET binding site such as BINDING SITE I, BINDING SITE II or BINDING SITE III. Table 2 illustrates the complementarity of the nucleotide sequences of PDE4DIP BINDING SITE, designated SEQ ID:16052, to the nucleotide sequence of VGAM450 RNA, herein designated VGAM RNA, also designated SEQ ID:3161.

Another function of VGAM450 is therefore inhibition of Phosphodiesterase 4D Interacting Protein (myomegalin) (PDE4DIP, Accession NM_014644). Accordingly, utilities of VGAM450 include diagnosis, prevention and treatment of diseases and clinical conditions associated with PDE4DIP. FIG. 1 further provides a conceptual description of a novel bioinformatically detected viral gene of the present invention, referred to here as Viral Genomic Address Messenger 451 (VGAM451) viral gene, which modulates expression of respective host target genes thereof, the function and utility of which host target genes is known in the art.

VGAM451 is a novel bioinformatically detected regulatory, non protein coding, viral micro RNA (miRNA) gene. The method by which VGAM451 was detected is described hereinabove with reference to FIGS. 1-8.

VGAM451 gene, herein designated VGAM GENE, is a viral gene contained in the genome of Cardamine Chlorotic Fleck Virus. VGAM451 host target gene, herein designated VGAM HOST TARGET GENE, is a human gene contained in the human genome.

VGAM451 gene encodes a VGAM451 precursor RNA, herein designated VGAM PRECURSOR RNA. Similar to other miRNA genes, and unlike most ordinary genes, VGAM451 precursor RNA does not encode a protein. A nucleotide sequence identical or highly similar to the nucleotide sequence of VGAM451 precursor RNA is designated SEQ ID:437, and is provided hereinbelow with reference to the sequence listing part. Nucleotide sequence SEQ ID:437 is located at position 694 relative to the genome of Cardamine Chlorotic Fleck Virus.

VGAM451 precursor RNA folds onto itself, forming VGAM451 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM451 folded precursor RNA into VGAM451 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM451 RNA is designated SEQ ID:3162, and is provided hereinbelow with reference to the sequence listing part.

VGAM451 host target gene, herein designated VGAM HOST TARGET GENE, encodes a corresponding messenger RNA, VGAM451 host target RNA, herein designated VGAM HOST TARGET RNA. VGAM451 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM451 RNA, herein designated VGAM RNA, binds complementarily to one or more host target binding sites located in untranslated regions of VGAM451 host target RNA, herein designated VGAM HOST TARGET RNA. This complementary binding is due to the fact that the nucleotide sequence of VGAM451 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM451 RNA, herein designated VGAM RNA, may have a different number of host target binding sites in untranslated regions of a VGAM451 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM451 RNA, herein designated VGAM RNA, to host target binding sites on VGAM451 host target RNA, herein designated VGAM HOST TARGET RNA, such as BINDING SITE I, BINDING SITE II and BINDING SITE III, inhibits translation of VGAM451 host target RNA into VGAM451 host target protein, herein designated VGAM HOST TARGET PROTEIN. VGAM host target protein is therefore outlined by a broken line.

It is appreciated that VGAM451 host target gene, herein designated VGAM HOST TARGET GENE, in fact represents a plurality of VGAM451 host target genes. The mRNA of each one of this plurality of VGAM451 host target genes comprises one or more host target binding sites, each having a nucleotide sequence which is at least partly complementary to VGAM451 RNA, herein designated VGAM RNA, and which when bound by VGAM451 RNA causes inhibition of translation of respective one or more VGAM451 host target proteins.

It is further appreciated by one skilled in the art that the mode of translational inhibition illustrated by FIG. 1 with specific reference to translational inhibition exerted by VGAM451 gene, herein designated VGAM GENE, on one or more VGAM451 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM451 is inhibition of expression of host target genes, as part of a novel viral mechanism of attacking a host. Accordingly, utilities of VGAM451 include diagnosis, prevention and treatment of viral infection by Cardamine Chlorotic Fleck Virus. Specific functions, and accordingly utilities, of VGAM451 correlate with, and may be deduced from, the identity of the host target genes which VGAM451 binds and inhibits, and the function of these host target genes, as elaborated hereinbelow.

Nucleotide sequences of the VGAM451 precursor RNA, herein designated VGAM PRECURSOR RNA, and of the 'diced' VGAM451 RNA, herein designated VGAM RNA, and a schematic representation of the secondary folding of VGAM451 folded precursor RNA, herein designated VGAM FOLDED PRECURSOR RNA, of VGAM451 are further described hereinbelow with reference to Table 1.

Nucleotide sequences of host target binding sites, such as BINDING SITE-I, BINDING SITE-II and BINDING SITE-III of FIG. 1, found on VGAM451 host target RNA, and schematic representation of the complementarity of each of these host target binding sites to VGAM451 RNA, herein designated VGAM RNA, are described hereinbelow with reference to Table 2.

As mentioned hereinabove with reference to FIG. 1, a function of VGAM451 gene, herein designated VGAM is inhibition of expression of VGAM451 target genes. It is appreciated that specific functions, and accordingly utilities, of VGAM451 correlate with, and may be deduced from, the identity of the target genes which VGAM451 binds and inhibits, and the function of these target genes, as elaborated hereinbelow.

Diacylglycerol Kinase, Gamma 90 kDa (DGKG, Accession NM_001346) is a VGAM451 host target gene. DGKG BINDING SITE is HOST TARGET binding site found in the 3' untranslated region of mRNA encoded by DGKG, corresponding to a HOST TARGET binding site such as BINDING SITE I, BINDING SITE II or BINDING SITE III. Table 2 illustrates the complementarity of the nucleotide sequences of DGKG BINDING SITE, designated SEQ ID:7025, to the nucleotide sequence of VGAM451 RNA, herein designated VGAM RNA, also designated SEQ ID:3162.

A function of VGAM451 is therefore inhibition of Diacylglycerol Kinase, Gamma 90 kDa (DGKG, Accession NM_001346), a gene which may convert diacylglycerol to phosphatidic acid. Accordingly, utilities of VGAM451 include diagnosis, prevention and treatment of diseases and clinical conditions associated with DGKG. The function of DGKG has been established by previous studies. Kai et al. (1994) used degenerate PCR to clone a novel DGK, termed DGK-gamma, from HepG2 human hepatoma mRNA. They subsequently cloned a full-length cDNA from a HepG2 cDNA library. Sequence analysis revealed that DGK-gamma encodes a polypeptide of 791 amino acids which is 52% similar to that of DGK-alpha (DAGK1; 125855) and 62% similar to that of DGK-beta (OMIM Ref. No. 604070). All 3 DGK isozymes contain 2 conserved EF-hand calcium-binding motifs and 2 zinc finger domains. They also noted that some cDNAs contained a 25-amino acid truncation, which the authors presumed to be an alternate splicing variant. Both the full-length and truncated transcripts are present in a range of human tissues, with greatest expression observed in retina. When expressed in COS-7 cells, Kai et al. (1994) observed that full-length, but not truncated, DGK-gamma gave DGK activity. This activity was phosphatidylserine-dependent and had no apparent specificity with regard to the acyl group. Kai et al. (1994) showed that DAGK3 is expressed predominantly in the human retina. Mutations in the gene encoding an eye-specific diacylglycerol kinase (DGK2) are known to cause retinal degeneration A (rdgA) in Drosophila melanogaster (Masai et al., 1993). Based on these findings, Stohr et al. (1999) reasoned that DAGK3 might be an excellent candidate gene for a human eye disease. They found that the human DAGK3 gene spans over 30 kb of genomic DNA interrupted by 23 introns. By FISH, they mapped the DAGK3 locus to 3q27-q28, overlapping the chromosomal region known to contain the gene (OPA1; 605290) underlying dominant optic atrophy (OMIM Ref. No. 165500), the most common form of hereditary atrophy of the optic nerve. Mutational analysis of the entire coding region of DAGK3 in 19 unrelated German optic atrophy-1 patients did not reveal any disease-causing mutations, thus excluding DAGK3 as a major cause underlying optic atrophy-1.

Full details of the abovementioned studies are described in the following publications, the disclosure of which are hereby incorporated by reference:

Kai, M.; Sakane, F.; Imai, S.; Wada, I.; Kanoh, H.: Molecular cloning of a diacylglycerol kinase isozyme predominantly expressed in human retina with a truncated and inactive enzyme expression in most other human cells. J. Biol. Chem. 269: 18492-18498, 1994; and Stohr, H.; Klein, J.; Gehrig, A.; Koehler, M. R.; Jurklies, B.; Kellner, U.; Leo-Kottler, B.; Schmid, M.; Weber, B. H. F.: Mapping and genomic characterization of the gene encoding diac.

Further studies establishing the function and utilities of DGKG are found in John Hopkins OMIM database record ID 601854, and in sited publications numbered 1266-1268 listed in the bibliography section hereinbelow, which are also hereby incorporated by reference. FLJ13955 (Accession NM_024759) is another VGAM451 host target gene. FLJ13955 BINDING SITE is HOST TARGET binding site found in the 3' untranslated region of mRNA encoded by FLJ13955, corresponding to a HOST TARGET binding site such as BINDING SITE I, BINDING SITE II or BINDING SITE III. Table 2 illustrates the complementarity of the nucleotide sequences of FLJ13955 BINDING SITE, designated SEQ ID:24108, to the nucleotide sequence of VGAM451 RNA, herein designated VGAM RNA, also designated SEQ ID:3162.

Another function of VGAM451 is therefore inhibition of FLJ13955 (Accession NM_024759). Accordingly, utilities of VGAM451 include diagnosis, prevention and treatment of diseases and clinical conditions associated with FLJ13955. KIAA0356 (Accession XM_038655) is another VGAM451 host target gene. KIAA0356 BINDING SITE is HOST TARGET binding site found in the 3' untranslated region of mRNA encoded by KIAA0356, corresponding to a HOST TARGET binding site such as BINDING SITE I, BINDING SITE II or BINDING SITE III. Table 2 illustrates the complementarity of the nucleotide sequences of KIAA0356 BINDING SITE, designated SEQ ID:32890, to the nucleotide sequence of VGAM451 RNA, herein designated VGAM RNA, also designated SEQ ID:3162.

Another function of VGAM451 is therefore inhibition of KIAA0356 (Accession XM_038655). Accordingly, utilities of VGAM451 include diagnosis, prevention and treatment of diseases and clinical conditions associated with KIAA0356. RASD Family, Member 2 (RASD2, Accession NM_014310) is another VGAM451 host target gene. RASD2 BINDING SITE is HOST TARGET binding site found in the 3' untranslated region of mRNA encoded by RASD2, corresponding to a HOST TARGET binding site such as BINDING SITE I, BINDING SITE II or BINDING SITE III. Table 2 illustrates the complementarity of the nucleotide sequences of RASD2 BINDING SITE, designated SEQ ID:15598, to the nucleotide sequence of VGAM451 RNA, herein designated VGAM RNA, also designated SEQ ID:3162.

Another function of VGAM451 is therefore inhibition of RASD Family, Member 2 (RASD2, Accession NM_014310). Accordingly, utilities of VGAM451 include diagnosis, prevention and treatment of diseases and clinical conditions associated with RASD2. FIG. 1 further provides a conceptual description of a novel bioinformatically detected viral gene of the present invention, referred to here as Viral Genomic Address Messenger 452 (VGAM452) viral gene, which modulates expression of respective host target genes thereof, the function and utility of which host target genes is known in the art.

VGAM452 is a novel bioinformatically detected regulatory, non protein coding, viral micro RNA (miRNA) gene. The method by which VGAM452 was detected is described hereinabove with reference to FIGS. 1-8.

VGAM452 gene, herein designated VGAM GENE, is a viral gene contained in the genome of Cardamine Chlorotic Fleck Virus. VGAM452 host target gene, herein designated VGAM HOST TARGET GENE, is a human gene contained in the human genome.

VGAM452 gene encodes a VGAM452 precursor RNA, herein designated VGAM PRECURSOR RNA. Similar to other miRNA genes, and unlike most ordinary genes, VGAM452 precursor RNA does not encode a protein. A nucleotide sequence identical or highly similar to the nucleotide sequence of VGAM452 precursor RNA is designated SEQ ID:438, and is provided hereinbelow with reference to the sequence listing part. Nucleotide sequence SEQ ID:438 is located at position 2170 relative to the genome of Cardamine Chlorotic Fleck Virus.

VGAM452 precursor RNA folds onto itself, forming VGAM452 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM452 folded precursor RNA into VGAM452 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 42%) nucleotide sequence of VGAM452 RNA is designated SEQ ID:3163, and is provided hereinbelow with reference to the sequence listing part.

VGAM452 host target gene, herein designated VGAM HOST TARGET GENE, encodes a corresponding messenger RNA, VGAM452 host target RNA, herein designated VGAM HOST TARGET RNA. VGAM452 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM452 RNA, herein designated VGAM RNA, binds complementarily to one or more host target binding sites located in untranslated regions of VGAM452 host target RNA, herein designated VGAM HOST TARGET RNA. This complementary binding is due to the fact that the nucleotide sequence of VGAM452 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM452 RNA, herein designated VGAM RNA, may have a different number of host target binding sites in untranslated regions of a VGAM452 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM452 RNA, herein designated VGAM RNA, to host target binding sites on VGAM452 host target RNA, herein designated VGAM HOST TARGET RNA, such as BINDING SITE I, BINDING SITE II and BINDING SITE III, inhibits translation of VGAM452 host target RNA into VGAM452 host target protein, herein designated VGAM HOST TARGET PROTEIN. VGAM host target protein is therefore outlined by a broken line.

It is appreciated that VGAM452 host target gene, herein designated VGAM HOST TARGET GENE, in fact represents a plurality of VGAM452 host target genes. The mRNA of each one of this plurality of VGAM452 host target genes comprises one or more host target binding sites, each having a nucleotide sequence which is at least partly complementary to VGAM452 RNA, herein designated VGAM RNA, and which when bound by VGAM452 RNA causes inhibition of translation of respective one or more VGAM452 host target proteins.

It is further appreciated by one skilled in the art that the mode of translational inhibition illustrated by FIG. 1 with specific reference to translational inhibition exerted by VGAM452 gene, herein designated VGAM GENE, on one or more VGAM452 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM452 is inhibition of expression of host target genes, as part of a novel viral mechanism of attacking a host. Accordingly, utilities of VGAM452 include diagnosis, prevention and treatment of viral infection by Cardamine Chlorotic Fleck Virus. Specific functions, and accordingly utilities, of VGAM452 correlate with, and may be deduced from, the identity of the host target genes which VGAM452 binds and inhibits, and the function of these host target genes, as elaborated hereinbelow.

Nucleotide sequences of the VGAM452 precursor RNA, herein designated VGAM PRECURSOR RNA, and of the 'diced' VGAM452 RNA, herein designated VGAM RNA, and a schematic representation of the secondary folding of VGAM452 folded precursor RNA, herein designated VGAM FOLDED PRECURSOR RNA, of VGAM452 are further described hereinbelow with reference to Table 1.

Nucleotide sequences of host target binding sites, such as BINDING SITE-I, BINDING SITE-II and BINDING SITE-III of FIG. 1, found on VGAM452 host target RNA, and schematic representation of the complementarity of each of these host target binding sites to VGAM452 RNA, herein designated VGAM RNA, are described hereinbelow with reference to Table 2.

As mentioned hereinabove with reference to FIG. 1, a function of VGAM452 gene, herein designated VGAM is inhibition of expression of VGAM452 target genes. It is appreciated that specific functions, and accordingly utilities, of VGAM452 correlate with, and may be deduced from, the identity of the target genes which VGAM452 binds and inhibits, and the function of these target genes, as elaborated hereinbelow.

TRIP15 (Accession NM_004236) is a VGAM452 host target gene. TRIP15 BINDING SITE is HOST TARGET binding site found in the 3' untranslated region of mRNA encoded by TRIP15, corresponding to a HOST TARGET binding site such as BINDING SITE I, BINDING SITE II or BINDING SITE III. Table 2 illustrates the complementarity of the nucleotide sequences of TRIP15 BINDING SITE, designated SEQ ID:10430, to the nucleotide sequence of VGAM452 RNA, herein designated VGAM RNA, also designated SEQ ID:3163.

A function of VGAM452 is therefore inhibition of TRIP15 (Accession NM_004236), a gene which is a subunit of the COP9 signalosome complex. Accordingly, utilities of VGAM452 include diagnosis, prevention and treatment of diseases and clinical conditions associated with TRIP15. The function of TRIP15 has been established by previous studies. TRIP15, or SGN2, is part of a 450-kD signalosome complex that includes COPS3 (OMIM Ref. No. 604665), COPS5 (OMIM Ref. No. 604850), GPS1 (OMIM Ref. No. 601934), and at least 4 other subunits. By autoradiographic analysis, Seeger et al. (1998) showed that the complex phosphorylates JUN (OMIM Ref. No. 165160), IKBA (OMIM Ref. No. 164008), and the C-terminal part of the p105 precursor of NFKB (OMIM Ref. No. 164011). The 26S proteasome is not a phosphorylation target, although immunofluorescence microscopy demonstrated that the 450-kD complex has a cytosolic localization, concentrated around the nucleus. Some nuclear hormone receptors (NHRs) silence gene expression in the absence of hormone. Corepressors, which are bound to the silencing domain of NHRs and are involved in the repression of gene expression, dissociate upon hormone binding, leading to the binding of coactivators that mediate gene activation. TR is a transcriptional silencer in the absence of hormone as well as a hormone-dependent transactivator, with its silencing domain localized in the C terminus. Dressel et al. (1999) obtained a full-length HeLa cell cDNA encoding TRIP15, the human homolog of the Drosophila corepressor 'Alien.' Sequence analysis predicted that the 305-amino acid TRIP15 protein, which is 90% identical and 95% similar to Drosophila Alien, contains an acidic region in the N terminus, a putative zinc finger in the C terminus, and a central hydrophobic core region flanked by 2 putative alpha-helical structures and a nuclear localization signal. Western blot analysis determined that TRIP15 is expressed as a 41-kD protein. Yeast 2-hybrid, GST pull-down, and coimmunoprecipitation analyses showed that TRIP15 interacts with the C terminus of TR, but not with intact RAR (OMIM Ref. No. 180240), only in the absence of hormone. Immunofluorescence microscopy demonstrated that TRIP15 is localized in the nucleus. Reporter assays indicated that TRIP15 increases receptor-mediated silencing and harbors an autonomous silencing function, which correlates with the ability of TRIP15 to interact with TR in both the hinge region and the C-terminal end of the TR silencing domain.

Full details of the abovementioned studies are described in the following publications, the disclosure of which are hereby incorporated by reference:

Seeger, M.; Kraft, R.; Ferrell, K.; Dawadschargal, B.-O.; Dumdey, R.; Schade, R.; Gordon, C.; Naumann, M.; Dubiel, W.: A novel protein complex involved in signal transduction possessing similarities to 26S proteasome subunits. FASEB J. 12:469-478, 1998; and Dressel, U.; Thormeyer, D.; Altincicek, B.; Paululat, A.; Eggert, M.; Schneider, S.; Tenbaum, S. P.; Renkawitz, R.; Baniahmad, A.: Alien, a highly conserved protein with characteristics of.

Further studies establishing the function and utilities of TRIP15 are found in John Hopkins OMIM database record ID 604508, and in sited publications numbered 544 and 6199-5445 listed in the bibliography section hereinbelow, which are also hereby incorporated by reference. FLJ10901 (Accession NM_018265) is another VGAM452 host target gene. FLJ10901 BINDING SITE is HOST TARGET binding site found in the 3' untranslated region of mRNA encoded by FLJ10901, corresponding to a HOST TARGET binding site such as BINDING SITE I, BINDING SITE II or BINDING SITE III. Table 2 illustrates the complementarity of the nucleotide sequences of FLJ10901 BINDING SITE, designated SEQ ID:20234, to the nucleotide sequence of VGAM452 RNA, herein designated VGAM RNA, also designated SEQ ID:3163.

Another function of VGAM452 is therefore inhibition of FLJ10901 (Accession NM_018265). Accordingly, utilities of VGAM452 include diagnosis, prevention and treatment of diseases and clinical conditions associated with FLJ10901. GW112 (Accession NM_006418) is another VGAM452 host target gene. GW112 BINDING SITE is HOST TARGET binding site found in the 3' untranslated region of mRNA encoded by GW112, corresponding to a HOST TARGET binding site such as BINDING SITE I, BINDING SITE II or BINDING SITE III. Table 2 illustrates the complementarity of the nucleotide sequences of GW112 BINDING SITE, designated SEQ ID:13133, to the nucleotide sequence of VGAM452 RNA, herein designated VGAM RNA, also designated SEQ ID:3163.

Another function of VGAM452 is therefore inhibition of GW112 (Accession NM_006418). Accordingly, utilities of VGAM452 include diagnosis, prevention and treatment of diseases and clinical conditions associated with GW112. KIAA0976 (Accession NM_014917) is another VGAM452 host target gene. KIAA0976 BINDING SITE is HOST TARGET binding site found in the 3' untranslated region of mRNA encoded by KIAA0976, corresponding to a HOST TARGET binding site such as BINDING SITE I, BINDING SITE II or BINDING SITE III. Table 2 illustrates the complementarity of the nucleotide sequences of KIAA0976 BINDING SITE, designated SEQ ID:17166, to the nucleotide sequence of VGAM452 RNA, herein designated VGAM RNA, also designated SEQ ID:3163.

Another function of VGAM452 is therefore inhibition of KIAA0976 (Accession NM_014917). Accordingly, utilities of VGAM452 include diagnosis, prevention and treatment of diseases and clinical conditions associated with KIAA0976. LOC245771 (Accession XM_167366) is another VGAM452 host target gene. LOC245771 BINDING SITE is HOST TARGET binding site found in the 5' untranslated region of mRNA encoded by LOC245771, corresponding to a HOST TARGET binding site such as BINDING SITE I, BINDING SITE II or BINDING SITE III. Table 2 illustrates the complementarity of the nucleotide sequences of LOC245771 BINDING SITE, designated SEQ ID:44639, to the nucleotide sequence of VGAM452 RNA, herein designated VGAM RNA, also designated SEQ ID:3163.

Another function of VGAM452 is therefore inhibition of LOC245771 (Accession XM_167366). Accordingly, utilities of VGAM452 include diagnosis, prevention and treatment of diseases and clinical conditions associated with LOC245771. FIG. 1 further provides a conceptual description of a novel bioinformatically detected viral gene of the present invention, referred to here as Viral Genomic Address Messenger 453 (VGAM453) viral gene, which modulates expression of respective host target genes thereof, the function and utility of which host target genes is known in the art.

VGAM453 is a novel bioinformatically detected regulatory, non protein coding, viral micro RNA (miRNA) gene. The method by which VGAM453 was detected is described hereinabove with reference to FIGS. 1-8.

VGAM453 gene, herein designated VGAM GENE, is a viral gene contained in the genome of Borna Disease Virus. VGAM453 host target gene, herein designated VGAM HOST TARGET GENE, is a human gene contained in the human genome.

VGAM453 gene encodes a VGAM453 precursor RNA, herein designated VGAM PRECURSOR RNA. Similar to other miRNA genes, and unlike most ordinary genes, VGAM453 precursor RNA does not encode a protein. A nucleotide sequence identical or highly similar to the nucleotide sequence of VGAM453 precursor RNA is designated SEQ ID:439, and is provided hereinbelow with reference to the sequence listing part. Nucleotide sequence SEQ ID:439 is located at position 5441 relative to the genome of Borna Disease Virus.

VGAM453 precursor RNA folds onto itself, forming VGAM453 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM453 folded precursor RNA into VGAM453 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM453 RNA is designated SEQ ID:3164, and is provided hereinbelow with reference to the sequence listing part.

VGAM453 host target gene, herein designated VGAM HOST TARGET GENE, encodes a corresponding messenger RNA, VGAM453 host target RNA, herein designated VGAM HOST TARGET RNA. VGAM453 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM453 RNA, herein designated VGAM RNA, binds complementarily to one or more host target binding sites located in untranslated regions of VGAM453 host target RNA, herein designated VGAM HOST TARGET RNA. This complementary binding is due to the fact that the nucleotide sequence of VGAM453 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM453 RNA, herein designated VGAM RNA, may have a different number of host target binding sites in untranslated regions of a VGAM453 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM453 RNA, herein designated VGAM RNA, to host target binding sites on VGAM453 host target RNA, herein designated VGAM HOST TARGET RNA, such as BINDING SITE I, BINDING SITE II and BINDING SITE III, inhibits translation of VGAM453 host target RNA into VGAM453 host target protein, herein designated VGAM HOST TARGET PROTEIN. VGAM host target protein is therefore outlined by a broken line.

It is appreciated that VGAM453 host target gene, herein designated VGAM HOST TARGET GENE, in fact represents a plurality of VGAM453 host target genes. The mRNA of each one of this plurality of VGAM453 host target genes comprises one or more host target binding sites, each having a nucleotide sequence which is at least partly complementary to VGAM453 RNA, herein designated VGAM RNA, and which when bound by VGAM453 RNA causes inhibition of translation of respective one or more VGAM453 host target proteins.

It is further appreciated by one skilled in the art that the mode of translational inhibition illustrated by FIG. 1 with specific reference to translational inhibition exerted by VGAM453 gene, herein designated VGAM GENE, on one or more VGAM453 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM453 is inhibition of expression of host target genes, as part of a novel viral mechanism of attacking a host. Accordingly, utilities of VGAM453 include diagnosis, prevention and treatment of viral infection by Borna Disease Virus. Specific functions, and accordingly utilities, of VGAM453 correlate with, and may be deduced from, the identity of the host target genes which VGAM453 binds and inhibits, and the function of these host target genes, as elaborated hereinbelow.

Nucleotide sequences of the VGAM453 precursor RNA, herein designated VGAM PRECURSOR RNA, and of the 'diced' VGAM453 RNA, herein designated VGAM RNA, and a schematic representation of the secondary folding of VGAM453 folded precursor RNA, herein designated VGAM FOLDED PRECURSOR RNA, of VGAM453 are further described hereinbelow with reference to Table 1.

Nucleotide sequences of host target binding sites, such as BINDING SITE-I, BINDING SITE-II and BINDING SITE-III of FIG. 1, found on VGAM453 host target RNA, and schematic representation of the complementarity of each of these host target binding sites to VGAM453 RNA, herein designated VGAM RNA, are described hereinbelow with reference to Table 2.

As mentioned hereinabove with reference to FIG. 1, a function of VGAM453 gene, herein designated VGAM is inhibition of expression of VGAM453 target genes. It is appreciated that specific functions, and accordingly utilities, of VGAM453 correlate with, and may be deduced from, the identity of the target genes which VGAM453 binds and inhibits, and the function of these target genes, as elaborated hereinbelow.

Aldehyde Dehydrogenase 3 Family, Member B2 (ALDH3B2, Accession NM_000695) is a VGAM453 host target gene. ALDH3B2 BINDING SITE is HOST TARGET binding site found in the 3' untranslated region of mRNA encoded by ALDH3B2, corresponding to a HOST TARGET binding site such as BINDING SITE I, BINDING SITE II or BINDING SITE III. Table 2 illustrates the complementarity of the nucleotide sequences of ALDH3B2 BINDING SITE, designated SEQ ID:6355, to the nucleotide sequence of VGAM453 RNA, herein designated VGAM RNA, also designated SEQ ID:3164.

A function of VGAM453 is therefore inhibition of Aldehyde Dehydrogenase 3 Family, Member B2 (ALDH3B2, Accession NM_000695), a gene which may play a role in alcohol detoxitation. Accordingly, utilities of VGAM453 include diagnosis, prevention and treatment of diseases and clinical conditions associated with ALDH3B2. The function of ALDH3B2 and its association with various diseases and clinical conditions, has been established by previous studies, as described hereinabove with reference to VGAM251.

FLJ20813 (Accession NM_017961) is another VGAM453 host target gene. FLJ20813 BINDING SITE is HOST TARGET binding site found in the 3" untranslated region of mRNA encoded by FLJ20813, corresponding to a HOST TARGET binding site such as BINDING SITE I, BINDING SITE II or BINDING SITE III. Table 2 illustrates the complementarity of the nucleotide sequences of FLJ20813 BINDING SITE, designated SEQ ID:19677, to the nucleotide sequence of VGAM453 RNA, herein designated VGAM RNA, also designated SEQ ID:3164.

Another function of VGAM453 is therefore inhibition of FLJ20813 (Accession NM_017961). Accordingly, utilities of VGAM453 include diagnosis, prevention and treatment of diseases and clinical conditions associated with FLJ20813.

LOC149650 (Accession XM_086623) is another VGAM453 host target gene. LOC149650 BINDING SITE is HOST TARGET binding site found in the 3' untranslated region of mRNA encoded by LOC149650, corresponding to a HOST TARGET binding site such as BINDING SITE I, BINDING SITE II or BINDING SITE III. Table 2 illustrates the complementarity of the nucleotide sequences of LOC149650 BINDING SITE, designated SEQ ID:38795, to the nucleotide sequence of VGAM453 RNA, herein designated VGAM RNA, also designated SEQ ID:3164.

Another function of VGAM453 is therefore inhibition of LOC149650 (Accession XM_086623). Accordingly, utilities of VGAM453 include diagnosis, prevention and treatment of diseases and clinical conditions associated with LOC149650. LOC150397 (Accession XM_086907) is another VGAM453 host target gene. LOC150397 BINDING SITE is HOST TARGET binding site found in the 3' untranslated region of mRNA encoded by LOC150397, corresponding to a HOST TARGET binding site such as BINDING SITE I, BINDING SITE II or BINDING SITE III. Table 2 illustrates the complementarity of the nucleotide sequences of LOC150397 BINDING SITE, designated SEQ ID:38958, to the nucleotide sequence of VGAM453 RNA, herein designated VGAM RNA, also designated SEQ ID:3164.

Another function of VGAM453 is therefore inhibition of LOC150397 (Accession XM_086907). Accordingly, utilities of VGAM453 include diagnosis, prevention and treatment of diseases and clinical conditions associated with LOC150397. LOC161823 (Accession XM_091156) is another VGAM453 host target gene. LOC161823 BINDING SITE is HOST TARGET binding site found in the 3' untranslated region of mRNA encoded by LOC161823, corresponding to a HOST TARGET binding site such as BINDING SITE I, BINDING SITE II or BINDING SITE III. Table 2 illustrates the complementarity of the nucleotide sequences of LOC161823 BINDING SITE, designated SEQ ID:40029, to the nucleotide sequence of VGAM453 RNA, herein designated VGAM RNA, also designated SEQ ID:3164.

Another function of VGAM453 is therefore inhibition of LOC161823 (Accession XM_091156). Accordingly, utilities of VGAM453 include diagnosis, prevention and treatment of diseases and clinical conditions associated with LOC161823. FIG. 1 further provides a conceptual description of a novel bioinformatically detected viral gene of the present invention, referred to here as Viral Genomic Address Messenger 454 (VGAM454) viral gene, which modulates expression of respective host target genes thereof, the function and utility of which host target genes is known in the art.

VGAM454 is a novel bioinformatically detected regulatory, non protein coding, viral micro RNA (miRNA) gene. The method by which VGAM454 was detected is described hereinabove with reference to FIGS. 1-8.

VGAM454 gene, herein designated VGAM GENE, is a viral gene contained in the genome of Borna Disease Virus. VGAM454 host target gene, herein designated VGAM HOST TARGET GENE, is a human gene contained in the human genome.

VGAM454 gene encodes a VGAM454 precursor RNA, herein designated VGAM PRECURSOR RNA. Similar to other miRNA genes, and unlike most ordinary genes, VGAM454 precursor RNA does not encode a protein. A nucleotide sequence identical or highly similar to the nucleotide sequence of VGAM454 precursor RNA is designated SEQ ID:440, and is provided hereinbelow with reference to the sequence listing part. Nucleotide sequence SEQ ID:440 is located at position 8313 relative to the genome of Borna Disease Virus.

VGAM454 precursor RNA folds onto itself, forming VGAM454 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM454 folded precursor RNA into VGAM454 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM454 RNA is designated SEQ ID:3165, and is provided hereinbelow with reference to the sequence listing part.

VGAM454 host target gene, herein designated VGAM HOST TARGET GENE, encodes a corresponding messenger RNA, VGAM454 host target RNA, herein designated VGAM HOST TARGET RNA. VGAM454 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM454 RNA, herein designated VGAM RNA, binds complementarily to one or more host target binding sites located in untranslated regions of VGAM454 host target RNA, herein designated VGAM HOST TARGET RNA. This complementary binding is due to the fact that the nucleotide sequence of VGAM454 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM454 RNA, herein designated VGAM RNA, may have a different number of host target binding sites in untranslated regions of a VGAM454 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM454 RNA, herein designated VGAM RNA, to host target binding sites on VGAM454 host target RNA, herein designated VGAM HOST TARGET RNA, such as BINDING SITE I, BINDING SITE II and BINDING SITE III, inhibits translation of VGAM454 host target RNA into VGAM454 host target protein, herein designated VGAM HOST TARGET PROTEIN. VGAM host target protein is therefore outlined by a broken line.

It is appreciated that VGAM454 host target gene, herein designated VGAM HOST TARGET GENE, in fact represents a plurality of VGAM454 host target genes. The mRNA of each one of this plurality of VGAM454 host target genes comprises one or more host target binding sites, each having a nucleotide sequence which is at least partly complementary to VGAM454 RNA, herein designated VGAM RNA, and which when bound by VGAM454 RNA causes inhibition of translation of respective one or more VGAM454 host target proteins.

It is further appreciated by one skilled in the art that the mode of translational inhibition illustrated by FIG. 1 with specific reference to translational inhibition exerted by VGAM454 gene, herein designated VGAM GENE, on one or more VGAM454 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM454 is inhibition of expression of host target genes, as part of a novel viral mechanism of attacking a host. Accordingly, utilities of VGAM454 include diagnosis, prevention and treatment of viral infection by Borna Disease Virus. Specific functions, and accordingly utilities, of VGAM454 correlate with, and may be deduced from, the identity of the host target genes which VGAM454 binds and inhibits, and the function of these host target genes, as elaborated hereinbelow.

Nucleotide sequences of the VGAM454 precursor RNA, herein designated VGAM PRECURSOR RNA, and of the 'diced' VGAM454 RNA, herein designated VGAM RNA, and a schematic representation of the secondary folding of VGAM454 folded precursor RNA, herein designated VGAM FOLDED PRECURSOR RNA, of VGAM454 are further described hereinbelow with reference to Table 1.

Nucleotide sequences of host target binding sites, such as BINDING SITE-I, BINDING SITE-II and BINDING SITE-III of FIG. 1, found on VGAM454 host target RNA, and schematic representation of the complementarity of each of these host target binding sites to VGAM454 RNA, herein designated VGAM RNA, are described hereinbelow with reference to Table 2.

As mentioned hereinabove with reference to FIG. 1, a function of VGAM454 gene, herein designated VGAM is inhibition of expression of VGAM454 target genes. It is appreciated that specific functions, and accordingly utilities, of VGAM454 correlate with, and may be deduced from, the identity of the target genes which VGAM454 binds and inhibits, and the function of these target genes, as elaborated hereinbelow.

LNK (Accession NM_005475) is a VGAM454 host target gene. LNK BINDING SITE is HOST TARGET binding site found in the 3' untranslated region of mRNA encoded by LNK, corresponding to a HOST TARGET binding site such as BINDING SITE I, BINDING SITE II or BINDING SITE III. Table 2 illustrates the complementarity of the nucleotide sequences of LNK BINDING SITE, designated SEQ ID:11971, to the nucleotide sequence of VGAM454 RNA, herein designated VGAM RNA, also designated SEQ ID:3165.

A function of VGAM454 is therefore inhibition of LNK (Accession NM_005475), a gene which links T-cell receptor activation signal to phospholipase c-gamma-1, grb-2 and phosphatidylinositol 3-kinase (by similarity). Accordingly, utilities of VGAM454 include diagnosis, prevention and treatment of diseases and clinical conditions associated with LNK. The function of LNK and its association with various diseases and clinical conditions, has been established by previous studies, as described hereinabove with reference to VGAM115. KIAA0265 (Accession XM_045954) is another VGAM454 host target gene. KIAA0265 BINDING SITE is HOST TARGET binding site found in the 3' untranslated region of mRNA encoded by KIAA0265, corresponding to a HOST TARGET binding site such as BINDING SITE I, BINDING SITE II or BINDING SITE III. Table 2 illustrates the complementarity of the nucleotide sequences of KIAA0265 BINDING SITE, designated SEQ ID:34618, to the nucleotide sequence of VGAM454 RNA, herein designated VGAM RNA, also designated SEQ ID:3165.

Another function of VGAM454 is therefore inhibition of KIAA0265 (Accession XM_045954). Accordingly, utilities of VGAM454 include diagnosis, prevention and treatment of diseases and clinical conditions associated with KIAA0265. KIAA0960 (Accession XM_166543) is another VGAM454 host target gene. KIAA0960 BINDING SITE is HOST TARGET binding site found in the 3' untranslated region of mRNA encoded by KIAA0960, corresponding to a HOST TARGET binding site such as BINDING SITE I, BINDING SITE II or BINDING SITE III. Table 2 illustrates the complementarity of the nucleotide sequences of KIAA0960 BINDING SITE, designated SEQ ID:44519, to the nucleotide sequence of VGAM454 RNA, herein designated VGAM RNA, also designated SEQ ID:3165.

Another function of VGAM454 is therefore inhibition of KIAA0960 (Accession XM_166543). Accordingly, utilities of VGAM454 include diagnosis, prevention and treatment of diseases and clinical conditions associated with KIAA0960. LOC138428 (Accession XM_059972) is another VGAM454 host target gene. LOC138428 BINDING SITE is HOST TARGET binding site found in the 5' untranslated region of mRNA encoded by LOC138428, corresponding to a HOST TARGET binding site such as BINDING SITE I, BINDING SITE II or BINDING SITE III. Table 2 illustrates the complementarity of the nucleotide sequences of LOC138428 BINDING SITE, designated SEQ ID:37133, to the nucleotide sequence of VGAM454 RNA, herein designated VGAM RNA, also designated SEQ ID:3165.

Another function of VGAM454 is therefore inhibition of LOC138428 (Accession XM_059972). Accordingly, utilities of VGAM454 include diagnosis, prevention and treatment of diseases and clinical conditions associated with LOC138428. LOC152048 (Accession XM_098158) is another VGAM454 host target gene. LOC152048 BINDING SITE is HOST TARGET binding site found in the 3' untranslated region of mRNA encoded by LOC152048, corresponding to a HOST TARGET binding site such as BINDING SITE I, BINDING SITE II or BINDING SITE III. Table 2 illustrates the complementarity of the nucleotide sequences of LOC152048 BINDING SITE, designated SEQ ID:41427, to the nucleotide sequence of VGAM454 RNA, herein designated VGAM RNA, also designated SEQ ID:3165.

Another function of VGAM454 is therefore inhibition of LOC152048 (Accession XM_098158). Accordingly, utilities of VGAM454 include diagnosis, prevention and treatment of diseases and clinical conditions associated with LOC152048. FIG. 1 further provides a conceptual description of a novel bioinformatically detected viral gene of the present invention, referred to here as Viral Genomic Address Messenger 455 (VGAM455) viral gene, which modulates expression of respective host target genes thereof, the function and utility of which host target genes is known in the art.

VGAM455 is a novel bioinformatically detected regulatory, non protein coding, viral micro RNA (miRNA) gene. The method by which VGAM455 was detected is described hereinabove with reference to FIGS. 1-8.

VGAM455 gene, herein designated VGAM GENE, is a viral gene contained in the genome of Borna Disease Virus. VGAM455 host target gene, herein designated VGAM HOST TARGET GENE, is a human gene contained in the human genome.

VGAM455 gene encodes a VGAM455 precursor RNA, herein designated VGAM PRECURSOR RNA. Similar to other miRNA genes, and unlike most ordinary genes, VGAM455 precursor RNA does not encode a protein. A nucleotide sequence identical or highly similar to the nucleotide sequence of VGAM455 precursor RNA is designated SEQ ID:441, and is provided hereinbelow with reference to the sequence listing part. Nucleotide sequence SEQ ID:441 is located at position 5801 relative to the genome of Borna Disease Virus.

VGAM455 precursor RNA folds onto itself, forming VGAM455 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM455 folded precursor RNA into VGAM455 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM455 RNA is designated SEQ ID:3166, and is provided hereinbelow with reference to the sequence listing part.

VGAM455 host target gene, herein designated VGAM HOST TARGET GENE, encodes a corresponding messenger RNA, VGAM455 host target RNA, herein designated VGAM HOST TARGET RNA. VGAM455 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM455 RNA, herein designated VGAM RNA, binds complementarily to one or more host target binding sites located in untranslated regions of VGAM455 host target RNA, herein designated VGAM HOST TARGET RNA. This complementary binding is due to the fact that the nucleotide sequence of VGAM455 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM455 RNA, herein designated VGAM RNA, may have a different number of host target binding sites in untranslated regions of a VGAM455 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM455 RNA, herein designated VGAM RNA, to host target binding sites on VGAM455 host target RNA, herein designated VGAM HOST TARGET RNA, such as BINDING SITE I, BINDING SITE II and BINDING SITE III, inhibits translation of VGAM455 host target RNA into VGAM455 host target protein, herein designated VGAM HOST TARGET PROTEIN. VGAM host target protein is therefore outlined by a broken line.

It is appreciated that VGAM455 host target gene, herein designated VGAM HOST TARGET GENE, in fact represents a plurality of VGAM455 host target genes. The mRNA of each one of this plurality of VGAM455 host target genes comprises one or more host target binding sites, each having a nucleotide sequence which is at least partly complementary to VGAM455 RNA, herein designated VGAM RNA, and which when bound by VGAM455 RNA causes inhibition of translation of respective one or more VGAM455 host target proteins.

It is further appreciated by one skilled in the art that the mode of translational inhibition illustrated by FIG. 1 with specific reference to translational inhibition exerted by VGAM455 gene, herein designated VGAM GENE, on one or more VGAM455 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM455 is inhibition of expression of host target genes, as part of a novel viral mechanism of attacking a host. Accordingly, utilities of VGAM455 include diagnosis, prevention and treatment of viral infection by Borna Disease Virus. Specific functions, and accordingly utilities, of VGAM455 correlate with, and may be deduced from, the identity of the host target genes which VGAM455 binds and inhibits, and the function of these host target genes, as elaborated hereinbelow.

Nucleotide sequences of the VGAM455 precursor RNA, herein designated VGAM PRECURSOR RNA, and of the 'diced' VGAM455 RNA, herein designated VGAM RNA, and a schematic representation of the secondary folding of VGAM455 folded precursor RNA, herein designated VGAM FOLDED PRECURSOR RNA, of VGAM455 are further described hereinbelow with reference to Table 1.

Nucleotide sequences of host target binding sites, such as BINDING SITE-I, BINDING SITE-II and BINDING SITE-III of FIG. 1, found on VGAM455 host target RNA, and schematic representation of the complementarity of each of these host target binding sites to VGAM455 RNA, herein designated VGAM RNA, are described hereinbelow with reference to Table 2.

As mentioned hereinabove with reference to FIG. 1, a function of VGAM455 gene, herein designated VGAM is inhibition of expression of VGAM455 target genes. It is appreciated that specific functions, and accordingly utilities, of VGAM455 correlate with, and may be deduced from, the identity of the target genes which VGAM455 binds and inhibits, and the function of these target genes, as elaborated hereinbelow.

EphB3 (EPHB3, Accession NM_004443) is a VGAM455 host target gene. EPHB3 BINDING SITE is HOST TARGET binding site found in the 3' untranslated region of mRNA encoded by EPHB3, corresponding to a HOST TARGET binding site such as BINDING SITE I, BINDING SITE II or BINDING SITE III. Table 2 illustrates the complementarity of the nucleotide sequences of EPHB3 BINDING SITE, designated SEQ ID:10737, to the nucleotide sequence of VGAM455 RNA, herein designated VGAM RNA, also designated SEQ ID:3166.

A function of VGAM455 is therefore inhibition of EphB3 (EPHB3, Accession NM_004443), a gene which receptor for members of the ephrin-b family. binds to ephrin-b1 and -b2. Accordingly, utilities of VGAM455 include diagnosis, prevention and treatment of diseases and clinical conditions associated with EPHB3. The function of EPHB3 has been established by previous studies. See 179610 for background on Eph receptors and their ligands, the ephrins. Bohme et al. (1993) used PCR to isolate a novel protein tyrosine kinase (PTK), which they termed HEK2 for 'human embryo kinase-2,' from a human embryonic cDNA library. Sequence analysis revealed that HEK2 encodes a 998-amino acid polypeptide having a single putative transmembrane domain, a secretory signal sequence, and 2 fibronectin repeats. Based on sequence homology, Bohme et al. (1993) stated that HEK2 is a member of the EPH/ELK family of tyrosine kinases. Northern blot analysis revealed that HEK2 was expressed as a variable 4.6-kb message in all adult human tissues tested. Southern blot analysis suggested that HEK2 is a single-copy gene in the human genome. Bohme et al. (1993) used PCR of human-mouse hybrids to map the HEK2 gene to human chromosome 3q21-qter. Bohme et al. (1996) presented evidence that HEK2 interacts with 2 ligands of EPH-related kinases (LERKs), namely, LERK2 (EFNB1; 300035) and LERK5 (EFNB2; 600527). They reported that coincubation of HEK2- and LERK2-expressing cells induces cell-cell adhesion and aggregation. Additionally, coexpression of HEK2 and LERK2 results in reduced kinase activity of HEK2. Halford et al. (2000) generated mice deficient in Ryk (OMIM Ref. No. 600524) and found that they had a distinctive craniofacial appearance, shortened limbs, and postnatal mortality due to feeding and respiratory complications associated with a complete cleft of the secondary palate. Consistent with cleft palate phenocopy in Ephb2 (OMIM Ref. No. 600997)/Ephb3-deficient mice and the role of a Drosophila Ryk ortholog, 'Derailed,' in the transduction of repulsive axon pathfinding cues, biochemical data implicated Ryk in signaling mediated by Eph receptors and cell junction-associated Af6 (OMIM Ref. No. 159559). Halford et al. (2000) concluded that their findings highlighted the importance of signal crosstalk between members of different RTK subfamilies.

Full details of the abovementioned studies are described in the following publications, the disclosure of which are hereby incorporated by reference:

Bohme, B.; Holtrich, U.; Wolf, G.; Luzius, H.; Grzeschik, K.-H.; Strebhardt, K.; Rubsamen-Waigmann, H.: PCR mediated detection of a new human receptor-tyrosine-kinase, HEK 2. Oncogene 8:2857-2862, 1993; and Halford, M. M.; Armes, J.; Buchert, M.; Meskenaite, V.; Grail, D.; Hibbs, M. L.; Wilks, A. F.; Farlie, P. G.; Newgreen, D. F.; Hovens, C. M.; Stacker, S. A.: Ryk-deficient mice exhibit.

Further studies establishing the function and utilities of EPHB3 are found in John Hopkins OMIM database record ID 601839, and in sited publications numbered 887 and 8879 listed in the bibliography section hereinbelow, which are also hereby incorporated by reference. KIAA0222 (Accession NM_014643) is another VGAM455 host target gene. KIAA0222 BINDING SITE is HOST TARGET binding site found in the 3' untranslated region of mRNA encoded by KIAA0222, corresponding to a HOST TARGET binding site such as BINDING SITE I, BINDING SITE II or BINDING SITE III. Table 2 illustrates the complementarity of the nucleotide sequences of KIAA0222 BINDING SITE, designated SEQ ID:16045, to the nucleotide sequence of VGAM455 RNA, herein designated VGAM RNA, also designated SEQ ID:3166.

Another function of VGAM455 is therefore inhibition of KIAA0222 (Accession NM_014643). Accordingly, utilities of VGAM455 include diagnosis, prevention and treatment of diseases and clinical conditions associated with KIAA0222. MGC10818 (Accession NM_030568) is another VGAM455 host target gene. MGC10818 BINDING SITE is HOST TARGET binding site found in the 3' untranslated region of mRNA encoded by MGC10818, corresponding to a HOST TARGET binding site such as BINDING SITE I, BINDING SITE II or BINDING SITE III. Table 2 illustrates the complementarity of the nucleotide sequences of MGC10818 BINDING SITE, designated SEQ ID:24943, to the nucleotide sequence of VGAM455 RNA, herein designated VGAM RNA, also designated SEQ ID:3166.

Another function of VGAM455 is therefore inhibition of MGC10818 (Accession NM_030568). Accordingly, utilities of VGAM455 include diagnosis, prevention and treatment of diseases and clinical conditions associated with MGC10818. FIG. 1 further provides a conceptual description of a novel bioinformatically detected viral gene of the present invention, referred to here as Viral Genomic Address Messenger 456 (VGAM456) viral gene, which modulates expression of respective host target genes thereof, the function and utility of which host target genes is known in the art.

VGAM456 is a novel bioinformatically detected regulatory, non protein coding, viral micro RNA (miRNA) gene. The method by which VGAM456 was detected is described hereinabove with reference to FIGS. 1-8.

VGAM456 gene, herein designated VGAM GENE, is a viral gene contained in the genome of Variola Virus. VGAM456 host target gene, herein designated VGAM HOST TARGET GENE, is a human gene contained in the human genome.

VGAM456 gene encodes a VGAM456 precursor RNA, herein designated VGAM PRECURSOR RNA. Similar to other miRNA genes, and unlike most ordinary genes, VGAM456 precursor RNA does not encode a protein. A nucleotide sequence identical or highly similar to the nucleotide sequence of VGAM456 precursor RNA is designated SEQ ID:442, and is provided hereinbelow with reference to the sequence listing part. Nucleotide sequence SEQ ID:442 is located at position 31089 relative to the genome of Variola Virus.

VGAM456 precursor RNA folds onto itself, forming VGAM456 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM456 folded precursor RNA into VGAM456 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM456 RNA is designated SEQ ID:3167, and is provided hereinbelow with reference to the sequence listing part.

VGAM456 host target gene, herein designated VGAM HOST TARGET GENE, encodes a corresponding messenger RNA, VGAM456 host target RNA, herein designated VGAM HOST TARGET RNA. VGAM456 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM456 RNA, herein designated VGAM RNA, binds complementarily to one or more host target binding sites located in untranslated regions of VGAM456 host target RNA, herein designated VGAM HOST TARGET RNA. This complementary binding is due to the fact that the nucleotide sequence of VGAM456 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM456 RNA, herein designated VGAM RNA, may have a different number of host target binding sites in untranslated regions of a VGAM456 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM456 RNA, herein designated VGAM RNA, to host target binding sites on VGAM456 host target RNA, herein designated VGAM HOST TARGET RNA, such as BINDING SITE I, BINDING SITE II and BINDING SITE III, inhibits translation of VGAM456 host target RNA into VGAM456 host target protein, herein designated VGAM HOST TARGET PROTEIN. VGAM host target protein is therefore outlined by a broken line.

It is appreciated that VGAM456 host target gene, herein designated VGAM HOST TARGET GENE, in fact represents a plurality of VGAM456 host target genes. The mRNA of each one of this plurality of VGAM456 host target genes comprises one or more host target binding sites, each having a nucleotide sequence which is at least partly complementary to VGAM456 RNA, herein designated VGAM RNA, and which when bound by VGAM456 RNA causes inhibition of translation of respective one or more VGAM456 host target proteins.

It is further appreciated by one skilled in the art that the mode of translational inhibition illustrated by FIG. 1 with specific reference to translational inhibition exerted by VGAM456 gene, herein designated VGAM GENE, on one or more VGAM456 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM456 is inhibition of expression of host target genes, as part of a novel viral mechanism of attacking a host. Accordingly, utilities of VGAM456 include diagnosis, prevention and treatment of viral infection by Variola Virus. Specific functions, and accordingly utilities, of VGAM456 correlate with, and may be deduced from, the identity of the host target genes which VGAM456 binds and inhibits, and the function of these host target genes, as elaborated hereinbelow.

Nucleotide sequences of the VGAM456 precursor RNA, herein designated VGAM PRECURSOR RNA, and of the 'diced' VGAM456 RNA, herein designated VGAM RNA, and a schematic representation of the secondary folding of VGAM456 folded precursor RNA, herein designated VGAM FOLDED PRECURSOR RNA, of VGAM456 are further described hereinbelow with reference to Table 1.

Nucleotide sequences of host target binding sites, such as BINDING SITE-I, BINDING SITE-II and BINDING SITE-III of FIG. 1, found on VGAM456 host target RNA, and schematic representation of the complementarity of each of these host target binding sites to VGAM456 RNA, herein designated VGAM RNA, are described hereinbelow with reference to Table 2.

As mentioned hereinabove with reference to FIG. 1, a function of VGAM456 gene, herein designated VGAM is inhibition of expression of VGAM456 target genes. It is appreciated that specific functions, and accordingly utilities, of VGAM456 correlate with, and may be deduced from, the identity of the target genes which VGAM456 binds and inhibits, and the function of these target genes, as elaborated hereinbelow.

Regulator of G-protein Signalling 17 (RGS17, Accession NM_012419) is a VGAM456 host target gene. RGS17 BINDING SITE is HOST TARGET binding site found in the 3' untranslated region of mRNA encoded by RGS17, corresponding to a HOST TARGET binding site such as BINDING SITE I, BINDING SITE II or BINDING SITE III. Table 2 illustrates the complementarity of the nucleotide sequences of RGS17 BINDING SITE, designated SEQ ID:14791, to the nucleotide sequence of VGAM456 RNA, herein designated VGAM RNA, also designated SEQ ID:3167.

A function of VGAM456 is therefore inhibition of Regulator of G-protein Signalling 17 (RGS17, Accession NM_012419). Accordingly, utilities of VGAM456 include diagnosis, prevention and treatment of diseases and clinical conditions associated with RGS17. Zinc Finger Protein 387 (ZNF387, Accession NM_014682) is another VGAM456 host target gene. ZNF387 BINDING SITE is HOST TARGET binding site found in the 3' untranslated region of mRNA encoded by ZNF387, corresponding to a HOST TARGET binding site such as BINDING SITE I, BINDING SITE II or BINDING SITE III. Table 2 illustrates the complementarity of the nucleotide sequences of ZNF387 BINDING SITE, designated SEQ ID:16172, to the nucleotide sequence of VGAM456 RNA, herein designated VGAM RNA, also designated SEQ ID:3167.

Another function of VGAM456 is therefore inhibition of Zinc Finger Protein 387 (ZNF387, Accession NM_014682). Accordingly, utilities of VGAM456 include diagnosis, prevention and treatment of diseases and clinical conditions associated with ZNF387. FIG. 1 further provides a conceptual description of a novel bioinformatically detected viral gene of the present invention, referred to here as Viral Genomic Address Messenger 457 (VGAM457) viral gene, which modulates expression of respective host target genes thereof, the function and utility of which host target genes is known in the art.

VGAM457 is a novel bioinformatically detected regulatory, non protein coding, viral micro RNA (miRNA) gene. The method by which VGAM457 was detected is described hereinabove with reference to FIGS. 1-8.

VGAM457 gene, herein designated VGAM GENE, is a viral gene contained in the genome of Variola Virus. VGAM457 host target gene, herein designated VGAM HOST TARGET GENE, is a human gene contained in the human genome.

VGAM457 gene encodes a VGAM457 precursor RNA, herein designated VGAM PRECURSOR RNA. Similar to other miRNA genes, and unlike most ordinary genes, VGAM457 precursor RNA does not encode a protein. A nucleotide sequence identical or highly similar to the nucleotide sequence of VGAM457 precursor RNA is designated SEQ ID:443, and is provided hereinbelow with reference to the sequence listing part. Nucleotide sequence SEQ ID:443 is located at position 31432 relative to the genome of Variola Virus.

VGAM457 precursor RNA folds onto itself, forming VGAM457 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM457 folded precursor RNA into VGAM457 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM457 RNA is designated SEQ ID:3168, and is provided hereinbelow with reference to the sequence listing part.

VGAM457 host target gene, herein designated VGAM HOST TARGET GENE, encodes a corresponding messenger RNA, VGAM457 host target RNA, herein designated VGAM HOST TARGET RNA. VGAM457 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM457 RNA, herein designated VGAM RNA, binds complementarily to one or more host target binding sites located in untranslated regions of VGAM457 host target RNA, herein designated VGAM HOST TARGET RNA. This complementary binding is due to the fact that the nucleotide sequence of VGAM457 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM457 RNA, herein designated VGAM RNA, may have a different number of host target binding sites in untranslated regions of a VGAM457 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM457 RNA, herein designated VGAM RNA, to host target binding sites on VGAM457 host target RNA, herein designated VGAM HOST TARGET RNA, such as BINDING SITE I, BINDING SITE II and BINDING SITE III, inhibits translation of VGAM457 host target RNA into VGAM457 host target protein, herein designated VGAM HOST TARGET PROTEIN. VGAM host target protein is therefore outlined by a broken line.

It is appreciated that VGAM457 host target gene, herein designated VGAM HOST TARGET GENE, in fact represents a plurality of VGAM457 host target genes. The mRNA of each one of this plurality of VGAM457 host target genes comprises one or more host target binding sites, each having a nucleotide sequence which is at least partly complementary to VGAM457 RNA, herein designated VGAM RNA, and which when bound by VGAM457 RNA causes inhibition of translation of respective one or more VGAM457 host target proteins.

It is further appreciated by one skilled in the art that the mode of translational inhibition illustrated by FIG. 1 with specific reference to translational inhibition exerted by VGAM457 gene, herein designated VGAM GENE, on one or more VGAM457 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM457 is inhibition of expression of host target genes, as part of a novel viral mechanism of attacking a host. Accordingly, utilities of VGAM457 include diagnosis, prevention and treatment of viral infection by Variola Virus. Specific functions, and accordingly utilities, of VGAM457 correlate with, and may be deduced from, the identity of the host target genes which VGAM457 binds and inhibits, and the function of these host target genes, as elaborated hereinbelow.

Nucleotide sequences of the VGAM457 precursor RNA, herein designated VGAM PRECURSOR RNA, and of the 'diced' VGAM457 RNA, herein designated VGAM RNA, and a schematic representation of the secondary folding of VGAM457 folded precursor RNA, herein designated VGAM FOLDED PRECURSOR RNA, of VGAM457 are further described hereinbelow with reference to Table 1.

Nucleotide sequences of host target binding sites, such as BINDING SITE-I, BINDING SITE-II and BINDING SITE-III of FIG. 1, found on VGAM457 host target RNA, and schematic representation of the complementarity of each of these host target binding sites to VGAM457 RNA, herein designated VGAM RNA, are described hereinbelow with reference to Table 2.

As mentioned hereinabove with reference to FIG. 1, a function of VGAM457 gene, herein designated VGAM is inhibition of expression of VGAM457 target genes. It is appreciated that specific functions, and accordingly utilities, of VGAM457 correlate with, and may be deduced from, the identity of the target genes which VGAM457 binds and inhibits, and the function of these target genes, as elaborated hereinbelow.

Calsequestrin 2 (cardiac muscle) (CASQ2, Accession NM_001232) is a VGAM457 host target gene. CASQ2 BINDING SITE is HOST TARGET binding site found in the 3' untranslated region of mRNA encoded by CASQ2, corresponding to a HOST TARGET binding site such as BINDING SITE I, BINDING SITE II or BINDING SITE III. Table 2 illustrates the complementarity of the nucleotide sequences of CASQ2 BINDING SITE, designated SEQ ID:6903, to the nucleotide sequence of VGAM457 RNA, herein designated VGAM RNA, also designated SEQ ID:3168.

A function of VGAM457 is therefore inhibition of Calsequestrin 2 (cardiac muscle) (CASQ2, Accession NM_001232). Accordingly, utilities of VGAM457 include diagnosis, prevention and treatment of diseases and clinical conditions associated with CASQ2. KIAA1715 (Accession XM_042834) is another VGAM457 host target gene. KIAA1715 BINDING SITE is HOST TARGET binding site found in the 3' untranslated region of mRNA encoded by KIAA1715, corresponding to a HOST TARGET binding site such as BINDING SITE I, BINDING SITE II or BINDING SITE III. Table 2 illustrates the complementarity of the nucleotide sequences of KIAA1715 BINDING SITE, designated SEQ ID:33792, to the nucleotide sequence of VGAM457 RNA, herein designated VGAM RNA, also designated SEQ ID:3168.

Another function of VGAM457 is therefore inhibition of KIAA1715 (Accession XM_042834). Accordingly, utilities of VGAM457 include diagnosis, prevention and treatment of diseases and clinical conditions associated with KIAA1715. PRO0097 (Accession NM_014114) is another VGAM457 host target gene. PRO0097 BINDING SITE is HOST TARGET binding site found in the 5' untranslated region of mRNA encoded by PRO0097, corresponding to a HOST TARGET binding site such as BINDING SITE I, BINDING SITE II or BINDING SITE III. Table 2 illustrates the complementarity of the nucleotide sequences of PRO0097 BINDING SITE, designated SEQ ID:15365, to the nucleotide sequence of VGAM457 RNA, herein designated VGAM RNA, also designated SEQ ID:3168.

Another function of VGAM457 is therefore inhibition of PRO0097 (Accession NM_014114). Accordingly, utilities of VGAM457 include diagnosis, prevention and treatment of diseases and clinical conditions associated with PRO0097. LOC143915 (Accession XM_096502) is another VGAM457 host target gene. LOC143915 BINDING SITE is HOST TARGET binding site found in the 3' untranslated region of mRNA encoded by LOC143915, corresponding to a HOST TARGET binding site such as BINDING SITE I, BINDING SITE II or BINDING SITE III. Table 2 illustrates the complementarity of the nucleotide sequences of LOC143915 BINDING SITE, designated SEQ ID:40380, to the nucleotide sequence of VGAM457 RNA, herein designated VGAM RNA, also designated SEQ ID:3168.

Another function of VGAM457 is therefore inhibition of LOC143915 (Accession XM_096502). Accordingly, utilities of VGAM457 include diagnosis, prevention and treatment of diseases and clinical conditions associated with LOC143915. LOC170063 (Accession XM_104820) is another VGAM457 host target gene. LOC170063 BINDING SITE is HOST TARGET binding site found in the 3' untranslated region of mRNA encoded by LOC170063, corresponding to a HOST TARGET binding site such as BINDING SITE I, BINDING SITE II or BINDING SITE III. Table 2 illustrates the complementarity of the nucleotide sequences of LOC170063 BINDING SITE, designated SEQ ID:42188, to the nucleotide sequence of VGAM457 RNA, herein designated VGAM RNA, also designated SEQ ID:3168.

Another function of VGAM457 is therefore inhibition of LOC170063 (Accession XM_104820). Accordingly, utilities of VGAM457 include diagnosis, prevention and treatment of diseases and clinical conditions associated with LOC170063. LOC90268 (Accession XM_030424) is another VGAM457 host target gene. LOC90268 BINDING SITE is HOST TARGET binding site found in the 3' untranslated region of mRNA encoded by LOC90268, corresponding to a HOST TARGET binding site such as BINDING SITE I, BINDING SITE II or BINDING SITE III. Table 2 illustrates the complementarity of the nucleotide sequences of LOC90268 BINDING SITE, designated SEQ ID:31041, to the nucleotide sequence of VGAM457 RNA, herein designated VGAM RNA, also designated SEQ ID:3168.

Another function of VGAM457 is therefore inhibition of LOC90268 (Accession XM_030424). Accordingly, utilities of VGAM457 include diagnosis, prevention and treatment of diseases and clinical conditions associated with LOC90268. FIG. 1 further provides a conceptual description of a novel bioinformatically detected viral gene of the present invention, referred to here as Viral Genomic Address Messenger 458 (VGAM458) viral gene, which modulates expression of respective host target genes thereof, the function and utility of which host target genes is known in the art.

VGAM458 is a novel bioinformatically detected regulatory, non protein coding, viral micro RNA (miRNA) gene. The method by which VGAM458 was detected is described hereinabove with reference to FIGS. 1-8.

VGAM458 gene, herein designated VGAM GENE, is a viral gene contained in the genome of Camelpox Virus. VGAM458 host target gene, herein designated VGAM HOST TARGET GENE, is a human gene contained in the human genome.

VGAM458 gene encodes a VGAM458 precursor RNA, herein designated VGAM PRECURSOR RNA. Similar to other miRNA genes, and unlike most ordinary genes, VGAM458 precursor RNA does not encode a protein. A nucleotide sequence identical or highly similar to the nucleotide sequence of VGAM458 precursor RNA is designated SEQ ID:444, and is provided hereinbelow with reference to the sequence listing part. Nucleotide sequence SEQ ID:444 is located at position 72676 relative to the genome of Camelpox Virus.

VGAM458 precursor RNA folds onto itself, forming VGAM458 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM458 folded precursor RNA into VGAM458 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM458 RNA is designated SEQ ID:3169, and is provided hereinbelow with reference to the sequence listing part.

VGAM458 host target gene, herein designated VGAM HOST TARGET GENE, encodes a corresponding messenger RNA, VGAM458 host target RNA, herein designated VGAM HOST TARGET RNA. VGAM458 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM458 RNA, herein designated VGAM RNA, binds complementarily to one or more host target binding sites located in untranslated regions of VGAM458 host target RNA, herein designated VGAM HOST TARGET RNA. This complementary binding is due to the fact that the nucleotide sequence of VGAM458 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM458 RNA, herein designated VGAM RNA, may have a different number of host target binding sites in untranslated regions of a VGAM458 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM458 RNA, herein designated VGAM RNA, to host target binding sites on VGAM458 host target RNA, herein designated VGAM HOST TARGET RNA, such as BINDING SITE I, BINDING SITE II and BINDING SITE III, inhibits translation of VGAM458 host target RNA into VGAM458 host target protein, herein designated VGAM HOST TARGET PROTEIN. VGAM host target protein is therefore outlined by a broken line.

It is appreciated that VGAM458 host target gene, herein designated VGAM HOST TARGET GENE, in fact represents a plurality of VGAM458 host target genes. The mRNA of each one of this plurality of VGAM458 host target genes comprises one or more host target binding sites, each having a nucleotide sequence which is at least partly complementary to VGAM458 RNA, herein designated VGAM RNA, and which when bound by VGAM458 RNA causes inhibition of translation of respective one or more VGAM458 host target proteins.

It is further appreciated by one skilled in the art that the mode of translational inhibition illustrated by FIG. 1 with specific reference to translational inhibition exerted by VGAM458 gene, herein designated VGAM GENE, on one or more VGAM458 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM458 is inhibition of expression of host target genes, as part of a novel viral mechanism of attacking a host. Accordingly, utilities of VGAM458 include diagnosis, prevention and treatment of viral infection by Camelpox Virus. Specific functions, and accordingly utilities, of VGAM458 correlate with, and may be deduced from, the identity of the host target genes which VGAM458 binds and inhibits, and the function of these host target genes, as elaborated hereinbelow.

Nucleotide sequences of the VGAM458 precursor RNA, herein designated VGAM PRECURSOR RNA, and of the 'diced' VGAM458 RNA, herein designated VGAM RNA, and a schematic representation of the secondary folding of VGAM458 folded precursor RNA, herein designated VGAM FOLDED PRECURSOR RNA, of VGAM458 are further described hereinbelow with reference to Table 1.

Nucleotide sequences of host target binding sites, such as BINDING SITE-I, BINDING SITE-II and BINDING SITE-III of FIG. 1, found on VGAM458 host target RNA, and schematic representation of the complementarity of each of these host target binding sites to VGAM458 RNA, herein designated VGAM RNA, are described hereinbelow with reference to Table 2.

As mentioned hereinabove with reference to FIG. 1, a function of VGAM458 gene, herein designated VGAM is inhibition of expression of VGAM458 target genes. It is appreciated that specific functions, and accordingly utilities, of VGAM458 correlate with, and may be deduced from, the identity of the target genes which VGAM458 binds and inhibits, and the function of these target genes, as elaborated hereinbelow.

Hydroxysteroid (17-beta) Dehydrogenase 1 (HSD17B1, Accession NM_000413) is a VGAM458 host target gene. HSD17B1 BINDING SITE is HOST TARGET binding site found in the 5' untranslated region of mRNA encoded by HSD17B1, corresponding to a HOST TARGET binding site such as BINDING SITE I, BINDING SITE II or BINDING SITE III. Table 2 illustrates the complementarity of the nucleotide sequences of HSD17B1 BINDING SITE, designated SEQ ID:5996, to the nucleotide sequence of VGAM458 RNA, herein designated VGAM RNA, also designated SEQ ID:3169.

A function of VGAM458 is therefore inhibition of Hydroxysteroid (17-beta) Dehydrogenase 1 (HSD17B1, Accession NM_000413). Accordingly, utilities of VGAM458 include diagnosis, prevention and treatment of diseases and clinical conditions associated with HSD17B1. Integral Membrane Protein 2B (ITM2B, Accession NM_021999) is another VGAM458 host target gene. ITM2B BINDING SITE is HOST TARGET binding site found in the 3' untranslated region of mRNA encoded by ITM2B, corresponding to a HOST TARGET binding site such as BINDING SITE I, BINDING SITE II or BINDING SITE III. Table 2 illustrates the complementarity of the nucleotide sequences of ITM2B BINDING SITE, designated SEQ ID:22541, to the nucleotide sequence of VGAM458 RNA, herein designated VGAM RNA, also designated SEQ ID:3169.

Another function of VGAM458 is therefore inhibition of Integral Membrane Protein 2B (ITM2B, Accession NM_021999), a gene which is a member of the type II integral membrane protein family. Accordingly, utilities of VGAM458 include diagnosis, prevention and treatment of diseases and clinical conditions associated with ITM2B. The function of ITM2B has been established by previous studies. Using isolated amyloid fibrils from a patient with familial British dementia (FBD; 176500), Vidal et al. (1999) identified a unique 4-kD protein subunit, which they called ABRI, that is encoded by a novel gene, BRI. The BRI cDNA encodes a predicted protein of 266 amino acids. The first ATG is located 150 basepairs downstream of an in-frame TAG stop codon and has a classic Kozak consensus sequence. Hydropathy analysis indicated the presence of a putative single transmembrane-spanning domain between amino acids 52 and 74, indicating that this highly insoluble molecule is a type II integral transmembrane protein with the C-terminal part being extracellular. A potential N-glycosylation site was identified at asparagine-170. Homology searches done with other species including chicken, rat, mouse, rabbit, and pig showed highly homologous ORFs, with human and murine identity being 96%. Northern blot analysis revealed 2.0- and 1.6-kb mRNA transcripts, which were expressed in most regions of the brain as well as in several peripheral tissues Ghiso et al. (2001) reported that carriers of the ter267-to-arg mutation (603904.0001) have a soluble form of the amyloid peptide (sABRI) in the circulation with an estimated concentration in the range of 20 ng/ml, several-fold higher than that of soluble amyloid-beta (OMIM Ref. No. 104760). In addition, ABRI species identical to those identified in the brain were also found as fibrillar components of amyloid deposits predominantly in the blood vessels of several peripheral tissues, including pancreas and myocardium. Ghiso et al. (2001) hypothesized that the high concentration of the soluble de novo-created amyloidogenic peptide and/or the insufficient tissue clearance are the main causative factors for the formation of amyloid deposits outside the brain. Thus, familial British dementia constitutes the first documented cerebral amyloidosis associated with neurodegeneration and dementia in which the amyloid deposition is also systemic Full details of the abovementioned studies are described in the following publications, the disclosure of which are hereby incorporated by reference:

Ghiso, J. A.; Holton, J.; Miravalle, L.; Calero, M.; Lashley, T.; Vidal, R.; Houlden, H.; Wood, N.; Neubert, T. A.; Rostagno, A.; Plant, G.; Revesz, T.; Frangione, B.: Systemic amyloid deposits in familial British dementia. J. Biol. Chem. 276: 43909-43914, 2001; and Vidal, R.; Revesz, T.; Rostagno, A.; Kim, E.; Holton, J. L.; Bek, T.; Bojsen-Moller, M.; Braendgaard, H.; Plant, G.; Ghiso, J.; Frangione, B.: A decamer duplication in the 3-prime regi.

Further studies establishing the function and utilities of ITM2B are found in John Hopkins OMIM database record ID 603904, and in sited publications numbered 8197-8198, 1235 and 12685 listed in the bibliography section hereinbelow, which are also hereby incorporated by reference. Polymeric Immunoglobulin Receptor (PIGR, Accession XM_052013) is another VGAM458 host target gene. PIGR BINDING SITE is HOST TARGET binding site found in the 3' untranslated region of mRNA encoded by PIGR, corresponding to a HOST TARGET binding site such as BINDING SITE I, BINDING SITE II or BINDING SITE III. Table 2 illustrates the complementarity of the nucleotide sequences of PIGR BINDING SITE, designated SEQ ID:35935, to the nucleotide sequence of VGAM458 RNA, herein designated VGAM RNA, also designated SEQ ID:3169.

Another function of VGAM458 is therefore inhibition of Polymeric Immunoglobulin Receptor (PIGR, Accession XM_052013). Accordingly, utilities of VGAM458 include diagnosis, prevention and treatment of diseases and clinical conditions associated with PIGR. Rhesus Blood Group, D Antigen (RHD, Accession NM_016124) is another VGAM458 host target gene. RHD BINDING SITE1 and RHD BINDING SITE2 are HOST TARGET binding sites found in untranslated regions of mRNA encoded by RHD, corresponding to HOST TARGET binding sites such as BINDING SITE I, BINDING SITE II or BINDING SITE III. Table 2 illustrates the complementarity of the nucleotide sequences of RHD BINDING SITE1 and RHD BINDING SITE2, designated SEQ ID:18214 and SEQ ID:18334 respectively, to the nucleotide sequence of VGAM458 RNA, herein designated VGAM RNA, also designated SEQ ID:3169.

Another function of VGAM458 is therefore inhibition of Rhesus Blood Group, D Antigen (RHD, Accession NM_016124), a gene which Major antigen of the RH system. Accordingly, utilities of VGAM458 include diagnosis, prevention and treatment of diseases and clinical conditions associated with RHD. The function of RHD and its association with various diseases and clinical conditions, has been established by previous studies, as described hereinabove with reference to VGAM74. DKFZP434C1715 (Accession XM_098421) is another VGAM458 host target gene. DKFZP434C1715 BINDING SITE is HOST TARGET binding site found in the 3' untranslated region of mRNA encoded by DKFZP434C1715, corresponding to a HOST TARGET binding site such as BINDING SITE I, BINDING SITE II or BINDING SITE III. Table 2 illustrates the complementarity of the nucleotide sequences of DKFZP434C1715 BINDING SITE, designated SEQ ID:41675, to the nucleotide sequence of VGAM458 RNA, herein designated VGAM RNA, also designated SEQ ID:3169.

Another function of VGAM458 is therefore inhibition of DKFZP434C1715 (Accession XM_098421). Accordingly, utilities of VGAM458 include diagnosis, prevention and treatment of diseases and clinical conditions associated with DKFZP434C1715. GFR (Accession NM_012294) is another VGAM458 host target gene. GFR BINDING SITE is HOST TARGET binding site found in the 3' untranslated region of mRNA encoded by GFR, corresponding to a HOST TARGET binding site such as BINDING SITE I, BINDING SITE II or BINDING SITE III. Table 2 illustrates the complementarity of the nucleotide sequences of GFR BINDING SITE, designated SEQ ID:14639, to the nucleotide sequence of VGAM458 RNA, herein designated VGAM RNA, also designated SEQ ID:3169.

Another function of VGAM458 is therefore inhibition of GFR (Accession NM_012294). Accordingly, utilities of VGAM458 include diagnosis, prevention and treatment of diseases and clinical conditions associated with GFR. Solute Carrier Family 7, (cationic amino acid transporter, y+ system) Member 11 (SLC7A11, Accession NM_014331) is another VGAM458 host target gene. SLC7A11 BINDING SITE is HOST TARGET binding site found in the 3' untranslated region of mRNA encoded by SLC7A11, corresponding to a HOST TARGET binding site such as BINDING SITE I, BINDING SITE II or BINDING SITE III. Table 2 illustrates the complementarity of the nucleotide sequences of SLC7A11 BINDING SITE, designated SEQ ID:15645, to the nucleotide sequence of VGAM458 RNA, herein designated VGAM RNA, also designated SEQ ID:3169.

Another function of VGAM458 is therefore inhibition of Solute Carrier Family 7, (cationic amino acid transporter, y+ system) Member 11 (SLC7A11, Accession NM_014331). Accordingly, utilities of VGAM458 include diagnosis, prevention and treatment of diseases and clinical conditions associated with SLC7A11. Ubiquitin Specific Protease 24 (USP24, Accession XM_165973) is another VGAM458 host target gene. USP24 BINDING SITE is HOST TARGET binding site found in the 3' untranslated region of mRNA encoded by USP24, corresponding to a HOST TARGET binding site such as BINDING SITE I, BINDING SITE II or BINDING SITE III. Table 2 illustrates the complementarity of the nucleotide sequences of USP24 BINDING SITE, designated SEQ ID:43819, to the nucleotide sequence of VGAM458 RNA, herein designated VGAM RNA, also designated SEQ ID:3169.

Another function of VGAM458 is therefore inhibition of Ubiquitin Specific Protease 24 (USP24, Accession XM_165973). Accordingly, utilities of VGAM458 include diagnosis, prevention and treatment of diseases and clinical conditions associated with USP24. LOC205251 (Accession XM_119554) is another VGAM458 host target gene. LOC205251 BINDING SITE is HOST TARGET binding site found in the 5' untranslated region of mRNA encoded by LOC205251, corresponding to a HOST TARGET binding site such as BINDING SITE I, BINDING SITE II or BINDING SITE III. Table 2 illustrates the complementarity of the nucleotide sequences of LOC205251 BINDING SITE, designated SEQ ID:43590, to the nucleotide sequence of VGAM458 RNA, herein designated VGAM RNA, also designated SEQ ID:3169.

Another function of VGAM458 is therefore inhibition of LOC205251 (Accession XM_119554). Accordingly, utilities of VGAM458 include diagnosis, prevention and treatment of diseases and clinical conditions associated with LOC205251. LOC254251 (Accession XM_171088) is another VGAM458 host target gene. LOC254251 BINDING SITE is HOST TARGET binding site found in the 3' untranslated region of mRNA encoded by LOC254251, corresponding to a HOST TARGET binding site such as BINDING SITE I, BINDING SITE II or BINDING SITE III. Table 2 illustrates the complementarity of the nucleotide sequences of LOC254251 BINDING SITE, designated SEQ ID:45899, to the nucleotide sequence of VGAM458 RNA, herein designated VGAM RNA, also designated SEQ ID:3169.

Another function of VGAM458 is therefore inhibition of LOC254251 (Accession XM_171088). Accordingly, utilities of VGAM458 include diagnosis, prevention and treatment of diseases and clinical conditions associated with LOC254251. FIG. 1 further provides a conceptual description of a novel bioinformatically detected viral gene of the present invention, referred to here as Viral Genomic Address Messenger 459 (VGAM459) viral gene, which modulates expression of respective host target genes thereof, the function and utility of which host target genes is known in the art.

VGAM459 is a novel bioinformatically detected regulatory, non protein coding, viral micro RNA (miRNA) gene. The method by which VGAM459 was detected is described hereinabove with reference to FIGS. 1-8.

VGAM459 gene, herein designated VGAM GENE, is a viral gene contained in the genome of Ectromelia Virus. VGAM459 host target gene, herein designated VGAM HOST TARGET GENE, is a human gene contained in the human genome.

VGAM459 gene encodes a VGAM459 precursor RNA, herein designated VGAM PRECURSOR RNA. Similar to other miRNA genes, and unlike most ordinary genes, VGAM459 precursor RNA does not encode a protein. A nucleotide sequence identical or highly similar to the nucleotide sequence of VGAM459 precursor RNA is designated SEQ ID:445, and is provided hereinbelow with reference to the sequence listing part. Nucleotide sequence SEQ ID:445 is located at position 78528 relative to the genome of Ectromelia Virus.

VGAM459 precursor RNA folds onto itself, forming VGAM459 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM459 folded precursor RNA into VGAM459 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM459 RNA is designated SEQ ID:3170, and is provided hereinbelow with reference to the sequence listing part.

VGAM459 host target gene, herein designated VGAM HOST TARGET GENE, encodes a corresponding messenger RNA, VGAM459 host target RNA, herein designated VGAM HOST TARGET RNA. VGAM459 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM459 RNA, herein designated VGAM RNA, binds complementarily to one or more host target binding sites located in untranslated regions of VGAM459 host target RNA, herein designated VGAM HOST TARGET RNA. This complementary binding is due to the fact that the nucleotide sequence of VGAM459 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM459 RNA, herein designated VGAM RNA, may have a different number of host target binding sites in untranslated regions of a VGAM459 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM459 RNA, herein designated VGAM RNA, to host target binding sites on VGAM459 host target RNA, herein designated VGAM HOST TARGET RNA, such as BINDING SITE I, BINDING SITE II and BINDING SITE III, inhibits translation of VGAM459 host target RNA into VGAM459 host target protein, herein designated VGAM HOST TARGET PROTEIN. VGAM host target protein is therefore outlined by a broken line.

It is appreciated that VGAM459 host target gene, herein designated VGAM HOST TARGET GENE, in fact represents a plurality of VGAM459 host target genes. The mRNA of each one of this plurality of VGAM459 host target genes comprises one or more host target binding sites, each having a nucleotide sequence which is at least partly complementary to VGAM459 RNA, herein designated VGAM RNA, and which when bound by VGAM459 RNA causes inhibition of translation of respective one or more VGAM459 host target proteins.

It is further appreciated by one skilled in the art that the mode of translational inhibition illustrated by FIG. 1 with specific reference to translational inhibition exerted by VGAM459 gene, herein designated VGAM GENE, on one or more VGAM459 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM459 is inhibition of expression of host target genes, as part of a novel viral mechanism of attacking a host. Accordingly, utilities of VGAM459 include diagnosis, prevention and treatment of viral infection by Ectromelia Virus. Specific functions, and accordingly utilities, of VGAM459 correlate with, and may be deduced from, the identity of the host target genes which VGAM459 binds and inhibits, and the function of these host target genes, as elaborated hereinbelow.

Nucleotide sequences of the VGAM459 precursor RNA, herein designated VGAM PRECURSOR RNA, and of the 'diced' VGAM459 RNA, herein designated VGAM RNA, and a schematic representation of the secondary folding of VGAM459 folded precursor RNA, herein designated VGAM FOLDED PRECURSOR RNA, of VGAM459 are further described hereinbelow with reference to Table 1.

Nucleotide sequences of host target binding sites, such as BINDING SITE-I, BINDING SITE-II and BINDING SITE-III of FIG. 1, found on VGAM459 host target RNA, and schematic representation of the complementarity of each of these host target binding sites to VGAM459 RNA, herein designated VGAM RNA, are described hereinbelow with reference to Table 2.

As mentioned hereinabove with reference to FIG. 1, a function of VGAM459 gene, herein designated VGAM is inhibition of expression of VGAM459 target genes. It is appreciated that specific functions, and accordingly utilities, of VGAM459 correlate with, and may be deduced from, the identity of the target genes which VGAM459 binds and inhibits, and the function of these target genes, as elaborated hereinbelow.

Cadherin, EGF LAG Seven-pass G-type Receptor 1 (flamingo homolog, Drosophila) (CELSR1, Accession NM_014246) is a VGAM459 host target gene. CELSR1 BINDING SITE is HOST TARGET binding site found in the 3' untranslated region of mRNA encoded by CELSR1, corresponding to a HOST TARGET binding site such as BINDING SITE I, BINDING SITE II or BINDING SITE III. Table 2 illustrates the complementarity of the nucleotide sequences of CELSR1 BINDING SITE, designated SEQ ID:15519, to the nucleotide sequence of VGAM459 RNA, herein designated VGAM RNA, also designated SEQ ID:3170.

A function of VGAM459 is therefore inhibition of Cadherin, EGF LAG Seven-pass G-type Receptor 1 (flamingo homolog, Drosophila) (CELSR1, Accession NM_014246), a gene which is involved in contact-mediated communication. Accordingly, utilities of VGAM459 include diagnosis, prevention and treatment of diseases and clinical conditions associated with CELSR1. The function of CELSR1 has been established by previous studies. By screening a mouse embryonic cDNA library, Hadjantonakis et al. (1997, 1998) obtained a cDNA encoding a 3,034-amino acid 7-pass transmembrane G protein-coupled receptor, which they termed cadherin EGF LAG seven-pass G-type receptor-1 (OMIM Ref. No. Celsr1). Celsr1 contains motifs that are recognized as mediators of protein-protein interactions. In its extracellular region it has a block of contiguous cadherin repeats in the N terminus and then a region with 7 epidermal growth factor (EGF; 131530)-like repeats interrupted by 2 laminin A (OMIM Ref. No. 150320) G-type (LAG) repeats. By in situ hybridization and RT-PCR analysis, Hadjantonakis et al. (1997) detected significant levels of Celsr1 in neural tube, brain, lung epithelium, and nascent eyelid in day 11.5 mouse embryos. In adult mice, expression was detected in spinal cord, eye, and brain, chiefly in ependymal cells lining the lateral, third, and fourth ventricles. The structure, putative G-linked signaling properties, and restricted expression of the Celsr1 protein suggest that it is a receptor involved in contact-mediated communication.

Full details of the abovementioned studies are described in the following publications, the disclosure of which are hereby incorporated by reference:

Hadjantonakis, A.-K.; Formstone, C. J.; Little, P. F. R.: mCelsr1 is an evolutionarily conserved seven-pass transmembrane receptor and is expressed during mouse embryonic development. Mech. Dev. 78:91-95, 1998; and Hadjantonakis, A.-K.; Sheward, W. J.; Harmar, A. J.; de Galan, L.; Hoovers, J. M. N.; Little, P. F. R.: Celsr1, a neural-specific gene encoding an unusual seven-pass transmembrane rece.

Further studies establishing the function and utilities of CELSR1 are found in John Hopkins OMIM database record ID 604523, and in sited publications numbered 6933-693 and 7438 listed in the bibliography section hereinbelow, which are also hereby incorporated by reference. Neurobeachin (NBEA, Accession XM_170732) is another VGAM459 host target gene. NBEA BINDING SITE is HOST TARGET binding site found in the 3' untranslated region of mRNA encoded by NBEA, corresponding to a HOST TARGET binding site such as BINDING SITE I, BINDING SITE II or BINDING SITE III. Table 2 illustrates the complementarity of the nucleotide sequences of NBEA BINDING SITE, designated SEQ ID:45490, to the nucleotide sequence of VGAM459 RNA, herein designated VGAM RNA, also designated SEQ ID:3170.

Another function of VGAM459 is therefore inhibition of Neurobeachin (NBEA, Accession XM_170732), a gene which may mediate protein-protein interactions. Accordingly, utilities of VGAM459 include diagnosis, prevention and treatment of diseases and clinical conditions associated with NBEA. The function of NBEA has been established by previous studies. The targeting of protein kinase A (PKA) actions to specific subcellular sites is mediated in part by A-kinase anchor proteins (AKAPs; OMIM Ref. No. 602449), a large and diverse group of proteins that includes neurobeachin. AKAPs reside at distinct subcellular locations and possess high-affinity binding sites for the type II regulatory subunit isoforms of PKA. By immunoscreening a chicken brain cDNA expression library with antibody to synaptic plasma membranes, followed by probing of a mouse cDNA library, Wang et al. (2000) identified a predominantly brain-expressed cDNA encoding Nbea. Sequence analysis predicted that the 2,936-amino acid cytosolic protein contains a series of C-terminal WD40 repeats preceded by an approximately 280-amino acid BEACH (for beige and Chediak-Higashi) domain, originally identified by Nagle et al. (1996) in LYST (OMIM Ref. No. 606897), the protein mutated in the Chediak-Higashi syndrome. BEACH is a conserved sequence, larger than a protein-protein interaction site, that is also found in human FAN (NSMAF; 603043) and the partial sequence known as BGL or CDC4L. Binding analysis showed that region B of Nbea binds with high affinity and specificity to the type II regulatory subunits, preferentially RII-alpha, of PKA. Helical wheel analysis revealed the potential for an amphiphilic alpha helix and the formation of a core binding site. Northern blot analysis of chicken tissue and Western blot analysis of mouse tissue indicated that Nbea expression is selective for brain. Immunocytochemical analysis demonstrated association with pleomorphic tubulovesicular endomembranes near the trans sides of Golgi stacks and in a subpopulation of synapses. Immunofluorescence microscopy revealed that Nbea association with Golgi-near membranes is stimulated by GTP-gamma-S and dispersed by brefeldin A.

Full details of the abovementioned studies are described in the following publications, the disclosure of which are hereby incorporated by reference:

Gilbert, D. J.; Engel, H.; Wang, X.; Grzeschik, K.-H.; Copeland, N. G.; Jenkins, N. A.; Kilimann, M. W.: The neurobeachin gene (Nbea) identifies a new region of homology between mouse central chromosome 3 and human chromosome 13q13. Mamm. Genome 10:1030-1031, 1999; and Nagle, D. L.; Karim, M. A.; Woolf, E. A.; Holmgren, L.; Bork, P.; Misumi, D. J.; McGrail, S. H.; Dussault, B. J., Jr.; Perou, C. M.; Boissy, R. E.; Duyk, G. M.; Spritz, R. A.; Moore, K.

Further studies establishing the function and utilities of NBEA are found in John Hopkins OMIM database record ID 604889, and in sited publications numbered 6950-6952 listed in the bibliography section hereinbelow, which are also hereby incorporated by reference. Sodium Channel, Voltage-gated, Type III, Alpha Polypeptide (SCN3A, Accession NM_006922) is another VGAM459 host target gene. SCN3A BINDING SITE is HOST TARGET binding site found in the 3' untranslated region of mRNA encoded by SCN3A, corresponding to a HOST TARGET binding site such as BINDING SITE I, BINDING SITE II or BINDING SITE III. Table 2 illustrates the complementarity of the nucleotide sequences of SCN3A BINDING SITE, designated SEQ ID:13797, to the nucleotide sequence of VGAM459 RNA, herein designated VGAM RNA, also designated SEQ ID:3170.

Another function of VGAM459 is therefore inhibition of Sodium Channel, Voltage-gated, Type III, Alpha Polypeptide (SCN3A, Accession NM_006922), a gene which may be important for maintaining neural membrane excitability. Accordingly, utilities of VGAM459 include diagnosis, prevention and treatment of diseases and clinical conditions associated with SCN3A. The function of SCN3A and its association with various diseases and clinical conditions, has been established by previous studies, as described hereinabove with reference to VGAM124. Ubiquitin-like 3 (UBL3, Accession NM_007106) is another VGAM459 host target gene. UBL3 BINDING SITE is HOST TARGET binding site found in the 3' untranslated region of mRNA encoded by UBL3, corresponding to a HOST TARGET binding site such as BINDING SITE I, BINDING SITE II or BINDING SITE III. Table 2 illustrates the complementarity of the nucleotide sequences of UBL3 BINDING SITE, designated SEQ ID:13963, to the nucleotide sequence of VGAM459 RNA, herein designated VGAM RNA, also designated SEQ ID:3170.

Another function of VGAM459 is therefore inhibition of Ubiquitin-like 3 (UBL3, Accession NM_007106), a gene which appears to have a diverse range of cellular functions. Accordingly, utilities of VGAM459 include diagnosis, prevention and treatment of diseases and clinical conditions associated with UBL3. The function of UBL3 has been established by previous studies. Ubiquitin (OMIM Ref. No. 191320) targets proteins for degradation by the 26S proteasome (see OMIM Ref. No. 603146). In contrast, ubiquitin-like (UBL) proteins (e.g., UBL1; 601912) may not be directly involved in protein degradation, but appear to have a diverse range of cellular functions (reviewed by Hodges et al., 1998). Chadwick et al. (1999) identified the Drosophila UBL3 gene. By searching an EST database using a Drosophila UBL3 cDNA as the query, they identified a human UBL3 EST. Using the EST, they isolated human keratinocyte stem cell cDNAs representing the complete UBL3 coding sequence. The deduced 117-amino acid human UBL3 protein contains 2 potential N-glycosylation sites, a potential protein kinase C phosphorylation site, and a potential C-terminal prenylation site. It is relatively hydrophilic with no predicted transmembrane domains. Human UBL3 shares 69% amino acid sequence identity with 1 form of Drosophila UBL3 and 99% identity with mouse Ubl3, a cDNA of which Chadwick et al. (1999) also isolated. Northern blot analysis of human tissues detected 3.5- and 4.5-kb UBL3 transcripts in all tissues tested, namely spleen, thymus, peripheral blood leukocytes, testis, ovary, placenta, prostate, liver, pancreas, small intestine, colon, kidney, heart, lung, brain, and skeletal muscle. Additional transcripts of 2.0 and 3.0 kb were found in testis. Chadwick et al. (1999) identified 3 polyadenylation signals that result in alternatively polyadenylated UBL3 transcripts. By somatic cell hybrid mapping, Chadwick et al. (1999) mapped the human UBL3 gene to chromosome 13. They localized the UBL3 gene to 13q12-q13 using radiation hybrid mapping. Using FISH, Chadwick et al. (1999) mapped the mouse Ubl3 gene to the telomeric end of chromosome 5 in band G2-3, a region showing homology of synteny with human 13q.

Full details of the abovementioned studies are described in the following publications, the disclosure of which are hereby incorporated by reference:

Chadwick, B. P.; Kidd, T.; Sgouros, J.; Ish-Horowicz, D.; Frischauf, A.-M.: Cloning, mapping and expression of UBL3, a novel ubiquitin-like gene. Gene 233: 189-195, 1999; and Hodges, M.; Tissot, C.; Freemont, P. S.: Protein regulation: tag wrestling with relatives of ubiquitin. Curr. Biol. 8: R749-R752, 1998.

Further studies establishing the function and utilities of UBL3 are found in John Hopkins OMIM database record ID 604711, and in sited publications numbered 4933-4934 listed in the bibliography section hereinbelow, which are also hereby incorporated by reference. Wilms Tumor 1 (WT1, Accession NM_024424) is another VGAM459 host target gene. WT1 BINDING SITE1 through WT1 BINDING SITE4 are HOST TARGET binding sites found in untranslated regions of mRNA encoded by WT1, corresponding to HOST TARGET binding sites such as BINDING SITE I, BINDING SITE II or BINDING SITE III. Table 2 illustrates the complementarity of the nucleotide sequences of WT1 BINDING SITE1 through WT1 BINDING SITE4, designated SEQ ID:23668, SEQ ID:23672, SEQ ID:23676 and SEQ ID:5952 respectively, to the nucleotide sequence of VGAM459 RNA, herein designated VGAM RNA, also designated SEQ ID:3170.

Another function of VGAM459 is therefore inhibition of Wilms Tumor 1 (WT1, Accession NM_024424). Accordingly, utilities of VGAM459 include diagnosis, prevention and treatment of diseases and clinical conditions associated with WT1. C1q and Tumor Necrosis Factor Related Protein 7 (C1QTNF7, Accession NM_031911) is another VGAM459 host target gene. C1QTNF7 BINDING SITE is HOST TARGET binding site found in the 3' untranslated region of mRNA encoded by C1QTNF7, corresponding to a HOST TARGET binding site such as BINDING SITE I, BINDING SITE II or BINDING SITE III. Table 2 illustrates the complementarity of the nucleotide sequences of C1QTNF7 BINDING SITE, designated SEQ ID:25663, to the nucleotide sequence of VGAM459 RNA, herein designated VGAM RNA, also designated SEQ ID:3170.

Another function of VGAM459 is therefore inhibition of C1q and Tumor Necrosis Factor Related Protein 7 (C1QTNF7, Accession NM_031911). Accordingly, utilities of VGAM459 include diagnosis, prevention and treatment of diseases and clinical conditions associated with C1QTNF7. HELO1 (Accession NM_021814) is another VGAM459 host target gene. HELO1 BINDING SITE is HOST TARGET binding site found in the 3' untranslated region of mRNA encoded by HELO1, corresponding to a HOST TARGET binding site such as BINDING SITE I, BINDING SITE II or BINDING SITE III. Table 2 illustrates the complementarity of the nucleotide sequences of HELO1 BINDING SITE, designated SEQ ID:22385, to the nucleotide sequence of VGAM459 RNA, herein designated VGAM RNA, also designated SEQ ID:3170.

Another function of VGAM459 is therefore inhibition of HELO1 (Accession NM_021814). Accordingly, utilities of VGAM459 include diagnosis, prevention and treatment of diseases and clinical conditions associated with HELO1. KIAA1203 (Accession XM_049683) is another VGAM459 host target gene. KIAA1203 BINDING SITE is HOST TARGET binding site found in the 3' untranslated region of mRNA encoded by KIAA1203, corresponding to a HOST TARGET binding site such as BINDING SITE I, BINDING SITE II or BINDING SITE III. Table 2 illustrates the complementarity of the nucleotide sequences of KIAA1203 BINDING SITE, designated SEQ ID:35466, to the nucleotide sequence of VGAM459 RNA, herein designated VGAM RNA, also designated SEQ ID:3170.

Another function of VGAM459 is therefore inhibition of KIAA1203 (Accession XM_049683). Accordingly, utilities of VGAM459 include diagnosis, prevention and treatment of diseases and clinical conditions associated with KIAA1203. MGC14161 (Accession NM_032892) is another VGAM459 host target gene. MGC14161 BINDING SITE is HOST TARGET binding site found in the 3' untranslated region of mRNA encoded by MGC14161, corresponding to a HOST TARGET binding site such as BINDING SITE I, BINDING SITE II or BINDING SITE III. Table 2 illustrates the complementarity of the nucleotide sequences of MGC14161 BINDING SITE, designated SEQ ID:26715, to the nucleotide sequence of VGAM459 RNA, herein designated VGAM RNA, also designated SEQ ID:3170.

Another function of VGAM459 is therefore inhibition of MGC14161 (Accession NM_032892). Accordingly, utilities of VGAM459 include diagnosis, prevention and treatment of diseases and clinical conditions associated with MGC14161. PANK (Accession NM_138316) is another VGAM459 host target gene. PANK BINDING SITE is HOST TARGET binding site found in the 3" untranslated region of mRNA encoded by PANK, corresponding to a HOST TARGET binding site such as BINDING SITE I, BINDING SITE II or BINDING SITE III. Table 2 illustrates the complementarity of the nucleotide sequences of PANK BINDING SITE, designated SEQ ID:28717, to the nucleotide sequence of VGAM459 RNA, herein designated VGAM RNA, also designated SEQ ID:3170.

Another function of VGAM459 is therefore inhibition of PANK (Accession NM_138316). Accordingly, utilities of VGAM459 include diagnosis, prevention and treatment of diseases and clinical conditions associated with PANK. LOC133686 (Accession XM_059667) is another VGAM459 host target gene. LOC133686 BINDING SITE is HOST TARGET binding site found in the 3' untranslated region of mRNA encoded by LOC133686, corresponding to a HOST TARGET binding site such as BINDING SITE I, BINDING SITE II or BINDING SITE III. Table 2 illustrates the complementarity of the nucleotide sequences of LOC133686 BINDING SITE, designated SEQ ID:37058, to the nucleotide sequence of VGAM459 RNA, herein designated VGAM RNA, also designated SEQ ID:3170.

Another function of VGAM459 is therefore inhibition of LOC133686 (Accession XM_059667). Accordingly, utilities of VGAM459 include diagnosis, prevention and treatment of diseases and clinical conditions associated with LOC133686. FIG. 1 further provides a conceptual description of a novel bioinformatically detected viral gene of the present invention, referred to here as Viral Genomic Address Messenger 460 (VGAM460) viral gene, which modulates expression of respective host target genes thereof, the function and utility of which host target genes is known in the art.

VGAM460 is a novel bioinformatically detected regulatory, non protein coding, viral micro RNA (miRNA) gene. The method by which VGAM460 was detected is described hereinabove with reference to FIGS. 1-8.

VGAM460 gene, herein designated VGAM GENE, is a viral gene contained in the genome of Variola Virus. VGAM460 host target gene, herein designated VGAM HOST TARGET GENE, is a human gene contained in the human genome.

VGAM460 gene encodes a VGAM460 precursor RNA, herein designated VGAM PRECURSOR RNA. Similar to other miRNA genes, and unlike most ordinary genes, VGAM460 precursor RNA does not encode a protein. A nucleotide sequence identical or highly similar to the nucleotide sequence of VGAM460 precursor RNA is designated SEQ ID:446, and is provided hereinbelow with reference to the sequence listing part. Nucleotide sequence SEQ ID:446 is located at position 69643 relative to the genome of Variola Virus.

VGAM460 precursor RNA folds onto itself, forming VGAM460 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM460 folded precursor RNA into VGAM460 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM460 RNA is designated SEQ ID:3171, and is provided hereinbelow with reference to the sequence listing part.

VGAM460 host target gene, herein designated VGAM HOST TARGET GENE, encodes a corresponding messenger RNA, VGAM460 host target RNA, herein designated VGAM HOST TARGET RNA. VGAM460 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM460 RNA, herein designated VGAM RNA, binds complementarily to one or more host target binding sites located in untranslated regions of VGAM460 host target RNA, herein designated VGAM HOST TARGET RNA. This complementary binding is due to the fact that the nucleotide sequence of VGAM460 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM460 RNA, herein designated VGAM RNA, may have a different number of host target binding sites in untranslated regions of a VGAM460 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM460 RNA, herein designated VGAM RNA, to host target binding sites on VGAM460 host target RNA, herein designated VGAM HOST TARGET RNA, such as BINDING SITE I, BINDING SITE II and BINDING SITE III, inhibits translation of VGAM460 host target RNA into VGAM460 host target protein, herein designated VGAM HOST TARGET PROTEIN. VGAM host target protein is therefore outlined by a broken line.

It is appreciated that VGAM460 host target gene, herein designated VGAM HOST TARGET GENE, in fact represents a plurality of VGAM460 host target genes. The mRNA of each one of this plurality of VGAM460 host target genes comprises one or more host target binding sites, each having a nucleotide sequence which is at least partly complementary to VGAM460 RNA, herein designated VGAM RNA, and which when bound by VGAM460 RNA causes inhibition of translation of respective one or more VGAM460 host target proteins.

It is further appreciated by one skilled in the art that the mode of translational inhibition illustrated by FIG. 1 with specific reference to translational inhibition exerted by VGAM460 gene, herein designated VGAM GENE, on one or more VGAM460 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM460 is inhibition of expression of host target genes, as part of a novel viral mechanism of attacking a host. Accordingly, utilities of VGAM460 include diagnosis, prevention and treatment of viral infection by Variola Virus. Specific functions, and accordingly utilities, of VGAM460 correlate with, and may be deduced from, the identity of the host target genes which VGAM460 binds and inhibits, and the function of these host target genes, as elaborated hereinbelow.

Nucleotide sequences of the VGAM460 precursor RNA, herein designated VGAM PRECURSOR RNA, and of the 'diced' VGAM460 RNA, herein designated VGAM RNA, and a schematic representation of the secondary folding of VGAM460 folded precursor RNA, herein designated VGAM FOLDED PRECURSOR RNA, of VGAM460 are further described hereinbelow with reference to Table 1.

Nucleotide sequences of host target binding sites, such as BINDING SITE-I, BINDING SITE-II and BINDING SITE-III of FIG. 1, found on VGAM460 host target RNA, and schematic representation of the complementarity of each of these host target binding sites to VGAM460 RNA, herein designated VGAM RNA, are described hereinbelow with reference to Table 2.

As mentioned hereinabove with reference to FIG. 1, a function of VGAM460 gene, herein designated VGAM is inhibition of expression of VGAM460 target genes. It is appreciated that specific functions, and accordingly utilities, of VGAM460 correlate with, and may be deduced from, the identity of the target genes which VGAM460 binds and inhibits, and the function of these target genes, as elaborated hereinbelow.

2',3'-cyclic Nucleotide 3' Phosphodiesterase (CNP, Accession NM_033133) is a VGAM460 host target gene. CNP BINDING SITE is HOST TARGET binding site found in the 3' untranslated region of mRNA encoded by CNP, corresponding to a HOST TARGET binding site such as BINDING SITE I, BINDING SITE II or BINDING SITE III. Table 2 illustrates the complementarity of the nucleotide sequences of CNP BINDING SITE, designated SEQ ID:26976, to the nucleotide sequence of VGAM460 RNA, herein designated VGAM RNA, also designated SEQ ID:3171.

A function of VGAM460 is therefore inhibition of 2',3'-cyclic Nucleotide 3' Phosphodiesterase (CNP, Accession NM_033133), a gene which can link tubulin to membranes and may regulate cytoplasmic microtubule distribution. Accordingly, utilities of VGAM460 include diagnosis, prevention and treatment of diseases and clinical conditions associated with CNP. The function of CNP and its association with various diseases and clinical conditions, has been established by previous studies, as described hereinabove with reference to VGAM443. Nuclear Receptor Coactivator 4 (NCOA4, Accession NM_005437) is another VGAM460 host target gene. NCOA4 BINDING SITE is HOST TARGET binding site found in the 3' untranslated region of mRNA encoded by NCOA4, corresponding to a HOST TARGET binding site such as BINDING SITE I, BINDING SITE II or BINDING SITE III. Table 2 illustrates the complementarity of the nucleotide sequences of NCOA4 BINDING SITE, designated SEQ ID:11922, to the nucleotide sequence of VGAM460 RNA, herein designated VGAM RNA, also designated SEQ ID:3171.

Another function of VGAM460 is therefore inhibition of Nuclear Receptor Coactivator 4 (NCOA4, Accession NM_005437), a gene which Binds and activates androgen receptor (AR) in ligand-dependent manner. Accordingly, utilities of VGAM460 include diagnosis, prevention and treatment of diseases and clinical conditions associated with NCOA4. The function of NCOA4 and its association with various diseases and clinical conditions, has been established by previous studies, as described hereinabove with reference to VGAM420. Transcription Factor Binding to IGHM Enhancer 3 (TFE3, Accession NM_006521) is another VGAM460 host target gene. TFE3 BINDING SITE is HOST TARGET binding site found in the 3' untranslated region of mRNA encoded by TFE3, corresponding to a HOST TARGET binding site such as BINDING SITE I, BINDING SITE II or BINDING SITE III. Table 2 illustrates the complementarity of the nucleotide sequences of TFE3 BINDING SITE, designated SEQ ID:13274, to the nucleotide sequence of VGAM460 RNA, herein designated VGAM RNA, also designated SEQ ID:3171.

Another function of VGAM460 is therefore inhibition of Transcription Factor Binding to IGHM Enhancer 3 (TFE3, Accession NM_006521), a gene which is a positive-acting transcription factor that binds to the immunoglobulin enchancer mue3 motif. Accordingly, utilities of VGAM460 include diagnosis, prevention and treatment of diseases and clinical conditions associated with TFE3. The function of TFE3 and its association with various diseases and clinical conditions, has been established by previous studies, as described hereinabove with reference to VGAM443. Vacuolar Protein Sorting 26 (yeast) (VPS26, Accession NM_004896) is another VGAM460 host target gene. VPS26 BINDING SITE is HOST TARGET binding site found in the 3' untranslated region of mRNA encoded by VPS26, corresponding to a HOST TARGET binding site such as BINDING SITE I, BINDING SITE II or BINDING SITE III. Table 2 illustrates the complementarity of the nucleotide sequences of VPS26 BINDING SITE, designated SEQ ID:11329, to the nucleotide sequence of VGAM460 RNA, herein designated VGAM RNA, also designated SEQ ID:3171.

Another function of VGAM460 is therefore inhibition of Vacuolar Protein Sorting 26 (yeast) (VPS26, Accession NM_004896), a gene which is a sorting protein- ensures the proper delivery of organelle-specific proteins. Accordingly, utilities of VGAM460 include diagnosis, prevention and treatment of diseases and clinical conditions associated with VPS26. The function of VPS26 and its association with various diseases and clinical conditions, has been established by previous studies, as described hereinabove with reference to VGAM315. Caspase Recruitment Domain Family, Member 6 (CARD6, Accession NM_032587) is another VGAM460 host target gene. CARD6 BINDING SITE is HOST TARGET binding site found in the 3' untranslated region of mRNA encoded by CARD6, corresponding to a HOST TARGET binding site such as BINDING SITE I, BINDING SITE II or BINDING SITE III. Table 2 illustrates the complementarity of the nucleotide sequences of CARD6 BINDING SITE, designated SEQ ID:26322, to the nucleotide sequence of VGAM460 RNA, herein designated VGAM RNA, also designated SEQ ID:3171.

Another function of VGAM460 is therefore inhibition of Caspase Recruitment Domain Family, Member 6 (CARD6, Accession NM_032587). Accordingly, utilities of VGAM460 include diagnosis, prevention and treatment of diseases and clinical conditions associated with CARD6. DKFZp761K1423 (Accession NM_018422) is another VGAM460 host target gene. DKFZp761K1423 BINDING SITE is HOST TARGET binding site found in the 5' untranslated region of mRNA encoded by DKFZp761K1423, corresponding to a HOST TARGET binding site such as BINDING SITE I, BINDING SITE II or BINDING SITE III. Table 2 illustrates the complementarity of the nucleotide sequences of DKFZp761K1423 BINDING SITE, designated SEQ ID:20475, to the nucleotide sequence of VGAM460 RNA, herein designated VGAM RNA, also designated SEQ ID:3171.

Another function of VGAM460 is therefore inhibition of DKFZp761K1423 (Accession NM_018422). Accordingly, utilities of VGAM460 include diagnosis, prevention and treatment of diseases and clinical conditions associated with DKFZp761K1423. KIAA0090 (Accession XM_114045) is another VGAM460 host target gene. KIAA0090 BINDING SITE is HOST TARGET binding site found in the 3' untranslated region of mRNA encoded by KIAA0090, corresponding to a HOST TARGET binding site such as BINDING SITE I, BINDING SITE II or BINDING SITE III. Table 2 illustrates the complementarity of the nucleotide sequences of KIAA0090 BINDING SITE, designated SEQ ID:42655, to the nucleotide sequence of VGAM460 RNA, herein designated VGAM RNA, also designated SEQ ID:3171.

Another function of VGAM460 is therefore inhibition of KIAA0090 (Accession XM_114045). Accordingly, utilities of VGAM460 include diagnosis, prevention and treatment of diseases and clinical conditions associated with KIAA0090. KIAA0543 (Accession XM_044213) is another VGAM460 host target gene. KIAA0543 BINDING SITE is HOST TARGET binding site found in the 3' untranslated region of mRNA encoded by KIAA0543, corresponding to a HOST TARGET binding site such as BINDING SITE I, BINDING SITE II or BINDING SITE III. Table 2 illustrates the complementarity of the nucleotide sequences of KIAA0543 BINDING SITE, designated SEQ ID:34180, to the nucleotide sequence of VGAM460 RNA, herein designated VGAM RNA, also designated SEQ ID:3171.

Another function of VGAM460 is therefore inhibition of KIAA0543 (Accession XM_044213). Accordingly, utilities of VGAM460 include diagnosis, prevention and treatment of diseases and clinical conditions associated with KIAA0543. Lymphocyte Antigen 75 (LY75, Accession NM_002349) is another VGAM460 host target gene. LY75 BINDING SITE is HOST TARGET binding site found in the 3' untranslated region of mRNA encoded by LY75, corresponding to a HOST TARGET binding site such as BINDING SITE I, BINDING SITE II or BINDING SITE III. Table 2 illustrates the complementarity of the nucleotide sequences of LY75 BINDING SITE, designated SEQ ID:8152, to the nucleotide sequence of VGAM460 RNA, herein designated VGAM RNA, also designated SEQ ID:3171.

Another function of VGAM460 is therefore inhibition of Lymphocyte Antigen 75 (LY75, Accession NM_002349). Accordingly, utilities of VGAM460 include diagnosis, prevention and treatment of diseases and clinical conditions associated with LY75. LOC146179 (Accession XM_085354) is another VGAM460 host target gene. LOC146179 BINDING SITE is HOST TARGET binding site found in the 5' untranslated region of mRNA encoded by LOC146179, corresponding to a HOST TARGET binding site such as BINDING SITE I, BINDING SITE II or BINDING SITE III. Table 2 illustrates the complementarity of the nucleotide sequences of LOC146179 BINDING SITE, designated SEQ ID:38077, to the nucleotide sequence of VGAM460 RNA, herein designated VGAM RNA, also designated SEQ ID:3171.

Another function of VGAM460 is therefore inhibition of LOC146179 (Accession XM_085354). Accordingly, utilities of VGAM460 include diagnosis, prevention and treatment of diseases and clinical conditions associated with LOC146179. LOC221399 (Accession XM_168134) is another VGAM460 host target gene. LOC221399 BINDING SITE is HOST TARGET binding site found in the 5' untranslated region of mRNA encoded by LOC221399, corresponding to a HOST TARGET binding site such as BINDING SITE I, BINDING SITE II or BINDING SITE III. Table 2 illustrates the complementarity of the nucleotide sequences of LOC221399 BINDING SITE, designated SEQ ID:45053, to the nucleotide sequence of VGAM460 RNA, herein designated VGAM RNA, also designated SEQ ID:3171.

Another function of VGAM460 is therefore inhibition of LOC221399 (Accession XM_168134). Accordingly, utilities of VGAM460 include diagnosis, prevention and treatment of diseases and clinical conditions associated with LOC221399. FIG. 1 further provides a conceptual description of a novel bioinformatically detected viral gene of the present invention, referred to here as Viral Genomic Address Messenger 461 (VGAM461) viral gene, which modulates expression of respective host target genes thereof, the function and utility of which host target genes is known in the art.

VGAM461 is a novel bioinformatically detected regulatory, non protein coding, viral micro RNA (miRNA) gene. The method by which VGAM461 was detected is described hereinabove with reference to FIGS. 1-8.

VGAM461 gene, herein designated VGAM GENE, is a viral gene contained in the genome of Variola Virus. VGAM461 host target gene, herein designated VGAM HOST TARGET GENE, is a human gene contained in the human genome.

VGAM461 gene encodes a VGAM461 precursor RNA, herein designated VGAM PRECURSOR RNA. Similar to other miRNA genes, and unlike most ordinary genes, VGAM461 precursor RNA does not encode a protein. A nucleotide sequence identical or highly similar to the nucleotide sequence of VGAM461 precursor RNA is designated SEQ ID:447, and is provided hereinbelow with reference to the sequence listing part. Nucleotide sequence SEQ ID:447 is located at position 119548 relative to the genome of Variola Virus.

VGAM461 precursor RNA folds onto itself, forming VGAM461 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM461 folded precursor RNA into VGAM461 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM461 RNA is designated SEQ ID:3172, and is provided hereinbelow with reference to the sequence listing part.

VGAM461 host target gene, herein designated VGAM HOST TARGET GENE, encodes a corresponding messenger RNA, VGAM461 host target RNA, herein designated VGAM HOST TARGET RNA. VGAM461 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM461 RNA, herein designated VGAM RNA, binds complementarily to one or more host target binding sites located in untranslated regions of VGAM461 host target RNA, herein designated VGAM HOST TARGET RNA. This complementary binding is due to the fact that the nucleotide sequence of VGAM461 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM461 RNA, herein designated VGAM RNA, may have a different number of host target binding sites in untranslated regions of a VGAM461 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM461 RNA, herein designated VGAM RNA, to host target binding sites on VGAM461 host target RNA, herein designated VGAM HOST TARGET RNA, such as BINDING SITE I, BINDING SITE II and BINDING SITE III, inhibits translation of VGAM461 host target RNA into VGAM461 host target protein, herein designated VGAM HOST TARGET PROTEIN. VGAM host target protein is therefore outlined by a broken line.

It is appreciated that VGAM461 host target gene, herein designated VGAM HOST TARGET GENE, in fact represents a plurality of VGAM461 host target genes. The mRNA of each one of this plurality of VGAM461 host target genes comprises one or more host target binding sites, each having a nucleotide sequence which is at least partly complementary to VGAM461 RNA, herein designated VGAM RNA, and which when bound by VGAM461 RNA causes inhibition of translation of respective one or more VGAM461 host target proteins.

It is further appreciated by one skilled in the art that the mode of translational inhibition illustrated by FIG. 1 with specific reference to translational inhibition exerted by VGAM461 gene, herein designated VGAM GENE, on one or more VGAM461 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM461 is inhibition of expression of host target genes, as part of a novel viral mechanism of attacking a host. Accordingly, utilities of VGAM461 include diagnosis, prevention and treatment of viral infection by Variola Virus. Specific functions, and accordingly utilities, of VGAM461 correlate with, and may be deduced from, the identity of the host target genes which VGAM461 binds and inhibits, and the function of these host target genes, as elaborated hereinbelow.

Nucleotide sequences of the VGAM461 precursor RNA, herein designated VGAM PRECURSOR RNA, and of the 'diced' VGAM461 RNA, herein designated VGAM RNA, and a schematic representation of the secondary folding of VGAM461 folded precursor RNA, herein designated VGAM FOLDED PRECURSOR RNA, of VGAM461 are further described hereinbelow with reference to Table 1.

Nucleotide sequences of host target binding sites, such as BINDING SITE-I, BINDING SITE-II and BINDING SITE-III of FIG. 1, found on VGAM461 host target RNA, and schematic representation of the complementarity of each of these host target binding sites to VGAM461 RNA, herein designated VGAM RNA, are described hereinbelow with reference to Table 2.

As mentioned hereinabove with reference to FIG. 1, a function of VGAM461 gene, herein designated VGAM is inhibition of expression of VGAM461 target genes. It is appreciated that specific functions, and accordingly utilities, of VGAM461 correlate with, and may be deduced from, the identity of the target genes which VGAM461 binds and inhibits, and the function of these target genes, as elaborated hereinbelow.

FLJ14009 (Accession NM_024760) is a VGAM461 host target gene. FLJ14009 BINDING SITE is HOST TARGET binding site found in the 5' untranslated region of mRNA encoded by FLJ14009, corresponding to a HOST TARGET binding site such as BINDING SITE I, BINDING SITE II or BINDING SITE III. Table 2 illustrates the complementarity of the nucleotide sequences of FLJ14009 BINDING SITE, designated SEQ ID:24112, to the nucleotide sequence of VGAM461 RNA, herein designated VGAM RNA, also designated SEQ ID:3172.

A function of VGAM461 is therefore inhibition of FLJ14009 (Accession NM_024760). Accordingly, utilities of VGAM461 include diagnosis, prevention and treatment of diseases and clinical conditions associated with FLJ14009. KIAA0332 (Accession XM_031553) is another VGAM461 host target gene. KIAA0332 BINDING SITE is HOST TARGET binding site found in the 3' untranslated region of mRNA encoded by KIAA0332, corresponding to a HOST TARGET binding site such as BINDING SITE I, BINDING SITE II or BINDING SITE III. Table 2 illustrates the complementarity of the nucleotide sequences of KIAA0332 BINDING SITE, designated SEQ ID:31416, to the nucleotide sequence of VGAM461 RNA, herein designated VGAM RNA, also designated SEQ ID:3172.

Another function of VGAM461 is therefore inhibition of KIAA0332 (Accession XM_031553). Accordingly, utilities of VGAM461 include diagnosis, prevention and treatment of diseases and clinical conditions associated with KIAA0332. PRO1768 (Accession NM_014099) is another VGAM461 host target gene. PRO1768 BINDING SITE is HOST TARGET binding site found in the 3' untranslated region of mRNA encoded by PRO1768, corresponding to a HOST TARGET binding site such as BINDING SITE I, BINDING SITE II or BINDING SITE III. Table 2 illustrates the complementarity of the nucleotide sequences of PRO1768 BINDING SITE, designated SEQ ID:15323, to the nucleotide sequence of VGAM461 RNA, herein designated VGAM RNA, also designated SEQ ID:3172.

Another function of VGAM461 is therefore inhibition of PRO1768 (Accession NM_014099). Accordingly, utilities of VGAM461 include diagnosis, prevention and treatment of diseases and clinical conditions associated with PRO1768. FIG. 1 further provides a conceptual description of a novel bioinformatically detected viral gene of the present invention, referred to here as Viral Genomic Address Messenger 462 (VGAM462) viral gene, which modulates expression of respective host target genes thereof, the function and utility of which host target genes is known in the art.

VGAM462 is a novel bioinformatically detected regulatory, non protein coding, viral micro RNA (miRNA) gene. The method by which VGAM462 was detected is described hereinabove with reference to FIGS. 1-8.

VGAM462 gene, herein designated VGAM GENE, is a viral gene contained in the genome of Variola Virus. VGAM462 host target gene, herein designated VGAM HOST TARGET GENE, is a human gene contained in the human genome.

VGAM462 gene encodes a VGAM462 precursor RNA, herein designated VGAM PRECURSOR RNA. Similar to other miRNA genes, and unlike most ordinary genes, VGAM462 precursor RNA does not encode a protein. A nucleotide sequence identical or highly similar to the nucleotide sequence of VGAM462 precursor RNA is designated SEQ ID:448, and is provided hereinbelow with reference to the sequence listing part. Nucleotide sequence SEQ ID:448 is located at position 168878 relative to the genome of Variola Virus.

VGAM462 precursor RNA folds onto itself, forming VGAM462 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM462 folded precursor RNA into VGAM462 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM462 RNA is designated SEQ ID:3173, and is provided hereinbelow with reference to the sequence listing part.

VGAM462 host target gene, herein designated VGAM HOST TARGET GENE, encodes a corresponding messenger RNA, VGAM462 host target RNA, herein designated VGAM HOST TARGET RNA. VGAM462 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM462 RNA, herein designated VGAM RNA, binds complementarily to one or more host target binding sites located in untranslated regions of VGAM462 host target RNA, herein designated VGAM HOST TARGET RNA. This complementary binding is due to the fact that the nucleotide sequence of VGAM462 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM462 RNA, herein designated VGAM RNA, may have a different number of host target binding sites in untranslated regions of a VGAM462 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM462 RNA, herein designated VGAM RNA, to host target binding sites on VGAM462 host target RNA, herein designated VGAM HOST TARGET RNA, such as BINDING SITE I, BINDING SITE II and BINDING SITE III, inhibits translation of VGAM462 host target RNA into VGAM462 host target protein, herein designated VGAM HOST TARGET PROTEIN. VGAM host target protein is therefore outlined by a broken line.

It is appreciated that VGAM462 host target gene, herein designated VGAM HOST TARGET GENE, in fact represents a plurality of VGAM462 host target genes. The mRNA of each one of this plurality of VGAM462 host target genes comprises one or more host target binding sites, each having a nucleotide sequence which is at least partly complementary to VGAM462 RNA, herein designated VGAM RNA, and which when bound by VGAM462 RNA causes inhibition of translation of respective one or more VGAM462 host target proteins.

It is further appreciated by one skilled in the art that the mode of translational inhibition illustrated by FIG. 1 with specific reference to translational inhibition exerted by VGAM462 gene, herein designated VGAM GENE, on one or more VGAM462 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM462 is inhibition of expression of host target genes, as part of a novel viral mechanism of attacking a host. Accordingly, utilities of VGAM462 include diagnosis, prevention and treatment of viral infection by Variola Virus. Specific functions, and accordingly utilities, of VGAM462 correlate with, and may be deduced from, the identity of the host target genes which VGAM462 binds and inhibits, and the function of these host target genes, as elaborated hereinbelow.

Nucleotide sequences of the VGAM462 precursor RNA, herein designated VGAM PRECURSOR RNA, and of the 'diced' VGAM462 RNA, herein designated VGAM RNA, and a schematic representation of the secondary folding of VGAM462 folded precursor RNA, herein designated VGAM FOLDED PRECURSOR RNA, of VGAM462 are further described hereinbelow with reference to Table 1.

Nucleotide sequences of host target binding sites, such as BINDING SITE-I, BINDING SITE-II and BINDING SITE-III of FIG. 1, found on VGAM462 host target RNA, and schematic representation of the complementarity of each of these host target binding sites to VGAM462 RNA, herein designated VGAM RNA, are described hereinbelow with reference to Table 2.

As mentioned hereinabove with reference to FIG. 1, a function of VGAM462 gene, herein designated VGAM is inhibition of expression of VGAM462 target genes. It is appreciated that specific functions, and accordingly utilities, of VGAM462 correlate with, and may be deduced from, the identity of the target genes which VGAM462 binds and inhibits, and the function of these target genes, as elaborated hereinbelow.

5-hydroxytryptamine (serotonin) Receptor 6 (HTR6, Accession NM_000871) is a VGAM462 host target gene. HTR6 BINDING SITE is HOST TARGET binding site found in the 5' untranslated region of mRNA encoded by HTR6, corresponding to a HOST TARGET binding site such as BINDING SITE I, BINDING SITE II or BINDING SITE III. Table 2 illustrates the complementarity of the nucleotide sequences of HTR6 BINDING SITE, designated SEQ ID:6548, to the nucleotide sequence of VGAM462 RNA, herein designated VGAM RNA, also designated SEQ ID:3173.

A function of VGAM462 is therefore inhibition of 5-hydroxytryptamine (serotonin) Receptor 6 (HTR6, Accession NM_000871), a gene which stimulates adenylate cyclase. Accordingly, utilities of VGAM462 include diagnosis, prevention and treatment of diseases and clinical conditions associated with HTR6. The function of HTR6 and its association with various diseases and clinical conditions, has been established by previous studies, as described hereinabove with reference to VGAM326. Cat Eye Syndrome Chromosome Region, Candidate 7 (CECR7, Accession XM_086803) is another VGAM462 host target gene. CECR7 BINDING SITE is HOST TARGET binding site found in the 5' untranslated region of mRNA encoded by CECR7, corresponding to a HOST TARGET binding site such as BINDING SITE I, BINDING SITE II or BINDING SITE III. Table 2 illustrates the complementarity of the nucleotide sequences of CECR7 BINDING SITE, designated SEQ ID:38876, to the nucleotide sequence of VGAM462 RNA, herein designated VGAM RNA, also designated SEQ ID:3173.

Another function of VGAM462 is therefore inhibition of Cat Eye Syndrome Chromosome Region, Candidate 7 (CECR7, Accession XM_086803). Accordingly, utilities of VGAM462 include diagnosis, prevention and treatment of diseases and clinical conditions associated with CECR7. KIAA1203 (Accession XM_049683) is another VGAM462 host target gene. KIAA1203 BINDING SITE is HOST TARGET binding site found in the 3' untranslated region of mRNA encoded by KIAA1203, corresponding to a HOST TARGET binding site such as BINDING SITE I, BINDING SITE II or BINDING SITE III. Table 2 illustrates the complementarity of the nucleotide sequences of KIAA1203 BINDING SITE, designated SEQ ID:35467, to the nucleotide sequence of VGAM462 RNA, herein designated VGAM RNA, also designated SEQ ID:3173.

Another function of VGAM462 is therefore inhibition of KIAA1203 (Accession XM_049683). Accordingly, utilities of VGAM462 include diagnosis, prevention and treatment of diseases and clinical conditions associated with KIAA1203. KIAA1535 (Accession XM_086565) is another VGAM462 host target gene. KIAA1535 BINDING SITE is HOST TARGET binding site found in the 3' untranslated region of mRNA encoded by KIAA1535, corresponding to a HOST TARGET binding site such as BINDING SITE I, BINDING SITE II or BINDING SITE III. Table 2 illustrates the complementarity of the nucleotide sequences of KIAA1535 BINDING SITE, designated SEQ ID:38763, to the nucleotide sequence of VGAM462 RNA, herein designated VGAM RNA, also designated SEQ ID:3173.

Another function of VGAM462 is therefore inhibition of KIAA1535 (Accession XM_086565). Accordingly, utilities of VGAM462 include diagnosis, prevention and treatment of diseases and clinical conditions associated with KIAA1535. KIAA1894 (Accession XM_058025) is another VGAM462 host target gene. KIAA1894 BINDING SITE is HOST TARGET binding site found in the 3' untranslated region of mRNA encoded by KIAA1894, corresponding to a HOST TARGET binding site such as BINDING SITE I, BINDING SITE II or BINDING SITE III. Table 2 illustrates the complementarity of the nucleotide sequences of KIAA1894 BINDING SITE, designated SEQ ID:36560, to the nucleotide sequence of VGAM462 RNA, herein designated VGAM RNA, also designated SEQ ID:3173.

Another function of VGAM462 is therefore inhibition of KIAA1894 (Accession XM_058025). Accordingly, utilities of VGAM462 include diagnosis, prevention and treatment of diseases and clinical conditions associated with KIAA1894. LOC151171 (Accession XM_087116) is another VGAM462 host target gene. LOC151171 BINDING SITE is HOST TARGET binding site found in the 5' untranslated region of mRNA encoded by LOC151171, corresponding to a HOST TARGET binding site such as BINDING SITE I, BINDING SITE II or BINDING SITE III. Table 2 illustrates the complementarity of the nucleotide sequences of LOC151171 BINDING SITE, designated SEQ ID:39065, to the nucleotide sequence of VGAM462 RNA, herein designated VGAM RNA, also designated SEQ ID:3173.

Another function of VGAM462 is therefore inhibition of LOC151171 (Accession XM_087116). Accordingly, utilities of VGAM462 include diagnosis, prevention and treatment of diseases and clinical conditions associated with LOC151171. FIG. 1 further provides a conceptual description of a novel bioinformatically detected viral gene of the present invention, referred to here as Viral Genomic Address Messenger 463 (VGAM463) viral gene, which modulates expression of respective host target genes thereof, the function and utility of which host target genes is known in the art.

VGAM463 is a novel bioinformatically detected regulatory, non protein coding, viral micro RNA (miRNA) gene.

The method by which VGAM463 was detected is described hereinabove with reference to FIGS. 1-8.

VGAM463 gene, herein designated VGAM GENE, is a viral gene contained in the genome of Variola Virus. VGAM463 host target gene, herein designated VGAM HOST TARGET GENE, is a human gene contained in the human genome.

VGAM463 gene encodes a VGAM463 precursor RNA, herein designated VGAM PRECURSOR RNA. Similar to other miRNA genes, and unlike most ordinary genes, VGAM463 precursor RNA does not encode a protein. A nucleotide sequence identical or highly similar to the nucleotide sequence of VGAM463 precursor RNA is designated SEQ ID:449, and is provided hereinbelow with reference to the sequence listing part. Nucleotide sequence SEQ ID:449 is located at position 169316 relative to the genome of Variola Virus.

VGAM463 precursor RNA folds onto itself, forming VGAM463 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM463 folded precursor RNA into VGAM463 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM463 RNA is designated SEQ ID:3174, and is provided hereinbelow with reference to the sequence listing part.

VGAM463 host target gene, herein designated VGAM HOST TARGET GENE, encodes a corresponding messenger RNA, VGAM463 host target RNA, herein designated VGAM HOST TARGET RNA. VGAM463 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM463 RNA, herein designated VGAM RNA, binds complementarily to one or more host target binding sites located in untranslated regions of VGAM463 host target RNA, herein designated VGAM HOST TARGET RNA. This complementary binding is due to the fact that the nucleotide sequence of VGAM463 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM463 RNA, herein designated VGAM RNA, may have a different number of host target binding sites in untranslated regions of a VGAM463 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM463 RNA, herein designated VGAM RNA, to host target binding sites on VGAM463 host target RNA, herein designated VGAM HOST TARGET RNA, such as BINDING SITE I, BINDING SITE II and BINDING SITE III, inhibits translation of VGAM463 host target RNA into VGAM463 host target protein, herein designated VGAM HOST TARGET PROTEIN. VGAM host target protein is therefore outlined by a broken line.

It is appreciated that VGAM463 host target gene, herein designated VGAM HOST TARGET GENE, in fact represents a plurality of VGAM463 host target genes. The mRNA of each one of this plurality of VGAM463 host target genes comprises one or more host target binding sites, each having a nucleotide sequence which is at least partly complementary to VGAM463 RNA, herein designated VGAM RNA, and which when bound by VGAM463 RNA causes inhibition of translation of respective one or more VGAM463 host target proteins.

It is further appreciated by one skilled in the art that the mode of translational inhibition illustrated by FIG. 1 with specific reference to translational inhibition exerted by VGAM463 gene, herein designated VGAM GENE, on one or more VGAM463 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM463 is inhibition of expression of host target genes, as part of a novel viral mechanism of attacking a host. Accordingly, utilities of VGAM463 include diagnosis, prevention and treatment of viral infection by Variola Virus. Specific functions, and accordingly utilities, of VGAM463 correlate with, and may be deduced from, the identity of the host target genes which VGAM463 binds and inhibits, and the function of these host target genes, as elaborated hereinbelow.

Nucleotide sequences of the VGAM463 precursor RNA, herein designated VGAM PRECURSOR RNA, and of the 'diced' VGAM463 RNA, herein designated VGAM RNA, and a schematic representation of the secondary folding of VGAM463 folded precursor RNA, herein designated VGAM FOLDED PRECURSOR RNA, of VGAM463 are further described hereinbelow with reference to Table 1.

Nucleotide sequences of host target binding sites, such as BINDING SITE-I, BINDING SITE-II and BINDING SITE-III of FIG. 1, found on VGAM463 host target RNA, and schematic representation of the complementarity of each of these host target binding sites to VGAM463 RNA, herein designated VGAM RNA, are described hereinbelow with reference to Table 2.

As mentioned hereinabove with reference to FIG. 1, a function of VGAM463 gene, herein designated VGAM is inhibition of expression of VGAM463 target genes. It is appreciated that specific functions, and accordingly utilities, of VGAM463 correlate with, and may be deduced from, the identity of the target genes which VGAM463 binds and inhibits, and the function of these target genes, as elaborated hereinbelow.

Exonuclease 1 (EXO1, Accession NM_003686) is a VGAM463 host target gene. EXO1 BINDING SITE1 through EXO1 BINDING SITE3 are HOST TARGET binding sites found in untranslated regions of mRNA encoded by EXO1, corresponding to HOST TARGET binding sites such as BINDING SITE I, BINDING SITE II or BINDING SITE III. Table 2 illustrates the complementarity of the nucleotide sequences of EXO1 BINDING SITE1 through EXO1 BINDING SITE3, designated SEQ ID:9797, SEQ ID:12644 and SEQ ID:28183 respectively, to the nucleotide sequence of VGAM463 RNA, herein designated VGAM RNA, also designated SEQ ID:3174.

A function of VGAM463 is therefore inhibition of Exonuclease 1 (EXO1, Accession NM_003686), a gene which excise and replace mismatched segments. Accordingly, utilities of VGAM463 include diagnosis, prevention and treatment of diseases and clinical conditions associated with EXO1. The function of EXO1 and its association with various diseases and clinical conditions, has been established by previous studies, as described hereinabove with reference to VGAM399. KIAA0237 (Accession NM_014747) is another VGAM463 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16447, to the nucleotide sequence of VGAM463 RNA, herein designated VGAM RNA, also designated SEQ ID:3174.

Another function of VGAM463 is therefore inhibition of KIAA0237 (Accession NM_014747). Accordingly, utilities of VGAM463 include diagnosis, prevention and treatment of diseases and clinical conditions associated with KIAA0237. KIAA0863 (Accession XM_170863) is another VGAM463 host target gene. KIAA0863 BINDING SITE is HOST TARGET binding site found in the 5' untranslated region of mRNA encoded by KIAA0863, corresponding to a HOST TARGET binding site such as BINDING SITE I, BINDING SITE II or BINDING SITE III. Table 2 illustrates the complementarity of the nucleotide sequences of KIAA0863 BINDING SITE, designated SEQ ID:45634, to the nucleotide sequence of VGAM463 RNA, herein designated VGAM RNA, also designated SEQ ID:3174.

Another function of VGAM463 is therefore inhibition of KIAA0863 (Accession XM_170863). Accordingly, utilities of VGAM463 include diagnosis, prevention and treatment of diseases and clinical conditions associated with KIAA0863. KIAA1165 (Accession XM_041162) is another VGAM463 host target gene. KIAA1165 BINDING SITE is HOST TARGET binding site found in the 3' untranslated region of mRNA encoded by KIAA1165, corresponding to a HOST TARGET binding site such as BINDING SITE I, BINDING SITE II or BINDING SITE III. Table 2 illustrates the complementarity of the nucleotide sequences of KIAA1165 BINDING SITE, designated SEQ ID:33474, to the nucleotide sequence of VGAM463 RNA, herein designated VGAM RNA, also designated SEQ ID:3174.

Another function of VGAM463 is therefore inhibition of KIAA1165 (Accession XM_041162). Accordingly, utilities of VGAM463 include diagnosis, prevention and treatment of diseases and clinical conditions associated with KIAA1165. Purinergic Receptor P2X, Ligand-gated Ion Channel, 5 (P2RX5, Accession NM_002561) is another VGAM463 host target gene. P2RX5 BINDING SITE is HOST TARGET binding site found in the 3' untranslated region of mRNA encoded by P2RX5, corresponding to a HOST TARGET binding site such as BINDING SITE I, BINDING SITE II or BINDING SITE III. Table 2 illustrates the complementarity of the nucleotide sequences of P2RX5 BINDING SITE, designated SEQ ID:8408, to the nucleotide sequence of VGAM463 RNA, herein designated VGAM RNA, also designated SEQ ID:3174.

Another function of VGAM463 is therefore inhibition of Purinergic Receptor P2X, Ligand-gated Ion Channel, 5 (P2RX5, Accession NM_002561). Accordingly, utilities of VGAM463 include diagnosis, prevention and treatment of diseases and clinical conditions associated with P2RX5. FIG. 1 further provides a conceptual description of a novel bioinformatically detected viral gene of the present invention, referred to here as Viral Genomic Address Messenger 464 (VGAM464) viral gene, which modulates expression of respective host target genes thereof, the function and utility of which host target genes is known in the art.

VGAM464 is a novel bioinformatically detected regulatory, non protein coding, viral micro RNA (miRNA) gene. The method by which VGAM464 was detected is described hereinabove with reference to FIGS. 1-8.

VGAM464 gene, herein designated VGAM GENE, is a viral gene contained in the genome of Variola Virus. VGAM464 host target gene, herein designated VGAM HOST TARGET GENE, is a human gene contained in the human genome.

VGAM464 gene encodes a VGAM464 precursor RNA, herein designated VGAM PRECURSOR RNA. Similar to other miRNA genes, and unlike most ordinary genes, VGAM464 precursor RNA does not encode a protein. A nucleotide sequence identical or highly similar to the nucleotide sequence of VGAM464 precursor RNA is designated SEQ ID:450, and is provided hereinbelow with reference to the sequence listing part. Nucleotide sequence SEQ ID:450 is located at position 170440 relative to the genome of Variola Virus.

VGAM464 precursor RNA folds onto itself, forming VGAM464 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM464 folded precursor RNA into VGAM464 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM464 RNA is designated SEQ ID:3175, and is provided hereinbelow with reference to the sequence listing part.

VGAM464 host target gene, herein designated VGAM HOST TARGET GENE, encodes a corresponding messenger RNA, VGAM464 host target RNA, herein designated VGAM HOST TARGET RNA. VGAM464 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM464 RNA, herein designated VGAM RNA, binds complementarily to one or more host target binding sites located in untranslated regions of VGAM464 host target RNA, herein designated VGAM HOST TARGET RNA. This complementary binding is due to the fact that the nucleotide sequence of VGAM464 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM464 RNA, herein designated VGAM RNA, may have a different number of host target binding sites in untranslated regions of a VGAM464 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM464 RNA, herein designated VGAM RNA, to host target binding sites on VGAM464 host target RNA, herein designated VGAM HOST TARGET RNA, such as BINDING SITE I, BINDING SITE II and BINDING SITE III, inhibits translation of VGAM464 host target RNA into VGAM464 host target protein, herein designated VGAM HOST TARGET PROTEIN. VGAM host target protein is therefore outlined by a broken line.

It is appreciated that VGAM464 host target gene, herein designated VGAM HOST TARGET GENE, in fact represents a plurality of VGAM464 host target genes. The mRNA of each one of this plurality of VGAM464 host target genes comprises one or more host target binding sites, each having a nucleotide sequence which is at least partly complementary to VGAM464 RNA, herein designated VGAM RNA, and which when bound by VGAM464 RNA causes inhibition of translation of respective one or more VGAM464 host target proteins.

It is further appreciated by one skilled in the art that the mode of translational inhibition illustrated by FIG. 1 with specific reference to translational inhibition exerted by VGAM464 gene, herein designated VGAM GENE, on one or more VGAM464 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM464 is inhibition of expression of host target genes, as part of a novel viral mechanism of attacking a host. Accordingly, utilities of VGAM464 include diagnosis, prevention and treatment of viral infection by Variola Virus. Specific functions, and accordingly utilities, of VGAM464 correlate with, and may be deduced from, the identity of the host target genes which VGAM464 binds and inhibits, and the function of these host target genes, as elaborated hereinbelow.

Nucleotide sequences of the VGAM464 precursor RNA, herein designated VGAM PRECURSOR RNA, and of the 'diced' VGAM464 RNA, herein designated VGAM RNA, and a schematic representation of the secondary folding of VGAM464 folded precursor RNA, herein designated VGAM FOLDED PRECURSOR RNA, of VGAM464 are further described hereinbelow with reference to Table 1.

Nucleotide sequences of host target binding sites, such as BINDING SITE-I, BINDING SITE-II and BINDING SITE-III of FIG. 1, found on VGAM464 host target RNA, and schematic representation of the complementarity of each of these host target binding sites to VGAM464 RNA, herein designated VGAM RNA, are described hereinbelow with reference to Table 2.

As mentioned hereinabove with reference to FIG. 1, a function of VGAM464 gene, herein designated VGAM is inhibition of expression of VGAM464 target genes. It is appreciated that specific functions, and accordingly utilities, of VGAM464 correlate with, and may be deduced from, the identity of the target genes which VGAM464 binds and inhibits, and the function of these target genes, as elaborated hereinbelow.

Collagen, Type IV, Alpha 4 (COL4A4, Accession NM_000092) is a VGAM464 host target gene. COL4A4 BINDING SITE is HOST TARGET binding site found in the 3' untranslated region of mRNA encoded by COL4A4, corresponding to a HOST TARGET binding site such as BINDING SITE I, BINDING SITE II or BINDING SITE III. Table 2 illustrates the complementarity of the nucleotide sequences of COL4A4 BINDING SITE, designated SEQ ID:5555, to the nucleotide sequence of VGAM464 RNA, herein designated VGAM RNA, also designated SEQ ID:3175.

A function of VGAM464 is therefore inhibition of Collagen, Type IV, Alpha 4 (COL4A4, Accession NM_000092). Accordingly, utilities of VGAM464 include diagnosis, prevention and treatment of diseases and clinical conditions associated with COL4A4. Cytochrome P450, 51 (lanosterol 14-alpha-demethylase) (CYP51, Accession NM_000786) is another VGAM464 host target gene. CYP51 BINDING SITE is HOST TARGET binding site found in the 3' untranslated region of mRNA encoded by CYP51, corresponding to a HOST TARGET binding site such as BINDING SITE I, BINDING SITE II or BINDING SITE III. Table 2 illustrates the complementarity of the nucleotide sequences of CYP51 BINDING SITE, designated SEQ ID:6438, to the nucleotide sequence of VGAM464 RNA, herein designated VGAM RNA, also designated SEQ ID:3175.

Another function of VGAM464 is therefore inhibition of Cytochrome P450, 51 (lanosterol 14-alpha-demethylase) (CYP51, Accession NM_000786). Accordingly, utilities of VGAM464 include diagnosis, prevention and treatment of diseases and clinical conditions associated with CYP51. Development and Differentiation Enhancing Factor 2 (DDEF2, Accession NM_003887) is another VGAM464 host target gene. DDEF2 BINDING SITE is HOST TARGET binding site found in the 3' untranslated region of mRNA encoded by DDEF2, corresponding to a HOST TARGET binding site such as BINDING SITE I, BINDING SITE II or BINDING SITE III. Table 2 illustrates the complementarity of the nucleotide sequences of DDEF2 BINDING SITE, designated SEQ ID:9968, to the nucleotide sequence of VGAM464 RNA, herein designated VGAM RNA, also designated SEQ ID:3175.

Another function of VGAM464 is therefore inhibition of Development and Differentiation Enhancing Factor 2 (DDEF2, Accession NM_003887), a gene which interacts with members of the Arf and Src family. Accordingly, utilities of VGAM464 include diagnosis, prevention and treatment of diseases and clinical conditions associated with DDEF2. The function of DDEF2 has been established by previous studies. By screening human brain cDNAs for those encoding large proteins, Ishikawa et al. (1997) identified a cDNA, which they called KIAA0400, encoding development- and differentiation-enhancing factor-2. They found that the deduced 1,006-amino acid DDEF2 protein contains a 60-amino acid zinc finger motif thought to be associated with GTPase activating protein (GAP) activity. Using PYK2 (OMIM Ref. No. 601212) as bait in a yeast 2-hybrid screen, Andreev et al. (1999) isolated DDEF2, a PYK2-binding protein which they designated PAP. DDEF2 is a multidomain protein composed of an N-terminal alpha-helical region with a coiled-coil motif, followed by a pleckstrin homology domain, an Arf-GAP domain, an ankyrin homology region, a proline-rich region, and a C-terminal SH3 domain. DDEF2 shares 95% sequence identity with the mouse homolog and 68% sequence identity with human DDEF1 (OMIM Ref. No. 605953). Andreev et al. (1999) identified 2 DDEF2 isoforms, designated PAP-alpha and PAP-beta, that differ by deletion of 45 amino acids from the proline-rich region and 172 amino acids from the N terminus. Northern blot analysis detected expression of an approximately 5.7-kb transcript at high levels in brain, kidney, and heart, and at lower levels in placenta, lung, and pancreas. Immunofluorescence studies demonstrated that DDEF2 is localized in the Golgi apparatus and at the plasma membrane, where it is colocalized with PYK2. DDEF2 forms a stable complex with PYK2 and activation of PYK2 leads to tyrosine phosphorylation of DDEF2 in vivo. The interaction of DDEF2 and PYK2 appears to be mediated by binding of the SH3 domain of DDEF2 to the proline-rich region in the C terminus of PYK2. In addition, in vitro recombinant DDEF2 exhibits strong GAP activity towards the small GTPases ARF1 (OMIM Ref. No. 103180) and ARF5 (OMIM Ref. No. 103188) and weak activity towards ARF6 (OMIM Ref. No. 600464).

Full details of the abovementioned studies are described in the following publications, the disclosure of which are hereby incorporated by reference:

Andreev, J.; Simon, J.-P.; Sabatini, D. D.; Kam, J.; Plowman, G.; Randazzo, P. A.; Schlessinger, J.: Identification of a new Pyk2 target protein with Arf-GAP activity. Molec. Cell. Biol. 19:2338-2350, 1999; and Ishikawa, K.; Nagase, T.; Nakajima, D.; Seki, N.; Ohira, M.; Miyajima, N.; Tanaka, A.; Kotani, H.; Nomura, N.; Ohara, O.: Prediction of the coding sequences of unidentified human gene.

Further studies establishing the function and utilities of DDEF2 are found in John Hopkins OMIM database record ID 603817, and in sited publications numbered 4912 listed in the bibliography section hereinbelow, which are also hereby incorporated by reference. Huntingtin Interacting Protein 2 (HIP2, Accession NM_005339) is another VGAM464 host target gene. HIP2 BINDING SITE is HOST TARGET binding site found in the 3' untranslated region of mRNA encoded by HIP2, corresponding to a HOST TARGET binding site such as BINDING SITE I, BINDING SITE II or BINDING SITE III. Table 2 illustrates the complementarity of the nucleotide sequences of HIP2 BINDING SITE, designated SEQ ID:11815, to the nucleotide sequence of VGAM464 RNA, herein designated VGAM RNA, also designated SEQ ID:3175.

Another function of VGAM464 is therefore inhibition of Huntingtin Interacting Protein 2 (HIP2, Accession NM_005339). Accordingly, utilities of VGAM464 include diagnosis, prevention and treatment of diseases and clinical conditions associated with HIP2. ISL1 Transcription Factor, LIM/homeodomain, (islet-1) (ISL1, Accession NM_002202) is another VGAM464 host target gene. ISL1 BINDING SITE is HOST TARGET binding site found in the 3' untranslated region of mRNA encoded by ISL1, corresponding to a HOST TARGET binding site such as BINDING SITE I, BINDING SITE II or BINDING SITE III. Table 2 illustrates the complementarity of the nucleotide sequences of ISL1 BINDING SITE, designated SEQ ID:7960, to the nucleotide sequence of VGAM464 RNA, herein designated VGAM RNA, also designated SEQ ID:3175.

Another function of VGAM464 is therefore inhibition of ISL1 Transcription Factor, LIM/homeodomain, (islet-1) (ISL1, Accession NM_002202), a gene which binds to one of the cis-acting domain of the insulin gene enhancer. Accordingly, utilities of VGAM464 include diagnosis, prevention and treatment of diseases and clinical conditions associated with ISL1. The function of ISL1 has been established by previous studies. Because insulin deficiency, either relative or absolute, is a cardinal feature of noninsulin-dependent diabetes mellitus (NIDDM; 125853), Tanizawa et al. (1994) investigated the possible involvement of mutations in genes that regulate insulin production. Rat Isl1 was the first insulin enhancer-binding protein to be isolated; Tanizawa et al. (1994) used the rat gene to isolate a partial human ISL1 cDNA and subsequently to isolate genomic clones. A simple sequence repeat was found in the ISL1 gene. PCR amplification of this region of genomic DNA revealed 12 alleles in St. Louis African-Americans (heterozygosity=0.87), 14 alleles in black Nigerians (heterozygosity=0.89), 8 alleles in Japanese (heterozygosity=0.69), and 8 alleles in Caucasians (heterozygosity=0.81). Allelic frequencies in the gene did not differ between patients with NIDDM and nondiabetic control subjects in 2 black populations Shimomura et al. (2000) found a nonsense mutation (Q310X) in the ISL1 gene in a Japanese patient with type II diabetes and a strong family history. The mutation led to decreased activity of the islet-1 transcription factor and thus may have been pathogenic. However, as indicated by Fajans et al. (2001), additional genetic and clinical studies were required to determine whether mutations in ISL1 are the cause of another subtype of MODY Full details of the abovementioned studies are described in the following publications, the disclosure of which are hereby incorporated by reference:

Shimomura, H.; Sanke, T.; Hanabusa, T.; Tsunoda, K.; Furuta, H.; Nanjo, K.: Nonsense mutation of islet-1 gene (Q310X) found in a type 2 diabetic patient with a strong family history. Diabetes 49:1597-1600, 2000; and Tanizawa, Y.; Riggs, A. C.; Dagogo-Jack, S.; Vaxillaire, M.; Froguel, P.; Liu, L.; Donis-Keller, H.; Permutt, M. A.: Isolation of the human LIM/homeodomain gene islet-1 and identificat.

Further studies establishing the function and utilities of ISL1 are found in John Hopkins OMIM database record ID 600366, and in sited publications numbered 12032 listed in the bibliography section hereinbelow, which are also hereby incorporated by reference. O-linked N-acetylglucosamine (GlcNAc) Transferase (UDP-N-acetylglucosamine:polypeptide-N-acetylglucosaminyl transferase) (OGT, Accession NM_003605) is another VGAM464 host target gene. OGT BINDING SITE is HOST TARGET binding site found in the 3' untranslated region of mRNA encoded by OGT, corresponding to a HOST TARGET binding site such as BINDING SITE I, BINDING SITE II or BINDING SITE III. Table 2 illustrates the complementarity of the nucleotide sequences of OGT BINDING SITE, designated SEQ ID:9661, to the nucleotide sequence of VGAM464 RNA, herein designated VGAM RNA, also designated SEQ ID:3175.

Another function of VGAM464 is therefore inhibition of O-linked N-acetylglucosamine (GlcNAc) Transferase (UDP-N-acetylglucosamine:polypeptide-N-acetylglucosaminyl transferase) (OGT, Accession NM_003605), a gene which has a role in the glycosylation of nuclear and cytoplasmic proteins. Accordingly, utilities of VGAM464 include diagnosis, prevention and treatment of diseases and clinical conditions associated with OGT. The function of OGT has been established by previous studies. O-linked N-acetylglucosamine (O-GlcNAc) transferase (OGT) catalyzes the addition of a single N-acetylglucosamine in O-glycosidic linkage to serine or threonine residues. Since both phosphorylation and glycosylation compete for similar serine or threonine residues, the 2 processes may compete for sites, or they may alter the substrate specificity of nearby sites by steric or electrostatic effects (Lubas et al., 1997). Haltiwanger et al. (1992) purified rat liver OGT and determined that it has a molecular mass of 340 kD. They proposed that OGT exists as a heterotrimeric complex with 2 subunits of 110 kD and 1 of 78 kD. However, using rabbit OGT, Lubas et al. (1997) analyzed the proteolytic fingerprint of both polypeptides and found that the 2 are related. They suggested that the 78 kD band is a proteolytic product of the 110 kD polypeptide or the product of an alternative translation start site. Kreppel et al. (1997) cloned rat cDNAs encoding the 110-kD subunit. Immunofluorescence of human cells expressing rat OGT indicated that OGT is present in both the nucleus and cytosol.

Full details of the abovementioned studies are described in the following publications, the disclosure of which are hereby incorporated by reference:

Kreppel, L. K.; Blomberg, M. A.; Hart, G. W.: Dynamic glycosylation of nuclear and cytosolic proteins: cloning and characterization of a unique O-GlcNAc transferase with multiple tetratricopeptide repeats. J. Biol. Chem. 272:9308-9315, 1997; and Lubas, W. A.; Frank, D. W.; Krause, M.; Hanover, J. A.: O-linked GlcNAc transferase is a conserved nucleocytoplasmic protein containing tetratricopeptide repeats. J. Biol. Chem. 272:9.

Further studies establishing the function and utilities of OGT are found in John Hopkins OMIM database record ID 300255, and in sited publications numbered 9074-9078 listed in the bibliography section hereinbelow, which are also hereby incorporated by reference. Platelet-activating Factor Acetylhydrolase, Isoform Ib, Alpha Subunit 45 kDa (PAFAH1B1, Accession NM_000430) is another VGAM464 host target gene. PAFAH1B1 BINDING SITE is HOST TARGET binding site found in the 3' untranslated region of mRNA encoded by PAFAH1B1, corresponding to a HOST TARGET binding site such as BINDING SITE I, BINDING SITE II or BINDING SITE III. Table 2 illustrates the complementarity of the nucleotide sequences of PAFAH1B1 BINDING SITE, designated SEQ ID:6012, to the nucleotide sequence of VGAM464 RNA, herein designated VGAM RNA, also designated SEQ ID:3175.

Another function of VGAM464 is therefore inhibition of Platelet-activating Factor Acetylhydrolase, Isoform Ib, Alpha Subunit 45 kDa (PAFAH1B1, Accession NM_000430). Accordingly, utilities of VGAM464 include diagnosis, prevention and treatment of diseases and clinical conditions associated with PAFAH1B1. Plastin 1 (I isoform) (PLS1, Accession NM_002670) is another VGAM464 host target gene. PLS1 BINDING SITE is HOST TARGET binding site found in the 3' untranslated region of mRNA encoded by PLS1, corresponding to a HOST TARGET binding site such as BINDING SITE I, BINDING SITE II or BINDING SITE III. Table 2 illustrates the complementarity of the nucleotide sequences of PLS1 BINDING SITE, designated SEQ ID:8541, to the nucleotide sequence of VGAM464 RNA, herein designated VGAM RNA, also designated SEQ ID:3175.

Another function of VGAM464 is therefore inhibition of Plastin 1 (I isoform) (PLS1, Accession NM_002670). Accordingly, utilities of VGAM464 include diagnosis, prevention and treatment of diseases and clinical conditions associated with PLS1. RAS P21 Protein Activator (GTPase activating protein) 1 (RASA1, Accession NM_022650) is another VGAM464 host target gene. RASA1 BINDING SITE is HOST TARGET binding site found in the 3' untranslated region of mRNA encoded by RASA1, corresponding to a HOST TARGET binding site such as BINDING SITE I, BINDING SITE II or BINDING SITE III. Table 2 illustrates the complementarity of the nucleotide sequences of RASA1 BINDING SITE, designated SEQ ID:22904, to the nucleotide sequence of VGAM464 RNA, herein designated VGAM RNA, also designated SEQ ID:3175.

Another function of VGAM464 is therefore inhibition of RAS P21 Protein Activator (GTPase activating protein) 1 (RASA1, Accession NM_022650), a gene which is involved in the control of cellular proliferation and differentiation. Accordingly, utilities of VGAM464 include diagnosis, prevention and treatment of diseases and clinical conditions associated with RASA1. The function of RASA1 has been established by previous studies. The RAS gene family encodes membrane-associated, guanine nucleotide-binding proteins (p21) that are involved in the control of cellular proliferation and differentiation. Similar to other guanine-binding proteins (such as the heterotrimeric G proteins), the RAS proteins cycle between an active guanosine-triphosphate (GTP) bound form and an inactive, guanosine-diphosphate (GDP) bound form. The weak intrinsic GTPase activity of RAS proteins is greatly enhanced by the action of GTPase-activating proteins (GAPs). GAP is an effector of RAS oncogene action. See also RASA2 (OMIM Ref. No. 601589). Trahey et al. (1988) purified guanosine triphosphatase-activating protein from placenta and obtained internal amino acid sequence of the protein from which they cloned 2 classes of cDNA. One class predicted a protein with molecular weight similar to purified GAP and corresponded to the human equivalent of bovine GAP cDNA. The other predicted a smaller protein with a different N-terminal sequence, presumably the result of differential splicing. Both types of cDNAs produced protein with GAP activity. Point mutations in RAS genes ('activating' or oncogenic mutants) decrease the intrinsic GTPase activity of RAS and are insensitive to stimulation by GAPs. This suggested to Friedman et al. (1993) that at least some of the transforming activity of mutant RAS is conferred by the RAS protein being constitutively activated in its GTP-bound state. Mutations in RAS that render it insensitive to GAP regulation result in tumor formation. Mutations in GAP that ablate its ability to downregulate RAS might result in a similar phenotype. To test this hypothesis, Friedman et al. (1993) analyzed 188 human tumor samples for mutations within the catalytic domain of the GAP gene and for mutations within its C-terminal SH2 region. Although no mutations could be demonstrated in the catalytic domain, 3 different nonsense mutations were observed in basal cell carcinomas. The region in which the mutations were clustered is A/T rich, raising the possibility that UV radiation is a contributing factor. The 3 mutations were found in the first 5 tumors examined. No abnormality was found in 16 other basal cell carcinomas. Thus, the apparent prevalence of GAP mutation was about 14% (3 of 21). The tumors analyzed included a great variety, including cancers of thyroid, lung, breast, colon, and pancreas. No GAP mutation was found in any of these. Mitsudomi et al. (1994) could not demonstrate mutations in the catalytic domain of the GAP gene in human lung cancer cell lines.

Full details of the abovementioned studies are described in the following publications, the disclosure of which are hereby incorporated by reference:

Friedman, E.; Gejman, P. V.; Martin, G. A.; McCormick, F.: Nonsense mutations in the C-terminal SH2 region of the GTPase activating protein (GAP) gene in human tumours. Nature Genet. 5:242-247, 1993; and Trahey, M.; Wong, G.; Halenbeck, R.; Rubinfeld, B.; Martin, G. A.; Ladner, M.; Long, C. M.; Crosier, W. J.; Watt, K.; Koths, K.; McCormick, F.: Molecular cloning of two types of GAP c.

Further studies establishing the function and utilities of RASA1 are found in John Hopkins OMIM database record ID 139150, and in sited publications numbered 4738-4743 listed in the bibliography section hereinbelow, which are also hereby incorporated by reference. Serine (or cysteine) Proteinase Inhibitor, Clade B (ovalbumin), Member 9 (SERPINB9, Accession NM_004155) is another VGAM464 host target gene. SERPINB9 BINDING SITE is HOST TARGET binding site found in the 3' untranslated region of mRNA encoded by SERPINB9, corresponding to a HOST TARGET binding site such as BINDING SITE I, BINDING SITE II or BINDING SITE III. Table 2 illustrates the complementarity of the nucleotide sequences of SERPINB9 BINDING SITE, designated SEQ ID:10367, to the nucleotide sequence of VGAM464 RNA, herein designated VGAM RNA, also designated SEQ ID:3175.

Another function of VGAM464 is therefore inhibition of Serine (or cysteine) Proteinase Inhibitor, Clade B (ovalbumin), Member 9 (SERPINB9, Accession NM_004155), a gene which may be a serpin serine protease inhibitor that interacts with granzyme B (GZMB). Accordingly, utilities of VGAM464 include diagnosis, prevention and treatment of diseases and clinical conditions associated with SERPINB9. The function of SERPINB9 and its association with various diseases and clinical conditions, has been established by previous studies, as described hereinabove with reference to VGAM60. Soc-2 Suppressor of Clear Homolog (C. elegans) (SHOC2, Accession NM_007373) is another VGAM464 host target gene. SHOC2 BINDING SITE is HOST TARGET binding site found in the 3' untranslated region of mRNA encoded by SHOC2, corresponding to a HOST TARGET binding site such as BINDING SITE I, BINDING SITE II or BINDING SITE III. Table 2 illustrates the complementarity of the nucleotide sequences of SHOC2 BINDING SITE, designated SEQ ID:14307, to the nucleotide sequence of VGAM464 RNA, herein designated VGAM RNA, also designated SEQ ID:3175.

Another function of VGAM464 is therefore inhibition of Soc-2 Suppressor of Clear Homolog (C. elegans) (SHOC2, Accession NM_007373), a gene which may be a regulator of the let-60 ras pathway. Accordingly, utilities of VGAM464 include diagnosis, prevention and treatment of diseases and clinical conditions associated with SHOC2. The function of SHOC2 has been established by previous studies. Activation of fibroblast growth factor (FGF) receptors elicits diverse cellular responses, including growth, mitogenesis, migration, and differentiation. Selfors et al. (1998) shed light on the intracellular signaling pathways that mediate these processes by studies in Caenorhabditis elegans. In this organism, they screened for genes that suppress the activity of an activated form of the EGL-15 FGF receptor consistent with the functioning of these genes downstream of EGL-15. Two of these genes were soc1 and soc2, symbolized thus for 'suppressor of clear (Clr)' phenotype; the third was sem5. Selfors et al. (1998) showed that soc2 encodes a protein composed almost entirely of leucine-rich repeats, a domain implicated in protein-protein interactions. They identified a putative human homolog, SHOC2, which is 54% identical to soc2. They showed that SHOC2 mRNA was expressed in all tissues assayed and that the SHOC2 protein is localized to the cytoplasm. Within the leucine-rich repeats of both soc2 and SHOC2 are 2 YXNX motifs that are potential tyrosine-phosphorylated docking sites for the SEM5/GRB2 Src homology 2 domain. However, phosphorylation of these residues was not required for soc2 function in vivo, and SHOC2 was not observed to be tyrosine phosphorylated in response to FGF stimulation. Selfors et al. (1998) concluded that this genetic system identified a conserved gene implicated in mediating FGF receptor signaling in C. elegans. Sieburth et al. (1998) identified and characterized the sur8 gene in C. elegans, which positively regulates Ras-mediated signal transduction during vulval development. The authors found that reduction of sur8 function suppresses an activated Ras mutation and dramatically enhances phenotypes of mpk-1 MAP kinase and ksr-1 (OMIM Ref. No. 601132) mutations, whereas increase of sur8 dosage enhances an activated Ras mutation. Sur8 appears to act downstream of or in parallel to Ras but upstream of Raf. Sur8 encodes a conserved protein that is composed predominantly of leucine-rich repeats. The sur8 protein interacts directly with Ras but not with the Ras (P34G) mutant protein, suggesting that sur8 may mediate its effects through Ras binding. By use of EST primers and 5-prime RACE, Sieburth et al. (1998) cloned a structural and functional SUR8 homolog in human S that specifically binds K-Ras (OMIM Ref. No. 190070) and N-Ras (OMIM Ref. No. 164790) but not H-Ras (OMIM Ref. No. 190020) in vitro.

Full details of the abovementioned studies are described in the following publications, the disclosure of which are hereby incorporated by reference:

Selfors, L. M.; Schutzman, J. L.; Borland, C. Z.; Stern, M. J.: Soc-2 encodes a leucine-rich repeat protein implicated in fibroblast growth factor receptor signaling. Proc. Nat. Acad. Sci. 95:6903-6908, 1998; and Sieburth, D. S.; Sun, Q.; Han, M.: SUR-8, a conserved Ras-binding protein with leucine-rich repeats, positively regulates Ras-mediated signaling in C. elegans. Cell 94:119-130, 1998.

Further studies establishing the function and utilities of SHOC2 are found in John Hopkins OMIM database record ID 602775, and in sited publications numbered 7648-7649 listed in the bibliography section hereinbelow, which are also hereby incorporated by reference. FLJ10895 (Accession NM_019084) is another VGAM464 host target gene. FLJ10895 BINDING SITE is HOST TARGET binding site found in the 3' untranslated region of mRNA encoded by FLJ10895, corresponding to a HOST TARGET binding site such as BINDING SITE I, BINDING SITE II or BINDING SITE III. Table 2 illustrates the complementarity of the nucleotide sequences of FLJ10895 BINDING SITE, designated SEQ ID:21160, to the nucleotide sequence of VGAM464 RNA, herein designated VGAM RNA, also designated SEQ ID:3175.

Another function of VGAM464 is therefore inhibition of FLJ10895 (Accession NM_019084). Accordingly, utilities of VGAM464 include diagnosis, prevention and treatment of diseases and clinical conditions associated with FLJ10895. FLJ20038 (Accession NM_017634) is another VGAM464 host target gene. FLJ20038 BINDING SITE is HOST TARGET binding site found in the 3' untranslated region of mRNA encoded by FLJ20038, corresponding to a HOST TARGET binding site such as BINDING SITE I, BINDING SITE II or BINDING SITE III. Table 2 illustrates the complementarity of the nucleotide sequences of FLJ20038 BINDING SITE, designated SEQ ID:19142, to the nucleotide sequence of VGAM464 RNA, herein designated VGAM RNA, also designated SEQ ID:3175.

Another function of VGAM464 is therefore inhibition of FLJ20038 (Accession NM_017634). Accordingly, utilities of VGAM464 include diagnosis, prevention and treatment of diseases and clinical conditions associated with FLJ20038.

FLJ23560 (Accession NM_024685) is another VGAM464 host target gene. FLJ23560 BINDING SITE is HOST TARGET binding site found in the 3' untranslated region of mRNA encoded by FLJ23560, corresponding to a HOST TARGET binding site such as BINDING SITE I, BINDING SITE II or BINDING SITE III. Table 2 illustrates the complementarity of the nucleotide sequences of FLJ23560 BINDING SITE, designated SEQ ID:23997, to the nucleotide sequence of VGAM464 RNA, herein designated VGAM RNA, also designated SEQ ID:3175.

Another function of VGAM464 is therefore inhibition of FLJ23560 (Accession NM_024685). Accordingly, utilities of VGAM464 include diagnosis, prevention and treatment of diseases and clinical conditions associated with FLJ23560.

GFR (Accession NM_012294) is another VGAM464 host target gene. GFR BINDING SITE is HOST TARGET binding site found in the 3" untranslated region of mRNA encoded by GFR, corresponding to a HOST TARGET binding site such as BINDING SITE I, BINDING SITE II or BINDING SITE III. Table 2 illustrates the complementarity of the nucleotide sequences of GFR BINDING SITE, designated SEQ ID:14641, to the nucleotide sequence of VGAM464 RNA, herein designated VGAM RNA, also designated SEQ ID:3175.

Another function of VGAM464 is therefore inhibition of GFR (Accession NM_012294). Accordingly, utilities of VGAM464 include diagnosis, prevention and treatment of diseases and clinical conditions associated with GFR.

KIAA0258 (Accession NM_014785) is another VGAM464 host target gene. KIAA0258 BINDING SITE is HOST TARGET binding site found in the 3" untranslated region of mRNA encoded by KIAA0258, corresponding to a HOST TARGET binding site such as BINDING SITE I, BINDING SITE II or BINDING SITE III. Table 2 illustrates the complementarity of the nucleotide sequences of KIAA0258 BINDING SITE, designated SEQ ID:16645, to the nucleotide sequence of VGAM464 RNA, herein designated VGAM RNA, also designated SEQ ID:3175.

Another function of VGAM464 is therefore inhibition of KIAA0258 (Accession NM_014785). Accordingly, utilities of VGAM464 include diagnosis, prevention and treatment of diseases and clinical conditions associated with KIAA0258.

KIAA0982 (Accession NM_014023) is another VGAM464 host target gene. KIAA0982 BINDING SITE is HOST TARGET binding site found in the 3' untranslated region of mRNA encoded by KIAA0982, corresponding to a HOST TARGET binding site such as BINDING SITE I, BINDING SITE II or BINDING SITE III. Table 2 illustrates the complementarity of the nucleotide sequences of KIAA0982 BINDING SITE, designated SEQ ID:15250, to the nucleotide sequence of VGAM464 RNA, herein designated VGAM RNA, also designated SEQ ID:3175.

Another function of VGAM464 is therefore inhibition of KIAA0982 (Accession NM_014023). Accordingly, utilities of VGAM464 include diagnosis, prevention and treatment of diseases and clinical conditions associated with KIAA0982.

KIAA1077 (Accession XM_053496) is another VGAM464 host target gene. KIAA1077 BINDING SITE is HOST TARGET binding site found in the 3' untranslated region of mRNA encoded by KIAA1077, corresponding to a HOST TARGET binding site such as BINDING SITE I, BINDING SITE II or BINDING SITE III. Table 2 illustrates the complementarity of the nucleotide sequences of KIAA1077 BINDING SITE, designated SEQ ID:36097, to the nucleotide sequence of VGAM464 RNA, herein designated VGAM RNA, also designated SEQ ID:3175.

Another function of VGAM464 is therefore inhibition of KIAA1077 (Accession XM_053496). Accordingly, utilities of VGAM464 include diagnosis, prevention and treatment of diseases and clinical conditions associated with KIAA1077.

KIAA1962 (Accession XM_088567) is another VGAM464 host target gene. KIAA1962 BINDING SITE is HOST TARGET binding site found in the 3' untranslated region of mRNA encoded by KIAA1962, corresponding to a HOST TARGET binding site such as BINDING SITE I, BINDING SITE II or BINDING SITE III. Table 2 illustrates the complementarity of the nucleotide sequences of KIAA1962 BINDING SITE, designated SEQ ID:39834, to the nucleotide sequence of VGAM464 RNA, herein designated VGAM RNA, also designated SEQ ID:3175.

Another function of VGAM464 is therefore inhibition of KIAA1962 (Accession XM_088567). Accordingly, utilities of VGAM464 include diagnosis, prevention and treatment of diseases and clinical conditions associated with KIAA1962.

MGC23980 (Accession NM_145005) is another VGAM464 host target gene. MGC23980 BINDING SITE is HOST TARGET binding site found in the 3' untranslated region of mRNA encoded by MGC23980, corresponding to a HOST TARGET binding site such as BINDING SITE I, BINDING SITE II or BINDING SITE III. Table 2 illustrates the complementarity of the nucleotide sequences of MGC23980 BINDING SITE, designated SEQ ID:29605, to the nucleotide sequence of VGAM464 RNA, herein designated VGAM RNA, also designated SEQ ID:3175.

Another function of VGAM464 is therefore inhibition of MGC23980 (Accession NM_145005). Accordingly, utilities of VGAM464 include diagnosis, prevention and treatment of diseases and clinical conditions associated with MGC23980.

RALGPS1A (Accession NM_014636) is another VGAM464 host target gene. RALGPS1A BINDING SITE is HOST TARGET binding site found in the 3' untranslated region of mRNA encoded by RALGPS1A, corresponding to a HOST TARGET binding site such as BINDING SITE I, BINDING SITE II or BINDING SITE III. Table 2 illustrates the complementarity of the nucleotide sequences of RALGPS1A BINDING SITE, designated SEQ ID:16020, to the nucleotide sequence of VGAM464 RNA, herein designated VGAM RNA, also designated SEQ ID:3175.

Another function of VGAM464 is therefore inhibition of RALGPS1A (Accession NM_014636). Accordingly, utilities of VGAM464 include diagnosis, prevention and treatment of diseases and clinical conditions associated with RALGPS1A.

TSLRP (Accession NM_012472) is another VGAM464 host target gene. TSLRP BINDING SITE is HOST TARGET binding site found in the 5" untranslated region of mRNA encoded by TSLRP, corresponding to a HOST TARGET binding site such as BINDING SITE I, BINDING SITE II or BINDING SITE III. Table 2 illustrates the complementarity of the nucleotide sequences of TSLRP BINDING SITE, designated SEQ ID:14853, to the nucleotide sequence of VGAM464 RNA, herein designated VGAM RNA, also designated SEQ ID:3175.

Another function of VGAM464 is therefore inhibition of TSLRP (Accession NM_012472). Accordingly, utilities of VGAM464 include diagnosis, prevention and treatment of diseases and clinical conditions associated with TSLRP.

Ubiquitin-activating Enzyme E1C (UBA3 homolog, yeast) (UBE1C, Accession NM_003968) is another VGAM464 host target gene. UBE1C BINDING SITE is HOST TARGET binding site found in the 3' untranslated region of mRNA encoded by UBE1C, corresponding to a HOST TARGET binding site such as BINDING SITE I, BINDING SITE II or BINDING SITE III. Table 2 illustrates the complementarity of the nucleotide sequences of UBE1C BINDING SITE, designated SEQ ID:10108, to the nucleotide sequence of VGAM464 RNA, herein designated VGAM RNA, also designated SEQ ID:3175.

Another function of VGAM464 is therefore inhibition of Ubiquitin-activating Enzyme E1C (UBA3 homolog, yeast) (UBE1C, Accession NM_003968). Accordingly, utilities of VGAM464 include diagnosis, prevention and treatment of diseases and clinical conditions associated with UBE1C. LOC144453 (Accession XM_084869) is another VGAM464 host target gene. LOC144453 BINDING SITE is HOST TARGET binding site found in the 3' untranslated region of mRNA encoded by LOC144453, corresponding to a HOST TARGET binding site such as BINDING SITE I, BINDING SITE II or BINDING SITE III. Table 2 illustrates the complementarity of the nucleotide sequences of LOC144453 BINDING SITE, designated SEQ ID:37745, to the nucleotide sequence of VGAM464 RNA, herein designated VGAM RNA, also designated SEQ ID:3175.

Another function of VGAM464 is therefore inhibition of LOC144453 (Accession XM_084869). Accordingly, utilities of VGAM464 include diagnosis, prevention and treatment of diseases and clinical conditions associated with LOC144453. LOC144571 (Accession XM_096630) is another VGAM464 host target gene. LOC144571 BINDING SITE is HOST TARGET binding site found in the 3' untranslated region of mRNA encoded by LOC144571, corresponding to a HOST TARGET binding site such as BINDING SITE I, BINDING SITE II or BINDING SITE III. Table 2 illustrates the complementarity of the nucleotide sequences of LOC144571 BINDING SITE, designated SEQ ID:40442, to the nucleotide sequence of VGAM464 RNA, herein designated VGAM RNA, also designated SEQ ID:3175.

Another function of VGAM464 is therefore inhibition of LOC144571 (Accession XM_096630). Accordingly, utilities of VGAM464 include diagnosis, prevention and treatment of diseases and clinical conditions associated with LOC144571. LOC145547 (Accession XM_085167) is another VGAM464 host target gene. LOC145547 BINDING SITE is HOST TARGET binding site found in the 3' untranslated region of mRNA encoded by LOC145547, corresponding to a HOST TARGET binding site such as BINDING SITE I, BINDING SITE II or BINDING SITE III. Table 2 illustrates the complementarity of the nucleotide sequences of LOC145547 BINDING SITE, designated SEQ ID:37896, to the nucleotide sequence of VGAM464 RNA, herein designated VGAM RNA, also designated SEQ ID:3175.

Another function of VGAM464 is therefore inhibition of LOC145547 (Accession XM_085167). Accordingly, utilities of VGAM464 include diagnosis, prevention and treatment of diseases and clinical conditions associated with LOC145547. LOC145608 (Accession XM_096818) is another VGAM464 host target gene. LOC145608 BINDING SITE is HOST TARGET binding site found in the 5' untranslated region of mRNA encoded by LOC145608, corresponding to a HOST TARGET binding site such as BINDING SITE I, BINDING SITE II or BINDING SITE III. Table 2 illustrates the complementarity of the nucleotide sequences of LOC145608 BINDING SITE, designated SEQ ID:40542, to the nucleotide sequence of VGAM464 RNA, herein designated VGAM RNA, also designated SEQ ID:3175.

Another function of VGAM464 is therefore inhibition of LOC145608 (Accession XM_096818). Accordingly, utilities of VGAM464 include diagnosis, prevention and treatment of diseases and clinical conditions associated with LOC145608. LOC221692 (Accession XM_166420) is another VGAM464 host target gene. LOC221692 BINDING SITE is HOST TARGET binding site found in the 3' untranslated region of mRNA encoded by LOC221692, corresponding to a HOST TARGET binding site such as BINDING SITE I, BINDING SITE II or BINDING SITE III. Table 2 illustrates the complementarity of the nucleotide sequences of LOC221692 BINDING SITE, designated SEQ ID:44296, to the nucleotide sequence of VGAM464 RNA, herein designated VGAM RNA, also designated SEQ ID:3175.

Another function of VGAM464 is therefore inhibition of LOC221692 (Accession XM_166420). Accordingly, utilities of VGAM464 include diagnosis, prevention and treatment of diseases and clinical conditions associated with LOC221692. LOC253443 (Accession XM_171074) is another VGAM464 host target gene. LOC253443 BINDING SITE is HOST TARGET binding site found in the 3' untranslated region of mRNA encoded by LOC253443, corresponding to a HOST TARGET binding site such as BINDING SITE I, BINDING SITE II or BINDING SITE III. Table 2 illustrates the complementarity of the nucleotide sequences of LOC253443 BINDING SITE, designated SEQ ID:45884, to the nucleotide sequence of VGAM464 RNA, herein designated VGAM RNA, also designated SEQ ID:3175.

Another function of VGAM464 is therefore inhibition of LOC253443 (Accession XM_171074). Accordingly, utilities of VGAM464 include diagnosis, prevention and treatment of diseases and clinical conditions associated with LOC253443. FIG. 1 further provides a conceptual description of a novel bioinformatically detected viral gene of the present invention, referred to here as Viral Genomic Address Messenger 465 (VGAM465) viral gene, which modulates expression of respective host target genes thereof, the function and utility of which host target genes is known in the art.

VGAM465 is a novel bioinformatically detected regulatory, non protein coding, viral micro RNA (miRNA) gene. The method by which VGAM465 was detected is described hereinabove with reference to FIGS. 1-8.

VGAM465 gene, herein designated VGAM GENE, is a viral gene contained in the genome of Variola Virus. VGAM465 host target gene, herein designated VGAM HOST TARGET GENE, is a human gene contained in the human genome.

VGAM465 gene encodes a VGAM465 precursor RNA, herein designated VGAM PRECURSOR RNA. Similar to other miRNA genes, and unlike most ordinary genes, VGAM465 precursor RNA does not encode a protein. A nucleotide sequence identical or highly similar to the nucleotide sequence of VGAM465 precursor RNA is designated SEQ ID:451, and is provided hereinbelow with reference to the sequence listing part. Nucleotide sequence SEQ ID:451 is located at position 183993 relative to the genome of Variola Virus.

VGAM465 precursor RNA folds onto itself, forming VGAM465 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM465 folded precursor RNA into VGAM465 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM465 RNA is designated SEQ ID:3176, and is provided hereinbelow with reference to the sequence listing part.

VGAM465 host target gene, herein designated VGAM HOST TARGET GENE, encodes a corresponding messenger RNA, VGAM465 host target RNA, herein designated VGAM HOST TARGET RNA. VGAM465 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM465 RNA, herein designated VGAM RNA, binds complementarily to one or more host target binding sites located in untranslated regions of VGAM465 host target RNA, herein designated VGAM HOST TARGET RNA. This complementary binding is due to the fact that the nucleotide sequence of VGAM465 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM465 RNA, herein designated VGAM RNA, may have a different number of host target binding sites in untranslated regions of a VGAM465 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM465 RNA, herein designated VGAM RNA, to host target binding sites on VGAM465 host target RNA, herein designated VGAM HOST TARGET RNA, such as BINDING SITE I, BINDING SITE II and BINDING SITE III, inhibits translation of VGAM465 host target RNA into VGAM465 host target protein, herein designated VGAM HOST TARGET PROTEIN. VGAM host target protein is therefore outlined by a broken line.

It is appreciated that VGAM465 host target gene, herein designated VGAM HOST TARGET GENE, in fact represents a plurality of VGAM465 host target genes. The mRNA of each one of this plurality of VGAM465 host target genes comprises one or more host target binding sites, each having a nucleotide sequence which is at least partly complementary to VGAM465 RNA, herein designated VGAM RNA, and which when bound by VGAM465 RNA causes inhibition of translation of respective one or more VGAM465 host target proteins.

It is further appreciated by one skilled in the art that the mode of translational inhibition illustrated by FIG. 1 with specific reference to translational inhibition exerted by VGAM465 gene, herein designated VGAM GENE, on one or more VGAM465 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM465 is inhibition of expression of host target genes, as part of a novel viral mechanism of attacking a host. Accordingly, utilities of VGAM465 include diagnosis, prevention and treatment of viral infection by Variola Virus. Specific functions, and accordingly utilities, of VGAM465 correlate with, and may be deduced from, the identity of the host target genes which VGAM465 binds and inhibits, and the function of these host target genes, as elaborated hereinbelow.

Nucleotide sequences of the VGAM465 precursor RNA, herein designated VGAM PRECURSOR RNA, and of the 'diced' VGAM465 RNA, herein designated VGAM RNA, and a schematic representation of the secondary folding of VGAM465 folded precursor RNA, herein designated VGAM FOLDED PRECURSOR RNA, of VGAM465 are further described hereinbelow with reference to Table 1.

Nucleotide sequences of host target binding sites, such as BINDING SITE-I, BINDING SITE-II and BINDING SITE-III of FIG. 1, found on VGAM465 host target RNA, and schematic representation of the complementarity of each of these host target binding sites to VGAM465 RNA, herein designated VGAM RNA, are described hereinbelow with reference to Table 2.

As mentioned hereinabove with reference to FIG. 1, a function of VGAM465 gene, herein designated VGAM is inhibition of expression of VGAM465 target genes. It is appreciated that specific functions, and accordingly utilities, of VGAM465 correlate with, and may be deduced from, the identity of the target genes which VGAM465 binds and inhibits, and the function of these target genes, as elaborated hereinbelow.

GLI-Kruppel Family Member GLI2 (GLI2, Accession NM_030379) is a VGAM465 host target gene. GLI2 BINDING SITE is HOST TARGET binding site found in the 5' untranslated region of mRNA encoded by GLI2, corresponding to a HOST TARGET binding site such as BINDING SITE I, BINDING SITE II or BINDING SITE III. Table 2 illustrates the complementarity of the nucleotide sequences of GLI2 BINDING SITE, designated SEQ ID:24935, to the nucleotide sequence of VGAM465 RNA, herein designated VGAM RNA, also designated SEQ ID:3176.

A function of VGAM465 is therefore inhibition of GLI-Kruppel Family Member GLI2 (GLI2, Accession NM_030379), a gene which may promote tax-dependent transcription of T-cell leukemia virus type 1 genes. Accordingly, utilities of VGAM465 include diagnosis, prevention and treatment of diseases and clinical conditions associated with GLI2. The function of GLI2 has been established by previous studies. The GLI gene (OMIM Ref. No. 165220) was discovered and so-named by reason of its amplification in gliomas of the brain. Sequencing of GLI cDNA clones showed the presence of 5 tandem zinc fingers connected by histidine-cysteine links, which indicated that the gene belongs to the family of zinc finger genes related to Kruppel (Kr). The Drosophila gene Kr is a member of the gap class of segmentation genes; thoracic and anterior abdominal segments fail to form in Kr mutant embryos. This suggested to Ruppert et al. (1988) that other genes of this class might prove important in normal or disease states. Indeed, other genes important in neoplasia, such as NMYC (OMIM Ref. No. 164840), LMYC (OMIM Ref. No. 164850), HER2 (OMIM Ref. No. 164870), and NRAS (OMIM Ref. No. 164790), have been identified partly by their homology to previously identified oncogenes. Therefore, Ruppert et al. (1988) used a GLI cDNA fragment encoding the zinc finger region to isolate related human sequences. Six distinct loci were identified in this manner. Partial sequencing revealed that each open reading frame was capable of encoding fingers with H-C links. Most of these sequences were found to be expressed in several adult tissues. Using DNA from human-rodent hybrid panels in hybridization studies with probes representing each of 6 distinct loci (identified as distinct by patterns of RNA expression and species conservation), Ruppert et al. (1988) demonstrated that the 6 loci are located on 5 different chromosomes: GLI2 was concordant with NMYC on chromosome 2; GLI3 with epidermal growth factor receptor (OMIM Ref. No. 131550) on chromosome 7; HKR1 and HKR2 with APOE (OMIM Ref. No. 107741) on chromosome 19; HKR3 with NRAS on chromosome 1; and HKR4 with MYC (OMIM Ref. No. 190080) on chromosome 8. Animal model experiments lend further support to the function of GLI2. Grachtchouk et al. (2000) showed that transgenic mice overexpressing Gli2 in cutaneous keratinocytes develop multiple basal cell carcinomas (BCCs). These results established Gli2 as a potent oncogene in skin and suggested a pivotal role for this transcription factor in the development of human BCC. Furthermore, they found that overexpression of Gli2 in skin results in the activation of multiple Sonic hedgehog (SHH; 600725) target genes, a feature of human BCCs. They proposed that irrespective of the genetic alteration eliciting uncontrolled SHH signaling in human BCCs, GLI2 has a central role in the genesis of these tumors.

It is appreciated that the abovementioned animal model for GLI2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Grachtchouk, M.; Mo, R.; Yu, S.; Zhang, X.; Sasaki, H.; Hui, C.; Dlugosz, A. A.: Basal cell carcinomas in mice overexpressing Gli2 in skin. (Letter) Nature Genet. 24:216-217, 2000; and Ruppert, J. M.; Kinzler, K. W.; Wong, A. J.; Bigner, S. H.; Kao, F.-T.; Law, M. L.; Seuanez, H. N.; O'Brien, S. J.; Vogelstein, B.: The GLI-Kruppel family of human genes. Molec. Cell.

Further studies establishing the function and utilities of GLI2 are found in John Hopkins OMIM database record ID 165230, and in sited publications numbered 46-4 and 45 listed in the bibliography section hereinbelow, which are also hereby incorporated by reference. Phenylalanine Hydroxylase (PAH, Accession NM_000277) is another VGAM465 host target gene. PAH BINDING SITE is HOST TARGET binding site found in the 5' untranslated region of mRNA encoded by PAH, corresponding to a HOST TARGET binding site such as BINDING SITE I, BINDING SITE II or BINDING SITE III. Table 2 illustrates the complementarity of the nucleotide sequences of PAH BINDING SITE, designated SEQ ID:5824, to the nucleotide sequence of VGAM465 RNA, herein designated VGAM RNA, also designated SEQ ID:3176.

Another function of VGAM465 is therefore inhibition of Phenylalanine Hydroxylase (PAH, Accession NM_000277). Accordingly, utilities of VGAM465 include diagnosis, prevention and treatment of diseases and clinical conditions associated with PAH. XT3 (Accession NM_020208) is another VGAM465 host target gene. XT3 BINDING SITE is HOST TARGET binding site found in the 3' untranslated region of mRNA encoded by XT3, corresponding to a HOST TARGET binding site such as BINDING SITE I, BINDING SITE II or BINDING SITE III. Table 2 illustrates the complementarity of the nucleotide sequences of XT3 BINDING SITE, designated SEQ ID:21444, to the nucleotide sequence of VGAM465 RNA, herein designated VGAM RNA, also designated SEQ ID:3176.

Another function of VGAM465 is therefore inhibition of XT3 (Accession NM_020208), a gene which is a Kidney-specific orphan transporter. Accordingly, utilities of VGAM465 include diagnosis, prevention and treatment of diseases and clinical conditions associated with XT3. The function of XT3 and its association with various diseases and clinical conditions, has been established by previous studies, as described hereinabove with reference to VGAM21. DKFZp762M136 (Accession XM_035635) is another VGAM465 host target gene. DKFZp762M136 BINDING SITE is HOST TARGET binding site found in the 3' untranslated region of mRNA encoded by DKFZp762M136, corresponding to a HOST TARGET binding site such as BINDING SITE I, BINDING SITE II or BINDING SITE III. Table 2 illustrates the complementarity of the nucleotide sequences of DKFZp762M136 BINDING SITE, designated SEQ ID:32302, to the nucleotide sequence of VGAM465 RNA, herein designated VGAM RNA, also designated SEQ ID:3176.

Another function of VGAM465 is therefore inhibition of DKFZp762M136 (Accession XM_035635). Accordingly, utilities of VGAM465 include diagnosis, prevention and treatment of diseases and clinical conditions associated with DKFZp762M136. FLJ20156 (Accession NM_017691) is another VGAM465 host target gene. FLJ20156 BINDING SITE is HOST TARGET binding site found in the 5' untranslated region of mRNA encoded by FLJ20156, corresponding to a HOST TARGET binding site such as BINDING SITE I, BINDING SITE II or BINDING SITE III. Table 2 illustrates the complementarity of the nucleotide sequences of FLJ20156 BINDING SITE, designated SEQ ID:19247, to the nucleotide sequence of VGAM465 RNA, herein designated VGAM RNA, also designated SEQ ID:3176.

Another function of VGAM465 is therefore inhibition of FLJ20156 (Accession NM_017691). Accordingly, utilities of VGAM465 include diagnosis, prevention and treatment of diseases and clinical conditions associated with FLJ20156. FLJ20489 (Accession NM_017842) is another VGAM465 host target gene. FLJ20489 BINDING SITE is HOST TARGET binding site found in the 3' untranslated region of mRNA encoded by FLJ20489, corresponding to a HOST TARGET binding site such as BINDING SITE I, BINDING SITE II or BINDING SITE III. Table 2 illustrates the complementarity of the nucleotide sequences of FLJ20489 BINDING SITE, designated SEQ ID:19505, to the nucleotide sequence of VGAM465 RNA, herein designated VGAM RNA, also designated SEQ ID:3176.

Another function of VGAM465 is therefore inhibition of FLJ20489 (Accession NM_017842). Accordingly, utilities of VGAM465 include diagnosis, prevention and treatment of diseases and clinical conditions associated with FLJ20489. Glutamate Receptor Interacting Protein 1 (GRIP1, Accession XM_047362) is another VGAM465 host target gene. GRIP1 BINDING SITE is HOST TARGET binding site found in the 5' untranslated region of mRNA encoded by GRIP1, corresponding to a HOST TARGET binding site such as BINDING SITE I, BINDING SITE II or BINDING SITE III. Table 2 illustrates the complementarity of the nucleotide sequences of GRIP1 BINDING SITE, designated SEQ ID:34963, to the nucleotide sequence of VGAM465 RNA, herein designated VGAM RNA, also designated SEQ ID:3176.

Another function of VGAM465 is therefore inhibition of Glutamate Receptor Interacting Protein 1 (GRIP1, Accession XM_047362). Accordingly, utilities of VGAM465 include diagnosis, prevention and treatment of diseases and clinical conditions associated with GRIP1. HT002 (Accession NM_014066) is another VGAM465 host target gene. HT002 BINDING SITE is HOST TARGET binding site found in the 3' untranslated region of mRNA encoded by HT002, corresponding to a HOST TARGET binding site such as BINDING SITE I, BINDING SITE II or BINDING SITE III. Table 2 illustrates the complementarity of the nucleotide sequences of HT002 BINDING SITE, designated SEQ ID:15279, to the nucleotide sequence of VGAM465 RNA, herein designated VGAM RNA, also designated SEQ ID:3176.

Another function of VGAM465 is therefore inhibition of HT002 (Accession NM_014066). Accordingly, utilities of VGAM465 include diagnosis, prevention and treatment of diseases and clinical conditions associated with HT002. KIAA0469 (Accession NM_014851) is another VGAM465 host target gene. KIAA0469 BINDING SITE is HOST TARGET binding site found in the 3' untranslated region of mRNA encoded by KIAA0469, corresponding to a HOST TARGET binding site such as BINDING SITE I, BINDING SITE II or BINDING SITE III. Table 2 illustrates the complementarity of the nucleotide sequences of KIAA0469 BINDING SITE, designated SEQ ID:16892, to the nucleotide sequence of VGAM465 RNA, herein designated VGAM RNA, also designated SEQ ID:3176.

Another function of VGAM465 is therefore inhibition of KIAA0469 (Accession NM_014851). Accordingly, utilities of VGAM465 include diagnosis, prevention and treatment of diseases and clinical conditions associated with KIAA0469. KIAA1554 (Accession XM_170834) is another VGAM465 host target gene. KIAA1554 BINDING SITE is HOST TARGET binding site found in the 3' untranslated region of mRNA encoded by KIAA1554, corresponding to a HOST TARGET binding site such as BINDING SITE I, BINDING SITE II or BINDING SITE III. Table 2 illustrates the complementarity of the nucleotide sequences of KIAA1554 BINDING SITE, designated SEQ ID:45615, to the nucleotide sequence of VGAM465 RNA, herein designated VGAM RNA, also designated SEQ ID:3176.

Another function of VGAM465 is therefore inhibition of KIAA1554 (Accession XM_170834). Accordingly, utilities of VGAM465 include diagnosis, prevention and treatment of diseases and clinical conditions associated with KIAA1554. LOC146272 (Accession XM_085396) is another VGAM465 host target gene. LOC146272 BINDING SITE is HOST TARGET binding site found in the 5' untranslated region of mRNA encoded by LOC146272, corresponding to a HOST TARGET binding site such as BINDING SITE I, BINDING SITE II or BINDING SITE III. Table 2 illustrates the complementarity of the nucleotide sequences of LOC146272 BINDING SITE, designated SEQ ID:38119, to the nucleotide sequence of VGAM465 RNA, herein designated VGAM RNA, also designated SEQ ID:3176.

Another function of VGAM465 is therefore inhibition of LOC146272 (Accession XM_085396). Accordingly, utilities of VGAM465 include diagnosis, prevention and treatment of diseases and clinical conditions associated with LOC146272. LOC92078 (Accession XM_042684) is another VGAM465 host target gene. LOC92078 BINDING SITE is HOST TARGET binding site found in the 3' untranslated region of mRNA encoded by LOC92078, corresponding to a HOST TARGET binding site such as BINDING SITE I, BINDING SITE II or BINDING SITE III. Table 2 illustrates the complementarity of the nucleotide sequences of LOC92078 BINDING SITE, designated SEQ ID:33747, to the nucleotide sequence of VGAM465 RNA, herein designated VGAM RNA, also designated SEQ ID:3176.

Another function of VGAM465 is therefore inhibition of LOC92078 (Accession XM_042684). Accordingly, utilities of VGAM465 include diagnosis, prevention and treatment of diseases and clinical conditions associated with LOC92078. FIG. 1 further provides a conceptual description of a novel bioinformatically detected viral gene of the present invention, referred to here as Viral Genomic Address Messenger 466 (VGAM466) viral gene, which modulates expression of respective host target genes thereof, the function and utility of which host target genes is known in the art.

VGAM466 is a novel bioinformatically detected regulatory, non protein coding, viral micro RNA (miRNA) gene. The method by which VGAM466 was detected is described hereinabove with reference to FIGS. 1-8.

VGAM466 gene, herein designated VGAM GENE, is a viral gene contained in the genome of Autographa Californica Nucleopolyhedrovirus. VGAM466 host target gene, herein designated VGAM HOST TARGET GENE, is a human gene contained in the human genome.

VGAM466 gene encodes a VGAM466 precursor RNA, herein designated VGAM PRECURSOR RNA. Similar to other miRNA genes, and unlike most ordinary genes, VGAM466 precursor RNA does not encode a protein. A nucleotide sequence identical or highly similar to the nucleotide sequence of VGAM466 precursor RNA is designated SEQ ID:452, and is provided hereinbelow with reference to the sequence listing part. Nucleotide sequence SEQ ID:452 is located at position 72494 relative to the genome of Autographa Californica Nucleopolyhedrovirus.

VGAM466 precursor RNA folds onto itself, forming VGAM466 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM466 folded precursor RNA into VGAM466 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 89%) nucleotide sequence of VGAM466 RNA is designated SEQ ID:3177, and is provided hereinbelow with reference to the sequence listing part.

VGAM466 host target gene, herein designated VGAM HOST TARGET GENE, encodes a corresponding messenger RNA, VGAM466 host target RNA, herein designated VGAM HOST TARGET RNA. VGAM466 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM466 RNA, herein designated VGAM RNA, binds complementarily to one or more host target binding sites located in untranslated regions of VGAM466 host target RNA, herein designated VGAM HOST TARGET RNA. This complementary binding is due to the fact that the nucleotide sequence of VGAM466 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM466 RNA, herein designated VGAM RNA, may have a different number of host target binding sites in untranslated regions of a VGAM466 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM466 RNA, herein designated VGAM RNA, to host target binding sites on VGAM466 host target RNA, herein designated VGAM HOST TARGET RNA, such as BINDING SITE I, BINDING SITE II and BINDING SITE III, inhibits translation of VGAM466 host target RNA into VGAM466 host target protein, herein designated VGAM HOST TARGET PROTEIN. VGAM host target protein is therefore outlined by a broken line.

It is appreciated that VGAM466 host target gene, herein designated VGAM HOST TARGET GENE, in fact represents a plurality of VGAM466 host target genes. The mRNA of each one of this plurality of VGAM466 host target genes comprises one or more host target binding sites, each having a nucleotide sequence which is at least partly complementary to VGAM466 RNA, herein designated VGAM RNA, and which when bound by VGAM466 RNA causes inhibition of translation of respective one or more VGAM466 host target proteins.

It is further appreciated by one skilled in the art that the mode of translational inhibition illustrated by FIG. 1 with specific reference to translational inhibition exerted by VGAM466 gene, herein designated VGAM GENE, on one or more VGAM466 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM466 is inhibition of expression of host target genes, as part of a novel viral mechanism of attacking a host. Accordingly, utilities of VGAM466 include diagnosis, prevention and treatment of viral infection by Autographa Californica Nucleopolyhedrovirus. Specific functions, and accordingly utilities, of VGAM466 correlate with, and may be deduced from, the identity of the host target genes which VGAM466 binds and inhibits, and the function of these host target genes, as elaborated hereinbelow.

Nucleotide sequences of the VGAM466 precursor RNA, herein designated VGAM PRECURSOR RNA, and of the 'diced' VGAM466 RNA, herein designated VGAM RNA, and a schematic representation of the secondary folding of VGAM466 folded precursor RNA, herein designated VGAM FOLDED PRECURSOR RNA, of VGAM466 are further described hereinbelow with reference to Table 1.

Nucleotide sequences of host target binding sites, such as BINDING SITE-I, BINDING SITE-II and BINDING SITE-III of FIG. 1, found on VGAM466 host target RNA, and schematic representation of the complementarity of each of these host target binding sites to VGAM466 RNA, herein designated VGAM RNA, are described hereinbelow with reference to Table 2.

As mentioned hereinabove with reference to FIG. 1, a function of VGAM466 gene, herein designated VGAM is inhibition of expression of VGAM466 target genes. It is appreciated that specific functions, and accordingly utilities, of VGAM466 correlate with, and may be deduced from, the identity of the target genes which VGAM466 binds and inhibits, and the function of these target genes, as elaborated hereinbelow.

B-cell CLL/lymphoma 2 (BCL2, Accession NM_000633) is a VGAM466 host target gene. BCL2 BINDING SITE is HOST TARGET binding site found in the 3' untranslated region of mRNA encoded by BCL2, corresponding to a HOST TARGET binding site such as BINDING SITE I, BINDING SITE II or BINDING SITE III. Table 2 illustrates the complementarity of the nucleotide sequences of BCL2 BINDING SITE, designated SEQ ID:6256, to the nucleotide sequence of VGAM466 RNA, herein designated VGAM RNA, also designated SEQ ID:3177.

A function of VGAM466 is therefore inhibition of B-cell CLL/lymphoma 2 (BCL2, Accession NM_000633). Accordingly, utilities of VGAM466 include diagnosis, prevention and treatment of diseases and clinical conditions associated with BCL2. B-cell CLL/lymphoma 7A (BCL7A, Accession NM_020993) is another VGAM466 host target gene. BCL7A BINDING SITE is HOST TARGET binding site found in the 3' untranslated region of mRNA encoded by BCL7A, corresponding to a HOST TARGET binding site such as BINDING SITE I, BINDING SITE II or BINDING SITE III. Table 2 illustrates the complementarity of the nucleotide sequences of BCL7A BINDING SITE, designated SEQ ID:21988, to the nucleotide sequence of VGAM466 RNA, herein designated VGAM RNA, also designated SEQ ID:3177.

Another function of VGAM466 is therefore inhibition of B-cell CLL/lymphoma 7A (BCL7A, Accession NM_020993). Accordingly, utilities of VGAM466 include diagnosis, prevention and treatment of diseases and clinical conditions associated with BCL7A. BCLG (Accession NM_030766) is another VGAM466 host target gene. BCLG BINDING SITE is HOST TARGET binding site found in the 3' untranslated region of mRNA encoded by BCLG, corresponding to a HOST TARGET binding site such as BINDING SITE I, BINDING SITE II or BINDING SITE III. Table 2 illustrates the complementarity of the nucleotide sequences of BCLG BINDING SITE, designated SEQ ID:25052, to the nucleotide sequence of VGAM466 RNA, herein designated VGAM RNA, also designated SEQ ID:3177.

Another function of VGAM466 is therefore inhibition of BCLG (Accession NM_030766). Accordingly, utilities of VGAM466 include diagnosis, prevention and treatment of diseases and clinical conditions associated with BCLG. Norrie Disease (pseudoglioma) (NDP, Accession NM_000266) is another VGAM466 host target gene. NDP BINDING SITE is HOST TARGET binding site found in the 3" untranslated region of mRNA encoded by NDP, corresponding to a HOST TARGET binding site such as BINDING SITE I, BINDING SITE II or BINDING SITE III. Table 2 illustrates the complementarity of the nucleotide sequences of NDP BINDING SITE, designated SEQ ID:5809, to the nucleotide sequence of VGAM466 RNA, herein designated VGAM RNA, also designated SEQ ID:3177.

Another function of VGAM466 is therefore inhibition of Norrie Disease (pseudoglioma) (NDP, Accession NM_000266), a gene which may be involved in a pathway that regulates neural cell differentiation and proliferation. Accordingly, utilities of VGAM466 include diagnosis, prevention and treatment of diseases and clinical conditions associated with NDP. The function of NDP and its association with various diseases and clinical conditions, has been established by previous studies, as described hereinabove with reference to VGAM113. Trichorhinophalangeal Syndrome I (TRPS1, Accession NM_014112) is another VGAM466 host target gene. TRPS1 BINDING SITE is HOST TARGET binding site found in the 3' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15361, to the nucleotide sequence of VGAM466 RNA, herein designated VGAM RNA, also designated SEQ ID:3177.

Another function of VGAM466 is therefore inhibition of Trichorhinophalangeal Syndrome I (TRPS1, Accession NM_014112), a gene which may function as a transcriptional activator protein. Accordingly, utilities of VGAM466 include diagnosis, prevention and treatment of diseases and clinical conditions associated with TRPS1. The function of TRPS1 and its association with various diseases and clinical conditions, has been established by previous studies, as described hereinabove with reference to VGAM172. FLJ12595 (Accession NM_024994) is another VGAM466 host target gene. FLJ12595 BINDING SITE is HOST TARGET binding site found in the 3' untranslated region of mRNA encoded by FLJ12595, corresponding to a HOST TARGET binding site such as BINDING SITE I, BINDING SITE II or BINDING SITE III. Table 2 illustrates the complementarity of the nucleotide sequences of FLJ12595 BINDING SITE, designated SEQ ID:24558, to the nucleotide sequence of VGAM466 RNA, herein designated VGAM RNA, also designated SEQ ID:3177.

Another function of VGAM466 is therefore inhibition of FLJ12595 (Accession NM_024994). Accordingly, utilities of VGAM466 include diagnosis, prevention and treatment of diseases and clinical conditions associated with FLJ12595. KIAA1078 (Accession XM_036589) is another VGAM466 host target gene. KIAA1078 BINDING SITE is HOST TARGET binding site found in the 3' untranslated region of mRNA encoded by KIAA1078, corresponding to a HOST TARGET binding site such as BINDING SITE I, BINDING SITE II or BINDING SITE III. Table 2 illustrates the complementarity of the nucleotide sequences of KIAA1078 BINDING SITE, designated SEQ ID:32473, to the nucleotide sequence of VGAM466 RNA, herein designated VGAM RNA, also designated SEQ ID:3177.

Another function of VGAM466 is therefore inhibition of KIAA1078 (Accession XM_036589). Accordingly, utilities of VGAM466 include diagnosis, prevention and treatment of diseases and clinical conditions associated with KIAA1078. Proteasome (prosome, macropain) Inhibitor Subunit 1 (PI31) (PSMF1, Accession NM_006814) is another VGAM466 host target gene. PSMF1 BINDING SITE is HOST TARGET binding site found in the 3' untranslated region of mRNA encoded by PSMF1, corresponding to a HOST TARGET binding site such as BINDING SITE I, BINDING SITE II or BINDING SITE III. Table 2 illustrates the complementarity of the nucleotide sequences of PSMF1 BINDING SITE, designated SEQ ID:13690, to the nucleotide sequence of VGAM466 RNA, herein designated VGAM RNA, also designated SEQ ID:3177.

Another function of VGAM466 is therefore inhibition of Proteasome (prosome, macropain) Inhibitor Subunit 1 (PI31) (PSMF1, Accession NM_006814). Accordingly, utilities of VGAM466 include diagnosis, prevention and treatment of diseases and clinical conditions associated with PSMF1. LOC144195 (Accession XM_016498) is another VGAM466 host target gene. LOC144195 BINDING SITE is HOST TARGET binding site found in the 3' untranslated region of mRNA encoded by LOC144195, corresponding to a HOST TARGET binding site such as BINDING SITE I, BINDING SITE II or BINDING SITE III. Table 2 illustrates the complementarity of the nucleotide sequences of LOC144195 BINDING SITE, designated SEQ ID:30266, to the nucleotide sequence of VGAM466 RNA, herein designated VGAM RNA, also designated SEQ ID:3177.

Another function of VGAM466 is therefore inhibition of LOC144195 (Accession XM_016498). Accordingly, utilities of VGAM466 include diagnosis, prevention and treatment of diseases and clinical conditions associated with LOC144195. FIG. 1 further provides a conceptual description of a novel bioinformatically detected viral gene of the present invention, referred to here as Viral Genomic Address Messenger 467 (VGAM467) viral gene, which modulates expression of respective host target genes thereof, the function and utility of which host target genes is known in the art.

VGAM467 is a novel bioinformatically detected regulatory, non protein coding, viral micro RNA (miRNA) gene. The method by which VGAM467 was detected is described hereinabove with reference to FIGS. 1-8.

VGAM467 gene, herein designated VGAM GENE, is a viral gene contained in the genome of Autographa Californica Nucleopolyhedrovirus. VGAM467 host target gene, herein designated VGAM HOST TARGET GENE, is a human gene contained in the human genome.

VGAM467 gene encodes a VGAM467 precursor RNA, herein designated VGAM PRECURSOR RNA. Similar to other miRNA genes, and unlike most ordinary genes, VGAM467 precursor RNA does not encode a protein. A nucleotide sequence identical or highly similar to the nucleotide sequence of VGAM467 precursor RNA is designated SEQ ID:453, and is provided hereinbelow with reference to the sequence listing part. Nucleotide sequence SEQ ID:453 is located at position 73764 relative to the genome of Autographa Californica Nucleopolyhedrovirus.

VGAM467 precursor RNA folds onto itself, forming VGAM467 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM467 folded precursor RNA into VGAM467 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM467 RNA is designated SEQ ID:3178, and is provided hereinbelow with reference to the sequence listing part.

VGAM467 host target gene, herein designated VGAM HOST TARGET GENE, encodes a corresponding messenger RNA, VGAM467 host target RNA, herein designated VGAM HOST TARGET RNA. VGAM467 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM467 RNA, herein designated VGAM RNA, binds complementarily to one or more host target binding sites located in untranslated regions of VGAM467 host target RNA, herein designated VGAM HOST TARGET RNA. This complementary binding is due to the fact that the nucleotide sequence of VGAM467 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM467 RNA, herein designated VGAM RNA, may have a different number of host target binding sites in untranslated regions of a VGAM467 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM467 RNA, herein designated VGAM RNA, to host target binding sites on VGAM467 host target RNA, herein designated VGAM HOST TARGET RNA, such as BINDING SITE I, BINDING SITE II and BINDING SITE III, inhibits translation of VGAM467 host target RNA into VGAM467 host target protein, herein designated VGAM HOST TARGET PROTEIN. VGAM host target protein is therefore outlined by a broken line.

It is appreciated that VGAM467 host target gene, herein designated VGAM HOST TARGET GENE, in fact represents a plurality of VGAM467 host target genes. The mRNA of each one of this plurality of VGAM467 host target genes comprises one or more host target binding sites, each having a nucleotide sequence which is at least partly complementary to VGAM467 RNA, herein designated VGAM RNA, and which when bound by VGAM467 RNA causes inhibition of translation of respective one or more VGAM467 host target proteins.

It is further appreciated by one skilled in the art that the mode of translational inhibition illustrated by FIG. 1 with specific reference to translational inhibition exerted by VGAM467 gene, herein designated VGAM GENE, on one or more VGAM467 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM467 is inhibition of expression of host target genes, as part of a novel viral mechanism of attacking a host. Accordingly, utilities of VGAM467 include diagnosis, prevention and treatment of viral infection by Autographa Californica Nucleopolyhedrovirus. Specific functions, and accordingly utilities, of VGAM467 correlate with, and may be deduced from, the identity of the host target genes which VGAM467 binds and inhibits, and the function of these host target genes, as elaborated hereinbelow.

Nucleotide sequences of the VGAM467 precursor RNA, herein designated VGAM PRECURSOR RNA, and of the 'diced' VGAM467 RNA, herein designated VGAM RNA, and a schematic representation of the secondary folding of VGAM467 folded precursor RNA, herein designated VGAM FOLDED PRECURSOR RNA, of VGAM467 are further described hereinbelow with reference to Table 1.

Nucleotide sequences of host target binding sites, such as BINDING SITE-I, BINDING SITE-II and BINDING SITE-III of FIG. 1, found on VGAM467 host target RNA, and schematic representation of the complementarity of each of these host target binding sites to VGAM467 RNA, herein designated VGAM RNA, are described hereinbelow with reference to Table 2.

As mentioned hereinabove with reference to FIG. 1, a function of VGAM467 gene, herein designated VGAM is inhibition of expression of VGAM467 target genes. It is appreciated that specific functions, and accordingly utilities, of VGAM467 correlate with, and may be deduced from, the identity of the target genes which VGAM467 binds and inhibits, and the function of these target genes, as elaborated hereinbelow.

Neural Precursor Cell Expressed, Developmentally Down-regulated 4 (NEDD4, Accession XM_046129) is a VGAM467 host target gene. NEDD4 BINDING SITE is HOST TARGET binding site found in the 3' untranslated region of mRNA encoded by NEDD4, corresponding to a HOST TARGET binding site such as BINDING SITE I, BINDING SITE II or BINDING SITE III. Table 2 illustrates the complementarity of the nucleotide sequences of NEDD4 BINDING SITE, designated SEQ ID:34693, to the nucleotide sequence of VGAM467 RNA, herein designated VGAM RNA, also designated SEQ ID:3178.

A function of VGAM467 is therefore inhibition of Neural Precursor Cell Expressed, Developmentally Down-regulated 4 (NEDD4, Accession XM_046129), a gene which ubiquitinates regulatory proteins involved in transcription. Accordingly, utilities of VGAM467 include diagnosis, prevention and treatment of diseases and clinical conditions associated with NEDD4. The function of NEDD4 and its association with various diseases and clinical conditions, has been established by previous studies, as described hereinabove with reference to VGAM209. Transmembrane, Prostate Androgen Induced RNA (TMEPAI, Accession NM_020182) is another VGAM467 host target gene. TMEPAI BINDING SITE is HOST TARGET binding site found in the 3' untranslated region of mRNA encoded by TMEPAI, corresponding to a HOST TARGET binding site such as BINDING SITE I, BINDING SITE II or BINDING SITE III. Table 2 illustrates the complementarity of the nucleotide sequences of TMEPAI BINDING SITE, designated SEQ ID:21405, to the nucleotide sequence of VGAM467 RNA, herein designated VGAM RNA, also designated SEQ ID:3178.

Another function of VGAM467 is therefore inhibition of Transmembrane, Prostate Androgen Induced RNA (TMEPAI, Accession NM_020182). Accordingly, utilities of VGAM467 include diagnosis, prevention and treatment of diseases and clinical conditions associated with TMEPAI. DKFZp761G2113 (Accession XM_046017) is another VGAM467 host target gene. DKFZp761G2113 BINDING SITE is HOST TARGET binding site found in the 5' untranslated region of mRNA encoded by DKFZp761G2113, corresponding to a HOST TARGET binding site such as BINDING SITE I, BINDING SITE II or BINDING SITE III. Table 2 illustrates the complementarity of the nucleotide sequences of DKFZp761G2113 BINDING SITE, designated SEQ ID:34642, to the nucleotide sequence of VGAM467 RNA, herein designated VGAM RNA, also designated SEQ ID:3178.

Another function of VGAM467 is therefore inhibition of DKFZp761G2113 (Accession XM_046017). Accordingly, utilities of VGAM467 include diagnosis, prevention and treatment of diseases and clinical conditions associated with DKFZp761G2113. FLJ12517 (Accession NM_023007) is another VGAM467 host target gene. FLJ12517 BINDING SITE is HOST TARGET binding site found in the 3' untranslated region of mRNA encoded by FLJ12517, corresponding to a HOST TARGET binding site such as BINDING SITE I, BINDING SITE II or BINDING SITE III. Table 2 illustrates the complementarity of the nucleotide sequences of FLJ12517 BINDING SITE, designated SEQ ID:23270, to the nucleotide sequence of VGAM467 RNA, herein designated VGAM RNA, also designated SEQ ID:3178.

Another function of VGAM467 is therefore inhibition of FLJ12517 (Accession NM_023007). Accordingly, utilities of VGAM467 include diagnosis, prevention and treatment of diseases and clinical conditions associated with FLJ12517. MGC15437 (Accession NM_032873) is another VGAM467 host target gene. MGC15437 BINDING SITE is HOST TARGET binding site found in the 3' untranslated region of mRNA encoded by MGC15437, corresponding to a HOST TARGET binding site such as BINDING SITE I, BINDING SITE II or BINDING SITE III. Table 2 illustrates the complementarity of the nucleotide sequences of MGC15437 BINDING SITE, designated SEQ ID:26688, to the nucleotide sequence of VGAM467 RNA, herein designated VGAM RNA, also designated SEQ ID:3178.

Another function of VGAM467 is therefore inhibition of MGC15437 (Accession NM_032873). Accordingly, utilities of VGAM467 include diagnosis, prevention and treatment of diseases and clinical conditions associated with MGC15437. LOC144893 (Accession XM_096687) is another VGAM467 host target gene. LOC144893 BINDING SITE is HOST TARGET binding site found in the 5' untranslated region of mRNA encoded by LOC144893, corresponding to a HOST TARGET binding site such as BINDING SITE I, BINDING SITE II or BINDING SITE III. Table 2 illustrates the complementarity of the nucleotide sequences of LOC144893 BINDING SITE, designated SEQ ID:40458, to the nucleotide sequence of VGAM467 RNA, herein designated VGAM RNA, also designated SEQ ID:3178.

Another function of VGAM467 is therefore inhibition of LOC144893 (Accession XM_096687). Accordingly, utilities of VGAM467 include diagnosis, prevention and treatment of diseases and clinical conditions associated with LOC144893. LOC221596 (Accession XM_166331) is another VGAM467 host target gene. LOC221596 BINDING SITE is HOST TARGET binding site found in the 5' untranslated region of mRNA encoded by LOC221596, corresponding to a HOST TARGET binding site such as BINDING SITE I, BINDING SITE II or BINDING SITE III. Table 2 illustrates the complementarity of the nucleotide sequences of LOC221596 BINDING SITE, designated SEQ ID:44174, to the nucleotide sequence of VGAM467 RNA, herein designated VGAM RNA, also designated SEQ ID:3178.

Another function of VGAM467 is therefore inhibition of LOC221596 (Accession XM_166331). Accordingly, utilities of VGAM467 include diagnosis, prevention and treatment of diseases and clinical conditions associated with LOC221596. LOC57821 (Accession NM_021179) is another VGAM467 host target gene. LOC57821 BINDING SITE is HOST TARGET binding site found in the 5' untranslated region of mRNA encoded by LOC57821, corresponding to a HOST TARGET binding site such as BINDING SITE I, BINDING SITE II or BINDING SITE III. Table 2 illustrates the complementarity of the nucleotide sequences of LOC57821 BINDING SITE, designated SEQ ID:22151, to the nucleotide sequence of VGAM467 RNA, herein designated VGAM RNA, also designated SEQ ID:3178.

Another function of VGAM467 is therefore inhibition of LOC57821 (Accession NM_021179). Accordingly, utilities of VGAM467 include diagnosis, prevention and treatment of diseases and clinical conditions associated with LOC57821.

FIG. 1 further provides a conceptual description of a novel bioinformatically detected viral gene of the present invention, referred to here as Viral Genomic Address Messenger 468 (VGAM468) viral gene, which modulates expression of respective host target genes thereof, the function and utility of which host target genes is known in the art.

VGAM468 is a novel bioinformatically detected regulatory, non protein coding, viral micro RNA (miRNA) gene. The method by which VGAM468 was detected is described hereinabove with reference to FIGS. 1-8.

VGAM468 gene, herein designated VGAM GENE, is a viral gene contained in the genome of Equine Herpesvirus 2. VGAM468 host target gene, herein designated VGAM HOST TARGET GENE, is a human gene contained in the human genome.

VGAM468 gene encodes a VGAM468 precursor RNA, herein designated VGAM PRECURSOR RNA. Similar to other miRNA genes, and unlike most ordinary genes, VGAM468 precursor RNA does not encode a protein. A nucleotide sequence identical or highly similar to the nucleotide sequence of VGAM468 precursor RNA is designated SEQ ID:454, and is provided hereinbelow with reference to the sequence listing part. Nucleotide sequence SEQ ID:454 is located at position 33653 relative to the genome of Equine Herpesvirus 2.

VGAM468 precursor RNA folds onto itself, forming VGAM468 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM468 folded precursor RNA into VGAM468 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM468 RNA is designated SEQ ID:3179, and is provided hereinbelow with reference to the sequence listing part.

VGAM468 host target gene, herein designated VGAM HOST TARGET GENE, encodes a corresponding messenger RNA, VGAM468 host target RNA, herein designated VGAM HOST TARGET RNA. VGAM468 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM468 RNA, herein designated VGAM RNA, binds complementarily to one or more host target binding sites located in untranslated regions of VGAM468 host target RNA, herein designated VGAM HOST TARGET RNA. This complementary binding is due to the fact that the nucleotide sequence of VGAM468 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM468 RNA, herein designated VGAM RNA, may have a different number of host target binding sites in untranslated regions of a VGAM468 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM468 RNA, herein designated VGAM RNA, to host target binding sites on VGAM468 host target RNA, herein designated VGAM HOST TARGET RNA, such as BINDING SITE I, BINDING SITE II and BINDING SITE III, inhibits translation of VGAM468 host target RNA into VGAM468 host target protein, herein designated VGAM HOST TARGET PROTEIN. VGAM host target protein is therefore outlined by a broken line.

It is appreciated that VGAM468 host target gene, herein designated VGAM HOST TARGET GENE, in fact represents a plurality of VGAM468 host target genes. The mRNA of each one of this plurality of VGAM468 host target genes comprises one or more host target binding sites, each having a nucleotide sequence which is at least partly complementary to VGAM468 RNA, herein designated VGAM RNA, and which when bound by VGAM468 RNA causes inhibition of translation of respective one or more VGAM468 host target proteins.

It is further appreciated by one skilled in the art that the mode of translational inhibition illustrated by FIG. 1 with specific reference to translational inhibition exerted by VGAM468 gene, herein designated VGAM GENE, on one or more VGAM468 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM468 is inhibition of expression of host target genes, as part of a novel viral mechanism of attacking a host. Accordingly, utilities of VGAM468 include diagnosis, prevention and treatment of viral infection by Equine Herpesvirus 2. Specific functions, and accordingly utilities, of VGAM468 correlate with, and may be deduced from, the identity of the host target genes which VGAM468 binds and inhibits, and the function of these host target genes, as elaborated hereinbelow.

Nucleotide sequences of the VGAM468 precursor RNA, herein designated VGAM PRECURSOR RNA, and of the 'diced' VGAM468 RNA, herein designated VGAM RNA, and a schematic representation of the secondary folding of VGAM468 folded precursor RNA, herein designated VGAM FOLDED PRECURSOR RNA, of VGAM468 are further described hereinbelow with reference to Table 1.

Nucleotide sequences of host target binding sites, such as BINDING SITE-I, BINDING SITE-II and BINDING SITE-III of FIG. 1, found on VGAM468 host target RNA, and schematic representation of the complementarity of each of these host target binding sites to VGAM468 RNA, herein designated VGAM RNA, are described hereinbelow with reference to Table 2.

As mentioned hereinabove with reference to FIG. 1, a function of VGAM468 gene, herein designated VGAM is inhibition of expression of VGAM468 target genes. It is appreciated that specific functions, and accordingly utilities, of VGAM468 correlate with, and may be deduced from, the identity of the target genes which VGAM468 binds and inhibits, and the function of these target genes, as elaborated hereinbelow.

RAB20, Member RAS Oncogene Family (RAB20, Accession NM_017817) is a VGAM468 host target gene. RAB20 BINDING SITE is HOST TARGET binding site found in the 3' untranslated region of mRNA encoded by RAB20, corresponding to a HOST TARGET binding site such as BINDING SITE I, BINDING SITE II or BINDING SITE III. Table 2 illustrates the complementarity of the nucleotide sequences of RAB20 BINDING SITE, designated SEQ ID:19462, to the nucleotide sequence of VGAM468 RNA, herein designated VGAM RNA, also designated SEQ ID:3179.

A function of VGAM468 is therefore inhibition of RAB20, Member RAS Oncogene Family (RAB20, Accession NM_017817). Accordingly, utilities of VGAM468 include diagnosis, prevention and treatment of diseases and clinical conditions associated with RAB20. FIG. 1 further provides a conceptual description of a novel bioinformatically detected viral gene of the present invention, referred to here as Viral Genomic Address Messenger 469 (VGAM469) viral gene, which modulates expression of respective host target genes thereof, the function and utility of which host target genes is known in the art.

VGAM469 is a novel bioinformatically detected regulatory, non protein coding, viral micro RNA (miRNA) gene. The method by which VGAM469 was detected is described hereinabove with reference to FIGS. 1-8.

VGAM469 gene, herein designated VGAM GENE, is a viral gene contained in the genome of Equine Herpesvirus 2. VGAM469 host target gene, herein designated VGAM HOST TARGET GENE, is a human gene contained in the human genome.

VGAM469 gene encodes a VGAM469 precursor RNA, herein designated VGAM PRECURSOR RNA. Similar to other miRNA genes, and unlike most ordinary genes, VGAM469 precursor RNA does not encode a protein. A nucleotide sequence identical or highly similar to the nucleotide sequence of VGAM469 precursor RNA is designated SEQ ID:455, and is provided hereinbelow with reference to the sequence listing part. Nucleotide sequence SEQ ID:455 is located at position 156830 relative to the genome of Equine Herpesvirus 2.

VGAM469 precursor RNA folds onto itself, forming VGAM469 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM469 folded precursor RNA into VGAM469 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM469 RNA is designated SEQ ID:3180, and is provided hereinbelow with reference to the sequence listing part.

VGAM469 host target gene, herein designated VGAM HOST TARGET GENE, encodes a corresponding messenger RNA, VGAM469 host target RNA, herein designated VGAM HOST TARGET RNA. VGAM469 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM469 RNA, herein designated VGAM RNA, binds complementarily to one or more host target binding sites located in untranslated regions of VGAM469 host target RNA, herein designated VGAM HOST TARGET RNA. This complementary binding is due to the fact that the nucleotide sequence of VGAM469 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM469 RNA, herein designated VGAM RNA, may have a different number of host target binding sites in untranslated regions of a VGAM469 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM469 RNA, herein designated VGAM RNA, to host target binding sites on VGAM469 host target RNA, herein designated VGAM HOST TARGET RNA, such as BINDING SITE I, BINDING SITE II and BINDING SITE III, inhibits translation of VGAM469 host target RNA into VGAM469 host target protein, herein designated VGAM HOST TARGET PROTEIN. VGAM host target protein is therefore outlined by a broken line.

It is appreciated that VGAM469 host target gene, herein designated VGAM HOST TARGET GENE, in fact represents a plurality of VGAM469 host target genes. The mRNA of each one of this plurality of VGAM469 host target genes comprises one or more host target binding sites, each having a nucleotide sequence which is at least partly complementary to VGAM469 RNA, herein designated VGAM RNA, and which when bound by VGAM469 RNA causes inhibition of translation of respective one or more VGAM469 host target proteins.

It is further appreciated by one skilled in the art that the mode of translational inhibition illustrated by FIG. 1 with specific reference to translational inhibition exerted by VGAM469 gene, herein designated VGAM GENE, on one or more VGAM469 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM469 is inhibition of expression of host target genes, as part of a novel viral mechanism of attacking a host. Accordingly, utilities of VGAM469 include diagnosis, prevention and treatment of viral infection by Equine Herpesvirus 2. Specific functions, and accordingly utilities, of VGAM469 correlate with, and may be deduced from, the identity of the host target genes which VGAM469 binds and inhibits, and the function of these host target genes, as elaborated hereinbelow.

Nucleotide sequences of the VGAM469 precursor RNA, herein designated VGAM PRECURSOR RNA, and of the 'diced' VGAM469 RNA, herein designated VGAM RNA, and a schematic representation of the secondary folding of VGAM469 folded precursor RNA, herein designated VGAM FOLDED PRECURSOR RNA, of VGAM469 are further described hereinbelow with reference to Table 1.

Nucleotide sequences of host target binding sites, such as BINDING SITE-I, BINDING SITE-II and BINDING SITE-III of FIG. 1, found on VGAM469 host target RNA, and schematic representation of the complementarity of each of these host target binding sites to VGAM469 RNA, herein designated VGAM RNA, are described hereinbelow with reference to Table 2.

As mentioned hereinabove with reference to FIG. 1, a function of VGAM469 gene, herein designated VGAM is inhibition of expression of VGAM469 target genes. It is appreciated that specific functions, and accordingly utilities, of VGAM469 correlate with, and may be deduced from, the identity of the target genes which VGAM469 binds and inhibits, and the function of these target genes, as elaborated hereinbelow.

Chaperone, ABC1 Activity of Bc1 Complex Like (S. pombe) (CABC1, Accession NM_020247) is a VGAM469 host target gene. CABC1 BINDING SITE is HOST TARGET binding site found in the 5' untranslated region of mRNA encoded by CABC1, corresponding to a HOST TARGET binding site such as BINDING SITE I, BINDING SITE II or BINDING SITE III. Table 2 illustrates the complementarity of the nucleotide sequences of CABC1 BINDING SITE, designated SEQ ID:21541, to the nucleotide sequence of VGAM469 RNA, herein designated VGAM RNA, also designated SEQ ID:3180.

A function of VGAM469 is therefore inhibition of Chaperone, ABC1 Activity of Bc1 Complex Like (S. pombe) (CABC1, Accession NM_020247). Accordingly, utilities of VGAM469 include diagnosis, prevention and treatment of diseases and clinical conditions associated with CABC1. F-box and Leucine-rich Repeat Protein 11 (FBXL11, Accession NM_012308) is another VGAM469 host target gene. FBXL11 BINDING SITE is HOST TARGET binding site found in the 3' untranslated region of mRNA encoded by FBXL11, corresponding to a HOST TARGET binding site such as BINDING SITE I, BINDING SITE II or BINDING SITE III. Table 2 illustrates the complementarity of the nucleotide sequences of FBXL11 BINDING SITE, designated SEQ ID:14682, to the nucleotide sequence of VGAM469 RNA, herein designated VGAM RNA, also designated SEQ ID:3180.

Another function of VGAM469 is therefore inhibition of F-box and Leucine-rich Repeat Protein 11 (FBXL11, Accession NM_012308), a gene which are BTB/POZ domain-containing zinc finger proteins implicated in oncogenesis. Accordingly, utilities of VGAM469 include diagnosis, prevention and treatment of diseases and clinical conditions associated with FBXL11. The function of FBXL11 and its association with various diseases and clinical conditions, has been established by previous studies, as described hereinabove with reference to VGAM404. Mitogen-activated Protein Kinase Kinase Kinase 1 (MAP3K1, Accession XM_042066) is another VGAM469 host target gene. MAP3K1 BINDING SITE is HOST TARGET binding site found in the 5' untranslated region of mRNA encoded by MAP3K1, corresponding to a HOST TARGET binding site such as BINDING SITE I, BINDING SITE II or BINDING SITE III. Table 2 illustrates the complementarity of the nucleotide sequences of MAP3K1 BINDING SITE, designated SEQ ID:33682, to the nucleotide sequence of VGAM469 RNA, herein designated VGAM RNA, also designated SEQ ID:3180.

Another function of VGAM469 is therefore inhibition of Mitogen-activated Protein Kinase Kinase Kinase 1 (MAP3K1, Accession XM_042066), a gene which can phosphorylate and activate mapkk 1 and mapkk 2 (mek1/mek2) which leads to phosphorylation of map kinases. it is also a highly efficient activator of the jnk cascade. Accordingly, utilities of VGAM469 include diagnosis, prevention and treatment of diseases and clinical conditions associated with MAP3K1. The function of MAP3K1 has been established by previous studies. Gamma interferon (IFNG; 147570) induces a number of genes, including MEKK1, to upregulate cellular responses by using specific transcription factors and the cognate elements (Roy et al., 2002). Lu et al. (2002) found that the PHD domain of MEKK1, a RING finger-like structure, exhibited E3 ubiquitin ligase activity toward ERK2 (OMIM Ref. No. 176948) in vitro and in vivo. Moreover, both MEKK1 kinase activity and the docking motif on ERK1 (OMIM Ref. No. 601795)/ERK2 were involved in ERK1/ERK2 ubiquitination. Significantly, cells expressing ERK2 with the docking motif mutation were resistant to sorbitol-induced apoptosis. Therefore, MEKK1 functions not only as an upstream activator of ERK and JNK (see OMIM Ref. No. 601158) through its kinase domain, but also as an E3 ligase through its PHD domain, providing a negative regulatory mechanism for decreasing ERK1/ERK2 activity Animal model experiments lend further support to the function of MAP3K1. Yujiri et al. (1998) targeted disruption of the gene encoding Mekk1 to define its function in the regulation of MAP kinase pathways and cell survival. Mekk1 -/- embryonic stem cells from mice had lost or altered responses of Jnk to microtubule disruption and cold stress but activated Jnk normally in response to heat shock, anisomycin, and ultraviolet irradiation. Activation of Jnk was lost and that of Erk was diminished in response to hyperosmolarity and serum factors in Mekk1 -/- cells. Loss of Mekk1 expression resulted in a greater apoptotic response of cells to hyperosmolarity and microtubule disruption. When activated by specific stresses that alter cell shape and the cytoskeleton, Mekk1 signals to protect cells from apoptosis It is appreciated that the abovementioned animal model for MAP3K1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lu, Z.; Xu, S.; Joazeiro, C.; Cobb, M. H.; Hunter, T.: The PHD domain of MEKK1 acts as an E3 ubiquitin ligase and mediates ubiquitination and degradation of ERK1/2. Molec. Cell 9:945-956, 2002; and Yujiri, T.; Sather, S.; Fanger, G. R.; Johnson, G. L.: Role of MEKK1 in cell survival and activation of JNK and ERK pathways defined by targeted gene disruption. Science 282: 1911-1914, 1.

Further studies establishing the function and utilities of MAP3K1 are found in John Hopkins OMIM database record ID 600982, and in sited publications numbered 781 and 7884-7885 listed in the bibliography section hereinbelow, which are also hereby incorporated by reference. AWP1 (Accession NM_019006) is another VGAM469 host target gene. AWP1 BINDING SITE is HOST TARGET binding site found in the 5' untranslated region of mRNA encoded by AWP1, corresponding to a HOST TARGET binding site such as BINDING SITE I, BINDING SITE II or BINDING SITE III. Table 2 illustrates the complementarity of the nucleotide sequences of AWP1 BINDING SITE, designated SEQ ID:21078, to the nucleotide sequence of VGAM469 RNA, herein designated VGAM RNA, also designated SEQ ID:3180.

Another function of VGAM469 is therefore inhibition of AWP1 (Accession NM_019006). Accordingly, utilities of VGAM469 include diagnosis, prevention and treatment of diseases and clinical conditions associated with AWP1. DCNP1 (Accession NM_130848) is another VGAM469 host target gene. DCNP1 BINDING SITE is HOST TARGET binding site found in the 5' untranslated region of mRNA encoded by DCNP1, corresponding to a HOST TARGET binding site such as BINDING SITE I, BINDING SITE II or BINDING SITE III. Table 2 illustrates the complementarity of the nucleotide sequences of DCNP1 BINDING SITE, designated SEQ ID:28385, to the nucleotide sequence of VGAM469 RNA, herein designated VGAM RNA, also designated SEQ ID:3180.

Another function of VGAM469 is therefore inhibition of DCNP1 (Accession NM_130848). Accordingly, utilities of VGAM469 include diagnosis, prevention and treatment of diseases and clinical conditions associated with DCNP1. DEAD/H (Asp-Glu-Ala-Asp/His) Box Polypeptide 34 (DDX34, Accession NM_014681) is another VGAM469 host target gene. DDX34 BINDING SITE is HOST TARGET binding site found in the 3' untranslated region of mRNA encoded by DDX34, corresponding to a HOST TARGET binding site such as BINDING SITE I, BINDING SITE II or BINDING SITE III. Table 2 illustrates the complementarity of the nucleotide sequences of DDX34 BINDING SITE, designated SEQ ID:16163, to the nucleotide sequence of VGAM469 RNA, herein designated VGAM RNA, also designated SEQ ID:3180.

Another function of VGAM469 is therefore inhibition of DEAD/H (Asp-Glu-Ala-Asp/His) Box Polypeptide 34 (DDX34, Accession NM_014681). Accordingly, utilities of VGAM469 include diagnosis, prevention and treatment of diseases and clinical conditions associated with DDX34. DREV1 (Accession NM_016025) is another VGAM469 host target gene. DREV1 BINDING SITE is HOST TARGET binding site found in the 5' untranslated region of mRNA encoded by DREV1, corresponding to a HOST TARGET binding site such as BINDING SITE I, BINDING SITE II or BINDING SITE III. Table 2 illustrates the complementarity of the nucleotide sequences of DREV1 BINDING SITE, designated SEQ ID:18108, to the nucleotide sequence of VGAM469 RNA, herein designated VGAM RNA, also designated SEQ ID:3180.

Another function of VGAM469 is therefore inhibition of DREV1 (Accession NM_016025). Accordingly, utilities of VGAM469 include diagnosis, prevention and treatment of diseases and clinical conditions associated with DREV1. FLJ10209 (Accession NM_018026) is another VGAM469 host target gene. FLJ10209 BINDING SITE is HOST TARGET binding site found in the 5' untranslated region of mRNA encoded by FLJ10209, corresponding to a HOST TARGET binding site such as BINDING SITE I, BINDING SITE II or BINDING SITE III. Table 2 illustrates the complementarity of the nucleotide sequences of FLJ10209 BINDING SITE, designated SEQ ID:19768, to the nucleotide sequence of VGAM469 RNA, herein designated VGAM RNA, also designated SEQ ID:3180.

Another function of VGAM469 is therefore inhibition of FLJ10209 (Accession NM_018026). Accordingly, utilities of VGAM469 include diagnosis, prevention and treatment of diseases and clinical conditions associated with FLJ10209. FLJ20401 (Accession NM_017805) is another VGAM469 host target gene. FLJ20401 BINDING SITE is HOST TARGET binding site found in the 5' untranslated region of mRNA encoded by FLJ20401, corresponding to a HOST TARGET binding site such as BINDING SITE I, BINDING SITE II or BINDING SITE III. Table 2 illustrates the complementarity of the nucleotide sequences of FLJ20401 BINDING SITE, designated SEQ ID:19448, to the nucleotide sequence of VGAM469 RNA, herein designated VGAM RNA, also designated SEQ ID:3180.

Another function of VGAM469 is therefore inhibition of FLJ20401 (Accession NM_017805). Accordingly, utilities of VGAM469 include diagnosis, prevention and treatment of diseases and clinical conditions associated with FLJ20401. FLJ22529 (Accession NM_024789) is another VGAM469 host target gene. FLJ22529 BINDING SITE is HOST TARGET binding site found in the 3' untranslated region of mRNA encoded by FLJ22529, corresponding to a HOST TARGET binding site such as BINDING SITE I, BINDING SITE II or BINDING SITE III. Table 2 illustrates the complementarity of the nucleotide sequences of FLJ22529 BINDING SITE, designated SEQ ID:24170, to the nucleotide sequence of VGAM469 RNA, herein designated VGAM RNA, also designated SEQ ID:3180.

Another function of VGAM469 is therefore inhibition of FLJ22529 (Accession NM_024789). Accordingly, utilities of VGAM469 include diagnosis, prevention and treatment of diseases and clinical conditions associated with FLJ22529. LCHN (Accession XM_098615) is another VGAM469 host target gene. LCHN BINDING SITE is HOST TARGET binding site found in the 5" untranslated region of mRNA encoded by LCHN, corresponding to a HOST TARGET binding site such as BINDING SITE I, BINDING SITE II or BINDING SITE III. Table 2 illustrates the complementarity of the nucleotide sequences of LCHN BINDING SITE, designated SEQ ID:41729, to the nucleotide sequence of VGAM469 RNA, herein designated VGAM RNA, also designated SEQ ID:3180.

Another function of VGAM469 is therefore inhibition of LCHN (Accession XM_098615). Accordingly, utilities of VGAM469 include diagnosis, prevention and treatment of diseases and clinical conditions associated with LCHN. MGC3113 (Accession NM_024035) is another VGAM469 host target gene. MGC3113 BINDING SITE is HOST TARGET binding site found in the 3" untranslated region of mRNA encoded by MGC3113, corresponding to a HOST TARGET binding site such as BINDING SITE I, BINDING SITE II or BINDING SITE III. Table 2 illustrates the complementarity of the nucleotide sequences of MGC3113 BINDING SITE, designated SEQ ID:23469, to the nucleotide sequence of VGAM469 RNA, herein designated VGAM RNA, also designated SEQ ID:3180.

Another function of VGAM469 is therefore inhibition of MGC3113 (Accession NM_024035). Accordingly, utilities of VGAM469 include diagnosis, prevention and treatment of diseases and clinical conditions associated with MGC3113. Mucin 16 (MUC16, Accession XM_018353) is another VGAM469 host target gene. MUC16 BINDING SITE is HOST TARGET binding site found in the 5' untranslated region of mRNA encoded by MUC16, corresponding to a HOST TARGET binding site such as BINDING SITE I, BINDING SITE II or BINDING SITE III. Table 2 illustrates the complementarity of the nucleotide sequences of MUC16 BINDING SITE, designated SEQ ID:30356, to the nucleotide sequence of VGAM469 RNA, herein designated VGAM RNA, also designated SEQ ID:3180.

Another function of VGAM469 is therefore inhibition of Mucin 16 (MUC16, Accession XM_018353). Accordingly, utilities of VGAM469 include diagnosis, prevention and treatment of diseases and clinical conditions associated with MUC16. Myosin, Heavy Polypeptide 7B, Cardiac Muscle, Beta (MYH7B, Accession XM_047196) is another VGAM469 host target gene. MYH7B BINDING SITE is HOST TARGET binding site found in the 3" untranslated region of mRNA encoded by MYH7B, corresponding to a HOST TARGET binding site such as BINDING SITE I, BINDING SITE II or BINDING SITE III. Table 2 illustrates the complementarity of the nucleotide sequences of MYH7B BINDING SITE, designated SEQ ID:34909, to the nucleotide sequence of VGAM469 RNA, herein designated VGAM RNA, also designated SEQ ID:3180.

Another function of VGAM469 is therefore inhibition of Myosin, Heavy Polypeptide 7B, Cardiac Muscle, Beta (MYH7B, Accession XM_047196). Accordingly, utilities of VGAM469 include diagnosis, prevention and treatment of diseases and clinical conditions associated with MYH7B. PCTAIRE2BP (Accession XM_047341) is another VGAM469 host target gene. PCTAIRE2BP BINDING SITE is HOST TARGET binding site found in the 5" untranslated region of mRNA encoded by PCTAIRE2BP, corresponding to a HOST TARGET binding site such as BINDING SITE I, BINDING SITE II or BINDING SITE III. Table 2 illustrates the complementarity of the nucleotide sequences of PCTAIRE2BP BINDING SITE, designated SEQ ID:34952, to the nucleotide sequence of VGAM469 RNA, herein designated VGAM RNA, also designated SEQ ID:3180.

Another function of VGAM469 is therefore inhibition of PCTAIRE2BP (Accession XM_047341). Accordingly, utilities of VGAM469 include diagnosis, prevention and treatment of diseases and clinical conditions associated with PCTAIRE2BP. SEC8 (Accession NM_021807) is another VGAM469 host target gene. SEC8 BINDING SITE is HOST TARGET binding site found in the 3' untranslated region of mRNA encoded by SEC8, corresponding to a HOST TARGET binding site such as BINDING SITE I, BINDING SITE II or BINDING SITE III. Table 2 illustrates the complementarity of the nucleotide sequences of SEC8 BINDING SITE, designated SEQ ID:22362, to the nucleotide sequence of VGAM469 RNA, herein designated VGAM RNA, also designated SEQ ID:3180.

Another function of VGAM469 is therefore inhibition of SEC8 (Accession NM_021807). Accordingly, utilities of VGAM469 include diagnosis, prevention and treatment of diseases and clinical conditions associated with SEC8. SIMRP7 (Accession XM_166462) is another VGAM469 host target gene. SIMRP7 BINDING SITE is HOST TARGET binding site found in the 3' untranslated region of mRNA encoded by SIMRP7, corresponding to a HOST TARGET binding site such as BINDING SITE I, BINDING SITE II or BINDING SITE III. Table 2 illustrates the complementarity of the nucleotide sequences of SIMRP7 BINDING SITE, designated SEQ ID:44372, to the nucleotide sequence of VGAM469 RNA, herein designated VGAM RNA, also designated SEQ ID:3180.

Another function of VGAM469 is therefore inhibition of SIMRP7 (Accession XM_166462). Accordingly, utilities of VGAM469 include diagnosis, prevention and treatment of diseases and clinical conditions associated with SIMRP7. SS-56 (Accession XM_006063) is another VGAM469 host target gene. SS-56 BINDING SITE is HOST TARGET binding site found in the 5' untranslated region of mRNA encoded by SS-56, corresponding to a HOST TARGET binding site such as BINDING SITE I, BINDING SITE II or BINDING SITE III. Table 2 illustrates the complementarity of the nucleotide sequences of SS-56 BINDING SITE, designated SEQ ID:29990, to the nucleotide sequence of VGAM469 RNA, herein designated VGAM RNA, also designated SEQ ID:3180.

Another function of VGAM469 is therefore inhibition of SS-56 (Accession XM_006063). Accordingly, utilities of VGAM469 include diagnosis, prevention and treatment of diseases and clinical conditions associated with SS-56. LOC222962 (Accession XM_167291) is another VGAM469 host target gene. LOC222962 BINDING SITE is HOST TARGET binding site found in the 3' untranslated region of mRNA encoded by LOC222962, corresponding to a HOST TARGET binding site such as BINDING SITE I, BINDING SITE II or BINDING SITE III. Table 2 illustrates the complementarity of the nucleotide sequences of LOC222962 BINDING SITE, designated SEQ ID:44631, to the nucleotide sequence of VGAM469 RNA, herein designated VGAM RNA, also designated SEQ ID:3180.

Another function of VGAM469 is therefore inhibition of LOC222962 (Accession XM_167291). Accordingly, utilities of VGAM469 include diagnosis, prevention and treatment of diseases and clinical conditions associated with LOC222962. LOC255975 (Accession XM_171083) is another VGAM469 host target gene. LOC255975 BINDING SITE is HOST TARGET binding site found in the 5' untranslated region of mRNA encoded by LOC255975, corresponding to a HOST TARGET binding site such as BINDING SITE I, BINDING SITE II or BINDING SITE III. Table 2 illustrates the complementarity of the nucleotide sequences of LOC255975 BINDING SITE, designated SEQ ID:45889, to the nucleotide sequence of VGAM469 RNA, herein designated VGAM RNA, also designated SEQ ID:3180.

Another function of VGAM469 is therefore inhibition of LOC255975 (Accession XM_171083). Accordingly, utilities of VGAM469 include diagnosis, prevention and treatment of diseases and clinical conditions associated with LOC255975. LOC256401 (Accession XM_171149) is another VGAM469 host target gene. LOC256401 BINDING SITE is HOST TARGET binding site found in the 5' untranslated region of mRNA encoded by LOC256401, corresponding to a HOST TARGET binding site such as BINDING SITE I, BINDING SITE II or BINDING SITE III. Table 2 illustrates the complementarity of the nucleotide sequences of LOC256401 BINDING SITE, designated SEQ ID:45947, to the nucleotide sequence of VGAM469 RNA, herein designated VGAM RNA, also designated SEQ ID:3180.

Another function of VGAM469 is therefore inhibition of LOC256401 (Accession XM_171149). Accordingly, utilities of VGAM469 include diagnosis, prevention and treatment of diseases and clinical conditions associated with LOC256401. LOC90249 (Accession XM_030300) is another VGAM469 host target gene. LOC90249 BINDING SITE is HOST TARGET binding site found in the 3' untranslated region of mRNA encoded by LOC90249, corresponding to a HOST TARGET binding site such as BINDING SITE I, BINDING SITE II or BINDING SITE III. Table 2 illustrates the complementarity of the nucleotide sequences of LOC90249 BINDING SITE, designated SEQ ID:31014, to the nucleotide sequence of VGAM469 RNA, herein designated VGAM RNA, also designated SEQ ID:3180.

Another function of VGAM469 is therefore inhibition of LOC90249 (Accession XM_030300). Accordingly, utilities of VGAM469 include diagnosis, prevention and treatment of diseases and clinical conditions associated with LOC90249. FIG. 1 further provides a conceptual description of a novel bioinformatically detected viral gene of the present invention, referred to here as Viral Genomic Address Messenger 470 (VGAM470) viral gene, which modulates expression of respective host target genes thereof, the function and utility of which host target genes is known in the art.

VGAM470 is a novel bioinformatically detected regulatory, non protein coding, viral micro RNA (miRNA) gene. The method by which VGAM470 was detected is described hereinabove with reference to FIGS. 1-8.

VGAM470 gene, herein designated VGAM GENE, is a viral gene contained in the genome of African Swine Fever Virus. VGAM470 host target gene, herein designated VGAM HOST TARGET GENE, is a human gene contained in the human genome.

VGAM470 gene encodes a VGAM470 precursor RNA, herein designated VGAM PRECURSOR RNA. Similar to other miRNA genes, and unlike most ordinary genes, VGAM470 precursor RNA does not encode a protein. A nucleotide sequence identical or highly similar to the nucleotide sequence of VGAM470 precursor RNA is designated SEQ ID:456, and is provided hereinbelow with reference to the sequence listing part. Nucleotide sequence SEQ ID:456 is located at position 45550 relative to the genome of African Swine Fever Virus.

VGAM470 precursor RNA folds onto itself, forming VGAM470 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM470 folded precursor RNA into VGAM470 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM470 RNA is designated SEQ ID:3181, and is provided hereinbelow with reference to the sequence listing part.

VGAM470 host target gene, herein designated VGAM HOST TARGET GENE, encodes a corresponding messenger RNA, VGAM470 host target RNA, herein designated VGAM HOST TARGET RNA. VGAM470 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM470 RNA, herein designated VGAM RNA, binds complementarily to one or more host target binding sites located in untranslated regions of VGAM470 host target RNA, herein designated VGAM HOST TARGET RNA. This complementary binding is due to the fact that the nucleotide sequence of VGAM470 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM470 RNA, herein designated VGAM RNA, may have a different number of host target binding sites in untranslated regions of a VGAM470 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM470 RNA, herein designated VGAM RNA, to host target binding sites on VGAM470 host target RNA, herein designated VGAM HOST TARGET RNA, such as BINDING SITE I, BINDING SITE II and BINDING SITE III, inhibits translation of VGAM470 host target RNA into VGAM470 host target protein, herein designated VGAM HOST TARGET PROTEIN. VGAM host target protein is therefore outlined by a broken line.

It is appreciated that VGAM470 host target gene, herein designated VGAM HOST TARGET GENE, in fact represents a plurality of VGAM470 host target genes. The mRNA of each one of this plurality of VGAM470 host target genes comprises one or more host target binding sites, each having a nucleotide sequence which is at least partly complementary to VGAM470 RNA, herein designated VGAM RNA, and which when bound by VGAM470 RNA causes inhibition of translation of respective one or more VGAM470 host target proteins.

It is further appreciated by one skilled in the art that the mode of translational inhibition illustrated by FIG. 1 with specific reference to translational inhibition exerted by VGAM470 gene, herein designated VGAM GENE, on one or more VGAM470 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM470 is inhibition of expression of host target genes, as part of a novel viral mechanism of attacking a host. Accordingly, utilities of VGAM470 include diagnosis, prevention and treatment of viral infection by African Swine Fever Virus. Specific functions, and accordingly utilities, of VGAM470 correlate with, and may be deduced from, the identity of the host target genes which VGAM470 binds and inhibits, and the function of these host target genes, as elaborated hereinbelow.

Nucleotide sequences of the VGAM470 precursor RNA, herein designated VGAM PRECURSOR RNA, and of the 'diced' VGAM470 RNA, herein designated VGAM RNA, and a schematic representation of the secondary folding of VGAM470 folded precursor RNA, herein designated VGAM FOLDED PRECURSOR RNA, of VGAM470 are further described hereinbelow with reference to Table 1.

Nucleotide sequences of host target binding sites, such as BINDING SITE-I, BINDING SITE-II and BINDING SITE-III of FIG. 1, found on VGAM470 host target RNA, and schematic representation of the complementarity of each of these host target binding sites to VGAM470 RNA, herein designated VGAM RNA, are described hereinbelow with reference to Table 2.

As mentioned hereinabove with reference to FIG. 1, a function of VGAM470 gene, herein designated VGAM is inhibition of expression of VGAM470 target genes. It is appreciated that specific functions, and accordingly utilities, of VGAM470 correlate with, and may be deduced from, the identity of the target genes which VGAM470 binds and inhibits, and the function of these target genes, as elaborated hereinbelow.

Epilepsy, Progressive Myoclonus Type 2, Lafora Disease (laforin) (EPM2A, Accession NM_005670) is a VGAM470 host target gene. EPM2A BINDING SITE is HOST TARGET binding site found in the 3' untranslated region of mRNA encoded by EPM2A, corresponding to a HOST TARGET binding site such as BINDING SITE I, BINDING SITE II or BINDING SITE III. Table 2 illustrates the complementarity of the nucleotide sequences of EPM2A BINDING SITE, designated SEQ ID:12228, to the nucleotide sequence of VGAM470 RNA, herein designated VGAM RNA, also designated SEQ ID:3181.

A function of VGAM470 is therefore inhibition of Epilepsy, Progressive Myoclonus Type 2, Lafora Disease (laforin) (EPM2A, Accession NM_005670), a gene which Laforin; protein tyrosine phosphatase that may have role in glycogen metabolism. Accordingly, utilities of VGAM470 include diagnosis, prevention and treatment of diseases and clinical conditions associated with EPM2A. The function of EPM2A has been established by previous studies. In the Lafora type, onset takes the form of grand mal seizures and/or myoclonus at about age 15 years. Rapid and severe mental deterioration ensues, often with psychotic features. Survival is short, less than 10 years after onset. Histologic study of the brain shows Lafora bodies (which may also be demonstrable on muscle and liver biopsy). Intracellular Lafora bodies suggesting amyloid are found in the brain, and similar inclusions in the cells of the heart and liver (Harriman and Millar, 1955). The Lafora material has the properties of an acid mucopolysaccharide. Yokoi et al. (1968) arrived at a preliminary conclusion that the Lafora body is polyglucosan in nature. They pictured the existence of an enzyme defect which leads to deposition of polyglucosans near their site of synthesis in the agranular endoplasmic reticulum. Schwarz and Yanoff (1965) described a brother and sister, offspring of a one-and-one-half cousin marriage, with this disease. Seizures began at age 15 in the boy with slowly progressive motor and mental deterioration leading to death at age 23.5 years. The sister's seizures began at age 14 years and progression to dementia and blindness occurred, with death at age 19. Intra- and extra-cellular Lafora bodies were found in the CNS, retina, axis cylinders of spinal nerves, heart muscle, liver cells, and striated muscle fibers. Diagnosis by liver or muscle biopsy was proposed. Busard et al. (1986, 1987) demonstrated that the diagnosis can be made reliably on axillary skin biopsy; all patients show typical periodic acid-Schiff (PAS)-positive inclusions in the myoepithelial cells of the secretory acini of the apocrine glands and/or in the cells of the eccrine duct. The method has no value for carrier detection. In cultured fibroblasts, Fluharty et al. (1970) described bodies which may be the equivalent of the Lafora body observed histologically.

Sarlin et al. (1960) claimed that electroencephalographic abnormalities distinguished heterozygotes from homozygous normals. Norio and Koskiniemi (1979), as well as others, have concluded that there are 3 types of what they termed progressive myoclonic epilepsy (PME). The Lafora type shows onset of grand mal seizures and/or myoclonus around the fifteenth year of life; rapid and severe mental deterioration, often with psychotic symptoms; short survival; histologic finding of Lafora bodies; and autosomal recessive inheritance. The Unverricht-Lundborg type (EPM1; 254800), which is frequent in Finland, has onset around the tenth year; variable severity; progressive incapacitation from myoclonus associated with mild mental symptoms; variable survival; 'degenerative' histologic changes; and autosomal recessive inheritance. A dominant form, to which Hartung's name is attached (see OMIM Ref. No. 159600), has been described. By linkage studies in 3 Italian families with Lafora disease, Lehesjoki et al. (1992) demonstrated that the gene is located at a locus other than that for the Unverricht-Lundborg type on chromosome 21q22.3. Serratosa et al. (1995) studied linkage in 9 families in which Lafora disease had been proven by biopsy in at least 1 member. Using microsatellite markers spaced an average of 13 cM apart, they used linkage analysis in all 9 families and homozygosity mapping in 4 consanguineous families to assign the gene for Lafora disease to 6q23-q25. An extended pedigree with 5 affected members independently proved linkage. The multipoint 1-lod unit support interval covered a 2.5-cM region surrounding D6S403. Homozygosity mapping defined a 17-cM region in 6q23-q25 flanked by D6S292 and D6S420. The 9 families with a total of 19 patients affected with Lafora disease originated from the United States, Spain, Palestine, and Iran. Maddox et al. (1997) studied a 2-generation family in which a recombination event reduced the Lafora critical region to a 4-cM interval flanked by markers D6S308 and D6S311. Sainz et al. (1997) narrowed the assignment of the MELF locus within 6q24 by study of recombinants and homozygosities. Ganesh et al. (2000) cloned and expressed the full-length 38-kD laforin protein in transfected cells. Recombinant laforin was able to hydrolyze phosphotyrosine as well as phosphoserine/threonine substrates, demonstrating that laforin is an active dual-specificity phosphatase. Biochemical, immunofluorescence, and ultrastructural studies on transfected HeLa cells revealed that laforin is a cytoplasmic protein associated with polyribosomes. Expression of 2 proteins with missense mutations seen in EPM2A patients resulted in ubiquitin-positive perinuclear aggregates, suggesting that these were misfolded proteins targeted for degradation. The authors suggested that laforin is involved in translational regulation and that protein misfolding may be one of the molecular bases of the Lafora disease phenotype caused by missense mutations in the EPM2A gene. Gomez-Garre et al. (2000) reported the complete coding sequence of the EPM2A gene, including the ATG initiation codon region. They used SSCP analysis of the 4 exons in 34 unrelated patients with Lafora disease and identified EPM2A mutations in 27 (79%) of them (49 of 68 chromosomes, or 72%). The patients originated from Spain, Italy, Australia, Holland, the US, North Africa, Turkey, and France. A total of 20 different EPM2A mutations, 11 of them novel, were characterized. The authors summarized 25 EPM2A mutations distributed throughout the gene in 44 unrelated Lafora disease patients. The mutations included 10 deletions of different sizes, 9 missense mutations, 3 nonsense mutations, and 3 frameshift mutations. The R241X mutation (254780.0008) was encountered in almost 40% of the probands. In 5 Lafora disease families (13% of the families studied), Gomez-Garre et al. (2000) excluded linkage to the EPM2A gene region.

Full details of the abovementioned studies are described in the following publications, the disclosure of which are hereby incorporated by reference:

Norio, R.; Koskiniemi, M.: Progressive myoclonus epilepsy: genetic and nosological aspects with special reference to 107 Finnish patients. Clin. Genet. 15:382-398, 1979; and Gomez-Garre, P.; Sanz, Y.; Rodriguez de Cordoba, S.; Serratosa, J. M.: Mutational spectrum of the EPM2A gene in progressive myoclonus epilepsy of Lafora: high degree of allelic heterogen.

Further studies establishing the function and utilities of EPM2A are found in John Hopkins OMIM database record ID 254780, and in sited publications numbered 9099-9107, 9220-922 and 9229-9228 listed in the bibliography section hereinbelow, which are also hereby incorporated by reference. KIAA1493 (Accession XM_034415) is another VGAM470 host target gene. KIAA1493 BINDING SITE is HOST TARGET binding site found in the 3' untranslated region of mRNA encoded by KIAA1493, corresponding to a HOST TARGET binding site such as BINDING SITE I, BINDING SITE II or BINDING SITE III. Table 2 illustrates the complementarity of the nucleotide sequences of KIAA1493 BINDING SITE, designated SEQ ID:32094, to the nucleotide sequence of VGAM470 RNA, herein designated VGAM RNA, also designated SEQ ID:3181.

Another function of VGAM470 is therefore inhibition of KIAA1493 (Accession XM_034415). Accordingly, utilities of VGAM470 include diagnosis, prevention and treatment of diseases and clinical conditions associated with KIAA1493. KR18 (Accession NM_033288) is another VGAM470 host target gene. KR18 BINDING SITE is HOST TARGET binding site found in the 3' untranslated region of mRNA encoded by KR18, corresponding to a HOST TARGET binding site such as BINDING SITE I, BINDING SITE II or BINDING SITE III. Table 2 illustrates the complementarity of the nucleotide sequences of KR18 BINDING SITE, designated SEQ ID:27119, to the nucleotide sequence of VGAM470 RNA, herein designated VGAM RNA, also designated SEQ ID:3181.

Another function of VGAM470 is therefore inhibition of KR18 (Accession NM_033288). Accordingly, utilities of VGAM470 include diagnosis, prevention and treatment of diseases and clinical conditions associated with KR18. LOC169166 (Accession XM_095541) is another VGAM470 host target gene. LOC169166 BINDING SITE is HOST TARGET binding site found in the 3' untranslated region of mRNA encoded by LOC169166, corresponding to a HOST TARGET binding site such as BINDING SITE I, BINDING SITE II or BINDING SITE III. Table 2 illustrates the complementarity of the nucleotide sequences of LOC169166 BINDING SITE, designated SEQ ID:40272, to the nucleotide sequence of VGAM470 RNA, herein designated VGAM RNA, also designated SEQ ID:3181.

Another function of VGAM470 is therefore inhibition of LOC169166 (Accession XM_095541). Accordingly, utilities of VGAM470 include diagnosis, prevention and treatment of diseases and clinical conditions associated with LOC169166. LOC200301 (Accession XM_114197) is another VGAM470 host target gene. LOC200301 BINDING SITE is HOST TARGET binding site found in the 5' untranslated region of mRNA encoded by LOC200301, corresponding to a HOST TARGET binding site such as BINDING SITE I, BINDING SITE II or BINDING SITE III. Table 2 illustrates the complementarity of the nucleotide sequences of LOC200301 BINDING SITE, designated SEQ ID:42783, to the nucleotide sequence of VGAM470 RNA, herein designated VGAM RNA, also designated SEQ ID:3181.

Another function of VGAM470 is therefore inhibition of LOC200301 (Accession XM_114197). Accordingly, utilities of VGAM470 include diagnosis, prevention and treatment of diseases and clinical conditions associated with LOC200301. FIG. 1 further provides a conceptual description of a novel bioinformatically detected viral gene of the present invention, referred to here as Viral Genomic Address Messenger 471 (VGAM471) viral gene, which modulates expression of respective host target genes thereof, the function and utility of which host target genes is known in the art.

VGAM471 is a novel bioinformatically detected regulatory, non protein coding, viral micro RNA (miRNA) gene. The method by which VGAM471 was detected is described hereinabove with reference to FIGS. 1-8.

VGAM471 gene, herein designated VGAM GENE, is a viral gene contained in the genome of Human Herpesvirus 6. VGAM471 host target gene, herein designated VGAM HOST TARGET GENE, is a human gene contained in the human genome.

VGAM471 gene encodes a VGAM471 precursor RNA, herein designated VGAM PRECURSOR RNA. Similar to other miRNA genes, and unlike most ordinary genes, VGAM471 precursor RNA does not encode a protein. A nucleotide sequence identical or highly similar to the nucleotide sequence of VGAM471 precursor RNA is designated SEQ ID:457, and is provided hereinbelow with reference to the sequence listing part. Nucleotide sequence SEQ ID:457 is located at position 135287 relative to the genome of Human Herpesvirus 6.

VGAM471 precursor RNA folds onto itself, forming VGAM471 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM471 folded precursor RNA into VGAM471 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM471 RNA is designated SEQ ID:3182, and is provided hereinbelow with reference to the sequence listing part.

VGAM471 host target gene, herein designated VGAM HOST TARGET GENE, encodes a corresponding messenger RNA, VGAM471 host target RNA, herein designated VGAM HOST TARGET RNA. VGAM471 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM471 RNA, herein designated VGAM RNA, binds complementarily to one or more host target binding sites located in untranslated regions of VGAM471 host target RNA, herein designated VGAM HOST TARGET RNA. This complementary binding is due to the fact that the nucleotide sequence of VGAM471 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM471 RNA, herein designated VGAM RNA, may have a different number of host target binding sites in untranslated regions of a VGAM471 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM471 RNA, herein designated VGAM RNA, to host target binding sites on VGAM471 host target RNA, herein designated VGAM HOST TARGET RNA, such as BINDING SITE I, BINDING SITE II and BINDING SITE III, inhibits translation of VGAM471 host target RNA into VGAM471 host target protein, herein designated VGAM HOST TARGET PROTEIN. VGAM host target protein is therefore outlined by a broken line.

It is appreciated that VGAM471 host target gene, herein designated VGAM HOST TARGET GENE, in fact represents a plurality of VGAM471 host target genes. The mRNA of each one of this plurality of VGAM471 host target genes comprises one or more host target binding sites, each having a nucleotide sequence which is at least partly complementary to VGAM471 RNA, herein designated VGAM RNA, and which when bound by VGAM471 RNA causes inhibition of translation of respective one or more VGAM471 host target proteins.

It is further appreciated by one skilled in the art that the mode of translational inhibition illustrated by FIG. 1 with specific reference to translational inhibition exerted by VGAM471 gene, herein designated VGAM GENE, on one or more VGAM471 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM471 is inhibition of expression of host target genes, as part of a novel viral mechanism of attacking a host. Accordingly, utilities of VGAM471 include diagnosis, prevention and treatment of viral infection by Human Herpesvirus 6. Specific functions, and accordingly utilities, of VGAM471 correlate with, and may be deduced from, the identity of the host target genes which VGAM471 binds and inhibits, and the function of these host target genes, as elaborated hereinbelow.

Nucleotide sequences of the VGAM471 precursor RNA, herein designated VGAM PRECURSOR RNA, and of the 'diced' VGAM471 RNA, herein designated VGAM RNA, and a schematic representation of the secondary folding of VGAM471 folded precursor RNA, herein designated VGAM FOLDED PRECURSOR RNA, of VGAM471 are further described hereinbelow with reference to Table 1.

Nucleotide sequences of host target binding sites, such as BINDING SITE-I, BINDING SITE-II and BINDING SITE-III of FIG. 1, found on VGAM471 host target RNA, and schematic representation of the complementarity of each of these host target binding sites to VGAM471 RNA, herein designated VGAM RNA, are described hereinbelow with reference to Table 2.

As mentioned hereinabove with reference to FIG. 1, a function of VGAM471 gene, herein designated VGAM is inhibition of expression of VGAM471 target genes. It is appreciated that specific functions, and accordingly utilities, of VGAM471 correlate with, and may be deduced from, the identity of the target genes which VGAM471 binds and inhibits, and the function of these target genes, as elaborated hereinbelow.

Bone Morphogenetic Protein 1 (BMP1, Accession NM_006131) is a VGAM471 host target gene. BMP1 BINDING SITE is HOST TARGET binding site found in the 3' untranslated region of mRNA encoded by BMP1, corresponding to a HOST TARGET binding site such as BINDING SITE I, BINDING SITE II or BINDING SITE III. Table 2 illustrates the complementarity of the nucleotide sequences of BMP1 BINDING SITE, designated SEQ ID:12770, to the nucleotide sequence of VGAM471 RNA, herein designated VGAM RNA, also designated SEQ ID:3182.

A function of VGAM471 is therefore inhibition of Bone Morphogenetic Protein 1 (BMP1, Accession NM_006131), a gene which cleaves procollagens leading to formation of extracellular matrix. Accordingly, utilities of VGAM471 include diagnosis, prevention and treatment of diseases and clinical conditions associated with BMP1. The function of BMP1 and its association with various diseases and clinical conditions, has been established by previous studies, as described hereinabove with reference to VGAM247. Dihydropyrimidinase-like 2 (DPYSL2, Accession NM_001386) is another VGAM471 host target gene. DPYSL2 BINDING SITE is HOST TARGET binding site found in the 3' untranslated region of mRNA encoded by DPYSL2, corresponding to a HOST TARGET binding site such as BINDING SITE I, BINDING SITE II or BINDING SITE III. Table 2 illustrates the complementarity of the nucleotide sequences of DPYSL2 BINDING SITE, designated SEQ ID:7061, to the nucleotide sequence of VGAM471 RNA, herein designated VGAM RNA, also designated SEQ ID:3182.

Another function of VGAM471 is therefore inhibition of Dihydropyrimidinase-like 2 (DPYSL2, Accession NM_001386), a gene which is a member of the dihydropyrimidinase family. Accordingly, utilities of VGAM471 include diagnosis, prevention and treatment of diseases and clinical conditions associated with DPYSL2. The function of DPYSL2 and its association with various diseases and clinical conditions, has been established by previous studies, as described hereinabove with reference to VGAM217. Inhibitor of Kappa Light Polypeptide Gene Enhancer In B-cells, Kinase Gamma (IKBKG, Accession NM_003639) is another VGAM471 host target gene. IKBKG BINDING SITE is HOST TARGET binding site found in the 3' untranslated region of mRNA encoded by IKBKG, corresponding to a HOST TARGET binding site such as BINDING SITE I, BINDING SITE II or BINDING SITE III. Table 2 illustrates the complementarity of the nucleotide sequences of IKBKG BINDING SITE, designated SEQ ID:9711, to the nucleotide sequence of VGAM471 RNA, herein designated VGAM RNA, also designated SEQ ID:3182.

Another function of VGAM471 is therefore inhibition of Inhibitor of Kappa Light Polypeptide Gene Enhancer In B-cells, Kinase Gamma (IKBKG, Accession NM_003639), a gene which regulatory subunit part of the ikk-signalosome complex activation. also considered to be a mediator for tax activation of nf-kappa-b. could be implicated in nf-kappa-b-mediated protection from cytokine toxicity. Accordingly, utilities of VGAM471 include diagnosis, prevention and treatment of diseases and clinical conditions associated with IKBKG. The function of IKBKG has been established by previous studies. Yamaoka et al. (1998) characterized a mutant cell line, 5R, originally isolated as a cellular flat variant of Rat-1 fibroblasts transformed by the Tax protein of human T-cell leukemia virus type 1 (OMIM Ref. No. HTLV-1). The 5R cell line was unresponsive to all tested NF-kappa-B (NFKB; OMIM Ref. No. 164011)-activating stimuli. Using a genetic complementation approach, Yamaoka et al. (1998) cloned a component of the I-kappa-B kinase complex that they termed NEMO for 'NF-kappa-B essential modulator' from 5R cells. The 2.8-kb NEMO cDNA encodes a 412-amino acid protein that is acidic, rich in glutamic acid and glutamine residues (each 13%), and contains a leucine zipper motif at amino acids 315-342. Yamaoka et al. (1998) determined that the defective phenotype of 5R cells resulted from the absence of the NEMO protein. NEMO also complemented the 1.3E2 mutant cell line, in which NFKB is not activated in response to a large set of stimuli. NEMO interacted with IKK2 (IKK-beta; 603258), but not with IKK1 (IKK-alpha; 600664). Aradhya et al. (2001) identified a truncated copy of NEMO (delta-NEMO), which maps 22 kb distal to NEMO and contains only exons 3 through 10. A sequence of 26 kb 3-prime of the NEMO coding sequence is also present in the same position relative to the delta-NEMO locus, bringing the total length of the duplication to 35.5 kb. The LAGE2 gene is also located within this duplicated region, and a similar but unique LAGE1 gene is located just distal to the duplicated loci. Mapping and sequence information indicated that the duplicated regions are in opposite orientation. Analysis of the great apes suggested that the NEMO/LAGE2 duplication occurred after divergence of the lineage leading to present day human S, chimpanzees, and gorillas, 10 to 15 million years ago. Despite this substantial evolutionary history, only 22 single-nucleotide differences exist between the 2 copies over the entire 35.5 kb, making the duplications more than 99% identical. This high sequence identity and the inverted orientations of the 2 copies, along with duplications of smaller internal sections within each copy, predispose this region to various genomic alterations. Aradhya et al. (2001) detected 4 rearrangements that involved NEMO, delta-NEMO, or LAGE1 and LAGE2. The authors hypothesized that the susceptibility of this complex genomic region to various types of pathogenic and polymorphic rearrangements may underlie the recurrent lethal deletion associated with IP Animal model experiments lend further support to the function of IKBKG. Schmidt-Supprian et al. (2000) found that disruption of the mouse Ikbkg gene produces male embryonic lethality, completely blocks NF-kappa-B activation by proinflammatory cytokines, and interferes with the generation and/or persistence of lymphocytes. Heterozygous female mice developed patchy skin lesions with massive granulocyte infiltration and hyperproliferation and increased apoptosis of keratinocytes. Diseased animals presented severe growth retardation and early mortality. Surviving mice recovered almost completely, presumably through clearing the skin of Ikbkg-deficient keratinocytes. The authors stated that male lethality and strikingly similar skin lesions in heterozygous females are hallmarks of the human genetic disorder IP2

It is appreciated that the abovementioned animal model for IKBKG is acknowledged by those skilled in the art as a scientifically valid animal model, as can be further appreciated from the publications sited hereinbelow.

Full details of the abovementioned studies are described in the following publications, the disclosure of which are hereby incorporated by reference:

Schmidt-Supprian, M.; Bloch, W.; Courtois, G.; Addicks, K.; Israel, A.; Rajewsky, K.; Pasparakis, M.: NEMO/IKK-gamma-deficient mice model incontinentia pigmenti. Molec. Cell 5:981-992, 2000; and Aradhya, S.; Bardaro, T.; Galgoczy, P.; Yamagata, T.; Esposito, T.; Patlan, H.; Ciccodicola, A.; Munnich, A.; Kenwrick, S.; Platzer, M.; d'urso, M.; Nelson, D. L.: Multiple pathogenic.

Further studies establishing the function and utilities of IKBKG are found in John Hopkins OMIM database record ID 300248, and in sited publications numbered 9191-9192, 919 and 9195-9209 listed in the bibliography section hereinbelow, which are also hereby incorporated by reference. Myeloma Overexpressed Gene (in a subset of t (11;14) Positive Multiple Myelomas) (MYEOV, Accession NM_138768) is another VGAM471 host target gene. MYEOV BINDING SITE is HOST TARGET binding site found in the 5' untranslated region of mRNA encoded by MYEOV, corresponding to a HOST TARGET binding site such as BINDING SITE I, BINDING SITE II or BINDING SITE III. Table 2 illustrates the complementarity of the nucleotide sequences of MYEOV BINDING SITE, designated SEQ ID:29001, to the nucleotide sequence of VGAM471 RNA, herein designated VGAM RNA, also designated SEQ ID:3182.

Another function of VGAM471 is therefore inhibition of Myeloma Overexpressed Gene (in a subset of t (11;14) Positive Multiple Myelomas) (MYEOV, Accession NM_138768), a gene which is encoded by MYELOMA OVEREXPRESSED GENE. Accordingly, utilities of VGAM471 include diagnosis, prevention and treatment of diseases and clinical conditions associated with MYEOV. The function of MYEOV has been established by previous studies. By cloning gastric carcinoma tumor DNA into phage vectors, probing with human Alu repetitive sequences, and exon-trap analysis, Janssen et al. (2000) isolated a cDNA encoding MYEOV (myeloma overexpressed gene). Sequence analysis predicted that the 313-amino acid protein contains no known functional motifs except for an RNP1 motif typical of RNA-binding proteins and a leucine-isoleucine tail similar to cytoplasmically exposed membrane proteins with a C-terminal membrane anchor. Northern blot analysis detected a major 2.8-kb and a minor 3.5-kb transcript in various tumor cell lines. In 3 of 7 multiple myeloma cell lines with a t (11;14)(q13; q32) and cyclin D1 (CCND1; 168461) overexpression, Northern blot analysis determined that MYEOV was overexpressed. In all 7 cell lines, the breakpoint was mapped to the 360-kb region between the 2 genes. MYEOV overexpression was associated with the juxtaposition of an enhancer to the MYEOV gene. Using FISH, Janssen et al. (2000) mapped the MYEOV gene to 11q13.1, 360 kb centromeric to CCND1. DNA amplifications at 11q13 are frequently observed in esophageal squamous cell carcinoma (OMIM Ref. No. 133239) and correlate with a malignant phenotype. Although this amplicon spans a region of several megabases and harbors numerous genes, CCND1 and EMS1 (OMIM Ref. No. 164765) are thought to be the relevant candidates in esophageal carcinoma. Janssen et al. (2002) investigated whether the putative transforming gene MYEOV, mapping 360 kb centromeric to CCND1 and activated concomitantly with CCND1 in a subset of t (11;14) (q13; q32) positive multiple myeloma cell lines, represents a target of 11q13 amplification in esophageal carcinoma. They tested 31 esophageal squamous cell carcinoma cell lines and 48 primary tumors for copy number levels of MYEOV and demonstrated that MYEOV was always coamplified with CCND1. However, its activation was sometimes inhibited by an epigenetic mechanism.

Full details of the abovementioned studies are described in the following publications, the disclosure of which are hereby incorporated by reference:

Janssen, J. W. G.; Imoto, I.; Inoue, J.; Shimada, Y.; Ueda, M.; Imamura, M.; Bartram, C. R.; Inazawa, J.: MYEOV, a gene at 11q13, is coamplified with CCND1, but epigenetically inactivated in a subset of esophageal squamous cell carcinomas. J. Hum. Genet. 47:460-464, 2002; and Janssen, J. W. G.; Vaandrager, J.-W.; Heuser, T.; Jauch, A.; Kluin, P. M.; Geelen, E.; Bergsagel, P. L.; Kuehl, W. M.; Drexler, H. G.; Otsuki, T.; Bartram, C. R.; Schuuring, E.: Concu.

Further studies establishing the function and utilities of MYEOV are found in John Hopkins OMIM database record ID 605625, and in sited publications numbered 6958-6959 listed in the bibliography section hereinbelow, which are also hereby incorporated by reference. Platelet-derived Growth Factor Receptor, Beta Polypeptide (PDGFRB, Accession XM_038350) is another VGAM471 host target gene. PDGFRB BINDING SITE is HOST TARGET binding site found in the 3" untranslated region of mRNA encoded by PDGFRB, corresponding to a HOST TARGET binding site such as BINDING SITE I, BINDING SITE II or BINDING SITE III. Table 2 illustrates the complementarity of the nucleotide sequences of PDGFRB BINDING SITE, designated SEQ ID:32812, to the nucleotide sequence of VGAM471 RNA, herein designated VGAM RNA, also designated SEQ ID:3182.

Another function of VGAM471 is therefore inhibition of Platelet-derived Growth Factor Receptor, Beta Polypeptide (PDGFRB, Accession XM_038350), a gene which Platelet-derived growth factor receptor beta chain; tyrosine kinase receptor. Accordingly, utilities of VGAM471 include diagnosis, prevention and treatment of diseases and clinical conditions associated with PDGFRB. The function of PDGFRB and its association with various diseases and clinical conditions, has been established by previous studies, as described hereinabove with reference to VGAM125. Sulfotransferase Family, Cytosolic, 1C, Member 1 (SULT1C1, Accession NM_001056) is another VGAM471 host target gene. SULT1C1 BINDING SITE is HOST TARGET binding site found in the 3" untranslated region of mRNA encoded by SULT1C1, corresponding to a HOST TARGET binding site such as BINDING SITE I, BINDING SITE II or BINDING SITE III. Table 2 illustrates the complementarity of the nucleotide sequences of SULT1C1 BINDING SITE, designated SEQ ID:6719, to the nucleotide sequence of VGAM471 RNA, herein designated VGAM RNA, also designated SEQ ID:3182.

Another function of VGAM471 is therefore inhibition of Sulfotransferase Family, Cytosolic, 1C, Member 1 (SULT1C1, Accession NM_001056). Accordingly, utilities of VGAM471 include diagnosis, prevention and treatment of diseases and clinical conditions associated with SULT1C1. DKFZP566B183 (Accession NM_015509) is another VGAM471 host target gene. DKFZP566B183 BINDING SITE is HOST TARGET binding site found in the 3' untranslated region of mRNA encoded by DKFZP566B183, corresponding to a HOST TARGET binding site such as BINDING SITE I, BINDING SITE II or BINDING SITE III. Table 2 illustrates the complementarity of the nucleotide sequences of DKFZP566B183 BINDING SITE, designated SEQ ID:17767, to the nucleotide sequence of VGAM471 RNA, herein designated VGAM RNA, also designated SEQ ID:3182.

Another function of VGAM471 is therefore inhibition of DKFZP566B183 (Accession NM_015509). Accordingly, utilities of VGAM471 include diagnosis, prevention and treatment of diseases and clinical conditions associated with DKFZP566B183. DNAM-1 (Accession NM_006566) is another VGAM471 host target gene. DNAM-1 BINDING SITE is HOST TARGET binding site found in the 3' untranslated region of mRNA encoded by DNAM-1, corresponding to a HOST TARGET binding site such as BINDING SITE I, BINDING SITE II or BINDING SITE III. Table 2 illustrates the complementarity of the nucleotide sequences of DNAM-1 BINDING SITE, designated SEQ ID:13336, to the nucleotide sequence of VGAM471 RNA, herein designated VGAM RNA, also designated SEQ ID:3182.

Another function of VGAM471 is therefore inhibition of DNAM-1 (Accession NM_006566). Accordingly, utilities of VGAM471 include diagnosis, prevention and treatment of diseases and clinical conditions associated with DNAM-1. FLJ10751 (Accession NM_018205) is another VGAM471 host target gene. FLJ10751 BINDING SITE1 and FLJ10751 BINDING SITE2 are HOST TARGET binding sites found in untranslated regions of mRNA encoded by FLJ10751, corresponding to HOST TARGET binding sites such as BINDING SITE I, BINDING SITE II or BINDING SITE III. Table 2 illustrates the complementarity of the nucleotide sequences of FLJ10751 BINDING SITE1 and FLJ10751 BINDING SITE2, designated SEQ ID:20093 and SEQ ID:20192 respectively, to the nucleotide sequence of VGAM471 RNA, herein designated VGAM RNA, also designated SEQ ID:3182.

Another function of VGAM471 is therefore inhibition of FLJ10751 (Accession NM_018205). Accordingly, utilities of VGAM471 include diagnosis, prevention and treatment of diseases and clinical conditions associated with FLJ10751. KIAA1538 (Accession XM_049474) is another VGAM471 host target gene. KIAA1538 BINDING SITE is HOST TARGET binding site found in the 3' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35429, to the nucleotide sequence of VGAM471 RNA, herein designated VGAM RNA, also designated SEQ ID:3182.

Another function of VGAM471 is therefore inhibition of KIAA1538 (Accession XM_049474). Accordingly, utilities of VGAM471 include diagnosis, prevention and treatment of diseases and clinical conditions associated with KIAA1538. LEC3 (Accession NM_015236) is another VGAM471 host target gene. LEC3 BINDING SITE is HOST TARGET binding site found in the 3' untranslated region of mRNA encoded by LEC3, corresponding to a HOST TARGET binding site such as BINDING SITE I, BINDING SITE II or BINDING SITE III. Table 2 illustrates the complementarity of the nucleotide sequences of LEC3 BINDING SITE, designated SEQ ID:17565, to the nucleotide sequence of VGAM471 RNA, herein designated VGAM RNA, also designated SEQ ID:3182.

Another function of VGAM471 is therefore inhibition of LEC3 (Accession NM_015236). Accordingly, utilities of VGAM471 include diagnosis, prevention and treatment of diseases and clinical conditions associated with LEC3. SNRK (Accession NM_017719) is another VGAM471 host target gene. SNRK BINDING SITE is HOST TARGET binding site found in the 3' untranslated region of mRNA encoded by SNRK, corresponding to a HOST TARGET binding site such as BINDING SITE I, BINDING SITE II or BINDING SITE III. Table 2 illustrates the complementarity of the nucleotide sequences of SNRK BINDING SITE, designated SEQ ID:19307, to the nucleotide sequence of VGAM471 RNA, herein designated VGAM RNA, also designated SEQ ID:3182.

Another function of VGAM471 is therefore inhibition of SNRK (Accession NM_017719). Accordingly, utilities of VGAM471 include diagnosis, prevention and treatment of diseases and clinical conditions associated with SNRK. LOC151195 (Accession XM_087125) is another VGAM471 host target gene. LOC151195 BINDING SITE is HOST TARGET binding site found in the 3' untranslated region of mRNA encoded by LOC151195, corresponding to a HOST TARGET binding site such as BINDING SITE I, BINDING SITE II or BINDING SITE III. Table 2 illustrates the complementarity of the nucleotide sequences of LOC151195 BINDING SITE, designated SEQ ID:39075, to the nucleotide sequence of VGAM471 RNA, herein designated VGAM RNA, also designated SEQ ID:3182.

Another function of VGAM471 is therefore inhibition of LOC151195 (Accession XM_087125). Accordingly, utilities of VGAM471 include diagnosis, prevention and treatment of diseases and clinical conditions associated with LOC151195. LOC201952 (Accession XM_117345) is another VGAM471 host target gene. LOC201952 BINDING SITE is HOST TARGET binding site found in the 5' untranslated region of mRNA encoded by LOC201952, corresponding to a HOST TARGET binding site such as BINDING SITE I, BINDING SITE II or BINDING SITE III. Table 2 illustrates the complementarity of the nucleotide sequences of LOC201952 BINDING SITE, designated SEQ ID:43395, to the nucleotide sequence of VGAM471 RNA, herein designated VGAM RNA, also designated SEQ ID:3182.

Another function of VGAM471 is therefore inhibition of LOC201952 (Accession XM_117345). Accordingly, utilities of VGAM471 include diagnosis, prevention and treatment of diseases and clinical conditions associated with LOC201952. LOC222183 (Accession XM_168436) is another VGAM471 host target gene. LOC222183 BINDING SITE is HOST TARGET binding site found in the 3' untranslated region of mRNA encoded by LOC222183, corresponding to a HOST TARGET binding site such as BINDING SITE I, BINDING SITE II or BINDING SITE III. Table 2 illustrates the complementarity of the nucleotide sequences of LOC222183 BINDING SITE, designated SEQ ID:45186, to the nucleotide sequence of VGAM471 RNA, herein designated VGAM RNA, also designated SEQ ID:3182.

Another function of VGAM471 is therefore inhibition of LOC222183 (Accession XM_168436). Accordingly, utilities of VGAM471 include diagnosis, prevention and treatment of diseases and clinical conditions associated with LOC222183. FIG. 1 further provides a conceptual description of a novel bioinformatically detected viral gene of the present invention, referred to here as Viral Genomic Address Messenger 472 (VGAM472) viral gene, which modulates expression of respective host target genes thereof, the function and utility of which host target genes is known in the art.

VGAM472 is a novel bioinformatically detected regulatory, non protein coding, viral micro RNA (miRNA) gene. The method by which VGAM472 was detected is described hereinabove with reference to FIGS. 1-8.

VGAM472 gene, herein designated VGAM GENE, is a viral gene contained in the genome of Tick-borne Encephalitis Virus. VGAM472 host target gene, herein designated VGAM HOST TARGET GENE, is a human gene contained in the human genome.

VGAM472 gene encodes a VGAM472 precursor RNA, herein designated VGAM PRECURSOR RNA. Similar to other miRNA genes, and unlike most ordinary genes, VGAM472 precursor RNA does not encode a protein. A nucleotide sequence identical or highly similar to the nucleotide sequence of VGAM472 precursor RNA is designated SEQ ID:458, and is provided hereinbelow with reference to the sequence listing part. Nucleotide sequence SEQ ID:458 is located at position 8516 relative to the genome of Tick-borne Encephalitis Virus.

VGAM472 precursor RNA folds onto itself, forming VGAM472 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM472 folded precursor RNA into VGAM472 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM472 RNA is designated SEQ ID:3183, and is provided hereinbelow with reference to the sequence listing part.

VGAM472 host target gene, herein designated VGAM HOST TARGET GENE, encodes a corresponding messenger RNA, VGAM472 host target RNA, herein designated VGAM HOST TARGET RNA. VGAM472 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM472 RNA, herein designated VGAM RNA, binds complementarily to one or more host target binding sites located in untranslated regions of VGAM472 host target RNA, herein designated VGAM HOST TARGET RNA. This complementary binding is due to the fact that the nucleotide sequence of VGAM472 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM472 RNA, herein designated VGAM RNA, may have a different number of host target binding sites in untranslated regions of a VGAM472 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM472 RNA, herein designated VGAM RNA, to host target binding sites on VGAM472 host target RNA, herein designated VGAM HOST TARGET RNA, such as BINDING SITE I, BINDING SITE II and BINDING SITE III, inhibits translation of VGAM472 host target RNA into VGAM472 host target protein, herein designated VGAM HOST TARGET PROTEIN. VGAM host target protein is therefore outlined by a broken line.

It is appreciated that VGAM472 host target gene, herein designated VGAM HOST TARGET GENE, in fact represents a plurality of VGAM472 host target genes. The mRNA of each one of this plurality of VGAM472 host target genes comprises one or more host target binding sites, each having a nucleotide sequence which is at least partly complementary to VGAM472 RNA, herein designated VGAM RNA, and which when bound by VGAM472 RNA causes inhibition of translation of respective one or more VGAM472 host target proteins.

It is further appreciated by one skilled in the art that the mode of translational inhibition illustrated by FIG. 1 with specific reference to translational inhibition exerted by VGAM472 gene, herein designated VGAM GENE, on one or more VGAM472 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM472 is inhibition of expression of host target genes, as part of a novel viral mechanism of attacking a host. Accordingly, utilities of VGAM472 include diagnosis, prevention and treatment of viral infection by Tick-borne Encephalitis Virus. Specific functions, and accordingly utilities, of VGAM472 correlate with, and may be deduced from, the identity of the host target genes which VGAM472 binds and inhibits, and the function of these host target genes, as elaborated hereinbelow.

Nucleotide sequences of the VGAM472 precursor RNA, herein designated VGAM PRECURSOR RNA, and of the 'diced' VGAM472 RNA, herein designated VGAM RNA, and a schematic representation of the secondary folding of VGAM472 folded precursor RNA, herein designated VGAM FOLDED PRECURSOR RNA, of VGAM472 are further described hereinbelow with reference to Table 1.

Nucleotide sequences of host target binding sites, such as BINDING SITE-I, BINDING SITE-II and BINDING SITE-III of FIG. 1, found on VGAM472 host target RNA, and schematic representation of the complementarity of each of these host target binding sites to VGAM472 RNA, herein designated VGAM RNA, are described hereinbelow with reference to Table 2.

As mentioned hereinabove with reference to FIG. 1, a function of VGAM472 gene, herein designated VGAM is inhibition of expression of VGAM472 target genes. It is appreciated that specific functions, and accordingly utilities, of VGAM472 correlate with, and may be deduced from, the identity of the target genes which VGAM472 binds and inhibits, and the function of these target genes, as elaborated hereinbelow.

F-box Only Protein 9 (FBXO9, Accession NM_033481) is a VGAM472 host target gene. FBXO9 BINDING SITE is HOST TARGET binding site found in the 5' untranslated region of mRNA encoded by FBXO9, corresponding to a HOST TARGET binding site such as BINDING SITE I, BINDING SITE II or BINDING SITE III. Table 2 illustrates the complementarity of the nucleotide sequences of FBXO9 BINDING SITE, designated SEQ ID:27260, to the nucleotide sequence of VGAM472 RNA, herein designated VGAM RNA, also designated SEQ ID:3183.

A function of VGAM472 is therefore inhibition of F-box Only Protein 9 (FBXO9, Accession NM_033481). Accordingly, utilities of VGAM472 include diagnosis, prevention and treatment of diseases and clinical conditions associated with FBXO9. FLJ14950 (Accession NM_032865) is another VGAM472 host target gene. FLJ14950 BINDING SITE is HOST TARGET binding site found in the 3' untranslated region of mRNA encoded by FLJ14950, corresponding to a HOST TARGET binding site such as BINDING SITE I, BINDING SITE II or BINDING SITE III. Table 2 illustrates the complementarity of the nucleotide sequences of FLJ14950 BINDING SITE, designated SEQ ID:26674, to the nucleotide sequence of VGAM472 RNA, herein designated VGAM RNA, also designated SEQ ID:3183.

Another function of VGAM472 is therefore inhibition of FLJ14950 (Accession NM_032865). Accordingly, utilities of VGAM472 include diagnosis, prevention and treatment of diseases and clinical conditions associated with FLJ14950. FLJ22362 (Accession NM_022823) is another VGAM472 host target gene. FLJ22362 BINDING SITE is HOST TARGET binding site found in the 5' untranslated region of mRNA encoded by FLJ22362, corresponding to a HOST TARGET binding site such as BINDING SITE I, BINDING SITE II or BINDING SITE III. Table 2 illustrates the complementarity of the nucleotide sequences of FLJ22362 BINDING SITE, designated SEQ ID:23103, to the nucleotide sequence of VGAM472 RNA, herein designated VGAM RNA, also designated SEQ ID:3183.

Another function of VGAM472 is therefore inhibition of FLJ22362 (Accession NM_022823). Accordingly, utilities of VGAM472 include diagnosis, prevention and treatment of diseases and clinical conditions associated with FLJ22362. KIAA0427 (Accession NM_014772) is another VGAM472 host target gene. KIAA0427 BINDING SITE is HOST TARGET binding site found in the 3' untranslated region of mRNA encoded by KIAA0427, corresponding to a HOST TARGET binding site such as BINDING SITE I, BINDING SITE II or BINDING SITE III. Table 2 illustrates the complementarity of the nucleotide sequences of KIAA0427 BINDING SITE, designated SEQ ID:16578, to the nucleotide sequence of VGAM472 RNA, herein designated VGAM RNA, also designated SEQ ID:3183.

Another function of VGAM472 is therefore inhibition of KIAA0427 (Accession NM_014772). Accordingly, utilities of VGAM472 include diagnosis, prevention and treatment of diseases and clinical conditions associated with KIAA0427. KIAA0478 (Accession NM_014870) is another VGAM472 host target gene. KIAA0478 BINDING SITE is HOST TARGET binding site found in the 3' untranslated region of mRNA encoded by KIAA0478, corresponding to a HOST TARGET binding site such as BINDING SITE I, BINDING SITE II or BINDING SITE III. Table 2 illustrates the complementarity of the nucleotide sequences of KIAA0478 BINDING SITE, designated SEQ ID:16981, to the nucleotide sequence of VGAM472 RNA, herein designated VGAM RNA, also designated SEQ ID:3183.

Another function of VGAM472 is therefore inhibition of KIAA0478 (Accession NM_014870). Accordingly, utilities of VGAM472 include diagnosis, prevention and treatment of diseases and clinical conditions associated with KIAA0478. KIAA1530 (Accession XM_042661) is another VGAM472 host target gene. KIAA1530 BINDING SITE is HOST TARGET binding site found in the 3' untranslated region of mRNA encoded by KIAA1530, corresponding to a HOST TARGET binding site such as BINDING SITE I, BINDING SITE II or BINDING SITE III. Table 2 illustrates the complementarity of the nucleotide sequences of KIAA1530 BINDING SITE, designated SEQ ID:33730, to the nucleotide sequence of VGAM472 RNA, herein designated VGAM RNA, also designated SEQ ID:3183.

Another function of VGAM472 is therefore inhibition of KIAA1530 (Accession XM_042661). Accordingly, utilities of VGAM472 include diagnosis, prevention and treatment of diseases and clinical conditions associated with KIAA1530. LOC145676 (Accession XM_085202) is another VGAM472 host target gene. LOC145676 BINDING SITE is HOST TARGET binding site found in the 5' untranslated region of mRNA encoded by LOC145676, corresponding to a HOST TARGET binding site such as BINDING SITE I, BINDING SITE II or BINDING SITE III. Table 2 illustrates the complementarity of the nucleotide sequences of LOC145676 BINDING SITE, designated SEQ ID:37921, to the nucleotide sequence of VGAM472 RNA, herein designated VGAM RNA, also designated SEQ ID:3183.

Another function of VGAM472 is therefore inhibition of LOC145676 (Accession XM_085202). Accordingly, utilities of VGAM472 include diagnosis, prevention and treatment of diseases and clinical conditions associated with LOC145676. LOC220575 (Accession XM_083991) is another VGAM472 host target gene. LOC220575 BINDING SITE is HOST TARGET binding site found in the 3' untranslated region of mRNA encoded by LOC220575, corresponding to a HOST TARGET binding site such as BINDING SITE I, BINDING SITE II or BINDING SITE III. Table 2 illustrates the complementarity of the nucleotide sequences of LOC220575 BINDING SITE, designated SEQ ID:37527, to the nucleotide sequence of VGAM472 RNA, herein designated VGAM RNA, also designated SEQ ID:3183.

Another function of VGAM472 is therefore inhibition of LOC220575 (Accession XM_083991). Accordingly, utilities of VGAM472 include diagnosis, prevention and treatment of diseases and clinical conditions associated with LOC220575. LOC91547 (Accession XM_039093) is another VGAM472 host target gene. LOC91547 BINDING SITE is HOST TARGET binding site found in the 3' untranslated region of mRNA encoded by LOC91547, corresponding to a HOST TARGET binding site such as BINDING SITE I, BINDING SITE II or BINDING SITE III. Table 2 illustrates the complementarity of the nucleotide sequences of LOC91547 BINDING SITE, designated SEQ ID:33002, to the nucleotide sequence of VGAM472 RNA, herein designated VGAM RNA, also designated SEQ ID:3183.

Another function of VGAM472 is therefore inhibition of LOC91547 (Accession XM_039093). Accordingly, utilities of VGAM472 include diagnosis, prevention and treatment of diseases and clinical conditions associated with LOC91547. FIG. 1 further provides a conceptual description of a novel bioinformatically detected viral gene of the present invention, referred to here as Viral Genomic Address Messenger 473 (VGAM473) viral gene, which modulates expression of respective host target genes thereof, the function and utility of which host target genes is known in the art.

VGAM473 is a novel bioinformatically detected regulatory, non protein coding, viral micro RNA (miRNA) gene. The method by which VGAM473 was detected is described hereinabove with reference to FIGS. 1-8.

VGAM473 gene, herein designated VGAM GENE, is a viral gene contained in the genome of Tick-borne Encephalitis Virus. VGAM473 host target gene, herein designated VGAM HOST TARGET GENE, is a human gene contained in the human genome.

VGAM473 gene encodes a VGAM473 precursor RNA, herein designated VGAM PRECURSOR RNA. Similar to other miRNA genes, and unlike most ordinary genes, VGAM473 precursor RNA does not encode a protein. A nucleotide sequence identical or highly similar to the nucleotide sequence of VGAM473 precursor RNA is designated SEQ ID:459, and is provided hereinbelow with reference to the sequence listing part. Nucleotide sequence SEQ ID:459 is located at position 9825 relative to the genome of Tick-borne Encephalitis Virus.

VGAM473 precursor RNA folds onto itself, forming VGAM473 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM473 folded precursor RNA into VGAM473 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM473 RNA is designated SEQ ID:3184, and is provided hereinbelow with reference to the sequence listing part.

VGAM473 host target gene, herein designated VGAM HOST TARGET GENE, encodes a corresponding messenger RNA, VGAM473 host target RNA, herein designated VGAM HOST TARGET RNA. VGAM473 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM473 RNA, herein designated VGAM RNA, binds complementarily to one or more host target binding sites located in untranslated regions of VGAM473 host target RNA, herein designated VGAM HOST TARGET RNA. This complementary binding is due to the fact that the nucleotide sequence of VGAM473 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM473 RNA, herein designated VGAM RNA, may have a different number of host target binding sites in untranslated regions of a VGAM473 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM473 RNA, herein designated VGAM RNA, to host target binding sites on VGAM473 host target RNA, herein designated VGAM HOST TARGET RNA, such as BINDING SITE I, BINDING SITE II and BINDING SITE III, inhibits translation of VGAM473 host target RNA into VGAM473 host target protein, herein designated VGAM HOST TARGET PROTEIN. VGAM host target protein is therefore outlined by a broken line.

It is appreciated that VGAM473 host target gene, herein designated VGAM HOST TARGET GENE, in fact represents a plurality of VGAM473 host target genes. The mRNA of each one of this plurality of VGAM473 host target genes comprises one or more host target binding sites, each having a nucleotide sequence which is at least partly complementary to VGAM473 RNA, herein designated VGAM RNA, and which when bound by VGAM473 RNA causes inhibition of translation of respective one or more VGAM473 host target proteins.

It is further appreciated by one skilled in the art that the mode of translational inhibition illustrated by FIG. 1 with specific reference to translational inhibition exerted by VGAM473 gene, herein designated VGAM GENE, on one or more VGAM473 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM473 is inhibition of expression of host target genes, as part of a novel viral mechanism of attacking a host. Accordingly, utilities of VGAM473 include diagnosis, prevention and treatment of viral infection by Tick-borne Encephalitis Virus. Specific functions, and accordingly utilities, of VGAM473 correlate with, and may be deduced from, the identity of the host target genes which VGAM473 binds and inhibits, and the function of these host target genes, as elaborated hereinbelow.

Nucleotide sequences of the VGAM473 precursor RNA, herein designated VGAM PRECURSOR RNA, and of the 'diced' VGAM473 RNA, herein designated VGAM RNA, and a schematic representation of the secondary folding of VGAM473 folded precursor RNA, herein designated VGAM FOLDED PRECURSOR RNA, of VGAM473 are further described hereinbelow with reference to Table 1.

Nucleotide sequences of host target binding sites, such as BINDING SITE-I, BINDING SITE-II and BINDING SITE-III of FIG. 1, found on VGAM473 host target RNA, and schematic representation of the complementarity of each of these host target binding sites to VGAM473 RNA, herein designated VGAM RNA, are described hereinbelow with reference to Table 2.

As mentioned hereinabove with reference to FIG. 1, a function of VGAM473 gene, herein designated VGAM is inhibition of expression of VGAM473 target genes. It is appreciated that specific functions, and accordingly utilities, of VGAM473 correlate with, and may be deduced from, the identity of the target genes which VGAM473 binds and inhibits, and the function of these target genes, as elaborated hereinbelow.

Dopamine Receptor D1 (DRD1, Accession NM_000794) is a VGAM473 host target gene. DRD1 BINDING SITE is HOST TARGET binding site found in the 5' untranslated region of mRNA encoded by DRD1, corresponding to a HOST TARGET binding site such as BINDING SITE I, BINDING SITE II or BINDING SITE III. Table 2 illustrates the complementarity of the nucleotide sequences of DRD1 BINDING SITE, designated SEQ ID:6465, to the nucleotide sequence of VGAM473 RNA, herein designated VGAM RNA, also designated SEQ ID:3184.

A function of VGAM473 is therefore inhibition of Dopamine Receptor D1 (DRD1, Accession NM_000794), a gene which is mediated by g proteins which activate adenylyl cyclase. Accordingly, utilities of VGAM473 include diagnosis, prevention and treatment of diseases and clinical conditions associated with DRD1. The function of DRD1 and its association with various diseases and clinical conditions, has been established by previous studies, as described hereinabove with reference to VGAM22. Coagulation Factor II (thrombin) Receptor (F2R, Accession NM_001992) is another VGAM473 host target gene. F2R BINDING SITE is HOST TARGET binding site found in the 3' untranslated region of mRNA encoded by F2R, corresponding to a HOST TARGET binding site such as BINDING SITE I, BINDING SITE II or BINDING SITE III. Table 2 illustrates the complementarity of the nucleotide sequences of F2R BINDING SITE, designated SEQ ID:7719, to the nucleotide sequence of VGAM473 RNA, herein designated VGAM RNA, also designated SEQ ID:3184.

Another function of VGAM473 is therefore inhibition of Coagulation Factor II (thrombin) Receptor (F2R, Accession NM_001992), a gene which Thrombin receptor; G protein-coupled receptor involved in platelet activation. Accordingly, utilities of VGAM473 include diagnosis, prevention and treatment of diseases and clinical conditions associated with F2R. The function of F2R and its association with various diseases and clinical conditions, has been established by previous studies, as described hereinabove with reference to VGAM140. Angiotensin II Receptor-like 2 (AGTRL2, Accession NM_005162) is another VGAM473 host target gene. AGTRL2 BINDING SITE is HOST TARGET binding site found in the 5' untranslated region of mRNA encoded by AGTRL2, corresponding to a HOST TARGET binding site such as BINDING SITE I, BINDING SITE II or BINDING SITE III. Table 2 illustrates the complementarity of the nucleotide sequences of AGTRL2 BINDING SITE, designated SEQ ID:11646, to the nucleotide sequence of VGAM473 RNA, herein designated VGAM RNA, also designated SEQ ID:3184.

Another function of VGAM473 is therefore inhibition of Angiotensin II Receptor-like 2 (AGTRL2, Accession NM_005162). Accordingly, utilities of VGAM473 include diagnosis, prevention and treatment of diseases and clinical conditions associated with AGTRL2. FLJ10540 (Accession NM_018131) is another VGAM473 host target gene. FLJ10540 BINDING SITE is HOST TARGET binding site found in the 3' untranslated region of mRNA encoded by FLJ10540, corresponding to a HOST TARGET binding site such as BINDING SITE I, BINDING SITE II or BINDING SITE III. Table 2 illustrates the complementarity of the nucleotide sequences of FLJ10540 BINDING SITE, designated SEQ ID:19928, to the nucleotide sequence of VGAM473 RNA, herein designated VGAM RNA, also designated SEQ ID:3184.

Another function of VGAM473 is therefore inhibition of FLJ10540 (Accession NM_018131). Accordingly, utilities of VGAM473 include diagnosis, prevention and treatment of diseases and clinical conditions associated with FLJ10540. FLJ13852 (Accession NM_023078) is another VGAM473 host target gene. FLJ13852 BINDING SITE is HOST TARGET binding site found in the 3' untranslated region of mRNA encoded by FLJ13852, corresponding to a HOST TARGET binding site such as BINDING SITE I, BINDING SITE II or BINDING SITE III. Table 2 illustrates the complementarity of the nucleotide sequences of FLJ13852 BINDING SITE, designated SEQ ID:23341, to the nucleotide sequence of VGAM473 RNA, herein designated VGAM RNA, also designated SEQ ID:3184.

Another function of VGAM473 is therefore inhibition of FLJ13852 (Accession NM_023078). Accordingly, utilities of VGAM473 include diagnosis, prevention and treatment of diseases and clinical conditions associated with FLJ13852. FIG. 1 further provides a conceptual description of a novel bioinformatically detected viral gene of the present invention, referred to here as Viral Genomic Address Messenger 474 (VGAM474) viral gene, which modulates expression of respective host target genes thereof, the function and utility of which host target genes is known in the art.

VGAM474 is a novel bioinformatically detected regulatory, non protein coding, viral micro RNA (miRNA) gene. The method by which VGAM474 was detected is described hereinabove with reference to FIGS. 1-8.

VGAM474 gene, herein designated VGAM GENE, is a viral gene contained in the genome of Tick-borne Encephalitis Virus. VGAM474 host target gene, herein designated VGAM HOST TARGET GENE, is a human gene contained in the human genome.

VGAM474 gene encodes a VGAM474 precursor RNA, herein designated VGAM PRECURSOR RNA. Similar to other miRNA genes, and unlike most ordinary genes, VGAM474 precursor RNA does not encode a protein. A nucleotide sequence identical or highly similar to the nucleotide sequence of VGAM474 precursor RNA is designated SEQ ID:460, and is provided hereinbelow with reference to the sequence listing part. Nucleotide sequence SEQ ID:460 is located at position 7427 relative to the genome of Tick-borne Encephalitis Virus.

VGAM474 precursor RNA folds onto itself, forming VGAM474 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM474 folded precursor RNA into VGAM474 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM474 RNA is designated SEQ ID:3185, and is provided hereinbelow with reference to the sequence listing part.

VGAM474 host target gene, herein designated VGAM HOST TARGET GENE, encodes a corresponding messenger RNA, VGAM474 host target RNA, herein designated VGAM HOST TARGET RNA. VGAM474 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM474 RNA, herein designated VGAM RNA, binds complementarily to one or more host target binding sites located in untranslated regions of VGAM474 host target RNA, herein designated VGAM HOST TARGET RNA. This complementary binding is due to the fact that the nucleotide sequence of VGAM474 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM474 RNA, herein designated VGAM RNA, may have a different number of host target binding sites in untranslated regions of a VGAM474 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM474 RNA, herein designated VGAM RNA, to host target binding sites on VGAM474 host target RNA, herein designated VGAM HOST TARGET RNA, such as BINDING SITE I, BINDING SITE II and BINDING SITE III, inhibits translation of VGAM474 host target RNA into VGAM474 host target protein, herein designated VGAM HOST TARGET PROTEIN. VGAM host target protein is therefore outlined by a broken line.

It is appreciated that VGAM474 host target gene, herein designated VGAM HOST TARGET GENE, in fact represents a plurality of VGAM474 host target genes. The mRNA of each one of this plurality of VGAM474 host target genes comprises one or more host target binding sites, each having a nucleotide sequence which is at least partly complementary to VGAM474 RNA, herein designated VGAM RNA, and which when bound by VGAM474 RNA causes inhibition of translation of respective one or more VGAM474 host target proteins.

It is further appreciated by one skilled in the art that the mode of translational inhibition illustrated by FIG. 1 with specific reference to translational inhibition exerted by VGAM474 gene, herein designated VGAM GENE, on one or more VGAM474 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM474 is inhibition of expression of host target genes, as part of a novel viral mechanism of attacking a host. Accordingly, utilities of VGAM474 include diagnosis, prevention and treatment of viral infection by Tick-borne Encephalitis Virus. Specific functions, and accordingly utilities, of VGAM474 correlate with, and may be deduced from, the identity of the host target genes which VGAM474 binds and inhibits, and the function of these target genes, as elaborated hereinbelow.

Nucleotide sequences of the VGAM474 precursor RNA, herein designated VGAM PRECURSOR RNA, and of the 'diced' VGAM474 RNA, herein designated VGAM RNA, and a schematic representation of the secondary folding of VGAM474 folded precursor RNA, herein designated VGAM FOLDED PRECURSOR RNA, of VGAM474 are further described hereinbelow with reference to Table 1.

Nucleotide sequences of host target binding sites, such as BINDING SITE-I, BINDING SITE-II and BINDING SITE-III of FIG. 1, found on VGAM474 host target RNA, and schematic representation of the complementarity of each of these host target binding sites to VGAM474 RNA, herein designated VGAM RNA, are described hereinbelow with reference to Table 2.

As mentioned hereinabove with reference to FIG. 1, a function of VGAM474 gene, herein designated VGAM is inhibition of expression of VGAM474 target genes. It is appreciated that specific functions, and accordingly utilities, of VGAM474 correlate with, and may be deduced from, the identity of the target genes which VGAM474 binds and inhibits, and the function of these target genes, as elaborated hereinbelow.

Adducin 1 (alpha) (ADD1, Accession NM_014190) is a VGAM474 host target gene. ADD1 BINDING SITE is HOST TARGET binding site found in the 3' untranslated region of mRNA encoded by ADD1, corresponding to a HOST TARGET binding site such as BINDING SITE I, BINDING SITE II or BINDING SITE III. Table 2 illustrates the complementarity of the nucleotide sequences of ADD1 BINDING SITE, designated SEQ ID:15471, to the nucleotide sequence of VGAM474 RNA, herein designated VGAM RNA, also designated SEQ ID:3185.

A function of VGAM474 is therefore inhibition of Adducin 1 (alpha) (ADD1, Accession NM_014190), a gene which membrane-cytoskeleton- protein that promotes the assembly of the spectrin-actin network. Accordingly, utilities of VGAM474 include diagnosis, prevention and treatment of diseases and clinical conditions associated with ADD1. The function of ADD1 has been established by previous studies. Adducin is a cell-membrane skeletal protein that was first purified from human erythrocytes by Gardner and Bennett (1986) and subsequently isolated from bovine brain membranes. Isoforms of this protein have been detected in lung, kidney, testes, and liver. Erythrocyte adducin is a 200-kD heterodimer protein present at about 30,000 copies per cell. It binds with high affinity to Ca (2+)/calmodulin and is a substrate for protein kinases A and C. Joshi and Bennett (1990) investigated the structure and function of the separate domains of the protein. Adducin is a heterodimeric protein. The related subunits, alpha and beta (ADD2; 102681), are produced from distinct genes but share a similar structure, with a protease-resistant N-terminal region and a protease-sensitive, hydrophilic C-terminal region. Joshi et al. (1991) isolated reticulocyte cDNAs for alpha- and beta-adducin and, by somatic cell hybrid analysis, provisionally assigned the ADD1 gene to chromosome 4 and the ADD2 gene to chromosome 2. Both alpha-adducin and beta-adducin show alternative splicing; thus, there may be several different heterodimeric or homodimeric forms of adducin, each with a different functional specificity. Adducin was thought to promote assembly of spectrin-actin complexes in the formation of the membrane cytoskeleton (the name comes from the Latin adducere, meaning 'to bring together'). At least in brain, alpha-adducin is encoded by alternatively spliced mRNAs. See Gilligan and Bennett (1993) for a review of adducin and the other components of the junctional complex of the cell membrane skeleton. Casari et al. (1995) found in human S an association between essential hypertension (see OMIM Ref. No. 145500) and some allelic markers close to the alpha-adducin locus. Cusi et al. (1997) found signfiicant linkage of the alpha-adducin locus to essential hypertension and greater sensitivity to changes in sodium balance among patients with a particular ADD1 allele, trp460 (102680.0001), suggesting that alpha-adducin is associated with a salt-sensitive form of essential hypertension. They suggested that this polymorphism may identify hypertensive patients who will benefit from diuretic treatment or maneuvers to reduce total body sodium. Heterozygous hypertensive patients (gly/trp) showed a greater fall in mean arterial pressure in response to 2 months' treatment with hydrochlorothiazide than did wildtype homozygous (gly/gly) hypertensive patients.

Full details of the abovementioned studies are described in the following publications, the disclosure of which are hereby incorporated by reference:

Joshi, R.; Gilligan, D. M.; Otto, E.; McLaughlin, T.; Bennett, V.: Primary structure and domain organization of human alpha and beta adducin. J. Cell Biol. 115: 665-675, 1991; and Cusi, D.; Barlassina, C.; Azzani, T.; Casari, G.; Citterio, L.; Devoto, M.; Glorioso, N.; Lanzani, C.; Manunta, P.; Righetti, M.; Rivera, R.; Stella, P.; Troffa, C.; Zagato, L.; Bianchi.

Further studies establishing the function and utilities of ADD1 are found in John Hopkins OMIM database record ID 102680, and in sited publications numbered 791, 3622, 3784-793, 2667, 2791, 2036-79 and 482-484 listed in the bibliography section hereinbelow, which are also hereby incorporated by reference. Huntingtin Interacting Protein 1 (HIP1, Accession NM_005338) is another VGAM474 host target gene. HIP1 BINDING SITE is HOST TARGET binding site found in the 3' untranslated region of mRNA encoded by HIP1, corresponding to a HOST TARGET binding site such as BINDING SITE I, BINDING SITE II or BINDING SITE III. Table 2 illustrates the complementarity of the nucleotide sequences of HIP1 BINDING SITE, designated SEQ ID:11812, to the nucleotide sequence of VGAM474 RNA, herein designated VGAM RNA, also designated SEQ ID:3185.

Another function of VGAM474 is therefore inhibition of Huntingtin Interacting Protein 1 (HIP1, Accession NM_005338), a gene which is a membrane protein and interacts with huntingtin. Accordingly, utilities of VGAM474 include diagnosis, prevention and treatment of diseases and clinical conditions associated with HIP1. The function of HIP1 has been established by previous studies. Huntington disease (HD; 143100) may be due to a toxic gain-of-function caused by abnormal protein-protein interactions related to the elongated polyglutamine sequence of huntingtin. Thus, the binding of distinct proteins to the polyglutamine region could either confer a new property on huntingtin or alter its normal interactions with other proteins. Wanker et al. (1997) hypothesized that the specific binding of a protein with a restricted pattern of expression to the elongated polyglutamine stretch of the huntingtin protein could cause selective vulnerability to particular cells. The potential huntingtin-interacting proteins that have been identified include huntingtin-associated protein-1 (OMIM Ref. No. 600947), the glycolytic enzyme GAPD (OMIM Ref. No. 138400), and the ubiquitin-conjugating enzyme E2-25K, also named HIP2 (OMIM Ref. No. 602846), which binds selectively to the N terminus of huntingtin. Wanker et al. (1997) demonstrated the specific binding of a protein to the N terminus of huntingtin, both in the yeast 2-hybrid screen and in in vitro binding experiments. A protein region downstream of the polyglutamine stretch in huntingtin was essential for the interaction in vitro. Thus, the authors designated the new protein 'huntingtin-interacting protein-1' (HIP1). The HIP1 cDNA isolated by the 2-hybrid screen encodes a 55-kD fragment of the novel protein. Using an affinity-purified polyclonal antibody raised against recombinant HIP1, a protein of 116 kD was detected in brain extracts by Western blot analysis. The predicted amino acid sequence of the HIP1 fragment exhibited significant similarity to cytoskeleton proteins, suggesting to Wanker et al. (1997) that HIP1 and huntingtin play a functional role in the cell filament network. The HIP1 gene was found to be ubiquitously expressed at low levels in different brain regions. HIP1 is enriched in human brain but can also be detected in other human tissues, as well as in mouse brain. The authors noted that HIP1 and huntingtin behave almost identically during subcellular fractionation and both proteins are enriched in the membrane-containing fractions. Animal model experiments lend further support to the function of HIP1. Kalchman et al. (1997) showed that HIP1 is a membrane-associated protein that colocalizes with huntingtin and shares sequence homology and biochemical characteristics with Sla2p, a protein essential for function of the cytoskeleton in S. cerevisiae. The huntingtin-HIP1 interaction was restricted to the brain and correlated inversely with the polyglutamine length in huntingtin. Their results provided a molecular link between huntingtin and the neuronal cytoskeleton and suggested that, in Huntington disease, loss of normal huntingtin-HIP1 interaction may contribute to a defect in membrane-cytoskeletal integrity in the brain.

It is appreciated that the abovementioned animal model for HIP1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kalchman, M. A.; Koide, H. B.; McCutcheon, K.; Graham, R. K.; Nichol, K.; Nishiyama, K.; Kazemi-Esfarjani, P.; Lynn, F. C.; Wellington, C.; Metzler, M.; Goldberg, Y. P.; Kanazawa, I.; Gietz, R. D.; Hayden, M. R.: HIP1, a human homologue of S. cerevisiae Slap2, interacts with membrane-associated huntingtin in the brain. Nature Genet. 16:44-53, 1997; and Wanker, E. E.; Rovira, C.; Scherzinger, E.; Hasenbank, R.; Walter, S.; Tait, D.; Colicelli, J.; Lehrach, H.: HIP-I: a huntingtin interacting protein isolated by the yeast two-hybrid sys.

Further studies establishing the function and utilities of HIP1 are found in John Hopkins OMIM database record ID 601767, and in sited publications numbered 7175, 11274-2866, 672 and 9966 listed in the bibliography section hereinbelow, which are also hereby incorporated by reference. Homeo Box C13 (HOXC13, Accession XM_006804) is another VGAM474 host target gene. HOXC13 BINDING SITE is HOST TARGET binding site found in the 3' untranslated region of mRNA encoded by HOXC13, corresponding to a HOST TARGET binding site such as BINDING SITE I, BINDING SITE II or BINDING SITE III. Table 2 illustrates the complementarity of the nucleotide sequences of HOXC13 BINDING SITE, designated SEQ ID:30014, to the nucleotide sequence of VGAM474 RNA, herein designated VGAM RNA, also designated SEQ ID:3185.

Another function of VGAM474 is therefore inhibition of Homeo Box C13 (HOXC13, Accession XM_006804). Accordingly, utilities of VGAM474 include diagnosis, prevention and treatment of diseases and clinical conditions associated with HOXC13. Jerky Homolog (mouse) (JRK, Accession XM_098818) is another VGAM474 host target gene. JRK BINDING SITE is HOST TARGET binding site found in the 3' untranslated region of mRNA encoded by JRK, corresponding to a HOST TARGET binding site such as BINDING SITE I, BINDING SITE II or BINDING SITE III. Table 2 illustrates the complementarity of the nucleotide sequences of JRK BINDING SITE, designated SEQ ID:41841, to the nucleotide sequence of VGAM474 RNA, herein designated VGAM RNA, also designated SEQ ID:3185.

Another function of VGAM474 is therefore inhibition of Jerky Homolog (mouse) (JRK, Accession XM_098818), a gene which might function as a DNA-binding protein. Accordingly, utilities of VGAM474 include diagnosis, prevention and treatment of diseases and clinical conditions associated with JRK. The function of JRK and its association with various diseases and clinical conditions, has been established by previous studies, as described hereinabove with reference to VGAM210. Kelch-like 3 (Drosophila) (KLHL3, Accession XM_113450) is another VGAM474 host target gene. KLHL3 BINDING SITE is HOST TARGET binding site found in the 3' untranslated region of mRNA encoded by KLHL3, corresponding to a HOST TARGET binding site such as BINDING SITE I, BINDING SITE II or BINDING SITE III. Table 2 illustrates the complementarity of the nucleotide sequences of KLHL3 BINDING SITE, designated SEQ ID:42269, to the nucleotide sequence of VGAM474 RNA, herein designated VGAM RNA, also designated SEQ ID:3185.

Another function of VGAM474 is therefore inhibition of Kelch-like 3 (Drosophila) (KLHL3, Accession XM_113450). Accordingly, utilities of VGAM474 include diagnosis, prevention and treatment of diseases and clinical conditions associated with KLHL3. Microtubule-associated Protein 1A (MAP1A, Accession NM_002373) is another VGAM474 host target gene. MAP1A BINDING SITE is HOST TARGET binding site found in the 3' untranslated region of mRNA encoded by MAP1A, corresponding to a HOST TARGET binding site such as BINDING SITE I, BINDING SITE II or BINDING SITE III. Table 2 illustrates the complementarity of the nucleotide sequences of MAP1A BINDING SITE, designated SEQ ID:8186, to the nucleotide sequence of VGAM474 RNA, herein designated VGAM RNA, also designated SEQ ID:3185.

Another function of VGAM474 is therefore inhibition of Microtubule-associated Protein 1A (MAP1A, Accession NM_002373), a gene which is a structural protein involved in the filamentous cross- bridging between microtubules and other skeletal elements. Accordingly, utilities of VGAM474 include diagnosis, prevention and treatment of diseases and clinical conditions associated with MAP1A. The function of MAP1A and its association with various diseases and clinical conditions, has been established by previous studies, as described hereinabove with reference to VGAM315. Neuralized-like (Drosophila) (NEURL, Accession NM_004210) is another VGAM474 host target gene. NEURL BINDING SITE is HOST TARGET binding site found in the 3' untranslated region of mRNA encoded by NEURL, corresponding to a HOST TARGET binding site such as BINDING SITE I, BINDING SITE II or BINDING SITE III. Table 2 illustrates the complementarity of the nucleotide sequences of NEURL BINDING SITE, designated SEQ ID:10415, to the nucleotide sequence of VGAM474 RNA, herein designated VGAM RNA, also designated SEQ ID:3185.

Another function of VGAM474 is therefore inhibition of Neuralized-like (Drosophila) (NEURL, Accession NM_004210). Accordingly, utilities of VGAM474 include diagnosis, prevention and treatment of diseases and clinical conditions associated with NEURL. Ovo-like 1(Drosophila) (OVOL1, Accession NM_004561) is another VGAM474 host target gene. OVOL1 BINDING SITE is HOST TARGET binding site found in the 3' untranslated region of mRNA encoded by OVOL1, corresponding to a HOST TARGET binding site such as BINDING SITE I, BINDING SITE II or BINDING SITE III. Table 2 illustrates the complementarity of the nucleotide sequences of OVOL1 BINDING SITE, designated SEQ ID:10900, to the nucleotide sequence of VGAM474 RNA, herein designated VGAM RNA, also designated SEQ ID:3185.

Another function of VGAM474 is therefore inhibition of Ovo-like 1(Drosophila) (OVOL1, Accession NM_004561). Accordingly, utilities of VGAM474 include diagnosis, prevention and treatment of diseases and clinical conditions associated with OVOL1. UDP Glycosyltransferase 1 Family, Polypeptide A1 (UGT1A1, Accession NM_000463) is another VGAM474 host target gene. UGT1A1 BINDING SITE is HOST TARGET binding site found in the 3' untranslated region of mRNA encoded by UGT1A1, corresponding to a HOST TARGET binding site such as BINDING SITE I, BINDING SITE II or BINDING SITE III. Table 2 illustrates the complementarity of the nucleotide sequences of UGT1A1 BINDING SITE, designated SEQ ID:6082, to the nucleotide sequence of VGAM474 RNA, herein designated VGAM RNA, also designated SEQ ID:3185.

Another function of VGAM474 is therefore inhibition of UDP Glycosyltransferase 1 Family, Polypeptide A1 (UGT1A1, Accession NM_000463). Accordingly, utilities of VGAM474 include diagnosis, prevention and treatment of diseases and clinical conditions associated with UGT1A1. UDP Glycosyltransferase 1 Family, Polypeptide A4 (UGT1A4, Accession NM_007120) is another VGAM474 host target gene. UGT1A4 BINDING SITE is HOST TARGET binding site found in the 3' untranslated region of mRNA encoded by UGT1A4, corresponding to a HOST TARGET binding site such as BINDING SITE I, BINDING SITE II or BINDING SITE III. Table 2 illustrates the complementarity of the nucleotide sequences of UGT1A4 BINDING SITE, designated SEQ ID:13980, to the nucleotide sequence of VGAM474 RNA, herein designated VGAM RNA, also designated SEQ ID:3185.

Another function of VGAM474 is therefore inhibition of UDP Glycosyltransferase 1 Family, Polypeptide A4 (UGT1A4, Accession NM_007120), a gene which is of major importance in the conjugation and subsequent elimination of potentially toxic xenobiotics and endogenous compounds. Accordingly, utilities of VGAM474 include diagnosis, prevention and treatment of diseases and clinical conditions associated with UGT1A4. The function of UGT1A4 has been established by previous studies. By screening a liver cDNA library with a probe to a conserved transferase C-terminal sequence, followed by 5-prime RACE, Ritter et al. (1991) obtained cDNAs encoding UGT1A1 and UGT1A4, which they termed HUGBR1 and HUGBR2, respectively. The deduced 534-amino acid UGT1A4 protein shares 66% sequence similarity with UGT1A1 in the N terminus, which contains potential N-linked glycosylation sites, and complete identity after codon 287. Northern blot analysis revealed expression of a 2.6-kb transcript in liver. Unlike UGT1A1, expression of UGT1A4 is normal in type I Crigler-Najjar syndrome (OMIM Ref. No. 218800). Functional analysis showed that UGT1A4 has glucuronidating activity although, in a review of the UGTs, Tukey and Strassburg (2000) found that UGT1A4 activity with bilirubin is rather modest compared to that of UGT1A1. UGT1A4 is relatively active with amines, steroids, and sapogenins. By Northern blot analysis, Ritter et al. (1992) determined that UGT1A4, then termed UGT1D, is expressed at lower levels than UGT1A1 in liver. By Southern blot analysis, Ritter et al. (1992) determined that all of the UGT1A genes map to the same locus on chromosome 2.

Full details of the abovementioned studies are described in the following publications, the disclosure of which are hereby incorporated by reference:

Ritter, J. K.; Chen, F.; Sheen, Y. Y.; Tran, H. M.; Kimura, S.; Yeatman, M. T.; Owens, I. S.: A novel complex locus UGT1 encodes human bilirubin, phenol, and other UDP-glucuronosyltransferase isozymes with identical carboxyl termini. J. Biol. Chem. 267:3257-3261, 1992; and Tukey, R. H.; Strassburg, C. P.: Human UDP-glucuronosyltransferases: metabolism, expression, and disease. Annu. Rev. Pharm. Toxicol. 40:581-616, 2000.

Further studies establishing the function and utilities of UGT1A4 are found in John Hopkins OMIM database record ID 606429, and in sited publications numbered 1244 and 12449 listed in the bibliography section hereinbelow, which are also hereby incorporated by reference. UDP Glycosyltransferase 1 Family, Polypeptide A9 (UGT1A9, Accession NM_021027) is another VGAM474 host target gene. UGT1A9 BINDING SITE is HOST TARGET binding site found in the 3' untranslated region of mRNA encoded by UGT1A9, corresponding to a HOST TARGET binding site such as BINDING SITE I, BINDING SITE II or BINDING SITE III. Table 2 illustrates the complementarity of the nucleotide sequences of UGT1A9 BINDING SITE, designated SEQ ID:22016, to the nucleotide sequence of VGAM474 RNA, herein designated VGAM RNA, also designated SEQ ID:3185.

Another function of VGAM474 is therefore inhibition of UDP Glycosyltransferase 1 Family, Polypeptide A9 (UGT1A9, Accession NM_021027), a gene which is of major importance in the conjugation and subsequent elimination of potentially toxic xenobiotics and endogenous compounds. Accordingly, utilities of VGAM474 include diagnosis, prevention and treatment of diseases and clinical conditions associated with UGT1A9. The function of UGT1A9 has been established by previous studies. By screening a liver cDNA library with a UGT1A6 (OMIM Ref. No. 606431) probe, Wooster et al. (1991) isolated a cDNA encoding UGT1A9, which they termed HLUGP4. The deduced 531-amino acid protein shares 67% overall sequence identity with UGT1A1 but only 38% in the N terminus. Western blot analysis showed expression of a 56-kD protein. Functional analysis indicated that, like UGT1A6, UGT1A9 is most active towards halogenated phenols with higher UGT1A9 activity with simple phenols. Findlay et al. (2000) reported that the predominant thyroid hormone released from the thyroid gland, T4, and the inactive rat T3 were glucuronidated by cloned expressed bilirubin UGT1A1 and also phenol UGT1A9. Results from Crigler-Najjar (see OMIM Ref. No. 218800) microsomal samples indicated that UGT1A1 was the main contributor to thyroid hormone glucuronidation in the liver, with rat T3 being the preferential substrate. In kidney microsomes, thyroid hormone glucuronidation was more complex, suggesting that more than just the UGT1A9 isoform may be involved. Bioactive T3 was not significantly glucuronidated by these isoforms and other UGTs, and sulfotransferases may have been involved.

Full details of the abovementioned studies are described in the following publications, the disclosure of which are hereby incorporated by reference:

Wooster, R.; Sutherland, L.; Ebner, T.; Clarke, D.; Da Cruz e Silva, O.; Burchell, B.: Cloning and stable expression of a new member of the human liver phenol/bilirubin:UDP-glucuronosyltransferase cDNA family. Biochem. J. 278:465-469, 1991; and Findlay, K. A. B.; Kaptein, E.; Visser, T. J.; Burchell, B.: Characterization of the uridine diphosphate-glucuronosyltransferase-catalyzing thyroid hormone glucuronidation in man. J. C.

Further studies establishing the function and utilities of UGT1A9 are found in John Hopkins OMIM database record ID 606434, and in sited publications numbered 608 and 6081 listed in the bibliography section hereinbelow, which are also hereby incorporated by reference. Chromosome 9 Open Reading Frame 14 (C9orf14, Accession XM_098859) is another VGAM474 host target gene. C9orf14 BINDING SITE is HOST TARGET binding site found in the 5' untranslated region of mRNA encoded by C9orf14, corresponding to a HOST TARGET binding site such as BINDING SITE I, BINDING SITE II or BINDING SITE III. Table 2 illustrates the complementarity of the nucleotide sequences of C9orf14 BINDING SITE, designated SEQ ID:41910, to the nucleotide sequence of VGAM474 RNA, herein designated VGAM RNA, also designated SEQ ID:3185.

Another function of VGAM474 is therefore inhibition of Chromosome 9 Open Reading Frame 14 (C9orf14, Accession XM_098859). Accordingly, utilities of VGAM474 include diagnosis, prevention and treatment of diseases and clinical conditions associated with C9orf14. CGI-01 (Accession NM_015935) is another VGAM474 host target gene. CGI-01 BINDING SITE is HOST TARGET binding site found in the 3' untranslated region of mRNA encoded by CGI-01, corresponding to a HOST TARGET binding site such as BINDING SITE I, BINDING SITE II or BINDING SITE III. Table 2 illustrates the complementarity of the nucleotide sequences of CGI-01 BINDING SITE, designated SEQ ID:18056, to the nucleotide sequence of VGAM474 RNA, herein designated VGAM RNA, also designated SEQ ID:3185.

Another function of VGAM474 is therefore inhibition of CGI-01 (Accession NM_015935). Accordingly, utilities of VGAM474 include diagnosis, prevention and treatment of diseases and clinical conditions associated with CGI-01. DKFZp434C0923 (Accession NM_017598) is another VGAM474 host target gene. DKFZp434C0923 BINDING SITE is HOST TARGET binding site found in the 3' untranslated region of mRNA encoded by DKFZp434C0923, corresponding to a HOST TARGET binding site such as BINDING SITE I, BINDING SITE II or BINDING SITE III. Table 2 illustrates the complementarity of the nucleotide sequences of DKFZp434C0923 BINDING SITE, designated SEQ ID:19063, to the nucleotide sequence of VGAM474 RNA, herein designated VGAM RNA, also designated SEQ ID:3185.

Another function of VGAM474 is therefore inhibition of DKFZp434C0923 (Accession NM_017598). Accordingly, utilities of VGAM474 include diagnosis, prevention and treatment of diseases and clinical conditions associated with DKFZp434C0923. DnaJ (Hsp40) Homolog, Subfamily C, Member 5 (DNAJC5, Accession XM_028966) is another VGAM474 host target gene. DNAJC5 BINDING SITE is HOST TARGET binding site found in the 3' untranslated region of mRNA encoded by DNAJC5, corresponding to a HOST TARGET binding site such as BINDING SITE I, BINDING SITE II or BINDING SITE III. Table 2 illustrates the complementarity of the nucleotide sequences of DNAJC5 BINDING SITE, designated SEQ ID:30811, to the nucleotide sequence of VGAM474 RNA, herein designated VGAM RNA, also designated SEQ ID:3185.

Another function of VGAM474 is therefore inhibition of DnaJ (Hsp40) Homolog, Subfamily C, Member 5 (DNAJC5, Accession XM_028966). Accordingly, utilities of VGAM474 include diagnosis, prevention and treatment of diseases and clinical conditions associated with DNAJC5. FLJ23584 (Accession NM_024588) is another VGAM474 host target gene. FLJ23584 BINDING SITE is HOST TARGET binding site found in the 3' untranslated region of mRNA encoded by FLJ23584, corresponding to a HOST TARGET binding site such as BINDING SITE I, BINDING SITE II or BINDING SITE III. Table 2 illustrates the complementarity of the nucleotide sequences of FLJ23584 BINDING SITE, designated SEQ ID:23822, to the nucleotide sequence of VGAM474 RNA, herein designated VGAM RNA, also designated SEQ ID:3185.

Another function of VGAM474 is therefore inhibition of FLJ23584 (Accession NM_024588). Accordingly, utilities of VGAM474 include diagnosis, prevention and treatment of diseases and clinical conditions associated with FLJ23584. HYA22 (Accession NM_005808) is another VGAM474 host target gene. HYA22 BINDING SITE is HOST TARGET binding site found in the 3' untranslated region of mRNA encoded by HYA22, corresponding to a HOST TARGET binding site such as BINDING SITE I, BINDING SITE II or BINDING SITE III. Table 2 illustrates the complementarity of the nucleotide sequences of HYA22 BINDING SITE, designated SEQ ID:12389, to the nucleotide sequence of VGAM474 RNA, herein designated VGAM RNA, also designated SEQ ID:3185.

Another function of VGAM474 is therefore inhibition of HYA22 (Accession NM_005808). Accordingly, utilities of VGAM474 include diagnosis, prevention and treatment of diseases and clinical conditions associated with HYA22. KIAA0237 (Accession NM_014747) is another VGAM474 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16443, to the nucleotide sequence of VGAM474 RNA, herein designated VGAM RNA, also designated SEQ ID:3185.

Another function of VGAM474 is therefore inhibition of KIAA0237 (Accession NM_014747). Accordingly, utilities of VGAM474 include diagnosis, prevention and treatment of diseases and clinical conditions associated with KIAA0237. KIAA1546 (Accession XM_042301) is another VGAM474 host target gene. KIAA1546 BINDING SITE is HOST TARGET binding site found in the 3' untranslated region of mRNA encoded by KIAA1546, corresponding to a HOST TARGET binding site such as BINDING SITE I, BINDING SITE II or BINDING SITE III. Table 2 illustrates the complementarity of the nucleotide sequences of KIAA1546 BINDING SITE, designated SEQ ID:33717, to the nucleotide sequence of VGAM474 RNA, herein designated VGAM RNA, also designated SEQ ID:3185.

Another function of VGAM474 is therefore inhibition of KIAA1546 (Accession XM_042301). Accordingly, utilities of VGAM474 include diagnosis, prevention and treatment of diseases and clinical conditions associated with KIAA1546. LBP-9 (Accession NM_014553) is another VGAM474 host target gene. LBP-9 BINDING SITE is HOST TARGET binding site found in the 3' untranslated region of mRNA encoded by LBP-9, corresponding to a HOST TARGET binding site such as BINDING SITE I, BINDING SITE II or BINDING SITE III. Table 2 illustrates the complementarity of the nucleotide sequences of LBP-9 BINDING SITE, designated SEQ ID:15881, to the nucleotide sequence of VGAM474 RNA, herein designated VGAM RNA, also designated SEQ ID:3185.

Another function of VGAM474 is therefore inhibition of LBP-9 (Accession NM_014553). Accordingly, utilities of VGAM474 include diagnosis, prevention and treatment of diseases and clinical conditions associated with LBP-9. Ninjurin 2 (NINJ2, Accession NM_016533) is another VGAM474 host target gene. NINJ2 BINDING SITE is HOST TARGET binding site found in the 3' untranslated region of mRNA encoded by NINJ2, corresponding to a HOST TARGET binding site such as BINDING SITE I, BINDING SITE II or BINDING SITE III. Table 2 illustrates the complementarity of the nucleotide sequences of NINJ2 BINDING SITE, designated SEQ ID:18602, to the nucleotide sequence of VGAM474 RNA, herein designated VGAM RNA, also designated SEQ ID:3185.

Another function of VGAM474 is therefore inhibition of Ninjurin 2 (NINJ2, Accession NM_016533). Accordingly, utilities of VGAM474 include diagnosis, prevention and treatment of diseases and clinical conditions associated with NINJ2. PDZ Domain Containing 2 (PDZD2, Accession XM_087705) is another VGAM474 host target gene. PDZD2 BINDING SITE is HOST TARGET binding site found in the 5' untranslated region of mRNA encoded by PDZD2, corresponding to a HOST TARGET binding site such as BINDING SITE I, BINDING SITE II or BINDING SITE III. Table 2 illustrates the complementarity of the nucleotide sequences of PDZD2 BINDING SITE, designated SEQ ID:39396, to the nucleotide sequence of VGAM474 RNA, herein designated VGAM RNA, also designated SEQ ID:3185.

Another function of VGAM474 is therefore inhibition of PDZ Domain Containing 2 (PDZD2, Accession XM_087705). Accordingly, utilities of VGAM474 include diagnosis, prevention and treatment of diseases and clinical conditions associated with PDZD2. PKMYT1 (Accession NM_004203) is another VGAM474 host target gene. PKMYT1 BINDING SITE is HOST TARGET binding site found in the 5' untranslated region of mRNA encoded by PKMYT1, corresponding to a HOST TARGET binding site such as BINDING SITE I, BINDING SITE II or BINDING SITE III. Table 2 illustrates the complementarity of the nucleotide sequences of PKMYT1 BINDING SITE, designated SEQ ID:10398, to the nucleotide sequence of VGAM474 RNA, herein designated VGAM RNA, also designated SEQ ID:3185.

Another function of VGAM474 is therefore inhibition of PKMYT1 (Accession NM_004203). Accordingly, utilities of VGAM474 include diagnosis, prevention and treatment of diseases and clinical conditions associated with PKMYT1. Protein Kinase, Lysine Deficient 2 (PRKWNK2, Accession XM_117531) is another VGAM474 host target gene. PRKWNK2 BINDING SITE is HOST TARGET binding site found in the 3' untranslated region of mRNA encoded by PRKWNK2, corresponding to a HOST TARGET binding site such as BINDING SITE I, BINDING SITE II or BINDING SITE III. Table 2 illustrates the complementarity of the nucleotide sequences of PRKWNK2 BINDING SITE, designated SEQ ID:43520, to the nucleotide sequence of VGAM474 RNA, herein designated VGAM RNA, also designated SEQ ID:3185.

Another function of VGAM474 is therefore inhibition of Protein Kinase, Lysine Deficient 2 (PRKWNK2, Accession XM_117531). Accordingly, utilities of VGAM474 include diagnosis, prevention and treatment of diseases and clinical conditions associated with PRKWNK2. Sideroflexin 2 (SFXN2, Accession XM_058359) is another VGAM474 host target gene. SFXN2 BINDING SITE is HOST TARGET binding site found in the 3' untranslated region of mRNA encoded by SFXN2, corresponding to a HOST TARGET binding site such as BINDING SITE I, BINDING SITE II or BINDING SITE III. Table 2 illustrates the complementarity of the nucleotide sequences of SFXN2 BINDING SITE, designated SEQ ID:36602, to the nucleotide sequence of VGAM474 RNA, herein designated VGAM RNA, also designated SEQ ID:3185.

Another function of VGAM474 is therefore inhibition of Sideroflexin 2 (SFXN2, Accession XM_058359). Accordingly, utilities of VGAM474 include diagnosis, prevention and treatment of diseases and clinical conditions associated with SFXN2. Syntaphilin (SNPH, Accession NM_014723) is another VGAM474 host target gene. SNPH BINDING SITE is HOST TARGET binding site found in the 5' untranslated region of mRNA encoded by SNPH, corresponding to a HOST TARGET binding site such as BINDING SITE I, BINDING SITE II or BINDING SITE III. Table 2 illustrates the complementarity of the nucleotide sequences of SNPH BINDING SITE, designated SEQ ID:16292, to the nucleotide sequence of VGAM474 RNA, herein designated VGAM RNA, also designated SEQ ID:3185.

Another function of VGAM474 is therefore inhibition of Syntaphilin (SNPH, Accession NM_014723). Accordingly, utilities of VGAM474 include diagnosis, prevention and treatment of diseases and clinical conditions associated with SNPH. LOC147599 (Accession XM_097253) is another VGAM474 host target gene. LOC147599 BINDING SITE is HOST TARGET binding site found in the 3' untranslated region of mRNA encoded by LOC147599, corresponding to a HOST TARGET binding site such as BINDING SITE I, BINDING SITE II or BINDING SITE III. Table 2 illustrates the complementarity of the nucleotide sequences of LOC147599 BINDING SITE, designated SEQ ID:40848, to the nucleotide sequence of VGAM474 RNA, herein designated VGAM RNA, also designated SEQ ID:3185.

Another function of VGAM474 is therefore inhibition of LOC147599 (Accession XM_097253). Accordingly, utilities of VGAM474 include diagnosis, prevention and treatment of diseases and clinical conditions associated with LOC147599. LOC150383 (Accession XM_086905) is another VGAM474 host target gene. LOC150383 BINDING SITE is HOST TARGET binding site found in the 3' untranslated region of mRNA encoded by LOC150383, corresponding to a HOST TARGET binding site such as BINDING SITE I, BINDING SITE II or BINDING SITE III. Table 2 illustrates the complementarity of the nucleotide sequences of LOC150383 BINDING SITE, designated SEQ ID:38947, to the nucleotide sequence of VGAM474 RNA, herein designated VGAM RNA, also designated SEQ ID:3185.

Another function of VGAM474 is therefore inhibition of LOC150383 (Accession XM_086905). Accordingly, utilities of VGAM474 include diagnosis, prevention and treatment of diseases and clinical conditions associated with LOC150383. LOC151836 (Accession XM_098124) is another VGAM474 host target gene. LOC151836 BINDING SITE is HOST TARGET binding site found in the 5' untranslated region of mRNA encoded by LOC151836, corresponding to a HOST TARGET binding site such as BINDING SITE I, BINDING SITE II or BINDING SITE III. Table 2 illustrates the complementarity of the nucleotide sequences of LOC151836 BINDING SITE, designated SEQ ID:41391, to the nucleotide sequence of VGAM474 RNA, herein designated VGAM RNA, also designated SEQ ID:3185.

Another function of VGAM474 is therefore inhibition of LOC151836 (Accession XM_098124). Accordingly, utilities of VGAM474 include diagnosis, prevention and treatment of diseases and clinical conditions associated with LOC151836. LOC221421 (Accession XM_166428) is another VGAM474 host target gene. LOC221421 BINDING SITE is HOST TARGET binding site found in the 3' untranslated region of mRNA encoded by LOC221421, corresponding to a HOST TARGET binding site such as BINDING SITE I, BINDING SITE II or BINDING SITE III. Table 2 illustrates the complementarity of the nucleotide sequences of LOC221421 BINDING SITE, designated SEQ ID:44325, to the nucleotide sequence of VGAM474 RNA, herein designated VGAM RNA, also designated SEQ ID:3185.

Another function of VGAM474 is therefore inhibition of LOC221421 (Accession XM_166428). Accordingly, utilities of VGAM474 include diagnosis, prevention and treatment of diseases and clinical conditions associated with LOC221421. LOC255196 (Accession XM_173157) is another VGAM474 host target gene. LOC255196 BINDING SITE is HOST TARGET binding site found in the 5' untranslated region of mRNA encoded by LOC255196, corresponding to a HOST TARGET binding site such as BINDING SITE I, BINDING SITE II or BINDING SITE III. Table 2 illustrates the complementarity of the nucleotide sequences of LOC255196 BINDING SITE, designated SEQ ID:46415, to the nucleotide sequence of VGAM474 RNA, herein designated VGAM RNA, also designated SEQ ID:3185.

Another function of VGAM474 is therefore inhibition of LOC255196 (Accession XM_173157). Accordingly, utilities of VGAM474 include diagnosis, prevention and treatment of diseases and clinical conditions associated with LOC255196. LOC256337 (Accession XM_170643) is another VGAM474 host target gene. LOC256337 BINDING SITE is HOST TARGET binding site found in the 3' untranslated region of mRNA encoded by LOC256337, corresponding to a HOST TARGET binding site such as BINDING SITE I, BINDING SITE II or BINDING SITE III. Table 2 illustrates the complementarity of the nucleotide sequences of LOC256337 BINDING SITE, designated SEQ ID:45422, to the nucleotide sequence of VGAM474 RNA, herein designated VGAM RNA, also designated SEQ ID:3185.

Another function of VGAM474 is therefore inhibition of LOC256337 (Accession XM_170643). Accordingly, utilities of VGAM474 include diagnosis, prevention and treatment of diseases and clinical conditions associated with LOC256337. FIG. 1 further provides a conceptual description of a novel bioinformatically detected viral gene of the present invention, referred to here as Viral Genomic Address Messenger 475 (VGAM475) viral gene, which modulates expression of respective host target genes thereof, the function and utility of which host target genes is known in the art.

VGAM475 is a novel bioinformatically detected regulatory, non protein coding, viral micro RNA (miRNA) gene. The method by which VGAM475 was detected is described hereinabove with reference to FIGS. 1-8.

VGAM475 gene, herein designated VGAM GENE, is a viral gene contained in the genome of Tick-borne Encephalitis Virus. VGAM475 host target gene, herein designated VGAM HOST TARGET GENE, is a human gene contained in the human genome.

VGAM475 gene encodes a VGAM475 precursor RNA, herein designated VGAM PRECURSOR RNA. Similar to other miRNA genes, and unlike most ordinary genes, VGAM475 precursor RNA does not encode a protein. A nucleotide sequence identical or highly similar to the nucleotide sequence of VGAM475 precursor RNA is designated SEQ ID:461, and is provided hereinbelow with reference to the sequence listing part. Nucleotide sequence SEQ ID:461 is located at position 606 relative to the genome of Tick-borne Encephalitis Virus.

VGAM475 precursor RNA folds onto itself, forming VGAM475 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM475 folded precursor RNA into VGAM475 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM475 RNA is designated SEQ ID:3186, and is provided hereinbelow with reference to the sequence listing part.

VGAM475 host target gene, herein designated VGAM HOST TARGET GENE, encodes a corresponding messenger RNA, VGAM475 host target RNA, herein designated VGAM HOST TARGET RNA. VGAM475 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM475 RNA, herein designated VGAM RNA, binds complementarily to one or more host target binding sites located in untranslated regions of VGAM475 host target RNA, herein designated VGAM HOST TARGET RNA. This complementary binding is due to the fact that the nucleotide sequence of VGAM475 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM475 RNA, herein designated VGAM RNA, may have a different number of host target binding sites in untranslated regions of a VGAM475 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM475 RNA, herein designated VGAM RNA, to host target binding sites on VGAM475 host target RNA, herein designated VGAM HOST TARGET RNA, such as BINDING SITE I, BINDING SITE II and BINDING SITE III, inhibits translation of VGAM475 host target RNA into VGAM475 host target protein, herein designated VGAM HOST TARGET PROTEIN. VGAM host target protein is therefore outlined by a broken line.

It is appreciated that VGAM475 host target gene, herein designated VGAM HOST TARGET GENE, in fact represents a plurality of VGAM475 host target genes. The mRNA of each one of this plurality of VGAM475 host target genes comprises one or more host target binding sites, each having a nucleotide sequence which is at least partly complementary to VGAM475 RNA, herein designated VGAM RNA, and which when bound by VGAM475 RNA causes inhibition of translation of respective one or more VGAM475 host target proteins.

It is further appreciated by one skilled in the art that the mode of translational inhibition illustrated by FIG. 1 with specific reference to translational inhibition exerted by VGAM475 gene, herein designated VGAM GENE, on one or more VGAM475 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM475 is inhibition of expression of host target genes, as part of a novel viral mechanism of attacking a host. Accordingly, utilities of VGAM475 include diagnosis, prevention and treatment of viral infection by Tick-borne Encephalitis Virus. Specific functions, and accordingly utilities, of VGAM475 correlate with, and may be deduced from, the identity of the host target genes which VGAM475 binds and inhibits, and the function of these host target genes, as elaborated hereinbelow.

Nucleotide sequences of the VGAM475 precursor RNA, herein designated VGAM PRECURSOR RNA, and of the 'diced' VGAM475 RNA, herein designated VGAM RNA, and a schematic representation of the secondary folding of VGAM475 folded precursor RNA, herein designated VGAM FOLDED PRECURSOR RNA, of VGAM475 are further described hereinbelow with reference to Table 1.

Nucleotide sequences of host target binding sites, such as BINDING SITE-I, BINDING SITE-II and BINDING SITE-III of FIG. 1, found on VGAM475 host target RNA, and schematic representation of the complementarity of each of these host target binding sites to VGAM475 RNA, herein designated VGAM RNA, are described hereinbelow with reference to Table 2.

As mentioned hereinabove with reference to FIG. 1, a function of VGAM475 gene, herein designated VGAM is inhibition of expression of VGAM475 target genes. It is appreciated that specific functions, and accordingly utilities, of VGAM475 correlate with, and may be deduced from, the identity of the target genes which VGAM475 binds and inhibits, and the function of these target genes, as elaborated hereinbelow.

Rac/Cdc42 Guanine Nucleotide Exchange Factor (GEF) 6 (ARHGEF6, Accession XM_042963) is a VGAM475 host target gene. ARHGEF6 BINDING SITE1 and ARHGEF6 BINDING SITE2 are HOST TARGET binding sites found in untranslated regions of mRNA encoded by ARHGEF6, corresponding to HOST TARGET binding sites such as BINDING SITE I, BINDING SITE II or BINDING SITE III. Table 2 illustrates the complementarity of the nucleotide sequences of ARHGEF6 BINDING SITE1 and ARHGEF6 BINDING SITE2, designated SEQ ID:33843 and SEQ ID:33850 respectively, to the nucleotide sequence of VGAM475 RNA, herein designated VGAM RNA, also designated SEQ ID:3186.

A function of VGAM475 is therefore inhibition of Rac/Cdc42 Guanine Nucleotide Exchange Factor (GEF) 6 (ARHGEF6, Accession XM_042963). Accordingly, utilities of VGAM475 include diagnosis, prevention and treatment of diseases and clinical conditions associated with ARHGEF6. Calbindin 1, 28 kDa (CALB1, Accession NM_004929) is another VGAM475 host target gene. CALB1 BINDING SITE is HOST TARGET binding site found in the 3' untranslated region of mRNA encoded by CALB1, corresponding to a HOST TARGET binding site such as BINDING SITE I, BINDING SITE II or BINDING SITE III. Table 2 illustrates the complementarity of the nucleotide sequences of CALB1 BINDING SITE, designated SEQ ID:11370, to the nucleotide sequence of VGAM475 RNA, herein designated VGAM RNA, also designated SEQ ID:3186.

Another function of VGAM475 is therefore inhibition of Calbindin 1, 28 kDa (CALB1, Accession NM_004929), a gene which buffers cytosolic calcium. Accordingly, utilities of VGAM475 include diagnosis, prevention and treatment of diseases and clinical conditions associated with CALB1. The function of CALB1 and its association with various diseases and clinical conditions, has been established by previous studies, as described hereinabove with reference to VGAM266. E2F Transcription Factor 3 (E2F3, Accession NM_001949) is another VGAM475 host target gene. E2F3 BINDING SITE is HOST TARGET binding site found in the 3' untranslated region of mRNA encoded by E2F3, corresponding to a HOST TARGET binding site such as BINDING SITE I, BINDING SITE II or BINDING SITE III. Table 2 illustrates the complementarity of the nucleotide sequences of E2F3 BINDING SITE, designated SEQ ID:7666, to the nucleotide sequence of VGAM475 RNA, herein designated VGAM RNA, also designated SEQ ID:3186.

Another function of VGAM475 is therefore inhibition of E2F Transcription Factor 3 (E2F3, Accession NM_001949), a gene which binds dna and controls cell-cycle progression from g1 to s phase. Accordingly, utilities of VGAM475 include diagnosis, prevention and treatment of diseases and clinical conditions associated with E2F3. The function of E2F3 has been established by previous studies. MYC (OMIM Ref. No. 190080) induces transcription of the E2F1, E2F2 (OMIM Ref. No. 600426), and E2F3 genes. Using primary mouse embryo fibroblasts deleted for individual E2f genes, Leone et al. (2001) showed that MYC-induced S phase and apoptosis requires distinct E2F activities. The ability of Myc to induce S phase was impaired in the absence of either E2f2 or E2f3 but not E2f1 or E2f4 (OMIM Ref. No. 600659). In contrast, the ability of Myc to induce apoptosis was markedly reduced in cells deleted for E2f1 but not E2f2 or E2f3. The authors proposed that the induction of specific E2F activities is an essential component in the MYC pathways that control cell proliferation and cell fate decisions. Animal model experiments lend further support to the function of E2F3. Cloud et al. (2002) generated E2f3-null mice. They found that E2f3 was essential for embryonic viability in the pure 129/Sv background, but that the presence of C57BL/6 alleles yielded some adult survivors. Although growth retarded, surviving E2f3 -/- animals were initially healthy and exhibited no obvious tumor phenotype. They died prematurely, however, with signs typical of congestive heart failure, a defect completely distinct from those reported in E2f1-null mice. Cloud et al. (2002) also generated E2f1/E2f3 compound mutant mice and found that almost all of the developmental and age-related defects arising in the individual E2f1- or E2f3-null mice were exacerbated by the mutation of the other E2f. One major difference in the properties of E2f1 and E2f3 loss was that, either alone or in combination with loss of E2f1, E2f3 mutants did not show an increase in the incidence of tumor formation.

It is appreciated that the abovementioned animal model for E2F3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Leone, G.; Sears, R.; Huang, E.; Rempel, R.; Nuckolls, F.; Park, C.-H.; Giangrande, P.; Wu, L.; Saavedra, H. I.; Field, S. J.; Thompson, M. A.; Yang, H.; Fujiwara, Y.; Greenberg, M. E.; Orkin, S.; Smith, C.; Nevins, J. R.: Myc requires distinct E2F activities to induce S phase and apoptosis. Molec. Cell 8:105-113, 2001; and Cloud, J. E.; Rogers, C.; Reza, T. L.; Ziebold, U.; Stone, J. R.; Picard, M. H.; Caron, A. M.; Bronson, R. T.; Lees, J. A.: Mutant mouse models reveal the relative roles of E2F1 and E2.

Further studies establishing the function and utilities of E2F3 are found in John Hopkins OMIM database record ID 600427, and in sited publications numbered 7563-7564, 756 and 9711 listed in the bibliography section hereinbelow, which are also hereby incorporated by reference. Egl Nine Homolog 1 (C. elegans) (EGLN1, Accession NM_022051) is another VGAM475 host target gene. EGLN1 BINDING SITE is HOST TARGET binding site found in the 5' untranslated region of mRNA encoded by EGLN1, corresponding to a HOST TARGET binding site such as BINDING SITE I, BINDING SITE II or BINDING SITE III. Table 2 illustrates the complementarity of the nucleotide sequences of EGLN1 BINDING SITE, designated SEQ ID:22580, to the nucleotide sequence of VGAM475 RNA, herein designated VGAM RNA, also designated SEQ ID:3186.

Another function of VGAM475 is therefore inhibition of Egl Nine Homolog 1 (C. elegans) (EGLN1, Accession NM_022051), a gene which is expressed in the cytoplasm of arterial smooth muscle cells. Accordingly, utilities of VGAM475 include diagnosis, prevention and treatment of diseases and clinical conditions associated with EGLN1. The function of EGLN1 and its association with various diseases and clinical conditions, has been established by previous studies, as described hereinabove with reference to VGAM216. Huntingtin Interacting Protein 1 (HIP1, Accession NM_005338) is another VGAM475 host target gene. HIP1 BINDING SITE is HOST TARGET binding site found in the 3' untranslated region of mRNA encoded by HIP1, corresponding to a HOST TARGET binding site such as BINDING SITE I, BINDING SITE II or BINDING SITE III. Table 2 illustrates the complementarity of the nucleotide sequences of HIP1 BINDING SITE, designated SEQ ID:11813, to the nucleotide sequence of VGAM475 RNA, herein designated VGAM RNA, also designated SEQ ID:3186.

Another function of VGAM475 is therefore inhibition of Huntingtin Interacting Protein 1 (HIP1, Accession NM_005338), a gene which is a membrane protein and interacts with huntingtin. Accordingly, utilities of VGAM475 include diagnosis, prevention and treatment of diseases and clinical conditions associated with HIP1. The function of HIP1 and its association with various diseases and clinical conditions, has been established by previous studies, as described hereinabove with reference to VGAM474. Holocarboxylase Synthetase (biotin-[proprionyl-Coenzyme A-carboxylase (ATP-hydrolysing)] Ligase) (HLCS, Accession NM_000411) is another VGAM475 host target gene. HLCS BINDING SITE is HOST TARGET binding site found in the 5' untranslated region of mRNA encoded by HLCS, corresponding to a HOST TARGET binding site such as BINDING SITE I, BINDING SITE II or BINDING SITE III. Table 2 illustrates the complementarity of the nucleotide sequences of HLCS BINDING SITE, designated SEQ ID:5993, to the nucleotide sequence of VGAM475 RNA, herein designated VGAM RNA, also designated SEQ ID:3186.

Another function of VGAM475 is therefore inhibition of Holocarboxylase Synthetase (biotin-[proprionyl-Coenzyme A-carboxylase (ATP-hydrolysing)] Ligase) (HLCS, Accession NM_000411). Accordingly, utilities of VGAM475 include diagnosis, prevention and treatment of diseases and clinical conditions associated with HLCS. Interleukin 1, Alpha (IL1A, Accession XM_031221) is another VGAM475 host target gene. IL1A BINDING SITE is HOST TARGET binding site found in the 3' untranslated region of mRNA encoded by IL1A, corresponding to a HOST TARGET binding site such as BINDING SITE I, BINDING SITE II or BINDING SITE III. Table 2 illustrates the complementarity of the nucleotide sequences of IL1A BINDING SITE, designated SEQ ID:31306, to the nucleotide sequence of VGAM475 RNA, herein designated VGAM RNA, also designated SEQ ID:3186.

Another function of VGAM475 is therefore inhibition of Interleukin 1, Alpha (IL1A, Accession XM_031221), a gene which stimulates thymocyte proliferation by inducing il-2 release, b-cell maturation & proliferation, & fibroblast growth factor activity. Accordingly, utilities of VGAM475 include diagnosis, prevention and treatment of diseases and clinical conditions associated with IL1A. The function of IL1A has been established by previous studies. There are 2 structurally distinct forms of IL1: IL1(alpha), which is the acidic form with pI5, and IL1(beta) (IL1B; 147720), the neutral form with pI7. Both are 17-kD proteins coded by separate genes. The IL1A gene has 10,206 bp with 7 exons and 6 introns (Furutani et al., 1986). By Southern transfer analysis of DNAs from human-rodent somatic cell hybrids, Modi et al. (1988) assigned the IL1A gene to chromosome 2. Regional localization to 2q13-q21 was achieved by in situ hybridization. Lafage et al. (1989) confirmed assignment to 2q13 by in situ hybridization. The IL1A and IL1B proteins, which are synthesized by a variety of cell types including activated macrophages, keratinocytes, stimulated B lymphocytes, and fibroblasts, are potent mediators of inflammation and immunity. Lord et al. (1991) demonstrated that both the alpha and beta forms, but particularly the beta form, are transcribed in polymorphonuclear leukocytes stimulated with LPS. Both IL1A and IL1B stimulate osteoclast activity in vitro and are potent bone resorbing factors. Sabatino et al. (1988) studied the effects of 72-hour subcutaneous infusions of interleukins 1-alpha and -beta on plasma, calcium, and bone morphology. Both interleukins 1 caused a marked, dose-dependent increase in plasma calcium. Increased numbers of osteoclasts and bone resorption surfaces were observed on quantitative histomorphometry of bone. The results suggest a role for IL1 in the modulation of extracellular fluid calcium homeostasis. Hogquist et al. (1991) demonstrated that interleukin-1 is involved in apoptosis (cell death). Both the alpha and the beta forms are released as a consequence of cell injury regardless of the insult Ki et al. (2001) analyzed the IL1A -889 C/T genotype of 126 Korean patients with AD and found no significant difference in allele frequencies between patients and controls. Interestingly, there were no T/T homozygotes in the entire study population Full details of the abovementioned studies are described in the following publications, the disclosure of which are hereby incorporated by reference:

Hogquist, K. A.; Nett, M. A.; Unanue, E. R.; Chaplin, D. D.: Interleukin 1 is processed and released during apoptosis. Proc. Nat. Acad. Sci. 88:8485-8489, 1991; and Ki, C.-S.; Na, D. L.; Kim, D. K.; Kim, H. J.; Kim, J.-W.: Lack of association of the interleukin-1-alpha gene polymorphism with Alzheimer's disease in a Korean population. (Letter) Ann.

Further studies establishing the function and utilities of IL1A are found in John Hopkins OMIM database record ID 147760, and in sited publications numbered 4142-4157, 4139-4141, 4158, 1116 and 11331-11334 listed in the bibliography section hereinbelow, which are also hereby incorporated by reference. Mitogen-activated Protein Kinase Kinase Kinase 7 Interacting Protein 1 (MAP3K7IP1, Accession NM_006116) is another VGAM475 host target gene. MAP3K7IP1 BINDING SITE is HOST TARGET binding site found in the 3' untranslated region of mRNA encoded by MAP3K7IP1, corresponding to a HOST TARGET binding site such as BINDING SITE I, BINDING SITE II or BINDING SITE III. Table 2 illustrates the complementarity of the nucleotide sequences of MAP3K7IP1 BINDING SITE, designated SEQ ID:12763, to the nucleotide sequence of VGAM475 RNA, herein designated VGAM RNA, also designated SEQ ID:3186.

Another function of VGAM475 is therefore inhibition of Mitogen-activated Protein Kinase Kinase Kinase 7 Interacting Protein 1 (MAP3K7IP1, Accession NM_006116), a gene which may be an important signaling intermediate between tgfb receptors and map3k7/tak1. Accordingly, utilities of VGAM475 include diagnosis, prevention and treatment of diseases and clinical conditions associated with MAP3K7IP1. The function of MAP3K7IP1 and its association with various diseases and clinical conditions, has been established by previous studies, as described hereinabove with reference to VGAM132. Microtubule-associated Protein Tau (MAPT, Accession NM_005910) is another VGAM475 host target gene. MAPT BINDING SITE1 through MAPT BINDING SITE4 are HOST TARGET binding sites found in untranslated regions of mRNA encoded by MAPT, corresponding to HOST TARGET binding sites such as BINDING SITE I, BINDING SITE II or BINDING SITE III. Table 2 illustrates the complementarity of the nucleotide sequences of MAPT BINDING SITE1 through MAPT BINDING SITE4, designated SEQ ID:12542, SEQ ID:18830, SEQ ID:18836 and SEQ ID:18842 respectively, to the nucleotide sequence of VGAM475 RNA, herein designated VGAM RNA, also designated SEQ ID:3186.

Another function of VGAM475 is therefore inhibition of Microtubule-associated Protein Tau (MAPT, Accession NM_005910), a gene which Microtubule-associated protein tau; promotes microtubule assembly. Accordingly, utilities of VGAM475 include diagnosis, prevention and treatment of diseases and clinical conditions associated with MAPT. The function of MAPT and its association with various diseases and clinical conditions, has been established by previous studies, as described hereinabove with reference to VGAM178. POU Domain, Class 2, Associating Factor 1 (POU2AF1, Accession NM_006235) is another VGAM475 host target gene. POU2AF1 BINDING SITE is HOST TARGET binding site found in the 3' untranslated region of mRNA encoded by POU2AF1, corresponding to a HOST TARGET binding site such as BINDING SITE I, BINDING SITE II or BINDING SITE III. Table 2 illustrates the complementarity of the nucleotide sequences of POU2AF1 BINDING SITE, designated SEQ ID:12894, to the nucleotide sequence of VGAM475 RNA, herein designated VGAM RNA, also designated SEQ ID:3186.

Another function of VGAM475 is therefore inhibition of POU Domain, Class 2, Associating Factor 1 (POU2AF1, Accession NM_006235), a gene which is a transcriptional coactivator that specifically associates with either oct1 or oct2. Accordingly, utilities of VGAM475 include diagnosis, prevention and treatment of diseases and clinical conditions associated with POU2AF1. The function of POU2AF1 and its association with various diseases and clinical conditions, has been established by previous studies, as described hereinabove with reference to VGAM171. PR Domain Containing 2, with ZNF Domain (PRDM2, Accession NM_012231) is another VGAM475 host target gene. PRDM2 BINDING SITE is HOST TARGET binding site found in the 3' untranslated region of mRNA encoded by PRDM2, corresponding to a HOST TARGET binding site such as BINDING SITE I, BINDING SITE II or BINDING SITE III. Table 2 illustrates the complementarity of the nucleotide sequences of PRDM2 BINDING SITE, designated SEQ ID:14530, to the nucleotide sequence of VGAM475 RNA, herein designated VGAM RNA, also designated SEQ ID:3186.

Another function of VGAM475 is therefore inhibition of PR Domain Containing 2, with ZNF Domain (PRDM2, Accession NM_012231), a gene which plays a role in transcriptional regulation during neuronal differentiation and pathogenesis of retinoblastoma. Accordingly, utilities of VGAM475 include diagnosis, prevention and treatment of diseases and clinical conditions associated with PRDM2. The function of PRDM2 and its association with various diseases and clinical conditions, has been established by previous studies, as described hereinabove with reference to VGAM120. Secreted Frizzled-related Protein 1 (SFRP1, Accession NM_003012) is another VGAM475 host target gene. SFRP1 BINDING SITE is HOST TARGET binding site found in the 3' untranslated region of mRNA encoded by SFRP1, corresponding to a HOST TARGET binding site such as BINDING SITE I, BINDING SITE II or BINDING SITE III. Table 2 illustrates the complementarity of the nucleotide sequences of SFRP1 BINDING SITE, designated SEQ ID:8932, to the nucleotide sequence of VGAM475 RNA, herein designated VGAM RNA, also designated SEQ ID:3186.

Another function of VGAM475 is therefore inhibition of Secreted Frizzled-related Protein 1 (SFRP1, Accession NM_003012), a gene which is a receptor for wnt proteins that may have an anti-apoptotic function. Accordingly, utilities of VGAM475 include diagnosis, prevention and treatment of diseases and clinical conditions associated with SFRP1. The function of SFRP1 and its association with various diseases and clinical conditions, has been established by previous studies, as described hereinabove with reference to VGAM250. Serine Hydroxymethyltransferase 1 (soluble) (SHMT1, Accession NM_004169) is another VGAM475 host target gene. SHMT1 BINDING SITE is HOST TARGET binding site found in the 3' untranslated region of mRNA encoded by SHMT1, corresponding to a HOST TARGET binding site such as BINDING SITE I, BINDING SITE II or BINDING SITE III. Table 2 illustrates the complementarity of the nucleotide sequences of SHMT1 BINDING SITE, designated SEQ ID:10375, to the nucleotide sequence of VGAM475 RNA, herein designated VGAM RNA, also designated SEQ ID:3186.

Another function of VGAM475 is therefore inhibition of Serine Hydroxymethyltransferase 1 (soluble) (SHMT1, Accession NM_004169), a gene which interconverts serine and glycine. Accordingly, utilities of VGAM475 include diagnosis, prevention and treatment of diseases and clinical conditions associated with SHMT1. The function of SHMT1 has been established by previous studies. Serine hydroxymethyltransferase (SHMT), a pyridoxal phosphate-containing enzyme, catalyzes the reversible conversion of serine and tetrahydrofolate to glycine and 5,10-methylene tetrahydrofolate. Some eukaryotic cells, including human cells, contain both cytosolic and mitochondrial forms of SHMT. Mammalian cells that lack mitochondrial SHMT activity are auxotrophic for glycine (SHMT2; 138450). It has been suggested that glycine synthesis from serine occurs in the mitochondria, whereas cytosolic SHMT may catalyze the conversion of glycine to serine, although direct evidence for this proposal is lacking. Garrow et al. (1993) cloned human cDNAs for cytosolic and mitochondrial SHMT by functional complementation of an Escherichia coli glyA mutant with a human cDNA library. The cDNA for the cytosolic enzyme encoded a 483-residue protein of M(r) 53,020. The deduced protein sequence shared 63% identity with that of the SHMT2 protein. By isotopic in situ hybridization, Garrow et al. (1993) assigned the cytosolic and mitochondrial SHMT genes to 17p11.2 and 12q13, respectively. The high degree of nucleotide sequence identity between the 2 isozymes as well as the presence of keratin genes in both chromosomal regions was consistent with these regions of chromosomes 12 and 17 having arisen by a duplication event. Folate-dependent one-carbon metabolism is critical for the synthesis of numerous cellular constituents required for cell growth, and SHMT is central to this process. Elsea et al. (1995) found that the SHMT1 gene maps to the critical interval for Smith-Magenis syndrome (SMS; 182290) on 17p11.2. They found that the gene spans approximately 40 kb. It was found to be deleted in all 26 SMS patients examined by PCR, fluorescence in situ hybridization, and/or Southern analysis. Furthermore, haploinsufficiency was indicated by the fact that SHMT enzyme activity in patient lymphoblasts was approximately 50% that of unaffected parent lymphoblasts. They suggested that haploinsufficiency may play a role in the SMS phenotype and that this finding may point to possible therapeutic interventions.

Full details of the abovementioned studies are described in the following publications, the disclosure of which are hereby incorporated by reference:

Garrow, T. A.; Brenner, A. A.; Whitehead, V. M.; Chen, X.-N.; Duncan, R. G.; Korenberg, J. R.; Shane, B.: Cloning of human cDNAs encoding mitochondrial and cytosolic serine hydroxymethyltransferases and chromosomal localization. J. Biol. Chem. 268:11910-11916, 1993; and Elsea, S. H.; Juyal, R. C.; Jiralerspong, S.; Finucane, B. M.; Pandolfo, M.; Greenberg, F.; Baldini, A.; Stover, P.; Patel, P. I.: Haploinsufficiency of cytosolic serine hydroxymethyltran.

Further studies establishing the function and utilities of SHMT1 are found in John Hopkins OMIM database record ID 182144, and in sited publications numbered 1142-114 and 4810 listed in the bibliography section hereinbelow, which are also hereby incorporated by reference. Sorbin and SH3 Domain Containing 1 (SORBS1, Accession NM_015385) is another VGAM475 host target gene. SORBS1 BINDING SITE is HOST TARGET binding site found in the 3' untranslated region of mRNA encoded by SORBS1, corresponding to a HOST TARGET binding site such as BINDING SITE I, BINDING SITE II or BINDING SITE III. Table 2 illustrates the complementarity of the nucleotide sequences of SORBS1 BINDING SITE, designated SEQ ID:17690, to the nucleotide sequence of VGAM475 RNA, herein designated VGAM RNA, also designated SEQ ID:3186.

Another function of VGAM475 is therefore inhibition of Sorbin and SH3 Domain Containing 1 (SORBS1, Accession NM_015385), a gene which necessary for cell polarization during vegetative growth. Accordingly, utilities of VGAM475 include diagnosis, prevention and treatment of diseases and clinical conditions associated with SORBS1. The function of SORBS1 has been established by previous studies. Lin et al. (2001) identified 14 single-nucleotide polymorphisms (SNPs) in the human SH3P12 gene, which they called SORBS1. Studies in 202 nonobese, 113 obese, and 455 subjects with type II diabetes (OMIM Ref. No. 125853) revealed that the alanine allele of a T228A polymorphism in exon 7 exerted a protective role for both obesity (OMIM Ref. No. 601665) (relative risk 0.466; 95% confidence interval 0.265 to 0.821) and diabetes (relative risk 0.668; 95% confidence interval 0.472 to 0.945). Neither allele of the R74W polymorphism was associated with either obesity or diabetes. The authors suggested that the SH3P12 gene may play an important role in the pathogenesis of human disorders with insulin resistance. Insulin stimulates the transport of glucose into fat and muscle cells and initiates its actions by binding to its tyrosine kinase receptor, leading to the phosphorylation of intracellular substrates. One such substrate is the CBL proto-oncogene product. CBL is recruited to the insulin receptor by interaction with the adaptor protein CAP, through 1 of 3 adjacent SH3 domains in the C terminus of CAP. Upon phosphorylation of CBL, the CAP-CBL complex dissociates from the insulin receptor and moves to a caveolin (see OMIM Ref. No. 601047)-enriched triton-insoluble membrane fraction (Mastick et al., 1995). To identify a molecular mechanism underlying this subcellular redistribution, Baumann et al. (2000) screened a yeast 2-hybrid library using the N-terminal region of CAP and identified the caveolar protein flotillin (OMIM Ref. No. 131560). Flotillin forms a ternary complex with CAP and CBL, directing the localization of the CAP-CBL complex to a lipid raft subdomain of the plasma membrane. Expression of the N-terminal domain of CAP in 3T3-L1 adipocytes blocks the stimulation of glucose transport by insulin, without affecting signaling events that depend on phosphatidylinositol-3-OH kinase (see OMIM Ref. No. 602838). Thus, localization of the CBL-CAP complex to lipid rafts generates a pathway that is crucial in the regulation of glucose uptake.

Full details of the abovementioned studies are described in the following publications, the disclosure of which are hereby incorporated by reference:

Lin, W.-H.; Chiu, K. C.; Chang, H.-M.; Lee, K.-C.; Tai, T.-Y.; Chuang, L.-M.: Molecular scanning of the human sorbin and SH3-domain-containing-1 (SORBS1) gene: positive association of the T228A polymorphism with obesity and type 2 diabetes. Hum. Molec. Genet. 10:1753-1760, 2001; and Baumann, C. A.; Ribon, V.; Kanzaki, M.; Thurmond, D. C.; Mora, S.; Shigematsu, S.; Bickel, P. E.; Pessin, J. E.; Saltiel, A. R.: CAP defines a second signalling pathway required for insul.

Further studies establishing the function and utilities of SORBS1 are found in John Hopkins OMIM database record ID 605264, and in sited publications numbered 4598, 11935-5034, 1090 and 11936 listed in the bibliography section hereinbelow, which are also hereby incorporated by reference. Sepiapterin Reductase (7,8-dihydrobiopterin:NADP+ oxidoreductase) (SPR, Accession NM_003124) is another VGAM475 host target gene. SPR BINDING SITE is HOST TARGET binding site found in the 3' untranslated region of mRNA encoded by SPR, corresponding to a HOST TARGET binding site such as BINDING SITE I, BINDING SITE II or BINDING SITE III. Table 2 illustrates the complementarity of the nucleotide sequences of SPR BINDING SITE, designated SEQ ID:9094, to the nucleotide sequence of VGAM475 RNA, herein designated VGAM RNA, also designated SEQ ID:3186.

Another function of VGAM475 is therefore inhibition of Sepiapterin Reductase (7,8-dihydrobiopterin:NADP+ oxidoreductase) (SPR, Accession NM_003124), a gene which catalyzes the. Accordingly, utilities of VGAM475 include diagnosis, prevention and treatment of diseases and clinical conditions associated with SPR. The function of SPR has been established by previous studies. Bonafe et al. (2001) reported 2 patients with progressive psychomotor retardation, dystonia, severe dopamine and serotonin deficiencies (low levels of 5-hydroxyindoleacetic and homovanillic acids), and abnormal pterin pattern (high levels of biopterin and dihydrobiopterin) in cerebrospinal fluid. They presented with normal urinary pterins and without hyperphenylalaninemia. Studies of skin fibroblasts revealed inactive sepiapterin reductase, the enzyme catalyzing the final 2-step reaction in the biosynthesis of tetrahydrobiopterin (BH4). Mutations in the SPR gene were detected in both patients: homozygous (182125.0001) in 1 and compound heterozygous (182125.0002) in the other. The authors suggested that autosomal recessive deficiency of sepiapterin reductase leads to BH4 and neurotransmitter deficiencies without hyperphenylalaninemia and may not be detected by neonatal screening for phenylketonuria.

Full details of the abovementioned studies are described in the following publications, the disclosure of which are hereby incorporated by reference:

Bonafe, L.; Thony, B.; Penzien, J. M.; Czarnecki, B.; Blau, N.: Mutations in the sepiapterin reductase gene cause a novel tetrahydrobiopterin-dependent monoamine-neurotransmitter deficiency without hyperphenylalaninemia. Am. J. Hum. Genet. 69:269-277, 2001; and Blau, N.; Thony, B.; Renneberg, A.; Arnold, L. A.; Hyland, K.: Dihydropteridine reductase deficiency localized to the central nervous system. J. Inherit. Metab. Dis. 21:433-434, 1998.

Further studies establishing the function and utilities of SPR are found in John Hopkins OMIM database record ID 182125, and in sited publications numbered 10607-10612 listed in the bibliography section hereinbelow, which are also hereby incorporated by reference. Topoisomerase (DNA) I (TOP1, Accession NM_003286) is another VGAM475 host target gene. TOP1 BINDING SITE is HOST TARGET binding site found in the 3' untranslated region of mRNA encoded by TOP1, corresponding to a HOST TARGET binding site such as BINDING SITE I, BINDING SITE II or BINDING SITE III. Table 2 illustrates the complementarity of the nucleotide sequences of TOP1 BINDING SITE, designated SEQ ID:9296, to the nucleotide sequence of VGAM475 RNA, herein designated VGAM RNA, also designated SEQ ID:3186.

Another function of VGAM475 is therefore inhibition of Topoisomerase (DNA) I (TOP1, Accession NM_003286). Accordingly, utilities of VGAM475 include diagnosis, prevention and treatment of diseases and clinical conditions associated with TOP1. Thiamin Pyrophosphokinase 1 (TPK1, Accession NM_022445) is another VGAM475 host target gene. TPK1 BINDING SITE is HOST TARGET binding site found in the 3' untranslated region of mRNA encoded by TPK1, corresponding to a HOST TARGET binding site such as BINDING SITE I, BINDING SITE II or BINDING SITE III. Table 2 illustrates the complementarity of the nucleotide sequences of TPK1 BINDING SITE, designated SEQ ID:22779, to the nucleotide sequence of VGAM475 RNA, herein designated VGAM RNA, also designated SEQ ID:3186.

Another function of VGAM475 is therefore inhibition of Thiamin Pyrophosphokinase 1 (TPK1, Accession NM_022445), a gene which catalyzes the conversion of thiamine, a form of vitamin B1, to thiamine pyrophosphate. Accordingly, utilities of VGAM475 include diagnosis, prevention and treatment of diseases and clinical conditions associated with TPK1. The function of TPK1 has been established by previous studies. By Northern blot analysis, Nosaka et al. (1999) detected expression of mouse Tpk1 predominantly in kidney and liver, with very faint expression in heart, brain, and testis. In contrast to the tissue-specific expression of mouse Tpk1, Nosaka et al. (2001) reported broad expression of a human 2.5-kb TPK1 transcript. They detected very low expression in a variety of human tissues and relatively abundant expression in heart, kidney, and peripheral leukocytes. By Northern blot analysis, Zhao et al. (2001) detected broad expression of a 2.6-kb TPK1 transcript, with highest levels in testis and in those tissues involved in thiamine absorption (small intestine) and reabsorption (OMIM Ref. No. kidney). They also detected a smaller (1-1.5 kb), testis-specific TPK1 transcript. From results of cell culture experiments, Nosaka et al. (1999) and Nosaka et al. (2001) concluded that thiamine or a thiamine derivative does not participate in the regulation of TPK1. Nosaka et al. (2001) detected no difference in TPK1 expression in cultured fibroblasts from normal subjects or from patients with thiamine-responsive megaloblastic anemia (OMIM Ref. No. 249270).

Full details of the abovementioned studies are described in the following publications, the disclosure of which are hereby incorporated by reference:

Zhao, R.; Gao, F.; Goldman, I. D.: Molecular cloning of human thiamin pyrophosphokinase. Biochim. Biophys. Acta 1517:320-322, 2001; and Nosaka, K.; Onozuka, M.; Nishino, H.; Nishimura, H.; Kawasaki, Y.; Ueyama, H.: Molecular cloning and expression of a mouse thiamin pyrophosphokinase cDNA. J. Biol. Chem. 274:34129-3413.

Further studies establishing the function and utilities of TPK1 are found in John Hopkins OMIM database record ID 606370, and in sited publications numbered 6176-6178 listed in the bibliography section hereinbelow, which are also hereby incorporated by reference. Wolf-Hirschhorn Syndrome Candidate 1-like 1 (WHSC1L1, Accession NM_017778) is another VGAM475 host target gene. WHSC1L1 BINDING SITE1 and WHSC1L1 BINDING SITE2 are HOST TARGET binding sites found in untranslated regions of mRNA encoded by WHSC1L1, corresponding to HOST TARGET binding sites such as BINDING SITE I, BINDING SITE II or BINDING SITE III. Table 2 illustrates the complementarity of the nucleotide sequences of WHSC1L1 BINDING SITE1 and WHSC1L1 BINDING SITE2, designated SEQ ID:19409 and SEQ ID:23316 respectively, to the nucleotide sequence of VGAM475 RNA, herein designated VGAM RNA, also designated SEQ ID:3186.

Another function of VGAM475 is therefore inhibition of Wolf-Hirschhorn Syndrome Candidate 1-like 1 (WHSC1L1, Accession NM_017778), a gene which restores repair of base-base and single- nucleotide insertion-deletion mismatches, and increases the proficiency to process heteroduplexes with insertion-deletion mismatches. Accordingly, utilities of VGAM475 include diagnosis, prevention and treatment of diseases and clinical conditions associated with WHSC1L1. The function of WHSC1L1 has been established by previous studies. By EST database searching with mouse Nsd1 (OMIM Ref. No. 606681) and human NSD2 (WHSC1; 602952) as probe and screening of an amnion cell cDNA library, Angrand et al. (2001) cloned a partial sequence for WHSC1L1, which they called NSD3. They obtained the full-length cDNA by 5-prime RACE. The deduced 1,437-amino acid protein contains 2 PWWP domains involved in protein-protein interaction, 5 PHD-type zinc finger motifs found in chromatin-associated proteins, a SAC (SET-associated cys-rich) domain, a SET domain, and a C-terminal C5HCH domain. They also identified a variant, arising from alternative polyadenylation and exon splicing, that encodes a deduced 645-amino acid peptide. The short isoform contains a single PWWP domain. By PCR analysis, Angrand et al. (2001) found the 2 variants, as well as a third, 1,388-amino acid peptide, in HeLa cells. WHSC1L1 shares 68% and 55% identity with mouse Nsd1 (OMIM Ref. No. 606681) and human WHSC1 (OMIM Ref. No. 602952), respectively, over a 700-amino acid block containing the SAC, SET, and C5HCH domains. Northern blot analysis detected an 8.5-kb transcript in all tissues examined, with highest expression in brain, heart, and skeletal muscle, and lower expression in liver and lung. Angrand et al. (2001) determined that the WHSC1L1 gene contains 24 exons and spans over 90 kb. By FISH, Angrand et al. (2001) mapped the WHSC1L1 gene to chromosome 8p12. Stec et al. (2001) identified a pseudogene (WHSC1L2P) on chromosome 17q21. Rosati et al. (2002) described fusion between the NUP98 gene (OMIM Ref. No. 601021) and the NSD3 gene in a patient with acute myeloid leukemia associated with t (8;11)(p11.2; p15). FISH analysis revealed a split of a specific BAC which showed the fusion partner at 8p11.2 to be NSD3.

Full details of the abovementioned studies are described in the following publications, the disclosure of which are hereby incorporated by reference:

Angrand, P.-O.; Apiou, F.; Stewart, A. F.; Dutrillaux, B.; Losson, R.; Chambon, P. : NSD3, a new SET domain-containing gene, maps to 8p12 and is amplified in human breast cancer cell lines. Genomics 74:79-88, 2001; and Rosati, R.; La Starza, R.; Veronese, A.; Aventin, A.; Schwienbacher, C.; Vallespi, T.; Negrini, M.; Martelli, M. F.; Mecucci, C.: NUP98 is fused to the NSD3 gene in acute myeloid leuke.

Further studies establishing the function and utilities of WHSC1L1 are found in John Hopkins OMIM database record ID 607083, and in sited publications numbered 549 and 9652 listed in the bibliography section hereinbelow, which are also hereby incorporated by reference. Chromosome 20 Open Reading Frame 4 (C20orf4, Accession NM_015511) is another VGAM475 host target gene. C20orf4 BINDING SITE is HOST TARGET binding site found in the 3' untranslated region of mRNA encoded by C20orf4, corresponding to a HOST TARGET binding site such as BINDING SITE I, BINDING SITE II or BINDING SITE III. Table 2 illustrates the complementarity of the nucleotide sequences of C20orf4 BINDING SITE, designated SEQ ID:17772, to the nucleotide sequence of VGAM475 RNA, herein designated VGAM RNA, also designated SEQ ID:3186.

Another function of VGAM475 is therefore inhibition of Chromosome 20 Open Reading Frame 4 (C20orf4, Accession NM_015511). Accordingly, utilities of VGAM475 include diagnosis, prevention and treatment of diseases and clinical conditions associated with C20orf4. Calcium/calmodulin-dependent Protein Kinase Kinase 2, Beta (CAMKK2, Accession NM_006549) is another VGAM475 host target gene. CAMKK2 BINDING SITE is HOST TARGET binding site found in the 3' untranslated region of mRNA encoded by CAMKK2, corresponding to a HOST TARGET binding site such as BINDING SITE I, BINDING SITE II or BINDING SITE III. Table 2 illustrates the complementarity of the nucleotide sequences of CAMKK2 BINDING SITE, designated SEQ ID:13309, to the nucleotide sequence of VGAM475 RNA, herein designated VGAM RNA, also designated SEQ ID:3186.

Another function of VGAM475 is therefore inhibition of Calcium/calmodulin-dependent Protein Kinase Kinase 2, Beta (CAMKK2, Accession NM_006549). Accordingly, utilities of VGAM475 include diagnosis, prevention and treatment of diseases and clinical conditions associated with CAMKK2. CTAGE-1 (Accession NM_022663) is another VGAM475 host target gene. CTAGE-1 BINDING SITE is HOST TARGET binding site found in the 3' untranslated region of mRNA encoded by CTAGE-1, corresponding to a HOST TARGET binding site such as BINDING SITE I, BINDING SITE II or BINDING SITE III. Table 2 illustrates the complementarity of the nucleotide sequences of CTAGE-1 BINDING SITE, designated SEQ ID:22910, to the nucleotide sequence of VGAM475 RNA, herein designated VGAM RNA, also designated SEQ ID:3186.

Another function of VGAM475 is therefore inhibition of CTAGE-1 (Accession NM_022663). Accordingly, utilities of VGAM475 include diagnosis, prevention and treatment of diseases and clinical conditions associated with CTAGE-1.

F-box Only Protein 9 (FBXO9, Accession NM_033480) is another VGAM475 host target gene. FBXO9 BINDING SITE is HOST TARGET binding site found in the 3' untranslated region of mRNA encoded by FBXO9, corresponding to a HOST TARGET binding site such as BINDING SITE I, BINDING SITE II or BINDING SITE III. Table 2 illustrates the complementarity of the nucleotide sequences of FBXO9 BINDING SITE, designated SEQ ID:27255, to the nucleotide sequence of VGAM475 RNA, herein designated VGAM RNA, also designated SEQ ID:3186.

Another function of VGAM475 is therefore inhibition of F-box Only Protein 9 (FBXO9, Accession NM_033480). Accordingly, utilities of VGAM475 include diagnosis, prevention and treatment of diseases and clinical conditions associated with FBXO9. FLJ13322 (Accession NM_024722) is another VGAM475 host target gene. FLJ13322 BINDING SITE is HOST TARGET binding site found in the 3' untranslated region of mRNA encoded by FLJ13322, corresponding to a HOST TARGET binding site such as BINDING SITE I, BINDING SITE II or BINDING SITE III. Table 2 illustrates the complementarity of the nucleotide sequences of FLJ13322 BINDING SITE, designated SEQ ID:24061, to the nucleotide sequence of VGAM475 RNA, herein designated VGAM RNA, also designated SEQ ID:3186.

Another function of VGAM475 is therefore inhibition of FLJ13322 (Accession NM_024722). Accordingly, utilities of VGAM475 include diagnosis, prevention and treatment of diseases and clinical conditions associated with FLJ13322. FLJ13646 (Accession NM_024584) is another VGAM475 host target gene. FLJ13646 BINDING SITE is HOST TARGET binding site found in the 3' untranslated region of mRNA encoded by FLJ13646, corresponding to a HOST TARGET binding site such as BINDING SITE I, BINDING SITE II or BINDING SITE III. Table 2 illustrates the complementarity of the nucleotide sequences of FLJ13646 BINDING SITE, designated SEQ ID:23815, to the nucleotide sequence of VGAM475 RNA, herein designated VGAM RNA, also designated SEQ ID:3186.

Another function of VGAM475 is therefore inhibition of FLJ13646 (Accession NM_024584). Accordingly, utilities of VGAM475 include diagnosis, prevention and treatment of diseases and clinical conditions associated with FLJ13646. FLJ20188 (Accession NM_017703) is another VGAM475 host target gene. FLJ20188 BINDING SITE is HOST TARGET binding site found in the 3' untranslated region of mRNA encoded by FLJ20188, corresponding to a HOST TARGET binding site such as BINDING SITE I, BINDING SITE II or BINDING SITE III. Table 2 illustrates the complementarity of the nucleotide sequences of FLJ20188 BINDING SITE, designated SEQ ID:19277, to the nucleotide sequence of VGAM475 RNA, herein designated VGAM RNA, also designated SEQ ID:3186.

Another function of VGAM475 is therefore inhibition of FLJ20188 (Accession NM_017703). Accordingly, utilities of VGAM475 include diagnosis, prevention and treatment of diseases and clinical conditions associated with FLJ20188. FLJ21032 (Accession NM_024906) is another VGAM475 host target gene. FLJ21032 BINDING SITE is HOST TARGET binding site found in the 3' untranslated region of mRNA encoded by FLJ21032, corresponding to a HOST TARGET binding site such as BINDING SITE I, BINDING SITE II or BINDING SITE III. Table 2 illustrates the complementarity of the nucleotide sequences of FLJ21032 BINDING SITE, designated SEQ ID:24403, to the nucleotide sequence of VGAM475 RNA, herein designated VGAM RNA, also designated SEQ ID:3186.

Another function of VGAM475 is therefore inhibition of FLJ21032 (Accession NM_024906). Accordingly, utilities of VGAM475 include diagnosis, prevention and treatment of diseases and clinical conditions associated with FLJ21032. FLJ23306 (Accession NM_024530) is another VGAM475 host target gene. FLJ23306 BINDING SITE is HOST TARGET binding site found in the 3' untranslated region of mRNA encoded by FLJ23306, corresponding to a HOST TARGET binding site such as BINDING SITE I, BINDING SITE II or BINDING SITE III. Table 2 illustrates the complementarity of the nucleotide sequences of FLJ23306 BINDING SITE, designated SEQ ID:23733, to the nucleotide sequence of VGAM475 RNA, herein designated VGAM RNA, also designated SEQ ID:3186.

Another function of VGAM475 is therefore inhibition of FLJ23306 (Accession NM_024530). Accordingly, utilities of VGAM475 include diagnosis, prevention and treatment of diseases and clinical conditions associated with FLJ23306. FYVE and Coiled-coil Domain Containing 1 (FYCO1, Accession NM_024513) is another VGAM475 host target gene. FYCO1 BINDING SITE is HOST TARGET binding site found in the 5' untranslated region of mRNA encoded by FYCO1, corresponding to a HOST TARGET binding site such as BINDING SITE I, BINDING SITE II or BINDING SITE III. Table 2 illustrates the complementarity of the nucleotide sequences of FYCO1 BINDING SITE, designated SEQ ID:23716, to the nucleotide sequence of VGAM475 RNA, herein designated VGAM RNA, also designated SEQ ID:3186.

Another function of VGAM475 is therefore inhibition of FYVE and Coiled-coil Domain Containing 1 (FYCO1, Accession NM_024513). Accordingly, utilities of VGAM475 include diagnosis, prevention and treatment of diseases and clinical conditions associated with FYCO1. GMPPB (Accession XM_171044) is another VGAM475 host target gene. GMPPB BINDING SITE is HOST TARGET binding site found in the 5' untranslated region of mRNA encoded by GMPPB, corresponding to a HOST TARGET binding site such as BINDING SITE I, BINDING SITE II or BINDING SITE III. Table 2 illustrates the complementarity of the nucleotide sequences of GMPPB BINDING SITE, designated SEQ ID:45816, to the nucleotide sequence of VGAM475 RNA, herein designated VGAM RNA, also designated SEQ ID:3186.

Another function of VGAM475 is therefore inhibition of GMPPB (Accession XM_171044). Accordingly, utilities of VGAM475 include diagnosis, prevention and treatment of diseases and clinical conditions associated with GMPPB. HCC-4 (Accession NM_138611) is another VGAM475 host target gene. HCC-4 BINDING SITE is HOST TARGET binding site found in the 3' untranslated region of mRNA encoded by HCC-4, corresponding to a HOST TARGET binding site such as BINDING SITE I, BINDING SITE II or BINDING SITE III. Table 2 illustrates the complementarity of the nucleotide sequences of HCC-4 BINDING SITE, designated SEQ ID:28897, to the nucleotide sequence of VGAM475 RNA, herein designated VGAM RNA, also designated SEQ ID:3186.

Another function of VGAM475 is therefore inhibition of HCC-4 (Accession NM_138611). Accordingly, utilities of VGAM475 include diagnosis, prevention and treatment of diseases and clinical conditions associated with HCC-4.

HM74 (Accession NM_006018) is another VGAM475 host target gene. HM74 BINDING SITE is HOST TARGET binding site found in the 3' untranslated region of mRNA encoded by HM74, corresponding to a HOST TARGET binding site such as BINDING SITE I, BINDING SITE II or BINDING SITE III. Table 2 illustrates the complementarity of the nucleotide sequences of HM74 BINDING SITE, designated SEQ ID:12637, to the nucleotide sequence of VGAM475 RNA, herein designated VGAM RNA, also designated SEQ ID:3186.

Another function of VGAM475 is therefore inhibition of HM74 (Accession NM_006018). Accordingly, utilities of VGAM475 include diagnosis, prevention and treatment of diseases and clinical conditions associated with HM74. HSPC063 (Accession NM_014155) is another VGAM475 host target gene. HSPC063 BINDING SITE is HOST TARGET binding site found in the 5' untranslated region of mRNA encoded by HSPC063, corresponding to a HOST TARGET binding site such as BINDING SITE I, BINDING SITE II or BINDING SITE III. Table 2 illustrates the complementarity of the nucleotide sequences of HSPC063 BINDING SITE, designated SEQ ID:15438, to the nucleotide sequence of VGAM475 RNA, herein designated VGAM RNA, also designated SEQ ID:3186.

Another function of VGAM475 is therefore inhibition of HSPC063 (Accession NM_014155). Accordingly, utilities of VGAM475 include diagnosis, prevention and treatment of diseases and clinical conditions associated with HSPC063. KIAA0247 (Accession NM_014734) is another VGAM475 host target gene. KIAA0247 BINDING SITE is HOST TARGET binding site found in the 3' untranslated region of mRNA encoded by KIAA0247, corresponding to a HOST TARGET binding site such as BINDING SITE I, BINDING SITE II or BINDING SITE III. Table 2 illustrates the complementarity of the nucleotide sequences of KIAA0247 BINDING SITE, designated SEQ ID:16372, to the nucleotide sequence of VGAM475 RNA, herein designated VGAM RNA, also designated SEQ ID:3186.

Another function of VGAM475 is therefore inhibition of KIAA0247 (Accession NM_014734). Accordingly, utilities of VGAM475 include diagnosis, prevention and treatment of diseases and clinical conditions associated with KIAA0247. KIAA0668 (Accession XM_039332) is another VGAM475 host target gene. KIAA0668 BINDING SITE is HOST TARGET binding site found in the 3' untranslated region of mRNA encoded by KIAA0668, corresponding to a HOST TARGET binding site such as BINDING SITE I, BINDING SITE II or BINDING SITE III. Table 2 illustrates the complementarity of the nucleotide sequences of KIAA0668 BINDING SITE, designated SEQ ID:33049, to the nucleotide sequence of VGAM475 RNA, herein designated VGAM RNA, also designated SEQ ID:3186.

Another function of VGAM475 is therefore inhibition of KIAA0668 (Accession XM_039332). Accordingly, utilities of VGAM475 include diagnosis, prevention and treatment of diseases and clinical conditions associated with KIAA0668. KIAA0669 (Accession NM_014779) is another VGAM475 host target gene. KIAA0669 BINDING SITE is HOST TARGET binding site found in the 3' untranslated region of mRNA encoded by KIAA0669, corresponding to a HOST TARGET binding site such as BINDING SITE I, BINDING SITE II or BINDING SITE III. Table 2 illustrates the complementarity of the nucleotide sequences of KIAA0669 BINDING SITE, designated SEQ ID:16628, to the nucleotide sequence of VGAM475 RNA, herein designated VGAM RNA, also designated SEQ ID:3186.

Another function of VGAM475 is therefore inhibition of KIAA0669 (Accession NM_014779). Accordingly, utilities of VGAM475 include diagnosis, prevention and treatment of diseases and clinical conditions associated with KIAA0669. KIAA0710 (Accession NM_014871) is another VGAM475 host target gene. KIAA0710 BINDING SITE is HOST TARGET binding site found in the 3' untranslated region of mRNA encoded by KIAA0710, corresponding to a HOST TARGET binding site such as BINDING SITE I, BINDING SITE II or BINDING SITE III. Table 2 illustrates the complementarity of the nucleotide sequences of KIAA0710 BINDING SITE, designated SEQ ID:16994, to the nucleotide sequence of VGAM475 RNA, herein designated VGAM RNA, also designated SEQ ID:3186.

Another function of VGAM475 is therefore inhibition of KIAA0710 (Accession NM_014871). Accordingly, utilities of VGAM475 include diagnosis, prevention and treatment of diseases and clinical conditions associated with KIAA0710. KIAA0720 (Accession XM_030970) is another VGAM475 host target gene. KIAA0720 BINDING SITE is HOST TARGET binding site found in the 3' untranslated region of mRNA encoded by KIAA0720, corresponding to a HOST TARGET binding site such as BINDING SITE I, BINDING SITE II or BINDING SITE III. Table 2 illustrates the complementarity of the nucleotide sequences of KIAA0720 BINDING SITE, designated SEQ ID:31237, to the nucleotide sequence of VGAM475 RNA, herein designated VGAM RNA, also designated SEQ ID:3186.

Another function of VGAM475 is therefore inhibition of KIAA0720 (Accession XM_030970). Accordingly, utilities of VGAM475 include diagnosis, prevention and treatment of diseases and clinical conditions associated with KIAA0720. KIAA1045 (Accession XM_048592) is another VGAM475 host target gene. KIAA1045 BINDING SITE1 and KIAA1045 BINDING SITE2 are HOST TARGET binding sites found in untranslated regions of mRNA encoded by KIAA1045, corresponding to HOST TARGET binding sites such as BINDING SITE I, BINDING SITE II or BINDING SITE III. Table 2 illustrates the complementarity of the nucleotide sequences of KIAA1045 BINDING SITE1 and KIAA1045 BINDING SITE2, designated SEQ ID:35203 and SEQ ID:35204 respectively, to the nucleotide sequence of VGAM475 RNA, herein designated VGAM RNA, also designated SEQ ID:3186.

Another function of VGAM475 is therefore inhibition of KIAA1045 (Accession XM_048592). Accordingly, utilities of VGAM475 include diagnosis, prevention and treatment of diseases and clinical conditions associated with KIAA1045. KIAA1337 (Accession XM_052561) is another VGAM475 host target gene. KIAA1337 BINDING SITE is HOST TARGET binding site found in the 3' untranslated region of mRNA encoded by KIAA1337, corresponding to a HOST TARGET binding site such as BINDING SITE I, BINDING SITE II or BINDING SITE III. Table 2 illustrates the complementarity of the nucleotide sequences of KIAA1337 BINDING SITE, designated SEQ ID:35982, to the nucleotide sequence of VGAM475 RNA, herein designated VGAM RNA, also designated SEQ ID:3186.

Another function of VGAM475 is therefore inhibition of KIAA1337 (Accession XM_052561). Accordingly, utilities of VGAM475 include diagnosis, prevention and treatment of diseases and clinical conditions associated with KIAA1337. KIAA1393 (Accession XM_050793) is another VGAM475 host target gene. KIAA1393 BINDING SITE is HOST TARGET binding site found in the 3' untranslated region of mRNA encoded by KIAA1393, corresponding to a HOST TARGET binding site such as BINDING SITE I, BINDING SITE II or BINDING SITE III. Table 2 illustrates the complementarity of the nucleotide sequences of KIAA1393 BINDING SITE, designated SEQ ID:35683, to the nucleotide sequence of VGAM475 RNA, herein designated VGAM RNA, also designated SEQ ID:3186.

Another function of VGAM475 is therefore inhibition of KIAA1393 (Accession XM_050793). Accordingly, utilities of VGAM475 include diagnosis, prevention and treatment of diseases and clinical conditions associated with KIAA1393. KIAA1854 (Accession XM_049884) is another VGAM475 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35532, to the nucleotide sequence of VGAM475 RNA, herein designated VGAM RNA, also designated SEQ ID:3186.

Another function of VGAM475 is therefore inhibition of KIAA1854 (Accession XM_049884). Accordingly, utilities of VGAM475 include diagnosis, prevention and treatment of diseases and clinical conditions associated with KIAA1854. KIAA1889 (Accession XM_056298) is another VGAM475 host target gene. KIAA1889 BINDING SITE is HOST TARGET binding site found in the 3' untranslated region of mRNA encoded by KIAA1889, corresponding to a HOST TARGET binding site such as BINDING SITE I, BINDING SITE II or BINDING SITE III. Table 2 illustrates the complementarity of the nucleotide sequences of KIAA1889 BINDING SITE, designated SEQ ID:36385, to the nucleotide sequence of VGAM475 RNA, herein designated VGAM RNA, also designated SEQ ID:3186.

Another function of VGAM475 is therefore inhibition of KIAA1889 (Accession XM_056298). Accordingly, utilities of VGAM475 include diagnosis, prevention and treatment of diseases and clinical conditions associated with KIAA1889. Lysophospholipase II (LYPLA2, Accession NM_007260) is another VGAM475 host target gene. LYPLA2 BINDING SITE is HOST TARGET binding site found in the 3' untranslated region of mRNA encoded by LYPLA2, corresponding to a HOST TARGET binding site such as BINDING SITE I, BINDING SITE II or BINDING SITE III. Table 2 illustrates the complementarity of the nucleotide sequences of LYPLA2 BINDING SITE, designated SEQ ID:14130, to the nucleotide sequence of VGAM475 RNA, herein designated VGAM RNA, also designated SEQ ID:3186.

Another function of VGAM475 is therefore inhibition of Lysophospholipase II (LYPLA2, Accession NM_007260). Accordingly, utilities of VGAM475 include diagnosis, prevention and treatment of diseases and clinical conditions associated with LYPLA2. Mab-21-like 2 (C. elegans) (MAB21L2, Accession NM_006439) is another VGAM475 host target gene. MAB21L2 BINDING SITE is HOST TARGET binding site found in the 5" untranslated region of mRNA encoded by MAB21L2, corresponding to a HOST TARGET binding site such as BINDING SITE I, BINDING SITE II or BINDING SITE III. Table 2 illustrates the complementarity of the nucleotide sequences of MAB21L2 BINDING SITE, designated SEQ ID:13153, to the nucleotide sequence of VGAM475 RNA, herein designated VGAM RNA, also designated SEQ ID:3186.

Another function of VGAM475 is therefore inhibition of Mab-21-like 2 (C. elegans) (MAB21L2, Accession NM_006439). Accordingly, utilities of VGAM475 include diagnosis, prevention and treatment of diseases and clinical conditions associated with MAB21L2. MGC2654 (Accession NM_024109) is another VGAM475 host target gene. MGC2654 BINDING SITE is HOST TARGET binding site found in the 3' untranslated region of mRNA encoded by MGC2654, corresponding to a HOST TARGET binding site such as BINDING SITE I, BINDING SITE II or BINDING SITE III. Table 2 illustrates the complementarity of the nucleotide sequences of MGC2654 BINDING SITE, designated SEQ ID:23555, to the nucleotide sequence of VGAM475 RNA, herein designated VGAM RNA, also designated SEQ ID:3186.

Another function of VGAM475 is therefore inhibition of MGC2654 (Accession NM_024109). Accordingly, utilities of VGAM475 include diagnosis, prevention and treatment of diseases and clinical conditions associated with MGC2654. Prostate Cancer Associated Protein 7 (PCANAP7, Accession XM_167803) is another VGAM475 host target gene. PCANAP7 BINDING SITE is HOST TARGET binding site found in the 5' untranslated region of mRNA encoded by PCANAP7, corresponding to a HOST TARGET binding site such as BINDING SITE I, BINDING SITE II or BINDING SITE III. Table 2 illustrates the complementarity of the nucleotide sequences of PCANAP7 BINDING SITE, designated SEQ ID:44839, to the nucleotide sequence of VGAM475 RNA, herein designated VGAM RNA, also designated SEQ ID:3186.

Another function of VGAM475 is therefore inhibition of Prostate Cancer Associated Protein 7 (PCANAP7, Accession XM_167803). Accordingly, utilities of VGAM475 include diagnosis, prevention and treatment of diseases and clinical conditions associated with PCANAP7. Phosphatidylserine Synthase 2 (PTDSS2, Accession NM_030783) is another VGAM475 host target gene. PTDSS2 BINDING SITE is HOST TARGET binding site found in the 3' untranslated region of mRNA encoded by PTDSS2, corresponding to a HOST TARGET binding site such as BINDING SITE I, BINDING SITE II or BINDING SITE III. Table 2 illustrates the complementarity of the nucleotide sequences of PTDSS2 BINDING SITE, designated SEQ ID:25077, to the nucleotide sequence of VGAM475 RNA, herein designated VGAM RNA, also designated SEQ ID:3186.

Another function of VGAM475 is therefore inhibition of Phosphatidylserine Synthase 2 (PTDSS2, Accession NM_030783). Accordingly, utilities of VGAM475 include diagnosis, prevention and treatment of diseases and clinical conditions associated with PTDSS2. LOC115330 (Accession NM_138445) is another VGAM475 host target gene. LOC115330 BINDING SITE is HOST TARGET binding site found in the 3' untranslated region of mRNA encoded by LOC115330, corresponding to a HOST TARGET binding site such as BINDING SITE I, BINDING SITE II or BINDING SITE III. Table 2 illustrates the complementarity of the nucleotide sequences of LOC115330 BINDING SITE, designated SEQ ID:28812, to the nucleotide sequence of VGAM475 RNA, herein designated VGAM RNA, also designated SEQ ID:3186.

Another function of VGAM475 is therefore inhibition of LOC115330 (Accession NM_138445). Accordingly, utilities of VGAM475 include diagnosis, prevention and treatment of diseases and clinical conditions associated with LOC115330. LOC124446 (Accession XM_058805) is another VGAM475 host target gene. LOC124446 BINDING SITE is HOST TARGET binding site found in the 5' untranslated region of mRNA encoded by LOC124446, corresponding to a HOST TARGET binding site such as BINDING SITE I, BINDING SITE II or BINDING SITE III. Table 2 illustrates the complementarity of the nucleotide sequences of LOC124446 BINDING SITE, designated SEQ ID:36751, to the nucleotide sequence of VGAM475 RNA, herein designated VGAM RNA, also designated SEQ ID:3186.

Another function of VGAM475 is therefore inhibition of LOC124446 (Accession XM_058805). Accordingly, utilities of VGAM475 include diagnosis, prevention and treatment of diseases and clinical conditions associated with LOC124446. LOC126299 (Accession XM_059019) is another VGAM475 host target gene. LOC126299 BINDING SITE is HOST TARGET binding site found in the 5' untranslated region of mRNA encoded by LOC126299, corresponding to a HOST TARGET binding site such as BINDING SITE I, BINDING SITE II or BINDING SITE III. Table 2 illustrates the complementarity of the nucleotide sequences of LOC126299 BINDING SITE, designated SEQ ID:36817, to the nucleotide sequence of VGAM475 RNA, herein designated VGAM RNA, also designated SEQ ID:3186.

Another function of VGAM475 is therefore inhibition of LOC126299 (Accession XM_059019). Accordingly, utilities of VGAM475 include diagnosis, prevention and treatment of diseases and clinical conditions associated with LOC126299. LOC133584 (Accession XM_059661) is another VGAM475 host target gene. LOC133584 BINDING SITE is HOST TARGET binding site found in the 3' untranslated region of mRNA encoded by LOC133584, corresponding to a HOST TARGET binding site such as BINDING SITE I, BINDING SITE II or BINDING SITE III. Table 2 illustrates the complementarity of the nucleotide sequences of LOC133584 BINDING SITE, designated SEQ ID:37047, to the nucleotide sequence of VGAM475 RNA, herein designated VGAM RNA, also designated SEQ ID:3186.

Another function of VGAM475 is therefore inhibition of LOC133584 (Accession XM_059661). Accordingly, utilities of VGAM475 include diagnosis, prevention and treatment of diseases and clinical conditions associated with LOC133584. LOC144347 (Accession XM_084832) is another VGAM475 host target gene. LOC144347 BINDING SITE is HOST TARGET binding site found in the 3' untranslated region of mRNA encoded by LOC144347, corresponding to a HOST TARGET binding site such as BINDING SITE I, BINDING SITE II or BINDING SITE III. Table 2 illustrates the complementarity of the nucleotide sequences of LOC144347 BINDING SITE, designated SEQ ID:37725, to the nucleotide sequence of VGAM475 RNA, herein designated VGAM RNA, also designated SEQ ID:3186.

Another function of VGAM475 is therefore inhibition of LOC144347 (Accession XM_084832). Accordingly, utilities of VGAM475 include diagnosis, prevention and treatment of diseases and clinical conditions associated with LOC144347. LOC147991 (Accession XM_085993) is another VGAM475 host target gene. LOC147991 BINDING SITE is HOST TARGET binding site found in the 5' untranslated region of mRNA encoded by LOC147991, corresponding to a HOST TARGET binding site such as BINDING SITE I, BINDING SITE II or BINDING SITE III. Table 2 illustrates the complementarity of the nucleotide sequences of LOC147991 BINDING SITE, designated SEQ ID:38437, to the nucleotide sequence of VGAM475 RNA, herein designated VGAM RNA, also designated SEQ ID:3186.

Another function of VGAM475 is therefore inhibition of LOC147991 (Accession XM_085993). Accordingly, utilities of VGAM475 include diagnosis, prevention and treatment of diseases and clinical conditions associated with LOC147991. LOC149175 (Accession XM_086445) is another VGAM475 host target gene. LOC149175 BINDING SITE is HOST TARGET binding site found in the 3' untranslated region of mRNA encoded by LOC149175, corresponding to a HOST TARGET binding site such as BINDING SITE I, BINDING SITE II or BINDING SITE III. Table 2 illustrates the complementarity of the nucleotide sequences of LOC149175 BINDING SITE, designated SEQ ID:38661, to the nucleotide sequence of VGAM475 RNA, herein designated VGAM RNA, also designated SEQ ID:3186.

Another function of VGAM475 is therefore inhibition of LOC149175 (Accession XM_086445). Accordingly, utilities of VGAM475 include diagnosis, prevention and treatment of diseases and clinical conditions associated with LOC149175. LOC149301 (Accession XM_086480) is another VGAM475 host target gene. LOC149301 BINDING SITE is HOST TARGET binding site found in the 3' untranslated region of mRNA encoded by LOC149301, corresponding to a HOST TARGET binding site such as BINDING SITE I, BINDING SITE II or BINDING SITE III. Table 2 illustrates the complementarity of the nucleotide sequences of LOC149301 BINDING SITE, designated SEQ ID:38687, to the nucleotide sequence of VGAM475 RNA, herein designated VGAM RNA, also designated SEQ ID:3186.

Another function of VGAM475 is therefore inhibition of LOC149301 (Accession XM_086480). Accordingly, utilities of VGAM475 include diagnosis, prevention and treatment of diseases and clinical conditions associated with LOC149301. LOC151584 (Accession XM_098089) is another VGAM475 host target gene. LOC151584 BINDING SITE is HOST TARGET binding site found in the 5' untranslated region of mRNA encoded by LOC151584, corresponding to a HOST TARGET binding site such as BINDING SITE I, BINDING SITE II or BINDING SITE III. Table 2 illustrates the complementarity of the nucleotide sequences of LOC151584 BINDING SITE, designated SEQ ID:41374, to the nucleotide sequence of VGAM475 RNA, herein designated VGAM RNA, also designated SEQ ID:3186.

Another function of VGAM475 is therefore inhibition of LOC151584 (Accession XM_098089). Accordingly, utilities of VGAM475 include diagnosis, prevention and treatment of diseases and clinical conditions associated with LOC151584. LOC158835 (Accession XM_088683) is another VGAM475 host target gene. LOC158835 BINDING SITE is HOST TARGET binding site found in the 3' untranslated region of mRNA encoded by LOC158835, corresponding to a HOST TARGET binding site such as BINDING SITE I, BINDING SITE II or BINDING SITE III. Table 2 illustrates the complementarity of the nucleotide sequences of LOC158835 BINDING SITE, designated SEQ ID:39896, to the nucleotide sequence of VGAM475 RNA, herein designated VGAM RNA, also designated SEQ ID:3186.

Another function of VGAM475 is therefore inhibition of LOC158835 (Accession XM_088683). Accordingly, utilities of VGAM475 include diagnosis, prevention and treatment of diseases and clinical conditions associated with LOC158835. LOC164397 (Accession XM_092780) is another VGAM475 host target gene. LOC164397 BINDING SITE is HOST TARGET binding site found in the 5' untranslated region of mRNA encoded by LOC164397, corresponding to a HOST TARGET binding site such as BINDING SITE I, BINDING SITE II or BINDING SITE III. Table 2 illustrates the complementarity of the nucleotide sequences of LOC164397 BINDING SITE, designated SEQ ID:40155, to the nucleotide sequence of VGAM475 RNA, herein designated VGAM RNA, also designated SEQ ID:3186.

Another function of VGAM475 is therefore inhibition of LOC164397 (Accession XM_092780). Accordingly, utilities of VGAM475 include diagnosis, prevention and treatment of diseases and clinical conditions associated with LOC164397. LOC166929 (Accession XM_094192) is another VGAM475 host target gene. LOC166929 BINDING SITE is HOST TARGET binding site found in the 5' untranslated region of mRNA encoded by LOC166929, corresponding to a HOST TARGET binding site such as BINDING SITE I, BINDING SITE II or BINDING SITE III. Table 2 illustrates the complementarity of the nucleotide sequences of LOC166929 BINDING SITE, designated SEQ ID:40224, to the nucleotide sequence of VGAM475 RNA, herein designated VGAM RNA, also designated SEQ ID:3186.

Another function of VGAM475 is therefore inhibition of LOC166929 (Accession XM_094192). Accordingly, utilities of VGAM475 include diagnosis, prevention and treatment of diseases and clinical conditions associated with LOC166929. LOC169026 (Accession XM_095471) is another VGAM475 host target gene. LOC169026 BINDING SITE is HOST TARGET binding site found in the 3' untranslated region of mRNA encoded by LOC169026, corresponding to a HOST TARGET binding site such as BINDING SITE I, BINDING SITE II or BINDING SITE III. Table 2 illustrates the complementarity of the nucleotide sequences of LOC169026 BINDING SITE, designated SEQ ID:40262, to the nucleotide sequence of VGAM475 RNA, herein designated VGAM RNA, also designated SEQ ID:3186.

Another function of VGAM475 is therefore inhibition of LOC169026 (Accession XM_095471). Accordingly, utilities of VGAM475 include diagnosis, prevention and treatment of diseases and clinical conditions associated with LOC169026. LOC201194 (Accession XM_117061) is another VGAM475 host target gene. LOC201194 BINDING SITE is HOST TARGET binding site found in the 3' untranslated region of mRNA encoded by LOC201194, corresponding to a HOST TARGET binding site such as BINDING SITE I, BINDING SITE II or BINDING SITE III. Table 2 illustrates the complementarity of the nucleotide sequences of LOC201194 BINDING SITE, designated SEQ ID:43219, to the nucleotide sequence of VGAM475 RNA, herein designated VGAM RNA, also designated SEQ ID:3186.

Another function of VGAM475 is therefore inhibition of LOC201194 (Accession XM_117061). Accordingly, utilities of VGAM475 include diagnosis, prevention and treatment of diseases and clinical conditions associated with LOC201194. LOC221683 (Accession XM_168089) is another VGAM475 host target gene. LOC221683 BINDING SITE is HOST TARGET binding site found in the 5' untranslated region of mRNA encoded by LOC221683, corresponding to a HOST TARGET binding site such as BINDING SITE I, BINDING SITE II or BINDING SITE III. Table 2 illustrates the complementarity of the nucleotide sequences of LOC221683 BINDING SITE, designated SEQ ID:45005, to the nucleotide sequence of VGAM475 RNA, herein designated VGAM RNA, also designated SEQ ID:3186.

Another function of VGAM475 is therefore inhibition of LOC221683 (Accession XM_168089). Accordingly, utilities of VGAM475 include diagnosis, prevention and treatment of diseases and clinical conditions associated with LOC221683. LOC222488 (Accession XM_169440) is another VGAM475 host target gene. LOC222488 BINDING SITE is HOST TARGET binding site found in the 3' untranslated region of mRNA encoded by LOC222488, corresponding to a HOST TARGET binding site such as BINDING SITE I, BINDING SITE II or BINDING SITE III. Table 2 illustrates the complementarity of the nucleotide sequences of LOC222488 BINDING SITE, designated SEQ ID:45301, to the nucleotide sequence of VGAM475 RNA, herein designated VGAM RNA, also designated SEQ ID:3186.

Another function of VGAM475 is therefore inhibition of LOC222488 (Accession XM_169440). Accordingly, utilities of VGAM475 include diagnosis, prevention and treatment of diseases and clinical conditions associated with LOC222488. LOC253613 (Accession XM_171225) is another VGAM475 host target gene. LOC253613 BINDING SITE is HOST TARGET binding site found in the 3' untranslated region of mRNA encoded by LOC253613, corresponding to a HOST TARGET binding site such as BINDING SITE I, BINDING SITE II or BINDING SITE III. Table 2 illustrates the complementarity of the nucleotide sequences of LOC253613 BINDING SITE, designated SEQ ID:46008, to the nucleotide sequence of VGAM475 RNA, herein designated VGAM RNA, also designated SEQ ID:3186.

Another function of VGAM475 is therefore inhibition of LOC253613 (Accession XM_171225). Accordingly, utilities of VGAM475 include diagnosis, prevention and treatment of diseases and clinical conditions associated with LOC253613. LOC254423 (Accession XM_173286) is another VGAM475 host target gene. LOC254423 BINDING SITE is HOST TARGET binding site found in the 3' untranslated region of mRNA encoded by LOC254423, corresponding to a HOST TARGET binding site such as BINDING SITE I, BINDING SITE II or BINDING SITE III. Table 2 illustrates the complementarity of the nucleotide sequences of LOC254423 BINDING SITE, designated SEQ ID:46530, to the nucleotide sequence of VGAM475 RNA, herein designated VGAM RNA, also designated SEQ ID:3186.

Another function of VGAM475 is therefore inhibition of LOC254423 (Accession XM_173286). Accordingly, utilities of VGAM475 include diagnosis, prevention and treatment of diseases and clinical conditions associated with LOC254423. LOC255045 (Accession XM_171243) is another VGAM475 host target gene. LOC255045 BINDING SITE is HOST TARGET binding site found in the 3' untranslated region of mRNA encoded by LOC255045, corresponding to a HOST TARGET binding site such as BINDING SITE I, BINDING SITE II or BINDING SITE III. Table 2 illustrates the complementarity of the nucleotide sequences of LOC255045 BINDING SITE, designated SEQ ID:46035, to the nucleotide sequence of VGAM475 RNA, herein designated VGAM RNA, also designated SEQ ID:3186.

Another function of VGAM475 is therefore inhibition of LOC255045 (Accession XM_171243). Accordingly, utilities of VGAM475 include diagnosis, prevention and treatment of diseases and clinical conditions associated with LOC255045. LOC257153 (Accession XM_171047) is another VGAM475 host target gene. LOC257153 BINDING SITE is HOST TARGET binding site found in the 5' untranslated region of mRNA encoded by LOC257153, corresponding to a HOST TARGET binding site such as BINDING SITE I, BINDING SITE II or BINDING SITE III. Table 2 illustrates the complementarity of the nucleotide sequences of LOC257153 BINDING SITE, designated SEQ ID:45826, to the nucleotide sequence of VGAM475 RNA, herein designated VGAM RNA, also designated SEQ ID:3186.

Another function of VGAM475 is therefore inhibition of LOC257153 (Accession XM_171047). Accordingly, utilities of VGAM475 include diagnosis, prevention and treatment of diseases and clinical conditions associated with LOC257153. LOC51667 (Accession NM_016118) is another VGAM475 host target gene. LOC51667 BINDING SITE is HOST TARGET binding site found in the 3' untranslated region of mRNA encoded by LOC51667, corresponding to a HOST TARGET binding site such as BINDING SITE I, BINDING SITE II or BINDING SITE III. Table 2 illustrates the complementarity of the nucleotide sequences of LOC51667 BINDING SITE, designated SEQ ID:18198, to the nucleotide sequence of VGAM475 RNA, herein designated VGAM RNA, also designated SEQ ID:3186.

Another function of VGAM475 is therefore inhibition of LOC51667 (Accession NM_016118). Accordingly, utilities of VGAM475 include diagnosis, prevention and treatment of diseases and clinical conditions associated with LOC51667. LOC55901 (Accession NM_018676) is another VGAM475 host target gene. LOC55901 BINDING SITE is HOST TARGET binding site found in the 5' untranslated region of mRNA encoded by LOC55901, corresponding to a HOST TARGET binding site such as BINDING SITE I, BINDING SITE II or BINDING SITE III. Table 2 illustrates the complementarity of the nucleotide sequences of LOC55901 BINDING SITE, designated SEQ ID:20750, to the nucleotide sequence of VGAM475 RNA, herein designated VGAM RNA, also designated SEQ ID:3186.

Another function of VGAM475 is therefore inhibition of LOC55901 (Accession NM_018676). Accordingly, utilities of VGAM475 include diagnosis, prevention and treatment of diseases and clinical conditions associated with LOC55901.

FIG. 1 further provides a conceptual description of a novel bioinformatically detected viral gene of the present invention, referred to here as Viral Genomic Address Messenger 476 (VGAM476) viral gene, which modulates expression of respective host target genes thereof, the function and utility of which host target genes is known in the art.

VGAM476 is a novel bioinformatically detected regulatory, non protein coding, viral micro RNA (miRNA) gene. The method by which VGAM476 was detected is described hereinabove with reference to FIGS. 1-8.

VGAM476 gene, herein designated VGAM GENE, is a viral gene contained in the genome of Tick-borne Encephalitis Virus. VGAM476 host target gene, herein designated VGAM HOST TARGET GENE, is a human gene contained in the human genome.

VGAM476 gene encodes a VGAM476 precursor RNA, herein designated VGAM PRECURSOR RNA. Similar to other miRNA genes, and unlike most ordinary genes, VGAM476 precursor RNA does not encode a protein. A nucleotide sequence identical or highly similar to the nucleotide sequence of VGAM476 precursor RNA is designated SEQ ID:462, and is provided hereinbelow with reference to the sequence listing part. Nucleotide sequence SEQ ID:462 is located at position 8886 relative to the genome of Tick-borne Encephalitis Virus.

VGAM476 precursor RNA folds onto itself, forming VGAM476 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM476 folded precursor RNA into VGAM476 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM476 RNA is designated SEQ ID:3187, and is provided hereinbelow with reference to the sequence listing part.

VGAM476 host target gene, herein designated VGAM HOST TARGET GENE, encodes a corresponding messenger RNA, VGAM476 host target RNA, herein designated VGAM HOST TARGET RNA. VGAM476 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM476 RNA, herein designated VGAM RNA, binds complementarily to one or more host target binding sites located in untranslated regions of VGAM476 host target RNA, herein designated VGAM HOST TARGET RNA. This complementary binding is due to the fact that the nucleotide sequence of VGAM476 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM476 RNA, herein designated VGAM RNA, may have a different number of host target binding sites in untranslated regions of a VGAM476 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM476 RNA, herein designated VGAM RNA, to host target binding sites on VGAM476 host target RNA, herein designated VGAM HOST TARGET RNA, such as BINDING SITE I, BINDING SITE II and BINDING SITE III, inhibits translation of VGAM476 host target RNA into VGAM476 host target protein, herein designated VGAM HOST TARGET PROTEIN. VGAM host target protein is therefore outlined by a broken line.

It is appreciated that VGAM476 host target gene, herein designated VGAM HOST TARGET GENE, in fact represents a plurality of VGAM476 host target genes. The mRNA of each one of this plurality of VGAM476 host target genes comprises one or more host target binding sites, each having a nucleotide sequence which is at least partly complementary to VGAM476 RNA, herein designated VGAM RNA, and which when bound by VGAM476 RNA causes inhibition of translation of respective one or more VGAM476 host target proteins.

It is further appreciated by one skilled in the art that the mode of translational inhibition illustrated by FIG. 1 with specific reference to translational inhibition exerted by VGAM476 gene, herein designated VGAM GENE, on one or more VGAM476 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM476 is inhibition of expression of host target genes, as part of a novel viral mechanism of attacking a host. Accordingly, utilities of VGAM476 include diagnosis, prevention and treatment of viral infection by Tick-borne Encephalitis Virus. Specific functions, and accordingly utilities, of VGAM476 correlate with, and may be deduced from, the identity of the host target genes which VGAM476 binds and inhibits, and the function of these host target genes, as elaborated hereinbelow.

Nucleotide sequences of the VGAM476 precursor RNA, herein designated VGAM PRECURSOR RNA, and of the 'diced' VGAM476 RNA, herein designated VGAM RNA, and a schematic representation of the secondary folding of VGAM476 folded precursor RNA, herein designated VGAM FOLDED PRECURSOR RNA, of VGAM476 are further described hereinbelow with reference to Table 1.

Nucleotide sequences of host target binding sites, such as BINDING SITE-I, BINDING SITE-II and BINDING SITE-III of FIG. 1, found on VGAM476 host target RNA, and schematic representation of the complementarity of each of these host target binding sites to VGAM476 RNA, herein designated VGAM RNA, are described hereinbelow with reference to Table 2.

As mentioned hereinabove with reference to FIG. 1, a function of VGAM476 gene, herein designated VGAM is inhibition of expression of VGAM476 target genes. It is appreciated that specific functions, and accordingly utilities, of VGAM476 correlate with, and may be deduced from, the identity of the target genes which VGAM476 binds and inhibits, and the function of these target genes, as elaborated hereinbelow.

BRF1 Homolog, Subunit of RNA Polymerase III Transcription Initiation Factor IIIB (S. cerevisiae) (BRF1, Accession NM_001519) is a VGAM476 host target gene. BRF1 BINDING SITE is HOST TARGET binding site found in the 3' untranslated region of mRNA encoded by BRF1, corresponding to a HOST TARGET binding site such as BINDING SITE I, BINDING SITE II or BINDING SITE III. Table 2 illustrates the complementarity of the nucleotide sequences of BRF1 BINDING SITE, designated SEQ ID:7255, to the nucleotide sequence of VGAM476 RNA, herein designated VGAM RNA, also designated SEQ ID:3187.

A function of VGAM476 is therefore inhibition of BRF1 Homolog, Subunit of RNA Polymerase III Transcription Initiation Factor IIIB (S. cerevisiae) (BRF1, Accession NM_001519), a gene which is a general activator of RNA polymerase III. Accordingly, utilities of VGAM476 include diagnosis, prevention and treatment of diseases and clinical conditions associated with BRF1. The function of BRF1 and its association with various diseases and clinical conditions, has been established by previous studies, as described hereinabove with reference to VGAM232. Chemokine (C-X3-C motif) Receptor 1 (CX3CR1, Accession XM_047502) is another VGAM476 host target gene. CX3CR1 BINDING SITE is HOST TARGET binding site found in the 3' untranslated region of mRNA encoded by CX3CR1, corresponding to a HOST TARGET binding site such as BINDING SITE I, BINDING SITE II or BINDING SITE III. Table 2 illustrates the complementarity of the nucleotide sequences of CX3CR1 BINDING SITE, designated SEQ ID:34982, to the nucleotide sequence of VGAM476 RNA, herein designated VGAM RNA, also designated SEQ ID:3187.

Another function of VGAM476 is therefore inhibition of Chemokine (C-X3-C motif) Receptor 1 (CX3CR1, Accession XM_047502), a gene which mediates both the adhesive and migratory functions of fractalkine. Accordingly, utilities of VGAM476 include diagnosis, prevention and treatment of diseases and clinical conditions associated with CX3CR1. The function of CX3CR1 and its association with various diseases and clinical conditions, has been established by previous studies, as described hereinabove with reference to VGAM25. Glucocorticoid Receptor DNA Binding Factor 1 (GRLF1, Accession XM_085943) is another VGAM476 host target gene. GRLF1 BINDING SITE is HOST TARGET binding site found in the 3' untranslated region of mRNA encoded by GRLF1, corresponding to a HOST TARGET binding site such as BINDING SITE I, BINDING SITE II or BINDING SITE III. Table 2 illustrates the complementarity of the nucleotide sequences of GRLF1 BINDING SITE, designated SEQ ID:38409, to the nucleotide sequence of VGAM476 RNA, herein designated VGAM RNA, also designated SEQ ID:3187.

Another function of VGAM476 is therefore inhibition of Glucocorticoid Receptor DNA Binding Factor 1 (GRLF1, Accession XM_085943), a gene which inhibits transcription of the glucocorticoid receptor gene. Accordingly, utilities of VGAM476 include diagnosis, prevention and treatment of diseases and clinical conditions associated with GRLF1. The function of GRLF1 and its association with various diseases and clinical conditions, has been established by previous studies, as described hereinabove with reference to VGAM55. Potassium Voltage-gated Channel, Shaw-related Subfamily, Member 3 (KCNC3, Accession NM_004977) is another VGAM476 host target gene. KCNC3 BINDING SITE is HOST TARGET binding site found in the 3' untranslated region of mRNA encoded by KCNC3, corresponding to a HOST TARGET binding site such as BINDING SITE I, BINDING SITE II or BINDING SITE III. Table 2 illustrates the complementarity of the nucleotide sequences of KCNC3 BINDING SITE, designated SEQ ID:11420, to the nucleotide sequence of VGAM476 RNA, herein designated VGAM RNA, also designated SEQ ID:3187.

Another function of VGAM476 is therefore inhibition of Potassium Voltage-gated Channel, Shaw-related Subfamily, Member 3 (KCNC3, Accession NM_004977), a gene which mediates the voltage-dependent potassium ion permeability of excitable membranes. Accordingly, utilities of VGAM476 include diagnosis, prevention and treatment of diseases and clinical conditions associated with KCNC3. The function of KCNC3 has been established by previous studies. Several genes (the Shaker or Sh gene family) encoding components of voltage-gated K(+) channels have been identified in various species. Based on sequence similarities, Sh genes are classified into 4 groups or subfamilies. Mammalian genes of each one of these subfamilies also show high levels of sequence similarity to 1 of 4 related Drosophila genes: Shaker, Shab, Shaw, and Shal. By fluorescence in situ hybridization, Ried et al. (1993) showed that the gene encoding a Shaw-related product previously studied in rat and mouse maps to 11p15 in a region that shows homology of synteny with a region of mouse chromosome 7. Because the prolonged QT syndrome (OMIM Ref. No. 192500) maps to this same region and because of pathophysiologic plausibility, mutations in the KCNC1 gene should be sought in that disorder. Grissmer et al. (1992) mapped the gene for the Shaw-related potassium channel in T cells to chromosome 11. This was referred to as Kv3.1. The related Kv1.1 and Kv3.2 genes were localized to chromosome 12, while the ISK gene (OMIM Ref. No. 176261) mapped to chromosome 21. Stubbs et al. (1994) established a long-range physical map of the region of mouse chromosome 7 containing 6 genes located within a 500-kb interval just proximal of the pink-eyed dilution (p) locus (OMIM Ref. No. 203200): Ldh1 (OMIM Ref. No. 150000), Ldh3 (OMIM Ref. No. 150150), Saa (OMIM Ref. No. 104750), Tph (OMIM Ref. No. 191060), Kcnc1, and Myod1 (OMIM Ref. No. 159970). The findings, together with mapping studies within the related region of human 11p15, demonstrated that gene content and organization within this homology segment had been highly conserved throughout evolution.

Full details of the abovementioned studies are described in the following publications, the disclosure of which are hereby incorporated by reference:

Ried, T.; Rudy, B.; Vega-Saenz de Miera, E.; Lau, D.; Ward, D. C.; Sen, K.: Localization of a highly conserved human potassium channel gene (NGK2-KV4; KCNC1) to chromosome 11p15. Genomics 15:405-411, 1993; and Stubbs, L.; Rinchik, E. M.; Goldberg, E.; Rudy, B.; Handel, M. A.; Johnson, D.: Clustering of six human 11p15 gene homologs within a 500-kb interval of proximal mouse chromosome 7. Gen.

Further studies establishing the function and utilities of KCNC3 are found in John Hopkins OMIM database record ID 176264, and in sited publications numbered 10927 listed in the bibliography section hereinbelow, which are also hereby incorporated by reference. Potassium Inwardly-rectifying Channel, Subfamily J, Member 10 (KCNJ10, Accession NM_002241) is another VGAM476 host target gene. KCNJ10 BINDING SITE is HOST TARGET binding site found in the 3' untranslated region of mRNA encoded by KCNJ10, corresponding to a HOST TARGET binding site such as BINDING SITE I, BINDING SITE II or BINDING SITE III. Table 2 illustrates the complementarity of the nucleotide sequences of KCNJ10 BINDING SITE, designated SEQ ID:8024, to the nucleotide sequence of VGAM476 RNA, herein designated VGAM RNA, also designated SEQ ID:3187.

Another function of VGAM476 is therefore inhibition of Potassium Inwardly-rectifying Channel, Subfamily J, Member 10 (KCNJ10, Accession NM_002241), a gene which may be responsible for potassium buffering action of glial cells in the brain. Accordingly, utilities of VGAM476 include diagnosis, prevention and treatment of diseases and clinical conditions associated with KCNJ10. The function of KCNJ10 and its association with various diseases and clinical conditions, has been established by previous studies, as described hereinabove with reference to VGAM167. Latent Transforming Growth Factor Beta Binding Protein 2 (LTBP2, Accession NM_000428) is another VGAM476 host target gene. LTBP2 BINDING SITE is HOST TARGET binding site found in the 3' untranslated region of mRNA encoded by LTBP2, corresponding to a HOST TARGET binding site such as BINDING SITE I, BINDING SITE II or BINDING SITE III. Table 2 illustrates the complementarity of the nucleotide sequences of LTBP2 BINDING SITE, designated SEQ ID:6004, to the nucleotide sequence of VGAM476 RNA, herein designated VGAM RNA, also designated SEQ ID:3187.

Another function of VGAM476 is therefore inhibition of Latent Transforming Growth Factor Beta Binding Protein 2 (LTBP2, Accession NM_000428), a gene which targets latent TGF-beta to the extracellular matrix. Accordingly, utilities of VGAM476 include diagnosis, prevention and treatment of diseases and clinical conditions associated with LTBP2. The function of LTBP2 has been established by previous studies. Transforming growth factors (TGFs) beta-1 (OMIM Ref. No. 190180), beta-2 (OMIM Ref. No. 190220), beta-3 (OMIM Ref. No. 190230), and others have both stimulatory and inhibitory effects on the growth of different cell types and play a role in the production and degradation of the extracellular matrix. TGF-beta molecules are secreted in the form of latent large molecular mass complexes that contain other proteins, such as latent TGF-beta-1 binding protein (LTBP1; 150390). There is evidence that these binding proteins modulate TGF-beta bioavailability Animal model experiments lend further support to the function of LTBP2. Dabovic et al. (2002) created an Ltbp3-null mutation in the mouse by gene targeting. Mice homozygous for the mutation developed craniofacial malformations by day 10. At 2 months, there was a pronounced rounding of the cranial vault, extension of the mandible beyond the maxilla, and kyphosis. Between 6 and 9 months of age, mutant mice also developed osteosclerosis and osteoarthritis. The pathologic changes were consistent with perturbed TGF-beta signaling in the skull and long bones It is appreciated that the abovementioned animal model for LTBP2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Oklu, R.; Hesketh, R.: The latent transforming growth factor beta binding protein (LTBP) family. Biochem. J. 352: 601-610, 2000; and Dabovic, B.; Chen, Y.; Colarossi, C.; Obata, H.; Zambuto, L.; Perle, M. A.; Rifkin, D. B.: Bone abnormalities in latent TGF-beta binding protein (Ltbp)-3-null mice indicate a role for Ltb.

Further studies establishing the function and utilities of LTBP2 are found in John Hopkins OMIM database record ID 602090, and in sited publications numbered 6357-635 and 12464-6360 listed in the bibliography section hereinbelow, which are also hereby incorporated by reference. Outer Dense Fiber of Sperm Tails 2 (ODF2, Accession NM_002540) is another VGAM476 host target gene. ODF2 BINDING SITE is HOST TARGET binding site found in the 5' untranslated region of mRNA encoded by ODF2, corresponding to a HOST TARGET binding site such as BINDING SITE I, BINDING SITE II or BINDING SITE III. Table 2 illustrates the complementarity of the nucleotide sequences of ODF2 BINDING SITE, designated SEQ ID:8385, to the nucleotide sequence of VGAM476 RNA, herein designated VGAM RNA, also designated SEQ ID:3187.

Another function of VGAM476 is therefore inhibition of Outer Dense Fiber of Sperm Tails 2 (ODF2, Accession NM_002540), a gene which is very strongly similar to rat Odf2. Accordingly, utilities of VGAM476 include diagnosis, prevention and treatment of diseases and clinical conditions associated with ODF2. The function of ODF2 and its association with various diseases and clinical conditions, has been established by previous studies, as described hereinabove with reference to VGAM363. Periaxin (PRX, Accession NM_020956) is another VGAM476 host target gene. PRX BINDING SITE is HOST TARGET binding site found in the 3' untranslated region of mRNA encoded by PRX, corresponding to a HOST TARGET binding site such as BINDING SITE I, BINDING SITE II or BINDING SITE III. Table 2 illustrates the complementarity of the nucleotide sequences of PRX BINDING SITE, designated SEQ ID:21941, to the nucleotide sequence of VGAM476 RNA, herein designated VGAM RNA, also designated SEQ ID:3187.

Another function of VGAM476 is therefore inhibition of Periaxin (PRX, Accession NM_020956), a gene which seems to be required for maintenance of peripheral nerve myelin sheath. may have a role in axon-glial interactions, possibly by interacting with the cytoplasmic domains of integral membrane proteins such as myelin-associated glycoprotein in the periaxonal regions of the schwann cell plasma membrane. may have a role in the early phases of myelin deposition. Accordingly, utilities of VGAM476 include diagnosis, prevention and treatment of diseases and clinical conditions associated with PRX. The function of PRX has been established by previous studies. The periaxin gene (PRX) encodes 2 PDZ-domain proteins, L- and S-periaxin, that are required for maintenance of peripheral nerve myelin. The PDZ domain, which consists of a nearly 90-amino acid protein-binding motif that interacts with the C termini of plasma membrane proteins and with the cortical cytoskeleton, has been implicated in the assembly of signaling complexes at sites of cell-cell contact. By FISH and electronic PCR (Schuler, 1997), Boerkoel et al. (2001) mapped the PRX gene between D19S324 and D19S223 within a BAC on 19q13.1-q13.2, a position showing conserved synteny with mouse chromosome 7 where the Prx gene maps (Gillespie et al., 1997). They pointed out that the interactions among L-periaxin, the cytoskeleton, and a membrane complex are reminiscent of the interactions among the proteins of the dystrophin-sarcoglycan complex (Cohn and Campbell, 2000) and the signaling complexes organized by other PDZ domain proteins. They hypothesized that mutations in cytoskeletal and membrane proteins interacting with L-periaxin may also cause Charcot-Marie-Tooth disease or related neuropathies. In 3 unrelated patients with Dejerine-Sottas neuropathy (OMIM Ref. No. 145900), Boerkoel et al. (2001) identified recessive mutations in the PRX gene (605725.0001-605725.004). They mapped recessive Dejerine-Sottas neuropathy to 19q13.1-q13.2, a region associated with a severe autosomal recessive demyelinating neuropathy in a Lebanese family reported by Delague et al. (2000) as Charcot-Marie-Tooth disease type 4F. Animal model experiments lend further support to the function of PRX. Confirming the necessity of periaxin for maintenance of the myelin sheath, Gillespie et al. (2000) demonstrated that Prx -/- mice ensheath and myelinate peripheral axons apparently normally but subsequently develop a severe demyelinating neuropathy associated with allodynia (pain from non-noxious stimuli) and hyperalgesia (hypersensitivity to pain).

It is appreciated that the abovementioned animal model for PRX is acknowledged by those skilled in the art as a scientifically valid animal model, as can be further appreciated from the publications sited hereinbelow.

Full details of the abovementioned studies are described in the following publications, the disclosure of which are hereby incorporated by reference:

Takashima, H.; Boerkoel, C. F.; De Jonghe, P.; Ceuterick, C.; Martin, J.-J.; Voit, T.; Schroder, J.-M.; Williams, A.; Brophy, P. J.; Timmerman, V.; Lupski, J. R.: Periaxin mutations cause a broad spectrum of demyelinating neuropathies. Ann. Neurol. 51:709-715, 2002; and Boerkoel, C. F.; Takashima, H.; Stankiewicz, P.; Garcia, C. A.; Leber, S. M.; Rhee-Morris, L.; Lupski, J. R.: Periaxin mutations cause recessive Dejerine-Sottas neuropathy. Am. J. Hum.

Further studies establishing the function and utilities of PRX are found in John Hopkins OMIM database record ID 605725, and in sited publications numbered 3546, 6910, 6911-6912, 355 and 6913-6914 listed in the bibliography section hereinbelow, which are also hereby incorporated by reference. Ribosomal Protein L10 (RPL10, Accession NM_006013) is another VGAM476 host target gene. RPL10 BINDING SITE is HOST TARGET binding site found in the 3' untranslated region of mRNA encoded by RPL10, corresponding to a HOST TARGET binding site such as BINDING SITE I, BINDING SITE II or BINDING SITE III. Table 2 illustrates the complementarity of the nucleotide sequences of RPL10 BINDING SITE, designated SEQ ID:12623, to the nucleotide sequence of VGAM476 RNA, herein designated VGAM RNA, also designated SEQ ID:3187.

Another function of VGAM476 is therefore inhibition of Ribosomal Protein L10 (RPL10, Accession NM_006013), a gene which may be a component of the 60S ribosomal subunit. Accordingly, utilities of VGAM476 include diagnosis, prevention and treatment of diseases and clinical conditions associated with RPL10. The function of RPL10 has been established by previous studies. Weissman et al. (1987) provided a functional assay for the identification of the suppressor gene (s) involved in Wilms tumor, by showing that introduction of a normal chromosome 11 into a Wilms tumor cell line completely abolished its tumorigenic action in nude mice. Dowdy et al. (1991) showed that this suppressor activity resided in the 11p15 and not in the 11p13 region; see Wilms tumor, type II (WT2; 194071). In an attempt to isolate a suppressor gene, Dowdy et al. (1991) performed a subtractive hybridization assay with the tumorigenic Wilms tumor cell line and its nontumorigenic derivative which contained an extra t (X;11) translocation chromosome. A single novel cDNA clone, designated QM, was identified and, as the QM mRNA was modulated between tumorigenic and nontumorigenic cell lines, the QM gene was an attractive tumor-suppressor candidate gene. In the course of investigating disease genes in the Xqter region, van den Ouweland et al. (1992) found a cosmid that appeared to harbor the QM gene as it demonstrated 100% identity with the cDNA sequence published by Dowdy et al. (1991). With an exon-specific polymerase chain reaction, van den Ouweland et al. (1992) demonstrated that the genomic homolog of the QM cDNA is located in Xq28 in the region of the G6PD and color vision genes. No homologous sequences could be detected on 11p. Thus, the QM gene is not, per se, involved in the suppression of Wilms tumor. QM is a 214-amino acid polypeptide encoded by a gene previously designated DXS648. It contains a high percentage of charged amino acids and binds to the JUN oncogene (OMIM Ref. No. 165160) and to DNA. Although they found no matches between QM and any other known transcription factors in searches of DNA databases, Farmer et al. (1994) found a high degree of conservation throughout the first 175 residues of the protein when studies were performed on a diverse array of eukaryotes. Most notable was the considerable conservation of charged amino acids within specific regions. The rate of sequence divergence of the various homologs was found to be slow, of the order of 1% change every 22 million years, consistent with a critical role of QM in eukaryotic cells. Farmer et al. (1994) suggested that QM belongs to a novel class of transcription regulatory proteins.

Full details of the abovementioned studies are described in the following publications, the disclosure of which are hereby incorporated by reference:

Dowdy, S. F.; Fasching, C. L.; Araujo, D.; Lai, K.-M.; Livanos, E.; Weissman, B. E.; Stanbridge, E. J.: Suppression of tumorigenicity in Wilms' tumor by the p15.5-p14 region of chromosome 11. Science 254:293-295, 1991; and Farmer, A. A.; Loftus, T. M.; Mills, A. A.; Sato, K. Y.; Neill, J. D.; Tron, T.; Yang, M.; Trumpower, B. L.; Stanbridge, E. J.: Extreme evolutionary conservation of QM, a novel c-Jun assoc.

Further studies establishing the function and utilities of RPL10 are found in John Hopkins OMIM database record ID 312173, and in sited publications numbered 8388-8394 listed in the bibliography section hereinbelow, which are also hereby incorporated by reference. Cyclin M1 (CNNM1, Accession NM_020348) is another VGAM476 host target gene. CNNM1 BINDING SITE is HOST TARGET binding site found in the 3' untranslated region of mRNA encoded by CNNM1, corresponding to a HOST TARGET binding site such as BINDING SITE I, BINDING SITE II or BINDING SITE III. Table 2 illustrates the complementarity of the nucleotide sequences of CNNM1 BINDING SITE, designated SEQ ID:21606, to the nucleotide sequence of VGAM476

RNA, herein designated VGAM RNA, also designated SEQ ID:3187.

Another function of VGAM476 is therefore inhibition of Cyclin M1 (CNNM1, Accession NM_020348). Accordingly, utilities of VGAM476 include diagnosis, prevention and treatment of diseases and clinical conditions associated with CNNM1. DKFZP434N1511 (Accession XM_166138) is another VGAM476 host target gene. DKFZP434N1511 BINDING SITE is HOST TARGET binding site found in the 3' untranslated region of mRNA encoded by DKFZP434N1511, corresponding to a HOST TARGET binding site such as BINDING SITE I, BINDING SITE II or BINDING SITE III. Table 2 illustrates the complementarity of the nucleotide sequences of DKFZP434N1511 BINDING SITE, designated SEQ ID:43934, to the nucleotide sequence of VGAM476 RNA, herein designated VGAM RNA, also designated SEQ ID:3187.

Another function of VGAM476 is therefore inhibition of DKFZP434N1511 (Accession XM_166138). Accordingly, utilities of VGAM476 include diagnosis, prevention and treatment of diseases and clinical conditions associated with DKFZP434N1511. FLJ12770 (Accession NM_032174) is another VGAM476 host target gene. FLJ12770 BINDING SITE is HOST TARGET binding site found in the 3' untranslated region of mRNA encoded by FLJ12770, corresponding to a HOST TARGET binding site such as BINDING SITE I, BINDING SITE II or BINDING SITE III. Table 2 illustrates the complementarity of the nucleotide sequences of FLJ12770 BINDING SITE, designated SEQ ID:25884, to the nucleotide sequence of VGAM476 RNA, herein designated VGAM RNA, also designated SEQ ID:3187.

Another function of VGAM476 is therefore inhibition of FLJ12770 (Accession NM_032174). Accordingly, utilities of VGAM476 include diagnosis, prevention and treatment of diseases and clinical conditions associated with FLJ12770. FLJ13964 (Accession NM_032186) is another VGAM476 host target gene. FLJ13964 BINDING SITE is HOST TARGET binding site found in the 3' untranslated region of mRNA encoded by FLJ13964, corresponding to a HOST TARGET binding site such as BINDING SITE I, BINDING SITE II or BINDING SITE III. Table 2 illustrates the complementarity of the nucleotide sequences of FLJ13964 BINDING SITE, designated SEQ ID:25901, to the nucleotide sequence of VGAM476 RNA, herein designated VGAM RNA, also designated SEQ ID:3187.

Another function of VGAM476 is therefore inhibition of FLJ13964 (Accession NM_032186). Accordingly, utilities of VGAM476 include diagnosis, prevention and treatment of diseases and clinical conditions associated with FLJ13964. FLJ20040 (Accession NM_018992) is another VGAM476 host target gene. FLJ20040 BINDING SITE is HOST TARGET binding site found in the 3' untranslated region of mRNA encoded by FLJ20040, corresponding to a HOST TARGET binding site such as BINDING SITE I, BINDING SITE II or BINDING SITE III. Table 2 illustrates the complementarity of the nucleotide sequences of FLJ20040 BINDING SITE, designated SEQ ID:21065, to the nucleotide sequence of VGAM476 RNA, herein designated VGAM RNA, also designated SEQ ID:3187.

Another function of VGAM476 is therefore inhibition of FLJ20040 (Accession NM_018992). Accordingly, utilities of VGAM476 include diagnosis, prevention and treatment of diseases and clinical conditions associated with FLJ20040. FLJ22551 (Accession NM_024708) is another VGAM476 host target gene. FLJ22551 BINDING SITE is HOST TARGET binding site found in the 5' untranslated region of mRNA encoded by FLJ22551, corresponding to a HOST TARGET binding site such as BINDING SITE I, BINDING SITE II or BINDING SITE III. Table 2 illustrates the complementarity of the nucleotide sequences of FLJ22551 BINDING SITE, designated SEQ ID:24025, to the nucleotide sequence of VGAM476 RNA, herein designated VGAM RNA, also designated SEQ ID:3187.

Another function of VGAM476 is therefore inhibition of FLJ22551 (Accession NM_024708). Accordingly, utilities of VGAM476 include diagnosis, prevention and treatment of diseases and clinical conditions associated with FLJ22551. KIAA0084 (Accession XM_042841) is another VGAM476 host target gene. KIAA0084 BINDING SITE is HOST TARGET binding site found in the 3' untranslated region of mRNA encoded by KIAA0084, corresponding to a HOST TARGET binding site such as BINDING SITE I, BINDING SITE II or BINDING SITE III. Table 2 illustrates the complementarity of the nucleotide sequences of KIAA0084 BINDING SITE, designated SEQ ID:33805, to the nucleotide sequence of VGAM476 RNA, herein designated VGAM RNA, also designated SEQ ID:3187.

Another function of VGAM476 is therefore inhibition of KIAA0084 (Accession XM_042841). Accordingly, utilities of VGAM476 include diagnosis, prevention and treatment of diseases and clinical conditions associated with KIAA0084. KIAA0806 (Accession NM_014813) is another VGAM476 host target gene. KIAA0806 BINDING SITE is HOST TARGET binding site found in the 3' untranslated region of mRNA encoded by KIAA0806, corresponding to a HOST TARGET binding site such as BINDING SITE I, BINDING SITE II or BINDING SITE III. Table 2 illustrates the complementarity of the nucleotide sequences of KIAA0806 BINDING SITE, designated SEQ ID:16779, to the nucleotide sequence of VGAM476 RNA, herein designated VGAM RNA, also designated SEQ ID:3187.

Another function of VGAM476 is therefore inhibition of KIAA0806 (Accession NM_014813). Accordingly, utilities of VGAM476 include diagnosis, prevention and treatment of diseases and clinical conditions associated with KIAA0806. KIAA1950 (Accession XM_166532) is another VGAM476 host target gene. KIAA1950 BINDING SITE is HOST TARGET binding site found in the 3' untranslated region of mRNA encoded by KIAA1950, corresponding to a HOST TARGET binding site such as BINDING SITE I, BINDING SITE II or BINDING SITE III. Table 2 illustrates the complementarity of the nucleotide sequences of KIAA1950 BINDING SITE, designated SEQ ID:44483, to the nucleotide sequence of VGAM476 RNA, herein designated VGAM RNA, also designated SEQ ID:3187.

Another function of VGAM476 is therefore inhibition of KIAA1950 (Accession XM_166532). Accordingly, utilities of VGAM476 include diagnosis, prevention and treatment of diseases and clinical conditions associated with KIAA1950. Protein Tyrosine Phosphatase, Receptor Type, F Polypeptide (PTPRF), Interacting Protein (liprin), Alpha 4 (PPFIA4, Accession XM_046751) is another VGAM476 host target gene. PPFIA4 BINDING SITE is HOST TARGET binding site found in the 3' untranslated region of mRNA encoded by PPFIA4, corresponding to a HOST TARGET binding site such as BINDING SITE I, BINDING SITE II or BINDING SITE III. Table 2 illustrates the complementarity of the nucleotide sequences of PPFIA4 BINDING SITE, designated SEQ ID:34819, to the nucleotide sequence of VGAM476 RNA, herein designated VGAM RNA, also designated SEQ ID:3187.

Another function of VGAM476 is therefore inhibition of Protein Tyrosine Phosphatase, Receptor Type, F Polypeptide (PTPRF), Interacting Protein (liprin), Alpha 4 (PPFIA4, Accession XM_046751). Accordingly, utilities of VGAM476 include diagnosis, prevention and treatment of diseases and clinical conditions associated with PPFIA4.

SSB-3 (Accession NM_080861) is another VGAM476 host target gene. SSB-3 BINDING SITE is HOST TARGET binding site found in the 3' untranslated region of mRNA encoded by SSB-3, corresponding to a HOST TARGET binding site such as BINDING SITE I, BINDING SITE II or BINDING SITE III. Table 2 illustrates the complementarity of the nucleotide sequences of SSB-3 BINDING SITE, designated SEQ ID:28100, to the nucleotide sequence of VGAM476 RNA, herein designated VGAM RNA, also designated SEQ ID:3187.

Another function of VGAM476 is therefore inhibition of SSB-3 (Accession NM_080861). Accordingly, utilities of VGAM476 include diagnosis, prevention and treatment of diseases and clinical conditions associated with SSB-3.

LOC115051 (Accession XM_010647) is another VGAM476 host target gene. LOC115051 BINDING SITE is HOST TARGET binding site found in the 3' untranslated region of mRNA encoded by LOC115051, corresponding to a HOST TARGET binding site such as BINDING SITE I, BINDING SITE II or BINDING SITE III. Table 2 illustrates the complementarity of the nucleotide sequences of LOC115051 BINDING SITE, designated SEQ ID:30159, to the nucleotide sequence of VGAM476 RNA, herein designated VGAM RNA, also designated SEQ ID:3187.

Another function of VGAM476 is therefore inhibition of LOC115051 (Accession XM_010647). Accordingly, utilities of VGAM476 include diagnosis, prevention and treatment of diseases and clinical conditions associated with LOC115051.

LOC127845 (Accession XM_059186) is another VGAM476 host target gene. LOC127845 BINDING SITE is HOST TARGET binding site found in the 5' untranslated region of mRNA encoded by LOC127845, corresponding to a HOST TARGET binding site such as BINDING SITE I, BINDING SITE II or BINDING SITE III. Table 2 illustrates the complementarity of the nucleotide sequences of LOC127845 BINDING SITE, designated SEQ ID:36911, to the nucleotide sequence of VGAM476 RNA, herein designated VGAM RNA, also designated SEQ ID:3187.

Another function of VGAM476 is therefore inhibition of LOC127845 (Accession XM_059186). Accordingly, utilities of VGAM476 include diagnosis, prevention and treatment of diseases and clinical conditions associated with LOC127845.

LOC158056 (Accession XM_088463) is another VGAM476 host target gene. LOC158056 BINDING SITE is HOST TARGET binding site found in the 5' untranslated region of mRNA encoded by LOC158056, corresponding to a HOST TARGET binding site such as BINDING SITE I, BINDING SITE II or BINDING SITE III. Table 2 illustrates the complementarity of the nucleotide sequences of LOC158056 BINDING SITE, designated SEQ ID:39714, to the nucleotide sequence of VGAM476 RNA, herein designated VGAM RNA, also designated SEQ ID:3187.

Another function of VGAM476 is therefore inhibition of LOC158056 (Accession XM_088463). Accordingly, utilities of VGAM476 include diagnosis, prevention and treatment of diseases and clinical conditions associated with LOC158056.

LOC196955 (Accession XM_085210) is another VGAM476 host target gene. LOC196955 BINDING SITE is HOST TARGET binding site found in the 5' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37927, to the nucleotide sequence of VGAM476 RNA, herein designated VGAM RNA, also designated SEQ ID:3187.

Another function of VGAM476 is therefore inhibition of LOC196955 (Accession XM_085210). Accordingly, utilities of VGAM476 include diagnosis, prevention and treatment of diseases and clinical conditions associated with LOC196955.

LOC256158 (Accession XM_175125) is another VGAM476 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46619, to the nucleotide sequence of VGAM476 RNA, herein designated VGAM RNA, also designated SEQ ID:3187.

Another function of VGAM476 is therefore inhibition of LOC256158 (Accession XM_175125). Accordingly, utilities of VGAM476 include diagnosis, prevention and treatment of diseases and clinical conditions associated with LOC256158.

FIG. 1 further provides a conceptual description of a novel bioinformatically detected viral gene of the present invention, referred to here as Viral Genomic Address Messenger 477 (VGAM477) viral gene, which modulates expression of respective host target genes thereof, the function and utility of which host target genes is known in the art.

VGAM477 is a novel bioinformatically detected regulatory, non protein coding, viral micro RNA (miRNA) gene. The method by which VGAM477 was detected is described hereinabove with reference to FIGS. 1-8.

VGAM477 gene, herein designated VGAM GENE, is a viral gene contained in the genome of Hepatitis G Virus. VGAM477 host target gene, herein designated VGAM HOST TARGET GENE, is a human gene contained in the human genome.

VGAM477 gene encodes a VGAM477 precursor RNA, herein designated VGAM PRECURSOR RNA. Similar to other miRNA genes, and unlike most ordinary genes, VGAM477 precursor RNA does not encode a protein. A nucleotide sequence identical or highly similar to the nucleotide sequence of VGAM477 precursor RNA is designated SEQ ID:463, and is provided hereinbelow with reference to the sequence listing part. Nucleotide sequence SEQ ID:463 is located at position 6061 relative to the genome of Hepatitis G Virus.

VGAM477 precursor RNA folds onto itself, forming VGAM477 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM477 folded precursor RNA into VGAM477 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM477 RNA is designated SEQ ID:3188, and is provided hereinbelow with reference to the sequence listing part.

VGAM477 host target gene, herein designated VGAM HOST TARGET GENE, encodes a corresponding messenger RNA, VGAM477 host target RNA, herein designated VGAM HOST TARGET RNA. VGAM477 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM477 RNA, herein designated VGAM RNA, binds complementarily to one or more host target binding sites located in untranslated regions of VGAM477 host target RNA, herein designated VGAM HOST TARGET RNA. This complementary binding is due to the fact that the nucleotide sequence of VGAM477 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM477 RNA, herein designated VGAM RNA, may have a different number of host target binding sites in untranslated regions of a VGAM477 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM477 RNA, herein designated VGAM RNA, to host target binding sites on VGAM477 host target RNA, herein designated VGAM HOST TARGET RNA, such as BINDING SITE I, BINDING SITE II and BINDING SITE III, inhibits translation of VGAM477 host target RNA into VGAM477 host target protein, herein designated VGAM HOST TARGET PROTEIN. VGAM host target protein is therefore outlined by a broken line.

It is appreciated that VGAM477 host target gene, herein designated VGAM HOST TARGET GENE, in fact represents a plurality of VGAM477 host target genes. The mRNA of each one of this plurality of VGAM477 host target genes comprises one or more host target binding sites, each having a nucleotide sequence which is at least partly complementary to VGAM477 RNA, herein designated VGAM RNA, and which when bound by VGAM477 RNA causes inhibition of translation of respective one or more VGAM477 host target proteins.

It is further appreciated by one skilled in the art that the mode of translational inhibition illustrated by FIG. 1 with specific reference to translational inhibition exerted by VGAM477 gene, herein designated VGAM GENE, on one or more VGAM477 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM477 is inhibition of expression of host target genes, as part of a novel viral mechanism of attacking a host. Accordingly, utilities of VGAM477 include diagnosis, prevention and treatment of viral infection by Hepatitis G Virus. Specific functions, and accordingly utilities, of VGAM477 correlate with, and may be deduced from, the identity of the host target genes which VGAM477 binds and inhibits, and the function of these host target genes, as elaborated hereinbelow.

Nucleotide sequences of the VGAM477 precursor RNA, herein designated VGAM PRECURSOR RNA, and of the 'diced' VGAM477 RNA, herein designated VGAM RNA, and a schematic representation of the secondary folding of VGAM477 folded precursor RNA, herein designated VGAM FOLDED PRECURSOR RNA, of VGAM477 are further described hereinbelow with reference to Table 1.

Nucleotide sequences of host target binding sites, such as BINDING SITE-I, BINDING SITE-II and BINDING SITE-III of FIG. 1, found on VGAM477 host target RNA, and schematic representation of the complementarity of each of these host target binding sites to VGAM477 RNA, herein designated VGAM RNA, are described hereinbelow with reference to Table 2.

As mentioned hereinabove with reference to FIG. 1, a function of VGAM477 gene, herein designated VGAM is inhibition of expression of VGAM477 target genes. It is appreciated that specific functions, and accordingly utilities, of VGAM477 correlate with, and may be deduced from, the identity of the target genes which VGAM477 binds and inhibits, and the function of these target genes, as elaborated hereinbelow.

Adenylate Cyclase 9 (ADCY9, Accession NM_001116) is a VGAM477 host target gene. ADCY9 BINDING SITE is HOST TARGET binding site found in the 3' untranslated region of mRNA encoded by ADCY9, corresponding to a HOST TARGET binding site such as BINDING SITE I, BINDING SITE II or BINDING SITE III. Table 2 illustrates the complementarity of the nucleotide sequences of ADCY9 BINDING SITE, designated SEQ ID:6791, to the nucleotide sequence of VGAM477 RNA, herein designated VGAM RNA, also designated SEQ ID:3188.

A function of VGAM477 is therefore inhibition of Adenylate Cyclase 9 (ADCY9, Accession NM_001116), a gene which, may be a physiologically relevant docking site for calcineurin (by similarity). Accordingly, utilities of VGAM477 include diagnosis, prevention and treatment of diseases and clinical conditions associated with ADCY9. The function of ADCY9 has been established by previous studies. The adenylyl cyclases (EC 4.6.1.1) are membrane-associated enzymes that are expressed in most human tissues. These enzymes catalyze the formation of cAMP and are regulated by a family of G protein-coupled receptors, protein kinases, and calcium. The type 9 adenylyl cyclase (ADCY9) is a widely distributed adenylyl cyclase that was originally cloned from mouse (Paterson et al., 1995; Premont et al., 1996). Hacker et al. (1998) cloned human cardiac ADCY9, or AC9, cDNAs and found that the deduced 1,294-amino acid protein is 90% identical to mouse Adcy9. Like mouse Adcy9, the predicted human ADCY9 protein contains 12 transmembrane domains, Asn-linked glycosylation sites, and cAMP-dependent protein kinase phosphorylation sites; however, these proteins differ in the C2b domain due to a frameshift in the human ADCY9 coding sequence relative to the coding sequence of mouse Adcy9. Northern blot analysis detected 8.5- and 6.3-kb ADCY9 transcripts in all human tissues examined. By fluorescence in situ hybridization, Hacker et al. (1998) mapped the human and mouse ADCY9 genes to 16p13.3 and chromosome 16 band B1, respectively.

Full details of the abovementioned studies are described in the following publications, the disclosure of which are hereby incorporated by reference:

Premont, R. T.; Matsuoka, I.; Mattei, M. G.; Pouille, Y.; Defer, N.; Hanoune, J.: Identification and characterization of a widely expressed form of adenylyl cyclase. J. Biol. Chem. 271:13900-13907, 1996; and Hacker, B. M.; Tomlinson, J. E.; Wayman, G. A.; Sultana, R.; Chan, G.; Villacres, E.; Disteche, C.; Storm, D. R.: Cloning, chromosomal mapping, and regulatory properties of the human ty.

Further studies establishing the function and utilities of ADCY9 are found in John Hopkins OMIM database record ID 603302, and in sited publications numbered 2438-2441 listed in the bibliography section hereinbelow, which are also hereby incorporated by reference. Beta-site APP-cleaving Enzyme (BACE, Accession NM_012104) is another VGAM477 host target gene. BACE BINDING SITE1 and BACE BINDING SITE2 are HOST TARGET binding sites found in untranslated regions of mRNA encoded by BACE, corresponding to HOST TARGET binding sites such as BINDING SITE I, BINDING SITE II or BINDING SITE III. Table 2 illustrates the complementarity of the nucleotide sequences of BACE BINDING SITE1 and BACE BINDING SITE2, designated SEQ ID:14414 and SEQ ID:29082 respectively, to the nucleotide sequence of VGAM477 RNA, herein designated VGAM RNA, also designated SEQ ID:3188.

Another function of VGAM477 is therefore inhibition of Beta-site APP-cleaving Enzyme (BACE, Accession NM_012104), a gene which is responsible for the proteolytic processing of the amyloid precursor protein. Accordingly, utilities of VGAM477 include diagnosis, prevention and treatment of diseases and clinical conditions associated with BACE. The function of BACE and its association with various diseases and clinical conditions, has been established by previous studies, as described hereinabove with reference to VGAM173. Fibroblast Growth Factor Receptor-like 1 (FGFRL1, Accession NM_021923) is another VGAM477 host target gene. FGFRL1 BINDING SITE is HOST TARGET binding site found in the 3' untranslated region of mRNA encoded by FGFRL1, corresponding to a HOST TARGET binding site such as BINDING SITE I, BINDING SITE II or BINDING SITE III. Table 2 illustrates the complementarity of the nucleotide sequences of FGFRL1 BINDING SITE, designated SEQ ID:22449, to the nucleotide sequence of VGAM477 RNA, herein designated VGAM RNA, also designated SEQ ID:3188.

Another function of VGAM477 is therefore inhibition of Fibroblast Growth Factor Receptor-like 1 (FGFRL1, Accession NM_021923). Accordingly, utilities of VGAM477 include diagnosis, prevention and treatment of diseases and clinical conditions associated with FGFRL1. COAS3 (Accession NM_139020) is another VGAM477 host target gene. COAS3 BINDING SITE is HOST TARGET binding site found in the 3' untranslated region of mRNA encoded by COAS3, corresponding to a HOST TARGET binding site such as BINDING SITE I, BINDING SITE II or BINDING SITE III. Table 2 illustrates the complementarity of the nucleotide sequences of COAS3 BINDING SITE, designated SEQ ID:29120, to the nucleotide sequence of VGAM477 RNA, herein designated VGAM RNA, also designated SEQ ID:3188.

Another function of VGAM477 is therefore inhibition of COAS3 (Accession NM_139020). Accordingly, utilities of VGAM477 include diagnosis, prevention and treatment of diseases and clinical conditions associated with COAS3. FLJ00058 (Accession XM_086123) is another VGAM477 host target gene. FLJ00058 BINDING SITE is HOST TARGET binding site found in the 5' untranslated region of mRNA encoded by FLJ00058, corresponding to a HOST TARGET binding site such as BINDING SITE I, BINDING SITE II or BINDING SITE III. Table 2 illustrates the complementarity of the nucleotide sequences of FLJ00058 BINDING SITE, designated SEQ ID:38507, to the nucleotide sequence of VGAM477 RNA, herein designated VGAM RNA, also designated SEQ ID:3188.

Another function of VGAM477 is therefore inhibition of FLJ00058 (Accession XM_086123). Accordingly, utilities of VGAM477 include diagnosis, prevention and treatment of diseases and clinical conditions associated with FLJ00058. KIAA0446 (Accession XM_044155) is another VGAM477 host target gene. KIAA0446 BINDING SITE is HOST TARGET binding site found in the 3' untranslated region of mRNA encoded by KIAA0446, corresponding to a HOST TARGET binding site such as BINDING SITE I, BINDING SITE II or BINDING SITE III. Table 2 illustrates the complementarity of the nucleotide sequences of KIAA0446 BINDING SITE, designated SEQ ID:34147, to the nucleotide sequence of VGAM477 RNA, herein designated VGAM RNA, also designated SEQ ID:3188.

Another function of VGAM477 is therefore inhibition of KIAA0446 (Accession XM_044155). Accordingly, utilities of VGAM477 include diagnosis, prevention and treatment of diseases and clinical conditions associated with KIAA0446. KIAA0563 (Accession NM_014834) is another VGAM477 host target gene. KIAA0563 BINDING SITE is HOST TARGET binding site found in the 5' untranslated region of mRNA encoded by KIAA0563, corresponding to a HOST TARGET binding site such as BINDING SITE I, BINDING SITE II or BINDING SITE III. Table 2 illustrates the complementarity of the nucleotide sequences of KIAA0563 BINDING SITE, designated SEQ ID:16844, to the nucleotide sequence of VGAM477 RNA, herein designated VGAM RNA, also designated SEQ ID:3188.

Another function of VGAM477 is therefore inhibition of KIAA0563 (Accession NM_014834). Accordingly, utilities of VGAM477 include diagnosis, prevention and treatment of diseases and clinical conditions associated with KIAA0563. KIAA1550 (Accession XM_039393) is another VGAM477 host target gene. KIAA1550 BINDING SITE is HOST TARGET binding site found in the 3' untranslated region of mRNA encoded by KIAA1550, corresponding to a HOST TARGET binding site such as BINDING SITE I, BINDING SITE II or BINDING SITE III. Table 2 illustrates the complementarity of the nucleotide sequences of KIAA1550 BINDING SITE, designated SEQ ID:33066, to the nucleotide sequence of VGAM477 RNA, herein designated VGAM RNA, also designated SEQ ID:3188.

Another function of VGAM477 is therefore inhibition of KIAA1550 (Accession XM_039393). Accordingly, utilities of VGAM477 include diagnosis, prevention and treatment of diseases and clinical conditions associated with KIAA1550. KIAA1884 (Accession XM_055539) is another VGAM477 host target gene. KIAA1884 BINDING SITE is HOST TARGET binding site found in the 3' untranslated region of mRNA encoded by KIAA1884, corresponding to a HOST TARGET binding site such as BINDING SITE I, BINDING SITE II or BINDING SITE III. Table 2 illustrates the complementarity of the nucleotide sequences of KIAA1884 BINDING SITE, designated SEQ ID:36290, to the nucleotide sequence of VGAM477 RNA, herein designated VGAM RNA, also designated SEQ ID:3188.

Another function of VGAM477 is therefore inhibition of KIAA1884 (Accession XM_055539). Accordingly, utilities of VGAM477 include diagnosis, prevention and treatment of diseases and clinical conditions associated with KIAA1884. MGC12921 (Accession XM_033362) is another VGAM477 host target gene. MGC12921 BINDING SITE is HOST TARGET binding site found in the 3' untranslated region of mRNA encoded by MGC12921, corresponding to a HOST TARGET binding site such as BINDING SITE I, BINDING SITE II or BINDING SITE III. Table 2 illustrates the complementarity of the nucleotide sequences of MGC12921 BINDING SITE, designated SEQ ID:31898, to the nucleotide sequence of VGAM477 RNA, herein designated VGAM RNA, also designated SEQ ID:3188.

Another function of VGAM477 is therefore inhibition of MGC12921 (Accession XM_033362). Accordingly, utilities of VGAM477 include diagnosis, prevention and treatment of diseases and clinical conditions associated with MGC12921. RA-GEF-2 (Accession NM_016340) is another VGAM477 host target gene. RA-GEF-2 BINDING SITE is HOST TARGET binding site found in the 3' untranslated region of mRNA encoded by RA-GEF-2, corresponding to a HOST TARGET binding site such as BINDING SITE I, BINDING SITE II or BINDING SITE III. Table 2 illustrates the complementarity of the nucleotide sequences of RA-GEF-2 BINDING SITE, designated SEQ ID:18463, to the nucleotide sequence of VGAM477 RNA, herein designated VGAM RNA, also designated SEQ ID:3188.

Another function of VGAM477 is therefore inhibition of RA-GEF-2 (Accession NM_016340). Accordingly, utilities of VGAM477 include diagnosis, prevention and treatment of diseases and clinical conditions associated with RA-GEF-2. LOC147071 (Accession XM_054031) is another VGAM477 host target gene. LOC147071 BINDING SITE is HOST TARGET binding site found in the 5' untranslated region of mRNA encoded by LOC147071, corresponding to a HOST TARGET binding site such as BINDING SITE I, BINDING SITE II or BINDING SITE III. Table 2 illustrates the complementarity of the nucleotide sequences of LOC147071 BINDING SITE, designated SEQ ID:36139, to the nucleotide sequence of VGAM477 RNA, herein designated VGAM RNA, also designated SEQ ID:3188.

Another function of VGAM477 is therefore inhibition of LOC147071 (Accession XM_054031). Accordingly, utilities of VGAM477 include diagnosis, prevention and treatment of diseases and clinical conditions associated with LOC147071. LOC154141 (Accession XM_098482) is another VGAM477 host target gene. LOC154141 BINDING SITE is HOST TARGET binding site found in the 5' untranslated region of mRNA encoded by LOC154141, corresponding to a HOST TARGET binding site such as BINDING SITE I, BINDING SITE II or BINDING SITE III. Table 2 illustrates the complementarity of the nucleotide sequences of LOC154141 BINDING SITE, designated SEQ ID:41686, to the nucleotide sequence of VGAM477 RNA, herein designated VGAM RNA, also designated SEQ ID:3188.

Another function of VGAM477 is therefore inhibition of LOC154141 (Accession XM_098482). Accordingly, utilities of VGAM477 include diagnosis, prevention and treatment of diseases and clinical conditions associated with LOC154141. LOC201173 (Accession XM_113312) is another VGAM477 host target gene. LOC201173 BINDING SITE is HOST TARGET binding site found in the 5' untranslated region of mRNA encoded by LOC201173, corresponding to a HOST TARGET binding site such as BINDING SITE I, BINDING SITE II or BINDING SITE III. Table 2 illustrates the complementarity of the nucleotide sequences of LOC201173 BINDING SITE, designated SEQ ID:42218, to the nucleotide sequence of VGAM477 RNA, herein designated VGAM RNA, also designated SEQ ID:3188.

Another function of VGAM477 is therefore inhibition of LOC201173 (Accession XM_113312). Accordingly, utilities of VGAM477 include diagnosis, prevention and treatment of diseases and clinical conditions associated with LOC201173.

LOC201220 (Accession XM_113321) is another VGAM477 host target gene. LOC201220 BINDING SITE is HOST TARGET binding site found in the 5' untranslated region of mRNA encoded by LOC201220, corresponding to a HOST TARGET binding site such as BINDING SITE I, BINDING SITE II or BINDING SITE III. Table 2 illustrates the complementarity of the nucleotide sequences of LOC201220 BINDING SITE, designated SEQ ID:42227, to the nucleotide sequence of VGAM477 RNA, herein designated VGAM RNA, also designated SEQ ID:3188.

Another function of VGAM477 is therefore inhibition of LOC201220 (Accession XM_113321). Accordingly, utilities of VGAM477 include diagnosis, prevention and treatment of diseases and clinical conditions associated with LOC201220. FIG. 1 further provides a conceptual description of a novel bioinformatically detected viral gene of the present invention, referred to here as Viral Genomic Address Messenger 478 (VGAM478) viral gene, which modulates expression of respective host target genes thereof, the function and utility of which host target genes is known in the art.

VGAM478 is a novel bioinformatically detected regulatory, non protein coding, viral micro RNA (miRNA) gene. The method by which VGAM478 was detected is described hereinabove with reference to FIGS. 1-8.

VGAM478 gene, herein designated VGAM GENE, is a viral gene contained in the genome of Hepatitis G Virus. VGAM478 host target gene, herein designated VGAM HOST TARGET GENE, is a human gene contained in the human genome.

VGAM478 gene encodes a VGAM478 precursor RNA, herein designated VGAM PRECURSOR RNA. Similar to other miRNA genes, and unlike most ordinary genes, VGAM478 precursor RNA does not encode a protein. A nucleotide sequence identical or highly similar to the nucleotide sequence of VGAM478 precursor RNA is designated SEQ ID:464, and is provided hereinbelow with reference to the sequence listing part. Nucleotide sequence SEQ ID:464 is located at position 8794 relative to the genome of Hepatitis G Virus.

VGAM478 precursor RNA folds onto itself, forming VGAM478 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM478 folded precursor RNA into VGAM478 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM478 RNA is designated SEQ ID:3189, and is provided hereinbelow with reference to the sequence listing part.

VGAM478 host target gene, herein designated VGAM HOST TARGET GENE, encodes a corresponding messenger RNA, VGAM478 host target RNA, herein designated VGAM HOST TARGET RNA. VGAM478 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM478 RNA, herein designated VGAM RNA, binds complementarily to one or more host target binding sites located in untranslated regions of VGAM478 host target RNA, herein designated VGAM HOST TARGET RNA. This complementary binding is due to the fact that the nucleotide sequence of VGAM478 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM478 RNA, herein designated VGAM RNA, may have a different number of host target binding sites in untranslated regions of a VGAM478 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM478 RNA, herein designated VGAM RNA, to host target binding sites on VGAM478 host target RNA, herein designated VGAM HOST TARGET RNA, such as BINDING SITE I, BINDING SITE II and BINDING SITE III, inhibits translation of VGAM478 host target RNA into VGAM478 host target protein, herein designated VGAM HOST TARGET PROTEIN. VGAM host target protein is therefore outlined by a broken line.

It is appreciated that VGAM478 host target gene, herein designated VGAM HOST TARGET GENE, in fact represents a plurality of VGAM478 host target genes. The mRNA of each one of this plurality of VGAM478 host target genes comprises one or more host target binding sites, each having a nucleotide sequence which is at least partly complementary to VGAM478 RNA, herein designated VGAM RNA, and which when bound by VGAM478 RNA causes inhibition of translation of respective one or more VGAM478 host target proteins.

It is further appreciated by one skilled in the art that the mode of translational inhibition illustrated by FIG. 1 with specific reference to translational inhibition exerted by VGAM478 gene, herein designated VGAM GENE, on one or more VGAM478 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM478 is inhibition of expression of host target genes, as part of a novel viral mechanism of attacking a host. Accordingly, utilities of VGAM478 include diagnosis, prevention and treatment of viral infection by Hepatitis G Virus. Specific functions, and accordingly utilities, of VGAM478 correlate with, and may be deduced from, the identity of the host target genes which VGAM478 binds and inhibits, and the function of these host target genes, as elaborated hereinbelow.

Nucleotide sequences of the VGAM478 precursor RNA, herein designated VGAM PRECURSOR RNA, and of the 'diced' VGAM478 RNA, herein designated VGAM RNA, and a schematic representation of the secondary folding of VGAM478 folded precursor RNA, herein designated VGAM FOLDED PRECURSOR RNA, of VGAM478 are further described hereinbelow with reference to Table 1.

Nucleotide sequences of host target binding sites, such as BINDING SITE-I, BINDING SITE-II and BINDING SITE-III of FIG. 1, found on VGAM478 host target RNA, and schematic representation of the complementarity of each of these host target binding sites to VGAM478 RNA, herein designated VGAM RNA, are described hereinbelow with reference to Table 2.

As mentioned hereinabove with reference to FIG. 1, a function of VGAM478 gene, herein designated VGAM is inhibition of expression of VGAM478 target genes. It is appreciated that specific functions, and accordingly utilities, of VGAM478 correlate with, and may be deduced from, the identity of the target genes which VGAM478 binds and inhibits, and the function of these target genes, as elaborated hereinbelow.

ATPase, Cu++ Transporting, Beta Polypeptide (Wilson disease) (ATP7B, Accession NM_000053) is a VGAM478 host target gene. ATP7B BINDING SITE is HOST TARGET binding site found in the 3' untranslated region of mRNA encoded by ATP7B, corresponding to a HOST TARGET binding site such as BINDING SITE I, BINDING SITE II or BINDING SITE III. Table 2 illustrates the complementarity of the nucleotide sequences of ATP7B BINDING SITE, designated SEQ ID:5504, to the nucleotide sequence of VGAM478 RNA, herein designated VGAM RNA, also designated SEQ ID:3189.

A function of VGAM478 is therefore inhibition of ATPase, Cu++ Transporting, Beta Polypeptide (Wilson disease) (ATP7B, Accession NM_000053). Accordingly, utilities of VGAM478 include diagnosis, prevention and treatment of diseases and clinical conditions associated with ATP7B. Multiple Endocrine Neoplasia I (MEN1, Accession NM_130804) is another VGAM478 host target gene. MEN1 BINDING SITE1 through MEN1 BINDING SITE7 are HOST TARGET binding sites found in untranslated regions of mRNA encoded by MEN1, corresponding to HOST TARGET binding sites such as BINDING SITE I, BINDING SITE II or BINDING SITE III. Table 2 illustrates the complementarity of the nucleotide sequences of MEN1 BINDING SITE1 through MEN1 BINDING SITE7, designated SEQ ID:28300, SEQ ID:5773, SEQ ID:28287, SEQ ID:28289, SEQ ID:28291, SEQ ID:28293 and SEQ ID:28296 respectively, to the nucleotide sequence of VGAM478 RNA, herein designated VGAM RNA, also designated SEQ ID:3189.

Another function of VGAM478 is therefore inhibition of Multiple Endocrine Neoplasia I (MEN1, Accession NM_130804). Accordingly, utilities of VGAM478 include diagnosis, prevention and treatment of diseases and clinical conditions associated with MEN1. DKFZp762E1511 (Accession XM_003460) is another VGAM478 host target gene. DKFZp762E1511 BINDING SITE is HOST TARGET binding site found in the 3' untranslated region of mRNA encoded by DKFZp762E1511, corresponding to a HOST TARGET binding site such as BINDING SITE I, BINDING SITE II or BINDING SITE III. Table 2 illustrates the complementarity of the nucleotide sequences of DKFZp762E1511 BINDING SITE, designated SEQ ID:29930, to the nucleotide sequence of VGAM478 RNA, herein designated VGAM RNA, also designated SEQ ID:3189.

Another function of VGAM478 is therefore inhibition of DKFZp762E1511 (Accession XM_003460). Accordingly, utilities of VGAM478 include diagnosis, prevention and treatment of diseases and clinical conditions associated with DKFZp762E1511. FLJ20312 (Accession NM_017761) is another VGAM478 host target gene. FLJ20312 BINDING SITE is HOST TARGET binding site found in the 5' untranslated region of mRNA encoded by FLJ20312, corresponding to a HOST TARGET binding site such as BINDING SITE I, BINDING SITE II or BINDING SITE III. Table 2 illustrates the complementarity of the nucleotide sequences of FLJ20312 BINDING SITE, designated SEQ ID:19375, to the nucleotide sequence of VGAM478 RNA, herein designated VGAM RNA, also designated SEQ ID:3189.

Another function of VGAM478 is therefore inhibition of FLJ20312 (Accession NM_017761). Accordingly, utilities of VGAM478 include diagnosis, prevention and treatment of diseases and clinical conditions associated with FLJ20312. KIAA1239 (Accession XM_049078) is another VGAM478 host target gene. KIAA1239 BINDING SITE is HOST TARGET binding site found in the 3' untranslated region of mRNA encoded by KIAA1239, corresponding to a HOST TARGET binding site such as BINDING SITE I, BINDING SITE II or BINDING SITE III. Table 2 illustrates the complementarity of the nucleotide sequences of KIAA1239 BINDING SITE, designated SEQ ID:35339, to the nucleotide sequence of VGAM478 RNA, herein designated VGAM RNA, also designated SEQ ID:3189.

Another function of VGAM478 is therefore inhibition of KIAA1239 (Accession XM_049078). Accordingly, utilities of VGAM478 include diagnosis, prevention and treatment of diseases and clinical conditions associated with KIAA1239. Peptidylprolyl Isomerase (cyclophilin)-like 3 (PPIL3, Accession NM_131916) is another VGAM478 host target gene. PPIL3 BINDING SITE is HOST TARGET binding site found in the 5' untranslated region of mRNA encoded by PPIL3, corresponding to a HOST TARGET binding site such as BINDING SITE I, BINDING SITE II or BINDING SITE III. Table 2 illustrates the complementarity of the nucleotide sequences of PPIL3 BINDING SITE, designated SEQ ID:28393, to the nucleotide sequence of VGAM478 RNA, herein designated VGAM RNA, also designated SEQ ID:3189.

Another function of VGAM478 is therefore inhibition of Peptidylprolyl Isomerase (cyclophilin)-like 3 (PPIL3, Accession NM_131916). Accordingly, utilities of VGAM478 include diagnosis, prevention and treatment of diseases and clinical conditions associated with PPIL3. LOC144962 (Accession XM_084990) is another VGAM478 host target gene. LOC144962 BINDING SITE is HOST TARGET binding site found in the 5' untranslated region of mRNA encoded by LOC144962, corresponding to a HOST TARGET binding site such as BINDING SITE I, BINDING SITE II or BINDING SITE III. Table 2 illustrates the complementarity of the nucleotide sequences of LOC144962 BINDING SITE, designated SEQ ID:37791, to the nucleotide sequence of VGAM478 RNA, herein designated VGAM RNA, also designated SEQ ID:3189.

Another function of VGAM478 is therefore inhibition of LOC144962 (Accession XM_084990). Accordingly, utilities of VGAM478 include diagnosis, prevention and treatment of diseases and clinical conditions associated with LOC144962. LOC150397 (Accession XM_086907) is another VGAM478 host target gene. LOC150397 BINDING SITE is HOST TARGET binding site found in the 3' untranslated region of mRNA encoded by LOC150397, corresponding to a HOST TARGET binding site such as BINDING SITE I, BINDING SITE II or BINDING SITE III. Table 2 illustrates the complementarity of the nucleotide sequences of LOC150397 BINDING SITE, designated SEQ ID:38960, to the nucleotide sequence of VGAM478 RNA, herein designated VGAM RNA, also designated SEQ ID:3189.

Another function of VGAM478 is therefore inhibition of LOC150397 (Accession XM_086907). Accordingly, utilities of VGAM478 include diagnosis, prevention and treatment of diseases and clinical conditions associated with LOC150397. LOC152359 (Accession XM_098213) is another VGAM478 host target gene. LOC152359 BINDING SITE is HOST TARGET binding site found in the 3' untranslated region of mRNA encoded by LOC152359, corresponding to a HOST TARGET binding site such as BINDING SITE I, BINDING SITE II or BINDING SITE III. Table 2 illustrates the complementarity of the nucleotide sequences of LOC152359 BINDING SITE, designated SEQ ID:41493, to the nucleotide sequence of VGAM478 RNA, herein designated VGAM RNA, also designated SEQ ID:3189.

Another function of VGAM478 is therefore inhibition of LOC152359 (Accession XM_098213). Accordingly, utilities of VGAM478 include diagnosis, prevention and treatment of diseases and clinical conditions associated with LOC152359. LOC220522 (Accession XM_018306) is another VGAM478 host target gene. LOC220522 BINDING SITE is HOST TARGET binding site found in the 3' untranslated region of mRNA encoded by LOC220522, corresponding to a HOST TARGET binding site such as BINDING SITE I, BINDING SITE II or BINDING SITE III. Table 2 illustrates the complementarity of the nucleotide sequences of LOC220522 BINDING SITE, designated SEQ ID:30351, to the nucleotide sequence of VGAM478 RNA, herein designated VGAM RNA, also designated SEQ ID:3189.

Another function of VGAM478 is therefore inhibition of LOC220522 (Accession XM_018306). Accordingly, utilities of VGAM478 include diagnosis, prevention and treatment of diseases and clinical conditions associated with LOC220522. FIG. 1 further provides a conceptual description of a novel bioinformatically detected viral gene of the present invention, referred to here as Viral Genomic Address Messenger 479 (VGAM479) viral gene, which modulates expression of respective host target genes thereof, the function and utility of which host target genes is known in the art.

VGAM479 is a novel bioinformatically detected regulatory, non protein coding, viral micro RNA (miRNA) gene. The method by which VGAM479 was detected is described hereinabove with reference to FIGS. 1-8.

VGAM479 gene, herein designated VGAM GENE, is a viral gene contained in the genome of Hepatitis G Virus. VGAM479 host target gene, herein designated VGAM HOST TARGET GENE, is a human gene contained in the human genome.

VGAM479 gene encodes a VGAM479 precursor RNA, herein designated VGAM PRECURSOR RNA. Similar to other miRNA genes, and unlike most ordinary genes, VGAM479 precursor RNA does not encode a protein. A nucleotide sequence identical or highly similar to the nucleotide sequence of VGAM479 precursor RNA is designated SEQ ID:465, and is provided hereinbelow with reference to the sequence listing part. Nucleotide sequence SEQ ID:465 is located at position 3988 relative to the genome of Hepatitis G Virus.

VGAM479 precursor RNA folds onto itself, forming VGAM479 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM479 folded precursor RNA into VGAM479 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM479 RNA is designated SEQ ID:3190, and is provided hereinbelow with reference to the sequence listing part.

VGAM479 host target gene, herein designated VGAM HOST TARGET GENE, encodes a corresponding messenger RNA, VGAM479 host target RNA, herein designated VGAM HOST TARGET RNA. VGAM479 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM479 RNA, herein designated VGAM RNA, binds complementarily to one or more host target binding sites located in untranslated regions of VGAM479 host target RNA, herein designated VGAM HOST TARGET RNA. This complementary binding is due to the fact that the nucleotide sequence of VGAM479 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM479 RNA, herein designated VGAM RNA, may have a different number of host target binding sites in untranslated regions of a VGAM479 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM479 RNA, herein designated VGAM RNA, to host target binding sites on VGAM479 host target RNA, herein designated VGAM HOST TARGET RNA, such as BINDING SITE I, BINDING SITE II and BINDING SITE III, inhibits translation of VGAM479 host target RNA into VGAM479 host target protein, herein designated VGAM HOST TARGET PROTEIN. VGAM host target protein is therefore outlined by a broken line.

It is appreciated that VGAM479 host target gene, herein designated VGAM HOST TARGET GENE, in fact represents a plurality of VGAM479 host target genes. The mRNA of each one of this plurality of VGAM479 host target genes comprises one or more host target binding sites, each having a nucleotide sequence which is at least partly complementary to VGAM479 RNA, herein designated VGAM RNA, and which when bound by VGAM479 RNA causes inhibition of translation of respective one or more VGAM479 host target proteins.

It is further appreciated by one skilled in the art that the mode of translational inhibition illustrated by FIG. 1 with specific reference to translational inhibition exerted by VGAM479 gene, herein designated VGAM GENE, on one or more VGAM479 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM479 is inhibition of expression of host target genes, as part of a novel viral mechanism of attacking a host. Accordingly, utilities of VGAM479 include diagnosis, prevention and treatment of viral infection by Hepatitis G Virus. Specific functions, and accordingly utilities, of VGAM479 correlate with, and may be deduced from, the identity of the host target genes which VGAM479 binds and inhibits, and the function of these host target genes, as elaborated hereinbelow.

Nucleotide sequences of the VGAM479 precursor RNA, herein designated VGAM PRECURSOR RNA, and of the 'diced' VGAM479 RNA, herein designated VGAM RNA, and a schematic representation of the secondary folding of VGAM479 folded precursor RNA, herein designated VGAM FOLDED PRECURSOR RNA, of VGAM479 are further described hereinbelow with reference to Table 1.

Nucleotide sequences of host target binding sites, such as BINDING SITE-I, BINDING SITE-II and BINDING SITE-III of FIG. 1, found on VGAM479 host target RNA, and schematic representation of the complementarity of each of these host target binding sites to VGAM479 RNA, herein designated VGAM RNA, are described hereinbelow with reference to Table 2.

As mentioned hereinabove with reference to FIG. 1, a function of VGAM479 gene, herein designated VGAM is inhibition of expression of VGAM479 target genes. It is appreciated that specific functions, and accordingly utilities, of VGAM479 correlate with, and may be deduced from, the identity of the target genes which VGAM479 binds and inhibits, and the function of these target genes, as elaborated hereinbelow.

ATP-binding Cassette, Sub-family C (CFTR/MRP), Member 1 (ABCC1, Accession NM_004996) is a VGAM479 host target gene. ABCC1 BINDING SITE1 through ABCC1 BINDING SITE3 are HOST TARGET binding sites found in untranslated regions of mRNA encoded by ABCC1, corresponding to HOST TARGET binding sites such as BINDING SITE I, BINDING SITE II or BINDING SITE III. Table 2 illustrates the complementarity of the nucleotide sequences of ABCC1 BINDING SITE1 through ABCC1 BINDING SITE3, designated SEQ ID:11440, SEQ ID:21284 and SEQ ID:21288 respectively, to the nucleotide sequence of VGAM479 RNA, herein designated VGAM RNA, also designated SEQ ID:3190.

A function of VGAM479 is therefore inhibition of ATP-binding Cassette, Sub-family C (CFTR/MRP), Member 1 (ABCC1, Accession NM_004996), a gene which may participate directly in the active transport of drugs into subcellular organelles or influence drug distribution indirectly. Accordingly, utilities of VGAM479 include diagnosis, prevention and treatment of diseases and clinical conditions associated with ABCC1. The function of ABCC1 has been established by previous studies. Cole et al. (1992) identified a transporter protein whose gene is overexpressed in a multi-drug-resistant variant of the small cell lung cancer cell line NCI-H69. Unlike most tumor cell lines that are resistant to multiple chemotherapeutic agents, it did not overexpress the transmembrane transport protein P-glycoprotein (MDR1;

171050). Cole et al. (1992) isolated cDNA clones corresponding to mRNAs overexpressed in the resistant H69 cells. One cDNA hybridized to an mRNA of 7.8 to 8.2 kb that was expressed 100- to 200-fold higher in the resistant cells than in the drug-sensitive H69 cells. Overexpression was associated with amplification of the cognate gene. The cDNA contained a single open reading frame of 1,522 amino acids encoding a protein that they designated MRP, for 'multidrug resistance-associated protein.' Database analyses demonstrated similarities in primary sequence to the adenosine triphosphate (ATP)-binding cassette (ABC) superfamily of transport systems. Included in this superfamily are the genes for MDR1 and for the cystic fibrosis transmembrane conductance regulator (CFTR; 602421). Northern blot analysis readily detected MRP transcripts in lung, testis, and peripheral blood mononuclear cells; MRP transcripts were below the level of detection in placenta, brain, kidney, salivary gland, uterus, liver, and spleen. By isotopic in situ hybridization, Cole et al. (1992) mapped the MRP1 gene to chromosome 16p13.1. Grant et al. (1997) located the MRP1 gene close to the short arm breakpoint of the pericentric inversion associated with the M4Eo subclass of acute myeloid leukemia and on the telomeric side of the MYH11 gene (OMIM Ref. No. 160745).

Full details of the abovementioned studies are described in the following publications, the disclosure of which are hereby incorporated by reference:

Cole, S. P. C.; Bhardwaj, G.; Gerlach, J. H.; Mackie, J. E.; Grant, C. E.; Almquist, K. C.; Stewart, A. J.; Kurz, E. U.; Duncan, A. M. V.; Deeley, R. G.: Overexpression of a transporter gene in a multidrug-resistant human lung cancer cell line. Science 258:1650-1654, 1992; and Grant, C. E.; Kurz, E. U.; Cole, S. P. C.; Deeley, R. G.: Analysis of the intron-exon organization of the human multidrug-resistance protein gene (MRP) and alternative splicing of its m.

Further studies establishing the function and utilities of ABCC1 are found in John Hopkins OMIM database record ID 158343, and in sited publications numbered 2530-2536 listed in the bibliography section hereinbelow, which are also hereby incorporated by reference. Chemokine (C-C motif) Receptor 5 (CCR5, Accession NM_000579) is another VGAM479 host target gene. CCR5 BINDING SITE is HOST TARGET binding site found in the 3' untranslated region of mRNA encoded by CCR5, corresponding to a HOST TARGET binding site such as BINDING SITE I, BINDING SITE II or BINDING SITE III. Table 2 illustrates the complementarity of the nucleotide sequences of CCR5 BINDING SITE, designated SEQ ID:6186, to the nucleotide sequence of VGAM479 RNA, herein designated VGAM RNA, also designated SEQ ID:3190.

Another function of VGAM479 is therefore inhibition of Chemokine (C-C motif) Receptor 5 (CCR5, Accession NM_000579). Accordingly, utilities of VGAM479 include diagnosis, prevention and treatment of diseases and clinical conditions associated with CCR5. KIAA1265 (Accession XM_047707) is another VGAM479 host target gene. KIAA1265 BINDING SITE is HOST TARGET binding site found in the 3' untranslated region of mRNA encoded by KIAA1265, corresponding to a HOST TARGET binding site such as BINDING SITE I, BINDING SITE II or BINDING SITE III. Table 2 illustrates the complementarity of the nucleotide sequences of KIAA1265 BINDING SITE, designated SEQ ID:35035, to the nucleotide sequence of VGAM479 RNA, herein designated VGAM RNA, also designated SEQ ID:3190.

Another function of VGAM479 is therefore inhibition of KIAA1265 (Accession XM_047707). Accordingly, utilities of VGAM479 include diagnosis, prevention and treatment of diseases and clinical conditions associated with KIAA1265. PDZ Domain Containing 2 (PDZD2, Accession XM_087705) is another VGAM479 host target gene. PDZD2 BINDING SITE is HOST TARGET binding site found in the 3' untranslated region of mRNA encoded by PDZD2, corresponding to a HOST TARGET binding site such as BINDING SITE I, BINDING SITE II or BINDING SITE III. Table 2 illustrates the complementarity of the nucleotide sequences of PDZD2 BINDING SITE, designated SEQ ID:39386, to the nucleotide sequence of VGAM479 RNA, herein designated VGAM RNA, also designated SEQ ID:3190.

Another function of VGAM479 is therefore inhibition of PDZ Domain Containing 2 (PDZD2, Accession XM_087705). Accordingly, utilities of VGAM479 include diagnosis, prevention and treatment of diseases and clinical conditions associated with PDZD2. LOC150372 (Accession XM_086893) is another VGAM479 host target gene. LOC150372 BINDING SITE is HOST TARGET binding site found in the 5' untranslated region of mRNA encoded by LOC150372, corresponding to a HOST TARGET binding site such as BINDING SITE I, BINDING SITE II or BINDING SITE III. Table 2 illustrates the complementarity of the nucleotide sequences of LOC150372 BINDING SITE, designated SEQ ID:38943, to the nucleotide sequence of VGAM479 RNA, herein designated VGAM RNA, also designated SEQ ID:3190.

Another function of VGAM479 is therefore inhibition of LOC150372 (Accession XM_086893). Accordingly, utilities of VGAM479 include diagnosis, prevention and treatment of diseases and clinical conditions associated with LOC150372.

FIG. 1 further provides a conceptual description of a novel bioinformatically detected viral gene of the present invention, referred to here as Viral Genomic Address Messenger 480 (VGAM480) viral gene, which modulates expression of respective host target genes thereof, the function and utility of which host target genes is known in the art.

VGAM480 is a novel bioinformatically detected regulatory, non protein coding, viral micro RNA (miRNA) gene. The method by which VGAM480 was detected is described hereinabove with reference to FIGS. 1-8.

VGAM480 gene, herein designated VGAM GENE, is a viral gene contained in the genome of Hepatitis G Virus. VGAM480 host target gene, herein designated VGAM HOST TARGET GENE, is a human gene contained in the human genome.

VGAM480 gene encodes a VGAM480 precursor RNA, herein designated VGAM PRECURSOR RNA. Similar to other miRNA genes, and unlike most ordinary genes, VGAM480 precursor RNA does not encode a protein. A nucleotide sequence identical or highly similar to the nucleotide sequence of VGAM480 precursor RNA is designated SEQ ID:466, and is provided hereinbelow with reference to the sequence listing part. Nucleotide sequence SEQ ID:466 is located at position 4279 relative to the genome of Hepatitis G Virus.

VGAM480 precursor RNA folds onto itself, forming VGAM480 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM480 folded precursor RNA into VGAM480

RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM480 RNA is designated SEQ ID:3191, and is provided hereinbelow with reference to the sequence listing part.

VGAM480 host target gene, herein designated VGAM HOST TARGET GENE, encodes a corresponding messenger RNA, VGAM480 host target RNA, herein designated VGAM HOST TARGET RNA. VGAM480 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM480 RNA, herein designated VGAM RNA, binds complementarily to one or more host target binding sites located in untranslated regions of VGAM480 host target RNA, herein designated VGAM HOST TARGET RNA. This complementary binding is due to the fact that the nucleotide sequence of VGAM480 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM480 RNA, herein designated VGAM RNA, may have a different number of host target binding sites in untranslated regions of a VGAM480 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM480 RNA, herein designated VGAM RNA, to host target binding sites on VGAM480 host target RNA, herein designated VGAM HOST TARGET RNA, such as BINDING SITE I, BINDING SITE II and BINDING SITE III, inhibits translation of VGAM480 host target RNA into VGAM480 host target protein, herein designated VGAM HOST TARGET PROTEIN. VGAM host target protein is therefore outlined by a broken line.

It is appreciated that VGAM480 host target gene, herein designated VGAM HOST TARGET GENE, in fact represents a plurality of VGAM480 host target genes. The mRNA of each one of this plurality of VGAM480 host target genes comprises one or more host target binding sites, each having a nucleotide sequence which is at least partly complementary to VGAM480 RNA, herein designated VGAM RNA, and which when bound by VGAM480 RNA causes inhibition of translation of respective one or more VGAM480 host target proteins.

It is further appreciated by one skilled in the art that the mode of translational inhibition illustrated by FIG. 1 with specific reference to translational inhibition exerted by VGAM480 gene, herein designated VGAM GENE, on one or more VGAM480 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM480 is inhibition of expression of host target genes, as part of a novel viral mechanism of attacking a host. Accordingly, utilities of VGAM480 include diagnosis, prevention and treatment of viral infection by Hepatitis G Virus. Specific functions, and accordingly utilities, of VGAM480 correlate with, and may be deduced from, the identity of the host target genes which VGAM480 binds and inhibits, and the function of these host target genes, as elaborated hereinbelow.

Nucleotide sequences of the VGAM480 precursor RNA, herein designated VGAM PRECURSOR RNA, and of the 'diced' VGAM480 RNA, herein designated VGAM RNA, and a schematic representation of the secondary folding of VGAM480 folded precursor RNA, herein designated VGAM FOLDED PRECURSOR RNA, of VGAM480 are further described hereinbelow with reference to Table 1.

Nucleotide sequences of host target binding sites, such as BINDING SITE-I, BINDING SITE-II and BINDING SITE-III of FIG. 1, found on VGAM480 host target RNA, and schematic representation of the complementarity of each of these host target binding sites to VGAM480 RNA, herein designated VGAM RNA, are described hereinbelow with reference to Table 2.

As mentioned hereinabove with reference to FIG. 1, a function of VGAM480 gene, herein designated VGAM is inhibition of expression of VGAM480 target genes. It is appreciated that specific functions, and accordingly utilities, of VGAM480 correlate with, and may be deduced from, the identity of the target genes which VGAM480 binds and inhibits, and the function of these target genes, as elaborated hereinbelow.

Myozenin 1 (MYOZ1, Accession NM_021245) is a VGAM480 host target gene. MYOZ1 BINDING SITE is HOST TARGET binding site found in the 5' untranslated region of mRNA encoded by MYOZ1, corresponding to a HOST TARGET binding site such as BINDING SITE I, BINDING SITE II or BINDING SITE III. Table 2 illustrates the complementarity of the nucleotide sequences of MYOZ1 BINDING SITE, designated SEQ ID:22213, to the nucleotide sequence of VGAM480 RNA, herein designated VGAM RNA, also designated SEQ ID:3191.

A function of VGAM480 is therefore inhibition of Myozenin 1 (MYOZ1, Accession NM_021245), a gene which modulates the function and substrate specificity of calcineurin in striated muscle cells. Accordingly, utilities of VGAM480 include diagnosis, prevention and treatment of diseases and clinical conditions associated with MYOZ1. The function of MYOZ1 has been established by previous studies. Calcineurin (see OMIM Ref. No. 114105) is a calcium/calmodulin-dependent serine-threonine phosphatase that plays an important role in transducing calcium-dependent signals in a variety of cell types. Calcineurin has also been shown to have a profound influence on the properties of striated muscle cells, including cardiac muscle. To identify potential cardiac-specific regulators of calcineurin, Frey et al. (2000) conducted a yeast 2-hybrid screen, using the catalytic A subunit of calcineurin as bait. They identified a novel family of striated muscle-specific calcineurin-interacting proteins called calsarcins. Calsarcins interact and colocalize with the Z-disc protein alpha-actinin (ACTN1; 102575) in vitro and in vivo and thereby tether calcineurin to the sarcomere of cardiac and skeletal muscle. These properties of calsarcins suggest an important role for these proteins in modulating the function and substrate specificity of calcineurin in striated muscle cells Using the yeast 2-hybrid system, Takada et al. (2001) used sarcomeric isoforms of alpha-actinin and gamma-filamin to screen a human skeletal muscle cDNA library for interacting proteins. The aim was to understand better the structure and function of Z lines. They described the characteristics of myozenin. It is predicted to be a 32-kD globular protein with a central glycine-rich domain flanked by alpha-helical regions with no strong homologies to any known genes. The MYOZ gene has 6 exons and maps to chromosome 10q22.1-q22.2; a homologous EST in the public database had been mapped to 10q22.1 by radiation hybrid mapping. Takada et al. (2001) considered myozenin as a skeletal muscle Z-line protein to be a candidate gene for limb-girdle muscular dystrophy or other neuromuscular disorders.

Full details of the abovementioned studies are described in the following publications, the disclosure of which are hereby incorporated by reference:

Frey, N.; Richardson, J. A.; Olson, E. N.: Calsarcins, a novel family of sarcomeric calcineurin-binding proteins. Proc. Nat. Acad. Sci. 97:14632-14637, 2000; and Takada, F.; Vander Woude, D. L.; Tong, H.-Q.; Thompson, T. G.; Watkins, S. C.; Kunkel, L. M.; Beggs, A. H.: Myozenin: an alpha-actinin- and gamma-filamin-binding protein of skeletal m.

Further studies establishing the function and utilities of MYOZ1 are found in John Hopkins OMIM database record ID 605603, and in sited publications numbered 700 and 7004 listed in the bibliography section hereinbelow, which are also hereby incorporated by reference. Baculoviral IAP Repeat-containing 8 (BIRC8, Accession NM_033341) is another VGAM480 host target gene. BIRC8 BINDING SITE is HOST TARGET binding site found in the 5' untranslated region of mRNA encoded by BIRC8, corresponding to a HOST TARGET binding site such as BINDING SITE I, BINDING SITE II or BINDING SITE III. Table 2 illustrates the complementarity of the nucleotide sequences of BIRC8 BINDING SITE, designated SEQ ID:27195, to the nucleotide sequence of VGAM480 RNA, herein designated VGAM RNA, also designated SEQ ID:3191.

Another function of VGAM480 is therefore inhibition of Baculoviral IAP Repeat-containing 8 (BIRC8, Accession NM_033341). Accordingly, utilities of VGAM480 include diagnosis, prevention and treatment of diseases and clinical conditions associated with BIRC8. DKFZp762M136 (Accession XM_035635) is another VGAM480 host target gene. DKFZp762M136 BINDING SITE is HOST TARGET binding site found in the 3' untranslated region of mRNA encoded by DKFZp762M136, corresponding to a HOST TARGET binding site such as BINDING SITE I, BINDING SITE II or BINDING SITE III. Table 2 illustrates the complementarity of the nucleotide sequences of DKFZp762M136 BINDING SITE, designated SEQ ID:32301, to the nucleotide sequence of VGAM480 RNA, herein designated VGAM RNA, also designated SEQ ID:3191.

Another function of VGAM480 is therefore inhibition of DKFZp762M136 (Accession XM_035635). Accordingly, utilities of VGAM480 include diagnosis, prevention and treatment of diseases and clinical conditions associated with DKFZp762M136. FLJ20449 (Accession NM_017826) is another VGAM480 host target gene. FLJ20449 BINDING SITE is HOST TARGET binding site found in the 3' untranslated region of mRNA encoded by FLJ20449, corresponding to a HOST TARGET binding site such as BINDING SITE I, BINDING SITE II or BINDING SITE III. Table 2 illustrates the complementarity of the nucleotide sequences of FLJ20449 BINDING SITE, designated SEQ ID:19485, to the nucleotide sequence of VGAM480 RNA, herein designated VGAM RNA, also designated SEQ ID:3191.

Another function of VGAM480 is therefore inhibition of FLJ20449 (Accession NM_017826). Accordingly, utilities of VGAM480 include diagnosis, prevention and treatment of diseases and clinical conditions associated with FLJ20449. FIG. 1 further provides a conceptual description of a novel bioinformatically detected viral gene of the present invention, referred to here as Viral Genomic Address Messenger 481 (VGAM481) viral gene, which modulates expression of respective host target genes thereof, the function and utility of which host target genes is known in the art.

VGAM481 is a novel bioinformatically detected regulatory, non protein coding, viral micro RNA (miRNA) gene. The method by which VGAM481 was detected is described hereinabove with reference to FIGS. 1-8.

VGAM481 gene, herein designated VGAM GENE, is a viral gene contained in the genome of Hepatitis G Virus. VGAM481 host target gene, herein designated VGAM HOST TARGET GENE, is a human gene contained in the human genome.

VGAM481 gene encodes a VGAM481 precursor RNA, herein designated VGAM PRECURSOR RNA. Similar to other miRNA genes, and unlike most ordinary genes, VGAM481 precursor RNA does not encode a protein. A nucleotide sequence identical or highly similar to the nucleotide sequence of VGAM481 precursor RNA is designated SEQ ID:467, and is provided hereinbelow with reference to the sequence listing part. Nucleotide sequence SEQ ID:467 is located at position 2786 relative to the genome of Hepatitis G Virus.

VGAM481 precursor RNA folds onto itself, forming VGAM481 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM481 folded precursor RNA into VGAM481 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM481 RNA is designated SEQ ID:3192, and is provided hereinbelow with reference to the sequence listing part.

VGAM481 host target gene, herein designated VGAM HOST TARGET GENE, encodes a corresponding messenger RNA, VGAM481 host target RNA, herein designated VGAM HOST TARGET RNA. VGAM481 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM481 RNA, herein designated VGAM RNA, binds complementarily to one or more host target binding sites located in untranslated regions of VGAM481 host target RNA, herein designated VGAM HOST TARGET RNA. This complementary binding is due to the fact that the nucleotide sequence of VGAM481 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM481 RNA, herein designated VGAM RNA, may have a different number of host target binding sites in untranslated regions of a VGAM481 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM481 RNA, herein designated VGAM RNA, to host target binding sites on VGAM481 host target RNA, herein designated VGAM HOST TARGET RNA, such as BINDING SITE I, BINDING SITE II and BINDING SITE III, inhibits translation of VGAM481 host target RNA into VGAM481 host target protein, herein designated VGAM HOST TARGET PROTEIN. VGAM host target protein is therefore outlined by a broken line.

It is appreciated that VGAM481 host target gene, herein designated VGAM HOST TARGET GENE, in fact represents a plurality of VGAM481 host target genes. The mRNA of each one of this plurality of VGAM481 host target genes comprises one or more host target binding sites, each having a nucleotide sequence which is at least partly complementary to VGAM481 RNA, herein designated VGAM RNA, and which when bound by VGAM481 RNA causes inhibition of translation of respective one or more VGAM481 host target proteins.

It is further appreciated by one skilled in the art that the mode of translational inhibition illustrated by FIG. 1 with specific reference to translational inhibition exerted by VGAM481 gene, herein designated VGAM GENE, on one or more VGAM481 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM481 is inhibition of expression of host target genes, as part of a novel viral mechanism of attacking a host. Accordingly, utilities of VGAM481 include diagnosis, prevention and treatment of viral infection by Hepatitis G Virus. Specific functions, and accordingly utilities, of VGAM481 correlate with, and may be deduced from, the identity of the host target genes which VGAM481 binds and inhibits, and the function of these host target genes, as elaborated hereinbelow.

Nucleotide sequences of the VGAM481 precursor RNA, herein designated VGAM PRECURSOR RNA, and of the 'diced' VGAM481 RNA, herein designated VGAM RNA, and a schematic representation of the secondary folding of VGAM481 folded precursor RNA, herein designated VGAM FOLDED PRECURSOR RNA, of VGAM481 are further described hereinbelow with reference to Table 1.

Nucleotide sequences of host target binding sites, such as BINDING SITE-I, BINDING SITE-II and BINDING SITE-III of FIG. 1, found on VGAM481 host target RNA, and schematic representation of the complementarity of each of these host target binding sites to VGAM481 RNA, herein designated VGAM RNA, are described hereinbelow with reference to Table 2.

As mentioned hereinabove with reference to FIG. 1, a function of VGAM481 gene, herein designated VGAM is inhibition of expression of VGAM481 target genes. It is appreciated that specific functions, and accordingly utilities, of VGAM481 correlate with, and may be deduced from, the identity of the target genes which VGAM481 binds and inhibits, and the function of these target genes, as elaborated hereinbelow.

Adenylate Cyclase 7 (ADCY7, Accession NM_001114) is a VGAM481 host target gene. ADCY7 BINDING SITE is HOST TARGET binding site found in the 3' untranslated region of mRNA encoded by ADCY7, corresponding to a HOST TARGET binding site such as BINDING SITE I, BINDING SITE II or BINDING SITE III. Table 2 illustrates the complementarity of the nucleotide sequences of ADCY7 BINDING SITE, designated SEQ ID:6785, to the nucleotide sequence of VGAM481 RNA, herein designated VGAM RNA, also designated SEQ ID:3192.

A function of VGAM481 is therefore inhibition of Adenylate Cyclase 7 (ADCY7, Accession NM_001114), a gene which this a membrane-bound, ca (2+)-inhibitable adenylyl cyclase. Accordingly, utilities of VGAM481 include diagnosis, prevention and treatment of diseases and clinical conditions associated with ADCY7. The function of ADCY7 and its association with various diseases and clinical conditions, has been established by previous studies, as described hereinabove with reference to VGAM108. BTB and CNC Homology 1, Basic Leucine Zipper Transcription Factor 2 (BACH2, Accession NM_021813) is another VGAM481 host target gene. BACH2 BINDING SITE is HOST TARGET binding site found in the 3' untranslated region of mRNA encoded by BACH2, corresponding to a HOST TARGET binding site such as BINDING SITE I, BINDING SITE II or BINDING SITE III. Table 2 illustrates the complementarity of the nucleotide sequences of BACH2 BINDING SITE, designated SEQ ID:22380, to the nucleotide sequence of VGAM481 RNA, herein designated VGAM RNA, also designated SEQ ID:3192.

Another function of VGAM481 is therefore inhibition of BTB and CNC Homology 1, Basic Leucine Zipper Transcription Factor 2 (BACH2, Accession NM_021813), a gene which acts as repressor or activator, binds to maf recognition elements. Accordingly, utilities of VGAM481 include diagnosis, prevention and treatment of diseases and clinical conditions associated with BACH2. The function of BACH2 and its association with various diseases and clinical conditions, has been established by previous studies, as described hereinabove with reference to VGAM331. B-cell CLL/lymphoma 6 (zinc finger protein 51) (BCL6, Accession NM_001706) is another VGAM481 host target gene. BCL6 BINDING SITE is HOST TARGET binding site found in the 5' untranslated region of mRNA encoded by BCL6, corresponding to a HOST TARGET binding site such as BINDING SITE I, BINDING SITE II or BINDING SITE III. Table 2 illustrates the complementarity of the nucleotide sequences of BCL6 BINDING SITE, designated SEQ ID:7430, to the nucleotide sequence of VGAM481 RNA, herein designated VGAM RNA, also designated SEQ ID:3192.

Another function of VGAM481 is therefore inhibition of B-cell CLL/lymphoma 6 (zinc finger protein 51) (BCL6, Accession NM_001706), a gene which is involved in the generation and maintenance of both T and B cells during immune responses. Accordingly, utilities of VGAM481 include diagnosis, prevention and treatment of diseases and clinical conditions associated with BCL6. The function of BCL6 has been established by previous studies. Chromosomal translocations involving chromosome 3q27 and immunoglobulin gene regions are among the most common rearrangements in B-cell non-Hodgkin lymphoma. Using a probe from the immunoglobulin heavy chain joining region locus (OMIM Ref. No. 147010), Baron et al. (1993) isolated genomic clones from a bacteriophage lambda library prepared from a lymphoma characterized by a translocation t (3;14)(q27; q32). Normal chromosome 3 sequences and the reciprocal breakpoint junction were isolated. DNA probes on each side of the chromosome 3 breakpoint hybridized at high stringency to the DNA of various mammalian species, demonstrating evolutionary conservation. A probe made from partial cDNA clones isolated from a T-cell line hybridized the genomic DNA from both sides of the chromosome 3 breakpoint, indicating that the t (3;14) is associated with a break within the gene on chromosome 3. In situ chromosomal hybridization revealed that the same gene is involved in the t (3;22)(q27; q11). Preliminary nucleotide sequencing showed no identity of the cDNA to gene sequences in available data banks. Baron et al. (1993) proposed the name B-cell lymphoma-6 (BCL6) for this gene, which they presumed plays a role in the pathogenesis of certain B-cell lymphomas. Ye et al. (1993) cloned the BCL6 gene. Animal model experiments lend further support to the function of BCL6. Ichii et al. (2002) observed that the percentage of CD8 (see OMIM Ref. No. 186910)-positive T cells with a memory phenotype was lower in Bcl6 -/- mice than in wildtype mice, while the percentage of activated T cells was the same. Transgenic mice and 'rescued' Bcl6 -/- mice expressing the Bcl6 transgene specifically in T cells had levels of memory CD8 cells like those of wildtype mice. After antigenic stimulation, memory CD8 cells, which express CD44 (OMIM Ref. No. 107269), Ly6C (see OMIM Ref. No. LY6D; 606204), CD122 (OMIM Ref. No. 146710), and Bcl2 (OMIM Ref. No. 151430), differentiated into effector cells more rapidly than nonmemory CD8 cells in wildtype mice. Analysis of CD8-positive T-cell proliferation indicated that memory-type CD8 cells proliferated through a homeostatic mechanism in a Bcl6-dependent manner in the lymphopenic environment of very young mouse spleens. Ichii et al. (2002) concluded that BCL6 is involved in the generation and maintenance of both T and B cells during immune responses.

It is appreciated that the abovementioned animal model for BCL6 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ye, B. H.; Rao, P. H.; Chaganti, R. S. K.; Dalla-Favera, R.: Cloning of bcl-6, the locus involved in chromosome translocations affecting band 3q27 in B-cell lymphoma. Cancer Res. 53:2732-2735, 1993; and Ichii, H.; Sakamoto, A.; Hatano, M.; Okada, S.; Toyama, H.; Taki, S.; Arima, M.; Kuroda, Y.; Tokuhisa, T.: Role of Bcl-6 in the generation and maintenance of memory CD8+ T cells. Natu.

Further studies establishing the function and utilities of BCL6 are found in John Hopkins OMIM database record ID 109565, and in sited publications numbered 1362-1371, 607, 1372-1378, 45 and 1379-1386 listed in the bibliography section hereinbelow, which are also hereby incorporated by reference. Heterogeneous Nuclear Ribonucleoprotein F (HNRPF, Accession NM_004966) is another VGAM481 host target gene. HNRPF BINDING SITE is HOST TARGET binding site found in the 5' untranslated region of mRNA encoded by HNRPF, corresponding to a HOST TARGET binding site such as BINDING SITE I, BINDING SITE II or BINDING SITE III. Table 2 illustrates the complementarity of the nucleotide sequences of HNRPF BINDING SITE, designated SEQ ID:11415, to the nucleotide sequence of VGAM481 RNA, herein designated VGAM RNA, also designated SEQ ID:3192.

Another function of VGAM481 is therefore inhibition of Heterogeneous Nuclear Ribonucleoprotein F (HNRPF, Accession NM_004966). Accordingly, utilities of VGAM481 include diagnosis, prevention and treatment of diseases and clinical conditions associated with HNRPF. Inositol Hexaphosphate Kinase 3 (IHPK3, Accession NM_054111) is another VGAM481 host target gene. IHPK3 BINDING SITE is HOST TARGET binding site found in the 5' untranslated region of mRNA encoded by IHPK3, corresponding to a HOST TARGET binding site such as BINDING SITE I, BINDING SITE II or BINDING SITE III. Table 2 illustrates the complementarity of the nucleotide sequences of IHPK3 BINDING SITE, designated SEQ ID:27658, to the nucleotide sequence of VGAM481 RNA, herein designated VGAM RNA, also designated SEQ ID:3192.

Another function of VGAM481 is therefore inhibition of Inositol Hexaphosphate Kinase 3 (IHPK3, Accession NM_054111). Accordingly, utilities of VGAM481 include diagnosis, prevention and treatment of diseases and clinical conditions associated with IHPK3. Neuron Navigator 2 (NAV2, Accession XM_012028) is another VGAM481 host target gene. NAV2 BINDING SITE is HOST TARGET binding site found in the 3' untranslated region of mRNA encoded by NAV2, corresponding to a HOST TARGET binding site such as BINDING SITE I, BINDING SITE II or BINDING SITE III. Table 2 illustrates the complementarity of the nucleotide sequences of NAV2 BINDING SITE, designated SEQ ID:30205, to the nucleotide sequence of VGAM481 RNA, herein designated VGAM RNA, also designated SEQ ID:3192.

Another function of VGAM481 is therefore inhibition of Neuron Navigator 2 (NAV2, Accession XM_012028), a gene which plays an important role in neuronal development, including neurite outgrowth. Accordingly, utilities of VGAM481 include diagnosis, prevention and treatment of diseases and clinical conditions associated with NAV2. The function of NAV2 has been established by previous studies. The vitamin A metabolite, all-trans retinoic acid (atRA), plays an important role in neuronal development, including neurite outgrowth. RAINB1 is an atRA-responsive gene.

Full details of the abovementioned studies are described in the following publications, the disclosure of which are hereby incorporated by reference:

Merrill, R. A.; Plum, L. A.; Kaiser, M. E.; Clagett-Dame, M.: A mammalian homolog of unc-53 is regulated by all-trans retinoic acid in neuroblastoma cells and embryos. Proc. Nat. Acad. Sci. 99:3422-3427, 2002; and Nagase, T.; Kikuno, R.; Ishikawa, K.; Hirosawa, M.; Ohara, O.: Prediction of the coding sequences of unidentified human genes. XVI. The complete sequences of 150 new cDNA clones from.

Further studies establishing the function and utilities of NAV2 are found in John Hopkins OMIM database record ID 607026, and in sited publications numbered 538 and 6371 listed in the bibliography section hereinbelow, which are also hereby incorporated by reference. NKX3A (Accession NM_006167) is another VGAM481 host target gene. NKX3A BINDING SITE is HOST TARGET binding site found in the 3' untranslated region of mRNA encoded by NKX3A, corresponding to a HOST TARGET binding site such as BINDING SITE I, BINDING SITE II or BINDING SITE III. Table 2 illustrates the complementarity of the nucleotide sequences of NKX3A BINDING SITE, designated SEQ ID:12826, to the nucleotide sequence of VGAM481 RNA, herein designated VGAM RNA, also designated SEQ ID:3192.

Another function of VGAM481 is therefore inhibition of NKX3A (Accession NM_006167), a gene which may regulate gene expression and control cell differentiation. Accordingly, utilities of VGAM481 include diagnosis, prevention and treatment of diseases and clinical conditions associated with NKX3A. The function of NKX3A has been established by previous studies. Using a random cDNA sequencing approach, He et al. (1997) cloned a novel prostate-specific gene that encodes a homeo box-containing protein. The gene, which they symbolized NKX3.1, encodes a deduced 234-amino acid polypeptide with greatest homology to the Drosophila NK3 gene. Northern blot analysis showed that NKX3.1 had a uniquely restricted tissue expression pattern. The 3.5-kb NKX3.1 mRNA was abundant in the prostate, present at a lower level in the testis, and absent from all other tissues tested. He et al. (1997) detected NKX3.1 expression in a hormone-responsive, androgen receptor-positive prostate cancer cell line, but not in either of 2 androgen receptor-negative prostate cancer cell lines, or in 11 other cell lines of varied origin. Androgen stimulation markedly increased NKX3.1 expression in an androgen-dependent carcinoma line. The authors suggested that the NKX3.1 gene plays a role in androgen-driven differentiation of prostatic tissue and in the loss of that differentiation during the progression of prostate cancer. Animal model experiments lend further support to the function of NKX3A. Abdulkadir et al. (2002) found that conditional deletion of one or both alleles of Nkx3.1 in transgenic mice led to the development of preinvasive lesions resembling human prostatic intraepithelial neoplasia.

It is appreciated that the abovementioned animal model for NKX3A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Abdulkadir, S. A.; Magee, J. A.; Peters, T. J.; Kaleem, Z.; Naughton, C. K.; Humphrey, P. A.; Milbrandt, J.: Conditional loss of Nkx3.1 in adult mice induces prostatic intraepithelial neoplasia. Molec. Cell. Biol. 22:1495-1503, 2002; and He, W. W.; Sciavolino, P. J.; Wing, J.; Augustus, M.; Hudson, P.; Meissner, P. S.; Curtis, R. T.; Shell, B. K.; Bostwick, D. G.; Tindall, D. J.; Gelmann, E. P.; Abate-Shen, C.; Carter.

Further studies establishing the function and utilities of NKX3A are found in John Hopkins OMIM database record ID 602041, and in sited publications numbered 6656-665 and 6659 listed in the bibliography section hereinbelow, which are also hereby incorporated by reference. Chromobox Homolog 6 (CBX6, Accession NM_014292) is another VGAM481 host target gene. CBX6 BINDING SITE is HOST TARGET binding site found in the 3' untranslated region of mRNA encoded by CBX6, corresponding to a HOST TARGET binding site such as BINDING SITE I, BINDING SITE II or BINDING SITE III. Table 2 illustrates the complementarity of the nucleotide sequences of CBX6 BINDING SITE, designated SEQ ID:15576, to the nucleotide sequence of VGAM481 RNA, herein designated VGAM RNA, also designated SEQ ID:3192.

Another function of VGAM481 is therefore inhibition of Chromobox Homolog 6 (CBX6, Accession NM_014292). Accordingly, utilities of VGAM481 include diagnosis, prevention and treatment of diseases and clinical conditions associated with CBX6. Ecotropic Viral Integration Site 5 (EVI5, Accession NM_005665) is another VGAM481 host target gene. EVI5 BINDING SITE is HOST TARGET binding site found in the 3' untranslated region of mRNA encoded by EVI5, corresponding to a HOST TARGET binding site such as BINDING SITE I, BINDING SITE II or BINDING SITE III. Table 2 illustrates the complementarity of the nucleotide sequences of EVI5 BINDING SITE, designated SEQ ID:12207, to the nucleotide sequence of VGAM481 RNA, herein designated VGAM RNA, also designated SEQ ID:3192.

Another function of VGAM481 is therefore inhibition of Ecotropic Viral Integration Site 5 (EVI5, Accession NM_005665). Accordingly, utilities of VGAM481 include diagnosis, prevention and treatment of diseases and clinical conditions associated with EVI5. FLJ20967 (Accession NM_022071) is another VGAM481 host target gene. FLJ20967 BINDING SITE is HOST TARGET binding site found in the 3' untranslated region of mRNA encoded by FLJ20967, corresponding to a HOST TARGET binding site such as BINDING SITE I, BINDING SITE II or BINDING SITE III. Table 2 illustrates the complementarity of the nucleotide sequences of FLJ20967 BINDING SITE, designated SEQ ID:22615, to the nucleotide sequence of VGAM481 RNA, herein designated VGAM RNA, also designated SEQ ID:3192.

Another function of VGAM481 is therefore inhibition of FLJ20967 (Accession NM_022071). Accordingly, utilities of VGAM481 include diagnosis, prevention and treatment of diseases and clinical conditions associated with FLJ20967. FLJ31978 (Accession NM_144669) is another VGAM481 host target gene. FLJ31978 BINDING SITE is HOST TARGET binding site found in the 3' untranslated region of mRNA encoded by FLJ31978, corresponding to a HOST TARGET binding site such as BINDING SITE I, BINDING SITE II or BINDING SITE III. Table 2 illustrates the complementarity of the nucleotide sequences of FLJ31978 BINDING SITE, designated SEQ ID:29489, to the nucleotide sequence of VGAM481 RNA, herein designated VGAM RNA, also designated SEQ ID:3192.

Another function of VGAM481 is therefore inhibition of FLJ31978 (Accession NM_144669). Accordingly, utilities of VGAM481 include diagnosis, prevention and treatment of diseases and clinical conditions associated with FLJ31978. KIAA0960 (Accession XM_166543) is another VGAM481 host target gene. KIAA0960 BINDING SITE is HOST TARGET binding site found in the 3' untranslated region of mRNA encoded by KIAA0960, corresponding to a HOST TARGET binding site such as BINDING SITE I, BINDING SITE II or BINDING SITE III. Table 2 illustrates the complementarity of the nucleotide sequences of KIAA0960 BINDING SITE, designated SEQ ID:44518, to the nucleotide sequence of VGAM481 RNA, herein designated VGAM RNA, also designated SEQ ID:3192.

Another function of VGAM481 is therefore inhibition of KIAA0960 (Accession XM_166543). Accordingly, utilities of VGAM481 include diagnosis, prevention and treatment of diseases and clinical conditions associated with KIAA0960. MGC35521 (Accession NM_145065) is another VGAM481 host target gene. MGC35521 BINDING SITE is HOST TARGET binding site found in the 3' untranslated region of mRNA encoded by MGC35521, corresponding to a HOST TARGET binding site such as BINDING SITE I, BINDING SITE II or BINDING SITE III. Table 2 illustrates the complementarity of the nucleotide sequences of MGC35521 BINDING SITE, designated SEQ ID:29703, to the nucleotide sequence of VGAM481 RNA, herein designated VGAM RNA, also designated SEQ ID:3192.

Another function of VGAM481 is therefore inhibition of MGC35521 (Accession NM_145065). Accordingly, utilities of VGAM481 include diagnosis, prevention and treatment of diseases and clinical conditions associated with MGC35521. RASD Family, Member 2 (RASD2, Accession NM_014310) is another VGAM481 host target gene. RASD2 BINDING SITE is HOST TARGET binding site found in the 3' untranslated region of mRNA encoded by RASD2, corresponding to a HOST TARGET binding site such as BINDING SITE I, BINDING SITE II or BINDING SITE III. Table 2 illustrates the complementarity of the nucleotide sequences of RASD2 BINDING SITE, designated SEQ ID:15606, to the nucleotide sequence of VGAM481 RNA, herein designated VGAM RNA, also designated SEQ ID:3192.

Another function of VGAM481 is therefore inhibition of RASD Family, Member 2 (RASD2, Accession NM_014310). Accordingly, utilities of VGAM481 include diagnosis, prevention and treatment of diseases and clinical conditions associated with RASD2. LOC126432 (Accession XM_059046) is another VGAM481 host target gene. LOC126432 BINDING SITE is HOST TARGET binding site found in the 5' untranslated region of mRNA encoded by LOC126432, corresponding to a HOST TARGET binding site such as BINDING SITE I, BINDING SITE II or BINDING SITE III. Table 2 illustrates the complementarity of the nucleotide sequences of LOC126432 BINDING SITE, designated SEQ ID:36841, to the nucleotide sequence of VGAM481 RNA, herein designated VGAM RNA, also designated SEQ ID:3192.

Another function of VGAM481 is therefore inhibition of LOC126432 (Accession XM_059046). Accordingly, utilities of VGAM481 include diagnosis, prevention and treatment of diseases and clinical conditions associated with LOC126432. LOC144866 (Accession XM_096699) is another VGAM481 host target gene. LOC144866 BINDING SITE is HOST TARGET binding site found in the 5' untranslated region of mRNA encoded by LOC144866, corresponding to a HOST TARGET binding site such as BINDING SITE I, BINDING SITE II or BINDING SITE III. Table 2 illustrates the complementarity of the nucleotide sequences of LOC144866 BINDING SITE, designated SEQ ID:40475, to the nucleotide sequence of VGAM481 RNA, herein designated VGAM RNA, also designated SEQ ID:3192.

Another function of VGAM481 is therefore inhibition of LOC144866 (Accession XM_096699). Accordingly, utilities of VGAM481 include diagnosis, prevention and treatment of diseases and clinical conditions associated with LOC144866. LOC146316 (Accession XM_027568) is another VGAM481 host target gene. LOC146316 BINDING SITE is HOST TARGET binding site found in the 5' untranslated region of mRNA encoded by LOC146316, corresponding to a HOST TARGET binding site such as BINDING SITE I, BINDING SITE II or BINDING SITE III. Table 2 illustrates the complementarity of the nucleotide sequences of LOC146316 BINDING SITE, designated SEQ ID:30525, to the nucleotide sequence of VGAM481 RNA, herein designated VGAM RNA, also designated SEQ ID:3192.

Another function of VGAM481 is therefore inhibition of LOC146316 (Accession XM_027568). Accordingly, utilities of VGAM481 include diagnosis, prevention and treatment of diseases and clinical conditions associated with LOC146316. LOC150481 (Accession XM_086929) is another VGAM481 host target gene. LOC150481 BINDING SITE is HOST TARGET binding site found in the 3' untranslated region of mRNA encoded by LOC150481, corresponding to a HOST TARGET binding site such as BINDING SITE I, BINDING SITE II or BINDING SITE III. Table 2 illustrates the complementarity of the nucleotide sequences of LOC150481 BINDING SITE, designated SEQ ID:38981, to the nucleotide sequence of VGAM481 RNA, herein designated VGAM RNA, also designated SEQ ID:3192.

Another function of VGAM481 is therefore inhibition of LOC150481 (Accession XM_086929). Accordingly, utilities of VGAM481 include diagnosis, prevention and treatment of diseases and clinical conditions associated with LOC150481. LOC64744 (Accession XM_029830) is another VGAM481 host target gene. LOC64744 BINDING SITE is HOST TARGET binding site found in the 3' untranslated region of mRNA encoded by LOC64744, corresponding to a HOST TARGET binding site such as BINDING SITE I, BINDING SITE II or BINDING SITE III. Table 2 illustrates the complementarity of the nucleotide sequences of LOC64744 BINDING SITE, designated SEQ ID:30951, to the nucleotide sequence of VGAM481 RNA, herein designated VGAM RNA, also designated SEQ ID:3192.

Another function of VGAM481 is therefore inhibition of LOC64744 (Accession XM_029830). Accordingly, utilities of VGAM481 include diagnosis, prevention and treatment of diseases and clinical conditions associated with LOC64744. LOC91266 (Accession XM_037268) is another VGAM481 host target gene. LOC91266 BINDING SITE is HOST TARGET binding site found in the 5' untranslated region of mRNA encoded by LOC91266, corresponding to a HOST TARGET binding site such as BINDING SITE I, BINDING SITE II or BINDING SITE III. Table 2 illustrates the complementarity of the nucleotide sequences of LOC91266 BINDING SITE, designated SEQ ID:32602, to the nucleotide sequence of VGAM481 RNA, herein designated VGAM RNA, also designated SEQ ID:3192.

Another function of VGAM481 is therefore inhibition of LOC91266 (Accession XM_037268). Accordingly, utilities of VGAM481 include diagnosis, prevention and treatment of diseases and clinical conditions associated with LOC91266. FIG. 1 further provides a conceptual description of a novel bioinformatically detected viral gene of the present invention, referred to here as Viral Genomic Address Messenger 482 (VGAM482) viral gene, which modulates expression of respective host target genes thereof, the function and utility of which host target genes is known in the art.

VGAM482 is a novel bioinformatically detected regulatory, non protein coding, viral micro RNA (miRNA) gene. The method by which VGAM482 was detected is described hereinabove with reference to FIGS. 1-8.

VGAM482 gene, herein designated VGAM GENE, is a viral gene contained in the genome of Hepatitis G Virus. VGAM482 host target gene, herein designated VGAM HOST TARGET GENE, is a human gene contained in the human genome.

VGAM482 gene encodes a VGAM482 precursor RNA, herein designated VGAM PRECURSOR RNA. Similar to other miRNA genes, and unlike most ordinary genes, VGAM482 precursor RNA does not encode a protein. A nucleotide sequence identical or highly similar to the nucleotide sequence of VGAM482 precursor RNA is designated SEQ ID:468, and is provided hereinbelow with reference to the sequence listing part. Nucleotide sequence SEQ ID:468 is located at position 2953 relative to the genome of Hepatitis G Virus.

VGAM482 precursor RNA folds onto itself, forming VGAM482 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM482 folded precursor RNA into VGAM482 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM482 RNA is designated SEQ ID:3193, and is provided hereinbelow with reference to the sequence listing part.

VGAM482 host target gene, herein designated VGAM HOST TARGET GENE, encodes a corresponding messenger RNA, VGAM482 host target RNA, herein designated VGAM HOST TARGET RNA. VGAM482 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM482 RNA, herein designated VGAM RNA, binds complementarily to one or more host target binding sites located in untranslated regions of VGAM482 host target RNA, herein designated VGAM HOST TARGET RNA. This complementary binding is due to the fact that the nucleotide sequence of VGAM482 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM482 RNA, herein designated VGAM RNA, may have a different number of host target binding sites in untranslated regions of a VGAM482 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM482 RNA, herein designated VGAM RNA, to host target binding sites on VGAM482 host target RNA, herein designated VGAM HOST TARGET RNA, such as BINDING SITE I, BINDING SITE II and BINDING SITE III, inhibits translation of VGAM482 host target RNA into VGAM482 host target protein, herein designated VGAM HOST TARGET PROTEIN. VGAM host target protein is therefore outlined by a broken line.

It is appreciated that VGAM482 host target gene, herein designated VGAM HOST TARGET GENE, in fact represents a plurality of VGAM482 host target genes. The mRNA of each one of this plurality of VGAM482 host target genes comprises one or more host target binding sites, each having a nucleotide sequence which is at least partly complementary to VGAM482 RNA, herein designated VGAM RNA, and which when bound by VGAM482 RNA causes inhibition of translation of respective one or more VGAM482 host target proteins.

It is further appreciated by one skilled in the art that the mode of translational inhibition illustrated by FIG. 1 with specific reference to translational inhibition exerted by VGAM482 gene, herein designated VGAM GENE, on one or more VGAM482 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM482 is inhibition of expression of host target genes, as part of a novel viral mechanism of attacking a host. Accordingly, utilities of VGAM482 include diagnosis, prevention and treatment of viral infection by Hepatitis G Virus. Specific functions, and accordingly utilities, of VGAM482 correlate with, and may be deduced from, the identity of the host target genes which VGAM482 binds and inhibits, and the function of these host target genes, as elaborated hereinbelow.

Nucleotide sequences of the VGAM482 precursor RNA, herein designated VGAM PRECURSOR RNA, and of the 'diced' VGAM482 RNA, herein designated VGAM RNA, and a schematic representation of the secondary folding of VGAM482 folded precursor RNA, herein designated VGAM FOLDED PRECURSOR RNA, of VGAM482 are further described hereinbelow with reference to Table 1.

Nucleotide sequences of host target binding sites, such as BINDING SITE-I, BINDING SITE-II and BINDING SITE-III of FIG. 1, found on VGAM482 host target RNA, and schematic representation of the complementarity of each of these host target binding sites to VGAM482 RNA, herein designated VGAM RNA, are described hereinbelow with reference to Table 2.

As mentioned hereinabove with reference to FIG. 1, a function of VGAM482 gene, herein designated VGAM is inhibition of expression of VGAM482 target genes. It is appreciated that specific functions, and accordingly utilities, of VGAM482 correlate with, and may be deduced from, the identity of the target genes which VGAM482 binds and inhibits, and the function of these target genes, as elaborated hereinbelow.

Chromosome 1 Open Reading Frame 1 (C1orf1, Accession NM_001213) is a VGAM482 host target gene. C1orf1 BINDING SITE is HOST TARGET binding site found in the 3' untranslated region of mRNA encoded by C1orf1, corresponding to a HOST TARGET binding site such as BINDING SITE I, BINDING SITE II or BINDING SITE III. Table 2 illustrates the complementarity of the nucleotide sequences of C1orf1 BINDING SITE, designated SEQ ID:6874, to the nucleotide sequence of VGAM482 RNA, herein designated VGAM RNA, also designated SEQ ID:3193.

A function of VGAM482 is therefore inhibition of Chromosome 1 Open Reading Frame 1 (C1orf1, Accession NM_001213). Accordingly, utilities of VGAM482 include diagnosis, prevention and treatment of diseases and clinical conditions associated with C1orf1. CSE1 Chromosome Segregation 1-like (yeast) (CSE1L, Accession XM_030044) is another VGAM482 host target gene. CSE1L BINDING SITE is HOST TARGET binding site found in the 5' untranslated region of mRNA encoded by CSE1L, corresponding to a HOST TARGET binding site such as BINDING SITE I, BINDING SITE II or BINDING SITE III. Table 2 illustrates the complementarity of the nucleotide sequences of CSE1L BINDING SITE, designated SEQ ID:30990, to the nucleotide sequence of VGAM482 RNA, herein designated VGAM RNA, also designated SEQ ID:3193.

Another function of VGAM482 is therefore inhibition of CSE1 Chromosome Segregation 1-like (yeast) (CSE1L, Accession XM_030044). Accordingly, utilities of VGAM482 include diagnosis, prevention and treatment of diseases and clinical conditions associated with CSE1L. Gap Junction Protein, Beta 3, 31 kDa (connexin 31) (GJB3, Accession NM_024009) is another VGAM482 host target gene. GJB3 BINDING SITE is HOST TARGET binding site found in the 3' untranslated region of mRNA encoded by GJB3, corresponding to a HOST TARGET binding site such as BINDING SITE I, BINDING SITE II or BINDING SITE III. Table 2 illustrates the complementarity of the nucleotide sequences of GJB3 BINDING SITE, designated SEQ ID:23441, to the nucleotide sequence of VGAM482 RNA, herein designated VGAM RNA, also designated SEQ ID:3193.

Another function of VGAM482 is therefore inhibition of Gap Junction Protein, Beta 3, 31 kDa (connexin 31) (GJB3, Accession NM_024009). Accordingly, utilities of VGAM482 include diagnosis, prevention and treatment of diseases and clinical conditions associated with GJB3. Protein Kinase, Lysine Deficient 3 (PRKWNK3, Accession XM_029183) is another VGAM482 host target gene. PRKWNK3 BINDING SITE is HOST TARGET binding site found in the 3' untranslated region of mRNA encoded by PRKWNK3, corresponding to a HOST TARGET binding site such as BINDING SITE I, BINDING SITE II or BINDING SITE III. Table 2 illustrates the complementarity of the nucleotide sequences of PRKWNK3 BINDING SITE, designated SEQ ID:30855, to the nucleotide sequence of VGAM482 RNA, herein designated VGAM RNA, also designated SEQ ID:3193.

Another function of VGAM482 is therefore inhibition of Protein Kinase, Lysine Deficient 3 (PRKWNK3, Accession XM_029183). Accordingly, utilities of VGAM482 include diagnosis, prevention and treatment of diseases and clinical conditions associated with PRKWNK3. RNA (guanine-7-) Methyltransferase (RNMT, Accession NM_003799) is another VGAM482 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9878, to the nucleotide sequence of VGAM482 RNA, herein designated VGAM RNA, also designated SEQ ID:3193.

Another function of VGAM482 is therefore inhibition of RNA (guanine-7-) Methyltransferase (RNMT, Accession NM_003799), a gene which catalyzes the methylation of GpppN- at the guanine N7 position. Accordingly, utilities of VGAM482 include diagnosis, prevention and treatment of diseases and clinical conditions associated with RNMT. The function of RNMT and its association with various diseases and clinical conditions, has been established by previous studies, as described hereinabove with reference to VGAM178. Chromosome 20 Open Reading Frame 126 (C20orf126, Accession NM_030815) is another VGAM482 host target gene. C20orf126 BINDING SITE is HOST TARGET binding site found in the 3' untranslated region of mRNA encoded by C20orf126, corresponding to a HOST TARGET binding site such as BINDING SITE I, BINDING SITE II or BINDING SITE III. Table 2 illustrates the complementarity of the nucleotide sequences of C20orf126 BINDING SITE, designated SEQ ID:25134, to the nucleotide sequence of VGAM482 RNA, herein designated VGAM RNA, also designated SEQ ID:3193.

Another function of VGAM482 is therefore inhibition of Chromosome 20 Open Reading Frame 126 (C20orf126, Accession NM_030815). Accordingly, utilities of VGAM482 include diagnosis, prevention and treatment of diseases and clinical conditions associated with C20orf126. FLJ12987 (Accession NM_025170) is another VGAM482 host target gene. FLJ12987 BINDING SITE is HOST TARGET binding site found in the 3' untranslated region of mRNA encoded by FLJ12987, corresponding to a HOST TARGET binding site such as BINDING SITE I, BINDING SITE II or BINDING SITE III. Table 2 illustrates the complementarity of the nucleotide sequences of FLJ12987 BINDING SITE, designated SEQ ID:24807, to the nucleotide sequence of VGAM482 RNA, herein designated VGAM RNA, also designated SEQ ID:3193.

Another function of VGAM482 is therefore inhibition of FLJ12987 (Accession NM_025170). Accordingly, utilities of VGAM482 include diagnosis, prevention and treatment of diseases and clinical conditions associated with FLJ12987. PR Domain Containing 8 (PRDM8, Accession NM_020226) is another VGAM482 host target gene. PRDM8 BINDING SITE is HOST TARGET binding site found in the 5' untranslated region of mRNA encoded by PRDM8, corresponding to a HOST TARGET binding site such as BINDING SITE I, BINDING SITE II or BINDING SITE III. Table 2 illustrates the complementarity of the nucleotide sequences of PRDM8 BINDING SITE, designated SEQ ID:21490, to the nucleotide sequence of VGAM482 RNA, herein designated VGAM RNA, also designated SEQ ID:3193.

Another function of VGAM482 is therefore inhibition of PR Domain Containing 8 (PRDM8, Accession NM_020226). Accordingly, utilities of VGAM482 include diagnosis, prevention and treatment of diseases and clinical conditions associated with PRDM8. Sema Domain, Seven Thrombospondin Repeats (type 1 and type 1-like), Transmembrane Domain (TM) and Short Cytoplasmic Domain, (semaphorin) 5A (SEMA5A, Accession NM_003966) is another VGAM482 host target gene. SEMA5A BINDING SITE is HOST TARGET binding site found in the 5' untranslated region of mRNA encoded by SEMA5A, corresponding to a HOST TARGET binding site such as BINDING SITE I, BINDING SITE II or BINDING SITE III. Table 2 illustrates the complementarity of the nucleotide sequences of SEMA5A BINDING SITE, designated SEQ ID:10103, to the nucleotide sequence of VGAM482 RNA, herein designated VGAM RNA, also designated SEQ ID:3193.

Another function of VGAM482 is therefore inhibition of Sema Domain, Seven Thrombospondin Repeats (type 1 and type 1-like), Transmembrane Domain (TM) and Short Cytoplasmic Domain, (semaphorin) 5A (SEMA5A, Accession NM_003966). Accordingly, utilities of VGAM482 include diagnosis, prevention and treatment of diseases and clinical conditions associated with SEMA5A. TU12B1-TY (Accession NM_016575) is another VGAM482 host target gene. TU12B1-TY BINDING SITE is HOST TARGET binding site found in the 3' untranslated region of mRNA encoded by TU12B1-TY, corresponding to a HOST TARGET binding site such as BINDING SITE I, BINDING SITE II or BINDING SITE III. Table 2 illustrates the complementarity of the nucleotide sequences of TU12B1-TY BINDING SITE, designated SEQ ID:18644, to the nucleotide sequence of VGAM482 RNA, herein designated VGAM RNA, also designated SEQ ID:3193.

Another function of VGAM482 is therefore inhibition of TU12B1-TY (Accession NM_016575). Accordingly, utilities of VGAM482 include diagnosis, prevention and treatment of diseases and clinical conditions associated with TU12B1-TY. LOC167040 (Accession XM_106497) is another VGAM482 host target gene. LOC167040 BINDING SITE is HOST TARGET binding site found in the 5' untranslated region of mRNA encoded by LOC167040, corresponding to a HOST TARGET binding site such as BINDING SITE I, BINDING SITE II or BINDING SITE III. Table 2 illustrates the complementarity of the nucleotide sequences of LOC167040 BINDING SITE, designated SEQ ID:42202, to the nucleotide sequence of VGAM482 RNA, herein designated VGAM RNA, also designated SEQ ID:3193.

Another function of VGAM482 is therefore inhibition of LOC167040 (Accession XM_106497). Accordingly, utilities of VGAM482 include diagnosis, prevention and treatment of diseases and clinical conditions associated with LOC167040. LOC91050 (Accession XM_035703) is another VGAM482 host target gene. LOC91050 BINDING SITE is HOST TARGET binding site found in the 3' untranslated region of mRNA encoded by LOC91050, corresponding to a HOST TARGET binding site such as BINDING SITE I, BINDING SITE II or BINDING SITE III. Table 2 illustrates the complementarity of the nucleotide sequences of LOC91050 BINDING SITE, designated SEQ ID:32340, to the nucleotide sequence of VGAM482 RNA, herein designated VGAM RNA, also designated SEQ ID:3193.

Another function of VGAM482 is therefore inhibition of LOC91050 (Accession XM_035703). Accordingly, utilities of VGAM482 include diagnosis, prevention and treatment of diseases and clinical conditions associated with LOC91050. FIG. 1 further provides a conceptual description of a novel bioinformatically detected viral gene of the present invention, referred to here as Viral Genomic Address Messenger 483 (VGAM483) viral gene, which modulates expression of respective host target genes thereof, the function and utility of which host target genes is known in the art.

VGAM483 is a novel bioinformatically detected regulatory, non protein coding, viral micro RNA (miRNA) gene. The method by which VGAM483 was detected is described hereinabove with reference to FIGS. 1-8.

VGAM483 gene, herein designated VGAM GENE, is a viral gene contained in the genome of Hepatitis G Virus. VGAM483 host target gene, herein designated VGAM HOST TARGET GENE, is a human gene contained in the human genome.

VGAM483 gene encodes a VGAM483 precursor RNA, herein designated VGAM PRECURSOR RNA. Similar to other miRNA genes, and unlike most ordinary genes, VGAM483 precursor RNA does not encode a protein. A nucleotide sequence identical or highly similar to the nucleotide sequence of VGAM483 precursor RNA is designated SEQ ID:469, and is provided hereinbelow with reference to the sequence listing part. Nucleotide sequence SEQ ID:469 is located at position 4804 relative to the genome of Hepatitis G Virus.

VGAM483 precursor RNA folds onto itself, forming VGAM483 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM483 folded precursor RNA into VGAM483 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM483 RNA is designated SEQ ID:3194, and is provided hereinbelow with reference to the sequence listing part.

VGAM483 host target gene, herein designated VGAM HOST TARGET GENE, encodes a corresponding messenger RNA, VGAM483 host target RNA, herein designated VGAM HOST TARGET RNA. VGAM483 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM483 RNA, herein designated VGAM RNA, binds complementarily to one or more host target binding sites located in untranslated regions of VGAM483 host target RNA, herein designated VGAM HOST TARGET RNA. This complementary binding is due to the fact that the nucleotide sequence of VGAM483 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM483 RNA, herein designated VGAM RNA, may have a different number of host target binding sites in untranslated regions of a VGAM483 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM483 RNA, herein designated VGAM RNA, to host target binding sites on VGAM483 host target RNA, herein designated VGAM HOST TARGET RNA, such as BINDING SITE I, BINDING SITE II and BINDING SITE III, inhibits translation of VGAM483 host target RNA into VGAM483 host target protein, herein designated VGAM HOST TARGET PROTEIN. VGAM host target protein is therefore outlined by a broken line.

It is appreciated that VGAM483 host target gene, herein designated VGAM HOST TARGET GENE, in fact represents a plurality of VGAM483 host target genes. The mRNA of each one of this plurality of VGAM483 host target genes comprises one or more host target binding sites, each having a nucleotide sequence which is at least partly complementary to VGAM483 RNA, herein designated VGAM RNA, and which when bound by VGAM483 RNA causes inhibition of translation of respective one or more VGAM483 host target proteins.

It is further appreciated by one skilled in the art that the mode of translational inhibition illustrated by FIG. 1 with specific reference to translational inhibition exerted by VGAM483 gene, herein designated VGAM GENE, on one or more VGAM483 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM483 is inhibition of expression of host target genes, as part of a novel viral mechanism of attacking a host. Accordingly, utilities of VGAM483 include diagnosis, prevention and treatment of viral infection by Hepatitis G Virus. Specific functions, and accordingly utilities, of VGAM483 correlate with, and may be deduced from, the identity of the host target genes which VGAM483 binds and inhibits, and the function of these host target genes, as elaborated hereinbelow.

Nucleotide sequences of the VGAM483 precursor RNA, herein designated VGAM PRECURSOR RNA, and of the 'diced' VGAM483 RNA, herein designated VGAM RNA, and a schematic representation of the secondary folding of VGAM483 folded precursor RNA, herein designated VGAM FOLDED PRECURSOR RNA, of VGAM483 are further described hereinbelow with reference to Table 1.

Nucleotide sequences of host target binding sites, such as BINDING SITE-I, BINDING SITE-II and BINDING SITE-III of FIG. 1, found on VGAM483 host target RNA, and schematic representation of the complementarity of each of these host target binding sites to VGAM483 RNA, herein designated VGAM RNA, are described hereinbelow with reference to Table 2.

As mentioned hereinabove with reference to FIG. 1, a function of VGAM483 gene, herein designated VGAM is inhibition of expression of VGAM483 target genes. It is appreciated that specific functions, and accordingly utilities, of VGAM483 correlate with, and may be deduced from, the identity of the target genes which VGAM483 binds and inhibits, and the function of these target genes, as elaborated hereinbelow.

N-ethylmaleimide-sensitive Factor Attachment Protein, Gamma (NAPG, Accession XM_172983) is a VGAM483 host target gene. NAPG BINDING SITE is HOST TARGET binding site found in the 5' untranslated region of mRNA encoded by NAPG, corresponding to a HOST TARGET binding site such as BINDING SITE I, BINDING SITE II or BINDING SITE III. Table 2 illustrates the complementarity of the nucleotide sequences of NAPG BINDING SITE, designated SEQ ID:46249, to the nucleotide sequence of VGAM483 RNA, herein designated VGAM RNA, also designated SEQ ID:3194.

A function of VGAM483 is therefore inhibition of N-ethylmaleimide-sensitive Factor Attachment Protein, Gamma (NAPG, Accession XM_172983). Accordingly, utilities of VGAM483 include diagnosis, prevention and treatment of diseases and clinical conditions associated with NAPG. LOC196955 (Accession XM_085210) is another VGAM483 host target gene. LOC196955 BINDING SITE is HOST TARGET binding site found in the 5' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37925, to the nucleotide sequence of VGAM483 RNA, herein designated VGAM RNA, also designated SEQ ID:3194.

Another function of VGAM483 is therefore inhibition of LOC196955 (Accession XM_085210). Accordingly, utilities of VGAM483 include diagnosis, prevention and treatment of diseases and clinical conditions associated with LOC196955. FIG. 1 further provides a conceptual description of a novel bioinformatically detected viral gene of the present invention, referred to here as Viral Genomic Address Messenger 484 (VGAM484) viral gene, which modulates expression of respective host target genes thereof, the function and utility of which host target genes is known in the art.

VGAM484 is a novel bioinformatically detected regulatory, non protein coding, viral micro RNA (miRNA) gene. The method by which VGAM484 was detected is described hereinabove with reference to FIGS. 1-8.

VGAM484 gene, herein designated VGAM GENE, is a viral gene contained in the genome of Hepatitis G Virus. VGAM484 host target gene, herein designated VGAM HOST TARGET GENE, is a human gene contained in the human genome.

VGAM484 gene encodes a VGAM484 precursor RNA, herein designated VGAM PRECURSOR RNA. Similar to other miRNA genes, and unlike most ordinary genes, VGAM484 precursor RNA does not encode a protein. A nucleotide sequence identical or highly similar to the nucleotide sequence of VGAM484 precursor RNA is designated SEQ ID:470, and is provided hereinbelow with reference to the sequence listing part. Nucleotide sequence SEQ ID:470 is located at position 6210 relative to the genome of Hepatitis G Virus.

VGAM484 precursor RNA folds onto itself, forming VGAM484 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM484 folded precursor RNA into VGAM484 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM484 RNA is designated SEQ ID:3195, and is provided hereinbelow with reference to the sequence listing part.

VGAM484 host target gene, herein designated VGAM HOST TARGET GENE, encodes a corresponding messenger RNA, VGAM484 host target RNA, herein designated VGAM HOST TARGET RNA. VGAM484 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM484 RNA, herein designated VGAM RNA, binds complementarily to one or more host target binding sites located in untranslated regions of VGAM484 host target RNA, herein designated VGAM HOST TARGET RNA. This complementary binding is due to the fact that the nucleotide sequence of VGAM484 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM484 RNA, herein designated VGAM RNA, may have a different number of host target binding sites in untranslated regions of a VGAM484 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM484 RNA, herein designated VGAM RNA, to host target binding sites on VGAM484 host target RNA, herein designated VGAM HOST TARGET RNA, such as BINDING SITE I, BINDING SITE II and BINDING SITE III, inhibits translation of VGAM484 host target RNA into VGAM484 host target protein, herein designated VGAM HOST TARGET PROTEIN. VGAM host target protein is therefore outlined by a broken line.

It is appreciated that VGAM484 host target gene, herein designated VGAM HOST TARGET GENE, in fact represents a plurality of VGAM484 host target genes. The mRNA of each one of this plurality of VGAM484 host target genes comprises one or more host target binding sites, each having a nucleotide sequence which is at least partly complementary to VGAM484 RNA, herein designated VGAM RNA, and which when bound by VGAM484 RNA causes inhibition of translation of respective one or more VGAM484 host target proteins.

It is further appreciated by one skilled in the art that the mode of translational inhibition illustrated by FIG. 1 with specific reference to translational inhibition exerted by VGAM484 gene, herein designated VGAM GENE, on one or more VGAM484 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM484 is inhibition of expression of host target genes, as part of a novel viral mechanism of attacking a host. Accordingly, utilities of VGAM484 include diagnosis, prevention and treatment of viral infection by Hepatitis G Virus. Specific functions, and accordingly utilities, of VGAM484 correlate with, and may be deduced from, the identity of the host target genes which VGAM484 binds and inhibits, and the function of these host target genes, as elaborated hereinbelow.

Nucleotide sequences of the VGAM484 precursor RNA, herein designated VGAM PRECURSOR RNA, and of the 'diced' VGAM484 RNA, herein designated VGAM RNA, and a schematic representation of the secondary folding of VGAM484 folded precursor RNA, herein designated VGAM FOLDED PRECURSOR RNA, of VGAM484 are further described hereinbelow with reference to Table 1.

Nucleotide sequences of host target binding sites, such as BINDING SITE-I, BINDING SITE-II and BINDING SITE-III of FIG. 1, found on VGAM484 host target RNA, and schematic representation of the complementarity of each of these host target binding sites to VGAM484 RNA, herein designated VGAM RNA, are described hereinbelow with reference to Table 2.

As mentioned hereinabove with reference to FIG. 1, a function of VGAM484 gene, herein designated VGAM is inhibition of expression of VGAM484 target genes. It is appreciated that specific functions, and accordingly utilities, of VGAM484 correlate with, and may be deduced from, the identity of the target genes which VGAM484 binds and inhibits, and the function of these target genes, as elaborated hereinbelow.

Complement Component 5 Receptor 1 (C5a ligand) (C5R1, Accession NM_001736) is a VGAM484 host target gene. C5R1 BINDING SITE is HOST TARGET binding site found in the 3' untranslated region of mRNA encoded by C5R1, corresponding to a HOST TARGET binding site such as BINDING SITE I, BINDING SITE II or BINDING SITE III. Table 2 illustrates the complementarity of the nucleotide sequences of C5R1 BINDING SITE, designated SEQ ID:7473, to the nucleotide sequence of VGAM484 RNA, herein designated VGAM RNA, also designated SEQ ID:3195.

A function of VGAM484 is therefore inhibition of Complement Component 5 Receptor 1 (C5a ligand) (C5R1, Accession NM_001736), a gene which has a nonredundant function and is required for mucosal host cell defense in the lung. Accordingly, utilities of VGAM484 include diagnosis, prevention and treatment of diseases and clinical conditions associated with C5R1. The function of C5R1 has been established by previous studies. Using a panel of somatic cell hybrids, Bao et al. (1992) mapped the receptor for the chemotactic ligand C5a to chromosome 19. This receptor, like those for the formyl peptides (136537, 136538) and interleukin-8 (OMIM Ref. No. 146929), is structurally related to rhodopsin (RHO; 180380) and transduces signals via intracellular GTP-binding proteins. Additionally, this receptor is similar to chemokine receptor-like 1 (OMIM Ref. No. 601531). Hopken et al. (1996) deleted the murine C5a receptor (C5ar) through homologous recombination. They reported that the C5ar-deficient mice showed no developmental or biologic defects in cells in which C5a is expressed (e.g., myeloid cell lineages, hepatocytes, and epithelial cells) apart from the ability to bind and signal to exogenous C5a. Hopken et al. (1996) reported that C5ar-deficient mice bred normally and displayed no gross defects when maintained under barrier conditions. When mice were challenged with intratracheal Pseudomonas aeruginosa, the C5ar-deficient mice, in contrast to their littermates, were unable to clear the bacteria and they succumbed to pneumonia. On the basis of these studies, Hopken et al. (1996) concluded that C5ar has a nonredundant function and is required for mucosal host cell defense in the lung.

Full details of the abovementioned studies are described in the following publications, the disclosure of which are hereby incorporated by reference:

Hopken, U. E.; Lu, D.; Gerard, N. P.; Gerard, C.: The C5a chemoattractant receptor mediates mucosal defense to infection. Nature 383:86-89, 1996; and Bao, L.; Gerard, N. P.; Eddy, R. L., Jr.; Shows, T. B.; Gerard, C.: Mapping of genes for the human C5a receptor (C5AR), human FMLP receptor (FPR), and two FMLP receptor homologue orphan.

Further studies establishing the function and utilities of C5R1 are found in John Hopkins OMIM database record ID 113995, and in sited publications numbered 2131, 3731-3732, 4555-373 and 4225 listed in the bibliography section hereinbelow, which are also hereby incorporated by reference. Cytoplasmic Linker 2 (CYLN2, Accession NM_003388) is another VGAM484 host target gene. CYLN2 BINDING SITE is HOST TARGET binding site found in the 3' untranslated region of mRNA encoded by CYLN2, corresponding to a HOST TARGET binding site such as BINDING SITE I, BINDING SITE II or BINDING SITE III. Table 2 illustrates the complementarity of the nucleotide sequences of CYLN2 BINDING SITE, designated SEQ ID:9423, to the nucleotide sequence of VGAM484 RNA, herein designated VGAM RNA, also designated SEQ ID:3195.

Another function of VGAM484 is therefore inhibition of Cytoplasmic Linker 2 (CYLN2, Accession NM_003388), a gene which associates with microtubules and dendritic lamellar bodies. Accordingly, utilities of VGAM484 include diagnosis, prevention and treatment of diseases and clinical conditions associated with CYLN2. The function of CYLN2 and its association with various diseases and clinical conditions, has been established by previous studies, as described hereinabove with reference to VGAM94. DXS1283E (Accession XM_047871) is another VGAM484 host target gene. DXS1283E BINDING SITE is HOST TARGET binding site found in the 3' untranslated region of mRNA encoded by DXS1283E, corresponding to a HOST TARGET binding site such as BINDING SITE I, BINDING SITE II or BINDING SITE III. Table 2 illustrates the complementarity of the nucleotide sequences of DXS1283E BINDING SITE, designated SEQ ID:35065, to the nucleotide sequence of VGAM484 RNA, herein designated VGAM RNA, also designated SEQ ID:3195.

Another function of VGAM484 is therefore inhibition of DXS1283E (Accession XM_047871). Accordingly, utilities of VGAM484 include diagnosis, prevention and treatment of diseases and clinical conditions associated with DXS1283E. Ribonuclease/angiogenin Inhibitor (RNH, Accession NM_002939) is another VGAM484 host target gene. RNH BINDING SITE1 and RNH BINDING SITE2 are HOST TARGET binding sites found in untranslated regions of mRNA encoded by RNH, corresponding to HOST TARGET binding sites such as BINDING SITE I, BINDING SITE II or BINDING SITE III. Table 2 illustrates the complementarity of the nucleotide sequences of RNH BINDING SITE1 and RNH BINDING SITE2, designated SEQ ID:8845 and SEQ ID:29994 respectively, to the nucleotide sequence of VGAM484 RNA, herein designated VGAM RNA, also designated SEQ ID:3195.

Another function of VGAM484 is therefore inhibition of Ribonuclease/angiogenin Inhibitor (RNH, Accession NM_002939), a gene which is an inhibitor of pancreatic rnase and angiogenin. may also function in the modulation of cellular activities. Accordingly, utilities of VGAM484 include diagnosis, prevention and treatment of diseases and clinical conditions associated with RNH. The function of RNH has been established by previous studies. Placental ribonuclease inhibitor is a member of a family of proteinaceous cytoplasmic RNase inhibitors that occur in many tissues and bind to both intracellular and extracellular RNases. In addition to control of intracellular RNases, the inhibitor may have a role in the regulation of angiogenin (OMIM Ref. No. 105850). Ribonuclease inhibitor, of 50,000 Da, binds to ribonucleases and holds them in a latent form. Since neutral and alkaline ribonucleases probably play a critical role in the turnover of RNA in eukaryotic cells, RNH may be essential for control of mRNA turnover; the interaction of eukaryotic cells with ribonuclease may be reversible in vivo. Lee et al. (1988) determined the primary structure of PRI from the cDNA. The mature protein encodes a 460-amino acid polypeptide with a molecular mass of 49,847 kD. The amino acid sequence contains 7 direct internal repeat units, each 57 amino acids in length. These repeat units comprise 87% of the molecule. The average degree of identity between any 2 is 39%. By study of human-rodent somatic cell hybrids and by in situ hybridization, Weremowicz et al. (1990) mapped the PRI gene to 11p15. The localization was further refined to 11p15.5, distal to the IGF2 gene, by in situ hybridization to metaphase chromosomes from a cell line with a well-characterized translocation involving a breakpoint between IGF2 (OMIM Ref. No. 147470) and HRAS (OMIM Ref. No. 190020). Zneimer et al. (1990) localized the RNH gene to 11p15.5 by in situ hybridization Full details of the abovementioned studies are described in the following publications, the disclosure of which are hereby incorporated by reference:

Weremowicz, S.; Fox, E. A.; Morton, C. C.; Vallee, B. L.: The placental ribonuclease inhibitor (RNH) gene is located on chromosome subband 11p15.5. Genomics 8:717-721, 1990; and Zneimer, S. M.; Crawford, D.; Schneider, N. R.; Beutler, B.: Mapping of the human ribonuclease inhibitor gene (RNH) to chromosome 11p15 by in situ hybridization. Genomics 8:175-178, 19.

Further studies establishing the function and utilities of RNH are found in John Hopkins OMIM database record ID 173320, and in sited publications numbered 9830-9832 listed in the bibliography section hereinbelow, which are also hereby incorporated by reference. EDR2 (Accession XM_018136) is another VGAM484 host target gene. EDR2 BINDING SITE is HOST TARGET binding site found in the 3' untranslated region of mRNA encoded by EDR2, corresponding to a HOST TARGET binding site such as BINDING SITE I, BINDING SITE II or BINDING SITE III. Table 2 illustrates the complementarity of the nucleotide sequences of EDR2 BINDING SITE, designated SEQ ID:30337, to the nucleotide sequence of VGAM484 RNA, herein designated VGAM RNA, also designated SEQ ID:3195.

Another function of VGAM484 is therefore inhibition of EDR2 (Accession XM_018136). Accordingly, utilities of VGAM484 include diagnosis, prevention and treatment of diseases and clinical conditions associated with EDR2. FLJ14800 (Accession NM_032840) is another VGAM484 host target gene. FLJ14800 BINDING SITE is HOST TARGET binding site found in the 3' untranslated region of mRNA encoded by FLJ14800, corresponding to a HOST TARGET binding site such as BINDING SITE I, BINDING SITE II or BINDING SITE III. Table 2 illustrates the complementarity of the nucleotide sequences of FLJ14800 BINDING SITE, designated SEQ ID:26621, to the nucleotide sequence of VGAM484 RNA, herein designated VGAM RNA, also designated SEQ ID:3195.

Another function of VGAM484 is therefore inhibition of FLJ14800 (Accession NM_032840). Accordingly, utilities of VGAM484 include diagnosis, prevention and treatment of diseases and clinical conditions associated with FLJ14800. FLJ23342 (Accession NM_024631) is another VGAM484 host target gene. FLJ23342 BINDING SITE is HOST TARGET binding site found in the 3' untranslated region of mRNA encoded by FLJ23342, corresponding to a HOST TARGET binding site such as BINDING SITE I, BINDING SITE II or BINDING SITE III. Table 2 illustrates the complementarity of the nucleotide sequences of FLJ23342 BINDING SITE, designated SEQ ID:23897, to the nucleotide sequence of VGAM484 RNA, herein designated VGAM RNA, also designated SEQ ID:3195.

Another function of VGAM484 is therefore inhibition of FLJ23342 (Accession NM_024631). Accordingly, utilities of VGAM484 include diagnosis, prevention and treatment of diseases and clinical conditions associated with FLJ23342. FLJ23519 (Accession NM_032240) is another VGAM484 host target gene. FLJ23519 BINDING SITE1 and FLJ23519 BINDING SITE2 are HOST TARGET binding sites found in untranslated regions of mRNA encoded by FLJ23519, corresponding to HOST TARGET binding sites such as BINDING SITE I, BINDING SITE II or BINDING SITE III. Table 2 illustrates the complementarity of the nucleotide sequences of FLJ23519 BINDING SITE1 and FLJ23519 BINDING SITE2, designated SEQ ID:25975 and SEQ ID:34308 respectively, to the nucleotide sequence of VGAM484 RNA, herein designated VGAM RNA, also designated SEQ ID:3195.

Another function of VGAM484 is therefore inhibition of FLJ23519 (Accession NM_032240). Accordingly, utilities of VGAM484 include diagnosis, prevention and treatment of diseases and clinical conditions associated with FLJ23519. KIAA0607 (Accession XM_051931) is another VGAM484 host target gene. KIAA0607 BINDING SITE is HOST TARGET binding site found in the 3' untranslated region of mRNA encoded by KIAA0607, corresponding to a HOST TARGET binding site such as BINDING SITE I, BINDING SITE II or BINDING SITE III. Table 2 illustrates the complementarity of the nucleotide sequences of KIAA0607 BINDING SITE, designated SEQ ID:35925, to the nucleotide sequence of VGAM484 RNA, herein designated VGAM RNA, also designated SEQ ID:3195.

Another function of VGAM484 is therefore inhibition of KIAA0607 (Accession XM_051931). Accordingly, utilities of VGAM484 include diagnosis, prevention and treatment of diseases and clinical conditions associated with KIAA0607. KIAA0674 (Accession XM_027054) is another VGAM484 host target gene. KIAA0674 BINDING SITE is HOST TARGET binding site found in the 5' untranslated region of mRNA encoded by KIAA0674, corresponding to a HOST TARGET binding site such as BINDING SITE I, BINDING SITE II or BINDING SITE III. Table 2 illustrates the complementarity of the nucleotide sequences of KIAA0674 BINDING SITE, designated SEQ ID:30398, to the nucleotide sequence of VGAM484 RNA, herein designated VGAM RNA, also designated SEQ ID:3195.

Another function of VGAM484 is therefore inhibition of KIAA0674 (Accession XM_027054). Accordingly, utilities of VGAM484 include diagnosis, prevention and treatment of diseases and clinical conditions associated with KIAA0674. KIAA1473 (Accession XM_047550) is another VGAM484 host target gene. KIAA1473 BINDING SITE is HOST TARGET binding site found in the 3' untranslated region of mRNA encoded by KIAA1473, corresponding to a HOST TARGET binding site such as BINDING SITE I, BINDING SITE II or BINDING SITE III. Table 2 illustrates the complementarity of the nucleotide sequences of KIAA1473 BINDING SITE, designated SEQ ID:34996, to the nucleotide sequence of VGAM484 RNA, herein designated VGAM RNA, also designated SEQ ID:3195.

Another function of VGAM484 is therefore inhibition of KIAA1473 (Accession XM_047550). Accordingly, utilities of VGAM484 include diagnosis, prevention and treatment of diseases and clinical conditions associated with KIAA1473. P450RAI-2 (Accession NM_019885) is another VGAM484 host target gene. P450RAI-2 BINDING SITE is HOST TARGET binding site found in the 3' untranslated region of mRNA encoded by P450RAI-2, corresponding to a HOST TARGET binding site such as BINDING SITE I, BINDING SITE II or BINDING SITE III. Table 2 illustrates the complementarity of the nucleotide sequences of P450RAI-2 BINDING SITE, designated SEQ ID:21267, to the nucleotide sequence of VGAM484 RNA, herein designated VGAM RNA, also designated SEQ ID:3195.

Another function of VGAM484 is therefore inhibition of P450RAI-2 (Accession NM_019885). Accordingly, utilities of VGAM484 include diagnosis, prevention and treatment of diseases and clinical conditions associated with P450RAI-2. LOC112868 (Accession XM_053402) is another VGAM484 host target gene. LOC112868 BINDING SITE is HOST TARGET binding site found in the 3' untranslated region of mRNA encoded by LOC112868, corresponding to a HOST TARGET binding site such as BINDING SITE I, BINDING SITE II or BINDING SITE III. Table 2 illustrates the complementarity of the nucleotide sequences of LOC112868 BINDING SITE, designated SEQ ID:36078, to the nucleotide sequence of VGAM484 RNA, herein designated VGAM RNA, also designated SEQ ID:3195.

Another function of VGAM484 is therefore inhibition of LOC112868 (Accession XM_053402). Accordingly, utilities of VGAM484 include diagnosis, prevention and treatment of diseases and clinical conditions associated with LOC112868. LOC51644 (Accession NM_016057) is another VGAM484 host target gene. LOC51644 BINDING SITE is HOST TARGET binding site found in the 3' untranslated region of mRNA encoded by LOC51644, corresponding to a HOST TARGET binding site such as BINDING SITE I, BINDING SITE II or BINDING SITE III. Table 2 illustrates the complementarity of the nucleotide sequences of LOC51644 BINDING SITE, designated SEQ ID:18131, to the nucleotide sequence of VGAM484 RNA, herein designated VGAM RNA, also designated SEQ ID:3195.

Another function of VGAM484 is therefore inhibition of LOC51644 (Accession NM_016057). Accordingly, utilities of VGAM484 include diagnosis, prevention and treatment of diseases and clinical conditions associated with LOC51644. FIG. 1 further provides a conceptual description of a novel bioinformatically detected viral gene of the present invention, referred to here as Viral Genomic Address Messenger 485 (VGAM485) viral gene, which modulates expression of respective host target genes thereof, the function and utility of which host target genes is known in the art.

VGAM485 is a novel bioinformatically detected regulatory, non protein coding, viral micro RNA (miRNA) gene. The method by which VGAM485 was detected is described hereinabove with reference to FIGS. 1-8.

VGAM485 gene, herein designated VGAM GENE, is a viral gene contained in the genome of Hepatitis G Virus. VGAM485 host target gene, herein designated VGAM HOST TARGET GENE, is a human gene contained in the human genome.

VGAM485 gene encodes a VGAM485 precursor RNA, herein designated VGAM PRECURSOR RNA. Similar to other miRNA genes, and unlike most ordinary genes, VGAM485 precursor RNA does not encode a protein. A nucleotide sequence identical or highly similar to the nucleotide sequence of VGAM485 precursor RNA is designated SEQ ID:471, and is provided hereinbelow with reference to the sequence listing part. Nucleotide sequence SEQ ID:471 is located at position 1462 relative to the genome of Hepatitis G Virus.

VGAM485 precursor RNA folds onto itself, forming VGAM485 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM485 folded precursor RNA into VGAM485 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM485 RNA is designated SEQ ID:3196, and is provided hereinbelow with reference to the sequence listing part.

VGAM485 host target gene, herein designated VGAM HOST TARGET GENE, encodes a corresponding messenger RNA, VGAM485 host target RNA, herein designated VGAM HOST TARGET RNA. VGAM485 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM485 RNA, herein designated VGAM RNA, binds complementarily to one or more host target binding sites located in untranslated regions of VGAM485 host target RNA, herein designated VGAM HOST TARGET RNA. This complementary binding is due to the fact that the nucleotide sequence of VGAM485 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM485 RNA, herein designated VGAM RNA, may have a different number of host target binding sites in untranslated regions of a VGAM485 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM485 RNA, herein designated VGAM RNA, to host target binding sites on VGAM485 host target RNA, herein designated VGAM HOST TARGET RNA, such as BINDING SITE I, BINDING SITE II and BINDING SITE III, inhibits translation of VGAM485 host target RNA into VGAM485 host target protein, herein designated VGAM HOST TARGET PROTEIN. VGAM host target protein is therefore outlined by a broken line.

It is appreciated that VGAM485 host target gene, herein designated VGAM HOST TARGET GENE, in fact represents a plurality of VGAM485 host target genes. The mRNA of each one of this plurality of VGAM485 host target genes comprises one or more host target binding sites, each having a nucleotide sequence which is at least partly complementary to VGAM485 RNA, herein designated VGAM RNA, and which when bound by VGAM485 RNA causes inhibition of translation of respective one or more VGAM485 host target proteins.

It is further appreciated by one skilled in the art that the mode of translational inhibition illustrated by FIG. 1 with specific reference to translational inhibition exerted by VGAM485 gene, herein designated VGAM GENE, on one or more VGAM485 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM485 is inhibition of expression of host target genes, as part of a novel viral mechanism of attacking a host. Accordingly, utilities of VGAM485 include diagnosis, prevention and treatment of viral infection by Hepatitis G Virus. Specific functions, and accordingly utilities, of VGAM485 correlate with, and may be deduced from, the identity of the host target genes which VGAM485 binds and inhibits, and the function of these host target genes, as elaborated hereinbelow.

Nucleotide sequences of the VGAM485 precursor RNA, herein designated VGAM PRECURSOR RNA, and of the 'diced' VGAM485 RNA, herein designated VGAM RNA, and a schematic representation of the secondary folding of VGAM485 folded precursor RNA, herein designated VGAM FOLDED PRECURSOR RNA, of VGAM485 are further described hereinbelow with reference to Table 1.

Nucleotide sequences of host target binding sites, such as BINDING SITE-I, BINDING SITE-II and BINDING SITE-III of FIG. 1, found on VGAM485 host target RNA, and schematic representation of the complementarity of each of these host target binding sites to VGAM485 RNA, herein designated VGAM RNA, are described hereinbelow with reference to Table 2.

As mentioned hereinabove with reference to FIG. 1, a function of VGAM485 gene, herein designated VGAM is inhibition of expression of VGAM485 target genes. It is appreciated that specific functions, and accordingly utilities, of VGAM485 correlate with, and may be deduced from, the identity of the target genes which VGAM485 binds and inhibits, and the function of these target genes, as elaborated hereinbelow.

LOC200014 (Accession XM_114087) is a VGAM485 host target gene. LOC200014 BINDING SITE is HOST TARGET binding site found in the 3' untranslated region of mRNA encoded by LOC200014, corresponding to a HOST TARGET binding site such as BINDING SITE I, BINDING SITE II or BINDING SITE III. Table 2 illustrates the complementarity of the nucleotide sequences of LOC200014 BINDING SITE, designated SEQ ID:42695, to the nucleotide sequence of VGAM485 RNA, herein designated VGAM RNA, also designated SEQ ID:3196.

A function of VGAM485 is therefore inhibition of LOC200014 (Accession XM_114087). Accordingly, utilities of VGAM485 include diagnosis, prevention and treatment of diseases and clinical conditions associated with LOC200014. FIG. 1 further provides a conceptual description of a novel bioinformatically detected viral gene of the present invention, referred to here as Viral Genomic Address Messenger 486 (VGAM486) viral gene, which modulates expression of respective host target genes thereof, the function and utility of which host target genes is known in the art.

VGAM486 is a novel bioinformatically detected regulatory, non protein coding, viral micro RNA (miRNA) gene. The method by which VGAM486 was detected is described hereinabove with reference to FIGS. 1-8.

VGAM486 gene, herein designated VGAM GENE, is a viral gene contained in the genome of Hepatitis G Virus. VGAM486 host target gene, herein designated VGAM HOST TARGET GENE, is a human gene contained in the human genome.

VGAM486 gene encodes a VGAM486 precursor RNA, herein designated VGAM PRECURSOR RNA. Similar to other miRNA genes, and unlike most ordinary genes, VGAM486 precursor RNA does not encode a protein. A nucleotide sequence identical or highly similar to the nucleotide sequence of VGAM486 precursor RNA is designated SEQ ID:472, and is provided hereinbelow with reference to the sequence listing part. Nucleotide sequence SEQ ID:472 is located at position 5080 relative to the genome of Hepatitis G Virus.

VGAM486 precursor RNA folds onto itself, forming VGAM486 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM486 folded precursor RNA into VGAM486 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM486 RNA is designated SEQ ID:3197, and is provided hereinbelow with reference to the sequence listing part.

VGAM486 host target gene, herein designated VGAM HOST TARGET GENE, encodes a corresponding messenger RNA, VGAM486 host target RNA, herein designated VGAM HOST TARGET RNA. VGAM486 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM486 RNA, herein designated VGAM RNA, binds complementarily to one or more host target binding sites located in untranslated regions of VGAM486 host target RNA, herein designated VGAM HOST TARGET RNA. This complementary binding is due to the fact that the nucleotide sequence of VGAM486 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM486 RNA, herein designated VGAM RNA, may have a different number of host target binding sites in untranslated regions of a VGAM486 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM486 RNA, herein designated VGAM RNA, to host target binding sites on VGAM486 host target RNA, herein designated VGAM HOST TARGET RNA, such as BINDING SITE I, BINDING SITE II and BINDING SITE III, inhibits translation of VGAM486 host target RNA into VGAM486 host target protein, herein designated VGAM HOST TARGET PROTEIN. VGAM host target protein is therefore outlined by a broken line.

It is appreciated that VGAM486 host target gene, herein designated VGAM HOST TARGET GENE, in fact represents a plurality of VGAM486 host target genes. The mRNA of each one of this plurality of VGAM486 host target genes comprises one or more host target binding sites, each having a nucleotide sequence which is at least partly complementary to VGAM486 RNA, herein designated VGAM RNA, and which when bound by VGAM486 RNA causes inhibition of translation of respective one or more VGAM486 host target proteins.

It is further appreciated by one skilled in the art that the mode of translational inhibition illustrated by FIG. 1 with specific reference to translational inhibition exerted by VGAM486 gene, herein designated VGAM GENE, on one or more VGAM486 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM486 is inhibition of expression of host target genes, as part of a novel viral mechanism of attacking a host. Accordingly, utilities of VGAM486 include diagnosis, prevention and treatment of viral infection by Hepatitis G Virus. Specific functions, and accordingly utilities, of VGAM486 correlate with, and may be deduced from, the identity of the host target genes which VGAM486 binds and inhibits, and the function of these host target genes, as elaborated hereinbelow.

Nucleotide sequences of the VGAM486 precursor RNA, herein designated VGAM PRECURSOR RNA, and of the 'diced' VGAM486 RNA, herein designated VGAM RNA, and a schematic representation of the secondary folding of VGAM486 folded precursor RNA, herein designated VGAM FOLDED PRECURSOR RNA, of VGAM486 are further described hereinbelow with reference to Table 1.

Nucleotide sequences of host target binding sites, such as BINDING SITE-I, BINDING SITE-II and BINDING SITE-III of FIG. 1, found on VGAM486 host target RNA, and schematic representation of the complementarity of each of these host target binding sites to VGAM486 RNA, herein designated VGAM RNA, are described hereinbelow with reference to Table 2.

As mentioned hereinabove with reference to FIG. 1, a function of VGAM486 gene, herein designated VGAM is inhibition of expression of VGAM486 target genes. It is appreciated that specific functions, and accordingly utilities, of VGAM486 correlate with, and may be deduced from, the identity of the target genes which VGAM486 binds and inhibits, and the function of these target genes, as elaborated hereinbelow.

Beta-site APP-cleaving Enzyme 2 (BACE2, Accession NM_138992) is a VGAM486 host target gene. BACE2 BINDING SITE is HOST TARGET binding site found in the 3' untranslated region of mRNA encoded by BACE2, corresponding to a HOST TARGET binding site such as BINDING SITE I, BINDING SITE II or BINDING SITE III. Table 2 illustrates the complementarity of the nucleotide sequences of BACE2 BINDING SITE, designated SEQ ID:29092, to the nucleotide sequence of VGAM486 RNA, herein designated VGAM RNA, also designated SEQ ID:3197.

A function of VGAM486 is therefore inhibition of Beta-site APP-cleaving Enzyme 2 (BACE2, Accession NM_138992), a gene which cleaves intracellularly the b-secretase site of amyloid precursor protein. Accordingly, utilities of VGAM486 include diagnosis, prevention and treatment of diseases and clinical conditions associated with BACE2. The function of BACE2 has been established by previous studies. Deposition in the brain of the 39- to 43-amino acid amyloid-beta peptide is a hallmark of Alzheimer disease (AD; 104300), a frequent complication of Down syndrome (OMIM Ref. No. 190685) patients after age 30 years. Amyloid-beta is generated by proteolytic processing of the amyloid precursor protein (APP; 104760) by beta- and gamma-secretase at the N and C termini, respectively. Presenilin-1 (OMIM Ref. No. 104311) is involved in the gamma-secretase activity. BACE (OMIM Ref. No. 604252), a transmembrane aspartyl protease, possesses beta-secretase activity. By differential display RT-PCR of poorly and highly metastatic breast cancer cell lines, followed by screening a bone marrow stroma cell cDNA library, Xin et al. (2000) obtained a cDNA encoding BACE2, which they termed ALP56. Sequence analysis predicted that the 518-amino acid protein has 2 pepsin-like active centers, a signal sequence, a propeptide, and a long C-terminal extension including a transmembrane domain. Northern blot analysis detected 2.5- and 2.0-kb transcripts in metastatic tumors injected in SCID mice (see OMIM Ref. No. 202500). In situ hybridization analysis demonstrated high expression in breast, colon, and prostate cancer biopsies, as well as in normal prostate. Northern blot analysis of normal tissue revealed expression in prostate, pancreas, and placenta. Further exposure detected expression in all tissues tested except brain and lymphocytes. Western blot analysis showed expression of a 60-kD protein as well as apparent autocleavage products of 17 and 14 kD. By searching EST databases with the BACE sequence and identifying mapped sequences, Saunders et al. (1999) identified a cDNA encoding BACE2 and mapped the gene to 21q22.2-q22.3. Using FISH, Acquati et al. (2000) confirmed the localization of BACE2 to 21q22.3, within the Down syndrome critical region.

Full details of the abovementioned studies are described in the following publications, the disclosure of which are hereby incorporated by reference:

Xin, H.; Stephans, J. C.; Duan, X.; Harrowe, G.; Kim, E.; Grieshammer, U.; Kingsley, C.; Giese, K.: Identification of a novel aspartic-like protease differentially expressed in human breast cancer cell lines. Biochim. Biophys. Acta 1501:125-137, 2000; and Saunders, A. J.; Kim, T.-W.; Tanzi, R. E.: BACE maps to chromosome 11 and a BACE homolog, BACE2, reside in the obligate Down syndrome region of chromosome 21. Science 286:1255A only.

Further studies establishing the function and utilities of BACE2 are found in John Hopkins OMIM database record ID 605668, and in sited publications numbered 641 and 6416-6419 listed in the bibliography section hereinbelow, which are also hereby incorporated by reference. LOC254314 (Accession XM_172871) is another VGAM486 host target gene. LOC254314 BINDING SITE is HOST TARGET binding site found in the 5' untranslated region of mRNA encoded by LOC254314, corresponding to a HOST TARGET binding site such as BINDING SITE I, BINDING SITE II or BINDING SITE III. Table 2 illustrates the complementarity of the nucleotide sequences of LOC254314 BINDING SITE, designated SEQ ID:46150, to the nucleotide sequence of VGAM486 RNA, herein designated VGAM RNA, also designated SEQ ID:3197.

Another function of VGAM486 is therefore inhibition of LOC254314 (Accession XM_172871). Accordingly, utilities of VGAM486 include diagnosis, prevention and treatment of diseases and clinical conditions associated with LOC254314. FIG. 1 further provides a conceptual description of a novel bioinformatically detected viral gene of the present invention, referred to here as Viral Genomic Address Messenger 487 (VGAM487) viral gene, which modulates expression of respective host target genes thereof, the function and utility of which host target genes is known in the art.

VGAM487 is a novel bioinformatically detected regulatory, non protein coding, viral micro RNA (miRNA) gene. The method by which VGAM487 was detected is described hereinabove with reference to FIGS. 1-8.

VGAM487 gene, herein designated VGAM GENE, is a viral gene contained in the genome of Hepatitis G Virus. VGAM487 host target gene, herein designated VGAM HOST TARGET GENE, is a human gene contained in the human genome.

VGAM487 gene encodes a VGAM487 precursor RNA, herein designated VGAM PRECURSOR RNA. Similar to other miRNA genes, and unlike most ordinary genes, VGAM487 precursor RNA does not encode a protein. A nucleotide sequence identical or highly similar to the nucleotide sequence of VGAM487 precursor RNA is designated SEQ ID:473, and is provided hereinbelow with reference to the sequence listing part. Nucleotide sequence SEQ ID:473 is located at position 9016 relative to the genome of Hepatitis G Virus.

VGAM487 precursor RNA folds onto itself, forming VGAM487 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM487 folded precursor RNA into VGAM487 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM487 RNA is designated SEQ ID:3198, and is provided hereinbelow with reference to the sequence listing part.

VGAM487 host target gene, herein designated VGAM HOST TARGET GENE, encodes a corresponding messenger RNA, VGAM487 host target RNA, herein designated VGAM HOST TARGET RNA. VGAM487 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM487 RNA, herein designated VGAM RNA, binds complementarily to one or more host target binding sites located in untranslated regions of VGAM487 host target RNA, herein designated VGAM HOST TARGET RNA. This complementary binding is due to the fact that the nucleotide sequence of VGAM487 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM487 RNA, herein designated VGAM RNA, may have a different number of host target binding sites in untranslated regions of a VGAM487 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM487 RNA, herein designated VGAM RNA, to host target binding sites on VGAM487 host target RNA, herein designated VGAM HOST TARGET RNA, such as BINDING SITE I, BINDING SITE II and BINDING SITE III, inhibits translation of VGAM487 host target RNA into VGAM487 host target protein, herein designated VGAM HOST TARGET PROTEIN. VGAM host target protein is therefore outlined by a broken line.

It is appreciated that VGAM487 host target gene, herein designated VGAM HOST TARGET GENE, in fact represents a plurality of VGAM487 host target genes. The mRNA of each one of this plurality of VGAM487 host target genes comprises one or more host target binding sites, each having a nucleotide sequence which is at least partly complementary to VGAM487 RNA, herein designated VGAM RNA, and which when bound by VGAM487 RNA causes inhibition of translation of respective one or more VGAM487 host target proteins.

It is further appreciated by one skilled in the art that the mode of translational inhibition illustrated by FIG. 1 with specific reference to translational inhibition exerted by VGAM487 gene, herein designated VGAM GENE, on one or more VGAM487 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM487 is inhibition of expression of host target genes, as part of a novel viral mechanism of attacking a host. Accordingly, utilities of VGAM487 include diagnosis, prevention and treatment of viral infection by Hepatitis G Virus. Specific functions, and accordingly utilities, of VGAM487 correlate with, and may be deduced from, the identity of the host target genes which VGAM487 binds and inhibits, and the function of these host target genes, as elaborated hereinbelow.

Nucleotide sequences of the VGAM487 precursor RNA, herein designated VGAM PRECURSOR RNA, and of the 'diced' VGAM487 RNA, herein designated VGAM RNA, and a schematic representation of the secondary folding of VGAM487 folded precursor RNA, herein designated VGAM FOLDED PRECURSOR RNA, of VGAM487 are further described hereinbelow with reference to Table 1.

Nucleotide sequences of host target binding sites, such as BINDING SITE-I, BINDING SITE-II and BINDING SITE-III of FIG. 1, found on VGAM487 host target RNA, and schematic representation of the complementarity of each of these host target binding sites to VGAM487 RNA, herein designated VGAM RNA, are described hereinbelow with reference to Table 2.

As mentioned hereinabove with reference to FIG. 1, a function of VGAM487 gene, herein designated VGAM is inhibition of expression of VGAM487 target genes. It is appreciated that specific functions, and accordingly utilities, of VGAM487 correlate with, and may be deduced from, the identity of the target genes which VGAM487 binds and inhibits, and the function of these target genes, as elaborated hereinbelow.

Interferon (alpha, beta and omega) Receptor 2 (IFNAR2, Accession NM_000874) is a VGAM487 host target gene. IFNAR2 BINDING SITE is HOST TARGET binding site found in the 3' untranslated region of mRNA encoded by IFNAR2, corresponding to a HOST TARGET binding site such as BINDING SITE I, BINDING SITE II or BINDING SITE III. Table 2 illustrates the complementarity of the nucleotide sequences of IFNAR2 BINDING SITE, designated SEQ ID:6554, to the nucleotide sequence of VGAM487 RNA, herein designated VGAM RNA, also designated SEQ ID:3198.

A function of VGAM487 is therefore inhibition of Interferon (alpha, beta and omega) Receptor 2 (IFNAR2, Accession NM_000874), a gene which is a receptor for interferons alpha and beta. Accordingly, utilities of VGAM487 include diagnosis, prevention and treatment of diseases and clinical conditions associated with IFNAR2. The function of IFNAR2 has been established by previous studies. Alpha-type antiviral protein is a factor, presumably protein in nature, that mediates specific interferon inhibition of virus replication. According to studies of mouse-man hybrid clones, the locus determining this protein is carried on chromosome 21 (Tan et al., 1973). Tan et al. (1974) made observations of dosage effect in monosomy-21 and trisomy-21 cells which supported assignment of the locus to chromosome 21. This character was also called interferon sensitivity (IS). Chany et al. (1975) showed that trisomy-21 cells have increased interferon sensitivity. Trisomy-16 cells have reduced sensitivity. This might suggest the presence on chromosome 16 of a regulator of mouse antiviral protein. Reve et al. (1976) showed that antibody to a cell surface component coded by human chromosome 21 inhibited the action of interferon. This suggested that antiviral protein is an interferon receptor. See 147570, 147640, 147660 for a discussion of the gamma, beta, and alpha interferons, respectively. De Clercq et al. (1976) concluded that it is not a cell membrane receptor for interferon that is encoded by chromosome 21 Raziuddin et al. (1984) showed that the receptors for alpha- and beta-interferons are specified by chromosome 21. It was presumed that separate genes encoded the alpha- and beta-interferon receptors. Novick et al. (1994) described a universal ligand-binding receptor for human interferons alpha and interferon beta. Sarkar and Gupta (1984) showed that gamma-interferon binds to a separate receptor that is carried by WISH cells (a human amnion cell line). The gene for the receptor was designated also IFNAR. Langer et al. (1990) sublocalized the IFNAR gene to 21q22.1-q22.2 by hybridization of (32)P-labeled recombinant interferon-alpha/beta receptor with human-hamster somatic cell hybrids containing various fragments of human chromosome 21. By in situ hybridization, Lutfalla et al. (1990) refined the assignment to 21q22.1. Lutfalla et al. (1992) further refined the localization by pulsed field gel electrophoresis and its linkage to adjacent markers. They compared the exon structure of the IFNAR gene with that of the genes for receptors of the cytokine/growth hormone/prolactin/interferon receptor family and concluded that they have a common origin and have diverged from the immunoglobulin superfamily with which they share a common ancestor. Cellular responses to cytokines involve cross-communication through their respective receptors. The IFNs alpha, beta, and gamma mediate innate immune responses to viral infection through IFNAR1/IFNAR2 (OMIM Ref. No. 602376) for IFNA and IFNB, and IFNGR1 (OMIM Ref. No. 107470)/IFNGR2 (OMIM Ref. No. 147569) for IFNG. Stimulation of these receptors activates Janus protein kinases (e.g., JAK1, 147795 and JAK2, 147796), which leads to the tyrosine phosphorylation of STAT1 (OMIM Ref. No. 600555) and STAT2 (OMIM Ref. No. 600556). Although the IFN receptors are expressed at low levels in cells, they may be clustered in the cell membrane to permit efficient signal transduction. Using mouse embryonic fibroblasts (MEFs) from IFNAR1- and IFNGR1-deficient mice, Takaoka et al. (2000) observed that the STAT1-mediated DNA-binding activity and the antiviral response to IFNG in IFNAR-null MEFs but not to IFNA in IFNGR-null MEFs are impaired. Restoration of the IFNG response requires constitutive subthreshold IFNA/IFNB signaling and an intact IFNAR1 capable of interacting with STAT1 after tyrosine phosphorylation. Immunoblot analysis showed that IFNAR1 coimmunoprecipitated with the nonligand-binding component, IFNGR2, of the IFNGR complex in wildtype MEFs but less well in IFNB-null MEFs. Immunoblot analysis also demonstrated that the IFN receptor components are exclusively localized in the caveolar membrane fractions (see OMIM Ref. No. CAV1; 601047) where there is a concentration of cytoplasmically oriented signaling molecules.

Full details of the abovementioned studies are described in the following publications, the disclosure of which are hereby incorporated by reference:

Takaoka, A.; Mitani, Y.; Suemori, H.; Sato, M.; Yokochi, T.; Noguchi, S.; Tanaka, N.; Taniguchi, T.: Cross talk between interferon-gamma and -alpha/beta signaling components in caveolar membrane domains. Science 288:2357-2360, 2000; and Novick, D.; Cohen, B.; Rubinstein, M.: The human interferon alpha/beta receptor: characterization and molecular cloning. Cell 77:391-400, 1994.

Further studies establishing the function and utilities of IFNAR2 are found in John Hopkins OMIM database record ID 602376, and in sited publications numbered 5597-5599, 560 and 11830-5601 listed in the bibliography section hereinbelow, which are also hereby incorporated by reference. FLJ14621 (Accession NM_032811) is another VGAM487 host target gene. FLJ14621 BINDING SITE is HOST TARGET binding site found in the 5" untranslated region of mRNA encoded by FLJ14621, corresponding to a HOST TARGET binding site such as BINDING SITE I, BINDING SITE II or BINDING SITE III. Table 2 illustrates the complementarity of the nucleotide sequences of FLJ14621 BINDING SITE, designated SEQ ID:26578, to the nucleotide sequence of VGAM487 RNA, herein designated VGAM RNA, also designated SEQ ID:3198.

Another function of VGAM487 is therefore inhibition of FLJ14621 (Accession NM_032811). Accordingly, utilities of VGAM487 include diagnosis, prevention and treatment of diseases and clinical conditions associated with FLJ14621. FLJ22169 (Accession NM_024085) is another VGAM487 host target gene. FLJ22169 BINDING SITE is HOST TARGET binding site found in the 3' untranslated region of mRNA encoded by FLJ22169, corresponding to a HOST TARGET binding site such as BINDING SITE I, BINDING SITE II or BINDING SITE III. Table 2 illustrates the complementarity of the nucleotide sequences of FLJ22169 BINDING SITE, designated SEQ ID:23521, to the nucleotide sequence of VGAM487 RNA, herein designated VGAM RNA, also designated SEQ ID:3198.

Another function of VGAM487 is therefore inhibition of FLJ22169 (Accession NM_024085). Accordingly, utilities of VGAM487 include diagnosis, prevention and treatment of diseases and clinical conditions associated with FLJ22169. RBAK (Accession NM_021163) is another VGAM487 host target gene. RBAK BINDING SITE is HOST TARGET binding site found in the 3" untranslated region of mRNA encoded by RBAK, corresponding to a HOST TARGET binding site such as BINDING SITE I, BINDING SITE II or BINDING SITE III. Table 2 illustrates the complementarity of the nucleotide sequences of RBAK BINDING SITE, designated SEQ ID:22140, to the nucleotide sequence of VGAM487 RNA, herein designated VGAM RNA, also designated SEQ ID:3198.

Another function of VGAM487 is therefore inhibition of RBAK (Accession NM_021163). Accordingly, utilities of VGAM487 include diagnosis, prevention and treatment of diseases and clinical conditions associated with RBAK. FIG. 1 further provides a conceptual description of a novel bioinformatically detected viral gene of the present invention, referred to here as Viral Genomic Address Messenger 488 (VGAM488) viral gene, which modulates expression of respective host target genes thereof, the function and utility of which host target genes is known in the art.

VGAM488 is a novel bioinformatically detected regulatory, non protein coding, viral micro RNA (miRNA) gene. The method by which VGAM488 was detected is described hereinabove with reference to FIGS. 1-8.

VGAM488 gene, herein designated VGAM GENE, is a viral gene contained in the genome of Hepatitis G Virus. VGAM488 host target gene, herein designated VGAM HOST TARGET GENE, is a human gene contained in the human genome.

VGAM488 gene encodes a VGAM488 precursor RNA, herein designated VGAM PRECURSOR RNA. Similar to other miRNA genes, and unlike most ordinary genes, VGAM488 precursor RNA does not encode a protein. A nucleotide sequence identical or highly similar to the nucleotide sequence of VGAM488 precursor RNA is designated SEQ ID:474, and is provided hereinbelow with reference to the sequence listing part. Nucleotide sequence SEQ ID:474 is located at position 2231 relative to the genome of Hepatitis G Virus.

VGAM488 precursor RNA folds onto itself, forming VGAM488 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM488 folded precursor RNA into VGAM488 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM488 RNA is designated SEQ ID:3199, and is provided hereinbelow with reference to the sequence listing part.

VGAM488 host target gene, herein designated VGAM HOST TARGET GENE, encodes a corresponding messenger RNA, VGAM488 host target RNA, herein designated VGAM HOST TARGET RNA. VGAM488 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM488 RNA, herein designated VGAM RNA, binds complementarily to one or more host target binding sites located in untranslated regions of VGAM488 host target RNA, herein designated VGAM HOST TARGET RNA. This complementary binding is due to the fact that the nucleotide sequence of VGAM488 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM488 RNA, herein designated VGAM RNA, may have a different number of host target binding sites in untranslated regions of a VGAM488 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM488 RNA, herein designated VGAM RNA, to host target binding sites on VGAM488 host target RNA, herein designated VGAM HOST TARGET RNA, such as BINDING SITE I, BINDING SITE II and BINDING SITE III, inhibits translation of VGAM488 host target RNA into VGAM488 host target protein, herein designated VGAM HOST TARGET PROTEIN. VGAM host target protein is therefore outlined by a broken line.

It is appreciated that VGAM488 host target gene, herein designated VGAM HOST TARGET GENE, in fact represents a plurality of VGAM488 host target genes. The mRNA of each one of this plurality of VGAM488 host target genes comprises one or more host target binding sites, each having a nucleotide sequence which is at least partly complementary to VGAM488 RNA, herein designated VGAM RNA, and which when bound by VGAM488 RNA causes inhibition of translation of respective one or more VGAM488 host target proteins.

It is further appreciated by one skilled in the art that the mode of translational inhibition illustrated by FIG. 1 with specific reference to translational inhibition exerted by VGAM488 gene, herein designated VGAM GENE, on one or more VGAM488 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM488 is inhibition of expression of host target genes, as part of a novel viral mechanism of attacking a host. Accordingly, utilities of VGAM488 include diagnosis, prevention and treatment of viral infection by Hepatitis G Virus. Specific functions, and accordingly utilities, of VGAM488 correlate with, and may be deduced from, the identity of the host target genes which VGAM488 binds and inhibits, and the function of these host target genes, as elaborated hereinbelow.

Nucleotide sequences of the VGAM488 precursor RNA, herein designated VGAM PRECURSOR RNA, and of the 'diced' VGAM488 RNA, herein designated VGAM RNA, and a schematic representation of the secondary folding of VGAM488 folded precursor RNA, herein designated VGAM FOLDED PRECURSOR RNA, of VGAM488 are further described hereinbelow with reference to Table 1.

Nucleotide sequences of host target binding sites, such as BINDING SITE-I, BINDING SITE-II and BINDING SITE-III of FIG. 1, found on VGAM488 host target RNA, and schematic representation of the complementarity of each of these host target binding sites to VGAM488 RNA, herein designated VGAM RNA, are described hereinbelow with reference to Table 2.

As mentioned hereinabove with reference to FIG. 1, a function of VGAM488 gene, herein designated VGAM is inhibition of expression of VGAM488 target genes. It is appreciated that specific functions, and accordingly utilities, of VGAM488 correlate with, and may be deduced from, the identity of the target genes which VGAM488 binds and inhibits, and the function of these target genes, as elaborated hereinbelow.

Cyclin-dependent Kinase (CDC2-like) 10 (CDK10, Accession NM_052988) is a VGAM488 host target gene. CDK10 BINDING SITE is HOST TARGET binding site found in the 3' untranslated region of mRNA encoded by CDK10, corresponding to a HOST TARGET binding site such as BINDING SITE I, BINDING SITE II or BINDING SITE III. Table 2 illustrates the complementarity of the nucleotide sequences of CDK10 BINDING SITE, designated SEQ ID:27558, to the nucleotide sequence of VGAM488 RNA, herein designated VGAM RNA, also designated SEQ ID:3199.

A function of VGAM488 is therefore inhibition of Cyclin-dependent Kinase (CDC2-like) 10 (CDK10, Accession NM_052988), a gene which plays a pivotal role in the regulation of the eukaryotic cell cycle. Accordingly, utilities of VGAM488 include diagnosis, prevention and treatment of diseases and clinical conditions associated with CDK10. The function of CDK10 and its association with various diseases and clinical conditions, has been established by previous studies, as described hereinabove with reference to VGAM193. Cytokine Inducible SH2-containing Protein (CISH, Accession NM_145071) is another VGAM488 host target gene. CISH BINDING SITE1 and CISH BINDING SITE2 are HOST TARGET binding sites found in untranslated regions of mRNA encoded by CISH, corresponding to HOST TARGET binding sites such as BINDING SITE I, BINDING SITE II or BINDING SITE III. Table 2 illustrates the complementarity of the nucleotide sequences of CISH BINDING SITE1 and CISH BINDING SITE2, designated SEQ ID:29705 and SEQ ID:14972 respectively, to the nucleotide sequence of VGAM488 RNA, herein designated VGAM RNA, also designated SEQ ID:3199.

Another function of VGAM488 is therefore inhibition of Cytokine Inducible SH2-containing Protein (CISH, Accession NM_145071), a gene which intervenes in the negative regulation of cytokines. Accordingly, utilities of VGAM488 include diagnosis, prevention and treatment of diseases and clinical conditions associated with CISH. The function of CISH has been established by previous studies. As part of the search for immediate-early cytokine-responsive genes, Yoshimura et al. (1995) cloned murine Cish, which was shown to have a growth inhibitory function. Cis, the protein product of Cish, has a Src homology 2 (SH2) domain in the middle of its sole structural motif. Tight linkage of Cish to the Gnai2 gene (OMIM Ref. No. 139360) on mouse chromosome 9, a region syntenic to human 3p21, prompted Uchida et al. (1997) to isolate a human CISH cDNA and map the gene to 3p21.3 by fluorescence in situ hybridization. Northern blot analysis showed expression of CISH as a 2-kb transcript in various epithelial tissues, including lung and kidney, which develop tumors frequently exhibiting 3p21.3 deletions. The CISH gene contains 2 introns, about 3 kb and 0.4 kb in size, and has 3 repeats of the pentameric mRNA destabilization signal, ATTTA, in its 3-prime untranslated region. The CIS protein consists of 258 amino acids.

Full details of the abovementioned studies are described in the following publications, the disclosure of which are hereby incorporated by reference:

Uchida, K.; Yoshimura, A.; Inazawa, J.; Yanagisawa, K.; Osada, H.; Masuda, A.; Saito, T.; Takahashi, T.; Miyajima, A.; Takahashi, T.: Molecular cloning of CISH, chromosome assignment to 3p21.3, and analysis of expression in fetal and adult tissues. Cytogenet. Cell Genet. 78:209-212, 1997; and Yoshimura, A.; Ohkubo, T.; Kiguchi, T.; Jenkins, N. A.; Gilbert, D. J.; Copeland, N. G.; Hara, T.; Miyajima, A.: A novel cytokine-inducible gene CIS, encodes an SH2-containing protein.

Further studies establishing the function and utilities of CISH are found in John Hopkins OMIM database record ID 602441, and in sited publications numbered 5610-5611 listed in the bibliography section hereinbelow, which are also hereby incorporated by reference. MHC Class II Transactivator (MHC2TA, Accession NM_000246) is another VGAM488 host target gene. MHC2TA BINDING SITE is HOST TARGET binding site found in the 3' untranslated region of mRNA encoded by MHC2TA, corresponding to a HOST TARGET binding site such as BINDING SITE I, BINDING SITE II or BINDING SITE III. Table 2 illustrates the complementarity of the nucleotide sequences of MHC2TA BINDING SITE, designated SEQ ID:5780, to the nucleotide sequence of VGAM488 RNA, herein designated VGAM RNA, also designated SEQ ID:3199.

Another function of VGAM488 is therefore inhibition of MHC Class II Transactivator (MHC2TA, Accession NM_000246). Accordingly, utilities of VGAM488 include diagnosis, prevention and treatment of diseases and clinical conditions associated with MHC2TA. POU Domain, Class 2, Associating Factor 1 (POU2AF1, Accession NM_006235) is another VGAM488 host target gene. POU2AF1 BINDING SITE is HOST TARGET binding site found in the 3' untranslated region of mRNA encoded by POU2AF1, corresponding to a HOST TARGET binding site such as BINDING SITE I, BINDING SITE II or BINDING SITE III. Table 2 illustrates the complementarity of the nucleotide sequences of POU2AF1 BINDING SITE, designated SEQ ID:12891, to the nucleotide sequence of VGAM488 RNA, herein designated VGAM RNA, also designated SEQ ID:3199.

Another function of VGAM488 is therefore inhibition of POU Domain, Class 2, Associating Factor 1 (POU2AF1, Accession NM_006235), a gene which is a transcriptional coactivator that specifically associates with either oct1 or oct2. Accordingly, utilities of VGAM488 include diagnosis, prevention and treatment of diseases and clinical conditions associated with POU2AF1. The function of POU2AF1 and its association with various diseases and clinical conditions, has been established by previous studies, as described hereinabove with reference to VGAM171. Stearoyl-CoA Desaturase (delta-9-desaturase) (SCD, Accession NM_005063) is another VGAM488 host target gene. SCD BINDING SITE is HOST TARGET binding site found in the 3' untranslated region of mRNA encoded by SCD, corresponding to a HOST TARGET binding site such as BINDING SITE I, BINDING SITE II or BINDING SITE III. Table 2 illustrates the complementarity of the nucleotide sequences of SCD BINDING SITE, designated SEQ ID:11497, to the nucleotide sequence of VGAM488 RNA, herein designated VGAM RNA, also designated SEQ ID:3199.

Another function of VGAM488 is therefore inhibition of Stearoyl-CoA Desaturase (delta-9-desaturase) (SCD, Accession NM_005063), a gene which functions in the synthesis of unsaturated fatty acids. Accordingly, utilities of VGAM488 include diagnosis, prevention and treatment of diseases and clinical conditions associated with SCD. The function of SCD and its association with various diseases and clinical conditions, has been established by previous studies, as described hereinabove with reference to VGAM314. Solute Carrier Family 6 (neurotransmitter transporter, creatine), Member 8 (SLC6A8, Accession NM_005629) is another VGAM488 host target gene. SLC6A8 BINDING SITE is HOST TARGET binding site found in the 3' untranslated region of mRNA encoded by SLC6A8, corresponding to a HOST TARGET binding site such as BINDING SITE I, BINDING SITE II or BINDING SITE III. Table 2 illustrates the complementarity of the nucleotide sequences of SLC6A8 BINDING SITE, designated SEQ ID:12151, to the nucleotide sequence of VGAM488 RNA, herein designated VGAM RNA, also designated SEQ ID:3199.

Another function of VGAM488 is therefore inhibition of Solute Carrier Family 6 (neurotransmitter transporter, creatine), Member 8 (SLC6A8, Accession NM_005629). Accordingly, utilities of VGAM488 include diagnosis, prevention and treatment of diseases and clinical conditions associated with SLC6A8. Suppressor of Fused Homolog (Drosophila) (SUFU, Accession NM_016169) is another VGAM488 host target gene. SUFU BINDING SITE is HOST TARGET binding site found in the 3' untranslated region of mRNA encoded by SUFU, corresponding to a HOST TARGET binding site such as BINDING SITE I, BINDING SITE II or BINDING SITE III. Table 2 illustrates the complementarity of the nucleotide sequences of SUFU BINDING SITE, designated SEQ ID:18253, to the nucleotide sequence of VGAM488 RNA, herein designated VGAM RNA, also designated SEQ ID:3199.

Another function of VGAM488 is therefore inhibition of Suppressor of Fused Homolog (Drosophila) (SUFU, Accession NM_016169). Accordingly, utilities of VGAM488 include diagnosis, prevention and treatment of diseases and clinical conditions associated with SUFU. Dynactin 4 (p62) (DCTN4, Accession XM_041993) is another VGAM488 host target gene. DCTN4 BINDING SITE is HOST TARGET binding site found in the 3' untranslated region of mRNA encoded by DCTN4, corresponding to a HOST TARGET binding site such as BINDING SITE I, BINDING SITE II or BINDING SITE III. Table 2 illustrates the complementarity of the nucleotide sequences of DCTN4 BINDING SITE, designated SEQ ID:33667, to the nucleotide sequence of VGAM488 RNA, herein designated VGAM RNA, also designated SEQ ID:3199.

Another function of VGAM488 is therefore inhibition of Dynactin 4 (p62) (DCTN4, Accession XM_041993). Accordingly, utilities of VGAM488 include diagnosis, prevention and treatment of diseases and clinical conditions associated with DCTN4. DKFZP434P0111 (Accession XM_041116) is another VGAM488 host target gene. DKFZP434P0111 BINDING SITE is HOST TARGET binding site found in the 3' untranslated region of mRNA encoded by DKFZP434P0111, corresponding to a HOST TARGET binding site such as BINDING SITE I, BINDING SITE II or BINDING SITE III. Table 2 illustrates the complementarity of the nucleotide sequences of DKFZP434P0111 BINDING SITE, designated SEQ ID:33458, to the nucleotide sequence of VGAM488 RNA, herein designated VGAM RNA, also designated SEQ ID:3199.

Another function of VGAM488 is therefore inhibition of DKFZP434P0111 (Accession XM_041116). Accordingly, utilities of VGAM488 include diagnosis, prevention and treatment of diseases and clinical conditions associated with DKFZP434P0111. EFA6R (Accession NM_015310) is another VGAM488 host target gene. EFA6R BINDING SITE is HOST TARGET binding site found in the 3' untranslated region of mRNA encoded by EFA6R, corresponding to a HOST TARGET binding site such as BINDING SITE I, BINDING SITE II or BINDING SITE III. Table 2 illustrates the complementarity of the nucleotide sequences of EFA6R BINDING SITE, designated SEQ ID:17625, to the nucleotide sequence of VGAM488 RNA, herein designated VGAM RNA, also designated SEQ ID:3199.

Another function of VGAM488 is therefore inhibition of EFA6R (Accession NM_015310). Accordingly, utilities of VGAM488 include diagnosis, prevention and treatment of diseases and clinical conditions associated with EFA6R. HEMK (Accession NM_016173) is another VGAM488 host target gene. HEMK BINDING SITE is HOST TARGET binding site found in the 3' untranslated region of mRNA encoded by HEMK, corresponding to a HOST TARGET binding site such as BINDING SITE I, BINDING SITE II or BINDING SITE III. Table 2 illustrates the complementarity of the nucleotide sequences of HEMK BINDING SITE, designated SEQ ID:18273, to the nucleotide sequence of VGAM488 RNA, herein designated VGAM RNA, also designated SEQ ID:3199.

Another function of VGAM488 is therefore inhibition of HEMK (Accession NM_016173). Accordingly, utilities of VGAM488 include diagnosis, prevention and treatment of diseases and clinical conditions associated with HEMK. KIAA1615 (Accession XM_044021) is another VGAM488 host target gene. KIAA1615 BINDING SITE is HOST TARGET binding site found in the 3" untranslated region of mRNA encoded by KIAA1615, corresponding to a HOST TARGET binding site such as BINDING SITE I, BINDING SITE II or BINDING SITE III. Table 2 illustrates the complementarity of the nucleotide sequences of KIAA1615 BINDING SITE, designated SEQ ID:34085, to the nucleotide sequence of VGAM488 RNA, herein designated VGAM RNA, also designated SEQ ID:3199.

Another function of VGAM488 is therefore inhibition of KIAA1615 (Accession XM_044021). Accordingly, utilities of VGAM488 include diagnosis, prevention and treatment of diseases and clinical conditions associated with KIAA1615. UQCR (Accession NM_006830) is another VGAM488 host target gene. UQCR BINDING SITE is HOST TARGET binding site found in the 3" untranslated region of mRNA encoded by UQCR, corresponding to a HOST TARGET binding site such as BINDING SITE I, BINDING SITE II or BINDING SITE III. Table 2 illustrates the complementarity of the nucleotide sequences of UQCR BINDING SITE, designated SEQ ID:13711, to the nucleotide sequence of VGAM488 RNA, herein designated VGAM RNA, also designated SEQ ID:3199.

Another function of VGAM488 is therefore inhibition of UQCR (Accession NM_006830). Accordingly, utilities of VGAM488 include diagnosis, prevention and treatment of diseases and clinical conditions associated with UQCR. ZF5128 (Accession NM_014347) is another VGAM488 host target gene. ZF5128 BINDING SITE is HOST TARGET binding site found in the 3' untranslated region of mRNA encoded by ZF5128, corresponding to a HOST TARGET binding site such as BINDING SITE I, BINDING SITE II or BINDING SITE III. Table 2 illustrates the complementarity of the nucleotide sequences of ZF5128 BINDING SITE, designated SEQ ID:15670, to the nucleotide sequence of VGAM488 RNA, herein designated VGAM RNA, also designated SEQ ID:3199.

Another function of VGAM488 is therefore inhibition of ZF5128 (Accession NM_014347). Accordingly, utilities of VGAM488 include diagnosis, prevention and treatment of diseases and clinical conditions associated with ZF5128. LOC152273 (Accession XM_087429) is another VGAM488 host target gene. LOC152273 BINDING SITE is HOST TARGET binding site found in the 5' untranslated region of mRNA encoded by LOC152273, corresponding to a HOST TARGET binding site such as BINDING SITE I, BINDING SITE II or BINDING SITE III. Table 2 illustrates the complementarity of the nucleotide sequences of LOC152273 BINDING SITE, designated SEQ ID:39247, to the nucleotide sequence of VGAM488 RNA, herein designated VGAM RNA, also designated SEQ ID:3199.

Another function of VGAM488 is therefore inhibition of LOC152273 (Accession XM_087429). Accordingly, utilities of VGAM488 include diagnosis, prevention and treatment of diseases and clinical conditions associated with LOC152273. LOC157381 (Accession XM_098754) is another VGAM488 host target gene. LOC157381 BINDING SITE is HOST TARGET binding site found in the 5' untranslated region of mRNA encoded by LOC157381, corresponding to a HOST TARGET binding site such as BINDING SITE I, BINDING SITE II or BINDING SITE III. Table 2 illustrates the complementarity of the nucleotide sequences of LOC157381 BINDING SITE, designated SEQ ID:41790, to the nucleotide sequence of VGAM488 RNA, herein designated VGAM RNA, also designated SEQ ID:3199.

Another function of VGAM488 is therefore inhibition of LOC157381 (Accession XM_098754). Accordingly, utilities of VGAM488 include diagnosis, prevention and treatment of diseases and clinical conditions associated with LOC157381. LOC157753 (Accession XM_088381) is another VGAM488 host target gene. LOC157753 BINDING SITE is HOST TARGET binding site found in the 3' untranslated region of mRNA encoded by LOC157753, corresponding to a HOST TARGET binding site such as BINDING SITE I, BINDING SITE II or BINDING SITE III. Table 2 illustrates the complementarity of the nucleotide sequences of LOC157753 BINDING SITE, designated SEQ ID:39661, to the nucleotide sequence of VGAM488 RNA, herein designated VGAM RNA, also designated SEQ ID:3199.

Another function of VGAM488 is therefore inhibition of LOC157753 (Accession XM_088381). Accordingly, utilities of VGAM488 include diagnosis, prevention and treatment of diseases and clinical conditions associated with LOC157753. LOC221250 (Accession XM_166301) is another VGAM488 host target gene. LOC221250 BINDING SITE is HOST TARGET binding site found in the 5' untranslated region of mRNA encoded by LOC221250, corresponding to a HOST TARGET binding site such as BINDING SITE I, BINDING SITE II or BINDING SITE III. Table 2 illustrates the complementarity of the nucleotide sequences of LOC221250 BINDING SITE, designated SEQ ID:44121, to the nucleotide sequence of VGAM488 RNA, herein designated VGAM RNA, also designated SEQ ID:3199.

Another function of VGAM488 is therefore inhibition of LOC221250 (Accession XM_166301). Accordingly, utilities of VGAM488 include diagnosis, prevention and treatment of diseases and clinical conditions associated with LOC221250.

FIG. 1 further provides a conceptual description of a novel bioinformatically detected viral gene of the present invention, referred to here as Viral Genomic Address Messenger 489 (VGAM489) viral gene, which modulates expression of respective host target genes thereof, the function and utility of which host target genes is known in the art.

VGAM489 is a novel bioinformatically detected regulatory, non protein coding, viral micro RNA (miRNA) gene. The method by which VGAM489 was detected is described hereinabove with reference to FIGS. 1-8.

VGAM489 gene, herein designated VGAM GENE, is a viral gene contained in the genome of Hepatitis G Virus. VGAM489 host target gene, herein designated VGAM HOST TARGET GENE, is a human gene contained in the human genome.

VGAM489 gene encodes a VGAM489 precursor RNA, herein designated VGAM PRECURSOR RNA. Similar to other miRNA genes, and unlike most ordinary genes, VGAM489 precursor RNA does not encode a protein. A nucleotide sequence identical or highly similar to the nucleotide sequence of VGAM489 precursor RNA is designated SEQ ID:475, and is provided hereinbelow with reference to the sequence listing part. Nucleotide sequence SEQ ID:475 is located at position 8122 relative to the genome of Hepatitis G Virus.

VGAM489 precursor RNA folds onto itself, forming VGAM489 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM489 folded precursor RNA into VGAM489 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM489 RNA is designated SEQ ID:3200, and is provided hereinbelow with reference to the sequence listing part.

VGAM489 host target gene, herein designated VGAM HOST TARGET GENE, encodes a corresponding messenger RNA, VGAM489 host target RNA, herein designated VGAM HOST TARGET RNA. VGAM489 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM489 RNA, herein designated VGAM RNA, binds complementarily to one or more host target binding sites located in untranslated regions of VGAM489 host target RNA, herein designated VGAM HOST TARGET RNA. This complementary binding is due to the fact that the nucleotide sequence of VGAM489 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM489 RNA, herein designated VGAM RNA, may have a different number of host target binding sites in untranslated regions of a VGAM489 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM489 RNA, herein designated VGAM RNA, to host target binding sites on VGAM489 host target RNA, herein designated VGAM HOST TARGET RNA, such as BINDING SITE I, BINDING SITE II and BINDING SITE III, inhibits translation of VGAM489 host target RNA into VGAM489 host target protein, herein designated VGAM HOST TARGET PROTEIN. VGAM host target protein is therefore outlined by a broken line.

It is appreciated that VGAM489 host target gene, herein designated VGAM HOST TARGET GENE, in fact represents a plurality of VGAM489 host target genes. The mRNA of each one of this plurality of VGAM489 host target genes comprises one or more host target binding sites, each having a nucleotide sequence which is at least partly complementary to VGAM489 RNA, herein designated VGAM RNA, and which when bound by VGAM489 RNA causes inhibition of translation of respective one or more VGAM489 host target proteins.

It is further appreciated by one skilled in the art that the mode of translational inhibition illustrated by FIG. 1 with specific reference to translational inhibition exerted by VGAM489 gene, herein designated VGAM GENE, on one or more VGAM489 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM489 is inhibition of expression of host target genes, as part of a novel viral mechanism of attacking a host. Accordingly, utilities of VGAM489 include diagnosis, prevention and treatment of viral infection by Hepatitis G Virus. Specific functions, and accordingly utilities, of VGAM489 correlate with, and may be deduced from, the identity of the host target genes which VGAM489 binds and inhibits, and the function of these host target genes, as elaborated hereinbelow.

Nucleotide sequences of the VGAM489 precursor RNA, herein designated VGAM PRECURSOR RNA, and of the 'diced' VGAM489 RNA, herein designated VGAM RNA, and a schematic representation of the secondary folding of VGAM489 folded precursor RNA, herein designated VGAM FOLDED PRECURSOR RNA, of VGAM489 are further described hereinbelow with reference to Table 1.

Nucleotide sequences of host target binding sites, such as BINDING SITE-I, BINDING SITE-II and BINDING SITE-III of FIG. 1, found on VGAM489 host target RNA, and schematic representation of the complementarity of each of these host target binding sites to VGAM489 RNA, herein designated VGAM RNA, are described hereinbelow with reference to Table 2.

As mentioned hereinabove with reference to FIG. 1, a function of VGAM489 gene, herein designated VGAM is inhibition of expression of VGAM489 target genes. It is appreciated that specific functions, and accordingly utilities, of VGAM489 correlate with, and may be deduced from, the identity of the target genes which VGAM489 binds and inhibits, and the function of these target genes, as elaborated hereinbelow.

Active BCR-related Gene (ABR, Accession NM_001092) is a VGAM489 host target gene. ABR BINDING SITE1 and ABR BINDING SITE2 are HOST TARGET binding sites found in untranslated regions of mRNA encoded by ABR, corresponding to HOST TARGET binding sites such as BINDING SITE I, BINDING SITE II or BINDING SITE III. Table 2 illustrates the complementarity of the nucleotide sequences of ABR BINDING SITE1 and ABR BINDING SITE2, designated SEQ ID:6747 and SEQ ID:22492 respectively, to the nucleotide sequence of VGAM489 RNA, herein designated VGAM RNA, also designated SEQ ID:3200.

A function of VGAM489 is therefore inhibition of Active BCR-related Gene (ABR, Accession NM_001092), a gene which gtpase-activating protein for rac and cdc42. Accordingly, utilities of VGAM489 include diagnosis, prevention and treatment of diseases and clinical conditions associated with ABR. The function of ABR has been established by previous studies. Heisterkamp et al. (1989) described an active BCR-related gene (ABR) that they identified based on its homology with the BCR gene (OMIM Ref. No. 151410) located on chromosome 22. BCR is involved in reciprocal translocations with the ABL oncogene (OMIM Ref. No. 189980) on chromosome 9 in Philadelphia chromosome-positive chronic myelogenous leukemia. Heisterkamp et al. (1993) mapped the ABR gene to 17p13.3 by in situ hybridization techniques. McDonald et al. (1994) found that the ABR locus was deleted in 7 of 8 informative cases of medulloblastoma. Using pulsed field gel electrophoresis, they localized a polymorphic marker of the ABR gene to within 220 kb of D17S34. A cosmid contig constructed in this region was used to demonstrate by fluorescence in situ hybridization that the 5-prime to 3-prime transcriptional orientation of the ABR gene is toward the telomere.

Full details of the abovementioned studies are described in the following publications, the disclosure of which are hereby incorporated by reference:

Heisterkamp, N.; Kaartinen, V.; van Soest, S.; Bokoch, G. M.; Groffen, J.: Human ABR encodes a protein with GAP-rac activity and homology to the DBL nucleotide exchange factor domain. J. Biol. Chem. 268:16903-16906, 1993; and McDonald, J. D.; Daneshvar, L.; Willert, J. R.; Matsumura, K.; Waldman, F.; Cogen, P. H.: Physical mapping of chromosome 17p13.3 in the region of a putative tumor suppressor gene import.

Further studies establishing the function and utilities of ABR are found in John Hopkins OMIM database record ID 600365, and in sited publications numbered 7740-7742 listed in the bibliography section hereinbelow, which are also hereby incorporated by reference. Fibroblast Growth Factor Receptor 2 (bacteria-expressed kinase, keratinocyte growth factor receptor, craniofacial dysostosis 1, Crouzon syndrome, Pfeiffer syndrome, Jackson-Weiss syndrome) (FGFR2, Accession NM_000141) is another VGAM489 host target gene. FGFR2 BINDING SITE1 through FGFR2 BINDING SITE6 are HOST TARGET binding sites found in untranslated regions of mRNA encoded by FGFR2, corresponding to HOST TARGET binding sites such as BINDING SITE I, BINDING SITE II or BINDING SITE III. Table 2 illustrates the complementarity of the nucleotide sequences of FGFR2 BINDING SITE1 through FGFR2 BINDING SITE6, designated SEQ ID:5637, SEQ ID:23233, SEQ ID:23240, SEQ ID:23287, SEQ ID:23293 and SEQ ID:23299 respectively, to the nucleotide sequence of VGAM489 RNA, herein designated VGAM RNA, also designated SEQ ID:3200.

Another function of VGAM489 is therefore inhibition of Fibroblast Growth Factor Receptor 2 (bacteria-expressed kinase, keratinocyte growth factor receptor, craniofacial dysostosis 1, Crouzon syndrome, Pfeiffer syndrome, Jackson-Weiss syndrome) (FGFR2, Accession NM_000141). Accordingly, utilities of VGAM489 include diagnosis, prevention and treatment of diseases and clinical conditions associated with FGFR2. HTRA3 (Accession XM_114416) is another VGAM489 host target gene. HTRA3 BINDING SITE is HOST TARGET binding site found in the 3' untranslated region of mRNA encoded by HTRA3, corresponding to a HOST TARGET binding site such as BINDING SITE I, BINDING SITE II or BINDING SITE III. Table 2 illustrates the complementarity of the nucleotide sequences of HTRA3 BINDING SITE, designated SEQ ID:42937, to the nucleotide sequence of VGAM489 RNA, herein designated VGAM RNA, also designated SEQ ID:3200.

Another function of VGAM489 is therefore inhibition of HTRA3 (Accession XM_114416). Accordingly, utilities of VGAM489 include diagnosis, prevention and treatment of diseases and clinical conditions associated with HTRA3. Apolipoprotein L, 2 (APOL2, Accession NM_030882) is another VGAM489 host target gene. APOL2 BINDING SITE is HOST TARGET binding site found in the 3' untranslated region of mRNA encoded by APOL2, corresponding to a HOST TARGET binding site such as BINDING SITE I, BINDING SITE II or BINDING SITE III. Table 2 illustrates the complementarity of the nucleotide sequences of APOL2 BINDING SITE, designated SEQ ID:25158, to the nucleotide sequence of VGAM489 RNA, herein designated VGAM RNA, also designated SEQ ID:3200.

Another function of VGAM489 is therefore inhibition of Apolipoprotein L, 2 (APOL2, Accession NM_030882). Accordingly, utilities of VGAM489 include diagnosis, prevention and treatment of diseases and clinical conditions associated with APOL2. FLJ10900 (Accession XM_037744) is another VGAM489 host target gene. FLJ10900 BINDING SITE is HOST TARGET binding site found in the 5' untranslated region of mRNA encoded by FLJ10900, corresponding to a HOST TARGET binding site such as BINDING SITE I, BINDING SITE II or BINDING SITE III. Table 2 illustrates the complementarity of the nucleotide sequences of FLJ10900 BINDING SITE, designated SEQ ID:32668, to the nucleotide sequence of VGAM489 RNA, herein designated VGAM RNA, also designated SEQ ID:3200.

Another function of VGAM489 is therefore inhibition of FLJ10900 (Accession XM_037744). Accordingly, utilities of VGAM489 include diagnosis, prevention and treatment of diseases and clinical conditions associated with FLJ10900. FLJ12154 (Accession NM_021944) is another VGAM489 host target gene. FLJ12154 BINDING SITE is HOST TARGET binding site found in the 5' untranslated region of mRNA encoded by FLJ12154, corresponding to a HOST TARGET binding site such as BINDING SITE I, BINDING SITE II or BINDING SITE III. Table 2 illustrates the complementarity of the nucleotide sequences of FLJ12154 BINDING SITE, designated SEQ ID:22465, to the nucleotide sequence of VGAM489 RNA, herein designated VGAM RNA, also designated SEQ ID:3200.

Another function of VGAM489 is therefore inhibition of FLJ12154 (Accession NM_021944). Accordingly, utilities of VGAM489 include diagnosis, prevention and treatment of diseases and clinical conditions associated with FLJ12154. G Protein-coupled Receptor Kinase-interactor 2 (GIT2, Accession NM_057169) is another VGAM489 host target gene. GIT2 BINDING SITE1 through GIT2 BINDING SITE3 are HOST TARGET binding sites found in untranslated regions of mRNA encoded by GIT2, corresponding to HOST TARGET binding sites such as BINDING SITE I, BINDING SITE II or BINDING SITE III. Table 2 illustrates the complementarity of the nucleotide sequences of GIT2 BINDING SITE1 through GIT2 BINDING SITE3, designated SEQ ID:27682, SEQ ID:27695 and SEQ ID:16600 respectively, to the nucleotide sequence of VGAM489 RNA, herein designated VGAM RNA, also designated SEQ ID:3200.

Another function of VGAM489 is therefore inhibition of G Protein-coupled Receptor Kinase-interactor 2 (GIT2, Accession NM_057169). Accordingly, utilities of VGAM489 include diagnosis, prevention and treatment of diseases and clinical conditions associated with GIT2. KIAA0157 (Accession NM_032182) is another VGAM489 host target gene. KIAA0157 BINDING SITE is HOST TARGET binding site found in the 3' untranslated region of mRNA encoded by KIAA0157, corresponding to a HOST TARGET binding site such as BINDING SITE I, BINDING SITE II or BINDING SITE III. Table 2 illustrates the complementarity of the nucleotide sequences of KIAA0157 BINDING SITE, designated SEQ ID:25898, to the nucleotide sequence of VGAM489 RNA, herein designated VGAM RNA, also designated SEQ ID:3200.

Another function of VGAM489 is therefore inhibition of KIAA0157 (Accession NM_032182). Accordingly, utilities of VGAM489 include diagnosis, prevention and treatment of diseases and clinical conditions associated with KIAA0157. KIAA0258 (Accession NM_014785) is another VGAM489 host target gene. KIAA0258 BINDING SITE is HOST TARGET binding site found in the 3' untranslated region of mRNA encoded by KIAA0258, corresponding to a HOST TARGET binding site such as BINDING SITE I, BINDING SITE II or BINDING SITE III. Table 2 illustrates the complementarity of the nucleotide sequences of KIAA0258 BINDING SITE, designated SEQ ID:16640, to the nucleotide sequence of VGAM489 RNA, herein designated VGAM RNA, also designated SEQ ID:3200.

Another function of VGAM489 is therefore inhibition of KIAA0258 (Accession NM_014785). Accordingly, utilities of VGAM489 include diagnosis, prevention and treatment of diseases and clinical conditions associated with KIAA0258. SSB-3 (Accession NM_080861) is another VGAM489 host target gene. SSB-3 BINDING SITE is HOST TARGET binding site found in the 3' untranslated region of mRNA encoded by SSB-3, corresponding to a HOST TARGET binding site such as BINDING SITE I, BINDING SITE II or BINDING SITE III. Table 2 illustrates the complementarity of the nucleotide sequences of SSB-3 BINDING SITE, designated SEQ ID:28103, to the nucleotide sequence of VGAM489 RNA, herein designated VGAM RNA, also designated SEQ ID:3200.

Another function of VGAM489 is therefore inhibition of SSB-3 (Accession NM_080861). Accordingly, utilities of VGAM489 include diagnosis, prevention and treatment of diseases and clinical conditions associated with SSB-3. LOC143173 (Accession XM_016685) is another VGAM489 host target gene. LOC143173 BINDING SITE is HOST TARGET binding site found in the 5' untranslated region of mRNA encoded by LOC143173, corresponding to a HOST TARGET binding site such as BINDING SITE I, BINDING SITE II or BINDING SITE III. Table 2 illustrates the complementarity of the nucleotide sequences of LOC143173 BINDING SITE, designated SEQ ID:30270, to the nucleotide sequence of VGAM489 RNA, herein designated VGAM RNA, also designated SEQ ID:3200.

Another function of VGAM489 is therefore inhibition of LOC143173 (Accession XM_016685). Accordingly, utilities of VGAM489 include diagnosis, prevention and treatment of diseases and clinical conditions associated with LOC143173. LOC144266 (Accession XM_084795) is another VGAM489 host target gene. LOC144266 BINDING SITE is HOST TARGET binding site found in the 5' untranslated region of mRNA encoded by LOC144266, corresponding to a HOST TARGET binding site such as BINDING SITE I, BINDING SITE II or BINDING SITE III. Table 2 illustrates the complementarity of the nucleotide sequences of LOC144266 BINDING SITE, designated SEQ ID:37710, to the nucleotide sequence of VGAM489 RNA, herein designated VGAM RNA, also designated SEQ ID:3200.

Another function of VGAM489 is therefore inhibition of LOC144266 (Accession XM_084795). Accordingly, utilities of VGAM489 include diagnosis, prevention and treatment of diseases and clinical conditions associated with LOC144266. LOC145188 (Accession XM_085049) is another VGAM489 host target gene. LOC145188 BINDING SITE is HOST TARGET binding site found in the 3' untranslated region of mRNA encoded by LOC145188, corresponding to a HOST TARGET binding site such as BINDING SITE I, BINDING SITE II or BINDING SITE III. Table 2 illustrates the complementarity of the nucleotide sequences of LOC145188 BINDING SITE, designated SEQ ID:37809, to the nucleotide sequence of VGAM489 RNA, herein designated VGAM RNA, also designated SEQ ID:3200.

Another function of VGAM489 is therefore inhibition of LOC145188 (Accession XM_085049). Accordingly, utilities of VGAM489 include diagnosis, prevention and treatment of diseases and clinical conditions associated with LOC145188. LOC151701 (Accession XM_098109) is another VGAM489 host target gene. LOC151701 BINDING SITE is HOST TARGET binding site found in the 5' untranslated region of mRNA encoded by LOC151701, corresponding to a HOST TARGET binding site such as BINDING SITE I, BINDING SITE II or BINDING SITE III. Table 2 illustrates the complementarity of the nucleotide sequences of LOC151701 BINDING SITE, designated SEQ ID:41386, to the nucleotide sequence of VGAM489 RNA, herein designated VGAM RNA, also designated SEQ ID:3200.

Another function of VGAM489 is therefore inhibition of LOC151701 (Accession XM_098109). Accordingly, utilities of VGAM489 include diagnosis, prevention and treatment of diseases and clinical conditions associated with LOC151701. LOC92912 (Accession XM_047970) is another VGAM489 host target gene. LOC92912 BINDING SITE is HOST TARGET binding site found in the 3' untranslated region of mRNA encoded by LOC92912, corresponding to a HOST TARGET binding site such as BINDING SITE I, BINDING SITE II or BINDING SITE III. Table 2 illustrates the complementarity of the nucleotide sequences of LOC92912 BINDING SITE, designated SEQ ID:35084, to the nucleotide sequence of VGAM489 RNA, herein designated VGAM RNA, also designated SEQ ID:3200.

Another function of VGAM489 is therefore inhibition of LOC92912 (Accession XM_047970). Accordingly, utilities of VGAM489 include diagnosis, prevention and treatment of diseases and clinical conditions associated with LOC92912. FIG. 1 further provides a conceptual description of a novel bioinformatically detected viral gene of the present invention, referred to here as Viral Genomic Address Messenger 490 (VGAM490) viral gene, which modulates expression of respective host target genes thereof, the function and utility of which host target genes is known in the art.

VGAM490 is a novel bioinformatically detected regulatory, non protein coding, viral micro RNA (miRNA) gene. The method by which VGAM490 was detected is described hereinabove with reference to FIGS. 1-8.

VGAM490 gene, herein designated VGAM GENE, is a viral gene contained in the genome of Hepatitis G Virus. VGAM490 host target gene, herein designated VGAM HOST TARGET GENE, is a human gene contained in the human genome.

VGAM490 gene encodes a VGAM490 precursor RNA, herein designated VGAM PRECURSOR RNA. Similar to other miRNA genes, and unlike most ordinary genes, VGAM490 precursor RNA does not encode a protein. A nucleotide sequence identical or highly similar to the nucleotide sequence of VGAM490 precursor RNA is designated SEQ ID:476, and is provided hereinbelow with reference to the sequence listing part. Nucleotide sequence SEQ ID:476 is located at position 776 relative to the genome of Hepatitis G Virus.

VGAM490 precursor RNA folds onto itself, forming VGAM490 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM490 folded precursor RNA into VGAM490 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM490 RNA is designated SEQ ID:3201, and is provided hereinbelow with reference to the sequence listing part.

VGAM490 host target gene, herein designated VGAM HOST TARGET GENE, encodes a corresponding messenger RNA, VGAM490 host target RNA, herein designated VGAM HOST TARGET RNA. VGAM490 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM490 RNA, herein designated VGAM RNA, binds complementarily to one or more host target binding sites located in untranslated regions of VGAM490 host target RNA, herein designated VGAM HOST TARGET RNA. This complementary binding is due to the fact that the nucleotide sequence of VGAM490 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM490 RNA, herein designated VGAM RNA, may have a different number of host target binding sites in untranslated regions of a VGAM490 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM490 RNA, herein designated VGAM RNA, to host target binding sites on VGAM490 host target RNA, herein designated VGAM HOST TARGET RNA, such as BINDING SITE I, BINDING SITE II and BINDING SITE III, inhibits translation of VGAM490 host target RNA into VGAM490 host target protein, herein designated VGAM HOST TARGET PROTEIN. VGAM host target protein is therefore outlined by a broken line.

It is appreciated that VGAM490 host target gene, herein designated VGAM HOST TARGET GENE, in fact represents a plurality of VGAM490 host target genes. The mRNA of each one of this plurality of VGAM490 host target genes comprises one or more host target binding sites, each having a nucleotide sequence which is at least partly complementary to VGAM490 RNA, herein designated VGAM RNA, and which when bound by VGAM490 RNA causes inhibition of translation of respective one or more VGAM490 host target proteins.

It is further appreciated by one skilled in the art that the mode of translational inhibition illustrated by FIG. 1 with specific reference to translational inhibition exerted by VGAM490 gene, herein designated VGAM GENE, on one or more VGAM490 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM490 is inhibition of expression of host target genes, as part of a novel viral mechanism of attacking a host. Accordingly, utilities of VGAM490 include diagnosis, prevention and treatment of viral infection by Hepatitis G Virus. Specific functions, and accordingly utilities, of VGAM490 correlate with, and may be deduced from, the identity of the host target genes which VGAM490 binds and inhibits, and the function of these host target genes, as elaborated hereinbelow.

Nucleotide sequences of the VGAM490 precursor RNA, herein designated VGAM PRECURSOR RNA, and of the 'diced' VGAM490 RNA, herein designated VGAM RNA, and a schematic representation of the secondary folding of VGAM490 folded precursor RNA, herein designated VGAM FOLDED PRECURSOR RNA, of VGAM490 are further described hereinbelow with reference to Table 1.

Nucleotide sequences of host target binding sites, such as BINDING SITE-I, BINDING SITE-II and BINDING SITE-III of FIG. 1, found on VGAM490 host target RNA, and schematic representation of the complementarity of each of these host target binding sites to VGAM490 RNA, herein designated VGAM RNA, are described hereinbelow with reference to Table 2.

As mentioned hereinabove with reference to FIG. 1, a function of VGAM490 gene, herein designated VGAM is inhibition of expression of VGAM490 target genes. It is appreciated that specific functions, and accordingly utilities, of VGAM490 correlate with, and may be deduced from, the identity of the target genes which VGAM490 binds and inhibits, and the function of these target genes, as elaborated hereinbelow.

Adenylate Cyclase 2 (brain) (ADCY2, Accession XM_036383) is a VGAM490 host target gene. ADCY2 BINDING SITE is HOST TARGET binding site found in the 3' untranslated region of mRNA encoded by ADCY2, corresponding to a HOST TARGET binding site such as BINDING SITE I, BINDING SITE II or BINDING SITE III. Table 2 illustrates the complementarity of the nucleotide sequences of ADCY2 BINDING SITE, designated SEQ ID:32432, to the nucleotide sequence of VGAM490 RNA, herein designated VGAM RNA, also designated SEQ ID:3201.

A function of VGAM490 is therefore inhibition of Adenylate Cyclase 2 (brain) (ADCY2, Accession XM_036383), a gene which Adenylate cyclase (type 2), an ATP-pyrophosphate lyase; converts ATP to cAMP. Accordingly, utilities of VGAM490 include diagnosis, prevention and treatment of diseases and clinical conditions associated with ADCY2. The function of ADCY2 and its association with various diseases and clinical conditions, has been established by previous studies, as described hereinabove with reference to VGAM120. Myosin IIIA (MYO3A, Accession XM_011851) is another VGAM490 host target gene. MYO3A BINDING SITE is HOST TARGET binding site found in the 5" untranslated region of mRNA encoded by MYO3A, corresponding to a HOST TARGET binding site such as BINDING SITE I, BINDING SITE II or BINDING SITE III. Table 2 illustrates the complementarity of the nucleotide sequences of MYO3A BINDING SITE, designated SEQ ID:30196, to the nucleotide sequence of VGAM490 RNA, herein designated VGAM RNA, also designated SEQ ID:3201.

Another function of VGAM490 is therefore inhibition of Myosin IIIA (MYO3A, Accession XM_011851), a gene which may have a role in photoreceptor function and/or maintenance. Accordingly, utilities of VGAM490 include diagnosis, prevention and treatment of diseases and clinical conditions associated with MYO3A. The function of MYO3A has been established by previous studies. Actin-dependent motor proteins are members of the large myosin superfamily and are categorized into conventional myosins (class II) and unconventional myosins (classes I and III through XV) based on their variable C-terminal cargo-binding domains. Class III myosins, such as MYO3A, have a kinase domain N-terminal to the conserved N-terminal motor domains and are expressed in photoreceptors. Walsh et al. (2002) showed that normal hearing in human S requires myosin IIIA, which is the human homolog of NINAC, a class III myosin that is required for normal vision in Drosophila. In an extended Israeli family, they showed that nonsyndromic progressive hearing loss is caused by 3 different recessive, loss of function mutations in myosin IIIA. Of 18 affected relatives in this family, 7 were homozygous and 11 were compound heterozygous for pairs of mutant alleles. Expression of mammalian myosin IIIA is highly restricted, with the strongest expression in retina and cochlea. The involvement of homologous class III myosins in both Drosophila vision and human hearing is an evolutionary link between these sensory systems.

Full details of the abovementioned studies are described in the following publications, the disclosure of which are hereby incorporated by reference:

Dose, A. C.; Burnside, B.: Cloning and chromosomal localization of a human class III myosin. Genomics 67:333-342, 2000; and Walsh, T.; Walsh, V.; Vreugde, S.; Hertzano, R.; Shahin, H.; Haika, S.; Lee, M. K.; Kanaan, M.; King, M.-C.; Avraham, K. B.: From flies' eyes to our ears: mutations in a human class I.

Further studies establishing the function and utilities of MYO3A are found in John Hopkins OMIM database record ID 606808, and in sited publications numbered 6140-6141 listed in the bibliography section hereinbelow, which are also hereby incorporated by reference. Phospholipase A2, Group IID (PLA2G2D, Accession NM_012400) is another VGAM490 host target gene. PLA2G2D BINDING SITE is HOST TARGET binding site found in the 3' untranslated region of mRNA encoded by PLA2G2D, corresponding to a HOST TARGET binding site such as BINDING SITE I, BINDING SITE II or BINDING SITE III. Table 2 illustrates the complementarity of the nucleotide sequences of PLA2G2D BINDING SITE, designated SEQ ID:14766, to the nucleotide sequence of VGAM490 RNA, herein designated VGAM RNA, also designated SEQ ID:3201.

Another function of VGAM490 is therefore inhibition of Phospholipase A2, Group IID (PLA2G2D, Accession NM_012400), a gene which is involved in phospholipid digestion, remodeling of cell membranes, and host defense, as well as pathophysiologic processes. Accordingly, utilities of VGAM490 include diagnosis, prevention and treatment of diseases and clinical conditions associated with PLA2G2D. The function of PLA2G2D and its association with various diseases and clinical conditions, has been established by previous studies, as described hereinabove with reference to VGAM74. DKFZP564O0423 (Accession XM_166254) is another VGAM490 host target gene. DKFZP564O0423 BINDING SITE is HOST TARGET binding site found in the 3' untranslated region of mRNA encoded by DKFZP564O0423, corresponding to a HOST TARGET binding site such as BINDING SITE I, BINDING SITE II or BINDING SITE III. Table 2 illustrates the complementarity of the nucleotide sequences of DKFZP564O0423 BINDING SITE, designated SEQ ID:44062, to the nucleotide sequence of VGAM490 RNA, herein designated VGAM RNA, also designated SEQ ID:3201.

Another function of VGAM490 is therefore inhibition of DKFZP564O0423 (Accession XM_166254). Accordingly, utilities of VGAM490 include diagnosis, prevention and treatment of diseases and clinical conditions associated with DKFZP564O0423. FLJ14564 (Accession XM_084459) is another VGAM490 host target gene. FLJ14564 BINDING SITE is HOST TARGET binding site found in the 3' untranslated region of mRNA encoded by FLJ14564, corresponding to a HOST TARGET binding site such as BINDING SITE I, BINDING SITE II or BINDING SITE III. Table 2 illustrates the complementarity of the nucleotide sequences of FLJ14564 BINDING SITE, designated SEQ ID:37594, to the nucleotide sequence of VGAM490 RNA, herein designated VGAM RNA, also designated SEQ ID:3201.

Another function of VGAM490 is therefore inhibition of FLJ14564 (Accession XM_084459). Accordingly, utilities of VGAM490 include diagnosis, prevention and treatment of diseases and clinical conditions associated with FLJ14564. KIAA0514 (Accession NM_014696) is another VGAM490 host target gene. KIAA0514 BINDING SITE is HOST TARGET binding site found in the 3' untranslated region of mRNA encoded by KIAA0514, corresponding to a HOST TARGET binding site such as BINDING SITE I, BINDING SITE II or BINDING SITE III. Table 2 illustrates the complementarity of the nucleotide sequences of KIAA0514 BINDING SITE, designated SEQ ID:16201, to the nucleotide sequence of VGAM490 RNA, herein designated VGAM RNA, also designated SEQ ID:3201.

Another function of VGAM490 is therefore inhibition of KIAA0514 (Accession NM_014696). Accordingly, utilities of VGAM490 include diagnosis, prevention and treatment of diseases and clinical conditions associated with KIAA0514. KIAA1522 (Accession XM_036299) is another VGAM490 host target gene. KIAA1522 BINDING SITE is HOST TARGET binding site found in the 3' untranslated region of mRNA encoded by KIAA1522, corresponding to a HOST TARGET binding site such as BINDING SITE I, BINDING SITE II or BINDING SITE III. Table 2 illustrates the complementarity of the nucleotide sequences of KIAA1522 BINDING SITE, designated SEQ ID:32417, to the nucleotide sequence of VGAM490 RNA, herein designated VGAM RNA, also designated SEQ ID:3201.

Another function of VGAM490 is therefore inhibition of KIAA1522 (Accession XM_036299). Accordingly, utilities of VGAM490 include diagnosis, prevention and treatment of diseases and clinical conditions associated with KIAA1522. KIAA1535 (Accession XM_086565) is another VGAM490 host target gene. KIAA1535 BINDING SITE is HOST TARGET binding site found in the 3' untranslated region of mRNA encoded by KIAA1535, corresponding to a HOST TARGET binding site such as BINDING SITE I, BINDING SITE II or BINDING SITE III. Table 2 illustrates the complementarity of the nucleotide sequences of KIAA1535 BINDING SITE, designated SEQ ID:38766, to the nucleotide sequence of VGAM490 RNA, herein designated VGAM RNA, also designated SEQ ID:3201.

Another function of VGAM490 is therefore inhibition of KIAA1535 (Accession XM_086565). Accordingly, utilities of VGAM490 include diagnosis, prevention and treatment of diseases and clinical conditions associated with KIAA1535. KIAA1656 (Accession XM_038022) is another VGAM490 host target gene. KIAA1656 BINDING SITE is HOST TARGET binding site found in the 3' untranslated region of mRNA encoded by KIAA1656, corresponding to a HOST TARGET binding site such as BINDING SITE I, BINDING SITE II or BINDING SITE III. Table 2 illustrates the complementarity of the nucleotide sequences of KIAA1656 BINDING SITE, designated SEQ ID:32725, to the nucleotide sequence of VGAM490 RNA, herein designated VGAM RNA, also designated SEQ ID:3201.

Another function of VGAM490 is therefore inhibition of KIAA1656 (Accession XM_038022). Accordingly, utilities of VGAM490 include diagnosis, prevention and treatment of diseases and clinical conditions associated with KIAA1656. MAD4 (Accession NM_006454) is another VGAM490 host target gene. MAD4 BINDING SITE is HOST TARGET binding site found in the 3' untranslated region of mRNA encoded by MAD4, corresponding to a HOST TARGET binding site such as BINDING SITE I, BINDING SITE II or BINDING SITE III. Table 2 illustrates the complementarity of the nucleotide sequences of MAD4 BINDING SITE, designated SEQ ID:13169, to the nucleotide sequence of VGAM490 RNA, herein designated VGAM RNA, also designated SEQ ID:3201.

Another function of VGAM490 is therefore inhibition of MAD4 (Accession NM_006454). Accordingly, utilities of VGAM490 include diagnosis, prevention and treatment of diseases and clinical conditions associated with MAD4. NKX2B (Accession NM_002509) is another VGAM490 host target gene. NKX2B BINDING SITE is HOST TARGET binding site found in the 3' untranslated region of mRNA encoded by NKX2B, corresponding to a HOST TARGET binding site such as BINDING SITE I, BINDING SITE II or BINDING SITE III. Table 2 illustrates the complementarity of the nucleotide sequences of NKX2B BINDING SITE, designated SEQ ID:8342, to the nucleotide sequence of VGAM490 RNA, herein designated VGAM RNA, also designated SEQ ID:3201.

Another function of VGAM490 is therefore inhibition of NKX2B (Accession NM_002509). Accordingly, utilities of VGAM490 include diagnosis, prevention and treatment of diseases and clinical conditions associated with NKX2B. Target of Myb1 (chicken) (TOM1, Accession NM_005488) is another VGAM490 host target gene. TOM1 BINDING SITE is HOST TARGET binding site found in the 3' untranslated region of mRNA encoded by TOM1, corresponding to a HOST TARGET binding site such as BINDING SITE I, BINDING SITE II or BINDING SITE III. Table 2 illustrates the complementarity of the nucleotide sequences of TOM1 BINDING SITE, designated SEQ ID:11984, to the nucleotide sequence of VGAM490 RNA, herein designated VGAM RNA, also designated SEQ ID:3201.

Another function of VGAM490 is therefore inhibition of Target of Myb1 (chicken) (TOM1, Accession NM_005488). Accordingly, utilities of VGAM490 include diagnosis, prevention and treatment of diseases and clinical conditions associated with TOM1. TP53TG3 (Accession NM_015369) is another VGAM490 host target gene. TP53TG3 BINDING SITE is HOST TARGET binding site found in the 3' untranslated region of mRNA encoded by TP53TG3, corresponding to a HOST TARGET binding site such as BINDING SITE I, BINDING SITE II or BINDING SITE III. Table 2 illustrates the complementarity of the nucleotide sequences of TP53TG3 BINDING SITE, designated SEQ ID:17668, to the nucleotide sequence of VGAM490 RNA, herein designated VGAM RNA, also designated SEQ ID:3201.

Another function of VGAM490 is therefore inhibition of TP53TG3 (Accession NM_015369). Accordingly, utilities of VGAM490 include diagnosis, prevention and treatment of diseases and clinical conditions associated with TP53TG3. LOC149267 (Accession NM_138480) is another VGAM490 host target gene. LOC149267 BINDING SITE is HOST TARGET binding site found in the 3' untranslated region of mRNA encoded by LOC149267, corresponding to a HOST TARGET binding site such as BINDING SITE I, BINDING SITE II or BINDING SITE III. Table 2 illustrates the complementarity of the nucleotide sequences of LOC149267 BINDING SITE, designated SEQ ID:28830, to the nucleotide sequence of VGAM490 RNA, herein designated VGAM RNA, also designated SEQ ID:3201.

Another function of VGAM490 is therefore inhibition of LOC149267 (Accession NM_138480). Accordingly, utilities of VGAM490 include diagnosis, prevention and treatment of diseases and clinical conditions associated with LOC149267. LOC150960 (Accession XM_087059) is another VGAM490 host target gene. LOC150960 BINDING SITE is HOST TARGET binding site found in the 5' untranslated region of mRNA encoded by LOC150960, corresponding to a HOST TARGET binding site such as BINDING SITE I, BINDING SITE II or BINDING SITE III. Table 2 illustrates the complementarity of the nucleotide sequences of LOC150960 BINDING SITE, designated SEQ ID:39030, to the nucleotide sequence of VGAM490 RNA, herein designated VGAM RNA, also designated SEQ ID:3201.

Another function of VGAM490 is therefore inhibition of LOC150960 (Accession XM_087059). Accordingly, utilities of VGAM490 include diagnosis, prevention and treatment of diseases and clinical conditions associated with LOC150960. LOC164714 (Accession XM_104657) is another VGAM490 host target gene. LOC164714 BINDING SITE is HOST TARGET binding site found in the 3' untranslated region of mRNA encoded by LOC164714, corresponding to a HOST TARGET binding site such as BINDING SITE I, BINDING SITE II or BINDING SITE III. Table 2 illustrates the complementarity of the nucleotide sequences of LOC164714 BINDING SITE, designated SEQ ID:42175, to the nucleotide sequence of VGAM490 RNA, herein designated VGAM RNA, also designated SEQ ID:3201.

Another function of VGAM490 is therefore inhibition of LOC164714 (Accession XM_104657). Accordingly, utilities of VGAM490 include diagnosis, prevention and treatment of diseases and clinical conditions associated with LOC164714. LOC203292 (Accession XM_117527) is another VGAM490 host target gene. LOC203292 BINDING SITE is HOST TARGET binding site found in the 3' untranslated region of mRNA encoded by LOC203292, corresponding to a HOST TARGET binding site such as BINDING SITE I, BINDING SITE II or BINDING SITE III. Table 2 illustrates the complementarity of the nucleotide sequences of LOC203292 BINDING SITE, designated SEQ ID:43499, to the nucleotide sequence of VGAM490 RNA, herein designated VGAM RNA, also designated SEQ ID:3201.

Another function of VGAM490 is therefore inhibition of LOC203292 (Accession XM_117527). Accordingly, utilities of VGAM490 include diagnosis, prevention and treatment of diseases and clinical conditions associated with LOC203292. LOC257364 (Accession XM_170768) is another VGAM490 host target gene. LOC257364 BINDING SITE is HOST TARGET binding site found in the 3' untranslated region of mRNA encoded by LOC257364, corresponding to a HOST TARGET binding site such as BINDING SITE I, BINDING SITE II or BINDING SITE III. Table 2 illustrates the complementarity of the nucleotide sequences of LOC257364 BINDING SITE, designated SEQ ID:45524, to the nucleotide sequence of VGAM490 RNA, herein designated VGAM RNA, also designated SEQ ID:3201.

Another function of VGAM490 is therefore inhibition of LOC257364 (Accession XM_170768). Accordingly, utilities of VGAM490 include diagnosis, prevention and treatment of diseases and clinical conditions associated with LOC257364. FIG. 1 further provides a conceptual description of a novel bioinformatically detected viral gene of the present invention, referred to here as Viral Genomic Address Messenger 491 (VGAM491) viral gene, which modulates expression of respective host target genes thereof, the function and utility of which host target genes is known in the art.

VGAM491 is a novel bioinformatically detected regulatory, non protein coding, viral micro RNA (miRNA) gene. The method by which VGAM491 was detected is described hereinabove with reference to FIGS. 1-8.

VGAM491 gene, herein designated VGAM GENE, is a viral gene contained in the genome of Hepatitis G Virus. VGAM491 host target gene, herein designated VGAM HOST TARGET GENE, is a human gene contained in the human genome.

VGAM491 gene encodes a VGAM491 precursor RNA, herein designated VGAM PRECURSOR RNA. Similar to other miRNA genes, and unlike most ordinary genes, VGAM491 precursor RNA does not encode a protein. A nucleotide sequence identical or highly similar to the nucleotide sequence of VGAM491 precursor RNA is designated SEQ ID:477, and is provided hereinbelow with reference to the sequence listing part. Nucleotide sequence SEQ ID:477 is located at position 1627 relative to the genome of Hepatitis G Virus.

VGAM491 precursor RNA folds onto itself, forming VGAM491 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM491 folded precursor RNA into VGAM491 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM491 RNA is designated SEQ ID:3202, and is provided hereinbelow with reference to the sequence listing part.

VGAM491 host target gene, herein designated VGAM HOST TARGET GENE, encodes a corresponding messenger RNA, VGAM491 host target RNA, herein designated VGAM HOST TARGET RNA. VGAM491 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM491 RNA, herein designated VGAM RNA, binds complementarily to one or more host target binding sites located in untranslated regions of VGAM491 host target RNA, herein designated VGAM HOST TARGET RNA. This complementary binding is due to the fact that the nucleotide sequence of VGAM491 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM491 RNA, herein designated VGAM RNA, may have a different number of host target binding sites in untranslated regions of a VGAM491 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM491 RNA, herein designated VGAM RNA, to host target binding sites on VGAM491 host target RNA, herein designated VGAM HOST TARGET RNA, such as BINDING SITE I, BINDING SITE II and BINDING SITE III, inhibits translation of VGAM491 host target RNA into VGAM491 host target protein, herein designated VGAM HOST TARGET PROTEIN. VGAM host target protein is therefore outlined by a broken line.

It is appreciated that VGAM491 host target gene, herein designated VGAM HOST TARGET GENE, in fact represents a plurality of VGAM491 host target genes. The mRNA of each one of this plurality of VGAM491 host target genes comprises one or more host target binding sites, each having a nucleotide sequence which is at least partly complementary to VGAM491 RNA, herein designated VGAM RNA, and which when bound by VGAM491 RNA causes inhibition of translation of respective one or more VGAM491 host target proteins.

It is further appreciated by one skilled in the art that the mode of translational inhibition illustrated by FIG. 1 with specific reference to translational inhibition exerted by VGAM491 gene, herein designated VGAM GENE, on one or more VGAM491 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM491 is inhibition of expression of host target genes, as part of a novel viral mechanism of attacking a host. Accordingly, utilities of VGAM491 include diagnosis, prevention and treatment of viral infection by Hepatitis G Virus. Specific functions, and accordingly utilities, of VGAM491 correlate with, and may be deduced from, the identity of the host target genes which VGAM491 binds and inhibits, and the function of these host target genes, as elaborated hereinbelow.

Nucleotide sequences of the VGAM491 precursor RNA, herein designated VGAM PRECURSOR RNA, and of the 'diced' VGAM491 RNA, herein designated VGAM RNA, and a schematic representation of the secondary folding of VGAM491 folded precursor RNA, herein designated VGAM FOLDED PRECURSOR RNA, of VGAM491 are further described hereinbelow with reference to Table 1.

Nucleotide sequences of host target binding sites, such as BINDING SITE-I, BINDING SITE-II and BINDING SITE-III of FIG. 1, found on VGAM491 host target RNA, and schematic representation of the complementarity of each of these host target binding sites to VGAM491 RNA, herein designated VGAM RNA, are described hereinbelow with reference to Table 2.

As mentioned hereinabove with reference to FIG. 1, a function of VGAM491 gene, herein designated VGAM is inhibition of expression of VGAM491 target genes. It is appreciated that specific functions, and accordingly utilities, of VGAM491 correlate with, and may be deduced from, the identity of the target genes which VGAM491 binds and inhibits, and the function of these target genes, as elaborated hereinbelow.

Casein Kinase 1, Gamma 2 (CSNK1G2, Accession NM_001319) is a VGAM491 host target gene. CSNK1G2 BINDING SITE is HOST TARGET binding site found in the 3' untranslated region of mRNA encoded by CSNK1G2, corresponding to a HOST TARGET binding site such as BINDING SITE I, BINDING SITE II or BINDING SITE III. Table 2 illustrates the complementarity of the nucleotide sequences of CSNK1G2 BINDING SITE, designated SEQ ID:7007, to the nucleotide sequence of VGAM491 RNA, herein designated VGAM RNA, also designated SEQ ID:3202.

A function of VGAM491 is therefore inhibition of Casein Kinase 1, Gamma 2 (CSNK1G2, Accession NM_001319). Accordingly, utilities of VGAM491 include diagnosis, prevention and treatment of diseases and clinical conditions associated with CSNK1G2. KIAA0669 (Accession NM_014779) is another VGAM491 host target gene. KIAA0669 BINDING SITE is HOST TARGET binding site found in the 5' untranslated region of mRNA encoded by KIAA0669, corresponding to a HOST TARGET binding site such as BINDING SITE I, BINDING SITE II or BINDING SITE III. Table 2 illustrates the complementarity of the nucleotide sequences of KIAA0669 BINDING SITE, designated SEQ ID:16624, to the nucleotide sequence of VGAM491 RNA, herein designated VGAM RNA, also designated SEQ ID:3202.

Another function of VGAM491 is therefore inhibition of KIAA0669 (Accession NM_014779). Accordingly, utilities of VGAM491 include diagnosis, prevention and treatment of diseases and clinical conditions associated with KIAA0669. Zinc Finger Protein 36, C3H Type-like 2 (ZFP36L2, Accession NM_006887) is another VGAM491 host target gene. ZFP36L2 BINDING SITE is HOST TARGET binding site found in the 5' untranslated region of mRNA encoded by ZFP36L2, corresponding to a HOST TARGET binding site such as BINDING SITE I, BINDING SITE II or BINDING SITE III. Table 2 illustrates the complementarity of the nucleotide sequences of ZFP36L2 BINDING SITE, designated SEQ ID:13751, to the nucleotide sequence of VGAM491 RNA, herein designated VGAM RNA, also designated SEQ ID:3202.

Another function of VGAM491 is therefore inhibition of Zinc Finger Protein 36, C3H Type-like 2 (ZFP36L2, Accession NM_006887). Accordingly, utilities of VGAM491 include diagnosis, prevention and treatment of diseases and clinical conditions associated with ZFP36L2. LOC147929 (Accession XM_085961) is another VGAM491 host target gene. LOC147929 BINDING SITE is HOST TARGET binding site found in the 5' untranslated region of mRNA encoded by LOC147929, corresponding to a HOST TARGET binding site such as BINDING SITE I, BINDING SITE II or BINDING SITE III. Table 2 illustrates the complementarity of the nucleotide sequences of LOC147929 BINDING SITE, designated SEQ ID:38421, to the nucleotide sequence of VGAM491 RNA, herein designated VGAM RNA, also designated SEQ ID:3202.

Another function of VGAM491 is therefore inhibition of LOC147929 (Accession XM_085961). Accordingly, utilities of VGAM491 include diagnosis, prevention and treatment of diseases and clinical conditions associated with LOC147929. FIG. 1 further provides a conceptual description of a novel bioinformatically detected viral gene of the present invention, referred to here as Viral Genomic Address Messenger 492 (VGAM492) viral gene, which modulates expression of respective host target genes thereof, the function and utility of which host target genes is known in the art.

VGAM492 is a novel bioinformatically detected regulatory, non protein coding, viral micro RNA (miRNA) gene. The method by which VGAM492 was detected is described hereinabove with reference to FIGS. 1-8.

VGAM492 gene, herein designated VGAM GENE, is a viral gene contained in the genome of Hepatitis G Virus. VGAM492 host target gene, herein designated VGAM HOST TARGET GENE, is a human gene contained in the human genome.

VGAM492 gene encodes a VGAM492 precursor RNA, herein designated VGAM PRECURSOR RNA. Similar to other miRNA genes, and unlike most ordinary genes, VGAM492 precursor RNA does not encode a protein. A nucleotide sequence identical or highly similar to the nucleotide sequence of VGAM492 precursor RNA is designated SEQ ID:478, and is provided hereinbelow with reference to the sequence listing part. Nucleotide sequence SEQ ID:478 is located at position 4128 relative to the genome of Hepatitis G Virus.

VGAM492 precursor RNA folds onto itself, forming VGAM492 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM492 folded precursor RNA into VGAM492 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM492 RNA is designated SEQ ID:3203, and is provided hereinbelow with reference to the sequence listing part.

VGAM492 host target gene, herein designated VGAM HOST TARGET GENE, encodes a corresponding messenger RNA, VGAM492 host target RNA, herein designated VGAM HOST TARGET RNA. VGAM492 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM492 RNA, herein designated VGAM RNA, binds complementarily to one or more host target binding sites located in untranslated regions of VGAM492 host target RNA, herein designated VGAM HOST TARGET RNA. This complementary binding is due to the fact that the nucleotide sequence of VGAM492 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM492 RNA, herein designated VGAM RNA, may have a different number of host target binding sites in untranslated regions of a VGAM492 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM492 RNA, herein designated VGAM RNA, to host target binding sites on VGAM492 host target RNA, herein designated VGAM HOST TARGET RNA, such as BINDING SITE I, BINDING SITE II and BINDING SITE III, inhibits translation of VGAM492 host target RNA into VGAM492 host target protein, herein designated VGAM HOST TARGET PROTEIN. VGAM host target protein is therefore outlined by a broken line.

It is appreciated that VGAM492 host target gene, herein designated VGAM HOST TARGET GENE, in fact represents a plurality of VGAM492 host target genes. The mRNA of each one of this plurality of VGAM492 host target genes comprises one or more host target binding sites, each having a nucleotide sequence which is at least partly complementary to VGAM492 RNA, herein designated VGAM RNA, and which when bound by VGAM492 RNA causes inhibition of translation of respective one or more VGAM492 host target proteins.

It is further appreciated by one skilled in the art that the mode of translational inhibition illustrated by FIG. 1 with specific reference to translational inhibition exerted by VGAM492 gene, herein designated VGAM GENE, on one or more VGAM492 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM492 is inhibition of expression of host target genes, as part of a novel viral mechanism of attacking a host. Accordingly, utilities of VGAM492 include diagnosis, prevention and treatment of viral infection by Hepatitis G Virus. Specific functions, and accordingly utilities, of VGAM492 correlate with, and may be deduced from, the identity of the host target genes which VGAM492 binds and inhibits, and the function of these host target genes, as elaborated hereinbelow.

Nucleotide sequences of the VGAM492 precursor RNA, herein designated VGAM PRECURSOR RNA, and of the 'diced' VGAM492 RNA, herein designated VGAM RNA, and a schematic representation of the secondary folding of VGAM492 folded precursor RNA, herein designated VGAM FOLDED PRECURSOR RNA, of VGAM492 are further described hereinbelow with reference to Table 1.

Nucleotide sequences of host target binding sites, such as BINDING SITE-I, BINDING SITE-II and BINDING SITE-III of FIG. 1, found on VGAM492 host target RNA, and schematic representation of the complementarity of each of these host target binding sites to VGAM492 RNA, herein designated VGAM RNA, are described hereinbelow with reference to Table 2.

As mentioned hereinabove with reference to FIG. 1, a function of VGAM492 gene, herein designated VGAM is inhibition of expression of VGAM492 target genes. It is appreciated that specific functions, and accordingly utilities, of VGAM492 correlate with, and may be deduced from, the identity of the target genes which VGAM492 binds and inhibits, and the function of these target genes, as elaborated hereinbelow.

APG5 Autophagy 5-like (S. cerevisiae) (APG5L, Accession NM_004849) is a VGAM492 host target gene. APG5L BINDING SITE is HOST TARGET binding site found in the 5' untranslated region of mRNA encoded by APG5L, corresponding to a HOST TARGET binding site such as BINDING SITE I, BINDING SITE II or BINDING SITE III. Table 2 illustrates the complementarity of the nucleotide sequences of APG5L BINDING SITE, designated SEQ ID:11264, to the nucleotide sequence of VGAM492 RNA, herein designated VGAM RNA, also designated SEQ ID:3203.

A function of VGAM492 is therefore inhibition of APG5 Autophagy 5-like (S. cerevisiae) (APG5L, Accession NM_004849), a gene which conjugates to apg12 and associates with isolation membrane to form cup-shaped isolation membrane and autophagosome. Accordingly, utilities of VGAM492 include diagnosis, prevention and treatment of diseases and clinical conditions associated with APG5L. The function of APG5L has been established by previous studies. Apoptosis is an active form of cell death and is of fundamental importance in tissue development and homeostasis. Grand et al. (1995) observed that human and rodent cells undergoing apoptosis expressed high levels of a novel 45-kD protein, which they termed apoptosis-specific protein (ASP). They also found ASP in Burkitt lymphoma (OMIM Ref. No. 113970) cells and in adenovirus-transformed human and rat embryo cells induced into apoptosis by a variety of stimuli.

The authors did not detect ASP in viable cells or in cells dying passively by necrosis. Microscopy showed high levels of ASP in the cytoplasm of cells displaying the chromatin condensation and fragmentation patterns typical of apoptosis. The authors observed retention of ASP even when DNA was no longer detectable. Immunofluorescence staining indicated that ASP primarily colocalizes with, but is clearly distinct from, nonmuscle actin (e.g., 102560). Grand et al. (1995) concluded that ASP forms part of, or at least strongly associates with, a modified cytoskeleton unique to cells undergoing apoptosis. Hammond et al. (1998) found that ASP mRNA is present at similar levels in viable and apoptotic cells, whereas ASP protein levels are dramatically higher in apoptotic cells. They concluded that this increase in protein expression is due to increased translation of preexisting ASP mRNA. ASP protein expression is a relatively late event in the apoptotic process, occurring downstream of caspase activity.

Full details of the abovementioned studies are described in the following publications, the disclosure of which are hereby incorporated by reference:

Grand, R. J. A.; Milner, A. E.; Mustoe, T.; Johnson, G. D.; Owen, D.; Grant, M. L.; Gregory, C. D.: A novel protein expressed in mammalian cells undergoing apoptosis. Exp. Cell Res. 218:439-451, 1995; and Hammond, E. M.; Brunet, C. L.; Johnson, G. D.; Parkhill, J.; Milner, A. E.; Brady, G.; Gregory, C. D.; Grand, R. J. A.: Homology between a human apoptosis specific protein and the prod.

Further studies establishing the function and utilities of APG5L are found in John Hopkins OMIM database record ID 604261, and in sited publications numbered 742 and 7435-7436 listed in the bibliography section hereinbelow, which are also hereby incorporated by reference. Caspase Recruitment Domain Family, Member 4 (CARD4, Accession NM_006092) is another VGAM492 host target gene. CARD4 BINDING SITE is HOST TARGET binding site found in the 3' untranslated region of mRNA encoded by CARD4, corresponding to a HOST TARGET binding site such as BINDING SITE I, BINDING SITE II or BINDING SITE III. Table 2 illustrates the complementarity of the nucleotide sequences of CARD4 BINDING SITE, designated SEQ ID:12740, to the nucleotide sequence of VGAM492 RNA, herein designated VGAM RNA, also designated SEQ ID:3203.

Another function of VGAM492 is therefore inhibition of Caspase Recruitment Domain Family, Member 4 (CARD4, Accession NM_006092), a gene which Activates CASP9 to induce apoptosis, regulates activation of NF-kappaB. Accordingly, utilities of VGAM492 include diagnosis, prevention and treatment of diseases and clinical conditions associated with CARD4. The function of CARD4 has been established by previous studies. By searching a proprietary EST database for sequences encoding CARD motifs, followed by screening an endothelial cell cDNA library, Bertin et al. (1999) obtained a cDNA encoding CARD4. The deduced 953-amino acid CARD4 protein contains an N-terminal CARD motif, an NBD, and unlike APAF1, 10 tandem leucine-rich repeats in its C terminus. Northern blot analysis revealed abundant expression of a 4.5-kb transcript in adult heart, spleen, and lung, as well as in numerous cancer cell lines and fetal tissues. Yeast 2-hybrid analysis using the CARD domain of CARD4 as bait to screen breast, prostate, and brain cDNA libraries, as well as coimmunoprecipitation analysis, indicated preferential interaction with the CARD of RICK (RIPK2; 603455). Luciferase reporter analysis showed that the CARD domain of CARD4, but not that of APAF1, potently induces activation of nuclear factor kappa-B (see OMIM Ref. No. 164011), but not of JUN N-terminal kinase (see OMIM Ref. No. 601158), in a concentration-dependent manner. Using similar methods, Inohara et al. (1999) cloned and characterized CARD4, which they called NOD1. Northern blot analysis detected wide expression of NOD1. In situ hybridization analysis showed relatively restricted expression of Nod1 in day-15.5 mouse embryos. Confocal microscopy demonstrated that NOD1 is a cytosolic protein. Coimmunoprecipitation analysis revealed that NOD1 preferentially interacts with procaspases containing CARDs or death effector domains (DEDs), as well as with itself, RICK, and CLARP (CFLAR; 603599), but not with RAIDD (CRADD; 603454), APAF1, NIK (OMIM Ref. No. 604655), or other CARD- or DED-containing proteins. Functional analysis indicated that the CARD and NBD of NOD1, but not the LRR, enhance apoptosis induced by CASP9, but not by other caspases or CLARP. The CARD was found to be essential for NOD1 to bind and activate CASP9, as well as to promote apoptosis. Inohara et al. (1999) also observed that NOD1 interacts with RICK in NFKB activation.

Full details of the abovementioned studies are described in the following publications, the disclosure of which are hereby incorporated by reference:

Bertin, J.; Nir, W.-J.; Fischer, C. M.; Tayber, O. V.; Errada, P. R.; Grant, J. R.; Keilty, J. J.; Gosselin, M. L.; Robison, K. E.; Wong, G. H. W.; Glucksmann, M. A.; DiStefano, P. S.: Human CARD4 protein is a novel CED-4/Apaf-1 cell death family member that activates NF-kappa-B. J. Biol. Chem. 274:12955-12958, 1999; and Inohara, N.; Koseki, T.; del Peso, L.; Hu, Y.; Yee, C.; Chen, S.; Carrio, R.; Merino, J.; Liu, D.; Ni, J.; Nunez, G.: Nod1, an Apaf-1-like activator of caspase-9 and nuclear factor-ka.

Further studies establishing the function and utilities of CARD4 are found in John Hopkins OMIM database record ID 605980, and in sited publications numbered 6825 listed in the bibliography section hereinbelow, which are also hereby incorporated by reference. Cytoplasmic Linker 2 (CYLN2, Accession NM_003388) is another VGAM492 host target gene. CYLN2 BINDING SITE is HOST TARGET binding site found in the 3' untranslated region of mRNA encoded by CYLN2, corresponding to a HOST TARGET binding site such as BINDING SITE I, BINDING SITE II or BINDING SITE III. Table 2 illustrates the complementarity of the nucleotide sequences of CYLN2 BINDING SITE, designated SEQ ID:9424, to the nucleotide sequence of VGAM492 RNA, herein designated VGAM RNA, also designated SEQ ID:3203.

Another function of VGAM492 is therefore inhibition of Cytoplasmic Linker 2 (CYLN2, Accession NM_003388), a gene which associates with microtubules and dendritic lamellar bodies. Accordingly, utilities of VGAM492 include diagnosis, prevention and treatment of diseases and clinical conditions associated with CYLN2. The function of CYLN2 and its association with various diseases and clinical conditions, has been established by previous studies, as described hereinabove with reference to VGAM94. Deoxyribonuclease I (DNASE1, Accession NM_005223) is another VGAM492 host target gene. DNASE1 BINDING SITE is HOST TARGET binding site found in the 5' untranslated region of mRNA encoded by DNASE1, corresponding to a HOST TARGET binding site such as BINDING SITE I, BINDING SITE II or BINDING SITE III. Table 2 illustrates the complementarity of the nucleotide sequences of DNASE1 BINDING SITE, designated SEQ ID:11716, to the nucleotide sequence of VGAM492 RNA, herein designated VGAM RNA, also designated SEQ ID:3203.

Another function of VGAM492 is therefore inhibition of Deoxyribonuclease I (DNASE1, Accession NM_005223), a gene which seems to be involved in cell death. Accordingly, utilities of VGAM492 include diagnosis, prevention and treatment of diseases and clinical conditions associated with DNASE1. The function of DNASE1 has been established by previous studies. Systemic lupus erythematosus (SLE; 152700) is a multifactorial autoimmune disease that is said to affect more than 1 million people in the United States. SLE is characterized by the presence of antinuclear antibodies (ANA) directed against naked DNA and entire nucleosomes. It was thought that the resulting immune complexes accumulate in vessel walls, glomeruli, and joints and cause a hypersensitivity reaction type III that manifests as glomerulonephritis, arthritis, and generalized vasculitis. Several studies had suggested that increased liberation or disturbed clearance of nuclear DNA-protein complexes after cell death may initiate and propagate the disease. Consequently, DNASE1, which is a major nuclease present in serum, urine, and secreta, may be responsible for the removal of DNA from nuclear antigens at sites of high cell turnover and thus prevent SLE. To test this hypothesis, Napirei et al. (2000) generated Dnase1-deficient mice by gene targeting. They found that these animals show the classic symptoms of SLE, namely the presence of ANA, the deposition of immune complexes in glomeruli, and full-blown glomerulonephritis in a Dnase1 dose-dependent manner. Moreover, in agreement with earlier reports, they found Dnase1 activities in serum to be lower in SLE patients than in normal subjects. The findings suggested that lack or reduction of Dnase1 is a critical factor in the initiation of human SLE. In 2 females with systemic lupus erythematosus (OMIM Ref. No. 152700), Yasutomo et al. (2001) identified an A-to-G transition in exon 2 at position 172 of the DNASE1 coding sequence, which resulted in a lys-to-ter substitution at codon 5. These female patients, who were 13 and 17 years of age, respectively, were diagnosed as having SLE based on clinical features, high serum titers of antibodies against double-stranded DNA, and Sjogren syndrome. The 2 patients were unrelated and the family members did not have any signs or symptoms of SLE. The patients had substantially lower levels of DNASE1 activity in the sera than in other SLE patients without a DNASE1 mutation. However, the DNASE1 activity of SLE patients without DNASE1 mutations is lower than that of healthy controls. The patient's B cells had 30 to 50% of the DNASE1 activity of cells from controls, showing that heterozygous mutation of DNASE1 reduces the total activity of this enzyme.

Full details of the abovementioned studies are described in the following publications, the disclosure of which are hereby incorporated by reference:

Napirei, M.; Karsunky, H.; Zevnik, B.; Stephan, H.; Mannherz, H. G.; Moroy, T.: Features of systemic lupus erythematosus in Dnase1-deficient mice. Nature Genet. 25:177-181, 2000; and Yasutomo, K.; Horiuchi, T.; Kagami, S.; Tsukamoto, H.; Hashimura, C.; Urushihara, M.; Kuroda, Y.: Mutation of DNASE1 in people with systemic lupus erythematosus. Nature Genet. 28:31.

Further studies establishing the function and utilities of DNASE1 are found in John Hopkins OMIM database record ID 125505, and in sited publications numbered 3737-3743 listed in the bibliography section hereinbelow, which are also hereby incorporated by reference. Potassium Intermediate/small Conductance Calcium-activated Channel, Subfamily N, Member 4 (KCNN4, Accession NM_002250) is another VGAM492 host target gene. KCNN4 BINDING SITE is HOST TARGET binding site found in the 5' untranslated region of mRNA encoded by KCNN4, corresponding to a HOST TARGET binding site such as BINDING SITE I, BINDING SITE II or BINDING SITE III. Table 2 illustrates the complementarity of the nucleotide sequences of KCNN4 BINDING SITE, designated SEQ ID:8039, to the nucleotide sequence of VGAM492 RNA, herein designated VGAM RNA, also designated SEQ ID:3203.

Another function of VGAM492 is therefore inhibition of Potassium Intermediate/small Conductance Calcium-activated Channel, Subfamily N, Member 4 (KCNN4, Accession NM_002250), a gene which forms a voltage-independent potassium channel that is activated by intracellular calcium. Accordingly, utilities of VGAM492 include diagnosis, prevention and treatment of diseases and clinical conditions associated with KCNN4. The function of KCNN4 and its association with various diseases and clinical conditions, has been established by previous studies, as described hereinabove with reference to VGAM152. ARL8 (Accession XM_167671) is another VGAM492 host target gene. ARL8 BINDING SITE is HOST TARGET binding site found in the 5' untranslated region of mRNA encoded by ARL8, corresponding to a HOST TARGET binding site such as BINDING SITE I, BINDING SITE II or BINDING SITE III. Table 2 illustrates the complementarity of the nucleotide sequences of ARL8 BINDING SITE, designated SEQ ID:44764, to the nucleotide sequence of VGAM492 RNA, herein designated VGAM RNA, also designated SEQ ID:3203.

Another function of VGAM492 is therefore inhibition of ARL8 (Accession XM_167671). Accordingly, utilities of VGAM492 include diagnosis, prevention and treatment of diseases and clinical conditions associated with ARL8. Chromosome 17 Open Reading Frame 31 (C17orf31, Accession NM_017575) is another VGAM492 host target gene. C17orf31 BINDING SITE is HOST TARGET binding site found in the 3" untranslated region of mRNA encoded by C17orf31, corresponding to a HOST TARGET binding site such as BINDING SITE I, BINDING SITE II or BINDING SITE III. Table 2 illustrates the complementarity of the nucleotide sequences of C17orf31 BINDING SITE, designated SEQ ID:19007, to the nucleotide sequence of VGAM492 RNA, herein designated VGAM RNA, also designated SEQ ID:3203.

Another function of VGAM492 is therefore inhibition of Chromosome 17 Open Reading Frame 31 (C17orf31, Accession NM_017575). Accordingly, utilities of VGAM492 include diagnosis, prevention and treatment of diseases and clinical conditions associated with C17orf31. Diacylglycerol Kinase, Delta 130 kDa (DGKD, Accession XM_002384) is another VGAM492 host target gene. DGKD BINDING SITE is HOST TARGET binding site found in the 3' untranslated region of mRNA encoded by DGKD, corresponding to a HOST TARGET binding site such as BINDING SITE I, BINDING SITE II or BINDING SITE III. Table 2 illustrates the complementarity of the nucleotide sequences of DGKD BINDING SITE, designated SEQ ID:29887, to the nucleotide sequence of VGAM492 RNA, herein designated VGAM RNA, also designated SEQ ID:3203.

Another function of VGAM492 is therefore inhibition of Diacylglycerol Kinase, Delta 130 kDa (DGKD, Accession XM_002384). Accordingly, utilities of VGAM492 include diagnosis, prevention and treatment of diseases and clinical conditions associated with DGKD. KIAA1649 (Accession NM_032311) is another VGAM492 host target gene. KIAA1649 BINDING SITE is HOST TARGET binding site found in the 3' untranslated region of mRNA encoded by KIAA1649, corresponding to a HOST TARGET binding site such as BINDING SITE I, BINDING SITE II or BINDING SITE III. Table 2 illustrates the complementarity of the nucleotide sequences of KIAA1649 BINDING SITE, designated SEQ ID:26110, to the nucleotide sequence of VGAM492 RNA, herein designated VGAM RNA, also designated SEQ ID:3203.

Another function of VGAM492 is therefore inhibition of KIAA1649 (Accession NM_032311). Accordingly, utilities of VGAM492 include diagnosis, prevention and treatment of diseases and clinical conditions associated with KIAA1649. MBC3205 (Accession NM_033408) is another VGAM492 host target gene. MBC3205 BINDING SITE is HOST TARGET binding site found in the 5' untranslated region of mRNA encoded by MBC3205, corresponding to a HOST TARGET binding site such as BINDING SITE I, BINDING SITE II or BINDING SITE III. Table 2 illustrates the complementarity of the nucleotide sequences of MBC3205 BINDING SITE, designated SEQ ID:27225, to the nucleotide sequence of VGAM492 RNA, herein designated VGAM RNA, also designated SEQ ID:3203.

Another function of VGAM492 is therefore inhibition of MBC3205 (Accession NM_033408). Accordingly, utilities of VGAM492 include diagnosis, prevention and treatment of diseases and clinical conditions associated with MBC3205. Transducer of ERBB2, 2 (TOB2, Accession XM_170995) is another VGAM492 host target gene. TOB2 BINDING SITE is HOST TARGET binding site found in the 3' untranslated region of mRNA encoded by TOB2, corresponding to a HOST TARGET binding site such as BINDING SITE I, BINDING SITE II or BINDING SITE III. Table 2 illustrates the complementarity of the nucleotide sequences of TOB2 BINDING SITE, designated SEQ ID:45769, to the nucleotide sequence of VGAM492 RNA, herein designated VGAM RNA, also designated SEQ ID:3203.

Another function of VGAM492 is therefore inhibition of Transducer of ERBB2, 2 (TOB2, Accession XM_170995). Accordingly, utilities of VGAM492 include diagnosis, prevention and treatment of diseases and clinical conditions associated with TOB2. Target of Myb1 (chicken) (TOM1, Accession NM_005488) is another VGAM492 host target gene. TOM1 BINDING SITE is HOST TARGET binding site found in the 3' untranslated region of mRNA encoded by TOM1, corresponding to a HOST TARGET binding site such as BINDING SITE I, BINDING SITE II or BINDING SITE III. Table 2 illustrates the complementarity of the nucleotide sequences of TOM1 BINDING SITE, designated SEQ ID:11987, to the nucleotide sequence of VGAM492 RNA, herein designated VGAM RNA, also designated SEQ ID:3203.

Another function of VGAM492 is therefore inhibition of Target of Myb1 (chicken) (TOM1, Accession NM_005488). Accordingly, utilities of VGAM492 include diagnosis, prevention and treatment of diseases and clinical conditions associated with TOM1. LOC144667 (Accession XM_096648) is another VGAM492 host target gene. LOC144667 BINDING SITE is HOST TARGET binding site found in the 5' untranslated region of mRNA encoded by LOC144667, corresponding to a HOST TARGET binding site such as BINDING SITE I, BINDING SITE II or BINDING SITE III. Table 2 illustrates the complementarity of the nucleotide sequences of LOC144667 BINDING SITE, designated SEQ ID:40452, to the nucleotide sequence of VGAM492 RNA, herein designated VGAM RNA, also designated SEQ ID:3203.

Another function of VGAM492 is therefore inhibition of LOC144667 (Accession XM_096648). Accordingly, utilities of VGAM492 include diagnosis, prevention and treatment of diseases and clinical conditions associated with LOC144667. LOC220370 (Accession XM_166943) is another VGAM492 host target gene. LOC220370 BINDING SITE is HOST TARGET binding site found in the 3' untranslated region of mRNA encoded by LOC220370, corresponding to a HOST TARGET binding site such as BINDING SITE I, BINDING SITE II or BINDING SITE III. Table 2 illustrates the complementarity of the nucleotide sequences of LOC220370 BINDING SITE, designated SEQ ID:44599, to the nucleotide sequence of VGAM492 RNA, herein designated VGAM RNA, also designated SEQ ID:3203.

Another function of VGAM492 is therefore inhibition of LOC220370 (Accession XM_166943). Accordingly, utilities of VGAM492 include diagnosis, prevention and treatment of diseases and clinical conditions associated with LOC220370. LOC222255 (Accession XM_168616) is another VGAM492 host target gene. LOC222255 BINDING SITE is HOST TARGET binding site found in the 5' untranslated region of mRNA encoded by LOC222255, corresponding to a HOST TARGET binding site such as BINDING SITE I, BINDING SITE II or BINDING SITE III. Table 2 illustrates the complementarity of the nucleotide sequences of LOC222255 BINDING SITE, designated SEQ ID:45272, to the nucleotide sequence of VGAM492 RNA, herein designated VGAM RNA, also designated SEQ ID:3203.

Another function of VGAM492 is therefore inhibition of LOC222255 (Accession XM_168616). Accordingly, utilities of VGAM492 include diagnosis, prevention and treatment of diseases and clinical conditions associated with LOC222255. LOC253070 (Accession XM_173088) is another VGAM492 host target gene. LOC253070 BINDING SITE is HOST TARGET binding site found in the 3' untranslated region of mRNA encoded by LOC253070, corresponding to a HOST TARGET binding site such as BINDING SITE I, BINDING SITE II or BINDING SITE III. Table 2 illustrates the complementarity of the nucleotide sequences of LOC253070 BINDING SITE, designated SEQ ID:46354, to the nucleotide sequence of VGAM492 RNA, herein designated VGAM RNA, also designated SEQ ID:3203.

Another function of VGAM492 is therefore inhibition of LOC253070 (Accession XM_173088). Accordingly, utilities of VGAM492 include diagnosis, prevention and treatment of diseases and clinical conditions associated with LOC253070. LOC257054 (Accession XM_171010) is another VGAM492 host target gene. LOC257054 BINDING SITE is HOST TARGET binding site found in the 3' untranslated region of mRNA encoded by LOC257054, corresponding to a HOST TARGET binding site such as BINDING SITE I, BINDING SITE II or BINDING SITE III. Table 2 illustrates the complementarity of the nucleotide sequences of LOC257054 BINDING SITE, designated SEQ ID:45783, to the nucleotide sequence of VGAM492 RNA, herein designated VGAM RNA, also designated SEQ ID:3203.

Another function of VGAM492 is therefore inhibition of LOC257054 (Accession XM_171010). Accordingly, utilities of VGAM492 include diagnosis, prevention and treatment of diseases and clinical conditions associated with LOC257054. LOC93259 (Accession XM_050105) is another VGAM492 host target gene. LOC93259 BINDING SITE is HOST TARGET binding site found in the 5' untranslated region of mRNA encoded by LOC93259, corresponding to a HOST TARGET binding site such as BINDING SITE I, BINDING SITE II or BINDING SITE III. Table 2 illustrates the complementarity of the nucleotide sequences of LOC93259 BINDING SITE, designated SEQ ID:35558, to the nucleotide sequence of VGAM492 RNA, herein designated VGAM RNA, also designated SEQ ID:3203.

Another function of VGAM492 is therefore inhibition of LOC93259 (Accession XM_050105). Accordingly, utilities of VGAM492 include diagnosis, prevention and treatment of diseases and clinical conditions associated with LOC93259. FIG. 1 further provides a conceptual description of a novel bioinformatically detected viral gene of the present invention, referred to here as Viral Genomic Address Messenger 493 (VGAM493) viral gene, which modulates expression of respective host target genes thereof, the function and utility of which host target genes is known in the art.

VGAM493 is a novel bioinformatically detected regulatory, non protein coding, viral micro RNA (miRNA) gene. The method by which VGAM493 was detected is described hereinabove with reference to FIGS. 1-8.

VGAM493 gene, herein designated VGAM GENE, is a viral gene contained in the genome of Hepatitis G Virus. VGAM493 host target gene, herein designated VGAM HOST TARGET GENE, is a human gene contained in the human genome.

VGAM493 gene encodes a VGAM493 precursor RNA, herein designated VGAM PRECURSOR RNA. Similar to other miRNA genes, and unlike most ordinary genes, VGAM493 precursor RNA does not encode a protein. A nucleotide sequence identical or highly similar to the nucleotide sequence of VGAM493 precursor RNA is designated SEQ ID:479, and is provided hereinbelow with reference to the sequence listing part. Nucleotide sequence SEQ ID:479 is located at position 7135 relative to the genome of Hepatitis G Virus.

VGAM493 precursor RNA folds onto itself, forming VGAM493 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM493 folded precursor RNA into VGAM493 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM493 RNA is designated SEQ ID:3204, and is provided hereinbelow with reference to the sequence listing part.

VGAM493 host target gene, herein designated VGAM HOST TARGET GENE, encodes a corresponding messenger RNA, VGAM493 host target RNA, herein designated VGAM HOST TARGET RNA. VGAM493 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM493 RNA, herein designated VGAM RNA, binds complementarily to one or more host target binding sites located in untranslated regions of VGAM493 host target RNA, herein designated VGAM HOST TARGET RNA. This complementary binding is due to the fact that the nucleotide sequence of VGAM493 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM493 RNA, herein designated VGAM RNA, may have a different number of host target binding sites in untranslated regions of a VGAM493 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM493 RNA, herein designated VGAM RNA, to host target binding sites on VGAM493 host target RNA, herein designated VGAM HOST TARGET RNA, such as BINDING SITE I, BINDING SITE II and BINDING SITE III, inhibits translation of VGAM493 host target RNA into VGAM493 host target protein, herein designated VGAM HOST TARGET PROTEIN. VGAM host target protein is therefore outlined by a broken line.

It is appreciated that VGAM493 host target gene, herein designated VGAM HOST TARGET GENE, in fact represents a plurality of VGAM493 host target genes. The mRNA of each one of this plurality of VGAM493 host target genes comprises one or more host target binding sites, each having a nucleotide sequence which is at least partly complementary to VGAM493 RNA, herein designated VGAM RNA, and which when bound by VGAM493 RNA causes inhibition of translation of respective one or more VGAM493 host target proteins.

It is further appreciated by one skilled in the art that the mode of translational inhibition illustrated by FIG. 1 with specific reference to translational inhibition exerted by VGAM493 gene, herein designated VGAM GENE, on one or more VGAM493 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM493 is inhibition of expression of host target genes, as part of a novel viral mechanism of attacking a host. Accordingly, utilities of VGAM493 include diagnosis, prevention and treatment of viral infection by Hepatitis G Virus. Specific functions, and accordingly utilities, of VGAM493 correlate with, and may be deduced from, the identity of the host target genes which VGAM493 binds and inhibits, and the function of these host target genes, as elaborated hereinbelow.

Nucleotide sequences of the VGAM493 precursor RNA, herein designated VGAM PRECURSOR RNA, and of the 'diced' VGAM493 RNA, herein designated VGAM RNA, and a schematic representation of the secondary folding of VGAM493 folded precursor RNA, herein designated VGAM FOLDED PRECURSOR RNA, of VGAM493 are further described hereinbelow with reference to Table 1.

Nucleotide sequences of host target binding sites, such as BINDING SITE-I, BINDING SITE-II and BINDING SITE-III of FIG. 1, found on VGAM493 host target RNA, and schematic representation of the complementarity of each of these host target binding sites to VGAM493 RNA, herein designated VGAM RNA, are described hereinbelow with reference to Table 2.

As mentioned hereinabove with reference to FIG. 1, a function of VGAM493 gene, herein designated VGAM is inhibition of expression of VGAM493 target genes. It is appreciated that specific functions, and accordingly utilities, of VGAM493 correlate with, and may be deduced from, the identity of the target genes which VGAM493 binds and inhibits, and the function of these target genes, as elaborated hereinbelow.

Eukaryotic Translation Initiation Factor 1A (EIF1A, Accession XM_114147) is a VGAM493 host target gene. EIF1A BINDING SITE is HOST TARGET binding site found in the 5' untranslated region of mRNA encoded by EIF1A, corresponding to a HOST TARGET binding site such as BINDING SITE I, BINDING SITE II or BINDING SITE III. Table 2 illustrates the complementarity of the nucleotide sequences of EIF1A BINDING SITE, designated SEQ ID:42726, to the nucleotide sequence of VGAM493 RNA, herein designated VGAM RNA, also designated SEQ ID:3204.

A function of VGAM493 is therefore inhibition of Eukaryotic Translation Initiation Factor 1A (EIF1A, Accession XM_114147), a gene which seems to be required for maximal rate of protein biosynthesis. Accordingly, utilities of VGAM493 include diagnosis, prevention and treatment of diseases and clinical conditions associated with EIF1A. The function of EIF1A and its association with various diseases and clinical conditions, has been established by previous studies, as described hereinabove with reference to VGAM120. Fc Fragment of IgG, Low Affinity IIa, Receptor For (CD32) (FCGR2A, Accession XM_086483) is another VGAM493 host target gene. FCGR2A BINDING SITE is HOST TARGET binding site found in the 3' untranslated region of mRNA encoded by FCGR2A, corresponding to a HOST TARGET binding site such as BINDING SITE I, BINDING SITE II or BINDING SITE III. Table 2 illustrates the complementarity of the nucleotide sequences of FCGR2A BINDING SITE, designated SEQ ID:38701, to the nucleotide sequence of VGAM493 RNA, herein designated VGAM RNA, also designated SEQ ID:3204.

Another function of VGAM493 is therefore inhibition of Fc Fragment of IgG, Low Affinity IIa, Receptor For (CD32) (FCGR2A, Accession XM_086483), a gene which binds IgG immune complexes; member of the immunoglobulin superfamily. Accordingly, utilities of VGAM493 include diagnosis, prevention and treatment of diseases and clinical conditions associated with FCGR2A. The function of FCGR2A and its association with various diseases and clinical conditions, has been established by previous studies, as described hereinabove with reference to VGAM444. Ficolin (collagen/fibrinogen domain containing lectin) 2 (hucolin) (FCN2, Accession NM_015839) is another VGAM493 host target gene. FCN2 BINDING SITE is HOST TARGET binding site found in the 3' untranslated region of mRNA encoded by FCN2, corresponding to a HOST TARGET binding site such as BINDING SITE I, BINDING SITE II or BINDING SITE III. Table 2 illustrates the complementarity of the nucleotide sequences of FCN2 BINDING SITE, designated SEQ ID:17952, to the nucleotide sequence of VGAM493 RNA, herein designated VGAM RNA, also designated SEQ ID:3204.

Another function of VGAM493 is therefore inhibition of Ficolin (collagen/fibrinogen domain containing lectin) 2 (hucolin) (FCN2, Accession NM_015839), a gene which is involved in phagocytosis of pathogens. Accordingly, utilities of VGAM493 include diagnosis, prevention and treatment of diseases and clinical conditions associated with FCN2. The function of FCN2 has been established by previous studies. Matsushita et al. (1996) reported the cloning and characterization of P35, a human lectin with collagen and fibrinogen domains. The P35 gene encodes ficolin 2 (FCN2). Endo et al. (1996) isolated genomic clones for P35 and a related gene shown to be identical to ficolin 1 (OMIM Ref. No. 601252). Endo et al. (1996) mapped both genes to 9q34 by fluorescence in situ hybridization.

Full details of the abovementioned studies are described in the following publications, the disclosure of which are hereby incorporated by reference:

Endo, Y.; Sato, Y.; Matsushita, M.; Fujita, T.: Cloning and characterization of the human lectin P35 gene and its related gene. Genomics 36:515-521, 1996; and Matsushita, M.; Endo, Y.; Taira, S.; Sato, Y.; Fujita, T.; Ichikawa, N.; Nakata, M.; Misuochi, T.: A novel human lectin with collagen- and fibrinogen-like domains which functions as an.

Further studies establishing the function and utilities of FCN2 are found in John Hopkins OMIM database record ID 601624, and in sited publications numbered 9383 listed in the bibliography section hereinbelow, which are also hereby incorporated by reference. Phosphorylase, Glycogen; Brain (PYGB, Accession NM_002862) is another VGAM493 host target gene. PYGB BINDING SITE is HOST TARGET binding site found in the 3' untranslated region of mRNA encoded by PYGB, corresponding to a HOST TARGET binding site such as BINDING SITE I, BINDING SITE II or BINDING SITE III. Table 2 illustrates the complementarity of the nucleotide sequences of PYGB BINDING SITE, designated SEQ ID:8766, to the nucleotide sequence of VGAM493 RNA, herein designated VGAM RNA, also designated SEQ ID:3204.

Another function of VGAM493 is therefore inhibition of Phosphorylase, Glycogen; Brain (PYGB, Accession NM_002862). Accordingly, utilities of VGAM493 include diagnosis, prevention and treatment of diseases and clinical conditions associated with PYGB. Solute Carrier Family 22 (organic cation transporter), Member 5 (SLC22A5, Accession NM_003060) is another VGAM493 host target gene. SLC22A5 BINDING SITE is HOST TARGET binding site found in the 5' untranslated region of mRNA encoded by SLC22A5, corresponding to a HOST TARGET binding site such as BINDING SITE I, BINDING SITE II or BINDING SITE III. Table 2 illustrates the complementarity of the nucleotide sequences of SLC22A5 BINDING SITE, designated SEQ ID:9025, to the nucleotide sequence of VGAM493 RNA, herein designated VGAM RNA, also designated SEQ ID:3204.

Another function of VGAM493 is therefore inhibition of Solute Carrier Family 22 (organic cation transporter), Member 5 (SLC22A5, Accession NM_003060). Accordingly, utilities of VGAM493 include diagnosis, prevention and treatment of diseases and clinical conditions associated with SLC22A5. Solute Carrier Family 9 (sodium/hydrogen exchanger), Isoform 6 (SLC9A6, Accession NM_006359) is another VGAM493 host target gene. SLC9A6 BINDING SITE is HOST TARGET binding site found in the 3' untranslated region of mRNA encoded by SLC9A6, corresponding to a HOST TARGET binding site such as BINDING SITE I, BINDING SITE II or BINDING SITE III. Table 2 illustrates the complementarity of the nucleotide sequences of SLC9A6 BINDING SITE, designated SEQ ID:13054, to the nucleotide sequence of VGAM493 RNA, herein designated VGAM RNA, also designated SEQ ID:3204.

Another function of VGAM493 is therefore inhibition of Solute Carrier Family 9 (sodium/hydrogen exchanger), Isoform 6 (SLC9A6, Accession NM_006359), a gene which is involved electroneutral exchange of protons for na+ and k+ across the mitochondrial inner membrane. Accordingly, utilities of VGAM493 include diagnosis, prevention and treatment of diseases and clinical conditions associated with SLC9A6. The function of SLC9A6 has been established by previous studies. By searching sequence databases for proteins with sequence similarity to the S. cerevisiae mitochondrial sodium/hydrogen exchanger Nha2, Numata et al. (1998) identified the deduced protein product of the KIAA0267 cDNA (Nagase et al., 1996), SLC9A6. The KIAA0267-encoded protein shares 30% amino acid sequence identity with S. cerevisiae Nha2, and approximately 20 to 24% identity with the mammalian NHE isoforms NHE1 to NHE5 (see OMIM Ref. No. SLC9A5; 600477). Numata et al. (1998), who concluded that the KIAA0267 cDNA lacks 5-prime coding sequence, isolated a human cDNA containing the complete coding sequence of SLC9A6, which they called NHE6. The deduced 669-amino acid SLC9A6 protein has 12 putative membrane-spanning segments within the N-terminal region, and a hydrophilic C terminus, similar to the topologies predicted for other NHEs. In addition, SLC9A6 has a putative mitochondrial inner membrane targeting signal at its N terminus. Northern blot analysis detected an approximately 5.5-kb SLC9A6 transcript that was ubiquitously expressed, with the most abundant expression in mitochondrion-rich tissues such as brain, skeletal muscle, and heart. Fluorescence microscopy suggested that SLC9A6 localizes to mitochondria. Numata et al. (1998) deleted the S. cerevisiae NHA2 gene by homologous disruption and found that benzamil-inhibitable, acid-activated sodium uptake into mitochondria was abolished in the mutant strain. The mutant strain also showed retarded growth on nonfermentable carbon sources and severely reduced survival during the stationary phase of the cell cycle compared with the parental strain, consistent with a defect in aerobic metabolism. The authors suggested that Nha2 and SLC9A6 are homologous sodium/hydrogen exchangers that are important for mitochondrial function.

Full details of the abovementioned studies are described in the following publications, the disclosure of which are hereby incorporated by reference:

Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human genes. VI. The coding sequences of 80 new genes (KIAA0201-KIAA0280) deduced by analysis of cDNA clones from cell line KG-1 and brain. DNA Res. 3:321-329, 1996. Note: Supplement: DNA Res. 3:341-354, 1996; and Numata, M.; Petrecca, K.; Lake, N.; Orlowski, J.: Identification of a mitochondrial Na+/H+ exchanger. J. Biol. Chem. 273:6951-6959, 1998.

Further studies establishing the function and utilities of SLC9A6 are found in John Hopkins OMIM database record ID 300231, and in sited publications numbered 9011-9012 listed in the bibliography section hereinbelow, which are also hereby incorporated by reference. SRGAP1 (Accession XM_051143) is another VGAM493 host target gene. SRGAP1 BINDING SITE is HOST TARGET binding site found in the 3' untranslated region of mRNA encoded by SRGAP1, corresponding to a HOST TARGET binding site such as BINDING SITE I, BINDING SITE II or BINDING SITE III. Table 2 illustrates the complementarity of the nucleotide sequences of SRGAP1 BINDING SITE, designated SEQ ID:35756, to the nucleotide sequence of VGAM493 RNA, herein designated VGAM RNA, also designated SEQ ID:3204.

Another function of VGAM493 is therefore inhibition of SRGAP1 (Accession XM_051143). Accordingly, utilities of VGAM493 include diagnosis, prevention and treatment of diseases and clinical conditions associated with SRGAP1. Transient Receptor Potential Cation Channel, Subfamily C, Member 6 (TRPC6, Accession NM_004621) is another VGAM493 host target gene. TRPC6 BINDING SITE is HOST TARGET binding site found in the 3' untranslated region of mRNA encoded by TRPC6, corresponding to a HOST TARGET binding site such as BINDING SITE I, BINDING SITE II or BINDING SITE III. Table 2 illustrates the complementarity of the nucleotide sequences of TRPC6 BINDING SITE, designated SEQ ID:10981, to the nucleotide sequence of VGAM493 RNA, herein designated VGAM RNA, also designated SEQ ID:3204.

Another function of VGAM493 is therefore inhibition of Transient Receptor Potential Cation Channel, Subfamily C, Member 6 (TRPC6, Accession NM_004621), a gene which has calcium channel activity. Accordingly, utilities of VGAM493 include diagnosis, prevention and treatment of diseases and clinical conditions associated with TRPC6. The function of TRPC6 and its association with various diseases and clinical conditions, has been established by previous studies, as described hereinabove with reference to VGAM25. Chromosome 7 Open Reading Frame 13 (C7orf13, Accession NM_032625) is another VGAM493 host target gene. C7orf13 BINDING SITE is HOST TARGET binding site found in the 5' untranslated region of mRNA encoded by C7orf13, corresponding to a HOST TARGET binding site such as BINDING SITE I, BINDING SITE II or BINDING SITE III. Table 2 illustrates the complementarity of the nucleotide sequences of C7orf13 BINDING SITE, designated SEQ ID:26344, to the nucleotide sequence of VGAM493 RNA, herein designated VGAM RNA, also designated SEQ ID:3204.

Another function of VGAM493 is therefore inhibition of Chromosome 7 Open Reading Frame 13 (C7orf13, Accession NM_032625). Accordingly, utilities of VGAM493 include diagnosis, prevention and treatment of diseases and clinical conditions associated with C7orf13. DKFZp547E052 (Accession NM_032276) is another VGAM493 host target gene. DKFZp547E052 BINDING SITE is HOST TARGET binding site found in the 3' untranslated region of mRNA encoded by DKFZp547E052, corresponding to a HOST TARGET binding site such as BINDING SITE I, BINDING SITE II or BINDING SITE III. Table 2 illustrates the complementarity of the nucleotide sequences of DKFZp547E052 BINDING SITE, designated SEQ ID:26032, to the nucleotide sequence of VGAM493 RNA, herein designated VGAM RNA, also designated SEQ ID:3204.

Another function of VGAM493 is therefore inhibition of DKFZp547E052 (Accession NM_032276). Accordingly, utilities of VGAM493 include diagnosis, prevention and treatment of diseases and clinical conditions associated with DKFZp547E052. DKFZP761I2123 (Accession NM_031449) is another VGAM493 host target gene. DKFZP761I2123 BINDING SITE is HOST TARGET binding site found in the 3' untranslated region of mRNA encoded by DKFZP761I2123, corresponding to a HOST TARGET binding site such as BINDING SITE I, BINDING SITE II or BINDING SITE III. Table 2 illustrates the complementarity of the nucleotide sequences of DKFZP761I2123 BINDING SITE, designated SEQ ID:25464, to the nucleotide sequence of VGAM493 RNA, herein designated VGAM RNA, also designated SEQ ID:3204.

Another function of VGAM493 is therefore inhibition of DKFZP761I2123 (Accession NM_031449). Accordingly, utilities of VGAM493 include diagnosis, prevention and treatment of diseases and clinical conditions associated with DKFZP761I2123. FLJ14082 (Accession NM_025024) is another VGAM493 host target gene. FLJ14082 BINDING SITE is HOST TARGET binding site found in the 3' untranslated region of mRNA encoded by FLJ14082, corresponding to a HOST TARGET binding site such as BINDING SITE I, BINDING SITE II or BINDING SITE III. Table 2 illustrates the complementarity of the nucleotide sequences of FLJ14082 BINDING SITE, designated SEQ ID:24608, to the nucleotide sequence of VGAM493 RNA, herein designated VGAM RNA, also designated SEQ ID:3204.

Another function of VGAM493 is therefore inhibition of FLJ14082 (Accession NM_025024). Accordingly, utilities of VGAM493 include diagnosis, prevention and treatment of diseases and clinical conditions associated with FLJ14082. FLJ22169 (Accession NM_024085) is another VGAM493 host target gene. FLJ22169 BINDING SITE is HOST TARGET binding site found in the 5' untranslated region of mRNA encoded by FLJ22169, corresponding to a HOST TARGET binding site such as BINDING SITE I, BINDING SITE II or BINDING SITE III. Table 2 illustrates the complementarity of the nucleotide sequences of FLJ22169 BINDING SITE, designated SEQ ID:23524, to the nucleotide sequence of VGAM493 RNA, herein designated VGAM RNA, also designated SEQ ID:3204.

Another function of VGAM493 is therefore inhibition of FLJ22169 (Accession NM_024085). Accordingly, utilities of VGAM493 include diagnosis, prevention and treatment of diseases and clinical conditions associated with FLJ22169. KIAA0133 (Accession NM_014777) is another VGAM493 host target gene. KIAA0133 BINDING SITE is HOST TARGET binding site found in the 3' untranslated region of mRNA encoded by KIAA0133, corresponding to a HOST TARGET binding site such as BINDING SITE I, BINDING SITE II or BINDING SITE III. Table 2 illustrates the complementarity of the nucleotide sequences of KIAA0133 BINDING SITE, designated SEQ ID:16609, to the nucleotide sequence of VGAM493 RNA, herein designated VGAM RNA, also designated SEQ ID:3204.

Another function of VGAM493 is therefore inhibition of KIAA0133 (Accession NM_014777). Accordingly, utilities of VGAM493 include diagnosis, prevention and treatment of diseases and clinical conditions associated with KIAA0133. KIAA0152 (Accession NM_014730) is another VGAM493 host target gene. KIAA0152 BINDING SITE is HOST TARGET binding site found in the 3' untranslated region of mRNA encoded by KIAA0152, corresponding to a HOST TARGET binding site such as BINDING SITE I, BINDING SITE II or BINDING SITE III. Table 2 illustrates the complementarity of the nucleotide sequences of KIAA0152 BINDING SITE, designated SEQ ID:16341, to the nucleotide sequence of VGAM493 RNA, herein designated VGAM RNA, also designated SEQ ID:3204.

Another function of VGAM493 is therefore inhibition of KIAA0152 (Accession NM_014730). Accordingly, utilities of VGAM493 include diagnosis, prevention and treatment of diseases and clinical conditions associated with KIAA0152. KIAA1858 (Accession XM_040592) is another VGAM493 host target gene. KIAA1858 BINDING SITE is HOST TARGET binding site found in the 3' untranslated region of mRNA encoded by KIAA1858, corresponding to a HOST TARGET binding site such as BINDING SITE I, BINDING SITE II or BINDING SITE III. Table 2 illustrates the complementarity of the nucleotide sequences of KIAA1858 BINDING SITE, designated SEQ ID:33329, to the nucleotide sequence of VGAM493 RNA, herein designated VGAM RNA, also designated SEQ ID:3204.

Another function of VGAM493 is therefore inhibition of KIAA1858 (Accession XM_040592). Accordingly, utilities of VGAM493 include diagnosis, prevention and treatment of diseases and clinical conditions associated with KIAA1858. Low Density Lipoprotein-related Protein 1B (deleted in tumors) (LRP1B, Accession NM_018557) is another VGAM493 host target gene. LRP1B BINDING SITE is HOST TARGET binding site found in the 3" untranslated region of mRNA encoded by LRP1B, corresponding to a HOST TARGET binding site such as BINDING SITE I, BINDING SITE II or BINDING SITE III. Table 2 illustrates the complementarity of the nucleotide sequences of LRP1B BINDING SITE, designated SEQ ID:20641, to the nucleotide sequence of VGAM493 RNA, herein designated VGAM RNA, also designated SEQ ID:3204.

Another function of VGAM493 is therefore inhibition of Low Density Lipoprotein-related Protein 1B (deleted in tumors) (LRP1B, Accession NM_018557). Accordingly, utilities of VGAM493 include diagnosis, prevention and treatment of diseases and clinical conditions associated with LRP1B. Phosphatidylinositol Glycan, Class Q (PIGQ, Accession NM_004204) is another VGAM493 host target gene. PIGQ BINDING SITE is HOST TARGET binding site found in the 3' untranslated region of mRNA encoded by PIGQ, corresponding to a HOST TARGET binding site such as BINDING SITE I, BINDING SITE II or BINDING SITE III. Table 2 illustrates the complementarity of the nucleotide sequences of PIGQ BINDING SITE, designated SEQ ID:10399, to the nucleotide sequence of VGAM493 RNA, herein designated VGAM RNA, also designated SEQ ID:3204.

Another function of VGAM493 is therefore inhibition of Phosphatidylinositol Glycan, Class Q (PIGQ, Accession NM_004204). Accordingly, utilities of VGAM493 include diagnosis, prevention and treatment of diseases and clinical conditions associated with PIGQ. Syntaphilin (SNPH, Accession NM_014723) is another VGAM493 host target gene. SNPH BINDING SITE is HOST TARGET binding site found in the 5' untranslated region of mRNA encoded by SNPH, corresponding to a HOST TARGET binding site such as BINDING SITE I, BINDING SITE II or BINDING SITE III. Table 2 illustrates the complementarity of the nucleotide sequences of SNPH BINDING SITE, designated SEQ ID:16302, to the nucleotide sequence of VGAM493 RNA, herein designated VGAM RNA, also designated SEQ ID:3204.

Another function of VGAM493 is therefore inhibition of Syntaphilin (SNPH, Accession NM_014723). Accordingly, utilities of VGAM493 include diagnosis, prevention and treatment of diseases and clinical conditions associated with SNPH. Thioesterase, Adipose Associated (THEA, Accession XM_038922) is another VGAM493 host target gene. THEA BINDING SITE is HOST TARGET binding site found in the 3' untranslated region of mRNA encoded by THEA, corresponding to a HOST TARGET binding site such as BINDING SITE I, BINDING SITE II or BINDING SITE III. Table 2 illustrates the complementarity of the nucleotide sequences of THEA BINDING SITE, designated SEQ ID:32950, to the nucleotide sequence of VGAM493 RNA, herein designated VGAM RNA, also designated SEQ ID:3204.

Another function of VGAM493 is therefore inhibition of Thioesterase, Adipose Associated (THEA, Accession XM_038922). Accordingly, utilities of VGAM493 include diagnosis, prevention and treatment of diseases and clinical conditions associated with THEA. LOC115110 (Accession XM_049825) is another VGAM493 host target gene. LOC115110 BINDING SITE is HOST TARGET binding site found in the 5' untranslated region of mRNA encoded by LOC115110, corresponding to a HOST TARGET binding site such as BINDING SITE I, BINDING SITE II or BIND- ING SITE III. Table 2 illustrates the complementarity of the nucleotide sequences of LOC115110 BINDING SITE, designated SEQ ID:35513, to the nucleotide sequence of VGAM493 RNA, herein designated VGAM RNA, also designated SEQ ID:3204.

Another function of VGAM493 is therefore inhibition of LOC115110 (Accession XM_049825). Accordingly, utilities of VGAM493 include diagnosis, prevention and treatment of diseases and clinical conditions associated with LOC115110. LOC147138 (Accession XM_085717) is another VGAM493 host target gene. LOC147138 BINDING SITE is HOST TARGET binding site found in the 5' untranslated region of mRNA encoded by LOC147138, corresponding to a HOST TARGET binding site such as BINDING SITE I, BINDING SITE II or BINDING SITE III. Table 2 illustrates the complementarity of the nucleotide sequences of LOC147138 BINDING SITE, designated SEQ ID:38309, to the nucleotide sequence of VGAM493 RNA, herein designated VGAM RNA, also designated SEQ ID:3204.

Another function of VGAM493 is therefore inhibition of LOC147138 (Accession XM_085717). Accordingly, utilities of VGAM493 include diagnosis, prevention and treatment of diseases and clinical conditions associated with LOC147138. LOC151121 (Accession XM_087102) is another VGAM493 host target gene. LOC151121 BINDING SITE is HOST TARGET binding site found in the 5' untranslated region of mRNA encoded by LOC151121, corresponding to a HOST TARGET binding site such as BINDING SITE I, BINDING SITE II or BINDING SITE III. Table 2 illustrates the complementarity of the nucleotide sequences of LOC151121 BINDING SITE, designated SEQ ID:39053, to the nucleotide sequence of VGAM493 RNA, herein designated VGAM RNA, also designated SEQ ID:3204.

Another function of VGAM493 is therefore inhibition of LOC151121 (Accession XM_087102). Accordingly, utilities of VGAM493 include diagnosis, prevention and treatment of diseases and clinical conditions associated with LOC151121. LOC157280 (Accession XM_058301) is another VGAM493 host target gene. LOC157280 BINDING SITE is HOST TARGET binding site found in the 3' untranslated region of mRNA encoded by LOC157280, corresponding to a HOST TARGET binding site such as BINDING SITE I, BINDING SITE II or BINDING SITE III. Table 2 illustrates the complementarity of the nucleotide sequences of LOC157280 BINDING SITE, designated SEQ ID:36592, to the nucleotide sequence of VGAM493 RNA, herein designated VGAM RNA, also designated SEQ ID:3204.

Another function of VGAM493 is therefore inhibition of LOC157280 (Accession XM_058301). Accordingly, utilities of VGAM493 include diagnosis, prevention and treatment of diseases and clinical conditions associated with LOC157280. LOC158857 (Accession XM_098997) is another VGAM493 host target gene. LOC158857 BINDING SITE is HOST TARGET binding site found in the 5' untranslated region of mRNA encoded by LOC158857, corresponding to a HOST TARGET binding site such as BINDING SITE I, BINDING SITE II or BINDING SITE III. Table 2 illustrates the complementarity of the nucleotide sequences of LOC158857 BINDING SITE, designated SEQ ID:42032, to the nucleotide sequence of VGAM493 RNA, herein designated VGAM RNA, also designated SEQ ID:3204.

Another function of VGAM493 is therefore inhibition of LOC158857 (Accession XM_098997). Accordingly, utilities of VGAM493 include diagnosis, prevention and treatment of diseases and clinical conditions associated with LOC158857. LOC159049 (Accession XM_099020) is another VGAM493 host target gene. LOC159049 BINDING SITE is HOST TARGET binding site found in the 5' untranslated region of mRNA encoded by LOC159049, corresponding to a HOST TARGET binding site such as BINDING SITE I, BINDING SITE II or BINDING SITE III. Table 2 illustrates the complementarity of the nucleotide sequences of LOC159049 BINDING SITE, designated SEQ ID:42058, to the nucleotide sequence of VGAM493 RNA, herein designated VGAM RNA, also designated SEQ ID:3204.

Another function of VGAM493 is therefore inhibition of LOC159049 (Accession XM_099020). Accordingly, utilities of VGAM493 include diagnosis, prevention and treatment of diseases and clinical conditions associated with LOC159049. LOC170261 (Accession XM_093214) is another VGAM493 host target gene. LOC170261 BINDING SITE is HOST TARGET binding site found in the 5' untranslated region of mRNA encoded by LOC170261, corresponding to a HOST TARGET binding site such as BINDING SITE I, BINDING SITE II or BINDING SITE III. Table 2 illustrates the complementarity of the nucleotide sequences of LOC170261 BINDING SITE, designated SEQ ID:40183, to the nucleotide sequence of VGAM493 RNA, herein designated VGAM RNA, also designated SEQ ID:3204.

Another function of VGAM493 is therefore inhibition of LOC170261 (Accession XM_093214). Accordingly, utilities of VGAM493 include diagnosis, prevention and treatment of diseases and clinical conditions associated with LOC170261. LOC205952 (Accession XM_120685) is another VGAM493 host target gene. LOC205952 BINDING SITE is HOST TARGET binding site found in the 5' untranslated region of mRNA encoded by LOC205952, corresponding to a HOST TARGET binding site such as BINDING SITE I, BINDING SITE II or BINDING SITE III. Table 2 illustrates the complementarity of the nucleotide sequences of LOC205952 BINDING SITE, designated SEQ ID:43611, to the nucleotide sequence of VGAM493 RNA, herein designated VGAM RNA, also designated SEQ ID:3204.

Another function of VGAM493 is therefore inhibition of LOC205952 (Accession XM_120685). Accordingly, utilities of VGAM493 include diagnosis, prevention and treatment of diseases and clinical conditions associated with LOC205952. LOC221756 (Accession XM_166394) is another VGAM493 host target gene. LOC221756 BINDING SITE is HOST TARGET binding site found in the 3' untranslated region of mRNA encoded by LOC221756, corresponding to a HOST TARGET binding site such as BINDING SITE I, BINDING SITE II or BINDING SITE III. Table 2 illustrates the complementarity of the nucleotide sequences of LOC221756 BINDING SITE, designated SEQ ID:44242, to the nucleotide sequence of VGAM493 RNA, herein designated VGAM RNA, also designated SEQ ID:3204.

Another function of VGAM493 is therefore inhibition of LOC221756 (Accession XM_166394). Accordingly, utilities of VGAM493 include diagnosis, prevention and treatment of diseases and clinical conditions associated with LOC221756. LOC255448 (Accession XM_170623) is another VGAM493 host target gene. LOC255448 BINDING SITE is HOST TARGET binding site found in the 3' untranslated region of mRNA encoded by LOC255448, corresponding to a HOST TARGET binding site such as BINDING SITE I, BINDING SITE II or BINDING SITE III. Table 2 illustrates the complementarity of the nucleotide sequences of LOC255448 BINDING SITE, designated SEQ ID:45402, to the nucleotide sequence of VGAM493 RNA, herein designated VGAM RNA, also designated SEQ ID:3204.

Another function of VGAM493 is therefore inhibition of LOC255448 (Accession XM_170623). Accordingly, utilities of VGAM493 include diagnosis, prevention and treatment of diseases and clinical conditions associated with LOC255448. LOC256586 (Accession XM_170759) is another VGAM493 host target gene. LOC256586 BINDING SITE is HOST TARGET binding site found in the 5' untranslated region of mRNA encoded by LOC256586, corresponding to a HOST TARGET binding site such as BINDING SITE I, BINDING SITE II or BINDING SITE III. Table 2 illustrates the complementarity of the nucleotide sequences of LOC256586 BINDING SITE, designated SEQ ID:45513, to the nucleotide sequence of VGAM493 RNA, herein designated VGAM RNA, also designated SEQ ID:3204.

Another function of VGAM493 is therefore inhibition of LOC256586 (Accession XM_170759). Accordingly, utilities of VGAM493 include diagnosis, prevention and treatment of diseases and clinical conditions associated with LOC256586. LOC257051 (Accession XM_172800) is another VGAM493 host target gene. LOC257051 BINDING SITE is HOST TARGET binding site found in the 5' untranslated region of mRNA encoded by LOC257051, corresponding to a HOST TARGET binding site such as BINDING SITE I, BINDING SITE II or BINDING SITE III. Table 2 illustrates the complementarity of the nucleotide sequences of LOC257051 BINDING SITE, designated SEQ ID:46083, to the nucleotide sequence of VGAM493 RNA, herein designated VGAM RNA, also designated SEQ ID:3204.

Another function of VGAM493 is therefore inhibition of LOC257051 (Accession XM_172800). Accordingly, utilities of VGAM493 include diagnosis, prevention and treatment of diseases and clinical conditions associated with LOC257051. LOC91344 (Accession XM_037782) is another VGAM493 host target gene. LOC91344 BINDING SITE is HOST TARGET binding site found in the 5' untranslated region of mRNA encoded by LOC91344, corresponding to a HOST TARGET binding site such as BINDING SITE I, BINDING SITE II or BINDING SITE III. Table 2 illustrates the complementarity of the nucleotide sequences of LOC91344 BINDING SITE, designated SEQ ID:32678, to the nucleotide sequence of VGAM493 RNA, herein designated VGAM RNA, also designated SEQ ID:3204.

Another function of VGAM493 is therefore inhibition of LOC91344 (Accession XM_037782). Accordingly, utilities of VGAM493 include diagnosis, prevention and treatment of diseases and clinical conditions associated with LOC91344. FIG. 1 further provides a conceptual description of a novel bioinformatically detected viral gene of the present invention, referred to here as Viral Genomic Address Messenger 494 (VGAM494) viral gene, which modulates expression of respective host target genes thereof, the function and utility of which host target genes is known in the art.

VGAM494 is a novel bioinformatically detected regulatory, non protein coding, viral micro RNA (miRNA) gene. The method by which VGAM494 was detected is described hereinabove with reference to FIGS. 1-8.

VGAM494 gene, herein designated VGAM GENE, is a viral gene contained in the genome of Hepatitis G Virus. VGAM494 host target gene, herein designated VGAM HOST TARGET GENE, is a human gene contained in the human genome.

VGAM494 gene encodes a VGAM494 precursor RNA, herein designated VGAM PRECURSOR RNA. Similar to other miRNA genes, and unlike most ordinary genes, VGAM494 precursor RNA does not encode a protein. A nucleotide sequence identical or highly similar to the nucleotide sequence of VGAM494 precursor RNA is designated SEQ ID:480, and is provided hereinbelow with reference to the sequence listing part. Nucleotide sequence SEQ ID:480 is located at position 4566 relative to the genome of Hepatitis G Virus.

VGAM494 precursor RNA folds onto itself, forming VGAM494 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM494 folded precursor RNA into VGAM494 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM494 RNA is designated SEQ ID:3205, and is provided hereinbelow with reference to the sequence listing part.

VGAM494 host target gene, herein designated VGAM HOST TARGET GENE, encodes a corresponding messenger RNA, VGAM494 host target RNA, herein designated VGAM HOST TARGET RNA. VGAM494 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM494 RNA, herein designated VGAM RNA, binds complementarily to one or more host target binding sites located in untranslated regions of VGAM494 host target RNA, herein designated VGAM HOST TARGET RNA. This complementary binding is due to the fact that the nucleotide sequence of VGAM494 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM494 RNA, herein designated VGAM RNA, may have a different number of host target binding sites in untranslated regions of a VGAM494 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM494 RNA, herein designated VGAM RNA, to host target binding sites on VGAM494 host target RNA, herein designated VGAM HOST TARGET RNA, such as BINDING SITE I, BINDING SITE II and BINDING SITE III, inhibits translation of VGAM494 host target RNA into VGAM494 host target protein, herein designated VGAM HOST TARGET PROTEIN. VGAM host target protein is therefore outlined by a broken line.

It is appreciated that VGAM494 host target gene, herein designated VGAM HOST TARGET GENE, in fact represents a plurality of VGAM494 host target genes. The mRNA of each one of this plurality of VGAM494 host target genes comprises one or more host target binding sites, each having a nucleotide sequence which is at least partly complementary to VGAM494 RNA, herein designated VGAM RNA, and which when bound by VGAM494 RNA causes inhibition of translation of respective one or more VGAM494 host target proteins.

It is further appreciated by one skilled in the art that the mode of translational inhibition illustrated by FIG. 1 with specific reference to translational inhibition exerted by VGAM494 gene, herein designated VGAM GENE, on one or more VGAM494 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM494 is inhibition of expression of host target genes, as part of a novel viral mechanism of attacking a host. Accordingly, utilities of VGAM494 include diagnosis, prevention and treatment of viral infection by Hepatitis G Virus. Specific functions, and accordingly utilities, of VGAM494 correlate with, and may be deduced from, the identity of the host target genes which VGAM494 binds and inhibits, and the function of these host target genes, as elaborated hereinbelow.

Nucleotide sequences of the VGAM494 precursor RNA, herein designated VGAM PRECURSOR RNA, and of the 'diced' VGAM494 RNA, herein designated VGAM RNA, and a schematic representation of the secondary folding of VGAM494 folded precursor RNA, herein designated VGAM FOLDED PRECURSOR RNA, of VGAM494 are further described hereinbelow with reference to Table 1.

Nucleotide sequences of host target binding sites, such as BINDING SITE-I, BINDING SITE-II and BINDING SITE-III of FIG. 1, found on VGAM494 host target RNA, and schematic representation of the complementarity of each of these host target binding sites to VGAM494 RNA, herein designated VGAM RNA, are described hereinbelow with reference to Table 2.

As mentioned hereinabove with reference to FIG. 1, a function of VGAM494 gene, herein designated VGAM is inhibition of expression of VGAM494 target genes. It is appreciated that specific functions, and accordingly utilities, of VGAM494 correlate with, and may be deduced from, the identity of the target genes which VGAM494 binds and inhibits, and the function of these target genes, as elaborated hereinbelow.

ATPase, Class VI, Type 11A (ATP11A, Accession XM_085028) is a VGAM494 host target gene. ATP11A BINDING SITE is HOST TARGET binding site found in the 3' untranslated region of mRNA encoded by ATP11A, corresponding to a HOST TARGET binding site such as BINDING SITE I, BINDING SITE II or BINDING SITE III. Table 2 illustrates the complementarity of the nucleotide sequences of ATP11A BINDING SITE, designated SEQ ID:37801, to the nucleotide sequence of VGAM494 RNA, herein designated VGAM RNA, also designated SEQ ID:3205.

A function of VGAM494 is therefore inhibition of ATPase, Class VI, Type 11A (ATP11A, Accession XM_085028). Accordingly, utilities of VGAM494 include diagnosis, prevention and treatment of diseases and clinical conditions associated with ATP11A. ATPase, Cu++ Transporting, Alpha Polypeptide (Menkes syndrome) (ATP7A, Accession NM_000052) is another VGAM494 host target gene. ATP7A BINDING SITE is HOST TARGET binding site found in the 3' untranslated region of mRNA encoded by ATP7A, corresponding to a HOST TARGET binding site such as BINDING SITE I, BINDING SITE II or BINDING SITE III. Table 2 illustrates the complementarity of the nucleotide sequences of ATP7A BINDING SITE, designated SEQ ID:5497, to the nucleotide sequence of VGAM494 RNA, herein designated VGAM RNA, also designated SEQ ID:3205.

Another function of VGAM494 is therefore inhibition of ATPase, Cu++ Transporting, Alpha Polypeptide (Menkes syndrome) (ATP7A, Accession NM_000052). Accordingly, utilities of VGAM494 include diagnosis, prevention and treatment of diseases and clinical conditions associated with ATP7A. Bullous Pemphigoid Antigen 1, 230/240 kDa (BPAG1, Accession NM_015548) is another VGAM494 host target gene. BPAG1 BINDING SITE is HOST TARGET binding site found in the 3' untranslated region of mRNA encoded by BPAG1, corresponding to a HOST TARGET binding site such as BINDING SITE I, BINDING SITE II or BINDING SITE III. Table 2 illustrates the complementarity of the nucleotide sequences of BPAG1 BINDING SITE, designated SEQ ID:17809, to the nucleotide sequence of VGAM494 RNA, herein designated VGAM RNA, also designated SEQ ID:3205.

Another function of VGAM494 is therefore inhibition of Bullous Pemphigoid Antigen 1, 230/240 kDa (BPAG1, Accession NM_015548), a gene which plays a role in cross-linking actin to other cytoskeletal proteins, binds to microtubules. Accordingly, utilities of VGAM494 include diagnosis, prevention and treatment of diseases and clinical conditions associated with BPAG1. The function of BPAG1 has been established by previous studies. Sensory neurodegeneration occurs in mice defective in Bpag1, a gene encoding cytoskeletal linker proteins capable of anchoring neuronal intermediate filaments to actin cytoskeleton. While Bpag1 null mice fail to anchor neurofilaments (NFs), Bpag1/NF null mice still degenerate in the absence of NFs. Yang et al. (1999) reported a novel BPAG1 neural splice form that lacks the actin-binding domain and instead binds and stabilizes microtubules. This interaction is functionally important; in mice and in vitro, neurons lacking BPAG1 displayed short, disorganized, and unstable microtubules defective in axonal transport. BPAG1 neural isoforms represent microtubule-associated proteins that when absent lead to devastating consequences. Moreover, BPAG1 can functionally account for the extraordinary stability of axonal microtubules necessary for transport over long distances. Its isoforms interconnect all 3 cytoskeletal networks, a feature apparently central to neuronal survival. Animal model experiments lend further support to the function of BPAG1. BPAG1 is made by stratified squamous epithelia, where it localizes to the inner surface of specialized integrin-mediated adherens junctions (hemidesmosomes). Guo et al. (1995) explored the function of BPAG1 and its relationship to bullous pemphigoid by targeting the knockout of the Bpag1 gene in mice. Hemidesmosomes were otherwise normal but they lacked the inner plate and had no cytoskeleton attached. Though not affecting cell growth or adhesion to substrate, this change compromised mechanical integrity and influenced migration. Unexpectedly, the mice also developed severe dystonia and sensory nerve degeneration typical of homozygous dystonia musculorum (dt/dt) mice. Guo et al. (1995) showed that the Bpag1 gene is defective in at least 1 strain of mice with spontaneous homozygous dystonia musculorum. As indicated elsewhere, a human homolog of the dystonia musculorum gene (OMIM Ref. No. 600088) has been mapped to 6p12, the same region as the BPAG1 gene. The dt/dt locus is on mouse chromosome 1 in the same region as the Bpag1 locus. Guo et al. (1995) discussed the evidence that they may one and the same. Brown et al. (1995) cloned a candidate dt gene, called dystonin, that is predominantly expressed in the dorsal root ganglia and other sites of neurodegeneration in dt mice. They showed that the dystonin gene encodes an N-terminal actin-binding domain and a C-terminal portion comprised of the bullous pemphigoid antigen-1 protein; dt and bpag1 are part of the same transcription unit which is partially deleted in a transgenic strain of mice that harbors an insertional mutation at the dt locus and in mice that carry a spontaneous dt mutation. They also demonstrated abnormal dystonin transcripts in a second dt mutant. Thus, they concluded that mutations in the dystonin gene are the primary genetic lesion in dt mice.

It is appreciated that the abovementioned animal model for BPAG1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Yang, Y.; Bauer, C.; Strasser, G.; Wollman, R.; Julien, J.-P.; Fuchs, E.: Integrators of the cytoskeleton that stabilize microtubules. Cell 98:229-238, 1999; and Guo, L.; Degenstein, L.; Dowling, J.; Yu, Q.-C.; Wollmann, R.; Perman, B.; Fuchs, E.: Gene targeting of BPAG1: abnormalities in mechanical strength and cell migration in stratified ep.

Further studies establishing the function and utilities of BPAG1 are found in John Hopkins OMIM database record ID 113810, and in sited publications numbered 4079-4090 listed in the bibliography section hereinbelow, which are also hereby incorporated by reference. EphA8 (EPHA8, Accession NM_020526) is another VGAM494 host target gene. EPHA8 BINDING SITE is HOST TARGET binding site found in the 3' untranslated region of mRNA encoded by EPHA8, corresponding to a HOST TARGET binding site such as BINDING SITE I, BINDING SITE II or BINDING SITE III. Table 2 illustrates the complementarity of the nucleotide sequences of EPHA8 BINDING SITE, designated SEQ ID:21742, to the nucleotide sequence of VGAM494 RNA, herein designated VGAM RNA, also designated SEQ ID:3205.

Another function of VGAM494 is therefore inhibition of EphA8 (EPHA8, Accession NM_020526), a gene which Eph-related receptor tyrosine kinase A8. Accordingly, utilities of VGAM494 include diagnosis, prevention and treatment of diseases and clinical conditions associated with EPHA8. The function of EPHA8 has been established by previous studies. See EPH (EPHA1; 179610) for background on Eph receptors and their ligands, the ephrins. Chan and Watt (1991) identified human and rat DNAs encoding 2 novel members of the EPH subclass of putative receptor protein-tyrosine kinases. Rat cDNA clones encoding EEK (EPH- and ELK-related kinase) were isolated from a brain cDNA library probed with DNA encoding the kinase region of the insulin receptor-related receptor (INSRR; 147671). The EEK protein was predicted to contain all the amino acid residues conserved in the catalytic domains of protein-tyrosine kinases and was most similar to 2 putative receptor protein-tyrosine kinases of the EPH subclass, ELK (EPHB1; 600600) and EPH, showing 69 and 57% identity, respectively. Human genomic DNAs, encoding part of EEK as well as another putative protein tyrosine kinase most similar to ELK (90%) and symbolized ERK (EPHB2; 600997) for ELK-related kinase, were isolated and partially characterized. The novel identity of these 2 EPH-family genes was further supported by Southern blot analysis and localization to human chromosome 1. In Northern blot analysis of rat RNA, DNAs encoding rat EEK and human ERK hybridized to transcripts most abundant in brain and lung, respectively. These 2 new members of the EPH subclass of receptor protein-tyrosine kinases, EEK and ERK, may therefore have tissue-specific functions distinct from those of the other EPH family members. Animal model experiments lend further support to the function of EPHA8. Park et al. (1997) generated mice homozygous for a mutation that disrupts the gene encoding EPHA8, a member of the Eph family of tyrosine proteinase receptors. EphA8 -/- mice developed to term, were fertile, and did not display obvious anatomical or physiologic defects.

It is appreciated that the abovementioned animal model for EPHA8 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chan, J.; Watt, V. M.: Eek and erk, new members of the eph subclass of receptor protein-tyrosine kinases. Oncogene 6:1057-1061, 1991; and Park, S.; Frisen, J.; Barbacid, M.: Aberrant axonal projections in mice lacking EphA8 (Eek) tyrosine protein kinase receptors. EMBO J. 16:3106-3114, 1997.

Further studies establishing the function and utilities of EPHA8 are found in John Hopkins OMIM database record ID 176945, and in sited publications numbered 12700-12701 listed in the bibliography section hereinbelow, which are also hereby incorporated by reference. WD Repeat Domain 1 (WDR1, Accession NM_017491) is another VGAM494 host target gene. WDR1 BINDING SITE is HOST TARGET binding site found in the 3' untranslated region of mRNA encoded by WDR1, corresponding to a HOST TARGET binding site such as BINDING SITE I, BINDING SITE II or BINDING SITE III. Table 2 illustrates the complementarity of the nucleotide sequences of WDR1 BINDING SITE, designated SEQ ID:18956, to the nucleotide sequence of VGAM494 RNA, herein designated VGAM RNA, also designated SEQ ID:3205.

Another function of VGAM494 is therefore inhibition of WD Repeat Domain 1 (WDR1, Accession NM_017491). Accordingly, utilities of VGAM494 include diagnosis, prevention and treatment of diseases and clinical conditions associated with WDR1. FLJ10781 (Accession NM_018215) is another VGAM494 host target gene. FLJ10781 BINDING SITE1 and FLJ10781 BINDING SITE2 are HOST TARGET binding sites found in untranslated regions of mRNA encoded by FLJ10781, corresponding to HOST TARGET binding sites such as BINDING SITE I, BINDING SITE II or BINDING SITE III. Table 2 illustrates the complementarity of the nucleotide sequences of FLJ10781 BINDING SITE1 and FLJ10781 BINDING SITE2, designated SEQ ID:20138 and SEQ ID:20131 respectively, to the nucleotide sequence of VGAM494 RNA, herein designated VGAM RNA, also designated SEQ ID:3205.

Another function of VGAM494 is therefore inhibition of FLJ10781 (Accession NM_018215). Accordingly, utilities of VGAM494 include diagnosis, prevention and treatment of diseases and clinical conditions associated with FLJ10781. KIAA0450 (Accession NM_014638) is another VGAM494 host target gene. KIAA0450 BINDING SITE is HOST TARGET binding site found in the 5' untranslated region of mRNA encoded by KIAA0450, corresponding to a HOST TARGET binding site such as BINDING SITE I, BINDING SITE II or BINDING SITE III. Table 2 illustrates the complementarity of the nucleotide sequences of KIAA0450 BIND- ING SITE, designated SEQ ID:16025, to the nucleotide sequence of VGAM494 RNA, herein designated VGAM RNA, also designated SEQ ID:3205.

Another function of VGAM494 is therefore inhibition of KIAA0450 (Accession NM_014638). Accordingly, utilities of VGAM494 include diagnosis, prevention and treatment of diseases and clinical conditions associated with KIAA0450. KIAA1492 (Accession XM_035312) is another VGAM494 host target gene. KIAA1492 BINDING SITE is HOST TARGET binding site found in the 3' untranslated region of mRNA encoded by KIAA1492, corresponding to a HOST TARGET binding site such as BINDING SITE I, BINDING SITE II or BINDING SITE III. Table 2 illustrates the complementarity of the nucleotide sequences of KIAA1492 BINDING SITE, designated SEQ ID:32226, to the nucleotide sequence of VGAM494 RNA, herein designated VGAM RNA, also designated SEQ ID:3205.

Another function of VGAM494 is therefore inhibition of KIAA1492 (Accession XM_035312). Accordingly, utilities of VGAM494 include diagnosis, prevention and treatment of diseases and clinical conditions associated with KIAA1492. Ras and Rab Interactor 3 (RIN3, Accession NM_024832) is another VGAM494 host target gene. RIN3 BINDING SITE is HOST TARGET binding site found in the 3' untranslated region of mRNA encoded by RIN3, corresponding to a HOST TARGET binding site such as BINDING SITE I, BINDING SITE II or BINDING SITE III. Table 2 illustrates the complementarity of the nucleotide sequences of RIN3 BINDING SITE, designated SEQ ID:24229, to the nucleotide sequence of VGAM494 RNA, herein designated VGAM RNA, also designated SEQ ID:3205.

Another function of VGAM494 is therefore inhibition of Ras and Rab Interactor 3 (RIN3, Accession NM_024832). Accordingly, utilities of VGAM494 include diagnosis, prevention and treatment of diseases and clinical conditions associated with RIN3. LOC115110 (Accession XM_049825) is another VGAM494 host target gene. LOC115110 BINDING SITE is HOST TARGET binding site found in the 3' untranslated region of mRNA encoded by LOC115110, corresponding to a HOST TARGET binding site such as BINDING SITE I, BINDING SITE II or BINDING SITE III. Table 2 illustrates the complementarity of the nucleotide sequences of LOC115110 BINDING SITE, designated SEQ ID:35512, to the nucleotide sequence of VGAM494 RNA, herein designated VGAM RNA, also designated SEQ ID:3205.

Another function of VGAM494 is therefore inhibition of LOC115110 (Accession XM_049825). Accordingly, utilities of VGAM494 include diagnosis, prevention and treatment of diseases and clinical conditions associated with LOC115110. LOC196500 (Accession XM_113734) is another VGAM494 host target gene. LOC196500 BINDING SITE is HOST TARGET binding site found in the 3' untranslated region of mRNA encoded by LOC196500, corresponding to a HOST TARGET binding site such as BINDING SITE I, BINDING SITE II or BINDING SITE III. Table 2 illustrates the complementarity of the nucleotide sequences of LOC196500 BINDING SITE, designated SEQ ID:42384, to the nucleotide sequence of VGAM494 RNA, herein designated VGAM RNA, also designated SEQ ID:3205.

Another function of VGAM494 is therefore inhibition of LOC196500 (Accession XM_113734). Accordingly, utilities of VGAM494 include diagnosis, prevention and treatment of diseases and clinical conditions associated with LOC196500. LOC197287 (Accession XM_027541) is another VGAM494 host target gene. LOC197287 BINDING SITE is HOST TARGET binding site found in the 3' untranslated region of mRNA encoded by LOC197287, corresponding to a HOST TARGET binding site such as BINDING SITE I, BINDING SITE II or BINDING SITE III. Table 2 illustrates the complementarity of the nucleotide sequences of LOC197287 BINDING SITE, designated SEQ ID:30520, to the nucleotide sequence of VGAM494 RNA, herein designated VGAM RNA, also designated SEQ ID:3205.

Another function of VGAM494 is therefore inhibition of LOC197287 (Accession XM_027541). Accordingly, utilities of VGAM494 include diagnosis, prevention and treatment of diseases and clinical conditions associated with LOC197287. LOC91782 (Accession XM_040612) is another VGAM494 host target gene. LOC91782 BINDING SITE is HOST TARGET binding site found in the 3' untranslated region of mRNA encoded by LOC91782, corresponding to a HOST TARGET binding site such as BINDING SITE I, BINDING SITE II or BINDING SITE III. Table 2 illustrates the complementarity of the nucleotide sequences of LOC91782 BINDING SITE, designated SEQ ID:33335, to the nucleotide sequence of VGAM494 RNA, herein designated VGAM RNA, also designated SEQ ID:3205.

Another function of VGAM494 is therefore inhibition of LOC91782 (Accession XM_040612). Accordingly, utilities of VGAM494 include diagnosis, prevention and treatment of diseases and clinical conditions associated with LOC91782. FIG. 1 further provides a conceptual description of a novel bioinformatically detected viral gene of the present invention, referred to here as Viral Genomic Address Messenger 495 (VGAM495) viral gene, which modulates expression of respective host target genes thereof, the function and utility of which host target genes is known in the art.

VGAM495 is a novel bioinformatically detected regulatory, non protein coding, viral micro RNA (miRNA) gene. The method by which VGAM495 was detected is described hereinabove with reference to FIGS. 1-8.

VGAM495 gene, herein designated VGAM GENE, is a viral gene contained in the genome of Hepatitis G Virus. VGAM495 host target gene, herein designated VGAM HOST TARGET GENE, is a human gene contained in the human genome.

VGAM495 gene encodes a VGAM495 precursor RNA, herein designated VGAM PRECURSOR RNA. Similar to other miRNA genes, and unlike most ordinary genes, VGAM495 precursor RNA does not encode a protein. A nucleotide sequence identical or highly similar to the nucleotide sequence of VGAM495 precursor RNA is designated SEQ ID:481, and is provided hereinbelow with reference to the sequence listing part. Nucleotide sequence SEQ ID:481 is located at position 3092 relative to the genome of Hepatitis G Virus.

VGAM495 precursor RNA folds onto itself, forming VGAM495 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM495 folded precursor RNA into VGAM495 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM495 RNA is designated SEQ ID:3206, and is provided hereinbelow with reference to the sequence listing part.

VGAM495 host target gene, herein designated VGAM HOST TARGET GENE, encodes a corresponding messenger RNA, VGAM495 host target RNA, herein designated VGAM HOST TARGET RNA. VGAM495 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM495 RNA, herein designated VGAM RNA, binds complementarily to one or more host target binding sites located in untranslated regions of VGAM495 host target RNA, herein designated VGAM HOST TARGET RNA. This complementary binding is due to the fact that the nucleotide sequence of VGAM495 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM495 RNA, herein designated VGAM RNA, may have a different number of host target binding sites in untranslated regions of a VGAM495 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM495 RNA, herein designated VGAM RNA, to host target binding sites on VGAM495 host target RNA, herein designated VGAM HOST TARGET RNA, such as BINDING SITE I, BINDING SITE II and BINDING SITE III, inhibits translation of VGAM495 host target RNA into VGAM495 host target protein, herein designated VGAM HOST TARGET PROTEIN. VGAM host target protein is therefore outlined by a broken line.

It is appreciated that VGAM495 host target gene, herein designated VGAM HOST TARGET GENE, in fact represents a plurality of VGAM495 host target genes. The mRNA of each one of this plurality of VGAM495 host target genes comprises one or more host target binding sites, each having a nucleotide sequence which is at least partly complementary to VGAM495 RNA, herein designated VGAM RNA, and which when bound by VGAM495 RNA causes inhibition of translation of respective one or more VGAM495 host target proteins.

It is further appreciated by one skilled in the art that the mode of translational inhibition illustrated by FIG. 1 with specific reference to translational inhibition exerted by VGAM495 gene, herein designated VGAM GENE, on one or more VGAM495 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM495 is inhibition of expression of host target genes, as part of a novel viral mechanism of attacking a host. Accordingly, utilities of VGAM495 include diagnosis, prevention and treatment of viral infection by Hepatitis G Virus. Specific functions, and accordingly utilities, of VGAM495 correlate with, and may be deduced from, the identity of the host target genes which VGAM495 binds and inhibits, and the function of these host target genes, as elaborated hereinbelow.

Nucleotide sequences of the VGAM495 precursor RNA, herein designated VGAM PRECURSOR RNA, and of the 'diced' VGAM495 RNA, herein designated VGAM RNA, and a schematic representation of the secondary folding of VGAM495 folded precursor RNA, herein designated VGAM FOLDED PRECURSOR RNA, of VGAM495 are further described hereinbelow with reference to Table 1.

Nucleotide sequences of host target binding sites, such as BINDING SITE-I, BINDING SITE-II and BINDING SITE-III of FIG. 1, found on VGAM495 host target RNA, and schematic representation of the complementarity of each of these host target binding sites to VGAM495 RNA, herein designated VGAM RNA, are described hereinbelow with reference to Table 2.

As mentioned hereinabove with reference to FIG. 1, a function of VGAM495 gene, herein designated VGAM is inhibition of expression of VGAM495 target genes. It is appreciated that specific functions, and accordingly utilities, of VGAM495 correlate with, and may be deduced from, the identity of the target genes which VGAM495 binds and inhibits, and the function of these target genes, as elaborated hereinbelow.

FLJ22056 (Accession NM_022489) is a VGAM495 host target gene. FLJ22056 BINDING SITE is HOST TARGET binding site found in the 5' untranslated region of mRNA encoded by FLJ22056, corresponding to a HOST TARGET binding site such as BINDING SITE I, BINDING SITE II or BINDING SITE III. Table 2 illustrates the complementarity of the nucleotide sequences of FLJ22056 BINDING SITE, designated SEQ ID:22867, to the nucleotide sequence of VGAM495 RNA, herein designated VGAM RNA, also designated SEQ ID:3206.

A function of VGAM495 is therefore inhibition of FLJ22056 (Accession NM_022489). Accordingly, utilities of VGAM495 include diagnosis, prevention and treatment of diseases and clinical conditions associated with FLJ22056. FLJ30567 (Accession NM_145022) is another VGAM495 host target gene. FLJ30567 BINDING SITE is HOST TARGET binding site found in the 3' untranslated region of mRNA encoded by FLJ30567, corresponding to a HOST TARGET binding site such as BINDING SITE I, BINDING SITE II or BINDING SITE III. Table 2 illustrates the complementarity of the nucleotide sequences of FLJ30567 BINDING SITE, designated SEQ ID:29631, to the nucleotide sequence of VGAM495 RNA, herein designated VGAM RNA, also designated SEQ ID:3206.

Another function of VGAM495 is therefore inhibition of FLJ30567 (Accession NM_145022). Accordingly, utilities of VGAM495 include diagnosis, prevention and treatment of diseases and clinical conditions associated with FLJ30567. LOC150142 (Accession XM_086791) is another VGAM495 host target gene. LOC150142 BINDING SITE is HOST TARGET binding site found in the 5' untranslated region of mRNA encoded by LOC150142, corresponding to a HOST TARGET binding site such as BINDING SITE I, BINDING SITE II or BINDING SITE III. Table 2 illustrates the complementarity of the nucleotide sequences of LOC150142 BINDING SITE, designated SEQ ID:38855, to the nucleotide sequence of VGAM495 RNA, herein designated VGAM RNA, also designated SEQ ID:3206.

Another function of VGAM495 is therefore inhibition of LOC150142 (Accession XM_086791). Accordingly, utilities of VGAM495 include diagnosis, prevention and treatment of diseases and clinical conditions associated with LOC150142. LOC199858 (Accession XM_114040) is another VGAM495 host target gene. LOC199858 BINDING SITE is HOST TARGET binding site found in the 3' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42642, to the nucleotide sequence of VGAM495 RNA, herein designated VGAM RNA, also designated SEQ ID:3206.

Another function of VGAM495 is therefore inhibition of LOC199858 (Accession XM_114040). Accordingly, utilities of VGAM495 include diagnosis, prevention and treatment of diseases and clinical conditions associated with LOC199858. FIG. 1 further provides a conceptual description of a novel bioinformatically detected viral gene of the present invention, referred to here as Viral Genomic Address Messenger 496 (VGAM496) viral gene, which modulates expression of respective host target genes thereof, the function and utility of which host target genes is known in the art.

VGAM496 is a novel bioinformatically detected regulatory, non protein coding, viral micro RNA (miRNA) gene. The method by which VGAM496 was detected is described hereinabove with reference to FIGS. 1-8.

VGAM496 gene, herein designated VGAM GENE, is a viral gene contained in the genome of Human Herpesvirus 7. VGAM496 host target gene, herein designated VGAM HOST TARGET GENE, is a human gene contained in the human genome.

VGAM496 gene encodes a VGAM496 precursor RNA, herein designated VGAM PRECURSOR RNA. Similar to other miRNA genes, and unlike most ordinary genes, VGAM496 precursor RNA does not encode a protein. A nucleotide sequence identical or highly similar to the nucleotide sequence of VGAM496 precursor RNA is designated SEQ ID:482, and is provided hereinbelow with reference to the sequence listing part. Nucleotide sequence SEQ ID:482 is located at position 58821 relative to the genome of Human Herpesvirus 7.

VGAM496 precursor RNA folds onto itself, forming VGAM496 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM496 folded precursor RNA into VGAM496 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM496 RNA is designated SEQ ID:3207, and is provided hereinbelow with reference to the sequence listing part.

VGAM496 host target gene, herein designated VGAM HOST TARGET GENE, encodes a corresponding messenger RNA, VGAM496 host target RNA, herein designated VGAM HOST TARGET RNA. VGAM496 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM496 RNA, herein designated VGAM RNA, binds complementarily to one or more host target binding sites located in untranslated regions of VGAM496 host target RNA, herein designated VGAM HOST TARGET RNA. This complementary binding is due to the fact that the nucleotide sequence of VGAM496 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM496 RNA, herein designated VGAM RNA, may have a different number of host target binding sites in untranslated regions of a VGAM496 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM496 RNA, herein designated VGAM RNA, to host target binding sites on VGAM496 host target RNA, herein designated VGAM HOST TARGET RNA, such as BINDING SITE I, BINDING SITE II and BINDING SITE III, inhibits translation of VGAM496 host target RNA into VGAM496 host target protein, herein designated VGAM HOST TARGET PROTEIN. VGAM host target protein is therefore outlined by a broken line.

It is appreciated that VGAM496 host target gene, herein designated VGAM HOST TARGET GENE, in fact represents a plurality of VGAM496 host target genes. The mRNA of each one of this plurality of VGAM496 host target genes comprises one or more host target binding sites, each having a nucleotide sequence which is at least partly complementary to VGAM496 RNA, herein designated VGAM RNA, and which when bound by VGAM496 RNA causes inhibition of translation of respective one or more VGAM496 host target proteins.

It is further appreciated by one skilled in the art that the mode of translational inhibition illustrated by FIG. 1 with specific reference to translational inhibition exerted by VGAM496 gene, herein designated VGAM GENE, on one or more VGAM496 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM496 is inhibition of expression of host target genes, as part of a novel viral mechanism of attacking a host. Accordingly, utilities of VGAM496 include diagnosis, prevention and treatment of viral infection by Human Herpesvirus 7. Specific functions, and accordingly utilities, of VGAM496 correlate with, and may be deduced from, the identity of the host target genes which VGAM496 binds and inhibits, and the function of these host target genes, as elaborated hereinbelow.

Nucleotide sequences of the VGAM496 precursor RNA, herein designated VGAM PRECURSOR RNA, and of the 'diced' VGAM496 RNA, herein designated VGAM RNA, and a schematic representation of the secondary folding of VGAM496 folded precursor RNA, herein designated VGAM FOLDED PRECURSOR RNA, of VGAM496 are further described hereinbelow with reference to Table 1.

Nucleotide sequences of host target binding sites, such as BINDING SITE-I, BINDING SITE-II and BINDING SITE-III of FIG. 1, found on VGAM496 host target RNA, and schematic representation of the complementarity of each of these host target binding sites to VGAM496 RNA, herein designated VGAM RNA, are described hereinbelow with reference to Table 2.

As mentioned hereinabove with reference to FIG. 1, a function of VGAM496 gene, herein designated VGAM is inhibition of expression of VGAM496 target genes. It is appreciated that specific functions, and accordingly utilities, of VGAM496 correlate with, and may be deduced from, the identity of the target genes which VGAM496 binds and inhibits, and the function of these target genes, as elaborated hereinbelow.

Acyl-Coenzyme A Dehydrogenase, Short/branched Chain (ACADSB, Accession NM_001609) is a VGAM496 host target gene. ACADSB BINDING SITE is HOST TARGET binding site found in the 3' untranslated region of mRNA encoded by ACADSB, corresponding to a HOST TARGET binding site such as BINDING SITE I, BINDING SITE II or BINDING SITE III. Table 2 illustrates the complementarity of the nucleotide sequences of ACADSB BINDING SITE, designated SEQ ID:7316, to the nucleotide sequence of VGAM496 RNA, herein designated VGAM RNA, also designated SEQ ID:3207.

A function of VGAM496 is therefore inhibition of Acyl-Coenzyme A Dehydrogenase, Short/branched Chain (ACADSB, Accession NM_001609). Accordingly, utilities of VGAM496 include diagnosis, prevention and treatment of diseases and clinical conditions associated with ACADSB. Collagen-like Tail Subunit (single strand of homotrimer) of Asymmetric Acetylcholinesterase (COLQ, Accession NM_005677) is another VGAM496 host target gene. COLQ BINDING SITE1 through COLQ BINDING SITE6 are HOST TARGET binding sites found in untranslated regions of mRNA encoded by COLQ, corresponding to HOST TARGET binding sites such as BINDING SITE I, BINDING SITE II or BINDING SITE III. Table 2 illustrates the complementarity of the nucleotide sequences of COLQ BINDING SITE1 through COLQ BINDING SITE6, designated SEQ ID:12233, SEQ ID:27865, SEQ ID:27859, SEQ ID:27853, SEQ ID:27862 and SEQ ID:27856 respectively, to the nucleotide sequence of VGAM496 RNA, herein designated VGAM RNA, also designated SEQ ID:3207.

Another function of VGAM496 is therefore inhibition of Collagen-like Tail Subunit (single strand of homotrimer) of Asymmetric Acetylcholinesterase (COLQ, Accession NM_005677). Accordingly, utilities of VGAM496 include diagnosis, prevention and treatment of diseases and clinical conditions associated with COLQ. UDP-N-acetyl-alpha-D-galactosamine:polypeptide N-acetylgalactosaminyltransferase 1 (GalNAc-T1) (GALNT1, Accession NM_020474) is another VGAM496 host target gene. GALNT1 BINDING SITE is HOST TARGET binding site found in the 3' untranslated region of mRNA encoded by GALNT1, corresponding to a HOST TARGET binding site such as BINDING SITE I, BINDING SITE II or BINDING SITE III. Table 2 illustrates the complementarity of the nucleotide sequences of GALNT1 BINDING SITE, designated SEQ ID:21722, to the nucleotide sequence of VGAM496 RNA, herein designated VGAM RNA, also designated SEQ ID:3207.

Another function of VGAM496 is therefore inhibition of UDP-N-acetyl-alpha-D-galactosamine:polypeptide N-acetylgalactosaminyltransferase 1 (GalNAc-T1) (GALNT1, Accession NM_020474), a gene which transfers an N-acetyl galactosamine (GalNAc) to a serine or threonine residue in the first step of O-linked oligosaccharide biosynthesis. Accordingly, utilities of VGAM496 include diagnosis, prevention and treatment of diseases and clinical conditions associated with GALNT1. The function of GALNT1 and its association with various diseases and clinical conditions, has been established by previous studies, as described hereinabove with reference to VGAM120. LFG (Accession XM_084780) is another VGAM496 host target gene. LFG BINDING SITE is HOST TARGET binding site found in the 3' untranslated region of mRNA encoded by LFG, corresponding to a HOST TARGET binding site such as BINDING SITE I, BINDING SITE II or BINDING SITE III. Table 2 illustrates the complementarity of the nucleotide sequences of LFG BINDING SITE, designated SEQ ID:37693, to the nucleotide sequence of VGAM496 RNA, herein designated VGAM RNA, also designated SEQ ID:3207.

Another function of VGAM496 is therefore inhibition of LFG (Accession XM_084780). Accordingly, utilities of VGAM496 include diagnosis, prevention and treatment of diseases and clinical conditions associated with LFG. Protocadherin Alpha 9 (PCDHA9, Accession NM_014005) is another VGAM496 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:15208, to the nucleotide sequence of VGAM496 RNA, herein designated VGAM RNA, also designated SEQ ID:3207.

Another function of VGAM496 is therefore inhibition of Protocadherin Alpha 9 (PCDHA9, Accession NM_014005), a gene which is a calcium-dependent cell-adhesion protein. Accordingly, utilities of VGAM496 include diagnosis, prevention and treatment of diseases and clinical conditions associated with PCDHA9. The function of PCDHA9 and its association with various diseases and clinical conditions, has been established by previous studies, as described hereinabove with reference to VGAM71. Retinitis Pigmentosa 2 (X-linked recessive) (RP2, Accession NM_006915) is another VGAM496 host target gene. RP2 BINDING SITE is HOST TARGET binding site found in the 3' untranslated region of mRNA encoded by RP2, corresponding to a HOST TARGET binding site such as BINDING SITE I, BINDING SITE II or BINDING SITE III. Table 2 illustrates the complementarity of the nucleotide sequences of RP2 BINDING SITE, designated SEQ ID:13789, to the nucleotide sequence of VGAM496 RNA, herein designated VGAM RNA, also designated SEQ ID:3207.

Another function of VGAM496 is therefore inhibition of Retinitis Pigmentosa 2 (X-linked recessive) (RP2, Accession NM_006915). Accordingly, utilities of VGAM496 include diagnosis, prevention and treatment of diseases and clinical conditions associated with RP2. SRGAP1 (Accession XM_051143) is another VGAM496 host target gene. SRGAP1 BINDING SITE is HOST TARGET binding site found in the 5' untranslated region of mRNA encoded by SRGAP1, corresponding to a HOST TARGET binding site such as BINDING SITE I, BINDING SITE II or BINDING SITE III. Table 2 illustrates the complementarity of the nucleotide sequences of SRGAP1 BINDING SITE, designated SEQ ID:35759, to the nucleotide sequence of VGAM496 RNA, herein designated VGAM RNA, also designated SEQ ID:3207.

Another function of VGAM496 is therefore inhibition of SRGAP1 (Accession XM_051143). Accordingly, utilities of VGAM496 include diagnosis, prevention and treatment of diseases and clinical conditions associated with SRGAP1. Surfeit 4 (SURF4, Accession NM_033161) is another VGAM496 host target gene. SURF4 BINDING SITE is HOST TARGET binding site found in the 3' untranslated region of mRNA encoded by SURF4, corresponding to a HOST TARGET binding site such as BINDING SITE I, BINDING SITE II or BINDING SITE III. Table 2 illustrates the complementarity of the nucleotide sequences of SURF4 BINDING SITE, designated SEQ ID:27011, to the nucleotide sequence of VGAM496 RNA, herein designated VGAM RNA, also designated SEQ ID:3207.

Another function of VGAM496 is therefore inhibition of Surfeit 4 (SURF4, Accession NM_033161), a gene which is a conserved integral membrane protein containing multiple putative transmembrane regions. Accordingly, utilities of VGAM496 include diagnosis, prevention and treatment of diseases and clinical conditions associated with SURF4. The function of SURF4 has been established by previous studies. Using PCR with primers based on the sequence of mouse Surf4 to screen a HeLa cell cDNA library, Reeves and Fried (1995) obtained a cDNA encoding human SURF4. The deduced 269-amino acid protein, which is 60% and 99% identical to the worm and mouse proteins, respectively, contains 7 transmembrane segments, a predicted lumenal N terminus, multiple phosphorylation sites, and a double-lysine retrieval motif at the C terminus. Immunoblot analysis showed expression of a 30-kD membrane protein. Immunofluorescence microscopy demonstrated cytoplasmic expression. Belden and Barlowe (2001) showed that Erv29, the yeast homolog of SURF4, is directly required for packaging glycosylated pro-alpha-factor (Gpaf) into COPII (see OMIM Ref. No. COPA; 601924) vesicles. Subcellular fractionation experiments indicated that Erv29 is equally distributed between endoplasmic reticulum (ER) and Golgi membranes. Increased expression of Erv29 in the ER alleviated the accumulation of Gpaf. Belden and Barlowe (2001) proposed that Erv29 binds to fully folded Gpaf and probably to other soluble secretory cargo in the ER, after which the Erv29-cargo complexes are packaged into COPII vesicles for transport to the Golgi complex. The authors noted that similar mechanisms have been postulated for ERGIC1 (LMAN1; 601567).

Full details of the abovementioned studies are described in the following publications, the disclosure of which are hereby incorporated by reference:

Belden, W. J.; Barlowe, C.: Role of Erv29p in collecting soluble secretory proteins into ER-derived transport vesicles. Science 294:1528-1531, 2001; and Reeves, J. E.; Fried, M.: The surf-4 gene encodes a novel 30 kDa integral membrane protein. Molec. Membr. Biol. 12:201-208, 1995.

Further studies establishing the function and utilities of SURF4 are found in John Hopkins OMIM database record ID 185660, and in sited publications numbered 10458-10460 listed in the bibliography section hereinbelow, which are also hereby incorporated by reference. ABLIM (Accession NM_002313) is another VGAM496 host target gene. ABLIM BINDING SITE1 and ABLIM BINDING SITE2 are HOST TARGET binding sites found in untranslated regions of mRNA encoded by ABLIM, corresponding to HOST TARGET binding sites such as BINDING SITE I, BINDING SITE II or BINDING SITE III. Table 2 illustrates the complementarity of the nucleotide sequences of ABLIM BINDING SITE1 and ABLIM BINDING SITE2, designated SEQ ID:8111 and SEQ ID:13544 respectively, to the nucleotide sequence of VGAM496 RNA, herein designated VGAM RNA, also designated SEQ ID:3207.

Another function of VGAM496 is therefore inhibition of ABLIM (Accession NM_002313). Accordingly, utilities of VGAM496 include diagnosis, prevention and treatment of diseases and clinical conditions associated with ABLIM. DKFZP761C169 (Accession XM_042059) is another VGAM496 host target gene. DKFZP761C169 BINDING SITE is HOST TARGET binding site found in the 3' untranslated region of mRNA encoded by DKFZP761C169, corresponding to a HOST TARGET binding site such as BINDING SITE I, BINDING SITE II or BINDING SITE III. Table 2 illustrates the complementarity of the nucleotide sequences of DKFZP761C169 BINDING SITE, designated SEQ ID:33679, to the nucleotide sequence of VGAM496 RNA, herein designated VGAM RNA, also designated SEQ ID:3207.

Another function of VGAM496 is therefore inhibition of DKFZP761C169 (Accession XM_042059). Accordingly, utilities of VGAM496 include diagnosis, prevention and treatment of diseases and clinical conditions associated with DKFZP761C169. FLJ10737 (Accession NM_018198) is another VGAM496 host target gene. FLJ10737 BINDING SITE is HOST TARGET binding site found in the 3' untranslated region of mRNA encoded by FLJ10737, corresponding to a HOST TARGET binding site such as BINDING SITE I, BINDING SITE II or BINDING SITE III. Table 2 illustrates the complementarity of the nucleotide sequences of FLJ10737 BINDING SITE, designated SEQ ID:20064, to the nucleotide sequence of VGAM496 RNA, herein designated VGAM RNA, also designated SEQ ID:3207.

Another function of VGAM496 is therefore inhibition of FLJ10737 (Accession NM_018198). Accordingly, utilities of VGAM496 include diagnosis, prevention and treatment of diseases and clinical conditions associated with FLJ10737. FLJ11273 (Accession NM_018374) is another VGAM496 host target gene. FLJ11273 BINDING SITE is HOST TARGET binding site found in the 3' untranslated region of mRNA encoded by FLJ11273, corresponding to a HOST TARGET binding site such as BINDING SITE I, BINDING SITE II or BINDING SITE III. Table 2 illustrates the complementarity of the nucleotide sequences of FLJ11273 BINDING SITE, designated SEQ ID:20394, to the nucleotide sequence of VGAM496 RNA, herein designated VGAM RNA, also designated SEQ ID:3207.

Another function of VGAM496 is therefore inhibition of FLJ11273 (Accession NM_018374). Accordingly, utilities of VGAM496 include diagnosis, prevention and treatment of diseases and clinical conditions associated with FLJ11273. FLJ11710 (Accession NM_024846) is another VGAM496 host target gene. FLJ11710 BINDING SITE is HOST TARGET binding site found in the 3' untranslated region of mRNA encoded by FLJ11710, corresponding to a HOST TARGET binding site such as BINDING SITE I, BINDING SITE II or BINDING SITE III. Table 2 illustrates the complementarity of the nucleotide sequences of FLJ11710 BINDING SITE, designated SEQ ID:24278, to the nucleotide sequence of VGAM496 RNA, herein designated VGAM RNA, also designated SEQ ID:3207.

Another function of VGAM496 is therefore inhibition of FLJ11710 (Accession NM_024846). Accordingly, utilities of VGAM496 include diagnosis, prevention and treatment of diseases and clinical conditions associated with FLJ11710.

FLJ20189 (Accession NM_017704) is another VGAM496 host target gene. FLJ20189 BINDING SITE is HOST TARGET binding site found in the 3' untranslated region of mRNA encoded by FLJ20189, corresponding to a HOST TARGET binding site such as BINDING SITE I, BINDING SITE II or BINDING SITE III. Table 2 illustrates the complementarity of the nucleotide sequences of FLJ20189 BINDING SITE, designated SEQ ID:19280, to the nucleotide sequence of VGAM496 RNA, herein designated VGAM RNA, also designated SEQ ID:3207.

Another function of VGAM496 is therefore inhibition of FLJ20189 (Accession NM_017704). Accordingly, utilities of VGAM496 include diagnosis, prevention and treatment of diseases and clinical conditions associated with FLJ20189.

FLJ20668 (Accession NM_017923) is another VGAM496 host target gene. FLJ20668 BINDING SITE is HOST TARGET binding site found in the 3' untranslated region of mRNA encoded by FLJ20668, corresponding to a HOST TARGET binding site such as BINDING SITE I, BINDING SITE II or BINDING SITE III. Table 2 illustrates the complementarity of the nucleotide sequences of FLJ20668 BINDING SITE, designated SEQ ID:19589, to the nucleotide sequence of VGAM496 RNA, herein designated VGAM RNA, also designated SEQ ID:3207.

Another function of VGAM496 is therefore inhibition of FLJ20668 (Accession NM_017923). Accordingly, utilities of VGAM496 include diagnosis, prevention and treatment of diseases and clinical conditions associated with FLJ20668.

FLJ20694 (Accession NM_017928) is another VGAM496 host target gene. FLJ20694 BINDING SITE is HOST TARGET binding site found in the 3' untranslated region of mRNA encoded by FLJ20694, corresponding to a HOST TARGET binding site such as BINDING SITE I, BINDING SITE II or BINDING SITE III. Table 2 illustrates the complementarity of the nucleotide sequences of FLJ20694 BINDING SITE, designated SEQ ID:19606, to the nucleotide sequence of VGAM496 RNA, herein designated VGAM RNA, also designated SEQ ID:3207.

Another function of VGAM496 is therefore inhibition of FLJ20694 (Accession NM_017928). Accordingly, utilities of VGAM496 include diagnosis, prevention and treatment of diseases and clinical conditions associated with FLJ20694.

FXYD Domain Containing Ion Transport Regulator 3 (FXYD3, Accession NM_005971) is another VGAM496 host target gene. FXYD3 BINDING SITE1 and FXYD3 BINDING SITE2 are HOST TARGET binding sites found in untranslated regions of mRNA encoded by FXYD3, corresponding to HOST TARGET binding sites such as BINDING SITE I, BINDING SITE II or BINDING SITE III. Table 2 illustrates the complementarity of the nucleotide sequences of FXYD3 BINDING SITE1 and FXYD3 BINDING SITE2, designated SEQ ID:12594 and SEQ ID:22437 respectively, to the nucleotide sequence of VGAM496 RNA, herein designated VGAM RNA, also designated SEQ ID:3207.

Another function of VGAM496 is therefore inhibition of FXYD Domain Containing Ion Transport Regulator 3 (FXYD3, Accession NM_005971). Accordingly, utilities of VGAM496 include diagnosis, prevention and treatment of diseases and clinical conditions associated with FXYD3.

KIAA0237 (Accession NM_014747) is another VGAM496 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16456, to the nucleotide sequence of VGAM496 RNA, herein designated VGAM RNA, also designated SEQ ID:3207.

Another function of VGAM496 is therefore inhibition of KIAA0237 (Accession NM_014747). Accordingly, utilities of VGAM496 include diagnosis, prevention and treatment of diseases and clinical conditions associated with KIAA0237.

KIAA0435 (Accession NM_014801) is another VGAM496 host target gene. KIAA0435 BINDING SITE is HOST TARGET binding site found in the 5' untranslated region of mRNA encoded by KIAA0435, corresponding to a HOST TARGET binding site such as BINDING SITE I, BINDING SITE II or BINDING SITE III. Table 2 illustrates the complementarity of the nucleotide sequences of KIAA0435 BINDING SITE, designated SEQ ID:16723, to the nucleotide sequence of VGAM496 RNA, herein designated VGAM RNA, also designated SEQ ID:3207.

Another function of VGAM496 is therefore inhibition of KIAA0435 (Accession NM_014801). Accordingly, utilities of VGAM496 include diagnosis, prevention and treatment of diseases and clinical conditions associated with KIAA0435.

KIAA1729 (Accession XM_114418) is another VGAM496 host target gene. KIAA1729 BINDING SITE is HOST TARGET binding site found in the 3' untranslated region of mRNA encoded by KIAA1729, corresponding to a HOST TARGET binding site such as BINDING SITE I, BINDING SITE II or BINDING SITE III. Table 2 illustrates the complementarity of the nucleotide sequences of KIAA1729 BINDING SITE, designated SEQ ID:42948, to the nucleotide sequence of VGAM496 RNA, herein designated VGAM RNA, also designated SEQ ID:3207.

Another function of VGAM496 is therefore inhibition of KIAA1729 (Accession XM_114418). Accordingly, utilities of VGAM496 include diagnosis, prevention and treatment of diseases and clinical conditions associated with KIAA1729.

MGC10960 (Accession NM_032653) is another VGAM496 host target gene. MGC10960 BINDING SITE is HOST TARGET binding site found in the 3' untranslated region of mRNA encoded by MGC10960, corresponding to a HOST TARGET binding site such as BINDING SITE I, BINDING SITE II or BINDING SITE III. Table 2 illustrates the complementarity of the nucleotide sequences of MGC10960 BINDING SITE, designated SEQ ID:26384, to the nucleotide sequence of VGAM496 RNA, herein designated VGAM RNA, also designated SEQ ID:3207.

Another function of VGAM496 is therefore inhibition of MGC10960 (Accession NM_032653). Accordingly, utilities of VGAM496 include diagnosis, prevention and treatment of diseases and clinical conditions associated with MGC10960.

MGC2865 (Accession NM_032375) is another VGAM496 host target gene. MGC2865 BINDING SITE is HOST TARGET binding site found in the 3' untranslated region of mRNA encoded by MGC2865, corresponding to a HOST TARGET binding site such as BINDING SITE I, BINDING SITE II or BINDING SITE III. Table 2 illustrates the complementarity of the nucleotide sequences of MGC2865 BINDING SITE, designated SEQ ID:26166, to the nucleotide sequence of VGAM496 RNA, herein designated VGAM RNA, also designated SEQ ID:3207.

Another function of VGAM496 is therefore inhibition of MGC2865 (Accession NM_032375). Accordingly, utilities of VGAM496 include diagnosis, prevention and treatment of diseases and clinical conditions associated with MGC2865.

RAB39, Member RAS Oncogene Family (RAB39, Accession XM_084662) is another VGAM496 host target gene. RAB39 BINDING SITE is HOST TARGET binding site found in the 3' untranslated region of mRNA encoded by RAB39, corresponding to a HOST TARGET binding site such as BINDING SITE I, BINDING SITE II or BINDING SITE III. Table 2 illustrates the complementarity of the nucleotide sequences of RAB39 BINDING SITE, designated SEQ ID:37647, to the nucleotide sequence of VGAM496 RNA, herein designated VGAM RNA, also designated SEQ ID:3207.

Another function of VGAM496 is therefore inhibition of RAB39, Member RAS Oncogene Family (RAB39, Accession XM_084662). Accordingly, utilities of VGAM496 include diagnosis, prevention and treatment of diseases and clinical conditions associated with RAB39. T-cell Leukemia/lymphoma 6 (TCL6, Accession NM_020552) is another VGAM496 host target gene. TCL6 BINDING SITE1 and TCL6 BINDING SITE2 are HOST TARGET binding sites found in untranslated regions of mRNA encoded by TCL6, corresponding to HOST TARGET binding sites such as BINDING SITE I, BINDING SITE II or BINDING SITE III. Table 2 illustrates the complementarity of the nucleotide sequences of TCL6 BINDING SITE1 and TCL6 BINDING SITE2, designated SEQ ID:21767 and SEQ ID:21774 respectively, to the nucleotide sequence of VGAM496 RNA, herein designated VGAM RNA, also designated SEQ ID:3207.

Another function of VGAM496 is therefore inhibition of T-cell Leukemia/lymphoma 6 (TCL6, Accession NM_020552). Accordingly, utilities of VGAM496 include diagnosis, prevention and treatment of diseases and clinical conditions associated with TCL6. LOC127428 (Accession XM_059144) is another VGAM496 host target gene. LOC127428 BINDING SITE is HOST TARGET binding site found in the 5' untranslated region of mRNA encoded by LOC127428, corresponding to a HOST TARGET binding site such as BINDING SITE I, BINDING SITE II or BINDING SITE III. Table 2 illustrates the complementarity of the nucleotide sequences of LOC127428 BINDING SITE, designated SEQ ID:36897, to the nucleotide sequence of VGAM496 RNA, herein designated VGAM RNA, also designated SEQ ID:3207.

Another function of VGAM496 is therefore inhibition of LOC127428 (Accession XM_059144). Accordingly, utilities of VGAM496 include diagnosis, prevention and treatment of diseases and clinical conditions associated with LOC127428. LOC139331 (Accession XM_066631) is another VGAM496 host target gene. LOC139331 BINDING SITE is HOST TARGET binding site found in the 5' untranslated region of mRNA encoded by LOC139331, corresponding to a HOST TARGET binding site such as BINDING SITE I, BINDING SITE II or BINDING SITE III. Table 2 illustrates the complementarity of the nucleotide sequences of LOC139331 BINDING SITE, designated SEQ ID:37341, to the nucleotide sequence of VGAM496 RNA, herein designated VGAM RNA, also designated SEQ ID:3207.

Another function of VGAM496 is therefore inhibition of LOC139331 (Accession XM_066631). Accordingly, utilities of VGAM496 include diagnosis, prevention and treatment of diseases and clinical conditions associated with LOC139331. LOC147991 (Accession XM_085993) is another VGAM496 host target gene. LOC147991 BINDING SITE is HOST TARGET binding site found in the 5' untranslated region of mRNA encoded by LOC147991, corresponding to a HOST TARGET binding site such as BINDING SITE I, BINDING SITE II or BINDING SITE III. Table 2 illustrates the complementarity of the nucleotide sequences of LOC147991 BINDING SITE, designated SEQ ID:38435, to the nucleotide sequence of VGAM496 RNA, herein designated VGAM RNA, also designated SEQ ID:3207.

Another function of VGAM496 is therefore inhibition of LOC147991 (Accession XM_085993). Accordingly, utilities of VGAM496 include diagnosis, prevention and treatment of diseases and clinical conditions associated with LOC147991. LOC149267 (Accession NM_138480) is another VGAM496 host target gene. LOC149267 BINDING SITE is HOST TARGET binding site found in the 5' untranslated region of mRNA encoded by LOC149267, corresponding to a HOST TARGET binding site such as BINDING SITE I, BINDING SITE II or BINDING SITE III. Table 2 illustrates the complementarity of the nucleotide sequences of LOC149267 BINDING SITE, designated SEQ ID:28834, to the nucleotide sequence of VGAM496 RNA, herein designated VGAM RNA, also designated SEQ ID:3207.

Another function of VGAM496 is therefore inhibition of LOC149267 (Accession NM_138480). Accordingly, utilities of VGAM496 include diagnosis, prevention and treatment of diseases and clinical conditions associated with LOC149267. LOC162333 (Accession XM_102591) is another VGAM496 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42141, to the nucleotide sequence of VGAM496 RNA, herein designated VGAM RNA, also designated SEQ ID:3207.

Another function of VGAM496 is therefore inhibition of LOC162333 (Accession XM_102591). Accordingly, utilities of VGAM496 include diagnosis, prevention and treatment of diseases and clinical conditions associated with LOC162333. LOC219673 (Accession XM_167567) is another VGAM496 host target gene. LOC219673 BINDING SITE is HOST TARGET binding site found in the 5' untranslated region of mRNA encoded by LOC219673, corresponding to a HOST TARGET binding site such as BINDING SITE I, BINDING SITE II or BINDING SITE III. Table 2 illustrates the complementarity of the nucleotide sequences of LOC219673 BINDING SITE, designated SEQ ID:44695, to the nucleotide sequence of VGAM496 RNA, herein designated VGAM RNA, also designated SEQ ID:3207.

Another function of VGAM496 is therefore inhibition of LOC219673 (Accession XM_167567). Accordingly, utilities of VGAM496 include diagnosis, prevention and treatment of diseases and clinical conditions associated with LOC219673. LOC221301 (Accession XM_166308) is another VGAM496 host target gene. LOC221301 BINDING SITE is HOST TARGET binding site found in the 3' untranslated region of mRNA encoded by LOC221301, corresponding to a HOST TARGET binding site such as BINDING SITE I, BINDING SITE II or BINDING SITE III. Table 2 illustrates the complementarity of the nucleotide sequences of LOC221301 BINDING SITE, designated SEQ ID:44129, to the nucleotide sequence of VGAM496 RNA, herein designated VGAM RNA, also designated SEQ ID:3207.

Another function of VGAM496 is therefore inhibition of LOC221301 (Accession XM_166308). Accordingly, utilities of VGAM496 include diagnosis, prevention and treatment of diseases and clinical conditions associated with LOC221301. LOC221421 (Accession XM_166428) is another VGAM496 host target gene. LOC221421 BINDING SITE is HOST TARGET binding site found in the 3' untranslated region of mRNA encoded by LOC221421, corresponding to a HOST TARGET binding site such as BINDING SITE I, BINDING SITE II or BINDING SITE III. Table 2 illustrates the complementarity of the nucleotide sequences of LOC221421 BINDING SITE, designated SEQ ID:44321, to the nucleotide sequence of VGAM496 RNA, herein designated VGAM RNA, also designated SEQ ID:3207.

Another function of VGAM496 is therefore inhibition of LOC221421 (Accession XM_166428). Accordingly, utilities of VGAM496 include diagnosis, prevention and treatment of diseases and clinical conditions associated with LOC221421. LOC90321 (Accession XM_030896) is another VGAM496 host target gene. LOC90321 BINDING SITE is HOST TARGET binding site found in the 3' untranslated region of mRNA encoded by LOC90321, corresponding to a HOST TARGET binding site such as BINDING SITE I, BINDING SITE II or BINDING SITE III. Table 2 illustrates the complementarity of the nucleotide sequences of LOC90321 BINDING SITE, designated SEQ ID:31212, to the nucleotide sequence of VGAM496 RNA, herein designated VGAM RNA, also designated SEQ ID:3207.

Another function of VGAM496 is therefore inhibition of LOC90321 (Accession XM_030896). Accordingly, utilities of VGAM496 include diagnosis, prevention and treatment of diseases and clinical conditions associated with LOC90321. FIG. 1 further provides a conceptual description of a novel bioinformatically detected viral gene of the present invention, referred to here as Viral Genomic Address Messenger 497 (VGAM497) viral gene, which modulates expression of respective host target genes thereof, the function and utility of which host target genes is known in the art.

VGAM497 is a novel bioinformatically detected regulatory, non protein coding, viral micro RNA (miRNA) gene. The method by which VGAM497 was detected is described hereinabove with reference to FIGS. 1-8.

VGAM497 gene, herein designated VGAM GENE, is a viral gene contained in the genome of Human Herpesvirus 7. VGAM497 host target gene, herein designated VGAM HOST TARGET GENE, is a human gene contained in the human genome.

VGAM497 gene encodes a VGAM497 precursor RNA, herein designated VGAM PRECURSOR RNA. Similar to other miRNA genes, and unlike most ordinary genes, VGAM497 precursor RNA does not encode a protein. A nucleotide sequence identical or highly similar to the nucleotide sequence of VGAM497 precursor RNA is designated SEQ ID:483, and is provided hereinbelow with reference to the sequence listing part. Nucleotide sequence SEQ ID:483 is located at position 58211 relative to the genome of Human Herpesvirus 7.

VGAM497 precursor RNA folds onto itself, forming VGAM497 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM497 folded precursor RNA into VGAM497 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM497 RNA is designated SEQ ID:3208, and is provided hereinbelow with reference to the sequence listing part.

VGAM497 host target gene, herein designated VGAM HOST TARGET GENE, encodes a corresponding messenger RNA, VGAM497 host target RNA, herein designated VGAM HOST TARGET RNA. VGAM497 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM497 RNA, herein designated VGAM RNA, binds complementarily to one or more host target binding sites located in untranslated regions of VGAM497 host target RNA, herein designated VGAM HOST TARGET RNA. This complementary binding is due to the fact that the nucleotide sequence of VGAM497 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM497 RNA, herein designated VGAM RNA, may have a different number of host target binding sites in untranslated regions of a VGAM497 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM497 RNA, herein designated VGAM RNA, to host target binding sites on VGAM497 host target RNA, herein designated VGAM HOST TARGET RNA, such as BINDING SITE I, BINDING SITE II and BINDING SITE III, inhibits translation of VGAM497 host target RNA into VGAM497 host target protein, herein designated VGAM HOST TARGET PROTEIN. VGAM host target protein is therefore outlined by a broken line.

It is appreciated that VGAM497 host target gene, herein designated VGAM HOST TARGET GENE, in fact represents a plurality of VGAM497 host target genes. The mRNA of each one of this plurality of VGAM497 host target genes comprises one or more host target binding sites, each having a nucleotide sequence which is at least partly complementary to VGAM497 RNA, herein designated VGAM RNA, and which when bound by VGAM497 RNA causes inhibition of translation of respective one or more VGAM497 host target proteins.

It is further appreciated by one skilled in the art that the mode of translational inhibition illustrated by FIG. 1 with specific reference to translational inhibition exerted by VGAM497 gene, herein designated VGAM GENE, on one or more VGAM497 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM497 is inhibition of expression of host target genes, as part of a novel viral mechanism of attacking a host. Accordingly, utilities of VGAM497 include diagnosis, prevention and treatment of viral infection by Human Herpesvirus 7. Specific functions, and accordingly utilities, of VGAM497 correlate with, and may be deduced from, the identity of the host target genes which VGAM497 binds and inhibits, and the function of these host target genes, as elaborated hereinbelow.

Nucleotide sequences of the VGAM497 precursor RNA, herein designated VGAM PRECURSOR RNA, and of the 'diced' VGAM497 RNA, herein designated VGAM RNA, and a schematic representation of the secondary folding of VGAM497 folded precursor RNA, herein designated VGAM FOLDED PRECURSOR RNA, of VGAM497 are further described hereinbelow with reference to Table 1.

Nucleotide sequences of host target binding sites, such as BINDING SITE-I, BINDING SITE-II and BINDING SITE-III of FIG. 1, found on VGAM497 host target RNA, and schematic representation of the complementarity of each of these host target binding sites to VGAM497 RNA, herein designated VGAM RNA, are described hereinbelow with reference to Table 2.

As mentioned hereinabove with reference to FIG. 1, a function of VGAM497 gene, herein designated VGAM is inhibition of expression of VGAM497 target genes. It is appreciated that specific functions, and accordingly utilities, of VGAM497 correlate with, and may be deduced from, the identity of the target genes which VGAM497 binds and inhibits, and the function of these target genes, as elaborated hereinbelow.

Amyloid Beta (A4) Precursor Protein (protease nexin-II, Alzheimer disease) (APP, Accession NM_000484) is a VGAM497 host target gene. APP BINDING SITE is HOST TARGET binding site found in the 3' untranslated region of mRNA encoded by APP, corresponding to a HOST TARGET binding site such as BINDING SITE I, BINDING SITE II or BINDING SITE III. Table 2 illustrates the complementarity of the nucleotide sequences of APP BINDING SITE, designated SEQ ID:6092, to the nucleotide sequence of VGAM497 RNA, herein designated VGAM RNA, also designated SEQ ID:3208.

A function of VGAM497 is therefore inhibition of Amyloid Beta (A4) Precursor Protein (protease nexin-II, Alzheimer disease) (APP, Accession NM_000484). Accordingly, utilities of VGAM497 include diagnosis, prevention and treatment of diseases and clinical conditions associated with APP. Bromodomain and PHD Finger Containing, 1 (BRPF1, Accession XM_054520) is another VGAM497 host target gene. BRPF1 BINDING SITE is HOST TARGET binding site found in the 3' untranslated region of mRNA encoded by BRPF1, corresponding to a HOST TARGET binding site such as BINDING SITE I, BINDING SITE II or BINDING SITE III. Table 2 illustrates the complementarity of the nucleotide sequences of BRPF1 BINDING SITE, designated SEQ ID:36175, to the nucleotide sequence of VGAM497 RNA, herein designated VGAM RNA, also designated SEQ ID:3208.

Another function of VGAM497 is therefore inhibition of Bromodomain and PHD Finger Containing, 1 (BRPF1, Accession XM_054520), a gene which has 6 zinc finger motifs and a bromodomain. Accordingly, utilities of VGAM497 include diagnosis, prevention and treatment of diseases and clinical conditions associated with BRPF1. The function of BRPF1 has been established by previous studies. Thompson et al. (1994) cloned a cDNA encoding a predicted 1,214-amino acid protein that they designated BR140. The BR140 protein, known also as peregrin, has 6 zinc finger motifs and a bromodomain. Thompson et al. (1994) found that BR140 migrates as a 150-kD protein on SDS-PAGE.

Northern blots showed that BR140 is expressed ubiquitously. Western blots and immunohistochemistry revealed that BR140 is expressed at the highest level in testes and spermatogonia, and is localized within nuclei. Gregorini et al. (1996) noted that BR140 is very similar in structure to 2 other zinc finger genes, AF10 (OMIM Ref. No. 602409) and AF17 (MLLT6; 600328) and suggested that they form a family of regulatory proteins. Gregorini et al. (1996) mapped the BR140 gene to 3p25-p26 by fluorescence in situ hybridization.

Full details of the abovementioned studies are described in the following publications, the disclosure of which are hereby incorporated by reference:

Gregorini, A.; Sahin, F. I.; Lillington, D. M.; Meerabux, J.; Saha, V.; McCullagh, P.; Bocci, M.; Menevse, S.; Papa, S.; Young, B. D.: Gene BR140, which is related to AF10 and AF17, maps to chromosome band 3p25. Genes Chromosomes Cancer 17:269-272, 1996; and Thompson, K. A.; Wang, B.; Argraves, W. S.; Giancotti, F. G.; Schranck, D. P.; Ruoslahti, E.: BR140, a novel zinc-finger protein with homology to the TAF250 subunit of TFIID. Biochem.

Further studies establishing the function and utilities of BRPF1 are found in John Hopkins OMIM database record ID 602410, and in sited publications numbered 6014-6015 listed in the bibliography section hereinbelow, which are also hereby incorporated by reference. CAMP Responsive Element Binding Protein 1 (CREB1, Accession NM_004379) is another VGAM497 host target gene. CREB1 BINDING SITE is HOST TARGET binding site found in the 3' untranslated region of mRNA encoded by CREB1, corresponding to a HOST TARGET binding site such as BINDING SITE I, BINDING SITE II or BINDING SITE III. Table 2 illustrates the complementarity of the nucleotide sequences of CREB1 BINDING SITE, designated SEQ ID:10602, to the nucleotide sequence of VGAM497 RNA, herein designated VGAM RNA, also designated SEQ ID:3208.

Another function of VGAM497 is therefore inhibition of CAMP Responsive Element Binding Protein 1 (CREB1, Accession NM_004379), a gene which regulates expression of cAMP-inducible genes. Accordingly, utilities of VGAM497 include diagnosis, prevention and treatment of diseases and clinical conditions associated with CREB1. The function of CREB1 has been established by previous studies. Cyclic AMP (cAMP) second messenger pathways provide a chief means by which cellular growth, differentiation, and function can be influenced by extracellular signals. Following hormonal stimulation of a neuroendocrine cell, for example, increased cAMP levels activate cAMP-dependent protein kinase A, which phosphorylates 1 or more DNA-binding proteins. These in turn stimulate transcription of an array of cAMP-responsive genes such as those for somatostatin (OMIM Ref. No. 182450), alpha-gonadotropin (OMIM Ref. No. 118850), proenkephalin (OMIM Ref. No. 131330) and FOS (OMIM Ref. No. 164810). All cAMP-responsive gene promoters have in common an 8-base enhancer known as the cAMP-response element (CRE) containing a conserved core sequence, 5-prime-TGACG-3-prime, first described in the somatostatin gene by Montminy et al. (1986). Montminy and Bilezikjian (1987) purified a 43-kD nuclear phosphoprotein, which binds to CRE with high affinity. Hoeffler et al. (1988) isolated cDNA clones for human CREB. CREB1 may be identical to activating transcription factor (ATF). By use of a cDNA probe for Southern blot analysis of genomic DNA from a panel of mouse/human somatic cell hybrids and for in situ hybridization, Taylor et al. (1990) mapped CREB1 to 2q32.3-q34. Taylor et al. (1990) speculated about the possible involvement of CREB1 in genetic disorders or cancer and pointed to the fact that TCL4 (OMIM Ref. No. 186860), a locus implicated in T-cell leukemia/lymphoma, is located at 2q34. Cole et al. (1992) demonstrated that the Creb-1 locus maps to the proximal region of mouse chromosome 1. The CREB gene was found to be single copy in the mouse and well conserved through evolution. Barton et al. (1992) mapped the Creb-1 gene to mouse chromosome 1 by linkage studies. It was found to be approximately 1 cM distal to Cryg and 7 cM proximal to Vil. cAMP mediates the effects of TSH (OMIM Ref. No. 118850) by regulating thyroid follicular cell proliferation, differentiation, and function. To assess the functional importance of the cAMP response element-binding protein (CREB) in thyroid follicular cell regulation in vivo, Nguyen et al. (2000) targeted the expression of a dominant-negative CREB isoform to the thyroid glands of transgenic mice using a tissue-specific promoter. Transgenic mice exhibited severe growth retardation and primary hypothyroidism. Serum levels of TSH were elevated 8-fold above normal levels, and T4 and T3 levels were low. Ciliated thyroid epithelial cells were observed in the transgenic thyroid glands, suggesting a failure of follicular cell differentiation. Nguyen et al. (2000) concluded that these results demonstrate a critical role for CREB in thyroid growth, differentiation, and function in vivo Animal model experiments lend further support to the function of CREB1. Kida et al. (2002) generated transgenic mice with an inducible and reversible CREB repressor by fusing CREB with a ser133-to-ala mutation to a tamoxifen-dependent mutant of an estrogen receptor ligand-binding domain. They found that CREB is crucial for the consolidation of long-term conditioned fear memories, but not for encoding, storage, or retrieval of these memories. Their studies also showed that CREB is required for the stability of reactivated or retrieved conditioned fear memories. Although the transcriptional processes necessary for the stability of initial and reactivated memories differ, CREB was found to be required for both.

It is appreciated that the abovementioned animal model for CREB1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Barton, C. H.; Ajioka, J. W.; Roach, T. I. A.; Blackwell, J. M.: Mapping Creb-1 to chromosome 1 in the mouse. Genomics 14:790-792, 1992; and Kida, S.; Josselyn, S. A.; Pena de Ortiz, S.; Kogan, J. H.; Chevere, I.; Masushige, S.; Silva, A. J.: CREB required for the stability of new and reactivated fear memories. Nature Neuros.

Further studies establishing the function and utilities of CREB1 are found in John Hopkins OMIM database record ID 123810, and in sited publications numbered 11851-11857, 1204 and 150-157 listed in the bibliography section hereinbelow, which are also hereby incorporated by reference. Diacylglycerol Kinase, Beta 90 kDa (DGKB, Accession XM_166516) is another VGAM497 host target gene. DGKB BINDING SITE is HOST TARGET binding site found in the 3' untranslated region of mRNA encoded by DGKB, corresponding to a HOST TARGET binding site such as BINDING SITE I, BINDING SITE II or BINDING SITE III. Table 2 illustrates the complementarity of the nucleotide sequences of DGKB BINDING SITE, designated SEQ ID:44448, to the nucleotide sequence of VGAM497 RNA, herein designated VGAM RNA, also designated SEQ ID:3208.

Another function of VGAM497 is therefore inhibition of Diacylglycerol Kinase, Beta 90 kDa (DGKB, Accession XM_166516), a gene which regulates the intracellular concentration of the second messenger diacylglycerol (DAG). Accordingly, utilities of VGAM497 include diagnosis, prevention and treatment of diseases and clinical conditions associated with DGKB. The function of DGKB has been established by previous studies. Diacylglycerol kinase (DGK) plays a key role in cellular processes by regulating the intracellular concentration of the second messenger diacylglycerol (DAG). For background information on the DGKs, see DGK-alpha (80-kD DGK; 125855). Goto and Kondo (1993) isolated rat brain cDNAs encoding a novel 90-kD DGK. The predicted 90-kD DGK protein was 58% identical to the rat 80-kD DGK. Both proteins contain EF-hand motifs, cysteine-rich zinc finger-like sequences, and putative ATP-binding sites. When expressed in mammalian cells, the 90-kD protein exhibited DGK activity. Northern blot analysis revealed that the 90-kD DGK was expressed as an approximately 6.2-kb transcript predominantly in brain. In situ hybridization to rat tissues indicated that the 90-kD DGK was expressed intensely in restricted brain regions such as the caudate putamen and olfactory tubercle. The pattern of expression was different from that of the 80-kD DGK, leading the authors to suggest that there are multiple DGK isozymes, each of which has a characteristic regional pattern of expression. By screening human brain cDNAs for those encoding proteins larger than 50 kD, Nagase et al. (1998) identified KIAA0718, a cDNA encoding a human homolog of rat Dgkb. Using radiation hybrid analysis, they mapped the DGKB gene to chromosome 7.

Full details of the abovementioned studies are described in the following publications, the disclosure of which are hereby incorporated by reference:

Goto, K.; Kondo, H.: Molecular cloning and expression of a 90-kDa diacylglycerol kinase that predominantly localizes in neurons. Proc. Nat. Acad. Sci. 90:7598-7602, 1993; and Nagase, T.; Ishikawa, K.; Suyama, M.; Kikuno, R.; Miyajima, N.; Tanaka, A.; Kotani, H.; Nomura, N.; Ohara, O.: Prediction of the coding sequences of unidentified human genes. XI. The c.

Further studies establishing the function and utilities of DGKB are found in John Hopkins OMIM database record ID 604070, and in sited publications numbered 63 and 7048 listed in the bibliography section hereinbelow, which are also hereby incorporated by reference. Ems1 Sequence (mammary tumor and squamous cell carcinoma-associated (p80/85 src substrate) (EMS1, Accession NM_138565) is another VGAM497 host target gene. EMS1 BINDING SITE1 and EMS1 BINDING SITE2 are HOST TARGET binding sites found in untranslated regions of mRNA encoded by EMS1, corresponding to HOST TARGET binding sites such as BINDING SITE I, BINDING SITE II or BINDING SITE III. Table 2 illustrates the complementarity of the nucleotide sequences of EMS1 BINDING SITE1 and EMS1 BINDING SITE2, designated SEQ ID:28868 and SEQ ID:11737 respectively, to the nucleotide sequence of VGAM497 RNA, herein designated VGAM RNA, also designated SEQ ID:3208.

Another function of VGAM497 is therefore inhibition of Ems1 Sequence (mammary tumor and squamous cell carcinoma-associated (p80/85 src substrate) (EMS1, Accession NM_138565), a gene which may contribute to the organization of cell structure. in transformed cells may contribute to cellular growth regulation and transformation. Accordingly, utilities of VGAM497 include diagnosis, prevention and treatment of diseases and clinical conditions associated with EMS1. The function of EMS1 has been established by previous studies. Amplification of the 11q13 region is frequently found in breast cancer and in squamous cell carcinomas of the head and neck. The known oncogenes within the amplified 11q13 region, INT2 (OMIM Ref. No. 164950) and FGF4 (OMIM Ref. No. 164980), are rarely expressed in these tumors, indicating that another, hitherto unidentified gene or genes are involved in the unfavorable clinical course of disease associated with such amplification. To identify the gene or genes, Schuuring et al. (1992) constructed a cDNA library from a cell line with an 11q13 amplification and performed a differential cDNA cloning using labeled cDNAs from human squamous cell carcinoma cell lines with and without an 11q13 amplification. They isolated 2 cDNA clones, U21B31 and U21C8, which recognized genes amplified and overexpressed in cell lines harboring an 11q13 amplification. Sequence analysis of the U21C8 cDNA clone revealed no homology to known genes; they called this gene EMS1. The U21B31 cDNA clone corresponded to the 3-prime end of the PRAD1 proto-oncogene (OMIM Ref. No. 168461). Van Damme et al. (1997) stated that EMS1 is the human homolog of cortactin, an actin-binding protein involved in the restructuring of the cortical actin cytoskeleton. Cortactin is a substrate for the pp60v-src tyrosine kinase (see OMIM Ref. No. 190090). Cortactin is overexpressed in carcinoma cells with an amplification of 11q13 and is found in 2 forms, designated p80 and p85. Van Damme et al. (1997) found that in carcinoma cells with the 11q13 amplification, p85 was produced from p80 by posttranslational modification. Also, treatment of these cells with epidermal growth factor (OMIM Ref. No. 131530) or vanadate caused conversion of p80 to p85 and enhanced phosphorylation of the p85 form. Both overexpression and posttranslational modification of cortactin coincided with its redistribution from the cytoplasm to cell-matrix contact sites, implying a role for cortactin in the modulation of cellular adhesive properties.

Full details of the abovementioned studies are described in the following publications, the disclosure of which are hereby incorporated by reference:

Schuuring, E.; Verhoeven, E.; Mooi, W. J.; Michalides, R. J. A. M.: Identification and cloning of two overexpressed genes, U21B31/PRAD1 and EMS1, within the amplified chromosome 11q13 region in human carcinomas. Oncogene 7:355-361, 1992; and van Damme, H.; Brok, H.; Schuuring-Scholtes, E.; Schuuring, E.: The redistribution of cortactin into cell-matrix contact sites in human carcinoma cells with 11q13 amplification is asso.

Further studies establishing the function and utilities of EMS1 are found in John Hopkins OMIM database record ID 164765, and in sited publications numbered 5098-5099 listed in the bibliography section hereinbelow, which are also hereby incorporated by reference. FXYD Domain Containing Ion Transport Regulator 6 (FXYD6, Accession NM_022003) is another VGAM497 host target gene. FXYD6 BINDING SITE is HOST TARGET binding site found in the 3' untranslated region of mRNA encoded by FXYD6, corresponding to a HOST TARGET binding site such as BINDING SITE I, BINDING SITE II or BINDING SITE III. Table 2 illustrates the complementarity of the nucleotide sequences of FXYD6 BINDING SITE, designated SEQ ID:22554, to the nucleotide sequence of VGAM497 RNA, herein designated VGAM RNA, also designated SEQ ID:3208.

Another function of VGAM497 is therefore inhibition of FXYD Domain Containing Ion Transport Regulator 6 (FXYD6, Accession NM_022003). Accordingly, utilities of VGAM497 include diagnosis, prevention and treatment of diseases and clinical conditions associated with FXYD6. Phosphoinositide-3-kinase, Regulatory Subunit, Polypeptide 3 (p55, gamma) (PIK3R3, Accession XM_027982) is another VGAM497 host target gene. PIK3R3 BINDING SITE is HOST TARGET binding site found in the 3' untranslated region of mRNA encoded by PIK3R3, corresponding to a HOST TARGET binding site such as BINDING SITE I, BINDING SITE II or BINDING SITE III. Table 2 illustrates the complementarity of the nucleotide sequences of PIK3R3 BINDING SITE, designated SEQ ID:30609, to the nucleotide sequence of VGAM497 RNA, herein designated VGAM RNA, also designated SEQ ID:3208.

Another function of VGAM497 is therefore inhibition of Phosphoinositide-3-kinase, Regulatory Subunit, Polypeptide 3 (p55, gamma) (PIK3R3, Accession XM_027982). Accordingly, utilities of VGAM497 include diagnosis, prevention and treatment of diseases and clinical conditions associated with PIK3R3. Protein Phosphatase 3 (formerly 2B), Catalytic Subunit, Alpha Isoform (calcineurin A alpha) (PPP3CA, Accession NM_000944) is another VGAM497 host target gene. PPP3CA BINDING SITE is HOST TARGET binding site found in the 3' untranslated region of mRNA encoded by PPP3CA, corresponding to a HOST TARGET binding site such as BINDING SITE I, BINDING SITE II or BINDING SITE III. Table 2 illustrates the complementarity of the nucleotide sequences of PPP3CA BINDING SITE, designated SEQ ID:6648, to the nucleotide sequence of VGAM497 RNA, herein designated VGAM RNA, also designated SEQ ID:3208.

Another function of VGAM497 is therefore inhibition of Protein Phosphatase 3 (formerly 2B), Catalytic Subunit, Alpha Isoform (calcineurin A alpha) (PPP3CA, Accession NM_000944), a gene which is the catalytic subunit of calcium-dependent, calmodulin-stimulated protein phosphatase. Accordingly, utilities of VGAM497 include diagnosis, prevention and treatment of diseases and clinical conditions associated with PPP3CA. The function of PPP3CA has been established by previous studies. Semsarian et al. (1999) and Musaro et al. (1999) independently showed that IGF1 (OMIM Ref. No. 147440) stimulates skeletal muscle hypertrophy and a switch to glycolytic metabolism by activating calcineurin A and inducing the nuclear translocation of transcription factor NFATC1 (OMIM Ref. No. 600489). Semsarian et al. (1999) found that hypertrophy was suppressed by the calcineurin inhibitors cyclosporin A or FK506, but not by inhibitors of the MAP kinase or phosphatidylinositol-3-OH kinase pathways. Musaro et al. (1999) showed that expression of a dominant-negative calcineurin mutant also repressed myocyte differentiation and hypertrophy. Musaro et al. (1999) demonstrated that either IGF1 or activated calcineurin induces expression of transcription factor GATA2 (OMIM Ref. No. 137295), which accumulates in a subset of myocyte nuclei, where it associates with calcineurin and a specific dephosphorylated isoform of NFATC1. Animal model experiments lend further support to the function of PPP3CA. Winder et al. (1998) generated transgenic mice that overexpressed a truncated form of the murine calcineurin A-alpha catalytic subunit under the control of the CaMKII-alpha promoter. Mice expressing this transgene show increased calcium-dependent phosphatase activity in the hippocampus. Physiologic studies and pharmacologic experiments revealed a novel, intermediate phase of long-term potentiation (I-LTP) in the CA1 region of the hippocampus. This I-LTP differs from the E-LTP (early component of LTP) by requiring multiple trains for induction and in being dependent on PKA (cAMP-dependent protein kinase). It also differs from the L-LTP (late component of LTP) in not requiring new protein synthesis. These data suggested to Winder et al. (1998) that calcineurin acts as an inhibitory constraint on I-LTP that is relieved by PKA, and that this inhibitory constraint acts as a gate to regulate the synaptic induction of L-LTP.

It is appreciated that the abovementioned animal model for PPP3CA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Winder, D. G.; Mansuy, I. M.; Osman, M.; Moallem, T. M.; Kandel, E. R.: Genetic and pharmacological evidence for a novel, intermediate phase of long-term potentiation suppressed by calcineurin. Cell 92:25-37, 1998; and Fuentes, J. J.; Genesca, L.; Kingsbury, T. J.; Cunningham, K. W.; Perez-Riba, M.; Estivill, X.; de la Luna, S.: DSCR1, overexpressed in Down syndrome, is an inhibitor of calcineurin-me.

Further studies establishing the function and utilities of PPP3CA are found in John Hopkins OMIM database record ID 114105, and in sited publications numbered 4679-4685, 11673-468 and 11674-4689 listed in the bibliography section hereinbelow, which are also hereby incorporated by reference. Protein Tyrosine Phosphatase, Receptor Type, C (PTPRC, Accession NM_002838) is another VGAM497 host target gene. PTPRC BINDING SITE1 and PTPRC BINDING SITE2 are HOST TARGET binding sites found in untranslated regions of mRNA encoded by PTPRC, corresponding to HOST TARGET binding sites such as BINDING SITE I, BINDING SITE II or BINDING SITE III. Table 2 illustrates the complementarity of the nucleotide sequences of PTPRC BINDING SITE1 and PTPRC BINDING SITE2, designated SEQ ID:8720 and SEQ ID:28146 respectively, to the nucleotide sequence of VGAM497 RNA, herein designated VGAM RNA, also designated SEQ ID:3208.

Another function of VGAM497 is therefore inhibition of Protein Tyrosine Phosphatase, Receptor Type, C (PTPRC, Accession NM_002838). Accordingly, utilities of VGAM497 include diagnosis, prevention and treatment of diseases and clinical conditions associated with PTPRC. Syndecan 2 (heparan sulfate proteoglycan 1, cell surface-associated, fibroglycan) (SDC2, Accession XM_040582) is another VGAM497 host target gene. SDC2 BINDING SITE is HOST TARGET binding site found in the 3' untranslated region of mRNA encoded by SDC2, corresponding to a HOST TARGET binding site such as BINDING SITE I, BINDING SITE II or BINDING SITE III. Table 2 illustrates the complementarity of the nucleotide sequences of SDC2 BINDING SITE, designated SEQ ID:33328, to the nucleotide sequence of VGAM497 RNA, herein designated VGAM RNA, also designated SEQ ID:3208.

Another function of VGAM497 is therefore inhibition of Syndecan 2 (heparan sulfate proteoglycan 1, cell surface-associated, fibroglycan) (SDC2, Accession XM_040582). Accordingly, utilities of VGAM497 include diagnosis, prevention and treatment of diseases and clinical conditions associated with SDC2. Translocase of Inner Mitochondrial Membrane 8 Homolog A (yeast) (TIMM8A, Accession NM_004085) is another VGAM497 host target gene. TIMM8A BINDING SITE is HOST TARGET binding site found in the 3' untranslated region of mRNA encoded by TIMM8A, corresponding to a HOST TARGET binding site such as BINDING SITE I, BINDING SITE II or BINDING SITE III. Table 2 illustrates the complementarity of the nucleotide sequences of TIMM8A BINDING SITE, designated SEQ ID:10288, to the nucleotide sequence of VGAM497 RNA, herein designated VGAM RNA, also designated SEQ ID:3208.

Another function of VGAM497 is therefore inhibition of Translocase of Inner Mitochondrial Membrane 8 Homolog A (yeast) (TIMM8A, Accession NM_004085). Accordingly, utilities of VGAM497 include diagnosis, prevention and treatment of diseases and clinical conditions associated with TIMM8A. Ubiquitously Transcribed Tetratricopeptide Repeat Gene, Y Chromosome (UTY, Accession NM_007125) is another VGAM497 host target gene. UTY BINDING SITE is HOST TARGET binding site found in the 3' untranslated region of mRNA encoded by UTY, corresponding to a HOST TARGET binding site such as BINDING SITE I, BINDING SITE II or BINDING SITE III. Table 2 illustrates the complementarity of the nucleotide sequences of UTY BINDING SITE, designated SEQ ID:13983, to the nucleotide sequence of VGAM497 RNA, herein designated VGAM RNA, also designated SEQ ID:3208.

Another function of VGAM497 is therefore inhibition of Ubiquitously Transcribed Tetratricopeptide Repeat Gene, Y Chromosome (UTY, Accession NM_007125), a gene which is an ubiquitous tetratricopeptide repeat protein with unknown function. Accordingly, utilities of VGAM497 include diagnosis, prevention and treatment of diseases and clinical conditions associated with UTY. The function of UTY has been established by previous studies. Greenfield et al. (1996) described a mouse Y-linked gene, Uty, which is widely expressed and encodes a tetratricopeptide repeat (TPR) protein. TPR motifs are found in a variety of functionally distinct proteins and are believed to mediate protein-protein interaction. The 5.5-kb Uty transcript encodes a 1,186 amino acid protein with 8 TPR motifs in its N terminus. Greenfield et al. (1998) reported that the human UTY gene maps to band 5C. This band is known to contain one or more genes functioning in spermatogenesis and a Y-specific growth gene. See 300128 for a description of the X-linked homolog of UTY. Foresta et al. (2000) reported a complete sequence map of the AZFa region (see OMIM Ref. No. 415000), the genomic structure of AZFa genes, and their deletion analysis in 173 infertile men with well-defined spermatogenic alterations. Deletions were found in 9 patients: DBY (OMIM Ref. No. 400010) alone was deleted in 6, DFFRY (USP9Y; 400005) only in 1, and 1 each with USP9Y-DBY or DBY-UTY missing. No patients solely lacked UTY. Patients lacking DBY exhibited either Sertoli cell-only syndrome or severe hypospermatogenesis. The authors suggested that DBY and USP9Y play key roles in the spermatogenic process.

Full details of the abovementioned studies are described in the following publications, the disclosure of which are hereby incorporated by reference:

Greenfield, A.; Scott, D.; Pennisi, D.; Ehrmann, I.; Ellis, P.; Cooper, L.; Simpson, E.; Koopman, P.: An H-YDb epitope is encoded by a novel mouse Y chromosome gene. Nature Genet. 14:474-478, 1996; and Foresta, C.; Ferlin, A.; Moro, E.: Deletion and expression analysis of AZFa genes on the human Y chromosome revealed a major role for DBY in male infertility. Hum. Molec. Genet. 9:1161-11.

Further studies establishing the function and utilities of UTY are found in John Hopkins OMIM database record ID 400009, and in sited publications numbered 882 and 10988 listed in the bibliography section hereinbelow, which are also hereby incorporated by reference. AOP2 (Accession NM_004905) is another VGAM497 host target gene. AOP2 BINDING SITE is HOST TARGET binding site found in the 3' untranslated region of mRNA encoded by AOP2, corresponding to a HOST TARGET binding site such as BINDING SITE I, BINDING SITE II or BINDING SITE III. Table 2 illustrates the complementarity of the nucleotide sequences of AOP2 BINDING SITE, designated SEQ ID:11342, to the nucleotide sequence of VGAM497 RNA, herein designated VGAM RNA, also designated SEQ ID:3208.

Another function of VGAM497 is therefore inhibition of AOP2 (Accession NM_004905). Accordingly, utilities of VGAM497 include diagnosis, prevention and treatment of diseases and clinical conditions associated with AOP2. AUT-like 1, Cysteine Endopeptidase (S. cerevisiae) (AUTL1, Accession NM_032852) is another VGAM497 host target gene. AUTL1 BINDING SITE is HOST TARGET binding site found in the 3' untranslated region of mRNA encoded by AUTL1, corresponding to a HOST TARGET binding site such as BINDING SITE I, BINDING SITE II or BINDING SITE III. Table 2 illustrates the complementarity of the nucleotide sequences of AUTL1 BINDING SITE, designated SEQ ID:26651, to the nucleotide sequence of VGAM497 RNA, herein designated VGAM RNA, also designated SEQ ID:3208.

Another function of VGAM497 is therefore inhibition of AUT-like 1, Cysteine Endopeptidase (S. cerevisiae) (AUTL1, Accession NM_032852). Accordingly, utilities of VGAM497 include diagnosis, prevention and treatment of diseases and clinical conditions associated with AUTL1. FLJ10719 (Accession XM_031328) is another VGAM497 host target gene. FLJ10719 BINDING SITE is HOST TARGET binding site found in the 3' untranslated region of mRNA encoded by FLJ10719, corresponding to a HOST TARGET binding site such as BINDING SITE I, BINDING SITE II or BINDING SITE III. Table 2 illustrates the complementarity of the nucleotide sequences of FLJ10719 BINDING SITE, designated SEQ ID:31341, to the nucleotide sequence of VGAM497 RNA, herein designated VGAM RNA, also designated SEQ ID:3208.

Another function of VGAM497 is therefore inhibition of FLJ10719 (Accession XM_031328). Accordingly, utilities of VGAM497 include diagnosis, prevention and treatment of diseases and clinical conditions associated with FLJ10719. FLJ12586 (Accession NM_024620) is another VGAM497 host target gene. FLJ12586 BINDING SITE is HOST TARGET binding site found in the 3' untranslated region of mRNA encoded by FLJ12586, corresponding to a HOST TARGET binding site such as BINDING SITE I, BINDING SITE II or BINDING SITE III. Table 2 illustrates the complementarity of the nucleotide sequences of FLJ12586 BINDING SITE, designated SEQ ID:23884, to the nucleotide sequence of VGAM497 RNA, herein designated VGAM RNA, also designated SEQ ID:3208.

Another function of VGAM497 is therefore inhibition of FLJ12586 (Accession NM_024620). Accordingly, utilities of VGAM497 include diagnosis, prevention and treatment of diseases and clinical conditions associated with FLJ12586. KIAA1309 (Accession NM_033495) is another VGAM497 host target gene. KIAA1309 BINDING SITE is HOST TARGET binding site found in the 3' untranslated region of mRNA encoded by KIAA1309, corresponding to a HOST TARGET binding site such as BINDING SITE I, BINDING SITE II or BINDING SITE III. Table 2 illustrates the complementarity of the nucleotide sequences of KIAA1309 BINDING SITE, designated SEQ ID:27265, to the nucleotide sequence of VGAM497 RNA, herein designated VGAM RNA, also designated SEQ ID:3208.

Another function of VGAM497 is therefore inhibition of KIAA1309 (Accession NM_033495). Accordingly, utilities of VGAM497 include diagnosis, prevention and treatment of diseases and clinical conditions associated with KIAA1309. MDN1, Midasin Homolog (yeast) (MDN1, Accession XM_031539) is another VGAM497 host target gene. MDN1 BINDING SITE is HOST TARGET binding site found in the 3' untranslated region of mRNA encoded by MDN1, corresponding to a HOST TARGET binding site such as BINDING SITE I, BINDING SITE II or BINDING SITE III. Table 2 illustrates the complementarity of the nucleotide sequences of MDN1 BINDING SITE, designated SEQ ID:31411, to the nucleotide sequence of VGAM497 RNA, herein designated VGAM RNA, also designated SEQ ID:3208.

Another function of VGAM497 is therefore inhibition of MDN1, Midasin Homolog (yeast) (MDN1, Accession XM_031539). Accordingly, utilities of VGAM497 include diagnosis, prevention and treatment of diseases and clinical conditions associated with MDN1. MGC16385 (Accession NM_145039) is another VGAM497 host target gene. MGC16385 BINDING SITE is HOST TARGET binding site found in the 3' untranslated region of mRNA encoded by MGC16385, corresponding to a HOST TARGET binding site such as BINDING SITE I, BINDING SITE II or BINDING SITE III. Table 2 illustrates the complementarity of the nucleotide sequences of MGC16385 BINDING SITE, designated SEQ ID:29663, to the nucleotide sequence of VGAM497 RNA, herein designated VGAM RNA, also designated SEQ ID:3208.

Another function of VGAM497 is therefore inhibition of MGC16385 (Accession NM_145039). Accordingly, utilities of VGAM497 include diagnosis, prevention and treatment of diseases and clinical conditions associated with MGC16385. NET-6 (Accession NM_014399) is another VGAM497 host target gene. NET-6 BINDING SITE is HOST TARGET binding site found in the 3' untranslated region of mRNA encoded by NET-6, corresponding to a HOST TARGET binding site such as BINDING SITE I, BINDING SITE II or BINDING SITE III. Table 2 illustrates the complementarity of the nucleotide sequences of NET-6 BINDING SITE, designated SEQ ID:15741, to the nucleotide sequence of VGAM497 RNA, herein designated VGAM RNA, also designated SEQ ID:3208.

Another function of VGAM497 is therefore inhibition of NET-6 (Accession NM_014399). Accordingly, utilities of VGAM497 include diagnosis, prevention and treatment of diseases and clinical conditions associated with NET-6. PRO0246 (Accession NM_014123) is another VGAM497 host target gene. PRO0246 BINDING SITE is HOST TARGET binding site found in the 5' untranslated region of mRNA encoded by PRO0246, corresponding to a HOST TARGET binding site such as BINDING SITE I, BINDING SITE II or BINDING SITE III. Table 2 illustrates the complementarity of the nucleotide sequences of PRO0246 BINDING SITE, designated SEQ ID:15382, to the nucleotide sequence of VGAM497 RNA, herein designated VGAM RNA, also designated SEQ ID:3208.

Another function of VGAM497 is therefore inhibition of PRO0246 (Accession NM_014123). Accordingly, utilities of VGAM497 include diagnosis, prevention and treatment of diseases and clinical conditions associated with PRO0246. Synaptophysin-like Protein (SYPL, Accession XM_167511) is another VGAM497 host target gene. SYPL BINDING SITE is HOST TARGET binding site found in the 3' untranslated region of mRNA encoded by SYPL, corresponding to a HOST TARGET binding site such as BINDING SITE I, BINDING SITE II or BINDING SITE III. Table 2 illustrates the complementarity of the nucleotide sequences of SYPL BINDING SITE, designated SEQ ID:44647, to the nucleotide sequence of VGAM497 RNA, herein designated VGAM RNA, also designated SEQ ID:3208.

Another function of VGAM497 is therefore inhibition of Synaptophysin-like Protein (SYPL, Accession XM_167511). Accordingly, utilities of VGAM497 include diagnosis, prevention and treatment of diseases and clinical conditions associated with SYPL. VEZATIN (Accession NM_017599) is another VGAM497 host target gene. VEZATIN BINDING SITE is HOST TARGET binding site found in the 3' untranslated region of mRNA encoded by VEZATIN, corresponding to a HOST TARGET binding site such as BINDING SITE I, BINDING SITE II or BINDING SITE III. Table 2 illustrates the complementarity of the nucleotide sequences of VEZATIN BINDING SITE, designated SEQ ID:19072, to the nucleotide sequence of VGAM497 RNA, herein designated VGAM RNA, also designated SEQ ID:3208.

Another function of VGAM497 is therefore inhibition of VEZATIN (Accession NM_017599). Accordingly, utilities of VGAM497 include diagnosis, prevention and treatment of diseases and clinical conditions associated with VEZATIN. LOC122525 (Accession XM_071793) is another VGAM497 host target gene. LOC122525 BINDING SITE is HOST TARGET binding site found in the 3' untranslated region of mRNA encoded by LOC122525, corresponding to a HOST TARGET binding site such as BINDING SITE I, BINDING SITE II or BINDING SITE III. Table 2 illustrates the complementarity of the nucleotide sequences of LOC122525 BINDING SITE, designated SEQ ID:37421, to the nucleotide sequence of VGAM497 RNA, herein designated VGAM RNA, also designated SEQ ID:3208.

Another function of VGAM497 is therefore inhibition of LOC122525 (Accession XM_071793). Accordingly, utilities of VGAM497 include diagnosis, prevention and treatment of diseases and clinical conditions associated with LOC122525. LOC147495 (Accession XM_097240) is another VGAM497 host target gene. LOC147495 BINDING SITE is HOST TARGET binding site found in the 3' untranslated region of mRNA encoded by LOC147495, corresponding to a HOST TARGET binding site such as BINDING SITE I, BINDING SITE II or BINDING SITE III. Table 2 illustrates the complementarity of the nucleotide sequences of LOC147495 BINDING SITE, designated SEQ ID:40840, to the nucleotide sequence of VGAM497 RNA, herein designated VGAM RNA, also designated SEQ ID:3208.

Another function of VGAM497 is therefore inhibition of LOC147495 (Accession XM_097240). Accordingly, utilities of VGAM497 include diagnosis, prevention and treatment of diseases and clinical conditions associated with LOC147495. LOC148254 (Accession XM_086121) is another VGAM497 host target gene. LOC148254 BINDING SITE is HOST TARGET binding site found in the 3' untranslated region of mRNA encoded by LOC148254, corresponding to a HOST TARGET binding site such as BINDING SITE I, BINDING SITE II or BINDING SITE III. Table 2 illustrates the complementarity of the nucleotide sequences of LOC148254 BINDING SITE, designated SEQ ID:38506, to the nucleotide sequence of VGAM497 RNA, herein designated VGAM RNA, also designated SEQ ID:3208.

Another function of VGAM497 is therefore inhibition of LOC148254 (Accession XM_086121). Accordingly, utilities of VGAM497 include diagnosis, prevention and treatment of diseases and clinical conditions associated with LOC148254. LOC196411 (Accession XM_113714) is another VGAM497 host target gene. LOC196411 BINDING SITE is HOST TARGET binding site found in the 3' untranslated region of mRNA encoded by LOC196411, corresponding to a HOST TARGET binding site such as BINDING SITE I, BINDING SITE II or BINDING SITE III. Table 2 illustrates the complementarity of the nucleotide sequences of LOC196411 BINDING SITE, designated SEQ ID:42367, to the nucleotide sequence of VGAM497 RNA, herein designated VGAM RNA, also designated SEQ ID:3208.

Another function of VGAM497 is therefore inhibition of LOC196411 (Accession XM_113714). Accordingly, utilities of VGAM497 include diagnosis, prevention and treatment of diseases and clinical conditions associated with LOC196411. FIG. 1 further provides a conceptual description of a novel bioinformatically detected viral gene of the present invention, referred to here as Viral Genomic Address Messenger 498 (VGAM498) viral gene, which modulates expression of respective host target genes thereof, the function and utility of which host target genes is known in the art.

VGAM498 is a novel bioinformatically detected regulatory, non protein coding, viral micro RNA (miRNA) gene. The method by which VGAM498 was detected is described hereinabove with reference to FIGS. 1-8.

VGAM498 gene, herein designated VGAM GENE, is a viral gene contained in the genome of Human Herpesvirus 7. VGAM498 host target gene, herein designated VGAM HOST TARGET GENE, is a human gene contained in the human genome.

VGAM498 gene encodes a VGAM498 precursor RNA, herein designated VGAM PRECURSOR RNA. Similar to other miRNA genes, and unlike most ordinary genes, VGAM498 precursor RNA does not encode a protein. A nucleotide sequence identical or highly similar to the nucleotide sequence of VGAM498 precursor RNA is designated SEQ ID:484, and is provided hereinbelow with reference to the sequence listing part. Nucleotide sequence SEQ ID:484 is located at position 127367 relative to the genome of Human Herpesvirus 7.

VGAM498 precursor RNA folds onto itself, forming VGAM498 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM498 folded precursor RNA into VGAM498 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM498 RNA is designated SEQ ID:3209, and is provided hereinbelow with reference to the sequence listing part.

VGAM498 host target gene, herein designated VGAM HOST TARGET GENE, encodes a corresponding messenger RNA, VGAM498 host target RNA, herein designated VGAM HOST TARGET RNA. VGAM498 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM498 RNA, herein designated VGAM RNA, binds complementarily to one or more host target binding sites located in untranslated regions of VGAM498 host target RNA, herein designated VGAM HOST TARGET RNA. This complementary binding is due to the fact that the nucleotide sequence of VGAM498 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM498 RNA, herein designated VGAM RNA, may have a different number of host target binding sites in untranslated regions of a VGAM498 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM498 RNA, herein designated VGAM RNA, to host target binding sites on VGAM498 host target RNA, herein designated VGAM HOST TARGET RNA, such as BINDING SITE I, BINDING SITE II and BINDING SITE III, inhibits translation of VGAM498 host target RNA into VGAM498 host target protein, herein designated VGAM HOST TARGET PROTEIN. VGAM host target protein is therefore outlined by a broken line.

It is appreciated that VGAM498 host target gene, herein designated VGAM HOST TARGET GENE, in fact represents a plurality of VGAM498 host target genes. The mRNA of each one of this plurality of VGAM498 host target genes comprises one or more host target binding sites, each having a nucleotide sequence which is at least partly complementary to VGAM498 RNA, herein designated VGAM RNA, and which when bound by VGAM498 RNA causes inhibition of translation of respective one or more VGAM498 host target proteins.

It is further appreciated by one skilled in the art that the mode of translational inhibition illustrated by FIG. 1 with specific reference to translational inhibition exerted by VGAM498 gene, herein designated VGAM GENE, on one or more VGAM498 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM498 is inhibition of expression of host target genes, as part of a novel viral mechanism of attacking a host. Accordingly, utilities of VGAM498 include diagnosis, prevention and treatment of viral infection by Human Herpesvirus 7. Specific functions, and accordingly utilities, of VGAM498 correlate with, and may be deduced from, the identity of the host target genes which VGAM498 binds and inhibits, and the function of these target genes, as elaborated hereinbelow.

Nucleotide sequences of the VGAM498 precursor RNA, herein designated VGAM PRECURSOR RNA, and of the 'diced' VGAM498 RNA, herein designated VGAM RNA, and a schematic representation of the secondary folding of VGAM498 folded precursor RNA, herein designated VGAM FOLDED PRECURSOR RNA, of VGAM498 are further described hereinbelow with reference to Table 1.

Nucleotide sequences of host target binding sites, such as BINDING SITE-I, BINDING SITE-II and BINDING SITE-III of FIG. 1, found on VGAM498 host target RNA, and schematic representation of the complementarity of each of these host target binding sites to VGAM498 RNA, herein designated VGAM RNA, are described hereinbelow with reference to Table 2.

As mentioned hereinabove with reference to FIG. 1, a function of VGAM498 gene, herein designated VGAM is inhibition of expression of VGAM498 target genes. It is appreciated that specific functions, and accordingly utilities, of VGAM498 correlate with, and may be deduced from, the identity of the target genes which VGAM498 binds and inhibits, and the function of these target genes, as elaborated hereinbelow.

Ankyrin 1, Erythrocytic (ANK1, Accession XM_016774) is a VGAM498 host target gene. ANK1 BINDING SITE is HOST TARGET binding site found in the 3' untranslated region of mRNA encoded by ANK1, corresponding to a HOST TARGET binding site such as BINDING SITE I, BINDING SITE II or BINDING SITE III. Table 2 illustrates the complementarity of the nucleotide sequences of ANK1 BINDING SITE, designated SEQ ID:30289, to the nucleotide sequence of VGAM498 RNA, herein designated VGAM RNA, also designated SEQ ID:3209.

A function of VGAM498 is therefore inhibition of Ankyrin 1, Erythrocytic (ANK1, Accession XM_016774). Accordingly, utilities of VGAM498 include diagnosis, prevention and treatment of diseases and clinical conditions associated with ANK1. Contactin 3 (plasmacytoma associated) (CNTN3, Accession XM_039627) is another VGAM498 host target gene. CNTN3 BINDING SITE is HOST TARGET binding site found in the 3' untranslated region of mRNA encoded by CNTN3, corresponding to a HOST TARGET binding site such as BINDING SITE I, BINDING SITE II or BINDING SITE III. Table 2 illustrates the complementarity of the nucleotide sequences of CNTN3 BINDING SITE, designated SEQ ID:33133, to the nucleotide sequence of VGAM498 RNA, herein designated VGAM RNA, also designated SEQ ID:3209.

Another function of VGAM498 is therefore inhibition of Contactin 3 (plasmacytoma associated) (CNTN3, Accession XM_039627), a gene which may play a role in the initial growth and guidance of axons. Accordingly, utilities of VGAM498 include diagnosis, prevention and treatment of diseases and clinical conditions associated with CNTN3. The function of CNTN3 and its association with various diseases and clinical conditions, has been established by previous studies, as described hereinabove with reference to VGAM420. Collagen, Type I, Alpha 1 (COL1A1, Accession NM_000088) is another VGAM498 host target gene. COL1A1 BINDING SITE is HOST TARGET binding site found in the 3' untranslated region of mRNA encoded by COL1A1, corresponding to a HOST TARGET binding site such as BINDING SITE I, BINDING SITE II or BINDING SITE III. Table 2 illustrates the complementarity of the nucleotide sequences of COL1A1 BINDING SITE, designated SEQ ID:5539, to the nucleotide sequence of VGAM498 RNA, herein designated VGAM RNA, also designated SEQ ID:3209.

Another function of VGAM498 is therefore inhibition of Collagen, Type I, Alpha 1 (COL1A1, Accession NM_000088). Accordingly, utilities of VGAM498 include diagnosis, prevention and treatment of diseases and clinical conditions associated with COL1A1. Hyaluronan Synthase 3 (HAS3, Accession NM_005329) is another VGAM498 host target gene. HAS3 BINDING SITE is HOST TARGET binding site found in the 3' untranslated region of mRNA encoded by HAS3, corresponding to a HOST TARGET binding site such as BINDING SITE I, BINDING SITE II or BINDING SITE III. Table 2 illustrates the complementarity of the nucleotide sequences of HAS3 BINDING SITE, designated SEQ ID:11803, to the nucleotide sequence of VGAM498 RNA, herein designated VGAM RNA, also designated SEQ ID:3209.

Another function of VGAM498 is therefore inhibition of Hyaluronan Synthase 3 (HAS3, Accession NM_005329), a gene which plays a role in hyaluronan/hyaluronic acid (ha) synthesis. Accordingly, utilities of VGAM498 include diagnosis, prevention and treatment of diseases and clinical conditions associated with HAS3. The function of HAS3 has been established by previous studies. Hyaluronan (HA) is an unbranched glycosaminoglycan composed of repeating disaccharide units. It is a major constituent of the extracellular matrix and has been implicated in development, tumorigenesis, and several diseases. HA is synthesized at the inner face of the plasma membrane and is subsequently extruded to the outside of the cell. By degenerate PCR, Spicer et al. (1997) isolated a genomic fragment of human HA synthase-3 (HAS3) and genomic and cDNA clones of mouse Has3. The amino acid sequences encoded by the partial HAS3 fragment and the corresponding region of Has3 are 99% conserved. The authors noted that the high degree of sequence conservation between specific human and mouse HASs contrasts with the lower level of identity between HASs within a species, suggesting an evolutionary conservation of functionally important residues and differences in the mode of action of the various HASs. The predicted 554-amino acid Has3 has several consensus HA-binding motifs and multiple transmembrane domains, with 2 at the N terminus and a cluster at the C terminus. Expression of Has3 in COS-1 cells led to high levels of HA biosynthesis. Northern blot analysis of the mouse embryo showed that Has3 is predominantly expressed at late gestation as a major, approximately 6.0- to 6.5-kb transcript and a minor, approximately 4.0-kb transcript. By PCR screening somatic cell hybrid DNAs and a YAC contig, Spicer et al. (1997) localized the human HAS3 gene to 16q22.1. By interspecific backcross analysis, they mapped the mouse Has3 gene to chromosome 8. Since HAS1 (OMIM Ref. No. 601463), HAS2 (OMIM Ref. No. 601636), and HAS3 are located on different autosomes, Spicer et al. (1997) suggested that the HAS gene family arose comparatively early in vertebrate evolution by sequential duplication of an ancestral HAS gene.

Full details of the abovementioned studies are described in the following publications, the disclosure of which are hereby incorporated by reference:

Spicer, A. P.; Olson, J. S.; McDonald, J. A.: Molecular cloning and characterization of a cDNA encoding the third putative mammalian hyaluronan synthase. J. Biol. Chem. 272:8957-8961, 1997; and Spicer, A. P.; Seldin, M. F.; Olsen, A. S.; Brown, N.; Wells, D. E.; Doggett, N. A.; Itano, N.; Kimata, K.; Inazawa, J.; McDonald, J. A.: Chromosomal localization of the human and mous.

Further studies establishing the function and utilities of HAS3 are found in John Hopkins OMIM database record ID 602428, and in sited publications numbered 8915 listed in the bibliography section hereinbelow, which are also hereby incorporated by reference. Protein Phosphatase 1, Regulatory (inhibitor) Subunit 12B (PPP1R12B, Accession NM_032104) is another VGAM498 host target gene. PPP1R12B BINDING SITE is HOST TARGET binding site found in the 3' untranslated region of mRNA encoded by PPP1R12B, corresponding to a HOST TARGET binding site such as BINDING SITE I, BINDING SITE II or BINDING SITE III. Table 2 illustrates the complementarity of the nucleotide sequences of PPP1R12B BINDING SITE, designated SEQ ID:25797, to the nucleotide sequence of VGAM498 RNA, herein designated VGAM RNA, also designated SEQ ID:3209.

Another function of VGAM498 is therefore inhibition of Protein Phosphatase 1, Regulatory (inhibitor) Subunit 12B (PPP1R12B, Accession NM_032104). Accordingly, utilities of VGAM498 include diagnosis, prevention and treatment of diseases and clinical conditions associated with PPP1R12B. Protein Tyrosine Phosphatase Type IVA, Member 2 (PTP4A2, Accession NM_080392) is another VGAM498 host target gene. PTP4A2 BINDING SITE1 and PTP4A2 BINDING SITE2 are HOST TARGET binding sites found in untranslated regions of mRNA encoded by PTP4A2, corresponding to HOST TARGET binding sites such as BINDING SITE I, BINDING SITE II or BINDING SITE III. Table 2 illustrates the complementarity of the nucleotide sequences of PTP4A2 BINDING SITE1 and PTP4A2 BINDING SITE2, designated SEQ ID:27832 and SEQ ID:9555 respectively, to the nucleotide sequence of VGAM498 RNA, herein designated VGAM RNA, also designated SEQ ID:3209.

Another function of VGAM498 is therefore inhibition of Protein Tyrosine Phosphatase Type IVA, Member 2 (PTP4A2, Accession NM_080392), a gene which is a protein tyrosine phosphatase which has a C-terminal prenylation site. Accordingly, utilities of VGAM498 include diagnosis, prevention and treatment of diseases and clinical conditions associated with PTP4A2. The function of PTP4A2 and its association with various diseases and clinical conditions, has been established by previous studies, as described hereinabove with reference to VGAM217. Usher Syndrome 3A (USH3A, Accession NM_052995) is another VGAM498 host target gene. USH3A BINDING SITE is HOST TARGET binding site found in the 5' untranslated region of mRNA encoded by USH3A, corresponding to a HOST TARGET binding site such as BINDING SITE I, BINDING SITE II or BINDING SITE III. Table 2 illustrates the complementarity of the nucleotide sequences of USH3A BINDING SITE, designated SEQ ID:27565, to the nucleotide sequence of VGAM498 RNA, herein designated VGAM RNA, also designated SEQ ID:3209.

Another function of VGAM498 is therefore inhibition of Usher Syndrome 3A (USH3A, Accession NM_052995). Accordingly, utilities of VGAM498 include diagnosis, prevention and treatment of diseases and clinical conditions associated with USH3A. Vitamin D (1,25- dihydroxyvitamin D3) Receptor (VDR, Accession NM_000376) is another VGAM498 host target gene. VDR BINDING SITE is HOST TARGET binding site found in the 3' untranslated region of mRNA encoded by VDR, corresponding to a HOST TARGET binding site such as BINDING SITE I, BINDING SITE II or BINDING SITE III. Table 2 illustrates the complementarity of the nucleotide sequences of VDR BINDING SITE, designated SEQ ID:5944, to the nucleotide sequence of VGAM498 RNA, herein designated VGAM RNA, also designated SEQ ID:3209.

Another function of VGAM498 is therefore inhibition of Vitamin D (1,25- dihydroxyvitamin D3) Receptor (VDR, Accession NM_000376). Accordingly, utilities of VGAM498 include diagnosis, prevention and treatment of diseases and clinical conditions associated with VDR. 20D7-FC4 (Accession XM_027578) is another VGAM498 host target gene. 20D7-FC4 BINDING SITE is HOST TARGET binding site found in the 3' untranslated region of mRNA encoded by 20D7-FC4, corresponding to a HOST TARGET binding site such as BINDING SITE I, BINDING SITE II or BINDING SITE III. Table 2 illustrates the complementarity of the nucleotide sequences of 20D7-FC4 BINDING SITE, designated SEQ ID:30537, to the nucleotide sequence of VGAM498 RNA, herein designated VGAM RNA, also designated SEQ ID:3209.

Another function of VGAM498 is therefore inhibition of 20D7-FC4 (Accession XM_027578). Accordingly, utilities of VGAM498 include diagnosis, prevention and treatment of diseases and clinical conditions associated with 20D7-FC4. Cbp/p300-interacting Transactivator, with Glu/Asp-rich Carboxy-terminal Domain, 2 (CITED2, Accession NM_006079) is another VGAM498 host target gene. CITED2 BINDING SITE is HOST TARGET binding site found in the 3' untranslated region of mRNA encoded by CITED2, corresponding to a HOST TARGET binding site such as BINDING SITE I, BINDING SITE II or BINDING SITE III. Table 2 illustrates the complementarity of the nucleotide sequences of CITED2 BINDING SITE, designated SEQ ID:12725, to the nucleotide sequence of VGAM498 RNA, herein designated VGAM RNA, also designated SEQ ID:3209.

Another function of VGAM498 is therefore inhibition of Cbp/p300-interacting Transactivator, with Glu/Asp-rich Carboxy-terminal Domain, 2 (CITED2, Accession NM_006079). Accordingly, utilities of VGAM498 include diagnosis, prevention and treatment of diseases and clinical conditions associated with CITED2. DKFZP434L187 (Accession XM_044070) is another VGAM498 host target gene. DKFZP434L187 BINDING SITE is HOST TARGET binding site found in the 5' untranslated region of mRNA encoded by DKFZP434L187, corresponding to a HOST TARGET binding site such as BINDING SITE I, BINDING SITE II or BINDING SITE III. Table 2 illustrates the complementarity of the nucleotide sequences of DKFZP434L187 BINDING SITE, designated SEQ ID:34124, to the nucleotide sequence of VGAM498 RNA, herein designated VGAM RNA, also designated SEQ ID:3209.

Another function of VGAM498 is therefore inhibition of DKFZP434L187 (Accession XM_044070). Accordingly, utilities of VGAM498 include diagnosis, prevention and treatment of diseases and clinical conditions associated with DKFZP434L187. FLJ13868 (Accession NM_022744) is another VGAM498 host target gene. FLJ13868 BINDING SITE is HOST TARGET binding site found in the 3' untranslated region of mRNA encoded by FLJ13868, corresponding to a HOST TARGET binding site such as BINDING SITE I, BINDING SITE II or BINDING SITE III. Table 2 illustrates the complementarity of the nucleotide sequences of FLJ13868 BINDING SITE, designated SEQ ID:22955, to the nucleotide sequence of VGAM498 RNA, herein designated VGAM RNA, also designated SEQ ID:3209.

Another function of VGAM498 is therefore inhibition of FLJ13868 (Accession NM_022744). Accordingly, utilities of VGAM498 include diagnosis, prevention and treatment of diseases and clinical conditions associated with FLJ13868. FLJ20070 (Accession NM_017652) is another VGAM498 host target gene. FLJ20070 BINDING SITE is HOST TARGET binding site found in the 3' untranslated region of mRNA encoded by FLJ20070, corresponding to a HOST TARGET binding site such as BINDING SITE I, BINDING SITE II or BINDING SITE III. Table 2 illustrates the complementarity of the nucleotide sequences of FLJ20070 BINDING SITE, designated SEQ ID:19161, to the nucleotide sequence of VGAM498 RNA, herein designated VGAM RNA, also designated SEQ ID:3209.

Another function of VGAM498 is therefore inhibition of FLJ20070 (Accession NM_017652). Accordingly, utilities of VGAM498 include diagnosis, prevention and treatment of diseases and clinical conditions associated with FLJ20070. FLJ20154 (Accession XM_053688) is another VGAM498 host target gene. FLJ20154 BINDING SITE is HOST TARGET binding site found in the 5' untranslated region of mRNA encoded by FLJ20154, corresponding to a HOST TARGET binding site such as BINDING SITE I, BINDING SITE II or BINDING SITE III. Table 2 illustrates the complementarity of the nucleotide sequences of FLJ20154 BINDING SITE, designated SEQ ID:36104, to the nucleotide sequence of VGAM498 RNA, herein designated VGAM RNA, also designated SEQ ID:3209.

Another function of VGAM498 is therefore inhibition of FLJ20154 (Accession XM_053688). Accordingly, utilities of VGAM498 include diagnosis, prevention and treatment of diseases and clinical conditions associated with FLJ20154. HSNOV1 (Accession NM_017515) is another VGAM498 host target gene. HSNOV1 BINDING SITE is HOST TARGET binding site found in the 3' untranslated region of mRNA encoded by HSNOV1, corresponding to a HOST TARGET binding site such as BINDING SITE I, BINDING SITE II or BINDING SITE III. Table 2 illustrates the complementarity of the nucleotide sequences of HSNOV1 BINDING SITE, designated SEQ ID:18967, to the nucleotide sequence of VGAM498 RNA, herein designated VGAM RNA, also designated SEQ ID:3209.

Another function of VGAM498 is therefore inhibition of HSNOV1 (Accession NM_017515). Accordingly, utilities of VGAM498 include diagnosis, prevention and treatment of diseases and clinical conditions associated with HSNOV1. KIAA0237 (Accession NM_014747) is another VGAM498 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16440, to the nucleotide sequence of VGAM498 RNA, herein designated VGAM RNA, also designated SEQ ID:3209.

Another function of VGAM498 is therefore inhibition of KIAA0237 (Accession NM_014747). Accordingly, utilities of VGAM498 include diagnosis, prevention and treatment of diseases and clinical conditions associated with KIAA0237. KIAA0286 (Accession XM_043118) is another VGAM498 host target gene. KIAA0286 BINDING SITE is HOST TARGET binding site found in the 3' untranslated region of mRNA encoded by KIAA0286, corresponding to a HOST TARGET binding site such as BINDING SITE I, BINDING SITE II or BINDING SITE III. Table 2 illustrates the complementarity of the nucleotide sequences of KIAA0286 BINDING SITE, designated SEQ ID:33903, to the nucleotide sequence of VGAM498 RNA, herein designated VGAM RNA, also designated SEQ ID:3209.

Another function of VGAM498 is therefore inhibition of KIAA0286 (Accession XM_043118). Accordingly, utilities of VGAM498 include diagnosis, prevention and treatment of diseases and clinical conditions associated with KIAA0286. PDZ-GEF1 (Accession NM_014247) is another VGAM498 host target gene. PDZ-GEF1 BINDING SITE is HOST TARGET binding site found in the 3' untranslated region of mRNA encoded by PDZ-GEF1, corresponding to a HOST TARGET binding site such as BINDING SITE I, BINDING SITE II or BINDING SITE III. Table 2 illustrates the complementarity of the nucleotide sequences of PDZ-GEF1 BINDING SITE, designated SEQ ID:15521, to the nucleotide sequence of VGAM498 RNA, herein designated VGAM RNA, also designated SEQ ID:3209.

Another function of VGAM498 is therefore inhibition of PDZ-GEF1 (Accession NM_014247). Accordingly, utilities of VGAM498 include diagnosis, prevention and treatment of diseases and clinical conditions associated with PDZ-GEF1. LOC151610 (Accession XM_087245) is another VGAM498 host target gene. LOC151610 BINDING SITE is HOST TARGET binding site found in the 3' untranslated region of mRNA encoded by LOC151610, corresponding to a HOST TARGET binding site such as BINDING SITE I, BINDING SITE II or BINDING SITE III. Table 2 illustrates the complementarity of the nucleotide sequences of LOC151610 BINDING SITE, designated SEQ ID:39138, to the nucleotide sequence of VGAM498 RNA, herein designated VGAM RNA, also designated SEQ ID:3209.

Another function of VGAM498 is therefore inhibition of LOC151610 (Accession XM_087245). Accordingly, utilities of VGAM498 include diagnosis, prevention and treatment of diseases and clinical conditions associated with LOC151610. LOC163231 (Accession XM_092094) is another VGAM498 host target gene. LOC163231 BINDING SITE1 and LOC163231 BINDING SITE2 are HOST TARGET binding sites found in untranslated regions of mRNA encoded by LOC163231, corresponding to HOST TARGET binding sites such as BINDING SITE I, BINDING SITE II or BINDING SITE III. Table 2 illustrates the complementarity of the nucleotide sequences of LOC163231 BINDING SITE1 and LOC163231 BINDING SITE2, designated SEQ ID:40100 and SEQ ID:40101 respectively, to the nucleotide sequence of VGAM498 RNA, herein designated VGAM RNA, also designated SEQ ID:3209.

Another function of VGAM498 is therefore inhibition of LOC163231 (Accession XM_092094). Accordingly, utilities of VGAM498 include diagnosis, prevention and treatment of diseases and clinical conditions associated with LOC163231. LOC254973 (Accession XM_172751) is another VGAM498 host target gene. LOC254973 BINDING SITE is HOST TARGET binding site found in the 5' untranslated region of mRNA encoded by LOC254973, corresponding to a HOST TARGET binding site such as BINDING SITE I, BINDING SITE II or BINDING SITE III. Table 2 illustrates the complementarity of the nucleotide sequences of LOC254973 BINDING SITE, designated SEQ ID:46077, to the nucleotide sequence of VGAM498 RNA, herein designated VGAM RNA, also designated SEQ ID:3209.

Another function of VGAM498 is therefore inhibition of LOC254973 (Accession XM_172751). Accordingly, utilities of VGAM498 include diagnosis, prevention and treatment of diseases and clinical conditions associated with LOC254973. FIG. 1 further provides a conceptual description of a novel bioinformatically detected viral gene of the present invention, referred to here as Viral Genomic Address Messenger 499 (VGAM499) viral gene, which modulates expression of respective host target genes thereof, the function and utility of which host target genes is known in the art.

VGAM499 is a novel bioinformatically detected regulatory, non protein coding, viral micro RNA (miRNA) gene. The method by which VGAM499 was detected is described hereinabove with reference to FIGS. 1-8.

VGAM499 gene, herein designated VGAM GENE, is a viral gene contained in the genome of Strawberry Vein Banding Virus (SVBV). VGAM499 host target gene, herein designated VGAM HOST TARGET GENE, is a human gene contained in the human genome.

VGAM499 gene encodes a VGAM499 precursor RNA, herein designated VGAM PRECURSOR RNA. Similar to other miRNA genes, and unlike most ordinary genes, VGAM499 precursor RNA does not encode a protein. A nucleotide sequence identical or highly similar to the nucleotide sequence of VGAM499 precursor RNA is designated SEQ ID:485, and is provided hereinbelow with reference to the sequence listing part. Nucleotide sequence SEQ ID:485 is located at position 4662 relative to the genome of Strawberry Vein Banding Virus (SVBV).

VGAM499 precursor RNA folds onto itself, forming VGAM499 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM499 folded precursor RNA into VGAM499 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM499 RNA is designated SEQ ID:3210, and is provided hereinbelow with reference to the sequence listing part.

VGAM499 host target gene, herein designated VGAM HOST TARGET GENE, encodes a corresponding messenger RNA, VGAM499 host target RNA, herein designated VGAM HOST TARGET RNA. VGAM499 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM499 RNA, herein designated VGAM RNA, binds complementarily to one or more host target binding sites located in untranslated regions of VGAM499 host target RNA, herein designated VGAM HOST TARGET RNA. This complementary binding is due to the fact that the nucleotide sequence of VGAM499 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM499 RNA, herein designated VGAM RNA, may have a different number of host target binding sites in untranslated regions of a VGAM499 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM499 RNA, herein designated VGAM RNA, to host target binding sites on VGAM499 host target RNA, herein designated VGAM HOST TARGET RNA, such as BINDING SITE I, BINDING SITE II and BINDING SITE III, inhibits translation of VGAM499 host target RNA into VGAM499 host target protein, herein designated VGAM HOST TARGET PROTEIN. VGAM host target protein is therefore outlined by a broken line.

It is appreciated that VGAM499 host target gene, herein designated VGAM HOST TARGET GENE, in fact represents a plurality of VGAM499 host target genes. The mRNA of each one of this plurality of VGAM499 host target genes comprises one or more host target binding sites, each having a nucleotide sequence which is at least partly complementary to VGAM499 RNA, herein designated VGAM RNA, and which when bound by VGAM499 RNA causes inhibition of translation of respective one or more VGAM499 host target proteins.

It is further appreciated by one skilled in the art that the mode of translational inhibition illustrated by FIG. 1 with specific reference to translational inhibition exerted by VGAM499 gene, herein designated VGAM GENE, on one or more VGAM499 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM499 is inhibition of expression of host target genes, as part of a novel viral mechanism of attacking a host. Accordingly, utilities of VGAM499 include diagnosis, prevention and treatment of viral infection by Strawberry Vein Banding Virus (SVBV). Specific functions, and accordingly utilities, of VGAM499 correlate with, and may be deduced from, the identity of the host target genes which VGAM499 binds and inhibits, and the function of these host target genes, as elaborated hereinbelow.

Nucleotide sequences of the VGAM499 precursor RNA, herein designated VGAM PRECURSOR RNA, and of the 'diced' VGAM499 RNA, herein designated VGAM RNA, and a schematic representation of the secondary folding of VGAM499 folded precursor RNA, herein designated VGAM FOLDED PRECURSOR RNA, of VGAM499 are further described hereinbelow with reference to Table 1.

Nucleotide sequences of host target binding sites, such as BINDING SITE-I, BINDING SITE-II and BINDING SITE-III of FIG. 1, found on VGAM499 host target RNA, and schematic representation of the complementarity of each of these host target binding sites to VGAM499 RNA, herein designated VGAM RNA, are described hereinbelow with reference to Table 2.

As mentioned hereinabove with reference to FIG. 1, a function of VGAM499 gene, herein designated VGAM is inhibition of expression of VGAM499 target genes. It is appreciated that specific functions, and accordingly utilities, of VGAM499 correlate with, and may be deduced from, the identity of the target genes which VGAM499 binds and inhibits, and the function of these target genes, as elaborated hereinbelow.

Pallidin Homolog (mouse) (PLDN, Accession NM_012388) is a VGAM499 host target gene. PLDN BINDING SITE is HOST TARGET binding site found in the 5' untranslated region of mRNA encoded by PLDN, corresponding to a HOST TARGET binding site such as BINDING SITE I, BINDING SITE II or BINDING SITE III. Table 2 illustrates the complementarity of the nucleotide sequences of PLDN BINDING SITE, designated SEQ ID:14743, to the nucleotide sequence of VGAM499 RNA, herein designated VGAM RNA, also designated SEQ ID:3210.

A function of VGAM499 is therefore inhibition of Pallidin Homolog (mouse) (PLDN, Accession NM_012388), a gene which may play a role in intracellular vesicle trafficking. Accordingly, utilities of VGAM499 include diagnosis, prevention and treatment of diseases and clinical conditions associated with PLDN. The function of PLDN and its association with various diseases and clinical conditions, has been established by previous studies, as described hereinabove with reference to VGAM138. DKFZp547A023 (Accession XM_052065) is another VGAM499 host target gene. DKFZp547A023 BINDING SITE is HOST TARGET binding site found in the 3' untranslated region of mRNA encoded by DKFZp547A023, corresponding to a HOST TARGET binding site such as BINDING SITE I, BINDING SITE II or BINDING SITE III. Table 2 illustrates the complementarity of the nucleotide sequences of DKFZp547A023 BINDING SITE, designated SEQ ID:35942, to the nucleotide sequence of VGAM499 RNA, herein designated VGAM RNA, also designated SEQ ID:3210.

Another function of VGAM499 is therefore inhibition of DKFZp547A023 (Accession XM_052065). Accordingly, utilities of VGAM499 include diagnosis, prevention and treatment of diseases and clinical conditions associated with DKFZp547A023. FLJ13902 (Accession NM_024653) is another VGAM499 host target gene. FLJ13902 BINDING SITE is HOST TARGET binding site found in the 3' untranslated region of mRNA encoded by FLJ13902, corresponding to a HOST TARGET binding site such as BINDING SITE I, BINDING SITE II or BINDING SITE III. Table 2 illustrates the complementarity of the nucleotide sequences of FLJ13902 BINDING SITE, designated SEQ ID:23950, to the nucleotide sequence of VGAM499 RNA, herein designated VGAM RNA, also designated SEQ ID:3210.

Another function of VGAM499 is therefore inhibition of FLJ13902 (Accession NM_024653). Accordingly, utilities of VGAM499 include diagnosis, prevention and treatment of diseases and clinical conditions associated with FLJ13902. KIAA0429 (Accession NM_014751) is another VGAM499 host target gene. KIAA0429 BINDING SITE is HOST TARGET binding site found in the 3' untranslated region of mRNA encoded by KIAA0429, corresponding to a HOST TARGET binding site such as BINDING SITE I, BINDING SITE II or BINDING SITE III. Table 2 illustrates the complementarity of the nucleotide sequences of KIAA0429 BINDING SITE, designated SEQ ID:16464, to the nucleotide sequence of VGAM499 RNA, herein designated VGAM RNA, also designated SEQ ID:3210.

Another function of VGAM499 is therefore inhibition of KIAA0429 (Accession NM_014751). Accordingly, utilities of VGAM499 include diagnosis, prevention and treatment of diseases and clinical conditions associated with KIAA0429. KIAA0446 (Accession XM_044155) is another VGAM499 host target gene. KIAA0446 BINDING SITE is HOST TARGET binding site found in the 5' untranslated region of mRNA encoded by KIAA0446, corresponding to a HOST TARGET binding site such as BINDING SITE I, BINDING SITE II or BINDING SITE III. Table 2 illustrates the complementarity of the nucleotide sequences of KIAA0446 BINDING SITE, designated SEQ ID:34151, to the nucleotide sequence of VGAM499 RNA, herein designated VGAM RNA, also designated SEQ ID:3210.

Another function of VGAM499 is therefore inhibition of KIAA0446 (Accession XM_044155). Accordingly, utilities of VGAM499 include diagnosis, prevention and treatment of diseases and clinical conditions associated with KIAA0446. LOC143888 (Accession XM_084669) is another VGAM499 host target gene. LOC143888 BINDING SITE is HOST TARGET binding site found in the 3' untranslated region of mRNA encoded by LOC143888, corresponding to a HOST TARGET binding site such as BINDING SITE I, BINDING SITE II or BINDING SITE III. Table 2 illustrates the complementarity of the nucleotide sequences of LOC143888 BINDING SITE, designated SEQ ID:37665, to the nucleotide sequence of VGAM499 RNA, herein designated VGAM RNA, also designated SEQ ID:3210.

Another function of VGAM499 is therefore inhibition of LOC143888 (Accession XM_084669). Accordingly, utilities of VGAM499 include diagnosis, prevention and treatment of diseases and clinical conditions associated with LOC143888. LOC254266 (Accession XM_173221) is another VGAM499 host target gene. LOC254266 BINDING SITE is HOST TARGET binding site found in the 5' untranslated region of mRNA encoded by LOC254266, corresponding to a HOST TARGET binding site such as BINDING SITE I, BINDING SITE II or BINDING SITE III. Table 2 illustrates the complementarity of the nucleotide sequences of LOC254266 BINDING SITE, designated SEQ ID:46480, to the nucleotide sequence of VGAM499 RNA, herein designated VGAM RNA, also designated SEQ ID:3210.

Another function of VGAM499 is therefore inhibition of LOC254266 (Accession XM_173221). Accordingly, utilities of VGAM499 include diagnosis, prevention and treatment of diseases and clinical conditions associated with LOC254266. FIG. 1 further provides a conceptual description of a novel bioinformatically detected viral gene of the present invention, referred to here as Viral Genomic Address Messenger 500 (VGAM500) viral gene, which modulates expression of respective host target genes thereof, the function and utility of which host target genes is known in the art.

VGAM500 is a novel bioinformatically detected regulatory, non protein coding, viral micro RNA (miRNA) gene. The method by which VGAM500 was detected is described hereinabove with reference to FIGS. 1-8.

VGAM500 gene, herein designated VGAM GENE, is a viral gene contained in the genome of Strawberry Vein Banding Virus (SVBV). VGAM500 host target gene, herein designated VGAM HOST TARGET GENE, is a human gene contained in the human genome.

VGAM500 gene encodes a VGAM500 precursor RNA, herein designated VGAM PRECURSOR RNA. Similar to other miRNA genes, and unlike most ordinary genes, VGAM500 precursor RNA does not encode a protein. A nucleotide sequence identical or highly similar to the nucleotide sequence of VGAM500 precursor RNA is designated SEQ ID:486, and is provided hereinbelow with reference to the sequence listing part. Nucleotide sequence SEQ ID:486 is located at position 4531 relative to the genome of Strawberry Vein Banding Virus (SVBV).

VGAM500 precursor RNA folds onto itself, forming VGAM500 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM500 folded precursor RNA into VGAM500 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM500 RNA is designated SEQ ID:3211, and is provided hereinbelow with reference to the sequence listing part.

VGAM500 host target gene, herein designated VGAM HOST TARGET GENE, encodes a corresponding messenger RNA, VGAM500 host target RNA, herein designated VGAM HOST TARGET RNA. VGAM500 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM500 RNA, herein designated VGAM RNA, binds complementarily to one or more host target binding sites located in untranslated regions of VGAM500 host target RNA, herein designated VGAM HOST TARGET RNA. This complementary binding is due to the fact that the nucleotide sequence of VGAM500 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM500 RNA, herein designated VGAM RNA, may have a different number of host target binding sites in untranslated regions of a VGAM500 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM500 RNA, herein designated VGAM RNA, to host target binding sites on VGAM500 host target RNA, herein designated VGAM HOST TARGET RNA, such as BINDING SITE I, BINDING SITE II and BINDING SITE III, inhibits translation of VGAM500 host target RNA into VGAM500 host target protein, herein designated VGAM HOST TARGET PROTEIN. VGAM host target protein is therefore outlined by a broken line.

It is appreciated that VGAM500 host target gene, herein designated VGAM HOST TARGET GENE, in fact represents a plurality of VGAM500 host target genes. The mRNA of each one of this plurality of VGAM500 host target genes comprises one or more host target binding sites, each having a nucleotide sequence which is at least partly complementary to VGAM500 RNA, herein designated VGAM RNA, and which when bound by VGAM500 RNA causes inhibition of translation of respective one or more VGAM500 host target proteins.

It is further appreciated by one skilled in the art that the mode of translational inhibition illustrated by FIG. 1 with specific reference to translational inhibition exerted by VGAM500 gene, herein designated VGAM GENE, on one or more VGAM500 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM500 is inhibition of expression of host target genes, as part of a novel viral mechanism of attacking a host. Accordingly, utilities of VGAM500 include diagnosis, prevention and treatment of viral infection by Strawberry Vein Banding Virus (SVBV). Specific functions, and accordingly utilities, of VGAM500 correlate with, and may be deduced from, the identity of the host target genes which VGAM500 binds and inhibits, and the function of these host target genes, as elaborated hereinbelow.

Nucleotide sequences of the VGAM500 precursor RNA, herein designated VGAM PRECURSOR RNA, and of the 'diced' VGAM500 RNA, herein designated VGAM RNA, and a schematic representation of the secondary folding of VGAM500 folded precursor RNA, herein designated VGAM FOLDED PRECURSOR RNA, of VGAM500 are further described hereinbelow with reference to Table 1.

Nucleotide sequences of host target binding sites, such as BINDING SITE-I, BINDING SITE-II and BINDING SITE-III of FIG. 1, found on VGAM500 host target RNA, and schematic representation of the complementarity of each of these host target binding sites to VGAM500 RNA, herein designated VGAM RNA, are described hereinbelow with reference to Table 2.

As mentioned hereinabove with reference to FIG. 1, a function of VGAM500 gene, herein designated VGAM is inhibition of expression of VGAM500 target genes. It is appreciated that specific functions, and accordingly utilities, of VGAM500 correlate with, and may be deduced from, the identity of the target genes which VGAM500 binds and inhibits, and the function of these target genes, as elaborated hereinbelow.

Adaptor-related Protein Complex 1, Mu 1 Subunit (AP1M1, Accession NM_032493) is a VGAM500 host target gene. AP1M1 BINDING SITE is HOST TARGET binding site found in the 3' untranslated region of mRNA encoded by AP1M1, corresponding to a HOST TARGET binding site such as BINDING SITE I, BINDING SITE II or BINDING SITE III. Table 2 illustrates the complementarity of the nucleotide sequences of AP1M1 BINDING SITE, designated SEQ ID:26244, to the nucleotide sequence of VGAM500 RNA, herein designated VGAM RNA, also designated SEQ ID:3211.

A function of VGAM500 is therefore inhibition of Adaptor-related Protein Complex 1, Mu 1 Subunit (AP1M1, Accession NM_032493), a gene which promotes the formation of clathrin-coated pits and vesicles. Accordingly, utilities of VGAM500 include diagnosis, prevention and treatment of diseases and clinical conditions associated with AP1M1. The function of AP1M1 has been established by previous studies. Heterotetrameric adaptor complexes promote the formation of clathrin-coated pits and vesicles. The AP-1 adaptor, localized at the trans-Golgi network, is composed of 2 approximately 100-kD subunits, beta-prime adaptin (OMIM Ref. No. 600157) and gamma-adaptin (OMIM Ref. No. 603533); a medium subunit, AP47; and a small subunit, AP19 (OMIM Ref. No. 603531). Nakayama et al. (1991) isolated a mouse brain cDNA encoding AP47.

Full details of the abovementioned studies are described in the following publications, the disclosure of which are hereby incorporated by reference:

Doray, B.; Ghosh, P.; Griffith, J.; Geuze, H. J.; Kornfeld, S.: Cooperation of GGAs and AP-1 in packaging MPRs at the trans-Golgi network. Science 297: 1700-1703, 2002; and Nakayama, Y.; Goebl, M.; O'Brine Greco, B.; Lemmon, S.; Pingchang Chow, E.; Kirchhausen, T.: The medium chains of the mammalian clathrin-associated proteins have a homolog in yeast. E.

Further studies establishing the function and utilities of AP1M1 are found in John Hopkins OMIM database record ID 603535, and in sited publications numbered 12596, 422 and 8521 listed in the bibliography section hereinbelow, which are also hereby incorporated by reference. ARPP-21 (Accession NM_016300) is another VGAM500 host target gene. ARPP-21 BINDING SITE is HOST TARGET binding site found in the 5' untranslated region of mRNA encoded by ARPP-21, corresponding to a HOST TARGET binding site such as BINDING SITE I, BINDING SITE II or BINDING SITE III. Table 2 illustrates the complementarity of the nucleotide sequences of ARPP-21 BINDING SITE, designated SEQ ID:18420, to the nucleotide sequence of VGAM500 RNA, herein designated VGAM RNA, also designated SEQ ID:3211.

Another function of VGAM500 is therefore inhibition of ARPP-21 (Accession NM_016300). Accordingly, utilities of VGAM500 include diagnosis, prevention and treatment of diseases and clinical conditions associated with ARPP-21. JM4 (Accession NM_007213) is another VGAM500 host target gene. JM4 BINDING SITE is HOST TARGET binding site found in the 3' untranslated region of mRNA encoded by JM4, corresponding to a HOST TARGET binding site such as BINDING SITE I, BINDING SITE II or BINDING SITE III. Table 2 illustrates the complementarity of the nucleotide sequences of JM4 BINDING SITE, designated SEQ ID:14079, to the nucleotide sequence of VGAM500 RNA, herein designated VGAM RNA, also designated SEQ ID:3211.

Another function of VGAM500 is therefore inhibition of JM4 (Accession NM_007213). Accordingly, utilities of VGAM500 include diagnosis, prevention and treatment of diseases and clinical conditions associated with JM4. MGC4309 (Accession NM_024115) is another VGAM500 host target gene. MGC4309 BINDING SITE is HOST TARGET binding site found in the 3' untranslated region of mRNA encoded by MGC4309, corresponding to a HOST TARGET binding site such as BINDING SITE I, BINDING SITE II or BINDING SITE III. Table 2 illustrates the complementarity of the nucleotide sequences of MGC4309 BINDING SITE, designated SEQ ID:23569, to the nucleotide sequence of VGAM500 RNA, herein designated VGAM RNA, also designated SEQ ID:3211.

Another function of VGAM500 is therefore inhibition of MGC4309 (Accession NM_024115). Accordingly, utilities of VGAM500 include diagnosis, prevention and treatment of diseases and clinical conditions associated with MGC4309. TED (Accession NM_015686) is another VGAM500 host target gene. TED BINDING SITE is HOST TARGET binding site found in the 3' untranslated region of mRNA encoded by TED, corresponding to a HOST TARGET binding site such as BINDING SITE I, BINDING SITE II or BINDING SITE III. Table 2 illustrates the complementarity of the nucleotide sequences of TED BINDING SITE, designated SEQ ID:17917, to the nucleotide sequence of VGAM500 RNA, herein designated VGAM RNA, also designated SEQ ID:3211.

Another function of VGAM500 is therefore inhibition of TED (Accession NM_015686). Accordingly, utilities of VGAM500 include diagnosis, prevention and treatment of diseases and clinical conditions associated with TED. Zinc Finger Protein 273 (ZNF273, Accession XM_088082) is another VGAM500 host target gene. ZNF273 BINDING SITE is HOST TARGET binding site found in the 5' untranslated region of mRNA encoded by ZNF273, corresponding to a HOST TARGET binding site such as BINDING SITE I, BINDING SITE II or BINDING SITE III. Table 2 illustrates the complementarity of the nucleotide sequences of ZNF273 BINDING SITE, designated SEQ ID:39509, to the nucleotide sequence of VGAM500 RNA, herein designated VGAM RNA, also designated SEQ ID:3211.

Another function of VGAM500 is therefore inhibition of Zinc Finger Protein 273 (ZNF273, Accession XM_088082). Accordingly, utilities of VGAM500 include diagnosis, prevention and treatment of diseases and clinical conditions associated with ZNF273. LOC145934 (Accession XM_096905) is another VGAM500 host target gene. LOC145934 BINDING SITE is HOST TARGET binding site found in the 5' untranslated region of mRNA encoded by LOC145934, corresponding to a HOST TARGET binding site such as BINDING SITE I, BINDING SITE II or BINDING SITE III. Table 2 illustrates the complementarity of the nucleotide sequences of LOC145934 BINDING SITE, designated SEQ ID:40626, to the nucleotide sequence of VGAM500 RNA, herein designated VGAM RNA, also designated SEQ ID:3211.

Another function of VGAM500 is therefore inhibition of LOC145934 (Accession XM_096905). Accordingly, utilities of VGAM500 include diagnosis, prevention and treatment of diseases and clinical conditions associated with LOC145934. LOC256444 (Accession XM_172937) is another VGAM500 host target gene. LOC256444 BINDING SITE is HOST TARGET binding site found in the 5' untranslated region of mRNA encoded by LOC256444, corresponding to a HOST TARGET binding site such as BINDING SITE I, BINDING SITE II or BINDING SITE III. Table 2 illustrates the complementarity of the nucleotide sequences of LOC256444 BINDING SITE, designated SEQ ID:46199, to the nucleotide sequence of VGAM500 RNA, herein designated VGAM RNA, also designated SEQ ID:3211.

Another function of VGAM500 is therefore inhibition of LOC256444 (Accession XM_172937). Accordingly, utilities of VGAM500 include diagnosis, prevention and treatment of diseases and clinical conditions associated with LOC256444. LOC257484 (Accession XM_114232) is another VGAM500 host target gene. LOC257484 BINDING SITE is HOST TARGET binding site found in the 5' untranslated region of mRNA encoded by LOC257484, corresponding to a HOST TARGET binding site such as BINDING SITE I, BINDING SITE II or BINDING SITE III. Table 2 illustrates the complementarity of the nucleotide sequences of LOC257484 BINDING SITE, designated SEQ ID:42815, to the nucleotide sequence of VGAM500 RNA, herein designated VGAM RNA, also designated SEQ ID:3211.

Another function of VGAM500 is therefore inhibition of LOC257484 (Accession XM_114232). Accordingly, utilities of VGAM500 include diagnosis, prevention and treatment of diseases and clinical conditions associated with LOC257484. FIG. 1 further provides a conceptual description of a novel bioinformatically detected viral gene of the present invention, referred to here as Viral Genomic Address Messenger 501 (VGAM501) viral gene, which modulates expression of respective host target genes thereof, the function and utility of which host target genes is known in the art.

VGAM501 is a novel bioinformatically detected regulatory, non protein coding, viral micro RNA (miRNA) gene. The method by which VGAM501 was detected is described hereinabove with reference to FIGS. 1-8.

VGAM501 gene, herein designated VGAM GENE, is a viral gene contained in the genome of Carrot Mottle Mimic Virus. VGAM501 host target gene, herein designated VGAM HOST TARGET GENE, is a human gene contained in the human genome.

VGAM501 gene encodes a VGAM501 precursor RNA, herein designated VGAM PRECURSOR RNA. Similar to other miRNA genes, and unlike most ordinary genes, VGAM501 precursor RNA does not encode a protein. A nucleotide sequence identical or highly similar to the nucleotide sequence of VGAM501 precursor RNA is designated SEQ ID:487, and is provided hereinbelow with reference to the sequence listing part. Nucleotide sequence SEQ ID:487 is located at position 2430 relative to the genome of Carrot Mottle Mimic Virus.

VGAM501 precursor RNA folds onto itself, forming VGAM501 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM501 folded precursor RNA into VGAM501 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM501 RNA is designated SEQ ID:3212, and is provided hereinbelow with reference to the sequence listing part.

VGAM501 host target gene, herein designated VGAM HOST TARGET GENE, encodes a corresponding messenger RNA, VGAM501 host target RNA, herein designated VGAM HOST TARGET RNA. VGAM501 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM501 RNA, herein designated VGAM RNA, binds complementarily to one or more host target binding sites located in untranslated regions of VGAM501 host target RNA, herein designated VGAM HOST TARGET RNA. This complementary binding is due to the fact that the nucleotide sequence of VGAM501 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM501 RNA, herein designated VGAM RNA, may have a different number of host target binding sites in untranslated regions of a VGAM501 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM501 RNA, herein designated VGAM RNA, to host target binding sites on VGAM501 host target RNA, herein designated VGAM HOST TARGET RNA, such as BINDING SITE I, BINDING SITE II and BINDING SITE III, inhibits translation of VGAM501 host target RNA into VGAM501 host target protein, herein designated VGAM HOST TARGET PROTEIN. VGAM host target protein is therefore outlined by a broken line.

It is appreciated that VGAM501 host target gene, herein designated VGAM HOST TARGET GENE, in fact represents a plurality of VGAM501 host target genes. The mRNA of each one of this plurality of VGAM501 host target genes comprises one or more host target binding sites, each having a nucleotide sequence which is at least partly complementary to VGAM501 RNA, herein designated VGAM RNA, and which when bound by VGAM501 RNA causes inhibition of translation of respective one or more VGAM501 host target proteins.

It is further appreciated by one skilled in the art that the mode of translational inhibition illustrated by FIG. 1 with specific reference to translational inhibition exerted by VGAM501 gene, herein designated VGAM GENE, on one or more VGAM501 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM501 is inhibition of expression of host target genes, as part of a novel viral mechanism of attacking a host. Accordingly, utilities of VGAM501 include diagnosis, prevention and treatment of viral infection by Carrot Mottle Mimic Virus. Specific functions, and accordingly utilities, of VGAM501 correlate with, and may be deduced from, the identity of the host target genes which VGAM501 binds and inhibits, and the function of these host target genes, as elaborated hereinbelow.

Nucleotide sequences of the VGAM501 precursor RNA, herein designated VGAM PRECURSOR RNA, and of the 'diced' VGAM501 RNA, herein designated VGAM RNA, and a schematic representation of the secondary folding of VGAM501 folded precursor RNA, herein designated VGAM FOLDED PRECURSOR RNA, of VGAM501 are further described hereinbelow with reference to Table 1.

Nucleotide sequences of host target binding sites, such as BINDING SITE-I, BINDING SITE-II and BINDING SITE-III of FIG. 1, found on VGAM501 host target RNA, and schematic representation of the complementarity of each of these host target binding sites to VGAM501 RNA, herein designated VGAM RNA, are described hereinbelow with reference to Table 2.

As mentioned hereinabove with reference to FIG. 1, a function of VGAM501 gene, herein designated VGAM is inhibition of expression of VGAM501 target genes. It is appreciated that specific functions, and accordingly utilities, of VGAM501 correlate with, and may be deduced from, the identity of the target genes which VGAM501 binds and inhibits, and the function of these target genes, as elaborated hereinbelow.

Eukaryotic Translation Initiation Factor 4E Binding Protein 2 (EIF4EBP2, Accession NM_004096) is a VGAM501 host target gene. EIF4EBP2 BINDING SITE is HOST TARGET binding site found in the 3' untranslated region of mRNA encoded by EIF4EBP2, corresponding to a HOST TARGET binding site such as BINDING SITE I, BINDING SITE II or BINDING SITE III. Table 2 illustrates the complementarity of the nucleotide sequences of EIF4EBP2 BINDING SITE, designated SEQ ID:10301, to the nucleotide sequence of VGAM501 RNA, herein designated VGAM RNA, also designated SEQ ID:3212.

A function of VGAM501 is therefore inhibition of Eukaryotic Translation Initiation Factor 4E Binding Protein 2 (EIF4EBP2, Accession NM_004096), a gene which binds EIF4E and negatively regulates initiation of translation. Accordingly, utilities of VGAM501 include diagnosis, prevention and treatment of diseases and clinical conditions associated with EIF4EBP2. The function of EIF4EBP2 has been established by previous studies. Pause et al. (1994) reported that the 4EBP2 gene encodes a 120-amino acid polypeptide that is 56% identical to that of 4EBP1 (OMIM Ref. No. 602223). By Northern blot analysis, Tsukiyama-Kohara et al. (1996) showed that a major 3.5-kb transcript of 4EBP2 is expressed ubiquitously. Tsukiyama-Kohara et al. (1996) analyzed the genomic structure of the mouse EIF4EBP2 gene and showed that it consists of 3 exons and spans 20 kb. Its intron/exon structure is identical to that of EIF4EBP1. Using fluorescence in situ hybridization, Tsukiyama-Kohara et al. (1996) mapped the EIF4EBP2 gene to human chromosome 10q21-q22. They noted that chromosomal alterations in this region have been found in some human cancers. Tsukiyama-Kohara et al. (1996) mapped the mouse 4EBP2 gene to chromosome 10B4-B5.

Full details of the abovementioned studies are described in the following publications, the disclosure of which are hereby incorporated by reference:

Pause, A.; Belsham, G. J.; Gingras, A.-C.; Donze, O.; Lin, T.-A.; Lawrence, J. C., Jr.; Sonenberg, N.: Insulin-dependent stimulation of protein synthesis by phosphorylation of a regulator of 5-prime-cap function. Nature 371:762-767, 1994; and Tsukiyama-Kohara, K.; Vidal, S. M.; Gingras, A.-C.; Glover, T. W.; Hanash, S. M.; Heng, H.; Sonenberg, N.: Tissue distribution, genomic structure, and chromosome mapping of mouse and h.

Further studies establishing the function and utilities of EIF4EBP2 are found in John Hopkins OMIM database record ID 602224, and in sited publications numbered 346 and 6286 listed in the bibliography section hereinbelow, which are also hereby incorporated by reference. Suppressor of Variegation 3-9 Homolog 1 (Drosophila) (SUV39H1, Accession NM_003173) is another VGAM501 host target gene. SUV39H1 BINDING SITE is HOST TARGET binding site found in the 3' untranslated region of mRNA encoded by SUV39H1, corresponding to a HOST TARGET binding site such as BINDING SITE I, BINDING SITE II or BINDING SITE III. Table 2 illustrates the complementarity of the nucleotide sequences of SUV39H1 BINDING SITE, designated SEQ ID:9147, to the nucleotide sequence of VGAM501 RNA, herein designated VGAM RNA, also designated SEQ ID:3212.

Another function of VGAM501 is therefore inhibition of Suppressor of Variegation 3-9 Homolog 1 (Drosophila) (SUV39H1, Accession NM_003173), a gene which is homolog of Drosophila suppressor of variegation 3-9 and modifies position effect variegation. Accordingly, utilities of VGAM501 include diagnosis, prevention and treatment of diseases and clinical conditions associated with SUV39H1. The function of SUV39H1 has been established by previous studies. By screening a human B-cell cDNA library with a sequence encoding the C-terminal portion of the Drosophila Su (var)3-9 gene product, which contains the SET domain, Aagaard et al. (1999) isolated a cDNA encoding SUV39H1. The predicted 412-amino acid SUV39H1 protein contains a chromodomain that is located close to the N terminus, a cysteine-rich region, an adjacent C-terminal SET domain that is followed at the very C-terminal tail by 3 conserved cysteine residues, and a putative nuclear localization signal. SUV39H1 shares 95% amino acid sequence identity with mouse Suv39h1, 42% identity with Drosophila Su (var)3-9, and 38% identity with S. pombe CLR4, another Su (var)3-9 ortholog. Immunoblot analysis of protein extracts from human cell lines detected an approximately 48-kD endogenous SUV39H1 protein, a mass that corresponds with the mass calculated from the SUV39H1 cDNA. Immunodetection of endogenous SUV39H1 protein revealed enriched distribution at heterochromatic foci during interphase and centromere-specific localization during metaphase. In addition, SUV39H1 protein associated with M31 (HP1-beta, or CBX1; 604511), an Su (var) homolog, indicating the existence of an Su (var) protein complex. Animal model experiments lend further support to the function of SUV39H1. Peters et al. (2001) generated mice deficient for either Suv39h1 or Suv39h2 (OMIM Ref. No. 606503). These animals displayed normal viability and fertility and did not exhibit apparent phenotypes. The authors subsequently intercrossed Suv39h1 -/- and Suv39h2 -/- mice to generate compound Suv39h mutants that were then used to derive Suv39h double-null mice (Suv39h1 -/- and Suv39h2 -/-). These mice displayed severely impaired viability and chromosomal instabilities that were associated with an increased tumor risk and perturbed chromosome interactions during male meiosis. These data suggested a crucial role for pericentric H3 histone-lys9 methylation in protecting genome stability and defined the Suv39h HMTases as important epigenetic regulators for mammalian development.

It is appreciated that the abovementioned animal model for SUV39H1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Aagaard, L.; Laible, G.; Selenko, P.; Schmid, M.; Dorn, R.; Schotta, G.; Kuhfittig, S.; Wolf, A.; Lebersorger, A.; Singh, P. B.; Reuter, G.; Jenuwein, T.: Functional mammalian homologues of the Drosophila PEV-modifier Su (var)3-9 encode centromere-associated proteins which complex with the heterochromatin component M31. EMBO J. 18:1923-1938, 1999; and Peters, A. H. F. M.; O'Carroll, D.; Scherthan, H.; Mechtler, K.; Sauer, S.; Schofer, C.; Weipoltshammer, K.; Pagani, M.; Lachner, M.; Kohlmaier, A.; Opravil, S.; Doyle, M.; Sibilia, M.

Further studies establishing the function and utilities of SUV39H1 are found in John Hopkins OMIM database record ID 300254, and in sited publications numbered 1244-124 and 9068-9073 listed in the bibliography section hereinbelow, which are also hereby incorporated by reference. Claudin 8 (CLDN8, Accession NM_012132) is another VGAM501 host target gene. CLDN8 BINDING SITE is HOST TARGET binding site found in the 3' untranslated region of mRNA encoded by CLDN8, corresponding to a HOST TARGET binding site such as BINDING SITE I, BINDING SITE II or BINDING SITE III. Table 2 illustrates the complementarity of the nucleotide sequences of CLDN8 BINDING SITE, designated SEQ ID:14443, to the nucleotide sequence of VGAM501 RNA, herein designated VGAM RNA, also designated SEQ ID:3212.

Another function of VGAM501 is therefore inhibition of Claudin 8 (CLDN8, Accession NM_012132). Accordingly, utilities of VGAM501 include diagnosis, prevention and treatment of diseases and clinical conditions associated with CLDN8. FLJ11267 (Accession NM_019607) is another VGAM501 host target gene. FLJ11267 BINDING SITE is HOST TARGET binding site found in the 3' untranslated region of mRNA encoded by FLJ11267, corresponding to a HOST TARGET binding site such as BINDING SITE I, BINDING SITE II or BINDING SITE III. Table 2 illustrates the complementarity of the nucleotide sequences of FLJ11267 BINDING SITE, designated SEQ ID:21223, to the nucleotide sequence of VGAM501 RNA, herein designated VGAM RNA, also designated SEQ ID:3212.

Another function of VGAM501 is therefore inhibition of FLJ11267 (Accession NM_019607). Accordingly, utilities of VGAM501 include diagnosis, prevention and treatment of diseases and clinical conditions associated with FLJ11267. KIAA0090 (Accession XM_114045) is another VGAM501 host target gene. KIAA0090 BINDING SITE is HOST TARGET binding site found in the 3' untranslated region of mRNA encoded by KIAA0090, corresponding to a HOST TARGET binding site such as BINDING SITE I, BINDING SITE II or BINDING SITE III. Table 2 illustrates the complementarity of the nucleotide sequences of KIAA0090 BINDING SITE, designated SEQ ID:42649, to the nucleotide sequence of VGAM501 RNA, herein designated VGAM RNA, also designated SEQ ID:3212.

Another function of VGAM501 is therefore inhibition of KIAA0090 (Accession XM_114045). Accordingly, utilities of VGAM501 include diagnosis, prevention and treatment of diseases and clinical conditions associated with KIAA0090. LOC221687 (Accession XM_166423) is another VGAM501 host target gene. LOC221687 BINDING SITE is HOST TARGET binding site found in the 5' untranslated region of mRNA encoded by LOC221687, corresponding to a HOST TARGET binding site such as BINDING SITE I, BINDING SITE II or BINDING SITE III. Table 2 illustrates the complementarity of the nucleotide sequences of LOC221687 BINDING SITE, designated SEQ ID:44305, to the nucleotide sequence of VGAM501 RNA, herein designated VGAM RNA, also designated SEQ ID:3212.

Another function of VGAM501 is therefore inhibition of LOC221687 (Accession XM_166423). Accordingly, utilities of VGAM501 include diagnosis, prevention and treatment of diseases and clinical conditions associated with LOC221687. LOC253769 (Accession XM_173183) is another VGAM501 host target gene. LOC253769 BINDING SITE is HOST TARGET binding site found in the 5' untranslated region of mRNA encoded by LOC253769, corresponding to a HOST TARGET binding site such as BINDING SITE I, BINDING SITE II or BINDING SITE III. Table 2 illustrates the complementarity of the nucleotide sequences of LOC253769 BINDING SITE, designated SEQ ID:46429, to the nucleotide sequence of VGAM501 RNA, herein designated VGAM RNA, also designated SEQ ID:3212.

Another function of VGAM501 is therefore inhibition of LOC253769 (Accession XM_173183). Accordingly, utilities of VGAM501 include diagnosis, prevention and treatment of diseases and clinical conditions associated with LOC253769. FIG. 1 further provides a conceptual description of a novel bioinformatically detected viral gene of the present invention, referred to here as Viral Genomic Address Messenger 502 (VGAM502) viral gene, which modulates expression of respective host target genes thereof, the function and utility of which host target genes is known in the art.

VGAM502 is a novel bioinformatically detected regulatory, non protein coding, viral micro RNA (miRNA) gene. The method by which VGAM502 was detected is described hereinabove with reference to FIGS. 1-8.

VGAM502 gene, herein designated VGAM GENE, is a viral gene contained in the genome of Carrot Mottle Mimic Virus. VGAM502 host target gene, herein designated VGAM HOST TARGET GENE, is a human gene contained in the human genome.

VGAM502 gene encodes a VGAM502 precursor RNA, herein designated VGAM PRECURSOR RNA. Similar to other miRNA genes, and unlike most ordinary genes, VGAM502 precursor RNA does not encode a protein. A nucleotide sequence identical or highly similar to the nucleotide sequence of VGAM502 precursor RNA is designated SEQ ID:488, and is provided hereinbelow with reference to the sequence listing part. Nucleotide sequence SEQ ID:488 is located at position 2271 relative to the genome of Carrot Mottle Mimic Virus.

VGAM502 precursor RNA folds onto itself, forming VGAM502 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM502 folded precursor RNA into VGAM502 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM502 RNA is designated SEQ ID:3213, and is provided hereinbelow with reference to the sequence listing part.

VGAM502 host target gene, herein designated VGAM HOST TARGET GENE, encodes a corresponding messenger RNA, VGAM502 host target RNA, herein designated VGAM HOST TARGET RNA. VGAM502 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM502 RNA, herein designated VGAM RNA, binds complementarily to one or more host target binding sites located in untranslated regions of VGAM502 host target RNA, herein designated VGAM HOST TARGET RNA. This complementary binding is due to the fact that the nucleotide sequence of VGAM502 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM502 RNA, herein designated VGAM RNA, may have a different number of host target binding sites in untranslated regions of a VGAM502 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM502 RNA, herein designated VGAM RNA, to host target binding sites on VGAM502 host target RNA, herein designated VGAM HOST TARGET RNA, such as BINDING SITE I, BINDING SITE II and BINDING SITE III, inhibits translation of VGAM502 host target RNA into VGAM502 host target protein, herein designated VGAM HOST TARGET PROTEIN. VGAM host target protein is therefore outlined by a broken line.

It is appreciated that VGAM502 host target gene, herein designated VGAM HOST TARGET GENE, in fact represents a plurality of VGAM502 host target genes. The mRNA of each one of this plurality of VGAM502 host target genes comprises one or more host target binding sites, each having a nucleotide sequence which is at least partly complementary to VGAM502 RNA, herein designated VGAM RNA, and which when bound by VGAM502 RNA causes inhibition of translation of respective one or more VGAM502 host target proteins.

It is further appreciated by one skilled in the art that the mode of translational inhibition illustrated by FIG. 1 with specific reference to translational inhibition exerted by VGAM502 gene, herein designated VGAM GENE, on one or more VGAM502 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM502 is inhibition of expression of host target genes, as part of a novel viral mechanism of attacking a host. Accordingly, utilities of VGAM502 include diagnosis, prevention and treatment of viral infection by Carrot Mottle Mimic Virus. Specific functions, and accordingly utilities, of VGAM502 correlate with, and may be deduced from, the identity of the host target genes which VGAM502 binds and inhibits, and the function of these host target genes, as elaborated hereinbelow.

Nucleotide sequences of the VGAM502 precursor RNA, herein designated VGAM PRECURSOR RNA, and of the 'diced' VGAM502 RNA, herein designated VGAM RNA, and a schematic representation of the secondary folding of VGAM502 folded precursor RNA, herein designated VGAM FOLDED PRECURSOR RNA, of VGAM502 are further described hereinbelow with reference to Table 1.

Nucleotide sequences of host target binding sites, such as BINDING SITE-I, BINDING SITE-II and BINDING SITE-III of FIG. 1, found on VGAM502 host target RNA, and schematic representation of the complementarity of each of these host target binding sites to VGAM502 RNA, herein designated VGAM RNA, are described hereinbelow with reference to Table 2.

As mentioned hereinabove with reference to FIG. 1, a function of VGAM502 gene, herein designated VGAM is inhibition of expression of VGAM502 target genes. It is appreciated that specific functions, and accordingly utilities, of VGAM502 correlate with, and may be deduced from, the identity of the target genes which VGAM502 binds and inhibits, and the function of these target genes, as elaborated hereinbelow.

CDC14 Cell Division Cycle 14 Homolog B (S. cerevisiae) (CDC14B, Accession NM_033332) is a VGAM502 host target gene. CDC14B BINDING SITE is HOST TARGET binding site found in the 3' untranslated region of mRNA encoded by CDC14B, corresponding to a HOST TARGET binding site such as BINDING SITE I, BINDING SITE II or BINDING SITE III. Table 2 illustrates the complementarity of the nucleotide sequences of CDC14B BINDING SITE, designated SEQ ID:27171, to the nucleotide sequence of VGAM502 RNA, herein designated VGAM RNA, also designated SEQ ID:3213.

A function of VGAM502 is therefore inhibition of CDC14 Cell Division Cycle 14 Homolog B (S. cerevisiae) (CDC14B, Accession NM_033332). Accordingly, utilities of VGAM502 include diagnosis, prevention and treatment of diseases and clinical conditions associated with CDC14B. Lipoma HMGIC Fusion Partner-like 2 (LHFPL2, Accession XM_046054) is another VGAM502 host target gene. LHFPL2 BINDING SITE is HOST TARGET binding site found in the 3' untranslated region of mRNA encoded by LHFPL2, corresponding to a HOST TARGET binding site such as BINDING SITE I, BINDING SITE II or BINDING SITE III. Table 2 illustrates the complementarity of the nucleotide sequences of LHFPL2 BINDING SITE, designated SEQ ID:34661, to the nucleotide sequence of VGAM502 RNA, herein designated VGAM RNA, also designated SEQ ID:3213.

Another function of VGAM502 is therefore inhibition of Lipoma HMGIC Fusion Partner-like 2 (LHFPL2, Accession XM_046054). Accordingly, utilities of VGAM502 include diagnosis, prevention and treatment of diseases and clinical conditions associated with LHFPL2. LOC115343 (Accession XM_050640) is another VGAM502 host target gene. LOC115343 BINDING SITE is HOST TARGET binding site found in the 5' untranslated region of mRNA encoded by LOC115343, corresponding to a HOST TARGET binding site such as BINDING SITE I, BINDING SITE II or BINDING SITE III. Table 2 illustrates the complementarity of the nucleotide sequences of LOC115343 BINDING SITE, designated SEQ ID:35665, to the nucleotide sequence of VGAM502 RNA, herein designated VGAM RNA, also designated SEQ ID:3213.

Another function of VGAM502 is therefore inhibition of LOC115343 (Accession XM_050640). Accordingly, utilities of VGAM502 include diagnosis, prevention and treatment of diseases and clinical conditions associated with LOC115343. FIG. 1 further provides a conceptual description of a novel bioinformatically detected viral gene of the present invention, referred to here as Viral Genomic Address Messenger 503 (VGAM503) viral gene, which modulates expression of respective host target genes thereof, the function and utility of which host target genes is known in the art.

VGAM503 is a novel bioinformatically detected regulatory, non protein coding, viral micro RNA (miRNA) gene. The method by which VGAM503 was detected is described hereinabove with reference to FIGS. 1-8.

VGAM503 gene, herein designated VGAM GENE, is a viral gene contained in the genome of Molluscum Contagiosum Virus. VGAM503 host target gene, herein designated VGAM HOST TARGET GENE, is a human gene contained in the human genome.

VGAM503 gene encodes a VGAM503 precursor RNA, herein designated VGAM PRECURSOR RNA. Similar to other miRNA genes, and unlike most ordinary genes, VGAM503 precursor RNA does not encode a protein. A nucleotide sequence identical or highly similar to the nucleotide sequence of VGAM503 precursor RNA is designated SEQ ID:489, and is provided hereinbelow with reference to the sequence listing part. Nucleotide sequence SEQ ID:489 is located at position 9956 relative to the genome of Molluscum Contagiosum Virus.

VGAM503 precursor RNA folds onto itself, forming VGAM503 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM503 folded precursor RNA into VGAM503 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM503 RNA is designated SEQ ID:3214, and is provided hereinbelow with reference to the sequence listing part.

VGAM503 host target gene, herein designated VGAM HOST TARGET GENE, encodes a corresponding messenger RNA, VGAM503 host target RNA, herein designated VGAM HOST TARGET RNA. VGAM503 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM503 RNA, herein designated VGAM RNA, binds complementarily to one or more host target binding sites located in untranslated regions of VGAM503 host target RNA, herein designated VGAM HOST TARGET RNA. This complementary binding is due to the fact that the nucleotide sequence of VGAM503 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM503 RNA, herein designated VGAM RNA, may have a different number of host target binding sites in untranslated regions of a VGAM503 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM503 RNA, herein designated VGAM RNA, to host target binding sites on VGAM503 host target RNA, herein designated VGAM HOST TARGET RNA, such as BINDING SITE I, BINDING SITE II and BINDING SITE III, inhibits translation of VGAM503 host target RNA into VGAM503 host target protein, herein designated VGAM HOST TARGET PROTEIN. VGAM host target protein is therefore outlined by a broken line.

It is appreciated that VGAM503 host target gene, herein designated VGAM HOST TARGET GENE, in fact represents a plurality of VGAM503 host target genes. The mRNA of each one of this plurality of VGAM503 host target genes comprises one or more host target binding sites, each having a nucleotide sequence which is at least partly complementary to VGAM503 RNA, herein designated VGAM RNA, and which when bound by VGAM503 RNA causes inhibition of translation of respective one or more VGAM503 host target proteins.

It is further appreciated by one skilled in the art that the mode of translational inhibition illustrated by FIG. 1 with specific reference to translational inhibition exerted by VGAM503 gene, herein designated VGAM GENE, on one or more VGAM503 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM503 is inhibition of expression of host target genes, as part of a novel viral mechanism of attacking a host. Accordingly, utilities of VGAM503 include diagnosis, prevention and treatment of viral infection by Molluscum Contagiosum Virus. Specific functions, and accordingly utilities, of VGAM503 correlate with, and may be deduced from, the identity of the host target genes which VGAM503 binds and inhibits, and the function of these host target genes, as elaborated hereinbelow.

Nucleotide sequences of the VGAM503 precursor RNA, herein designated VGAM PRECURSOR RNA, and of the 'diced' VGAM503 RNA, herein designated VGAM RNA, and a schematic representation of the secondary folding of VGAM503 folded precursor RNA, herein designated VGAM FOLDED PRECURSOR RNA, of VGAM503 are further described hereinbelow with reference to Table 1.

Nucleotide sequences of host target binding sites, such as BINDING SITE-I, BINDING SITE-II and BINDING SITE-III of FIG. 1, found on VGAM503 host target RNA, and a schematic representation of the complementarity of each of these host target binding sites to VGAM503 RNA, herein designated VGAM RNA, are described hereinbelow with reference to Table 2.

As mentioned hereinabove with reference to FIG. 1, a function of VGAM503 gene, herein designated VGAM is inhibition of expression of VGAM503 target genes. It is appreciated that specific functions, and accordingly utilities, of VGAM503 correlate with, and may be deduced from, the identity of the target genes which VGAM503 binds and inhibits, and the function of these target genes, as elaborated hereinbelow.

A Disintegrin-like and Metalloprotease (reprolysin type) with Thrombospondin Type 1 Motif, 1 (ADAMTS1, Accession NM_006988) is a VGAM503 host target gene. ADAMTS1 BINDING SITE is HOST TARGET binding site found in the 3' untranslated region of mRNA encoded by ADAMTS1, corresponding to a HOST TARGET binding site such as BINDING SITE I, BINDING SITE II or BINDING SITE III. Table 2 illustrates the complementarity of the nucleotide sequences of ADAMTS1 BINDING SITE, designated SEQ ID:13851, to the nucleotide sequence of VGAM503 RNA, herein designated VGAM RNA, also designated SEQ ID:3214.

A function of VGAM503 is therefore inhibition of A Disintegrin-like and Metalloprotease (reprolysin type) with Thrombospondin Type 1 Motif, 1 (ADAMTS1, Accession NM_006988). Accordingly, utilities of VGAM503 include diagnosis, prevention and treatment of diseases and clinical conditions associated with ADAMTS1. Frizzled Homolog 8 (Drosophila) (FZD8, Accession NM_031866) is another VGAM503 host target gene. FZD8 BINDING SITE is HOST TARGET binding site found in the 3' untranslated region of mRNA encoded by FZD8, corresponding to a HOST TARGET binding site such as BINDING SITE I, BINDING SITE II or BINDING SITE III. Table 2 illustrates the complementarity of the nucleotide sequences of FZD8 BINDING SITE, designated SEQ ID:25624, to the nucleotide sequence of VGAM503 RNA, herein designated VGAM RNA, also designated SEQ ID:3214.

Another function of VGAM503 is therefore inhibition of Frizzled Homolog 8 (Drosophila) (FZD8, Accession NM_031866), a gene which may be involved in transduction and intercellular transmission of polarity information during tissue morphogenesis and/or in differentiated tissues. Accordingly, utilities of VGAM503 include diagnosis, prevention and treatment of diseases and clinical conditions associated with FZD8. The function of FZD8 has been established by previous studies. Drosophila cuticle hairs are arranged in a defined polarity that is genetically controlled by 'frizzled,' a 7-transmembrane receptor with a large extracellular N-terminal cysteine-rich domain (CRD). Members of the FZD family are receptors for secreted WNT glycoproteins (see OMIM Ref. No. 602863), which are involved in developmental control. FZD proteins transmit signals through the beta-catenin (CTNNB1; 116806) or JNK (e.g., JNK3; 602897) pathways. The selection of intracellular signaling cascade may be determined by different C-terminal motifs in FZD proteins. By searching an EST database for sequences homologous to mouse Fzd8, followed by PCR, screening genomic DNA, brain cDNA, and fetal cDNA libraries, and RT-PCR on fetal kidney cDNA, Saitoh et al. (2001) isolated a cDNA encoding human FZD8. Sequence analysis predicted that the 694-amino acid protein, which is 69% identical to FZD5 (OMIM Ref. No. 601723) and 95% identical to mouse Fzd8, contains an N-terminal signal peptide, a CRD, 7 transmembrane domains, 3 N-linked glycosylation sites, and a C-terminal ser/thr-X-val motif, which is a binding site for scaffold proteins with multiple PDZ domains. Northern blot analysis revealed expression of a 4.0-kb FZD8 transcript that was most abundant in fetal kidney, followed by fetal brain and fetal lung. In adult tissue, FZD8 was expressed in kidney, heart, pancreas, and skeletal muscle. Based on its high degree of identity to the mouse sequence, Saitoh et al. (2001) predicted that FZD8 may also activate the CTNNB1-TCF signaling pathway, like mouse Fzd8.

Full details of the abovementioned studies are described in the following publications, the disclosure of which are hereby incorporated by reference:

Saitoh, T.; Hirai, M.; Katoh, M.: Molecular cloning and characterization of human Frizzled-8 gene on chromosome 10p11.2. Int. Oncol. 18: 991-996, 2001. 3. Wang, Y.; Macke, J. P.; Abella, B. S.; Andreasson, K.; Worley, P.; Gilbert, D. J.; Copeland, N. G.; Jenkins, N. A.; Nathans, J.: A large family of putative transmembrane receptors homologous to the product of the Drosophila tissue polarity gene frizzled. J. Biol. Chem. 271:4468-4476, 1996; and

CREATION DATE.

Further studies establishing the function and utilities of FZD8 are found in John Hopkins OMIM database record ID 606146, and in sited publications numbered 6601 listed in the bibliography section hereinbelow, which are also hereby incorporated by reference. Huntingtin (Huntington disease) (HD, Accession NM_002111) is another VGAM503 host target gene. HD BINDING SITE is HOST TARGET binding site found in the 3' untranslated region of mRNA encoded by HD, corresponding to a HOST TARGET binding site such as BINDING SITE I, BINDING SITE II or BINDING SITE III. Table 2 illustrates the complementarity of the nucleotide sequences of HD BINDING SITE, designated SEQ ID:7895, to the nucleotide sequence of VGAM503 RNA, herein designated VGAM RNA, also designated SEQ ID:3214.

Another function of VGAM503 is therefore inhibition of Huntingtin (Huntington disease) (HD, Accession NM_002111). Accordingly, utilities of VGAM503 include diagnosis, prevention and treatment of diseases and clinical conditions associated with HD. X-ray Repair Complementing Defective Repair In Chinese Hamster Cells 2 (XRCC2, Accession NM_005431) is another VGAM503 host target gene. XRCC2 BINDING SITE is HOST TARGET binding site found in the 3' untranslated region of mRNA encoded by XRCC2, corresponding to a HOST TARGET binding site such as BINDING SITE I, BINDING SITE II or BINDING SITE III. Table 2 illustrates the complementarity of the nucleotide sequences of XRCC2 BINDING SITE, designated SEQ ID:11903, to the nucleotide sequence of VGAM503 RNA, herein designated VGAM RNA, also designated SEQ ID:3214.

Another function of VGAM503 is therefore inhibition of X-ray Repair Complementing Defective Repair In Chinese Hamster Cells 2 (XRCC2, Accession NM_005431), a gene which involves in the homologous recombination repair (hrr) pathway of double-stranded dna. Accordingly, utilities of VGAM503 include diagnosis, prevention and treatment of diseases and clinical conditions associated with XRCC2. The function of XRCC2 and its association with various diseases and clinical conditions, has been established by previous studies, as described hereinabove with reference to VGAM241. Chromosome 20 Open Reading Frame 59 (C20orf59, Accession NM_022082) is another VGAM503 host target gene. C20orf59 BINDING SITE is HOST TARGET binding site found in the 3' untranslated region of mRNA encoded by C20orf59, corresponding to a HOST TARGET binding site such as BINDING SITE I, BINDING SITE II or BINDING SITE III. Table 2 illustrates the complementarity of the nucleotide sequences of C20orf59 BINDING SITE, designated SEQ ID:22626, to the nucleotide sequence of VGAM503 RNA, herein designated VGAM RNA, also designated SEQ ID:3214.

Another function of VGAM503 is therefore inhibition of Chromosome 20 Open Reading Frame 59 (C20orf59, Accession NM_022082). Accordingly, utilities of VGAM503 include diagnosis, prevention and treatment of diseases and clinical conditions associated with C20orf59. Tight Junction Protein 2 (zona occludens 2) (TJP2, Accession XM_005446) is another VGAM503 host target gene. TJP2 BINDING SITE is HOST TARGET binding site found in the 3' untranslated region of mRNA encoded by TJP2, corresponding to a HOST TARGET binding site such as BINDING SITE I, BINDING SITE II or BINDING SITE III. Table 2 illustrates the complementarity of the nucleotide sequences of TJP2 BINDING SITE, designated SEQ ID:29980, to the nucleotide sequence of VGAM503 RNA, herein designated VGAM RNA, also designated SEQ ID:3214.

Another function of VGAM503 is therefore inhibition of Tight Junction Protein 2 (zona occludens 2) (TJP2, Accession XM_005446). Accordingly, utilities of VGAM503 include diagnosis, prevention and treatment of diseases and clinical conditions associated with TJP2. FIG. 1 further provides a conceptual description of a novel bioinformatically detected viral gene of the present invention, referred to here as Viral Genomic Address Messenger 504 (VGAM504) viral gene, which modulates expression of respective host target genes thereof, the function and utility of which host target genes is known in the art.

VGAM504 is a novel bioinformatically detected regulatory, non protein coding, viral micro RNA (miRNA) gene. The method by which VGAM504 was detected is described hereinabove with reference to FIGS. 1-8.

VGAM504 gene, herein designated VGAM GENE, is a viral gene contained in the genome of Molluscum Contagiosum Virus. VGAM504 host target gene, herein designated VGAM HOST TARGET GENE, is a human gene contained in the human genome.

VGAM504 gene encodes a VGAM504 precursor RNA, herein designated VGAM PRECURSOR RNA. Similar to other miRNA genes, and unlike most ordinary genes, VGAM504 precursor RNA does not encode a protein. A nucleotide sequence identical or highly similar to the nucleotide sequence of VGAM504 precursor RNA is designated SEQ ID:490, and is provided hereinbelow with reference to the sequence listing part. Nucleotide sequence SEQ ID:490 is located at position 49770 relative to the genome of Molluscum Contagiosum Virus.

VGAM504 precursor RNA folds onto itself, forming VGAM504 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM504 folded precursor RNA into VGAM504 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM504 RNA is designated SEQ ID:3215, and is provided hereinbelow with reference to the sequence listing part.

VGAM504 host target gene, herein designated VGAM HOST TARGET GENE, encodes a corresponding messenger RNA, VGAM504 host target RNA, herein designated VGAM HOST TARGET RNA. VGAM504 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM504 RNA, herein designated VGAM RNA, binds complementarily to one or more host target binding sites located in untranslated regions of VGAM504 host target RNA, herein designated VGAM HOST TARGET RNA. This complementary binding is due to the fact that the nucleotide sequence of VGAM504 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM504 RNA, herein designated VGAM RNA, may have a different number of host target binding sites in untranslated regions of a VGAM504 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM504 RNA, herein designated VGAM RNA, to host target binding sites on VGAM504 host target RNA, herein designated VGAM HOST TARGET RNA, such as BINDING SITE I, BINDING SITE II and BINDING SITE III, inhibits translation of VGAM504 host target RNA into VGAM504 host target protein, herein designated VGAM HOST TARGET PROTEIN. VGAM host target protein is therefore outlined by a broken line.

It is appreciated that VGAM504 host target gene, herein designated VGAM HOST TARGET GENE, in fact represents a plurality of VGAM504 host target genes. The mRNA of each one of this plurality of VGAM504 host target genes comprises one or more host target binding sites, each having a nucleotide sequence which is at least partly complementary to VGAM504 RNA, herein designated VGAM RNA, and which when bound by VGAM504 RNA causes inhibition of translation of respective one or more VGAM504 host target proteins.

It is further appreciated by one skilled in the art that the mode of translational inhibition illustrated by FIG. 1 with specific reference to translational inhibition exerted by VGAM504 gene, herein designated VGAM GENE, on one or more VGAM504 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM504 is inhibition of expression of host target genes, as part of a novel viral mechanism of attacking a host. Accordingly, utilities of VGAM504 include diagnosis, prevention and treatment of viral infection by Molluscum Contagiosum Virus. Specific functions, and accordingly utilities, of VGAM504 correlate with, and may be deduced from, the identity of the host target genes which VGAM504 binds and inhibits, and the function of these host target genes, as elaborated hereinbelow.

Nucleotide sequences of the VGAM504 precursor RNA, herein designated VGAM PRECURSOR RNA, and of the 'diced' VGAM504 RNA, herein designated VGAM RNA, and a schematic representation of the secondary folding of VGAM504 folded precursor RNA, herein designated VGAM FOLDED PRECURSOR RNA, of VGAM504 are further described hereinbelow with reference to Table 1.

Nucleotide sequences of host target binding sites, such as BINDING SITE-I, BINDING SITE-II and BINDING SITE-III of FIG. 1, found on VGAM504 host target RNA, and schematic representation of the complementarity of each of these host target binding sites to VGAM504 RNA, herein designated VGAM RNA, are described hereinbelow with reference to Table 2.

As mentioned hereinabove with reference to FIG. 1, a function of VGAM504 gene, herein designated VGAM is inhibition of expression of VGAM504 target genes. It is appreciated that specific functions, and accordingly utilities, of VGAM504 correlate with, and may be deduced from, the identity of the target genes which VGAM504 binds and inhibits, and the function of these target genes, as elaborated hereinbelow.

Nuclear Factor of Activated T-cells, Cytoplasmic, Calcineurin-dependent 1 (NFATC1, Accession NM_006162) is a VGAM504 host target gene. NFATC1 BINDING SITE is HOST TARGET binding site found in the 3' untranslated region of mRNA encoded by NFATC1, corresponding to a HOST TARGET binding site such as BINDING SITE I, BINDING SITE II or BINDING SITE III. Table 2 illustrates the complementarity of the nucleotide sequences of NFATC1 BINDING SITE, designated SEQ ID:12816, to the nucleotide sequence of VGAM504 RNA, herein designated VGAM RNA, also designated SEQ ID:3215.

A function of VGAM504 is therefore inhibition of Nuclear Factor of Activated T-cells, Cytoplasmic, Calcineurin-dependent 1 (NFATC1, Accession NM_006162), a gene which regulates he activation, proliferation, differentiation and programmed death of ymphoid and nonlymphoid cells. Accordingly, utilities of VGAM504 include diagnosis, prevention and treatment of diseases and clinical conditions associated with NFATC1. The function of NFATC1 and its association with various diseases and clinical conditions, has been established by previous studies, as described hereinabove with reference to VGAM123. Transducin (beta)-like 2 (TBL2, Accession NM_032988) is another VGAM504 host target gene. TBL2 BINDING SITE is HOST TARGET binding site found in the 3' untranslated region of mRNA encoded by TBL2, corresponding to a HOST TARGET binding site such as BINDING SITE I, BINDING SITE II or BINDING SITE III. Table 2 illustrates the complementarity of the nucleotide sequences of TBL2 BINDING SITE, designated SEQ ID:26871, to the nucleotide sequence of VGAM504 RNA, herein designated VGAM RNA, also designated SEQ ID:3215.

Another function of VGAM504 is therefore inhibition of Transducin (beta)-like 2 (TBL2, Accession NM_032988), a gene which is of unknown function. Accordingly, utilities of VGAM504 include diagnosis, prevention and treatment of diseases and clinical conditions associated with TBL2. The function of TBL2 and its association with various diseases and clinical conditions, has been established by previous studies, as described hereinabove with reference to VGAM229. DKFZp586I021 (Accession NM_032271) is another VGAM504 host target gene. DKFZp586I021 BINDING SITE is HOST TARGET binding site found in the 3' untranslated region of mRNA encoded by DKFZp586I021, corresponding to a HOST TARGET binding site such as BINDING SITE I, BINDING SITE II or BINDING SITE III. Table 2 illustrates the complementarity of the nucleotide sequences of DKFZp586I021 BINDING SITE, designated SEQ ID:26022, to the nucleotide sequence of VGAM504 RNA, herein designated VGAM RNA, also designated SEQ ID:3215.

Another function of VGAM504 is therefore inhibition of DKFZp586I021 (Accession NM_032271). Accordingly, utilities of VGAM504 include diagnosis, prevention and treatment of diseases and clinical conditions associated with DKFZp586I021. FLJ22362 (Accession NM_022823) is another VGAM504 host target gene. FLJ22362 BINDING SITE is HOST TARGET binding site found in the 5' untranslated region of mRNA encoded by FLJ22362, corresponding to a HOST TARGET binding site such as BINDING SITE I, BINDING SITE II or BINDING SITE III. Table 2 illustrates the complementarity of the nucleotide sequences of FLJ22362 BINDING SITE, designated SEQ ID:23104, to the nucleotide sequence of VGAM504 RNA, herein designated VGAM RNA, also designated SEQ ID:3215.

Another function of VGAM504 is therefore inhibition of FLJ22362 (Accession NM_022823). Accordingly, utilities of VGAM504 include diagnosis, prevention and treatment of diseases and clinical conditions associated with FLJ22362. JM11 (Accession NM_033626) is another VGAM504 host target gene. JM11 BINDING SITE1 and JM11 BINDING SITE2 are HOST TARGET binding sites found in untranslated regions of mRNA encoded by JM11, corresponding to HOST TARGET binding sites such as BINDING SITE I, BINDING SITE II or BINDING SITE III. Table 2 illustrates the complementarity of the nucleotide sequences of JM11 BINDING SITE1 and JM11 BINDING SITE2, designated SEQ ID:27328 and SEQ ID:27329 respectively, to the nucleotide sequence of VGAM504 RNA, herein designated VGAM RNA, also designated SEQ ID:3215.

Another function of VGAM504 is therefore inhibition of JM11 (Accession NM_033626). Accordingly, utilities of VGAM504 include diagnosis, prevention and treatment of diseases and clinical conditions associated with JM11. LOC96597 (Accession XM_039922) is another VGAM504 host target gene. LOC96597 BINDING SITE is HOST TARGET binding site found in the 5' untranslated region of mRNA encoded by LOC96597, corresponding to a HOST TARGET binding site such as BINDING SITE I, BINDING SITE II or BINDING SITE III. Table 2 illustrates the complementarity of the nucleotide sequences of LOC96597 BINDING SITE, designated SEQ ID:33230, to the nucleotide sequence of VGAM504 RNA, herein designated VGAM RNA, also designated SEQ ID:3215.

Another function of VGAM504 is therefore inhibition of LOC96597 (Accession XM_039922). Accordingly, utilities of VGAM504 include diagnosis, prevention and treatment of diseases and clinical conditions associated with LOC96597. FIG. 1 further provides a conceptual description of a novel bioinformatically detected viral gene of the present invention, referred to here as Viral Genomic Address Messenger 505 (VGAM505) viral gene, which modulates expression of respective host target genes thereof, the function and utility of which host target genes is known in the art.

VGAM505 is a novel bioinformatically detected regulatory, non protein coding, viral micro RNA (miRNA) gene. The method by which VGAM505 was detected is described hereinabove with reference to FIGS. 1-8.

VGAM505 gene, herein designated VGAM GENE, is a viral gene contained in the genome of Molluscum Contagiosum Virus. VGAM505 host target gene, herein designated VGAM HOST TARGET GENE, is a human gene contained in the human genome.

VGAM505 gene encodes a VGAM505 precursor RNA, herein designated VGAM PRECURSOR RNA. Similar to other miRNA genes, and unlike most ordinary genes, VGAM505 precursor RNA does not encode a protein. A nucleotide sequence identical or highly similar to the nucleotide sequence of VGAM505 precursor RNA is designated SEQ ID:491, and is provided hereinbelow with reference to the sequence listing part. Nucleotide sequence SEQ ID:491 is located at position 106639 relative to the genome of Molluscum Contagiosum Virus.

VGAM505 precursor RNA folds onto itself, forming VGAM505 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM505 folded precursor RNA into VGAM505 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM505 RNA is designated SEQ ID:3216, and is provided hereinbelow with reference to the sequence listing part.

VGAM505 host target gene, herein designated VGAM HOST TARGET GENE, encodes a corresponding messenger RNA, VGAM505 host target RNA, herein designated VGAM HOST TARGET RNA. VGAM505 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM505 RNA, herein designated VGAM RNA, binds complementarily to one or more host target binding sites located in untranslated regions of VGAM505 host target RNA, herein designated VGAM HOST TARGET RNA. This complementary binding is due to the fact that the nucleotide sequence of VGAM505 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM505 RNA, herein designated VGAM RNA, may have a different number of host target binding sites in untranslated regions of a VGAM505 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM505 RNA, herein designated VGAM RNA, to host target binding sites on VGAM505 host target RNA, herein designated VGAM HOST TARGET RNA, such as BINDING SITE I, BINDING SITE II and BINDING SITE III, inhibits translation of VGAM505 host target RNA into VGAM505 host target protein, herein designated VGAM HOST TARGET PROTEIN. VGAM host target protein is therefore outlined by a broken line.

It is appreciated that VGAM505 host target gene, herein designated VGAM HOST TARGET GENE, in fact represents a plurality of VGAM505 host target genes. The mRNA of each one of this plurality of VGAM505 host target genes comprises one or more host target binding sites, each having a nucleotide sequence which is at least partly complementary to VGAM505 RNA, herein designated VGAM RNA, and which when bound by VGAM505 RNA causes inhibition of translation of respective one or more VGAM505 host target proteins.

It is further appreciated by one skilled in the art that the mode of translational inhibition illustrated by FIG. 1 with specific reference to translational inhibition exerted by VGAM505 gene, herein designated VGAM GENE, on one or more VGAM505 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM505 is inhibition of expression of host target genes, as part of a novel viral mechanism of attacking a host. Accordingly, utilities of VGAM505 include diagnosis, prevention and treatment of viral infection by Molluscum Contagiosum Virus. Specific functions, and accordingly utilities, of VGAM505 correlate with, and may be deduced from, the identity of the host target genes which VGAM505 binds and inhibits, and the function of these host target genes, as elaborated hereinbelow.

Nucleotide sequences of the VGAM505 precursor RNA, herein designated VGAM PRECURSOR RNA, and of the 'diced' VGAM505 RNA, herein designated VGAM RNA, and a schematic representation of the secondary folding of VGAM505 folded precursor RNA, herein designated VGAM FOLDED PRECURSOR RNA, of VGAM505 are further described hereinbelow with reference to Table 1.

Nucleotide sequences of host target binding sites, such as BINDING SITE-I, BINDING SITE-II and BINDING SITE-III of FIG. 1, found on VGAM505 host target RNA, and schematic representation of the complementarity of each of these host target binding sites to VGAM505 RNA, herein designated VGAM RNA, are described hereinbelow with reference to Table 2.

As mentioned hereinabove with reference to FIG. 1, a function of VGAM505 gene, herein designated VGAM is inhibition of expression of VGAM505 target genes. It is appreciated that specific functions, and accordingly utilities, of VGAM505 correlate with, and may be deduced from, the identity of the target genes which VGAM505 binds and inhibits, and the function of these target genes, as elaborated hereinbelow.

ATP-binding Cassette, Sub-family C (CFTR/MRP), Member 3 (ABCC3, Accession NM_020038) is a VGAM505 host target gene. ABCC3 BINDING SITE is HOST TARGET binding site found in the 3' untranslated region of mRNA encoded by ABCC3, corresponding to a HOST TARGET binding site such as BINDING SITE I, BINDING SITE II or BINDING SITE III. Table 2 illustrates the complementarity of the nucleotide sequences of ABCC3 BINDING SITE, designated SEQ ID:21295, to the nucleotide sequence of VGAM505 RNA, herein designated VGAM RNA, also designated SEQ ID:3216.

A function of VGAM505 is therefore inhibition of ATP-binding Cassette, Sub-family C (CFTR/MRP), Member 3 (ABCC3, Accession NM_020038), a gene which may act as an inducible transporter in the biliary and intestinal excretion of organic anions. Accordingly, utilities of VGAM505 include diagnosis, prevention and treatment of diseases and clinical conditions associated with ABCC3. The function of ABCC3 has been established by previous studies. Bile secretion in liver is driven in large part by ATP-binding cassette (ABC)-type proteins that reside in the canalicular membrane and effect ATP-dependent transport of bile acids, phospholipids, and non-bile acid organic anions. Canalicular ABC-type proteins can be classified into 2 subfamilies based on membrane topology and sequence identity: MDR1 (multi-drug resistance-1; 171050), MDR3 (multidrug resistance-3; 171060), and SPGP (bile salt export pump, or sister of P-glycoprotein; 603201) resemble the multidrug resistance P-glycoprotein, whereas MRP2 (OMIM Ref. No. 601107) is similar in structure and sequence to the multidrug resistance protein MRP1 (OMIM Ref. No. 158343) and transports similar substrates. Kool et al. (1999) detected expression of ABCC3 in the lateral side of cholangiocytes and in the basolateral membranes of hepatocytes, where it mediates transport of S-glutathione. When expressed in ovarian carcinoma cells, ABCC3 conferred resistance to the anticancer drugs methotrexate, etoposide, and teniposide. The authors noted that sequence analysis of ABCC3 predicts a protein organized in a way similar to ABCC1 and ABCC2. Using FISH, Uchiumi et al. (1998) mapped the ABCC3 gene to 17q22.

Full details of the abovementioned studies are described in the following publications, the disclosure of which are hereby incorporated by reference:

Kool, M.; van der Linden, M.; de Haas, M.; Scheffer, G. L.; de Vree, J. M. L.; Smith, A. J.; Jansen, G.; Peters, G. J.; Ponne, N.; Scheper, R. J.; Oude Elferink, R. P. J.; Baas, F.; Borst, P.: MRP3, an organic anion transporter able to transport anticancer drugs. Proc. Nat. Acad. Sci. 96:6914-6919, 1999. ; and Uchiumi, T.; Hinoshita, E.; Haga, S.; Nakamura, T.; Tanaka, T.; Toh, S.; Furukawa, M.; Kawabe, T.; Wada, M.; Kagotani, K.; Okumura, K.; Kohno, K.; Akiyama, S.; Kuwano, M.: Isolation of.

Further studies establishing the function and utilities of ABCC3 are found in John Hopkins OMIM database record ID 604323, and in sited publications numbered 5013-501 and 7467 listed in the bibliography section hereinbelow, which are also hereby incorporated by reference. SH3-domain Binding Protein 4 (SH3BP4, Accession NM_014521) is another VGAM505 host target gene. SH3BP4 BINDING SITE is HOST TARGET binding site found in the 5' untranslated region of mRNA encoded by SH3BP4, corresponding to a HOST TARGET binding site such as BINDING SITE I, BINDING SITE II or BINDING SITE III. Table 2 illustrates the complementarity of the nucleotide sequences of SH3BP4 BINDING SITE, designated SEQ ID:15856, to the nucleotide sequence of VGAM505 RNA, herein designated VGAM RNA, also designated SEQ ID:3216.

Another function of VGAM505 is therefore inhibition of SH3-domain Binding Protein 4 (SH3BP4, Accession NM_014521), a gene which is of unknown function, contains SH3-domain binding protein 4; similar to the EH-binding protein. Accordingly, utilities of VGAM505 include diagnosis, prevention and treatment of diseases and clinical conditions associated with SH3BP4. The function of SH3BP4 and its association with various diseases and clinical conditions, has been established by previous studies, as described hereinabove with reference to VGAM179. Cofactor Required For Sp1 Transcriptional Activation, Subunit 3, 130 kDa (CRSP3, Accession XM_027112) is another VGAM505 host target gene. CRSP3 BINDING SITE is HOST TARGET binding site found in the 3' untranslated region of mRNA encoded by CRSP3, corresponding to a HOST TARGET binding site such as BINDING SITE I, BINDING SITE II or BINDING SITE III. Table 2 illustrates the complementarity of the nucleotide sequences of CRSP3 BINDING SITE, designated SEQ ID:30413, to the nucleotide sequence of VGAM505 RNA, herein designated VGAM RNA, also designated SEQ ID:3216.

Another function of VGAM505 is therefore inhibition of Cofactor Required For Sp1 Transcriptional Activation, Subunit 3, 130 kDa (CRSP3, Accession XM_027112). Accordingly, utilities of VGAM505 include diagnosis, prevention and treatment of diseases and clinical conditions associated with CRSP3. Ecotropic Viral Integration Site 5 (EVI5, Accession NM_005665) is another VGAM505 host target gene. EVI5 BINDING SITE is HOST TARGET binding site found in the 3' untranslated region of mRNA encoded by EVI5, corresponding to a HOST TARGET binding site such as BINDING SITE I, BINDING SITE II or BINDING SITE III. Table 2 illustrates the complementarity of the nucleotide sequences of EVI5 BINDING SITE, designated SEQ ID:12211, to the nucleotide sequence of VGAM505 RNA, herein designated VGAM RNA, also designated SEQ ID:3216.

Another function of VGAM505 is therefore inhibition of Ecotropic Viral Integration Site 5 (EVI5, Accession NM_005665). Accordingly, utilities of VGAM505 include diagnosis, prevention and treatment of diseases and clinical conditions associated with EVI5. FLJ14888 (Accession NM_032856) is another VGAM505 host target gene. FLJ14888 BINDING SITE is HOST TARGET binding site found in the 3' untranslated region of mRNA encoded by FLJ14888, corresponding to a HOST TARGET binding site such as BINDING SITE I, BINDING SITE II or BINDING SITE III. Table 2 illustrates the complementarity of the nucleotide sequences of FLJ14888 BINDING SITE, designated SEQ ID:26657, to the nucleotide sequence of VGAM505 RNA, herein designated VGAM RNA, also designated SEQ ID:3216.

Another function of VGAM505 is therefore inhibition of FLJ14888 (Accession NM_032856). Accordingly, utilities of VGAM505 include diagnosis, prevention and treatment of diseases and clinical conditions associated with FLJ14888. KIAA1058 (Accession XM_090586) is another VGAM505 host target gene. KIAA1058 BINDING SITE is HOST TARGET binding site found in the 3' untranslated region of mRNA encoded by KIAA1058, corresponding to a HOST TARGET binding site such as BINDING SITE I, BINDING SITE II or BINDING SITE III. Table 2 illustrates the complementarity of the nucleotide sequences of KIAA1058 BINDING SITE, designated SEQ ID:40013, to the nucleotide sequence of VGAM505 RNA, herein designated VGAM RNA, also designated SEQ ID:3216.

Another function of VGAM505 is therefore inhibition of KIAA1058 (Accession XM_090586). Accordingly, utilities of VGAM505 include diagnosis, prevention and treatment of diseases and clinical conditions associated with KIAA1058. NBR2 (Accession NM_005821) is another VGAM505 host target gene. NBR2 BINDING SITE is HOST TARGET binding site found in the 5' untranslated region of mRNA encoded by NBR2, corresponding to a HOST TARGET binding site such as BINDING SITE I, BINDING SITE II or BINDING SITE III. Table 2 illustrates the complementarity of the nucleotide sequences of NBR2 BINDING SITE, designated SEQ ID:12425, to the nucleotide sequence of VGAM505 RNA, herein designated VGAM RNA, also designated SEQ ID:3216.

Another function of VGAM505 is therefore inhibition of NBR2 (Accession NM_005821). Accordingly, utilities of VGAM505 include diagnosis, prevention and treatment of diseases and clinical conditions associated with NBR2. PIP3-E (Accession XM_039749) is another VGAM505 host target gene. PIP3-E BINDING SITE is HOST TARGET binding site found in the 3' untranslated region of mRNA encoded by PIP3-E, corresponding to a HOST TARGET binding site such as BINDING SITE I, BINDING SITE II or BINDING SITE III. Table 2 illustrates the complementarity of the nucleotide sequences of PIP3-E BINDING SITE, designated SEQ ID:33174, to the nucleotide sequence of VGAM505 RNA, herein designated VGAM RNA, also designated SEQ ID:3216.

Another function of VGAM505 is therefore inhibition of PIP3-E (Accession XM_039749). Accordingly, utilities of VGAM505 include diagnosis, prevention and treatment of diseases and clinical conditions associated with PIP3-E. LOC158969 (Accession XM_088728) is another VGAM505 host target gene. LOC158969 BINDING SITE is HOST TARGET binding site found in the 5' untranslated region of mRNA encoded by LOC158969, corresponding to a HOST TARGET binding site such as BINDING SITE I, BINDING SITE II or BINDING SITE III. Table 2 illustrates the complementarity of the nucleotide sequences of LOC158969 BINDING SITE, designated SEQ ID:39923, to the nucleotide sequence of VGAM505 RNA, herein designated VGAM RNA, also designated SEQ ID:3216.

Another function of VGAM505 is therefore inhibition of LOC158969 (Accession XM_088728). Accordingly, utilities of VGAM505 include diagnosis, prevention and treatment of diseases and clinical conditions associated with LOC158969. LOC196510 (Accession XM_113738) is another VGAM505 host target gene. LOC196510 BINDING SITE is HOST TARGET binding site found in the 3' untranslated region of mRNA encoded by LOC196510, corresponding to a HOST TARGET binding site such as BINDING SITE I, BINDING SITE II or BINDING SITE III. Table 2 illustrates the complementarity of the nucleotide sequences of LOC196510 BINDING SITE, designated SEQ ID:42396, to the nucleotide sequence of VGAM505 RNA, herein designated VGAM RNA, also designated SEQ ID:3216.

Another function of VGAM505 is therefore inhibition of LOC196510 (Accession XM_113738). Accordingly, utilities of VGAM505 include diagnosis, prevention and treatment of diseases and clinical conditions associated with LOC196510. LOC199986 (Accession XM_117168) is another VGAM505 host target gene. LOC199986 BINDING SITE is HOST TARGET binding site found in the 3' untranslated region of mRNA encoded by LOC199986, corresponding to a HOST TARGET binding site such as BINDING SITE I, BINDING SITE II or BINDING SITE III. Table 2 illustrates the complementarity of the nucleotide sequences of LOC199986 BINDING SITE, designated SEQ ID:43272, to the nucleotide sequence of VGAM505 RNA, herein designated VGAM RNA, also designated SEQ ID:3216.

Another function of VGAM505 is therefore inhibition of LOC199986 (Accession XM_117168). Accordingly, utilities of VGAM505 include diagnosis, prevention and treatment of diseases and clinical conditions associated with LOC199986. LOC200220 (Accession XM_114157) is another VGAM505 host target gene. LOC200220 BINDING SITE is HOST TARGET binding site found in the 3' untranslated region of mRNA encoded by LOC200220, corresponding to a HOST TARGET binding site such as BINDING SITE I, BINDING SITE II or BINDING SITE III. Table 2 illustrates the complementarity of the nucleotide sequences of LOC200220 BINDING SITE, designated SEQ ID:42745, to the nucleotide sequence of VGAM505 RNA, herein designated VGAM RNA, also designated SEQ ID:3216.

Another function of VGAM505 is therefore inhibition of LOC200220 (Accession XM_114157). Accordingly, utilities of VGAM505 include diagnosis, prevention and treatment of diseases and clinical conditions associated with LOC200220. FIG. 1 further provides a conceptual description of a novel bioinformatically detected viral gene of the present invention, referred to here as Viral Genomic Address Messenger 506 (VGAM506) viral gene, which modulates expression of respective host target genes thereof, the function and utility of which host target genes is known in the art.

VGAM506 is a novel bioinformatically detected regulatory, non protein coding, viral micro RNA (miRNA) gene. The method by which VGAM506 was detected is described hereinabove with reference to FIGS. 1-8.

VGAM506 gene, herein designated VGAM GENE, is a viral gene contained in the genome of Saguaro Cactus Virus. VGAM506 host target gene, herein designated VGAM HOST TARGET GENE, is a human gene contained in the human genome.

VGAM506 gene encodes a VGAM506 precursor RNA, herein designated VGAM PRECURSOR RNA. Similar to other miRNA genes, and unlike most ordinary genes, VGAM506 precursor RNA does not encode a protein. A nucleotide sequence identical or highly similar to the nucleotide sequence of VGAM506 precursor RNA is designated SEQ ID:492, and is provided hereinbelow with reference to the sequence listing part. Nucleotide sequence SEQ ID:492 is located at position 1711 relative to the genome of Saguaro Cactus Virus.

VGAM506 precursor RNA folds onto itself, forming VGAM506 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM506 folded precursor RNA into VGAM506 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM506 RNA is designated SEQ ID:3217, and is provided hereinbelow with reference to the sequence listing part.

VGAM506 host target gene, herein designated VGAM HOST TARGET GENE, encodes a corresponding messenger RNA, VGAM506 host target RNA, herein designated VGAM HOST TARGET RNA. VGAM506 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM506 RNA, herein designated VGAM RNA, binds complementarily to one or more host target binding sites located in untranslated regions of VGAM506 host target RNA, herein designated VGAM HOST TARGET RNA. This complementary binding is due to the fact that the nucleotide sequence of VGAM506 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM506 RNA, herein designated VGAM RNA, may have a different number of host target binding sites in untranslated regions of a VGAM506 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM506 RNA, herein designated VGAM RNA, to host target binding sites on VGAM506 host target RNA, herein designated VGAM HOST TARGET RNA, such as BINDING SITE I, BINDING SITE II and BINDING SITE III, inhibits translation of VGAM506 host target RNA into VGAM506 host target protein, herein designated VGAM HOST TARGET PROTEIN. VGAM host target protein is therefore outlined by a broken line.

It is appreciated that VGAM506 host target gene, herein designated VGAM HOST TARGET GENE, in fact represents a plurality of VGAM506 host target genes. The mRNA of each one of this plurality of VGAM506 host target genes comprises one or more host target binding sites, each having a nucleotide sequence which is at least partly complementary to VGAM506 RNA, herein designated VGAM RNA, and which when bound by VGAM506 RNA causes inhibition of translation of respective one or more VGAM506 host target proteins.

It is further appreciated by one skilled in the art that the mode of translational inhibition illustrated by FIG. 1 with specific reference to translational inhibition exerted by VGAM506 gene, herein designated VGAM GENE, on one or more VGAM506 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM506 is inhibition of expression of host target genes, as part of a novel viral mechanism of attacking a host. Accordingly, utilities of VGAM506 include diagnosis, prevention and treatment of viral infection by Saguaro Cactus Virus. Specific functions, and accordingly utilities, of VGAM506 correlate with, and may be deduced from, the identity of the host target genes which VGAM506 binds and inhibits, and the function of these host target genes, as elaborated hereinbelow.

Nucleotide sequences of the VGAM506 precursor RNA, herein designated VGAM PRECURSOR RNA, and of the 'diced' VGAM506 RNA, herein designated VGAM RNA, and a schematic representation of the secondary folding of VGAM506 folded precursor RNA, herein designated VGAM FOLDED PRECURSOR RNA, of VGAM506 are further described hereinbelow with reference to Table 1.

Nucleotide sequences of host target binding sites, such as BINDING SITE-I, BINDING SITE-II and BINDING SITE-III of FIG. 1, found on VGAM506 host target RNA, and schematic representation of the complementarity of each of these host target binding sites to VGAM506 RNA, herein designated VGAM RNA, are described hereinbelow with reference to Table 2.

As mentioned hereinabove with reference to FIG. 1, a function of VGAM506 gene, herein designated VGAM is inhibition of expression of VGAM506 target genes. It is appreciated that specific functions, and accordingly utilities, of VGAM506 correlate with, and may be deduced from, the identity of the target genes which VGAM506 binds and inhibits, and the function of these target genes, as elaborated hereinbelow.

ADP-ribosyltransferase (NAD+; poly (ADP-ribose) Polymerase) (ADPRT, Accession NM_001618) is a VGAM506 host target gene. ADPRT BINDING SITE is HOST TARGET binding site found in the 3' untranslated region of mRNA encoded by ADPRT, corresponding to a HOST TARGET binding site such as BINDING SITE I, BINDING SITE II or BINDING SITE III. Table 2 illustrates the complementarity of the nucleotide sequences of ADPRT BINDING SITE, designated SEQ ID:7323, to the nucleotide sequence of VGAM506 RNA, herein designated VGAM RNA, also designated SEQ ID:3217.

A function of VGAM506 is therefore inhibition of ADP-ribosyltransferase (NAD+; poly (ADP-ribose) Polymerase) (ADPRT, Accession NM_001618), a gene which catalyzes addition of mono-ADP-ribose to arginine residues of proteins, inhibits Pol II transcription. Accordingly, utilities of VGAM506 include diagnosis, prevention and treatment of diseases and clinical conditions associated with ADPRT. The function of ADPRT has been established by previous studies. The chromatin-associated enzyme poly (ADP-ribose) polymerase (ADPRT; EC 2.4.2.30) is a 116-kD protein that uses NAD as substrate to catalyze both the covalent transfer of ADP-ribose to a variety of nuclear protein acceptors and subsequently the transfer of an additional 60 to 80 ADP-ribose units to the initial moiety. Nuclear proteins that become predominantly poly (ADP-ribosyl)ated include nucleosomal core histones, histone H1 (see OMIM Ref. No. 142711), HMG proteins (see OMIM Ref. No. 163910), and topoisomerases I (OMIM Ref. No. 126420) and II (see OMIM Ref. No. 126430). ADP ribosyltransferase is required for cellular repair. Inhibitors of this enzyme potentiate the lethal effects of noxious agents. During repair, NAD(+) is consumed and the NAD(+) content of the cell decreases. Concomitantly, nuclear proteins are ADP-ribosylated. The enzyme is induced by single-strand breaks in DNA which serve as cosubstrate for the reaction. Yu et al. (2002) demonstrated that PARP1 activation is required for translocation of apoptosis-inducing factor (AIF; 300169) from the mitochondria to the nucleus and that AIF is necessary for PARP1-dependent cell death. N-methyl-N-prime-nitro-N-nitrosoguanidine, hydrogen peroxide, and NMDA induce AIF translocation and cell death, which is prevented by PARP inhibitors or genetic knockout of PARP1, but is caspase independent. Microinjection of an antibody to AIF protects against PARP1-dependent cytotoxicity. Yu et al. (2002) concluded that their data support a model in which PARP1 activation signals AIF release from mitochondria, resulting in a caspase-independent pathway of programmed cell death. Animal model experiments lend further support to the function of ADPRT. Pieper et al. (1999) demonstrated DNA damage and a major activation of PARP in pancreatic islets of STZ-treated mice. These mice displayed a 5-fold increase in blood glucose and major pancreatic islet damage.

It is appreciated that the abovementioned animal model for ADPRT is acknowledged by those skilled in the art as a scientifically valid animal model, as can be further appreciated from the publications sited hereinbelow.

Full details of the abovementioned studies are described in the following publications, the disclosure of which are hereby incorporated by reference:

Yu, S.-W.; Wang, H.; Poitras, M. F.; Coombs, C.; Bowers, W. J.; Federoff, H. J.; Poirier, G. G.; Dawson, T. M.; Dawson, V. L.: Mediation of poly (ADP-ribose) polymerase-1-dependent cell death by apoptosis-inducing factor. Science 297: 259-263, 2002; and Pieper, A. A.; Brat, D. J.; Krug, D. K.; Watkins, C. C.; Gupta, A.; Blackshaw, S.; Verma, A.; Wang, Z.-Q.; Snyder, S. H.: Poly (ADP-ribose) polymerase-deficient mice are protected from.

Further studies establishing the function and utilities of ADPRT are found in John Hopkins OMIM database record ID 173870, and in sited publications numbered 1772-1774, 1778-1777, 1779-1791, 2124, 420 and 10258-10261 listed in the bibliography section hereinbelow, which are also hereby incorporated by reference. Fibrinogen, A Alpha Polypeptide (FGA, Accession NM_000508) is another VGAM506 host target gene. FGA BINDING SITE is HOST TARGET binding site found in the 3' untranslated region of mRNA encoded by FGA, corresponding to a HOST TARGET binding site such as BINDING SITE I, BINDING SITE II or BINDING SITE III. Table 2 illustrates the complementarity of the nucleotide sequences of FGA BINDING SITE, designated SEQ ID:6120, to the nucleotide sequence of VGAM506 RNA, herein designated VGAM RNA, also designated SEQ ID:3217.

Another function of VGAM506 is therefore inhibition of Fibrinogen, A Alpha Polypeptide (FGA, Accession NM_000508). Accordingly, utilities of VGAM506 include diagnosis, prevention and treatment of diseases and clinical conditions associated with FGA. KIAA0993 (Accession XM_034413) is another VGAM506 host target gene. KIAA0993 BINDING SITE is HOST TARGET binding site found in the 3' untranslated region of mRNA encoded by KIAA0993, corresponding to a HOST TARGET binding site such as BINDING SITE I, BINDING SITE II or BINDING SITE III. Table 2 illustrates the complementarity of the nucleotide sequences of KIAA0993 BINDING SITE, designated SEQ ID:32079, to the nucleotide sequence of VGAM506 RNA, herein designated VGAM RNA, also designated SEQ ID:3217.

Another function of VGAM506 is therefore inhibition of KIAA0993 (Accession XM_034413). Accordingly, utilities of VGAM506 include diagnosis, prevention and treatment of diseases and clinical conditions associated with KIAA0993.

FIG. 1 further provides a conceptual description of a novel bioinformatically detected viral gene of the present invention, referred to here as Viral Genomic Address Messenger 507 (VGAM507) viral gene, which modulates expression of respective host target genes thereof, the function and utility of which host target genes is known in the art.

VGAM507 is a novel bioinformatically detected regulatory, non protein coding, viral micro RNA (miRNA) gene. The method by which VGAM507 was detected is described hereinabove with reference to FIGS. 1-8.

VGAM507 gene, herein designated VGAM GENE, is a viral gene contained in the genome of Saguaro Cactus Virus. VGAM507 host target gene, herein designated VGAM HOST TARGET GENE, is a human gene contained in the human genome.

VGAM507 gene encodes a VGAM507 precursor RNA, herein designated VGAM PRECURSOR RNA. Similar to other miRNA genes, and unlike most ordinary genes, VGAM507 precursor RNA does not encode a protein. A nucleotide sequence identical or highly similar to the nucleotide sequence of VGAM507 precursor RNA is designated SEQ ID:493, and is provided hereinbelow with reference to the sequence listing part. Nucleotide sequence SEQ ID:493 is located at position 2130 relative to the genome of Saguaro Cactus Virus.

VGAM507 precursor RNA folds onto itself, forming VGAM507 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM507 folded precursor RNA into VGAM507 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 41%) nucleotide sequence of VGAM507 RNA is designated SEQ ID:3218, and is provided hereinbelow with reference to the sequence listing part.

VGAM507 host target gene, herein designated VGAM HOST TARGET GENE, encodes a corresponding messenger RNA, VGAM507 host target RNA, herein designated VGAM HOST TARGET RNA. VGAM507 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM507 RNA, herein designated VGAM RNA, binds complementarily to one or more host target binding sites located in untranslated regions of VGAM507 host target RNA, herein designated VGAM HOST TARGET RNA. This complementary binding is due to the fact that the nucleotide sequence of VGAM507 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM507 RNA, herein designated VGAM RNA, may have a different number of host target binding sites in untranslated regions of a VGAM507 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM507 RNA, herein designated VGAM RNA, to host target binding sites on VGAM507 host target RNA, herein designated VGAM HOST TARGET RNA, such as BINDING SITE I, BINDING SITE II and BINDING SITE III, inhibits translation of VGAM507 host target RNA into VGAM507 host target protein, herein designated VGAM HOST TARGET PROTEIN. VGAM host target protein is therefore outlined by a broken line.

It is appreciated that VGAM507 host target gene, herein designated VGAM HOST TARGET GENE, in fact represents a plurality of VGAM507 host target genes. The mRNA of each one of this plurality of VGAM507 host target genes comprises one or more host target binding sites, each having a nucleotide sequence which is at least partly complementary to VGAM507 RNA, herein designated VGAM RNA, and which when bound by VGAM507 RNA causes inhibition of translation of respective one or more VGAM507 host target proteins.

It is further appreciated by one skilled in the art that the mode of translational inhibition illustrated by FIG. 1 with specific reference to translational inhibition exerted by VGAM507 gene, herein designated VGAM GENE, on one or more VGAM507 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM507 is inhibition of expression of host target genes, as part of a novel viral mechanism of attacking a host. Accordingly, utilities of VGAM507 include diagnosis, prevention and treatment of viral infection by Saguaro Cactus Virus. Specific functions, and accordingly utilities, of VGAM507 correlate with, and may be deduced from, the identity of the host target genes which VGAM507 binds and inhibits, and the function of these host target genes, as elaborated hereinbelow.

Nucleotide sequences of the VGAM507 precursor RNA, herein designated VGAM PRECURSOR RNA, and of the 'diced' VGAM507 RNA, herein designated VGAM RNA, and a schematic representation of the secondary folding of VGAM507 folded precursor RNA, herein designated VGAM FOLDED PRECURSOR RNA, of VGAM507 are further described hereinbelow with reference to Table 1.

Nucleotide sequences of host target binding sites, such as BINDING SITE-I, BINDING SITE-II and BINDING SITE-III of FIG. 1, found on VGAM507 host target RNA, and schematic representation of the complementarity of each of these host target binding sites to VGAM507 RNA, herein designated VGAM RNA, are described hereinbelow with reference to Table 2.

As mentioned hereinabove with reference to FIG. 1, a function of VGAM507 gene, herein designated VGAM is inhibition of expression of VGAM507 target genes. It is appreciated that specific functions, and accordingly utilities, of VGAM507 correlate with, and may be deduced from, the identity of the target genes which VGAM507 binds and inhibits, and the function of these target genes, as elaborated hereinbelow.

Chromosome 20 Open Reading Frame 126 (C20orf126, Accession NM_030815) is a VGAM507 host target gene. C20orf126 BINDING SITE is HOST TARGET binding site found in the 3' untranslated region of mRNA encoded by C20orf126, corresponding to a HOST TARGET binding site such as BINDING SITE I, BINDING SITE II or BINDING SITE III. Table 2 illustrates the complementarity of the nucleotide sequences of C20orf126 BINDING SITE, designated SEQ ID:25133, to the nucleotide sequence of VGAM507 RNA, herein designated VGAM RNA, also designated SEQ ID:3218.

A function of VGAM507 is therefore inhibition of Chromosome 20 Open Reading Frame 126 (C20orf126, Accession NM_030815). Accordingly, utilities of VGAM507 include diagnosis, prevention and treatment of diseases and clinical conditions associated with C20orf126. Phosphatidylinositol-4-phosphate 5-kinase, Type II, Beta (PIP5K2B, Accession NM_003559) is another VGAM507 host target gene. PIP5K2B BINDING SITE is HOST TARGET binding site found in the 3' untranslated region of mRNA encoded by PIP5K2B, corresponding to a HOST TARGET binding site such as BINDING SITE I, BINDING SITE II or BINDING SITE III. Table 2 illustrates the complementarity of the nucleotide sequences of PIP5K2B BINDING SITE, designated SEQ ID:9615, to the nucleotide sequence of VGAM507 RNA, herein designated VGAM RNA, also designated SEQ ID:3218.

Another function of VGAM507 is therefore inhibition of Phosphatidylinositol-4-phosphate 5-kinase, Type II, Beta (PIP5K2B, Accession NM_003559). Accordingly, utilities of VGAM507 include diagnosis, prevention and treatment of diseases and clinical conditions associated with PIP5K2B. Zinc Finger, DHHC Domain Containing 2 (ZDHHC2, Accession NM_016353) is another VGAM507 host target gene.

ZDHHC2 BINDING SITE is HOST TARGET binding site found in the 3' untranslated region of mRNA encoded by ZDHHC2, corresponding to a HOST TARGET binding site such as BINDING SITE I, BINDING SITE II or BINDING SITE III. Table 2 illustrates the complementarity of the nucleotide sequences of ZDHHC2 BINDING SITE, designated SEQ ID:18484, to the nucleotide sequence of VGAM507 RNA, herein designated VGAM RNA, also designated SEQ ID:3218.

Another function of VGAM507 is therefore inhibition of Zinc Finger, DHHC Domain Containing 2 (ZDHHC2, Accession NM_016353). Accordingly, utilities of VGAM507 include diagnosis, prevention and treatment of diseases and clinical conditions associated with ZDHHC2. LOC150142 (Accession XM_086791) is another VGAM507 host target gene. LOC150142 BINDING SITE is HOST TARGET binding site found in the 5' untranslated region of mRNA encoded by LOC150142, corresponding to a HOST TARGET binding site such as BINDING SITE I, BINDING SITE II or BINDING SITE III. Table 2 illustrates the complementarity of the nucleotide sequences of LOC150142 BINDING SITE, designated SEQ ID:38848, to the nucleotide sequence of VGAM507 RNA, herein designated VGAM RNA, also designated SEQ ID:3218.

Another function of VGAM507 is therefore inhibition of LOC150142 (Accession XM_086791). Accordingly, utilities of VGAM507 include diagnosis, prevention and treatment of diseases and clinical conditions associated with LOC150142. LOC219988 (Accession XM_166223) is another VGAM507 host target gene. LOC219988 BINDING SITE is HOST TARGET binding site found in the 5' untranslated region of mRNA encoded by LOC219988, corresponding to a HOST TARGET binding site such as BINDING SITE I, BINDING SITE II or BINDING SITE III. Table 2 illustrates the complementarity of the nucleotide sequences of LOC219988 BINDING SITE, designated SEQ ID:44046, to the nucleotide sequence of VGAM507 RNA, herein designated VGAM RNA, also designated SEQ ID:3218.

Another function of VGAM507 is therefore inhibition of LOC219988 (Accession XM_166223). Accordingly, utilities of VGAM507 include diagnosis, prevention and treatment of diseases and clinical conditions associated with LOC219988. FIG. 1 further provides a conceptual description of a novel bioinformatically detected viral gene of the present invention, referred to here as Viral Genomic Address Messenger 508 (VGAM508) viral gene, which modulates expression of respective host target genes thereof, the function and utility of which host target genes is known in the art.

VGAM508 is a novel bioinformatically detected regulatory, non protein coding, viral micro RNA (miRNA) gene. The method by which VGAM508 was detected is described hereinabove with reference to FIGS. 1-8.

VGAM508 gene, herein designated VGAM GENE, is a viral gene contained in the genome of Saguaro Cactus Virus. VGAM508 host target gene, herein designated VGAM HOST TARGET GENE, is a human gene contained in the human genome.

VGAM508 gene encodes a VGAM508 precursor RNA, herein designated VGAM PRECURSOR RNA. Similar to other miRNA genes, and unlike most ordinary genes, VGAM508 precursor RNA does not encode a protein. A nucleotide sequence identical or highly similar to the nucleotide sequence of VGAM508 precursor RNA is designated SEQ ID:494, and is provided hereinbelow with reference to the sequence listing part. Nucleotide sequence SEQ ID:494 is located at position 1022 relative to the genome of Saguaro Cactus Virus.

VGAM508 precursor RNA folds onto itself, forming VGAM508 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM508 folded precursor RNA into VGAM508 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM508 RNA is designated SEQ ID:3219, and is provided hereinbelow with reference to the sequence listing part.

VGAM508 host target gene, herein designated VGAM HOST TARGET GENE, encodes a corresponding messenger RNA, VGAM508 host target RNA, herein designated VGAM HOST TARGET RNA. VGAM508 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM508 RNA, herein designated VGAM RNA, binds complementarily to one or more host target binding sites located in untranslated regions of VGAM508 host target RNA, herein designated VGAM HOST TARGET RNA. This complementary binding is due to the fact that the nucleotide sequence of VGAM508 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM508 RNA, herein designated VGAM RNA, may have a different number of host target binding sites in untranslated regions of a VGAM508 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM508 RNA, herein designated VGAM RNA, to host target binding sites on VGAM508 host target RNA, herein designated VGAM HOST TARGET RNA, such as BINDING SITE I, BINDING SITE II and BINDING SITE III, inhibits translation of VGAM508 host target RNA into VGAM508 host target protein, herein designated VGAM HOST TARGET PROTEIN. VGAM host target protein is therefore outlined by a broken line.

It is appreciated that VGAM508 host target gene, herein designated VGAM HOST TARGET GENE, in fact represents a plurality of VGAM508 host target genes. The mRNA of each one of this plurality of VGAM508 host target genes comprises one or more host target binding sites, each having a nucleotide sequence which is at least partly complementary to VGAM508 RNA, herein designated VGAM RNA, and which when bound by VGAM508 RNA causes inhibition of translation of respective one or more VGAM508 host target proteins.

It is further appreciated by one skilled in the art that the mode of translational inhibition illustrated by FIG. 1 with specific reference to translational inhibition exerted by VGAM508 gene, herein designated VGAM GENE, on one or more VGAM508 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM508 is inhibition of expression of host target genes, as part of a novel viral mechanism of attacking a host. Accordingly, utilities of VGAM508 include diagnosis, prevention and treatment of viral infection by Saguaro Cactus Virus. Specific functions, and accordingly utilities, of VGAM508 correlate with, and may be deduced from, the identity of the host target genes which VGAM508 binds and inhibits, and the function of these host target genes, as elaborated hereinbelow.

Nucleotide sequences of the VGAM508 precursor RNA, herein designated VGAM PRECURSOR RNA, and of the 'diced' VGAM508 RNA, herein designated VGAM RNA, and a schematic representation of the secondary folding of VGAM508 folded precursor RNA, herein designated VGAM FOLDED PRECURSOR RNA, of VGAM508 are further described hereinbelow with reference to Table 1.

Nucleotide sequences of host target binding sites, such as BINDING SITE-I, BINDING SITE-II and BINDING SITE-III of FIG. 1, found on VGAM508 host target RNA, and schematic representation of the complementarity of each of these host target binding sites to VGAM508 RNA, herein designated VGAM RNA, are described hereinbelow with reference to Table 2.

As mentioned hereinabove with reference to FIG. 1, a function of VGAM508 gene, herein designated VGAM is inhibition of expression of VGAM508 target genes. It is appreciated that specific functions, and accordingly utilities, of VGAM508 correlate with, and may be deduced from, the identity of the target genes which VGAM508 binds and inhibits, and the function of these target genes, as elaborated hereinbelow.

A Disintegrin-like and Metalloprotease (reprolysin type) with Thrombospondin Type 1 Motif, 3 (ADAMTS3, Accession NM_014243) is a VGAM508 host target gene. ADAMTS3 BINDING SITE is HOST TARGET binding site found in the 3' untranslated region of mRNA encoded by ADAMTS3, corresponding to a HOST TARGET binding site such as BINDING SITE I, BINDING SITE II or BINDING SITE III. Table 2 illustrates the complementarity of the nucleotide sequences of ADAMTS3 BINDING SITE, designated SEQ ID:15508, to the nucleotide sequence of VGAM508 RNA, herein designated VGAM RNA, also designated SEQ ID:3219.

A function of VGAM508 is therefore inhibition of A Disintegrin-like and Metalloprotease (reprolysin type) with Thrombospondin Type 1 Motif, 3 (ADAMTS3, Accession NM_014243), a gene which cleaves the propeptides of type ii collagen prior to fibril assembly. Accordingly, utilities of VGAM508 include diagnosis, prevention and treatment of diseases and clinical conditions associated with ADAMTS3. The function of ADAMTS3 and its association with various diseases and clinical conditions, has been established by previous studies, as described hereinabove with reference to VGAM211. Carbonic Anhydrase XII (CA12, Accession NM_001218) is another VGAM508 host target gene. CA12 BINDING SITE is HOST TARGET binding site found in the 3' untranslated region of mRNA encoded by CA12, corresponding to a HOST TARGET binding site such as BINDING SITE I, BINDING SITE II or BINDING SITE III. Table 2 illustrates the complementarity of the nucleotide sequences of CA12 BINDING SITE, designated SEQ ID:6877, to the nucleotide sequence of VGAM508 RNA, herein designated VGAM RNA, also designated SEQ ID:3219.

Another function of VGAM508 is therefore inhibition of Carbonic Anhydrase XII (CA12, Accession NM_001218), a gene which functions in cellular transport and metabolic processes. Accordingly, utilities of VGAM508 include diagnosis, prevention and treatment of diseases and clinical conditions associated with CA12. The function of CA12 has been established by previous studies. Tureci et al. (1998) cloned the gene identified by Sahin et al. (1995) from the RCC and named it CA XII. The cDNA sequence encodes a deduced 354-amino acid protein with a predicted molecular mass of 39,448 Da and features of a type I membrane protein. The extracellular CA domain shows 30 to 42% similarity with known human CAs, contains all 3 zinc-binding histidine residues found in active CAs, and contains 2 potential sites for asparagine glycosylation. Expression of the CA XII cDNA in mammalian cells produced a 43- to 44-kD doublet; treatment with PNGase (endoglycosidase) F resulted in a single 39-kD product. The recombinant CA XII had appreciable catalytic activity. By Northern blot analysis, the authors detected a 4.5-kb CA XII transcript in normal human kidney, colon, and activated lymphocytes. They found that CA XII is overexpressed in 10% of clear cell renal carcinomas, as compared with the corresponding normal renal tissue. Sequencing revealed no differences between the RCC-derived cDNA and a CA XII cDNA isolated from normal kidney. Carbonic anhydrases (CAs) are a family of zinc metalloenzymes. For background information on the CA family, Full details of the abovementioned studies are described in the following publications, the disclosure of which are hereby incorporated by reference:

Tureci, O.; Sahin, U.; Vollmar, E.; Siemer, S.; Gottert, E.; Seitz, G.; Parkkila, A. K.; Shah, G. N.; Grubb, J. H.; Pfreundschuh, M.; Sly, W. S.: Human carbonic anhydrase XII: cDNA cloning, expression, and chromosomal localization of a carbonic anhydrase gene that is overexpressed in some renal cell cancers. Proc. Nat. Acad. Sci. 95: 7608-7613, 1998; and Sahin, U.; Tureci, O.; Schmitt, H.; Cochlovius, B.; Johannes, T.; Schmits, R.; Stenner, F.; Luo, G.; Schobert, I.; Pfreundschuh, M.: Human neoplasms elicit multiple specific immune resp.

Further studies establishing the function and utilities of CA12 are found in John Hopkins OMIM database record ID 603263, and in sited publications numbered 269 and 6327-6328 listed in the bibliography section hereinbelow, which are also hereby incorporated by reference. Cytochrome P450, Subfamily XIX (aromatization of androgens) (CYP19, Accession NM_000103) is another VGAM508 host target gene. CYP19 BINDING SITE1 and CYP19 BINDING SITE2 are HOST TARGET binding sites found in untranslated regions of mRNA encoded by CYP19, corresponding to HOST TARGET binding sites such as BINDING SITE I, BINDING SITE II or BINDING SITE III. Table 2 illustrates the complementarity of the nucleotide sequences of CYP19 BINDING SITE1 and CYP19 BINDING SITE2, designated SEQ ID:5559 and SEQ ID:25269 respectively, to the nucleotide sequence of VGAM508 RNA, herein designated VGAM RNA, also designated SEQ ID:3219.

Another function of VGAM508 is therefore inhibition of Cytochrome P450, Subfamily XIX (aromatization of androgens) (CYP19, Accession NM_000103), a gene which catalyzes the last steps of estrogen biosynthesis. Accordingly, utilities of VGAM508 include diagnosis, prevention and treatment of diseases and clinical conditions associated with CYP19. The function of CYP19 has been established by previous studies. The distinct gender-specific patterns of fat distribution in men and women (android and gynoid) suggest a role for sex steroids. It has been suggested that estrogens can promote preadipocyte cell proliferation and/or differentiation. The enzyme CYP19 is responsible for the conversion of androgen precursor steroids to estrogens and may, therefore, have a role in regulating adipose tissue mass and its distribution. McTernan et al. (2002) investigated the glucocorticoid regulation of aromatase expression in adipose tissue, specifically to define any site- and gender-specific differences. Abdominal subcutaneous and omental adipose tissue was obtained from male and female patients undergoing elective surgery. Cortisol-induced aromatase activity in omental adipocytes from postmenopausal females was higher than that in premenopausal females (P less than 0.001). Insulin had no independent effect on aromatase expression, but coincubation of preadipocytes with cortisol and insulin eliminated both gender- and site-specific differences. The authors concluded that in women, but not men, cortisol increases aromatase activity at subcutaneous sites, and this may facilitate predilection for subcutaneous adiposity in females. They suggested that the observed site-, gender-, and menopausal-specific differences in the glucocorticoid regulation of this enzyme may contribute to the gender- and menopausal-specific patterns of fat distribution. Hemsell et al. (1977) reported a case of gynecomastia apparently due to excessive peripheral conversion of androgen to estrogen as a result of 50-times-normal aromatase activity. The patient was an adopted boy, aged 11 years 7 months. Effects of excessive estrogen became evident at age 8, the time when plasma androstenedione begins to increase. Extraglandular aromatization, as well as sulfurylation, is extensively involved in C19-steroid metabolism in the fetus, but the activity of the enzymes falls rapidly after birth. In the patient of Hemsell et al. (1977), the fetal situation appeared to persist. Berkovitz et al. (1985) investigated a black family in which marked gynecomastia with normal male genitalia occurred in 5 men in 3 sibships of 2 generations connected through females. In each, gynecomastia and male sexual differentiation began at an early age (10 to 11 years). The ratio of the concentration of plasma estradiol-17 beta to that of plasma testosterone was elevated in each. In 3 affected sibs, the transfer constant of conversion of androstenedione to estrone (i.e., the fraction of plasma androstenedione that was converted to estrone as measured in the urine) was 10 times the normal. Despite elevated extraglandular aromatase activity, the hypothalamic-pituitary axis responded normally to provocative stimuli. None of the 5 males had children, but 4 were still in their teens; the fifth was 29 years of age. The pattern of inheritance of familial gynecomastia with increased aromatase activity is consistent with either X-linked recessive or autosomal dominant, male-limited inheritance. Mapping of the aromatase locus to an autosome makes the latter possibility highly likely. Autosomal dominant inheritance appeared likely in a family, reported by Leiberman and Zachmann (1992), in which increased steroid aromatization seemed to be responsible for 'familial adrenal feminization.' The father and 2 male and 2 female sibs had gynecomastia, early growth, and short final stature. The 8-year-old propositus had advanced bone age, facial acne, gynecomastia, pubic hair, and prepubertal testicular volume. ACTH-dependent adrenal feminization was confirmed by a transient reduction of breast tissue following dexamethasone or cyproterone acetate treatment. Testolactone, which is an inhibitor of peripheral aromatase activity in vivo, temporarily reduced the breast tissue. This was the first example of male-to-male and male-to-female transmission reported. Animal model experiments lend further support to the function of CYP19. Aromatase knockout (ArKO) mice, lacking a functional Cyp19 gene, cannot synthesize endogenous estrogens. Jones et al. (2000) examined the adipose deposits of male and female ArKO mice, observing that these animal progressively accumulated significantly more intraabdominal adipose tissue than their wildtype littermates, reflected in increased adipocyte volume at gonadal and infrarenal sites. This increased adiposity was not due to hyperphagia or reduced resting energy expenditure, but was associated with reduced spontaneous physical activity levels, reduced glucose oxidation, and a decrease in lean body mass. A striking accumulation of lipid droplets was observed in the livers of ArKO animals. The findings demonstrated an important role for estrogen in the maintenance of lipid homeostasis in both males and females. Along the same lines, Heine et al. (2000) studied male and female Esr1 knockout mice and found that signaling by this receptor is critical in female and male white adipose tissue. Obesity in the males involved a mechanism of reduced energy expenditure rather than increased energy intake.

It is appreciated that the abovementioned animal model for CYP19 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Deladoey, J.; Fluck, C.; Bex, M.; Yoshimura, N.; Harada, N.; Mullis, P. E.: Aromatase deficiency caused by a novel P450(arom) gene mutation: impact of absent estrogen production on serum gonadotropin concentration in a boy. J. Clin. Endocr. Metab. 84:4050-4054, 1999; and Yang, S.; Fang, Z.; Suzuki, T.; Sasano, H.; Zhou, J.; Gurates, B.; Tamura, M.; Ferrer, K.; Bulun, S.: Regulation of aromatase P450 expression in endometriotic and endometrial stromal.

Further studies establishing the function and utilities of CYP19 are found in John Hopkins OMIM database record ID 107910, and in sited publications numbered 4675, 4845, 4855-4869, 2149, 4870-4871, 877, 4872-4881, 29, 12529-12530, 313 and 12531-12535 listed in the bibliography section hereinbelow, which are also hereby incorporated by reference. Selectin E (endothelial adhesion molecule 1) (SELE, Accession NM_000450) is another VGAM508 host target gene. SELE BINDING SITE is HOST TARGET binding site found in the 3' untranslated region of mRNA encoded by SELE, corresponding to a HOST TARGET binding site such as BINDING SITE I, BINDING SITE II or BINDING SITE III. Table 2 illustrates the complementarity of the nucleotide sequences of SELE BINDING SITE, designated SEQ ID:6051, to the nucleotide sequence of VGAM508 RNA, herein designated VGAM RNA, also designated SEQ ID:3219.

Another function of VGAM508 is therefore inhibition of Selectin E (endothelial adhesion molecule 1) (SELE, Accession NM_000450), a gene which expressed on cytokine induced endothelial cells and mediates their binding to leukocytes. Accordingly, utilities of VGAM508 include diagnosis, prevention and treatment of diseases and clinical conditions associated with SELE. The function of SELE has been established by previous studies. Zheng et al. (2001) examined whether a polymorphism in the SELE gene, due to a G-to-T mutation (98G-T) in the untranslated region of exon 2, was related to premature coronary artery disease (CAD). Both lipid and nonlipid risk factors, including the ser128-to-arg substitution studied by Wenzel et al. (1994), were also assessed. The frequency of the 98G-T mutation was found to be significantly increased among male patients under 45 years of age and female patients under 55 years of age. After controlling for other CAD risk factors by multiple logistic analysis, the 98G-T mutation was still a significant predictor of premature CAD. The glaucomas are a group of optic neuropathies comprising the leading cause of irreversible blindness worldwide. Elevated intraocular pressure due to a reduction in normal aqueous outflow is a major causal risk factor. Wang et al. (2001) found that ELAM1, the earliest marker for the atherosclerotic plaque in the vasculature, was consistently present on trabecular meshwork cells in the outflow pathways of eyes with glaucomas of diverse etiology. They determined expression of ELAM1 to be controlled by activation of an interleukin-1 (see OMIM Ref. No. 147760) autocrine feedback loop through transcription factor NK-kappa-B (see OMIM Ref. No. 164011), and activity of this signaling pathway was shown to protect trabecular meshwork cells against oxidative stress. Wang et al. (2001) concluded that their findings characterized a protective stress response specific to the eye's aqueous outflow pathways and provided the first known diagnostic indicator of glaucomatous trabecular meshwork cells. They further indicated that common mechanisms contribute to the pathophysiology of the glaucomas and vascular diseases.

Full details of the abovementioned studies are described in the following publications, the disclosure of which are hereby incorporated by reference:

Wang, N.; Chintala, S. K.; Fini, M. E.; Schuman, J. S.: Activation of a tissue-specific stress response in the aqueous outflow pathway of the eye defines the glaucoma disease phenotype. Nature Med. 7:304-309, 2001; and Zheng, F.; Chevalier, J. A.; Zhang, L. Q.; Virgil, D.; Ye, S. Q.; Kwiterovich, P. O.: An HphI polymorphism in the E-selectin gene is associated with premature coronary artery diseas.

Further studies establishing the function and utilities of SELE are found in John Hopkins OMIM database record ID 131210, and in sited publications numbered 11805-11812 listed in the bibliography section hereinbelow, which are also hereby incorporated by reference. FLJ21945 (Accession NM_025203) is another VGAM508 host target gene. FLJ21945 BINDING SITE is HOST TARGET binding site found in the 3' untranslated region of mRNA encoded by FLJ21945, corresponding to a HOST TARGET binding site such as BINDING SITE I, BINDING SITE II or BINDING SITE III. Table 2 illustrates the complementarity of the nucleotide sequences of FLJ21945 BINDING SITE, designated SEQ ID:24866, to the nucleotide sequence of VGAM508 RNA, herein designated VGAM RNA, also designated SEQ ID:3219.

Another function of VGAM508 is therefore inhibition of FLJ21945 (Accession NM_025203). Accordingly, utilities of VGAM508 include diagnosis, prevention and treatment of diseases and clinical conditions associated with FLJ21945. Heterogeneous Nuclear Ribonucleoprotein U (scaffold attachment factor A) (HNRPU, Accession NM_031844) is another VGAM508 host target gene. HNRPU BINDING SITE1 and HNRPU BINDING SITE2 are HOST TARGET binding sites found in untranslated regions of mRNA encoded by HNRPU, corresponding to HOST TARGET binding sites such as BINDING SITE I, BINDING SITE II or BINDING SITE III. Table 2 illustrates the complementarity of the nucleotide sequences of HNRPU BINDING SITE1 and HNRPU BINDING SITE2, designated SEQ ID:25579 and SEQ ID:10835 respectively, to the nucleotide sequence of VGAM508 RNA, herein designated VGAM RNA, also designated SEQ ID:3219.

Another function of VGAM508 is therefore inhibition of Heterogeneous Nuclear Ribonucleoprotein U (scaffold attachment factor A) (HNRPU, Accession NM_031844). Accordingly, utilities of VGAM508 include diagnosis, prevention and treatment of diseases and clinical conditions associated with HNRPU. LOC91266 (Accession XM_037268) is another VGAM508 host target gene. LOC91266 BINDING SITE is HOST TARGET binding site found in the 5' untranslated region of mRNA encoded by LOC91266, corresponding to a HOST TARGET binding site such as BINDING SITE I, BINDING SITE II or BINDING SITE III. Table 2 illustrates the complementarity of the nucleotide sequences of LOC91266 BINDING SITE, designated SEQ ID:32600, to the nucleotide sequence of VGAM508 RNA, herein designated VGAM RNA, also designated SEQ ID:3219.

Another function of VGAM508 is therefore inhibition of LOC91266 (Accession XM_037268). Accordingly, utilities of VGAM508 include diagnosis, prevention and treatment of diseases and clinical conditions associated with LOC91266. FIG. 1 further provides a conceptual description of a novel bioinformatically detected viral gene of the present invention, referred to here as Viral Genomic Address Messenger 509 (VGAM509) viral gene, which modulates expression of respective host target genes thereof, the function and utility of which host target genes is known in the art.

VGAM509 is a novel bioinformatically detected regulatory, non protein coding, viral micro RNA (miRNA) gene. The method by which VGAM509 was detected is described hereinabove with reference to FIGS. 1-8.

VGAM509 gene, herein designated VGAM GENE, is a viral gene contained in the genome of Papaya Ringspot Virus. VGAM509 host target gene, herein designated VGAM HOST TARGET GENE, is a human gene contained in the human genome.

VGAM509 gene encodes a VGAM509 precursor RNA, herein designated VGAM PRECURSOR RNA. Similar to other miRNA genes, and unlike most ordinary genes, VGAM509 precursor RNA does not encode a protein. A nucleotide sequence identical or highly similar to the nucleotide sequence of VGAM509 precursor RNA is designated SEQ ID:495, and is provided hereinbelow with reference to the sequence listing part. Nucleotide sequence SEQ ID:495 is located at position 7642 relative to the genome of Papaya Ringspot Virus.

VGAM509 precursor RNA folds onto itself, forming VGAM509 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM509 folded precursor RNA into VGAM509 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM509 RNA is designated SEQ ID:3220, and is provided hereinbelow with reference to the sequence listing part.

VGAM509 host target gene, herein designated VGAM HOST TARGET GENE, encodes a corresponding messenger RNA, VGAM509 host target RNA, herein designated VGAM HOST TARGET RNA. VGAM509 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM509 RNA, herein designated VGAM RNA, binds complementarily to one or more host target binding sites located in untranslated regions of VGAM509 host target RNA, herein designated VGAM HOST TARGET RNA. This complementary binding is due to the fact that the nucleotide sequence of VGAM509 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM509 RNA, herein designated VGAM RNA, may have a different number of host target binding sites in untranslated regions of a VGAM509 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM509 RNA, herein designated VGAM RNA, to host target binding sites on VGAM509 host target RNA, herein designated VGAM HOST TARGET RNA, such as BINDING SITE I, BINDING SITE II and BINDING SITE III, inhibits translation of VGAM509 host target RNA into VGAM509 host target protein, herein designated VGAM HOST TARGET PROTEIN. VGAM host target protein is therefore outlined by a broken line.

It is appreciated that VGAM509 host target gene, herein designated VGAM HOST TARGET GENE, in fact represents a plurality of VGAM509 host target genes. The mRNA of each one of this plurality of VGAM509 host target genes comprises one or more host target binding sites, each having a nucleotide sequence which is at least partly complementary to VGAM509 RNA, herein designated VGAM RNA, and which when bound by VGAM509 RNA causes inhibition of translation of respective one or more VGAM509 host target proteins.

It is further appreciated by one skilled in the art that the mode of translational inhibition illustrated by FIG. 1 with specific reference to translational inhibition exerted by VGAM509 gene, herein designated VGAM GENE, on one or more VGAM509 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM509 is inhibition of expression of host target genes, as part of a novel viral mechanism of attacking a host. Accordingly, utilities of VGAM509 include diagnosis, prevention and treatment of viral infection by Papaya Ringspot Virus. Specific functions, and accordingly utilities, of VGAM509 correlate with, and may be deduced from, the identity of the host target genes which VGAM509 binds and inhibits, and the function of these host target genes, as elaborated hereinbelow.

Nucleotide sequences of the VGAM509 precursor RNA, herein designated VGAM PRECURSOR RNA, and of the 'diced' VGAM509 RNA, herein designated VGAM RNA, and a schematic representation of the secondary folding of VGAM509 folded precursor RNA, herein designated VGAM FOLDED PRECURSOR RNA, of VGAM509 are further described hereinbelow with reference to Table 1.

Nucleotide sequences of host target binding sites, such as BINDING SITE-I, BINDING SITE-II and BINDING SITE-III of FIG. 1, found on VGAM509 host target RNA, and schematic representation of the complementarity of each of these host target binding sites to VGAM509 RNA, herein designated VGAM RNA, are described hereinbelow with reference to Table 2.

As mentioned hereinabove with reference to FIG. 1, a function of VGAM509 gene, herein designated VGAM is inhibition of expression of VGAM509 target genes. It is appreciated that specific functions, and accordingly utilities, of VGAM509 correlate with, and may be deduced from, the identity of the target genes which VGAM509 binds and inhibits, and the function of these target genes, as elaborated hereinbelow.

Cystinosis, Nephropathic (CTNS, Accession NM_004937) is a VGAM509 host target gene. CTNS BINDING SITE is HOST TARGET binding site found in the 3' untranslated region of mRNA encoded by CTNS, corresponding to a HOST TARGET binding site such as BINDING SITE I, BINDING SITE II or BINDING SITE III. Table 2 illustrates the complementarity of the nucleotide sequences of CTNS BINDING SITE, designated SEQ ID:11382, to the nucleotide sequence of VGAM509 RNA, herein designated VGAM RNA, also designated SEQ ID:3220.

A function of VGAM509 is therefore inhibition of Cystinosis, Nephropathic (CTNS, Accession NM_004937). Accordingly, utilities of VGAM509 include diagnosis, prevention and treatment of diseases and clinical conditions associated with CTNS. Mannosyl (alpha-1,6-)-glycoprotein Beta-1,2-N-acetylglucosaminyltransferase (MGAT2, Accession NM_002408) is another VGAM509 host target gene. MGAT2 BINDING SITE is HOST TARGET binding site found in the 5' untranslated region of mRNA encoded by MGAT2, corresponding to a HOST TARGET binding site such as BINDING SITE I, BINDING SITE II or BINDING SITE III. Table 2 illustrates the complementarity of the nucleotide sequences of MGAT2 BINDING SITE, designated SEQ ID:8231, to the nucleotide sequence of VGAM509 RNA, herein designated VGAM RNA, also designated SEQ ID:3220.

Another function of VGAM509 is therefore inhibition of Mannosyl (alpha-1,6-)-glycoprotein Beta-1,2-N-acetylglucosaminyltransferase (MGAT2, Accession NM_002408). Accordingly, utilities of VGAM509 include diagnosis, prevention and treatment of diseases and clinical conditions associated with MGAT2. HT001 (Accession XM_039534) is another VGAM509 host target gene. HT001 BINDING SITE is HOST TARGET binding site found in the 5' untranslated region of mRNA encoded by HT001, corresponding to a HOST TARGET binding site such as BINDING SITE I, BINDING SITE II or BINDING SITE III. Table 2 illustrates the complementarity of the nucleotide sequences of HT001 BINDING SITE, designated SEQ ID:33115, to the nucleotide sequence of VGAM509 RNA, herein designated VGAM RNA, also designated SEQ ID:3220.

Another function of VGAM509 is therefore inhibition of HT001 (Accession XM_039534). Accordingly, utilities of VGAM509 include diagnosis, prevention and treatment of diseases and clinical conditions associated with HT001. Zinc Finger Protein 226 (ZNF226, Accession NM_016444) is another VGAM509 host target gene. ZNF226 BINDING SITE is HOST TARGET binding site found in the 5' untranslated region of mRNA encoded by ZNF226, corresponding to a HOST TARGET binding site such as BINDING SITE I, BINDING SITE II or BINDING SITE III. Table 2 illustrates the complementarity of the nucleotide sequences of ZNF226 BINDING SITE, designated SEQ ID:18565, to the nucleotide sequence of VGAM509 RNA, herein designated VGAM RNA, also designated SEQ ID:3220.

Another function of VGAM509 is therefore inhibition of Zinc Finger Protein 226 (ZNF226, Accession NM_016444). Accordingly, utilities of VGAM509 include diagnosis, prevention and treatment of diseases and clinical conditions associated with ZNF226. FIG. 1 further provides a conceptual description of a novel bioinformatically detected viral gene of the present invention, referred to here as Viral Genomic Address Messenger 510 (VGAM510) viral gene, which modulates expression of respective host target genes thereof, the function and utility of which host target genes is known in the art.

VGAM510 is a novel bioinformatically detected regulatory, non protein coding, viral micro RNA (miRNA) gene. The method by which VGAM510 was detected is described hereinabove with reference to FIGS. 1-8.

VGAM510 gene, herein designated VGAM GENE, is a viral gene contained in the genome of Papaya Ringspot Virus. VGAM510 host target gene, herein designated VGAM HOST TARGET GENE, is a human gene contained in the human genome.

VGAM510 gene encodes a VGAM510 precursor RNA, herein designated VGAM PRECURSOR RNA. Similar to other miRNA genes, and unlike most ordinary genes, VGAM510 precursor RNA does not encode a protein. A nucleotide sequence identical or highly similar to the nucleotide sequence of VGAM510 precursor RNA is designated SEQ ID:496, and is provided hereinbelow with reference to the sequence listing part. Nucleotide sequence SEQ ID:496 is located at position 4216 relative to the genome of Papaya Ringspot Virus.

VGAM510 precursor RNA folds onto itself, forming VGAM510 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM510 folded precursor RNA into VGAM510 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM510 RNA is designated SEQ ID:3221, and is provided hereinbelow with reference to the sequence listing part.

VGAM510 host target gene, herein designated VGAM HOST TARGET GENE, encodes a corresponding messenger RNA, VGAM510 host target RNA, herein designated VGAM HOST TARGET RNA. VGAM510 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM510 RNA, herein designated VGAM RNA, binds complementarily to one or more host target binding sites located in untranslated regions of VGAM510 host target RNA, herein designated VGAM HOST TARGET RNA. This complementary binding is due to the fact that the nucleotide sequence of VGAM510 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM510 RNA, herein designated VGAM RNA, may have a different number of host target binding sites in untranslated regions of a VGAM510 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM510 RNA, herein designated VGAM RNA, to host target binding sites on VGAM510 host target RNA, herein designated VGAM HOST TARGET RNA, such as BINDING SITE I, BINDING SITE II and BINDING SITE III, inhibits translation of VGAM510 host target RNA into VGAM510 host target protein, herein designated VGAM HOST TARGET PROTEIN. VGAM host target protein is therefore outlined by a broken line.

It is appreciated that VGAM510 host target gene, herein designated VGAM HOST TARGET GENE, in fact represents a plurality of VGAM510 host target genes. The mRNA of each one of this plurality of VGAM510 host target genes comprises one or more host target binding sites, each having a nucleotide sequence which is at least partly complementary to VGAM510 RNA, herein designated VGAM RNA, and which when bound by VGAM510 RNA causes inhibition of translation of respective one or more VGAM510 host target proteins.

It is further appreciated by one skilled in the art that the mode of translational inhibition illustrated by FIG. 1 with specific reference to translational inhibition exerted by VGAM510 gene, herein designated VGAM GENE, on one or more VGAM510 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM510 is inhibition of expression of host target genes, as part of a novel viral mechanism of attacking a host. Accordingly, utilities of VGAM510 include diagnosis, prevention and treatment of viral infection by Papaya Ringspot Virus. Specific functions, and accordingly utilities, of VGAM510 correlate with, and may be deduced from, the identity of the host target genes which VGAM510 binds and inhibits, and the function of these host target genes, as elaborated hereinbelow.

Nucleotide sequences of the VGAM510 precursor RNA, herein designated VGAM PRECURSOR RNA, and of the 'diced' VGAM510 RNA, herein designated VGAM RNA, and a schematic representation of the secondary folding of VGAM510 folded precursor RNA, herein designated VGAM FOLDED PRECURSOR RNA, of VGAM510 are further described hereinbelow with reference to Table 1.

Nucleotide sequences of host target binding sites, such as BINDING SITE-I, BINDING SITE-II and BINDING SITE-III of FIG. 1, found on VGAM510 host target RNA, and schematic representation of the complementarity of each of these host target binding sites to VGAM510 RNA, herein designated VGAM RNA, are described hereinbelow with reference to Table 2.

As mentioned hereinabove with reference to FIG. 1, a function of VGAM510 gene, herein designated VGAM is inhibition of expression of VGAM510 target genes. It is appreciated that specific functions, and accordingly utilities, of VGAM510 correlate with, and may be deduced from, the identity of the target genes which VGAM510 binds and inhibits, and the function of these target genes, as elaborated hereinbelow.

B-cell CLL/lymphoma 11B (zinc finger protein) (BCL11B, Accession NM_022898) is a VGAM510 host target gene. BCL11B BINDING SITE is HOST TARGET binding site found in the 3' untranslated region of mRNA encoded by BCL11B, corresponding to a HOST TARGET binding site such as BINDING SITE I, BINDING SITE II or BINDING SITE III. Table 2 illustrates the complementarity of the nucleotide sequences of BCL11B BINDING SITE, designated SEQ ID:23157, to the nucleotide sequence of VGAM510 RNA, herein designated VGAM RNA, also designated SEQ ID:3221.

A function of VGAM510 is therefore inhibition of B-cell CLL/lymphoma 11B (zinc finger protein) (BCL11B, Accession NM_022898). Accordingly, utilities of VGAM510 include diagnosis, prevention and treatment of diseases and clinical conditions associated with BCL11B. Empty Spiracles Homolog 2 (Drosophila) (EMX2, Accession XM_113640) is another VGAM510 host target gene. EMX2 BINDING SITE is HOST TARGET binding site found in the 3' untranslated region of mRNA encoded by EMX2, corresponding to a HOST TARGET binding site such as BINDING SITE I, BINDING SITE II or BINDING SITE III. Table 2 illustrates the complementarity of the nucleotide sequences of EMX2 BINDING SITE, designated SEQ ID:42315, to the nucleotide sequence of VGAM510 RNA, herein designated VGAM RNA, also designated SEQ ID:3221.

Another function of VGAM510 is therefore inhibition of Empty Spiracles Homolog 2 (Drosophila) (EMX2, Accession XM_113640), a gene which may function in combinations with otx1/2 to specify cell fates in the developing central nervous system. Accordingly, utilities of VGAM510 include diagnosis, prevention and treatment of diseases and clinical conditions associated with EMX2. The function of EMX2 has been established by previous studies. Brunelli et al. (1996) described schizencephaly (OMIM Ref. No. 269160) as an extremely rare congenital disorder characterized by a full-thickness cleft within the cerebral hemispheres. The clefts are lined with gray matter and most commonly involve the parasylvian regions (Wolpert and Barnes, 1992). Large portions of the cerebral hemispheres may be absent and replaced by cerebrospinal fluid. In a search for mutations in the human homologs of the Emx1, Emx2, Otx1, and Otx2 genes, which are expressed in the developing mouse forebrain, Brunelli et al. (1996) found that 3 of 8 patients with severe schizencephaly were heterozygous for different mutations in the EMX2 gene. One of the mutations was a frameshift in the homeodomain resulting in the alteration of its carboxy terminus, including the entire recognition helix. The other 2 were 3-prime splice site mutations in the first intron, upstream from the homeodomain, which prevented appropriate splicing of EMX2 transcripts in vitro. All 3 were de novo mutations, as they were not present in the patients' parents. Thus, the authors concluded that the EMX2 protein appears to be required for the correct formation of the human cerebral cortex. Two types of schizencephaly have been described, depending on the size of the area involved and the separation of the cleft lips (Wolpert and Barnes, 1992). Type I schizencephaly consists of a fused cleft. This fused pial-apendymal seam forms a furrow in the developing brain, and is lined by polymicrogyric gray matter. In type II schizencephaly, there is a large defect, a holohemispheric cleft in the cerebral cortex filled with fluid and lined by polymicrogyric gray matter. The clinical manifestations depend on the severity of the lesion. Patients with type I are often almost normal; they may have seizures and spasticity. In type II abnormalities, there is usually mental retardation, seizures, hypotonia, spasticity, inability to walk or speak, and blindness. The patients in whom Brunelli et al. (1996) demonstrated EMX2 mutations belonged to the type II category. The authors speculated that EMX2 may play a part in the control of cell proliferation of cortical neuroblasts and/or cell migration of postmitotic neurons, as it is known that these cells reach their final destination in the mature cortex according to their birth date (Boncinelli et al., 1995). Patients with mild forms of schizencephaly are often almost normal but may show partial epileptic seizures and mild spastic hemiparesis. Conversely, patients with bilateral open-lip clefts usually have microcephaly, severe developmental delay with serious mental retardation, and spastic quadriparesis. Adding to the previously reported analysis of EMX2 mutations in 7 of 8 sporadic cases of schizencephaly, Faiella et al. (1997) analyzed 10 additional patients, including 2 brothers. Six patients were found to be heterozygous for de novo mutations in EMX2. In particular, the 2 brothers, who had severe bilateral schizencephaly, showed the same mutation affecting the splicing of the first intron, while this mutation was absent in their parents and in 2 unaffected sibs. Presumably this was an instance of germinal mosaicism in one or the other of the parents. Some other patients with mutations hadmild unilateral schizencephaly associated with partial epilepsy. Mutation analysis by Noonan et al. (2001) of endometrioid adenocarcinomas and a Mullerian mesodermal tumor identified multiple variants in the EMX2 gene, including somatic mutations not found in normal DNA, intronic polymorphisms present in normal DNA samples, and polymorphisms in the 3-prime untranslated region. Noonan et al. (2001) concluded that EMX2 is most likely involved in the control of differentiation and possibly in tumor suppression Animal model experiments lend further support to the function of EMX2. The contribution of extrinsic and genetic mechanisms in determining areas of the mammalian neocortex has been a contested issue. Bishop et al. (2000) analyzed the roles of the regulatory genes Emx2 and Pax6 (OMIM Ref. No. 607108), which are expressed in opposing gradients in the neocortical ventricular zone, in specifying areas. Changes in the patterning of molecular markers and area-specific connections between the cortex and thalamus suggested that arealization of the neocortex is disproportionately altered in Emx2 and Pax6 mutant mice in opposing manners predicted from their countergradients of expression: rostral areas expanded and caudal areas contracted in Emx2 mutants, whereas the opposite effect was seen in Pax6 mutants. Bishop et al. (2000) concluded that Emx2 and Pax6 cooperate to regulate arealization of the neocortex and to confer area identity to cortical cells.

It is appreciated that the abovementioned animal model for EMX2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bishop, K. M.; Goudreau, G.; O'Leary, D. D. M.: Regulation of area identity in the mammalian neocortex by Emx2 and Pax6. Science 288:344-349, 2000; and Noonan, F. C.; Mutch, D. G.; Mallon, M. A.; Goodfellow, P. J.: Characterization of the homeodomain gene EMX2: sequence conservation, expression analysis, and a search for mutations in.

Further studies establishing the function and utilities of EMX2 are found in John Hopkins OMIM database record ID 600035, and in sited publications numbered 8112-8114, 8714, 925 and 8115 listed in the bibliography section hereinbelow, which are also hereby incorporated by reference. PRO2086 (Accession NM_014111) is another VGAM510 host target gene. PRO2086 BINDING SITE is HOST TARGET binding site found in the 5" untranslated region of mRNA encoded by PRO2086, corresponding to a HOST TARGET binding site such as BINDING SITE I, BINDING SITE II or BINDING SITE III. Table 2 illustrates the complementarity of the nucleotide sequences of PRO2086 BINDING SITE, designated SEQ ID:15344, to the nucleotide sequence of VGAM510 RNA, herein designated VGAM RNA, also designated SEQ ID:3221.

Another function of VGAM510 is therefore inhibition of PRO2086 (Accession NM_014111). Accordingly, utilities of VGAM510 include diagnosis, prevention and treatment of diseases and clinical conditions associated with PRO2086. Ubiquitin-like, Containing PHD and RING Finger Domains, 1 (UHRF1, Accession NM_013282) is another VGAM510 host target gene. UHRF1 BINDING SITE is HOST TARGET binding site found in the 3' untranslated region of mRNA encoded by UHRF1, corresponding to a HOST TARGET binding site such as BINDING SITE I, BINDING SITE II or BINDING SITE III. Table 2 illustrates the complementarity of the nucleotide sequences of UHRF1 BINDING SITE, designated SEQ ID:14953, to the nucleotide sequence of VGAM510 RNA, herein designated VGAM RNA, also designated SEQ ID:3221.

Another function of VGAM510 is therefore inhibition of Ubiquitin-like, Containing PHD and RING Finger Domains, 1 (UHRF1, Accession NM_013282). Accordingly, utilities of VGAM510 include diagnosis, prevention and treatment of diseases and clinical conditions associated with UHRF1. LOC139331 (Accession XM_066631) is another VGAM510 host target gene. LOC139331 BINDING SITE is HOST TARGET binding site found in the 5' untranslated region of mRNA encoded by LOC139331, corresponding to a HOST TARGET binding site such as BINDING SITE I, BINDING SITE II or BINDING SITE III. Table 2 illustrates the complementarity of the nucleotide sequences of LOC139331 BINDING SITE, designated SEQ ID:37340, to the nucleotide sequence of VGAM510 RNA, herein designated VGAM RNA, also designated SEQ ID:3221.

Another function of VGAM510 is therefore inhibition of LOC139331 (Accession XM_066631). Accordingly, utilities of VGAM510 include diagnosis, prevention and treatment of diseases and clinical conditions associated with LOC139331. LOC151248 (Accession XM_087143) is another VGAM510 host target gene. LOC151248 BINDING SITE is HOST TARGET binding site found in the 5' untranslated region of mRNA encoded by LOC151248, corresponding to a HOST TARGET binding site such as BINDING SITE I, BINDING SITE II or BINDING SITE III. Table 2 illustrates the complementarity of the nucleotide sequences of LOC151248 BINDING SITE, designated SEQ ID:39081, to the nucleotide sequence of VGAM510 RNA, herein designated VGAM RNA, also designated SEQ ID:3221.

Another function of VGAM510 is therefore inhibition of LOC151248 (Accession XM_087143). Accordingly, utilities of VGAM510 include diagnosis, prevention and treatment of diseases and clinical conditions associated with LOC151248. FIG. 1 further provides a conceptual description of a novel bioinformatically detected viral gene of the present invention, referred to here as Viral Genomic Address Messenger 511 (VGAM511) viral gene, which modulates expression of respective host target genes thereof, the function and utility of which host target genes is known in the art.

VGAM511 is a novel bioinformatically detected regulatory, non protein coding, viral micro RNA (miRNA) gene. The method by which VGAM511 was detected is described hereinabove with reference to FIGS. 1-8.

VGAM511 gene, herein designated VGAM GENE, is a viral gene contained in the genome of Cucumber Green Mottle Mosaic Virus. VGAM511 host target gene, herein designated VGAM HOST TARGET GENE, is a human gene contained in the human genome.

VGAM511 gene encodes a VGAM511 precursor RNA, herein designated VGAM PRECURSOR RNA. Similar to other miRNA genes, and unlike most ordinary genes, VGAM511 precursor RNA does not encode a protein. A nucleotide sequence identical or highly similar to the nucleotide sequence of VGAM511 precursor RNA is designated SEQ ID:497, and is provided hereinbelow with reference to the sequence listing part. Nucleotide sequence SEQ ID:497 is located at position 1481 relative to the genome of Cucumber Green Mottle Mosaic Virus.

VGAM511 precursor RNA folds onto itself, forming VGAM511 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM511 folded precursor RNA into VGAM511 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM511 RNA is designated SEQ ID:3222, and is provided hereinbelow with reference to the sequence listing part.

VGAM511 host target gene, herein designated VGAM HOST TARGET GENE, encodes a corresponding messenger RNA, VGAM511 host target RNA, herein designated VGAM HOST TARGET RNA. VGAM511 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM511 RNA, herein designated VGAM RNA, binds complementarily to one or more host target binding sites located in untranslated regions of VGAM511 host target RNA, herein designated VGAM HOST TARGET RNA. This complementary binding is due to the fact that the nucleotide sequence of VGAM511 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM511 RNA, herein designated VGAM RNA, may have a different number of host target binding sites in untranslated regions of a VGAM511 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM511 RNA, herein designated VGAM RNA, to host target binding sites on VGAM511 host target RNA, herein designated VGAM HOST TARGET RNA, such as BINDING SITE I, BINDING SITE II and BINDING SITE III, inhibits translation of VGAM511 host target RNA into VGAM511 host target protein, herein designated VGAM HOST TARGET PROTEIN. VGAM host target protein is therefore outlined by a broken line.

It is appreciated that VGAM511 host target gene, herein designated VGAM HOST TARGET GENE, in fact represents a plurality of VGAM511 host target genes. The mRNA of each one of this plurality of VGAM511 host target genes comprises one or more host target binding sites, each having a nucleotide sequence which is at least partly complementary to VGAM511 RNA, herein designated VGAM RNA, and which when bound by VGAM511 RNA causes inhibition of translation of respective one or more VGAM511 host target proteins.

It is further appreciated by one skilled in the art that the mode of translational inhibition illustrated by FIG. 1 with specific reference to translational inhibition exerted by VGAM511 gene, herein designated VGAM GENE, on one or more VGAM511 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM511 is inhibition of expression of host target genes, as part of a novel viral mechanism of attacking a host. Accordingly, utilities of VGAM511 include diagnosis, prevention and treatment of viral infection by Cucumber Green Mottle Mosaic Virus. Specific functions, and accordingly utilities, of VGAM511 correlate with, and may be deduced from, the identity of the host target genes which VGAM511 binds and inhibits, and the function of these host target genes, as elaborated hereinbelow.

Nucleotide sequences of the VGAM511 precursor RNA, herein designated VGAM PRECURSOR RNA, and of the 'diced' VGAM511 RNA, herein designated VGAM RNA, and a schematic representation of the secondary folding of VGAM511 folded precursor RNA, herein designated VGAM FOLDED PRECURSOR RNA, of VGAM511 are further described hereinbelow with reference to Table 1.

Nucleotide sequences of host target binding sites, such as BINDING SITE-I, BINDING SITE-II and BINDING SITE-III of FIG. 1, found on VGAM511 host target RNA, and schematic representation of the complementarity of each of these host target binding sites to VGAM511 RNA, herein designated VGAM RNA, are described hereinbelow with reference to Table 2.

As mentioned hereinabove with reference to FIG. 1, a function of VGAM511 gene, herein designated VGAM is inhibition of expression of VGAM511 target genes. It is appreciated that specific functions, and accordingly utilities, of VGAM511 correlate with, and may be deduced from, the identity of the target genes which VGAM511 binds and inhibits, and the function of these target genes, as elaborated hereinbelow.

Cadherin 6, Type 2, K-cadherin (fetal kidney) (CDH6, Accession NM_004932) is a VGAM511 host target gene. CDH6 BINDING SITE is HOST TARGET binding site found in the 3' untranslated region of mRNA encoded by CDH6, corresponding to a HOST TARGET binding site such as BINDING SITE I, BINDING SITE II or BINDING SITE III. Table 2 illustrates the complementarity of the nucleotide sequences of CDH6 BINDING SITE, designated SEQ ID:11372, to the nucleotide sequence of VGAM511 RNA, herein designated VGAM RNA, also designated SEQ ID:3222.

A function of VGAM511 is therefore inhibition of Cadherin 6, Type 2, K-cadherin (fetal kidney) (CDH6, Accession NM_004932), a gene which is a calcium dependent cell adhesion protein. Accordingly, utilities of VGAM511 include diagnosis, prevention and treatment of diseases and clinical conditions associated with CDH6. The function of CDH6 and its association with various diseases and clinical conditions, has been established by previous studies, as described hereinabove with reference to VGAM60. Interferon Regulatory Factor 2 (IRF2, Accession NM_002199) is another VGAM511 host target gene. IRF2 BINDING SITE is HOST TARGET binding site found in the 3' untranslated region of mRNA encoded by IRF2, corresponding to a HOST TARGET binding site such as BINDING SITE I, BINDING SITE II or BINDING SITE III. Table 2 illustrates the complementarity of the nucleotide sequences of IRF2 BINDING SITE, designated SEQ ID:7957, to the nucleotide sequence of VGAM511 RNA, herein designated VGAM RNA, also designated SEQ ID:3222.

Another function of VGAM511 is therefore inhibition of Interferon Regulatory Factor 2 (IRF2, Accession NM_002199), a gene which is a transcriptional activator of type I interferon and interferon-inducible genes. Accordingly, utilities of VGAM511 include diagnosis, prevention and treatment of diseases and clinical conditions associated with IRF2. The function of IRF2 has been established by previous studies. Interferon regulatory factor-1 (IRF1; 147575), a transcriptional activator, and IRF2, its antagonistic repressor, are regulators of type I interferon and interferon-inducible genes.

The IRF1 gene is itself interferon-inducible and hence may be one of the target genes critical for interferon action. Harada et al. (1993) found that when the IRF2 gene was overexpressed in NIH 3T3 cells, the cells became transformed and displayed enhanced tumorigenicity in nude mice. This transformed phenotype was reversed by concomitant expression of the IRF1 gene. Thus, restrained cell growth depends on a balance between these 2 mutually antagonistic transcription factors Nishio et al. (2001) screened for mutations in the 5-prime flanking and coding regions of IRF2 in patients with atopic dermatitis (see OMIM Ref. No. 603165). They found 5 novel variants and conducted a transmission disequilibrium test in families identified through patients with atopic dermatitis. The data suggested that the IRF2 gene may play a role in the development of atopic dermatitis in Japanese Ko et al. (2002) noted that Irf1 -/- mice are deficient in Inos (OMIM Ref. No. 163730), Il12b (OMIM Ref. No. 161561), Cd8-positive T cells, and natural killer (NK) cells, whereas Irf2 -/- mice are deficient in NK cells and have dysregulated Il12b induction. Icsbp (OMIM Ref. No. 601565) -/- mice are deficient in Il12b, Irf2, and reactive oxygen intermediates (ROIs). All 3 are inducible by gamma-interferon (Ifng; 147570) and have varying susceptibility to different intracellular bacterial and protozoan pathogens. Ko et al. (2002) determined that Irf1 -/- mice are highly susceptible to fatal liver damage from Brucella abortus, the causative agent of brucellosis, which manifests as arthritis, endocarditis, and meningitis in human S. In contrast, Irf2 -/- mice are highly resistant to Brucella, whereas Icsbp -/- mice maintain a plateau of infection similar to that seen in Il12b -/- mice. The authors concluded that IL12, reactive nitrogen intermediates, and ROIs are probably crucial immune components in resistance to Brucella infection Animal model experiments lend further support to the function of IRF2. Hida et al. (2000) observed that Irf2 -/- mice exhibited progressive cutaneous inflammation accompanied by hair loss and ulcer formation. Histopathologic analysis demonstrated epidermal thickening with proliferating keratinocytes expressing Icam1/Cd54 (OMIM Ref. No. 147840), features similar to those found in psoriasis. In addition, however, there was a disorganized muscle layer and prominent fibrosis. In the basal dermis, infiltrating Cd8 (see OMIM Ref. No. 186910)-positive rather than Cd4 (OMIM Ref. No. 186940)-positive T cells were involved in the development of disease. In vitro analysis showed that the Cd8 T cells exhibited prolonged activation and proliferation with high expression of Cd44 (OMIM Ref. No. 107269) and Ly6c. RT-PCR and Northern blot analysis detected spontaneous expression of Ifna (OMIM Ref. No. 147660) and Ifnb (OMIM Ref. No. 147640), as well as overexpression of IFN-inducible genes, i.e., Oas (see OMIM Ref. No. 603351), Irf7 (OMIM Ref. No. 605047), Ip10 (SCYB10; 147310), and Mig (SCYB9; 601704), in the Irf2 -/- mice. Inactivation of the Ifna/Ifnb pathways by mutating Ifnar1 (OMIM Ref. No. 107450) or Irf9 resulted in the absence of skin disease in Irf2 -/- mice.

It is appreciated that the abovementioned animal model for IRF2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ko, J.; Gendron-Fitzpatrick, A.; Splitter, G. A.: Susceptibility of IFN regulatory factor-1 and IFN consensus sequence binding protein-deficient mice to brucellosis. J. Immun. 168: 2433-2440, 2002; and Nishio, Y.; Noguchi, E.; Ito, S.; Ichikawa, E.; Umebayashi, Y.; Otsuka, F.; Arinami, T.: Mutation and association analysis of the interferon regulatory factor 2 gene (IRF2) with atopic.

Further studies establishing the function and utilities of IRF2 are found in John Hopkins OMIM database record ID 147576, and in sited publications numbered 3397-3399, 339 and 3400 listed in the bibliography section hereinbelow, which are also hereby incorporated by reference. Sal-like 1 (Drosophila) (SALL1, Accession NM_002968) is another VGAM511 host target gene. SALL1 BINDING SITE is HOST TARGET binding site found in the 3' untranslated region of mRNA encoded by SALL1, corresponding to a HOST TARGET binding site such as BINDING SITE I, BINDING SITE II or BINDING SITE III. Table 2 illustrates the complementarity of the nucleotide sequences of SALL1 BINDING SITE, designated SEQ ID:8879, to the nucleotide sequence of VGAM511 RNA, herein designated VGAM RNA, also designated SEQ ID:3222.

Another function of VGAM511 is therefore inhibition of Sal-like 1 (Drosophila) (SALL1, Accession NM_002968). Accordingly, utilities of VGAM511 include diagnosis, prevention and treatment of diseases and clinical conditions associated with SALL1. DKFZP547L112 (Accession XM_039353) is another VGAM511 host target gene. DKFZP547L112 BINDING SITE is HOST TARGET binding site found in the 5' untranslated region of mRNA encoded by DKFZP547L112, corresponding to a HOST TARGET binding site such as BINDING SITE I, BINDING SITE II or BINDING SITE III. Table 2 illustrates the complementarity of the nucleotide sequences of DKFZP547L112 BINDING SITE, designated SEQ ID:33056, to the nucleotide sequence of VGAM511 RNA, herein designated VGAM RNA, also designated SEQ ID:3222.

Another function of VGAM511 is therefore inhibition of DKFZP547L112 (Accession XM_039353). Accordingly, utilities of VGAM511 include diagnosis, prevention and treatment of diseases and clinical conditions associated with DKFZP547L112. Tripartite Motif-containing 2 (TRIM2, Accession NM_015271) is another VGAM511 host target gene. TRIM2 BINDING SITE is HOST TARGET binding site found in the 3' untranslated region of mRNA encoded by TRIM2, corresponding to a HOST TARGET binding site such as BINDING SITE I, BINDING SITE II or BINDING SITE III. Table 2 illustrates the complementarity of the nucleotide sequences of TRIM2 BINDING SITE, designated SEQ ID:17596, to the nucleotide sequence of VGAM511 RNA, herein designated VGAM RNA, also designated SEQ ID:3222.

Another function of VGAM511 is therefore inhibition of Tripartite Motif-containing 2 (TRIM2, Accession NM_015271). Accordingly, utilities of VGAM511 include diagnosis, prevention and treatment of diseases and clinical conditions associated with TRIM2. LOC161403 (Accession XM_090873) is another VGAM511 host target gene. LOC161403 BINDING SITE is HOST TARGET binding site found in the 5' untranslated region of mRNA encoded by LOC161403, corresponding to a HOST TARGET binding site such as BINDING SITE I, BINDING SITE II or BINDING SITE III. Table 2 illustrates the complementarity of the nucleotide sequences of LOC161403 BINDING SITE, designated SEQ ID:40019, to the nucleotide sequence of VGAM511 RNA, herein designated VGAM RNA, also designated SEQ ID:3222.

Another function of VGAM511 is therefore inhibition of LOC161403 (Accession XM_090873). Accordingly, utilities of VGAM511 include diagnosis, prevention and treatment of diseases and clinical conditions associated with LOC161403.

LOC199926 (Accession XM_117157) is another VGAM511 host target gene. LOC199926 BINDING SITE is HOST TARGET binding site found in the 3' untranslated region of mRNA encoded by LOC199926, corresponding to a HOST TARGET binding site such as BINDING SITE I, BINDING SITE II or BINDING SITE III. Table 2 illustrates the complementarity of the nucleotide sequences of LOC199926 BINDING SITE, designated SEQ ID:43261, to the nucleotide sequence of VGAM511 RNA, herein designated VGAM RNA, also designated SEQ ID:3222.

Another function of VGAM511 is therefore inhibition of LOC199926 (Accession XM_117157). Accordingly, utilities of VGAM511 include diagnosis, prevention and treatment of diseases and clinical conditions associated with LOC199926. LOC202316 (Accession XM_117380) is another VGAM511 host target gene. LOC202316 BINDING SITE is HOST TARGET binding site found in the 3' untranslated region of mRNA encoded by LOC202316, corresponding to a HOST TARGET binding site such as BINDING SITE I, BINDING SITE II or BINDING SITE III. Table 2 illustrates the complementarity of the nucleotide sequences of LOC202316 BINDING SITE, designated SEQ ID:43426, to the nucleotide sequence of VGAM511 RNA, herein designated VGAM RNA, also designated SEQ ID:3222.

Another function of VGAM511 is therefore inhibition of LOC202316 (Accession XM_117380). Accordingly, utilities of VGAM511 include diagnosis, prevention and treatment of diseases and clinical conditions associated with LOC202316. FIG. 1 further provides a conceptual description of a novel bioinformatically detected viral gene of the present invention, referred to here as Viral Genomic Address Messenger 512 (VGAM512) viral gene, which modulates expression of respective host target genes thereof, the function and utility of which host target genes is known in the art.

VGAM512 is a novel bioinformatically detected regulatory, non protein coding, viral micro RNA (miRNA) gene. The method by which VGAM512 was detected is described hereinabove with reference to FIGS. 1-8.

VGAM512 gene, herein designated VGAM GENE, is a viral gene contained in the genome of Cucumber Green Mottle Mosaic Virus. VGAM512 host target gene, herein designated VGAM HOST TARGET GENE, is a human gene contained in the human genome.

VGAM512 gene encodes a VGAM512 precursor RNA, herein designated VGAM PRECURSOR RNA. Similar to other miRNA genes, and unlike most ordinary genes, VGAM512 precursor RNA does not encode a protein. A nucleotide sequence identical or highly similar to the nucleotide sequence of VGAM512 precursor RNA is designated SEQ ID:498, and is provided hereinbelow with reference to the sequence listing part. Nucleotide sequence SEQ ID:498 is located at position 2385 relative to the genome of Cucumber Green Mottle Mosaic Virus.

VGAM512 precursor RNA folds onto itself, forming VGAM512 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM512 folded precursor RNA into VGAM512 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 86%) nucleotide sequence of VGAM512 RNA is designated SEQ ID:3223, and is provided hereinbelow with reference to the sequence listing part.

VGAM512 host target gene, herein designated VGAM HOST TARGET GENE, encodes a corresponding messenger RNA, VGAM512 host target RNA, herein designated VGAM HOST TARGET RNA. VGAM512 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM512 RNA, herein designated VGAM RNA, binds complementarily to one or more host target binding sites located in untranslated regions of VGAM512 host target RNA, herein designated VGAM HOST TARGET RNA. This complementary binding is due to the fact that the nucleotide sequence of VGAM512 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM512 RNA, herein designated VGAM RNA, may have a different number of host target binding sites in untranslated regions of a VGAM512 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM512 RNA, herein designated VGAM RNA, to host target binding sites on VGAM512 host target RNA, herein designated VGAM HOST TARGET RNA, such as BINDING SITE I, BINDING SITE II and BINDING SITE III, inhibits translation of VGAM512 host target RNA into VGAM512 host target protein, herein designated VGAM HOST TARGET PROTEIN. VGAM host target protein is therefore outlined by a broken line.

It is appreciated that VGAM512 host target gene, herein designated VGAM HOST TARGET GENE, in fact represents a plurality of VGAM512 host target genes. The mRNA of each one of this plurality of VGAM512 host target genes comprises one or more host target binding sites, each having a nucleotide sequence which is at least partly complementary to VGAM512 RNA, herein designated VGAM RNA, and which when bound by VGAM512 RNA causes inhibition of translation of respective one or more VGAM512 host target proteins.

It is further appreciated by one skilled in the art that the mode of translational inhibition illustrated by FIG. 1 with specific reference to translational inhibition exerted by VGAM512 gene, herein designated VGAM GENE, on one or more VGAM512 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM512 is inhibition of expression of host target genes, as part of a novel viral mechanism of attacking a host. Accordingly, utilities of VGAM512 include diagnosis, prevention and treatment of viral infection by Cucumber Green Mottle Mosaic Virus. Specific functions, and accordingly utilities, of VGAM512 correlate with, and may be deduced from, the identity of the host target genes which VGAM512 binds and inhibits, and the function of these host target genes, as elaborated hereinbelow.

Nucleotide sequences of the VGAM512 precursor RNA, herein designated VGAM PRECURSOR RNA, and of the 'diced' VGAM512 RNA, herein designated VGAM RNA, and a schematic representation of the secondary folding of VGAM512 folded precursor RNA, herein designated VGAM FOLDED PRECURSOR RNA, of VGAM512 are further described hereinbelow with reference to Table 1.

Nucleotide sequences of host target binding sites, such as BINDING SITE-I, BINDING SITE-II and BINDING SITE-III of FIG. 1, found on VGAM512 host target RNA, and schematic representation of the complementarity of each of these host target binding sites to VGAM512 RNA, herein designated VGAM RNA, are described hereinbelow with reference to Table 2.

As mentioned hereinabove with reference to FIG. 1, a function of VGAM512 gene, herein designated VGAM is inhibition of expression of VGAM512 target genes. It is appreciated that specific functions, and accordingly utilities, of VGAM512 correlate with, and may be deduced from, the identity of the target genes which VGAM512 binds and inhibits, and the function of these target genes, as elaborated hereinbelow.

RAB1A, Member RAS Oncogene Family (RAB1A, Accession XM_046674) is a VGAM512 host target gene. RAB1A BINDING SITE is HOST TARGET binding site found in the 3' untranslated region of mRNA encoded by RAB1A, corresponding to a HOST TARGET binding site such as BINDING SITE I, BINDING SITE II or BINDING SITE III. Table 2 illustrates the complementarity of the nucleotide sequences of RAB1A BINDING SITE, designated SEQ ID:34787, to the nucleotide sequence of VGAM512 RNA, herein designated VGAM RNA, also designated SEQ ID:3223.

A function of VGAM512 is therefore inhibition of RAB1A, Member RAS Oncogene Family (RAB1A, Accession XM_046674), a gene which is involved in vesicle transport. Accordingly, utilities of VGAM512 include diagnosis, prevention and treatment of diseases and clinical conditions associated with RAB1A. The function of RAB1A and its association with various diseases and clinical conditions, has been established by previous studies, as described hereinabove with reference to VGAM433. FIG. 1 further provides a conceptual description of a novel bioinformatically detected viral gene of the present invention, referred to here as Viral Genomic Address Messenger 513 (VGAM513) viral gene, which modulates expression of respective host target genes thereof, the function and utility of which host target genes is known in the art.

VGAM513 is a novel bioinformatically detected regulatory, non protein coding, viral micro RNA (miRNA) gene. The method by which VGAM513 was detected is described hereinabove with reference to FIGS. 1-8.

VGAM513 gene, herein designated VGAM GENE, is a viral gene contained in the genome of Cucumber Green Mottle Mosaic Virus. VGAM513 host target gene, herein designated VGAM HOST TARGET GENE, is a human gene contained in the human genome.

VGAM513 gene encodes a VGAM513 precursor RNA, herein designated VGAM PRECURSOR RNA. Similar to other miRNA genes, and unlike most ordinary genes, VGAM513 precursor RNA does not encode a protein. A nucleotide sequence identical or highly similar to the nucleotide sequence of VGAM513 precursor RNA is designated SEQ ID:499, and is provided hereinbelow with reference to the sequence listing part. Nucleotide sequence SEQ ID:499 is located at position 2231 relative to the genome of Cucumber Green Mottle Mosaic Virus.

VGAM513 precursor RNA folds onto itself, forming VGAM513 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM513 folded precursor RNA into VGAM513 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM513 RNA is designated SEQ ID:3224, and is provided hereinbelow with reference to the sequence listing part.

VGAM513 host target gene, herein designated VGAM HOST TARGET GENE, encodes a corresponding messenger RNA, VGAM513 host target RNA, herein designated VGAM HOST TARGET RNA. VGAM513 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM513 RNA, herein designated VGAM RNA, binds complementarily to one or more host target binding sites located in untranslated regions of VGAM513 host target RNA, herein designated VGAM HOST TARGET RNA. This complementary binding is due to the fact that the nucleotide sequence of VGAM513 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM513 RNA, herein designated VGAM RNA, may have a different number of host target binding sites in untranslated regions of a VGAM513 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM513 RNA, herein designated VGAM RNA, to host target binding sites on VGAM513 host target RNA, herein designated VGAM HOST TARGET RNA, such as BINDING SITE I, BINDING SITE II and BINDING SITE III, inhibits translation of VGAM513 host target RNA into VGAM513 host target protein, herein designated VGAM HOST TARGET PROTEIN.

VGAM host target protein is therefore outlined by a broken line.

It is appreciated that VGAM513 host target gene, herein designated VGAM HOST TARGET GENE, in fact represents a plurality of VGAM513 host target genes. The mRNA of each one of this plurality of VGAM513 host target genes comprises one or more host target binding sites, each having a nucleotide sequence which is at least partly complementary to VGAM513 RNA, herein designated VGAM RNA, and which when bound by VGAM513 RNA causes inhibition of translation of respective one or more VGAM513 host target proteins.

It is further appreciated by one skilled in the art that the mode of translational inhibition illustrated by FIG. 1 with specific reference to translational inhibition exerted by VGAM513 gene, herein designated VGAM GENE, on one or more VGAM513 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM513 is inhibition of expression of host target genes, as part of a novel viral mechanism of attacking a host. Accordingly, utilities of VGAM513 include diagnosis, prevention and treatment of viral infection by Cucumber Green Mottle Mosaic Virus. Specific functions, and accordingly utilities, of VGAM513 correlate with, and may be deduced from, the identity of the host target genes which VGAM513 binds and inhibits, and the function of these host target genes, as elaborated hereinbelow.

Nucleotide sequences of the VGAM513 precursor RNA, herein designated VGAM PRECURSOR RNA, and of the 'diced' VGAM513 RNA, herein designated VGAM RNA, and a schematic representation of the secondary folding of VGAM513 folded precursor RNA, herein designated VGAM FOLDED PRECURSOR RNA, of VGAM514 are further described hereinbelow with reference to Table 1.

Nucleotide sequences of host target binding sites, such as BINDING SITE-I, BINDING SITE-II and BINDING SITE-III of FIG. 1, found on VGAM513 host target RNA, and schematic representation of the complementarity of each of these host target binding sites to VGAM513 RNA, herein designated VGAM RNA, are described hereinbelow with reference to Table 2.

As mentioned hereinabove with reference to FIG. 1, a function of VGAM513 gene, herein designated VGAM is inhibition of expression of VGAM513 target genes. It is appreciated that specific functions, and accordingly utilities, of VGAM513 correlate with, and may be deduced from, the identity of the target genes which VGAM513 binds and inhibits, and the function of these target genes, as elaborated hereinbelow.

LAG1 Longevity Assurance Homolog 2 (S. cerevisiae) (LASS2, Accession XM_041889) is a VGAM513 host target gene. LASS2 BINDING SITE is HOST TARGET binding site found in the 3' untranslated region of mRNA encoded by LASS2, corresponding to a HOST TARGET binding site such as BINDING SITE I, BINDING SITE II or BINDING SITE III. Table 2 illustrates the complementarity of the nucleotide sequences of LASS2 BINDING SITE, designated SEQ ID:33623, to the nucleotide sequence of VGAM513 RNA, herein designated VGAM RNA, also designated SEQ ID:3224.

A function of VGAM513 is therefore inhibition of LAG1 Longevity Assurance Homolog 2 (S. cerevisiae) (LASS2, Accession XM_041889). Accordingly, utilities of VGAM513 include diagnosis, prevention and treatment of diseases and clinical conditions associated with LASS2. FLJ14249 (Accession NM_022460) is another VGAM513 host target gene. FLJ14249 BINDING SITE1 and FLJ14249 BINDING SITE2 are HOST TARGET binding sites found in untranslated regions of mRNA encoded by FLJ14249, corresponding to HOST TARGET binding sites such as BINDING SITE I, BINDING SITE II or BINDING SITE III. Table 2 illustrates the complementarity of the nucleotide sequences of FLJ14249 BINDING SITE1 and FLJ14249 BINDING SITE2, designated SEQ ID:22798 and SEQ ID:28168 respectively, to the nucleotide sequence of VGAM513 RNA, herein designated VGAM RNA, also designated SEQ ID:3224.

Another function of VGAM513 is therefore inhibition of FLJ14249 (Accession NM_022460). Accordingly, utilities of VGAM513 include diagnosis, prevention and treatment of diseases and clinical conditions associated with FLJ14249. LOC149103 (Accession XM_086434) is another VGAM513 host target gene. LOC149103 BINDING SITE is HOST TARGET binding site found in the 3' untranslated region of mRNA encoded by LOC149103, corresponding to a HOST TARGET binding site such as BINDING SITE I, BINDING SITE II or BINDING SITE III. Table 2 illustrates the complementarity of the nucleotide sequences of LOC149103 BINDING SITE, designated SEQ ID:38652, to the nucleotide sequence of VGAM513 RNA, herein designated VGAM RNA, also designated SEQ ID:3224.

Another function of VGAM513 is therefore inhibition of LOC149103 (Accession XM_086434). Accordingly, utilities of VGAM513 include diagnosis, prevention and treatment of diseases and clinical conditions associated with LOC149103.

FIG. 1 further provides a conceptual description of a novel bioinformatically detected viral gene of the present invention, referred to here as Viral Genomic Address Messenger 514 (VGAM514) viral gene, which modulates expression of respective host target genes thereof, the function and utility of which host target genes is known in the art.

VGAM514 is a novel bioinformatically detected regulatory, non protein coding, viral micro RNA (miRNA) gene. The method by which VGAM514 was detected is described hereinabove with reference to FIGS. 1-8.

VGAM514 gene, herein designated VGAM GENE, is a viral gene contained in the genome of Cucumber Green Mottle Mosaic Virus. VGAM514 host target gene, herein designated VGAM HOST TARGET GENE, is a human gene contained in the human genome.

VGAM514 gene encodes a VGAM514 precursor RNA, herein designated VGAM PRECURSOR RNA. Similar to other miRNA genes, and unlike most ordinary genes, VGAM514 precursor RNA does not encode a protein. A nucleotide sequence identical or highly similar to the nucleotide sequence of VGAM514 precursor RNA is designated SEQ ID:500, and is provided hereinbelow with reference to the sequence listing part. Nucleotide sequence SEQ ID:500 is located at position 1818 relative to the genome of Cucumber Green Mottle Mosaic Virus.

VGAM514 precursor RNA folds onto itself, forming VGAM514 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM514 folded precursor RNA into VGAM514 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM514 RNA is designated SEQ ID:3225, and is provided hereinbelow with reference to the sequence listing part.

VGAM514 host target gene, herein designated VGAM HOST TARGET GENE, encodes a corresponding messenger RNA, VGAM514 host target RNA, herein designated VGAM HOST TARGET RNA. VGAM514 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM514 RNA, herein designated VGAM RNA, binds complementarily to one or more host target binding sites located in untranslated regions of VGAM514 host target RNA, herein designated VGAM HOST TARGET RNA. This complementary binding is due to the fact that the nucleotide sequence of VGAM514 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM514 RNA, herein designated VGAM RNA, may have a different number of host target binding sites in untranslated regions of a VGAM514 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM514 RNA, herein designated VGAM RNA, to host target binding sites on VGAM514 host target RNA, herein designated VGAM HOST TARGET RNA, such as BINDING SITE I, BINDING SITE II and BINDING SITE III, inhibits translation of VGAM514 host target RNA into VGAM514 host target protein, herein designated VGAM HOST TARGET PROTEIN. VGAM host target protein is therefore outlined by a broken line.

It is appreciated that VGAM514 host target gene, herein designated VGAM HOST TARGET GENE, in fact represents a plurality of VGAM514 host target genes. The mRNA of each one of this plurality of VGAM514 host target genes comprises one or more host target binding sites, each having a nucleotide sequence which is at least partly complementary to VGAM514 RNA, herein designated VGAM RNA, and which when bound by VGAM514 RNA causes inhibition of translation of respective one or more VGAM514 host target proteins.

It is further appreciated by one skilled in the art that the mode of translational inhibition illustrated by FIG. 1 with specific reference to translational inhibition exerted by VGAM514 gene, herein designated VGAM GENE, on one or more VGAM514 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM514 is inhibition of expression of host target genes, as part of a novel viral mechanism of attacking a host. Accordingly, utilities of VGAM514 include diagnosis, prevention and treatment of viral infection by Cucumber Green Mottle Mosaic Virus. Specific functions, and accordingly utilities, of VGAM514 correlate with, and may be deduced from, the identity of the host target genes which VGAM514 binds and inhibits, and the function of these host target genes, as elaborated hereinbelow.

Nucleotide sequences of the VGAM514 precursor RNA, herein designated VGAM PRECURSOR RNA, and of the 'diced' VGAM514 RNA, herein designated VGAM RNA, and a schematic representation of the secondary folding of VGAM514 folded precursor RNA, herein designated VGAM FOLDED PRECURSOR RNA, of VGAM514 are further described hereinbelow with reference to Table 1.

Nucleotide sequences of host target binding sites, such as BINDING SITE-I, BINDING SITE-II and BINDING SITE-III of FIG. 1, found on VGAM514 host target RNA, and schematic representation of the complementarity of each of these host target binding sites to VGAM514 RNA, herein designated VGAM RNA, are described hereinbelow with reference to Table 2.

As mentioned hereinabove with reference to FIG. 1, a function of VGAM514 gene, herein designated VGAM is inhibition of expression of VGAM514 target genes. It is appreciated that specific functions, and accordingly utilities, of VGAM514 correlate with, and may be deduced from, the identity of the target genes which VGAM514 binds and inhibits, and the function of these target genes, as elaborated hereinbelow.

Galanin (GAL, Accession XM_166189) is a VGAM514 host target gene. GAL BINDING SITE is HOST TARGET binding site found in the 5' untranslated region of mRNA encoded by GAL, corresponding to a HOST TARGET binding site such as BINDING SITE I, BINDING SITE II or BINDING SITE III. Table 2 illustrates the complementarity of the nucleotide sequences of GAL BINDING SITE, designated SEQ ID:43998, to the nucleotide sequence of VGAM514 RNA, herein designated VGAM RNA, also designated SEQ ID:3225.

A function of VGAM514 is therefore inhibition of Galanin (GAL, Accession XM_166189), a gene which stimulates LH secretion and enhances LHRH-induced LH release from dispersed anterior pituitary cells in vitro. Accordingly, utilities of VGAM514 include diagnosis, prevention and treatment of diseases and clinical conditions associated with GAL. The function of GAL has been established by previous studies. Galanin is a 29-amino acid peptide widely distributed in the peripheral and central nervous systems. In the brain, the highest concentrations are observed in the hypothalamus and particularly in the nerve terminals of the median eminence. Since the establishment of the neurovascular concept in the regulation of the hypothalamus-pituitary axis (Harris, 1948), it is well known that the median eminence represents a key area for neuroendocrine regulation. Hypothalamic releasing and inhibiting factors are secreted from median eminence terminals into the portal circulation to reach the adenohypophyseal cells where they exert specific actions. Lopez et al. (1991) presented evidence that galanin meets the criteria to be considered a hypothalamic-hypophysiotropic hormone. They found a possibly meaningful colocalization and cosecretion of galanin and LHRH (OMIM Ref. No. 152760). Galanin stimulates LH secretion and enhances LHRH-induced LH release from dispersed anterior pituitary cells in vitro. Galanin is important to gastrointestinal function also (Rattan, 1991). Animal model experiments lend further support to the function of GAL. The neuropeptide galanin is predominantly expressed by the lactotrophs (the prolactin-secreting cell type) in the rodent anterior pituitary and in the median eminence and paraventricular nucleus of the hypothalamus. Prolactin (PRL; 176760) and galanin colocalize in the same secretory granule, and the expression of both proteins is extremely sensitive to the estrogen status of the animal. Administration of estradiol-17-beta induces pituitary hyperplasia followed by adenoma formation and causes a 3,000-fold increase in the galanin mRNA content of the lactotroph. To further study the role of galanin in prolactin release and lactotroph growth, Wynick et al. (1998) generated mice carrying a loss-of-function mutation of the endogenous galanin gene. There was no evidence of embryonic lethality and the mutant mice grew normally. The specific endocrine abnormalities identified related to the expression of prolactin. Pituitary prolactin message levels and protein content of adult female mutant mice were reduced by 30 to 40% compared with wildtype controls. Mutant females failed to lactate and pups died of starvation/dehydration unless fostered onto wildtype mothers. Prolactin secretion in mutant females was markedly reduced at 7 days postpartum compared with wildtype controls with an associated failure in mammary gland maturation. There was almost complete abrogation of the proliferative response of the lactotroph to high doses of estrogen, with a failure to upregulate prolactin release and STAT5 (OMIM Ref. No. 601511) expression or to increase pituitary cell number. These data supported the hypothesis that galanin acts as a paracrine regulator of prolactin expression and as a growth factor to the lactotroph.

It is appreciated that the abovementioned animal model for GAL is acknowledged by those skilled in the art as a scientifically valid animal model, as can be further appreciated from the publications sited hereinbelow.

Full details of the abovementioned studies are described in the following publications, the disclosure of which are hereby incorporated by reference:

Wynick, D.; Small, C. J.; Bacon, A.; Holmes, F. E.; Norman, M.; Ormandy, C. J.; Kilic, E.; Kerr, N. C. H.; Ghatei, M.; Talamantes, F.; Bloom, S. R.; Pachnis, V.: Galanin regulates prolactin release and lactotroph proliferation. Proc. Nat. Acad. Sci. 95:12671-12676, 1998; and Lopez, F. J.; Merchenthaler, I.; Ching, M.; Wisniewski, M. G.; Negro-Vilar, A.: Galanin: a hypothalamic-hypophysiotropic hormone modulating reproductive functions. Proc. Nat. Acad. Sci.

Further studies establishing the function and utilities of GAL are found in John Hopkins OMIM database record ID 137035, and in sited publications numbered 4054-4065 listed in the bibliography section hereinbelow, which are also hereby incorporated by reference. Potassium Channel, Subfamily K, Member 4 (KCNK4, Accession NM_016611) is another VGAM514 host target gene. KCNK4 BINDING SITE is HOST TARGET binding site found in the 3' untranslated region of mRNA encoded by KCNK4, corresponding to a HOST TARGET binding site such as BINDING SITE I, BINDING SITE II or BINDING SITE III. Table 2 illustrates the complementarity of the nucleotide sequences of KCNK4 BINDING SITE, designated SEQ ID:18714, to the nucleotide sequence of VGAM514 RNA, herein designated VGAM RNA, also designated SEQ ID:3225.

Another function of VGAM514 is therefore inhibition of Potassium Channel, Subfamily K, Member 4 (KCNK4, Accession NM_016611). Accordingly, utilities of VGAM514 include diagnosis, prevention and treatment of diseases and clinical conditions associated with KCNK4. LIM Domain Kinase 1 (LIMK1, Accession NM_016735) is another VGAM514 host target gene. LIMK1 BINDING SITE is HOST TARGET binding site found in the 3' untranslated region of mRNA encoded by LIMK1, corresponding to a HOST TARGET binding site such as BINDING SITE I, BINDING SITE II or BINDING SITE III. Table 2 illustrates the complementarity of the nucleotide sequences of LIMK1 BINDING SITE, designated SEQ ID:18798, to the nucleotide sequence of VGAM514 RNA, herein designated VGAM RNA, also designated SEQ ID:3225.

Another function of VGAM514 is therefore inhibition of LIM Domain Kinase 1 (LIMK1, Accession NM_016735). Accordingly, utilities of VGAM514 include diagnosis, prevention and treatment of diseases and clinical conditions associated with LIMK1. Matrix Metalloproteinase 25 (MMP25, Accession NM_022468) is another VGAM514 host target gene. MMP25 BINDING SITE is HOST TARGET binding site found in the 3' untranslated region of mRNA encoded by MMP25, corresponding to a HOST TARGET binding site such as BINDING SITE I, BINDING SITE II or BINDING SITE III. Table 2 illustrates the complementarity of the nucleotide sequences of MMP25 BINDING SITE, designated SEQ ID:22821, to the nucleotide sequence of VGAM514 RNA, herein designated VGAM RNA, also designated SEQ ID:3225.

Another function of VGAM514 is therefore inhibition of Matrix Metalloproteinase 25 (MMP25, Accession NM_022468). Accordingly, utilities of VGAM514 include diagnosis, prevention and treatment of diseases and clinical conditions associated with MMP25. MLL Sep.in-like Fusion (MSF, Accession XM_113892) is another VGAM514 host target gene. MSF BINDING SITE is HOST TARGET binding site found in the 3' untranslated region of mRNA encoded by MSF, corresponding to a HOST TARGET binding site such as BINDING SITE I, BINDING SITE II or BINDING SITE III. Table 2 illustrates the complementarity of the nucleotide sequences of MSF BINDING SITE, designated SEQ ID:42521, to the nucleotide sequence of VGAM514 RNA, herein designated VGAM RNA, also designated SEQ ID:3225.

Another function of VGAM514 is therefore inhibition of MLL Sep.in-like Fusion (MSF, Accession XM_113892), a gene which plays a role in the cell cycle. Accordingly, utilities of VGAM514 include diagnosis, prevention and treatment of diseases and clinical conditions associated with MSF. The function of MSF has been established by previous studies. Bahabri et al. (1998) mapped the locus for autosomal recessive camptodactyly-arthropathy-coxa vara-pericarditis syndrome (CACP; 208250) to chromosome 1q25-q31. Marcelino et al. (1999) independently identified the CACP gene using a positional cloning approach. They determined that the MSF and CACP genes are the same. Analysis of a human multitissue Northern blot demonstrated that the 4.5-kb CACP mRNA is expressed in tissues including liver, lung, and heart. It is highly expressed in synovial tissue. The 30-kD N-terminal megakaryocyte-stimulating factor fragment was detectable in serum and urine. Marcelino et al. (1999) identified 8 likely disease-causing mutations in patients with CACP from consanguineous families. Four were homozygous deletions. Additionally, they detected a dinucleotide transversion that created a nonsense codon, and a 41-bp insertion 14 nucleotides upstream of the intron 6 splice acceptor site that disrupted the polypyrimidine tract of the splice site. Each of these mutations was predicted to result in a truncated protein. Due to its high glycosylation content and mucin-like repeats, Marcelino et al. (1999) suggested that CACP may act as a joint/intimal cell lubricant. Both synovial and pericardial cell hyperplasia may represent secondary consequences of insufficient cell surface lubrication. Alternatively, cell overgrowth may be primary to the pathogenesis of CACP. The occurrence of multiple small ganglion cysts in 2 unrelated patients, and of coxa vara deformity in this disorder, suggested a regulatory role for the CACP protein product to Marcelino et al. (1999).

Full details of the abovementioned studies are described in the following publications, the disclosure of which are hereby incorporated by reference:

Bahabri, S. A.; Suwairi, W. M.; Laxer, R. M.; Polinkovsky, A.; Dalaan, A. A.; Warman, M. L.: The camptodactyly-arthropathy-coxa vara-pericarditis syndrome: clinical features and genetic mapping to human chromosome 1. Arthritis Rheum. 41:730-735, 1998; and Marcelino, J.; Carpten, J. D.; Suwairi, W. M.; Gutierrez, O. M.; Schwartz, S.; Robbins, C.; Sood, R.; Makalowska, I.; Baxevanis, A.; Johnstone, B.; Laxer, R. M.; Zemel, L.; and 13 other.

Further studies establishing the function and utilities of MSF are found in John Hopkins OMIM database record ID 604283, and in sited publications numbered 2073, 7617-7618, 207 and 7619-7620 listed in the bibliography section hereinbelow, which are also hereby incorporated by reference. PTK7 Protein Tyrosine Kinase 7 (PTK7, Accession NM_002821) is another VGAM514 host target gene. PTK7 BINDING SITE is HOST TARGET binding site found in the 3' untranslated region of mRNA encoded by PTK7, corresponding to a HOST TARGET binding site such as BINDING SITE I, BINDING SITE II or BINDING SITE III. Table 2 illustrates the complementarity of the nucleotide sequences of PTK7 BINDING SITE, designated SEQ ID:8688, to the nucleotide sequence of VGAM514 RNA, herein designated VGAM RNA, also designated SEQ ID:3225.

Another function of VGAM514 is therefore inhibition of PTK7 Protein Tyrosine Kinase 7 (PTK7, Accession NM_002821), a gene which is a glycosylated receptor protein tyrosine kinase and may function as a cell adhesion molecule. Accordingly, utilities of VGAM514 include diagnosis, prevention and treatment of diseases and clinical conditions associated with PTK7. The function of PTK7 has been established by previous studies. Protein-tyrosine kinases (PTKs) play important roles in regulating cell proliferation and differentiation during development. Lee et al. (1993) isolated a 220-bp fragment of PTK7 cDNA through a screen designed to identify tyrosine kinase mRNAs expressed in normal human melanocytes. This fragment was mapped to chromosome 6 by Southern blotting using a panel of human-hamster somatic cell hybrids. Park et al. (1996) isolated a full-length PTK7 cDNA and found that it encodes a receptor protein-tyrosine kinase-like molecule closely related to a chick kinase-like gene whose function was unknown. Mossie et al. (1995) independently isolated the PTK7 gene from colon carcinoma and designated it colon carcinoma kinase-4. Banga et al. (1997) sublocalized the PTK7 gene to 6p21.1-p12.2 by fluorescence in situ hybridization.

Full details of the abovementioned studies are described in the following publications, the disclosure of which are hereby incorporated by reference:

Lee, S.-T.; Strunk, K. M.; Spritz, R. A.: A survey of protein tyrosine kinase mRNAs expressed in normal human melanocytes. Oncogene 8:3403-3410, 1993; and Park, S.-K.; Lee, H.-S.; Lee, S.-T.: Characterization of the human full-length PTK7 cDNA encoding a receptor protein tyrosine kinase-like molecule closely related to chick KLG. J. Bioch.

Further studies establishing the function and utilities of PTK7 are found in John Hopkins OMIM database record ID 601890, and in sited publications numbered 6703-6706 listed in the bibliography section hereinbelow, which are also hereby incorporated by reference. Ring Finger Protein 4 (RNF4, Accession NM_002938) is another VGAM514 host target gene. RNF4 BINDING SITE is HOST TARGET binding site found in the 3' untranslated region of mRNA encoded by RNF4, corresponding to a HOST TARGET binding site such as BINDING SITE I, BINDING SITE II or BINDING SITE III. Table 2 illustrates the complementarity of the nucleotide sequences of RNF4 BINDING SITE, designated SEQ ID:8840, to the nucleotide sequence of VGAM514 RNA, herein designated VGAM RNA, also designated SEQ ID:3225.

Another function of VGAM514 is therefore inhibition of Ring Finger Protein 4 (RNF4, Accession NM_002938). Accordingly, utilities of VGAM514 include diagnosis, prevention and treatment of diseases and clinical conditions associated with RNF4. Solute Carrier Family 8 (sodium-calcium exchanger), Member 2 (SLC8A2, Accession XM_038970) is another VGAM514 host target gene. SLC8A2 BINDING SITE is HOST TARGET binding site found in the 3' untranslated region of mRNA encoded by SLC8A2, corresponding to a HOST TARGET binding site such as BINDING SITE I, BINDING SITE II or BINDING SITE III. Table 2 illustrates the complementarity of the nucleotide sequences of SLC8A2 BINDING SITE, designated SEQ ID:32967, to the nucleotide sequence of VGAM514 RNA, herein designated VGAM RNA, also designated SEQ ID:3225.

Another function of VGAM514 is therefore inhibition of Solute Carrier Family 8 (sodium-calcium exchanger), Member 2 (SLC8A2, Accession XM_038970). Accordingly, utilities of VGAM514 include diagnosis, prevention and treatment of diseases and clinical conditions associated with SLC8A2. DKFZP727G051 (Accession XM_045308) is another VGAM514 host target gene. DKFZP727G051 BINDING SITE is HOST TARGET binding site found in the 3' untranslated region of mRNA encoded by DKFZP727G051, corresponding to a HOST TARGET binding site such as BINDING SITE I, BINDING SITE II or BINDING SITE III. Table 2 illustrates the complementarity of the nucleotide sequences of DKFZP727G051 BINDING SITE, designated SEQ ID:34429, to the nucleotide sequence of VGAM514 RNA, herein designated VGAM RNA, also designated SEQ ID:3225.

Another function of VGAM514 is therefore inhibition of DKFZP727G051 (Accession XM_045308). Accordingly, utilities of VGAM514 include diagnosis, prevention and treatment of diseases and clinical conditions associated with DKFZP727G051. FLJ00007 (Accession XM_048928) is another VGAM514 host target gene. FLJ00007 BINDING SITE is HOST TARGET binding site found in the 3' untranslated region of mRNA encoded by FLJ00007, corresponding to a HOST TARGET binding site such as BINDING SITE I, BINDING SITE II or BINDING SITE III. Table 2 illustrates the complementarity of the nucleotide sequences of FLJ00007 BINDING SITE, designated SEQ ID:35308, to the nucleotide sequence of VGAM514 RNA, herein designated VGAM RNA, also designated SEQ ID:3225.

Another function of VGAM514 is therefore inhibition of FLJ00007 (Accession XM_048928). Accordingly, utilities of VGAM514 include diagnosis, prevention and treatment of diseases and clinical conditions associated with FLJ00007. KIAA0237 (Accession NM_014747) is another VGAM514 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16444, to the nucleotide sequence of VGAM514 RNA, herein designated VGAM RNA, also designated SEQ ID:3225.

Another function of VGAM514 is therefore inhibition of KIAA0237 (Accession NM_014747). Accordingly, utilities of VGAM514 include diagnosis, prevention and treatment of diseases and clinical conditions associated with KIAA0237. KIAA1656 (Accession XM_038022) is another VGAM514 host target gene. KIAA1656 BINDING SITE is HOST TARGET binding site found in the 3' untranslated region of mRNA encoded by KIAA1656, corresponding to a HOST TARGET binding site such as BINDING SITE I, BINDING SITE II or BINDING SITE III. Table 2 illustrates the complementarity of the nucleotide sequences of KIAA1656 BINDING SITE, designated SEQ ID:32728, to the nucleotide sequence of VGAM514 RNA, herein designated VGAM RNA, also designated SEQ ID:3225.

Another function of VGAM514 is therefore inhibition of KIAA1656 (Accession XM_038022). Accordingly, utilities of VGAM514 include diagnosis, prevention and treatment of diseases and clinical conditions associated with KIAA1656. LOC112840 (Accession NM_080666) is another VGAM514 host target gene. LOC112840 BINDING SITE is HOST TARGET binding site found in the 3' untranslated region of mRNA encoded by LOC112840, corresponding to a HOST TARGET binding site such as BINDING SITE I, BINDING SITE II or BINDING SITE III. Table 2 illustrates the complementarity of the nucleotide sequences of LOC112840 BINDING SITE, designated SEQ ID:27956, to the nucleotide sequence of VGAM514 RNA, herein designated VGAM RNA, also designated SEQ ID:3225.

Another function of VGAM514 is therefore inhibition of LOC112840 (Accession NM_080666). Accordingly, utilities of VGAM514 include diagnosis, prevention and treatment of diseases and clinical conditions associated with LOC112840. LOC115207 (Accession NM_138444) is another VGAM514 host target gene. LOC115207 BINDING SITE is HOST TARGET binding site found in the 3' untranslated region of mRNA encoded by LOC115207, corresponding to a HOST TARGET binding site such as BINDING SITE I, BINDING SITE II or BINDING SITE III. Table 2 illustrates the complementarity of the nucleotide sequences of LOC115207 BINDING SITE, designated SEQ ID:28807, to the nucleotide sequence of VGAM514 RNA, herein designated VGAM RNA, also designated SEQ ID:3225.

Another function of VGAM514 is therefore inhibition of LOC115207 (Accession NM_138444). Accordingly, utilities of VGAM514 include diagnosis, prevention and treatment of diseases and clinical conditions associated with LOC115207. LOC147136 (Accession XM_085716) is another VGAM514 host target gene. LOC147136 BINDING SITE is HOST TARGET binding site found in the 3' untranslated region of mRNA encoded by LOC147136, corresponding to a HOST TARGET binding site such as BINDING SITE I, BINDING SITE II or BINDING SITE III. Table 2 illustrates the complementarity of the nucleotide sequences of LOC147136 BINDING SITE, designated SEQ ID:38300, to the nucleotide sequence of VGAM514 RNA, herein designated VGAM RNA, also designated SEQ ID:3225.

Another function of VGAM514 is therefore inhibition of LOC147136 (Accession XM_085716). Accordingly, utilities of VGAM514 include diagnosis, prevention and treatment of diseases and clinical conditions associated with LOC147136. LOC222031 (Accession XM_168371) is another VGAM514 host target gene. LOC222031 BINDING SITE is HOST TARGET binding site found in the 3' untranslated region of mRNA encoded by LOC222031, corresponding to a HOST TARGET binding site such as BINDING SITE I, BINDING SITE II or BINDING SITE III. Table 2 illustrates the complementarity of the nucleotide sequences of LOC222031 BINDING SITE, designated SEQ ID:45131, to the nucleotide sequence of VGAM514 RNA, herein designated VGAM RNA, also designated SEQ ID:3225.

Another function of VGAM514 is therefore inhibition of LOC222031 (Accession XM_168371). Accordingly, utilities of VGAM514 include diagnosis, prevention and treatment of diseases and clinical conditions associated with LOC222031. LOC254556 (Accession XM_170588) is another VGAM514 host target gene. LOC254556 BINDING SITE is HOST TARGET binding site found in the 3' untranslated region of mRNA encoded by LOC254556, corresponding to a HOST TARGET binding site such as BINDING SITE I, BINDING SITE II or BINDING SITE III. Table 2 illustrates the complementarity of the nucleotide sequences of LOC254556 BINDING SITE, designated SEQ ID:45393, to the nucleotide sequence of VGAM514 RNA, herein designated VGAM RNA, also designated SEQ ID:3225.

Another function of VGAM514 is therefore inhibition of LOC254556 (Accession XM_170588). Accordingly, utilities of VGAM514 include diagnosis, prevention and treatment of diseases and clinical conditions associated with LOC254556. LOC257428 (Accession XM_168584) is another VGAM514 host target gene. LOC257428 BINDING SITE is HOST TARGET binding site found in the 5' untranslated region of mRNA encoded by LOC257428, corresponding to a HOST TARGET binding site such as BINDING SITE I, BINDING SITE II or BINDING SITE III. Table 2 illustrates the complementarity of the nucleotide sequences of LOC257428 BINDING SITE, designated SEQ ID:45261, to the nucleotide sequence of VGAM514 RNA, herein designated VGAM RNA, also designated SEQ ID:3225.

Another function of VGAM514 is therefore inhibition of LOC257428 (Accession XM_168584). Accordingly, utilities of VGAM514 include diagnosis, prevention and treatment of diseases and clinical conditions associated with LOC257428. LOC56965 (Accession NM_020213) is another VGAM514 host target gene. LOC56965 BINDING SITE is HOST TARGET binding site found in the 3' untranslated region of mRNA encoded by LOC56965, corresponding to a HOST TARGET binding site such as BINDING SITE I, BINDING SITE II or BINDING SITE III. Table 2 illustrates the complementarity of the nucleotide sequences of LOC56965 BINDING SITE, designated SEQ ID:21451, to the nucleotide sequence of VGAM514 RNA, herein designated VGAM RNA, also designated SEQ ID:3225.

Another function of VGAM514 is therefore inhibition of LOC56965 (Accession NM_020213). Accordingly, utilities of VGAM514 include diagnosis, prevention and treatment of diseases and clinical conditions associated with LOC56965.

FIG. 1 further provides a conceptual description of a novel bioinformatically detected viral gene of the present invention, referred to here as Viral Genomic Address Messenger 515 (VGAM515) viral gene, which modulates expression of respective host target genes thereof, the function and utility of which host target genes is known in the art.

VGAM515 is a novel bioinformatically detected regulatory, non protein coding, viral micro RNA (miRNA) gene. The method by which VGAM515 was detected is described hereinabove with reference to FIGS. 1-8.

VGAM515 gene, herein designated VGAM GENE, is a viral gene contained in the genome of Cucumber Green Mottle Mosaic Virus. VGAM515 host target gene, herein designated VGAM HOST TARGET GENE, is a human gene contained in the human genome.

VGAM515 gene encodes a VGAM515 precursor RNA, herein designated VGAM PRECURSOR RNA. Similar to other miRNA genes, and unlike most ordinary genes, VGAM515 precursor RNA does not encode a protein. A nucleotide sequence identical or highly similar to the nucleotide sequence of VGAM515 precursor RNA is designated SEQ ID:501, and is provided hereinbelow with reference to the sequence listing part. Nucleotide sequence SEQ ID:501 is located at position 4400 relative to the genome of Cucumber Green Mottle Mosaic Virus.

VGAM515 precursor RNA folds onto itself, forming VGAM515 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM515 folded precursor RNA into VGAM515 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM515 RNA is designated SEQ ID:3226, and is provided hereinbelow with reference to the sequence listing part.

VGAM515 host target gene, herein designated VGAM HOST TARGET GENE, encodes a corresponding messenger RNA, VGAM515 host target RNA, herein designated VGAM HOST TARGET RNA. VGAM515 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM515 RNA, herein designated VGAM RNA, binds complementarily to one or more host target binding sites located in untranslated regions of VGAM515 host target RNA, herein designated VGAM HOST TARGET RNA. This complementary binding is due to the fact that the nucleotide sequence of VGAM515 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM515 RNA, herein designated VGAM RNA, may have a different number of host target binding sites in untranslated regions of a VGAM515 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM515 RNA, herein designated VGAM RNA, to host target binding sites on VGAM515 host target RNA, herein designated VGAM HOST TARGET RNA, such as BINDING SITE I, BINDING SITE II and BINDING SITE III, inhibits translation of VGAM515 host target RNA into VGAM515 host target protein, herein designated VGAM HOST TARGET PROTEIN. VGAM host target protein is therefore outlined by a broken line.

It is appreciated that VGAM515 host target gene, herein designated VGAM HOST TARGET GENE, in fact represents a plurality of VGAM515 host target genes. The mRNA of each one of this plurality of VGAM515 host target genes comprises one or more host target binding sites, each having a nucleotide sequence which is at least partly complementary to VGAM515 RNA, herein designated VGAM RNA, and which when bound by VGAM515 RNA causes inhibition of translation of respective one or more VGAM515 host target proteins.

It is further appreciated by one skilled in the art that the mode of translational inhibition illustrated by FIG. 1 with specific reference to translational inhibition exerted by VGAM515 gene, herein designated VGAM GENE, on one or more VGAM515 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM515 is inhibition of expression of host target genes, as part of a novel viral mechanism of attacking a host. Accordingly, utilities of VGAM515 include diagnosis, prevention and treatment of viral infection by Cucumber Green Mottle Mosaic Virus. Specific functions, and accordingly utilities, of VGAM515 correlate with, and may be deduced from, the identity of the host target genes which VGAM515 binds and inhibits, and the function of these host target genes, as elaborated hereinbelow.

Nucleotide sequences of the VGAM515 precursor RNA, herein designated VGAM PRECURSOR RNA, and of the 'diced' VGAM515 RNA, herein designated VGAM RNA, and a schematic representation of the secondary folding of VGAM515 folded precursor RNA, herein designated VGAM FOLDED PRECURSOR RNA, of VGAM515 are further described hereinbelow with reference to Table 1.

Nucleotide sequences of host target binding sites, such as BINDING SITE-I, BINDING SITE-II and BINDING SITE-III of FIG. 1, found on VGAM515 host target RNA, and schematic representation of the complementarity of each of these host target binding sites to VGAM515 RNA, herein designated VGAM RNA, are described hereinbelow with reference to Table 2.

As mentioned hereinabove with reference to FIG. 1, a function of VGAM515 gene, herein designated VGAM is inhibition of expression of VGAM515 target genes. It is appreciated that specific functions, and accordingly utilities, of VGAM515 correlate with, and may be deduced from, the identity of the target genes which VGAM515 binds and inhibits, and the function of these target genes, as elaborated hereinbelow.

B-cell CLL/lymphoma 11B (zinc finger protein) (BCL11B, Accession NM_022898) is a VGAM515 host target gene. BCL11B BINDING SITE is HOST TARGET binding site found in the 3' untranslated region of mRNA encoded by BCL11B, corresponding to a HOST TARGET binding site such as BINDING SITE I, BINDING SITE II or BINDING SITE III. Table 2 illustrates the complementarity of the nucleotide sequences of BCL11B BINDING SITE, designated SEQ ID:23162, to the nucleotide sequence of VGAM515 RNA, herein designated VGAM RNA, also designated SEQ ID:3226.

A function of VGAM515 is therefore inhibition of B-cell CLL/lymphoma 11B (zinc finger protein) (BCL11B, Accession NM_022898). Accordingly, utilities of VGAM515 include diagnosis, prevention and treatment of diseases and clinical conditions associated with BCL11B. Homeo Box A7 (HOXA7, Accession NM_006896) is another VGAM515 host target gene. HOXA7 BINDING SITE is HOST TARGET binding site found in the 3' untranslated region of mRNA encoded by HOXA7, corresponding to a HOST TARGET binding site such as BINDING SITE I, BINDING SITE II or BINDING SITE III. Table 2 illustrates the complementarity of the nucleotide sequences of HOXA7 BINDING SITE, designated SEQ ID:13771, to the nucleotide sequence of VGAM515 RNA, herein designated VGAM RNA, also designated SEQ ID:3226.

Another function of VGAM515 is therefore inhibition of Homeo Box A7 (HOXA7, Accession NM_006896), a gene which provides cells with specific positional identities on the anterior-posterior axis. Accordingly, utilities of VGAM515 include diagnosis, prevention and treatment of diseases and clinical conditions associated with HOXA7. The function of HOXA7 and its association with various diseases and clinical conditions, has been established by previous studies, as described hereinabove with reference to VGAM206. DKFZP566G1424 (Accession XM_097771) is another VGAM515 host target gene. DKFZP566G1424 BINDING SITE is HOST TARGET binding site found in the 3' untranslated region of mRNA encoded by DKFZP566G1424, corresponding to a HOST TARGET binding site such as BINDING SITE I, BINDING SITE II or BINDING SITE III. Table 2 illustrates the complementarity of the nucleotide sequences of DKFZP566G1424 BINDING SITE, designated SEQ ID:41114, to the nucleotide sequence of VGAM515 RNA, herein designated VGAM RNA, also designated SEQ ID:3226.

Another function of VGAM515 is therefore inhibition of DKFZP566G1424 (Accession XM_097771). Accordingly, utilities of VGAM515 include diagnosis, prevention and treatment of diseases and clinical conditions associated with DKFZP566G1424. FLJ11125 (Accession XM_005318) is another VGAM515 host target gene. FLJ11125 BINDING SITE is HOST TARGET binding site found in the 3' untranslated region of mRNA encoded by FLJ11125, corresponding to a HOST TARGET binding site such as BINDING SITE I, BINDING SITE II or BINDING SITE III. Table 2 illustrates the complementarity of the nucleotide sequences of FLJ11125 BINDING SITE, designated SEQ ID:29977, to the nucleotide sequence of VGAM515 RNA, herein designated VGAM RNA, also designated SEQ ID:3226.

Another function of VGAM515 is therefore inhibition of FLJ11125 (Accession XM_005318). Accordingly, utilities of VGAM515 include diagnosis, prevention and treatment of diseases and clinical conditions associated with FLJ11125. KIAA1465 (Accession XM_027396) is another VGAM515 host target gene. KIAA1465 BINDING SITE is HOST TARGET binding site found in the 3' untranslated region of mRNA encoded by KIAA1465, corresponding to a HOST TARGET binding site such as BINDING SITE I, BINDING SITE II or BINDING SITE III. Table 2 illustrates the complementarity of the nucleotide sequences of KIAA1465 BINDING SITE, designated SEQ ID:30506, to the nucleotide sequence of VGAM515 RNA, herein designated VGAM RNA, also designated SEQ ID:3226.

Another function of VGAM515 is therefore inhibition of KIAA1465 (Accession XM_027396). Accordingly, utilities of VGAM515 include diagnosis, prevention and treatment of diseases and clinical conditions associated with KIAA1465. KIAA1771 (Accession XM_086404) is another VGAM515 host target gene. KIAA1771 BINDING SITE is HOST TARGET binding site found in the 5' untranslated region of mRNA encoded by KIAA1771, corresponding to a HOST TARGET binding site such as BINDING SITE I, BINDING SITE II or BINDING SITE III. Table 2 illustrates the complementarity of the nucleotide sequences of KIAA1771 BINDING SITE, designated SEQ ID:38635, to the nucleotide sequence of VGAM515 RNA, herein designated VGAM RNA, also designated SEQ ID:3226.

Another function of VGAM515 is therefore inhibition of KIAA1771 (Accession XM_086404). Accordingly, utilities of VGAM515 include diagnosis, prevention and treatment of diseases and clinical conditions associated with KIAA1771. Nuclear Factor of Activated T-cells 5, Tonicity-responsive (NFAT5, Accession NM_138714) is another VGAM515 host target gene. NFAT5 BINDING SITE is HOST TARGET binding site found in the 5' untranslated region of mRNA encoded by NFAT5, corresponding to a HOST TARGET binding site such as BINDING SITE I, BINDING SITE II or BINDING SITE III. Table 2 illustrates the complementarity of the nucleotide sequences of NFAT5 BINDING SITE, designated SEQ ID:28959, to the nucleotide sequence of VGAM515 RNA, herein designated VGAM RNA, also designated SEQ ID:3226.

Another function of VGAM515 is therefore inhibition of Nuclear Factor of Activated T-cells 5, Tonicity-responsive (NFAT5, Accession NM_138714). Accordingly, utilities of VGAM515 include diagnosis, prevention and treatment of diseases and clinical conditions associated with NFAT5. Protocadherin 17 (PCDH17, Accession NM_014459) is another VGAM515 host target gene. PCDH17 BINDING SITE is HOST TARGET binding site found in the 3' untranslated region of mRNA encoded by PCDH17, corresponding to a HOST TARGET binding site such as BINDING SITE I, BINDING SITE II or BINDING SITE III. Table 2 illustrates the complementarity of the nucleotide sequences of PCDH17 BINDING SITE, designated SEQ ID:15814, to the nucleotide sequence of VGAM515 RNA, herein designated VGAM RNA, also designated SEQ ID:3226.

Another function of VGAM515 is therefore inhibition of Protocadherin 17 (PCDH17, Accession NM_014459). Accordingly, utilities of VGAM515 include diagnosis, prevention and treatment of diseases and clinical conditions associated with PCDH17. SSB-3 (Accession NM_080861) is another VGAM515 host target gene. SSB-3 BINDING SITE is HOST TARGET binding site found in the 5' untranslated region of mRNA encoded by SSB-3, corresponding to a HOST TARGET binding site such as BINDING SITE I, BINDING SITE II or BINDING SITE III. Table 2 illustrates the complementarity of the nucleotide sequences of SSB-3 BINDING SITE, designated SEQ ID:28101, to the nucleotide sequence of VGAM515 RNA, herein designated VGAM RNA, also designated SEQ ID:3226.

Another function of VGAM515 is therefore inhibition of SSB-3 (Accession NM_080861). Accordingly, utilities of VGAM515 include diagnosis, prevention and treatment of diseases and clinical conditions associated with SSB-3. LOC152300 (Accession XM_087432) is another VGAM515 host target gene. LOC152300 BINDING SITE is HOST TARGET binding site found in the 3' untranslated region of mRNA encoded by LOC152300, corresponding to a HOST TARGET binding site such as BINDING SITE I, BINDING SITE II or BINDING SITE III. Table 2 illustrates the complementarity of the nucleotide sequences of LOC152300 BINDING SITE, designated SEQ ID:39250, to the nucleotide sequence of VGAM515 RNA, herein designated VGAM RNA, also designated SEQ ID:3226.

Another function of VGAM515 is therefore inhibition of LOC152300 (Accession XM_087432). Accordingly, utilities of VGAM515 include diagnosis, prevention and treatment of diseases and clinical conditions associated with LOC152300. LOC207089 (Accession XM_115923) is another VGAM515 host target gene. LOC207089 BINDING SITE is HOST TARGET binding site found in the 3' untranslated region of mRNA encoded by LOC207089, corresponding to a HOST TARGET binding site such as BINDING SITE I, BINDING SITE II or BINDING SITE III. Table 2 illustrates the complementarity of the nucleotide sequences of LOC207089 BINDING SITE, designated SEQ ID:43108, to the nucleotide sequence of VGAM515 RNA, herein designated VGAM RNA, also designated SEQ ID:3226.

Another function of VGAM515 is therefore inhibition of LOC207089 (Accession XM_115923). Accordingly, utilities of VGAM515 include diagnosis, prevention and treatment of diseases and clinical conditions associated with LOC207089. LOC221399 (Accession XM_168134) is another VGAM515 host target gene. LOC221399 BINDING SITE is HOST TARGET binding site found in the 5' untranslated region of mRNA encoded by LOC221399, corresponding to a HOST TARGET binding site such as BINDING SITE I, BINDING SITE II or BINDING SITE III. Table 2 illustrates the complementarity of the nucleotide sequences of LOC221399 BINDING SITE, designated SEQ ID:45049, to the nucleotide sequence of VGAM515 RNA, herein designated VGAM RNA, also designated SEQ ID:3226.

Another function of VGAM515 is therefore inhibition of LOC221399 (Accession XM_168134). Accordingly, utilities of VGAM515 include diagnosis, prevention and treatment of diseases and clinical conditions associated with LOC221399. FIG. 1 further provides a conceptual description of a novel bioinformatically detected viral gene of the present invention, referred to here as Viral Genomic Address Messenger 516 (VGAM516) viral gene, which modulates expression of respective host target genes thereof, the function and utility of which host target genes is known in the art.

VGAM516 is a novel bioinformatically detected regulatory, non protein coding, viral micro RNA (miRNA) gene. The method by which VGAM516 was detected is described hereinabove with reference to FIGS. 1-8.

VGAM516 gene, herein designated VGAM GENE, is a viral gene contained in the genome of Galinsoga Mosaic Virus. VGAM516 host target gene, herein designated VGAM HOST TARGET GENE, is a human gene contained in the human genome.

VGAM516 gene encodes a VGAM516 precursor RNA, herein designated VGAM PRECURSOR RNA. Similar to other miRNA genes, and unlike most ordinary genes, VGAM516 precursor RNA does not encode a protein. A nucleotide sequence identical or highly similar to the nucleotide sequence of VGAM516 precursor RNA is designated SEQ ID:502, and is provided hereinbelow with reference to the sequence listing part. Nucleotide sequence SEQ ID:502 is located at position 2863 relative to the genome of Galinsoga Mosaic Virus.

VGAM516 precursor RNA folds onto itself, forming VGAM516 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM516 folded precursor RNA into VGAM516 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM516 RNA is designated SEQ ID:3227, and is provided hereinbelow with reference to the sequence listing part.

VGAM516 host target gene, herein designated VGAM HOST TARGET GENE, encodes a corresponding messenger RNA, VGAM516 host target RNA, herein designated VGAM HOST TARGET RNA. VGAM516 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM516 RNA, herein designated VGAM RNA, binds complementarily to one or more host target binding sites located in untranslated regions of VGAM516 host target RNA, herein designated VGAM HOST TARGET RNA. This complementary binding is due to the fact that the nucleotide sequence of VGAM516 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM516 RNA, herein designated VGAM RNA, may have a different number of host target binding sites in untranslated regions of a VGAM516 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM516 RNA, herein designated VGAM RNA, to host target binding sites on VGAM516 host target RNA, herein designated VGAM HOST TARGET RNA, such as BINDING SITE I, BINDING SITE II and BINDING SITE III, inhibits translation of VGAM516 host target RNA into VGAM516 host target protein, herein designated VGAM HOST TARGET PROTEIN. VGAM host target protein is therefore outlined by a broken line.

It is appreciated that VGAM516 host target gene, herein designated VGAM HOST TARGET GENE, in fact represents a plurality of VGAM516 host target genes. The mRNA of each one of this plurality of VGAM516 host target genes comprises one or more host target binding sites, each having a nucleotide sequence which is at least partly complementary to VGAM516 RNA, herein designated VGAM RNA, and which when bound by VGAM516 RNA causes inhibition of translation of respective one or more VGAM516 host target proteins.

It is further appreciated by one skilled in the art that the mode of translational inhibition illustrated by FIG. 1 with specific reference to translational inhibition exerted by VGAM516 gene, herein designated VGAM GENE, on one or more VGAM516 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM516 is inhibition of expression of host target genes, as part of a novel viral mechanism of attacking a host. Accordingly, utilities of VGAM516 include diagnosis, prevention and treatment of viral infection by Galinsoga Mosaic Virus. Specific functions, and accordingly utilities, of VGAM516 correlate with, and may be deduced from, the identity of the host target genes which VGAM516 binds and inhibits, and the function of these host target genes, as elaborated hereinbelow.

Nucleotide sequences of the VGAM516 precursor RNA, herein designated VGAM PRECURSOR RNA, and of the 'diced' VGAM516 RNA, herein designated VGAM RNA, and a schematic representation of the secondary folding of VGAM516 folded precursor RNA, herein designated VGAM FOLDED PRECURSOR RNA, of VGAM516 are further described hereinbelow with reference to Table 1.

Nucleotide sequences of host target binding sites, such as BINDING SITE-I, BINDING SITE-II and BINDING SITE-III of FIG. 1, found on VGAM516 host target RNA, and schematic representation of the complementarity of each of these host target binding sites to VGAM516 RNA, herein designated VGAM RNA, are described hereinbelow with reference to Table 2.

As mentioned hereinabove with reference to FIG. 1, a function of VGAM516 gene, herein designated VGAM is inhibition of expression of VGAM516 target genes. It is appreciated that specific functions, and accordingly utilities, of VGAM516 correlate with, and may be deduced from, the identity of the target genes which VGAM516 binds and inhibits, and the function of these target genes, as elaborated hereinbelow.

Bromodomain Adjacent to Zinc Finger Domain, 1B (BAZ1B, Accession NM_032408) is a VGAM516 host target gene. BAZ1B BINDING SITE is HOST TARGET binding site found in the 3' untranslated region of mRNA encoded by BAZ1B, corresponding to a HOST TARGET binding site such as BINDING SITE I, BINDING SITE II or BINDING SITE III. Table 2 illustrates the complementarity of the nucleotide sequences of BAZ1B BINDING SITE, designated SEQ ID:26192, to the nucleotide sequence of VGAM516 RNA, herein designated VGAM RNA, also designated SEQ ID:3227.

A function of VGAM516 is therefore inhibition of Bromodomain Adjacent to Zinc Finger Domain, 1B (BAZ1B, Accession NM_032408). Accordingly, utilities of VGAM516 include diagnosis, prevention and treatment of diseases and clinical conditions associated with BAZ1B. APCL (Accession NM_005883) is another VGAM516 host target gene. APCL BINDING SITE is HOST TARGET binding site found in the 3' untranslated region of mRNA encoded by APCL, corresponding to a HOST TARGET binding site such as BINDING SITE I, BINDING SITE II or BINDING SITE III. Table 2 illustrates the complementarity of the nucleotide sequences of APCL BINDING SITE, designated SEQ ID:12495, to the nucleotide sequence of VGAM516 RNA, herein designated VGAM RNA, also designated SEQ ID:3227.

Another function of VGAM516 is therefore inhibition of APCL (Accession NM_005883). Accordingly, utilities of VGAM516 include diagnosis, prevention and treatment of diseases and clinical conditions associated with APCL. FLJ14547 (Accession NM_032804) is another VGAM516 host target gene. FLJ14547 BINDING SITE is HOST TARGET binding site found in the 3" untranslated region of mRNA encoded by FLJ14547, corresponding to a HOST TARGET binding site such as BINDING SITE I, BINDING SITE II or BINDING SITE III. Table 2 illustrates the complementarity of the nucleotide sequences of FLJ14547 BINDING SITE, designated SEQ ID:26559, to the nucleotide sequence of VGAM516 RNA, herein designated VGAM RNA, also designated SEQ ID:3227.

Another function of VGAM516 is therefore inhibition of FLJ14547 (Accession NM_032804). Accordingly, utilities of VGAM516 include diagnosis, prevention and treatment of diseases and clinical conditions associated with FLJ14547. PRAX-1 (Accession NM_004758) is another VGAM516 host target gene. PRAX-1 BINDING SITE is HOST TARGET binding site found in the 3' untranslated region of mRNA encoded by PRAX-1, corresponding to a HOST TARGET binding site such as BINDING SITE I, BINDING SITE II or BINDING SITE III. Table 2 illustrates the complementarity of the nucleotide sequences of PRAX-1 BINDING SITE, designated SEQ ID:11145, to the nucleotide sequence of VGAM516 RNA, herein designated VGAM RNA, also designated SEQ ID:3227.

Another function of VGAM516 is therefore inhibition of PRAX-1 (Accession NM_004758). Accordingly, utilities of VGAM516 include diagnosis, prevention and treatment of diseases and clinical conditions associated with PRAX-1. Syndecan 3 (N-syndecan) (SDC3, Accession NM_014654) is another VGAM516 host target gene. SDC3 BINDING SITE is HOST TARGET binding site found in the 5' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16086, to the nucleotide sequence of VGAM516 RNA, herein designated VGAM RNA, also designated SEQ ID:3227.

Another function of VGAM516 is therefore inhibition of Syndecan 3 (N-syndecan) (SDC3, Accession NM_014654). Accordingly, utilities of VGAM516 include diagnosis, prevention and treatment of diseases and clinical conditions associated with SDC3. LOC150577 (Accession XM_097918) is another VGAM516 host target gene. LOC150577 BINDING SITE is HOST TARGET binding site found in the 3' untranslated region of mRNA encoded by LOC150577, corresponding to a HOST TARGET binding site such as BINDING SITE I, BINDING SITE II or BINDING SITE III. Table 2 illustrates the complementarity of the nucleotide sequences of LOC150577 BINDING SITE, designated SEQ ID:41224, to the nucleotide sequence of VGAM516 RNA, herein designated VGAM RNA, also designated SEQ ID:3227.

Another function of VGAM516 is therefore inhibition of LOC150577 (Accession XM_097918). Accordingly, utilities of VGAM516 include diagnosis, prevention and treatment of diseases and clinical conditions associated with LOC150577. LOC151162 (Accession XM_098012) is another VGAM516 host target gene. LOC151162 BINDING SITE is HOST TARGET binding site found in the 5' untranslated region of mRNA encoded by LOC151162, corresponding to a HOST TARGET binding site such as BINDING SITE I, BINDING SITE II or BINDING SITE III. Table 2 illustrates the complementarity of the nucleotide sequences of LOC151162 BINDING SITE, designated SEQ ID:41307, to the nucleotide sequence of VGAM516 RNA, herein designated VGAM RNA, also designated SEQ ID:3227.

Another function of VGAM516 is therefore inhibition of LOC151162 (Accession XM_098012). Accordingly, utilities of VGAM516 include diagnosis, prevention and treatment of diseases and clinical conditions associated with LOC151162. LOC203377 (Accession XM_117540) is another VGAM516 host target gene. LOC203377 BINDING SITE is HOST TARGET binding site found in the 5' untranslated region of mRNA encoded by LOC203377, corresponding to a HOST TARGET binding site such as BINDING SITE I, BINDING SITE II or BINDING SITE III. Table 2 illustrates the complementarity of the nucleotide sequences of LOC203377 BINDING SITE, designated SEQ ID:43542, to the nucleotide sequence of VGAM516 RNA, herein designated VGAM RNA, also designated SEQ ID:3227.

Another function of VGAM516 is therefore inhibition of LOC203377 (Accession XM_117540). Accordingly, utilities of VGAM516 include diagnosis, prevention and treatment of diseases and clinical conditions associated with LOC203377. FIG. 1 further provides a conceptual description of a novel bioinformatically detected viral gene of the present invention, referred to here as Viral Genomic Address Messenger 517 (VGAM517) viral gene, which modulates expression of respective host target genes thereof, the function and utility of which host target genes is known in the art.

VGAM517 is a novel bioinformatically detected regulatory, non protein coding, viral micro RNA (miRNA) gene. The method by which VGAM517 was detected is described hereinabove with reference to FIGS. 1-8.

VGAM517 gene, herein designated VGAM GENE, is a viral gene contained in the genome of Galinsoga Mosaic Virus. VGAM517 host target gene, herein designated VGAM HOST TARGET GENE, is a human gene contained in the human genome.

VGAM517 gene encodes a VGAM517 precursor RNA, herein designated VGAM PRECURSOR RNA. Similar to other miRNA genes, and unlike most ordinary genes, VGAM517 precursor RNA does not encode a protein. A nucleotide sequence identical or highly similar to the nucleotide sequence of VGAM517 precursor RNA is designated SEQ ID:503, and is provided hereinbelow with reference to the sequence listing part. Nucleotide sequence SEQ ID:503 is located at position 3248 relative to the genome of Galinsoga Mosaic Virus.

VGAM517 precursor RNA folds onto itself, forming VGAM517 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM517 folded precursor RNA into VGAM517 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM517 RNA is designated SEQ ID:3228, and is provided hereinbelow with reference to the sequence listing part.

VGAM517 host target gene, herein designated VGAM HOST TARGET GENE, encodes a corresponding messenger RNA, VGAM517 host target RNA, herein designated VGAM HOST TARGET RNA. VGAM517 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM517 RNA, herein designated VGAM RNA, binds complementarily to one or more host target binding sites located in untranslated regions of VGAM517 host target RNA, herein designated VGAM HOST TARGET RNA. This complementary binding is due to the fact that the nucleotide sequence of VGAM517 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM517 RNA, herein designated VGAM RNA, may have a different number of host target binding sites in untranslated regions of a VGAM517 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM517 RNA, herein designated VGAM RNA, to host target binding sites on VGAM517 host target RNA, herein designated VGAM HOST TARGET RNA, such as BINDING SITE I, BINDING SITE II and BINDING SITE III, inhibits translation of VGAM517 host target RNA into VGAM517 host target protein, herein designated VGAM HOST TARGET PROTEIN. VGAM host target protein is therefore outlined by a broken line.

It is appreciated that VGAM517 host target gene, herein designated VGAM HOST TARGET GENE, in fact represents a plurality of VGAM517 host target genes. The mRNA of each one of this plurality of VGAM517 host target genes comprises one or more host target binding sites, each having a nucleotide sequence which is at least partly complementary to VGAM517 RNA, herein designated VGAM RNA, and which when bound by VGAM517 RNA causes inhibition of translation of respective one or more VGAM517 host target proteins.

It is further appreciated by one skilled in the art that the mode of translational inhibition illustrated by FIG. 1 with specific reference to translational inhibition exerted by VGAM517 gene, herein designated VGAM GENE, on one or more VGAM517 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM517 is inhibition of expression of host target genes, as part of a novel viral mechanism of attacking a host. Accordingly, utilities of VGAM517 include diagnosis, prevention and treatment of viral infection by Galinsoga Mosaic Virus. Specific functions, and accordingly utilities, of VGAM517 correlate with, and may be deduced from, the identity of the host target genes which VGAM517 binds and inhibits, and the function of these host target genes, as elaborated hereinbelow.

Nucleotide sequences of the VGAM517 precursor RNA, herein designated VGAM PRECURSOR RNA, and of the 'diced' VGAM517 RNA, herein designated VGAM RNA, and a schematic representation of the secondary folding of VGAM517 folded precursor RNA, herein designated VGAM FOLDED PRECURSOR RNA, of VGAM517 are further described hereinbelow with reference to Table 1.

Nucleotide sequences of host target binding sites, such as BINDING SITE-I, BINDING SITE-II and BINDING SITE-III of FIG. 1, found on VGAM517 host target RNA, and schematic representation of the complementarity of each of these host target binding sites to VGAM517 RNA, herein designated VGAM RNA, are described hereinbelow with reference to Table 2.

As mentioned hereinabove with reference to FIG. 1, a function of VGAM517 gene, herein designated VGAM is inhibition of expression of VGAM517 target genes. It is appreciated that specific functions, and accordingly utilities, of VGAM517 correlate with, and may be deduced from, the identity of the target genes which VGAM517 binds and inhibits, and the function of these target genes, as elaborated hereinbelow.

Interleukin 18 Receptor 1 (IL18R1, Accession NM_003855) is a VGAM517 host target gene. IL18R1 BINDING SITE is HOST TARGET binding site found in the 3' untranslated region of mRNA encoded by IL18R1, corresponding to a HOST TARGET binding site such as BINDING SITE I, BINDING SITE II or BINDING SITE III. Table 2 illustrates the complementarity of the nucleotide sequences of IL18R1 BINDING SITE, designated SEQ ID:9950, to the nucleotide sequence of VGAM517 RNA, herein designated VGAM RNA, also designated SEQ ID:3228.

A function of VGAM517 is therefore inhibition of Interleukin 18 Receptor 1 (IL18R1, Accession NM_003855), a gene which is required for dorsal-ventral embryonic polarity and promotes heterophilic cellular adhesion. Accordingly, utilities of VGAM517 include diagnosis, prevention and treatment of diseases and clinical conditions associated with IL18R1. The function of IL18R1 and its association with various diseases and clinical conditions, has been established by previous studies, as described hereinabove with reference to VGAM37. Lunatic Fringe Homolog (Drosophila) (LFNG, Accession XM_166539) is another VGAM517 host target gene. LFNG BINDING SITE is HOST TARGET binding site found in the 3' untranslated region of mRNA encoded by LFNG, corresponding to a HOST TARGET binding site such as BINDING SITE I, BINDING SITE II or BINDING SITE III. Table 2 illustrates the complementarity of the nucleotide sequences of LFNG BINDING SITE, designated SEQ ID:44511, to the nucleotide sequence of VGAM517 RNA, herein designated VGAM RNA, also designated SEQ ID:3228.

Another function of VGAM517 is therefore inhibition of Lunatic Fringe Homolog (Drosophila) (LFNG, Accession XM_166539). Accordingly, utilities of VGAM517 include diagnosis, prevention and treatment of diseases and clinical conditions associated with LFNG. HSPC014 (Accession NM_015932) is another VGAM517 host target gene. HSPC014 BINDING SITE is HOST TARGET binding site found in the 3' untranslated region of mRNA encoded by HSPC014, corresponding to a HOST TARGET binding site such as BINDING SITE I, BINDING SITE II or BINDING SITE III. Table 2 illustrates the complementarity of the nucleotide sequences of HSPC014 BINDING SITE, designated SEQ ID:18053, to the nucleotide sequence of VGAM517 RNA, herein designated VGAM RNA, also designated SEQ ID:3228.

Another function of VGAM517 is therefore inhibition of HSPC014 (Accession NM_015932). Accordingly, utilities of VGAM517 include diagnosis, prevention and treatment of diseases and clinical conditions associated with HSPC014. KIAA0261 (Accession XM_042946) is another VGAM517 host target gene. KIAA0261 BINDING SITE is HOST TARGET binding site found in the 3' untranslated region of mRNA encoded by KIAA0261, corresponding to a HOST TARGET binding site such as BINDING SITE I, BINDING SITE II or BINDING SITE III. Table 2 illustrates the complementarity of the nucleotide sequences of KIAA0261 BINDING SITE, designated SEQ ID:33834, to the nucleotide sequence of VGAM517 RNA, herein designated VGAM RNA, also designated SEQ ID:3228.

Another function of VGAM517 is therefore inhibition of KIAA0261 (Accession XM_042946). Accordingly, utilities of VGAM517 include diagnosis, prevention and treatment of diseases and clinical conditions associated with KIAA0261. KIAA1727 (Accession XM_034262) is another VGAM517 host target gene. KIAA1727 BINDING SITE is HOST TARGET binding site found in the 3' untranslated region of mRNA encoded by KIAA1727, corresponding to a HOST TARGET binding site such as BINDING SITE I, BINDING SITE II or BINDING SITE III. Table 2 illustrates the complementarity of the nucleotide sequences of KIAA1727 BINDING SITE, designated SEQ ID:32028, to the nucleotide sequence of VGAM517 RNA, herein designated VGAM RNA, also designated SEQ ID:3228.

Another function of VGAM517 is therefore inhibition of KIAA1727 (Accession XM_034262). Accordingly, utilities of VGAM517 include diagnosis, prevention and treatment of diseases and clinical conditions associated with KIAA1727. LOC162333 (Accession XM_102591) is another VGAM517 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42120, to the nucleotide sequence of VGAM517 RNA, herein designated VGAM RNA, also designated SEQ ID:3228.

Another function of VGAM517 is therefore inhibition of LOC162333 (Accession XM_102591). Accordingly, utilities of VGAM517 include diagnosis, prevention and treatment of diseases and clinical conditions associated with LOC162333. LOC90906 (Accession XM_034809) is another VGAM517 host target gene. LOC90906 BINDING SITE is HOST TARGET binding site found in the 5' untranslated region of mRNA encoded by LOC90906, corresponding to a HOST TARGET binding site such as BINDING SITE I, BINDING SITE II or BINDING SITE III. Table 2 illustrates the complementarity of the nucleotide sequences of LOC90906 BINDING SITE, designated SEQ ID:32154, to the nucleotide sequence of VGAM517 RNA, herein designated VGAM RNA, also designated SEQ ID:3228.

Another function of VGAM517 is therefore inhibition of LOC90906 (Accession XM_034809). Accordingly, utilities of VGAM517 include diagnosis, prevention and treatment of diseases and clinical conditions associated with LOC90906. FIG. 1 further provides a conceptual description of a novel bioinformatically detected viral gene of the present invention, referred to here as Viral Genomic Address Messenger 518 (VGAM518) viral gene, which modulates expression of respective host target genes thereof, the function and utility of which host target genes is known in the art.

VGAM518 is a novel bioinformatically detected regulatory, non protein coding, viral micro RNA (miRNA) gene. The method by which VGAM518 was detected is described hereinabove with reference to FIGS. 1-8.

VGAM518 gene, herein designated VGAM GENE, is a viral gene contained in the genome of Lymphocystis Disease Virus 1. VGAM518 host target gene, herein designated VGAM HOST TARGET GENE, is a human gene contained in the human genome.

VGAM518 gene encodes a VGAM518 precursor RNA, herein designated VGAM PRECURSOR RNA. Similar to other miRNA genes, and unlike most ordinary genes, VGAM518 precursor RNA does not encode a protein. A nucleotide sequence identical or highly similar to the nucleotide sequence of VGAM518 precursor RNA is designated SEQ ID:504, and is provided hereinbelow with reference to the sequence listing part. Nucleotide sequence SEQ ID:504 is located at position 10108 relative to the genome of Lymphocystis Disease Virus 1.

VGAM518 precursor RNA folds onto itself, forming VGAM518 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM518 folded precursor RNA into VGAM518 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM518 RNA is designated SEQ ID:3229, and is provided hereinbelow with reference to the sequence listing part.

VGAM518 host target gene, herein designated VGAM HOST TARGET GENE, encodes a corresponding messenger RNA, VGAM518 host target RNA, herein designated VGAM HOST TARGET RNA. VGAM518 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM518 RNA, herein designated VGAM RNA, binds complementarily to one or more host target binding sites located in untranslated regions of VGAM518 host target RNA, herein designated VGAM HOST TARGET RNA. This complementary binding is due to the fact that the nucleotide sequence of VGAM518 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM518 RNA, herein designated VGAM RNA, may have a different number of host target binding sites in untranslated regions of a VGAM518 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM518 RNA, herein designated VGAM RNA, to host target binding sites on VGAM518 host target RNA, herein designated VGAM HOST TARGET RNA, such as BINDING SITE I, BINDING SITE II and BINDING SITE III, inhibits translation of VGAM518 host target RNA into VGAM518 host target protein, herein designated VGAM HOST TARGET PROTEIN. VGAM host target protein is therefore outlined by a broken line.

It is appreciated that VGAM518 host target gene, herein designated VGAM HOST TARGET GENE, in fact represents a plurality of VGAM518 host target genes. The mRNA of each one of this plurality of VGAM518 host target genes comprises one or more host target binding sites, each having a nucleotide sequence which is at least partly complementary to VGAM518 RNA, herein designated VGAM RNA, and which when bound by VGAM518 RNA causes inhibition of translation of respective one or more VGAM518 host target proteins.

It is further appreciated by one skilled in the art that the mode of translational inhibition illustrated by FIG. 1 with specific reference to translational inhibition exerted by VGAM518 gene, herein designated VGAM GENE, on one or more VGAM518 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM518 is inhibition of expression of host target genes, as part of a novel viral mechanism of attacking a host. Accordingly, utilities of VGAM518 include diagnosis, prevention and treatment of viral infection by Lymphocystis Disease Virus 1. Specific functions, and accordingly utilities, of VGAM518 correlate with, and may be deduced from, the identity of the host target genes which VGAM518 binds and inhibits, and the function of these host target genes, as elaborated hereinbelow.

Nucleotide sequences of the VGAM518 precursor RNA, herein designated VGAM PRECURSOR RNA, and of the 'diced' VGAM518 RNA, herein designated VGAM RNA, and a schematic representation of the secondary folding of VGAM518 folded precursor RNA, herein designated VGAM FOLDED PRECURSOR RNA, of VGAM518 are further described hereinbelow with reference to Table 1.

Nucleotide sequences of host target binding sites, such as BINDING SITE-I, BINDING SITE-II and BINDING SITE-III of FIG. 1, found on VGAM518 host target RNA, and schematic representation of the complementarity of each of these host target binding sites to VGAM518 RNA, herein designated VGAM RNA, are described hereinbelow with reference to Table 2.

As mentioned hereinabove with reference to FIG. 1, a function of VGAM518 gene, herein designated VGAM is inhibition of expression of VGAM518 target genes. It is appreciated that specific functions, and accordingly utilities, of VGAM518 correlate with, and may be deduced from, the identity of the target genes which VGAM518 binds and inhibits, and the function of these target genes, as elaborated hereinbelow.

IL2-inducible T-cell Kinase (ITK, Accession NM_005546) is a VGAM518 host target gene. ITK BINDING SITE is HOST TARGET binding site found in the 3' untranslated region of mRNA encoded by ITK, corresponding to a HOST TARGET binding site such as BINDING SITE I, BINDING SITE II or BINDING SITE III. Table 2 illustrates the complementarity of the nucleotide sequences of ITK BINDING SITE, designated SEQ ID:12079, to the nucleotide sequence of VGAM518 RNA, herein designated VGAM RNA, also designated SEQ ID:3229.

A function of VGAM518 is therefore inhibition of IL2-inducible T-cell Kinase (ITK, Accession NM_005546), a gene which plays a role in t cell proliferation and differentiation. Accordingly, utilities of VGAM518 include diagnosis, prevention and treatment of diseases and clinical conditions associated with ITK. The function of ITK and its association with various diseases and clinical conditions, has been established by previous studies, as described hereinabove with reference to VGAM288. Platelet-derived Growth Factor Receptor, Beta Polypeptide (PDGFRB, Accession XM_038350) is another VGAM518 host target gene. PDGFRB BINDING SITE is HOST TARGET binding site found in the 3' untranslated region of mRNA encoded by PDGFRB, corresponding to a HOST TARGET binding site such as BINDING SITE I, BINDING SITE II or BINDING SITE III. Table 2 illustrates the complementarity of the nucleotide sequences of PDGFRB BINDING SITE, designated SEQ ID:32819, to the nucleotide sequence of VGAM518 RNA, herein designated VGAM RNA, also designated SEQ ID:3229.

Another function of VGAM518 is therefore inhibition of Platelet-derived Growth Factor Receptor, Beta Polypeptide (PDGFRB, Accession XM_038350), a gene which Platelet-derived growth factor receptor beta chain; tyrosine kinase receptor. Accordingly, utilities of VGAM518 include diagnosis, prevention and treatment of diseases and clinical conditions associated with PDGFRB. The function of PDGFRB and its association with various diseases and clinical conditions, has been established by previous studies, as described hereinabove with reference to VGAM125. Xenotropic and Polytropic Retrovirus Receptor (XPR1, Accession NM_004736) is another VGAM518 host target gene. XPR1 BINDING SITE is HOST TARGET binding site found in the 3' untranslated region of mRNA encoded by XPR1, corresponding to a HOST TARGET binding site such as BINDING SITE I, BINDING SITE II or BINDING SITE III. Table 2 illustrates the complementarity of the nucleotide sequences of XPR1 BINDING SITE, designated SEQ ID:11126, to the nucleotide sequence of VGAM518 RNA, herein designated VGAM RNA, also designated SEQ ID:3229.

Another function of VGAM518 is therefore inhibition of Xenotropic and Polytropic Retrovirus Receptor (XPR1, Accession NM_004736), a gene which is a putative G protein-coupled receptor and a target for xenotropic and polytropic murine leukemia retroviruses. Accordingly, utilities of VGAM518 include diagnosis, prevention and treatment of diseases and clinical conditions associated with XPR1. The function of XPR1 and its association with various diseases and clinical conditions, has been established by previous studies, as described hereinabove with reference to VGAM430. Chromosome 5 Open Reading Frame 7 (C5orf7, Accession XM_033576) is another VGAM518 host target gene. C5orf7 BINDING SITE is HOST TARGET binding site found in the 3' untranslated region of mRNA encoded by C5orf7, corresponding to a HOST TARGET binding site such as BINDING SITE I, BINDING SITE II or BINDING SITE III. Table 2 illustrates the complementarity of the nucleotide sequences of C5orf7 BINDING SITE, designated SEQ ID:31941, to the nucleotide sequence of VGAM518 RNA, herein designated VGAM RNA, also designated SEQ ID:3229.

Another function of VGAM518 is therefore inhibition of Chromosome 5 Open Reading Frame 7 (C5orf7, Accession XM_033576). Accordingly, utilities of VGAM518 include diagnosis, prevention and treatment of diseases and clinical conditions associated with C5orf7. DT1P1A10 (Accession XM_029187) is another VGAM518 host target gene. DT1P1A10 BINDING SITE is HOST TARGET binding site found in the 3' untranslated region of mRNA encoded by DT1P1A10, corresponding to a HOST TARGET binding site such as BINDING SITE I, BINDING SITE II or BINDING SITE III. Table 2 illustrates the complementarity of the nucleotide sequences of DT1P1A10 BINDING SITE, designated SEQ ID:30857, to the nucleotide sequence of VGAM518 RNA, herein designated VGAM RNA, also designated SEQ ID:3229.

Another function of VGAM518 is therefore inhibition of DT1P1A10 (Accession XM_029187). Accordingly, utilities of VGAM518 include diagnosis, prevention and treatment of diseases and clinical conditions associated with DT1P1A10. Echinoderm Microtubule Associated Protein Like 4 (EML4, Accession NM_019063) is another VGAM518 host target gene. EML4 BINDING SITE is HOST TARGET binding site found in the 3' untranslated region of mRNA encoded by EML4, corresponding to a HOST TARGET binding site such as BINDING SITE I, BINDING SITE II or BINDING SITE III. Table 2 illustrates the complementarity of the nucleotide sequences of EML4 BINDING SITE, designated SEQ ID:21147, to the nucleotide sequence of VGAM518 RNA, herein designated VGAM RNA, also designated SEQ ID:3229.

Another function of VGAM518 is therefore inhibition of Echinoderm Microtubule Associated Protein Like 4 (EML4, Accession NM_019063). Accordingly, utilities of VGAM518 include diagnosis, prevention and treatment of diseases and clinical conditions associated with EML4. Erythrocyte Membrane Protein Band 4.1-like 1 (EPB41L1, Accession XM_047295) is another VGAM518 host target gene. EPB41L1 BINDING SITE is HOST TARGET binding site found in the 3' untranslated region of mRNA encoded by EPB41L1, corresponding to a HOST TARGET binding site such as BINDING SITE I, BINDING SITE II or BINDING SITE III. Table 2 illustrates the complementarity of the nucleotide sequences of EPB41L1 BINDING SITE, designated SEQ ID:34943, to the nucleotide sequence of VGAM518 RNA, herein designated VGAM RNA, also designated SEQ ID:3229.

Another function of VGAM518 is therefore inhibition of Erythrocyte Membrane Protein Band 4.1-like 1 (EPB41L1, Accession XM_047295). Accordingly, utilities of VGAM518 include diagnosis, prevention and treatment of diseases and clinical conditions associated with EPB41L1. FLJ10583 (Accession NM_018148) is another VGAM518 host target gene. FLJ10583 BINDING SITE is HOST TARGET binding site found in the 3' untranslated region of mRNA encoded by FLJ10583, corresponding to a HOST TARGET binding site such as BINDING SITE I, BINDING SITE II or BINDING SITE III. Table 2 illustrates the complementarity of the nucleotide sequences of FLJ10583 BINDING SITE, designated SEQ ID:19951, to the nucleotide sequence of VGAM518 RNA, herein designated VGAM RNA, also designated SEQ ID:3229.

Another function of VGAM518 is therefore inhibition of FLJ10583 (Accession NM_018148). Accordingly, utilities of VGAM518 include diagnosis, prevention and treatment of diseases and clinical conditions associated with FLJ10583. FLJ20154 (Accession XM_053688) is another VGAM518 host target gene. FLJ20154 BINDING SITE is HOST TARGET binding site found in the 5' untranslated region of mRNA encoded by FLJ20154, corresponding to a HOST TARGET binding site such as BINDING SITE I, BINDING SITE II or BINDING SITE III. Table 2 illustrates the complementarity of the nucleotide sequences of FLJ20154 BINDING SITE, designated SEQ ID:36107, to the nucleotide sequence of VGAM518 RNA, herein designated VGAM RNA, also designated SEQ ID:3229.

Another function of VGAM518 is therefore inhibition of FLJ20154 (Accession XM_053688). Accordingly, utilities of VGAM518 include diagnosis, prevention and treatment of diseases and clinical conditions associated with FLJ20154. Heat Shock Transcription Factor 2 (HSF2, Accession NM_004506) is another VGAM518 host target gene. HSF2 BINDING SITE is HOST TARGET binding site found in the 3' untranslated region of mRNA encoded by HSF2, corresponding to a HOST TARGET binding site such as BINDING SITE I, BINDING SITE II or BINDING SITE III. Table 2 illustrates the complementarity of the nucleotide sequences of HSF2 BINDING SITE, designated SEQ ID:10838, to the nucleotide sequence of VGAM518 RNA, herein designated VGAM RNA, also designated SEQ ID:3229.

Another function of VGAM518 is therefore inhibition of Heat Shock Transcription Factor 2 (HSF2, Accession NM_004506). Accordingly, utilities of VGAM518 include diagnosis, prevention and treatment of diseases and clinical conditions associated with HSF2. KIAA1323 (Accession XM_032146) is another VGAM518 host target gene. KIAA1323 BINDING SITE is HOST TARGET binding site found in the 3' untranslated region of mRNA encoded by KIAA1323, corresponding to a HOST TARGET binding site such as BINDING SITE I, BINDING SITE II or BINDING SITE III. Table 2 illustrates the complementarity of the nucleotide sequences of KIAA1323 BINDING SITE, designated SEQ ID:31570, to the nucleotide sequence of VGAM518 RNA, herein designated VGAM RNA, also designated SEQ ID:3229.

Another function of VGAM518 is therefore inhibition of KIAA1323 (Accession XM_032146). Accordingly, utilities of VGAM518 include diagnosis, prevention and treatment of diseases and clinical conditions associated with KIAA1323. Nuclear Receptor Subfamily 6, Group A, Member 1 (NR6A1, Accession NM_033334) is another VGAM518 host target gene. NR6A1 BINDING SITE1 through NR6A1 BINDING SITE3 are HOST TARGET binding sites found in untranslated regions of mRNA encoded by NR6A1, corresponding to HOST TARGET binding sites such as BINDING SITE I, BINDING SITE II or BINDING SITE III. Table 2 illustrates the complementarity of the nucleotide sequences of NR6A1 BINDING SITE1 through NR6A1 BINDING SITE3, designated SEQ ID:27182, SEQ ID:27188 and SEQ ID:7234 respectively, to the nucleotide sequence of VGAM518 RNA, herein designated VGAM RNA, also designated SEQ ID:3229.

Another function of VGAM518 is therefore inhibition of Nuclear Receptor Subfamily 6, Group A, Member 1 (NR6A1, Accession NM_033334). Accordingly, utilities of VGAM518 include diagnosis, prevention and treatment of diseases and clinical conditions associated with NR6A1. LOC158235 (Accession XM_098897) is another VGAM518 host target gene. LOC158235 BINDING SITE is HOST TARGET binding site found in the 5' untranslated region of mRNA encoded by LOC158235, corresponding to a HOST TARGET binding site such as BINDING SITE I, BINDING SITE II or BINDING SITE III. Table 2 illustrates the complementarity of the nucleotide sequences of LOC158235 BINDING SITE, designated SEQ ID:41925, to the nucleotide sequence of VGAM518 RNA, herein designated VGAM RNA, also designated SEQ ID:3229.

Another function of VGAM518 is therefore inhibition of LOC158235 (Accession XM_098897). Accordingly, utilities of VGAM518 include diagnosis, prevention and treatment of diseases and clinical conditions associated with LOC158235. LOC158434 (Accession XM_098939) is another VGAM518 host target gene. LOC158434 BINDING SITE is HOST TARGET binding site found in the 3' untranslated region of mRNA encoded by LOC158434, corresponding to a HOST TARGET binding site such as BINDING SITE I, BINDING SITE II or BINDING SITE III. Table 2 illustrates the complementarity of the nucleotide sequences of LOC158434 BINDING SITE, designated SEQ ID:41988, to the nucleotide sequence of VGAM518 RNA, herein designated VGAM RNA, also designated SEQ ID:3229.

Another function of VGAM518 is therefore inhibition of LOC158434 (Accession XM_098939). Accordingly, utilities of VGAM518 include diagnosis, prevention and treatment of diseases and clinical conditions associated with LOC158434. LOC203350 (Accession XM_117536) is another VGAM518 host target gene. LOC203350 BINDING SITE is HOST TARGET binding site found in the 3' untranslated region of mRNA encoded by LOC203350, corresponding to a HOST TARGET binding site such as BINDING SITE I, BINDING SITE II or BINDING SITE III. Table 2 illustrates the complementarity of the nucleotide sequences of LOC203350 BINDING SITE, designated SEQ ID:43536, to the nucleotide sequence of VGAM518 RNA, herein designated VGAM RNA, also designated SEQ ID:3229.

Another function of VGAM518 is therefore inhibition of LOC203350 (Accession XM_117536). Accordingly, utilities of VGAM518 include diagnosis, prevention and treatment of diseases and clinical conditions associated with LOC203350. LOC219529 (Accession XM_167563) is another VGAM518 host target gene. LOC219529 BINDING SITE is HOST TARGET binding site found in the 3' untranslated region of mRNA encoded by LOC219529, corresponding to a HOST TARGET binding site such as BINDING SITE I, BINDING SITE II or BINDING SITE III. Table 2 illustrates the complementarity of the nucleotide sequences of LOC219529 BINDING SITE, designated SEQ ID:44674, to the nucleotide sequence of VGAM518 RNA, herein designated VGAM RNA, also designated SEQ ID:3229.

Another function of VGAM518 is therefore inhibition of LOC219529 (Accession XM_167563). Accordingly, utilities of VGAM518 include diagnosis, prevention and treatment of diseases and clinical conditions associated with LOC219529. LOC253613 (Accession XM_171225) is another VGAM518 host target gene. LOC253613 BINDING SITE is HOST TARGET binding site found in the 3' untranslated region of mRNA encoded by LOC253613, corresponding to a HOST TARGET binding site such as BINDING SITE I, BINDING SITE II or BINDING SITE III. Table 2 illustrates the complementarity of the nucleotide sequences of LOC253613 BINDING SITE, designated SEQ ID:46009, to the nucleotide sequence of VGAM518 RNA, herein designated VGAM RNA, also designated SEQ ID:3229.

Another function of VGAM518 is therefore inhibition of LOC253613 (Accession XM_171225). Accordingly, utilities of VGAM518 include diagnosis, prevention and treatment of diseases and clinical conditions associated with LOC253613. LOC255252 (Accession XM_170779) is another VGAM518 host target gene. LOC255252 BINDING SITE is HOST TARGET binding site found in the 3' untranslated region of mRNA encoded by LOC255252, corresponding to a HOST TARGET binding site such as BINDING SITE I, BINDING SITE II or BINDING SITE III. Table 2 illustrates the complementarity of the nucleotide sequences of LOC255252 BINDING SITE, designated SEQ ID:45549, to the nucleotide sequence of VGAM518 RNA, herein designated VGAM RNA, also designated SEQ ID:3229.

Another function of VGAM518 is therefore inhibition of LOC255252 (Accession XM_170779). Accordingly, utilities of VGAM518 include diagnosis, prevention and treatment of diseases and clinical conditions associated with LOC255252. LOC90750 (Accession XM_033868) is another VGAM518 host target gene. LOC90750 BINDING SITE is HOST TARGET binding site found in the 3' untranslated region of mRNA encoded by LOC90750, corresponding to a HOST TARGET binding site such as BINDING SITE I, BINDING SITE II or BINDING SITE III. Table 2 illustrates the complementarity of the nucleotide sequences of LOC90750 BINDING SITE, designated SEQ ID:31969, to the nucleotide sequence of VGAM518 RNA, herein designated VGAM RNA, also designated SEQ ID:3229.

Another function of VGAM518 is therefore inhibition of LOC90750 (Accession XM_033868). Accordingly, utilities of VGAM518 include diagnosis, prevention and treatment of diseases and clinical conditions associated with LOC90750. FIG. 1 further provides a conceptual description of a novel bioinformatically detected viral gene of the present invention, referred to here as Viral Genomic Address Messenger 519 (VGAM519) viral gene, which modulates expression of respective host target genes thereof, the function and utility of which host target genes is known in the art.

VGAM519 is a novel bioinformatically detected regulatory, non protein coding, viral micro RNA (miRNA) gene. The method by which VGAM519 was detected is described hereinabove with reference to FIGS. 1-8.

VGAM519 gene, herein designated VGAM GENE, is a viral gene contained in the genome of Lymphocystis Disease Virus 1. VGAM519 host target gene, herein designated VGAM HOST TARGET GENE, is a human gene contained in the human genome.

VGAM519 gene encodes a VGAM519 precursor RNA, herein designated VGAM PRECURSOR RNA. Similar to other miRNA genes, and unlike most ordinary genes, VGAM519 precursor RNA does not encode a protein. A nucleotide sequence identical or highly similar to the nucleotide sequence of VGAM519 precursor RNA is designated SEQ ID:505, and is provided hereinbelow with reference to the sequence listing part. Nucleotide sequence SEQ ID:505 is located at position 70833 relative to the genome of Lymphocystis Disease Virus 1.

VGAM519 precursor RNA folds onto itself, forming VGAM519 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM519 folded precursor RNA into VGAM519 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM519 RNA is designated SEQ ID:3230, and is provided hereinbelow with reference to the sequence listing part.

VGAM519 host target gene, herein designated VGAM HOST TARGET GENE, encodes a corresponding messenger RNA, VGAM519 host target RNA, herein designated VGAM HOST TARGET RNA. VGAM519 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM519 RNA, herein designated VGAM RNA, binds complementarily to one or more host target binding sites located in untranslated regions of VGAM519 host target RNA, herein designated VGAM HOST TARGET RNA. This complementary binding is due to the fact that the nucleotide sequence of VGAM519 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM519 RNA, herein designated VGAM RNA, may have a different number of host target binding sites in untranslated regions of a VGAM519 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM519 RNA, herein designated VGAM RNA, to host target binding sites on VGAM519 host target RNA, herein designated VGAM HOST TARGET RNA, such as BINDING SITE I, BINDING SITE II and BINDING SITE III, inhibits translation of VGAM519 host target RNA into VGAM519 host target protein, herein designated VGAM HOST TARGET PROTEIN. VGAM host target protein is therefore outlined by a broken line.

It is appreciated that VGAM519 host target gene, herein designated VGAM HOST TARGET GENE, in fact represents a plurality of VGAM519 host target genes. The mRNA of each one of this plurality of VGAM519 host target genes comprises one or more host target binding sites, each having a nucleotide sequence which is at least partly complementary to VGAM519 RNA, herein designated VGAM RNA, and which when bound by VGAM519 RNA causes inhibition of translation of respective one or more VGAM519 host target proteins.

It is further appreciated by one skilled in the art that the mode of translational inhibition illustrated by FIG. 1 with specific reference to translational inhibition exerted by VGAM519 gene, herein designated VGAM GENE, on one or more VGAM519 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM519 is inhibition of expression of host target genes, as part of a novel viral mechanism of attacking a host. Accordingly, utilities of VGAM519 include diagnosis, prevention and treatment of viral infection by Lymphocystis Disease Virus 1. Specific functions, and accordingly utilities, of VGAM519 correlate with, and may be deduced from, the identity of the host target genes which VGAM519 binds and inhibits, and the function of these host target genes, as elaborated hereinbelow.

Nucleotide sequences of the VGAM519 precursor RNA, herein designated VGAM PRECURSOR RNA, and of the 'diced' VGAM519 RNA, herein designated VGAM RNA, and a schematic representation of the secondary folding of VGAM519 folded precursor RNA, herein designated VGAM FOLDED PRECURSOR RNA, of VGAM519 are further described hereinbelow with reference to Table 1.

Nucleotide sequences of host target binding sites, such as BINDING SITE-I, BINDING SITE-II and BINDING SITE-III of FIG. 1, found on VGAM519 host target RNA, and schematic representation of the complementarity of each of these host target binding sites to VGAM519 RNA, herein designated VGAM RNA, are described hereinbelow with reference to Table 2.

As mentioned hereinabove with reference to FIG. 1, a function of VGAM519 gene, herein designated VGAM is inhibition of expression of VGAM519 target genes. It is appreciated that specific functions, and accordingly utilities, of VGAM519 correlate with, and may be deduced from, the identity of the target genes which VGAM519 binds and inhibits, and the function of these target genes, as elaborated hereinbelow.

Solute Carrier Family 1 (neuronal/epithelial high affinity glutamate transporter, system Xag), Member 1 (SLC1A1, Accession NM_004170) is a VGAM519 host target gene. SLC1A1 BINDING SITE is HOST TARGET binding site found in the 3' untranslated region of mRNA encoded by SLC1A1, corresponding to a HOST TARGET binding site such as BINDING SITE I, BINDING SITE II or BINDING SITE III. Table 2 illustrates the complementarity of the nucleotide sequences of SLC1A1 BINDING SITE, designated SEQ ID:10378, to the nucleotide sequence of VGAM519 RNA, herein designated VGAM RNA, also designated SEQ ID:3230.

A function of VGAM519 is therefore inhibition of Solute Carrier Family 1 (neuronal/epithelial high affinity glutamate transporter, system Xag), Member 1 (SLC1A1, Accession NM_004170), a gene which is a glutamate transporter, essential for terminating the postsynaptic action of glutamate by rapidly removing it from the synaptic cleft. Accordingly, utilities of VGAM519 include diagnosis, prevention and treatment of diseases and clinical conditions associated with SLC1A1. The function of SLC1A1 and its association with various diseases and clinical conditions, has been established by previous studies, as described hereinabove with reference to VGAM206. DKFZP566B183 (Accession NM_015509) is another VGAM519 host target gene. DKFZP566B183 BINDING SITE is HOST TARGET binding site found in the 3' untranslated region of mRNA encoded by DKFZP566B183, corresponding to a HOST TARGET binding site such as BINDING SITE I, BINDING SITE II or BINDING SITE III. Table 2 illustrates the complementarity of the nucleotide sequences of DKFZP566B183 BINDING SITE, designated SEQ ID:17766, to the nucleotide sequence of VGAM519 RNA, herein designated VGAM RNA, also designated SEQ ID:3230.

Another function of VGAM519 is therefore inhibition of DKFZP566B183 (Accession NM_015509). Accordingly, utilities of VGAM519 include diagnosis, prevention and treatment of diseases and clinical conditions associated with DKFZP566B183. FLJ00024 (Accession XM_033361) is another VGAM519 host target gene. FLJ00024 BINDING SITE is HOST TARGET binding site found in the 3' untranslated region of mRNA encoded by FLJ00024, corresponding to a HOST TARGET binding site such as BINDING SITE I, BINDING SITE II or BINDING SITE III. Table 2 illustrates the complementarity of the nucleotide sequences of FLJ00024 BINDING SITE, designated SEQ ID:31886, to the nucleotide sequence of VGAM519 RNA, herein designated VGAM RNA, also designated SEQ ID:3230.

Another function of VGAM519 is therefore inhibition of FLJ00024 (Accession XM_033361). Accordingly, utilities of VGAM519 include diagnosis, prevention and treatment of diseases and clinical conditions associated with FLJ00024. RAB3-GAP150 (Accession NM_012414) is another VGAM519 host target gene. RAB3-GAP150 BINDING SITE is HOST TARGET binding site found in the 3' untranslated region of mRNA encoded by RAB3-GAP150, corresponding to a HOST TARGET binding site such as BINDING SITE I, BINDING SITE II or BINDING SITE III. Table 2 illustrates the complementarity of the nucleotide sequences of RAB3-GAP150 BINDING SITE, designated SEQ ID:14789, to the nucleotide sequence of VGAM519 RNA, herein designated VGAM RNA, also designated SEQ ID:3230.

Another function of VGAM519 is therefore inhibition of RAB3-GAP150 (Accession NM_012414). Accordingly, utilities of VGAM519 include diagnosis, prevention and treatment of diseases and clinical conditions associated with RAB3-GAP150. FIG. 1 further provides a conceptual description of a novel bioinformatically detected viral gene of the present invention, referred to here as Viral Genomic Address Messenger 520 (VGAM520) viral gene, which modulates expression of respective host target genes thereof, the function and utility of which host target genes is known in the art.

VGAM520 is a novel bioinformatically detected regulatory, non protein coding, viral micro RNA (miRNA) gene. The method by which VGAM520 was detected is described hereinabove with reference to FIGS. 1-8.

VGAM520 gene, herein designated VGAM GENE, is a viral gene contained in the genome of Lymphocystis Disease Virus 1. VGAM520 host target gene, herein designated VGAM HOST TARGET GENE, is a human gene contained in the human genome.

VGAM520 gene encodes a VGAM520 precursor RNA, herein designated VGAM PRECURSOR RNA. Similar to other miRNA genes, and unlike most ordinary genes, VGAM520 precursor RNA does not encode a protein. A nucleotide sequence identical or highly similar to the nucleotide sequence of VGAM520 precursor RNA is designated SEQ ID:506, and is provided hereinbelow with reference to the sequence listing part. Nucleotide sequence SEQ ID:506 is located at position 71198 relative to the genome of Lymphocystis Disease Virus 1.

VGAM520 precursor RNA folds onto itself, forming VGAM520 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM520 folded precursor RNA into VGAM520 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM520 RNA is designated SEQ ID:3231, and is provided hereinbelow with reference to the sequence listing part.

VGAM520 host target gene, herein designated VGAM HOST TARGET GENE, encodes a corresponding messenger RNA, VGAM520 host target RNA, herein designated VGAM HOST TARGET RNA. VGAM520 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM520 RNA, herein designated VGAM RNA, binds complementarily to one or more host target binding sites located in untranslated regions of VGAM520 host target RNA, herein designated VGAM HOST TARGET RNA. This complementary binding is due to the fact that the nucleotide sequence of VGAM520 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM520 RNA, herein designated VGAM RNA, may have a different number of host target binding sites in untranslated regions of a VGAM520 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM520 RNA, herein designated VGAM RNA, to host target binding sites on VGAM520 host target RNA, herein designated VGAM HOST TARGET RNA, such as BINDING SITE I, BINDING SITE II and BINDING SITE III, inhibits translation of VGAM520 host target RNA into VGAM520 host target protein, herein designated VGAM HOST TARGET PROTEIN. VGAM host target protein is therefore outlined by a broken line.

It is appreciated that VGAM520 host target gene, herein designated VGAM HOST TARGET GENE, in fact represents a plurality of VGAM520 host target genes. The mRNA of each one of this plurality of VGAM520 host target genes comprises one or more host target binding sites, each having a nucleotide sequence which is at least partly complementary to VGAM520 RNA, herein designated VGAM RNA, and which when bound by VGAM520 RNA causes inhibition of translation of respective one or more VGAM520 host target proteins.

It is further appreciated by one skilled in the art that the mode of translational inhibition illustrated by FIG. 1 with specific reference to translational inhibition exerted by VGAM520 gene, herein designated VGAM GENE, on one or more VGAM520 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM520 is inhibition of expression of host target genes, as part of a novel viral mechanism of attacking a host. Accordingly, utilities of VGAM520 include diagnosis, prevention and treatment of viral infection by Lymphocystis Disease Virus 1. Specific functions, and accordingly utilities, of VGAM520 correlate with, and may be deduced from, the identity of the host target genes which VGAM520 binds and inhibits, and the function of these host target genes, as elaborated hereinbelow.

Nucleotide sequences of the VGAM520 precursor RNA, herein designated VGAM PRECURSOR RNA, and of the 'diced' VGAM520 RNA, herein designated VGAM RNA, and a schematic representation of the secondary folding of VGAM520 folded precursor RNA, herein designated VGAM FOLDED PRECURSOR RNA, of VGAM520 are further described hereinbelow with reference to Table 1.

Nucleotide sequences of host target binding sites, such as BINDING SITE-I, BINDING SITE-II and BINDING SITE-III of FIG. 1, found on VGAM520 host target RNA, and schematic representation of the complementarity of each of these host target binding sites to VGAM520 RNA, herein designated VGAM RNA, are described hereinbelow with reference to Table 2.

As mentioned hereinabove with reference to FIG. 1, a function of VGAM520 gene, herein designated VGAM is inhibition of expression of VGAM520 target genes. It is appreciated that specific functions, and accordingly utilities, of VGAM520 correlate with, and may be deduced from, the identity of the target genes which VGAM520 binds and inhibits, and the function of these target genes, as elaborated hereinbelow.

Nuclear Antigen Sp100 (SP100, Accession NM_003113) is a VGAM520 host target gene. SP100 BINDING SITE is HOST TARGET binding site found in the 3' untranslated region of mRNA encoded by SP100, corresponding to a HOST TARGET binding site such as BINDING SITE I, BINDING SITE II or BINDING SITE III. Table 2 illustrates the complementarity of the nucleotide sequences of SP100 BINDING SITE, designated SEQ ID:9085, to the nucleotide sequence of VGAM520 RNA, herein designated VGAM RNA, also designated SEQ ID:3231.

A function of VGAM520 is therefore inhibition of Nuclear Antigen Sp100 (SP100, Accession NM_003113), a gene which may be involved in transduction of interferon action. Accordingly, utilities of VGAM520 include diagnosis, prevention and treatment of diseases and clinical conditions associated with SP100. The function of SP100 has been established by previous studies. Seeler et al. (1998) showed that SP100 complexes with members of the HP1 family of nonhistone chromosomal proteins (e.g., CBX5, 604478). A variant of SP100, termed SP100B by the authors, contains additional 3-prime sequence encoding a 688-amino acid protein. A splice variant of SP100B, termed SP100-HMG, is joined to an 81-amino acid HMG1 (OMIM Ref. No. 163905)-like peptide by a 14-amino acid bridge. The HMG1-like domain is 87% identical and 93% similar to HMG1. SP100-HMG has the potential to be a DNA-binding protein. All 3 variants, SP100, SP100B, and SP100-HMG, colocalize with HP1 in NBs, suggesting that the N-terminal portion of SP100 is responsible for the interaction. HP1 expression is enhanced when SP100 synthesis is induced by interferon. By Northern blot analysis, Dent et al. (1996) found that SP100B, which they called LYSP100, is expressed only in lymphoid tissues (spleen, tonsil, and thymus), mature B-cell lines, and some T-cell lines, but not in brain, liver, muscle, or nonlymphoid cell lines. They noted that SP100 expression is widespread. By confocal immunofluorescence microscopy, they determined that a minority of the nuclear dots for SP100B overlapped with SP100 and PML, whereas most localized to another class of subnuclear structures, which they termed LANDs (LYSP100-associated nuclear domains), which are morphologically and spatially distinct from PML NBs.

Full details of the abovementioned studies are described in the following publications, the disclosure of which are hereby incorporated by reference:

Seeler, J. S.; Marchio, A.; Sitterlin, D.; Transy, C.; Dejean, A.: Interaction of SP100 with HP1 proteins: a link between the promyelocytic leukemia-associated nuclear bodies and the chromatin compartment. Proc. Nat. Acad. Sci. 95:7316-7321, 1998; and Dent, A. L.; Yewdell, J.; Puvion-Dutilleul, F.; Koken, M. H.; de The, H.; Staudt, L. M.: LYSP100 associated nuclear domains (LANDs): description of a new class of subnuclear structures a.

Further studies establishing the function and utilities of SP100 are found in John Hopkins OMIM database record ID 604585, and in sited publications numbered 4943-494 and 4547 listed in the bibliography section hereinbelow, which are also hereby incorporated by reference. Calcium/calmodulin-dependent Protein Kinase Kinase 2, Beta (CAMKK2, Accession NM_006549) is another VGAM520 host target gene. CAMKK2 BINDING SITE is HOST TARGET binding site found in the 3' untranslated region of mRNA encoded by CAMKK2, corresponding to a HOST TARGET binding site such as BINDING SITE I, BINDING SITE II or BINDING SITE III. Table 2 illustrates the complementarity of the nucleotide sequences of CAMKK2 BINDING SITE, designated SEQ ID:13314, to the nucleotide sequence of VGAM520 RNA, herein designated VGAM RNA, also designated SEQ ID:3231.

Another function of VGAM520 is therefore inhibition of Calcium/calmodulin-dependent Protein Kinase Kinase 2, Beta (CAMKK2, Accession NM_006549). Accordingly, utilities of VGAM520 include diagnosis, prevention and treatment of diseases and clinical conditions associated with CAMKK2. KIAA0449 (Accession NM_017596) is another VGAM520 host target gene. KIAA0449 BINDING SITE is HOST TARGET binding site found in the 3' untranslated region of mRNA encoded by KIAA0449, corresponding to a HOST TARGET binding site such as BINDING SITE I, BINDING SITE II or BINDING SITE III. Table 2 illustrates the complementarity of the nucleotide sequences of KIAA0449 BINDING SITE, designated SEQ ID:19058, to the nucleotide sequence of VGAM520 RNA, herein designated VGAM RNA, also designated SEQ ID:3231.

Another function of VGAM520 is therefore inhibition of KIAA0449 (Accession NM_017596). Accordingly, utilities of VGAM520 include diagnosis, prevention and treatment of diseases and clinical conditions associated with KIAA0449. FIG. 1 further provides a conceptual description of a novel bioinformatically detected viral gene of the present invention, referred to here as Viral Genomic Address Messenger 521 (VGAM521) viral gene, which modulates expression of respective host target genes thereof, the function and utility of which host target genes is known in the art.

VGAM521 is a novel bioinformatically detected regulatory, non protein coding, viral micro RNA (miRNA) gene. The method by which VGAM521 was detected is described hereinabove with reference to FIGS. 1-8.

VGAM521 gene, herein designated VGAM GENE, is a viral gene contained in the genome of Lymphocystis Disease Virus 1. VGAM521 host target gene, herein designated VGAM HOST TARGET GENE, is a human gene contained in the human genome.

VGAM521 gene encodes a VGAM521 precursor RNA, herein designated VGAM PRECURSOR RNA. Similar to other miRNA genes, and unlike most ordinary genes, VGAM521 precursor RNA does not encode a protein. A nucleotide sequence identical or highly similar to the nucleotide sequence of VGAM521 precursor RNA is designated SEQ ID:507, and is provided hereinbelow with reference to the sequence listing part. Nucleotide sequence SEQ ID:507 is located at position 75552 relative to the genome of Lymphocystis Disease Virus 1.

VGAM521 precursor RNA folds onto itself, forming VGAM521 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM521 folded precursor RNA into VGAM521 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM521 RNA is designated SEQ ID:3232, and is provided hereinbelow with reference to the sequence listing part.

VGAM521 host target gene, herein designated VGAM HOST TARGET GENE, encodes a corresponding messenger RNA, VGAM521 host target RNA, herein designated VGAM HOST TARGET RNA. VGAM521 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM521 RNA, herein designated VGAM RNA, binds complementarily to one or more host target binding sites located in untranslated regions of VGAM521 host target RNA, herein designated VGAM HOST TARGET RNA. This complementary binding is due to the fact that the nucleotide sequence of VGAM521 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM521 RNA, herein designated VGAM RNA, may have a different number of host target binding sites in untranslated regions of a VGAM521 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM521 RNA, herein designated VGAM RNA, to host target binding sites on VGAM521 host target RNA, herein designated VGAM HOST TARGET RNA, such as BINDING SITE I, BINDING SITE II and BINDING SITE III, inhibits translation of VGAM521 host target RNA into VGAM521 host target protein, herein designated VGAM HOST TARGET PROTEIN. VGAM host target protein is therefore outlined by a broken line.

It is appreciated that VGAM521 host target gene, herein designated VGAM HOST TARGET GENE, in fact represents a plurality of VGAM521 host target genes. The mRNA of each one of this plurality of VGAM521 host target genes comprises one or more host target binding sites, each having a nucleotide sequence which is at least partly complementary to VGAM521 RNA, herein designated VGAM RNA, and which when bound by VGAM521 RNA causes inhibition of translation of respective one or more VGAM521 host target proteins.

It is further appreciated by one skilled in the art that the mode of translational inhibition illustrated by FIG. 1 with specific reference to translational inhibition exerted by VGAM521 gene, herein designated VGAM GENE, on one or more VGAM521 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM521 is inhibition of expression of host target genes, as part of a novel viral mechanism of attacking a host. Accordingly, utilities of VGAM521 include diagnosis, prevention and treatment of viral infection by Lymphocystis Disease Virus 1. Specific functions, and accordingly utilities, of VGAM521 correlate with, and may be deduced from, the identity of the host target genes which VGAM521 binds and inhibits, and the function of these host target genes, as elaborated hereinbelow.

Nucleotide sequences of the VGAM521 precursor RNA, herein designated VGAM PRECURSOR RNA, and of the 'diced' VGAM521 RNA, herein designated VGAM RNA, and a schematic representation of the secondary folding of VGAM521 folded precursor RNA, herein designated VGAM FOLDED PRECURSOR RNA, of VGAM521 are further described hereinbelow with reference to Table 1.

Nucleotide sequences of host target binding sites, such as BINDING SITE-I, BINDING SITE-II and BINDING SITE-III of FIG. 1, found on VGAM521 host target RNA, and schematic representation of the complementarity of each of these host target binding sites to VGAM521 RNA, herein designated VGAM RNA, are described hereinbelow with reference to Table 2.

As mentioned hereinabove with reference to FIG. 1, a function of VGAM521 gene, herein designated VGAM is inhibition of expression of VGAM521 target genes. It is appreciated that specific functions, and accordingly utilities, of VGAM521 correlate with, and may be deduced from, the identity of the target genes which VGAM521 binds and inhibits, and the function of these target genes, as elaborated hereinbelow.

Neuro-oncological Ventral Antigen 1 (NOVA1, Accession NM_002515) is a VGAM521 host target gene. NOVA1 BINDING SITE1 and NOVA1 BINDING SITE2 are HOST TARGET binding sites found in untranslated regions of mRNA encoded by NOVA1, corresponding to HOST TARGET binding sites such as BINDING SITE I, BINDING SITE II or BINDING SITE III. Table 2 illustrates the complementarity of the nucleotide sequences of NOVA1 BINDING SITE1 and NOVA1 BINDING SITE2, designated SEQ ID:8348 and SEQ ID:13217 respectively, to the nucleotide sequence of VGAM521 RNA, herein designated VGAM RNA, also designated SEQ ID:3232.

A function of VGAM521 is therefore inhibition of Neuro-oncological Ventral Antigen 1 (NOVA1, Accession NM_002515), a gene which may regulate rna splicing or metabolism in a specific subset of developing neurons. Accordingly, utilities of VGAM521 include diagnosis, prevention and treatment of diseases and clinical conditions associated with NOVA1. The function of NOVA1 has been established by previous studies. Using antisera from patients with a paraneoplastic neurologic disorder involving the subcortical motor system, Buckanovich et al. (1993) identified a gene that they termed NOVA1. The NOVA1 gene encodes a neuron-specific RNA-binding protein that is inhibited by paraneoplastic antibodies (Buckanovich et al., 1996). Fletcher et al. (1997) showed that the mouse homolog maps to mouse chromosome 12 and suggested that the human gene is probably located on 14q. See also NOVA2 (OMIM Ref. No. 601991). Prestigiacomo et al. (2001) described a patient with a history of bladder carcinoma (OMIM Ref. No. 109800) who presented with the opsoclonus-ataxia syndrome. They demonstrated the presence of anti-Ri antibodies in the patient's serum and cerebrospinal fluid and found that the target Ri antigen was expressed in the original tumor specimen. This may have been the first instance of the syndrome with bladder cancer; it has been associated in children with neuroblastoma and in adults with breast carcinoma and gynecologic malignancies.

Full details of the abovementioned studies are described in the following publications, the disclosure of which are hereby incorporated by reference:

Buckanovich, R. J.; Posner, J. B.; Darnell, R. B.: Nova, the paraneoplastic Ri antigen, is homologous to an RNA-binding protein and is specifically expressed in the developing motor system. Neuron 11:657-672, 1993; and Prestigiacomo, C. J.; Balmaceda, C.; Dalmau, J.: Anti-Ri-associated paraneoplastic opsoclonus-ataxia syndrome in a man with transitional cell carcinoma: a case report. Cancer 91:1423.

Further studies establishing the function and utilities of NOVA1 are found in John Hopkins OMIM database record ID 602157, and in sited publications numbered 5989-5990, 2386, 481 and 5991 listed in the bibliography section hereinbelow, which are also hereby incorporated by reference. FIG. 1 further provides a conceptual description of a novel bioinformatically detected viral gene of the present invention, referred to here as Viral Genomic Address Messenger 522 (VGAM522) viral gene, which modulates expression of respective host target genes thereof, the function and utility of which host target genes is known in the art.

VGAM522 is a novel bioinformatically detected regulatory, non protein coding, viral micro RNA (miRNA) gene. The method by which VGAM522 was detected is described hereinabove with reference to FIGS. 1-8.

VGAM522 gene, herein designated VGAM GENE, is a viral gene contained in the genome of Lymphocystis Disease Virus 1. VGAM522 host target gene, herein designated VGAM HOST TARGET GENE, is a human gene contained in the human genome.

VGAM522 gene encodes a VGAM522 precursor RNA, herein designated VGAM PRECURSOR RNA. Similar to other miRNA genes, and unlike most ordinary genes, VGAM522 precursor RNA does not encode a protein. A nucleotide sequence identical or highly similar to the nucleotide sequence of VGAM522 precursor RNA is designated SEQ ID:508, and is provided hereinbelow with reference to the sequence listing part. Nucleotide sequence SEQ ID:508 is located at position 76141 relative to the genome of Lymphocystis Disease Virus 1.

VGAM522 precursor RNA folds onto itself, forming VGAM522 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM522 folded precursor RNA into VGAM522 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM522 RNA is designated SEQ ID:3233, and is provided hereinbelow with reference to the sequence listing part.

VGAM522 host target gene, herein designated VGAM HOST TARGET GENE, encodes a corresponding messenger RNA, VGAM522 host target RNA, herein designated VGAM HOST TARGET RNA. VGAM522 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM522 RNA, herein designated VGAM RNA, binds complementarily to one or more host target binding sites located in untranslated regions of VGAM522 host target RNA, herein designated VGAM HOST TARGET RNA. This complementary binding is due to the fact that the nucleotide sequence of VGAM522 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM522 RNA, herein designated VGAM RNA, may have a different number of host target binding sites in untranslated regions of a VGAM522 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM522 RNA, herein designated VGAM RNA, to host target binding sites on VGAM522 host target RNA, herein designated VGAM HOST TARGET RNA, such as BINDING SITE I, BINDING SITE II and BINDING SITE III, inhibits translation of VGAM522 host target RNA into VGAM522 host target protein, herein designated VGAM HOST TARGET PROTEIN. VGAM host target protein is therefore outlined by a broken line.

It is appreciated that VGAM522 host target gene, herein designated VGAM HOST TARGET GENE, in fact represents a plurality of VGAM522 host target genes. The mRNA of each one of this plurality of VGAM522 host target genes comprises one or more host target binding sites, each having a nucleotide sequence which is at least partly complementary to VGAM522 RNA, herein designated VGAM RNA, and which when bound by VGAM522 RNA causes inhibition of translation of respective one or more VGAM522 host target proteins.

It is further appreciated by one skilled in the art that the mode of translational inhibition illustrated by FIG. 1 with specific reference to translational inhibition exerted by VGAM522 gene, herein designated VGAM GENE, on one or more VGAM522 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM522 is inhibition of expression of host target genes, as part of a novel viral mechanism of attacking a host. Accordingly, utilities of VGAM522 include diagnosis, prevention and treatment of viral infection by Lymphocystis Disease Virus 1. Specific functions, and accordingly utilities, of VGAM522 correlate with, and may be deduced from, the identity of the host target genes which VGAM522 binds and inhibits, and the function of these host target genes, as elaborated hereinbelow.

Nucleotide sequences of the VGAM522 precursor RNA, herein designated VGAM PRECURSOR RNA, and of the 'diced' VGAM522 RNA, herein designated VGAM RNA, and a schematic representation of the secondary folding of VGAM522 folded precursor RNA, herein designated VGAM FOLDED PRECURSOR RNA, of VGAM522 are further described hereinbelow with reference to Table 1.

Nucleotide sequences of host target binding sites, such as BINDING SITE-I, BINDING SITE-II and BINDING SITE-III of FIG. 1, found on VGAM522 host target RNA, and schematic representation of the complementarity of each of these host target binding sites to VGAM522 RNA, herein designated VGAM RNA, are described hereinbelow with reference to Table 2.

As mentioned hereinabove with reference to FIG. 1, a function of VGAM522 gene, herein designated VGAM is inhibition of expression of VGAM522 target genes. It is appreciated that specific functions, and accordingly utilities, of VGAM522 correlate with, and may be deduced from, the identity of the target genes which VGAM522 binds and inhibits, and the function of these target genes, as elaborated hereinbelow.

UDP-GlcNAc:betaGal Beta-1,3-N-acetylglucosaminyltransferase 5 (B3GNT5, Accession NM_032047) is a VGAM522 host target gene. B3GNT5 BINDING SITE is HOST TARGET binding site found in the 3' untranslated region of mRNA encoded by B3GNT5, corresponding to a HOST TARGET binding site such as BINDING SITE I, BINDING SITE II or BINDING SITE III. Table 2 illustrates the complementarity of the nucleotide sequences of B3GNT5 BINDING SITE, designated SEQ ID:25764, to the nucleotide sequence of VGAM522 RNA, herein designated VGAM RNA, also designated SEQ ID:3233.

A function of VGAM522 is therefore inhibition of UDP-GlcNAc:betaGal Beta-1,3-N-acetylglucosaminyltransferase 5 (B3GNT5, Accession NM_032047). Accordingly, utilities of VGAM522 include diagnosis, prevention and treatment of diseases and clinical conditions associated with B3GNT5. LOC154007 (Accession XM_087824) is another VGAM522 host target gene. LOC154007 BINDING SITE is HOST TARGET binding site found in the 3' untranslated region of mRNA encoded by LOC154007, corresponding to a HOST TARGET binding site such as BINDING SITE I, BINDING SITE II or BINDING SITE III. Table 2 illustrates the complementarity of the nucleotide sequences of LOC154007 BINDING SITE, designated SEQ ID:39457, to the nucleotide sequence of VGAM522 RNA, herein designated VGAM RNA, also designated SEQ ID:3233.

Another function of VGAM522 is therefore inhibition of LOC154007 (Accession XM_087824). Accordingly, utilities of VGAM522 include diagnosis, prevention and treatment of diseases and clinical conditions associated with LOC154007. FIG. 1 further provides a conceptual description of a novel bioinformatically detected viral gene of the present invention, referred to here as Viral Genomic Address Messenger 523 (VGAM523) viral gene, which modulates expression of respective host target genes thereof, the function and utility of which host target genes is known in the art.

VGAM523 is a novel bioinformatically detected regulatory, non protein coding, viral micro RNA (miRNA) gene. The method by which VGAM523 was detected is described hereinabove with reference to FIGS. 1-8.

VGAM523 gene, herein designated VGAM GENE, is a viral gene contained in the genome of Murid Herpesvirus 4. VGAM523 host target gene, herein designated VGAM HOST TARGET GENE, is a human gene contained in the human genome.

VGAM523 gene encodes a VGAM523 precursor RNA, herein designated VGAM PRECURSOR RNA. Similar to other miRNA genes, and unlike most ordinary genes, VGAM523 precursor RNA does not encode a protein. A nucleotide sequence identical or highly similar to the nucleotide sequence of VGAM523 precursor RNA is designated SEQ ID:509, and is provided hereinbelow with reference to the sequence listing part. Nucleotide sequence SEQ ID:509 is located at position 44554 relative to the genome of Murid Herpesvirus 4.

VGAM523 precursor RNA folds onto itself, forming VGAM523 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM523 folded precursor RNA into VGAM523 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM523 RNA is designated SEQ ID:3234, and is provided hereinbelow with reference to the sequence listing part.

VGAM523 host target gene, herein designated VGAM HOST TARGET GENE, encodes a corresponding messenger RNA, VGAM523 host target RNA, herein designated VGAM HOST TARGET RNA. VGAM523 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM523 RNA, herein designated VGAM RNA, binds complementarily to one or more host target binding sites located in untranslated regions of VGAM523 host target RNA, herein designated VGAM HOST TARGET RNA. This complementary binding is due to the fact that the nucleotide sequence of VGAM523 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM523 RNA, herein designated VGAM RNA, may have a different number of host target binding sites in untranslated regions of a VGAM523 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM523 RNA, herein designated VGAM RNA, to host target binding sites on VGAM523 host target RNA, herein designated VGAM HOST TARGET RNA, such as BINDING SITE I, BINDING SITE II and BINDING SITE III, inhibits translation of VGAM523 host target RNA into VGAM523 host target protein, herein designated VGAM HOST TARGET PROTEIN. VGAM host target protein is therefore outlined by a broken line.

It is appreciated that VGAM523 host target gene, herein designated VGAM HOST TARGET GENE, in fact represents a plurality of VGAM523 host target genes. The mRNA of each one of this plurality of VGAM523 host target genes comprises one or more host target binding sites, each having a nucleotide sequence which is at least partly complementary to VGAM523 RNA, herein designated VGAM RNA, and which when bound by VGAM523 RNA causes inhibition of translation of respective one or more VGAM523 host target proteins.

It is further appreciated by one skilled in the art that the mode of translational inhibition illustrated by FIG. 1 with specific reference to translational inhibition exerted by VGAM523 gene, herein designated VGAM GENE, on one or more VGAM523 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM523 is inhibition of expression of host target genes, as part of a novel viral mechanism of attacking a host. Accordingly, utilities of VGAM523 include diagnosis, prevention and treatment of viral infection by Murid Herpesvirus 4. Specific functions, and accordingly utilities, of VGAM523 correlate with, and may be deduced from, the identity of the host target genes which VGAM523 binds and inhibits, and the function of these host target genes, as elaborated hereinbelow.

Nucleotide sequences of the VGAM523 precursor RNA, herein designated VGAM PRECURSOR RNA, and of the 'diced' VGAM523 RNA, herein designated VGAM RNA, and a schematic representation of the secondary folding of VGAM523 folded precursor RNA, herein designated VGAM FOLDED PRECURSOR RNA, of VGAM523 are further described hereinbelow with reference to Table 1.

Nucleotide sequences of host target binding sites, such as BINDING SITE-I, BINDING SITE-II and BINDING SITE-III of FIG. 1, found on VGAM523 host target RNA, and schematic representation of the complementarity of each of these host target binding sites to VGAM523 RNA, herein designated VGAM RNA, are described hereinbelow with reference to Table 2.

As mentioned hereinabove with reference to FIG. 1, a function of VGAM523 gene, herein designated VGAM is inhibition of expression of VGAM523 target genes. It is appreciated that specific functions, and accordingly utilities, of VGAM523 correlate with, and may be deduced from, the identity of the target genes which VGAM523 binds and inhibits, and the function of these target genes, as elaborated hereinbelow.

Jumonji Homolog (mouse) (JMJ, Accession NM_004973) is a VGAM523 host target gene. JMJ BINDING SITE is HOST TARGET binding site found in the 5" untranslated region of mRNA encoded by JMJ, corresponding to a HOST TARGET binding site such as BINDING SITE I, BINDING SITE II or BINDING SITE III. Table 2 illustrates the complementarity of the nucleotide sequences of JMJ BINDING SITE, designated SEQ ID:11418, to the nucleotide sequence of VGAM523 RNA, herein designated VGAM RNA, also designated SEQ ID:3234.

A function of VGAM523 is therefore inhibition of Jumonji Homolog (mouse) (JMJ, Accession NM_004973), a gene which participates in the negative regulation of cell growth. Accordingly, utilities of VGAM523 include diagnosis, prevention and treatment of diseases and clinical conditions associated with JMJ. The function of JMJ has been established by previous studies. Berge-Lefranc et al. (1996) isolated clones highly homologous to the mouse gene jumonji from a human embryonic cDNA library. In mouse, jumonji (jmj) is required for neural tube formation. Berge-Lefranc et al. (1996) reported that the human jumonji (JMJ) and mouse jmj gene products are 90% identical. Northern blot analysis revealed a low level of expression of JMJ in all human embryonic and adult tissues analyzed. In situ hybridization studies on embryonic slices revealed high levels of expression in dorsal root ganglia neurons. The authors detected high levels of expression in adult cerebral cortex. Toyoda et al. (2000) determined that JMJ is expressed as a 160-kD protein by Western blot analysis. Immunofluorescence and Western blot analysis demonstrated that JMJ specifically localizes to the cell nucleus. Overexpression of JMJ appeared to inhibit cell growth, whereas Jmj-deficient mice had cell growth enhancement. Berge-Lefranc et al. (1996) mapped the human JMJ gene to chromosome 6p24-p23 using autoradiographic in situ hybridization Full details of the abovementioned studies are described in the following publications, the disclosure of which are hereby incorporated by reference:

Berge-Lefranc, J.-L.; Jay, P.; Massacrier, A.; Cau, P.; Mattei, M. G.; Bauer, S.; Marsollier, C.; Berta, P.; Fontes, M.: Characterization of the human jumonji gene. Hum. Molec. Genet. 5:1637-1641, 1996; and Toyoda, M.; Kojima, M.; Takeuchi, T.: Jumonji is a nuclear protein that participates in the negative regulation of cell growth. Biochem. Biophys. Res. Commun. 274: 332-336, 2000.

Further studies establishing the function and utilities of JMJ are found in John Hopkins OMIM database record ID 601594, and in sited publications numbered 1286-1287 listed in the bibliography section hereinbelow, which are also hereby incorporated by reference. Neuronal Cell Adhesion Molecule (NRCAM, Accession NM_005010) is another VGAM523 host target gene. NRCAM BINDING SITE is HOST TARGET binding site found in the 3' untranslated region of mRNA encoded by NRCAM, corresponding to a HOST TARGET binding site such as BINDING SITE I, BINDING SITE II or BINDING SITE III. Table 2 illustrates the complementarity of the nucleotide sequences of NRCAM BINDING SITE, designated SEQ ID:11452, to the nucleotide sequence of VGAM523 RNA, herein designated VGAM RNA, also designated SEQ ID:3234.

Another function of VGAM523 is therefore inhibition of Neuronal Cell Adhesion Molecule (NRCAM, Accession NM_005010), a gene which functions as a cell surface protein and belongs to the immunoglobulin superfamily. Accordingly, utilities of VGAM523 include diagnosis, prevention and treatment of diseases and clinical conditions associated with NRCAM. The function of NRCAM and its association with various diseases and clinical conditions, has been established by previous studies, as described hereinabove with reference to VGAM268. DKFZp564I1922 (Accession NM_015419) is another VGAM523 host target gene. DKFZp564I1922 BINDING SITE is HOST TARGET binding site found in the 3' untranslated region of mRNA encoded by DKFZp564I1922, corresponding to a HOST TARGET binding site such as BINDING SITE I, BINDING SITE II or BINDING SITE III. Table 2 illustrates the complementarity of the nucleotide sequences of DKFZp564I1922 BINDING SITE, designated SEQ ID:17722, to the nucleotide sequence of VGAM523 RNA, herein designated VGAM RNA, also designated SEQ ID:3234.

Another function of VGAM523 is therefore inhibition of DKFZp564I1922 (Accession NM_015419). Accordingly, utilities of VGAM523 include diagnosis, prevention and treatment of diseases and clinical conditions associated with DKFZp564I1922. FLJ10097 (Accession XM_043653) is another VGAM523 host target gene. FLJ10097 BINDING SITE is HOST TARGET binding site found in the 3' untranslated region of mRNA encoded by FLJ10097, corresponding to a HOST TARGET binding site such as BINDING SITE I, BINDING SITE II or BINDING SITE III. Table 2 illustrates the complementarity of the nucleotide sequences of FLJ10097 BINDING SITE, designated SEQ ID:33988, to the nucleotide sequence of VGAM523 RNA, herein designated VGAM RNA, also designated SEQ ID:3234.

Another function of VGAM523 is therefore inhibition of FLJ10097 (Accession XM_043653). Accordingly, utilities of VGAM523 include diagnosis, prevention and treatment of diseases and clinical conditions associated with FLJ10097. FLJ20276 (Accession NM_017738) is another VGAM523 host target gene. FLJ20276 BINDING SITE is HOST TARGET binding site found in the 3' untranslated region of mRNA encoded by FLJ20276, corresponding to a HOST TARGET binding site such as BINDING SITE I, BINDING SITE II or BINDING SITE III. Table 2 illustrates the complementarity of the nucleotide sequences of FLJ20276 BINDING SITE, designated SEQ ID:19327, to the nucleotide sequence of VGAM523 RNA, herein designated VGAM RNA, also designated SEQ ID:3234.

Another function of VGAM523 is therefore inhibition of FLJ20276 (Accession NM_017738). Accordingly, utilities of VGAM523 include diagnosis, prevention and treatment of diseases and clinical conditions associated with FLJ20276. KIAA0825 (Accession XM_027906) is another VGAM523 host target gene. KIAA0825 BINDING SITE is HOST TARGET binding site found in the 3' untranslated region of mRNA encoded by KIAA0825, corresponding to a HOST TARGET binding site such as BINDING SITE I, BINDING SITE II or BINDING SITE III. Table 2 illustrates the complementarity of the nucleotide sequences of KIAA0825 BINDING SITE, designated SEQ ID:30592, to the nucleotide sequence of VGAM523 RNA, herein designated VGAM RNA, also designated SEQ ID:3234.

Another function of VGAM523 is therefore inhibition of KIAA0825 (Accession XM_027906). Accordingly, utilities of VGAM523 include diagnosis, prevention and treatment of diseases and clinical conditions associated with KIAA0825. LOC149153 (Accession XM_097599) is another VGAM523 host target gene. LOC149153 BINDING SITE is HOST TARGET binding site found in the 3' untranslated region of mRNA encoded by LOC149153, corresponding to a HOST TARGET binding site such as BINDING SITE I, BINDING SITE II or BINDING SITE III. Table 2 illustrates the complementarity of the nucleotide sequences of LOC149153 BINDING SITE, designated SEQ ID:40962, to the nucleotide sequence of VGAM523 RNA, herein designated VGAM RNA, also designated SEQ ID:3234.

Another function of VGAM523 is therefore inhibition of LOC149153 (Accession XM_097599). Accordingly, utilities of VGAM523 include diagnosis, prevention and treatment of diseases and clinical conditions associated with LOC149153. LOC200563 (Accession XM_117251) is another VGAM523 host target gene. LOC200563 BINDING SITE is HOST TARGET binding site found in the 5' untranslated region of mRNA encoded by LOC200563, corresponding to a HOST TARGET binding site such as BINDING SITE I, BINDING SITE II or BINDING SITE III. Table 2 illustrates the complementarity of the nucleotide sequences of LOC200563 BINDING SITE, designated SEQ ID:43318, to the nucleotide sequence of VGAM523 RNA, herein designated VGAM RNA, also designated SEQ ID:3234.

Another function of VGAM523 is therefore inhibition of LOC200563 (Accession XM_117251). Accordingly, utilities of VGAM523 include diagnosis, prevention and treatment of diseases and clinical conditions associated with LOC200563. LOC219627 (Accession XM_166402) is another VGAM523 host target gene. LOC219627 BINDING SITE is HOST TARGET binding site found in the 3' untranslated region of mRNA encoded by LOC219627, corresponding to a HOST TARGET binding site such as BINDING SITE I, BINDING SITE II or BINDING SITE III. Table 2 illustrates the complementarity of the nucleotide sequences of LOC219627 BINDING SITE, designated SEQ ID:44272, to the nucleotide sequence of VGAM523 RNA, herein designated VGAM RNA, also designated SEQ ID:3234.

Another function of VGAM523 is therefore inhibition of LOC219627 (Accession XM_166402). Accordingly, utilities of VGAM523 include diagnosis, prevention and treatment of diseases and clinical conditions associated with LOC219627. LOC221814 (Accession XM_168226) is another VGAM523 host target gene. LOC221814 BINDING SITE is HOST TARGET binding site found in the 3' untranslated region of mRNA encoded by LOC221814, corresponding to a HOST TARGET binding site such as BINDING SITE I, BINDING SITE II or BINDING SITE III. Table 2 illustrates the complementarity of the nucleotide sequences of LOC221814 BINDING SITE, designated SEQ ID:45088, to the nucleotide sequence of VGAM523 RNA, herein designated VGAM RNA, also designated SEQ ID:3234.

Another function of VGAM523 is therefore inhibition of LOC221814 (Accession XM_168226). Accordingly, utilities of VGAM523 include diagnosis, prevention and treatment of diseases and clinical conditions associated with LOC221814. LOC257415 (Accession XM_171177) is another VGAM523 host target gene. LOC257415 BINDING SITE is HOST TARGET binding site found in the 3' untranslated region of mRNA encoded by LOC257415, corresponding to a HOST TARGET binding site such as BINDING SITE I, BINDING SITE II or BINDING SITE III. Table 2 illustrates the complementarity of the nucleotide sequences of LOC257415 BINDING SITE, designated SEQ ID:45957, to the nucleotide sequence of VGAM523 RNA, herein designated VGAM RNA, also designated SEQ ID:3234.

Another function of VGAM523 is therefore inhibition of LOC257415 (Accession XM_171177). Accordingly, utilities of VGAM523 include diagnosis, prevention and treatment of diseases and clinical conditions associated with LOC257415. FIG. 1 further provides a conceptual description of a novel bioinformatically detected viral gene of the present invention, referred to here as Viral Genomic Address Messenger 524 (VGAM524) viral gene, which modulates expression of respective host target genes thereof, the function and utility of which host target genes is known in the art.

VGAM524 is a novel bioinformatically detected regulatory, non protein coding, viral micro RNA (miRNA) gene. The method by which VGAM524 was detected is described hereinabove with reference to FIGS. 1-8.

VGAM524 gene, herein designated VGAM GENE, is a viral gene contained in the genome of Murid Herpesvirus 4. VGAM524 host target gene, herein designated VGAM HOST TARGET GENE, is a human gene contained in the human genome.

VGAM524 gene encodes a VGAM524 precursor RNA, herein designated VGAM PRECURSOR RNA. Similar to other miRNA genes, and unlike most ordinary genes, VGAM524 precursor RNA does not encode a protein. A nucleotide sequence identical or highly similar to the nucleotide sequence of VGAM524 precursor RNA is designated SEQ ID:510, and is provided hereinbelow with reference to the sequence listing part. Nucleotide sequence SEQ ID:510 is located at position 45166 relative to the genome of Murid Herpesvirus 4.

VGAM524 precursor RNA folds onto itself, forming VGAM524 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM524 folded precursor RNA into VGAM524 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM524 RNA is designated SEQ ID:3235, and is provided hereinbelow with reference to the sequence listing part.

VGAM524 host target gene, herein designated VGAM HOST TARGET GENE, encodes a corresponding messenger RNA, VGAM524 host target RNA, herein designated VGAM HOST TARGET RNA. VGAM524 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM524 RNA, herein designated VGAM RNA, binds complementarily to one or more host target binding sites located in untranslated regions of VGAM524 host target RNA, herein designated VGAM HOST TARGET RNA. This complementary binding is due to the fact that the nucleotide sequence of VGAM524 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM524 RNA, herein designated VGAM RNA, may have a different number of host target binding sites in untranslated regions of a VGAM524 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM524 RNA, herein designated VGAM RNA, to host target binding sites on VGAM524 host target RNA, herein designated VGAM HOST TARGET RNA, such as BINDING SITE I, BINDING SITE II and BINDING SITE III, inhibits translation of VGAM524 host target RNA into VGAM524 host target protein, herein designated VGAM HOST TARGET PROTEIN. VGAM host target protein is therefore outlined by a broken line.

It is appreciated that VGAM524 host target gene, herein designated VGAM HOST TARGET GENE, in fact represents a plurality of VGAM524 host target genes. The mRNA of each one of this plurality of VGAM524 host target genes comprises one or more host target binding sites, each having a nucleotide sequence which is at least partly complementary to VGAM524 RNA, herein designated VGAM RNA, and which when bound by VGAM524 RNA causes inhibition of translation of respective one or more VGAM524 host target proteins.

It is further appreciated by one skilled in the art that the mode of translational inhibition illustrated by FIG. 1 with specific reference to translational inhibition exerted by VGAM524 gene, herein designated VGAM GENE, on one or more VGAM524 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM524 is inhibition of expression of host target genes, as part of a novel viral mechanism of attacking a host. Accordingly, utilities of VGAM524 include diagnosis, prevention and treatment of viral infection by Murid Herpesvirus 4. Specific functions, and accordingly utilities, of VGAM524 correlate with, and may be deduced from, the identity of the host target genes which VGAM524 binds and inhibits, and the function of these host target genes, as elaborated hereinbelow.

Nucleotide sequences of the VGAM524 precursor RNA, herein designated VGAM PRECURSOR RNA, and of the 'diced' VGAM524 RNA, herein designated VGAM RNA, and a schematic representation of the secondary folding of VGAM524 folded precursor RNA, herein designated VGAM FOLDED PRECURSOR RNA, of VGAM524 are further described hereinbelow with reference to Table 1.

Nucleotide sequences of host target binding sites, such as BINDING SITE-I, BINDING SITE-II and BINDING SITE-III of FIG. 1, found on VGAM524 host target RNA, and schematic representation of the complementarity of each of these host target binding sites to VGAM524 RNA, herein designated VGAM RNA, are described hereinbelow with reference to Table 2.

As mentioned hereinabove with reference to FIG. 1, a function of VGAM524 gene, herein designated VGAM is inhibition of expression of VGAM524 target genes. It is appreciated that specific functions, and accordingly utilities, of VGAM524 correlate with, and may be deduced from, the identity of the target genes which VGAM524 binds and inhibits, and the function of these target genes, as elaborated hereinbelow.

Heterogeneous Nuclear Ribonucleoprotein K (HNRPK, Accession NM_002140) is a VGAM524 host target gene. HNRPK BINDING SITE1 and HNRPK BINDING SITE2 are HOST TARGET binding sites found in untranslated regions of mRNA encoded by HNRPK, corresponding to HOST TARGET binding sites such as BINDING SITE I, BINDING SITE II or BINDING SITE III. Table 2 illustrates the complementarity of the nucleotide sequences of HNRPK BINDING SITE1 and HNRPK BINDING SITE2, designated SEQ ID:7916 and SEQ ID:25280 respectively, to the nucleotide sequence of VGAM524 RNA, herein designated VGAM RNA, also designated SEQ ID:3235.

A function of VGAM524 is therefore inhibition of Heterogeneous Nuclear Ribonucleoprotein K (HNRPK, Accession NM_002140), a gene which play a role in the nuclear metabolism of hnrnas, particularly for pre-mrnas that contain cytidine-rich sequence. Accordingly, utilities of VGAM524 include diagnosis, prevention and treatment of diseases and clinical conditions associated with HNRPK. The function of HNRPK and its association with various diseases and clinical conditions, has been established by previous studies, as described hereinabove with reference to VGAM125. FLJ10546 (Accession XM_002989) is another VGAM524 host target gene. FLJ10546 BINDING SITE is HOST TARGET binding site found in the 5' untranslated region of mRNA encoded by FLJ10546, corresponding to a HOST TARGET binding site such as BINDING SITE I, BINDING SITE II or BINDING SITE III. Table 2 illustrates the complementarity of the nucleotide sequences of FLJ10546 BINDING SITE, designated SEQ ID:29912, to the nucleotide sequence of VGAM524 RNA, herein designated VGAM RNA, also designated SEQ ID:3235.

Another function of VGAM524 is therefore inhibition of FLJ10546 (Accession XM_002989). Accordingly, utilities of VGAM524 include diagnosis, prevention and treatment of diseases and clinical conditions associated with FLJ10546. FIG. 1 further provides a conceptual description of a novel bioinformatically detected viral gene of the present invention, referred to here as Viral Genomic Address Messenger 525 (VGAM525) viral gene, which modulates expression of respective host target genes thereof, the function and utility of which host target genes is known in the art.

VGAM525 is a novel bioinformatically detected regulatory, non protein coding, viral micro RNA (miRNA) gene. The method by which VGAM525 was detected is described hereinabove with reference to FIGS. 1-8.

VGAM525 gene, herein designated VGAM GENE, is a viral gene contained in the genome of Murid Herpesvirus 4. VGAM525 host target gene, herein designated VGAM HOST TARGET GENE, is a human gene contained in the human genome.

VGAM525 gene encodes a VGAM525 precursor RNA, herein designated VGAM PRECURSOR RNA. Similar to other miRNA genes, and unlike most ordinary genes, VGAM525 precursor RNA does not encode a protein. A nucleotide sequence identical or highly similar to the nucleotide sequence of VGAM525 precursor RNA is designated SEQ ID:511, and is provided hereinbelow with reference to the sequence listing part. Nucleotide sequence SEQ ID:511 is located at position 53388 relative to the genome of Murid Herpesvirus 4.

VGAM525 precursor RNA folds onto itself, forming VGAM525 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM525 folded precursor RNA into VGAM525 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM525 RNA is designated SEQ ID:3236, and is provided hereinbelow with reference to the sequence listing part.

VGAM525 host target gene, herein designated VGAM HOST TARGET GENE, encodes a corresponding messenger RNA, VGAM525 host target RNA, herein designated VGAM HOST TARGET RNA. VGAM525 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM525 RNA, herein designated VGAM RNA, binds complementarily to one or more host target binding sites located in untranslated regions of VGAM525 host target RNA, herein designated VGAM HOST TARGET RNA. This complementary binding is due to the fact that the nucleotide sequence of VGAM525 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM525 RNA, herein designated VGAM RNA, may have a different number of host target binding sites in untranslated regions of a VGAM525 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM525 RNA, herein designated VGAM RNA, to host target binding sites on VGAM525 host target RNA, herein designated VGAM HOST TARGET RNA, such as BINDING SITE I, BINDING SITE II and BINDING SITE III, inhibits translation of VGAM525 host target RNA into VGAM525 host target protein, herein designated VGAM HOST TARGET PROTEIN. VGAM host target protein is therefore outlined by a broken line.

It is appreciated that VGAM525 host target gene, herein designated VGAM HOST TARGET GENE, in fact represents a plurality of VGAM525 host target genes. The mRNA of each one of this plurality of VGAM525 host target genes comprises one or more host target binding sites, each having a nucleotide sequence which is at least partly complementary to VGAM525 RNA, herein designated VGAM RNA, and which when bound by VGAM525 RNA causes inhibition of translation of respective one or more VGAM525 host target proteins.

It is further appreciated by one skilled in the art that the mode of translational inhibition illustrated by FIG. 1 with specific reference to translational inhibition exerted by VGAM525 gene, herein designated VGAM GENE, on one or more VGAM525 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM525 is inhibition of expression of host target genes, as part of a novel viral mechanism of attacking a host. Accordingly, utilities of VGAM525 include diagnosis, prevention and treatment of viral infection by Murid Herpesvirus 4. Specific functions, and accordingly utilities, of VGAM525 correlate with, and may be deduced from, the identity of the host target genes which VGAM525 binds and inhibits, and the function of these host target genes, as elaborated hereinbelow.

Nucleotide sequences of the VGAM525 precursor RNA, herein designated VGAM PRECURSOR RNA, and of the 'diced' VGAM525 RNA, herein designated VGAM RNA, and a schematic representation of the secondary folding of VGAM525 folded precursor RNA, herein designated VGAM FOLDED PRECURSOR RNA, of VGAM525 are further described hereinbelow with reference to Table 1.

Nucleotide sequences of host target binding sites, such as BINDING SITE-I, BINDING SITE-II and BINDING SITE-III of FIG. 1, found on VGAM525 host target RNA, and schematic representation of the complementarity of each of these host target binding sites to VGAM525 RNA, herein designated VGAM RNA, are described hereinbelow with reference to Table 2.

As mentioned hereinabove with reference to FIG. 1, a function of VGAM525 gene, herein designated VGAM is inhibition of expression of VGAM525 target genes. It is appreciated that specific functions, and accordingly utilities, of VGAM525 correlate with, and may be deduced from, the identity of the target genes which VGAM525 binds and inhibits, and the function of these target genes, as elaborated hereinbelow.

Amyloid Beta Precursor Protein (cytoplasmic tail) Binding Protein 2 (APPBP2, Accession NM_006380) is a VGAM525 host target gene. APPBP2 BINDING SITE is HOST TARGET binding site found in the 3' untranslated region of mRNA encoded by APPBP2, corresponding to a HOST TARGET binding site such as BINDING SITE I, BINDING SITE II or BINDING SITE III. Table 2 illustrates the complementarity of the nucleotide sequences of APPBP2 BINDING SITE, designated SEQ ID:13077, to the nucleotide sequence of VGAM525 RNA, herein designated VGAM RNA, also designated SEQ ID:3236.

A function of VGAM525 is therefore inhibition of Amyloid Beta Precursor Protein (cytoplasmic tail) Binding Protein 2 (APPBP2, Accession NM_006380), a gene which interacts with the basolateral sorting signal of amyloid precursor protein. Accordingly, utilities of VGAM525 include diagnosis, prevention and treatment of diseases and clinical conditions associated with APPBP2. The function of APPBP2 has been established by previous studies. Epithelial cell surfaces are divided into apical and basolateral domains. The basolateral sorting of cell surface proteins depends on the presence of peptide-based basolateral sorting signals (BaSS) in the cytoplasmic domains of proteins. Amyloid precursor protein (APP; 104760), a basolateral protein implicated in the pathogenesis of Alzheimer disease (AD; 104300), contains a tyrosine-based BaSS. Mutation of the tyrosine results in nonpolarized transport of APP. Using APP-BaSS as bait in a yeast 2-hybrid screen of a HeLa cell cDNA library, followed by negative selection with a tyr-ala mutant APP-BaSS as bait and 5-prime RACE, Zheng et al. (1998) isolated a cDNA encoding amyloid beta precursor protein-binding protein-2 (OMIM Ref. No. APPBP2), which they called PAT1 (protein interacting with APP tail-1). The deduced 585-amino acid hydrophilic APPBP2 protein, which is identical to the uncharacterized KIAA0228 protein identified by Nagase et al. (1996), lacks signal or transmembrane sequences but contains N- and C-terminal globular structures, a coiled coil domain, several protein kinase C phosphorylation sites, and 4 imperfect C-terminal tandem repeats. Binding analysis determined that APPBP2 binds specifically to the tyrosine-containing APP-BaSS and to to the complete cytoplasmic domain of APP; it does not bind to mutant APP-BaSS. Western blot analysis showed that APPBP2 is present as a 70-kD protein in both cytosolic and, together with APP, membrane-associated cell fractions. Immunofluorescence microscopy demonstrated that APPBP2 is present in the Golgi region and that its distribution overlaps that of APP. SDS-PAGE and immunoblotting showed that APPBP2 interacts with microtubules and is functionally associated with APP transport and/or processing. By Northern blot analysis, Nagase et al. (1996) detected ubiquitous expression of KIAA0228 as an approximately 6.5-kb transcript.

Full details of the abovementioned studies are described in the following publications, the disclosure of which are hereby incorporated by reference:

Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human genes. VI. The coding sequences of 80 new genes (KIAA0201-KIAA0280) deduced by analysis of cDNA clones from cell line KG-1 and brain. DNA Res. 3:321-329, 1996; and Zheng, P.; Eastman, J.; Vande Pol, S.; Pimplikar, S. W.: PAT1, a microtubule-interacting protein, recognizes the basolateral sorting signal of amyloid precursor protein. Proc. Nat. Aca.

Further studies establishing the function and utilities of APPBP2 are found in John Hopkins OMIM database record ID 605324, and in sited publications numbered 680 and 9379 listed in the bibliography section hereinbelow, which are also hereby incorporated by reference. Chondroitin Sulfate Proteoglycan 4 (melanoma-associated) (CSPG4, Accession NM_001897) is another VGAM525 host target gene. CSPG4 BINDING SITE is HOST TARGET binding site found in the 3' untranslated region of mRNA encoded by CSPG4, corresponding to a HOST TARGET binding site such as BINDING SITE I, BINDING SITE II or BINDING SITE III. Table 2 illustrates the complementarity of the nucleotide sequences of CSPG4 BINDING SITE, designated SEQ ID:7624, to the nucleotide sequence of VGAM525 RNA, herein designated VGAM RNA, also designated SEQ ID:3236.

Another function of VGAM525 is therefore inhibition of Chondroitin Sulfate Proteoglycan 4 (melanoma-associated) (CSPG4, Accession NM_001897), a gene which plays a role in stabilizing cell-substratum interactions. Accordingly, utilities of VGAM525 include diagnosis, prevention and treatment of diseases and clinical conditions associated with CSPG4. The function of CSPG4 has been established by previous studies. By N-terminal micropeptide sequence analysis, screening a melanoma cell line with a rat NG2 chondroitin sulfate proteoglycan probe, and anchored PCR, Pluschke et al. (1996) isolated a cDNA encoding CSPG4, which they called MCSP. The deduced 2,322-amino acid protein has a signal sequence; 3 N-terminal domains defined by cysteine content; 15 potential N-linked glycosylation sites; a transmembrane segment containing a single cysteine; and a 75-residue cytoplasmic domain with 3 potential phosphorylation sites. Northern blot analysis revealed expression of a 9.0-kb transcript in melanoma cells; expression was not found in other tumors or normal tissues. In situ hybridization analysis demonstrated expression of CSPG4 in cells that stained with MCSP-specific monoclonal antibodies Smith et al. (1996) described the expression of a 220- to 240-kD cell-surface chondroitin sulfate proteoglycan molecule, previously described on human melanoma cells, and by amino acid sequencing identified it as the human homolog of the rat NG2 chondroitin sulfate proteoglycan molecule. They found that is not expressed by normal hematopoietic cells but is selectively expressed by leukemic blast cells from a subpopulation of children with acute myeloid leukemia who have a poor prognosis. These AML blasts have abnormalities in chromosome band 11q23, the site of the MLL gene (OMIM Ref. No.

159555). The authors hypothesized that the gene that encodes the NG2 molecule is controlled by a transcription factor encoded by the MLL gene and that certain types of alterations in MLL result in the aberrant expression of the NG2 molecule. Behm et al. (1996) studied 104 consecutive children at initial presentation with acute lymphoblastic leukemia and concluded that the cell surface expression of NG2 is useful for identifying patients who have t (4;11) or t (11;19) translocations Full details of the abovementioned studies are described in the following publications, the disclosure of which are hereby incorporated by reference:

Pluschke, G.; Vanek, M.; Evans, A.; Dittmar, T.; Schmid, P.; Itin, P.; Filardo, E. J.; Reisfeld, R. A.: Molecular cloning of a human melanoma-associated chondroitin sulfate proteoglycan. Proc. Nat. Acad. Sci. 93:9710-9715, 1996; and Behm, F. G.; Smith, F. O.; Raimondi, S. C.; Pui, C.-H.; Bernstein, I. D.: Human homologue of the rat chondroitin sulfate proteoglycan, NG2, detected by monoclonal antibody 7.1, identifi.

Further studies establishing the function and utilities of CSPG4 are found in John Hopkins OMIM database record ID 601172, and in sited publications numbered 9309-9313 listed in the bibliography section hereinbelow, which are also hereby incorporated by reference. Fibronectin Leucine Rich Transmembrane Protein 2 (FLRT2, Accession NM_013231) is another VGAM525 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14876, to the nucleotide sequence of VGAM525 RNA, herein designated VGAM RNA, also designated SEQ ID:3236.

Another function of VGAM525 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM525 include diagnosis, prevention and treatment of diseases and clinical conditions associated with FLRT2. The function of FLRT2 and its association with various diseases and clinical conditions, has been established by previous studies, as described hereinabove with reference to VGAM247. Neural Precursor Cell Expressed, Developmentally Down-regulated 4 (NEDD4, Accession XM_046129) is another VGAM525 host target gene. NEDD4 BINDING SITE is HOST TARGET binding site found in the 3' untranslated region of mRNA encoded by NEDD4, corresponding to a HOST TARGET binding site such as BINDING SITE I, BINDING SITE II or BINDING SITE III. Table 2 illustrates the complementarity of the nucleotide sequences of NEDD4 BINDING SITE, designated SEQ ID:34690, to the nucleotide sequence of VGAM525 RNA, herein designated VGAM RNA, also designated SEQ ID:3236.

Another function of VGAM525 is therefore inhibition of Neural Precursor Cell Expressed, Developmentally Down-regulated 4 (NEDD4, Accession XM_046129), a gene which ubiquitinates regulatory proteins involved in transcription. Accordingly, utilities of VGAM525 include diagnosis, prevention and treatment of diseases and clinical conditions associated with NEDD4. The function of NEDD4 and its association with various diseases and clinical conditions, has been established by previous studies, as described hereinabove with reference to VGAM209. Dedicator of Cyto-kinesis 3 (DOCK3, Accession XM_039259) is another VGAM525 host target gene. DOCK3 BINDING SITE is HOST TARGET binding site found in the 3' untranslated region of mRNA encoded by DOCK3, corresponding to a HOST TARGET binding site such as BINDING SITE I, BINDING SITE II or BINDING SITE III. Table 2 illustrates the complementarity of the nucleotide sequences of DOCK3 BINDING SITE, designated SEQ ID:33039, to the nucleotide sequence of VGAM525 RNA, herein designated VGAM RNA, also designated SEQ ID:3236.

Another function of VGAM525 is therefore inhibition of Dedicator of Cyto-kinesis 3 (DOCK3, Accession XM_039259). Accordingly, utilities of VGAM525 include diagnosis, prevention and treatment of diseases and clinical conditions associated with DOCK3. FLJ20457 (Accession NM_017832) is another VGAM525 host target gene. FLJ20457 BINDING SITE is HOST TARGET binding site found in the 3' untranslated region of mRNA encoded by FLJ20457, corresponding to a HOST TARGET binding site such as BINDING SITE I, BINDING SITE II or BINDING SITE III. Table 2 illustrates the complementarity of the nucleotide sequences of FLJ20457 BINDING SITE, designated SEQ ID:19495, to the nucleotide sequence of VGAM525 RNA, herein designated VGAM RNA, also designated SEQ ID:3236.

Another function of VGAM525 is therefore inhibition of FLJ20457 (Accession NM_017832). Accordingly, utilities of VGAM525 include diagnosis, prevention and treatment of diseases and clinical conditions associated with FLJ20457. KIAA0293 (Accession XM_027045) is another VGAM525 host target gene. KIAA0293 BINDING SITE is HOST TARGET binding site found in the 3' untranslated region of mRNA encoded by KIAA0293, corresponding to a HOST TARGET binding site such as BINDING SITE I, BINDING SITE II or BINDING SITE III. Table 2 illustrates the complementarity of the nucleotide sequences of KIAA0293 BINDING SITE, designated SEQ ID:30397, to the nucleotide sequence of VGAM525 RNA, herein designated VGAM RNA, also designated SEQ ID:3236.

Another function of VGAM525 is therefore inhibition of KIAA0293 (Accession XM_027045). Accordingly, utilities of VGAM525 include diagnosis, prevention and treatment of diseases and clinical conditions associated with KIAA0293. KIAA0542 (Accession XM_038520) is another VGAM525 host target gene. KIAA0542 BINDING SITE is HOST TARGET binding site found in the 3' untranslated region of mRNA encoded by KIAA0542, corresponding to a HOST TARGET binding site such as BINDING SITE I, BINDING SITE II or BINDING SITE III. Table 2 illustrates the complementarity of the nucleotide sequences of KIAA0542 BINDING SITE, designated SEQ ID:32859, to the nucleotide sequence of VGAM525 RNA, herein designated VGAM RNA, also designated SEQ ID:3236.

Another function of VGAM525 is therefore inhibition of KIAA0542 (Accession XM_038520). Accordingly, utilities of VGAM525 include diagnosis, prevention and treatment of diseases and clinical conditions associated with KIAA0542. KIAA1322 (Accession XM_052626) is another VGAM525 host target gene. KIAA1322 BINDING SITE is HOST TARGET binding site found in the 3' untranslated region of mRNA encoded by KIAA1322, corresponding to a HOST TARGET binding site such as BINDING SITE I, BINDING SITE II or BINDING SITE III. Table 2 illustrates the complementarity of the nucleotide sequences of KIAA1322 BINDING SITE, designated SEQ ID:36018, to the nucleotide sequence of VGAM525 RNA, herein designated VGAM RNA, also designated SEQ ID:3236.

Another function of VGAM525 is therefore inhibition of KIAA1322 (Accession XM_052626). Accordingly, utilities of VGAM525 include diagnosis, prevention and treatment of diseases and clinical conditions associated with KIAA1322. LOC144559 (Accession XM_084896) is another VGAM525 host target gene. LOC144559 BINDING SITE is HOST TARGET binding site found in the 3' untranslated region of mRNA encoded by LOC144559, corresponding to a HOST TARGET binding site such as BINDING SITE I, BINDING SITE II or BINDING SITE III. Table 2 illustrates the complementarity of the nucleotide sequences of LOC144559 BINDING SITE, designated SEQ ID:37763, to the nucleotide sequence of VGAM525 RNA, herein designated VGAM RNA, also designated SEQ ID:3236.

Another function of VGAM525 is therefore inhibition of LOC144559 (Accession XM_084896). Accordingly, utilities of VGAM525 include diagnosis, prevention and treatment of diseases and clinical conditions associated with LOC144559. LOC257041 (Accession XM_173829) is another VGAM525 host target gene. LOC257041 BINDING SITE is HOST TARGET binding site found in the 5' untranslated region of mRNA encoded by LOC257041, corresponding to a HOST TARGET binding site such as BINDING SITE I, BINDING SITE II or BINDING SITE III. Table 2 illustrates the complementarity of the nucleotide sequences of LOC257041 BINDING SITE, designated SEQ ID:46563, to the nucleotide sequence of VGAM525 RNA, herein designated VGAM RNA, also designated SEQ ID:3236.

Another function of VGAM525 is therefore inhibition of LOC257041 (Accession XM_173829). Accordingly, utilities of VGAM525 include diagnosis, prevention and treatment of diseases and clinical conditions associated with LOC257041. FIG. 1 further provides a conceptual description of a novel bioinformatically detected viral gene of the present invention, referred to here as Viral Genomic Address Messenger 526 (VGAM526) viral gene, which modulates expression of respective host target genes thereof, the function and utility of which host target genes is known in the art.

VGAM526 is a novel bioinformatically detected regulatory, non protein coding, viral micro RNA (miRNA) gene. The method by which VGAM526 was detected is described hereinabove with reference to FIGS. 1-8.

VGAM526 gene, herein designated VGAM GENE, is a viral gene contained in the genome of Murid Herpesvirus 4. VGAM526 host target gene, herein designated VGAM HOST TARGET GENE, is a human gene contained in the human genome.

VGAM526 gene encodes a VGAM526 precursor RNA, herein designated VGAM PRECURSOR RNA. Similar to other miRNA genes, and unlike most ordinary genes, VGAM526 precursor RNA does not encode a protein. A nucleotide sequence identical or highly similar to the nucleotide sequence of VGAM526 precursor RNA is designated SEQ ID:512, and is provided hereinbelow with reference to the sequence listing part. Nucleotide sequence SEQ ID:512 is located at position 54037 relative to the genome of Murid Herpesvirus 4.

VGAM526 precursor RNA folds onto itself, forming VGAM526 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM526 folded precursor RNA into VGAM526 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM526 RNA is designated SEQ ID:3237, and is provided hereinbelow with reference to the sequence listing part.

VGAM526 host target gene, herein designated VGAM HOST TARGET GENE, encodes a corresponding messenger RNA, VGAM526 host target RNA, herein designated VGAM HOST TARGET RNA. VGAM526 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM526 RNA, herein designated VGAM RNA, binds complementarily to one or more host target binding sites located in untranslated regions of VGAM526 host target RNA, herein designated VGAM HOST TARGET RNA. This complementary binding is due to the fact that the nucleotide sequence of VGAM526 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM526 RNA, herein designated VGAM RNA, may have a different number of host target binding sites in untranslated regions of a VGAM526 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM526 RNA, herein designated VGAM RNA, to host target binding sites on VGAM526 host target RNA, herein designated VGAM HOST TARGET RNA, such as BINDING SITE I, BINDING SITE II and BINDING SITE III, inhibits translation of VGAM526 host target RNA into VGAM526 host target protein, herein designated VGAM HOST TARGET PROTEIN. VGAM host target protein is therefore outlined by a broken line.

It is appreciated that VGAM526 host target gene, herein designated VGAM HOST TARGET GENE, in fact represents a plurality of VGAM526 host target genes. The mRNA of each one of this plurality of VGAM526 host target genes comprises one or more host target binding sites, each having a nucleotide sequence which is at least partly complementary to VGAM526 RNA, herein designated VGAM RNA, and which when bound by VGAM526 RNA causes inhibition of translation of respective one or more VGAM526 host target proteins.

It is further appreciated by one skilled in the art that the mode of translational inhibition illustrated by FIG. 1 with specific reference to translational inhibition exerted by VGAM526 gene, herein designated VGAM GENE, on one or more VGAM526 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM526 is inhibition of expression of host target genes, as part of a novel viral mechanism of attacking a host. Accordingly, utilities of VGAM526 include diagnosis, prevention and treatment of viral infection by Murid Herpesvirus 4. Specific functions, and accordingly utilities, of VGAM526 correlate with, and may be deduced from, the identity of the host target genes which VGAM526 binds and inhibits, and the function of these host target genes, as elaborated hereinbelow.

Nucleotide sequences of the VGAM526 precursor RNA, herein designated VGAM PRECURSOR RNA, and of the 'diced' VGAM526 RNA, herein designated VGAM RNA, and a schematic representation of the secondary folding of VGAM526 folded precursor RNA, herein designated VGAM FOLDED PRECURSOR RNA, of VGAM526 are further described hereinbelow with reference to Table 1.

Nucleotide sequences of host target binding sites, such as BINDING SITE-I, BINDING SITE-II and BINDING SITE-III of FIG. 1, found on VGAM526 host target RNA, and schematic representation of the complementarity of each of these host target binding sites to VGAM526 RNA, herein designated VGAM RNA, are described hereinbelow with reference to Table 2.

As mentioned hereinabove with reference to FIG. 1, a function of VGAM526 gene, herein designated VGAM is inhibition of expression of VGAM526 target genes. It is appreciated that specific functions, and accordingly utilities, of VGAM526 correlate with, and may be deduced from, the identity of the target genes which VGAM526 binds and inhibits, and the function of these target genes, as elaborated hereinbelow.

LOC143888 (Accession XM_084669) is a VGAM526 host target gene. LOC143888 BINDING SITE is HOST TARGET binding site found in the 3' untranslated region of mRNA encoded by LOC143888, corresponding to a HOST TARGET binding site such as BINDING SITE I, BINDING SITE II or BINDING SITE III. Table 2 illustrates the complementarity of the nucleotide sequences of LOC143888 BINDING SITE, designated SEQ ID:37666, to the nucleotide sequence of VGAM526 RNA, herein designated VGAM RNA, also designated SEQ ID:3237.

A function of VGAM526 is therefore inhibition of LOC143888 (Accession XM_084669). Accordingly, utilities of VGAM526 include diagnosis, prevention and treatment of diseases and clinical conditions associated with LOC143888. FIG. 1 further provides a conceptual description of a novel bioinformatically detected viral gene of the present invention, referred to here as Viral Genomic Address Messenger 527 (VGAM527) viral gene, which modulates expression of respective host target genes thereof, the function and utility of which host target genes is known in the art.

VGAM527 is a novel bioinformatically detected regulatory, non protein coding, viral micro RNA (miRNA) gene. The method by which VGAM527 was detected is described hereinabove with reference to FIGS. 1-8.

VGAM527 gene, herein designated VGAM GENE, is a viral gene contained in the genome of Murid Herpesvirus 4. VGAM527 host target gene, herein designated VGAM HOST TARGET GENE, is a human gene contained in the human genome.

VGAM527 gene encodes a VGAM527 precursor RNA, herein designated VGAM PRECURSOR RNA. Similar to other miRNA genes, and unlike most ordinary genes, VGAM527 precursor RNA does not encode a protein. A nucleotide sequence identical or highly similar to the nucleotide sequence of VGAM527 precursor RNA is designated SEQ ID:513, and is provided hereinbelow with reference to the sequence listing part. Nucleotide sequence SEQ ID:513 is located at position 83822 relative to the genome of Murid Herpesvirus 4.

VGAM527 precursor RNA folds onto itself, forming VGAM527 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM527 folded precursor RNA into VGAM527 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM527 RNA is designated SEQ ID:3238, and is provided hereinbelow with reference to the sequence listing part.

VGAM527 host target gene, herein designated VGAM HOST TARGET GENE, encodes a corresponding messenger RNA, VGAM527 host target RNA, herein designated VGAM HOST TARGET RNA. VGAM527 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM527 RNA, herein designated VGAM RNA, binds complementarily to one or more host target binding sites located in untranslated regions of VGAM527 host target RNA, herein designated VGAM HOST TARGET RNA. This complementary binding is due to the fact that the nucleotide sequence of VGAM527 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM527 RNA, herein designated VGAM RNA, may have a different number of host target binding sites in untranslated regions of a VGAM527 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM527 RNA, herein designated VGAM RNA, to host target binding sites on VGAM527 host target RNA, herein designated VGAM HOST TARGET RNA, such as BINDING SITE I, BINDING SITE II and BINDING SITE III, inhibits translation of VGAM527 host target RNA into VGAM527 host target protein, herein designated VGAM HOST TARGET PROTEIN. VGAM host target protein is therefore outlined by a broken line.

It is appreciated that VGAM527 host target gene, herein designated VGAM HOST TARGET GENE, in fact represents a plurality of VGAM527 host target genes. The mRNA of each one of this plurality of VGAM527 host target genes comprises one or more host target binding sites, each having a nucleotide sequence which is at least partly complementary to VGAM527 RNA, herein designated VGAM RNA, and which when bound by VGAM527 RNA causes inhibition of translation of respective one or more VGAM527 host target proteins.

It is further appreciated by one skilled in the art that the mode of translational inhibition illustrated by FIG. 1 with specific reference to translational inhibition exerted by VGAM527 gene, herein designated VGAM GENE, on one or more VGAM527 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM527 is inhibition of expression of host target genes, as part of a novel viral mechanism of attacking a host. Accordingly, utilities of VGAM527 include diagnosis, prevention and treatment of viral infection by Murid Herpesvirus 4. Specific functions, and accordingly utilities, of VGAM527 correlate with, and may be deduced from, the identity of the host target genes which VGAM527 binds and inhibits, and the function of these host target genes, as elaborated hereinbelow.

Nucleotide sequences of the VGAM527 precursor RNA, herein designated VGAM PRECURSOR RNA, and of the 'diced' VGAM527 RNA, herein designated VGAM RNA, and a schematic representation of the secondary folding of VGAM527 folded precursor RNA, herein designated VGAM FOLDED PRECURSOR RNA, of VGAM527 are further described hereinbelow with reference to Table 1.

Nucleotide sequences of host target binding sites, such as BINDING SITE-I, BINDING SITE-II and BINDING SITE-III of FIG. 1, found on VGAM527 host target RNA, and schematic representation of the complementarity of each of these host target binding sites to VGAM527 RNA, herein designated VGAM RNA, are described hereinbelow with reference to Table 2.

As mentioned hereinabove with reference to FIG. 1, a function of VGAM527 gene, herein designated VGAM is inhibition of expression of VGAM527 target genes. It is appreciated that specific functions, and accordingly utilities, of VGAM527 correlate with, and may be deduced from, the identity of the target genes which VGAM527 binds and inhibits, and the function of these target genes, as elaborated hereinbelow.

BLAME (Accession NM_020125) is a VGAM527 host target gene. BLAME BINDING SITE is HOST TARGET binding site found in the 3' untranslated region of mRNA encoded by BLAME, corresponding to a HOST TARGET binding site such as BINDING SITE I, BINDING SITE II or BINDING SITE III. Table 2 illustrates the complementarity of the nucleotide sequences of BLAME BINDING SITE, designated SEQ ID:21303, to the nucleotide sequence of VGAM527 RNA, herein designated VGAM RNA, also designated SEQ ID:3238.

A function of VGAM527 is therefore inhibition of BLAME (Accession NM_020125). Accordingly, utilities of VGAM527 include diagnosis, prevention and treatment of diseases and clinical conditions associated with BLAME. LOC123242 (Accession XM_063548) is another VGAM527 host target gene. LOC123242 BINDING SITE is HOST TARGET binding site found in the 5' untranslated region of mRNA encoded by LOC123242, corresponding to a HOST TARGET binding site such as BINDING SITE I, BINDING SITE II or BINDING SITE III. Table 2 illustrates the complementarity of the nucleotide sequences of LOC123242 BINDING SITE, designated SEQ ID:37240, to the nucleotide sequence of VGAM527 RNA, herein designated VGAM RNA, also designated SEQ ID:3238.

Another function of VGAM527 is therefore inhibition of LOC123242 (Accession XM_063548). Accordingly, utilities of VGAM527 include diagnosis, prevention and treatment of diseases and clinical conditions associated with LOC123242. LOC253001 (Accession XM_171711) is another VGAM527 host target gene. LOC253001 BINDING SITE is HOST TARGET binding site found in the 5' untranslated region of mRNA encoded by LOC253001, corresponding to a HOST TARGET binding site such as BINDING SITE I, BINDING SITE II or BINDING SITE III. Table 2 illustrates the complementarity of the nucleotide sequences of LOC253001 BINDING SITE, designated SEQ ID:46057, to the nucleotide sequence of VGAM527 RNA, herein designated VGAM RNA, also designated SEQ ID:3238.

Another function of VGAM527 is therefore inhibition of LOC253001 (Accession XM_171711). Accordingly, utilities of VGAM527 include diagnosis, prevention and treatment of diseases and clinical conditions associated with LOC253001. LOC254413 (Accession XM_173141) is another VGAM527 host target gene. LOC254413 BINDING SITE is HOST TARGET binding site found in the 5' untranslated region of mRNA encoded by LOC254413, corresponding to a HOST TARGET binding site such as BINDING SITE I, BINDING SITE II or BINDING SITE III. Table 2 illustrates the complementarity of the nucleotide sequences of LOC254413 BINDING SITE, designated SEQ ID:46403, to the nucleotide sequence of VGAM527 RNA, herein designated VGAM RNA, also designated SEQ ID:3238.

Another function of VGAM527 is therefore inhibition of LOC254413 (Accession XM_173141). Accordingly, utilities of VGAM527 include diagnosis, prevention and treatment of diseases and clinical conditions associated with LOC254413. FIG. 1 further provides a conceptual description of a novel bioinformatically detected viral gene of the present invention, referred to here as Viral Genomic Address Messenger 528 (VGAM528) viral gene, which modulates expression of respective host target genes thereof, the function and utility of which host target genes is known in the art.

VGAM528 is a novel bioinformatically detected regulatory, non protein coding, viral micro RNA (miRNA) gene. The method by which VGAM528 was detected is described hereinabove with reference to FIGS. 1-8.

VGAM528 gene, herein designated VGAM GENE, is a viral gene contained in the genome of Murid Herpesvirus 4. VGAM528 host target gene, herein designated VGAM HOST TARGET GENE, is a human gene contained in the human genome.

VGAM528 gene encodes a VGAM528 precursor RNA, herein designated VGAM PRECURSOR RNA. Similar to other miRNA genes, and unlike most ordinary genes, VGAM528 precursor RNA does not encode a protein. A nucleotide sequence identical or highly similar to the nucleotide sequence of VGAM528 precursor RNA is designated SEQ ID:514, and is provided hereinbelow with reference to the sequence listing part. Nucleotide sequence SEQ ID:514 is located at position 97660 relative to the genome of Murid Herpesvirus 4.

VGAM528 precursor RNA folds onto itself, forming VGAM528 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM528 folded precursor RNA into VGAM528 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM528 RNA is designated SEQ ID:3239, and is provided hereinbelow with reference to the sequence listing part.

VGAM528 host target gene, herein designated VGAM HOST TARGET GENE, encodes a corresponding messenger RNA, VGAM528 host target RNA, herein designated VGAM HOST TARGET RNA. VGAM528 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM528 RNA, herein designated VGAM RNA, binds complementarily to one or more host target binding sites located in untranslated regions of VGAM528 host target RNA, herein designated VGAM HOST TARGET RNA. This complementary binding is due to the fact that the nucleotide sequence of VGAM528 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM528 RNA, herein designated VGAM RNA, may have a different number of host target binding sites in untranslated regions of a VGAM528 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM528 RNA, herein designated VGAM RNA, to host target binding sites on VGAM528 host target RNA, herein designated VGAM HOST TARGET RNA, such as BINDING SITE I, BINDING SITE II and BINDING SITE III, inhibits translation of VGAM528 host target RNA into VGAM528 host target protein, herein designated VGAM HOST TARGET PROTEIN. VGAM host target protein is therefore outlined by a broken line.

It is appreciated that VGAM528 host target gene, herein designated VGAM HOST TARGET GENE, in fact represents a plurality of VGAM528 host target genes. The mRNA of each one of this plurality of VGAM528 host target genes comprises one or more host target binding sites, each having a nucleotide sequence which is at least partly complementary to VGAM528 RNA, herein designated VGAM RNA, and which when bound by VGAM528 RNA causes inhibition of translation of respective one or more VGAM528 host target proteins.

It is further appreciated by one skilled in the art that the mode of translational inhibition illustrated by FIG. 1 with specific reference to translational inhibition exerted by VGAM528 gene, herein designated VGAM GENE, on one or more VGAM528 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM528 is inhibition of expression of host target genes, as part of a novel viral mechanism of attacking a host. Accordingly, utilities of VGAM528 include diagnosis, prevention and treatment of viral infection by Murid Herpesvirus 4. Specific functions, and accordingly utilities, of VGAM528 correlate with, and may be deduced from, the identity of the host target genes which VGAM528 binds and inhibits, and the function of these host target genes, as elaborated hereinbelow.

Nucleotide sequences of the VGAM528 precursor RNA, herein designated VGAM PRECURSOR RNA, and of the 'diced' VGAM528 RNA, herein designated VGAM RNA, and a schematic representation of the secondary folding of VGAM528 folded precursor RNA, herein designated VGAM FOLDED PRECURSOR RNA, of VGAM528 are further described hereinbelow with reference to Table 1.

Nucleotide sequences of host target binding sites, such as BINDING SITE-I, BINDING SITE-II and BINDING SITE-III of FIG. 1, found on VGAM528 host target RNA, and schematic representation of the complementarity of each of these host target binding sites to VGAM528 RNA, herein designated VGAM RNA, are described hereinbelow with reference to Table 2.

As mentioned hereinabove with reference to FIG. 1, a function of VGAM528 gene, herein designated VGAM is inhibition of expression of VGAM528 target genes. It is appreciated that specific functions, and accordingly utilities, of VGAM528 correlate with, and may be deduced from, the identity of the target genes which VGAM528 binds and inhibits, and the function of these target genes, as elaborated hereinbelow.

FAT Tumor Suppressor Homolog 1 (Drosophila) (FAT, Accession NM_005245) is a VGAM528 host target gene. FAT BINDING SITE is HOST TARGET binding site found in the 3' untranslated region of mRNA encoded by FAT, corresponding to a HOST TARGET binding site such as BINDING SITE I, BINDING SITE II or BINDING SITE III. Table 2 illustrates the complementarity of the nucleotide sequences of FAT BINDING SITE, designated SEQ ID:11753, to the nucleotide sequence of VGAM528 RNA, herein designated VGAM RNA, also designated SEQ ID:3239.

A function of VGAM528 is therefore inhibition of FAT Tumor Suppressor Homolog 1 (Drosophila) (FAT, Accession NM_005245), a gene which possibly functions in developmental processes and cell communication. Accordingly, utilities of VGAM528 include diagnosis, prevention and treatment of diseases and clinical conditions associated with FAT. The function of FAT has been established by previous studies.

Cell-cell interactions that involve adhesion molecules are important in many developmental processes. Dunne et al. (1995) stated that many adhesion molecules have been found to be conserved between Drosophila and vertebrates, indicating that the adhesion molecules involved in tissue morphogenesis evolved long before the divergence of the arthropods and chordates Hortsch and Goodman, 1991). Adhesion molecules have been classified into 4 major families: the immunoglobulin superfamily, the integrin superfamily, the selectin family, and the cadherin superfamily. Cadherins mediate homophilic, calcium-dependent cell-cell adhesion in a wide variety of tissues and are important regulators of morphogenesis, and loss of function may be involved in the invasion and metastasis of malignant tumors. The original or classical adherins have a highly conserved domain structure typically including 5 extracellular, conserved repeated amino acid sequences (cadherin repeats). The Drosophila 'fat' gene does not belong to the classical cadherin gene family yet encodes a transmembrane protein containing 34 cadherin repeats in association with a number of other motifs Mahoney et al. (1991). The Drosophila 'fat' locus encodes a tumor suppressor gene, and recessive (loss-of-function) mutations lead to hyperplastic overgrowth of the imaginal discs, indicating that contact-dependent cell interactions may play an important role in regulating growth (Bryant et al., 1988). This excessive cell proliferation occurs while maintaining normal epithelial organization and differentiation potential. Dunne et al. (1995) reported the sequence of a cDNA that was serendipitously obtained during a screen of a human T-lymphocyte cDNA library. The full-length cDNA had the potential to encode a large protein that most resembled the Drosophila 'fat' protein in its possession of 34 cadherin repeats and other characteristics. Therefore, they named the gene and the gene product FAT. Analysis of the expression of FAT in fetal and adult tissues revealed that FAT mRNA is present in many epithelial and some endothelial and smooth muscle cells. The FAT gene was localized to 4q34-q35 by isotopic in situ hybridization. The authors commented that the molecule is probably important in mammalian developmental processes and cell communication. The large FAT protein was predicted to contain nearly 4600 residues Full details of the abovementioned studies are described in the following publications, the disclosure of which are hereby incorporated by reference:

Hortsch, M.; Goodman, C. S.: Cell and substrate adhesion molecules in Drosophila. Ann. Rev. Cell. Biol. 7:505-557, 1991; and Mahoney, P. A.; Weber, U.; Onofrechuk, P.; Biessmann, H.; Bryant, P. J.; Goodman, C. S.: The fat tumor suppressor gene in Drosophila encodes a novel member of the cadherin gene superfa.

Further studies establishing the function and utilities of FAT are found in John Hopkins OMIM database record ID 600976, and in sited publications numbered 7800-7803 listed in the bibliography section hereinbelow, which are also hereby incorporated by reference. Mitogen-activated Protein Kinase Kinase 1 (MAP2K1, Accession NM_002755) is another VGAM528 host target gene. MAP2K1 BINDING SITE is HOST TARGET binding site found in the 3' untranslated region of mRNA encoded by MAP2K1, corresponding to a HOST TARGET binding site such as BINDING SITE I, BINDING SITE II or BINDING SITE III. Table 2 illustrates the complementarity of the nucleotide sequences of MAP2K1 BINDING SITE, designated SEQ ID:8635, to the nucleotide sequence of VGAM528 RNA, herein designated VGAM RNA, also designated SEQ ID:3239.

Another function of VGAM528 is therefore inhibition of Mitogen-activated Protein Kinase Kinase 1 (MAP2K1, Accession NM_002755), a gene which is a signaling intermediate, may take part in cell transformation. Accordingly, utilities of VGAM528 include diagnosis, prevention and treatment of diseases and clinical conditions associated with MAP2K1. The function of MAP2K1 has been established by previous studies. Mitogen-activated protein (MAP) kinases, also known as extracellular signal-regulated kinases (ERKs) (see OMIM Ref. No. PRKM1; 176948), are thought to act as an integration point for multiple biochemical signals because they are activated by a wide variety of extracellular signals, are rapidly phosphorylated on threonine and tyrosine residues, and are highly conserved in evolution (Crews et al., 1992). A critical protein kinase lies upstream of MAP kinase and stimulates the enzymatic activity of MAP kinase. Crews et al. (1992) cloned a mouse cDNA, denoted Mek1 (for Map/Erk kinase-1) by them, that encodes a member of this protein kinase family. The 393-amino acid, 43.5-kD protein is most closely related in size and sequence to the product encoded by the byr1 gene of S. pombe. Crews et al. (1992) found that Mek1 protein expressed in bacteria phosphorylates the Erk gene product in vitro. They showed that the Mek1 gene is highly expressed in murine brain. Ryan et al. (2000) showed that inhibition of MEK1 blocks p53 (OMIM Ref. No. 191170)-induced NF-kappa-B activation and apoptosis but not cell cycle arrest. They demonstrated that p53 activates NF-kappa-B through the RAF/MEK1/p90(rsk) (see OMIM Ref. No. 601684) pathway rather than the TNFR1 (OMIM Ref. No. 191190)/TRAF2 (OMIM Ref. No. 601895)/IKK (e.g., 600664) pathway used by TNFA (OMIM Ref. No. 191160). To elucidate the mechanism through which MAPK signaling regulates the MYOD (OMIM Ref. No. 159970) family of transcription factors, Perry et al. (2001) investigated the role of the signaling intermediate MEK1 in myogenesis. Transfection of activated MEK1 strongly repressed gene activation and myogenic conversion by the MYOD family. This repression was not mediated by direct phosphorylation of MYOD or by changes in MYOD stability or subcellular distribution. Deletion mapping revealed that MEK1-mediated repression required the MYOD N-terminal transactivation domain. Moreover, activated MEK1 was nuclearly localized and bound a complex containing MYOD in a manner that was dependent on the presence of the MYOD N terminus. These data demonstrated that MEK1 signaling has a strong negative effect on MYOD activity via a mechanism involving binding of MEK1 to the nuclear MYOD transcriptional comple Full details of the abovementioned studies are described in the following publications, the disclosure of which are hereby incorporated by reference:

Crews, C. M.; Alessandrini, A.; Erikson, R. L.: The primary structure of MEK, a protein kinase that phosphorylates the ERK gene product. Science 258:478-480, 1992; and Perry, R. L. S.; Parker, M. H.; Rudnicki, M. A.: Activated MEK1 binds the nuclear MyoD transcriptional complex to repress transactivation. Molec. Cell 8: 291-301, 2001.

Further studies establishing the function and utilities of MAP2K1 are found in John Hopkins OMIM database record ID 176872, and in sited publications numbered 10344-10356 listed in the bibliography section hereinbelow, which are also hereby incorporated by reference. KIAA0561 (Accession XM_038150) is another VGAM528 host target gene. KIAA0561 BINDING SITE is HOST TARGET binding site found in the 3' untranslated region of mRNA encoded by KIAA0561, corresponding to a HOST TARGET binding site such as BINDING SITE I, BINDING SITE II or BINDING SITE III. Table 2 illustrates the complementarity of the nucleotide sequences of KIAA0561 BINDING SITE, designated SEQ ID:32767, to the nucleotide sequence of VGAM528 RNA, herein designated VGAM RNA, also designated SEQ ID:3239.

Another function of VGAM528 is therefore inhibition of KIAA0561 (Accession XM_038150). Accordingly, utilities of VGAM528 include diagnosis, prevention and treatment of diseases and clinical conditions associated with KIAA0561. LOC120105 (Accession XM_061864) is another VGAM528 host target gene. LOC120105 BINDING SITE is HOST TARGET binding site found in the 5' untranslated region of mRNA encoded by LOC120105, corresponding to a HOST TARGET binding site such as BINDING SITE I, BINDING SITE II or BINDING SITE III. Table 2 illustrates the complementarity of the nucleotide sequences of LOC120105 BINDING SITE, designated SEQ ID:37209, to the nucleotide sequence of VGAM528 RNA, herein designated VGAM RNA, also designated SEQ ID:3239.

Another function of VGAM528 is therefore inhibition of LOC120105 (Accession XM_061864). Accordingly, utilities of VGAM528 include diagnosis, prevention and treatment of diseases and clinical conditions associated with LOC120105. LOC129831 (Accession XM_059376) is another VGAM528 host target gene. LOC129831 BINDING SITE is HOST TARGET binding site found in the 3' untranslated region of mRNA encoded by LOC129831, corresponding to a HOST TARGET binding site such as BINDING SITE I, BINDING SITE II or BINDING SITE III. Table 2 illustrates the complementarity of the nucleotide sequences of LOC129831 BINDING SITE, designated SEQ ID:36978, to the nucleotide sequence of VGAM528 RNA, herein designated VGAM RNA, also designated SEQ ID:3239.

Another function of VGAM528 is therefore inhibition of LOC129831 (Accession XM_059376). Accordingly, utilities of VGAM528 include diagnosis, prevention and treatment of diseases and clinical conditions associated with LOC129831. FIG. 1 further provides a conceptual description of a novel bioinformatically detected viral gene of the present invention, referred to here as Viral Genomic Address Messenger 529 (VGAM529) viral gene, which modulates expression of respective host target genes thereof, the function and utility of which host target genes is known in the art.

VGAM529 is a novel bioinformatically detected regulatory, non protein coding, viral micro RNA (miRNA) gene. The method by which VGAM529 was detected is described hereinabove with reference to FIGS. 1-8.

VGAM529 gene, herein designated VGAM GENE, is a viral gene contained in the genome of Murid Herpesvirus 4. VGAM529 host target gene, herein designated VGAM HOST TARGET GENE, is a human gene contained in the human genome.

VGAM529 gene encodes a VGAM529 precursor RNA, herein designated VGAM PRECURSOR RNA. Similar to other miRNA genes, and unlike most ordinary genes, VGAM529 precursor RNA does not encode a protein. A nucleotide sequence identical or highly similar to the nucleotide sequence of VGAM529 precursor RNA is designated SEQ ID:515, and is provided hereinbelow with reference to the sequence listing part. Nucleotide sequence SEQ ID:515 is located at position 102688 relative to the genome of Murid Herpesvirus 4.

VGAM529 precursor RNA folds onto itself, forming VGAM529 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM529 folded precursor RNA into VGAM529 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM529 RNA is designated SEQ ID:3240, and is provided hereinbelow with reference to the sequence listing part.

VGAM529 host target gene, herein designated VGAM HOST TARGET GENE, encodes a corresponding messenger RNA, VGAM529 host target RNA, herein designated VGAM HOST TARGET RNA. VGAM529 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM529 RNA, herein designated VGAM RNA, binds complementarily to one or more host target binding sites located in untranslated regions of VGAM529 host target RNA, herein designated VGAM HOST TARGET RNA. This complementary binding is due to the fact that the nucleotide sequence of VGAM529 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM529 RNA, herein designated VGAM RNA, may have a different number of host target binding sites in untranslated regions of a VGAM529 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM529 RNA, herein designated VGAM RNA, to host target binding sites on VGAM529 host target RNA, herein designated VGAM HOST TARGET RNA, such as BINDING SITE I, BINDING SITE II and BINDING SITE III, inhibits translation of VGAM529 host target RNA into VGAM529 host target protein, herein designated VGAM HOST TARGET PROTEIN. VGAM host target protein is therefore outlined by a broken line.

It is appreciated that VGAM529 host target gene, herein designated VGAM HOST TARGET GENE, in fact represents a plurality of VGAM529 host target genes. The mRNA of each one of this plurality of VGAM529 host target genes comprises one or more host target binding sites, each having a nucleotide sequence which is at least partly complementary to VGAM529 RNA, herein designated VGAM RNA, and which when bound by VGAM529 RNA causes inhibition of translation of respective one or more VGAM529 host target proteins.

It is further appreciated by one skilled in the art that the mode of translational inhibition illustrated by FIG. 1 with specific reference to translational inhibition exerted by VGAM529 gene, herein designated VGAM GENE, on one or more VGAM529 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM529 is inhibition of expression of host target genes, as part of a novel viral mechanism of attacking a host. Accordingly, utilities of VGAM529 include diagnosis, prevention and treatment of viral infection by Murid Herpesvirus 4. Specific functions, and accordingly utilities, of VGAM529 correlate with, and may be deduced from, the identity of the host target genes which VGAM529 binds and inhibits, and the function of these host target genes, as elaborated hereinbelow.

Nucleotide sequences of the VGAM529 precursor RNA, herein designated VGAM PRECURSOR RNA, and of the 'diced' VGAM529 RNA, herein designated VGAM RNA, and a schematic representation of the secondary folding of VGAM529 folded precursor RNA, herein designated VGAM FOLDED PRECURSOR RNA, of VGAM529 are further described hereinbelow with reference to Table 1.

Nucleotide sequences of host target binding sites, such as BINDING SITE-I, BINDING SITE-II and BINDING SITE-III of FIG. 1, found on VGAM529 host target RNA, and schematic representation of the complementarity of each of these host target binding sites to VGAM529 RNA, herein designated VGAM RNA, are described hereinbelow with reference to Table 2.

As mentioned hereinabove with reference to FIG. 1, a function of VGAM529 gene, herein designated VGAM is inhibition of expression of VGAM529 target genes. It is appreciated that specific functions, and accordingly utilities, of VGAM529 correlate with, and may be deduced from, the identity of the target genes which VGAM529 binds and inhibits, and the function of these target genes, as elaborated hereinbelow.

DNA Fragmentation Factor, 40 kDa, Beta Polypeptide (caspase-activated DNase) (DFFB, Accession XM_113366) is a VGAM529 host target gene. DFFB BINDING SITE is HOST TARGET binding site found in the 3' untranslated region of mRNA encoded by DFFB, corresponding to a HOST TARGET binding site such as BINDING SITE I, BINDING SITE II or BINDING SITE III. Table 2 illustrates the complementarity of the nucleotide sequences of DFFB BINDING SITE, designated SEQ ID:42243, to the nucleotide sequence of VGAM529 RNA, herein designated VGAM RNA, also designated SEQ ID:3240.

A function of VGAM529 is therefore inhibition of DNA Fragmentation Factor, 40 kDa, Beta Polypeptide (caspase-activated DNase) (DFFB, Accession XM_113366), a gene which induces DNA fragmentation and chromatin condensation during apoptosis. Accordingly, utilities of VGAM529 include diagnosis, prevention and treatment of diseases and clinical conditions associated with DFFB. The function of DFFB and its association with various diseases and clinical conditions, has been established by previous studies, as described hereinabove with reference to VGAM74. Fibroblast Growth Factor 5 (FGF5, Accession NM_004464) is another VGAM529 host target gene. FGF5 BINDING SITE1 and FGF5 BINDING SITE2 are HOST TARGET binding sites found in untranslated regions of mRNA encoded by FGF5, corresponding to HOST TARGET binding sites such as BINDING SITE I, BINDING SITE II or BINDING SITE III. Table 2 illustrates the complementarity of the nucleotide sequences of FGF5 BINDING SITE1 and FGF5 BINDING SITE2, designated SEQ ID:10774 and SEQ ID:27001 respectively, to the nucleotide sequence of VGAM529 RNA, herein designated VGAM RNA, also designated SEQ ID:3240.

Another function of VGAM529 is therefore inhibition of Fibroblast Growth Factor 5 (FGF5, Accession NM_004464), a gene which induces transformation and may regulate neuronal differentiation. Accordingly, utilities of VGAM529 include diagnosis, prevention and treatment of diseases and clinical conditions associated with FGF5. The function of FGF5 and its association with various diseases and clinical conditions, has been established by previous studies, as described hereinabove with reference to VGAM276. Carbohydrate (chondroitin 6) Sulfotransferase 3 (CHST3, Accession NM_004273) is another VGAM529 host target gene. CHST3 BINDING SITE is HOST TARGET binding site found in the 3' untranslated region of mRNA encoded by CHST3, corresponding to a HOST TARGET binding site such as BINDING SITE I, BINDING SITE II or BINDING SITE III. Table 2 illustrates the complementarity of the nucleotide sequences of CHST3 BINDING SITE, designated SEQ ID:10485, to the nucleotide sequence of VGAM529 RNA, herein designated VGAM RNA, also designated SEQ ID:3240.

Another function of VGAM529 is therefore inhibition of Carbohydrate (chondroitin 6) Sulfotransferase 3 (CHST3, Accession NM_004273). Accordingly, utilities of VGAM529 include diagnosis, prevention and treatment of diseases and clinical conditions associated with CHST3. FLJ10713 (Accession NM_018189) is another VGAM529 host target gene. FLJ10713 BINDING SITE is HOST TARGET binding site found in the 3" untranslated region of mRNA encoded by FLJ10713, corresponding to a HOST TARGET binding site such as BINDING SITE I, BINDING SITE II or BINDING SITE III. Table 2 illustrates the complementarity of the nucleotide sequences of FLJ10713 BINDING SITE, designated SEQ ID:20041, to the nucleotide sequence of VGAM529 RNA, herein designated VGAM RNA, also designated SEQ ID:3240.

Another function of VGAM529 is therefore inhibition of FLJ10713 (Accession NM_018189). Accordingly, utilities of VGAM529 include diagnosis, prevention and treatment of diseases and clinical conditions associated with FLJ10713. FLJ12363 (Accession NM_032167) is another VGAM529 host target gene. FLJ12363 BINDING SITE is HOST TARGET binding site found in the 3' untranslated region of mRNA encoded by FLJ12363, corresponding to a HOST TARGET binding site such as BINDING SITE I, BINDING SITE II or BINDING SITE III. Table 2 illustrates the complementarity of the nucleotide sequences of FLJ12363 BINDING SITE, designated SEQ ID:25867, to the nucleotide sequence of VGAM529 RNA, herein designated VGAM RNA, also designated SEQ ID:3240.

Another function of VGAM529 is therefore inhibition of FLJ12363 (Accession NM_032167). Accordingly, utilities of VGAM529 include diagnosis, prevention and treatment of diseases and clinical conditions associated with FLJ12363. FLJ12973 (Accession NM_024908) is another VGAM529 host target gene. FLJ12973 BINDING SITE is HOST TARGET binding site found in the 3' untranslated region of mRNA encoded by FLJ12973, corresponding to a HOST TARGET binding site such as BINDING SITE I, BINDING SITE II or BINDING SITE III. Table 2 illustrates the complementarity of the nucleotide sequences of FLJ12973 BINDING SITE, designated SEQ ID:24407, to the nucleotide sequence of VGAM529 RNA, herein designated VGAM RNA, also designated SEQ ID:3240.

Another function of VGAM529 is therefore inhibition of FLJ12973 (Accession NM_024908). Accordingly, utilities of VGAM529 include diagnosis, prevention and treatment of diseases and clinical conditions associated with FLJ12973. FLJ22684 (Accession NM_025048) is another VGAM529 host target gene. FLJ22684 BINDING SITE is HOST TARGET binding site found in the 3' untranslated region of mRNA encoded by FLJ22684, corresponding to a HOST TARGET binding site such as BINDING SITE I, BINDING SITE II or BINDING SITE III. Table 2 illustrates the complementarity of the nucleotide sequences of FLJ22684 BINDING SITE, designated SEQ ID:24643, to the nucleotide sequence of VGAM529 RNA, herein designated VGAM RNA, also designated SEQ ID:3240.

Another function of VGAM529 is therefore inhibition of FLJ22684 (Accession NM_025048). Accordingly, utilities of VGAM529 include diagnosis, prevention and treatment of diseases and clinical conditions associated with FLJ22684. FLJ31101 (Accession NM_017964) is another VGAM529 host target gene. FLJ31101 BINDING SITE is HOST TARGET binding site found in the 3' untranslated region of mRNA encoded by FLJ31101, corresponding to a HOST TARGET binding site such as BINDING SITE I, BINDING SITE II or BINDING SITE III. Table 2 illustrates the complementarity of the nucleotide sequences of FLJ31101 BINDING SITE, designated SEQ ID:19684, to the nucleotide sequence of VGAM529 RNA, herein designated VGAM RNA, also designated SEQ ID:3240.

Another function of VGAM529 is therefore inhibition of FLJ31101 (Accession NM_017964). Accordingly, utilities of VGAM529 include diagnosis, prevention and treatment of diseases and clinical conditions associated with FLJ31101. KIAA0513 (Accession NM_014732) is another VGAM529 host target gene. KIAA0513 BINDING SITE is HOST TARGET binding site found in the 5' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16357, to the nucleotide sequence of VGAM529 RNA, herein designated VGAM RNA, also designated SEQ ID:3240.

Another function of VGAM529 is therefore inhibition of KIAA0513 (Accession NM_014732). Accordingly, utilities of VGAM529 include diagnosis, prevention and treatment of diseases and clinical conditions associated with KIAA0513. MDS018 (Accession NM_021823) is another VGAM529 host target gene. MDS018 BINDING SITE is HOST TARGET binding site found in the 3' untranslated region of mRNA encoded by MDS018, corresponding to a HOST TARGET binding site such as BINDING SITE I, BINDING SITE II or BINDING SITE III. Table 2 illustrates the complementarity of the nucleotide sequences of MDS018 BINDING SITE, designated SEQ ID:22402, to the nucleotide sequence of VGAM529 RNA, herein designated VGAM RNA, also designated SEQ ID:3240.

Another function of VGAM529 is therefore inhibition of MDS018 (Accession NM_021823). Accordingly, utilities of VGAM529 include diagnosis, prevention and treatment of diseases and clinical conditions associated with MDS018. MGC11386 (Accession NM_032933) is another VGAM529 host target gene. MGC11386 BINDING SITE is HOST TARGET binding site found in the 3' untranslated region of mRNA encoded by MGC11386, corresponding to a HOST TARGET binding site such as BINDING SITE I, BINDING SITE II or BINDING SITE III. Table 2 illustrates the complementarity of the nucleotide sequences of MGC11386 BINDING SITE, designated SEQ ID:26756, to the nucleotide sequence of VGAM529 RNA, herein designated VGAM RNA, also designated SEQ ID:3240.

Another function of VGAM529 is therefore inhibition of MGC11386 (Accession NM_032933). Accordingly, utilities of VGAM529 include diagnosis, prevention and treatment of diseases and clinical conditions associated with MGC11386. MGC15416 (Accession NM_138418) is another VGAM529 host target gene. MGC15416 BINDING SITE is HOST TARGET binding site found in the 3' untranslated region of mRNA encoded by MGC15416, corresponding to a HOST TARGET binding site such as BINDING SITE I, BINDING SITE II or BINDING SITE III. Table 2 illustrates the complementarity of the nucleotide sequences of MGC15416 BINDING SITE, designated SEQ ID:28788, to the nucleotide sequence of VGAM529 RNA, herein designated VGAM RNA, also designated SEQ ID:3240.

Another function of VGAM529 is therefore inhibition of MGC15416 (Accession NM_138418). Accordingly, utilities of VGAM529 include diagnosis, prevention and treatment of diseases and clinical conditions associated with MGC15416. MGC2474 (Accession NM_023931) is another VGAM529 host target gene. MGC2474 BINDING SITE is HOST TARGET binding site found in the 3' untranslated region of mRNA encoded by MGC2474, corresponding to a HOST TARGET binding site such as BINDING SITE I, BINDING SITE II or BINDING SITE III. Table 2 illustrates the complementarity of the nucleotide sequences of MGC2474 BINDING SITE, designated SEQ ID:23417, to the nucleotide sequence of VGAM529 RNA, herein designated VGAM RNA, also designated SEQ ID:3240.

Another function of VGAM529 is therefore inhibition of MGC2474 (Accession NM_023931). Accordingly, utilities of VGAM529 include diagnosis, prevention and treatment of diseases and clinical conditions associated with MGC2474. PRO2389 (Accession XM_033334) is another VGAM529 host target gene. PRO2389 BINDING SITE is HOST TARGET binding site found in the 3' untranslated region of mRNA encoded by PRO2389, corresponding to a HOST TARGET binding site such as BINDING SITE I, BINDING SITE II or BINDING SITE III. Table 2 illustrates the complementarity of the nucleotide sequences of PRO2389 BINDING SITE, designated SEQ ID:31880, to the nucleotide sequence of VGAM529 RNA, herein designated VGAM RNA, also designated SEQ ID:3240.

Another function of VGAM529 is therefore inhibition of PRO2389 (Accession XM_033334). Accordingly, utilities of VGAM529 include diagnosis, prevention and treatment of diseases and clinical conditions associated with PRO2389. Protein Tyrosine Phosphatase, Receptor Type, N Polypeptide 2 (PTPRN2, Accession NM_130842) is another VGAM529 host target gene. PTPRN2 BINDING SITE1 and PTPRN2 BINDING SITE2 are HOST TARGET binding sites found in untranslated regions of mRNA encoded by PTPRN2, corresponding to HOST TARGET binding sites such as BINDING SITE I, BINDING SITE II or BINDING SITE III. Table 2 illustrates the complementarity of the nucleotide sequences of PTPRN2 BINDING SITE1 and PTPRN2 BINDING SITE2, designated SEQ ID:28371 and SEQ ID:28376 respectively, to the nucleotide sequence of VGAM529 RNA, herein designated VGAM RNA, also designated SEQ ID:3240.

Another function of VGAM529 is therefore inhibition of Protein Tyrosine Phosphatase, Receptor Type, N Polypeptide 2 (PTPRN2, Accession NM_130842). Accordingly, utilities of VGAM529 include diagnosis, prevention and treatment of diseases and clinical conditions associated with PTPRN2. LOC146909 (Accession XM_085634) is another VGAM529 host target gene. LOC146909 BINDING SITE is HOST TARGET binding site found in the 3' untranslated region of mRNA encoded by LOC146909, corresponding to a HOST TARGET binding site such as BINDING SITE I, BINDING SITE II or BINDING SITE III. Table 2 illustrates the complementarity of the nucleotide sequences of LOC146909 BINDING SITE, designated SEQ ID:38267, to the nucleotide sequence of VGAM529 RNA, herein designated VGAM RNA, also designated SEQ ID:3240.

Another function of VGAM529 is therefore inhibition of LOC146909 (Accession XM_085634). Accordingly, utilities of VGAM529 include diagnosis, prevention and treatment of diseases and clinical conditions associated with LOC146909. LOC152313 (Accession XM_098190) is another VGAM529 host target gene. LOC152313 BINDING SITE is HOST TARGET binding site found in the 3' untranslated region of mRNA encoded by LOC152313, corresponding to a HOST TARGET binding site such as BINDING SITE I, BINDING SITE II or BINDING SITE III. Table 2 illustrates the complementarity of the nucleotide sequences of LOC152313 BINDING SITE, designated SEQ ID:41476, to the nucleotide sequence of VGAM529 RNA, herein designated VGAM RNA, also designated SEQ ID:3240.

Another function of VGAM529 is therefore inhibition of LOC152313 (Accession XM_098190). Accordingly, utilities of VGAM529 include diagnosis, prevention and treatment of diseases and clinical conditions associated with LOC152313. LOC154877 (Accession XM_098626) is another VGAM529 host target gene. LOC154877 BINDING SITE is HOST TARGET binding site found in the 3' untranslated region of mRNA encoded by LOC154877, corresponding to a HOST TARGET binding site such as BINDING SITE I, BINDING SITE II or BINDING SITE III. Table 2 illustrates the complementarity of the nucleotide sequences of LOC154877 BINDING SITE, designated SEQ ID:41742, to the nucleotide sequence of VGAM529 RNA, herein designated VGAM RNA, also designated SEQ ID:3240.

Another function of VGAM529 is therefore inhibition of LOC154877 (Accession XM_098626). Accordingly, utilities of VGAM529 include diagnosis, prevention and treatment of diseases and clinical conditions associated with LOC154877. LOC169026 (Accession XM_095471) is another VGAM529 host target gene. LOC169026 BINDING SITE is HOST TARGET binding site found in the 3' untranslated region of mRNA encoded by LOC169026, corresponding to a HOST TARGET binding site such as BINDING SITE I, BINDING SITE II or BINDING SITE III. Table 2 illustrates the complementarity of the nucleotide sequences of LOC169026 BINDING SITE, designated SEQ ID:40265, to the nucleotide sequence of VGAM529 RNA, herein designated VGAM RNA, also designated SEQ ID:3240.

Another function of VGAM529 is therefore inhibition of LOC169026 (Accession XM_095471). Accordingly, utilities of VGAM529 include diagnosis, prevention and treatment of diseases and clinical conditions associated with LOC169026. LOC200014 (Accession XM_114087) is another VGAM529 host target gene. LOC200014 BINDING SITE is HOST TARGET binding site found in the 3' untranslated region of mRNA encoded by LOC200014, corresponding to a HOST TARGET binding site such as BINDING SITE I, BINDING SITE II or BINDING SITE III. Table 2 illustrates the complementarity of the nucleotide sequences of LOC200014 BINDING SITE, designated SEQ ID:42691, to the nucleotide sequence of VGAM529 RNA, herein designated VGAM RNA, also designated SEQ ID:3240.

Another function of VGAM529 is therefore inhibition of LOC200014 (Accession XM_114087). Accordingly, utilities of VGAM529 include diagnosis, prevention and treatment of diseases and clinical conditions associated with LOC200014. LOC254439 (Accession XM_170659) is another VGAM529 host target gene. LOC254439 BINDING SITE is HOST TARGET binding site found in the 3' untranslated region of mRNA encoded by LOC254439, corresponding to a HOST TARGET binding site such as BINDING SITE I, BINDING SITE II or BINDING SITE III. Table 2 illustrates the complementarity of the nucleotide sequences of LOC254439 BINDING SITE, designated SEQ ID:45432, to the nucleotide sequence of VGAM529 RNA, herein designated VGAM RNA, also designated SEQ ID:3240.

Another function of VGAM529 is therefore inhibition of LOC254439 (Accession XM_170659). Accordingly, utilities of VGAM529 include diagnosis, prevention and treatment of diseases and clinical conditions associated with LOC254439. LOC57107 (Accession NM_020381) is another VGAM529 host target gene. LOC57107 BINDING SITE is HOST TARGET binding site found in the 3' untranslated region of mRNA encoded by LOC57107, corresponding to a HOST TARGET binding site such as BINDING SITE I, BINDING SITE II or BINDING SITE III. Table 2 illustrates the complementarity of the nucleotide sequences of LOC57107 BINDING SITE, designated SEQ ID:21649, to the nucleotide sequence of VGAM529 RNA, herein designated VGAM RNA, also designated SEQ ID:3240.

Another function of VGAM529 is therefore inhibition of LOC57107 (Accession NM_020381). Accordingly, utilities of VGAM529 include diagnosis, prevention and treatment of diseases and clinical conditions associated with LOC57107. FIG. 1 further provides a conceptual description of a novel bioinformatically detected viral gene of the present invention, referred to here as Viral Genomic Address Messenger 530 (VGAM530) viral gene, which modulates expression of respective host target genes thereof, the function and utility of which host target genes is known in the art.

VGAM530 is a novel bioinformatically detected regulatory, non protein coding, viral micro RNA (miRNA) gene. The method by which VGAM530 was detected is described hereinabove with reference to FIGS. 1-8.

VGAM530 gene, herein designated VGAM GENE, is a viral gene contained in the genome of Common Chimpanzee Papillomavirus 1. VGAM530 host target gene, herein designated VGAM HOST TARGET GENE, is a human gene contained in the human genome.

VGAM530 gene encodes a VGAM530 precursor RNA, herein designated VGAM PRECURSOR RNA. Similar to other miRNA genes, and unlike most ordinary genes, VGAM530 precursor RNA does not encode a protein. A nucleotide sequence identical or highly similar to the nucleotide sequence of VGAM530 precursor RNA is designated SEQ ID:516, and is provided hereinbelow with reference to the sequence listing part. Nucleotide sequence SEQ ID:516 is located at position 2882 relative to the genome of Common Chimpanzee Papillomavirus 1.

VGAM530 precursor RNA folds onto itself, forming VGAM530 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM530 folded precursor RNA into VGAM530 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 78%) nucleotide sequence of VGAM530 RNA is designated SEQ ID:3241, and is provided hereinbelow with reference to the sequence listing part.

VGAM530 host target gene, herein designated VGAM HOST TARGET GENE, encodes a corresponding messenger RNA, VGAM530 host target RNA, herein designated VGAM HOST TARGET RNA. VGAM530 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM530 RNA, herein designated VGAM RNA, binds complementarily to one or more host target binding sites located in untranslated regions of VGAM530 host target RNA, herein designated VGAM HOST TARGET RNA. This complementary binding is due to the fact that the nucleotide sequence of VGAM530 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM530 RNA, herein designated VGAM RNA, may have a different number of host target binding sites in untranslated regions of a VGAM530 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM530 RNA, herein designated VGAM RNA, to host target binding sites on VGAM530 host target RNA, herein designated VGAM HOST TARGET RNA, such as BINDING SITE I, BINDING SITE II and BINDING SITE III, inhibits translation of VGAM530 host target RNA into VGAM530 host target protein, herein designated VGAM HOST TARGET PROTEIN. VGAM host target protein is therefore outlined by a broken line.

It is appreciated that VGAM530 host target gene, herein designated VGAM HOST TARGET GENE, in fact represents a plurality of VGAM530 host target genes. The mRNA of each one of this plurality of VGAM530 host target genes comprises one or more host target binding sites, each having a nucleotide sequence which is at least partly complementary to VGAM530 RNA, herein designated VGAM RNA, and which when bound by VGAM530 RNA causes inhibition of translation of respective one or more VGAM530 host target proteins.

It is further appreciated by one skilled in the art that the mode of translational inhibition illustrated by FIG. 1 with specific reference to translational inhibition exerted by VGAM530 gene, herein designated VGAM GENE, on one or more VGAM530 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM530 is inhibition of expression of host target genes, as part of a novel viral mechanism of attacking a host. Accordingly, utilities of VGAM530 include diagnosis, prevention and treatment of viral infection by Common Chimpanzee Papillomavirus 1. Specific functions, and accordingly utilities, of VGAM530 correlate with, and may be deduced from, the identity of the host target genes which VGAM530 binds and inhibits, and the function of these host target genes, as elaborated hereinbelow.

Nucleotide sequences of the VGAM530 precursor RNA, herein designated VGAM PRECURSOR RNA, and of the 'diced' VGAM530 RNA, herein designated VGAM RNA, and a schematic representation of the secondary folding of VGAM530 folded precursor RNA, herein designated VGAM FOLDED PRECURSOR RNA, of VGAM530 are further described hereinbelow with reference to Table 1.

Nucleotide sequences of host target binding sites, such as BINDING SITE-I, BINDING SITE-II and BINDING SITE-III of FIG. 1, found on VGAM530 host target RNA, and schematic representation of the complementarity of each of these host target binding sites to VGAM530 RNA, herein designated VGAM RNA, are described hereinbelow with reference to Table 2.

As mentioned hereinabove with reference to FIG. 1, a function of VGAM530 gene, herein designated VGAM is inhibition of expression of VGAM530 target genes. It is appreciated that specific functions, and accordingly utilities, of VGAM530 correlate with, and may be deduced from, the identity of the target genes which VGAM530 binds and inhibits, and the function of these target genes, as elaborated hereinbelow.

5'-nucleotidase, Cytosolic II (NT5C2, Accession NM_012229) is a VGAM530 host target gene. NT5C2 BINDING SITE is HOST TARGET binding site found in the 3' untranslated region of mRNA encoded by NT5C2, corresponding to a HOST TARGET binding site such as BINDING SITE I, BINDING SITE II or BINDING SITE III. Table 2 illustrates the complementarity of the nucleotide sequences of NT5C2 BINDING SITE, designated SEQ ID:14527, to the nucleotide sequence of VGAM530 RNA, herein designated VGAM RNA, also designated SEQ ID:3241.

A function of VGAM530 is therefore inhibition of 5'-nucleotidase, Cytosolic II (NT5C2, Accession NM_012229). Accordingly, utilities of VGAM530 include diagnosis, prevention and treatment of diseases and clinical conditions associated with NT5C2. Rho-associated, Coiled-coil Containing Protein Kinase 2 (ROCK2, Accession XM_038377) is another VGAM530 host target gene. ROCK2 BINDING SITE is HOST TARGET binding site found in the 3' untranslated region of mRNA encoded by ROCK2, corresponding to a HOST TARGET binding site such as BINDING SITE I, BINDING SITE II or BINDING SITE III. Table 2 illustrates the complementarity of the nucleotide sequences of ROCK2 BINDING SITE, designated SEQ ID:32838, to the nucleotide sequence of VGAM530 RNA, herein designated VGAM RNA, also designated SEQ ID:3241.

Another function of VGAM530 is therefore inhibition of Rho-associated, Coiled-coil Containing Protein Kinase 2 (ROCK2, Accession XM_038377), a gene which regulates cytokinesis, smooth muscle contraction, the formation of actin stress fibers and focal adhesions. Accordingly, utilities of VGAM530 include diagnosis, prevention and treatment of diseases and clinical conditions associated with ROCK2. The function of ROCK2 and its association with various diseases and clinical conditions, has been established by previous studies, as described hereinabove with reference to VGAM273. FLJ13852 (Accession NM_023078) is another VGAM530 host target gene. FLJ13852 BINDING SITE is HOST TARGET binding site found in the 3' untranslated region of mRNA encoded by FLJ13852, corresponding to a HOST TARGET binding site such as BINDING SITE I, BINDING SITE II or BINDING SITE III. Table 2 illustrates the complementarity of the nucleotide sequences of FLJ13852 BINDING SITE, designated SEQ ID:23339, to the nucleotide sequence of VGAM530 RNA, herein designated VGAM RNA, also designated SEQ ID:3241.

Another function of VGAM530 is therefore inhibition of FLJ13852 (Accession NM_023078). Accordingly, utilities of VGAM530 include diagnosis, prevention and treatment of diseases and clinical conditions associated with FLJ13852. FLJ23563 (Accession XM_041701) is another VGAM530 host target gene. FLJ23563 BINDING SITE is HOST TARGET binding site found in the 5' untranslated region of mRNA encoded by FLJ23563, corresponding to a HOST TARGET binding site such as BINDING SITE I, BINDING SITE II or BINDING SITE III. Table 2 illustrates the complementarity of the nucleotide sequences of FLJ23563 BINDING SITE, designated SEQ ID:33561, to the nucleotide sequence of VGAM530 RNA, herein designated VGAM RNA, also designated SEQ ID:3241.

Another function of VGAM530 is therefore inhibition of FLJ23563 (Accession XM_041701). Accordingly, utilities of VGAM530 include diagnosis, prevention and treatment of diseases and clinical conditions associated with FLJ23563. KIAA0161 (Accession NM_014746) is another VGAM530 host target gene. KIAA0161 BINDING SITE is HOST TARGET binding site found in the 3' untranslated region of mRNA encoded by KIAA0161, corresponding to a HOST TARGET binding site such as BINDING SITE I, BINDING SITE II or BINDING SITE III. Table 2 illustrates the complementarity of the nucleotide sequences of KIAA0161 BINDING SITE, designated SEQ ID:16430, to the nucleotide sequence of VGAM530 RNA, herein designated VGAM RNA, also designated SEQ ID:3241.

Another function of VGAM530 is therefore inhibition of KIAA0161 (Accession NM_014746). Accordingly, utilities of VGAM530 include diagnosis, prevention and treatment of diseases and clinical conditions associated with KIAA0161. LanC Lantibiotic Synthetase Component C-like 2 (bacterial) (LANCL2, Accession NM_018697) is another VGAM530 host target gene. LANCL2 BINDING SITE is HOST TARGET binding site found in the 3' untranslated region of mRNA encoded by LANCL2, corresponding to a HOST TARGET binding site such as BINDING SITE I, BINDING SITE II or BINDING SITE III. Table 2 illustrates the complementarity of the nucleotide sequences of LANCL2 BINDING SITE, designated SEQ ID:20775, to the nucleotide sequence of VGAM530 RNA, herein designated VGAM RNA, also designated SEQ ID:3241.

Another function of VGAM530 is therefore inhibition of LanC Lantibiotic Synthetase Component C-like 2 (bacterial) (LANCL2, Accession NM_018697). Accordingly, utilities of VGAM530 include diagnosis, prevention and treatment of diseases and clinical conditions associated with LANCL2. MAP (Accession NM_022818) is another VGAM530 host target gene. MAP BINDING SITE is HOST TARGET binding site found in the 3' untranslated region of mRNA encoded by MAP, corresponding to a HOST TARGET binding site such as BINDING SITE I, BINDING SITE II or BINDING SITE III. Table 2 illustrates the complementarity of the nucleotide sequences of MAP BINDING SITE, designated SEQ ID:23095, to the nucleotide sequence of VGAM530 RNA, herein designated VGAM RNA, also designated SEQ ID:3241.

Another function of VGAM530 is therefore inhibition of MAP (Accession NM_022818). Accordingly, utilities of VGAM530 include diagnosis, prevention and treatment of diseases and clinical conditions associated with MAP. LOC221421 (Accession XM_166428) is another VGAM530 host target gene. LOC221421 BINDING SITE is HOST TARGET binding site found in the 3' untranslated region of mRNA encoded by LOC221421, corresponding to a HOST TARGET binding site such as BINDING SITE I, BINDING SITE II or BINDING SITE III. Table 2 illustrates the complementarity of the nucleotide sequences of LOC221421 BINDING SITE, designated SEQ ID:44322, to the nucleotide sequence of VGAM530 RNA, herein designated VGAM RNA, also designated SEQ ID:3241.

Another function of VGAM530 is therefore inhibition of LOC221421 (Accession XM_166428). Accordingly, utilities of VGAM530 include diagnosis, prevention and treatment of diseases and clinical conditions associated with LOC221421. FIG. 1 further provides a conceptual description of a novel bioinformatically detected viral gene of the present invention, referred to here as Viral Genomic Address Messenger 531 (VGAM531) viral gene, which modulates expression of respective host target genes thereof, the function and utility of which host target genes is known in the art.

VGAM531 is a novel bioinformatically detected regulatory, non protein coding, viral micro RNA (miRNA) gene. The method by which VGAM531 was detected is described hereinabove with reference to FIGS. 1-8.

VGAM531 gene, herein designated VGAM GENE, is a viral gene contained in the genome of Equine Herpesvirus 4. VGAM531 host target gene, herein designated VGAM HOST TARGET GENE, is a human gene contained in the human genome.

VGAM531 gene encodes a VGAM531 precursor RNA, herein designated VGAM PRECURSOR RNA. Similar to other miRNA genes, and unlike most ordinary genes, VGAM531 precursor RNA does not encode a protein. A nucleotide sequence identical or highly similar to the nucleotide sequence of VGAM531 precursor RNA is designated SEQ ID:517, and is provided hereinbelow with reference to the sequence listing part. Nucleotide sequence SEQ ID:517 is located at position 130187 relative to the genome of Equine Herpesvirus 4.

VGAM531 precursor RNA folds onto itself, forming VGAM531 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM531 folded precursor RNA into VGAM531 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM531 RNA is designated SEQ ID:3242, and is provided hereinbelow with reference to the sequence listing part.

VGAM531 host target gene, herein designated VGAM HOST TARGET GENE, encodes a corresponding messenger RNA, VGAM531 host target RNA, herein designated VGAM HOST TARGET RNA. VGAM531 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM531 RNA, herein designated VGAM RNA, binds complementarily to one or more host target binding sites located in untranslated regions of VGAM531 host target RNA, herein designated VGAM HOST TARGET RNA. This complementary binding is due to the fact that the nucleotide sequence of VGAM531 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM531 RNA, herein designated VGAM RNA, may have a different number of host target binding sites in untranslated regions of a VGAM531 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM531 RNA, herein designated VGAM RNA, to host target binding sites on VGAM531 host target RNA, herein designated VGAM HOST TARGET RNA, such as BINDING SITE I, BINDING SITE II and BINDING SITE III, inhibits translation of VGAM531 host target RNA into VGAM531 host target protein, herein designated VGAM HOST TARGET PROTEIN. VGAM host target protein is therefore outlined by a broken line.

It is appreciated that VGAM531 host target gene, herein designated VGAM HOST TARGET GENE, in fact represents a plurality of VGAM531 host target genes. The mRNA of each one of this plurality of VGAM531 host target genes comprises one or more host target binding sites, each having a nucleotide sequence which is at least partly complementary to VGAM531 RNA, herein designated VGAM RNA, and which when bound by VGAM531 RNA causes inhibition of translation of respective one or more VGAM531 host target proteins.

It is further appreciated by one skilled in the art that the mode of translational inhibition illustrated by FIG. 1 with specific reference to translational inhibition exerted by VGAM531 gene, herein designated VGAM GENE, on one or more VGAM531 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM531 is inhibition of expression of host target genes, as part of a novel viral mechanism of attacking a host. Accordingly, utilities of VGAM531 include diagnosis, prevention and treatment of viral infection by Equine Herpesvirus 4. Specific functions, and accordingly utilities, of VGAM531 correlate with, and may be deduced from, the identity of the host target genes which VGAM531 binds and inhibits, and the function of these host target genes, as elaborated hereinbelow.

Nucleotide sequences of the VGAM531 precursor RNA, herein designated VGAM PRECURSOR RNA, and of the 'diced' VGAM531 RNA, herein designated VGAM RNA, and a schematic representation of the secondary folding of VGAM531 folded precursor RNA, herein designated VGAM FOLDED PRECURSOR RNA, of VGAM531 are further described hereinbelow with reference to Table 1.

Nucleotide sequences of host target binding sites, such as BINDING SITE-I, BINDING SITE-II and BINDING SITE-III of FIG. 1, found on VGAM531 host target RNA, and schematic representation of the complementarity of each of these host target binding sites to VGAM531 RNA, herein designated VGAM RNA, are described hereinbelow with reference to Table 2.

As mentioned hereinabove with reference to FIG. 1, a function of VGAM531 gene, herein designated VGAM is inhibition of expression of VGAM531 target genes. It is appreciated that specific functions, and accordingly utilities, of VGAM531 correlate with, and may be deduced from, the identity of the target genes which VGAM531 binds and inhibits, and the function of these target genes, as elaborated hereinbelow.

Potassium Voltage-gated Channel, Delayed-rectifier, Subfamily S, Member 3 (KCNS3, Accession NM_002252) is a VGAM531 host target gene. KCNS3 BINDING SITE is HOST TARGET binding site found in the 5' untranslated region of mRNA encoded by KCNS3, corresponding to a HOST TARGET binding site such as BINDING SITE I, BINDING SITE II or BINDING SITE III. Table 2 illustrates the complementarity of the nucleotide sequences of KCNS3 BINDING SITE, designated SEQ ID:8050, to the nucleotide sequence of VGAM531 RNA, herein designated VGAM RNA, also designated SEQ ID:3242.

A function of VGAM531 is therefore inhibition of Potassium Voltage-gated Channel, Delayed-rectifier, Subfamily S, Member 3 (KCNS3, Accession NM_002252). Accordingly, utilities of VGAM531 include diagnosis, prevention and treatment of diseases and clinical conditions associated with KCNS3. Myotubularin Related Protein 2 (MTMR2, Accession NM_016156) is another VGAM531 host target gene. MTMR2 BINDING SITE is HOST TARGET binding site found in the 3' untranslated region of mRNA encoded by MTMR2, corresponding to a HOST TARGET binding site such as BINDING SITE I, BINDING SITE II or BINDING SITE III. Table 2 illustrates the complementarity of the nucleotide sequences of MTMR2 BINDING SITE, designated SEQ ID:18246, to the nucleotide sequence of VGAM531 RNA, herein designated VGAM RNA, also designated SEQ ID:3242.

Another function of VGAM531 is therefore inhibition of Myotubularin Related Protein 2 (MTMR2, Accession NM_016156). Accordingly, utilities of VGAM531 include diagnosis, prevention and treatment of diseases and clinical conditions associated with MTMR2. FLJ10052 (Accession NM_017982) is another VGAM531 host target gene. FLJ10052 BINDING SITE is HOST TARGET binding site found in the 3' untranslated region of mRNA encoded by FLJ10052, corresponding to a HOST TARGET binding site such as BINDING SITE I, BINDING SITE II or BINDING SITE III. Table 2 illustrates the complementarity of the nucleotide sequences of FLJ10052 BINDING SITE, designated SEQ ID:19712, to the nucleotide sequence of VGAM531 RNA, herein designated VGAM RNA, also designated SEQ ID:3242.

Another function of VGAM531 is therefore inhibition of FLJ10052 (Accession NM_017982). Accordingly, utilities of VGAM531 include diagnosis, prevention and treatment of diseases and clinical conditions associated with FLJ10052. G4 (Accession XM_165712) is another VGAM531 host target gene. G4 BINDING SITE is HOST TARGET binding site found in the 5' untranslated region of mRNA encoded by G4, corresponding to a HOST TARGET binding site such as BINDING SITE I, BINDING SITE II or BINDING SITE III. Table 2 illustrates the complementarity of the nucleotide sequences of G4 BINDING SITE, designated SEQ ID:43736, to the nucleotide sequence of VGAM531 RNA, herein designated VGAM RNA, also designated SEQ ID:3242.

Another function of VGAM531 is therefore inhibition of G4 (Accession XM_165712). Accordingly, utilities of VGAM531 include diagnosis, prevention and treatment of diseases and clinical conditions associated with G4. KIAA1246 (Accession XM_166372) is another VGAM531 host target gene. KIAA1246 BINDING SITE is HOST TARGET binding site found in the 5' untranslated region of mRNA encoded by KIAA1246, corresponding to a HOST TARGET binding site such as BINDING SITE I, BINDING SITE II or BINDING SITE III. Table 2 illustrates the complementarity of the nucleotide sequences of KIAA1246 BINDING SITE, designated SEQ ID:44193, to the nucleotide sequence of VGAM531 RNA, herein designated VGAM RNA, also designated SEQ ID:3242.

Another function of VGAM531 is therefore inhibition of KIAA1246 (Accession XM_166372). Accordingly, utilities of VGAM531 include diagnosis, prevention and treatment of diseases and clinical conditions associated with KIAA1246. RALGPS1A (Accession NM_014636) is another VGAM531 host target gene. RALGPS1A BINDING SITE is HOST TARGET binding site found in the 3' untranslated region of mRNA encoded by RALGPS1A, corresponding to a HOST TARGET binding site such as BINDING SITE I, BINDING SITE II or BINDING SITE III. Table 2 illustrates the complementarity of the nucleotide sequences of RALGPS1A BINDING SITE, designated SEQ ID:16019, to the nucleotide sequence of VGAM531 RNA, herein designated VGAM RNA, also designated SEQ ID:3242.

Another function of VGAM531 is therefore inhibition of RALGPS1A (Accession NM_014636). Accordingly, utilities of VGAM531 include diagnosis, prevention and treatment of diseases and clinical conditions associated with RALGPS1A. LOC158337 (Accession XM_098926) is another VGAM531 host target gene. LOC158337 BINDING SITE is HOST TARGET binding site found in the 3' untranslated region of mRNA encoded by LOC158337, corresponding to a HOST TARGET binding site such as BINDING SITE I, BINDING SITE II or BINDING SITE III. Table 2 illustrates the complementarity of the nucleotide sequences of LOC158337 BINDING SITE, designated SEQ ID:41961, to the nucleotide sequence of VGAM531 RNA, herein designated VGAM RNA, also designated SEQ ID:3242.

Another function of VGAM531 is therefore inhibition of LOC158337 (Accession XM_098926). Accordingly, utilities of VGAM531 include diagnosis, prevention and treatment of diseases and clinical conditions associated with LOC158337. LOC200261 (Accession XM_114172) is another VGAM531 host target gene. LOC200261 BINDING SITE is HOST TARGET binding site found in the 3' untranslated region of mRNA encoded by LOC200261, corresponding to a HOST TARGET binding site such as BINDING SITE I, BINDING SITE II or BINDING SITE III. Table 2 illustrates the complementarity of the nucleotide sequences of LOC200261 BINDING SITE, designated SEQ ID:42752, to the nucleotide sequence of VGAM531 RNA, herein designated VGAM RNA, also designated SEQ ID:3242.

Another function of VGAM531 is therefore inhibition of LOC200261 (Accession XM_114172). Accordingly, utilities of VGAM531 include diagnosis, prevention and treatment of diseases and clinical conditions associated with LOC200261. LOC203292 (Accession XM_117527) is another VGAM531 host target gene. LOC203292 BINDING SITE is HOST TARGET binding site found in the 5' untranslated region of mRNA encoded by LOC203292, corresponding to a HOST TARGET binding site such as BINDING SITE I, BINDING SITE II or BINDING SITE III. Table 2 illustrates the complementarity of the nucleotide sequences of LOC203292 BINDING SITE, designated SEQ ID:43503, to the nucleotide sequence of VGAM531 RNA, herein designated VGAM RNA, also designated SEQ ID:3242.

Another function of VGAM531 is therefore inhibition of LOC203292 (Accession XM_117527). Accordingly, utilities of VGAM531 include diagnosis, prevention and treatment of diseases and clinical conditions associated with LOC203292. LOC219744 (Accession XM_166123) is another VGAM531 host target gene. LOC219744 BINDING SITE is HOST TARGET binding site found in the 5' untranslated region of mRNA encoded by LOC219744, corresponding to a HOST TARGET binding site such as BINDING SITE I, BINDING SITE II or BINDING SITE III. Table 2 illustrates the complementarity of the nucleotide sequences of LOC219744 BINDING SITE, designated SEQ ID:43903, to the nucleotide sequence of VGAM531 RNA, herein designated VGAM RNA, also designated SEQ ID:3242.

Another function of VGAM531 is therefore inhibition of LOC219744 (Accession XM_166123). Accordingly, utilities of VGAM531 include diagnosis, prevention and treatment of diseases and clinical conditions associated with LOC219744. LOC221479 (Accession XM_166417) is another VGAM531 host target gene. LOC221479 BINDING SITE is HOST TARGET binding site found in the 3' untranslated region of mRNA encoded by LOC221479, corresponding to a HOST TARGET binding site such as BINDING SITE I, BINDING SITE II or BINDING SITE III. Table 2 illustrates the complementarity of the nucleotide sequences of LOC221479 BINDING SITE, designated SEQ ID:44289, to the nucleotide sequence of VGAM531 RNA, herein designated VGAM RNA, also designated SEQ ID:3242.

Another function of VGAM531 is therefore inhibition of LOC221479 (Accession XM_166417). Accordingly, utilities of VGAM531 include diagnosis, prevention and treatment of diseases and clinical conditions associated with LOC221479. LOC257554 (Accession XM_175149) is another VGAM531 host target gene. LOC257554 BINDING SITE is HOST TARGET binding site found in the 5' untranslated region of mRNA encoded by LOC257554, corresponding to a HOST TARGET binding site such as BINDING SITE I, BINDING SITE II or BINDING SITE III. Table 2 illustrates the complementarity of the nucleotide sequences of LOC257554 BINDING SITE, designated SEQ ID:46643, to the nucleotide sequence of VGAM531 RNA, herein designated VGAM RNA, also designated SEQ ID:3242.

Another function of VGAM531 is therefore inhibition of LOC257554 (Accession XM_175149). Accordingly, utilities of VGAM531 include diagnosis, prevention and treatment of diseases and clinical conditions associated with LOC257554. LOC92973 (Accession XM_048529) is another VGAM531 host target gene. LOC92973 BINDING SITE is HOST TARGET binding site found in the 5' untranslated region of mRNA encoded by LOC92973, corresponding to a HOST TARGET binding site such as BINDING SITE I, BINDING SITE II or BINDING SITE III. Table 2 illustrates the complementarity of the nucleotide sequences of LOC92973 BINDING SITE, designated SEQ ID:35188, to the nucleotide sequence of VGAM531 RNA, herein designated VGAM RNA, also designated SEQ ID:3242.

Another function of VGAM531 is therefore inhibition of LOC92973 (Accession XM_048529). Accordingly, utilities of VGAM531 include diagnosis, prevention and treatment of diseases and clinical conditions associated with LOC92973. FIG. 1 further provides a conceptual description of a novel bioinformatically detected viral gene of the present invention, referred to here as Viral Genomic Address Messenger 532 (VGAM532) viral gene, which modulates expression of respective host target genes thereof, the function and utility of which host target genes is known in the art.

VGAM532 is a novel bioinformatically detected regulatory, non protein coding, viral micro RNA (miRNA) gene. The method by which VGAM532 was detected is described hereinabove with reference to FIGS. 1-8.

VGAM532 gene, herein designated VGAM GENE, is a viral gene contained in the genome of Murine Hepatitis Virus. VGAM532 host target gene, herein designated VGAM HOST TARGET GENE, is a human gene contained in the human genome.

VGAM532 gene encodes a VGAM532 precursor RNA, herein designated VGAM PRECURSOR RNA. Similar to other miRNA genes, and unlike most ordinary genes, VGAM532 precursor RNA does not encode a protein. A nucleotide sequence identical or highly similar to the nucleotide sequence of VGAM532 precursor RNA is designated SEQ ID:518, and is provided hereinbelow with reference to the sequence listing part. Nucleotide sequence SEQ ID:518 is located at position 27967 relative to the genome of Murine Hepatitis Virus.

VGAM532 precursor RNA folds onto itself, forming VGAM532 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM532 folded precursor RNA into VGAM532 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM532 RNA is designated SEQ ID:3243, and is provided hereinbelow with reference to the sequence listing part.

VGAM532 host target gene, herein designated VGAM HOST TARGET GENE, encodes a corresponding messenger RNA, VGAM532 host target RNA, herein designated VGAM HOST TARGET RNA. VGAM532 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM532 RNA, herein designated VGAM RNA, binds complementarily to one or more host target binding sites located in untranslated regions of VGAM532 host target RNA, herein designated VGAM HOST TARGET RNA. This complementary binding is due to the fact that the nucleotide sequence of VGAM532 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM532 RNA, herein designated VGAM RNA, may have a different number of host target binding sites in untranslated regions of a VGAM532 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM532 RNA, herein designated VGAM RNA, to host target binding sites on VGAM532 host target RNA, herein designated VGAM HOST TARGET RNA, such as BINDING SITE I, BINDING SITE II and BINDING SITE III, inhibits translation of VGAM532 host target RNA into VGAM532 host target protein, herein designated VGAM HOST TARGET PROTEIN. VGAM host target protein is therefore outlined by a broken line.

It is appreciated that VGAM532 host target gene, herein designated VGAM HOST TARGET GENE, in fact represents a plurality of VGAM532 host target genes. The mRNA of each one of this plurality of VGAM532 host target genes comprises one or more host target binding sites, each having a nucleotide sequence which is at least partly complementary to VGAM532 RNA, herein designated VGAM RNA, and which when bound by VGAM532 RNA causes inhibition of translation of respective one or more VGAM532 host target proteins.

It is further appreciated by one skilled in the art that the mode of translational inhibition illustrated by FIG. 1 with specific reference to translational inhibition exerted by VGAM532 gene, herein designated VGAM GENE, on one or more VGAM532 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM532 is inhibition of expression of host target genes, as part of a novel viral mechanism of attacking a host. Accordingly, utilities of VGAM532 include diagnosis, prevention and treatment of viral infection by Murine Hepatitis Virus. Specific functions, and accordingly utilities, of VGAM532 correlate with, and may be deduced from, the identity of the host target genes which VGAM532 binds and inhibits, and the function of these host target genes, as elaborated hereinbelow.

Nucleotide sequences of the VGAM532 precursor RNA, herein designated VGAM PRECURSOR RNA, and of the 'diced' VGAM532 RNA, herein designated VGAM RNA, and a schematic representation of the secondary folding of VGAM532 folded precursor RNA, herein designated VGAM FOLDED PRECURSOR RNA, of VGAM532 are further described hereinbelow with reference to Table 1.

Nucleotide sequences of host target binding sites, such as BINDING SITE-I, BINDING SITE-II and BINDING SITE-III of FIG. 1, found on VGAM532 host target RNA, and schematic representation of the complementarity of each of these host target binding sites to VGAM532 RNA, herein designated VGAM RNA, are described hereinbelow with reference to Table 2.

As mentioned hereinabove with reference to FIG. 1, a function of VGAM532 gene, herein designated VGAM is inhibition of expression of VGAM532 target genes. It is appreciated that specific functions, and accordingly utilities, of VGAM532 correlate with, and may be deduced from, the identity of the target genes which VGAM532 binds and inhibits, and the function of these target genes, as elaborated hereinbelow.

Chemokine-like Receptor 1 (CMKLR1, Accession NM_004072) is a VGAM532 host target gene. CMKLR1 BINDING SITE is HOST TARGET binding site found in the 5' untranslated region of mRNA encoded by CMKLR1, corresponding to a HOST TARGET binding site such as BINDING SITE I, BINDING SITE II or BINDING SITE III. Table 2 illustrates the complementarity of the nucleotide sequences of CMKLR1 BINDING SITE, designated SEQ ID:10275, to the nucleotide sequence of VGAM532 RNA, herein designated VGAM RNA, also designated SEQ ID:3243.

A function of VGAM532 is therefore inhibition of Chemokine-like Receptor 1 (CMKLR1, Accession NM_004072), a gene which may have a function in bone metabolism. Accordingly, utilities of VGAM532 include diagnosis, prevention and treatment of diseases and clinical conditions associated with CMKLR1. The function of CMKLR1 and its association with various diseases and clinical conditions, has been established by previous studies, as described hereinabove with reference to VGAM237. LENG4 (Accession NM_024298) is another VGAM532 host target gene. LENG4 BINDING SITE is HOST TARGET binding site found in the 5' untranslated region of mRNA encoded by LENG4, corresponding to a HOST TARGET binding site such as BINDING SITE I, BINDING SITE II or BINDING SITE III. Table 2 illustrates the complementarity of the nucleotide sequences of LENG4 BINDING SITE, designated SEQ ID:23579, to the nucleotide sequence of VGAM532 RNA, herein designated VGAM RNA, also designated SEQ ID:3243.

Another function of VGAM532 is therefore inhibition of LENG4 (Accession NM_024298), a gene which may be a transmembrane protein. Accordingly, utilities of VGAM532 include diagnosis, prevention and treatment of diseases and clinical conditions associated with LENG4. The function of LENG4 and its association with various diseases and clinical conditions, has been established by previous studies, as described hereinabove with reference to VGAM259. Low Density Lipoprotein Receptor-related Protein 4 (LRP4, Accession XM_035037) is another VGAM532 host target gene. LRP4 BINDING SITE is HOST TARGET binding site found in the 3' untranslated region of mRNA encoded by LRP4, corresponding to a HOST TARGET binding site such as BINDING SITE I, BINDING SITE II or BINDING SITE III. Table 2 illustrates the complementarity of the nucleotide sequences of LRP4 BINDING SITE, designated SEQ ID:32194, to the nucleotide sequence of VGAM532 RNA, herein designated VGAM RNA, also designated SEQ ID:3243.

Another function of VGAM532 is therefore inhibition of Low Density Lipoprotein Receptor-related Protein 4 (LRP4, Accession XM_035037). Accordingly, utilities of VGAM532 include diagnosis, prevention and treatment of diseases and clinical conditions associated with LRP4. SRY (sex determining region Y)-box 10 (SOX10, Accession NM_006941) is another VGAM532 host target gene. SOX10 BINDING SITE is HOST TARGET binding site found in the 3' untranslated region of mRNA encoded by SOX10, corresponding to a HOST TARGET binding site such as BINDING SITE I, BINDING SITE II or BINDING SITE III. Table 2 illustrates the complementarity of the nucleotide sequences of SOX10 BINDING SITE, designated SEQ ID:13826, to the nucleotide sequence of VGAM532 RNA, herein designated VGAM RNA, also designated SEQ ID:3243.

Another function of VGAM532 is therefore inhibition of SRY (sex determining region Y)-box 10 (SOX10, Accession NM_006941). Accordingly, utilities of VGAM532 include diagnosis, prevention and treatment of diseases and clinical conditions associated with SOX10. Fidgetin (FIGN, Accession XM_171005) is another VGAM532 host target gene. FIGN BINDING SITE is HOST TARGET binding site found in the 3' untranslated region of mRNA encoded by FIGN, corresponding to a HOST TARGET binding site such as BINDING SITE I, BINDING SITE II or BINDING SITE III. Table 2 illustrates the complementarity of the nucleotide sequences of FIGN BINDING SITE, designated SEQ ID:45777, to the nucleotide sequence of VGAM532 RNA, herein designated VGAM RNA, also designated SEQ ID:3243.

Another function of VGAM532 is therefore inhibition of Fidgetin (FIGN, Accession XM_171005). Accordingly, utilities of VGAM532 include diagnosis, prevention and treatment of diseases and clinical conditions associated with FIGN. KIAA0759 (Accession XM_041090) is another VGAM532 host target gene. KIAA0759 BINDING SITE is HOST TARGET binding site found in the 3' untranslated region of mRNA encoded by KIAA0759, corresponding to a HOST TARGET binding site such as BINDING SITE I, BINDING SITE II or BINDING SITE III. Table 2 illustrates the complementarity of the nucleotide sequences of KIAA0759 BINDING SITE, designated SEQ ID:33441, to the nucleotide sequence of VGAM532 RNA, herein designated VGAM RNA, also designated SEQ ID:3243.

Another function of VGAM532 is therefore inhibition of KIAA0759 (Accession XM_041090). Accordingly, utilities of VGAM532 include diagnosis, prevention and treatment of diseases and clinical conditions associated with KIAA0759. KIAA1058 (Accession XM_090586) is another VGAM532 host target gene. KIAA1058 BINDING SITE is HOST TARGET binding site found in the 3' untranslated region of mRNA encoded by KIAA1058, corresponding to a HOST TARGET binding site such as BINDING SITE I, BINDING SITE II or BINDING SITE III. Table 2 illustrates the complementarity of the nucleotide sequences of KIAA1058 BINDING SITE, designated SEQ ID:40012, to the nucleotide sequence of VGAM532 RNA, herein designated VGAM RNA, also designated SEQ ID:3243.

Another function of VGAM532 is therefore inhibition of KIAA1058 (Accession XM_090586). Accordingly, utilities of VGAM532 include diagnosis, prevention and treatment of diseases and clinical conditions associated with KIAA1058. Sorting Nexin 10 (SNX10, Accession NM_013322) is another VGAM532 host target gene. SNX10 BINDING SITE is HOST TARGET binding site found in the 3' untranslated region of mRNA encoded by SNX10, corresponding to a HOST TARGET binding site such as BINDING SITE I, BINDING SITE II or BINDING SITE III. Table 2 illustrates the complementarity of the nucleotide sequences of SNX10 BINDING SITE, designated SEQ ID:14968, to the nucleotide sequence of VGAM532 RNA, herein designated VGAM RNA, also designated SEQ ID:3243.

Another function of VGAM532 is therefore inhibition of Sorting Nexin 10 (SNX10, Accession NM_013322). Accordingly, utilities of VGAM532 include diagnosis, prevention and treatment of diseases and clinical conditions associated with SNX10. LOC146714 (Accession XM_097072) is another VGAM532 host target gene. LOC146714 BINDING SITE is HOST TARGET binding site found in the 5' untranslated region of mRNA encoded by LOC146714, corresponding to a HOST TARGET binding site such as BINDING SITE I, BINDING SITE II or BINDING SITE III. Table 2 illustrates the complementarity of the nucleotide sequences of LOC146714 BINDING SITE, designated SEQ ID:40722, to the nucleotide sequence of VGAM532 RNA, herein designated VGAM RNA, also designated SEQ ID:3243.

Another function of VGAM532 is therefore inhibition of LOC146714 (Accession XM_097072). Accordingly, utilities of VGAM532 include diagnosis, prevention and treatment of diseases and clinical conditions associated with LOC146714. LOC150142 (Accession XM_086791) is another VGAM532 host target gene. LOC150142 BINDING SITE is HOST TARGET binding site found in the 5' untranslated region of mRNA encoded by LOC150142, corresponding to a HOST TARGET binding site such as BINDING SITE I, BINDING SITE II or BINDING SITE III. Table 2 illustrates the complementarity of the nucleotide sequences of LOC150142 BINDING SITE, designated SEQ ID:38854, to the nucleotide sequence of VGAM532 RNA, herein designated VGAM RNA, also designated SEQ ID:3243.

Another function of VGAM532 is therefore inhibition of LOC150142 (Accession XM_086791). Accordingly, utilities of VGAM532 include diagnosis, prevention and treatment of diseases and clinical conditions associated with LOC150142. LOC150696 (Accession NM_144707) is another VGAM532 host target gene. LOC150696 BINDING SITE is HOST TARGET binding site found in the 3' untranslated region of mRNA encoded by LOC150696, corresponding to a HOST TARGET binding site such as BINDING SITE I, BINDING SITE II or BINDING SITE III. Table 2 illustrates the complementarity of the nucleotide sequences of LOC150696 BINDING SITE, designated SEQ ID:29531, to the nucleotide sequence of VGAM532 RNA, herein designated VGAM RNA, also designated SEQ ID:3243.

Another function of VGAM532 is therefore inhibition of LOC150696 (Accession NM_144707). Accordingly, utilities of VGAM532 include diagnosis, prevention and treatment of diseases and clinical conditions associated with LOC150696. LOC220980 (Accession XM_167629) is another VGAM532 host target gene. LOC220980 BINDING SITE is HOST TARGET binding site found in the 3' untranslated region of mRNA encoded by LOC220980, corresponding to a HOST TARGET binding site such as BINDING SITE I, BINDING SITE II or BINDING SITE III. Table 2 illustrates the complementarity of the nucleotide sequences of LOC220980 BINDING SITE, designated SEQ ID:44738, to the nucleotide sequence of VGAM532 RNA, herein designated VGAM RNA, also designated SEQ ID:3243.

Another function of VGAM532 is therefore inhibition of LOC220980 (Accession XM_167629). Accordingly, utilities of VGAM532 include diagnosis, prevention and treatment of diseases and clinical conditions associated with LOC220980.

LOC92539 (Accession XM_045632) is another VGAM532 host target gene. LOC92539 BINDING SITE is HOST TARGET binding site found in the 3' untranslated region of mRNA encoded by LOC92539, corresponding to a HOST TARGET binding site such as BINDING SITE I, BINDING SITE II or BINDING SITE III. Table 2 illustrates the complementarity of the nucleotide sequences of LOC92539 BINDING SITE, designated SEQ ID:34504, to the nucleotide sequence of VGAM532 RNA, herein designated VGAM RNA, also designated SEQ ID:3243.

Another function of VGAM532 is therefore inhibition of LOC92539 (Accession XM_045632). Accordingly, utilities of VGAM532 include diagnosis, prevention and treatment of diseases and clinical conditions associated with LOC92539. FIG. 1 further provides a conceptual description of a novel bioinformatically detected viral gene of the present invention, referred to here as Viral Genomic Address Messenger 533 (VGAM533) viral gene, which modulates expression of respective host target genes thereof, the function and utility of which host target genes is known in the art.

VGAM533 is a novel bioinformatically detected regulatory, non protein coding, viral micro RNA (miRNA) gene. The method by which VGAM533 was detected is described hereinabove with reference to FIGS. 1-8.

VGAM533 gene, herein designated VGAM GENE, is a viral gene contained in the genome of Turnip Vein-clearing Virus. VGAM533 host target gene, herein designated VGAM HOST TARGET GENE, is a human gene contained in the human genome.

VGAM533 gene encodes a VGAM533 precursor RNA, herein designated VGAM PRECURSOR RNA. Similar to other miRNA genes, and unlike most ordinary genes, VGAM533 precursor RNA does not encode a protein. A nucleotide sequence identical or highly similar to the nucleotide sequence of VGAM533 precursor RNA is designated SEQ ID:519, and is provided hereinbelow with reference to the sequence listing part. Nucleotide sequence SEQ ID:519 is located at position 4883 relative to the genome of Turnip Vein-clearing Virus.

VGAM533 precursor RNA folds onto itself, forming VGAM533 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM533 folded precursor RNA into VGAM533 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM533 RNA is designated SEQ ID:3244, and is provided hereinbelow with reference to the sequence listing part.

VGAM533 host target gene, herein designated VGAM HOST TARGET GENE, encodes a corresponding messenger RNA, VGAM533 host target RNA, herein designated VGAM HOST TARGET RNA. VGAM533 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM533 RNA, herein designated VGAM RNA, binds complementarily to one or more host target binding sites located in untranslated regions of VGAM533 host target RNA, herein designated VGAM HOST TARGET RNA. This complementary binding is due to the fact that the nucleotide sequence of VGAM533 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM533 RNA, herein designated VGAM RNA, may have a different number of host target binding sites in untranslated regions of a VGAM533 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM533 RNA, herein designated VGAM RNA, to host target binding sites on VGAM533 host target RNA, herein designated VGAM HOST TARGET RNA, such as BINDING SITE I, BINDING SITE II and BINDING SITE III, inhibits translation of VGAM533 host target RNA into VGAM533 host target protein, herein designated VGAM HOST TARGET PROTEIN. VGAM host target protein is therefore outlined by a broken line.

It is appreciated that VGAM533 host target gene, herein designated VGAM HOST TARGET GENE, in fact represents a plurality of VGAM533 host target genes. The mRNA of each one of this plurality of VGAM533 host target genes comprises one or more host target binding sites, each having a nucleotide sequence which is at least partly complementary to VGAM533 RNA, herein designated VGAM RNA, and which when bound by VGAM533 RNA causes inhibition of translation of respective one or more VGAM533 host target proteins.

It is further appreciated by one skilled in the art that the mode of translational inhibition illustrated by FIG. 1 with specific reference to translational inhibition exerted by VGAM533 gene, herein designated VGAM GENE, on one or more VGAM533 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM533 is inhibition of expression of host target genes, as part of a novel viral mechanism of attacking a host. Accordingly, utilities of VGAM533 include diagnosis, prevention and treatment of viral infection by Turnip Vein-clearing Virus. Specific functions, and accordingly utilities, of VGAM533 correlate with, and may be deduced from, the identity of the host target genes which VGAM533 binds and inhibits, and the function of these host target genes, as elaborated hereinbelow.

Nucleotide sequences of the VGAM533 precursor RNA, herein designated VGAM PRECURSOR RNA, and of the 'diced' VGAM533 RNA, herein designated VGAM RNA, and a schematic representation of the secondary folding of VGAM533 folded precursor RNA, herein designated VGAM FOLDED PRECURSOR RNA, of VGAM533 are further described hereinbelow with reference to Table 1.

Nucleotide sequences of host target binding sites, such as BINDING SITE-I, BINDING SITE-II and BINDING SITE-III of FIG. 1, found on VGAM533 host target RNA, and schematic representation of the complementarity of each of these host target binding sites to VGAM533 RNA, herein designated VGAM RNA, are described hereinbelow with reference to Table 2.

As mentioned hereinabove with reference to FIG. 1, a function of VGAM533 gene, herein designated VGAM is inhibition of expression of VGAM533 target genes. It is appreciated that specific functions, and accordingly utilities, of VGAM533 correlate with, and may be deduced from, the identity of the target genes which VGAM533 binds and inhibits, and the function of these target genes, as elaborated hereinbelow.

A Kinase (PRKA) Anchor Protein 13 (AKAP13, Accession XM_116974) is a VGAM533 host target gene. AKAP13 BINDING SITE is HOST TARGET binding site found in the 3' untranslated region of mRNA encoded by AKAP13, corresponding to a HOST TARGET binding site such as BINDING SITE I, BINDING SITE II or BINDING SITE III. Table 2 illustrates the complementarity of the nucleotide sequences of AKAP13 BINDING SITE, designated SEQ ID:43176, to the nucleotide sequence of VGAM533 RNA, herein designated VGAM RNA, also designated SEQ ID:3244.

A function of VGAM533 is therefore inhibition of A Kinase (PRKA) Anchor Protein 13 (AKAP13, Accession XM_116974), a gene which regulates subcellular localization of type II cAMP-dependent PKA. Accordingly, utilities of VGAM533 include diagnosis, prevention and treatment of diseases and clinical conditions associated with AKAP13. The function of AKAP13 and its association with various diseases and clinical conditions, has been established by previous studies, as described hereinabove with reference to VGAM17. BTB and CNC Homology 1, Basic Leucine Zipper Transcription Factor 2 (BACH2, Accession NM_021813) is another VGAM533 host target gene. BACH2 BINDING SITE is HOST TARGET binding site found in the 5' untranslated region of mRNA encoded by BACH2, corresponding to a HOST TARGET binding site such as BINDING SITE I, BINDING SITE II or BINDING SITE III. Table 2 illustrates the complementarity of the nucleotide sequences of BACH2 BINDING SITE, designated SEQ ID:22376, to the nucleotide sequence of VGAM533 RNA, herein designated VGAM RNA, also designated SEQ ID:3244.

Another function of VGAM533 is therefore inhibition of BTB and CNC Homology 1, Basic Leucine Zipper Transcription Factor 2 (BACH2, Accession NM_021813), a gene which acts as repressor or activator, binds to maf recognition elements. Accordingly, utilities of VGAM533 include diagnosis, prevention and treatment of diseases and clinical conditions associated with BACH2. The function of BACH2 and its association with various diseases and clinical conditions, has been established by previous studies, as described hereinabove with reference to VGAM331. Cannabinoid Receptor 1 (brain) (CNR1, Accession NM_016083) is another VGAM533 host target gene. CNR1 BINDING SITE is HOST TARGET binding site found in the 3' untranslated region of mRNA encoded by CNR1, corresponding to a HOST TARGET binding site such as BINDING SITE I, BINDING SITE II or BINDING SITE III. Table 2 illustrates the complementarity of the nucleotide sequences of CNR1 BINDING SITE, designated SEQ ID:18165, to the nucleotide sequence of VGAM533 RNA, herein designated VGAM RNA, also designated SEQ ID:3244.

Another function of VGAM533 is therefore inhibition of Cannabinoid Receptor 1 (brain) (CNR1, Accession NM_016083), a gene which is involved in the cannabinoid-induced CNS effects. Accordingly, utilities of VGAM533 include diagnosis, prevention and treatment of diseases and clinical conditions associated with CNR1. The function of CNR1 has been established by previous studies. Ledent et al. (1999) investigated the function of the central cannabinoid receptor (CB1) by disrupting the gene in mice. Mutant mice did not respond to cannabinoid drugs, demonstrating the exclusive role of CB1 in mediating analgesia, reinforcement, hypothermia, hypolocomotion, and hypotension. The acute effects of opiates were unaffected, but the reinforcing properties of morphine and the severity of the withdrawal syndrome were strongly reduced. These observations suggested that CB1 is involved in the motivational properties of opiates and in the development of physical dependence, and extended the concept of an interconnected role of CB1 and opiate receptors in the brain areas mediating addictive behavior The cannabinoids are psychoactive ingredients of marijuana, principally delta-9-tetrahydrocannabinol, as well as the synthetic analogs. Matsuda et al. (1990) cloned a cannabinoid receptor from a rat brain. Gerard et al. (1991) isolated a cDNA encoding a cannabinoid receptor from a human brain stem cDNA library. The deduced amino acid sequence encoded a protein of 472 residues which shared 97.3% identity with the rat cannabinoid receptor cloned by Matsuda et al. (1990). They provided evidence for the existence of an identical cannabinoid receptor expressed in human testis Animal model experiments lend further support to the function of CNR1. Di Marzo et al. (2001) showed that following temporary food restriction, CB1 receptor knockout mice eat less than their wildtype littermates, and the CB1 antagonist SR141716A reduces food intake in wildtype but not knockout mice. Furthermore, defective leptin (OMIM Ref. No. 164160) signaling is associated with elevated hypothalamic, but not cerebellar, levels of endocannabinoids in obese db/db and ob/ob mice and Zucker rats. Acute leptin treatment of normal rats and ob/ob mice reduces anandamide and 2-arachidonoyl glycerol in the hypothalamus. Di Marzo et al. (2001) concluded that endocannabinoids in the hypothalamus may tonically activate CB1 receptors to maintain food intake and form part of the neural circuitry regulated by leptin It is appreciated that the abovementioned animal model for CNR1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ledent, C.; Valverde, O.; Cossu, G.; Petitet, F.; Aubert, J.-F.; Beslot, F.; Bohme, G. A.; Imperato, A.; Pedrazzini, T.; Roques, B. P.; Vassart, G.; Fratta, W.; Parmentier, M.: Unresponsiveness to cannabinoids and reduced addictive effects of opiates in CB(1) receptor knockout mice. Science 283:401-404, 1999; and Gerard, C. M.; Mollereau, C.; Vassart, G.; Parmentier, M.: Molecular cloning of a human cannabinoid receptor which is also expressed in testis. Biochem. J. 279:129-134, 1991.

Further studies establishing the function and utilities of CNR1 are found in John Hopkins OMIM database record ID 114610, and in sited publications numbered 3702-3709 listed in the bibliography section hereinbelow, which are also hereby incorporated by reference. DEAD/H (Asp-Glu-Ala-Asp/His) Box Polypeptide 6 (RNA helicase, 54 kDa) (DDX6, Accession NM_004397) is another VGAM533 host target gene. DDX6 BINDING SITE is HOST TARGET binding site found in the 3' untranslated region of mRNA encoded by DDX6, corresponding to a HOST TARGET binding site such as BINDING SITE I, BINDING SITE II or BINDING SITE III. Table 2 illustrates the complementarity of the nucleotide sequences of DDX6 BINDING SITE, designated SEQ ID:10641, to the nucleotide sequence of VGAM533 RNA, herein designated VGAM RNA, also designated SEQ ID:3244.

Another function of VGAM533 is therefore inhibition of DEAD/H (Asp-Glu-Ala-Asp/His) Box Polypeptide 6 (RNA helicase, 54 kDa) (DDX6, Accession NM_004397), a gene which is putative RNA helicases. Accordingly, utilities of VGAM533 include diagnosis, prevention and treatment of diseases and clinical conditions associated with DDX6. The function of DDX6 and its association with various diseases and clinical conditions, has been established by previous studies, as described hereinabove with reference to VGAM179. Discs, Large (Drosophila) Homolog 5 (DLG5, Accession XM_096398) is another VGAM533 host target gene. DLG5 BINDING SITE is HOST TARGET binding site found in the 3' untranslated region of mRNA encoded by DLG5, corresponding to a HOST TARGET binding site such as BINDING SITE I, BINDING SITE II or BINDING SITE III. Table 2 illustrates the complementarity of the nucleotide sequences of DLG5 BINDING SITE, designated SEQ ID:40332, to the nucleotide sequence of VGAM533 RNA, herein designated VGAM RNA, also designated SEQ ID:3244.

Another function of VGAM533 is therefore inhibition of Discs, Large (Drosophila) Homolog 5 (DLG5, Accession XM_096398), a gene which may transmit extracellular signals to inhibit cell proliferation. Accordingly, utilities of VGAM533 include diagnosis, prevention and treatment of diseases and clinical conditions associated with DLG5. The function of DLG5 and its association with various diseases and clinical conditions, has been established by previous studies, as described hereinabove with reference to VGAM444. EphB2 (EPHB2, Accession NM_004442) is another VGAM533 host target gene. EPHB2 BINDING SITE is HOST TARGET binding site found in the 3' untranslated region of mRNA encoded by EPHB2, corresponding to a HOST TARGET binding site such as BINDING SITE I, BINDING SITE II or BINDING SITE III. Table 2 illustrates the complementarity of the nucleotide sequences of EPHB2 BINDING SITE, designated SEQ ID:10731, to the nucleotide sequence of VGAM533 RNA, herein designated VGAM RNA, also designated SEQ ID:3244.

Another function of VGAM533 is therefore inhibition of EphB2 (EPHB2, Accession NM_004442), a gene which Eph-related receptor tyrosine kinase B2; may have a role in neurogenesis. Accordingly, utilities of VGAM533 include diagnosis, prevention and treatment of diseases and clinical conditions associated with EPHB2. The function of EPHB2 has been established by previous studies. See 179610 for background on Eph receptors and their ligands, the ephrins. Chan and Watt (1991) cloned partial sequences of the EEK (EPHA8; 176945) and ERK genes encoding members of the EPH subclass of receptor protein-tyrosine kinases. Northern blot analysis of rat RNA showed that DNA encoding human ERK hybridized to transcripts most abundantly in lung. By screening a human fetal brain cDNA expression library using a monoclonal antiphosphotyrosine antibody and by 5-prime RACE (rapid amplification of cDNA ends) procedures, Ikegaki et al. (1995) isolated overlapping cDNAs encoding a receptor-type tyrosine kinase belonging to the EPH family and designated the gene DRT (for developmentally regulated EPH-related tyrosine kinase). The DRT gene is expressed in transcripts of 3 different sizes (4, 5, and 11 kb). The DRT transcripts are expressed in human brain and several other tissues, including heart, lung, kidney, placenta, pancreas, liver, and skeletal muscle, but the 11-kb DRT transcript is preferentially expressed in fetal brain. Steady-state levels of DRT mRNA in several tissues, including brain, heart, lung, and kidney, are greater in the midterm fetus than those in the adult. Ikegaki et al. (1995) showed that a large number of tumor cell lines derived from neuroectoderm express DRT transcripts. The authors speculated that DRT may play a part in human neurogenesis. Using a yeast 2-hybrid system, Cowan et al. (2000) demonstrated that PDZ domain-containing protein Pick1 (PRKCABP; 605926) binds the C-terminal tail of EphB2. Using colocalization studies and biochemical analysis, they demonstrated that a protein complex containing EphB2 and aquaporin-1 (AQP1; 107776) is formed in vivo. They concluded that Ephb2 may regulate ionic homeostasis and endolymph fluid production through macromolecular associations with membrane channels that transport chloride, bicarbonate, and water. Chan and Watt (1991) mapped the EEK and ERK genes to chromosome 1 by Southern blot analysis of somatic cell hybrids. Ikegaki et al. (1995) mapped DRT, the EPHB2 gene, to 1p36.1-p35 by PCR screening of human/rodent somatic cell hybrid panels and by fluorescence in situ hybridization. As the distal end of 1p is often deleted in neuroblastomas, the DRT gene may play a role in neuroblastoma and small cell lung carcinoma (SCLC) tumorigenesis. By fluorescence in situ hybridization, Saito et al. (1995) demonstrated that the ERK gene is located in chromosomal region 1p36.1. They showed that the homologous genes are located on mouse 4D2.2-D3 and rat 5q36.13, both of which are regions with conserved linkage homology to human chromosome 1p. Animal model experiments lend further support to the function of EPHB2. Halford et al. (2000) generated mice deficient in Ryk (OMIM Ref. No. 600524) and found that they had a distinctive craniofacial appearance, shortened limbs, and postnatal mortality due to feeding and respiratory complications associated with a complete cleft of the secondary palate. Consistent with cleft palate phenocopy in Ephb2/Ephb3 (OMIM Ref. No. 601839)-deficient mice and the role of a Drosophila Ryk ortholog, 'Derailed,' in the transduction of repulsive axon pathfinding cues, biochemical data implicated Ryk in signaling mediated by Eph receptors and cell junction-associated Af6 (OMIM Ref. No. 159559). Halford et al. (2000) concluded that their findings highlighted the importance of signal crosstalk between members of different RTK subfamilies.

It is appreciated that the abovementioned animal model for EPHB2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ikegaki, N.; Tang, X. X.; Liu, X.-G.; Biegel, J. A.; Allen, C.; Yoshioka, A.; Sulman, E. P.; Brodeur, G. M.; Pleasure, D. E.: Molecular characterization and chromosomal localization of DRT (EPHT3): a developmentally regulated human protein-tyrosine kinase gene of the EPH family. Hum. Molec. Genet. 4:2033-2045, 1995; and Halford, M. M.; Armes, J.; Buchert, M.; Meskenaite, V.; Grail, D.; Hibbs, M. L.; Wilks, A. F.; Farlie, P. G.; Newgreen, D. F.; Hovens, C. M.; Stacker, S. A.: Ryk-deficient mice exhibit.

Further studies establishing the function and utilities of EPHB2 are found in John Hopkins OMIM database record ID 600997, and in sited publications numbered 12700, 12675-7763, 7565, 7764, 7877, 7878-7879, 776 and 7880 listed in the bibliography section hereinbelow, which are also hereby incorporated by reference. Exonuclease 1 (EXO1, Accession NM_130398) is another VGAM533 host target gene. EXO1 BINDING SITE is HOST TARGET binding site found in the 5' untranslated region of mRNA encoded by EXO1, corresponding to a HOST TARGET binding site such as BINDING SITE I, BINDING SITE II or BINDING SITE III. Table 2 illustrates the complementarity of the nucleotide sequences of EXO1 BINDING SITE, designated SEQ ID:28182, to the nucleotide sequence of VGAM533 RNA, herein designated VGAM RNA, also designated SEQ ID:3244.

Another function of VGAM533 is therefore inhibition of Exonuclease 1 (EXO1, Accession NM_130398), a gene which excise and replace mismatched segments. Accordingly, utilities of VGAM533 include diagnosis, prevention and treatment of diseases and clinical conditions associated with EXO1. The function of EXO1 and its association with various diseases and clinical conditions, has been established by previous studies, as described hereinabove with reference to VGAM399. CNIL (Accession NM_005776) is another VGAM533 host target gene. CNIL BINDING SITE is HOST TARGET binding site found in the 3' untranslated region of mRNA encoded by CNIL, corresponding to a HOST TARGET binding site such as BINDING SITE I, BINDING SITE II or BINDING SITE III. Table 2 illustrates the complementarity of the nucleotide sequences of CNIL BINDING SITE, designated SEQ ID:12354, to the nucleotide sequence of VGAM533 RNA, herein designated VGAM RNA, also designated SEQ ID:3244.

Another function of VGAM533 is therefore inhibition of CNIL (Accession NM_005776). Accordingly, utilities of VGAM533 include diagnosis, prevention and treatment of diseases and clinical conditions associated with CNIL. Dickkopf Homolog 2 (Xenopus laevis) (DKK2, Accession NM_014421) is another VGAM533 host target gene. DKK2 BINDING SITE is HOST TARGET binding site found in the 3' untranslated region of mRNA encoded by DKK2, corresponding to a HOST TARGET binding site such as BINDING SITE I, BINDING SITE II or BINDING SITE III. Table 2 illustrates the complementarity of the nucleotide sequences of DKK2 BINDING SITE, designated SEQ ID:15775, to the nucleotide sequence of VGAM533 RNA, herein designated VGAM RNA, also designated SEQ ID:3244.

Another function of VGAM533 is therefore inhibition of Dickkopf Homolog 2 (Xenopus laevis) (DKK2, Accession NM_014421). Accordingly, utilities of VGAM533 include diagnosis, prevention and treatment of diseases and clinical conditions associated with DKK2. FLJ10307 (Accession NM_018053) is another VGAM533 host target gene. FLJ10307 BINDING SITE is HOST TARGET binding site found in the 3' untranslated region of mRNA encoded by FLJ10307, corresponding to a HOST TARGET binding site such as BINDING SITE I, BINDING SITE II or BINDING SITE III. Table 2 illustrates the complementarity of the nucleotide sequences of FLJ10307 BINDING SITE, designated SEQ ID:19812, to the nucleotide sequence of VGAM533 RNA, herein designated VGAM RNA, also designated SEQ ID:3244.

Another function of VGAM533 is therefore inhibition of FLJ10307 (Accession NM_018053). Accordingly, utilities of VGAM533 include diagnosis, prevention and treatment of diseases and clinical conditions associated with FLJ10307. General Transcription Factor IIIC, Polypeptide 1, Alpha 220kDa (GTF3C1, Accession NM_001520) is another VGAM533 host target gene. GTF3C1 BINDING SITE is HOST TARGET binding site found in the 3' untranslated region of mRNA encoded by GTF3C1, corresponding to a HOST TARGET binding site such as BINDING SITE I, BINDING SITE II or BINDING SITE III. Table 2 illustrates the complementarity of the nucleotide sequences of GTF3C1 BINDING SITE, designated SEQ ID:7261, to the nucleotide sequence of VGAM533 RNA, herein designated VGAM RNA, also designated SEQ ID:3244.

Another function of VGAM533 is therefore inhibition of General Transcription Factor IIIC, Polypeptide 1, Alpha 220 kDa (GTF3C1, Accession NM_001520). Accordingly, utilities of VGAM533 include diagnosis, prevention and treatment of diseases and clinical conditions associated with GTF3C1. HSA277841 (Accession NM_018553) is another VGAM533 host target gene. HSA277841 BINDING SITE is HOST TARGET binding site found in the 3' untranslated region of mRNA encoded by HSA277841, corresponding to a HOST TARGET binding site such as BINDING SITE I, BINDING SITE II or BINDING SITE III. Table 2 illustrates the complementarity of the nucleotide sequences of HSA277841 BINDING SITE, designated SEQ ID:20634, to the nucleotide sequence of VGAM533 RNA, herein designated VGAM RNA, also designated SEQ ID:3244.

Another function of VGAM533 is therefore inhibition of HSA277841 (Accession NM_018553). Accordingly, utilities of VGAM533 include diagnosis, prevention and treatment of diseases and clinical conditions associated with HSA277841. KIAA0189 (Accession NM_014725) is another VGAM533 host target gene. KIAA0189 BINDING SITE is HOST TARGET binding site found in the 3' untranslated region of mRNA encoded by KIAA0189, corresponding to a HOST TARGET binding site such as BINDING SITE I, BINDING SITE II or BINDING SITE III. Table 2 illustrates the complementarity of the nucleotide sequences of KIAA0189 BINDING SITE, designated SEQ ID:16318, to the nucleotide sequence of VGAM533 RNA, herein designated VGAM RNA, also designated SEQ ID:3244.

Another function of VGAM533 is therefore inhibition of KIAA0189 (Accession NM_014725). Accordingly, utilities of VGAM533 include diagnosis, prevention and treatment of diseases and clinical conditions associated with KIAA0189. KIAA0552 (Accession NM_014731) is another VGAM533 host target gene. KIAA0552 BINDING SITE is HOST TARGET binding site found in the 3' untranslated region of mRNA encoded by KIAA0552, corresponding to a HOST TARGET binding site such as BINDING SITE I, BINDING SITE II or BINDING SITE III. Table 2 illustrates the complementarity of the nucleotide sequences of KIAA0552 BINDING SITE, designated SEQ ID:16347, to the nucleotide sequence of VGAM533 RNA, herein designated VGAM RNA, also designated SEQ ID:3244.

Another function of VGAM533 is therefore inhibition of KIAA0552 (Accession NM_014731). Accordingly, utilities of VGAM533 include diagnosis, prevention and treatment of diseases and clinical conditions associated with KIAA0552. KIAA0712 (Accession NM_014715) is another VGAM533 host target gene. KIAA0712 BINDING SITE is HOST TARGET binding site found in the 3' untranslated region of mRNA encoded by KIAA0712, corresponding to a HOST TARGET binding site such as BINDING SITE I, BINDING SITE II or BINDING SITE III. Table 2 illustrates the complementarity of the nucleotide sequences of KIAA0712 BINDING SITE, designated SEQ ID:16265, to the nucleotide sequence of VGAM533 RNA, herein designated VGAM RNA, also designated SEQ ID:3244.

Another function of VGAM533 is therefore inhibition of KIAA0712 (Accession NM_014715). Accordingly, utilities of VGAM533 include diagnosis, prevention and treatment of diseases and clinical conditions associated with KIAA0712. WWP1 (Accession XM_087357) is another VGAM533 host target gene. WWP1 BINDING SITE is HOST TARGET binding site found in the 5' untranslated region of mRNA encoded by WWP1, corresponding to a HOST TARGET binding site such as BINDING SITE I, BINDING SITE II or BINDING SITE III. Table 2 illustrates the complementarity of the nucleotide sequences of WWP1 BINDING SITE, designated SEQ ID:39191, to the nucleotide sequence of VGAM533 RNA, herein designated VGAM RNA, also designated SEQ ID:3244.

Another function of VGAM533 is therefore inhibition of WWP1 (Accession XM_087357). Accordingly, utilities of VGAM533 include diagnosis, prevention and treatment of diseases and clinical conditions associated with WWP1. LOC137492 (Accession XM_059910) is another VGAM533 host target gene. LOC137492 BINDING SITE is HOST TARGET binding site found in the 5' untranslated region of mRNA encoded by LOC137492, corresponding to a HOST TARGET binding site such as BINDING SITE I, BINDING SITE II or BINDING SITE III. Table 2 illustrates the complementarity of the nucleotide sequences of LOC137492 BINDING SITE, designated SEQ ID:37106, to the nucleotide sequence of VGAM533 RNA, herein designated VGAM RNA, also designated SEQ ID:3244.

Another function of VGAM533 is therefore inhibition of LOC137492 (Accession XM_059910). Accordingly, utilities of VGAM533 include diagnosis, prevention and treatment of diseases and clinical conditions associated with LOC137492. LOC144776 (Accession XM_084964) is another VGAM533 host target gene. LOC144776 BINDING SITE is HOST TARGET binding site found in the 3' untranslated region of mRNA encoded by LOC144776, corresponding to a HOST TARGET binding site such as BINDING SITE I, BINDING SITE II or BINDING SITE III. Table 2 illustrates the complementarity of the nucleotide sequences of LOC144776 BINDING SITE, designated SEQ ID:37787, to the nucleotide sequence of VGAM533 RNA, herein designated VGAM RNA, also designated SEQ ID:3244.

Another function of VGAM533 is therefore inhibition of LOC144776 (Accession XM_084964). Accordingly, utilities of VGAM533 include diagnosis, prevention and treatment of diseases and clinical conditions associated with LOC144776. LOC146420 (Accession XM_096996) is another VGAM533 host target gene. LOC146420 BINDING SITE is HOST TARGET binding site found in the 5' untranslated region of mRNA encoded by LOC146420, corresponding to a HOST TARGET binding site such as BINDING SITE I, BINDING SITE II or BINDING SITE III. Table 2 illustrates the complementarity of the nucleotide sequences of LOC146420 BINDING SITE, designated SEQ ID:40694, to the nucleotide sequence of VGAM533 RNA, herein designated VGAM RNA, also designated SEQ ID:3244.

Another function of VGAM533 is therefore inhibition of LOC146420 (Accession XM_096996). Accordingly, utilities of VGAM533 include diagnosis, prevention and treatment of diseases and clinical conditions associated with LOC146420. LOC158402 (Accession XM_098936) is another VGAM533 host target gene. LOC158402 BINDING SITE is HOST TARGET binding site found in the 5' untranslated region of mRNA encoded by LOC158402, corresponding to a HOST TARGET binding site such as BINDING SITE I, BINDING SITE II or BINDING SITE III. Table 2 illustrates the complementarity of the nucleotide sequences of LOC158402 BIND- ING SITE, designated SEQ ID:41978, to the nucleotide sequence of VGAM533 RNA, herein designated VGAM RNA, also designated SEQ ID:3244.

Another function of VGAM533 is therefore inhibition of LOC158402 (Accession XM_098936). Accordingly, utilities of VGAM533 include diagnosis, prevention and treatment of diseases and clinical conditions associated with LOC158402. LOC257438 (Accession XM_168338) is another VGAM533 host target gene. LOC257438 BINDING SITE is HOST TARGET binding site found in the 3' untranslated region of mRNA encoded by LOC257438, corresponding to a HOST TARGET binding site such as BINDING SITE I, BINDING SITE II or BINDING SITE III. Table 2 illustrates the complementarity of the nucleotide sequences of LOC257438 BINDING SITE, designated SEQ ID:45106, to the nucleotide sequence of VGAM533 RNA, herein designated VGAM RNA, also designated SEQ ID:3244.

Another function of VGAM533 is therefore inhibition of LOC257438 (Accession XM_168338). Accordingly, utilities of VGAM533 include diagnosis, prevention and treatment of diseases and clinical conditions associated with LOC257438. FIG. 1 further provides a conceptual description of a novel bioinformatically detected viral gene of the present invention, referred to here as Viral Genomic Address Messenger 534 (VGAM534) viral gene, which modulates expression of respective host target genes thereof, the function and utility of which host target genes is known in the art.

VGAM534 is a novel bioinformatically detected regulatory, non protein coding, viral micro RNA (miRNA) gene. The method by which VGAM534 was detected is described hereinabove with reference to FIGS. 1-8.

VGAM534 gene, herein designated VGAM GENE, is a viral gene contained in the genome of Orgyia Pseudotsugata Single Capsid Nuclear Polyhedrosis Virus. VGAM534 host target gene, herein designated VGAM HOST TARGET GENE, is a human gene contained in the human genome.

VGAM534 gene encodes a VGAM534 precursor RNA, herein designated VGAM PRECURSOR RNA. Similar to other miRNA genes, and unlike most ordinary genes, VGAM534 precursor RNA does not encode a protein. A nucleotide sequence identical or highly similar to the nucleotide sequence of VGAM534 precursor RNA is designated SEQ ID:520, and is provided hereinbelow with reference to the sequence listing part. Nucleotide sequence SEQ ID:520 is located at position 23857 relative to the genome of Orgyia Pseudotsugata Single Capsid Nuclear Polyhedrosis Virus.

VGAM534 precursor RNA folds onto itself, forming VGAM534 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM534 folded precursor RNA into VGAM534 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM534 RNA is designated SEQ ID:3245, and is provided hereinbelow with reference to the sequence listing part.

VGAM534 host target gene, herein designated VGAM HOST TARGET GENE, encodes a corresponding messenger RNA, VGAM534 host target RNA, herein designated VGAM HOST TARGET RNA. VGAM534 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM534 RNA, herein designated VGAM RNA, binds complementarily to one or more host target binding sites located in untranslated regions of VGAM534 host target RNA, herein designated VGAM HOST TARGET RNA. This complementary binding is due to the fact that the nucleotide sequence of VGAM534 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM534 RNA, herein designated VGAM RNA, may have a different number of host target binding sites in untranslated regions of a VGAM534 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM534 RNA, herein designated VGAM RNA, to host target binding sites on VGAM534 host target RNA, herein designated VGAM HOST TARGET RNA, such as BINDING SITE I, BINDING SITE II and BINDING SITE III, inhibits translation of VGAM534 host target RNA into VGAM534 host target protein, herein designated VGAM HOST TARGET PROTEIN. VGAM host target protein is therefore outlined by a broken line.

It is appreciated that VGAM534 host target gene, herein designated VGAM HOST TARGET GENE, in fact represents a plurality of VGAM534 host target genes. The mRNA of each one of this plurality of VGAM534 host target genes comprises one or more host target binding sites, each having a nucleotide sequence which is at least partly complementary to VGAM534 RNA, herein designated VGAM RNA, and which when bound by VGAM534 RNA causes inhibition of translation of respective one or more VGAM534 host target proteins.

It is further appreciated by one skilled in the art that the mode of translational inhibition illustrated by FIG. 1 with specific reference to translational inhibition exerted by VGAM534 gene, herein designated VGAM GENE, on one or more VGAM534 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM534 is inhibition of expression of host target genes, as part of a novel viral mechanism of attacking a host. Accordingly, utilities of VGAM534 include diagnosis, prevention and treatment of viral infection by Orgyia Pseudotsugata Single Capsid Nuclear Polyhedrosis Virus. Specific functions, and accordingly utilities, of VGAM534 correlate with, and may be deduced from, the identity of the host target genes which VGAM534 binds and inhibits, and the function of these host target genes, as elaborated hereinbelow.

Nucleotide sequences of the VGAM534 precursor RNA, herein designated VGAM PRECURSOR RNA, and of the 'diced' VGAM534 RNA, herein designated VGAM RNA, and a schematic representation of the secondary folding of VGAM534 folded precursor RNA, herein designated VGAM FOLDED PRECURSOR RNA, of VGAM534 are further described hereinbelow with reference to Table 1.

Nucleotide sequences of host target binding sites, such as BINDING SITE-I, BINDING SITE-II and BINDING SITE-III of FIG. 1, found on VGAM534 host target RNA, and schematic representation of the complementarity of each of these host target binding sites to VGAM534 RNA, herein designated VGAM RNA, are described hereinbelow with reference to Table 2.

As mentioned hereinabove with reference to FIG. 1, a function of VGAM534 gene, herein designated VGAM is inhibition of expression of VGAM534 target genes. It is appreciated that specific functions, and accordingly utilities, of VGAM534 correlate with, and may be deduced from, the identity of the target genes which VGAM534 binds and inhibits, and the function of these target genes, as elaborated hereinbelow.

Forkhead Box D2 (FOXD2, Accession NM_004474) is a VGAM534 host target gene. FOXD2 BINDING SITE is HOST TARGET binding site found in the 5' untranslated region of mRNA encoded by FOXD2, corresponding to a HOST TARGET binding site such as BINDING SITE I, BINDING SITE II or BINDING SITE III. Table 2 illustrates the complementarity of the nucleotide sequences of FOXD2 BINDING SITE, designated SEQ ID:10790, to the nucleotide sequence of VGAM534 RNA, herein designated VGAM RNA, also designated SEQ ID:3245.

A function of VGAM534 is therefore inhibition of Forkhead Box D2 (FOXD2, Accession NM_004474). Accordingly, utilities of VGAM534 include diagnosis, prevention and treatment of diseases and clinical conditions associated with FOXD2. Syndecan 1 (SDC1, Accession NM_002997) is another VGAM534 host target gene. SDC1 BINDING SITE is HOST TARGET binding site found in the 3' untranslated region of mRNA encoded by SDC1, corresponding to a HOST TARGET binding site such as BINDING SITE I, BINDING SITE II or BINDING SITE III. Table 2 illustrates the complementarity of the nucleotide sequences of SDC1 BINDING SITE, designated SEQ ID:8887, to the nucleotide sequence of VGAM534 RNA, herein designated VGAM RNA, also designated SEQ ID:3245.

Another function of VGAM534 is therefore inhibition of Syndecan 1 (SDC1, Accession NM_002997), a gene which mediates cell behaviors like cell adhesion, action of growth factors. Accordingly, utilities of VGAM534 include diagnosis, prevention and treatment of diseases and clinical conditions associated with SDC1. The function of SDC1 has been established by previous studies. Sanderson et al. (1989) showed that Sdc1 is expressed in mouse only when and where B lymphocytes associate with extracellular matrix, namely as B-cell precursors in bone marrow and as immobilized plasma cells in interstitial matrices. Expression is lost immediately before maturation and release of B lymphocytes into the circulation and is absent on circulating and mature peripheral B lymphocytes. SDC1 is reexpressed on differentiated plasma cells and is a marker for cells secreting immunoglobulin. By probing a breast epithelial cell line cDNA library with mouse syndecan probes, Mali et al. (1990) obtained a cDNA encoding human SDC1. Sequence analysis predicted that the 310-amino acid human protein is 77% identical to the mouse sequence. SDC1 has an ectodomain, a 25-residue transmembrane domain, and a 34-residue cytoplasmic domain, which are 70%, 96%, and 100% identical to those of the mouse protein, respectively. The ectodomain is preceded by an N-terminal signal peptide and contains 5 potential glycosaminoglycan-attachment sites, 1 potential N-glycosylation site, and a dibasic lys-arg cleavage site adjacent to the transmembrane domain. Northern blot analysis revealed expression of 2.6- and 3.4-kb SDC1 transcripts in mammary epithelial and carcinoma cells and in fetal skin; a 4.5-kb transcript was detected in brain. Animal model experiments lend further support to the function of SDC1. Reizes et al. (2001) found that transgenic expression in the hypothalamus of Sdc1 produced mice with hyperphagia and maturity-onset obesity resembling mice with reduced action of alpha-melanocyte-stimulating hormone (alpha-MSH; OMIM Ref. No. 155555). Via their heparan sulfate chains, syndecans potentiate the action of agouti-related protein (OMIM Ref. No. 602311) and agouti signaling protein (OMIM Ref. No. 600201), endogenous inhibitors of alpha-MSH. In wildtype mice, Sdc3 (OMIM Ref. No. 186357), the predominantly neural syndecan, was expressed in hypothalamic regions that control energy balance. Food deprivation increased hypothalamic Sdc3 levels several-fold. Sdc3 null mice, which otherwise appeared normal, responded to food deprivation with markedly reduced reflex hyperphagia. Reizes et al. (2001) proposed that oscillation of hypothalamic SDC3 levels physiologically modulates feeding behavior.

It is appreciated that the abovementioned animal model for SDC1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Alexander, C. M.; Reichsman, F.; Hinkes, M. T.; Lincecum, J.; Becker, K. A.; Cumberledge, S.; Bernfield, M.: Syndecan-1 is required for Wnt-1-induced mammary tumorigenesis in mice. Nature Genet. 25:329-332, 2000; and Mali, M.; Jaakkola, P.; Arvilommi, A.-M.; Jalkanen, M.: Sequence of human syndecan indicates a novel gene family of integral membrane proteoglycans. J. Biol. Chem. 265:6884-6889, 199.

Further studies establishing the function and utilities of SDC1 are found in John Hopkins OMIM database record ID 186355, and in sited publications numbered 10500-1050 and 11616 listed in the bibliography section hereinbelow, which are also hereby incorporated by reference. CSR1 (Accession NM_016240) is another VGAM534 host target gene. CSR1 BINDING SITE is HOST TARGET binding site found in the 3' untranslated region of mRNA encoded by CSR1, corresponding to a HOST TARGET binding site such as BINDING SITE I, BINDING SITE II or BINDING SITE III. Table 2 illustrates the complementarity of the nucleotide sequences of CSR1 BINDING SITE, designated SEQ ID:18360, to the nucleotide sequence of VGAM534 RNA, herein designated VGAM RNA, also designated SEQ ID:3245.

Another function of VGAM534 is therefore inhibition of CSR1 (Accession NM_016240). Accordingly, utilities of VGAM534 include diagnosis, prevention and treatment of diseases and clinical conditions associated with CSR1. DKFZP434P211 (Accession NM_014549) is another VGAM534 host target gene. DKFZP434P211 BINDING SITE is HOST TARGET binding site found in the 3' untranslated region of mRNA encoded by DKFZP434P211, corresponding to a HOST TARGET binding site such as BINDING SITE I, BINDING SITE II or BINDING SITE III. Table 2 illustrates the complementarity of the nucleotide sequences of DKFZP434P211 BINDING SITE, designated SEQ ID:15869, to the nucleotide sequence of VGAM534 RNA, herein designated VGAM RNA, also designated SEQ ID:3245.

Another function of VGAM534 is therefore inhibition of DKFZP434P211 (Accession NM_014549). Accordingly, utilities of VGAM534 include diagnosis, prevention and treatment of diseases and clinical conditions associated with DKFZP434P211. DKFZP586B2420 (Accession XM_059482) is another VGAM534 host target gene. DKFZP586B2420 BINDING SITE is HOST TARGET binding site found in the 3' untranslated region of mRNA encoded by DKFZP586B2420, corresponding to a HOST TARGET binding site such as BINDING SITE I, BINDING SITE II or BINDING SITE III. Table 2 illustrates the complementarity of the nucleotide sequences of DKFZP586B2420 BINDING SITE, designated SEQ ID:37009, to the nucleotide sequence of VGAM534 RNA, herein designated VGAM RNA, also designated SEQ ID:3245.

Another function of VGAM534 is therefore inhibition of DKFZP586B2420 (Accession XM_059482). Accordingly, utilities of VGAM534 include diagnosis, prevention and treatment of diseases and clinical conditions associated with DKFZP586B2420. FBX30 (Accession NM_033182) is another VGAM534 host target gene. FBX30 BINDING SITE is HOST TARGET binding site found in the 3' untranslated region of mRNA encoded by FBX30, corresponding to a HOST TARGET binding site such as BINDING SITE I, BINDING SITE II or BINDING SITE III. Table 2 illustrates the complementarity of the nucleotide sequences of FBX30 BINDING SITE, designated SEQ ID:27042, to the nucleotide sequence of VGAM534 RNA, herein designated VGAM RNA, also designated SEQ ID:3245.

Another function of VGAM534 is therefore inhibition of FBX30 (Accession NM_033182). Accordingly, utilities of VGAM534 include diagnosis, prevention and treatment of diseases and clinical conditions associated with FBX30. HSPC043 (Accession XM_041943) is another VGAM534 host target gene. HSPC043 BINDING SITE is HOST TARGET binding site found in the 5' untranslated region of mRNA encoded by HSPC043, corresponding to a HOST TARGET binding site such as BINDING SITE I, BINDING SITE II or BINDING SITE III. Table 2 illustrates the complementarity of the nucleotide sequences of HSPC043 BINDING SITE, designated SEQ ID:33636, to the nucleotide sequence of VGAM534 RNA, herein designated VGAM RNA, also designated SEQ ID:3245.

Another function of VGAM534 is therefore inhibition of HSPC043 (Accession XM_041943). Accordingly, utilities of VGAM534 include diagnosis, prevention and treatment of diseases and clinical conditions associated with HSPC043. KIAA0495 (Accession XM_031397) is another VGAM534 host target gene. KIAA0495 BINDING SITE is HOST TARGET binding site found in the 5' untranslated region of mRNA encoded by KIAA0495, corresponding to a HOST TARGET binding site such as BINDING SITE I, BINDING SITE II or BINDING SITE III. Table 2 illustrates the complementarity of the nucleotide sequences of KIAA0495 BINDING SITE, designated SEQ ID:31356, to the nucleotide sequence of VGAM534 RNA, herein designated VGAM RNA, also designated SEQ ID:3245.

Another function of VGAM534 is therefore inhibition of KIAA0495 (Accession XM_031397). Accordingly, utilities of VGAM534 include diagnosis, prevention and treatment of diseases and clinical conditions associated with KIAA0495. KIAA1243 (Accession XM_057057) is another VGAM534 host target gene. KIAA1243 BINDING SITE is HOST TARGET binding site found in the 5' untranslated region of mRNA encoded by KIAA1243, corresponding to a HOST TARGET binding site such as BINDING SITE I, BINDING SITE II or BINDING SITE III. Table 2 illustrates the complementarity of the nucleotide sequences of KIAA1243 BINDING SITE, designated SEQ ID:36471, to the nucleotide sequence of VGAM534 RNA, herein designated VGAM RNA, also designated SEQ ID:3245.

Another function of VGAM534 is therefore inhibition of KIAA1243 (Accession XM_057057). Accordingly, utilities of VGAM534 include diagnosis, prevention and treatment of diseases and clinical conditions associated with KIAA1243. LOC157918 (Accession XM_098842) is another VGAM534 host target gene. LOC157918 BINDING SITE is HOST TARGET binding site found in the 3' untranslated region of mRNA encoded by LOC157918, corresponding to a HOST TARGET binding site such as BINDING SITE I, BINDING SITE II or BINDING SITE III. Table 2 illustrates the complementarity of the nucleotide sequences of LOC157918 BINDING SITE, designated SEQ ID:41898, to the nucleotide sequence of VGAM534 RNA, herein designated VGAM RNA, also designated SEQ ID:3245.

Another function of VGAM534 is therefore inhibition of LOC157918 (Accession XM_098842). Accordingly, utilities of VGAM534 include diagnosis, prevention and treatment of diseases and clinical conditions associated with LOC157918. FIG. 1 further provides a conceptual description of a novel bioinformatically detected viral gene of the present invention, referred to here as Viral Genomic Address Messenger 535 (VGAM535) viral gene, which modulates expression of respective host target genes thereof, the function and utility of which host target genes is known in the art.

VGAM535 is a novel bioinformatically detected regulatory, non protein coding, viral micro RNA (miRNA) gene. The method by which VGAM535 was detected is described hereinabove with reference to FIGS. 1-8.

VGAM535 gene, herein designated VGAM GENE, is a viral gene contained in the genome of Hendra Virus. VGAM535 host target gene, herein designated VGAM HOST TARGET GENE, is a human gene contained in the human genome.

VGAM535 gene encodes a VGAM535 precursor RNA, herein designated VGAM PRECURSOR RNA. Similar to other miRNA genes, and unlike most ordinary genes, VGAM535 precursor RNA does not encode a protein. A nucleotide sequence identical or highly similar to the nucleotide sequence of VGAM535 precursor RNA is designated SEQ ID:521, and is provided hereinbelow with reference to the sequence listing part. Nucleotide sequence SEQ ID:521 is located at position 9666 relative to the genome of Hendra Virus.

VGAM535 precursor RNA folds onto itself, forming VGAM535 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM535 folded precursor RNA into VGAM535 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM535 RNA is designated SEQ ID:3246, and is provided hereinbelow with reference to the sequence listing part.

VGAM535 host target gene, herein designated VGAM HOST TARGET GENE, encodes a corresponding messenger RNA, VGAM535 host target RNA, herein designated VGAM HOST TARGET RNA. VGAM535 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM535 RNA, herein designated VGAM RNA, binds complementarily to one or more host target binding sites located in untranslated regions of VGAM535 host target RNA, herein designated VGAM HOST TARGET RNA. This complementary binding is due to the fact that the nucleotide sequence of VGAM535 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM535 RNA, herein designated VGAM RNA, may have a different number of host target binding sites in untranslated regions of a VGAM535 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM535 RNA, herein designated VGAM RNA, to host target binding sites on VGAM535 host target RNA, herein designated VGAM HOST TARGET RNA, such as BINDING SITE I, BINDING SITE II and BINDING SITE III, inhibits translation of VGAM535 host target RNA into VGAM535 host target protein, herein designated VGAM HOST TARGET PROTEIN. VGAM host target protein is therefore outlined by a broken line.

It is appreciated that VGAM535 host target gene, herein designated VGAM HOST TARGET GENE, in fact represents a plurality of VGAM535 host target genes. The mRNA of each one of this plurality of VGAM535 host target genes comprises one or more host target binding sites, each having a nucleotide sequence which is at least partly complementary to VGAM535 RNA, herein designated VGAM RNA, and which when bound by VGAM535 RNA causes inhibition of translation of respective one or more VGAM535 host target proteins.

It is further appreciated by one skilled in the art that the mode of translational inhibition illustrated by FIG. 1 with specific reference to translational inhibition exerted by VGAM535 gene, herein designated VGAM GENE, on one or more VGAM535 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM535 is inhibition of expression of host target genes, as part of a novel viral mechanism of attacking a host. Accordingly, utilities of VGAM535 include diagnosis, prevention and treatment of viral infection by Hendra Virus. Specific functions, and accordingly utilities, of VGAM535 correlate with, and may be deduced from, the identity of the host target genes which VGAM535 binds and inhibits, and the function of these host target genes, as elaborated hereinbelow.

Nucleotide sequences of the VGAM535 precursor RNA, herein designated VGAM PRECURSOR RNA, and of the 'diced' VGAM535 RNA, herein designated VGAM RNA, and a schematic representation of the secondary folding of VGAM535 folded precursor RNA, herein designated VGAM FOLDED PRECURSOR RNA, of VGAM535 are further described hereinbelow with reference to Table 1.

Nucleotide sequences of host target binding sites, such as BINDING SITE-I, BINDING SITE-II and BINDING SITE-III of FIG. 1, found on VGAM535 host target RNA, and schematic representation of the complementarity of each of these host target binding sites to VGAM535 RNA, herein designated VGAM RNA, are described hereinbelow with reference to Table 2.

As mentioned hereinabove with reference to FIG. 1, a function of VGAM535 gene, herein designated VGAM is inhibition of expression of VGAM535 target genes. It is appreciated that specific functions, and accordingly utilities, of VGAM535 correlate with, and may be deduced from, the identity of the target genes which VGAM535 binds and inhibits, and the function of these target genes, as elaborated hereinbelow.

Pleckstrin Homology-like Domain, Family A, Member 3 (PHLDA3, Accession NM_012396) is a VGAM535 host target gene. PHLDA3 BINDING SITE is HOST TARGET binding site found in the 3' untranslated region of mRNA encoded by PHLDA3, corresponding to a HOST TARGET binding site such as BINDING SITE I, BINDING SITE II or BINDING SITE III. Table 2 illustrates the complementarity of the nucleotide sequences of PHLDA3 BINDING SITE, designated SEQ ID:14760, to the nucleotide sequence of VGAM535 RNA, herein designated VGAM RNA, also designated SEQ ID:3246.

A function of VGAM535 is therefore inhibition of Pleckstrin Homology-like Domain, Family A, Member 3 (PHLDA3, Accession NM_012396). Accordingly, utilities of VGAM535 include diagnosis, prevention and treatment of diseases and clinical conditions associated with PHLDA3. Pim-2 Oncogene (PIM2, Accession XM_010208) is another VGAM535 host target gene. PIM2 BINDING SITE is HOST TARGET binding site found in the 3' untranslated region of mRNA encoded by PIM2, corresponding to a HOST TARGET binding site such as BINDING SITE I, BINDING SITE II or BINDING SITE III. Table 2 illustrates the complementarity of the nucleotide sequences of PIM2 BINDING SITE, designated SEQ ID:30135, to the nucleotide sequence of VGAM535 RNA, herein designated VGAM RNA, also designated SEQ ID:3246.

Another function of VGAM535 is therefore inhibition of Pim-2 Oncogene (PIM2, Accession XM_010208). Accordingly, utilities of VGAM535 include diagnosis, prevention and treatment of diseases and clinical conditions associated with PIM2. DKFZP566G1424 (Accession XM_097771) is another VGAM535 host target gene. DKFZP566G1424

BINDING SITE is HOST TARGET binding site found in the 5' untranslated region of mRNA encoded by DKFZP566G1424, corresponding to a HOST TARGET binding site such as BINDING SITE I, BINDING SITE II or BINDING SITE III. Table 2 illustrates the complementarity of the nucleotide sequences of DKFZP566G1424 BINDING SITE, designated SEQ ID:41116, to the nucleotide sequence of VGAM535 RNA, herein designated VGAM RNA, also designated SEQ ID:3246.

Another function of VGAM535 is therefore inhibition of DKFZP566G1424 (Accession XM_097771). Accordingly, utilities of VGAM535 include diagnosis, prevention and treatment of diseases and clinical conditions associated with DKFZP566G1424. FLJ11370 (Accession NM_024961) is another VGAM535 host target gene. FLJ11370 BINDING SITE is HOST TARGET binding site found in the 3' untranslated region of mRNA encoded by FLJ11370, corresponding to a HOST TARGET binding site such as BINDING SITE I, BINDING SITE II or BINDING SITE III. Table 2 illustrates the complementarity of the nucleotide sequences of FLJ11370 BINDING SITE, designated SEQ ID:24517, to the nucleotide sequence of VGAM535 RNA, herein designated VGAM RNA, also designated SEQ ID:3246.

Another function of VGAM535 is therefore inhibition of FLJ11370 (Accession NM_024961). Accordingly, utilities of VGAM535 include diagnosis, prevention and treatment of diseases and clinical conditions associated with FLJ11370. MIG (Accession NM_002416) is another VGAM535 host target gene. MIG BINDING SITE is HOST TARGET binding site found in the 3" untranslated region of mRNA encoded by MIG, corresponding to a HOST TARGET binding site such as BINDING SITE I, BINDING SITE II or BINDING SITE III. Table 2 illustrates the complementarity of the nucleotide sequences of MIG BINDING SITE, designated SEQ ID:8247, to the nucleotide sequence of VGAM535 RNA, herein designated VGAM RNA, also designated SEQ ID:3246.

Another function of VGAM535 is therefore inhibition of MIG (Accession NM_002416). Accordingly, utilities of VGAM535 include diagnosis, prevention and treatment of diseases and clinical conditions associated with MIG. Phosphatase, Orphan 1 (phospho1, Accession XM_091572) is another VGAM535 host target gene. phospho1 BINDING SITE is HOST TARGET binding site found in the 5' untranslated region of mRNA encoded by phospho1, corresponding to a HOST TARGET binding site such as BINDING SITE I, BINDING SITE II or BINDING SITE III. Table 2 illustrates the complementarity of the nucleotide sequences of phospho1 BINDING SITE, designated SEQ ID:40059, to the nucleotide sequence of VGAM535 RNA, herein designated VGAM RNA, also designated SEQ ID:3246.

Another function of VGAM535 is therefore inhibition of Phosphatase, Orphan 1 (phospho1, Accession XM_091572). Accordingly, utilities of VGAM535 include diagnosis, prevention and treatment of diseases and clinical conditions associated with phospho1. Zinc Finger Protein 262 (ZNF262, Accession NM_005095) is another VGAM535 host target gene. ZNF262 BINDING SITE is HOST TARGET binding site found in the 3' untranslated region of mRNA encoded by ZNF262, corresponding to a HOST TARGET binding site such as BINDING SITE I, BINDING SITE II or BINDING SITE III. Table 2 illustrates the complementarity of the nucleotide sequences of ZNF262 BINDING SITE, designated SEQ ID:11559, to the nucleotide sequence of VGAM535 RNA, herein designated VGAM RNA, also designated SEQ ID:3246.

Another function of VGAM535 is therefore inhibition of Zinc Finger Protein 262 (ZNF262, Accession NM_005095). Accordingly, utilities of VGAM535 include diagnosis, prevention and treatment of diseases and clinical conditions associated with ZNF262. LOC144308 (Accession XM_096575) is another VGAM535 host target gene. LOC144308 BINDING SITE is HOST TARGET binding site found in the 3' untranslated region of mRNA encoded by LOC144308, corresponding to a HOST TARGET binding site such as BINDING SITE I, BINDING SITE II or BINDING SITE III. Table 2 illustrates the complementarity of the nucleotide sequences of LOC144308 BINDING SITE, designated SEQ ID:40405, to the nucleotide sequence of VGAM535 RNA, herein designated VGAM RNA, also designated SEQ ID:3246.

Another function of VGAM535 is therefore inhibition of LOC144308 (Accession XM_096575). Accordingly, utilities of VGAM535 include diagnosis, prevention and treatment of diseases and clinical conditions associated with LOC144308. LOC149414 (Accession XM_097635) is another VGAM535 host target gene. LOC149414 BINDING SITE is HOST TARGET binding site found in the 5' untranslated region of mRNA encoded by LOC149414, corresponding to a HOST TARGET binding site such as BINDING SITE I, BINDING SITE II or BINDING SITE III. Table 2 illustrates the complementarity of the nucleotide sequences of LOC149414 BINDING SITE, designated SEQ ID:40988, to the nucleotide sequence of VGAM535 RNA, herein designated VGAM RNA, also designated SEQ ID:3246.

Another function of VGAM535 is therefore inhibition of LOC149414 (Accession XM_097635). Accordingly, utilities of VGAM535 include diagnosis, prevention and treatment of diseases and clinical conditions associated with LOC149414. LOC196527 (Accession XM_113743) is another VGAM535 host target gene. LOC196527 BINDING SITE is HOST TARGET binding site found in the 3' untranslated region of mRNA encoded by LOC196527, corresponding to a HOST TARGET binding site such as BINDING SITE I, BINDING SITE II or BINDING SITE III. Table 2 illustrates the complementarity of the nucleotide sequences of LOC196527 BINDING SITE, designated SEQ ID:42401, to the nucleotide sequence of VGAM535 RNA, herein designated VGAM RNA, also designated SEQ ID:3246.

Another function of VGAM535 is therefore inhibition of LOC196527 (Accession XM_113743). Accordingly, utilities of VGAM535 include diagnosis, prevention and treatment of diseases and clinical conditions associated with LOC196527. LOC199858 (Accession XM_114040) is another VGAM535 host target gene. LOC199858 BINDING SITE is HOST TARGET binding site found in the 5' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42629, to the nucleotide sequence of VGAM535 RNA, herein designated VGAM RNA, also designated SEQ ID:3246.

Another function of VGAM535 is therefore inhibition of LOC199858 (Accession XM_114040). Accordingly, utilities of VGAM535 include diagnosis, prevention and treatment of diseases and clinical conditions associated with LOC199858. LOC222134 (Accession XM_168432) is another VGAM535 host target gene. LOC222134 BINDING SITE is HOST TARGET binding site found in the 5' untranslated region of mRNA encoded by LOC222134, corresponding to a HOST TARGET binding site such as BINDING SITE I, BINDING SITE II or BINDING SITE III. Table 2 illustrates the complementarity of the nucleotide sequences of LOC222134 BINDING SITE, designated SEQ ID:45169, to the nucleotide sequence of VGAM535 RNA, herein designated VGAM RNA, also designated SEQ ID:3246.

Another function of VGAM535 is therefore inhibition of LOC222134 (Accession XM_168432). Accordingly, utilities of VGAM535 include diagnosis, prevention and treatment of diseases and clinical conditions associated with LOC222134. FIG. 1 further provides a conceptual description of a novel bioinformatically detected viral gene of the present invention, referred to here as Viral Genomic Address Messenger 536 (VGAM536) viral gene, which modulates expression of respective host target genes thereof, the function and utility of which host target genes is known in the art.

VGAM536 is a novel bioinformatically detected regulatory, non protein coding, viral micro RNA (miRNA) gene. The method by which VGAM536 was detected is described hereinabove with reference to FIGS. 1-8.

VGAM536 gene, herein designated VGAM GENE, is a viral gene contained in the genome of Ateline Herpesvirus 3. VGAM536 host target gene, herein designated VGAM HOST TARGET GENE, is a human gene contained in the human genome.

VGAM536 gene encodes a VGAM536 precursor RNA, herein designated VGAM PRECURSOR RNA. Similar to other miRNA genes, and unlike most ordinary genes, VGAM536 precursor RNA does not encode a protein. A nucleotide sequence identical or highly similar to the nucleotide sequence of VGAM536 precursor RNA is designated SEQ ID:522, and is provided hereinbelow with reference to the sequence listing part. Nucleotide sequence SEQ ID:522 is located at position 103974 relative to the genome of Ateline Herpesvirus 3.

VGAM536 precursor RNA folds onto itself, forming VGAM536 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM536 folded precursor RNA into VGAM536 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM536 RNA is designated SEQ ID:3247, and is provided hereinbelow with reference to the sequence listing part.

VGAM536 host target gene, herein designated VGAM HOST TARGET GENE, encodes a corresponding messenger RNA, VGAM536 host target RNA, herein designated VGAM HOST TARGET RNA. VGAM536 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM536 RNA, herein designated VGAM RNA, binds complementarily to one or more host target binding sites located in untranslated regions of VGAM536 host target RNA, herein designated VGAM HOST TARGET RNA. This complementary binding is due to the fact that the nucleotide sequence of VGAM536 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM536 RNA, herein designated VGAM RNA, may have a different number of host target binding sites in untranslated regions of a VGAM536 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM536 RNA, herein designated VGAM RNA, to host target binding sites on VGAM536 host target RNA, herein designated VGAM HOST TARGET RNA, such as BINDING SITE I, BINDING SITE II and BINDING SITE III, inhibits translation of VGAM536 host target RNA into VGAM536 host target protein, herein designated VGAM HOST TARGET PROTEIN. VGAM host target protein is therefore outlined by a broken line.

It is appreciated that VGAM536 host target gene, herein designated VGAM HOST TARGET GENE, in fact represents a plurality of VGAM536 host target genes. The mRNA of each one of this plurality of VGAM536 host target genes comprises one or more host target binding sites, each having a nucleotide sequence which is at least partly complementary to VGAM536 RNA, herein designated VGAM RNA, and which when bound by VGAM536 RNA causes inhibition of translation of respective one or more VGAM536 host target proteins.

It is further appreciated by one skilled in the art that the mode of translational inhibition illustrated by FIG. 1 with specific reference to translational inhibition exerted by VGAM536 gene, herein designated VGAM GENE, on one or more VGAM536 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM536 is inhibition of expression of host target genes, as part of a novel viral mechanism of attacking a host. Accordingly, utilities of VGAM536 include diagnosis, prevention and treatment of viral infection by Ateline Herpesvirus 3. Specific functions, and accordingly utilities, of VGAM536 correlate with, and may be deduced from, the identity of the host target genes which VGAM536 binds and inhibits, and the function of these host target genes, as elaborated hereinbelow.

Nucleotide sequences of the VGAM536 precursor RNA, herein designated VGAM PRECURSOR RNA, and of the 'diced' VGAM536 RNA, herein designated VGAM RNA, and a schematic representation of the secondary folding of VGAM536 folded precursor RNA, herein designated VGAM FOLDED PRECURSOR RNA, of VGAM536 are further described hereinbelow with reference to Table 1.

Nucleotide sequences of host target binding sites, such as BINDING SITE-I, BINDING SITE-II and BINDING SITE- III of FIG. 1, found on VGAM536 host target RNA, and schematic representation of the complementarity of each of these host target binding sites to VGAM536 RNA, herein designated VGAM RNA, are described hereinbelow with reference to Table 2.

As mentioned hereinabove with reference to FIG. 1, a function of VGAM536 gene, herein designated VGAM is inhibition of expression of VGAM536 target genes. It is appreciated that specific functions, and accordingly utilities, of VGAM536 correlate with, and may be deduced from, the identity of the target genes which VGAM536 binds and inhibits, and the function of these target genes, as elaborated hereinbelow.

V-akt Murine Thymoma Viral Oncogene Homolog 1 (AKT1, Accession NM_005163) is a VGAM536 host target gene. AKT1 BINDING SITE is HOST TARGET binding site found in the 3' untranslated region of mRNA encoded by AKT1, corresponding to a HOST TARGET binding site such as BINDING SITE I, BINDING SITE II or BINDING SITE III. Table 2 illustrates the complementarity of the nucleotide sequences of AKT1 BINDING SITE, designated SEQ ID:11649, to the nucleotide sequence of VGAM536 RNA, herein designated VGAM RNA, also designated SEQ ID:3247.

A function of VGAM536 is therefore inhibition of V-akt Murine Thymoma Viral Oncogene Homolog 1 (AKT1, Accession NM_005163), a gene which Serine-threonine protein kinase. Accordingly, utilities of VGAM536 include diagnosis, prevention and treatment of diseases and clinical conditions associated with AKT1. The function of AKT1 and its association with various diseases and clinical conditions, has been established by previous studies, as described hereinabove with reference to VGAM188. KIAA0534 (Accession XM_049349) is another VGAM536 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35376, to the nucleotide sequence of VGAM536 RNA, herein designated VGAM RNA, also designated SEQ ID:3247.

Another function of VGAM536 is therefore inhibition of KIAA0534 (Accession XM_049349). Accordingly, utilities of VGAM536 include diagnosis, prevention and treatment of diseases and clinical conditions associated with KIAA0534. FIG. 1 further provides a conceptual description of a novel bioinformatically detected viral gene of the present invention, referred to here as Viral Genomic Address Messenger 537 (VGAM537) viral gene, which modulates expression of respective host target genes thereof, the function and utility of which host target genes is known in the art.

VGAM537 is a novel bioinformatically detected regulatory, non protein coding, viral micro RNA (miRNA) gene. The method by which VGAM537 was detected is described hereinabove with reference to FIGS. 1-8.

VGAM537 gene, herein designated VGAM GENE, is a viral gene contained in the genome of Ateline Herpesvirus 3. VGAM537 host target gene, herein designated VGAM HOST TARGET GENE, is a human gene contained in the human genome.

VGAM537 gene encodes a VGAM537 precursor RNA, herein designated VGAM PRECURSOR RNA. Similar to other miRNA genes, and unlike most ordinary genes, VGAM537 precursor RNA does not encode a protein. A nucleotide sequence identical or highly similar to the nucleotide sequence of VGAM537 precursor RNA is designated SEQ ID:523, and is provided hereinbelow with reference to the sequence listing part. Nucleotide sequence SEQ ID:523 is located at position 103754 relative to the genome of Ateline Herpesvirus 3.

VGAM537 precursor RNA folds onto itself, forming VGAM537 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM537 folded precursor RNA into VGAM537 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM537 RNA is designated SEQ ID:3248, and is provided hereinbelow with reference to the sequence listing part.

VGAM537 host target gene, herein designated VGAM HOST TARGET GENE, encodes a corresponding messenger RNA, VGAM537 host target RNA, herein designated VGAM HOST TARGET RNA. VGAM537 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM537 RNA, herein designated VGAM RNA, binds complementarily to one or more host target binding sites located in untranslated regions of VGAM537 host target RNA, herein designated VGAM HOST TARGET RNA. This complementary binding is due to the fact that the nucleotide sequence of VGAM537 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM537 RNA, herein designated VGAM RNA, may have a different number of host target binding sites in untranslated regions of a VGAM537 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM537 RNA, herein designated VGAM RNA, to host target binding sites on VGAM537 host target RNA, herein designated VGAM HOST TARGET RNA, such as BINDING SITE I, BINDING SITE II and BINDING SITE III, inhibits translation of VGAM537 host target RNA into VGAM537 host target protein, herein designated VGAM HOST TARGET PROTEIN. VGAM host target protein is therefore outlined by a broken line.

It is appreciated that VGAM537 host target gene, herein designated VGAM HOST TARGET GENE, in fact represents a plurality of VGAM537 host target genes. The mRNA of each one of this plurality of VGAM537 host target genes comprises one or more host target binding sites, each having a nucleotide sequence which is at least partly complementary to VGAM537 RNA, herein designated VGAM RNA, and which when bound by VGAM537 RNA causes inhibition of translation of respective one or more VGAM537 host target proteins.

It is further appreciated by one skilled in the art that the mode of translational inhibition illustrated by FIG. 1 with specific reference to translational inhibition exerted by VGAM537 gene, herein designated VGAM GENE, on one or more VGAM537 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM537 is inhibition of expression of host target genes, as part of a novel viral mechanism of attacking a host. Accordingly, utilities of VGAM537 include diagnosis, prevention and treatment of viral infection by Ateline Herpesvirus 3. Specific functions, and accordingly utilities, of VGAM537 correlate with, and may be deduced from, the identity of the host target genes which VGAM537 binds and inhibits, and the function of these host target genes, as elaborated hereinbelow.

Nucleotide sequences of the VGAM537 precursor RNA, herein designated VGAM PRECURSOR RNA, and of the 'diced' VGAM537 RNA, herein designated VGAM RNA, and a schematic representation of the secondary folding of VGAM537 folded precursor RNA, herein designated VGAM FOLDED PRECURSOR RNA, of VGAM537 are further described hereinbelow with reference to Table 1.

Nucleotide sequences of host target binding sites, such as BINDING SITE-I, BINDING SITE-II and BINDING SITE-III of FIG. 1, found on VGAM537 host target RNA, and schematic representation of the complementarity of each of these host target binding sites to VGAM537 RNA, herein designated VGAM RNA, are described hereinbelow with reference to Table 2.

As mentioned hereinabove with reference to FIG. 1, a function of VGAM537 gene, herein designated VGAM is inhibition of expression of VGAM537 target genes. It is appreciated that specific functions, and accordingly utilities, of VGAM537 correlate with, and may be deduced from, the identity of the target genes which VGAM537 binds and inhibits, and the function of these target genes, as elaborated hereinbelow.

G Protein-coupled Receptor 18 (GPR18, Accession NM_005292) is a VGAM537 host target gene. GPR18 BINDING SITE is HOST TARGET binding site found in the 5' untranslated region of mRNA encoded by GPR18, corresponding to a HOST TARGET binding site such as BINDING SITE I, BINDING SITE II or BINDING SITE III. Table 2 illustrates the complementarity of the nucleotide sequences of GPR18 BINDING SITE, designated SEQ ID:11783, to the nucleotide sequence of VGAM537 RNA, herein designated VGAM RNA, also designated SEQ ID:3248.

A function of VGAM537 is therefore inhibition of G Protein-coupled Receptor 18 (GPR18, Accession NM_005292). Accordingly, utilities of VGAM537 include diagnosis, prevention and treatment of diseases and clinical conditions associated with GPR18. LOC148894 (Accession XM_097542) is another VGAM537 host target gene. LOC148894 BINDING SITE is HOST TARGET binding site found in the 3' untranslated region of mRNA encoded by LOC148894, corresponding to a HOST TARGET binding site such as BINDING SITE I, BINDING SITE II or BINDING SITE III. Table 2 illustrates the complementarity of the nucleotide sequences of LOC148894 BINDING SITE, designated SEQ ID:40914, to the nucleotide sequence of VGAM537 RNA, herein designated VGAM RNA, also designated SEQ ID:3248.

Another function of VGAM537 is therefore inhibition of LOC148894 (Accession XM_097542). Accordingly, utilities of VGAM537 include diagnosis, prevention and treatment of diseases and clinical conditions associated with LOC148894. FIG. 1 further provides a conceptual description of a novel bioinformatically detected viral gene of the present invention, referred to here as Viral Genomic Address Messenger 538 (VGAM538) viral gene, which modulates expression of respective host target genes thereof, the function and utility of which host target genes is known in the art.

VGAM538 is a novel bioinformatically detected regulatory, non protein coding, viral micro RNA (miRNA) gene. The method by which VGAM538 was detected is described hereinabove with reference to FIGS. 1-8.

VGAM538 gene, herein designated VGAM GENE, is a viral gene contained in the genome of Ateline Herpesvirus 3. VGAM538 host target gene, herein designated VGAM HOST TARGET GENE, is a human gene contained in the human genome.

VGAM538 gene encodes a VGAM538 precursor RNA, herein designated VGAM PRECURSOR RNA. Similar to other miRNA genes, and unlike most ordinary genes, VGAM538 precursor RNA does not encode a protein. A nucleotide sequence identical or highly similar to the nucleotide sequence of VGAM538 precursor RNA is designated SEQ ID:524, and is provided hereinbelow with reference to the sequence listing part. Nucleotide sequence SEQ ID:524 is located at position 65909 relative to the genome of Ateline Herpesvirus 3.

VGAM538 precursor RNA folds onto itself, forming VGAM538 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM538 folded precursor RNA into VGAM538 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM538 RNA is designated SEQ ID:3249, and is provided hereinbelow with reference to the sequence listing part.

VGAM538 host target gene, herein designated VGAM HOST TARGET GENE, encodes a corresponding messenger RNA, VGAM538 host target RNA, herein designated VGAM HOST TARGET RNA. VGAM538 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM538 RNA, herein designated VGAM RNA, binds complementarily to one or more host target binding sites located in untranslated regions of VGAM538 host target RNA, herein designated VGAM HOST TARGET RNA. This complementary binding is due to the fact that the nucleotide sequence of VGAM538 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM538 RNA, herein designated VGAM RNA, may have a different number of host target binding sites in untranslated regions of a VGAM538 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM538 RNA, herein designated VGAM RNA, to host target binding sites on VGAM538 host target RNA, herein designated VGAM HOST TARGET RNA, such as BINDING SITE I, BINDING SITE II and BINDING SITE III, inhibits translation of VGAM538 host target RNA into VGAM538 host target protein, herein designated VGAM HOST TARGET PROTEIN. VGAM host target protein is therefore outlined by a broken line.

It is appreciated that VGAM538 host target gene, herein designated VGAM HOST TARGET GENE, in fact represents a plurality of VGAM538 host target genes. The mRNA of each one of this plurality of VGAM538 host target genes comprises one or more host target binding sites, each having a nucleotide sequence which is at least partly complementary to VGAM538 RNA, herein designated VGAM RNA, and which when bound by VGAM538 RNA causes inhibition of translation of respective one or more VGAM538 host target proteins.

It is further appreciated by one skilled in the art that the mode of translational inhibition illustrated by FIG. 1 with specific reference to translational inhibition exerted by VGAM538 gene, herein designated VGAM GENE, on one or more VGAM538 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM538 is inhibition of expression of host target genes, as part of a novel viral mechanism of attacking a host. Accordingly, utilities of VGAM538 include diagnosis, prevention and treatment of viral infection by Ateline Herpesvirus 3. Specific functions, and accordingly utilities, of VGAM538 correlate with, and may be deduced from, the identity of the host target genes which VGAM538 binds and inhibits, and the function of these host target genes, as elaborated hereinbelow.

Nucleotide sequences of the VGAM538 precursor RNA, herein designated VGAM PRECURSOR RNA, and of the 'diced' VGAM538 RNA, herein designated VGAM RNA, and a schematic representation of the secondary folding of VGAM538 folded precursor RNA, herein designated VGAM FOLDED PRECURSOR RNA, of VGAM538 are further described hereinbelow with reference to Table 1.

Nucleotide sequences of host target binding sites, such as BINDING SITE-I, BINDING SITE-II and BINDING SITE-III of FIG. 1, found on VGAM538 host target RNA, and schematic representation of the complementarity of each of these host target binding sites to VGAM538 RNA, herein designated VGAM RNA, are described hereinbelow with reference to Table 2.

As mentioned hereinabove with reference to FIG. 1, a function of VGAM538 gene, herein designated VGAM is inhibition of expression of VGAM538 target genes. It is appreciated that specific functions, and accordingly utilities, of VGAM538 correlate with, and may be deduced from, the identity of the target genes which VGAM538 binds and inhibits, and the function of these target genes, as elaborated hereinbelow.

Annexin A8 (ANXA8, Accession NM_001630) is a VGAM538 host target gene. ANXA8 BINDING SITE is HOST TARGET binding site found in the 3' untranslated region of mRNA encoded by ANXA8, corresponding to a HOST TARGET binding site such as BINDING SITE I, BINDING SITE II or BINDING SITE III. Table 2 illustrates the complementarity of the nucleotide sequences of ANXA8 BINDING SITE, designated SEQ ID:7341, to the nucleotide sequence of VGAM538 RNA, herein designated VGAM RNA, also designated SEQ ID:3249.

A function of VGAM538 is therefore inhibition of Annexin A8 (ANXA8, Accession NM_001630), a gene which acts as an indirect inhibitor of the thromboplastin-specific complex, which is involved in the blood coagulation cascade. Accordingly, utilities of VGAM538 include diagnosis, prevention and treatment of diseases and clinical conditions associated with ANXA8. The function of ANXA8 and its association with various diseases and clinical conditions, has been established by previous studies, as described hereinabove with reference to VGAM372. CERD4 (Accession NM_012074) is another VGAM538 host target gene. CERD4 BINDING SITE is HOST TARGET binding site found in the 3' untranslated region of mRNA encoded by CERD4, corresponding to a HOST TARGET binding site such as BINDING SITE I, BINDING SITE II or BINDING SITE III. Table 2 illustrates the complementarity of the nucleotide sequences of CERD4 BINDING SITE, designated SEQ ID:14347, to the nucleotide sequence of VGAM538 RNA, herein designated VGAM RNA, also designated SEQ ID:3249.

Another function of VGAM538 is therefore inhibition of CERD4 (Accession NM_012074). Accordingly, utilities of VGAM538 include diagnosis, prevention and treatment of diseases and clinical conditions associated with CERD4. Collagen, Type IV, Alpha 3 (Goodpasture antigen) (COL4A3, Accession NM_031363) is another VGAM538 host target gene. COL4A3 BINDING SITE1 through COL4A3 BINDING SITE3 are HOST TARGET binding sites found in untranslated regions of mRNA encoded by COL4A3, corresponding to HOST TARGET binding sites such as BINDING SITE I, BINDING SITE II or BINDING SITE III. Table 2 illustrates the complementarity of the nucleotide sequences of COL4A3 BINDING SITE1 through COL4A3 BINDING SITE3, designated SEQ ID:25355, SEQ ID:25361 and SEQ ID:5548 respectively, to the nucleotide sequence of VGAM538 RNA, herein designated VGAM RNA, also designated SEQ ID:3249.

Another function of VGAM538 is therefore inhibition of Collagen, Type IV, Alpha 3 (Goodpasture antigen) (COL4A3, Accession NM_031363). Accordingly, utilities of VGAM538 include diagnosis, prevention and treatment of diseases and clinical conditions associated with COL4A3. Dual Specificity Phosphatase 5 (DUSP5, Accession NM_004419) is another VGAM538 host target gene. DUSP5 BINDING SITE is HOST TARGET binding site found in the 3' untranslated region of mRNA encoded by DUSP5, corresponding to a HOST TARGET binding site such as BINDING SITE I, BINDING SITE II or BINDING SITE III. Table 2 illustrates the complementarity of the nucleotide sequences of DUSP5 BINDING SITE, designated SEQ ID:10685, to the nucleotide sequence of VGAM538 RNA, herein designated VGAM RNA, also designated SEQ ID:3249.

Another function of VGAM538 is therefore inhibition of Dual Specificity Phosphatase 5 (DUSP5, Accession NM_004419), a gene which displays phosphatase activity toward several substrates. Accordingly, utilities of VGAM538 include diagnosis, prevention and treatment of diseases and clinical conditions associated with DUSP5. The function of DUSP5 has been established by previous studies. The VH1 phosphatase encoded by vaccinia virus is a dual-specificity protein-tyrosine phosphatase (OMIM Ref. No. PTPase) which hydrolyzes substrates phosphorylated on both tyrosine and serine/threonine residues. VH1-like PTPases have been identified in human S and other organisms. See DUSP1 (OMIM Ref. No. 600714). To identify additional human dual-specificity PTPases, Martell et al. (1994) screened a genomic library with a partial DUSP1 cDNA. They isolated several novel PTPase genes, including 1 which they designated HVH3 for human VH1-like PTPase-3. Kwak and Dixon (1995) cloned human placental HVH3 cDNAs and reported that the predicted protein has 384 amino acids. Using immunofluorescence, they determined that epitope-tagged HVH3 is localized primarily in the nucleus of mammalian cells. Ishibashi et al. (1994) isolated HVH3 cDNAs from a human mammary epithelial cell cDNA library and found that the predicted protein has 397 amino acids. In vitro, recombinant protein containing the catalytic domain of HVH3 displayed phosphatase activity toward several substrates. The highest relative activity was toward ERK1 (OMIM Ref. No. 601795), suggesting that it may be a target for HVH3 activity in vivo. Northern blot analysis revealed that HVH3 is expressed as a 2.5-kb mRNA in a variety of tissues, with the highest levels in pancreas and brain. HVH3 expression was induced by serum stimulation of fibroblasts and by heat shock, with similar kinetics to those observed with DUSP1. As has been proposed for other dual-specificity PTPases like DUSP1 and DUSP2 (OMIM Ref. No. 603068), Ishibashi et al. (1994) suggested that the induction of HVH3 may lead to the deactivation of mitogen- or stress-activated protein kinases, thereby restoring these signaling pathways to their mitogen- or stress-sensitive state. By fluorescence in situ hybridization, Martell et al. (1994) mapped the HVH3 gene to 10q25

Full details of the abovementioned studies are described in the following publications, the disclosure of which are hereby incorporated by reference:

Ishibashi, T.; Bottaro, D. P.; Michieli, P.; Kelley, C. A.; Aaronson, S. A.: A novel dual specificity phosphatase induced by serum stimulation and heat shock. J. Biol. Chem. 269:29897-29902, 1994; and Martell, K. J.; Kwak, S.; Hakes, D. J.; Dixon, J. E.; Trent, J. M.: Chromosomal localization of four human VH1-like protein-tyrosine phosphatases. Genomics 22:462-464, 1994.

Further studies establishing the function and utilities of DUSP5 are found in John Hopkins OMIM database record ID 603069, and in sited publications numbered 8850-885 and 10055 listed in the bibliography section hereinbelow, which are also hereby incorporated by reference. Eukaryotic Translation Initiation Factor 1A, Y Chromosome (EIF1AY, Accession NM_004681) is another VGAM538 host target gene. EIF1AY BINDING SITE is HOST TARGET binding site found in the 3' untranslated region of mRNA encoded by EIF1AY, corresponding to a HOST TARGET binding site such as BINDING SITE I, BINDING SITE II or BINDING SITE III. Table 2 illustrates the complementarity of the nucleotide sequences of EIF1AY BINDING SITE, designated SEQ ID:11045, to the nucleotide sequence of VGAM538 RNA, herein designated VGAM RNA, also designated SEQ ID:3249.

Another function of VGAM538 is therefore inhibition of Eukaryotic Translation Initiation Factor 1A, Y Chromosome (EIF1AY, Accession NM_004681). Accordingly, utilities of VGAM538 include diagnosis, prevention and treatment of diseases and clinical conditions associated with EIF1AY. Echinoderm Microtubule Associated Protein Like 1 (EML1, Accession XM_007243) is another VGAM538 host target gene. EML1 BINDING SITE is HOST TARGET binding site found in the 3' untranslated region of mRNA encoded by EML1, corresponding to a HOST TARGET binding site such as BINDING SITE I, BINDING SITE II or BINDING SITE III. Table 2 illustrates the complementarity of the nucleotide sequences of EML1 BINDING SITE, designated SEQ ID:30037, to the nucleotide sequence of VGAM538 RNA, herein designated VGAM RNA, also designated SEQ ID:3249.

Another function of VGAM538 is therefore inhibition of Echinoderm Microtubule Associated Protein Like 1 (EML1, Accession XM_007243). Accordingly, utilities of VGAM538 include diagnosis, prevention and treatment of diseases and clinical conditions associated with EML1. Fibroblast Growth Factor Receptor 1 (fms-related tyrosine kinase 2, Pfeiffer syndrome) (FGFR1, Accession NM_000604) is another VGAM538 host target gene. FGFR1 BINDING SITE1 through FGFR1 BINDING SITE3 are HOST TARGET binding sites found in untranslated regions of mRNA encoded by FGFR1, corresponding to HOST TARGET binding sites such as BINDING SITE I, BINDING SITE II or BINDING SITE III. Table 2 illustrates the complementarity of the nucleotide sequences of FGFR1 BINDING SITE1 through FGFR1 BINDING SITE3, designated SEQ ID:6209, SEQ ID:23374 and SEQ ID:17980 respectively, to the nucleotide sequence of VGAM538 RNA, herein designated VGAM RNA, also designated SEQ ID:3249.

Another function of VGAM538 is therefore inhibition of Fibroblast Growth Factor Receptor 1 (fms-related tyrosine kinase 2, Pfeiffer syndrome) (FGFR1, Accession NM_000604). Accordingly, utilities of VGAM538 include diagnosis, prevention and treatment of diseases and clinical conditions associated with FGFR1. Histone Deacetylase 4 (HDAC4, Accession NM_006037) is another VGAM538 host target gene. HDAC4 BINDING SITE is HOST TARGET binding site found in the 3' untranslated region of mRNA encoded by HDAC4, corresponding to a HOST TARGET binding site such as BINDING SITE I, BINDING SITE II or BINDING SITE III. Table 2 illustrates the complementarity of the nucleotide sequences of HDAC4 BINDING SITE, designated SEQ ID:12667, to the nucleotide sequence of VGAM538 RNA, herein designated VGAM RNA, also designated SEQ ID:3249.

Another function of VGAM538 is therefore inhibition of Histone Deacetylase 4 (HDAC4, Accession NM_006037), a gene which is responsible for the deacetylation of lysine residues on the n-terminal part of the core histones and may mediate transcriptional regulation. Accordingly, utilities of VGAM538 include diagnosis, prevention and treatment of diseases and clinical conditions associated with HDAC4. The function of HDAC4 and its association with various diseases and clinical conditions, has been established by previous studies, as described hereinabove with reference to VGAM264. Itchy Homolog E3 Ubiquitin Protein Ligase (mouse) (ITCH, Accession NM_031483) is another VGAM538 host target gene. ITCH BINDING SITE is HOST TARGET binding site found in the 3' untranslated region of mRNA encoded by ITCH, corresponding to a HOST TARGET binding site such as BINDING SITE I, BINDING SITE II or BINDING SITE III. Table 2 illustrates the complementarity of the nucleotide sequences of ITCH BINDING SITE, designated SEQ ID:25563, to the nucleotide sequence of VGAM538 RNA, herein designated VGAM RNA, also designated SEQ ID:3249.

Another function of VGAM538 is therefore inhibition of Itchy Homolog E3 Ubiquitin Protein Ligase (mouse) (ITCH, Accession NM_031483), a gene which accepts ubiquitin from an e2 ubiquitin-conjugating enzyme in the form of a thioester and then directly transfers the ubiquitin to targeted substrates. Accordingly, utilities of VGAM538 include diagnosis, prevention and treatment of diseases and clinical conditions associated with ITCH. The function of ITCH and its association with various diseases and clinical conditions, has been established by previous studies, as described hereinabove with reference to VGAM206. Lipase A, Lysosomal Acid, Cholesterol Esterase (Wolman disease) (LIPA, Accession NM_000235) is another VGAM538 host target gene. LIPA BINDING SITE is HOST TARGET binding site found in the 3' untranslated region of mRNA encoded by LIPA, corresponding to a HOST TARGET binding site such as BINDING SITE I, BINDING SITE II or BINDING SITE III. Table 2 illustrates the complementarity of the nucleotide sequences of LIPA BINDING SITE, designated SEQ ID:5746, to the nucleotide sequence of VGAM538 RNA, herein designated VGAM RNA, also designated SEQ ID:3249.

Another function of VGAM538 is therefore inhibition of Lipase A, Lysosomal Acid, Cholesterol Esterase (Wolman disease) (LIPA, Accession NM_000235). Accordingly, utilities of VGAM538 include diagnosis, prevention and treatment of diseases and clinical conditions associated with LIPA. Neuroblastoma RAS Viral (v-ras) Oncogene Homolog (NRAS, Accession NM_002524) is another VGAM538 host target gene. NRAS BINDING SITE is HOST TARGET binding site found in the 3' untranslated region of mRNA encoded by NRAS, corresponding to a HOST TARGET binding site such as BINDING SITE I, BINDING SITE II or BINDING SITE III. Table 2 illustrates the complementarity of the nucleotide sequences of NRAS BINDING SITE, designated SEQ ID:8362, to the nucleotide sequence of VGAM538 RNA, herein designated VGAM RNA, also designated SEQ ID:3249.

Another function of VGAM538 is therefore inhibition of Neuroblastoma RAS Viral (v-ras) Oncogene Homolog (NRAS, Accession NM_002524), a gene which ras proteins bind gdp/gtp and possess intrinsic gtpase activity. Accordingly, utilities of VGAM538 include diagnosis, prevention and treatment of diseases and clinical conditions associated with NRAS. The function of NRAS and its association with various diseases and clinical conditions, has been established by previous studies, as described hereinabove with reference to VGAM351. Oxidative-stress Responsive 1 (OSR1, Accession NM_005109) is another VGAM538 host target gene. OSR1 BINDING SITE is HOST TARGET binding site found in the 3' untranslated region of mRNA encoded by OSR1, corresponding to a HOST TARGET binding site such as BINDING SITE I, BINDING SITE II or BINDING SITE III. Table 2 illustrates the complementarity of the nucleotide sequences of OSR1 BINDING SITE, designated SEQ ID:11591, to the nucleotide sequence of VGAM538 RNA, herein designated VGAM RNA, also designated SEQ ID:3249.

Another function of VGAM538 is therefore inhibition of Oxidative-stress Responsive 1 (OSR1, Accession NM_005109), a gene which mediats stress-activated signals. Accordingly, utilities of VGAM538 include diagnosis, prevention and treatment of diseases and clinical conditions associated with OSR1. The function of OSR1 has been established by previous studies. The 3p22-p21.3 chromosomal region is one of 3 regions of 3p that is commonly deleted in various carcinomas. By analyzing a cloned segment from this region, Tamari et al. (1999) identified a novel gene that they designated OSR1 (oxidative stress-responsive-1) because the predicted 527-amino acid protein shares 39% identity with Ste20/oxidant stress-response kinase-1 (OMIM Ref. No. 602255). The OSR1 gene contains 18 exons and spans approximately 90 kb. Northern blot analysis revealed that OSR1 was expressed as a 4.6-kb major transcript in all tissues tested. A less abundant 7.5-kb mRNA was detected in heart and skeletal muscle. Daigo et al. (1999) reported that the OSR1 gene is located between the OCTL1 (OMIM Ref. No. 604047) and MYD88 (OMIM Ref. No. 602170) genes on 3p22-p21.3.

Full details of the abovementioned studies are described in the following publications, the disclosure of which are hereby incorporated by reference:

Tamari, M.; Daigo, Y.; Nakamura, Y.: Isolation and characterization of a novel serine threonine kinase gene on chromosome 3q22-21.3. J. Hum. Genet. 44:116-120,1999; and Daigo, Y.; Isomura, M.; Nishiwaki, T.; Tamari, M.; Ishikawa, S.; Kai, M.; Murata, Y.; Takeuchi, K.; Yamane, Y.; Hayashi, R.; Minami, M.; Fujino, M. A.; Hojo, Y.; Uchiyama, I.; Takagi, T.

Further studies establishing the function and utilities of OSR1 are found in John Hopkins OMIM database record ID 604046, and in sited publications numbered 9037 listed in the bibliography section hereinbelow, which are also hereby incorporated by reference. Plexin A2 (PLXNA2, Accession NM_025179) is another VGAM538 host target gene. PLXNA2 BINDING SITE is HOST TARGET binding site found in the 3' untranslated region of mRNA encoded by PLXNA2, corresponding to a HOST TARGET binding site such as BINDING SITE I, BINDING SITE II or BINDING SITE III. Table 2 illustrates the complementarity of the nucleotide sequences of PLXNA2 BINDING SITE, designated SEQ ID:24814, to the nucleotide sequence of VGAM538 RNA, herein designated VGAM RNA, also designated SEQ ID:3249.

Another function of VGAM538 is therefore inhibition of Plexin A2 (PLXNA2, Accession NM_025179), a gene which is a transmembrane protein. Accordingly, utilities of VGAM538 include diagnosis, prevention and treatment of diseases and clinical conditions associated with PLXNA2. The function of PLXNA2 has been established by previous studies. In the course of searching for previously unknown genes on the human X chromosome, Maestrini et al. (1996) identified a cDNA in Xq28 encoding a transmembrane protein that they termed SEX (OMIM Ref. No. 300022). They showed that SEX shares significant homology with the extracellular domain of the receptors encoded by MET and other members of the hepatocyte growth factor (HGF) receptor family. Three other sequences closely related to SEX were identified, 1 of which (designated OCT) was shown by analysis of a panel of human/hamster somatic cell hybrids to map to chromosome 1. The proteins encoded by all 4 genes contained large cytoplasmic domains characterized by a distinctive highly conserved sequence they called the SEX domain. See also 601053 and 601055. Nomenclature: Tamagnone et al. (1999) proposed a novel nomenclature for the genes of the plexin family, which they grouped into the A, B, C, and D subfamilies; the PLXN2 gene was renamed plexin A2 by them.

Full details of the abovementioned studies are described in the following publications, the disclosure of which are hereby incorporated by reference:

Maestrini, E.; Tamagnone, L.; Longati, P.; Cremona, O.; Gulisano, M.; Bione, S.; Tamanini, F.; Neel, B. G.; Toniolo, D.; Comoglio, P. M.: A family of transmembrane proteins with homology to the MET-hepatocyte growth factor receptor. Proc. Nat. Acad. Sci. 93:674-678, 1996; and Tamagnone, L.; Artigiani, S.; Chen, H.; He, Z.; Ming, G.; Song, H.; Chedotal, A.; Winberg, M. L.; Goodman, C. S.; Poo, M.; Tessier-Lavigne, M.; Comoglio, P. M.: Plexins are a large family.

Further studies establishing the function and utilities of PLXNA2 are found in John Hopkins OMIM database record ID 601054, and in sited publications numbered 7271-7272 listed in the bibliography section hereinbelow, which are also hereby incorporated by reference. Solute Carrier Family 22 (organic cation transporter), Member 5 (SLC22A5, Accession NM_003060) is another VGAM538 host target gene. SLC22A5 BINDING SITE is HOST TARGET binding site found in the 3' untranslated region of mRNA encoded by SLC22A5, corresponding to a HOST TARGET binding site such as BINDING SITE I, BINDING SITE II or BINDING SITE III. Table 2 illustrates the complementarity of the nucleotide sequences of SLC22A5 BINDING SITE, designated SEQ ID:9027, to the nucleotide sequence of VGAM538 RNA, herein designated VGAM RNA, also designated SEQ ID:3249.

Another function of VGAM538 is therefore inhibition of Solute Carrier Family 22 (organic cation transporter), Member 5 (SLC22A5, Accession NM_003060). Accordingly, utilities of VGAM538 include diagnosis, prevention and treatment of diseases and clinical conditions associated with SLC22A5. Transforming Growth Factor, Beta Receptor II (70/80 kDa) (TGFBR2, Accession NM_003242) is another VGAM538 host target gene. TGFBR2 BINDING SITE is HOST TARGET binding site found in the 3' untranslated region of mRNA encoded by TGFBR2, corresponding to a HOST TARGET binding site such as BINDING SITE I, BINDING SITE II or BINDING SITE III. Table 2 illustrates the complementarity of the nucleotide sequences of TGFBR2 BINDING SITE, designated SEQ ID:9240, to the nucleotide sequence of VGAM538 RNA, herein designated VGAM RNA, also designated SEQ ID:3249.

Another function of VGAM538 is therefore inhibition of Transforming Growth Factor, Beta Receptor II (70/80 kDa) (TGFBR2, Accession NM_003242). Accordingly, utilities of VGAM538 include diagnosis, prevention and treatment of diseases and clinical conditions associated with TGFBR2. Titin (TTN, Accession NM_133378) is another VGAM538 host target gene. TTN BINDING SITE1 through TTN BINDING SITE4 are HOST TARGET binding sites found in untranslated regions of mRNA encoded by TTN, corresponding to HOST TARGET binding sites such as BINDING SITE I, BINDING SITE II or BINDING SITE III. Table 2 illustrates the complementarity of the nucleotide sequences of TTN BINDING SITE1 through TTN BINDING SITE4, designated SEQ ID:28503, SEQ ID:28505, SEQ ID:28508 and SEQ ID:28518 respectively, to the nucleotide sequence of VGAM538 RNA, herein designated VGAM RNA, also designated SEQ ID:3249.

Another function of VGAM538 is therefore inhibition of Titin (TTN, Accession NM_133378). Accordingly, utilities of VGAM538 include diagnosis, prevention and treatment of diseases and clinical conditions associated with TTN. Cysteine and Histidine-rich Domain (CHORD)-containing, Zinc Binding Protein 1 (CHORDC1, Accession NM_012124) is another VGAM538 host target gene. CHORDC1 BINDING SITE is HOST TARGET binding site found in the 3' untranslated region of mRNA encoded by CHORDC1, corresponding to a HOST TARGET binding site such as BINDING SITE I, BINDING SITE II or BINDING SITE III. Table 2 illustrates the complementarity of the nucleotide sequences of CHORDC1 BINDING SITE, designated SEQ ID:14437, to the nucleotide sequence of VGAM538 RNA, herein designated VGAM RNA, also designated SEQ ID:3249.

Another function of VGAM538 is therefore inhibition of Cysteine and Histidine-rich Domain (CHORD)-containing, Zinc Binding Protein 1 (CHORDC1, Accession NM_012124). Accordingly, utilities of VGAM538 include diagnosis, prevention and treatment of diseases and clinical conditions associated with CHORDC1. DKFZP434C0826 (Accession XM_097248) is another VGAM538 host target gene. DKFZP434C0826 BINDING SITE is HOST TARGET binding site found in the 5' untranslated region of mRNA encoded by DKFZP434C0826, corresponding to a HOST TARGET binding site such as BINDING SITE I, BINDING SITE II or BINDING SITE III. Table 2 illustrates the complementarity of the nucleotide sequences of DKFZP434C0826 BINDING SITE, designated SEQ ID:40845, to the nucleotide sequence of VGAM538 RNA, herein designated VGAM RNA, also designated SEQ ID:3249.

Another function of VGAM538 is therefore inhibition of DKFZP434C0826 (Accession XM_097248). Accordingly, utilities of VGAM538 include diagnosis, prevention and treatment of diseases and clinical conditions associated with DKFZP434C0826. DKFZp566H0824 (Accession NM_017535) is another VGAM538 host target gene. DKFZp566H0824 BINDING SITE is HOST TARGET binding site found in the 5' untranslated region of mRNA encoded by DKFZp566H0824, corresponding to a HOST TARGET binding site such as BINDING SITE I, BINDING SITE II or BINDING SITE III. Table 2 illustrates the complementarity of the nucleotide sequences of DKFZp566H0824 BINDING SITE, designated SEQ ID:18977, to the nucleotide sequence of VGAM538 RNA, herein designated VGAM RNA, also designated SEQ ID:3249.

Another function of VGAM538 is therefore inhibition of DKFZp566H0824 (Accession NM_017535). Accordingly, utilities of VGAM538 include diagnosis, prevention and treatment of diseases and clinical conditions associated with DKFZp566H0824. DnaJ (Hsp40) Homolog, Subfamily B, Member 4 (DNAJB4, Accession NM_007034) is another VGAM538 host target gene. DNAJB4 BINDING SITE is HOST TARGET binding site found in the 5' untranslated region of mRNA encoded by DNAJB4, corresponding to a HOST TARGET binding site such as BINDING SITE I, BINDING SITE II or BINDING SITE III. Table 2 illustrates the complementarity of the nucleotide sequences of DNAJB4

BINDING SITE, designated SEQ ID:13904, to the nucleotide sequence of VGAM538 RNA, herein designated VGAM RNA, also designated SEQ ID:3249.

Another function of VGAM538 is therefore inhibition of DnaJ (Hsp40) Homolog, Subfamily B, Member 4 (DNAJB4, Accession NM_007034). Accordingly, utilities of VGAM538 include diagnosis, prevention and treatment of diseases and clinical conditions associated with DNAJB4.

FLJ00026 (Accession XM_036307) is another VGAM538 host target gene. FLJ00026 BINDING SITE is HOST TARGET binding site found in the 3' untranslated region of mRNA encoded by FLJ00026, corresponding to a HOST TARGET binding site such as BINDING SITE I, BINDING SITE II or BINDING SITE III. Table 2 illustrates the complementarity of the nucleotide sequences of FLJ00026 BINDING SITE, designated SEQ ID:32428, to the nucleotide sequence of VGAM538 RNA, herein designated VGAM RNA, also designated SEQ ID:3249.

Another function of VGAM538 is therefore inhibition of FLJ00026 (Accession XM_036307). Accordingly, utilities of VGAM538 include diagnosis, prevention and treatment of diseases and clinical conditions associated with FLJ00026.

FLJ10081 (Accession NM_017991) is another VGAM538 host target gene. FLJ10081 BINDING SITE is HOST TARGET binding site found in the 3' untranslated region of mRNA encoded by FLJ10081, corresponding to a HOST TARGET binding site such as BINDING SITE I, BINDING SITE II or BINDING SITE III. Table 2 illustrates the complementarity of the nucleotide sequences of FLJ10081 BINDING SITE, designated SEQ ID:19724, to the nucleotide sequence of VGAM538 RNA, herein designated VGAM RNA, also designated SEQ ID:3249.

Another function of VGAM538 is therefore inhibition of FLJ10081 (Accession NM_017991). Accordingly, utilities of VGAM538 include diagnosis, prevention and treatment of diseases and clinical conditions associated with FLJ10081.

FLJ10702 (Accession NM_018184) is another VGAM538 host target gene. FLJ10702 BINDING SITE is HOST TARGET binding site found in the 3' untranslated region of mRNA encoded by FLJ10702, corresponding to a HOST TARGET binding site such as BINDING SITE I, BINDING SITE II or BINDING SITE III. Table 2 illustrates the complementarity of the nucleotide sequences of FLJ10702 BINDING SITE, designated SEQ ID:20027, to the nucleotide sequence of VGAM538 RNA, herein designated VGAM RNA, also designated SEQ ID:3249.

Another function of VGAM538 is therefore inhibition of FLJ10702 (Accession NM_018184). Accordingly, utilities of VGAM538 include diagnosis, prevention and treatment of diseases and clinical conditions associated with FLJ10702.

FLJ11850 (Accession NM_022741) is another VGAM538 host target gene. FLJ11850 BINDING SITE is HOST TARGET binding site found in the 3' untranslated region of mRNA encoded by FLJ11850, corresponding to a HOST TARGET binding site such as BINDING SITE I, BINDING SITE II or BINDING SITE III. Table 2 illustrates the complementarity of the nucleotide sequences of FLJ11850 BINDING SITE, designated SEQ ID:22950, to the nucleotide sequence of VGAM538 RNA, herein designated VGAM RNA, also designated SEQ ID:3249.

Another function of VGAM538 is therefore inhibition of FLJ11850 (Accession NM_022741). Accordingly, utilities of VGAM538 include diagnosis, prevention and treatment of diseases and clinical conditions associated with FLJ11850.

FLJ13187 (Accession NM_024613) is another VGAM538 host target gene. FLJ13187 BINDING SITE is HOST TARGET binding site found in the 3' untranslated region of mRNA encoded by FLJ13187, corresponding to a HOST TARGET binding site such as BINDING SITE I, BINDING SITE II or BINDING SITE III. Table 2 illustrates the complementarity of the nucleotide sequences of FLJ13187 BINDING SITE, designated SEQ ID:23870, to the nucleotide sequence of VGAM538 RNA, herein designated VGAM RNA, also designated SEQ ID:3249.

Another function of VGAM538 is therefore inhibition of FLJ13187 (Accession NM_024613). Accordingly, utilities of VGAM538 include diagnosis, prevention and treatment of diseases and clinical conditions associated with FLJ13187.

FLJ20232 (Accession NM_019008) is another VGAM538 host target gene. FLJ20232 BINDING SITE is HOST TARGET binding site found in the 3' untranslated region of mRNA encoded by FLJ20232, corresponding to a HOST TARGET binding site such as BINDING SITE I, BINDING SITE II or BINDING SITE III. Table 2 illustrates the complementarity of the nucleotide sequences of FLJ20232 BINDING SITE, designated SEQ ID:21083, to the nucleotide sequence of VGAM538 RNA, herein designated VGAM RNA, also designated SEQ ID:3249.

Another function of VGAM538 is therefore inhibition of FLJ20232 (Accession NM_019008). Accordingly, utilities of VGAM538 include diagnosis, prevention and treatment of diseases and clinical conditions associated with FLJ20232.

KIAA0229 (Accession XM_166478) is another VGAM538 host target gene. KIAA0229 BINDING SITE is HOST TARGET binding site found in the 3' untranslated region of mRNA encoded by KIAA0229, corresponding to a HOST TARGET binding site such as BINDING SITE I, BINDING SITE II or BINDING SITE III. Table 2 illustrates the complementarity of the nucleotide sequences of KIAA0229 BINDING SITE, designated SEQ ID:44399, to the nucleotide sequence of VGAM538 RNA, herein designated VGAM RNA, also designated SEQ ID:3249.

Another function of VGAM538 is therefore inhibition of KIAA0229 (Accession XM_166478). Accordingly, utilities of VGAM538 include diagnosis, prevention and treatment of diseases and clinical conditions associated with KIAA0229.

KIAA0258 (Accession NM_014785) is another VGAM538 host target gene. KIAA0258 BINDING SITE is HOST TARGET binding site found in the 3' untranslated region of mRNA encoded by KIAA0258, corresponding to a HOST TARGET binding site such as BINDING SITE I, BINDING SITE II or BINDING SITE III. Table 2 illustrates the complementarity of the nucleotide sequences of KIAA0258 BINDING SITE, designated SEQ ID:16652, to the nucleotide sequence of VGAM538 RNA, herein designated VGAM RNA, also designated SEQ ID:3249.

Another function of VGAM538 is therefore inhibition of KIAA0258 (Accession NM_014785). Accordingly, utilities of VGAM538 include diagnosis, prevention and treatment of diseases and clinical conditions associated with KIAA0258.

KIAA0276 (Accession XM_048199) is another VGAM538 host target gene. KIAA0276 BINDING SITE is HOST TARGET binding site found in the 3' untranslated region of mRNA encoded by KIAA0276, corresponding to a HOST TARGET binding site such as BINDING SITE I, BINDING SITE II or BINDING SITE III. Table 2 illustrates the complementarity of the nucleotide sequences of KIAA0276 BINDING SITE, designated SEQ ID:35137, to the nucleotide sequence of VGAM538 RNA, herein designated VGAM RNA, also designated SEQ ID:3249.

Another function of VGAM538 is therefore inhibition of KIAA0276 (Accession XM_048199). Accordingly, utilities of VGAM538 include diagnosis, prevention and treatment of diseases and clinical conditions associated with KIAA0276.

KIAA0322 (Accession XM_166591) is another VGAM538 host target gene. KIAA0322 BINDING SITE is HOST TARGET binding site found in the 3' untranslated region of mRNA encoded by KIAA0322, corresponding to a HOST TARGET binding site such as BINDING SITE I, BINDING SITE II or BINDING SITE III. Table 2 illustrates the complementarity of the nucleotide sequences of KIAA0322 BINDING SITE, designated SEQ ID:44560, to the nucleotide sequence of VGAM538 RNA, herein designated VGAM RNA, also designated SEQ ID:3249.

Another function of VGAM538 is therefore inhibition of KIAA0322 (Accession XM_166591). Accordingly, utilities of VGAM538 include diagnosis, prevention and treatment of diseases and clinical conditions associated with KIAA0322. KIAA0515 (Accession XM_033380) is another VGAM538 host target gene. KIAA0515 BINDING SITE is HOST TARGET binding site found in the 3' untranslated region of mRNA encoded by KIAA0515, corresponding to a HOST TARGET binding site such as BINDING SITE I, BINDING SITE II or BINDING SITE III. Table 2 illustrates the complementarity of the nucleotide sequences of KIAA0515 BINDING SITE, designated SEQ ID:31924, to the nucleotide sequence of VGAM538 RNA, herein designated VGAM RNA, also designated SEQ ID:3249.

Another function of VGAM538 is therefore inhibition of KIAA0515 (Accession XM_033380). Accordingly, utilities of VGAM538 include diagnosis, prevention and treatment of diseases and clinical conditions associated with KIAA0515. KIAA0660 (Accession NM_012297) is another VGAM538 host target gene. KIAA0660 BINDING SITE is HOST TARGET binding site found in the 3' untranslated region of mRNA encoded by KIAA0660, corresponding to a HOST TARGET binding site such as BINDING SITE I, BINDING SITE II or BINDING SITE III. Table 2 illustrates the complementarity of the nucleotide sequences of KIAA0660 BINDING SITE, designated SEQ ID:14657, to the nucleotide sequence of VGAM538 RNA, herein designated VGAM RNA, also designated SEQ ID:3249.

Another function of VGAM538 is therefore inhibition of KIAA0660 (Accession NM_012297). Accordingly, utilities of VGAM538 include diagnosis, prevention and treatment of diseases and clinical conditions associated with KIAA0660. KIAA0876 (Accession XM_035625) is another VGAM538 host target gene. KIAA0876 BINDING SITE is HOST TARGET binding site found in the 3' untranslated region of mRNA encoded by KIAA0876, corresponding to a HOST TARGET binding site such as BINDING SITE I, BINDING SITE II or BINDING SITE III. Table 2 illustrates the complementarity of the nucleotide sequences of KIAA0876 BINDING SITE, designated SEQ ID:32298, to the nucleotide sequence of VGAM538 RNA, herein designated VGAM RNA, also designated SEQ ID:3249.

Another function of VGAM538 is therefore inhibition of KIAA0876 (Accession XM_035625). Accordingly, utilities of VGAM538 include diagnosis, prevention and treatment of diseases and clinical conditions associated with KIAA0876. KIAA0993 (Accession XM_034413) is another VGAM538 host target gene. KIAA0993 BINDING SITE is HOST TARGET binding site found in the 3' untranslated region of mRNA encoded by KIAA0993, corresponding to a HOST TARGET binding site such as BINDING SITE I, BINDING SITE II or BINDING SITE III. Table 2 illustrates the complementarity of the nucleotide sequences of KIAA0993 BINDING SITE, designated SEQ ID:32081, to the nucleotide sequence of VGAM538 RNA, herein designated VGAM RNA, also designated SEQ ID:3249.

Another function of VGAM538 is therefore inhibition of KIAA0993 (Accession XM_034413). Accordingly, utilities of VGAM538 include diagnosis, prevention and treatment of diseases and clinical conditions associated with KIAA0993. KIAA1023 (Accession NM_017604) is another VGAM538 host target gene. KIAA1023 BINDING SITE is HOST TARGET binding site found in the 3' untranslated region of mRNA encoded by KIAA1023, corresponding to a HOST TARGET binding site such as BINDING SITE I, BINDING SITE II or BINDING SITE III. Table 2 illustrates the complementarity of the nucleotide sequences of KIAA1023 BINDING SITE, designated SEQ ID:19092, to the nucleotide sequence of VGAM538 RNA, herein designated VGAM RNA, also designated SEQ ID:3249.

Another function of VGAM538 is therefore inhibition of KIAA1023 (Accession NM_017604). Accordingly, utilities of VGAM538 include diagnosis, prevention and treatment of diseases and clinical conditions associated with KIAA1023. KIAA1265 (Accession XM_047707) is another VGAM538 host target gene. KIAA1265 BINDING SITE is HOST TARGET binding site found in the 3' untranslated region of mRNA encoded by KIAA1265, corresponding to a HOST TARGET binding site such as BINDING SITE I, BINDING SITE II or BINDING SITE III. Table 2 illustrates the complementarity of the nucleotide sequences of KIAA1265 BINDING SITE, designated SEQ ID:35036, to the nucleotide sequence of VGAM538 RNA, herein designated VGAM RNA, also designated SEQ ID:3249.

Another function of VGAM538 is therefore inhibition of KIAA1265 (Accession XM_047707). Accordingly, utilities of VGAM538 include diagnosis, prevention and treatment of diseases and clinical conditions associated with KIAA1265. KIAA1493 (Accession XM_034415) is another VGAM538 host target gene. KIAA1493 BINDING SITE is HOST TARGET binding site found in the 3' untranslated region of mRNA encoded by KIAA1493, corresponding to a HOST TARGET binding site such as BINDING SITE I, BINDING SITE II or BINDING SITE III. Table 2 illustrates the complementarity of the nucleotide sequences of KIAA1493 BINDING SITE, designated SEQ ID:32091, to the nucleotide sequence of VGAM538 RNA, herein designated VGAM RNA, also designated SEQ ID:3249.

Another function of VGAM538 is therefore inhibition of KIAA1493 (Accession XM_034415). Accordingly, utilities of VGAM538 include diagnosis, prevention and treatment of diseases and clinical conditions associated with KIAA1493. KIAA1804 (Accession XM_045864) is another VGAM538 host target gene. KIAA1804 BINDING SITE is HOST TARGET binding site found in the 3' untranslated region of mRNA encoded by KIAA1804, corresponding to a HOST TARGET binding site such as BINDING SITE I, BINDING SITE II or BINDING SITE III. Table 2 illustrates the complementarity of the nucleotide sequences of KIAA1804 BINDING SITE, designated SEQ ID:34587, to the nucleotide sequence of VGAM538 RNA, herein designated VGAM RNA, also designated SEQ ID:3249.

Another function of VGAM538 is therefore inhibition of KIAA1804 (Accession XM_045864). Accordingly, utilities of VGAM538 include diagnosis, prevention and treatment of diseases and clinical conditions associated with KIAA1804. MGC2452 (Accession NM_032644) is another VGAM538 host target gene. MGC2452 BINDING SITE is HOST TARGET binding site found in the 5' untranslated region of mRNA encoded by MGC2452, corresponding to a HOST TARGET binding site such as BINDING SITE I, BINDING SITE II or BINDING SITE III. Table 2 illustrates the complementarity of the nucleotide sequences of MGC2452 BIND- ING SITE, designated SEQ ID:26372, to the nucleotide sequence of VGAM538 RNA, herein designated VGAM RNA, also designated SEQ ID:3249.

Another function of VGAM538 is therefore inhibition of MGC2452 (Accession NM_032644). Accordingly, utilities of VGAM538 include diagnosis, prevention and treatment of diseases and clinical conditions associated with MGC2452. MGC2477 (Accession NM_024099) is another VGAM538 host target gene. MGC2477 BINDING SITE is HOST TARGET binding site found in the 5' untranslated region of mRNA encoded by MGC2477, corresponding to a HOST TARGET binding site such as BINDING SITE I, BINDING SITE II or BINDING SITE III. Table 2 illustrates the complementarity of the nucleotide sequences of MGC2477 BINDING SITE, designated SEQ ID:23542, to the nucleotide sequence of VGAM538 RNA, herein designated VGAM RNA, also designated SEQ ID:3249.

Another function of VGAM538 is therefore inhibition of MGC2477 (Accession NM_024099). Accordingly, utilities of VGAM538 include diagnosis, prevention and treatment of diseases and clinical conditions associated with MGC2477. Nudix (nucleoside diphosphate linked moiety X)-type Motif 11 (NUDT11, Accession XM_010230) is another VGAM538 host target gene. NUDT11 BINDING SITE is HOST TARGET binding site found in the 3' untranslated region of mRNA encoded by NUDT11, corresponding to a HOST TARGET binding site such as BINDING SITE I, BINDING SITE II or BINDING SITE III. Table 2 illustrates the complementarity of the nucleotide sequences of NUDT11 BINDING SITE, designated SEQ ID:30141, to the nucleotide sequence of VGAM538 RNA, herein designated VGAM RNA, also designated SEQ ID:3249.

Another function of VGAM538 is therefore inhibition of Nudix (nucleoside diphosphate linked moiety X)-type Motif 11 (NUDT11, Accession XM_010230). Accordingly, utilities of VGAM538 include diagnosis, prevention and treatment of diseases and clinical conditions associated with NUDT11. SEC14-like 1 (S. cerevisiae) (SEC14L1, Accession NM_003003) is another VGAM538 host target gene. SEC14L1 BINDING SITE is HOST TARGET binding site found in the 3' untranslated region of mRNA encoded by SEC14L1, corresponding to a HOST TARGET binding site such as BINDING SITE I, BINDING SITE II or BINDING SITE III. Table 2 illustrates the complementarity of the nucleotide sequences of SEC14L1 BINDING SITE, designated SEQ ID:8902, to the nucleotide sequence of VGAM538 RNA, herein designated VGAM RNA, also designated SEQ ID:3249.

Another function of VGAM538 is therefore inhibition of SEC14-like 1 (S. cerevisiae) (SEC14L1, Accession NM_003003). Accordingly, utilities of VGAM538 include diagnosis, prevention and treatment of diseases and clinical conditions associated with SEC14L1. Sp2 Transcription Factor (SP2, Accession NM_003110) is another VGAM538 host target gene. SP2 BINDING SITE is HOST TARGET binding site found in the 5' untranslated region of mRNA encoded by SP2, corresponding to a HOST TARGET binding site such as BINDING SITE I, BINDING SITE II or BINDING SITE III. Table 2 illustrates the complementarity of the nucleotide sequences of SP2 BINDING SITE, designated SEQ ID:9081, to the nucleotide sequence of VGAM538 RNA, herein designated VGAM RNA, also designated SEQ ID:3249.

Another function of VGAM538 is therefore inhibition of Sp2 Transcription Factor (SP2, Accession NM_003110). Accordingly, utilities of VGAM538 include diagnosis, prevention and treatment of diseases and clinical conditions associated with SP2. SFRS Protein Kinase 1 (SRPK1, Accession NM_003137) is another VGAM538 host target gene. SRPK1 BINDING SITE is HOST TARGET binding site found in the 3' untranslated region of mRNA encoded by SRPK1, corresponding to a HOST TARGET binding site such as BINDING SITE I, BINDING SITE II or BINDING SITE III. Table 2 illustrates the complementarity of the nucleotide sequences of SRPK1 BINDING SITE, designated SEQ ID:9110, to the nucleotide sequence of VGAM538 RNA, herein designated VGAM RNA, also designated SEQ ID:3249.

Another function of VGAM538 is therefore inhibition of SFRS Protein Kinase 1 (SRPK1, Accession NM_003137). Accordingly, utilities of VGAM538 include diagnosis, prevention and treatment of diseases and clinical conditions associated with SRPK1. LOC134266 (Accession XM_059701) is another VGAM538 host target gene. LOC134266 BINDING SITE is HOST TARGET binding site found in the 3' untranslated region of mRNA encoded by LOC134266, corresponding to a HOST TARGET binding site such as BINDING SITE I, BINDING SITE II or BINDING SITE III. Table 2 illustrates the complementarity of the nucleotide sequences of LOC134266 BINDING SITE, designated SEQ ID:37072, to the nucleotide sequence of VGAM538 RNA, herein designated VGAM RNA, also designated SEQ ID:3249.

Another function of VGAM538 is therefore inhibition of LOC134266 (Accession XM_059701). Accordingly, utilities of VGAM538 include diagnosis, prevention and treatment of diseases and clinical conditions associated with LOC134266. LOC142972 (Accession XM_036593) is another VGAM538 host target gene. LOC142972 BINDING SITE is HOST TARGET binding site found in the 3' untranslated region of mRNA encoded by LOC142972, corresponding to a HOST TARGET binding site such as BINDING SITE I, BINDING SITE II or BINDING SITE III. Table 2 illustrates the complementarity of the nucleotide sequences of LOC142972 BINDING SITE, designated SEQ ID:32478, to the nucleotide sequence of VGAM538 RNA, herein designated VGAM RNA, also designated SEQ ID:3249.

Another function of VGAM538 is therefore inhibition of LOC142972 (Accession XM_036593). Accordingly, utilities of VGAM538 include diagnosis, prevention and treatment of diseases and clinical conditions associated with LOC142972. LOC145439 (Accession XM_085144) is another VGAM538 host target gene. LOC145439 BINDING SITE is HOST TARGET binding site found in the 5' untranslated region of mRNA encoded by LOC145439, corresponding to a HOST TARGET binding site such as BINDING SITE I, BINDING SITE II or BINDING SITE III. Table 2 illustrates the complementarity of the nucleotide sequences of LOC145439 BINDING SITE, designated SEQ ID:37864, to the nucleotide sequence of VGAM538 RNA, herein designated VGAM RNA, also designated SEQ ID:3249.

Another function of VGAM538 is therefore inhibition of LOC145439 (Accession XM_085144). Accordingly, utilities of VGAM538 include diagnosis, prevention and treatment of diseases and clinical conditions associated with LOC145439. LOC147165 (Accession XM_097205) is another VGAM538 host target gene. LOC147165 BINDING SITE is HOST TARGET binding site found in the 3' untranslated region of mRNA encoded by LOC147165, corresponding to a HOST TARGET binding site such as BINDING SITE I, BINDING SITE II or BINDING SITE III. Table 2 illustrates the complementarity of the nucleotide sequences of LOC147165 BINDING SITE, designated SEQ ID:40814, to the nucleotide sequence of VGAM538 RNA, herein designated VGAM RNA, also designated SEQ ID:3249.

Another function of VGAM538 is therefore inhibition of LOC147165 (Accession XM_097205). Accordingly, utilities of VGAM538 include diagnosis, prevention and treatment of diseases and clinical conditions associated with LOC147165.

LOC199232 (Accession XM_114336) is another VGAM538 host target gene. LOC199232 BINDING SITE is HOST TARGET binding site found in the 3' untranslated region of mRNA encoded by LOC199232, corresponding to a HOST TARGET binding site such as BINDING SITE I, BINDING SITE II or BINDING SITE III. Table 2 illustrates the complementarity of the nucleotide sequences of LOC199232 BINDING SITE, designated SEQ ID:42879, to the nucleotide sequence of VGAM538 RNA, herein designated VGAM RNA, also designated SEQ ID:3249.

Another function of VGAM538 is therefore inhibition of LOC199232 (Accession XM_114336). Accordingly, utilities of VGAM538 include diagnosis, prevention and treatment of diseases and clinical conditions associated with LOC199232. LOC200609 (Accession XM_117256) is another VGAM538 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43328, to the nucleotide sequence of VGAM538 RNA, herein designated VGAM RNA, also designated SEQ ID:3249.

Another function of VGAM538 is therefore inhibition of LOC200609 (Accession XM_117256). Accordingly, utilities of VGAM538 include diagnosis, prevention and treatment of diseases and clinical conditions associated with LOC200609. LOC200933 (Accession XM_117294) is another VGAM538 host target gene. LOC200933 BINDING SITE is HOST TARGET binding site found in the 3' untranslated region of mRNA encoded by LOC200933, corresponding to a HOST TARGET binding site such as BINDING SITE I, BINDING SITE II or BINDING SITE III. Table 2 illustrates the complementarity of the nucleotide sequences of LOC200933 BINDING SITE, designated SEQ ID:43363, to the nucleotide sequence of VGAM538 RNA, herein designated VGAM RNA, also designated SEQ ID:3249.

Another function of VGAM538 is therefore inhibition of LOC200933 (Accession XM_117294). Accordingly, utilities of VGAM538 include diagnosis, prevention and treatment of diseases and clinical conditions associated with LOC200933. LOC253664 (Accession XM_170673) is another VGAM538 host target gene. LOC253664 BINDING SITE is HOST TARGET binding site found in the 3' untranslated region of mRNA encoded by LOC253664, corresponding to a HOST TARGET binding site such as BINDING SITE I, BINDING SITE II or BINDING SITE III. Table 2 illustrates the complementarity of the nucleotide sequences of LOC253664 BINDING SITE, designated SEQ ID:45449, to the nucleotide sequence of VGAM538 RNA, herein designated VGAM RNA, also designated SEQ ID:3249.

Another function of VGAM538 is therefore inhibition of LOC253664 (Accession XM_170673). Accordingly, utilities of VGAM538 include diagnosis, prevention and treatment of diseases and clinical conditions associated with LOC253664. LOC51026 (Accession NM_016072) is another VGAM538 host target gene. LOC51026 BINDING SITE is HOST TARGET binding site found in the 3' untranslated region of mRNA encoded by LOC51026, corresponding to a HOST TARGET binding site such as BINDING SITE I, BINDING SITE II or BINDING SITE III. Table 2 illustrates the complementarity of the nucleotide sequences of LOC51026 BINDING SITE, designated SEQ ID:18144, to the nucleotide sequence of VGAM538 RNA, herein designated VGAM RNA, also designated SEQ ID:3249.

Another function of VGAM538 is therefore inhibition of LOC51026 (Accession NM_016072). Accordingly, utilities of VGAM538 include diagnosis, prevention and treatment of diseases and clinical conditions associated with LOC51026. LOC91351 (Accession XM_037817) is another VGAM538 host target gene. LOC91351 BINDING SITE is HOST TARGET binding site found in the 3' untranslated region of mRNA encoded by LOC91351, corresponding to a HOST TARGET binding site such as BINDING SITE I, BINDING SITE II or BINDING SITE III. Table 2 illustrates the complementarity of the nucleotide sequences of LOC91351 BINDING SITE, designated SEQ ID:32696, to the nucleotide sequence of VGAM538 RNA, herein designated VGAM RNA, also designated SEQ ID:3249.

Another function of VGAM538 is therefore inhibition of LOC91351 (Accession XM_037817). Accordingly, utilities of VGAM538 include diagnosis, prevention and treatment of diseases and clinical conditions associated with LOC91351. LOC93512 (Accession XM_051758) is another VGAM538 host target gene. LOC93512 BINDING SITE is HOST TARGET binding site found in the 3' untranslated region of mRNA encoded by LOC93512, corresponding to a HOST TARGET binding site such as BINDING SITE I, BINDING SITE II or BINDING SITE III. Table 2 illustrates the complementarity of the nucleotide sequences of LOC93512 BINDING SITE, designated SEQ ID:35878, to the nucleotide sequence of VGAM538 RNA, herein designated VGAM RNA, also designated SEQ ID:3249.

Another function of VGAM538 is therefore inhibition of LOC93512 (Accession XM_051758). Accordingly, utilities of VGAM538 include diagnosis, prevention and treatment of diseases and clinical conditions associated with LOC93512. FIG. 1 further provides a conceptual description of a novel bioinformatically detected viral gene of the present invention, referred to here as Viral Genomic Address Messenger 539 (VGAM539) viral gene, which modulates expression of respective host target genes thereof, the function and utility of which host target genes is known in the art.

VGAM539 is a novel bioinformatically detected regulatory, non protein coding, viral micro RNA (miRNA) gene. The method by which VGAM539 was detected is described hereinabove with reference to FIGS. 1-8.

VGAM539 gene, herein designated VGAM GENE, is a viral gene contained in the genome of Bovine Respiratory Syncytial Virus. VGAM539 host target gene, herein designated VGAM HOST TARGET GENE, is a human gene contained in the human genome.

VGAM539 gene encodes a VGAM539 precursor RNA, herein designated VGAM PRECURSOR RNA. Similar to other miRNA genes, and unlike most ordinary genes, VGAM539 precursor RNA does not encode a protein. A nucleotide sequence identical or highly similar to the nucleotide sequence of VGAM539 precursor RNA is designated SEQ ID:525, and is provided hereinbelow with reference to the sequence listing part. Nucleotide sequence SEQ ID:525 is located at position 10613 relative to the genome of Bovine Respiratory Syncytial Virus.

VGAM539 precursor RNA folds onto itself, forming VGAM539 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM539 folded precursor RNA into VGAM539 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM539 RNA is designated SEQ ID:3250, and is provided hereinbelow with reference to the sequence listing part.

VGAM539 host target gene, herein designated VGAM HOST TARGET GENE, encodes a corresponding messenger RNA, VGAM539 host target RNA, herein designated VGAM HOST TARGET RNA. VGAM539 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM539 RNA, herein designated VGAM RNA, binds complementarily to one or more host target binding sites located in untranslated regions of VGAM539 host target RNA, herein designated VGAM HOST TARGET RNA. This complementary binding is due to the fact that the nucleotide sequence of VGAM539 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM539 RNA, herein designated VGAM RNA, may have a different number of host target binding sites in untranslated regions of a VGAM539 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM539 RNA, herein designated VGAM RNA, to host target binding sites on VGAM539 host target RNA, herein designated VGAM HOST TARGET RNA, such as BINDING SITE I, BINDING SITE II and BINDING SITE III, inhibits translation of VGAM539 host target RNA into VGAM539 host target protein, herein designated VGAM HOST TARGET PROTEIN. VGAM host target protein is therefore outlined by a broken line.

It is appreciated that VGAM539 host target gene, herein designated VGAM HOST TARGET GENE, in fact represents a plurality of VGAM539 host target genes. The mRNA of each one of this plurality of VGAM539 host target genes comprises one or more host target binding sites, each having a nucleotide sequence which is at least partly complementary to VGAM539 RNA, herein designated VGAM RNA, and which when bound by VGAM539 RNA causes inhibition of translation of respective one or more VGAM539 host target proteins.

It is further appreciated by one skilled in the art that the mode of translational inhibition illustrated by FIG. 1 with specific reference to translational inhibition exerted by VGAM539 gene, herein designated VGAM GENE, on one or more VGAM539 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM539 is inhibition of expression of host target genes, as part of a novel viral mechanism of attacking a host. Accordingly, utilities of VGAM539 include diagnosis, prevention and treatment of viral infection by Bovine Respiratory Syncytial Virus. Specific functions, and accordingly utilities, of VGAM539 correlate with, and may be deduced from, the identity of the host target genes which VGAM539 binds and inhibits, and the function of these host target genes, as elaborated hereinbelow.

Nucleotide sequences of the VGAM539 precursor RNA, herein designated VGAM PRECURSOR RNA, and of the 'diced' VGAM539 RNA, herein designated VGAM RNA, and a schematic representation of the secondary folding of VGAM539 folded precursor RNA, herein designated VGAM FOLDED PRECURSOR RNA, of VGAM539 are further described hereinbelow with reference to Table 1.

Nucleotide sequences of host target binding sites, such as BINDING SITE-I, BINDING SITE-II and BINDING SITE-III of FIG. 1, found on VGAM539 host target RNA, and schematic representation of the complementarity of each of these host target binding sites to VGAM539 RNA, herein designated VGAM RNA, are described hereinbelow with reference to Table 2.

As mentioned hereinabove with reference to FIG. 1, a function of VGAM539 gene, herein designated VGAM is inhibition of expression of VGAM539 target genes. It is appreciated that specific functions, and accordingly utilities, of VGAM539 correlate with, and may be deduced from, the identity of the target genes which VGAM539 binds and inhibits, and the function of these target genes, as elaborated hereinbelow.

Cadherin 6, Type 2, K-cadherin (fetal kidney) (CDH6, Accession NM_004932) is a VGAM539 host target gene. CDH6 BINDING SITE is HOST TARGET binding site found in the 3' untranslated region of mRNA encoded by CDH6, corresponding to a HOST TARGET binding site such as BINDING SITE I, BINDING SITE II or BINDING SITE III. Table 2 illustrates the complementarity of the nucleotide sequences of CDH6 BINDING SITE, designated SEQ ID:11371, to the nucleotide sequence of VGAM539 RNA, herein designated VGAM RNA, also designated SEQ ID:3250.

A function of VGAM539 is therefore inhibition of Cadherin 6, Type 2, K-cadherin (fetal kidney) (CDH6, Accession NM_004932), a gene which is a calcium dependent cell adhesion protein. Accordingly, utilities of VGAM539 include diagnosis, prevention and treatment of diseases and clinical conditions associated with CDH6. The function of CDH6 and its association with various diseases and clinical conditions, has been established by previous studies, as described hereinabove with reference to VGAM60. Gamma-aminobutyric Acid (GABA) A Receptor, Epsilon (GABRE, Accession NM_004961) is another VGAM539 host target gene. GABRE BINDING SITE1 through GABRE BINDING SITE4 are HOST TARGET binding sites found in untranslated regions of mRNA encoded by GABRE, corresponding to HOST TARGET binding sites such as BINDING SITE I, BINDING SITE II or BINDING SITE III. Table 2 illustrates the complementarity of the nucleotide sequences of GABRE BINDING SITE1 through GABRE BINDING SITE4, designated SEQ ID:11406, SEQ ID:22508, SEQ ID:22512 and SEQ ID:22527 respectively, to the nucleotide sequence of VGAM539 RNA, herein designated VGAM RNA, also designated SEQ ID:3250.

Another function of VGAM539 is therefore inhibition of Gamma-aminobutyric Acid (GABA) A Receptor, Epsilon (GABRE, Accession NM_004961), a gene which mediates neuronal inhibition by binding to the gaba/benzodiazepine receptor and opening an integral chloride channel. Accordingly, utilities of VGAM539 include diagnosis, prevention and treatment of diseases and clinical conditions associated with GABRE. The function of GABRE and its association with various diseases and clinical conditions, has been established by previous studies, as described hereinabove with reference to VGAM259. Pim-2 Oncogene (PIM2, Accession XM_010208) is another VGAM539 host target gene. PIM2 BINDING SITE is HOST TARGET binding site found in the 3' untranslated region of mRNA encoded by PIM2, corresponding to a HOST TARGET binding site such as BINDING SITE I, BINDING SITE II or BINDING SITE III. Table 2 illustrates the complementarity of the nucleotide sequences of PIM2 BINDING SITE, designated SEQ ID:30132, to the nucleotide sequence of VGAM539 RNA, herein designated VGAM RNA, also designated SEQ ID:3250.

Another function of VGAM539 is therefore inhibition of Pim-2 Oncogene (PIM2, Accession XM_010208). Accordingly, utilities of VGAM539 include diagnosis, prevention and treatment of diseases and clinical conditions associated with PIM2. FIG. 1 further provides a conceptual description of a novel bioinformatically detected viral gene of the present invention, referred to here as Viral Genomic Address Messenger 540 (VGAM540) viral gene, which modulates expression of respective host target genes thereof, the function and utility of which host target genes is known in the art.

VGAM540 is a novel bioinformatically detected regulatory, non protein coding, viral micro RNA (miRNA) gene. The method by which VGAM540 was detected is described hereinabove with reference to FIGS. 1-8.

VGAM540 gene, herein designated VGAM GENE, is a viral gene contained in the genome of Bovine Respiratory Syncytial Virus. VGAM540 host target gene, herein designated VGAM HOST TARGET GENE, is a human gene contained in the human genome.

VGAM540 gene encodes a VGAM540 precursor RNA, herein designated VGAM PRECURSOR RNA. Similar to other miRNA genes, and unlike most ordinary genes, VGAM540 precursor RNA does not encode a protein. A nucleotide sequence identical or highly similar to the nucleotide sequence of VGAM540 precursor RNA is designated SEQ ID:526, and is provided hereinbelow with reference to the sequence listing part. Nucleotide sequence SEQ ID:526 is located at position 14011 relative to the genome of Bovine Respiratory Syncytial Virus.

VGAM540 precursor RNA folds onto itself, forming VGAM540 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM540 folded precursor RNA into VGAM540 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM540 RNA is designated SEQ ID:3251, and is provided hereinbelow with reference to the sequence listing part.

VGAM540 host target gene, herein designated VGAM HOST TARGET GENE, encodes a corresponding messenger RNA, VGAM540 host target RNA, herein designated VGAM HOST TARGET RNA. VGAM540 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM540 RNA, herein designated VGAM RNA, binds complementarily to one or more host target binding sites located in untranslated regions of VGAM540 host target RNA, herein designated VGAM HOST TARGET RNA. This complementary binding is due to the fact that the nucleotide sequence of VGAM540 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM540 RNA, herein designated VGAM RNA, may have a different number of host target binding sites in untranslated regions of a VGAM540 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM540 RNA, herein designated VGAM RNA, to host target binding sites on VGAM540 host target RNA, herein designated VGAM HOST TARGET RNA, such as BINDING SITE I, BINDING SITE II and BINDING SITE III, inhibits translation of VGAM540 host target RNA into VGAM540 host target protein, herein designated VGAM HOST TARGET PROTEIN. VGAM host target protein is therefore outlined by a broken line.

It is appreciated that VGAM540 host target gene, herein designated VGAM HOST TARGET GENE, in fact represents a plurality of VGAM540 host target genes. The mRNA of each one of this plurality of VGAM540 host target genes comprises one or more host target binding sites, each having a nucleotide sequence which is at least partly complementary to VGAM540 RNA, herein designated VGAM RNA, and which when bound by VGAM540 RNA causes inhibition of translation of respective one or more VGAM540 host target proteins.

It is further appreciated by one skilled in the art that the mode of translational inhibition illustrated by FIG. 1 with specific reference to translational inhibition exerted by VGAM540 gene, herein designated VGAM GENE, on one or more VGAM540 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM540 is inhibition of expression of host target genes, as part of a novel viral mechanism of attacking a host. Accordingly, utilities of VGAM540 include diagnosis, prevention and treatment of viral infection by Bovine Respiratory Syncytial Virus. Specific functions, and accordingly utilities, of VGAM540 correlate with, and may be deduced from, the identity of the host target genes which VGAM540 binds and inhibits, and the function of these host target genes, as elaborated hereinbelow.

Nucleotide sequences of the VGAM540 precursor RNA, herein designated VGAM PRECURSOR RNA, and of the 'diced' VGAM540 RNA, herein designated VGAM RNA, and a schematic representation of the secondary folding of VGAM540 folded precursor RNA, herein designated VGAM FOLDED PRECURSOR RNA, of VGAM540 are further described hereinbelow with reference to Table 1.

Nucleotide sequences of host target binding sites, such as BINDING SITE-I, BINDING SITE-II and BINDING SITE-III of FIG. 1, found on VGAM540 host target RNA, and schematic representation of the complementarity of each of these host target binding sites to VGAM540 RNA, herein designated VGAM RNA, are described hereinbelow with reference to Table 2.

As mentioned hereinabove with reference to FIG. 1, a function of VGAM540 gene, herein designated VGAM is inhibition of expression of VGAM540 target genes. It is appreciated that specific functions, and accordingly utilities, of VGAM540 correlate with, and may be deduced from, the identity of the target genes which VGAM540 binds and inhibits, and the function of these target genes, as elaborated hereinbelow.

NCK Adaptor Protein 1 (NCK1, Accession NM_006153) is a VGAM540 host target gene. NCK1 BINDING SITE is HOST TARGET binding site found in the 3' untranslated region of mRNA encoded by NCK1, corresponding to a HOST TARGET binding site such as BINDING SITE I, BINDING SITE II or BINDING SITE III. Table 2 illustrates the complementarity of the nucleotide sequences of NCK1 BINDING SITE, designated SEQ ID:12809, to the nucleotide sequence of VGAM540 RNA, herein designated VGAM RNA, also designated SEQ ID:3251.

A function of VGAM540 is therefore inhibition of NCK Adaptor Protein 1 (NCK1, Accession NM_006153). Accordingly, utilities of VGAM540 include diagnosis, prevention and treatment of diseases and clinical conditions associated with NCK1. Oxysterol Binding Protein-like 11 (OSBPL11, Accession NM_022776) is another VGAM540 host target gene. OSBPL11 BINDING SITE is HOST TARGET binding site found in the 3' untranslated region of mRNA encoded by OSBPL11, corresponding to a HOST TARGET binding site such as BINDING SITE I, BINDING SITE II or BINDING SITE III. Table 2 illustrates the complementarity of the nucleotide sequences of OSBPL11 BINDING SITE, designated SEQ ID:23046, to the nucleotide sequence of VGAM540 RNA, herein designated VGAM RNA, also designated SEQ ID:3251.

Another function of VGAM540 is therefore inhibition of Oxysterol Binding Protein-like 11 (OSBPL11, Accession NM_022776). Accordingly, utilities of VGAM540 include diagnosis, prevention and treatment of diseases and clinical conditions associated with OSBPL11. Thioesterase, Adipose Associated (THEA, Accession XM_038922) is another VGAM540 host target gene. THEA BINDING SITE is HOST TARGET binding site found in the 3' untranslated region of mRNA encoded by THEA, corresponding to a HOST TARGET binding site such as BINDING SITE I, BINDING SITE II or BINDING SITE III. Table 2 illustrates the complementarity of the nucleotide sequences of THEA BINDING SITE, designated SEQ ID:32948, to the nucleotide sequence of VGAM540 RNA, herein designated VGAM RNA, also designated SEQ ID:3251.

Another function of VGAM540 is therefore inhibition of Thioesterase, Adipose Associated (THEA, Accession XM_038922). Accordingly, utilities of VGAM540 include diagnosis, prevention and treatment of diseases and clinical conditions associated with THEA. LOC199796 (Accession XM_058994) is another VGAM540 host target gene. LOC199796 BINDING SITE is HOST TARGET binding site found in the 5' untranslated region of mRNA encoded by LOC199796, corresponding to a HOST TARGET binding site such as BINDING SITE I, BINDING SITE II or BINDING SITE III. Table 2 illustrates the complementarity of the nucleotide sequences of LOC199796 BINDING SITE, designated SEQ ID:36805, to the nucleotide sequence of VGAM540 RNA, herein designated VGAM RNA, also designated SEQ ID:3251.

Another function of VGAM540 is therefore inhibition of LOC199796 (Accession XM_058994). Accordingly, utilities of VGAM540 include diagnosis, prevention and treatment of diseases and clinical conditions associated with LOC199796. FIG. 1 further provides a conceptual description of a novel bioinformatically detected viral gene of the present invention, referred to here as Viral Genomic Address Messenger 541 (VGAM541) viral gene, which modulates expression of respective host target genes thereof, the function and utility of which host target genes is known in the art.

VGAM541 is a novel bioinformatically detected regulatory, non protein coding, viral micro RNA (miRNA) gene. The method by which VGAM541 was detected is described hereinabove with reference to FIGS. 1-8.

VGAM541 gene, herein designated VGAM GENE, is a viral gene contained in the genome of Bovine Respiratory Syncytial Virus. VGAM541 host target gene, herein designated VGAM HOST TARGET GENE, is a human gene contained in the human genome.

VGAM541 gene encodes a VGAM541 precursor RNA, herein designated VGAM PRECURSOR RNA. Similar to other miRNA genes, and unlike most ordinary genes, VGAM541 precursor RNA does not encode a protein. A nucleotide sequence identical or highly similar to the nucleotide sequence of VGAM541 precursor RNA is designated SEQ ID:527, and is provided hereinbelow with reference to the sequence listing part. Nucleotide sequence SEQ ID:527 is located at position 14726 relative to the genome of Bovine Respiratory Syncytial Virus.

VGAM541 precursor RNA folds onto itself, forming VGAM541 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM541 folded precursor RNA into VGAM541 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM541 RNA is designated SEQ ID:3252, and is provided hereinbelow with reference to the sequence listing part.

VGAM541 host target gene, herein designated VGAM HOST TARGET GENE, encodes a corresponding messenger RNA, VGAM541 host target RNA, herein designated VGAM HOST TARGET RNA. VGAM541 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM541 RNA, herein designated VGAM RNA, binds complementarily to one or more host target binding sites located in untranslated regions of VGAM541 host target RNA, herein designated VGAM HOST TARGET RNA. This complementary binding is due to the fact that the nucleotide sequence of VGAM541 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM541 RNA, herein designated VGAM RNA, may have a different number of host target binding sites in untranslated regions of a VGAM541 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM541 RNA, herein designated VGAM RNA, to host target binding sites on VGAM541 host target RNA, herein designated VGAM HOST TARGET RNA, such as BINDING SITE I, BINDING SITE II and BINDING SITE III, inhibits translation of VGAM541 host target RNA into VGAM541 host target protein, herein designated VGAM HOST TARGET PROTEIN. VGAM host target protein is therefore outlined by a broken line.

It is appreciated that VGAM541 host target gene, herein designated VGAM HOST TARGET GENE, in fact represents a plurality of VGAM541 host target genes. The mRNA of each one of this plurality of VGAM541 host target genes comprises one or more host target binding sites, each having a nucleotide sequence which is at least partly complementary to VGAM541 RNA, herein designated VGAM RNA, and which when bound by VGAM541 RNA causes inhibition of translation of respective one or more VGAM541 host target proteins.

It is further appreciated by one skilled in the art that the mode of translational inhibition illustrated by FIG. 1 with specific reference to translational inhibition exerted by VGAM541 gene, herein designated VGAM GENE, on one or more VGAM541 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM541 is inhibition of expression of host target genes, as part of a novel viral mechanism of attacking a host. Accordingly, utilities of VGAM541 include diagnosis, prevention and treatment of viral infection by Bovine Respiratory Syncytial Virus. Specific functions, and accordingly utilities, of VGAM541 correlate with, and may be deduced from, the identity of the host target genes which VGAM541 binds and inhibits, and the function of these host target genes, as elaborated hereinbelow.

Nucleotide sequences of the VGAM541 precursor RNA, herein designated VGAM PRECURSOR RNA, and of the 'diced' VGAM541 RNA, herein designated VGAM RNA, and a schematic representation of the secondary folding of VGAM541 folded precursor RNA, herein designated VGAM FOLDED PRECURSOR RNA, of VGAM541 are further described hereinbelow with reference to Table 1.

Nucleotide sequences of host target binding sites, such as BINDING SITE-I, BINDING SITE-II and BINDING SITE-III of FIG. 1, found on VGAM541 host target RNA, and schematic representation of the complementarity of each of these host target binding sites to VGAM541 RNA, herein designated VGAM RNA, are described hereinbelow with reference to Table 2.

As mentioned hereinabove with reference to FIG. 1, a function of VGAM541 gene, herein designated VGAM is inhibition of expression of VGAM541 target genes. It is appreciated that specific functions, and accordingly utilities, of VGAM541 correlate with, and may be deduced from, the identity of the target genes which VGAM541 binds and inhibits, and the function of these target genes, as elaborated hereinbelow.

HSA249128 (Accession NM_017583) is a VGAM541 host target gene. HSA249128 BINDING SITE is HOST TARGET binding site found in the 3' untranslated region of mRNA encoded by HSA249128, corresponding to a HOST TARGET binding site such as BINDING SITE I, BINDING SITE II or BINDING SITE III. Table 2 illustrates the complementarity of the nucleotide sequences of HSA249128 BINDING SITE, designated SEQ ID:19023, to the nucleotide sequence of VGAM541 RNA, herein designated VGAM RNA, also designated SEQ ID:3252.

A function of VGAM541 is therefore inhibition of HSA249128 (Accession NM_017583). Accordingly, utilities of VGAM541 include diagnosis, prevention and treatment of diseases and clinical conditions associated with HSA249128. KIAA1005 (Accession XM_051197) is another VGAM541 host target gene. KIAA1005 BINDING SITE is HOST TARGET binding site found in the 3' untranslated region of mRNA encoded by KIAA1005, corresponding to a HOST TARGET binding site such as BINDING SITE I, BINDING SITE II or BINDING SITE III. Table 2 illustrates the complementarity of the nucleotide sequences of KIAA1005 BINDING SITE, designated SEQ ID:35779, to the nucleotide sequence of VGAM541 RNA, herein designated VGAM RNA, also designated SEQ ID:3252.

Another function of VGAM541 is therefore inhibition of KIAA1005 (Accession XM_051197). Accordingly, utilities of VGAM541 include diagnosis, prevention and treatment of diseases and clinical conditions associated with KIAA1005. FIG. 1 further provides a conceptual description of a novel bioinformatically detected viral gene of the present invention, referred to here as Viral Genomic Address Messenger 542 (VGAM542) viral gene, which modulates expression of respective host target genes thereof, the function and utility of which host target genes is known in the art.

VGAM542 is a novel bioinformatically detected regulatory, non protein coding, viral micro RNA (miRNA) gene. The method by which VGAM542 was detected is described hereinabove with reference to FIGS. 1-8.

VGAM542 gene, herein designated VGAM GENE, is a viral gene contained in the genome of Melanoplus Sanguinipes Entomopoxvirus. VGAM542 host target gene, herein designated VGAM HOST TARGET GENE, is a human gene contained in the human genome.

VGAM542 gene encodes a VGAM542 precursor RNA, herein designated VGAM PRECURSOR RNA. Similar to other miRNA genes, and unlike most ordinary genes, VGAM542 precursor RNA does not encode a protein. A nucleotide sequence identical or highly similar to the nucleotide sequence of VGAM542 precursor RNA is designated SEQ ID:528, and is provided hereinbelow with reference to the sequence listing part. Nucleotide sequence SEQ ID:528 is located at position 229631 relative to the genome of Melanoplus Sanguinipes Entomopoxvirus.

VGAM542 precursor RNA folds onto itself, forming VGAM542 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM542 folded precursor RNA into VGAM542 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM542 RNA is designated SEQ ID:3253, and is provided hereinbelow with reference to the sequence listing part.

VGAM542 host target gene, herein designated VGAM HOST TARGET GENE, encodes a corresponding messenger RNA, VGAM542 host target RNA, herein designated VGAM HOST TARGET RNA. VGAM542 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM542 RNA, herein designated VGAM RNA, binds complementarily to one or more host target binding sites located in untranslated regions of VGAM542 host target RNA, herein designated VGAM HOST TARGET RNA. This complementary binding is due to the fact that the nucleotide sequence of VGAM542 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM542 RNA, herein designated VGAM RNA, may have a different number of host target binding sites in untranslated regions of a VGAM542 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM542 RNA, herein designated VGAM RNA, to host target binding sites on VGAM542 host target RNA, herein designated VGAM HOST TARGET RNA, such as BINDING SITE I, BINDING SITE II and BINDING SITE III, inhibits translation of VGAM542 host target RNA into VGAM542 host target protein, herein designated VGAM HOST TARGET PROTEIN. VGAM host target protein is therefore outlined by a broken line.

It is appreciated that VGAM542 host target gene, herein designated VGAM HOST TARGET GENE, in fact represents a plurality of VGAM542 host target genes. The mRNA of each one of this plurality of VGAM542 host target genes comprises one or more host target binding sites, each having a nucleotide sequence which is at least partly complementary to VGAM542 RNA, herein designated VGAM RNA, and which when bound by VGAM542 RNA causes inhibition of translation of respective one or more VGAM542 host target proteins.

It is further appreciated by one skilled in the art that the mode of translational inhibition illustrated by FIG. 1 with specific reference to translational inhibition exerted by VGAM542 gene, herein designated VGAM GENE, on one or more VGAM542 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM542 is inhibition of expression of host target genes, as part of a novel viral mechanism of attacking a host. Accordingly, utilities of VGAM542 include diagnosis, prevention and treatment of viral infection by Melanoplus Sanguinipes Entomopoxvirus. Specific functions, and accordingly utilities, of VGAM542 correlate with, and may be deduced from, the identity of the host target genes which VGAM542 binds and inhibits, and the function of these host target genes, as elaborated hereinbelow.

Nucleotide sequences of the VGAM542 precursor RNA, herein designated VGAM PRECURSOR RNA, and of the 'diced' VGAM542 RNA, herein designated VGAM RNA, and a schematic representation of the secondary folding of VGAM542 folded precursor RNA, herein designated VGAM FOLDED PRECURSOR RNA, of VGAM542 are further described hereinbelow with reference to Table 1.

Nucleotide sequences of host target binding sites, such as BINDING SITE-I, BINDING SITE-II and BINDING SITE-III of FIG. 1, found on VGAM542 host target RNA, and schematic representation of the complementarity of each of these host target binding sites to VGAM542 RNA, herein designated VGAM RNA, are described hereinbelow with reference to Table 2.

As mentioned hereinabove with reference to FIG. 1, a function of VGAM542 gene, herein designated VGAM is inhibition of expression of VGAM542 target genes. It is appreciated that specific functions, and accordingly utilities, of VGAM542 correlate with, and may be deduced from, the identity of the target genes which VGAM542 binds and inhibits, and the function of these target genes, as elaborated hereinbelow.

Endothelin Receptor Type A (EDNRA, Accession XM_034331) is a VGAM542 host target gene. EDNRA BINDING SITE is HOST TARGET binding site found in the 3' untranslated region of mRNA encoded by EDNRA, corresponding to a HOST TARGET binding site such as BINDING SITE I, BINDING SITE II or BINDING SITE III. Table 2 illustrates the complementarity of the nucleotide sequences of EDNRA BINDING SITE, designated SEQ ID:32060, to the nucleotide sequence of VGAM542 RNA, herein designated VGAM RNA, also designated SEQ ID:3253.

A function of VGAM542 is therefore inhibition of Endothelin Receptor Type A (EDNRA, Accession XM_034331), a gene which binds endothelins, and induces intracellular calcium flux and arachidonic acid accumulation. Accordingly, utilities of VGAM542 include diagnosis, prevention and treatment of diseases and clinical conditions associated with EDNRA. The function of EDNRA and its association with various diseases and clinical conditions, has been established by previous studies, as described hereinabove with reference to VGAM441. Fukuyama Type Congenital Muscular Dystrophy (fukutin) (FCMD, Accession NM_006731) is another VGAM542 host target gene. FCMD BINDING SITE is HOST TARGET binding site found in the 3' untranslated region of mRNA encoded by FCMD, corresponding to a HOST TARGET binding site such as BINDING SITE I, BINDING SITE II or BINDING SITE III. Table 2 illustrates the complementarity of the nucleotide sequences of FCMD BINDING SITE, designated SEQ ID:13571, to the nucleotide sequence of VGAM542 RNA, herein designated VGAM RNA, also designated SEQ ID:3253.

Another function of VGAM542 is therefore inhibition of Fukuyama Type Congenital Muscular Dystrophy (fukutin) (FCMD, Accession NM_006731). Accordingly, utilities of VGAM542 include diagnosis, prevention and treatment of diseases and clinical conditions associated with FCMD. Inhibitor of Growth Family, Member 1 (ING1, Accession NM_005537) is another VGAM542 host target gene. ING1 BINDING SITE is HOST TARGET binding site found in the 3' untranslated region of mRNA encoded by ING1, corresponding to a HOST TARGET binding site such as BINDING SITE I, BINDING SITE II or BINDING SITE III. Table 2 illustrates the complementarity of the nucleotide sequences of ING1 BINDING SITE, designated SEQ ID:12060, to the nucleotide sequence of VGAM542 RNA, herein designated VGAM RNA, also designated SEQ ID:3253.

Another function of VGAM542 is therefore inhibition of Inhibitor of Growth Family, Member 1 (ING1, Accession NM_005537), a gene which acts as a potent growth regulator in normal and in established cells. Accordingly, utilities of VGAM542 include diagnosis, prevention and treatment of diseases and clinical conditions associated with ING1. The function of ING1 and its association with various diseases and clinical conditions, has been established by previous studies, as described hereinabove with reference to VGAM170. DKFZP434C1715 (Accession XM_098421) is another VGAM542 host target gene. DKFZP434C1715 BINDING SITE is HOST TARGET binding site found in the 3' untranslated region of mRNA encoded by DKFZP434C1715, corresponding to a HOST TARGET binding site such as BINDING SITE I, BINDING SITE II or BINDING SITE III. Table 2 illustrates the complementarity of the nucleotide sequences of DKFZP434C1715 BINDING SITE, designated SEQ ID:41671, to the nucleotide sequence of VGAM542 RNA, herein designated VGAM RNA, also designated SEQ ID:3253.

Another function of VGAM542 is therefore inhibition of DKFZP434C1715 (Accession XM_098421). Accordingly, utilities of VGAM542 include diagnosis, prevention and treatment of diseases and clinical conditions associated with DKFZP434C1715. Oxysterol Binding Protein-like 1A (OSBPL1A, Accession NM_080597) is another VGAM542 host target gene. OSBPL1A BINDING SITE1 through OSBPL1A BINDING SITE3 are HOST TARGET binding sites found in untranslated regions of mRNA encoded by OSBPL1A, corresponding to HOST TARGET binding sites such as BINDING SITE I, BINDING SITE II or BINDING SITE III. Table 2 illustrates the complementarity of the nucleotide sequences of OSBPL1A BINDING SITE1 through OSBPL1A BINDING SITE3, designated SEQ ID:27906, SEQ ID:28423 and SEQ ID:19771 respectively, to the nucleotide sequence of VGAM542 RNA, herein designated VGAM RNA, also designated SEQ ID:3253.

Another function of VGAM542 is therefore inhibition of Oxysterol Binding Protein-like 1A (OSBPL1A, Accession NM_080597). Accordingly, utilities of VGAM542 include diagnosis, prevention and treatment of diseases and clinical conditions associated with OSBPL1A. LOC220038 (Accession XM_166257) is another VGAM542 host target gene. LOC220038 BINDING SITE is HOST TARGET binding site found in the 5' untranslated region of mRNA encoded by LOC220038, corresponding to a HOST TARGET binding site such as BINDING SITE I, BINDING SITE II or BINDING SITE III. Table 2 illustrates the complementarity of the nucleotide sequences of LOC220038 BINDING SITE, designated SEQ ID:44079, to the nucleotide sequence of VGAM542 RNA, herein designated VGAM RNA, also designated SEQ ID:3253.

Another function of VGAM542 is therefore inhibition of LOC220038 (Accession XM_166257). Accordingly, utilities of VGAM542 include diagnosis, prevention and treatment of diseases and clinical conditions associated with LOC220038. FIG. 1 further provides a conceptual description of a novel bioinformatically detected viral gene of the present invention, referred to here as Viral Genomic Address Messenger 543 (VGAM543) viral gene, which modulates expression of respective host target genes thereof, the function and utility of which host target genes is known in the art.

VGAM543 is a novel bioinformatically detected regulatory, non protein coding, viral micro RNA (miRNA) gene. The method by which VGAM543 was detected is described hereinabove with reference to FIGS. 1-8.

VGAM543 gene, herein designated VGAM GENE, is a viral gene contained in the genome of Melanoplus Sanguinipes Entomopoxvirus. VGAM543 host target gene, herein designated VGAM HOST TARGET GENE, is a human gene contained in the human genome.

VGAM543 gene encodes a VGAM543 precursor RNA, herein designated VGAM PRECURSOR RNA. Similar to other miRNA genes, and unlike most ordinary genes, VGAM543 precursor RNA does not encode a protein. A nucleotide sequence identical or highly similar to the nucleotide sequence of VGAM543 precursor RNA is designated SEQ ID:529, and is provided hereinbelow with reference to the sequence listing part. Nucleotide sequence SEQ ID:529 is located at position 179507 relative to the genome of Melanoplus Sanguinipes Entomopoxvirus.

VGAM543 precursor RNA folds onto itself, forming VGAM543 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM543 folded precursor RNA into VGAM543 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM543 RNA is designated SEQ ID:3254, and is provided hereinbelow with reference to the sequence listing part.

VGAM543 host target gene, herein designated VGAM HOST TARGET GENE, encodes a corresponding messenger RNA, VGAM543 host target RNA, herein designated VGAM HOST TARGET RNA. VGAM543 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM543 RNA, herein designated VGAM RNA, binds complementarily to one or more host target binding sites located in untranslated regions of VGAM543 host target RNA, herein designated VGAM HOST TARGET RNA. This complementary binding is due to the fact that the nucleotide sequence of VGAM543 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM543 RNA, herein designated VGAM RNA, may have a different number of host target binding sites in untranslated regions of a VGAM543 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM543 RNA, herein designated VGAM RNA, to host target binding sites on VGAM543 host target RNA, herein designated VGAM HOST TARGET RNA, such as BINDING SITE I, BINDING SITE II and BINDING SITE III, inhibits translation of VGAM543 host target RNA into VGAM543 host target protein, herein designated VGAM HOST TARGET PROTEIN. VGAM host target protein is therefore outlined by a broken line.

It is appreciated that VGAM543 host target gene, herein designated VGAM HOST TARGET GENE, in fact represents a plurality of VGAM543 host target genes. The mRNA of each one of this plurality of VGAM543 host target genes comprises one or more host target binding sites, each having a nucleotide sequence which is at least partly complementary to VGAM543 RNA, herein designated VGAM RNA, and which when bound by VGAM543 RNA causes inhibition of translation of respective one or more VGAM543 host target proteins.

It is further appreciated by one skilled in the art that the mode of translational inhibition illustrated by FIG. 1 with specific reference to translational inhibition exerted by VGAM543 gene, herein designated VGAM GENE, on one or more VGAM543 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM543 is inhibition of expression of host target genes, as part of a novel viral mechanism of attacking a host. Accordingly, utilities of VGAM543 include diagnosis, prevention and treatment of viral infection by Melanoplus Sanguinipes Entomopoxvirus. Specific functions, and accordingly utilities, of VGAM543 correlate with, and may be deduced from, the identity of the host target genes which VGAM543 binds and inhibits, and the function of these host target genes, as elaborated hereinbelow.

Nucleotide sequences of the VGAM543 precursor RNA, herein designated VGAM PRECURSOR RNA, and of the 'diced' VGAM543 RNA, herein designated VGAM RNA, and a schematic representation of the secondary folding of VGAM543 folded precursor RNA, herein designated VGAM FOLDED PRECURSOR RNA, of VGAM543 are further described hereinbelow with reference to Table 1.

Nucleotide sequences of host target binding sites, such as BINDING SITE-I, BINDING SITE-II and BINDING SITE-III of FIG. 1, found on VGAM543 host target RNA, and schematic representation of the complementarity of each of these host target binding sites to VGAM543 RNA, herein designated VGAM RNA, are described hereinbelow with reference to Table 2.

As mentioned hereinabove with reference to FIG. 1, a function of VGAM543 gene, herein designated VGAM is inhibition of expression of VGAM543 target genes. It is appreciated that specific functions, and accordingly utilities, of VGAM543 correlate with, and may be deduced from, the identity of the target genes which VGAM543 binds and inhibits, and the function of these target genes, as elaborated hereinbelow.

C1D (Accession NM_006333) is a VGAM543 host target gene. C1D BINDING SITE is HOST TARGET binding site found in the 3' untranslated region of mRNA encoded by C1D, corresponding to a HOST TARGET binding site such as BINDING SITE I, BINDING SITE II or BINDING SITE III. Table 2 illustrates the complementarity of the nucleotide sequences of C1D BINDING SITE, designated SEQ ID:13031, to the nucleotide sequence of VGAM543 RNA, herein designated VGAM RNA, also designated SEQ ID:3254.

A function of VGAM543 is therefore inhibition of C1D (Accession NM_006333), a gene which is similar to murine C1D and may be a component of nuclear hormone receptor complexes. Accordingly, utilities of VGAM543 include diagnosis, prevention and treatment of diseases and clinical conditions associated with C1D. The function of C1D and its association with various diseases and clinical conditions, has been established by previous studies, as described hereinabove with reference to VGAM78. Serum/glucocorticoid Regulated Kinase (SGK, Accession NM_005627) is another VGAM543 host target gene. SGK BINDING SITE is HOST TARGET binding site found in the 3' untranslated region of mRNA encoded by SGK, corresponding to a HOST TARGET binding site such as BINDING SITE I, BINDING SITE II or BINDING SITE III. Table 2 illustrates the complementarity of the nucleotide sequences of SGK BINDING SITE, designated SEQ ID:12139, to the nucleotide sequence of VGAM543 RNA, herein designated VGAM RNA, also designated SEQ ID:3254.

Another function of VGAM543 is therefore inhibition of Serum/glucocorticoid Regulated Kinase (SGK, Accession NM_005627), a gene which Serine/threonine kinase. Accordingly, utilities of VGAM543 include diagnosis, prevention and treatment of diseases and clinical conditions associated with SGK. The function of SGK has been established by previous studies. Transforming growth factor-beta (TGFB1; 190180) participates in the pathophysiology of diabetic complications. TGF-beta stimulates the expression of SGK. Lang et al. (2000) demonstrated markedly enhanced transcription of SGK in diabetic nephropathy, with particularly high expression in mesangial cells, interstitial cells, and cells in the thick ascending limbs of the loop of Henle and distal tubules. The enhanced SGK transcription, which results from excessive extracellular glucose concentrations, stimulates renal tubular Na (+) transport. These observations disclosed an additional element in the pathophysiology of diabetic nephropathy. Animal model experiments lend further support to the function of SGK. Using differential display PCR, Tsai et al. (2002) identified 98 cDNA fragments from the rat dorsal hippocampus that were expressed differentially between the fast learners and slow learners in the water maze learning task. One of these cDNA fragments came from the Sgk gene. Northern blot analysis showed that Sgk mRNA levels were approximately 4-fold higher in the hippocampus of fast learners than slow learners. In situ hybridization results indicated that Sgk mRNA levels were increased markedly in the CA1, CA3, and dentate gyrus of the hippocampus of fast learners. Transient transfection of Sgk mutant DNA to the CA1 area of the hippocampus impaired water maze performance in rats, whereas transfection of Sgk wildtype DNA facilitated it.

It is appreciated that the abovementioned animal model for SGK is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lang, F.; Klingel, K.; Wagner, C. A.; Stegen, C.; Warntges, S.; Friedrich, B.; Lanzendorfer, M.; Melzig, J.; Moschen, I.; Steuer, S.; Waldegger, S.; Sauter, M.; and 9 others. Deranged transcriptional regulation of cell-volume-sensitive kinase hSGK in diabetic nephropathy. Proc. Nat. Acad. Sci. 97:8157-8162, 2000; and Tsai, K. J.; Chen, S. K.; Ma, Y. L.; Hsu, W. L.; Lee, E. H. Y.: sgk, a primary glucocorticoid-induced gene, facilitates memory consolidation of spatial learning in rats. Proc. Nat. Acad.

Further studies establishing the function and utilities of SGK are found in John Hopkins OMIM database record ID 602958, and in sited publications numbered 2503, 8644-864 and 8474-8475 listed in the bibliography section hereinbelow, which are also hereby incorporated by reference. Chromosome 12 Open Reading Frame 22 (C12orf22, Accession NM_030809) is another VGAM543 host target gene. C12orf22 BINDING SITE is HOST TARGET binding site found in the 3' untranslated region of mRNA encoded by C12orf22, corresponding to a HOST TARGET binding site such as BINDING SITE I, BINDING SITE II or BINDING SITE III. Table 2 illustrates the complementarity of the nucleotide sequences of C12orf22 BINDING SITE, designated SEQ ID:25130, to the nucleotide sequence of VGAM543 RNA, herein designated VGAM RNA, also designated SEQ ID:3254.

Another function of VGAM543 is therefore inhibition of Chromosome 12 Open Reading Frame 22 (C12orf22, Accession NM_030809). Accordingly, utilities of VGAM543 include diagnosis, prevention and treatment of diseases and clinical conditions associated with C12orf22. GG2-1 (Accession NM_014350) is another VGAM543 host target gene. GG2-1 BINDING SITE is HOST TARGET binding site found in the 3' untranslated region of mRNA encoded by GG2-1, corresponding to a HOST TARGET binding site such as BINDING SITE I, BINDING SITE II or BINDING SITE III. Table 2 illustrates the complementarity of the nucleotide sequences of GG2-1 BINDING SITE, designated SEQ ID:15678, to the nucleotide sequence of VGAM543 RNA, herein designated VGAM RNA, also designated SEQ ID:3254.

Another function of VGAM543 is therefore inhibition of GG2-1 (Accession NM_014350). Accordingly, utilities of VGAM543 include diagnosis, prevention and treatment of diseases and clinical conditions associated with GG2-1. HT008 (Accession XM_008246) is another VGAM543 host target gene. HT008 BINDING SITE is HOST TARGET binding site found in the 3' untranslated region of mRNA encoded by HT008, corresponding to a HOST TARGET binding site such as BINDING SITE I, BINDING SITE II or BINDING SITE III. Table 2 illustrates the complementarity of the nucleotide sequences of HT008 BINDING SITE, designated SEQ ID:30072, to the nucleotide sequence of VGAM543 RNA, herein designated VGAM RNA, also designated SEQ ID:3254.

Another function of VGAM543 is therefore inhibition of HT008 (Accession XM_008246). Accordingly, utilities of VGAM543 include diagnosis, prevention and treatment of diseases and clinical conditions associated with HT008. KIAA0820 (Accession XM_044463) is another VGAM543 host target gene. KIAA0820 BINDING SITE is HOST TARGET binding site found in the 3' untranslated region of mRNA encoded by KIAA0820, corresponding to a HOST TARGET binding site such as BINDING SITE I, BINDING SITE II or BINDING SITE III. Table 2 illustrates the complementarity of the nucleotide sequences of KIAA0820 BINDING SITE, designated SEQ ID:34218, to the nucleotide sequence of VGAM543 RNA, herein designated VGAM RNA, also designated SEQ ID:3254.

Another function of VGAM543 is therefore inhibition of KIAA0820 (Accession XM_044463). Accordingly, utilities of VGAM543 include diagnosis, prevention and treatment of diseases and clinical conditions associated with KIAA0820. T-cell Leukemia/lymphoma 6 (TCL6, Accession NM_014418) is another VGAM543 host target gene. TCL6 BINDING SITE1 and TCL6 BINDING SITE2 are HOST TARGET binding sites found in untranslated regions of mRNA encoded by TCL6, corresponding to HOST TARGET binding sites such as BINDING SITE I, BINDING SITE II or BINDING SITE III. Table 2 illustrates the complementarity of the nucleotide sequences of TCL6 BINDING SITE1 and TCL6 BINDING SITE2, designated SEQ ID:15766 and SEQ ID:21760 respectively, to the nucleotide sequence of VGAM543 RNA, herein designated VGAM RNA, also designated SEQ ID:3254.

Another function of VGAM543 is therefore inhibition of T-cell Leukemia/lymphoma 6 (TCL6, Accession NM_014418). Accordingly, utilities of VGAM543 include diagnosis, prevention and treatment of diseases and clinical conditions associated with TCL6. LOC154792 (Accession XM_098608) is another VGAM543 host target gene. LOC154792 BINDING SITE is HOST TARGET binding site found in the 5' untranslated region of mRNA encoded by LOC154792, corresponding to a HOST TARGET binding site such as BINDING SITE I, BINDING SITE II or BINDING SITE III. Table 2 illustrates the complementarity of the nucleotide sequences of LOC154792 BINDING SITE, designated SEQ ID:41728, to the nucleotide sequence of VGAM543 RNA, herein designated VGAM RNA, also designated SEQ ID:3254.

Another function of VGAM543 is therefore inhibition of LOC154792 (Accession XM_098608). Accordingly, utilities of VGAM543 include diagnosis, prevention and treatment of diseases and clinical conditions associated with LOC154792. FIG. 1 further provides a conceptual description of a novel bioinformatically detected viral gene of the present invention, referred to here as Viral Genomic Address Messenger 544 (VGAM544) viral gene, which modulates expression of respective host target genes thereof, the function and utility of which host target genes is known in the art.

VGAM544 is a novel bioinformatically detected regulatory, non protein coding, viral micro RNA (miRNA) gene. The method by which VGAM544 was detected is described hereinabove with reference to FIGS. 1-8.

VGAM544 gene, herein designated VGAM GENE, is a viral gene contained in the genome of Infectious Spleen and Kidney Necrosis Virus. VGAM544 host target gene, herein designated VGAM HOST TARGET GENE, is a human gene contained in the human genome.

VGAM544 gene encodes a VGAM544 precursor RNA, herein designated VGAM PRECURSOR RNA. Similar to other miRNA genes, and unlike most ordinary genes, VGAM544 precursor RNA does not encode a protein. A nucleotide sequence identical or highly similar to the nucleotide sequence of VGAM544 precursor RNA is designated SEQ ID:530, and is provided hereinbelow with reference to the sequence listing part. Nucleotide sequence SEQ ID:530 is located at position 22231 relative to the genome of Infectious Spleen and Kidney Necrosis Virus.

VGAM544 precursor RNA folds onto itself, forming VGAM544 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM544 folded precursor RNA into VGAM544 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM544 RNA is designated SEQ ID:3255, and is provided hereinbelow with reference to the sequence listing part.

VGAM544 host target gene, herein designated VGAM HOST TARGET GENE, encodes a corresponding messenger RNA, VGAM544 host target RNA, herein designated VGAM HOST TARGET RNA. VGAM544 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM544 RNA, herein designated VGAM RNA, binds complementarily to one or more host target binding sites located in untranslated regions of VGAM544 host target RNA, herein designated VGAM HOST TARGET RNA. This complementary binding is due to the fact that the nucleotide sequence of VGAM544 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM544 RNA, herein designated VGAM RNA, may have a different number of host target binding sites in untranslated regions of a VGAM544 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM544 RNA, herein designated VGAM RNA, to host target binding sites on VGAM544 host target RNA, herein designated VGAM HOST TARGET RNA, such as BINDING SITE I, BINDING SITE II and BINDING SITE III, inhibits translation of VGAM544 host target RNA into VGAM544 host target protein, herein designated VGAM HOST TARGET PROTEIN. VGAM host target protein is therefore outlined by a broken line.

It is appreciated that VGAM544 host target gene, herein designated VGAM HOST TARGET GENE, in fact represents a plurality of VGAM544 host target genes. The mRNA of each one of this plurality of VGAM544 host target genes comprises one or more host target binding sites, each having a nucleotide sequence which is at least partly complementary to VGAM544 RNA, herein designated VGAM RNA, and which when bound by VGAM544 RNA causes inhibition of translation of respective one or more VGAM544 host target proteins.

It is further appreciated by one skilled in the art that the mode of translational inhibition illustrated by FIG. 1 with specific reference to translational inhibition exerted by VGAM544 gene, herein designated VGAM GENE, on one or more VGAM544 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM544 is inhibition of expression of host target genes, as part of a novel viral mechanism of attacking a host. Accordingly, utilities of VGAM544 include diagnosis, prevention and treatment of viral infection by Infectious Spleen and Kidney Necrosis Virus. Specific functions, and accordingly utilities, of VGAM544 correlate with, and may be deduced from, the identity of the host target genes which VGAM544 binds and inhibits, and the function of these host target genes, as elaborated hereinbelow.

Nucleotide sequences of the VGAM544 precursor RNA, herein designated VGAM PRECURSOR RNA, and of the 'diced' VGAM544 RNA, herein designated VGAM RNA, and a schematic representation of the secondary folding of VGAM544 folded precursor RNA, herein designated VGAM FOLDED PRECURSOR RNA, of VGAM544 are further described hereinbelow with reference to Table 1.

Nucleotide sequences of host target binding sites, such as BINDING SITE-I, BINDING SITE-II and BINDING SITE-III of FIG. 1, found on VGAM544 host target RNA, and schematic representation of the complementarity of each of these host target binding sites to VGAM544 RNA, herein designated VGAM RNA, are described hereinbelow with reference to Table 2.

As mentioned hereinabove with reference to FIG. 1, a function of VGAM544 gene, herein designated VGAM is inhibition of expression of VGAM544 target genes. It is appreciated that specific functions, and accordingly utilities, of VGAM544 correlate with, and may be deduced from, the identity of the target genes which VGAM544 binds and inhibits, and the function of these target genes, as elaborated hereinbelow.

PDX1 (Accession NM_003477) is a VGAM544 host target gene. PDX1 BINDING SITE is HOST TARGET binding site found in the 3' untranslated region of mRNA encoded by PDX1, corresponding to a HOST TARGET binding site such as BINDING SITE I, BINDING SITE II or BINDING SITE III. Table 2 illustrates the complementarity of the nucleotide sequences of PDX1 BINDING SITE, designated SEQ ID:9547, to the nucleotide sequence of VGAM544 RNA, herein designated VGAM RNA, also designated SEQ ID:3255.

A function of VGAM544 is therefore inhibition of PDX1 (Accession NM_003477). Accordingly, utilities of VGAM544 include diagnosis, prevention and treatment of diseases and clinical conditions associated with PDX1. S164 (Accession XM_027330) is another VGAM544 host target gene. S164 BINDING SITE is HOST TARGET binding site found in the 3' untranslated region of mRNA encoded by S164, corresponding to a HOST TARGET binding site such as BINDING SITE I, BINDING SITE II or BINDING SITE III. Table 2 illustrates the complementarity of the nucleotide sequences of S164 BINDING SITE, designated SEQ ID:30483, to the nucleotide sequence of VGAM544 RNA, herein designated VGAM RNA, also designated SEQ ID:3255.

Another function of VGAM544 is therefore inhibition of S164 (Accession XM_027330). Accordingly, utilities of VGAM544 include diagnosis, prevention and treatment of diseases and clinical conditions associated with S164. LOC153338 (Accession XM_098361) is another VGAM544 host target gene. LOC153338 BINDING SITE is HOST TARGET binding site found in the 3' untranslated region of mRNA encoded by LOC153338, corresponding to a HOST TARGET binding site such as BINDING SITE I, BINDING SITE II or BINDING SITE III. Table 2 illustrates the complementarity of the nucleotide sequences of LOC153338 BINDING SITE, designated SEQ ID:41610, to the nucleotide sequence of VGAM544 RNA, herein designated VGAM RNA, also designated SEQ ID:3255.

Another function of VGAM544 is therefore inhibition of LOC153338 (Accession XM_098361). Accordingly, utilities of VGAM544 include diagnosis, prevention and treatment of diseases and clinical conditions associated with LOC153338. LOC220936 (Accession XM_166137) is another VGAM544 host target gene. LOC220936 BINDING SITE is HOST TARGET binding site found in the 3' untranslated region of mRNA encoded by LOC220936, corresponding to a HOST TARGET binding site such as BINDING SITE I, BINDING SITE II or BINDING SITE III. Table 2 illustrates the complementarity of the nucleotide sequences of LOC220936 BINDING SITE, designated SEQ ID:43930, to the nucleotide sequence of VGAM544 RNA, herein designated VGAM RNA, also designated SEQ ID:3255.

Another function of VGAM544 is therefore inhibition of LOC220936 (Accession XM_166137). Accordingly, utilities of VGAM544 include diagnosis, prevention and treatment of diseases and clinical conditions associated with LOC220936. LOC92973 (Accession XM_048529) is another VGAM544 host target gene. LOC92973 BINDING SITE is HOST TARGET binding site found in the 5' untranslated region of mRNA encoded by LOC92973, corresponding to a HOST TARGET binding site such as BINDING SITE I, BINDING SITE II or BINDING SITE III. Table 2 illustrates the complementarity of the nucleotide sequences of LOC92973 BINDING SITE, designated SEQ ID:35184, to the nucleotide sequence of VGAM544 RNA, herein designated VGAM RNA, also designated SEQ ID:3255.

Another function of VGAM544 is therefore inhibition of LOC92973 (Accession XM_048529). Accordingly, utilities of VGAM544 include diagnosis, prevention and treatment of diseases and clinical conditions associated with LOC92973. FIG. 1 further provides a conceptual description of a novel bioinformatically detected viral gene of the present invention, referred to here as Viral Genomic Address Messenger 545 (VGAM545) viral gene, which modulates expression of respective host target genes thereof, the function and utility of which host target genes is known in the art.

VGAM545 is a novel bioinformatically detected regulatory, non protein coding, viral micro RNA (miRNA) gene. The method by which VGAM545 was detected is described hereinabove with reference to FIGS. 1-8.

VGAM545 gene, herein designated VGAM GENE, is a viral gene contained in the genome of Melanoplus Sanguinipes Entomopoxvirus. VGAM545 host target gene, herein designated VGAM HOST TARGET GENE, is a human gene contained in the human genome.

VGAM545 gene encodes a VGAM545 precursor RNA, herein designated VGAM PRECURSOR RNA. Similar to other miRNA genes, and unlike most ordinary genes, VGAM545 precursor RNA does not encode a protein. A nucleotide sequence identical or highly similar to the nucleotide sequence of VGAM545 precursor RNA is designated SEQ ID:531, and is provided hereinbelow with reference to the sequence listing part. Nucleotide sequence SEQ ID:531 is located at position 205892 relative to the genome of Melanoplus Sanguinipes Entomopoxvirus.

VGAM545 precursor RNA folds onto itself, forming VGAM545 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM545 folded precursor RNA into VGAM545 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM545 RNA is designated SEQ ID:3256, and is provided hereinbelow with reference to the sequence listing part.

VGAM545 host target gene, herein designated VGAM HOST TARGET GENE, encodes a corresponding messenger RNA, VGAM545 host target RNA, herein designated VGAM HOST TARGET RNA. VGAM545 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM545 RNA, herein designated VGAM RNA, binds complementarily to one or more host target binding sites located in untranslated regions of VGAM545 host target RNA, herein designated VGAM HOST TARGET RNA. This complementary binding is due to the fact that the nucleotide sequence of VGAM545 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM545 RNA, herein designated VGAM RNA, may have a different number of host target binding sites in untranslated regions of a VGAM545 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM545 RNA, herein designated VGAM RNA, to host target binding sites on VGAM545 host target RNA, herein designated VGAM HOST TARGET RNA, such as BINDING SITE I, BINDING SITE II and BINDING SITE III, inhibits translation of VGAM545 host target RNA into VGAM545 host target protein, herein designated VGAM HOST TARGET PROTEIN. VGAM host target protein is therefore outlined by a broken line.

It is appreciated that VGAM545 host target gene, herein designated VGAM HOST TARGET GENE, in fact represents a plurality of VGAM545 host target genes. The mRNA of each one of this plurality of VGAM545 host target genes comprises one or more host target binding sites, each having a nucleotide sequence which is at least partly complementary to VGAM545 RNA, herein designated VGAM RNA, and which when bound by VGAM545 RNA causes inhibition of translation of respective one or more VGAM545 host target proteins.

It is further appreciated by one skilled in the art that the mode of translational inhibition illustrated by FIG. 1 with specific reference to translational inhibition exerted by VGAM545 gene, herein designated VGAM GENE, on one or more VGAM545 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM545 is inhibition of expression of host target genes, as part of a novel viral mechanism of attacking a host. Accordingly, utilities of VGAM545 include diagnosis, prevention and treatment of viral infection by Melanoplus Sanguinipes Entomopoxvirus. Specific functions, and accordingly utilities, of VGAM545 correlate with, and may be deduced from, the identity of the host target genes which VGAM545 binds and inhibits, and the function of these host target genes, as elaborated hereinbelow.

Nucleotide sequences of the VGAM545 precursor RNA, herein designated VGAM PRECURSOR RNA, and of the 'diced' VGAM545 RNA, herein designated VGAM RNA, and a schematic representation of the secondary folding of VGAM545 folded precursor RNA, herein designated VGAM FOLDED PRECURSOR RNA, of VGAM545 are further described hereinbelow with reference to Table 1.

Nucleotide sequences of host target binding sites, such as BINDING SITE-I, BINDING SITE-II and BINDING SITE-III of FIG. 1, found on VGAM545 host target RNA, and schematic representation of the complementarity of each of these host target binding sites to VGAM545 RNA, herein designated VGAM RNA, are described hereinbelow with reference to Table 2.

As mentioned hereinabove with reference to FIG. 1, a function of VGAM545 gene, herein designated VGAM is inhibition of expression of VGAM545 target genes. It is appreciated that specific functions, and accordingly utilities, of VGAM545 correlate with, and may be deduced from, the identity of the target genes which VGAM545 binds and inhibits, and the function of these target genes, as elaborated hereinbelow.

Sirtuin Silent Mating Type Information Regulation 2 Homolog 5 (S. cerevisiae) (SIRT5, Accession NM_012241) is a VGAM545 host target gene. SIRT5 BINDING SITE is HOST TARGET binding site found in the 5' untranslated region of mRNA encoded by SIRT5, corresponding to a HOST TARGET binding site such as BINDING SITE I, BINDING SITE II or BINDING SITE III. Table 2 illustrates the complementarity of the nucleotide sequences of SIRT5 BINDING SITE, designated SEQ ID:14547, to the nucleotide sequence of VGAM545 RNA, herein designated VGAM RNA, also designated SEQ ID:3256.

A function of VGAM545 is therefore inhibition of Sirtuin Silent Mating Type Information Regulation 2 Homolog 5 (S. cerevisiae) (SIRT5, Accession NM_012241), a gene which acts as a nad-dependent histone deacetylase; silences transcription at telomeres and the ribosomal dna. Accordingly, utilities of VGAM545 include diagnosis, prevention and treatment of diseases and clinical conditions associated with SIRT5. The function of SIRT5 has been established by previous studies. The yeast Sir2 protein (Shore et al., 1984) regulates epigenetic gene silencing and, as a possible antiaging effect, suppresses recombination of rDNA. Studies involving cobB, a bacterial Sir2-like gene, have suggested that Sir2 may encode a pyridine nucleotide transferase. By in silico and PCR-cloning techniques, Frye (1999) obtained cDNA sequences encoding 5 human Sir2-like genes, which they called sirtuin-1 to -5 (SIRT1 to SIRT5). The SIRT1 (OMIM Ref. No. 604479) sequence has the closest homology to the S. cerevisiae Sir2 protein, while SIRT4 (OMIM Ref. No. 604482) and SIRT5 more closely resemble prokaryotic sirtuin sequences. PCR analysis showed that the 5 human sirtuins are widely expressed in fetal and adult tissues. Recombinant human SIRT2 (OMIM Ref. No. 604480) was able to cause radioactivity to be transferred from (32P)NAD to bovine serum albumin (BSA). When a conserved histidine within SIRT2 was converted to tyrosine, the mutant recombinant protein was unable to transfer radioactivity from (32P) NAD to BSA. These results suggested that the sirtuins may function via mono-ADP-ribosylation of proteins. Tanny et al. (1999) showed that the yeast Sir2 protein can transfer labeled phosphate from nicotinamide adenine dinucleotide to itself and histones in vitro. A modified form of Sir2, which results from its automodification activity, was specifically recognized by anti-mono-ADP-ribose antibodies, suggesting that Sir2 is an ADP-ribosyltransferase. Mutation of a phylogenetically invariant histidine (his364 to tyr) in Sir2 abolished both its enzymatic activity in vitro and its silencing functions in vivo. However, the mutant protein was associated with chromatin and other silencing factors in a manner similar to wild-type Sir2. These findings suggested that Sir2 contains an ADP-ribosyltransferase activity that is essential for its silencing function.

Full details of the abovementioned studies are described in the following publications, the disclosure of which are hereby incorporated by reference:

Frye, R. A.: Characterization of five human cDNAs with homology to the yeast SIR2 gene: Sir2-like proteins (sirtuins) metabolize NAD and may have protein ADP-ribosyltransferase activity. Biochem. Biophys. Res. Commun. 260:273-279, 1999; and Tanny, J. C.; Dowd, G. J.; Huang, J.; Hilz, H.; Moazed, D.: An enzymatic activity in the yeast Sir2 protein that is essential for gene silencing. Cell 99:735-745, 1999.

Further studies establishing the function and utilities of SIRT5 are found in John Hopkins OMIM database record ID 604483, and in sited publications numbered 5008, 504 and 5051 listed in the bibliography section hereinbelow, which are also hereby incorporated by reference. Chromosome 20 Open Reading Frame 106 (C20orf106, Accession NM_080824) is another VGAM545 host target gene. C20orf106 BINDING SITE is HOST TARGET binding site found in the 3' untranslated region of mRNA encoded by C20orf106, corresponding to a HOST TARGET binding site such as BINDING SITE I, BINDING SITE II or BINDING SITE III. Table 2 illustrates the complementarity of the nucleotide sequences of C20orf106 BINDING SITE, designated SEQ ID:28090, to the nucleotide sequence of VGAM545 RNA, herein designated VGAM RNA, also designated SEQ ID:3256.

Another function of VGAM545 is therefore inhibition of Chromosome 20 Open Reading Frame 106 (C20orf106, Accession NM_080824). Accordingly, utilities of VGAM545 include diagnosis, prevention and treatment of diseases and clinical conditions associated with C20orf106. LOC151248 (Accession XM_087143) is another VGAM545 host target gene. LOC151248 BINDING SITE is HOST TARGET binding site found in the 5' untranslated region of mRNA encoded by LOC151248, corresponding to a HOST TARGET binding site such as BINDING SITE I, BINDING SITE II or BINDING SITE III. Table 2 illustrates the complementarity of the nucleotide sequences of LOC151248 BINDING SITE, designated SEQ ID:39082, to the nucleotide sequence of VGAM545 RNA, herein designated VGAM RNA, also designated SEQ ID:3256.

Another function of VGAM545 is therefore inhibition of LOC151248 (Accession XM_087143). Accordingly, utilities of VGAM545 include diagnosis, prevention and treatment of diseases and clinical conditions associated with LOC151248. LOC90408 (Accession XM_031517) is another VGAM545 host target gene. LOC90408 BINDING SITE is HOST TARGET binding site found in the 5' untranslated region of mRNA encoded by LOC90408, corresponding to a HOST TARGET binding site such as BINDING SITE I, BINDING SITE II or BINDING SITE III. Table 2 illustrates the complementarity of the nucleotide sequences of LOC90408 BINDING SITE, designated SEQ ID:31393, to the nucleotide sequence of VGAM545 RNA, herein designated VGAM RNA, also designated SEQ ID:3256.

Another function of VGAM545 is therefore inhibition of LOC90408 (Accession XM_031517). Accordingly, utilities of VGAM545 include diagnosis, prevention and treatment of diseases and clinical conditions associated with LOC90408. FIG. 1 further provides a conceptual description of a novel bioinformatically detected viral gene of the present invention, referred to here as Viral Genomic Address Messenger 546 (VGAM546) viral gene, which modulates expression of respective host target genes thereof, the function and utility of which host target genes is known in the art.

VGAM546 is a novel bioinformatically detected regulatory, non protein coding, viral micro RNA (miRNA) gene. The method by which VGAM546 was detected is described hereinabove with reference to FIGS. 1-8.

VGAM546 gene, herein designated VGAM GENE, is a viral gene contained in the genome of Peanut Stunt Virus. VGAM546 host target gene, herein designated VGAM HOST TARGET GENE, is a human gene contained in the human genome.

VGAM546 gene encodes a VGAM546 precursor RNA, herein designated VGAM PRECURSOR RNA. Similar to other miRNA genes, and unlike most ordinary genes, VGAM546 precursor RNA does not encode a protein. A nucleotide sequence identical or highly similar to the nucleotide sequence of VGAM546 precursor RNA is designated SEQ ID:532, and is provided hereinbelow with reference to the sequence listing part. Nucleotide sequence SEQ ID:532 is located at position 1857 relative to the genome of Peanut Stunt Virus.

VGAM546 precursor RNA folds onto itself, forming VGAM546 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM546 folded precursor RNA into VGAM546 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM546 RNA is designated SEQ ID:3257, and is provided hereinbelow with reference to the sequence listing part.

VGAM546 host target gene, herein designated VGAM HOST TARGET GENE, encodes a corresponding messenger RNA, VGAM546 host target RNA, herein designated VGAM HOST TARGET RNA. VGAM546 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM546 RNA, herein designated VGAM RNA, binds complementarily to one or more host target binding sites located in untranslated regions of VGAM546 host target RNA, herein designated VGAM HOST TARGET RNA. This complementary binding is due to the fact that the nucleotide sequence of VGAM546 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM546 RNA, herein designated VGAM RNA, may have a different number of host target binding sites in untranslated regions of a VGAM546 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM546 RNA, herein designated VGAM RNA, to host target binding sites on VGAM546 host target RNA, herein designated VGAM HOST TARGET RNA, such as BINDING SITE I, BINDING SITE II and BINDING SITE III, inhibits translation of VGAM546 host target RNA into VGAM546 host target protein, herein designated VGAM HOST TARGET PROTEIN. VGAM host target protein is therefore outlined by a broken line.

It is appreciated that VGAM546 host target gene, herein designated VGAM HOST TARGET GENE, in fact represents a plurality of VGAM546 host target genes. The mRNA of each one of this plurality of VGAM546 host target genes comprises one or more host target binding sites, each having a nucleotide sequence which is at least partly complementary to VGAM546 RNA, herein designated VGAM RNA, and which when bound by VGAM546 RNA causes inhibition of translation of respective one or more VGAM546 host target proteins.

It is further appreciated by one skilled in the art that the mode of translational inhibition illustrated by FIG. 1 with specific reference to translational inhibition exerted by VGAM546 gene, herein designated VGAM GENE, on one or more VGAM546 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM546 is inhibition of expression of host target genes, as part of a novel viral mechanism of attacking a host. Accordingly, utilities of VGAM546 include diagnosis, prevention and treatment of viral infection by Peanut Stunt Virus. Specific functions, and accordingly utilities, of VGAM546 correlate with, and may be deduced from, the identity of the host target genes which VGAM546 binds and inhibits, and the function of these host target genes, as elaborated hereinbelow.

Nucleotide sequences of the VGAM546 precursor RNA, herein designated VGAM PRECURSOR RNA, and of the 'diced' VGAM546 RNA, herein designated VGAM RNA, and a schematic representation of the secondary folding of VGAM546 folded precursor RNA, herein designated VGAM FOLDED PRECURSOR RNA, of VGAM546 are further described hereinbelow with reference to Table 1.

Nucleotide sequences of host target binding sites, such as BINDING SITE-I, BINDING SITE-II and BINDING SITE-III of FIG. 1, found on VGAM546 host target RNA, and schematic representation of the complementarity of each of these host target binding sites to VGAM546 RNA, herein designated VGAM RNA, are described hereinbelow with reference to Table 2.

As mentioned hereinabove with reference to FIG. 1, a function of VGAM546 gene, herein designated VGAM is inhibition of expression of VGAM546 target genes. It is appreciated that specific functions, and accordingly utilities, of VGAM546 correlate with, and may be deduced from, the identity of the target genes which VGAM546 binds and inhibits, and the function of these target genes, as elaborated hereinbelow.

Chemokine (C-C motif) Receptor-like 1 (CCRL1, Accession NM_016557) is a VGAM546 host target gene. CCRL1 BINDING SITE is HOST TARGET binding site found in the 3' untranslated region of mRNA encoded by CCRL1, corresponding to a HOST TARGET binding site such as BINDING SITE I, BINDING SITE II or BINDING SITE III. Table 2 illustrates the complementarity of the nucleotide sequences of CCRL1 BINDING SITE, designated SEQ ID:18632, to the nucleotide sequence of VGAM546 RNA, herein designated VGAM RNA, also designated SEQ ID:3257.

A function of VGAM546 is therefore inhibition of Chemokine (C-C motif) Receptor-like 1 (CCRL1, Accession NM_016557), a gene which is a G protein-coupled receptor that binds chemokines of the CC subfamily, especially MCP-4, ELC (SCYA19) and TECK (SCYA25). Accordingly, utilities of VGAM546 include diagnosis, prevention and treatment of diseases and clinical conditions associated with CCRL1. The function of CCRL1 has been established by previous studies. Chemokine receptors are members of the 7-transmembrane-spanning, G protein-coupled receptor family that recognize small proteins responsible for the directed migration of specific cell types. Depending on the number of amino acids between the first 2 cysteines of their ligands (they may have more than 1 ligand), chemokine receptors are designated CCR (adjacent cysteines), CXCR (1 amino acid between the cysteines), or CX3CR (3 amino acids between the cysteines). The 'R' designation refers to proteins that not only bind, but also have a signaling function after binding. By searching an EST database for PPR1 homologs, Schweickart et al. (2000) obtained a cDNA encoding CCRL1, which they called CCR11. They initially reported that CCRL1 shares functional similarity to CCR2 (OMIM Ref. No. 601267) because it has a chemotactic response to MCP family chemokines (e.g., MCP2; 602283). However, in an erratum, Schweickart et al. (2000) corrected their functional data and stated that cells expressing CCRL1 do not have a chemotactic response to MCP family chemokines. They confirmed that CCRL1 binds ELC, SLC, and TECK, as reported by Gosling et al. (2000).

Full details of the abovementioned studies are described in the following publications, the disclosure of which are hereby incorporated by reference:

Schweickart, V. L.; Epp, A.; Raport, C. J.; Gray, P. W.: CCR11 is a functional receptor for the monocyte chemoattractant protein family of chemokines. J. Biol. Chem. 275: 9550-9556, 2000. Note: Erratum: J. Biol. Chem. 276:856 only, 2001; and Gosling, J.; Dairaghi, D. J.; Wang, Y.; Hanley, M.; Talbot, D.; Miao, Z.; Schall, T. J.: Cutting edge: identification of a novel chemokine receptor that binds dendritic cell- and T cel.

Further studies establishing the function and utilities of CCRL1 are found in John Hopkins OMIM database record ID 606065, and in sited publications numbered 6908-6339 listed in the bibliography section hereinbelow, which are also hereby incorporated by reference. LOC200845 (Accession XM_114305) is another VGAM546 host target gene. LOC200845 BINDING SITE is HOST TARGET binding site found in the 5' untranslated region of mRNA encoded by LOC200845, corresponding to a HOST TARGET binding site such as BINDING SITE I, BINDING SITE II or BINDING SITE III. Table 2 illustrates the complementarity of the nucleotide sequences of LOC200845 BINDING SITE, designated SEQ ID:42862, to the nucleotide sequence of VGAM546 RNA, herein designated VGAM RNA, also designated SEQ ID:3257.

Another function of VGAM546 is therefore inhibition of LOC200845 (Accession XM_114305). Accordingly, utilities of VGAM546 include diagnosis, prevention and treatment of diseases and clinical conditions associated with LOC200845. LOC221975 (Accession XM_166534) is another VGAM546 host target gene. LOC221975 BINDING SITE is HOST TARGET binding site found in the 3' untranslated region of mRNA encoded by LOC221975, corresponding to a HOST TARGET binding site such as BINDING SITE I, BINDING SITE II or BINDING SITE III. Table 2 illustrates the complementarity of the nucleotide sequences of LOC221975 BINDING SITE, designated SEQ ID:44497, to the nucleotide sequence of VGAM546 RNA, herein designated VGAM RNA, also designated SEQ ID:3257.

Another function of VGAM546 is therefore inhibition of LOC221975 (Accession XM_166534). Accordingly, utilities of VGAM546 include diagnosis, prevention and treatment of diseases and clinical conditions associated with LOC221975. FIG. 1 further provides a conceptual description of a novel bioinformatically detected viral gene of the present invention, referred to here as Viral Genomic Address Messenger 547 (VGAM547) viral gene, which modulates expression of respective host target genes thereof, the function and utility of which host target genes is known in the art.

VGAM547 is a novel bioinformatically detected regulatory, non protein coding, viral micro RNA (miRNA) gene. The method by which VGAM547 was detected is described hereinabove with reference to FIGS. 1-8.

VGAM547 gene, herein designated VGAM GENE, is a viral gene contained in the genome of Peanut Stunt Virus. VGAM547 host target gene, herein designated VGAM HOST TARGET GENE, is a human gene contained in the human genome.

VGAM547 gene encodes a VGAM547 precursor RNA, herein designated VGAM PRECURSOR RNA. Similar to other miRNA genes, and unlike most ordinary genes, VGAM547 precursor RNA does not encode a protein. A nucleotide sequence identical or highly similar to the nucleotide sequence of VGAM547 precursor RNA is designated SEQ ID:533, and is provided hereinbelow with reference to the sequence listing part. Nucleotide sequence SEQ ID:533 is located at position 1186 relative to the genome of Peanut Stunt Virus.

VGAM547 precursor RNA folds onto itself, forming VGAM547 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM547 folded precursor RNA into VGAM547 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM547 RNA is designated SEQ ID:3258, and is provided hereinbelow with reference to the sequence listing part.

VGAM547 host target gene, herein designated VGAM HOST TARGET GENE, encodes a corresponding messenger RNA, VGAM547 host target RNA, herein designated VGAM HOST TARGET RNA. VGAM547 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM547 RNA, herein designated VGAM RNA, binds complementarily to one or more host target binding sites located in untranslated regions of VGAM547 host target RNA, herein designated VGAM HOST TARGET RNA. This complementary binding is due to the fact that the nucleotide sequence of VGAM547 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM547 RNA, herein designated VGAM RNA, may have a different number of host target binding sites in untranslated regions of a VGAM547 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM547 RNA, herein designated VGAM RNA, to host target binding sites on VGAM547 host target RNA, herein designated VGAM HOST TARGET RNA, such as BINDING SITE I, BINDING SITE II and BINDING SITE III, inhibits translation of VGAM547 host target RNA into VGAM547 host target protein, herein designated VGAM HOST TARGET PROTEIN. VGAM host target protein is therefore outlined by a broken line.

It is appreciated that VGAM547 host target gene, herein designated VGAM HOST TARGET GENE, in fact represents a plurality of VGAM547 host target genes. The mRNA of each one of this plurality of VGAM547 host target genes comprises one or more host target binding sites, each having a nucleotide sequence which is at least partly complementary to VGAM547 RNA, herein designated VGAM RNA, and which when bound by VGAM547 RNA causes inhibition of translation of respective one or more VGAM547 host target proteins.

It is further appreciated by one skilled in the art that the mode of translational inhibition illustrated by FIG. 1 with specific reference to translational inhibition exerted by VGAM547 gene, herein designated VGAM GENE, on one or more VGAM547 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM547 is inhibition of expression of host target genes, as part of a novel viral mechanism of attacking a host. Accordingly, utilities of VGAM547 include diagnosis, prevention and treatment of viral infection by Peanut Stunt Virus. Specific functions, and accordingly utilities, of VGAM547 correlate with, and may be deduced from, the identity of the host target genes which VGAM547 binds and inhibits, and the function of these host target genes, as elaborated hereinbelow.

Nucleotide sequences of the VGAM547 precursor RNA, herein designated VGAM PRECURSOR RNA, and of the 'diced' VGAM547 RNA, herein designated VGAM RNA, and a schematic representation of the secondary folding of VGAM547 folded precursor RNA, herein designated VGAM FOLDED PRECURSOR RNA, of VGAM547 are further described hereinbelow with reference to Table 1.

Nucleotide sequences of host target binding sites, such as BINDING SITE-I, BINDING SITE-II and BINDING SITE-III of FIG. 1, found on VGAM547 host target RNA, and schematic representation of the complementarity of each of these host target binding sites to VGAM547 RNA, herein designated VGAM RNA, are described hereinbelow with reference to Table 2.

As mentioned hereinabove with reference to FIG. 1, a function of VGAM547 gene, herein designated VGAM is inhibition of expression of VGAM547 target genes. It is appreciated that specific functions, and accordingly utilities, of VGAM547 correlate with, and may be deduced from, the identity of the target genes which VGAM547 binds and inhibits, and the function of these target genes, as elaborated hereinbelow.

Aspartate Beta-hydroxylase (ASPH, Accession NM_032466) is a VGAM547 host target gene. ASPH BINDING SITE1 and ASPH BINDING SITE2 are HOST TARGET binding sites found in untranslated regions of mRNA encoded by ASPH, corresponding to HOST TARGET binding sites such as BINDING SITE I, BINDING SITE II or BINDING SITE III. Table 2 illustrates the complementarity of the nucleotide sequences of ASPH BINDING SITE1 and ASPH BINDING SITE2, designated SEQ ID:26224 and SEQ ID:26228 respectively, to the nucleotide sequence of VGAM547 RNA, herein designated VGAM RNA, also designated SEQ ID:3258.

A function of VGAM547 is therefore inhibition of Aspartate Beta-hydroxylase (ASPH, Accession NM_032466), a gene which specifically hydroxylates the beta carbon of aspartic acid or asparagine residues in certain epidermal growth factor (EGF)-like domains of a number of proteins. Accordingly, utilities of VGAM547 include diagnosis, prevention and treatment of diseases and clinical conditions associated with ASPH. The function of ASPH and its association with various diseases and clinical conditions, has been established by previous studies, as described hereinabove with reference to VGAM47. Solute Carrier Family 17 (sodium phosphate), Member 4 (SLC17A4, Accession NM_005495) is another VGAM547 host target gene. SLC17A4 BINDING SITE is HOST TARGET binding site found in the 3' untranslated region of mRNA encoded by SLC17A4, corresponding to a HOST TARGET binding site such as BINDING SITE I, BINDING SITE II or BINDING SITE III. Table 2 illustrates the complementarity of the nucleotide sequences of SLC17A4 BINDING SITE, designated SEQ ID:11998, to the nucleotide sequence of VGAM547 RNA, herein designated VGAM RNA, also designated SEQ ID:3258.

Another function of VGAM547 is therefore inhibition of Solute Carrier Family 17 (sodium phosphate), Member 4 (SLC17A4, Accession NM_005495). Accordingly, utilities of VGAM547 include diagnosis, prevention and treatment of diseases and clinical conditions associated with SLC17A4. Chromosome 20 Open Reading Frame 110 (C20orf110, Accession XM_086728) is another VGAM547 host target gene. C20orf110 BINDING SITE is HOST TARGET binding site found in the 3" untranslated region of mRNA encoded by C20orf110, corresponding to a HOST TARGET binding site such as BINDING SITE I, BINDING SITE II or BINDING SITE III. Table 2 illustrates the complementarity of the nucleotide sequences of C20orf110 BINDING SITE, designated SEQ ID:38833, to the nucleotide sequence of VGAM547 RNA, herein designated VGAM RNA, also designated SEQ ID:3258.

Another function of VGAM547 is therefore inhibition of Chromosome 20 Open Reading Frame 110 (C20orf110, Accession XM_086728). Accordingly, utilities of VGAM547 include diagnosis, prevention and treatment of diseases and clinical conditions associated with C20orf110. Zinc Finger Protein 323 (ZNF323, Accession NM_030899) is another VGAM547 host target gene. ZNF323 BINDING SITE is HOST TARGET binding site found in the 3' untranslated region of mRNA encoded by ZNF323, corresponding to a HOST TARGET binding site such as BINDING SITE I, BINDING SITE II or BINDING SITE III. Table 2 illustrates the complementarity of the nucleotide sequences of ZNF323 BINDING SITE, designated SEQ ID:25168, to the nucleotide sequence of VGAM547 RNA, herein designated VGAM RNA, also designated SEQ ID:3258.

Another function of VGAM547 is therefore inhibition of Zinc Finger Protein 323 (ZNF323, Accession NM_030899). Accordingly, utilities of VGAM547 include diagnosis, prevention and treatment of diseases and clinical conditions associated with ZNF323. LOC149619 (Accession XM_097690) is another VGAM547 host target gene. LOC149619 BINDING SITE is HOST TARGET binding site found in the 5' untranslated region of mRNA encoded by LOC149619, corresponding to a HOST TARGET binding site such as BINDING SITE I, BINDING SITE II or BINDING SITE III. Table 2 illustrates the complementarity of the nucleotide sequences of LOC149619 BINDING SITE, designated SEQ ID:41027, to the nucleotide sequence of VGAM547 RNA, herein designated VGAM RNA, also designated SEQ ID:3258.

Another function of VGAM547 is therefore inhibition of LOC149619 (Accession XM_097690). Accordingly, utilities of VGAM547 include diagnosis, prevention and treatment of diseases and clinical conditions associated with LOC149619. FIG. 1 further provides a conceptual description of a novel bioinformatically detected viral gene of the present invention, referred to here as Viral Genomic Address Messenger 548 (VGAM548) viral gene, which modulates expression of respective host target genes thereof, the function and utility of which host target genes is known in the art.

VGAM548 is a novel bioinformatically detected regulatory, non protein coding, viral micro RNA (miRNA) gene. The method by which VGAM548 was detected is described hereinabove with reference to FIGS. 1-8.

VGAM548 gene, herein designated VGAM GENE, is a viral gene contained in the genome of Tomato Leaf Curl Virus. VGAM548 host target gene, herein designated VGAM HOST TARGET GENE, is a human gene contained in the human genome.

VGAM548 gene encodes a VGAM548 precursor RNA, herein designated VGAM PRECURSOR RNA. Similar to other miRNA genes, and unlike most ordinary genes, VGAM548 precursor RNA does not encode a protein. A nucleotide sequence identical or highly similar to the nucleotide sequence of VGAM548 precursor RNA is designated SEQ ID:534, and is provided hereinbelow with reference to the sequence listing part. Nucleotide sequence SEQ ID:534 is located at position 462 relative to the genome of Tomato Leaf Curl Virus.

VGAM548 precursor RNA folds onto itself, forming VGAM548 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM548 folded precursor RNA into VGAM548 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM548 RNA is designated SEQ ID:3259, and is provided hereinbelow with reference to the sequence listing part.

VGAM548 host target gene, herein designated VGAM HOST TARGET GENE, encodes a corresponding messenger RNA, VGAM548 host target RNA, herein designated VGAM HOST TARGET RNA. VGAM548 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM548 RNA, herein designated VGAM RNA, binds complementarily to one or more host target binding sites located in untranslated regions of VGAM548 host target RNA, herein designated VGAM HOST TARGET RNA. This complementary binding is due to the fact that the nucleotide sequence of VGAM548 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM548 RNA, herein designated VGAM RNA, may have a different number of host target binding sites in untranslated regions of a VGAM548 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM548 RNA, herein designated VGAM RNA, to host target binding sites on VGAM548 host target RNA, herein designated VGAM HOST TARGET RNA, such as BINDING SITE I, BINDING SITE II and BINDING SITE III, inhibits translation of VGAM548 host target RNA into VGAM548 host target protein, herein designated VGAM HOST TARGET PROTEIN. VGAM host target protein is therefore outlined by a broken line.

It is appreciated that VGAM548 host target gene, herein designated VGAM HOST TARGET GENE, in fact represents a plurality of VGAM548 host target genes. The mRNA of each one of this plurality of VGAM548 host target genes comprises one or more host target binding sites, each having a nucleotide sequence which is at least partly complementary to VGAM548 RNA, herein designated VGAM RNA, and which when bound by VGAM548 RNA causes inhibition of translation of respective one or more VGAM548 host target proteins.

It is further appreciated by one skilled in the art that the mode of translational inhibition illustrated by FIG. 1 with specific reference to translational inhibition exerted by VGAM548 gene, herein designated VGAM GENE, on one or more VGAM548 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM548 is inhibition of expression of host target genes, as part of a novel viral mechanism of attacking a host. Accordingly, utilities of VGAM548 include diagnosis, prevention and treatment of viral infection by Tomato Leaf Curl Virus. Specific functions, and accordingly utilities, of VGAM548 correlate with, and may be deduced from, the identity of the host target genes which VGAM548 binds and inhibits, and the function of these host target genes, as elaborated hereinbelow.

Nucleotide sequences of the VGAM548 precursor RNA, herein designated VGAM PRECURSOR RNA, and of the 'diced' VGAM548 RNA, herein designated VGAM RNA, and a schematic representation of the secondary folding of VGAM548 folded precursor RNA, herein designated VGAM FOLDED PRECURSOR RNA, of VGAM548 are further described hereinbelow with reference to Table 1.

Nucleotide sequences of host target binding sites, such as BINDING SITE-I, BINDING SITE-II and BINDING SITE-III of FIG. 1, found on VGAM548 host target RNA, and schematic representation of the complementarity of each of these host target binding sites to VGAM548 RNA, herein designated VGAM RNA, are described hereinbelow with reference to Table 2.

As mentioned hereinabove with reference to FIG. 1, a function of VGAM548 gene, herein designated VGAM is inhibition of expression of VGAM548 target genes. It is appreciated that specific functions, and accordingly utilities, of VGAM548 correlate with, and may be deduced from, the identity of the target genes which VGAM548 binds and inhibits, and the function of these target genes, as elaborated hereinbelow.

KIAA0857 (Accession XM_039552) is a VGAM548 host target gene. KIAA0857 BINDING SITE is HOST TARGET binding site found in the 3' untranslated region of mRNA encoded by KIAA0857, corresponding to a HOST TARGET binding site such as BINDING SITE I, BINDING SITE II or BINDING SITE III. Table 2 illustrates the complementarity of the nucleotide sequences of KIAA0857 BINDING SITE, designated SEQ ID:33120, to the nucleotide sequence of VGAM548 RNA, herein designated VGAM RNA, also designated SEQ ID:3259.

A function of VGAM548 is therefore inhibition of KIAA0857 (Accession XM_039552), a gene which is involved in cytoskeletal organization and cellular growth. Accordingly, utilities of VGAM548 include diagnosis, prevention and treatment of diseases and clinical conditions associated with KIAA0857. The function of KIAA0857 has been established by previous studies. RAB11 (see OMIM Ref. No. 604198) is a GTPase that regulates endosomal trafficking to apical plasma membrane domains in polarized epithelial cells. Using protein purification and microsequence analysis, Prekeris et al. (2000) identified a novel RAB11 effector, which they called RIP11. RIP11 is identical to the KIAA0857 open reading frame (Nagase et al., 1998), which encodes a 653-amino acid protein. Northern blot analysis detected 2 major RIP11 transcripts of 4.4 and 6 kb. Both transcripts were enriched in kidney, while other tissues expressed reduced levels of RIP11. Antibodies recognized a protein doublet of 72 kD. RIP11 was found to be enriched in polarized epithelial cells where, like Rab11, it localized to subapical recycling endosomes (AREs) and the apical plasma membrane. Transport assays demonstrated that RIP11 is important for protein trafficking from AREs to the apical plasma membrane. RIP11 is recruited to AREs by binding to RAB11, as well as through a Mg (2+)-dependent interaction of its C2 domain with neutral phospholipids. The association of RIP11 with membranes is regulated by a phosphorylation and dephosphorylation cycle. Prekeris et al. (2000) proposed a model whereby the RAB11/RIP11 complex regulates vesicle targeting from the ARE Full details of the abovementioned studies are described in the following publications, the disclosure of which are hereby incorporated by reference:

Nagase, T.; Ishikawa, K.; Suyama, M.; Kikuno, R.; Hirosawa, M.; Miyajima, N.; Tanaka, A.; Kotani, H.; Nomura, N.; Oharo, O.: Prediction of the coding sequences of unidentified human genes. XII. The complete sequences of 100 new cDNA clones from brain which code for large proteins in vitro. DNA Res. 5:355-364, 1998; and Prekeris, R.; Klumperman, J.; Scheller, R. H.: A Rab11/Rip11 protein complex regulates apical membrane trafficking via recycling endosomes. Molec. Cell 6:1437-1448, 2000.

Further studies establishing the function and utilities of KIAA0857 are found in John Hopkins OMIM database record ID 605536, and in sited publications numbered 2011 listed in the bibliography section hereinbelow, which are also hereby incorporated by reference. Vasoactive Intestinal Peptide Receptor 1 (VIPR1, Accession NM_004624) is another VGAM548 host target gene. VIPR1 BINDING SITE is HOST TARGET binding site found in the 3' untranslated region of mRNA encoded by VIPR1, corresponding to a HOST TARGET binding site such as BINDING SITE I, BINDING SITE II or BINDING SITE III. Table 2 illustrates the complementarity of the nucleotide sequences of VIPR1 BINDING SITE, designated SEQ ID:10992, to the nucleotide sequence of VGAM548 RNA, herein designated VGAM RNA, also designated SEQ ID:3259.

Another function of VGAM548 is therefore inhibition of Vasoactive Intestinal Peptide Receptor 1 (VIPR1, Accession NM_004624), a gene which binds vip and is mediated by g proteins which activate adenylyl cyclase. Accordingly, utilities of VGAM548 include diagnosis, prevention and treatment of diseases and clinical conditions associated with VIPR1. The function of VIPR1 has been established by previous studies. Vasoactive intestinal peptide (VIP; 192320) is an octacosameric neuroendocrine mediator found predominantly in cholinergic presynaptic neurons of the central nervous system and in peripheral peptidergic neurons innervating diverse tissues. Of the many neuroendocrine peptides with immunologic functions, VIP is distinguished by its capacity to affect both B and T cells directly. Distinct subsets of neural, respiratory, gastrointestinal, and immune cells bear specific high-affinity receptors for VIP, which are associated with a guanine nucleotide-binding (G) protein capable of activating adenylate cyclase. Libert et al. (1991) obtained 4 new receptors of the G protein-coupled receptor family by selective amplification and cloning from thyroid cDNA. One of these, termed RDC1, was identified as the VIP receptor by Sreedharan et al. (1991). Libert et al. (1991) mapped the VIPR gene to 2q37 by in situ hybridization. Later information made it doubtful that the gene mapped to 2q37 was in fact the VIP receptor gene (Vassart, 1992). The sequence that was designated GPRN1 by Sreedharan et al. (1991) and mapped to 2q37 was found not to bind VIP by Wenger (1993). Sreedharan et al. (1995) isolated an authentic type I VIP receptor gene and by fluorescence in situ hybridization localized it to the 3p22 band in a region associated with small-cell lung cancer. By interspecific backcross analysis, Hashimoto et al. (1999) mapped the mouse Vipr1 gene to the distal region of chromosome 9, a region that shows homology of synteny with human chromosome 3p. Sreedharan et al. (1993) cloned a human intestinal VIP receptor gene; the deduced amino acid sequence shares 84% identity with the rat lung VIP receptor. Couvineau et al. (1994) isolated 2 VIPR cDNA clones from a human jejunal epithelial cell cDNA library. One encodes a VIP receptor consisting of 460 amino acids and having 7 putative transmembrane domains, as do other G protein-coupled receptors. The other encodes a 495-amino acid VIP receptor-related protein exhibiting 100% homology with the functional VIP receptor over the 428 amino acids at the C-terminal region, but containing a completely divergent 67-amino acid N-terminal domain. When expressed in COS-7 cells, the second protein did not bind radioiodinated VIP, although it was normally addressed at the plasma membrane as assessed by immunofluorescence studies.

Full details of the abovementioned studies are described in the following publications, the disclosure of which are hereby incorporated by reference:

Sreedharan, S. P.; Huang, J.-X.; Cheung, M.-C.; Goetzl, E. J.: Structure, expression, and chromosomal localization of the type I human vasoactive intestinal peptide receptor gene. Proc. Nat. Acad. Sci. 92:2939-2943, 1995; and Couvineau, A.; Rouyer-Fessard, C.; Darmoul, D.; Maoret, J.-J.; Carrero, I.; Ogier-Denis, E.; Laburthe, M.: Human intestinal VIP receptor: cloning and functional expression of two cDNA enc.

Further studies establishing the function and utilities of VIPR1 are found in John Hopkins OMIM database record ID 192321, and in sited publications numbered 9672-9673, 189, 9674-967 and 9743-9744 listed in the bibliography section hereinbelow, which are also hereby incorporated by reference. C16orf5 (Accession NM_013399) is another VGAM548 host target gene. C16orf5 BINDING SITE is HOST TARGET binding site found in the 5' untranslated region of mRNA encoded by C16orf5, corresponding to a HOST TARGET binding site such as BINDING SITE I, BINDING SITE II or BINDING SITE III. Table 2 illustrates the complementarity of the nucleotide sequences of C16orf5 BINDING SITE, designated SEQ ID:15053, to the nucleotide sequence of VGAM548 RNA, herein designated VGAM RNA, also designated SEQ ID:3259.

Another function of VGAM548 is therefore inhibition of C16orf5 (Accession NM_013399). Accordingly, utilities of VGAM548 include diagnosis, prevention and treatment of diseases and clinical conditions associated with C16orf5. KIAA0427 (Accession NM_014772) is another VGAM548 host target gene. KIAA0427 BINDING SITE is HOST TARGET binding site found in the 3' untranslated region of mRNA encoded by KIAA0427, corresponding to a HOST TARGET binding site such as BINDING SITE I, BINDING SITE II or BINDING SITE III. Table 2 illustrates the complementarity of the nucleotide sequences of KIAA0427 BINDING SITE, designated SEQ ID:16575, to the nucleotide sequence of VGAM548 RNA, herein designated VGAM RNA, also designated SEQ ID:3259.

Another function of VGAM548 is therefore inhibition of KIAA0427 (Accession NM_014772). Accordingly, utilities of VGAM548 include diagnosis, prevention and treatment of diseases and clinical conditions associated with KIAA0427. KIAA1163 (Accession XM_086231) is another VGAM548 host target gene. KIAA1163 BINDING SITE is HOST TARGET binding site found in the 3' untranslated region of mRNA encoded by KIAA1163, corresponding to a HOST TARGET binding site such as BINDING SITE I, BINDING SITE II or BINDING SITE III. Table 2 illustrates the complementarity of the nucleotide sequences of KIAA1163 BINDING SITE, designated SEQ ID:38559, to the nucleotide sequence of VGAM548 RNA, herein designated VGAM RNA, also designated SEQ ID:3259.

Another function of VGAM548 is therefore inhibition of KIAA1163 (Accession XM_086231). Accordingly, utilities of VGAM548 include diagnosis, prevention and treatment of diseases and clinical conditions associated with KIAA1163. KIAA1889 (Accession XM_056298) is another VGAM548 host target gene. KIAA1889 BINDING SITE is HOST TARGET binding site found in the 3' untranslated region of mRNA encoded by KIAA1889, corresponding to a HOST TARGET binding site such as BINDING SITE I, BINDING SITE II or BINDING SITE III. Table 2 illustrates the complementarity of the nucleotide sequences of KIAA1889 BINDING SITE, designated SEQ ID:36391, to the nucleotide sequence of VGAM548 RNA, herein designated VGAM RNA, also designated SEQ ID:3259.

Another function of VGAM548 is therefore inhibition of KIAA1889 (Accession XM_056298). Accordingly, utilities of VGAM548 include diagnosis, prevention and treatment of diseases and clinical conditions associated with KIAA1889. MGC5139 (Accession XM_058587) is another VGAM548 host target gene. MGC5139 BINDING SITE is HOST TARGET binding site found in the 5' untranslated region of mRNA encoded by MGC5139, corresponding to a HOST TARGET binding site such as BINDING SITE I, BINDING SITE II or BINDING SITE III. Table 2 illustrates the complementarity of the nucleotide sequences of MGC5139 BINDING SITE, designated SEQ ID:36678, to the nucleotide sequence of VGAM548 RNA, herein designated VGAM RNA, also designated SEQ ID:3259.

Another function of VGAM548 is therefore inhibition of MGC5139 (Accession XM_058587). Accordingly, utilities of VGAM548 include diagnosis, prevention and treatment of diseases and clinical conditions associated with MGC5139. PRO2435 (Accession NM_018527) is another VGAM548 host target gene. PRO2435 BINDING SITE is HOST TARGET binding site found in the 5' untranslated region of mRNA encoded by PRO2435, corresponding to a HOST TARGET binding site such as BINDING SITE I, BINDING SITE II or BINDING SITE III. Table 2 illustrates the complementarity of the nucleotide sequences of PRO2435 BINDING SITE, designated SEQ ID:20602, to the nucleotide sequence of VGAM548 RNA, herein designated VGAM RNA, also designated SEQ ID:3259.

Another function of VGAM548 is therefore inhibition of PRO2435 (Accession NM_018527). Accordingly, utilities of VGAM548 include diagnosis, prevention and treatment of diseases and clinical conditions associated with PRO2435. Three Prime Repair Exonuclease 1 (TREX1, Accession NM_033627) is another VGAM548 host target gene. TREX1 BINDING SITE is HOST TARGET binding site found in the 5' untranslated region of mRNA encoded by TREX1, corresponding to a HOST TARGET binding site such as BINDING SITE I, BINDING SITE II or BINDING SITE III. Table 2 illustrates the complementarity of the nucleotide sequences of TREX1 BINDING SITE, designated SEQ ID:27338, to the nucleotide sequence of VGAM548 RNA, herein designated VGAM RNA, also designated SEQ ID:3259.

Another function of VGAM548 is therefore inhibition of Three Prime Repair Exonuclease 1 (TREX1, Accession NM_033627). Accordingly, utilities of VGAM548 include diagnosis, prevention and treatment of diseases and clinical conditions associated with TREX1. LOC113146 (Accession XM_053817) is another VGAM548 host target gene. LOC113146 BINDING SITE is HOST TARGET binding site found in the 3' untranslated region of mRNA encoded by LOC113146, corresponding to a HOST TARGET binding site such as BINDING SITE I, BINDING SITE II or BINDING SITE III. Table 2 illustrates the complementarity of the nucleotide sequences of LOC113146 BINDING SITE, designated SEQ ID:36128, to the nucleotide sequence of VGAM548 RNA, herein designated VGAM RNA, also designated SEQ ID:3259.

Another function of VGAM548 is therefore inhibition of LOC113146 (Accession XM_053817). Accordingly, utilities of VGAM548 include diagnosis, prevention and treatment of diseases and clinical conditions associated with LOC113146. LOC90826 (Accession XM_034321) is another VGAM548 host target gene. LOC90826 BINDING SITE is HOST TARGET binding site found in the 5' untranslated region of mRNA encoded by LOC90826, corresponding to a HOST TARGET binding site such as BINDING SITE I, BINDING SITE II or BINDING SITE III. Table 2 illustrates the complementarity of the nucleotide sequences of LOC90826 BINDING SITE, designated SEQ ID:32049, to the nucleotide sequence of VGAM548 RNA, herein designated VGAM RNA, also designated SEQ ID:3259.

Another function of VGAM548 is therefore inhibition of LOC90826 (Accession XM_034321). Accordingly, utilities of VGAM548 include diagnosis, prevention and treatment of diseases and clinical conditions associated with LOC90826. LOC92822 (Accession XM_047520) is another VGAM548 host target gene. LOC92822 BINDING SITE is HOST TARGET binding site found in the 3' untranslated region of mRNA encoded by LOC92822, corresponding to a HOST TARGET binding site such as BINDING SITE I, BINDING SITE II or BINDING SITE III. Table 2 illustrates the complementarity of the nucleotide sequences of LOC92822 BINDING SITE, designated SEQ ID:34984, to the nucleotide sequence of VGAM548 RNA, herein designated VGAM RNA, also designated SEQ ID:3259.

Another function of VGAM548 is therefore inhibition of LOC92822 (Accession XM_047520). Accordingly, utilities of VGAM548 include diagnosis, prevention and treatment of diseases and clinical conditions associated with LOC92822. FIG. 1 further provides a conceptual description of a novel bioinformatically detected viral gene of the present invention, referred to here as Viral Genomic Address Messenger 549 (VGAM549) viral gene, which modulates expression of respective host target genes thereof, the function and utility of which host target genes is known in the art.

VGAM549 is a novel bioinformatically detected regulatory, non protein coding, viral micro RNA (miRNA) gene. The method by which VGAM549 was detected is described hereinabove with reference to FIGS. 1-8.

VGAM549 gene, herein designated VGAM GENE, is a viral gene contained in the genome of Leishmania RNA Virus 1-1. VGAM549 host target gene, herein designated VGAM HOST TARGET GENE, is a human gene contained in the human genome.

VGAM549 gene encodes a VGAM549 precursor RNA, herein designated VGAM PRECURSOR RNA. Similar to other miRNA genes, and unlike most ordinary genes, VGAM549 precursor RNA does not encode a protein. A nucleotide sequence identical or highly similar to the nucleotide sequence of VGAM549 precursor RNA is designated SEQ ID:535, and is provided hereinbelow with reference to the sequence listing part. Nucleotide sequence SEQ ID:535 is located at position 1399 relative to the genome of Leishmania RNA Virus 1-1.

VGAM549 precursor RNA folds onto itself, forming VGAM549 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM549 folded precursor RNA into VGAM549 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM549 RNA is designated SEQ ID:3260, and is provided hereinbelow with reference to the sequence listing part.

VGAM549 host target gene, herein designated VGAM HOST TARGET GENE, encodes a corresponding messenger RNA, VGAM549 host target RNA, herein designated VGAM HOST TARGET RNA. VGAM549 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM549 RNA, herein designated VGAM RNA, binds complementarily to one or more host target binding sites located in untranslated regions of VGAM549 host target RNA, herein designated VGAM HOST TARGET RNA. This complementary binding is due to the fact that the nucleotide sequence of VGAM549 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM549 RNA, herein designated VGAM RNA, may have a different number of host target binding sites in untranslated regions of a VGAM549 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM549 RNA, herein designated VGAM RNA, to host target binding sites on VGAM549 host target RNA, herein designated VGAM HOST TARGET RNA, such as BINDING SITE I, BINDING SITE II and BINDING SITE III, inhibits translation of VGAM549 host target RNA into VGAM549 host target protein, herein designated VGAM HOST TARGET PROTEIN. VGAM host target protein is therefore outlined by a broken line.

It is appreciated that VGAM549 host target gene, herein designated VGAM HOST TARGET GENE, in fact represents a plurality of VGAM549 host target genes. The mRNA of each one of this plurality of VGAM549 host target genes comprises one or more host target binding sites, each having a nucleotide sequence which is at least partly complementary to VGAM549 RNA, herein designated VGAM RNA, and which when bound by VGAM549 RNA causes inhibition of translation of respective one or more VGAM549 host target proteins.

It is further appreciated by one skilled in the art that the mode of translational inhibition illustrated by FIG. 1 with specific reference to translational inhibition exerted by VGAM549 gene, herein designated VGAM GENE, on one or more VGAM549 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM549 is inhibition of expression of host target genes, as part of a novel viral mechanism of attacking a host. Accordingly, utilities of VGAM549 include diagnosis, prevention and treatment of viral infection by Leishmania RNA Virus 1-1. Specific functions, and accordingly utilities, of VGAM549 correlate with, and may be deduced from, the identity of the host target genes which VGAM549 binds and inhibits, and the function of these host target genes, as elaborated hereinbelow.

Nucleotide sequences of the VGAM549 precursor RNA, herein designated VGAM PRECURSOR RNA, and of the 'diced' VGAM549 RNA, herein designated VGAM RNA, and a schematic representation of the secondary folding of VGAM549 folded precursor RNA, herein designated VGAM FOLDED PRECURSOR RNA, of VGAM549 are further described hereinbelow with reference to Table 1.

Nucleotide sequences of host target binding sites, such as BINDING SITE-I, BINDING SITE-II and BINDING SITE-III of FIG. 1, found on VGAM549 host target RNA, and schematic representation of the complementarity of each of these host target binding sites to VGAM549 RNA, herein designated VGAM RNA, are described hereinbelow with reference to Table 2.

As mentioned hereinabove with reference to FIG. 1, a function of VGAM549 gene, herein designated VGAM is inhibition of expression of VGAM549 target genes. It is appreciated that specific functions, and accordingly utilities, of VGAM549 correlate with, and may be deduced from, the identity of the target genes which VGAM549 binds and inhibits, and the function of these target genes, as elaborated hereinbelow.

Acyl-Coenzyme A Dehydrogenase, Short/branched Chain (ACADSB, Accession NM_001609) is a VGAM549 host target gene. ACADSB BINDING SITE is HOST TARGET binding site found in the 3' untranslated region of mRNA encoded by ACADSB, corresponding to a HOST TARGET binding site such as BINDING SITE I, BINDING SITE II or BINDING SITE III. Table 2 illustrates the complementarity of the nucleotide sequences of ACADSB BINDING SITE, designated SEQ ID:7312, to the nucleotide sequence of VGAM549 RNA, herein designated VGAM RNA, also designated SEQ ID:3260.

A function of VGAM549 is therefore inhibition of Acyl-Coenzyme A Dehydrogenase, Short/branched Chain (ACADSB, Accession NM_001609). Accordingly, utilities of VGAM549 include diagnosis, prevention and treatment of diseases and clinical conditions associated with ACADSB. Arginine Vasopressin Receptor 1A (AVPR1A, Accession NM_000706) is another VGAM549 host target gene. AVPR1A BINDING SITE is HOST TARGET binding site found in the 5' untranslated region of mRNA encoded by AVPR1A, corresponding to a HOST TARGET binding site such as BINDING SITE I, BINDING SITE II or BINDING SITE III. Table 2 illustrates the complementarity of the nucleotide sequences of AVPR1A BINDING SITE, designated SEQ ID:6375, to the nucleotide sequence of VGAM549 RNA, herein designated VGAM RNA, also designated SEQ ID:3260.

Another function of VGAM549 is therefore inhibition of Arginine Vasopressin Receptor 1A (AVPR1A, Accession NM_000706), a gene which mediates cell contraction and proliferation, platelet aggregation, release of coagulation factor, and glycogenolysis. Accordingly, utilities of VGAM549 include diagnosis, prevention and treatment of diseases and clinical conditions associated with AVPR1A. The function of AVPR1A has been established by previous studies. The antidiuretic hormone vasopressin (OMIM Ref. No. 192340) is a cyclic nonapeptide involved in the control of body fluid osmolality, blood volume, blood pressure, and vascular tone. It acts by binding to G protein-coupled membrane receptors (see OMIM Ref. No. AVPR1B, 600264). One member of this receptor family is AVPR1A, which mediates cell contraction and proliferation, platelet aggregation, release of coagulation factor, and glycogenolysis. AVP action through the V1A receptor is mediated by activating phospholipase C, which in turn stimulates phosphatidylinositol turnover to increase intracellular calcium ion. Morel et al. (1992) cloned the rat hepatocyte V1A receptor. Based on that sequence, Thibonnier et al. (1994) screened a human liver cDNA library. The cDNA encodes a predicted protein of 418 amino acids with 7 putative transmembrane domains as seen in other G protein-coupled receptors. The protein was 72% identical to the rat sequence and 36% identical to the human V2 receptor (see OMIM Ref. No. 304800). Human oxytocin receptor (OMIM Ref. No. 167055) was 45% similar to AVPR1A. Recombinant V1A was expressed and localized to the cell surface. Birnbaumer (2000) noted that the biologic effects of AVP are mediated by 3 receptor subtypes: the V1A and V1B receptors that activate phospholipases via Gq/11, and the V2 receptor that activates adenylyl cyclase by interacting with GS. Isolation of the cDNAs encoding the V1A and V1B receptor subtypes explained the tissue variability of V1 antagonist binding, whereas identification of the cDNA and gene encoding the V2 receptor provided the information to identify the mutations responsible for X-linked nephrogenic diabetes insipidus (OMIM Ref. No. 304800). Mutations that abrogate the production and/or release of AVP from the pituitary have diabetes insipidus as their most dramatic manifestation, indicating that the maintenance of water homeostasis is the most important physiologic role of this neuropeptide. Animal model experiments lend further support to the function of AVPR1A. Arginine vasopressin influences male reproductive and social behaviors in several vertebrate taxa through its actions at the V1A receptor in the brain. The neuroanatomic distribution of vasopressin V1A receptors varies greatly between species with different forms of social organization. Young et al. (1999) demonstrated that centrally administered arginine vasopressin increases affiliative behavior in the highly social, monogamous prairie vole, but not in the relatively asocial, promiscuous montane vole. While no significant differences were found in the coding regions of the V1A receptor of the 2 species, the 5-prime flanking region of the V1A gene displayed marked differences between the species. In the prairie vole V1A receptor gene, the 5-prime flanking region contained a 428-bp sequence that is rich in microsatellite DNA. This sequence was not found in the montane vole V1A gene, and sequences on either side of the expansion were contiguous in the montane vole gene. Another monogamous vole, the pine vole, was found to have the same 428-bp sequence in the 5-prime flanking region. Young et al. (1999) generated mice that were transgenic for the prairie vole receptor gene and found that they had a neuroanatomic pattern of receptor binding that was similar to that of the prairie vole and exhibited increased affiliative behavior after injection with arginine vasopressin. Young et al. (1999) concluded that the pattern of V1A receptor gene expression in the brain may be functionally associated with species-typical social behaviors in male vertebrates.

It is appreciated that the abovementioned animal model for AVPR1A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Birnbaumer, M.: Vasopressin receptors. TEM 11:406-410, 2000; and

Young, L. J.; Nilsen, R.; Waymire, K. G.; MacGregor, G. R.; Insel, T. R.: Increased affiliative response to vasopressin in mice expressing the V(1A) receptor from a monogamous vole. Na.

Further studies establishing the function and utilities of AVPR1A are found in John Hopkins OMIM database record ID 600821, and in sited publications numbered 737 and 7531-7535 listed in the bibliography section hereinbelow, which are also hereby incorporated by reference. T-cell Acute Lymphocytic Leukemia 1 (TAL1, Accession NM_003189) is another VGAM549 host target gene. TAL1 BINDING SITE is HOST TARGET binding site found in the 3' untranslated region of mRNA encoded by TAL1, corresponding to a HOST TARGET binding site such as BINDING SITE I, BINDING SITE II or BINDING SITE III. Table 2 illustrates the complementarity of the nucleotide sequences of TAL1 BINDING SITE, designated SEQ ID:9170, to the nucleotide sequence of VGAM549 RNA, herein designated VGAM RNA, also designated SEQ ID:3260.

Another function of VGAM549 is therefore inhibition of T-cell Acute Lymphocytic Leukemia 1 (TAL1, Accession NM_003189), a gene which may help control cell growth and differentiation. Accordingly, utilities of VGAM549 include diagnosis, prevention and treatment of diseases and clinical conditions associated with TAL1. The function of TAL1 and its association with various diseases and clinical conditions, has been established by previous studies, as described hereinabove with reference to VGAM172. Cadherin-like 26 (CDH26, Accession NM_021810) is another VGAM549 host target gene. CDH26 BINDING SITE is HOST TARGET binding site found in the 3' untranslated region of mRNA encoded by CDH26, corresponding to a HOST TARGET binding site such as BINDING SITE I, BINDING SITE II or BINDING SITE III. Table 2 illustrates the complementarity of the nucleotide sequences of CDH26 BINDING SITE, designated SEQ ID:22371, to the nucleotide sequence of VGAM549 RNA, herein designated VGAM RNA, also designated SEQ ID:3260.

Another function of VGAM549 is therefore inhibition of Cadherin-like 26 (CDH26, Accession NM_021810). Accordingly, utilities of VGAM549 include diagnosis, prevention and treatment of diseases and clinical conditions associated with CDH26. FLJ12587 (Accession NM_022480) is another VGAM549 host target gene. FLJ12587 BINDING SITE is HOST TARGET binding site found in the 3' untranslated region of mRNA encoded by FLJ12587, corresponding to a HOST TARGET binding site such as BINDING SITE I, BINDING SITE II or BINDING SITE III. Table 2 illustrates the complementarity of the nucleotide sequences of FLJ12587 BINDING SITE, designated SEQ ID:22849, to the nucleotide sequence of VGAM549 RNA, herein designated VGAM RNA, also designated SEQ ID:3260.

Another function of VGAM549 is therefore inhibition of FLJ12587 (Accession NM_022480). Accordingly, utilities of VGAM549 include diagnosis, prevention and treatment of diseases and clinical conditions associated with FLJ12587. FLJ20073 (Accession NM_017654) is another VGAM549 host target gene. FLJ20073 BINDING SITE is HOST TARGET binding site found in the 3' untranslated region of mRNA encoded by FLJ20073, corresponding to a HOST TARGET binding site such as BINDING SITE I, BINDING SITE II or BINDING SITE III. Table 2 illustrates the complementarity of the nucleotide sequences of FLJ20073 BINDING SITE, designated SEQ ID:19163, to the nucleotide sequence of VGAM549 RNA, herein designated VGAM RNA, also designated SEQ ID:3260.

Another function of VGAM549 is therefore inhibition of FLJ20073 (Accession NM_017654). Accordingly, utilities of VGAM549 include diagnosis, prevention and treatment of diseases and clinical conditions associated with FLJ20073. MGC15875 (Accession NM_032921) is another VGAM549 host target gene. MGC15875 BINDING SITE is HOST TARGET binding site found in the 5' untranslated region of mRNA encoded by MGC15875, corresponding to a HOST TARGET binding site such as BINDING SITE I, BINDING SITE II or BINDING SITE III. Table 2 illustrates the complementarity of the nucleotide sequences of MGC15875 BINDING SITE, designated SEQ ID:26746, to the nucleotide sequence of VGAM549 RNA, herein designated VGAM RNA, also designated SEQ ID:3260.

Another function of VGAM549 is therefore inhibition of MGC15875 (Accession NM_032921). Accordingly, utilities of VGAM549 include diagnosis, prevention and treatment of diseases and clinical conditions associated with MGC15875. MGC2654 (Accession NM_024109) is another VGAM549 host target gene. MGC2654 BINDING SITE is HOST TARGET binding site found in the 3' untranslated region of mRNA encoded by MGC2654, corresponding to a HOST TARGET binding site such as BINDING SITE I, BINDING SITE II or BINDING SITE III. Table 2 illustrates the complementarity of the nucleotide sequences of MGC2654 BINDING SITE, designated SEQ ID:23553, to the nucleotide sequence of VGAM549 RNA, herein designated VGAM RNA, also designated SEQ ID:3260.

Another function of VGAM549 is therefore inhibition of MGC2654 (Accession NM_024109). Accordingly, utilities of VGAM549 include diagnosis, prevention and treatment of diseases and clinical conditions associated with MGC2654. LOC255251 (Accession XM_171096) is another VGAM549 host target gene. LOC255251 BINDING SITE is HOST TARGET binding site found in the 5' untranslated region of mRNA encoded by LOC255251, corresponding to a HOST TARGET binding site such as BINDING SITE I, BINDING SITE II or BINDING SITE III. Table 2 illustrates the complementarity of the nucleotide sequences of LOC255251 BINDING SITE, designated SEQ ID:45907, to the nucleotide sequence of VGAM549 RNA, herein designated VGAM RNA, also designated SEQ ID:3260.

Another function of VGAM549 is therefore inhibition of LOC255251 (Accession XM_171096). Accordingly, utilities of VGAM549 include diagnosis, prevention and treatment of diseases and clinical conditions associated with LOC255251. FIG. 1 further provides a conceptual description of a novel bioinformatically detected viral gene of the present invention, referred to here as Viral Genomic Address Messenger 550 (VGAM550) viral gene, which modulates expression of respective host target genes thereof, the function and utility of which host target genes is known in the art.

VGAM550 is a novel bioinformatically detected regulatory, non protein coding, viral micro RNA (miRNA) gene. The method by which VGAM550 was detected is described hereinabove with reference to FIGS. 1-8.

VGAM550 gene, herein designated VGAM GENE, is a viral gene contained in the genome of Leishmania RNA Virus 2-1. VGAM550 host target gene, herein designated VGAM HOST TARGET GENE, is a human gene contained in the human genome.

VGAM550 gene encodes a VGAM550 precursor RNA, herein designated VGAM PRECURSOR RNA. Similar to other miRNA genes, and unlike most ordinary genes, VGAM550 precursor RNA does not encode a protein. A nucleotide sequence identical or highly similar to the nucleotide sequence of VGAM550 precursor RNA is designated SEQ ID:536, and is provided hereinbelow with reference to the sequence listing part. Nucleotide sequence SEQ ID:536 is located at position 4755 relative to the genome of Leishmania RNA Virus 2-1.

VGAM550 precursor RNA folds onto itself, forming VGAM550 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM550 folded precursor RNA into VGAM550 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM550 RNA is designated SEQ ID:3261, and is provided hereinbelow with reference to the sequence listing part.

VGAM550 host target gene, herein designated VGAM HOST TARGET GENE, encodes a corresponding messenger RNA, VGAM550 host target RNA, herein designated VGAM HOST TARGET RNA. VGAM550 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM550 RNA, herein designated VGAM RNA, binds complementarily to one or more host target binding sites located in untranslated regions of VGAM550 host target RNA, herein designated VGAM HOST TARGET RNA. This complementary binding is due to the fact that the nucleotide sequence of VGAM550 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM550 RNA, herein designated VGAM RNA, may have a different number of host target binding sites in untranslated regions of a VGAM550 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM550 RNA, herein designated VGAM RNA, to host target binding sites on VGAM550 host target RNA, herein designated VGAM HOST TARGET RNA, such as BINDING SITE I, BINDING SITE II and BINDING SITE III, inhibits translation of VGAM550 host target RNA into VGAM550 host target protein, herein designated VGAM HOST TARGET PROTEIN. VGAM host target protein is therefore outlined by a broken line.

It is appreciated that VGAM550 host target gene, herein designated VGAM HOST TARGET GENE, in fact represents a plurality of VGAM550 host target genes. The mRNA of each one of this plurality of VGAM550 host target genes comprises one or more host target binding sites, each having a nucleotide sequence which is at least partly complementary to VGAM550 RNA, herein designated VGAM RNA, and which when bound by VGAM550 RNA causes inhibition of translation of respective one or more VGAM550 host target proteins.

It is further appreciated by one skilled in the art that the mode of translational inhibition illustrated by FIG. 1 with specific reference to translational inhibition exerted by VGAM550 gene, herein designated VGAM GENE, on one or more VGAM550 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM550 is inhibition of expression of host target genes, as part of a novel viral mechanism of attacking a host. Accordingly, utilities of VGAM550 include diagnosis, prevention and treatment of viral infection by Leishmania RNA Virus 2-1. Specific functions, and accordingly utilities, of VGAM550 correlate with, and may be deduced from, the identity of the host target genes which VGAM550 binds and inhibits, and the function of these host target genes, as elaborated hereinbelow.

Nucleotide sequences of the VGAM550 precursor RNA, herein designated VGAM PRECURSOR RNA, and of the 'diced' VGAM550 RNA, herein designated VGAM RNA, and a schematic representation of the secondary folding of VGAM550 folded precursor RNA, herein designated VGAM FOLDED PRECURSOR RNA, of VGAM550 are further described hereinbelow with reference to Table 1.

Nucleotide sequences of host target binding sites, such as BINDING SITE-I, BINDING SITE-II and BINDING SITE-III of FIG. 1, found on VGAM550 host target RNA, and schematic representation of the complementarity of each of these host target binding sites to VGAM550 RNA, herein designated VGAM RNA, are described hereinbelow with reference to Table 2.

As mentioned hereinabove with reference to FIG. 1, a function of VGAM550 gene, herein designated VGAM is inhibition of expression of VGAM550 target genes. It is appreciated that specific functions, and accordingly utilities, of VGAM550 correlate with, and may be deduced from, the identity of the target genes which VGAM550 binds and inhibits, and the function of these target genes, as elaborated hereinbelow.

Carnitine O-octanoyltransferase (CROT, Accession NM_021151) is a VGAM550 host target gene. CROT BINDING SITE is HOST TARGET binding site found in the 3' untranslated region of mRNA encoded by CROT, corresponding to a HOST TARGET binding site such as BINDING SITE I, BINDING SITE II or BINDING SITE III. Table 2 illustrates the complementarity of the nucleotide sequences of CROT BINDING SITE, designated SEQ ID:22124, to the nucleotide sequence of VGAM550 RNA, herein designated VGAM RNA, also designated SEQ ID:3261.

A function of VGAM550 is therefore inhibition of Carnitine O-octanoyltransferase (CROT, Accession NM_021151), a gene which CROT plays a crucial role in the beta-oxidation of branched-chain fatty acids including pristanic acid. Accordingly, utilities of VGAM550 include diagnosis, prevention and treatment of diseases and clinical conditions associated with CROT. The function of CROT and its association with various diseases and clinical conditions, has been established by previous studies, as described hereinabove with reference to VGAM70. Follistatin-like 3 (secreted glycoprotein) (FSTL3, Accession NM_005860) is another VGAM550 host target gene. FSTL3 BINDING SITE is HOST TARGET binding site found in the 3' untranslated region of mRNA encoded by FSTL3, corresponding to a HOST TARGET binding site such as BINDING SITE I, BINDING SITE II or BINDING SITE III. Table 2 illustrates the complementarity of the nucleotide sequences of FSTL3 BINDING SITE, designated SEQ ID:12472, to the nucleotide sequence of VGAM550 RNA, herein designated VGAM RNA, also designated SEQ ID:3261.

Another function of VGAM550 is therefore inhibition of Follistatin-like 3 (secreted glycoprotein) (FSTL3, Accession NM_005860), a gene which is a member of the follistatin-module-protein family. Accordingly, utilities of VGAM550 include diagnosis, prevention and treatment of diseases and clinical conditions associated with FSTL3. The function of FSTL3 and its association with various diseases and clinical conditions, has been established by previous studies, as described hereinabove with reference to VGAM200. Glutamic-oxaloacetic Transaminase 1, Soluble (aspartate aminotransferase 1) (GOT1, Accession NM_002079) is another VGAM550 host target gene. GOT1 BINDING SITE is HOST TARGET binding site found in the 3' untranslated region of mRNA encoded by GOT1, corresponding to a HOST TARGET binding site such as BINDING SITE I, BINDING SITE II or BINDING SITE III. Table 2 illustrates the complementarity of the nucleotide sequences of GOT1 BINDING SITE, designated SEQ ID:7867, to the nucleotide sequence of VGAM550 RNA, herein designated VGAM RNA, also designated SEQ ID:3261.

Another function of VGAM550 is therefore inhibition of Glutamic-oxaloacetic Transaminase 1, Soluble (aspartate aminotransferase 1) (GOT1, Accession NM_002079), a gene which reversiblly transfers amino group from aspartate to 2-oxoglutarate to form oxaloacetate and glutamate. Accordingly, utilities of VGAM550 include diagnosis, prevention and treatment of diseases and clinical conditions associated with GOT1. The function of GOT1 has been established by previous studies. Glutamate oxaloacetate transaminase (EC 2.6.1.1) is a ubiquitous pyridoxal phosphate-dependent enzyme which exists in both mitochondrial (OMIM Ref. No. 138150) and cytosolic forms. The enzyme plays an important role in amino acid metabolism and in the urea and tricarboxylic acid cycles. The 2 isoenzymes are homodimeric. In liver about 80% of the enzyme activity is mitochondrial in origin, whereas in serum the enzyme activity is largely cytosolic. Although the mitochondrial and soluble forms of GOT are coded by different chromosomes (according to a rule that has few exceptions; McKusick, 1986), the 2 show close homology in amino acid sequence and were presumably derived from a common ancestral gene (Ford et al., 1980; Doonan et al., 1984). Panteghini (1990) reviewed the clinical usefulness of assays for aspartate aminotransferase (AST) isoenzymes in serum. By analysis of mouse-human somatic cell hybrids, Creagan et al. (1973) concluded that the structural locus for cytoplasmic glutamate oxaloacetate transaminase is on chromosome 10. Spritz et al. (1979) studied soluble GOT activity in fibroblasts of 2 persons with duplications of the long arm of chromosome 10. Since the 2 differed by only half a band, the authors concluded that the structural locus is on band 10q24. Koch et al. (1981) pointed out that GOT1 and LIPA (OMIM Ref. No. 278000) are also syntenic on chromosome 19 of the mouse. Junien et al. (1982) assigned GOT1 and PGAMA (OMIM Ref. No. 172250) to 10q26.1 (or 10q25.3) by dosage studies. Pol et al. (1988) cloned cDNAs corresponding to human liver cytosolic and mitochondrial aspartate aminotransferase mRNAs. Pol et al. (1989) used these cDNA probes to locate the GOT1 gene in the region 10q24.1-q25.1 by in situ hybridization. Wang et al. (1999) located the GOT1 gene within the critical region for the urofacial syndrome (OMIM Ref. No. 236730), between markers D10S198 and D10S2494, but excluded it as a candidate for that disorder by mutation analysis.

Full details of the abovementioned studies are described in the following publications, the disclosure of which are hereby incorporated by reference:

McKusick, V. A.: The morbid anatomy of the human genome: a review of gene mapping in clinical medicine (part 1). Medicine 65:1-33, 1986. ; and Wang, C.-Y.; Huang, Y.-Q.; Shi, J.-O.; Marron, M. P.; Ruan, Q.-G.; Hawkins-Lee, B.; Ochoa, B.; She, J.-X.: Genetic homogeneity, high-resolution mapping, and mutation analysis of the u.

Further studies establishing the function and utilities of GOT1 are found in John Hopkins OMIM database record ID 138180, and in sited publications numbered 11913-11914, 2988, 11915-11917, 11921, 11927-11929, 1882, 378 and 11930-11934 listed in the bibliography section hereinbelow, which are also hereby incorporated by reference. Stress 70 Protein Chaperone, Microsome-associated, 60 kDa (STCH, Accession NM_006948) is another VGAM550 host target gene. STCH BINDING SITE is HOST TARGET binding site found in the 3' untranslated region of mRNA encoded by STCH, corresponding to a HOST TARGET binding site such as BINDING SITE I, BINDING SITE II or BINDING SITE III. Table 2 illustrates the complementarity of the nucleotide sequences of STCH BINDING SITE, designated SEQ ID:13836, to the nucleotide sequence of VGAM550 RNA, herein designated VGAM RNA, also designated SEQ ID:3261.

Another function of VGAM550 is therefore inhibition of Stress 70 Protein Chaperone, Microsome-associated, 60 kDa (STCH, Accession NM_006948), a gene which has peptide-independent atpase activity. Accordingly, utilities of VGAM550 include diagnosis, prevention and treatment of diseases and clinical conditions associated with STCH. The function of STCH has been established by previous studies. The stress-70 chaperone family consists of proteins that bind to denatured or incorrectly folded polypeptides and play a major role in the processing of cytosolic and secretory proteins. Otterson et al. (1994) cloned a human cDNA encoding a predicted 471-amino acid protein (60 kD) which they designated STCH. Brodsky et al. (1995) stated that the protein sequence is very similar to that of HSP70 (OMIM Ref. No. 140550) and BiP (OMIM Ref. No. 138120). As with other members of the family, the STCH protein contains an ATPase domain at the amino terminus whose activity was shown to be independent of peptide stimulation. The protein was found to be microsome-associated and constitutively expressed in all cell types examined. Brodsky et al. (1995) mapped the STCH gene to chromosome 21q11.1 with a high-resolution somatic cell hybrid panel for chromosome 21 and by fluorescence in situ hybridization with a YAC containing the gene. By interspecific backcross analysis, Reeves et al. (1998) mapped the mouse Stch gene to chromosome 16.

Full details of the abovementioned studies are described in the following publications, the disclosure of which are hereby incorporated by reference:

Brodsky, G.; Otterson, G. A.; Parry, B. B.; Hart, I.; Patterson, D.; Kaye, F. J. : Localization of STCH to human chromosome 21q11.1. Genomics 30: 627-628, 1995; and Otterson, G. A.; Flynn, G. C.; Kratzke, R. A.; Coxon, A.; Johnston, P. G.; Kaye, F. J.: Stch encodes the 'ATPase core' of a microsomal stress70 protein. EMBO J. 13:1216-1225, 1994.

Further studies establishing the function and utilities of STCH are found in John Hopkins OMIM database record ID 601100, and in sited publications numbered 9629-9631 listed in the bibliography section hereinbelow, which are also hereby incorporated by reference. Chromosome 9 Open Reading Frame 14 (C9orf14, Accession XM_098859) is another VGAM550 host target gene. C9orf14 BINDING SITE is HOST TARGET binding site found in the 5' untranslated region of mRNA encoded by C9orf14, corresponding to a HOST TARGET binding site such as BINDING SITE I, BINDING SITE II or BINDING SITE III. Table 2 illustrates the complementarity of the nucleotide sequences of C9orf14 BINDING SITE, designated SEQ ID:41911, to the nucleotide sequence of VGAM550 RNA, herein designated VGAM RNA, also designated SEQ ID:3261.

Another function of VGAM550 is therefore inhibition of Chromosome 9 Open Reading Frame 14 (C9orf14, Accession XM_098859). Accordingly, utilities of VGAM550 include diagnosis, prevention and treatment of diseases and clinical conditions associated with C9orf14. DKFZp547A023 (Accession XM_052065) is another VGAM550 host target gene. DKFZp547A023 BINDING SITE is HOST TARGET binding site found in the 5' untranslated region of mRNA encoded by DKFZp547A023, corresponding to a HOST TARGET binding site such as BINDING SITE I, BINDING SITE II or BINDING SITE III. Table 2 illustrates the complementarity of the nucleotide sequences of DKFZp547A023 BINDING SITE, designated SEQ ID:35944, to the nucleotide sequence of VGAM550 RNA, herein designated VGAM RNA, also designated SEQ ID:3261.

Another function of VGAM550 is therefore inhibition of DKFZp547A023 (Accession XM_052065). Accordingly, utilities of VGAM550 include diagnosis, prevention and treatment of diseases and clinical conditions associated with DKFZp547A023. 5-hydroxytryptamine (serotonin) Receptor 3A (HTR3A, Accession NM_000869) is another VGAM550 host target gene. HTR3A BINDING SITE is HOST TARGET binding site found in the 5' untranslated region of mRNA encoded by HTR3A, corresponding to a HOST TARGET binding site such as BINDING SITE I, BINDING SITE II or BINDING SITE III. Table 2 illustrates the complementarity of the nucleotide sequences of HTR3A BINDING SITE, designated SEQ ID:6537, to the nucleotide sequence of VGAM550 RNA, herein designated VGAM RNA, also designated SEQ ID:3261.

Another function of VGAM550 is therefore inhibition of 5-hydroxytryptamine (serotonin) Receptor 3A (HTR3A, Accession NM_000869). Accordingly, utilities of VGAM550 include diagnosis, prevention and treatment of diseases and clinical conditions associated with HTR3A. FIG. 1 further provides a conceptual description of a novel bioinformatically detected viral gene of the present invention, referred to here as Viral Genomic Address Messenger 551 (VGAM551) viral gene, which modulates expression of respective host target genes thereof, the function and utility of which host target genes is known in the art.

VGAM551 is a novel bioinformatically detected regulatory, non protein coding, viral micro RNA (miRNA) gene. The method by which VGAM551 was detected is described hereinabove with reference to FIGS. 1-8.

VGAM551 gene, herein designated VGAM GENE, is a viral gene contained in the genome of Leishmania RNA Virus 2-1. VGAM551 host target gene, herein designated VGAM HOST TARGET GENE, is a human gene contained in the human genome.

VGAM551 gene encodes a VGAM551 precursor RNA, herein designated VGAM PRECURSOR RNA. Similar to other miRNA genes, and unlike most ordinary genes, VGAM551 precursor RNA does not encode a protein. A nucleotide sequence identical or highly similar to the nucleotide sequence of VGAM551 precursor RNA is designated SEQ ID:537, and is provided hereinbelow with reference to the sequence listing part. Nucleotide sequence SEQ ID:537 is located at position 3584 relative to the genome of Leishmania RNA Virus 2-1.

VGAM551 precursor RNA folds onto itself, forming VGAM551 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM551 folded precursor RNA into VGAM551 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM551 RNA is designated SEQ ID:3262, and is provided hereinbelow with reference to the sequence listing part.

VGAM551 host target gene, herein designated VGAM HOST TARGET GENE, encodes a corresponding messenger RNA, VGAM551 host target RNA, herein designated VGAM HOST TARGET RNA. VGAM551 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM551 RNA, herein designated VGAM RNA, binds complementarily to one or more host target binding sites located in untranslated regions of VGAM551 host target RNA, herein designated VGAM HOST TARGET RNA. This complementary binding is due to the fact that the nucleotide sequence of VGAM551 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM551 RNA, herein designated VGAM RNA, may have a different number of host target binding sites in untranslated regions of a VGAM551 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM551 RNA, herein designated VGAM RNA, to host target binding sites on VGAM551 host target RNA, herein designated VGAM HOST TARGET RNA, such as BINDING SITE I, BINDING SITE II and BINDING SITE III, inhibits translation of VGAM551 host target RNA into VGAM551 host target protein, herein designated VGAM HOST TARGET PROTEIN. VGAM host target protein is therefore outlined by a broken line.

It is appreciated that VGAM551 host target gene, herein designated VGAM HOST TARGET GENE, in fact represents a plurality of VGAM551 host target genes. The mRNA of each one of this plurality of VGAM551 host target genes comprises one or more host target binding sites, each having a nucleotide sequence which is at least partly complementary to VGAM551 RNA, herein designated VGAM RNA, and which when bound by VGAM551 RNA causes inhibition of translation of respective one or more VGAM551 host target proteins.

It is further appreciated by one skilled in the art that the mode of translational inhibition illustrated by FIG. 1 with specific reference to translational inhibition exerted by VGAM551 gene, herein designated VGAM GENE, on one or more VGAM551 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM551 is inhibition of expression of host target genes, as part of a novel viral mechanism of attacking a host. Accordingly, utilities of VGAM551 include diagnosis, prevention and treatment of viral infection by Leishmania RNA Virus 2-1. Specific functions, and accordingly utilities, of VGAM551 correlate with, and may be deduced from, the identity of the host target genes which VGAM551 binds and inhibits, and the function of these host target genes, as elaborated hereinbelow.

Nucleotide sequences of the VGAM551 precursor RNA, herein designated VGAM PRECURSOR RNA, and of the 'diced' VGAM551 RNA, herein designated VGAM RNA, and a schematic representation of the secondary folding of VGAM551 folded precursor RNA, herein designated VGAM FOLDED PRECURSOR RNA, of VGAM551 are further described hereinbelow with reference to Table 1.

Nucleotide sequences of host target binding sites, such as BINDING SITE-I, BINDING SITE-II and BINDING SITE-III of FIG. 1, found on VGAM551 host target RNA, and schematic representation of the complementarity of each of these host target binding sites to VGAM551 RNA, herein designated VGAM RNA, are described hereinbelow with reference to Table 2.

As mentioned hereinabove with reference to FIG. 1, a function of VGAM551 gene, herein designated VGAM is inhibition of expression of VGAM551 target genes. It is appreciated that specific functions, and accordingly utilities, of VGAM551 correlate with, and may be deduced from, the identity of the target genes which VGAM551 binds and inhibits, and the function of these target genes, as elaborated hereinbelow.

Solute Carrier Family 4, Sodium Bicarbonate Cotransporter, Member 4 (SLC4A4, Accession NM_003759) is a VGAM551 host target gene. SLC4A4 BINDING SITE is HOST TARGET binding site found in the 3' untranslated region of mRNA encoded by SLC4A4, corresponding to a HOST TARGET binding site such as BINDING SITE I, BINDING SITE II or BINDING SITE III. Table 2 illustrates the complementarity of the nucleotide sequences of SLC4A4 BINDING SITE, designated SEQ ID:9840, to the nucleotide sequence of VGAM551 RNA, herein designated VGAM RNA, also designated SEQ ID:3262.

A function of VGAM551 is therefore inhibition of Solute Carrier Family 4, Sodium Bicarbonate Cotransporter, Member 4 (SLC4A4, Accession NM_003759), a gene which is a sodium bicarbonate cotransporter. Accordingly, utilities of VGAM551 include diagnosis, prevention and treatment of diseases and clinical conditions associated with SLC4A4. The function of SLC4A4 and its association with various diseases and clinical conditions, has been established by previous studies, as described hereinabove with reference to VGAM222. Chromosome 20 Open Reading Frame 13 (C20orf13, Accession NM_017714) is another VGAM551 host target gene. C20orf13 BINDING SITE is HOST TARGET binding site found in the 3' untranslated region of mRNA encoded by C20orf13, corresponding to a HOST TARGET binding site such as BINDING SITE I, BINDING SITE II or BINDING SITE III. Table 2 illustrates the complementarity of the nucleotide sequences of C20orf13 BINDING SITE, designated SEQ ID:19300, to the nucleotide sequence of VGAM551 RNA, herein designated VGAM RNA, also designated SEQ ID:3262.

Another function of VGAM551 is therefore inhibition of Chromosome 20 Open Reading Frame 13 (C20orf13, Accession NM_017714). Accordingly, utilities of VGAM551 include diagnosis, prevention and treatment of diseases and clinical conditions associated with C20orf13. DnaJ (Hsp40) Homolog, Subfamily C, Member 5 (DNAJC5, Accession XM_028966) is another VGAM551 host target gene. DNAJC5 BINDING SITE is HOST TARGET binding site found in the 3' untranslated region of mRNA encoded by DNAJC5, corresponding to a HOST TARGET binding site such as BINDING SITE I, BINDING SITE II or BINDING SITE III. Table 2 illustrates the complementarity of the nucleotide sequences of DNAJC5 BINDING SITE, designated SEQ ID:30813, to the nucleotide sequence of VGAM551 RNA, herein designated VGAM RNA, also designated SEQ ID:3262.

Another function of VGAM551 is therefore inhibition of DnaJ (Hsp40) Homolog, Subfamily C, Member 5 (DNAJC5, Accession XM_028966). Accordingly, utilities of VGAM551 include diagnosis, prevention and treatment of diseases and clinical conditions associated with DNAJC5. FLJ10737 (Accession NM_018198) is another VGAM551 host target gene. FLJ10737 BINDING SITE is HOST TARGET binding site found in the 3' untranslated region of mRNA encoded by FLJ10737, corresponding to a HOST TARGET binding site such as BINDING SITE I, BINDING SITE II or BINDING SITE III. Table 2 illustrates the complementarity of the nucleotide sequences of FLJ10737 BINDING SITE, designated SEQ ID:20067, to the nucleotide sequence of VGAM551 RNA, herein designated VGAM RNA, also designated SEQ ID:3262.

Another function of VGAM551 is therefore inhibition of FLJ10737 (Accession NM_018198). Accordingly, utilities of VGAM551 include diagnosis, prevention and treatment of diseases and clinical conditions associated with FLJ10737. FLJ20079 (Accession NM_017656) is another VGAM551 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19167, to the nucleotide sequence of VGAM551 RNA, herein designated VGAM RNA, also designated SEQ ID:3262.

Another function of VGAM551 is therefore inhibition of FLJ20079 (Accession NM_017656). Accordingly, utilities of VGAM551 include diagnosis, prevention and treatment of diseases and clinical conditions associated with FLJ20079. FLJ32499 (Accession NM_144607) is another VGAM551 host target gene. FLJ32499 BINDING SITE is HOST TARGET binding site found in the 3' untranslated region of mRNA encoded by FLJ32499, corresponding to a HOST TARGET binding site such as BINDING SITE I, BINDING SITE II or BINDING SITE III. Table 2 illustrates the complementarity of the nucleotide sequences of FLJ32499 BINDING SITE, designated SEQ ID:29422, to the nucleotide sequence of VGAM551 RNA, herein designated VGAM RNA, also designated SEQ ID:3262.

Another function of VGAM551 is therefore inhibition of FLJ32499 (Accession NM_144607). Accordingly, utilities of VGAM551 include diagnosis, prevention and treatment of diseases and clinical conditions associated with FLJ32499. Gamma-aminobutyric Acid (GABA) B Receptor, 1 (GABBR1, Accession NM_021903) is another VGAM551 host target gene. GABBR1 BINDING SITE1 and GABBR1 BINDING SITE2 are HOST TARGET binding sites found in untranslated regions of mRNA encoded by GABBR1, corresponding to HOST TARGET binding sites such as BINDING SITE I, BINDING SITE II or BINDING SITE III. Table 2 illustrates the complementarity of the nucleotide sequences of GABBR1 BINDING SITE1 and GABBR1 BINDING SITE2, designated SEQ ID:22426 and SEQ ID:7208 respectively, to the nucleotide sequence of VGAM551 RNA, herein designated VGAM RNA, also designated SEQ ID:3262.

Another function of VGAM551 is therefore inhibition of Gamma-aminobutyric Acid (GABA) B Receptor, 1 (GABBR1, Accession NM_021903). Accordingly, utilities of VGAM551 include diagnosis, prevention and treatment of diseases and clinical conditions associated with GABBR1. Nuclear Receptor Subfamily 4, Group A, Member 3 (NR4A3, Accession NM_006981) is another VGAM551 host target gene. NR4A3 BINDING SITE is HOST TARGET binding site found in the 5' untranslated region of mRNA encoded by NR4A3, corresponding to a HOST TARGET binding site such as BINDING SITE I, BINDING SITE II or BINDING SITE III. Table 2 illustrates the complementarity of the nucleotide sequences of NR4A3 BINDING SITE, designated SEQ ID:13844, to the nucleotide sequence of VGAM551 RNA, herein designated VGAM RNA, also designated SEQ ID:3262.

Another function of VGAM551 is therefore inhibition of Nuclear Receptor Subfamily 4, Group A, Member 3 (NR4A3, Accession NM_006981). Accordingly, utilities of VGAM551 include diagnosis, prevention and treatment of diseases and clinical conditions associated with NR4A3. SH3 Domain Binding Glutamic Acid-rich Protein Like 2 (SH3BGRL2, Accession NM_031469) is another VGAM551 host target gene. SH3BGRL2 BINDING SITE is HOST TARGET binding site found in the 3' untranslated region of mRNA encoded by SH3BGRL2, corresponding to a HOST TARGET binding site such as BINDING SITE I, BINDING SITE II or BINDING SITE III. Table 2 illustrates the complementarity of the nucleotide sequences of SH3BGRL2 BINDING SITE, designated SEQ ID:25528, to the nucleotide sequence of VGAM551 RNA, herein designated VGAM RNA, also designated SEQ ID:3262.

Another function of VGAM551 is therefore inhibition of SH3 Domain Binding Glutamic Acid-rich Protein Like 2 (SH3BGRL2, Accession NM_031469). Accordingly, utilities of VGAM551 include diagnosis, prevention and treatment of diseases and clinical conditions associated with SH3BGRL2. LOC128989 (Accession XM_059310) is another VGAM551 host target gene. LOC128989 BINDING SITE is HOST TARGET binding site found in the 3' untranslated region of mRNA encoded by LOC128989, corresponding to a HOST TARGET binding site such as BINDING SITE I, BINDING SITE II or BINDING SITE III. Table 2 illustrates the complementarity of the nucleotide sequences of LOC128989 BINDING SITE, designated SEQ ID:36946, to the nucleotide sequence of VGAM551 RNA, herein designated VGAM RNA, also designated SEQ ID:3262.

Another function of VGAM551 is therefore inhibition of LOC128989 (Accession XM_059310). Accordingly, utilities of VGAM551 include diagnosis, prevention and treatment of diseases and clinical conditions associated with LOC128989. LOC149276 (Accession XM_097621) is another VGAM551 host target gene. LOC149276 BINDING SITE is HOST TARGET binding site found in the 3' untranslated region of mRNA encoded by LOC149276, corresponding to a HOST TARGET binding site such as BINDING SITE I, BINDING SITE II or BINDING SITE III. Table 2 illustrates the complementarity of the nucleotide sequences of LOC149276 BINDING SITE, designated SEQ ID:40975, to the nucleotide sequence of VGAM551 RNA, herein designated VGAM RNA, also designated SEQ ID:3262.

Another function of VGAM551 is therefore inhibition of LOC149276 (Accession XM_097621). Accordingly, utilities of VGAM551 include diagnosis, prevention and treatment of diseases and clinical conditions associated with LOC149276. FIG. 1 further provides a conceptual description of a novel bioinformatically detected viral gene of the present invention, referred to here as Viral Genomic Address Messenger 552 (VGAM552) viral gene, which modulates expression of respective host target genes thereof, the function and utility of which host target genes is known in the art.

VGAM552 is a novel bioinformatically detected regulatory, non protein coding, viral micro RNA (miRNA) gene. The method by which VGAM552 was detected is described hereinabove with reference to FIGS. 1-8.

VGAM552 gene, herein designated VGAM GENE, is a viral gene contained in the genome of Human Adenovirus D. VGAM552 host target gene, herein designated VGAM HOST TARGET GENE, is a human gene contained in the human genome.

VGAM552 gene encodes a VGAM552 precursor RNA, herein designated VGAM PRECURSOR RNA. Similar to other miRNA genes, and unlike most ordinary genes, VGAM552 precursor RNA does not encode a protein. A nucleotide sequence identical or highly similar to the nucleotide sequence of VGAM552 precursor RNA is designated SEQ ID:538, and is provided hereinbelow with reference to the sequence listing part. Nucleotide sequence SEQ ID:538 is located at position 980 relative to the genome of Human Adenovirus D.

VGAM552 precursor RNA folds onto itself, forming VGAM552 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM552 folded precursor RNA into VGAM552 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM552 RNA is designated SEQ ID:3263, and is provided hereinbelow with reference to the sequence listing part.

VGAM552 host target gene, herein designated VGAM HOST TARGET GENE, encodes a corresponding messenger RNA, VGAM552 host target RNA, herein designated VGAM HOST TARGET RNA. VGAM552 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM552 RNA, herein designated VGAM RNA, binds complementarily to one or more host target binding sites located in untranslated regions of VGAM552 host target RNA, herein designated VGAM HOST TARGET RNA. This complementary binding is due to the fact that the nucleotide sequence of VGAM552 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM552 RNA, herein designated VGAM RNA, may have a different number of host target binding sites in untranslated regions of a VGAM552 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM552 RNA, herein designated VGAM RNA, to host target binding sites on VGAM552 host target RNA, herein designated VGAM HOST TARGET RNA, such as BINDING SITE I, BINDING SITE II and BINDING SITE III, inhibits translation of VGAM552 host target RNA into VGAM552 host target protein, herein designated VGAM HOST TARGET PROTEIN. VGAM host target protein is therefore outlined by a broken line.

It is appreciated that VGAM552 host target gene, herein designated VGAM HOST TARGET GENE, in fact represents a plurality of VGAM552 host target genes. The mRNA of each one of this plurality of VGAM552 host target genes comprises one or more host target binding sites, each having a nucleotide sequence which is at least partly complementary to VGAM552 RNA, herein designated VGAM RNA, and which when bound by VGAM552 RNA causes inhibition of translation of respective one or more VGAM552 host target proteins.

It is further appreciated by one skilled in the art that the mode of translational inhibition illustrated by FIG. 1 with specific reference to translational inhibition exerted by VGAM552 gene, herein designated VGAM GENE, on one or more VGAM552 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM552 is inhibition of expression of host target genes, as part of a novel viral mechanism of attacking a host. Accordingly, utilities of VGAM552 include diagnosis, prevention and treatment of viral infection by Human Adenovirus D. Specific functions, and accordingly utilities, of VGAM552 correlate with, and may be deduced from, the identity of the host target genes which VGAM552 binds and inhibits, and the function of these host target genes, as elaborated hereinbelow.

Nucleotide sequences of the VGAM552 precursor RNA, herein designated VGAM PRECURSOR RNA, and of the 'diced' VGAM552 RNA, herein designated VGAM RNA, and a schematic representation of the secondary folding of VGAM552 folded precursor RNA, herein designated VGAM FOLDED PRECURSOR RNA, of VGAM552 are further described hereinbelow with reference to Table 1.

Nucleotide sequences of host target binding sites, such as BINDING SITE-I, BINDING SITE-II and BINDING SITE-III of FIG. 1, found on VGAM552 host target RNA, and schematic representation of the complementarity of each of these host target binding sites to VGAM552 RNA, herein designated VGAM RNA, are described hereinbelow with reference to Table 2.

As mentioned hereinabove with reference to FIG. 1, a function of VGAM552 gene, herein designated VGAM is inhibition of expression of VGAM552 target genes. It is appreciated that specific functions, and accordingly utilities, of VGAM552 correlate with, and may be deduced from, the identity of the target genes which VGAM552 binds and inhibits, and the function of these target genes, as elaborated hereinbelow.

Apoptotic Protease Activating Factor (APAF1, Accession NM_001160) is a VGAM552 host target gene. APAF1 BINDING SITE1 and APAF1 BINDING SITE2 are HOST TARGET binding sites found in untranslated regions of mRNA encoded by APAF1, corresponding to HOST TARGET binding sites such as BINDING SITE I, BINDING SITE II or BINDING SITE III. Table 2 illustrates the complementarity of the nucleotide sequences of APAF1 BINDING SITE1 and APAF1 BINDING SITE2, designated SEQ ID:6829 and SEQ ID:14868 respectively, to the nucleotide sequence of VGAM552 RNA, herein designated VGAM RNA, also designated SEQ ID:3263.

A function of VGAM552 is therefore inhibition of Apoptotic Protease Activating Factor (APAF1, Accession NM_001160), a gene which functions in the mitochondrial apoptotic pathway that leads to caspase 9 dependent activation of caspase 3. Accordingly, utilities of VGAM552 include diagnosis, prevention and treatment of diseases and clinical conditions associated with APAF1. The function of APAF1 has been established by previous studies. Metastatic melanoma is a deadly cancer that fails to respond to conventional chemotherapy. Mutations in p53 (OMIM Ref. No. 191170) often occur in aggressive and chemoresistant cancers but are rarely observed in melanoma. Soengas et al. (2001) showed that metastatic melanomas often lose APAF1. Loss of APAF1 expression was accompanied by allelic loss in metastatic melanomas, but could be recovered in melanoma cell lines by treatment with the methylation inhibitor 5-aza-2-prime-deoxycytidine (5aza2dC). APAF1-negative melanomas were invariably chemoresistant and were unable to execute a typical apoptotic program in response to p53 activation. Restoring physiologic levels of APAF1 through gene transfer or 5aza2dC treatment markedly enhanced chemosensitivity and rescued the apoptotic defects associated with APAF1 loss. Soengas et al. (2001) concluded that APAF1 is inactivated in metastatic melanomas, leading to defects in the execution of apoptotic cell death. Animal model experiments lend further support to the function of APAF1. Yoshida et al. (1998) also produced Apaf1-deficient mice which exhibited reduced apoptosis in the brain and striking craniofacial abnormalities with hyperproliferation of neuronal cells. Apaf1-deficient cells were resistant to a variety of apoptotic stimuli, and the processing of caspases-2, -3, and -8 was impaired. However, both Apaf1 -/- thymocytes and activated T lymphocytes were sensitive to Fas-induced killing, showing that Fas-mediated apoptosis in these cells is independent of Apaf1. These data indicated that Apaf1 plays a central role in the common events of mitochondria-dependent apoptosis in most death pathways and that this role is critical for normal development.

It is appreciated that the abovementioned animal model for APAF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Soengas, M. S.; Capodieci, P.; Polsky, D.; Mora, J.; Esteller, M.; Opitz-Araya, X.; McCombie, R.; Herman, J. G.; Gerald, W. L.; Lazebnik, Y. A.; Cordon-Cardo, C.; Lowe, S. W.: Inactivation of the apoptosis effector Apaf-1 in malignant melanoma. Nature 409:207-211, 2001; and Yoshida, H.; Kong, Y.-Y.; Yoshida, R.; Elia, A. J.; Hakem, A.; Hakem, R.; Penninger, J. M.; Mak, T. W.: Apaf1 is required for mitochondrial pathways of apoptosis and brain development.

Further studies establishing the function and utilities of APAF1 are found in John Hopkins OMIM database record ID 602233, and in sited publications numbered 6292-6296, 230 and 5997-6000 listed in the bibliography section hereinbelow, which are also hereby incorporated by reference. High Mobility Group AT-hook 2 (HMGA2, Accession NM_003483) is another VGAM552 host target gene. HMGA2 BINDING SITE is HOST TARGET binding site found in the 5' untranslated region of mRNA encoded by HMGA2, corresponding to a HOST TARGET binding site such as BINDING SITE I, BINDING SITE II or BINDING SITE III. Table 2 illustrates the complementarity of the nucleotide sequences of HMGA2 BINDING SITE, designated SEQ ID:9569, to the nucleotide sequence of VGAM552 RNA, herein designated VGAM RNA, also designated SEQ ID:3263.

Another function of VGAM552 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM552 include diagnosis, prevention and treatment of diseases and clinical conditions associated with HMGA2. The function of HMGA2 has been established by previous studies. Ashar et al. (1995) considered the HMGIC gene a good candidate for involvement in lipoma for several reasons, including the facts that it encodes a transcriptional regulating factor, that the pygmy mouse had disproportionately less fat than normal litter mates, and that the mouse gene maps to a region of chromosome 10 with homology of synteny to human 12q14-q15. Therefore, they cloned the human gene and investigated its possible role in lipomas. In FISH studies, Ashar et al. (1995) found apparent deletion of the 3-prime end of the HMGIC gene in translocations associated with lipoma. Chimeric transcripts were isolated from 2 lipomas in which HMGIC DNA-binding domains (AT hook motifs) were fused to either a LIM or an acidic transactivator domain. The identification of a gene rearranged in a benign neoplastic process suggests a role for HMGIC in adipogenesis and mesenchymal differentiation. Animal model experiments lend further support to the function of HMGA2. To evaluate the role of the HMGIC component in the development of lipoma, Arlotta et al. (2000) expressed the 3 DNA-binding domains of HMGIC in transgenic mice. Despite the ubiquitous expression of the truncated HMGIC protein, the transgenic mice developed a selective abundance of fat tissue early in life, showed marked adipose tissue inflammation, and had an abnormally high incidence of lipomas. These findings demonstrated that the DNA-binding domain of HMGIC, in the absence of a C-terminal fusion partner, are sufficient to perturb adipogenesis and predispose to lipomas.

It is appreciated that the abovementioned animal model for HMGA2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ashar, H. R.; Schoenberg Fejzo, M.; Tkachenko, A.; Zhou, X.; Fletcher, J. A.; Weremowicz, S.; Morton, C. C.; Chada, K.: Disruption of the architectural factor HMGI-C: DNA-binding AT hook motifs fused in lipomas to distinct transcriptional regulatory domains. Cell 82:57-65, 1995; and Arlotta, P.; Tai, A. K.-F.; Manfioletti, G.; Clifford, C.; Jay, G.; Ono, S. J.: Transgenic mice expressing a truncated form of the high mobility group I-C protein develop adiposity and.

Further studies establishing the function and utilities of HMGA2 are found in John Hopkins OMIM database record ID 600698, and in sited publications numbered 10147-10159, 10242, 10397-10398, 347 and 10399 listed in the bibliography section hereinbelow, which are also hereby incorporated by reference. Loss of Heterozygosity, 11, Chromosomal Region 2, Gene A (LOH11CR2A, Accession NM_014622) is another VGAM552 host target gene. LOH11CR2A BINDING SITE is HOST TARGET binding site found in the 3' untranslated region of mRNA encoded by LOH11CR2A, corresponding to a HOST TARGET binding site such as BINDING SITE I, BINDING SITE II or BINDING SITE III. Table 2 illustrates the complementarity of the nucleotide sequences of LOH11CR2A BINDING SITE, designated SEQ ID:15990, to the nucleotide sequence of VGAM552 RNA, herein designated VGAM RNA, also designated SEQ ID:3263.

Another function of VGAM552 is therefore inhibition of Loss of Heterozygosity, 11, Chromosomal Region 2, Gene A (LOH11CR2A, Accession NM_014622). Accordingly, utilities of VGAM552 include diagnosis, prevention and treatment of diseases and clinical conditions associated with LOH11CR2A. Protein Tyrosine Phosphatase, Receptor Type, J (PTPRJ, Accession NM_002843) is another VGAM552 host target gene. PTPRJ BINDING SITE is HOST TARGET binding site found in the 5' untranslated region of mRNA encoded by PTPRJ, corresponding to a HOST TARGET binding site such as BINDING SITE I, BINDING SITE II or BINDING SITE III. Table 2 illustrates the complementarity of the nucleotide sequences of PTPRJ BINDING SITE, designated SEQ ID:8732, to the nucleotide sequence of VGAM552 RNA, herein designated VGAM RNA, also designated SEQ ID:3263.

Another function of VGAM552 is therefore inhibition of Protein Tyrosine Phosphatase, Receptor Type, J (PTPRJ, Accession NM_002843), a gene which Receptor-type protein tyrosine phosphatase J. Accordingly, utilities of VGAM552 include diagnosis, prevention and treatment of diseases and clinical conditions associated with PTPRJ. The function of PTPRJ has been established by previous studies. Experimental evidence indicates that specific protein tyrosine phosphatases (PTPases) interact with members of cascades to modulate biologic function differentiation and development. Experiments suggested that the PTPases PTP-beta (OMIM Ref. No. 176882) and PTP-epsilon (OMIM Ref. No. 600926) are involved in the early molecular events for in vitro differentiation of mouse erythroleukemia (MEL) as well as embryonic carcinoma (F9) cells (Watanabe et al., 1995).

Full details of the abovementioned studies are described in the following publications, the disclosure of which are hereby incorporated by reference:

Watanabe, T.; Mukouyama, Y.; Rhodes, M.; Thomas, M.; Kume, T.; Oishi, M.: Chromosomal location of murine protein tyrosine phosphatase (Ptprj and Ptpre) genes. Genomics 29:793-795, 1995; and Ruivenkamp, C. A. L.; van Wezel, T.; Zanon, C.; Stassen, A. P. M.; Vlcek, C.; Csikos, T.; Klous, A. M.; Tripodis, N.; Perrakis, A.; Boerrigter, L.; Groot, P. C.; Lindeman, J.; Mooi, W. J.

Further studies establishing the function and utilities of PTPRJ are found in John Hopkins OMIM database record ID 600925, and in sited publications numbered 10255-1025 and 1583 listed in the bibliography section hereinbelow, which are also hereby incorporated by reference. Ribosomal Protein S6 Kinase, 90 kDa, Polypeptide 2 (RPS6KA2, Accession NM_021135) is another VGAM552 host target gene. RPS6KA2 BINDING SITE is HOST TARGET binding site found in the 3' untranslated region of mRNA encoded by RPS6KA2, corresponding to a HOST TARGET binding site such as BINDING SITE I, BINDING SITE II or BINDING SITE III. Table 2 illustrates the complementarity of the nucleotide sequences of RPS6KA2 BINDING SITE, designated SEQ ID:22106, to the nucleotide sequence of VGAM552 RNA, herein designated VGAM RNA, also designated SEQ ID:3263.

Another function of VGAM552 is therefore inhibition of Ribosomal Protein S6 Kinase, 90 kDa, Polypeptide 2 (RPS6KA2, Accession NM_021135), a gene which phosphorylates a wide range of substrates including ribosomal protein s6. Accordingly, utilities of VGAM552 include diagnosis, prevention and treatment of diseases and clinical conditions associated with RPS6KA2. The function of RPS6KA2 and its association with various diseases and clinical conditions, has been established by previous studies, as described hereinabove with reference to VGAM216. Syndecan 4 (amphiglycan, ryudocan) (SDC4, Accession NM_002999) is another VGAM552 host target gene. SDC4 BINDING SITE is HOST TARGET binding site found in the 3' untranslated region of mRNA encoded by SDC4, corresponding to a HOST TARGET binding site such as BINDING SITE I, BINDING SITE II or BINDING SITE III. Table 2 illustrates the complementarity of the nucleotide sequences of SDC4 BINDING SITE, designated SEQ ID:8892, to the nucleotide sequence of VGAM552 RNA, herein designated VGAM RNA, also designated SEQ ID:3263.

Another function of VGAM552 is therefore inhibition of Syndecan 4 (amphiglycan, ryudocan) (SDC4, Accession NM_002999), a gene which is a cell surface proteoglycan. Accordingly, utilities of VGAM552 include diagnosis, prevention and treatment of diseases and clinical conditions associated with SDC4. The function of SDC4 has been established by previous studies. The syndecans are transmembrane heparan sulfate proteoglycans that appear to act as receptors or coreceptors involved in intracellular communication. Syndecan-4 was isolated from rat endothelial cells, as ryudocan, by Kojima et al. (1992) and from human epithelial and fibroblastic cells, under the designation amphiglycan, by David et al. (1992). By analysis of interspecific backcrosses, Spring et al. (1994) mapped the Synd4 gene to distal mouse chromosome 2, very close to the Ada gene. Kojima et al. (1993) mapped the SYND4 in the human to 20q12-q13 as would be predicted from the mouse location within no more than 2.2 cM of Ada. The BMYC gene is probably located on human chromosome 20 and has been shown to be located on mouse chromosome 2 (Ingvarsson et al., 1988; Asker et al., 1989). Although BMYC is a nonfunctional MYC-related gene, its location on chromosome 2 and chromosome 20 in the mouse and the human, respectively, extends the observation of Spring et al. (1994) that 4 members of the MYC gene family and 4 members of the syndecan gene family are closely situated on 4 different chromosomes. Yu et al. (1995) cloned the human ryudocan promoter. Analysis of the sequence revealed the presence of several potential sites for nuclear transcription factor binding.

Full details of the abovementioned studies are described in the following publications, the disclosure of which are hereby incorporated by reference:

Spring, J.; Goldberger, O. A.; Jenkins, N. A.; Gilbert, D. J.; Copeland, N. G.; Bernfield, M.: Mapping of the syndecan genes in the mouse: linkage with members of the Myc gene family. Genomics 21:597-601, 1994; and Yu, H.; Humphries, D. E.; Watkins, M.; Karlinsky, J. B.: Molecular cloning of the human ryudocan promoter. Biochem. Biophys. Res. Commun. 212:1139-1144, 1995.

Further studies establishing the function and utilities of SDC4 are found in John Hopkins OMIM database record ID 600017, and in sited publications numbered 8784, 11614-878 and 11616 listed in the bibliography section hereinbelow, which are also hereby incorporated by reference. DKFZp762E1312 (Accession NM_018410) is another VGAM552 host target gene. DKFZp762E1312 BINDING SITE is HOST TARGET binding site found in the 5' untranslated region of mRNA encoded by DKFZp762E1312, corresponding to a HOST TARGET binding site such as BINDING SITE I, BINDING SITE II or BINDING SITE III. Table 2 illustrates the complementarity of the nucleotide sequences of DKFZp762E1312 BINDING SITE, designated SEQ ID:20453, to the nucleotide sequence of VGAM552 RNA, herein designated VGAM RNA, also designated SEQ ID:3263.

Another function of VGAM552 is therefore inhibition of DKFZp762E1312 (Accession NM_018410). Accordingly, utilities of VGAM552 include diagnosis, prevention and treatment of diseases and clinical conditions associated with DKFZp762E1312. FLJ14082 (Accession NM_025024) is another VGAM552 host target gene. FLJ14082 BINDING SITE is HOST TARGET binding site found in the 3' untranslated region of mRNA encoded by FLJ14082, corresponding to a HOST TARGET binding site such as BINDING SITE I, BINDING SITE II or BINDING SITE III. Table 2 illustrates the complementarity of the nucleotide sequences of FLJ14082 BINDING SITE, designated SEQ ID:24613, to the nucleotide sequence of VGAM552 RNA, herein designated VGAM RNA, also designated SEQ ID:3263.

Another function of VGAM552 is therefore inhibition of FLJ14082 (Accession NM_025024). Accordingly, utilities of VGAM552 include diagnosis, prevention and treatment of diseases and clinical conditions associated with FLJ14082. FLJ20297 (Accession NM_017951) is another VGAM552 host target gene. FLJ20297 BINDING SITE is HOST TARGET binding site found in the 5' untranslated region of mRNA encoded by FLJ20297, corresponding to a HOST TARGET binding site such as BINDING SITE I, BINDING SITE II or BINDING SITE III. Table 2 illustrates the complementarity of the nucleotide sequences of FLJ20297 BINDING SITE, designated SEQ ID:19652, to the nucleotide sequence of VGAM552 RNA, herein designated VGAM RNA, also designated SEQ ID:3263.

Another function of VGAM552 is therefore inhibition of FLJ20297 (Accession NM_017951). Accordingly, utilities of VGAM552 include diagnosis, prevention and treatment of diseases and clinical conditions associated with FLJ20297. FLJ20366 (Accession NM_017786) is another VGAM552 host target gene. FLJ20366 BINDING SITE is HOST TARGET binding site found in the 3' untranslated region of mRNA encoded by FLJ20366, corresponding to a HOST TARGET binding site such as BINDING SITE I, BINDING SITE II or BINDING SITE III. Table 2 illustrates the complementarity of the nucleotide sequences of FLJ20366 BINDING SITE, designated SEQ ID:19419, to the nucleotide sequence of VGAM552 RNA, herein designated VGAM RNA, also designated SEQ ID:3263.

Another function of VGAM552 is therefore inhibition of FLJ20366 (Accession NM_017786). Accordingly, utilities of VGAM552 include diagnosis, prevention and treatment of diseases and clinical conditions associated with FLJ20366. KIAA0014 (Accession NM_014665) is another VGAM552 host target gene. KIAA0014 BINDING SITE is HOST TAR- GET binding site found in the 3' untranslated region of mRNA encoded by KIAA0014, corresponding to a HOST TARGET binding site such as BINDING SITE I, BINDING SITE II or BINDING SITE III. Table 2 illustrates the complementarity of the nucleotide sequences of KIAA0014 BINDING SITE, designated SEQ ID:16119, to the nucleotide sequence of VGAM552 RNA, herein designated VGAM RNA, also designated SEQ ID:3263.

Another function of VGAM552 is therefore inhibition of KIAA0014 (Accession NM_014665). Accordingly, utilities of VGAM552 include diagnosis, prevention and treatment of diseases and clinical conditions associated with KIAA0014. KIAA1274 (Accession XM_166125) is another VGAM552 host target gene. KIAA1274 BINDING SITE is HOST TARGET binding site found in the 3' untranslated region of mRNA encoded by KIAA1274, corresponding to a HOST TARGET binding site such as BINDING SITE I, BINDING SITE II or BINDING SITE III. Table 2 illustrates the complementarity of the nucleotide sequences of KIAA1274 BINDING SITE, designated SEQ ID:43914, to the nucleotide sequence of VGAM552 RNA, herein designated VGAM RNA, also designated SEQ ID:3263.

Another function of VGAM552 is therefore inhibition of KIAA1274 (Accession XM_166125). Accordingly, utilities of VGAM552 include diagnosis, prevention and treatment of diseases and clinical conditions associated with KIAA1274. P450RAI-2 (Accession NM_019885) is another VGAM552 host target gene. P450RAI-2 BINDING SITE is HOST TARGET binding site found in the 3' untranslated region of mRNA encoded by P450RAI-2, corresponding to a HOST TARGET binding site such as BINDING SITE I, BINDING SITE II or BINDING SITE III. Table 2 illustrates the complementarity of the nucleotide sequences of P450RAI-2 BINDING SITE, designated SEQ ID:21270, to the nucleotide sequence of VGAM552 RNA, herein designated VGAM RNA, also designated SEQ ID:3263.

Another function of VGAM552 is therefore inhibition of P450RAI-2 (Accession NM_019885). Accordingly, utilities of VGAM552 include diagnosis, prevention and treatment of diseases and clinical conditions associated with P450RAI-2. SBBI26 (Accession NM_018846) is another VGAM552 host target gene. SBBI26 BINDING SITE is HOST TARGET binding site found in the 3' untranslated region of mRNA encoded by SBBI26, corresponding to a HOST TARGET binding site such as BINDING SITE I, BINDING SITE II or BINDING SITE III. Table 2 illustrates the complementarity of the nucleotide sequences of SBBI26 BINDING SITE, designated SEQ ID:20832, to the nucleotide sequence of VGAM552 RNA, herein designated VGAM RNA, also designated SEQ ID:3263.

Another function of VGAM552 is therefore inhibition of SBBI26 (Accession NM_018846). Accordingly, utilities of VGAM552 include diagnosis, prevention and treatment of diseases and clinical conditions associated with SBBI26. Serologically Defined Colon Cancer Antigen 3 (SDCCAG3, Accession NM_006643) is another VGAM552 host target gene. SDCCAG3 BINDING SITE is HOST TARGET binding site found in the 3' untranslated region of mRNA encoded by SDCCAG3, corresponding to a HOST TARGET binding site such as BINDING SITE I, BINDING SITE II or BINDING SITE III. Table 2 illustrates the complementarity of the nucleotide sequences of SDCCAG3 BINDING SITE, designated SEQ ID:13436, to the nucleotide sequence of VGAM552 RNA, herein designated VGAM RNA, also designated SEQ ID:3263.

Another function of VGAM552 is therefore inhibition of Serologically Defined Colon Cancer Antigen 3 (SDCCAG3, Accession NM_006643). Accordingly, utilities of VGAM552 include diagnosis, prevention and treatment of diseases and clinical conditions associated with SDCCAG3. Syntaxin 1B2 (STX1B2, Accession NM_052874) is another VGAM552 host target gene. STX1B2 BINDING SITE is HOST TARGET binding site found in the 3' untranslated region of mRNA encoded by STX1B2, corresponding to a HOST TARGET binding site such as BINDING SITE I, BINDING SITE II or BINDING SITE III. Table 2 illustrates the complementarity of the nucleotide sequences of STX1B2 BINDING SITE, designated SEQ ID:27456, to the nucleotide sequence of VGAM552 RNA, herein designated VGAM RNA, also designated SEQ ID:3263.

Another function of VGAM552 is therefore inhibition of Syntaxin 1B2 (STX1B2, Accession NM_052874). Accordingly, utilities of VGAM552 include diagnosis, prevention and treatment of diseases and clinical conditions associated with STX1B2. LOC120839 (Accession XM_071729) is another VGAM552 host target gene. LOC120839 BINDING SITE is HOST TARGET binding site found in the 5' untranslated region of mRNA encoded by LOC120839, corresponding to a HOST TARGET binding site such as BINDING SITE I, BINDING SITE II or BINDING SITE III. Table 2 illustrates the complementarity of the nucleotide sequences of LOC120839 BINDING SITE, designated SEQ ID:37415, to the nucleotide sequence of VGAM552 RNA, herein designated VGAM RNA, also designated SEQ ID:3263.

Another function of VGAM552 is therefore inhibition of LOC120839 (Accession XM_071729). Accordingly, utilities of VGAM552 include diagnosis, prevention and treatment of diseases and clinical conditions associated with LOC120839. LOC150245 (Accession XM_097843) is another VGAM552 host target gene. LOC150245 BINDING SITE is HOST TARGET binding site found in the 5' untranslated region of mRNA encoded by LOC150245, corresponding to a HOST TARGET binding site such as BINDING SITE I, BINDING SITE II or BINDING SITE III. Table 2 illustrates the complementarity of the nucleotide sequences of LOC150245 BINDING SITE, designated SEQ ID:41163, to the nucleotide sequence of VGAM552 RNA, herein designated VGAM RNA, also designated SEQ ID:3263.

Another function of VGAM552 is therefore inhibition of LOC150245 (Accession XM_097843). Accordingly, utilities of VGAM552 include diagnosis, prevention and treatment of diseases and clinical conditions associated with LOC150245. LOC150776 (Accession XM_032542) is another VGAM552 host target gene. LOC150776 BINDING SITE is HOST TARGET binding site found in the 5' untranslated region of mRNA encoded by LOC150776, corresponding to a HOST TARGET binding site such as BINDING SITE I, BINDING SITE II or BINDING SITE III. Table 2 illustrates the complementarity of the nucleotide sequences of LOC150776 BINDING SITE, designated SEQ ID:31678, to the nucleotide sequence of VGAM552 RNA, herein designated VGAM RNA, also designated SEQ ID:3263.

Another function of VGAM552 is therefore inhibition of LOC150776 (Accession XM_032542). Accordingly, utilities of VGAM552 include diagnosis, prevention and treatment of diseases and clinical conditions associated with LOC150776. LOC151610 (Accession XM_087245) is another VGAM552 host target gene. LOC151610 BINDING SITE is HOST TARGET binding site found in the 3' untranslated region of mRNA encoded by LOC151610, corresponding to a HOST TARGET binding site such as BINDING SITE I, BINDING SITE II or BINDING SITE III. Table 2 illustrates the complementarity of the nucleotide sequences of LOC151610 BINDING SITE, designated SEQ ID:39137, to the nucleotide sequence of VGAM552 RNA, herein designated VGAM RNA, also designated SEQ ID:3263.

Another function of VGAM552 is therefore inhibition of LOC151610 (Accession XM_087245). Accordingly, utilities of VGAM552 include diagnosis, prevention and treatment of diseases and clinical conditions associated with LOC151610. LOC199848 (Accession XM_117144) is another VGAM552 host target gene. LOC199848 BINDING SITE is HOST TARGET binding site found in the 5' untranslated region of mRNA encoded by LOC199848, corresponding to a HOST TARGET binding site such as BINDING SITE I, BINDING SITE II or BINDING SITE III. Table 2 illustrates the complementarity of the nucleotide sequences of LOC199848 BINDING SITE, designated SEQ ID:43251, to the nucleotide sequence of VGAM552 RNA, herein designated VGAM RNA, also designated SEQ ID:3263.

Another function of VGAM552 is therefore inhibition of LOC199848 (Accession XM_117144). Accordingly, utilities of VGAM552 include diagnosis, prevention and treatment of diseases and clinical conditions associated with LOC199848. LOC220045 (Accession XM_167820) is another VGAM552 host target gene. LOC220045 BINDING SITE is HOST TARGET binding site found in the 3' untranslated region of mRNA encoded by LOC220045, corresponding to a HOST TARGET binding site such as BINDING SITE I, BINDING SITE II or BINDING SITE III. Table 2 illustrates the complementarity of the nucleotide sequences of LOC220045 BINDING SITE, designated SEQ ID:44862, to the nucleotide sequence of VGAM552 RNA, herein designated VGAM RNA, also designated SEQ ID:3263.

Another function of VGAM552 is therefore inhibition of LOC220045 (Accession XM_167820). Accordingly, utilities of VGAM552 include diagnosis, prevention and treatment of diseases and clinical conditions associated with LOC220045. LOC91097 (Accession XM_035977) is another VGAM552 host target gene. LOC91097 BINDING SITE is HOST TARGET binding site found in the 5' untranslated region of mRNA encoded by LOC91097, corresponding to a HOST TARGET binding site such as BINDING SITE I, BINDING SITE II or BINDING SITE III. Table 2 illustrates the complementarity of the nucleotide sequences of LOC91097 BINDING SITE, designated SEQ ID:32370, to the nucleotide sequence of VGAM552 RNA, herein designated VGAM RNA, also designated SEQ ID:3263.

Another function of VGAM552 is therefore inhibition of LOC91097 (Accession XM_035977). Accordingly, utilities of VGAM552 include diagnosis, prevention and treatment of diseases and clinical conditions associated with LOC91097. FIG. 1 further provides a conceptual description of a novel bioinformatically detected viral gene of the present invention, referred to here as Viral Genomic Address Messenger 553 (VGAM553) viral gene, which modulates expression of respective host target genes thereof, the function and utility of which host target genes is known in the art.

VGAM553 is a novel bioinformatically detected regulatory, non protein coding, viral micro RNA (miRNA) gene. The method by which VGAM553 was detected is described hereinabove with reference to FIGS. 1-8.

VGAM553 gene, herein designated VGAM GENE, is a viral gene contained in the genome of Bovine Parainfluenza Virus 3. VGAM553 host target gene, herein designated VGAM HOST TARGET GENE, is a human gene contained in the human genome.

VGAM553 gene encodes a VGAM553 precursor RNA, herein designated VGAM PRECURSOR RNA. Similar to other miRNA genes, and unlike most ordinary genes, VGAM553 precursor RNA does not encode a protein. A nucleotide sequence identical or highly similar to the nucleotide sequence of VGAM553 precursor RNA is designated SEQ ID:539, and is provided hereinbelow with reference to the sequence listing part. Nucleotide sequence SEQ ID:539 is located at position 7376 relative to the genome of Bovine Parainfluenza Virus 3.

VGAM553 precursor RNA folds onto itself, forming VGAM553 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM553 folded precursor RNA into VGAM553 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM553 RNA is designated SEQ ID:3264, and is provided hereinbelow with reference to the sequence listing part.

VGAM553 host target gene, herein designated VGAM HOST TARGET GENE, encodes a corresponding messenger RNA, VGAM553 host target RNA, herein designated VGAM HOST TARGET RNA. VGAM553 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM553 RNA, herein designated VGAM RNA, binds complementarily to one or more host target binding sites located in untranslated regions of VGAM553 host target RNA, herein designated VGAM HOST TARGET RNA. This complementary binding is due to the fact that the nucleotide sequence of VGAM553 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM553 RNA, herein designated VGAM RNA, may have a different number of host target binding sites in untranslated regions of a VGAM553 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM553 RNA, herein designated VGAM RNA, to host target binding sites on VGAM553 host target RNA, herein designated VGAM HOST TARGET RNA, such as BINDING SITE I, BINDING SITE II and BINDING SITE III, inhibits translation of VGAM553 host target RNA into VGAM553 host target protein, herein designated VGAM HOST TARGET PROTEIN. VGAM host target protein is therefore outlined by a broken line.

It is appreciated that VGAM553 host target gene, herein designated VGAM HOST TARGET GENE, in fact represents a plurality of VGAM553 host target genes. The mRNA of each one of this plurality of VGAM553 host target genes comprises one or more host target binding sites, each having a nucleotide sequence which is at least partly complementary to VGAM553 RNA, herein designated VGAM RNA, and which when bound by VGAM553 RNA causes inhibition of translation of respective one or more VGAM553 host target proteins.

It is further appreciated by one skilled in the art that the mode of translational inhibition illustrated by FIG. 1 with specific reference to translational inhibition exerted by VGAM553 gene, herein designated VGAM GENE, on one or more VGAM553 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM553 is inhibition of expression of host target genes, as part of a novel viral mechanism of attacking a host. Accordingly, utilities of VGAM553 include diagnosis, prevention and treatment of viral infection by Bovine Parainfluenza Virus 3. Specific functions, and accordingly utilities, of VGAM553 correlate with, and may be deduced from, the identity of the host target genes which VGAM553 binds and inhibits, and the function of these host target genes, as elaborated hereinbelow.

Nucleotide sequences of the VGAM553 precursor RNA, herein designated VGAM PRECURSOR RNA, and of the 'diced' VGAM553 RNA, herein designated VGAM RNA, and a schematic representation of the secondary folding of VGAM553 folded precursor RNA, herein designated VGAM FOLDED PRECURSOR RNA, of VGAM553 are further described hereinbelow with reference to Table 1.

Nucleotide sequences of host target binding sites, such as BINDING SITE-I, BINDING SITE-II and BINDING SITE-III of FIG. 1, found on VGAM553 host target RNA, and schematic representation of the complementarity of each of these host target binding sites to VGAM553 RNA, herein designated VGAM RNA, are described hereinbelow with reference to Table 2.

As mentioned hereinabove with reference to FIG. 1, a function of VGAM553 gene, herein designated VGAM is inhibition of expression of VGAM553 target genes. It is appreciated that specific functions, and accordingly utilities, of VGAM553 correlate with, and may be deduced from, the identity of the target genes which VGAM553 binds and inhibits, and the function of these target genes, as elaborated hereinbelow.

NDRG Family Member 3 (NDRG3, Accession NM_022477) is a VGAM553 host target gene. NDRG3 BINDING SITE1 and NDRG3 BINDING SITE2 are HOST TARGET binding sites found in untranslated regions of mRNA encoded by NDRG3, corresponding to HOST TARGET binding sites such as BINDING SITE I, BINDING SITE II or BINDING SITE III. Table 2 illustrates the complementarity of the nucleotide sequences of NDRG3 BINDING SITE1 and NDRG3 BINDING SITE2, designated SEQ ID:22848 and SEQ ID:25724 respectively, to the nucleotide sequence of VGAM553 RNA, herein designated VGAM RNA, also designated SEQ ID:3264.

A function of VGAM553 is therefore inhibition of NDRG Family Member 3 (NDRG3, Accession NM_022477). Accordingly, utilities of VGAM553 include diagnosis, prevention and treatment of diseases and clinical conditions associated with NDRG3. LOC115073 (Accession XM_055193) is another VGAM553 host target gene. LOC115073 BINDING SITE is HOST TARGET binding site found in the 3' untranslated region of mRNA encoded by LOC115073, corresponding to a HOST TARGET binding site such as BINDING SITE I, BINDING SITE II or BINDING SITE III. Table 2 illustrates the complementarity of the nucleotide sequences of LOC115073 BINDING SITE, designated SEQ ID:36234, to the nucleotide sequence of VGAM553 RNA, herein designated VGAM RNA, also designated SEQ ID:3264.

Another function of VGAM553 is therefore inhibition of LOC115073 (Accession XM_055193). Accordingly, utilities of VGAM553 include diagnosis, prevention and treatment of diseases and clinical conditions associated with LOC115073. LOC147072 (Accession XM_017121) is another VGAM553 host target gene. LOC147072 BINDING SITE is HOST TARGET binding site found in the 3' untranslated region of mRNA encoded by LOC147072, corresponding to a HOST TARGET binding site such as BINDING SITE I, BINDING SITE II or BINDING SITE III. Table 2 illustrates the complementarity of the nucleotide sequences of LOC147072 BINDING SITE, designated SEQ ID:30299, to the nucleotide sequence of VGAM553 RNA, herein designated VGAM RNA, also designated SEQ ID:3264.

Another function of VGAM553 is therefore inhibition of LOC147072 (Accession XM_017121). Accordingly, utilities of VGAM553 include diagnosis, prevention and treatment of diseases and clinical conditions associated with LOC147072. LOC148085 (Accession XM_097388) is another VGAM553 host target gene. LOC148085 BINDING SITE is HOST TARGET binding site found in the 5' untranslated region of mRNA encoded by LOC148085, corresponding to a HOST TARGET binding site such as BINDING SITE I, BINDING SITE II or BINDING SITE III. Table 2 illustrates the complementarity of the nucleotide sequences of LOC148085 BINDING SITE, designated SEQ ID:40867, to the nucleotide sequence of VGAM553 RNA, herein designated VGAM RNA, also designated SEQ ID:3264.

Another function of VGAM553 is therefore inhibition of LOC148085 (Accession XM_097388). Accordingly, utilities of VGAM553 include diagnosis, prevention and treatment of diseases and clinical conditions associated with LOC148085. FIG. 1 further provides a conceptual description of a novel bioinformatically detected viral gene of the present invention, referred to here as Viral Genomic Address Messenger 554 (VGAM554) viral gene, which modulates expression of respective host target genes thereof, the function and utility of which host target genes is known in the art.

VGAM554 is a novel bioinformatically detected regulatory, non protein coding, viral micro RNA (miRNA) gene. The method by which VGAM554 was detected is described hereinabove with reference to FIGS. 1-8.

VGAM554 gene, herein designated VGAM GENE, is a viral gene contained in the genome of Spodoptera Exigua Nucleopolyhedrovirus. VGAM554 host target gene, herein designated VGAM HOST TARGET GENE, is a human gene contained in the human genome.

VGAM554 gene encodes a VGAM554 precursor RNA, herein designated VGAM PRECURSOR RNA. Similar to other miRNA genes, and unlike most ordinary genes, VGAM554 precursor RNA does not encode a protein. A nucleotide sequence identical or highly similar to the nucleotide sequence of VGAM554 precursor RNA is designated SEQ ID:540, and is provided hereinbelow with reference to the sequence listing part. Nucleotide sequence SEQ ID:540 is located at position 47344 relative to the genome of Spodoptera Exigua Nucleopolyhedrovirus.

VGAM554 precursor RNA folds onto itself, forming VGAM554 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM554 folded precursor RNA into VGAM554 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM554 RNA is designated SEQ ID:3265, and is provided hereinbelow with reference to the sequence listing part.

VGAM554 host target gene, herein designated VGAM HOST TARGET GENE, encodes a corresponding messenger RNA, VGAM554 host target RNA, herein designated VGAM HOST TARGET RNA. VGAM554 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM554 RNA, herein designated VGAM RNA, binds complementarily to one or more host target binding sites located in untranslated regions of VGAM554 host target RNA, herein designated VGAM HOST TARGET RNA. This complementary binding is due to the fact that the nucleotide sequence of VGAM554 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM554 RNA, herein designated VGAM RNA, may have a different number of host target binding sites in untranslated regions of a VGAM554 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM554 RNA, herein designated VGAM RNA, to host target binding sites on VGAM554 host target RNA, herein designated VGAM HOST TARGET RNA, such as BINDING SITE I, BINDING SITE II and BINDING SITE III, inhibits translation of VGAM554 host target RNA into VGAM554 host target protein, herein designated VGAM HOST TARGET PROTEIN. VGAM host target protein is therefore outlined by a broken line.

It is appreciated that VGAM554 host target gene, herein designated VGAM HOST TARGET GENE, in fact represents a plurality of VGAM554 host target genes. The mRNA of each one of this plurality of VGAM554 host target genes comprises one or more host target binding sites, each having a nucleotide sequence which is at least partly complementary to VGAM554 RNA, herein designated VGAM RNA, and which when bound by VGAM554 RNA causes inhibition of translation of respective one or more VGAM554 host target proteins.

It is further appreciated by one skilled in the art that the mode of translational inhibition illustrated by FIG. 1 with specific reference to translational inhibition exerted by VGAM554 gene, herein designated VGAM GENE, on one or more VGAM554 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM554 is inhibition of expression of host target genes, as part of a novel viral mechanism of attacking a host. Accordingly, utilities of VGAM554 include diagnosis, prevention and treatment of viral infection by Spodoptera Exigua Nucleopolyhedrovirus. Specific functions, and accordingly utilities, of VGAM554 correlate with, and may be deduced from, the identity of the host target genes which VGAM554 binds and inhibits, and the function of these host target genes, as elaborated hereinbelow.

Nucleotide sequences of the VGAM554 precursor RNA, herein designated VGAM PRECURSOR RNA, and of the 'diced' VGAM554 RNA, herein designated VGAM RNA, and a schematic representation of the secondary folding of VGAM554 folded precursor RNA, herein designated VGAM FOLDED PRECURSOR RNA, of VGAM554 are further described hereinbelow with reference to Table 1.

Nucleotide sequences of host target binding sites, such as BINDING SITE-I, BINDING SITE-II and BINDING SITE-III of FIG. 1, found on VGAM554 host target RNA, and schematic representation of the complementarity of each of these host target binding sites to VGAM554 RNA, herein designated VGAM RNA, are described hereinbelow with reference to Table 2.

As mentioned hereinabove with reference to FIG. 1, a function of VGAM554 gene, herein designated VGAM is inhibition of expression of VGAM554 target genes. It is appreciated that specific functions, and accordingly utilities, of VGAM554 correlate with, and may be deduced from, the identity of the target genes which VGAM554 binds and inhibits, and the function of these target genes, as elaborated hereinbelow.

EphA8 (EPHA8, Accession NM_020526) is a VGAM554 host target gene. EPHA8 BINDING SITE is HOST TARGET binding site found in the 3' untranslated region of mRNA encoded by EPHA8, corresponding to a HOST TARGET binding site such as BINDING SITE I, BINDING SITE II or BINDING SITE III. Table 2 illustrates the complementarity of the nucleotide sequences of EPHA8 BINDING SITE, designated SEQ ID:21743, to the nucleotide sequence of VGAM554 RNA, herein designated VGAM RNA, also designated SEQ ID:3265.

A function of VGAM554 is therefore inhibition of EphA8 (EPHA8, Accession NM_020526), a gene which Eph-related receptor tyrosine kinase A8. Accordingly, utilities of VGAM554 include diagnosis, prevention and treatment of diseases and clinical conditions associated with EPHA8. The function of EPHA8 and its association with various diseases and clinical conditions, has been established by previous studies, as described hereinabove with reference to VGAM494. Hormonally Upregulated Neu-associated Kinase (HUNK, Accession NM_014586) is another VGAM554 host target gene. HUNK BINDING SITE is HOST TARGET binding site found in the 3' untranslated region of mRNA encoded by HUNK, corresponding to a HOST TARGET binding site such as BINDING SITE I, BINDING SITE II or BINDING SITE III. Table 2 illustrates the complementarity of the nucleotide sequences of HUNK BINDING SITE, designated SEQ ID:15945, to the nucleotide sequence of VGAM554 RNA, herein designated VGAM RNA, also designated SEQ ID:3265.

Another function of VGAM554 is therefore inhibition of Hormonally Upregulated Neu-associated Kinase (HUNK, Accession NM_014586). Accordingly, utilities of VGAM554 include diagnosis, prevention and treatment of diseases and clinical conditions associated with HUNK. Integrin, Alpha 11 (ITGA11, Accession NM_012211) is another VGAM554 host target gene. ITGA11 BINDING SITE is HOST TARGET binding site found in the 3' untranslated region of mRNA encoded by ITGA11, corresponding to a HOST TARGET binding site such as BINDING SITE I, BINDING SITE II or BINDING SITE III. Table 2 illustrates the complementarity of the nucleotide sequences of ITGA11 BINDING SITE, designated SEQ ID:14512, to the nucleotide sequence of VGAM554 RNA, herein designated VGAM RNA, also designated SEQ ID:3265.

Another function of VGAM554 is therefore inhibition of Integrin, Alpha 11 (ITGA11, Accession NM_012211), a gene which acts as a collagen I receptor. Accordingly, utilities of VGAM554 include diagnosis, prevention and treatment of diseases and clinical conditions associated with ITGA11. The function of ITGA11 and its association with various diseases and clinical conditions, has been established by previous studies, as described hereinabove with reference to VGAM206. Nucleolar Protein 3 (apoptosis repressor with CARD domain) (NOL3, Accession NM_003946) is another VGAM554 host target gene. NOL3 BINDING SITE is HOST TARGET binding site found in the 3' untranslated region of mRNA encoded by NOL3, corresponding to a HOST TARGET binding site such as BINDING SITE I, BINDING SITE II or BINDING SITE III. Table 2 illustrates the complementarity of the nucleotide sequences of NOL3 BINDING SITE, designated SEQ ID:10064, to the nucleotide sequence of VGAM554 RNA, herein designated VGAM RNA, also designated SEQ ID:3265.

Another function of VGAM554 is therefore inhibition of Nucleolar Protein 3 (apoptosis repressor with CARD domain) (NOL3, Accession NM_003946), a gene which inhibits CASP2 and CASP8 and interacts with splicing factors. Accordingly, utilities of VGAM554 include diagnosis, prevention and treatment of diseases and clinical conditions associated with NOL3. The function of NOL3 has been established by previous studies. By searching an EST database for apoptosis-regulating proteins with homology to the caspase recruitment domain (CARD) of caspase-9 (CASP9; 602234), Koseki et al. (1998) identified a cDNA encoding ARC (apoptosis repressor with CARD). Sequence analysis predicted that the 208-amino acid ARC protein contains an N-terminal CARD and a C-terminal region rich in proline and glutamic acid. Northern blot analysis detected 5.5- and 1.0-kb ARC transcripts in skeletal muscle and heart, but no expression was detected in brain, placenta, lung, liver, kidney, pancreas, and lymphoid/hematopoietic tissues. To identify proteins involved in RNA processing, Stoss et al. (1999) used a yeast 2-hybrid screen with SRp30c (SFRS9; 601943) as bait on a HeLa library. They isolated a cDNA encoding a protein that they designated NOP30 (nucleolar protein of 30 kD) based on SDS-PAGE analysis. The authors also identified a cDNA encoding a smaller isoform that they termed MYC (muscle-enriched cytosolic protein), which is created by a frameshift and is identical to the ARC protein reported by Koseki et al. (1998). MYC did not interact with SFRS9. Sequence analysis of the 219-amino acid NOP30 protein predicted that it contains a highly acidic N terminus and a basic C terminus enriched with arginines, serines, and prolines and having multiple phosphorylation sites. Northern blot analysis detected 1.8- and 1.3-kb NOP30 transcripts, with highest expression in heart and skeletal muscle and weak expression in other tissues. In contrast, SFRS9 is relatively strongly and ubiquitously expressed as a 1.35-kb transcript. In situ hybridization analysis showed that NOP30 is expressed in the pia mater, a tissue surrounding the brain containing blood vessels lined with smooth muscle cells. Binding analysis indicated that NOP30 binds to itself and that the N and C termini of NOP30 interact with SFRS9 through its RS domain. Confocal microscopy demonstrated that NOP30, through its arginine-rich C terminus, colocalizes with B23 (NPM1; 164040) in the granular component of nucleoli; however, the majority of NOP30 was localized in the fibrillar component. NOP30 and SFRS9 colocalized in the nucleoplasm. In contrast, MYP, with its acidic N terminus, was predominantly localized in the cytoplasm.

Full details of the abovementioned studies are described in the following publications, the disclosure of which are hereby incorporated by reference:

Koseki, T.; Inohara, N.; Chen, S.; Nunez, G.: ARC, an inhibitor of apoptosis expressed in skeletal muscle and heart that interacts selectively with caspases. Proc. Nat. Acad. Sci. 95:5156-5160, 1998; and Stoss, O.; Schwaiger, F.-W.; Cooper, T. A.; Stamm, S.: Alternative splicing determines the intracellular localization of the novel nuclear protein Nop30 and its interaction with the sp.

Further studies establishing the function and utilities of NOL3 are found in John Hopkins OMIM database record ID 605235, and in sited publications numbered 7309-731 and 940 listed in the bibliography section hereinbelow, which are also hereby incorporated by reference. RecQ Protein-like 5 (RECQL5, Accession NM_004259) is another VGAM554 host target gene. RECQL5 BINDING SITE is HOST TARGET binding site found in the 3' untranslated region of mRNA encoded by RECQL5, corresponding to a HOST TARGET binding site such as BINDING SITE I, BINDING SITE II or BINDING SITE III. Table 2 illustrates the complementarity of the nucleotide sequences of RECQL5 BINDING SITE, designated SEQ ID:10447, to the nucleotide sequence of VGAM554 RNA, herein designated VGAM RNA, also designated SEQ ID:3265.

Another function of VGAM554 is therefore inhibition of RecQ Protein-like 5 (RECQL5, Accession NM_004259). Accordingly, utilities of VGAM554 include diagnosis, prevention and treatment of diseases and clinical conditions associated with RECQL5. SWI/SNF Related, Matrix Associated, Actin Dependent Regulator of Chromatin, Subfamily D, Member 2 (SMARCD2, Accession NM_003077) is another VGAM554 host target gene. SMARCD2 BINDING SITE is HOST TARGET binding site found in the 3' untranslated region of mRNA encoded by SMARCD2, corresponding to a HOST TARGET binding site such as BINDING SITE I, BINDING SITE II or BINDING SITE III. Table 2 illustrates the complementarity of the nucleotide sequences of SMARCD2 BINDING SITE, designated SEQ ID:9050, to the nucleotide sequence of VGAM554 RNA, herein designated VGAM RNA, also designated SEQ ID:3265.

Another function of VGAM554 is therefore inhibition of SWI/SNF Related, Matrix Associated, Actin Dependent Regulator of Chromatin, Subfamily D, Member 2 (SMARCD2, Accession NM_003077), a gene which is involved in chromatin remodeling. Accordingly, utilities of VGAM554 include diagnosis, prevention and treatment of diseases and clinical conditions associated with SMARCD2. The function of SMARCD2 has been established by previous studies. Chromatin is actively remodeled during development. Chromatin remodeling of certain genes appears to precede their transcriptional activation. In yeast, the multisubunit SWI/SNF complex is thought to be responsible for chromatin remodeling. Wang et al. (1996) isolated an analogous SWI/SNF complex from the human YT cell line. They found that the resultant complexes are composed of 9 to 12 polypeptides, which they termed BAFs (for BRG1-associated factors). Wang et al. (1996) cloned the BAF60b subunit based on its homology with BAF60a (OMIM Ref. No. 601735). BAF60b encodes a polypeptide of 475 amino acids and is homologous to the yeast SWP73 gene, a component of the yeast SWI/SNF chromatin remodeling complex. The human genes BAF60a, BAF60b, and BAF60c (OMIM Ref. No. 601737) are highly homologous. By PCR of a somatic cell hybrid panel and radiation hybrid analysis, Ring et al. (1998) mapped the SMARCD2 gene to chromosome 17q23-q24

Full details of the abovementioned studies are described in the following publications, the disclosure of which are hereby incorporated by reference:

Ring, H. Z.; Vameghi-Meyers, V.; Wang, W.; Crabtree, G. R.; Francke, U.: Five SWI/SNF-related, matrix-associated, actin-dependent regulator of chromatin (SMARC) genes are dispersed in the human genome. Genomics 51:140-143, 1998; and Wang, W.; Xue, Y.; Zhou, S.; Kuo, A.; Cairns, B. R.; Crabtree, G. R.: Diversity and specialization of mammalian SWI/SNF complexes. Genes Dev. 10:2117-2130, 1996.

Further studies establishing the function and utilities of SMARCD2 are found in John Hopkins OMIM database record ID 601736, and in sited publications numbered 9322-9323 listed in the bibliography section hereinbelow, which are also hereby incorporated by reference. Transmembrane, Cochlear Expressed, 1 (TMC1, Accession NM_138691) is another VGAM554 host target gene. TMC1 BINDING SITE is HOST TARGET binding site found in the 5' untranslated region of mRNA encoded by TMC1, corresponding to a HOST TARGET binding site such as BINDING SITE I, BINDING SITE II or BINDING SITE III. Table 2 illustrates the complementarity of the nucleotide sequences of TMC1 BINDING SITE, designated SEQ ID:28933, to the nucleotide sequence of VGAM554 RNA, herein designated VGAM RNA, also designated SEQ ID:3265.

Another function of VGAM554 is therefore inhibition of Transmembrane, Cochlear Expressed, 1 (TMC1, Accession NM_138691), a gene which is required for normal function of cochlear hair cells. Accordingly, utilities of VGAM554 include diagnosis, prevention and treatment of diseases and clinical conditions associated with TMC1. The function of TMC1 has been established by previous studies. By positional cloning, Kurima et al. (2002) identified the gene mutant in a form of autosomal dominant deafness (DFNA36; 606705) and of recessive deafness (DFNB7/B11; 600974) that map to the same interval on 9q13-q21. The authors evaluated several candidate genes in the critical region but found no mutations in the deaf families. To identify additional DFNA36/B7/B11 candidate genes based upon sequence similarity to related genes elsewhere in the genome, they initiated a systematic BLAST analysis of segments of genomic DNA sequence in the critical region. One sequence was found to be similar to a predicted gene (subsequently named TMC2; 606707) on 20p13. They used conserved sequences between TMC2 and the query sequence (subsequently named TMC1) on chromosome 9q13-q21 to design primers for amplifying potential TMC1 transcripts from a human fetal brain cDNA library. Kurima et al. (2002) found the longest open reading frame to be 2,283 nucleotides, predicting an 87-kD protein. The TMC1 protein is predicted to contain 6 transmembrane domains and to have cytoplasmic orientation of N and C termini. Kurima et al. (2002) obtained the orthologous mouse Tmc1 cDNA by RT-PCR and 5-prime and 3-prime RACE of mouse inner-ear cDNA. They found that in the mouse, Tmc1 mRNA is expressed in hair cells of the postnatal cochlea and vestibular end organs and is required for normal function of cochlear hair cells. Animal model experiments lend further support to the function of TMC1. Vreugde et al. (2002) identified a missense mutation in the Tmc1 gene in the mouse deaf mutant 'Beethoven' (Bth). Thus it is a mouse model for autosomal dominant progressive hearing loss (DFNA36; 606705). Similarly, the recessive deafness mutation dn, which maps to mouse chromosome 19, is a model of profound congenital deafness caused by mutations in the TMC1 gene: DFNB7 (OMIM Ref. No. 600974), also known as DFNB11.

It is appreciated that the abovementioned animal model for TMC1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kurima, K.; Peters. L. M.; Yang, Y.; Riazuddin, S.; Ahmed, Z. M.; Naz, S.; Arnaud, D.; Drury, S.; Mo, J.; Makishima, T.; Ghosh, M.; Menon, P. S. N.; and 13 others : Dominant and recessive deafness caused by mutations of a novel gene, TMC1, required for cochlear hair-cell function. Nature Genet. 30:277-284, 2002; and Vreugde, S.; Erven, A.; Kros, C. J.; Marcotti, W.; Fuches, H.; Kurima, K.; Wilcox, E. R.; Friedman, T. B.; Griffith, A. J.; Balling, R.; de Angelis, M. H.; Avraham, K. B.; Steel, K. P.

Further studies establishing the function and utilities of TMC1 are found in John Hopkins OMIM database record ID 606706, and in sited publications numbered 7799 listed in the bibliography section hereinbelow, which are also hereby incorporated by reference. Bobby Sox Homolog (Drosophila) (BBX, Accession NM_020235) is another VGAM554 host target gene. BBX BINDING SITE is HOST TARGET binding site found in the 5' untranslated region of mRNA encoded by BBX, corresponding to a HOST TARGET binding site such as BINDING SITE I, BINDING SITE II or BINDING SITE III. Table 2 illustrates the complementarity of the nucleotide sequences of BBX BINDING SITE, designated SEQ ID:21504, to the nucleotide sequence of VGAM554 RNA, herein designated VGAM RNA, also designated SEQ ID:3265.

Another function of VGAM554 is therefore inhibition of Bobby Sox Homolog (Drosophila) (BBX, Accession NM_020235). Accordingly, utilities of VGAM554 include diagnosis, prevention and treatment of diseases and clinical conditions associated with BBX. EphA7 (EPHA7, Accession NM_004440) is another VGAM554 host target gene. EPHA7 BINDING SITE is HOST TARGET binding site found in the 5' untranslated region of mRNA encoded by EPHA7, corresponding to a HOST TARGET binding site such as BIND- ING SITE I, BINDING SITE II or BINDING SITE III. Table 2 illustrates the complementarity of the nucleotide sequences of EPHA7 BINDING SITE, designated SEQ ID:10724, to the nucleotide sequence of VGAM554 RNA, herein designated VGAM RNA, also designated SEQ ID:3265.

Another function of VGAM554 is therefore inhibition of EphA7 (EPHA7, Accession NM_004440). Accordingly, utilities of VGAM554 include diagnosis, prevention and treatment of diseases and clinical conditions associated with EPHA7. FLJ14213 (Accession NM_024841) is another VGAM554 host target gene. FLJ14213 BINDING SITE is HOST TARGET binding site found in the 3' untranslated region of mRNA encoded by FLJ14213, corresponding to a HOST TARGET binding site such as BINDING SITE I, BINDING SITE II or BINDING SITE III. Table 2 illustrates the complementarity of the nucleotide sequences of FLJ14213 BINDING SITE, designated SEQ ID:24251, to the nucleotide sequence of VGAM554 RNA, herein designated VGAM RNA, also designated SEQ ID:3265.

Another function of VGAM554 is therefore inhibition of FLJ14213 (Accession NM_024841). Accordingly, utilities of VGAM554 include diagnosis, prevention and treatment of diseases and clinical conditions associated with FLJ14213. FLJ20004 (Accession XM_170889) is another VGAM554 host target gene. FLJ20004 BINDING SITE is HOST TARGET binding site found in the 3' untranslated region of mRNA encoded by FLJ20004, corresponding to a HOST TARGET binding site such as BINDING SITE I, BINDING SITE II or BINDING SITE III. Table 2 illustrates the complementarity of the nucleotide sequences of FLJ20004 BINDING SITE, designated SEQ ID:45646, to the nucleotide sequence of VGAM554 RNA, herein designated VGAM RNA, also designated SEQ ID:3265.

Another function of VGAM554 is therefore inhibition of FLJ20004 (Accession XM_170889). Accordingly, utilities of VGAM554 include diagnosis, prevention and treatment of diseases and clinical conditions associated with FLJ20004. FLJ20378 (Accession NM_017795) is another VGAM554 host target gene. FLJ20378 BINDING SITE is HOST TARGET binding site found in the 3' untranslated region of mRNA encoded by FLJ20378, corresponding to a HOST TARGET binding site such as BINDING SITE I, BINDING SITE II or BINDING SITE III. Table 2 illustrates the complementarity of the nucleotide sequences of FLJ20378 BINDING SITE, designated SEQ ID:19434, to the nucleotide sequence of VGAM554 RNA, herein designated VGAM RNA, also designated SEQ ID:3265.

Another function of VGAM554 is therefore inhibition of FLJ20378 (Accession NM_017795). Accordingly, utilities of VGAM554 include diagnosis, prevention and treatment of diseases and clinical conditions associated with FLJ20378. KIAA0711 (Accession NM_014867) is another VGAM554 host target gene. KIAA0711 BINDING SITE is HOST TARGET binding site found in the 5' untranslated region of mRNA encoded by KIAA0711, corresponding to a HOST TARGET binding site such as BINDING SITE I, BINDING SITE II or BINDING SITE III. Table 2 illustrates the complementarity of the nucleotide sequences of KIAA0711 BINDING SITE, designated SEQ ID:16961, to the nucleotide sequence of VGAM554 RNA, herein designated VGAM RNA, also designated SEQ ID:3265.

Another function of VGAM554 is therefore inhibition of KIAA0711 (Accession NM_014867). Accordingly, utilities of VGAM554 include diagnosis, prevention and treatment of diseases and clinical conditions associated with KIAA0711. KIAA0992 (Accession NM_016081) is another VGAM554 host target gene. KIAA0992 BINDING SITE is HOST TARGET binding site found in the 3' untranslated region of mRNA encoded by KIAA0992, corresponding to a HOST TARGET binding site such as BINDING SITE I, BINDING SITE II or BINDING SITE III. Table 2 illustrates the complementarity of the nucleotide sequences of KIAA0992 BINDING SITE, designated SEQ ID:18158, to the nucleotide sequence of VGAM554 RNA, herein designated VGAM RNA, also designated SEQ ID:3265.

Another function of VGAM554 is therefore inhibition of KIAA0992 (Accession NM_016081). Accordingly, utilities of VGAM554 include diagnosis, prevention and treatment of diseases and clinical conditions associated with KIAA0992. KIAA1130 (Accession XM_031104) is another VGAM554 host target gene. KIAA1130 BINDING SITE is HOST TARGET binding site found in the 3' untranslated region of mRNA encoded by KIAA1130, corresponding to a HOST TARGET binding site such as BINDING SITE I, BINDING SITE II or BINDING SITE III. Table 2 illustrates the complementarity of the nucleotide sequences of KIAA1130 BINDING SITE, designated SEQ ID:31280, to the nucleotide sequence of VGAM554 RNA, herein designated VGAM RNA, also designated SEQ ID:3265.

Another function of VGAM554 is therefore inhibition of KIAA1130 (Accession XM_031104). Accordingly, utilities of VGAM554 include diagnosis, prevention and treatment of diseases and clinical conditions associated with KIAA1130. Leucine-rich Repeat Protein, Neuronal 3 (LRRN3, Accession XM_045261) is another VGAM554 host target gene. LRRN3 BINDING SITE is HOST TARGET binding site found in the 5' untranslated region of mRNA encoded by LRRN3, corresponding to a HOST TARGET binding site such as BINDING SITE I, BINDING SITE II or BINDING SITE III. Table 2 illustrates the complementarity of the nucleotide sequences of LRRN3 BINDING SITE, designated SEQ ID:34401, to the nucleotide sequence of VGAM554 RNA, herein designated VGAM RNA, also designated SEQ ID:3265.

Another function of VGAM554 is therefore inhibition of Leucine-rich Repeat Protein, Neuronal 3 (LRRN3, Accession XM_045261). Accordingly, utilities of VGAM554 include diagnosis, prevention and treatment of diseases and clinical conditions associated with LRRN3. MGC22014 (Accession XM_035307) is another VGAM554 host target gene. MGC22014 BINDING SITE is HOST TARGET binding site found in the 3' untranslated region of mRNA encoded by MGC22014, corresponding to a HOST TARGET binding site such as BINDING SITE I, BINDING SITE II or BINDING SITE III. Table 2 illustrates the complementarity of the nucleotide sequences of MGC22014 BINDING SITE, designated SEQ ID:32216, to the nucleotide sequence of VGAM554 RNA, herein designated VGAM RNA, also designated SEQ ID:3265.

Another function of VGAM554 is therefore inhibition of MGC22014 (Accession XM_035307). Accordingly, utilities of VGAM554 include diagnosis, prevention and treatment of diseases and clinical conditions associated with MGC22014. MGC3248 (Accession NM_032486) is another VGAM554 host target gene. MGC3248 BINDING SITE is HOST TARGET binding site found in the 3' untranslated region of mRNA encoded by MGC3248, corresponding to a HOST TARGET binding site such as BINDING SITE I, BINDING SITE II or BINDING SITE III. Table 2 illustrates the complementarity of the nucleotide sequences of MGC3248 BINDING SITE, designated SEQ ID:26236, to the nucleotide sequence of VGAM554 RNA, herein designated VGAM RNA, also designated SEQ ID:3265.

Another function of VGAM554 is therefore inhibition of MGC3248 (Accession NM_032486). Accordingly, utilities of VGAM554 include diagnosis, prevention and treatment of diseases and clinical conditions associated with MGC3248. PDZ Domain Containing 2 (PDZD2, Accession XM_087705) is another VGAM554 host target gene. PDZD2 BINDING SITE is HOST TARGET binding site found in the 3' untranslated region of mRNA encoded by PDZD2, corresponding to a HOST TARGET binding site such as BINDING SITE I, BINDING SITE II or BINDING SITE III. Table 2 illustrates the complementarity of the nucleotide sequences of PDZD2 BINDING SITE, designated SEQ ID:39388, to the nucleotide sequence of VGAM554 RNA, herein designated VGAM RNA, also designated SEQ ID:3265.

Another function of VGAM554 is therefore inhibition of PDZ Domain Containing 2 (PDZD2, Accession XM_087705). Accordingly, utilities of VGAM554 include diagnosis, prevention and treatment of diseases and clinical conditions associated with PDZD2. PRO2859 (Accession NM_018543) is another VGAM554 host target gene. PRO2859 BINDING SITE is HOST TARGET binding site found in the 5' untranslated region of mRNA encoded by PRO2859, corresponding to a HOST TARGET binding site such as BINDING SITE I, BINDING SITE II or BINDING SITE III. Table 2 illustrates the complementarity of the nucleotide sequences of PRO2859 BINDING SITE, designated SEQ ID:20615, to the nucleotide sequence of VGAM554 RNA, herein designated VGAM RNA, also designated SEQ ID:3265.

Another function of VGAM554 is therefore inhibition of PRO2859 (Accession NM_018543). Accordingly, utilities of VGAM554 include diagnosis, prevention and treatment of diseases and clinical conditions associated with PRO2859. Protein Serine Kinase H1 (PSKH1, Accession XM_043047) is another VGAM554 host target gene. PSKH1 BINDING SITE is HOST TARGET binding site found in the 3' untranslated region of mRNA encoded by PSKH1, corresponding to a HOST TARGET binding site such as BINDING SITE I, BINDING SITE II or BINDING SITE III. Table 2 illustrates the complementarity of the nucleotide sequences of PSKH1 BINDING SITE, designated SEQ ID:33867, to the nucleotide sequence of VGAM554 RNA, herein designated VGAM RNA, also designated SEQ ID:3265.

Another function of VGAM554 is therefore inhibition of Protein Serine Kinase H1 (PSKH1, Accession XM_043047). Accordingly, utilities of VGAM554 include diagnosis, prevention and treatment of diseases and clinical conditions associated with PSKH1. LOC123242 (Accession XM_063548) is another VGAM554 host target gene. LOC123242 BINDING SITE is HOST TARGET binding site found in the 5' untranslated region of mRNA encoded by LOC123242, corresponding to a HOST TARGET binding site such as BINDING SITE I, BINDING SITE II or BINDING SITE III. Table 2 illustrates the complementarity of the nucleotide sequences of LOC123242 BINDING SITE, designated SEQ ID:37239, to the nucleotide sequence of VGAM554 RNA, herein designated VGAM RNA, also designated SEQ ID:3265.

Another function of VGAM554 is therefore inhibition of LOC123242 (Accession XM_063548). Accordingly, utilities of VGAM554 include diagnosis, prevention and treatment of diseases and clinical conditions associated with LOC123242. LOC127703 (Accession XM_059172) is another VGAM554 host target gene. LOC127703 BINDING SITE is HOST TARGET binding site found in the 3' untranslated region of mRNA encoded by LOC127703, corresponding to a HOST TARGET binding site such as BINDING SITE I, BINDING SITE II or BINDING SITE III. Table 2 illustrates the complementarity of the nucleotide sequences of LOC127703 BINDING SITE, designated SEQ ID:36908, to the nucleotide sequence of VGAM554 RNA, herein designated VGAM RNA, also designated SEQ ID:3265.

Another function of VGAM554 is therefore inhibition of LOC127703 (Accession XM_059172). Accordingly, utilities of VGAM554 include diagnosis, prevention and treatment of diseases and clinical conditions associated with LOC127703. LOC157273 (Accession XM_098743) is another VGAM554 host target gene. LOC157273 BINDING SITE is HOST TARGET binding site found in the 3' untranslated region of mRNA encoded by LOC157273, corresponding to a HOST TARGET binding site such as BINDING SITE I, BINDING SITE II or BINDING SITE III. Table 2 illustrates the complementarity of the nucleotide sequences of LOC157273 BINDING SITE, designated SEQ ID:41781, to the nucleotide sequence of VGAM554 RNA, herein designated VGAM RNA, also designated SEQ ID:3265.

Another function of VGAM554 is therefore inhibition of LOC157273 (Accession XM_098743). Accordingly, utilities of VGAM554 include diagnosis, prevention and treatment of diseases and clinical conditions associated with LOC157273. LOC221463 (Accession XM_166374) is another VGAM554 host target gene. LOC221463 BINDING SITE is HOST TARGET binding site found in the 3' untranslated region of mRNA encoded by LOC221463, corresponding to a HOST TARGET binding site such as BINDING SITE I, BINDING SITE II or BINDING SITE III. Table 2 illustrates the complementarity of the nucleotide sequences of LOC221463 BINDING SITE, designated SEQ ID:44204, to the nucleotide sequence of VGAM554 RNA, herein designated VGAM RNA, also designated SEQ ID:3265.

Another function of VGAM554 is therefore inhibition of LOC221463 (Accession XM_166374). Accordingly, utilities of VGAM554 include diagnosis, prevention and treatment of diseases and clinical conditions associated with LOC221463. LOC253001 (Accession XM_171711) is another VGAM554 host target gene. LOC253001 BINDING SITE is HOST TARGET binding site found in the 5' untranslated region of mRNA encoded by LOC253001, corresponding to a HOST TARGET binding site such as BINDING SITE I, BINDING SITE II or BINDING SITE III. Table 2 illustrates the complementarity of the nucleotide sequences of LOC253001 BINDING SITE, designated SEQ ID:46056, to the nucleotide sequence of VGAM554 RNA, herein designated VGAM RNA, also designated SEQ ID:3265.

Another function of VGAM554 is therefore inhibition of LOC253001 (Accession XM_171711). Accordingly, utilities of VGAM554 include diagnosis, prevention and treatment of diseases and clinical conditions associated with LOC253001. LOC56965 (Accession NM_020213) is another VGAM554 host target gene. LOC56965 BINDING SITE is HOST TARGET binding site found in the 3' untranslated region of mRNA encoded by LOC56965, corresponding to a HOST TARGET binding site such as BINDING SITE I, BINDING SITE II or BINDING SITE III. Table 2 illustrates the complementarity of the nucleotide sequences of LOC56965 BINDING SITE, designated SEQ ID:21453, to the nucleotide sequence of VGAM554 RNA, herein designated VGAM RNA, also designated SEQ ID:3265.

Another function of VGAM554 is therefore inhibition of LOC56965 (Accession NM_020213). Accordingly, utilities of VGAM554 include diagnosis, prevention and treatment of diseases and clinical conditions associated with LOC56965. FIG. 1 further provides a conceptual description of a novel bioinformatically detected viral gene of the present invention, referred to here as Viral Genomic Address Messenger 555 (VGAM555) viral gene, which modulates expression of respective host target genes thereof, the function and utility of which host target genes is known in the art.

VGAM555 is a novel bioinformatically detected regulatory, non protein coding, viral micro RNA (miRNA) gene. The method by which VGAM555 was detected is described hereinabove with reference to FIGS. 1-8.

VGAM555 gene, herein designated VGAM GENE, is a viral gene contained in the genome of Spodoptera Exigua Nucleopolyhedrovirus. VGAM555 host target gene, herein designated VGAM HOST TARGET GENE, is a human gene contained in the human genome.

VGAM555 gene encodes a VGAM555 precursor RNA, herein designated VGAM PRECURSOR RNA. Similar to other miRNA genes, and unlike most ordinary genes, VGAM555 precursor RNA does not encode a protein. A nucleotide sequence identical or highly similar to the nucleotide sequence of VGAM555 precursor RNA is designated SEQ ID:541, and is provided hereinbelow with reference to the sequence listing part. Nucleotide sequence SEQ ID:541 is located at position 47117 relative to the genome of Spodoptera Exigua Nucleopolyhedrovirus.

VGAM555 precursor RNA folds onto itself, forming VGAM555 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM555 folded precursor RNA into VGAM555 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM555 RNA is designated SEQ ID:3266, and is provided hereinbelow with reference to the sequence listing part.

VGAM555 host target gene, herein designated VGAM HOST TARGET GENE, encodes a corresponding messenger RNA, VGAM555 host target RNA, herein designated VGAM HOST TARGET RNA. VGAM555 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM555 RNA, herein designated VGAM RNA, binds complementarily to one or more host target binding sites located in untranslated regions of VGAM555 host target RNA, herein designated VGAM HOST TARGET RNA. This complementary binding is due to the fact that the nucleotide sequence of VGAM555 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM555 RNA, herein designated VGAM RNA, may have a different number of host target binding sites in untranslated regions of a VGAM555 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM555 RNA, herein designated VGAM RNA, to host target binding sites on VGAM555 host target RNA, herein designated VGAM HOST TARGET RNA, such as BINDING SITE I, BINDING SITE II and BINDING SITE III, inhibits translation of VGAM555 host target RNA into VGAM555 host target protein, herein designated VGAM HOST TARGET PROTEIN. VGAM host target protein is therefore outlined by a broken line.

It is appreciated that VGAM555 host target gene, herein designated VGAM HOST TARGET GENE, in fact represents a plurality of VGAM555 host target genes. The mRNA of each one of this plurality of VGAM555 host target genes comprises one or more host target binding sites, each having a nucleotide sequence which is at least partly complementary to VGAM555 RNA, herein designated VGAM RNA, and which when bound by VGAM555 RNA causes inhibition of translation of respective one or more VGAM555 host target proteins.

It is further appreciated by one skilled in the art that the mode of translational inhibition illustrated by FIG. 1 with specific reference to translational inhibition exerted by VGAM555 gene, herein designated VGAM GENE, on one or more VGAM555 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM555 is inhibition of expression of host target genes, as part of a novel viral mechanism of attacking a host. Accordingly, utilities of VGAM555 include diagnosis, prevention and treatment of viral infection by Spodoptera Exigua Nucleopolyhedrovirus. Specific functions, and accordingly utilities, of VGAM555 correlate with, and may be deduced from, the identity of the host target genes which VGAM555 binds and inhibits, and the function of these host target genes, as elaborated hereinbelow.

Nucleotide sequences of the VGAM555 precursor RNA, herein designated VGAM PRECURSOR RNA, and of the 'diced' VGAM555 RNA, herein designated VGAM RNA, and a schematic representation of the secondary folding of VGAM555 folded precursor RNA, herein designated VGAM FOLDED PRECURSOR RNA, of VGAM555 are further described hereinbelow with reference to Table 1.

Nucleotide sequences of host target binding sites, such as BINDING SITE-I, BINDING SITE-II and BINDING SITE-III of FIG. 1, found on VGAM555 host target RNA, and schematic representation of the complementarity of each of these host target binding sites to VGAM555 RNA, herein designated VGAM RNA, are described hereinbelow with reference to Table 2.

As mentioned hereinabove with reference to FIG. 1, a function of VGAM555 gene, herein designated VGAM is inhibition of expression of VGAM555 target genes. It is appreciated that specific functions, and accordingly utilities, of VGAM555 correlate with, and may be deduced from, the identity of the target genes which VGAM555 binds and inhibits, and the function of these target genes, as elaborated hereinbelow.

Protein Tyrosine Kinase 2 Beta (PTK2B, Accession NM_004103) is a VGAM555 host target gene. PTK2B BINDING SITE is HOST TARGET binding site found in the 5' untranslated region of mRNA encoded by PTK2B, corresponding to a HOST TARGET binding site such as BINDING SITE I, BINDING SITE II or BINDING SITE III. Table 2 illustrates the complementarity of the nucleotide sequences of PTK2B BINDING SITE, designated SEQ ID:10312, to the nucleotide sequence of VGAM555 RNA, herein designated VGAM RNA, also designated SEQ ID:3266.

A function of VGAM555 is therefore inhibition of Protein Tyrosine Kinase 2 Beta (PTK2B, Accession NM_004103), a gene which is involved in calcium induced regulation of ion channel and activation of the map kinase signaling pathway. Accordingly, utilities of VGAM555 include diagnosis, prevention and treatment of diseases and clinical conditions associated with PTK2B. The function of PTK2B has been established by previous studies. Lev et al. (1995) showed that the PYK2 protein undergoes rapid tyrosine phosphorylation in response to various stimuli that elevate intracellular calcium concentration, such as addition of bradykinin, a neuropeptide hormone that binds to a G protein-coupled receptor and in turn stimulates phosphatidylinositol hydrolysis. PYK2 is also tyrosine phosphorylated following activation of the nicotinic acetylcholine receptor (see OMIM Ref. No. 100690), by membrane depolarization, and by treatment of cells with a calcium ionophore. Protein kinase C (OMIM Ref. No. 176960) activation also induces PYK2 phosphorylation. Activation of PYK2 leads to the modulation of ion channel function and activation of the MAP kinase signaling pathway. Lev et al. (1995) proposed that PYK2 may represent an important signaling intermediate between neuropeptide activated receptors or neurotransmitters that increase calcium flux and the downstream signals that regulate neuronal activity. PYK2 may also provide a mechanism for a variety of short- and long-term calcium-dependent signaling events in the nervous system. Hepatitis B virus (HBV) causes acute and chronic infection of the liver and is also a risk factor for hepatic cancer. The virus has only 4 open reading frames, 3 of which encode the capsid, envelope, and polymerase proteins. The fourth encodes HBX, a poorly expressed protein required for viral replication (Ganem, 2001). Bouchard et al. (2001) showed that HBX induces release of calcium into the cytoplasm, presumably from mitochondria or endoplasmic reticulum. HBX expression thereby induces activation of PYK2, which activates SRC (OMIM Ref. No. 190090) and HBV DNA replication. Inhibition of PYK2 or calcium signaling mediated by mitochondrial calcium channels could block HBV DNA replication, and enhancement of cytoplasmic calcium was able to substitute for HBX in stimulating HBV DNA replication.

Full details of the abovementioned studies are described in the following publications, the disclosure of which are hereby incorporated by reference:

Lev, S.; Moreno, H.; Martinez, R.; Canoll, P.; Peles, E.; Musacchio, J. M.; Plowman, G. D.; Rudy, B.; Schlessinger, J.: Protein tyrosine kinase PYK2 involved in Ca (2+)-induced regulation of ion channel and MAP kinase functions. Nature 376:737-745, 1995; and Bouchard, M. J.; Wang, L.-H.; Schneider, R. J.: Calcium signaling by HBx protein in hepatitis B virus DNA replication. Science 294:2376-2378, 2001.

Further studies establishing the function and utilities of PTK2B are found in John Hopkins OMIM database record ID 601212, and in sited publications numbered 6887-6893 listed in the bibliography section hereinbelow, which are also hereby incorporated by reference. FLJ10583 (Accession NM_018148) is another VGAM555 host target gene. FLJ10583 BINDING SITE is HOST TARGET binding site found in the 5' untranslated region of mRNA encoded by FLJ10583, corresponding to a HOST TARGET binding site such as BINDING SITE I, BINDING SITE II or BINDING SITE III. Table 2 illustrates the complementarity of the nucleotide sequences of FLJ10583 BINDING SITE, designated SEQ ID:19949, to the nucleotide sequence of VGAM555 RNA, herein designated VGAM RNA, also designated SEQ ID:3266.

Another function of VGAM555 is therefore inhibition of FLJ10583 (Accession NM_018148). Accordingly, utilities of VGAM555 include diagnosis, prevention and treatment of diseases and clinical conditions associated with FLJ10583. MGC4562 (Accession NM_133375) is another VGAM555 host target gene. MGC4562 BINDING SITE is HOST TARGET binding site found in the 5' untranslated region of mRNA encoded by MGC4562, corresponding to a HOST TARGET binding site such as BINDING SITE I, BINDING SITE II or BINDING SITE III. Table 2 illustrates the complementarity of the nucleotide sequences of MGC4562 BINDING SITE, designated SEQ ID:28496, to the nucleotide sequence of VGAM555 RNA, herein designated VGAM RNA, also designated SEQ ID:3266.

Another function of VGAM555 is therefore inhibition of MGC4562 (Accession NM_133375). Accordingly, utilities of VGAM555 include diagnosis, prevention and treatment of diseases and clinical conditions associated with MGC4562. Trimethyllysine Hydroxylase, Epsilon (TMLHE, Accession NM_018196) is another VGAM555 host target gene. TMLHE BINDING SITE is HOST TARGET binding site found in the 3' untranslated region of mRNA encoded by TMLHE, corresponding to a HOST TARGET binding site such as BINDING SITE I, BINDING SITE II or BINDING SITE III. Table 2 illustrates the complementarity of the nucleotide sequences of TMLHE BINDING SITE, designated SEQ ID:20062, to the nucleotide sequence of VGAM555 RNA, herein designated VGAM RNA, also designated SEQ ID:3266.

Another function of VGAM555 is therefore inhibition of Trimethyllysine Hydroxylase, Epsilon (TMLHE, Accession NM_018196). Accordingly, utilities of VGAM555 include diagnosis, prevention and treatment of diseases and clinical conditions associated with TMLHE. LOC139673 (Accession XM_071645) is another VGAM555 host target gene. LOC139673 BINDING SITE is HOST TARGET binding site found in the 3' untranslated region of mRNA encoded by LOC139673, corresponding to a HOST TARGET binding site such as BINDING SITE I, BINDING SITE II or BINDING SITE III. Table 2 illustrates the complementarity of the nucleotide sequences of LOC139673 BINDING SITE, designated SEQ ID:37403, to the nucleotide sequence of VGAM555 RNA, herein designated VGAM RNA, also designated SEQ ID:3266.

Another function of VGAM555 is therefore inhibition of LOC139673 (Accession XM_071645). Accordingly, utilities of VGAM555 include diagnosis, prevention and treatment of diseases and clinical conditions associated with LOC139673. FIG. 1 further provides a conceptual description of a novel bioinformatically detected viral gene of the present invention, referred to here as Viral Genomic Address Messenger 556 (VGAM556) viral gene, which modulates expression of respective host target genes thereof, the function and utility of which host target genes is known in the art.

VGAM556 is a novel bioinformatically detected regulatory, non protein coding, viral micro RNA (miRNA) gene. The method by which VGAM556 was detected is described hereinabove with reference to FIGS. 1-8.

VGAM556 gene, herein designated VGAM GENE, is a viral gene contained in the genome of Spodoptera Exigua Nucleopolyhedrovirus. VGAM556 host target gene, herein designated VGAM HOST TARGET GENE, is a human gene contained in the human genome.

VGAM556 gene encodes a VGAM556 precursor RNA, herein designated VGAM PRECURSOR RNA. Similar to other miRNA genes, and unlike most ordinary genes, VGAM556 precursor RNA does not encode a protein. A nucleotide sequence identical or highly similar to the nucleotide sequence of VGAM556 precursor RNA is designated SEQ ID:542, and is provided hereinbelow with reference to the sequence listing part. Nucleotide sequence SEQ ID:542 is located at position 47004 relative to the genome of Spodoptera Exigua Nucleopolyhedrovirus.

VGAM556 precursor RNA folds onto itself, forming VGAM556 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM556 folded precursor RNA into VGAM556 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM556 RNA is designated SEQ ID:3267, and is provided hereinbelow with reference to the sequence listing part.

VGAM556 host target gene, herein designated VGAM HOST TARGET GENE, encodes a corresponding messenger RNA, VGAM556 host target RNA, herein designated VGAM HOST TARGET RNA. VGAM556 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM556 RNA, herein designated VGAM RNA, binds complementarily to one or more host target binding sites located in untranslated regions of VGAM556 host target RNA, herein designated VGAM HOST TARGET RNA. This complementary binding is due to the fact that the nucleotide sequence of VGAM556 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM556 RNA, herein designated VGAM RNA, may have a different number of host target binding sites in untranslated regions of a VGAM556 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM556 RNA, herein designated VGAM RNA, to host target binding sites on VGAM556 host target RNA, herein designated VGAM HOST TARGET RNA, such as BINDING SITE I, BINDING SITE II and BINDING SITE III, inhibits translation of VGAM556 host target RNA into VGAM556 host target protein, herein designated VGAM HOST TARGET PROTEIN. VGAM host target protein is therefore outlined by a broken line.

It is appreciated that VGAM556 host target gene, herein designated VGAM HOST TARGET GENE, in fact represents a plurality of VGAM556 host target genes. The mRNA of each one of this plurality of VGAM556 host target genes comprises one or more host target binding sites, each having a nucleotide sequence which is at least partly complementary to VGAM556 RNA, herein designated VGAM RNA, and which when bound by VGAM556 RNA causes inhibition of translation of respective one or more VGAM556 host target proteins.

It is further appreciated by one skilled in the art that the mode of translational inhibition illustrated by FIG. 1 with specific reference to translational inhibition exerted by VGAM556 gene, herein designated VGAM GENE, on one or more VGAM556 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM556 is inhibition of expression of host target genes, as part of a novel viral mechanism of attacking a host. Accordingly, utilities of VGAM556 include diagnosis, prevention and treatment of viral infection by Spodoptera Exigua Nucleopolyhedrovirus. Specific functions, and accordingly utilities, of VGAM556 correlate with, and may be deduced from, the identity of the host target genes which VGAM556 binds and inhibits, and the function of these host target genes, as elaborated hereinbelow.

Nucleotide sequences of the VGAM556 precursor RNA, herein designated VGAM PRECURSOR RNA, and of the 'diced' VGAM556 RNA, herein designated VGAM RNA, and a schematic representation of the secondary folding of VGAM556 folded precursor RNA, herein designated VGAM FOLDED PRECURSOR RNA, of VGAM556 are further described hereinbelow with reference to Table 1.

Nucleotide sequences of host target binding sites, such as BINDING SITE-I, BINDING SITE-II and BINDING SITE-III of FIG. 1, found on VGAM556 host target RNA, and schematic representation of the complementarity of each of these host target binding sites to VGAM556 RNA, herein designated VGAM RNA, are described hereinbelow with reference to Table 2.

As mentioned hereinabove with reference to FIG. 1, a function of VGAM556 gene, herein designated VGAM is inhibition of expression of VGAM556 target genes. It is appreciated that specific functions, and accordingly utilities, of VGAM556 correlate with, and may be deduced from, the identity of the target genes which VGAM556 binds and inhibits, and the function of these target genes, as elaborated hereinbelow.

V-abl Abelson Murine Leukemia Viral Oncogene Homolog 2 (arg, Abelson-related gene) (ABL2, Accession NM_007314) is a VGAM556 host target gene. ABL2 BINDING SITE is HOST TARGET binding site found in the 5' untranslated region of mRNA encoded by ABL2, corresponding to a HOST TARGET binding site such as BINDING SITE I, BINDING SITE II or BINDING SITE III. Table 2 illustrates the complementarity of the nucleotide sequences of ABL2 BINDING SITE, designated SEQ ID:14229, to the nucleotide sequence of VGAM556 RNA, herein designated VGAM RNA, also designated SEQ ID:3267.

A function of VGAM556 is therefore inhibition of V-abl Abelson Murine Leukemia Viral Oncogene Homolog 2 (arg, Abelson-related gene) (ABL2, Accession NM_007314), a gene which Cytoplasmic tyrosine kinase of the Abelson subfamily. Accordingly, utilities of VGAM556 include diagnosis, prevention and treatment of diseases and clinical conditions associated with ABL2. The function of ABL2 has been established by previous studies. Kruh et al. (1986) identified a novel oncogene related to ABL (OMIM Ref. No. 189980) in DNA sequences from human plasma. The new sequence, called ARG by the authors, was localized by in situ hybridization and somatic cell analysis to human chromosome 1q24-q25. The detection of a novel 12-kb transcript from this gene in human normal and tumor cells establishes it as a new member of the tyrosine kinase family that is closely related to but distinct from ABL. A constitutional fragile site is located at 1q24-q25. Seldin and Kruh (1989) mapped the mouse homolog (Abll) to chromosome 1 by analysis of segregation with other distal chromosome 1 genetic polymorphisms in a panel of DNAs from interspecific backcross mice. This defined a region of distal mouse chromosome 1 homologous with human chromosome 1q21-q32.

Full details of the abovementioned studies are described in the following publications, the disclosure of which are hereby incorporated by reference:

Kruh, G. D.; King, C. R.; Kraus, M. H.; Popescu, N. C.; Amsbaugh, S. C.; McBride, W. O.; Aaronson, S. A.: A novel human gene closely related to the abl proto-oncogene. Science 234:1545-1548, 1986; and Seldin, M. F.; Kruh, G. D.: Mapping of Abll within a conserved linkage group on distal mouse chromosome 1 syntenic with human chromosome 1 using an interspecific cross. Genomics 4:221.

Further studies establishing the function and utilities of ABL2 are found in John Hopkins OMIM database record ID 164690, and in sited publications numbered 10900-10901, 1103 and 11040 listed in the bibliography section hereinbelow, which are also hereby incorporated by reference. ATP Synthase, H+ Transporting, Mitochondrial F0 Complex, Subunit F6 (ATP5J, Accession NM_001685) is another VGAM556 host target gene. ATP5J BINDING SITE is HOST TARGET binding site found in the 5' untranslated region of mRNA encoded by ATP5J, corresponding to a HOST TARGET binding site such as BINDING SITE I, BINDING SITE II or BINDING SITE III. Table 2 illustrates the complementarity of the nucleotide sequences of ATP5J BINDING SITE, designated SEQ ID:7406, to the nucleotide sequence of VGAM556 RNA, herein designated VGAM RNA, also designated SEQ ID:3267.

Another function of VGAM556 is therefore inhibition of ATP Synthase, H+ Transporting, Mitochondrial F0 Complex, Subunit F6 (ATP5J, Accession NM_001685), a gene which is one of the chains of the nonenzymatic component of the mitochondrial ATPase complex. Accordingly, utilities of VGAM556 include diagnosis, prevention and treatment of diseases and clinical conditions associated with ATP5J. The function of ATP5J has been established by previous studies. H(+)-ATP synthase is a multisubunit membrane-bound enzyme complex consisting of an F0 segment embedded in the membrane and an F1 segment attached to the F0. The F1 segment provides the catalytic activity for the interconversion of ADP and ATP, whereas the F0 segment contains a proton channel that couples the transmembrane H+ gradient and membrane potential generated by electron transport to the synthesis of ATP in the F1 domain. Coupling factor 6 (F6) is a soluble integral component of mitochondrial ATP synthase that is required for the interactions of the catalytic and proton-translocating segments. Higuti et al. (1991) and Javed et al. (1991) independently isolated a cDNA encoding F6, or ATP5J, from human kidney and human fetal muscle cDNA libraries, respectively. The deduced protein consists of a 32-amino acid import signal peptide and a mature 76-amino acid polypeptide with an estimated molecular mass of 8,969 Da. Javed et al. (1991) and Higuti et al. (1991) noted that the predicted import signal peptide is rich in basic amino acids, devoid of acidic amino acids, and amphiphilic, which allows it to be water-soluble yet capable of passage through the phospholipid membrane bilayers. The authors reported that the mature human F6 protein has 81% sequence identity with bovine F6, and Higuti et al. (1991) stated that human F6 shares 72% sequence identity with rat F6.

Full details of the abovementioned studies are described in the following publications, the disclosure of which are hereby incorporated by reference:

Higuti, T.; Tsurumi, C.; Kawamura, Y.; Tsujita, H.; Osaka, F.; Yoshihara, Y.; Tani, I.; Tanaka, K.; Ichihara, A.: Molecular cloning of cDNA for the import precursor of human coupling factor 6 of H(+)-ATP synthase in mitochondria. Biochem. Biophys. Res. Commun. 178:793-799, 1991; and Javed, A. A.; Ogata, K.; Sanadi, D. R.: Human mitochondrial ATP synthase: cloning cDNA for the nuclear-encoded precursor of coupling factor 6. Gene 97: 307-310, 1991.

Further studies establishing the function and utilities of ATP5J are found in John Hopkins OMIM database record ID 603152, and in sited publications numbered 5432-5434 listed in the bibliography section hereinbelow, which are also hereby incorporated by reference. Cadherin 6, Type 2, K-cadherin (fetal kidney) (CDH6, Accession NM_004932) is another VGAM556 host target gene. CDH6 BINDING SITE is HOST TARGET binding site found in the 5' untranslated region of mRNA encoded by CDH6, corresponding to a HOST TARGET binding site such as BINDING SITE I, BINDING SITE II or BINDING SITE III. Table 2 illustrates the complementarity of the nucleotide sequences of CDH6 BINDING SITE, designated SEQ ID:11374, to the nucleotide sequence of VGAM556 RNA, herein designated VGAM RNA, also designated SEQ ID:3267.

Another function of VGAM556 is therefore inhibition of Cadherin 6, Type 2, K-cadherin (fetal kidney) (CDH6, Accession NM_004932), a gene which is a calcium dependent cell adhesion protein. Accordingly, utilities of VGAM556 include diagnosis, prevention and treatment of diseases and clinical conditions associated with CDH6. The function of CDH6 and its association with various diseases and clinical conditions, has been established by previous studies, as described hereinabove with reference to VGAM60. Dystrophin (muscular dystrophy, Duchenne and Becker types) (DMD, Accession NM_004022) is another VGAM556 host target gene. DMD BINDING SITE1 through DMD BINDING SITE3 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 through DMD BINDING SITE3, designated SEQ ID:10233, SEQ ID:10194 and SEQ ID:10221 respectively, to the nucleotide sequence of VGAM556 RNA, herein designated VGAM RNA, also designated SEQ ID:3267.

Another function of VGAM556 is therefore inhibition of Dystrophin (muscular dystrophy, Duchenne and Becker types) (DMD, Accession NM_004022), a gene which muscular dystrophy. Accordingly, utilities of VGAM556 include diagnosis, prevention and treatment of diseases and clinical conditions associated with DMD. The function of DMD and its association with various diseases and clinical conditions, has been established by previous studies, as described hereinabove with reference to VGAM218. Neuregulin 2 (NRG2, Accession NM_004883) is another VGAM556 host target gene. NRG2 BINDING SITE1 through NRG2 BINDING SITE6 are HOST TARGET binding sites found in untranslated regions of mRNA encoded by NRG2, corresponding to HOST TARGET binding sites such as BINDING SITE I, BINDING SITE II or BINDING SITE III. Table 2 illustrates the complementarity of the nucleotide sequences of NRG2 BINDING SITE1 through NRG2 BINDING SITE6, designated SEQ ID:11318, SEQ ID:15144, SEQ ID:15143, SEQ ID:15145, SEQ ID:15146 and SEQ ID:15147 respectively, to the nucleotide sequence of VGAM556 RNA, herein designated VGAM RNA, also designated SEQ ID:3267.

Another function of VGAM556 is therefore inhibition of Neuregulin 2 (NRG2, Accession NM_004883), a gene which recruits erbb1 and erbb2 coreceptors resulting in ligand-stimulated tyrosine phosphorylation and activation of the erbb receptors. Accordingly, utilities of VGAM556 include diagnosis, prevention and treatment of diseases and clinical conditions associated with NRG2. The function of NRG2 has been established by previous studies. Neuregulins are a family of growth and differentiation factors that are related to epidermal growth factor (EGF; 131530). The receptors for neuregulins are the ERBB family of tyrosine kinase transmembrane receptors, which includes the EGF receptor (EGFR; 131550), ERBB2 (OMIM Ref. No. 164870), ERBB3 (OMIM Ref. No. 190151), and ERBB4 (OMIM Ref. No. 600543). Through interaction with ERBB receptors, neuregulins induce the growth and differentiation of epithelial, neuronal, glial, and other types of cells (Burden and Yarden, 1997). In particular, the neuregulin-ERBB signaling pathways play crucial roles in regulating the proliferation and differentiation of Schwann cells, the myelin-forming cells in the peripheral nervous system. For additional information about neuregulins, see NRG1 (OMIM Ref. No. 142445). Using homologous mouse cDNA as probe, Busfield et al. (1997) cloned 2 NRG2 variants, which they called DON-1r and DON-1b, from a human fetal brain library. The clones predict mosaic proteins containing an N-terminal domain, an immunoglobulin-C2 loop, an EGF-like domain, a transmembrane sequence, and a large cytoplasmic tail showing a number of potential N-linked and O-linked glycosylation sites. DON-1b differs from DON-1r by an 8-amino acid insertion proximal to the transmembrane domain. Northern blot analysis of adult human tissues revealed expression of 3- and 4-kb transcripts restricted to the cerebellum. Expression was also detected in fetal brain and lung. In situ hybridization of mouse brain sections revealed restricted expression in the cerebellum and dentate gyrus.

Full details of the abovementioned studies are described in the following publications, the disclosure of which are hereby incorporated by reference:

Burden, S.; Yarden, Y.: Neuregulins and their receptors: a versatile signaling module in organogenesis and oncogenesis. Neuron 18:847-855, 1997; and Busfield, S. J.; Michnick, D. A.; Chickering, T. W.; Revett, T. L.; Ma, J.; Woolf, E. A.; Comrack, C. A.; Dussault, B. J.; Woolf, J.; Goodearl, A. D. J.; Gearing, D. P. : Characterizati.

Further studies establishing the function and utilities of NRG2 are found in John Hopkins OMIM database record ID 603818, and in sited publications numbered 4913-4918 listed in the bibliography section hereinbelow, which are also hereby incorporated by reference. FLJ10748 (Accession NM_018203) is another VGAM556 host target gene. FLJ10748 BINDING SITE is HOST TARGET binding site found in the 5' untranslated region of mRNA encoded by FLJ10748, corresponding to a HOST TARGET binding site such as BINDING SITE I, BINDING SITE II or BINDING SITE III. Table 2 illustrates the complementarity of the nucleotide sequences of FLJ10748 BINDING SITE, designated SEQ ID:20086, to the nucleotide sequence of VGAM556 RNA, herein designated VGAM RNA, also designated SEQ ID:3267.

Another function of VGAM556 is therefore inhibition of FLJ10748 (Accession NM_018203). Accordingly, utilities of VGAM556 include diagnosis, prevention and treatment of diseases and clinical conditions associated with FLJ10748. FLJ10925 (Accession NM_018275) is another VGAM556 host target gene. FLJ10925 BINDING SITE is HOST TARGET binding site found in the 5' untranslated region of mRNA encoded by FLJ10925, corresponding to a HOST TARGET binding site such as BINDING SITE I, BINDING SITE II or BINDING SITE III. Table 2 illustrates the complementarity of the nucleotide sequences of FLJ10925 BINDING SITE, designated SEQ ID:20259, to the nucleotide sequence of VGAM556 RNA, herein designated VGAM RNA, also designated SEQ ID:3267.

Another function of VGAM556 is therefore inhibition of FLJ10925 (Accession NM_018275). Accordingly, utilities of VGAM556 include diagnosis, prevention and treatment of diseases and clinical conditions associated with FLJ10925. FLJ20315 (Accession NM_017763) is another VGAM556 host target gene. FLJ20315 BINDING SITE is HOST TARGET binding site found in the 3' untranslated region of mRNA encoded by FLJ20315, corresponding to a HOST TARGET binding site such as BINDING SITE I, BINDING SITE II or BINDING SITE III. Table 2 illustrates the complementarity of the nucleotide sequences of FLJ20315 BINDING SITE, designated SEQ ID:19379, to the nucleotide sequence of VGAM556 RNA, herein designated VGAM RNA, also designated SEQ ID:3267.

Another function of VGAM556 is therefore inhibition of FLJ20315 (Accession NM_017763). Accordingly, utilities of VGAM556 include diagnosis, prevention and treatment of diseases and clinical conditions associated with FLJ20315. Leucine-rich Repeat LGI Family, Member 3 (LGI3, Accession NM_139278) is another VGAM556 host target gene. LGI3 BINDING SITE is HOST TARGET binding site found in the 5' untranslated region of mRNA encoded by LGI3, corresponding to a HOST TARGET binding site such as BINDING SITE I, BINDING SITE II or BINDING SITE III. Table 2 illustrates the complementarity of the nucleotide sequences of LGI3 BINDING SITE, designated SEQ ID:29279, to the nucleotide sequence of VGAM556 RNA, herein designated VGAM RNA, also designated SEQ ID:3267.

Another function of VGAM556 is therefore inhibition of Leucine-rich Repeat LGI Family, Member 3 (LGI3, Accession NM_139278). Accordingly, utilities of VGAM556 include diagnosis, prevention and treatment of diseases and clinical conditions associated with LGI3. MAP Kinase-interacting Serine/threonine Kinase 1 (MKNK1, Accession NM_003684) is another VGAM556 host target gene. MKNK1 BINDING SITE is HOST TARGET binding site found in the 5' untranslated region of mRNA encoded by MKNK1, corresponding to a HOST TARGET binding site such as BINDING SITE I, BINDING SITE II or BINDING SITE III. Table 2 illustrates the complementarity of the nucleotide sequences of MKNK1 BINDING SITE, designated SEQ ID:9792, to the nucleotide sequence of VGAM556 RNA, herein designated VGAM RNA, also designated SEQ ID:3267.

Another function of VGAM556 is therefore inhibition of MAP Kinase-interacting Serine/threonine Kinase 1 (MKNK1, Accession NM_003684). Accordingly, utilities of VGAM556 include diagnosis, prevention and treatment of diseases and clinical conditions associated with MKNK1. PM5 (Accession XM_027359) is another VGAM556 host target gene. PM5 BINDING SITE is HOST TARGET binding site found in the 5' untranslated region of mRNA encoded by PM5, corresponding to a HOST TARGET binding site such as BINDING SITE I, BINDING SITE II or BINDING SITE III. Table 2 illustrates the complementarity of the nucleotide sequences of PM5 BINDING SITE, designated SEQ ID:30497, to the nucleotide sequence of VGAM556 RNA, herein designated VGAM RNA, also designated SEQ ID:3267.

Another function of VGAM556 is therefore inhibition of PM5 (Accession XM_027359). Accordingly, utilities of VGAM556 include diagnosis, prevention and treatment of diseases and clinical conditions associated with PM5. Protein Tyrosine Phosphatase, Non-receptor Type 4 (megakaryocyte) (PTPN4, Accession NM_002830) is another VGAM556 host target gene. PTPN4 BINDING SITE is HOST TARGET binding site found in the 5' untranslated region of mRNA encoded by PTPN4, corresponding to a HOST TARGET binding site such as BINDING SITE I, BINDING SITE II or BINDING SITE III. Table 2 illustrates the complementarity of the nucleotide sequences of PTPN4 BINDING SITE, designated SEQ ID:8707, to the nucleotide sequence of VGAM556 RNA, herein designated VGAM RNA, also designated SEQ ID:3267.

Another function of VGAM556 is therefore inhibition of Protein Tyrosine Phosphatase, Non-receptor Type 4 (megakaryocyte) (PTPN4, Accession NM_002830). Accordingly, utilities of VGAM556 include diagnosis, prevention and treatment of diseases and clinical conditions associated with PTPN4. LOC145748 (Accession XM_096853) is another VGAM556 host target gene. LOC145748 BINDING SITE is HOST TARGET binding site found in the 5' untranslated region of mRNA encoded by LOC145748, corresponding to a HOST TARGET binding site such as BINDING SITE I, BINDING SITE II or BINDING SITE III. Table 2 illustrates the complementarity of the nucleotide sequences of LOC145748 BINDING SITE, designated SEQ ID:40579, to the nucleotide sequence of VGAM556 RNA, herein designated VGAM RNA, also designated SEQ ID:3267.

Another function of VGAM556 is therefore inhibition of LOC145748 (Accession XM_096853). Accordingly, utilities of VGAM556 include diagnosis, prevention and treatment of diseases and clinical conditions associated with LOC145748. LOC151445 (Accession XM_045283) is another VGAM556 host target gene. LOC151445 BINDING SITE is HOST TARGET binding site found in the 3' untranslated region of mRNA encoded by LOC151445, corresponding to a HOST TARGET binding site such as BINDING SITE I, BINDING SITE II or BINDING SITE III. Table 2 illustrates the complementarity of the nucleotide sequences of LOC151445 BINDING SITE, designated SEQ ID:34419, to the nucleotide sequence of VGAM556 RNA, herein designated VGAM RNA, also designated SEQ ID:3267.

Another function of VGAM556 is therefore inhibition of LOC151445 (Accession XM_045283). Accordingly, utilities of VGAM556 include diagnosis, prevention and treatment of diseases and clinical conditions associated with LOC151445. LOC163682 (Accession XM_099402) is another VGAM556 host target gene. LOC163682 BINDING SITE is HOST TARGET binding site found in the 3' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42096, to the nucleotide sequence of VGAM556 RNA, herein designated VGAM RNA, also designated SEQ ID:3267.

Another function of VGAM556 is therefore inhibition of LOC163682 (Accession XM_099402). Accordingly, utilities of VGAM556 include diagnosis, prevention and treatment of diseases and clinical conditions associated with LOC163682. LOC197003 (Accession XM_113798) is another VGAM556 host target gene. LOC197003 BINDING SITE is HOST TARGET binding site found in the 3' untranslated region of mRNA encoded by LOC197003, corresponding to a HOST TARGET binding site such as BINDING SITE I, BINDING SITE II or BINDING SITE III. Table 2 illustrates the complementarity of the nucleotide sequences of LOC197003 BINDING SITE, designated SEQ ID:42444, to the nucleotide sequence of VGAM556 RNA, herein designated VGAM RNA, also designated SEQ ID:3267.

Another function of VGAM556 is therefore inhibition of LOC197003 (Accession XM_113798). Accordingly, utilities of VGAM556 include diagnosis, prevention and treatment of diseases and clinical conditions associated with LOC197003. LOC221975 (Accession XM_166534) is another VGAM556 host target gene. LOC221975 BINDING SITE is HOST TARGET binding site found in the 5' untranslated region of mRNA encoded by LOC221975, corresponding to a HOST TARGET binding site such as BINDING SITE I, BINDING SITE II or BINDING SITE III. Table 2 illustrates the complementarity of the nucleotide sequences of LOC221975 BINDING SITE, designated SEQ ID:44495, to the nucleotide sequence of VGAM556 RNA, herein designated VGAM RNA, also designated SEQ ID:3267.

Another function of VGAM556 is therefore inhibition of LOC221975 (Accession XM_166534). Accordingly, utilities of VGAM556 include diagnosis, prevention and treatment of diseases and clinical conditions associated with LOC221975. LOC254712 (Accession XM_171104) is another VGAM556 host target gene. LOC254712 BINDING SITE is HOST TARGET binding site found in the 5' untranslated region of mRNA encoded by LOC254712, corresponding to a HOST TARGET binding site such as BINDING SITE I, BINDING SITE II or BINDING SITE III. Table 2 illustrates the complementarity of the nucleotide sequences of LOC254712 BINDING SITE, designated SEQ ID:45912, to the nucleotide sequence of VGAM556 RNA, herein designated VGAM RNA, also designated SEQ ID:3267.

Another function of VGAM556 is therefore inhibition of LOC254712 (Accession XM_171104). Accordingly, utilities of VGAM556 include diagnosis, prevention and treatment of diseases and clinical conditions associated with LOC254712. LOC93538 (Accession XM_051927) is another VGAM556 host target gene. LOC93538 BINDING SITE is HOST TAR- GET binding site found in the 5' untranslated region of mRNA encoded by LOC93538, corresponding to a HOST TARGET binding site such as BINDING SITE I, BINDING SITE II or BINDING SITE III. Table 2 illustrates the complementarity of the nucleotide sequences of LOC93538 BINDING SITE, designated SEQ ID:35923, to the nucleotide sequence of VGAM556 RNA, herein designated VGAM RNA, also designated SEQ ID:3267.

Another function of VGAM556 is therefore inhibition of LOC93538 (Accession XM_051927). Accordingly, utilities of VGAM556 include diagnosis, prevention and treatment of diseases and clinical conditions associated with LOC93538. FIG. 1 further provides a conceptual description of a novel bioinformatically detected viral gene of the present invention, referred to here as Viral Genomic Address Messenger 557 (VGAM557) viral gene, which modulates expression of respective host target genes thereof, the function and utility of which host target genes is known in the art.

VGAM557 is a novel bioinformatically detected regulatory, non protein coding, viral micro RNA (miRNA) gene. The method by which VGAM557 was detected is described hereinabove with reference to FIGS. 1-8.

VGAM557 gene, herein designated VGAM GENE, is a viral gene contained in the genome of Spodoptera Exigua Nucleopolyhedrovirus. VGAM557 host target gene, herein designated VGAM HOST TARGET GENE, is a human gene contained in the human genome.

VGAM557 gene encodes a VGAM557 precursor RNA, herein designated VGAM PRECURSOR RNA. Similar to other miRNA genes, and unlike most ordinary genes, VGAM557 precursor RNA does not encode a protein. A nucleotide sequence identical or highly similar to the nucleotide sequence of VGAM557 precursor RNA is designated SEQ ID:543, and is provided hereinbelow with reference to the sequence listing part. Nucleotide sequence SEQ ID:543 is located at position 77506 relative to the genome of Spodoptera Exigua Nucleopolyhedrovirus.

VGAM557 precursor RNA folds onto itself, forming VGAM557 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM557 folded precursor RNA into VGAM557 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM557 RNA is designated SEQ ID:3268, and is provided hereinbelow with reference to the sequence listing part.

VGAM557 host target gene, herein designated VGAM HOST TARGET GENE, encodes a corresponding messenger RNA, VGAM557 host target RNA, herein designated VGAM HOST TARGET RNA. VGAM557 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM557 RNA, herein designated VGAM RNA, binds complementarily to one or more host target binding sites located in untranslated regions of VGAM557 host target RNA, herein designated VGAM HOST TARGET RNA. This complementary binding is due to the fact that the nucleotide sequence of VGAM557 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM557 RNA, herein designated VGAM RNA, may have a different number of host target binding sites in untranslated regions of a VGAM557 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM557 RNA, herein designated VGAM RNA, to host target binding sites on VGAM557 host target RNA, herein designated VGAM HOST TARGET RNA, such as BINDING SITE I, BINDING SITE II and BINDING SITE III, inhibits translation of VGAM557 host target RNA into VGAM557 host target protein, herein designated VGAM HOST TARGET PROTEIN. VGAM host target protein is therefore outlined by a broken line.

It is appreciated that VGAM557 host target gene, herein designated VGAM HOST TARGET GENE, in fact represents a plurality of VGAM557 host target genes. The mRNA of each one of this plurality of VGAM557 host target genes comprises one or more host target binding sites, each having a nucleotide sequence which is at least partly complementary to VGAM557 RNA, herein designated VGAM RNA, and which when bound by VGAM557 RNA causes inhibition of translation of respective one or more VGAM557 host target proteins.

It is further appreciated by one skilled in the art that the mode of translational inhibition illustrated by FIG. 1 with specific reference to translational inhibition exerted by VGAM557 gene, herein designated VGAM GENE, on one or more VGAM557 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM557 is inhibition of expression of host target genes, as part of a novel viral mechanism of attacking a host. Accordingly, utilities of VGAM557 include diagnosis, prevention and treatment of viral infection by Spodoptera Exigua Nucleopolyhedrovirus. Specific functions, and accordingly utilities, of VGAM557 correlate with, and may be deduced from, the identity of the host target genes which VGAM557 binds and inhibits, and the function of these host target genes, as elaborated hereinbelow.

Nucleotide sequences of the VGAM557 precursor RNA, herein designated VGAM PRECURSOR RNA, and of the 'diced' VGAM557 RNA, herein designated VGAM RNA, and a schematic representation of the secondary folding of VGAM557 folded precursor RNA, herein designated VGAM FOLDED PRECURSOR RNA, of VGAM557 are further described hereinbelow with reference to Table 1.

Nucleotide sequences of host target binding sites, such as BINDING SITE-I, BINDING SITE-II and BINDING SITE-III of FIG. 1, found on VGAM557 host target RNA, and schematic representation of the complementarity of each of these host target binding sites to VGAM557 RNA, herein designated VGAM RNA, are described hereinbelow with reference to Table 2.

As mentioned hereinabove with reference to FIG. 1, a function of VGAM557 gene, herein designated VGAM is inhibition of expression of VGAM557 target genes. It is appreciated that specific functions, and accordingly utilities, of VGAM557 correlate with, and may be deduced from, the identity of the target genes which VGAM557 binds and inhibits, and the function of these target genes, as elaborated hereinbelow.

Phosphatase, Orphan 1 (phospho1, Accession XM_091572) is a VGAM557 host target gene. phospho1 BINDING SITE is HOST TARGET binding site found in the 5' untranslated region of mRNA encoded by phospho1, corresponding to a HOST TARGET binding site such as BINDING SITE I, BINDING SITE II or BINDING SITE III. Table 2 illustrates the complementarity of the nucleotide sequences of phospho1 BINDING SITE, designated SEQ ID:40063, to the nucleotide sequence of VGAM557 RNA, herein designated VGAM RNA, also designated SEQ ID:3268.

A function of VGAM557 is therefore inhibition of Phosphatase, Orphan 1 (phospho1, Accession XM_091572). Accordingly, utilities of VGAM557 include diagnosis, prevention and treatment of diseases and clinical conditions associated with phospho1. FIG. 1 further provides a conceptual description of a novel bioinformatically detected viral gene of the present invention, referred to here as Viral Genomic Address Messenger 558 (VGAM558) viral gene, which modulates expression of respective host target genes thereof, the function and utility of which host target genes is known in the art.

VGAM558 is a novel bioinformatically detected regulatory, non protein coding, viral micro RNA (miRNA) gene. The method by which VGAM558 was detected is described hereinabove with reference to FIGS. 1-8.

VGAM558 gene, herein designated VGAM GENE, is a viral gene contained in the genome of Spodoptera Exigua Nucleopolyhedrovirus. VGAM558 host target gene, herein designated VGAM HOST TARGET GENE, is a human gene contained in the human genome.

VGAM558 gene encodes a VGAM558 precursor RNA, herein designated VGAM PRECURSOR RNA. Similar to other miRNA genes, and unlike most ordinary genes, VGAM558 precursor RNA does not encode a protein. A nucleotide sequence identical or highly similar to the nucleotide sequence of VGAM558 precursor RNA is designated SEQ ID:544, and is provided hereinbelow with reference to the sequence listing part. Nucleotide sequence SEQ ID:544 is located at position 78942 relative to the genome of Spodoptera Exigua Nucleopolyhedrovirus.

VGAM558 precursor RNA folds onto itself, forming VGAM558 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM558 folded precursor RNA into VGAM558 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM558 RNA is designated SEQ ID:3269, and is provided hereinbelow with reference to the sequence listing part.

VGAM558 host target gene, herein designated VGAM HOST TARGET GENE, encodes a corresponding messenger RNA, VGAM558 host target RNA, herein designated VGAM HOST TARGET RNA. VGAM558 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM558 RNA, herein designated VGAM RNA, binds complementarily to one or more host target binding sites located in untranslated regions of VGAM558 host target RNA, herein designated VGAM HOST TARGET RNA. This complementary binding is due to the fact that the nucleotide sequence of VGAM558 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM558 RNA, herein designated VGAM RNA, may have a different number of host target binding sites in untranslated regions of a VGAM558 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM558 RNA, herein designated VGAM RNA, to host target binding sites on VGAM558 host target RNA, herein designated VGAM HOST TARGET RNA, such as BINDING SITE I, BINDING SITE II and BINDING SITE III, inhibits translation of VGAM558 host target RNA into VGAM558 host target protein, herein designated VGAM HOST TARGET PROTEIN. VGAM host target protein is therefore outlined by a broken line.

It is appreciated that VGAM558 host target gene, herein designated VGAM HOST TARGET GENE, in fact represents a plurality of VGAM558 host target genes. The mRNA of each one of this plurality of VGAM558 host target genes comprises one or more host target binding sites, each having a nucleotide sequence which is at least partly complementary to VGAM558 RNA, herein designated VGAM RNA, and which when bound by VGAM558 RNA causes inhibition of translation of respective one or more VGAM558 host target proteins.

It is further appreciated by one skilled in the art that the mode of translational inhibition illustrated by FIG. 1 with specific reference to translational inhibition exerted by VGAM558 gene, herein designated VGAM GENE, on one or more VGAM558 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM558 is inhibition of expression of host target genes, as part of a novel viral mechanism of attacking a host. Accordingly, utilities of VGAM558 include diagnosis, prevention and treatment of viral infection by Spodoptera Exigua Nucleopolyhedrovirus. Specific functions, and accordingly utilities, of VGAM558 correlate with, and may be deduced from, the identity of the host target genes which VGAM558 binds and inhibits, and the function of these host target genes, as elaborated hereinbelow.

Nucleotide sequences of the VGAM558 precursor RNA, herein designated VGAM PRECURSOR RNA, and of the 'diced' VGAM558 RNA, herein designated VGAM RNA, and a schematic representation of the secondary folding of VGAM558 folded precursor RNA, herein designated VGAM FOLDED PRECURSOR RNA, of VGAM558 are further described hereinbelow with reference to Table 1.

Nucleotide sequences of host target binding sites, such as BINDING SITE-I, BINDING SITE-II and BINDING SITE-III of FIG. 1, found on VGAM558 host target RNA, and schematic representation of the complementarity of each of these host target binding sites to VGAM558 RNA, herein designated VGAM RNA, are described hereinbelow with reference to Table 2.

As mentioned hereinabove with reference to FIG. 1, a function of VGAM558 gene, herein designated VGAM is inhibition of expression of VGAM558 target genes. It is appreciated that specific functions, and accordingly utilities, of VGAM558 correlate with, and may be deduced from, the identity of the target genes which VGAM558 binds and inhibits, and the function of these target genes, as elaborated hereinbelow.

Activating Transcription Factor 7 (ATF7, Accession NM_006856) is a VGAM558 host target gene. ATF7 BINDING SITE is HOST TARGET binding site found in the 3' untranslated region of mRNA encoded by ATF7, corresponding to a HOST TARGET binding site such as BINDING SITE I, BINDING SITE II or BINDING SITE III. Table 2 illustrates the complementarity of the nucleotide sequences of ATF7 BINDING SITE, designated SEQ ID:13727, to the nucleotide sequence of VGAM558 RNA, herein designated VGAM RNA, also designated SEQ ID:3269.

A function of VGAM558 is therefore inhibition of Activating Transcription Factor 7 (ATF7, Accession NM_006856). Accordingly, utilities of VGAM558 include diagnosis, prevention and treatment of diseases and clinical conditions associated with ATF7. Beta-site APP-cleaving Enzyme (BACE, Accession NM_012104) is another VGAM558 host target gene. BACE BINDING SITE1 and BACE BINDING SITE2 are HOST TARGET binding sites found in untranslated regions of mRNA encoded by BACE, corresponding to HOST TARGET binding sites such as BINDING SITE I, BINDING SITE II or BINDING SITE III. Table 2 illustrates the complementarity of the nucleotide sequences of BACE BINDING SITE1 and BACE BINDING SITE2, designated SEQ ID:14422 and SEQ ID:29090 respectively, to the nucleotide sequence of VGAM558 RNA, herein designated VGAM RNA, also designated SEQ ID:3269.

Another function of VGAM558 is therefore inhibition of Beta-site APP-cleaving Enzyme (BACE, Accession NM_012104), a gene which is responsible for the proteolytic processing of the amyloid precursor protein. Accordingly, utilities of VGAM558 include diagnosis, prevention and treatment of diseases and clinical conditions associated with BACE. The function of BACE and its association with various diseases and clinical conditions, has been established by previous studies, as described hereinabove with reference to VGAM173. Egl Nine Homolog 1 (C. elegans) (EGLN1, Accession NM_022051) is another VGAM558 host target gene. EGLN1 BINDING SITE is HOST TARGET binding site found in the 5' untranslated region of mRNA encoded by EGLN1, corresponding to a HOST TARGET binding site such as BINDING SITE I, BINDING SITE II or BINDING SITE III. Table 2 illustrates the complementarity of the nucleotide sequences of EGLN1 BINDING SITE, designated SEQ ID:22583, to the nucleotide sequence of VGAM558 RNA, herein designated VGAM RNA, also designated SEQ ID:3269.

Another function of VGAM558 is therefore inhibition of Egl Nine Homolog 1 (C. elegans) (EGLN1, Accession NM_022051), a gene which is expressed in the cytoplasm of arterial smooth muscle cells. Accordingly, utilities of VGAM558 include diagnosis, prevention and treatment of diseases and clinical conditions associated with EGLN1. The function of EGLN1 and its association with various diseases and clinical conditions, has been established by previous studies, as described hereinabove with reference to VGAM216. Fibroblast Growth Factor 2 (basic) (FGF2, Accession NM_002006) is another VGAM558 host target gene. FGF2 BINDING SITE is HOST TARGET binding site found in the 3' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7743, to the nucleotide sequence of VGAM558 RNA, herein designated VGAM RNA, also designated SEQ ID:3269.

Another function of VGAM558 is therefore inhibition of Fibroblast Growth Factor 2 (basic) (FGF2, Accession NM_002006), a gene which probably involved in nervous system development and function. Accordingly, utilities of VGAM558 include diagnosis, prevention and treatment of diseases and clinical conditions associated with FGF2. The function of FGF2 and its association with various diseases and clinical conditions, has been established by previous studies, as described hereinabove with reference to VGAM51. Gap Junction Protein, Alpha 1, 43 kDa (connexin 43) (GJA1, Accession NM_000165) is another VGAM558 host target gene. GJA1 BINDING SITE is HOST TARGET binding site found in the 3' untranslated region of mRNA encoded by GJA1, corresponding to a HOST TARGET binding site such as BINDING SITE I, BINDING SITE II or BINDING SITE III. Table 2 illustrates the complementarity of the nucleotide sequences of GJA1 BINDING SITE, designated SEQ ID:5680, to the nucleotide sequence of VGAM558 RNA, herein designated VGAM RNA, also designated SEQ ID:3269.

Another function of VGAM558 is therefore inhibition of Gap Junction Protein, Alpha 1, 43 kDa (connexin 43) (GJA1, Accession NM_000165), a gene which may act in synchronizing heart contraction and embryonic development. Accordingly, utilities of VGAM558 include diagnosis, prevention and treatment of diseases and clinical conditions associated with GJA1. The function of GJA1 and its association with various diseases and clinical conditions, has been established by previous studies, as described hereinabove with reference to VGAM341. Heparanase (HPSE, Accession NM_006665) is another VGAM558 host target gene. HPSE BINDING SITE is HOST TARGET binding site found in the 3' untranslated region of mRNA encoded by HPSE, corresponding to a HOST TARGET binding site such as BINDING SITE I, BINDING SITE II or BINDING SITE III. Table 2 illustrates the complementarity of the nucleotide sequences of HPSE BINDING SITE, designated SEQ ID:13481, to the nucleotide sequence of VGAM558 RNA, herein designated VGAM RNA, also designated SEQ ID:3269.

Another function of VGAM558 is therefore inhibition of Heparanase (HPSE, Accession NM_006665), a gene which is an endoglycosidase that cleaves heparan sulfate. Accordingly, utilities of VGAM558 include diagnosis, prevention and treatment of diseases and clinical conditions associated with HPSE. The function of HPSE and its association with various diseases and clinical conditions, has been established by previous studies, as described hereinabove with reference to VGAM374. Mannosyl (alpha-1,6-)-glycoprotein Beta-1,2-N-acetylglucosaminyltransferase (MGAT2, Accession NM_002408) is another VGAM558 host target gene. MGAT2 BINDING SITE is HOST TARGET binding site found in the 3' untranslated region of mRNA encoded by MGAT2, corresponding to a HOST TARGET binding site such as BINDING SITE I, BINDING SITE II or BINDING SITE III. Table 2 illustrates the complementarity of the nucleotide sequences of MGAT2 BINDING SITE, designated SEQ ID:8234, to the nucleotide sequence of VGAM558 RNA, herein designated VGAM RNA, also designated SEQ ID:3269.

Another function of VGAM558 is therefore inhibition of Mannosyl (alpha-1,6-)-glycoprotein Beta-1,2-N-acetylglucosaminyltransferase (MGAT2, Accession NM_002408). Accordingly, utilities of VGAM558 include diagnosis, prevention and treatment of diseases and clinical conditions associated with MGAT2. Myeloid/lymphoid Or Mixed-lineage Leukemia (trithorax homolog, Drosophila); Translocated To, 2 (MLLT2, Accession NM_005935) is another VGAM558 host target gene. MLLT2 BINDING SITE is HOST TARGET binding site found in the 3' untranslated region of mRNA encoded by MLLT2, corresponding to a HOST TARGET binding site such as BINDING SITE I, BINDING SITE II or BINDING SITE III. Table 2 illustrates the complementarity of the nucleotide sequences of MLLT2 BINDING SITE, designated SEQ ID:12573, to the nucleotide sequence of VGAM558 RNA, herein designated VGAM RNA, also designated SEQ ID:3269.

Another function of VGAM558 is therefore inhibition of Myeloid/lymphoid Or Mixed-lineage Leukemia (trithorax homolog, Drosophila); Translocated To, 2 (MLLT2, Accession NM_005935), a gene which is a Putative transcription factor. Accordingly, utilities of VGAM558 include diagnosis, prevention and treatment of diseases and clinical conditions associated with MLLT2. The function of MLLT2 and its association with various diseases and clinical conditions, has been established by previous studies, as described hereinabove with reference to VGAM57. Nuclear Receptor Coactivator 6 Interacting Protein (NCOA6IP, Accession NM_024831) is another VGAM558 host target gene. NCOA6IP BINDING SITE is HOST TARGET binding site found in the 3' untranslated region of mRNA encoded by NCOA6IP, corresponding to a HOST TARGET binding site such as BINDING SITE I, BINDING SITE II or BINDING SITE III. Table 2 illustrates the complementarity of the nucleotide sequences of NCOA6IP BINDING SITE, designated SEQ ID:24228, to the nucleotide sequence of VGAM558 RNA, herein designated VGAM RNA, also designated SEQ ID:3269.

Another function of VGAM558 is therefore inhibition of Nuclear Receptor Coactivator 6 Interacting Protein (NCOA6IP, Accession NM_024831). Accordingly, utilities of VGAM558 include diagnosis, prevention and treatment of diseases and clinical conditions associated with NCOA6IP. RAS P21 Protein Activator (GTPase activating protein) 1 (RASA1, Accession NM_022650) is another VGAM558 host target gene. RASA1 BINDING SITE is HOST TARGET binding site found in the 3' untranslated region of mRNA encoded by RASA1, corresponding to a HOST TARGET binding site such as BINDING SITE I, BINDING SITE II or BINDING SITE III. Table 2 illustrates the complementarity of the nucleotide sequences of RASA1 BINDING SITE, designated SEQ ID:22906, to the nucleotide sequence of VGAM558 RNA, herein designated VGAM RNA, also designated SEQ ID:3269.

Another function of VGAM558 is therefore inhibition of RAS P21 Protein Activator (GTPase activating protein) 1 (RASA1, Accession NM_022650), a gene which is involved in the control of cellular proliferation and differentiation. Accordingly, utilities of VGAM558 include diagnosis, prevention and treatment of diseases and clinical conditions associated with RASA1. The function of RASA1 and its association with various diseases and clinical conditions, has been established by previous studies, as described hereinabove with reference to VGAM464. Ribonuclease, RNase A Family, 4 (RNASE4, Accession NM_002937) is another VGAM558 host target gene. RNASE4 BINDING SITE is HOST TARGET binding site found in the 3' untranslated region of mRNA encoded by RNASE4, corresponding to a HOST TARGET binding site such as BINDING SITE I, BINDING SITE II or BINDING SITE III. Table 2 illustrates the complementarity of the nucleotide sequences of RNASE4 BINDING SITE, designated SEQ ID:8838, to the nucleotide sequence of VGAM558 RNA, herein designated VGAM RNA, also designated SEQ ID:3269.

Another function of VGAM558 is therefore inhibition of Ribonuclease, RNase A Family, 4 (RNASE4, Accession NM_002937). Accordingly, utilities of VGAM558 include diagnosis, prevention and treatment of diseases and clinical conditions associated with RNASE4. Suppressor of Fused Homolog (Drosophila) (SUFU, Accession NM_016169) is another VGAM558 host target gene. SUFU BINDING SITE is HOST TARGET binding site found in the 3" untranslated region of mRNA encoded by SUFU, corresponding to a HOST TARGET binding site such as BINDING SITE I, BINDING SITE II or BINDING SITE III. Table 2 illustrates the complementarity of the nucleotide sequences of SUFU BINDING SITE, designated SEQ ID:18259, to the nucleotide sequence of VGAM558 RNA, herein designated VGAM RNA, also designated SEQ ID:3269.

Another function of VGAM558 is therefore inhibition of Suppressor of Fused Homolog (Drosophila) (SUFU, Accession NM_016169). Accordingly, utilities of VGAM558 include diagnosis, prevention and treatment of diseases and clinical conditions associated with SUFU. TSLP (Accession NM_138551) is another VGAM558 host target gene. TSLP BINDING SITE is HOST TARGET binding site found in the 5' untranslated region of mRNA encoded by TSLP, corresponding to a HOST TARGET binding site such as BINDING SITE I, BINDING SITE II or BINDING SITE III. Table 2 illustrates the complementarity of the nucleotide sequences of TSLP BINDING SITE, designated SEQ ID:28849, to the nucleotide sequence of VGAM558 RNA, herein designated VGAM RNA, also designated SEQ ID:3269.

Another function of VGAM558 is therefore inhibition of TSLP (Accession NM_138551), a gene which may contribute directly to the activation of Langerhans cells and inhibit apoptosis. Accordingly, utilities of VGAM558 include diagnosis, prevention and treatment of diseases and clinical conditions associated with TSLP. The function of TSLP has been established by previous studies. By EST and genomic database screening for sequences similar to IL7, followed by screening a lung fibroblast sarcoma cDNA library, Reche et al. (2001) obtained a cDNA encoding TSLP. The deduced 159-amino acid protein, which is only 43% identical to mouse Tslp, contains a 28-residue signal sequence, 6 cysteines, and 2 N-glycosylation sites. SDS-PAGE analysis showed expression of a 23-kD protein, larger than the predicted 15 kD, suggesting that TSLP is glycosylated. PCR analysis of a panel of cDNA libraries and cultured cell lines indicated that expression of a 1.3-kb TSLP transcript may be restricted to a few lung libraries. Reche et al. (2001) also identified TSLP receptor, which is composed of TSLPR (CRLF2; 300357) and IL7R (OMIM Ref. No. 146661) subunits. Dendritic cells (DCs) and monocytes coexpress IL7R and TSLPR. Quentmeier et al. (2001) also cloned and characterized TSLP. They noted the presence of 7 basic C-terminal amino acids (KKRRKRK) in the protein and that 6 of the 7 cysteines in the mouse protein (those involved in disulfide bond formation) are conserved in human, whereas the sites for N-glycosylation are distinct. Northern blot analysis revealed wide expression of an approximately 1.1-kb transcript, with highest levels in heart, liver, testis, and prostate. Reche et al. (2001) showed that incubation of DCs or monocytes with TSLP enhanced the expression of CCL17 (OMIM Ref. No. 601520), CCL18 (OMIM Ref. No. 603757), CCL22 (OMIM Ref. No. 602957), and CCL19 (OMIM Ref. No. 602227). IL7, on the other hand, induced expression of CCL17, CCL22, and CCL19, but also CXCL8 (OMIM Ref. No. 146930), CXCL7 (OMIM Ref. No. 121010), CXCL5 (OMIM Ref. No. 600324), CXCL1 (OMIM Ref. No. 155730), CXCL2 (OMIM Ref. No. 139110), and CXCL3 (OMIM Ref. No. 139111). Functional analysis indicated that TSLP enhances the DC maturation process, as evidenced by upregulation of DC markers and costimulatory molecules and stronger T-cell proliferation. By screening myeloid cell lines, Quentmeier et al. (2001) established that an acute myeloid leukemia line, MUTZ-3, responds by proliferating in response to TSLP. TSLP also inhibited apoptosis in these cells. Proliferation in response to TSLP could not be attributed to the production of other growth factors tested and could be inhibited by relatively high concentrations of anti-IL7R. TSLP, like IL7, stimulated phosphorylation of STAT5 (OMIM Ref. No. 601511), but unlike IL7, it did not activate JAK3 (OMIM Ref. No. 600173). TSLP did not phosphorylate mitogen-activated protein kinases (e.g., ERK1; 601795). By flow cytometric analysis, Soumelis et al. (2002) showed that TSLP-activated DCs (TSLP-DCs) express higher levels of HLA-DR and DCLAMP (OMIM Ref. No. 605883) than do nonactivated or IL7-activated DCs, and that TSLP-DCs induce marked proliferation and expansion of allogeneic naive CD4 (OMIM Ref. No. 186940)-positive T cells. Quantitative mRNA screening and ELISA analysis showed that TSLP-DCs do not produce detectable proinflammatory cytokines, but do produce high levels of TARC (CCL17) and MDC (CCL22) chemokines, which preferentially attract CCR4 (OMIM Ref. No. 604836)-expressing Th2 lymphocytes. TSLP-DCs induced CD4 cells to produce high amounts of IL13 (OMIM Ref. No. 147683), IL5 (OMIM Ref. No. 147850), and the proinflammatory cytokine tumor necrosis factor (TNF; 191160), but only low amounts of IL10 (OMIM Ref. No. 124092) and gamma-interferon (IFNG; 147570). RT-PCR analysis did not detect TSLP in most hemopoietic cells, the exception being mast cells. Keratinocytes, epithelial cells, smooth muscle cells, and lung fibroblasts also expressed high levels of TSLP. Within tonsils, highest levels were in crypt epithelial cells. Soumelis et al. (2002) suggested that TSLP may contribute to constitutive inflammation in this tissue and sporadic inflammation in squamous epithelium. Immunohistochemical analysis of allergic inflammatory tissue showed high expression of TSLP in keratinocytes of acute and chronic atopic dermatitis lesions, but no expression in normal skin. Strong TSLP expression in atopic dermatitis was associated with the disappearance of langerin (OMIM Ref. No. 604862)-positive Langerhans cells within the epidermis and the concurrent appearance of many DCLAMP-activated DCs within the dermis, many of which expressed langerin. Soumelis et al. (2002) proposed that TSLP expression by keratinocytes in atopic dermatitis lesions may contribute directly to the activation of Langerhans cells, which may migrate into the dermis and then the draining lymph nodes where they can prime allergen-specific Th2 responses.

Full details of the abovementioned studies are described in the following publications, the disclosure of which are hereby incorporated by reference:

Reche, P. A.; Soumelis, V.; Gorman, D. M.; Clifford, T.; Liu, M.; Travis, M.; Zurawski, S. M.; Johnston, J.; Liu, Y.-J.; Spits, H.; de Waal Malefyt, R.; Kastelein, R. A.; Bazan, J. F.: Human thymic stromal lymphopoietin preferentially stimulates myeloid cells. J. Immun. 167:336-343, 2001; and Soumelis, V.; Reche, P. A.; Kanzler, H.; Yuan, W.; Edward, G.; Homey, B.; Gilliet, M.; Ho, S.; Antonenko, S.; Lauerma, A.; Smith, K.; Gorman, D.; Zurawski, S.; Abrams, J.; Menon, S.; Mc.

Further studies establishing the function and utilities of TSLP are found in John Hopkins OMIM database record ID 607003, and in sited publications numbered 555 and 6729 listed in the bibliography section hereinbelow, which are also hereby incorporated by reference. Ubiquitin-like 1 (sentrin) (UBL1, Accession NM_003352) is another VGAM558 host target gene. UBL1 BINDING SITE is HOST TARGET binding site found in the 3' untranslated region of mRNA encoded by UBL1, corresponding to a HOST TARGET binding site such as BINDING SITE I, BINDING SITE II or BINDING SITE III. Table 2 illustrates the complementarity of the nucleotide sequences of UBL1 BINDING SITE, designated SEQ ID:9378, to the nucleotide sequence of VGAM558 RNA, herein designated VGAM RNA, also designated SEQ ID:3269.

Another function of VGAM558 is therefore inhibition of Ubiquitin-like 1 (sentrin) (UBL1, Accession NM_003352), a gene which generates proteins resistant to degradation through its modification. Accordingly, utilities of VGAM558 include diagnosis, prevention and treatment of diseases and clinical conditions associated with UBL1. The function of UBL1 and its association with various diseases and clinical conditions, has been established by previous studies, as described hereinabove with reference to VGAM206. Von Hippel-Lindau Syndrome (VHL, Accession NM_000551) is another VGAM558 host target gene. VHL BINDING SITE is HOST TARGET binding site found in the 3" untranslated region of mRNA encoded by VHL, corresponding to a HOST TARGET binding site such as BINDING SITE I, BINDING SITE II or BINDING SITE III. Table 2 illustrates the complementarity of the nucleotide sequences of VHL BINDING SITE, designated SEQ ID:6161, to the nucleotide sequence of VGAM558 RNA, herein designated VGAM RNA, also designated SEQ ID:3269.

Another function of VGAM558 is therefore inhibition of Von Hippel-Lindau Syndrome (VHL, Accession NM_000551), a gene which may control rna stability through the selective degradation of rna-bound proteins. Accordingly, utilities of VGAM558 include diagnosis, prevention and treatment of diseases and clinical conditions associated with VHL. The function of VHL and its association with various diseases and clinical conditions, has been established by previous studies, as described hereinabove with reference to VGAM197. ADP-ribosylation Factor Domain Protein 1, 64 kDa (ARFD1, Accession NM_001656) is another VGAM558 host target gene. ARFD1 BINDING SITE is HOST TARGET binding site found in the 3' untranslated region of mRNA encoded by ARFD1, corresponding to a HOST TARGET binding site such as BINDING SITE I, BINDING SITE II or BINDING SITE III. Table 2 illustrates the complementarity of the nucleotide sequences of ARFD1 BINDING SITE, designated SEQ ID:7375, to the nucleotide sequence of VGAM558 RNA, herein designated VGAM RNA, also designated SEQ ID:3269.

Another function of VGAM558 is therefore inhibition of ADP-ribosylation Factor Domain Protein 1, 64 kDa (ARFD1, Accession NM_001656). Accordingly, utilities of VGAM558 include diagnosis, prevention and treatment of diseases and clinical conditions associated with ARFD1. Bromodomain Containing 4 (BRD4, Accession NM_014299) is another VGAM558 host target gene. BRD4 BINDING SITE is HOST TARGET binding site found in the 3' untranslated region of mRNA encoded by BRD4, corresponding to a HOST TARGET binding site such as BINDING SITE I, BINDING SITE II or BINDING SITE III. Table 2 illustrates the complementarity of the nucleotide sequences of BRD4 BINDING SITE, designated SEQ ID:15595, to the nucleotide sequence of VGAM558 RNA, herein designated VGAM RNA, also designated SEQ ID:3269.

Another function of VGAM558 is therefore inhibition of Bromodomain Containing 4 (BRD4, Accession NM_014299). Accordingly, utilities of VGAM558 include diagnosis, prevention and treatment of diseases and clinical conditions associated with BRD4. DJ667H12.2 (Accession NM_019605) is another VGAM558 host target gene. DJ667H12.2 BINDING SITE is HOST TARGET binding site found in the 3' untranslated region of mRNA encoded by DJ667H12.2, corresponding to a HOST TARGET binding site such as BINDING SITE I, BINDING SITE II or BINDING SITE III. Table 2 illustrates the complementarity of the nucleotide sequences of DJ667H12.2 BINDING SITE, designated SEQ ID:21218, to the nucleotide sequence of VGAM558 RNA, herein designated VGAM RNA, also designated SEQ ID:3269.

Another function of VGAM558 is therefore inhibition of DJ667H12.2 (Accession NM_019605). Accordingly, utilities of VGAM558 include diagnosis, prevention and treatment of diseases and clinical conditions associated with DJ667H12.2. DKFZp547I224 (Accession NM_020221) is another VGAM558 host target gene. DKFZp547I224 BINDING SITE is HOST TARGET binding site found in the 5' untranslated region of mRNA encoded by DKFZp547I224, corresponding to a HOST TARGET binding site such as BINDING SITE I, BINDING SITE II or BINDING SITE III. Table 2 illustrates the complementarity of the nucleotide sequences of DKFZp547I224 BINDING SITE, designated SEQ ID:21476, to the nucleotide sequence of VGAM558 RNA, herein designated VGAM RNA, also designated SEQ ID:3269.

Another function of VGAM558 is therefore inhibition of DKFZp547I224 (Accession NM_020221). Accordingly, utilities of VGAM558 include diagnosis, prevention and treatment of diseases and clinical conditions associated with DKFZp547I224. DKFZP566K1924 (Accession XM_057469) is another VGAM558 host target gene. DKFZP566K1924 BINDING SITE is HOST TARGET binding site found in the 3' untranslated region of mRNA encoded by DKFZP566K1924, corresponding to a HOST TARGET binding site such as BINDING SITE I, BINDING SITE II or BINDING SITE III. Table 2 illustrates the complementarity of the nucleotide sequences of DKFZP566K1924 BINDING SITE, designated SEQ ID:36523, to the nucleotide sequence of VGAM558 RNA, herein designated VGAM RNA, also designated SEQ ID:3269.

Another function of VGAM558 is therefore inhibition of DKFZP566K1924 (Accession XM_057469). Accordingly, utilities of VGAM558 include diagnosis, prevention and treatment of diseases and clinical conditions associated with DKFZP566K1924. DKFZP586C1619 (Accession XM_030350) is another VGAM558 host target gene. DKFZP586C1619 BINDING SITE is HOST TARGET binding site found in the 3' untranslated region of mRNA encoded by DKFZP586C1619, corresponding to a HOST TARGET binding site such as BINDING SITE I, BINDING SITE II or BINDING SITE III. Table 2 illustrates the complementarity of the nucleotide sequences of DKFZP586C1619 BINDING SITE, designated SEQ ID:31019, to the nucleotide sequence of VGAM558 RNA, herein designated VGAM RNA, also designated SEQ ID:3269.

Another function of VGAM558 is therefore inhibition of DKFZP586C1619 (Accession XM_030350). Accordingly, utilities of VGAM558 include diagnosis, prevention and treatment of diseases and clinical conditions associated with DKFZP586C1619. DRCTNNB1A (Accession NM_032581) is another VGAM558 host target gene. DRCTNNB1A BINDING SITE is HOST TARGET binding site found in the 3' untranslated region of mRNA encoded by DRCTNNB1A, corresponding to a HOST TARGET binding site such as BINDING SITE I, BINDING SITE II or BINDING SITE III. Table 2 illustrates the complementarity of the nucleotide sequences of DRCTNNB1A BINDING SITE, designated SEQ ID:26317, to the nucleotide sequence of VGAM558 RNA, herein designated VGAM RNA, also designated SEQ ID:3269.

Another function of VGAM558 is therefore inhibition of DRCTNNB1A (Accession NM_032581). Accordingly, utilities of VGAM558 include diagnosis, prevention and treatment of diseases and clinical conditions associated with DRCTNNB1A. ELL2 (Accession NM_012081) is another VGAM558 host target gene. ELL2 BINDING SITE is HOST TARGET binding site found in the 3' untranslated region of mRNA encoded by ELL2, corresponding to a HOST TARGET binding site such as BINDING SITE I, BINDING SITE II or BINDING SITE III. Table 2 illustrates the complementarity of the nucleotide sequences of ELL2 BINDING SITE, designated SEQ ID:14369, to the nucleotide sequence of VGAM558 RNA, herein designated VGAM RNA, also designated SEQ ID:3269.

Another function of VGAM558 is therefore inhibition of ELL2 (Accession NM_012081). Accordingly, utilities of VGAM558 include diagnosis, prevention and treatment of diseases and clinical conditions associated with ELL2. FLJ10199 (Accession XM_048840) is another VGAM558 host target gene. FLJ10199 BINDING SITE is HOST TARGET binding site found in the 3' untranslated region of mRNA encoded by FLJ10199, corresponding to a HOST TARGET binding site such as BINDING SITE I, BINDING SITE II or BINDING SITE III. Table 2 illustrates the complementarity of the nucleotide sequences of FLJ10199 BINDING SITE, designated SEQ ID:35286, to the nucleotide sequence of VGAM558 RNA, herein designated VGAM RNA, also designated SEQ ID:3269.

Another function of VGAM558 is therefore inhibition of FLJ10199 (Accession XM_048840). Accordingly, utilities of VGAM558 include diagnosis, prevention and treatment of diseases and clinical conditions associated with FLJ10199. FLJ12650 (Accession NM_024522) is another VGAM558 host target gene. FLJ12650 BINDING SITE is HOST TARGET binding site found in the 3' untranslated region of mRNA encoded by FLJ12650, corresponding to a HOST TARGET binding site such as BINDING SITE I, BINDING SITE II or BINDING SITE III. Table 2 illustrates the complementarity of the nucleotide sequences of FLJ12650 BINDING SITE, designated SEQ ID:23723, to the nucleotide sequence of VGAM558 RNA, herein designated VGAM RNA, also designated SEQ ID:3269.

Another function of VGAM558 is therefore inhibition of FLJ12650 (Accession NM_024522). Accordingly, utilities of VGAM558 include diagnosis, prevention and treatment of diseases and clinical conditions associated with FLJ12650. FLJ13189 (Accession NM_024882) is another VGAM558 host target gene. FLJ13189 BINDING SITE is HOST TARGET binding site found in the 3' untranslated region of mRNA encoded by FLJ13189, corresponding to a HOST TARGET binding site such as BINDING SITE I, BINDING SITE II or BINDING SITE III. Table 2 illustrates the complementarity of the nucleotide sequences of FLJ13189 BINDING SITE, designated SEQ ID:24333, to the nucleotide sequence of VGAM558 RNA, herein designated VGAM RNA, also designated SEQ ID:3269.

Another function of VGAM558 is therefore inhibition of FLJ13189 (Accession NM_024882). Accordingly, utilities of VGAM558 include diagnosis, prevention and treatment of diseases and clinical conditions associated with FLJ13189. FLJ14054 (Accession NM_024563) is another VGAM558 host target gene. FLJ14054 BINDING SITE is HOST TARGET binding site found in the 3' untranslated region of mRNA encoded by FLJ14054, corresponding to a HOST TARGET binding site such as BINDING SITE I, BINDING SITE II or BINDING SITE III. Table 2 illustrates the complementarity of the nucleotide sequences of FLJ14054 BINDING SITE, designated SEQ ID:23786, to the nucleotide sequence of VGAM558 RNA, herein designated VGAM RNA, also designated SEQ ID:3269.

Another function of VGAM558 is therefore inhibition of FLJ14054 (Accession NM_024563). Accordingly, utilities of VGAM558 include diagnosis, prevention and treatment of diseases and clinical conditions associated with FLJ14054. FLJ20093 (Accession NM_017664) is another VGAM558 host target gene. FLJ20093 BINDING SITE is HOST TARGET binding site found in the 3' untranslated region of mRNA encoded by FLJ20093, corresponding to a HOST TARGET binding site such as BINDING SITE I, BINDING SITE II or BINDING SITE III. Table 2 illustrates the complementarity of the nucleotide sequences of FLJ20093 BINDING SITE, designated SEQ ID:19205, to the nucleotide sequence of VGAM558 RNA, herein designated VGAM RNA, also designated SEQ ID:3269.

Another function of VGAM558 is therefore inhibition of FLJ20093 (Accession NM_017664). Accordingly, utilities of VGAM558 include diagnosis, prevention and treatment of diseases and clinical conditions associated with FLJ20093. FLJ20793 (Accession XM_166296) is another VGAM558 host target gene. FLJ20793 BINDING SITE is HOST TARGET binding site found in the 3' untranslated region of mRNA encoded by FLJ20793, corresponding to a HOST TARGET binding site such as BINDING SITE I, BINDING SITE II or BINDING SITE III. Table 2 illustrates the complementarity of the nucleotide sequences of FLJ20793 BINDING SITE, designated SEQ ID:44111, to the nucleotide sequence of VGAM558 RNA, herein designated VGAM RNA, also designated SEQ ID:3269.

Another function of VGAM558 is therefore inhibition of FLJ20793 (Accession XM_166296). Accordingly, utilities of VGAM558 include diagnosis, prevention and treatment of diseases and clinical conditions associated with FLJ20793. KIAA0367 (Accession XM_041018) is another VGAM558 host target gene. KIAA0367 BINDING SITE is HOST TARGET binding site found in the 3' untranslated region of mRNA encoded by KIAA0367, corresponding to a HOST TARGET binding site such as BINDING SITE I, BINDING SITE II or BINDING SITE III. Table 2 illustrates the complementarity of the nucleotide sequences of KIAA0367 BINDING SITE, designated SEQ ID:33419, to the nucleotide sequence of VGAM558 RNA, herein designated VGAM RNA, also designated SEQ ID:3269.

Another function of VGAM558 is therefore inhibition of KIAA0367 (Accession XM_041018). Accordingly, utilities of VGAM558 include diagnosis, prevention and treatment of diseases and clinical conditions associated with KIAA0367. Nuclear Factor of Activated T-cells 5, Tonicity-responsive (NFAT5, Accession NM_006599) is another VGAM558 host target gene. NFAT5 BINDING SITE is HOST TARGET binding site found in the 3' untranslated region of mRNA encoded by NFAT5, corresponding to a HOST TARGET binding site such as BINDING SITE I, BINDING SITE II or BINDING SITE III. Table 2 illustrates the complementarity of the nucleotide sequences of NFAT5 BINDING SITE, designated SEQ ID:13378, to the nucleotide sequence of VGAM558 RNA, herein designated VGAM RNA, also designated SEQ ID:3269.

Another function of VGAM558 is therefore inhibition of Nuclear Factor of Activated T-cells 5, Tonicity-responsive (NFAT5, Accession NM_006599). Accordingly, utilities of VGAM558 include diagnosis, prevention and treatment of diseases and clinical conditions associated with NFAT5. PRO1386 (Accession NM_031269) is another VGAM558 host target gene. PRO1386 BINDING SITE is HOST TARGET binding site found in the 5" untranslated region of mRNA encoded by PRO1386, corresponding to a HOST TARGET binding site such as BINDING SITE I, BINDING SITE II or BINDING SITE III. Table 2 illustrates the complementarity of the nucleotide sequences of PRO1386 BINDING SITE, designated SEQ ID:25293, to the nucleotide sequence of VGAM558 RNA, herein designated VGAM RNA, also designated SEQ ID:3269.

Another function of VGAM558 is therefore inhibition of PRO1386 (Accession NM_031269). Accordingly, utilities of VGAM558 include diagnosis, prevention and treatment of diseases and clinical conditions associated with PRO1386. RRN3 (Accession NM_018427) is another VGAM558 host target gene. RRN3 BINDING SITE is HOST TARGET binding site found in the 3' untranslated region of mRNA encoded by RRN3, corresponding to a HOST TARGET binding site such as BINDING SITE I, BINDING SITE II or BINDING SITE III. Table 2 illustrates the complementarity of the nucleotide sequences of RRN3 BINDING SITE, designated SEQ ID:20490, to the nucleotide sequence of VGAM558 RNA, herein designated VGAM RNA, also designated SEQ ID:3269.

Another function of VGAM558 is therefore inhibition of RRN3 (Accession NM_018427). Accordingly, utilities of VGAM558 include diagnosis, prevention and treatment of diseases and clinical conditions associated with RRN3. Tumor Protein P53 Inducible Nuclear Protein 1 (TP53INP1, Accession NM_033285) is another VGAM558 host target gene. TP53INP1 BINDING SITE1 and TP53INP1 BINDING SITE2 are HOST TARGET binding sites found in untranslated regions of mRNA encoded by TP53INP1, corresponding to HOST TARGET binding sites such as BINDING SITE I, BINDING SITE II or BINDING SITE III. Table 2 illustrates the complementarity of the nucleotide sequences of TP53INP1 BINDING SITE1 and TP53INP1 BINDING SITE2, designated SEQ ID:27107 and SEQ ID:36117 respectively, to the nucleotide sequence of VGAM558 RNA, herein designated VGAM RNA, also designated SEQ ID:3269.

Another function of VGAM558 is therefore inhibition of Tumor Protein P53 Inducible Nuclear Protein 1 (TP53INP1, Accession NM_033285). Accordingly, utilities of VGAM558 include diagnosis, prevention and treatment of diseases and clinical conditions associated with TP53INP1. LOC120892 (Accession XM_058513) is another VGAM558 host target gene. LOC120892 BINDING SITE is HOST TARGET binding site found in the 3' untranslated region of mRNA encoded by LOC120892, corresponding to a HOST TARGET binding site such as BINDING SITE I, BINDING SITE II or BINDING SITE III. Table 2 illustrates the complementarity of the nucleotide sequences of LOC120892 BINDING SITE, designated SEQ ID:36649, to the nucleotide sequence of VGAM558 RNA, herein designated VGAM RNA, also designated SEQ ID:3269.

Another function of VGAM558 is therefore inhibition of LOC120892 (Accession XM_058513). Accordingly, utilities of VGAM558 include diagnosis, prevention and treatment of diseases and clinical conditions associated with LOC120892. LOC130612 (Accession XM_059461) is another VGAM558 host target gene. LOC130612 BINDING SITE is HOST TARGET binding site found in the 5' untranslated region of mRNA encoded by LOC130612, corresponding to a HOST TARGET binding site such as BINDING SITE I, BINDING SITE II or BINDING SITE III. Table 2 illustrates the complementarity of the nucleotide sequences of LOC130612 BINDING SITE, designated SEQ ID:36998, to the nucleotide sequence of VGAM558 RNA, herein designated VGAM RNA, also designated SEQ ID:3269.

Another function of VGAM558 is therefore inhibition of LOC130612 (Accession XM_059461). Accordingly, utilities of VGAM558 include diagnosis, prevention and treatment of diseases and clinical conditions associated with LOC130612. LOC145828 (Accession XM_096879) is another VGAM558 host target gene. LOC145828 BINDING SITE is HOST TARGET binding site found in the 5' untranslated region of mRNA encoded by LOC145828, corresponding to a HOST TARGET binding site such as BINDING SITE I, BINDING SITE II or BINDING SITE III. Table 2 illustrates the complementarity of the nucleotide sequences of LOC145828 BINDING SITE, designated SEQ ID:40613, to the nucleotide sequence of VGAM558 RNA, herein designated VGAM RNA, also designated SEQ ID:3269.

Another function of VGAM558 is therefore inhibition of LOC145828 (Accession XM_096879). Accordingly, utilities of VGAM558 include diagnosis, prevention and treatment of diseases and clinical conditions associated with LOC145828. LOC147341 (Accession XM_097223) is another VGAM558 host target gene. LOC147341 BINDING SITE is HOST TARGET binding site found in the 3' untranslated region of mRNA encoded by LOC147341, corresponding to a HOST TARGET binding site such as BINDING SITE I, BINDING SITE II or BINDING SITE III. Table 2 illustrates the complementarity of the nucleotide sequences of LOC147341 BINDING SITE, designated SEQ ID:40828, to the nucleotide sequence of VGAM558 RNA, herein designated VGAM RNA, also designated SEQ ID:3269.

Another function of VGAM558 is therefore inhibition of LOC147341 (Accession XM_097223). Accordingly, utilities of VGAM558 include diagnosis, prevention and treatment of diseases and clinical conditions associated with LOC147341. LOC149175 (Accession XM_086445) is another VGAM558 host target gene. LOC149175 BINDING SITE is HOST TARGET binding site found in the 3' untranslated region of mRNA encoded by LOC149175, corresponding to a HOST TARGET binding site such as BINDING SITE I, BINDING SITE II or BINDING SITE III. Table 2 illustrates the complementarity of the nucleotide sequences of LOC149175 BINDING SITE, designated SEQ ID:38660, to the nucleotide sequence of VGAM558 RNA, herein designated VGAM RNA, also designated SEQ ID:3269.

Another function of VGAM558 is therefore inhibition of LOC149175 (Accession XM_086445). Accordingly, utilities of VGAM558 include diagnosis, prevention and treatment of diseases and clinical conditions associated with LOC149175. LOC149650 (Accession XM_086623) is another VGAM558 host target gene. LOC149650 BINDING SITE is HOST TARGET binding site found in the 3' untranslated region of mRNA encoded by LOC149650, corresponding to a HOST TARGET binding site such as BINDING SITE I, BINDING SITE II or BINDING SITE III. Table 2 illustrates the complementarity of the nucleotide sequences of LOC149650 BINDING SITE, designated SEQ ID:38797, to the nucleotide sequence of VGAM558 RNA, herein designated VGAM RNA, also designated SEQ ID:3269.

Another function of VGAM558 is therefore inhibition of LOC149650 (Accession XM_086623). Accordingly, utilities of VGAM558 include diagnosis, prevention and treatment of diseases and clinical conditions associated with LOC149650. LOC152762 (Accession XM_087518) is another VGAM558 host target gene. LOC152762 BINDING SITE is HOST TARGET binding site found in the 3' untranslated region of mRNA encoded by LOC152762, corresponding to a HOST TARGET binding site such as BINDING SITE I, BINDING SITE II or BINDING SITE III. Table 2 illustrates the complementarity of the nucleotide sequences of LOC152762 BINDING SITE, designated SEQ ID:39308, to the nucleotide sequence of VGAM558 RNA, herein designated VGAM RNA, also designated SEQ ID:3269.

Another function of VGAM558 is therefore inhibition of LOC152762 (Accession XM_087518). Accordingly, utilities of VGAM558 include diagnosis, prevention and treatment of diseases and clinical conditions associated with LOC152762. LOC196528 (Accession XM_113745) is another VGAM558 host target gene. LOC196528 BINDING SITE is HOST TARGET binding site found in the 3' untranslated region of mRNA encoded by LOC196528, corresponding to a HOST TARGET binding site such as BINDING SITE I, BINDING SITE II or BINDING SITE III. Table 2 illustrates the complementarity of the nucleotide sequences of LOC196528 BINDING SITE, designated SEQ ID:42406, to the nucleotide sequence of VGAM558 RNA, herein designated VGAM RNA, also designated SEQ ID:3269.

Another function of VGAM558 is therefore inhibition of LOC196528 (Accession XM_113745). Accordingly, utilities of VGAM558 include diagnosis, prevention and treatment of diseases and clinical conditions associated with LOC196528. LOC221876 (Accession XM_168220) is another VGAM558 host target gene. LOC221876 BINDING SITE is HOST TARGET binding site found in the 5' untranslated region of mRNA encoded by LOC221876, corresponding to a HOST TARGET binding site such as BINDING SITE I, BINDING SITE II or BINDING SITE III. Table 2 illustrates the complementarity of the nucleotide sequences of LOC221876 BINDING SITE, designated SEQ ID:45080, to the nucleotide sequence of VGAM558 RNA, herein designated VGAM RNA, also designated SEQ ID:3269.

Another function of VGAM558 is therefore inhibition of LOC221876 (Accession XM_168220). Accordingly, utilities of VGAM558 include diagnosis, prevention and treatment of diseases and clinical conditions associated with LOC221876. LOC254042 (Accession XM_171022) is another VGAM558 host target gene. LOC254042 BINDING SITE is HOST TARGET binding site found in the 3' untranslated region of mRNA encoded by LOC254042, corresponding to a HOST TARGET binding site such as BINDING SITE I, BINDING SITE II or BINDING SITE III. Table 2 illustrates the complementarity of the nucleotide sequences of LOC254042 BINDING SITE, designated SEQ ID:45794, to the nucleotide sequence of VGAM558 RNA, herein designated VGAM RNA, also designated SEQ ID:3269.

Another function of VGAM558 is therefore inhibition of LOC254042 (Accession XM_171022). Accordingly, utilities of VGAM558 include diagnosis, prevention and treatment of diseases and clinical conditions associated with LOC254042. LOC255446 (Accession XM_173154) is another VGAM558 host target gene. LOC255446 BINDING SITE is HOST TARGET binding site found in the 5' untranslated region of mRNA encoded by LOC255446, corresponding to a HOST TARGET binding site such as BINDING SITE I, BINDING SITE II or BINDING SITE III. Table 2 illustrates the complementarity of the nucleotide sequences of LOC255446 BINDING SITE, designated SEQ ID:46409, to the nucleotide sequence of VGAM558 RNA, herein designated VGAM RNA, also designated SEQ ID:3269.

Another function of VGAM558 is therefore inhibition of LOC255446 (Accession XM_173154). Accordingly, utilities of VGAM558 include diagnosis, prevention and treatment of diseases and clinical conditions associated with LOC255446. LOC257017 (Accession XM_173227) is another VGAM558 host target gene. LOC257017 BINDING SITE is HOST TARGET binding site found in the 5' untranslated region of mRNA encoded by LOC257017, corresponding to a HOST TARGET binding site such as BINDING SITE I, BINDING SITE II or BINDING SITE III. Table 2 illustrates the complementarity of the nucleotide sequences of LOC257017 BINDING SITE, designated SEQ ID:46500, to the nucleotide sequence of VGAM558 RNA, herein designated VGAM RNA, also designated SEQ ID:3269.

Another function of VGAM558 is therefore inhibition of LOC257017 (Accession XM_173227). Accordingly, utilities of VGAM558 include diagnosis, prevention and treatment of diseases and clinical conditions associated with LOC257017. LOC51644 (Accession NM_016057) is another VGAM558 host target gene. LOC51644 BINDING SITE is HOST TARGET binding site found in the 3' untranslated region of mRNA encoded by LOC51644, corresponding to a HOST TARGET binding site such as BINDING SITE I, BINDING SITE II or BINDING SITE III. Table 2 illustrates the complementarity of the nucleotide sequences of LOC51644 BINDING SITE, designated SEQ ID:18132, to the nucleotide sequence of VGAM558 RNA, herein designated VGAM RNA, also designated SEQ ID:3269.

Another function of VGAM558 is therefore inhibition of LOC51644 (Accession NM_016057). Accordingly, utilities of VGAM558 include diagnosis, prevention and treatment of diseases and clinical conditions associated with LOC51644.

LOC92360 (Accession XM_044589) is another VGAM558 host target gene. LOC92360 BINDING SITE is HOST TARGET binding site found in the 3' untranslated region of mRNA encoded by LOC92360, corresponding to a HOST TARGET binding site such as BINDING SITE I, BINDING SITE II or BINDING SITE III. Table 2 illustrates the complementarity of the nucleotide sequences of LOC92360 BINDING SITE, designated SEQ ID:34241, to the nucleotide sequence of VGAM558 RNA, herein designated VGAM RNA, also designated SEQ ID:3269.

Another function of VGAM558 is therefore inhibition of LOC92360 (Accession XM_044589). Accordingly, utilities of VGAM558 include diagnosis, prevention and treatment of diseases and clinical conditions associated with LOC92360. FIG. 1 further provides a conceptual description of a novel bioinformatically detected viral gene of the present invention, referred to here as Viral Genomic Address Messenger 559 (VGAM559) viral gene, which modulates expression of respective host target genes thereof, the function and utility of which host target genes is known in the art.

VGAM559 is a novel bioinformatically detected regulatory, non protein coding, viral micro RNA (miRNA) gene. The method by which VGAM559 was detected is described hereinabove with reference to FIGS. 1-8.

VGAM559 gene, herein designated VGAM GENE, is a viral gene contained in the genome of Fowlpox Virus. VGAM559 host target gene, herein designated VGAM HOST TARGET GENE, is a human gene contained in the human genome.

VGAM559 gene encodes a VGAM559 precursor RNA, herein designated VGAM PRECURSOR RNA. Similar to other miRNA genes, and unlike most ordinary genes, VGAM559 precursor RNA does not encode a protein. A nucleotide sequence identical or highly similar to the nucleotide sequence of VGAM559 precursor RNA is designated SEQ ID:545, and is provided hereinbelow with reference to the sequence listing part. Nucleotide sequence SEQ ID:545 is located at position 19237 relative to the genome of Fowlpox Virus.

VGAM559 precursor RNA folds onto itself, forming VGAM559 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM559 folded precursor RNA into VGAM559 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM559 RNA is designated SEQ ID:3270, and is provided hereinbelow with reference to the sequence listing part.

VGAM559 host target gene, herein designated VGAM HOST TARGET GENE, encodes a corresponding messenger RNA, VGAM559 host target RNA, herein designated VGAM HOST TARGET RNA. VGAM559 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM559 RNA, herein designated VGAM RNA, binds complementarily to one or more host target binding sites located in untranslated regions of VGAM559 host target RNA, herein designated VGAM HOST TARGET RNA. This complementary binding is due to the fact that the nucleotide sequence of VGAM559 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM559 RNA, herein designated VGAM RNA, may have a different number of host target binding sites in untranslated regions of a VGAM559 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM559 RNA, herein designated VGAM RNA, to host target binding sites on VGAM559 host target RNA, herein designated VGAM HOST TARGET RNA, such as BINDING SITE I, BINDING SITE II and BINDING SITE III, inhibits translation of VGAM559 host target RNA into VGAM559 host target protein, herein designated VGAM HOST TARGET PROTEIN. VGAM host target protein is therefore outlined by a broken line.

It is appreciated that VGAM559 host target gene, herein designated VGAM HOST TARGET GENE, in fact represents a plurality of VGAM559 host target genes. The mRNA of each one of this plurality of VGAM559 host target genes comprises one or more host target binding sites, each having a nucleotide sequence which is at least partly complementary to VGAM559 RNA, herein designated VGAM RNA, and which when bound by VGAM559 RNA causes inhibition of translation of respective one or more VGAM559 host target proteins.

It is further appreciated by one skilled in the art that the mode of translational inhibition illustrated by FIG. 1 with specific reference to translational inhibition exerted by VGAM559 gene, herein designated VGAM GENE, on one or more VGAM559 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM559 is inhibition of expression of host target genes, as part of a novel viral mechanism of attacking a host. Accordingly, utilities of VGAM559 include diagnosis, prevention and treatment of viral infection by Fowlpox Virus. Specific functions, and accordingly utilities, of VGAM559 correlate with, and may be deduced from, the identity of the host target genes which VGAM559 binds and inhibits, and the function of these host target genes, as elaborated hereinbelow.

Nucleotide sequences of the VGAM559 precursor RNA, herein designated VGAM PRECURSOR RNA, and of the 'diced' VGAM559 RNA, herein designated VGAM RNA, and a schematic representation of the secondary folding of VGAM559 folded precursor RNA, herein designated VGAM FOLDED PRECURSOR RNA, of VGAM559 are further described hereinbelow with reference to Table 1.

Nucleotide sequences of host target binding sites, such as BINDING SITE-I, BINDING SITE-II and BINDING SITE-III of FIG. 1, found on VGAM559 host target RNA, and schematic representation of the complementarity of each of these host target binding sites to VGAM559 RNA, herein designated VGAM RNA, are described hereinbelow with reference to Table 2.

As mentioned hereinabove with reference to FIG. 1, a function of VGAM559 gene, herein designated VGAM is inhibition of expression of VGAM559 target genes. It is appreciated that specific functions, and accordingly utilities, of VGAM559 correlate with, and may be deduced from, the identity of the target genes which VGAM559 binds and inhibits, and the function of these target genes, as elaborated hereinbelow.

Dyskeratosis Congenita 1, Dyskerin (DKC1, Accession NM_001363) is a VGAM559 host target gene. DKC1 BINDING SITE is HOST TARGET binding site found in the 3' untranslated region of mRNA encoded by DKC1, corresponding to a HOST TARGET binding site such as BINDING SITE I, BINDING SITE II or BINDING SITE III. Table 2 illustrates the complementarity of the nucleotide sequences of DKC1 BINDING SITE, designated SEQ ID:7044, to the nucleotide sequence of VGAM559 RNA, herein designated VGAM RNA, also designated SEQ ID:3270.

A function of VGAM559 is therefore inhibition of Dyskeratosis Congenita 1, Dyskerin (DKC1, Accession NM_001363), a gene which may have cell cycle and nucleolar functions. Accordingly, utilities of VGAM559 include diagnosis, prevention and treatment of diseases and clinical conditions associated with DKC1. The function of DKC1 has been established by previous studies. Heiss et al. (1998) demonstrated missense mutations in the DKC1 gene that correlated with dyskeratosis congenita. The disease is characterized by the early manifestation of reticulate skin pigmentation, nail dystrophy, and mucosal leukoplakia. Progressive bone marrow failure occurs in over 80% of cases and is the main cause of early mortality. Variability in the age of onset, severity of bone marrow failure, and range of congenital abnormalities was observed. An increased risk of developing different types of malignancies also exists. Chromosomal instability is indicated by the keratin chromosomal aberrations in skin fibroblast cell cultures and bone marrow metaphases. In contrast to patients with Fanconi anemia (OMIM Ref. No. 227650), lymphocytes from DKC patients do not show an increased sensitivity to clastogens. Females heterozygous for the mutant gene showed a skewed pattern of X-chromosome inactivation consistent with the gene defect giving rise to a proliferation and/or survival disadvantage in those cells expressing it. By positional cloning, Heiss et al. (1998) identified a gene, symbolized DKC1, in the Xq28 region that is the cause of X-linked recessive dyskeratosis congenita (DKC; 305000). Heiss et al. (1998) found that the DKC1 gene is highly conserved across species barriers and is the ortholog of rat NAP57 and S. cerevisiae Cbf5. The gene product, referred to as dyskerin, contains 2 TruB pseudouridine synthase motifs, multiple phosphorylation sites, and a carboxy-terminal lysine-rich domain. By analogy to the function of known dyskerin orthologs, Heiss et al. (1998) predicted that dyskerin is involved in the cell cycle and nucleolar function.

Full details of the abovementioned studies are described in the following publications, the disclosure of which are hereby incorporated by reference:

Heiss, N. S.; Knight, S. W.; Vulliamy, T. J.; Klauck, S. M.; Wiemann, S.; Mason, P. J.; Poustka, A.; Dokal, I.: X-linked dyskeratosis congenita is caused by mutations in a highly conserved gene with putative nucleolar functions. Nature Genet. 19: 32-38, 1998; and Heiss, N. S.; Megarbane, A.; Klauck, S. M.; Kreuz, F. R.; Makhoul, E.; Majewski, F.; Poustka, A.: One novel and two recurrent missense DKC1 mutations in patients with dyskeratosis cong.

Further studies establishing the function and utilities of DKC1 are found in John Hopkins OMIM database record ID 300126, and in sited publications numbered 9154-915 and 10979-10987 listed in the bibliography section hereinbelow, which are also hereby incorporated by reference. Glutamate Receptor, Metabotropic 6 (GRM6, Accession NM_000843) is another VGAM559 host target gene. GRM6 BINDING SITE is HOST TARGET binding site found in the 3' untranslated region of mRNA encoded by GRM6, corresponding to a HOST TARGET binding site such as BINDING SITE I, BINDING SITE II or BINDING SITE III. Table 2 illustrates the complementarity of the nucleotide sequences of GRM6 BINDING SITE, designated SEQ ID:6513, to the nucleotide sequence of VGAM559 RNA, herein designated VGAM RNA, also designated SEQ ID:3270.

Another function of VGAM559 is therefore inhibition of Glutamate Receptor, Metabotropic 6 (GRM6, Accession NM_000843). Accordingly, utilities of VGAM559 include diagnosis, prevention and treatment of diseases and clinical conditions associated with GRM6. Nuclear Receptor Coactivator 6 (NCOA6, Accession NM_014071) is another VGAM559 host target gene. NCOA6 BINDING SITE is HOST TARGET binding site found in the 5' untranslated region of mRNA encoded by NCOA6, corresponding to a HOST TARGET binding site such as BINDING SITE I, BINDING SITE II or BINDING SITE III. Table 2 illustrates the complementarity of the nucleotide sequences of NCOA6 BINDING SITE, designated SEQ ID:15294, to the nucleotide sequence of VGAM559 RNA, herein designated VGAM RNA, also designated SEQ ID:3270.

Another function of VGAM559 is therefore inhibition of Nuclear Receptor Coactivator 6 (NCOA6, Accession NM_014071), a gene which activates gene transcription through ligand-dependent association with coactivators. Accordingly, utilities of VGAM559 include diagnosis, prevention and treatment of diseases and clinical conditions associated with NCOA6. The function of NCOA6 and its association with various diseases and clinical conditions, has been established by previous studies, as described hereinabove with reference to VGAM25. Solute Carrier Family 11 (proton-coupled divalent metal ion transporters), Member 3 (SLC11A3, Accession NM_014585) is another VGAM559 host target gene. SLC11A3 BINDING SITE is HOST TARGET binding site found in the 3' untranslated region of mRNA encoded by SLC11A3, corresponding to a HOST TARGET binding site such as BINDING SITE I, BINDING SITE II or BINDING SITE III. Table 2 illustrates the complementarity of the nucleotide sequences of SLC11A3 BINDING SITE, designated SEQ ID:15943, to the nucleotide sequence of VGAM559 RNA, herein designated VGAM RNA, also designated SEQ ID:3270.

Another function of VGAM559 is therefore inhibition of Solute Carrier Family 11 (proton-coupled divalent metal ion transporters), Member 3 (SLC11A3, Accession NM_014585). Accordingly, utilities of VGAM559 include diagnosis, prevention and treatment of diseases and clinical conditions associated with SLC11A3. ESDN (Accession NM_080927) is another VGAM559 host target gene. ESDN BINDING SITE is HOST TARGET binding site found in the 3' untranslated region of mRNA encoded by ESDN, corresponding to a HOST TARGET binding site such as BINDING SITE I, BINDING SITE II or BINDING SITE III. Table 2 illustrates the complementarity of the nucleotide sequences of ESDN BINDING SITE, designated SEQ ID:28156, to the nucleotide sequence of VGAM559 RNA, herein designated VGAM RNA, also designated SEQ ID:3270.

Another function of VGAM559 is therefore inhibition of ESDN (Accession NM_080927). Accordingly, utilities of VGAM559 include diagnosis, prevention and treatment of diseases and clinical conditions associated with ESDN. FLJ20445 (Accession NM_017824) is another VGAM559 host target gene. FLJ20445 BINDING SITE is HOST TARGET binding site found in the 3" untranslated region of mRNA encoded by FLJ20445, corresponding to a HOST TARGET binding site such as BINDING SITE I, BINDING SITE II or BINDING SITE III. Table 2 illustrates the complementarity of the nucleotide sequences of FLJ20445 BINDING SITE, designated SEQ ID:19484, to the nucleotide sequence of VGAM559 RNA, herein designated VGAM RNA, also designated SEQ ID:3270.

Another function of VGAM559 is therefore inhibition of FLJ20445 (Accession NM_017824). Accordingly, utilities of VGAM559 include diagnosis, prevention and treatment of diseases and clinical conditions associated with FLJ20445. FLJ23510 (Accession NM_024720) is another VGAM559 host target gene. FLJ23510 BINDING SITE is HOST TARGET binding site found in the 5' untranslated region of mRNA encoded by FLJ23510, corresponding to a HOST TARGET binding site such as BINDING SITE I, BINDING SITE II or BINDING SITE III. Table 2 illustrates the complementarity of the nucleotide sequences of FLJ23510 BINDING SITE, designated SEQ ID:24054, to the nucleotide sequence of VGAM559 RNA, herein designated VGAM RNA, also designated SEQ ID:3270.

Another function of VGAM559 is therefore inhibition of FLJ23510 (Accession NM_024720). Accordingly, utilities of VGAM559 include diagnosis, prevention and treatment of diseases and clinical conditions associated with FLJ23510. KIAA0179 (Accession XM_035973) is another VGAM559 host target gene. KIAA0179 BINDING SITE is HOST TARGET binding site found in the 3' untranslated region of mRNA encoded by KIAA0179, corresponding to a HOST TARGET binding site such as BINDING SITE I, BINDING SITE II or BINDING SITE III. Table 2 illustrates the complementarity of the nucleotide sequences of KIAA0179 BINDING SITE, designated SEQ ID:32366, to the nucleotide sequence of VGAM559 RNA, herein designated VGAM RNA, also designated SEQ ID:3270.

Another function of VGAM559 is therefore inhibition of KIAA0179 (Accession XM_035973). Accordingly, utilities of VGAM559 include diagnosis, prevention and treatment of diseases and clinical conditions associated with KIAA0179. KIAA1535 (Accession XM_086565) is another VGAM559 host target gene. KIAA1535 BINDING SITE is HOST TARGET binding site found in the 3' untranslated region of mRNA encoded by KIAA1535, corresponding to a HOST TARGET binding site such as BINDING SITE I, BINDING SITE II or BINDING SITE III. Table 2 illustrates the complementarity of the nucleotide sequences of KIAA1535 BINDING SITE, designated SEQ ID:38769, to the nucleotide sequence of VGAM559 RNA, herein designated VGAM RNA, also designated SEQ ID:3270.

Another function of VGAM559 is therefore inhibition of KIAA1535 (Accession XM_086565). Accordingly, utilities of VGAM559 include diagnosis, prevention and treatment of diseases and clinical conditions associated with KIAA1535. Kv6.3 (Accession NM_133490) is another VGAM559 host target gene. Kv6.3 BINDING SITE is HOST TARGET binding site found in the 3' untranslated region of mRNA encoded by Kv6.3, corresponding to a HOST TARGET binding site such as BINDING SITE I, BINDING SITE II or BINDING SITE III. Table 2 illustrates the complementarity of the nucleotide sequences of Kv6.3 BINDING SITE, designated SEQ ID:28568, to the nucleotide sequence of VGAM559 RNA, herein designated VGAM RNA, also designated SEQ ID:3270.

Another function of VGAM559 is therefore inhibition of Kv6.3 (Accession NM_133490). Accordingly, utilities of VGAM559 include diagnosis, prevention and treatment of diseases and clinical conditions associated with Kv6.3. PFTAIRE Protein Kinase 1 (PFTK1, Accession NM_012395) is another VGAM559 host target gene. PFTK1 BINDING SITE is HOST TARGET binding site found in the 3' untranslated region of mRNA encoded by PFTK1, corresponding to a HOST TARGET binding site such as BINDING SITE I, BINDING SITE II or BINDING SITE III. Table 2 illustrates the complementarity of the nucleotide sequences of PFTK1 BINDING SITE, designated SEQ ID:14757, to the nucleotide sequence of VGAM559 RNA, herein designated VGAM RNA, also designated SEQ ID:3270.

Another function of VGAM559 is therefore inhibition of PFTAIRE Protein Kinase 1 (PFTK1, Accession NM_012395). Accordingly, utilities of VGAM559 include diagnosis, prevention and treatment of diseases and clinical conditions associated with PFTK1. LOC139522 (Accession XM_066738) is another VGAM559 host target gene. LOC139522 BINDING SITE is HOST TARGET binding site found in the 5' untranslated region of mRNA encoded by LOC139522, corresponding to a HOST TARGET binding site such as BINDING SITE I, BINDING SITE II or BINDING SITE III. Table 2 illustrates the complementarity of the nucleotide sequences of LOC139522 BINDING SITE, designated SEQ ID:37345, to the nucleotide sequence of VGAM559 RNA, herein designated VGAM RNA, also designated SEQ ID:3270.

Another function of VGAM559 is therefore inhibition of LOC139522 (Accession XM_066738). Accordingly, utilities of VGAM559 include diagnosis, prevention and treatment of diseases and clinical conditions associated with LOC139522. LOC196485 (Accession XM_113731) is another VGAM559 host target gene. LOC196485 BINDING SITE is HOST TARGET binding site found in the 3' untranslated region of mRNA encoded by LOC196485, corresponding to a HOST TARGET binding site such as BINDING SITE I, BINDING SITE II or BINDING SITE III. Table 2 illustrates the complementarity of the nucleotide sequences of LOC196485 BINDING SITE, designated SEQ ID:42381, to the nucleotide sequence of VGAM559 RNA, herein designated VGAM RNA, also designated SEQ ID:3270.

Another function of VGAM559 is therefore inhibition of LOC196485 (Accession XM_113731). Accordingly, utilities of VGAM559 include diagnosis, prevention and treatment of diseases and clinical conditions associated with LOC196485. LOC202986 (Accession XM_117489) is another VGAM559 host target gene. LOC202986 BINDING SITE is HOST TARGET binding site found in the 3' untranslated region of mRNA encoded by LOC202986, corresponding to a HOST TARGET binding site such as BINDING SITE I, BINDING SITE II or BINDING SITE III. Table 2 illustrates the complementarity of the nucleotide sequences of LOC202986 BINDING SITE, designated SEQ ID:43472, to the nucleotide sequence of VGAM559 RNA, herein designated VGAM RNA, also designated SEQ ID:3270.

Another function of VGAM559 is therefore inhibition of LOC202986 (Accession XM_117489). Accordingly, utilities of VGAM559 include diagnosis, prevention and treatment of diseases and clinical conditions associated with LOC202986. LOC203378 (Accession XM_117541) is another VGAM559 host target gene. LOC203378 BINDING SITE is HOST TARGET binding site found in the 3' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43556, to the nucleotide sequence of VGAM559 RNA, herein designated VGAM RNA, also designated SEQ ID:3270.

Another function of VGAM559 is therefore inhibition of LOC203378 (Accession XM_117541). Accordingly, utilities of VGAM559 include diagnosis, prevention and treatment of diseases and clinical conditions associated with LOC203378. LOC257106 (Accession XM_170910) is another VGAM559 host target gene. LOC257106 BINDING SITE is HOST TARGET binding site found in the 3' untranslated region of mRNA encoded by LOC257106, corresponding to a HOST TARGET binding site such as BINDING SITE I, BINDING SITE II or BINDING SITE III. Table 2 illustrates the complementarity of the nucleotide sequences of LOC257106 BINDING SITE, designated SEQ ID:45679, to the nucleotide sequence of VGAM559 RNA, herein designated VGAM RNA, also designated SEQ ID:3270.

Another function of VGAM559 is therefore inhibition of LOC257106 (Accession XM_170910). Accordingly, utilities of VGAM559 include diagnosis, prevention and treatment of diseases and clinical conditions associated with LOC257106. FIG. 1 further provides a conceptual description of a novel bioinformatically detected viral gene of the present invention, referred to here as Viral Genomic Address Messenger 560 (VGAM560) viral gene, which modulates expression of respective host target genes thereof, the function and utility of which host target genes is known in the art.

VGAM560 is a novel bioinformatically detected regulatory, non protein coding, viral micro RNA (miRNA) gene. The method by which VGAM560 was detected is described hereinabove with reference to FIGS. 1-8.

VGAM560 gene, herein designated VGAM GENE, is a viral gene contained in the genome of Fowlpox Virus. VGAM560 host target gene, herein designated VGAM HOST TARGET GENE, is a human gene contained in the human genome.

VGAM560 gene encodes a VGAM560 precursor RNA, herein designated VGAM PRECURSOR RNA. Similar to other miRNA genes, and unlike most ordinary genes, VGAM560 precursor RNA does not encode a protein. A nucleotide sequence identical or highly similar to the nucleotide sequence of VGAM560 precursor RNA is designated SEQ ID:546, and is provided hereinbelow with reference to the sequence listing part. Nucleotide sequence SEQ ID:546 is located at position 23914 relative to the genome of Fowlpox Virus.

VGAM560 precursor RNA folds onto itself, forming VGAM560 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM560 folded precursor RNA into VGAM560 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM560 RNA is designated SEQ ID:3271, and is provided hereinbelow with reference to the sequence listing part.

VGAM560 host target gene, herein designated VGAM HOST TARGET GENE, encodes a corresponding messenger RNA, VGAM560 host target RNA, herein designated VGAM HOST TARGET RNA. VGAM560 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM560 RNA, herein designated VGAM RNA, binds complementarily to one or more host target binding sites located in untranslated regions of VGAM560 host target RNA, herein designated VGAM HOST TARGET RNA. This complementary binding is due to the fact that the nucleotide sequence of VGAM560 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM560 RNA, herein designated VGAM RNA, may have a different number of host target binding sites in untranslated regions of a VGAM560 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM560 RNA, herein designated VGAM RNA, to host target binding sites on VGAM560 host target RNA, herein designated VGAM HOST TARGET RNA, such as BINDING SITE I, BINDING SITE II and BINDING SITE III, inhibits translation of VGAM560 host target RNA into VGAM560 host target protein, herein designated VGAM HOST TARGET PROTEIN. VGAM host target protein is therefore outlined by a broken line.

It is appreciated that VGAM560 host target gene, herein designated VGAM HOST TARGET GENE, in fact represents a plurality of VGAM560 host target genes. The mRNA of each one of this plurality of VGAM560 host target genes comprises one or more host target binding sites, each having a nucleotide sequence which is at least partly complementary to VGAM560 RNA, herein designated VGAM RNA, and which when bound by VGAM560 RNA causes inhibition of translation of respective one or more VGAM560 host target proteins.

It is further appreciated by one skilled in the art that the mode of translational inhibition illustrated by FIG. 1 with specific reference to translational inhibition exerted by VGAM560 gene, herein designated VGAM GENE, on one or more VGAM560 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM560 is inhibition of expression of host target genes, as part of a novel viral mechanism of attacking a host. Accordingly, utilities of VGAM560 include diagnosis, prevention and treatment of viral infection by Fowlpox Virus. Specific functions, and accordingly utilities, of VGAM560 correlate with, and may be deduced from, the identity of the host target genes which VGAM560 binds and inhibits, and the function of these host target genes, as elaborated hereinbelow.

Nucleotide sequences of the VGAM560 precursor RNA, herein designated VGAM PRECURSOR RNA, and of the 'diced' VGAM560 RNA, herein designated VGAM RNA, and a schematic representation of the secondary folding of VGAM560 folded precursor RNA, herein designated VGAM FOLDED PRECURSOR RNA, of VGAM560 are further described hereinbelow with reference to Table 1.

Nucleotide sequences of host target binding sites, such as BINDING SITE-I, BINDING SITE-II and BINDING SITE-III of FIG. 1, found on VGAM560 host target RNA, and schematic representation of the complementarity of each of these host target binding sites to VGAM560 RNA, herein designated VGAM RNA, are described hereinbelow with reference to Table 2.

As mentioned hereinabove with reference to FIG. 1, a function of VGAM560 gene, herein designated VGAM is inhibition of expression of VGAM560 target genes. It is appreciated that specific functions, and accordingly utilities, of VGAM560 correlate with, and may be deduced from, the identity of the target genes which VGAM560 binds and inhibits, and the function of these target genes, as elaborated hereinbelow.

SB52 (Accession NM_138335) is a VGAM560 host target gene. SB52 BINDING SITE is HOST TARGET binding site found in the 3' untranslated region of mRNA encoded by SB52, corresponding to a HOST TARGET binding site such as BINDING SITE I, BINDING SITE II or BINDING SITE III. Table 2 illustrates the complementarity of the nucleotide sequences of SB52 BINDING SITE, designated SEQ ID:28733, to the nucleotide sequence of VGAM560 RNA, herein designated VGAM RNA, also designated SEQ ID:3271.

A function of VGAM560 is therefore inhibition of SB52 (Accession NM_138335). Accordingly, utilities of VGAM560 include diagnosis, prevention and treatment of diseases and clinical conditions associated with SB52. Ubiquitin-like, Containing PHD and RING Finger Domains, 2 (UHRF2, Accession XM_055929) is another VGAM560 host target gene. UHRF2 BINDING SITE is HOST TARGET binding site found in the 3' untranslated region of mRNA encoded by UHRF2, corresponding to a HOST TARGET binding site such as BINDING SITE I, BINDING SITE II or BINDING SITE III. Table 2 illustrates the complementarity of the nucleotide sequences of UHRF2 BINDING SITE, designated SEQ ID:36353, to the nucleotide sequence of VGAM560 RNA, herein designated VGAM RNA, also designated SEQ ID:3271.

Another function of VGAM560 is therefore inhibition of Ubiquitin-like, Containing PHD and RING Finger Domains, 2 (UHRF2, Accession XM_055929). Accordingly, utilities of VGAM560 include diagnosis, prevention and treatment of diseases and clinical conditions associated with UHRF2. LOC50999 (Accession NM_016040) is another VGAM560 host target gene. LOC50999 BINDING SITE is HOST TARGET binding site found in the 3' untranslated region of mRNA encoded by LOC50999, corresponding to a HOST TARGET binding site such as BINDING SITE I, BINDING SITE II or BINDING SITE III. Table 2 illustrates the complementarity of the nucleotide sequences of LOC50999 BINDING SITE, designated SEQ ID:18117, to the nucleotide sequence of VGAM560 RNA, herein designated VGAM RNA, also designated SEQ ID:3271.

Another function of VGAM560 is therefore inhibition of LOC50999 (Accession NM_016040). Accordingly, utilities of VGAM560 include diagnosis, prevention and treatment of diseases and clinical conditions associated with LOC50999. FIG. 1 further provides a conceptual description of a novel bioinformatically detected viral gene of the present invention, referred to here as Viral Genomic Address Messenger 561 (VGAM561) viral gene, which modulates expression of respective host target genes thereof, the function and utility of which host target genes is known in the art.

VGAM561 is a novel bioinformatically detected regulatory, non protein coding, viral micro RNA (miRNA) gene. The method by which VGAM561 was detected is described hereinabove with reference to FIGS. 1-8.

VGAM561 gene, herein designated VGAM GENE, is a viral gene contained in the genome of Fowlpox Virus. VGAM561 host target gene, herein designated VGAM HOST TARGET GENE, is a human gene contained in the human genome.

VGAM561 gene encodes a VGAM561 precursor RNA, herein designated VGAM PRECURSOR RNA. Similar to other miRNA genes, and unlike most ordinary genes, VGAM561 precursor RNA does not encode a protein. A nucleotide sequence identical or highly similar to the nucleotide sequence of VGAM561 precursor RNA is designated SEQ ID:547, and is provided hereinbelow with reference to the sequence listing part. Nucleotide sequence SEQ ID:547 is located at position 33749 relative to the genome of Fowlpox Virus.

VGAM561 precursor RNA folds onto itself, forming VGAM561 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM561 folded precursor RNA into VGAM561 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM561 RNA is designated SEQ ID:3272, and is provided hereinbelow with reference to the sequence listing part.

VGAM561 host target gene, herein designated VGAM HOST TARGET GENE, encodes a corresponding messenger RNA, VGAM561 host target RNA, herein designated VGAM HOST TARGET RNA. VGAM561 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM561 RNA, herein designated VGAM RNA, binds complementarily to one or more host target binding sites located in untranslated regions of VGAM561 host target RNA, herein designated VGAM HOST TARGET RNA. This complementary binding is due to the fact that the nucleotide sequence of VGAM561 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM561 RNA, herein designated VGAM RNA, may have a different number of host target binding sites in untranslated regions of a VGAM561 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM561 RNA, herein designated VGAM RNA, to host target binding sites on VGAM561 host target RNA, herein designated VGAM HOST TARGET RNA, such as BINDING SITE I, BINDING SITE II and BINDING SITE III, inhibits translation of VGAM561 host target RNA into VGAM561 host target protein, herein designated VGAM HOST TARGET PROTEIN. VGAM host target protein is therefore outlined by a broken line.

It is appreciated that VGAM561 host target gene, herein designated VGAM HOST TARGET GENE, in fact represents a plurality of VGAM561 host target genes. The mRNA of each one of this plurality of VGAM561 host target genes comprises one or more host target binding sites, each having a nucleotide sequence which is at least partly complementary to VGAM561 RNA, herein designated VGAM RNA, and which when bound by VGAM561 RNA causes inhibition of translation of respective one or more VGAM561 host target proteins.

It is further appreciated by one skilled in the art that the mode of translational inhibition illustrated by FIG. 1 with specific reference to translational inhibition exerted by VGAM561 gene, herein designated VGAM GENE, on one or more VGAM561 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM561 is inhibition of expression of host target genes, as part of a novel viral mechanism of attacking a host. Accordingly, utilities of VGAM561 include diagnosis, prevention and treatment of viral infection by Fowlpox Virus. Specific functions, and accordingly utilities, of VGAM561 correlate with, and may be deduced from, the identity of the host target genes which VGAM561 binds and inhibits, and the function of these host target genes, as elaborated hereinbelow.

Nucleotide sequences of the VGAM561 precursor RNA, herein designated VGAM PRECURSOR RNA, and of the 'diced' VGAM561 RNA, herein designated VGAM RNA, and a schematic representation of the secondary folding of VGAM561 folded precursor RNA, herein designated VGAM FOLDED PRECURSOR RNA, of VGAM561 are further described hereinbelow with reference to Table 1.

Nucleotide sequences of host target binding sites, such as BINDING SITE-I, BINDING SITE-II and BINDING SITE-III of FIG. 1, found on VGAM561 host target RNA, and schematic representation of the complementarity of each of these host target binding sites to VGAM561 RNA, herein designated VGAM RNA, are described hereinbelow with reference to Table 2.

As mentioned hereinabove with reference to FIG. 1, a function of VGAM561 gene, herein designated VGAM is inhibition of expression of VGAM561 target genes. It is appreciated that specific functions, and accordingly utilities, of VGAM561 correlate with, and may be deduced from, the identity of the target genes which VGAM561 binds and inhibits, and the function of these target genes, as elaborated hereinbelow.

BLAME (Accession NM_020125) is a VGAM561 host target gene. BLAME BINDING SITE is HOST TARGET binding site found in the 3' untranslated region of mRNA encoded by BLAME, corresponding to a HOST TARGET binding site such as BINDING SITE I, BINDING SITE II or BINDING SITE III. Table 2 illustrates the complementarity of the nucleotide sequences of BLAME BINDING SITE, designated SEQ ID:21305, to the nucleotide sequence of VGAM561 RNA, herein designated VGAM RNA, also designated SEQ ID:3272.

A function of VGAM561 is therefore inhibition of BLAME (Accession NM_020125). Accordingly, utilities of VGAM561 include diagnosis, prevention and treatment of diseases and clinical conditions associated with BLAME. LOC90342 (Accession XM_031009) is another VGAM561 host target gene. LOC90342 BINDING SITE is HOST TARGET binding site found in the 5" untranslated region of mRNA encoded by LOC90342, corresponding to a HOST TARGET binding site such as BINDING SITE I, BINDING SITE II or BINDING SITE III. Table 2 illustrates the complementarity of the nucleotide sequences of LOC90342 BINDING SITE, designated SEQ ID:31252, to the nucleotide sequence of VGAM561 RNA, herein designated VGAM RNA, also designated SEQ ID:3272.

Another function of VGAM561 is therefore inhibition of LOC90342 (Accession XM_031009). Accordingly, utilities of VGAM561 include diagnosis, prevention and treatment of diseases and clinical conditions associated with LOC90342. FIG. 1 further provides a conceptual description of a novel bioinformatically detected viral gene of the present invention, referred to here as Viral Genomic Address Messenger 562 (VGAM562) viral gene, which modulates expression of respective host target genes thereof, the function and utility of which host target genes is known in the art.

VGAM562 is a novel bioinformatically detected regulatory, non protein coding, viral micro RNA (miRNA) gene. The method by which VGAM562 was detected is described hereinabove with reference to FIGS. 1-8.

VGAM562 gene, herein designated VGAM GENE, is a viral gene contained in the genome of Fowlpox Virus. VGAM562 host target gene, herein designated VGAM HOST TARGET GENE, is a human gene contained in the human genome.

VGAM562 gene encodes a VGAM562 precursor RNA, herein designated VGAM PRECURSOR RNA. Similar to other miRNA genes, and unlike most ordinary genes, VGAM562 precursor RNA does not encode a protein. A nucleotide sequence identical or highly similar to the nucleotide sequence of VGAM562 precursor RNA is designated SEQ ID:548, and is provided hereinbelow with reference to the sequence listing part. Nucleotide sequence SEQ ID:548 is located at position 81779 relative to the genome of Fowlpox Virus.

VGAM562 precursor RNA folds onto itself, forming VGAM562 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM562 folded precursor RNA into VGAM562 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM562 RNA is designated SEQ ID:3273, and is provided hereinbelow with reference to the sequence listing part.

VGAM562 host target gene, herein designated VGAM HOST TARGET GENE, encodes a corresponding messenger RNA, VGAM562 host target RNA, herein designated VGAM HOST TARGET RNA. VGAM562 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM562 RNA, herein designated VGAM RNA, binds complementarily to one or more host target binding sites located in untranslated regions of VGAM562 host target RNA, herein designated VGAM HOST TARGET RNA. This complementary binding is due to the fact that the nucleotide sequence of VGAM562 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM562 RNA, herein designated VGAM RNA, may have a different number of host target binding sites in untranslated regions of a VGAM562 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM562 RNA, herein designated VGAM RNA, to host target binding sites on VGAM562 host target RNA, herein designated VGAM HOST TARGET RNA, such as BINDING SITE I, BINDING SITE II and BINDING SITE III, inhibits translation of VGAM562 host target RNA into VGAM562 host target protein, herein designated VGAM HOST TARGET PROTEIN. VGAM host target protein is therefore outlined by a broken line.

It is appreciated that VGAM562 host target gene, herein designated VGAM HOST TARGET GENE, in fact represents a plurality of VGAM562 host target genes. The mRNA of each one of this plurality of VGAM562 host target genes comprises one or more host target binding sites, each having a nucleotide sequence which is at least partly complementary to VGAM562 RNA, herein designated VGAM RNA, and which when bound by VGAM562 RNA causes inhibition of translation of respective one or more VGAM562 host target proteins.

It is further appreciated by one skilled in the art that the mode of translational inhibition illustrated by FIG. 1 with specific reference to translational inhibition exerted by VGAM562 gene, herein designated VGAM GENE, on one or more VGAM562 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM562 is inhibition of expression of host target genes, as part of a novel viral mechanism of attacking a host. Accordingly, utilities of VGAM562 include diagnosis, prevention and treatment of viral infection by Fowlpox Virus. Specific functions, and accordingly utilities, of VGAM562 correlate with, and may be deduced from, the identity of the host target genes which VGAM562 binds and inhibits, and the function of these host target genes, as elaborated hereinbelow.

Nucleotide sequences of the VGAM562 precursor RNA, herein designated VGAM PRECURSOR RNA, and of the 'diced' VGAM562 RNA, herein designated VGAM RNA, and a schematic representation of the secondary folding of VGAM562 folded precursor RNA, herein designated VGAM FOLDED PRECURSOR RNA, of VGAM562 are further described hereinbelow with reference to Table 1.

Nucleotide sequences of host target binding sites, such as BINDING SITE-I, BINDING SITE-II and BINDING SITE-III of FIG. 1, found on VGAM562 host target RNA, and schematic representation of the complementarity of each of these host target binding sites to VGAM562 RNA, herein designated VGAM RNA, are described hereinbelow with reference to Table 2.

As mentioned hereinabove with reference to FIG. 1, a function of VGAM562 gene, herein designated VGAM is inhibition of expression of VGAM562 target genes. It is appreciated that specific functions, and accordingly utilities, of VGAM562 correlate with, and may be deduced from, the identity of the target genes which VGAM562 binds and inhibits, and the function of these target genes, as elaborated hereinbelow.

BCRP2 (Accession XM_031102) is a VGAM562 host target gene. BCRP2 BINDING SITE is HOST TARGET binding site found in the 3' untranslated region of mRNA encoded by BCRP2, corresponding to a HOST TARGET binding site such as BINDING SITE I, BINDING SITE II or BINDING SITE III. Table 2 illustrates the complementarity of the nucleotide sequences of BCRP2 BINDING SITE, designated SEQ ID:31278, to the nucleotide sequence of VGAM562 RNA, herein designated VGAM RNA, also designated SEQ ID:3273.

A function of VGAM562 is therefore inhibition of BCRP2 (Accession XM_031102). Accordingly, utilities of VGAM562 include diagnosis, prevention and treatment of diseases and clinical conditions associated with BCRP2. Forkhead Box O1A (rhabdomyosarcoma) (FOXO1A, Accession NM_002015) is another VGAM562 host target gene. FOXO1A BINDING SITE is HOST TARGET binding site found in the 3' untranslated region of mRNA encoded by FOXO1A, corresponding to a HOST TARGET binding site such as BINDING SITE I, BINDING SITE II or BINDING SITE III. Table 2 illustrates the complementarity of the nucleotide sequences of FOXO1A BINDING SITE, designated SEQ ID:7757, to the nucleotide sequence of VGAM562 RNA, herein designated VGAM RNA, also designated SEQ ID:3273.

Another function of VGAM562 is therefore inhibition of Forkhead Box O1A (rhabdomyosarcoma) (FOXO1A, Accession NM_002015), a gene which is a probable transcription factor. Accordingly, utilities of VGAM562 include diagnosis, prevention and treatment of diseases and clinical conditions associated with FOXO1A. The function of FOXO1A and its association with various diseases and clinical conditions, has been established by previous studies, as described hereinabove with reference to VGAM228. Interleukin 20 Receptor, Alpha (IL20RA, Accession NM_014432) is another VGAM562 host target gene. IL20RA BINDING SITE is HOST TARGET binding site found in the 3' untranslated region of mRNA encoded by IL20RA, corresponding to a HOST TARGET binding site such as BINDING SITE I, BINDING SITE II or BINDING SITE III. Table 2 illustrates the complementarity of the nucleotide sequences of IL20RA BINDING SITE, designated SEQ ID:15789, to the nucleotide sequence of VGAM562 RNA, herein designated VGAM RNA, also designated SEQ ID:3273.

Another function of VGAM562 is therefore inhibition of Interleukin 20 Receptor, Alpha (IL20RA, Accession NM_014432), a gene which is the receptor for interleukin-20. Accordingly, utilities of VGAM562 include diagnosis, prevention and treatment of diseases and clinical conditions associated with IL20RA. The function of IL20RA and its association with various diseases and clinical conditions, has been established by previous studies, as described hereinabove with reference to VGAM315. TACTILE (Accession NM_005816) is another VGAM562 host target gene. TACTILE BINDING SITE is HOST TARGET binding site found in the 3' untranslated region of mRNA encoded by TACTILE, corresponding to a HOST TARGET binding site such as BINDING SITE I, BINDING SITE II or BINDING SITE III. Table 2 illustrates the complementarity of the nucleotide sequences of TACTILE BINDING SITE, designated SEQ ID:12408, to the nucleotide sequence of VGAM562 RNA, herein designated VGAM RNA, also designated SEQ ID:3273.

Another function of VGAM562 is therefore inhibition of TACTILE (Accession NM_005816). Accordingly, utilities of VGAM562 include diagnosis, prevention and treatment of diseases and clinical conditions associated with TACTILE. FIG. 1 further provides a conceptual description of a novel bioinformatically detected viral gene of the present invention, referred to here as Viral Genomic Address Messenger 563 (VGAM563) viral gene, which modulates expression of respective host target genes thereof, the function and utility of which host target genes is known in the art.

VGAM563 is a novel bioinformatically detected regulatory, non protein coding, viral micro RNA (miRNA) gene. The method by which VGAM563 was detected is described hereinabove with reference to FIGS. 1-8.

VGAM563 gene, herein designated VGAM GENE, is a viral gene contained in the genome of Fowlpox Virus. VGAM563 host target gene, herein designated VGAM HOST TARGET GENE, is a human gene contained in the human genome.

VGAM563 gene encodes a VGAM563 precursor RNA, herein designated VGAM PRECURSOR RNA. Similar to other miRNA genes, and unlike most ordinary genes, VGAM563 precursor RNA does not encode a protein. A nucleotide sequence identical or highly similar to the nucleotide sequence of VGAM563 precursor RNA is designated SEQ ID:549, and is provided hereinbelow with reference to the sequence listing part. Nucleotide sequence SEQ ID:549 is located at position 82125 relative to the genome of Fowlpox Virus.

VGAM563 precursor RNA folds onto itself, forming VGAM563 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM563 folded precursor RNA into VGAM563 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM563 RNA is designated SEQ ID:3274, and is provided hereinbelow with reference to the sequence listing part.

VGAM563 host target gene, herein designated VGAM HOST TARGET GENE, encodes a corresponding messenger RNA, VGAM563 host target RNA, herein designated VGAM HOST TARGET RNA. VGAM563 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM563 RNA, herein designated VGAM RNA, binds complementarily to one or more host target binding sites located in untranslated regions of VGAM563 host target RNA, herein designated VGAM HOST TARGET RNA. This complementary binding is due to the fact that the nucleotide sequence of VGAM563 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM563 RNA, herein designated VGAM RNA, may have a different number of host target binding sites in untranslated regions of a VGAM563 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM563 RNA, herein designated VGAM RNA, to host target binding sites on VGAM563 host target RNA, herein designated VGAM HOST TARGET RNA, such as BINDING SITE I, BINDING SITE II and BINDING SITE III, inhibits translation of VGAM563 host target RNA into VGAM563 host target protein, herein designated VGAM HOST TARGET PROTEIN. VGAM host target protein is therefore outlined by a broken line.

It is appreciated that VGAM563 host target gene, herein designated VGAM HOST TARGET GENE, in fact represents a plurality of VGAM563 host target genes. The mRNA of each one of this plurality of VGAM563 host target genes comprises one or more host target binding sites, each having a nucleotide sequence which is at least partly complementary to VGAM563 RNA, herein designated VGAM RNA, and which when bound by VGAM563 RNA causes inhibition of translation of respective one or more VGAM563 host target proteins.

It is further appreciated by one skilled in the art that the mode of translational inhibition illustrated by FIG. 1 with specific reference to translational inhibition exerted by VGAM563 gene, herein designated VGAM GENE, on one or more VGAM563 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM563 is inhibition of expression of host target genes, as part of a novel viral mechanism of attacking a host. Accordingly, utilities of VGAM563 include diagnosis, prevention and treatment of viral infection by Fowlpox Virus. Specific functions, and accordingly utilities, of VGAM563 correlate with, and may be deduced from, the identity of the host target genes which VGAM563 binds and inhibits, and the function of these host target genes, as elaborated hereinbelow.

Nucleotide sequences of the VGAM563 precursor RNA, herein designated VGAM PRECURSOR RNA, and of the 'diced' VGAM563 RNA, herein designated VGAM RNA, and a schematic representation of the secondary folding of VGAM563 folded precursor RNA, herein designated VGAM FOLDED PRECURSOR RNA, of VGAM563 are further described hereinbelow with reference to Table 1.

Nucleotide sequences of host target binding sites, such as BINDING SITE-I, BINDING SITE-II and BINDING SITE-III of FIG. 1, found on VGAM563 host target RNA, and schematic representation of the complementarity of each of these host target binding sites to VGAM563 RNA, herein designated VGAM RNA, are described hereinbelow with reference to Table 2.

As mentioned hereinabove with reference to FIG. 1, a function of VGAM563 gene, herein designated VGAM is inhibition of expression of VGAM563 target genes. It is appreciated that specific functions, and accordingly utilities, of VGAM563 correlate with, and may be deduced from, the identity of the target genes which VGAM563 binds and inhibits, and the function of these target genes, as elaborated hereinbelow.

Nuclear Receptor Subfamily 2, Group F, Member 2 (NR2F2, Accession NM_021005) is a VGAM563 host target gene. NR2F2 BINDING SITE is HOST TARGET binding site found in the 5' untranslated region of mRNA encoded by NR2F2, corresponding to a HOST TARGET binding site such as BINDING SITE I, BINDING SITE II or BINDING SITE III. Table 2 illustrates the complementarity of the nucleotide sequences of NR2F2 BINDING SITE, designated SEQ ID:22001, to the nucleotide sequence of VGAM563 RNA, herein designated VGAM RNA, also designated SEQ ID:3274.

A function of VGAM563 is therefore inhibition of Nuclear Receptor Subfamily 2, Group F, Member 2 (NR2F2, Accession NM_021005), a gene which is the regulation of the apolipoprotein ai gene transcription. Accordingly, utilities of VGAM563 include diagnosis, prevention and treatment of diseases and clinical conditions associated with NR2F2. The function of NR2F2 has been established by previous studies. Hepatocyte-specific expression of the human apolipoprotein A-I gene (OMIM Ref. No. 107680) is dependent on synergistic actions between nuclear proteins bound to distinct sites within a liver-specific enhancer located upstream of the APOA1 transcription start site (Widom et al., 1991). From analysis of the cDNA-derived amino acid sequence, Ladias and Karathanasis (1991) found that one of these proteins, apolipoprotein regulatory protein I, is a novel member of the steroid/thyroid nuclear receptor of ligand-dependent transcription factors. Using a 3.9-kb fragment, Modi et al. (1991) assigned the NR2F2 gene to 15q26.1-q26.2 by Southern analysis of human-rodent somatic cell hybrid DNAs and in situ chromosomal hybridization. Chicken ovalbumin upstream promoter transcription factors (COUP-TFs) are members of the steroid/thyroid hormone receptor superfamily. They are often called orphan receptors, since their ligands have not been identified. COUP-TF homologs have been cloned in many species, from Drosophila to human. The protein sequences are highly homologous across species, suggesting functional conservation. ARP1, also called COUP-TFII, and COUP-TFI (OMIM Ref. No. 132890), were cloned from the human and their genomic organization characterized. Qiu et al. (1995) isolated the mouse genes encoding COUP-TFs I and II and characterized their genomic structures. Both have relatively simple structures similar to those of their human counterparts. Qiu et al. (1995) used interspecific backcross analysis to map Tcfcoup1 to mouse chromosome 13 and Tcfcoup2 to mouse chromosome 7. By isotopic in situ hybridization, they mapped the human counterparts to 5q14 and 15q26, in regions that show homology of synteny between mouse and human. The previous assignment of the so-called ARP1 gene was confirmed.

Full details of the abovementioned studies are described in the following publications, the disclosure of which are hereby incorporated by reference:

Qiu, Y.; Krishnan, V.; Zeng, Z.; Gilbert, D. J.; Copeland, N. G.; Gibson, L.; Yang-Feng, T.; Jenkins, N. A.; Tsai, M.-J.; Tsai, S. Y.: Isolation, characterization, and chromosomal localization of mouse and human COUP-TF I and II genes. Genomics 29:240-246, 1995; and Widom, R. L.; Ladias, J. A. A.; Kouidou, S.; Karathanasis, S. K.: Synergistic interactions between transcription factors control expression of the apolipoprotein AI gene in liver cells.

Further studies establishing the function and utilities of NR2F2 are found in John Hopkins OMIM database record ID 107773, and in sited publications numbered 12069, 12071-12072, 402 and 12073 listed in the bibliography section hereinbelow, which are also hereby incorporated by reference.

FIG. 1 further provides a conceptual description of a novel bioinformatically detected viral gene of the present invention, referred to here as Viral Genomic Address Messenger 564 (VGAM564) viral gene, which modulates expression of respective host target genes thereof, the function and utility of which host target genes is known in the art.

VGAM564 is a novel bioinformatically detected regulatory, non protein coding, viral micro RNA (miRNA) gene. The method by which VGAM564 was detected is described hereinabove with reference to FIGS. 1-8.

VGAM564 gene, herein designated VGAM GENE, is a viral gene contained in the genome of Fowlpox Virus. VGAM564 host target gene, herein designated VGAM HOST TARGET GENE, is a human gene contained in the human genome.

VGAM564 gene encodes a VGAM564 precursor RNA, herein designated VGAM PRECURSOR RNA. Similar to other miRNA genes, and unlike most ordinary genes, VGAM564 precursor RNA does not encode a protein. A nucleotide sequence identical or highly similar to the nucleotide sequence of VGAM564 precursor RNA is designated SEQ ID:550, and is provided hereinbelow with reference to the sequence listing part. Nucleotide sequence SEQ ID:550 is located at position 81158 relative to the genome of Fowlpox Virus.

VGAM564 precursor RNA folds onto itself, forming VGAM564 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM564 folded precursor RNA into VGAM564 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM564 RNA is designated SEQ ID:3275, and is provided hereinbelow with reference to the sequence listing part.

VGAM564 host target gene, herein designated VGAM HOST TARGET GENE, encodes a corresponding messenger RNA, VGAM564 host target RNA, herein designated VGAM HOST TARGET RNA. VGAM564 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM564 RNA, herein designated VGAM RNA, binds complementarily to one or more host target binding sites located in untranslated regions of VGAM564 host target RNA, herein designated VGAM HOST TARGET RNA. This complementary binding is due to the fact that the nucleotide sequence of VGAM564 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM564 RNA, herein designated VGAM RNA, may have a different number of host target binding sites in untranslated regions of a VGAM564 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM564 RNA, herein designated VGAM RNA, to host target binding sites on VGAM564 host target RNA, herein designated VGAM HOST TARGET RNA, such as BINDING SITE I, BINDING SITE II and BINDING SITE III, inhibits translation of VGAM564 host target RNA into VGAM564 host target protein, herein designated VGAM HOST TARGET PROTEIN. VGAM host target protein is therefore outlined by a broken line.

It is appreciated that VGAM564 host target gene, herein designated VGAM HOST TARGET GENE, in fact represents a plurality of VGAM564 host target genes. The mRNA of each one of this plurality of VGAM564 host target genes comprises one or more host target binding sites, each having a nucleotide sequence which is at least partly complementary to VGAM564 RNA, herein designated VGAM RNA, and which when bound by VGAM564 RNA causes inhibition of translation of respective one or more VGAM564 host target proteins.

It is further appreciated by one skilled in the art that the mode of translational inhibition illustrated by FIG. 1 with specific reference to translational inhibition exerted by VGAM564 gene, herein designated VGAM GENE, on one or more VGAM564 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM564 is inhibition of expression of host target genes, as part of a novel viral mechanism of attacking a host. Accordingly, utilities of VGAM564 include diagnosis, prevention and treatment of viral infection by Fowlpox Virus. Specific functions, and accordingly utilities, of VGAM564 correlate with, and may be deduced from, the identity of the host target genes which VGAM564 binds and inhibits, and the function of these host target genes, as elaborated hereinbelow.

Nucleotide sequences of the VGAM564 precursor RNA, herein designated VGAM PRECURSOR RNA, and of the ‘diced’ VGAM564 RNA, herein designated VGAM RNA, and a schematic representation of the secondary folding of VGAM564 folded precursor RNA, herein designated VGAM FOLDED PRECURSOR RNA, of VGAM564 are further described hereinbelow with reference to Table 1.

Nucleotide sequences of host target binding sites, such as BINDING SITE-I, BINDING SITE-II and BINDING SITE-III of FIG. 1, found on VGAM564 host target RNA, and schematic representation of the complementarity of each of these host target binding sites to VGAM564 RNA, herein designated VGAM RNA, are described hereinbelow with reference to Table 2.

As mentioned hereinabove with reference to FIG. 1, a function of VGAM564 gene, herein designated VGAM is inhibition of expression of VGAM564 target genes. It is appreciated that specific functions, and accordingly utilities, of VGAM564 correlate with, and may be deduced from, the identity of the target genes which VGAM564 binds and inhibits, and the function of these target genes, as elaborated hereinbelow.

Dedicator of Cyto-kinesis 1 (DOCK1, Accession NM_001380) is a VGAM564 host target gene. DOCK1 BINDING SITE is HOST TARGET binding site found in the 3' untranslated region of mRNA encoded by DOCK1, corresponding to a HOST TARGET binding site such as BINDING SITE I, BINDING SITE II or BINDING SITE III. Table 2 illustrates the complementarity of the nucleotide sequences of DOCK1 BINDING SITE, designated SEQ ID:7050, to the nucleotide sequence of VGAM564 RNA, herein designated VGAM RNA, also designated SEQ ID:3275.

A function of VGAM564 is therefore inhibition of Dedicator of Cyto-kinesis 1 (DOCK1, Accession NM_001380), a gene which may function in the extension of cell surfaces. Accordingly, utilities of VGAM564 include diagnosis, prevention and treatment of diseases and clinical conditions associated with DOCK1. The function of DOCK1 has been established by previous studies. The CRK protein (OMIM Ref. No. 164762), comprised mostly of SH2 and SH3 src-homology domains, has an important role in signaling from focal adhesions. Along with other adaptor proteins such as GRB2 (OMIM Ref. No. 108355) and NCK (OMIM Ref. No. 600508), it receives signals through its SH2 domains from phosphotyrosine-containing peptides and transfers them to other proteins bound to its SH3 domains. Among proteins that bind to the SH3 domain of CRK are C3G (OMIM Ref. No. 600303), a guanine nucleotide exchange protein for RAP1 (OMIM Ref. No. 600278), and the 180-kD DOCK (downstream of CRK) protein. Hasegawa et al. (1996) isolated a cDNA for DOCK by screening an expression library with CRK SH3. They found a full-length cDNA that encodes a putative 1,866-amino acid polypeptide with an SH3 domain at its amino end. Northern blots showed a 7.6-kb transcript that was expressed in most tissues and most strongly in placenta, lungs, kidney, and pancreas. Wildtype DOCK180 was found in the cytoplasm and did not affect cell morphology. However, when farnesylated, the protein became associated with the cytoplasmic membrane and made spindle 3T3 cells become flattened and polygonal. Takai et al. (1996) mapped DOCK180 to 10q26.13-q26.3 by fluorescence in situ hybridization. During programmed cell death (apoptosis), cell corpses are rapidly engulfed. This engulfment process involves the recognition and subsequent phagocytosis of cell corpses by engulfing cells. Wu and Horvitz (1998) shed light on the previously obscure mechanisms by which cell corpses are engulfed. They reported that ced-5, a gene that is required for cell-corpse engulfment in the nematode Caenorhabditis elegans, encodes a protein that is similar to the human protein DOCK180 and the Drosophila melanogaster protein Myoblast City (MBC), both of which had been implicated in the extension of cell surfaces. C. elegans ced-5 mutants were defective not only in the engulfment of cell corpses but also in the migrations of 2 specific gonadal cells, the distal tip cells. The expression of human DOCK180 in C. elegans rescued the cell-migration defect of a ced-5 mutant. Wu and Horvitz (1998) presented evidence that ced-5 functions in engulfing cells during the engulfment of cell corpses. They suggested that ced-5 acts in the extension of the surface of an engulfing cell around a dying cell during programmed cell death. They named the new family of proteins that function in the extension of cell surfaces the CDM (for CED-5, DOCK180, and MBC) family.

Full details of the abovementioned studies are described in the following publications, the disclosure of which are hereby incorporated by reference:

Savill, J.: Phagocytic docking without shocking. Nature 442-443, 1998; and

Takai, S.; Hasegawa, H.; Kiyokawa, E.; Yamada, K.; Kurata, T.; Matsuda, M.: Chromosomal mapping of the gene encoding DOCK180, a major Crk-binding protein, to 10q26.13-q26.3 by fluoresc.

Further studies establishing the function and utilities of DOCK1 are found in John Hopkins OMIM database record ID 601403, and in sited publications numbered 6497-6500 listed in the bibliography section hereinbelow, which are also hereby incorporated by reference. LOC146452 (Accession XM_085473) is another VGAM564 host target gene. LOC146452 BINDING SITE is HOST TARGET binding site found in the 3' untranslated region of mRNA encoded by LOC146452, corresponding to a HOST TARGET binding site such as BINDING SITE I, BINDING SITE II or BINDING SITE III. Table 2 illustrates the complementarity of the nucleotide sequences of LOC146452 BINDING SITE, designated SEQ ID:38162, to the nucleotide sequence of VGAM564 RNA, herein designated VGAM RNA, also designated SEQ ID:3275.

Another function of VGAM564 is therefore inhibition of LOC146452 (Accession XM_085473). Accordingly, utilities of VGAM564 include diagnosis, prevention and treatment of diseases and clinical conditions associated with LOC146452. FIG. 1 further provides a conceptual description of a novel bioinformatically detected viral gene of the present invention, referred to here as Viral Genomic Address Messenger 565 (VGAM565) viral gene, which modulates expression of respective host target genes thereof, the function and utility of which host target genes is known in the art.

VGAM565 is a novel bioinformatically detected regulatory, non protein coding, viral micro RNA (miRNA) gene. The method by which VGAM565 was detected is described hereinabove with reference to FIGS. 1-8.

VGAM565 gene, herein designated VGAM GENE, is a viral gene contained in the genome of Fowlpox Virus. VGAM565 host target gene, herein designated VGAM HOST TARGET GENE, is a human gene contained in the human genome.

VGAM565 gene encodes a VGAM565 precursor RNA, herein designated VGAM PRECURSOR RNA. Similar to other miRNA genes, and unlike most ordinary genes, VGAM565 precursor RNA does not encode a protein. A nucleotide sequence identical or highly similar to the nucleotide sequence of VGAM565 precursor RNA is designated SEQ ID:551, and is provided hereinbelow with reference to the sequence listing part. Nucleotide sequence SEQ ID:551 is located at position 104297 relative to the genome of Fowlpox Virus.

VGAM565 precursor RNA folds onto itself, forming VGAM565 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM565 folded precursor RNA into VGAM565 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM565 RNA is designated SEQ ID:3276, and is provided hereinbelow with reference to the sequence listing part.

VGAM565 host target gene, herein designated VGAM HOST TARGET GENE, encodes a corresponding messenger RNA, VGAM565 host target RNA, herein designated VGAM HOST TARGET RNA. VGAM565 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM565 RNA, herein designated VGAM RNA, binds complementarily to one or more host target binding sites located in untranslated regions of VGAM565 host target RNA, herein designated VGAM HOST TARGET RNA. This complementary binding is due to the fact that the nucleotide sequence of VGAM565 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM565 RNA, herein designated VGAM RNA, may have a different number of host target binding sites in untranslated regions of a VGAM565 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM565 RNA, herein designated VGAM RNA, to host target binding sites on VGAM565 host target RNA, herein designated VGAM HOST TARGET RNA, such as BINDING SITE I, BINDING SITE II and BINDING SITE III, inhibits translation of VGAM565 host target RNA into VGAM565 host target protein, herein designated VGAM HOST TARGET PROTEIN. VGAM host target protein is therefore outlined by a broken line.

It is appreciated that VGAM565 host target gene, herein designated VGAM HOST TARGET GENE, in fact represents a plurality of VGAM565 host target genes. The mRNA of each one of this plurality of VGAM565 host target genes comprises one or more host target binding sites, each having a nucleotide sequence which is at least partly complementary to VGAM565 RNA, herein designated VGAM RNA, and which when bound by VGAM565 RNA causes inhibition of translation of respective one or more VGAM565 host target proteins.

It is further appreciated by one skilled in the art that the mode of translational inhibition illustrated by FIG. 1 with specific reference to translational inhibition exerted by VGAM565 gene, herein designated VGAM GENE, on one or more VGAM565 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM565 is inhibition of expression of host target genes, as part of a novel viral mechanism of attacking a host. Accordingly, utilities of VGAM565 include diagnosis, prevention and treatment of viral infection by Fowlpox Virus. Specific functions, and accordingly utilities, of VGAM565 correlate with, and may be deduced from, the identity of the host target genes which VGAM565 binds and inhibits, and the function of these host target genes, as elaborated hereinbelow.

Nucleotide sequences of the VGAM565 precursor RNA, herein designated VGAM PRECURSOR RNA, and of the 'diced' VGAM565 RNA, herein designated VGAM RNA, and a schematic representation of the secondary folding of VGAM565 folded precursor RNA, herein designated VGAM FOLDED PRECURSOR RNA, of VGAM565 are further described hereinbelow with reference to Table 1.

Nucleotide sequences of host target binding sites, such as BINDING SITE-I, BINDING SITE-II and BINDING SITE-III of FIG. 1, found on VGAM565 host target RNA, and schematic representation of the complementarity of each of these host target binding sites to VGAM565 RNA, herein designated VGAM RNA, are described hereinbelow with reference to Table 2.

As mentioned hereinabove with reference to FIG. 1, a function of VGAM565 gene, herein designated VGAM is inhibition of expression of VGAM565 target genes. It is appreciated that specific functions, and accordingly utilities, of VGAM565 correlate with, and may be deduced from, the identity of the target genes which VGAM565 binds and inhibits, and the function of these target genes, as elaborated hereinbelow.

Aldehyde Dehydrogenase 1 Family, Member A3 (ALDH1A3, Accession NM_000693) is a VGAM565 host target gene. ALDH1A3 BINDING SITE is HOST TARGET binding site found in the 3' untranslated region of mRNA encoded by ALDH1A3, corresponding to a HOST TARGET binding site such as BINDING SITE I, BINDING SITE II or BINDING SITE III. Table 2 illustrates the complementarity of the nucleotide sequences of ALDH1A3 BINDING SITE, designated SEQ ID:6352, to the nucleotide sequence of VGAM565 RNA, herein designated VGAM RNA, also designated SEQ ID:3276.

A function of VGAM565 is therefore inhibition of Aldehyde Dehydrogenase 1 Family, Member A3 (ALDH1A3, Accession NM_000693), a gene which plays a major role in the detoxification of aldehydes generated by alcohol metabolism and lipid peroxidation. Accordingly, utilities of VGAM565 include diagnosis, prevention and treatment of diseases and clinical conditions associated with ALDH1A3. The function of ALDH1A3 has been established by previous studies. Hsu et al. (1994) identified and characterized the ALDH6 gene. The existence of this unique ALDH isozyme in human saliva and its polymorphism had previously been demonstrated. The ALDH6 cDNA is 3,457 bp long and contains an open reading frame encoding 512 amino acids. The deduced amino acid sequence shows that the protein is larger than human liver ALDH1 (OMIM Ref. No. 100640) by 11 residues at the N terminus, and the degree of identity between the 2 isozymes is 70% with an alignment of 500 amino acid residues. Northern blot analysis demonstrated that the ALDH6 gene is expressed at low levels in many tissues and at higher levels in salivary gland, stomach, and kidney. By in situ hybridization of chick and mouse embryos, Grun et al. (2000) demonstrated expression of Aldh1a3 in the developing sensory neuroepithelia of the eye, nose, and ear, and in discreet sites within the central nervous system. Expression of chick Aldh1a3 in a human choriocarcinoma cell line conferred increased sensitivity to retinol in a retinoic acid receptor (see OMIM Ref. No. 180240)-dependent reporter assay. GENE STRUCTURE Hsu et al. (1994) determined that the ALDH6 gene spans about 37 kb and contains 13 exons. Putative TATA and CCAAT boxes and Sp1 binding sites were found in the 5-prime upstream region of the gene.

Full details of the abovementioned studies are described in the following publications, the disclosure of which are hereby incorporated by reference:

Grun, F.; Hirose, Y.; Kawauchi, S.; Ogura, T.; Umesono, K.: Aldehyde dehydrogenase 6, a cytosolic retinaldehyde dehydrogenase prominently expressed in sensory neuroepithelia during development. J. Biol. Chem. 275:41210-41218, 2000; and Hsu, L. C.; Chang, W.-C.; Hiraoka, L.; Hsieh, C.-L.: Molecular cloning, genomic organization, and chromosomal localization of an additional human aldehyde dehydrogenase gene, ALDH6. G.

Further studies establishing the function and utilities of ALDH1A3 are found in John Hopkins OMIM database record ID 600463, and in sited publications numbered 1613-1614 listed in the bibliography section hereinbelow, which are also hereby incorporated by reference. Glial Fibrillary Acidic Protein (GFAP, Accession NM_002055) is another VGAM565 host target gene. GFAP BINDING SITE is HOST TARGET binding site found in the 3' untranslated region of mRNA encoded by GFAP, corresponding to a HOST TARGET binding site such as BINDING SITE I, BINDING SITE II or BINDING SITE III. Table 2 illustrates the complementarity of the nucleotide sequences of GFAP BINDING SITE, designated SEQ ID:7816, to the nucleotide sequence of VGAM565 RNA, herein designated VGAM RNA, also designated SEQ ID:3276.

Another function of VGAM565 is therefore inhibition of Glial Fibrillary Acidic Protein (GFAP, Accession NM_002055). Accordingly, utilities of VGAM565 include diagnosis, prevention and treatment of diseases and clinical conditions associated with GFAP. Protein Phosphatase 2, Regulatory Subunit B (B56), Epsilon Isoform (PPP2R5E, Accession NM_006246) is another VGAM565 host target gene. PPP2R5E BINDING SITE is HOST TARGET binding site found in the 3' untranslated region of mRNA encoded by PPP2R5E, corresponding to a HOST TARGET binding site such as BINDING SITE I, BINDING SITE II or BINDING SITE III. Table 2 illustrates the complementarity of the nucleotide sequences of PPP2R5E BINDING SITE, designated SEQ ID:12920, to the nucleotide sequence of VGAM565 RNA, herein designated VGAM RNA, also designated SEQ ID:3276.

Another function of VGAM565 is therefore inhibition of Protein Phosphatase 2, Regulatory Subunit B (B56), Epsilon Isoform (PPP2R5E, Accession NM_006246), a gene which is a regulatory subunit of protein phosphatase 2A. Accordingly, utilities of VGAM565 include diagnosis, prevention and treatment of diseases and clinical conditions associated with PPP2R5E. The function of PPP2R5E and its association with various diseases and clinical conditions, has been established by previous studies, as described hereinabove with reference to VGAM302. Prolactin Regulatory Element Binding (PREB, Accession NM_013388) is another VGAM565 host target gene. PREB BINDING SITE is HOST TARGET binding site found in the 3' untranslated region of mRNA encoded by PREB, corresponding to a HOST TARGET binding site such as BINDING SITE I, BINDING SITE II or BINDING SITE III. Table 2 illustrates the complementarity of the nucleotide sequences of PREB BINDING SITE, designated SEQ ID:15038, to the nucleotide sequence of VGAM565 RNA, herein designated VGAM RNA, also designated SEQ ID:3276.

Another function of VGAM565 is therefore inhibition of Prolactin Regulatory Element Binding (PREB, Accession NM_013388), a gene which is a WD motif DNA-binding protein and involved in transcriptional regulation. Accordingly, utilities of VGAM565 include diagnosis, prevention and treatment of diseases and clinical conditions associated with PREB. The function of PREB has been established by previous studies. Fliss et al. (1999) isolated a rat cDNA encoding Preb, a WD motif DNA-binding protein with the capacity to regulate prolactin (PRL; 176760) promoter activity. Northern blot analysis of human tissues using a rat Preb cDNA probe showed expression of a 2.2-kb transcript in heart, brain, placenta, liver, skeletal muscle, kidney, and pancreas; a 1.9-kb transcript in brain, placenta, and lung; and a 1.5-kb transcript heart, skeletal muscle, and pancreas. By screening a fetal brain cDNA library with a rat Preb probe, followed by 5-prime primer walking, Taylor Clelland et al. (2000) isolated a cDNA encoding human PREB. The deduced 417-amino acid protein, which is 89% identical to the rat protein, has 3 conserved WD repeats and 2 conserved pro-gln-rich regions. RNA dot blot analysis detected variable expression of PREB in all adult and fetal tissues. They proposed that PREB is a DNA-binding factor during mammalian development and that abnormal dosage may play a role in some of the phenotypic abnormalities observed in the partial trisomy 2p syndrome, which is characterized by a number of congenital defects, including genital abnormalities.

Full details of the abovementioned studies are described in the following publications, the disclosure of which are hereby incorporated by reference:

Fliss, M. S.; Hinkle, P. M.; Bancroft, C.: Expression cloning and characterization of PREB (prolactin regulatory element binding), a novel WD motif DNA-binding protein with a capacity to regulate prolactin promoter activity. Molec. Endocr. 13: 644-657, 1999; and Taylor Clelland, C. L.; Levy, B.; McKie, J. M.; Duncan, A. M. V.; Hirschhorn, K.; Bancroft, C.: Cloning and characterization of human PREB; a gene that maps to a genomic region associ.

Further studies establishing the function and utilities of PREB are found in John Hopkins OMIM database record ID 606395, and in sited publications numbered 6795-6796 listed in the bibliography section hereinbelow, which are also hereby incorporated by reference. Zinc Finger Protein 24 (KOX 17) (ZNF24, Accession NM_006965) is another VGAM565 host target gene. ZNF24 BINDING SITE is HOST TARGET binding site found in the 3' untranslated region of mRNA encoded by ZNF24, corresponding to a HOST TARGET binding site such as BINDING SITE I, BINDING SITE II or BINDING SITE III. Table 2 illustrates the complementarity of the nucleotide sequences of ZNF24 BINDING SITE, designated SEQ ID:13838, to the nucleotide sequence of VGAM565 RNA, herein designated VGAM RNA, also designated SEQ ID:3276.

Another function of VGAM565 is therefore inhibition of Zinc Finger Protein 24 (KOX 17) (ZNF24, Accession NM_006965). Accordingly, utilities of VGAM565 include diagnosis, prevention and treatment of diseases and clinical conditions associated with ZNF24. FLJ22028 (Accession NM_024854) is another VGAM565 host target gene. FLJ22028 BINDING SITE is HOST TARGET binding site found in the 3' untranslated region of mRNA encoded by FLJ22028, corresponding to a HOST TARGET binding site such as BINDING SITE I, BINDING SITE II or BINDING SITE III. Table 2 illustrates the complementarity of the nucleotide sequences of FLJ22028 BINDING SITE, designated SEQ ID:24286, to the nucleotide sequence of VGAM565 RNA, herein designated VGAM RNA, also designated SEQ ID:3276.

Another function of VGAM565 is therefore inhibition of FLJ22028 (Accession NM_024854). Accordingly, utilities of VGAM565 include diagnosis, prevention and treatment of diseases and clinical conditions associated with FLJ22028. KIAA0626 (Accession NM_021647) is another VGAM565 host target gene. KIAA0626 BINDING SITE is HOST TARGET binding site found in the 3' untranslated region of mRNA encoded by KIAA0626, corresponding to a HOST TARGET binding site such as BINDING SITE I, BINDING SITE II or BINDING SITE III. Table 2 illustrates the complementarity of the nucleotide sequences of KIAA0626 BINDING SITE, designated SEQ ID:22315, to the nucleotide sequence of VGAM565 RNA, herein designated VGAM RNA, also designated SEQ ID:3276.

Another function of VGAM565 is therefore inhibition of KIAA0626 (Accession NM_021647). Accordingly, utilities of VGAM565 include diagnosis, prevention and treatment of diseases and clinical conditions associated with KIAA0626. KIAA0794 (Accession XM_087353) is another VGAM565 host target gene. KIAA0794 BINDING SITE is HOST TARGET binding site found in the 3' untranslated region of mRNA encoded by KIAA0794, corresponding to a HOST TARGET binding site such as BINDING SITE I, BINDING SITE II or BINDING SITE III. Table 2 illustrates the complementarity of the nucleotide sequences of KIAA0794 BINDING SITE, designated SEQ ID:39184, to the nucleotide sequence of VGAM565 RNA, herein designated VGAM RNA, also designated SEQ ID:3276.

Another function of VGAM565 is therefore inhibition of KIAA0794 (Accession XM_087353). Accordingly, utilities of VGAM565 include diagnosis, prevention and treatment of diseases and clinical conditions associated with KIAA0794. LOC157421 (Accession XM_098756) is another VGAM565 host target gene. LOC157421 BINDING SITE is HOST TARGET binding site found in the 5' untranslated region of mRNA encoded by LOC157421, corresponding to a HOST TARGET binding site such as BINDING SITE I, BINDING SITE II or BINDING SITE III. Table 2 illustrates the complementarity of the nucleotide sequences of LOC157421 BINDING SITE, designated SEQ ID:41793, to the nucleotide sequence of VGAM565 RNA, herein designated VGAM RNA, also designated SEQ ID:3276.

Another function of VGAM565 is therefore inhibition of LOC157421 (Accession XM_098756). Accordingly, utilities of VGAM565 include diagnosis, prevention and treatment of diseases and clinical conditions associated with LOC157421. LOC257048 (Accession XM_171240) is another VGAM565 host target gene. LOC257048 BINDING SITE is HOST TARGET binding site found in the 3' untranslated region of mRNA encoded by LOC257048, corresponding to a HOST TARGET binding site such as BINDING SITE I, BINDING SITE II or BINDING SITE III. Table 2 illustrates the complementarity of the nucleotide sequences of LOC257048 BINDING SITE, designated SEQ ID:46027, to the nucleotide sequence of VGAM565 RNA, herein designated VGAM RNA, also designated SEQ ID:3276.

Another function of VGAM565 is therefore inhibition of LOC257048 (Accession XM_171240). Accordingly, utilities of VGAM565 include diagnosis, prevention and treatment of diseases and clinical conditions associated with LOC257048. LOC84549 (Accession NM_032509) is another VGAM565 host target gene. LOC84549 BINDING SITE is HOST TARGET binding site found in the 3' untranslated region of mRNA encoded by LOC84549, corresponding to a HOST TARGET binding site such as BINDING SITE I, BINDING SITE II or BINDING SITE III. Table 2 illustrates the complementarity of the nucleotide sequences of LOC84549 BINDING SITE, designated SEQ ID:26255, to the nucleotide sequence of VGAM565 RNA, herein designated VGAM RNA, also designated SEQ ID:3276.

Another function of VGAM565 is therefore inhibition of LOC84549 (Accession NM_032509). Accordingly, utilities of VGAM565 include diagnosis, prevention and treatment of diseases and clinical conditions associated with LOC84549. FIG. 1 further provides a conceptual description of a novel bioinformatically detected viral gene of the present invention, referred to here as Viral Genomic Address Messenger 566 (VGAM566) viral gene, which modulates expression of respective host target genes thereof, the function and utility of which host target genes is known in the art.

VGAM566 is a novel bioinformatically detected regulatory, non protein coding, viral micro RNA (miRNA) gene. The method by which VGAM566 was detected is described hereinabove with reference to FIGS. 1-8.

VGAM566 gene, herein designated VGAM GENE, is a viral gene contained in the genome of Fowlpox Virus. VGAM566 host target gene, herein designated VGAM HOST TARGET GENE, is a human gene contained in the human genome.

VGAM566 gene encodes a VGAM566 precursor RNA, herein designated VGAM PRECURSOR RNA. Similar to other miRNA genes, and unlike most ordinary genes, VGAM566 precursor RNA does not encode a protein. A nucleotide sequence identical or highly similar to the nucleotide sequence of VGAM566 precursor RNA is designated SEQ ID:552, and is provided hereinbelow with reference to the sequence listing part. Nucleotide sequence SEQ ID:552 is located at position 101053 relative to the genome of Fowlpox Virus.

VGAM566 precursor RNA folds onto itself, forming VGAM566 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM566 folded precursor RNA into VGAM566 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM566 RNA is designated SEQ ID:3277, and is provided hereinbelow with reference to the sequence listing part.

VGAM566 host target gene, herein designated VGAM HOST TARGET GENE, encodes a corresponding messenger RNA, VGAM566 host target RNA, herein designated VGAM HOST TARGET RNA. VGAM566 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM566 RNA, herein designated VGAM RNA, binds complementarily to one or more host target binding sites located in untranslated regions of VGAM566 host target RNA, herein designated VGAM HOST TARGET RNA. This complementary binding is due to the fact that the nucleotide sequence of VGAM566 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM566 RNA, herein designated VGAM RNA, may have a different number of host target binding sites in untranslated regions of a VGAM566 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM566 RNA, herein designated VGAM RNA, to host target binding sites on VGAM566 host target RNA, herein designated VGAM HOST TARGET RNA, such as BINDING SITE I, BINDING SITE II and BINDING SITE III, inhibits translation of VGAM566 host target RNA into VGAM566 host target protein, herein designated VGAM HOST TARGET PROTEIN. VGAM host target protein is therefore outlined by a broken line.

It is appreciated that VGAM566 host target gene, herein designated VGAM HOST TARGET GENE, in fact represents a plurality of VGAM566 host target genes. The mRNA of each one of this plurality of VGAM566 host target genes comprises one or more host target binding sites, each having a nucleotide sequence which is at least partly complementary to VGAM566 RNA, herein designated VGAM RNA, and which when bound by VGAM566 RNA causes inhibition of translation of respective one or more VGAM566 host target proteins.

It is further appreciated by one skilled in the art that the mode of translational inhibition illustrated by FIG. 1 with specific reference to translational inhibition exerted by VGAM566 gene, herein designated VGAM GENE, on one or more VGAM566 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM566 is inhibition of expression of host target genes, as part of a novel viral mechanism of attacking a host. Accordingly, utilities of VGAM566 include diagnosis, prevention and treatment of viral infection by Fowlpox Virus. Specific functions, and accordingly utilities, of VGAM566 correlate with, and may be deduced from, the identity of the host target genes which VGAM566 binds and inhibits, and the function of these host target genes, as elaborated hereinbelow.

Nucleotide sequences of the VGAM566 precursor RNA, herein designated VGAM PRECURSOR RNA, and of the 'diced' VGAM566 RNA, herein designated VGAM RNA, and a schematic representation of the secondary folding of VGAM566 folded precursor RNA, herein designated VGAM FOLDED PRECURSOR RNA, of VGAM566 are further described hereinbelow with reference to Table 1.

Nucleotide sequences of host target binding sites, such as BINDING SITE-I, BINDING SITE-II and BINDING SITE-III of FIG. 1, found on VGAM566 host target RNA, and schematic representation of the complementarity of each of these host target binding sites to VGAM566 RNA, herein designated VGAM RNA, are described hereinbelow with reference to Table 2.

As mentioned hereinabove with reference to FIG. 1, a function of VGAM566 gene, herein designated VGAM is inhibition of expression of VGAM566 target genes. It is appreciated that specific functions, and accordingly utilities, of VGAM566 correlate with, and may be deduced from, the identity of the target genes which VGAM566 binds and inhibits, and the function of these target genes, as elaborated hereinbelow.

Cytochrome P450, 51 (lanosterol 14-alpha-demethylase) (CYP51, Accession NM_000786) is a VGAM566 host target gene. CYP51 BINDING SITE is HOST TARGET binding site found in the 3' untranslated region of mRNA encoded by CYP51, corresponding to a HOST TARGET binding site such as BINDING SITE I, BINDING SITE II or BINDING SITE III. Table 2 illustrates the complementarity of the nucleotide sequences of CYP51 BINDING SITE, designated SEQ ID:6435, to the nucleotide sequence of VGAM566 RNA, herein designated VGAM RNA, also designated SEQ ID:3277.

A function of VGAM566 is therefore inhibition of Cytochrome P450, 51 (lanosterol 14-alpha-demethylase) (CYP51, Accession NM_000786). Accordingly, utilities of VGAM566 include diagnosis, prevention and treatment of diseases and clinical conditions associated with CYP51. Mannan-binding Lectin Serine Protease 1 (C4/C2 activating component of Ra-reactive factor) (MASP1, Accession NM_139125) is another VGAM566 host target gene. MASP1 BINDING SITE is HOST TARGET binding site found in the 3' untranslated region of mRNA encoded by MASP1, corresponding to a HOST TARGET binding site such as BINDING SITE I, BINDING SITE II or BINDING SITE III. Table 2 illustrates the complementarity of the nucleotide sequences of MASP1 BINDING SITE, designated SEQ ID:29157, to the nucleotide sequence of VGAM566 RNA, herein designated VGAM RNA, also designated SEQ ID:3277.

Another function of VGAM566 is therefore inhibition of Mannan-binding Lectin Serine Protease 1 (C4/C2 activating component of Ra-reactive factor) (MASP1, Accession NM_139125), a gene which a complement-dependent bactericidal factor. Accordingly, utilities of VGAM566 include diagnosis, prevention and treatment of diseases and clinical conditions associated with MASP1. The function of MASP1 has been established by previous studies. The Ra-reactive factor (RARF) is a complement-dependent bactericidal factor that binds to the Ra and R2 polysaccharides expressed by certain enterobacteria. RARF activity is found in the sera of a diverse group of vertebrates, suggesting that it is an evolutionarily conserved mechanism to resist infection by these bacterial strains. RARF includes a 100-kD component, CRARF, also called MASP1 or p100, that was thought to activate the complement components C4 (C4F, 120820; C4S, 120810), C2 (OMIM Ref. No. 217000), and C3 (OMIM Ref. No. 120700). Subsequent work, however, separated MASP1 from MASP2 (OMIM Ref. No. 605102) and showed that MASP1 activates C3 and C2, whereas MASP2 activates C4 and C2. The other component of RARF is mannan-binding lectin (OMIM Ref. No. 154545), a plasma protein member of the complement system that binds to microbial carbohydrates and activates the MASPs. The MASPs then recruit C4 and C2 to generate the C3 convertase or directly activate C3. Takada et al. (1993) cloned a partial human CRARF cDNA from a liver library. The human CRARF amino acid sequence is similar to the human complement subcomponents C1R (OMIM Ref. No. 216950) and C1S (OMIM Ref. No. 120580). Takada et al. (1995) obtained a corresponding mouse cDNA. By RT-PCR with primers based on N-terminal peptide sequence analysis and the consensus sequence of serine proteases, followed by screening a fetal liver cDNA library, Sato et al. (1994) isolated a cDNA encoding MASP. Sequence analysis predicted that the 699-amino acid protein contains a leader peptide; 2 structural domains similar to those of C1R and C1S; an EGF-like domain thought to be related to calcium-binding activity; 2 short consensus repeat domains; and a serine protease domain. Northern blot analysis revealed expression of 4.8- and 3.4-kb MASP transcripts in fetal liver; no expression was detected in adult tissues or in fetal heart, brain, lung, or kidney. Sato et al. (1994) proposed that the MBL-MASP complex is a novel activator of complement in what they designated the lectin pathway. By biochemical purification of plasma proteins and immunoblot analysis, Dahl et al. (2001) detected a 42-kD serine protease associated with MBL. They identified a cDNA encoding this protein, MASP3, which is generated by alternative splicing of MASP1. The MASP3 transcription product is composed of an A chain, which is common to both MASP1 and MASP3, and a B chain, which is unique to MASP3. The deduced 728-amino acid MASP3 protein has a signal peptide, 3 N-glycosylation sites on the B chain and 4 on the A chain. Sato et al. (1994) mapped the MASP1 gene to 3q27-q28 by FISH. Using FISH, Takada et al. (1995) mapped the human CRARF gene to 3q27-q28 and the mouse gene to 16B2-B3, regions thought to share homology of synteny.

Full details of the abovementioned studies are described in the following publications, the disclosure of which are hereby incorporated by reference:

Dahl, M. R.; Thiel, S.; Matsushita, M.; Fujita, T.; Willis, A. C.; Christensen, T.; Vorup-Jensen, T.; Jensenius, J. C.: MASP-3 and its association with distinct complexes of the mannan-binding lectin complement activation pathway. Immunity 15:127-135, 2001; and Takada, F.; Seki, N.; Matsuda, Y.; Takayama, Y.; Kawakami, M.: Localization of the genes for the 100-kDa complement-activating components of Ra-reactive factor (CRARF and Crarf) to hum.

Further studies establishing the function and utilities of MASP1 are found in John Hopkins OMIM database record ID 600521, and in sited publications numbered 7504-7510 listed in the bibliography section hereinbelow, which are also hereby incorporated by reference. Protein Kinase, Lysine Deficient 3 (PRKWNK3, Accession XM_029183) is another VGAM566 host target gene. PRKWNK3 BINDING SITE is HOST TARGET binding site found in the 3' untranslated region of mRNA encoded by PRKWNK3, corresponding to a HOST TARGET binding site such as BINDING SITE I, BINDING SITE II or BINDING SITE III. Table 2 illustrates the complementarity of the nucleotide sequences of PRKWNK3 BINDING SITE, designated SEQ ID:30854, to the nucleotide sequence of VGAM566 RNA, herein designated VGAM RNA, also designated SEQ ID:3277.

Another function of VGAM566 is therefore inhibition of Protein Kinase, Lysine Deficient 3 (PRKWNK3, Accession XM_029183). Accordingly, utilities of VGAM566 include diagnosis, prevention and treatment of diseases and clinical conditions associated with PRKWNK3. FLJ10199 (Accession XM_048840) is another VGAM566 host target gene. FLJ10199 BINDING SITE is HOST TARGET binding site found in the 3' untranslated region of mRNA encoded by FLJ10199, corresponding to a HOST TARGET binding site such as BINDING SITE I, BINDING SITE II or BINDING SITE III. Table 2 illustrates the complementarity of the nucleotide sequences of FLJ10199 BINDING SITE, designated SEQ ID:35284, to the nucleotide sequence of VGAM566 RNA, herein designated VGAM RNA, also designated SEQ ID:3277.

Another function of VGAM566 is therefore inhibition of FLJ10199 (Accession XM_048840). Accordingly, utilities of VGAM566 include diagnosis, prevention and treatment of diseases and clinical conditions associated with FLJ10199. KIAA0981 (Accession XM_028867) is another VGAM566 host target gene. KIAA0981 BINDING SITE is HOST TARGET binding site found in the 3' untranslated region of mRNA encoded by KIAA0981, corresponding to a HOST TARGET binding site such as BINDING SITE I, BINDING SITE II or BINDING SITE III. Table 2 illustrates the complementarity of the nucleotide sequences of KIAA0981 BINDING SITE, designated SEQ ID:30794, to the nucleotide sequence of VGAM566 RNA, herein designated VGAM RNA, also designated SEQ ID:3277.

Another function of VGAM566 is therefore inhibition of KIAA0981 (Accession XM_028867). Accordingly, utilities of VGAM566 include diagnosis, prevention and treatment of diseases and clinical conditions associated with KIAA0981. MGC4832 (Accession NM_145061) is another VGAM566 host target gene. MGC4832 BINDING SITE is HOST TARGET binding site found in the 3' untranslated region of mRNA encoded by MGC4832, corresponding to a HOST TARGET binding site such as BINDING SITE I, BINDING SITE II or BINDING SITE III. Table 2 illustrates the complementarity of the nucleotide sequences of MGC4832 BINDING SITE, designated SEQ ID:29697, to the nucleotide sequence of VGAM566 RNA, herein designated VGAM RNA, also designated SEQ ID:3277.

Another function of VGAM566 is therefore inhibition of MGC4832 (Accession NM_145061). Accordingly, utilities of VGAM566 include diagnosis, prevention and treatment of diseases and clinical conditions associated with MGC4832. Ubiquitin-conjugating Enzyme E2D 1 (UBC4/5 homolog, yeast) (UBE2D1, Accession NM_003338) is another VGAM566 host target gene. UBE2D1 BINDING SITE is HOST TARGET binding site found in the 3' untranslated region of mRNA encoded by UBE2D1, corresponding to a HOST TARGET binding site such as BINDING SITE I, BINDING SITE II or BINDING SITE III. Table 2 illustrates the complementarity of the nucleotide sequences of UBE2D1 BINDING SITE, designated SEQ ID:9345, to the nucleotide sequence of VGAM566 RNA, herein designated VGAM RNA, also designated SEQ ID:3277.

Another function of VGAM566 is therefore inhibition of Ubiquitin-conjugating Enzyme E2D 1 (UBC4/5 homolog, yeast) (UBE2D1, Accession NM_003338). Accordingly, utilities of VGAM566 include diagnosis, prevention and treatment of diseases and clinical conditions associated with UBE2D1. ZFP106 (Accession NM_022473) is another VGAM566 host target gene. ZFP106 BINDING SITE is HOST TARGET binding site found in the 3' untranslated region of mRNA encoded by ZFP106, corresponding to a HOST TARGET binding site such as BINDING SITE I, BINDING SITE II or BINDING SITE III. Table 2 illustrates the complementarity of the nucleotide sequences of ZFP106 BINDING SITE, designated SEQ ID:22828, to the nucleotide sequence of VGAM566 RNA, herein designated VGAM RNA, also designated SEQ ID:3277.

Another function of VGAM566 is therefore inhibition of ZFP106 (Accession NM_022473). Accordingly, utilities of VGAM566 include diagnosis, prevention and treatment of diseases and clinical conditions associated with ZFP106. LOC145739 (Accession XM_085222) is another VGAM566 host target gene. LOC145739 BINDING SITE is HOST TARGET binding site found in the 3' untranslated region of mRNA encoded by LOC145739, corresponding to a HOST TARGET binding site such as BINDING SITE I, BINDING SITE II or BINDING SITE III. Table 2 illustrates the complementarity of the nucleotide sequences of LOC145739 BINDING SITE, designated SEQ ID:37966, to the nucleotide sequence of VGAM566 RNA, herein designated VGAM RNA, also designated SEQ ID:3277.

Another function of VGAM566 is therefore inhibition of LOC145739 (Accession XM_085222). Accordingly, utilities of VGAM566 include diagnosis, prevention and treatment of diseases and clinical conditions associated with LOC145739. LOC147990 (Accession XM_097358) is another VGAM566 host target gene. LOC147990 BINDING SITE is HOST TARGET binding site found in the 3' untranslated region of mRNA encoded by LOC147990, corresponding to a HOST TARGET binding site such as BINDING SITE I, BINDING SITE II or BINDING SITE III. Table 2 illustrates the complementarity of the nucleotide sequences of LOC147990 BINDING SITE, designated SEQ ID:40862, to the nucleotide sequence of VGAM566 RNA, herein designated VGAM RNA, also designated SEQ ID:3277.

Another function of VGAM566 is therefore inhibition of LOC147990 (Accession XM_097358). Accordingly, utilities of VGAM566 include diagnosis, prevention and treatment of diseases and clinical conditions associated with LOC147990. LOC162239 (Accession XM_091439) is another VGAM566 host target gene. LOC162239 BINDING SITE is HOST TARGET binding site found in the 3' untranslated region of mRNA encoded by LOC162239, corresponding to a HOST TARGET binding site such as BINDING SITE I, BINDING SITE II or BINDING SITE III. Table 2 illustrates the complementarity of the nucleotide sequences of LOC162239 BINDING SITE, designated SEQ ID:40049, to the nucleotide sequence of VGAM566 RNA, herein designated VGAM RNA, also designated SEQ ID:3277.

Another function of VGAM566 is therefore inhibition of LOC162239 (Accession XM_091439). Accordingly, utilities of VGAM566 include diagnosis, prevention and treatment of diseases and clinical conditions associated with LOC162239. LOC221395 (Accession XM_166354) is another VGAM566 host target gene. LOC221395 BINDING SITE is HOST TARGET binding site found in the 3' untranslated region of mRNA encoded by LOC221395, corresponding to a HOST TARGET binding site such as BINDING SITE I, BINDING SITE II or BINDING SITE III. Table 2 illustrates the complementarity of the nucleotide sequences of LOC221395 BINDING SITE, designated SEQ ID:44182, to the nucleotide sequence of VGAM566 RNA, herein designated VGAM RNA, also designated SEQ ID:3277.

Another function of VGAM566 is therefore inhibition of LOC221395 (Accession XM_166354). Accordingly, utilities of VGAM566 include diagnosis, prevention and treatment of diseases and clinical conditions associated with LOC221395. LOC254778 (Accession XM_171193) is another VGAM566 host target gene. LOC254778 BINDING SITE is HOST TARGET binding site found in the 3' untranslated region of mRNA encoded by LOC254778, corresponding to a HOST TARGET binding site such as BINDING SITE I, BINDING SITE II or BINDING SITE III. Table 2 illustrates the complementarity of the nucleotide sequences of LOC254778 BINDING SITE, designated SEQ ID:45975, to the nucleotide sequence of VGAM566 RNA, herein designated VGAM RNA, also designated SEQ ID:3277.

Another function of VGAM566 is therefore inhibition of LOC254778 (Accession XM_171193). Accordingly, utilities of VGAM566 include diagnosis, prevention and treatment of diseases and clinical conditions associated with LOC254778. LOC51026 (Accession NM_016072) is another VGAM566 host target gene. LOC51026 BINDING SITE is HOST TARGET binding site found in the 3' untranslated region of mRNA encoded by LOC51026, corresponding to a HOST TARGET binding site such as BINDING SITE I, BINDING SITE II or BINDING SITE III. Table 2 illustrates the complementarity of the nucleotide sequences of LOC51026 BINDING SITE, designated SEQ ID:18139, to the nucleotide sequence of VGAM566 RNA, herein designated VGAM RNA, also designated SEQ ID:3277.

Another function of VGAM566 is therefore inhibition of LOC51026 (Accession NM_016072). Accordingly, utilities of VGAM566 include diagnosis, prevention and treatment of diseases and clinical conditions associated with LOC51026. FIG. 1 further provides a conceptual description of a novel bioinformatically detected viral gene of the present invention, referred to here as Viral Genomic Address Messenger 567 (VGAM567) viral gene, which modulates expression of respective host target genes thereof, the function and utility of which host target genes is known in the art.

VGAM567 is a novel bioinformatically detected regulatory, non protein coding, viral micro RNA (miRNA) gene. The method by which VGAM567 was detected is described hereinabove with reference to FIGS. 1-8.

VGAM567 gene, herein designated VGAM GENE, is a viral gene contained in the genome of Fowlpox Virus. VGAM567 host target gene, herein designated VGAM HOST TARGET GENE, is a human gene contained in the human genome.

VGAM567 gene encodes a VGAM567 precursor RNA, herein designated VGAM PRECURSOR RNA. Similar to other miRNA genes, and unlike most ordinary genes, VGAM567 precursor RNA does not encode a protein. A nucleotide sequence identical or highly similar to the nucleotide sequence of VGAM567 precursor RNA is designated SEQ ID:553, and is provided hereinbelow with reference to the sequence listing part. Nucleotide sequence SEQ ID:553 is located at position 126386 relative to the genome of Fowlpox Virus.

VGAM567 precursor RNA folds onto itself, forming VGAM567 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM567 folded precursor RNA into VGAM567 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM567 RNA is designated SEQ ID:3278, and is provided hereinbelow with reference to the sequence listing part.

VGAM567 host target gene, herein designated VGAM HOST TARGET GENE, encodes a corresponding messenger RNA, VGAM567 host target RNA, herein designated VGAM HOST TARGET RNA. VGAM567 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM567 RNA, herein designated VGAM RNA, binds complementarily to one or more host target binding sites located in untranslated regions of VGAM567 host target RNA, herein designated VGAM HOST TARGET RNA. This complementary binding is due to the fact that the nucleotide sequence of VGAM567 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM567 RNA, herein designated VGAM RNA, may have a different number of host target binding sites in untranslated regions of a VGAM567 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM567 RNA, herein designated VGAM RNA, to host target binding sites on VGAM567 host target RNA, herein designated VGAM HOST TARGET RNA, such as BINDING SITE I, BINDING SITE II and BINDING SITE III, inhibits translation of VGAM567 host target RNA into VGAM567 host target protein, herein designated VGAM HOST TARGET PROTEIN. VGAM host target protein is therefore outlined by a broken line.

It is appreciated that VGAM567 host target gene, herein designated VGAM HOST TARGET GENE, in fact represents a plurality of VGAM567 host target genes. The mRNA of each one of this plurality of VGAM567 host target genes comprises one or more host target binding sites, each having a nucleotide sequence which is at least partly complementary to VGAM567 RNA, herein designated VGAM RNA, and which when bound by VGAM567 RNA causes inhibition of translation of respective one or more VGAM567 host target proteins.

It is further appreciated by one skilled in the art that the mode of translational inhibition illustrated by FIG. 1 with specific reference to translational inhibition exerted by VGAM567 gene, herein designated VGAM GENE, on one or more VGAM567 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM567 is inhibition of expression of host target genes, as part of a novel viral mechanism of attacking a host. Accordingly, utilities of VGAM567 include diagnosis, prevention and treatment of viral infection by Fowlpox Virus. Specific functions, and accordingly utilities, of VGAM567 correlate with, and may be deduced from, the identity of the host target genes which VGAM567 binds and inhibits, and the function of these host target genes, as elaborated hereinbelow.

Nucleotide sequences of the VGAM567 precursor RNA, herein designated VGAM PRECURSOR RNA, and of the 'diced' VGAM567 RNA, herein designated VGAM RNA, and a schematic representation of the secondary folding of VGAM567 folded precursor RNA, herein designated VGAM FOLDED PRECURSOR RNA, of VGAM567 are further described hereinbelow with reference to Table 1.

Nucleotide sequences of host target binding sites, such as BINDING SITE-I, BINDING SITE-II and BINDING SITE-III of FIG. 1, found on VGAM567 host target RNA, and schematic representation of the complementarity of each of these host target binding sites to VGAM567 RNA, herein designated VGAM RNA, are described hereinbelow with reference to Table 2.

As mentioned hereinabove with reference to FIG. 1, a function of VGAM567 gene, herein designated VGAM is inhibition of expression of VGAM567 target genes. It is appreciated that specific functions, and accordingly utilities, of VGAM567 correlate with, and may be deduced from, the identity of the target genes which VGAM567 binds and inhibits, and the function of these target genes, as elaborated hereinbelow.

ATPase, Na+/K+ Transporting, Alpha 2 (+) Polypeptide (ATP1A2, Accession NM_000702) is a VGAM567 host target gene. ATP1A2 BINDING SITE is HOST TARGET binding site found in the 3' untranslated region of mRNA encoded by ATP1A2, corresponding to a HOST TARGET binding site such as BINDING SITE I, BINDING SITE II or BINDING SITE III. Table 2 illustrates the complementarity of the nucleotide sequences of ATP1A2 BINDING SITE, designated SEQ ID:6372, to the nucleotide sequence of VGAM567 RNA, herein designated VGAM RNA, also designated SEQ ID:3278.

A function of VGAM567 is therefore inhibition of ATPase, Na+/K+ Transporting, Alpha 2 (+) Polypeptide (ATP1A2, Accession NM_000702). Accordingly, utilities of VGAM567 include diagnosis, prevention and treatment of diseases and clinical conditions associated with ATP1A2. Wolf-Hirschhorn Syndrome Candidate 1 (WHSC1, Accession NM_007331) is another VGAM567 host target gene. WHSC1 BINDING SITE is HOST TARGET binding site found in the 3' untranslated region of mRNA encoded by WHSC1, corresponding to a HOST TARGET binding site such as BINDING SITE I, BINDING SITE II or BINDING SITE III. Table 2 illustrates the complementarity of the nucleotide sequences of WHSC1 BINDING SITE, designated SEQ ID:14252, to the nucleotide sequence of VGAM567 RNA, herein designated VGAM RNA, also designated SEQ ID:3278.

Another function of VGAM567 is therefore inhibition of Wolf-Hirschhorn Syndrome Candidate 1 (WHSC1, Accession NM_007331), a gene which binds covalently to and repairs g/t mismatches. Accordingly, utilities of VGAM567 include diagnosis, prevention and treatment of diseases and clinical conditions associated with WHSC1. The function of WHSC1 and its association with various diseases and clinical conditions, has been established by previous studies, as described hereinabove with reference to VGAM200. Zinc Finger Protein 146 (ZNF146, Accession NM_007145) is another VGAM567 host target gene. ZNF146 BINDING SITE is HOST TARGET binding site found in the 5' untranslated region of mRNA encoded by ZNF146, corresponding to a HOST TARGET binding site such as BINDING SITE I, BINDING SITE II or BINDING SITE III. Table 2 illustrates the complementarity of the nucleotide sequences of ZNF146 BINDING SITE, designated SEQ ID:13996, to the nucleotide sequence of VGAM567 RNA, herein designated VGAM RNA, also designated SEQ ID:3278.

Another function of VGAM567 is therefore inhibition of Zinc Finger Protein 146 (ZNF146, Accession NM_007145), a gene which binds zinc ions, DNA, and heparin. Accordingly, utilities of VGAM567 include diagnosis, prevention and treatment of diseases and clinical conditions associated with ZNF146. The function of ZNF146 and its association with various diseases and clinical conditions, has been established by previous studies, as described hereinabove with reference to VGAM192. ADP-ribosylation Factor Domain Protein 1, 64 kDa (ARFD1, Accession NM_001656) is another VGAM567 host target gene. ARFD1 BINDING SITE is HOST TARGET binding site found in the 3' untranslated region of mRNA encoded by ARFD1, corresponding to a HOST TARGET binding site such as BINDING SITE I, BINDING SITE II or BINDING SITE III. Table 2 illustrates the complementarity of the nucleotide sequences of ARFD1 BINDING SITE, designated SEQ ID:7374, to the nucleotide sequence of VGAM567 RNA, herein designated VGAM RNA, also designated SEQ ID:3278.

Another function of VGAM567 is therefore inhibition of ADP-ribosylation Factor Domain Protein 1, 64 kDa (ARFD1, Accession NM_001656). Accordingly, utilities of VGAM567 include diagnosis, prevention and treatment of diseases and clinical conditions associated with ARFD1. BART1 (Accession NM_012106) is another VGAM567 host target gene. BART1 BINDING SITE is HOST TARGET binding site found in the 3' untranslated region of mRNA encoded by BART1, corresponding to a HOST TARGET binding site such as BINDING SITE I, BINDING SITE II or BINDING SITE III. Table 2 illustrates the complementarity of the nucleotide sequences of BART1 BINDING SITE, designated SEQ ID:14426, to the nucleotide sequence of VGAM567 RNA, herein designated VGAM RNA, also designated SEQ ID:3278.

Another function of VGAM567 is therefore inhibition of BART1 (Accession NM_012106). Accordingly, utilities of VGAM567 include diagnosis, prevention and treatment of diseases and clinical conditions associated with BART1. FLJ20093 (Accession NM_017664) is another VGAM567 host target gene. FLJ20093 BINDING SITE is HOST TARGET binding site found in the 3' untranslated region of mRNA encoded by FLJ20093, corresponding to a HOST TARGET binding site such as BINDING SITE I, BINDING SITE II or BINDING SITE III. Table 2 illustrates the complementarity of the nucleotide sequences of FLJ20093 BINDING SITE, designated SEQ ID:19206, to the nucleotide sequence of VGAM567 RNA, herein designated VGAM RNA, also designated SEQ ID:3278.

Another function of VGAM567 is therefore inhibition of FLJ20093 (Accession NM_017664). Accordingly, utilities of VGAM567 include diagnosis, prevention and treatment of diseases and clinical conditions associated with FLJ20093. KIAA0763 (Accession NM_014869) is another VGAM567 host target gene. KIAA0763 BINDING SITE is HOST TARGET binding site found in the 3' untranslated region of mRNA encoded by KIAA0763, corresponding to a HOST TARGET binding site such as BINDING SITE I, BINDING SITE II or BINDING SITE III. Table 2 illustrates the complementarity of the nucleotide sequences of KIAA0763 BINDING SITE, designated SEQ ID:16966, to the nucleotide sequence of VGAM567 RNA, herein designated VGAM RNA, also designated SEQ ID:3278.

Another function of VGAM567 is therefore inhibition of KIAA0763 (Accession NM_014869). Accordingly, utilities of VGAM567 include diagnosis, prevention and treatment of diseases and clinical conditions associated with KIAA0763. Zinc Finger Protein 387 (ZNF387, Accession NM_014682) is another VGAM567 host target gene. ZNF387 BINDING SITE is HOST TARGET binding site found in the 3' untranslated region of mRNA encoded by ZNF387, corresponding to a HOST TARGET binding site such as BINDING SITE I, BINDING SITE II or BINDING SITE III. Table 2 illustrates the complementarity of the nucleotide sequences of ZNF387 BINDING SITE, designated SEQ ID:16181, to the nucleotide sequence of VGAM567 RNA, herein designated VGAM RNA, also designated SEQ ID:3278.

Another function of VGAM567 is therefore inhibition of Zinc Finger Protein 387 (ZNF387, Accession NM_014682). Accordingly, utilities of VGAM567 include diagnosis, prevention and treatment of diseases and clinical conditions associated with ZNF387. LOC221830 (Accession XM_166508) is another VGAM567 host target gene. LOC221830 BINDING SITE is HOST TARGET binding site found in the 3' untranslated region of mRNA encoded by LOC221830, corresponding to a HOST TARGET binding site such as BINDING SITE I, BINDING SITE II or BINDING SITE III. Table 2 illustrates the complementarity of the nucleotide sequences of LOC221830 BINDING SITE, designated SEQ ID:44437, to the nucleotide sequence of VGAM567 RNA, herein designated VGAM RNA, also designated SEQ ID:3278.

Another function of VGAM567 is therefore inhibition of LOC221830 (Accession XM_166508). Accordingly, utilities of VGAM567 include diagnosis, prevention and treatment of diseases and clinical conditions associated with LOC221830. LOC222493 (Accession XM_169446) is another VGAM567 host target gene. LOC222493 BINDING SITE is HOST TARGET binding site found in the 5' untranslated region of mRNA encoded by LOC222493, corresponding to a HOST TARGET binding site such as BINDING SITE I, BINDING SITE II or BINDING SITE III. Table 2 illustrates the complementarity of the nucleotide sequences of LOC222493 BINDING SITE, designated SEQ ID:45302, to the nucleotide sequence of VGAM567 RNA, herein designated VGAM RNA, also designated SEQ ID:3278.

Another function of VGAM567 is therefore inhibition of LOC222493 (Accession XM_169446). Accordingly, utilities of VGAM567 include diagnosis, prevention and treatment of diseases and clinical conditions associated with LOC222493. FIG. 1 further provides a conceptual description of a novel bioinformatically detected viral gene of the present invention, referred to here as Viral Genomic Address Messenger 568 (VGAM568) viral gene, which modulates expression of respective host target genes thereof, the function and utility of which host target genes is known in the art.

VGAM568 is a novel bioinformatically detected regulatory, non protein coding, viral micro RNA (miRNA) gene. The method by which VGAM568 was detected is described hereinabove with reference to FIGS. 1-8.

VGAM568 gene, herein designated VGAM GENE, is a viral gene contained in the genome of Fowlpox Virus. VGAM568 host target gene, herein designated VGAM HOST TARGET GENE, is a human gene contained in the human genome.

VGAM568 gene encodes a VGAM568 precursor RNA, herein designated VGAM PRECURSOR RNA. Similar to other miRNA genes, and unlike most ordinary genes, VGAM568 precursor RNA does not encode a protein. A nucleotide sequence identical or highly similar to the nucleotide sequence of VGAM568 precursor RNA is designated SEQ ID:554, and is provided hereinbelow with reference to the sequence listing part. Nucleotide sequence SEQ ID:554 is located at position 123346 relative to the genome of Fowlpox Virus.

VGAM568 precursor RNA folds onto itself, forming VGAM568 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM568 folded precursor RNA into VGAM568 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM568 RNA is designated SEQ ID:3279, and is provided hereinbelow with reference to the sequence listing part.

VGAM568 host target gene, herein designated VGAM HOST TARGET GENE, encodes a corresponding messenger RNA, VGAM568 host target RNA, herein designated VGAM HOST TARGET RNA. VGAM568 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM568 RNA, herein designated VGAM RNA, binds complementarily to one or more host target binding sites located in untranslated regions of VGAM568 host target RNA, herein designated VGAM HOST TARGET RNA. This complementary binding is due to the fact that the nucleotide sequence of VGAM568 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM568 RNA, herein designated VGAM RNA, may have a different number of host target binding sites in untranslated regions of a VGAM568 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM568 RNA, herein designated VGAM RNA, to host target binding sites on VGAM568 host target RNA, herein designated VGAM HOST TARGET RNA, such as BINDING SITE I, BINDING SITE II and BINDING SITE III, inhibits translation of VGAM568 host target RNA into VGAM568 host target protein, herein designated VGAM HOST TARGET PROTEIN. VGAM host target protein is therefore outlined by a broken line.

It is appreciated that VGAM568 host target gene, herein designated VGAM HOST TARGET GENE, in fact represents a plurality of VGAM568 host target genes. The mRNA of each one of this plurality of VGAM568 host target genes comprises one or more host target binding sites, each having a nucleotide sequence which is at least partly complementary to VGAM568 RNA, herein designated VGAM RNA, and which when bound by VGAM568 RNA causes inhibition of translation of respective one or more VGAM568 host target proteins.

It is further appreciated by one skilled in the art that the mode of translational inhibition illustrated by FIG. 1 with specific reference to translational inhibition exerted by VGAM568 gene, herein designated VGAM GENE, on one or more VGAM568 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM568 is inhibition of expression of host target genes, as part of a novel viral mechanism of attacking a host. Accordingly, utilities of VGAM568 include diagnosis, prevention and treatment of viral infection by Fowlpox Virus. Specific functions, and accordingly utilities, of VGAM568 correlate with, and may be deduced from, the identity of the host target genes which VGAM568 binds and inhibits, and the function of these host target genes, as elaborated hereinbelow.

Nucleotide sequences of the VGAM568 precursor RNA, herein designated VGAM PRECURSOR RNA, and of the 'diced' VGAM568 RNA, herein designated VGAM RNA, and a schematic representation of the secondary folding of VGAM568 folded precursor RNA, herein designated VGAM FOLDED PRECURSOR RNA, of VGAM568 are further described hereinbelow with reference to Table 1.

Nucleotide sequences of host target binding sites, such as BINDING SITE-I, BINDING SITE-II and BINDING SITE-III of FIG. 1, found on VGAM568 host target RNA, and schematic representation of the complementarity of each of these host target binding sites to VGAM568 RNA, herein designated VGAM RNA, are described hereinbelow with reference to Table 2.

As mentioned hereinabove with reference to FIG. 1, a function of VGAM568 gene, herein designated VGAM is inhibition of expression of VGAM568 target genes. It is appreciated that specific functions, and accordingly utilities, of VGAM568 correlate with, and may be deduced from, the identity of the target genes which VGAM568 binds and inhibits, and the function of these target genes, as elaborated hereinbelow.

Fibroblast Growth Factor Receptor 1 (fms-related tyrosine kinase 2, Pfeiffer syndrome) (FGFR1, Accession NM_000604) is a VGAM568 host target gene. FGFR1 BINDING SITE1 through FGFR1 BINDING SITE6 are HOST TARGET binding sites found in untranslated regions of mRNA encoded by FGFR1, corresponding to HOST TARGET binding sites such as BINDING SITE I, BINDING SITE II or BINDING SITE III. Table 2 illustrates the complementarity of the nucleotide sequences of FGFR1 BINDING SITE1 through FGFR1 BINDING SITE6, designated SEQ ID:6210, SEQ ID:17981, SEQ ID:23363, SEQ ID:23367, SEQ ID:23378 and SEQ ID:23375 respectively, to the nucleotide sequence of VGAM568 RNA, herein designated VGAM RNA, also designated SEQ ID:3279.

A function of VGAM568 is therefore inhibition of Fibroblast Growth Factor Receptor 1 (fms-related tyrosine kinase 2, Pfeiffer syndrome) (FGFR1, Accession NM_000604). Accordingly, utilities of VGAM568 include diagnosis, prevention and treatment of diseases and clinical conditions associated with FGFR1. FIG. 1 further provides a conceptual description of a novel bioinformatically detected viral gene of the present invention, referred to here as Viral Genomic Address Messenger 569 (VGAM569) viral gene, which modulates expression of respective host target genes thereof, the function and utility of which host target genes is known in the art.

VGAM569 is a novel bioinformatically detected regulatory, non protein coding, viral micro RNA (miRNA) gene. The method by which VGAM569 was detected is described hereinabove with reference to FIGS. 1-8.

VGAM569 gene, herein designated VGAM GENE, is a viral gene contained in the genome of Fowlpox Virus. VGAM569 host target gene, herein designated VGAM HOST TARGET GENE, is a human gene contained in the human genome.

VGAM569 gene encodes a VGAM569 precursor RNA, herein designated VGAM PRECURSOR RNA. Similar to other miRNA genes, and unlike most ordinary genes, VGAM569 precursor RNA does not encode a protein. A nucleotide sequence identical or highly similar to the nucleotide sequence of VGAM569 precursor RNA is designated SEQ ID:555, and is provided hereinbelow with reference to the sequence listing part. Nucleotide sequence SEQ ID:555 is located at position 127302 relative to the genome of Fowlpox Virus.

VGAM569 precursor RNA folds onto itself, forming VGAM569 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM569 folded precursor RNA into VGAM569 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM569 RNA is designated SEQ ID:3280, and is provided hereinbelow with reference to the sequence listing part.

VGAM569 host target gene, herein designated VGAM HOST TARGET GENE, encodes a corresponding messenger RNA, VGAM569 host target RNA, herein designated VGAM HOST TARGET RNA. VGAM569 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM569 RNA, herein designated VGAM RNA, binds complementarily to one or more host target binding sites located in untranslated regions of VGAM569 host target RNA, herein designated VGAM HOST TARGET RNA. This complementary binding is due to the fact that the nucleotide sequence of VGAM569 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM569 RNA, herein designated VGAM RNA, may have a different number of host target binding sites in untranslated regions of a VGAM569 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM569 RNA, herein designated VGAM RNA, to host target binding sites on VGAM569 host target RNA, herein designated VGAM HOST TARGET RNA, such as BINDING SITE I, BINDING SITE II and BINDING SITE III, inhibits translation of VGAM569 host target RNA into VGAM569 host target protein, herein designated VGAM HOST TARGET PROTEIN. VGAM host target protein is therefore outlined by a broken line.

It is appreciated that VGAM569 host target gene, herein designated VGAM HOST TARGET GENE, in fact represents a plurality of VGAM569 host target genes. The mRNA of each one of this plurality of VGAM569 host target genes comprises one or more host target binding sites, each having a nucleotide sequence which is at least partly complementary to VGAM569 RNA, herein designated VGAM RNA, and which when bound by VGAM569 RNA causes inhibition of translation of respective one or more VGAM569 host target proteins.

It is further appreciated by one skilled in the art that the mode of translational inhibition illustrated by FIG. 1 with specific reference to translational inhibition exerted by VGAM569 gene, herein designated VGAM GENE, on one or more VGAM569 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM569 is inhibition of expression of host target genes, as part of a novel viral mechanism of attacking a host. Accordingly, utilities of VGAM569 include diagnosis, prevention and treatment of viral infection by Fowlpox Virus. Specific functions, and accordingly utilities, of VGAM569 correlate with, and may be deduced from, the identity of the host target genes which VGAM569 binds and inhibits, and the function of these host target genes, as elaborated hereinbelow.

Nucleotide sequences of the VGAM569 precursor RNA, herein designated VGAM PRECURSOR RNA, and of the ‘diced’ VGAM569 RNA, herein designated VGAM RNA, and a schematic representation of the secondary folding of VGAM569 folded precursor RNA, herein designated VGAM FOLDED PRECURSOR RNA, of VGAM569 are further described hereinbelow with reference to Table 1.

Nucleotide sequences of host target binding sites, such as BINDING SITE-I, BINDING SITE-II and BINDING SITE-III of FIG. 1, found on VGAM569 host target RNA, and schematic representation of the complementarity of each of these host target binding sites to VGAM569 RNA, herein designated VGAM RNA, are described hereinbelow with reference to Table 2.

As mentioned hereinabove with reference to FIG. 1, a function of VGAM569 gene, herein designated VGAM is inhibition of expression of VGAM569 target genes. It is appreciated that specific functions, and accordingly utilities, of VGAM569 correlate with, and may be deduced from, the identity of the target genes which VGAM569 binds and inhibits, and the function of these target genes, as elaborated hereinbelow.

UDP-N-acetyl-alpha-D-galactosamine:(N-acetylneuraminyl)-galactosylglucosylceramide N-acetylgalactosaminyltransferase (GalNAc-T) (GALGT, Accession NM_001478) is a VGAM569 host target gene. GALGT BINDING SITE is HOST TARGET binding site found in the 3' untranslated region of mRNA encoded by GALGT, corresponding to a HOST TARGET binding site such as BINDING SITE I, BINDING SITE II or BINDING SITE III. Table 2 illustrates the complementarity of the nucleotide sequences of GALGT BINDING SITE, designated SEQ ID:7210, to the nucleotide sequence of VGAM569 RNA, herein designated VGAM RNA, also designated SEQ ID:3280.

A function of VGAM569 is therefore inhibition of UDP-N-acetyl-alpha-D-galactosamine:(N-acetylneuraminyl)-galactosylglucosylceramide N-acetylgalactosaminyltransferase (GalNAc-T) (GALGT, Accession NM_001478), a gene which is involved in the biosynthesis of gangliosides gm2, gd2 and ga2. Accordingly, utilities of VGAM569 include diagnosis, prevention and treatment of diseases and clinical conditions associated with GALGT. The function of GALGT and its association with various diseases and clinical conditions, has been established by previous studies, as described hereinabove with reference to VGAM179. Homeo Box C10 (HOXC10, Accession XM_028621) is another VGAM569 host target gene. HOXC10 BINDING SITE is HOST TARGET binding site found in the 3' untranslated region of mRNA encoded by HOXC10, corresponding to a HOST TARGET binding site such as BINDING SITE I, BINDING SITE II or BINDING SITE III. Table 2 illustrates the complementarity of the nucleotide sequences of HOXC10 BINDING SITE, designated SEQ ID:30720, to the nucleotide sequence of VGAM569 RNA, herein designated VGAM RNA, also designated SEQ ID:3280.

Another function of VGAM569 is therefore inhibition of Homeo Box C10 (HOXC10, Accession XM_028621). Accordingly, utilities of VGAM569 include diagnosis, prevention and treatment of diseases and clinical conditions associated with HOXC10. SWI/SNF Related, Matrix Associated, Actin Dependent Regulator of Chromatin, Subfamily D, Member 1 (SMARCD1, Accession NM_003076) is another VGAM569 host target gene. SMARCD1 BINDING SITE1 and SMARCD1 BINDING SITE2 are HOST TARGET binding sites found in untranslated regions of mRNA encoded by SMARCD1, corresponding to HOST TARGET binding sites such as BINDING SITE I, BINDING SITE II or BINDING SITE III. Table 2 illustrates the complementarity of the nucleotide sequences of SMARCD1 BINDING SITE1 and SMARCD1 BINDING SITE2, designated SEQ ID:9048 and SEQ ID:29146 respectively, to the nucleotide sequence of VGAM569 RNA, herein designated VGAM RNA, also designated SEQ ID:3280.

Another function of VGAM569 is therefore inhibition of SWI/SNF Related, Matrix Associated, Actin Dependent Regulator of Chromatin, Subfamily D, Member 1 (SMARCD1, Accession NM_003076), a gene which is involved in chromatin assembly and remodeling. Accordingly, utilities of VGAM569 include diagnosis, prevention and treatment of diseases and clinical conditions associated with SMARCD1. The function of SMARCD1 and its association with various diseases and clinical conditions, has been established by previous studies, as described hereinabove with reference to VGAM152. LOC149628 (Accession XM_086611) is another VGAM569 host target gene. LOC149628 BINDING SITE is HOST TARGET binding site found in the 3' untranslated region of mRNA encoded by LOC149628, corresponding to a HOST TARGET binding site such as BINDING SITE I, BINDING SITE II or BINDING SITE III. Table 2 illustrates the complementarity of the nucleotide sequences of LOC149628 BINDING SITE, designated SEQ ID:38791, to the nucleotide sequence of VGAM569 RNA, herein designated VGAM RNA, also designated SEQ ID:3280.

Another function of VGAM569 is therefore inhibition of LOC149628 (Accession XM_086611). Accordingly, utilities of VGAM569 include diagnosis, prevention and treatment of diseases and clinical conditions associated with LOC149628. FIG. 1 further provides a conceptual description of a novel bioinformatically detected viral gene of the present invention, referred to here as Viral Genomic Address Messenger 570 (VGAM570) viral gene, which modulates expression of respective host target genes thereof, the function and utility of which host target genes is known in the art.

VGAM570 is a novel bioinformatically detected regulatory, non protein coding, viral micro RNA (miRNA) gene. The method by which VGAM570 was detected is described hereinabove with reference to FIGS. 1-8.

VGAM570 gene, herein designated VGAM GENE, is a viral gene contained in the genome of Fowlpox Virus. VGAM570 host target gene, herein designated VGAM HOST TARGET GENE, is a human gene contained in the human genome.

VGAM570 gene encodes a VGAM570 precursor RNA, herein designated VGAM PRECURSOR RNA. Similar to other miRNA genes, and unlike most ordinary genes, VGAM570 precursor RNA does not encode a protein. A nucleotide sequence identical or highly similar to the nucleotide sequence of VGAM570 precursor RNA is designated SEQ ID:556, and is provided hereinbelow with reference to the sequence listing part. Nucleotide sequence SEQ ID:556 is located at position 124616 relative to the genome of Fowlpox Virus.

VGAM570 precursor RNA folds onto itself, forming VGAM570 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM570 folded precursor RNA into VGAM570 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM570 RNA is designated SEQ ID:3281, and is provided hereinbelow with reference to the sequence listing part.

VGAM570 host target gene, herein designated VGAM HOST TARGET GENE, encodes a corresponding messenger RNA, VGAM570 host target RNA, herein designated VGAM HOST TARGET RNA. VGAM570 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM570 RNA, herein designated VGAM RNA, binds complementarily to one or more host target binding sites located in untranslated regions of VGAM570 host target RNA, herein designated VGAM HOST TARGET RNA. This complementary binding is due to the fact that the nucleotide sequence of VGAM570 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM570 RNA, herein designated VGAM RNA, may have a different number of host target binding sites in untranslated regions of a VGAM570 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM570 RNA, herein designated VGAM RNA, to host target binding sites on VGAM570 host target RNA, herein designated VGAM HOST TARGET RNA, such as BINDING SITE I, BINDING SITE II and BINDING SITE III, inhibits translation of VGAM570 host target RNA into VGAM570 host target protein, herein designated VGAM HOST TARGET PROTEIN. VGAM host target protein is therefore outlined by a broken line.

It is appreciated that VGAM570 host target gene, herein designated VGAM HOST TARGET GENE, in fact represents a plurality of VGAM570 host target genes. The mRNA of each one of this plurality of VGAM570 host target genes comprises one or more host target binding sites, each having a nucleotide sequence which is at least partly complementary to VGAM570 RNA, herein designated VGAM RNA, and which when bound by VGAM570 RNA causes inhibition of translation of respective one or more VGAM570 host target proteins.

It is further appreciated by one skilled in the art that the mode of translational inhibition illustrated by FIG. 1 with specific reference to translational inhibition exerted by VGAM570 gene, herein designated VGAM GENE, on one or more VGAM570 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM570 is inhibition of expression of host target genes, as part of a novel viral mechanism of attacking a host. Accordingly, utilities of VGAM570 include diagnosis, prevention and treatment of viral infection by Fowlpox Virus. Specific functions, and accordingly utilities, of VGAM570 correlate with, and may be deduced from, the identity of the host target genes which VGAM570 binds and inhibits, and the function of these host target genes, as elaborated hereinbelow.

Nucleotide sequences of the VGAM570 precursor RNA, herein designated VGAM PRECURSOR RNA, and of the 'diced' VGAM570 RNA, herein designated VGAM RNA, and a schematic representation of the secondary folding of VGAM570 folded precursor RNA, herein designated VGAM FOLDED PRECURSOR RNA, of VGAM570 are further described hereinbelow with reference to Table 1.

Nucleotide sequences of host target binding sites, such as BINDING SITE-I, BINDING SITE-II and BINDING SITE-III of FIG. 1, found on VGAM570 host target RNA, and schematic representation of the complementarity of each of these host target binding sites to VGAM570 RNA, herein designated VGAM RNA, are described hereinbelow with reference to Table 2.

As mentioned hereinabove with reference to FIG. 1, a function of VGAM570 gene, herein designated VGAM is inhibition of expression of VGAM570 target genes. It is appreciated that specific functions, and accordingly utilities, of VGAM570 correlate with, and may be deduced from, the identity of the target genes which VGAM570 binds and inhibits, and the function of these target genes, as elaborated hereinbelow.

UDP-Gal:betaGlcNAc Beta 1,3-galactosyltransferase, Polypeptide 2 (B3GALT2, Accession NM_003783) is a VGAM570 host target gene. B3GALT2 BINDING SITE is HOST TARGET binding site found in the 3' untranslated region of mRNA encoded by B3GALT2, corresponding to a HOST TARGET binding site such as BINDING SITE I, BINDING SITE II or BINDING SITE III. Table 2 illustrates the complementarity of the nucleotide sequences of B3GALT2 BINDING SITE, designated SEQ ID:9871, to the nucleotide sequence of VGAM570 RNA, herein designated VGAM RNA, also designated SEQ ID:3281.

A function of VGAM570 is therefore inhibition of UDP-Gal:betaGlcNAc Beta 1,3-galactosyltransferase, Polypeptide 2 (B3GALT2, Accession NM_003783). Accordingly, utilities of VGAM570 include diagnosis, prevention and treatment of diseases and clinical conditions associated with B3GALT2. FIG. 1 further provides a conceptual description of a novel bioinformatically detected viral gene of the present invention, referred to here as Viral Genomic Address Messenger 571 (VGAM571) viral gene, which modulates expression of respective host target genes thereof, the function and utility of which host target genes is known in the art.

VGAM571 is a novel bioinformatically detected regulatory, non protein coding, viral micro RNA (miRNA) gene. The method by which VGAM571 was detected is described hereinabove with reference to FIGS. 1-8.

VGAM571 gene, herein designated VGAM GENE, is a viral gene contained in the genome of Fowlpox Virus. VGAM571 host target gene, herein designated VGAM HOST TARGET GENE, is a human gene contained in the human genome.

VGAM571 gene encodes a VGAM571 precursor RNA, herein designated VGAM PRECURSOR RNA. Similar to other miRNA genes, and unlike most ordinary genes, VGAM571 precursor RNA does not encode a protein. A nucleotide sequence identical or highly similar to the nucleotide sequence of VGAM571 precursor RNA is designated SEQ ID:557, and is provided hereinbelow with reference to the sequence listing part. Nucleotide sequence SEQ ID:557 is located at position 152048 relative to the genome of Fowlpox Virus.

VGAM571 precursor RNA folds onto itself, forming VGAM571 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM571 folded precursor RNA into VGAM571 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM571 RNA is designated SEQ ID:3282, and is provided hereinbelow with reference to the sequence listing part.

VGAM571 host target gene, herein designated VGAM HOST TARGET GENE, encodes a corresponding messenger RNA, VGAM571 host target RNA, herein designated VGAM HOST TARGET RNA. VGAM571 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM571 RNA, herein designated VGAM RNA, binds complementarily to one or more host target binding sites located in untranslated regions of VGAM571 host target RNA, herein designated VGAM HOST TARGET RNA. This complementary binding is due to the fact that the nucleotide sequence of VGAM571 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM571 RNA, herein designated VGAM RNA, may have a different number of host target binding sites in untranslated regions of a VGAM571 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM571 RNA, herein designated VGAM RNA, to host target binding sites on VGAM571 host target RNA, herein designated VGAM HOST TARGET RNA, such as BINDING SITE I, BINDING SITE II and BINDING SITE III, inhibits translation of VGAM571 host target RNA into VGAM571 host target protein, herein designated VGAM HOST TARGET PROTEIN. VGAM host target protein is therefore outlined by a broken line.

It is appreciated that VGAM571 host target gene, herein designated VGAM HOST TARGET GENE, in fact represents a plurality of VGAM571 host target genes. The mRNA of each one of this plurality of VGAM571 host target genes comprises one or more host target binding sites, each having a nucleotide sequence which is at least partly complementary to VGAM571 RNA, herein designated VGAM RNA, and which when bound by VGAM571 RNA causes inhibition of translation of respective one or more VGAM571 host target proteins.

It is further appreciated by one skilled in the art that the mode of translational inhibition illustrated by FIG. 1 with specific reference to translational inhibition exerted by VGAM571 gene, herein designated VGAM GENE, on one or more VGAM571 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM571 is inhibition of expression of host target genes, as part of a novel viral mechanism of attacking a host. Accordingly, utilities of VGAM571 include diagnosis, prevention and treatment of viral infection by Fowlpox Virus. Specific functions, and accordingly utilities, of VGAM571 correlate with, and may be deduced from, the identity of the host target genes which VGAM571 binds and inhibits, and the function of these host target genes, as elaborated hereinbelow.

Nucleotide sequences of the VGAM571 precursor RNA, herein designated VGAM PRECURSOR RNA, and of the 'diced' VGAM571 RNA, herein designated VGAM RNA, and a schematic representation of the secondary folding of VGAM571 folded precursor RNA, herein designated VGAM FOLDED PRECURSOR RNA, of VGAM571 are further described hereinbelow with reference to Table 1.

Nucleotide sequences of host target binding sites, such as BINDING SITE-I, BINDING SITE-II and BINDING SITE-III of FIG. 1, found on VGAM571 host target RNA, and schematic representation of the complementarity of each of these host target binding sites to VGAM571 RNA, herein designated VGAM RNA, are described hereinbelow with reference to Table 2.

As mentioned hereinabove with reference to FIG. 1, a function of VGAM571 gene, herein designated VGAM is inhibition of expression of VGAM571 target genes. It is appreciated that specific functions, and accordingly utilities, of VGAM571 correlate with, and may be deduced from, the identity of the target genes which VGAM571 binds and inhibits, and the function of these target genes, as elaborated hereinbelow.

FLJ12448 (Accession NM_022895) is a VGAM571 host target gene. FLJ12448 BINDING SITE is HOST TARGET binding site found in the 3' untranslated region of mRNA encoded by FLJ12448, corresponding to a HOST TARGET binding site such as BINDING SITE I, BINDING SITE II or BINDING SITE III. Table 2 illustrates the complementarity of the nucleotide sequences of FLJ12448 BINDING SITE, designated SEQ ID:23156, to the nucleotide sequence of VGAM571 RNA, herein designated VGAM RNA, also designated SEQ ID:3282.

A function of VGAM571 is therefore inhibition of FLJ12448 (Accession NM_022895). Accordingly, utilities of VGAM571 include diagnosis, prevention and treatment of diseases and clinical conditions associated with FLJ12448. KIAA0293 (Accession XM_027045) is another VGAM571 host target gene. KIAA0293 BINDING SITE is HOST TARGET binding site found in the 3' untranslated region of mRNA encoded by KIAA0293, corresponding to a HOST TARGET binding site such as BINDING SITE I, BINDING SITE II or BINDING SITE III. Table 2 illustrates the complementarity of the nucleotide sequences of KIAA0293 BINDING SITE, designated SEQ ID:30393, to the nucleotide sequence of VGAM571 RNA, herein designated VGAM RNA, also designated SEQ ID:3282.

Another function of VGAM571 is therefore inhibition of KIAA0293 (Accession XM_027045). Accordingly, utilities of VGAM571 include diagnosis, prevention and treatment of diseases and clinical conditions associated with KIAA0293. LOC152245 (Accession XM_098182) is another VGAM571 host target gene. LOC152245 BINDING SITE is HOST TARGET binding site found in the 5' untranslated region of mRNA encoded by LOC152245, corresponding to a HOST TARGET binding site such as BINDING SITE I, BINDING SITE II or BINDING SITE III. Table 2 illustrates the complementarity of the nucleotide sequences of LOC152245 BINDING SITE, designated SEQ ID:41448, to the nucleotide sequence of VGAM571 RNA, herein designated VGAM RNA, also designated SEQ ID:3282.

Another function of VGAM571 is therefore inhibition of LOC152245 (Accession XM_098182). Accordingly, utilities of VGAM571 include diagnosis, prevention and treatment of diseases and clinical conditions associated with LOC152245.

FIG. 1 further provides a conceptual description of a novel bioinformatically detected viral gene of the present invention, referred to here as Viral Genomic Address Messenger 572 (VGAM572) viral gene, which modulates expression of respective host target genes thereof, the function and utility of which host target genes is known in the art.

VGAM572 is a novel bioinformatically detected regulatory, non protein coding, viral micro RNA (miRNA) gene. The method by which VGAM572 was detected is described hereinabove with reference to FIGS. 1-8.

VGAM572 gene, herein designated VGAM GENE, is a viral gene contained in the genome of Fowlpox Virus. VGAM572 host target gene, herein designated VGAM HOST TARGET GENE, is a human gene contained in the human genome.

VGAM572 gene encodes a VGAM572 precursor RNA, herein designated VGAM PRECURSOR RNA. Similar to other miRNA genes, and unlike most ordinary genes, VGAM572 precursor RNA does not encode a protein. A nucleotide sequence identical or highly similar to the nucleotide sequence of VGAM572 precursor RNA is designated SEQ ID:558, and is provided hereinbelow with reference to the sequence listing part. Nucleotide sequence SEQ ID:558 is located at position 151611 relative to the genome of Fowlpox Virus.

VGAM572 precursor RNA folds onto itself, forming VGAM572 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM572 folded precursor RNA into VGAM572 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM572 RNA is designated SEQ ID:3283, and is provided hereinbelow with reference to the sequence listing part.

VGAM572 host target gene, herein designated VGAM HOST TARGET GENE, encodes a corresponding messenger RNA, VGAM572 host target RNA, herein designated VGAM HOST TARGET RNA. VGAM572 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM572 RNA, herein designated VGAM RNA, binds complementarily to one or more host target binding sites located in untranslated regions of VGAM572 host target RNA, herein designated VGAM HOST TARGET RNA. This complementary binding is due to the fact that the nucleotide sequence of VGAM572 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM572 RNA, herein designated VGAM RNA, may have a different number of host target binding sites in untranslated regions of a VGAM572 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM572 RNA, herein designated VGAM RNA, to host target binding sites on VGAM572 host target RNA, herein designated VGAM HOST TARGET RNA, such as BINDING SITE I, BINDING SITE II and BINDING SITE III, inhibits translation of VGAM572 host target RNA into VGAM572 host target protein, herein designated VGAM HOST TARGET PROTEIN. VGAM host target protein is therefore outlined by a broken line.

It is appreciated that VGAM572 host target gene, herein designated VGAM HOST TARGET GENE, in fact represents a plurality of VGAM572 host target genes. The mRNA of each one of this plurality of VGAM572 host target genes comprises one or more host target binding sites, each having a nucleotide sequence which is at least partly complementary to VGAM572 RNA, herein designated VGAM RNA, and which when bound by VGAM572 RNA causes inhibition of translation of respective one or more VGAM572 host target proteins.

It is further appreciated by one skilled in the art that the mode of translational inhibition illustrated by FIG. 1 with specific reference to translational inhibition exerted by VGAM572 gene, herein designated VGAM GENE, on one or more VGAM572 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM572 is inhibition of expression of host target genes, as part of a novel viral mechanism of attacking a host. Accordingly, utilities of VGAM572 include diagnosis, prevention and treatment of viral infection by Fowlpox Virus. Specific functions, and accordingly utilities, of VGAM572 correlate with, and may be deduced from, the identity of the host target genes which VGAM572 binds and inhibits, and the function of these host target genes, as elaborated hereinbelow.

Nucleotide sequences of the VGAM572 precursor RNA, herein designated VGAM PRECURSOR RNA, and of the 'diced' VGAM572 RNA, herein designated VGAM RNA, and a schematic representation of the secondary folding of VGAM572 folded precursor RNA, herein designated VGAM FOLDED PRECURSOR RNA, of VGAM572 are further described hereinbelow with reference to Table 1.

Nucleotide sequences of host target binding sites, such as BINDING SITE-I, BINDING SITE-II and BINDING SITE-III of FIG. 1, found on VGAM572 host target RNA, and schematic representation of the complementarity of each of these host target binding sites to VGAM572 RNA, herein designated VGAM RNA, are described hereinbelow with reference to Table 2.

As mentioned hereinabove with reference to FIG. 1, a function of VGAM572 gene, herein designated VGAM is inhibition of expression of VGAM572 target genes. It is appreciated that specific functions, and accordingly utilities, of VGAM572 correlate with, and may be deduced from, the identity of the target genes which VGAM572 binds and inhibits, and the function of these target genes, as elaborated hereinbelow.

KIAA1948 (Accession XM_091984) is a VGAM572 host target gene. KIAA1948 BINDING SITE is HOST TARGET binding site found in the 5' untranslated region of mRNA encoded by KIAA1948, corresponding to a HOST TARGET binding site such as BINDING SITE I, BINDING SITE II or BINDING SITE III. Table 2 illustrates the complementarity of the nucleotide sequences of KIAA1948 BINDING SITE, designated SEQ ID:40078, to the nucleotide sequence of VGAM572 RNA, herein designated VGAM RNA, also designated SEQ ID:3283.

A function of VGAM572 is therefore inhibition of KIAA1948 (Accession XM_091984). Accordingly, utilities of VGAM572 include diagnosis, prevention and treatment of diseases and clinical conditions associated with KIAA1948. RASD Family, Member 2 (RASD2, Accession NM_014310) is another VGAM572 host target gene. RASD2 BINDING SITE is HOST TARGET binding site found in the 3' untranslated region of mRNA encoded by RASD2, corresponding to a HOST TARGET binding site such as BINDING SITE I, BINDING SITE II or BINDING SITE III. Table 2 illustrates the complementarity of the nucleotide sequences of RASD2 BINDING SITE, designated SEQ ID:15599, to the nucleotide sequence of VGAM572 RNA, herein designated VGAM RNA, also designated SEQ ID:3283.

Another function of VGAM572 is therefore inhibition of RASD Family, Member 2 (RASD2, Accession NM_014310). Accordingly, utilities of VGAM572 include diagnosis, prevention and treatment of diseases and clinical conditions associated with RASD2. FIG. 1 further provides a conceptual description of a novel bioinformatically detected viral gene of the present invention, referred to here as Viral Genomic Address Messenger 573 (VGAM573) viral gene, which modulates expression of respective host target genes thereof, the function and utility of which host target genes is known in the art.

VGAM573 is a novel bioinformatically detected regulatory, non protein coding, viral micro RNA (miRNA) gene. The method by which VGAM573 was detected is described hereinabove with reference to FIGS. 1-8.

VGAM573 gene, herein designated VGAM GENE, is a viral gene contained in the genome of Fowlpox Virus. VGAM573 host target gene, herein designated VGAM HOST TARGET GENE, is a human gene contained in the human genome.

VGAM573 gene encodes a VGAM573 precursor RNA, herein designated VGAM PRECURSOR RNA. Similar to other miRNA genes, and unlike most ordinary genes, VGAM573 precursor RNA does not encode a protein. A nucleotide sequence identical or highly similar to the nucleotide sequence of VGAM573 precursor RNA is designated SEQ ID:559, and is provided hereinbelow with reference to the sequence listing part. Nucleotide sequence SEQ ID:559 is located at position 150116 relative to the genome of Fowlpox Virus.

VGAM573 precursor RNA folds onto itself, forming VGAM573 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM573 folded precursor RNA into VGAM573 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM573 RNA is designated SEQ ID:3284, and is provided hereinbelow with reference to the sequence listing part.

VGAM573 host target gene, herein designated VGAM HOST TARGET GENE, encodes a corresponding messenger RNA, VGAM573 host target RNA, herein designated VGAM HOST TARGET RNA. VGAM573 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM573 RNA, herein designated VGAM RNA, binds complementarily to one or more host target binding sites located in untranslated regions of VGAM573 host target RNA, herein designated VGAM HOST TARGET RNA. This complementary binding is due to the fact that the nucleotide sequence of VGAM573 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM573 RNA, herein designated VGAM RNA, may have a different number of host target binding sites in untranslated regions of a VGAM573 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM573 RNA, herein designated VGAM RNA, to host target binding sites on VGAM573 host target RNA, herein designated VGAM HOST TARGET RNA, such as BINDING SITE I, BINDING SITE II and BINDING SITE III, inhibits translation of VGAM573 host target RNA into VGAM573 host target protein, herein designated VGAM HOST TARGET PROTEIN. VGAM host target protein is therefore outlined by a broken line.

It is appreciated that VGAM573 host target gene, herein designated VGAM HOST TARGET GENE, in fact represents a plurality of VGAM573 host target genes. The mRNA of each one of this plurality of VGAM573 host target genes comprises one or more host target binding sites, each having a nucleotide sequence which is at least partly complementary to VGAM573 RNA, herein designated VGAM RNA, and which when bound by VGAM573 RNA causes inhibition of translation of respective one or more VGAM573 host target proteins.

It is further appreciated by one skilled in the art that the mode of translational inhibition illustrated by FIG. 1 with specific reference to translational inhibition exerted by VGAM573 gene, herein designated VGAM GENE, on one or more VGAM573 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM573 is inhibition of expression of host target genes, as part of a novel viral mechanism of attacking a host. Accordingly, utilities of VGAM573 include diagnosis, prevention and treatment of viral infection by Fowlpox Virus. Specific functions, and accordingly utilities, of VGAM573 correlate with, and may be deduced from, the identity of the host target genes which VGAM573 binds and inhibits, and the function of these host target genes, as elaborated hereinbelow.

Nucleotide sequences of the VGAM573 precursor RNA, herein designated VGAM PRECURSOR RNA, and of the 'diced' VGAM573 RNA, herein designated VGAM RNA, and a schematic representation of the secondary folding of VGAM573 folded precursor RNA, herein designated VGAM FOLDED PRECURSOR RNA, of VGAM573 are further described hereinbelow with reference to Table 1.

Nucleotide sequences of host target binding sites, such as BINDING SITE-I, BINDING SITE-II and BINDING SITE-III of FIG. 1, found on VGAM573 host target RNA, and schematic representation of the complementarity of each of these host target binding sites to VGAM573 RNA, herein designated VGAM RNA, are described hereinbelow with reference to Table 2.

As mentioned hereinabove with reference to FIG. 1, a function of VGAM573 gene, herein designated VGAM is inhibition of expression of VGAM573 target genes. It is appreciated that specific functions, and accordingly utilities, of VGAM573 correlate with, and may be deduced from, the identity of the target genes which VGAM573 binds and inhibits, and the function of these target genes, as elaborated hereinbelow.

Zinc Finger Protein 268 (ZNF268, Accession XM_031851) is a VGAM573 host target gene. ZNF268 BINDING SITE is HOST TARGET binding site found in the 3' untranslated region of mRNA encoded by ZNF268, corresponding to a HOST TARGET binding site such as BIND- ING SITE I, BINDING SITE II or BINDING SITE III. Table 2 illustrates the complementarity of the nucleotide sequences of ZNF268 BINDING SITE, designated SEQ ID:31498, to the nucleotide sequence of VGAM573 RNA, herein designated VGAM RNA, also designated SEQ ID:3284.

A function of VGAM573 is therefore inhibition of Zinc Finger Protein 268 (ZNF268, Accession XM_031851). Accordingly, utilities of VGAM573 include diagnosis, prevention and treatment of diseases and clinical conditions associated with ZNF268. KIAA0970 (Accession NM_014923) is another VGAM573 host target gene. KIAA0970 BINDING SITE is HOST TARGET binding site found in the 3' untranslated region of mRNA encoded by KIAA0970, corresponding to a HOST TARGET binding site such as BINDING SITE I, BINDING SITE II or BINDING SITE III. Table 2 illustrates the complementarity of the nucleotide sequences of KIAA0970 BINDING SITE, designated SEQ ID:17203, to the nucleotide sequence of VGAM573 RNA, herein designated VGAM RNA, also designated SEQ ID:3284.

Another function of VGAM573 is therefore inhibition of KIAA0970 (Accession NM_014923). Accordingly, utilities of VGAM573 include diagnosis, prevention and treatment of diseases and clinical conditions associated with KIAA0970. TBC1 Domain Family, Member 2 (TBC1D2, Accession NM_018421) is another VGAM573 host target gene. TBC1D2 BINDING SITE is HOST TARGET binding site found in the 5' untranslated region of mRNA encoded by TBC1D2, corresponding to a HOST TARGET binding site such as BINDING SITE I, BINDING SITE II or BINDING SITE III. Table 2 illustrates the complementarity of the nucleotide sequences of TBC1D2 BINDING SITE, designated SEQ ID:20467, to the nucleotide sequence of VGAM573 RNA, herein designated VGAM RNA, also designated SEQ ID:3284.

Another function of VGAM573 is therefore inhibition of TBC1 Domain Family, Member 2 (TBC1D2, Accession NM_018421). Accordingly, utilities of VGAM573 include diagnosis, prevention and treatment of diseases and clinical conditions associated with TBC1D2. LOC92283 (Accession XM_044049) is another VGAM573 host target gene. LOC92283 BINDING SITE is HOST TARGET binding site found in the 3' untranslated region of mRNA encoded by LOC92283, corresponding to a HOST TARGET binding site such as BINDING SITE I, BINDING SITE II or BINDING SITE III. Table 2 illustrates the complementarity of the nucleotide sequences of LOC92283 BINDING SITE, designated SEQ ID:34092, to the nucleotide sequence of VGAM573 RNA, herein designated VGAM RNA, also designated SEQ ID:3284.

Another function of VGAM573 is therefore inhibition of LOC92283 (Accession XM_044049). Accordingly, utilities of VGAM573 include diagnosis, prevention and treatment of diseases and clinical conditions associated with LOC92283. FIG. 1 further provides a conceptual description of a novel bioinformatically detected viral gene of the present invention, referred to here as Viral Genomic Address Messenger 574 (VGAM574) viral gene, which modulates expression of respective host target genes thereof, the function and utility of which host target genes is known in the art.

VGAM574 is a novel bioinformatically detected regulatory, non protein coding, viral micro RNA (miRNA) gene. The method by which VGAM574 was detected is described hereinabove with reference to FIGS. 1-8.

VGAM574 gene, herein designated VGAM GENE, is a viral gene contained in the genome of Fowlpox Virus. VGAM574 host target gene, herein designated VGAM HOST TARGET GENE, is a human gene contained in the human genome.

VGAM574 gene encodes a VGAM574 precursor RNA, herein designated VGAM PRECURSOR RNA. Similar to other miRNA genes, and unlike most ordinary genes, VGAM574 precursor RNA does not encode a protein. A nucleotide sequence identical or highly similar to the nucleotide sequence of VGAM574 precursor RNA is designated SEQ ID:560, and is provided hereinbelow with reference to the sequence listing part. Nucleotide sequence SEQ ID:560 is located at position 151276 relative to the genome of Fowlpox Virus.

VGAM574 precursor RNA folds onto itself, forming VGAM574 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM574 folded precursor RNA into VGAM574 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM574 RNA is designated SEQ ID:3285, and is provided hereinbelow with reference to the sequence listing part.

VGAM574 host target gene, herein designated VGAM HOST TARGET GENE, encodes a corresponding messenger RNA, VGAM574 host target RNA, herein designated VGAM HOST TARGET RNA. VGAM574 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM574 RNA, herein designated VGAM RNA, binds complementarily to one or more host target binding sites located in untranslated regions of VGAM574 host target RNA, herein designated VGAM HOST TARGET RNA. This complementary binding is due to the fact that the nucleotide sequence of VGAM574 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM574 RNA, herein designated VGAM RNA, may have a different number of host target binding sites in untranslated regions of a VGAM574 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM574 RNA, herein designated VGAM RNA, to host target binding sites on VGAM574 host target RNA, herein designated VGAM HOST TARGET RNA, such as BINDING SITE I, BINDING SITE II and BINDING SITE III, inhibits translation of VGAM574 host target RNA into VGAM574 host target protein, herein designated VGAM HOST TARGET PROTEIN.

VGAM host target protein is therefore outlined by a broken line.

It is appreciated that VGAM574 host target gene, herein designated VGAM HOST TARGET GENE, in fact represents a plurality of VGAM574 host target genes. The mRNA of each one of this plurality of VGAM574 host target genes comprises one or more host target binding sites, each having a nucleotide sequence which is at least partly complementary to VGAM574 RNA, herein designated VGAM RNA, and which when bound by VGAM574 RNA causes inhibition of translation of respective one or more VGAM574 host target proteins.

It is further appreciated by one skilled in the art that the mode of translational inhibition illustrated by FIG. 1 with specific reference to translational inhibition exerted by VGAM574 gene, herein designated VGAM GENE, on one or more VGAM574 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM574 is inhibition of expression of host target genes, as part of a novel viral mechanism of attacking a host. Accordingly, utilities of VGAM574 include diagnosis, prevention and treatment of viral infection by Fowlpox Virus. Specific functions, and accordingly utilities, of VGAM574 correlate with, and may be deduced from, the identity of the host target genes which VGAM574 binds and inhibits, and the function of these host target genes, as elaborated hereinbelow.

Nucleotide sequences of the VGAM574 precursor RNA, herein designated VGAM PRECURSOR RNA, and of the 'diced' VGAM574 RNA, herein designated VGAM RNA, and a schematic representation of the secondary folding of VGAM574 folded precursor RNA, herein designated VGAM FOLDED PRECURSOR RNA, of VGAM574 are further described hereinbelow with reference to Table 1.

Nucleotide sequences of host target binding sites, such as BINDING SITE-I, BINDING SITE-II and BINDING SITE-III of FIG. 1, found on VGAM574 host target RNA, and schematic representation of the complementarity of each of these host target binding sites to VGAM574 RNA, herein designated VGAM RNA, are described hereinbelow with reference to Table 2.

As mentioned hereinabove with reference to FIG. 1, a function of VGAM574 gene, herein designated VGAM is inhibition of expression of VGAM574 target genes. It is appreciated that specific functions, and accordingly utilities, of VGAM574 correlate with, and may be deduced from, the identity of the target genes which VGAM574 binds and inhibits, and the function of these target genes, as elaborated hereinbelow.

Ceroid-lipofuscinosis, Neuronal 5 (CLN5, Accession NM_006493) is a VGAM574 host target gene. CLN5 BINDING SITE is HOST TARGET binding site found in the 5' untranslated region of mRNA encoded by CLN5, corresponding to a HOST TARGET binding site such as BINDING SITE I, BINDING SITE II or BINDING SITE III. Table 2 illustrates the complementarity of the nucleotide sequences of CLN5 BINDING SITE, designated SEQ ID:13225, to the nucleotide sequence of VGAM574 RNA, herein designated VGAM RNA, also designated SEQ ID:3285.

A function of VGAM574 is therefore inhibition of Ceroid-lipofuscinosis, Neuronal 5 (CLN5, Accession NM_006493). Accordingly, utilities of VGAM574 include diagnosis, prevention and treatment of diseases and clinical conditions associated with CLN5. FLJ13646 (Accession NM_024584) is another VGAM574 host target gene. FLJ13646 BINDING SITE is HOST TARGET binding site found in the 3' untranslated region of mRNA encoded by FLJ13646, corresponding to a HOST TARGET binding site such as BINDING SITE I, BINDING SITE II or BINDING SITE III. Table 2 illustrates the complementarity of the nucleotide sequences of FLJ13646 BINDING SITE, designated SEQ ID:23810, to the nucleotide sequence of VGAM574 RNA, herein designated VGAM RNA, also designated SEQ ID:3285.

Another function of VGAM574 is therefore inhibition of FLJ13646 (Accession NM_024584). Accordingly, utilities of VGAM574 include diagnosis, prevention and treatment of diseases and clinical conditions associated with FLJ13646. KIAA1615 (Accession XM_044021) is another VGAM574 host target gene. KIAA1615 BINDING SITE is HOST TARGET binding site found in the 3' untranslated region of mRNA encoded by KIAA1615, corresponding to a HOST TARGET binding site such as BINDING SITE I, BINDING SITE II or BINDING SITE III. Table 2 illustrates the complementarity of the nucleotide sequences of KIAA1615 BINDING SITE, designated SEQ ID:34081, to the nucleotide sequence of VGAM574 RNA, herein designated VGAM RNA, also designated SEQ ID:3285.

Another function of VGAM574 is therefore inhibition of KIAA1615 (Accession XM_044021). Accordingly, utilities of VGAM574 include diagnosis, prevention and treatment of diseases and clinical conditions associated with KIAA1615. Solute Carrier Family 21 (organic anion transporter), Member 14 (SLC21A14, Accession NM_017435) is another VGAM574 host target gene. SLC21A14 BINDING SITE is HOST TARGET binding site found in the 3' untranslated region of mRNA encoded by SLC21A14, corresponding to a HOST TARGET binding site such as BINDING SITE I, BINDING SITE II or BINDING SITE III. Table 2 illustrates the complementarity of the nucleotide sequences of SLC21A14 BINDING SITE, designated SEQ ID:18891, to the nucleotide sequence of VGAM574 RNA, herein designated VGAM RNA, also designated SEQ ID:3285.

Another function of VGAM574 is therefore inhibition of Solute Carrier Family 21 (organic anion transporter), Member 14 (SLC21A14, Accession NM_017435). Accordingly, utilities of VGAM574 include diagnosis, prevention and treatment of diseases and clinical conditions associated with SLC21A14. LOC146229 (Accession XM_085387) is another VGAM574 host target gene. LOC146229 BINDING SITE is HOST TARGET binding site found in the 3' untranslated region of mRNA encoded by LOC146229, corresponding to a HOST TARGET binding site such as BINDING SITE I, BINDING SITE II or BINDING SITE III. Table 2 illustrates the complementarity of the nucleotide sequences of LOC146229 BINDING SITE, designated SEQ ID:38115, to the nucleotide sequence of VGAM574 RNA, herein designated VGAM RNA, also designated SEQ ID:3285.

Another function of VGAM574 is therefore inhibition of LOC146229 (Accession XM_085387). Accordingly, utilities of VGAM574 include diagnosis, prevention and treatment of diseases and clinical conditions associated with LOC146229. LOC92405 (Accession XM_044914) is another VGAM574 host target gene. LOC92405 BINDING SITE is HOST TARGET binding site found in the 3' untranslated region of mRNA encoded by LOC92405, corresponding to a HOST TARGET binding site such as BINDING SITE I, BINDING SITE II or BINDING SITE III. Table 2 illustrates the complementarity of the nucleotide sequences of LOC92405 BINDING SITE, designated SEQ ID:34303, to the nucleotide sequence of VGAM574 RNA, herein designated VGAM RNA, also designated SEQ ID:3285.

Another function of VGAM574 is therefore inhibition of LOC92405 (Accession XM_044914). Accordingly, utilities of VGAM574 include diagnosis, prevention and treatment of diseases and clinical conditions associated with LOC92405. FIG. 1 further provides a conceptual description of a novel bioinformatically detected viral gene of the present invention, referred to here as Viral Genomic Address Messenger 575 (VGAM575) viral gene, which modulates expression of respective host target genes thereof, the function and utility of which host target genes is known in the art.

VGAM575 is a novel bioinformatically detected regulatory, non protein coding, viral micro RNA (miRNA) gene. The method by which VGAM575 was detected is described hereinabove with reference to FIGS. 1-8.

VGAM575 gene, herein designated VGAM GENE, is a viral gene contained in the genome of Fowlpox Virus. VGAM575 host target gene, herein designated VGAM HOST TARGET GENE, is a human gene contained in the human genome.

VGAM575 gene encodes a VGAM575 precursor RNA, herein designated VGAM PRECURSOR RNA. Similar to other miRNA genes, and unlike most ordinary genes, VGAM575 precursor RNA does not encode a protein. A nucleotide sequence identical or highly similar to the nucleotide sequence of VGAM575 precursor RNA is designated SEQ ID:561, and is provided hereinbelow with reference to the sequence listing part. Nucleotide sequence SEQ ID:561 is located at position 159770 relative to the genome of Fowlpox Virus.

VGAM575 precursor RNA folds onto itself, forming VGAM575 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM575 folded precursor RNA into VGAM575 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM575 RNA is designated SEQ ID:3286, and is provided hereinbelow with reference to the sequence listing part.

VGAM575 host target gene, herein designated VGAM HOST TARGET GENE, encodes a corresponding messenger RNA, VGAM575 host target RNA, herein designated VGAM HOST TARGET RNA. VGAM575 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM575 RNA, herein designated VGAM RNA, binds complementarily to one or more host target binding sites located in untranslated regions of VGAM575 host target RNA, herein designated VGAM HOST TARGET RNA. This complementary binding is due to the fact that the nucleotide sequence of VGAM575 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM575 RNA, herein designated VGAM RNA, may have a different number of host target binding sites in untranslated regions of a VGAM575 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM575 RNA, herein designated VGAM RNA, to host target binding sites on VGAM575 host target RNA, herein designated VGAM HOST TARGET RNA, such as BINDING SITE I, BINDING SITE II and BINDING SITE III, inhibits translation of VGAM575 host target RNA into VGAM575 host target protein, herein designated VGAM HOST TARGET PROTEIN. VGAM host target protein is therefore outlined by a broken line.

It is appreciated that VGAM575 host target gene, herein designated VGAM HOST TARGET GENE, in fact represents a plurality of VGAM575 host target genes. The mRNA of each one of this plurality of VGAM575 host target genes comprises one or more host target binding sites, each having a nucleotide sequence which is at least partly complementary to VGAM575 RNA, herein designated VGAM RNA, and which when bound by VGAM575 RNA causes inhibition of translation of respective one or more VGAM575 host target proteins.

It is further appreciated by one skilled in the art that the mode of translational inhibition illustrated by FIG. 1 with specific reference to translational inhibition exerted by VGAM575 gene, herein designated VGAM GENE, on one or more VGAM575 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM575 is inhibition of expression of host target genes, as part of a novel viral mechanism of attacking a host. Accordingly, utilities of VGAM575 include diagnosis, prevention and treatment of viral infection by Fowlpox Virus. Specific functions, and accordingly utilities, of VGAM575 correlate with, and may be deduced from, the identity of the host target genes which VGAM575 binds and inhibits, and the function of these host target genes, as elaborated hereinbelow.

Nucleotide sequences of the VGAM575 precursor RNA, herein designated VGAM PRECURSOR RNA, and of the 'diced' VGAM575 RNA, herein designated VGAM RNA, and a schematic representation of the secondary folding of VGAM575 folded precursor RNA, herein designated VGAM FOLDED PRECURSOR RNA, of VGAM575 are further described hereinbelow with reference to Table 1.

Nucleotide sequences of host target binding sites, such as BINDING SITE-I, BINDING SITE-II and BINDING SITE-III of FIG. 1, found on VGAM575 host target RNA, and schematic representation of the complementarity of each of these host target binding sites to VGAM575 RNA, herein designated VGAM RNA, are described hereinbelow with reference to Table 2.

As mentioned hereinabove with reference to FIG. 1, a function of VGAM575 gene, herein designated VGAM is inhibition of expression of VGAM575 target genes. It is appreciated that specific functions, and accordingly utilities, of VGAM575 correlate with, and may be deduced from, the identity of the target genes which VGAM575 binds and inhibits, and the function of these target genes, as elaborated hereinbelow.

Contactin Associated Protein-like 2 (CNTNAP2, Accession NM_014141) is a VGAM575 host target gene. CNTNAP2 BINDING SITE is HOST TARGET binding site found in the 3' untranslated region of mRNA encoded by CNTNAP2, corresponding to a HOST TARGET binding site such as BINDING SITE I, BINDING SITE II or BINDING SITE III. Table 2 illustrates the complementarity of the nucleotide sequences of CNTNAP2 BINDING SITE, designated SEQ ID:15422, to the nucleotide sequence of VGAM575 RNA, herein designated VGAM RNA, also designated SEQ ID:3286.

A function of VGAM575 is therefore inhibition of Contactin Associated Protein-like 2 (CNTNAP2, Accession NM_014141). Accordingly, utilities of VGAM575 include diagnosis, prevention and treatment of diseases and clinical conditions associated with CNTNAP2. Eukaryotic Translation Initiation Factor 1A (EIF1A, Accession XM_114147) is another VGAM575 host target gene. EIF1A BINDING SITE is HOST TARGET binding site found in the 3' untranslated region of mRNA encoded by EIF1A, corresponding to a HOST TARGET binding site such as BINDING SITE I, BINDING SITE II or BINDING SITE III. Table 2 illustrates the complementarity of the nucleotide sequences of EIF1A BINDING SITE, designated SEQ ID:42723, to the nucleotide sequence of VGAM575 RNA, herein designated VGAM RNA, also designated SEQ ID:3286.

Another function of VGAM575 is therefore inhibition of Eukaryotic Translation Initiation Factor 1A (EIF1A, Accession XM_114147), a gene which seems to be required for maximal rate of protein biosynthesis. Accordingly, utilities of VGAM575 include diagnosis, prevention and treatment of diseases and clinical conditions associated with EIF1A. The function of EIF1A and its association with various diseases and clinical conditions, has been established by previous studies, as described hereinabove with reference to VGAM120. Hematopoietically Expressed Homeobox (HHEX, Accession NM_002729) is another VGAM575 host target gene. HHEX BINDING SITE is HOST TARGET binding site found in the 3' untranslated region of mRNA encoded by HHEX, corresponding to a HOST TARGET binding site such as BINDING SITE I, BINDING SITE II or BINDING SITE III. Table 2 illustrates the complementarity of the nucleotide sequences of HHEX BINDING SITE, designated SEQ ID:8595, to the nucleotide sequence of VGAM575 RNA, herein designated VGAM RNA, also designated SEQ ID:3286.

Another function of VGAM575 is therefore inhibition of Hematopoietically Expressed Homeobox (HHEX, Accession NM_002729), a gene which may play a role in hematopoietic differentiation. Accordingly, utilities of VGAM575 include diagnosis, prevention and treatment of diseases and clinical conditions associated with HHEX. The function of HHEX has been established by previous studies. Tanaka et al. (1999) found that rat HHEX functions as a transcriptional repressor in liver cells and may be involved in the differentiation and/or maintenance of the differentiated state in hepatocytes. The divergent homeobox gene HEX is expressed in the anterior visceral endoderm during early mouse development and in some adult tissues of endodermal origin, including liver and thyroid. d'Elia et al. (2002) analyzed HEX expression and subcellular localization in a series of 55 human thyroid tumors and in several tumor cell lines. HEX mRNA was detected by RT-PCR either in normal tissues or in thyroid adenomas and differentiated (papillary and follicular) carcinomas. HEX mRNA was also expressed in most undifferentiated carcinomas. In normal tissues and adenomas, HEX protein was present both in nucleus and cytoplasm. In contrast, both differentiated and undifferentiated carcinomas, as well as the tumor cell lines investigated, showed HEX protein only in the cytoplasm. These findings suggested that regulation of HEX entry in the nucleus of thyrocytes may represent a critical step during human thyroid tumorigenesis.

Full details of the abovementioned studies are described in the following publications, the disclosure of which are hereby incorporated by reference:

Tanaka, T.; Inazu, T.; Yamada, K.; Myint, Z.; Keng, V. W; Inoue, Y.; Taniguchi, N.; Noguchi, T.: cDNA cloning and expression of rat homeobox gene, Hex, and functional characterization of the protein. Biochem. J. 339:111-117, 1999; and D'Elia, A. V.; Tell, G.; Russo, D.; Arturi, F.; Puglisi, F.; Manfioletti, G.; Gattei, V.; Mack, D. L.; Cataldi, P.; Filetti, S.; Di Loreto, C.; Damante, G.: Expression and localization.

Further studies establishing the function and utilities of HHEX are found in John Hopkins OMIM database record ID 604420, and in sited publications numbered 7397-7402 listed in the bibliography section hereinbelow, which are also hereby incorporated by reference. DKFZp547H025 (Accession NM_020161) is another VGAM575 host target gene. DKFZp547H025 BINDING SITE is HOST TARGET binding site found in the 3' untranslated region of mRNA encoded by DKFZp547H025, corresponding to a HOST TARGET binding site such as BINDING SITE I, BINDING SITE II or BINDING SITE III. Table 2 illustrates the complementarity of the nucleotide sequences of DKFZp547H025 BINDING SITE, designated SEQ ID:21372, to the nucleotide sequence of VGAM575 RNA, herein designated VGAM RNA, also designated SEQ ID:3286.

Another function of VGAM575 is therefore inhibition of DKFZp547H025 (Accession NM_020161). Accordingly, utilities of VGAM575 include diagnosis, prevention and treatment of diseases and clinical conditions associated with DKFZp547H025. DKFZp761B0514 (Accession NM_032289) is another VGAM575 host target gene. DKFZp761B0514 BINDING SITE is HOST TARGET binding site found in the 3' untranslated region of mRNA encoded by DKFZp761B0514, corresponding to a HOST TARGET binding site such as BINDING SITE I, BINDING SITE II or BINDING SITE III. Table 2 illustrates the complementarity of the nucleotide sequences of DKFZp761B0514 BINDING SITE, designated SEQ ID:26050, to the nucleotide sequence of VGAM575 RNA, herein designated VGAM RNA, also designated SEQ ID:3286.

Another function of VGAM575 is therefore inhibition of DKFZp761B0514 (Accession NM_032289). Accordingly, utilities of VGAM575 include diagnosis, prevention and treatment of diseases and clinical conditions associated with DKFZp761B0514. Eukaryotic Translation Initiation Factor 2, Subunit 1 Alpha, 35 kDa (EIF2S1, Accession NM_004094) is another VGAM575 host target gene. EIF2S1 BINDING SITE is HOST TARGET binding site found in the 3' untranslated region of mRNA encoded by EIF2S1, corresponding to a HOST TARGET binding site such as BINDING SITE I, BINDING SITE II or BINDING SITE III. Table 2 illustrates the complementarity of the nucleotide sequences of EIF2S1 BINDING SITE, designated SEQ ID:10299, to the nucleotide sequence of VGAM575 RNA, herein designated VGAM RNA, also designated SEQ ID:3286.

Another function of VGAM575 is therefore inhibition of Eukaryotic Translation Initiation Factor 2, Subunit 1 Alpha, 35 kDa (EIF2S1, Accession NM_004094). Accordingly, utilities of VGAM575 include diagnosis, prevention and treatment of diseases and clinical conditions associated with EIF2S1. KIAA0008 (Accession NM_014750) is another VGAM575 host target gene. KIAA0008 BINDING SITE is HOST TARGET binding site found in the 5' untranslated region of mRNA encoded by KIAA0008, corresponding to a HOST TARGET binding site such as BINDING SITE I, BINDING SITE II or BINDING SITE III. Table 2 illustrates the complementarity of the nucleotide sequences of KIAA0008 BINDING SITE, designated SEQ ID:16461, to the nucleotide sequence of VGAM575 RNA, herein designated VGAM RNA, also designated SEQ ID:3286.

Another function of VGAM575 is therefore inhibition of KIAA0008 (Accession NM_014750). Accordingly, utilities of VGAM575 include diagnosis, prevention and treatment of diseases and clinical conditions associated with KIAA0008. KIAA1673 (Accession XM_047672) is another VGAM575 host target gene. KIAA1673 BINDING SITE is HOST TARGET binding site found in the 3' untranslated region of mRNA encoded by KIAA1673, corresponding to a HOST TARGET binding site such as BINDING SITE I, BINDING SITE II or BINDING SITE III. Table 2 illustrates the complementarity of the nucleotide sequences of KIAA1673 BINDING SITE, designated SEQ ID:35026, to the nucleotide sequence of VGAM575 RNA, herein designated VGAM RNA, also designated SEQ ID:3286.

Another function of VGAM575 is therefore inhibition of KIAA1673 (Accession XM_047672). Accordingly, utilities of VGAM575 include diagnosis, prevention and treatment of diseases and clinical conditions associated with KIAA1673. KIAA1911 (Accession XM_056302) is another VGAM575 host target gene. KIAA1911 BINDING SITE is HOST TARGET binding site found in the 3' untranslated region of mRNA encoded by KIAA1911, corresponding to a HOST TARGET binding site such as BINDING SITE I, BINDING SITE II or BINDING SITE III. Table 2 illustrates the complementarity of the nucleotide sequences of KIAA1911 BINDING SITE, designated SEQ ID:36392, to the nucleotide sequence of VGAM575 RNA, herein designated VGAM RNA, also designated SEQ ID:3286.

Another function of VGAM575 is therefore inhibition of KIAA1911 (Accession XM_056302). Accordingly, utilities of VGAM575 include diagnosis, prevention and treatment of diseases and clinical conditions associated with KIAA1911. Signal Sequence Receptor, Gamma (translocon-associated protein gamma) (SSR3, Accession NM_007107) is another VGAM575 host target gene. SSR3 BINDING SITE is HOST TARGET binding site found in the 3' untranslated region of mRNA encoded by SSR3, corresponding to a HOST TARGET binding site such as BINDING SITE I, BINDING SITE II or BINDING SITE III. Table 2 illustrates the complementarity of the nucleotide sequences of SSR3 BINDING SITE, designated SEQ ID:13974, to the nucleotide sequence of VGAM575 RNA, herein designated VGAM RNA, also designated SEQ ID:3286.

Another function of VGAM575 is therefore inhibition of Signal Sequence Receptor, Gamma (translocon-associated protein gamma) (SSR3, Accession NM_007107). Accordingly, utilities of VGAM575 include diagnosis, prevention and treatment of diseases and clinical conditions associated with SSR3. LOC147341 (Accession XM_097223) is another VGAM575 host target gene. LOC147341 BINDING SITE is HOST TARGET binding site found in the 5' untranslated region of mRNA encoded by LOC147341, corresponding to a HOST TARGET binding site such as BINDING SITE I, BINDING SITE II or BINDING SITE III. Table 2 illustrates the complementarity of the nucleotide sequences of LOC147341 BINDING SITE, designated SEQ ID:40829, to the nucleotide sequence of VGAM575 RNA, herein designated VGAM RNA, also designated SEQ ID:3286.

Another function of VGAM575 is therefore inhibition of LOC147341 (Accession XM_097223). Accordingly, utilities of VGAM575 include diagnosis, prevention and treatment of diseases and clinical conditions associated with LOC147341. LOC148195 (Accession XM_097419) is another VGAM575 host target gene. LOC148195 BINDING SITE is HOST TARGET binding site found in the 3' untranslated region of mRNA encoded by LOC148195, corresponding to a HOST TARGET binding site such as BINDING SITE I, BINDING SITE II or BINDING SITE III. Table 2 illustrates the complementarity of the nucleotide sequences of LOC148195 BINDING SITE, designated SEQ ID:40875, to the nucleotide sequence of VGAM575 RNA, herein designated VGAM RNA, also designated SEQ ID:3286.

Another function of VGAM575 is therefore inhibition of LOC148195 (Accession XM_097419). Accordingly, utilities of VGAM575 include diagnosis, prevention and treatment of diseases and clinical conditions associated with LOC148195. LOC158819 (Accession XM_098995) is another VGAM575 host target gene. LOC158819 BINDING SITE is HOST TARGET binding site found in the 5' untranslated region of mRNA encoded by LOC158819, corresponding to a HOST TARGET binding site such as BINDING SITE I, BINDING SITE II or BINDING SITE III. Table 2 illustrates the complementarity of the nucleotide sequences of LOC158819 BINDING SITE, designated SEQ ID:42028, to the nucleotide sequence of VGAM575 RNA, herein designated VGAM RNA, also designated SEQ ID:3286.

Another function of VGAM575 is therefore inhibition of LOC158819 (Accession XM_098995). Accordingly, utilities of VGAM575 include diagnosis, prevention and treatment of diseases and clinical conditions associated with LOC158819. LOC51026 (Accession NM_016072) is another VGAM575 host target gene. LOC51026 BINDING SITE is HOST TARGET binding site found in the 3' untranslated region of mRNA encoded by LOC51026, corresponding to a HOST TARGET binding site such as BINDING SITE I, BINDING SITE II or BINDING SITE III. Table 2 illustrates the complementarity of the nucleotide sequences of LOC51026 BINDING SITE, designated SEQ ID:18141, to the nucleotide sequence of VGAM575 RNA, herein designated VGAM RNA, also designated SEQ ID:3286.

Another function of VGAM575 is therefore inhibition of LOC51026 (Accession NM_016072). Accordingly, utilities of VGAM575 include diagnosis, prevention and treatment of diseases and clinical conditions associated with LOC51026. LOC91035 (Accession XM_035622) is another VGAM575 host target gene. LOC91035 BINDING SITE is HOST TARGET binding site found in the 5' untranslated region of mRNA encoded by LOC91035, corresponding to a HOST TARGET binding site such as BINDING SITE I, BINDING SITE II or BINDING SITE III. Table 2 illustrates the complementarity of the nucleotide sequences of LOC91035 BINDING SITE, designated SEQ ID:32291, to the nucleotide sequence of VGAM575 RNA, herein designated VGAM RNA, also designated SEQ ID:3286.

Another function of VGAM575 is therefore inhibition of LOC91035 (Accession XM_035622). Accordingly, utilities of VGAM575 include diagnosis, prevention and treatment of diseases and clinical conditions associated with LOC91035. FIG. 1 further provides a conceptual description of a novel bioinformatically detected viral gene of the present invention, referred to here as Viral Genomic Address Messenger 576 (VGAM576) viral gene, which modulates expression of respective host target genes thereof, the function and utility of which host target genes is known in the art.

VGAM576 is a novel bioinformatically detected regulatory, non protein coding, viral micro RNA (miRNA) gene. The method by which VGAM576 was detected is described hereinabove with reference to FIGS. 1-8.

VGAM576 gene, herein designated VGAM GENE, is a viral gene contained in the genome of Fowlpox Virus. VGAM576 host target gene, herein designated VGAM HOST TARGET GENE, is a human gene contained in the human genome.

VGAM576 gene encodes a VGAM576 precursor RNA, herein designated VGAM PRECURSOR RNA. Similar to other miRNA genes, and unlike most ordinary genes, VGAM576 precursor RNA does not encode a protein. A nucleotide sequence identical or highly similar to the nucleotide sequence of VGAM576 precursor RNA is designated SEQ ID:562, and is provided hereinbelow with reference to the sequence listing part. Nucleotide sequence SEQ ID:562 is located at position 160178 relative to the genome of Fowlpox Virus.

VGAM576 precursor RNA folds onto itself, forming VGAM576 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM576 folded precursor RNA into VGAM576 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM576 RNA is designated SEQ ID:3287, and is provided hereinbelow with reference to the sequence listing part.

VGAM576 host target gene, herein designated VGAM HOST TARGET GENE, encodes a corresponding messenger RNA, VGAM576 host target RNA, herein designated VGAM HOST TARGET RNA. VGAM576 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM576 RNA, herein designated VGAM RNA, binds complementarily to one or more host target binding sites located in untranslated regions of VGAM576 host target RNA, herein designated VGAM HOST TARGET RNA. This complementary binding is due to the fact that the nucleotide sequence of VGAM576 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM576 RNA, herein designated VGAM RNA, may have a different number of host target binding sites in untranslated regions of a VGAM576 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM576 RNA, herein designated VGAM RNA, to host target binding sites on VGAM576 host target RNA, herein designated VGAM HOST TARGET RNA, such as BINDING SITE I, BINDING SITE II and BINDING SITE III, inhibits translation of VGAM576 host target RNA into VGAM576 host target protein, herein designated VGAM HOST TARGET PROTEIN. VGAM host target protein is therefore outlined by a broken line.

It is appreciated that VGAM576 host target gene, herein designated VGAM HOST TARGET GENE, in fact represents a plurality of VGAM576 host target genes. The mRNA of each one of this plurality of VGAM576 host target genes comprises one or more host target binding sites, each having a nucleotide sequence which is at least partly complementary to VGAM576 RNA, herein designated VGAM RNA, and which when bound by VGAM576 RNA causes inhibition of translation of respective one or more VGAM576 host target proteins.

It is further appreciated by one skilled in the art that the mode of translational inhibition illustrated by FIG. 1 with specific reference to translational inhibition exerted by VGAM576 gene, herein designated VGAM GENE, on one or more VGAM576 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM576 is inhibition of expression of host target genes, as part of a novel viral mechanism of attacking a host. Accordingly, utilities of VGAM576 include diagnosis, prevention and treatment of viral infection by Fowlpox Virus. Specific functions, and accordingly utilities, of VGAM576 correlate with, and may be deduced from, the identity of the host target genes which VGAM576 binds and inhibits, and the function of these host target genes, as elaborated hereinbelow.

Nucleotide sequences of the VGAM576 precursor RNA, herein designated VGAM PRECURSOR RNA, and of the 'diced' VGAM576 RNA, herein designated VGAM RNA, and a schematic representation of the secondary folding of VGAM576 folded precursor RNA, herein designated VGAM FOLDED PRECURSOR RNA, of VGAM576 are further described hereinbelow with reference to Table 1.

Nucleotide sequences of host target binding sites, such as BINDING SITE-I, BINDING SITE-II and BINDING SITE-III of FIG. 1, found on VGAM576 host target RNA, and schematic representation of the complementarity of each of these host target binding sites to VGAM576 RNA, herein designated VGAM RNA, are described hereinbelow with reference to Table 2.

As mentioned hereinabove with reference to FIG. 1, a function of VGAM576 gene, herein designated VGAM is inhibition of expression of VGAM576 target genes. It is appreciated that specific functions, and accordingly utilities, of VGAM576 correlate with, and may be deduced from, the identity of the target genes which VGAM576 binds and inhibits, and the function of these target genes, as elaborated hereinbelow.

Sorbitol Dehydrogenase (SORD, Accession NM_003104) is a VGAM576 host target gene. SORD BINDING SITE is HOST TARGET binding site found in the 3' untranslated region of mRNA encoded by SORD, corresponding to a HOST TARGET binding site such as BINDING SITE I, BINDING SITE II or BINDING SITE III. Table 2 illustrates the complementarity of the nucleotide sequences of SORD BINDING SITE, designated SEQ ID:9069, to the nucleotide sequence of VGAM576 RNA, herein designated VGAM RNA, also designated SEQ ID:3287.

A function of VGAM576 is therefore inhibition of Sorbitol Dehydrogenase (SORD, Accession NM_003104). Accordingly, utilities of VGAM576 include diagnosis, prevention and treatment of diseases and clinical conditions associated with SORD. Wilms Tumor 1 (WT1, Accession NM_024424) is another VGAM576 host target gene. WT1 BINDING SITE1 through WT1 BINDING SITE4 are HOST TARGET binding sites found in untranslated regions of mRNA encoded by WT1, corresponding to HOST TARGET binding sites such as BINDING SITE I, BINDING SITE II or BINDING SITE III. Table 2 illustrates the complementarity of the nucleotide sequences of WT1 BINDING SITE1 through WT1 BINDING SITE4, designated SEQ ID:23666, SEQ ID:5950, SEQ ID:23670 and SEQ ID:23674 respectively, to the nucleotide sequence of VGAM576 RNA, herein designated VGAM RNA, also designated SEQ ID:3287.

Another function of VGAM576 is therefore inhibition of Wilms Tumor 1 (WT1, Accession NM_024424). Accordingly, utilities of VGAM576 include diagnosis, prevention and treatment of diseases and clinical conditions associated with WT1. FLJ11011 (Accession NM_018299) is another VGAM576 host target gene. FLJ11011 BINDING SITE is HOST TARGET binding site found in the 3' untranslated region of mRNA encoded by FLJ11011, corresponding to a HOST TARGET binding site such as BINDING SITE I, BINDING SITE II or BINDING SITE III. Table 2 illustrates the complementarity of the nucleotide sequences of FLJ11011 BINDING SITE, designated SEQ ID:20290, to the nucleotide sequence of VGAM576 RNA, herein designated VGAM RNA, also designated SEQ ID:3287.

Another function of VGAM576 is therefore inhibition of FLJ11011 (Accession NM_018299). Accordingly, utilities of VGAM576 include diagnosis, prevention and treatment of diseases and clinical conditions associated with FLJ11011. FLJ20802 (Accession NM_017959) is another VGAM576 host target gene. FLJ20802 BINDING SITE is HOST TARGET binding site found in the 3' untranslated region of mRNA encoded by FLJ20802, corresponding to a HOST TARGET binding site such as BINDING SITE I, BINDING SITE II or BINDING SITE III. Table 2 illustrates the complementarity of the nucleotide sequences of FLJ20802 BINDING SITE, designated SEQ ID:19673, to the nucleotide sequence of VGAM576 RNA, herein designated VGAM RNA, also designated SEQ ID:3287.

Another function of VGAM576 is therefore inhibition of FLJ20802 (Accession NM_017959). Accordingly, utilities of VGAM576 include diagnosis, prevention and treatment of diseases and clinical conditions associated with FLJ20802. KIAA1396 (Accession XM_032054) is another VGAM576 host target gene. KIAA1396 BINDING SITE is HOST TARGET binding site found in the 3' untranslated region of mRNA encoded by KIAA1396, corresponding to a HOST TARGET binding site such as BINDING SITE I, BINDING SITE II or BINDING SITE III. Table 2 illustrates the complementarity of the nucleotide sequences of KIAA1396 BINDING SITE, designated SEQ ID:31547, to the nucleotide sequence of VGAM576 RNA, herein designated VGAM RNA, also designated SEQ ID:3287.

Another function of VGAM576 is therefore inhibition of KIAA1396 (Accession XM_032054). Accordingly, utilities of VGAM576 include diagnosis, prevention and treatment of diseases and clinical conditions associated with KIAA1396. LOC116166 (Accession XM_007651) is another VGAM576 host target gene. LOC116166 BINDING SITE is HOST TARGET binding site found in the 3' untranslated region of mRNA encoded by LOC116166, corresponding to a HOST TARGET binding site such as BINDING SITE I, BINDING SITE II or BINDING SITE III. Table 2 illustrates the complementarity of the nucleotide sequences of LOC116166 BINDING SITE, designated SEQ ID:30059, to the nucleotide sequence of VGAM576 RNA, herein designated VGAM RNA, also designated SEQ ID:3287.

Another function of VGAM576 is therefore inhibition of LOC116166 (Accession XM_007651). Accordingly, utilities of VGAM576 include diagnosis, prevention and treatment of diseases and clinical conditions associated with LOC116166. LOC201696 (Accession XM_032269) is another VGAM576 host target gene. LOC201696 BINDING SITE is HOST TARGET binding site found in the 3' untranslated region of mRNA encoded by LOC201696, corresponding to a HOST TARGET binding site such as BINDING SITE I, BINDING SITE II or BINDING SITE III. Table 2 illustrates the complementarity of the nucleotide sequences of LOC201696 BINDING SITE, designated SEQ ID:31624, to the nucleotide sequence of VGAM576 RNA, herein designated VGAM RNA, also designated SEQ ID:3287.

Another function of VGAM576 is therefore inhibition of LOC201696 (Accession XM_032269). Accordingly, utilities of VGAM576 include diagnosis, prevention and treatment of diseases and clinical conditions associated with LOC201696. LOC254266 (Accession XM_173221) is another VGAM576 host target gene. LOC254266 BINDING SITE is HOST TARGET binding site found in the 5' untranslated region of mRNA encoded by LOC254266, corresponding to a HOST TARGET binding site such as BINDING SITE I, BINDING SITE II or BINDING SITE III. Table 2 illustrates the complementarity of the nucleotide sequences of LOC254266 BINDING SITE, designated SEQ ID:46479, to the nucleotide sequence of VGAM576 RNA, herein designated VGAM RNA, also designated SEQ ID:3287.

Another function of VGAM576 is therefore inhibition of LOC254266 (Accession XM_173221). Accordingly, utilities of VGAM576 include diagnosis, prevention and treatment of diseases and clinical conditions associated with LOC254266. FIG. 1 further provides a conceptual description of a novel bioinformatically detected viral gene of the present invention, referred to here as Viral Genomic Address Messenger 577 (VGAM577) viral gene, which modulates expression of respective host target genes thereof, the function and utility of which host target genes is known in the art.

VGAM577 is a novel bioinformatically detected regulatory, non protein coding, viral micro RNA (miRNA) gene. The method by which VGAM577 was detected is described hereinabove with reference to FIGS. 1-8.

VGAM577 gene, herein designated VGAM GENE, is a viral gene contained in the genome of Fowlpox Virus. VGAM577 host target gene, herein designated VGAM HOST TARGET GENE, is a human gene contained in the human genome.

VGAM577 gene encodes a VGAM577 precursor RNA, herein designated VGAM PRECURSOR RNA. Similar to other miRNA genes, and unlike most ordinary genes, VGAM577 precursor RNA does not encode a protein. A nucleotide sequence identical or highly similar to the nucleotide sequence of VGAM577 precursor RNA is designated SEQ ID:563, and is provided hereinbelow with reference to the sequence listing part. Nucleotide sequence SEQ ID:563 is located at position 170504 relative to the genome of Fowlpox Virus.

VGAM577 precursor RNA folds onto itself, forming VGAM577 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM577 folded precursor RNA into VGAM577 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM577 RNA is designated SEQ ID:3288, and is provided hereinbelow with reference to the sequence listing part.

VGAM577 host target gene, herein designated VGAM HOST TARGET GENE, encodes a corresponding messenger RNA, VGAM577 host target RNA, herein designated VGAM HOST TARGET RNA. VGAM577 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM577 RNA, herein designated VGAM RNA, binds complementarily to one or more host target binding sites located in untranslated regions of VGAM577 host target RNA, herein designated VGAM HOST TARGET RNA. This complementary binding is due to the fact that the nucleotide sequence of VGAM577 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM577 RNA, herein designated VGAM RNA, may have a different number of host target binding sites in untranslated regions of a VGAM577 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM577 RNA, herein designated VGAM RNA, to host target binding sites on VGAM577 host target RNA, herein designated VGAM HOST TARGET RNA, such as BINDING SITE I, BINDING SITE II and BINDING SITE III, inhibits translation of VGAM577 host target RNA into VGAM577 host target protein, herein designated VGAM HOST TARGET PROTEIN. VGAM host target protein is therefore outlined by a broken line.

It is appreciated that VGAM577 host target gene, herein designated VGAM HOST TARGET GENE, in fact represents a plurality of VGAM577 host target genes. The mRNA of each one of this plurality of VGAM577 host target genes comprises one or more host target binding sites, each having a nucleotide sequence which is at least partly complementary to VGAM577 RNA, herein designated VGAM RNA, and which when bound by VGAM577 RNA causes inhibition of translation of respective one or more VGAM577 host target proteins.

It is further appreciated by one skilled in the art that the mode of translational inhibition illustrated by FIG. 1 with specific reference to translational inhibition exerted by VGAM577 gene, herein designated VGAM GENE, on one or more VGAM577 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM577 is inhibition of expression of host target genes, as part of a novel viral mechanism of attacking a host. Accordingly, utilities of VGAM577 include diagnosis, prevention and treatment of viral infection by Fowlpox Virus. Specific functions, and accordingly utilities, of VGAM577 correlate with, and may be deduced from, the identity of the host target genes which VGAM577 binds and inhibits, and the function of these host target genes, as elaborated hereinbelow.

Nucleotide sequences of the VGAM577 precursor RNA, herein designated VGAM PRECURSOR RNA, and of the 'diced' VGAM577 RNA, herein designated VGAM RNA, and a schematic representation of the secondary folding of VGAM577 folded precursor RNA, herein designated VGAM FOLDED PRECURSOR RNA, of VGAM577 are further described hereinbelow with reference to Table 1.

Nucleotide sequences of host target binding sites, such as BINDING SITE-I, BINDING SITE-II and BINDING SITE-III of FIG. 1, found on VGAM577 host target RNA, and schematic representation of the complementarity of each of these host target binding sites to VGAM577 RNA, herein designated VGAM RNA, are described hereinbelow with reference to Table 2.

As mentioned hereinabove with reference to FIG. 1, a function of VGAM577 gene, herein designated VGAM is inhibition of expression of VGAM577 target genes. It is appreciated that specific functions, and accordingly utilities, of VGAM577 correlate with, and may be deduced from, the identity of the target genes which VGAM577 binds and inhibits, and the function of these target genes, as elaborated hereinbelow.

TOX (Accession NM_014729) is a VGAM577 host target gene. TOX BINDING SITE is HOST TARGET binding site found in the 3' untranslated region of mRNA encoded by TOX, corresponding to a HOST TARGET binding site such as BINDING SITE I, BINDING SITE II or BINDING SITE III. Table 2 illustrates the complementarity of the nucleotide sequences of TOX BINDING SITE, designated SEQ ID:16325, to the nucleotide sequence of VGAM577 RNA, herein designated VGAM RNA, also designated SEQ ID:3288.

A function of VGAM577 is therefore inhibition of TOX (Accession NM_014729). Accordingly, utilities of VGAM577 include diagnosis, prevention and treatment of diseases and clinical conditions associated with TOX. Ubiquitin-like 3 (UBL3, Accession NM_007106) is another VGAM577 host target gene. UBL3 BINDING SITE is HOST TARGET binding site found in the 3' untranslated region of mRNA encoded by UBL3, corresponding to a HOST TARGET binding site such as BINDING SITE I, BINDING SITE II or BINDING SITE III. Table 2 illustrates the complementarity of the nucleotide sequences of UBL3 BINDING SITE, designated SEQ ID:13965, to the nucleotide sequence of VGAM577 RNA, herein designated VGAM RNA, also designated SEQ ID:3288.

Another function of VGAM577 is therefore inhibition of Ubiquitin-like 3 (UBL3, Accession NM_007106), a gene which appears to have a diverse range of cellular functions. Accordingly, utilities of VGAM577 include diagnosis, prevention and treatment of diseases and clinical conditions associated with UBL3. The function of UBL3 and its association with various diseases and clinical conditions, has been established by previous studies, as described hereinabove with reference to VGAM459. DKFZP547E2110 (Accession XM_165676) is another VGAM577 host target gene. DKFZP547E2110 BINDING SITE is HOST TARGET binding site found in the 3' untranslated region of mRNA encoded by DKFZP547E2110, corresponding to a HOST TARGET binding site such as BINDING SITE I, BINDING SITE II or BINDING SITE III. Table 2 illustrates the complementarity of the nucleotide sequences of DKFZP547E2110 BINDING SITE, designated SEQ ID:43731, to the nucleotide sequence of VGAM577 RNA, herein designated VGAM RNA, also designated SEQ ID:3288.

Another function of VGAM577 is therefore inhibition of DKFZP547E2110 (Accession XM_165676). Accordingly, utilities of VGAM577 include diagnosis, prevention and treatment of diseases and clinical conditions associated with DKFZP547E2110. FLJ10352 (Accession NM_032142) is another VGAM577 host target gene. FLJ10352 BINDING SITE is HOST TARGET binding site found in the 3' untranslated region of mRNA encoded by FLJ10352, corresponding to a HOST TARGET binding site such as BINDING SITE I, BINDING SITE II or BINDING SITE III. Table 2 illustrates the complementarity of the nucleotide sequences of FLJ10352 BINDING SITE, designated SEQ ID:25828, to the nucleotide sequence of VGAM577 RNA, herein designated VGAM RNA, also designated SEQ ID:3288.

Another function of VGAM577 is therefore inhibition of FLJ10352 (Accession NM_032142). Accordingly, utilities of VGAM577 include diagnosis, prevention and treatment of diseases and clinical conditions associated with FLJ10352. KIAA1028 (Accession XM_166324) is another VGAM577 host target gene. KIAA1028 BINDING SITE is HOST TARGET binding site found in the 3' untranslated region of mRNA encoded by KIAA1028, corresponding to a HOST TARGET binding site such as BINDING SITE I, BINDING SITE II or BINDING SITE III. Table 2 illustrates the complementarity of the nucleotide sequences of KIAA1028 BINDING SITE, designated SEQ ID:44166, to the nucleotide sequence of VGAM577 RNA, herein designated VGAM RNA, also designated SEQ ID:3288.

Another function of VGAM577 is therefore inhibition of KIAA1028 (Accession XM_166324). Accordingly, utilities of VGAM577 include diagnosis, prevention and treatment of diseases and clinical conditions associated with KIAA1028.

FIG. 1 further provides a conceptual description of a novel bioinformatically detected viral gene of the present invention, referred to here as Viral Genomic Address Messenger 578 (VGAM578) viral gene, which modulates expression of respective host target genes thereof, the function and utility of which host target genes is known in the art.

VGAM578 is a novel bioinformatically detected regulatory, non protein coding, viral micro RNA (miRNA) gene. The method by which VGAM578 was detected is described hereinabove with reference to FIGS. 1-8.

VGAM578 gene, herein designated VGAM GENE, is a viral gene contained in the genome of Fowlpox Virus. VGAM578 host target gene, herein designated VGAM HOST TARGET GENE, is a human gene contained in the human genome.

VGAM578 gene encodes a VGAM578 precursor RNA, herein designated VGAM PRECURSOR RNA. Similar to other miRNA genes, and unlike most ordinary genes, VGAM578 precursor RNA does not encode a protein. A nucleotide sequence identical or highly similar to the nucleotide sequence of VGAM578 precursor RNA is designated SEQ ID:564, and is provided hereinbelow with reference to the sequence listing part. Nucleotide sequence SEQ ID:564 is located at position 168962 relative to the genome of Fowlpox Virus.

VGAM578 precursor RNA folds onto itself, forming VGAM578 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM578 folded precursor RNA into VGAM578 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM578 RNA is designated SEQ ID:3289, and is provided hereinbelow with reference to the sequence listing part.

VGAM578 host target gene, herein designated VGAM HOST TARGET GENE, encodes a corresponding messenger RNA, VGAM578 host target RNA, herein designated VGAM HOST TARGET RNA. VGAM578 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM578 RNA, herein designated VGAM RNA, binds complementarily to one or more host target binding sites located in untranslated regions of VGAM578 host target RNA, herein designated VGAM HOST TARGET RNA. This complementary binding is due to the fact that the nucleotide sequence of VGAM578 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM578 RNA, herein designated VGAM RNA, may have a different number of host target binding sites in untranslated regions of a VGAM578 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM578 RNA, herein designated VGAM RNA, to host target binding sites on VGAM578 host target RNA, herein designated VGAM HOST TARGET RNA, such as BINDING SITE I, BINDING SITE II and BINDING SITE III, inhibits translation of VGAM578 host target RNA into VGAM578 host target protein, herein designated VGAM HOST TARGET PROTEIN. VGAM host target protein is therefore outlined by a broken line.

It is appreciated that VGAM578 host target gene, herein designated VGAM HOST TARGET GENE, in fact represents a plurality of VGAM578 host target genes. The mRNA of each one of this plurality of VGAM578 host target genes comprises one or more host target binding sites, each having a nucleotide sequence which is at least partly complementary to VGAM578 RNA, herein designated VGAM RNA, and which when bound by VGAM578 RNA causes inhibition of translation of respective one or more VGAM578 host target proteins.

It is further appreciated by one skilled in the art that the mode of translational inhibition illustrated by FIG. 1 with specific reference to translational inhibition exerted by VGAM578 gene, herein designated VGAM GENE, on one or more VGAM578 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM578 is inhibition of expression of host target genes, as part of a novel viral mechanism of attacking a host. Accordingly, utilities of VGAM578 include diagnosis, prevention and treatment of viral infection by Fowlpox Virus. Specific functions, and accordingly utilities, of VGAM578 correlate with, and may be deduced from, the identity of the host target genes which VGAM578 binds and inhibits, and the function of these host target genes, as elaborated hereinbelow.

Nucleotide sequences of the VGAM578 precursor RNA, herein designated VGAM PRECURSOR RNA, and of the 'diced' VGAM578 RNA, herein designated VGAM RNA, and a schematic representation of the secondary folding of VGAM578 folded precursor RNA, herein designated VGAM FOLDED PRECURSOR RNA, of VGAM578 are further described hereinbelow with reference to Table 1.

Nucleotide sequences of host target binding sites, such as BINDING SITE-I, BINDING SITE-II and BINDING SITE-III of FIG. 1, found on VGAM578 host target RNA, and schematic representation of the complementarity of each of these host target binding sites to VGAM578 RNA, herein designated VGAM RNA, are described hereinbelow with reference to Table 2.

As mentioned hereinabove with reference to FIG. 1, a function of VGAM578 gene, herein designated VGAM is inhibition of expression of VGAM578 target genes. It is appreciated that specific functions, and accordingly utilities, of VGAM578 correlate with, and may be deduced from, the identity of the target genes which VGAM578 binds and inhibits, and the function of these target genes, as elaborated hereinbelow.

Calcium/calmodulin-dependent Protein Kinase IV (CAMK4, Accession NM_001744) is a VGAM578 host target gene. CAMK4 BINDING SITE is HOST TARGET binding site found in the 3' untranslated region of mRNA encoded by CAMK4, corresponding to a HOST TARGET binding site such as BINDING SITE I, BINDING SITE II or BINDING SITE III. Table 2 illustrates the complementarity of the nucleotide sequences of CAMK4 BINDING SITE, designated SEQ ID:7482, to the nucleotide sequence of VGAM578 RNA, herein designated VGAM RNA, also designated SEQ ID:3289.

A function of VGAM578 is therefore inhibition of Calcium/calmodulin-dependent Protein Kinase IV (CAMK4, Accession NM_001744), a gene which is a heat-stable, acidic, calmodulin-binding protein. Accordingly, utilities of VGAM578 include diagnosis, prevention and treatment of diseases and clinical conditions associated with CAMK4. The function of CAMK4 has been established by previous studies. Protein phosphorylation, a prominent activity in the brain, apparently plays an important role in several neural functions such as neural transmitter release, ion channel modulation, and axoplasmic transport. Sikela et al. (1989) identified cDNA clones corresponding to a brain Ca (2+)/calmodulin-dependent protein kinase, which they referred to as brain CaM kinase IV (CAMK4). On the basis of Western blot analysis, this kinase appeared to be restricted to brain in the rat; interestingly, it was not detected in the brain of the newborn, but became detectable within a few days after birth. Animal model experiments lend further support to the function of CAMK4. Camk4 is a multifunctional serine/threonine protein kinase with limited tissue distribution that has been implicated in transcriptional regulation in lymphocytes, neurons, and male germ cells. In the mouse testis, however, Camk4 is expressed in spermatids and associated with chromatin and nuclear matrix. Elongating spermatids are not transcriptionally active, raising the possibility that Camk4 has a novel function in male germ cells. To investigate the role of Camk4 in spermatogenesis, Wu et al. (2000) generated mice with a targeted deletion of the Camk4 gene. Male Camk4 -/- mice were infertile with impairment of spermiogenesis in late elongating spermatids. The sequential deposition of sperm basic nuclear proteins on chromatin was disrupted, with a specific loss of protamine-2 (OMIM Ref. No. 182890) and prolonged retention of transition protein-2 (OMIM Ref. No. 190232) in step-15 spermatids. Protamine-2 is phosphorylated by Camk4 in vitro, implicating a connection between Camk4 signaling and the exchange of basic nuclear proteins in mammalian male germ cells. Defects in protamine-2 have been identified in sperm of infertile men, suggesting that the results of Wu et al. (2000) may have clinical implications for the understanding of human male infertility.

It is appreciated that the abovementioned animal model for CAMK4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sikela, J. M.; Law, M. L.; Kao, F.-T.; Hartz, J. A.; Wei, Q.; Hahn, W. E.: Chromosomal localization of the human gene for brain Ca (2+)/calmodulin-dependent protein kinase type IV. Genomics 4:21-27, 1989; and Wu, J. Y.; Ribar, T. J.; Cummings, D. E.; Burton, K. A.; McKnight, G. S.; Means, A. R.: Spermiogenesis and exchange of basic nuclear proteins are impaired in male germ cells lacking Cam.

Further studies establishing the function and utilities of CAMK4 are found in John Hopkins OMIM database record ID 114080, and in sited publications numbered 12075-12081 listed in the bibliography section hereinbelow, which are also hereby incorporated by reference. Down Syndrome Critical Region Gene 1-like 1 (DSCR1L1, Accession NM_005822) is another VGAM578 host target gene. DSCR1L1 BINDING SITE is HOST TARGET binding site found in the 3' untranslated region of mRNA encoded by DSCR1L1, corresponding to a HOST TARGET binding site such as BINDING SITE I, BINDING SITE II or BINDING SITE III. Table 2 illustrates the complementarity of the nucleotide sequences of DSCR1L1 BINDING SITE, designated SEQ ID:12431, to the nucleotide sequence of VGAM578 RNA, herein designated VGAM RNA, also designated SEQ ID:3289.

Another function of VGAM578 is therefore inhibition of Down Syndrome Critical Region Gene 1-like 1 (DSCR1L1, Accession NM_005822). Accordingly, utilities of VGAM578 include diagnosis, prevention and treatment of diseases and clinical conditions associated with DSCR1L1. FLJ13646 (Accession NM_024584) is another VGAM578 host target gene. FLJ13646 BINDING SITE is HOST TARGET binding site found in the 3' untranslated region of mRNA encoded by FLJ13646, corresponding to a HOST TARGET binding site such as BINDING SITE I, BINDING SITE II or BINDING SITE III. Table 2 illustrates the complementarity of the nucleotide sequences of FLJ13646 BINDING SITE, designated SEQ ID:23814, to the nucleotide sequence of VGAM578 RNA, herein designated VGAM RNA, also designated SEQ ID:3289.

Another function of VGAM578 is therefore inhibition of FLJ13646 (Accession NM_024584). Accordingly, utilities of VGAM578 include diagnosis, prevention and treatment of diseases and clinical conditions associated with FLJ13646. FLJ14106 (Accession NM_025067) is another VGAM578 host target gene. FLJ14106 BINDING SITE is HOST TARGET binding site found in the 3' untranslated region of mRNA encoded by FLJ14106, corresponding to a HOST TARGET binding site such as BINDING SITE I, BINDING SITE II or BINDING SITE III. Table 2 illustrates the complementarity of the nucleotide sequences of FLJ14106 BINDING SITE, designated SEQ ID:24663, to the nucleotide sequence of VGAM578 RNA, herein designated VGAM RNA, also designated SEQ ID:3289.

Another function of VGAM578 is therefore inhibition of FLJ14106 (Accession NM_025067). Accordingly, utilities of VGAM578 include diagnosis, prevention and treatment of diseases and clinical conditions associated with FLJ14106. KIAA0515 (Accession XM_033380) is another VGAM578 host target gene. KIAA0515 BINDING SITE is HOST TARGET binding site found in the 3' untranslated region of mRNA encoded by KIAA0515, corresponding to a HOST TARGET binding site such as BINDING SITE I, BINDING SITE II or BINDING SITE III. Table 2 illustrates the complementarity of the nucleotide sequences of KIAA0515 BINDING SITE, designated SEQ ID:31928, to the nucleotide sequence of VGAM578 RNA, herein designated VGAM RNA, also designated SEQ ID:3289.

Another function of VGAM578 is therefore inhibition of KIAA0515 (Accession XM_033380). Accordingly, utilities of VGAM578 include diagnosis, prevention and treatment of diseases and clinical conditions associated with KIAA0515. KIAA1554 (Accession XM_170834) is another VGAM578 host target gene. KIAA1554 BINDING SITE is HOST TARGET binding site found in the 3' untranslated region of mRNA encoded by KIAA1554, corresponding to a HOST TARGET binding site such as BINDING SITE I, BINDING SITE II or BINDING SITE III. Table 2 illustrates the complementarity of the nucleotide sequences of KIAA1554 BINDING SITE, designated SEQ ID:45612, to the nucleotide sequence of VGAM578 RNA, herein designated VGAM RNA, also designated SEQ ID:3289.

Another function of VGAM578 is therefore inhibition of KIAA1554 (Accession XM_170834). Accordingly, utilities of VGAM578 include diagnosis, prevention and treatment of diseases and clinical conditions associated with KIAA1554. Suppression of Tumorigenicity 13 (colon carcinoma) (Hsp70 interacting protein) (ST13, Accession NM_003932) is another VGAM578 host target gene. ST13 BINDING SITE1 and ST13 BINDING SITE2 are HOST TARGET binding sites found in untranslated regions of mRNA encoded by ST13, corresponding to HOST TARGET binding sites such as BINDING SITE I, BINDING SITE II or BINDING SITE III. Table 2 illustrates the complementarity of the nucleotide sequences of ST13 BINDING SITE1 and ST13 BINDING SITE2, designated SEQ ID:10032 and SEQ ID:10033 respectively, to the nucleotide sequence of VGAM578 RNA, herein designated VGAM RNA, also designated SEQ ID:3289.

Another function of VGAM578 is therefore inhibition of Suppression of Tumorigenicity 13 (colon carcinoma) (Hsp70 interacting protein) (ST13, Accession NM_003932). Accordingly, utilities of VGAM578 include diagnosis, prevention and treatment of diseases and clinical conditions associated with ST13. LOC157798 (Accession XM_098827) is another VGAM578 host target gene. LOC157798 BINDING SITE is HOST TARGET binding site found in the 5' untranslated region of mRNA encoded by LOC157798, corresponding to a HOST TARGET binding site such as BINDING SITE I, BINDING SITE II or BINDING SITE III. Table 2 illustrates the complementarity of the nucleotide sequences of LOC157798 BINDING SITE, designated SEQ ID:41851, to the nucleotide sequence of VGAM578 RNA, herein designated VGAM RNA, also designated SEQ ID:3289.

Another function of VGAM578 is therefore inhibition of LOC157798 (Accession XM_098827). Accordingly, utilities of VGAM578 include diagnosis, prevention and treatment of diseases and clinical conditions associated with LOC157798. LOC163590 (Accession NM_145034) is another VGAM578 host target gene. LOC163590 BINDING SITE is HOST TARGET binding site found in the 3' untranslated region of mRNA encoded by LOC163590, corresponding to a HOST TARGET binding site such as BINDING SITE I, BINDING SITE II or BINDING SITE III. Table 2 illustrates the complementarity of the nucleotide sequences of LOC163590 BINDING SITE, designated SEQ ID:29652, to the nucleotide sequence of VGAM578 RNA, herein designated VGAM RNA, also designated SEQ ID:3289.

Another function of VGAM578 is therefore inhibition of LOC163590 (Accession NM_145034). Accordingly, utilities of VGAM578 include diagnosis, prevention and treatment of diseases and clinical conditions associated with LOC163590.

LOC255045 (Accession XM_171243) is another VGAM578 host target gene. LOC255045 BINDING SITE is HOST TARGET binding site found in the 3' untranslated region of mRNA encoded by LOC255045, corresponding to a HOST TARGET binding site such as BINDING SITE I, BINDING SITE II or BINDING SITE III. Table 2 illustrates the complementarity of the nucleotide sequences of LOC255045 BINDING SITE, designated SEQ ID:46034, to the nucleotide sequence of VGAM578 RNA, herein designated VGAM RNA, also designated SEQ ID:3289.

Another function of VGAM578 is therefore inhibition of LOC255045 (Accession XM_171243). Accordingly, utilities of VGAM578 include diagnosis, prevention and treatment of diseases and clinical conditions associated with LOC255045.

LOC51134 (Accession NM_016122) is another VGAM578 host target gene. LOC51134 BINDING SITE is HOST TARGET binding site found in the 5' untranslated region of mRNA encoded by LOC51134, corresponding to a HOST TARGET binding site such as BINDING SITE I, BINDING SITE II or BINDING SITE III. Table 2 illustrates the complementarity of the nucleotide sequences of LOC51134 BINDING SITE, designated SEQ ID:18207, to the nucleotide sequence of VGAM578 RNA, herein designated VGAM RNA, also designated SEQ ID:3289.

Another function of VGAM578 is therefore inhibition of LOC51134 (Accession NM_016122). Accordingly, utilities of VGAM578 include diagnosis, prevention and treatment of diseases and clinical conditions associated with LOC51134. FIG. 1 further provides a conceptual description of a novel bioinformatically detected viral gene of the present invention, referred to here as Viral Genomic Address Messenger 579 (VGAM579) viral gene, which modulates expression of respective host target genes thereof, the function and utility of which host target genes is known in the art.

VGAM579 is a novel bioinformatically detected regulatory, non protein coding, viral micro RNA (miRNA) gene. The method by which VGAM579 was detected is described hereinabove with reference to FIGS. 1-8.

VGAM579 gene, herein designated VGAM GENE, is a viral gene contained in the genome of Fowlpox Virus. VGAM579 host target gene, herein designated VGAM HOST TARGET GENE, is a human gene contained in the human genome.

VGAM579 gene encodes a VGAM579 precursor RNA, herein designated VGAM PRECURSOR RNA. Similar to other miRNA genes, and unlike most ordinary genes, VGAM579 precursor RNA does not encode a protein. A nucleotide sequence identical or highly similar to the nucleotide sequence of VGAM579 precursor RNA is designated SEQ ID:565, and is provided hereinbelow with reference to the sequence listing part. Nucleotide sequence SEQ ID:565 is located at position 219679 relative to the genome of Fowlpox Virus.

VGAM579 precursor RNA folds onto itself, forming VGAM579 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM579 folded precursor RNA into VGAM579 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 89%) nucleotide sequence of VGAM579 RNA is designated SEQ ID:3290, and is provided hereinbelow with reference to the sequence listing part.

VGAM579 host target gene, herein designated VGAM HOST TARGET GENE, encodes a corresponding messenger RNA, VGAM579 host target RNA, herein designated VGAM HOST TARGET RNA. VGAM579 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM579 RNA, herein designated VGAM RNA, binds complementarily to one or more host target binding sites located in untranslated regions of VGAM579 host target RNA, herein designated VGAM HOST TARGET RNA. This complementary binding is due to the fact that the nucleotide sequence of VGAM579 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM579 RNA, herein designated VGAM RNA, may have a different number of host target binding sites in untranslated regions of a VGAM579 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM579 RNA, herein designated VGAM RNA, to host target binding sites on VGAM579 host target RNA, herein designated VGAM HOST TARGET RNA, such as BINDING SITE I, BINDING SITE II and BINDING SITE III, inhibits translation of VGAM579 host target RNA into VGAM579 host target protein, herein designated VGAM HOST TARGET PROTEIN. VGAM host target protein is therefore outlined by a broken line.

It is appreciated that VGAM579 host target gene, herein designated VGAM HOST TARGET GENE, in fact represents a plurality of VGAM579 host target genes. The mRNA of each one of this plurality of VGAM579 host target genes comprises one or more host target binding sites, each having a nucleotide sequence which is at least partly complementary to VGAM579 RNA, herein designated VGAM RNA, and which when bound by VGAM579 RNA causes inhibition of translation of respective one or more VGAM579 host target proteins.

It is further appreciated by one skilled in the art that the mode of translational inhibition illustrated by FIG. 1 with specific reference to translational inhibition exerted by VGAM579 gene, herein designated VGAM GENE, on one or more VGAM579 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM579 is inhibition of expression of host target genes, as part of a novel viral mechanism of attacking a host. Accordingly, utilities of VGAM579 include diagnosis, prevention and treatment of viral infection by Fowlpox Virus. Specific functions, and accordingly utilities, of VGAM579 correlate with, and may be deduced from, the identity of the host target genes which VGAM579 binds and inhibits, and the function of these host target genes, as elaborated hereinbelow.

Nucleotide sequences of the VGAM579 precursor RNA, herein designated VGAM PRECURSOR RNA, and of the 'diced' VGAM579 RNA, herein designated VGAM RNA, and a schematic representation of the secondary folding of VGAM579 folded precursor RNA, herein designated VGAM FOLDED PRECURSOR RNA, of VGAM579 are further described hereinbelow with reference to Table 1.

Nucleotide sequences of host target binding sites, such as BINDING SITE-I, BINDING SITE-II and BINDING SITE-III of FIG. 1, found on VGAM579 host target RNA, and schematic representation of the complementarity of each of these host target binding sites to VGAM579 RNA, herein designated VGAM RNA, are described hereinbelow with reference to Table 2.

As mentioned hereinabove with reference to FIG. 1, a function of VGAM579 gene, herein designated VGAM is inhibition of expression of VGAM579 target genes. It is appreciated that specific functions, and accordingly utilities, of VGAM579 correlate with, and may be deduced from, the identity of the target genes which VGAM579 binds and inhibits, and the function of these target genes, as elaborated hereinbelow.

Adducin 3 (gamma) (ADD3, Accession NM_016824) is a VGAM579 host target gene. ADD3 BINDING SITE is HOST TARGET binding site found in the 3' untranslated region of mRNA encoded by ADD3, corresponding to a HOST TARGET binding site such as BINDING SITE I, BINDING SITE II or BINDING SITE III. Table 2 illustrates the complementarity of the nucleotide sequences of ADD3 BINDING SITE, designated SEQ ID:18818, to the nucleotide sequence of VGAM579 RNA, herein designated VGAM RNA, also designated SEQ ID:3290.

A function of VGAM579 is therefore inhibition of Adducin 3 (gamma) (ADD3, Accession NM_016824), a gene which membrane-cytoskeleton-associated protein that promotes the assembly of the spectrin-actin network. Accordingly, utilities of VGAM579 include diagnosis, prevention and treatment of diseases and clinical conditions associated with ADD3. The function of ADD3 has been established by previous studies. From a human fetal-brain cDNA library, Katagiri et al. (1996) isolated a novel human cDNA which they termed adducin-like 70. The predicted amino acid sequence shows a high degree of homology to adducins (alpha-102680; beta-102681). In human erythrocytes, adducin is a 200-kD heterodimeric skeletal component of the cell membrane, where it promotes the binding of spectrin to actin. This binding is regulated by calcium/calmodulin (OMIM Ref. No. 114180). Adducin also is phosphorylated by protein kinase-C. Adducin and its multiple isoforms represent a family of proteins present in a variety of tissues and cultured cell lines, including those from brain, kidney, and liver. The gene, symbolized here ADDL, contains an open reading frame of 2,022 nucleotides encoding 674 amino acids. It shows 54%, 53%, and 59% identity in predicted amino acid sequence with alpha and beta components of human adducin and rat adducin 63, respectively. Katagiri et al. (1996) stated that human adducin-like 70 is likely to play an important role in the skeletal organization of the cell membrane. Northern blot analysis indicated ubiquitous expression of this gene in adult human tissues. In a comprehensive assay of gene expression, Gilligan et al. (1999) showed the ubiquitous expression of alpha- and gamma-adducin, in contrast to the restricted expression of beta-adducin. Beta-adducin was expressed at high levels in brain and hematopoietic tissues (bone marrow in human S, spleen in mice).

Full details of the abovementioned studies are described in the following publications, the disclosure of which are hereby incorporated by reference:

Gilligan, D. M.; Lozovatsky, L.; Gwynn, B.; Brugnara, C.; Mohandas, N.; Peters, L. L.: Targeted disruption of the beta adducin gene (Add2) causes red blood cell spherocytosis in mice. Proc. Nat. Acad. Sci. 96:10717-10722, 1999; and Katagiri, T.; Ozaki, K.; Fujiwara, T.; Shimizu, F.; Kawai, A.; Okuno, S.; Suzuki, M.; Nakamura, Y.; Takahashi, E.; Hirai, Y.: Cloning, expression and chromosome mapping of adducin-lik.

Further studies establishing the function and utilities of ADD3 are found in John Hopkins OMIM database record ID 601568, and in sited publications numbered 2791-2792 listed in the bibliography section hereinbelow, which are also hereby incorporated by reference. Activator of Basal Transcription 1 (ABT1, Accession NM_013375) is another VGAM579 host target gene. ABT1 BINDING SITE is HOST TARGET binding site found in the 3' untranslated region of mRNA encoded by ABT1, corresponding to a HOST TARGET binding site such as BINDING SITE I, BINDING SITE II or BINDING SITE III. Table 2 illustrates the complementarity of the nucleotide sequences of ABT1 BINDING SITE, designated SEQ ID:15028, to the nucleotide sequence of VGAM579 RNA, herein designated VGAM RNA, also designated SEQ ID:3290.

Another function of VGAM579 is therefore inhibition of Activator of Basal Transcription 1 (ABT1, Accession NM_013375). Accordingly, utilities of VGAM579 include diagnosis, prevention and treatment of diseases and clinical conditions associated with ABT1. FLJ21144 (Accession NM_022774) is another VGAM579 host target gene. FLJ21144 BINDING SITE is HOST TARGET binding site found in the 3' untranslated region of mRNA encoded by FLJ21144, corresponding to a HOST TARGET binding site such as BINDING SITE I, BINDING SITE II or BINDING SITE III. Table 2 illustrates the complementarity of the nucleotide sequences of FLJ21144 BINDING SITE, designated SEQ ID:23039, to the nucleotide sequence of VGAM579 RNA, herein designated VGAM RNA, also designated SEQ ID:3290.

Another function of VGAM579 is therefore inhibition of FLJ21144 (Accession NM_022774). Accordingly, utilities of VGAM579 include diagnosis, prevention and treatment of diseases and clinical conditions associated with FLJ21144. FLJ22551 (Accession NM_024708) is another VGAM579 host target gene. FLJ22551 BINDING SITE is HOST TARGET binding site found in the 5' untranslated region of mRNA encoded by FLJ22551, corresponding to a HOST TARGET binding site such as BINDING SITE I, BINDING SITE II or BINDING SITE III. Table 2 illustrates the complementarity of the nucleotide sequences of FLJ22551 BINDING SITE, designated SEQ ID:24026, to the nucleotide sequence of VGAM579 RNA, herein designated VGAM RNA, also designated SEQ ID:3290.

Another function of VGAM579 is therefore inhibition of FLJ22551 (Accession NM_024708). Accordingly, utilities of VGAM579 include diagnosis, prevention and treatment of diseases and clinical conditions associated with FLJ22551. KIAA0594 (Accession XM_036117) is another VGAM579 host target gene. KIAA0594 BINDING SITE is HOST TARGET binding site found in the 3' untranslated region of mRNA encoded by KIAA0594, corresponding to a HOST TARGET binding site such as BINDING SITE I, BINDING SITE II or BINDING SITE III. Table 2 illustrates the complementarity of the nucleotide sequences of KIAA0594 BINDING SITE, designated SEQ ID:32384, to the nucleotide sequence of VGAM579 RNA, herein designated VGAM RNA, also designated SEQ ID:3290.

Another function of VGAM579 is therefore inhibition of KIAA0594 (Accession XM_036117). Accordingly, utilities of VGAM579 include diagnosis, prevention and treatment of diseases and clinical conditions associated with KIAA0594. KIAA1877 (Accession XM_038616) is another VGAM579 host target gene. KIAA1877 BINDING SITE is HOST TARGET binding site found in the 3' untranslated region of mRNA encoded by KIAA1877, corresponding to a HOST TARGET binding site such as BINDING SITE I, BINDING SITE II or BINDING SITE III. Table 2 illustrates the complementarity of the nucleotide sequences of KIAA1877 BINDING SITE, designated SEQ ID:32883, to the nucleotide sequence of VGAM579 RNA, herein designated VGAM RNA, also designated SEQ ID:3290.

Another function of VGAM579 is therefore inhibition of KIAA1877 (Accession XM_038616). Accordingly, utilities of VGAM579 include diagnosis, prevention and treatment of diseases and clinical conditions associated with KIAA1877. TNF Receptor-associated Factor 3 (TRAF3, Accession XM_007256) is another VGAM579 host target gene. TRAF3 BINDING SITE is HOST TARGET binding site found in the 3' untranslated region of mRNA encoded by TRAF3, corresponding to a HOST TARGET binding site such as BINDING SITE I, BINDING SITE II or BINDING SITE III. Table 2 illustrates the complementarity of the nucleotide sequences of TRAF3 BINDING SITE, designated SEQ ID:30045, to the nucleotide sequence of VGAM579 RNA, herein designated VGAM RNA, also designated SEQ ID:3290.

Another function of VGAM579 is therefore inhibition of TNF Receptor-associated Factor 3 (TRAF3, Accession XM_007256). Accordingly, utilities of VGAM579 include diagnosis, prevention and treatment of diseases and clinical conditions associated with TRAF3. FIG. 1 further provides a conceptual description of a novel bioinformatically detected viral gene of the present invention, referred to here as Viral Genomic Address Messenger 580 (VGAM580) viral gene, which modulates expression of respective host target genes thereof, the function and utility of which host target genes is known in the art.

VGAM580 is a novel bioinformatically detected regulatory, non protein coding, viral micro RNA (miRNA) gene. The method by which VGAM580 was detected is described hereinabove with reference to FIGS. 1-8.

VGAM580 gene, herein designated VGAM GENE, is a viral gene contained in the genome of Fowlpox Virus. VGAM580 host target gene, herein designated VGAM HOST TARGET GENE, is a human gene contained in the human genome.

VGAM580 gene encodes a VGAM580 precursor RNA, herein designated VGAM PRECURSOR RNA. Similar to other miRNA genes, and unlike most ordinary genes, VGAM580 precursor RNA does not encode a protein. A nucleotide sequence identical or highly similar to the nucleotide sequence of VGAM580 precursor RNA is designated SEQ ID:566, and is provided hereinbelow with reference to the sequence listing part. Nucleotide sequence SEQ ID:566 is located at position 244009 relative to the genome of Fowlpox Virus.

VGAM580 precursor RNA folds onto itself, forming VGAM580 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM580 folded precursor RNA into VGAM580 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM580 RNA is designated SEQ ID:3291, and is provided hereinbelow with reference to the sequence listing part.

VGAM580 host target gene, herein designated VGAM HOST TARGET GENE, encodes a corresponding messenger RNA, VGAM580 host target RNA, herein designated VGAM HOST TARGET RNA. VGAM580 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM580 RNA, herein designated VGAM RNA, binds complementarily to one or more host target binding sites located in untranslated regions of VGAM580 host target RNA, herein designated VGAM HOST TARGET RNA. This complementary binding is due to the fact that the nucleotide sequence of VGAM580 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM580 RNA, herein designated VGAM RNA, may have a different number of host target binding sites in untranslated regions of a VGAM580 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM580 RNA, herein designated VGAM RNA, to host target binding sites on VGAM580 host target RNA, herein designated VGAM HOST TARGET RNA, such as BINDING SITE I, BINDING SITE II and BINDING SITE III, inhibits translation of VGAM580 host target RNA into VGAM580 host target protein, herein designated VGAM HOST TARGET PROTEIN. VGAM host target protein is therefore outlined by a broken line.

It is appreciated that VGAM580 host target gene, herein designated VGAM HOST TARGET GENE, in fact represents a plurality of VGAM580 host target genes. The mRNA of each one of this plurality of VGAM580 host target genes comprises one or more host target binding sites, each having a nucleotide sequence which is at least partly complementary to VGAM580 RNA, herein designated VGAM RNA, and which when bound by VGAM580 RNA causes inhibition of translation of respective one or more VGAM580 host target proteins.

It is further appreciated by one skilled in the art that the mode of translational inhibition illustrated by FIG. 1 with specific reference to translational inhibition exerted by VGAM580 gene, herein designated VGAM GENE, on one or more VGAM580 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM580 is inhibition of expression of host target genes, as part of a novel viral mechanism of attacking a host. Accordingly, utilities of VGAM580 include diagnosis, prevention and treatment of viral infection by Fowlpox Virus. Specific functions, and accordingly utilities, of VGAM580 correlate with, and may be deduced from, the identity of the host target genes which VGAM580 binds and inhibits, and the function of these host target genes, as elaborated hereinbelow.

Nucleotide sequences of the VGAM580 precursor RNA, herein designated VGAM PRECURSOR RNA, and of the 'diced' VGAM580 RNA, herein designated VGAM RNA, and a schematic representation of the secondary folding of VGAM580 folded precursor RNA, herein designated VGAM FOLDED PRECURSOR RNA, of VGAM580 are further described hereinbelow with reference to Table 1.

Nucleotide sequences of host target binding sites, such as BINDING SITE-I, BINDING SITE-II and BINDING SITE-III of FIG. 1, found on VGAM580 host target RNA, and schematic representation of the complementarity of each of these host target binding sites to VGAM580 RNA, herein designated VGAM RNA, are described hereinbelow with reference to Table 2.

As mentioned hereinabove with reference to FIG. 1, a function of VGAM580 gene, herein designated VGAM is inhibition of expression of VGAM580 target genes. It is appreciated that specific functions, and accordingly utilities, of VGAM580 correlate with, and may be deduced from, the identity of the target genes which VGAM580 binds and inhibits, and the function of these target genes, as elaborated hereinbelow.

Solute Carrier Family 15 (oligopeptide transporter), Member 1 (SLC15A1, Accession NM_005073) is a VGAM580 host target gene. SLC15A1 BINDING SITE is HOST TARGET binding site found in the 3' untranslated region of mRNA encoded by SLC15A1, corresponding to a HOST TARGET binding site such as BINDING SITE I, BINDING SITE II or BINDING SITE III. Table 2 illustrates the complementarity of the nucleotide sequences of SLC15A1 BINDING SITE, designated SEQ ID:11520, to the nucleotide sequence of VGAM580 RNA, herein designated VGAM RNA, also designated SEQ ID:3291.

A function of VGAM580 is therefore inhibition of Solute Carrier Family 15 (oligopeptide transporter), Member 1 (SLC15A1, Accession NM_005073), a gene which is a H(+)-coupled peptide transporter. Accordingly, utilities of VGAM580 include diagnosis, prevention and treatment of diseases and clinical conditions associated with SLC15A1. The function of SLC15A1 and its association with various diseases and clinical conditions, has been established by previous studies, as described hereinabove with reference to VGAM74. FLJ10846 (Accession NM_018241) is another VGAM580 host target gene. FLJ10846 BINDING SITE is HOST TARGET binding site found in the 3' untranslated region of mRNA encoded by FLJ10846, corresponding to a HOST TARGET binding site such as BINDING SITE I, BINDING SITE II or BINDING SITE III. Table 2 illustrates the complementarity of the nucleotide sequences of FLJ10846 BINDING SITE, designated SEQ ID:20201, to the nucleotide sequence of VGAM580 RNA, herein designated VGAM RNA, also designated SEQ ID:3291.

Another function of VGAM580 is therefore inhibition of FLJ10846 (Accession NM_018241). Accordingly, utilities of VGAM580 include diagnosis, prevention and treatment of diseases and clinical conditions associated with FLJ10846. FIG. 1 further provides a conceptual description of a novel bioinformatically detected viral gene of the present invention, referred to here as Viral Genomic Address Messenger 581 (VGAM581) viral gene, which modulates expression of respective host target genes thereof, the function and utility of which host target genes is known in the art.

VGAM581 is a novel bioinformatically detected regulatory, non protein coding, viral micro RNA (miRNA) gene. The method by which VGAM581 was detected is described hereinabove with reference to FIGS. 1-8.

VGAM581 gene, herein designated VGAM GENE, is a viral gene contained in the genome of Fowlpox Virus. VGAM581 host target gene, herein designated VGAM HOST TARGET GENE, is a human gene contained in the human genome.

VGAM581 gene encodes a VGAM581 precursor RNA, herein designated VGAM PRECURSOR RNA. Similar to other miRNA genes, and unlike most ordinary genes, VGAM581 precursor RNA does not encode a protein. A nucleotide sequence identical or highly similar to the nucleotide sequence of VGAM581 precursor RNA is designated SEQ ID:567, and is provided hereinbelow with reference to the sequence listing part. Nucleotide sequence SEQ ID:567 is located at position 244236 relative to the genome of Fowlpox Virus.

VGAM581 precursor RNA folds onto itself, forming VGAM581 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM581 folded precursor RNA into VGAM581 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 91%) nucleotide sequence of VGAM581 RNA is designated SEQ ID:3292, and is provided hereinbelow with reference to the sequence listing part.

VGAM581 host target gene, herein designated VGAM HOST TARGET GENE, encodes a corresponding messenger RNA, VGAM581 host target RNA, herein designated VGAM HOST TARGET RNA. VGAM581 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM581 RNA, herein designated VGAM RNA, binds complementarily to one or more host target binding sites located in untranslated regions of VGAM581 host target RNA, herein designated VGAM HOST TARGET RNA. This complementary binding is due to the fact that the nucleotide sequence of VGAM581 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM581 RNA, herein designated VGAM RNA, may have a different number of host target binding sites in untranslated regions of a VGAM581 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM581 RNA, herein designated VGAM RNA, to host target binding sites on VGAM581 host target RNA, herein designated VGAM HOST TARGET RNA, such as BINDING SITE I, BINDING SITE II and BINDING SITE III, inhibits translation of VGAM581 host target RNA into VGAM581 host target protein, herein designated VGAM HOST TARGET PROTEIN. VGAM host target protein is therefore outlined by a broken line.

It is appreciated that VGAM581 host target gene, herein designated VGAM HOST TARGET GENE, in fact represents a plurality of VGAM581 host target genes. The mRNA of each one of this plurality of VGAM581 host target genes comprises one or more host target binding sites, each having a nucleotide sequence which is at least partly complementary to VGAM581 RNA, herein designated VGAM RNA, and which when bound by VGAM581 RNA causes inhibition of translation of respective one or more VGAM581 host target proteins.

It is further appreciated by one skilled in the art that the mode of translational inhibition illustrated by FIG. 1 with specific reference to translational inhibition exerted by VGAM581 gene, herein designated VGAM GENE, on one or more VGAM581 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM581 is inhibition of expression of host target genes, as part of a novel viral mechanism of attacking a host. Accordingly, utilities of VGAM581 include diagnosis, prevention and treatment of viral infection by Fowlpox Virus. Specific functions, and accordingly utilities, of VGAM581 correlate with, and may be deduced from, the identity of the host target genes which VGAM581 binds and inhibits, and the function of these host target genes, as elaborated hereinbelow.

Nucleotide sequences of the VGAM581 precursor RNA, herein designated VGAM PRECURSOR RNA, and of the 'diced' VGAM581 RNA, herein designated VGAM RNA, and a schematic representation of the secondary folding of VGAM581 folded precursor RNA, herein designated VGAM FOLDED PRECURSOR RNA, of VGAM581 are further described hereinbelow with reference to Table 1.

Nucleotide sequences of host target binding sites, such as BINDING SITE-I, BINDING SITE-II and BINDING SITE-III of FIG. 1, found on VGAM581 host target RNA, and schematic representation of the complementarity of each of these host target binding sites to VGAM581 RNA, herein designated VGAM RNA, are described hereinbelow with reference to Table 2.

As mentioned hereinabove with reference to FIG. 1, a function of VGAM581 gene, herein designated VGAM is inhibition of expression of VGAM581 target genes. It is appreciated that specific functions, and accordingly utilities, of VGAM581 correlate with, and may be deduced from, the identity of the target genes which VGAM581 binds and inhibits, and the function of these target genes, as elaborated hereinbelow.

CASP8 Associated Protein 2 (CASP8AP2, Accession NM_012115) is a VGAM581 host target gene. CASP8AP2 BINDING SITE is HOST TARGET binding site found in the 3' untranslated region of mRNA encoded by CASP8AP2, corresponding to a HOST TARGET binding site such as BINDING SITE I, BINDING SITE II or BINDING SITE III. Table 2 illustrates the complementarity of the nucleotide sequences of CASP8AP2 BINDING SITE, designated SEQ ID:14429, to the nucleotide sequence of VGAM581 RNA, herein designated VGAM RNA, also designated SEQ ID:3292.

A function of VGAM581 is therefore inhibition of CASP8 Associated Protein 2 (CASP8AP2, Accession NM_012115), a gene which interacts with and activates caspase-8 in Fas-mediated apoptosis. Accordingly, utilities of VGAM581 include diagnosis, prevention and treatment of diseases and clinical conditions associated with CASP8AP2. The function of CASP8AP2 has been established by previous studies. Through coimmunoprecipitation and transfection experiments, Imai et al. (1999) determined that Flash binds caspase-8 (OMIM Ref. No. 601763) and Fadd (OMIM Ref. No. 602457). It also specifically coimmunoprecipitated with activated Fas (OMIM Ref. No. 134637), suggesting that Casp8ap2 is part of the death-inducing signaling complex (DISC). Using luciferase reporter analysis, Choi et al. (2001) showed that inhibition of FLASH expression abolishes TNF (OMIM Ref. No. 191160)-induced NFKB (OMIM Ref. No. 164011) activation in embryonic kidney cells. Expression or overexpression of FLASH activates NFKB through a central oligomerization domain, called the NFKB activation domain (NAD), in a TRAF2 (OMIM Ref. No. 601895)-NIK (OMIM Ref. No. 604655)-IKKA (OMIM Ref. No. 600664)-dependent pathway. Immunoprecipitation analysis indicated that the FLASH NAD interacts with TRAF2. Choi et al. (2001) concluded that FLASH coordinates downstream NFKB activity via a TRAF2-dependent pathway in TNF signaling.

Full details of the abovementioned studies are described in the following publications, the disclosure of which are hereby incorporated by reference:

Choi, Y.-H.; Kim, K.-B.; Kim, H.-H.; Hong, G.-S.; Kwon, Y.-K.; Chung, C.-W.; Park, Y.-M.; Shen, Z.-J.; Kim, B. J.; Lee, S.-Y.; Jung, Y.-K.: FLASH coordinates NF-kappa-B activity via TRAF2. J. Biol. Chem. 276:25073-25077, 2001; and Imai, Y.; Kimura, T.; Murakami, A.; Yajima, N.; Sakamaki, K.; Yonehara, S.: The CED-4-homologous protein FLASH is involved in Fas-mediated activation of caspase-8 during apoptosis. Na.

Further studies establishing the function and utilities of CASP8AP2 are found in John Hopkins OMIM database record ID 606880, and in sited publications numbered 6083-6084 listed in the bibliography section hereinbelow, which are also hereby incorporated by reference. Dual Adaptor of Phosphotyrosine and 3-phosphoinositides (DAPP1, Accession NM_014395) is another VGAM581 host target gene. DAPP1 BINDING SITE is HOST TARGET binding site found in the 3' untranslated region of mRNA encoded by DAPP1, corresponding to a HOST TARGET binding site such as BINDING SITE I, BINDING SITE II or BINDING SITE III. Table 2 illustrates the complementarity of the nucleotide sequences of DAPP1 BINDING SITE, designated SEQ ID:15732, to the nucleotide sequence of VGAM581 RNA, herein designated VGAM RNA, also designated SEQ ID:3292.

Another function of VGAM581 is therefore inhibition of Dual Adaptor of Phosphotyrosine and 3-phosphoinositides (DAPP1, Accession NM_014395), a gene which regulates the ras-cyclic amp pathway. Accordingly, utilities of VGAM581 include diagnosis, prevention and treatment of diseases and clinical conditions associated with DAPP1. The function of DAPP1 and its association with various diseases and clinical conditions, has been established by previous studies, as described hereinabove with reference to VGAM283. FLJ10483 (Accession NM_018108) is another VGAM581 host target gene. FLJ10483 BINDING SITE is HOST TARGET binding site found in the 3' untranslated region of mRNA encoded by FLJ10483, corresponding to a HOST TARGET binding site such as BINDING SITE I, BINDING SITE II or BINDING SITE III. Table 2 illustrates the complementarity of the nucleotide sequences of FLJ10483 BINDING SITE, designated SEQ ID:19878, to the nucleotide sequence of VGAM581 RNA, herein designated VGAM RNA, also designated SEQ ID:3292.

Another function of VGAM581 is therefore inhibition of FLJ10483 (Accession NM_018108). Accordingly, utilities of VGAM581 include diagnosis, prevention and treatment of diseases and clinical conditions associated with FLJ10483. FLJ10936 (Accession NM_018279) is another VGAM581 host target gene. FLJ10936 BINDING SITE is HOST TARGET binding site found in the 3' untranslated region of mRNA encoded by FLJ10936, corresponding to a HOST TARGET binding site such as BINDING SITE I, BINDING SITE II or BINDING SITE III. Table 2 illustrates the complementarity of the nucleotide sequences of FLJ10936 BINDING SITE, designated SEQ ID:20272, to the nucleotide sequence of VGAM581 RNA, herein designated VGAM RNA, also designated SEQ ID:3292.

Another function of VGAM581 is therefore inhibition of FLJ10936 (Accession NM_018279). Accordingly, utilities of VGAM581 include diagnosis, prevention and treatment of diseases and clinical conditions associated with FLJ10936. KIAA0798 (Accession NM_014650) is another VGAM581 host target gene. KIAA0798 BINDING SITE is HOST TARGET binding site found in the 3' untranslated region of mRNA encoded by KIAA0798, corresponding to a HOST TARGET binding site such as BINDING SITE I, BINDING SITE II or BINDING SITE III. Table 2 illustrates the complementarity of the nucleotide sequences of KIAA0798 BINDING SITE, designated SEQ ID:16070, to the nucleotide sequence of VGAM581 RNA, herein designated VGAM RNA, also designated SEQ ID:3292.

Another function of VGAM581 is therefore inhibition of KIAA0798 (Accession NM_014650). Accordingly, utilities of VGAM581 include diagnosis, prevention and treatment of diseases and clinical conditions associated with KIAA0798. TERA (Accession NM_021238) is another VGAM581 host target gene. TERA BINDING SITE is HOST TARGET binding site found in the 3" untranslated region of mRNA encoded by TERA, corresponding to a HOST TARGET binding site such as BINDING SITE I, BINDING SITE II or BINDING SITE III. Table 2 illustrates the complementarity of the nucleotide sequences of TERA BINDING SITE, designated SEQ ID:22207, to the nucleotide sequence of VGAM581 RNA, herein designated VGAM RNA, also designated SEQ ID:3292.

Another function of VGAM581 is therefore inhibition of TERA (Accession NM_021238). Accordingly, utilities of VGAM581 include diagnosis, prevention and treatment of diseases and clinical conditions associated with TERA. Zinc Finger Protein 84 (HPF2) (ZNF84, Accession NM_003428) is another VGAM581 host target gene. ZNF84 BINDING SITE is HOST TARGET binding site found in the 3' untranslated region of mRNA encoded by ZNF84, corresponding to a HOST TARGET binding site such as BINDING SITE I, BINDING SITE II or BINDING SITE III. Table 2 illustrates the complementarity of the nucleotide sequences of ZNF84 BINDING SITE, designated SEQ ID:9478, to the nucleotide sequence of VGAM581 RNA, herein designated VGAM RNA, also designated SEQ ID:3292.

Another function of VGAM581 is therefore inhibition of Zinc Finger Protein 84 (HPF2) (ZNF84, Accession NM_003428). Accordingly, utilities of VGAM581 include diagnosis, prevention and treatment of diseases and clinical conditions associated with ZNF84. LOC127255 (Accession NM_145258) is another VGAM581 host target gene. LOC127255 BINDING SITE is HOST TARGET binding site found in the 3' untranslated region of mRNA encoded by LOC127255, corresponding to a HOST TARGET binding site such as BINDING SITE I, BINDING SITE II or BINDING SITE III. Table 2 illustrates the complementarity of the nucleotide sequences of LOC127255 BINDING SITE, designated SEQ ID:29774, to the nucleotide sequence of VGAM581 RNA, herein designated VGAM RNA, also designated SEQ ID:3292.

Another function of VGAM581 is therefore inhibition of LOC127255 (Accession NM_145258). Accordingly, utilities of VGAM581 include diagnosis, prevention and treatment of diseases and clinical conditions associated with LOC127255. LOC90317 (Accession XM_030892) is another VGAM581 host target gene. LOC90317 BINDING SITE is HOST TARGET binding site found in the 3' untranslated region of mRNA encoded by LOC90317, corresponding to a HOST TARGET binding site such as BINDING SITE I, BINDING SITE II or BINDING SITE III. Table 2 illustrates the complementarity of the nucleotide sequences of LOC90317 BINDING SITE, designated SEQ ID:31208, to the nucleotide sequence of VGAM581 RNA, herein designated VGAM RNA, also designated SEQ ID:3292.

Another function of VGAM581 is therefore inhibition of LOC90317 (Accession XM_030892). Accordingly, utilities of VGAM581 include diagnosis, prevention and treatment of diseases and clinical conditions associated with LOC90317. LOC93070 (Accession XM_049046) is another VGAM581 host target gene. LOC93070 BINDING SITE is HOST TARGET binding site found in the 3' untranslated region of mRNA encoded by LOC93070, corresponding to a HOST TARGET binding site such as BINDING SITE I, BINDING SITE II or BINDING SITE III. Table 2 illustrates the complementarity of the nucleotide sequences of LOC93070 BINDING SITE, designated SEQ ID:35327, to the nucleotide sequence of VGAM581 RNA, herein designated VGAM RNA, also designated SEQ ID:3292.

Another function of VGAM581 is therefore inhibition of LOC93070 (Accession XM_049046). Accordingly, utilities of VGAM581 include diagnosis, prevention and treatment of diseases and clinical conditions associated with LOC93070. FIG. 1 further provides a conceptual description of a novel bioinformatically detected viral gene of the present invention, referred to here as Viral Genomic Address Messenger 582 (VGAM582) viral gene, which modulates expression of respective host target genes thereof, the function and utility of which host target genes is known in the art.

VGAM582 is a novel bioinformatically detected regulatory, non protein coding, viral micro RNA (miRNA) gene. The method by which VGAM582 was detected is described hereinabove with reference to FIGS. 1-8.

VGAM582 gene, herein designated VGAM GENE, is a viral gene contained in the genome of Fowlpox Virus. VGAM582 host target gene, herein designated VGAM HOST TARGET GENE, is a human gene contained in the human genome.

VGAM582 gene encodes a VGAM582 precursor RNA, herein designated VGAM PRECURSOR RNA. Similar to other miRNA genes, and unlike most ordinary genes, VGAM582 precursor RNA does not encode a protein. A nucleotide sequence identical or highly similar to the nucleotide sequence of VGAM582 precursor RNA is designated SEQ ID:568, and is provided hereinbelow with reference to the sequence listing part. Nucleotide sequence SEQ ID:568 is located at position 251054 relative to the genome of Fowlpox Virus.

VGAM582 precursor RNA folds onto itself, forming VGAM582 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM582 folded precursor RNA into VGAM582 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 80%) nucleotide sequence of VGAM582 RNA is designated SEQ ID:3293, and is provided hereinbelow with reference to the sequence listing part.

VGAM582 host target gene, herein designated VGAM HOST TARGET GENE, encodes a corresponding messenger RNA, VGAM582 host target RNA, herein designated VGAM HOST TARGET RNA. VGAM582 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM582 RNA, herein designated VGAM RNA, binds complementarily to one or more host target binding sites located in untranslated regions of VGAM582 host target RNA, herein designated VGAM HOST TARGET RNA. This complementary binding is due to the fact that the nucleotide sequence of VGAM582 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM582 RNA, herein designated VGAM RNA, may have a different number of host target binding sites in untranslated regions of a VGAM582 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM582 RNA, herein designated VGAM RNA, to host target binding sites on VGAM582 host target RNA, herein designated VGAM HOST TARGET RNA, such as BINDING SITE I, BINDING SITE II and BINDING SITE III, inhibits translation of VGAM582 host target RNA into VGAM582 host target protein, herein designated VGAM HOST TARGET PROTEIN. VGAM host target protein is therefore outlined by a broken line.

It is appreciated that VGAM582 host target gene, herein designated VGAM HOST TARGET GENE, in fact represents a plurality of VGAM582 host target genes. The mRNA of each one of this plurality of VGAM582 host target genes comprises one or more host target binding sites, each having a nucleotide sequence which is at least partly complementary to VGAM582 RNA, herein designated VGAM RNA, and which when bound by VGAM582 RNA causes inhibition of translation of respective one or more VGAM582 host target proteins.

It is further appreciated by one skilled in the art that the mode of translational inhibition illustrated by FIG. 1 with specific reference to translational inhibition exerted by VGAM582 gene, herein designated VGAM GENE, on one or more VGAM582 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM582 is inhibition of expression of host target genes, as part of a novel viral mechanism of attacking a host. Accordingly, utilities of VGAM582 include diagnosis, prevention and treatment of viral infection by Fowlpox Virus. Specific functions, and accordingly utilities, of VGAM582 correlate with, and may be deduced from, the identity of the host target genes which VGAM582 binds and inhibits, and the function of these host target genes, as elaborated hereinbelow.

Nucleotide sequences of the VGAM582 precursor RNA, herein designated VGAM PRECURSOR RNA, and of the ‘diced’ VGAM582 RNA, herein designated VGAM RNA, and a schematic representation of the secondary folding of VGAM582 folded precursor RNA, herein designated VGAM FOLDED PRECURSOR RNA, of VGAM582 are further described hereinbelow with reference to Table 1.

Nucleotide sequences of host target binding sites, such as BINDING SITE-I, BINDING SITE-II and BINDING SITE-III of FIG. 1, found on VGAM582 host target RNA, and schematic representation of the complementarity of each of these host target binding sites to VGAM582 RNA, herein designated VGAM RNA, are described hereinbelow with reference to Table 2.

As mentioned hereinabove with reference to FIG. 1, a function of VGAM582 gene, herein designated VGAM is inhibition of expression of VGAM582 target genes. It is appreciated that specific functions, and accordingly utilities, of VGAM582 correlate with, and may be deduced from, the identity of the target genes which VGAM582 binds and inhibits, and the function of these target genes, as elaborated hereinbelow.

Mitochondrial Translational Initiation Factor 2 (MTIF2, Accession NM_002453) is a VGAM582 host target gene. MTIF2 BINDING SITE is HOST TARGET binding site found in the 5' untranslated region of mRNA encoded by MTIF2, corresponding to a HOST TARGET binding site such as BINDING SITE I, BINDING SITE II or BINDING SITE III. Table 2 illustrates the complementarity of the nucleotide sequences of MTIF2 BINDING SITE, designated SEQ ID:8289, to the nucleotide sequence of VGAM582 RNA, herein designated VGAM RNA, also designated SEQ ID:3293.

A function of VGAM582 is therefore inhibition of Mitochondrial Translational Initiation Factor 2 (MTIF2, Accession NM_002453). Accordingly, utilities of VGAM582 include diagnosis, prevention and treatment of diseases and clinical conditions associated with MTIF2. Zinc Finger Protein 202 (ZNF202, Accession NM_003455) is another VGAM582 host target gene. ZNF202 BINDING SITE is HOST TARGET binding site found in the 3' untranslated region of mRNA encoded by ZNF202, corresponding to a HOST TARGET binding site such as BINDING SITE I, BINDING SITE II or BINDING SITE III. Table 2 illustrates the complementarity of the nucleotide sequences of ZNF202 BINDING SITE, designated SEQ ID:9507, to the nucleotide sequence of VGAM582 RNA, herein designated VGAM RNA, also designated SEQ ID:3293.

Another function of VGAM582 is therefore inhibition of Zinc Finger Protein 202 (ZNF202, Accession NM_003455). Accordingly, utilities of VGAM582 include diagnosis, prevention and treatment of diseases and clinical conditions associated with ZNF202. CG012 (Accession XM_096710) is another VGAM582 host target gene. CG012 BINDING SITE is HOST TARGET binding site found in the 3' untranslated region of mRNA encoded by CG012, corresponding to a HOST TARGET binding site such as BINDING SITE I, BINDING SITE II or BINDING SITE III. Table 2 illustrates the complementarity of the nucleotide sequences of CG012 BINDING SITE, designated SEQ ID:40484, to the nucleotide sequence of VGAM582 RNA, herein designated VGAM RNA, also designated SEQ ID:3293.

Another function of VGAM582 is therefore inhibition of CG012 (Accession XM_096710). Accordingly, utilities of VGAM582 include diagnosis, prevention and treatment of diseases and clinical conditions associated with CG012. DKFZP564C196 (Accession XM_046405) is another VGAM582 host target gene. DKFZP564C196 BINDING SITE is HOST TARGET binding site found in the 3' untranslated region of mRNA encoded by DKFZP564C196, corresponding to a HOST TARGET binding site such as BINDING SITE I, BINDING SITE II or BINDING SITE III. Table 2 illustrates the complementarity of the nucleotide sequences of DKFZP564C196 BINDING SITE, designated SEQ ID:34710, to the nucleotide sequence of VGAM582 RNA, herein designated VGAM RNA, also designated SEQ ID:3293.

Another function of VGAM582 is therefore inhibition of DKFZP564C196 (Accession XM_046405). Accordingly, utilities of VGAM582 include diagnosis, prevention and treatment of diseases and clinical conditions associated with DKFZP564C196. Polymerase (RNA) II (DNA directed) Polypeptide D (POLR2D, Accession NM_004805) is another VGAM582 host target gene. POLR2D BINDING SITE is HOST TARGET binding site found in the 3" untranslated region of mRNA encoded by POLR2D, corresponding to a HOST TARGET binding site such as BINDING SITE I, BINDING SITE II or BINDING SITE III. Table 2 illustrates the complementarity of the nucleotide sequences of POLR2D BINDING SITE, designated SEQ ID:11228, to the nucleotide sequence of VGAM582 RNA, herein designated VGAM RNA, also designated SEQ ID:3293.

Another function of VGAM582 is therefore inhibition of Polymerase (RNA) II (DNA directed) Polypeptide D (POLR2D, Accession NM_004805). Accordingly, utilities of VGAM582 include diagnosis, prevention and treatment of diseases and clinical conditions associated with POLR2D. TPARL (Accession NM_018475) is another VGAM582 host target gene. TPARL BINDING SITE is HOST TARGET binding site found in the 3' untranslated region of mRNA encoded by TPARL, corresponding to a HOST TARGET binding site such as BINDING SITE I, BINDING SITE II or BINDING SITE III. Table 2 illustrates the complementarity of the nucleotide sequences of TPARL BINDING SITE, designated SEQ ID:20542, to the nucleotide sequence of VGAM582 RNA, herein designated VGAM RNA, also designated SEQ ID:3293.

Another function of VGAM582 is therefore inhibition of TPARL (Accession NM_018475). Accordingly, utilities of VGAM582 include diagnosis, prevention and treatment of diseases and clinical conditions associated with TPARL. FIG. 1 further provides a conceptual description of a novel bioinformatically detected viral gene of the present invention, referred to here as Viral Genomic Address Messenger 583 (VGAM583) viral gene, which modulates expression of respective host target genes thereof, the function and utility of which host target genes is known in the art.

VGAM583 is a novel bioinformatically detected regulatory, non protein coding, viral micro RNA (miRNA) gene. The method by which VGAM583 was detected is described hereinabove with reference to FIGS. 1-8.

VGAM583 gene, herein designated VGAM GENE, is a viral gene contained in the genome of Fowlpox Virus. VGAM583 host target gene, herein designated VGAM HOST TARGET GENE, is a human gene contained in the human genome.

VGAM583 gene encodes a VGAM583 precursor RNA, herein designated VGAM PRECURSOR RNA. Similar to other miRNA genes, and unlike most ordinary genes, VGAM583 precursor RNA does not encode a protein. A nucleotide sequence identical or highly similar to the nucleotide sequence of VGAM583 precursor RNA is designated SEQ ID:569, and is provided hereinbelow with reference to the sequence listing part. Nucleotide sequence SEQ ID:569 is located at position 274080 relative to the genome of Fowlpox Virus.

VGAM583 precursor RNA folds onto itself, forming VGAM583 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM583 folded precursor RNA into VGAM583 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM583 RNA is designated SEQ ID:3294, and is provided hereinbelow with reference to the sequence listing part.

VGAM583 host target gene, herein designated VGAM HOST TARGET GENE, encodes a corresponding messenger RNA, VGAM583 host target RNA, herein designated VGAM HOST TARGET RNA. VGAM583 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM583 RNA, herein designated VGAM RNA, binds complementarily to one or more host target binding sites located in untranslated regions of VGAM583 host target RNA, herein designated VGAM HOST TARGET RNA. This complementary binding is due to the fact that the nucleotide sequence of VGAM583 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM583 RNA, herein designated VGAM RNA, may have a different number of host target binding sites in untranslated regions of a VGAM583 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM583 RNA, herein designated VGAM RNA, to host target binding sites on VGAM583 host target RNA, herein designated VGAM HOST TARGET RNA, such as BINDING SITE I, BINDING SITE II and BINDING SITE III, inhibits translation of VGAM583 host target RNA into VGAM583 host target protein, herein designated VGAM HOST TARGET PROTEIN. VGAM host target protein is therefore outlined by a broken line.

It is appreciated that VGAM583 host target gene, herein designated VGAM HOST TARGET GENE, in fact represents a plurality of VGAM583 host target genes. The mRNA of each one of this plurality of VGAM583 host target genes comprises one or more host target binding sites, each having a nucleotide sequence which is at least partly complementary to VGAM583 RNA, herein designated VGAM RNA, and which when bound by VGAM583 RNA causes inhibition of translation of respective one or more VGAM583 host target proteins.

It is further appreciated by one skilled in the art that the mode of translational inhibition illustrated by FIG. 1 with specific reference to translational inhibition exerted by VGAM583 gene, herein designated VGAM GENE, on one or more VGAM583 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM583 is inhibition of expression of host target genes, as part of a novel viral mechanism of attacking a host. Accordingly, utilities of VGAM583 include diagnosis, prevention and treatment of viral infection by Fowlpox Virus. Specific functions, and accordingly utilities, of VGAM583 correlate with, and may be deduced from, the identity of the host target genes which VGAM583 binds and inhibits, and the function of these host target genes, as elaborated hereinbelow.

Nucleotide sequences of the VGAM583 precursor RNA, herein designated VGAM PRECURSOR RNA, and of the 'diced' VGAM583 RNA, herein designated VGAM RNA, and a schematic representation of the secondary folding of VGAM583 folded precursor RNA, herein designated VGAM FOLDED PRECURSOR RNA, of VGAM583 are further described hereinbelow with reference to Table 1.

Nucleotide sequences of host target binding sites, such as BINDING SITE-I, BINDING SITE-II and BINDING SITE-III of FIG. 1, found on VGAM583 host target RNA, and schematic representation of the complementarity of each of these host target binding sites to VGAM583 RNA, herein designated VGAM RNA, are described hereinbelow with reference to Table 2.

As mentioned hereinabove with reference to FIG. 1, a function of VGAM583 gene, herein designated VGAM is inhibition of expression of VGAM583 target genes. It is appreciated that specific functions, and accordingly utilities, of VGAM583 correlate with, and may be deduced from, the identity of the target genes which VGAM583 binds and inhibits, and the function of these target genes, as elaborated hereinbelow.

Interleukin 12 Receptor, Beta 2 (IL12RB2, Accession NM_001559) is a VGAM583 host target gene. IL12RB2 BINDING SITE is HOST TARGET binding site found in the 5' untranslated region of mRNA encoded by IL12RB2, corresponding to a HOST TARGET binding site such as BINDING SITE I, BINDING SITE II or BINDING SITE III. Table 2 illustrates the complementarity of the nucleotide sequences of IL12RB2 BINDING SITE, designated SEQ ID:7281, to the nucleotide sequence of VGAM583 RNA, herein designated VGAM RNA, also designated SEQ ID:3294.

A function of VGAM583 is therefore inhibition of Interleukin 12 Receptor, Beta 2 (IL12RB2, Accession NM_001559), a gene which is involved in il-12 transduction. binds to il-12 with a low affinity. Accordingly, utilities of VGAM583 include diagnosis, prevention and treatment of diseases and clinical conditions associated with IL12RB2. The function of IL12RB2 and its association with various diseases and clinical conditions, has been established by previous studies, as described hereinabove with reference to VGAM326. FLJ00024 (Accession XM_033361) is another VGAM583 host target gene. FLJ00024 BINDING SITE is HOST TARGET binding site found in the 5' untranslated region of mRNA encoded by FLJ00024, corresponding to a HOST TARGET binding site such as BINDING SITE I, BINDING SITE II or BINDING SITE III. Table 2 illustrates the complementarity of the nucleotide sequences of FLJ00024 BINDING SITE, designated SEQ ID:31887, to the nucleotide sequence of VGAM583 RNA, herein designated VGAM RNA, also designated SEQ ID:3294.

Another function of VGAM583 is therefore inhibition of FLJ00024 (Accession XM_033361). Accordingly, utilities of VGAM583 include diagnosis, prevention and treatment of diseases and clinical conditions associated with FLJ00024. LOC121536 (Accession XM_058567) is another VGAM583 host target gene. LOC121536 BINDING SITE is HOST TARGET binding site found in the 3' untranslated region of mRNA encoded by LOC121536, corresponding to a HOST TARGET binding site such as BINDING SITE I, BINDING SITE II or BINDING SITE III. Table 2 illustrates the complementarity of the nucleotide sequences of LOC121536 BINDING SITE, designated SEQ ID:36663, to the nucleotide sequence of VGAM583 RNA, herein designated VGAM RNA, also designated SEQ ID:3294.

Another function of VGAM583 is therefore inhibition of LOC121536 (Accession XM_058567). Accordingly, utilities of VGAM583 include diagnosis, prevention and treatment of diseases and clinical conditions associated with LOC121536. LOC221322 (Accession XM_166323) is another VGAM583 host target gene. LOC221322 BINDING SITE is HOST TARGET binding site found in the 5' untranslated region of mRNA encoded by LOC221322, corresponding to a HOST TARGET binding site such as BINDING SITE I, BINDING SITE II or BINDING SITE III. Table 2 illustrates the complementarity of the nucleotide sequences of LOC221322 BINDING SITE, designated SEQ ID:44152, to the nucleotide sequence of VGAM583 RNA, herein designated VGAM RNA, also designated SEQ ID:3294.

Another function of VGAM583 is therefore inhibition of LOC221322 (Accession XM_166323). Accordingly, utilities of VGAM583 include diagnosis, prevention and treatment of diseases and clinical conditions associated with LOC221322. FIG. 1 further provides a conceptual description of a novel bioinformatically detected viral gene of the present invention, referred to here as Viral Genomic Address Messenger 584 (VGAM584) viral gene, which modulates expression of respective host target genes thereof, the function and utility of which host target genes is known in the art.

VGAM584 is a novel bioinformatically detected regulatory, non protein coding, viral micro RNA (miRNA) gene. The method by which VGAM584 was detected is described hereinabove with reference to FIGS. 1-8.

VGAM584 gene, herein designated VGAM GENE, is a viral gene contained in the genome of Fowlpox Virus. VGAM584 host target gene, herein designated VGAM HOST TARGET GENE, is a human gene contained in the human genome.

VGAM584 gene encodes a VGAM584 precursor RNA, herein designated VGAM PRECURSOR RNA. Similar to other miRNA genes, and unlike most ordinary genes, VGAM584 precursor RNA does not encode a protein. A nucleotide sequence identical or highly similar to the nucleotide sequence of VGAM584 precursor RNA is designated SEQ ID:570, and is provided hereinbelow with reference to the sequence listing part. Nucleotide sequence SEQ ID:570 is located at position 54006 relative to the genome of Fowlpox Virus.

VGAM584 precursor RNA folds onto itself, forming VGAM584 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM584 folded precursor RNA into VGAM584 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM584 RNA is designated SEQ ID:3295, and is provided hereinbelow with reference to the sequence listing part.

VGAM584 host target gene, herein designated VGAM HOST TARGET GENE, encodes a corresponding messenger RNA, VGAM584 host target RNA, herein designated VGAM HOST TARGET RNA. VGAM584 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM584 RNA, herein designated VGAM RNA, binds complementarily to one or more host target binding sites located in untranslated regions of VGAM584 host target RNA, herein designated VGAM HOST TARGET RNA. This complementary binding is due to the fact that the nucleotide sequence of VGAM584 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM584 RNA, herein designated VGAM RNA, may have a different number of host target binding sites in untranslated regions of a VGAM584 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM584 RNA, herein designated VGAM RNA, to host target binding sites on VGAM584 host target RNA, herein designated VGAM HOST TARGET RNA, such as BINDING SITE I, BINDING SITE II and BINDING SITE III, inhibits translation of VGAM584 host target RNA into VGAM584 host target protein, herein designated VGAM HOST TARGET PROTEIN. VGAM host target protein is therefore outlined by a broken line.

It is appreciated that VGAM584 host target gene, herein designated VGAM HOST TARGET GENE, in fact represents a plurality of VGAM584 host target genes. The mRNA of each one of this plurality of VGAM584 host target genes comprises one or more host target binding sites, each having a nucleotide sequence which is at least partly complementary to VGAM584 RNA, herein designated VGAM RNA, and which when bound by VGAM584 RNA causes inhibition of translation of respective one or more VGAM584 host target proteins.

It is further appreciated by one skilled in the art that the mode of translational inhibition illustrated by FIG. 1 with specific reference to translational inhibition exerted by VGAM584 gene, herein designated VGAM GENE, on one or more VGAM584 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM584 is inhibition of expression of host target genes, as part of a novel viral mechanism of attacking a host. Accordingly, utilities of VGAM584 include diagnosis, prevention and treatment of viral infection by Fowlpox Virus. Specific functions, and accordingly utilities, of VGAM584 correlate with, and may be deduced from, the identity of the host target genes which VGAM584 binds and inhibits, and the function of these host target genes, as elaborated hereinbelow.

Nucleotide sequences of the VGAM584 precursor RNA, herein designated VGAM PRECURSOR RNA, and of the 'diced' VGAM584 RNA, herein designated VGAM RNA, and a schematic representation of the secondary folding of VGAM584 folded precursor RNA, herein designated VGAM FOLDED PRECURSOR RNA, of VGAM584 are further described hereinbelow with reference to Table 1.

Nucleotide sequences of host target binding sites, such as BINDING SITE-I, BINDING SITE-II and BINDING SITE-III of FIG. 1, found on VGAM584 host target RNA, and schematic representation of the complementarity of each of these host target binding sites to VGAM584 RNA, herein designated VGAM RNA, are described hereinbelow with reference to Table 2.

As mentioned hereinabove with reference to FIG. 1, a function of VGAM584 gene, herein designated VGAM is inhibition of expression of VGAM584 target genes. It is appreciated that specific functions, and accordingly utilities, of VGAM584 correlate with, and may be deduced from, the identity of the target genes which VGAM584 binds and inhibits, and the function of these target genes, as elaborated hereinbelow.

Desmoplakin (DPI, DPII) (DSP, Accession NM_004415) is a VGAM584 host target gene. DSP BINDING SITE is HOST TARGET binding site found in the 3" untranslated region of mRNA encoded by DSP, corresponding to a HOST TARGET binding site such as BINDING SITE I, BINDING SITE II or BINDING SITE III. Table 2 illustrates the complementarity of the nucleotide sequences of DSP BINDING SITE, designated SEQ ID:10678, to the nucleotide sequence of VGAM584 RNA, herein designated VGAM RNA, also designated SEQ ID:3295.

A function of VGAM584 is therefore inhibition of Desmoplakin (DPI, DPII) (DSP, Accession NM_004415). Accordingly, utilities of VGAM584 include diagnosis, prevention and treatment of diseases and clinical conditions associated with DSP. Retinoic Acid Induced 2 (RAI2, Accession NM_021785) is another VGAM584 host target gene. RAI2 BINDING SITE is HOST TARGET binding site found in the 5' untranslated region of mRNA encoded by RAI2, corresponding to a HOST TARGET binding site such as BINDING SITE I, BINDING SITE II or BINDING SITE III. Table 2 illustrates the complementarity of the nucleotide sequences of RAI2 BINDING SITE, designated SEQ ID:22350, to the nucleotide sequence of VGAM584 RNA, herein designated VGAM RNA, also designated SEQ ID:3295.

Another function of VGAM584 is therefore inhibition of Retinoic Acid Induced 2 (RAI2, Accession NM_021785). Accordingly, utilities of VGAM584 include diagnosis, prevention and treatment of diseases and clinical conditions associated with RAI2. Dual-specificity tyrosine-(Y)-phosphorylation Regulated Kinase 4 (DYRK4, Accession XM_034551) is another VGAM584 host target gene. DYRK4 BINDING SITE is HOST TARGET binding site found in the 5' untranslated region of mRNA encoded by DYRK4, corresponding to a HOST TARGET binding site such as BINDING SITE I, BINDING SITE II or BINDING SITE III. Table 2 illustrates the complementarity of the nucleotide sequences of DYRK4 BINDING SITE, designated SEQ ID:32123, to the nucleotide sequence of VGAM584 RNA, herein designated VGAM RNA, also designated SEQ ID:3295.

Another function of VGAM584 is therefore inhibition of Dual-specificity tyrosine-(Y)-phosphorylation Regulated Kinase 4 (DYRK4, Accession XM_034551). Accordingly, utilities of VGAM584 include diagnosis, prevention and treatment of diseases and clinical conditions associated with DYRK4. FLJ21032 (Accession NM_024906) is another VGAM584 host target gene. FLJ21032 BINDING SITE is HOST TARGET binding site found in the 3' untranslated region of mRNA encoded by FLJ21032, corresponding to a HOST TARGET binding site such as BINDING SITE I, BINDING SITE II or BINDING SITE III. Table 2 illustrates the complementarity of the nucleotide sequences of FLJ21032 BINDING SITE, designated SEQ ID:24401, to the nucleotide sequence of VGAM584 RNA, herein designated VGAM RNA, also designated SEQ ID:3295.

Another function of VGAM584 is therefore inhibition of FLJ21032 (Accession NM_024906). Accordingly, utilities of VGAM584 include diagnosis, prevention and treatment of diseases and clinical conditions associated with FLJ21032. LOC219942 (Accession XM_167790) is another VGAM584 host target gene. LOC219942 BINDING SITE is HOST TARGET binding site found in the 3' untranslated region of mRNA encoded by LOC219942, corresponding to a HOST TARGET binding site such as BINDING SITE I, BINDING SITE II or BINDING SITE III. Table 2 illustrates the complementarity of the nucleotide sequences of LOC219942 BINDING SITE, designated SEQ ID:44826, to the nucleotide sequence of VGAM584 RNA, herein designated VGAM RNA, also designated SEQ ID:3295.

Another function of VGAM584 is therefore inhibition of LOC219942 (Accession XM_167790). Accordingly, utilities of VGAM584 include diagnosis, prevention and treatment of diseases and clinical conditions associated with LOC219942. LOC221288 (Accession XM_168058) is another VGAM584 host target gene. LOC221288 BINDING SITE is HOST TARGET binding site found in the 3' untranslated region of mRNA encoded by LOC221288, corresponding to a HOST TARGET binding site such as BINDING SITE I, BINDING SITE II or BINDING SITE III. Table 2 illustrates the complementarity of the nucleotide sequences of LOC221288 BINDING SITE, designated SEQ ID:44973, to the nucleotide sequence of VGAM584 RNA, herein designated VGAM RNA, also designated SEQ ID:3295.

Another function of VGAM584 is therefore inhibition of LOC221288 (Accession XM_168058). Accordingly, utilities of VGAM584 include diagnosis, prevention and treatment of diseases and clinical conditions associated with LOC221288. FIG. 1 further provides a conceptual description of a novel bioinformatically detected viral gene of the present invention, referred to here as Viral Genomic Address Messenger 585 (VGAM585) viral gene, which modulates expression of respective host target genes thereof, the function and utility of which host target genes is known in the art.

VGAM585 is a novel bioinformatically detected regulatory, non protein coding, viral micro RNA (miRNA) gene. The method by which VGAM585 was detected is described hereinabove with reference to FIGS. 1-8.

VGAM585 gene, herein designated VGAM GENE, is a viral gene contained in the genome of Gallid Herpesvirus 2. VGAM585 host target gene, herein designated VGAM HOST TARGET GENE, is a human gene contained in the human genome.

VGAM585 gene encodes a VGAM585 precursor RNA, herein designated VGAM PRECURSOR RNA. Similar to other miRNA genes, and unlike most ordinary genes, VGAM585 precursor RNA does not encode a protein. A nucleotide sequence identical or highly similar to the nucleotide sequence of VGAM585 precursor RNA is designated SEQ ID:571, and is provided hereinbelow with reference to the sequence listing part. Nucleotide sequence SEQ ID:571 is located at position 24033 relative to the genome of Gallid Herpesvirus 2.

VGAM585 precursor RNA folds onto itself, forming VGAM585 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM585 folded precursor RNA into VGAM585 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 62%) nucleotide sequence of VGAM585 RNA is designated SEQ ID:3296, and is provided hereinbelow with reference to the sequence listing part.

VGAM585 host target gene, herein designated VGAM HOST TARGET GENE, encodes a corresponding messenger RNA, VGAM585 host target RNA, herein designated VGAM HOST TARGET RNA. VGAM585 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM585 RNA, herein designated VGAM RNA, binds complementarily to one or more host target binding sites located in untranslated regions of VGAM585 host target RNA, herein designated VGAM HOST TARGET RNA. This complementary binding is due to the fact that the nucleotide sequence of VGAM585 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM585 RNA, herein designated VGAM RNA, may have a different number of host target binding sites in untranslated regions of a VGAM585 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM585 RNA, herein designated VGAM RNA, to host target binding sites on VGAM585 host target RNA, herein designated VGAM HOST TARGET RNA, such as BINDING SITE I, BINDING SITE II and BINDING SITE III, inhibits translation of VGAM585 host target RNA into VGAM585 host target protein, herein designated VGAM HOST TARGET PROTEIN. VGAM host target protein is therefore outlined by a broken line.

It is appreciated that VGAM585 host target gene, herein designated VGAM HOST TARGET GENE, in fact represents a plurality of VGAM585 host target genes. The mRNA of each one of this plurality of VGAM585 host target genes comprises one or more host target binding sites, each having a nucleotide sequence which is at least partly complementary to VGAM585 RNA, herein designated VGAM RNA, and which when bound by VGAM585 RNA causes inhibition of translation of respective one or more VGAM585 host target proteins.

It is further appreciated by one skilled in the art that the mode of translational inhibition illustrated by FIG. 1 with specific reference to translational inhibition exerted by VGAM585 gene, herein designated VGAM GENE, on one or more VGAM585 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM585 is inhibition of expression of host target genes, as part of a novel viral mechanism of attacking a host. Accordingly, utilities of VGAM585 include diagnosis, prevention and treatment of viral infection by Gallid Herpesvirus 2. Specific functions, and accordingly utilities, of VGAM585 correlate with, and may be deduced from, the identity of the host target genes which VGAM585 binds and inhibits, and the function of these host target genes, as elaborated hereinbelow.

Nucleotide sequences of the VGAM585 precursor RNA, herein designated VGAM PRECURSOR RNA, and of the 'diced' VGAM585 RNA, herein designated VGAM RNA, and a schematic representation of the secondary folding of VGAM585 folded precursor RNA, herein designated VGAM FOLDED PRECURSOR RNA, of VGAM585 are further described hereinbelow with reference to Table 1.

Nucleotide sequences of host target binding sites, such as BINDING SITE-I, BINDING SITE-II and BINDING SITE-III of FIG. 1, found on VGAM585 host target RNA, and schematic representation of the complementarity of each of these host target binding sites to VGAM585 RNA, herein designated VGAM RNA, are described hereinbelow with reference to Table 2.

As mentioned hereinabove with reference to FIG. 1, a function of VGAM585 gene, herein designated VGAM is inhibition of expression of VGAM585 target genes. It is appreciated that specific functions, and accordingly utilities, of VGAM585 correlate with, and may be deduced from, the identity of the target genes which VGAM585 binds and inhibits, and the function of these target genes, as elaborated hereinbelow.

EGF-like-domain, Multiple 5 (EGFL5, Accession XM_098838) is a VGAM585 host target gene. EGFL5 BINDING SITE is HOST TARGET binding site found in the 5' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41875, to the nucleotide sequence of VGAM585 RNA, herein designated VGAM RNA, also designated SEQ ID:3296.

A function of VGAM585 is therefore inhibition of EGF-like-domain, Multiple 5 (EGFL5, Accession XM_098838). Accordingly, utilities of VGAM585 include diagnosis, prevention and treatment of diseases and clinical conditions associated with EGFL5. LOC165552 (Accession XM_092666) is another VGAM585 host target gene. LOC165552 BINDING SITE is HOST TARGET binding site found in the 3' untranslated region of mRNA encoded by LOC165552, corresponding to a HOST TARGET binding site such as BINDING SITE I, BINDING SITE II or BINDING SITE III. Table 2 illustrates the complementarity of the nucleotide sequences of LOC165552 BINDING SITE, designated SEQ ID:40131, to the nucleotide sequence of VGAM585 RNA, herein designated VGAM RNA, also designated SEQ ID:3296.

Another function of VGAM585 is therefore inhibition of LOC165552 (Accession XM_092666). Accordingly, utilities of VGAM585 include diagnosis, prevention and treatment of diseases and clinical conditions associated with LOC165552. LOC200132 (Accession XM_114126) is another VGAM585 host target gene. LOC200132 BINDING SITE is HOST TARGET binding site found in the 3' untranslated region of mRNA encoded by LOC200132, corresponding to a HOST TARGET binding site such as BINDING SITE I, BINDING SITE II or BINDING SITE III. Table 2 illustrates the complementarity of the nucleotide sequences of LOC200132 BINDING SITE, designated SEQ ID:42710, to the nucleotide sequence of VGAM585 RNA, herein designated VGAM RNA, also designated SEQ ID:3296.

Another function of VGAM585 is therefore inhibition of LOC200132 (Accession XM_114126). Accordingly, utilities of VGAM585 include diagnosis, prevention and treatment of diseases and clinical conditions associated with LOC200132. LOC93380 (Accession XM_051020) is another VGAM585 host target gene. LOC93380 BINDING SITE is HOST TARGET binding site found in the 3' untranslated region of mRNA encoded by LOC93380, corresponding to a HOST TARGET binding site such as BINDING SITE I, BINDING SITE II or BINDING SITE III. Table 2 illustrates the complementarity of the nucleotide sequences of LOC93380 BINDING SITE, designated SEQ ID:35724, to the nucleotide sequence of VGAM585 RNA, herein designated VGAM RNA, also designated SEQ ID:3296.

Another function of VGAM585 is therefore inhibition of LOC93380 (Accession XM_051020). Accordingly, utilities of VGAM585 include diagnosis, prevention and treatment of diseases and clinical conditions associated with LOC93380.

FIG. 1 further provides a conceptual description of a novel bioinformatically detected viral gene of the present invention, referred to here as Viral Genomic Address Messenger 586 (VGAM586) viral gene, which modulates expression of respective host target genes thereof, the function and utility of which host target genes is known in the art.

VGAM586 is a novel bioinformatically detected regulatory, non protein coding, viral micro RNA (miRNA) gene.

The method by which VGAM586 was detected is described hereinabove with reference to FIGS. 1-8.

VGAM586 gene, herein designated VGAM GENE, is a viral gene contained in the genome of Gallid Herpesvirus 2. VGAM586 host target gene, herein designated VGAM HOST TARGET GENE, is a human gene contained in the human genome.

VGAM586 gene encodes a VGAM586 precursor RNA, herein designated VGAM PRECURSOR RNA. Similar to other miRNA genes, and unlike most ordinary genes, VGAM586 precursor RNA does not encode a protein. A nucleotide sequence identical or highly similar to the nucleotide sequence of VGAM586 precursor RNA is designated SEQ ID:572, and is provided hereinbelow with reference to the sequence listing part. Nucleotide sequence SEQ ID:572 is located at position 25576 relative to the genome of Gallid Herpesvirus 2.

VGAM586 precursor RNA folds onto itself, forming VGAM586 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM586 folded precursor RNA into VGAM586 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 62%) nucleotide sequence of VGAM586 RNA is designated SEQ ID:3297, and is provided hereinbelow with reference to the sequence listing part.

VGAM586 host target gene, herein designated VGAM HOST TARGET GENE, encodes a corresponding messenger RNA, VGAM586 host target RNA, herein designated VGAM HOST TARGET RNA. VGAM586 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM586 RNA, herein designated VGAM RNA, binds complementarily to one or more host target binding sites located in untranslated regions of VGAM586 host target RNA, herein designated VGAM HOST TARGET RNA. This complementary binding is due to the fact that the nucleotide sequence of VGAM586 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM586 RNA, herein designated VGAM RNA, may have a different number of host target binding sites in untranslated regions of a VGAM586 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM586 RNA, herein designated VGAM RNA, to host target binding sites on VGAM586 host target RNA, herein designated VGAM HOST TARGET RNA, such as BINDING SITE I, BINDING SITE II and BINDING SITE III, inhibits translation of VGAM586 host target RNA into VGAM586 host target protein, herein designated VGAM HOST TARGET PROTEIN. VGAM host target protein is therefore outlined by a broken line.

It is appreciated that VGAM586 host target gene, herein designated VGAM HOST TARGET GENE, in fact represents a plurality of VGAM586 host target genes. The mRNA of each one of this plurality of VGAM586 host target genes comprises one or more host target binding sites, each having a nucleotide sequence which is at least partly complementary to VGAM586 RNA, herein designated VGAM RNA, and which when bound by VGAM586 RNA causes inhibition of translation of respective one or more VGAM586 host target proteins.

It is further appreciated by one skilled in the art that the mode of translational inhibition illustrated by FIG. 1 with specific reference to translational inhibition exerted by VGAM586 gene, herein designated VGAM GENE, on one or more VGAM586 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM586 is inhibition of expression of host target genes, as part of a novel viral mechanism of attacking a host. Accordingly, utilities of VGAM586 include diagnosis, prevention and treatment of viral infection by Gallid Herpesvirus 2. Specific functions, and accordingly utilities, of VGAM586 correlate with, and may be deduced from, the identity of the host target genes which VGAM586 binds and inhibits, and the function of these host target genes, as elaborated hereinbelow.

Nucleotide sequences of the VGAM586 precursor RNA, herein designated VGAM PRECURSOR RNA, and of the 'diced' VGAM586 RNA, herein designated VGAM RNA, and a schematic representation of the secondary folding of VGAM586 folded precursor RNA, herein designated VGAM FOLDED PRECURSOR RNA, of VGAM586 are further described hereinbelow with reference to Table 1.

Nucleotide sequences of host target binding sites, such as BINDING SITE-I, BINDING SITE-II and BINDING SITE-III of FIG. 1, found on VGAM586 host target RNA, and schematic representation of the complementarity of each of these host target binding sites to VGAM586 RNA, herein designated VGAM RNA, are described hereinbelow with reference to Table 2.

As mentioned hereinabove with reference to FIG. 1, a function of VGAM586 gene, herein designated VGAM is inhibition of expression of VGAM586 target genes. It is appreciated that specific functions, and accordingly utilities, of VGAM586 correlate with, and may be deduced from, the identity of the target genes which VGAM586 binds and inhibits, and the function of these target genes, as elaborated hereinbelow.

Amiloride-sensitive Cation Channel 2, Neuronal (ACCN2, Accession NM_020039) is a VGAM586 host target gene. ACCN2 BINDING SITE is HOST TARGET binding site found in the 3' untranslated region of mRNA encoded by ACCN2, corresponding to a HOST TARGET binding site such as BINDING SITE I, BINDING SITE II or BINDING SITE III. Table 2 illustrates the complementarity of the nucleotide sequences of ACCN2 BINDING SITE, designated SEQ ID:21297, to the nucleotide sequence of VGAM586 RNA, herein designated VGAM RNA, also designated SEQ ID:3297.

A function of VGAM586 is therefore inhibition of Amiloride-sensitive Cation Channel 2, Neuronal (ACCN2, Accession NM_020039). Accordingly, utilities of VGAM586 include diagnosis, prevention and treatment of diseases and clinical conditions associated with ACCN2. COX11 Homolog, Cytochrome C Oxidase Assembly Protein (yeast) (COX11, Accession NM_004375) is another VGAM586 host target gene. COX11 BINDING SITE is HOST TARGET binding site found in the 3' untranslated region of mRNA encoded by COX11, corresponding to a HOST TARGET binding site such as BINDING SITE I, BINDING SITE II or BINDING SITE III. Table 2 illustrates the complementarity of the nucleotide sequences of COX11 BINDING SITE, designated SEQ ID:10592, to the nucleotide sequence of VGAM586 RNA, herein designated VGAM RNA, also designated SEQ ID:3297.

Another function of VGAM586 is therefore inhibition of COX11 Homolog, Cytochrome C Oxidase Assembly Protein (yeast) (COX11, Accession NM_004375). Accordingly, utilities of VGAM586 include diagnosis, prevention and treatment of diseases and clinical conditions associated with COX11. NORE1 (Accession NM_031437) is another VGAM586 host target gene. NORE1 BINDING SITE is HOST TARGET binding site found in the 3' untranslated region of mRNA encoded by NORE1, corresponding to a HOST TARGET binding site such as BINDING SITE I, BINDING SITE II or BINDING SITE III. Table 2 illustrates the complementarity of the nucleotide sequences of NORE1 BINDING SITE, designated SEQ ID:25443, to the nucleotide sequence of VGAM586 RNA, herein designated VGAM RNA, also designated SEQ ID:3297.

Another function of VGAM586 is therefore inhibition of NORE1 (Accession NM_031437), a gene which may modulate intracellular signal transduction pathways. Accordingly, utilities of VGAM586 include diagnosis, prevention and treatment of diseases and clinical conditions associated with NORE1. The function of NORE1 and its association with various diseases and clinical conditions, has been established by previous studies, as described hereinabove with reference to VGAM276. Solute Carrier Family 14 (urea transporter), Member 1 (Kidd blood group) (SLC14A1, Accession NM_015865) is another VGAM586 host target gene. SLC14A1 BINDING SITE is HOST TARGET binding site found in the 3' untranslated region of mRNA encoded by SLC14A1, corresponding to a HOST TARGET binding site such as BINDING SITE I, BINDING SITE II or BINDING SITE III. Table 2 illustrates the complementarity of the nucleotide sequences of SLC14A1 BINDING SITE, designated SEQ ID:17996, to the nucleotide sequence of VGAM586 RNA, herein designated VGAM RNA, also designated SEQ ID:3297.

Another function of VGAM586 is therefore inhibition of Solute Carrier Family 14 (urea transporter), Member 1 (Kidd blood group) (SLC14A1, Accession NM_015865), a gene which is a urea transporters in spermatogenesis. Accordingly, utilities of VGAM586 include diagnosis, prevention and treatment of diseases and clinical conditions associated with SLC14A1. The function of SLC14A1 has been established by previous studies. Tsukaguchi et al. (1997) undertook a characterization of the tissue distribution and physiologic role of the erythrocyte urea transporter, UT11, by studying its rat homolog and testing whether there are additional urea transporter isoforms expressed in rat kidney. Using a PCR-based homology cloning approach with degenerate primers corresponding to conserved regions of the UT family of genes, they isolated a kidney urea transporter that appeared to be the rat homolog of human UT11. The rat gene, symbolized UT3 by them, was strongly expressed in the kidney. Furthermore, UT3 was expressed in testis, brain, bone marrow, and spleen. Its expression in the rat testis suggested a potential role for urea transporters in spermatogenesis. On in situ hybridization of testis, UT3 was detected in Sertoli cells associated with the early stages of spermatocyte development. The distribution in the kidneys suggested that UT3 is involved in counter-current exchange between ascending and descending vasa recta, to enhance the cortico-papillary osmolality gradient. Although Jk-null red blood cells have reduced urea permeability, the Jk deficiency is not associated with any obvious clinical syndrome except for a urine concentration defect (Sands et al., 1992) that probably results from the absence of the Jk protein expressed on endothelial cells of the vasa recta of kidney (Xu et al., 1997; Promeneur et al., 1996). Persons with the Jk-null phenotype are detected because antibody against Jk3 can develop after immunization by transfusion or pregnancy, and this antibody may cause immediate and delayed hemolytic transfusion reactions (Lucien et al. (2002)).

Full details of the abovementioned studies are described in the following publications, the disclosure of which are hereby incorporated by reference:

Tsukaguchi, H.; Shayakul, C.; Berger, U. V.; Tokui, T.; Brown, D.; Hediger, M. A. : Cloning and characterization of the urea transportation UT3: localization in rat kidney and testis. J. Clin. Invest. 99:1506-1515, 1997.; and Sands, J. M.; Gargus, J. J.; Frohlich, O.; Gunn, R. B.; Kokko, J. P.: Urinary concentrating ability in patients with Jk(a/b) blood type who lack carrier-mediated urea transport. J. Am. Soc.

Further studies establishing the function and utilities of SLC14A1 are found in John Hopkins OMIM database record ID 111000, and in sited publications numbered 12376-12090, 9433, 12091, 12092-12094, 11251, 12095-22 and 3780-234 listed in the bibliography section hereinbelow, which are also hereby incorporated by reference. Chromosome 6 Open Reading Frame 26 (C6orf26, Accession NM_025259) is another VGAM586 host target gene. C6orf26 BINDING SITE is HOST TARGET binding site found in the 3' untranslated region of mRNA encoded by C6orf26, corresponding to a HOST TARGET binding site such as BINDING SITE I, BINDING SITE II or BINDING SITE III. Table 2 illustrates the complementarity of the nucleotide sequences of C6orf26 BINDING SITE, designated SEQ ID:24929, to the nucleotide sequence of VGAM586 RNA, herein designated VGAM RNA, also designated SEQ ID:3297.

Another function of VGAM586 is therefore inhibition of Chromosome 6 Open Reading Frame 26 (C6orf26, Accession NM_025259). Accordingly, utilities of VGAM586 include diagnosis, prevention and treatment of diseases and clinical conditions associated with C6orf26. FLJ20188 (Accession NM_017703) is another VGAM586 host target gene. FLJ20188 BINDING SITE is HOST TARGET binding site found in the 3' untranslated region of mRNA encoded by FLJ20188, corresponding to a HOST TARGET binding site such as BINDING SITE I, BINDING SITE II or BINDING SITE III. Table 2 illustrates the complementarity of the nucleotide sequences of FLJ20188 BINDING SITE, designated SEQ ID:19275, to the nucleotide sequence of VGAM586 RNA, herein designated VGAM RNA, also designated SEQ ID:3297.

Another function of VGAM586 is therefore inhibition of FLJ20188 (Accession NM_017703). Accordingly, utilities of VGAM586 include diagnosis, prevention and treatment of diseases and clinical conditions associated with FLJ20188. LOC221143 (Accession XM_167986) is another VGAM586 host target gene. LOC221143 BINDING SITE is HOST TARGET binding site found in the 3' untranslated region of mRNA encoded by LOC221143, corresponding to a HOST TARGET binding site such as BINDING SITE I, BINDING SITE II or BINDING SITE III. Table 2 illustrates the complementarity of the nucleotide sequences of LOC221143 BINDING SITE, designated SEQ ID:44945, to the nucleotide sequence of VGAM586 RNA, herein designated VGAM RNA, also designated SEQ ID:3297.

Another function of VGAM586 is therefore inhibition of LOC221143 (Accession XM_167986). Accordingly, utilities of VGAM586 include diagnosis, prevention and treatment of diseases and clinical conditions associated with LOC221143. LOC253918 (Accession XM_171345) is another VGAM586 host target gene. LOC253918 BINDING SITE is HOST TARGET binding site found in the 5' untranslated region of mRNA encoded by LOC253918, corresponding to a HOST TARGET binding site such as BINDING SITE I, BINDING SITE II or BINDING SITE III. Table 2 illustrates the complementarity of the nucleotide sequences of LOC253918 BINDING SITE, designated SEQ ID:46042, to the nucleotide sequence of VGAM586 RNA, herein designated VGAM RNA, also designated SEQ ID:3297.

Another function of VGAM586 is therefore inhibition of LOC253918 (Accession XM_171345). Accordingly, utilities of VGAM586 include diagnosis, prevention and treatment of diseases and clinical conditions associated with LOC253918. FIG. 1 further provides a conceptual description of a novel bioinformatically detected viral gene of the present invention, referred to here as Viral Genomic Address Messenger 587 (VGAM587) viral gene, which modulates expression of respective host target genes thereof, the function and utility of which host target genes is known in the art.

VGAM587 is a novel bioinformatically detected regulatory, non protein coding, viral micro RNA (miRNA) gene. The method by which VGAM587 was detected is described hereinabove with reference to FIGS. 1-8.

VGAM587 gene, herein designated VGAM GENE, is a viral gene contained in the genome of Gallid Herpesvirus 2. VGAM587 host target gene, herein designated VGAM HOST TARGET GENE, is a human gene contained in the human genome.

VGAM587 gene encodes a VGAM587 precursor RNA, herein designated VGAM PRECURSOR RNA. Similar to other miRNA genes, and unlike most ordinary genes, VGAM587 precursor RNA does not encode a protein. A nucleotide sequence identical or highly similar to the nucleotide sequence of VGAM587 precursor RNA is designated SEQ ID:573, and is provided hereinbelow with reference to the sequence listing part. Nucleotide sequence SEQ ID:573 is located at position 24271 relative to the genome of Gallid Herpesvirus 2.

VGAM587 precursor RNA folds onto itself, forming VGAM587 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM587 folded precursor RNA into VGAM587 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM587 RNA is designated SEQ ID:3298, and is provided hereinbelow with reference to the sequence listing part.

VGAM587 host target gene, herein designated VGAM HOST TARGET GENE, encodes a corresponding messenger RNA, VGAM587 host target RNA, herein designated VGAM HOST TARGET RNA. VGAM587 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM587 RNA, herein designated VGAM RNA, binds complementarily to one or more host target binding sites located in untranslated regions of VGAM587 host target RNA, herein designated VGAM HOST TARGET RNA. This complementary binding is due to the fact that the nucleotide sequence of VGAM587 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM587 RNA, herein designated VGAM RNA, may have a different number of host target binding sites in untranslated regions of a VGAM587 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM587 RNA, herein designated VGAM RNA, to host target binding sites on VGAM587 host target RNA, herein designated VGAM HOST TARGET RNA, such as BINDING SITE I, BINDING SITE II and BINDING SITE III, inhibits translation of VGAM587 host target RNA into VGAM587 host target protein, herein designated VGAM HOST TARGET PROTEIN. VGAM host target protein is therefore outlined by a broken line.

It is appreciated that VGAM587 host target gene, herein designated VGAM HOST TARGET GENE, in fact represents a plurality of VGAM587 host target genes. The mRNA of each one of this plurality of VGAM587 host target genes comprises one or more host target binding sites, each having a nucleotide sequence which is at least partly complementary to VGAM587 RNA, herein designated VGAM RNA, and which when bound by VGAM587 RNA causes inhibition of translation of respective one or more VGAM587 host target proteins.

It is further appreciated by one skilled in the art that the mode of translational inhibition illustrated by FIG. 1 with specific reference to translational inhibition exerted by VGAM587 gene, herein designated VGAM GENE, on one or more VGAM587 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM587 is inhibition of expression of host target genes, as part of a novel viral mechanism of attacking a host. Accordingly, utilities of VGAM587 include diagnosis, prevention and treatment of viral infection by Gallid Herpesvirus 2. Specific functions, and accordingly utilities, of VGAM587 correlate with, and may be deduced from, the identity of the host target genes which VGAM587 binds and inhibits, and the function of these host target genes, as elaborated hereinbelow.

Nucleotide sequences of the VGAM587 precursor RNA, herein designated VGAM PRECURSOR RNA, and of the 'diced' VGAM587 RNA, herein designated VGAM RNA, and a schematic representation of the secondary folding of VGAM587 folded precursor RNA, herein designated VGAM FOLDED PRECURSOR RNA, of VGAM587 are further described hereinbelow with reference to Table 1.

Nucleotide sequences of host target binding sites, such as BINDING SITE-I, BINDING SITE-II and BINDING SITE-III of FIG. 1, found on VGAM587 host target RNA, and schematic representation of the complementarity of each of these host target binding sites to VGAM587 RNA, herein designated VGAM RNA, are described hereinbelow with reference to Table 2.

As mentioned hereinabove with reference to FIG. 1, a function of VGAM587 gene, herein designated VGAM is inhibition of expression of VGAM587 target genes. It is appreciated that specific functions, and accordingly utilities, of VGAM587 correlate with, and may be deduced from, the identity of the target genes which VGAM587 binds and inhibits, and the function of these target genes, as elaborated hereinbelow.

Desmocollin 3 (DSC3, Accession NM_001941) is a VGAM587 host target gene. DSC3 BINDING SITE1 and DSC3 BINDING SITE2 are HOST TARGET binding sites found in untranslated regions of mRNA encoded by DSC3, corresponding to HOST TARGET binding sites such as BINDING SITE I, BINDING SITE II or BINDING SITE III. Table 2 illustrates the complementarity of the nucleotide sequences of DSC3 BINDING SITE1 and DSC3 BINDING SITE2, designated SEQ ID:7652 and SEQ ID:23663 respectively, to the nucleotide sequence of VGAM587 RNA, herein designated VGAM RNA, also designated SEQ ID:3298.

A function of VGAM587 is therefore inhibition of Desmocollin 3 (DSC3, Accession NM_001941), a gene which is a component of intercellular desmosome junctions. Accordingly, utilities of VGAM587 include diagnosis, prevention and treatment of diseases and clinical conditions associated with DSC3. The function of DSC3 and its association with various diseases and clinical conditions, has been established by previous studies, as described hereinabove with reference to VGAM230. Solute Carrier Family 14 (urea transporter), Member 1 (Kidd blood group) (SLC14A1, Accession NM_015865) is another VGAM587 host target gene. SLC14A1 BINDING SITE is HOST TARGET binding site found in the 5' untranslated region of mRNA encoded by SLC14A1, corresponding to a HOST TARGET binding site such as BINDING SITE I, BINDING SITE II or BINDING SITE III. Table 2 illustrates the complementarity of the nucleotide sequences of SLC14A1 BINDING SITE, designated SEQ ID:17995, to the nucleotide sequence of VGAM587 RNA, herein designated VGAM RNA, also designated SEQ ID:3298.

Another function of VGAM587 is therefore inhibition of Solute Carrier Family 14 (urea transporter), Member 1 (Kidd blood group) (SLC14A1, Accession NM_015865), a gene which is a urea transporters in spermatogenesis. Accordingly, utilities of VGAM587 include diagnosis, prevention and treatment of diseases and clinical conditions associated with SLC14A1. The function of SLC14A1 and its association with various diseases and clinical conditions, has been established by previous studies, as described hereinabove with reference to VGAM586. Chromosome 8 Open Reading Frame 4 (C8orf4, Accession NM_020130) is another VGAM587 host target gene. C8orf4 BINDING SITE is HOST TARGET binding site found in the 3' untranslated region of mRNA encoded by C8orf4, corresponding to a HOST TARGET binding site such as BINDING SITE I, BINDING SITE II or BINDING SITE III. Table 2 illustrates the complementarity of the nucleotide sequences of C8orf4 BINDING SITE, designated SEQ ID:21324, to the nucleotide sequence of VGAM587 RNA, herein designated VGAM RNA, also designated SEQ ID:3298.

Another function of VGAM587 is therefore inhibition of Chromosome 8 Open Reading Frame 4 (C8orf4, Accession NM_020130). Accordingly, utilities of VGAM587 include diagnosis, prevention and treatment of diseases and clinical conditions associated with C8orf4. FLJ10700 (Accession NM_018182) is another VGAM587 host target gene. FLJ10700 BINDING SITE is HOST TARGET binding site found in the 3' untranslated region of mRNA encoded by FLJ10700, corresponding to a HOST TARGET binding site such as BINDING SITE I, BINDING SITE II or BINDING SITE III. Table 2 illustrates the complementarity of the nucleotide sequences of FLJ10700 BINDING SITE, designated SEQ ID:20018, to the nucleotide sequence of VGAM587 RNA, herein designated VGAM RNA, also designated SEQ ID:3298.

Another function of VGAM587 is therefore inhibition of FLJ10700 (Accession NM_018182). Accordingly, utilities of VGAM587 include diagnosis, prevention and treatment of diseases and clinical conditions associated with FLJ10700. FLJ20276 (Accession NM_017738) is another VGAM587 host target gene. FLJ20276 BINDING SITE is HOST TARGET binding site found in the 3' untranslated region of mRNA encoded by FLJ20276, corresponding to a HOST TARGET binding site such as BINDING SITE I, BINDING SITE II or BINDING SITE III. Table 2 illustrates the complementarity of the nucleotide sequences of FLJ20276 BINDING SITE, designated SEQ ID:19326, to the nucleotide sequence of VGAM587 RNA, herein designated VGAM RNA, also designated SEQ ID:3298.

Another function of VGAM587 is therefore inhibition of FLJ20276 (Accession NM_017738). Accordingly, utilities of VGAM587 include diagnosis, prevention and treatment of diseases and clinical conditions associated with FLJ20276. FLJ21839 (Accession NM_021831) is another VGAM587 host target gene. FLJ21839 BINDING SITE is HOST TARGET binding site found in the 3' untranslated region of mRNA encoded by FLJ21839, corresponding to a HOST TARGET binding site such as BINDING SITE I, BINDING SITE II or BINDING SITE III. Table 2 illustrates the complementarity of the nucleotide sequences of FLJ21839 BINDING SITE, designated SEQ ID:22405, to the nucleotide sequence of VGAM587 RNA, herein designated VGAM RNA, also designated SEQ ID:3298.

Another function of VGAM587 is therefore inhibition of FLJ21839 (Accession NM_021831). Accordingly, utilities of VGAM587 include diagnosis, prevention and treatment of diseases and clinical conditions associated with FLJ21839. LOC163682 (Accession XM_099402) is another VGAM587 host target gene. LOC163682 BINDING SITE is HOST TARGET binding site found in the 5' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42082, to the nucleotide sequence of VGAM587 RNA, herein designated VGAM RNA, also designated SEQ ID:3298.

Another function of VGAM587 is therefore inhibition of LOC163682 (Accession XM_099402). Accordingly, utilities of VGAM587 include diagnosis, prevention and treatment of diseases and clinical conditions associated with LOC163682. LOC169026 (Accession XM_095471) is another VGAM587 host target gene. LOC169026 BINDING SITE is HOST TARGET binding site found in the 3' untranslated region of mRNA encoded by LOC169026, corresponding to a HOST TARGET binding site such as BINDING SITE I, BINDING SITE II or BINDING SITE III. Table 2 illustrates the complementarity of the nucleotide sequences of LOC169026 BINDING SITE, designated SEQ ID:40259, to the nucleotide sequence of VGAM587 RNA, herein designated VGAM RNA, also designated SEQ ID:3298.

Another function of VGAM587 is therefore inhibition of LOC169026 (Accession XM_095471). Accordingly, utilities of VGAM587 include diagnosis, prevention and treatment of diseases and clinical conditions associated with LOC169026. FIG. 1 further provides a conceptual description of a novel bioinformatically detected viral gene of the present invention, referred to here as Viral Genomic Address Messenger 588 (VGAM588) viral gene, which modulates expression of respective host target genes thereof, the function and utility of which host target genes is known in the art.

VGAM588 is a novel bioinformatically detected regulatory, non protein coding, viral micro RNA (miRNA) gene. The method by which VGAM588 was detected is described hereinabove with reference to FIGS. 1-8.

VGAM588 gene, herein designated VGAM GENE, is a viral gene contained in the genome of Gallid Herpesvirus 2. VGAM588 host target gene, herein designated VGAM HOST TARGET GENE, is a human gene contained in the human genome.

VGAM588 gene encodes a VGAM588 precursor RNA, herein designated VGAM PRECURSOR RNA. Similar to other miRNA genes, and unlike most ordinary genes, VGAM588 precursor RNA does not encode a protein. A nucleotide sequence identical or highly similar to the nucleotide sequence of VGAM588 precursor RNA is designated SEQ ID:574, and is provided hereinbelow with reference to the sequence listing part. Nucleotide sequence SEQ ID:574 is located at position 41654 relative to the genome of Gallid Herpesvirus 2.

VGAM588 precursor RNA folds onto itself, forming VGAM588 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM588 folded precursor RNA into VGAM588 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM588 RNA is designated SEQ ID:3299, and is provided hereinbelow with reference to the sequence listing part.

VGAM588 host target gene, herein designated VGAM HOST TARGET GENE, encodes a corresponding messenger RNA, VGAM588 host target RNA, herein designated VGAM HOST TARGET RNA. VGAM588 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM588 RNA, herein designated VGAM RNA, binds complementarily to one or more host target binding sites located in untranslated regions of VGAM588 host target RNA, herein designated VGAM HOST TARGET RNA. This complementary binding is due to the fact that the nucleotide sequence of VGAM588 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM588 RNA, herein designated VGAM RNA, may have a different number of host target binding sites in untranslated regions of a VGAM588 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM588 RNA, herein designated VGAM RNA, to host target binding sites on VGAM588 host target RNA, herein designated VGAM HOST TARGET RNA, such as BINDING SITE I, BINDING SITE II and BINDING SITE III, inhibits translation of VGAM588 host target RNA into VGAM588 host target protein, herein designated VGAM HOST TARGET PROTEIN. VGAM host target protein is therefore outlined by a broken line.

It is appreciated that VGAM588 host target gene, herein designated VGAM HOST TARGET GENE, in fact represents a plurality of VGAM588 host target genes. The mRNA of each one of this plurality of VGAM588 host target genes comprises one or more host target binding sites, each having a nucleotide sequence which is at least partly complementary to VGAM588 RNA, herein designated VGAM RNA, and which when bound by VGAM588 RNA causes inhibition of translation of respective one or more VGAM588 host target proteins.

It is further appreciated by one skilled in the art that the mode of translational inhibition illustrated by FIG. 1 with specific reference to translational inhibition exerted by VGAM588 gene, herein designated VGAM GENE, on one or more VGAM588 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM588 is inhibition of expression of host target genes, as part of a novel viral mechanism of attacking a host. Accordingly, utilities of VGAM588 include diagnosis, prevention and treatment of viral infection by Gallid Herpesvirus 2. Specific functions, and accordingly utilities, of VGAM588 correlate with, and may be deduced from, the identity of the host target genes which VGAM588 binds and inhibits, and the function of these host target genes, as elaborated hereinbelow.

Nucleotide sequences of the VGAM588 precursor RNA, herein designated VGAM PRECURSOR RNA, and of the 'diced' VGAM588 RNA, herein designated VGAM RNA, and a schematic representation of the secondary folding of VGAM588 folded precursor RNA, herein designated VGAM FOLDED PRECURSOR RNA, of VGAM588 are further described hereinbelow with reference to Table 1.

Nucleotide sequences of host target binding sites, such as BINDING SITE-I, BINDING SITE-II and BINDING SITE-III of FIG. 1, found on VGAM588 host target RNA, and schematic representation of the complementarity of each of these host target binding sites to VGAM588 RNA, herein designated VGAM RNA, are described hereinbelow with reference to Table 2.

As mentioned hereinabove with reference to FIG. 1, a function of VGAM588 gene, herein designated VGAM is inhibition of expression of VGAM588 target genes. It is appreciated that specific functions, and accordingly utilities, of VGAM588 correlate with, and may be deduced from, the identity of the target genes which VGAM588 binds and inhibits, and the function of these target genes, as elaborated hereinbelow.

Activating Transcription Factor 5 (ATF5, Accession NM_012068) is a VGAM588 host target gene. ATF5 BINDING SITE is HOST TARGET binding site found in the 3' untranslated region of mRNA encoded by ATF5, corresponding to a HOST TARGET binding site such as BINDING SITE I, BINDING SITE II or BINDING SITE III. Table 2 illustrates the complementarity of the nucleotide sequences of ATF5 BINDING SITE, designated SEQ ID:14320, to the nucleotide sequence of VGAM588 RNA, herein designated VGAM RNA, also designated SEQ ID:3299.

A function of VGAM588 is therefore inhibition of Activating Transcription Factor 5 (ATF5, Accession NM_012068), a gene which binds to cAMP-inducible promoters and is involved in gene transcription. Accordingly, utilities of VGAM588 include diagnosis, prevention and treatment of diseases and clinical conditions associated with ATF5. The function of ATF5 has been established by previous studies. Using a yeast 2-hybrid screen with CDC34 (OMIM Ref. No. 116948) as the bait, Pati et al. (1999) obtained a partial cDNA encoding ATF5. The deduced 122-amino acid protein contains a C-terminal bZIP motif with only 3 leucines instead of the conventional 5; the 2 distal leucines are replaced by valines. Functional analysis showed that ATF5 is degraded by ubiquitin proteasome machinery in a CDC34- and RAD6B (UBE2B; 179095)-dependent pathway. Using a yeast 2-hybrid screen with PRL1 (PTP4A1; 601585) as the bait, Peters et al. (2001) identified a cDNA encoding ATF5, which they termed ATF7. EMSA analysis indicated that ATF5 binds to CRE but not C/EBP oligonucleotides. Northern blot analysis revealed ubiquitous expression of ATF5, with highest levels in liver, lung, adipose tissue, heart, and skeletal muscle. Coimmunoprecipitation and GST pull-down analyses confirmed the association of the C-terminal bZIP motif of ATF5 with the PTPase domain and adjacent residues of PRL1 in vitro. SDS-PAGE analysis showed that PRL1 dephosphorylates ATF5.

Full details of the abovementioned studies are described in the following publications, the disclosure of which are hereby incorporated by reference:

Pati, D.; Meistrich, M. L.; Plon, S. E.: Human Cdc34 and Rad6B ubiquitin-conjugating enzymes target repressors of cyclic AMP-induced transcription for proteolysis. Molec. Cell. Biol. 19:5001-5013, 1999; and Peters, C. S.; Liang, X.; Li, S.; Kannan, S.; Peng, Y.; Taub, R.; Diamond, R. H.: ATF-7, a novel bZIP protein, interacts with the PRL-1 protein-tyrosine phosphatase. J. Biol. Chem. 276.

Further studies establishing the function and utilities of ATF5 are found in John Hopkins OMIM database record ID 606398, and in sited publications numbered 451 and 4523-4524 listed in the bibliography section hereinbelow, which are also hereby incorporated by reference. FK506 Binding Protein 9, 63 KDa (FKBP9, Accession XM_168403) is another VGAM588 host target gene. FKBP9 BINDING SITE is HOST TARGET binding site found in the 3' untranslated region of mRNA encoded by FKBP9, corresponding to a HOST TARGET binding site such as BINDING SITE I, BINDING SITE II or BINDING SITE III. Table 2 illustrates the complementarity of the nucleotide sequences of FKBP9 BINDING SITE, designated SEQ ID:45144, to the nucleotide sequence of VGAM588 RNA, herein designated VGAM RNA, also designated SEQ ID:3299.

Another function of VGAM588 is therefore inhibition of FK506 Binding Protein 9, 63 KDa (FKBP9, Accession XM_168403). Accordingly, utilities of VGAM588 include diagnosis, prevention and treatment of diseases and clinical conditions associated with FKBP9. FIG. 1 further provides a conceptual description of a novel bioinformatically detected viral gene of the present invention, referred to here as Viral Genomic Address Messenger 589 (VGAM589) viral gene, which modulates expression of respective host target genes thereof, the function and utility of which host target genes is known in the art.

VGAM589 is a novel bioinformatically detected regulatory, non protein coding, viral micro RNA (miRNA) gene. The method by which VGAM589 was detected is described hereinabove with reference to FIGS. 1-8.

VGAM589 gene, herein designated VGAM GENE, is a viral gene contained in the genome of Gallid Herpesvirus 2. VGAM589 host target gene, herein designated VGAM HOST TARGET GENE, is a human gene contained in the human genome.

VGAM589 gene encodes a VGAM589 precursor RNA, herein designated VGAM PRECURSOR RNA. Similar to other miRNA genes, and unlike most ordinary genes, VGAM589 precursor RNA does not encode a protein. A nucleotide sequence identical or highly similar to the nucleotide sequence of VGAM589 precursor RNA is designated SEQ ID:575, and is provided hereinbelow with reference to the sequence listing part. Nucleotide sequence SEQ ID:575 is located at position 37271 relative to the genome of Gallid Herpesvirus 2.

VGAM589 precursor RNA folds onto itself, forming VGAM589 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM589 folded precursor RNA into VGAM589 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM589 RNA is designated SEQ ID:3300, and is provided hereinbelow with reference to the sequence listing part.

VGAM589 host target gene, herein designated VGAM HOST TARGET GENE, encodes a corresponding messenger RNA, VGAM589 host target RNA, herein designated VGAM HOST TARGET RNA. VGAM589 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM589 RNA, herein designated VGAM RNA, binds complementarily to one or more host target binding sites located in untranslated regions of VGAM589 host target RNA, herein designated VGAM HOST TARGET RNA. This complementary binding is due to the fact that the nucleotide sequence of VGAM589 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM589 RNA, herein designated VGAM RNA, may have a different number of host target binding sites in untranslated regions of a VGAM589 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM589 RNA, herein designated VGAM RNA, to host target binding sites on VGAM589 host target RNA, herein designated VGAM HOST TARGET RNA, such as BINDING SITE I, BINDING SITE II and BINDING SITE III, inhibits translation of VGAM589 host target RNA into VGAM589 host target protein, herein designated VGAM HOST TARGET PROTEIN. VGAM host target protein is therefore outlined by a broken line.

It is appreciated that VGAM589 host target gene, herein designated VGAM HOST TARGET GENE, in fact represents a plurality of VGAM589 host target genes. The mRNA of each one of this plurality of VGAM589 host target genes comprises one or more host target binding sites, each having a nucleotide sequence which is at least partly complementary to VGAM589 RNA, herein designated VGAM RNA, and which when bound by VGAM589 RNA causes inhibition of translation of respective one or more VGAM589 host target proteins.

It is further appreciated by one skilled in the art that the mode of translational inhibition illustrated by FIG. 1 with specific reference to translational inhibition exerted by VGAM589 gene, herein designated VGAM GENE, on one or more VGAM589 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM589 is inhibition of expression of host target genes, as part of a novel viral mechanism of attacking a host. Accordingly, utilities of VGAM589 include diagnosis, prevention and treatment of viral infection by Gallid Herpesvirus 2. Specific functions, and accordingly utilities, of VGAM589 correlate with, and may be deduced from, the identity of the host target genes which VGAM589 binds and inhibits, and the function of these host target genes, as elaborated hereinbelow.

Nucleotide sequences of the VGAM589 precursor RNA, herein designated VGAM PRECURSOR RNA, and of the 'diced' VGAM589 RNA, herein designated VGAM RNA, and a schematic representation of the secondary folding of VGAM589 folded precursor RNA, herein designated VGAM FOLDED PRECURSOR RNA, of VGAM589 are further described hereinbelow with reference to Table 1.

Nucleotide sequences of host target binding sites, such as BINDING SITE-I, BINDING SITE-II and BINDING SITE-III of FIG. 1, found on VGAM589 host target RNA, and schematic representation of the complementarity of each of these host target binding sites to VGAM589 RNA, herein designated VGAM RNA, are described hereinbelow with reference to Table 2.

As mentioned hereinabove with reference to FIG. 1, a function of VGAM589 gene, herein designated VGAM is inhibition of expression of VGAM589 target genes. It is appreciated that specific functions, and accordingly utilities, of VGAM589 correlate with, and may be deduced from, the identity of the target genes which VGAM589 binds and inhibits, and the function of these target genes, as elaborated hereinbelow.

B-cell CLL/lymphoma 7A (BCL7A, Accession NM_020993) is a VGAM589 host target gene. BCL7A BINDING SITE is HOST TARGET binding site found in the 3' untranslated region of mRNA encoded by BCL7A, corresponding to a HOST TARGET binding site such as BINDING SITE I, BINDING SITE II or BINDING SITE III. Table 2 illustrates the complementarity of the nucleotide sequences of BCL7A BINDING SITE, designated SEQ ID:21994, to the nucleotide sequence of VGAM589 RNA, herein designated VGAM RNA, also designated SEQ ID:3300.

A function of VGAM589 is therefore inhibition of B-cell CLL/lymphoma 7A (BCL7A, Accession NM_020993). Accordingly, utilities of VGAM589 include diagnosis, prevention and treatment of diseases and clinical conditions associated with BCL7A. Deoxyguanosine Kinase (DGUOK, Accession NM_080915) is another VGAM589 host target gene. DGUOK BINDING SITE is HOST TARGET binding site found in the 3' untranslated region of mRNA encoded by DGUOK, corresponding to a HOST TARGET binding site such as BINDING SITE I, BINDING SITE II or BINDING SITE III. Table 2 illustrates the complementarity of the nucleotide sequences of DGUOK BINDING SITE, designated SEQ ID:28135, to the nucleotide sequence of VGAM589 RNA, herein designated VGAM RNA, also designated SEQ ID:3300.

Another function of VGAM589 is therefore inhibition of Deoxyguanosine Kinase (DGUOK, Accession NM_080915), a gene which is deoxyguanosine kinase and mediates phosphorylation of several deoxyribonucleosides. Accordingly, utilities of VGAM589 include diagnosis, prevention and treatment of diseases and clinical conditions associated with DGUOK. The function of DGUOK and its association with various diseases and clinical conditions, has been established by previous studies, as described hereinabove with reference to VGAM121. Down Syndrome Critical Region Gene 1 (DSCR1, Accession NM_004414) is another VGAM589 host target gene. DSCR1 BINDING SITE is HOST TARGET binding site found in the 3' untranslated region of mRNA encoded by DSCR1, corresponding to a HOST TARGET binding site such as BINDING SITE I, BINDING SITE II or BINDING SITE III. Table 2 illustrates the complementarity of the nucleotide sequences of DSCR1 BINDING SITE, designated SEQ ID:10675, to the nucleotide sequence of VGAM589 RNA, herein designated VGAM RNA, also designated SEQ ID:3300.

Another function of VGAM589 is therefore inhibition of Down Syndrome Critical Region Gene 1 (DSCR1, Accession NM_004414), a gene which inhibits calcineurin-dependent transcriptional responses. Accordingly, utilities of VGAM589 include diagnosis, prevention and treatment of diseases and clinical conditions associated with DSCR1. The function of DSCR1 has been established by previous studies. The study of patients with partial trisomy 21 has defined an area of approximately 3 Mb at chromosomal region 21q22 as the minimal candidate region for the Down syndrome phenotype (OMIM Ref. No. 190685). Using a novel exon cloning strategy, Fuentes et al. (1995) identified several putative exons from region 21q22.1-q22.2. One exon was used to isolate fetal brain cDNAs corresponding to a gene that the authors designated DSCR1. The predicted 171-amino acid protein contains 2 proline-rich regions, a putative DNA-binding domain, and an acidic region. Northern blot analysis revealed that the 2.2-kb DSCR1 transcript is expressed at the highest levels in fetal brain and adult heart and at lower levels in various other tissues. An additional 2-kb mRNA was detected in fetal and adult liver. Increased expression in the brains of young rats compared with adults suggested to Fuentes et al. (1995) that DSCR1 plays a role during central nervous system development. Fuentes et al. (1997) determined that DSCR1 spans nearly 45 kb and contains 7 exons, 4 of which are alternative first exons. They found tissue-specific expression patterns for the alternative transcripts. Kingsbury and Cunningham (2000) referred to the proteins encoded by the MCIP genes as calcipressins. Functional analysis showed that when expressed in yeast, DSCR1 and ZAKI4 inhibited calcineurin function. The authors proposed that increased expression of DSCR1 in trisomy-21 individuals may contribute to the neurologic, cardiac, or immunologic defects of Down syndrome.

Full details of the abovementioned studies are described in the following publications, the disclosure of which are hereby incorporated by reference:

Fuentes, J. J.; Pritchard, M. A.; Estivill, X.: Genomic organization, alternative splicing, and expression patterns of the DSCR1 (Down syndrome candidate region 1) gene. Genomics 44:358-361, 1997; and Kingsbury, T. J.; Cunningham, K. W.: A conserved family of calcineurin regulators. Genes Dev. 14:1595-1604, 2000.

Further studies establishing the function and utilities of DSCR1 are found in John Hopkins OMIM database record ID 602917, and in sited publications numbered 6049, 6192-619 and 5335-5336 listed in the bibliography section hereinbelow, which are also hereby incorporated by reference. Interleukin 2 Receptor, Beta (IL2RB, Accession NM_000878) is another VGAM589 host target gene. IL2RB BINDING SITE is HOST TARGET binding site found in the 3' untranslated region of mRNA encoded by IL2RB, corresponding to a HOST TARGET binding site such as BINDING SITE I, BINDING SITE II or BINDING SITE III. Table 2 illustrates the complementarity of the nucleotide sequences of IL2RB BINDING SITE, designated SEQ ID:6575, to the nucleotide sequence of VGAM589 RNA, herein designated VGAM RNA, also designated SEQ ID:3300.

Another function of VGAM589 is therefore inhibition of Interleukin 2 Receptor, Beta (IL2RB, Accession NM_000878), a gene which is involved in receptor mediated endocytosis and transduces the mitogenic signals of il-2. Accordingly, utilities of VGAM589 include diagnosis, prevention and treatment of diseases and clinical conditions associated with IL2RB. The function of IL2RB and its association with various diseases and clinical conditions, has been established by previous studies, as described hereinabove with reference to VGAM450. Procollagen-proline, 2-oxoglutarate 4-dioxygenase (proline 4-hydroxylase), Beta Polypeptide (protein disulfide isomerase; thyroid hormone binding protein p55) (P4HB, Accession NM_000918) is another VGAM589 host target gene. P4HB BINDING SITE is HOST TARGET binding site found in the 3' untranslated region of mRNA encoded by P4HB, corresponding to a HOST TARGET binding site such as BINDING SITE I, BINDING SITE II or BINDING SITE III. Table 2 illustrates the complementarity of the nucleotide sequences of P4HB BINDING SITE, designated SEQ ID:6628, to the nucleotide sequence of VGAM589 RNA, herein designated VGAM RNA, also designated SEQ ID:3300.

Another function of VGAM589 is therefore inhibition of Procollagen-proline, 2-oxoglutarate 4-dioxygenase (proline 4-hydroxylase), Beta Polypeptide (protein disulfide isomerase; thyroid hormone binding protein p55) (P4HB, Accession NM_000918), a gene which catalyzes formation of 4-hydroxyproline in collagens. Accordingly, utilities of VGAM589 include diagnosis, prevention and treatment of diseases and clinical conditions associated with P4HB. The function of P4HB has been established by previous studies. Prolyl 4-hydroxylase (EC 1.14.11.2) is involved in hydroxylation of prolyl residues in preprocollagen. Pihlajaniemi et al. (1987) cloned the PROHB gene. Prolyl 4-hydroxylase is a tetramer consisting of 2 alpha (176710, 600608) and 2 beta subunits of molecular weights about 64,000 and 60,000, respectively, for the monomers. Characterization of cDNA clones for the human beta subunit indicated that the polypeptide is 508 amino acids long, including a signal peptide of 17 amino acids. Pihlajaniemi et al. (1987) also found that disulfide isomerase (EC 5.3.4.1) is a product of the same gene. When present in cells in monomeric form, the protein serves the function of DSI (Koivu et al., 1987); when present in the prolyl 4-hydroxylase tetramer, it catalyzes the formation of 4-hydroxyproline in collagen. Cheng et al. (1987) demonstrated by molecular cloning and nucleotide sequencing that cellular thyroid hormone-binding protein is also identical to the beta subunit of prolyl 4-hydroxylase and protein disulfide isomerase. Tasanen et al. (1988) isolated genomic clones for the human gene coding for this multifunctional protein. They found that the gene is about 18 kb long and consists of 11 exons. The codons for the 2 presumed active sites of protein disulfide isomerase, each a cys-gly-his-cys sequence, were found to be located 12 bp from the beginning of exons 2 and 9. Another of the many functions of protein disulfide isomerase is its role as the smaller element of the heterodimeric microsomal triglyceride transfer protein (MTP; 157147). The unique larger subunit of this heterodimer is mutant in patients with abetalipoproteinemia (OMIM Ref. No. 200100). Since chylomicrons, very low density lipoproteins, and low density lipoproteins are absent from the plasma in abetalipoproteinemic subjects, and since the clinical pathology of abetalipoproteinemia results from deficiency of fat-soluble vitamins that are transported on apoB-containing lipoproteins, Sharp et al. (1993) proposed that inhibition of MTP may provide a specific mechanism for lowering plasma cholesterol and triglyceride levels.

Full details of the abovementioned studies are described in the following publications, the disclosure of which are hereby incorporated by reference:

Pihlajaniemi, T.; Helaakoski, T.; Tasanen, K.; Myllyla, R.; Huhtala, M.-L.; Koivu, J.; Kivirikko, K. I.: Molecular cloning of the beta-subunit of human prolyl 4-hydroxylase: this subunit and protein disulphide isomerase are products of the same gene. EMBO J. 6:643-649, 1987; and Sharp, D.; Blinderman, L.; Combs, K. A.; Kienzle, B.; Ricci, B.; Wager-Smith, K.; Gil, C. M.; Turck, C. W.; Bouma, M.-E.; Rader, D. J.; Aggerbeck, L. P.; Gregg, R. E.; Gordon, D. A.; We.

Further studies establishing the function and utilities of P4HB are found in John Hopkins OMIM database record ID 176790, and in sited publications numbered 9725-9734, 329 and 9735 listed in the bibliography section hereinbelow, which are also hereby incorporated by reference.poly (A)-specific Ribonuclease (deadenylation nuclease) (PARN, Accession NM_002582) is another VGAM589 host target gene. PARN BINDING SITE is HOST TARGET binding site found in the 3' untranslated region of mRNA encoded by PARN, corresponding to a HOST TARGET binding site such as BINDING SITE I, BINDING SITE II or BINDING SITE III. Table 2 illustrates the complementarity of the nucleotide sequences of PARN BINDING SITE, designated SEQ ID:8444, to the nucleotide sequence of VGAM589 RNA, herein designated VGAM RNA, also designated SEQ ID:3300.

Another function of VGAM589 is therefore inhibition of poly (A)-specific Ribonuclease (deadenylation nuclease) (PARN, Accession NM_002582), a gene which degrades mRNA poly (A) tails during oocyte maturation. Accordingly, utilities of VGAM589 include diagnosis, prevention and treatment of diseases and clinical conditions associated with PARN. The function of PARN has been established by previous studies. Exonucleolytic degradation of the poly (A) tail is often the first step in the decay of eukaryotic mRNAs. Korner and Wahle (1997) purified the enzyme for deadenylation, PARN, which they named DAN, from calf thymus. Korner et al. (1998) partially sequenced the bovine PARN protein. By searching an EST database with the bovine PARN peptide sequences, they identified a human PARN EST encoding a deduced 639-amino acid protein. The calculated molecular mass of human PARN is 73.5 kD, which was the mass of recombinant PARN expressed in E. coli. The human PARN protein shows sequence similarity to the RNase D family of 3-prime exonucleases, which includes E. coli polymerase I. PARN is a 3-prime exonuclease that prefers poly (A) as the substrate. In an in vitro assay, PARN activity was partially inhibited by PAB1 (OMIM Ref. No. 604679), resulting in phased shortening of the poly (A) tail of the polyadenylated RNA substrate. The PARN protein is located in both the nucleus and the cytoplasm. It is not stably associated with polysomes or ribosomal subunits. Northern blot analysis detected a 3.1-kb PARN transcript in HeLa cell extracts. The authors noted that the PARN gene is widely expressed. Korner et al. (1998) noted that the PARN gene maps to chromosome 16.

Full details of the abovementioned studies are described in the following publications, the disclosure of which are hereby incorporated by reference:

Korner, C. G.; Wahle, E.: Poly (A) tail shortening by a mammalian poly (A)-specific 3-prime-exoribonuclease. J. Biol. Chem. 272:10448-10456, 1997; and Korner, C. G.; Wormington, M.; Muckenthaler, M.; Schneider, S.; Dehlin, E.; Wahle, E.: The deadenylating nuclease (DAN) is involved in poly (A) tail removal during the meiotic maturation.

Further studies establishing the function and utilities of PARN are found in John Hopkins OMIM database record ID 604212, and in sited publications numbered 4921-4922 listed in the bibliography section hereinbelow, which are also hereby incorporated by reference. Phosphoribosyl Pyrophosphate Amidotransferase (PPAT, Accession NM_002703) is another VGAM589 host target gene. PPAT BINDING SITE is HOST TARGET binding site found in the 3' untranslated region of mRNA encoded by PPAT, corresponding to a HOST TARGET binding site such as BINDING SITE I, BINDING SITE II or BINDING SITE III. Table 2 illustrates the complementarity of the nucleotide sequences of PPAT BINDING SITE, designated SEQ ID:8551, to the nucleotide sequence of VGAM589 RNA, herein designated VGAM RNA, also designated SEQ ID:3300.

Another function of VGAM589 is therefore inhibition of Phosphoribosyl Pyrophosphate Amidotransferase (PPAT, Accession NM_002703). Accordingly, utilities of VGAM589 include diagnosis, prevention and treatment of diseases and clinical conditions associated with PPAT. Alpha 1,4-galactosyltransferase (A4GALT, Accession NM_017436) is another VGAM589 host target gene. A4GALT BINDING SITE is HOST TARGET binding site found in the 5' untranslated region of mRNA encoded by A4GALT, corresponding to a HOST TARGET binding site such as BINDING SITE I, BINDING SITE II or BINDING SITE III. Table 2 illustrates the complementarity of the nucleotide sequences of A4GALT BINDING SITE, designated SEQ ID:18896, to the nucleotide sequence of VGAM589 RNA, herein designated VGAM RNA, also designated SEQ ID:3300.

Another function of VGAM589 is therefore inhibition of Alpha 1,4-galactosyltransferase (A4GALT, Accession NM_017436). Accordingly, utilities of VGAM589 include diagnosis, prevention and treatment of diseases and clinical conditions associated with A4GALT. FLJ20309 (Accession NM_017759) is another VGAM589 host target gene. FLJ20309 BINDING SITE is HOST TARGET binding site found in the 3' untranslated region of mRNA encoded by FLJ20309, corresponding to a HOST TARGET binding site such as BINDING SITE I, BINDING SITE II or BINDING SITE III. Table 2 illustrates the complementarity of the nucleotide sequences of FLJ20309 BINDING SITE, designated SEQ ID:19371, to the nucleotide sequence of VGAM589 RNA, herein designated VGAM RNA, also designated SEQ ID:3300.

Another function of VGAM589 is therefore inhibition of FLJ20309 (Accession NM_017759). Accordingly, utilities of VGAM589 include diagnosis, prevention and treatment of diseases and clinical conditions associated with FLJ20309. FLJ21916 (Accession NM_023112) is another VGAM589 host target gene. FLJ21916 BINDING SITE is HOST TARGET binding site found in the 3' untranslated region of mRNA encoded by FLJ21916, corresponding to a HOST TARGET binding site such as BINDING SITE I, BINDING SITE II or BINDING SITE III. Table 2 illustrates the complementarity of the nucleotide sequences of FLJ21916 BINDING SITE, designated SEQ ID:23384, to the nucleotide sequence of VGAM589 RNA, herein designated VGAM RNA, also designated SEQ ID:3300.

Another function of VGAM589 is therefore inhibition of FLJ21916 (Accession NM_023112). Accordingly, utilities of VGAM589 include diagnosis, prevention and treatment of diseases and clinical conditions associated with FLJ21916. KIAA1089 (Accession XM_044148) is another VGAM589 host target gene. KIAA1089 BINDING SITE is HOST TARGET binding site found in the 3' untranslated region of mRNA encoded by KIAA1089, corresponding to a HOST TARGET binding site such as BINDING SITE I, BINDING SITE II or BINDING SITE III. Table 2 illustrates the complementarity of the nucleotide sequences of KIAA1089 BINDING SITE, designated SEQ ID:34142, to the nucleotide sequence of VGAM589 RNA, herein designated VGAM RNA, also designated SEQ ID:3300.

Another function of VGAM589 is therefore inhibition of KIAA1089 (Accession XM_044148). Accordingly, utilities of VGAM589 include diagnosis, prevention and treatment of diseases and clinical conditions associated with KIAA1089. KIAA1538 (Accession XM_049474) is another VGAM589 host target gene. KIAA1538 BINDING SITE is HOST TARGET binding site found in the 3' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35433, to the nucleotide sequence of VGAM589 RNA, herein designated VGAM RNA, also designated SEQ ID:3300.

Another function of VGAM589 is therefore inhibition of KIAA1538 (Accession XM_049474). Accordingly, utilities of VGAM589 include diagnosis, prevention and treatment of diseases and clinical conditions associated with KIAA1538. Sideroflexin 5 (SFXN5, Accession NM_144579) is another VGAM589 host target gene. SFXN5 BINDING SITE is HOST TARGET binding site found in the 3' untranslated region of mRNA encoded by SFXN5, corresponding to a HOST TARGET binding site such as BINDING SITE I, BINDING SITE II or BINDING SITE III. Table 2 illustrates the complementarity of the nucleotide sequences of SFXN5 BINDING SITE, designated SEQ ID:29389, to the nucleotide sequence of VGAM589 RNA, herein designated VGAM RNA, also designated SEQ ID:3300.

Another function of VGAM589 is therefore inhibition of Sideroflexin 5 (SFXN5, Accession NM_144579). Accordingly, utilities of VGAM589 include diagnosis, prevention and treatment of diseases and clinical conditions associated with SFXN5. WD Repeat Domain 13 (WDR13, Accession NM_017883) is another VGAM589 host target gene. WDR13 BINDING SITE is HOST TARGET binding site found in the 5' untranslated region of mRNA encoded by WDR13, corresponding to a HOST TARGET binding site such as BINDING SITE I, BINDING SITE II or BINDING SITE III. Table 2 illustrates the complementarity of the nucleotide sequences of WDR13 BINDING SITE, designated SEQ ID:19552, to the nucleotide sequence of VGAM589 RNA, herein designated VGAM RNA, also designated SEQ ID:3300.

Another function of VGAM589 is therefore inhibition of WD Repeat Domain 13 (WDR13, Accession NM_017883). Accordingly, utilities of VGAM589 include diagnosis, prevention and treatment of diseases and clinical conditions associated with WDR13. LOC124997 (Accession XM_058886) is another VGAM589 host target gene. LOC124997 BINDING SITE is HOST TARGET binding site found in the 3' untranslated region of mRNA encoded by LOC124997, corresponding to a HOST TARGET binding site such as BINDING SITE I, BINDING SITE II or BINDING SITE III. Table 2 illustrates the complementarity of the nucleotide sequences of LOC124997 BINDING SITE, designated SEQ ID:36787, to the nucleotide sequence of VGAM589 RNA, herein designated VGAM RNA, also designated SEQ ID:3300.

Another function of VGAM589 is therefore inhibition of LOC124997 (Accession XM_058886). Accordingly, utilities of VGAM589 include diagnosis, prevention and treatment of diseases and clinical conditions associated with LOC124997. LOC150174 (Accession XM_086802) is another VGAM589 host target gene. LOC150174 BINDING SITE is HOST TARGET binding site found in the 3' untranslated region of mRNA encoded by LOC150174, corresponding to a HOST TARGET binding site such as BINDING SITE I, BINDING SITE II or BINDING SITE III. Table 2 illustrates the complementarity of the nucleotide sequences of LOC150174 BINDING SITE, designated SEQ ID:38875, to the nucleotide sequence of VGAM589 RNA, herein designated VGAM RNA, also designated SEQ ID:3300.

Another function of VGAM589 is therefore inhibition of LOC150174 (Accession XM_086802). Accordingly, utilities of VGAM589 include diagnosis, prevention and treatment of diseases and clinical conditions associated with LOC150174. LOC150213 (Accession XM_059324) is another VGAM589 host target gene. LOC150213 BINDING SITE is HOST TARGET binding site found in the 3' untranslated region of mRNA encoded by LOC150213, corresponding to a HOST TARGET binding site such as BINDING SITE I, BINDING SITE II or BINDING SITE III. Table 2 illustrates the complementarity of the nucleotide sequences of LOC150213 BINDING SITE, designated SEQ ID:36962, to the nucleotide sequence of VGAM589 RNA, herein designated VGAM RNA, also designated SEQ ID:3300.

Another function of VGAM589 is therefore inhibition of LOC150213 (Accession XM_059324). Accordingly, utilities of VGAM589 include diagnosis, prevention and treatment of diseases and clinical conditions associated with LOC150213. LOC150236 (Accession XM_086824) is another VGAM589 host target gene. LOC150236 BINDING SITE is HOST TARGET binding site found in the 5' untranslated region of mRNA encoded by LOC150236, corresponding to a HOST TARGET binding site such as BINDING SITE I, BINDING SITE II or BINDING SITE III. Table 2 illustrates the complementarity of the nucleotide sequences of LOC150236 BINDING SITE, designated SEQ ID:38907, to the nucleotide sequence of VGAM589 RNA, herein designated VGAM RNA, also designated SEQ ID:3300.

Another function of VGAM589 is therefore inhibition of LOC150236 (Accession XM_086824). Accordingly, utilities of VGAM589 include diagnosis, prevention and treatment of diseases and clinical conditions associated with LOC150236. LOC153218 (Accession XM_087628) is another VGAM589 host target gene. LOC153218 BINDING SITE is HOST TARGET binding site found in the 5' untranslated region of mRNA encoded by LOC153218, corresponding to a HOST TARGET binding site such as BINDING SITE I, BINDING SITE II or BINDING SITE III. Table 2 illustrates the complementarity of the nucleotide sequences of LOC153218 BINDING SITE, designated SEQ ID:39365, to the nucleotide sequence of VGAM589 RNA, herein designated VGAM RNA, also designated SEQ ID:3300.

Another function of VGAM589 is therefore inhibition of LOC153218 (Accession XM_087628). Accordingly, utilities of VGAM589 include diagnosis, prevention and treatment of diseases and clinical conditions associated with LOC153218. LOC154525 (Accession XM_098554) is another VGAM589 host target gene. LOC154525 BINDING SITE is HOST TARGET binding site found in the 5' untranslated region of mRNA encoded by LOC154525, corresponding to a HOST TARGET binding site such as BINDING SITE I, BINDING SITE II or BINDING SITE III. Table 2 illustrates the complementarity of the nucleotide sequences of LOC154525 BINDING SITE, designated SEQ ID:41708, to the nucleotide sequence of VGAM589 RNA, herein designated VGAM RNA, also designated SEQ ID:3300.

Another function of VGAM589 is therefore inhibition of LOC154525 (Accession XM_098554). Accordingly, utilities of VGAM589 include diagnosis, prevention and treatment of diseases and clinical conditions associated with LOC154525. LOC200261 (Accession XM_114172) is another VGAM589 host target gene. LOC200261 BINDING SITE is HOST TARGET binding site found in the 5' untranslated region of mRNA encoded by LOC200261, corresponding to a HOST TARGET binding site such as BINDING SITE I, BINDING SITE II or BINDING SITE III. Table 2 illustrates the complementarity of the nucleotide sequences of LOC200261 BINDING SITE, designated SEQ ID:42751, to the nucleotide sequence of VGAM589 RNA, herein designated VGAM RNA, also designated SEQ ID:3300.

Another function of VGAM589 is therefore inhibition of LOC200261 (Accession XM_114172). Accordingly, utilities of VGAM589 include diagnosis, prevention and treatment of diseases and clinical conditions associated with LOC200261.

FIG. 1 further provides a conceptual description of a novel bioinformatically detected viral gene of the present invention, referred to here as Viral Genomic Address Messenger 590 (VGAM590) viral gene, which modulates expression of respective host target genes thereof, the function and utility of which host target genes is known in the art.

VGAM590 is a novel bioinformatically detected regulatory, non protein coding, viral micro RNA (miRNA) gene. The method by which VGAM590 was detected is described hereinabove with reference to FIGS. 1-8.

VGAM590 gene, herein designated VGAM GENE, is a viral gene contained in the genome of Gallid Herpesvirus 2. VGAM590 host target gene, herein designated VGAM HOST TARGET GENE, is a human gene contained in the human genome.

VGAM590 gene encodes a VGAM590 precursor RNA, herein designated VGAM PRECURSOR RNA. Similar to other miRNA genes, and unlike most ordinary genes, VGAM590 precursor RNA does not encode a protein. A nucleotide sequence identical or highly similar to the nucleotide sequence of VGAM590 precursor RNA is designated SEQ ID:576, and is provided hereinbelow with reference to the sequence listing part. Nucleotide sequence SEQ ID:576 is located at position 37055 relative to the genome of Gallid Herpesvirus 2.

VGAM590 precursor RNA folds onto itself, forming VGAM590 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM590 folded precursor RNA into VGAM590 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM590 RNA is designated SEQ ID:3301, and is provided hereinbelow with reference to the sequence listing part.

VGAM590 host target gene, herein designated VGAM HOST TARGET GENE, encodes a corresponding messenger RNA, VGAM590 host target RNA, herein designated VGAM HOST TARGET RNA. VGAM590 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM590 RNA, herein designated VGAM RNA, binds complementarily to one or more host target binding sites located in untranslated regions of VGAM590 host target RNA, herein designated VGAM HOST TARGET RNA. This complementary binding is due to the fact that the nucleotide sequence of VGAM590 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM590 RNA, herein designated VGAM RNA, may have a different number of host target binding sites in untranslated regions of a VGAM590 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM590 RNA, herein designated VGAM RNA, to host target binding sites on VGAM590 host target RNA, herein designated VGAM HOST TARGET RNA, such as BINDING SITE I, BINDING SITE II and BINDING SITE III, inhibits translation of VGAM590 host target RNA into VGAM590 host target protein, herein designated VGAM HOST TARGET PROTEIN. VGAM host target protein is therefore outlined by a broken line.

It is appreciated that VGAM590 host target gene, herein designated VGAM HOST TARGET GENE, in fact represents a plurality of VGAM590 host target genes. The mRNA of each one of this plurality of VGAM590 host target genes comprises one or more host target binding sites, each having a nucleotide sequence which is at least partly complementary to VGAM590 RNA, herein designated VGAM RNA, and which when bound by VGAM590 RNA causes inhibition of translation of respective one or more VGAM590 host target proteins.

It is further appreciated by one skilled in the art that the mode of translational inhibition illustrated by FIG. 1 with specific reference to translational inhibition exerted by VGAM590 gene, herein designated VGAM GENE, on one or more VGAM590 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM590 is inhibition of expression of host target genes, as part of a novel viral mechanism of attacking a host. Accordingly, utilities of VGAM590 include diagnosis, prevention and treatment of viral infection by Gallid Herpesvirus 2. Specific functions, and accordingly utilities, of VGAM590 correlate with, and may be deduced from, the identity of the host target genes which VGAM590 binds and inhibits, and the function of these host target genes, as elaborated hereinbelow.

Nucleotide sequences of the VGAM590 precursor RNA, herein designated VGAM PRECURSOR RNA, and of the 'diced' VGAM590 RNA, herein designated VGAM RNA, and a schematic representation of the secondary folding of VGAM590 folded precursor RNA, herein designated VGAM FOLDED PRECURSOR RNA, of VGAM590 are further described hereinbelow with reference to Table 1.

Nucleotide sequences of host target binding sites, such as BINDING SITE-I, BINDING SITE-II and BINDING SITE-III of FIG. 1, found on VGAM590 host target RNA, and schematic representation of the complementarity of each of these host target binding sites to VGAM590 RNA, herein designated VGAM RNA, are described hereinbelow with reference to Table 2.

As mentioned hereinabove with reference to FIG. 1, a function of VGAM590 gene, herein designated VGAM is inhibition of expression of VGAM590 target genes. It is appreciated that specific functions, and accordingly utilities, of VGAM590 correlate with, and may be deduced from, the identity of the target genes which VGAM590 binds and inhibits, and the function of these target genes, as elaborated hereinbelow.

Translin (TSN, Accession NM_004622) is a VGAM590 host target gene. TSN BINDING SITE is HOST TARGET binding site found in the 3' untranslated region of mRNA encoded by TSN, corresponding to a HOST TARGET binding site such as BINDING SITE I, BINDING SITE II or BINDING SITE III. Table 2 illustrates the complementarity of the nucleotide sequences of TSN BINDING SITE, designated SEQ ID:10982, to the nucleotide sequence of VGAM590 RNA, herein designated VGAM RNA, also designated SEQ ID:3301.

A function of VGAM590 is therefore inhibition of Translin (TSN, Accession NM_004622), a gene which is a DNA binding protein and involved in DNA repair, replication, or recombination. Accordingly, utilities of VGAM590 include diagnosis, prevention and treatment of diseases and clinical conditions associated with TSN. The function of TSN and its association with various diseases and clinical conditions, has been established by previous studies, as described hereinabove with reference to VGAM98. KIAA0318 (Accession XM_044334) is another VGAM590 host target gene. KIAA0318 BINDING SITE is HOST TARGET binding site found in the 3' untranslated region of mRNA encoded by KIAA0318, corresponding to a HOST TARGET binding site such as BINDING SITE I, BINDING SITE II or BINDING SITE III. Table 2 illustrates the complementarity of the nucleotide sequences of KIAA0318 BINDING SITE, designated SEQ ID:34184, to the nucleotide sequence of VGAM590

RNA, herein designated VGAM RNA, also designated SEQ ID:3301.

Another function of VGAM590 is therefore inhibition of KIAA0318 (Accession XM_044334). Accordingly, utilities of VGAM590 include diagnosis, prevention and treatment of diseases and clinical conditions associated with KIAA0318. LOC142779 (Accession XM_084337) is another VGAM590 host target gene. LOC142779 BINDING SITE is HOST TARGET binding site found in the 3' untranslated region of mRNA encoded by LOC142779, corresponding to a HOST TARGET binding site such as BINDING SITE I, BINDING SITE II or BINDING SITE III. Table 2 illustrates the complementarity of the nucleotide sequences of LOC142779 BINDING SITE, designated SEQ ID:37558, to the nucleotide sequence of VGAM590 RNA, herein designated VGAM RNA, also designated SEQ ID:3301.

Another function of VGAM590 is therefore inhibition of LOC142779 (Accession XM_084337). Accordingly, utilities of VGAM590 include diagnosis, prevention and treatment of diseases and clinical conditions associated with LOC142779. LOC200609 (Accession XM_117256) is another VGAM590 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43323, to the nucleotide sequence of VGAM590 RNA, herein designated VGAM RNA, also designated SEQ ID:3301.

Another function of VGAM590 is therefore inhibition of LOC200609 (Accession XM_117256). Accordingly, utilities of VGAM590 include diagnosis, prevention and treatment of diseases and clinical conditions associated with LOC200609. FIG. 1 further provides a conceptual description of a novel bioinformatically detected viral gene of the present invention, referred to here as Viral Genomic Address Messenger 591 (VGAM591) viral gene, which modulates expression of respective host target genes thereof, the function and utility of which host target genes is known in the art.

VGAM591 is a novel bioinformatically detected regulatory, non protein coding, viral micro RNA (miRNA) gene. The method by which VGAM591 was detected is described hereinabove with reference to FIGS. 1-8.

VGAM591 gene, herein designated VGAM GENE, is a viral gene contained in the genome of Gallid Herpesvirus 2. VGAM591 host target gene, herein designated VGAM HOST TARGET GENE, is a human gene contained in the human genome.

VGAM591 gene encodes a VGAM591 precursor RNA, herein designated VGAM PRECURSOR RNA. Similar to other miRNA genes, and unlike most ordinary genes, VGAM591 precursor RNA does not encode a protein. A nucleotide sequence identical or highly similar to the nucleotide sequence of VGAM591 precursor RNA is designated SEQ ID:577, and is provided hereinbelow with reference to the sequence listing part. Nucleotide sequence SEQ ID:577 is located at position 47365 relative to the genome of Gallid Herpesvirus 2.

VGAM591 precursor RNA folds onto itself, forming VGAM591 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM591 folded precursor RNA into VGAM591 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM591 RNA is designated SEQ ID:3302, and is provided hereinbelow with reference to the sequence listing part.

VGAM591 host target gene, herein designated VGAM HOST TARGET GENE, encodes a corresponding messenger RNA, VGAM591 host target RNA, herein designated VGAM HOST TARGET RNA. VGAM591 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM591 RNA, herein designated VGAM RNA, binds complementarily to one or more host target binding sites located in untranslated regions of VGAM591 host target RNA, herein designated VGAM HOST TARGET RNA. This complementary binding is due to the fact that the nucleotide sequence of VGAM591 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM591 RNA, herein designated VGAM RNA, may have a different number of host target binding sites in untranslated regions of a VGAM591 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM591 RNA, herein designated VGAM RNA, to host target binding sites on VGAM591 host target RNA, herein designated VGAM HOST TARGET RNA, such as BINDING SITE I, BINDING SITE II and BINDING SITE III, inhibits translation of VGAM591 host target RNA into VGAM591 host target protein, herein designated VGAM HOST TARGET PROTEIN. VGAM host target protein is therefore outlined by a broken line.

It is appreciated that VGAM591 host target gene, herein designated VGAM HOST TARGET GENE, in fact represents a plurality of VGAM591 host target genes. The mRNA of each one of this plurality of VGAM591 host target genes comprises one or more host target binding sites, each having a nucleotide sequence which is at least partly complementary to VGAM591 RNA, herein designated VGAM RNA, and which when bound by VGAM591 RNA causes inhibition of translation of respective one or more VGAM591 host target proteins.

It is further appreciated by one skilled in the art that the mode of translational inhibition illustrated by FIG. 1 with specific reference to translational inhibition exerted by VGAM591 gene, herein designated VGAM GENE, on one or more VGAM591 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM591 is inhibition of expression of host target genes, as part of a novel viral mechanism of attacking a host. Accordingly, utilities of VGAM591 include diagnosis, prevention and treatment of viral infection by Gallid Herpesvirus 2. Specific functions, and accordingly utilities, of VGAM591 correlate with, and may be deduced from, the identity of the host target genes which VGAM591 binds and inhibits, and the function of these host target genes, as elaborated hereinbelow.

Nucleotide sequences of the VGAM591 precursor RNA, herein designated VGAM PRECURSOR RNA, and of the 'diced' VGAM591 RNA, herein designated VGAM RNA, and a schematic representation of the secondary folding of VGAM591 folded precursor RNA, herein designated VGAM FOLDED PRECURSOR RNA, of VGAM591 are further described hereinbelow with reference to Table 1.

Nucleotide sequences of host target binding sites, such as BINDING SITE-I, BINDING SITE-II and BINDING SITE-III of FIG. 1, found on VGAM591 host target RNA, and schematic representation of the complementarity of each of these host target binding sites to VGAM591 RNA, herein designated VGAM RNA, are described hereinbelow with reference to Table 2.

As mentioned hereinabove with reference to FIG. 1, a function of VGAM591 gene, herein designated VGAM is inhibition of expression of VGAM591 target genes. It is appreciated that specific functions, and accordingly utilities, of VGAM591 correlate with, and may be deduced from, the identity of the target genes which VGAM591 binds and inhibits, and the function of these target genes, as elaborated hereinbelow.

LOC153196 (Accession XM_098323) is a VGAM591 host target gene. LOC153196 BINDING SITE is HOST TARGET binding site found in the 5' untranslated region of mRNA encoded by LOC153196, corresponding to a HOST TARGET binding site such as BINDING SITE I, BINDING SITE II or BINDING SITE III. Table 2 illustrates the complementarity of the nucleotide sequences of LOC153196 BINDING SITE, designated SEQ ID:41593, to the nucleotide sequence of VGAM591 RNA, herein designated VGAM RNA, also designated SEQ ID:3302.

A function of VGAM591 is therefore inhibition of LOC153196 (Accession XM_098323). Accordingly, utilities of VGAM591 include diagnosis, prevention and treatment of diseases and clinical conditions associated with LOC153196. LOC158014 (Accession XM_088442) is another VGAM591 host target gene. LOC158014 BINDING SITE is HOST TARGET binding site found in the 5' untranslated region of mRNA encoded by LOC158014, corresponding to a HOST TARGET binding site such as BINDING SITE I, BINDING SITE II or BINDING SITE III. Table 2 illustrates the complementarity of the nucleotide sequences of LOC158014 BINDING SITE, designated SEQ ID:39690, to the nucleotide sequence of VGAM591 RNA, herein designated VGAM RNA, also designated SEQ ID:3302.

Another function of VGAM591 is therefore inhibition of LOC158014 (Accession XM_088442). Accordingly, utilities of VGAM591 include diagnosis, prevention and treatment of diseases and clinical conditions associated with LOC158014. LOC158318 (Accession XM_098925) is another VGAM591 host target gene. LOC158318 BINDING SITE is HOST TARGET binding site found in the 5' untranslated region of mRNA encoded by LOC158318, corresponding to a HOST TARGET binding site such as BINDING SITE I, BINDING SITE II or BINDING SITE III. Table 2 illustrates the complementarity of the nucleotide sequences of LOC158318 BINDING SITE, designated SEQ ID:41959, to the nucleotide sequence of VGAM591 RNA, herein designated VGAM RNA, also designated SEQ ID:3302.

Another function of VGAM591 is therefore inhibition of LOC158318 (Accession XM_098925). Accordingly, utilities of VGAM591 include diagnosis, prevention and treatment of diseases and clinical conditions associated with LOC158318. FIG. 1 further provides a conceptual description of a novel bioinformatically detected viral gene of the present invention, referred to here as Viral Genomic Address Messenger 592 (VGAM592) viral gene, which modulates expression of respective host target genes thereof, the function and utility of which host target genes is known in the art.

VGAM592 is a novel bioinformatically detected regulatory, non protein coding, viral micro RNA (miRNA) gene. The method by which VGAM592 was detected is described hereinabove with reference to FIGS. 1-8.

VGAM592 gene, herein designated VGAM GENE, is a viral gene contained in the genome of Gallid Herpesvirus 2. VGAM592 host target gene, herein designated VGAM HOST TARGET GENE, is a human gene contained in the human genome.

VGAM592 gene encodes a VGAM592 precursor RNA, herein designated VGAM PRECURSOR RNA. Similar to other miRNA genes, and unlike most ordinary genes, VGAM592 precursor RNA does not encode a protein. A nucleotide sequence identical or highly similar to the nucleotide sequence of VGAM592 precursor RNA is designated SEQ ID:578, and is provided hereinbelow with reference to the sequence listing part. Nucleotide sequence SEQ ID:578 is located at position 44626 relative to the genome of Gallid Herpesvirus 2.

VGAM592 precursor RNA folds onto itself, forming VGAM592 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM592 folded precursor RNA into VGAM592 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM592 RNA is designated SEQ ID:3303, and is provided hereinbelow with reference to the sequence listing part.

VGAM592 host target gene, herein designated VGAM HOST TARGET GENE, encodes a corresponding messenger RNA, VGAM592 host target RNA, herein designated VGAM HOST TARGET RNA. VGAM592 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM592 RNA, herein designated VGAM RNA, binds complementarily to one or more host target binding sites located in untranslated regions of VGAM592 host target RNA, herein designated VGAM HOST TARGET RNA. This complementary binding is due to the fact that the nucleotide sequence of VGAM592 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM592 RNA, herein designated VGAM RNA, may have a different number of host target binding sites in untranslated regions of a VGAM592 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM592 RNA, herein designated VGAM RNA, to host target binding sites on VGAM592 host target RNA, herein designated VGAM HOST TARGET RNA, such as BINDING SITE I, BINDING SITE II and BINDING SITE III, inhibits translation of VGAM592 host target RNA into VGAM592 host target protein, herein designated VGAM HOST TARGET PROTEIN. VGAM host target protein is therefore outlined by a broken line.

It is appreciated that VGAM592 host target gene, herein designated VGAM HOST TARGET GENE, in fact represents a plurality of VGAM592 host target genes. The mRNA of each one of this plurality of VGAM592 host target genes comprises one or more host target binding sites, each having a nucleotide sequence which is at least partly complementary to VGAM592 RNA, herein designated VGAM RNA, and which when bound by VGAM592 RNA causes inhibition of translation of respective one or more VGAM592 host target proteins.

It is further appreciated by one skilled in the art that the mode of translational inhibition illustrated by FIG. 1 with specific reference to translational inhibition exerted by VGAM592 gene, herein designated VGAM GENE, on one or more VGAM592 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM592 is inhibition of expression of host target genes, as part of a novel viral mechanism of attacking a host. Accordingly, utilities of VGAM592 include diagnosis, prevention and treatment of viral infection by Gallid Herpesvirus 2. Specific functions, and accordingly utilities, of VGAM592 correlate with, and may be deduced from, the identity of the host target genes which VGAM592 binds and inhibits, and the function of these host target genes, as elaborated hereinbelow.

Nucleotide sequences of the VGAM592 precursor RNA, herein designated VGAM PRECURSOR RNA, and of the 'diced' VGAM592 RNA, herein designated VGAM RNA, and a schematic representation of the secondary folding of VGAM592 folded precursor RNA, herein designated VGAM FOLDED PRECURSOR RNA, of VGAM592 are further described hereinbelow with reference to Table 1.

Nucleotide sequences of host target binding sites, such as BINDING SITE-I, BINDING SITE-II and BINDING SITE-III of FIG. 1, found on VGAM592 host target RNA, and schematic representation of the complementarity of each of these host target binding sites to VGAM592 RNA, herein designated VGAM RNA, are described hereinbelow with reference to Table 2.

As mentioned hereinabove with reference to FIG. 1, a function of VGAM592 gene, herein designated VGAM is inhibition of expression of VGAM592 target genes. It is appreciated that specific functions, and accordingly utilities, of VGAM592 correlate with, and may be deduced from, the identity of the target genes which VGAM592 binds and inhibits, and the function of these target genes, as elaborated hereinbelow.

BN51 (BHK21) Temperature Sensitivity Complementing (BN51T, Accession XM_113557) is a VGAM592 host target gene. BN51T BINDING SITE is HOST TARGET binding site found in the 3' untranslated region of mRNA encoded by BN51T, corresponding to a HOST TARGET binding site such as BINDING SITE I, BINDING SITE II or BINDING SITE III. Table 2 illustrates the complementarity of the nucleotide sequences of BN51T BINDING SITE, designated SEQ ID:42284, to the nucleotide sequence of VGAM592 RNA, herein designated VGAM RNA, also designated SEQ ID:3303.

A function of VGAM592 is therefore inhibition of BN51 (BHK21) Temperature Sensitivity Complementing (BN51T, Accession XM_113557), a gene which complements a temperature-sensitive cell cycle mutation in BHK cells. Accordingly, utilities of VGAM592 include diagnosis, prevention and treatment of diseases and clinical conditions associated with BN51T. The function of BN51T has been established by previous studies. Two temperature-sensitive mutants have been isolated from the BHK-21 Syrian hamster cell line. Both of the human genes that complement these mutations, designated ts11 and tsBN51, lead to a block in progression through the G1 phase of the cell cycle at nonpermissive temperatures. Ts11 has been identified as asparagine synthetase; see 108370. The tsBN51 gene encodes a highly charged novel protein of 395 amino acids (Ittmann et al., 1987) whose biochemical function had not yet been determined when Greco et al. (1989) assigned the gene to 8q21 by study of rodent-human hybrid cells and by in situ hybridization using a tsBN51 probe. This is one of a considerable number of temperature-sensitive mutants which have been mapped to various autosomes and in several instances to the X chromosome.

Full details of the abovementioned studies are described in the following publications, the disclosure of which are hereby incorporated by reference:

Ittmann, M.; Greco, A.; Basilico, C.: Isolation of the human gene that complements a temperature-sensitive cell cycle mutation in BHK cells. Molec. Cell. Biol. 7: 3386-3393, 1987; and Greco, A.; Ittmann, M.; Barletta, C.; Basilico, C.; Croce, C. M.; Cannizzaro, L. A.; Huebner, K.: Chromosomal localization of human genes required for G(1) progression in mammalian cell.

Further studies establishing the function and utilities of BN51T are found in John Hopkins OMIM database record ID 187280, and in sited publications numbered 12373-12374 listed in the bibliography section hereinbelow, which are also hereby incorporated by reference. Cyclin-dependent Kinase Inhibitor 1B (p27, Kip1) (CDKN1B, Accession NM_004064) is another VGAM592 host target gene. CDKN1B BINDING SITE is HOST TARGET binding site found in the 3' untranslated region of mRNA encoded by CDKN1B, corresponding to a HOST TARGET binding site such as BINDING SITE I, BINDING SITE II or BINDING SITE III. Table 2 illustrates the complementarity of the nucleotide sequences of CDKN1B BINDING SITE, designated SEQ ID:10274, to the nucleotide sequence of VGAM592 RNA, herein designated VGAM RNA, also designated SEQ ID:3303.

Another function of VGAM592 is therefore inhibition of Cyclin-dependent Kinase Inhibitor 1B (p27, Kip1) (CDKN1B, Accession NM_004064), a gene which is involved in g1 arrest and may mediate tgf beta-induced g1 arrest. Accordingly, utilities of VGAM592 include diagnosis, prevention and treatment of diseases and clinical conditions associated with CDKN1B. The function of CDKN1B has been established by previous studies. Stegmaier et al. (1995) studied loss of heterozygosity (LOH) in the region 12p13-p12 in acute lymphoblastic leukemia; this chromosomal region often shows deletion in such patients. In 15% of informative patients, there was evidence of LOH of the TEL locus (OMIM Ref. No. 600618) which was not evident on cytogenetic analysis. Detailed examination of patients with LOH showed that the critically deleted region included a second candidate tumor suppressor gene, referred to by them as KIP1, which encodes the cyclin-dependent kinase inhibitor previously called p27 (Toyoshima and Hunter, 1994 and Polyak et al., 1994). Based on the STS content of TEL-positive YACs, Stegmaier et al. (1995) reported that KIP1 and TEL were in close proximity. Apoptosis of human endothelial cells after growth factor deprivation is associated with rapid and dramatic upregulation of cyclin A-associated CDK2 activity. Levkau et al. (1998) showed that in apoptotic cells the carboxyl-termini of the CDK inhibitors CDKN1A (OMIM Ref. No. 116899) and CDKN1B are truncated by specific cleavage. The enzyme involved in this cleavage is CASP3 (OMIM Ref. No. 600636) and/or a CASP3-like caspase. After cleavage, CDKN1A loses its nuclear localization sequence and exits the nucleus. Cleavage of CDKN1A and CDKN1B resulted in a substantial reduction in their association with nuclear cyclin-CDK2 complexes, leading to a dramatic induction of CDK2 activity. Dominant-negative CDK2, as well as a mutant CDKN1A resistant to caspase cleavage, partially suppressed apoptosis. These data suggested that CDK2 activation, through caspase-mediated cleavage of CDK inhibitors, may be instrumental in the execution of apoptosis following caspase activation.

Full details of the abovementioned studies are described in the following publications, the disclosure of which are hereby incorporated by reference:

Levkau, B.; Koyama, H.; Raines, E. W.; Clurman, B. E.; Herren, B.; Orth, K.; Roberts, J. M.; Ross, R.: Cleavage of p21(Cip1/Waf1) and p27(Kip1) mediates apoptosis in endothelial cells through activation of Cdk2: role of a caspase cascade. Molec. Cell 1:553-563, 1998; and Stegmaier, K.; Pendse, S.; Barker, G. F.; Bray-Ward, P.; Ward, D. C.; Montgomery, K. T.; Krauter, K. S.; Reynolds, C.; Sklar, J.; Donnelly, M.; Bohlander, S. K.; Rowley, J. D.; Sallan.

Further studies establishing the function and utilities of CDKN1B are found in John Hopkins OMIM database record ID 600778, and in sited publications numbered 5665, 9927-9930, 7124, 9936-9937, 12194, 9939-9940, 4705, 994 and 9942 listed in the bibliography section hereinbelow, which are also hereby incorporated by reference. Laminin, Gamma 2 (LAMC2, Accession NM_005562) is another VGAM592 host target gene. LAMC2 BINDING SITE is HOST TARGET binding site found in the 3' untranslated region of mRNA encoded by LAMC2, corresponding to a HOST TARGET binding site such as BINDING SITE I, BINDING SITE II or BINDING SITE III. Table 2 illustrates the complementarity of the nucleotide sequences of LAMC2 BINDING SITE, designated SEQ ID:12090, to the nucleotide sequence of VGAM592 RNA, herein designated VGAM RNA, also designated SEQ ID:3303.

Another function of VGAM592 is therefore inhibition of Laminin, Gamma 2 (LAMC2, Accession NM_005562). Accordingly, utilities of VGAM592 include diagnosis, prevention and treatment of diseases and clinical conditions associated with LAMC2. PAG (Accession NM_018440) is another VGAM592 host target gene. PAG BINDING SITE is HOST TARGET binding site found in the 3' untranslated region of mRNA encoded by PAG, corresponding to a HOST TARGET binding site such as BINDING SITE I, BINDING SITE II or BINDING SITE III. Table 2 illustrates the complementarity of the nucleotide sequences of PAG BINDING SITE, designated SEQ ID:20512, to the nucleotide sequence of VGAM592 RNA, herein designated VGAM RNA, also designated SEQ ID:3303.

Another function of VGAM592 is therefore inhibition of PAG (Accession NM_018440). Accordingly, utilities of VGAM592 include diagnosis, prevention and treatment of diseases and clinical conditions associated with PAG. Retinoblastoma-like 1 (p107) (RBL1, Accession NM_002895) is another VGAM592 host target gene. RBL1 BINDING SITE is HOST TARGET binding site found in the 3' untranslated region of mRNA encoded by RBL1, corresponding to a HOST TARGET binding site such as BINDING SITE I, BINDING SITE II or BINDING SITE III. Table 2 illustrates the complementarity of the nucleotide sequences of RBL1 BINDING SITE, designated SEQ ID:8802, to the nucleotide sequence of VGAM592 RNA, herein designated VGAM RNA, also designated SEQ ID:3303.

Another function of VGAM592 is therefore inhibition of Retinoblastoma-like 1 (p107) (RBL1, Accession NM_002895), a gene which has an important role in negatively regulating the rate of progression of the cell cycle. Accordingly, utilities of VGAM592 include diagnosis, prevention and treatment of diseases and clinical conditions associated with RBL1. The function of RBL1 has been established by previous studies. The cellular protein p107, like the retinoblastoma gene product (OMIM Ref. No. 180200), has been shown to form a specific complex with adenovirus E1A and SV40 large T antigen (T). The binding characteristics implied that RB1 and p107 share a common biochemical function. Ewen et al. (1991) used a partial cDNA for human p107 to map the gene to 20q11.2 by fluorescence in situ hybridization. The cDNA encoded a 936-residue protein. Comparison with RB1 showed a major region of homology extending over 564 residues. This region in RB1 is essential to its growth-controlling function. Sequences outside of this region are largely unique to each protein. Animal model experiments lend further support to the function of RBL1. LeCouter et al. (1998) introduced a null mutation in p107 into the germ line of mice and bred into a BALB/cJ genetic background. Mice lacking p107 were viable and fertile but displayed impaired growth, reaching about 50% of normal weight by 21 days of age. Mutant mice exhibited a myeloproliferative disorder characterized by ectopic myeloid hyperplasia in the spleen and liver. Embryonic p107 -/- fibroblasts and primary myoblasts isolated from adult p107 -/- mice displayed a striking 2-fold acceleration in doubling time. However, cell sort analysis indicated that the fraction of cells in G1, S, and G2 was unaltered, suggesting that the different phases of the cell cycle in p107 -/- cells was uniformly reduced by a factor of 2. Western analysis of cyclin expression in synchronized p107 -/- fibroblasts revealed that expression of cyclins E and A preceded that of D1. Mutant embryos expressed approximately twice the normal levels of Rb, whereas p130 levels were unaltered. Finally, mutant mice reverted to a wildtype phenotype following a single backcross with C57BL/6J mice, suggesting the existence of modifier genes that have potentially epistatic relationships with p107. LeCouter et al. (1998) concluded that p107 has an important role in negatively regulating the rate of progression of the cell cycle, but in a strain-dependent manner.

It is appreciated that the abovementioned animal model for RBL1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ewen, M. E.; Xing, Y.; Lawrence, J. B.; Livingston, D. M.: Molecular cloning, chromosomal mapping, and expression of the cDNA for p107, a retinoblastoma gene product-related protein. Cell 66:1155-1164, 1991; and LeCouter, J. E.; Kablar, B.; Hardy, W. R.; Ying, C.; Megeney, L. A.; May, L. L.; Rudnicki, M. A.: Strain-dependent myeloid hyperplasia, growth deficiency, and accelerated cell cycle in.

Further studies establishing the function and utilities of RBL1 are found in John Hopkins OMIM database record ID 116957, and in sited publications numbered 12349-4450 listed in the bibliography section hereinbelow, which are also hereby incorporated by reference. Suppressor of Cytokine Signaling 5 (SOCS5, Accession NM_014011) is another VGAM592 host target gene. SOCS5 BINDING SITE is HOST TARGET binding site found in the 3' untranslated region of mRNA encoded by SOCS5, corresponding to a HOST TARGET binding site such as BINDING SITE I, BINDING SITE II or BINDING SITE III. Table 2 illustrates the complementarity of the nucleotide sequences of SOCS5 BINDING SITE, designated SEQ ID:15228, to the nucleotide sequence of VGAM592 RNA, herein designated VGAM RNA, also designated SEQ ID:3303.

Another function of VGAM592 is therefore inhibition of Suppressor of Cytokine Signaling 5 (SOCS5, Accession NM_014011). Accordingly, utilities of VGAM592 include diagnosis, prevention and treatment of diseases and clinical conditions associated with SOCS5. FLJ23017 (Accession NM_022840) is another VGAM592 host target gene. FLJ23017 BINDING SITE is HOST TARGET binding site found in the 3' untranslated region of mRNA encoded by FLJ23017, corresponding to a HOST TARGET binding site such as BINDING SITE I, BINDING SITE II or BINDING SITE III. Table 2 illustrates the complementarity of the nucleotide sequences of FLJ23017 BINDING SITE, designated SEQ ID:23130, to the nucleotide sequence of VGAM592 RNA, herein designated VGAM RNA, also designated SEQ ID:3303.

Another function of VGAM592 is therefore inhibition of FLJ23017 (Accession NM_022840). Accordingly, utilities of VGAM592 include diagnosis, prevention and treatment of diseases and clinical conditions associated with FLJ23017. KIAA0354 (Accession NM_014872) is another VGAM592 host target gene. KIAA0354 BINDING SITE is HOST TARGET binding site found in the 3' untranslated region of mRNA encoded by KIAA0354, corresponding to a HOST TARGET binding site such as BINDING SITE I, BINDING SITE II or BINDING SITE III. Table 2 illustrates the complementarity of the nucleotide sequences of KIAA0354 BINDING SITE, designated SEQ ID:16997, to the nucleotide sequence of VGAM592 RNA, herein designated VGAM RNA, also designated SEQ ID:3303.

Another function of VGAM592 is therefore inhibition of KIAA0354 (Accession NM_014872). Accordingly, utilities of VGAM592 include diagnosis, prevention and treatment of diseases and clinical conditions associated with KIAA0354. KIAA0472 (Accession XM_050147) is another VGAM592 host target gene. KIAA0472 BINDING SITE is HOST TARGET binding site found in the 3' untranslated region of mRNA encoded by KIAA0472, corresponding to a HOST TARGET binding site such as BINDING SITE I, BINDING SITE II or BINDING SITE III. Table 2 illustrates the complementarity of the nucleotide sequences of KIAA0472 BINDING SITE, designated SEQ ID:35579, to the nucleotide sequence of VGAM592 RNA, herein designated VGAM RNA, also designated SEQ ID:3303.

Another function of VGAM592 is therefore inhibition of KIAA0472 (Accession XM_050147). Accordingly, utilities of VGAM592 include diagnosis, prevention and treatment of diseases and clinical conditions associated with KIAA0472. KIAA1297 (Accession XM_051005) is another VGAM592 host target gene. KIAA1297 BINDING SITE is HOST TARGET binding site found in the 5' untranslated region of mRNA encoded by KIAA1297, corresponding to a HOST TARGET binding site such as BINDING SITE I, BINDING SITE II or BINDING SITE III. Table 2 illustrates the complementarity of the nucleotide sequences of KIAA1297 BINDING SITE, designated SEQ ID:35718, to the nucleotide sequence of VGAM592 RNA, herein designated VGAM RNA, also designated SEQ ID:3303.

Another function of VGAM592 is therefore inhibition of KIAA1297 (Accession XM_051005). Accordingly, utilities of VGAM592 include diagnosis, prevention and treatment of diseases and clinical conditions associated with KIAA1297.1 (3) mbt-like 2 (Drosophila) (L3MBTL2, Accession XM_114201) is another VGAM592 host target gene. L3MBTL2 BINDING SITE is HOST TARGET binding site found in the 5' untranslated region of mRNA encoded by L3MBTL2, corresponding to a HOST TARGET binding site such as BINDING SITE I, BINDING SITE II or BINDING SITE III. Table 2 illustrates the complementarity of the nucleotide sequences of L3MBTL2 BINDING SITE, designated SEQ ID:42793, to the nucleotide sequence of VGAM592 RNA, herein designated VGAM RNA, also designated SEQ ID:3303.

Another function of VGAM592 is therefore inhibition of l (3) mbt-like 2 (Drosophila) (L3MBTL2, Accession XM_114201). Accordingly, utilities of VGAM592 include diagnosis, prevention and treatment of diseases and clinical conditions associated with L3MBTL2. LEC3 (Accession NM_015236) is another VGAM592 host target gene. LEC3 BINDING SITE is HOST TARGET binding site found in the 5' untranslated region of mRNA encoded by LEC3, corresponding to a HOST TARGET binding site such as BINDING SITE I, BINDING SITE II or BINDING SITE III. Table 2 illustrates the complementarity of the nucleotide sequences of LEC3 BINDING SITE, designated SEQ ID:17572, to the nucleotide sequence of VGAM592 RNA, herein designated VGAM RNA, also designated SEQ ID:3303.

Another function of VGAM592 is therefore inhibition of LEC3 (Accession NM_015236). Accordingly, utilities of VGAM592 include diagnosis, prevention and treatment of diseases and clinical conditions associated with LEC3. TUSP (Accession NM_020245) is another VGAM592 host target gene. TUSP BINDING SITE is HOST TARGET binding site found in the 3' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21532, to the nucleotide sequence of VGAM592 RNA, herein designated VGAM RNA, also designated SEQ ID:3303.

Another function of VGAM592 is therefore inhibition of TUSP (Accession NM_020245). Accordingly, utilities of VGAM592 include diagnosis, prevention and treatment of diseases and clinical conditions associated with TUSP. LOC143308 (Accession XM_096411) is another VGAM592 host target gene. LOC143308 BINDING SITE is HOST TARGET binding site found in the 5' untranslated region of mRNA encoded by LOC143308, corresponding to a HOST TARGET binding site such as BINDING SITE I, BINDING SITE II or BINDING SITE III. Table 2 illustrates the complementarity of the nucleotide sequences of LOC143308 BINDING SITE, designated SEQ ID:40349, to the nucleotide sequence of VGAM592 RNA, herein designated VGAM RNA, also designated SEQ ID:3303.

Another function of VGAM592 is therefore inhibition of LOC143308 (Accession XM_096411). Accordingly, utilities of VGAM592 include diagnosis, prevention and treatment of diseases and clinical conditions associated with LOC143308. LOC146136 (Accession XM_053737) is another VGAM592 host target gene. LOC146136 BINDING SITE is HOST TARGET binding site found in the 5' untranslated region of mRNA encoded by LOC146136, corresponding to a HOST TARGET binding site such as BINDING SITE I, BINDING SITE II or BINDING SITE III. Table 2 illustrates the complementarity of the nucleotide sequences of LOC146136 BINDING SITE, designated SEQ ID:36111, to the nucleotide sequence of VGAM592 RNA, herein designated VGAM RNA, also designated SEQ ID:3303.

Another function of VGAM592 is therefore inhibition of LOC146136 (Accession XM_053737). Accordingly, utilities of VGAM592 include diagnosis, prevention and treatment of diseases and clinical conditions associated with LOC146136. LOC150225 (Accession XM_097870) is another VGAM592 host target gene. LOC150225 BINDING SITE is HOST TARGET binding site found in the 3' untranslated region of mRNA encoded by LOC150225, corresponding to a HOST TARGET binding site such as BINDING SITE I, BINDING SITE II or BINDING SITE III. Table 2 illustrates the complementarity of the nucleotide sequences of LOC150225 BINDING SITE, designated SEQ ID:41190, to the nucleotide sequence of VGAM592 RNA, herein designated VGAM RNA, also designated SEQ ID:3303.

Another function of VGAM592 is therefore inhibition of LOC150225 (Accession XM_097870). Accordingly, utilities of VGAM592 include diagnosis, prevention and treatment of diseases and clinical conditions associated with LOC150225. LOC152860 (Accession XM_087539) is another VGAM592 host target gene. LOC152860 BINDING SITE is HOST TARGET binding site found in the 3' untranslated region of mRNA encoded by LOC152860, corresponding to a HOST TARGET binding site such as BINDING SITE I, BINDING SITE II or BINDING SITE III. Table 2 illustrates the complementarity of the nucleotide sequences of LOC152860 BINDING SITE, designated SEQ ID:39325, to the nucleotide sequence of VGAM592 RNA, herein designated VGAM RNA, also designated SEQ ID:3303.

Another function of VGAM592 is therefore inhibition of LOC152860 (Accession XM_087539). Accordingly, utilities of VGAM592 include diagnosis, prevention and treatment of diseases and clinical conditions associated with LOC152860. LOC158301 (Accession XM_088543) is another VGAM592 host target gene. LOC158301 BINDING SITE is HOST TARGET binding site found in the 5' untranslated region of mRNA encoded by LOC158301, corresponding to a HOST TARGET binding site such as BINDING SITE I, BINDING SITE II or BINDING SITE III. Table 2 illustrates the complementarity of the nucleotide sequences of LOC158301 BINDING SITE, designated SEQ ID:39810, to the nucleotide sequence of VGAM592 RNA, herein designated VGAM RNA, also designated SEQ ID:3303.

Another function of VGAM592 is therefore inhibition of LOC158301 (Accession XM_088543). Accordingly, utilities of VGAM592 include diagnosis, prevention and treatment of diseases and clinical conditions associated with LOC158301. LOC220565 (Accession XM_165417) is another VGAM592 host target gene. LOC220565 BINDING SITE is HOST TARGET binding site found in the 3' untranslated region of mRNA encoded by LOC220565, corresponding to a HOST TARGET binding site such as BINDING SITE I, BINDING SITE II or BINDING SITE III. Table 2 illustrates the complementarity of the nucleotide sequences of LOC220565 BINDING SITE, designated SEQ ID:43635, to the nucleotide sequence of VGAM592 RNA, herein designated VGAM RNA, also designated SEQ ID:3303.

Another function of VGAM592 is therefore inhibition of LOC220565 (Accession XM_165417). Accordingly, utilities of VGAM592 include diagnosis, prevention and treatment of diseases and clinical conditions associated with LOC220565. LOC221810 (Accession XM_168222) is another VGAM592 host target gene. LOC221810 BINDING SITE is HOST TARGET binding site found in the 3' untranslated region of mRNA encoded by LOC221810, corresponding to a HOST TARGET binding site such as BINDING SITE I, BINDING SITE II or BINDING SITE III. Table 2 illustrates the complementarity of the nucleotide sequences of LOC221810 BINDING SITE, designated SEQ ID:45085, to the nucleotide sequence of VGAM592 RNA, herein designated VGAM RNA, also designated SEQ ID:3303.

Another function of VGAM592 is therefore inhibition of LOC221810 (Accession XM_168222). Accordingly, utilities of VGAM592 include diagnosis, prevention and treatment of diseases and clinical conditions associated with LOC221810. LOC255158 (Accession XM_171213) is another VGAM592 host target gene. LOC255158 BINDING SITE is HOST TARGET binding site found in the 3' untranslated region of mRNA encoded by LOC255158, corresponding to a HOST TARGET binding site such as BINDING SITE I, BINDING SITE II or BINDING SITE III. Table 2 illustrates the complementarity of the nucleotide sequences of LOC255158 BINDING SITE, designated SEQ ID:46001, to the nucleotide sequence of VGAM592 RNA, herein designated VGAM RNA, also designated SEQ ID:3303.

Another function of VGAM592 is therefore inhibition of LOC255158 (Accession XM_171213). Accordingly, utilities of VGAM592 include diagnosis, prevention and treatment of diseases and clinical conditions associated with LOC255158. LOC90538 (Accession XM_032401) is another VGAM592 host target gene. LOC90538 BINDING SITE is HOST TARGET binding site found in the 3' untranslated region of mRNA encoded by LOC90538, corresponding to a HOST TARGET binding site such as BINDING SITE I, BINDING SITE II or BINDING SITE III. Table 2 illustrates the complementarity of the nucleotide sequences of LOC90538 BINDING SITE, designated SEQ ID:31657, to the nucleotide sequence of VGAM592 RNA, herein designated VGAM RNA, also designated SEQ ID:3303.

Another function of VGAM592 is therefore inhibition of LOC90538 (Accession XM_032401). Accordingly, utilities of VGAM592 include diagnosis, prevention and treatment of diseases and clinical conditions associated with LOC90538. LOC93380 (Accession XM_051020) is another VGAM592 host target gene. LOC93380 BINDING SITE is HOST TARGET binding site found in the 3' untranslated region of mRNA encoded by LOC93380, corresponding to a HOST TARGET binding site such as BINDING SITE I, BINDING SITE II or BINDING SITE III. Table 2 illustrates the complementarity of the nucleotide sequences of LOC93380 BINDING SITE, designated SEQ ID:35726, to the nucleotide sequence of VGAM592 RNA, herein designated VGAM RNA, also designated SEQ ID:3303.

Another function of VGAM592 is therefore inhibition of LOC93380 (Accession XM_051020). Accordingly, utilities of VGAM592 include diagnosis, prevention and treatment of diseases and clinical conditions associated with LOC93380. FIG. 1 further provides a conceptual description of a novel bioinformatically detected viral gene of the present invention, referred to here as Viral Genomic Address Messenger 593 (VGAM593) viral gene, which modulates expression of respective host target genes thereof, the function and utility of which host target genes is known in the art.

VGAM593 is a novel bioinformatically detected regulatory, non protein coding, viral micro RNA (miRNA) gene. The method by which VGAM593 was detected is described hereinabove with reference to FIGS. 1-8.

VGAM593 gene, herein designated VGAM GENE, is a viral gene contained in the genome of Gallid Herpesvirus 2. VGAM593 host target gene, herein designated VGAM HOST TARGET GENE, is a human gene contained in the human genome.

VGAM593 gene encodes a VGAM593 precursor RNA, herein designated VGAM PRECURSOR RNA. Similar to other miRNA genes, and unlike most ordinary genes, VGAM593 precursor RNA does not encode a protein. A nucleotide sequence identical or highly similar to the nucleotide sequence of VGAM593 precursor RNA is designated SEQ ID:579, and is provided hereinbelow with reference to the sequence listing part. Nucleotide sequence SEQ ID:579 is located at position 75792 relative to the genome of Gallid Herpesvirus 2.

VGAM593 precursor RNA folds onto itself, forming VGAM593 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM593 folded precursor RNA into VGAM593 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM593 RNA is designated SEQ ID:3304, and is provided hereinbelow with reference to the sequence listing part.

VGAM593 host target gene, herein designated VGAM HOST TARGET GENE, encodes a corresponding messenger RNA, VGAM593 host target RNA, herein designated VGAM HOST TARGET RNA. VGAM593 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM593 RNA, herein designated VGAM RNA, binds complementarily to one or more host target binding sites located in untranslated regions of VGAM593 host target RNA, herein designated VGAM HOST TARGET RNA. This complementary binding is due to the fact that the nucleotide sequence of VGAM593 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM593 RNA, herein designated VGAM RNA, may have a different number of host target binding sites in untranslated regions of a VGAM593 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM593 RNA, herein designated VGAM RNA, to host target binding sites on VGAM593 host target RNA, herein designated VGAM HOST TARGET RNA, such as BINDING SITE I, BINDING SITE II and BINDING SITE III, inhibits translation of VGAM593 host target RNA into VGAM593 host target protein, herein designated VGAM HOST TARGET PROTEIN. VGAM host target protein is therefore outlined by a broken line.

It is appreciated that VGAM593 host target gene, herein designated VGAM HOST TARGET GENE, in fact represents a plurality of VGAM593 host target genes. The mRNA of each one of this plurality of VGAM593 host target genes comprises one or more host target binding sites, each having a nucleotide sequence which is at least partly complementary to VGAM593 RNA, herein designated VGAM RNA, and which when bound by VGAM593 RNA causes inhibition of translation of respective one or more VGAM593 host target proteins.

It is further appreciated by one skilled in the art that the mode of translational inhibition illustrated by FIG. 1 with specific reference to translational inhibition exerted by VGAM593 gene, herein designated VGAM GENE, on one or more VGAM593 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM593 is inhibition of expression of host target genes, as part of a novel viral mechanism of attacking a host. Accordingly, utilities of VGAM593 include diagnosis, prevention and treatment of viral infection by Gallid Herpesvirus 2. Specific functions, and accordingly utilities, of VGAM593 correlate with, and may be deduced from, the identity of the host target genes which VGAM593 binds and inhibits, and the function of these host target genes, as elaborated hereinbelow.

Nucleotide sequences of the VGAM593 precursor RNA, herein designated VGAM PRECURSOR RNA, and of the 'diced' VGAM593 RNA, herein designated VGAM RNA, and a schematic representation of the secondary folding of VGAM593 folded precursor RNA, herein designated VGAM FOLDED PRECURSOR RNA, of VGAM593 are further described hereinbelow with reference to Table 1.

Nucleotide sequences of host target binding sites, such as BINDING SITE-I, BINDING SITE-II and BINDING SITE-III of FIG. 1, found on VGAM593 host target RNA, and schematic representation of the complementarity of each of these host target binding sites to VGAM593 RNA, herein designated VGAM RNA, are described hereinbelow with reference to Table 2.

As mentioned hereinabove with reference to FIG. 1, a function of VGAM593 gene, herein designated VGAM is inhibition of expression of VGAM593 target genes. It is appreciated that specific functions, and accordingly utilities, of VGAM593 correlate with, and may be deduced from, the identity of the target genes which VGAM593 binds and inhibits, and the function of these target genes, as elaborated hereinbelow.

Core-binding Factor, Runt Domain, Alpha Subunit 2; Translocated To, 3 (CBFA2T3, Accession NM_005187) is a VGAM593 host target gene. CBFA2T3 BINDING SITE is HOST TARGET binding site found in the 3' untranslated region of mRNA encoded by CBFA2T3, corresponding to a HOST TARGET binding site such as BINDING SITE I, BINDING SITE II or BINDING SITE III. Table 2 illustrates the complementarity of the nucleotide sequences of CBFA2T3 BINDING SITE, designated SEQ ID:11694, to the nucleotide sequence of VGAM593 RNA, herein designated VGAM RNA, also designated SEQ ID:3304.

A function of VGAM593 is therefore inhibition of Core-binding Factor, Runt Domain, Alpha Subunit 2; Translocated To, 3 (CBFA2T3, Accession NM_005187). Accordingly, utilities of VGAM593 include diagnosis, prevention and treatment of diseases and clinical conditions associated with CBFA2T3. Growth Arrest-specific 11 (GAS11, Accession NM_001481) is another VGAM593 host target gene. GAS11 BINDING SITE is HOST TARGET binding site found in the 3' untranslated region of mRNA encoded by GAS11, corresponding to a HOST TARGET binding site such as BINDING SITE I, BINDING SITE II or BINDING SITE III. Table 2 illustrates the complementarity of the nucleotide sequences of GAS11 BINDING SITE, designated SEQ ID:7222, to the nucleotide sequence of VGAM593 RNA, herein designated VGAM RNA, also designated SEQ ID:3304.

Another function of VGAM593 is therefore inhibition of Growth Arrest-specific 11 (GAS11, Accession NM_001481). Accordingly, utilities of VGAM593 include diagnosis, prevention and treatment of diseases and clinical conditions associated with GAS11. Nidogen (enactin) (NID, Accession NM_002508) is another VGAM593 host target gene. NID BINDING SITE is HOST TARGET binding site found in the 3' untranslated region of mRNA encoded by NID, corresponding to a HOST TARGET binding site such as BINDING SITE I, BINDING SITE II or BINDING SITE III. Table 2 illustrates the complementarity of the nucleotide sequences of NID BINDING SITE, designated SEQ ID:8341, to the nucleotide sequence of VGAM593 RNA, herein designated VGAM RNA, also designated SEQ ID:3304.

Another function of VGAM593 is therefore inhibition of Nidogen (enactin) (NID, Accession NM_002508). Accordingly, utilities of VGAM593 include diagnosis, prevention and treatment of diseases and clinical conditions associated with NID. Nipsnap Homolog 1 (C. elegans) (NIPSNAP1, Accession NM_003634) is another VGAM593 host target gene. NIPSNAP1 BINDING SITE is HOST TARGET binding site found in the 3' untranslated region of mRNA encoded by NIPSNAP1, corresponding to a HOST TARGET binding site such as BINDING SITE I, BINDING SITE II or BINDING SITE III. Table 2 illustrates the complementarity of the nucleotide sequences of NIPSNAP1 BINDING SITE, designated SEQ ID:9703, to the nucleotide sequence of VGAM593 RNA, herein designated VGAM RNA, also designated SEQ ID:3304.

Another function of VGAM593 is therefore inhibition of Nipsnap Homolog 1 (C. elegans) (NIPSNAP1, Accession NM_003634). Accordingly, utilities of VGAM593 include diagnosis, prevention and treatment of diseases and clinical conditions associated with NIPSNAP1. Ubiquitin Protein Ligase E3A (human papilloma virus E6-associated protein, Angelman syndrome) (UBE3A, Accession NM_130838) is another VGAM593 host target gene. UBE3A BINDING SITE1 through UBE3A BINDING SITE3 are HOST TARGET binding sites found in untranslated regions of mRNA encoded by UBE3A, corresponding to HOST TARGET binding sites such as BINDING SITE I, BINDING SITE II or BINDING SITE III. Table 2 illustrates the complementarity of the nucleotide sequences of UBE3A BINDING SITE1 through UBE3A BINDING SITE3, designated SEQ ID:28359, SEQ ID:28363 and SEQ ID:6078 respectively, to the nucleotide sequence of VGAM593 RNA, herein designated VGAM RNA, also designated SEQ ID:3304.

Another function of VGAM593 is therefore inhibition of Ubiquitin Protein Ligase E3A (human papilloma virus E6-associated protein, Angelman syndrome) (UBE3A, Accession NM_130838). Accordingly, utilities of VGAM593 include diagnosis, prevention and treatment of diseases and clinical conditions associated with UBE3A. KIAA0141 (Accession NM_014773) is another VGAM593 host target gene. KIAA0141 BINDING SITE is HOST TARGET binding site found in the 3' untranslated region of mRNA encoded by KIAA0141, corresponding to a HOST TARGET binding site such as BINDING SITE I, BINDING SITE II or BINDING SITE III. Table 2 illustrates the complementarity of the nucleotide sequences of KIAA0141 BINDING SITE, designated SEQ ID:16584, to the nucleotide sequence of VGAM593 RNA, herein designated VGAM RNA, also designated SEQ ID:3304.

Another function of VGAM593 is therefore inhibition of KIAA0141 (Accession NM_014773). Accordingly, utilities of VGAM593 include diagnosis, prevention and treatment of diseases and clinical conditions associated with KIAA0141. KIAA1550 (Accession XM_039393) is another VGAM593 host target gene. KIAA1550 BINDING SITE is HOST TARGET binding site found in the 3' untranslated region of mRNA encoded by KIAA1550, corresponding to a HOST TARGET binding site such as BINDING SITE I, BINDING SITE II or BINDING SITE III. Table 2 illustrates the complementarity of the nucleotide sequences of KIAA1550 BINDING SITE, designated SEQ ID:33067, to the nucleotide sequence of VGAM593 RNA, herein designated VGAM RNA, also designated SEQ ID:3304.

Another function of VGAM593 is therefore inhibition of KIAA1550 (Accession XM_039393). Accordingly, utilities of VGAM593 include diagnosis, prevention and treatment of diseases and clinical conditions associated with KIAA1550. KIAA1956 (Accession XM_085836) is another VGAM593 host target gene. KIAA1956 BINDING SITE is HOST TARGET binding site found in the 3' untranslated region of mRNA encoded by KIAA1956, corresponding to a HOST TARGET binding site such as BINDING SITE I, BINDING SITE II or BINDING SITE III. Table 2 illustrates the complementarity of the nucleotide sequences of KIAA1956 BINDING SITE, designated SEQ ID:38363, to the nucleotide sequence of VGAM593 RNA, herein designated VGAM RNA, also designated SEQ ID:3304.

Another function of VGAM593 is therefore inhibition of KIAA1956 (Accession XM_085836). Accordingly, utilities of VGAM593 include diagnosis, prevention and treatment of diseases and clinical conditions associated with KIAA1956. MGC17330 (Accession NM_052880) is another VGAM593 host target gene. MGC17330 BINDING SITE is HOST TARGET binding site found in the 3' untranslated region of mRNA encoded by MGC17330, corresponding to a HOST TARGET binding site such as BINDING SITE I, BINDING SITE II or BINDING SITE III. Table 2 illustrates the complementarity of the nucleotide sequences of MGC17330 BINDING SITE, designated SEQ ID:27458, to the nucleotide sequence of VGAM593 RNA, herein designated VGAM RNA, also designated SEQ ID:3304.

Another function of VGAM593 is therefore inhibition of MGC17330 (Accession NM_052880). Accordingly, utilities of VGAM593 include diagnosis, prevention and treatment of diseases and clinical conditions associated with MGC17330. NYD-SP11 (Accession NM_031951) is another VGAM593 host target gene. NYD-SP11 BINDING SITE is HOST TARGET binding site found in the 3' untranslated region of mRNA encoded by NYD-SP11, corresponding to a HOST TARGET binding site such as BINDING SITE I, BINDING SITE II or BINDING SITE III. Table 2 illustrates the complementarity of the nucleotide sequences of NYD-SP11 BINDING SITE, designated SEQ ID:25688, to the nucleotide sequence of VGAM593 RNA, herein designated VGAM RNA, also designated SEQ ID:3304.

Another function of VGAM593 is therefore inhibition of NYD-SP11 (Accession NM_031951). Accordingly, utilities of VGAM593 include diagnosis, prevention and treatment of diseases and clinical conditions associated with NYD-SP11. Zinc Finger Protein 33a (KOX 31) (ZNF33A, Accession XM_166119) is another VGAM593 host target gene. ZNF33A BINDING SITE is HOST TARGET binding site found in the 3' untranslated region of mRNA encoded by ZNF33A, corresponding to a HOST TARGET binding site such as BINDING SITE I, BINDING SITE II or BINDING SITE III. Table 2 illustrates the complementarity of the nucleotide sequences of ZNF33A BINDING SITE, designated SEQ ID:43895, to the nucleotide sequence of VGAM593 RNA, herein designated VGAM RNA, also designated SEQ ID:3304.

Another function of VGAM593 is therefore inhibition of Zinc Finger Protein 33a (KOX 31) (ZNF33A, Accession XM_166119). Accordingly, utilities of VGAM593 include diagnosis, prevention and treatment of diseases and clinical conditions associated with ZNF33A. LOC124602 (Accession XM_058829) is another VGAM593 host target gene. LOC124602 BINDING SITE is HOST TARGET binding site found in the 3' untranslated region of mRNA encoded by LOC124602, corresponding to a HOST TARGET binding site such as BINDING SITE I, BINDING SITE II or BINDING SITE III. Table 2 illustrates the complementarity of the nucleotide sequences of LOC124602 BINDING SITE, designated SEQ ID:36758, to the nucleotide sequence of VGAM593 RNA, herein designated VGAM RNA, also designated SEQ ID:3304.

Another function of VGAM593 is therefore inhibition of LOC124602 (Accession XM_058829). Accordingly, utilities of VGAM593 include diagnosis, prevention and treatment of diseases and clinical conditions associated with LOC124602. LOC130412 (Accession XM_065708) is another VGAM593 host target gene. LOC130412 BINDING SITE is HOST TARGET binding site found in the 5' untranslated region of mRNA encoded by LOC130412, corresponding to a HOST TARGET binding site such as BINDING SITE I, BINDING SITE II or BINDING SITE III. Table 2 illustrates the complementarity of the nucleotide sequences of LOC130412 BINDING SITE, designated SEQ ID:37291, to the nucleotide sequence of VGAM593 RNA, herein designated VGAM RNA, also designated SEQ ID:3304.

Another function of VGAM593 is therefore inhibition of LOC130412 (Accession XM_065708). Accordingly, utilities of VGAM593 include diagnosis, prevention and treatment of diseases and clinical conditions associated with LOC130412. LOC203397 (Accession XM_114695) is another VGAM593 host target gene. LOC203397 BINDING SITE is HOST TARGET binding site found in the 3' untranslated region of mRNA encoded by LOC203397, corresponding to a HOST TARGET binding site such as BINDING SITE I, BINDING SITE II or BINDING SITE III. Table 2 illustrates the complementarity of the nucleotide sequences of LOC203397 BINDING SITE, designated SEQ ID:43038, to the nucleotide sequence of VGAM593 RNA, herein designated VGAM RNA, also designated SEQ ID:3304.

Another function of VGAM593 is therefore inhibition of LOC203397 (Accession XM_114695). Accordingly, utilities of VGAM593 include diagnosis, prevention and treatment of diseases and clinical conditions associated with LOC203397. FIG. 1 further provides a conceptual description of a novel bioinformatically detected viral gene of the present invention, referred to here as Viral Genomic Address Messenger 594 (VGAM594) viral gene, which modulates expression of respective host target genes thereof, the function and utility of which host target genes is known in the art.

VGAM594 is a novel bioinformatically detected regulatory, non protein coding, viral micro RNA (miRNA) gene. The method by which VGAM594 was detected is described hereinabove with reference to FIGS. 1-8.

VGAM594 gene, herein designated VGAM GENE, is a viral gene contained in the genome of Northern Cereal Mosaic Virus. VGAM594 host target gene, herein designated VGAM HOST TARGET GENE, is a human gene contained in the human genome.

VGAM594 gene encodes a VGAM594 precursor RNA, herein designated VGAM PRECURSOR RNA. Similar to other miRNA genes, and unlike most ordinary genes, VGAM594 precursor RNA does not encode a protein. A nucleotide sequence identical or highly similar to the nucleotide sequence of VGAM594 precursor RNA is designated SEQ ID:580, and is provided hereinbelow with reference to the sequence listing part. Nucleotide sequence SEQ ID:580 is located at position 8565 relative to the genome of Northern Cereal Mosaic Virus.

VGAM594 precursor RNA folds onto itself, forming VGAM594 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM594 folded precursor RNA into VGAM594 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM594 RNA is designated SEQ ID:3305, and is provided hereinbelow with reference to the sequence listing part.

VGAM594 host target gene, herein designated VGAM HOST TARGET GENE, encodes a corresponding messenger RNA, VGAM594 host target RNA, herein designated VGAM HOST TARGET RNA. VGAM594 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM594 RNA, herein designated VGAM RNA, binds complementarily to one or more host target binding sites located in untranslated regions of VGAM594 host target RNA, herein designated VGAM HOST TARGET RNA. This complementary binding is due to the fact that the nucleotide sequence of VGAM594 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM594 RNA, herein designated VGAM RNA, may have a different number of host target binding sites in untranslated regions of a VGAM594 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM594 RNA, herein designated VGAM RNA, to host target binding sites on VGAM594 host target RNA, herein designated VGAM HOST TARGET RNA, such as BINDING SITE I, BINDING SITE II and BINDING SITE III, inhibits translation of VGAM594 host target RNA into VGAM594 host target protein, herein designated VGAM HOST TARGET PROTEIN. VGAM host target protein is therefore outlined by a broken line.

It is appreciated that VGAM594 host target gene, herein designated VGAM HOST TARGET GENE, in fact represents a plurality of VGAM594 host target genes. The mRNA of each one of this plurality of VGAM594 host target genes comprises one or more host target binding sites, each having a nucleotide sequence which is at least partly complementary to VGAM594 RNA, herein designated VGAM RNA, and which when bound by VGAM594 RNA causes inhibition of translation of respective one or more VGAM594 host target proteins.

It is further appreciated by one skilled in the art that the mode of translational inhibition illustrated by FIG. 1 with specific reference to translational inhibition exerted by VGAM594 gene, herein designated VGAM GENE, on one or more VGAM594 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM594 is inhibition of expression of host target genes, as part of a novel viral mechanism of attacking a host. Accordingly, utilities of VGAM594 include diagnosis, prevention and treatment of viral infection by Northern Cereal Mosaic Virus. Specific functions, and accordingly utilities, of VGAM594 correlate with, and may be deduced from, the identity of the host target genes which VGAM594 binds and inhibits, and the function of these host target genes, as elaborated hereinbelow.

Nucleotide sequences of the VGAM594 precursor RNA, herein designated VGAM PRECURSOR RNA, and of the 'diced' VGAM594 RNA, herein designated VGAM RNA, and a schematic representation of the secondary folding of VGAM594 folded precursor RNA, herein designated VGAM FOLDED PRECURSOR RNA, of VGAM594 are further described hereinbelow with reference to Table 1.

Nucleotide sequences of host target binding sites, such as BINDING SITE-I, BINDING SITE-II and BINDING SITE-III of FIG. 1, found on VGAM594 host target RNA, and schematic representation of the complementarity of each of these host target binding sites to VGAM594 RNA, herein designated VGAM RNA, are described hereinbelow with reference to Table 2.

As mentioned hereinabove with reference to FIG. 1, a function of VGAM594 gene, herein designated VGAM is inhibition of expression of VGAM594 target genes. It is appreciated that specific functions, and accordingly utilities, of VGAM594 correlate with, and may be deduced from, the identity of the target genes which VGAM594 binds and inhibits, and the function of these target genes, as elaborated hereinbelow.

Amyotrophic Lateral Sclerosis 2 (juvenile) (ALS2, Accession NM_020919) is a VGAM594 host target gene. ALS2 BINDING SITE is HOST TARGET binding site found in the 3' untranslated region of mRNA encoded by ALS2, corresponding to a HOST TARGET binding site such as BINDING SITE I, BINDING SITE II or BINDING SITE III. Table 2 illustrates the complementarity of the nucleotide sequences of ALS2 BINDING SITE, designated SEQ ID:21931, to the nucleotide sequence of VGAM594 RNA, herein designated VGAM RNA, also designated SEQ ID:3305.

A function of VGAM594 is therefore inhibition of Amyotrophic Lateral Sclerosis 2 (juvenile) (ALS2, Accession NM_020919). Accordingly, utilities of VGAM594 include diagnosis, prevention and treatment of diseases and clinical conditions associated with ALS2. HTRA3 (Accession XM_114416) is another VGAM594 host target gene. HTRA3 BINDING SITE is HOST TARGET binding site found in the 3' untranslated region of mRNA encoded by HTRA3, corresponding to a HOST TARGET binding site such as BINDING SITE I, BINDING SITE II or BINDING SITE III. Table 2 illustrates the complementarity of the nucleotide sequences of HTRA3 BINDING SITE, designated SEQ ID:42942, to the nucleotide sequence of VGAM594 RNA, herein designated VGAM RNA, also designated SEQ ID:3305.

Another function of VGAM594 is therefore inhibition of HTRA3 (Accession XM_114416). Accordingly, utilities of VGAM594 include diagnosis, prevention and treatment of diseases and clinical conditions associated with HTRA3. Kynurenine 3-monooxygenase (kynurenine 3-hydroxylase) (KMO, Accession NM_003679) is another VGAM594 host target gene. KMO BINDING SITE is HOST TARGET binding site found in the 3' untranslated region of mRNA encoded by KMO, corresponding to a HOST TARGET binding site such as BINDING SITE I, BINDING SITE II or BINDING SITE III. Table 2 illustrates the complementarity of the nucleotide sequences of KMO BINDING SITE, designated SEQ ID:9780, to the nucleotide sequence of VGAM594 RNA, herein designated VGAM RNA, also designated SEQ ID:3305.

Another function of VGAM594 is therefore inhibition of Kynurenine 3-monooxygenase (kynurenine 3-hydroxylase) (KMO, Accession NM_003679), a gene which may play a role in encephalic photoreception. Accordingly, utilities of VGAM594 include diagnosis, prevention and treatment of diseases and clinical conditions associated with KMO. The function of KMO and its association with various diseases and clinical conditions, has been established by previous studies, as described hereinabove with reference to VGAM162. Laminin, Alpha 4 (LAMA4, Accession NM_002290) is another VGAM594 host target gene. LAMA4 BINDING SITE is HOST TARGET binding site found in the 5' untranslated region of mRNA encoded by LAMA4, corresponding to a HOST TARGET binding site such as BINDING SITE I, BINDING SITE II or BINDING SITE III. Table 2 illustrates the complementarity of the nucleotide sequences of LAMA4 BINDING SITE, designated SEQ ID:8070, to the nucleotide sequence of VGAM594 RNA, herein designated VGAM RNA, also designated SEQ ID:3305.

Another function of VGAM594 is therefore inhibition of Laminin, Alpha 4 (LAMA4, Accession NM_002290), a gene which mediates the attachment, migration and organization of cells into tissues. Accordingly, utilities of VGAM594 include diagnosis, prevention and treatment of diseases and clinical conditions associated with LAMA4. The function of LAMA4 and its association with various diseases and clinical conditions, has been established by previous studies, as described hereinabove with reference to VGAM300. Tumor Necrosis Factor Receptor Superfamily, Member 10b (TNFRSF10B, Accession NM_003842) is another VGAM594 host target gene. TNFRSF10B BINDING SITE is HOST TARGET binding site found in the 3' untranslated region of mRNA encoded by TNFRSF10B, corresponding to a HOST TARGET binding site such as BINDING SITE I, BINDING SITE II or BINDING SITE III. Table 2 illustrates the complementarity of the nucleotide sequences of TNFRSF10B BINDING SITE, designated SEQ ID:9942, to the nucleotide sequence of VGAM594 RNA, herein designated VGAM RNA, also designated SEQ ID:3305.

Another function of VGAM594 is therefore inhibition of Tumor Necrosis Factor Receptor Superfamily, Member 10b (TNFRSF10B, Accession NM_003842), a gene which forms complex that induces apoptosis. Accordingly, utilities of VGAM594 include diagnosis, prevention and treatment of diseases and clinical conditions associated with TNFRSF10B. The function of TNFRSF10B and its association with various diseases and clinical conditions, has been established by previous studies, as described hereinabove with reference to VGAM400. Wingless-type MMTV Integration Site Family, Member 10B (WNT10B, Accession NM_003394) is another VGAM594 host target gene. WNT10B BINDING SITE is HOST TARGET binding site found in the 3' untranslated region of mRNA encoded by WNT10B, corresponding to a HOST TARGET binding site such as BINDING SITE I, BINDING SITE II or BINDING SITE III. Table 2 illustrates the complementarity of the nucleotide sequences of WNT10B BINDING SITE, designated SEQ ID:9432, to the nucleotide sequence of VGAM594 RNA, herein designated VGAM RNA, also designated SEQ ID:3305.

Another function of VGAM594 is therefore inhibition of Wingless-type MMTV Integration Site Family, Member 10B (WNT10B, Accession NM_003394), a gene which is a ligand for members of the frizzled family of seven transmembrane receptors and may be a signaling molecule. Accordingly, utilities of VGAM594 include diagnosis, prevention and treatment of diseases and clinical conditions associated with WNT10B. The function of WNT10B has been established by previous studies. Several members of the Wnt gene family have been shown to cause mammary tumors in mice. Using degenerate primer PCR on human genomic DNA and specific PCR of cDNA libraries, Bui et al. (1997) isolated a Wnt gene that had not previously been described in human. It is the human homolog of mouse Wnt10b, which had been shown to be one of the oncogenes cooperating with FGF3 (OMIM Ref. No. 164950) in the development of mouse mammary tumor virus (MMTV)-induced mammary carcinomas in mice. The human WNT10B sequence is 88 and 95% identical to the murine gene at nucleotide and amino acid levels, respectively. By YAC and fluorescence in situ hybridization (FISH) mapping, Bui et al. (1997) localized the gene to 12q13, a chromosomal region frequently rearranged in human tumors and also containing the WNT1 gene (OMIM Ref. No. 164820). WNT10B expression was not observed in normal and benign proliferations of human breast tissue but was found to be elevated in 3 of 50 primary breast carcinomas. Southern blot analysis of the carcinoma expressing the highest level of WNT10B showed no amplification or rearrangement of the gene. Hardiman et al. (1997) demonstrated that the WNT10B gene encodes a 389-amino acid protein with 96.6% sequence identity to mouse Wnt10b. The expression pattern showed that it is synthesized in many adult tissues with the highest levels found in heart and skeletal muscle. Ross et al. (2000) showed that WNT signaling, likely mediated by WNT10B, is a molecular switch that governs adipogenesis. WNT signaling maintains preadipocytes in an undifferentiated state through inhibition of the adipogenic transcription factors CEBPA (OMIM Ref. No. 116897) and PPAR-gamma (OMIM Ref. No. 601487). When WNT signaling in preadipocytes is prevented by overexpression of axin (OMIM Ref. No. 603816) or dominant-negative TCF4 (OMIM Ref. No. 602272), these cells differentiate into adipocytes. Disruption of WNT signaling also causes transdifferentiation of myoblasts into adipocytes in vitro, highlighting the importance of this pathway not only in adipocyte differentiation but also in mesodermal cell fate determination. By PCR typing of a human/rodent monochromosomal panel and FISH, Hardiman et al. (1997) mapped the WNT10B gene to chromosome 12q13.1. By analyzing human genome draft sequence, Kirikoshi et al. (2001) determined that WNT10B is encoded by 5 exons and is clustered with WNT1 (OMIM Ref. No. 164820) in a head-to-head manner with an interval of less than 7 kb. They hypothesized that the WNT1-WNT10B gene cluster and the WNT6 (OMIM Ref. No. 604663)-WNT10A (OMIM Ref. No. 606268) gene cluster on chromosome 2 might be due to duplication of an ancestral WNT gene cluster.

Full details of the abovementioned studies are described in the following publications, the disclosure of which are hereby incorporated by reference:

Kirikoshi, H.; Sekihara, H.; Katoh, M.: WNT10A and WNT6, clustered in human chromosome 2q35 region with head-to-tail manner, are strongly coexpressed in SW480 cells. Biochem. Biophys. Res. Commun. 283:798-805, 2001; and Ross, S. E.; Hemati, N.; Longo, K. A.; Bennett, C. N.; Lucas, P. C.; Erickson, R. L.; MacDougald, O. A.: Inhibition of adipogenesis by Wnt signaling. Science 289:950-953, 2000.

Further studies establishing the function and utilities of WNT10B are found in John Hopkins OMIM database record ID 601906, and in sited publications numbered 8886-888 and 12748 listed in the bibliography section hereinbelow, which are also hereby incorporated by reference. CDC14 Cell Division Cycle 14 Homolog B (S. cerevisiae) (CDC14B, Accession NM_033332) is another VGAM594 host target gene. CDC14B BINDING SITE is HOST TARGET binding site found in the 3' untranslated region of mRNA encoded by CDC14B, corresponding to a HOST TARGET binding site such as BINDING SITE I, BINDING SITE II or BINDING SITE III. Table 2 illustrates the complementarity of the nucleotide sequences of CDC14B BINDING SITE, designated SEQ ID:27176, to the nucleotide sequence of VGAM594 RNA, herein designated VGAM RNA, also designated SEQ ID:3305.

Another function of VGAM594 is therefore inhibition of CDC14 Cell Division Cycle 14 Homolog B (S. cerevisiae) (CDC14B, Accession NM_033332). Accordingly, utilities of VGAM594 include diagnosis, prevention and treatment of diseases and clinical conditions associated with CDC14B. CSRP2 Binding Protein (CSRP2BP, Accession XM_046520) is another VGAM594 host target gene. CSRP2BP BINDING SITE is HOST TARGET binding site found in the 3' untranslated region of mRNA encoded by CSRP2BP, corresponding to a HOST TARGET binding site such as BINDING SITE I, BINDING SITE II or BINDING SITE III. Table 2 illustrates the complementarity of the nucleotide sequences of CSRP2BP BINDING SITE, designated SEQ ID:34737, to the nucleotide sequence of VGAM594 RNA, herein designated VGAM RNA, also designated SEQ ID:3305.

Another function of VGAM594 is therefore inhibition of CSRP2 Binding Protein (CSRP2BP, Accession XM_046520). Accordingly, utilities of VGAM594 include diagnosis, prevention and treatment of diseases and clinical conditions associated with CSRP2BP. DKFZP434D146 (Accession NM_015595) is another VGAM594 host target gene. DKFZP434D146 BINDING SITE is HOST TARGET binding site found in the 3' untranslated region of mRNA encoded by DKFZP434D146, corresponding to a HOST TARGET binding site such as BINDING SITE I, BINDING SITE II or BINDING SITE III. Table 2 illustrates the complementarity of the nucleotide sequences of DKFZP434D146 BINDING SITE, designated SEQ ID:17874, to the nucleotide sequence of VGAM594 RNA, herein designated VGAM RNA, also designated SEQ ID:3305.

Another function of VGAM594 is therefore inhibition of DKFZP434D146 (Accession NM_015595). Accordingly, utilities of VGAM594 include diagnosis, prevention and treatment of diseases and clinical conditions associated with DKFZP434D146. KIAA0435 (Accession NM_014801) is another VGAM594 host target gene. KIAA0435 BINDING SITE is HOST TARGET binding site found in the 5' untranslated region of mRNA encoded by KIAA0435, corresponding to a HOST TARGET binding site such as BINDING SITE I, BINDING SITE II or BINDING SITE III. Table 2 illustrates the complementarity of the nucleotide sequences of KIAA0435 BINDING SITE, designated SEQ ID:16726, to the nucleotide sequence of VGAM594 RNA, herein designated VGAM RNA, also designated SEQ ID:3305.

Another function of VGAM594 is therefore inhibition of KIAA0435 (Accession NM_014801). Accordingly, utilities of VGAM594 include diagnosis, prevention and treatment of diseases and clinical conditions associated with KIAA0435. KIAA0444 (Accession XM_030999) is another VGAM594 host target gene. KIAA0444 BINDING SITE is HOST TARGET binding site found in the 3' untranslated region of mRNA encoded by KIAA0444, corresponding to a HOST TARGET binding site such as BINDING SITE I, BINDING SITE II or BINDING SITE III. Table 2 illustrates the complementarity of the nucleotide sequences of KIAA0444 BINDING SITE, designated SEQ ID:31247, to the nucleotide sequence of VGAM594 RNA, herein designated VGAM RNA, also designated SEQ ID:3305.

Another function of VGAM594 is therefore inhibition of KIAA0444 (Accession XM_030999). Accordingly, utilities of VGAM594 include diagnosis, prevention and treatment of diseases and clinical conditions associated with KIAA0444. KIAA0563 (Accession NM_014834) is another VGAM594 host target gene. KIAA0563 BINDING SITE is HOST TARGET binding site found in the 5' untranslated region of mRNA encoded by KIAA0563, corresponding to a HOST TARGET binding site such as BINDING SITE I, BINDING SITE II or BINDING SITE III. Table 2 illustrates the complementarity of the nucleotide sequences of KIAA0563 BINDING SITE, designated SEQ ID:16845, to the nucleotide sequence of VGAM594 RNA, herein designated VGAM RNA, also designated SEQ ID:3305.

Another function of VGAM594 is therefore inhibition of KIAA0563 (Accession NM_014834). Accordingly, utilities of VGAM594 include diagnosis, prevention and treatment of diseases and clinical conditions associated with KIAA0563. Phytanoyl-CoA Hydroxylase Interacting Protein (PHYHIP, Accession NM_014759) is another VGAM594 host target gene. PHYHIP BINDING SITE is HOST TARGET binding site found in the 3' untranslated region of mRNA encoded by PHYHIP, corresponding to a HOST TARGET binding site such as BINDING SITE I, BINDING SITE II or BINDING SITE III. Table 2 illustrates the complementarity of the nucleotide sequences of PHYHIP BINDING SITE, designated SEQ ID:16512, to the nucleotide sequence of VGAM594 RNA, herein designated VGAM RNA, also designated SEQ ID:3305.

Another function of VGAM594 is therefore inhibition of Phytanoyl-CoA Hydroxylase Interacting Protein (PHYHIP, Accession NM_014759). Accordingly, utilities of VGAM594 include diagnosis, prevention and treatment of diseases and clinical conditions associated with PHYHIP. PRO1843 (Accession NM_018507) is another VGAM594 host target gene. PRO1843 BINDING SITE is HOST TARGET binding site found in the 5' untranslated region of mRNA encoded by PRO1843, corresponding to a HOST TARGET binding site such as BINDING SITE I, BINDING SITE II or BINDING SITE III. Table 2 illustrates the complementarity of the nucleotide sequences of PRO1843 BINDING SITE, designated SEQ ID:20574, to the nucleotide sequence of VGAM594 RNA, herein designated VGAM RNA, also designated SEQ ID:3305.

Another function of VGAM594 is therefore inhibition of PRO1843 (Accession NM_018507). Accordingly, utilities of VGAM594 include diagnosis, prevention and treatment of diseases and clinical conditions associated with PRO1843. RIL (Accession NM_003687) is another VGAM594 host target gene. RIL BINDING SITE is HOST TARGET binding site found in the 3' untranslated region of mRNA encoded by RIL, corresponding to a HOST TARGET binding site such as BINDING SITE I, BINDING SITE II or BINDING SITE III.

Table 2 illustrates the complementarity of the nucleotide sequences of RIL BINDING SITE, designated SEQ ID:9798, to the nucleotide sequence of VGAM594 RNA, herein designated VGAM RNA, also designated SEQ ID:3305.

Another function of VGAM594 is therefore inhibition of RIL (Accession NM_003687). Accordingly, utilities of VGAM594 include diagnosis, prevention and treatment of diseases and clinical conditions associated with RIL. TUSP (Accession NM_020245) is another VGAM594 host target gene. TUSP BINDING SITE is HOST TARGET binding site found in the 3' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21536, to the nucleotide sequence of VGAM594 RNA, herein designated VGAM RNA, also designated SEQ ID:3305.

Another function of VGAM594 is therefore inhibition of TUSP (Accession NM_020245). Accordingly, utilities of VGAM594 include diagnosis, prevention and treatment of diseases and clinical conditions associated with TUSP. LOC144845 (Accession NM_138474) is another VGAM594 host target gene. LOC144845 BINDING SITE is HOST TARGET binding site found in the 5' untranslated region of mRNA encoded by LOC144845, corresponding to a HOST TARGET binding site such as BINDING SITE I, BINDING SITE II or BINDING SITE III. Table 2 illustrates the complementarity of the nucleotide sequences of LOC144845 BINDING SITE, designated SEQ ID:28823, to the nucleotide sequence of VGAM594 RNA, herein designated VGAM RNA, also designated SEQ ID:3305.

Another function of VGAM594 is therefore inhibition of LOC144845 (Accession NM_138474). Accordingly, utilities of VGAM594 include diagnosis, prevention and treatment of diseases and clinical conditions associated with LOC144845. LOC150290 (Accession XM_086863) is another VGAM594 host target gene. LOC150290 BINDING SITE is HOST TARGET binding site found in the 3' untranslated region of mRNA encoded by LOC150290, corresponding to a HOST TARGET binding site such as BINDING SITE I, BINDING SITE II or BINDING SITE III. Table 2 illustrates the complementarity of the nucleotide sequences of LOC150290 BINDING SITE, designated SEQ ID:38934, to the nucleotide sequence of VGAM594 RNA, herein designated VGAM RNA, also designated SEQ ID:3305.

Another function of VGAM594 is therefore inhibition of LOC150290 (Accession XM_086863). Accordingly, utilities of VGAM594 include diagnosis, prevention and treatment of diseases and clinical conditions associated with LOC150290. LOC254423 (Accession XM_173286) is another VGAM594 host target gene. LOC254423 BINDING SITE is HOST TARGET binding site found in the 3' untranslated region of mRNA encoded by LOC254423, corresponding to a HOST TARGET binding site such as BINDING SITE I, BINDING SITE II or BINDING SITE III. Table 2 illustrates the complementarity of the nucleotide sequences of LOC254423 BINDING SITE, designated SEQ ID:46531, to the nucleotide sequence of VGAM594 RNA, herein designated VGAM RNA, also designated SEQ ID:3305.

Another function of VGAM594 is therefore inhibition of LOC254423 (Accession XM_173286). Accordingly, utilities of VGAM594 include diagnosis, prevention and treatment of diseases and clinical conditions associated with LOC254423. FIG. 1 further provides a conceptual description of a novel bioinformatically detected viral gene of the present invention, referred to here as Viral Genomic Address Messenger 595 (VGAM595) viral gene, which modulates expression of respective host target genes thereof, the function and utility of which host target genes is known in the art.

VGAM595 is a novel bioinformatically detected regulatory, non protein coding, viral micro RNA (miRNA) gene. The method by which VGAM595 was detected is described hereinabove with reference to FIGS. 1-8.

VGAM595 gene, herein designated VGAM GENE, is a viral gene contained in the genome of Northern Cereal Mosaic Virus. VGAM595 host target gene, herein designated VGAM HOST TARGET GENE, is a human gene contained in the human genome.

VGAM595 gene encodes a VGAM595 precursor RNA, herein designated VGAM PRECURSOR RNA. Similar to other miRNA genes, and unlike most ordinary genes, VGAM595 precursor RNA does not encode a protein. A nucleotide sequence identical or highly similar to the nucleotide sequence of VGAM595 precursor RNA is designated SEQ ID:581, and is provided hereinbelow with reference to the sequence listing part. Nucleotide sequence SEQ ID:581 is located at position 9694 relative to the genome of Northern Cereal Mosaic Virus.

VGAM595 precursor RNA folds onto itself, forming VGAM595 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM595 folded precursor RNA into VGAM595 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM595 RNA is designated SEQ ID:3306, and is provided hereinbelow with reference to the sequence listing part.

VGAM595 host target gene, herein designated VGAM HOST TARGET GENE, encodes a corresponding messenger RNA, VGAM595 host target RNA, herein designated VGAM HOST TARGET RNA. VGAM595 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM595 RNA, herein designated VGAM RNA, binds complementarily to one or more host target binding sites located in untranslated regions of VGAM595 host target RNA, herein designated VGAM HOST TARGET RNA. This complementary binding is due to the fact that the nucleotide sequence of VGAM595 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM595 RNA, herein designated VGAM RNA, may have a different number of host target binding sites in untranslated regions of a VGAM595 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM595 RNA, herein designated VGAM RNA, to host target binding sites on VGAM595 host target RNA, herein designated VGAM HOST TARGET RNA, such as BINDING SITE I, BINDING SITE II and BINDING SITE III, inhibits translation of VGAM595 host target RNA into VGAM595 host target protein, herein designated VGAM HOST TARGET PROTEIN. VGAM host target protein is therefore outlined by a broken line.

It is appreciated that VGAM595 host target gene, herein designated VGAM HOST TARGET GENE, in fact represents a plurality of VGAM595 host target genes. The mRNA of each one of this plurality of VGAM595 host target genes comprises one or more host target binding sites, each having a nucleotide sequence which is at least partly complementary to VGAM595 RNA, herein designated VGAM RNA, and which when bound by VGAM595 RNA causes inhibition of translation of respective one or more VGAM595 host target proteins.

It is further appreciated by one skilled in the art that the mode of translational inhibition illustrated by FIG. 1 with specific reference to translational inhibition exerted by VGAM595 gene, herein designated VGAM GENE, on one or more VGAM595 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM595 is inhibition of expression of host target genes, as part of a novel viral mechanism of attacking a host. Accordingly, utilities of VGAM595 include diagnosis, prevention and treatment of viral infection by Northern Cereal Mosaic Virus. Specific functions, and accordingly utilities, of VGAM595 correlate with, and may be deduced from, the identity of the host target genes which VGAM595 binds and inhibits, and the function of these host target genes, as elaborated hereinbelow.

Nucleotide sequences of the VGAM595 precursor RNA, herein designated VGAM PRECURSOR RNA, and of the 'diced' VGAM595 RNA, herein designated VGAM RNA, and a schematic representation of the secondary folding of VGAM595 folded precursor RNA, herein designated VGAM FOLDED PRECURSOR RNA, of VGAM595 are further described hereinbelow with reference to Table 1.

Nucleotide sequences of host target binding sites, such as BINDING SITE-I, BINDING SITE-II and BINDING SITE-III of FIG. 1, found on VGAM595 host target RNA, and schematic representation of the complementarity of each of these host target binding sites to VGAM595 RNA, herein designated VGAM RNA, are described hereinbelow with reference to Table 2.

As mentioned hereinabove with reference to FIG. 1, a function of VGAM595 gene, herein designated VGAM is inhibition of expression of VGAM595 target genes. It is appreciated that specific functions, and accordingly utilities, of VGAM595 correlate with, and may be deduced from, the identity of the target genes which VGAM595 binds and inhibits, and the function of these target genes, as elaborated hereinbelow.

ATP-binding Cassette, Sub-family G (WHITE), Member 1 (ABCG1, Accession NM_004915) is a VGAM595 host target gene. ABCG1 BINDING SITE is HOST TARGET binding site found in the 3' untranslated region of mRNA encoded by ABCG1, corresponding to a HOST TARGET binding site such as BINDING SITE I, BINDING SITE II or BINDING SITE III. Table 2 illustrates the complementarity of the nucleotide sequences of ABCG1 BINDING SITE, designated SEQ ID:11352, to the nucleotide sequence of VGAM595 RNA, herein designated VGAM RNA, also designated SEQ ID:3306.

A function of VGAM595 is therefore inhibition of ATP-binding Cassette, Sub-family G (WHITE), Member 1 (ABCG1, Accession NM_004915), a gene which transporter involved in macrophage lipid homeostasis. Accordingly, utilities of VGAM595 include diagnosis, prevention and treatment of diseases and clinical conditions associated with ABCG1. The function of ABCG1 has been established by previous studies. In Drosophila, the 'White' (W), 'Scarlet' (St), and 'Brown' (Bw) proteins are members of the ATP-binding cassette (ABC) transporter superfamily of transmembrane permeases and are involved in transporting precursors of eye pigments. See 601691. A functional ABC transporter unit contains 2 nucleotide-binding domains and 2 hydrophobic domains. The W, Bw, and St proteins contain only 1 of each domain, and so W is thought to form heterodimers with St or Bw to assemble functional transporters. Using RACE assays, Lorkowski et al. (2001) determined that the ABCG1 gene contains 5 exons more that what was previously reported, 4 upstream and 1 downstream of the previous exon 1, and spans 97 kb. The novel exons are predicted to encode at least 5 novel transcripts. Additional promoter regions were identified upstream of exons 1 and 5, respectively. The first promoter contains putative SP1 (OMIM Ref. No. 189906) and nuclear factor kappa-B (see OMIM Ref. No. 164011) binding sites, but no sterol response elements or retinoid X receptor (see OMIM Ref. No. 180245) binding sites. The second promoter contains all 4 of these binding-site types. Both promoters, however, were found to be responsive in macrophages to hydroxycholesterol and retinoic acid. Chen et al. (1996) reported a DNA polymorphism with 62% heterozygosity due to variation of a poly (T) region in the 3-prime untranslated region of hW. Croop et al. (1997) identified a polymorphic (CA) n repeat that is either intragenic or within 20 kb of the 3-prime end of hW. By analysis of somatic cell hybrids and by linkage analysis, Chen et al. (1996) mapped the hW gene to 21q22.3. This assignment was confirmed by Croop et al. (1997) using fluorescence in situ hybridization and by Savary et al. (1996) using in situ hybridization. By in situ hybridization, Savary et al. (1996) mapped the ABC8 gene to mouse chromosome 17, region A2-B, a region that shows homology of synteny with human chromosome 21q22.2-q22.3.

Full details of the abovementioned studies are described in the following publications, the disclosure of which are hereby incorporated by reference:

Chen, H.; Rossier, C.; Lalioti, M. D.; Lynn, A.; Chakravarti, A.; Perrin, G.; Antonarakis, S. E.: Cloning of the cDNA for a human homologue of the Drosophila white gene and mapping to chromosome 21q22.3. Am. J. Hum. Genet. 59:66-75, 1996; and Lorkowski, S.; Rust, S.; Engel, T.; Jung, E.; Tegelkamp, K.; Galinski, E. A.; Assmann, G.; Cullen, P.: Genomic sequence and structure of the human ABCG1 (ABC8) gene. Biochem. Biophys. R.

Further studies establishing the function and utilities of ABCG1 are found in John Hopkins OMIM database record ID 603076, and in sited publications numbered 1062-1067 listed in the bibliography section hereinbelow, which are also hereby incorporated by reference. Adenosine A1 Receptor (ADORA1, Accession NM_000674) is another VGAM595 host target gene. ADORA1 BINDING SITE is HOST TARGET binding site found in the 3' untranslated region of mRNA encoded by ADORA1, corresponding to a HOST TARGET binding site such as BINDING SITE I, BINDING SITE II or BINDING SITE III. Table 2 illustrates the complementarity of the nucleotide sequences of ADORA1 BINDING SITE, designated SEQ ID:6330, to the nucleotide sequence of VGAM595 RNA, herein designated VGAM RNA, also designated SEQ ID:3306.

Another function of VGAM595 is therefore inhibition of Adenosine A1 Receptor (ADORA1, Accession NM_000674), a gene which the activity of this receptor is mediated by g proteins which inhibit adenylyl cyclase. Accordingly, utilities of VGAM595 include diagnosis, prevention and treatment of diseases and clinical conditions associated with ADORA1. The function of ADORA1 and its association with various diseases and clinical conditions, has been established by previous studies, as described hereinabove with reference to VGAM234. CD28 Antigen (Tp44) (CD28, Accession NM_006139) is another VGAM595 host target gene. CD28 BINDING SITE is HOST TARGET binding site found in the 3' untranslated region of mRNA encoded by CD28, corresponding to a HOST TARGET binding site such as BINDING SITE I, BINDING SITE II or BINDING SITE III. Table 2 illustrates the complementarity of the nucleotide sequences of CD28 BINDING SITE, designated SEQ ID:12783, to the nucleotide sequence of VGAM595 RNA, herein designated VGAM RNA, also designated SEQ ID:3306.

Another function of VGAM595 is therefore inhibition of CD28 Antigen (Tp44) (CD28, Accession NM_006139), a gene which possibly involved in t-cell activation. Accordingly, utilities of VGAM595 include diagnosis, prevention and treatment of diseases and clinical conditions associated with CD28. The function of CD28 and its association with various diseases and clinical conditions, has been established by previous studies, as described hereinabove with reference to VGAM281. Citron (rho-interacting, serine/threonine kinase 21) (CIT, Accession XM_045786) is another VGAM595 host target gene. CIT BINDING SITE is HOST TARGET binding site found in the 5' untranslated region of mRNA encoded by CIT, corresponding to a HOST TARGET binding site such as BINDING SITE I, BINDING SITE II or BINDING SITE III. Table 2 illustrates the complementarity of the nucleotide sequences of CIT BINDING SITE, designated SEQ ID:34565, to the nucleotide sequence of VGAM595 RNA, herein designated VGAM RNA, also designated SEQ ID:3306.

Another function of VGAM595 is therefore inhibition of Citron (rho-interacting, serine/threonine kinase 21) (CIT, Accession XM_045786), a gene which is increased severalfold by coexpression of constitutively active Rho . Accordingly, utilities of VGAM595 include diagnosis, prevention and treatment of diseases and clinical conditions associated with CIT. The function of CIT and its association with various diseases and clinical conditions, has been established by previous studies, as described hereinabove with reference to VGAM393. Chloride Channel, Calcium Activated, Family Member 3 (CLCA3, Accession NM_004921) is another VGAM595 host target gene. CLCA3 BINDING SITE is HOST TARGET binding site found in the 3' untranslated region of mRNA encoded by CLCA3, corresponding to a HOST TARGET binding site such as BINDING SITE I, BINDING SITE II or BINDING SITE III. Table 2 illustrates the complementarity of the nucleotide sequences of CLCA3 BINDING SITE, designated SEQ ID:11356, to the nucleotide sequence of VGAM595 RNA, herein designated VGAM RNA, also designated SEQ ID:3306.

Another function of VGAM595 is therefore inhibition of Chloride Channel, Calcium Activated, Family Member 3 (CLCA3, Accession NM_004921), a gene which is similar to calcium-activated chloride channel family. Accordingly, utilities of VGAM595 include diagnosis, prevention and treatment of diseases and clinical conditions associated with CLCA3. The function of CLCA3 has been established by previous studies. Members of the CLCA family of calcium-activated chloride channels, such as human CLCA1 (OMIM Ref. No. 603906) and bovine lung-endothelial cell adhesion molecule-1 (Lu-ECAM-1), are translated as approximately 125-kD proteins that are cleaved to form transmembrane heterodimers consisting of approximately 90- and 35-kD polypeptides. See CLCA1 for additional information on the CLCA family. By screening a human spleen cDNA library with a Lu-ECAM-1 cDNA and by RACE, Gruber and Pauli (1999) isolated a 3.6-kb cDNA encoding CLCA3. The CLCA3 cDNA is similar in length and sequence to the cDNAs of previously cloned family members. However, unlike all previously known CLCA cDNAs, the CLCA3 cDNA does not have a long open reading frame (ORF), but instead contains 2 smaller ORFs. The authors demonstrated that only 1 of these ORFs is of biologic significance and that it is expressed in mammalian cells as a secreted 37-kD glycoprotein. The deduced 262-amino acid CLCA3 protein corresponds to the N-terminal extracellular domain of other family members. RT-PCR detected CLCA3 expression in all human tissues examined. Gruber and Pauli (1999) verified the sequence of the spleen CLCA3 cDNA by isolating and sequencing a CLCA3 cDNA from human trachea. They concluded that CLCA3 is a structurally divergent member of the CLCA family and that it does not function as a channel protein.

Full details of the abovementioned studies are described in the following publications, the disclosure of which are hereby incorporated by reference:

Gruber, A. D.; Pauli, B. U.: Clustering of the human CLCA gene family on the short arm of chromosome 1 (1p22-31). Genome 42:1030-1032, 1999; and Gruber, A. D.; Pauli, B. U.: Molecular cloning and biochemical characterization of a truncated, secreted member of the human family of Ca (2+)-activated Cl- channels. Biochim. Biophys.

Further studies establishing the function and utilities of CLCA3 are found in John Hopkins OMIM database record ID 604337, and in sited publications numbered 7393 listed in the bibliography section hereinbelow, which are also hereby incorporated by reference. Cytochrome P450, Subfamily XIX (aromatization of androgens) (CYP19, Accession NM_031226) is another VGAM595 host target gene. CYP19 BINDING SITE1 and CYP19 BINDING SITE2 are HOST TARGET binding sites found in untranslated regions of mRNA encoded by CYP19, corresponding to HOST TARGET binding sites such as BINDING SITE I, BINDING SITE II or BINDING SITE III. Table 2 illustrates the complementarity of the nucleotide sequences of CYP19 BINDING SITE1 and CYP19 BINDING SITE2, designated SEQ ID:25268 and SEQ ID:5558 respectively, to the nucleotide sequence of VGAM595 RNA, herein designated VGAM RNA, also designated SEQ ID:3306.

Another function of VGAM595 is therefore inhibition of Cytochrome P450, Subfamily XIX (aromatization of androgens) (CYP19, Accession NM_031226), a gene which catalyzes the last steps of estrogen biosynthesis. Accordingly, utilities of VGAM595 include diagnosis, prevention and treatment of diseases and clinical conditions associated with CYP19. The function of CYP19 and its association with various diseases and clinical conditions, has been established by previous studies, as described hereinabove with reference to VGAM508. MDM1 (Accession NM_020128) is another VGAM595 host target gene. MDM1 BINDING SITE is HOST TARGET binding site found in the 3' untranslated region of mRNA encoded by MDM1, corresponding to a HOST TARGET binding site such as BINDING SITE I, BINDING SITE II or BINDING SITE III. Table 2 illustrates the complementarity of the nucleotide sequences of MDM1 BINDING SITE, designated SEQ ID:21321, to the nucleotide sequence of VGAM595 RNA, herein designated VGAM RNA, also designated SEQ ID:3306.

Another function of VGAM595 is therefore inhibition of MDM1 (Accession NM_020128). Accordingly, utilities of VGAM595 include diagnosis, prevention and treatment of diseases and clinical conditions associated with MDM1. Nuclear RNA Export Factor 2 (NXF2, Accession NM_017809) is another VGAM595 host target gene. NXF2 BINDING SITE is HOST TARGET binding site found in the 5' untranslated region of mRNA encoded by NXF2, corresponding to a HOST TARGET binding site such as BINDING SITE I, BINDING SITE II or BINDING SITE III. Table 2 illustrates the complementarity of the nucleotide sequences of NXF2 BINDING SITE, designated SEQ ID:19459, to the nucleotide sequence of VGAM595 RNA, herein designated VGAM RNA, also designated SEQ ID:3306.

Another function of VGAM595 is therefore inhibition of Nuclear RNA Export Factor 2 (NXF2, Accession NM_017809), a gene which is involved in the export of mrna from the nucleus to the cytoplasm. Accordingly, utilities of VGAM595 include diagnosis, prevention and treatment of diseases and clinical conditions associated with NXF2. The function of NXF2 has been established by previous studies. By searching EST databases for homologs of NXF1 and by RT-PCR analysis, Herold et al. (2000) obtained cDNAs encoding NXF2, NXF3 (OMIM Ref. No. 300316), NXF4 (OMIM Ref. No. 300318), and NXF5 (OMIM Ref. No. 300319). The deduced 626-amino acid NXF2 protein has the conserved domain structure of NXF1, including a noncanonical RNP-type RNA-binding domain (RBD), 4 leucine-rich repeats (LRRs), a nuclear transport factor-2 (NTF2; 605813)-like domain that allows heterodimerization with NTF2-related export protein-1 (NXT1; 605811), and a ubiquitin-associated domain that mediates interactions with nucleoporins. Binding analysis showed that NXF1, NXF2, and NXF3 interact with E1BAP5 (OMIM Ref. No. 605800), as well as with NXT1 and NXT2 (OMIM Ref. No. 300320). The RBDs of NXF1 and NXF2, but not that of NXF3, were found to bind RNA. Only NXF1, however, could promote RNA export mediated by the constitutive transport element of simian type D retrovirus. Both NXF1 and NXF2, but not NXF3, through their C-terminal NWD loop, could bind to the nucleoporins CAN (NUP214; 114350), NUP153 (OMIM Ref. No. 603948), and NUP62 (OMIM Ref. No. 605815). Only NXF1 could bind to NUP98 (OMIM Ref. No. 601021). Fluorescence microscopy demonstrated expression of NXF2 in the nucleoplasm and the nuclear envelope, but it was excluded from the nucleolus. CAT reporter and Western blot assays showed that coexpression of NXF1 or NXF2, but not NXF3, with NXT1 or NXT2 activated CAT expression, suggesting that under these conditions NXF2 can stimulate RNA export. The LRRs and NTF2-like domains are required for export activity. By cDNA subtraction of mouse somatic tissue cDNA from spermatogonia cDNA, database searching, and screening a testis cDNA library, Wang et al. (2001) also identified NXF2.

Full details of the abovementioned studies are described in the following publications, the disclosure of which are hereby incorporated by reference:

Herold, A.; Suyama, M.; Rodrigues, J. P.; Braun, I. C.; Kutay, U.; Carmo-Fonseca, M.; Bork, P.; Izaurralde, E.: TAP (NXF1) belongs to a multigene family of putative RNA export factors with a conserved modular architecture. Molec. Cell. Biol. 20:8996-9008, 2000; and Wang, P. J.; McCarrey, J. R.; Yang, F.; Page, D. C.: An abundance of X-linked genes expressed in spermatogonia. Nature Genet. 27:422-426, 2001.

Further studies establishing the function and utilities of NXF2 are found in John Hopkins OMIM database record ID 300315, and in sited publications numbered 9444 listed in the bibliography section hereinbelow, which are also hereby incorporated by reference. BH-protocadherin (brain-heart) (PCDH7, Accession NM_032456) is another VGAM595 host target gene. PCDH7 BINDING SITE is HOST TARGET binding site found in the 3' untranslated region of mRNA encoded by PCDH7, corresponding to a HOST TARGET binding site such as BINDING SITE I, BINDING SITE II or BINDING SITE III. Table 2 illustrates the complementarity of the nucleotide sequences of PCDH7 BINDING SITE, designated SEQ ID:26218, to the nucleotide sequence of VGAM595 RNA, herein designated VGAM RNA, also designated SEQ ID:3306.

Another function of VGAM595 is therefore inhibition of BH-protocadherin (brain-heart) (PCDH7, Accession NM_032456). Accordingly, utilities of VGAM595 include diagnosis, prevention and treatment of diseases and clinical conditions associated with PCDH7. RAD54B (Accession NM_134434) is another VGAM595 host target gene. RAD54B BINDING SITE is HOST TARGET binding site found in the 3' untranslated region of mRNA encoded by RAD54B, corresponding to a HOST TARGET binding site such as BINDING SITE I, BINDING SITE II or BINDING SITE III. Table 2 illustrates the complementarity of the nucleotide sequences of RAD54B BINDING SITE, designated SEQ ID:28678, to the nucleotide sequence of VGAM595 RNA, herein designated VGAM RNA, also designated SEQ ID:3306.

Another function of VGAM595 is therefore inhibition of RAD54B (Accession NM_134434), a gene which is involved in dna repair and mitotic recombination. Accordingly, utilities of VGAM595 include diagnosis, prevention and treatment of diseases and clinical conditions associated with RAD54B. The function of RAD54B has been established by previous studies. RAD54B, a member of the SNF2/SWI2 superfamily (see OMIM Ref. No. 600014), is part of a complex involved in the recombinational repair of DNA damage. Hiramoto et al. (1999) described the isolation of a member of the SNF2 superfamily characterized by sequence motifs similar to those in DNA and RNA helicases. The gene, designated RAD54B, shows significant homology to the RAD54 gene (OMIM Ref. No. 603615). The RAD54B cDNA was predicted to encode a protein of 910 amino acids. Northern blot analysis detected a 3.2-kb transcript highly expressed in testis and spleen, which are active in meiotic and mitotic recombination.

Full details of the abovementioned studies are described in the following publications, the disclosure of which are hereby incorporated by reference:

Hiramoto, T.; Nakanishi, T.; Sumiyoshi, T.; Fukuda, T.; Matsuura, S.; Tauchi, H.; Komatsu, K.; Shibasaki, Y.; Inui, H.; Watatani, M.; Yasutomi, M.; Sumii, K.; Kajiyama, G.; Kamada, N.; Miyagawa, K.; Kamiya, K.: Mutations of a novel human RAD54 homologue, RAD54B, in primary cancer. Oncogene 18:3422-3426, 1999; and Miyagawa, K.; Tsuruga, T.; Kinomura, A.; Usui, K.; Katsura, M.; Tashiro, S.; Mishima, H.; Tanaka, K.: A role for RAD54B in homologous recombination in human cells. EMBO J. 21:175-180.

Further studies establishing the function and utilities of RAD54B are found in John Hopkins OMIM database record ID 604289, and in sited publications numbered 1102-1104 listed in the bibliography section hereinbelow, which are also hereby incorporated by reference. Solute Carrier Family 2 (facilitated glucose transporter), Member 3 (SLC2A3, Accession NM_006931) is another VGAM595 host target gene. SLC2A3 BINDING SITE is HOST TARGET binding site found in the 3' untranslated region of mRNA encoded by SLC2A3, corresponding to a HOST TARGET binding site such as BINDING SITE I, BINDING SITE II or BINDING SITE III. Table 2 illustrates the complementarity of the nucleotide sequences of SLC2A3 BINDING SITE, designated SEQ ID:13814, to the nucleotide sequence of VGAM595 RNA, herein designated VGAM RNA, also designated SEQ ID:3306.

Another function of VGAM595 is therefore inhibition of Solute Carrier Family 2 (facilitated glucose transporter), Member 3 (SLC2A3, Accession NM_006931), a gene which probably is a neuronal glucose transporter. Accordingly, utilities of VGAM595 include diagnosis, prevention and treatment of diseases and clinical conditions associated with SLC2A3. The function of SLC2A3 and its association with various diseases and clinical conditions, has been established by previous studies, as described hereinabove with reference to VGAM247. Transient Receptor Potential Cation Channel, Subfamily C, Member 5 (TRPC5, Accession NM_012471) is another VGAM595 host target gene. TRPC5 BINDING SITE is HOST TARGET binding site found in the 3' untranslated region of mRNA encoded by TRPC5, corresponding to a HOST TARGET binding site such as BINDING SITE I, BINDING SITE II or BINDING SITE III. Table 2 illustrates the complementarity of the nucleotide sequences of TRPC5 BINDING SITE, designated SEQ ID:14850, to the nucleotide sequence of VGAM595 RNA, herein designated VGAM RNA, also designated SEQ ID:3306.

Another function of VGAM595 is therefore inhibition of Transient Receptor Potential Cation Channel, Subfamily C, Member 5 (TRPC5, Accession NM_012471). Accordingly, utilities of VGAM595 include diagnosis, prevention and treatment of diseases and clinical conditions associated with TRPC5. Wolf-Hirschhorn Syndrome Candidate 1 (WHSC1, Accession NM_007331) is another VGAM595 host target gene. WHSC1 BINDING SITE is HOST TARGET binding site found in the 3' untranslated region of mRNA encoded by WHSC1, corresponding to a HOST TARGET binding site such as BINDING SITE I, BINDING SITE II or BINDING SITE III. Table 2 illustrates the complementarity of the nucleotide sequences of WHSC1 BINDING SITE, designated SEQ ID:14250, to the nucleotide sequence of VGAM595 RNA, herein designated VGAM RNA, also designated SEQ ID:3306.

Another function of VGAM595 is therefore inhibition of Wolf-Hirschhorn Syndrome Candidate 1 (WHSC1, Accession NM_007331), a gene which binds covalently to and repairs g/t mismatches. Accordingly, utilities of VGAM595 include diagnosis, prevention and treatment of diseases and clinical conditions associated with WHSC1. The function of WHSC1 and its association with various diseases and clinical conditions, has been established by previous studies, as described hereinabove with reference to VGAM200. AAK1 (Accession NM_014911) is another VGAM595 host target gene. AAK1 BINDING SITE is HOST TARGET binding site found in the 3' untranslated region of mRNA encoded by AAK1, corresponding to a HOST TARGET binding site such as BINDING SITE I, BINDING SITE II or BINDING SITE III. Table 2 illustrates the complementarity of the nucleotide sequences of AAK1 BINDING SITE, designated SEQ ID:17145, to the nucleotide sequence of VGAM595 RNA, herein designated VGAM RNA, also designated SEQ ID:3306.

Another function of VGAM595 is therefore inhibition of AAK1 (Accession NM_014911). Accordingly, utilities of VGAM595 include diagnosis, prevention and treatment of diseases and clinical conditions associated with AAK1. AF020591 (Accession NM_014480) is another VGAM595 host target gene. AF020591 BINDING SITE is HOST TARGET binding site found in the 5' untranslated region of mRNA encoded by AF020591, corresponding to a HOST TARGET binding site such as BINDING SITE I, BINDING SITE II or BINDING SITE III. Table 2 illustrates the complementarity of the nucleotide sequences of AF020591 BINDING SITE, designated SEQ ID:15825, to the nucleotide sequence of VGAM595 RNA, herein designated VGAM RNA, also designated SEQ ID:3306.

Another function of VGAM595 is therefore inhibition of AF020591 (Accession NM_014480). Accordingly, utilities of VGAM595 include diagnosis, prevention and treatment of diseases and clinical conditions associated with AF020591. Bifunctional Apoptosis Regulator (BFAR, Accession XM_027311) is another VGAM595 host target gene. BFAR BINDING SITE is HOST TARGET binding site found in the 3' untranslated region of mRNA encoded by BFAR, corresponding to a HOST TARGET binding site such as BINDING SITE I, BINDING SITE II or BINDING SITE III. Table 2 illustrates the complementarity of the nucleotide sequences of BFAR BINDING SITE, designated SEQ ID:30480, to the nucleotide sequence of VGAM595 RNA, herein designated VGAM RNA, also designated SEQ ID:3306.

Another function of VGAM595 is therefore inhibition of Bifunctional Apoptosis Regulator (BFAR, Accession XM_027311). Accordingly, utilities of VGAM595 include diagnosis, prevention and treatment of diseases and clinical conditions associated with BFAR. Chromosome 15 Open Reading Frame 5 (C15orf5, Accession NM_030944) is another VGAM595 host target gene. C15orf5 BINDING SITE is HOST TARGET binding site found in the 3' untranslated region of mRNA encoded by C15orf5, corresponding to a HOST TARGET binding site such as BINDING SITE I, BINDING SITE II or BINDING SITE III. Table 2 illustrates the complementarity of the nucleotide sequences of C15orf5 BINDING SITE, designated SEQ ID:25215, to the nucleotide sequence of VGAM595 RNA, herein designated VGAM RNA, also designated SEQ ID:3306.

Another function of VGAM595 is therefore inhibition of Chromosome 15 Open Reading Frame 5 (C15orf5, Accession NM_030944). Accordingly, utilities of VGAM595 include diagnosis, prevention and treatment of diseases and clinical conditions associated with C15orf5. CED-6 (Accession NM_016315) is another VGAM595 host target gene. CED-6 BINDING SITE is HOST TARGET binding site found in the 3' untranslated region of mRNA encoded by CED-6, corresponding to a HOST TARGET binding site such as BINDING SITE I, BINDING SITE II or BINDING SITE III. Table 2 illustrates the complementarity of the nucleotide sequences of CED-6 BINDING SITE, designated SEQ ID:18434, to the nucleotide sequence of VGAM595 RNA, herein designated VGAM RNA, also designated SEQ ID:3306.

Another function of VGAM595 is therefore inhibition of CED-6 (Accession NM_016315). Accordingly, utilities of VGAM595 include diagnosis, prevention and treatment of diseases and clinical conditions associated with CED-6. DKFZP761C169 (Accession XM_042059) is another VGAM595 host target gene. DKFZP761C169 BINDING SITE1 and DKFZP761C169 BINDING SITE2 are HOST TARGET binding sites found in untranslated regions of mRNA encoded by DKFZP761C169, corresponding to HOST TARGET binding sites such as BINDING SITE I, BINDING SITE II or BINDING SITE III. Table 2 illustrates the complementarity of the nucleotide sequences of DKFZP761C169 BINDING SITE1 and DKFZP761C169 BINDING SITE2, designated SEQ ID:33677 and SEQ ID:33678 respectively, to the nucleotide sequence of VGAM595 RNA, herein designated VGAM RNA, also designated SEQ ID:3306.

Another function of VGAM595 is therefore inhibition of DKFZP761C169 (Accession XM_042059). Accordingly, utilities of VGAM595 include diagnosis, prevention and treatment of diseases and clinical conditions associated with DKFZP761C169. FLJ10956 (Accession NM_018283) is another VGAM595 host target gene. FLJ10956 BINDING SITE is HOST TARGET binding site found in the 3' untranslated region of mRNA encoded by FLJ10956, corresponding to a HOST TARGET binding site such as BINDING SITE I, BINDING SITE II or BINDING SITE III. Table 2 illustrates the complementarity of the nucleotide sequences of FLJ10956 BINDING SITE, designated SEQ ID:20278, to the nucleotide sequence of VGAM595 RNA, herein designated VGAM RNA, also designated SEQ ID:3306.

Another function of VGAM595 is therefore inhibition of FLJ10956 (Accession NM_018283). Accordingly, utilities of VGAM595 include diagnosis, prevention and treatment of diseases and clinical conditions associated with FLJ10956. FLJ11125 (Accession XM_005318) is another VGAM595 host target gene. FLJ11125 BINDING SITE is HOST TARGET binding site found in the 3' untranslated region of mRNA encoded by FLJ11125, corresponding to a HOST TARGET binding site such as BINDING SITE I, BINDING SITE II or BINDING SITE III. Table 2 illustrates the complementarity of the nucleotide sequences of FLJ11125 BINDING SITE, designated SEQ ID:29978, to the nucleotide sequence of VGAM595 RNA, herein designated VGAM RNA, also designated SEQ ID:3306.

Another function of VGAM595 is therefore inhibition of FLJ11125 (Accession XM_005318). Accordingly, utilities of VGAM595 include diagnosis, prevention and treatment of diseases and clinical conditions associated with FLJ11125. FLJ20294 (Accession NM_017749) is another VGAM595 host target gene. FLJ20294 BINDING SITE is HOST TARGET binding site found in the 3' untranslated region of mRNA encoded by FLJ20294, corresponding to a HOST TARGET binding site such as BINDING SITE I, BINDING SITE II or BINDING SITE III. Table 2 illustrates the complementarity of the nucleotide sequences of FLJ20294 BINDING SITE, designated SEQ ID:19352, to the nucleotide sequence of VGAM595 RNA, herein designated VGAM RNA, also designated SEQ ID:3306.

Another function of VGAM595 is therefore inhibition of FLJ20294 (Accession NM_017749). Accordingly, utilities of VGAM595 include diagnosis, prevention and treatment of diseases and clinical conditions associated with FLJ20294. FLJ21034 (Accession NM_024940) is another VGAM595 host target gene. FLJ21034 BINDING SITE is HOST TARGET binding site found in the 3' untranslated region of mRNA encoded by FLJ21034, corresponding to a HOST TARGET binding site such as BINDING SITE I, BINDING SITE II or BINDING SITE III. Table 2 illustrates the complementarity of the nucleotide sequences of FLJ21034 BINDING SITE, designated SEQ ID:24484, to the nucleotide sequence of VGAM595 RNA, herein designated VGAM RNA, also designated SEQ ID:3306.

Another function of VGAM595 is therefore inhibition of FLJ21034 (Accession NM_024940). Accordingly, utilities of VGAM595 include diagnosis, prevention and treatment of diseases and clinical conditions associated with FLJ21034. FLJ23584 (Accession NM_024588) is another VGAM595 host target gene. FLJ23584 BINDING SITE is HOST TARGET binding site found in the 5' untranslated region of mRNA encoded by FLJ23584, corresponding to a HOST TARGET binding site such as BINDING SITE I, BINDING SITE II or BINDING SITE III. Table 2 illustrates the complementarity of the nucleotide sequences of FLJ23584 BINDING SITE, designated SEQ ID:23823, to the nucleotide sequence of VGAM595 RNA, herein designated VGAM RNA, also designated SEQ ID:3306.

Another function of VGAM595 is therefore inhibition of FLJ23584 (Accession NM_024588). Accordingly, utilities of VGAM595 include diagnosis, prevention and treatment of diseases and clinical conditions associated with FLJ23584. FLJ30213 (Accession NM_145008) is another VGAM595 host target gene. FLJ30213 BINDING SITE is HOST TARGET binding site found in the 3' untranslated region of mRNA encoded by FLJ30213, corresponding to a HOST TARGET binding site such as BINDING SITE I, BINDING SITE II or BINDING SITE III. Table 2 illustrates the complementarity of the nucleotide sequences of FLJ30213 BINDING SITE, designated SEQ ID:29609, to the nucleotide sequence of VGAM595 RNA, herein designated VGAM RNA, also designated SEQ ID:3306.

Another function of VGAM595 is therefore inhibition of FLJ30213 (Accession NM_145008). Accordingly, utilities of VGAM595 include diagnosis, prevention and treatment of diseases and clinical conditions associated with FLJ30213. KIAA0089 (Accession XM_046056) is another VGAM595 host target gene. KIAA0089 BINDING SITE is HOST TARGET binding site found in the 3' untranslated region of mRNA encoded by KIAA0089, corresponding to a HOST TARGET binding site such as BINDING SITE I, BINDING SITE II or BINDING SITE III. Table 2 illustrates the complementarity of the nucleotide sequences of KIAA0089 BINDING SITE, designated SEQ ID:34670, to the nucleotide sequence of VGAM595 RNA, herein designated VGAM RNA, also designated SEQ ID:3306.

Another function of VGAM595 is therefore inhibition of KIAA0089 (Accession XM_046056). Accordingly, utilities of VGAM595 include diagnosis, prevention and treatment of diseases and clinical conditions associated with KIAA0089. KIAA1155 (Accession XM_030864) is another VGAM595 host target gene. KIAA1155 BINDING SITE is HOST TARGET binding site found in the 3' untranslated region of mRNA encoded by KIAA1155, corresponding to a HOST TARGET binding site such as BINDING SITE I, BINDING SITE II or BINDING SITE III. Table 2 illustrates the complementarity of the nucleotide sequences of KIAA1155 BIND- ING SITE, designated SEQ ID:31201, to the nucleotide sequence of VGAM595 RNA, herein designated VGAM RNA, also designated SEQ ID:3306.

Another function of VGAM595 is therefore inhibition of KIAA1155 (Accession XM_030864). Accordingly, utilities of VGAM595 include diagnosis, prevention and treatment of diseases and clinical conditions associated with KIAA1155. KIAA1276 (Accession XM_039169) is another VGAM595 host target gene. KIAA1276 BINDING SITE is HOST TARGET binding site found in the 5' untranslated region of mRNA encoded by KIAA1276, corresponding to a HOST TARGET binding site such as BINDING SITE I, BINDING SITE II or BINDING SITE III. Table 2 illustrates the complementarity of the nucleotide sequences of KIAA1276 BINDING SITE, designated SEQ ID:33020, to the nucleotide sequence of VGAM595 RNA, herein designated VGAM RNA, also designated SEQ ID:3306.

Another function of VGAM595 is therefore inhibition of KIAA1276 (Accession XM_039169). Accordingly, utilities of VGAM595 include diagnosis, prevention and treatment of diseases and clinical conditions associated with KIAA1276. KIAA1712 (Accession XM_041497) is another VGAM595 host target gene. KIAA1712 BINDING SITE is HOST TARGET binding site found in the 3' untranslated region of mRNA encoded by KIAA1712, corresponding to a HOST TARGET binding site such as BINDING SITE I, BINDING SITE II or BINDING SITE III. Table 2 illustrates the complementarity of the nucleotide sequences of KIAA1712 BINDING SITE, designated SEQ ID:33540, to the nucleotide sequence of VGAM595 RNA, herein designated VGAM RNA, also designated SEQ ID:3306.

Another function of VGAM595 is therefore inhibition of KIAA1712 (Accession XM_041497). Accordingly, utilities of VGAM595 include diagnosis, prevention and treatment of diseases and clinical conditions associated with KIAA1712. KIAA1775 (Accession NM_033100) is another VGAM595 host target gene. KIAA1775 BINDING SITE is HOST TARGET binding site found in the 3' untranslated region of mRNA encoded by KIAA1775, corresponding to a HOST TARGET binding site such as BINDING SITE I, BINDING SITE II or BINDING SITE III. Table 2 illustrates the complementarity of the nucleotide sequences of KIAA1775 BINDING SITE, designated SEQ ID:26945, to the nucleotide sequence of VGAM595 RNA, herein designated VGAM RNA, also designated SEQ ID:3306.

Another function of VGAM595 is therefore inhibition of KIAA1775 (Accession NM_033100). Accordingly, utilities of VGAM595 include diagnosis, prevention and treatment of diseases and clinical conditions associated with KIAA1775. MSP (Accession NM_032046) is another VGAM595 host target gene. MSP BINDING SITE is HOST TARGET binding site found in the 3" untranslated region of mRNA encoded by MSP, corresponding to a HOST TARGET binding site such as BINDING SITE I, BINDING SITE II or BINDING SITE III. Table 2 illustrates the complementarity of the nucleotide sequences of MSP BINDING SITE, designated SEQ ID:25762, to the nucleotide sequence of VGAM595 RNA, herein designated VGAM RNA, also designated SEQ ID:3306.

Another function of VGAM595 is therefore inhibition of MSP (Accession NM_032046). Accordingly, utilities of VGAM595 include diagnosis, prevention and treatment of diseases and clinical conditions associated with MSP. Myozenin 2 (MYOZ2, Accession NM_016599) is another VGAM595 host target gene. MYOZ2 BINDING SITE is HOST TARGET binding site found in the 3' untranslated region of mRNA encoded by MYOZ2, corresponding to a HOST TARGET binding site such as BINDING SITE I, BINDING SITE II or BINDING SITE III. Table 2 illustrates the complementarity of the nucleotide sequences of MYOZ2 BINDING SITE, designated SEQ ID:18694, to the nucleotide sequence of VGAM595 RNA, herein designated VGAM RNA, also designated SEQ ID:3306.

Another function of VGAM595 is therefore inhibition of Myozenin 2 (MYOZ2, Accession NM_016599). Accordingly, utilities of VGAM595 include diagnosis, prevention and treatment of diseases and clinical conditions associated with MYOZ2. P21 (CDKN1A)-activated Kinase 2 (PAK2, Accession XM_039354) is another VGAM595 host target gene. PAK2 BINDING SITE is HOST TARGET binding site found in the 5' untranslated region of mRNA encoded by PAK2, corresponding to a HOST TARGET binding site such as BINDING SITE I, BINDING SITE II or BINDING SITE III. Table 2 illustrates the complementarity of the nucleotide sequences of PAK2 BINDING SITE, designated SEQ ID:33063, to the nucleotide sequence of VGAM595 RNA, herein designated VGAM RNA, also designated SEQ ID:3306.

Another function of VGAM595 is therefore inhibition of P21 (CDKN1A)-activated Kinase 2 (PAK2, Accession XM_039354). Accordingly, utilities of VGAM595 include diagnosis, prevention and treatment of diseases and clinical conditions associated with PAK2. PRO1430 (Accession NM_018599) is another VGAM595 host target gene. PRO1430 BINDING SITE is HOST TARGET binding site found in the 5' untranslated region of mRNA encoded by PRO1430, corresponding to a HOST TARGET binding site such as BINDING SITE I, BINDING SITE II or BINDING SITE III. Table 2 illustrates the complementarity of the nucleotide sequences of PRO1430 BINDING SITE, designated SEQ ID:20678, to the nucleotide sequence of VGAM595 RNA, herein designated VGAM RNA, also designated SEQ ID:3306.

Another function of VGAM595 is therefore inhibition of PRO1430 (Accession NM_018599). Accordingly, utilities of VGAM595 include diagnosis, prevention and treatment of diseases and clinical conditions associated with PRO1430. Sialyltransferase 4A (beta-galactoside alpha-2,3-sialytransferase) (SIAT4A, Accession NM_003033) is another VGAM595 host target gene. SIAT4A BINDING SITE is HOST TARGET binding site found in the 5' untranslated region of mRNA encoded by SIAT4A, corresponding to a HOST TARGET binding site such as BINDING SITE I, BINDING SITE II or BINDING SITE III. Table 2 illustrates the complementarity of the nucleotide sequences of SIAT4A BINDING SITE, designated SEQ ID:8982, to the nucleotide sequence of VGAM595 RNA, herein designated VGAM RNA, also designated SEQ ID:3306.

Another function of VGAM595 is therefore inhibition of Sialyltransferase 4A (beta-galactoside alpha-2,3-sialytransferase) (SIAT4A, Accession NM_003033). Accordingly, utilities of VGAM595 include diagnosis, prevention and treatment of diseases and clinical conditions associated with SIAT4A. TOPBP1 (Accession NM_007027) is another VGAM595 host target gene. TOPBP1 BINDING SITE is HOST TARGET binding site found in the 3' untranslated region of mRNA encoded by TOPBP1, corresponding to a HOST TARGET binding site such as BINDING SITE I, BINDING SITE II or BINDING SITE III. Table 2 illustrates the complementarity of the nucleotide sequences of TOPBP1 BINDING SITE, designated SEQ ID:13888, to the nucleotide sequence of VGAM595 RNA, herein designated VGAM RNA, also designated SEQ ID:3306.

Another function of VGAM595 is therefore inhibition of TOPBP1 (Accession NM_007027). Accordingly, utilities of VGAM595 include diagnosis, prevention and treatment of diseases and clinical conditions associated with TOPBP1. LOC126603 (Accession XM_060090) is another VGAM595 host target gene. LOC126603 BINDING SITE is HOST TARGET binding site found in the 5' untranslated region of mRNA encoded by LOC126603, corresponding to a HOST TARGET binding site such as BINDING SITE I, BINDING SITE II or BINDING SITE III. Table 2 illustrates the complementarity of the nucleotide sequences of LOC126603 BINDING SITE, designated SEQ ID:37152, to the nucleotide sequence of VGAM595 RNA, herein designated VGAM RNA, also designated SEQ ID:3306.

Another function of VGAM595 is therefore inhibition of LOC126603 (Accession XM_060090). Accordingly, utilities of VGAM595 include diagnosis, prevention and treatment of diseases and clinical conditions associated with LOC126603. LOC129676 (Accession XM_065341) is another VGAM595 host target gene. LOC129676 BINDING SITE is HOST TARGET binding site found in the 5' untranslated region of mRNA encoded by LOC129676, corresponding to a HOST TARGET binding site such as BINDING SITE I, BINDING SITE II or BINDING SITE III. Table 2 illustrates the complementarity of the nucleotide sequences of LOC129676 BINDING SITE, designated SEQ ID:37289, to the nucleotide sequence of VGAM595 RNA, herein designated VGAM RNA, also designated SEQ ID:3306.

Another function of VGAM595 is therefore inhibition of LOC129676 (Accession XM_065341). Accordingly, utilities of VGAM595 include diagnosis, prevention and treatment of diseases and clinical conditions associated with LOC129676. LOC143914 (Accession XM_084654) is another VGAM595 host target gene. LOC143914 BINDING SITE is HOST TARGET binding site found in the 5' untranslated region of mRNA encoded by LOC143914, corresponding to a HOST TARGET binding site such as BINDING SITE I, BINDING SITE II or BINDING SITE III. Table 2 illustrates the complementarity of the nucleotide sequences of LOC143914 BINDING SITE, designated SEQ ID:37637, to the nucleotide sequence of VGAM595 RNA, herein designated VGAM RNA, also designated SEQ ID:3306.

Another function of VGAM595 is therefore inhibition of LOC143914 (Accession XM_084654). Accordingly, utilities of VGAM595 include diagnosis, prevention and treatment of diseases and clinical conditions associated with LOC143914. LOC144195 (Accession XM_016498) is another VGAM595 host target gene. LOC144195 BINDING SITE is HOST TARGET binding site found in the 3' untranslated region of mRNA encoded by LOC144195, corresponding to a HOST TARGET binding site such as BINDING SITE I, BINDING SITE II or BINDING SITE III. Table 2 illustrates the complementarity of the nucleotide sequences of LOC144195 BINDING SITE, designated SEQ ID:30264, to the nucleotide sequence of VGAM595 RNA, herein designated VGAM RNA, also designated SEQ ID:3306.

Another function of VGAM595 is therefore inhibition of LOC144195 (Accession XM_016498). Accordingly, utilities of VGAM595 include diagnosis, prevention and treatment of diseases and clinical conditions associated with LOC144195. LOC149707 (Accession XM_086641) is another VGAM595 host target gene. LOC149707 BINDING SITE is HOST TARGET binding site found in the 5' untranslated region of mRNA encoded by LOC149707, corresponding to a HOST TARGET binding site such as BINDING SITE I, BINDING SITE II or BINDING SITE III. Table 2 illustrates the complementarity of the nucleotide sequences of LOC149707 BINDING SITE, designated SEQ ID:38803, to the nucleotide sequence of VGAM595 RNA, herein designated VGAM RNA, also designated SEQ ID:3306.

Another function of VGAM595 is therefore inhibition of LOC149707 (Accession XM_086641). Accordingly, utilities of VGAM595 include diagnosis, prevention and treatment of diseases and clinical conditions associated with LOC149707. LOC150848 (Accession XM_097959) is another VGAM595 host target gene. LOC150848 BINDING SITE is HOST TARGET binding site found in the 3' untranslated region of mRNA encoded by LOC150848, corresponding to a HOST TARGET binding site such as BINDING SITE I, BINDING SITE II or BINDING SITE III. Table 2 illustrates the complementarity of the nucleotide sequences of LOC150848 BINDING SITE, designated SEQ ID:41252, to the nucleotide sequence of VGAM595 RNA, herein designated VGAM RNA, also designated SEQ ID:3306.

Another function of VGAM595 is therefore inhibition of LOC150848 (Accession XM_097959). Accordingly, utilities of VGAM595 include diagnosis, prevention and treatment of diseases and clinical conditions associated with LOC150848. LOC150960 (Accession XM_087059) is another VGAM595 host target gene. LOC150960 BINDING SITE is HOST TARGET binding site found in the 3' untranslated region of mRNA encoded by LOC150960, corresponding to a HOST TARGET binding site such as BINDING SITE I, BINDING SITE II or BINDING SITE III. Table 2 illustrates the complementarity of the nucleotide sequences of LOC150960 BINDING SITE, designated SEQ ID:39032, to the nucleotide sequence of VGAM595 RNA, herein designated VGAM RNA, also designated SEQ ID:3306.

Another function of VGAM595 is therefore inhibition of LOC150960 (Accession XM_087059). Accordingly, utilities of VGAM595 include diagnosis, prevention and treatment of diseases and clinical conditions associated with LOC150960. LOC154789 (Accession XM_088043) is another VGAM595 host target gene. LOC154789 BINDING SITE is HOST TARGET binding site found in the 5' untranslated region of mRNA encoded by LOC154789, corresponding to a HOST TARGET binding site such as BINDING SITE I, BINDING SITE II or BINDING SITE III. Table 2 illustrates the complementarity of the nucleotide sequences of LOC154789 BINDING SITE, designated SEQ ID:39488, to the nucleotide sequence of VGAM595 RNA, herein designated VGAM RNA, also designated SEQ ID:3306.

Another function of VGAM595 is therefore inhibition of LOC154789 (Accession XM_088043). Accordingly, utilities of VGAM595 include diagnosis, prevention and treatment of diseases and clinical conditions associated with LOC154789. LOC157226 (Accession XM_033876) is another VGAM595 host target gene. LOC157226 BINDING SITE is HOST TARGET binding site found in the 5' untranslated region of mRNA encoded by LOC157226, corresponding to a HOST TARGET binding site such as BINDING SITE I, BINDING SITE II or BINDING SITE III. Table 2 illustrates the complementarity of the nucleotide sequences of LOC157226 BINDING SITE, designated SEQ ID:31979, to the nucleotide sequence of VGAM595 RNA, herein designated VGAM RNA, also designated SEQ ID:3306.

Another function of VGAM595 is therefore inhibition of LOC157226 (Accession XM_033876). Accordingly, utilities of VGAM595 include diagnosis, prevention and treatment of diseases and clinical conditions associated with LOC157226. LOC158062 (Accession XM_098861) is another VGAM595 host target gene. LOC158062 BINDING SITE is HOST TARGET binding site found in the 3' untranslated region of mRNA encoded by LOC158062, corresponding to a HOST TARGET binding site such as BINDING SITE I, BINDING SITE II or BINDING SITE III. Table 2 illustrates the complementarity of the nucleotide sequences of LOC158062 BINDING SITE, designated SEQ ID:41916, to the nucleotide sequence of VGAM595 RNA, herein designated VGAM RNA, also designated SEQ ID:3306.

Another function of VGAM595 is therefore inhibition of LOC158062 (Accession XM_098861). Accordingly, utilities of VGAM595 include diagnosis, prevention and treatment of diseases and clinical conditions associated with LOC158062. LOC200227 (Accession XM_114162) is another VGAM595 host target gene. LOC200227 BINDING SITE is HOST TARGET binding site found in the 5' untranslated region of mRNA encoded by LOC200227, corresponding to a HOST TARGET binding site such as BINDING SITE I, BINDING SITE II or BINDING SITE III. Table 2 illustrates the complementarity of the nucleotide sequences of LOC200227 BINDING SITE, designated SEQ ID:42748, to the nucleotide sequence of VGAM595 RNA, herein designated VGAM RNA, also designated SEQ ID:3306.

Another function of VGAM595 is therefore inhibition of LOC200227 (Accession XM_114162). Accordingly, utilities of VGAM595 include diagnosis, prevention and treatment of diseases and clinical conditions associated with LOC200227. LOC200273 (Accession XM_047698) is another VGAM595 host target gene. LOC200273 BINDING SITE is HOST TARGET binding site found in the 3' untranslated region of mRNA encoded by LOC200273, corresponding to a HOST TARGET binding site such as BINDING SITE I, BINDING SITE II or BINDING SITE III. Table 2 illustrates the complementarity of the nucleotide sequences of LOC200273 BINDING SITE, designated SEQ ID:35029, to the nucleotide sequence of VGAM595 RNA, herein designated VGAM RNA, also designated SEQ ID:3306.

Another function of VGAM595 is therefore inhibition of LOC200273 (Accession XM_047698). Accordingly, utilities of VGAM595 include diagnosis, prevention and treatment of diseases and clinical conditions associated with LOC200273. LOC256529 (Accession XM_174314) is another VGAM595 host target gene. LOC256529 BINDING SITE is HOST TARGET binding site found in the 5' untranslated region of mRNA encoded by LOC256529, corresponding to a HOST TARGET binding site such as BINDING SITE I, BINDING SITE II or BINDING SITE III. Table 2 illustrates the complementarity of the nucleotide sequences of LOC256529 BINDING SITE, designated SEQ ID:46590, to the nucleotide sequence of VGAM595 RNA, herein designated VGAM RNA, also designated SEQ ID:3306.

Another function of VGAM595 is therefore inhibition of LOC256529 (Accession XM_174314). Accordingly, utilities of VGAM595 include diagnosis, prevention and treatment of diseases and clinical conditions associated with LOC256529. LOC51068 (Accession NM_015938) is another VGAM595 host target gene. LOC51068 BINDING SITE is HOST TARGET binding site found in the 3' untranslated region of mRNA encoded by LOC51068, corresponding to a HOST TARGET binding site such as BINDING SITE I, BINDING SITE II or BINDING SITE III. Table 2 illustrates the complementarity of the nucleotide sequences of LOC51068 BINDING SITE, designated SEQ ID:18057, to the nucleotide sequence of VGAM595 RNA, herein designated VGAM RNA, also designated SEQ ID:3306.

Another function of VGAM595 is therefore inhibition of LOC51068 (Accession NM_015938). Accordingly, utilities of VGAM595 include diagnosis, prevention and treatment of diseases and clinical conditions associated with LOC51068. LOC91496 (Accession XM_038788) is another VGAM595 host target gene. LOC91496 BINDING SITE is HOST TARGET binding site found in the 5' untranslated region of mRNA encoded by LOC91496, corresponding to a HOST TARGET binding site such as BINDING SITE I, BINDING SITE II or BINDING SITE III. Table 2 illustrates the complementarity of the nucleotide sequences of LOC91496 BINDING SITE, designated SEQ ID:32914, to the nucleotide sequence of VGAM595 RNA, herein designated VGAM RNA, also designated SEQ ID:3306.

Another function of VGAM595 is therefore inhibition of LOC91496 (Accession XM_038788). Accordingly, utilities of VGAM595 include diagnosis, prevention and treatment of diseases and clinical conditions associated with LOC91496.

FIG. 1 further provides a conceptual description of a novel bioinformatically detected viral gene of the present invention, referred to here as Viral Genomic Address Messenger 596 (VGAM596) viral gene, which modulates expression of respective host target genes thereof, the function and utility of which host target genes is known in the art.

VGAM596 is a novel bioinformatically detected regulatory, non protein coding, viral micro RNA (miRNA) gene. The method by which VGAM596 was detected is described hereinabove with reference to FIGS. 1-8.

VGAM596 gene, herein designated VGAM GENE, is a viral gene contained in the genome of Northern Cereal Mosaic Virus. VGAM596 host target gene, herein designated VGAM HOST TARGET GENE, is a human gene contained in the human genome.

VGAM596 gene encodes a VGAM596 precursor RNA, herein designated VGAM PRECURSOR RNA. Similar to other miRNA genes, and unlike most ordinary genes, VGAM596 precursor RNA does not encode a protein. A nucleotide sequence identical or highly similar to the nucleotide sequence of VGAM596 precursor RNA is designated SEQ ID:582, and is provided hereinbelow with reference to the sequence listing part. Nucleotide sequence SEQ ID:582 is located at position 12057 relative to the genome of Northern Cereal Mosaic Virus.

VGAM596 precursor RNA folds onto itself, forming VGAM596 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM596 folded precursor RNA into VGAM596 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM596 RNA is designated SEQ ID:3307, and is provided hereinbelow with reference to the sequence listing part.

VGAM596 host target gene, herein designated VGAM HOST TARGET GENE, encodes a corresponding messenger RNA, VGAM596 host target RNA, herein designated VGAM HOST TARGET RNA. VGAM596 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM596 RNA, herein designated VGAM RNA, binds complementarily to one or more host target binding sites located in untranslated regions of VGAM596 host target RNA, herein designated VGAM HOST TARGET RNA. This complementary binding is due to the fact that the nucleotide sequence of VGAM596 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM596 RNA, herein designated VGAM RNA, may have a different number of host target binding sites in untranslated regions of a VGAM596 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM596 RNA, herein designated VGAM RNA, to host target binding sites on VGAM596 host target RNA, herein designated VGAM HOST TARGET RNA, such as BINDING SITE I, BINDING SITE II and BINDING SITE III, inhibits translation of VGAM596 host target RNA into VGAM596 host target protein, herein designated VGAM HOST TARGET PROTEIN. VGAM host target protein is therefore outlined by a broken line.

It is appreciated that VGAM596 host target gene, herein designated VGAM HOST TARGET GENE, in fact represents a plurality of VGAM596 host target genes. The mRNA of each one of this plurality of VGAM596 host target genes comprises one or more host target binding sites, each having a nucleotide sequence which is at least partly complementary to VGAM596 RNA, herein designated VGAM RNA, and which when bound by VGAM596 RNA causes inhibition of translation of respective one or more VGAM596 host target proteins.

It is further appreciated by one skilled in the art that the mode of translational inhibition illustrated by FIG. 1 with specific reference to translational inhibition exerted by VGAM596 gene, herein designated VGAM GENE, on one or more VGAM596 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM596 is inhibition of expression of host target genes, as part of a novel viral mechanism of attacking a host. Accordingly, utilities of VGAM596 include diagnosis, prevention and treatment of viral infection by Northern Cereal Mosaic Virus. Specific functions, and accordingly utilities, of VGAM596 correlate with, and may be deduced from, the identity of the host target genes which VGAM596 binds and inhibits, and the function of these host target genes, as elaborated hereinbelow.

Nucleotide sequences of the VGAM596 precursor RNA, herein designated VGAM PRECURSOR RNA, and of the 'diced' VGAM596 RNA, herein designated VGAM RNA, and a schematic representation of the secondary folding of VGAM596 folded precursor RNA, herein designated VGAM FOLDED PRECURSOR RNA, of VGAM596 are further described hereinbelow with reference to Table 1.

Nucleotide sequences of host target binding sites, such as BINDING SITE-I, BINDING SITE-II and BINDING SITE-III of FIG. 1, found on VGAM596 host target RNA, and schematic representation of the complementarity of each of these host target binding sites to VGAM596 RNA, herein designated VGAM RNA, are described hereinbelow with reference to Table 2.

As mentioned hereinabove with reference to FIG. 1, a function of VGAM596 gene, herein designated VGAM is inhibition of expression of VGAM596 target genes. It is appreciated that specific functions, and accordingly utilities, of VGAM596 correlate with, and may be deduced from, the identity of the target genes which VGAM596 binds and inhibits, and the function of these target genes, as elaborated hereinbelow.

Carboxypeptidase D (CPD, Accession NM_001304) is a VGAM596 host target gene. CPD BINDING SITE is HOST TARGET binding site found in the 3" untranslated region of mRNA encoded by CPD, corresponding to a HOST TARGET binding site such as BINDING SITE I, BINDING SITE II or BINDING SITE III. Table 2 illustrates the complementarity of the nucleotide sequences of CPD BINDING SITE, designated SEQ ID:6983, to the nucleotide sequence of VGAM596 RNA, herein designated VGAM RNA, also designated SEQ ID:3307.

A function of VGAM596 is therefore inhibition of Carboxypeptidase D (CPD, Accession NM_001304), a gene which is a membrane-bound metalloprotease. Accordingly, utilities of VGAM596 include diagnosis, prevention and treatment of diseases and clinical conditions associated with CPD. The function of CPD has been established by previous studies. The metallocarboxypeptidase family of enzymes is divided into 2 subfamilies based on sequence similarities. The pancreatic carboxypeptidase-like class includes carboxypeptidase A (OMIM Ref. No. 114850), carboxypeptidase B (OMIM Ref. No. 114852), CPA3 (OMIM Ref. No. 114851) and CPB2 (OMIM Ref. No. 603101). The regulatory B-type carboxypeptidase subfamily includes carboxypeptidase N (OMIM Ref. No. 603103), CPM (OMIM Ref. No. 114860), CPE, or H (OMIM Ref. No. 114855), and AEBP1 (OMIM Ref. No. 602981). In membrane fractions of mammalian cells, McGwire et al. (1997) identified a novel regulatory B-type carboxypeptidase that they designated carboxypeptidase D, or CPD. CPD is homologous to duck gp180, a hepatitis B virus-binding protein. By carrying out BLAST searches to identify human homologs of gp180, Tan et al. (1997) isolated cDNAs encoding CPD. The predicted 1,377-amino acid protein contains a signal sequence, 3 tandem carboxypeptidase homology domains, and a C-terminal putative transmembrane domain. The 3 carboxypeptidase domains have sequence similarity to the regulatory B-type carboxypeptidase family. Overall, the amino acid sequences of CPD and gp180 are 75% identical. Northern blot analysis revealed CPD expression as multiple mRNAs in pancreas, placenta, heart, and skeletal muscle. By analysis of somatic cell hybrid panels, Riley et al. (1998) mapped the CPD gene to the centromeric region 17p11.1-q11.2.

Full details of the abovementioned studies are described in the following publications, the disclosure of which are hereby incorporated by reference:

McGwire, G. B.; Tan, F.; Michel, B.; Rehli, M.; Skidgel, R. A.: Identification of a membrane-bound carboxypeptidase as the mammalian homolog of duck gp180, a hepatitis B virus-binding protein. Life Sci. 60:715-724, 1997; and Riley, D. A.; Tan, F.; Miletich, D. J.; Skidgel, R. A.: Chromosomal localization of the genes for human carboxypeptidase D (CPD) and the active 50-kilodalton subunit of human carboxypep.

Further studies establishing the function and utilities of CPD are found in John Hopkins OMIM database record ID 603102, and in sited publications numbered 8489-8491 listed in the bibliography section hereinbelow, which are also hereby incorporated by reference. Dishevelled, Dsh Homolog 3 (Drosophila) (DVL3, Accession NM_004423) is another VGAM596 host target gene. DVL3 BINDING SITE is HOST TARGET binding site found in the 3' untranslated region of mRNA encoded by DVL3, corresponding to a HOST TARGET binding site such as BINDING SITE I, BINDING SITE II or BINDING SITE III. Table 2 illustrates the complementarity of the nucleotide sequences of DVL3 BINDING SITE, designated SEQ ID:10689, to the nucleotide sequence of VGAM596 RNA, herein designated VGAM RNA, also designated SEQ ID:3307.

Another function of VGAM596 is therefore inhibition of Dishevelled, Dsh Homolog 3 (Drosophila) (DVL3, Accession NM_004423), a gene which regulates cell proliferation. Accordingly, utilities of VGAM596 include diagnosis, prevention and treatment of diseases and clinical conditions associated with DVL3. The function of DVL3 and its association with various diseases and clinical conditions, has been established by previous studies, as described hereinabove with reference to VGAM57. Reticulon 3 (RTN3, Accession XM_058207) is another VGAM596 host target gene. RTN3 BINDING SITE is HOST TARGET binding site found in the 3' untranslated region of mRNA encoded by RTN3, corresponding to a HOST TARGET binding site such as BINDING SITE I, BINDING SITE II or BINDING SITE III. Table 2 illustrates the complementarity of the nucleotide sequences of RTN3 BINDING SITE, designated SEQ ID:36584, to the nucleotide sequence of VGAM596 RNA, herein designated VGAM RNA, also designated SEQ ID:3307.

Another function of VGAM596 is therefore inhibition of Reticulon 3 (RTN3, Accession XM_058207), a gene which is a member of the reticulon (neuroendocrine-specific, NSP) family. Accordingly, utilities of VGAM596 include diagnosis, prevention and treatment of diseases and clinical conditions associated with RTN3. The function of RTN3 has been established by previous studies. The reticulons are a group of highly conserved genes with preferential expression in neuroendocrine tissues. During a subtraction cloning between macula and peripheral retina, Moreira et al. (1999) isolated a novel member of the reticulon gene family, which they designated reticulon-3. The mRNA for RTN3 was approximately 3-fold more abundant in macula than in peripheral retina. The 2,527-bp cDNA encodes a predicted 236-amino acid protein that shows strong sequence similarity with other members of the RTN gene family (see, OMIM Ref. No., e.g., 600865). Northern blot analysis showed that RTN3 is widely expressed in human tissues, with highest expression in the brain. The RTN3 gene contains 7 exons and spans more than 15 kb By use of somatic cell hybrid and radiation hybrid panels, Moreira et al. (1999) mapped the RTN3 gene to 11q13, between markers D11S4535 and D11S4627. Southern blot analysis identified the presence of at least one pseudogene that was subsequently localized to chromosome 4

Full details of the abovementioned studies are described in the following publications, the disclosure of which are hereby incorporated by reference:

Moreira, E. F.; Jaworski, C. J.; Rodriguez, I. R.: Cloning of a novel member of the reticulon gene family (RTN3): gene structure and chromosomal localization to 11q13. Genomics 58:73-81, 1999; and Moreira, E. F.; Jaworski, C. J.; Rodriguez, I. R.: Cloning of a novel member of the reticulon gene family (RTN3): gene structure and chromosomal localization to 11q13. Genomics 58:73-81.

Further studies establishing the function and utilities of RTN3 are found in John Hopkins OMIM database record ID 604249, and in sited publications numbered 692 listed in the bibliography section hereinbelow, which are also hereby incorporated by reference. TEM6 (Accession NM_022748) is another VGAM596 host target gene. TEM6 BINDING SITE is HOST TARGET binding site found in the 3' untranslated region of mRNA encoded by TEM6, corresponding to a HOST TARGET binding site such as BINDING SITE I, BINDING SITE II or BINDING SITE III. Table 2 illustrates the complementarity of the nucleotide sequences of TEM6 BINDING SITE, designated SEQ ID:22964, to the nucleotide sequence of VGAM596 RNA, herein designated VGAM RNA, also designated SEQ ID:3307.

Another function of VGAM596 is therefore inhibition of TEM6 (Accession NM_022748), a gene which displayes elevated expression during tumor angiogenesis. Accordingly, utilities of VGAM596 include diagnosis, prevention and treatment of diseases and clinical conditions associated with TEM6. The function of TEM6 and its association with various diseases and clinical conditions, has been established by previous studies, as described hereinabove with reference to VGAM175. Xenotropic and Polytropic Retrovirus Receptor (XPR1, Accession NM_004736) is another VGAM596 host target gene. XPR1 BINDING SITE is HOST TARGET binding site found in the 3' untranslated region of mRNA encoded by XPR1, corresponding to a HOST TARGET binding site such as BINDING SITE I, BINDING SITE II or BINDING SITE III. Table 2 illustrates the complementarity of the nucleotide sequences of XPR1 BINDING SITE, designated SEQ ID:11123, to the nucleotide sequence of VGAM596 RNA, herein designated VGAM RNA, also designated SEQ ID:3307.

Another function of VGAM596 is therefore inhibition of Xenotropic and Polytropic Retrovirus Receptor (XPR1, Accession NM_004736), a gene which is a putative G protein-coupled receptor and a target for xenotropic and polytropic murine leukemia retroviruses. Accordingly, utilities of VGAM596 include diagnosis, prevention and treatment of diseases and clinical conditions associated with XPR1. The function of XPR1 and its association with various diseases and clinical conditions, has been established by previous studies, as described hereinabove with reference to VGAM430. MGC29898 (Accession NM_145048) is another VGAM596 host target gene. MGC29898 BINDING SITE is HOST TARGET binding site found in the 3' untranslated region of mRNA encoded by MGC29898, corresponding to a HOST TARGET binding site such as BINDING SITE I, BINDING SITE II or BINDING SITE III. Table 2 illustrates the complementarity of the nucleotide sequences of MGC29898 BINDING SITE, designated SEQ ID:29679, to the nucleotide sequence of VGAM596 RNA, herein designated VGAM RNA, also designated SEQ ID:3307.

Another function of VGAM596 is therefore inhibition of MGC29898 (Accession NM_145048). Accordingly, utilities of VGAM596 include diagnosis, prevention and treatment of diseases and clinical conditions associated with MGC29898. LOC145955 (Accession XM_096912) is another VGAM596 host target gene. LOC145955 BINDING SITE is HOST TARGET binding site found in the 5' untranslated region of mRNA encoded by LOC145955, corresponding to a HOST TARGET binding site such as BINDING SITE I, BINDING SITE II or BINDING SITE III. Table 2 illustrates the complementarity of the nucleotide sequences of LOC145955 BINDING SITE, designated SEQ ID:40642, to the nucleotide sequence of VGAM596 RNA, herein designated VGAM RNA, also designated SEQ ID:3307.

Another function of VGAM596 is therefore inhibition of LOC145955 (Accession XM_096912). Accordingly, utilities of VGAM596 include diagnosis, prevention and treatment of diseases and clinical conditions associated with LOC145955. LOC152905 (Accession XM_017966) is another VGAM596 host target gene. LOC152905 BINDING SITE is HOST TARGET binding site found in the 3' untranslated region of mRNA encoded by LOC152905, corresponding to a HOST TARGET binding site such as BINDING SITE I, BINDING SITE II or BINDING SITE III. Table 2 illustrates the complementarity of the nucleotide sequences of LOC152905 BINDING SITE, designated SEQ ID:30330, to the nucleotide sequence of VGAM596 RNA, herein designated VGAM RNA, also designated SEQ ID:3307.

Another function of VGAM596 is therefore inhibition of LOC152905 (Accession XM_017966). Accordingly, utilities of VGAM596 include diagnosis, prevention and treatment of diseases and clinical conditions associated with LOC152905. FIG. 1 further provides a conceptual description of a novel bioinformatically detected viral gene of the present invention, referred to here as Viral Genomic Address Messenger 597 (VGAM597) viral gene, which modulates expression of respective host target genes thereof, the function and utility of which host target genes is known in the art.

VGAM597 is a novel bioinformatically detected regulatory, non protein coding, viral micro RNA (miRNA) gene. The method by which VGAM597 was detected is described hereinabove with reference to FIGS. 1-8.

VGAM597 gene, herein designated VGAM GENE, is a viral gene contained in the genome of Transmissible Gastroenteritis Virus. VGAM597 host target gene, herein designated VGAM HOST TARGET GENE, is a human gene contained in the human genome.

VGAM597 gene encodes a VGAM597 precursor RNA, herein designated VGAM PRECURSOR RNA. Similar to other miRNA genes, and unlike most ordinary genes, VGAM597 precursor RNA does not encode a protein. A nucleotide sequence identical or highly similar to the nucleotide sequence of VGAM597 precursor RNA is designated SEQ ID:583, and is provided hereinbelow with reference to the sequence listing part. Nucleotide sequence SEQ ID:583 is located at position 10633 relative to the genome of Transmissible Gastroenteritis Virus.

VGAM597 precursor RNA folds onto itself, forming VGAM597 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM597 folded precursor RNA into VGAM597 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 62%) nucleotide sequence of VGAM597 RNA is designated SEQ ID:3308, and is provided hereinbelow with reference to the sequence listing part.

VGAM597 host target gene, herein designated VGAM HOST TARGET GENE, encodes a corresponding messenger RNA, VGAM597 host target RNA, herein designated VGAM HOST TARGET RNA. VGAM597 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM597 RNA, herein designated VGAM RNA, binds complementarily to one or more host target binding sites located in untranslated regions of VGAM597 host target RNA, herein designated VGAM HOST TARGET RNA. This complementary binding is due to the fact that the nucleotide sequence of VGAM597 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM597 RNA, herein designated VGAM RNA, may have a different number of host target binding sites in untranslated regions of a VGAM597 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM597 RNA, herein designated VGAM RNA, to host target binding sites on VGAM597 host target RNA, herein designated VGAM HOST TARGET RNA, such as BINDING SITE I, BINDING SITE II and BINDING SITE III, inhibits translation of VGAM597 host target RNA into VGAM597 host target protein, herein designated VGAM HOST TARGET PROTEIN. VGAM host target protein is therefore outlined by a broken line.

It is appreciated that VGAM597 host target gene, herein designated VGAM HOST TARGET GENE, in fact represents a plurality of VGAM597 host target genes. The mRNA of each one of this plurality of VGAM597 host target genes comprises one or more host target binding sites, each having a nucleotide sequence which is at least partly complementary to VGAM597 RNA, herein designated VGAM RNA, and which when bound by VGAM597 RNA causes inhibition of translation of respective one or more VGAM597 host target proteins.

It is further appreciated by one skilled in the art that the mode of translational inhibition illustrated by FIG. 1 with specific reference to translational inhibition exerted by VGAM597 gene, herein designated VGAM GENE, on one or more VGAM597 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM597 is inhibition of expression of host target genes, as part of a novel viral mechanism of attacking a host. Accordingly, utilities of VGAM597 include diagnosis, prevention and treatment of viral infection by Transmissible Gastroenteritis Virus. Specific functions, and accordingly utilities, of VGAM597 correlate with, and may be deduced from, the identity of the host target genes which VGAM597 binds and inhibits, and the function of these host target genes, as elaborated hereinbelow.

Nucleotide sequences of the VGAM597 precursor RNA, herein designated VGAM PRECURSOR RNA, and of the 'diced' VGAM597 RNA, herein designated VGAM RNA, and a schematic representation of the secondary folding of VGAM597 folded precursor RNA, herein designated VGAM FOLDED PRECURSOR RNA, of VGAM597 are further described hereinbelow with reference to Table 1.

Nucleotide sequences of host target binding sites, such as BINDING SITE-I, BINDING SITE-II and BINDING SITE-III of FIG. 1, found on VGAM597 host target RNA, and schematic representation of the complementarity of each of these host target binding sites to VGAM597 RNA, herein designated VGAM RNA, are described hereinbelow with reference to Table 2.

As mentioned hereinabove with reference to FIG. 1, a function of VGAM597 gene, herein designated VGAM is inhibition of expression of VGAM597 target genes. It is appreciated that specific functions, and accordingly utilities, of VGAM597 correlate with, and may be deduced from, the identity of the target genes which VGAM597 binds and inhibits, and the function of these target genes, as elaborated hereinbelow.

CGG Triplet Repeat Binding Protein 1 (CGGBP1, Accession NM_003663) is a VGAM597 host target gene. CGGBP1 BINDING SITE is HOST TARGET binding site found in the 3' untranslated region of mRNA encoded by CGGBP1, corresponding to a HOST TARGET binding site such as BINDING SITE I, BINDING SITE II or BINDING SITE III. Table 2 illustrates the complementarity of the nucleotide sequences of CGGBP1 BINDING SITE, designated SEQ ID:9737, to the nucleotide sequence of VGAM597 RNA, herein designated VGAM RNA, also designated SEQ ID:3308.

A function of VGAM597 is therefore inhibition of CGG Triplet Repeat Binding Protein 1 (CGGBP1, Accession NM_003663). Accordingly, utilities of VGAM597 include diagnosis, prevention and treatment of diseases and clinical conditions associated with CGGBP1. FIG. 1 further provides a conceptual description of a novel bioinformatically detected viral gene of the present invention, referred to here as Viral Genomic Address Messenger 598 (VGAM598) viral gene, which modulates expression of respective host target genes thereof, the function and utility of which host target genes is known in the art.

VGAM598 is a novel bioinformatically detected regulatory, non protein coding, viral micro RNA (miRNA) gene. The method by which VGAM598 was detected is described hereinabove with reference to FIGS. 1-8.

VGAM598 gene, herein designated VGAM GENE, is a viral gene contained in the genome of Transmissible Gastroenteritis Virus. VGAM598 host target gene, herein designated VGAM HOST TARGET GENE, is a human gene contained in the human genome.

VGAM598 gene encodes a VGAM598 precursor RNA, herein designated VGAM PRECURSOR RNA. Similar to other miRNA genes, and unlike most ordinary genes, VGAM598 precursor RNA does not encode a protein. A nucleotide sequence identical or highly similar to the nucleotide sequence of VGAM598 precursor RNA is designated SEQ ID:584, and is provided hereinbelow with reference to the sequence listing part. Nucleotide sequence SEQ ID:584 is located at position 7593 relative to the genome of Transmissible Gastroenteritis Virus.

VGAM598 precursor RNA folds onto itself, forming VGAM598 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM598 folded precursor RNA into VGAM598 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM598 RNA is designated SEQ ID:3309, and is provided hereinbelow with reference to the sequence listing part.

VGAM598 host target gene, herein designated VGAM HOST TARGET GENE, encodes a corresponding messenger RNA, VGAM598 host target RNA, herein designated VGAM HOST TARGET RNA. VGAM598 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM598 RNA, herein designated VGAM RNA, binds complementarily to one or more host target binding sites located in untranslated regions of VGAM598 host target RNA, herein designated VGAM HOST TARGET RNA. This complementary binding is due to the fact that the nucleotide sequence of VGAM598 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM598 RNA, herein designated VGAM RNA, may have a different number of host target binding sites in untranslated regions of a VGAM598 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM598 RNA, herein designated VGAM RNA, to host target binding sites on VGAM598 host target RNA, herein designated VGAM HOST TARGET RNA, such as BINDING SITE I, BINDING SITE II and BINDING SITE III, inhibits translation of VGAM598 host target RNA into VGAM598 host target protein, herein designated VGAM HOST TARGET PROTEIN. VGAM host target protein is therefore outlined by a broken line.

It is appreciated that VGAM598 host target gene, herein designated VGAM HOST TARGET GENE, in fact represents a plurality of VGAM598 host target genes. The mRNA of each one of this plurality of VGAM598 host target genes comprises one or more host target binding sites, each having a nucleotide sequence which is at least partly complementary to VGAM598 RNA, herein designated VGAM RNA, and which when bound by VGAM598 RNA causes inhibition of translation of respective one or more VGAM598 host target proteins.

It is further appreciated by one skilled in the art that the mode of translational inhibition illustrated by FIG. 1 with specific reference to translational inhibition exerted by VGAM598 gene, herein designated VGAM GENE, on one or more VGAM598 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM598 is inhibition of expression of host target genes, as part of a novel viral mechanism of attacking a host. Accordingly, utilities of VGAM598 include diagnosis, prevention and treatment of viral infection by Transmissible Gastroenteritis Virus. Specific functions, and accordingly utilities, of VGAM598 correlate with, and may be deduced from, the identity of the host target genes which VGAM598 binds and inhibits, and the function of these host target genes, as elaborated hereinbelow.

Nucleotide sequences of the VGAM598 precursor RNA, herein designated VGAM PRECURSOR RNA, and of the 'diced' VGAM598 RNA, herein designated VGAM RNA, and a schematic representation of the secondary folding of VGAM598 folded precursor RNA, herein designated VGAM FOLDED PRECURSOR RNA, of VGAM598 are further described hereinbelow with reference to Table 1.

Nucleotide sequences of host target binding sites, such as BINDING SITE-I, BINDING SITE-II and BINDING SITE-III of FIG. 1, found on VGAM598 host target RNA, and schematic representation of the complementarity of each of these host target binding sites to VGAM598 RNA, herein designated VGAM RNA, are described hereinbelow with reference to Table 2.

As mentioned hereinabove with reference to FIG. 1, a function of VGAM598 gene, herein designated VGAM is inhibition of expression of VGAM598 target genes. It is appreciated that specific functions, and accordingly utilities, of VGAM598 correlate with, and may be deduced from, the identity of the target genes which VGAM598 binds and inhibits, and the function of these target genes, as elaborated hereinbelow.

BCRP2 (Accession XM_031102) is a VGAM598 host target gene. BCRP2 BINDING SITE is HOST TARGET binding site found in the 3' untranslated region of mRNA encoded by BCRP2, corresponding to a HOST TARGET binding site such as BINDING SITE I, BINDING SITE II or BINDING SITE III. Table 2 illustrates the complementarity of the nucleotide sequences of BCRP2 BINDING SITE, designated SEQ ID:31272, to the nucleotide sequence of VGAM598 RNA, herein designated VGAM RNA, also designated SEQ ID:3309.

A function of VGAM598 is therefore inhibition of BCRP2 (Accession XM_031102). Accordingly, utilities of VGAM598 include diagnosis, prevention and treatment of diseases and clinical conditions associated with BCRP2. Estrogen-related Receptor Gamma (ESRRG, Accession XM_039053) is another VGAM598 host target gene. ESRRG BINDING SITE is HOST TARGET binding site found in the 3' untranslated region of mRNA encoded by ESRRG, corresponding to a HOST TARGET binding site such as BINDING SITE I, BINDING SITE II or BINDING SITE III. Table 2 illustrates the complementarity of the nucleotide sequences of ESRRG BINDING SITE, designated SEQ ID:32996, to the nucleotide sequence of VGAM598 RNA, herein designated VGAM RNA, also designated SEQ ID:3309.

Another function of VGAM598 is therefore inhibition of Estrogen-related Receptor Gamma (ESRRG, Accession XM_039053), a gene which Estrogen-related receptor gamma. Accordingly, utilities of VGAM598 include diagnosis, prevention and treatment of diseases and clinical conditions associated with ESRRG. The function of ESRRG and its association with various diseases and clinical conditions, has been established by previous studies, as described hereinabove with reference to VGAM359. FLJ20147 (Accession NM_017687) is another VGAM598 host target gene. FLJ20147 BINDING SITE is HOST TARGET binding site found in the 3' untranslated region of mRNA encoded by FLJ20147, corresponding to a HOST TARGET binding site such as BINDING SITE I, BINDING SITE II or BINDING SITE III. Table 2 illustrates the complementarity of the nucleotide sequences of FLJ20147 BINDING SITE, designated SEQ ID:19242, to the nucleotide sequence of VGAM598 RNA, herein designated VGAM RNA, also designated SEQ ID:3309.

Another function of VGAM598 is therefore inhibition of FLJ20147 (Accession NM_017687). Accordingly, utilities of VGAM598 include diagnosis, prevention and treatment of diseases and clinical conditions associated with FLJ20147. FLJ22060 (Accession NM_024612) is another VGAM598 host target gene. FLJ22060 BINDING SITE is HOST TARGET binding site found in the 3' untranslated region of mRNA encoded by FLJ22060, corresponding to a HOST TARGET binding site such as BINDING SITE I, BINDING SITE II or BINDING SITE III. Table 2 illustrates the complementarity of the nucleotide sequences of FLJ22060 BINDING SITE, designated SEQ ID:23866, to the nucleotide sequence of VGAM598 RNA, herein designated VGAM RNA, also designated SEQ ID:3309.

Another function of VGAM598 is therefore inhibition of FLJ22060 (Accession NM_024612). Accordingly, utilities of VGAM598 include diagnosis, prevention and treatment of diseases and clinical conditions associated with FLJ22060. HIC (Accession XM_041273) is another VGAM598 host target gene. HIC BINDING SITE is HOST TARGET binding site found in the 3" untranslated region of mRNA encoded by HIC, corresponding to a HOST TARGET binding site such as BINDING SITE I, BINDING SITE II or BINDING SITE III. Table 2 illustrates the complementarity of the nucleotide sequences of HIC BINDING SITE, designated SEQ ID:33496, to the nucleotide sequence of VGAM598 RNA, herein designated VGAM RNA, also designated SEQ ID:3309.

Another function of VGAM598 is therefore inhibition of HIC (Accession XM_041273). Accordingly, utilities of VGAM598 include diagnosis, prevention and treatment of diseases and clinical conditions associated with HIC. TAF2 RNA Polymerase II, TATA Box Binding Protein (TBP)-associated Factor, 150kDa (TAF2, Accession NM_003184) is another VGAM598 host target gene. TAF2 BINDING SITE is HOST TARGET binding site found in the 3' untranslated region of mRNA encoded by TAF2, corresponding to a HOST TARGET binding site such as BINDING SITE I, BINDING SITE II or BINDING SITE III. Table 2 illustrates the complementarity of the nucleotide sequences of TAF2 BINDING SITE, designated SEQ ID:9158, to the nucleotide sequence of VGAM598 RNA, herein designated VGAM RNA, also designated SEQ ID:3309.

Another function of VGAM598 is therefore inhibition of TAF2 RNA Polymerase II, TATA Box Binding Protein (TBP)-associated Factor, 150 kDa (TAF2, Accession NM_003184). Accordingly, utilities of VGAM598 include diagnosis, prevention and treatment of diseases and clinical conditions associated with TAF2. FIG. 1 further provides a conceptual description of a novel bioinformatically detected viral gene of the present invention, referred to here as Viral Genomic Address Messenger 599 (VGAM599) viral gene, which modulates expression of respective host target genes thereof, the function and utility of which host target genes is known in the art.

VGAM599 is a novel bioinformatically detected regulatory, non protein coding, viral micro RNA (miRNA) gene. The method by which VGAM599 was detected is described hereinabove with reference to FIGS. 1-8.

VGAM599 gene, herein designated VGAM GENE, is a viral gene contained in the genome of Transmissible Gastroenteritis Virus. VGAM599 host target gene, herein designated VGAM HOST TARGET GENE, is a human gene contained in the human genome.

VGAM599 gene encodes a VGAM599 precursor RNA, herein designated VGAM PRECURSOR RNA. Similar to other miRNA genes, and unlike most ordinary genes, VGAM599 precursor RNA does not encode a protein. A nucleotide sequence identical or highly similar to the nucleotide sequence of VGAM599 precursor RNA is designated SEQ ID:585, and is provided hereinbelow with reference to the sequence listing part. Nucleotide sequence SEQ ID:585 is located at position 5831 relative to the genome of Transmissible Gastroenteritis Virus.

VGAM599 precursor RNA folds onto itself, forming VGAM599 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM599 folded precursor RNA into VGAM599 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM599 RNA is designated SEQ ID:3310, and is provided hereinbelow with reference to the sequence listing part.

VGAM599 host target gene, herein designated VGAM HOST TARGET GENE, encodes a corresponding messenger RNA, VGAM599 host target RNA, herein designated VGAM HOST TARGET RNA. VGAM599 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM599 RNA, herein designated VGAM RNA, binds complementarily to one or more host target binding sites located in untranslated regions of VGAM599 host target RNA, herein designated VGAM HOST TARGET RNA. This complementary binding is due to the fact that the nucleotide sequence of VGAM599 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM599 RNA, herein designated VGAM RNA, may have a different number of host target binding sites in untranslated regions of a VGAM599 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM599 RNA, herein designated VGAM RNA, to host target binding sites on VGAM599 host target RNA, herein designated VGAM HOST TARGET RNA, such as BINDING SITE I, BINDING SITE II and BINDING SITE III, inhibits translation of VGAM599 host target RNA into VGAM599 host target protein, herein designated VGAM HOST TARGET PROTEIN. VGAM host target protein is therefore outlined by a broken line.

It is appreciated that VGAM599 host target gene, herein designated VGAM HOST TARGET GENE, in fact represents a plurality of VGAM599 host target genes. The mRNA of each one of this plurality of VGAM599 host target genes comprises one or more host target binding sites, each having a nucleotide sequence which is at least partly complementary to VGAM599 RNA, herein designated VGAM RNA, and which when bound by VGAM599 RNA causes inhibition of translation of respective one or more VGAM599 host target proteins.

It is further appreciated by one skilled in the art that the mode of translational inhibition illustrated by FIG. 1 with specific reference to translational inhibition exerted by VGAM599 gene, herein designated VGAM GENE, on one or more VGAM599 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM599 is inhibition of expression of host target genes, as part of a novel viral mechanism of attacking a host. Accordingly, utilities of VGAM599 include diagnosis, prevention and treatment of viral infection by Transmissible Gastroenteritis Virus. Specific functions, and accordingly utilities, of VGAM599 correlate with, and may be deduced from, the identity of the host target genes which VGAM599 binds and inhibits, and the function of these host target genes, as elaborated hereinbelow.

Nucleotide sequences of the VGAM599 precursor RNA, herein designated VGAM PRECURSOR RNA, and of the 'diced' VGAM599 RNA, herein designated VGAM RNA, and a schematic representation of the secondary folding of VGAM599 folded precursor RNA, herein designated VGAM FOLDED PRECURSOR RNA, of VGAM599 are further described hereinbelow with reference to Table 1.

Nucleotide sequences of host target binding sites, such as BINDING SITE-I, BINDING SITE-II and BINDING SITE-III of FIG. 1, found on VGAM599 host target RNA, and schematic representation of the complementarity of each of these host target binding sites to VGAM599 RNA, herein designated VGAM RNA, are described hereinbelow with reference to Table 2.

As mentioned hereinabove with reference to FIG. 1, a function of VGAM599 gene, herein designated VGAM is inhibition of expression of VGAM599 target genes. It is appreciated that specific functions, and accordingly utilities, of VGAM599 correlate with, and may be deduced from, the identity of the target genes which VGAM599 binds and inhibits, and the function of these target genes, as elaborated hereinbelow.

Adducin 3 (gamma) (ADD3, Accession NM_016824) is a VGAM599 host target gene. ADD3 BINDING SITE is HOST TARGET binding site found in the 3' untranslated region of mRNA encoded by ADD3, corresponding to a HOST TARGET binding site such as BINDING SITE I, BINDING SITE II or BINDING SITE III. Table 2 illustrates the complementarity of the nucleotide sequences of ADD3 BINDING SITE, designated SEQ ID:18819, to the nucleotide sequence of VGAM599 RNA, herein designated VGAM RNA, also designated SEQ ID:3310.

A function of VGAM599 is therefore inhibition of Adducin 3 (gamma) (ADD3, Accession NM_016824), a gene which membrane-cytoskeleton-associated protein that promotes the assembly of the spectrin-actin network. Accordingly, utilities of VGAM599 include diagnosis, prevention and treatment of diseases and clinical conditions associated with ADD3. The function of ADD3 and its association with various diseases and clinical conditions, has been established by previous studies, as described hereinabove with reference to VGAM579. Chloride Channel 6 (CLCN6, Accession NM_021735) is another VGAM599 host target gene. CLCN6 BINDING SITE1 through CLCN6 BINDING SITE3 are HOST TARGET binding sites found in untranslated regions of mRNA encoded by CLCN6, corresponding to HOST TARGET binding sites such as BINDING SITE I, BINDING SITE II or BINDING SITE III. Table 2 illustrates the complementarity of the nucleotide sequences of CLCN6 BINDING SITE1 through CLCN6 BINDING SITE3, designated SEQ ID:22339, SEQ ID:22344 and SEQ ID:6962 respectively, to the nucleotide sequence of VGAM599 RNA, herein designated VGAM RNA, also designated SEQ ID:3310.

Another function of VGAM599 is therefore inhibition of Chloride Channel 6 (CLCN6, Accession NM_021735), a gene which is a voltage-gated chloride channel. Accordingly, utilities of VGAM599 include diagnosis, prevention and treatment of diseases and clinical conditions associated with CLCN6. The function of CLCN6 has been established by previous studies. Members of the mammalian CLCN family of voltage-gated chloride channels display differential tissue distribution and perform diverse functions. Nomura et al. (1994) identified a partial human CLCN6 cDNA, which they called KIAA0046. Northern blot analysis revealed that CLCN6 was expressed widely. Using the partial cDNA sequence of Nomura et al. (1994), Brandt and Jentsch (1995) cloned human cerebral cortex cDNAs that covered the entire CLCN6 coding region. The predicted 869-amino acid protein was called CLC6 by them. The amino acid sequence of CLCN6 is 45% identical to that of CLCN7 (OMIM Ref. No. 602727) but only 23 to 29% identical to the sequences of other known CLCNs. Therefore, Brandt and Jentsch (1995) stated that CLCN6 and CLCN7 together define a new branch of the chloride channel protein family. By Northern blot analysis, Brandt and Jentsch (1995) found that CLCN6 was expressed as an approximately 6-kb mRNA in all tissues examined. Eggermont et al. (1997) identified 4 different CLCN6 cDNAs that represent alternatively spliced transcripts. Nomura et al. (1994) mapped the CLCN6 gene to chromosome 1 using a somatic cell hybrid panel. By fluorescence in situ hybridization, Brandt and Jentsch (1995) refined the localization of the CLCN6 gene to 1p36. They noted that 2 genes encoding kidney-specific chloride channels, CLCNKA (OMIM Ref. No. 602024) and CLCNKB (OMIM Ref. No. 602023), also map to 1p36.

Full details of the abovementioned studies are described in the following publications, the disclosure of which are hereby incorporated by reference:

REFERENCES 1. Brandt, S.; Jentsch, T. J.: ClC-6 and ClC-7 are two novel broadly expressed members of the CLC chloride channel family. FEBS Lett. 377:15-20, 1995; and Eggermont, J.; Buyse, G.; Voets, T.; Tytgat, J.; De Smedt, H.; Droogmans, G.: Alternative splicing of ClC-6 (a member of the ClC chloride-channel family) transcripts generates three tr.

Further studies establishing the function and utilities of CLCN6 are found in John Hopkins OMIM database record ID 602726, and in sited publications numbered 8588-858 and 2255 listed in the bibliography section hereinbelow, which are also hereby incorporated by reference. MAD2 Mitotic Arrest Deficient-like 1 (yeast) (MAD2L1, Accession NM_002358) is another VGAM599 host target gene. MAD2L1 BINDING SITE is HOST TARGET binding site found in the 3' untranslated region of mRNA encoded by MAD2L1, corresponding to a HOST TARGET binding site such as BINDING SITE I, BINDING SITE II or BINDING SITE III. Table 2 illustrates the complementarity of the nucleotide sequences of MAD2L1 BINDING SITE, designated SEQ ID:8171, to the nucleotide sequence of VGAM599 RNA, herein designated VGAM RNA, also designated SEQ ID:3310.

Another function of VGAM599 is therefore inhibition of MAD2 Mitotic Arrest Deficient-like 1 (yeast) (MAD2L1, Accession NM_002358), a gene which may monitor the completeness of the spindle-kinetochore attachment. delays the onset of anaphase when this process is not complete. Accordingly, utilities of VGAM599 include diagnosis, prevention and treatment of diseases and clinical conditions associated with MAD2L1. The function of MAD2L1 and its association with various diseases and clinical conditions, has been established by previous studies, as described hereinabove with reference to VGAM176. Origin Recognition Complex, Subunit 4-like (yeast) (ORC4L, Accession XM_030582) is another VGAM599 host target gene. ORC4L BINDING SITE is HOST TARGET binding site found in the 3' untranslated region of mRNA encoded by ORC4L, corresponding to a HOST TARGET binding site such as BINDING SITE I, BINDING SITE II or BINDING SITE III. Table 2 illustrates the complementarity of the nucleotide sequences of ORC4L BINDING SITE, designated SEQ ID:31091, to the nucleotide sequence of VGAM599 RNA, herein designated VGAM RNA, also designated SEQ ID:3310.

Another function of VGAM599 is therefore inhibition of Origin Recognition Complex, Subunit 4-like (yeast) (ORC4L, Accession XM_030582), a gene which may be required for initiation of DNA replication and has a putative nucleotide triphosphate binding motif. Accordingly, utilities of VGAM599 include diagnosis, prevention and treatment of diseases and clinical conditions associated with ORC4L. The function of ORC4L has been established by previous studies. In S. cerevisiae, sites at which DNA replication initiates are recognized by a 6-subunit origin recognition complex (ORC). The yeast ORC components have been designated ORC1 to 6. By searching an expressed sequence tag database, Quintana et al. (1997) identified mouse and human cDNAs with homology to yeast ORC4. The predicted 436-amino acid human ORC4L protein, which they called HsORC4P, shares 29% sequence identity with yeast ORC4. Antibodies against ORC4L detected a 45-kD doublet on immunoblots of human cell lysates. Immunoprecipitation studies revealed that ORC4L associates with multiple cellular proteins, including ORC2L (OMIM Ref. No. 601182), in vivo. By analysis of somatic cell hybrids and by fluorescence in situ hybridization, Eki et al. (1998) mapped the ORC4L gene to 2q22-q23.

Full details of the abovementioned studies are described in the following publications, the disclosure of which are hereby incorporated by reference:

Eki, T.; Dean, F. B.; Kohda, A.; Okumura, K.; Abe, M.; Murakami, Y.; Ishiai, M.; Satomoto, K.; Hurwitz, J.; O'Donnell, M.; Hanaoka, F.: Assignment1 of the homologue of the yeast origin recognition complex subunit ORC4 (ORC4L) to human chromosome band 2q22-q23 by in situ hybridization and somatic cell hybrid analysis. Cytogenet. Cell Genet. 81:89-90, 1998; and Quintana, D. G.; Hou, Z.; Thome, K. C.; Hendricks, M.; Saha, P.; Dutta, A.: Identification of HsORC4, a member of the human origin of replication recognition complex. J. Biol. Chem. 27.

Further studies establishing the function and utilities of ORC4L are found in John Hopkins OMIM database record ID 603056, and in sited publications numbered 8481 listed in the bibliography section hereinbelow, which are also hereby incorporated by reference. RNA Binding Motif Protein 3 (RBM3, Accession XM_047024) is another VGAM599 host target gene. RBM3 BINDING SITE is HOST TARGET binding site found in the 5' untranslated region of mRNA encoded by RBM3, corresponding to a HOST TARGET binding site such as BINDING SITE I, BINDING SITE II or BINDING SITE III. Table 2 illustrates the complementarity of the nucleotide sequences of RBM3 BINDING SITE, designated SEQ ID:34894, to the nucleotide sequence of VGAM599 RNA, herein designated VGAM RNA, also designated SEQ ID:3310.

Another function of VGAM599 is therefore inhibition of RNA Binding Motif Protein 3 (RBM3, Accession XM_047024). Accordingly, utilities of VGAM599 include diagnosis, prevention and treatment of diseases and clinical conditions associated with RBM3. Transforming Growth Factor, Beta Receptor I (activin A receptor type II-like kinase, 53 kDa) (TGFBR1, Accession NM_004612) is another VGAM599 host target gene. TGFBR1 BINDING SITE is HOST TARGET binding site found in the 3' untranslated region of mRNA encoded by TGFBR1, corresponding to a HOST TARGET binding site such as BINDING SITE I, BINDING SITE II or BINDING SITE III. Table 2 illustrates the complementarity of the nucleotide sequences of TGFBR1 BINDING SITE, designated SEQ ID:10951, to the nucleotide sequence of VGAM599 RNA, herein designated VGAM RNA, also designated SEQ ID:3310.

Another function of VGAM599 is therefore inhibition of Transforming Growth Factor, Beta Receptor I (activin A receptor type II-like kinase, 53 kDa) (TGFBR1, Accession NM_004612), a gene which forms a complex with TGF beta type II receptor and acts as signal transducer. Accordingly, utilities of VGAM599 include diagnosis, prevention and treatment of diseases and clinical conditions associated with TGFBR1. The function of TGFBR1 has been established by previous studies. Ebner et al. (1993) cloned a murine serine/threonine kinase receptor that shares a conserved extracellular domain with the type II TGF-beta receptor. Overexpression of this receptor alone did not increase cell surface binding of TGF-beta, but coexpression with the type II TGF-beta receptor caused TGF-beta to bind to this receptor, which had the size of the type I TGF-beta receptor. Overexpression of this newly cloned receptor inhibited binding of TGF-beta to the type II receptor in a dominant-negative fashion. Combinatorial interactions and stoichiometric ratios between the type I and II receptors may therefore determine the extent of TGF-beta binding and the resulting biologic activities. Wang et al. (1994) reported that the type I receptor may be a natural ligand for immunophilin FKBP12 (OMIM Ref. No. 186945). The membrane-bound protein encoded by TGFBR1 binds TGF-beta and forms a heterodimeric complex with the TGF-beta II receptor. Ligand binding by TGF-beta I receptors is dependent on coexpression with type II receptors. Type II receptors alone can bind ligand, but require association with type I receptors for activation of their kinase (signaling) function. Johnson et al. (1995) used PCR with a hybrid cell DNA panel and FISH to localize the TGFBR1 gene to 9q33-q34. By FISH, Pasche et al. (1998) localized the gene to 9q22. Kuan and Kono (1998) mapped the Tgfbr1 gene to mouse chromosome 4. TGFB stimulation leads to phosphorylation and activation of SMAD2 (OMIM Ref. No. 601366) and SMAD3 (OMIM Ref. No. 603109), which form complexes with SMAD4 (OMIM Ref. No. 600993) that accumulate in the nucleus and regulate transcription of target genes. Inman et al. (2002) demonstrated that following TGFB stimulation of epithelial cells, receptors remain active for at least 3 to 4 hours, and continuous receptor activity is required to maintain active SMADs in the nucleus and for TGFB-induced transcription. Continuous nucleocytoplasmic shuttling of the SMADs during active TGFB signaling provides the mechanism whereby the intracellular transducers of the signal continuously monitor receptor activity. These data explain how, at all times, the concentration of active SMADs in the nucleus is directly dictated by the levels of activated receptors in the cytoplasm.

Full details of the abovementioned studies are described in the following publications, the disclosure of which are hereby incorporated by reference:

Ebner, R.; Chen, R.-H.; Shum, L.; Lawler, S.; Zioncheck, T. F.; Lee, A.; Lopez, A. R.; Derynck, R.: Cloning of a type I TGF-beta receptor and its effect on TGF-beta binding to the type II receptor. Science 260:1344-1348, 1993; and Inman, G. J.; Nicolas, F. J.; Hill, C. S.: Nucleocytoplasmic shuttling of Smads 2, 3, and 4 permits sensing of TGF-beta receptor activity. Molec. Cell 10:283-294, 2002.

Further studies establishing the function and utilities of TGFBR1 are found in John Hopkins OMIM database record ID 190181, and in sited publications numbered 2504-2509, 114 and 10040 listed in the bibliography section hereinbelow, which are also hereby incorporated by reference. Potassium Large Conductance Calcium-activated Channel, Subfamily M, Beta Member 2 (KCNMB2, Accession NM_005832) is another VGAM599 host target gene. KCNMB2 BINDING SITE is HOST TARGET binding site found in the 3' untranslated region of mRNA encoded by KCNMB2, corresponding to a HOST TARGET binding site such as BINDING SITE I, BINDING SITE II or BINDING SITE III. Table 2 illustrates the complementarity of the nucleotide sequences of KCNMB2 BINDING SITE, designated SEQ ID:12447, to the nucleotide sequence of VGAM599 RNA, herein designated VGAM RNA, also designated SEQ ID:3310.

Another function of VGAM599 is therefore inhibition of Potassium Large Conductance Calcium-activated Channel, Subfamily M, Beta Member 2 (KCNMB2, Accession NM_005832). Accordingly, utilities of VGAM599 include diagnosis, prevention and treatment of diseases and clinical conditions associated with KCNMB2. KIAA1627 (Accession XM_087571) is another VGAM599 host target gene. KIAA1627 BINDING SITE is HOST TARGET binding site found in the 3' untranslated region of mRNA encoded by KIAA1627, corresponding to a HOST TARGET binding site such as BINDING SITE I, BINDING SITE II or BINDING SITE III. Table 2 illustrates the complementarity of the nucleotide sequences of KIAA1627 BINDING SITE, designated SEQ ID:39345, to the nucleotide sequence of VGAM599 RNA, herein designated VGAM RNA, also designated SEQ ID:3310.

Another function of VGAM599 is therefore inhibition of KIAA1627 (Accession XM_087571). Accordingly, utilities of VGAM599 include diagnosis, prevention and treatment of diseases and clinical conditions associated with KIAA1627. LOC152573 (Accession XM_087488) is another VGAM599 host target gene. LOC152573 BINDING SITE is HOST TARGET binding site found in the 3' untranslated region of mRNA encoded by LOC152573, corresponding to a HOST TARGET binding site such as BINDING SITE I, BINDING SITE II or BINDING SITE III. Table 2 illustrates the complementarity of the nucleotide sequences of LOC152573 BINDING SITE, designated SEQ ID:39289, to the nucleotide sequence of VGAM599 RNA, herein designated VGAM RNA, also designated SEQ ID:3310.

Another function of VGAM599 is therefore inhibition of LOC152573 (Accession XM_087488). Accordingly, utilities of VGAM599 include diagnosis, prevention and treatment of diseases and clinical conditions associated with LOC152573. LOC202451 (Accession XM_117401) is another VGAM599 host target gene. LOC202451 BINDING SITE is HOST TARGET binding site found in the 5' untranslated region of mRNA encoded by LOC202451, corresponding to a HOST TARGET binding site such as BINDING SITE I, BINDING SITE II or BINDING SITE III. Table 2 illustrates the complementarity of the nucleotide sequences of LOC202451 BINDING SITE, designated SEQ ID:43440, to the nucleotide sequence of VGAM599 RNA, herein designated VGAM RNA, also designated SEQ ID:3310.

Another function of VGAM599 is therefore inhibition of LOC202451 (Accession XM_117401). Accordingly, utilities of VGAM599 include diagnosis, prevention and treatment of diseases and clinical conditions associated with LOC202451. LOC253039 (Accession XM_171203) is another VGAM599 host target gene. LOC253039 BINDING SITE is HOST TARGET binding site found in the 3' untranslated region of mRNA encoded by LOC253039, corresponding to a HOST TARGET binding site such as BINDING SITE I, BINDING SITE II or BINDING SITE III. Table 2 illustrates the complementarity of the nucleotide sequences of LOC253039 BINDING SITE, designated SEQ ID:45994, to the nucleotide sequence of VGAM599 RNA, herein designated VGAM RNA, also designated SEQ ID:3310.

Another function of VGAM599 is therefore inhibition of LOC253039 (Accession XM_171203). Accordingly, utilities of VGAM599 include diagnosis, prevention and treatment of diseases and clinical conditions associated with LOC253039. LOC253782 (Accession XM_171023) is another VGAM599 host target gene. LOC253782 BINDING SITE is HOST TARGET binding site found in the 3' untranslated region of mRNA encoded by LOC253782, corresponding to a HOST TARGET binding site such as BINDING SITE I, BINDING SITE II or BINDING SITE III. Table 2 illustrates the complementarity of the nucleotide sequences of LOC253782 BINDING SITE, designated SEQ ID:45800, to the nucleotide sequence of VGAM599 RNA, herein designated VGAM RNA, also designated SEQ ID:3310.

Another function of VGAM599 is therefore inhibition of LOC253782 (Accession XM_171023). Accordingly, utilities of VGAM599 include diagnosis, prevention and treatment of diseases and clinical conditions associated with LOC253782. LOC91801 (Accession NM_138775) is another VGAM599 host target gene. LOC91801 BINDING SITE is HOST TARGET binding site found in the 3' untranslated region of mRNA encoded by LOC91801, corresponding to a HOST TARGET binding site such as BINDING SITE I, BINDING SITE II or BINDING SITE III. Table 2 illustrates the complementarity of the nucleotide sequences of LOC91801 BINDING SITE, designated SEQ ID:29010, to the nucleotide sequence of VGAM599 RNA, herein designated VGAM RNA, also designated SEQ ID:3310.

Another function of VGAM599 is therefore inhibition of LOC91801 (Accession NM_138775). Accordingly, utilities of VGAM599 include diagnosis, prevention and treatment of diseases and clinical conditions associated with LOC91801. FIG. 1 further provides a conceptual description of a novel bioinformatically detected viral gene of the present invention, referred to here as Viral Genomic Address Messenger 600 (VGAM600) viral gene, which modulates expression of respective host target genes thereof, the function and utility of which host target genes is known in the art.

VGAM600 is a novel bioinformatically detected regulatory, non protein coding, viral micro RNA (miRNA) gene. The method by which VGAM600 was detected is described hereinabove with reference to FIGS. 1-8.

VGAM600 gene, herein designated VGAM GENE, is a viral gene contained in the genome of Transmissible Gastroenteritis Virus. VGAM600 host target gene, herein designated VGAM HOST TARGET GENE, is a human gene contained in the human genome.

VGAM600 gene encodes a VGAM600 precursor RNA, herein designated VGAM PRECURSOR RNA. Similar to other miRNA genes, and unlike most ordinary genes, VGAM600 precursor RNA does not encode a protein. A nucleotide sequence identical or highly similar to the nucleotide sequence of VGAM600 precursor RNA is designated SEQ ID:586, and is provided hereinbelow with reference to the sequence listing part. Nucleotide sequence SEQ ID:586 is located at position 5005 relative to the genome of Transmissible Gastroenteritis Virus.

VGAM600 precursor RNA folds onto itself, forming VGAM600 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM600 folded precursor RNA into VGAM600 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM600 RNA is designated SEQ ID:3311, and is provided hereinbelow with reference to the sequence listing part.

VGAM600 host target gene, herein designated VGAM HOST TARGET GENE, encodes a corresponding messenger RNA, VGAM600 host target RNA, herein designated VGAM HOST TARGET RNA. VGAM600 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM600 RNA, herein designated VGAM RNA, binds complementarily to one or more host target binding sites located in untranslated regions of VGAM600 host target RNA, herein designated VGAM HOST TARGET RNA. This complementary binding is due to the fact that the nucleotide sequence of VGAM600 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM600 RNA, herein designated VGAM RNA, may have a different number of host target binding sites in untranslated regions of a VGAM600 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM600 RNA, herein designated VGAM RNA, to host target binding sites on VGAM600 host target RNA, herein designated VGAM HOST TARGET RNA, such as BINDING SITE I, BINDING SITE II and BINDING SITE III, inhibits translation of VGAM600 host target RNA into VGAM600 host target protein, herein designated VGAM HOST TARGET PROTEIN. VGAM host target protein is therefore outlined by a broken line.

It is appreciated that VGAM600 host target gene, herein designated VGAM HOST TARGET GENE, in fact represents a plurality of VGAM600 host target genes. The mRNA of each one of this plurality of VGAM600 host target genes comprises one or more host target binding sites, each having a nucleotide sequence which is at least partly complementary to VGAM600 RNA, herein designated VGAM RNA, and which when bound by VGAM600 RNA causes inhibition of translation of respective one or more VGAM600 host target proteins.

It is further appreciated by one skilled in the art that the mode of translational inhibition illustrated by FIG. 1 with specific reference to translational inhibition exerted by VGAM600 gene, herein designated VGAM GENE, on one or more VGAM600 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM600 is inhibition of expression of host target genes, as part of a novel viral mechanism of attacking a host. Accordingly, utilities of VGAM600 include diagnosis, prevention and treatment of viral infection by Transmissible Gastroenteritis Virus. Specific functions, and accordingly utilities, of VGAM600 correlate with, and may be deduced from, the identity of the host target genes which VGAM600 binds and inhibits, and the function of these host target genes, as elaborated hereinbelow.

Nucleotide sequences of the VGAM600 precursor RNA, herein designated VGAM PRECURSOR RNA, and of the 'diced' VGAM600 RNA, herein designated VGAM RNA, and a schematic representation of the secondary folding of VGAM600 folded precursor RNA, herein designated VGAM FOLDED PRECURSOR RNA, of VGAM600 are further described hereinbelow with reference to Table 1.

Nucleotide sequences of host target binding sites, such as BINDING SITE-I, BINDING SITE-II and BINDING SITE-III of FIG. 1, found on VGAM600 host target RNA, and schematic representation of the complementarity of each of these host target binding sites to VGAM600 RNA, herein designated VGAM RNA, are described hereinbelow with reference to Table 2.

As mentioned hereinabove with reference to FIG. 1, a function of VGAM600 gene, herein designated VGAM is inhibition of expression of VGAM600 target genes. It is appreciated that specific functions, and accordingly utilities, of VGAM600 correlate with, and may be deduced from, the identity of the target genes which VGAM600 binds and inhibits, and the function of these target genes, as elaborated hereinbelow.

Activation-induced Cytidine Deaminase (AICDA, Accession NM_020661) is a VGAM600 host target gene. AICDA BINDING SITE is HOST TARGET binding site found in the 3' untranslated region of mRNA encoded by AICDA, corresponding to a HOST TARGET binding site such as BINDING SITE I, BINDING SITE II or BINDING SITE III. Table 2 illustrates the complementarity of the nucleotide sequences of AICDA BINDING SITE, designated SEQ ID:21832, to the nucleotide sequence of VGAM600 RNA, herein designated VGAM RNA, also designated SEQ ID:3311.

A function of VGAM600 is therefore inhibition of Activation-induced Cytidine Deaminase (AICDA, Accession NM_020661), a gene which a member of the cytidine deaminase family. Accordingly, utilities of VGAM600 include diagnosis, prevention and treatment of diseases and clinical conditions associated with AICDA. The function of AICDA has been established by previous studies. Muramatsu et al. (1999) isolated the gene encoding activation-induced cytidine deaminase (Aid), a member of the cytidine deaminase family, from a murine B-cell lymphoma line induced by combined stimulation of transforming growth factor-beta (TGFB; 190180), interleukin-4 (IL4; 147780), and CD40 ligand (CD40L; 300386). Muto et al. (2000) isolated the human AID gene, which encodes a 198-amino acid protein containing a conserved cytidine deaminase motif. The human AID protein shares 92% amino acid identity with mouse Aid. RT-PCR analysis of 15 human tissues detected strong expression of AID mRNA in lymph nodes and tonsils. Petersen-Mahrt et al. (2002) hypothesized that the 3 gene diversification processes mediated by AICDA, somatic hypermutation, gene conversion, and class-switch recombination, may be initiated by DNA lesions at dC/dG pairs by AICDA, which has sequence homology to the RNA editing enzyme APOBEC1 (OMIM Ref. No. 600130). Expression of AICDA in E. coli confers a mutator phenotype yielding nucleotide transitions at dC/dG in a context-dependent manner. The mutation triggered by AICDA is enhanced by a deficiency of uracil-DNA glycosylase (UNG; 191525), indicating that AICDA functions by deaminating dC residues in DNA. Petersen-Mahrt et al. (2002) proposed that diversification of functional Ig genes is triggered by AICDA-mediated deamination of dC residues in the Ig locus with the outcome, i.e., hypermutation phases 1 and 2, gene conversion, or switch recombination, dependent on the way in which the initiating dU/dG lesion is resolved. Muto et al. (2000) mapped the AID gene to 12p13 by FISH. Animal model experiments lend further support to the function of AICDA. Muramatsu et al. (2000) found that in the mouse, Aid deficiency caused a complete defect in class switching and showed a hyper-IgM phenotype with enlarged germinal centers containing strongly activated B cells before or after immunization. Mouse Aid -/- spleen cells stimulated in vitro with lipopolysaccharide (LPS) and cytokines failed to undergo CSR, although they expressed germline transcripts.

It is appreciated that the abovementioned animal model for AICDA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Muramatsu, M.; Sankaranand, V. S.; Anant, S.; Sugai, M.; Kinoshita, K.; Davidson, N. O.; Honjo, T.: Specific expression of activation-induced cytidine deaminase (AID), a novel member of the RNA-editing deaminase family in germinal center B cells. J. Biol. Chem. 274:18470-18476, 1999; and Muramatsu, M.; Kinoshita, K.; Fagarasan, S.; Yamada, S.; Shinkai, Y.; Honjo, T.: Class switch recombination and hypermutation require activation-induced cytidine deaminase (AID), a pot.

Further studies establishing the function and utilities of AICDA are found in John Hopkins OMIM database record ID 605257, and in sited publications numbered 4410-4413, 479 and 9131-2317 listed in the bibliography section hereinbelow, which are also hereby incorporated by reference. Coagulation Factor II (thrombin) Receptor (F2R, Accession NM_001992) is another VGAM600 host target gene. F2R BINDING SITE is HOST TARGET binding site found in the 3' untranslated region of mRNA encoded by F2R, corresponding to a HOST TARGET binding site such as BINDING SITE I, BINDING SITE II or BINDING SITE III. Table 2 illustrates the complementarity of the nucleotide sequences of F2R BINDING SITE, designated SEQ ID:7724, to the nucleotide sequence of VGAM600 RNA, herein designated VGAM RNA, also designated SEQ ID:3311.

Another function of VGAM600 is therefore inhibition of Coagulation Factor II (thrombin) Receptor (F2R, Accession NM_001992), a gene which Thrombin receptor; G protein-coupled receptor involved in platelet activation. Accordingly, utilities of VGAM600 include diagnosis, prevention and treatment of diseases and clinical conditions associated with F2R. The function of F2R and its association with various diseases and clinical conditions, has been established by previous studies, as described hereinabove with reference to VGAM140. Rho-associated, Coiled-coil Containing Protein Kinase 2 (ROCK2, Accession XM_038377) is another VGAM600 host target gene. ROCK2 BINDING SITE is HOST TARGET binding site found in the 3' untranslated region of mRNA encoded by ROCK2, corresponding to a HOST TARGET binding site such as BINDING SITE I, BINDING SITE II or BINDING SITE III. Table 2 illustrates the complementarity of the nucleotide sequences of ROCK2 BINDING SITE, designated SEQ ID:32837, to the nucleotide sequence of VGAM600 RNA, herein designated VGAM RNA, also designated SEQ ID:3311.

Another function of VGAM600 is therefore inhibition of Rho-associated, Coiled-coil Containing Protein Kinase 2 (ROCK2, Accession XM_038377), a gene which regulates cytokinesis, smooth muscle contraction, the formation of actin stress fibers and focal adhesions. Accordingly, utilities of VGAM600 include diagnosis, prevention and treatment of diseases and clinical conditions associated with ROCK2. The function of ROCK2 and its association with various diseases and clinical conditions, has been established by previous studies, as described hereinabove with reference to VGAM273. AP1 Gamma Subunit Binding Protein 1 (AP1GBP1, Accession NM_080551) is another VGAM600 host target gene. AP1GBP1 BINDING SITE is HOST TARGET binding site found in the 3' untranslated region of mRNA encoded by AP1GBP1, corresponding to a HOST TARGET binding site such as BINDING SITE I, BINDING SITE II or BINDING SITE III. Table 2 illustrates the complementarity of the nucleotide sequences of AP1GBP1 BINDING SITE, designated SEQ ID:27878, to the nucleotide sequence of VGAM600 RNA, herein designated VGAM RNA, also designated SEQ ID:3311.

Another function of VGAM600 is therefore inhibition of AP1 Gamma Subunit Binding Protein 1 (AP1GBP1, Accession NM_080551). Accordingly, utilities of VGAM600 include diagnosis, prevention and treatment of diseases and clinical conditions associated with AP1GBP1. ARSDR1 (Accession NM_016026) is another VGAM600 host target gene. ARSDR1 BINDING SITE is HOST TARGET binding site found in the 3' untranslated region of mRNA encoded by ARSDR1, corresponding to a HOST TARGET binding site such as BINDING SITE I, BINDING SITE II or BINDING SITE III. Table 2 illustrates the complementarity of the nucleotide sequences of ARSDR1 BINDING SITE, designated SEQ ID:18109, to the nucleotide sequence of VGAM600 RNA, herein designated VGAM RNA, also designated SEQ ID:3311.

Another function of VGAM600 is therefore inhibition of ARSDR1 (Accession NM_016026). Accordingly, utilities of VGAM600 include diagnosis, prevention and treatment of diseases and clinical conditions associated with ARSDR1. FLJ12688 (Accession XM_055071) is another VGAM600 host target gene. FLJ12688 BINDING SITE is HOST TARGET binding site found in the 3' untranslated region of mRNA encoded by FLJ12688, corresponding to a HOST TARGET binding site such as BINDING SITE I, BINDING SITE II or BINDING SITE III. Table 2 illustrates the complementarity of the nucleotide sequences of FLJ12688 BINDING SITE, designated SEQ ID:36221, to the nucleotide sequence of VGAM600 RNA, herein designated VGAM RNA, also designated SEQ ID:3311.

Another function of VGAM600 is therefore inhibition of FLJ12688 (Accession XM_055071). Accordingly, utilities of VGAM600 include diagnosis, prevention and treatment of diseases and clinical conditions associated with FLJ12688. FLJ23042 (Accession NM_025157) is another VGAM600 host target gene. FLJ23042 BINDING SITE is HOST TARGET binding site found in the 3' untranslated region of mRNA encoded by FLJ23042, corresponding to a HOST TARGET binding site such as BINDING SITE I, BINDING SITE II or BINDING SITE III. Table 2 illustrates the complementarity of the nucleotide sequences of FLJ23042 BINDING SITE, designated SEQ ID:24795, to the nucleotide sequence of VGAM600 RNA, herein designated VGAM RNA, also designated SEQ ID:3311.

Another function of VGAM600 is therefore inhibition of FLJ23042 (Accession NM_025157). Accordingly, utilities of VGAM600 include diagnosis, prevention and treatment of diseases and clinical conditions associated with FLJ23042. KIAA0391 (Accession NM_014672) is another VGAM600 host target gene. KIAA0391 BINDING SITE is HOST TARGET binding site found in the 3' untranslated region of mRNA encoded by KIAA0391, corresponding to a HOST TARGET binding site such as BINDING SITE I, BINDING SITE II or BINDING SITE III. Table 2 illustrates the complementarity of the nucleotide sequences of KIAA0391 BINDING SITE, designated SEQ ID:16141, to the nucleotide sequence of VGAM600 RNA, herein designated VGAM RNA, also designated SEQ ID:3311.

Another function of VGAM600 is therefore inhibition of KIAA0391 (Accession NM_014672). Accordingly, utilities of VGAM600 include diagnosis, prevention and treatment of diseases and clinical conditions associated with KIAA0391. KIAA1364 (Accession XM_032997) is another VGAM600 host target gene. KIAA1364 BINDING SITE is HOST TARGET binding site found in the 3' untranslated region of mRNA encoded by KIAA1364, corresponding to a HOST TARGET binding site such as BINDING SITE I, BINDING SITE II or BINDING SITE III. Table 2 illustrates the complementarity of the nucleotide sequences of KIAA1364 BINDING SITE, designated SEQ ID:31812, to the nucleotide sequence of VGAM600 RNA, herein designated VGAM RNA, also designated SEQ ID:3311.

Another function of VGAM600 is therefore inhibition of KIAA1364 (Accession XM_032997). Accordingly, utilities of VGAM600 include diagnosis, prevention and treatment of diseases and clinical conditions associated with KIAA1364. KIAA1586 (Accession XM_166451) is another VGAM600 host target gene. KIAA1586 BINDING SITE is HOST TARGET binding site found in the 5' untranslated region of mRNA encoded by KIAA1586, corresponding to a HOST TARGET binding site such as BINDING SITE I, BINDING SITE II or BINDING SITE III. Table 2 illustrates the complementarity of the nucleotide sequences of KIAA1586 BINDING SITE, designated SEQ ID:44348, to the nucleotide sequence of VGAM600 RNA, herein designated VGAM RNA, also designated SEQ ID:3311.

Another function of VGAM600 is therefore inhibition of KIAA1586 (Accession XM_166451). Accordingly, utilities of VGAM600 include diagnosis, prevention and treatment of diseases and clinical conditions associated with KIAA1586. MGC13017 (Accession NM_080656) is another VGAM600 host target gene. MGC13017 BINDING SITE is HOST TARGET binding site found in the 3' untranslated region of mRNA encoded by MGC13017, corresponding to a HOST TARGET binding site such as BINDING SITE I, BINDING SITE II or BINDING SITE III. Table 2 illustrates the complementarity of the nucleotide sequences of MGC13017 BINDING SITE, designated SEQ ID:27945, to the nucleotide sequence of VGAM600 RNA, herein designated VGAM RNA, also designated SEQ ID:3311.

Another function of VGAM600 is therefore inhibition of MGC13017 (Accession NM_080656). Accordingly, utilities of VGAM600 include diagnosis, prevention and treatment of diseases and clinical conditions associated with MGC13017. Protein Tyrosine Phosphatase, Non-receptor Type Substrate 1 (PTPNS1, Accession NM_080792) is another VGAM600 host target gene. PTPNS1 BINDING SITE is HOST TARGET binding site found in the 3' untranslated region of mRNA encoded by PTPNS1, corresponding to a HOST TARGET binding site such as BINDING SITE I, BINDING SITE II or BINDING SITE III. Table 2 illustrates the complementarity of the nucleotide sequences of PTPNS1 BINDING SITE, designated SEQ ID:28057, to the nucleotide sequence of VGAM600 RNA, herein designated VGAM RNA, also designated SEQ ID:3311.

Another function of VGAM600 is therefore inhibition of Protein Tyrosine Phosphatase, Non-receptor Type Substrate 1 (PTPNS1, Accession NM_080792). Accordingly, utilities of VGAM600 include diagnosis, prevention and treatment of diseases and clinical conditions associated with PTPNS1. RoXaN (Accession NM_025013) is another VGAM600 host target gene. RoXaN BINDING SITE is HOST TARGET binding site found in the 3' untranslated region of mRNA encoded by RoXaN, corresponding to a HOST TARGET binding site such as BINDING SITE I, BINDING SITE II or BINDING SITE III. Table 2 illustrates the complementarity of the nucleotide sequences of RoXaN BINDING SITE, designated SEQ ID:24601, to the nucleotide sequence of VGAM600 RNA, herein designated VGAM RNA, also designated SEQ ID:3311.

Another function of VGAM600 is therefore inhibition of RoXaN (Accession NM_025013). Accordingly, utilities of VGAM600 include diagnosis, prevention and treatment of diseases and clinical conditions associated with RoXaN. LOC148809 (Accession XM_086325) is another VGAM600 host target gene. LOC148809 BINDING SITE is HOST TARGET binding site found in the 5' untranslated region of mRNA encoded by LOC148809, corresponding to a HOST TARGET binding site such as BINDING SITE I, BINDING SITE II or BINDING SITE III. Table 2 illustrates the complementarity of the nucleotide sequences of LOC148809 BINDING SITE, designated SEQ ID:38593, to the nucleotide sequence of VGAM600 RNA, herein designated VGAM RNA, also designated SEQ ID:3311.

Another function of VGAM600 is therefore inhibition of LOC148809 (Accession XM_086325). Accordingly, utilities of VGAM600 include diagnosis, prevention and treatment of diseases and clinical conditions associated with LOC148809. LOC149606 (Accession XM_086600) is another VGAM600 host target gene. LOC149606 BINDING SITE is HOST TARGET binding site found in the 5' untranslated region of mRNA encoded by LOC149606, corresponding to a HOST TARGET binding site such as BINDING SITE I, BINDING SITE II or BINDING SITE III. Table 2 illustrates the complementarity of the nucleotide sequences of LOC149606 BINDING SITE, designated SEQ ID:38784, to the nucleotide sequence of VGAM600 RNA, herein designated VGAM RNA, also designated SEQ ID:3311.

Another function of VGAM600 is therefore inhibition of LOC149606 (Accession XM_086600). Accordingly, utilities of VGAM600 include diagnosis, prevention and treatment of diseases and clinical conditions associated with LOC149606. LOC153579 (Accession XM_087714) is another VGAM600 host target gene. LOC153579 BINDING SITE is HOST TARGET binding site found in the 3' untranslated region of mRNA encoded by LOC153579, corresponding to a HOST TARGET binding site such as BINDING SITE I, BINDING SITE II or BINDING SITE III. Table 2 illustrates the complementarity of the nucleotide sequences of LOC153579 BINDING SITE, designated SEQ ID:39403, to the nucleotide sequence of VGAM600 RNA, herein designated VGAM RNA, also designated SEQ ID:3311.

Another function of VGAM600 is therefore inhibition of LOC153579 (Accession XM_087714). Accordingly, utilities of VGAM600 include diagnosis, prevention and treatment of diseases and clinical conditions associated with LOC153579. LOC200251 (Accession XM_114173) is another VGAM600 host target gene. LOC200251 BINDING SITE is HOST TARGET binding site found in the 5' untranslated region of mRNA encoded by LOC200251, corresponding to a HOST TARGET binding site such as BINDING SITE I, BINDING SITE II or BINDING SITE III. Table 2 illustrates the complementarity of the nucleotide sequences of LOC200251 BINDING SITE, designated SEQ ID:42755, to the nucleotide sequence of VGAM600 RNA, herein designated VGAM RNA, also designated SEQ ID:3311.

Another function of VGAM600 is therefore inhibition of LOC200251 (Accession XM_114173). Accordingly, utilities of VGAM600 include diagnosis, prevention and treatment of diseases and clinical conditions associated with LOC200251. LOC202052 (Accession XM_117355) is another VGAM600 host target gene. LOC202052 BINDING SITE is HOST TARGET binding site found in the 3' untranslated region of mRNA encoded by LOC202052, corresponding to a HOST TARGET binding site such as BINDING SITE I, BINDING SITE II or BINDING SITE III. Table 2 illustrates the complementarity of the nucleotide sequences of LOC202052 BINDING SITE, designated SEQ ID:43406, to the nucleotide sequence of VGAM600 RNA, herein designated VGAM RNA, also designated SEQ ID:3311.

Another function of VGAM600 is therefore inhibition of LOC202052 (Accession XM_117355). Accordingly, utilities of VGAM600 include diagnosis, prevention and treatment of diseases and clinical conditions associated with LOC202052. LOC90092 (Accession XM_028862) is another VGAM600 host target gene. LOC90092 BINDING SITE is HOST TARGET binding site found in the 3' untranslated region of mRNA encoded by LOC90092, corresponding to a HOST TARGET binding site such as BINDING SITE I, BINDING SITE II or BINDING SITE III. Table 2 illustrates the complementarity of the nucleotide sequences of LOC90092 BINDING SITE, designated SEQ ID:30784, to the nucleotide sequence of VGAM600 RNA, herein designated VGAM RNA, also designated SEQ ID:3311.

Another function of VGAM600 is therefore inhibition of LOC90092 (Accession XM_028862). Accordingly, utilities of VGAM600 include diagnosis, prevention and treatment of diseases and clinical conditions associated with LOC90092. FIG. 1 further provides a conceptual description of a novel bioinformatically detected viral gene of the present invention, referred to here as Viral Genomic Address Messenger 601 (VGAM601) viral gene, which modulates expression of respective host target genes thereof, the function and utility of which host target genes is known in the art.

VGAM601 is a novel bioinformatically detected regulatory, non protein coding, viral micro RNA (miRNA) gene. The method by which VGAM601 was detected is described hereinabove with reference to FIGS. 1-8.

VGAM601 gene, herein designated VGAM GENE, is a viral gene contained in the genome of Transmissible Gastroenteritis Virus. VGAM601 host target gene, herein designated VGAM HOST TARGET GENE, is a human gene contained in the human genome.

VGAM601 gene encodes a VGAM601 precursor RNA, herein designated VGAM PRECURSOR RNA. Similar to other miRNA genes, and unlike most ordinary genes, VGAM601 precursor RNA does not encode a protein. A nucleotide sequence identical or highly similar to the nucleotide sequence of VGAM601 precursor RNA is designated SEQ ID:587, and is provided hereinbelow with reference to the sequence listing part. Nucleotide sequence SEQ ID:587 is located at position 10134 relative to the genome of Transmissible Gastroenteritis Virus.

VGAM601 precursor RNA folds onto itself, forming VGAM601 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM601 folded precursor RNA into VGAM601 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM601 RNA is designated SEQ ID:3312, and is provided hereinbelow with reference to the sequence listing part.

VGAM601 host target gene, herein designated VGAM HOST TARGET GENE, encodes a corresponding messenger RNA, VGAM601 host target RNA, herein designated VGAM HOST TARGET RNA. VGAM601 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM601 RNA, herein designated VGAM RNA, binds complementarily to one or more host target binding sites located in untranslated regions of VGAM601 host target RNA, herein designated VGAM HOST TARGET RNA. This complementary binding is due to the fact that the nucleotide sequence of VGAM601 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM601 RNA, herein designated VGAM RNA, may have a different number of host target binding sites in untranslated regions of a VGAM601 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM601 RNA, herein designated VGAM RNA, to host target binding sites on VGAM601 host target RNA, herein designated VGAM HOST TARGET RNA, such as BINDING SITE I, BINDING SITE II and BINDING SITE III, inhibits translation of VGAM601 host target RNA into VGAM601 host target protein, herein designated VGAM HOST TARGET PROTEIN. VGAM host target protein is therefore outlined by a broken line.

It is appreciated that VGAM601 host target gene, herein designated VGAM HOST TARGET GENE, in fact represents a plurality of VGAM601 host target genes. The mRNA of each one of this plurality of VGAM601 host target genes comprises one or more host target binding sites, each having a nucleotide sequence which is at least partly complementary to VGAM601 RNA, herein designated VGAM RNA, and which when bound by VGAM601 RNA causes inhibition of translation of respective one or more VGAM601 host target proteins.

It is further appreciated by one skilled in the art that the mode of translational inhibition illustrated by FIG. 1 with specific reference to translational inhibition exerted by VGAM601 gene, herein designated VGAM GENE, on one or more VGAM601 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM601 is inhibition of expression of host target genes, as part of a novel viral mechanism of attacking a host. Accordingly, utilities of VGAM601 include diagnosis, prevention and treatment of viral infection by Transmissible Gastroenteritis Virus. Specific functions, and accordingly utilities, of VGAM601 correlate with, and may be deduced from, the identity of the host target genes which VGAM601 binds and inhibits, and the function of these host target genes, as elaborated hereinbelow.

Nucleotide sequences of the VGAM601 precursor RNA, herein designated VGAM PRECURSOR RNA, and of the 'diced' VGAM601 RNA, herein designated VGAM RNA, and a schematic representation of the secondary folding of VGAM601 folded precursor RNA, herein designated VGAM FOLDED PRECURSOR RNA, of VGAM601 are further described hereinbelow with reference to Table 1.

Nucleotide sequences of host target binding sites, such as BINDING SITE-I, BINDING SITE-II and BINDING SITE-III of FIG. 1, found on VGAM601 host target RNA, and schematic representation of the complementarity of each of these host target binding sites to VGAM601 RNA, herein designated VGAM RNA, are described hereinbelow with reference to Table 2.

As mentioned hereinabove with reference to FIG. 1, a function of VGAM601 gene, herein designated VGAM is inhibition of expression of VGAM601 target genes. It is appreciated that specific functions, and accordingly utilities, of VGAM601 correlate with, and may be deduced from, the identity of the target genes which VGAM601 binds and inhibits, and the function of these target genes, as elaborated hereinbelow.

Dystrophin (muscular dystrophy, Duchenne and Becker types) (DMD, Accession NM_004013) is a VGAM601 host target gene. DMD BINDING SITE1 through DMD BINDING SITE3 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 through DMD BINDING SITE3, designated SEQ ID:10190, SEQ ID:10217 and SEQ ID:10229 respectively, to the nucleotide sequence of VGAM601 RNA, herein designated VGAM RNA, also designated SEQ ID:3312.

A function of VGAM601 is therefore inhibition of Dystrophin (muscular dystrophy, Duchenne and Becker types) (DMD, Accession NM_004013), a gene which muscular dystrophy. Accordingly, utilities of VGAM601 include diagnosis, prevention and treatment of diseases and clinical conditions associated with DMD. The function of DMD and its association with various diseases and clinical conditions, has been established by previous studies, as described hereinabove with reference to VGAM218. Interleukin 18 Receptor Accessory Protein (IL18RAP, Accession NM_003853) is another VGAM601 host target gene. IL18RAP BINDING SITE is HOST TARGET binding site found in the 5' untranslated region of mRNA encoded by IL18RAP, corresponding to a HOST TARGET binding site such as BINDING SITE I, BINDING SITE II or BINDING SITE III. Table 2 illustrates the complementarity of the nucleotide sequences of IL18RAP BINDING SITE, designated SEQ ID:9948, to the nucleotide sequence of VGAM601 RNA, herein designated VGAM RNA, also designated SEQ ID:3312.

Another function of VGAM601 is therefore inhibition of Interleukin 18 Receptor Accessory Protein (IL18RAP, Accession NM_003853). Accordingly, utilities of VGAM601 include diagnosis, prevention and treatment of diseases and clinical conditions associated with IL18RAP. Asparaginyl-tRNA Synthetase (NARS, Accession NM_004539) is another VGAM601 host target gene. NARS BINDING SITE is HOST TARGET binding site found in the 3' untranslated region of mRNA encoded by NARS, corresponding to a HOST TARGET binding site such as BINDING SITE I, BINDING SITE II or BINDING SITE III. Table 2 illustrates the complementarity of the nucleotide sequences of NARS BINDING SITE, designated SEQ ID:10889, to the nucleotide sequence of VGAM601 RNA, herein designated VGAM RNA, also designated SEQ ID:3312.

Another function of VGAM601 is therefore inhibition of Asparaginyl-tRNA Synthetase (NARS, Accession NM_004539), a gene which is ASPARAGINYL-tRNA SYNTHETASE. Accordingly, utilities of VGAM601 include diagnosis, prevention and treatment of diseases and clinical conditions associated with NARS. The function of NARS has been established by previous studies. Using a DNA probe in human-rodent hybrid cells, Shows (1983) found that asparaginyl-tRNA synthetase segregated with peptidase A, a chromosome 18 marker. Cirullo et al. (1983) used the abbreviation-symbol 'asnS.' They isolated hybrids between human peripheral leukocytes and a temperature-sensitive CHO cell line with a thermolabile asparaginyl-tRNA synthetase. Hybrids selected at 39 degrees C required the presence of human chromosome 18. Temperature-resistant hybrid cells contained 2 forms of ASNRS: 1 highly thermal resistant, like the human enzyme, and 1 highly thermolabile, like the CHO mutant enzyme.

Full details of the abovementioned studies are described in the following publications, the disclosure of which are hereby incorporated by reference:

Cirullo, R. E.; Arredondo-Vega, F. X.; Smith, M.; Wasmuth, J. J.: Isolation and characterization of interspecific heat-resistant hybrids between a temperature-sensitive Chinese hamster cell asparaginyl-tRNA synthetase mutant and normal human leukocytes: assignment of human asnS gene to chromosome 18. Somat. Cell Genet. 9: 215-233, 1983; and Shows, T. B.: Personal Communication. Buffalo, N. Y., 1/11/1983.

Further studies establishing the function and utilities of NARS are found in John Hopkins OMIM database record ID 108410, and in sited publications numbered 1360-1361 listed in the bibliography section hereinbelow, which are also hereby incorporated by reference. TIRAP (Accession NM_052887) is another VGAM601 host target gene. TIRAP BINDING SITE is HOST TARGET binding site found in the 3' untranslated region of mRNA encoded by TIRAP, corresponding to a HOST TARGET binding site such as BINDING SITE I, BINDING SITE II or BINDING SITE III. Table 2 illustrates the complementarity of the nucleotide sequences of TIRAP BINDING SITE, designated SEQ ID:27471, to the nucleotide sequence of VGAM601 RNA, herein designated VGAM RNA, also designated SEQ ID:3312.

Another function of VGAM601 is therefore inhibition of TIRAP (Accession NM_052887), a gene which is a adapter involved in the TLR4 signaling pathway in the innate immune response. Accordingly, utilities of VGAM601 include diagnosis, prevention and treatment of diseases and clinical conditions associated with TIRAP. The function of TIRAP and its association with various diseases and clinical conditions, has been established by previous studies, as described hereinabove with reference to VGAM189. FLJ23403 (Accession NM_022068) is another VGAM601 host target gene. FLJ23403 BINDING SITE is HOST TARGET binding site found in the 3' untranslated region of mRNA encoded by FLJ23403, corresponding to a HOST TARGET binding site such as BINDING SITE I, BINDING SITE II or BINDING SITE III. Table 2 illustrates the complementarity of the nucleotide sequences of FLJ23403 BINDING SITE, designated SEQ ID:22611, to the nucleotide sequence of VGAM601 RNA, herein designated VGAM RNA, also designated SEQ ID:3312.

Another function of VGAM601 is therefore inhibition of FLJ23403 (Accession NM_022068). Accordingly, utilities of VGAM601 include diagnosis, prevention and treatment of diseases and clinical conditions associated with FLJ23403. KIAA1948 (Accession XM_091984) is another VGAM601 host target gene. KIAA1948 BINDING SITE is HOST TARGET binding site found in the 3' untranslated region of mRNA encoded by KIAA1948, corresponding to a HOST TARGET binding site such as BINDING SITE I, BINDING SITE II or BINDING SITE III. Table 2 illustrates the complementarity of the nucleotide sequences of KIAA1948 BINDING SITE, designated SEQ ID:40074, to the nucleotide sequence of VGAM601 RNA, herein designated VGAM RNA, also designated SEQ ID:3312.

Another function of VGAM601 is therefore inhibition of KIAA1948 (Accession XM_091984). Accordingly, utilities of VGAM601 include diagnosis, prevention and treatment of diseases and clinical conditions associated with KIAA1948. LOC142893 (Accession XM_096354) is another VGAM601 host target gene. LOC142893 BINDING SITE is HOST TARGET binding site found in the 5' untranslated region of mRNA encoded by LOC142893, corresponding to a HOST TARGET binding site such as BINDING SITE I, BINDING SITE II or BINDING SITE III. Table 2 illustrates the complementarity of the nucleotide sequences of LOC142893 BINDING SITE, designated SEQ ID:40320, to the nucleotide sequence of VGAM601 RNA, herein designated VGAM RNA, also designated SEQ ID:3312.

Another function of VGAM601 is therefore inhibition of LOC142893 (Accession XM_096354). Accordingly, utilities of VGAM601 include diagnosis, prevention and treatment of diseases and clinical conditions associated with LOC142893. FIG. 1 further provides a conceptual description of a novel bioinformatically detected viral gene of the present invention, referred to here as Viral Genomic Address Messenger 602 (VGAM602) viral gene, which modulates expression of respective host target genes thereof, the function and utility of which host target genes is known in the art.

VGAM602 is a novel bioinformatically detected regulatory, non protein coding, viral micro RNA (miRNA) gene. The method by which VGAM602 was detected is described hereinabove with reference to FIGS. 1-8.

VGAM602 gene, herein designated VGAM GENE, is a viral gene contained in the genome of Transmissible Gastroenteritis Virus. VGAM602 host target gene, herein designated VGAM HOST TARGET GENE, is a human gene contained in the human genome.

VGAM602 gene encodes a VGAM602 precursor RNA, herein designated VGAM PRECURSOR RNA. Similar to other miRNA genes, and unlike most ordinary genes, VGAM602 precursor RNA does not encode a protein. A nucleotide sequence identical or highly similar to the nucleotide sequence of VGAM602 precursor RNA is designated SEQ ID:588, and is provided hereinbelow with reference to the sequence listing part. Nucleotide sequence SEQ ID:588 is located at position 10388 relative to the genome of Transmissible Gastroenteritis Virus.

VGAM602 precursor RNA folds onto itself, forming VGAM602 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM602 folded precursor RNA into VGAM602 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 69%) nucleotide sequence of VGAM602 RNA is designated SEQ ID:3313, and is provided hereinbelow with reference to the sequence listing part.

VGAM602 host target gene, herein designated VGAM HOST TARGET GENE, encodes a corresponding messenger RNA, VGAM602 host target RNA, herein designated VGAM HOST TARGET RNA. VGAM602 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM602 RNA, herein designated VGAM RNA, binds complementarily to one or more host target binding sites located in untranslated regions of VGAM602 host target RNA, herein designated VGAM HOST TARGET RNA. This complementary binding is due to the fact that the nucleotide sequence of VGAM602 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM602 RNA, herein designated VGAM RNA, may have a different number of host target binding sites in untranslated regions of a VGAM602 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM602 RNA, herein designated VGAM RNA, to host target binding sites on VGAM602 host target RNA, herein designated VGAM HOST TARGET RNA, such as BINDING SITE I, BINDING SITE II and BINDING SITE III, inhibits translation of VGAM602 host target RNA into VGAM602 host target protein, herein designated VGAM HOST TARGET PROTEIN. VGAM host target protein is therefore outlined by a broken line.

It is appreciated that VGAM602 host target gene, herein designated VGAM HOST TARGET GENE, in fact represents a plurality of VGAM602 host target genes. The mRNA of each one of this plurality of VGAM602 host target genes comprises one or more host target binding sites, each having a nucleotide sequence which is at least partly complementary to VGAM602 RNA, herein designated VGAM RNA, and which when bound by VGAM602 RNA causes inhibition of translation of respective one or more VGAM602 host target proteins.

It is further appreciated by one skilled in the art that the mode of translational inhibition illustrated by FIG. 1 with specific reference to translational inhibition exerted by VGAM602 gene, herein designated VGAM GENE, on one or more VGAM602 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM602 is inhibition of expression of host target genes, as part of a novel viral mechanism of attacking a host. Accordingly, utilities of VGAM602 include diagnosis, prevention and treatment of viral infection by Transmissible Gastroenteritis Virus. Specific functions, and accordingly utilities, of VGAM602 correlate with, and may be deduced from, the identity of the host target genes which VGAM602 binds and inhibits, and the function of these host target genes, as elaborated hereinbelow.

Nucleotide sequences of the VGAM602 precursor RNA, herein designated VGAM PRECURSOR RNA, and of the 'diced' VGAM602 RNA, herein designated VGAM RNA, and a schematic representation of the secondary folding of VGAM602 folded precursor RNA, herein designated VGAM FOLDED PRECURSOR RNA, of VGAM602 are further described hereinbelow with reference to Table 1.

Nucleotide sequences of host target binding sites, such as BINDING SITE-I, BINDING SITE-II and BINDING SITE-III of FIG. 1, found on VGAM602 host target RNA, and schematic representation of the complementarity of each of these host target binding sites to VGAM602 RNA, herein designated VGAM RNA, are described hereinbelow with reference to Table 2.

As mentioned hereinabove with reference to FIG. 1, a function of VGAM602 gene, herein designated VGAM is inhibition of expression of VGAM602 target genes. It is appreciated that specific functions, and accordingly utilities, of VGAM602 correlate with, and may be deduced from, the identity of the target genes which VGAM602 binds and inhibits, and the function of these target genes, as elaborated hereinbelow.

Adrenergic, Alpha-2A-, Receptor (ADRA2A, Accession NM_000681) is a VGAM602 host target gene. ADRA2A BINDING SITE is HOST TARGET binding site found in the 3' untranslated region of mRNA encoded by ADRA2A, corresponding to a HOST TARGET binding site such as BINDING SITE I, BINDING SITE II or BINDING SITE III. Table 2 illustrates the complementarity of the nucleotide sequences of ADRA2A BINDING SITE, designated SEQ ID:6338, to the nucleotide sequence of VGAM602 RNA, herein designated VGAM RNA, also designated SEQ ID:3313.

A function of VGAM602 is therefore inhibition of Adrenergic, Alpha-2A-, Receptor (ADRA2A, Accession NM_000681), a gene which mediates the effects of epinephrine and norepinephrine. Accordingly, utilities of VGAM602 include diagnosis, prevention and treatment of diseases and clinical conditions associated with ADRA2A. The function of ADRA2A has been established by previous studies. Hormones and drugs exert their physiologic and pharmacologic effects by interacting with specific plasma membrane receptors of responsive cells. Adrenergic receptors fall into 2 major classes, alpha and beta, each of which is subdivided into 2 subclasses, termed alpha-1 and alpha-2 and beta-1 and beta-2. The beta-adrenergic receptors, which stimulate, and the alpha-2-adrenergic receptors, which often inhibit adenylate cyclase, are coupled to guanine nucleotide regulatory proteins. Using an alpha-2-adrenergic receptor clone, Yang-Feng et al. (1987) mapped the ADRAR locus to 10q23-q25 by somatic cell hybridization and in situ hybridization. Kobilka et al. (1987) cloned the gene for the human platelet alpha-2-adrenergic receptor using oligonucleotides corresponding to the partial amino acid sequence of the purified receptor. The deduced amino acid sequence is most similar to those of human beta-2- and beta-1-adrenergic receptors. Similarities to the muscarinic cholinergic receptors are also evident. Two related genes were identified by low stringency Southern blot analysis. Hoehe et al. (1988) identified a DraI RFLP of the ADRAR gene. By study of interspecific backcrosses, Oakey et al. (1991) assigned the Adra2r gene to the distal region of mouse chromosome 19. A substantial percentage of human pregnancies are lost as spontaneous abortions after implantation. This is often caused by an inadequately developed placenta. Proper development of the placental vascular system is essential to nutrient and gas exchange between mother and developing embryo. Philipp et al. (2002) showed that alpha-2-adrenoceptors, which are activated by adrenaline and noradrenaline, are important regulators of placental structure and function. Mice with deletions in the genes Adra2a, Adra2b, and Adra2c died between embryonic days 9.5 and 11.5 from a severe defect in yolk-sac and placenta development. In wildtype placentae, alpha-2-adrenoceptors are abundantly expressed in giant cells, which secrete angiogenic factors to initiate development of the placental vascular labyrinth. In placentae deficient in the 3 adrenoceptors encoded by the 3 genes deleted in these mice, the density of fetal blood vessels in the labyrinth was markedly lower than normal, leading to death of the embryos as a result of reduced oxygen and nutrient supply. Basal phosphorylation of the extracellular signal-regulated kinases ERK1 (OMIM Ref. No. 601795) and ERK2 (OMIM Ref. No. 176948) was also lower than normal, suggesting that activation of the mitogen-activated protein kinase (MAP kinase) pathway by alpha-2-adrenoceptors is required for placenta and yolk-sac vascular development. Thus, alpha-2-adrenoceptors are essential at the placental interface between mother and embryo to establish the circulatory system of the placenta and thus maintain pregnancy.

Full details of the abovementioned studies are described in the following publications, the disclosure of which are hereby incorporated by reference:

Kobilka, B. K.; Matsui, H.; Kobilka, T. S.; Yang-Feng, T. L.; Francke, U.; Caron, M. G.; Lefkowitz, R. J.; Regan, J. W.: Cloning, sequencing, and expression of the gene coding for the human platelet alpha-2-adrenergic receptor. Science 238: 650-656, 1987; and Philipp, M.; Brede, M. E.; Hadamek, K.; Gessler, M.; Lohse, M. J.; Hein, L.: Placental alpha-2-adrenoceptors control vascular development at the interface between mother and embryo. Nat.

Further studies establishing the function and utilities of ADRA2A are found in John Hopkins OMIM database record ID 104210, and in sited publications numbered 12104-12113 listed in the bibliography section hereinbelow, which are also hereby incorporated by reference. BCRP2 (Accession XM_031102) is another VGAM602 host target gene. BCRP2 BINDING SITE is HOST TARGET binding site found in the 3' untranslated region of mRNA encoded by BCRP2, corresponding to a HOST TARGET binding site such as BINDING SITE I, BINDING SITE II or BINDING SITE III. Table 2 illustrates the complementarity of the nucleotide sequences of BCRP2 BINDING SITE, designated SEQ ID:31271, to the nucleotide sequence of VGAM602 RNA, herein designated VGAM RNA, also designated SEQ ID:3313.

Another function of VGAM602 is therefore inhibition of BCRP2 (Accession XM_031102). Accordingly, utilities of VGAM602 include diagnosis, prevention and treatment of diseases and clinical conditions associated with BCRP2. Dynein, Axonemal, Heavy Polypeptide 9 (DNAH9, Accession NM_004662) is another VGAM602 host target gene. DNAH9 BINDING SITE is HOST TARGET binding site found in the 5' untranslated region of mRNA encoded by DNAH9, corresponding to a HOST TARGET binding site such as BINDING SITE I, BINDING SITE II or BINDING SITE III. Table 2 illustrates the complementarity of the nucleotide sequences of DNAH9 BINDING SITE, designated SEQ ID:11032, to the nucleotide sequence of VGAM602 RNA, herein designated VGAM RNA, also designated SEQ ID:3313.

Another function of VGAM602 is therefore inhibition of Dynein, Axonemal, Heavy Polypeptide 9 (DNAH9, Accession NM_004662), a gene which is a microtubule-associated motor protein. Accordingly, utilities of VGAM602 include diagnosis, prevention and treatment of diseases and clinical conditions associated with DNAH9. The function of DNAH9 has been established by previous studies. Dyneins are microtubule-associated motor protein complexes composed of several heavy, light, and intermediate chains. Two major classes of dyneins, axonemal and cytoplasmic, have been identified. The axonemal dyneins, found in cilia and flagella, are components of the outer and inner dynein arms attached to the peripheral microtubule doublets. See 603297. Vaughan et al. (1996) isolated human partial cDNAs encoding DNAH9 (HL20) and several other dynein heavy chains (DHCs). See DNAH5 (OMIM Ref. No. 603335). Sequence analysis revealed that DNAH9 is an axonemal DHC and is homologous to rat DLP9. Milisav et al. (1996) identified a human testis cDNA encoding DNAH9, which they called DNEL1. Although the predicted 798-amino acid DNAH9 protein was the size of an intermediate or light dynein chain, it showed extensive homology to the C-terminal region of outer-arm axonemal dynein beta-heavy chains from sea urchin and other species. The authors suggested that the similarity of DNAH9 to the beta-heavy chains indicates that these genes share a common origin. Northern blot analysis revealed that DNAH9 is expressed as a 3.2-kb mRNA exclusively in testis. Bartoloni et al. (2001) cloned an almost full-length cDNA encoding DNAH9. The deduced 4,486-amino acid protein contains several ATP/GTP-binding sites (P-loops), a microtubule-binding motif, a leucine zipper domain, and several phosphorylation sites. Analysis of 3 overlapping BACs determined that the DNAH9 gene contains 69 exons extending over 373 kb. RT-PCR analysis of nasal epithelium and testis RNA revealed several alternatively spliced transcripts.

Full details of the abovementioned studies are described in the following publications, the disclosure of which are hereby incorporated by reference:

Milisav, I.; Jones, M. H.; Affara, N. A.: Characterization of a novel human dynein-related gene that is specifically expressed in testis. Mammalian Genome 7:667-672, 1996; and Bartoloni, L.; Blouin, J.-L.; Maiti, A. K.; Sainsbury, A.; Rossier, C.; Gehrig, C.; She, J.-X.; Marron, M. P.; Lander, E. S.; Meeks, M.; Chung, E.; Armengot, M.; Jorissen, M.; Scott, H.

Further studies establishing the function and utilities of DNAH9 are found in John Hopkins OMIM database record ID 603330, and in sited publications numbered 7495, 7496-749 and 5344 listed in the bibliography section hereinbelow, which are also hereby incorporated by reference. Glycine Receptor, Alpha 3 (GLRA3, Accession XM_011092) is another VGAM602 host target gene. GLRA3 BINDING SITE is HOST TARGET binding site found in the 3' untranslated region of mRNA encoded by GLRA3, corresponding to a HOST TARGET binding site such as BINDING SITE I, BINDING SITE II or BINDING SITE III. Table 2 illustrates the complementarity of the nucleotide sequences of GLRA3 BINDING SITE, designated SEQ ID:30168, to the nucleotide sequence of VGAM602 RNA, herein designated VGAM RNA, also designated SEQ ID:3313.

Another function of VGAM602 is therefore inhibition of Glycine Receptor, Alpha 3 (GLRA3, Accession XM_011092), a gene which increases the chloride conductance and thus produces hyperpolarization (inhibition of neuronal firing). Accordingly, utilities of VGAM602 include diagnosis, prevention and treatment of diseases and clinical conditions associated with GLRA3. The function of GLRA3 has been established by previous studies. The neuronal glycine receptor is a ligand-gated chloride channel composed of ligand-binding alpha and structural beta polypeptides. Kingsmore et al. (1994) mapped the gene encoding the alpha-3 subunit of the glycine receptor to mouse chromosome 8. The human and rat homologs of GLRA3 were cloned by Kuhse et al. (1990). The mouse gene was mapped in relation to Plat (plasminogen activator, tissue type; 173370), which is on human chromosome 8; thus, the human GLRA3 gene may be on human chromosome 8 also. This proved, however, not to be the case; Nikolic et al. (1998) mapped the GLRA3 gene to human 4q33-q34 by fluorescence in situ hybridization. By homology screening of a human fetal brain cDNA library, Nikolic et al. (1998) identified 2 alternative splice variants of the glycine receptor alpha-3 subunit. The amino acid sequence predicted for the long alpha-3 variant, designated alpha-3-L, was largely identical to the corresponding rat subunit. In contrast, the novel splice variant, designated alpha-3-K, lacked the coding sequence for 15 amino acids located within the cytoplasmic loop connecting transmembrane spanning region-3 (TM3) and TM4. Using P1 artificial chromosome (PAC) clones, they elucidated the structure of the GLRA3 gene. Two transcripts of 2.4 and 9 kb, corresponding to alpha-3-L and alpha-3-K, respectively, were identified and found to be widely distributed throughout the human central nervous system. Structural analysis of the GLRA3 gene revealed that the alpha-3-K transcript resulted from a complex splice event where excision of the novel exon 8A comprising the alternative sequence of 45 basepairs coincides with the persistence of a large intronic sequence in the 3-prime untranslated region. Functional expression in HEK 293 cells of alpha-3-L and alpha-3-K subunits resulted in the formation of glycine-gated chloride channels that differed significantly in desensitization behavior, thus defining the cytoplasmic loop as an important determinant of the channel inactivation kinetics Full details of the abovementioned studies are described in the following publications, the disclosure of which are hereby incorporated by reference:

Kuhse, J.; Schmieden, V.; Betz, H.: Identification and functional expression of a novel ligand binding subunit of the inhibitory glycine receptor. J. Biol. Chem. 265:22317-22320, 1990; and Nikolic, Z.; Laube, B.; Weber, R. G.; Lichter, P.; Kioschis, P.; Poustka, A.; Mulhardt, C.; Becker, C.-M.: The human glycine receptor subunit alpha-3: GLRA3 gene structure, chromosomal.

Further studies establishing the function and utilities of GLRA3 are found in John Hopkins OMIM database record ID 600421, and in sited publications numbered 10174-10176 listed in the bibliography section hereinbelow, which are also hereby incorporated by reference. Insulin-like Growth Factor Binding Protein 3 (IGFBP3, Accession NM_000598) is another VGAM602 host target gene. IGFBP3 BINDING SITE is HOST TARGET binding site found in the 3' untranslated region of mRNA encoded by IGFBP3, corresponding to a HOST TARGET binding site such as BINDING SITE I, BINDING SITE II or BINDING SITE III. Table 2 illustrates the complementarity of the nucleotide sequences of IGFBP3 BINDING SITE, designated SEQ ID:6196, to the nucleotide sequence of VGAM602 RNA, herein designated VGAM RNA, also designated SEQ ID:3313.

Another function of VGAM602 is therefore inhibition of Insulin-like Growth Factor Binding Protein 3 (IGFBP3, Accession NM_000598). Accordingly, utilities of VGAM602 include diagnosis, prevention and treatment of diseases and clinical conditions associated with IGFBP3. Mannosyl (alpha-1,6-)-glycoprotein Beta-1,2-N-acetylglucosaminyltransferase (MGAT2, Accession NM_002408) is another VGAM602 host target gene. MGAT2 BINDING SITE is HOST TARGET binding site found in the 3' untranslated region of mRNA encoded by MGAT2, corresponding to a HOST TARGET binding site such as BINDING SITE I, BINDING SITE II or BINDING SITE III. Table 2 illustrates the complementarity of the nucleotide sequences of MGAT2 BINDING SITE, designated SEQ ID:8233, to the nucleotide sequence of VGAM602 RNA, herein designated VGAM RNA, also designated SEQ ID:3313.

Another function of VGAM602 is therefore inhibition of Mannosyl (alpha-1,6-)-glycoprotein Beta-1,2-N-acetylglucosaminyltransferase (MGAT2, Accession NM_002408). Accordingly, utilities of VGAM602 include diagnosis, prevention and treatment of diseases and clinical conditions associated with MGAT2. Thrombomodulin (THBD, Accession NM_000361) is another VGAM602 host target gene. THBD BINDING SITE is HOST TARGET binding site found in the 3' untranslated region of mRNA encoded by THBD, corresponding to a HOST TARGET binding site such as BINDING SITE I, BINDING SITE II or BINDING SITE III. Table 2 illustrates the complementarity of the nucleotide sequences of THBD BINDING SITE, designated SEQ ID:5917, to the nucleotide sequence of VGAM602 RNA, herein designated VGAM RNA, also designated SEQ ID:3313.

Another function of VGAM602 is therefore inhibition of Thrombomodulin (THBD, Accession NM_000361). Accordingly, utilities of VGAM602 include diagnosis, prevention and treatment of diseases and clinical conditions associated with THBD. Zinc Finger Protein 278 (ZNF278, Accession NM_014323) is another VGAM602 host target gene. ZNF278 BINDING SITE1 through ZNF278 BINDING SITE3 are HOST TARGET binding sites found in untranslated regions of mRNA encoded by ZNF278, corresponding to HOST TARGET binding sites such as BINDING SITE I, BINDING SITE II or BINDING SITE III. Table 2 illustrates the complementarity of the nucleotide sequences of ZNF278 BINDING SITE1 through ZNF278 BINDING SITE3, designated SEQ ID:15624, SEQ ID:25773 and SEQ ID:25782 respectively, to the nucleotide sequence of VGAM602 RNA, herein designated VGAM RNA, also designated SEQ ID:3313.

Another function of VGAM602 is therefore inhibition of Zinc Finger Protein 278 (ZNF278, Accession NM_014323), a gene which represses basal transcription as well as RNF4-mediated activation. Accordingly, utilities of VGAM602 include diagnosis, prevention and treatment of diseases and clinical conditions associated with ZNF278. The function of ZNF278 and its association with various diseases and clinical conditions, has been established by previous studies, as described hereinabove with reference to VGAM414. DKFZp547H025 (Accession NM_020161) is another VGAM602 host target gene. DKFZp547H025 BINDING SITE is HOST TARGET binding site found in the 3' untranslated region of mRNA encoded by DKFZp547H025, corresponding to a HOST TARGET binding site such as BINDING SITE I, BINDING SITE II or BINDING SITE III. Table 2 illustrates the complementarity of the nucleotide sequences of DKFZp547H025 BINDING SITE, designated SEQ ID:21373, to the nucleotide sequence of VGAM602 RNA, herein designated VGAM RNA, also designated SEQ ID:3313.

Another function of VGAM602 is therefore inhibition of DKFZp547H025 (Accession NM_020161). Accordingly, utilities of VGAM602 include diagnosis, prevention and treatment of diseases and clinical conditions associated with DKFZp547H025. FLJ10044 (Accession NM_017980) is another VGAM602 host target gene. FLJ10044 BINDING SITE is HOST TARGET binding site found in the 3' untranslated region of mRNA encoded by FLJ10044, corresponding to a HOST TARGET binding site such as BINDING SITE I, BINDING SITE II or BINDING SITE III. Table 2 illustrates the complementarity of the nucleotide sequences of FLJ10044 BINDING SITE, designated SEQ ID:19710, to the nucleotide sequence of VGAM602 RNA, herein designated VGAM RNA, also designated SEQ ID:3313.

Another function of VGAM602 is therefore inhibition of FLJ10044 (Accession NM_017980). Accordingly, utilities of VGAM602 include diagnosis, prevention and treatment of diseases and clinical conditions associated with FLJ10044. FLJ11164 (Accession NM_018346) is another VGAM602 host target gene. FLJ11164 BINDING SITE is HOST TARGET binding site found in the 3' untranslated region of mRNA encoded by FLJ11164, corresponding to a HOST TARGET binding site such as BINDING SITE I, BINDING SITE II or BINDING SITE III. Table 2 illustrates the complementarity of the nucleotide sequences of FLJ11164 BINDING SITE, designated SEQ ID:20354, to the nucleotide sequence of VGAM602 RNA, herein designated VGAM RNA, also designated SEQ ID:3313.

Another function of VGAM602 is therefore inhibition of FLJ11164 (Accession NM_018346). Accordingly, utilities of VGAM602 include diagnosis, prevention and treatment of diseases and clinical conditions associated with FLJ11164. Golgi Phosphoprotein 2 (GOLPH2, Accession NM_016548) is another VGAM602 host target gene. GOLPH2 BINDING SITE is HOST TARGET binding site found in the 3' untranslated region of mRNA encoded by GOLPH2, corresponding to a HOST TARGET binding site such as BINDING SITE I, BINDING SITE II or BINDING SITE III. Table 2 illustrates the complementarity of the nucleotide sequences of GOLPH2 BINDING SITE, designated SEQ ID:18624, to the nucleotide sequence of VGAM602 RNA, herein designated VGAM RNA, also designated SEQ ID:3313.

Another function of VGAM602 is therefore inhibition of Golgi Phosphoprotein 2 (GOLPH2, Accession NM_016548).

Accordingly, utilities of VGAM602 include diagnosis, prevention and treatment of diseases and clinical conditions associated with GOLPH2. KIAA0420 (Accession XM_032693) is another VGAM602 host target gene. KIAA0420 BINDING SITE is HOST TARGET binding site found in the 3' untranslated region of mRNA encoded by KIAA0420, corresponding to a HOST TARGET binding site such as BINDING SITE I, BINDING SITE II or BINDING SITE III. Table 2 illustrates the complementarity of the nucleotide sequences of KIAA0420 BINDING SITE, designated SEQ ID:31721, to the nucleotide sequence of VGAM602 RNA, herein designated VGAM RNA, also designated SEQ ID:3313.

Another function of VGAM602 is therefore inhibition of KIAA0420 (Accession XM_032693). Accordingly, utilities of VGAM602 include diagnosis, prevention and treatment of diseases and clinical conditions associated with KIAA0420. KIAA1024 (Accession XM_044580) is another VGAM602 host target gene. KIAA1024 BINDING SITE is HOST TARGET binding site found in the 3' untranslated region of mRNA encoded by KIAA1024, corresponding to a HOST TARGET binding site such as BINDING SITE I, BINDING SITE II or BINDING SITE III. Table 2 illustrates the complementarity of the nucleotide sequences of KIAA1024 BINDING SITE, designated SEQ ID:34236, to the nucleotide sequence of VGAM602 RNA, herein designated VGAM RNA, also designated SEQ ID:3313.

Another function of VGAM602 is therefore inhibition of KIAA1024 (Accession XM_044580). Accordingly, utilities of VGAM602 include diagnosis, prevention and treatment of diseases and clinical conditions associated with KIAA1024. KIAA1239 (Accession XM_049078) is another VGAM602 host target gene. KIAA1239 BINDING SITE is HOST TARGET binding site found in the 3' untranslated region of mRNA encoded by KIAA1239, corresponding to a HOST TARGET binding site such as BINDING SITE I, BINDING SITE II or BINDING SITE III. Table 2 illustrates the complementarity of the nucleotide sequences of KIAA1239 BINDING SITE, designated SEQ ID:35338, to the nucleotide sequence of VGAM602 RNA, herein designated VGAM RNA, also designated SEQ ID:3313.

Another function of VGAM602 is therefore inhibition of KIAA1239 (Accession XM_049078). Accordingly, utilities of VGAM602 include diagnosis, prevention and treatment of diseases and clinical conditions associated with KIAA1239. MGC4655 (Accession NM_033309) is another VGAM602 host target gene. MGC4655 BINDING SITE is HOST TARGET binding site found in the 3' untranslated region of mRNA encoded by MGC4655, corresponding to a HOST TARGET binding site such as BINDING SITE I, BINDING SITE II or BINDING SITE III. Table 2 illustrates the complementarity of the nucleotide sequences of MGC4655 BINDING SITE, designated SEQ ID:27143, to the nucleotide sequence of VGAM602 RNA, herein designated VGAM RNA, also designated SEQ ID:3313.

Another function of VGAM602 is therefore inhibition of MGC4655 (Accession NM_033309). Accordingly, utilities of VGAM602 include diagnosis, prevention and treatment of diseases and clinical conditions associated with MGC4655. Polymerase (DNA directed), Epsilon 3 (p17 subunit) (POLE3, Accession NM_017443) is another VGAM602 host target gene. POLE3 BINDING SITE is HOST TARGET binding site found in the 3' untranslated region of mRNA encoded by POLE3, corresponding to a HOST TARGET binding site such as BINDING SITE I, BINDING SITE II or BINDING SITE III. Table 2 illustrates the complementarity of the nucleotide sequences of POLE3 BINDING SITE, designated SEQ ID:18899, to the nucleotide sequence of VGAM602 RNA, herein designated VGAM RNA, also designated SEQ ID:3313.

Another function of VGAM602 is therefore inhibition of Polymerase (DNA directed), Epsilon 3 (p17 subunit) (POLE3, Accession NM_017443). Accordingly, utilities of VGAM602 include diagnosis, prevention and treatment of diseases and clinical conditions associated with POLE3. ZID (Accession NM_006626) is another VGAM602 host target gene. ZID BINDING SITE is HOST TARGET binding site found in the 3' untranslated region of mRNA encoded by ZID, corresponding to a HOST TARGET binding site such as BINDING SITE I, BINDING SITE II or BINDING SITE III. Table 2 illustrates the complementarity of the nucleotide sequences of ZID BINDING SITE, designated SEQ ID:13415, to the nucleotide sequence of VGAM602 RNA, herein designated VGAM RNA, also designated SEQ ID:3313.

Another function of VGAM602 is therefore inhibition of ZID (Accession NM_006626). Accordingly, utilities of VGAM602 include diagnosis, prevention and treatment of diseases and clinical conditions associated with ZID. LOC123283 (Accession XM_071829) is another VGAM602 host target gene. LOC123283 BINDING SITE is HOST TARGET binding site found in the 3' untranslated region of mRNA encoded by LOC123283, corresponding to a HOST TARGET binding site such as BINDING SITE I, BINDING SITE II or BINDING SITE III. Table 2 illustrates the complementarity of the nucleotide sequences of LOC123283 BINDING SITE, designated SEQ ID:37424, to the nucleotide sequence of VGAM602 RNA, herein designated VGAM RNA, also designated SEQ ID:3313.

Another function of VGAM602 is therefore inhibition of LOC123283 (Accession XM_071829). Accordingly, utilities of VGAM602 include diagnosis, prevention and treatment of diseases and clinical conditions associated with LOC123283. LOC144266 (Accession XM_084795) is another VGAM602 host target gene. LOC144266 BINDING SITE is HOST TARGET binding site found in the 5' untranslated region of mRNA encoded by LOC144266, corresponding to a HOST TARGET binding site such as BINDING SITE I, BINDING SITE II or BINDING SITE III. Table 2 illustrates the complementarity of the nucleotide sequences of LOC144266 BINDING SITE, designated SEQ ID:37708, to the nucleotide sequence of VGAM602 RNA, herein designated VGAM RNA, also designated SEQ ID:3313.

Another function of VGAM602 is therefore inhibition of LOC144266 (Accession XM_084795). Accordingly, utilities of VGAM602 include diagnosis, prevention and treatment of diseases and clinical conditions associated with LOC144266. LOC253782 (Accession XM_171023) is another VGAM602 host target gene. LOC253782 BINDING SITE is HOST TARGET binding site found in the 3' untranslated region of mRNA encoded by LOC253782, corresponding to a HOST TARGET binding site such as BINDING SITE I, BINDING SITE II or BINDING SITE III. Table 2 illustrates the complementarity of the nucleotide sequences of LOC253782 BINDING SITE, designated SEQ ID:45795, to the nucleotide sequence of VGAM602 RNA, herein designated VGAM RNA, also designated SEQ ID:3313.

Another function of VGAM602 is therefore inhibition of LOC253782 (Accession XM_171023). Accordingly, utilities of VGAM602 include diagnosis, prevention and treatment of diseases and clinical conditions associated with LOC253782. LOC257354 (Accession XM_170810) is another VGAM602 host target gene. LOC257354 BINDING SITE is HOST TARGET binding site found in the 3' untranslated region of mRNA encoded by LOC257354, corresponding to a HOST TARGET binding site such as BINDING SITE I, BINDING SITE II or BINDING SITE III. Table 2 illustrates the complementarity of the nucleotide sequences of LOC257354 BINDING SITE, designated SEQ ID:45574, to the nucleotide sequence of VGAM602 RNA, herein designated VGAM RNA, also designated SEQ ID:3313.

Another function of VGAM602 is therefore inhibition of LOC257354 (Accession XM_170810). Accordingly, utilities of VGAM602 include diagnosis, prevention and treatment of diseases and clinical conditions associated with LOC257354. LOC51320 (Accession NM_016626) is another VGAM602 host target gene. LOC51320 BINDING SITE is HOST TARGET binding site found in the 3' untranslated region of mRNA encoded by LOC51320, corresponding to a HOST TARGET binding site such as BINDING SITE I, BINDING SITE II or BINDING SITE III. Table 2 illustrates the complementarity of the nucleotide sequences of LOC51320 BINDING SITE, designated SEQ ID:18740, to the nucleotide sequence of VGAM602 RNA, herein designated VGAM RNA, also designated SEQ ID:3313.

Another function of VGAM602 is therefore inhibition of LOC51320 (Accession NM_016626). Accordingly, utilities of VGAM602 include diagnosis, prevention and treatment of diseases and clinical conditions associated with LOC51320. LOC89932 (Accession XM_027341) is another VGAM602 host target gene. LOC89932 BINDING SITE is HOST TARGET binding site found in the 3' untranslated region of mRNA encoded by LOC89932, corresponding to a HOST TARGET binding site such as BINDING SITE I, BINDING SITE II or BINDING SITE III. Table 2 illustrates the complementarity of the nucleotide sequences of LOC89932 BINDING SITE, designated SEQ ID:30485, to the nucleotide sequence of VGAM602 RNA, herein designated VGAM RNA, also designated SEQ ID:3313.

Another function of VGAM602 is therefore inhibition of LOC89932 (Accession XM_027341). Accordingly, utilities of VGAM602 include diagnosis, prevention and treatment of diseases and clinical conditions associated with LOC89932. LOC90470 (Accession XM_031975) is another VGAM602 host target gene. LOC90470 BINDING SITE is HOST TARGET binding site found in the 3' untranslated region of mRNA encoded by LOC90470, corresponding to a HOST TARGET binding site such as BINDING SITE I, BINDING SITE II or BINDING SITE III. Table 2 illustrates the complementarity of the nucleotide sequences of LOC90470 BINDING SITE, designated SEQ ID:31537, to the nucleotide sequence of VGAM602 RNA, herein designated VGAM RNA, also designated SEQ ID:3313.

Another function of VGAM602 is therefore inhibition of LOC90470 (Accession XM_031975). Accordingly, utilities of VGAM602 include diagnosis, prevention and treatment of diseases and clinical conditions associated with LOC90470. FIG. 1 further provides a conceptual description of a novel bioinformatically detected viral gene of the present invention, referred to here as Viral Genomic Address Messenger 603 (VGAM603) viral gene, which modulates expression of respective host target genes thereof, the function and utility of which host target genes is known in the art.

VGAM603 is a novel bioinformatically detected regulatory, non protein coding, viral micro RNA (miRNA) gene. The method by which VGAM603 was detected is described hereinabove with reference to FIGS. 1-8.

VGAM603 gene, herein designated VGAM GENE, is a viral gene contained in the genome of Transmissible Gastroenteritis Virus. VGAM603 host target gene, herein designated VGAM HOST TARGET GENE, is a human gene contained in the human genome.

VGAM603 gene encodes a VGAM603 precursor RNA, herein designated VGAM PRECURSOR RNA. Similar to other miRNA genes, and unlike most ordinary genes, VGAM603 precursor RNA does not encode a protein. A nucleotide sequence identical or highly similar to the nucleotide sequence of VGAM603 precursor RNA is designated SEQ ID:589, and is provided hereinbelow with reference to the sequence listing part. Nucleotide sequence SEQ ID:589 is located at position 11750 relative to the genome of Transmissible Gastroenteritis Virus.

VGAM603 precursor RNA folds onto itself, forming VGAM603 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM603 folded precursor RNA into VGAM603 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM603 RNA is designated SEQ ID:3314, and is provided hereinbelow with reference to the sequence listing part.

VGAM603 host target gene, herein designated VGAM HOST TARGET GENE, encodes a corresponding messenger RNA, VGAM603 host target RNA, herein designated VGAM HOST TARGET RNA. VGAM603 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM603 RNA, herein designated VGAM RNA, binds complementarily to one or more host target binding sites located in untranslated regions of VGAM603 host target RNA, herein designated VGAM HOST TARGET RNA. This complementary binding is due to the fact that the nucleotide sequence of VGAM603 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM603 RNA, herein designated VGAM RNA, may have a different number of host target binding sites in untranslated regions of a VGAM603 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM603 RNA, herein designated VGAM RNA, to host target binding sites on VGAM603 host target RNA, herein designated VGAM HOST TARGET RNA, such as BINDING SITE I, BINDING SITE II and BINDING SITE III, inhibits translation of VGAM603 host target RNA into VGAM603 host target protein, herein designated VGAM HOST TARGET PROTEIN.

VGAM host target protein is therefore outlined by a broken line.

It is appreciated that VGAM603 host target gene, herein designated VGAM HOST TARGET GENE, in fact represents a plurality of VGAM603 host target genes. The mRNA of each one of this plurality of VGAM603 host target genes comprises one or more host target binding sites, each having a nucleotide sequence which is at least partly complementary to VGAM603 RNA, herein designated VGAM RNA, and which when bound by VGAM603 RNA causes inhibition of translation of respective one or more VGAM603 host target proteins.

It is further appreciated by one skilled in the art that the mode of translational inhibition illustrated by FIG. 1 with specific reference to translational inhibition exerted by VGAM603 gene, herein designated VGAM GENE, on one or more VGAM603 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM603 is inhibition of expression of host target genes, as part of a novel viral mechanism of attacking a host. Accordingly, utilities of VGAM603 include diagnosis, prevention and treatment of viral infection by Transmissible Gastroenteritis Virus. Specific functions, and accordingly utilities, of VGAM603 correlate with, and may be deduced from, the identity of the host target genes which VGAM603 binds and inhibits, and the function of these host target genes, as elaborated hereinbelow.

Nucleotide sequences of the VGAM603 precursor RNA, herein designated VGAM PRECURSOR RNA, and of the 'diced' VGAM603 RNA, herein designated VGAM RNA, and a schematic representation of the secondary folding of VGAM603 folded precursor RNA, herein designated VGAM FOLDED PRECURSOR RNA, of VGAM603 are further described hereinbelow with reference to Table 1.

Nucleotide sequences of host target binding sites, such as BINDING SITE-I, BINDING SITE-II and BINDING SITE-III of FIG. 1, found on VGAM603 host target RNA, and schematic representation of the complementarity of each of these host target binding sites to VGAM603 RNA, herein designated VGAM RNA, are described hereinbelow with reference to Table 2.

As mentioned hereinabove with reference to FIG. 1, a function of VGAM603 gene, herein designated VGAM is inhibition of expression of VGAM603 target genes. It is appreciated that specific functions, and accordingly utilities, of VGAM603 correlate with, and may be deduced from, the identity of the target genes which VGAM603 binds and inhibits, and the function of these target genes, as elaborated hereinbelow.

Neural Precursor Cell Expressed, Developmentally Down-regulated 4-like (NEDD4L, Accession NM_015277) is a VGAM603 host target gene. NEDD4L BINDING SITE is HOST TARGET binding site found in the 3' untranslated region of mRNA encoded by NEDD4L, corresponding to a HOST TARGET binding site such as BINDING SITE I, BINDING SITE II or BINDING SITE III. Table 2 illustrates the complementarity of the nucleotide sequences of NEDD4L BINDING SITE, designated SEQ ID:17606, to the nucleotide sequence of VGAM603 RNA, herein designated VGAM RNA, also designated SEQ ID:3314.

A function of VGAM603 is therefore inhibition of Neural Precursor Cell Expressed, Developmentally Down-regulated 4-like (NEDD4L, Accession NM_015277), a gene which may play a role in the regulation of epithelial sodium channel function. Accordingly, utilities of VGAM603 include diagnosis, prevention and treatment of diseases and clinical conditions associated with NEDD4L. The function of NEDD4L has been established by previous studies. Using cosmids from a human chromosome 18-specific library, Chen et al. (2001) used exon trapping and cDNA cloning to identify a gene homologous to NEDD4. The full-length cDNA sequence of 3,246 bp, obtained by RACE, contains an open reading frame of 2,562 nucleotides. The deduced 854-amino acid polypeptide was predicted to contain 4 WW domains and an HECT ubiquitin-protein ligase domain, highly conserved features in the NEDD4 gene family. The NEDD4L gene has 97% and 62% amino acid sequence identity to mouse Nedd4-2 and human NEDD4 genes, respectively. By expression analysis, a 3.4-kb band was observed in heart and muscle, while a 3.2-kb band and/or an additional 3.6-kb band were seen in other tissues examined. An alternative splicing event involving exon 12 of 60 bp was observed, the shorter allele being predominantly present in brain and lymphocytes, while the longer allele was strongly expressed in kidney and placenta. Since the NEDD4L gene mapped to the region of 18q21 showing linkage evidence for a susceptibility locus for bipolar affective disorder (OMIM Ref. No. 125480), Chen et al. (2001) screened the NEDD4L gene for mutations in 3 unrelated bipolar I probands and their parents, but no mutations were detected. Due to the potential role of NEDD4L in regulating the epithelial sodium channel (ENaC; OMIM Ref. No. 600228), Chen et al. (2001) proposed it a candidate gene for autosomal dominant orthostatic hypotensive disorder (OMIM Ref. No. 143850), mapped to 18q21. Erdeniz and Rothstein (2000) found that the ubiquitination domain of KIAA0439 shares homology with the S. cerevisiae Rsp5, a ubiquitin-protein ligase. They analyzed Rsp5 mutant strains and concluded that Rsp5 may be involved in the degradation of the single-stranded DNA-binding protein Rfa1, thereby linking ubiquitin-dependent protein degradation to the replication-recombination machinery.

Full details of the abovementioned studies are described in the following publications, the disclosure of which are hereby incorporated by reference:

Chen, H.; Ross, C. A.; Wang, N.; Huo, Y.; MacKinnon, D. F.; Potash, J. B.; Simpson, S. G.; McMahon, F. J.; DePaulo, J. R., Jr.; McInnis, M. G.: NEDD4L on human chromosome 18q21 has multiple forms of transcripts and is a homologue of the mouse Nedd4-2 gene. Europ. J. Hum. Genet. 9:922-930, 2001; and Erdeniz, N.; Rothstein, R.: Rsp5, a ubiquitin-protein ligase, is involved in degradation of the single-stranded-DNA binding protein Rfa1 in Saccharomyces cerevisiae. Molec. Cell. Bio.

Further studies establishing the function and utilities of NEDD4L are found in John Hopkins OMIM database record ID 606384, and in sited publications numbered 6477-647 and 7555 listed in the bibliography section hereinbelow, which are also hereby incorporated by reference. DKFZp566D133 (Accession XM_050005) is another VGAM603 host target gene. DKFZp566D133 BINDING SITE is HOST TARGET binding site found in the 3' untranslated region of mRNA encoded by DKFZp566D133, corresponding to a HOST TARGET binding site such as BINDING SITE I, BINDING SITE II or BINDING SITE III. Table 2 illustrates the complementarity of the nucleotide sequences of DKFZp566D133 BINDING SITE, designated SEQ ID:35546, to the nucleotide sequence of VGAM603 RNA, herein designated VGAM RNA, also designated SEQ ID:3314.

Another function of VGAM603 is therefore inhibition of DKFZp566D133 (Accession XM_050005). Accordingly, utilities of VGAM603 include diagnosis, prevention and treatment of diseases and clinical conditions associated with DKFZp566D133. Mitogen-activated Protein Kinase Kinase 6 (MAP2K6, Accession NM_002758) is another VGAM603 host target gene. MAP2K6 BINDING SITE1 and MAP2K6 BINDING SITE2 are HOST TARGET binding sites found in untranslated regions of mRNA encoded by MAP2K6, corresponding to HOST TARGET binding sites such as BINDING SITE I, BINDING SITE II or BINDING SITE III. Table 2 illustrates the complementarity of the nucleotide sequences of MAP2K6 BINDING SITE1 and MAP2K6 BINDING SITE2, designated SEQ ID:8644 and SEQ ID:25703 respectively, to the nucleotide sequence of VGAM603 RNA, herein designated VGAM RNA, also designated SEQ ID:3314.

Another function of VGAM603 is therefore inhibition of Mitogen-activated Protein Kinase Kinase 6 (MAP2K6, Accession NM_002758). Accordingly, utilities of VGAM603 include diagnosis, prevention and treatment of diseases and clinical conditions associated with MAP2K6. LOC253959 (Accession XM_170749) is another VGAM603 host target gene. LOC253959 BINDING SITE is HOST TARGET binding site found in the 3' untranslated region of mRNA encoded by LOC253959, corresponding to a HOST TARGET binding site such as BINDING SITE I, BINDING SITE II or BINDING SITE III. Table 2 illustrates the complementarity of the nucleotide sequences of LOC253959 BINDING SITE, designated SEQ ID:45512, to the nucleotide sequence of VGAM603 RNA, herein designated VGAM RNA, also designated SEQ ID:3314.

Another function of VGAM603 is therefore inhibition of LOC253959 (Accession XM_170749). Accordingly, utilities of VGAM603 include diagnosis, prevention and treatment of diseases and clinical conditions associated with LOC253959. FIG. 1 further provides a conceptual description of a novel bioinformatically detected viral gene of the present invention, referred to here as Viral Genomic Address Messenger 604 (VGAM604) viral gene, which modulates expression of respective host target genes thereof, the function and utility of which host target genes is known in the art.

VGAM604 is a novel bioinformatically detected regulatory, non protein coding, viral micro RNA (miRNA) gene. The method by which VGAM604 was detected is described hereinabove with reference to FIGS. 1-8.

VGAM604 gene, herein designated VGAM GENE, is a viral gene contained in the genome of Transmissible Gastroenteritis Virus. VGAM604 host target gene, herein designated VGAM HOST TARGET GENE, is a human gene contained in the human genome.

VGAM604 gene encodes a VGAM604 precursor RNA, herein designated VGAM PRECURSOR RNA. Similar to other miRNA genes, and unlike most ordinary genes, VGAM604 precursor RNA does not encode a protein. A nucleotide sequence identical or highly similar to the nucleotide sequence of VGAM604 precursor RNA is designated SEQ ID:590, and is provided hereinbelow with reference to the sequence listing part. Nucleotide sequence SEQ ID:590 is located at position 9039 relative to the genome of Transmissible Gastroenteritis Virus.

VGAM604 precursor RNA folds onto itself, forming VGAM604 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM604 folded precursor RNA into VGAM604 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM604 RNA is designated SEQ ID:3315, and is provided hereinbelow with reference to the sequence listing part.

VGAM604 host target gene, herein designated VGAM HOST TARGET GENE, encodes a corresponding messenger RNA, VGAM604 host target RNA, herein designated VGAM HOST TARGET RNA. VGAM604 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM604 RNA, herein designated VGAM RNA, binds complementarily to one or more host target binding sites located in untranslated regions of VGAM604 host target RNA, herein designated VGAM HOST TARGET RNA. This complementary binding is due to the fact that the nucleotide sequence of VGAM604 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM604 RNA, herein designated VGAM RNA, may have a different number of host target binding sites in untranslated regions of a VGAM604 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM604 RNA, herein designated VGAM RNA, to host target binding sites on VGAM604 host target RNA, herein designated VGAM HOST TARGET RNA, such as BINDING SITE I, BINDING SITE II and BINDING SITE III, inhibits translation of VGAM604 host target RNA into VGAM604 host target protein, herein designated VGAM HOST TARGET PROTEIN. VGAM host target protein is therefore outlined by a broken line.

It is appreciated that VGAM604 host target gene, herein designated VGAM HOST TARGET GENE, in fact represents a plurality of VGAM604 host target genes. The mRNA of each one of this plurality of VGAM604 host target genes comprises one or more host target binding sites, each having a nucleotide sequence which is at least partly complementary to VGAM604 RNA, herein designated VGAM RNA, and which when bound by VGAM604 RNA causes inhibition of translation of respective one or more VGAM604 host target proteins.

It is further appreciated by one skilled in the art that the mode of translational inhibition illustrated by FIG. 1 with specific reference to translational inhibition exerted by VGAM604 gene, herein designated VGAM GENE, on one or more VGAM604 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM604 is inhibition of expression of host target genes, as part of a novel viral mechanism of attacking a host. Accordingly, utilities of VGAM604 include diagnosis, prevention and treatment of viral infection by Transmissible Gastroenteritis Virus. Specific functions, and accordingly utilities, of VGAM604 correlate with, and may be deduced from, the identity of the host target genes which VGAM604 binds and inhibits, and the function of these host target genes, as elaborated hereinbelow.

Nucleotide sequences of the VGAM604 precursor RNA, herein designated VGAM PRECURSOR RNA, and of the 'diced' VGAM604 RNA, herein designated VGAM RNA, and a schematic representation of the secondary folding of VGAM604 folded precursor RNA, herein designated VGAM FOLDED PRECURSOR RNA, of VGAM604 are further described hereinbelow with reference to Table 1.

Nucleotide sequences of host target binding sites, such as BINDING SITE-I, BINDING SITE-II and BINDING SITE-III of FIG. 1, found on VGAM604 host target RNA, and schematic representation of the complementarity of each of these host target binding sites to VGAM604 RNA, herein designated VGAM RNA, are described hereinbelow with reference to Table 2.

As mentioned hereinabove with reference to FIG. 1, a function of VGAM604 gene, herein designated VGAM is inhibition of expression of VGAM604 target genes. It is appreciated that specific functions, and accordingly utilities, of VGAM604 correlate with, and may be deduced from, the identity of the target genes which VGAM604 binds and inhibits, and the function of these target genes, as elaborated hereinbelow.

Aspartoacylase (aminoacylase 2, Canavan disease) (ASPA, Accession NM_000049) is a VGAM604 host target gene. ASPA BINDING SITE is HOST TARGET binding site found in the 5' untranslated region of mRNA encoded by ASPA, corresponding to a HOST TARGET binding site such as BINDING SITE I, BINDING SITE II or BINDING SITE III. Table 2 illustrates the complementarity of the nucleotide sequences of ASPA BINDING SITE, designated SEQ ID:5489, to the nucleotide sequence of VGAM604 RNA, herein designated VGAM RNA, also designated SEQ ID:3315.

A function of VGAM604 is therefore inhibition of Aspartoacylase (aminoacylase 2, Canavan disease) (ASPA, Accession NM_000049). Accordingly, utilities of VGAM604 include diagnosis, prevention and treatment of diseases and clinical conditions associated with ASPA. Egl Nine Homolog 1 (C. elegans) (EGLN1, Accession NM_022051) is another VGAM604 host target gene. EGLN1 BINDING SITE is HOST TARGET binding site found in the 5' untranslated region of mRNA encoded by EGLN1, corresponding to a HOST TARGET binding site such as BINDING SITE I, BINDING SITE II or BINDING SITE III. Table 2 illustrates the complementarity of the nucleotide sequences of EGLN1 BINDING SITE, designated SEQ ID:22588, to the nucleotide sequence of VGAM604 RNA, herein designated VGAM RNA, also designated SEQ ID:3315.

Another function of VGAM604 is therefore inhibition of Egl Nine Homolog 1 (C. elegans) (EGLN1, Accession NM_022051), a gene which is expressed in the cytoplasm of arterial smooth muscle cells. Accordingly, utilities of VGAM604 include diagnosis, prevention and treatment of diseases and clinical conditions associated with EGLN1. The function of EGLN1 and its association with various diseases and clinical conditions, has been established by previous studies, as described hereinabove with reference to VGAM216. Early Growth Response 3 (EGR3, Accession XM_005040) is another VGAM604 host target gene. EGR3 BINDING SITE is HOST TARGET binding site found in the 3' untranslated region of mRNA encoded by EGR3, corresponding to a HOST TARGET binding site such as BINDING SITE I, BINDING SITE II or BINDING SITE III. Table 2 illustrates the complementarity of the nucleotide sequences of EGR3 BINDING SITE, designated SEQ ID:29960, to the nucleotide sequence of VGAM604 RNA, herein designated VGAM RNA, also designated SEQ ID:3315.

Another function of VGAM604 is therefore inhibition of Early Growth Response 3 (EGR3, Accession XM_005040), a gene which is a putative transcription factor. Accordingly, utilities of VGAM604 include diagnosis, prevention and treatment of diseases and clinical conditions associated with EGR3. The function of EGR3 and its association with various diseases and clinical conditions, has been established by previous studies, as described hereinabove with reference to VGAM189. Interferon (alpha, beta and omega) Receptor 2 (IFNAR2, Accession NM_000874) is another VGAM604 host target gene. IFNAR2 BINDING SITE is HOST TARGET binding site found in the 5' untranslated region of mRNA encoded by IFNAR2, corresponding to a HOST TARGET binding site such as BINDING SITE I, BINDING SITE II or BINDING SITE III. Table 2 illustrates the complementarity of the nucleotide sequences of IFNAR2 BINDING SITE, designated SEQ ID:6551, to the nucleotide sequence of VGAM604 RNA, herein designated VGAM RNA, also designated SEQ ID:3315.

Another function of VGAM604 is therefore inhibition of Interferon (alpha, beta and omega) Receptor 2 (IFNAR2, Accession NM_000874), a gene which is a receptor for interferons alpha and beta. Accordingly, utilities of VGAM604 include diagnosis, prevention and treatment of diseases and clinical conditions associated with IFNAR2. The function of IFNAR2 and its association with various diseases and clinical conditions, has been established by previous studies, as described hereinabove with reference to VGAM487. BAI1-associated Protein 1 (BAIAP1, Accession NM_004742) is another VGAM604 host target gene. BAIAP1 BINDING SITE is HOST TARGET binding site found in the 3' untranslated region of mRNA encoded by BAIAP1, corresponding to a HOST TARGET binding site such as BINDING SITE I, BINDING SITE II or BINDING SITE III. Table 2 illustrates the complementarity of the nucleotide sequences of BAIAP1 BINDING SITE, designated SEQ ID:11138, to the nucleotide sequence of VGAM604 RNA, herein designated VGAM RNA, also designated SEQ ID:3315.

Another function of VGAM604 is therefore inhibition of BAI1-associated Protein 1 (BAIAP1, Accession NM_004742). Accordingly, utilities of VGAM604 include diagnosis, prevention and treatment of diseases and clinical conditions associated with BAIAP1. DKFZp762K2015 (Accession XM_051791) is another VGAM604 host target gene.

DKFZp762K2015 BINDING SITE is HOST TARGET binding site found in the 3' untranslated region of mRNA encoded by DKFZp762K2015, corresponding to a HOST TARGET binding site such as BINDING SITE I, BINDING SITE II or BINDING SITE III. Table 2 illustrates the complementarity of the nucleotide sequences of DKFZp762K2015 BINDING SITE, designated SEQ ID:35885, to the nucleotide sequence of VGAM604 RNA, herein designated VGAM RNA, also designated SEQ ID:3315.

Another function of VGAM604 is therefore inhibition of DKFZp762K2015 (Accession XM_051791). Accordingly, utilities of VGAM604 include diagnosis, prevention and treatment of diseases and clinical conditions associated with DKFZp762K2015. FLJ11127 (Accession NM_019018) is another VGAM604 host target gene. FLJ11127 BINDING SITE is HOST TARGET binding site found in the 3' untranslated region of mRNA encoded by FLJ11127, corresponding to a HOST TARGET binding site such as BINDING SITE I, BINDING SITE II or BINDING SITE III. Table 2 illustrates the complementarity of the nucleotide sequences of FLJ11127 BINDING SITE, designated SEQ ID:21109, to the nucleotide sequence of VGAM604 RNA, herein designated VGAM RNA, also designated SEQ ID:3315.

Another function of VGAM604 is therefore inhibition of FLJ11127 (Accession NM_019018). Accordingly, utilities of VGAM604 include diagnosis, prevention and treatment of diseases and clinical conditions associated with FLJ11127. KIAA0391 (Accession NM_014672) is another VGAM604 host target gene. KIAA0391 BINDING SITE is HOST TARGET binding site found in the 3' untranslated region of mRNA encoded by KIAA0391, corresponding to a HOST TARGET binding site such as BINDING SITE I, BINDING SITE II or BINDING SITE III. Table 2 illustrates the complementarity of the nucleotide sequences of KIAA0391 BINDING SITE, designated SEQ ID:16138, to the nucleotide sequence of VGAM604 RNA, herein designated VGAM RNA, also designated SEQ ID:3315.

Another function of VGAM604 is therefore inhibition of KIAA0391 (Accession NM_014672). Accordingly, utilities of VGAM604 include diagnosis, prevention and treatment of diseases and clinical conditions associated with KIAA0391. PAI-RBP1 (Accession NM_015640) is another VGAM604 host target gene. PAI-RBP1 BINDING SITE is HOST TARGET binding site found in the 3' untranslated region of mRNA encoded by PAI-RBP1, corresponding to a HOST TARGET binding site such as BINDING SITE I, BINDING SITE II or BINDING SITE III. Table 2 illustrates the complementarity of the nucleotide sequences of PAI-RBP1 BINDING SITE, designated SEQ ID:17893, to the nucleotide sequence of VGAM604 RNA, herein designated VGAM RNA, also designated SEQ ID:3315.

Another function of VGAM604 is therefore inhibition of PAI-RBP1 (Accession NM_015640). Accordingly, utilities of VGAM604 include diagnosis, prevention and treatment of diseases and clinical conditions associated with PAI-RBP1. SAD1 (Accession XM_034123) is another VGAM604 host target gene. SAD1 BINDING SITE is HOST TARGET binding site found in the 5' untranslated region of mRNA encoded by SAD1, corresponding to a HOST TARGET binding site such as BINDING SITE I, BINDING SITE II or BINDING SITE III. Table 2 illustrates the complementarity of the nucleotide sequences of SAD1 BINDING SITE, designated SEQ ID:32010, to the nucleotide sequence of VGAM604 RNA, herein designated VGAM RNA, also designated SEQ ID:3315.

Another function of VGAM604 is therefore inhibition of SAD1 (Accession XM_034123). Accordingly, utilities of VGAM604 include diagnosis, prevention and treatment of diseases and clinical conditions associated with SAD1. LOC145868 (Accession XM_096895) is another VGAM604 host target gene. LOC145868 BINDING SITE is HOST TARGET binding site found in the 5' untranslated region of mRNA encoded by LOC145868, corresponding to a HOST TARGET binding site such as BINDING SITE I, BINDING SITE II or BINDING SITE III. Table 2 illustrates the complementarity of the nucleotide sequences of LOC145868 BINDING SITE, designated SEQ ID:40620, to the nucleotide sequence of VGAM604 RNA, herein designated VGAM RNA, also designated SEQ ID:3315.

Another function of VGAM604 is therefore inhibition of LOC145868 (Accession XM_096895). Accordingly, utilities of VGAM604 include diagnosis, prevention and treatment of diseases and clinical conditions associated with LOC145868. LOC152316 (Accession XM_098185) is another VGAM604 host target gene. LOC152316 BINDING SITE is HOST TARGET binding site found in the 3' untranslated region of mRNA encoded by LOC152316, corresponding to a HOST TARGET binding site such as BINDING SITE I, BINDING SITE II or BINDING SITE III. Table 2 illustrates the complementarity of the nucleotide sequences of LOC152316 BINDING SITE, designated SEQ ID:41454, to the nucleotide sequence of VGAM604 RNA, herein designated VGAM RNA, also designated SEQ ID:3315.

Another function of VGAM604 is therefore inhibition of LOC152316 (Accession XM_098185). Accordingly, utilities of VGAM604 include diagnosis, prevention and treatment of diseases and clinical conditions associated with LOC152316. LOC158230 (Accession XM_088517) is another VGAM604 host target gene. LOC158230 BINDING SITE is HOST TARGET binding site found in the 3' untranslated region of mRNA encoded by LOC158230, corresponding to a HOST TARGET binding site such as BINDING SITE I, BINDING SITE II or BINDING SITE III. Table 2 illustrates the complementarity of the nucleotide sequences of LOC158230 BINDING SITE, designated SEQ ID:39767, to the nucleotide sequence of VGAM604 RNA, herein designated VGAM RNA, also designated SEQ ID:3315.

Another function of VGAM604 is therefore inhibition of LOC158230 (Accession XM_088517). Accordingly, utilities of VGAM604 include diagnosis, prevention and treatment of diseases and clinical conditions associated with LOC158230. LOC91660 (Accession XM_039902) is another VGAM604 host target gene. LOC91660 BINDING SITE is HOST TARGET binding site found in the 5' untranslated region of mRNA encoded by LOC91660, corresponding to a HOST TARGET binding site such as BINDING SITE I, BINDING SITE II or BINDING SITE III. Table 2 illustrates the complementarity of the nucleotide sequences of LOC91660 BINDING SITE, designated SEQ ID:33209, to the nucleotide sequence of VGAM604 RNA, herein designated VGAM RNA, also designated SEQ ID:3315.

Another function of VGAM604 is therefore inhibition of LOC91660 (Accession XM_039902). Accordingly, utilities of VGAM604 include diagnosis, prevention and treatment of diseases and clinical conditions associated with LOC91660. FIG. 1 further provides a conceptual description of a novel bioinformatically detected viral gene of the present invention, referred to here as Viral Genomic Address Messenger 605 (VGAM605) viral gene, which modulates expression of respective host target genes thereof, the function and utility of which host target genes is known in the art.

VGAM605 is a novel bioinformatically detected regulatory, non protein coding, viral micro RNA (miRNA) gene.

The method by which VGAM605 was detected is described hereinabove with reference to FIGS. 1-8.

VGAM605 gene, herein designated VGAM GENE, is a viral gene contained in the genome of Transmissible Gastroenteritis Virus. VGAM605 host target gene, herein designated VGAM HOST TARGET GENE, is a human gene contained in the human genome.

VGAM605 gene encodes a VGAM605 precursor RNA, herein designated VGAM PRECURSOR RNA. Similar to other miRNA genes, and unlike most ordinary genes, VGAM605 precursor RNA does not encode a protein. A nucleotide sequence identical or highly similar to the nucleotide sequence of VGAM605 precursor RNA is designated SEQ ID:591, and is provided hereinbelow with reference to the sequence listing part. Nucleotide sequence SEQ ID:591 is located at position 4344 relative to the genome of Transmissible Gastroenteritis Virus.

VGAM605 precursor RNA folds onto itself, forming VGAM605 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM605 folded precursor RNA into VGAM605 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM605 RNA is designated SEQ ID:3316, and is provided hereinbelow with reference to the sequence listing part.

VGAM605 host target gene, herein designated VGAM HOST TARGET GENE, encodes a corresponding messenger RNA, VGAM605 host target RNA, herein designated VGAM HOST TARGET RNA. VGAM605 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM605 RNA, herein designated VGAM RNA, binds complementarily to one or more host target binding sites located in untranslated regions of VGAM605 host target RNA, herein designated VGAM HOST TARGET RNA. This complementary binding is due to the fact that the nucleotide sequence of VGAM605 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM605 RNA, herein designated VGAM RNA, may have a different number of host target binding sites in untranslated regions of a VGAM605 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM605 RNA, herein designated VGAM RNA, to host target binding sites on VGAM605 host target RNA, herein designated VGAM HOST TARGET RNA, such as BINDING SITE I, BINDING SITE II and BINDING SITE III, inhibits translation of VGAM605 host target RNA into VGAM605 host target protein, herein designated VGAM HOST TARGET PROTEIN. VGAM host target protein is therefore outlined by a broken line.

It is appreciated that VGAM605 host target gene, herein designated VGAM HOST TARGET GENE, in fact represents a plurality of VGAM605 host target genes. The mRNA of each one of this plurality of VGAM605 host target genes comprises one or more host target binding sites, each having a nucleotide sequence which is at least partly complementary to VGAM605 RNA, herein designated VGAM RNA, and which when bound by VGAM605 RNA causes inhibition of translation of respective one or more VGAM605 host target proteins.

It is further appreciated by one skilled in the art that the mode of translational inhibition illustrated by FIG. 1 with specific reference to translational inhibition exerted by VGAM605 gene, herein designated VGAM GENE, on one or more VGAM605 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM605 is inhibition of expression of host target genes, as part of a novel viral mechanism of attacking a host. Accordingly, utilities of VGAM605 include diagnosis, prevention and treatment of viral infection by Transmissible Gastroenteritis Virus. Specific functions, and accordingly utilities, of VGAM605 correlate with, and may be deduced from, the identity of the host target genes which VGAM605 binds and inhibits, and the function of these host target genes, as elaborated hereinbelow.

Nucleotide sequences of the VGAM605 precursor RNA, herein designated VGAM PRECURSOR RNA, and of the 'diced' VGAM605 RNA, herein designated VGAM RNA, and a schematic representation of the secondary folding of VGAM605 folded precursor RNA, herein designated VGAM FOLDED PRECURSOR RNA, of VGAM605 are further described hereinbelow with reference to Table 1.

Nucleotide sequences of host target binding sites, such as BINDING SITE-I, BINDING SITE-II and BINDING SITE-III of FIG. 1, found on VGAM605 host target RNA, and schematic representation of the complementarity of each of these host target binding sites to VGAM605 RNA, herein designated VGAM RNA, are described hereinbelow with reference to Table 2.

As mentioned hereinabove with reference to FIG. 1, a function of VGAM605 gene, herein designated VGAM is inhibition of expression of VGAM605 target genes. It is appreciated that specific functions, and accordingly utilities, of VGAM605 correlate with, and may be deduced from, the identity of the target genes which VGAM605 binds and inhibits, and the function of these target genes, as elaborated hereinbelow.

Enabled Homolog (Drosophila) (ENAH, Accession NM_018212) is a VGAM605 host target gene. ENAH BINDING SITE is HOST TARGET binding site found in the 3' untranslated region of mRNA encoded by ENAH, corresponding to a HOST TARGET binding site such as BINDING SITE I, BINDING SITE II or BINDING SITE III. Table 2 illustrates the complementarity of the nucleotide sequences of ENAH BINDING SITE, designated SEQ ID:20121, to the nucleotide sequence of VGAM605 RNA, herein designated VGAM RNA, also designated SEQ ID:3316.

A function of VGAM605 is therefore inhibition of Enabled Homolog (Drosophila) (ENAH, Accession NM_018212). Accordingly, utilities of VGAM605 include diagnosis, prevention and treatment of diseases and clinical conditions associated with ENAH. ERp44 (Accession XM_088476) is another VGAM605 host target gene. ERp44 BINDING SITE is HOST TARGET binding site found in the 3' untranslated region of mRNA encoded by ERp44, corresponding to a HOST TARGET binding site such as BINDING SITE I, BINDING SITE II or BINDING SITE III. Table 2 illustrates the complementarity of the nucleotide sequences of ERp44 BINDING SITE, designated SEQ ID:39724, to the nucleotide sequence of VGAM605 RNA, herein designated VGAM RNA, also designated SEQ ID:3316.

Another function of VGAM605 is therefore inhibition of ERp44 (Accession XM_088476). Accordingly, utilities of VGAM605 include diagnosis, prevention and treatment of diseases and clinical conditions associated with ERp44. MO25 (Accession NM_016289) is another VGAM605 host target gene. MO25 BINDING SITE is HOST TARGET binding site found in the 3' untranslated region of mRNA encoded by MO25, corresponding to a HOST TARGET binding site such as BINDING SITE I, BINDING SITE II or BINDING SITE III. Table 2 illustrates the complementarity of the nucleotide sequences of MO25 BINDING SITE, designated SEQ ID:18415, to the nucleotide sequence of VGAM605 RNA, herein designated VGAM RNA, also designated SEQ ID:3316.

Another function of VGAM605 is therefore inhibition of MO25 (Accession NM_016289). Accordingly, utilities of VGAM605 include diagnosis, prevention and treatment of diseases and clinical conditions associated with MO25. LOC150372 (Accession XM_086893) is another VGAM605 host target gene. LOC150372 BINDING SITE is HOST TARGET binding site found in the 5' untranslated region of mRNA encoded by LOC150372, corresponding to a HOST TARGET binding site such as BINDING SITE I, BINDING SITE II or BINDING SITE III. Table 2 illustrates the complementarity of the nucleotide sequences of LOC150372 BINDING SITE, designated SEQ ID:38935, to the nucleotide sequence of VGAM605 RNA, herein designated VGAM RNA, also designated SEQ ID:3316.

Another function of VGAM605 is therefore inhibition of LOC150372 (Accession XM_086893). Accordingly, utilities of VGAM605 include diagnosis, prevention and treatment of diseases and clinical conditions associated with LOC150372. LOC219940 (Accession XM_167791) is another VGAM605 host target gene. LOC219940 BINDING SITE is HOST TARGET binding site found in the 5' untranslated region of mRNA encoded by LOC219940, corresponding to a HOST TARGET binding site such as BINDING SITE I, BINDING SITE II or BINDING SITE III. Table 2 illustrates the complementarity of the nucleotide sequences of LOC219940 BINDING SITE, designated SEQ ID:44829, to the nucleotide sequence of VGAM605 RNA, herein designated VGAM RNA, also designated SEQ ID:3316.

Another function of VGAM605 is therefore inhibition of LOC219940 (Accession XM_167791). Accordingly, utilities of VGAM605 include diagnosis, prevention and treatment of diseases and clinical conditions associated with LOC219940. LOC222166 (Accession XM_168425) is another VGAM605 host target gene. LOC222166 BINDING SITE is HOST TARGET binding site found in the 3' untranslated region of mRNA encoded by LOC222166, corresponding to a HOST TARGET binding site such as BINDING SITE I, BINDING SITE II or BINDING SITE III. Table 2 illustrates the complementarity of the nucleotide sequences of LOC222166 BINDING SITE, designated SEQ ID:45149, to the nucleotide sequence of VGAM605 RNA, herein designated VGAM RNA, also designated SEQ ID:3316.

Another function of VGAM605 is therefore inhibition of LOC222166 (Accession XM_168425). Accordingly, utilities of VGAM605 include diagnosis, prevention and treatment of diseases and clinical conditions associated with LOC222166. LOC51133 (Accession NM_016121) is another VGAM605 host target gene. LOC51133 BINDING SITE is HOST TARGET binding site found in the 3' untranslated region of mRNA encoded by LOC51133, corresponding to a HOST TARGET binding site such as BINDING SITE I, BINDING SITE II or BINDING SITE III. Table 2 illustrates the complementarity of the nucleotide sequences of LOC51133 BINDING SITE, designated SEQ ID:18203, to the nucleotide sequence of VGAM605 RNA, herein designated VGAM RNA, also designated SEQ ID:3316.

Another function of VGAM605 is therefore inhibition of LOC51133 (Accession NM_016121). Accordingly, utilities of VGAM605 include diagnosis, prevention and treatment of diseases and clinical conditions associated with LOC51133. LOC92181 (Accession XM_043394) is another VGAM605 host target gene. LOC92181 BINDING SITE is HOST TARGET binding site found in the 3' untranslated region of mRNA encoded by LOC92181, corresponding to a HOST TARGET binding site such as BINDING SITE I, BINDING SITE II or BINDING SITE III. Table 2 illustrates the complementarity of the nucleotide sequences of LOC92181 BINDING SITE, designated SEQ ID:33943, to the nucleotide sequence of VGAM605 RNA, herein designated VGAM RNA, also designated SEQ ID:3316.

Another function of VGAM605 is therefore inhibition of LOC92181 (Accession XM_043394). Accordingly, utilities of VGAM605 include diagnosis, prevention and treatment of diseases and clinical conditions associated with LOC92181. FIG. 1 further provides a conceptual description of a novel bioinformatically detected viral gene of the present invention, referred to here as Viral Genomic Address Messenger 606 (VGAM606) viral gene, which modulates expression of respective host target genes thereof, the function and utility of which host target genes is known in the art.

VGAM606 is a novel bioinformatically detected regulatory, non protein coding, viral micro RNA (miRNA) gene. The method by which VGAM606 was detected is described hereinabove with reference to FIGS. 1-8.

VGAM606 gene, herein designated VGAM GENE, is a viral gene contained in the genome of Transmissible Gastroenteritis Virus. VGAM606 host target gene, herein designated VGAM HOST TARGET GENE, is a human gene contained in the human genome.

VGAM606 gene encodes a VGAM606 precursor RNA, herein designated VGAM PRECURSOR RNA. Similar to other miRNA genes, and unlike most ordinary genes, VGAM606 precursor RNA does not encode a protein. A nucleotide sequence identical or highly similar to the nucleotide sequence of VGAM606 precursor RNA is designated SEQ ID:592, and is provided hereinbelow with reference to the sequence listing part. Nucleotide sequence SEQ ID:592 is located at position 6033 relative to the genome of Transmissible Gastroenteritis Virus.

VGAM606 precursor RNA folds onto itself, forming VGAM606 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM606 folded precursor RNA into VGAM606 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM606 RNA is designated SEQ ID:3317, and is provided hereinbelow with reference to the sequence listing part.

VGAM606 host target gene, herein designated VGAM HOST TARGET GENE, encodes a corresponding messenger RNA, VGAM606 host target RNA, herein designated VGAM HOST TARGET RNA. VGAM606 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM606 RNA, herein designated VGAM RNA, binds complementarily to one or more host target binding sites located in untranslated regions of VGAM606 host target RNA, herein designated VGAM HOST TARGET RNA. This complementary binding is due to the fact that the nucleotide sequence of VGAM606 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM606 RNA, herein designated VGAM RNA, may have a different number of host target binding sites in untranslated regions of a VGAM606 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM606 RNA, herein designated VGAM RNA, to host target binding sites on VGAM606 host target RNA, herein designated VGAM HOST TARGET RNA, such as BINDING SITE I, BINDING SITE II and BINDING SITE III, inhibits translation of VGAM606 host target RNA into VGAM606 host target protein, herein designated VGAM HOST TARGET PROTEIN. VGAM host target protein is therefore outlined by a broken line.

It is appreciated that VGAM606 host target gene, herein designated VGAM HOST TARGET GENE, in fact represents a plurality of VGAM606 host target genes. The mRNA of each one of this plurality of VGAM606 host target genes comprises one or more host target binding sites, each having a nucleotide sequence which is at least partly complementary to VGAM606 RNA, herein designated VGAM RNA, and which when bound by VGAM606 RNA causes inhibition of translation of respective one or more VGAM606 host target proteins.

It is further appreciated by one skilled in the art that the mode of translational inhibition illustrated by FIG. 1 with specific reference to translational inhibition exerted by VGAM606 gene, herein designated VGAM GENE, on one or more VGAM606 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM606 is inhibition of expression of host target genes, as part of a novel viral mechanism of attacking a host. Accordingly, utilities of VGAM606 include diagnosis, prevention and treatment of viral infection by Transmissible Gastroenteritis Virus. Specific functions, and accordingly utilities, of VGAM606 correlate with, and may be deduced from, the identity of the host target genes which VGAM606 binds and inhibits, and the function of these host target genes, as elaborated hereinbelow.

Nucleotide sequences of the VGAM606 precursor RNA, herein designated VGAM PRECURSOR RNA, and of the 'diced' VGAM606 RNA, herein designated VGAM RNA, and a schematic representation of the secondary folding of VGAM606 folded precursor RNA, herein designated VGAM FOLDED PRECURSOR RNA, of VGAM606 are further described hereinbelow with reference to Table 1.

Nucleotide sequences of host target binding sites, such as BINDING SITE-I, BINDING SITE-II and BINDING SITE-III of FIG. 1, found on VGAM606 host target RNA, and schematic representation of the complementarity of each of these host target binding sites to VGAM606 RNA, herein designated VGAM RNA, are described hereinbelow with reference to Table 2.

As mentioned hereinabove with reference to FIG. 1, a function of VGAM606 gene, herein designated VGAM is inhibition of expression of VGAM606 target genes. It is appreciated that specific functions, and accordingly utilities, of VGAM606 correlate with, and may be deduced from, the identity of the target genes which VGAM606 binds and inhibits, and the function of these target genes, as elaborated hereinbelow.

Giant Axonal Neuropathy (gigaxonin) (GAN, Accession NM_022041) is a VGAM606 host target gene. GAN BINDING SITE is HOST TARGET binding site found in the 3' untranslated region of mRNA encoded by GAN, corresponding to a HOST TARGET binding site such as BINDING SITE I, BINDING SITE II or BINDING SITE III. Table 2 illustrates the complementarity of the nucleotide sequences of GAN BINDING SITE, designated SEQ ID:22565, to the nucleotide sequence of VGAM606 RNA, herein designated VGAM RNA, also designated SEQ ID:3317.

A function of VGAM606 is therefore inhibition of Giant Axonal Neuropathy (gigaxonin) (GAN, Accession NM_022041), a gene which plays an important role in neurofilament architecture. Accordingly, utilities of VGAM606 include diagnosis, prevention and treatment of diseases and clinical conditions associated with GAN. The function of GAN has been established by previous studies. Giant axonal neuropathy (GAN; 256850), a severe autosomal recessive sensorineural neuropathy affecting both the peripheral nerves and the central nervous system, is characterized by neurofilament accumulation, leading to segmental distention of axons. The neuropathy is part of a generalized disorganization of the cytoskeletal intermediate filaments (IFs), to which neurofilaments belong, as abnormal aggregation of multiple tissue-specific IFs has been reported in this disorder: vimentin (VIM; 193060) in endothelial cells, Schwann cells, and cultured skin fibroblasts, and glial fibrillary acidic protein (GFAP; 137780) in astrocytes (Prineas et al., 1976; Pena, 1982; Bousquet et al., 1996). Keratin intermediate filaments also seem to be altered, as most patients present characteristic curly or kinky hairs (Treiber-Held et al., 1994). Bomont et al. (2000) used a positional cloning approach to isolate a novel, ubiquitously expressed gene that encoded a protein they named gigaxonin and contained mutations associated with giant axonal neuropathy. Gigaxonin contains an N-terminal BTB (broad-complex, tramtrack, and bric-a-brac) domain followed by 6 kelch repeats, which were predicted to adopt a beta-propeller shape. Distantly related proteins sharing a similar domain organization have various functions associated with the cytoskeleton, predicting that gigaxonin is a novel and distinct cytoskeletal protein that may represent a general pathologic target for other neurodegenerative disorders with alterations in the neurofilament network.

Full details of the abovementioned studies are described in the following publications, the disclosure of which are hereby incorporated by reference:

Bomont, P.; Cavalier, L.; Blondeau, F.; Ben Hamida, C.; Belal, S.; Tazir, M.; Demir, E.; Topaloglu, H.; Korinthenberg, R.; Tuysuz, B.; Landrieu, P.; Hentati, F.; Koenig, M.: The gene encoding gigaxonin, a new member of the cytoskeletal BTB/kelch repeat family, is mutated in giant axonal neuropathy. Nature Genet. 26:370-374, 2000; and Bousquet, O.; Basseville, M.; Vila-Porcile, E.; Billette de Villemeur, T.; Hauw, J.-J.; Landrieu, P.; Portier, M.-M.: Aggregation of a subpopulation of vimentin filaments in cultured.

Further studies establishing the function and utilities of GAN are found in John Hopkins OMIM database record ID 605379, and in sited publications numbered 9215-698 and 9216 listed in the bibliography section hereinbelow, which are also hereby incorporated by reference. Glutaminase (GLS, Accession NM_014905) is another VGAM606 host target gene. GLS BINDING SITE is HOST TARGET binding site found in the 3' untranslated region of mRNA encoded by GLS, corresponding to a HOST TARGET binding site such as BINDING SITE I, BINDING SITE II or BINDING SITE III. Table 2 illustrates the complementarity of the nucleotide sequences of GLS BINDING SITE, designated SEQ ID:17113, to the nucleotide sequence of VGAM606 RNA, herein designated VGAM RNA, also designated SEQ ID:3317.

Another function of VGAM606 is therefore inhibition of Glutaminase (GLS, Accession NM_014905). Accordingly, utilities of VGAM606 include diagnosis, prevention and treatment of diseases and clinical conditions associated with GLS. HUS1 Checkpoint Homolog (S. pombe) (HUS1, Accession XM_165873) is another VGAM606 host target gene. HUS1 BINDING SITE is HOST TARGET binding site found in the 3' untranslated region of mRNA encoded by HUS1, corresponding to a HOST TARGET binding site such as BINDING SITE I, BINDING SITE II or BINDING SITE III. Table 2 illustrates the complementarity of the nucleotide sequences of HUS1 BINDING SITE, designated SEQ ID:43791, to the nucleotide sequence of VGAM606 RNA, herein designated VGAM RNA, also designated SEQ ID:3317.

Another function of VGAM606 is therefore inhibition of HUS1 Checkpoint Homolog (S. pombe) (HUS1, Accession XM_165873), a gene which May form DNA damage-responsive protein complex. Accordingly, utilities of VGAM606 include diagnosis, prevention and treatment of diseases and clinical conditions associated with HUS1. The function of HUS1 and its association with various diseases and clinical conditions, has been established by previous studies, as described hereinabove with reference to VGAM228. Interleukin 20 Receptor, Alpha (IL20RA, Accession NM_014432) is another VGAM606 host target gene. IL20RA BINDING SITE is HOST TARGET binding site found in the 3' untranslated region of mRNA encoded by IL20RA, corresponding to a HOST TARGET binding site such as BINDING SITE I, BINDING SITE II or BINDING SITE III. Table 2 illustrates the complementarity of the nucleotide sequences of IL20RA BINDING SITE, designated SEQ ID:15790, to the nucleotide sequence of VGAM606 RNA, herein designated VGAM RNA, also designated SEQ ID:3317.

Another function of VGAM606 is therefore inhibition of Interleukin 20 Receptor, Alpha (IL20RA, Accession NM_014432), a gene which is the receptor for interleukin-20. Accordingly, utilities of VGAM606 include diagnosis, prevention and treatment of diseases and clinical conditions associated with IL20RA. The function of IL20RA and its association with various diseases and clinical conditions, has been established by previous studies, as described hereinabove with reference to VGAM315. Plastin 1 (I isoform) (PLS1, Accession NM_002670) is another VGAM606 host target gene. PLS1 BINDING SITE is HOST TARGET binding site found in the 3' untranslated region of mRNA encoded by PLS1, corresponding to a HOST TARGET binding site such as BINDING SITE I, BINDING SITE II or BINDING SITE III. Table 2 illustrates the complementarity of the nucleotide sequences of PLS1 BINDING SITE, designated SEQ ID:8539, to the nucleotide sequence of VGAM606 RNA, herein designated VGAM RNA, also designated SEQ ID:3317.

Another function of VGAM606 is therefore inhibition of Plastin 1 (I isoform) (PLS1, Accession NM_002670). Accordingly, utilities of VGAM606 include diagnosis, prevention and treatment of diseases and clinical conditions associated with PLS1. Chromosome 1 Open Reading Frame 17 (C1orf17, Accession XM_042965) is another VGAM606 host target gene. C1orf17 BINDING SITE is HOST TARGET binding site found in the 3' untranslated region of mRNA encoded by C1orf17, corresponding to a HOST TARGET binding site such as BINDING SITE I, BINDING SITE II or BINDING SITE III. Table 2 illustrates the complementarity of the nucleotide sequences of C1orf17 BINDING SITE, designated SEQ ID:33851, to the nucleotide sequence of VGAM606 RNA, herein designated VGAM RNA, also designated SEQ ID:3317.

Another function of VGAM606 is therefore inhibition of Chromosome 1 Open Reading Frame 17 (C1orf17, Accession XM_042965). Accordingly, utilities of VGAM606 include diagnosis, prevention and treatment of diseases and clinical conditions associated with C1orf17. KIAA0894 (Accession NM_014896) is another VGAM606 host target gene. KIAA0894 BINDING SITE is HOST TARGET binding site found in the 3' untranslated region of mRNA encoded by KIAA0894, corresponding to a HOST TARGET binding site such as BINDING SITE I, BINDING SITE II or BINDING SITE III. Table 2 illustrates the complementarity of the nucleotide sequences of KIAA0894 BINDING SITE, designated SEQ ID:17061, to the nucleotide sequence of VGAM606

RNA, herein designated VGAM RNA, also designated SEQ ID:3317.

Another function of VGAM606 is therefore inhibition of KIAA0894 (Accession NM_014896). Accordingly, utilities of VGAM606 include diagnosis, prevention and treatment of diseases and clinical conditions associated with KIAA0894. KIAA1181 (Accession XM_043340) is another VGAM606 host target gene. KIAA1181 BINDING SITE is HOST TARGET binding site found in the 3' untranslated region of mRNA encoded by KIAA1181, corresponding to a HOST TARGET binding site such as BINDING SITE I, BINDING SITE II or BINDING SITE III. Table 2 illustrates the complementarity of the nucleotide sequences of KIAA1181 BINDING SITE, designated SEQ ID:33925, to the nucleotide sequence of VGAM606 RNA, herein designated VGAM RNA, also designated SEQ ID:3317.

Another function of VGAM606 is therefore inhibition of KIAA1181 (Accession XM_043340). Accordingly, utilities of VGAM606 include diagnosis, prevention and treatment of diseases and clinical conditions associated with KIAA1181. Neural Precursor Cell Expressed, Developmentally Downregulated 5 (NEDD5, Accession NM_004404) is another VGAM606 host target gene. NEDD5 BINDING SITE is HOST TARGET binding site found in the 3' untranslated region of mRNA encoded by NEDD5, corresponding to a HOST TARGET binding site such as BINDING SITE I, BINDING SITE II or BINDING SITE III. Table 2 illustrates the complementarity of the nucleotide sequences of NEDD5 BINDING SITE, designated SEQ ID:10659, to the nucleotide sequence of VGAM606 RNA, herein designated VGAM RNA, also designated SEQ ID:3317.

Another function of VGAM606 is therefore inhibition of Neural Precursor Cell Expressed, Developmentally Downregulated 5 (NEDD5, Accession NM_004404). Accordingly, utilities of VGAM606 include diagnosis, prevention and treatment of diseases and clinical conditions associated with NEDD5. LOC154525 (Accession XM_098554) is another VGAM606 host target gene. LOC154525 BINDING SITE is HOST TARGET binding site found in the 5' untranslated region of mRNA encoded by LOC154525, corresponding to a HOST TARGET binding site such as BINDING SITE I, BINDING SITE II or BINDING SITE III. Table 2 illustrates the complementarity of the nucleotide sequences of LOC154525 BINDING SITE, designated SEQ ID:41709, to the nucleotide sequence of VGAM606 RNA, herein designated VGAM RNA, also designated SEQ ID:3317.

Another function of VGAM606 is therefore inhibition of LOC154525 (Accession XM_098554). Accordingly, utilities of VGAM606 include diagnosis, prevention and treatment of diseases and clinical conditions associated with LOC154525. LOC221271 (Accession XM_166307) is another VGAM606 host target gene. LOC221271 BINDING SITE is HOST TARGET binding site found in the 3' untranslated region of mRNA encoded by LOC221271, corresponding to a HOST TARGET binding site such as BINDING SITE I, BINDING SITE II or BINDING SITE III. Table 2 illustrates the complementarity of the nucleotide sequences of LOC221271 BINDING SITE, designated SEQ ID:44127, to the nucleotide sequence of VGAM606 RNA, herein designated VGAM RNA, also designated SEQ ID:3317.

Another function of VGAM606 is therefore inhibition of LOC221271 (Accession XM_166307). Accordingly, utilities of VGAM606 include diagnosis, prevention and treatment of diseases and clinical conditions associated with LOC221271. LOC253260 (Accession XM_171097) is another VGAM606 host target gene. LOC253260 BINDING SITE is HOST TARGET binding site found in the 3' untranslated region of mRNA encoded by LOC253260, corresponding to a HOST TARGET binding site such as BINDING SITE I, BINDING SITE II or BINDING SITE III. Table 2 illustrates the complementarity of the nucleotide sequences of LOC253260 BINDING SITE, designated SEQ ID:45910, to the nucleotide sequence of VGAM606 RNA, herein designated VGAM RNA, also designated SEQ ID:3317.

Another function of VGAM606 is therefore inhibition of LOC253260 (Accession XM_171097). Accordingly, utilities of VGAM606 include diagnosis, prevention and treatment of diseases and clinical conditions associated with LOC253260. LOC90841 (Accession XM_034427) is another VGAM606 host target gene. LOC90841 BINDING SITE is HOST TARGET binding site found in the 5' untranslated region of mRNA encoded by LOC90841, corresponding to a HOST TARGET binding site such as BINDING SITE I, BINDING SITE II or BINDING SITE III. Table 2 illustrates the complementarity of the nucleotide sequences of LOC90841 BINDING SITE, designated SEQ ID:32115, to the nucleotide sequence of VGAM606 RNA, herein designated VGAM RNA, also designated SEQ ID:3317.

Another function of VGAM606 is therefore inhibition of LOC90841 (Accession XM_034427). Accordingly, utilities of VGAM606 include diagnosis, prevention and treatment of diseases and clinical conditions associated with LOC90841. LOC91149 (Accession XM_036480) is another VGAM606 host target gene. LOC91149 BINDING SITE is HOST TARGET binding site found in the 3' untranslated region of mRNA encoded by LOC91149, corresponding to a HOST TARGET binding site such as BINDING SITE I, BINDING SITE II or BINDING SITE III. Table 2 illustrates the complementarity of the nucleotide sequences of LOC91149 BINDING SITE, designated SEQ ID:32461, to the nucleotide sequence of VGAM606 RNA, herein designated VGAM RNA, also designated SEQ ID:3317.

Another function of VGAM606 is therefore inhibition of LOC91149 (Accession XM_036480). Accordingly, utilities of VGAM606 include diagnosis, prevention and treatment of diseases and clinical conditions associated with LOC91149. FIG. 1 further provides a conceptual description of a novel bioinformatically detected viral gene of the present invention, referred to here as Viral Genomic Address Messenger 607 (VGAM607) viral gene, which modulates expression of respective host target genes thereof, the function and utility of which host target genes is known in the art.

VGAM607 is a novel bioinformatically detected regulatory, non protein coding, viral micro RNA (miRNA) gene. The method by which VGAM607 was detected is described hereinabove with reference to FIGS. 1-8.

VGAM607 gene, herein designated VGAM GENE, is a viral gene contained in the genome of Rice Grassy Stunt Virus. VGAM607 host target gene, herein designated VGAM HOST TARGET GENE, is a human gene contained in the human genome.

VGAM607 gene encodes a VGAM607 precursor RNA, herein designated VGAM PRECURSOR RNA. Similar to other miRNA genes, and unlike most ordinary genes, VGAM607 precursor RNA does not encode a protein. A nucleotide sequence identical or highly similar to the nucleotide sequence of VGAM607 precursor RNA is designated SEQ ID:593, and is provided hereinbelow with reference to the sequence listing part. Nucleotide sequence SEQ ID:593 is located at position 8963 relative to the genome of Rice Grassy Stunt Virus.

VGAM607 precursor RNA folds onto itself, forming VGAM607 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM607 folded precursor RNA into VGAM607 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM607 RNA is designated SEQ ID:3318, and is provided hereinbelow with reference to the sequence listing part.

VGAM607 host target gene, herein designated VGAM HOST TARGET GENE, encodes a corresponding messenger RNA, VGAM607 host target RNA, herein designated VGAM HOST TARGET RNA. VGAM607 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM607 RNA, herein designated VGAM RNA, binds complementarily to one or more host target binding sites located in untranslated regions of VGAM607 host target RNA, herein designated VGAM HOST TARGET RNA. This complementary binding is due to the fact that the nucleotide sequence of VGAM607 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM607 RNA, herein designated VGAM RNA, may have a different number of host target binding sites in untranslated regions of a VGAM607 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM607 RNA, herein designated VGAM RNA, to host target binding sites on VGAM607 host target RNA, herein designated VGAM HOST TARGET RNA, such as BINDING SITE I, BINDING SITE II and BINDING SITE III, inhibits translation of VGAM607 host target RNA into VGAM607 host target protein, herein designated VGAM HOST TARGET PROTEIN. VGAM host target protein is therefore outlined by a broken line.

It is appreciated that VGAM607 host target gene, herein designated VGAM HOST TARGET GENE, in fact represents a plurality of VGAM607 host target genes. The mRNA of each one of this plurality of VGAM607 host target genes comprises one or more host target binding sites, each having a nucleotide sequence which is at least partly complementary to VGAM607 RNA, herein designated VGAM RNA, and which when bound by VGAM607 RNA causes inhibition of translation of respective one or more VGAM607 host target proteins.

It is further appreciated by one skilled in the art that the mode of translational inhibition illustrated by FIG. 1 with specific reference to translational inhibition exerted by VGAM607 gene, herein designated VGAM GENE, on one or more VGAM607 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM607 is inhibition of expression of host target genes, as part of a novel viral mechanism of attacking a host. Accordingly, utilities of VGAM607 include diagnosis, prevention and treatment of viral infection by Rice Grassy Stunt Virus. Specific functions, and accordingly utilities, of VGAM607 correlate with, and may be deduced from, the identity of the host target genes which VGAM607 binds and inhibits, and the function of these host target genes, as elaborated hereinbelow.

Nucleotide sequences of the VGAM607 precursor RNA, herein designated VGAM PRECURSOR RNA, and of the 'diced' VGAM607 RNA, herein designated VGAM RNA, and a schematic representation of the secondary folding of VGAM607 folded precursor RNA, herein designated VGAM FOLDED PRECURSOR RNA, of VGAM607 are further described hereinbelow with reference to Table 1.

Nucleotide sequences of host target binding sites, such as BINDING SITE-I, BINDING SITE-II and BINDING SITE-III of FIG. 1, found on VGAM607 host target RNA, and schematic representation of the complementarity of each of these host target binding sites to VGAM607 RNA, herein designated VGAM RNA, are described hereinbelow with reference to Table 2.

As mentioned hereinabove with reference to FIG. 1, a function of VGAM607 gene, herein designated VGAM is inhibition of expression of VGAM607 target genes. It is appreciated that specific functions, and accordingly utilities, of VGAM607 correlate with, and may be deduced from, the identity of the target genes which VGAM607 binds and inhibits, and the function of these target genes, as elaborated hereinbelow.

Parathyroid Hormone Receptor 2 (PTHR2, Accession NM_005048) is a VGAM607 host target gene. PTHR2 BINDING SITE is HOST TARGET binding site found in the 3' untranslated region of mRNA encoded by PTHR2, corresponding to a HOST TARGET binding site such as BINDING SITE I, BINDING SITE II or BINDING SITE III. Table 2 illustrates the complementarity of the nucleotide sequences of PTHR2 BINDING SITE, designated SEQ ID:11481, to the nucleotide sequence of VGAM607 RNA, herein designated VGAM RNA, also designated SEQ ID:3318.

A function of VGAM607 is therefore inhibition of Parathyroid Hormone Receptor 2 (PTHR2, Accession NM_005048), a gene which is a G protein-coupled receptor selective for parathyroid hormone binding. Accordingly, utilities of VGAM607 include diagnosis, prevention and treatment of diseases and clinical conditions associated with PTHR2. The function of PTHR2 has been established by previous studies. Usdin et al. (1995) identified a 7-transmembrane-domain G protein-coupled receptor that selectively recognizes parathyroid hormone (PTH; 168450). The receptor, which they designated PTHR2, is a member of the secretin receptor family of G protein-coupled receptors (see OMIM Ref. No. 182098). There is 30 to 70% amino acid sequence identity between receptors within the secretin receptor family, but these receptors have essentially no sequence identity with most known G protein-coupled receptors of the rhodopsin family (see OMIM Ref. No. 180380) or with the metabotropic glutamate receptor family (see OMIM Ref. No. 601115). PTHR2 is most similar (51% overall amino acid identity) to the PTH/PTHRP receptor (OMIM Ref. No. 168468). The PTHR2 gene was most abundantly expressed in brain, pancreas, testis, and placenta. Although both PTH and PTH-related peptide (PTHRP; 168470) bind to the PTH/PTHRP receptor and stimulate cAMP accumulation with similar efficacy, only PTH activates PTHR2. To determine the structural basis for this selectivity, Clark et al. (1998) analyzed receptor chimeras in which the amino terminus and third extracellular domains of the 2 receptors were interchanged. Simultaneous interchange of wildtype amino termini and third extracellular loops eliminated agonist activation but not binding for both receptors. These results suggested that the amino terminus and third extracellular loop of the PTH2 and PTH/PTHRP receptors interact similarly with PTH, and that both domains contribute to differential interaction with PTHRP.

Full details of the abovementioned studies are described in the following publications, the disclosure of which are hereby incorporated by reference:

Usdin, T. B.; Gruber, C.; Bonner, T. I.: Identification and functional expression of a receptor selectively recognizing parathyroid hormone, the PTH2 receptor. J. Biol. Chem. 270: 15455-15458, 1995; and Clark, J. A.; Bonner, T. I.; Kim, A. S.; Usdin, T. B.: Multiple regions of ligand discrimination revealed by analysis of chimeric parathyroid hormone 2 (PTH2) and PTH/PTH-related peptid.

Further studies establishing the function and utilities of PTHR2 are found in John Hopkins OMIM database record ID 601469, and in sited publications numbered 6691-6693 listed in the bibliography section hereinbelow, which are also hereby incorporated by reference. FLJ23017 (Accession NM_022840) is another VGAM607 host target gene. FLJ23017 BINDING SITE is HOST TARGET binding site found in the 3' untranslated region of mRNA encoded by FLJ23017, corresponding to a HOST TARGET binding site such as BINDING SITE I, BINDING SITE II or BINDING SITE III. Table 2 illustrates the complementarity of the nucleotide sequences of FLJ23017 BINDING SITE, designated SEQ ID:23129, to the nucleotide sequence of VGAM607 RNA, herein designated VGAM RNA, also designated SEQ ID:3318.

Another function of VGAM607 is therefore inhibition of FLJ23017 (Accession NM_022840). Accordingly, utilities of VGAM607 include diagnosis, prevention and treatment of diseases and clinical conditions associated with FLJ23017. KIAA1622 (Accession NM_058237) is another VGAM607 host target gene. KIAA1622 BINDING SITE is HOST TARGET binding site found in the 3' untranslated region of mRNA encoded by KIAA1622, corresponding to a HOST TARGET binding site such as BINDING SITE I, BINDING SITE II or BINDING SITE III. Table 2 illustrates the complementarity of the nucleotide sequences of KIAA1622 BINDING SITE, designated SEQ ID:27767, to the nucleotide sequence of VGAM607 RNA, herein designated VGAM RNA, also designated SEQ ID:3318.

Another function of VGAM607 is therefore inhibition of KIAA1622 (Accession NM_058237). Accordingly, utilities of VGAM607 include diagnosis, prevention and treatment of diseases and clinical conditions associated with KIAA1622. LOC145820 (Accession XM_085246) is another VGAM607 host target gene. LOC145820 BINDING SITE is HOST TARGET binding site found in the 3' untranslated region of mRNA encoded by LOC145820, corresponding to a HOST TARGET binding site such as BINDING SITE I, BINDING SITE II or BINDING SITE III. Table 2 illustrates the complementarity of the nucleotide sequences of LOC145820 BINDING SITE, designated SEQ ID:37987, to the nucleotide sequence of VGAM607 RNA, herein designated VGAM RNA, also designated SEQ ID:3318.

Another function of VGAM607 is therefore inhibition of LOC145820 (Accession XM_085246). Accordingly, utilities of VGAM607 include diagnosis, prevention and treatment of diseases and clinical conditions associated with LOC145820. LOC149420 (Accession XM_086530) is another VGAM607 host target gene. LOC149420 BINDING SITE is HOST TARGET binding site found in the 3' untranslated region of mRNA encoded by LOC149420, corresponding to a HOST TARGET binding site such as BINDING SITE I, BINDING SITE II or BINDING SITE III. Table 2 illustrates the complementarity of the nucleotide sequences of LOC149420 BINDING SITE, designated SEQ ID:38748, to the nucleotide sequence of VGAM607 RNA, herein designated VGAM RNA, also designated SEQ ID:3318.

Another function of VGAM607 is therefore inhibition of LOC149420 (Accession XM_086530). Accordingly, utilities of VGAM607 include diagnosis, prevention and treatment of diseases and clinical conditions associated with LOC149420. FIG. 1 further provides a conceptual description of a novel bioinformatically detected viral gene of the present invention, referred to here as Viral Genomic Address Messenger 608 (VGAM608) viral gene, which modulates expression of respective host target genes thereof, the function and utility of which host target genes is known in the art.

VGAM608 is a novel bioinformatically detected regulatory, non protein coding, viral micro RNA (miRNA) gene. The method by which VGAM608 was detected is described hereinabove with reference to FIGS. 1-8.

VGAM608 gene, herein designated VGAM GENE, is a viral gene contained in the genome of Rice Grassy Stunt Virus. VGAM608 host target gene, herein designated VGAM HOST TARGET GENE, is a human gene contained in the human genome.

VGAM608 gene encodes a VGAM608 precursor RNA, herein designated VGAM PRECURSOR RNA. Similar to other miRNA genes, and unlike most ordinary genes, VGAM608 precursor RNA does not encode a protein. A nucleotide sequence identical or highly similar to the nucleotide sequence of VGAM608 precursor RNA is designated SEQ ID:594, and is provided hereinbelow with reference to the sequence listing part. Nucleotide sequence SEQ ID:594 is located at position 1950 relative to the genome of Rice Grassy Stunt Virus.

VGAM608 precursor RNA folds onto itself, forming VGAM608 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM608 folded precursor RNA into VGAM608 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM608 RNA is designated SEQ ID:3319, and is provided hereinbelow with reference to the sequence listing part.

VGAM608 host target gene, herein designated VGAM HOST TARGET GENE, encodes a corresponding messenger RNA, VGAM608 host target RNA, herein designated VGAM HOST TARGET RNA. VGAM608 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM608 RNA, herein designated VGAM RNA, binds complementarily to one or more host target binding sites located in untranslated regions of VGAM608 host target RNA, herein designated VGAM HOST TARGET RNA. This complementary binding is due to the fact that the nucleotide sequence of VGAM608 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM608 RNA, herein designated VGAM RNA, may have a different number of host target binding sites in untranslated regions of a VGAM608 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM608 RNA, herein designated VGAM RNA, to host target binding sites on VGAM608 host target RNA, herein designated VGAM HOST TARGET RNA, such as BINDING SITE I, BINDING SITE II and BINDING SITE III, inhibits translation of VGAM608 host target RNA into VGAM608 host target protein, herein designated VGAM HOST TARGET PROTEIN. VGAM host target protein is therefore outlined by a broken line.

It is appreciated that VGAM608 host target gene, herein designated VGAM HOST TARGET GENE, in fact represents a plurality of VGAM608 host target genes. The mRNA of each one of this plurality of VGAM608 host target genes comprises one or more host target binding sites, each having a nucleotide sequence which is at least partly complementary to VGAM608 RNA, herein designated VGAM RNA, and which when bound by VGAM608 RNA causes inhibition of translation of respective one or more VGAM608 host target proteins.

It is further appreciated by one skilled in the art that the mode of translational inhibition illustrated by FIG. 1 with specific reference to translational inhibition exerted by VGAM608 gene, herein designated VGAM GENE, on one or more VGAM608 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM608 is inhibition of expression of host target genes, as part of a novel viral mechanism of attacking a host. Accordingly, utilities of VGAM608 include diagnosis, prevention and treatment of viral infection by Rice Grassy Stunt Virus. Specific functions, and accordingly utilities, of VGAM608 correlate with, and may be deduced from, the identity of the host target genes which VGAM608 binds and inhibits, and the function of these host target genes, as elaborated hereinbelow.

Nucleotide sequences of the VGAM608 precursor RNA, herein designated VGAM PRECURSOR RNA, and of the 'diced' VGAM608 RNA, herein designated VGAM RNA, and a schematic representation of the secondary folding of VGAM608 folded precursor RNA, herein designated VGAM FOLDED PRECURSOR RNA, of VGAM608 are further described hereinbelow with reference to Table 1.

Nucleotide sequences of host target binding sites, such as BINDING SITE-I, BINDING SITE-II and BINDING SITE-III of FIG. 1, found on VGAM608 host target RNA, and schematic representation of the complementarity of each of these host target binding sites to VGAM608 RNA, herein designated VGAM RNA, are described hereinbelow with reference to Table 2.

As mentioned hereinabove with reference to FIG. 1, a function of VGAM608 gene, herein designated VGAM is inhibition of expression of VGAM608 target genes. It is appreciated that specific functions, and accordingly utilities, of VGAM608 correlate with, and may be deduced from, the identity of the target genes which VGAM608 binds and inhibits, and the function of these target genes, as elaborated hereinbelow.

A Disintegrin and Metalloproteinase Domain 28 (ADAM28, Accession NM_014265) is a VGAM608 host target gene. ADAM28 BINDING SITE is HOST TARGET binding site found in the 3' untranslated region of mRNA encoded by ADAM28, corresponding to a HOST TARGET binding site such as BINDING SITE I, BINDING SITE II or BINDING SITE III. Table 2 illustrates the complementarity of the nucleotide sequences of ADAM28 BINDING SITE, designated SEQ ID:15541, to the nucleotide sequence of VGAM608 RNA, herein designated VGAM RNA, also designated SEQ ID:3319.

A function of VGAM608 is therefore inhibition of A Disintegrin and Metalloproteinase Domain 28 (ADAM28, Accession NM_014265), a gene which Member of the MDC family of metalloproteinases. Accordingly, utilities of VGAM608 include diagnosis, prevention and treatment of diseases and clinical conditions associated with ADAM28. The function of ADAM28 has been established by previous studies. ADAM28 belongs to a family of cell surface and secreted glycoproteins that possess both proteolytic and adhesive properties (Bridges et al., 2002). ADAM proteins have been implicated in neurogenesis, fertilization, muscle development, and the release of membrane-anchored proteins. By PCR with degenerate primers on lymph node cDNA, searching sequence databases, and probing a lymph node cDNA library, Roberts et al. (1999) isolated cDNAs encoding 2 splice variants of ADAM28, which they designated MDCL. The deduced 775-amino acid transmembrane variant, MDCLm, has the typical ADAM domain structure, including signal peptide, propeptide, metalloprotease, disintegrin, cysteine-rich, EGF, and transmembrane domains. The deduced 540-amino acid secreted variant, MDCLs, has signal peptide, propeptide, metalloprotease, and disintegrin domains identical to those of MDCLm; however, its cysteine-rich domain differs in sequence and contains a stop codon midway through. In addition, MDCLm has 6 potential N-linked glycosylation sites, while MDCLs has only 3. Northern blot and RT-PCR analyses revealed expression of a 2.8-kb MDCLm transcript in spleen, lymph node, and, to a lesser extent, in peripheral blood leukocytes. MDCLs was primarily expressed in spleen as a 2.2-kb transcript. Immunoblot analysis of peripheral blood lymphocytes recognized MDCL proteins of 87 and 67 kD. Immunohistochemical analysis detected expression of MDCL in multiple T- and B-lymphocyte-containing tissues. Jury et al. (1999) cloned ADAM28, which they termed eMDC II, from macaque and human epididymis.

Full details of the abovementioned studies are described in the following publications, the disclosure of which are hereby incorporated by reference:

Bridges, L. C.; Tani, P. H.; Hanson, K. R.; Roberts, C. M.; Judkins, M. B.; Bowditch, R. D.: The lymphocyte metalloprotease MDC-L (ADAM28) is a ligand for the integrin alpha-4/beta-1. J. Biol. Chem. 277:3784-3792, 2002; and Roberts, C. M.; Tani, P. H.; Bridges, L. C.; Laszik, Z.; Bowditch, R. D.: MDC-L, a novel metalloprotease disintegrin cysteine-rich protein family member expressed by human lymphocytes.

Further studies establishing the function and utilities of ADAM28 are found in John Hopkins OMIM database record ID 606188, and in sited publications numbered 6132-6135 listed in the bibliography section hereinbelow, which are also hereby incorporated by reference. Collagen, Type IV, Alpha 3 (Goodpasture antigen) (COL4A3, Accession NM_031363) is another VGAM608 host target gene. COL4A3 BINDING SITE1 through COL4A3 BINDING SITE3 are HOST TARGET binding sites found in untranslated regions of mRNA encoded by COL4A3, corresponding to HOST TARGET binding sites such as BINDING SITE I, BINDING SITE II or BINDING SITE III. Table 2 illustrates the complementarity of the nucleotide sequences of COL4A3 BINDING SITE1 through COL4A3 BINDING SITE3, designated SEQ ID:25354, SEQ ID:25360 and SEQ ID:5547 respectively, to the nucleotide sequence of VGAM608 RNA, herein designated VGAM RNA, also designated SEQ ID:3319.

Another function of VGAM608 is therefore inhibition of Collagen, Type IV, Alpha 3 (Goodpasture antigen) (COL4A3, Accession NM_031363). Accordingly, utilities of VGAM608 include diagnosis, prevention and treatment of diseases and clinical conditions associated with COL4A3. Dihydropyrimidinase-like 2 (DPYSL2, Accession NM_001386) is another VGAM608 host target gene. DPYSL2 BINDING SITE is HOST TARGET binding site found in the 3' untranslated region of mRNA encoded by DPYSL2, corresponding to a HOST TARGET binding site such as BINDING SITE I, BINDING SITE II or BINDING SITE III. Table 2 illustrates the complementarity of the nucleotide sequences of DPYSL2 BINDING SITE, designated SEQ ID:7066, to the nucleotide sequence of VGAM608 RNA, herein designated VGAM RNA, also designated SEQ ID:3319.

Another function of VGAM608 is therefore inhibition of Dihydropyrimidinase-like 2 (DPYSL2, Accession NM_001386), a gene which is a member of the dihydropyrimidinase family. Accordingly, utilities of VGAM608 include diagnosis, prevention and treatment of diseases and clinical conditions associated with DPYSL2. The function of DPYSL2 and its association with various diseases and clinical conditions, has been established by previous studies, as described hereinabove with reference to VGAM217. DXS1283E (Accession XM_047871) is another VGAM608 host target gene. DXS1283E BINDING SITE is HOST TARGET binding site found in the 3' untranslated region of mRNA encoded by DXS1283E, corresponding to a HOST TARGET binding site such as BINDING SITE I, BINDING SITE II or BINDING SITE III. Table 2 illustrates the complementarity of the nucleotide sequences of DXS1283E BINDING SITE, designated SEQ ID:35064, to the nucleotide sequence of VGAM608 RNA, herein designated VGAM RNA, also designated SEQ ID:3319.

Another function of VGAM608 is therefore inhibition of DXS1283E (Accession XM_047871). Accordingly, utilities of VGAM608 include diagnosis, prevention and treatment of diseases and clinical conditions associated with DXS1283E. Epithelial Membrane Protein 1 (EMP1, Accession NM_001423) is another VGAM608 host target gene. EMP1 BINDING SITE is HOST TARGET binding site found in the 3' untranslated region of mRNA encoded by EMP1, corresponding to a HOST TARGET binding site such as BINDING SITE I, BINDING SITE II or BINDING SITE III. Table 2 illustrates the complementarity of the nucleotide sequences of EMP1 BINDING SITE, designated SEQ ID:7131, to the nucleotide sequence of VGAM608 RNA, herein designated VGAM RNA, also designated SEQ ID:3319.

Another function of VGAM608 is therefore inhibition of Epithelial Membrane Protein 1 (EMP1, Accession NM_001423), a gene which plays a role in squamous cell differentiation; member of the PMP22/EMP/MP20 family of membrane glycoproteins. Accordingly, utilities of VGAM608 include diagnosis, prevention and treatment of diseases and clinical conditions associated with EMP1. The function of EMP1 and its association with various diseases and clinical conditions, has been established by previous studies, as described hereinabove with reference to VGAM107. Ficolin (collagen/fibrinogen domain containing) 3 (Hakata antigen) (FCN3, Accession NM_003665) is another VGAM608 host target gene. FCN3 BINDING SITE is HOST TARGET binding site found in the 5' untranslated region of mRNA encoded by FCN3, corresponding to a HOST TARGET binding site such as BINDING SITE I, BINDING SITE II or BINDING SITE III. Table 2 illustrates the complementarity of the nucleotide sequences of FCN3 BINDING SITE, designated SEQ ID:9744, to the nucleotide sequence of VGAM608 RNA, herein designated VGAM RNA, also designated SEQ ID:3319.

Another function of VGAM608 is therefore inhibition of Ficolin (collagen/fibrinogen domain containing) 3 (Hakata antigen) (FCN3, Accession NM_003665). Accordingly, utilities of VGAM608 include diagnosis, prevention and treatment of diseases and clinical conditions associated with FCN3. Glutaminase (GLS, Accession NM_014905) is another VGAM608 host target gene. GLS BINDING SITE is HOST TARGET binding site found in the 3' untranslated region of mRNA encoded by GLS, corresponding to a HOST TARGET binding site such as BINDING SITE I, BINDING SITE II or BINDING SITE III. Table 2 illustrates the complementarity of the nucleotide sequences of GLS BINDING SITE, designated SEQ ID:17111, to the nucleotide sequence of VGAM608 RNA, herein designated VGAM RNA, also designated SEQ ID:3319.

Another function of VGAM608 is therefore inhibition of Glutaminase (GLS, Accession NM_014905). Accordingly, utilities of VGAM608 include diagnosis, prevention and treatment of diseases and clinical conditions associated with GLS. Leucine Zipper Transcription Factor-like 1 (LZTFL1, Accession NM_020347) is another VGAM608 host target gene. LZTFL1 BINDING SITE is HOST TARGET binding site found in the 3' untranslated region of mRNA encoded by LZTFL1, corresponding to a HOST TARGET binding site such as BINDING SITE I, BINDING SITE II or BINDING SITE III. Table 2 illustrates the complementarity of the nucleotide sequences of LZTFL1 BINDING SITE, designated SEQ ID:21601, to the nucleotide sequence of VGAM608 RNA, herein designated VGAM RNA, also designated SEQ ID:3319.

Another function of VGAM608 is therefore inhibition of Leucine Zipper Transcription Factor-like 1 (LZTFL1, Accession NM_020347). Accordingly, utilities of VGAM608 include diagnosis, prevention and treatment of diseases and clinical conditions associated with LZTFL1. Protease, Serine, 16 (thymus) (PRSS16, Accession NM_005865) is another VGAM608 host target gene. PRSS16 BINDING SITE is HOST TARGET binding site found in the 3' untranslated region of mRNA encoded by PRSS16, corresponding to a HOST TARGET binding site such as BINDING SITE I, BINDING SITE II or BINDING SITE III. Table 2 illustrates the complementarity of the nucleotide sequences of PRSS16 BINDING SITE, designated SEQ ID:12482, to the nucleotide sequence of VGAM608 RNA, herein designated VGAM RNA, also designated SEQ ID:3319.

Another function of VGAM608 is therefore inhibition of Protease, Serine, 16 (thymus) (PRSS16, Accession NM_005865). Accordingly, utilities of VGAM608 include diagnosis, prevention and treatment of diseases and clinical conditions associated with PRSS16. Solute Carrier Family 20 (phosphate transporter), Member 1 (SLC20A1, Accession XM_002217) is another VGAM608 host target gene. SLC20A1 BINDING SITE is HOST TARGET binding site found in the 5' untranslated region of mRNA encoded by SLC20A1, corresponding to a HOST TARGET binding site such as BINDING SITE I, BINDING SITE II or BINDING SITE III. Table 2 illustrates the complementarity of the nucleotide sequences of SLC20A1 BINDING SITE, designated SEQ ID:29874, to the nucleotide sequence of VGAM608 RNA, herein designated VGAM RNA, also designated SEQ ID:3319.

Another function of VGAM608 is therefore inhibition of Solute Carrier Family 20 (phosphate transporter), Member 1 (SLC20A1, Accession XM_002217), a gene which could be a sodium-phosphate symporter. Accordingly, utilities of VGAM608 include diagnosis, prevention and treatment of diseases and clinical conditions associated with SLC20A1. The function of SLC20A1 has been established by previous studies. By expression in Xenopus oocytes and in mammalian cells, Kavanaugh et al. (1994) determined that GLVR1 is a sodium-dependent phosphate symporter. Voltage-clamp analysis indicated net cation influx, suggesting that phosphate is transported with excess sodium ions. Palmer et al. (1999) showed that the GLVR1 gene consists of 11 exons spanning approximately 18 kb of genomic DNA. Exon 1 is noncoding. Using a luciferase reporter gene assay in transiently transfected chondrocytes and osteoblasts, Palmer et al. (2001) determined that the activity of the promoter of SLC20A1, which they called PIT1, requires a TATA-like sequence and a single SP1 (OMIM Ref. No. 189906) site. They found that this SP1 site could bind SP1 and SP3 (OMIM Ref. No. 601804). Despite the conservation of sequence between the human and mouse promoter, the promoter of mouse Pit1 depends on a combination of several cis-acting elements.

Full details of the abovementioned studies are described in the following publications, the disclosure of which are hereby incorporated by reference:

Kavanaugh, M. P.; Miller, D. G.; Zhang, W.; Law, W.; Kozak, S. L.; Kabat, D.; Miller, A. D.: Cell-surface receptors for gibbon ape leukemia virus and amphotropic murine retrovirus are inducible sodium-dependent phosphate symporters. Proc. Nat. Acad. Sci. 91:7071-7075, 1994; and Palmer, G.; Manen, D.; Bonjour, J.-P.; Caverzasio, J.: Species-specific mechanisms control the activity of the Pit1/PIT1 phosphate transporter gene promoter in mouse and human. Gene 279.

Further studies establishing the function and utilities of SLC20A1 are found in John Hopkins OMIM database record ID 137570, and in sited publications numbered 4026-402 and 4007 listed in the bibliography section hereinbelow, which are also hereby incorporated by reference. Tripartite Motif-containing 9 (TRIM9, Accession NM_015163) is another VGAM608 host target gene. TRIM9 BINDING SITE is HOST TARGET binding site found in the 3' untranslated region of mRNA encoded by TRIM9, corresponding to a HOST TARGET binding site such as BINDING SITE I, BINDING SITE II or BINDING SITE III. Table 2 illustrates the complementarity of the nucleotide sequences of TRIM9 BINDING SITE, designated SEQ ID:17514, to the nucleotide sequence of VGAM608 RNA, herein designated VGAM RNA, also designated SEQ ID:3319.

Another function of VGAM608 is therefore inhibition of Tripartite Motif-containing 9 (TRIM9, Accession NM_015163), a gene which may function as a positive regulator for mannosylphosphate transferase and is required to mediate mannosylphosphate transfer in both the core and outer chain portions of n-linked. oligosaccharides. Accordingly, utilities of VGAM608 include diagnosis, prevention and treatment of diseases and clinical conditions associated with TRIM9. The function of TRIM9 and its association with various diseases and clinical conditions, has been established by previous studies, as described hereinabove with reference to VGAM74. Zinc Finger Protein 215 (ZNF215, Accession NM_013250) is another VGAM608 host target gene. ZNF215 BINDING SITE is HOST TARGET binding site found in the 5' untranslated region of mRNA encoded by ZNF215, corresponding to a HOST TARGET binding site such as BINDING SITE I, BINDING SITE II or BINDING SITE III. Table 2 illustrates the complementarity of the nucleotide sequences of ZNF215 BINDING SITE, designated SEQ ID:14912, to the nucleotide sequence of VGAM608 RNA, herein designated VGAM RNA, also designated SEQ ID:3319.

Another function of VGAM608 is therefore inhibition of Zinc Finger Protein 215 (ZNF215, Accession NM_013250). Accordingly, utilities of VGAM608 include diagnosis, prevention and treatment of diseases and clinical conditions associated with ZNF215. Apolipoprotein A-V (APOA5, Accession NM_052968) is another VGAM608 host target gene. APOA5 BINDING SITE is HOST TARGET binding site found in the 3' untranslated region of mRNA encoded by APOA5, corresponding to a HOST TARGET binding site such as BINDING SITE I, BINDING SITE II or BINDING SITE III. Table 2 illustrates the complementarity of the nucleotide sequences of APOA5 BINDING SITE, designated SEQ ID:27540, to the nucleotide sequence of VGAM608 RNA, herein designated VGAM RNA, also designated SEQ ID:3319.

Another function of VGAM608 is therefore inhibition of Apolipoprotein A-V (APOA5, Accession NM_052968). Accordingly, utilities of VGAM608 include diagnosis, prevention and treatment of diseases and clinical conditions associated with APOA5. Rho GTPase Activating Protein 5 (ARHGAP5, Accession XM_085082) is another VGAM608 host target gene. ARHGAP5 BINDING SITE is HOST TARGET binding site found in the 3' untranslated region of mRNA encoded by ARHGAP5, corresponding to a HOST TARGET binding site such as BINDING SITE I, BINDING SITE II or BINDING SITE III. Table 2 illustrates the complementarity of the nucleotide sequences of ARHGAP5 BINDING SITE, designated SEQ ID:37821, to the nucleotide sequence of VGAM608 RNA, herein designated VGAM RNA, also designated SEQ ID:3319.

Another function of VGAM608 is therefore inhibition of Rho GTPase Activating Protein 5 (ARHGAP5, Accession XM_085082). Accordingly, utilities of VGAM608 include diagnosis, prevention and treatment of diseases and clinical conditions associated with ARHGAP5. Rho Guanine Nucleotide Exchange Factor (GEF) 4 (ARHGEF4, Accession NM_032995) is another VGAM608 host target gene. ARHGEF4 BINDING SITE is HOST TARGET binding site found in the 3' untranslated region of mRNA encoded by ARHGEF4, corresponding to a HOST TARGET binding site such as BINDING SITE I, BINDING SITE II or BINDING SITE III. Table 2 illustrates the complementarity of the nucleotide sequences of ARHGEF4 BINDING SITE, designated SEQ ID:26875, to the nucleotide sequence of VGAM608 RNA, herein designated VGAM RNA, also designated SEQ ID:3319.

Another function of VGAM608 is therefore inhibition of Rho Guanine Nucleotide Exchange Factor (GEF) 4 (ARHGEF4, Accession NM_032995). Accordingly, utilities of VGAM608 include diagnosis, prevention and treatment of diseases and clinical conditions associated with ARHGEF4. ARNTL2 (Accession NM_020183) is another VGAM608 host target gene. ARNTL2 BINDING SITE is HOST TARGET binding site found in the 3' untranslated region of mRNA encoded by ARNTL2, corresponding to a HOST TARGET binding site such as BINDING SITE I, BINDING SITE II or BINDING SITE III. Table 2 illustrates the complementarity of the nucleotide sequences of ARNTL2 BINDING SITE, designated SEQ ID:21421, to the nucleotide sequence of VGAM608 RNA, herein designated VGAM RNA, also designated SEQ ID:3319.

Another function of VGAM608 is therefore inhibition of ARNTL2 (Accession NM_020183). Accordingly, utilities of VGAM608 include diagnosis, prevention and treatment of diseases and clinical conditions associated with ARNTL2. DKFZP727G051 (Accession XM_045308) is another VGAM608 host target gene. DKFZP727G051 BINDING SITE is HOST TARGET binding site found in the 3' untranslated region of mRNA encoded by DKFZP727G051, corresponding to a HOST TARGET binding site such as BINDING SITE I, BINDING SITE II or BINDING SITE III. Table 2 illustrates the complementarity of the nucleotide sequences of DKFZP727G051 BINDING SITE, designated SEQ ID:34431, to the nucleotide sequence of VGAM608 RNA, herein designated VGAM RNA, also designated SEQ ID:3319.

Another function of VGAM608 is therefore inhibition of DKFZP727G051 (Accession XM_045308). Accordingly, utilities of VGAM608 include diagnosis, prevention and treatment of diseases and clinical conditions associated with DKFZP727G051. DKFZp761D221 (Accession NM_032291) is another VGAM608 host target gene. DKFZp761D221 BINDING SITE is HOST TARGET binding site found in the 3' untranslated region of mRNA encoded by DKFZp761D221, corresponding to a HOST TARGET binding site such as BINDING SITE I, BINDING SITE II or BINDING SITE III. Table 2 illustrates the complementarity of the nucleotide sequences of DKFZp761D221 BINDING SITE, designated SEQ ID:26058, to the nucleotide sequence of VGAM608 RNA, herein designated VGAM RNA, also designated SEQ ID:3319.

Another function of VGAM608 is therefore inhibition of DKFZp761D221 (Accession NM_032291). Accordingly, utilities of VGAM608 include diagnosis, prevention and treatment of diseases and clinical conditions associated with DKFZp761D221. FLJ10687 (Accession NM_018178) is another VGAM608 host target gene. FLJ10687 BINDING SITE is HOST TARGET binding site found in the 3' untranslated region of mRNA encoded by FLJ10687, corresponding to a HOST TARGET binding site such as BINDING SITE I, BINDING SITE II or BINDING SITE III. Table 2 illustrates the complementarity of the nucleotide sequences of FLJ10687 BINDING SITE, designated SEQ ID:20012, to the nucleotide sequence of VGAM608 RNA, herein designated VGAM RNA, also designated SEQ ID:3319.

Another function of VGAM608 is therefore inhibition of FLJ10687 (Accession NM_018178). Accordingly, utilities of VGAM608 include diagnosis, prevention and treatment of diseases and clinical conditions associated with FLJ10687. FLJ13855 (Accession NM_023079) is another VGAM608 host target gene. FLJ13855 BINDING SITE is HOST TARGET binding site found in the 3' untranslated region of mRNA encoded by FLJ13855, corresponding to a HOST TARGET binding site such as BINDING SITE I, BINDING SITE II or BINDING SITE III. Table 2 illustrates the complementarity of the nucleotide sequences of FLJ13855 BINDING SITE, designated SEQ ID:23345, to the nucleotide sequence of VGAM608 RNA, herein designated VGAM RNA, also designated SEQ ID:3319.

Another function of VGAM608 is therefore inhibition of FLJ13855 (Accession NM_023079). Accordingly, utilities of VGAM608 include diagnosis, prevention and treatment of diseases and clinical conditions associated with FLJ13855. FLJ20006 (Accession NM_017618) is another VGAM608 host target gene. FLJ20006 BINDING SITE is HOST TARGET binding site found in the 3' untranslated region of mRNA encoded by FLJ20006, corresponding to a HOST TARGET binding site such as BINDING SITE I, BINDING SITE II or BINDING SITE III. Table 2 illustrates the complementarity of the nucleotide sequences of FLJ20006 BINDING SITE, designated SEQ ID:19119, to the nucleotide sequence of VGAM608 RNA, herein designated VGAM RNA, also designated SEQ ID:3319.

Another function of VGAM608 is therefore inhibition of FLJ20006 (Accession NM_017618). Accordingly, utilities of VGAM608 include diagnosis, prevention and treatment of diseases and clinical conditions associated with FLJ20006. FLJ20986 (Accession NM_024524) is another VGAM608 host target gene. FLJ20986 BINDING SITE is HOST TARGET binding site found in the 5' untranslated region of mRNA encoded by FLJ20986, corresponding to a HOST TARGET binding site such as BINDING SITE I, BINDING SITE II or BINDING SITE III. Table 2 illustrates the complementarity of the nucleotide sequences of FLJ20986 BINDING SITE, designated SEQ ID:23728, to the nucleotide sequence of VGAM608 RNA, herein designated VGAM RNA, also designated SEQ ID:3319.

Another function of VGAM608 is therefore inhibition of FLJ20986 (Accession NM_024524). Accordingly, utilities of VGAM608 include diagnosis, prevention and treatment of diseases and clinical conditions associated with FLJ20986. KIAA0907 (Accession NM_014949) is another VGAM608 host target gene. KIAA0907 BINDING SITE is HOST TARGET binding site found in the 3' untranslated region of mRNA encoded by KIAA0907, corresponding to a HOST TARGET binding site such as BINDING SITE I, BINDING SITE II or BINDING SITE III. Table 2 illustrates the complementarity of the nucleotide sequences of KIAA0907 BIND- ING SITE, designated SEQ ID:17277, to the nucleotide sequence of VGAM608 RNA, herein designated VGAM RNA, also designated SEQ ID:3319.

Another function of VGAM608 is therefore inhibition of KIAA0907 (Accession NM_014949). Accordingly, utilities of VGAM608 include diagnosis, prevention and treatment of diseases and clinical conditions associated with KIAA0907. moblak (Accession NM_130807) is another VGAM608 host target gene. moblak BINDING SITE is HOST TARGET binding site found in the 3' untranslated region of mRNA encoded by moblak, corresponding to a HOST TARGET binding site such as BINDING SITE I, BINDING SITE II or BINDING SITE III. Table 2 illustrates the complementarity of the nucleotide sequences of moblak BINDING SITE, designated SEQ ID:28312, to the nucleotide sequence of VGAM608 RNA, herein designated VGAM RNA, also designated SEQ ID:3319.

Another function of VGAM608 is therefore inhibition of moblak (Accession NM_130807). Accordingly, utilities of VGAM608 include diagnosis, prevention and treatment of diseases and clinical conditions associated with moblak. PA26 (Accession NM_014454) is another VGAM608 host target gene. PA26 BINDING SITE is HOST TARGET binding site found in the 3' untranslated region of mRNA encoded by PA26, corresponding to a HOST TARGET binding site such as BINDING SITE I, BINDING SITE II or BINDING SITE III. Table 2 illustrates the complementarity of the nucleotide sequences of PA26 BINDING SITE, designated SEQ ID:15809, to the nucleotide sequence of VGAM608 RNA, herein designated VGAM RNA, also designated SEQ ID:3319.

Another function of VGAM608 is therefore inhibition of PA26 (Accession NM_014454). Accordingly, utilities of VGAM608 include diagnosis, prevention and treatment of diseases and clinical conditions associated with PA26. PRO2730 (Accession NM_025222) is another VGAM608 host target gene. PRO2730 BINDING SITE is HOST TARGET binding site found in the 3' untranslated region of mRNA encoded by PRO2730, corresponding to a HOST TARGET binding site such as BINDING SITE I, BINDING SITE II or BINDING SITE III. Table 2 illustrates the complementarity of the nucleotide sequences of PRO2730 BINDING SITE, designated SEQ ID:24900, to the nucleotide sequence of VGAM608 RNA, herein designated VGAM RNA, also designated SEQ ID:3319.

Another function of VGAM608 is therefore inhibition of PRO2730 (Accession NM_025222). Accordingly, utilities of VGAM608 include diagnosis, prevention and treatment of diseases and clinical conditions associated with PRO2730. SSH2 (Accession XM_030846) is another VGAM608 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31187, to the nucleotide sequence of VGAM608 RNA, herein designated VGAM RNA, also designated SEQ ID:3319.

Another function of VGAM608 is therefore inhibition of SSH2 (Accession XM_030846). Accordingly, utilities of VGAM608 include diagnosis, prevention and treatment of diseases and clinical conditions associated with SSH2. STAF65(gamma) (Accession NM_014860) is another VGAM608 host target gene. STAF65(gamma) BINDING SITE is HOST TARGET binding site found in the 3' untranslated region of mRNA encoded by STAF65(gamma), corresponding to a HOST TARGET binding site such as BINDING SITE I, BINDING SITE II or BINDING SITE III. Table 2 illustrates the complementarity of the nucleotide sequences of STAF65(gamma) BINDING SITE, designated SEQ ID:16927, to the nucleotide sequence of VGAM608 RNA, herein designated VGAM RNA, also designated SEQ ID:3319.

Another function of VGAM608 is therefore inhibition of STAF65(gamma) (Accession NM_014860). Accordingly, utilities of VGAM608 include diagnosis, prevention and treatment of diseases and clinical conditions associated with STAF65(gamma). SZF1 (Accession NM_016089) is another VGAM608 host target gene. SZF1 BINDING SITE is HOST TARGET binding site found in the 3' untranslated region of mRNA encoded by SZF1, corresponding to a HOST TARGET binding site such as BINDING SITE I, BINDING SITE II or BINDING SITE III. Table 2 illustrates the complementarity of the nucleotide sequences of SZF1 BINDING SITE, designated SEQ ID:18176, to the nucleotide sequence of VGAM608 RNA, herein designated VGAM RNA, also designated SEQ ID:3319.

Another function of VGAM608 is therefore inhibition of SZF1 (Accession NM_016089). Accordingly, utilities of VGAM608 include diagnosis, prevention and treatment of diseases and clinical conditions associated with SZF1. LOC134637 (Accession XM_059727) is another VGAM608 host target gene. LOC134637 BINDING SITE is HOST TARGET binding site found in the 3' untranslated region of mRNA encoded by LOC134637, corresponding to a HOST TARGET binding site such as BINDING SITE I, BINDING SITE II or BINDING SITE III. Table 2 illustrates the complementarity of the nucleotide sequences of LOC134637 BINDING SITE, designated SEQ ID:37078, to the nucleotide sequence of VGAM608 RNA, herein designated VGAM RNA, also designated SEQ ID:3319.

Another function of VGAM608 is therefore inhibition of LOC134637 (Accession XM_059727). Accordingly, utilities of VGAM608 include diagnosis, prevention and treatment of diseases and clinical conditions associated with LOC134637. LOC136345 (Accession XM_072455) is another VGAM608 host target gene. LOC136345 BINDING SITE is HOST TARGET binding site found in the 3' untranslated region of mRNA encoded by LOC136345, corresponding to a HOST TARGET binding site such as BINDING SITE I, BINDING SITE II or BINDING SITE III. Table 2 illustrates the complementarity of the nucleotide sequences of LOC136345 BINDING SITE, designated SEQ ID:37502, to the nucleotide sequence of VGAM608 RNA, herein designated VGAM RNA, also designated SEQ ID:3319.

Another function of VGAM608 is therefore inhibition of LOC136345 (Accession XM_072455). Accordingly, utilities of VGAM608 include diagnosis, prevention and treatment of diseases and clinical conditions associated with LOC136345. LOC147694 (Accession XM_085843) is another VGAM608 host target gene. LOC147694 BINDING SITE is HOST TARGET binding site found in the 3' untranslated region of mRNA encoded by LOC147694, corresponding to a HOST TARGET binding site such as BINDING SITE I, BINDING SITE II or BINDING SITE III. Table 2 illustrates the complementarity of the nucleotide sequences of LOC147694 BINDING SITE, designated SEQ ID:38373, to the nucleotide sequence of VGAM608 RNA, herein designated VGAM RNA, also designated SEQ ID:3319.

Another function of VGAM608 is therefore inhibition of LOC147694 (Accession XM_085843). Accordingly, utilities of VGAM608 include diagnosis, prevention and treatment of diseases and clinical conditions associated with LOC147694.

LOC155032 (Accession XM_098647) is another VGAM608 host target gene. LOC155032 BINDING SITE is HOST TARGET binding site found in the 5' untranslated region of mRNA encoded by LOC155032, corresponding to a HOST TARGET binding site such as BINDING SITE I, BINDING SITE II or BINDING SITE III. Table 2 illustrates the complementarity of the nucleotide sequences of LOC155032 BINDING SITE, designated SEQ ID:41750, to the nucleotide sequence of VGAM608 RNA, herein designated VGAM RNA, also designated SEQ ID:3319.

Another function of VGAM608 is therefore inhibition of LOC155032 (Accession XM_098647). Accordingly, utilities of VGAM608 include diagnosis, prevention and treatment of diseases and clinical conditions associated with LOC155032. LOC158835 (Accession XM_088683) is another VGAM608 host target gene. LOC158835 BINDING SITE is HOST TARGET binding site found in the 3' untranslated region of mRNA encoded by LOC158835, corresponding to a HOST TARGET binding site such as BINDING SITE I, BINDING SITE II or BINDING SITE III. Table 2 illustrates the complementarity of the nucleotide sequences of LOC158835 BINDING SITE, designated SEQ ID:39897, to the nucleotide sequence of VGAM608 RNA, herein designated VGAM RNA, also designated SEQ ID:3319.

Another function of VGAM608 is therefore inhibition of LOC158835 (Accession XM_088683). Accordingly, utilities of VGAM608 include diagnosis, prevention and treatment of diseases and clinical conditions associated with LOC158835. LOC199991 (Accession XM_117169) is another VGAM608 host target gene. LOC199991 BINDING SITE is HOST TARGET binding site found in the 5' untranslated region of mRNA encoded by LOC199991, corresponding to a HOST TARGET binding site such as BINDING SITE I, BINDING SITE II or BINDING SITE III. Table 2 illustrates the complementarity of the nucleotide sequences of LOC199991 BINDING SITE, designated SEQ ID:43276, to the nucleotide sequence of VGAM608 RNA, herein designated VGAM RNA, also designated SEQ ID:3319.

Another function of VGAM608 is therefore inhibition of LOC199991 (Accession XM_117169). Accordingly, utilities of VGAM608 include diagnosis, prevention and treatment of diseases and clinical conditions associated with LOC199991. LOC255520 (Accession XM_171073) is another VGAM608 host target gene. LOC255520 BINDING SITE is HOST TARGET binding site found in the 3' untranslated region of mRNA encoded by LOC255520, corresponding to a HOST TARGET binding site such as BINDING SITE I, BINDING SITE II or BINDING SITE III. Table 2 illustrates the complementarity of the nucleotide sequences of LOC255520 BINDING SITE, designated SEQ ID:45880, to the nucleotide sequence of VGAM608 RNA, herein designated VGAM RNA, also designated SEQ ID:3319.

Another function of VGAM608 is therefore inhibition of LOC255520 (Accession XM_171073). Accordingly, utilities of VGAM608 include diagnosis, prevention and treatment of diseases and clinical conditions associated with LOC255520. LOC257358 (Accession XM_173138) is another VGAM608 host target gene. LOC257358 BINDING SITE is HOST TARGET binding site found in the 3' untranslated region of mRNA encoded by LOC257358, corresponding to a HOST TARGET binding site such as BINDING SITE I, BINDING SITE II or BINDING SITE III. Table 2 illustrates the complementarity of the nucleotide sequences of LOC257358 BINDING SITE, designated SEQ ID:46391, to the nucleotide sequence of VGAM608 RNA, herein designated VGAM RNA, also designated SEQ ID:3319.

Another function of VGAM608 is therefore inhibition of LOC257358 (Accession XM_173138). Accordingly, utilities of VGAM608 include diagnosis, prevention and treatment of diseases and clinical conditions associated with LOC257358. LOC90485 (Accession XM_032059) is another VGAM608 host target gene. LOC90485 BINDING SITE is HOST TARGET binding site found in the 3' untranslated region of mRNA encoded by LOC90485, corresponding to a HOST TARGET binding site such as BINDING SITE I, BINDING SITE II or BINDING SITE III. Table 2 illustrates the complementarity of the nucleotide sequences of LOC90485 BINDING SITE, designated SEQ ID:31556, to the nucleotide sequence of VGAM608 RNA, herein designated VGAM RNA, also designated SEQ ID:3319.

Another function of VGAM608 is therefore inhibition of LOC90485 (Accession XM_032059). Accordingly, utilities of VGAM608 include diagnosis, prevention and treatment of diseases and clinical conditions associated with LOC90485. FIG. 1 further provides a conceptual description of a novel bioinformatically detected viral gene of the present invention, referred to here as Viral Genomic Address Messenger 609 (VGAM609) viral gene, which modulates expression of respective host target genes thereof, the function and utility of which host target genes is known in the art.

VGAM609 is a novel bioinformatically detected regulatory, non protein coding, viral micro RNA (miRNA) gene. The method by which VGAM609 was detected is described hereinabove with reference to FIGS. 1-8.

VGAM609 gene, herein designated VGAM GENE, is a viral gene contained in the genome of Rice Grassy Stunt Virus. VGAM609 host target gene, herein designated VGAM HOST TARGET GENE, is a human gene contained in the human genome.

VGAM609 gene encodes a VGAM609 precursor RNA, herein designated VGAM PRECURSOR RNA. Similar to other miRNA genes, and unlike most ordinary genes, VGAM609 precursor RNA does not encode a protein. A nucleotide sequence identical or highly similar to the nucleotide sequence of VGAM609 precursor RNA is designated SEQ ID:595, and is provided hereinbelow with reference to the sequence listing part. Nucleotide sequence SEQ ID:595 is located at position 8205 relative to the genome of Rice Grassy Stunt Virus.

VGAM609 precursor RNA folds onto itself, forming VGAM609 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM609 folded precursor RNA into VGAM609 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM609 RNA is designated SEQ ID:3320, and is provided hereinbelow with reference to the sequence listing part.

VGAM609 host target gene, herein designated VGAM HOST TARGET GENE, encodes a corresponding messenger RNA, VGAM609 host target RNA, herein designated VGAM HOST TARGET RNA. VGAM609 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM609 RNA, herein designated VGAM RNA, binds complementarily to one or more host target binding sites located in untranslated regions of VGAM609 host target RNA, herein designated VGAM HOST TARGET RNA. This complementary binding is due to the fact that the nucleotide sequence of VGAM609 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM609 RNA, herein designated VGAM RNA, may have a different number of host target binding sites in untranslated regions of a VGAM609 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM609 RNA, herein designated VGAM RNA, to host target binding sites on VGAM609 host target RNA, herein designated VGAM HOST TARGET RNA, such as BINDING SITE I, BINDING SITE II and BINDING SITE III, inhibits translation of VGAM609 host target RNA into VGAM609 host target protein, herein designated VGAM HOST TARGET PROTEIN. VGAM host target protein is therefore outlined by a broken line.

It is appreciated that VGAM609 host target gene, herein designated VGAM HOST TARGET GENE, in fact represents a plurality of VGAM609 host target genes. The mRNA of each one of this plurality of VGAM609 host target genes comprises one or more host target binding sites, each having a nucleotide sequence which is at least partly complementary to VGAM609 RNA, herein designated VGAM RNA, and which when bound by VGAM609 RNA causes inhibition of translation of respective one or more VGAM609 host target proteins.

It is further appreciated by one skilled in the art that the mode of translational inhibition illustrated by FIG. 1 with specific reference to translational inhibition exerted by VGAM609 gene, herein designated VGAM GENE, on one or more VGAM609 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM609 is inhibition of expression of host target genes, as part of a novel viral mechanism of attacking a host. Accordingly, utilities of VGAM609 include diagnosis, prevention and treatment of viral infection by Rice Grassy Stunt Virus. Specific functions, and accordingly utilities, of VGAM609 correlate with, and may be deduced from, the identity of the host target genes which VGAM609 binds and inhibits, and the function of these host target genes, as elaborated hereinbelow.

Nucleotide sequences of the VGAM609 precursor RNA, herein designated VGAM PRECURSOR RNA, and of the 'diced' VGAM609 RNA, herein designated VGAM RNA, and a schematic representation of the secondary folding of VGAM609 folded precursor RNA, herein designated VGAM FOLDED PRECURSOR RNA, of VGAM609 are further described hereinbelow with reference to Table 1.

Nucleotide sequences of host target binding sites, such as BINDING SITE-I, BINDING SITE-II and BINDING SITE-III of FIG. 1, found on VGAM609 host target RNA, and schematic representation of the complementarity of each of these host target binding sites to VGAM609 RNA, herein designated VGAM RNA, are described hereinbelow with reference to Table 2.

As mentioned hereinabove with reference to FIG. 1, a function of VGAM609 gene, herein designated VGAM is inhibition of expression of VGAM609 target genes. It is appreciated that specific functions, and accordingly utilities, of VGAM609 correlate with, and may be deduced from, the identity of the target genes which VGAM609 binds and inhibits, and the function of these target genes, as elaborated hereinbelow.

Adrenergic, Alpha-2B-, Receptor (ADRA2B, Accession NM_000682) is a VGAM609 host target gene. ADRA2B BINDING SITE is HOST TARGET binding site found in the 3' untranslated region of mRNA encoded by ADRA2B, corresponding to a HOST TARGET binding site such as BINDING SITE I, BINDING SITE II or BINDING SITE III. Table 2 illustrates the complementarity of the nucleotide sequences of ADRA2B BINDING SITE, designated SEQ ID:6340, to the nucleotide sequence of VGAM609 RNA, herein designated VGAM RNA, also designated SEQ ID:3320.

A function of VGAM609 is therefore inhibition of Adrenergic, Alpha-2B-, Receptor (ADRA2B, Accession NM_000682), a gene which mediate the catecholamine-induced inhibition of adenylate cyclase through the action of g proteins. Accordingly, utilities of VGAM609 include diagnosis, prevention and treatment of diseases and clinical conditions associated with ADRA2B. The function of ADRA2B has been established by previous studies. Regan et al. (1988) indicated that in addition to the platelet alpha-2-adrenergic receptor (ADRA2A, encoded by chromosome 10; 104210) and the renal form of receptor (ADRA2C, encoded by chromosome 4; 104250), a related protein is coded by chromosome 2. Lomasney et al. (1990) also cloned the ADRA2B gene. By hybridization with somatic cell hybrids, they showed that the gene for this receptor is located on chromosome 2. Northern blot analysis of various rat tissues showed expression in liver and kidney. Unique pharmacology and tissue localization suggested that this was a previously unidentified subtype. Alpha-2-adrenergic receptors have a critical role in regulating neurotransmitter release from sympathetic nerves and from adrenergic neurons in the central nervous system. To help elucidate the individual roles of the 3 highly homologous alpha-2-adrenergic receptors (ADRA2A, ADRA2B, and ADRA2C) in this process, Hein et al. (1999) studied neurotransmitter release in mice in which the genes encoding the 3 alpha-2-adrenergic-receptor subtypes were disrupted. By PCR-SSCP analysis, Heinonen et al. (1999) screened the entire coding sequence of the ADRA2B gene in 58 obese, nondiabetic Finns. They identified a polymorphism that led to a deletion of 3 glutamic acids from a glutamic acid repeat element (glu12, amino acids 297 to 309) present in the third intracellular loop of the receptor protein.

This repeat element had been shown to be important for agonist-dependent receptor desensitization.

Full details of the abovementioned studies are described in the following publications, the disclosure of which are hereby incorporated by reference:

Lomasney, J. W.; Lorenz, W.; Allen, L. F.; King, K.; Regan, J. W.; Yang-Feng, T. L.; Caron, M. G.; Lefkowitz, R. J.: Expansion of the alpha-2-adrenergic receptor family: cloning and characterization of a human alpha-2-adrenergic receptor subtype, the gene for which is located on chromosome 2. Proc. Nat. Acad. Sci. 87:5094-5098, 1990; and Heinonen, P.; Koulu, M.; Pesonen, U.; Karvonen, M. K.; Rissanen, A.; Laakso, M.; Valve, R.; Uusitupa, M.; Scheinin, M.: Identification of a three-amino acid deletion in the alpha-2B-adr.

Further studies establishing the function and utilities of ADRA2B are found in John Hopkins OMIM database record ID 104260, and in sited publications numbered 12106-48 and 478 listed in the bibliography section hereinbelow, which are also hereby incorporated by reference. CD8 Antigen, Alpha Polypeptide (p32) (CD8A, Accession NM_001768) is another VGAM609 host target gene. CD8A BINDING SITE is HOST TARGET binding site found in the 3' untranslated region of mRNA encoded by CD8A, corresponding to a HOST TARGET binding site such as BINDING SITE I, BINDING SITE II or BINDING SITE III. Table 2 illustrates the complementarity of the nucleotide sequences of CD8A BINDING SITE, designated SEQ ID:7530, to the nucleotide sequence of VGAM609 RNA, herein designated VGAM RNA, also designated SEQ ID:3320.

Another function of VGAM609 is therefore inhibition of CD8 Antigen, Alpha Polypeptide (p32) (CD8A, Accession NM_001768), a gene which is thought to play a role in the process of t-cell mediated killing. Accordingly, utilities of VGAM609 include diagnosis, prevention and treatment of diseases and clinical conditions associated with CD8A. The function of CD8A has been established by previous studies. Comparative structural and functional studies of mouse and human T-cell antigens showed that human cytotoxic-suppressor T cells have a molecule homologous to the mouse Lyt-2, Lyt-3 molecule (Ledbetter et al., 1981). The human homolog of Lyt-2, Lyt-3 is termed LEU2. It is selectively expressed on a subset of T cells and in structure is a multimeric macromolecule composed of individual disulfide-bonded subunits. LEU2, or T8, is expressed by most T lymphocytes with cytotoxic or suppressor function. The molecule appears to be composed of multimers of a 32-kD and a 45-kD polypeptide in thymocytes and of a 32-kD polypeptide in peripheral blood lymphocytes. LEU2 (like its proposed murine homolog Lyt-2) may play a role in target-cell recognition. Kavathas et al. (1984) isolated genomic and cDNA clones for LEU2. Giblin et al. (1989) showed that through alternative splicing of mRNA, an exon encoding a transmembrane domain of CD8 is deleted. This gives rise to a 30-kD molecule that is secreted and exists as a monomer. The splicing pattern in man differs from that found in the mouse CD8 gene. This mRNA is also alternatively spliced, but an exon encoding a cytoplasmic region is deleted, giving rise to a cell surface molecule that differs in its cytoplasmic tail from the protein encoded by the longer mRNA. Neither protein is secreted. This is an example of the different splicing patterns of 2 homologous mouse and human genes giving rise to different proteins. This represents 1 mechanism of generating diversity during speciation Animal model experiments lend further support to the function of CD8A. Leishman et al. (2001) used tetramer analysis in a mouse model to show that thymus leukemia antigen (TL; 188850), which is expressed abundantly on intestinal epithelial cells, preferentially binds to the homotypic form of CD8A (CD8A-CD8A), in contrast to other major histocompatibility complex molecules that bind to CD8A-CD8B (OMIM Ref. No. 186730). Flow cytometric analysis demonstrated that most intestinal intraepithelial lymphocytes (IELs), but not splenocytes, react specifically to TL tetramers. Leishman et al. (2001) concluded that CD8A-CD8A on IELs acts semi-autonomously, rather than as a T-cell receptor coreceptor. They suggested that expression of CD8A-CD8A on IELs could have important regulatory effects that influence homeostasis, activation, and survival of IELs under the high antigen load of the intestine It is appreciated that the abovementioned animal model for CD8A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kavathas, P.; Sukhatme, V. P.; Herzenberg, L. A.; Parnes, J. R.: Isolation of the gene encoding the human T-lymphocyte differentiation antigen Leu-2 (T8) by gene transfer and cDNA subtraction. Proc. Nat. Acad. Sci. 81:7688-7692, 1984; and Leishman, A. J.; Naidenko, O. V.; Attinger, A.; Koning, F.; Lena, C. J.; Xiong, Y.; Chang, H.-C.; Reinherz, E.; Kronenberg, M.; Cheroutre, H.: T cell responses modulated through interac.

Further studies establishing the function and utilities of CD8A are found in John Hopkins OMIM database record ID 186910, and in sited publications numbered 6028-6039, 605 and 9776-9778 listed in the bibliography section hereinbelow, which are also hereby incorporated by reference. FLJ20509 (Accession NM_017851) is another VGAM609 host target gene. FLJ20509 BINDING SITE is HOST TARGET binding site found in the 3" untranslated region of mRNA encoded by FLJ20509, corresponding to a HOST TARGET binding site such as BINDING SITE I, BINDING SITE II or BINDING SITE III. Table 2 illustrates the complementarity of the nucleotide sequences of FLJ20509 BINDING SITE, designated SEQ ID:19522, to the nucleotide sequence of VGAM609 RNA, herein designated VGAM RNA, also designated SEQ ID:3320.

Another function of VGAM609 is therefore inhibition of FLJ20509 (Accession NM_017851). Accordingly, utilities of VGAM609 include diagnosis, prevention and treatment of diseases and clinical conditions associated with FLJ20509. FLJ21777 (Accession NM_032209) is another VGAM609 host target gene. FLJ21777 BINDING SITE is HOST TARGET binding site found in the 3' untranslated region of mRNA encoded by FLJ21777, corresponding to a HOST TARGET binding site such as BINDING SITE I, BINDING SITE II or BINDING SITE III. Table 2 illustrates the complementarity of the nucleotide sequences of FLJ21777 BINDING SITE, designated SEQ ID:25924, to the nucleotide sequence of VGAM609 RNA, herein designated VGAM RNA, also designated SEQ ID:3320.

Another function of VGAM609 is therefore inhibition of FLJ21777 (Accession NM_032209). Accordingly, utilities of VGAM609 include diagnosis, prevention and treatment of diseases and clinical conditions associated with FLJ21777. KIAA1586 (Accession XM_166451) is another VGAM609 host target gene. KIAA1586 BINDING SITE is HOST TARGET binding site found in the 5' untranslated region of mRNA encoded by KIAA1586, corresponding to a HOST TARGET binding site such as BINDING SITE I, BINDING SITE II or BINDING SITE III. Table 2 illustrates the complementarity of the nucleotide sequences of KIAA1586 BIND- ING SITE, designated SEQ ID:44349, to the nucleotide sequence of VGAM609 RNA, herein designated VGAM RNA, also designated SEQ ID:3320.

Another function of VGAM609 is therefore inhibition of KIAA1586 (Accession XM_166451). Accordingly, utilities of VGAM609 include diagnosis, prevention and treatment of diseases and clinical conditions associated with KIAA1586. KIAA1841 (Accession XM_087056) is another VGAM609 host target gene. KIAA1841 BINDING SITE is HOST TARGET binding site found in the 3' untranslated region of mRNA encoded by KIAA1841, corresponding to a HOST TARGET binding site such as BINDING SITE I, BINDING SITE II or BINDING SITE III. Table 2 illustrates the complementarity of the nucleotide sequences of KIAA1841 BINDING SITE, designated SEQ ID:39026, to the nucleotide sequence of VGAM609 RNA, herein designated VGAM RNA, also designated SEQ ID:3320.

Another function of VGAM609 is therefore inhibition of KIAA1841 (Accession XM_087056). Accordingly, utilities of VGAM609 include diagnosis, prevention and treatment of diseases and clinical conditions associated with KIAA1841. MGC30052 (Accession NM_144721) is another VGAM609 host target gene. MGC30052 BINDING SITE is HOST TARGET binding site found in the 3' untranslated region of mRNA encoded by MGC30052, corresponding to a HOST TARGET binding site such as BINDING SITE I, BINDING SITE II or BINDING SITE III. Table 2 illustrates the complementarity of the nucleotide sequences of MGC30052 BINDING SITE, designated SEQ ID:29545, to the nucleotide sequence of VGAM609 RNA, herein designated VGAM RNA, also designated SEQ ID:3320.

Another function of VGAM609 is therefore inhibition of MGC30052 (Accession NM_144721). Accordingly, utilities of VGAM609 include diagnosis, prevention and treatment of diseases and clinical conditions associated with MGC30052. N-myristoyltransferase 1 (NMT1, Accession NM_021079) is another VGAM609 host target gene. NMT1 BINDING SITE is HOST TARGET binding site found in the 3' untranslated region of mRNA encoded by NMT1, corresponding to a HOST TARGET binding site such as BINDING SITE I, BINDING SITE II or BINDING SITE III. Table 2 illustrates the complementarity of the nucleotide sequences of NMT1 BINDING SITE, designated SEQ ID:22049, to the nucleotide sequence of VGAM609 RNA, herein designated VGAM RNA, also designated SEQ ID:3320.

Another function of VGAM609 is therefore inhibition of N-myristoyltransferase 1 (NMT1, Accession NM_021079). Accordingly, utilities of VGAM609 include diagnosis, prevention and treatment of diseases and clinical conditions associated with NMT1. Nudix (nucleoside diphosphate linked moiety X)-type Motif 11 (NUDT11, Accession XM_010230) is another VGAM609 host target gene. NUDT11 BINDING SITE is HOST TARGET binding site found in the 3' untranslated region of mRNA encoded by NUDT11, corresponding to a HOST TARGET binding site such as BINDING SITE I, BINDING SITE II or BINDING SITE III. Table 2 illustrates the complementarity of the nucleotide sequences of NUDT11 BINDING SITE, designated SEQ ID:30143, to the nucleotide sequence of VGAM609 RNA, herein designated VGAM RNA, also designated SEQ ID:3320.

Another function of VGAM609 is therefore inhibition of Nudix (nucleoside diphosphate linked moiety X)-type Motif 11 (NUDT11, Accession XM_010230). Accordingly, utilities of VGAM609 include diagnosis, prevention and treatment of diseases and clinical conditions associated with NUDT11. P5-1 (Accession NM_006674) is another VGAM609 host target gene. P5-1 BINDING SITE is HOST TARGET binding site found in the 3' untranslated region of mRNA encoded by P5-1, corresponding to a HOST TARGET binding site such as BINDING SITE I, BINDING SITE II or BINDING SITE III. Table 2 illustrates the complementarity of the nucleotide sequences of P5-1 BINDING SITE, designated SEQ ID:13496, to the nucleotide sequence of VGAM609 RNA, herein designated VGAM RNA, also designated SEQ ID:3320.

Another function of VGAM609 is therefore inhibition of P5-1 (Accession NM_006674). Accordingly, utilities of VGAM609 include diagnosis, prevention and treatment of diseases and clinical conditions associated with P5-1. Synaptotagmin XIII (SYT13, Accession XM_167880) is another VGAM609 host target gene. SYT13 BINDING SITE is HOST TARGET binding site found in the 3' untranslated region of mRNA encoded by SYT13, corresponding to a HOST TARGET binding site such as BINDING SITE I, BINDING SITE II or BINDING SITE III. Table 2 illustrates the complementarity of the nucleotide sequences of SYT13 BINDING SITE, designated SEQ ID:44887, to the nucleotide sequence of VGAM609 RNA, herein designated VGAM RNA, also designated SEQ ID:3320.

Another function of VGAM609 is therefore inhibition of Synaptotagmin XIII (SYT13, Accession XM_167880). Accordingly, utilities of VGAM609 include diagnosis, prevention and treatment of diseases and clinical conditions associated with SYT13. LOC130813 (Accession XM_065904) is another VGAM609 host target gene. LOC130813 BINDING SITE is HOST TARGET binding site found in the 3' untranslated region of mRNA encoded by LOC130813, corresponding to a HOST TARGET binding site such as BINDING SITE I, BINDING SITE II or BINDING SITE III. Table 2 illustrates the complementarity of the nucleotide sequences of LOC130813 BINDING SITE, designated SEQ ID:37313, to the nucleotide sequence of VGAM609 RNA, herein designated VGAM RNA, also designated SEQ ID:3320.

Another function of VGAM609 is therefore inhibition of LOC130813 (Accession XM_065904). Accordingly, utilities of VGAM609 include diagnosis, prevention and treatment of diseases and clinical conditions associated with LOC130813. LOC157681 (Accession XM_088363) is another VGAM609 host target gene. LOC157681 BINDING SITE is HOST TARGET binding site found in the 5' untranslated region of mRNA encoded by LOC157681, corresponding to a HOST TARGET binding site such as BINDING SITE I, BINDING SITE II or BINDING SITE III. Table 2 illustrates the complementarity of the nucleotide sequences of LOC157681 BINDING SITE, designated SEQ ID:39641, to the nucleotide sequence of VGAM609 RNA, herein designated VGAM RNA, also designated SEQ ID:3320.

Another function of VGAM609 is therefore inhibition of LOC157681 (Accession XM_088363). Accordingly, utilities of VGAM609 include diagnosis, prevention and treatment of diseases and clinical conditions associated with LOC157681. FIG. 1 further provides a conceptual description of a novel bioinformatically detected viral gene of the present invention, referred to here as Viral Genomic Address Messenger 610 (VGAM610) viral gene, which modulates expression of respective host target genes thereof, the function and utility of which host target genes is known in the art.

VGAM610 is a novel bioinformatically detected regulatory, non protein coding, viral micro RNA (miRNA) gene. The method by which VGAM610 was detected is described hereinabove with reference to FIGS. 1-8.

VGAM610 gene, herein designated VGAM GENE, is a viral gene contained in the genome of Rice Grassy Stunt Virus. VGAM610 host target gene, herein designated VGAM HOST TARGET GENE, is a human gene contained in the human genome.

VGAM610 gene encodes a VGAM610 precursor RNA, herein designated VGAM PRECURSOR RNA. Similar to other miRNA genes, and unlike most ordinary genes, VGAM610 precursor RNA does not encode a protein. A nucleotide sequence identical or highly similar to the nucleotide sequence of VGAM610 precursor RNA is designated SEQ ID:596, and is provided hereinbelow with reference to the sequence listing part. Nucleotide sequence SEQ ID:596 is located at position 4515 relative to the genome of Rice Grassy Stunt Virus.

VGAM610 precursor RNA folds onto itself, forming VGAM610 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM610 folded precursor RNA into VGAM610 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM610 RNA is designated SEQ ID:3321, and is provided hereinbelow with reference to the sequence listing part.

VGAM610 host target gene, herein designated VGAM HOST TARGET GENE, encodes a corresponding messenger RNA, VGAM610 host target RNA, herein designated VGAM HOST TARGET RNA. VGAM610 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM610 RNA, herein designated VGAM RNA, binds complementarily to one or more host target binding sites located in untranslated regions of VGAM610 host target RNA, herein designated VGAM HOST TARGET RNA. This complementary binding is due to the fact that the nucleotide sequence of VGAM610 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM610 RNA, herein designated VGAM RNA, may have a different number of host target binding sites in untranslated regions of a VGAM610 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM610 RNA, herein designated VGAM RNA, to host target binding sites on VGAM610 host target RNA, herein designated VGAM HOST TARGET RNA, such as BINDING SITE I, BINDING SITE II and BINDING SITE III, inhibits translation of VGAM610 host target RNA into VGAM610 host target protein, herein designated VGAM HOST TARGET PROTEIN. VGAM host target protein is therefore outlined by a broken line.

It is appreciated that VGAM610 host target gene, herein designated VGAM HOST TARGET GENE, in fact represents a plurality of VGAM610 host target genes. The mRNA of each one of this plurality of VGAM610 host target genes comprises one or more host target binding sites, each having a nucleotide sequence which is at least partly complementary to VGAM610 RNA, herein designated VGAM RNA, and which when bound by VGAM610 RNA causes inhibition of translation of respective one or more VGAM610 host target proteins.

It is further appreciated by one skilled in the art that the mode of translational inhibition illustrated by FIG. 1 with specific reference to translational inhibition exerted by VGAM610 gene, herein designated VGAM GENE, on one or more VGAM610 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM610 is inhibition of expression of host target genes, as part of a novel viral mechanism of attacking a host. Accordingly, utilities of VGAM610 include diagnosis, prevention and treatment of viral infection by Rice Grassy Stunt Virus. Specific functions, and accordingly utilities, of VGAM610 correlate with, and may be deduced from, the identity of the host target genes which VGAM610 binds and inhibits, and the function of these host target genes, as elaborated hereinbelow.

Nucleotide sequences of the VGAM610 precursor RNA, herein designated VGAM PRECURSOR RNA, and of the 'diced' VGAM610 RNA, herein designated VGAM RNA, and a schematic representation of the secondary folding of VGAM610 folded precursor RNA, herein designated VGAM FOLDED PRECURSOR RNA, of VGAM610 are further described hereinbelow with reference to Table 1.

Nucleotide sequences of host target binding sites, such as BINDING SITE-I, BINDING SITE-II and BINDING SITE-III of FIG. 1, found on VGAM610 host target RNA, and schematic representation of the complementarity of each of these host target binding sites to VGAM610 RNA, herein designated VGAM RNA, are described hereinbelow with reference to Table 2.

As mentioned hereinabove with reference to FIG. 1, a function of VGAM610 gene, herein designated VGAM is inhibition of expression of VGAM610 target genes. It is appreciated that specific functions, and accordingly utilities, of VGAM610 correlate with, and may be deduced from, the identity of the target genes which VGAM610 binds and inhibits, and the function of these target genes, as elaborated hereinbelow.

Tumor Necrosis Factor Receptor Superfamily, Member 6b, Decoy (TNFRSF6B, Accession NM_016434) is a VGAM610 host target gene. TNFRSF6B BINDING SITE is HOST TARGET binding site found in the 5' untranslated region of mRNA encoded by TNFRSF6B, corresponding to a HOST TARGET binding site such as BINDING SITE I, BINDING SITE II or BINDING SITE III. Table 2 illustrates the complementarity of the nucleotide sequences of TNFRSF6B BINDING SITE, designated SEQ ID:18557, to the nucleotide sequence of VGAM610 RNA, herein designated VGAM RNA, also designated SEQ ID:3321.

A function of VGAM610 is therefore inhibition of Tumor Necrosis Factor Receptor Superfamily, Member 6b, Decoy (TNFRSF6B, Accession NM_016434), a gene which is decoy receptor and protects against apoptosis. Accordingly, utilities of VGAM610 include diagnosis, prevention and treatment of diseases and clinical conditions associated with TNFRSF6B. The function of TNFRSF6B has been established by previous studies. Pitti et al. (1998) identified ESTs that showed homology to the tumor necrosis factor receptor (TNFR) superfamily. Using PCR with primers based on the region of EST consensus, they isolated a cDNA encoding a soluble decoy receptor, termed decoy receptor-3 (DCR3), from a human fetal lung cDNA library. The DCR3 protein contains 300 amino acids and has a molecular mass of 35 kD. By Northern blot analysis, Pitti et al. (1998) detected a 1.2-kb transcript in human fetal lung, brain, and liver, and in adult spleen, colon, and lung. Pitti et al. (1998) demonstrated that DCR3 binds to FASL and inhibits FASL-induced apoptosis. Like osteoprotegerin (OPG; 602643), another TNFR superfamily member, DCR3 lacks an apparent transmembrane sequence, indicating that DCR3 may be a secreted, rather than a membrane-associated, molecule. The DCR3 protein shares 31% sequence homology with OPG, and all of the cysteines in the 4 cysteine-rich domains of DCR3 and OPG are conserved. Pitti et al. (1998) stated that DCR3 and OPG define a subset of TNFR family members that function as secreted decoys to modulate ligands that induce apoptosis. Bai et al. (2000) independently identified the DCR3 gene, which they called M68. M68 genomic DNA, mRNA, and protein levels were examined in a series of human gastrointestinal tract tumors. Using M68 immunohistochemistry and a scoring system similar to that used for HER-2/neu (ERBB2; 164870), they found that M68 protein was overexpressed in 30 of 68 (44%) human adenocarcinomas of the esophagus, stomach, colon, and rectum. Tumors examined by Northern blot revealed M68 mRNA highly elevated in a similar fraction of primary tumors from the same gastrointestinal tract regions, as well as in 2 colon adenocarcinoma cell lines. They also found M68 protein to be overexpressed in a substantial number of tumors in which gene amplification could not be detected by fluorescence in situ hybridization or quantitative genomic PCR, suggesting that overexpression of M68 may precede amplification in tumors. They found that M68 lies within a 4-gene cluster that includes a novel helicase-like gene related to RAD3/ERCC2 (OMIM Ref. No. 126340), a plasma membrane Ras-related GTPase and a member of the stathmin family (OMIM Ref. No. 151442), amplification or overexpression of which may also contribute to cell growth and tumor progression.

Full details of the abovementioned studies are described in the following publications, the disclosure of which are hereby incorporated by reference:

Bai, C.; Connolly, B.; Metzker, M. L.; Hilliard, C. A.; Liu, X.; Sandig, V.; Soderman, A.; Galloway, S. M.; Liu, Q.; Austin, C. P.; Caskey, C. T.: Overexpression of M68/DCR3 in human gastrointestinal tract tumors independent of gene amplification and its location in a four-gene cluster. Proc. Nat. Acad. Sci. 97:1230-1235, 2000; and Pitti, R. M.; Marsters, S. A.; Lawrence, D. A.; Roy, M.; Kischkel, F. C.; Dowd, P.; Huang, A.; Donahue, C. J.; Sherwood, S. W.; Baldwin, D. T.; Godowski, P. J.; Wood, W. I.; Gurney, A.

Further studies establishing the function and utilities of TNFRSF6B are found in John Hopkins OMIM database record ID 603361, and in sited publications numbered 8657-8658 listed in the bibliography section hereinbelow, which are also hereby incorporated by reference. FIG. 1 further provides a conceptual description of a novel bioinformatically detected viral gene of the present invention, referred to here as Viral Genomic Address Messenger 611 (VGAM611) viral gene, which modulates expression of respective host target genes thereof, the function and utility of which host target genes is known in the art.

VGAM611 is a novel bioinformatically detected regulatory, non protein coding, viral micro RNA (miRNA) gene. The method by which VGAM611 was detected is described hereinabove with reference to FIGS. 1-8.

VGAM611 gene, herein designated VGAM GENE, is a viral gene contained in the genome of Xestia C-nigrum Granulovirus. VGAM611 host target gene, herein designated VGAM HOST TARGET GENE, is a human gene contained in the human genome.

VGAM611 gene encodes a VGAM611 precursor RNA, herein designated VGAM PRECURSOR RNA. Similar to other miRNA genes, and unlike most ordinary genes, VGAM611 precursor RNA does not encode a protein. A nucleotide sequence identical or highly similar to the nucleotide sequence of VGAM611 precursor RNA is designated SEQ ID:597, and is provided hereinbelow with reference to the sequence listing part. Nucleotide sequence SEQ ID:597 is located at position 62972 relative to the genome of Xestia C-nigrum Granulovirus.

VGAM611 precursor RNA folds onto itself, forming VGAM611 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM611 folded precursor RNA into VGAM611 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM611 RNA is designated SEQ ID:3322, and is provided hereinbelow with reference to the sequence listing part.

VGAM611 host target gene, herein designated VGAM HOST TARGET GENE, encodes a corresponding messenger RNA, VGAM611 host target RNA, herein designated VGAM HOST TARGET RNA. VGAM611 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM611 RNA, herein designated VGAM RNA, binds complementarily to one or more host target binding sites located in untranslated regions of VGAM611 host target RNA, herein designated VGAM HOST TARGET RNA. This complementary binding is due to the fact that the nucleotide sequence of VGAM611 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM611 RNA, herein designated VGAM RNA, may have a different number of host target binding sites in untranslated regions of a VGAM611 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM611 RNA, herein designated VGAM RNA, to host target binding sites on VGAM611 host target RNA, herein designated VGAM HOST TARGET RNA, such as BINDING SITE I, BINDING SITE II and BINDING SITE III, inhibits translation of VGAM611 host target RNA into VGAM611 host target protein, herein designated VGAM HOST TARGET PROTEIN. VGAM host target protein is therefore outlined by a broken line.

It is appreciated that VGAM611 host target gene, herein designated VGAM HOST TARGET GENE, in fact represents a plurality of VGAM611 host target genes. The mRNA of each one of this plurality of VGAM611 host target genes comprises one or more host target binding sites, each having a nucleotide sequence which is at least partly complementary to VGAM611 RNA, herein designated VGAM RNA, and which when bound by VGAM611 RNA causes inhibition of translation of respective one or more VGAM611 host target proteins.

It is further appreciated by one skilled in the art that the mode of translational inhibition illustrated by FIG. 1 with specific reference to translational inhibition exerted by VGAM611 gene, herein designated VGAM GENE, on one or more VGAM611 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM611 is inhibition of expression of host target genes, as part of a novel viral mechanism of attacking a host. Accordingly, utilities of VGAM611 include diagnosis, prevention and treatment of viral infection by Xestia C-nigrum Granulovirus. Specific functions, and accordingly utilities, of VGAM611 correlate with, and may be deduced from, the identity of the host target genes which VGAM611 binds and inhibits, and the function of these host target genes, as elaborated hereinbelow.

Nucleotide sequences of the VGAM611 precursor RNA, herein designated VGAM PRECURSOR RNA, and of the 'diced' VGAM611 RNA, herein designated VGAM RNA, and a schematic representation of the secondary folding of VGAM611 folded precursor RNA, herein designated VGAM FOLDED PRECURSOR RNA, of VGAM611 are further described hereinbelow with reference to Table 1.

Nucleotide sequences of host target binding sites, such as BINDING SITE-I, BINDING SITE-II and BINDING SITE-III of FIG. 1, found on VGAM611 host target RNA, and schematic representation of the complementarity of each of these host target binding sites to VGAM611 RNA, herein designated VGAM RNA, are described hereinbelow with reference to Table 2.

As mentioned hereinabove with reference to FIG. 1, a function of VGAM611 gene, herein designated VGAM is inhibition of expression of VGAM611 target genes. It is appreciated that specific functions, and accordingly utilities, of VGAM611 correlate with, and may be deduced from, the identity of the target genes which VGAM611 binds and inhibits, and the function of these target genes, as elaborated hereinbelow.

Agmatine Ureohydrolase (agmatinase) (AGMAT, Accession NM_024758) is a VGAM611 host target gene. AGMAT BINDING SITE is HOST TARGET binding site found in the 3' untranslated region of mRNA encoded by AGMAT, corresponding to a HOST TARGET binding site such as BINDING SITE I, BINDING SITE II or BINDING SITE III. Table 2 illustrates the complementarity of the nucleotide sequences of AGMAT BINDING SITE, designated SEQ ID:24106, to the nucleotide sequence of VGAM611 RNA, herein designated VGAM RNA, also designated SEQ ID:3322.

A function of VGAM611 is therefore inhibition of Agmatine Ureohydrolase (agmatinase) (AGMAT, Accession NM_024758). Accordingly, utilities of VGAM611 include diagnosis, prevention and treatment of diseases and clinical conditions associated with AGMAT. KIAA0337 (Accession NM_014786) is another VGAM611 host target gene. KIAA0337 BINDING SITE is HOST TARGET binding site found in the 3' untranslated region of mRNA encoded by KIAA0337, corresponding to a HOST TARGET binding site such as BINDING SITE I, BINDING SITE II or BINDING SITE III. Table 2 illustrates the complementarity of the nucleotide sequences of KIAA0337 BINDING SITE, designated SEQ ID:16654, to the nucleotide sequence of VGAM611 RNA, herein designated VGAM RNA, also designated SEQ ID:3322.

Another function of VGAM611 is therefore inhibition of KIAA0337 (Accession NM_014786). Accordingly, utilities of VGAM611 include diagnosis, prevention and treatment of diseases and clinical conditions associated with KIAA0337. KIAA0544 (Accession XM_048119) is another VGAM611 host target gene. KIAA0544 BINDING SITE is HOST TARGET binding site found in the 3' untranslated region of mRNA encoded by KIAA0544, corresponding to a HOST TARGET binding site such as BINDING SITE I, BINDING SITE II or BINDING SITE III. Table 2 illustrates the complementarity of the nucleotide sequences of KIAA0544 BINDING SITE, designated SEQ ID:35110, to the nucleotide sequence of VGAM611 RNA, herein designated VGAM RNA, also designated SEQ ID:3322.

Another function of VGAM611 is therefore inhibition of KIAA0544 (Accession XM_048119). Accordingly, utilities of VGAM611 include diagnosis, prevention and treatment of diseases and clinical conditions associated with KIAA0544. KIAA0825 (Accession XM_027906) is another VGAM611 host target gene. KIAA0825 BINDING SITE is HOST TARGET binding site found in the 3' untranslated region of mRNA encoded by KIAA0825, corresponding to a HOST TARGET binding site such as BINDING SITE I, BINDING SITE II or BINDING SITE III. Table 2 illustrates the complementarity of the nucleotide sequences of KIAA0825 BINDING SITE, designated SEQ ID:30590, to the nucleotide sequence of VGAM611 RNA, herein designated VGAM RNA, also designated SEQ ID:3322.

Another function of VGAM611 is therefore inhibition of KIAA0825 (Accession XM_027906). Accordingly, utilities of VGAM611 include diagnosis, prevention and treatment of diseases and clinical conditions associated with KIAA0825. Syndecan 3 (N-syndecan) (SDC3, Accession NM_014654) is another VGAM611 host target gene. SDC3 BINDING SITE is HOST TARGET binding site found in the 3' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16078, to the nucleotide sequence of VGAM611 RNA, herein designated VGAM RNA, also designated SEQ ID:3322.

Another function of VGAM611 is therefore inhibition of Syndecan 3 (N-syndecan) (SDC3, Accession NM_014654). Accordingly, utilities of VGAM611 include diagnosis, prevention and treatment of diseases and clinical conditions associated with SDC3. LOC51301 (Accession NM_016591) is another VGAM611 host target gene. LOC51301 BINDING SITE is HOST TARGET binding site found in the 5' untranslated region of mRNA encoded by LOC51301, corresponding to a HOST TARGET binding site such as BINDING SITE I, BINDING SITE II or BINDING SITE III. Table 2 illustrates the complementarity of the nucleotide sequences of LOC51301 BINDING SITE, designated SEQ ID:18671, to the nucleotide sequence of VGAM611 RNA, herein designated VGAM RNA, also designated SEQ ID:3322.

Another function of VGAM611 is therefore inhibition of LOC51301 (Accession NM_016591). Accordingly, utilities of VGAM611 include diagnosis, prevention and treatment of diseases and clinical conditions associated with LOC51301. FIG. 1 further provides a conceptual description of a novel bioinformatically detected viral gene of the present invention, referred to here as Viral Genomic Address Messenger 612 (VGAM612) viral gene, which modulates expression of respective host target genes thereof, the function and utility of which host target genes is known in the art.

VGAM612 is a novel bioinformatically detected regulatory, non protein coding, viral micro RNA (miRNA) gene. The method by which VGAM612 was detected is described hereinabove with reference to FIGS. 1-8.

VGAM612 gene, herein designated VGAM GENE, is a viral gene contained in the genome of Xestia C-nigrum Granulovirus. VGAM612 host target gene, herein designated VGAM HOST TARGET GENE, is a human gene contained in the human genome.

VGAM612 gene encodes a VGAM612 precursor RNA, herein designated VGAM PRECURSOR RNA. Similar to other miRNA genes, and unlike most ordinary genes, VGAM612 precursor RNA does not encode a protein. A nucleotide sequence identical or highly similar to the nucleotide sequence of VGAM612 precursor RNA is designated SEQ ID:598, and is provided hereinbelow with reference to the sequence listing part. Nucleotide sequence SEQ ID:598 is located at position 72787 relative to the genome of Xestia C-nigrum Granulovirus.

VGAM612 precursor RNA folds onto itself, forming VGAM612 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM612 folded precursor RNA into VGAM612 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM612 RNA is designated SEQ ID:3323, and is provided hereinbelow with reference to the sequence listing part.

VGAM612 host target gene, herein designated VGAM HOST TARGET GENE, encodes a corresponding messenger RNA, VGAM612 host target RNA, herein designated VGAM HOST TARGET RNA. VGAM612 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM612 RNA, herein designated VGAM RNA, binds complementarily to one or more host target binding sites located in untranslated regions of VGAM612 host target RNA, herein designated VGAM HOST TARGET RNA. This complementary binding is due to the fact that the nucleotide sequence of VGAM612 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM612 RNA, herein designated VGAM RNA, may have a different number of host target binding sites in untranslated regions of a VGAM612 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM612 RNA, herein designated VGAM RNA, to host target binding sites on VGAM612 host target RNA, herein designated VGAM HOST TARGET RNA, such as BINDING SITE I, BINDING SITE II and BINDING SITE III, inhibits translation of VGAM612 host target RNA into VGAM612 host target protein, herein designated VGAM HOST TARGET PROTEIN. VGAM host target protein is therefore outlined by a broken line.

It is appreciated that VGAM612 host target gene, herein designated VGAM HOST TARGET GENE, in fact represents a plurality of VGAM612 host target genes. The mRNA of each one of this plurality of VGAM612 host target genes comprises one or more host target binding sites, each having a nucleotide sequence which is at least partly complementary to VGAM612 RNA, herein designated VGAM RNA, and which when bound by VGAM612 RNA causes inhibition of translation of respective one or more VGAM612 host target proteins.

It is further appreciated by one skilled in the art that the mode of translational inhibition illustrated by FIG. 1 with specific reference to translational inhibition exerted by VGAM612 gene, herein designated VGAM GENE, on one or more VGAM612 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM612 is inhibition of expression of host target genes, as part of a novel viral mechanism of attacking a host. Accordingly, utilities of VGAM612 include diagnosis, prevention and treatment of viral infection by Xestia C-nigrum Granulovirus. Specific functions, and accordingly utilities, of VGAM612 correlate with, and may be deduced from, the identity of the host target genes which VGAM612 binds and inhibits, and the function of these host target genes, as elaborated hereinbelow.

Nucleotide sequences of the VGAM612 precursor RNA, herein designated VGAM PRECURSOR RNA, and of the 'diced' VGAM612 RNA, herein designated VGAM RNA, and a schematic representation of the secondary folding of VGAM612 folded precursor RNA, herein designated VGAM FOLDED PRECURSOR RNA, of VGAM612 are further described hereinbelow with reference to Table 1.

Nucleotide sequences of host target binding sites, such as BINDING SITE-I, BINDING SITE-II and BINDING SITE-III of FIG. 1, found on VGAM612 host target RNA, and schematic representation of the complementarity of each of these host target binding sites to VGAM612 RNA, herein designated VGAM RNA, are described hereinbelow with reference to Table 2.

As mentioned hereinabove with reference to FIG. 1, a function of VGAM612 gene, herein designated VGAM is inhibition of expression of VGAM612 target genes. It is appreciated that specific functions, and accordingly utilities, of VGAM612 correlate with, and may be deduced from, the identity of the target genes which VGAM612 binds and inhibits, and the function of these target genes, as elaborated hereinbelow.

Epithelial V-like Antigen 1 (EVA1, Accession NM_005797) is a VGAM612 host target gene. EVA1 BINDING SITE is HOST TARGET binding site found in the 3' untranslated region of mRNA encoded by EVA1, corresponding to a HOST TARGET binding site such as BINDING SITE I, BINDING SITE II or BINDING SITE III. Table 2 illustrates the complementarity of the nucleotide sequences of EVA1 BINDING SITE, designated SEQ ID:12379, to the nucleotide sequence of VGAM612 RNA, herein designated VGAM RNA, also designated SEQ ID:3323.

A function of VGAM612 is therefore inhibition of Epithelial V-like Antigen 1 (EVA1, Accession NM_005797). Accordingly, utilities of VGAM612 include diagnosis, prevention and treatment of diseases and clinical conditions associated with EVA1. DKFZp434E0519 (Accession NM_032247) is another VGAM612 host target gene. DKFZp434E0519 BINDING SITE is HOST TARGET binding site found in the 3' untranslated region of mRNA encoded by DKFZp434E0519, corresponding to a HOST TARGET binding site such as BINDING SITE I, BINDING SITE II or BINDING SITE III. Table 2 illustrates the complementarity of the nucleotide sequences of DKFZp434E0519 BINDING SITE, designated SEQ ID:25983, to the nucleotide sequence of VGAM612 RNA, herein designated VGAM RNA, also designated SEQ ID:3323.

Another function of VGAM612 is therefore inhibition of DKFZp434E0519 (Accession NM_032247). Accordingly, utilities of VGAM612 include diagnosis, prevention and treatment of diseases and clinical conditions associated with DKFZp434E0519. LOC148166 (Accession XM_086077) is another VGAM612 host target gene. LOC148166 BINDING SITE is HOST TARGET binding site found in the 5' untranslated region of mRNA encoded by LOC148166, corresponding to a HOST TARGET binding site such as BINDING SITE I, BINDING SITE II or BINDING SITE III. Table 2 illustrates the complementarity of the nucleotide sequences of LOC148166 BINDING SITE, designated SEQ ID:38480, to the nucleotide sequence of VGAM612 RNA, herein designated VGAM RNA, also designated SEQ ID:3323.

Another function of VGAM612 is therefore inhibition of LOC148166 (Accession XM_086077). Accordingly, utilities of VGAM612 include diagnosis, prevention and treatment of diseases and clinical conditions associated with LOC148166. FIG. 1 further provides a conceptual description of a novel bioinformatically detected viral gene of the present invention, referred to here as Viral Genomic Address Messenger 613 (VGAM613) viral gene, which modulates expression of respective host target genes thereof, the function and utility of which host target genes is known in the art.

VGAM613 is a novel bioinformatically detected regulatory, non protein coding, viral micro RNA (miRNA) gene. The method by which VGAM613 was detected is described hereinabove with reference to FIGS. 1-8.

VGAM613 gene, herein designated VGAM GENE, is a viral gene contained in the genome of Xestia C-nigrum Granulovirus. VGAM613 host target gene, herein designated VGAM HOST TARGET GENE, is a human gene contained in the human genome.

VGAM613 gene encodes a VGAM613 precursor RNA, herein designated VGAM PRECURSOR RNA. Similar to other miRNA genes, and unlike most ordinary genes, VGAM613 precursor RNA does not encode a protein. A nucleotide sequence identical or highly similar to the nucleotide sequence of VGAM613 precursor RNA is designated SEQ ID:599, and is provided hereinbelow with reference to the sequence listing part. Nucleotide sequence SEQ ID:599 is located at position 74562 relative to the genome of Xestia C-nigrum Granulovirus.

VGAM613 precursor RNA folds onto itself, forming VGAM613 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM613 folded precursor RNA into VGAM613 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM613 RNA is designated SEQ ID:3324, and is provided hereinbelow with reference to the sequence listing part.

VGAM613 host target gene, herein designated VGAM HOST TARGET GENE, encodes a corresponding messenger RNA, VGAM613 host target RNA, herein designated VGAM HOST TARGET RNA. VGAM613 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM613 RNA, herein designated VGAM RNA, binds complementarily to one or more host target binding sites located in untranslated regions of VGAM613 host target RNA, herein designated VGAM HOST TARGET RNA. This complementary binding is due to the fact that the nucleotide sequence of VGAM613 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM613 RNA, herein designated VGAM RNA, may have a different number of host target binding sites in untranslated regions of a VGAM613 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM613 RNA, herein designated VGAM RNA, to host target binding sites on VGAM613 host target RNA, herein designated VGAM HOST TARGET RNA, such as BINDING SITE I, BINDING SITE II and BINDING SITE III, inhibits translation of VGAM613 host target RNA into VGAM613 host target protein, herein designated VGAM HOST TARGET PROTEIN. VGAM host target protein is therefore outlined by a broken line.

It is appreciated that VGAM613 host target gene, herein designated VGAM HOST TARGET GENE, in fact represents a plurality of VGAM613 host target genes. The mRNA of each one of this plurality of VGAM613 host target genes comprises one or more host target binding sites, each having a nucleotide sequence which is at least partly complementary to VGAM613 RNA, herein designated VGAM RNA, and which when bound by VGAM613 RNA causes inhibition of translation of respective one or more VGAM613 host target proteins.

It is further appreciated by one skilled in the art that the mode of translational inhibition illustrated by FIG. 1 with specific reference to translational inhibition exerted by VGAM613 gene, herein designated VGAM GENE, on one or more VGAM613 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM613 is inhibition of expression of host target genes, as part of a novel viral mechanism of attacking a host. Accordingly, utilities of VGAM613 include diagnosis, prevention and treatment of viral infection by Xestia C-nigrum Granulovirus. Specific functions, and accordingly utilities, of VGAM613 correlate with, and may be deduced from, the identity of the host target genes which VGAM613 binds and inhibits, and the function of these host target genes, as elaborated hereinbelow.

Nucleotide sequences of the VGAM613 precursor RNA, herein designated VGAM PRECURSOR RNA, and of the 'diced' VGAM613 RNA, herein designated VGAM RNA, and a schematic representation of the secondary folding of VGAM613 folded precursor RNA, herein designated VGAM FOLDED PRECURSOR RNA, of VGAM613 are further described hereinbelow with reference to Table 1.

Nucleotide sequences of host target binding sites, such as BINDING SITE-I, BINDING SITE-II and BINDING SITE-III of FIG. 1, found on VGAM613 host target RNA, and schematic representation of the complementarity of each of these host target binding sites to VGAM613 RNA, herein designated VGAM RNA, are described hereinbelow with reference to Table 2.

As mentioned hereinabove with reference to FIG. 1, a function of VGAM613 gene, herein designated VGAM is inhibition of expression of VGAM613 target genes. It is appreciated that specific functions, and accordingly utilities, of VGAM613 correlate with, and may be deduced from, the identity of the target genes which VGAM613 binds and inhibits, and the function of these target genes, as elaborated hereinbelow.

Chromosome 20 Open Reading Frame 7 (C20orf7, Accession NM_024120) is a VGAM613 host target gene. C20orf7 BINDING SITE is HOST TARGET binding site found in the 3' untranslated region of mRNA encoded by C20orf7, corresponding to a HOST TARGET binding site such as BINDING SITE I, BINDING SITE II or BINDING SITE III. Table 2 illustrates the complementarity of the nucleotide sequences of C20orf7 BINDING SITE, designated SEQ ID:23571, to the nucleotide sequence of VGAM613 RNA, herein designated VGAM RNA, also designated SEQ ID:3324.

A function of VGAM613 is therefore inhibition of Chromosome 20 Open Reading Frame 7 (C20orf7, Accession NM_024120). Accordingly, utilities of VGAM613 include diagnosis, prevention and treatment of diseases and clinical conditions associated with C20orf7. Eukaryotic Translation Initiation Factor 3, Subunit 1 Alpha, 35 kDa (EIF3S1, Accession XM_032384) is another VGAM613 host target gene. EIF3S1 BINDING SITE is HOST TARGET binding site found in the 3' untranslated region of mRNA encoded by EIF3S1, corresponding to a HOST TARGET binding site such as BINDING SITE I, BINDING SITE II or BINDING SITE III. Table 2 illustrates the complementarity of the nucleotide sequences of EIF3S1 BINDING SITE, designated SEQ ID:31641, to the nucleotide sequence of VGAM613 RNA, herein designated VGAM RNA, also designated SEQ ID:3324.

Another function of VGAM613 is therefore inhibition of Eukaryotic Translation Initiation Factor 3, Subunit 1 Alpha, 35 kDa (EIF3S1, Accession XM_032384). Accordingly, utilities of VGAM613 include diagnosis, prevention and treatment of diseases and clinical conditions associated with EIF3S1. FIG. 1 further provides a conceptual description of a novel bioinformatically detected viral gene of the present invention, referred to here as Viral Genomic Address Messenger 614 (VGAM614) viral gene, which modulates expression of respective host target genes thereof, the function and utility of which host target genes is known in the art.

VGAM614 is a novel bioinformatically detected regulatory, non protein coding, viral micro RNA (miRNA) gene. The method by which VGAM614 was detected is described hereinabove with reference to FIGS. 1-8.

VGAM614 gene, herein designated VGAM GENE, is a viral gene contained in the genome of Xestia C-nigrum Granulovirus. VGAM614 host target gene, herein designated VGAM HOST TARGET GENE, is a human gene contained in the human genome.

VGAM614 gene encodes a VGAM614 precursor RNA, herein designated VGAM PRECURSOR RNA. Similar to other miRNA genes, and unlike most ordinary genes, VGAM614 precursor RNA does not encode a protein. A nucleotide sequence identical or highly similar to the nucleotide sequence of VGAM614 precursor RNA is designated SEQ ID:600, and is provided hereinbelow with reference to the sequence listing part. Nucleotide sequence SEQ ID:600 is located at position 74778 relative to the genome of Xestia C-nigrum Granulovirus.

VGAM614 precursor RNA folds onto itself, forming VGAM614 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM614 folded precursor RNA into VGAM614 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM614 RNA is designated SEQ ID:3325, and is provided hereinbelow with reference to the sequence listing part.

VGAM614 host target gene, herein designated VGAM HOST TARGET GENE, encodes a corresponding messenger RNA, VGAM614 host target RNA, herein designated VGAM HOST TARGET RNA. VGAM614 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM614 RNA, herein designated VGAM RNA, binds complementarily to one or more host target binding sites located in untranslated regions of VGAM614 host target RNA, herein designated VGAM HOST TARGET RNA. This complementary binding is due to the fact that the nucleotide sequence of VGAM614 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM614 RNA, herein designated VGAM RNA, may have a different number of host target binding sites in untranslated regions of a VGAM614 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM614 RNA, herein designated VGAM RNA, to host target binding sites on VGAM614 host target RNA, herein designated VGAM HOST TARGET RNA, such as BINDING SITE I, BINDING SITE II and BINDING SITE III, inhibits translation of VGAM614 host target RNA into VGAM614 host target protein, herein designated VGAM HOST TARGET PROTEIN. VGAM host target protein is therefore outlined by a broken line.

It is appreciated that VGAM614 host target gene, herein designated VGAM HOST TARGET GENE, in fact represents a plurality of VGAM614 host target genes. The mRNA of each one of this plurality of VGAM614 host target genes comprises one or more host target binding sites, each having a nucleotide sequence which is at least partly complementary to VGAM614 RNA, herein designated VGAM RNA, and which when bound by VGAM614 RNA causes inhibition of translation of respective one or more VGAM614 host target proteins.

It is further appreciated by one skilled in the art that the mode of translational inhibition illustrated by FIG. 1 with specific reference to translational inhibition exerted by VGAM614 gene, herein designated VGAM GENE, on one or more VGAM614 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM614 is inhibition of expression of host target genes, as part of a novel viral mechanism of attacking a host. Accordingly, utilities of VGAM614 include diagnosis, prevention and treatment of viral infection by Xestia C-nigrum Granulovirus. Specific functions, and accordingly utilities, of VGAM614 correlate with, and may be deduced from, the identity of the host target genes which VGAM614 binds and inhibits, and the function of these host target genes, as elaborated hereinbelow.

Nucleotide sequences of the VGAM614 precursor RNA, herein designated VGAM PRECURSOR RNA, and of the 'diced' VGAM614 RNA, herein designated VGAM RNA, and a schematic representation of the secondary folding of VGAM614 folded precursor RNA, herein designated VGAM FOLDED PRECURSOR RNA, of VGAM614 are further described hereinbelow with reference to Table 1.

Nucleotide sequences of host target binding sites, such as BINDING SITE-I, BINDING SITE-II and BINDING SITE-III of FIG. 1, found on VGAM614 host target RNA, and schematic representation of the complementarity of each of these host target binding sites to VGAM614 RNA, herein designated VGAM RNA, are described hereinbelow with reference to Table 2.

As mentioned hereinabove with reference to FIG. 1, a function of VGAM614 gene, herein designated VGAM is inhibition of expression of VGAM614 target genes. It is appreciated that specific functions, and accordingly utilities, of VGAM614 correlate with, and may be deduced from, the identity of the target genes which VGAM614 binds and inhibits, and the function of these target genes, as elaborated hereinbelow.

Cytochrome B-245, Beta Polypeptide (chronic granulomatous disease) (CYBB, Accession XM_084288) is a VGAM614 host target gene. CYBB BINDING SITE is HOST TARGET binding site found in the 3' untranslated region of mRNA encoded by CYBB, corresponding to a HOST TARGET binding site such as BINDING SITE I, BINDING SITE II or BINDING SITE III. Table 2 illustrates the complementarity of the nucleotide sequences of CYBB BINDING SITE, designated SEQ ID:37536, to the nucleotide sequence of VGAM614 RNA, herein designated VGAM RNA, also designated SEQ ID:3325.

A function of VGAM614 is therefore inhibition of Cytochrome B-245, Beta Polypeptide (chronic granulomatous disease) (CYBB, Accession XM_084288). Accordingly, utilities of VGAM614 include diagnosis, prevention and treatment of diseases and clinical conditions associated with CYBB. HSPC155 (Accession NM_016406) is another VGAM614 host target gene. HSPC155 BINDING SITE is HOST TARGET binding site found in the 5' untranslated region of mRNA encoded by HSPC155, corresponding to a HOST TARGET binding site such as BINDING SITE I, BINDING SITE II or BINDING SITE III. Table 2 illustrates the complementarity of the nucleotide sequences of HSPC155 BINDING SITE, designated SEQ ID:18539, to the nucleotide sequence of VGAM614 RNA, herein designated VGAM RNA, also designated SEQ ID:3325.

Another function of VGAM614 is therefore inhibition of HSPC155 (Accession NM_016406). Accordingly, utilities of VGAM614 include diagnosis, prevention and treatment of diseases and clinical conditions associated with HSPC155. LOC158431 (Accession XM_098940) is another VGAM614 host target gene. LOC158431 BINDING SITE is HOST TARGET binding site found in the 3' untranslated region of mRNA encoded by LOC158431, corresponding to a HOST TARGET binding site such as BINDING SITE I, BINDING SITE II or BINDING SITE III. Table 2 illustrates the complementarity of the nucleotide sequences of LOC158431 BINDING SITE, designated SEQ ID:41991, to the nucleotide sequence of VGAM614 RNA, herein designated VGAM RNA, also designated SEQ ID:3325.

Another function of VGAM614 is therefore inhibition of LOC158431 (Accession XM_098940). Accordingly, utilities of VGAM614 include diagnosis, prevention and treatment of diseases and clinical conditions associated with LOC158431. FIG. 1 further provides a conceptual description of a novel bioinformatically detected viral gene of the present invention, referred to here as Viral Genomic Address Messenger 615 (VGAM615) viral gene, which modulates expression of respective host target genes thereof, the function and utility of which host target genes is known in the art.

VGAM615 is a novel bioinformatically detected regulatory, non protein coding, viral micro RNA (miRNA) gene. The method by which VGAM615 was detected is described hereinabove with reference to FIGS. 1-8.

VGAM615 gene, herein designated VGAM GENE, is a viral gene contained in the genome of Xestia C-nigrum Granulovirus. VGAM615 host target gene, herein designated VGAM HOST TARGET GENE, is a human gene contained in the human genome.

VGAM615 gene encodes a VGAM615 precursor RNA, herein designated VGAM PRECURSOR RNA. Similar to other miRNA genes, and unlike most ordinary genes, VGAM615 precursor RNA does not encode a protein. A nucleotide sequence identical or highly similar to the nucleotide sequence of VGAM615 precursor RNA is designated SEQ ID:601, and is provided hereinbelow with reference to the sequence listing part. Nucleotide sequence SEQ ID:601 is located at position 128621 relative to the genome of Xestia C-nigrum Granulovirus.

VGAM615 precursor RNA folds onto itself, forming VGAM615 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM615 folded precursor RNA into VGAM615 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM615 RNA is designated SEQ ID:3326, and is provided hereinbelow with reference to the sequence listing part.

VGAM615 host target gene, herein designated VGAM HOST TARGET GENE, encodes a corresponding messenger RNA, VGAM615 host target RNA, herein designated VGAM HOST TARGET RNA. VGAM615 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM615 RNA, herein designated VGAM RNA, binds complementarily to one or more host target binding sites located in untranslated regions of VGAM615 host target RNA, herein designated VGAM HOST TARGET RNA. This complementary binding is due to the fact that the nucleotide sequence of VGAM615 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM615 RNA, herein designated VGAM RNA, may have a different number of host target binding sites in untranslated regions of a VGAM615 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM615 RNA, herein designated VGAM RNA, to host target binding sites on VGAM615 host target RNA, herein designated VGAM HOST TARGET RNA, such as BINDING SITE I, BINDING SITE II and BINDING SITE III, inhibits translation of VGAM615 host target RNA into VGAM615 host target protein, herein designated VGAM HOST TARGET PROTEIN. VGAM host target protein is therefore outlined by a broken line.

It is appreciated that VGAM615 host target gene, herein designated VGAM HOST TARGET GENE, in fact represents a plurality of VGAM615 host target genes. The mRNA of each one of this plurality of VGAM615 host target genes comprises one or more host target binding sites, each having a nucleotide sequence which is at least partly complementary to VGAM615 RNA, herein designated VGAM RNA, and which when bound by VGAM615 RNA causes inhibition of translation of respective one or more VGAM615 host target proteins.

It is further appreciated by one skilled in the art that the mode of translational inhibition illustrated by FIG. 1 with specific reference to translational inhibition exerted by VGAM615 gene, herein designated VGAM GENE, on one or more VGAM615 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM615 is inhibition of expression of host target genes, as part of a novel viral mechanism of attacking a host. Accordingly, utilities of VGAM615 include diagnosis, prevention and treatment of viral infection by Xestia C-nigrum Granulovirus. Specific functions, and accordingly utilities, of VGAM615 correlate with, and may be deduced from, the identity of the host target genes which VGAM615 binds and inhibits, and the function of these host target genes, as elaborated hereinbelow.

Nucleotide sequences of the VGAM615 precursor RNA, herein designated VGAM PRECURSOR RNA, and of the 'diced' VGAM615 RNA, herein designated VGAM RNA, and a schematic representation of the secondary folding of VGAM615 folded precursor RNA, herein designated VGAM FOLDED PRECURSOR RNA, of VGAM615 are further described hereinbelow with reference to Table 1.

Nucleotide sequences of host target binding sites, such as BINDING SITE-I, BINDING SITE-II and BINDING SITE-III of FIG. 1, found on VGAM615 host target RNA, and schematic representation of the complementarity of each of these host target binding sites to VGAM615 RNA, herein designated VGAM RNA, are described hereinbelow with reference to Table 2.

As mentioned hereinabove with reference to FIG. 1, a function of VGAM615 gene, herein designated VGAM is inhibition of expression of VGAM615 target genes. It is appreciated that specific functions, and accordingly utilities, of VGAM615 correlate with, and may be deduced from, the identity of the target genes which VGAM615 binds and inhibits, and the function of these target genes, as elaborated hereinbelow.

Axin 1 (AXIN1, Accession XM_027520) is a VGAM615 host target gene. AXIN1 BINDING SITE is HOST TARGET binding site found in the 3' untranslated region of mRNA encoded by AXIN1, corresponding to a HOST TARGET binding site such as BINDING SITE I, BINDING SITE II or BINDING SITE III. Table 2 illustrates the complementarity of the nucleotide sequences of AXIN1 BINDING SITE, designated SEQ ID:30514, to the nucleotide sequence of VGAM615 RNA, herein designated VGAM RNA, also designated SEQ ID:3326.

A function of VGAM615 is therefore inhibition of Axin 1 (AXIN1, Accession XM_027520). Accordingly, utilities of VGAM615 include diagnosis, prevention and treatment of diseases and clinical conditions associated with AXIN1. EGF-like-domain, Multiple 4 (EGFL4, Accession XM_029883) is another VGAM615 host target gene. EGFL4 BINDING SITE is HOST TARGET binding site found in the 3' untranslated region of mRNA encoded by EGFL4, corresponding to a HOST TARGET binding site such as BINDING SITE I, BINDING SITE II or BINDING SITE III. Table 2 illustrates the complementarity of the nucleotide sequences of EGFL4 BINDING SITE, designated SEQ ID:30965, to the nucleotide sequence of VGAM615 RNA, herein designated VGAM RNA, also designated SEQ ID:3326.

Another function of VGAM615 is therefore inhibition of EGF-like-domain, Multiple 4 (EGFL4, Accession XM_029883). Accordingly, utilities of VGAM615 include diagnosis, prevention and treatment of diseases and clinical conditions associated with EGFL4. Formin-like (FMNL, Accession NM_005892) is another VGAM615 host target gene. FMNL BINDING SITE is HOST TARGET binding site found in the 5' untranslated region of mRNA encoded by FMNL, corresponding to a HOST TARGET binding site such as BINDING SITE I, BINDING SITE II or BINDING SITE III. Table 2 illustrates the complementarity of the nucleotide sequences of FMNL BINDING SITE, designated SEQ ID:12512, to the nucleotide sequence of VGAM615 RNA, herein designated VGAM RNA, also designated SEQ ID:3326.

Another function of VGAM615 is therefore inhibition of Formin-like (FMNL, Accession NM_005892), a gene which controls the reorganization of the actin cytoskeleton in association with Rac. Accordingly, utilities of VGAM615 include diagnosis, prevention and treatment of diseases and clinical conditions associated with FMNL. The function of FMNL has been established by previous studies. By sequencing a recombinant cosmid library, Aronsson et al. (1998) identified 2 genes, NIK (OMIM Ref. No. 604655) and C17ORF1B. Northern blot analysis revealed that C17ORF1B is expressed as a 1.8-kb transcript in heart, brain, placenta, lung, liver, skeletal muscle, kidney, and pancreas. By directed sequencing of the cosmid library, Aronsson et al. (1998) showed that C17ORF1B contains 11 exons spanning 5.1 kb of genomic DNA. Yayoshi-Yamamoto et al. (2000) isolated cDNAs encoding mouse Frl-alpha and Frl-beta (formin-related gene in leukocytes) that appeared to be homologs of C17ORF1B. Western blot, immunofluorescence, and Northern blot analyses showed that Frl is expressed as a 160-kD cytosolic protein that is highly expressed in spleen, lymph node, and bone marrow cells and that it associates with Rac (see OMIM Ref. No. 602048) and profilin (see OMIM Ref. No. 176610). Yayoshi-Yamamoto et al. (2000) suggested that Frl may play a role in the control of reorganization of the actin cytoskeleton in association with Rac and in the regulation of the signal for cell survival. By FISH and radiation hybrid analysis, Aronsson et al. (1998) mapped the C17ORF1B gene to chromosome 17q21. Using exon-intron maps and mutation screening, Aronsson et al. (1998) found no disease-specific alterations in the C17ORF1B gene in a pedigree with frontotemporal dementia and parkinsonism linked to chromosome 17 (OMIM Ref. No. 600274).

Full details of the abovementioned studies are described in the following publications, the disclosure of which are hereby incorporated by reference:

Aronsson, F. C.; Magnusson, P.; Andersson, B.; Karsten, S. L.; Shibasaki, Y.; Lendon, C. L.; Goate, A. M.; Brookes, A. J.: The NIK protein kinase and C17orf1 genes: chromosomal mapping, gene structures and mutational screening in frontotemporal dementia and parkinsonism linked to chromosome 17. Hum. Genet. 103:340-345, 1998; and Yayoshi-Yamamoto, S.; Taniuchi, I.; Watanabe, T.: FRL, a novel formin-related protein, binds to Rac and regulates cell motility and survival of macrophages. Molec. Cell. Biol. 20:6872.

Further studies establishing the function and utilities of FMNL are found in John Hopkins OMIM database record ID 604656, and in sited publications numbered 7284-7285 listed in the bibliography section hereinbelow, which are also hereby incorporated by reference. Farnesyltransferase, CAAX Box, Beta (FNTB, Accession NM_002028) is another VGAM615 host target gene. FNTB BINDING SITE is HOST TARGET binding site found in the 3' untranslated region of mRNA encoded by FNTB, corresponding to a HOST TARGET binding site such as BINDING SITE I, BINDING SITE II or BINDING SITE III. Table 2 illustrates the complementarity of the nucleotide sequences of FNTB BINDING SITE, designated SEQ ID:7780, to the nucleotide sequence of VGAM615 RNA, herein designated VGAM RNA, also designated SEQ ID:3326.

Another function of VGAM615 is therefore inhibition of Farnesyltransferase, CAAX Box, Beta (FNTB, Accession NM_002028), a gene which transfers farnesyl groups to proteins. Accordingly, utilities of VGAM615 include diagnosis, prevention and treatment of diseases and clinical conditions associated with FNTB. The function of FNTB has been established by previous studies. Andres et al. (1993) localized the gene for the beta subunit of CAAX farnesyltransferase (FNTB) to 14q23-q24 by Southern blot hybridization and PCR analyses of panels of human/Chinese hamster somatic cell hybrid lines and by fluorescence chromosomal in situ hybridization. They found a related farnesyltransferase gene, FNTBL1, on chromosome 9. Long et al. (2002) presented a complete series of structures representing the major steps along the reaction coordinate of the enzyme protein farnesyltransferase. From these observations, Long et al. (2002) deduced the determinants of substrate specificity and an unusual mechanism in which product release requires binding of substrate, analogous to classically processive enzymes. A structural model for the transition state consistent with previous mechanistic studies was also constructed.

Full details of the abovementioned studies are described in the following publications, the disclosure of which are hereby incorporated by reference:

Andres, D. A.; Milatovich, A.; Ozcelik, T.; Wenzlau, J. M.; Brown, M. S.; Goldstein, J. L.; Francke, U.: cDNA cloning of the two subunits of human CAAX farnesyltransferase and chromosomal mapping of FNTA and FNTB loci and related sequences. Genomics 18:105-112, 1993; and Long, S. B.; Casey, P. J.; Beese, L. S.: Reaction path of protein farnesyltransferase at atomic resolution. Nature 419: 645-650, 2002.

Further studies establishing the function and utilities of FNTB are found in John Hopkins OMIM database record ID 134636, and in sited publications numbered 11671-11672 listed in the bibliography section hereinbelow, which are also hereby incorporated by reference. Forkhead Box D1 (FOXD1, Accession NM_004472) is another VGAM615 host target gene. FOXD1 BINDING SITE is HOST TARGET binding site found in the 5' untranslated region of mRNA encoded by FOXD1, corresponding to a HOST TARGET binding site such as BINDING SITE I, BINDING SITE II or BINDING SITE III. Table 2 illustrates the complementarity of the nucleotide sequences of FOXD1 BINDING SITE, designated SEQ ID:10778, to the nucleotide sequence of VGAM615 RNA, herein designated VGAM RNA, also designated SEQ ID:3326.

Another function of VGAM615 is therefore inhibition of Forkhead Box D1 (FOXD1, Accession NM_004472), a gene which has regulatory role in embryonic development. Accordingly, utilities of VGAM615 include diagnosis, prevention and treatment of diseases and clinical conditions associated with FOXD1. The function of FOXD1 has been established by previous studies. The forkhead genes are transcription factors distinguished by a characteristic 100-amino acid motif that was originally identified in Drosophila (see OMIM Ref. No. 164874). Pierrou et al. (1994) identified 7 human genes containing a forkhead domain and designated them forkhead related activators (FREAC) 1 through 7. Northern blot analysis revealed that the FREAC4, or FKHL8, gene is expressed as a 2.1-kb mRNA exclusively in testis and kidney. These authors determined the DNA binding specificity of FKHL8 through selection of high affinity binding sites from random sequence oligonucleotides. Ernstsson et al. (1996) identified the human forkhead gene FREAC4 (FKHL8) as a nearly full-length cDNA and a 5.2-kb genomic fragment. The intronless gene predicts a protein of 465 amino acids with a hyperacidic N-terminal end, a DNA-binding forkhead domain, and a proline- and alanine-rich C-terminal end. The putative promoter region was active as a reporter fusion in the kidney-derived cell lines 293 and COS-7. Cotransfections with plasmids expressing WT1 (OMIM Ref. No. 607102), WTAR (a mutated form of WT1), p53 (OMIM Ref. No. 191170), and a mutated form of p53 revealed a complex pattern of regulation, suggesting that FREAC4 may be regulated by these gene products. Larsson et al. (1995) mapped the FKHL8 gene to 5q12-q13 by fluorescence in situ hybridization and somatic cell hybrid analysis.

Full details of the abovementioned studies are described in the following publications, the disclosure of which are hereby incorporated by reference:

Ernstsson, S.; Pierrou, S.; Hulander, M.; Cederberg, A.; Hellqvist, M.; Carlsson, P.; Enerback, S.: Characterization of the human forkhead gene FREAC-4. J. Biol. Chem. 271: 21094-21099, 1996; and Larsson, C.; Hellqvist, M.; Pierrou, S.; White, I.; Enerback, S.; Carlsson, P.: Chromosomal localization of six human forkhead genes, freac-1 (FKHL5), -3 (FKHL7), -4 (FKHL8), -5 (FKHL9).

Further studies establishing the function and utilities of FOXD1 are found in John Hopkins OMIM database record ID 601091, and in sited publications numbered 9461-9460 listed in the bibliography section hereinbelow, which are also hereby incorporated by reference. Potassium Intermediate/small Conductance Calcium-activated Channel, Subfamily N, Member 4 (KCNN4, Accession NM_002250) is another VGAM615 host target gene. KCNN4 BINDING SITE is HOST TARGET binding site found in the 5' untranslated region of mRNA encoded by KCNN4, corresponding to a HOST TARGET binding site such as BINDING SITE I, BINDING SITE II or BINDING SITE III. Table 2 illustrates the complementarity of the nucleotide sequences of KCNN4 BINDING SITE, designated SEQ ID:8035, to the nucleotide sequence of VGAM615 RNA, herein designated VGAM RNA, also designated SEQ ID:3326.

Another function of VGAM615 is therefore inhibition of Potassium Intermediate/small Conductance Calcium-activated Channel, Subfamily N, Member 4 (KCNN4, Accession NM_002250), a gene which forms a voltage-independent potassium channel that is activated by intracellular calcium. Accordingly, utilities of VGAM615 include diagnosis, prevention and treatment of diseases and clinical conditions associated with KCNN4. The function of KCNN4 and its association with various diseases and clinical conditions, has been established by previous studies, as described hereinabove with reference to VGAM152. Lymphocyte Antigen 6 Complex, Locus E (LY6E, Accession NM_002346) is another VGAM615 host target gene. LY6E BINDING SITE is HOST TARGET binding site found in the 3' untranslated region of mRNA encoded by LY6E, corresponding to a HOST TARGET binding site such as BINDING SITE I, BINDING SITE II or BINDING SITE III. Table 2 illustrates the complementarity of the nucleotide sequences of LY6E BINDING SITE, designated SEQ ID:8146, to the nucleotide sequence of VGAM615 RNA, herein designated VGAM RNA, also designated SEQ ID:3326.

Another function of VGAM615 is therefore inhibition of Lymphocyte Antigen 6 Complex, Locus E (LY6E, Accession NM_002346). Accordingly, utilities of VGAM615 include diagnosis, prevention and treatment of diseases and clinical conditions associated with LY6E. MAD, Mothers Against Decapentaplegic Homolog 4 (Drosophila) (MADH4, Accession NM_005359) is another VGAM615 host target gene. MADH4 BINDING SITE is HOST TARGET binding site found in the 5' untranslated region of mRNA encoded by MADH4, corresponding to a HOST TARGET binding site such as BINDING SITE I, BINDING SITE II or BINDING SITE III. Table 2 illustrates the complementarity of the nucleotide sequences of MADH4 BINDING SITE, designated SEQ ID:11831, to the nucleotide sequence of VGAM615 RNA, herein designated VGAM RNA, also designated SEQ ID:3326.

Another function of VGAM615 is therefore inhibition of MAD, Mothers Against Decapentaplegic Homolog 4 (Drosophila) (MADH4, Accession NM_005359), a gene which common mediator of signal transduction by tgf-beta (transforming growth factor) superfamily; smad4 is the common smad (co-smad). promotes binding of the smad2/smad4/fast-1 complex to dna and provides an activation function required for smad1 or smad2 to stimulate transcription. may act as a tumor suppressor. Accordingly, utilities of VGAM615 include diagnosis, prevention and treatment of diseases and clinical conditions associated with MADH4. The function of MADH4 and its association with various diseases and clinical conditions, has been established by previous studies, as described hereinabove with reference to VGAM217. Microtubule-associated Protein Tau (MAPT, Accession NM_016834) is another VGAM615 host target gene. MAPT BINDING SITE1 through MAPT BINDING SITE4 are HOST TARGET binding sites found in untranslated regions of mRNA encoded by MAPT, corresponding to HOST TARGET binding sites such as BINDING SITE I, BINDING SITE II or BINDING SITE III. Table 2 illustrates the complementarity of the nucleotide sequences of MAPT BINDING SITE1 through MAPT BINDING SITE4, designated SEQ ID:18828, SEQ ID:12540, SEQ ID:18834 and SEQ ID:18840 respectively, to the nucleotide sequence of VGAM615 RNA, herein designated VGAM RNA, also designated SEQ ID:3326.

Another function of VGAM615 is therefore inhibition of Microtubule-associated Protein Tau (MAPT, Accession NM_016834), a gene which Microtubule-associated protein tau; promotes microtubule assembly. Accordingly, utilities of VGAM615 include diagnosis, prevention and treatment of diseases and clinical conditions associated with MAPT. The function of MAPT and its association with various diseases and clinical conditions, has been established by previous studies, as described hereinabove with reference to VGAM178. MLL Sep.in-like Fusion (MSF, Accession XM_113892) is another VGAM615 host target gene. MSF BINDING SITE is HOST TARGET binding site found in the 5' untranslated region of mRNA encoded by MSF, corresponding to a HOST TARGET binding site such as BINDING SITE I, BINDING SITE II or BINDING SITE III. Table 2 illustrates the complementarity of the nucleotide sequences of MSF BINDING SITE, designated SEQ ID:42523, to the nucleotide sequence of VGAM615 RNA, herein designated VGAM RNA, also designated SEQ ID:3326.

Another function of VGAM615 is therefore inhibition of MLL Sep.in-like Fusion (MSF, Accession XM_113892), a gene which plays a role in the cell cycle. Accordingly, utilities of VGAM615 include diagnosis, prevention and treatment of diseases and clinical conditions associated with MSF. The function of MSF and its association with various diseases and clinical conditions, has been established by previous studies, as described hereinabove with reference to VGAM514. Neuroglobin (NGB, Accession NM_021257) is another VGAM615 host target gene. NGB BINDING SITE is HOST TARGET binding site found in the 3' untranslated region of mRNA encoded by NGB, corresponding to a HOST TARGET binding site such as BINDING SITE I, BINDING SITE II or BINDING SITE III. Table 2 illustrates the complementarity of the nucleotide sequences of NGB BINDING SITE, designated SEQ ID:22233, to the nucleotide sequence of VGAM615 RNA, herein designated VGAM RNA, also designated SEQ ID:3326.

Another function of VGAM615 is therefore inhibition of Neuroglobin (NGB, Accession NM_021257), a gene which has function in oxygen transport and storage in human S. Accordingly, utilities of VGAM615 include diagnosis, prevention and treatment of diseases and clinical conditions associated with NGB. The function of NGB has been established by previous studies. By EST database searching for globin-like sequences, Burmester et al. (2000) identified cDNAs encoding human and mouse neuroglobin, symbolized NGB. Sequence analysis predicted that the 151-amino acid mouse and human proteins share 94% identity with each other but less than 25% identity with other vertebrate globins. RNA dot blot analysis revealed predominant expression in the brain, with strongest signals observed in the frontal lobe, the subthalamic nucleus, and the thalamus. In situ hybridization analysis demonstrated expression in mouse brain neuronal cells. RT-PCR detected only trace amounts of Ngb in other mouse tissues. Biochemical purification and size-exclusion chromatographic analysis showed that Ngb is a 16-kD monomer, found in low concentrations in mouse brain, that reversibly binds oxygen with an affinity nearly as high as that of MB but higher than that of HB. Genomic sequence analysis of a PAC clone determined that the NGB gene has a 4 exon/3 intron structure, distinct from that of other globin genes, and a promoter region that contains several putative SP1 (OMIM Ref. No. 189906)-binding sites. Five-prime RACE identified at least 3 transcription starting points but no TATA box, suggesting a housekeeping promoter. In an accompanying editorial, Moens and Dewilde (2000) noted that regions of the brain with lower expression of NGB (e.g., hippocampus) have lower resistance to ischemia and are frequently affected by neurofibrillary tangles in Alzheimer disease.

Full details of the abovementioned studies are described in the following publications, the disclosure of which are hereby incorporated by reference:

Burmester, T.; Weich, B.; Reinhardt, S.; Hankeln, T.: A vertebrate globin expressed in the brain. Nature 407:520-523, 2000; and Moens, L.; Dewilde, S.: Globins in the brain. Nature 407: 461-462, 2000.

Further studies establishing the function and utilities of NGB are found in John Hopkins OMIM database record ID 605304, and in sited publications numbered 7476-7477 listed in the bibliography section hereinbelow, which are also hereby incorporated by reference. Neuropeptide Y Receptor Y2 (NPY2R, Accession NM_000910) is another VGAM615 host target gene. NPY2R BINDING SITE is HOST TARGET binding site found in the 5' untranslated region of mRNA encoded by NPY2R, corresponding to a HOST TARGET binding site such as BINDING SITE I, BINDING SITE II or BINDING SITE III. Table 2 illustrates the complementarity of the nucleotide sequences of NPY2R BINDING SITE, designated SEQ ID:6609, to the nucleotide sequence of VGAM615 RNA, herein designated VGAM RNA, also designated SEQ ID:3326.

Another function of VGAM615 is therefore inhibition of Neuropeptide Y Receptor Y2 (NPY2R, Accession NM_000910), a gene which stimulates intracellular calcium flux and may modulate psychomotor activity, food intake, endocrine secretion and vasoconstriction. Accordingly, utilities of VGAM615 include diagnosis, prevention and treatment of diseases and clinical conditions associated with NPY2R. The function of NPY2R and its association with various diseases and clinical conditions, has been established by previous studies, as described hereinabove with reference to VGAM309. Pleckstrin Homology, Sec7 and Coiled/coil Domains 4 (PSCD4, Accession NM_013385) is another VGAM615 host target gene. PSCD4 BINDING SITE is HOST TARGET binding site found in the 3' untranslated region of mRNA encoded by PSCD4, corresponding to a HOST TARGET binding site such as BINDING SITE I, BINDING SITE II or BINDING SITE III. Table 2 illustrates the complementarity of the nucleotide sequences of PSCD4 BINDING SITE, designated SEQ ID:15037, to the nucleotide sequence of VGAM615 RNA, herein designated VGAM RNA, also designated SEQ ID:3326.

Another function of VGAM615 is therefore inhibition of Pleckstrin Homology, Sec7 and Coiled/coil Domains 4 (PSCD4, Accession NM_013385), a gene which promotes guanine-nucleotide exchange on arf1 and arf5. Accordingly, utilities of VGAM615 include diagnosis, prevention and treatment of diseases and clinical conditions associated with PSCD4. The function of PSCD4 has been established by previous studies. ADP-ribosylation factors, or ARFS (see OMIM Ref. No. ARF1; 103180), are small GTP-binding proteins within the Ras superfamily that regulate vesicle trafficking in eukaryotic cells. ARF1 recruits coat proteins (e.g., COPA; 601924) to membranes on the cytoplasmic face of the Golgi apparatus. The PSCD proteins (e.g., PSCD1; 182115), a family of proteins containing a C-terminal pleckstrin homology (PH) domain and a central 200-amino acid region similar to a domain within the yeast Sec7 protein, which is required for vesicular traffic of polypeptides through the Golgi, function as guanine-nucleotide exchange factors (GEFs) for ARFs. Klarlund et al. (1997) identified a cDNA encoding mouse Grp1 (general receptor for phosphoinositides-1) by screening mouse adipocyte and brain cDNA expression libraries with phosphoinositide probes. By searching an EST database for sequences similar to mouse brain Grp1, followed by PCR and screening of a human blood cDNA library, Venkateswarlu et al. (1998) obtained a cDNA encoding PSCD3, which they called GRP1. Sequence analysis showed that the predicted 399-amino acid PSCD3 protein contains a 39-amino acid coiled-coil domain, a 172-amino acid Sec7 domain, and a 118-amino acid PH domain. PSCD3 shares 82.7% and 79.5% amino acid identity with PSCD1 and PSCD2 (OMIM Ref. No. 602488), respectively, as well as 98.8% identity with mouse Grp1. By Scatchard and mutational analyses, Venkateswarlu et al. (1998) determined that PSCD3 binds via its PH domain to the inositol head group of phosphatidylinositol 3,4,5-triphosphate with high affinity. Confocal laser microscopy demonstrated that stimulation of cells with either epidermal growth factor (EGF; 131530) or nerve growth factor (NGF; 162030) results in PH domain-dependent translocation of PSCD3 from the cytosol to the plasma membrane. The translocation was rapid and transient with EGF, whereas NGF mediated a relatively longer translocation. By searching an EST database for Sec7 domain-related sequences and by screening a placenta cDNA library, Franco et al. (1998) isolated a cDNA encoding PSCD3, which they called ARNO3. Northern blot analysis revealed that PSCD3, in contrast to the ubiquitously expressed PSCD1 and PSCD2, is expressed as a 4.5-kb transcript that is almost absent from liver, thymus, and peripheral blood lymphocytes. Franco et al. (1998) found that PSCD3, like PSCD1 and PSCD2, shows GEF activity, mediated by the Sec7 domain, towards ARF1 but not ARF6 (OMIM Ref. No. 600464). Immunofluorescence microscopy indicated that overexpression of PSCD3 induces major morphologic alterations of the Golgi apparatus, including redistribution of Golgi resident proteins and the coat protein COPB (OMIM Ref. No. 600959). Lietzke et al. (2000) and Ferguson et al. (2000) determined the structure of the GRP1 PH domain in the unliganded form and bound to inositol 1,3,4,5-tetraphosphate. Lietzke et al. (2000) found that a novel mode of phosphoinositide recognition involving a 20-residue insertion within the beta-6/beta-7 loop explains the unusually high specificity of the GRP1 PH domain and the promiscuous 3-phosphoinositide binding typical of several other PH domains, including that of protein kinase B (AKT1; 164730). By comparing the GRP1 PH domain to other PH domains, general determinants of 3-phosphoinositide recognition and specificity could be deduced.

Full details of the abovementioned studies are described in the following publications, the disclosure of which are hereby incorporated by reference:

Ferguson, K. M.; Kavran, J. M.; Sankaran, V. G.; Fournier, E.; Isakoff, S. J.; Skolnik, E. Y.; Lemmon, M. A.: Structural basis for discrimination of 3-phosphoinositides by pleckstrin homology domains. Molec. Cell 6:373-384, 2000; and Franco, M.; Boretto, J.; Robineau, S.; Monier, S.; Goud, B.; Chardin, P.; Chavrier, P.: ARNO3, a Sec7-domain guanine nucleotide exchange factor for ADP ribosylation factor 1, is invol.

Further studies establishing the function and utilities of PSCD4 are found in John Hopkins OMIM database record ID 606514, and in sited publications numbered 10705 listed in the bibliography section hereinbelow, which are also hereby incorporated by reference. RAN Binding Protein 3 (RANBP3, Accession NM_003624) is another VGAM615 host target gene. RANBP3 BINDING SITE1 and RANBP3 BINDING SITE2 are HOST TARGET binding sites found in untranslated regions of mRNA encoded by RANBP3, corresponding to HOST TARGET binding sites such as BINDING SITE I, BINDING SITE II or BINDING SITE III. Table 2 illustrates the complementarity of the nucleotide sequences of RANBP3 BINDING SITE1 and RANBP3 BINDING SITE2, designated SEQ ID:9688 and SEQ ID:14240 respectively, to the nucleotide sequence of VGAM615 RNA, herein designated VGAM RNA, also designated SEQ ID:3326.

Another function of VGAM615 is therefore inhibition of RAN Binding Protein 3 (RANBP3, Accession NM_003624). Accordingly, utilities of VGAM615 include diagnosis, prevention and treatment of diseases and clinical conditions associated with RANBP3. Chromosome 1 Open Reading Frame 2 (C1orf2, Accession NM_006589) is another VGAM615 host target gene. C1orf2 BINDING SITE1 and C1orf2 BINDING SITE2 are HOST TARGET binding sites found in untranslated regions of mRNA encoded by C1orf2, corresponding to HOST TARGET binding sites such as BINDING SITE I, BINDING SITE II or BINDING SITE III. Table 2 illustrates the complementarity of the nucleotide sequences of C1orf2 BINDING SITE1 and C1orf2 BINDING SITE2, designated SEQ ID:13356 and SEQ ID:45396 respectively, to the nucleotide sequence of VGAM615 RNA, herein designated VGAM RNA, also designated SEQ ID:3326.

Another function of VGAM615 is therefore inhibition of Chromosome 1 Open Reading Frame 2 (C1orf2, Accession NM_006589). Accordingly, utilities of VGAM615 include diagnosis, prevention and treatment of diseases and clinical conditions associated with C1orf2. DKFZP434J193 (Accession XM_048452) is another VGAM615 host target gene. DKFZP434J193 BINDING SITE is HOST TARGET binding site found in the 3' untranslated region of mRNA encoded by DKFZP434J193, corresponding to a HOST TARGET binding site such as BINDING SITE I, BINDING SITE II or BINDING SITE III. Table 2 illustrates the complementarity of the nucleotide sequences of DKFZP434J193 BINDING SITE, designated SEQ ID:35164, to the nucleotide sequence of VGAM615 RNA, herein designated VGAM RNA, also designated SEQ ID:3326.

Another function of VGAM615 is therefore inhibition of DKFZP434J193 (Accession XM_048452). Accordingly, utilities of VGAM615 include diagnosis, prevention and treatment of diseases and clinical conditions associated with DKFZP434J193. DKFZp586I021 (Accession NM_032271) is another VGAM615 host target gene. DKFZp586I021 BINDING SITE is HOST TARGET binding site found in the 5' untranslated region of mRNA encoded by DKFZp586I021, corresponding to a HOST TARGET binding site such as BINDING SITE I, BINDING SITE II or BINDING SITE III. Table 2 illustrates the complementarity of the nucleotide sequences of DKFZp586I021 BINDING SITE, designated SEQ ID:26021, to the nucleotide sequence of VGAM615 RNA, herein designated VGAM RNA, also designated SEQ ID:3326.

Another function of VGAM615 is therefore inhibition of DKFZp586I021 (Accession NM_032271). Accordingly, utilities of VGAM615 include diagnosis, prevention and treatment of diseases and clinical conditions associated with DKFZp586I021. FLJ22215 (Accession NM_022834) is another VGAM615 host target gene. FLJ22215 BINDING SITE1 and FLJ22215 BINDING SITE2 are HOST TARGET binding sites found in untranslated regions of mRNA encoded by FLJ22215, corresponding to HOST TARGET binding sites such as BINDING SITE I, BINDING SITE II or BINDING SITE III. Table 2 illustrates the complementarity of the nucleotide sequences of FLJ22215 BINDING SITE1 and FLJ22215 BINDING SITE2, designated SEQ ID:23118 and SEQ ID:46280 respectively, to the nucleotide sequence of VGAM615 RNA, herein designated VGAM RNA, also designated SEQ ID:3326.

Another function of VGAM615 is therefore inhibition of FLJ22215 (Accession NM_022834). Accordingly, utilities of VGAM615 include diagnosis, prevention and treatment of diseases and clinical conditions associated with FLJ22215. KIAA0455 (Accession XM_051785) is another VGAM615 host target gene. KIAA0455 BINDING SITE is HOST TARGET binding site found in the 3' untranslated region of mRNA encoded by KIAA0455, corresponding to a HOST TARGET binding site such as BINDING SITE I, BINDING SITE II or BINDING SITE III. Table 2 illustrates the complementarity of the nucleotide sequences of KIAA0455 BINDING SITE, designated SEQ ID:35881, to the nucleotide sequence of VGAM615 RNA, herein designated VGAM RNA, also designated SEQ ID:3326.

Another function of VGAM615 is therefore inhibition of KIAA0455 (Accession XM_051785). Accordingly, utilities of VGAM615 include diagnosis, prevention and treatment of diseases and clinical conditions associated with KIAA0455. MCFP (Accession NM_018843) is another VGAM615 host target gene. MCFP BINDING SITE is HOST TARGET binding site found in the 5" untranslated region of mRNA encoded by MCFP, corresponding to a HOST TARGET binding site such as BINDING SITE I, BINDING SITE II or BINDING SITE III. Table 2 illustrates the complementarity of the nucleotide sequences of MCFP BINDING SITE, designated SEQ ID:20828, to the nucleotide sequence of VGAM615 RNA, herein designated VGAM RNA, also designated SEQ ID:3326.

Another function of VGAM615 is therefore inhibition of MCFP (Accession NM_018843). Accordingly, utilities of VGAM615 include diagnosis, prevention and treatment of diseases and clinical conditions associated with MCFP. MGC15730 (Accession NM_032880) is another VGAM615 host target gene. MGC15730 BINDING SITE is HOST TARGET binding site found in the 5" untranslated region of mRNA encoded by MGC15730, corresponding to a HOST TARGET binding site such as BINDING SITE I, BINDING SITE II or BINDING SITE III. Table 2 illustrates the complementarity of the nucleotide sequences of MGC15730 BINDING SITE, designated SEQ ID:26701, to the nucleotide sequence of VGAM615 RNA, herein designated VGAM RNA, also designated SEQ ID:3326.

Another function of VGAM615 is therefore inhibition of MGC15730 (Accession NM_032880). Accordingly, utilities of VGAM615 include diagnosis, prevention and treatment of diseases and clinical conditions associated with MGC15730. Neural Precursor Cell Expressed, Developmentally Down-regulated 5 (NEDD5, Accession NM_004404) is another VGAM615 host target gene. NEDD5 BINDING SITE is HOST TARGET binding site found in the 5' untranslated region of mRNA encoded by NEDD5, corresponding to a HOST TARGET binding site such as BINDING SITE I, BINDING SITE II or BINDING SITE III. Table 2 illustrates the complementarity of the nucleotide sequences of NEDD5 BINDING SITE, designated SEQ ID:10657, to the nucleotide sequence of VGAM615 RNA, herein designated VGAM RNA, also designated SEQ ID:3326.

Another function of VGAM615 is therefore inhibition of Neural Precursor Cell Expressed, Developmentally Down-regulated 5 (NEDD5, Accession NM_004404). Accordingly, utilities of VGAM615 include diagnosis, prevention and treatment of diseases and clinical conditions associated with NEDD5. LOC128710 (Accession XM_059267) is another VGAM615 host target gene. LOC128710 BINDING SITE is HOST TARGET binding site found in the 5' untranslated region of mRNA encoded by LOC128710, corresponding to a HOST TARGET binding site such as BINDING SITE I, BINDING SITE II or BINDING SITE III. Table 2 illustrates the complementarity of the nucleotide sequences of LOC128710 BINDING SITE, designated SEQ ID:36934, to the nucleotide sequence of VGAM615 RNA, herein designated VGAM RNA, also designated SEQ ID:3326.

Another function of VGAM615 is therefore inhibition of LOC128710 (Accession XM_059267). Accordingly, utilities of VGAM615 include diagnosis, prevention and treatment of diseases and clinical conditions associated with LOC128710. LOC146381 (Accession XM_085439) is another VGAM615 host target gene. LOC146381 BINDING SITE is HOST TARGET binding site found in the 5' untranslated region of mRNA encoded by LOC146381, corresponding to a HOST TARGET binding site such as BINDING SITE I, BINDING SITE II or BINDING SITE III. Table 2 illustrates the complementarity of the nucleotide sequences of LOC146381 BINDING SITE, designated SEQ ID:38145, to the nucleotide sequence of VGAM615 RNA, herein designated VGAM RNA, also designated SEQ ID:3326.

Another function of VGAM615 is therefore inhibition of LOC146381 (Accession XM_085439). Accordingly, utilities of VGAM615 include diagnosis, prevention and treatment of diseases and clinical conditions associated with LOC146381. LOC197439 (Accession XM_113889) is another VGAM615 host target gene. LOC197439 BINDING SITE is HOST TARGET binding site found in the 5' untranslated region of mRNA encoded by LOC197439, corresponding to a HOST TARGET binding site such as BINDING SITE I, BINDING SITE II or BINDING SITE III. Table 2 illustrates the complementarity of the nucleotide sequences of LOC197439 BIND- ING SITE, designated SEQ ID:42517, to the nucleotide sequence of VGAM615 RNA, herein designated VGAM RNA, also designated SEQ ID:3326.

Another function of VGAM615 is therefore inhibition of LOC197439 (Accession XM_113889). Accordingly, utilities of VGAM615 include diagnosis, prevention and treatment of diseases and clinical conditions associated with LOC197439. LOC245811 (Accession XM_168197) is another VGAM615 host target gene. LOC245811 BINDING SITE is HOST TARGET binding site found in the 5' untranslated region of mRNA encoded by LOC245811, corresponding to a HOST TARGET binding site such as BINDING SITE I, BINDING SITE II or BINDING SITE III. Table 2 illustrates the complementarity of the nucleotide sequences of LOC245811 BINDING SITE, designated SEQ ID:45070, to the nucleotide sequence of VGAM615 RNA, herein designated VGAM RNA, also designated SEQ ID:3326.

Another function of VGAM615 is therefore inhibition of LOC245811 (Accession XM_168197). Accordingly, utilities of VGAM615 include diagnosis, prevention and treatment of diseases and clinical conditions associated with LOC245811. LOC92573 (Accession XM_045884) is another VGAM615 host target gene. LOC92573 BINDING SITE is HOST TARGET binding site found in the 5' untranslated region of mRNA encoded by LOC92573, corresponding to a HOST TARGET binding site such as BINDING SITE I, BINDING SITE II or BINDING SITE III. Table 2 illustrates the complementarity of the nucleotide sequences of LOC92573 BINDING SITE, designated SEQ ID:34595, to the nucleotide sequence of VGAM615 RNA, herein designated VGAM RNA, also designated SEQ ID:3326.

Another function of VGAM615 is therefore inhibition of LOC92573 (Accession XM_045884). Accordingly, utilities of VGAM615 include diagnosis, prevention and treatment of diseases and clinical conditions associated with LOC92573. FIG. 1 further provides a conceptual description of a novel bioinformatically detected viral gene of the present invention, referred to here as Viral Genomic Address Messenger 616 (VGAM616) viral gene, which modulates expression of respective host target genes thereof, the function and utility of which host target genes is known in the art.

VGAM616 is a novel bioinformatically detected regulatory, non protein coding, viral micro RNA (miRNA) gene. The method by which VGAM616 was detected is described hereinabove with reference to FIGS. 1-8.

VGAM616 gene, herein designated VGAM GENE, is a viral gene contained in the genome of Xestia C-nigrum Granulovirus. VGAM616 host target gene, herein designated VGAM HOST TARGET GENE, is a human gene contained in the human genome.

VGAM616 gene encodes a VGAM616 precursor RNA, herein designated VGAM PRECURSOR RNA. Similar to other miRNA genes, and unlike most ordinary genes, VGAM616 precursor RNA does not encode a protein. A nucleotide sequence identical or highly similar to the nucleotide sequence of VGAM616 precursor RNA is designated SEQ ID:602, and is provided hereinbelow with reference to the sequence listing part. Nucleotide sequence SEQ ID:602 is located at position 128882 relative to the genome of Xestia C-nigrum Granulovirus.

VGAM616 precursor RNA folds onto itself, forming VGAM616 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM616 folded precursor RNA into VGAM616 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM616 RNA is designated SEQ ID:3327, and is provided hereinbelow with reference to the sequence listing part.

VGAM616 host target gene, herein designated VGAM HOST TARGET GENE, encodes a corresponding messenger RNA, VGAM616 host target RNA, herein designated VGAM HOST TARGET RNA. VGAM616 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM616 RNA, herein designated VGAM RNA, binds complementarily to one or more host target binding sites located in untranslated regions of VGAM616 host target RNA, herein designated VGAM HOST TARGET RNA. This complementary binding is due to the fact that the nucleotide sequence of VGAM616 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM616 RNA, herein designated VGAM RNA, may have a different number of host target binding sites in untranslated regions of a VGAM616 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM616 RNA, herein designated VGAM RNA, to host target binding sites on VGAM616 host target RNA, herein designated VGAM HOST TARGET RNA, such as BINDING SITE I, BINDING SITE II and BINDING SITE III, inhibits translation of VGAM616 host target RNA into VGAM616 host target protein, herein designated VGAM HOST TARGET PROTEIN. VGAM host target protein is therefore outlined by a broken line.

It is appreciated that VGAM616 host target gene, herein designated VGAM HOST TARGET GENE, in fact represents a plurality of VGAM616 host target genes. The mRNA of each one of this plurality of VGAM616 host target genes comprises one or more host target binding sites, each having a nucleotide sequence which is at least partly complementary to VGAM616 RNA, herein designated VGAM RNA, and which when bound by VGAM616 RNA causes inhibition of translation of respective one or more VGAM616 host target proteins.

It is further appreciated by one skilled in the art that the mode of translational inhibition illustrated by FIG. 1 with specific reference to translational inhibition exerted by VGAM616 gene, herein designated VGAM GENE, on one or more VGAM616 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM616 is inhibition of expression of host target genes, as part of a novel viral mechanism of attacking a host. Accordingly, utilities of VGAM616 include diagnosis, prevention and treatment of viral infection by Xestia C-nigrum Granulovirus. Specific functions, and accordingly utilities, of VGAM616 correlate with, and may be deduced from, the identity of the host target genes which VGAM616 binds and inhibits, and the function of these host target genes, as elaborated hereinbelow.

Nucleotide sequences of the VGAM616 precursor RNA, herein designated VGAM PRECURSOR RNA, and of the 'diced' VGAM616 RNA, herein designated VGAM RNA, and a schematic representation of the secondary folding of VGAM616 folded precursor RNA, herein designated VGAM FOLDED PRECURSOR RNA, of VGAM616 are further described hereinbelow with reference to Table 1.

Nucleotide sequences of host target binding sites, such as BINDING SITE-I, BINDING SITE-II and BINDING SITE-III of FIG. 1, found on VGAM616 host target RNA, and schematic representation of the complementarity of each of these host target binding sites to VGAM616 RNA, herein designated VGAM RNA, are described hereinbelow with reference to Table 2.

As mentioned hereinabove with reference to FIG. 1, a function of VGAM616 gene, herein designated VGAM is inhibition of expression of VGAM616 target genes. It is appreciated that specific functions, and accordingly utilities, of VGAM616 correlate with, and may be deduced from, the identity of the target genes which VGAM616 binds and inhibits, and the function of these target genes, as elaborated hereinbelow.

Copine III (CPNE3, Accession NM_003909) is a VGAM616 host target gene. CPNE3 BINDING SITE is HOST TARGET binding site found in the 3' untranslated region of mRNA encoded by CPNE3, corresponding to a HOST TARGET binding site such as BINDING SITE I, BINDING SITE II or BINDING SITE III. Table 2 illustrates the complementarity of the nucleotide sequences of CPNE3 BINDING SITE, designated SEQ ID:9998, to the nucleotide sequence of VGAM616 RNA, herein designated VGAM RNA, also designated SEQ ID:3327.

A function of VGAM616 is therefore inhibition of Copine III (CPNE3, Accession NM_003909), a gene which may function in membrane trafficking. Accordingly, utilities of VGAM616 include diagnosis, prevention and treatment of diseases and clinical conditions associated with CPNE3. The function of CPNE3 and its association with various diseases and clinical conditions, has been established by previous studies, as described hereinabove with reference to VGAM28. Protocadherin Alpha 9 (PCDHA9, Accession NM_014005) is another VGAM616 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:15216, to the nucleotide sequence of VGAM616 RNA, herein designated VGAM RNA, also designated SEQ ID:3327.

Another function of VGAM616 is therefore inhibition of Protocadherin Alpha 9 (PCDHA9, Accession NM_014005), a gene which is a calcium-dependent cell-adhesion protein. Accordingly, utilities of VGAM616 include diagnosis, prevention and treatment of diseases and clinical conditions associated with PCDHA9. The function of PCDHA9 and its association with various diseases and clinical conditions, has been established by previous studies, as described hereinabove with reference to VGAM71. Src-like-adaptor (SLA, Accession NM_006748) is another VGAM616 host target gene. SLA BINDING SITE is HOST TARGET binding site found in the 3' untranslated region of mRNA encoded by SLA, corresponding to a HOST TARGET binding site such as BINDING SITE I, BINDING SITE II or BINDING SITE III. Table 2 illustrates the complementarity of the nucleotide sequences of SLA BINDING SITE, designated SEQ ID:13595, to the nucleotide sequence of VGAM616 RNA, herein designated VGAM RNA, also designated SEQ ID:3327.

Another function of VGAM616 is therefore inhibition of Src-like-adaptor (SLA, Accession NM_006748), a gene which is a negative regulator of T-cell receptor signaling. Accordingly, utilities of VGAM616 include diagnosis, prevention and treatment of diseases and clinical conditions associated with SLA. The function of SLA and its association with various diseases and clinical conditions, has been established by previous studies, as described hereinabove with reference to VGAM383. ARHGAP10 (Accession NM_020824) is another VGAM616 host target gene. ARHGAP10 BINDING SITE is HOST TARGET binding site found in the 3' untranslated region of mRNA encoded by ARHGAP10, corresponding to a HOST TARGET binding site such as BINDING SITE I, BINDING SITE II or BINDING SITE III. Table 2 illustrates the complementarity of the nucleotide sequences of ARHGAP10 BINDING SITE, designated SEQ ID:21889, to the nucleotide sequence of VGAM616 RNA, herein designated VGAM RNA, also designated SEQ ID:3327.

Another function of VGAM616 is therefore inhibition of ARHGAP10 (Accession NM_020824). Accordingly, utilities of VGAM616 include diagnosis, prevention and treatment of diseases and clinical conditions associated with ARHGAP10. BCL2-associated Athanogene 5 (BAG5, Accession NM_004873) is another VGAM616 host target gene. BAG5 BINDING SITE is HOST TARGET binding site found in the 3' untranslated region of mRNA encoded by BAG5, corresponding to a HOST TARGET binding site such as BINDING SITE I, BINDING SITE II or BINDING SITE III. Table 2 illustrates the complementarity of the nucleotide sequences of BAG5 BINDING SITE, designated SEQ ID:11308, to the nucleotide sequence of VGAM616 RNA, herein designated VGAM RNA, also designated SEQ ID:3327.

Another function of VGAM616 is therefore inhibition of BCL2-associated Athanogene 5 (BAG5, Accession NM_004873). Accordingly, utilities of VGAM616 include diagnosis, prevention and treatment of diseases and clinical conditions associated with BAG5. Chromosome 20 Open Reading Frame 45 (C20orf45, Accession NM_016045) is another VGAM616 host target gene. C20orf45 BINDING SITE is HOST TARGET binding site found in the 3' untranslated region of mRNA encoded by C20orf45, corresponding to a HOST TARGET binding site such as BINDING SITE I, BINDING SITE II or BINDING SITE III. Table 2 illustrates the complementarity of the nucleotide sequences of C20orf45 BINDING SITE, designated SEQ ID:18123, to the nucleotide sequence of VGAM616 RNA, herein designated VGAM RNA, also designated SEQ ID:3327.

Another function of VGAM616 is therefore inhibition of Chromosome 20 Open Reading Frame 45 (C20orf45, Accession NM_016045). Accordingly, utilities of VGAM616 include diagnosis, prevention and treatment of diseases and clinical conditions associated with C20orf45. FLJ14437 (Accession NM_032578) is another VGAM616 host target gene. FLJ14437 BINDING SITE is HOST TARGET binding site found in the 3' untranslated region of mRNA encoded by FLJ14437, corresponding to a HOST TARGET binding site such as BINDING SITE I, BINDING SITE II or BINDING SITE III. Table 2 illustrates the complementarity of the nucleotide sequences of FLJ14437 BINDING SITE, designated SEQ ID:26311, to the nucleotide sequence of VGAM616 RNA, herein designated VGAM RNA, also designated SEQ ID:3327.

Another function of VGAM616 is therefore inhibition of FLJ14437 (Accession NM_032578). Accordingly, utilities of VGAM616 include diagnosis, prevention and treatment of diseases and clinical conditions associated with FLJ14437. FLJ20725 (Accession NM_017943) is another VGAM616 host target gene. FLJ20725 BINDING SITE is HOST TARGET binding site found in the 3' untranslated region of mRNA encoded by FLJ20725, corresponding to a HOST TARGET binding site such as BINDING SITE I, BINDING SITE II or BINDING SITE III. Table 2 illustrates the complementarity of the nucleotide sequences of FLJ20725 BINDING SITE, designated SEQ ID:19637, to the nucleotide sequence of VGAM616 RNA, herein designated VGAM RNA, also designated SEQ ID:3327.

Another function of VGAM616 is therefore inhibition of FLJ20725 (Accession NM_017943). Accordingly, utilities of VGAM616 include diagnosis, prevention and treatment of diseases and clinical conditions associated with FLJ20725. KIAA0350 (Accession XM_028332) is another VGAM616 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30667, to the nucleotide sequence of VGAM616 RNA, herein designated VGAM RNA, also designated SEQ ID:3327.

Another function of VGAM616 is therefore inhibition of KIAA0350 (Accession XM_028332). Accordingly, utilities of VGAM616 include diagnosis, prevention and treatment of diseases and clinical conditions associated with KIAA0350. KIAA0947 (Accession XM_029101) is another VGAM616 host target gene. KIAA0947 BINDING SITE is HOST TARGET binding site found in the 3' untranslated region of mRNA encoded by KIAA0947, corresponding to a HOST TARGET binding site such as BINDING SITE I, BINDING SITE II or BINDING SITE III. Table 2 illustrates the complementarity of the nucleotide sequences of KIAA0947 BINDING SITE, designated SEQ ID:30849, to the nucleotide sequence of VGAM616 RNA, herein designated VGAM RNA, also designated SEQ ID:3327.

Another function of VGAM616 is therefore inhibition of KIAA0947 (Accession XM_029101). Accordingly, utilities of VGAM616 include diagnosis, prevention and treatment of diseases and clinical conditions associated with KIAA0947. KIAA1322 (Accession XM_052626) is another VGAM616 host target gene. KIAA1322 BINDING SITE is HOST TARGET binding site found in the 3' untranslated region of mRNA encoded by KIAA1322, corresponding to a HOST TARGET binding site such as BINDING SITE I, BINDING SITE II or BINDING SITE III. Table 2 illustrates the complementarity of the nucleotide sequences of KIAA1322 BINDING SITE, designated SEQ ID:36026, to the nucleotide sequence of VGAM616 RNA, herein designated VGAM RNA, also designated SEQ ID:3327.

Another function of VGAM616 is therefore inhibition of KIAA1322 (Accession XM_052626). Accordingly, utilities of VGAM616 include diagnosis, prevention and treatment of diseases and clinical conditions associated with KIAA1322. KIAA1376 (Accession XM_033042) is another VGAM616 host target gene. KIAA1376 BINDING SITE is HOST TARGET binding site found in the 5' untranslated region of mRNA encoded by KIAA1376, corresponding to a HOST TARGET binding site such as BINDING SITE I, BINDING SITE II or BINDING SITE III. Table 2 illustrates the complementarity of the nucleotide sequences of KIAA1376 BINDING SITE, designated SEQ ID:31824, to the nucleotide sequence of VGAM616 RNA, herein designated VGAM RNA, also designated SEQ ID:3327.

Another function of VGAM616 is therefore inhibition of KIAA1376 (Accession XM_033042). Accordingly, utilities of VGAM616 include diagnosis, prevention and treatment of diseases and clinical conditions associated with KIAA1376. KIAA1870 (Accession NM_032161) is another VGAM616 host target gene. KIAA1870 BINDING SITE is HOST TARGET binding site found in the 3' untranslated region of mRNA encoded by KIAA1870, corresponding to a HOST TARGET binding site such as BINDING SITE I, BINDING SITE II or BINDING SITE III. Table 2 illustrates the complementarity of the nucleotide sequences of KIAA1870 BINDING SITE, designated SEQ ID:25862, to the nucleotide sequence of VGAM616 RNA, herein designated VGAM RNA, also designated SEQ ID:3327.

Another function of VGAM616 is therefore inhibition of KIAA1870 (Accession NM_032161). Accordingly, utilities of VGAM616 include diagnosis, prevention and treatment of diseases and clinical conditions associated with KIAA1870. MBLL39 (Accession NM_144778) is another VGAM616 host target gene. MBLL39 BINDING SITE is HOST TARGET binding site found in the 3' untranslated region of mRNA encoded by MBLL39, corresponding to a HOST TARGET binding site such as BINDING SITE I, BINDING SITE II or BINDING SITE III. Table 2 illustrates the complementarity of the nucleotide sequences of MBLL39 BINDING SITE, designated SEQ ID:29569, to the nucleotide sequence of VGAM616 RNA, herein designated VGAM RNA, also designated SEQ ID:3327.

Another function of VGAM616 is therefore inhibition of MBLL39 (Accession NM_144778). Accordingly, utilities of VGAM616 include diagnosis, prevention and treatment of diseases and clinical conditions associated with MBLL39. SCYB10 (Accession NM_001565) is another VGAM616 host target gene. SCYB10 BINDING SITE is HOST TARGET binding site found in the 3' untranslated region of mRNA encoded by SCYB10, corresponding to a HOST TARGET binding site such as BINDING SITE I, BINDING SITE II or BINDING SITE III. Table 2 illustrates the complementarity of the nucleotide sequences of SCYB10 BINDING SITE, designated SEQ ID:7294, to the nucleotide sequence of VGAM616 RNA, herein designated VGAM RNA, also designated SEQ ID:3327.

Another function of VGAM616 is therefore inhibition of SCYB10 (Accession NM_001565). Accordingly, utilities of VGAM616 include diagnosis, prevention and treatment of diseases and clinical conditions associated with SCYB10. LOC151877 (Accession XM_098132) is another VGAM616 host target gene. LOC151877 BINDING SITE is HOST TARGET binding site found in the 3' untranslated region of mRNA encoded by LOC151877, corresponding to a HOST TARGET binding site such as BINDING SITE I, BINDING SITE II or BINDING SITE III. Table 2 illustrates the complementarity of the nucleotide sequences of LOC151877 BINDING SITE, designated SEQ ID:41396, to the nucleotide sequence of VGAM616 RNA, herein designated VGAM RNA, also designated SEQ ID:3327.

Another function of VGAM616 is therefore inhibition of LOC151877 (Accession XM_098132). Accordingly, utilities of VGAM616 include diagnosis, prevention and treatment of diseases and clinical conditions associated with LOC151877. FIG. 1 further provides a conceptual description of a novel bioinformatically detected viral gene of the present invention, referred to here as Viral Genomic Address Messenger 617 (VGAM617) viral gene, which modulates expression of respective host target genes thereof, the function and utility of which host target genes is known in the art.

VGAM617 is a novel bioinformatically detected regulatory, non protein coding, viral micro RNA (miRNA) gene. The method by which VGAM617 was detected is described hereinabove with reference to FIGS. 1-8.

VGAM617 gene, herein designated VGAM GENE, is a viral gene contained in the genome of Xestia C-nigrum Granulovirus. VGAM617 host target gene, herein designated VGAM HOST TARGET GENE, is a human gene contained in the human genome.

VGAM617 gene encodes a VGAM617 precursor RNA, herein designated VGAM PRECURSOR RNA. Similar to other miRNA genes, and unlike most ordinary genes, VGAM617 precursor RNA does not encode a protein. A nucleotide sequence identical or highly similar to the nucleotide sequence of VGAM617 precursor RNA is designated SEQ ID:603, and is provided hereinbelow with reference to the sequence listing part. Nucleotide sequence SEQ ID:603 is located at position 140057 relative to the genome of Xestia C-nigrum Granulovirus.

VGAM617 precursor RNA folds onto itself, forming VGAM617 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or a partial inversed-reversed sequence of the nucleotide sequence of the second half thereof.

An enzyme complex designated DICER COMPLEX, 'dices' the VGAM617 folded precursor RNA into VGAM617 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM617 RNA is designated SEQ ID:3328, and is provided hereinbelow with reference to the sequence listing part.

VGAM617 host target gene, herein designated VGAM HOST TARGET GENE, encodes a corresponding messenger RNA, VGAM617 host target RNA, herein designated VGAM HOST TARGET RNA. VGAM617 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM617 RNA, herein designated VGAM RNA, binds complementarily to one or more host target binding sites located in untranslated regions of VGAM617 host target RNA, herein designated VGAM HOST TARGET RNA. This complementary binding is due to the fact that the nucleotide sequence of VGAM617 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM617 RNA, herein designated VGAM RNA, may have a different number of host target binding sites in untranslated regions of a VGAM617 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM617 RNA, herein designated VGAM RNA, to host target binding sites on VGAM617 host target RNA, herein designated VGAM HOST TARGET RNA, such as BINDING SITE I, BINDING SITE II and BINDING SITE III, inhibits translation of VGAM617 host target RNA into VGAM617 host target protein, herein designated VGAM HOST TARGET PROTEIN. VGAM host target protein is therefore outlined by a broken line.

It is appreciated that VGAM617 host target gene, herein designated VGAM HOST TARGET GENE, in fact represents a plurality of VGAM617 host target genes. The mRNA of each one of this plurality of VGAM617 host target genes comprises one or more host target binding sites, each having a nucleotide sequence which is at least partly complementary to VGAM617 RNA, herein designated VGAM RNA, and which when bound by VGAM617 RNA causes inhibition of translation of respective one or more VGAM617 host target proteins.

It is further appreciated by one skilled in the art that the mode of translational inhibition illustrated by FIG. 1 with specific reference to translational inhibition exerted by VGAM617 gene, herein designated VGAM GENE, on one or more VGAM617 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM617 is inhibition of expression of host target genes, as part of a novel viral mechanism of attacking a host. Accordingly, utilities of VGAM617 include diagnosis, prevention and treatment of viral infection by Xestia C-nigrum Granulovirus. Specific functions, and accordingly utilities, of VGAM617 correlate with, and may be deduced from, the identity of the host target genes which VGAM617 binds and inhibits, and the function of these host target genes, as elaborated hereinbelow.

Nucleotide sequences of the VGAM617 precursor RNA, herein designated VGAM PRECURSOR RNA, and of the 'diced' VGAM617 RNA, herein designated VGAM RNA, and a schematic representation of the secondary folding of VGAM617 folded precursor RNA, herein designated VGAM FOLDED PRECURSOR RNA, of VGAM617 are further described hereinbelow with reference to Table 1.

Nucleotide sequences of host target binding sites, such as BINDING SITE-I, BINDING SITE-II and BINDING SITE-III of FIG. 1, found on VGAM617 host target RNA, and schematic representation of the complementarity of each of these host target binding sites to VGAM617 RNA, herein designated VGAM RNA, are described hereinbelow with reference to Table 2.

As mentioned hereinabove with reference to FIG. 1, a function of VGAM617 gene, herein designated VGAM is inhibition of expression of VGAM617 target genes. It is appreciated that specific functions, and accordingly utilities, of VGAM617 correlate with, and may be deduced from, the identity of the target genes which VGAM617 binds and inhibits, and the function of these target genes, as elaborated hereinbelow.

LOC154442 (Accession XM_098536) is a VGAM617 host target gene. LOC154442 BINDING SITE is HOST TARGET binding site found in the 3' untranslated region of mRNA encoded by LOC154442, corresponding to a HOST TARGET binding site such as BINDING SITE I, BINDING SITE II or BINDING SITE III. Table 2 illustrates the complementarity of the nucleotide sequences of LOC154442 BINDING SITE, designated SEQ ID:41706, to the nucleotide sequence of VGAM617 RNA, herein designated VGAM RNA, also designated SEQ ID:3328.

A function of VGAM617 is therefore inhibition of LOC154442 (Accession XM_098536). Accordingly, utilities of VGAM617 include diagnosis, prevention and treatment of diseases and clinical conditions associated with LOC154442.

LOC51279 (Accession NM_016546) is another VGAM617 host target gene. LOC51279 BINDING SITE is HOST TARGET binding site found in the 3' untranslated region of mRNA encoded by LOC51279, corresponding to a HOST TARGET binding site such as BINDING SITE I, BINDING SITE II or BINDING SITE III. Table 2 illustrates the complementarity of the nucleotide sequences of LOC51279 BINDING SITE, designated SEQ ID:18613, to the nucleotide sequence of VGAM617 RNA, herein designated VGAM RNA, also designated SEQ ID:3328.

Another function of VGAM617 is therefore inhibition of LOC51279 (Accession NM_016546). Accordingly, utilities of VGAM617 include diagnosis, prevention and treatment of diseases and clinical conditions associated with LOC51279.

LOC51336 (Accession NM_016646) is another VGAM617 host target gene. LOC51336 BINDING SITE is HOST TARGET binding site found in the 3' untranslated region of mRNA encoded by LOC51336, corresponding to a HOST TARGET binding site such as BINDING SITE I, BINDING SITE II or BINDING SITE III. Table 2 illustrates the complementarity of the nucleotide sequences of LOC51336 BINDING SITE, designated SEQ ID:18760, to the nucleotide sequence of VGAM617 RNA, herein designated VGAM RNA, also designated SEQ ID:3328.

Another function of VGAM617 is therefore inhibition of LOC51336 (Accession NM_016646). Accordingly, utilities of VGAM617 include diagnosis, prevention and treatment of diseases and clinical conditions associated with LOC51336.

FIG. 1 further provides a conceptual description of a novel bioinformatically detected viral gene of the present invention, referred to here as Viral Genomic Address Messenger 618 (VGAM618) viral gene, which modulates expression of respective host target genes thereof, the function and utility of which host target genes is known in the art.

VGAM618 is a novel bioinformatically detected regulatory, non protein coding, viral micro RNA (miRNA) gene. The method by which VGAM618 was detected is described hereinabove with reference to FIGS. 1-8.

VGAM618 gene, herein designated VGAM GENE, is a viral gene contained in the genome of Rabbit Oral Papillomavirus. VGAM618 host target gene, herein designated VGAM HOST TARGET GENE, is a human gene contained in the human genome.

VGAM618 gene encodes a VGAM618 precursor RNA, herein designated VGAM PRECURSOR RNA. Similar to other miRNA genes, and unlike most ordinary genes, VGAM618 precursor RNA does not encode a protein. A nucleotide sequence identical or highly similar to the nucleotide sequence of VGAM618 precursor RNA is designated SEQ ID:604, and is provided hereinbelow with reference to the sequence listing part. Nucleotide sequence SEQ ID:604 is located at position 4111 relative to the genome of Rabbit Oral Papillomavirus.

VGAM618 precursor RNA folds onto itself, forming VGAM618 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM618 folded precursor RNA into VGAM618 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM618 RNA is designated SEQ ID:3329, and is provided hereinbelow with reference to the sequence listing part.

VGAM618 host target gene, herein designated VGAM HOST TARGET GENE, encodes a corresponding messenger RNA, VGAM618 host target RNA, herein designated VGAM HOST TARGET RNA. VGAM618 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM618 RNA, herein designated VGAM RNA, binds complementarily to one or more host target binding sites located in untranslated regions of VGAM618 host target RNA, herein designated VGAM HOST TARGET RNA. This complementary binding is due to the fact that the nucleotide sequence of VGAM618 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM618 RNA, herein designated VGAM RNA, may have a different number of host target binding sites in untranslated regions of a VGAM618 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM618 RNA, herein designated VGAM RNA, to host target binding sites on VGAM618 host target RNA, herein designated VGAM HOST TARGET RNA, such as BINDING SITE I, BINDING SITE II and BINDING SITE III, inhibits translation of VGAM618 host target RNA into VGAM618 host target protein, herein designated VGAM HOST TARGET PROTEIN. VGAM host target protein is therefore outlined by a broken line.

It is appreciated that VGAM618 host target gene, herein designated VGAM HOST TARGET GENE, in fact represents a plurality of VGAM618 host target genes. The mRNA of each one of this plurality of VGAM618 host target genes comprises one or more host target binding sites, each having a nucleotide sequence which is at least partly complementary to VGAM618 RNA, herein designated VGAM RNA, and which when bound by VGAM618 RNA causes inhibition of translation of respective one or more VGAM618 host target proteins.

It is further appreciated by one skilled in the art that the mode of translational inhibition illustrated by FIG. 1 with specific reference to translational inhibition exerted by VGAM618 gene, herein designated VGAM GENE, on one or more VGAM618 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM618 is inhibition of expression of host target genes, as part of a novel viral mechanism of attacking a host. Accordingly, utilities of VGAM618 include diagnosis, prevention and treatment of viral infection by Rabbit Oral Papillomavirus. Specific functions, and accordingly utilities, of VGAM618 correlate with, and may be deduced from, the identity of the host target genes which VGAM618 binds and inhibits, and the function of these host target genes, as elaborated hereinbelow.

Nucleotide sequences of the VGAM618 precursor RNA, herein designated VGAM PRECURSOR RNA, and of the 'diced' VGAM618 RNA, herein designated VGAM RNA, and a schematic representation of the secondary folding of VGAM618 folded precursor RNA, herein designated VGAM FOLDED PRECURSOR RNA, of VGAM618 are further described hereinbelow with reference to Table 1.

Nucleotide sequences of host target binding sites, such as BINDING SITE-I, BINDING SITE-II and BINDING SITE-III of FIG. 1, found on VGAM618 host target RNA, and schematic representation of the complementarity of each of these host target binding sites to VGAM618 RNA, herein designated VGAM RNA, are described hereinbelow with reference to Table 2.

As mentioned hereinabove with reference to FIG. 1, a function of VGAM618 gene, herein designated VGAM is inhibition of expression of VGAM618 target genes. It is appreciated that specific functions, and accordingly utilities, of VGAM618 correlate with, and may be deduced from, the identity of the target genes which VGAM618 binds and inhibits, and the function of these target genes, as elaborated hereinbelow.

UDP-Gal:betaGlcNAc Beta 1,4-Galactosyltransferase, Polypeptide 4 (B4GALT4, Accession NM_003778) is a VGAM618 host target gene. B4GALT4 BINDING SITE is HOST TARGET binding site found in the 3' untranslated region of mRNA encoded by B4GALT4, corresponding to a HOST TARGET binding site such as BINDING SITE I, BINDING SITE II or BINDING SITE III. Table 2 illustrates the complementarity of the nucleotide sequences of B4GALT4 BINDING SITE, designated SEQ ID:9857, to the nucleotide sequence of VGAM618 RNA, herein designated VGAM RNA, also designated SEQ ID:3329.

A function of VGAM618 is therefore inhibition of UDP-Gal:betaGlcNAc Beta 1,4-Galactosyltransferase, Polypeptide 4 (B4GALT4, Accession NM_003778). Accordingly, utilities of VGAM618 include diagnosis, prevention and treatment of diseases and clinical conditions associated with B4GALT4. Macrophage Scavenger Receptor 1 (MSR1, Accession NM_002445) is another VGAM618 host target gene. MSR1 BINDING SITE is HOST TARGET binding site found in the 3' untranslated region of mRNA encoded by MSR1, corresponding to a HOST TARGET binding site such as BINDING SITE I, BINDING SITE II or BINDING SITE III. Table 2 illustrates the complementarity of the nucleotide sequences of MSR1 BINDING SITE, designated SEQ ID:8284, to the nucleotide sequence of VGAM618 RNA, herein designated VGAM RNA, also designated SEQ ID:3329.

Another function of VGAM618 is therefore inhibition of Macrophage Scavenger Receptor 1 (MSR1, Accession NM_002445), a gene which plays a role in endocytosis of macromolecules. Accordingly, utilities of VGAM618 include diagnosis, prevention and treatment of diseases and clinical conditions associated with MSR1. The function of MSR1 and its association with various diseases and clinical conditions, has been established by previous studies, as described hereinabove with reference to VGAM176. Solute Carrier Family 12, (potassium-chloride transporter) Member 5 (SLC12A5, Accession NM_020708) is another VGAM618 host target gene. SLC12A5 BINDING SITE is HOST TARGET binding site found in the 3' untranslated region of mRNA encoded by SLC12A5, corresponding to a HOST TARGET binding site such as BINDING SITE I, BINDING SITE II or BINDING SITE III. Table 2 illustrates the complementarity of the nucleotide sequences of SLC12A5 BINDING SITE, designated SEQ ID:21854, to the nucleotide sequence of VGAM618 RNA, herein designated VGAM RNA, also designated SEQ ID:3329.

Another function of VGAM618 is therefore inhibition of Solute Carrier Family 12, (potassium-chloride transporter) Member 5 (SLC12A5, Accession NM_020708). Accordingly, utilities of VGAM618 include diagnosis, prevention and treatment of diseases and clinical conditions associated with SLC12A5. FIG. 1 further provides a conceptual description of a novel bioinformatically detected viral gene of the present invention, referred to here as Viral Genomic Address Messenger 619 (VGAM619) viral gene, which modulates expression of respective host target genes thereof, the function and utility of which host target genes is known in the art.

VGAM619 is a novel bioinformatically detected regulatory, non protein coding, viral micro RNA (miRNA) gene. The method by which VGAM619 was detected is described hereinabove with reference to FIGS. 1-8.

VGAM619 gene, herein designated VGAM GENE, is a viral gene contained in the genome of Hepatitis GB Virus C. VGAM619 host target gene, herein designated VGAM HOST TARGET GENE, is a human gene contained in the human genome.

VGAM619 gene encodes a VGAM619 precursor RNA, herein designated VGAM PRECURSOR RNA. Similar to other miRNA genes, and unlike most ordinary genes, VGAM619 precursor RNA does not encode a protein. A nucleotide sequence identical or highly similar to the nucleotide sequence of VGAM619 precursor RNA is designated SEQ ID:605, and is provided hereinbelow with reference to the sequence listing part. Nucleotide sequence SEQ ID:605 is located at position 8778 relative to the genome of Hepatitis GB Virus C.

VGAM619 precursor RNA folds onto itself, forming VGAM619 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM619 folded precursor RNA into VGAM619 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM619 RNA is designated SEQ ID:3330, and is provided hereinbelow with reference to the sequence listing part.

VGAM619 host target gene, herein designated VGAM HOST TARGET GENE, encodes a corresponding messenger RNA, VGAM619 host target RNA, herein designated VGAM HOST TARGET RNA. VGAM619 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM619 RNA, herein designated VGAM RNA, binds complementarily to one or more host target binding sites located in untranslated regions of VGAM619 host target RNA, herein designated VGAM HOST TARGET RNA. This complementary binding is due to the fact that the nucleotide sequence of VGAM619 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM619 RNA, herein designated VGAM RNA, may have a different number of host target binding sites in untranslated regions of a VGAM619 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM619 RNA, herein designated VGAM RNA, to host target binding sites on VGAM619 host target RNA, herein designated VGAM HOST TARGET RNA, such as BINDING SITE I, BINDING SITE II and BINDING SITE III, inhibits translation of VGAM619 host target RNA into VGAM619 host target protein, herein designated VGAM HOST TARGET PROTEIN. VGAM host target protein is therefore outlined by a broken line.

It is appreciated that VGAM619 host target gene, herein designated VGAM HOST TARGET GENE, in fact represents a plurality of VGAM619 host target genes. The mRNA of each one of this plurality of VGAM619 host target genes comprises one or more host target binding sites, each having a nucleotide sequence which is at least partly complementary to VGAM619 RNA, herein designated VGAM RNA, and which when bound by VGAM619 RNA causes inhibition of translation of respective one or more VGAM619 host target proteins.

It is further appreciated by one skilled in the art that the mode of translational inhibition illustrated by FIG. 1 with specific reference to translational inhibition exerted by VGAM619 gene, herein designated VGAM GENE, on one or more VGAM619 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM619 is inhibition of expression of host target genes, as part of a novel viral mechanism of attacking a host. Accordingly, utilities of VGAM619 include diagnosis, prevention and treatment of viral infection by Hepatitis GB Virus C. Specific functions, and accordingly utilities, of VGAM619 correlate with, and may be deduced from, the identity of the host target genes which VGAM619 binds and inhibits, and the function of these host target genes, as elaborated hereinbelow.

Nucleotide sequences of the VGAM619 precursor RNA, herein designated VGAM PRECURSOR RNA, and of the 'diced' VGAM619 RNA, herein designated VGAM RNA, and a schematic representation of the secondary folding of VGAM619 folded precursor RNA, herein designated VGAM FOLDED PRECURSOR RNA, of VGAM619 are further described hereinbelow with reference to Table 1.

Nucleotide sequences of host target binding sites, such as BINDING SITE-I, BINDING SITE-II and BINDING SITE-III of FIG. 1, found on VGAM619 host target RNA, and schematic representation of the complementarity of each of these host target binding sites to VGAM619 RNA, herein designated VGAM RNA, are described hereinbelow with reference to Table 2.

As mentioned hereinabove with reference to FIG. 1, a function of VGAM619 gene, herein designated VGAM is inhibition of expression of VGAM619 target genes. It is appreciated that specific functions, and accordingly utilities, of VGAM619 correlate with, and may be deduced from, the identity of the target genes which VGAM619 binds and inhibits, and the function of these target genes, as elaborated hereinbelow.

Solute Carrier Family 21 (organic anion transporter), Member 11 (SLC21A11, Accession XM_035268) is a VGAM619 host target gene. SLC21A11 BINDING SITE is HOST TARGET binding site found in the 5' untranslated region of mRNA encoded by SLC21A11, corresponding to a HOST TARGET binding site such as BINDING SITE I, BINDING SITE II or BINDING SITE III. Table 2 illustrates the complementarity of the nucleotide sequences of SLC21A11 BINDING SITE, designated SEQ ID:32207, to the nucleotide sequence of VGAM619 RNA, herein designated VGAM RNA, also designated SEQ ID:3330.

A function of VGAM619 is therefore inhibition of Solute Carrier Family 21 (organic anion transporter), Member 11 (SLC21A11, Accession XM_035268). Accordingly, utilities of VGAM619 include diagnosis, prevention and treatment of diseases and clinical conditions associated with SLC21A11. LOC151429 (Accession XM_098059) is another VGAM619 host target gene. LOC151429 BINDING SITE is HOST TARGET binding site found in the 3' untranslated region of mRNA encoded by LOC151429, corresponding to a HOST TARGET binding site such as BINDING SITE I, BINDING SITE II or BINDING SITE III. Table 2 illustrates the complementarity of the nucleotide sequences of LOC151429 BINDING SITE, designated SEQ ID:41341, to the nucleotide sequence of VGAM619 RNA, herein designated VGAM RNA, also designated SEQ ID:3330.

Another function of VGAM619 is therefore inhibition of LOC151429 (Accession XM_098059). Accordingly, utilities of VGAM619 include diagnosis, prevention and treatment of diseases and clinical conditions associated with LOC151429. LOC153572 (Accession XM_098392) is another VGAM619 host target gene. LOC153572 BINDING SITE is HOST TARGET binding site found in the 5' untranslated region of mRNA encoded by LOC153572, corresponding to a HOST TARGET binding site such as BINDING SITE I, BINDING SITE II or BINDING SITE III. Table 2 illustrates the complementarity of the nucleotide sequences of LOC153572 BINDING SITE, designated SEQ ID:41639, to the nucleotide sequence of VGAM619 RNA, herein designated VGAM RNA, also designated SEQ ID:3330.

Another function of VGAM619 is therefore inhibition of LOC153572 (Accession XM_098392). Accordingly, utilities of VGAM619 include diagnosis, prevention and treatment of diseases and clinical conditions associated with LOC153572. LOC155340 (Accession XM_055725) is another VGAM619 host target gene. LOC155340 BINDING SITE is HOST TARGET binding site found in the 5' untranslated region of mRNA encoded by LOC155340, corresponding to a HOST TARGET binding site such as BINDING SITE I, BINDING SITE II or BINDING SITE III. Table 2 illustrates the complementarity of the nucleotide sequences of LOC155340 BINDING SITE, designated SEQ ID:36318, to the nucleotide sequence of VGAM619 RNA, herein designated VGAM RNA, also designated SEQ ID:3330.

Another function of VGAM619 is therefore inhibition of LOC155340 (Accession XM_055725). Accordingly, utilities of VGAM619 include diagnosis, prevention and treatment of diseases and clinical conditions associated with LOC155340. LOC93052 (Accession XM_048905) is another VGAM619 host target gene. LOC93052 BINDING SITE is HOST TARGET binding site found in the 5' untranslated region of mRNA encoded by LOC93052, corresponding to a HOST TARGET binding site such as BINDING SITE I, BINDING SITE II or BINDING SITE III. Table 2 illustrates the complementarity of the nucleotide sequences of LOC93052 BINDING SITE, designated SEQ ID:35302, to the nucleotide sequence of VGAM619 RNA, herein designated VGAM RNA, also designated SEQ ID:3330.

Another function of VGAM619 is therefore inhibition of LOC93052 (Accession XM_048905). Accordingly, utilities of VGAM619 include diagnosis, prevention and treatment of diseases and clinical conditions associated with LOC93052. FIG. 1 further provides a conceptual description of a novel bioinformatically detected viral gene of the present invention, referred to here as Viral Genomic Address Messenger 620 (VGAM620) viral gene, which modulates expression of respective host target genes thereof, the function and utility of which host target genes is known in the art.

VGAM620 is a novel bioinformatically detected regulatory, non protein coding, viral micro RNA (miRNA) gene. The method by which VGAM620 was detected is described hereinabove with reference to FIGS. 1-8.

VGAM620 gene, herein designated VGAM GENE, is a viral gene contained in the genome of Hepatitis GB Virus C. VGAM620 host target gene, herein designated VGAM HOST TARGET GENE, is a human gene contained in the human genome.

VGAM620 gene encodes a VGAM620 precursor RNA, herein designated VGAM PRECURSOR RNA. Similar to other miRNA genes, and unlike most ordinary genes, VGAM620 precursor RNA does not encode a protein. A nucleotide sequence identical or highly similar to the nucleotide sequence of VGAM620 precursor RNA is designated SEQ ID:606, and is provided hereinbelow with reference to the sequence listing part. Nucleotide sequence SEQ ID:606 is located at position 3307 relative to the genome of Hepatitis GB Virus C.

VGAM620 precursor RNA folds onto itself, forming VGAM620 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM620 folded precursor RNA into VGAM620 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM620 RNA is designated SEQ ID:3331, and is provided hereinbelow with reference to the sequence listing part.

VGAM620 host target gene, herein designated VGAM HOST TARGET GENE, encodes a corresponding messenger RNA, VGAM620 host target RNA, herein designated VGAM HOST TARGET RNA. VGAM620 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM620 RNA, herein designated VGAM RNA, binds complementarily to one or more host target binding sites located in untranslated regions of VGAM620 host target RNA, herein designated VGAM HOST TARGET RNA. This complementary binding is due to the fact that the nucleotide sequence of VGAM620 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM620 RNA, herein designated VGAM RNA, may have a different number of host target binding sites in untranslated regions of a VGAM620 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM620 RNA, herein designated VGAM RNA, to host target binding sites on VGAM620 host target RNA, herein designated VGAM HOST TARGET RNA, such as BINDING SITE I, BINDING SITE II and BINDING SITE III, inhibits translation of VGAM620 host target RNA into VGAM620 host target protein, herein designated VGAM HOST TARGET PROTEIN. VGAM host target protein is therefore outlined by a broken line.

It is appreciated that VGAM620 host target gene, herein designated VGAM HOST TARGET GENE, in fact represents a plurality of VGAM620 host target genes. The mRNA of each one of this plurality of VGAM620 host target genes comprises one or more host target binding sites, each having a nucleotide sequence which is at least partly complementary to VGAM620 RNA, herein designated VGAM RNA, and which when bound by VGAM620 RNA causes inhibition of translation of respective one or more VGAM620 host target proteins.

It is further appreciated by one skilled in the art that the mode of translational inhibition illustrated by FIG. 1 with specific reference to translational inhibition exerted by VGAM620 gene, herein designated VGAM GENE, on one or more VGAM620 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM620 is inhibition of expression of host target genes, as part of a novel viral mechanism of attacking a host. Accordingly, utilities of VGAM620 include diagnosis, prevention and treatment of viral infection by Hepatitis GB Virus C. Specific functions, and accordingly utilities, of VGAM620 correlate with, and may be deduced from, the identity of the host target genes which VGAM620 binds and inhibits, and the function of these host target genes, as elaborated hereinbelow.

Nucleotide sequences of the VGAM620 precursor RNA, herein designated VGAM PRECURSOR RNA, and of the 'diced' VGAM620 RNA, herein designated VGAM RNA, and a schematic representation of the secondary folding of VGAM620 folded precursor RNA, herein designated VGAM FOLDED PRECURSOR RNA, of VGAM620 are further described hereinbelow with reference to Table 1.

Nucleotide sequences of host target binding sites, such as BINDING SITE-I, BINDING SITE-II and BINDING SITE-III of FIG. 1, found on VGAM620 host target RNA, and schematic representation of the complementarity of each of these host target binding sites to VGAM620 RNA, herein designated VGAM RNA, are described hereinbelow with reference to Table 2.

As mentioned hereinabove with reference to FIG. 1, a function of VGAM620 gene, herein designated VGAM is inhibition of expression of VGAM620 target genes. It is appreciated that specific functions, and accordingly utilities, of VGAM620 correlate with, and may be deduced from, the identity of the target genes which VGAM620 binds and inhibits, and the function of these target genes, as elaborated hereinbelow.

FLJ10781 (Accession NM_018215) is a VGAM620 host target gene. FLJ10781 BINDING SITE is HOST TARGET binding site found in the 3' untranslated region of mRNA encoded by FLJ10781, corresponding to a HOST TARGET binding site such as BINDING SITE I, BINDING SITE II or BINDING SITE III. Table 2 illustrates the complementarity of the nucleotide sequences of FLJ10781 BINDING SITE, designated SEQ ID:20136, to the nucleotide sequence of VGAM620 RNA, herein designated VGAM RNA, also designated SEQ ID:3331.

A function of VGAM620 is therefore inhibition of FLJ10781 (Accession NM_018215). Accordingly, utilities of VGAM620 include diagnosis, prevention and treatment of diseases and clinical conditions associated with FLJ10781. KIAA0182 (Accession XM_050495) is another VGAM620 host target gene. KIAA0182 BINDING SITE is HOST TARGET binding site found in the 3' untranslated region of mRNA encoded by KIAA0182, corresponding to a HOST TARGET binding site such as BINDING SITE I, BINDING SITE II or BINDING SITE III. Table 2 illustrates the complementarity of the nucleotide sequences of KIAA0182 BINDING SITE, designated SEQ ID:35647, to the nucleotide sequence of VGAM620 RNA, herein designated VGAM RNA, also designated SEQ ID:3331.

Another function of VGAM620 is therefore inhibition of KIAA0182 (Accession XM_050495). Accordingly, utilities of VGAM620 include diagnosis, prevention and treatment of diseases and clinical conditions associated with KIAA0182. LOC151610 (Accession XM_087245) is another VGAM620 host target gene. LOC151610 BINDING SITE is HOST TARGET binding site found in the 3' untranslated region of mRNA encoded by LOC151610, corresponding to a HOST TARGET binding site such as BINDING SITE I, BINDING SITE II or BINDING SITE III. Table 2 illustrates the complementarity of the nucleotide sequences of LOC151610 BINDING SITE, designated SEQ ID:39135, to the nucleotide sequence of VGAM620 RNA, herein designated VGAM RNA, also designated SEQ ID:3331.

Another function of VGAM620 is therefore inhibition of LOC151610 (Accession XM_087245). Accordingly, utilities of VGAM620 include diagnosis, prevention and treatment of diseases and clinical conditions associated with LOC151610. LOC157958 (Accession XM_088431) is another VGAM620 host target gene. LOC157958 BINDING SITE is HOST TARGET binding site found in the 3' untranslated region of mRNA encoded by LOC157958, corresponding to a HOST TARGET binding site such as BINDING SITE I, BINDING SITE II or BINDING SITE III. Table 2 illustrates the complementarity of the nucleotide sequences of LOC157958 BINDING SITE, designated SEQ ID:39685, to the nucleotide sequence of VGAM620 RNA, herein designated VGAM RNA, also designated SEQ ID:3331.

Another function of VGAM620 is therefore inhibition of LOC157958 (Accession XM_088431). Accordingly, utilities of VGAM620 include diagnosis, prevention and treatment of diseases and clinical conditions associated with LOC157958. FIG. 1 further provides a conceptual description of a novel bioinformatically detected viral gene of the present invention, referred to here as Viral Genomic Address Messenger 621 (VGAM621) viral gene, which modulates expression of respective host target genes thereof, the function and utility of which host target genes is known in the art.

VGAM621 is a novel bioinformatically detected regulatory, non protein coding, viral micro RNA (miRNA) gene.

The method by which VGAM621 was detected is described hereinabove with reference to FIGS. 1-8.

VGAM621 gene, herein designated VGAM GENE, is a viral gene contained in the genome of Hepatitis GB Virus C. VGAM621 host target gene, herein designated VGAM HOST TARGET GENE, is a human gene contained in the human genome.

VGAM621 gene encodes a VGAM621 precursor RNA, herein designated VGAM PRECURSOR RNA. Similar to other miRNA genes, and unlike most ordinary genes, VGAM621 precursor RNA does not encode a protein. A nucleotide sequence identical or highly similar to the nucleotide sequence of VGAM621 precursor RNA is designated SEQ ID:607, and is provided hereinbelow with reference to the sequence listing part. Nucleotide sequence SEQ ID:607 is located at position 757 relative to the genome of Hepatitis GB Virus C.

VGAM621 precursor RNA folds onto itself, forming VGAM621 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM621 folded precursor RNA into VGAM621 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM621 RNA is designated SEQ ID:3332, and is provided hereinbelow with reference to the sequence listing part.

VGAM621 host target gene, herein designated VGAM HOST TARGET GENE, encodes a corresponding messenger RNA, VGAM621 host target RNA, herein designated VGAM HOST TARGET RNA. VGAM621 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM621 RNA, herein designated VGAM RNA, binds complementarily to one or more host target binding sites located in untranslated regions of VGAM621 host target RNA, herein designated VGAM HOST TARGET RNA. This complementary binding is due to the fact that the nucleotide sequence of VGAM621 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM621 RNA, herein designated VGAM RNA, may have a different number of host target binding sites in untranslated regions of a VGAM621 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM621 RNA, herein designated VGAM RNA, to host target binding sites on VGAM621 host target RNA, herein designated VGAM HOST TARGET RNA, such as BINDING SITE I, BINDING SITE II and BINDING SITE III, inhibits translation of VGAM621 host target RNA into VGAM621 host target protein, herein designated VGAM HOST TARGET PROTEIN. VGAM host target protein is therefore outlined by a broken line.

It is appreciated that VGAM621 host target gene, herein designated VGAM HOST TARGET GENE, in fact represents a plurality of VGAM621 host target genes. The mRNA of each one of this plurality of VGAM621 host target genes comprises one or more host target binding sites, each having a nucleotide sequence which is at least partly complementary to VGAM621 RNA, herein designated VGAM RNA, and which when bound by VGAM621 RNA causes inhibition of translation of respective one or more VGAM621 host target proteins.

It is further appreciated by one skilled in the art that the mode of translational inhibition illustrated by FIG. 1 with specific reference to translational inhibition exerted by VGAM621 gene, herein designated VGAM GENE, on one or more VGAM621 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM621 is inhibition of expression of host target genes, as part of a novel viral mechanism of attacking a host. Accordingly, utilities of VGAM621 include diagnosis, prevention and treatment of viral infection by Hepatitis GB Virus C. Specific functions, and accordingly utilities, of VGAM621 correlate with, and may be deduced from, the identity of the host target genes which VGAM621 binds and inhibits, and the function of these host target genes, as elaborated hereinbelow.

Nucleotide sequences of the VGAM621 precursor RNA, herein designated VGAM PRECURSOR RNA, and of the 'diced' VGAM621 RNA, herein designated VGAM RNA, and a schematic representation of the secondary folding of VGAM621 folded precursor RNA, herein designated VGAM FOLDED PRECURSOR RNA, of VGAM621 are further described hereinbelow with reference to Table 1.

Nucleotide sequences of host target binding sites, such as BINDING SITE-I, BINDING SITE-II and BINDING SITE-III of FIG. 1, found on VGAM621 host target RNA, and schematic representation of the complementarity of each of these host target binding sites to VGAM621 RNA, herein designated VGAM RNA, are described hereinbelow with reference to Table 2.

As mentioned hereinabove with reference to FIG. 1, a function of VGAM621 gene, herein designated VGAM is inhibition of expression of VGAM621 target genes. It is appreciated that specific functions, and accordingly utilities, of VGAM621 correlate with, and may be deduced from, the identity of the target genes which VGAM621 binds and inhibits, and the function of these target genes, as elaborated hereinbelow.

poly (A) Binding Protein, Cytoplasmic 1 (PABPC1, Accession NM_002568) is a VGAM621 host target gene. PABPC1 BINDING SITE is HOST TARGET binding site found in the 5' untranslated region of mRNA encoded by PABPC1, corresponding to a HOST TARGET binding site such as BINDING SITE I, BINDING SITE II or BINDING SITE III. Table 2 illustrates the complementarity of the nucleotide sequences of PABPC1 BINDING SITE, designated SEQ ID:8418, to the nucleotide sequence of VGAM621 RNA, herein designated VGAM RNA, also designated SEQ ID:3332.

A function of VGAM621 is therefore inhibition of poly (A) Binding Protein, Cytoplasmic 1 (PABPC1, Accession NM_002568), a gene which involves in cytoplasmic regulatory processes of mRNA metabolism. Accordingly, utilities of VGAM621 include diagnosis, prevention and treatment of diseases and clinical conditions associated with PABPC1. The function of PABPC1 and its association with various diseases and clinical conditions, has been established by previous studies, as described hereinabove with reference to VGAM280. Polymerase (DNA directed) Sigma (POLS, Accession NM_006999) is another VGAM621 host target gene. POLS BINDING SITE is HOST TARGET binding site found in the 3' untranslated region of mRNA encoded by POLS, corresponding to a HOST TARGET binding site such as BINDING SITE I, BINDING SITE II or BINDING SITE III. Table 2 illustrates the complementarity of the nucleotide sequences of POLS BINDING SITE, designated SEQ ID:13864, to the nucleotide sequence of VGAM621 RNA, herein designated VGAM RNA, also designated SEQ ID:3332.

Another function of VGAM621 is therefore inhibition of Polymerase (DNA directed) Sigma (POLS, Accession NM_006999), a gene which is necessary for chromosome segregation. Accordingly, utilities of VGAM621 include diagnosis, prevention and treatment of diseases and clinical conditions associated with POLS. The function of POLS and its association with various diseases and clinical conditions, has been established by previous studies, as described hereinabove with reference to VGAM106. CD36L2 (Accession NM_005506) is another VGAM621 host target gene. CD36L2 BINDING SITE is HOST TARGET binding site found in the 5' untranslated region of mRNA encoded by CD36L2, corresponding to a HOST TARGET binding site such as BINDING SITE I, BINDING SITE II or BINDING SITE III. Table 2 illustrates the complementarity of the nucleotide sequences of CD36L2 BINDING SITE, designated SEQ ID:12021, to the nucleotide sequence of VGAM621 RNA, herein designated VGAM RNA, also designated SEQ ID:3332.

Another function of VGAM621 is therefore inhibition of CD36L2 (Accession NM_005506). Accordingly, utilities of VGAM621 include diagnosis, prevention and treatment of diseases and clinical conditions associated with CD36L2. Protein-O-mannosyltransferase 1 (POMT1, Accession NM_007171) is another VGAM621 host target gene. POMT1 BINDING SITE is HOST TARGET binding site found in the 3' untranslated region of mRNA encoded by POMT1, corresponding to a HOST TARGET binding site such as BINDING SITE I, BINDING SITE II or BINDING SITE III. Table 2 illustrates the complementarity of the nucleotide sequences of POMT1 BINDING SITE, designated SEQ ID:14015, to the nucleotide sequence of VGAM621 RNA, herein designated VGAM RNA, also designated SEQ ID:3332.

Another function of VGAM621 is therefore inhibition of Protein-O-mannosyltransferase 1 (POMT1, Accession NM_007171). Accordingly, utilities of VGAM621 include diagnosis, prevention and treatment of diseases and clinical conditions associated with POMT1. Rab11-FIP3 (Accession NM_014700) is another VGAM621 host target gene. Rab11-FIP3 BINDING SITE is HOST TARGET binding site found in the 3" untranslated region of mRNA encoded by Rab11-FIP3, corresponding to a HOST TARGET binding site such as BINDING SITE I, BINDING SITE II or BINDING SITE III. Table 2 illustrates the complementarity of the nucleotide sequences of Rab11-FIP3 BINDING SITE, designated SEQ ID:16225, to the nucleotide sequence of VGAM621 RNA, herein designated VGAM RNA, also designated SEQ ID:3332.

Another function of VGAM621 is therefore inhibition of Rab11-FIP3 (Accession NM_014700). Accordingly, utilities of VGAM621 include diagnosis, prevention and treatment of diseases and clinical conditions associated with Rab11-FIP3. FIG. 1 further provides a conceptual description of a novel bioinformatically detected viral gene of the present invention, referred to here as Viral Genomic Address Messenger 622 (VGAM622) viral gene, which modulates expression of respective host target genes thereof, the function and utility of which host target genes is known in the art.

VGAM622 is a novel bioinformatically detected regulatory, non protein coding, viral micro RNA (miRNA) gene. The method by which VGAM622 was detected is described hereinabove with reference to FIGS. 1-8.

VGAM622 gene, herein designated VGAM GENE, is a viral gene contained in the genome of Hepatitis GB Virus C. VGAM622 host target gene, herein designated VGAM HOST TARGET GENE, is a human gene contained in the human genome.

VGAM622 gene encodes a VGAM622 precursor RNA, herein designated VGAM PRECURSOR RNA. Similar to other miRNA genes, and unlike most ordinary genes, VGAM622 precursor RNA does not encode a protein. A nucleotide sequence identical or highly similar to the nucleotide sequence of VGAM622 precursor RNA is designated SEQ ID:608, and is provided hereinbelow with reference to the sequence listing part. Nucleotide sequence SEQ ID:608 is located at position 6041 relative to the genome of Hepatitis GB Virus C.

VGAM622 precursor RNA folds onto itself, forming VGAM622 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM622 folded precursor RNA into VGAM622 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM622 RNA is designated SEQ ID:3333, and is provided hereinbelow with reference to the sequence listing part.

VGAM622 host target gene, herein designated VGAM HOST TARGET GENE, encodes a corresponding messenger RNA, VGAM622 host target RNA, herein designated VGAM HOST TARGET RNA. VGAM622 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM622 RNA, herein designated VGAM RNA, binds complementarily to one or more host target binding sites located in untranslated regions of VGAM622 host target RNA, herein designated VGAM HOST TARGET RNA. This complementary binding is due to the fact that the nucleotide sequence of VGAM622 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM622 RNA, herein designated VGAM RNA, may have a different number of host target binding sites in untranslated regions of a VGAM622 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM622 RNA, herein designated VGAM RNA, to host target binding sites on VGAM622 host target RNA, herein designated VGAM HOST TARGET RNA, such as BINDING SITE I, BINDING SITE II and BINDING SITE III, inhibits translation of VGAM622 host target RNA into VGAM622 host target protein, herein designated VGAM HOST TARGET PROTEIN. VGAM host target protein is therefore outlined by a broken line.

It is appreciated that VGAM622 host target gene, herein designated VGAM HOST TARGET GENE, in fact represents a plurality of VGAM622 host target genes. The mRNA of each one of this plurality of VGAM622 host target genes comprises one or more host target binding sites, each having a nucleotide sequence which is at least partly complementary to VGAM622 RNA, herein designated VGAM RNA, and which when bound by VGAM622 RNA causes inhibition of translation of respective one or more VGAM622 host target proteins.

It is further appreciated by one skilled in the art that the mode of translational inhibition illustrated by FIG. 1 with specific reference to translational inhibition exerted by VGAM622 gene, herein designated VGAM GENE, on one or more VGAM622 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM622 is inhibition of expression of host target genes, as part of a novel viral mechanism of attacking a host. Accordingly, utilities of VGAM622 include diagnosis, prevention and treatment of viral infection by Hepatitis GB Virus C. Specific functions, and accordingly utilities, of VGAM622 correlate with, and may be deduced from, the identity of the host target genes which VGAM622 binds and inhibits, and the function of these host target genes, as elaborated hereinbelow.

Nucleotide sequences of the VGAM622 precursor RNA, herein designated VGAM PRECURSOR RNA, and of the 'diced' VGAM622 RNA, herein designated VGAM RNA, and a schematic representation of the secondary folding of VGAM622 folded precursor RNA, herein designated VGAM FOLDED PRECURSOR RNA, of VGAM622 are further described hereinbelow with reference to Table 1.

Nucleotide sequences of host target binding sites, such as BINDING SITE-I, BINDING SITE-II and BINDING SITE-III of FIG. 1, found on VGAM622 host target RNA, and schematic representation of the complementarity of each of these host target binding sites to VGAM622 RNA, herein designated VGAM RNA, are described hereinbelow with reference to Table 2.

As mentioned hereinabove with reference to FIG. 1, a function of VGAM622 gene, herein designated VGAM is inhibition of expression of VGAM622 target genes. It is appreciated that specific functions, and accordingly utilities, of VGAM622 correlate with, and may be deduced from, the identity of the target genes which VGAM622 binds and inhibits, and the function of these target genes, as elaborated hereinbelow.

Potassium Voltage-gated Channel, KQT-like Subfamily, Member 1 (KCNQ1, Accession NM_000218) is a VGAM622 host target gene. KCNQ1 BINDING SITE is HOST TARGET binding site found in the 3' untranslated region of mRNA encoded by KCNQ1, corresponding to a HOST TARGET binding site such as BINDING SITE I, BINDING SITE II or BINDING SITE III. Table 2 illustrates the complementarity of the nucleotide sequences of KCNQ1 BINDING SITE, designated SEQ ID:5722, to the nucleotide sequence of VGAM622 RNA, herein designated VGAM RNA, also designated SEQ ID:3333.

A function of VGAM622 is therefore inhibition of Potassium Voltage-gated Channel, KQT-like Subfamily, Member 1 (KCNQ1, Accession NM_000218), a gene which probably important in cardiac repolarization. associates with kcne1 (mink) to form the i (ks) cardiac potassium current. elicits a rapidly activating, k(+)-selective outward current. muscarinic agonist oxotremorine-m strongly suppresses kcnq1/kcne1 current in cho cells in which cloned kcnq1/kcne1 channels were coexpressed with m1 muscarinic receptors. may associate also with kcne3 (mirp2) to form the potassium channel that is important for cyclic amp-stimulated intestinal secretion of chloride io TISSUE:abondantly expressed in heart, pancreas, prostate, kidney, small intestine and peripheral blood leukocytes. less abondant in placenta, lung, spleen, colon, thymus, testis and ovaries. Accordingly, utilities of VGAM622 include diagnosis, prevention and treatment of diseases and clinical conditions associated with KCNQ1. The function of KCNQ1 and its association with various diseases and clinical conditions, has been established by previous studies, as described hereinabove with reference to VGAM339. Regulatory Factor X, 2 (influences HLA class II expression) (RFX2, Accession NM_000635) is another VGAM622 host target gene. RFX2 BINDING SITE is HOST TARGET binding site found in the 3' untranslated region of mRNA encoded by RFX2, corresponding to a HOST TARGET binding site such as BINDING SITE I, BINDING SITE II or BINDING SITE III. Table 2 illustrates the complementarity of the nucleotide sequences of RFX2 BINDING SITE, designated SEQ ID:6270, to the nucleotide sequence of VGAM622 RNA, herein designated VGAM RNA, also designated SEQ ID:3333.

Another function of VGAM622 is therefore inhibition of Regulatory Factor X, 2 (influences HLA class II expression) (RFX2, Accession NM_000635), a gene which acts as a dimer to regulate the expression of many genes. Accordingly, utilities of VGAM622 include diagnosis, prevention and treatment of diseases and clinical conditions associated with RFX2. The function of RFX2 has been established by previous studies. Pugliatti et al. (1992) noted that the expression of HLA class II genes (DR, DQ, and DP) is controlled primarily by cis-acting DNA motifs located within the 150 bp upstream of the genes and in particular by 2 highly conserved sequences, the X and Y boxes. Several protein factors bind to these cis-acting sequences. RFX is of special interest since a specific defect in its binding to target DNA sequence has been observed in patients with HLA class II deficient combined immunodeficiency (see OMIM Ref. No. 209920). Overexpression of RFX in transfected cells transactivates an HLA class II promoter, and antisense RNA expressed in transfected cells inhibits the expression of HLA-DR genes. A closely related form of RFX, referred to as RFX2, has also been isolated. The RFX1 (OMIM Ref. No. 600006) gene product is a transactivator of the human hepatitis B viral enhancer I. Reith et al. (1994) commented that the RFX family members, particularly RFX1 and RFX3 (OMIM Ref. No. 601337), constitute the nuclear complexes referred to previously as enhancer factor C (EF-C), EP, and methylation-dependent DNA-binding protein (MDBP), or rpL30-alpha. Reith et al. (1994) identified and cloned 3 members of this gene family from both human and mouse using lambda gt11 cDNA libraries. The gene encoding human RFX2 encodes a 721-amino acid polypeptide. Homology between the 3 RFX proteins is restricted largely to 5 conserved regions, including the 2 domains required for DNA binding and dimerization. Reith et al. (1994) found that RFX1, RFX2, and RFX3 have similar DNA-binding specificities. The RFX monomers can heterodimerize both in vivo and in vitro, but all 3 are capable of binding DNA as monomers. They showed that the RFX2 transcript is particularly elevated in mouse testis.

Full details of the abovementioned studies are described in the following publications, the disclosure of which are hereby incorporated by reference:

Pugliatti, L.; Derre, J.; Berger, R.; Ucla, C.; Reith, W.; Mach, B.: The genes for MHC class II regulatory factors RFX1 and RFX2 are located on the short arm of chromosome 19. Genomics 13:1307-1310, 1992; and Reith, W.; Ucla, C.; Barras, E.; Gaud, A.; Durand, B.; Herrero-Sanchez, C.; Kobr, M.; Mach, B.: RFX1, a transactivator of hepatitis B virus enhancer I, belongs to a novel family of hom.

Further studies establishing the function and utilities of RFX2 are found in John Hopkins OMIM database record ID 142765, and in sited publications numbered 4745-4747 listed in the bibliography section hereinbelow, which are also hereby incorporated by reference. FK506 Binding Protein 5 (FKBP5, Accession NM_004117) is another VGAM622 host target gene. FKBP5 BINDING SITE is HOST TARGET binding site found in the 3' untranslated region of mRNA encoded by FKBP5, corresponding to a HOST TARGET binding site such as BINDING SITE I, BINDING SITE II or BINDING SITE III. Table 2 illustrates the complementarity of the nucleotide sequences of FKBP5 BINDING SITE, designated SEQ ID:10323, to the nucleotide sequence of VGAM622 RNA, herein designated VGAM RNA, also designated SEQ ID:3333.

Another function of VGAM622 is therefore inhibition of FK506 Binding Protein 5 (FKBP5, Accession NM_004117). Accordingly, utilities of VGAM622 include diagnosis, prevention and treatment of diseases and clinical conditions associated with FKBP5. MGC20576 (Accession NM_144691) is another VGAM622 host target gene. MGC20576 BINDING SITE is HOST TARGET binding site found in the 5' untranslated region of mRNA encoded by MGC20576, corresponding to a HOST TARGET binding site such as BINDING SITE I, BINDING SITE II or BINDING SITE III. Table 2 illustrates the complementarity of the nucleotide sequences of MGC20576 BINDING SITE, designated SEQ ID:29510, to the nucleotide sequence of VGAM622 RNA, herein designated VGAM RNA, also designated SEQ ID:3333.

Another function of VGAM622 is therefore inhibition of MGC20576 (Accession NM_144691). Accordingly, utilities of VGAM622 include diagnosis, prevention and treatment of diseases and clinical conditions associated with MGC20576. Oxysterol Binding Protein-like 5 (OSBPL5, Accession XM_052567) is another VGAM622 host target gene. OSBPL5 BINDING SITE is HOST TARGET binding site found in the 3' untranslated region of mRNA encoded by OSBPL5, corresponding to a HOST TARGET binding site such as BINDING SITE I, BINDING SITE II or BINDING SITE III. Table 2 illustrates the complementarity of the nucleotide sequences of OSBPL5 BINDING SITE, designated SEQ ID:35987, to the nucleotide sequence of VGAM622 RNA, herein designated VGAM RNA, also designated SEQ ID:3333.

Another function of VGAM622 is therefore inhibition of Oxysterol Binding Protein-like 5 (OSBPL5, Accession XM_052567). Accordingly, utilities of VGAM622 include diagnosis, prevention and treatment of diseases and clinical conditions associated with OSBPL5. Purinergic Receptor P2X-like 1, Orphan Receptor (P2RXL1, Accession NM_005446) is another VGAM622 host target gene. P2RXL1 BINDING SITE is HOST TARGET binding site found in the 3' untranslated region of mRNA encoded by P2RXL1, corresponding to a HOST TARGET binding site such as BINDING SITE I, BINDING SITE II or BINDING SITE III. Table 2 illustrates the complementarity of the nucleotide sequences of P2RXL1 BINDING SITE, designated SEQ ID:11927, to the nucleotide sequence of VGAM622 RNA, herein designated VGAM RNA, also designated SEQ ID:3333.

Another function of VGAM622 is therefore inhibition of Purinergic Receptor P2X-like 1, Orphan Receptor (P2RXL1, Accession NM_005446). Accordingly, utilities of VGAM622 include diagnosis, prevention and treatment of diseases and clinical conditions associated with P2RXL1. RA-GEF-2 (Accession NM_016340) is another VGAM622 host target gene. RA-GEF-2 BINDING SITE is HOST TARGET binding site found in the 3' untranslated region of mRNA encoded by RA-GEF-2, corresponding to a HOST TARGET binding site such as BINDING SITE I, BINDING SITE II or BINDING SITE III. Table 2 illustrates the complementarity of the nucleotide sequences of RA-GEF-2 BINDING SITE, designated SEQ ID:18462, to the nucleotide sequence of VGAM622 RNA, herein designated VGAM RNA, also designated SEQ ID:3333.

Another function of VGAM622 is therefore inhibition of RA-GEF-2 (Accession NM_016340). Accordingly, utilities of VGAM622 include diagnosis, prevention and treatment of diseases and clinical conditions associated with RA-GEF-2. LOC197358 (Accession XM_113872) is another VGAM622 host target gene. LOC197358 BINDING SITE is HOST TARGET binding site found in the 3' untranslated region of mRNA encoded by LOC197358, corresponding to a HOST TARGET binding site such as BINDING SITE I, BINDING SITE II or BINDING SITE III. Table 2 illustrates the complementarity of the nucleotide sequences of LOC197358 BINDING SITE, designated SEQ ID:42507, to the nucleotide sequence of VGAM622 RNA, herein designated VGAM RNA, also designated SEQ ID:3333.

Another function of VGAM622 is therefore inhibition of LOC197358 (Accession XM_113872). Accordingly, utilities of VGAM622 include diagnosis, prevention and treatment of diseases and clinical conditions associated with LOC197358.

FIG. 1 further provides a conceptual description of a novel bioinformatically detected viral gene of the present invention, referred to here as Viral Genomic Address Messenger 623 (VGAM623) viral gene, which modulates expression of respective host target genes thereof, the function and utility of which host target genes is known in the art.

VGAM623 is a novel bioinformatically detected regulatory, non protein coding, viral micro RNA (miRNA) gene. The method by which VGAM623 was detected is described hereinabove with reference to FIGS. 1-8.

VGAM623 gene, herein designated VGAM GENE, is a viral gene contained in the genome of Hepatitis GB Virus C. VGAM623 host target gene, herein designated VGAM HOST TARGET GENE, is a human gene contained in the human genome.

VGAM623 gene encodes a VGAM623 precursor RNA, herein designated VGAM PRECURSOR RNA. Similar to other miRNA genes, and unlike most ordinary genes, VGAM623 precursor RNA does not encode a protein. A nucleotide sequence identical or highly similar to the nucleotide sequence of VGAM623 precursor RNA is designated SEQ ID:609, and is provided hereinbelow with reference to the sequence listing part. Nucleotide sequence SEQ ID:609 is located at position 1610 relative to the genome of Hepatitis GB Virus C.

VGAM623 precursor RNA folds onto itself, forming VGAM623 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM623 folded precursor RNA into VGAM623 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM623 RNA is designated SEQ ID:3334, and is provided hereinbelow with reference to the sequence listing part.

VGAM623 host target gene, herein designated VGAM HOST TARGET GENE, encodes a corresponding messenger RNA, VGAM623 host target RNA, herein designated VGAM HOST TARGET RNA. VGAM623 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM623 RNA, herein designated VGAM RNA, binds complementarily to one or more host target binding sites located in untranslated regions of VGAM623 host target RNA, herein designated VGAM HOST TARGET RNA. This complementary binding is due to the fact that the nucleotide sequence of VGAM623 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM623 RNA, herein designated VGAM RNA, may have a different number of host target binding sites in untranslated regions of a VGAM623 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM623 RNA, herein designated VGAM RNA, to host target binding sites on VGAM623 host target RNA, herein designated VGAM HOST TARGET RNA, such as BINDING SITE I, BINDING SITE II and BINDING SITE III, inhibits translation of VGAM623 host target RNA into VGAM623 host target protein, herein designated VGAM HOST TARGET PROTEIN. VGAM host target protein is therefore outlined by a broken line.

It is appreciated that VGAM623 host target gene, herein designated VGAM HOST TARGET GENE, in fact represents a plurality of VGAM623 host target genes. The mRNA of each one of this plurality of VGAM623 host target genes comprises one or more host target binding sites, each having a nucleotide sequence which is at least partly complementary to VGAM623 RNA, herein designated VGAM RNA, and which when bound by VGAM623 RNA causes inhibition of translation of respective one or more VGAM623 host target proteins.

It is further appreciated by one skilled in the art that the mode of translational inhibition illustrated by FIG. 1 with specific reference to translational inhibition exerted by VGAM623 gene, herein designated VGAM GENE, on one or more VGAM623 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM623 is inhibition of expression of host target genes, as part of a novel viral mechanism of attacking a host. Accordingly, utilities of VGAM623 include diagnosis, prevention and treatment of viral infection by Hepatitis GB Virus C. Specific functions, and accordingly utilities, of VGAM623 correlate with, and may be deduced from, the identity of the host target genes which VGAM623 binds and inhibits, and the function of these host target genes, as elaborated hereinbelow.

Nucleotide sequences of the VGAM623 precursor RNA, herein designated VGAM PRECURSOR RNA, and of the 'diced' VGAM623 RNA, herein designated VGAM RNA, and a schematic representation of the secondary folding of VGAM623 folded precursor RNA, herein designated VGAM FOLDED PRECURSOR RNA, of VGAM623 are further described hereinbelow with reference to Table 1.

Nucleotide sequences of host target binding sites, such as BINDING SITE-I, BINDING SITE-II and BINDING SITE-III of FIG. 1, found on VGAM623 host target RNA, and schematic representation of the complementarity of each of these host target binding sites to VGAM623 RNA, herein designated VGAM RNA, are described hereinbelow with reference to Table 2.

As mentioned hereinabove with reference to FIG. 1, a function of VGAM623 gene, herein designated VGAM is inhibition of expression of VGAM623 target genes. It is appreciated that specific functions, and accordingly utilities, of VGAM623 correlate with, and may be deduced from, the identity of the target genes which VGAM623 binds and inhibits, and the function of these target genes, as elaborated hereinbelow.

Chloride Channel 7 (CLCN7, Accession NM_001287) is a VGAM623 host target gene. CLCN7 BINDING SITE is HOST TARGET binding site found in the 3' untranslated region of mRNA encoded by CLCN7, corresponding to a HOST TARGET binding site such as BINDING SITE I, BINDING SITE II or BINDING SITE III. Table 2 illustrates the complementarity of the nucleotide sequences of CLCN7 BINDING SITE, designated SEQ ID:6963, to the nucleotide sequence of VGAM623 RNA, herein designated VGAM RNA, also designated SEQ ID:3334.

A function of VGAM623 is therefore inhibition of Chloride Channel 7 (CLCN7, Accession NM_001287), a gene which is voltage-gated chloride channel. Accordingly, utilities of VGAM623 include diagnosis, prevention and treatment of diseases and clinical conditions associated with CLCN7. The function of CLCN7 has been established by previous studies. Cleiren et al. (2001) reported 7 different mutations in the CLCN7 gene among 12 autosomal dominant osteopetrosis type II (OPTA2; 166600) families analyzed. Among these families was the Danish family initially linked to chromosome 1p21. Additionally, 1 patient with the severe autosomal recessive infantile form of osteopetrosis (OPTB1) was identified as being homozygous for a CLCN7 mutation. The authors hypothesized that OPTA2 reflects a dominant negative effect, since loss-of-function mutations in CLCN7 do not cause abnormalities in heterozygous individuals. Because some OPTB1 patients have mutations in both copies of the CLCN7 gene, it appears that OPTA2 is allelic with a subset of OPTB1 cases. In a patient with autosomal recessive infantile malignant osteopetrosis (OMIM Ref. No. 259700), Kornak et al. (2001) identified compound heterozygosity for a C-to-T transition at codon 555 of the CLCN7 gene, leading to gln-to-ter substitution, and a G-to-A transition at nucleotide 2285, leading to an arg762-to-gln substitution (602727.0002). The arg762-to-gln substitution abolished a positive charge within the conserved CBS2 domain of CCLN7. To investigate whether the mutations affected protein expression, fibroblasts were analyzed by Western blot analysis and immunofluorescence. In contrast to control cells, CLCN7 protein could not be detected in the fibroblasts from the patient. Animal model experiments lend further support to the function of CLCN7. Kornak et al. (2001) observed that mice with targeted disruption of the Clcn7 gene (Clcn7 -/-) had severe osteopetrosis and retinal degeneration. Although osteoclasts were present in normal numbers, they failed to resorb bone because they could not acidify the extracellular resorption lacuna. Clcn7 was found to reside in late endosomal and lysosomal compartments. In osteoclasts it was highly expressed in the ruffled membrane, formed by the fusion of H(+) ATPase-containing vesicles, that secretes protons into the lacuna. Based on the similarity between the mouse model and human infantile malignant osteopetrosis (OMIM Ref. No. 259700), Kornak et al. (2001) searched for mutations in the human CLCN7 gene in patients with the disease. They identified CLCN7 mutations in 1 of 12 patients with infantile malignant osteopetrosis. The authors concluded that CLCN7 provides the chloride conductance required for an efficient proton pumping by the H(+) ATPase of the osteoclast ruffled membrane.

It is appreciated that the abovementioned animal model for CLCN7 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Cleiren, E.; Benichou, O.; Van Hul, E.; Gram, J.; Bollerslav, J.; Singer, F. R.; Beaverson, K.; Aledo, A.; Whyte, M. P.; Yoneyama, T.; deVernejou, M.-C.; Van Hul, W. : Albers-Schonberg disease (autosomal dominant osteopetrosis, type II) results from mutations in the ClCN7 chloride channel gene. Hum. Molec. Genet. 10: 2861-2867, 2001; and Kornak, U.; Kasper, D.; Bosl, M. R.; Kaiser, E.; Schweizer, M.; Schulz, A.; Friedrich, W.; Delling, G.; Jentsch, T. J.: Loss of the ClC-7 chloride channel leads to osteopetrosis in mi.

Further studies establishing the function and utilities of CLCN7 are found in John Hopkins OMIM database record ID 602727, and in sited publications numbered 8588, 859 and 11076 listed in the bibliography section hereinbelow, which are also hereby incorporated by reference. N-acetylgalactosaminidase, Alpha- (NAGA, Accession NM_000262) is another VGAM623 host target gene. NAGA BINDING SITE is HOST TARGET binding site found in the 3' untranslated region of mRNA encoded by NAGA, corresponding to a HOST TARGET binding site such as BINDING SITE I, BINDING SITE II or BINDING SITE III. Table 2 illustrates the complementarity of the nucleotide sequences of NAGA BINDING SITE, designated SEQ ID:5798, to the nucleotide sequence of VGAM623 RNA, herein designated VGAM RNA, also designated SEQ ID:3334.

Another function of VGAM623 is therefore inhibition of N-acetylgalactosaminidase, Alpha- (NAGA, Accession NM_000262). Accordingly, utilities of VGAM623 include diagnosis, prevention and treatment of diseases and clinical conditions associated with NAGA. PDGFA Associated Protein 1 (PDAP1, Accession XM_166484) is another VGAM623 host target gene. PDAP1 BINDING SITE is HOST TARGET binding site found in the 3' untranslated region of mRNA encoded by PDAP1, corresponding to a HOST TARGET binding site such as BINDING SITE I, BINDING SITE II or BINDING SITE III. Table 2 illustrates the complementarity of the nucleotide sequences of PDAP1 BINDING SITE, designated SEQ ID:44420, to the nucleotide sequence of VGAM623 RNA, herein designated VGAM RNA, also designated SEQ ID:3334.

Another function of VGAM623 is therefore inhibition of PDGFA Associated Protein 1 (PDAP1, Accession XM_166484). Accordingly, utilities of VGAM623 include diagnosis, prevention and treatment of diseases and clinical conditions associated with PDAP1. Stanniocalcin 1 (STC1, Accession NM_003155) is another VGAM623 host target gene. STC1 BINDING SITE is HOST TARGET binding site found in the 3' untranslated region of mRNA encoded by STC1, corresponding to a HOST TARGET binding site such as BINDING SITE I, BINDING SITE II or BINDING SITE III. Table 2 illustrates the complementarity of the nucleotide sequences of STC1 BINDING SITE, designated SEQ ID:9133, to the nucleotide sequence of VGAM623 RNA, herein designated VGAM RNA, also designated SEQ ID:3334.

Another function of VGAM623 is therefore inhibition of Stanniocalcin 1 (STC1, Accession NM_003155), a gene which stimulates renal phosphate reabsorption, and could therefore prevent hypercalcemia. Accordingly, utilities of VGAM623 include diagnosis, prevention and treatment of diseases and clinical conditions associated with STC1. The function of STC1 has been established by previous studies. Stanniocalcin (STC) is a calcium-regulated hormone in bony fishes. The hormone was so named because it is synthesized by the corpuscles of Stannius, endocrine glands that are associated with the kidneys of all fishes with a bony skeleton. The primary function of STC in fishes is the prevention of hypercalcemia; Olsen et al. (1996) noted that a rise in serum calcium levels is the primary stimulus for secretion. Upon release into the circulation, STC lowers calcium transport by the gills, thereby reducing its rate of influx from the environment into the extracellular compartment. A second equally important action of STC is stimulation of phosphate reabsorption by renal proximal tubules. The consequence of this renal effect is increased levels of plasma phosphate, which combines with excess calcium and promotes its disposal into bone and scales. Wagner et al. (1995) found evidence of STC immunoreactivity in human kidney and serum, suggesting the existence of the hormone in mammals. Olsen et al. (1996) isolated a human cDNA clone encoding the mammalian homolog of STC. Human STC was found to be 247 amino acids long and to share 73% amino acid sequence similarity with fish STC. Polyclonal antibodies to recombinant human STC localized to a distinct cell type in the nephron tubule, suggesting kidney as a possible site of synthesis. Recombinant human STC inhibited the gill transport of calcium when administered to fish and stimulated renal phosphate reabsorption in the rat.

Full details of the abovementioned studies are described in the following publications, the disclosure of which are hereby incorporated by reference:

Olsen, H. S.; Cepeda, M. A.; Zhang, Q.-Q.; Rosen, C. A.; Vozzolo, B. L.; Wagner, G. F.: Human stanniocalcin: a possible hormonal regulator of mineral metabolism. Proc. Nat. Acad. Sci. 93:1792-1796, 1996; and Wagner, G. F.; Guiraudon, C. C.; Milliken, C.; Copp, D. H.: Immunological and biological evidence for a stanniocalcin-like hormone in human kidney. Proc. Nat. Acad. Sci. 92:1871-1875.

Further studies establishing the function and utilities of STC1 are found in John Hopkins OMIM database record ID 601185, and in sited publications numbered 9509-9514, 963 and 9834 listed in the bibliography section hereinbelow, which are also hereby incorporated by reference. Surfeit 5 (SURF5, Accession NM_006752) is another VGAM623 host target gene. SURF5 BINDING SITE is HOST TARGET binding site found in the 3' untranslated region of mRNA encoded by SURF5, corresponding to a HOST TARGET binding site such as BINDING SITE I, BINDING SITE II or BINDING SITE III. Table 2 illustrates the complementarity of the nucleotide sequences of SURF5 BINDING SITE, designated SEQ ID:13606, to the nucleotide sequence of VGAM623 RNA, herein designated VGAM RNA, also designated SEQ ID:3334.

Another function of VGAM623 is therefore inhibition of Surfeit 5 (SURF5, Accession NM_006752). Accordingly, utilities of VGAM623 include diagnosis, prevention and treatment of diseases and clinical conditions associated with SURF5. Chromosome 11 Open Reading Frame 14 (C11orf14, Accession NM_020645) is another VGAM623 host target gene. C11orf14 BINDING SITE is HOST TARGET binding site found in the 3' untranslated region of mRNA encoded by C11orf14, corresponding to a HOST TARGET binding site such as BINDING SITE I, BINDING SITE II or BINDING SITE III. Table 2 illustrates the complementarity of the nucleotide sequences of C11orf14 BINDING SITE, designated SEQ ID:21808, to the nucleotide sequence of VGAM623 RNA, herein designated VGAM RNA, also designated SEQ ID:3334.

Another function of VGAM623 is therefore inhibition of Chromosome 11 Open Reading Frame 14 (C11orf14, Accession NM_020645). Accordingly, utilities of VGAM623 include diagnosis, prevention and treatment of diseases and clinical conditions associated with C11orf14. ERp44 (Accession XM_088476) is another VGAM623 host target gene. ERp44 BINDING SITE is HOST TARGET binding site found in the 3' untranslated region of mRNA encoded by ERp44, corresponding to a HOST TARGET binding site such as BINDING SITE I, BINDING SITE II or BINDING SITE III. Table 2 illustrates the complementarity of the nucleotide sequences of ERp44 BINDING SITE, designated SEQ ID:39723, to the nucleotide sequence of VGAM623 RNA, herein designated VGAM RNA, also designated SEQ ID:3334.

Another function of VGAM623 is therefore inhibition of ERp44 (Accession XM_088476). Accordingly, utilities of VGAM623 include diagnosis, prevention and treatment of diseases and clinical conditions associated with ERp44. KIAA1091 (Accession XM_045750) is another VGAM623 host target gene. KIAA1091 BINDING SITE is HOST TARGET binding site found in the 3' untranslated region of mRNA encoded by KIAA1091, corresponding to a HOST TARGET binding site such as BINDING SITE I, BINDING SITE II or BINDING SITE III. Table 2 illustrates the complementarity of the nucleotide sequences of KIAA1091 BINDING SITE, designated SEQ ID:34538, to the nucleotide sequence of VGAM623 RNA, herein designated VGAM RNA, also designated SEQ ID:3334.

Another function of VGAM623 is therefore inhibition of KIAA1091 (Accession XM_045750). Accordingly, utilities of VGAM623 include diagnosis, prevention and treatment of diseases and clinical conditions associated with KIAA1091. Proteasome (prosome, macropain) Inhibitor Subunit 1 (PI31) (PSMF1, Accession NM_006814) is another VGAM623 host target gene. PSMF1 BINDING SITE is HOST TARGET binding site found in the 3' untranslated region of mRNA encoded by PSMF1, corresponding to a HOST TARGET binding site such as BINDING SITE I, BINDING SITE II or BINDING SITE III. Table 2 illustrates the complementarity of the nucleotide sequences of PSMF1 BINDING SITE, designated SEQ ID:13687, to the nucleotide sequence of VGAM623 RNA, herein designated VGAM RNA, also designated SEQ ID:3334.

Another function of VGAM623 is therefore inhibition of Proteasome (prosome, macropain) Inhibitor Subunit 1 (PI31) (PSMF1, Accession NM_006814). Accordingly, utilities of VGAM623 include diagnosis, prevention and treatment of diseases and clinical conditions associated with PSMF1. RAB6C, Member RAS Oncogene Family (RAB6C, Accession NM_032144) is another VGAM623 host target gene. RAB6C BINDING SITE is HOST TARGET binding site found in the 3' untranslated region of mRNA encoded by RAB6C, corresponding to a HOST TARGET binding site such as BINDING SITE I, BINDING SITE II or BINDING SITE III. Table 2 illustrates the complementarity of the nucleotide sequences of RAB6C BINDING SITE, designated SEQ ID:25832, to the nucleotide sequence of VGAM623 RNA, herein designated VGAM RNA, also designated SEQ ID:3334.

Another function of VGAM623 is therefore inhibition of RAB6C, Member RAS Oncogene Family (RAB6C, Accession NM_032144). Accordingly, utilities of VGAM623 include diagnosis, prevention and treatment of diseases and clinical conditions associated with RAB6C. WD Repeat Domain 9 (WDR9, Accession NM_033656) is another VGAM623 host target gene. WDR9 BINDING SITE is HOST TARGET binding site found in the 3' untranslated region of mRNA encoded by WDR9, corresponding to a HOST TARGET binding site such as BINDING SITE I, BINDING SITE II or BINDING SITE III. Table 2 illustrates the complementarity of the nucleotide sequences of WDR9 BINDING SITE, designated SEQ ID:27389, to the nucleotide sequence of VGAM623 RNA, herein designated VGAM RNA, also designated SEQ ID:3334.

Another function of VGAM623 is therefore inhibition of WD Repeat Domain 9 (WDR9, Accession NM_033656). Accordingly, utilities of VGAM623 include diagnosis, prevention and treatment of diseases and clinical conditions associated with WDR9. LOC143943 (Accession XM_096504) is another VGAM623 host target gene. LOC143943 BINDING SITE is HOST TARGET binding site found in the 5' untranslated region of mRNA encoded by LOC143943, corresponding to a HOST TARGET binding site such as BINDING SITE I, BINDING SITE II or BINDING SITE III. Table 2 illustrates the complementarity of the nucleotide sequences of LOC143943 BINDING SITE, designated SEQ ID:40381, to the nucleotide sequence of VGAM623 RNA, herein designated VGAM RNA, also designated SEQ ID:3334.

Another function of VGAM623 is therefore inhibition of LOC143943 (Accession XM_096504). Accordingly, utilities of VGAM623 include diagnosis, prevention and treatment of diseases and clinical conditions associated with LOC143943. LOC147976 (Accession XM_085980) is another VGAM623 host target gene. LOC147976 BINDING SITE is HOST TARGET binding site found in the 3' untranslated region of mRNA encoded by LOC147976, corresponding to a HOST TARGET binding site such as BINDING SITE I, BINDING SITE II or BINDING SITE III. Table 2 illustrates the complementarity of the nucleotide sequences of LOC147976 BINDING SITE, designated SEQ ID:38426, to the nucleotide sequence of VGAM623 RNA, herein designated VGAM RNA, also designated SEQ ID:3334.

Another function of VGAM623 is therefore inhibition of LOC147976 (Accession XM_085980). Accordingly, utilities of VGAM623 include diagnosis, prevention and treatment of diseases and clinical conditions associated with LOC147976. LOC150157 (Accession XM_097823) is another VGAM623 host target gene. LOC150157 BINDING SITE is HOST TARGET binding site found in the 5' untranslated region of mRNA encoded by LOC150157, corresponding to a HOST TARGET binding site such as BINDING SITE I, BINDING SITE II or BINDING SITE III. Table 2 illustrates the complementarity of the nucleotide sequences of LOC150157 BINDING SITE, designated SEQ ID:41141, to the nucleotide sequence of VGAM623 RNA, herein designated VGAM RNA, also designated SEQ ID:3334.

Another function of VGAM623 is therefore inhibition of LOC150157 (Accession XM_097823). Accordingly, utilities of VGAM623 include diagnosis, prevention and treatment of diseases and clinical conditions associated with LOC150157. LOC157653 (Accession XM_088353) is another VGAM623 host target gene. LOC157653 BINDING SITE is HOST TARGET binding site found in the 5' untranslated region of mRNA encoded by LOC157653, corresponding to a HOST TARGET binding site such as BINDING SITE I, BINDING SITE II or BINDING SITE III. Table 2 illustrates the complementarity of the nucleotide sequences of LOC157653 BINDING SITE, designated SEQ ID:39631, to the nucleotide sequence of VGAM623 RNA, herein designated VGAM RNA, also designated SEQ ID:3334.

Another function of VGAM623 is therefore inhibition of LOC157653 (Accession XM_088353). Accordingly, utilities of VGAM623 include diagnosis, prevention and treatment of diseases and clinical conditions associated with LOC157653. LOC256158 (Accession XM_175125) is another VGAM623 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46635, to the nucleotide sequence of VGAM623 RNA, herein designated VGAM RNA, also designated SEQ ID:3334.

Another function of VGAM623 is therefore inhibition of LOC256158 (Accession XM_175125). Accordingly, utilities of VGAM623 include diagnosis, prevention and treatment of diseases and clinical conditions associated with LOC256158. FIG. 1 further provides a conceptual description of a novel bioinformatically detected viral gene of the present invention, referred to here as Viral Genomic Address Messenger 624 (VGAM624) viral gene, which modulates expression of respective host target genes thereof, the function and utility of which host target genes is known in the art.

VGAM624 is a novel bioinformatically detected regulatory, non protein coding, viral micro RNA (miRNA) gene. The method by which VGAM624 was detected is described hereinabove with reference to FIGS. 1-8.

VGAM624 gene, herein designated VGAM GENE, is a viral gene contained in the genome of Hepatitis GB Virus C. VGAM624 host target gene, herein designated VGAM HOST TARGET GENE, is a human gene contained in the human genome.

VGAM624 gene encodes a VGAM624 precursor RNA, herein designated VGAM PRECURSOR RNA. Similar to other miRNA genes, and unlike most ordinary genes, VGAM624 precursor RNA does not encode a protein. A nucleotide sequence identical or highly similar to the nucleotide sequence of VGAM624 precursor RNA is designated SEQ ID:610, and is provided hereinbelow with reference to the sequence listing part. Nucleotide sequence SEQ ID:610 is located at position 4971 relative to the genome of Hepatitis GB Virus C.

VGAM624 precursor RNA folds onto itself, forming VGAM624 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM624 folded precursor RNA into VGAM624 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM624 RNA is designated SEQ ID:3335, and is provided hereinbelow with reference to the sequence listing part.

VGAM624 host target gene, herein designated VGAM HOST TARGET GENE, encodes a corresponding messenger RNA, VGAM624 host target RNA, herein designated VGAM HOST TARGET RNA. VGAM624 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM624 RNA, herein designated VGAM RNA, binds complementarily to one or more host target binding sites located in untranslated regions of VGAM624 host target RNA, herein designated VGAM HOST TARGET RNA. This complementary binding is due to the fact that the nucleotide sequence of VGAM624 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM624 RNA, herein designated VGAM RNA, may have a different number of host target binding sites in untranslated regions of a VGAM624 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM624 RNA, herein designated VGAM RNA, to host target binding sites on VGAM624 host target RNA, herein designated VGAM HOST TARGET RNA, such as BINDING SITE I, BINDING SITE II and BINDING SITE III, inhibits translation of VGAM624 host target RNA into VGAM624 host target protein, herein designated VGAM HOST TARGET PROTEIN. VGAM host target protein is therefore outlined by a broken line.

It is appreciated that VGAM624 host target gene, herein designated VGAM HOST TARGET GENE, in fact represents a plurality of VGAM624 host target genes. The mRNA of each one of this plurality of VGAM624 host target genes comprises one or more host target binding sites, each having a nucleotide sequence which is at least partly complementary to VGAM624 RNA, herein designated VGAM RNA, and which when bound by VGAM624 RNA causes inhibition of translation of respective one or more VGAM624 host target proteins.

It is further appreciated by one skilled in the art that the mode of translational inhibition illustrated by FIG. 1 with specific reference to translational inhibition exerted by VGAM624 gene, herein designated VGAM GENE, on one or more VGAM624 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM624 is inhibition of expression of host target genes, as part of a novel viral mechanism of attacking a host. Accordingly, utilities of VGAM624 include diagnosis, prevention and treatment of viral infection by Hepatitis GB Virus C. Specific functions, and accordingly utilities, of VGAM624 correlate with, and may be deduced from, the identity of the host target genes which VGAM624 binds and inhibits, and the function of these host target genes, as elaborated hereinbelow.

Nucleotide sequences of the VGAM624 precursor RNA, herein designated VGAM PRECURSOR RNA, and of the 'diced' VGAM624 RNA, herein designated VGAM RNA, and a schematic representation of the secondary folding of VGAM624 folded precursor RNA, herein designated VGAM FOLDED PRECURSOR RNA, of VGAM624 are further described hereinbelow with reference to Table 1.

Nucleotide sequences of host target binding sites, such as BINDING SITE-I, BINDING SITE-II and BINDING SITE-III of FIG. 1, found on VGAM624 host target RNA, and schematic representation of the complementarity of each of these host target binding sites to VGAM624 RNA, herein designated VGAM RNA, are described hereinbelow with reference to Table 2.

As mentioned hereinabove with reference to FIG. 1, a function of VGAM624 gene, herein designated VGAM is inhibition of expression of VGAM624 target genes. It is appreciated that specific functions, and accordingly utilities, of VGAM624 correlate with, and may be deduced from, the identity of the target genes which VGAM624 binds and inhibits, and the function of these target genes, as elaborated hereinbelow.

Carbonic Anhydrase II (CA2, Accession NM_000067) is a VGAM624 host target gene. CA2 BINDING SITE is HOST TARGET binding site found in the 3' untranslated region of mRNA encoded by CA2, corresponding to a HOST TARGET binding site such as BINDING SITE I, BINDING SITE II or BINDING SITE III. Table 2 illustrates the complementarity of the nucleotide sequences of CA2 BINDING SITE, designated SEQ ID:5513, to the nucleotide sequence of VGAM624 RNA, herein designated VGAM RNA, also designated SEQ ID:3335.

A function of VGAM624 is therefore inhibition of Carbonic Anhydrase II (CA2, Accession NM_000067). Accordingly, utilities of VGAM624 include diagnosis, prevention and treatment of diseases and clinical conditions associated with CA2. Galactosylceramidase (Krabbe disease) (GALC, Accession NM_000153) is another VGAM624 host target gene. GALC BINDING SITE is HOST TARGET binding site found in the 3' untranslated region of mRNA encoded by GALC, corresponding to a HOST TARGET binding site such as BINDING SITE I, BINDING SITE II or BINDING SITE III. Table 2 illustrates the complementarity of the nucleotide sequences of GALC BINDING SITE, designated SEQ ID:5662, to the nucleotide sequence of VGAM624 RNA, herein designated VGAM RNA, also designated SEQ ID:3335.

Another function of VGAM624 is therefore inhibition of Galactosylceramidase (Krabbe disease) (GALC, Accession NM_000153), a gene which hydrolyses the galactose ester bonds of galactosylceramide, galactosylsphingosine, lactosylceramide, and monogalactosyldiglyceride. Accordingly, utilities of VGAM624 include diagnosis, prevention and treatment of diseases and clinical conditions associated with GALC. The function of GALC has been established by previous studies. Sakai et al. (1994) identified a glu369-to-ter nonsense mutation in a patient with typical Krabbe disease (606890.0001). Rafi et al. (1995) described a mutation of the GALC gene leading to the loss of exons 11-17. The deletion was associated with a C-to-T transition at position 502 of the cDNA leading to replacement of arginine by cysteine; see 606890.0002. Expression of the 502/del mutation in COS-1 cells resulted in no measurable GALC activity above that in mock transfected cells. Rafi et al. (1995) indicated that, while not yet confirmed by expression studies, 3 missense mutations and 1 single nucleotide insertion had been identified in patients with infantile Krabbe disease. Animal model experiments lend further support to the function of GALC. Victoria et al. (1996) found that the disease-causing mutation in the canine GALC gene was demonstrated to be an A-to-C transversion at cDNA position 473 (Y158S). Luzi et al. (1997) found that the mutation causing GLD in the rhesus monkey was a deletion of AC corresponding to cDNA positions 387 and 388 in exon 4. This resulted in a frameshift and stop codon after 46 nucleotides. Using an engineered sense primer and an antisense primer from intron 4, Luzi et al. (1997) developed a rapid method to detect the GALC mutation. When 45 monkeys from 1 colony were tested, 22 were found to be carriers. The availability of this non human primate model of GLD provides unique opportunities to evaluate treatment for this severe disease.

It is appreciated that the abovementioned animal model for GALC is acknowledged by those skilled in the art as a scientifically valid animal model, as can be further appreciated from the publications sited hereinbelow.

Full details of the abovementioned studies are described in the following publications, the disclosure of which are hereby incorporated by reference:

Rafi, M. A.; Luzi, P.; Chen, Y. Q.; Wenger, D. A.: A large deletion together with a point mutation in the GALC gene is a common mutant allele in patients with infantile Krabbe disease. Hum. Molec. Genet. 4:1285-1289, 1995; and Victoria, T.; Rafi, M. A.; Wenger, D. A.: Cloning of the canine GALC cDNA and identification of the mutation causing globoid cell leukodystrophy in West Highland White and Cairn terrie.

Further studies establishing the function and utilities of GALC are found in John Hopkins OMIM database record ID 606890, and in sited publications numbered 9217-5396, 9218-9219, 5397-5401, 9230, 9594-923 and 9590-9593 listed in the bibliography section hereinbelow, which are also hereby incorporated by reference. Phosphoinositide-3-kinase, Regulatory Subunit, Polypeptide 3 (p55, gamma) (PIK3R3, Accession XM_027982) is another VGAM624 host target gene. PIK3R3 BINDING SITE is HOST TARGET binding site found in the 3' untranslated region of mRNA encoded by PIK3R3, corresponding to a HOST TARGET binding site such as BINDING SITE I, BINDING SITE II or BINDING SITE III. Table 2 illustrates the complementarity of the nucleotide sequences of PIK3R3 BINDING SITE, designated SEQ ID:30604, to the nucleotide sequence of VGAM624 RNA, herein designated VGAM RNA, also designated SEQ ID:3335.

Another function of VGAM624 is therefore inhibition of Phosphoinositide-3-kinase, Regulatory Subunit, Polypeptide 3 (p55, gamma) (PIK3R3, Accession XM_027982). Accordingly, utilities of VGAM624 include diagnosis, prevention and treatment of diseases and clinical conditions associated with PIK3R3. Protein Tyrosine Phosphatase, Receptor Type, C (PTPRC, Accession NM_002838) is another VGAM624 host target gene. PTPRC BINDING SITE1 and PTPRC BINDING SITE2 are HOST TARGET binding sites found in untranslated regions of mRNA encoded by PTPRC, corresponding to HOST TARGET binding sites such as BINDING SITE I, BINDING SITE II or BINDING SITE III. Table 2 illustrates the complementarity of the nucleotide sequences of PTPRC BINDING SITE1 and PTPRC BINDING SITE2, designated SEQ ID:8721 and SEQ ID:28147 respectively, to the nucleotide sequence of VGAM624 RNA, herein designated VGAM RNA, also designated SEQ ID:3335.

Another function of VGAM624 is therefore inhibition of Protein Tyrosine Phosphatase, Receptor Type, C (PTPRC, Accession NM_002838). Accordingly, utilities of VGAM624 include diagnosis, prevention and treatment of diseases and clinical conditions associated with PTPRC. ABLIM (Accession NM_006720) is another VGAM624 host target gene. ABLIM BINDING SITE1 and ABLIM BINDING SITE2 are HOST TARGET binding sites found in untranslated regions of mRNA encoded by ABLIM, corresponding to HOST TARGET binding sites such as BINDING SITE I, BINDING SITE II or BINDING SITE III. Table 2 illustrates the complementarity of the nucleotide sequences of ABLIM BINDING SITE1 and ABLIM BINDING SITE2, designated SEQ ID:13547 and SEQ ID:8114 respectively, to the nucleotide sequence of VGAM624 RNA, herein designated VGAM RNA, also designated SEQ ID:3335.

Another function of VGAM624 is therefore inhibition of ABLIM (Accession NM_006720). Accordingly, utilities of VGAM624 include diagnosis, prevention and treatment of diseases and clinical conditions associated with ABLIM. DKFZP564A1164 (Accession XM_048304) is another VGAM624 host target gene. DKFZP564A1164 BINDING SITE is HOST TARGET binding site found in the 5' untranslated region of mRNA encoded by DKFZP564A1164, corresponding to a HOST TARGET binding site such as BINDING SITE I, BINDING SITE II or BINDING SITE III. Table 2 illustrates the complementarity of the nucleotide sequences of DKFZP564A1164 BINDING SITE, designated SEQ ID:35153, to the nucleotide sequence of VGAM624 RNA, herein designated VGAM RNA, also designated SEQ ID:3335.

Another function of VGAM624 is therefore inhibition of DKFZP564A1164 (Accession XM_048304). Accordingly, utilities of VGAM624 include diagnosis, prevention and treatment of diseases and clinical conditions associated with DKFZP564A1164. DKFZP564K0822 (Accession XM_168378) is another VGAM624 host target gene. DKFZP564K0822 BINDING SITE is HOST TARGET binding site found in the 3' untranslated region of mRNA encoded by DKFZP564K0822, corresponding to a HOST TARGET binding site such as BINDING SITE I, BINDING SITE II or BINDING SITE III. Table 2 illustrates the complementarity of the nucleotide sequences of DKFZP564K0822 BINDING SITE, designated SEQ ID:45141, to the nucleotide sequence of VGAM624 RNA, herein designated VGAM RNA, also designated SEQ ID:3335.

Another function of VGAM624 is therefore inhibition of DKFZP564K0822 (Accession XM_168378). Accordingly, utilities of VGAM624 include diagnosis, prevention and treatment of diseases and clinical conditions associated with DKFZP564K0822. FLJ14735 (Accession NM_032832) is another VGAM624 host target gene. FLJ14735 BINDING SITE is HOST TARGET binding site found in the 3' untranslated region of mRNA encoded by FLJ14735, corresponding to a HOST TARGET binding site such as BINDING SITE I, BINDING SITE II or BINDING SITE III. Table 2 illustrates the complementarity of the nucleotide sequences of FLJ14735 BINDING SITE, designated SEQ ID:26609, to the nucleotide sequence of VGAM624 RNA, herein designated VGAM RNA, also designated SEQ ID:3335.

Another function of VGAM624 is therefore inhibition of FLJ14735 (Accession NM_032832). Accordingly, utilities of VGAM624 include diagnosis, prevention and treatment of diseases and clinical conditions associated with FLJ14735. G4 (Accession XM_165712) is another VGAM624 host target gene. G4 BINDING SITE is HOST TARGET binding site found in the 5' untranslated region of mRNA encoded by G4, corresponding to a HOST TARGET binding site such as BINDING SITE I, BINDING SITE II or BINDING SITE III.

Table 2 illustrates the complementarity of the nucleotide sequences of G4 BINDING SITE, designated SEQ ID:43734, to the nucleotide sequence of VGAM624 RNA, herein designated VGAM RNA, also designated SEQ ID:3335.

Another function of VGAM624 is therefore inhibition of G4 (Accession XM_165712). Accordingly, utilities of VGAM624 include diagnosis, prevention and treatment of diseases and clinical conditions associated with G4. Potassium Inwardly-rectifying Channel, Subfamily J, Member 14 (KCNJ14, Accession NM_013348) is another VGAM624 host target gene. KCNJ14 BINDING SITE is HOST TARGET binding site found in the 3' untranslated region of mRNA encoded by KCNJ14, corresponding to a HOST TARGET binding site such as BINDING SITE I, BINDING SITE II or BINDING SITE III. Table 2 illustrates the complementarity of the nucleotide sequences of KCNJ14 BINDING SITE, designated SEQ ID:14994, to the nucleotide sequence of VGAM624 RNA, herein designated VGAM RNA, also designated SEQ ID:3335.

Another function of VGAM624 is therefore inhibition of Potassium Inwardly-rectifying Channel, Subfamily J, Member 14 (KCNJ14, Accession NM_013348). Accordingly, utilities of VGAM624 include diagnosis, prevention and treatment of diseases and clinical conditions associated with KCNJ14. KIAA0470 (Accession NM_014812) is another VGAM624 host target gene. KIAA0470 BINDING SITE is HOST TARGET binding site found in the 3' untranslated region of mRNA encoded by KIAA0470, corresponding to a HOST TARGET binding site such as BINDING SITE I, BINDING SITE II or BINDING SITE III. Table 2 illustrates the complementarity of the nucleotide sequences of KIAA0470 BINDING SITE, designated SEQ ID:16776, to the nucleotide sequence of VGAM624 RNA, herein designated VGAM RNA, also designated SEQ ID:3335.

Another function of VGAM624 is therefore inhibition of KIAA0470 (Accession NM_014812). Accordingly, utilities of VGAM624 include diagnosis, prevention and treatment of diseases and clinical conditions associated with KIAA0470. PRSC (Accession NM_006587) is another VGAM624 host target gene. PRSC BINDING SITE is HOST TARGET binding site found in the 3" untranslated region of mRNA encoded by PRSC, corresponding to a HOST TARGET binding site such as BINDING SITE I, BINDING SITE II or BINDING SITE III. Table 2 illustrates the complementarity of the nucleotide sequences of PRSC BINDING SITE, designated SEQ ID:13349, to the nucleotide sequence of VGAM624 RNA, herein designated VGAM RNA, also designated SEQ ID:3335.

Another function of VGAM624 is therefore inhibition of PRSC (Accession NM_006587). Accordingly, utilities of VGAM624 include diagnosis, prevention and treatment of diseases and clinical conditions associated with PRSC. Serum Response Factor (c-fos serum response element-binding transcription factor) (SRF, Accession NM_003131) is another VGAM624 host target gene. SRF BINDING SITE is HOST TARGET binding site found in the 3' untranslated region of mRNA encoded by SRF, corresponding to a HOST TARGET binding site such as BINDING SITE I, BINDING SITE II or BINDING SITE III. Table 2 illustrates the complementarity of the nucleotide sequences of SRF BINDING SITE, designated SEQ ID:9100, to the nucleotide sequence of VGAM624 RNA, herein designated VGAM RNA, also designated SEQ ID:3335.

Another function of VGAM624 is therefore inhibition of Serum Response Factor (c-fos serum response element-binding transcription factor) (SRF, Accession NM_003131). Accordingly, utilities of VGAM624 include diagnosis, prevention and treatment of diseases and clinical conditions associated with SRF. Transmembrane 4 Superfamily Member 11 (plasmolipin) (TM4SF11, Accession NM_015993) is another VGAM624 host target gene. TM4SF11 BINDING SITE is HOST TARGET binding site found in the 3" untranslated region of mRNA encoded by TM4SF11, corresponding to a HOST TARGET binding site such as BINDING SITE I, BINDING SITE II or BINDING SITE III. Table 2 illustrates the complementarity of the nucleotide sequences of TM4SF11 BINDING SITE, designated SEQ ID:18086, to the nucleotide sequence of VGAM624 RNA, herein designated VGAM RNA, also designated SEQ ID:3335.

Another function of VGAM624 is therefore inhibition of Transmembrane 4 Superfamily Member 11 (plasmolipin) (TM4SF11, Accession NM_015993). Accordingly, utilities of VGAM624 include diagnosis, prevention and treatment of diseases and clinical conditions associated with TM4SF11. TRIP-Br2 (Accession NM_014755) is another VGAM624 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16485, to the nucleotide sequence of VGAM624 RNA, herein designated VGAM RNA, also designated SEQ ID:3335.

Another function of VGAM624 is therefore inhibition of TRIP-Br2 (Accession NM_014755). Accordingly, utilities of VGAM624 include diagnosis, prevention and treatment of diseases and clinical conditions associated with TRIP-Br2. Ubiquitination Factor E4B (UFD2 homolog, yeast) (UBE4B, Accession NM_006048) is another VGAM624 host target gene. UBE4B BINDING SITE is HOST TARGET binding site found in the 3' untranslated region of mRNA encoded by UBE4B, corresponding to a HOST TARGET binding site such as BINDING SITE I, BINDING SITE II or BINDING SITE III. Table 2 illustrates the complementarity of the nucleotide sequences of UBE4B BINDING SITE, designated SEQ ID:12682, to the nucleotide sequence of VGAM624 RNA, herein designated VGAM RNA, also designated SEQ ID:3335.

Another function of VGAM624 is therefore inhibition of Ubiquitination Factor E4B (UFD2 homolog, yeast) (UBE4B, Accession NM_006048). Accordingly, utilities of VGAM624 include diagnosis, prevention and treatment of diseases and clinical conditions associated with UBE4B. LOC115219 (Accession XM_055499) is another VGAM624 host target gene. LOC115219 BINDING SITE is HOST TARGET binding site found in the 3' untranslated region of mRNA encoded by LOC115219, corresponding to a HOST TARGET binding site such as BINDING SITE I, BINDING SITE II or BINDING SITE III. Table 2 illustrates the complementarity of the nucleotide sequences of LOC115219 BINDING SITE, designated SEQ ID:36280, to the nucleotide sequence of VGAM624 RNA, herein designated VGAM RNA, also designated SEQ ID:3335.

Another function of VGAM624 is therefore inhibition of LOC115219 (Accession XM_055499). Accordingly, utilities of VGAM624 include diagnosis, prevention and treatment of diseases and clinical conditions associated with LOC115219. LOC126526 (Accession XM_059053) is another VGAM624 host target gene. LOC126526 BINDING SITE is HOST TARGET binding site found in the 5' untranslated region of mRNA encoded by LOC126526, corresponding to a HOST TARGET binding site such as BINDING SITE I, BINDING SITE II or BINDING SITE III. Table 2 illustrates the complementarity of the nucleotide sequences of LOC126526 BINDING SITE, designated SEQ ID:36846, to the nucleotide sequence of VGAM624 RNA, herein designated VGAM RNA, also designated SEQ ID:3335.

Another function of VGAM624 is therefore inhibition of LOC126526 (Accession XM_059053). Accordingly, utilities of VGAM624 include diagnosis, prevention and treatment of diseases and clinical conditions associated with LOC126526. LOC143286 (Accession XM_096412) is another VGAM624 host target gene. LOC143286 BINDING SITE is HOST TARGET binding site found in the 5' untranslated region of mRNA encoded by LOC143286, corresponding to a HOST TARGET binding site such as BINDING SITE I, BINDING SITE II or BINDING SITE III. Table 2 illustrates the complementarity of the nucleotide sequences of LOC143286 BINDING SITE, designated SEQ ID:40355, to the nucleotide sequence of VGAM624 RNA, herein designated VGAM RNA, also designated SEQ ID:3335.

Another function of VGAM624 is therefore inhibition of LOC143286 (Accession XM_096412). Accordingly, utilities of VGAM624 include diagnosis, prevention and treatment of diseases and clinical conditions associated with LOC143286. LOC165693 (Accession XM_093373) is another VGAM624 host target gene. LOC165693 BINDING SITE is HOST TARGET binding site found in the 5' untranslated region of mRNA encoded by LOC165693, corresponding to a HOST TARGET binding site such as BINDING SITE I, BINDING SITE II or BINDING SITE III. Table 2 illustrates the complementarity of the nucleotide sequences of LOC165693 BINDING SITE, designated SEQ ID:40187, to the nucleotide sequence of VGAM624 RNA, herein designated VGAM RNA, also designated SEQ ID:3335.

Another function of VGAM624 is therefore inhibition of LOC165693 (Accession XM_093373). Accordingly, utilities of VGAM624 include diagnosis, prevention and treatment of diseases and clinical conditions associated with LOC165693. LOC220020 (Accession XM_167821) is another VGAM624 host target gene. LOC220020 BINDING SITE is HOST TARGET binding site found in the 5' untranslated region of mRNA encoded by LOC220020, corresponding to a HOST TARGET binding site such as BINDING SITE I, BINDING SITE II or BINDING SITE III. Table 2 illustrates the complementarity of the nucleotide sequences of LOC220020 BINDING SITE, designated SEQ ID:44865, to the nucleotide sequence of VGAM624 RNA, herein designated VGAM RNA, also designated SEQ ID:3335.

Another function of VGAM624 is therefore inhibition of LOC220020 (Accession XM_167821). Accordingly, utilities of VGAM624 include diagnosis, prevention and treatment of diseases and clinical conditions associated with LOC220020. LOC220766 (Accession XM_165471) is another VGAM624 host target gene. LOC220766 BINDING SITE is HOST TARGET binding site found in the 3' untranslated region of mRNA encoded by LOC220766, corresponding to a HOST TARGET binding site such as BINDING SITE I, BINDING SITE II or BINDING SITE III. Table 2 illustrates the complementarity of the nucleotide sequences of LOC220766 BINDING SITE, designated SEQ ID:43651, to the nucleotide sequence of VGAM624 RNA, herein designated VGAM RNA, also designated SEQ ID:3335.

Another function of VGAM624 is therefore inhibition of LOC220766 (Accession XM_165471). Accordingly, utilities of VGAM624 include diagnosis, prevention and treatment of diseases and clinical conditions associated with LOC220766. LOC254826 (Accession XM_173188) is another VGAM624 host target gene. LOC254826 BINDING SITE is HOST TARGET binding site found in the 3' untranslated region of mRNA encoded by LOC254826, corresponding to a HOST TARGET binding site such as BINDING SITE I, BINDING SITE II or BINDING SITE III. Table 2 illustrates the complementarity of the nucleotide sequences of LOC254826 BINDING SITE, designated SEQ ID:46434, to the nucleotide sequence of VGAM624 RNA, herein designated VGAM RNA, also designated SEQ ID:3335.

Another function of VGAM624 is therefore inhibition of LOC254826 (Accession XM_173188). Accordingly, utilities of VGAM624 include diagnosis, prevention and treatment of diseases and clinical conditions associated with LOC254826. LOC257554 (Accession XM_175149) is another VGAM624 host target gene. LOC257554 BINDING SITE is HOST TARGET binding site found in the 5' untranslated region of mRNA encoded by LOC257554, corresponding to a HOST TARGET binding site such as BINDING SITE I, BINDING SITE II or BINDING SITE III. Table 2 illustrates the complementarity of the nucleotide sequences of LOC257554 BINDING SITE, designated SEQ ID:46641, to the nucleotide sequence of VGAM624 RNA, herein designated VGAM RNA, also designated SEQ ID:3335.

Another function of VGAM624 is therefore inhibition of LOC257554 (Accession XM_175149). Accordingly, utilities of VGAM624 include diagnosis, prevention and treatment of diseases and clinical conditions associated with LOC257554. LOC92568 (Accession XM_045852) is another VGAM624 host target gene. LOC92568 BINDING SITE is HOST TARGET binding site found in the 3' untranslated region of mRNA encoded by LOC92568, corresponding to a HOST TARGET binding site such as BINDING SITE I, BINDING SITE II or BINDING SITE III. Table 2 illustrates the complementarity of the nucleotide sequences of LOC92568 BINDING SITE, designated SEQ ID:34573, to the nucleotide sequence of VGAM624 RNA, herein designated VGAM RNA, also designated SEQ ID:3335.

Another function of VGAM624 is therefore inhibition of LOC92568 (Accession XM_045852). Accordingly, utilities of VGAM624 include diagnosis, prevention and treatment of diseases and clinical conditions associated with LOC92568. FIG. 1 further provides a conceptual description of a novel bioinformatically detected viral gene of the present invention, referred to here as Viral Genomic Address Messenger 625 (VGAM625) viral gene, which modulates expression of respective host target genes thereof, the function and utility of which host target genes is known in the art.

VGAM625 is a novel bioinformatically detected regulatory, non protein coding, viral micro RNA (miRNA) gene. The method by which VGAM625 was detected is described hereinabove with reference to FIGS. 1-8.

VGAM625 gene, herein designated VGAM GENE, is a viral gene contained in the genome of Hepatitis GB Virus C. VGAM625 host target gene, herein designated VGAM HOST TARGET GENE, is a human gene contained in the human genome.

VGAM625 gene encodes a VGAM625 precursor RNA, herein designated VGAM PRECURSOR RNA. Similar to other miRNA genes, and unlike most ordinary genes, VGAM625 precursor RNA does not encode a protein. A nucleotide sequence identical or highly similar to the nucleotide sequence of VGAM625 precursor RNA is designated SEQ ID:611, and is provided hereinbelow with reference to the sequence listing part. Nucleotide sequence SEQ ID:611 is located at position 6632 relative to the genome of Hepatitis GB Virus C.

VGAM625 precursor RNA folds onto itself, forming VGAM625 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM625 folded precursor RNA into VGAM625 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM625 RNA is designated SEQ ID:3336, and is provided hereinbelow with reference to the sequence listing part.

VGAM625 host target gene, herein designated VGAM HOST TARGET GENE, encodes a corresponding messenger RNA, VGAM625 host target RNA, herein designated VGAM HOST TARGET RNA. VGAM625 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM625 RNA, herein designated VGAM RNA, binds complementarily to one or more host target binding sites located in untranslated regions of VGAM625 host target RNA, herein designated VGAM HOST TARGET RNA. This complementary binding is due to the fact that the nucleotide sequence of VGAM625 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM625 RNA, herein designated VGAM RNA, may have a different number of host target binding sites in untranslated regions of a VGAM625 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM625 RNA, herein designated VGAM RNA, to host target binding sites on VGAM625 host target RNA, herein designated VGAM HOST TARGET RNA, such as BINDING SITE I, BINDING SITE II and BINDING SITE III, inhibits translation of VGAM625 host target RNA into VGAM625 host target protein, herein designated VGAM HOST TARGET PROTEIN. VGAM host target protein is therefore outlined by a broken line.

It is appreciated that VGAM625 host target gene, herein designated VGAM HOST TARGET GENE, in fact represents a plurality of VGAM625 host target genes. The mRNA of each one of this plurality of VGAM625 host target genes comprises one or more host target binding sites, each having a nucleotide sequence which is at least partly complementary to VGAM625 RNA, herein designated VGAM RNA, and which when bound by VGAM625 RNA causes inhibition of translation of respective one or more VGAM625 host target proteins.

It is further appreciated by one skilled in the art that the mode of translational inhibition illustrated by FIG. 1 with specific reference to translational inhibition exerted by VGAM625 gene, herein designated VGAM GENE, on one or more VGAM625 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM625 is inhibition of expression of host target genes, as part of a novel viral mechanism of attacking a host. Accordingly, utilities of VGAM625 include diagnosis, prevention and treatment of viral infection by Hepatitis GB Virus C. Specific functions, and accordingly utilities, of VGAM625 correlate with, and may be deduced from, the identity of the host target genes which VGAM625 binds and inhibits, and the function of these host target genes, as elaborated hereinbelow.

Nucleotide sequences of the VGAM625 precursor RNA, herein designated VGAM PRECURSOR RNA, and of the 'diced' VGAM625 RNA, herein designated VGAM RNA, and a schematic representation of the secondary folding of VGAM625 folded precursor RNA, herein designated VGAM FOLDED PRECURSOR RNA, of VGAM625 are further described hereinbelow with reference to Table 1.

Nucleotide sequences of host target binding sites, such as BINDING SITE-I, BINDING SITE-II and BINDING SITE-III of FIG. 1, found on VGAM625 host target RNA, and schematic representation of the complementarity of each of these host target binding sites to VGAM625 RNA, herein designated VGAM RNA, are described hereinbelow with reference to Table 2.

As mentioned hereinabove with reference to FIG. 1, a function of VGAM625 gene, herein designated VGAM is inhibition of expression of VGAM625 target genes. It is appreciated that specific functions, and accordingly utilities, of VGAM625 correlate with, and may be deduced from, the identity of the target genes which VGAM625 binds and inhibits, and the function of these target genes, as elaborated hereinbelow.

Aryl-hydrocarbon Receptor Nuclear Translocator 2 (ARNT2, Accession NM_014862) is a VGAM625 host target gene. ARNT2 BINDING SITE is HOST TARGET binding site found in the 3' untranslated region of mRNA encoded by ARNT2, corresponding to a HOST TARGET binding site such as BINDING SITE I, BINDING SITE II or BINDING SITE III. Table 2 illustrates the complementarity of the nucleotide sequences of ARNT2 BINDING SITE, designated SEQ ID:16934, to the nucleotide sequence of VGAM625 RNA, herein designated VGAM RNA, also designated SEQ ID:3336.

A function of VGAM625 is therefore inhibition of Aryl-hydrocarbon Receptor Nuclear Translocator 2 (ARNT2, Accession NM_014862), a gene which specifically recognizes the xenobiotic response element (xre). Accordingly, utilities of VGAM625 include diagnosis, prevention and treatment of diseases and clinical conditions associated with ARNT2. The function of ARNT2 and its association with various diseases and clinical conditions, has been established by previous studies, as described hereinabove with reference to VGAM345. Otoferlin (OTOF, Accession NM_004802) is another VGAM625 host target gene. OTOF BINDING SITE is HOST TARGET binding site found in the 3' untranslated region of mRNA encoded by OTOF, corresponding to a HOST TARGET binding site such as BINDING SITE I, BINDING SITE II or BINDING SITE III. Table 2 illustrates the complementarity of the nucleotide sequences of OTOF BINDING SITE, designated SEQ ID:11224, to the nucleotide sequence of VGAM625 RNA, herein designated VGAM RNA, also designated SEQ ID:3336.

Another function of VGAM625 is therefore inhibition of Otoferlin (OTOF, Accession NM_004802), a gene which is involved in vesicle membrane fusion and required for inner ear function. Accordingly, utilities of VGAM625 include diagnosis, prevention and treatment of diseases and clinical conditions associated with OTOF. The function of OTOF has been established by previous studies. Using a candidate gene approach, Yasunaga et al. (1999) identified a novel human gene, which they called OTOF, mutation in which causes DFNB9 (OMIM Ref. No. 601071). DFNB9 had been linked to chromosome 2p23.1, between D2S2303 and D2S174. Yasunaga et al. (1999) refined the interval to a 1-cM interval between D2S158 and D2S174. A contig of YACs, BACs, and PACs was constructed, and 2 genes, HADHB and CENPA, and 4 ESTs were assigned to the interval. The genes were excluded as candidates for DFNB9 by function. The ESTs were submitted to rounds of 5-prime RACE-PCR and the deduced amino acids were compared with clones isolated from 2 subtracted mouse cochlear cDNA libraries. The human OTOF gene encodes a 4,954-bp transcript with a 3,690-bp open reading frame and a 1,038-bp 3-prime untranslated region with a polyadenylation signal at position 4934. The 1,230-amino acid protein has a calculated molecular mass of 140.5 kD. It has 3 C2 domains and a single carboxy-terminal transmembrane domain. The protein is homologous to the C. elegans spermatogenesis factor FER-1 and human dysferlin (OMIM Ref. No. 603009), prompting the authors to name it 'otoferlin.' The homology suggests the otoferlin is involved in vesicle membrane fusion. The OTOF gene extends over 21 kb and contains 28 coding exons and a 5-prime untranslated region exon. Otof expression was identified by RT-PCR in mouse cochlea, vestibule, and brain. By in situ hybridization, Otof labeling was seen in the inner hair cells, and faintly in the outer hair cells and spiral ganglion cells, at embryonic day 19.5, P0, and P2. Neuroepithelia of the utricle, saccule, and semicircular canals expressed Otof during the same days. Type I cells, but not type II cells or supporting cells, expressed Otof. By Northern blot analysis, Yasunaga et al. (2000) detected a 7-kb otoferlin mRNA in the human brain. They isolated a corresponding cDNA, which was predicted to encode a 1,977-long form of otoferlin with 6 C2 domains. They found that the human OTOF gene contains 48 coding exons and spans approximately 90 kb. Other alternatively spliced transcripts were detected, which predicted several long isoforms (with 6 C2 domains) in human S and mice and short isoforms (3 C2 domains) only in human S. Yasunaga et al. (2000) studied a consanguineous family originating from India in which 3 sibs suffered from severe to profound hearing loss. By segregation analysis with polymorphic markers of the DFNB9 chromosomal region, they concluded that an OTOF mutation was likely to underlie deafness in this family. By sequencing the 48 OTOF coding exons in members of this family, they identified a splice mutation in intron 8 (603681.0002). These studies demonstrated that the long otoferlin isoforms are By Northern blot analysis, Yasunaga et al. (2000) detected a 7-kb otoferlin mRNA in the human brain. They isolated a corresponding cDNA, which was predicted to encode a 1,977-long form of otoferlin with 6 C2 domains. They found that the human OTOF gene contains 48 coding exons and spans approximately 90 kb. Other alternatively spliced transcripts were detected, which predicted several long isoforms (with 6 C2 domains) in human S and mice and short isoforms (3 C2 domains) only in human S. Yasunaga et al. (2000) studied a consanguineous family originating from India in which 3 sibs suffered from severe to profound hearing loss. By segregation analysis with polymorphic markers of the DFNB9 chromosomal region, they concluded that an OTOF mutation was likely to underlie deafness in this family. By sequencing the 48 OTOF coding exons in members of this family, they identified a splice mutation in intron 8 (603681.0002). These studies demonstrated that the long otoferlin isoforms are required for inner ear function.

Full details of the abovementioned studies are described in the following publications, the disclosure of which are hereby incorporated by reference:

Yasunaga, S.; Grati, M.; Chardenoux, S.; Smith, T. N.; Friedman, T. B.; Lalwani, A. K.; Wilcox, E. R.; Petit, C.: OTOF encodes multiple long and short isoforms: genetic evidence that the long ones underlie recessive deafness DFNB9. Am. J. Hum. Genet. 67:591-600, 2000; and Yasunaga, S.; Grati, M.; Cohen-Salmon, M.; El-Amraoui, A.; Mustapha, M.; Salem, N.; El-Zir, E.; Loiselet, J.; Petit, C.: A mutation in OTOF, encoding otoferlin, a FER-1-like protein, c.

Further studies establishing the function and utilities of OTOF are found in John Hopkins OMIM database record ID 603681, and in sited publications numbered 8486-8487, 786 and 8488 listed in the bibliography section hereinbelow, which are also hereby incorporated by reference. Regulator of G-protein Signalling 3 (RGS3, Accession NM_134427) is another VGAM625 host target gene. RGS3 BINDING SITE is HOST TARGET binding site found in the 5' untranslated region of mRNA encoded by RGS3, corresponding to a HOST TARGET binding site such as BINDING SITE I, BINDING SITE II or BINDING SITE III. Table 2 illustrates the complementarity of the nucleotide sequences of RGS3 BINDING SITE, designated SEQ ID:28669, to the nucleotide sequence of VGAM625 RNA, herein designated VGAM RNA, also designated SEQ ID:3336.

Another function of VGAM625 is therefore inhibition of Regulator of G-protein Signalling 3 (RGS3, Accession NM_134427), a gene which negatively regulates G protein-coupled receptor signalling. Accordingly, utilities of VGAM625 include diagnosis, prevention and treatment of diseases and clinical conditions associated with RGS3. The function of RGS3 and its association with various diseases and clinical conditions, has been established by previous studies, as described hereinabove with reference to VGAM404. Transcription Factor 7 (T-cell specific, HMG-box) (TCF7, Accession NM_003202) is another VGAM625 host target gene. TCF7 BINDING SITE is HOST TARGET binding site found in the 3' untranslated region of mRNA encoded by TCF7, corresponding to a HOST TARGET binding site such as BINDING SITE I, BINDING SITE II or BINDING SITE III. Table 2 illustrates the complementarity of the nucleotide sequences of TCF7 BINDING SITE, designated SEQ ID:9194, to the nucleotide sequence of VGAM625 RNA, herein designated VGAM RNA, also designated SEQ ID:3336.

Another function of VGAM625 is therefore inhibition of Transcription Factor 7 (T-cell specific, HMG-box) (TCF7, Accession NM_003202). Accordingly, utilities of VGAM625 include diagnosis, prevention and treatment of diseases and clinical conditions associated with TCF7. ABLIM (Accession NM_002313) is another VGAM625 host target gene. ABLIM BINDING SITE1 and ABLIM BINDING SITE2 are HOST TARGET binding sites found in untranslated regions of mRNA encoded by ABLIM, corresponding to HOST TARGET binding sites such as BINDING SITE I, BINDING SITE II or BINDING SITE III. Table 2 illustrates the complementarity of the nucleotide sequences of ABLIM BINDING SITE1 and ABLIM BINDING SITE2, designated SEQ ID:8115 and SEQ ID:13548 respectively, to the nucleotide sequence of VGAM625 RNA, herein designated VGAM RNA, also designated SEQ ID:3336.

Another function of VGAM625 is therefore inhibition of ABLIM (Accession NM_002313). Accordingly, utilities of VGAM625 include diagnosis, prevention and treatment of diseases and clinical conditions associated with ABLIM. DKFZP564L0864 (Accession XM_051905) is another VGAM625 host target gene. DKFZP564L0864 BINDING SITE is HOST TARGET binding site found in the 3' untranslated region of mRNA encoded by DKFZP564L0864, corresponding to a HOST TARGET binding site such as BINDING SITE I, BINDING SITE II or BINDING SITE III. Table 2 illustrates the complementarity of the nucleotide sequences of DKFZP564L0864 BINDING SITE, designated SEQ ID:35920, to the nucleotide sequence of VGAM625 RNA, herein designated VGAM RNA, also designated SEQ ID:3336.

Another function of VGAM625 is therefore inhibition of DKFZP564L0864 (Accession XM_051905). Accordingly, utilities of VGAM625 include diagnosis, prevention and treatment of diseases and clinical conditions associated with DKFZP564L0864. FLJ12552 (Accession NM_022832) is another VGAM625 host target gene. FLJ12552 BINDING SITE is HOST TARGET binding site found in the 3' untranslated region of mRNA encoded by FLJ12552, corresponding to a HOST TARGET binding site such as BINDING SITE I, BINDING SITE II or BINDING SITE III. Table 2 illustrates the complementarity of the nucleotide sequences of FLJ12552 BINDING SITE, designated SEQ ID:23114, to the nucleotide sequence of VGAM625 RNA, herein designated VGAM RNA, also designated SEQ ID:3336.

Another function of VGAM625 is therefore inhibition of FLJ12552 (Accession NM_022832). Accordingly, utilities of VGAM625 include diagnosis, prevention and treatment of diseases and clinical conditions associated with FLJ12552. FLJ22390 (Accession NM_022746) is another VGAM625 host target gene. FLJ22390 BINDING SITE is HOST TARGET binding site found in the 3' untranslated region of mRNA encoded by FLJ22390, corresponding to a HOST TARGET binding site such as BINDING SITE I, BINDING SITE II or BINDING SITE III. Table 2 illustrates the complementarity of the nucleotide sequences of FLJ22390 BINDING SITE, designated SEQ ID:22958, to the nucleotide sequence of VGAM625 RNA, herein designated VGAM RNA, also designated SEQ ID:3336.

Another function of VGAM625 is therefore inhibition of FLJ22390 (Accession NM_022746). Accordingly, utilities of VGAM625 include diagnosis, prevention and treatment of diseases and clinical conditions associated with FLJ22390. KIAA0210 (Accession NM_014744) is another VGAM625 host target gene. KIAA0210 BINDING SITE is HOST TARGET binding site found in the 3' untranslated region of mRNA encoded by KIAA0210, corresponding to a HOST TARGET binding site such as BINDING SITE I, BINDING SITE II or BINDING SITE III. Table 2 illustrates the complementarity of the nucleotide sequences of KIAA0210 BINDING SITE, designated SEQ ID:16422, to the nucleotide sequence of VGAM625 RNA, herein designated VGAM RNA, also designated SEQ ID:3336.

Another function of VGAM625 is therefore inhibition of KIAA0210 (Accession NM_014744). Accordingly, utilities of VGAM625 include diagnosis, prevention and treatment of diseases and clinical conditions associated with KIAA0210. Nuclear Receptor Subfamily 1, Group I, Member 3 (NR1I3, Accession NM_005122) is another VGAM625 host target gene. NR1I3 BINDING SITE is HOST TARGET binding site found in the 5' untranslated region of mRNA encoded by NR1I3, corresponding to a HOST TARGET binding site such as BINDING SITE I, BINDING SITE II or BINDING SITE III. Table 2 illustrates the complementarity of the nucleotide sequences of NR1I3 BINDING SITE, designated SEQ ID:11605, to the nucleotide sequence of VGAM625 RNA, herein designated VGAM RNA, also designated SEQ ID:3336.

Another function of VGAM625 is therefore inhibition of Nuclear Receptor Subfamily 1, Group I, Member 3 (NR1I3, Accession NM_005122). Accordingly, utilities of VGAM625 include diagnosis, prevention and treatment of diseases and clinical conditions associated with NR1I3. Sema Domain, Transmembrane Domain (TM), and Cytoplasmic Domain, (semaphorin) 6B (SEMA6B, Accession NM_032108) is another VGAM625 host target gene. SEMA6B BINDING SITE is HOST TARGET binding site found in the 3' untranslated region of mRNA encoded by SEMA6B, corresponding to a HOST TARGET binding site such as BINDING SITE I, BINDING SITE II or BINDING SITE III. Table 2 illustrates the complementarity of the nucleotide sequences of SEMA6B BINDING SITE, designated SEQ ID:25800, to the nucleotide sequence of VGAM625 RNA, herein designated VGAM RNA, also designated SEQ ID:3336.

Another function of VGAM625 is therefore inhibition of Sema Domain, Transmembrane Domain (TM), and Cytoplasmic Domain, (semaphorin) 6B (SEMA6B, Accession NM_032108). Accordingly, utilities of VGAM625 include diagnosis, prevention and treatment of diseases and clinical conditions associated with SEMA6B. SV2 (Accession NM_014849) is another VGAM625 host target gene. SV2 BINDING SITE is HOST TARGET binding site found in the 3' untranslated region of mRNA encoded by SV2, corresponding to a HOST TARGET binding site such as BINDING SITE I, BINDING SITE II or BINDING SITE III. Table 2 illustrates the complementarity of the nucleotide sequences of SV2 BINDING SITE, designated SEQ ID:16884, to the nucleotide sequence of VGAM625 RNA, herein designated VGAM RNA, also designated SEQ ID:3336.

Another function of VGAM625 is therefore inhibition of SV2 (Accession NM_014849). Accordingly, utilities of VGAM625 include diagnosis, prevention and treatment of diseases and clinical conditions associated with SV2. LOC133814 (Accession XM_068546) is another VGAM625 host target gene. LOC133814 BINDING SITE is HOST TARGET binding site found in the 5' untranslated region of mRNA encoded by LOC133814, corresponding to a HOST TARGET binding site such as BINDING SITE I, BINDING SITE II or BINDING SITE III. Table 2 illustrates the complementarity of the nucleotide sequences of LOC133814 BINDING SITE, designated SEQ ID:37381, to the nucleotide sequence of VGAM625 RNA, herein designated VGAM RNA, also designated SEQ ID:3336.

Another function of VGAM625 is therefore inhibition of LOC133814 (Accession XM_068546). Accordingly, utilities of VGAM625 include diagnosis, prevention and treatment of diseases and clinical conditions associated with LOC133814. LOC146227 (Accession XM_085374) is another VGAM625 host target gene. LOC146227 BINDING SITE is HOST TARGET binding site found in the 3' untranslated region of mRNA encoded by LOC146227, corresponding to a HOST TARGET binding site such as BINDING SITE I, BINDING SITE II or BINDING SITE III. Table 2 illustrates the complementarity of the nucleotide sequences of LOC146227 BINDING SITE, designated SEQ ID:38088, to the nucleotide sequence of VGAM625 RNA, herein designated VGAM RNA, also designated SEQ ID:3336.

Another function of VGAM625 is therefore inhibition of LOC146227 (Accession XM_085374). Accordingly, utilities of VGAM625 include diagnosis, prevention and treatment of diseases and clinical conditions associated with LOC146227. LOC152674 (Accession XM_098251) is another VGAM625 host target gene. LOC152674 BINDING SITE is HOST TARGET binding site found in the 3' untranslated region of mRNA encoded by LOC152674, corresponding to a HOST TARGET binding site such as BINDING SITE I, BINDING SITE II or BINDING SITE III. Table 2 illustrates the complementarity of the nucleotide sequences of LOC152674 BINDING SITE, designated SEQ ID:41539, to the nucleotide sequence of VGAM625 RNA, herein designated VGAM RNA, also designated SEQ ID:3336.

Another function of VGAM625 is therefore inhibition of LOC152674 (Accession XM_098251). Accordingly, utilities of VGAM625 include diagnosis, prevention and treatment of diseases and clinical conditions associated with LOC152674. LOC197287 (Accession XM_027541) is another VGAM625 host target gene. LOC197287 BINDING SITE is HOST TARGET binding site found in the 3' untranslated region of mRNA encoded by LOC197287, corresponding to a HOST TARGET binding site such as BINDING SITE I, BINDING SITE II or BINDING SITE III. Table 2 illustrates the complementarity of the nucleotide sequences of LOC197287 BINDING SITE, designated SEQ ID:30522, to the nucleotide sequence of VGAM625 RNA, herein designated VGAM RNA, also designated SEQ ID:3336.

Another function of VGAM625 is therefore inhibition of LOC197287 (Accession XM_027541). Accordingly, utilities of VGAM625 include diagnosis, prevention and treatment of diseases and clinical conditions associated with LOC197287. FIG. 1 further provides a conceptual description of a novel bioinformatically detected viral gene of the present invention, referred to here as Viral Genomic Address Messenger 626 (VGAM626) viral gene, which modulates expression of respective host target genes thereof, the function and utility of which host target genes is known in the art.

VGAM626 is a novel bioinformatically detected regulatory, non protein coding, viral micro RNA (miRNA) gene. The method by which VGAM626 was detected is described hereinabove with reference to FIGS. 1-8.

VGAM626 gene, herein designated VGAM GENE, is a viral gene contained in the genome of Hepatitis GB Virus C. VGAM626 host target gene, herein designated VGAM HOST TARGET GENE, is a human gene contained in the human genome.

VGAM626 gene encodes a VGAM626 precursor RNA, herein designated VGAM PRECURSOR RNA. Similar to other miRNA genes, and unlike most ordinary genes, VGAM626 precursor RNA does not encode a protein. A nucleotide sequence identical or highly similar to the nucleotide sequence of VGAM626 precursor RNA is designated SEQ ID:612, and is provided hereinbelow with reference to the sequence listing part. Nucleotide sequence SEQ ID:612 is located at position 1889 relative to the genome of Hepatitis GB Virus C.

VGAM626 precursor RNA folds onto itself, forming VGAM626 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM626 folded precursor RNA into VGAM626 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM626 RNA is designated SEQ ID:3337, and is provided hereinbelow with reference to the sequence listing part.

VGAM626 host target gene, herein designated VGAM HOST TARGET GENE, encodes a corresponding messenger RNA, VGAM626 host target RNA, herein designated VGAM HOST TARGET RNA. VGAM626 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM626 RNA, herein designated VGAM RNA, binds complementarily to one or more host target binding sites located in untranslated regions of VGAM626 host target RNA, herein designated VGAM HOST TARGET RNA. This complementary binding is due to the fact that the nucleotide sequence of VGAM626 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM626 RNA, herein designated VGAM RNA, may have a different number of host target binding sites in untranslated regions of a VGAM626 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM626 RNA, herein designated VGAM RNA, to host target binding sites on VGAM626 host target RNA, herein designated VGAM HOST TARGET RNA, such as BINDING SITE I, BINDING SITE II and BINDING SITE III, inhibits translation of VGAM626 host target RNA into VGAM626 host target protein, herein designated VGAM HOST TARGET PROTEIN. VGAM host target protein is therefore outlined by a broken line.

It is appreciated that VGAM626 host target gene, herein designated VGAM HOST TARGET GENE, in fact represents a plurality of VGAM626 host target genes. The mRNA of each one of this plurality of VGAM626 host target genes comprises one or more host target binding sites, each having a nucleotide sequence which is at least partly complementary to VGAM626 RNA, herein designated VGAM RNA, and which when bound by VGAM626 RNA causes inhibition of translation of respective one or more VGAM626 host target proteins.

It is further appreciated by one skilled in the art that the mode of translational inhibition illustrated by FIG. 1 with specific reference to translational inhibition exerted by VGAM626 gene, herein designated VGAM GENE, on one or more VGAM626 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM626 is inhibition of expression of host target genes, as part of a novel viral mechanism of attacking a host. Accordingly, utilities of VGAM626 include diagnosis, prevention and treatment of viral infection by Hepatitis GB Virus C. Specific functions, and accordingly utilities, of VGAM626 correlate with, and may be deduced from, the identity of the host target genes which VGAM626 binds and inhibits, and the function of these host target genes, as elaborated hereinbelow.

Nucleotide sequences of the VGAM626 precursor RNA, herein designated VGAM PRECURSOR RNA, and of the 'diced' VGAM626 RNA, herein designated VGAM RNA, and a schematic representation of the secondary folding of VGAM626 folded precursor RNA, herein designated VGAM FOLDED PRECURSOR RNA, of VGAM626 are further described hereinbelow with reference to Table 1.

Nucleotide sequences of host target binding sites, such as BINDING SITE-I, BINDING SITE-II and BINDING SITE-III of FIG. 1, found on VGAM626 host target RNA, and schematic representation of the complementarity of each of these host target binding sites to VGAM626 RNA, herein designated VGAM RNA, are described hereinbelow with reference to Table 2.

As mentioned hereinabove with reference to FIG. 1, a function of VGAM626 gene, herein designated VGAM is inhibition of expression of VGAM626 target genes. It is appreciated that specific functions, and accordingly utilities, of VGAM626 correlate with, and may be deduced from, the identity of the target genes which VGAM626 binds and inhibits, and the function of these target genes, as elaborated hereinbelow.

Adrenergic, Beta, Receptor Kinase 1 (ADRBK1, Accession NM_001619) is a VGAM626 host target gene. ADRBK1 BINDING SITE is HOST TARGET binding site found in the 3' untranslated region of mRNA encoded by ADRBK1, corresponding to a HOST TARGET binding site such as BINDING SITE I, BINDING SITE II or BINDING SITE III. Table 2 illustrates the complementarity of the nucleotide sequences of ADRBK1 BINDING SITE, designated SEQ ID:7328, to the nucleotide sequence of VGAM626 RNA, herein designated VGAM RNA, also designated SEQ ID:3337.

A function of VGAM626 is therefore inhibition of Adrenergic, Beta, Receptor Kinase 1 (ADRBK1, Accession NM_001619), a gene which regulates desensitization of b-adrenergic receptors and related GPCRs. Accordingly, utilities of VGAM626 include diagnosis, prevention and treatment of diseases and clinical conditions associated with ADRBK1. The function of ADRBK1 has been established by previous studies. Beta-adrenergic receptor kinase (BARK) phosphorylates the beta-2-adrenergic receptor (OMIM Ref. No. 109690) and appears to mediate agonist-specific desensitization observed at high agonist concentrations. BARK is a ubiquitous cytosolic enzyme that specifically phosphorylates the activated form of the beta-adrenergic and related G protein-coupled receptors. Benovic et al. (1991) used the bovine BARK cDNA to screen a human retina library and isolate the human cDNA. They showed that it encodes a protein of 689 amino acids with an overall 98% amino acid and 92.5% nucleotide identity with bovine BARK. By study of rodent/human hybrid cells retaining various human chromosomes and parts of chromosomes, Benovic et al. (1991) demonstrated that the ADRBK1 gene segregates with the long arm of chromosome 11, centromeric to 11q13, i.e., 11cen-q13. Benovic et al. (1991) mapped the homologous gene to mouse chromosome 19. Animal model experiments lend further support to the function of ADRBK1. Rockman et al. (1998) mated transgenic mice with cardiac-restricted overexpression of either a peptide inhibitor of beta-ARK1 or the beta-2-AR into a genetic model of murine heart failure. They found that overexpression of the inhibitor prevented the development of cardiomyopathy in this murine model of heart failure.

It is appreciated that the abovementioned animal model for ADRBK1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Benovic, J. L.; Stone, W. C.; Huebner, K.; Croce, C.; Caron, M. G.; Lefkowitz, R. J.: cDNA cloning and chromosomal localization of the human beta-adrenergic receptor kinase. FEBS Lett. 283:122-126, 1991; and Rockman, H. A.; Chien, K. R.; Choi, D.-J.; Iaccarino, G.; Hunter, J. J.; Ross, J., Jr.; Lefkowitz, R. J.; Koch, W. J.: Expression of a beta-adrenergic receptor kinase 1 inhibitor preven.

Further studies establishing the function and utilities of ADRBK1 are found in John Hopkins OMIM database record ID 109635, and in sited publications numbered 1447-1451 listed in the bibliography section hereinbelow, which are also hereby incorporated by reference.24-dehydrocholesterol Reductase (DHCR24, Accession NM_014762) is another VGAM626 host target gene. DHCR24 BINDING SITE is HOST TARGET binding site found in the 3' untranslated region of mRNA encoded by DHCR24, corresponding to a HOST TARGET binding site such as BINDING SITE I, BINDING SITE II or BINDING SITE III. Table 2 illustrates the complementarity of the nucleotide sequences of DHCR24 BINDING SITE, designated SEQ ID:16525, to the nucleotide sequence of VGAM626 RNA, herein designated VGAM RNA, also designated SEQ ID:3337.

Another function of VGAM626 is therefore inhibition of 24-dehydrocholesterol Reductase (DHCR24, Accession NM_014762), a gene which catalyzes the reduction of sterol intermediates. Accordingly, utilities of VGAM626 include diagnosis, prevention and treatment of diseases and clinical conditions associated with DHCR24. The function of DHCR24 and its association with various diseases and clinical conditions, has been established by previous studies, as described hereinabove with reference to VGAM235. Follistatin-like 3 (secreted glycoprotein) (FSTL3, Accession NM_005860) is another VGAM626 host target gene. FSTL3 BINDING SITE is HOST TARGET binding site found in the 3' untranslated region of mRNA encoded by FSTL3, corresponding to a HOST TARGET binding site such as BINDING SITE I, BINDING SITE II or BINDING SITE III. Table 2 illustrates the complementarity of the nucleotide sequences of FSTL3 BINDING SITE, designated SEQ ID:12469, to the nucleotide sequence of VGAM626 RNA, herein designated VGAM RNA, also designated SEQ ID:3337.

Another function of VGAM626 is therefore inhibition of Follistatin-like 3 (secreted glycoprotein) (FSTL3, Accession NM_005860), a gene which is a member of the follistatin-module-protein family. Accordingly, utilities of VGAM626 include diagnosis, prevention and treatment of diseases and clinical conditions associated with FSTL3. The function of FSTL3 and its association with various diseases and clinical conditions, has been established by previous studies, as described hereinabove with reference to VGAM200. Lymphocyte Antigen 6 Complex, Locus E (LY6E, Accession NM_002346) is another VGAM626 host target gene. LY6E BINDING SITE is HOST TARGET binding site found in the 3' untranslated region of mRNA encoded by LY6E, corresponding to a HOST TARGET binding site such as BINDING SITE I, BINDING SITE II or BINDING SITE III. Table 2 illustrates the complementarity of the nucleotide sequences of LY6E BINDING SITE, designated SEQ ID:8147, to the nucleotide sequence of VGAM626 RNA, herein designated VGAM RNA, also designated SEQ ID:3337.

Another function of VGAM626 is therefore inhibition of Lymphocyte Antigen 6 Complex, Locus E (LY6E, Accession NM_002346). Accordingly, utilities of VGAM626 include diagnosis, prevention and treatment of diseases and clinical conditions associated with LY6E. NADH Dehydrogenase (ubiquinone) Flavoprotein 3, 10 kDa (NDUFV3, Accession NM_021075) is another VGAM626 host target gene. NDUFV3 BINDING SITE is HOST TARGET binding site found in the 5' untranslated region of mRNA encoded by NDUFV3, corresponding to a HOST TARGET binding site such as BINDING SITE I, BINDING SITE II or BINDING SITE III. Table 2 illustrates the complementarity of the nucleotide sequences of NDUFV3 BINDING SITE, designated SEQ ID:22044, to the nucleotide sequence of VGAM626 RNA, herein designated VGAM RNA, also designated SEQ ID:3337.

Another function of VGAM626 is therefore inhibition of NADH Dehydrogenase (ubiquinone) Flavoprotein 3, 10 kDa (NDUFV3, Accession NM_021075), a gene which transports electrons from NADH to ubiquinone. Accordingly, utilities of VGAM626 include diagnosis, prevention and treatment of diseases and clinical conditions associated with NDUFV3. The function of NDUFV3 has been established by previous studies. NADH:ubiquinone oxidoreductase (complex I; EC 1.6.5.3) is an inner mitochondrial membrane-bound multisubunit enzyme complex. Complex I consists of at least 41 subunits of which 7 are encoded by the mitochondrial genome. See MTND1 (OMIM Ref. No. 516000) through MTND6 (OMIM Ref. No. 516006). As one of the complexes of the mitochondrial respiratory chain, complex I functions in the catalysis of the rotenone-sensitive oxidation of NADH and the reduction of ubiquinone. By means of chaotropic agents, complex I can be resolved into 2 hydrophilic fractions, the flavoprotein fraction and the iron-protein fraction, and a hydrophobic fraction. The flavoprotein fraction comprises the 51-, 24-, and 10-kD subunits, all encoded by the nuclear genes NDUFV1 (OMIM Ref. No. 161015), NDUFV2 (OMIM Ref. No. 600532), and NDUFV3, respectively. This fraction plays a catalytic role in the oxidation of NADH as it is associated with flavoprotein and NAD binding. The 51-kD and 24-kD subunits are involved in electron transfer. The function of the 10-kD protein is unknown. The human gene for the 10-kD flavoprotein subunit was completely cloned and sequenced by de Coo et al. (1997). The NDUFV3 gene was found to contain 3 exons, spanning 20 kb. The open reading frame contains a 34-codon import sequence and a 74-codon mature protein sequence. Its homology to bovine and rat protein sequence was found but not to any other known protein. Northern blot analysis showed that the NDUFV3 gene is ubiquitously expressed. By fluorescence in situ hybridization, de Coo et al. (1997) assigned the NDUFV3 gene to 21q22.3, where it may play a dosage-dependent role in the phenotype of Down syndrome (OMIM Ref. No. 190685). Berry et al. (2000) found that NDUFV3 is located approximately 120 kb telomeric to PDE9A (OMIM Ref. No. 602973).

Full details of the abovementioned studies are described in the following publications, the disclosure of which are hereby incorporated by reference:

Berry, A.; Scott, H. S.; Kudoh, J.; Talior, I.; Korostishevsky, M.; Wattenhofer, M.; Guipponi, M.; Barras, C.; Rossier, C.; Shibuya, K.; Wang, J.; Kawasaki, K.; Asakawa, S.; Minoshima, S.; Shimizu, N.; Antonarakis, S.; Bonne-Tamir, B.: Refined localization of autosomal recessive nonsyndromic deafness DFNB10 locus using 34 novel microsatellite markers, genomic structure, and exclusion of six known genes in the region. Genomics 68:22-29, 2000; and de Coo, R. F. M.; Buddiger, P.; Smeets, H. J. M.; van Oost, B. A.: Molecular cloning and characterization of the human mitochondrial NADH:oxidoreductase 10-kDa gene (NDUFV3). Genomics.

Further studies establishing the function and utilities of NDUFV3 are found in John Hopkins OMIM database record ID 602184, and in sited publications numbered 786 and 8532 listed in the bibliography section hereinbelow, which are also hereby incorporated by reference. Upstream Binding Transcription Factor, RNA Polymerase I (UBTF, Accession NM_014233) is another VGAM626 host target gene. UBTF BINDING SITE is HOST TARGET binding site found in the 3" untranslated region of mRNA encoded by UBTF, corresponding to a HOST TARGET binding site such as BINDING SITE I, BINDING SITE II or BINDING SITE III. Table 2 illustrates the complementarity of the nucleotide sequences of UBTF BINDING SITE, designated SEQ ID:15497, to the nucleotide sequence of VGAM626 RNA, herein designated VGAM RNA, also designated SEQ ID:3337.

Another function of VGAM626 is therefore inhibition of Upstream Binding Transcription Factor, RNA Polymerase I (UBTF, Accession NM_014233), a gene which recognizes the ribosomal rna gene promoter and activates transcription. Accordingly, utilities of VGAM626 include diagnosis, prevention and treatment of diseases and clinical conditions associated with UBTF. The function of UBTF has been established by previous studies. Upstream binding factor (UBF) is a transcription factor required for expression of the 18S, 5.8S, and 28S ribosomal RNAs, along with SL1 (a complex of TBP (OMIM Ref. No. 600075) and multiple TBP-associated factors or 'TAFs'). Two UBF polypeptides, of 94 and 97 kD, exist in the human (Bell et al., 1988). UBF is a nucleolar phosphoprotein with both DNA binding and transactivation domains. Sequence-specific DNA binding to the core and upstream control elements of the human rRNA promoter is mediated through several HMG boxes (Jantzen et al., 1990). Jantzen et al. (1990) cloned human UBF by screening a HeLa cell cDNA library with DNA probes based on tryptic peptides of the protein. They found an open reading frame encoding the 764-amino acid UBF. The authors also characterized DNA binding characteristics of UBF. Chan et al. (1991) cloned the human cDNA by screening an expression library with a specific autoantibody that recognizes nucleolar organizing regions. Jones et al. (1995) mapped the gene, symbolized UBTF, to the BRCA1 region of 17q21 by analyzing genomic clones from that region. They found the gene order to be cen--PPY(OMIM Ref. No. 167780)--UBTF--EPB3 (OMIM Ref. No. 109270)--GP2B(OMIM Ref. No. 273800)--tel.

Full details of the abovementioned studies are described in the following publications, the disclosure of which are hereby incorporated by reference:

Jantzen, H.-M.; Admon, A.; Bell, S. P.; Tjian, R.: Nucleolar transcription factor hUBF contains a DNA-binding motif with homology to HMG proteins. Nature 344: 830-836, 1990; and Chan, E. K. L.; Imai, H.; Hamel, J. C.; Tan, E. M.: Human autoantibody to RNA polymerase I transcription factor hUBF: molecular identity of nucleolus organizer region autoantigen NOR-9.

Further studies establishing the function and utilities of UBTF are found in John Hopkins OMIM database record ID 600673, and in sited publications numbered 1310-1316 listed in the bibliography section hereinbelow, which are also hereby incorporated by reference. CD109 (Accession NM_133493) is another VGAM626 host target gene. CD109 BINDING SITE is HOST TARGET binding site found in the 3' untranslated region of mRNA encoded by CD109, corresponding to a HOST TARGET binding site such as BINDING SITE I, BINDING SITE II or BINDING SITE III. Table 2 illustrates the complementarity of the nucleotide sequences of CD109 BINDING SITE, designated SEQ ID:28571, to the nucleotide sequence of VGAM626 RNA, herein designated VGAM RNA, also designated SEQ ID:3337.

Another function of VGAM626 is therefore inhibition of CD109 (Accession NM_133493). Accordingly, utilities of VGAM626 include diagnosis, prevention and treatment of diseases and clinical conditions associated with CD109. DKFZP434N161 (Accession XM_085920) is another VGAM626 host target gene. DKFZP434N161 BINDING SITE is HOST TARGET binding site found in the 3' untranslated region of mRNA encoded by DKFZP434N161, corresponding to a HOST TARGET binding site such as BINDING SITE I, BINDING SITE II or BINDING SITE III. Table 2 illustrates the complementarity of the nucleotide sequences of DKFZP434N161 BINDING SITE, designated SEQ ID:38397, to the nucleotide sequence of VGAM626 RNA, herein designated VGAM RNA, also designated SEQ ID:3337.

Another function of VGAM626 is therefore inhibition of DKFZP434N161 (Accession XM_085920). Accordingly, utilities of VGAM626 include diagnosis, prevention and treatment of diseases and clinical conditions associated with DKFZP434N161. FLJ12750 (Accession NM_024667) is another VGAM626 host target gene. FLJ12750 BINDING SITE is HOST TARGET binding site found in the 3' untranslated region of mRNA encoded by FLJ12750, corresponding to a HOST TARGET binding site such as BINDING SITE I, BINDING SITE II or BINDING SITE III. Table 2 illustrates the complementarity of the nucleotide sequences of FLJ12750 BINDING SITE, designated SEQ ID:23971, to the nucleotide sequence of VGAM626 RNA, herein designated VGAM RNA, also designated SEQ ID:3337.

Another function of VGAM626 is therefore inhibition of FLJ12750 (Accession NM_024667). Accordingly, utilities of VGAM626 include diagnosis, prevention and treatment of diseases and clinical conditions associated with FLJ12750. KIAA0346 (Accession XM_043272) is another VGAM626 host target gene. KIAA0346 BINDING SITE is HOST TARGET binding site found in the 5' untranslated region of mRNA encoded by KIAA0346, corresponding to a HOST TARGET binding site such as BINDING SITE I, BINDING SITE II or BINDING SITE III. Table 2 illustrates the complementarity of the nucleotide sequences of KIAA0346 BINDING SITE, designated SEQ ID:33920, to the nucleotide sequence of VGAM626 RNA, herein designated VGAM RNA, also designated SEQ ID:3337.

Another function of VGAM626 is therefore inhibition of KIAA0346 (Accession XM_043272). Accordingly, utilities of VGAM626 include diagnosis, prevention and treatment of diseases and clinical conditions associated with KIAA0346. KIAA1023 (Accession NM_017604) is another VGAM626 host target gene. KIAA1023 BINDING SITE is HOST TARGET binding site found in the 3' untranslated region of mRNA encoded by KIAA1023, corresponding to a HOST TARGET binding site such as BINDING SITE I, BINDING SITE II or BINDING SITE III. Table 2 illustrates the complementarity of the nucleotide sequences of KIAA1023 BINDING SITE, designated SEQ ID:19089, to the nucleotide sequence of VGAM626 RNA, herein designated VGAM RNA, also designated SEQ ID:3337.

Another function of VGAM626 is therefore inhibition of KIAA1023 (Accession NM_017604). Accordingly, utilities of VGAM626 include diagnosis, prevention and treatment of diseases and clinical conditions associated with KIAA1023. KIAA1163 (Accession XM_086231) is another VGAM626 host target gene. KIAA1163 BINDING SITE is HOST TARGET binding site found in the 3' untranslated region of mRNA encoded by KIAA1163, corresponding to a HOST TARGET binding site such as BINDING SITE I, BINDING SITE II or BINDING SITE III. Table 2 illustrates the complementarity of the nucleotide sequences of KIAA1163 BINDING SITE, designated SEQ ID:38556, to the nucleotide sequence of VGAM626 RNA, herein designated VGAM RNA, also designated SEQ ID:3337.

Another function of VGAM626 is therefore inhibition of KIAA1163 (Accession XM_086231). Accordingly, utilities of VGAM626 include diagnosis, prevention and treatment of diseases and clinical conditions associated with KIAA1163. KIAA1465 (Accession XM_027396) is another VGAM626 host target gene. KIAA1465 BINDING SITE is HOST TARGET binding site found in the 3' untranslated region of mRNA encoded by KIAA1465, corresponding to a HOST TARGET binding site such as BINDING SITE I, BINDING SITE II or BINDING SITE III. Table 2 illustrates the complementarity of the nucleotide sequences of KIAA1465 BINDING SITE, designated SEQ ID:30503, to the nucleotide sequence of VGAM626 RNA, herein designated VGAM RNA, also designated SEQ ID:3337.

Another function of VGAM626 is therefore inhibition of KIAA1465 (Accession XM_027396). Accordingly, utilities of VGAM626 include diagnosis, prevention and treatment of diseases and clinical conditions associated with KIAA1465. SCYA14 (Accession NM_032962) is another VGAM626 host target gene. SCYA14 BINDING SITE1 and SCYA14 BINDING SITE2 are HOST TARGET binding sites found in untranslated regions of mRNA encoded by SCYA14, corresponding to HOST TARGET binding sites such as BINDING SITE I, BINDING SITE II or BINDING SITE III. Table 2 illustrates the complementarity of the nucleotide sequences of SCYA14 BINDING SITE1 and SCYA14 BINDING SITE2, designated SEQ ID:26773 and SEQ ID:10373 respectively, to the nucleotide sequence of VGAM626 RNA, herein designated VGAM RNA, also designated SEQ ID:3337.

Another function of VGAM626 is therefore inhibition of SCYA14 (Accession NM_032962). Accordingly, utilities of VGAM626 include diagnosis, prevention and treatment of diseases and clinical conditions associated with SCYA14. LOC148697 (Accession XM_086276) is another VGAM626 host target gene. LOC148697 BINDING SITE is HOST TARGET binding site found in the 5' untranslated region of mRNA encoded by LOC148697, corresponding to a HOST TARGET binding site such as BINDING SITE I, BINDING SITE II or BINDING SITE III. Table 2 illustrates the complementarity of the nucleotide sequences of LOC148697 BINDING SITE, designated SEQ ID:38573, to the nucleotide sequence of VGAM626 RNA, herein designated VGAM RNA, also designated SEQ ID:3337.

Another function of VGAM626 is therefore inhibition of LOC148697 (Accession XM_086276). Accordingly, utilities of VGAM626 include diagnosis, prevention and treatment of diseases and clinical conditions associated with LOC148697. LOC155179 (Accession XM_088169) is another VGAM626 host target gene. LOC155179 BINDING SITE is HOST TARGET binding site found in the 3' untranslated region of mRNA encoded by LOC155179, corresponding to a HOST TARGET binding site such as BINDING SITE I, BINDING SITE II or BINDING SITE III. Table 2 illustrates the complementarity of the nucleotide sequences of LOC155179 BINDING SITE, designated SEQ ID:39556, to the nucleotide sequence of VGAM626 RNA, herein designated VGAM RNA, also designated SEQ ID:3337.

Another function of VGAM626 is therefore inhibition of LOC155179 (Accession XM_088169). Accordingly, utilities of VGAM626 include diagnosis, prevention and treatment of diseases and clinical conditions associated with LOC155179. LOC219700 (Accession XM_167570) is another VGAM626 host target gene. LOC219700 BINDING SITE is HOST TARGET binding site found in the 5' untranslated region of mRNA encoded by LOC219700, corresponding to a HOST TARGET binding site such as BINDING SITE I, BINDING SITE II or BINDING SITE III. Table 2 illustrates the complementarity of the nucleotide sequences of LOC219700 BINDING SITE, designated SEQ ID:44702, to the nucleotide sequence of VGAM626 RNA, herein designated VGAM RNA, also designated SEQ ID:3337.

Another function of VGAM626 is therefore inhibition of LOC219700 (Accession XM_167570). Accordingly, utilities of VGAM626 include diagnosis, prevention and treatment of diseases and clinical conditions associated with LOC219700. LOC220753 (Accession XM_167549) is another VGAM626 host target gene. LOC220753 BINDING SITE is HOST TARGET binding site found in the 3' untranslated region of mRNA encoded by LOC220753, corresponding to a HOST TARGET binding site such as BINDING SITE I, BINDING SITE II or BINDING SITE III. Table 2 illustrates the complementarity of the nucleotide sequences of LOC220753 BINDING SITE, designated SEQ ID:44662, to the nucleotide sequence of VGAM626 RNA, herein designated VGAM RNA, also designated SEQ ID:3337.

Another function of VGAM626 is therefore inhibition of LOC220753 (Accession XM_167549). Accordingly, utilities of VGAM626 include diagnosis, prevention and treatment of diseases and clinical conditions associated with LOC220753. FIG. 1 further provides a conceptual description of a novel bioinformatically detected viral gene of the present invention, referred to here as Viral Genomic Address Messenger 627 (VGAM627) viral gene, which modulates expression of respective host target genes thereof, the function and utility of which host target genes is known in the art.

VGAM627 is a novel bioinformatically detected regulatory, non protein coding, viral micro RNA (miRNA) gene. The method by which VGAM627 was detected is described hereinabove with reference to FIGS. 1-8.

VGAM627 gene, herein designated VGAM GENE, is a viral gene contained in the genome of Hepatitis GB Virus C. VGAM627 host target gene, herein designated VGAM HOST TARGET GENE, is a human gene contained in the human genome.

VGAM627 gene encodes a VGAM627 precursor RNA, herein designated VGAM PRECURSOR RNA. Similar to other miRNA genes, and unlike most ordinary genes, VGAM627 precursor RNA does not encode a protein. A nucleotide sequence identical or highly similar to the nucleotide sequence of VGAM627 precursor RNA is designated SEQ ID:613, and is provided hereinbelow with reference to the sequence listing part. Nucleotide sequence SEQ ID:613 is located at position 1443 relative to the genome of Hepatitis GB Virus C.

VGAM627 precursor RNA folds onto itself, forming VGAM627 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM627 folded precursor RNA into VGAM627 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM627 RNA is designated SEQ ID:3338, and is provided hereinbelow with reference to the sequence listing part.

VGAM627 host target gene, herein designated VGAM HOST TARGET GENE, encodes a corresponding messenger RNA, VGAM627 host target RNA, herein designated VGAM HOST TARGET RNA. VGAM627 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM627 RNA, herein designated VGAM RNA, binds complementarily to one or more host target binding sites located in untranslated regions of VGAM627 host target RNA, herein designated VGAM HOST TARGET RNA. This complementary binding is due to the fact that the nucleotide sequence of VGAM627 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM627 RNA, herein designated VGAM RNA, may have a different number of host target binding sites in untranslated regions of a VGAM627 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM627 RNA, herein designated VGAM RNA, to host target binding sites on VGAM627 host target RNA, herein designated VGAM HOST TARGET RNA, such as BINDING SITE I, BINDING SITE II and BINDING SITE III, inhibits translation of VGAM627 host target RNA into VGAM627 host target protein, herein designated VGAM HOST TARGET PROTEIN. VGAM host target protein is therefore outlined by a broken line.

It is appreciated that VGAM627 host target gene, herein designated VGAM HOST TARGET GENE, in fact represents a plurality of VGAM627 host target genes. The mRNA of each one of this plurality of VGAM627 host target genes comprises one or more host target binding sites, each having a nucleotide sequence which is at least partly complementary to VGAM627 RNA, herein designated VGAM RNA, and which when bound by VGAM627 RNA causes inhibition of translation of respective one or more VGAM627 host target proteins.

It is further appreciated by one skilled in the art that the mode of translational inhibition illustrated by FIG. 1 with specific reference to translational inhibition exerted by VGAM627 gene, herein designated VGAM GENE, on one or more VGAM627 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM627 is inhibition of expression of host target genes, as part of a novel viral mechanism of attacking a host. Accordingly, utilities of VGAM627 include diagnosis, prevention and treatment of viral infection by Hepatitis GB Virus C. Specific functions, and accordingly utilities, of VGAM627 correlate with, and may be deduced from, the identity of the host target genes which VGAM627 binds and inhibits, and the function of these host target genes, as elaborated hereinbelow.

Nucleotide sequences of the VGAM627 precursor RNA, herein designated VGAM PRECURSOR RNA, and of the 'diced' VGAM627 RNA, herein designated VGAM RNA, and a schematic representation of the secondary folding of VGAM627 folded precursor RNA, herein designated VGAM FOLDED PRECURSOR RNA, of VGAM627 are further described hereinbelow with reference to Table 1.

Nucleotide sequences of host target binding sites, such as BINDING SITE-I, BINDING SITE-II and BINDING SITE-III of FIG. 1, found on VGAM627 host target RNA, and schematic representation of the complementarity of each of these host target binding sites to VGAM627 RNA, herein designated VGAM RNA, are described hereinbelow with reference to Table 2.

As mentioned hereinabove with reference to FIG. 1, a function of VGAM627 gene, herein designated VGAM is inhibition of expression of VGAM627 target genes. It is appreciated that specific functions, and accordingly utilities, of VGAM627 correlate with, and may be deduced from, the identity of the target genes which VGAM627 binds and inhibits, and the function of these target genes, as elaborated hereinbelow.

FLJ12294 (Accession NM_025100) is a VGAM627 host target gene. FLJ12294 BINDING SITE is HOST TARGET binding site found in the 3' untranslated region of mRNA encoded by FLJ12294, corresponding to a HOST TARGET binding site such as BINDING SITE I, BINDING SITE II or BINDING SITE III. Table 2 illustrates the complementarity of the nucleotide sequences of FLJ12294 BINDING SITE, designated SEQ ID:24744, to the nucleotide sequence of VGAM627 RNA, herein designated VGAM RNA, also designated SEQ ID:3338.

A function of VGAM627 is therefore inhibition of FLJ12294 (Accession NM_025100). Accordingly, utilities of VGAM627 include diagnosis, prevention and treatment of diseases and clinical conditions associated with FLJ12294. LOC255718 (Accession XM_174148) is another VGAM627 host target gene. LOC255718 BINDING SITE is HOST TARGET binding site found in the 5' untranslated region of mRNA encoded by LOC255718, corresponding to a HOST TARGET binding site such as BINDING SITE I, BINDING SITE II or BINDING SITE III. Table 2 illustrates the complementarity of the nucleotide sequences of LOC255718 BINDING SITE, designated SEQ ID:46581, to the nucleotide sequence of VGAM627 RNA, herein designated VGAM RNA, also designated SEQ ID:3338.

Another function of VGAM627 is therefore inhibition of LOC255718 (Accession XM_174148). Accordingly, utilities of VGAM627 include diagnosis, prevention and treatment of diseases and clinical conditions associated with LOC255718. FIG. 1 further provides a conceptual description of a novel bioinformatically detected viral gene of the present invention, referred to here as Viral Genomic Address Messenger 628 (VGAM628) viral gene, which modulates expression of respective host target genes thereof, the function and utility of which host target genes is known in the art.

VGAM628 is a novel bioinformatically detected regulatory, non protein coding, viral micro RNA (miRNA) gene. The method by which VGAM628 was detected is described hereinabove with reference to FIGS. 1-8.

VGAM628 gene, herein designated VGAM GENE, is a viral gene contained in the genome of Hepatitis GB Virus C. VGAM628 host target gene, herein designated VGAM HOST TARGET GENE, is a human gene contained in the human genome.

VGAM628 gene encodes a VGAM628 precursor RNA, herein designated VGAM PRECURSOR RNA. Similar to other miRNA genes, and unlike most ordinary genes, VGAM628 precursor RNA does not encode a protein. A nucleotide sequence identical or highly similar to the nucleotide sequence of VGAM628 precursor RNA is designated SEQ ID:614, and is provided hereinbelow with reference to the sequence listing part. Nucleotide sequence SEQ ID:614 is located at position 3072 relative to the genome of Hepatitis GB Virus C.

VGAM628 precursor RNA folds onto itself, forming VGAM628 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM628 folded precursor RNA into VGAM628 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM628 RNA is designated SEQ ID:3339, and is provided hereinbelow with reference to the sequence listing part.

VGAM628 host target gene, herein designated VGAM HOST TARGET GENE, encodes a corresponding messenger RNA, VGAM628 host target RNA, herein designated VGAM HOST TARGET RNA. VGAM628 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM628 RNA, herein designated VGAM RNA, binds complementarily to one or more host target binding sites located in untranslated regions of VGAM628 host target RNA, herein designated VGAM HOST TARGET RNA. This complementary binding is due to the fact that the nucleotide sequence of VGAM628 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM628 RNA, herein designated VGAM RNA, may have a different number of host target binding sites in untranslated regions of a VGAM628 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM628 RNA, herein designated VGAM RNA, to host target binding sites on VGAM628 host target RNA, herein designated VGAM HOST TARGET RNA, such as BINDING SITE I, BINDING SITE II and BINDING SITE III, inhibits translation of VGAM628 host target RNA into VGAM628 host target protein, herein designated VGAM HOST TARGET PROTEIN. VGAM host target protein is therefore outlined by a broken line.

It is appreciated that VGAM628 host target gene, herein designated VGAM HOST TARGET GENE, in fact represents a plurality of VGAM628 host target genes. The mRNA of each one of this plurality of VGAM628 host target genes comprises one or more host target binding sites, each having a nucleotide sequence which is at least partly complementary to VGAM628 RNA, herein designated VGAM RNA, and which when bound by VGAM628 RNA causes inhibition of translation of respective one or more VGAM628 host target proteins.

It is further appreciated by one skilled in the art that the mode of translational inhibition illustrated by FIG. 1 with specific reference to translational inhibition exerted by VGAM628 gene, herein designated VGAM GENE, on one or more VGAM628 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM628 is inhibition of expression of host target genes, as part of a novel viral mechanism of attacking a host. Accordingly, utilities of VGAM628 include diagnosis, prevention and treatment of viral infection by Hepatitis GB Virus C. Specific functions, and accordingly utilities, of VGAM628 correlate with, and may be deduced from, the identity of the host target genes which VGAM628 binds and inhibits, and the function of these host target genes, as elaborated hereinbelow.

Nucleotide sequences of the VGAM628 precursor RNA, herein designated VGAM PRECURSOR RNA, and of the 'diced' VGAM628 RNA, herein designated VGAM RNA, and a schematic representation of the secondary folding of VGAM628 folded precursor RNA, herein designated VGAM FOLDED PRECURSOR RNA, of VGAM628 are further described hereinbelow with reference to Table 1.

Nucleotide sequences of host target binding sites, such as BINDING SITE-I, BINDING SITE-II and BINDING SITE-III of FIG. 1, found on VGAM628 host target RNA, and schematic representation of the complementarity of each of these host target binding sites to VGAM628 RNA, herein designated VGAM RNA, are described hereinbelow with reference to Table 2.

As mentioned hereinabove with reference to FIG. 1, a function of VGAM628 gene, herein designated VGAM is inhibition of expression of VGAM628 target genes. It is appreciated that specific functions, and accordingly utilities, of VGAM628 correlate with, and may be deduced from, the identity of the target genes which VGAM628 binds and inhibits, and the function of these target genes, as elaborated hereinbelow.

Hermansky-Pudlak Syndrome 3 (HPS3, Accession NM_032383) is a VGAM628 host target gene. HPS3 BINDING SITE is HOST TARGET binding site found in the 3' untranslated region of mRNA encoded by HPS3, corresponding to a HOST TARGET binding site such as BINDING SITE I, BINDING SITE II or BINDING SITE III. Table 2 illustrates the complementarity of the nucleotide sequences of HPS3 BINDING SITE, designated SEQ ID:26176, to the nucleotide sequence of VGAM628 RNA, herein designated VGAM RNA, also designated SEQ ID:3339.

A function of VGAM628 is therefore inhibition of Hermansky-Pudlak Syndrome 3 (HPS3, Accession NM_032383). Accordingly, utilities of VGAM628 include diagnosis, prevention and treatment of diseases and clinical conditions associated with HPS3. MAP-kinase Activating Death Domain (MADD, Accession NM_130470) is another VGAM628 host target gene. MADD BINDING SITE is HOST TARGET binding site found in the 5' untranslated region of mRNA encoded by MADD, corresponding to a HOST TARGET binding site such as BINDING SITE I, BINDING SITE II or BINDING SITE III. Table 2 illustrates the complementarity of the nucleotide sequences of MADD BINDING SITE, designated SEQ ID:28232, to the nucleotide sequence of VGAM628 RNA, herein designated VGAM RNA, also designated SEQ ID:3339.

Another function of VGAM628 is therefore inhibition of MAP-kinase Activating Death Domain (MADD, Accession NM_130470), a gene which may regulate two different pathways for neural activities.interacts with the type-1 tumor necrosis factor receptor (TNFR1); death domain-containing protein. Accordingly, utilities of VGAM628 include diagnosis, prevention and treatment of diseases and clinical conditions associated with MADD. The function of MADD and its association with various diseases and clinical conditions, has been established by previous studies, as described hereinabove with reference to VGAM430. Pleckstrin Homology, Sec7 and Coiled/coil Domains 3 (PSCD3, Accession NM_004227) is another VGAM628 host target gene. PSCD3 BINDING SITE is HOST TARGET binding site found in the 3' untranslated region of mRNA encoded by PSCD3, corresponding to a HOST TARGET binding site such as BINDING SITE I, BINDING SITE II or BINDING SITE III. Table 2 illustrates the complementarity of the nucleotide sequences of PSCD3 BINDING SITE, designated SEQ ID:10422, to the nucleotide sequence of VGAM628 RNA, herein designated VGAM RNA, also designated SEQ ID:3339.

Another function of VGAM628 is therefore inhibition of Pleckstrin Homology, Sec7 and Coiled/coil Domains 3 (PSCD3, Accession NM_004227), a gene which regulates vesicle trafficking in eukaryotic cells. Accordingly, utilities of VGAM628 include diagnosis, prevention and treatment of diseases and clinical conditions associated with PSCD3. The function of PSCD3 and its association with various diseases and clinical conditions, has been established by previous studies, as described hereinabove with reference to VGAM191. Transcription Factor 21 (TCF21, Accession NM_003206) is another VGAM628 host target gene. TCF21 BINDING SITE is HOST TARGET binding site found in the 5' untranslated region of mRNA encoded by TCF21, corresponding to a HOST TARGET binding site such as BINDING SITE I, BINDING SITE II or BINDING SITE III. Table 2 illustrates the complementarity of the nucleotide sequences of TCF21 BINDING SITE, designated SEQ ID:9204, to the nucleotide sequence of VGAM628 RNA, herein designated VGAM RNA, also designated SEQ ID:3339.

Another function of VGAM628 is therefore inhibition of Transcription Factor 21 (TCF21, Accession NM_003206), a gene which may play a role in the specification or differentiation of one or more subsets of epicardial cell types. Accordingly, utilities of VGAM628 include diagnosis, prevention and treatment of diseases and clinical conditions associated with TCF21. The function of TCF21 has been established by previous studies. By searching EST databases for class B bHLH proteins expressed in developing kidney, Quaggin et al. (1998) identified human and mouse cDNAs encoding TCF21. They called the protein POD1 because it was highly expressed in podocytes (visceral glomerular epithelial cells). The predicted 179-amino acid human TCF21 protein contains a 57-amino acid bHLH domain, a putative nuclear localization signal, and an acidic transcriptional activation domain. Human TCF21 shares 60% and 95% protein sequence identity with TCF15 (OMIM Ref. No. 601010) and mouse Tcf21, respectively. Northern blot analysis revealed that TCF21 is expressed as a 1.3-kb mRNA in human lung, kidney, heart, and placenta, and at lower levels in pancreas. Animal model experiments lend further support to the function of TCF21. Lu et al. (2000) demonstrated that mice homozygous for a capsulin-null mutation fail to form a spleen. Homozygous mutant embryos expressed Hox11 (OMIM Ref. No. 186770) and Bapx1 (OMIM Ref. No. 602183), which had previously been shown to be essential regulators of spleen organogenesis. However, in the capsulin-null homozygous embryos, the primordium of the spleen failed to develop beyond an initial group of precursor cells and underwent rapid apoptosis. The phenotype of capsulin mutant mice demonstrated that capsulin acts within a subpopulation of splanchnic mesodermal cells to control an essential early step in spleen organogenesis that is likely to represent a point of regulatory convergence of the capsulin, Hox11, and Bapx1 genes.

It is appreciated that the abovementioned animal model for TCF21 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lu, J.; Chang, P.; Richardson, J. A.; Gan, L.; Weiler, H.; Olson, E. N.: The basic helix-loop-helix transcription factor capsulin controls spleen organogenesis. Proc. Nat. Acad. Sci. 97:9525-9530, 2000; and Quaggin, S. E.; Vanden Heuvel, G. B.; Igarashi, P.: Pod-1, a mesoderm-specific basic-helix-loop-helix protein expressed in mesenchymal and glomerular epithelial cells in the developi.

Further studies establishing the function and utilities of TCF21 are found in John Hopkins OMIM database record ID 603306, and in sited publications numbered 2442-2446 listed in the bibliography section hereinbelow, which are also hereby incorporated by reference. DJ37E16.5 (Accession NM_020315) is another VGAM628 host target gene. DJ37E16.5 BINDING SITE is HOST TARGET binding site found in the 3' untranslated region of mRNA encoded by DJ37E16.5, corresponding to a HOST TARGET binding site such as BINDING SITE I, BINDING SITE II or BINDING SITE III. Table 2 illustrates the complementarity of the nucleotide sequences of DJ37E16.5 BINDING SITE, designated SEQ ID:21578, to the nucleotide sequence of VGAM628 RNA, herein designated VGAM RNA, also designated SEQ ID:3339.

Another function of VGAM628 is therefore inhibition of DJ37E16.5 (Accession NM_020315). Accordingly, utilities of VGAM628 include diagnosis, prevention and treatment of diseases and clinical conditions associated with DJ37E16.5. DKFZP564O123 (Accession XM_002810) is another VGAM628 host target gene. DKFZP564O123 BINDING SITE is HOST TARGET binding site found in the 3' untranslated region of mRNA encoded by DKFZP564O123, corresponding to a HOST TARGET binding site such as BINDING SITE I, BINDING SITE II or BINDING SITE III. Table 2 illustrates the complementarity of the nucleotide sequences of DKFZP564O123 BINDING SITE, designated SEQ ID:29903, to the nucleotide sequence of VGAM628 RNA, herein designated VGAM RNA, also designated SEQ ID:3339.

Another function of VGAM628 is therefore inhibition of DKFZP564O123 (Accession XM_002810). Accordingly, utilities of VGAM628 include diagnosis, prevention and treatment of diseases and clinical conditions associated with DKFZP564O123. FLJ10761 (Accession NM_018208) is another VGAM628 host target gene. FLJ10761 BINDING SITE is HOST TARGET binding site found in the 3' untranslated region of mRNA encoded by FLJ10761, corresponding to a HOST TARGET binding site such as BINDING SITE I, BINDING SITE II or BINDING SITE III. Table 2 illustrates the complementarity of the nucleotide sequences of FLJ10761 BINDING SITE, designated SEQ ID:20105, to the nucleotide sequence of VGAM628 RNA, herein designated VGAM RNA, also designated SEQ ID:3339.

Another function of VGAM628 is therefore inhibition of FLJ10761 (Accession NM_018208). Accordingly, utilities of VGAM628 include diagnosis, prevention and treatment of diseases and clinical conditions associated with FLJ10761. FLJ23189 (Accession NM_025057) is another VGAM628 host target gene. FLJ23189 BINDING SITE is HOST TARGET binding site found in the 3' untranslated region of mRNA encoded by FLJ23189, corresponding to a HOST TARGET binding site such as BINDING SITE I, BINDING SITE II or BINDING SITE III. Table 2 illustrates the complementarity of the nucleotide sequences of FLJ23189 BINDING SITE, designated SEQ ID:24654, to the nucleotide sequence of VGAM628 RNA, herein designated VGAM RNA, also designated SEQ ID:3339.

Another function of VGAM628 is therefore inhibition of FLJ23189 (Accession NM_025057). Accordingly, utilities of VGAM628 include diagnosis, prevention and treatment of diseases and clinical conditions associated with FLJ23189. NYD-SP11 (Accession NM_031951) is another VGAM628 host target gene. NYD-SP11 BINDING SITE is HOST TARGET binding site found in the 3' untranslated region of mRNA encoded by NYD-SP11, corresponding to a HOST TARGET binding site such as BINDING SITE I, BINDING SITE II or BINDING SITE III. Table 2 illustrates the complementarity of the nucleotide sequences of NYD-SP11 BINDING SITE, designated SEQ ID:25692, to the nucleotide sequence of VGAM628 RNA, herein designated VGAM RNA, also designated SEQ ID:3339.

Another function of VGAM628 is therefore inhibition of NYD-SP11 (Accession NM_031951). Accordingly, utilities of VGAM628 include diagnosis, prevention and treatment of diseases and clinical conditions associated with NYD-SP11. SSH2 (Accession XM_030846) is another VGAM628 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31184, to the nucleotide sequence of VGAM628 RNA, herein designated VGAM RNA, also designated SEQ ID:3339.

Another function of VGAM628 is therefore inhibition of SSH2 (Accession XM_030846). Accordingly, utilities of VGAM628 include diagnosis, prevention and treatment of diseases and clinical conditions associated with SSH2. LOC124976 (Accession XM_058879) is another VGAM628 host target gene. LOC124976 BINDING SITE is HOST TARGET binding site found in the 3' untranslated region of mRNA encoded by LOC124976, corresponding to a HOST TARGET binding site such as BINDING SITE I, BINDING SITE II or BINDING SITE III. Table 2 illustrates the complementarity of the nucleotide sequences of LOC124976 BINDING SITE, designated SEQ ID:36784, to the nucleotide sequence of VGAM628 RNA, herein designated VGAM RNA, also designated SEQ ID:3339.

Another function of VGAM628 is therefore inhibition of LOC124976 (Accession XM_058879). Accordingly, utilities of VGAM628 include diagnosis, prevention and treatment of diseases and clinical conditions associated with LOC124976. FIG. 1 further provides a conceptual description of a novel bioinformatically detected viral gene of the present invention, referred to here as Viral Genomic Address Messenger 629 (VGAM629) viral gene, which modulates expression of respective host target genes thereof, the function and utility of which host target genes is known in the art.

VGAM629 is a novel bioinformatically detected regulatory, non protein coding, viral micro RNA (miRNA) gene. The method by which VGAM629 was detected is described hereinabove with reference to FIGS. 1-8.

VGAM629 gene, herein designated VGAM GENE, is a viral gene contained in the genome of Hepatitis GB Virus C. VGAM629 host target gene, herein designated VGAM HOST TARGET GENE, is a human gene contained in the human genome.

VGAM629 gene encodes a VGAM629 precursor RNA, herein designated VGAM PRECURSOR RNA. Similar to other miRNA genes, and unlike most ordinary genes, VGAM629 precursor RNA does not encode a protein. A nucleotide sequence identical or highly similar to the nucleotide sequence of VGAM629 precursor RNA is designated SEQ ID:615, and is provided hereinbelow with reference to the sequence listing part. Nucleotide sequence SEQ ID:615 is located at position 7116 relative to the genome of Hepatitis GB Virus C.

VGAM629 precursor RNA folds onto itself, forming VGAM629 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM629 folded precursor RNA into VGAM629 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM629 RNA is designated SEQ ID:3340, and is provided hereinbelow with reference to the sequence listing part.

VGAM629 host target gene, herein designated VGAM HOST TARGET GENE, encodes a corresponding messenger RNA, VGAM629 host target RNA, herein designated VGAM HOST TARGET RNA. VGAM629 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM629 RNA, herein designated VGAM RNA, binds complementarily to one or more host target binding sites located in untranslated regions of VGAM629 host target RNA, herein designated VGAM HOST TARGET RNA. This complementary binding is due to the fact that the nucleotide sequence of VGAM629 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM629 RNA, herein designated VGAM RNA, may have a different number of host target binding sites in untranslated regions of a VGAM629 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM629 RNA, herein designated VGAM RNA, to host target binding sites on VGAM629 host target RNA, herein designated VGAM HOST TARGET RNA, such as BINDING SITE I, BINDING SITE II and BINDING SITE III, inhibits translation of VGAM629 host target RNA into VGAM629 host target protein, herein designated VGAM HOST TARGET PROTEIN. VGAM host target protein is therefore outlined by a broken line.

It is appreciated that VGAM629 host target gene, herein designated VGAM HOST TARGET GENE, in fact represents a plurality of VGAM629 host target genes. The mRNA of each one of this plurality of VGAM629 host target genes comprises one or more host target binding sites, each having a nucleotide sequence which is at least partly complementary to VGAM629 RNA, herein designated VGAM RNA, and which when bound by VGAM629 RNA causes inhibition of translation of respective one or more VGAM629 host target proteins.

It is further appreciated by one skilled in the art that the mode of translational inhibition illustrated by FIG. 1 with specific reference to translational inhibition exerted by VGAM629 gene, herein designated VGAM GENE, on one or more VGAM629 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM629 is inhibition of expression of host target genes, as part of a novel viral mechanism of attacking a host. Accordingly, utilities of VGAM629 include diagnosis, prevention and treatment of viral infection by Hepatitis GB Virus C. Specific functions, and accordingly utilities, of VGAM629 correlate with, and may be deduced from, the identity of the host target genes which VGAM629 binds and inhibits, and the function of these host target genes, as elaborated hereinbelow.

Nucleotide sequences of the VGAM629 precursor RNA, herein designated VGAM PRECURSOR RNA, and of the 'diced' VGAM629 RNA, herein designated VGAM RNA, and a schematic representation of the secondary folding of VGAM629 folded precursor RNA, herein designated VGAM FOLDED PRECURSOR RNA, of VGAM629 are further described hereinbelow with reference to Table 1.

Nucleotide sequences of host target binding sites, such as BINDING SITE-I, BINDING SITE-II and BINDING SITE-III of FIG. 1, found on VGAM629 host target RNA, and schematic representation of the complementarity of each of these host target binding sites to VGAM629 RNA, herein designated VGAM RNA, are described hereinbelow with reference to Table 2.

As mentioned hereinabove with reference to FIG. 1, a function of VGAM629 gene, herein designated VGAM is inhibition of expression of VGAM629 target genes. It is appreciated that specific functions, and accordingly utilities, of VGAM629 correlate with, and may be deduced from, the identity of the target genes which VGAM629 binds and inhibits, and the function of these target genes, as elaborated hereinbelow.

ATPase, Ca++ Transporting, Cardiac Muscle, Slow Twitch 2 (ATP2A2, Accession NM_001681) is a VGAM629 host target gene. ATP2A2 BINDING SITE is HOST TARGET binding site found in the 3' untranslated region of mRNA encoded by ATP2A2, corresponding to a HOST TARGET binding site such as BINDING SITE I, BINDING SITE II or BINDING SITE III. Table 2 illustrates the complementarity of the nucleotide sequences of ATP2A2 BINDING SITE, designated SEQ ID:7398, to the nucleotide sequence of VGAM629 RNA, herein designated VGAM RNA, also designated SEQ ID:3340.

A function of VGAM629 is therefore inhibition of ATPase, Ca++ Transporting, Cardiac Muscle, Slow Twitch 2 (ATP2A2, Accession NM_001681). Accordingly, utilities of VGAM629 include diagnosis, prevention and treatment of diseases and clinical conditions associated with ATP2A2. KIAA1643 (Accession XM_035371) is another VGAM629 host target gene. KIAA1643 BINDING SITE is HOST TARGET binding site found in the 3' untranslated region of mRNA encoded by KIAA1643, corresponding to a HOST TARGET binding site such as BINDING SITE I, BINDING SITE II or BINDING SITE III. Table 2 illustrates the complementarity of the nucleotide sequences of KIAA1643 BINDING SITE, designated SEQ ID:32237, to the nucleotide sequence of VGAM629 RNA, herein designated VGAM RNA, also designated SEQ ID:3340.

Another function of VGAM629 is therefore inhibition of KIAA1643 (Accession XM_035371). Accordingly, utilities of VGAM629 include diagnosis, prevention and treatment of diseases and clinical conditions associated with KIAA1643. MGC10999 (Accession NM_032307) is another VGAM629 host target gene. MGC10999 BINDING SITE is HOST TARGET binding site found in the 3' untranslated region of mRNA encoded by MGC10999, corresponding to a HOST TARGET binding site such as BINDING SITE I, BINDING SITE II or BINDING SITE III. Table 2 illustrates the complementarity of the nucleotide sequences of MGC10999 BINDING SITE, designated SEQ ID:26089, to the nucleotide sequence of VGAM629 RNA, herein designated VGAM RNA, also designated SEQ ID:3340.

Another function of VGAM629 is therefore inhibition of MGC10999 (Accession NM_032307). Accordingly, utilities of VGAM629 include diagnosis, prevention and treatment of diseases and clinical conditions associated with MGC10999. NAF1 (Accession NM_006058) is another VGAM629 host target gene. NAF1 BINDING SITE is HOST TARGET binding site found in the 3' untranslated region of mRNA encoded by NAF1, corresponding to a HOST TARGET binding site such as BINDING SITE I, BINDING SITE II or BINDING SITE III. Table 2 illustrates the complementarity of the nucleotide sequences of NAF1 BINDING SITE, designated SEQ ID:12702, to the nucleotide sequence of VGAM629 RNA, herein designated VGAM RNA, also designated SEQ ID:3340.

Another function of VGAM629 is therefore inhibition of NAF1 (Accession NM_006058). Accordingly, utilities of VGAM629 include diagnosis, prevention and treatment of diseases and clinical conditions associated with NAF1. Tight Junction Protein 2 (zona occludens 2) (TJP2, Accession XM_005446) is another VGAM629 host target gene. TJP2 BINDING SITE is HOST TARGET binding site found in the 3' untranslated region of mRNA encoded by TJP2, corresponding to a HOST TARGET binding site such as BINDING SITE I, BINDING SITE II or BINDING SITE III. Table 2 illustrates the complementarity of the nucleotide sequences of TJP2 BINDING SITE, designated SEQ ID:29981, to the nucleotide sequence of VGAM629 RNA, herein designated VGAM RNA, also designated SEQ ID:3340.

Another function of VGAM629 is therefore inhibition of Tight Junction Protein 2 (zona occludens 2) (TJP2, Accession XM_005446). Accordingly, utilities of VGAM629 include diagnosis, prevention and treatment of diseases and clinical conditions associated with TJP2. TSPEAR (Accession NM_144991) is another VGAM629 host target gene. TSPEAR BINDING SITE is HOST TARGET binding site found in the 3' untranslated region of mRNA encoded by TSPEAR, corresponding to a HOST TARGET binding site such as BINDING SITE I, BINDING SITE II or BINDING SITE III. Table 2 illustrates the complementarity of the nucleotide sequences of TSPEAR BINDING SITE, designated SEQ ID:29595, to the nucleotide sequence of VGAM629 RNA, herein designated VGAM RNA, also designated SEQ ID:3340.

Another function of VGAM629 is therefore inhibition of TSPEAR (Accession NM_144991). Accordingly, utilities of VGAM629 include diagnosis, prevention and treatment of diseases and clinical conditions associated with TSPEAR. LOC113730 (Accession XM_054631) is another VGAM629 host target gene. LOC113730 BINDING SITE is HOST TARGET binding site found in the 5' untranslated region of mRNA encoded by LOC113730, corresponding to a HOST TARGET binding site such as BINDING SITE I, BINDING SITE II or BINDING SITE III. Table 2 illustrates the complementarity of the nucleotide sequences of LOC113730 BINDING SITE, designated SEQ ID:36182, to the nucleotide sequence of VGAM629 RNA, herein designated VGAM RNA, also designated SEQ ID:3340.

Another function of VGAM629 is therefore inhibition of LOC113730 (Accession XM_054631). Accordingly, utilities of VGAM629 include diagnosis, prevention and treatment of diseases and clinical conditions associated with LOC113730. LOC152687 (Accession XM_087503) is another VGAM629 host target gene. LOC152687 BINDING SITE is HOST TARGET binding site found in the 5' untranslated region of mRNA encoded by LOC152687, corresponding to a HOST TARGET binding site such as BINDING SITE I, BINDING SITE II or BINDING SITE III. Table 2 illustrates the complementarity of the nucleotide sequences of LOC152687 BINDING SITE, designated SEQ ID:39302, to the nucleotide sequence of VGAM629 RNA, herein designated VGAM RNA, also designated SEQ ID:3340.

Another function of VGAM629 is therefore inhibition of LOC152687 (Accession XM_087503). Accordingly, utilities of VGAM629 include diagnosis, prevention and treatment of diseases and clinical conditions associated with LOC152687. LOC164582 (Accession XM_092881) is another VGAM629 host target gene. LOC164582 BINDING SITE is HOST TARGET binding site found in the 5' untranslated region of mRNA encoded by LOC164582, corresponding to a HOST TARGET binding site such as BINDING SITE I, BINDING SITE II or BINDING SITE III. Table 2 illustrates the complementarity of the nucleotide sequences of LOC164582 BINDING SITE, designated SEQ ID:40156, to the nucleotide sequence of VGAM629 RNA, herein designated VGAM RNA, also designated SEQ ID:3340.

Another function of VGAM629 is therefore inhibition of LOC164582 (Accession XM_092881). Accordingly, utilities of VGAM629 include diagnosis, prevention and treatment of diseases and clinical conditions associated with LOC164582. LOC220370 (Accession XM_166943) is another VGAM629 host target gene. LOC220370 BINDING SITE is HOST TARGET binding site found in the 3' untranslated region of mRNA encoded by LOC220370, corresponding to a HOST TARGET binding site such as BINDING SITE I, BINDING SITE II or BINDING SITE III. Table 2 illustrates the complementarity of the nucleotide sequences of LOC220370 BINDING SITE, designated SEQ ID:44597, to the nucleotide sequence of VGAM629 RNA, herein designated VGAM RNA, also designated SEQ ID:3340.

Another function of VGAM629 is therefore inhibition of LOC220370 (Accession XM_166943). Accordingly, utilities of VGAM629 include diagnosis, prevention and treatment of diseases and clinical conditions associated with LOC220370. LOC221763 (Accession XM_168107) is another VGAM629 host target gene. LOC221763 BINDING SITE is HOST TARGET binding site found in the 3' untranslated region of mRNA encoded by LOC221763, corresponding to a HOST TARGET binding site such as BINDING SITE I, BINDING SITE II or BINDING SITE III. Table 2 illustrates the complementarity of the nucleotide sequences of LOC221763 BINDING SITE, designated SEQ ID:45034, to the nucleotide sequence of VGAM629 RNA, herein designated VGAM RNA, also designated SEQ ID:3340.

Another function of VGAM629 is therefore inhibition of LOC221763 (Accession XM_168107). Accordingly, utilities of VGAM629 include diagnosis, prevention and treatment of diseases and clinical conditions associated with LOC221763. LOC89932 (Accession XM_027341) is another VGAM629 host target gene. LOC89932 BINDING SITE is HOST TARGET binding site found in the 3' untranslated region of mRNA encoded by LOC89932, corresponding to a HOST TARGET binding site such as BINDING SITE I, BINDING SITE II or BINDING SITE III. Table 2 illustrates the complementarity of the nucleotide sequences of LOC89932 BINDING SITE, designated SEQ ID:30486, to the nucleotide sequence of VGAM629 RNA, herein designated VGAM RNA, also designated SEQ ID:3340.

Another function of VGAM629 is therefore inhibition of LOC89932 (Accession XM_027341). Accordingly, utilities of VGAM629 include diagnosis, prevention and treatment of diseases and clinical conditions associated with LOC89932. FIG. 1 further provides a conceptual description of a novel bioinformatically detected viral gene of the present invention, referred to here as Viral Genomic Address Messenger 630 (VGAM630) viral gene, which modulates expression of respective host target genes thereof, the function and utility of which host target genes is known in the art.

VGAM630 is a novel bioinformatically detected regulatory, non protein coding, viral micro RNA (miRNA) gene. The method by which VGAM630 was detected is described hereinabove with reference to FIGS. 1-8.

VGAM630 gene, herein designated VGAM GENE, is a viral gene contained in the genome of Hepatitis GB Virus C. VGAM630 host target gene, herein designated VGAM HOST TARGET GENE, is a human gene contained in the human genome.

VGAM630 gene encodes a VGAM630 precursor RNA, herein designated VGAM PRECURSOR RNA. Similar to other miRNA genes, and unlike most ordinary genes, VGAM630 precursor RNA does not encode a protein. A nucleotide sequence identical or highly similar to the nucleotide sequence of VGAM630 precursor RNA is designated SEQ ID:616, and is provided hereinbelow with reference to the sequence listing part. Nucleotide sequence SEQ ID:616 is located at position 4257 relative to the genome of Hepatitis GB Virus C.

VGAM630 precursor RNA folds onto itself, forming VGAM630 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM630 folded precursor RNA into VGAM630 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM630 RNA is designated SEQ ID:3341, and is provided hereinbelow with reference to the sequence listing part.

VGAM630 host target gene, herein designated VGAM HOST TARGET GENE, encodes a corresponding messenger RNA, VGAM630 host target RNA, herein designated VGAM HOST TARGET RNA. VGAM630 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM630 RNA, herein designated VGAM RNA, binds complementarily to one or more host target binding sites located in untranslated regions of VGAM630 host target RNA, herein designated VGAM HOST TARGET RNA. This complementary binding is due to the fact that the nucleotide sequence of VGAM630 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM630 RNA, herein designated VGAM RNA, may have a different number of host target binding sites in untranslated regions of a VGAM630 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM630 RNA, herein designated VGAM RNA, to host target binding sites on VGAM630 host target RNA, herein designated VGAM HOST TARGET RNA, such as BINDING SITE I, BINDING SITE II and BINDING SITE III, inhibits translation of VGAM630 host target RNA into VGAM630 host target protein, herein designated VGAM HOST TARGET PROTEIN. VGAM host target protein is therefore outlined by a broken line.

It is appreciated that VGAM630 host target gene, herein designated VGAM HOST TARGET GENE, in fact represents a plurality of VGAM630 host target genes. The mRNA of each one of this plurality of VGAM630 host target genes comprises one or more host target binding sites, each having a nucleotide sequence which is at least partly complementary to VGAM630 RNA, herein designated VGAM RNA, and which when bound by VGAM630 RNA causes inhibition of translation of respective one or more VGAM630 host target proteins.

It is further appreciated by one skilled in the art that the mode of translational inhibition illustrated by FIG. 1 with specific reference to translational inhibition exerted by VGAM630 gene, herein designated VGAM GENE, on one or more VGAM630 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM630 is inhibition of expression of host target genes, as part of a novel viral mechanism of attacking a host. Accordingly, utilities of VGAM630 include diagnosis, prevention and treatment of viral infection by Hepatitis GB Virus C. Specific functions, and accordingly utilities, of VGAM630 correlate with, and may be deduced from, the identity of the host target genes which VGAM630 binds and inhibits, and the function of these host target genes, as elaborated hereinbelow.

Nucleotide sequences of the VGAM630 precursor RNA, herein designated VGAM PRECURSOR RNA, and of the 'diced' VGAM630 RNA, herein designated VGAM RNA, and a schematic representation of the secondary folding of VGAM630 folded precursor RNA, herein designated VGAM FOLDED PRECURSOR RNA, of VGAM630 are further described hereinbelow with reference to Table 1.

Nucleotide sequences of host target binding sites, such as BINDING SITE-I, BINDING SITE-II and BINDING SITE-III of FIG. 1, found on VGAM630 host target RNA, and schematic representation of the complementarity of each of these host target binding sites to VGAM630 RNA, herein designated VGAM RNA, are described hereinbelow with reference to Table 2.

As mentioned hereinabove with reference to FIG. 1, a function of VGAM630 gene, herein designated VGAM is inhibition of expression of VGAM630 target genes. It is appreciated that specific functions, and accordingly utilities, of VGAM630 correlate with, and may be deduced from, the identity of the target genes which VGAM630 binds and inhibits, and the function of these target genes, as elaborated hereinbelow.

Golgi Reassembly Stacking Protein 1, 65 kDa (GORASP1, Accession NM_031899) is a VGAM630 host target gene. GORASP1 BINDING SITE is HOST TARGET binding site found in the 3' untranslated region of mRNA encoded by GORASP1, corresponding to a HOST TARGET binding site such as BINDING SITE I, BINDING SITE II or BINDING SITE III. Table 2 illustrates the complementarity of the nucleotide sequences of GORASP1 BINDING SITE, designated SEQ ID:25644, to the nucleotide sequence of VGAM630 RNA, herein designated VGAM RNA, also designated SEQ ID:3341.

A function of VGAM630 is therefore inhibition of Golgi Reassembly Stacking Protein 1, 65 kDa (GORASP1, Accession NM_031899), a gene which has some funtion with the Golgi apparatus. Accordingly, utilities of VGAM630 include diagnosis, prevention and treatment of diseases and clinical conditions associated with GORASP1. The function of GORASP1 has been established by previous studies. Barr et al. (1998) determined that GOLPH5 interacts with GM130 (OMIM Ref. No. 602580), a Golgi matrix protein, in detergent extracts of rat liver Golgi membranes. They further determined that this complex can bind to the vesicle docking protein p115 (OMIM Ref. No. 603344). Using in vitro translation and site-directed mutagenesis in conjunction with immunoprecipitation, Barr et al. (1998) localized the critical interacting domains to the C terminus of GM130 and the PDZ-like domain of GOLPH5. Interaction was also found to be critical for the correct targeting of both proteins to the Golgi apparatus. Sutterlin et al. (2002) found that addition of an antibody to the Golgi-associated protein GRASP65 inhibited Golgi fragmentation by mitotic cytosol in permeabilized cells. Microinjecting this antibody or a C-terminal fragment of GRASP65 containing the antibody-binding site into normal rat kidney cells prevented entry into mitosis. Under these conditions the cells had completed S phase but were not in the prophase stage of mitosis. Fragmentation of the Golgi apparatus by nocodazole or brefeldin A treatment prior to or after microinjection of the anti-GRASP65 antibody alleviated the block in mitotic entry. These data suggested that pericentriolar Golgi organization is a sensor for controlling entry into mitosis in mammalian cells.

Full details of the abovementioned studies are described in the following publications, the disclosure of which are hereby incorporated by reference:

Barr, F. A.; Nakamura, N.; Warren, G.: Mapping the interaction between GRASP65 and GM130, components of a protein complex involved in the stacking of Golgi cisternae. EMBO J. 17:3258-3268, 1998; and Sutterlin, C.; Hsu, P.; Mallabiabarrena, A.; Malhotra, V.: Fragmentation and dispersal of the pericentriolar Golgi complex is required for entry into mitosis in mammalian cells. Cell 1.

Further studies establishing the function and utilities of GORASP1 are found in John Hopkins OMIM database record ID 606867, and in sited publications numbered 9039-5584 listed in the bibliography section hereinbelow, which are also hereby incorporated by reference. TATA Box Binding Protein (TBP)-associated Factor, RNA Polymerase I, C, 110 kDa (TAF1C, Accession NM_005679) is another VGAM630 host target gene. TAF1C BINDING SITE is HOST TARGET binding site found in the 3' untranslated region of mRNA encoded by TAF1C, corresponding to a HOST TARGET binding site such as BINDING SITE I, BINDING SITE II or BINDING SITE III. Table 2 illustrates the complementarity of the nucleotide sequences of TAF1C BINDING SITE, designated SEQ ID:12234, to the nucleotide sequence of VGAM630 RNA, herein designated VGAM RNA, also designated SEQ ID:3341.

Another function of VGAM630 is therefore inhibition of TATA Box Binding Protein (TBP)-associated Factor, RNA Polymerase I, C, 110 kDa (TAF1C, Accession NM_005679), a gene which belongs to component of the RNA polymerase I and II SL1 transcription factor. Accordingly, utilities of VGAM630 include diagnosis, prevention and treatment of diseases and clinical conditions associated with TAF1C. The function of TAF1C and its association with various diseases and clinical conditions, has been established by previous studies, as described hereinabove with reference to VGAM191. DRIL2 (Accession NM_006465) is another VGAM630 host target gene. DRIL2 BINDING SITE is HOST TARGET binding site found in the 3' untranslated region of mRNA encoded by DRIL2, corresponding to a HOST TARGET binding site such as BINDING SITE I, BINDING SITE II or BINDING SITE III. Table 2 illustrates the complementarity of the nucleotide sequences of DRIL2 BINDING SITE, designated SEQ ID:13181, to the nucleotide sequence of VGAM630 RNA, herein designated VGAM RNA, also designated SEQ ID:3341.

Another function of VGAM630 is therefore inhibition of DRIL2 (Accession NM_006465). Accordingly, utilities of VGAM630 include diagnosis, prevention and treatment of diseases and clinical conditions associated with DRIL2. LOC120114 (Accession XM_061871) is another VGAM630 host target gene. LOC120114 BINDING SITE is HOST TARGET binding site found in the 3' untranslated region of mRNA encoded by LOC120114, corresponding to a HOST TARGET binding site such as BINDING SITE I, BINDING SITE II or BINDING SITE III. Table 2 illustrates the complementarity of the nucleotide sequences of LOC120114 BINDING SITE, designated SEQ ID:37212, to the nucleotide sequence of VGAM630 RNA, herein designated VGAM RNA, also designated SEQ ID:3341.

Another function of VGAM630 is therefore inhibition of LOC120114 (Accession XM_061871). Accordingly, utilities of VGAM630 include diagnosis, prevention and treatment of diseases and clinical conditions associated with LOC120114. LOC204823 (Accession XM_115621) is another VGAM630 host target gene. LOC204823 BINDING SITE is HOST TARGET binding site found in the 5' untranslated region of mRNA encoded by LOC204823, corresponding to a HOST TARGET binding site such as BINDING SITE I, BINDING SITE II or BINDING SITE III. Table 2 illustrates the complementarity of the nucleotide sequences of LOC204823 BINDING SITE, designated SEQ ID:43101, to the nucleotide sequence of VGAM630 RNA, herein designated VGAM RNA, also designated SEQ ID:3341.

Another function of VGAM630 is therefore inhibition of LOC204823 (Accession XM_115621). Accordingly, utilities of VGAM630 include diagnosis, prevention and treatment of diseases and clinical conditions associated with LOC204823. LOC220672 (Accession XM_017177) is another VGAM630 host target gene. LOC220672 BINDING SITE is HOST TARGET binding site found in the 3' untranslated region of mRNA encoded by LOC220672, corresponding to a HOST TARGET binding site such as BINDING SITE I, BINDING SITE II or BINDING SITE III. Table 2 illustrates the complementarity of the nucleotide sequences of LOC220672 BINDING SITE, designated SEQ ID:30307, to the nucleotide sequence of VGAM630 RNA, herein designated VGAM RNA, also designated SEQ ID:3341.

Another function of VGAM630 is therefore inhibition of LOC220672 (Accession XM_017177). Accordingly, utilities of VGAM630 include diagnosis, prevention and treatment of diseases and clinical conditions associated with LOC220672. LOC90841 (Accession XM_034427) is another VGAM630 host target gene. LOC90841 BINDING SITE is HOST TARGET binding site found in the 3' untranslated region of mRNA encoded by LOC90841, corresponding to a HOST TARGET binding site such as BINDING SITE I, BINDING SITE II or BINDING SITE III. Table 2 illustrates the complementarity of the nucleotide sequences of LOC90841 BINDING SITE, designated SEQ ID:32109, to the nucleotide sequence of VGAM630 RNA, herein designated VGAM RNA, also designated SEQ ID:3341.

Another function of VGAM630 is therefore inhibition of LOC90841 (Accession XM_034427). Accordingly, utilities of VGAM630 include diagnosis, prevention and treatment of diseases and clinical conditions associated with LOC90841. FIG. 1 further provides a conceptual description of a novel bioinformatically detected viral gene of the present invention, referred to here as Viral Genomic Address Messenger 631 (VGAM631) viral gene, which modulates expression of respective host target genes thereof, the function and utility of which host target genes is known in the art.

VGAM631 is a novel bioinformatically detected regulatory, non protein coding, viral micro RNA (miRNA) gene. The method by which VGAM631 was detected is described hereinabove with reference to FIGS. 1-8.

VGAM631 gene, herein designated VGAM GENE, is a viral gene contained in the genome of Ovine Astrovirus. VGAM631 host target gene, herein designated VGAM HOST TARGET GENE, is a human gene contained in the human genome.

VGAM631 gene encodes a VGAM631 precursor RNA, herein designated VGAM PRECURSOR RNA. Similar to other miRNA genes, and unlike most ordinary genes, VGAM631 precursor RNA does not encode a protein. A nucleotide sequence identical or highly similar to the nucleotide sequence of VGAM631 precursor RNA is designated SEQ ID:617, and is provided hereinbelow with reference to the sequence listing part. Nucleotide sequence SEQ ID:617 is located at position 1595 relative to the genome of Ovine Astrovirus.

VGAM631 precursor RNA folds onto itself, forming VGAM631 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM631 folded precursor RNA into VGAM631 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM631 RNA is designated SEQ ID:3342, and is provided hereinbelow with reference to the sequence listing part.

VGAM631 host target gene, herein designated VGAM HOST TARGET GENE, encodes a corresponding messenger RNA, VGAM631 host target RNA, herein designated VGAM HOST TARGET RNA. VGAM631 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM631 RNA, herein designated VGAM RNA, binds complementarily to one or more host target binding sites located in untranslated regions of VGAM631 host target RNA, herein designated VGAM HOST TARGET RNA. This complementary binding is due to the fact that the nucleotide sequence of VGAM631 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM631 RNA, herein designated VGAM RNA, may have a different number of host target binding sites in untranslated regions of a VGAM631 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM631 RNA, herein designated VGAM RNA, to host target binding sites on VGAM631 host target RNA, herein designated VGAM HOST TARGET RNA, such as BINDING SITE I, BINDING SITE II and BINDING SITE III, inhibits translation of VGAM631 host target RNA into VGAM631 host target protein, herein designated VGAM HOST TARGET PROTEIN. VGAM host target protein is therefore outlined by a broken line.

It is appreciated that VGAM631 host target gene, herein designated VGAM HOST TARGET GENE, in fact represents a plurality of VGAM631 host target genes. The mRNA of each one of this plurality of VGAM631 host target genes comprises one or more host target binding sites, each having a nucleotide sequence which is at least partly complementary to VGAM631 RNA, herein designated VGAM RNA, and which when bound by VGAM631 RNA causes inhibition of translation of respective one or more VGAM631 host target proteins.

It is further appreciated by one skilled in the art that the mode of translational inhibition illustrated by FIG. 1 with specific reference to translational inhibition exerted by VGAM631 gene, herein designated VGAM GENE, on one or more VGAM631 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM631 is inhibition of expression of host target genes, as part of a novel viral mechanism of attacking a host. Accordingly, utilities of VGAM631 include diagnosis, prevention and treatment of viral infection by Ovine Astrovirus. Specific functions, and accordingly utilities, of VGAM631 correlate with, and may be deduced from, the identity of the host target genes which VGAM631 binds and inhibits, and the function of these host target genes, as elaborated hereinbelow.

Nucleotide sequences of the VGAM631 precursor RNA, herein designated VGAM PRECURSOR RNA, and of the 'diced' VGAM631 RNA, herein designated VGAM RNA, and a schematic representation of the secondary folding of VGAM631 folded precursor RNA, herein designated VGAM FOLDED PRECURSOR RNA, of VGAM631 are further described hereinbelow with reference to Table 1.

Nucleotide sequences of host target binding sites, such as BINDING SITE-I, BINDING SITE-II and BINDING SITE-III of FIG. 1, found on VGAM631 host target RNA, and schematic representation of the complementarity of each of these host target binding sites to VGAM631 RNA, herein designated VGAM RNA, are described hereinbelow with reference to Table 2.

As mentioned hereinabove with reference to FIG. 1, a function of VGAM631 gene, herein designated VGAM is inhibition of expression of VGAM631 target genes. It is appreciated that specific functions, and accordingly utilities, of VGAM631 correlate with, and may be deduced from, the identity of the target genes which VGAM631 binds and inhibits, and the function of these target genes, as elaborated hereinbelow.

Deoxyribonuclease I (DNASE1, Accession NM_005223) is a VGAM631 host target gene. DNASE1 BINDING SITE is HOST TARGET binding site found in the 5' untranslated region of mRNA encoded by DNASE1, corresponding to a HOST TARGET binding site such as BINDING SITE I, BINDING SITE II or BINDING SITE III. Table 2 illustrates the complementarity of the nucleotide sequences of DNASE1 BINDING SITE, designated SEQ ID:11714, to the nucleotide sequence of VGAM631 RNA, herein designated VGAM RNA, also designated SEQ ID:3342.

A function of VGAM631 is therefore inhibition of Deoxyribonuclease I (DNASE1, Accession NM_005223), a gene which seems to be involved in cell death. Accordingly, utilities of VGAM631 include diagnosis, prevention and treatment of diseases and clinical conditions associated with DNASE1. The function of DNASE1 and its association with various diseases and clinical conditions, has been established by previous studies, as described hereinabove with reference to VGAM492. Egl Nine Homolog 1 (C. elegans) (EGLN1, Accession NM_022051) is another VGAM631 host target gene. EGLN1 BINDING SITE is HOST TARGET binding site found in the 5' untranslated region of mRNA encoded by EGLN1, corresponding to a HOST TARGET binding site such as BINDING SITE I, BINDING SITE II or BINDING SITE III. Table 2 illustrates the complementarity of the nucleotide sequences of EGLN1 BINDING SITE, designated SEQ ID:22582, to the nucleotide sequence of VGAM631 RNA, herein designated VGAM RNA, also designated SEQ ID:3342.

Another function of VGAM631 is therefore inhibition of Egl Nine Homolog 1 (C. elegans) (EGLN1, Accession NM_022051), a gene which is expressed in the cytoplasm of arterial smooth muscle cells. Accordingly, utilities of VGAM631 include diagnosis, prevention and treatment of diseases and clinical conditions associated with EGLN1. The function of EGLN1 and its association with various diseases and clinical conditions, has been established by previous studies, as described hereinabove with reference to VGAM216. Interferon (alpha, beta and omega) Receptor 2 (IFNAR2, Accession NM_000874) is another VGAM631 host target gene. IFNAR2 BINDING SITE is HOST TARGET binding site found in the 3' untranslated region of mRNA encoded by IFNAR2, corresponding to a HOST TARGET binding site such as BINDING SITE I, BINDING SITE II or BINDING SITE III. Table 2 illustrates the complementarity of the nucleotide sequences of IFNAR2 BINDING SITE, designated SEQ ID:6552, to the nucleotide sequence of VGAM631 RNA, herein designated VGAM RNA, also designated SEQ ID:3342.

Another function of VGAM631 is therefore inhibition of Interferon (alpha, beta and omega) Receptor 2 (IFNAR2, Accession NM_000874), a gene which is a receptor for interferons alpha and beta. Accordingly, utilities of VGAM631 include diagnosis, prevention and treatment of diseases and clinical conditions associated with IFNAR2. The function of IFNAR2 and its association with various diseases and clinical conditions, has been established by previous studies, as described hereinabove with reference to VGAM487. Collagen, Type XII, Alpha 1 (COL12A1, Accession NM_080645) is another VGAM631 host target gene. COL12A1 BINDING SITE1 and COL12A1 BINDING SITE2 are HOST TARGET binding sites found in untranslated regions of mRNA encoded by COL12A1, corresponding to HOST TARGET binding sites such as BINDING SITE I, BINDING SITE II or BINDING SITE III. Table 2 illustrates the complementarity of the nucleotide sequences of COL12A1 BINDING SITE1 and COL12A1 BINDING SITE2, designated SEQ ID:27936 and SEQ ID:10589 respectively, to the nucleotide sequence of VGAM631 RNA, herein designated VGAM RNA, also designated SEQ ID:3342.

Another function of VGAM631 is therefore inhibition of Collagen, Type XII, Alpha 1 (COL12A1, Accession NM_080645). Accordingly, utilities of VGAM631 include diagnosis, prevention and treatment of diseases and clinical conditions associated with COL12A1. KIAA1091 (Accession XM_045750) is another VGAM631 host target gene. KIAA1091 BINDING SITE is HOST TARGET binding site found in the 3' untranslated region of mRNA encoded by KIAA1091, corresponding to a HOST TARGET binding site such as BINDING SITE I, BINDING SITE II or BINDING SITE III. Table 2 illustrates the complementarity of the nucleotide sequences of KIAA1091 BINDING SITE, designated SEQ ID:34543, to the nucleotide sequence of VGAM631 RNA, herein designated VGAM RNA, also designated SEQ ID:3342.

Another function of VGAM631 is therefore inhibition of KIAA1091 (Accession XM_045750). Accordingly, utilities of VGAM631 include diagnosis, prevention and treatment of diseases and clinical conditions associated with KIAA1091. NRF (Accession NM_017544) is another VGAM631 host target gene. NRF BINDING SITE is HOST TARGET binding site found in the 3" untranslated region of mRNA encoded by NRF, corresponding to a HOST TARGET binding site such as BINDING SITE I, BINDING SITE II or BINDING SITE III. Table 2 illustrates the complementarity of the nucleotide sequences of NRF BINDING SITE, designated SEQ ID:18986, to the nucleotide sequence of VGAM631 RNA, herein designated VGAM RNA, also designated SEQ ID:3342.

Another function of VGAM631 is therefore inhibition of NRF (Accession NM_017544). Accordingly, utilities of VGAM631 include diagnosis, prevention and treatment of diseases and clinical conditions associated with NRF. LOC148089 (Accession XM_086040) is another VGAM631 host target gene. LOC148089 BINDING SITE is HOST TARGET binding site found in the 3' untranslated region of mRNA encoded by LOC148089, corresponding to a HOST TARGET binding site such as BINDING SITE I, BINDING SITE II or BINDING SITE III. Table 2 illustrates the complementarity of the nucleotide sequences of LOC148089 BINDING SITE, designated SEQ ID:38451, to the nucleotide sequence of VGAM631 RNA, herein designated VGAM RNA, also designated SEQ ID:3342.

Another function of VGAM631 is therefore inhibition of LOC148089 (Accession XM_086040). Accordingly, utilities of VGAM631 include diagnosis, prevention and treatment of diseases and clinical conditions associated with LOC148089. LOC148490 (Accession XM_086210) is another VGAM631 host target gene. LOC148490 BINDING SITE is HOST TARGET binding site found in the 5' untranslated region of mRNA encoded by LOC148490, corresponding to a HOST TARGET binding site such as BINDING SITE I, BINDING SITE II or BINDING SITE III. Table 2 illustrates the complementarity of the nucleotide sequences of LOC148490 BINDING SITE, designated SEQ ID:38546, to the nucleotide sequence of VGAM631 RNA, herein designated VGAM RNA, also designated SEQ ID:3342.

Another function of VGAM631 is therefore inhibition of LOC148490 (Accession XM_086210). Accordingly, utilities of VGAM631 include diagnosis, prevention and treatment of diseases and clinical conditions associated with LOC148490. LOC148764 (Accession XM_086307) is another VGAM631 host target gene. LOC148764 BINDING SITE is HOST TARGET binding site found in the 5' untranslated region of mRNA encoded by LOC148764, corresponding to a HOST TARGET binding site such as BINDING SITE I, BINDING SITE II or BINDING SITE III. Table 2 illustrates the complementarity of the nucleotide sequences of LOC148764 BINDING SITE, designated SEQ ID:38589, to the nucleotide sequence of VGAM631 RNA, herein designated VGAM RNA, also designated SEQ ID:3342.

Another function of VGAM631 is therefore inhibition of LOC148764 (Accession XM_086307). Accordingly, utilities of VGAM631 include diagnosis, prevention and treatment of diseases and clinical conditions associated with LOC148764. LOC155179 (Accession XM_088169) is another VGAM631 host target gene. LOC155179 BINDING SITE is HOST TARGET binding site found in the 3' untranslated region of mRNA encoded by LOC155179, corresponding to a HOST TARGET binding site such as BINDING SITE I, BINDING SITE II or BINDING SITE III. Table 2 illustrates the complementarity of the nucleotide sequences of LOC155179 BINDING SITE, designated SEQ ID:39552, to the nucleotide sequence of VGAM631 RNA, herein designated VGAM RNA, also designated SEQ ID:3342.

Another function of VGAM631 is therefore inhibition of LOC155179 (Accession XM_088169). Accordingly, utilities of VGAM631 include diagnosis, prevention and treatment of diseases and clinical conditions associated with LOC155179. LOC91355 (Accession XM_037825) is another VGAM631 host target gene. LOC91355 BINDING SITE is HOST TARGET binding site found in the 5' untranslated region of mRNA encoded by LOC91355, corresponding to a HOST TARGET binding site such as BINDING SITE I, BINDING SITE II or BINDING SITE III. Table 2 illustrates the complementarity of the nucleotide sequences of LOC91355 BINDING SITE, designated SEQ ID:32702, to the nucleotide sequence of VGAM631 RNA, herein designated VGAM RNA, also designated SEQ ID:3342.

Another function of VGAM631 is therefore inhibition of LOC91355 (Accession XM_037825). Accordingly, utilities of VGAM631 include diagnosis, prevention and treatment of diseases and clinical conditions associated with LOC91355. FIG. 1 further provides a conceptual description of a novel bioinformatically detected viral gene of the present invention, referred to here as Viral Genomic Address Messenger 632 (VGAM632) viral gene, which modulates expression of respective host target genes thereof, the function and utility of which host target genes is known in the art.

VGAM632 is a novel bioinformatically detected regulatory, non protein coding, viral micro RNA (miRNA) gene. The method by which VGAM632 was detected is described hereinabove with reference to FIGS. 1-8.

VGAM632 gene, herein designated VGAM GENE, is a viral gene contained in the genome of Ovine Astrovirus. VGAM632 host target gene, herein designated VGAM HOST TARGET GENE, is a human gene contained in the human genome.

VGAM632 gene encodes a VGAM632 precursor RNA, herein designated VGAM PRECURSOR RNA. Similar to other miRNA genes, and unlike most ordinary genes, VGAM632 precursor RNA does not encode a protein. A nucleotide sequence identical or highly similar to the nucleotide sequence of VGAM632 precursor RNA is designated SEQ ID:618, and is provided hereinbelow with reference to the sequence listing part. Nucleotide sequence SEQ ID:618 is located at position 1405 relative to the genome of Ovine Astrovirus.

VGAM632 precursor RNA folds onto itself, forming VGAM632 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM632 folded precursor RNA into VGAM632 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM632 RNA is designated SEQ ID:3343, and is provided hereinbelow with reference to the sequence listing part.

VGAM632 host target gene, herein designated VGAM HOST TARGET GENE, encodes a corresponding messenger RNA, VGAM632 host target RNA, herein designated VGAM HOST TARGET RNA. VGAM632 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM632 RNA, herein designated VGAM RNA, binds complementarily to one or more host target binding sites located in untranslated regions of VGAM632 host target RNA, herein designated VGAM HOST TARGET RNA. This complementary binding is due to the fact that the nucleotide sequence of VGAM632 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM632 RNA, herein designated VGAM RNA, may have a different number of host target binding sites in untranslated regions of a VGAM632 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM632 RNA, herein designated VGAM RNA, to host target binding sites on VGAM632 host target RNA, herein designated VGAM HOST TARGET RNA, such as BINDING SITE I, BINDING SITE II and BINDING SITE III, inhibits translation of VGAM632 host target RNA into VGAM632 host target protein, herein designated VGAM HOST TARGET PROTEIN. VGAM host target protein is therefore outlined by a broken line.

It is appreciated that VGAM632 host target gene, herein designated VGAM HOST TARGET GENE, in fact represents a plurality of VGAM632 host target genes. The mRNA of each one of this plurality of VGAM632 host target genes comprises one or more host target binding sites, each having a nucleotide sequence which is at least partly complementary to VGAM632 RNA, herein designated VGAM RNA, and which when bound by VGAM632 RNA causes inhibition of translation of respective one or more VGAM632 host target proteins.

It is further appreciated by one skilled in the art that the mode of translational inhibition illustrated by FIG. 1 with specific reference to translational inhibition exerted by VGAM632 gene, herein designated VGAM GENE, on one or more VGAM632 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM632 is inhibition of expression of host target genes, as part of a novel viral mechanism of attacking a host. Accordingly, utilities of VGAM632 include diagnosis, prevention and treatment of viral infection by Ovine Astrovirus. Specific functions, and accordingly utilities, of VGAM632 correlate with, and may be deduced from, the identity of the host target genes which VGAM632 binds and inhibits, and the function of these host target genes, as elaborated hereinbelow.

Nucleotide sequences of the VGAM632 precursor RNA, herein designated VGAM PRECURSOR RNA, and of the 'diced' VGAM632 RNA, herein designated VGAM RNA, and a schematic representation of the secondary folding of VGAM632 folded precursor RNA, herein designated VGAM FOLDED PRECURSOR RNA, of VGAM632 are further described hereinbelow with reference to Table 1.

Nucleotide sequences of host target binding sites, such as BINDING SITE-I, BINDING SITE-II and BINDING SITE-III of FIG. 1, found on VGAM632 host target RNA, and schematic representation of the complementarity of each of these host target binding sites to VGAM632 RNA, herein designated VGAM RNA, are described hereinbelow with reference to Table 2.

As mentioned hereinabove with reference to FIG. 1, a function of VGAM632 gene, herein designated VGAM is inhibition of expression of VGAM632 target genes. It is appreciated that specific functions, and accordingly utilities, of VGAM632 correlate with, and may be deduced from, the identity of the target genes which VGAM632 binds and inhibits, and the function of these target genes, as elaborated hereinbelow.

Calcium Channel, Voltage-dependent, Gamma Subunit 6 (CACNG6, Accession NM_031897) is a VGAM632 host target gene. CACNG6 BINDING SITE is HOST TARGET binding site found in the 5' untranslated region of mRNA encoded by CACNG6, corresponding to a HOST TARGET binding site such as BINDING SITE I, BINDING SITE II or BINDING SITE III. Table 2 illustrates the complementarity of the nucleotide sequences of CACNG6 BINDING SITE, designated SEQ ID:25642, to the nucleotide sequence of VGAM632 RNA, herein designated VGAM RNA, also designated SEQ ID:3343.

A function of VGAM632 is therefore inhibition of Calcium Channel, Voltage-dependent, Gamma Subunit 6 (CACNG6, Accession NM_031897), a gene which plays a role in excitation-contraction coupling. Accordingly, utilities of VGAM632 include diagnosis, prevention and treatment of diseases and clinical conditions associated with CACNG6. The function of CACNG6 has been established by previous studies. Voltage-dependent calcium channels couple membrane depolarization in a number of cellular processes. These activities are regulated by distinct channels composed of the pore-forming alpha-1 (e.g., CACNA1D; 114206) subunit and the modulatory beta (e.g., CACNB1; 114207), alpha-2/delta (e.g., CACNA2D1; 114204), and gamma (e.g., CACNG1; 114209) subunits. By RT-PCR and genomic sequence analysis, Burgess et al. (2001) determined that the CACNG6 gene, like CACNG7 and CACNG8, contains 4 exons. A potential splice variant lacking exon 3 would eliminate 2 transmembrane domains.

Full details of the abovementioned studies are described in the following publications, the disclosure of which are hereby incorporated by reference:

Burgess, D. L.; Gefrides, L. A.; Foreman, P. J.; Noebels, J. L.: A cluster of three novel Ca (2+) channel gamma subunit genes on chromosome 19q13.4: evolution and expression profile of the gamma subunit gene family. Genomics 71: 339-350, 2001; and Chu, P.-J.; Robertson, H. M.; Best, P. M.: Calcium channel gamma subunits provide insights into the evolution of this gene family. Gene 280:37-48, 2001.

Further studies establishing the function and utilities of CACNG6 are found in John Hopkins OMIM database record ID 606898, and in sited publications numbered 4526-4527 listed in the bibliography section hereinbelow, which are also hereby incorporated by reference. Chimerin (chimaerin) 1 (CHN1, Accession NM_001822) is another VGAM632 host target gene. CHN1 BINDING SITE is HOST TARGET binding site found in the 5' untranslated region of mRNA encoded by CHN1, corresponding to a HOST TARGET binding site such as BINDING SITE I, BINDING SITE II or BINDING SITE III. Table 2 illustrates the complementarity of the nucleotide sequences of CHN1 BINDING SITE, designated SEQ ID:7562, to the nucleotide sequence of VGAM632 RNA, herein designated VGAM RNA, also designated SEQ ID:3343.

Another function of VGAM632 is therefore inhibition of Chimerin (chimaerin) 1 (CHN1, Accession NM_001822), a gene which may play an important role in neuronal signal-transduction mechanisms. Accordingly, utilities of VGAM632 include diagnosis, prevention and treatment of diseases and clinical conditions associated with CHN1. The function of CHN1 has been established by previous studies. Hall et al. (1990) isolated a novel human brain cDNA sequence encoding n-chimerin, a 34,000 M(r) protein. They found that the N-terminal half shared almost 50% identity with sequences in the regulatory domain of protein kinase C (OMIM Ref. No. 176960); the C-terminal half had 42% identity with the C-terminal region of BCR, the product of the breakpoint cluster region gene involved in the Philadelphia chromosome translocation (OMIM Ref. No. 151410). Also known as alpha-1-chimerin, n-chimerin is a brain GTPase-activating protein (GAP) for the RAS-related p21 (RAC). Hall et al. (1993) found another form of chimerin, termed alpha-2-chimerin, and showed that it is the product of an alternately spliced transcript of the human n-chimerin gene. The mRNAs corresponding to the 2 forms of chimerin were expressed differently. The single human n-chimerin gene was mapped to 2q31-q32.1 by Southern analysis of a hybrid cell DNA panel and by fluorescence in situ hybridization.

Full details of the abovementioned studies are described in the following publications, the disclosure of which are hereby incorporated by reference:

Hall, C.; Monfries, C.; Smith, P.; Lim, H. H.; Kozma, R.; Ahmed, S.; Vanniasingham, V.; Leung, T.; Lim, L.: Novel human brain cDNA encoding a 34,000 M(r) protein n-chimaerin, related to both the regulatory domain of protein kinase C and BCR, the product of the breakpoint cluster region gene. J. Molec. Biol. 211:11-16, 1990; and Hall, C.; Sin, W. C.; Teo, M.; Michael, G. J.; Smith, P.; Dong, J. M.; Lim, H. H.; Manser, E.; Spurr, N. K.; Jones, T. A.; Lim, L.: Alpha-2-chimerin, an SH2-containing GTPase-activatin.

Further studies establishing the function and utilities of CHN1 are found in John Hopkins OMIM database record ID 118423, and in sited publications numbered 3719-3720 listed in the bibliography section hereinbelow, which are also hereby incorporated by reference. Early Growth Response 3 (EGR3, Accession XM_005040) is another VGAM632 host target gene. EGR3 BINDING SITE is HOST TARGET binding site found in the 3' untranslated region of mRNA encoded by EGR3, corresponding to a HOST TARGET binding site such as BINDING SITE I, BINDING SITE II or BINDING SITE III. Table 2 illustrates the complementarity of the nucleotide sequences of EGR3 BINDING SITE, designated SEQ ID:29955, to the nucleotide sequence of VGAM632 RNA, herein designated VGAM RNA, also designated SEQ ID:3343.

Another function of VGAM632 is therefore inhibition of Early Growth Response 3 (EGR3, Accession XM_005040), a gene which is a putative transcription factor. Accordingly, utilities of VGAM632 include diagnosis, prevention and treatment of diseases and clinical conditions associated with EGR3. The function of EGR3 and its association with various diseases and clinical conditions, has been established by previous studies, as described hereinabove with reference to VGAM189. Forkhead Box E3 (FOXE3, Accession NM_012186) is another VGAM632 host target gene. FOXE3 BINDING SITE is HOST TARGET binding site found in the 3' untranslated region of mRNA encoded by FOXE3, corresponding to a HOST TARGET binding site such as BINDING SITE I, BINDING SITE II or BINDING SITE III. Table 2 illustrates the complementarity of the nucleotide sequences of FOXE3 BINDING SITE, designated SEQ ID:14472, to the nucleotide sequence of VGAM632 RNA, herein designated VGAM RNA, also designated SEQ ID:3343.

Another function of VGAM632 is therefore inhibition of Forkhead Box E3 (FOXE3, Accession NM_012186), a gene which regulates embryonic development. Accordingly, utilities of VGAM632 include diagnosis, prevention and treatment of diseases and clinical conditions associated with FOXE3. The function of FOXE3 has been established by previous studies. Dysgenesis of the anterior segment of the eye is frequently associated with cataracts and glaucoma, resulting in visual disability in childhood. Semina et al. (2001) reported a single nucleotide insertion in the coding region of the FOXE3 gene in a family with anterior segment ocular dysgenesis and cataracts (OMIM Ref. No. 107250). The mutation caused a frameshift that resulted in an abnormal sequence of 5 terminal amino acids and an addition of 111 amino acids to the predicted protein. The mutation was present in 2 affected individuals from this family and was not identified in 180 normal control chromosomes. Animal model experiments lend further support to the function of FOXE3. Blixt et al. (2000) hypothesized that mutations in Foxe3 could be responsible for the phenotype observed in dysgenetic lens (dyl) mutant mice. In these mice, the lens vesicle fails to separate from the ectoderm, causing a fusion between the lens and the cornea. Blixt et al. (2000) identified 2 mutations within the DNA-binding domain of Foxe3 in dyl mice: phe93-to-leu and phe98-to-ser. These 2 phenylalanine residues are highly conserved in all forkhead proteins and Blixt et al. (2000) predicted the mutations would obliterate DNA binding.

It is appreciated that the abovementioned animal model for FOXE3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Blixt, A.; Mahlapuu, M.; Aitola, M.; Pelto-Huikko, M.; Enerback, S.; Carlsson, P.: A forkhead gene, FoxE3, is essential for lens epithelial proliferation and closure of the lens vesicle. Genes Dev. 14:245-254, 2000; and Semina, E. V.; Brownell, I.; Mintz-Hittner, H. A.; Murray, J. C.; Jamrich, M.: Mutations in the human forkhead transcription factor FOXE3 associated with anterior segment ocular dysgen.

Further studies establishing the function and utilities of FOXE3 are found in John Hopkins OMIM database record ID 601094, and in sited publications numbered 1252 and 12528 listed in the bibliography section hereinbelow, which are also hereby incorporated by reference. Forkhead Box M1 (FOXM1, Accession NM_021953) is another VGAM632 host target gene. FOXM1 BINDING SITE is HOST TARGET binding site found in the 3' untranslated region of mRNA encoded by FOXM1, corresponding to a HOST TARGET binding site such as BINDING SITE I, BINDING SITE II or BINDING SITE III. Table 2 illustrates the complementarity of the nucleotide sequences of FOXM1 BINDING SITE, designated SEQ ID:22482, to the nucleotide sequence of VGAM632 RNA, herein designated VGAM RNA, also designated SEQ ID:3343.

Another function of VGAM632 is therefore inhibition of Forkhead Box M1 (FOXM1, Accession NM_021953), a gene which may play a role in the control of cell proliferation. Accordingly, utilities of VGAM632 include diagnosis, prevention and treatment of diseases and clinical conditions associated with FOXM1. The function of FOXM1 has been established by previous studies. The 'forkhead' gene family, originally identified in Drosophila, comprises transcription factors with a conserved 100-amino acid DNA-binding motif. One group of factors with the forkhead, or winged-helix, domain is the hepatocyte nuclear factor-3 family of proteins, which appears to regulate cell-specific transcription in hepatocytes and in respiratory and intestinal epithelia. In an attempt to identify forkhead domain transcription factors involved in intestinal cell differentiation, Ye et al. (1997) isolated FKHL16, which they designated HNF3/forkhead homolog-11 (HFH11), from a human colon carcinoma cell line. On Northern blots, FKHL16 is expressed primarily in thymus, testis, small intestine, and colon, moderately in ovary, and at reduced levels in other tissues. Ye et al. (1997) found 2 alternatively spliced FKHL16 mRNAs, yielding predicted proteins of 801 (OMIM Ref. No. HFH11A) and 748 (OMIM Ref. No. HFH11B) amino acids. Both isoforms contain 2 PEST regions, associated with rapid protein degradation. Expression studies in mouse revealed that Fkhl16 is transcribed broadly in embryos, but is expressed only in adult organs containing proliferating cells involved in replenishing differentiated cell populations or in response to growth factors released during injury or repair. By analyzing the promoter region of human FKHL16, or TRIDENT, Korver et al. (1997) found that the 300 bp upstream of the transcription start site are essential for the cell cycle-specific expression of FKHL16. They stated that the promoter data in combination with the expression of FKHL16 in cycling, but not resting, cells indicate that this protein is likely to play a role in the control of cell proliferation. By analysis of cDNA microarrays, Ly et al. (2000) showed that diminished proliferation exhibited by fibroblasts from either elderly patients or patients with Hutchinson-Gilford progeria (OMIM Ref. No. 176670) was associated with reduced expression of cell cycle genes as well as a decline in FOXM1B (OMIM Ref. No. HFH11B) levels. Wang et al. (2001) showed that increased levels of Foxm1b in regenerating liver of old transgenic mice restored the sharp peaks in hepatocyte DNA replication and mitosis that are the hallmarks of young regenerating mouse liver. Restoration of the young regenerating liver phenotype was associated with increased expression of numerous cell cycle regulatory genes. Cotransfection assays in the human hepatoma HepG2 cell line demonstrated that FOXM1B protein stimulated expression of both the cyclin B1 (OMIM Ref. No. 123836) and cyclin D1 (OMIM Ref. No. 168461) promoters, suggesting that these cyclin genes are a direct FOXM1B transcription target. The results suggested that FOXM1B controls the transcription network of genes that are essential for cell division and exit from mitosis. The results indicated that reduced expression of the FOXM1B transcription factor contributes to the decline in cellular proliferation observed in the aging process.

Full details of the abovementioned studies are described in the following publications, the disclosure of which are hereby incorporated by reference:

Westendorf, J. M.; Rao, P. N.; Gerace, L.: Cloning of cDNAs for M-phase phosphoproteins recognized by the MPM2 monoclonal antibody and determination of the phosphorylated epitope. Proc. Nat. Acad. Sci. 91:714-718, 1994; and Yao, K.-M.; Sha, M.; Lu, Z.; Wong, G. G.: Molecular analysis of a novel winged helix protein, WIN: expression pattern, DNA binding property, and alternative splicing within the DNA bin.

Further studies establishing the function and utilities of FOXM1 are found in John Hopkins OMIM database record ID 602341, and in sited publications numbered 6306-630 and 6311 listed in the bibliography section hereinbelow, which are also hereby incorporated by reference. Galanin (GAL, Accession XM_166189) is another VGAM632 host target gene. GAL BINDING SITE is HOST TARGET binding site found in the 5' untranslated region of mRNA encoded by GAL, corresponding to a HOST TARGET binding site such as BINDING SITE I, BINDING SITE II or BINDING SITE III. Table 2 illustrates the complementarity of the nucleotide sequences of GAL BINDING SITE, designated SEQ ID:43999, to the nucleotide sequence of VGAM632 RNA, herein designated VGAM RNA, also designated SEQ ID:3343.

Another function of VGAM632 is therefore inhibition of Galanin (GAL, Accession XM_166189), a gene which stimulates LH secretion and enhances LHRH-induced LH release from dispersed anterior pituitary cells in vitro. Accordingly, utilities of VGAM632 include diagnosis, prevention and treatment of diseases and clinical conditions associated with GAL. The function of GAL and its association with various diseases and clinical conditions, has been established by previous studies, as described hereinabove with reference to VGAM514. Potassium Channel, Subfamily K, Member 7 (KCNK7, Accession NM_033456) is another VGAM632 host target gene. KCNK7 BINDING SITE1 through KCNK7 BINDING SITE4 are HOST TARGET binding sites found in untranslated regions of mRNA encoded by KCNK7, corresponding to HOST TARGET binding sites such as BINDING SITE I, BINDING SITE II or BINDING SITE III. Table 2 illustrates the complementarity of the nucleotide sequences of KCNK7 BINDING SITE1 through KCNK7 BINDING SITE4, designated SEQ ID:27254, SEQ ID:27199, SEQ ID:27200 and SEQ ID:12268 respectively, to the nucleotide sequence of VGAM632 RNA, herein designated VGAM RNA, also designated SEQ ID:3343.

Another function of VGAM632 is therefore inhibition of Potassium Channel, Subfamily K, Member 7 (KCNK7, Accession NM_033456). Accordingly, utilities of VGAM632 include diagnosis, prevention and treatment of diseases and clinical conditions associated with KCNK7. Mannosyl (alpha-1,3-)-glycoprotein Beta-1,2-N-acetylglucosaminyltransferase (MGAT1, Accession NM_002406) is another VGAM632 host target gene. MGAT1 BINDING SITE is HOST TARGET binding site found in the 3' untranslated region of mRNA encoded by MGAT1, corresponding to a HOST TARGET binding site such as BINDING SITE I, BINDING SITE II or BINDING SITE III. Table 2 illustrates the complementarity of the nucleotide sequences of MGAT1 BINDING SITE, designated SEQ ID:8226, to the nucleotide sequence of VGAM632 RNA, herein designated VGAM RNA, also designated SEQ ID:3343.

Another function of VGAM632 is therefore inhibition of Mannosyl (alpha-1,3-)-glycoprotein Beta-1,2-N-acetylglucosaminyltransferase (MGAT1, Accession NM_002406), a gene which exists as a single protein-encoding exon. Accordingly, utilities of VGAM632 include diagnosis, prevention and treatment of diseases and clinical conditions associated with MGAT1. The function of MGAT1 and its association with various diseases and clinical conditions, has been established by previous studies, as described hereinabove with reference to VGAM165. Oculocerebrorenal Syndrome of Lowe (OCRL, Accession NM_000276) is another VGAM632 host target gene. OCRL BINDING SITE1 and OCRL BINDING SITE2 are HOST TARGET binding sites found in untranslated regions of mRNA encoded by OCRL, corresponding to HOST TARGET binding sites such as BINDING SITE I, BINDING SITE II or BINDING SITE III. Table 2 illustrates the complementarity of the nucleotide sequences of OCRL BINDING SITE1 and OCRL BINDING SITE2, designated SEQ ID:5818 and SEQ ID:7305 respectively, to the nucleotide sequence of VGAM632 RNA, herein designated VGAM RNA, also designated SEQ ID:3343.

Another function of VGAM632 is therefore inhibition of Oculocerebrorenal Syndrome of Lowe (OCRL, Accession NM_000276). Accordingly, utilities of VGAM632 include diagnosis, prevention and treatment of diseases and clinical conditions associated with OCRL. Src-like-adaptor 2 (SLA2, Accession NM_032214) is another VGAM632 host target gene. SLA2 BINDING SITE is HOST TARGET binding site found in the 3' untranslated region of mRNA encoded by SLA2, corresponding to a HOST TARGET binding site such as BINDING SITE I, BINDING SITE II or BINDING SITE III. Table 2 illustrates the complementarity of the nucleotide sequences of SLA2 BINDING SITE, designated SEQ ID:25943, to the nucleotide sequence of VGAM632 RNA, herein designated VGAM RNA, also designated SEQ ID:3343.

Another function of VGAM632 is therefore inhibition of Src-like-adaptor 2 (SLA2, Accession NM_032214). Accordingly, utilities of VGAM632 include diagnosis, prevention and treatment of diseases and clinical conditions associated with SLA2. Chromosome 11 Open Reading Frame 11 (C11orf11, Accession XM_167769) is another VGAM632 host target gene. C11orf11 BINDING SITE is HOST TARGET binding site found in the 3' untranslated region of mRNA encoded by C11orf11, corresponding to a HOST TARGET binding site such as BINDING SITE I, BINDING SITE II or BINDING SITE III. Table 2 illustrates the complementarity of the nucleotide sequences of C11orf11 BINDING SITE, designated SEQ ID:44789, to the nucleotide sequence of VGAM632 RNA, herein designated VGAM RNA, also designated SEQ ID:3343.

Another function of VGAM632 is therefore inhibition of Chromosome 11 Open Reading Frame 11 (C11orf11, Accession XM_167769). Accordingly, utilities of VGAM632 include diagnosis, prevention and treatment of diseases and clinical conditions associated with C11orf11. CGI-203 (Accession NM_020408) is another VGAM632 host target gene. CGI-203 BINDING SITE is HOST TARGET binding site found in the 5' untranslated region of mRNA encoded by CGI-203, corresponding to a HOST TARGET binding site such as BINDING SITE I, BINDING SITE II or BINDING SITE III. Table 2 illustrates the complementarity of the nucleotide sequences of CGI-203 BINDING SITE, designated SEQ ID:21675, to the nucleotide sequence of VGAM632 RNA, herein designated VGAM RNA, also designated SEQ ID:3343.

Another function of VGAM632 is therefore inhibition of CGI-203 (Accession NM_020408). Accordingly, utilities of VGAM632 include diagnosis, prevention and treatment of diseases and clinical conditions associated with CGI-203. KIAA0222 (Accession NM_014643) is another VGAM632 host target gene. KIAA0222 BINDING SITE is HOST TAR- GET binding site found in the 3' untranslated region of mRNA encoded by KIAA0222, corresponding to a HOST TARGET binding site such as BINDING SITE I, BINDING SITE II or BINDING SITE III. Table 2 illustrates the complementarity of the nucleotide sequences of KIAA0222 BINDING SITE, designated SEQ ID:16046, to the nucleotide sequence of VGAM632 RNA, herein designated VGAM RNA, also designated SEQ ID:3343.

Another function of VGAM632 is therefore inhibition of KIAA0222 (Accession NM_014643). Accordingly, utilities of VGAM632 include diagnosis, prevention and treatment of diseases and clinical conditions associated with KIAA0222. KIAA1915 (Accession XM_055481) is another VGAM632 host target gene. KIAA1915 BINDING SITE is HOST TARGET binding site found in the 5' untranslated region of mRNA encoded by KIAA1915, corresponding to a HOST TARGET binding site such as BINDING SITE I, BINDING SITE II or BINDING SITE III. Table 2 illustrates the complementarity of the nucleotide sequences of KIAA1915 BINDING SITE, designated SEQ ID:36274, to the nucleotide sequence of VGAM632 RNA, herein designated VGAM RNA, also designated SEQ ID:3343.

Another function of VGAM632 is therefore inhibition of KIAA1915 (Accession XM_055481). Accordingly, utilities of VGAM632 include diagnosis, prevention and treatment of diseases and clinical conditions associated with KIAA1915. Quiescin Q6 (QSCN6, Accession NM_002826) is another VGAM632 host target gene. QSCN6 BINDING SITE is HOST TARGET binding site found in the 3' untranslated region of mRNA encoded by QSCN6, corresponding to a HOST TARGET binding site such as BINDING SITE I, BINDING SITE II or BINDING SITE III. Table 2 illustrates the complementarity of the nucleotide sequences of QSCN6 BINDING SITE, designated SEQ ID:8698, to the nucleotide sequence of VGAM632 RNA, herein designated VGAM RNA, also designated SEQ ID:3343.

Another function of VGAM632 is therefore inhibition of Quiescin Q6 (QSCN6, Accession NM_002826). Accordingly, utilities of VGAM632 include diagnosis, prevention and treatment of diseases and clinical conditions associated with QSCN6. UCK1 (Accession NM_031432) is another VGAM632 host target gene. UCK1 BINDING SITE is HOST TARGET binding site found in the 3' untranslated region of mRNA encoded by UCK1, corresponding to a HOST TARGET binding site such as BINDING SITE I, BINDING SITE II or BINDING SITE III. Table 2 illustrates the complementarity of the nucleotide sequences of UCK1 BINDING SITE, designated SEQ ID:25429, to the nucleotide sequence of VGAM632 RNA, herein designated VGAM RNA, also designated SEQ ID:3343.

Another function of VGAM632 is therefore inhibition of UCK1 (Accession NM_031432). Accordingly, utilities of VGAM632 include diagnosis, prevention and treatment of diseases and clinical conditions associated with UCK1. LOC149134 (Accession XM_097594) is another VGAM632 host target gene. LOC149134 BINDING SITE is HOST TARGET binding site found in the 5' untranslated region of mRNA encoded by LOC149134, corresponding to a HOST TARGET binding site such as BINDING SITE I, BINDING SITE II or BINDING SITE III. Table 2 illustrates the complementarity of the nucleotide sequences of LOC149134 BINDING SITE, designated SEQ ID:40960, to the nucleotide sequence of VGAM632 RNA, herein designated VGAM RNA, also designated SEQ ID:3343.

Another function of VGAM632 is therefore inhibition of LOC149134 (Accession XM_097594). Accordingly, utilities of VGAM632 include diagnosis, prevention and treatment of diseases and clinical conditions associated with LOC149134. LOC149837 (Accession XM_097747) is another VGAM632 host target gene. LOC149837 BINDING SITE is HOST TARGET binding site found in the 3' untranslated region of mRNA encoded by LOC149837, corresponding to a HOST TARGET binding site such as BINDING SITE I, BINDING SITE II or BINDING SITE III. Table 2 illustrates the complementarity of the nucleotide sequences of LOC149837 BINDING SITE, designated SEQ ID:41103, to the nucleotide sequence of VGAM632 RNA, herein designated VGAM RNA, also designated SEQ ID:3343.

Another function of VGAM632 is therefore inhibition of LOC149837 (Accession XM_097747). Accordingly, utilities of VGAM632 include diagnosis, prevention and treatment of diseases and clinical conditions associated with LOC149837. LOC151723 (Accession XM_093395) is another VGAM632 host target gene. LOC151723 BINDING SITE is HOST TARGET binding site found in the 5' untranslated region of mRNA encoded by LOC151723, corresponding to a HOST TARGET binding site such as BINDING SITE I, BINDING SITE II or BINDING SITE III. Table 2 illustrates the complementarity of the nucleotide sequences of LOC151723 BINDING SITE, designated SEQ ID:40192, to the nucleotide sequence of VGAM632 RNA, herein designated VGAM RNA, also designated SEQ ID:3343.

Another function of VGAM632 is therefore inhibition of LOC151723 (Accession XM_093395). Accordingly, utilities of VGAM632 include diagnosis, prevention and treatment of diseases and clinical conditions associated with LOC151723. LOC157653 (Accession XM_088353) is another VGAM632 host target gene. LOC157653 BINDING SITE is HOST TARGET binding site found in the 5' untranslated region of mRNA encoded by LOC157653, corresponding to a HOST TARGET binding site such as BINDING SITE I, BINDING SITE II or BINDING SITE III. Table 2 illustrates the complementarity of the nucleotide sequences of LOC157653 BINDING SITE, designated SEQ ID:39636, to the nucleotide sequence of VGAM632 RNA, herein designated VGAM RNA, also designated SEQ ID:3343.

Another function of VGAM632 is therefore inhibition of LOC157653 (Accession XM_088353). Accordingly, utilities of VGAM632 include diagnosis, prevention and treatment of diseases and clinical conditions associated with LOC157653. LOC255397 (Accession XM_173868) is another VGAM632 host target gene. LOC255397 BINDING SITE is HOST TARGET binding site found in the 5' untranslated region of mRNA encoded by LOC255397, corresponding to a HOST TARGET binding site such as BINDING SITE I, BINDING SITE II or BINDING SITE III. Table 2 illustrates the complementarity of the nucleotide sequences of LOC255397 BINDING SITE, designated SEQ ID:46566, to the nucleotide sequence of VGAM632 RNA, herein designated VGAM RNA, also designated SEQ ID:3343.

Another function of VGAM632 is therefore inhibition of LOC255397 (Accession XM_173868). Accordingly, utilities of VGAM632 include diagnosis, prevention and treatment of diseases and clinical conditions associated with LOC255397. LOC58525 (Accession XM_086045) is another VGAM632 host target gene. LOC58525 BINDING SITE is HOST TARGET binding site found in the 3' untranslated region of mRNA encoded by LOC58525, corresponding to a HOST TARGET binding site such as BINDING SITE I, BINDING SITE II or BINDING SITE III. Table 2 illustrates the complementarity of the nucleotide sequences of LOC58525 BINDING SITE, designated SEQ ID:38458, to the nucleotide sequence of VGAM632 RNA, herein designated VGAM RNA, also designated SEQ ID:3343.

Another function of VGAM632 is therefore inhibition of LOC58525 (Accession XM_086045). Accordingly, utilities of VGAM632 include diagnosis, prevention and treatment of diseases and clinical conditions associated with LOC58525. FIG. 1 further provides a conceptual description of a novel bioinformatically detected viral gene of the present invention, referred to here as Viral Genomic Address Messenger 633 (VGAM633) viral gene, which modulates expression of respective host target genes thereof, the function and utility of which host target genes is known in the art.

VGAM633 is a novel bioinformatically detected regulatory, non protein coding, viral micro RNA (miRNA) gene. The method by which VGAM633 was detected is described hereinabove with reference to FIGS. 1-8.

VGAM633 gene, herein designated VGAM GENE, is a viral gene contained in the genome of Turkey Astrovirus. VGAM633 host target gene, herein designated VGAM HOST TARGET GENE, is a human gene contained in the human genome.

VGAM633 gene encodes a VGAM633 precursor RNA, herein designated VGAM PRECURSOR RNA. Similar to other miRNA genes, and unlike most ordinary genes, VGAM633 precursor RNA does not encode a protein. A nucleotide sequence identical or highly similar to the nucleotide sequence of VGAM633 precursor RNA is designated SEQ ID:619, and is provided hereinbelow with reference to the sequence listing part. Nucleotide sequence SEQ ID:619 is located at position 2114 relative to the genome of Turkey Astrovirus.

VGAM633 precursor RNA folds onto itself, forming VGAM633 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM633 folded precursor RNA into VGAM633 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM633 RNA is designated SEQ ID:3344, and is provided hereinbelow with reference to the sequence listing part.

VGAM633 host target gene, herein designated VGAM HOST TARGET GENE, encodes a corresponding messenger RNA, VGAM633 host target RNA, herein designated VGAM HOST TARGET RNA. VGAM633 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM633 RNA, herein designated VGAM RNA, binds complementarily to one or more host target binding sites located in untranslated regions of VGAM633 host target RNA, herein designated VGAM HOST TARGET RNA. This complementary binding is due to the fact that the nucleotide sequence of VGAM633 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM633 RNA, herein designated VGAM RNA, may have a different number of host target binding sites in untranslated regions of a VGAM633 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM633 RNA, herein designated VGAM RNA, to host target binding sites on VGAM633 host target RNA, herein designated VGAM HOST TARGET RNA, such as BINDING SITE I, BINDING SITE II and BINDING SITE III, inhibits translation of VGAM633 host target RNA into VGAM633 host target protein, herein designated VGAM HOST TARGET PROTEIN. VGAM host target protein is therefore outlined by a broken line.

It is appreciated that VGAM633 host target gene, herein designated VGAM HOST TARGET GENE, in fact represents a plurality of VGAM633 host target genes. The mRNA of each one of this plurality of VGAM633 host target genes comprises one or more host target binding sites, each having a nucleotide sequence which is at least partly complementary to VGAM633 RNA, herein designated VGAM RNA, and which when bound by VGAM633 RNA causes inhibition of translation of respective one or more VGAM633 host target proteins.

It is further appreciated by one skilled in the art that the mode of translational inhibition illustrated by FIG. 1 with specific reference to translational inhibition exerted by VGAM633 gene, herein designated VGAM GENE, on one or more VGAM633 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM633 is inhibition of expression of host target genes, as part of a novel viral mechanism of attacking a host. Accordingly, utilities of VGAM633 include diagnosis, prevention and treatment of viral infection by Turkey Astrovirus. Specific functions, and accordingly utilities, of VGAM633 correlate with, and may be deduced from, the identity of the host target genes which VGAM633 binds and inhibits, and the function of these host target genes, as elaborated hereinbelow.

Nucleotide sequences of the VGAM633 precursor RNA, herein designated VGAM PRECURSOR RNA, and of the 'diced' VGAM633 RNA, herein designated VGAM RNA, and a schematic representation of the secondary folding of VGAM633 folded precursor RNA, herein designated VGAM FOLDED PRECURSOR RNA, of VGAM633 are further described hereinbelow with reference to Table 1.

Nucleotide sequences of host target binding sites, such as BINDING SITE-I, BINDING SITE-II and BINDING SITE-III of FIG. 1, found on VGAM633 host target RNA, and schematic representation of the complementarity of each of these host target binding sites to VGAM633 RNA, herein designated VGAM RNA, are described hereinbelow with reference to Table 2.

As mentioned hereinabove with reference to FIG. 1, a function of VGAM633 gene, herein designated VGAM is inhibition of expression of VGAM633 target genes. It is appreciated that specific functions, and accordingly utilities, of VGAM633 correlate with, and may be deduced from, the identity of the target genes which VGAM633 binds and inhibits, and the function of these target genes, as elaborated hereinbelow.

Fibroblast Growth Factor 5 (FGF5, Accession NM_033143) is a VGAM633 host target gene. FGF5 BINDING SITE is HOST TARGET binding site found in the 3' untranslated region of mRNA encoded by FGF5, corresponding to a HOST TARGET binding site such as BINDING SITE I, BINDING SITE II or BINDING SITE III. Table 2 illustrates the complementarity of the nucleotide sequences of FGF5 BINDING SITE, designated SEQ ID:26995, to the nucleotide sequence of VGAM633 RNA, herein designated VGAM RNA, also designated SEQ ID:3344.

A function of VGAM633 is therefore inhibition of Fibroblast Growth Factor 5 (FGF5, Accession NM_033143), a gene which induces transformation and may regulate neuronal differentiation. Accordingly, utilities of VGAM633 include diagnosis, prevention and treatment of diseases and clinical conditions associated with FGF5. The function of FGF5 and its association with various diseases and clinical conditions, has been established by previous studies, as described hereinabove with reference to VGAM276. Huntingtin Interacting Protein 1 (HIP1, Accession NM_005338) is another VGAM633 host target gene. HIP1 BINDING SITE is HOST TARGET binding site found in the 3' untranslated region of mRNA encoded by HIP1, corresponding to a HOST TARGET binding site such as BINDING SITE I, BINDING SITE II or BINDING SITE III. Table 2 illustrates the complementarity of the nucleotide sequences of HIP1 BINDING SITE, designated SEQ ID:11809, to the nucleotide sequence of VGAM633 RNA, herein designated VGAM RNA, also designated SEQ ID:3344.

Another function of VGAM633 is therefore inhibition of Huntingtin Interacting Protein 1 (HIP1, Accession NM_005338), a gene which is a membrane protein and interacts with huntingtin. Accordingly, utilities of VGAM633 include diagnosis, prevention and treatment of diseases and clinical conditions associated with HIP1. The function of HIP1 and its association with various diseases and clinical conditions, has been established by previous studies, as described hereinabove with reference to VGAM474. Transforming Growth Factor, Beta Receptor III (betaglycan, 300 kDa) (TGFBR3, Accession NM_003243) is another VGAM633 host target gene. TGFBR3 BINDING SITE is HOST TARGET binding site found in the 3' untranslated region of mRNA encoded by TGFBR3, corresponding to a HOST TARGET binding site such as BINDING SITE I, BINDING SITE II or BINDING SITE III. Table 2 illustrates the complementarity of the nucleotide sequences of TGFBR3 BINDING SITE, designated SEQ ID:9246, to the nucleotide sequence of VGAM633 RNA, herein designated VGAM RNA, also designated SEQ ID:3344.

Another function of VGAM633 is therefore inhibition of Transforming Growth Factor, Beta Receptor III (betaglycan, 300 kDa) (TGFBR3, Accession NM_003243), a gene which involves in capturing and retaining TGF-beta for presentation to the signaling receptors. Accordingly, utilities of VGAM633 include diagnosis, prevention and treatment of diseases and clinical conditions associated with TGFBR3. The function of TGFBR3 and its association with various diseases and clinical conditions, has been established by previous studies, as described hereinabove with reference to VGAM139. FLJ20413 (Accession NM_017808) is another VGAM633 host target gene. FLJ20413 BINDING SITE is HOST TARGET binding site found in the 3' untranslated region of mRNA encoded by FLJ20413, corresponding to a HOST TARGET binding site such as BINDING SITE I, BINDING SITE II or BINDING SITE III. Table 2 illustrates the complementarity of the nucleotide sequences of FLJ20413 BINDING SITE, designated SEQ ID:19449, to the nucleotide sequence of VGAM633 RNA, herein designated VGAM RNA, also designated SEQ ID:3344.

Another function of VGAM633 is therefore inhibition of FLJ20413 (Accession NM_017808). Accordingly, utilities of VGAM633 include diagnosis, prevention and treatment of diseases and clinical conditions associated with FLJ20413. Heat Shock 90 kDa Protein 1, Alpha-like 3 (HSPCAL3, Accession XM_084514) is another VGAM633 host target gene. HSPCAL3 BINDING SITE is HOST TARGET binding site found in the 3' untranslated region of mRNA encoded by HSPCAL3, corresponding to a HOST TARGET binding site such as BINDING SITE I, BINDING SITE II or BINDING SITE III. Table 2 illustrates the complementarity of the nucleotide sequences of HSPCAL3 BINDING SITE, designated SEQ ID:37616, to the nucleotide sequence of VGAM633 RNA, herein designated VGAM RNA, also designated SEQ ID:3344.

Another function of VGAM633 is therefore inhibition of Heat Shock 90kDa Protein 1, Alpha-like 3 (HSPCAL3, Accession XM_084514). Accordingly, utilities of VGAM633 include diagnosis, prevention and treatment of diseases and clinical conditions associated with HSPCAL3. KIAA0608 (Accession XM_051081) is another VGAM633 host target gene. KIAA0608 BINDING SITE is HOST TARGET binding site found in the 3" untranslated region of mRNA encoded by KIAA0608, corresponding to a HOST TARGET binding site such as BINDING SITE I, BINDING SITE II or BINDING SITE III. Table 2 illustrates the complementarity of the nucleotide sequences of KIAA0608 BINDING SITE, designated SEQ ID:35735, to the nucleotide sequence of VGAM633 RNA, herein designated VGAM RNA, also designated SEQ ID:3344.

Another function of VGAM633 is therefore inhibition of KIAA0608 (Accession XM_051081). Accordingly, utilities of VGAM633 include diagnosis, prevention and treatment of diseases and clinical conditions associated with KIAA0608. KIAA1026 (Accession XM_048825) is another VGAM633 host target gene. KIAA1026 BINDING SITE is HOST TARGET binding site found in the 3' untranslated region of mRNA encoded by KIAA1026, corresponding to a HOST TARGET binding site such as BINDING SITE I, BINDING SITE II or BINDING SITE III. Table 2 illustrates the complementarity of the nucleotide sequences of KIAA1026 BINDING SITE, designated SEQ ID:35272, to the nucleotide sequence of VGAM633 RNA, herein designated VGAM RNA, also designated SEQ ID:3344.

Another function of VGAM633 is therefore inhibition of KIAA1026 (Accession XM_048825). Accordingly, utilities of VGAM633 include diagnosis, prevention and treatment of diseases and clinical conditions associated with KIAA1026. LOC220549 (Accession XM_167521) is another VGAM633 host target gene. LOC220549 BINDING SITE is HOST TARGET binding site found in the 5' untranslated region of mRNA encoded by LOC220549, corresponding to a HOST TARGET binding site such as BINDING SITE I, BINDING SITE II or BINDING SITE III. Table 2 illustrates the complementarity of the nucleotide sequences of LOC220549 BIND- ING SITE, designated SEQ ID:44653, to the nucleotide sequence of VGAM633 RNA, herein designated VGAM RNA, also designated SEQ ID:3344.

Another function of VGAM633 is therefore inhibition of LOC220549 (Accession XM_167521). Accordingly, utilities of VGAM633 include diagnosis, prevention and treatment of diseases and clinical conditions associated with LOC220549. LOC51696 (Accession NM_016217) is another VGAM633 host target gene. LOC51696 BINDING SITE is HOST TARGET binding site found in the 3' untranslated region of mRNA encoded by LOC51696, corresponding to a HOST TARGET binding site such as BINDING SITE I, BINDING SITE II or BINDING SITE III. Table 2 illustrates the complementarity of the nucleotide sequences of LOC51696 BINDING SITE, designated SEQ ID:18306, to the nucleotide sequence of VGAM633 RNA, herein designated VGAM RNA, also designated SEQ ID:3344.

Another function of VGAM633 is therefore inhibition of LOC51696 (Accession NM_016217). Accordingly, utilities of VGAM633 include diagnosis, prevention and treatment of diseases and clinical conditions associated with LOC51696.

FIG. 1 further provides a conceptual description of a novel bioinformatically detected viral gene of the present invention, referred to here as Viral Genomic Address Messenger 634 (VGAM634) viral gene, which modulates expression of respective host target genes thereof, the function and utility of which host target genes is known in the art.

VGAM634 is a novel bioinformatically detected regulatory, non protein coding, viral micro RNA (miRNA) gene. The method by which VGAM634 was detected is described hereinabove with reference to FIGS. 1-8.

VGAM634 gene, herein designated VGAM GENE, is a viral gene contained in the genome of Turkey Astrovirus. VGAM634 host target gene, herein designated VGAM HOST TARGET GENE, is a human gene contained in the human genome.

VGAM634 gene encodes a VGAM634 precursor RNA, herein designated VGAM PRECURSOR RNA. Similar to other miRNA genes, and unlike most ordinary genes, VGAM634 precursor RNA does not encode a protein. A nucleotide sequence identical or highly similar to the nucleotide sequence of VGAM634 precursor RNA is designated SEQ ID:620, and is provided hereinbelow with reference to the sequence listing part. Nucleotide sequence SEQ ID:620 is located at position 1689 relative to the genome of Turkey Astrovirus.

VGAM634 precursor RNA folds onto itself, forming VGAM634 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM634 folded precursor RNA into VGAM634 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM634 RNA is designated SEQ ID:3345, and is provided hereinbelow with reference to the sequence listing part.

VGAM634 host target gene, herein designated VGAM HOST TARGET GENE, encodes a corresponding messenger RNA, VGAM634 host target RNA, herein designated VGAM HOST TARGET RNA. VGAM634 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM634 RNA, herein designated VGAM RNA, binds complementarily to one or more host target binding sites located in untranslated regions of VGAM634 host target RNA, herein designated VGAM HOST TARGET RNA. This complementary binding is due to the fact that the nucleotide sequence of VGAM634 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM634 RNA, herein designated VGAM RNA, may have a different number of host target binding sites in untranslated regions of a VGAM634 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM634 RNA, herein designated VGAM RNA, to host target binding sites on VGAM634 host target RNA, herein designated VGAM HOST TARGET RNA, such as BINDING SITE I, BINDING SITE II and BINDING SITE III, inhibits translation of VGAM634 host target RNA into VGAM634 host target protein, herein designated VGAM HOST TARGET PROTEIN. VGAM host target protein is therefore outlined by a broken line.

It is appreciated that VGAM634 host target gene, herein designated VGAM HOST TARGET GENE, in fact represents a plurality of VGAM634 host target genes. The mRNA of each one of this plurality of VGAM634 host target genes comprises one or more host target binding sites, each having a nucleotide sequence which is at least partly complementary to VGAM634 RNA, herein designated VGAM RNA, and which when bound by VGAM634 RNA causes inhibition of translation of respective one or more VGAM634 host target proteins.

It is further appreciated by one skilled in the art that the mode of translational inhibition illustrated by FIG. 1 with specific reference to translational inhibition exerted by VGAM634 gene, herein designated VGAM GENE, on one or more VGAM634 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM634 is inhibition of expression of host target genes, as part of a novel viral mechanism of attacking a host. Accordingly, utilities of VGAM634 include diagnosis, prevention and treatment of viral infection by Turkey Astrovirus. Specific functions, and accordingly utilities, of VGAM634 correlate with, and may be deduced from, the identity of the host target genes which VGAM634 binds and inhibits, and the function of these host target genes, as elaborated hereinbelow.

Nucleotide sequences of the VGAM634 precursor RNA, herein designated VGAM PRECURSOR RNA, and of the 'diced' VGAM634 RNA, herein designated VGAM RNA, and a schematic representation of the secondary folding of VGAM634 folded precursor RNA, herein designated VGAM FOLDED PRECURSOR RNA, of VGAM634 are further described hereinbelow with reference to Table 1.

Nucleotide sequences of host target binding sites, such as BINDING SITE-I, BINDING SITE-II and BINDING SITE-III of FIG. 1, found on VGAM634 host target RNA, and schematic representation of the complementarity of each of these host target binding sites to VGAM634 RNA, herein designated VGAM RNA, are described hereinbelow with reference to Table 2.

As mentioned hereinabove with reference to FIG. 1, a function of VGAM634 gene, herein designated VGAM is inhibition of expression of VGAM634 target genes. It is appreciated that specific functions, and accordingly utilities, of VGAM634 correlate with, and may be deduced from, the identity of the target genes which VGAM634 binds and inhibits, and the function of these target genes, as elaborated hereinbelow.

Chondroitin Sulfate Proteoglycan 3 (neurocan) (CSPG3, Accession NM_004386) is a VGAM634 host target gene. CSPG3 BINDING SITE is HOST TARGET binding site found in the 3' untranslated region of mRNA encoded by CSPG3, corresponding to a HOST TARGET binding site such as BINDING SITE I, BINDING SITE II or BINDING SITE III. Table 2 illustrates the complementarity of the nucleotide sequences of CSPG3 BINDING SITE, designated SEQ ID:10614, to the nucleotide sequence of VGAM634 RNA, herein designated VGAM RNA, also designated SEQ ID:3345.

A function of VGAM634 is therefore inhibition of Chondroitin Sulfate Proteoglycan 3 (neurocan) (CSPG3, Accession NM_004386), a gene which may play a role in modulating cell adhesion and migrationn. Accordingly, utilities of VGAM634 include diagnosis, prevention and treatment of diseases and clinical conditions associated with CSPG3. The function of CSPG3 has been established by previous studies. Neurocan was first described in the early postnatal rat brain where it accounts for 20 to 30% of the total chondroitin sulfate proteoglycan. Rauch et al. (1992) cloned the rat cDNA using degenerate primers based on partial amino acid sequence of immunoaffinity-purified protein. The mouse neurocan cDNA encodes a deduced 1,257-amino acid protein with a predicted molecular mass of 136 kD. The large protein is processed into a smaller form in the adult brain. The predicted protein has a 22-amino acid signal peptide followed by an immunoglobin-like domain and repeating motifs characteristic of the hyaluronic acid-binding region of aggregating proteoglycans. The C terminus shows approximately 60% identity to the fibroblast and cartilage proteoglycans versican (OMIM Ref. No. 118661) and aggrecan (OMIM Ref. No. 155760). Northern blots detected a 7.5-kb transcript from 4-day and adult rat brains Prange et al. (1998) cloned human neurocan cDNAs from infant and adult brain cDNA libraries. The deduced 1,321-amino acid protein shares 63% sequence identity with both mouse and rat neurocan proteins. Like other known proteoglycans, its N terminus contains an immunoglobulin domain and a series of hyaluronic acid-binding tandem repeats, and its C terminus contains an EGF-like domain, a lectin-like domain, and a complement regulatory-like domain. Northern blot analysis detected expression of a 7.5-kb transcript in fetal and adult tissues from all brain regions tested Full details of the abovementioned studies are described in the following publications, the disclosure of which are hereby incorporated by reference:

Rauch, U.; Grimpe, B.; Kulbe, G.; Arnold-Ammer, I.; Beier, D. R.; Fassler, R.: Structure and chromosomal localization of the mouse neurocan gene. Genomics 28: 405-410, 1995; and Prange, C. K.; Pennacchio, L. A.; Lieuallen, K.; Fan, W.; Lennon, G. G.: Characterization of the human neurocan gene, CSPG3. Gene 221:199-205, 1998.

Further studies establishing the function and utilities of CSPG3 are found in John Hopkins OMIM database record ID 600826, and in sited publications numbered 7779-7782 listed in the bibliography section hereinbelow, which are also hereby incorporated by reference. Dishevelled Associated Activator of Morphogenesis 2 (DAAM2, Accession XM_166434) is another VGAM634 host target gene. DAAM2 BINDING SITE is HOST TARGET binding site found in the 3' untranslated region of mRNA encoded by DAAM2, corresponding to a HOST TARGET binding site such as BINDING SITE I, BINDING SITE II or BINDING SITE III. Table 2 illustrates the complementarity of the nucleotide sequences of DAAM2 BINDING SITE, designated SEQ ID:44336, to the nucleotide sequence of VGAM634 RNA, herein designated VGAM RNA, also designated SEQ ID:3345.

Another function of VGAM634 is therefore inhibition of Dishevelled Associated Activator of Morphogenesis 2 (DAAM2, Accession XM_166434), a gene which controls cell polarity and movement during development. Accordingly, utilities of VGAM634 include diagnosis, prevention and treatment of diseases and clinical conditions associated with DAAM2. The function of DAAM2 and its association with various diseases and clinical conditions, has been established by previous studies, as described hereinabove with reference to VGAM247. Estrogen-related Receptor Beta Like 1 (ESRRBL1, Accession NM_018010) is another VGAM634 host target gene. ESRRBL1 BINDING SITE is HOST TARGET binding site found in the 3' untranslated region of mRNA encoded by ESRRBL1, corresponding to a HOST TARGET binding site such as BINDING SITE I, BINDING SITE II or BINDING SITE III. Table 2 illustrates the complementarity of the nucleotide sequences of ESRRBL1 BINDING SITE, designated SEQ ID:19741, to the nucleotide sequence of VGAM634 RNA, herein designated VGAM RNA, also designated SEQ ID:3345.

Another function of VGAM634 is therefore inhibition of Estrogen-related Receptor Beta Like 1 (ESRRBL1, Accession NM_018010). Accordingly, utilities of VGAM634 include diagnosis, prevention and treatment of diseases and clinical conditions associated with ESRRBL1. Growth Factor Receptor-bound Protein 10 (GRB10, Accession NM_005311) is another VGAM634 host target gene. GRB10 BINDING SITE is HOST TARGET binding site found in the 3' untranslated region of mRNA encoded by GRB10, corresponding to a HOST TARGET binding site such as BINDING SITE I, BINDING SITE II or BINDING SITE III. Table 2 illustrates the complementarity of the nucleotide sequences of GRB10 BINDING SITE, designated SEQ ID:11788, to the nucleotide sequence of VGAM634 RNA, herein designated VGAM RNA, also designated SEQ ID:3345.

Another function of VGAM634 is therefore inhibition of Growth Factor Receptor-bound Protein 10 (GRB10, Accession NM_005311), a gene which plays a functional role in insulin and IGF-I signaling. Accordingly, utilities of VGAM634 include diagnosis, prevention and treatment of diseases and clinical conditions associated with GRB10. The function of GRB10 and its association with various diseases and clinical conditions, has been established by previous studies, as described hereinabove with reference to VGAM441. Interleukin 1, Alpha (IL1A, Accession XM_031221) is another VGAM634 host target gene. IL1A BINDING SITE is HOST TARGET binding site found in the 3' untranslated region of mRNA encoded by IL1A, corresponding to a HOST TARGET binding site such as BINDING SITE I, BINDING SITE II or BINDING SITE III. Table 2 illustrates the complementarity of the nucleotide sequences of IL1A BINDING SITE, designated SEQ ID:31308, to the nucleotide sequence of VGAM634 RNA, herein designated VGAM RNA, also designated SEQ ID:3345.

Another function of VGAM634 is therefore inhibition of Interleukin 1, Alpha (IL1A, Accession XM_031221), a gene which stimulates thymocyte proliferation by inducing il-2 release, b-cell maturation & proliferation, & fibroblast growth factor activity. Accordingly, utilities of VGAM634 include diagnosis, prevention and treatment of diseases and clinical conditions associated with IL1A. The function of IL1A and its association with various diseases and clinical conditions, has been established by previous studies, as described hereinabove with reference to VGAM475. IRTA1 (Accession NM_031282) is another VGAM634 host target gene. IRTA1 BINDING SITE is HOST TARGET binding site found in the 3' untranslated region of mRNA encoded by IRTA1, corresponding to a HOST TARGET binding site such as BINDING SITE I, BINDING SITE II or BINDING SITE III. Table 2 illustrates the complementarity of the nucleotide sequences of IRTA1 BINDING SITE, designated SEQ ID:25303, to the nucleotide sequence of VGAM634 RNA, herein designated VGAM RNA, also designated SEQ ID:3345.

Another function of VGAM634 is therefore inhibition of IRTA1 (Accession NM_031282). Accordingly, utilities of VGAM634 include diagnosis, prevention and treatment of diseases and clinical conditions associated with IRTA1. Arginine-glutamic Acid Dipeptide (RE) Repeats (RERE, Accession NM_012102) is another VGAM634 host target gene. RERE BINDING SITE is HOST TARGET binding site found in the 3' untranslated region of mRNA encoded by RERE, corresponding to a HOST TARGET binding site such as BINDING SITE I, BINDING SITE II or BINDING SITE III. Table 2 illustrates the complementarity of the nucleotide sequences of RERE BINDING SITE, designated SEQ ID:14411, to the nucleotide sequence of VGAM634 RNA, herein designated VGAM RNA, also designated SEQ ID:3345.

Another function of VGAM634 is therefore inhibition of Arginine-glutamic Acid Dipeptide (RE) Repeats (RERE, Accession NM_012102), a gene which binds DRPLA and locates in the nucleus. Accordingly, utilities of VGAM634 include diagnosis, prevention and treatment of diseases and clinical conditions associated with RERE. The function of RERE and its association with various diseases and clinical conditions, has been established by previous studies, as described hereinabove with reference to VGAM51. RNA (guanine-7-) Methyltransferase (RNMT, Accession NM_003799) is another VGAM634 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9892, to the nucleotide sequence of VGAM634 RNA, herein designated VGAM RNA, also designated SEQ ID:3345.

Another function of VGAM634 is therefore inhibition of RNA (guanine-7-) Methyltransferase (RNMT, Accession NM_003799), a gene which catalyzes the methylation of GpppN- at the guanine N7 position. Accordingly, utilities of VGAM634 include diagnosis, prevention and treatment of diseases and clinical conditions associated with RNMT. The function of RNMT and its association with various diseases and clinical conditions, has been established by previous studies, as described hereinabove with reference to VGAM178. RU2 (Accession NM_016356) is another VGAM634 host target gene. RU2 BINDING SITE is HOST TARGET binding site found in the 5' untranslated region of mRNA encoded by RU2, corresponding to a HOST TARGET binding site such as BINDING SITE I, BINDING SITE II or BINDING SITE III. Table 2 illustrates the complementarity of the nucleotide sequences of RU2 BINDING SITE, designated SEQ ID:18494, to the nucleotide sequence of VGAM634 RNA, herein designated VGAM RNA, also designated SEQ ID:3345.

Another function of VGAM634 is therefore inhibition of RU2 (Accession NM_016356), a gene which expressed ubiquitously, potentially useful antigens for cancer immunotherapy cannot be predicted from the sequence of the normal cellular protein. Accordingly, utilities of VGAM634 include diagnosis, prevention and treatment of diseases and clinical conditions associated with RU2. The function of RU2 has been established by previous studies. Tumor antigens recognized by cytolytic T cells (CTLs) can be classified into 4 groups: shared tumor-specific antigens encoded by MAGE-type genes (e.g., MAGEA1; 300016) that are silent in most normal tissues and expressed in many tumors; differentiation antigens that are also expressed in normal cells; antigens resulting from tumor-specific point mutations; and antigens overexpressed in tumor cells. By screening cells expressing both HLA-B7 and kidney tumor cell RNA with autologous CTLs, followed by PCR, van den Eynde et al. (1999) obtained cDNAs encoding RU2, which is identical to the KIAA1154 gene identified by Hirosawa et al. (1999). Genomic sequence analysis determined that RU2 is transcribed as a 'normal' gene, resulting in a sense transcript (RU2S), and in the opposite direction, resulting in a shorter antisense transcript (RU2AS) found in tumors. Testing of synthetic peptides determined that the tumor antigen binding to HLA-B7 has the sequence LPRWPPPQL. Northern blot analysis revealed that the full-length gene is expressed as a 2.2-kb transcript. RT-PCR analysis detected ubiquitous expression of the full-length RU2S transcript, but expression of the RU2AS transcript was restricted to normal kidney, bladder, liver, and testis, as well as tumors of various histologic origins. The deduced RU2S protein contains 476 amino acids, while the RU2AS protein contains 84 residues. Van den Eynde et al. (1999) concluded that potentially useful antigens for cancer immunotherapy cannot be predicted from the sequence of the normal cellular protein. Using FISH, van den Eynde et al. (1999) mapped the RU2 gene to 6p22.1.

Full details of the abovementioned studies are described in the following publications, the disclosure of which are hereby incorporated by reference:

Hirosawa, M.; Nagase, T.; Ishikawa, K.; Kikuno, R.; Nomura, N.; Ohara, O.: Characterization of cDNA clones selected by the GeneMark analysis from size-fractionated cDNA libraries from human brain. DNA Res. 6:329-336, 1999; and van den Eynde, B. J.; Gaugler, B.; Probst-Kepper, M.; Michaux, L.; Devuyst, O.; Lorge, F.; Weynants, P.; Boon, T.: A new antigen recognized by cytolytic T lymphocytes on a human kidney.

Further studies establishing the function and utilities of RU2 are found in John Hopkins OMIM database record ID 605755, and in sited publications numbered 7480 listed in the bibliography section hereinbelow, which are also hereby incorporated by reference. TRAM (Accession NM_014294) is another VGAM634 host target gene. TRAM BINDING SITE is HOST TARGET binding site found in the 3' untranslated region of mRNA encoded by TRAM, corresponding to a HOST TARGET binding site such as BINDING SITE I, BINDING SITE II or BINDING SITE III. Table 2 illustrates the complementarity of the nucleotide sequences of TRAM BINDING SITE, designated SEQ ID:15592, to the nucleotide sequence of VGAM634 RNA, herein designated VGAM RNA, also designated SEQ ID:3345.

Another function of VGAM634 is therefore inhibition of TRAM (Accession NM_014294). Accordingly, utilities of VGAM634 include diagnosis, prevention and treatment of diseases and clinical conditions associated with TRAM. Ubiquitin-conjugating Enzyme E2A (RAD6 homolog) (UBE2A, Accession NM_003336) is another VGAM634 host target gene. UBE2A BINDING SITE is HOST TARGET binding site found in the 3' untranslated region of mRNA encoded by UBE2A, corresponding to a HOST TARGET binding site such as BINDING SITE I, BINDING SITE II or BINDING SITE III. Table 2 illustrates the complementarity of the nucleotide sequences of UBE2A BINDING SITE, designated SEQ ID:9343, to the nucleotide sequence of VGAM634 RNA, herein designated VGAM RNA, also designated SEQ ID:3345.

Another function of VGAM634 is therefore inhibition of Ubiquitin-conjugating Enzyme E2A (RAD6 homolog) (UBE2A, Accession NM_003336), a gene which catalyzes the covalent attachment of ubiquitin to other proteins and is required for postreplication repair of uv-damaged dna. Accordingly, utilities of VGAM634 include diagnosis, prevention and treatment of diseases and clinical conditions associated with UBE2A. The function of UBE2A and its association with various diseases and clinical conditions, has been established by previous studies, as described hereinabove with reference to VGAM294. ADAM-like, Decysin 1 (ADAMDEC1, Accession NM_014479) is another VGAM634 host target gene. ADAMDEC1 BINDING SITE is HOST TARGET binding site found in the 3' untranslated region of mRNA encoded by ADAMDEC1, corresponding to a HOST TARGET binding site such as BINDING SITE I, BINDING SITE II or BINDING SITE III. Table 2 illustrates the complementarity of the nucleotide sequences of ADAMDEC1 BINDING SITE, designated SEQ ID:15824, to the nucleotide sequence of VGAM634 RNA, herein designated VGAM RNA, also designated SEQ ID:3345.

Another function of VGAM634 is therefore inhibition of ADAM-like, Decysin 1 (ADAMDEC1, Accession NM_014479). Accordingly, utilities of VGAM634 include diagnosis, prevention and treatment of diseases and clinical conditions associated with ADAMDEC1. APCL (Accession NM_005883) is another VGAM634 host target gene. APCL BINDING SITE is HOST TARGET binding site found in the 3' untranslated region of mRNA encoded by APCL, corresponding to a HOST TARGET binding site such as BINDING SITE I, BINDING SITE II or BINDING SITE III. Table 2 illustrates the complementarity of the nucleotide sequences of APCL BINDING SITE, designated SEQ ID:12496, to the nucleotide sequence of VGAM634 RNA, herein designated VGAM RNA, also designated SEQ ID:3345.

Another function of VGAM634 is therefore inhibition of APCL (Accession NM_005883). Accordingly, utilities of VGAM634 include diagnosis, prevention and treatment of diseases and clinical conditions associated with APCL. Rho GTPase Activating Protein 8 (ARHGAP8, Accession NM_017701) is another VGAM634 host target gene. ARHGAP8 BINDING SITE is HOST TARGET binding site found in the 5' untranslated region of mRNA encoded by ARHGAP8, corresponding to a HOST TARGET binding site such as BINDING SITE I, BINDING SITE II or BINDING SITE III. Table 2 illustrates the complementarity of the nucleotide sequences of ARHGAP8 BINDING SITE, designated SEQ ID:19274, to the nucleotide sequence of VGAM634 RNA, herein designated VGAM RNA, also designated SEQ ID:3345.

Another function of VGAM634 is therefore inhibition of Rho GTPase Activating Protein 8 (ARHGAP8, Accession NM_017701). Accordingly, utilities of VGAM634 include diagnosis, prevention and treatment of diseases and clinical conditions associated with ARHGAP8. BCAA (Accession NM_016374) is another VGAM634 host target gene. BCAA BINDING SITE is HOST TARGET binding site found in the 3' untranslated region of mRNA encoded by BCAA, corresponding to a HOST TARGET binding site such as BINDING SITE I, BINDING SITE II or BINDING SITE III. Table 2 illustrates the complementarity of the nucleotide sequences of BCAA BINDING SITE, designated SEQ ID:18514, to the nucleotide sequence of VGAM634 RNA, herein designated VGAM RNA, also designated SEQ ID:3345.

Another function of VGAM634 is therefore inhibition of BCAA (Accession NM_016374). Accordingly, utilities of VGAM634 include diagnosis, prevention and treatment of diseases and clinical conditions associated with BCAA. CAMP-GEFII (Accession NM_007023) is another VGAM634 host target gene. CAMP-GEFII BINDING SITE is HOST TARGET binding site found in the 3' untranslated region of mRNA encoded by CAMP-GEFII, corresponding to a HOST TARGET binding site such as BINDING SITE I, BINDING SITE II or BINDING SITE III. Table 2 illustrates the complementarity of the nucleotide sequences of CAMP-GEFII BINDING SITE, designated SEQ ID:13880, to the nucleotide sequence of VGAM634 RNA, herein designated VGAM RNA, also designated SEQ ID:3345.

Another function of VGAM634 is therefore inhibition of CAMP-GEFII (Accession NM_007023). Accordingly, utilities of VGAM634 include diagnosis, prevention and treatment of diseases and clinical conditions associated with CAMP-GEFII. Cytoskeleton-associated Protein 4 (CKAP4, Accession NM_006825) is another VGAM634 host target gene. CKAP4 BINDING SITE is HOST TARGET binding site found in the 3' untranslated region of mRNA encoded by CKAP4, corresponding to a HOST TARGET binding site such as BINDING SITE I, BINDING SITE II or BINDING SITE III. Table 2 illustrates the complementarity of the nucleotide sequences of CKAP4 BINDING SITE, designated SEQ ID:13703, to the nucleotide sequence of VGAM634 RNA, herein designated VGAM RNA, also designated SEQ ID:3345.

Another function of VGAM634 is therefore inhibition of Cytoskeleton-associated Protein 4 (CKAP4, Accession NM_006825). Accordingly, utilities of VGAM634 include diagnosis, prevention and treatment of diseases and clinical conditions associated with CKAP4. DKFZp434E0519 (Accession NM_032247) is another VGAM634 host target gene. DKFZp434E0519 BINDING SITE is HOST TARGET binding site found in the 3' untranslated region of mRNA encoded by DKFZp434E0519, corresponding to a HOST TARGET binding site such as BINDING SITE I, BINDING SITE II or BINDING SITE III. Table 2 illustrates the complementarity of the nucleotide sequences of DKFZp434E0519 BINDING SITE, designated SEQ ID:25985, to the nucleotide sequence of VGAM634 RNA, herein designated VGAM RNA, also designated SEQ ID:3345.

Another function of VGAM634 is therefore inhibition of DKFZp434E0519 (Accession NM_032247). Accordingly, utilities of VGAM634 include diagnosis, prevention and treatment of diseases and clinical conditions associated with DKFZp434E0519. FLJ11078 (Accession NM_018316) is another VGAM634 host target gene. FLJ11078 BINDING SITE is HOST TARGET binding site found in the 3' untranslated region of mRNA encoded by FLJ11078, corresponding to a HOST TARGET binding site such as BINDING SITE I, BINDING SITE II or BINDING SITE III. Table 2 illustrates the complementarity of the nucleotide sequences of FLJ11078 BINDING SITE, designated SEQ ID:20310, to the nucleotide sequence of VGAM634 RNA, herein designated VGAM RNA, also designated SEQ ID:3345.

Another function of VGAM634 is therefore inhibition of FLJ11078 (Accession NM_018316). Accordingly, utilities of VGAM634 include diagnosis, prevention and treatment of diseases and clinical conditions associated with FLJ11078. FLJ12783 (Accession NM_031426) is another VGAM634 host target gene. FLJ12783 BINDING SITE is HOST TARGET binding site found in the 3' untranslated region of mRNA encoded by FLJ12783, corresponding to a HOST TARGET binding site such as BINDING SITE I, BINDING SITE II or BINDING SITE III. Table 2 illustrates the complementarity of the nucleotide sequences of FLJ12783 BINDING SITE, designated SEQ ID:25421, to the nucleotide sequence of VGAM634 RNA, herein designated VGAM RNA, also designated SEQ ID:3345.

Another function of VGAM634 is therefore inhibition of FLJ12783 (Accession NM_031426). Accordingly, utilities of VGAM634 include diagnosis, prevention and treatment of diseases and clinical conditions associated with FLJ12783. FLJ14327 (Accession NM_024912) is another VGAM634 host target gene. FLJ14327 BINDING SITE is HOST TARGET binding site found in the 3' untranslated region of mRNA encoded by FLJ14327, corresponding to a HOST TARGET binding site such as BINDING SITE I, BINDING SITE II or BINDING SITE III. Table 2 illustrates the complementarity of the nucleotide sequences of FLJ14327 BINDING SITE, designated SEQ ID:24422, to the nucleotide sequence of VGAM634 RNA, herein designated VGAM RNA, also designated SEQ ID:3345.

Another function of VGAM634 is therefore inhibition of FLJ14327 (Accession NM_024912). Accordingly, utilities of VGAM634 include diagnosis, prevention and treatment of diseases and clinical conditions associated with FLJ14327. FLJ20345 (Accession NM_017777) is another VGAM634 host target gene. FLJ20345 BINDING SITE is HOST TARGET binding site found in the 3' untranslated region of mRNA encoded by FLJ20345, corresponding to a HOST TARGET binding site such as BINDING SITE I, BINDING SITE II or BINDING SITE III. Table 2 illustrates the complementarity of the nucleotide sequences of FLJ20345 BINDING SITE, designated SEQ ID:19406, to the nucleotide sequence of VGAM634 RNA, herein designated VGAM RNA, also designated SEQ ID:3345.

Another function of VGAM634 is therefore inhibition of FLJ20345 (Accession NM_017777). Accordingly, utilities of VGAM634 include diagnosis, prevention and treatment of diseases and clinical conditions associated with FLJ20345. FLJ21369 (Accession NM_024802) is another VGAM634 host target gene. FLJ21369 BINDING SITE is HOST TARGET binding site found in the 3' untranslated region of mRNA encoded by FLJ21369, corresponding to a HOST TARGET binding site such as BINDING SITE I, BINDING SITE II or BINDING SITE III. Table 2 illustrates the complementarity of the nucleotide sequences of FLJ21369 BINDING SITE, designated SEQ ID:24184, to the nucleotide sequence of VGAM634 RNA, herein designated VGAM RNA, also designated SEQ ID:3345.

Another function of VGAM634 is therefore inhibition of FLJ21369 (Accession NM_024802). Accordingly, utilities of VGAM634 include diagnosis, prevention and treatment of diseases and clinical conditions associated with FLJ21369. FLJ23233 (Accession NM_024691) is another VGAM634 host target gene. FLJ23233 BINDING SITE is HOST TARGET binding site found in the 3' untranslated region of mRNA encoded by FLJ23233, corresponding to a HOST TARGET binding site such as BINDING SITE I, BINDING SITE II or BINDING SITE III. Table 2 illustrates the complementarity of the nucleotide sequences of FLJ23233 BINDING SITE, designated SEQ ID:24001, to the nucleotide sequence of VGAM634 RNA, herein designated VGAM RNA, also designated SEQ ID:3345.

Another function of VGAM634 is therefore inhibition of FLJ23233 (Accession NM_024691). Accordingly, utilities of VGAM634 include diagnosis, prevention and treatment of diseases and clinical conditions associated with FLJ23233. KIAA0993 (Accession XM_034413) is another VGAM634 host target gene. KIAA0993 BINDING SITE is HOST TARGET binding site found in the 3' untranslated region of mRNA encoded by KIAA0993, corresponding to a HOST TARGET binding site such as BINDING SITE I, BINDING SITE II or BINDING SITE III. Table 2 illustrates the complementarity of the nucleotide sequences of KIAA0993 BINDING SITE, designated SEQ ID:32084, to the nucleotide sequence of VGAM634 RNA, herein designated VGAM RNA, also designated SEQ ID:3345.

Another function of VGAM634 is therefore inhibition of KIAA0993 (Accession XM_034413). Accordingly, utilities of VGAM634 include diagnosis, prevention and treatment of diseases and clinical conditions associated with KIAA0993. KIAA1040 (Accession XM_051091) is another VGAM634 host target gene. KIAA1040 BINDING SITE is HOST TARGET binding site found in the 3' untranslated region of mRNA encoded by KIAA1040, corresponding to a HOST TARGET binding site such as BINDING SITE I, BINDING SITE II or BINDING SITE III. Table 2 illustrates the complementarity of the nucleotide sequences of KIAA1040 BINDING SITE, designated SEQ ID:35746, to the nucleotide sequence of VGAM634 RNA, herein designated VGAM RNA, also designated SEQ ID:3345.

Another function of VGAM634 is therefore inhibition of KIAA1040 (Accession XM_051091). Accordingly, utilities of VGAM634 include diagnosis, prevention and treatment of diseases and clinical conditions associated with KIAA1040. KIAA1069 (Accession XM_042635) is another VGAM634 host target gene. KIAA1069 BINDING SITE is HOST TARGET binding site found in the 3' untranslated region of mRNA encoded by KIAA1069, corresponding to a HOST TARGET binding site such as BINDING SITE I, BINDING SITE II or BINDING SITE III. Table 2 illustrates the complementarity of the nucleotide sequences of KIAA1069 BINDING SITE, designated SEQ ID:33728, to the nucleotide sequence of VGAM634 RNA, herein designated VGAM RNA, also designated SEQ ID:3345.

Another function of VGAM634 is therefore inhibition of KIAA1069 (Accession XM_042635). Accordingly, utilities of VGAM634 include diagnosis, prevention and treatment of diseases and clinical conditions associated with KIAA1069. KIAA1613 (Accession XM_035946) is another VGAM634 host target gene. KIAA1613 BINDING SITE is HOST TARGET binding site found in the 3' untranslated region of mRNA encoded by KIAA1613, corresponding to a HOST TARGET binding site such as BINDING SITE I, BINDING SITE II or BINDING SITE III. Table 2 illustrates the complementarity of the nucleotide sequences of KIAA1613 BINDING SITE, designated SEQ ID:32361, to the nucleotide sequence of VGAM634 RNA, herein designated VGAM RNA, also designated SEQ ID:3345.

Another function of VGAM634 is therefore inhibition of KIAA1613 (Accession XM_035946). Accordingly, utilities of VGAM634 include diagnosis, prevention and treatment of diseases and clinical conditions associated with KIAA1613. MGC2550 (Accession NM_024071) is another VGAM634 host target gene. MGC2550 BINDING SITE is HOST TARGET binding site found in the 3' untranslated region of mRNA encoded by MGC2550, corresponding to a HOST TARGET binding site such as BINDING SITE I, BINDING SITE II or BINDING SITE III. Table 2 illustrates the complementarity of the nucleotide sequences of MGC2550 BINDING SITE, designated SEQ ID:23500, to the nucleotide sequence of VGAM634 RNA, herein designated VGAM RNA, also designated SEQ ID:3345.

Another function of VGAM634 is therefore inhibition of MGC2550 (Accession NM_024071). Accordingly, utilities of VGAM634 include diagnosis, prevention and treatment of diseases and clinical conditions associated with MGC2550. MGC26954 (Accession NM_145025) is another VGAM634 host target gene. MGC26954 BINDING SITE is HOST TARGET binding site found in the 3' untranslated region of mRNA encoded by MGC26954, corresponding to a HOST TARGET binding site such as BINDING SITE I, BINDING SITE II or BINDING SITE III. Table 2 illustrates the complementarity of the nucleotide sequences of MGC26954 BINDING SITE, designated SEQ ID:29640, to the nucleotide sequence of VGAM634 RNA, herein designated VGAM RNA, also designated SEQ ID:3345.

Another function of VGAM634 is therefore inhibition of MGC26954 (Accession NM_145025). Accordingly, utilities of VGAM634 include diagnosis, prevention and treatment of diseases and clinical conditions associated with MGC26954. PRO0365 (Accession NM_014126) is another VGAM634 host target gene. PRO0365 BINDING SITE is HOST TARGET binding site found in the 3' untranslated region of mRNA encoded by PRO0365, corresponding to a HOST TARGET binding site such as BINDING SITE I, BINDING SITE II or BINDING SITE III. Table 2 illustrates the complementarity of the nucleotide sequences of PRO0365 BINDING SITE, designated SEQ ID:15391, to the nucleotide sequence of VGAM634 RNA, herein designated VGAM RNA, also designated SEQ ID:3345.

Another function of VGAM634 is therefore inhibition of PRO0365 (Accession NM_014126). Accordingly, utilities of VGAM634 include diagnosis, prevention and treatment of diseases and clinical conditions associated with PRO0365. SGP28 (Accession NM_006061) is another VGAM634 host target gene. SGP28 BINDING SITE is HOST TARGET binding site found in the 3' untranslated region of mRNA encoded by SGP28, corresponding to a HOST TARGET binding site such as BINDING SITE I, BINDING SITE II or BINDING SITE III. Table 2 illustrates the complementarity of the nucleotide sequences of SGP28 BINDING SITE, designated SEQ ID:12704, to the nucleotide sequence of VGAM634 RNA, herein designated VGAM RNA, also designated SEQ ID:3345.

Another function of VGAM634 is therefore inhibition of SGP28 (Accession NM_006061). Accordingly, utilities of VGAM634 include diagnosis, prevention and treatment of diseases and clinical conditions associated with SGP28. LOC120856 (Accession XM_058509) is another VGAM634 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36645, to the nucleotide sequence of VGAM634 RNA, herein designated VGAM RNA, also designated SEQ ID:3345.

Another function of VGAM634 is therefore inhibition of LOC120856 (Accession XM_058509). Accordingly, utilities of VGAM634 include diagnosis, prevention and treatment of diseases and clinical conditions associated with LOC120856. LOC144079 (Accession XM_084711) is another VGAM634 host target gene. LOC144079 BINDING SITE is HOST TARGET binding site found in the 5' untranslated region of mRNA encoded by LOC144079, corresponding to a HOST TARGET binding site such as BINDING SITE I, BINDING SITE II or BINDING SITE III. Table 2 illustrates the complementarity of the nucleotide sequences of LOC144079 BINDING SITE, designated SEQ ID:37674, to the nucleotide sequence of VGAM634 RNA, herein designated VGAM RNA, also designated SEQ ID:3345.

Another function of VGAM634 is therefore inhibition of LOC144079 (Accession XM_084711). Accordingly, utilities of VGAM634 include diagnosis, prevention and treatment of diseases and clinical conditions associated with LOC144079. LOC146184 (Accession XM_096942) is another VGAM634 host target gene. LOC146184 BINDING SITE is HOST TARGET binding site found in the 5' untranslated region of mRNA encoded by LOC146184, corresponding to a HOST TARGET binding site such as BINDING SITE I, BINDING SITE II or BINDING SITE III. Table 2 illustrates the complementarity of the nucleotide sequences of LOC146184 BINDING SITE, designated SEQ ID:40660, to the nucleotide sequence of VGAM634 RNA, herein designated VGAM RNA, also designated SEQ ID:3345.

Another function of VGAM634 is therefore inhibition of LOC146184 (Accession XM_096942). Accordingly, utilities of VGAM634 include diagnosis, prevention and treatment of diseases and clinical conditions associated with LOC146184. LOC147077 (Accession XM_085699) is another VGAM634 host target gene. LOC147077 BINDING SITE is HOST TARGET binding site found in the 3' untranslated region of mRNA encoded by LOC147077, corresponding to a HOST TARGET binding site such as BINDING SITE I, BINDING SITE II or BINDING SITE III. Table 2 illustrates the complementarity of the nucleotide sequences of LOC147077 BINDING SITE, designated SEQ ID:38295, to the nucleotide sequence of VGAM634 RNA, herein designated VGAM RNA, also designated SEQ ID:3345.

Another function of VGAM634 is therefore inhibition of LOC147077 (Accession XM_085699). Accordingly, utilities of VGAM634 include diagnosis, prevention and treatment of diseases and clinical conditions associated with LOC147077. LOC148046 (Accession XM_097375) is another VGAM634 host target gene. LOC148046 BINDING SITE is HOST TARGET binding site found in the 3' untranslated region of mRNA encoded by LOC148046, corresponding to a HOST TARGET binding site such as BINDING SITE I, BINDING SITE II or BINDING SITE III. Table 2 illustrates the complementarity of the nucleotide sequences of LOC148046 BINDING SITE, designated SEQ ID:40865, to the nucleotide sequence of VGAM634 RNA, herein designated VGAM RNA, also designated SEQ ID:3345.

Another function of VGAM634 is therefore inhibition of LOC148046 (Accession XM_097375). Accordingly, utilities of VGAM634 include diagnosis, prevention and treatment of diseases and clinical conditions associated with LOC148046. LOC152674 (Accession XM_098251) is another VGAM634 host target gene. LOC152674 BINDING SITE is HOST TARGET binding site found in the 5' untranslated region of mRNA encoded by LOC152674, corresponding to a HOST TARGET binding site such as BINDING SITE I, BINDING SITE II or BINDING SITE III. Table 2 illustrates the complementarity of the nucleotide sequences of LOC152674 BINDING SITE, designated SEQ ID:41541, to the nucleotide sequence of VGAM634 RNA, herein designated VGAM RNA, also designated SEQ ID:3345.

Another function of VGAM634 is therefore inhibition of LOC152674 (Accession XM_098251). Accordingly, utilities of VGAM634 include diagnosis, prevention and treatment of diseases and clinical conditions associated with LOC152674. LOC153222 (Accession XM_087631) is another VGAM634 host target gene. LOC153222 BINDING SITE is HOST TARGET binding site found in the 3' untranslated region of mRNA encoded by LOC153222, corresponding to a HOST TARGET binding site such as BINDING SITE I, BINDING SITE II or BINDING SITE III. Table 2 illustrates the complementarity of the nucleotide sequences of LOC153222 BINDING SITE, designated SEQ ID:39368, to the nucleotide sequence of VGAM634 RNA, herein designated VGAM RNA, also designated SEQ ID:3345.

Another function of VGAM634 is therefore inhibition of LOC153222 (Accession XM_087631). Accordingly, utilities of VGAM634 include diagnosis, prevention and treatment of diseases and clinical conditions associated with LOC153222. LOC153711 (Accession XM_098419) is another VGAM634 host target gene. LOC153711 BINDING SITE is HOST TARGET binding site found in the 3' untranslated region of mRNA encoded by LOC153711, corresponding to a HOST TARGET binding site such as BINDING SITE I, BINDING SITE II or BINDING SITE III. Table 2 illustrates the complementarity of the nucleotide sequences of LOC153711 BINDING SITE, designated SEQ ID:41669, to the nucleotide sequence of VGAM634 RNA, herein designated VGAM RNA, also designated SEQ ID:3345.

Another function of VGAM634 is therefore inhibition of LOC153711 (Accession XM_098419). Accordingly, utilities of VGAM634 include diagnosis, prevention and treatment of diseases and clinical conditions associated with LOC153711. LOC157624 (Accession XM_098801) is another VGAM634 host target gene. LOC157624 BINDING SITE is HOST TARGET binding site found in the 5' untranslated region of mRNA encoded by LOC157624, corresponding to a HOST TARGET binding site such as BINDING SITE I, BINDING SITE II or BINDING SITE III. Table 2 illustrates the complementarity of the nucleotide sequences of LOC157624 BINDING SITE, designated SEQ ID:41828, to the nucleotide sequence of VGAM634 RNA, herein designated VGAM RNA, also designated SEQ ID:3345.

Another function of VGAM634 is therefore inhibition of LOC157624 (Accession XM_098801). Accordingly, utilities of VGAM634 include diagnosis, prevention and treatment of diseases and clinical conditions associated with LOC157624. LOC157867 (Accession XM_098831) is another VGAM634 host target gene. LOC157867 BINDING SITE is HOST TARGET binding site found in the 5' untranslated region of mRNA encoded by LOC157867, corresponding to a HOST TARGET binding site such as BINDING SITE I, BINDING SITE II or BINDING SITE III. Table 2 illustrates the complementarity of the nucleotide sequences of LOC157867 BINDING SITE, designated SEQ ID:41855, to the nucleotide sequence of VGAM634 RNA, herein designated VGAM RNA, also designated SEQ ID:3345.

Another function of VGAM634 is therefore inhibition of LOC157867 (Accession XM_098831). Accordingly, utilities of VGAM634 include diagnosis, prevention and treatment of diseases and clinical conditions associated with LOC157867. LOC196264 (Accession XM_113683) is another VGAM634 host target gene. LOC196264 BINDING SITE is HOST TARGET binding site found in the 3' untranslated region of mRNA encoded by LOC196264, corresponding to a HOST TARGET binding site such as BINDING SITE I, BINDING SITE II or BINDING SITE III. Table 2 illustrates the complementarity of the nucleotide sequences of LOC196264 BINDING SITE, designated SEQ ID:42338, to the nucleotide sequence of VGAM634 RNA, herein designated VGAM RNA, also designated SEQ ID:3345.

Another function of VGAM634 is therefore inhibition of LOC196264 (Accession XM_113683). Accordingly, utilities of VGAM634 include diagnosis, prevention and treatment of diseases and clinical conditions associated with LOC196264. LOC219899 (Accession XM_166173) is another VGAM634 host target gene. LOC219899 BINDING SITE is HOST TARGET binding site found in the 3' untranslated region of mRNA encoded by LOC219899, corresponding to a HOST TARGET binding site such as BINDING SITE I, BINDING SITE II or BINDING SITE III. Table 2 illustrates the complementarity of the nucleotide sequences of LOC219899 BINDING SITE, designated SEQ ID:43994, to the nucleotide sequence of VGAM634 RNA, herein designated VGAM RNA, also designated SEQ ID:3345.

Another function of VGAM634 is therefore inhibition of LOC219899 (Accession XM_166173). Accordingly, utilities of VGAM634 include diagnosis, prevention and treatment of diseases and clinical conditions associated with LOC219899. LOC253187 (Accession XM_173139) is another VGAM634 host target gene. LOC253187 BINDING SITE is HOST TARGET binding site found in the 5' untranslated region of mRNA encoded by LOC253187, corresponding to a HOST TARGET binding site such as BINDING SITE I, BINDING SITE II or BINDING SITE III. Table 2 illustrates the complementarity of the nucleotide sequences of LOC253187 BINDING SITE, designated SEQ ID:46394, to the nucleotide sequence of VGAM634 RNA, herein designated VGAM RNA, also designated SEQ ID:3345.

Another function of VGAM634 is therefore inhibition of LOC253187 (Accession XM_173139). Accordingly, utilities of VGAM634 include diagnosis, prevention and treatment of diseases and clinical conditions associated with LOC253187. LOC90750 (Accession XM_033868) is another VGAM634 host target gene. LOC90750 BINDING SITE is HOST TARGET binding site found in the 5' untranslated region of mRNA encoded by LOC90750, corresponding to a HOST TARGET binding site such as BINDING SITE I, BINDING SITE II or BINDING SITE III. Table 2 illustrates the complementarity of the nucleotide sequences of LOC90750 BINDING SITE, designated SEQ ID:31972, to the nucleotide sequence of VGAM634 RNA, herein designated VGAM RNA, also designated SEQ ID:3345.

Another function of VGAM634 is therefore inhibition of LOC90750 (Accession XM_033868). Accordingly, utilities of VGAM634 include diagnosis, prevention and treatment of diseases and clinical conditions associated with LOC90750. LOC91133 (Accession XM_036372) is another VGAM634 host target gene. LOC91133 BINDING SITE is HOST TARGET binding site found in the 3' untranslated region of mRNA encoded by LOC91133, corresponding to a HOST TARGET binding site such as BINDING SITE I, BINDING SITE II or BINDING SITE III. Table 2 illustrates the complementarity of the nucleotide sequences of LOC91133 BINDING SITE, designated SEQ ID:32431, to the nucleotide sequence of VGAM634 RNA, herein designated VGAM RNA, also designated SEQ ID:3345.

Another function of VGAM634 is therefore inhibition of LOC91133 (Accession XM_036372). Accordingly, utilities of VGAM634 include diagnosis, prevention and treatment of diseases and clinical conditions associated with LOC91133. FIG. 1 further provides a conceptual description of a novel bioinformatically detected viral gene of the present invention, referred to here as Viral Genomic Address Messenger 635 (VGAM635) viral gene, which modulates expression of respective host target genes thereof, the function and utility of which host target genes is known in the art.

VGAM635 is a novel bioinformatically detected regulatory, non protein coding, viral micro RNA (miRNA) gene. The method by which VGAM635 was detected is described hereinabove with reference to FIGS. 1-8.

VGAM635 gene, herein designated VGAM GENE, is a viral gene contained in the genome of Cherry Mottle Leaf Virus. VGAM635 host target gene, herein designated VGAM HOST TARGET GENE, is a human gene contained in the human genome.

VGAM635 gene encodes a VGAM635 precursor RNA, herein designated VGAM PRECURSOR RNA. Similar to other miRNA genes, and unlike most ordinary genes, VGAM635 precursor RNA does not encode a protein. A nucleotide sequence identical or highly similar to the nucleotide sequence of VGAM635 precursor RNA is designated SEQ ID:621, and is provided hereinbelow with reference to the sequence listing part. Nucleotide sequence SEQ ID:621 is located at position 457 relative to the genome of Cherry Mottle Leaf Virus.

VGAM635 precursor RNA folds onto itself, forming VGAM635 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM635 folded precursor RNA into VGAM635 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM635 RNA is designated SEQ ID:3346, and is provided hereinbelow with reference to the sequence listing part.

VGAM635 host target gene, herein designated VGAM HOST TARGET GENE, encodes a corresponding messenger RNA, VGAM635 host target RNA, herein designated VGAM HOST TARGET RNA. VGAM635 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM635 RNA, herein designated VGAM RNA, binds complementarily to one or more host target binding sites located in untranslated regions of VGAM635 host target RNA, herein designated VGAM HOST TARGET RNA. This complementary binding is due to the fact that the nucleotide sequence of VGAM635 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM635 RNA, herein designated VGAM RNA, may have a different number of host target binding sites in untranslated regions of a VGAM635 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM635 RNA, herein designated VGAM RNA, to host target binding sites on VGAM635 host target RNA, herein designated VGAM HOST TARGET RNA, such as BINDING SITE I, BINDING SITE II and BINDING SITE III, inhibits translation of VGAM635 host target RNA into VGAM635 host target protein, herein designated VGAM HOST TARGET PROTEIN. VGAM host target protein is therefore outlined by a broken line.

It is appreciated that VGAM635 host target gene, herein designated VGAM HOST TARGET GENE, in fact represents a plurality of VGAM635 host target genes. The mRNA of each one of this plurality of VGAM635 host target genes comprises one or more host target binding sites, each having a nucleotide sequence which is at least partly complementary to VGAM635 RNA, herein designated VGAM RNA, and which when bound by VGAM635 RNA causes inhibition of translation of respective one or more VGAM635 host target proteins.

It is further appreciated by one skilled in the art that the mode of translational inhibition illustrated by FIG. 1 with specific reference to translational inhibition exerted by VGAM635 gene, herein designated VGAM GENE, on one or more VGAM635 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM635 is inhibition of expression of host target genes, as part of a novel viral mechanism of attacking a host. Accordingly, utilities of VGAM635 include diagnosis, prevention and treatment of viral infection by Cherry Mottle Leaf Virus. Specific functions, and accordingly utilities, of VGAM635 correlate with, and may be deduced from, the identity of the host target genes which VGAM635 binds and inhibits, and the function of these host target genes, as elaborated hereinbelow.

Nucleotide sequences of the VGAM635 precursor RNA, herein designated VGAM PRECURSOR RNA, and of the 'diced' VGAM635 RNA, herein designated VGAM RNA, and a schematic representation of the secondary folding of VGAM635 folded precursor RNA, herein designated VGAM FOLDED PRECURSOR RNA, of VGAM635 are further described hereinbelow with reference to Table 1.

Nucleotide sequences of host target binding sites, such as BINDING SITE-I, BINDING SITE-II and BINDING SITE-III of FIG. 1, found on VGAM635 host target RNA, and schematic representation of the complementarity of each of these host target binding sites to VGAM635 RNA, herein designated VGAM RNA, are described hereinbelow with reference to Table 2.

As mentioned hereinabove with reference to FIG. 1, a function of VGAM635 gene, herein designated VGAM is inhibition of expression of VGAM635 target genes. It is appreciated that specific functions, and accordingly utilities, of VGAM635 correlate with, and may be deduced from, the identity of the target genes which VGAM635 binds and inhibits, and the function of these target genes, as elaborated hereinbelow.

MGC5370 (Accession NM_032739) is a VGAM635 host target gene. MGC5370 BINDING SITE is HOST TARGET binding site found in the 3' untranslated region of mRNA encoded by MGC5370, corresponding to a HOST TARGET binding site such as BINDING SITE I, BINDING SITE II or BINDING SITE III. Table 2 illustrates the complementarity of the nucleotide sequences of MGC5370 BINDING SITE, designated SEQ ID:26469, to the nucleotide sequence of VGAM635 RNA, herein designated VGAM RNA, also designated SEQ ID:3346.

A function of VGAM635 is therefore inhibition of MGC5370 (Accession NM_032739). Accordingly, utilities of VGAM635 include diagnosis, prevention and treatment of diseases and clinical conditions associated with MGC5370. LOC139522 (Accession XM_066738) is another VGAM635 host target gene. LOC139522 BINDING SITE is HOST TARGET binding site found in the 5' untranslated region of mRNA encoded by LOC139522, corresponding to a HOST TARGET binding site such as BINDING SITE I, BINDING SITE II or BINDING SITE III. Table 2 illustrates the complementarity of the nucleotide sequences of LOC139522 BINDING SITE, designated SEQ ID:37344, to the nucleotide sequence of VGAM635 RNA, herein designated VGAM RNA, also designated SEQ ID:3346.

Another function of VGAM635 is therefore inhibition of LOC139522 (Accession XM_066738). Accordingly, utilities of VGAM635 include diagnosis, prevention and treatment of diseases and clinical conditions associated with LOC139522. LOC158382 (Accession XM_098931) is another VGAM635 host target gene. LOC158382 BINDING SITE is HOST TARGET binding site found in the 5' untranslated region of mRNA encoded by LOC158382, corresponding to a HOST TARGET binding site such as BINDING SITE I, BINDING SITE II or BINDING SITE III. Table 2 illustrates the complementarity of the nucleotide sequences of LOC158382 BINDING SITE, designated SEQ ID:41965, to the nucleotide sequence of VGAM635 RNA, herein designated VGAM RNA, also designated SEQ ID:3346.

Another function of VGAM635 is therefore inhibition of LOC158382 (Accession XM_098931). Accordingly, utilities of VGAM635 include diagnosis, prevention and treatment of diseases and clinical conditions associated with LOC158382. LOC219920 (Accession XM_167787) is another VGAM635 host target gene. LOC219920 BINDING SITE is HOST TARGET binding site found in the 3' untranslated region of mRNA encoded by LOC219920, corresponding to a HOST TARGET binding site such as BINDING SITE I, BINDING SITE II or BINDING SITE III. Table 2 illustrates the complementarity of the nucleotide sequences of LOC219920 BINDING SITE, designated SEQ ID:44805, to the nucleotide sequence of VGAM635 RNA, herein designated VGAM RNA, also designated SEQ ID:3346.

Another function of VGAM635 is therefore inhibition of LOC219920 (Accession XM_167787). Accordingly, utilities of VGAM635 include diagnosis, prevention and treatment of diseases and clinical conditions associated with LOC219920. LOC63928 (Accession NM_022097) is another VGAM635 host target gene. LOC63928 BINDING SITE is HOST TARGET binding site found in the 3' untranslated region of mRNA encoded by LOC63928, corresponding to a HOST TARGET binding site such as BINDING SITE I, BINDING SITE II or BINDING SITE III. Table 2 illustrates the complementarity of the nucleotide sequences of LOC63928 BINDING SITE, designated SEQ ID:22637, to the nucleotide sequence of VGAM635 RNA, herein designated VGAM RNA, also designated SEQ ID:3346.

Another function of VGAM635 is therefore inhibition of LOC63928 (Accession NM_022097). Accordingly, utilities of VGAM635 include diagnosis, prevention and treatment of diseases and clinical conditions associated with LOC63928. FIG. 1 further provides a conceptual description of a novel bioinformatically detected viral gene of the present invention, referred to here as Viral Genomic Address Messenger 636 (VGAM636) viral gene, which modulates expression of respective host target genes thereof, the function and utility of which host target genes is known in the art.

VGAM636 is a novel bioinformatically detected regulatory, non protein coding, viral micro RNA (miRNA) gene. The method by which VGAM636 was detected is described hereinabove with reference to FIGS. 1-8.

VGAM636 gene, herein designated VGAM GENE, is a viral gene contained in the genome of Cherry Mottle Leaf Virus. VGAM636 host target gene, herein designated VGAM HOST TARGET GENE, is a human gene contained in the human genome.

VGAM636 gene encodes a VGAM636 precursor RNA, herein designated VGAM PRECURSOR RNA. Similar to other miRNA genes, and unlike most ordinary genes, VGAM636 precursor RNA does not encode a protein. A nucleotide sequence identical or highly similar to the nucleotide sequence of VGAM636 precursor RNA is designated SEQ ID:622, and is provided hereinbelow with reference to the sequence listing part. Nucleotide sequence SEQ ID:622 is located at position 3861 relative to the genome of Cherry Mottle Leaf Virus.

VGAM636 precursor RNA folds onto itself, forming VGAM636 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM636 folded precursor RNA into VGAM636 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM636 RNA is designated SEQ ID:3347, and is provided hereinbelow with reference to the sequence listing part.

VGAM636 host target gene, herein designated VGAM HOST TARGET GENE, encodes a corresponding messenger RNA, VGAM636 host target RNA, herein designated VGAM HOST TARGET RNA. VGAM636 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM636 RNA, herein designated VGAM RNA, binds complementarily to one or more host target binding sites located in untranslated regions of VGAM636 host target RNA, herein designated VGAM HOST TARGET RNA. This complementary binding is due to the fact that the nucleotide sequence of VGAM636 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM636 RNA, herein designated VGAM RNA, may have a different number of host target binding sites in untranslated regions of a VGAM636 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM636 RNA, herein designated VGAM RNA, to host target binding sites on VGAM636 host target RNA, herein designated VGAM HOST TARGET RNA, such as BINDING SITE I, BINDING SITE II and BINDING SITE III, inhibits translation of VGAM636 host target RNA into VGAM636 host target protein, herein designated VGAM HOST TARGET PROTEIN. VGAM host target protein is therefore outlined by a broken line.

It is appreciated that VGAM636 host target gene, herein designated VGAM HOST TARGET GENE, in fact represents a plurality of VGAM636 host target genes. The mRNA of each one of this plurality of VGAM636 host target genes comprises one or more host target binding sites, each having a nucleotide sequence which is at least partly complementary to VGAM636 RNA, herein designated VGAM RNA, and which when bound by VGAM636 RNA causes inhibition of translation of respective one or more VGAM636 host target proteins.

It is further appreciated by one skilled in the art that the mode of translational inhibition illustrated by FIG. 1 with specific reference to translational inhibition exerted by VGAM636 gene, herein designated VGAM GENE, on one or more VGAM636 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM636 is inhibition of expression of host target genes, as part of a novel viral mechanism of attacking a host. Accordingly, utilities of VGAM636 include diagnosis, prevention and treatment of viral infection by Cherry Mottle Leaf Virus. Specific functions, and accordingly utilities, of VGAM636 correlate with, and may be deduced from, the identity of the host target genes which VGAM636 binds and inhibits, and the function of these host target genes, as elaborated hereinbelow.

Nucleotide sequences of the VGAM636 precursor RNA, herein designated VGAM PRECURSOR RNA, and of the 'diced' VGAM636 RNA, herein designated VGAM RNA, and a schematic representation of the secondary folding of VGAM636 folded precursor RNA, herein designated VGAM FOLDED PRECURSOR RNA, of VGAM636 are further described hereinbelow with reference to Table 1.

Nucleotide sequences of host target binding sites, such as BINDING SITE-I, BINDING SITE-II and BINDING SITE-III of FIG. 1, found on VGAM636 host target RNA, and schematic representation of the complementarity of each of these host target binding sites to VGAM636 RNA, herein designated VGAM RNA, are described hereinbelow with reference to Table 2.

As mentioned hereinabove with reference to FIG. 1, a function of VGAM636 gene, herein designated VGAM is inhibition of expression of VGAM636 target genes. It is appreciated that specific functions, and accordingly utilities, of VGAM636 correlate with, and may be deduced from, the identity of the target genes which VGAM636 binds and inhibits, and the function of these target genes, as elaborated hereinbelow.

Glucose-6-phosphatase, Catalytic (glycogen storage disease type I, von Gierke disease) (G6PC, Accession NM_000151) is a VGAM636 host target gene. G6PC BINDING SITE is HOST TARGET binding site found in the 3" untranslated region of mRNA encoded by G6PC, corresponding to a HOST TARGET binding site such as BINDING SITE I, BINDING SITE II or BINDING SITE III. Table 2 illustrates the complementarity of the nucleotide sequences of G6PC BINDING SITE, designated SEQ ID:5661, to the nucleotide sequence of VGAM636 RNA, herein designated VGAM RNA, also designated SEQ ID:3347.

A function of VGAM636 is therefore inhibition of Glucose-6-phosphatase, Catalytic (glycogen storage disease type I, von Gierke disease) (G6PC, Accession NM_000151). Accordingly, utilities of VGAM636 include diagnosis, prevention and treatment of diseases and clinical conditions associated with G6PC. Membrane-spanning 4-domains, Subfamily A, Member 2 (Fc fragment of IgE, high affinity I, receptor for; beta polypeptide) (MS4A2, Accession NM_021950) is another VGAM636 host target gene. MS4A2 BINDING SITE is HOST TARGET binding site found in the 3' untranslated region of mRNA encoded by MS4A2, corresponding to a HOST TARGET binding site such as BINDING SITE I, BINDING SITE II or BINDING SITE III. Table 2 illustrates the complementarity of the nucleotide sequences of MS4A2 BINDING SITE, designated SEQ ID:22477, to the nucleotide sequence of VGAM636 RNA, herein designated VGAM RNA, also designated SEQ ID:3347.

Another function of VGAM636 is therefore inhibition of Membrane-spanning 4-domains, Subfamily A, Member 2 (Fc fragment of IgE, high affinity I, receptor for; beta polypeptide) (MS4A2, Accession NM_021950), a gene which binds to the fc region of immunoglobulins epsilon. Accordingly, utilities of VGAM636 include diagnosis, prevention and treatment of diseases and clinical conditions associated with MS4A2. The function of MS4A2 has been established by previous studies. Shirakawa et al. (1994) reported a significant association between atopy and substitution of a leucine for an isoleucine at position 181 of the FCER1B gene product. Hizawa et al. (1995) failed to find this leu181-to-ile substitution. Folster-Holst et al. (1998) presented evidence from linkage studies in 12 families with atopic dermatitis for linkage in close proximity to the marker D11S903. The method of analysis suggested an oligogenic mode of inheritance as well as heterogeneity in the genetic susceptibility to atopy and atopic dermatitis; only 2 of 12 families showed evidence for linkage using the oligogenic model.

Full details of the abovementioned studies are described in the following publications, the disclosure of which are hereby incorporated by reference:

Folster-Holst, R.; Moises, H. W.; Yang, L.; Fritsch, W.; Weissenbach, J.; Christophers, E.: Linkage between atopy and the IgE high-affinity receptor gene at 11q13 in atopic dermatitis families. Hum. Genet. 102:236-239, 1998; and Shirakawa, T.; Li, A.; Dubowitz, M.; Dekker, J. W.; Shaw, A. E.; Faux, J. A.; Ra, C.; Cookson, W. O. C. M.; Hopkin, J. M.: Association between atopy and variants of the beta subunit of.

Further studies establishing the function and utilities of MS4A2 are found in John Hopkins OMIM database record ID 147138, and in sited publications numbered 11465-11466, 3386, 11467-11469, 338 and 11470-11472 listed in the bibliography section hereinbelow, which are also hereby incorporated by reference. Oxytocin Receptor (OXTR, Accession NM_000916) is another VGAM636 host target gene. OXTR BINDING SITE is HOST TARGET binding site found in the 3' untranslated region of mRNA encoded by OXTR, corresponding to a HOST TARGET binding site such as BINDING SITE I, BINDING SITE II or BINDING SITE III. Table 2 illustrates the complementarity of the nucleotide sequences of OXTR BINDING SITE, designated SEQ ID:6623, to the nucleotide sequence of VGAM636 RNA, herein designated VGAM RNA, also designated SEQ ID:3347.

Another function of VGAM636 is therefore inhibition of Oxytocin Receptor (OXTR, Accession NM_000916), a gene which induces inward ion currents. Accordingly, utilities of VGAM636 include diagnosis, prevention and treatment of diseases and clinical conditions associated with OXTR. The function of OXTR has been established by previous studies. Just before the onset of labor, uterine muscle becomes exceedingly sensitive to oxytocin, for which it is a primary target tissue, because of a dramatic increase in the number of oxytocin receptors. Kimura et al. (1992) reported the structure and expression of the human oxytocin receptor cDNA isolated by expression cloning. The encoded receptor was a 388-amino acid polypeptide with 7 transmembrane domains typical of G protein-coupled receptors. The oxytocin receptor, expressed in Xenopus oocytes, specifically responded to oxytocin and induced an inward membrane current. Messenger RNAs for the receptor were of 2 sizes, 3.6 kb in breast and 4.4 kb in ovary, endometrium, and myometrium. The mRNA level in myometrium was very high at term. Yang et al. (2002) found that mutation of lysine-270 (K270) in wildtype OTR completely abolished the ability of the receptor to stimulate phosphatidylinositide turnover, with only a small reduction in ligand affinity. These data demonstrated that OTR K270 is critically important in the stimulation by OTR of phosphatidylinositide turnover. Mutation of K270 also adversely affected the ability of OTR to stimulate ERK1/2 (601795, 176948) phosphorylation. Therefore, this residue plays an important role in the specificity of OTR/G-alpha-q (OMIM Ref. No. 600998)/PLC (see OMIM Ref. No. 602142) coupling.

Full details of the abovementioned studies are described in the following publications, the disclosure of which are hereby incorporated by reference:

Kimura, T.; Tanizawa, O.; Mori, K.; Brownstein, M. J.; Okayama, H.: Structure and expression of a human oxytocin receptor. Nature 356:526-529, 1992; and Yang, M.; Wang, W.; Zhong, M.; Philippi, A.; Lichtarge, O.; Sanborn, B. M.: Lysine 270 in the third intracellular domain of the oxytocin receptor is an important determinant for G-alph.

Further studies establishing the function and utilities of OXTR are found in John Hopkins OMIM database record ID 167055, and in sited publications numbered 3154-3157 listed in the bibliography section hereinbelow, which are also hereby incorporated by reference. Serine (or cysteine) Proteinase Inhibitor, Clade B (ovalbumin), Member 9 (SERPINB9, Accession NM_004155) is another VGAM636 host target gene. SERPINB9 BINDING SITE is HOST TARGET binding site found in the 3' untranslated region of mRNA encoded by SERPINB9, corresponding to a HOST TARGET binding site such as BINDING SITE I, BINDING SITE II or BINDING SITE III. Table 2 illustrates the complementarity of the nucleotide sequences of SERPINB9 BINDING SITE, designated SEQ ID:10365, to the nucleotide sequence of VGAM636 RNA, herein designated VGAM RNA, also designated SEQ ID:3347.

Another function of VGAM636 is therefore inhibition of Serine (or cysteine) Proteinase Inhibitor, Clade B (ovalbumin), Member 9 (SERPINB9, Accession NM_004155), a gene which may be a serpin serine protease inhibitor that interacts with granzyme B (GZMB). Accordingly, utilities of VGAM636 include diagnosis, prevention and treatment of diseases and clinical conditions associated with SERPINB9. The function of SERPINB9 and its association with various diseases and clinical conditions, has been established by previous studies, as described hereinabove with reference to VGAM60. Wingless-type MMTV Integration Site Family, Member 8B (WNT8B, Accession XM_005702) is another VGAM636 host target gene. WNT8B BINDING SITE is HOST TARGET binding site found in the 3' untranslated region of mRNA encoded by WNT8B, corresponding to a HOST TARGET binding site such as BINDING SITE I, BINDING SITE II or BINDING SITE III. Table 2 illustrates the complementarity of the nucleotide sequences of WNT8B BINDING SITE, designated SEQ ID:29984, to the nucleotide sequence of VGAM636 RNA, herein designated VGAM RNA, also designated SEQ ID:3347.

Another function of VGAM636 is therefore inhibition of Wingless-type MMTV Integration Site Family, Member 8B (WNT8B, Accession XM_005702), a gene which is the ligand for members of the frizzled family of seven transmembrane receptors and may play an important role in the development and differentiation of certain forebrain structures. Accordingly, utilities of VGAM636 include diagnosis, prevention and treatment of diseases and clinical conditions associated with WNT8B. The function of WNT8B has been established by previous studies. WNT genes encode intercellular signaling glycoproteins that play important roles in key processes of embryonic development such as mesoderm induction, specification of the embryonic axis, and patterning of the central nervous system, spinal cord, and limbs. The name WNT denotes the relationship of this family to the Drosophila segment polarity gene 'wingless,' and to its vertebrate ortholog Int1, a mouse proto-oncogene; see WNT1 (OMIM Ref. No. 164820). Lako et al. (1996) noted that multiple WNT genes are known to exist in several species that have been investigated ranging from Drosophila to man. They have been classified into various groups and subgroups on the basis of high sequence homology and common expression patterns. The vertebrate WNT8 subfamily includes genes from Xenopus, zebrafish, and chicken; Lako et al. (1996) characterized the first mammalian WNT8 homolog, a human member of the Wnt8 family that they termed WNT8B on the basis of the very high sequence similarity (approximately 90% identity) of the inferred protein to those encoded by the Xenopus and zebrafish Wnt8b genes. The human cDNA encodes a polypeptide that contains a C2H2 zinc finger-like motif. Lako et al. (1998) presented the full-length cDNA sequence and genomic organization of the human WNT8B gene and reported studies of expression of the gene in human and mouse embryos. The WNT8B gene contains 6 exons separated by small introns, with the exception of intron 1. The predicted protein has 351 amino acids. The gene is expressed predominantly as a transcript of approximately 2.1 kb. The human and mouse expression patterns appeared to be identical and were restricted to the developing brain, with the great majority of expression being found in the developing forebrain. In the latter case, expression was confined to the germinative neuroepithelium of 3 sharply delimited regions: the dorsomedial wall of the telencephalic ventricles (which includes the developing hippocampus), a discrete region of the dorsal thalamus, and the mammillary and retromammillary regions of the posterior hypothalamus. Expression in the developing hippocampus may suggest a role for WNT8B in patterning of this region. By use of PCR typing of a human monochromosomal hybrid cell panel, Lako et al. (1996) mapped the WNT8B gene to chromosome 10. They refined the localization to 10q24 by fluorescence in situ hybridization. Lako et al. (1998) suggested WNT8B as a candidate gene for partial epilepsy (EPT; 600512) in families in which the disease has been linked to markers in the 10q23-q24 region.

Full details of the abovementioned studies are described in the following publications, the disclosure of which are hereby incorporated by reference:

Lako, M.; Lindsay, S.; Bullen, P.; Wilson, D. I.; Robson, S. C.; Strachan, T.: A novel mammalian Wnt gene, WNT8B, shows brain-restricted expression in early development, with sharply delimited expression boundaries in the developing forebrain. Hum. Molec. Genet. 7:813-822, 1998; and Lako, M.; Strachan, T.; Curtis, A. R. J.; Lindsay, S.: Isolation and characterization of WNT8B, a novel human Wnt gene that maps to 10q24. Genomics 35:386-388, 1996.

Further studies establishing the function and utilities of WNT8B are found in John Hopkins OMIM database record ID 601396, and in sited publications numbered 6652-6653 listed in the bibliography section hereinbelow, which are also hereby incorporated by reference. KIAA0976 (Accession NM_014917) is another VGAM636 host target gene. KIAA0976 BINDING SITE is HOST TARGET binding site found in the 3' untranslated region of mRNA encoded by KIAA0976, corresponding to a HOST TARGET binding site such as BINDING SITE I, BINDING SITE II or BINDING SITE III. Table 2 illustrates the complementarity of the nucleotide sequences of KIAA0976 BINDING SITE, designated SEQ ID:17169, to the nucleotide sequence of VGAM636 RNA, herein designated VGAM RNA, also designated SEQ ID:3347.

Another function of VGAM636 is therefore inhibition of KIAA0976 (Accession NM_014917). Accordingly, utilities of VGAM636 include diagnosis, prevention and treatment of diseases and clinical conditions associated with KIAA0976. Smith-Magenis Syndrome Chromosome Region, Candidate 7 (SMCR7, Accession NM_139162) is another VGAM636 host target gene. SMCR7 BINDING SITE is HOST TARGET binding site found in the 3' untranslated region of mRNA encoded by SMCR7, corresponding to a HOST TARGET binding site such as BINDING SITE I, BINDING SITE II or BINDING SITE III. Table 2 illustrates the complementarity of the nucleotide sequences of SMCR7 BINDING SITE, designated SEQ ID:29170, to the nucleotide sequence of VGAM636 RNA, herein designated VGAM RNA, also designated SEQ ID:3347.

Another function of VGAM636 is therefore inhibition of Smith-Magenis Syndrome Chromosome Region, Candidate 7 (SMCR7, Accession NM_139162). Accordingly, utilities of VGAM636 include diagnosis, prevention and treatment of diseases and clinical conditions associated with SMCR7. LOC138307 (Accession XM_059963) is another VGAM636 host target gene. LOC138307 BINDING SITE is HOST TARGET binding site found in the 5' untranslated region of mRNA encoded by LOC138307, corresponding to a HOST TARGET binding site such as BINDING SITE I, BINDING SITE II or BINDING SITE III. Table 2 illustrates the complementarity of the nucleotide sequences of LOC138307 BINDING SITE, designated SEQ ID:37124, to the nucleotide sequence of VGAM636 RNA, herein designated VGAM RNA, also designated SEQ ID:3347.

Another function of VGAM636 is therefore inhibition of LOC138307 (Accession XM_059963). Accordingly, utilities of VGAM636 include diagnosis, prevention and treatment of diseases and clinical conditions associated with LOC138307. LOC146316 (Accession XM_027568) is another VGAM636 host target gene. LOC146316 BINDING SITE is HOST TARGET binding site found in the 5' untranslated region of mRNA encoded by LOC146316, corresponding to a HOST TARGET binding site such as BINDING SITE I, BINDING SITE II or BINDING SITE III. Table 2 illustrates the complementarity of the nucleotide sequences of LOC146316 BINDING SITE, designated SEQ ID:30524, to the nucleotide sequence of VGAM636 RNA, herein designated VGAM RNA, also designated SEQ ID:3347.

Another function of VGAM636 is therefore inhibition of LOC146316 (Accession XM_027568). Accordingly, utilities of VGAM636 include diagnosis, prevention and treatment of diseases and clinical conditions associated with LOC146316. LOC157226 (Accession XM_033876) is another VGAM636 host target gene. LOC157226 BINDING SITE is HOST TARGET binding site found in the 5' untranslated region of mRNA encoded by LOC157226, corresponding to a HOST TARGET binding site such as BINDING SITE I, BINDING SITE II or BINDING SITE III. Table 2 illustrates the complementarity of the nucleotide sequences of LOC157226 BINDING SITE, designated SEQ ID:31978, to the nucleotide sequence of VGAM636 RNA, herein designated VGAM RNA, also designated SEQ ID:3347.

Another function of VGAM636 is therefore inhibition of LOC157226 (Accession XM_033876). Accordingly, utilities of VGAM636 include diagnosis, prevention and treatment of diseases and clinical conditions associated with LOC157226. LOC158714 (Accession XM_088650) is another VGAM636 host target gene. LOC158714 BINDING SITE is HOST TARGET binding site found in the 5' untranslated region of mRNA encoded by LOC158714, corresponding to a HOST TARGET binding site such as BINDING SITE I, BINDING SITE II or BINDING SITE III. Table 2 illustrates the complementarity of the nucleotide sequences of LOC158714 BINDING SITE, designated SEQ ID:39884, to the nucleotide sequence of VGAM636 RNA, herein designated VGAM RNA, also designated SEQ ID:3347.

Another function of VGAM636 is therefore inhibition of LOC158714 (Accession XM_088650). Accordingly, utilities of VGAM636 include diagnosis, prevention and treatment of diseases and clinical conditions associated with LOC158714. LOC254082 (Accession XM_173165) is another VGAM636 host target gene. LOC254082 BINDING SITE is HOST TARGET binding site found in the 5' untranslated region of mRNA encoded by LOC254082, corresponding to a HOST TARGET binding site such as BINDING SITE I, BINDING SITE II or BINDING SITE III. Table 2 illustrates the complementarity of the nucleotide sequences of LOC254082 BINDING SITE, designated SEQ ID:46422, to the nucleotide sequence of VGAM636 RNA, herein designated VGAM RNA, also designated SEQ ID:3347.

Another function of VGAM636 is therefore inhibition of LOC254082 (Accession XM_173165). Accordingly, utilities of VGAM636 include diagnosis, prevention and treatment of diseases and clinical conditions associated with LOC254082. LOC51634 (Accession NM_016024) is another VGAM636 host target gene. LOC51634 BINDING SITE is HOST TARGET binding site found in the 3' untranslated region of mRNA encoded by LOC51634, corresponding to a HOST TARGET binding site such as BINDING SITE I, BINDING SITE II or BINDING SITE III. Table 2 illustrates the complementarity of the nucleotide sequences of LOC51634 BINDING SITE, designated SEQ ID:18101, to the nucleotide sequence of VGAM636 RNA, herein designated VGAM RNA, also designated SEQ ID:3347.

Another function of VGAM636 is therefore inhibition of LOC51634 (Accession NM_016024). Accordingly, utilities of VGAM636 include diagnosis, prevention and treatment of diseases and clinical conditions associated with LOC51634. LOC92017 (Accession XM_042234) is another VGAM636 host target gene. LOC92017 BINDING SITE is HOST TARGET binding site found in the 3' untranslated region of mRNA encoded by LOC92017, corresponding to a HOST TARGET binding site such as BINDING SITE I, BINDING SITE II or BINDING SITE III. Table 2 illustrates the complementarity of the nucleotide sequences of LOC92017 BINDING SITE, designated SEQ ID:33711, to the nucleotide sequence of VGAM636 RNA, herein designated VGAM RNA, also designated SEQ ID:3347.

Another function of VGAM636 is therefore inhibition of LOC92017 (Accession XM_042234). Accordingly, utilities of VGAM636 include diagnosis, prevention and treatment of diseases and clinical conditions associated with LOC92017. FIG. 1 further provides a conceptual description of a novel bioinformatically detected viral gene of the present invention, referred to here as Viral Genomic Address Messenger 637 (VGAM637) viral gene, which modulates expression of respective host target genes thereof, the function and utility of which host target genes is known in the art.

VGAM637 is a novel bioinformatically detected regulatory, non protein coding, viral micro RNA (miRNA) gene. The method by which VGAM637 was detected is described hereinabove with reference to FIGS. 1-8.

VGAM637 gene, herein designated VGAM GENE, is a viral gene contained in the genome of Frog Adenovirus 1. VGAM637 host target gene, herein designated VGAM HOST TARGET GENE, is a human gene contained in the human genome.

VGAM637 gene encodes a VGAM637 precursor RNA, herein designated VGAM PRECURSOR RNA. Similar to other miRNA genes, and unlike most ordinary genes, VGAM637 precursor RNA does not encode a protein. A nucleotide sequence identical or highly similar to the nucleotide sequence of VGAM637 precursor RNA is designated SEQ ID:623, and is provided hereinbelow with reference to the sequence listing part. Nucleotide sequence SEQ ID:623 is located at position 5382 relative to the genome of Frog Adenovirus 1.

VGAM637 precursor RNA folds onto itself, forming VGAM637 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM637 folded precursor RNA into VGAM637 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM637 RNA is designated SEQ ID:3348, and is provided hereinbelow with reference to the sequence listing part.

VGAM637 host target gene, herein designated VGAM HOST TARGET GENE, encodes a corresponding messenger RNA, VGAM637 host target RNA, herein designated VGAM HOST TARGET RNA. VGAM637 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM637 RNA, herein designated VGAM RNA, binds complementarily to one or more host target binding sites located in untranslated regions of VGAM637 host target RNA, herein designated VGAM HOST TARGET RNA. This complementary binding is due to the fact that the nucleotide sequence of VGAM637 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM637 RNA, herein designated VGAM RNA, may have a different number of host target binding sites in untranslated regions of a VGAM637 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM637 RNA, herein designated VGAM RNA, to host target binding sites on VGAM637 host target RNA, herein designated VGAM HOST TARGET RNA, such as BINDING SITE I, BINDING SITE II and BINDING SITE III, inhibits translation of VGAM637 host target RNA into VGAM637 host target protein, herein designated VGAM HOST TARGET PROTEIN. VGAM host target protein is therefore outlined by a broken line.

It is appreciated that VGAM637 host target gene, herein designated VGAM HOST TARGET GENE, in fact represents a plurality of VGAM637 host target genes. The mRNA of each one of this plurality of VGAM637 host target genes comprises one or more host target binding sites, each having a nucleotide sequence which is at least partly complementary to VGAM637 RNA, herein designated VGAM RNA, and which when bound by VGAM637 RNA causes inhibition of translation of respective one or more VGAM637 host target proteins.

It is further appreciated by one skilled in the art that the mode of translational inhibition illustrated by FIG. 1 with specific reference to translational inhibition exerted by VGAM637 gene, herein designated VGAM GENE, on one or more VGAM637 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM637 is inhibition of expression of host target genes, as part of a novel viral mechanism of attacking a host. Accordingly, utilities of VGAM637 include diagnosis, prevention and treatment of viral infection by Frog Adenovirus 1. Specific functions, and accordingly utilities, of VGAM637 correlate with, and may be deduced from, the identity of the host target genes which VGAM637 binds and inhibits, and the function of these host target genes, as elaborated hereinbelow.

Nucleotide sequences of the VGAM637 precursor RNA, herein designated VGAM PRECURSOR RNA, and of the 'diced' VGAM637 RNA, herein designated VGAM RNA, and a schematic representation of the secondary folding of VGAM637 folded precursor RNA, herein designated VGAM FOLDED PRECURSOR RNA, of VGAM637 are further described hereinbelow with reference to Table 1.

Nucleotide sequences of host target binding sites, such as BINDING SITE-I, BINDING SITE-II and BINDING SITE-III of FIG. 1, found on VGAM637 host target RNA, and schematic representation of the complementarity of each of these host target binding sites to VGAM637 RNA, herein designated VGAM RNA, are described hereinbelow with reference to Table 2.

As mentioned hereinabove with reference to FIG. 1, a function of VGAM637 gene, herein designated VGAM is inhibition of expression of VGAM637 target genes. It is appreciated that specific functions, and accordingly utilities, of VGAM637 correlate with, and may be deduced from, the identity of the target genes which VGAM637 binds and inhibits, and the function of these target genes, as elaborated hereinbelow.

FREB (Accession NM_032738) is a VGAM637 host target gene. FREB BINDING SITE is HOST TARGET binding site found in the 3' untranslated region of mRNA encoded by FREB, corresponding to a HOST TARGET binding site such as BINDING SITE I, BINDING SITE II or BINDING SITE III. Table 2 illustrates the complementarity of the nucleotide sequences of FREB BINDING SITE, designated SEQ ID:26465, to the nucleotide sequence of VGAM637 RNA, herein designated VGAM RNA, also designated SEQ ID:3348.

A function of VGAM637 is therefore inhibition of FREB (Accession NM_032738). Accordingly, utilities of VGAM637 include diagnosis, prevention and treatment of diseases and clinical conditions associated with FREB. Tumor Necrosis Factor (ligand) Superfamily, Member 10 (TNFSF10, Accession NM_003810) is another VGAM637 host target gene. TNFSF10 BINDING SITE is HOST TARGET binding site found in the 3' untranslated region of mRNA encoded by TNFSF10, corresponding to a HOST TARGET binding site such as BINDING SITE I, BINDING SITE II or BINDING SITE III. Table 2 illustrates the complementarity of the nucleotide sequences of TNFSF10 BINDING SITE, designated SEQ ID:9899, to the nucleotide sequence of VGAM637 RNA, herein designated VGAM RNA, also designated SEQ ID:3348.

Another function of VGAM637 is therefore inhibition of Tumor Necrosis Factor (ligand) Superfamily, Member 10 (TNFSF10, Accession NM_003810), a gene which mediates cell death. Accordingly, utilities of VGAM637 include diagnosis, prevention and treatment of diseases and clinical conditions associated with TNFSF10. The function of TNFSF10 has been established by previous studies. Degli-Esposti et al. (1997) noted that TRAIL can induce apoptosis in a wide variety of transformed cell lines of diverse lineage, but does not appear to kill normal cells even though TRAIL mRNA is expressed at significant levels in most normal tissues. They suggested that the regulation of TRAIL function takes place at the level of receptor expression. The TRAIL receptors TRAILR1, also called DR4 (OMIM Ref. No. 603611), and TRAILR2, also called DR5 (OMIM Ref. No. 603612), are capable of mediating apoptosis. Two other receptors, TRAILR3 (OMIM Ref. No. 603613) and TRAILR4 (OMIM Ref. No. 603614), do not signal apoptosis and are potential decoy receptors for TRAIL. Cell death induced by TRAIL had been believed to occur exclusively in tumor cells, suggesting that this drug was safe to use as an antitumor therapy. Nitsch et al. (2000) reported that TRAIL induced apoptosis in the human brain, which argues against the use of TRAIL for therapy of human brain tumors. However, neuroinflammatory T cells that express TRAIL might induce apoptosis of brain tissue, indicating a potential target for treatment of multiple sclerosis. Animal model experiments lend further support to the function of TNFSF10. Cretney et al. (2002) generated healthy, fertile Trail-deficient mice by homologous recombination. Functional analysis confirmed the importance of Trail in mediating natural killer (NK) cytotoxicity to some tumor target cells. The authors found that Trail contributes to NK cell suppression of metastases to liver by a renal adenocarcinoma and to multiple tissues by breast carcinoma cells. Trail -/- mice were also more susceptible than wildtype mice to early onset of fibrosarcomas from lower doses of methylcholanthrene.

It is appreciated that the abovementioned animal model for TNFSF10 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Degli-Esposti, M. A.; Dougall, W. C.; Smolak, P. J.; Waugh, J. Y.; Smith, C. A.; Goodwin, R. G.: The novel receptor TRAIL-R4 induces NF-kappa-B and protects against TRAIL-mediated apoptosis, yet retains an incomplete death domain. Immunity 7:813-820, 1997; and Nitsch, R.; Bechmann, I.; Deisz, R. A.; Haas, D.; Lehmann, T. N.; Wendling, U.; Zipp, F.: Human brain-cell death induced by tumour-necrosis-factor-related apoptosis-inducing ligand (TRA.

Further studies establishing the function and utilities of TNFSF10 are found in John Hopkins OMIM database record ID 603598, and in sited publications numbered 5312-5313, 5880, 5963-5965, 60 and 5966 listed in the bibliography section hereinbelow, which are also hereby incorporated by reference. KIAA0323 (Accession XM_032634) is another VGAM637 host target gene. KIAA0323 BINDING SITE is HOST TARGET binding site found in the 3' untranslated region of mRNA encoded by KIAA0323, corresponding to a HOST TARGET binding site such as BINDING SITE I, BINDING SITE II or BINDING SITE III. Table 2 illustrates the complementarity of the nucleotide sequences of KIAA0323 BINDING SITE, designated SEQ ID:31687, to the nucleotide sequence of VGAM637 RNA, herein designated VGAM RNA, also designated SEQ ID:3348.

Another function of VGAM637 is therefore inhibition of KIAA0323 (Accession XM_032634). Accordingly, utilities of VGAM637 include diagnosis, prevention and treatment of diseases and clinical conditions associated with KIAA0323. LOC254251 (Accession XM_171088) is another VGAM637 host target gene. LOC254251 BINDING SITE is HOST TARGET binding site found in the 5' untranslated region of mRNA encoded by LOC254251, corresponding to a HOST TARGET binding site such as BINDING SITE I, BINDING SITE II or BINDING SITE III. Table 2 illustrates the complementarity of the nucleotide sequences of LOC254251 BINDING SITE, designated SEQ ID:45893, to the nucleotide sequence of VGAM637 RNA, herein designated VGAM RNA, also designated SEQ ID:3348.

Another function of VGAM637 is therefore inhibition of LOC254251 (Accession XM_171088). Accordingly, utilities of VGAM637 include diagnosis, prevention and treatment of diseases and clinical conditions associated with LOC254251. FIG. 1 further provides a conceptual description of a novel bioinformatically detected viral gene of the present invention, referred to here as Viral Genomic Address Messenger 638 (VGAM638) viral gene, which modulates expression of respective host target genes thereof, the function and utility of which host target genes is known in the art.

VGAM638 is a novel bioinformatically detected regulatory, non protein coding, viral micro RNA (miRNA) gene. The method by which VGAM638 was detected is described hereinabove with reference to FIGS. 1-8.

VGAM638 gene, herein designated VGAM GENE, is a viral gene contained in the genome of Turnip Mosaic Virus. VGAM638 host target gene, herein designated VGAM HOST TARGET GENE, is a human gene contained in the human genome.

VGAM638 gene encodes a VGAM638 precursor RNA, herein designated VGAM PRECURSOR RNA. Similar to other miRNA genes, and unlike most ordinary genes, VGAM638 precursor RNA does not encode a protein. A nucleotide sequence identical or highly similar to the nucleotide sequence of VGAM638 precursor RNA is designated SEQ ID:624, and is provided hereinbelow with reference to the sequence listing part. Nucleotide sequence SEQ ID:624 is located at position 6990 relative to the genome of Turnip Mosaic Virus.

VGAM638 precursor RNA folds onto itself, forming VGAM638 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM638 folded precursor RNA into VGAM638 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM638 RNA is designated SEQ ID:3349, and is provided hereinbelow with reference to the sequence listing part.

VGAM638 host target gene, herein designated VGAM HOST TARGET GENE, encodes a corresponding messenger RNA, VGAM638 host target RNA, herein designated VGAM HOST TARGET RNA. VGAM638 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM638 RNA, herein designated VGAM RNA, binds complementarily to one or more host target binding sites located in untranslated regions of VGAM638 host target RNA, herein designated VGAM HOST TARGET RNA. This complementary binding is due to the fact that the nucleotide sequence of VGAM638 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM638 RNA, herein designated VGAM RNA, may have a different number of host target binding sites in untranslated regions of a VGAM638 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM638 RNA, herein designated VGAM RNA, to host target binding sites on VGAM638 host target RNA, herein designated VGAM HOST TARGET RNA, such as BINDING SITE I, BINDING SITE II and BINDING SITE III, inhibits translation of VGAM638 host target RNA into VGAM638 host target protein, herein designated VGAM HOST TARGET PROTEIN. VGAM host target protein is therefore outlined by a broken line.

It is appreciated that VGAM638 host target gene, herein designated VGAM HOST TARGET GENE, in fact represents a plurality of VGAM638 host target genes. The mRNA of each one of this plurality of VGAM638 host target genes comprises one or more host target binding sites, each having a nucleotide sequence which is at least partly complementary to VGAM638 RNA, herein designated VGAM RNA, and which when bound by VGAM638 RNA causes inhibition of translation of respective one or more VGAM638 host target proteins.

It is further appreciated by one skilled in the art that the mode of translational inhibition illustrated by FIG. 1 with specific reference to translational inhibition exerted by VGAM638 gene, herein designated VGAM GENE, on one or more VGAM638 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM638 is inhibition of expression of host target genes, as part of a novel viral mechanism of attacking a host. Accordingly, utilities of VGAM638 include diagnosis, prevention and treatment of viral infection by Turnip Mosaic Virus. Specific functions, and accordingly utilities, of VGAM638 correlate with, and may be deduced from, the identity of the host target genes which VGAM638 binds and inhibits, and the function of these host target genes, as elaborated hereinbelow.

Nucleotide sequences of the VGAM638 precursor RNA, herein designated VGAM PRECURSOR RNA, and of the 'diced' VGAM638 RNA, herein designated VGAM RNA, and a schematic representation of the secondary folding of VGAM638 folded precursor RNA, herein designated VGAM FOLDED PRECURSOR RNA, of VGAM638 are further described hereinbelow with reference to Table 1.

Nucleotide sequences of host target binding sites, such as BINDING SITE-I, BINDING SITE-II and BINDING SITE-III of FIG. 1, found on VGAM638 host target RNA, and schematic representation of the complementarity of each of these host target binding sites to VGAM638 RNA, herein designated VGAM RNA, are described hereinbelow with reference to Table 2.

As mentioned hereinabove with reference to FIG. 1, a function of VGAM638 gene, herein designated VGAM is inhibition of expression of VGAM638 target genes. It is appreciated that specific functions, and accordingly utilities, of VGAM638 correlate with, and may be deduced from, the identity of the target genes which VGAM638 binds and inhibits, and the function of these target genes, as elaborated hereinbelow.

V-akt Murine Thymoma Viral Oncogene Homolog 1 (AKT1, Accession NM_005163) is a VGAM638 host target gene. AKT1 BINDING SITE is HOST TARGET binding site found in the 3' untranslated region of mRNA encoded by AKT1, corresponding to a HOST TARGET binding site such as BINDING SITE I, BINDING SITE II or BINDING SITE III. Table 2 illustrates the complementarity of the nucleotide sequences of AKT1 BINDING SITE, designated SEQ ID:11650, to the nucleotide sequence of VGAM638 RNA, herein designated VGAM RNA, also designated SEQ ID:3349.

A function of VGAM638 is therefore inhibition of V-akt Murine Thymoma Viral Oncogene Homolog 1 (AKT1, Accession NM_005163), a gene which Serine-threonine protein kinase. Accordingly, utilities of VGAM638 include diagnosis, prevention and treatment of diseases and clinical conditions associated with AKT1. The function of AKT1 and its association with various diseases and clinical conditions, has been established by previous studies, as described hereinabove with reference to VGAM188. Rho GTPase Activating Protein 6 (ARHGAP6, Accession NM_001174) is another VGAM638 host target gene. ARHGAP6 BINDING SITE is HOST TARGET binding site found in the 3' untranslated region of mRNA encoded by ARHGAP6, corresponding to a HOST TARGET binding site such as BINDING SITE I, BINDING SITE II or BINDING SITE III. Table 2 illustrates the complementarity of the nucleotide sequences of ARHGAP6 BINDING SITE, designated SEQ ID:6841, to the nucleotide sequence of VGAM638 RNA, herein designated VGAM RNA, also designated SEQ ID:3349.

Another function of VGAM638 is therefore inhibition of Rho GTPase Activating Protein 6 (ARHGAP6, Accession NM_001174), a gene which activates the rho-type GTPases by converting them to an inactive GTP-bound state. Accordingly, utilities of VGAM638 include diagnosis, prevention and treatment of diseases and clinical conditions associated with ARHGAP6. The function of ARHGAP6 and its association with various diseases and clinical conditions, has been established by previous studies, as described hereinabove with reference to VGAM55. Bassoon (presynaptic cytomatrix protein) (BSN, Accession NM_003458) is another VGAM638 host target gene. BSN BINDING SITE is HOST TARGET binding site found in the 3' untranslated region of mRNA encoded by BSN, corresponding to a HOST TARGET binding site such as BINDING SITE I, BINDING SITE II or BINDING SITE III. Table 2 illustrates the complementarity of the nucleotide sequences of BSN BINDING SITE, designated SEQ ID:9521, to the nucleotide sequence of VGAM638 RNA, herein designated VGAM RNA, also designated SEQ ID:3349.

Another function of VGAM638 is therefore inhibition of Bassoon (presynaptic cytomatrix protein) (BSN, Accession NM_003458), a gene which may be involved in cytomatrix organization at the site of neurotransmitter release. Accordingly, utilities of VGAM638 include diagnosis, prevention and treatment of diseases and clinical conditions associated with BSN. The function of BSN has been established by previous studies. Both the presynaptic terminal and the postsynaptic compartment of neuronal synapses comprise a highly specialized cytoskeleton underlying the synaptic membranes. The presynaptic nerve terminal is the principal site of regulated neurotransmitter release. The active zone is the region of the presynaptic plasmalemma over which synaptic vesicles dock, fuse, and release neurotransmitter. Piccolo (PCLO; 604918), a 420-kD protein, is 1 component of the presynaptic cytomatrix. Tom Dieck et al. (1998) isolated a large (greater than 400 kD) protein in mouse that is also found in the presynaptic compartments of rat brain synapses. They designated the protein Bassoon because it, along with Piccolo, is part of the ensemble of presynaptic proteins that are involved in orchestrating events at the nerve terminal. Bassoon is found in axon terminals of hippocampal neurons where it is highly concentrated in the vicinity of the active zone. Piccolo has a similar distribution and colocalizes with Bassoon in cultured hippocampal cells. Tom Dieck et al. (1998) suggested that Bassoon may be involved in cytomatrix organization at the site of neurotransmitter release Multiple system atrophy (MSA) is a sporadic progressive neurodegenerative disease. By differential hybridization to high-density cDNA filters, Hashida et al. (1998) identified human frontal lobe cDNAs with altered expression patterns in MSA patients. One partial cDNA whose expression was elevated 2-fold in MSA cerebella encoded a protein that the authors designated ZNF231 (zinc finger protein-231). By screening additional libraries with the partial cDNA, they assembled a full-length ZNF231 cDNA. The predicted 3,926-amino acid protein contains 2 glycine-proline dipeptide repeats, a pair of homologous C8 double zinc finger motifs, a leucine zipper motif, an SH3 domain-binding motif, 2 nuclear targeting sequences, 2 glutamine-rich domains, and a histidine-rich domain. Northern blot analysis of rat tissues indicated that the ZNF231 gene was expressed as a 16-kb mRNA specifically in brain. By RT-PCR of human brain cell lines and tissue, Hashida et al. (1998) determined that ZNF231 was expressed in the cerebellum and in a neuroblastoma cell line, but not in the white matter. Ishikawa et al. (1997) recovered a ZNF231 cDNA, designated KIAA0434, as 1 of 78 brain cDNAs that may encode large proteins. Gundelfinger (1999) stated that ZNF231 is the human homolog of Bassoon Full details of the abovementioned studies are described in the following publications, the disclosure of which are hereby incorporated by reference:

tom Dieck, S.; Sanmarti-Vila, L.; Langnaese, K.; Richter, K.; Kindler, S.; Soyke, A.; Wex, H.; Smalla, K.-H.; Kampf, U.; Franzer, J.-T.; Stumm, M.; Garner, C. C.; Gundelfinger, E. D.: Bassoon, a novel zinc-finger CAG/glutamine-repeat protein selectively localized at the active zone of presynaptic nerve terminals. J. Cell Biol. 142:499-509, 1998; and Hashida, H.; Goto, J.; Zhao, N.; Takahashi, N.; Hirai, M.; Kanazawa, I.; Sakaki, Y.: Cloning and mapping of ZNF231, a novel brain-specific gene encoding neuronal double zinc finger prot.

Further studies establishing the function and utilities of BSN are found in John Hopkins OMIM database record ID 604020, and in sited publications numbered 7612-7613, 110 and 7632-7633 listed in the bibliography section hereinbelow, which are also hereby incorporated by reference. Deiodinase, Iodothyronine, Type III (DIO3, Accession NM_001362) is another VGAM638 host target gene. DIO3 BINDING SITE is HOST TARGET binding site found in the 3' untranslated region of mRNA encoded by DIO3, corresponding to a HOST TARGET binding site such as BINDING SITE I, BINDING SITE II or BINDING SITE III. Table 2 illustrates the complementarity of the nucleotide sequences of DIO3 BINDING SITE, designated SEQ ID:7042, to the nucleotide sequence of VGAM638 RNA, herein designated VGAM RNA, also designated SEQ ID:3349.

Another function of VGAM638 is therefore inhibition of Deiodinase, Iodothyronine, Type III (DIO3, Accession NM_001362), a gene which regulates circulating fetal thyroid hormone concentrations. Accordingly, utilities of VGAM638 include diagnosis, prevention and treatment of diseases and clinical conditions associated with DIO3. The function of DIO3 has been established by previous studies. Thyroid hormone is critical to the normal development of the human central nervous system. Salvatore et al. (1995) noted that, despite the presence of thyroxine (T4) and thyroid follicles in the fetal thyroid by 10 to 12 weeks of gestation, as well as the potential availability of maternal thyroid hormone, the free concentration of the active thyroid hormone T3 is less than half that of maternal levels up to the time of delivery. The physiologic rationale for this circumstance is not well understood, but the authors suggested that it is possible that 'normal' circulating T3 concentrations could have deleterious effects on immature tissues or could enhance the metabolic requirements of the fetus. There are 2 principal mechanisms by which the circulating fetal T3 concentration is maintained at low levels. One is that the type I iodothyronine deiodinase (OMIM Ref. No. 147892) in fetal liver is expressed at lower levels relative to those in adult life. This reduces the extra thyroidal T3 supply from this source. The second important factor in maintaining low serum T3 concentrations is the expression of high levels of the type III deiodinase in placenta of all species examined. Type III iodothyronine deiodinase catalyzes the conversion of T4 and T3 to inactive metabolites. Salvatore et al. (1995) cloned human placental type III iodothyronine deiodinase (which they referred to as D3). It is a selenoenzyme, as evidenced by (1) the presence of an in-frame UGA codon at position 144; (2) the synthesis of a 32-kD (75)Se-labeled protein in D3 cDNA transfected cells; and (3) the presence of a selenocysteine insertion sequence element in the 3-prime untranslated region of an mRNA that is required for its expression. The authors stated that the D3 selenocysteine insertion sequence element is more potent than that found in the type I deiodinase or glutathione peroxidase (OMIM Ref. No. 138320) gene, suggesting a high priority for selenocysteine incorporation into this enzyme. The conservation of this enzyme from Xenopus laevis tadpoles to human S implies an essential role for regulation of thyroid hormone inactivation during embryologic development. Huang et al. (2000) reported the case of a 3-month-old infant with massive hepatic hemangiomas and primary hypothyroidism who needed very high doses of thyroid hormone to restore euthyroidism and normal thyrotropin secretion. This finding suggested that the rate of degradation of thyroid hormone was accelerated. They subsequently identified high levels of type III iodothyronine deiodinase activity in the hemangioma tissue. Normally present in the brain and placenta, this selenoenzyme catalyzes the conversion of thyroxine to reverse triiodothyronine and the conversion of triiodothyronine to 3,3-prime-diiodothyronine, both of which are biologically inactive. They then retrospectively analyzed other patients with hemangiomas and identified additional patients with similar histories and other hemangiomas with type III iodothyronine deiodinase activity.

Full details of the abovementioned studies are described in the following publications, the disclosure of which are hereby incorporated by reference:

Hernandez, A.; Park, J. P.; Lyon, G. J.; Mohandas, T. K.; St. Germain, D. L.: Localization of the type 3 iodothyronine deiodinase (DIO3) gene to human chromosome 14q32 and mouse chromosome 12F1. Genomics 53:119-121, 1998; and Huang, S. A.; Tu, H. M.; Harney, J. W.; Venihaki, M.; Butte, A. J.; Kozakewich, H. P. W.; Fishman, S. J.; Larsen, P. R.: Severe hypothyroidism caused by type 3 iodothyronine deiodinase.

Further studies establishing the function and utilities of DIO3 are found in John Hopkins OMIM database record ID 601038, and in sited publications numbered 6871-6873 listed in the bibliography section hereinbelow, which are also hereby incorporated by reference. Ferritin, Heavy Polypeptide 1 (FTH1, Accession XM_042852) is another VGAM638 host target gene. FTH1 BINDING SITE is HOST TARGET binding site found in the 5' untranslated region of mRNA encoded by FTH1, corresponding to a HOST TARGET binding site such as BINDING SITE I, BINDING SITE II or BINDING SITE III. Table 2 illustrates the complementarity of the nucleotide sequences of FTH1 BINDING SITE, designated SEQ ID:33808, to the nucleotide sequence of VGAM638 RNA, herein designated VGAM RNA, also designated SEQ ID:3349.

Another function of VGAM638 is therefore inhibition of Ferritin, Heavy Polypeptide 1 (FTH1, Accession XM_042852), a gene which stores iron in a soluble, nontoxic, readily available form. Accordingly, utilities of VGAM638 include diagnosis, prevention and treatment of diseases and clinical conditions associated with FTH1. The function of FTH1 has been established by previous studies. Synthesis of both the H- and L-ferritin subunits is controlled by a common cytosolic protein, iron regulatory protein (IRP), which binds to the iron-responsive element (IRE) in the 5-prime untranslated region of the H- and L-ferritin mRNAs (Leibold and Munro, 1988; Eisenstein, 2000). In 4 of 7 members of a Japanese family affected by dominantly inherited iron overload, Kato et al. (2001) found a single point mutation (A49U; 134770.0001) in the IRE motif of H ferritin mRNA. Gel-shift mobility assay and Scatchard-plot analysis revealed that a mutated IRE probe had a higher binding affinity to IRP than did the wildtype probe. When mutated H subunit was overexpressed in COS1 cells, suppression of H-subunit synthesis and of the increment of radiolabeled iron uptake were observed. These data suggested that the A49U mutation in the IRE of H-subunit is responsible for tissue iron deposition and is a novel cause of hereditary iron overload, most likely related to impairment of the ferroxidase activity generated by H subunit. Animal model experiments lend further support to the function of FTH1. Ferreira et al. (2000) disrupted the H ferritin gene in mice by homologous recombination. Heterozygous mice were healthy, fertile, and did not differ significantly from their control littermates. However, Fth -/- embryos died between 3.5 and 9.5 days of development, suggesting that there is no functional redundancy between the 2 ferritin subunits and that, in the absence of H subunits, L ferritin homopolymers are not able to maintain iron in a bioavailable and nontoxic form. The pattern of expression of the wildtype Fth gene in 9.5-day embryos is restricted to the developing heart and central nervous system.

It is appreciated that the abovementioned animal model for FTH1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ferreira, C.; Bucchini, D.; Martin, M.-E.; Levi, S.; Arosio, P.; Grandchamp, B.; Beaumont, C.: Early embryonic lethality of H ferritin gene deletion in mice. J. Biol. Chem. 275:3021-3024, 2000; and Kato, J.; Fujikawa, K.; Kanda, M.; Fukuda, N.; Sasaki, K.; Takayama, T.; Kobune, M.; Takada, K.; Takimoto, R.; Hamada, H.; Ikeda, T.; Niitsu, Y.: A mutation, in the iron-responsive el.

Further studies establishing the function and utilities of FTH1 are found in John Hopkins OMIM database record ID 134770, and in sited publications numbered 11578-11580, 3984, 11581-1159 and 11962-11970 listed in the bibliography section hereinbelow, which are also hereby incorporated by reference. Gonadotropin-releasing Hormone Receptor (GNRHR, Accession NM_000406) is another VGAM638 host target gene. GNRHR BINDING SITE is HOST TARGET binding site found in the 5' untranslated region of mRNA encoded by GNRHR, corresponding to a HOST TARGET binding site such as BINDING SITE I, BINDING SITE II or BINDING SITE III. Table 2 illustrates the complementarity of the nucleotide sequences of GNRHR BINDING SITE, designated SEQ ID:5983, to the nucleotide sequence of VGAM638 RNA, herein designated VGAM RNA, also designated SEQ ID:3349.

Another function of VGAM638 is therefore inhibition of Gonadotropin-releasing Hormone Receptor (GNRHR, Accession NM_000406), a gene which stimulates the secretionstimulates phosphoinositide turnover and membrane depolarization. Accordingly, utilities of VGAM638 include diagnosis, prevention and treatment of diseases and clinical conditions associated with GNRHR. The function of GNRHR has been established by previous studies. Kakar et al. (1992) isolated a cDNA for the GNRH receptor and showed that it encodes a protein with a transmembrane topology similar to that of other G protein-coupled 7-transmembrane-domain receptors. Grosse et al. (1997) used RT-PCR of human pituitary poly (A)+ RNA to clone the full-length GNRHR gene and a second truncated cDNA characterized by a 128-bp deletion between nucleotide positions 522 and 651. The deletion causes a frameshift in the open reading frame, thus generating new coding sequence for a further 75 amino acids. The truncated cDNA arises from alternative splicing that uses a cryptic 3-prime splice site in exon 2. Translation products of approximately 45 to 50 and 42 kD were immunoprecipitated from COS-7 cells transfected with wildtype and truncated GNRHR cDNAs, respectively. The splice variant was incapable of ligand binding and signal transduction. Coexpression of wildtype and truncated proteins in transiently or stably transfected cells, resulted in impaired signaling via the wildtype GNRHR by reducing maximal agonist-induced inositol phosphate accumulation. This inhibitory effect depended on the amount of splice variant cDNA cotransfected and was specific for GNRHR. Coexpression of the wildtype and truncated GNRHRs resulted in impaired insertion of wildtype GNRHR into the plasma membrane. Caron et al. (1999) studied a kindred with 3 sibs with isolated hypogonadotropic hypogonadism who were genetic compounds for the arg262-to-gln mutation (138850.0002) and an ala129-to-asp (138850.0004) mutation that resulted in a complete loss of function. The 2 brothers had microphallus and bilateral cryptorchidism and were referred for lack of puberty; their sister had primary amenorrhea and a complete lack of puberty. The authors concluded that these hypogonadal patients were partially resistant to pulsatile GNRH administration, suggesting that they should be treated with gonadotropins to induce spermatogenesis or ovulation rather than with pulsatile GNRH. Kottler et al. (1999) analyzed in detail the GNRHR mutations in 7 independent familial and sporadic cases of idiopathic hypogonadotropic hypogonadism reported to that time. The Q106R (138850.0001) and R262Q (138850.0002) mutations were frequent in patients from all geographic areas (North or South America or Europe).

Full details of the abovementioned studies are described in the following publications, the disclosure of which are hereby incorporated by reference:

Caron, P.; Chauvin, S.; Christin-Maitre, S.; Bennet, A.; Lahlou, N.; Counis, R.; Bouchard, P.; Kottler, M.-L.: Resistance of hypogonadic patients with mutated GnRH receptor genes to pulsatile GnRH administration. J. Clin. Endocr. Metab. 84: 990-996, 1999; and Kakar, S. S.; Musgrove, L. C.; Devor, D. C.; Sellers, J. C.; Neill, J. D.: Cloning, sequencing, and expression of human gonadotropin releasing hormone (GnRH) receptor. Biochem. Biophy.

Further studies establishing the function and utilities of GNRHR are found in John Hopkins OMIM database record ID 138850, and in sited publications numbered 3917-392 and 4008-4022 listed in the bibliography section hereinbelow, which are also hereby incorporated by reference. G Protein-coupled Receptor 30 (GPR30, Accession NM_001505) is another VGAM638 host target gene. GPR30 BINDING SITE is HOST TARGET binding site found in the 3' untranslated region of mRNA encoded by GPR30, corresponding to a HOST TARGET binding site such as BINDING SITE I, BINDING SITE II or BINDING SITE III. Table 2 illustrates the complementarity of the nucleotide sequences of GPR30 BINDING SITE, designated SEQ ID:7252, to the nucleotide sequence of VGAM638 RNA, herein designated VGAM RNA, also designated SEQ ID:3349.

Another function of VGAM638 is therefore inhibition of G Protein-coupled Receptor 30 (GPR30, Accession NM_001505), a gene which receives chemical signals in cell communication in both CNS and peripheral tissues. Accordingly, utilities of VGAM638 include diagnosis, prevention and treatment of diseases and clinical conditions associated with GPR30. The function of GPR30 and its association with various diseases and clinical conditions, has been established by previous studies, as described hereinabove with reference to VGAM171. V-myb Myeloblastosis Viral Oncogene Homolog (avian)-like 1 (MYBL1, Accession XM_034274) is another VGAM638 host target gene. MYBL1 BINDING SITE is HOST TARGET binding site found in the 3' untranslated region of mRNA encoded by MYBL1, corresponding to a HOST TARGET binding site such as BINDING SITE I, BINDING SITE II or BINDING SITE III. Table 2 illustrates the complementarity of the nucleotide sequences of MYBL1 BINDING SITE, designated SEQ ID:32041, to the nucleotide sequence of VGAM638 RNA, herein designated VGAM RNA, also designated SEQ ID:3349.

Another function of VGAM638 is therefore inhibition of V-myb Myeloblastosis Viral Oncogene Homolog (avian)-like 1 (MYBL1, Accession XM_034274), a gene which could have a role in the proliferation and/or differentiation of neurogenic, spermatogenic and b-lymphoid cells. Accordingly, utilities of VGAM638 include diagnosis, prevention and treatment of diseases and clinical conditions associated with MYBL1. The function of MYBL1 and its association with various diseases and clinical conditions, has been established by previous studies, as described hereinabove with reference to VGAM184. Neurocalcin Delta (NCALD, Accession NM_032041) is another VGAM638 host target gene. NCALD BINDING SITE is HOST TARGET binding site found in the 3' untranslated region of mRNA encoded by NCALD, corresponding to a HOST TARGET binding site such as BINDING SITE I, BINDING SITE II or BINDING SITE III. Table 2 illustrates the complementarity of the nucleotide sequences of NCALD BINDING SITE, designated SEQ ID:25746, to the nucleotide sequence of VGAM638 RNA, herein designated VGAM RNA, also designated SEQ ID:3349.

Another function of VGAM638 is therefore inhibition of Neurocalcin Delta (NCALD, Accession NM_032041). Accordingly, utilities of VGAM638 include diagnosis, prevention and treatment of diseases and clinical conditions associated with NCALD. Short Stature Homeobox (SHOX, Accession NM_006883) is another VGAM638 host target gene. SHOX BINDING SITE1 and SHOX BINDING SITE2 are HOST TARGET binding sites found in untranslated regions of mRNA encoded by SHOX, corresponding to HOST TARGET binding sites such as BINDING SITE I, BINDING SITE II or BINDING SITE III. Table 2 illustrates the complementarity of the nucleotide sequences of SHOX BINDING SITE1 and SHOX BINDING SITE2, designated SEQ ID:13746 and SEQ ID:6053 respectively, to the nucleotide sequence of VGAM638 RNA, herein designated VGAM RNA, also designated SEQ ID:3349.

Another function of VGAM638 is therefore inhibition of Short Stature Homeobox (SHOX, Accession NM_006883). Accordingly, utilities of VGAM638 include diagnosis, prevention and treatment of diseases and clinical conditions associated with SHOX. Thymidine Kinase 2, Mitochondrial (TK2, Accession NM_004614) is another VGAM638 host target gene. TK2 BINDING SITE is HOST TARGET binding site found in the 3' untranslated region of mRNA encoded by TK2, corresponding to a HOST TARGET binding site such as BINDING SITE I, BINDING SITE II or BINDING SITE III. Table 2 illustrates the complementarity of the nucleotide sequences of TK2 BINDING SITE, designated SEQ ID:10959, to the nucleotide sequence of VGAM638 RNA, herein designated VGAM RNA, also designated SEQ ID:3349.

Another function of VGAM638 is therefore inhibition of Thymidine Kinase 2, Mitochondrial (TK2, Accession NM_004614), a gene which phosphorylates thymidine, deoxycytidine, deoxyuridine, and also anti-viral and anti-cancer nucleoside analogs. Accordingly, utilities of VGAM638 include diagnosis, prevention and treatment of diseases and clinical conditions associated with TK2. The function of TK2 and its association with various diseases and clinical conditions, has been established by previous studies, as described hereinabove with reference to VGAM210. BM-002 (Accession NM_016617) is another VGAM638 host target gene. BM-002 BINDING SITE is HOST TARGET binding site found in the 3' untranslated region of mRNA encoded by BM-002, corresponding to a HOST TARGET binding site such as BINDING SITE I, BINDING SITE II or BINDING SITE III. Table 2 illustrates the complementarity of the nucleotide sequences of BM-002 BINDING SITE, designated SEQ ID:18725, to the nucleotide sequence of VGAM638 RNA, herein designated VGAM RNA, also designated SEQ ID:3349.

Another function of VGAM638 is therefore inhibition of BM-002 (Accession NM_016617). Accordingly, utilities of VGAM638 include diagnosis, prevention and treatment of diseases and clinical conditions associated with BM-002. C1q and Tumor Necrosis Factor Related Protein 3 (C1QTNF3, Accession NM_030945) is another VGAM638 host target gene. C1QTNF3 BINDING SITE is HOST TARGET binding site found in the 3' untranslated region of mRNA encoded by C1QTNF3, corresponding to a HOST TARGET binding site such as BINDING SITE I, BINDING SITE II or BINDING SITE III. Table 2 illustrates the complementarity of the nucleotide sequences of C1QTNF3 BINDING SITE, designated SEQ ID:25217, to the nucleotide sequence of VGAM638 RNA, herein designated VGAM RNA, also designated SEQ ID:3349.

Another function of VGAM638 is therefore inhibition of C1q and Tumor Necrosis Factor Related Protein 3 (C1QTNF3, Accession NM_030945). Accordingly, utilities of VGAM638 include diagnosis, prevention and treatment of diseases and clinical conditions associated with C1QTNF3. Carbohydrate (N-acetylglucosamine 6-O) Sulfotransferase 4 (CHST4, Accession NM_005769) is another VGAM638 host target gene. CHST4 BINDING SITE is HOST TARGET binding site found in the 5' untranslated region of mRNA encoded by CHST4, corresponding to a HOST TARGET binding site such as BINDING SITE I, BINDING SITE II or BINDING SITE III. Table 2 illustrates the complementarity of the nucleotide sequences of CHST4 BINDING SITE, designated SEQ ID:12339, to the nucleotide sequence of VGAM638 RNA, herein designated VGAM RNA, also designated SEQ ID:3349.

Another function of VGAM638 is therefore inhibition of Carbohydrate (N-acetylglucosamine 6-O) Sulfotransferase 4 (CHST4, Accession NM_005769). Accordingly, utilities of VGAM638 include diagnosis, prevention and treatment of diseases and clinical conditions associated with CHST4. DKFZp761N1114 (Accession XM_086327) is another VGAM638 host target gene. DKFZp761N1114 BINDING SITE is HOST TARGET binding site found in the 3' untranslated region of mRNA encoded by DKFZp761N1114, corresponding to a HOST TARGET binding site such as BINDING SITE I, BINDING SITE II or BINDING SITE III. Table 2 illustrates the complementarity of the nucleotide sequences of DKFZp761N1114 BINDING SITE, designated SEQ ID:38605, to the nucleotide sequence of VGAM638 RNA, herein designated VGAM RNA, also designated SEQ ID:3349.

Another function of VGAM638 is therefore inhibition of DKFZp761N1114 (Accession XM_086327). Accordingly, utilities of VGAM638 include diagnosis, prevention and treatment of diseases and clinical conditions associated with DKFZp761N1114. FLJ14327 (Accession NM_024912) is another VGAM638 host target gene. FLJ14327 BINDING SITE is HOST TARGET binding site found in the 3' untranslated region of mRNA encoded by FLJ14327, corresponding to a HOST TARGET binding site such as BINDING SITE I, BINDING SITE II or BINDING SITE III. Table 2 illustrates the complementarity of the nucleotide sequences of FLJ14327 BINDING SITE, designated SEQ ID:24427, to the nucleotide sequence of VGAM638 RNA, herein designated VGAM RNA, also designated SEQ ID:3349.

Another function of VGAM638 is therefore inhibition of FLJ14327 (Accession NM_024912). Accordingly, utilities of VGAM638 include diagnosis, prevention and treatment of diseases and clinical conditions associated with FLJ14327. FLJ23375 (Accession NM_024956) is another VGAM638 host target gene. FLJ23375 BINDING SITE is HOST TARGET binding site found in the 3' untranslated region of mRNA encoded by FLJ23375, corresponding to a HOST TARGET binding site such as BINDING SITE I, BINDING SITE II or BINDING SITE III. Table 2 illustrates the complementarity of the nucleotide sequences of FLJ23375 BINDING SITE, designated SEQ ID:24513, to the nucleotide sequence of VGAM638 RNA, herein designated VGAM RNA, also designated SEQ ID:3349.

Another function of VGAM638 is therefore inhibition of FLJ23375 (Accession NM_024956). Accordingly, utilities of VGAM638 include diagnosis, prevention and treatment of diseases and clinical conditions associated with FLJ23375. GTP Binding Protein 2 (GTPBP2, Accession NM_019096) is another VGAM638 host target gene. GTPBP2 BINDING SITE is HOST TARGET binding site found in the 3' untranslated region of mRNA encoded by GTPBP2, corresponding to a HOST TARGET binding site such as BINDING SITE I, BINDING SITE II or BINDING SITE III. Table 2 illustrates the complementarity of the nucleotide sequences of GTPBP2 BINDING SITE, designated SEQ ID:21171, to the nucleotide sequence of VGAM638 RNA, herein designated VGAM RNA, also designated SEQ ID:3349.

Another function of VGAM638 is therefore inhibition of GTP Binding Protein 2 (GTPBP2, Accession NM_019096). Accordingly, utilities of VGAM638 include diagnosis, prevention and treatment of diseases and clinical conditions associated with GTPBP2. KIAA0876 (Accession XM_035625) is another VGAM638 host target gene. KIAA0876 BINDING SITE is HOST TARGET binding site found in the 3' untranslated region of mRNA encoded by KIAA0876, corresponding to a HOST TARGET binding site such as BINDING SITE I, BINDING SITE II or BINDING SITE III. Table 2 illustrates the complementarity of the nucleotide sequences of KIAA0876 BINDING SITE, designated SEQ ID:32295, to the nucleotide sequence of VGAM638 RNA, herein designated VGAM RNA, also designated SEQ ID:3349.

Another function of VGAM638 is therefore inhibition of KIAA0876 (Accession XM_035625). Accordingly, utilities of VGAM638 include diagnosis, prevention and treatment of diseases and clinical conditions associated with KIAA0876. KIAA0923 (Accession NM_014021) is another VGAM638 host target gene. KIAA0923 BINDING SITE is HOST TARGET binding site found in the 3' untranslated region of mRNA encoded by KIAA0923, corresponding to a HOST TARGET binding site such as BINDING SITE I, BINDING SITE II or BINDING SITE III. Table 2 illustrates the complementarity of the nucleotide sequences of KIAA0923 BINDING SITE, designated SEQ ID:15239, to the nucleotide sequence of VGAM638 RNA, herein designated VGAM RNA, also designated SEQ ID:3349.

Another function of VGAM638 is therefore inhibition of KIAA0923 (Accession NM_014021). Accordingly, utilities of VGAM638 include diagnosis, prevention and treatment of diseases and clinical conditions associated with KIAA0923. Kelch-like 6 (Drosophila) (KLHL6, Accession NM_130446) is another VGAM638 host target gene. KLHL6 BINDING SITE is HOST TARGET binding site found in the 3' untranslated region of mRNA encoded by KLHL6, corresponding to a HOST TARGET binding site such as BINDING SITE I, BINDING SITE II or BINDING SITE III. Table 2 illustrates the complementarity of the nucleotide sequences of KLHL6 BINDING SITE, designated SEQ ID:28211, to the nucleotide sequence of VGAM638 RNA, herein designated VGAM RNA, also designated SEQ ID:3349.

Another function of VGAM638 is therefore inhibition of Kelch-like 6 (Drosophila) (KLHL6, Accession NM_130446). Accordingly, utilities of VGAM638 include diagnosis, prevention and treatment of diseases and clinical conditions associated with KLHL6. MDN1, Midasin Homolog (yeast) (MDN1, Accession XM_031539) is another VGAM638 host target gene. MDN1 BINDING SITE is HOST TARGET binding site found in the 3' untranslated region of mRNA encoded by MDN1, corresponding to a HOST TARGET binding site such as BINDING SITE I, BINDING SITE II or BINDING SITE III. Table 2 illustrates the complementarity of the nucleotide sequences of MDN1 BINDING SITE, designated SEQ ID:31409, to the nucleotide sequence of VGAM638 RNA, herein designated VGAM RNA, also designated SEQ ID:3349.

Another function of VGAM638 is therefore inhibition of MDN1, Midasin Homolog (yeast) (MDN1, Accession XM_031539). Accordingly, utilities of VGAM638 include diagnosis, prevention and treatment of diseases and clinical conditions associated with MDN1. MGC10870 (Accession NM_032301) is another VGAM638 host target gene. MGC10870 BINDING SITE is HOST TARGET binding site found in the 5' untranslated region of mRNA encoded by MGC10870, corresponding to a HOST TARGET binding site such as BINDING SITE I, BINDING SITE II or BINDING SITE III. Table 2 illustrates the complementarity of the nucleotide sequences of MGC10870 BINDING SITE, designated SEQ ID:26080, to the nucleotide sequence of VGAM638 RNA, herein designated VGAM RNA, also designated SEQ ID:3349.

Another function of VGAM638 is therefore inhibition of MGC10870 (Accession NM_032301). Accordingly, utilities of VGAM638 include diagnosis, prevention and treatment of diseases and clinical conditions associated with MGC10870. MGC10981 (Accession NM_032654) is another VGAM638 host target gene. MGC10981 BINDING SITE is HOST TARGET binding site found in the 3' untranslated region of mRNA encoded by MGC10981, corresponding to a HOST TARGET binding site such as BINDING SITE I, BINDING SITE II or BINDING SITE III. Table 2 illustrates the complementarity of the nucleotide sequences of MGC10981 BINDING SITE, designated SEQ ID:26387, to the nucleotide sequence of VGAM638 RNA, herein designated VGAM RNA, also designated SEQ ID:3349.

Another function of VGAM638 is therefore inhibition of MGC10981 (Accession NM_032654). Accordingly, utilities of VGAM638 include diagnosis, prevention and treatment of diseases and clinical conditions associated with MGC10981. RAB, Member of RAS Oncogene Family-like 4 (RABL4, Accession NM_006860) is another VGAM638 host target gene. RABL4 BINDING SITE is HOST TARGET binding site found in the 5' untranslated region of mRNA encoded by RABL4, corresponding to a HOST TARGET binding site such as BINDING SITE I, BINDING SITE II or BINDING SITE III. Table 2 illustrates the complementarity of the nucleotide sequences of RABL4 BINDING SITE, designated SEQ ID:13730, to the nucleotide sequence of VGAM638 RNA, herein designated VGAM RNA, also designated SEQ ID:3349.

Another function of VGAM638 is therefore inhibition of RAB, Member of RAS Oncogene Family-like 4 (RABL4, Accession NM_006860). Accordingly, utilities of VGAM638 include diagnosis, prevention and treatment of diseases and clinical conditions associated with RABL4. Signal-regulatory Protein Beta 1 (SIRPB1, Accession NM_006065) is another VGAM638 host target gene. SIRPB1 BINDING SITE is HOST TARGET binding site found in the 3' untranslated region of mRNA encoded by SIRPB1, corresponding to a HOST TARGET binding site such as BINDING SITE I, BINDING SITE II or BINDING SITE III. Table 2 illustrates the complementarity of the nucleotide sequences of SIRPB1 BINDING SITE, designated SEQ ID:12705, to the nucleotide sequence of VGAM638 RNA, herein designated VGAM RNA, also designated SEQ ID:3349.

Another function of VGAM638 is therefore inhibition of Signal-regulatory Protein Beta 1 (SIRPB1, Accession NM_006065). Accordingly, utilities of VGAM638 include diagnosis, prevention and treatment of diseases and clinical conditions associated with SIRPB1. Unc-5 Homolog D (C. elegans) (UNC5D, Accession NM_080872) is another VGAM638 host target gene. UNC5D BINDING SITE is HOST TARGET binding site found in the 3' untranslated region of mRNA encoded by UNC5D, corresponding to a HOST TARGET binding site such as BINDING SITE I, BINDING SITE II or BINDING SITE III. Table 2 illustrates the complementarity of the nucleotide sequences of UNC5D BINDING SITE, designated SEQ ID:28110, to the nucleotide sequence of VGAM638 RNA, herein designated VGAM RNA, also designated SEQ ID:3349.

Another function of VGAM638 is therefore inhibition of Unc-5 Homolog D (C. elegans) (UNC5D, Accession NM_080872). Accordingly, utilities of VGAM638 include diagnosis, prevention and treatment of diseases and clinical conditions associated with UNC5D. LOC150225 (Accession XM_097870) is another VGAM638 host target gene. LOC150225 BINDING SITE is HOST TARGET binding site found in the 3' untranslated region of mRNA encoded by LOC150225, corresponding to a HOST TARGET binding site such as BINDING SITE I, BINDING SITE II or BINDING SITE III. Table 2 illustrates the complementarity of the nucleotide sequences of LOC150225 BINDING SITE, designated SEQ ID:41189, to the nucleotide sequence of VGAM638 RNA, herein designated VGAM RNA, also designated SEQ ID:3349.

Another function of VGAM638 is therefore inhibition of LOC150225 (Accession XM_097870). Accordingly, utilities of VGAM638 include diagnosis, prevention and treatment of diseases and clinical conditions associated with LOC150225. LOC154007 (Accession XM_087824) is another VGAM638 host target gene. LOC154007 BINDING SITE is HOST TARGET binding site found in the 3' untranslated region of mRNA encoded by LOC154007, corresponding to a HOST TARGET binding site such as BINDING SITE I, BINDING SITE II or BINDING SITE III. Table 2 illustrates the complementarity of the nucleotide sequences of LOC154007 BINDING SITE, designated SEQ ID:39456, to the nucleotide sequence of VGAM638 RNA, herein designated VGAM RNA, also designated SEQ ID:3349.

Another function of VGAM638 is therefore inhibition of LOC154007 (Accession XM_087824). Accordingly, utilities of VGAM638 include diagnosis, prevention and treatment of diseases and clinical conditions associated with LOC154007. LOC154222 (Accession XM_098497) is another VGAM638 host target gene. LOC154222 BINDING SITE is HOST TARGET binding site found in the 3' untranslated region of mRNA encoded by LOC154222, corresponding to a HOST TARGET binding site such as BINDING SITE I, BINDING SITE II or BINDING SITE III. Table 2 illustrates the complementarity of the nucleotide sequences of LOC154222 BINDING SITE, designated SEQ ID:41692, to the nucleotide sequence of VGAM638 RNA, herein designated VGAM RNA, also designated SEQ ID:3349.

Another function of VGAM638 is therefore inhibition of LOC154222 (Accession XM_098497). Accordingly, utilities of VGAM638 include diagnosis, prevention and treatment of diseases and clinical conditions associated with LOC154222. LOC157918 (Accession XM_098842) is another VGAM638 host target gene. LOC157918 BINDING SITE is HOST TARGET binding site found in the 3' untranslated region of mRNA encoded by LOC157918, corresponding to a HOST TARGET binding site such as BINDING SITE I, BINDING SITE II or BINDING SITE III. Table 2 illustrates the complementarity of the nucleotide sequences of LOC157918 BINDING SITE, designated SEQ ID:41894, to the nucleotide sequence of VGAM638 RNA, herein designated VGAM RNA, also designated SEQ ID:3349.

Another function of VGAM638 is therefore inhibition of LOC157918 (Accession XM_098842). Accordingly, utilities of VGAM638 include diagnosis, prevention and treatment of diseases and clinical conditions associated with LOC157918. LOC157919 (Accession XM_088420) is another VGAM638 host target gene. LOC157919 BINDING SITE is HOST TARGET binding site found in the 5' untranslated region of mRNA encoded by LOC157919, corresponding to a HOST TARGET binding site such as BINDING SITE I, BINDING SITE II or BINDING SITE III. Table 2 illustrates the complementarity of the nucleotide sequences of LOC157919 BINDING SITE, designated SEQ ID:39681, to the nucleotide sequence of VGAM638 RNA, herein designated VGAM RNA, also designated SEQ ID:3349.

Another function of VGAM638 is therefore inhibition of LOC157919 (Accession XM_088420). Accordingly, utilities of VGAM638 include diagnosis, prevention and treatment of diseases and clinical conditions associated with LOC157919. LOC201562 (Accession XM_114343) is another VGAM638 host target gene. LOC201562 BINDING SITE is HOST TARGET binding site found in the 3' untranslated region of mRNA encoded by LOC201562, corresponding to a HOST TARGET binding site such as BINDING SITE I, BINDING SITE II or BINDING SITE III. Table 2 illustrates the complementarity of the nucleotide sequences of LOC201562 BINDING SITE, designated SEQ ID:42884, to the nucleotide sequence of VGAM638 RNA, herein designated VGAM RNA, also designated SEQ ID:3349.

Another function of VGAM638 is therefore inhibition of LOC201562 (Accession XM_114343). Accordingly, utilities of VGAM638 include diagnosis, prevention and treatment of diseases and clinical conditions associated with LOC201562. LOC257106 (Accession XM_170910) is another VGAM638 host target gene. LOC257106 BINDING SITE is HOST TARGET binding site found in the 3' untranslated region of mRNA encoded by LOC257106, corresponding to a HOST TARGET binding site such as BINDING SITE I, BINDING SITE II or BINDING SITE III. Table 2 illustrates the complementarity of the nucleotide sequences of LOC257106 BINDING SITE, designated SEQ ID:45676, to the nucleotide sequence of VGAM638 RNA, herein designated VGAM RNA, also designated SEQ ID:3349.

Another function of VGAM638 is therefore inhibition of LOC257106 (Accession XM_170910). Accordingly, utilities of VGAM638 include diagnosis, prevention and treatment of diseases and clinical conditions associated with LOC257106. LOC92689 (Accession XM_046663) is another VGAM638 host target gene. LOC92689 BINDING SITE is HOST TARGET binding site found in the 3' untranslated region of mRNA encoded by LOC92689, corresponding to a HOST TARGET binding site such as BINDING SITE I, BINDING SITE II or BINDING SITE III. Table 2 illustrates the complementarity of the nucleotide sequences of LOC92689 BINDING SITE, designated SEQ ID:34783, to the nucleotide sequence of VGAM638 RNA, herein designated VGAM RNA, also designated SEQ ID:3349.

Another function of VGAM638 is therefore inhibition of LOC92689 (Accession XM_046663). Accordingly, utilities of VGAM638 include diagnosis, prevention and treatment of diseases and clinical conditions associated with LOC92689. FIG. 1 further provides a conceptual description of a novel bioinformatically detected viral gene of the present invention, referred to here as Viral Genomic Address Messenger 639 (VGAM639) viral gene, which modulates expression of respective host target genes thereof, the function and utility of which host target genes is known in the art.

VGAM639 is a novel bioinformatically detected regulatory, non protein coding, viral micro RNA (miRNA) gene. The method by which VGAM639 was detected is described hereinabove with reference to FIGS. 1-8.

VGAM639 gene, herein designated VGAM GENE, is a viral gene contained in the genome of Turnip Mosaic Virus. VGAM639 host target gene, herein designated VGAM HOST TARGET GENE, is a human gene contained in the human genome.

VGAM639 gene encodes a VGAM639 precursor RNA, herein designated VGAM PRECURSOR RNA. Similar to other miRNA genes, and unlike most ordinary genes, VGAM639 precursor RNA does not encode a protein. A nucleotide sequence identical or highly similar to the nucleotide sequence of VGAM639 precursor RNA is designated SEQ ID:625, and is provided hereinbelow with reference to the sequence listing part. Nucleotide sequence SEQ ID:625 is located at position 5030 relative to the genome of Turnip Mosaic Virus.

VGAM639 precursor RNA folds onto itself, forming VGAM639 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM639 folded precursor RNA into VGAM639 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM639 RNA is designated SEQ ID:3350, and is provided hereinbelow with reference to the sequence listing part.

VGAM639 host target gene, herein designated VGAM HOST TARGET GENE, encodes a corresponding messenger RNA, VGAM639 host target RNA, herein designated VGAM HOST TARGET RNA. VGAM639 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM639 RNA, herein designated VGAM RNA, binds complementarily to one or more host target binding sites located in untranslated regions of VGAM639 host target RNA, herein designated VGAM HOST TARGET RNA. This complementary binding is due to the fact that the nucleotide sequence of VGAM639 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM639 RNA, herein designated VGAM RNA, may have a different number of host target binding sites in untranslated regions of a VGAM639 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM639 RNA, herein designated VGAM RNA, to host target binding sites on VGAM639 host target RNA, herein designated VGAM HOST TARGET RNA, such as BINDING SITE I, BINDING SITE II and BINDING SITE III, inhibits translation of VGAM639 host target RNA into VGAM639 host target protein, herein designated VGAM HOST TARGET PROTEIN. VGAM host target protein is therefore outlined by a broken line.

It is appreciated that VGAM639 host target gene, herein designated VGAM HOST TARGET GENE, in fact represents a plurality of VGAM639 host target genes. The mRNA of each one of this plurality of VGAM639 host target genes comprises one or more host target binding sites, each having a nucleotide sequence which is at least partly complementary to VGAM639 RNA, herein designated VGAM RNA, and which when bound by VGAM639 RNA causes inhibition of translation of respective one or more VGAM639 host target proteins.

It is further appreciated by one skilled in the art that the mode of translational inhibition illustrated by FIG. 1 with specific reference to translational inhibition exerted by VGAM639 gene, herein designated VGAM GENE, on one or more VGAM639 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM639 is inhibition of expression of host target genes, as part of a novel viral mechanism of attacking a host. Accordingly, utilities of VGAM639 include diagnosis, prevention and treatment of viral infection by Turnip Mosaic Virus. Specific functions, and accordingly utilities, of VGAM639 correlate with, and may be deduced from, the identity of the host target genes which VGAM639 binds and inhibits, and the function of these host target genes, as elaborated hereinbelow.

Nucleotide sequences of the VGAM639 precursor RNA, herein designated VGAM PRECURSOR RNA, and of the 'diced' VGAM639 RNA, herein designated VGAM RNA, and a schematic representation of the secondary folding of VGAM639 folded precursor RNA, herein designated VGAM FOLDED PRECURSOR RNA, of VGAM639 are further described hereinbelow with reference to Table 1.

Nucleotide sequences of host target binding sites, such as BINDING SITE-I, BINDING SITE-II and BINDING SITE-III of FIG. 1, found on VGAM639 host target RNA, and schematic representation of the complementarity of each of these host target binding sites to VGAM639 RNA, herein designated VGAM RNA, are described hereinbelow with reference to Table 2.

As mentioned hereinabove with reference to FIG. 1, a function of VGAM639 gene, herein designated VGAM is inhibition of expression of VGAM639 target genes. It is appreciated that specific functions, and accordingly utilities, of VGAM639 correlate with, and may be deduced from, the identity of the target genes which VGAM639 binds and inhibits, and the function of these target genes, as elaborated hereinbelow.

GLI-Kruppel Family Member GLI2 (GLI2, Accession NM_030379) is a VGAM639 host target gene. GLI2 BINDING SITE is HOST TARGET binding site found in the 5' untranslated region of mRNA encoded by GLI2, corresponding to a HOST TARGET binding site such as BINDING SITE I, BINDING SITE II or BINDING SITE III. Table 2 illustrates the complementarity of the nucleotide sequences of GLI2 BINDING SITE, designated SEQ ID:24938, to the nucleotide sequence of VGAM639 RNA, herein designated VGAM RNA, also designated SEQ ID:3350.

A function of VGAM639 is therefore inhibition of GLI-Kruppel Family Member GLI2 (GLI2, Accession NM_030379), a gene which may promote tax-dependent transcription of T-cell leukemia virus type 1 genes. Accordingly, utilities of VGAM639 include diagnosis, prevention and treatment of diseases and clinical conditions associated with GLI2. The function of GLI2 and its association with various diseases and clinical conditions, has been established by previous studies, as described hereinabove with reference to VGAM465. Chromosome 11 Open Reading Frame 23 (C11orf23, Accession NM_018312) is another VGAM639 host target gene. C11orf23 BINDING SITE is HOST TARGET binding site found in the 3' untranslated region of mRNA encoded by C11orf23, corresponding to a HOST TARGET binding site such as BINDING SITE I, BINDING SITE II or BINDING SITE III. Table 2 illustrates the complementarity of the nucleotide sequences of C11orf23 BINDING SITE, designated SEQ ID:20303, to the nucleotide sequence of VGAM639 RNA, herein designated VGAM RNA, also designated SEQ ID:3350.

Another function of VGAM639 is therefore inhibition of Chromosome 11 Open Reading Frame 23 (C11orf23, Accession NM_018312). Accordingly, utilities of VGAM639 include diagnosis, prevention and treatment of diseases and clinical conditions associated with C11orf23. ECE2 (Accession NM_014693) is another VGAM639 host target gene. ECE2 BINDING SITE is HOST TARGET binding site found in the 3' untranslated region of mRNA encoded by ECE2, corresponding to a HOST TARGET binding site such as BINDING SITE I, BINDING SITE II or BINDING SITE III. Table 2 illustrates the complementarity of the nucleotide sequences of ECE2 BINDING SITE, designated SEQ ID:16198, to the nucleotide sequence of VGAM639 RNA, herein designated VGAM RNA, also designated SEQ ID:3350.

Another function of VGAM639 is therefore inhibition of ECE2 (Accession NM_014693). Accordingly, utilities of VGAM639 include diagnosis, prevention and treatment of diseases and clinical conditions associated with ECE2. FLJ10901 (Accession NM_018265) is another VGAM639 host target gene. FLJ10901 BINDING SITE is HOST TARGET binding site found in the 3' untranslated region of mRNA encoded by FLJ10901, corresponding to a HOST TARGET binding site such as BINDING SITE I, BINDING SITE II or BINDING SITE III. Table 2 illustrates the complementarity of the nucleotide sequences of FLJ10901 BINDING SITE, designated SEQ ID:20230, to the nucleotide sequence of VGAM639 RNA, herein designated VGAM RNA, also designated SEQ ID:3350.

Another function of VGAM639 is therefore inhibition of FLJ10901 (Accession NM_018265). Accordingly, utilities of VGAM639 include diagnosis, prevention and treatment of diseases and clinical conditions associated with FLJ10901. Zinc Finger Protein 317 (ZNF317, Accession XM_050435) is another VGAM639 host target gene. ZNF317 BINDING SITE is HOST TARGET binding site found in the 3' untranslated region of mRNA encoded by ZNF317, corresponding to a HOST TARGET binding site such as BINDING SITE I, BINDING SITE II or BINDING SITE III. Table 2 illustrates the complementarity of the nucleotide sequences of ZNF317 BINDING SITE, designated SEQ ID:35636, to the nucleotide sequence of VGAM639 RNA, herein designated VGAM RNA, also designated SEQ ID:3350.

Another function of VGAM639 is therefore inhibition of Zinc Finger Protein 317 (ZNF317, Accession XM_050435). Accordingly, utilities of VGAM639 include diagnosis, prevention and treatment of diseases and clinical conditions associated with ZNF317. LOC245771 (Accession XM_167366) is another VGAM639 host target gene. LOC245771 BINDING SITE is HOST TARGET binding site found in the 3' untranslated region of mRNA encoded by LOC245771, corresponding to a HOST TARGET binding site such as BINDING SITE I, BINDING SITE II or BINDING SITE III. Table 2 illustrates the complementarity of the nucleotide sequences of LOC245771 BINDING SITE, designated SEQ ID:44635, to the nucleotide sequence of VGAM639 RNA, herein designated VGAM RNA, also designated SEQ ID:3350.

Another function of VGAM639 is therefore inhibition of LOC245771 (Accession XM_167366). Accordingly, utilities of VGAM639 include diagnosis, prevention and treatment of diseases and clinical conditions associated with LOC245771. FIG. 1 further provides a conceptual description of a novel bioinformatically detected viral gene of the present invention, referred to here as Viral Genomic Address Messenger 640 (VGAM640) viral gene, which modulates expression of respective host target genes thereof, the function and utility of which host target genes is known in the art.

VGAM640 is a novel bioinformatically detected regulatory, non protein coding, viral micro RNA (miRNA) gene. The method by which VGAM640 was detected is described hereinabove with reference to FIGS. 1-8.

VGAM640 gene, herein designated VGAM GENE, is a viral gene contained in the genome of Turnip Mosaic Virus. VGAM640 host target gene, herein designated VGAM HOST TARGET GENE, is a human gene contained in the human genome.

VGAM640 gene encodes a VGAM640 precursor RNA, herein designated VGAM PRECURSOR RNA. Similar to other miRNA genes, and unlike most ordinary genes, VGAM640 precursor RNA does not encode a protein. A nucleotide sequence identical or highly similar to the nucleotide sequence of VGAM640 precursor RNA is designated SEQ ID:626, and is provided hereinbelow with reference to the sequence listing part. Nucleotide sequence SEQ ID:626 is located at position 9395 relative to the genome of Turnip Mosaic Virus.

VGAM640 precursor RNA folds onto itself, forming VGAM640 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM640 folded precursor RNA into VGAM640 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM640 RNA is designated SEQ ID:3351, and is provided hereinbelow with reference to the sequence listing part.

VGAM640 host target gene, herein designated VGAM HOST TARGET GENE, encodes a corresponding messenger RNA, VGAM640 host target RNA, herein designated VGAM HOST TARGET RNA. VGAM640 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM640 RNA, herein designated VGAM RNA, binds complementarily to one or more host target binding sites located in untranslated regions of VGAM640 host target RNA, herein designated VGAM HOST TARGET RNA. This complementary binding is due to the fact that the nucleotide sequence of VGAM640 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM640 RNA, herein designated VGAM RNA, may have a different number of host target binding sites in untranslated regions of a VGAM640 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM640 RNA, herein designated VGAM RNA, to host target binding sites on VGAM640 host target RNA, herein designated VGAM HOST TARGET RNA, such as BINDING SITE I, BINDING SITE II and BINDING SITE III, inhibits translation of VGAM640 host target RNA into VGAM640 host target protein, herein designated VGAM HOST TARGET PROTEIN. VGAM host target protein is therefore outlined by a broken line.

It is appreciated that VGAM640 host target gene, herein designated VGAM HOST TARGET GENE, in fact represents a plurality of VGAM640 host target genes. The mRNA of each one of this plurality of VGAM640 host target genes comprises one or more host target binding sites, each having a nucleotide sequence which is at least partly complementary to VGAM640 RNA, herein designated VGAM RNA, and which when bound by VGAM640 RNA causes inhibition of translation of respective one or more VGAM640 host target proteins.

It is further appreciated by one skilled in the art that the mode of translational inhibition illustrated by FIG. 1 with specific reference to translational inhibition exerted by VGAM640 gene, herein designated VGAM GENE, on one or more VGAM640 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM640 is inhibition of expression of host target genes, as part of a novel viral mechanism of attacking a host. Accordingly, utilities of VGAM640 include diagnosis, prevention and treatment of viral infection by Turnip Mosaic Virus. Specific functions, and accordingly utilities, of VGAM640 correlate with, and may be deduced from, the identity of the host target genes which VGAM640 binds and inhibits, and the function of these host target genes, as elaborated hereinbelow.

Nucleotide sequences of the VGAM640 precursor RNA, herein designated VGAM PRECURSOR RNA, and of the 'diced' VGAM640 RNA, herein designated VGAM RNA, and a schematic representation of the secondary folding of VGAM640 folded precursor RNA, herein designated VGAM FOLDED PRECURSOR RNA, of VGAM640 are further described hereinbelow with reference to Table 1.

Nucleotide sequences of host target binding sites, such as BINDING SITE-I, BINDING SITE-II and BINDING SITE-III of FIG. 1, found on VGAM640 host target RNA, and schematic representation of the complementarity of each of these host target binding sites to VGAM640 RNA, herein designated VGAM RNA, are described hereinbelow with reference to Table 2.

As mentioned hereinabove with reference to FIG. 1, a function of VGAM640 gene, herein designated VGAM is inhibition of expression of VGAM640 target genes. It is appreciated that specific functions, and accordingly utilities, of VGAM640 correlate with, and may be deduced from, the identity of the target genes which VGAM640 binds and inhibits, and the function of these target genes, as elaborated hereinbelow.

G Protein-coupled Receptor Kinase 7 (GPRK7, Accession NM_139209) is a VGAM640 host target gene. GPRK7 BINDING SITE is HOST TARGET binding site found in the 3' untranslated region of mRNA encoded by GPRK7, corresponding to a HOST TARGET binding site such as BINDING SITE I, BINDING SITE II or BINDING SITE III. Table 2 illustrates the complementarity of the nucleotide sequences of GPRK7 BINDING SITE, designated SEQ ID:29228, to the nucleotide sequence of VGAM640 RNA, herein designated VGAM RNA, also designated SEQ ID:3351.

A function of VGAM640 is therefore inhibition of G Protein-coupled Receptor Kinase 7 (GPRK7, Accession NM_139209), a gene which may play a role in signal transduction pathways that involve calcium as a second messenger. Accordingly, utilities of VGAM640 include diagnosis, prevention and treatment of diseases and clinical conditions associated with GPRK7. The function of GPRK7 has been established by previous studies. Weiss et al. (2001) cloned GRK7 from a human retina cDNA library using primers designed from the pig GRK7 sequence. GRK7 encodes a deduced 553-amino acid protein with a calculated molecular mass of 62 kD. The protein contains a CaaX motif for isoprenylation and carboxymethylation of the C terminus, an autophosphorylation site at ser491, and a motif for geranylgeranylation. GRK7 shares 85% and 59% amino acid identity with the pig and medaka fish GRK7, respectively, and 47% identity with GRK1 (OMIM Ref. No. 180381). Western blot analysis revealed an apparent molecular mass of 62 kD for purified recombinant human GRK7, and an identical mass in retinal extracts of various mammalian species. Immunolocalization using human retina sections showed staining limited to cone cells, with particularly intense staining in the outer segments. Weiss et al. (2001) noted that GRK1 is expressed in both cones and rods. By database analysis, Chen et al. (2001) independently identified GRK7 and cloned GRK7 from a human retinal cDNA library and from human retinal mRNA by PCR and RT-PCR. RT-PCR revealed retina-specific expression in human tissues. Western blot analysis detected a 64-kD band in human retina, but not in any of the other 11 tissues tested. Immunocytochemistry showed positive staining for GRK7 in the nuclear layers, the inner and outer plexiform layers, and the inner segment layer. GRK7 colocalized with GRK1 in human cone outer segments. In retina from a 4-month-old donor, GRK7 was specifically localized to the proximal portion of the cone outer segments. Western blot analysis of mouse tissues showed more widespread expression, including not only retina but brain, olfactory bulb, lung, and pancreas. In the mouse retina, staining was seen in the inner and outer plexiform layers and in the nucleus of the inner nuclear and ganglion cell layers. Outer segment layers were negative for Grk7.

Full details of the abovementioned studies are described in the following publications, the disclosure of which are hereby incorporated by reference:

Chen, C.-K.; Zhang, K.; Church-Kopish, J.; Huang, W.; Zhang, H.; Chen, Y.-J.; Frederick, J. M.; Baehr, W.: Characterization of human GRK7 as a potential cone opsin kinase. Molec. Vision 7:305-313, 2001; and Weiss, E. R.; Ducceschi, M. H.; Horner, T. J.; Li, A.; Craft, C. M.; Osawa, S.: Species-specific differences in expression of G-protein-coupled receptor kinase (GRK) 7 and GRK1 in mam.

Further studies establishing the function and utilities of GPRK7 are found in John Hopkins OMIM database record ID 606987, and in sited publications numbered 5529-5530 listed in the bibliography section hereinbelow, which are also hereby incorporated by reference. Integrin, Alpha L (antigen CD11A (p180), Lymphocyte Function-associated Antigen 1; Alpha Polypeptide) (ITGAL, Accession NM_002209) is another VGAM640 host target gene. ITGAL BINDING SITE is HOST TARGET binding site found in the 3' untranslated region of mRNA encoded by ITGAL, corresponding to a HOST TARGET binding site such as BINDING SITE I, BINDING SITE II or BINDING SITE III. Table 2 illustrates the complementarity of the nucleotide sequences of ITGAL BINDING SITE, designated SEQ ID:7971, to the nucleotide sequence of VGAM640 RNA, herein designated VGAM RNA, also designated SEQ ID:3351.

Another function of VGAM640 is therefore inhibition of Integrin, Alpha L (antigen CD11A (p180), Lymphocyte Function-associated Antigen 1; Alpha Polypeptide) (ITGAL, Accession NM_002209), a gene which s a receptor for icam1, icam2, icam3 and icam4. it is involved in a variety of immune phenomena including leukocyte-endothelial cell interaction, cytotoxic t-cell mediated killing, and antibody dependent killing by granulocytes and monocytes. Accordingly, utilities of VGAM640 include diagnosis, prevention and treatment of diseases and clinical conditions associated with ITGAL. The function of ITGAL and its association with various diseases and clinical conditions, has been established by previous studies, as described hereinabove with reference to VGAM200. Integrin, Beta 3 (platelet glycoprotein IIIa, antigen CD61) (ITGB3, Accession NM_000212) is another VGAM640 host target gene. ITGB3 BINDING SITE is HOST TARGET binding site found in the 3' untranslated region of mRNA encoded by ITGB3, corresponding to a HOST TARGET binding site such as BINDING SITE I, BINDING SITE II or BINDING SITE III. Table 2 illustrates the complementarity of the nucleotide sequences of ITGB3 BINDING SITE, designated SEQ ID:5707, to the nucleotide sequence of VGAM640 RNA, herein designated VGAM RNA, also designated SEQ ID:3351.

Another function of VGAM640 is therefore inhibition of Integrin, Beta 3 (platelet glycoprotein IIIa, antigen CD61) (ITGB3, Accession NM_000212). Accordingly, utilities of VGAM640 include diagnosis, prevention and treatment of diseases and clinical conditions associated with ITGB3. V-myc Myelocytomatosis Viral Oncogene Homolog 1, Lung Carcinoma Derived (avian) (MYCL1, Accession NM_005376) is another VGAM640 host target gene. MYCL1 BINDING SITE is HOST TARGET binding site found in the 3' untranslated region of mRNA encoded by MYCL1, corresponding to a HOST TARGET binding site such as BINDING SITE I, BINDING SITE II or BINDING SITE III. Table 2 illustrates the complementarity of the nucleotide sequences of MYCL1 BINDING SITE, designated SEQ ID:11853, to the nucleotide sequence of VGAM640 RNA, herein designated VGAM RNA, also designated SEQ ID:3351.

Another function of VGAM640 is therefore inhibition of V-myc Myelocytomatosis Viral Oncogene Homolog 1, Lung Carcinoma Derived (avian) (MYCL1, Accession NM_005376), a gene which is a Myc-like transcription factor. Accordingly, utilities of VGAM640 include diagnosis, prevention and treatment of diseases and clinical conditions associated with MYCL1. The function of MYCL1 has been established by previous studies. Nau et al. (1985) cloned from DNA of small-cell lung cancer (SCCL) a gene with homology to a small region of both MYC (OMIM Ref. No. 190080) and NMYC (OMIM Ref. No. 164840). By somatic cell hybridization and in situ hybridization, they assigned the gene to 1p32. This LMYC sequence was amplified 10- to 20-fold in the DNA of 4 SCCL lines and of 1 SCCL specimen taken directly from a patient. A restriction polymorphism was found. In heterozygotes, only 1 of the 2 alleles was amplified in any 1 genome. In a linkage map of chromosome 1 prepared by Rouleau et al. (1990), it was concluded that MYCL1 is 17 cM proximal to RH. Kaye et al. (1988) found that the LMYC gene is composed of 3 exons and 2 introns spanning 6.6 kilobases. Several distinct mRNAs were produced in all SCCL cell lines that expressed LMYC. These transcripts were generated from a single gene by alternative splicing of introns 1 and 2 and by use of alternative polyadenylation signals. Comparisons with MYC and NMYC demonstrated multiple discrete regions with extensive homology. Kawashima et al. (1988) concluded that a correlation exists between particular RFLP alleles of the MYCL gene and the occurrence of metastasis of lung cancer to lymph nodes and other organs. Among lung cancer patients, those with only the L band (10 kb) had few lymph node metastases, whereas patients with either the S band (6 kb) or the S and L bands almost always had lymph node metastases. A similar correlation was found between the presence of the S band and metastases to other organs. The correlation was particularly marked in cases of adenocarcinoma of the lung. By study of DNA from mouse-hamster somatic cell hybrids, Campbell et al. (1989) mapped 2 L-myc loci provisionally to mouse chromosomes 4 and 12. The locus on chromosome 12 may be a pseudogene. When studying chromosome 1p breakpoints in neuroblastoma cell lines using fluorescence in situ hybridization (FISH) with region-specific probes, Van Roy et al. (1995) found evidence for a position of MYCL1 more distal than 1p32. To investigate the discrepancy Speleman et al. (1996) used FISH on high-resolution R-banded chromosomes with a YAC clone for MYCL1 and reassigned the gene to 1p34.3.

Full details of the abovementioned studies are described in the following publications, the disclosure of which are hereby incorporated by reference:

Kawashima, K.; Shikama, H.; Imoto, K.; Izawa, M.; Naruke, T.; Okabayashi, K.; Nishimura, S.: Close correlation between restriction fragment length polymorphism of the L-MYC gene and metastasis of human lung cancer to the lymph nodes and other organs. Proc. Nat. Acad. Sci. 85:2353-2356, 1988; and Kaye, F.; Battey, J.; Nau, M.; Brooks, B.; Seifter, E.; De Greve, J.; Birrer, M.; Sausville, E.; Minna, J.: Structure and expression of the human L-myc gene reveal a complex pattern of.

Further studies establishing the function and utilities of MYCL1 are found in John Hopkins OMIM database record ID 164850, and in sited publications numbered 173 and 1818-1824 listed in the bibliography section hereinbelow, which are also hereby incorporated by reference. Sirtuin Silent Mating Type Information Regulation 2 Homolog 2 (S. cerevisiae) (SIRT2, Accession NM_030593) is another VGAM640 host target gene. SIRT2 BINDING SITE is HOST TARGET binding site found in the 3' untranslated region of mRNA encoded by SIRT2, corresponding to a HOST TARGET binding site such as BINDING SITE I, BINDING SITE II or BINDING SITE III. Table 2 illustrates the complementarity of the nucleotide sequences of SIRT2 BINDING SITE, designated SEQ ID:24958, to the nucleotide sequence of VGAM640 RNA, herein designated VGAM RNA, also designated SEQ ID:3351.

Another function of VGAM640 is therefore inhibition of Sirtuin Silent Mating Type Information Regulation 2 Homolog 2 (S. cerevisiae) (SIRT2, Accession NM_030593), a gene which might function in telomeric silencing, cell cycle progression and chromosome stability. Accordingly, utilities of VGAM640 include diagnosis, prevention and treatment of diseases and clinical conditions associated with SIRT2. The function of SIRT2 has been established by previous studies. The yeast Sir2 protein (Shore et al., 1984) regulates epigenetic gene silencing and, as a possible antiaging effect, suppresses recombination of rDNA. Studies involving cobB, a bacterial Sir2-like gene, have suggested that Sir2 may encode a pyridine nucleotide transferase. By in silico and PCR-cloning techniques, Frye (1999) obtained cDNA sequences encoding 5 human Sir2-like genes, which they called sirtuin-1 to -5 (SIRT1 to SIRT5). The SIRT1 (OMIM Ref. No. 604479) sequence has the closest homology to the S. cerevisiae Sir2 protein, while SIRT4 (OMIM Ref. No. 604482) and SIRT5 (OMIM Ref. No. 604483) more closely resemble prokaryotic sirtuin sequences. PCR analysis showed that the 5 human sirtuins are widely expressed in fetal and adult tissues. Recombinant human SIRT2 was able to cause radioactivity to be transferred from (32P)NAD to bovine serum albumin (BSA). When a conserved histidine within SIRT2 was converted to tyrosine, the mutant recombinant protein was unable to transfer radioactivity from (32P)NAD to BSA. These results suggested that the sirtuins may function via mono-ADP-ribosylation of proteins. Tanny et al. (1999) showed that the yeast Sir2 protein can transfer labeled phosphate from nicotinamide adenine dinucleotide to itself and histones in vitro. A modified form of Sir2, which results from its automodification activity, was specifically recognized by anti-mono-ADP-ribose antibodies, suggesting that Sir2 is an ADP-ribosyltransferase. Mutation of a phylogenetically invariant histidine (his364 to tyr) in Sir2 abolished both its enzymatic activity in vitro and its silencing functions in vivo. However, the mutant protein was associated with chromatin and other silencing factors in a manner similar to wildtype Sir2. These findings suggested that Sir2 contains an ADP-ribosyltransferase activity that is essential for its silencing function.

Full details of the abovementioned studies are described in the following publications, the disclosure of which are hereby incorporated by reference:

Frye, R. A.: Characterization of five human cDNAs with homology to the yeast SIR2 gene: Sir2-like proteins (sirtuins) metabolize NAD and may have protein ADP-ribosyltransferase activity. Biochem. Biophys. Res. Commun. 260:273-279, 1999; and Tanny, J. C.; Dowd, G. J.; Huang, J.; Hilz, H.; Moazed, D.: An enzymatic activity in the yeast Sir2 protein that is essential for gene silencing. Cell 99:735-745, 1999.

Further studies establishing the function and utilities of SIRT2 are found in John Hopkins OMIM database record ID 604480, and in sited publications numbered 5008, 504 and 5051 listed in the bibliography section hereinbelow, which are also hereby incorporated by reference. Tumor Protein D52-like 2 (TPD52L2, Accession NM_003288) is another VGAM640 host target gene. TPD52L2 BINDING SITE is HOST TARGET binding site found in the 3' untranslated region of mRNA encoded by TPD52L2, corresponding to a HOST TARGET binding site such as BINDING SITE I, BINDING SITE II or BINDING SITE III. Table 2 illustrates the complementarity of the nucleotide sequences of TPD52L2 BINDING SITE, designated SEQ ID:9297, to the nucleotide sequence of VGAM640 RNA, herein designated VGAM RNA, also designated SEQ ID:3351.

Another function of VGAM640 is therefore inhibition of Tumor Protein D52-like 2 (TPD52L2, Accession NM_003288). Accordingly, utilities of VGAM640 include diagnosis, prevention and treatment of diseases and clinical conditions associated with TPD52L2. Zinc Finger Protein 261 (ZNF261, Accession NM_005096) is another VGAM640 host target gene. ZNF261 BINDING SITE is HOST TARGET binding site found in the 3' untranslated region of mRNA encoded by ZNF261, corresponding to a HOST TARGET binding site such as BINDING SITE I, BINDING SITE II or BINDING SITE III. Table 2 illustrates the complementarity of the nucleotide sequences of ZNF261 BINDING SITE, designated SEQ ID:11563, to the nucleotide sequence of VGAM640 RNA, herein designated VGAM RNA, also designated SEQ ID:3351.

Another function of VGAM640 is therefore inhibition of Zinc Finger Protein 261 (ZNF261, Accession NM_005096). Accordingly, utilities of VGAM640 include diagnosis, prevention and treatment of diseases and clinical conditions associated with ZNF261. Chromosome 20 Open Reading Frame 103 (C20orf103, Accession NM_012261) is another VGAM640 host target gene. C20orf103 BINDING SITE is HOST TARGET binding site found in the 5' untranslated region of mRNA encoded by C20orf103, corresponding to a HOST TARGET binding site such as BINDING SITE I, BINDING SITE II or BINDING SITE III. Table 2 illustrates the complementarity of the nucleotide sequences of C20orf103 BINDING SITE, designated SEQ ID:14570, to the nucleotide sequence of VGAM640 RNA, herein designated VGAM RNA, also designated SEQ ID:3351.

Another function of VGAM640 is therefore inhibition of Chromosome 20 Open Reading Frame 103 (C20orf103, Accession NM_012261). Accordingly, utilities of VGAM640 include diagnosis, prevention and treatment of diseases and clinical conditions associated with C20orf103. MGC5242 (Accession NM_024033) is another VGAM640 host target gene. MGC5242 BINDING SITE is HOST TARGET binding site found in the 3' untranslated region of mRNA encoded by MGC5242, corresponding to a HOST TARGET binding site such as BINDING SITE I, BINDING SITE II or BINDING SITE III. Table 2 illustrates the complementarity of the nucleotide sequences of MGC5242 BINDING SITE, designated SEQ ID:23464, to the nucleotide sequence of VGAM640 RNA, herein designated VGAM RNA, also designated SEQ ID:3351.

Another function of VGAM640 is therefore inhibition of MGC5242 (Accession NM_024033). Accordingly, utilities of VGAM640 include diagnosis, prevention and treatment of diseases and clinical conditions associated with MGC5242. Sema Domain, Immunoglobulin Domain (Ig), Short Basic Domain, Secreted, (semaphorin) 3E (SEMA3E, Accession NM_012431) is another VGAM640 host target gene. SEMA3E BINDING SITE is HOST TARGET binding site found in the 5' untranslated region of mRNA encoded by SEMA3E, corresponding to a HOST TARGET binding site such as BINDING SITE I, BINDING SITE II or BINDING SITE III. Table 2 illustrates the complementarity of the nucleotide sequences of SEMA3E BINDING SITE, designated SEQ ID:14809, to the nucleotide sequence of VGAM640 RNA, herein designated VGAM RNA, also designated SEQ ID:3351.

Another function of VGAM640 is therefore inhibition of Sema Domain, Immunoglobulin Domain (Ig), Short Basic Domain, Secreted, (semaphorin) 3E (SEMA3E, Accession NM_012431). Accordingly, utilities of VGAM640 include diagnosis, prevention and treatment of diseases and clinical conditions associated with SEMA3E. LOC112817 (Accession NM_138413) is another VGAM640 host target gene. LOC112817 BINDING SITE is HOST TARGET binding site found in the 5' untranslated region of mRNA encoded by LOC112817, corresponding to a HOST TARGET binding site such as BINDING SITE I, BINDING SITE II or BINDING SITE III. Table 2 illustrates the complementarity of the nucleotide sequences of LOC112817 BINDING SITE, designated SEQ ID:28781, to the nucleotide sequence of VGAM640 RNA, herein designated VGAM RNA, also designated SEQ ID:3351.

Another function of VGAM640 is therefore inhibition of LOC112817 (Accession NM_138413). Accordingly, utilities of VGAM640 include diagnosis, prevention and treatment of diseases and clinical conditions associated with LOC112817. LOC147353 (Accession XM_097227) is another VGAM640 host target gene. LOC147353 BINDING SITE is HOST TARGET binding site found in the 3' untranslated region of mRNA encoded by LOC147353, corresponding to a HOST TARGET binding site such as BINDING SITE I, BINDING SITE II or BINDING SITE III. Table 2 illustrates the complementarity of the nucleotide sequences of LOC147353 BINDING SITE, designated SEQ ID:40834, to the nucleotide sequence of VGAM640 RNA, herein designated VGAM RNA, also designated SEQ ID:3351.

Another function of VGAM640 is therefore inhibition of LOC147353 (Accession XM_097227). Accordingly, utilities of VGAM640 include diagnosis, prevention and treatment of diseases and clinical conditions associated with LOC147353. LOC63923 (Accession XM_040527) is another VGAM640 host target gene. LOC63923 BINDING SITE is HOST TARGET binding site found in the 3' untranslated region of mRNA encoded by LOC63923, corresponding to a HOST TARGET binding site such as BINDING SITE I, BINDING SITE II or BINDING SITE III. Table 2 illustrates the complementarity of the nucleotide sequences of LOC63923 BINDING SITE, designated SEQ ID:33325, to the nucleotide sequence of VGAM640 RNA, herein designated VGAM RNA, also designated SEQ ID:3351.

Another function of VGAM640 is therefore inhibition of LOC63923 (Accession XM_040527). Accordingly, utilities of VGAM640 include diagnosis, prevention and treatment of diseases and clinical conditions associated with LOC63923. LOC91301 (Accession XM_037564) is another VGAM640 host target gene. LOC91301 BINDING SITE is HOST TARGET binding site found in the 5' untranslated region of mRNA encoded by LOC91301, corresponding to a HOST TARGET binding site such as BINDING SITE I, BINDING SITE II or BINDING SITE III. Table 2 illustrates the complementarity of the nucleotide sequences of LOC91301 BINDING SITE, designated SEQ ID:32647, to the nucleotide sequence of VGAM640 RNA, herein designated VGAM RNA, also designated SEQ ID:3351.

Another function of VGAM640 is therefore inhibition of LOC91301 (Accession XM_037564). Accordingly, utilities of VGAM640 include diagnosis, prevention and treatment of diseases and clinical conditions associated with LOC91301. FIG. 1 further provides a conceptual description of a novel bioinformatically detected viral gene of the present invention, referred to here as Viral Genomic Address Messenger 641 (VGAM641) viral gene, which modulates expression of respective host target genes thereof, the function and utility of which host target genes is known in the art.

VGAM641 is a novel bioinformatically detected regulatory, non protein coding, viral micro RNA (miRNA) gene. The method by which VGAM641 was detected is described hereinabove with reference to FIGS. 1-8.

VGAM641 gene, herein designated VGAM GENE, is a viral gene contained in the genome of Rat Cytomegalovirus. VGAM641 host target gene, herein designated VGAM HOST TARGET GENE, is a human gene contained in the human genome.

VGAM641 gene encodes a VGAM641 precursor RNA, herein designated VGAM PRECURSOR RNA. Similar to other miRNA genes, and unlike most ordinary genes, VGAM641 precursor RNA does not encode a protein. A nucleotide sequence identical or highly similar to the nucleotide sequence of VGAM641 precursor RNA is designated SEQ ID:627, and is provided hereinbelow with reference to the sequence listing part. Nucleotide sequence SEQ ID:627 is located at position 50326 relative to the genome of Rat Cytomegalovirus.

VGAM641 precursor RNA folds onto itself, forming VGAM641 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM641 folded precursor RNA into VGAM641 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM641 RNA is designated SEQ ID:3352, and is provided hereinbelow with reference to the sequence listing part.

VGAM641 host target gene, herein designated VGAM HOST TARGET GENE, encodes a corresponding messenger RNA, VGAM641 host target RNA, herein designated VGAM HOST TARGET RNA. VGAM641 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM641 RNA, herein designated VGAM RNA, binds complementarily to one or more host target binding sites located in untranslated regions of VGAM641 host target RNA, herein designated VGAM HOST TARGET RNA. This complementary binding is due to the fact that the nucleotide sequence of VGAM641 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM641 RNA, herein designated VGAM RNA, may have a different number of host target binding sites in untranslated regions of a VGAM641 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM641 RNA, herein designated VGAM RNA, to host target binding sites on VGAM641 host target RNA, herein designated VGAM HOST TARGET RNA, such as BINDING SITE I, BINDING SITE II and BINDING SITE III, inhibits translation of VGAM641 host target RNA into VGAM641 host target protein, herein designated VGAM HOST TARGET PROTEIN. VGAM host target protein is therefore outlined by a broken line.

It is appreciated that VGAM641 host target gene, herein designated VGAM HOST TARGET GENE, in fact represents a plurality of VGAM641 host target genes. The mRNA of each one of this plurality of VGAM641 host target genes comprises one or more host target binding sites, each having a nucleotide sequence which is at least partly complementary to VGAM641 RNA, herein designated VGAM RNA, and which when bound by VGAM641 RNA causes inhibition of translation of respective one or more VGAM641 host target proteins.

It is further appreciated by one skilled in the art that the mode of translational inhibition illustrated by FIG. 1 with specific reference to translational inhibition exerted by VGAM641 gene, herein designated VGAM GENE, on one or more VGAM641 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM641 is inhibition of expression of host target genes, as part of a novel viral mechanism of attacking a host. Accordingly, utilities of VGAM641 include diagnosis, prevention and treatment of viral infection by Rat Cytomegalovirus. Specific functions, and accordingly utilities, of VGAM641 correlate with, and may be deduced from, the identity of the host target genes which VGAM641 binds and inhibits, and the function of these host target genes, as elaborated hereinbelow.

Nucleotide sequences of the VGAM641 precursor RNA, herein designated VGAM PRECURSOR RNA, and of the 'diced' VGAM641 RNA, herein designated VGAM RNA, and a schematic representation of the secondary folding of VGAM641 folded precursor RNA, herein designated VGAM FOLDED PRECURSOR RNA, of VGAM641 are further described hereinbelow with reference to Table 1.

Nucleotide sequences of host target binding sites, such as BINDING SITE-I, BINDING SITE-II and BINDING SITE-III of FIG. 1, found on VGAM641 host target RNA, and schematic representation of the complementarity of each of these host target binding sites to VGAM641 RNA, herein designated VGAM RNA, are described hereinbelow with reference to Table 2.

As mentioned hereinabove with reference to FIG. 1, a function of VGAM641 gene, herein designated VGAM is inhibition of expression of VGAM641 target genes. It is appreciated that specific functions, and accordingly utilities, of VGAM641 correlate with, and may be deduced from, the identity of the target genes which VGAM641 binds and inhibits, and the function of these target genes, as elaborated hereinbelow.

Polycystic Kidney Disease (polycystin) and REJ (sperm receptor for egg jelly homolog, sea urchin)-like (PKDREJ, Accession NM_006071) is a VGAM641 host target gene. PKDREJ BINDING SITE is HOST TARGET binding site found in the 3" untranslated region of mRNA encoded by PKDREJ, corresponding to a HOST TARGET binding site such as BINDING SITE I, BINDING SITE II or BINDING SITE III. Table 2 illustrates the complementarity of the nucleotide sequences of PKDREJ BINDING SITE, designated SEQ ID:12714, to the nucleotide sequence of VGAM641 RNA, herein designated VGAM RNA, also designated SEQ ID:3352.

A function of VGAM641 is therefore inhibition of Polycystic Kidney Disease (polycystin) and REJ (sperm receptor for egg jelly homolog, sea urchin)-like (PKDREJ, Accession NM_006071), a gene which may intervene in fertilization. Accordingly, utilities of VGAM641 include diagnosis, prevention and treatment of diseases and clinical conditions associated with PKDREJ. The function of PKDREJ has been established by previous studies. By searching cDNA and genomic databases for sequences similar to PKD1 (OMIM Ref. No. 601313), PKD2 (OMIM Ref. No. 173910), and the sea urchin sperm receptor for egg jelly (suREJ), Hughes et al. (1999) identified an intronless gene, which they designated PKDREJ, on cosmids located on chromosome 22q13. By screening a testis cDNA library, the authors obtained a PKDREJ cDNA encoding a deduced 2,253-amino acid protein. The PKDREJ protein is 64% identical and 78% similar to the mouse Pkdrej protein. Hydrophobicity analysis indicated that the structure of PKDREJ, with 11 transmembrane regions, is similar to that of PKD1. Northern blot analysis showed expression of an approximately 8-kb PKDREJ transcript exclusively in testis, coincident with the timing of sperm maturation. By radiation hybrid analysis, Veldhuisen et al. (1999) mapped the PKDREJ gene to chromosome 22q13.3.

Full details of the abovementioned studies are described in the following publications, the disclosure of which are hereby incorporated by reference:

Hughes, J.; Ward, C. J.; Aspinwall, R.; Butler, R.; Harris, P. C.: Identification of a human homologue of the sea urchin receptor for egg jelly: a polycystic kidney disease-like protein. Hum. Molec. Genet. 8:543-549, 1999; and Veldhuisen, B.; Spruit, L.; Dauwerse, H. G.; Breuning, M. H.; Peters, D. J.: Genes homologous to the autosomal dominant polycystic kidney disease genes (PKD1 and PKD2). Europ. J. Hum.

Further studies establishing the function and utilities of PKDREJ are found in John Hopkins OMIM database record ID 604670, and in sited publications numbered 7483 listed in the bibliography section hereinbelow, which are also hereby incorporated by reference. Chloride Intracellular Channel 5 (CLIC5, Accession NM_016929) is another VGAM641 host target gene. CLIC5 BINDING SITE is HOST TARGET binding site found in the 5' untranslated region of mRNA encoded by CLIC5, corresponding to a HOST TARGET binding site such as BINDING SITE I, BINDING SITE II or BINDING SITE III. Table 2 illustrates the complementarity of the nucleotide sequences of CLIC5 BINDING SITE, designated SEQ ID:18847, to the nucleotide sequence of VGAM641 RNA, herein designated VGAM RNA, also designated SEQ ID:3352.

Another function of VGAM641 is therefore inhibition of Chloride Intracellular Channel 5 (CLIC5, Accession NM_016929). Accordingly, utilities of VGAM641 include diagnosis, prevention and treatment of diseases and clinical conditions associated with CLIC5. FLJ23360 (Accession NM_023076) is another VGAM641 host target gene. FLJ23360 BINDING SITE is HOST TARGET binding site found in the 5' untranslated region of mRNA encoded by FLJ23360, corresponding to a HOST TARGET binding site such as BINDING SITE I, BINDING SITE II or BINDING SITE III. Table 2 illustrates the complementarity of the nucleotide sequences of FLJ23360 BINDING SITE, designated SEQ ID:23334, to the nucleotide sequence of VGAM641 RNA, herein designated VGAM RNA, also designated SEQ ID:3352.

Another function of VGAM641 is therefore inhibition of FLJ23360 (Accession NM_023076). Accordingly, utilities of VGAM641 include diagnosis, prevention and treatment of diseases and clinical conditions associated with FLJ23360. RTP801 (Accession NM_019058) is another VGAM641 host target gene. RTP801 BINDING SITE is HOST TARGET binding site found in the 5' untranslated region of mRNA encoded by RTP801, corresponding to a HOST TARGET binding site such as BINDING SITE I, BINDING SITE II or BINDING SITE III. Table 2 illustrates the complementarity of the nucleotide sequences of RTP801 BINDING SITE, designated SEQ ID:21141, to the nucleotide sequence of VGAM641 RNA, herein designated VGAM RNA, also designated SEQ ID:3352.

Another function of VGAM641 is therefore inhibition of RTP801 (Accession NM_019058). Accordingly, utilities of VGAM641 include diagnosis, prevention and treatment of diseases and clinical conditions associated with RTP801. FIG. 1 further provides a conceptual description of a novel bioinformatically detected viral gene of the present invention, referred to here as Viral Genomic Address Messenger 642 (VGAM642) viral gene, which modulates expression of respective host target genes thereof, the function and utility of which host target genes is known in the art.

VGAM642 is a novel bioinformatically detected regulatory, non protein coding, viral micro RNA (miRNA) gene. The method by which VGAM642 was detected is described hereinabove with reference to FIGS. 1-8.

VGAM642 gene, herein designated VGAM GENE, is a viral gene contained in the genome of Rat Cytomegalovirus. VGAM642 host target gene, herein designated VGAM HOST TARGET GENE, is a human gene contained in the human genome.

VGAM642 gene encodes a VGAM642 precursor RNA, herein designated VGAM PRECURSOR RNA. Similar to other miRNA genes, and unlike most ordinary genes, VGAM642 precursor RNA does not encode a protein. A nucleotide sequence identical or highly similar to the nucleotide sequence of VGAM642 precursor RNA is designated SEQ ID:628, and is provided hereinbelow with reference to the sequence listing part. Nucleotide sequence SEQ ID:628 is located at position 96235 relative to the genome of Rat Cytomegalovirus.

VGAM642 precursor RNA folds onto itself, forming VGAM642 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM642 folded precursor RNA into VGAM642 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM642 RNA is designated SEQ ID:3353, and is provided hereinbelow with reference to the sequence listing part.

VGAM642 host target gene, herein designated VGAM HOST TARGET GENE, encodes a corresponding messenger RNA, VGAM642 host target RNA, herein designated VGAM HOST TARGET RNA. VGAM642 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM642 RNA, herein designated VGAM RNA, binds complementarily to one or more host target binding sites located in untranslated regions of VGAM642 host target RNA, herein designated VGAM HOST TARGET RNA. This complementary binding is due to the fact that the nucleotide sequence of VGAM642 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM642 RNA, herein designated VGAM RNA, may have a different number of host target binding sites in untranslated regions of a VGAM642 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM642 RNA, herein designated VGAM RNA, to host target binding sites on VGAM642 host target RNA, herein designated VGAM HOST TARGET RNA, such as BINDING SITE I, BINDING SITE II and BINDING SITE III, inhibits translation of VGAM642 host target RNA into VGAM642 host target protein, herein designated VGAM HOST TARGET PROTEIN. VGAM host target protein is therefore outlined by a broken line.

It is appreciated that VGAM642 host target gene, herein designated VGAM HOST TARGET GENE, in fact represents a plurality of VGAM642 host target genes. The mRNA of each one of this plurality of VGAM642 host target genes comprises one or more host target binding sites, each having a nucleotide sequence which is at least partly complementary to VGAM642 RNA, herein designated VGAM RNA, and which when bound by VGAM642 RNA causes inhibition of translation of respective one or more VGAM642 host target proteins.

It is further appreciated by one skilled in the art that the mode of translational inhibition illustrated by FIG. 1 with specific reference to translational inhibition exerted by VGAM642 gene, herein designated VGAM GENE, on one or more VGAM642 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM642 is inhibition of expression of host target genes, as part of a novel viral mechanism of attacking a host. Accordingly, utilities of VGAM642 include diagnosis, prevention and treatment of viral infection by Rat Cytomegalovirus. Specific functions, and accordingly utilities, of VGAM642 correlate with, and may be deduced from, the identity of the host target genes which VGAM642 binds and inhibits, and the function of these target genes, as elaborated hereinbelow.

Nucleotide sequences of the VGAM642 precursor RNA, herein designated VGAM PRECURSOR RNA, and of the 'diced' VGAM642 RNA, herein designated VGAM RNA, and a schematic representation of the secondary folding of VGAM642 folded precursor RNA, herein designated VGAM FOLDED PRECURSOR RNA, of VGAM642 are further described hereinbelow with reference to Table 1.

Nucleotide sequences of host target binding sites, such as BINDING SITE-I, BINDING SITE-II and BINDING SITE-III of FIG. 1, found on VGAM642 host target RNA, and schematic representation of the complementarity of each of these host target binding sites to VGAM642 RNA, herein designated VGAM RNA, are described hereinbelow with reference to Table 2.

As mentioned hereinabove with reference to FIG. 1, a function of VGAM642 gene, herein designated VGAM is inhibition of expression of VGAM642 target genes. It is appreciated that specific functions, and accordingly utilities, of VGAM642 correlate with, and may be deduced from, the identity of the target genes which VGAM642 binds and inhibits, and the function of these target genes, as elaborated hereinbelow.

ATPase, Cu++ Transporting, Beta Polypeptide (Wilson disease) (ATP7B, Accession NM_000053) is a VGAM642 host target gene. ATP7B BINDING SITE is HOST TARGET binding site found in the 3' untranslated region of mRNA encoded by ATP7B, corresponding to a HOST TARGET binding site such as BINDING SITE I, BINDING SITE II or BINDING SITE III. Table 2 illustrates the complementarity of the nucleotide sequences of ATP7B BINDING SITE, designated SEQ ID:5502, to the nucleotide sequence of VGAM642 RNA, herein designated VGAM RNA, also designated SEQ ID:3353.

A function of VGAM642 is therefore inhibition of ATPase, Cu++ Transporting, Beta Polypeptide (Wilson disease) (ATP7B, Accession NM_000053). Accordingly, utilities of VGAM642 include diagnosis, prevention and treatment of diseases and clinical conditions associated with ATP7B. Beta-1,3-glucuronyltransferase 1 (glucuronosyltransferase P) (B3GAT1, Accession NM_018644) is another VGAM642 host target gene. B3GAT1 BINDING SITE1 and B3GAT1 BINDING SITE2 are HOST TARGET binding sites found in untranslated regions of mRNA encoded by B3GAT1, corresponding to HOST TARGET binding sites such as BINDING SITE I, BINDING SITE II or BINDING SITE III. Table 2 illustrates the complementarity of the nucleotide sequences of B3GAT1 BINDING SITE1 and B3GAT1 BINDING SITE2, designated SEQ ID:20718 and SEQ ID:27630 respectively, to the nucleotide sequence of VGAM642 RNA, herein designated VGAM RNA, also designated SEQ ID:3353.

Another function of VGAM642 is therefore inhibition of Beta-1,3-glucuronyltransferase 1 (glucuronosyltransferase P) (B3GAT1, Accession NM_018644). Accordingly, utilities of VGAM642 include diagnosis, prevention and treatment of diseases and clinical conditions associated with B3GAT1. EGF-like-domain, Multiple 3 (EGFL3, Accession XM_031401) is another VGAM642 host target gene. EGFL3 BINDING SITE is HOST TARGET binding site found in the 3' untranslated region of mRNA encoded by EGFL3, corresponding to a HOST TARGET binding site such as BINDING SITE I, BINDING SITE II or BINDING SITE III. Table 2 illustrates the complementarity of the nucleotide sequences of EGFL3 BINDING SITE, designated SEQ ID:31373, to the nucleotide sequence of VGAM642 RNA, herein designated VGAM RNA, also designated SEQ ID:3353.

Another function of VGAM642 is therefore inhibition of EGF-like-domain, Multiple 3 (EGFL3, Accession XM_031401). Accordingly, utilities of VGAM642 include diagnosis, prevention and treatment of diseases and clinical conditions associated with EGFL3. KIAA0513 (Accession NM_014732) is another VGAM642 host target gene. KIAA0513 BINDING SITE is HOST TARGET binding site found in the 5' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16355, to the nucleotide sequence of VGAM642 RNA, herein designated VGAM RNA, also designated SEQ ID:3353.

Another function of VGAM642 is therefore inhibition of KIAA0513 (Accession NM_014732). Accordingly, utilities of VGAM642 include diagnosis, prevention and treatment of diseases and clinical conditions associated with KIAA0513. LOC149478 (Accession XM_086536) is another VGAM642 host target gene. LOC149478 BINDING SITE is HOST TARGET binding site found in the 5' untranslated region of mRNA encoded by LOC149478, corresponding to a HOST TARGET binding site such as BINDING SITE I, BINDING SITE II or BINDING SITE III. Table 2 illustrates the complementarity of the nucleotide sequences of LOC149478 BINDING SITE, designated SEQ ID:38754, to the nucleotide sequence of VGAM642 RNA, herein designated VGAM RNA, also designated SEQ ID:3353.

Another function of VGAM642 is therefore inhibition of LOC149478 (Accession XM_086536). Accordingly, utilities of VGAM642 include diagnosis, prevention and treatment of diseases and clinical conditions associated with LOC149478. LOC203378 (Accession XM_117541) is another VGAM642 host target gene. LOC203378 BINDING SITE is HOST TARGET binding site found in the 5' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43554, to the nucleotide sequence of VGAM642 RNA, herein designated VGAM RNA, also designated SEQ ID:3353.

Another function of VGAM642 is therefore inhibition of LOC203378 (Accession XM_117541). Accordingly, utilities of VGAM642 include diagnosis, prevention and treatment of diseases and clinical conditions associated with LOC203378. LOC91179 (Accession XM_036731) is another VGAM642 host target gene. LOC91179 BINDING SITE is HOST TARGET binding site found in the 5' untranslated region of mRNA encoded by LOC91179, corresponding to a HOST TARGET binding site such as BINDING SITE I, BINDING SITE II or BINDING SITE III. Table 2 illustrates the complementarity of the nucleotide sequences of LOC91179 BINDING SITE, designated SEQ ID:32492, to the nucleotide sequence of VGAM642 RNA, herein designated VGAM RNA, also designated SEQ ID:3353.

Another function of VGAM642 is therefore inhibition of LOC91179 (Accession XM_036731). Accordingly, utilities of VGAM642 include diagnosis, prevention and treatment of diseases and clinical conditions associated with LOC91179.

FIG. 1 further provides a conceptual description of a novel bioinformatically detected viral gene of the present invention, referred to here as Viral Genomic Address Messenger 643 (VGAM643) viral gene, which modulates expression of respective host target genes thereof, the function and utility of which host target genes is known in the art.

VGAM643 is a novel bioinformatically detected regulatory, non protein coding, viral micro RNA (miRNA) gene. The method by which VGAM643 was detected is described hereinabove with reference to FIGS. 1-8.

VGAM643 gene, herein designated VGAM GENE, is a viral gene contained in the genome of Rat Cytomegalovirus. VGAM643 host target gene, herein designated VGAM HOST TARGET GENE, is a human gene contained in the human genome.

VGAM643 gene encodes a VGAM643 precursor RNA, herein designated VGAM PRECURSOR RNA. Similar to other miRNA genes, and unlike most ordinary genes, VGAM643 precursor RNA does not encode a protein. A nucleotide sequence identical or highly similar to the nucleotide sequence of VGAM643 precursor RNA is designated SEQ ID:629, and is provided hereinbelow with reference to the sequence listing part. Nucleotide sequence SEQ ID:629 is located at position 112209 relative to the genome of Rat Cytomegalovirus.

VGAM643 precursor RNA folds onto itself, forming VGAM643 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM643 folded precursor RNA into VGAM643 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM643 RNA is designated SEQ ID:3354, and is provided hereinbelow with reference to the sequence listing part.

VGAM643 host target gene, herein designated VGAM HOST TARGET GENE, encodes a corresponding messenger RNA, VGAM643 host target RNA, herein designated VGAM HOST TARGET RNA. VGAM643 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM643 RNA, herein designated VGAM RNA, binds complementarily to one or more host target binding sites located in untranslated regions of VGAM643 host target RNA, herein designated VGAM HOST TARGET RNA. This complementary binding is due to the fact that the nucleotide sequence of VGAM643 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM643 RNA, herein designated VGAM RNA, may have a different number of host target binding sites in untranslated regions of a VGAM643 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM643 RNA, herein designated VGAM RNA, to host target binding sites on VGAM643 host target RNA, herein designated VGAM HOST TARGET RNA, such as BINDING SITE I, BINDING SITE II and BINDING SITE III, inhibits translation of VGAM643 host target RNA into VGAM643 host target protein, herein designated VGAM HOST TARGET PROTEIN. VGAM host target protein is therefore outlined by a broken line.

It is appreciated that VGAM643 host target gene, herein designated VGAM HOST TARGET GENE, in fact represents a plurality of VGAM643 host target genes. The mRNA of each one of this plurality of VGAM643 host target genes comprises one or more host target binding sites, each having a nucleotide sequence which is at least partly complementary to VGAM643 RNA, herein designated VGAM RNA, and which when bound by VGAM643 RNA causes inhibition of translation of respective one or more VGAM643 host target proteins.

It is further appreciated by one skilled in the art that the mode of translational inhibition illustrated by FIG. 1 with specific reference to translational inhibition exerted by VGAM643 gene, herein designated VGAM GENE, on one or more VGAM643 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM643 is inhibition of expression of host target genes, as part of a novel viral mechanism of attacking a host. Accordingly, utilities of VGAM643 include diagnosis, prevention and treatment of viral infection by Rat Cytomegalovirus. Specific functions, and accordingly utilities, of VGAM643 correlate with, and may be deduced from, the identity of the host target genes which VGAM643 binds and inhibits, and the function of these host target genes, as elaborated hereinbelow.

Nucleotide sequences of the VGAM643 precursor RNA, herein designated VGAM PRECURSOR RNA, and of the 'diced' VGAM643 RNA, herein designated VGAM RNA, and a schematic representation of the secondary folding of VGAM643 folded precursor RNA, herein designated VGAM FOLDED PRECURSOR RNA, of VGAM643 are further described hereinbelow with reference to Table 1.

Nucleotide sequences of host target binding sites, such as BINDING SITE-I, BINDING SITE-II and BINDING SITE-III of FIG. 1, found on VGAM643 host target RNA, and schematic representation of the complementarity of each of these host target binding sites to VGAM643 RNA, herein designated VGAM RNA, are described hereinbelow with reference to Table 2.

As mentioned hereinabove with reference to FIG. 1, a function of VGAM643 gene, herein designated VGAM is inhibition of expression of VGAM643 target genes. It is appreciated that specific functions, and accordingly utilities, of VGAM643 correlate with, and may be deduced from, the identity of the target genes which VGAM643 binds and inhibits, and the function of these target genes, as elaborated hereinbelow.

SMURF1 (Accession XM_166483) is a VGAM643 host target gene. SMURF1 BINDING SITE is HOST TARGET binding site found in the 5' untranslated region of mRNA encoded by SMURF1, corresponding to a HOST TARGET binding site such as BINDING SITE I, BINDING SITE II or BINDING SITE III. Table 2 illustrates the complementarity of the nucleotide sequences of SMURF1 BINDING SITE, designated SEQ ID:44411, to the nucleotide sequence of VGAM643 RNA, herein designated VGAM RNA, also designated SEQ ID:3354.

A function of VGAM643 is therefore inhibition of SMURF1 (Accession XM_166483). Accordingly, utilities of VGAM643 include diagnosis, prevention and treatment of diseases and clinical conditions associated with SMURF1. FLJ12443 (Accession NM_024830) is another VGAM643 host target gene. FLJ12443 BINDING SITE is HOST TARGET binding site found in the 3' untranslated region of mRNA encoded by FLJ12443, corresponding to a HOST TARGET binding site such as BINDING SITE I, BINDING SITE II or BINDING SITE III. Table 2 illustrates the complementarity of the nucleotide sequences of FLJ12443 BINDING SITE, designated SEQ ID:24225, to the nucleotide sequence of VGAM643 RNA, herein designated VGAM RNA, also designated SEQ ID:3354.

Another function of VGAM643 is therefore inhibition of FLJ12443 (Accession NM_024830). Accordingly, utilities of VGAM643 include diagnosis, prevention and treatment of diseases and clinical conditions associated with FLJ12443. KIAA0229 (Accession XM_166478) is another VGAM643 host target gene. KIAA0229 BINDING SITE is HOST TARGET binding site found in the 3' untranslated region of mRNA encoded by KIAA0229, corresponding to a HOST TARGET binding site such as BINDING SITE I, BINDING SITE II or BINDING SITE III. Table 2 illustrates the complementarity of the nucleotide sequences of KIAA0229 BINDING SITE, designated SEQ ID:44401, to the nucleotide sequence of VGAM643 RNA, herein designated VGAM RNA, also designated SEQ ID:3354.

Another function of VGAM643 is therefore inhibition of KIAA0229 (Accession XM_166478). Accordingly, utilities of VGAM643 include diagnosis, prevention and treatment of diseases and clinical conditions associated with KIAA0229. KIAA0674 (Accession XM_027054) is another VGAM643 host target gene. KIAA0674 BINDING SITE is HOST TARGET binding site found in the 5' untranslated region of mRNA encoded by KIAA0674, corresponding to a HOST TARGET binding site such as BINDING SITE I, BINDING SITE II or BINDING SITE III. Table 2 illustrates the complementarity of the nucleotide sequences of KIAA0674 BINDING SITE, designated SEQ ID:30399, to the nucleotide sequence of VGAM643 RNA, herein designated VGAM RNA, also designated SEQ ID:3354.

Another function of VGAM643 is therefore inhibition of KIAA0674 (Accession XM_027054). Accordingly, utilities of VGAM643 include diagnosis, prevention and treatment of diseases and clinical conditions associated with KIAA0674. KIAA0712 (Accession NM_014715) is another VGAM643 host target gene. KIAA0712 BINDING SITE is HOST TARGET binding site found in the 3' untranslated region of mRNA encoded by KIAA0712, corresponding to a HOST TARGET binding site such as BINDING SITE I, BINDING SITE II or BINDING SITE III. Table 2 illustrates the complementarity of the nucleotide sequences of KIAA0712 BINDING SITE, designated SEQ ID:16264, to the nucleotide sequence of VGAM643 RNA, herein designated VGAM RNA, also designated SEQ ID:3354.

Another function of VGAM643 is therefore inhibition of KIAA0712 (Accession NM_014715). Accordingly, utilities of VGAM643 include diagnosis, prevention and treatment of diseases and clinical conditions associated with KIAA0712. KIAA1229 (Accession XM_030665) is another VGAM643 host target gene. KIAA1229 BINDING SITE is HOST TARGET binding site found in the 3' untranslated region of mRNA encoded by KIAA1229, corresponding to a HOST TARGET binding site such as BINDING SITE I, BINDING SITE II or BINDING SITE III. Table 2 illustrates the complementarity of the nucleotide sequences of KIAA1229 BINDING SITE, designated SEQ ID:31100, to the nucleotide sequence of VGAM643 RNA, herein designated VGAM RNA, also designated SEQ ID:3354.

Another function of VGAM643 is therefore inhibition of KIAA1229 (Accession XM_030665). Accordingly, utilities of VGAM643 include diagnosis, prevention and treatment of diseases and clinical conditions associated with KIAA1229. Ring Finger Protein 10 (RNF10, Accession NM_014868) is another VGAM643 host target gene. RNF10 BINDING SITE is HOST TARGET binding site found in the 5' untranslated region of mRNA encoded by RNF10, corresponding to a HOST TARGET binding site such as BINDING SITE I, BINDING SITE II or BINDING SITE III. Table 2 illustrates the complementarity of the nucleotide sequences of RNF10 BINDING SITE, designated SEQ ID:16963, to the nucleotide sequence of VGAM643 RNA, herein designated VGAM RNA, also designated SEQ ID:3354.

Another function of VGAM643 is therefore inhibition of Ring Finger Protein 10 (RNF10, Accession NM_014868). Accordingly, utilities of VGAM643 include diagnosis, prevention and treatment of diseases and clinical conditions associated with RNF10. Serologically Defined Colon Cancer Antigen 43 (SDCCAG43, Accession XM_046834) is another VGAM643 host target gene. SDCCAG43 BINDING SITE is HOST TARGET binding site found in the 3' untranslated region of mRNA encoded by SDCCAG43, corresponding to a HOST TARGET binding site such as BINDING SITE I, BINDING SITE II or BINDING SITE III. Table 2 illustrates the complementarity of the nucleotide sequences of SDCCAG43 BINDING SITE, designated SEQ ID:34845, to the nucleotide sequence of VGAM643 RNA, herein designated VGAM RNA, also designated SEQ ID:3354.

Another function of VGAM643 is therefore inhibition of Serologically Defined Colon Cancer Antigen 43 (SDCCAG43, Accession XM_046834). Accordingly, utilities of VGAM643 include diagnosis, prevention and treatment of diseases and clinical conditions associated with SDCCAG43. SMOC2 (Accession XM_051452) is another VGAM643 host target gene. SMOC2 BINDING SITE is HOST TARGET binding site found in the 5' untranslated region of mRNA encoded by SMOC2, corresponding to a HOST TARGET binding site such as BINDING SITE I, BINDING SITE II or BINDING SITE III. Table 2 illustrates the complementarity of the nucleotide sequences of SMOC2 BINDING SITE, designated SEQ ID:35835, to the nucleotide sequence of VGAM643 RNA, herein designated VGAM RNA, also designated SEQ ID:3354.

Another function of VGAM643 is therefore inhibition of SMOC2 (Accession XM_051452). Accordingly, utilities of VGAM643 include diagnosis, prevention and treatment of diseases and clinical conditions associated with SMOC2. Stromal Antigen 2 (STAG2, Accession XM_047285) is another VGAM643 host target gene. STAG2 BINDING SITE is HOST TARGET binding site found in the 5' untranslated region of mRNA encoded by STAG2, corresponding to a HOST TARGET binding site such as BINDING SITE I, BINDING SITE II or BINDING SITE III. Table 2 illustrates the complementarity of the nucleotide sequences of STAG2 BINDING SITE, designated SEQ ID:34931, to the nucleotide sequence of VGAM643 RNA, herein designated VGAM RNA, also designated SEQ ID:3354.

Another function of VGAM643 is therefore inhibition of Stromal Antigen 2 (STAG2, Accession XM_047285). Accordingly, utilities of VGAM643 include diagnosis, prevention and treatment of diseases and clinical conditions associated with STAG2. LOC253981 (Accession XM_171064) is another VGAM643 host target gene. LOC253981 BINDING SITE is HOST TARGET binding site found in the 3' untranslated region of mRNA encoded by LOC253981, corresponding to a HOST TARGET binding site such as BINDING SITE I, BINDING SITE II or BINDING SITE III. Table 2 illustrates the complementarity of the nucleotide sequences of LOC253981 BINDING SITE, designated SEQ ID:45865, to the nucleotide sequence of VGAM643 RNA, herein designated VGAM RNA, also designated SEQ ID:3354.

Another function of VGAM643 is therefore inhibition of LOC253981 (Accession XM_171064). Accordingly, utilities of VGAM643 include diagnosis, prevention and treatment of diseases and clinical conditions associated with LOC253981. FIG. 1 further provides a conceptual description of a novel bioinformatically detected viral gene of the present invention, referred to here as Viral Genomic Address Messenger 644 (VGAM644) viral gene, which modulates expression of respective host target genes thereof, the function and utility of which host target genes is known in the art.

VGAM644 is a novel bioinformatically detected regulatory, non protein coding, viral micro RNA (miRNA) gene. The method by which VGAM644 was detected is described hereinabove with reference to FIGS. 1-8.

VGAM644 gene, herein designated VGAM GENE, is a viral gene contained in the genome of Parvovirus H1. VGAM644 host target gene, herein designated VGAM HOST TARGET GENE, is a human gene contained in the human genome.

VGAM644 gene encodes a VGAM644 precursor RNA, herein designated VGAM PRECURSOR RNA. Similar to other miRNA genes, and unlike most ordinary genes, VGAM644 precursor RNA does not encode a protein. A nucleotide sequence identical or highly similar to the nucleotide sequence of VGAM644 precursor RNA is designated SEQ ID:630, and is provided hereinbelow with reference to the sequence listing part. Nucleotide sequence SEQ ID:630 is located at position 129 relative to the genome of Parvovirus H1.

VGAM644 precursor RNA folds onto itself, forming VGAM644 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM644 folded precursor RNA into VGAM644 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM644 RNA is designated SEQ ID:3355, and is provided hereinbelow with reference to the sequence listing part.

VGAM644 host target gene, herein designated VGAM HOST TARGET GENE, encodes a corresponding messenger RNA, VGAM644 host target RNA, herein designated VGAM HOST TARGET RNA. VGAM644 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM644 RNA, herein designated VGAM RNA, binds complementarily to one or more host target binding sites located in untranslated regions of VGAM644 host target RNA, herein designated VGAM HOST TARGET RNA. This complementary binding is due to the fact that the nucleotide sequence of VGAM644 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM644 RNA, herein designated VGAM RNA, may have a different number of host target binding sites in untranslated regions of a VGAM644 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM644 RNA, herein designated VGAM RNA, to host target binding sites on VGAM644 host target RNA, herein designated VGAM HOST TARGET RNA, such as BINDING SITE I, BINDING SITE II and BINDING SITE III, inhibits translation of VGAM644 host target RNA into VGAM644 host target protein, herein designated VGAM HOST TARGET PROTEIN. VGAM host target protein is therefore outlined by a broken line.

It is appreciated that VGAM644 host target gene, herein designated VGAM HOST TARGET GENE, in fact represents a plurality of VGAM644 host target genes. The mRNA of each one of this plurality of VGAM644 host target genes comprises one or more host target binding sites, each having a nucleotide sequence which is at least partly complementary to VGAM644 RNA, herein designated VGAM RNA, and which when bound by VGAM644 RNA causes inhibition of translation of respective one or more VGAM644 host target proteins.

It is further appreciated by one skilled in the art that the mode of translational inhibition illustrated by FIG. 1 with specific reference to translational inhibition exerted by VGAM644 gene, herein designated VGAM GENE, on one or more VGAM644 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM644 is inhibition of expression of host target genes, as part of a novel viral mechanism of attacking a host. Accordingly, utilities of VGAM644 include diagnosis, prevention and treatment of viral infection by Parvovirus H1. Specific functions, and accordingly utilities, of VGAM644 correlate with, and may be deduced from, the identity of the host target genes which VGAM644 binds and inhibits, and the function of these host target genes, as elaborated hereinbelow.

Nucleotide sequences of the VGAM644 precursor RNA, herein designated VGAM PRECURSOR RNA, and of the 'diced' VGAM644 RNA, herein designated VGAM RNA, and a schematic representation of the secondary folding of VGAM644 folded precursor RNA, herein designated VGAM FOLDED PRECURSOR RNA, of VGAM644 are further described hereinbelow with reference to Table 1.

Nucleotide sequences of host target binding sites, such as BINDING SITE-I, BINDING SITE-II and BINDING SITE-III of FIG. 1, found on VGAM644 host target RNA, and schematic representation of the complementarity of each of these host target binding sites to VGAM644 RNA, herein designated VGAM RNA, are described hereinbelow with reference to Table 2.

As mentioned hereinabove with reference to FIG. 1, a function of VGAM644 gene, herein designated VGAM is inhibition of expression of VGAM644 target genes. It is appreciated that specific functions, and accordingly utilities, of VGAM644 correlate with, and may be deduced from, the identity of the target genes which VGAM644 binds and inhibits, and the function of these target genes, as elaborated hereinbelow.

ATP-binding Cassette, Sub-family C (CFTR/MRP), Member 1 (ABCC1, Accession NM_004996) is a VGAM644 host target gene. ABCC1 BINDING SITE1 through ABCC1 BINDING SITE3 are HOST TARGET binding sites found in untranslated regions of mRNA encoded by ABCC1, corresponding to HOST TARGET binding sites such as BINDING SITE I, BINDING SITE II or BINDING SITE III. Table 2 illustrates the complementarity of the nucleotide sequences of ABCC1 BINDING SITE1 through ABCC1 BINDING SITE3, designated SEQ ID:11438, SEQ ID:21282 and SEQ ID:21286 respectively, to the nucleotide sequence of VGAM644 RNA, herein designated VGAM RNA, also designated SEQ ID:3355.

A function of VGAM644 is therefore inhibition of ATP-binding Cassette, Sub-family C (CFTR/MRP), Member 1 (ABCC1, Accession NM_004996), a gene which may participate directly in the active transport of drugs into subcellular organelles or influence drug distribution indirectly. Accordingly, utilities of VGAM644 include diagnosis, prevention and treatment of diseases and clinical conditions associated with ABCC1. The function of ABCC1 and its association with various diseases and clinical conditions, has been established by previous studies, as described hereinabove with reference to VGAM479. WW Domain Containing Oxidoreductase (WWOX, Accession NM_016373) is another VGAM644 host target gene. WWOX BINDING SITE is HOST TARGET binding site found in the 3' untranslated region of mRNA encoded by WWOX, corresponding to a HOST TARGET binding site such as BINDING SITE I, BINDING SITE II or BINDING SITE III. Table 2 illustrates the complementarity of the nucleotide sequences of WWOX BINDING SITE, designated SEQ ID:18503, to the nucleotide sequence of VGAM644 RNA, herein designated VGAM RNA, also designated SEQ ID:3355.

Another function of VGAM644 is therefore inhibition of WW Domain Containing Oxidoreductase (WWOX, Accession NM_016373), a gene which involves in in protein-protein interactions and may contribute to the biologic consequences of DNA instability. Accordingly, utilities of VGAM644 include diagnosis, prevention and treatment of diseases and clinical conditions associated with WWOX. The function of WWOX has been established by previous studies. To identify genes mapping to the chromosome region 16q23.3-q24.1, an area commonly affected by allelic loss in breast cancer, Bednarek et al. (2000) generated a detailed physical map of the genomic region spanning STS markers D16S518 and D16S516. By use of shotgun genomic sequencing as well as isolation and analysis of transcripts mapping to this region, they identified and cloned a novel gene, the genomic structure of which spanned the entire region. They designated the gene WWOX because it contains 2 WW domains coupled to a region with high homology to the short-chain dehydrogenase/reductase (SRD) family of enzymes. The WWOX gene contains 9 exons and encodes a 414-amino acid protein. Bednarek et al. (2000) performed a mutation screen of WWOX exons in a panel of breast cancer lines, most of which were hemizygous for the 16q genomic region indicated. They found no evidence of mutations, indicating that WWOX is probably not a tumor suppressor gene. However, they observed that 1 case of homozygous deletion and 2 previously described translocation breakpoints map to intronic regions of this gene. They speculated that the WWOX gene may span the region of the common fragile site FRA16D. Northern blot analysis detected overexpression of a 2.2-kb WWOX transcript in breast cancer cell lines when compared to normal tissues. The highest normal expression was detected in hormonally regulated tissues such as testis, ovary, and prostate. This expression pattern and the presence of an SRD domain and specific amino acid features suggested a role for WWOX in steroid metabolism. The presence of WW domains indicated a role in protein-protein interactions. Chang et al. (2001) showed that the homologous mouse protein, Wox1, is an essential mediator of tumor necrosis factor-alpha-induced apoptosis. Furthermore, mouse Wox1 protein binds directly to p53 (OMIM Ref. No. 191170), and blocking Wox1 by expression of antisense mRNA abolishes p53-mediated apoptosis in NIH 3T3 cells. The high conservation of WWOX protein between Homo sapiens and Mus musculus (93% identity) supported a similar, important role in apoptosis for human WWOX. In a mutation screen of WWOX in human cancer, Paige et al. (2001) demonstrated homozygous deletion of WWOX exons from ovarian cancer cells and 3 different tumor cell lines. They also identified an internally deleted WWOX transcript from a further primary ovarian tumor. In 3 of these samples the deletions resulted in frame-shifts, and in each case the resulting WWOX transcripts lacked part, or all, of the short-chain dehydrogenase domain and the putative mitochondrial localization signal. Sequencing demonstrated several missense polymorphisms in tumor cell lines and identified a high level of single nucleotide polymorphism within the WWOX gene. The authors stated that the evidence strengthened the case for WWOX as a tumor suppressor gene in ovarian cancer and other tumor types. Bednarek et al. (2001) presented data indicating that WWOX behaves as a potent suppressor of tumor growth and suggesting that abnormalities affecting this gene at the genomic and transcriptional level may be relevant in carcinogenesis. Two of the most frequently observed fragile sites in human S, FRA3B and FRA16D, show a high frequency of breakage and colocalize with genes crossing large regions of breakage. At FRA3B, the fragile histidine triad gene (FHIT; 601153) spans more than 1 Mb, and at FRA16D the WWOX gene spans more than 750 kb. In the mouse, the common fragile site Fra14A2 and the Fhit gene are conserved in the homologous region of the genome. Krummel et al. (2002) positioned the mouse homolog of WWOX (Wox1) at band 8E1 of the mouse genome, colocalizing with Fra8E1. The sequence from this region, including introns, is highly conserved over at least a 100-kb region. This evolutionary conservation suggests that the 2 most active common fragile sites share many features and that they and their associated genes may be necessary for cell survival.

Full details of the abovementioned studies are described in the following publications, the disclosure of which are hereby incorporated by reference:

Kuroki, T.; Trapasso, F.; Shiraishi, T.; Alder, H.; Mimori, K.; Mori, M.; Croce, C. M.: Genetic alterations of the tumor suppressor gene WWOX in esophageal squamous cell carcinoma. Cancer Res. 62:2258-2260, 2002; and Paige, A. J. W.; Taylor, K. J.; Taylor, C.; Hillier, S. G.; Farrington, S.; Scott, D.; Porteous, D. J.; Smyth, J. F.; Gabra, H.; Watson, J. E. V.: WWOX: a candidate tumor suppressor ge.

Further studies establishing the function and utilities of WWOX are found in John Hopkins OMIM database record ID 605131, and in sited publications numbered 7084-708 and 4651-2874 listed in the bibliography section hereinbelow, which are also hereby incorporated by reference. DKFZp762E1511 (Accession XM_003460) is another VGAM644 host target gene. DKFZp762E1511 BINDING SITE is HOST TARGET binding site found in the 3' untranslated region of mRNA encoded by DKFZp762E1511, corresponding to a HOST TARGET binding site such as BINDING SITE I, BINDING SITE II or BINDING SITE III. Table 2 illustrates the complementarity of the nucleotide sequences of DKFZp762E1511 BINDING SITE, designated SEQ ID:29935, to the nucleotide sequence of VGAM644 RNA, herein designated VGAM RNA, also designated SEQ ID:3355.

Another function of VGAM644 is therefore inhibition of DKFZp762E1511 (Accession XM_003460). Accordingly, utilities of VGAM644 include diagnosis, prevention and treatment of diseases and clinical conditions associated with DKFZp762E1511. KIAA0534 (Accession XM_049349) is another VGAM644 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35388, to the nucleotide sequence of VGAM644 RNA, herein designated VGAM RNA, also designated SEQ ID:3355.

Another function of VGAM644 is therefore inhibition of KIAA0534 (Accession XM_049349). Accordingly, utilities of VGAM644 include diagnosis, prevention and treatment of diseases and clinical conditions associated with KIAA0534. KIAA1580 (Accession XM_045271) is another VGAM644 host target gene. KIAA1580 BINDING SITE is HOST TARGET binding site found in the 5' untranslated region of mRNA encoded by KIAA1580, corresponding to a HOST TARGET binding site such as BINDING SITE I, BINDING SITE II or BINDING SITE III. Table 2 illustrates the complementarity of the nucleotide sequences of KIAA1580 BINDING SITE, designated SEQ ID:34405, to the nucleotide sequence of VGAM644 RNA, herein designated VGAM RNA, also designated SEQ ID:3355.

Another function of VGAM644 is therefore inhibition of KIAA1580 (Accession XM_045271). Accordingly, utilities of VGAM644 include diagnosis, prevention and treatment of diseases and clinical conditions associated with KIAA1580. Retinoic Acid Induced 17 (RAI17, Accession XM_166091) is another VGAM644 host target gene. RAI17 BINDING SITE is HOST TARGET binding site found in the 3' untranslated region of mRNA encoded by RAI17, corresponding to a HOST TARGET binding site such as BINDING SITE I, BINDING SITE II or BINDING SITE III. Table 2 illustrates the complementarity of the nucleotide sequences of RAI17 BINDING SITE, designated SEQ ID:43863, to the nucleotide sequence of VGAM644 RNA, herein designated VGAM RNA, also designated SEQ ID:3355.

Another function of VGAM644 is therefore inhibition of Retinoic Acid Induced 17 (RAI17, Accession XM_166091). Accordingly, utilities of VGAM644 include diagnosis, prevention and treatment of diseases and clinical conditions associated with RAI17. SBBI26 (Accession NM_018846) is another VGAM644 host target gene. SBBI26 BINDING SITE is HOST TARGET binding site found in the 3' untranslated region of mRNA encoded by SBBI26, corresponding to a HOST TARGET binding site such as BINDING SITE I, BINDING SITE II or BINDING SITE III. Table 2 illustrates the complementarity of the nucleotide sequences of SBBI26 BINDING SITE, designated SEQ ID:20831, to the nucleotide sequence of VGAM644 RNA, herein designated VGAM RNA, also designated SEQ ID:3355.

Another function of VGAM644 is therefore inhibition of SBBI26 (Accession NM_018846). Accordingly, utilities of VGAM644 include diagnosis, prevention and treatment of diseases and clinical conditions associated with SBBI26. LOC220018 (Accession XM_167816) is another VGAM644 host target gene. LOC220018 BINDING SITE is HOST TARGET binding site found in the 5' untranslated region of mRNA encoded by LOC220018, corresponding to a HOST TARGET binding site such as BINDING SITE I, BINDING SITE II or BINDING SITE III. Table 2 illustrates the complementarity of the nucleotide sequences of LOC220018 BINDING SITE, designated SEQ ID:44853, to the nucleotide sequence of VGAM644 RNA, herein designated VGAM RNA, also designated SEQ ID:3355.

Another function of VGAM644 is therefore inhibition of LOC220018 (Accession XM_167816). Accordingly, utilities of VGAM644 include diagnosis, prevention and treatment of diseases and clinical conditions associated with LOC220018. LOC254251 (Accession XM_171088) is another VGAM644 host target gene. LOC254251 BINDING SITE is HOST TARGET binding site found in the 3' untranslated region of mRNA encoded by LOC254251, corresponding to a HOST TARGET binding site such as BINDING SITE I, BINDING SITE II or BINDING SITE III. Table 2 illustrates the complementarity of the nucleotide sequences of LOC254251 BINDING SITE, designated SEQ ID:45897, to the nucleotide sequence of VGAM644 RNA, herein designated VGAM RNA, also designated SEQ ID:3355.

Another function of VGAM644 is therefore inhibition of LOC254251 (Accession XM_171088). Accordingly, utilities of VGAM644 include diagnosis, prevention and treatment of diseases and clinical conditions associated with LOC254251. LOC57086 (Accession NM_020351) is another VGAM644 host target gene. LOC57086 BINDING SITE is HOST TARGET binding site found in the 5' untranslated region of mRNA encoded by LOC57086, corresponding to a HOST TARGET binding site such as BINDING SITE I, BINDING SITE II or BINDING SITE III. Table 2 illustrates the complementarity of the nucleotide sequences of LOC57086 BINDING SITE, designated SEQ ID:21616, to the nucleotide sequence of VGAM644 RNA, herein designated VGAM RNA, also designated SEQ ID:3355.

Another function of VGAM644 is therefore inhibition of LOC57086 (Accession NM_020351). Accordingly, utilities of VGAM644 include diagnosis, prevention and treatment of diseases and clinical conditions associated with LOC57086. FIG. 1 further provides a conceptual description of a novel bioinformatically detected viral gene of the present invention, referred to here as Viral Genomic Address Messenger 645 (VGAM645) viral gene, which modulates expression of respective host target genes thereof, the function and utility of which host target genes is known in the art.

VGAM645 is a novel bioinformatically detected regulatory, non protein coding, viral micro RNA (miRNA) gene. The method by which VGAM645 was detected is described hereinabove with reference to FIGS. 1-8.

VGAM645 gene, herein designated VGAM GENE, is a viral gene contained in the genome of Parvovirus H1. VGAM645 host target gene, herein designated VGAM HOST TARGET GENE, is a human gene contained in the human genome.

VGAM645 gene encodes a VGAM645 precursor RNA, herein designated VGAM PRECURSOR RNA. Similar to other miRNA genes, and unlike most ordinary genes, VGAM645 precursor RNA does not encode a protein. A nucleotide sequence identical or highly similar to the nucleotide sequence of VGAM645 precursor RNA is designated SEQ ID:631, and is provided hereinbelow with reference to the sequence listing part. Nucleotide sequence SEQ ID:631 is located at position 1 relative to the genome of Parvovirus H1.

VGAM645 precursor RNA folds onto itself, forming VGAM645 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM645 folded precursor RNA into VGAM645 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM645 RNA is designated SEQ ID:3356, and is provided hereinbelow with reference to the sequence listing part.

VGAM645 host target gene, herein designated VGAM HOST TARGET GENE, encodes a corresponding messenger RNA, VGAM645 host target RNA, herein designated VGAM HOST TARGET RNA. VGAM645 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM645 RNA, herein designated VGAM RNA, binds complementarily to one or more host target binding sites located in untranslated regions of VGAM645 host target RNA, herein designated VGAM HOST TARGET RNA. This complementary binding is due to the fact that the nucleotide sequence of VGAM645 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM645 RNA, herein designated VGAM RNA, may have a different number of host target binding sites in untranslated regions of a VGAM645 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM645 RNA, herein designated VGAM RNA, to host target binding sites on VGAM645 host target RNA, herein designated VGAM HOST TARGET RNA, such as BINDING SITE I, BINDING SITE II and BINDING SITE III, inhibits translation of VGAM645 host target RNA into VGAM645 host target protein, herein designated VGAM HOST TARGET PROTEIN. VGAM host target protein is therefore outlined by a broken line.

It is appreciated that VGAM645 host target gene, herein designated VGAM HOST TARGET GENE, in fact represents a plurality of VGAM645 host target genes. The mRNA of each one of this plurality of VGAM645 host target genes comprises one or more host target binding sites, each having a nucleotide sequence which is at least partly complementary to VGAM645 RNA, herein designated VGAM RNA, and which when bound by VGAM645 RNA causes inhibition of translation of respective one or more VGAM645 host target proteins.

It is further appreciated by one skilled in the art that the mode of translational inhibition illustrated by FIG. 1 with specific reference to translational inhibition exerted by VGAM645 gene, herein designated VGAM GENE, on one or more VGAM645 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM645 is inhibition of expression of host target genes, as part of a novel viral mechanism of attacking a host. Accordingly, utilities of VGAM645 include diagnosis, prevention and treatment of viral infection by Parvovirus H1. Specific functions, and accordingly utilities, of VGAM645 correlate with, and may be deduced from, the identity of the host target genes which VGAM645 binds and inhibits, and the function of these host target genes, as elaborated hereinbelow.

Nucleotide sequences of the VGAM645 precursor RNA, herein designated VGAM PRECURSOR RNA, and of the 'diced' VGAM645 RNA, herein designated VGAM RNA, and a schematic representation of the secondary folding of VGAM645 folded precursor RNA, herein designated VGAM FOLDED PRECURSOR RNA, of VGAM645 are further described hereinbelow with reference to Table 1.

Nucleotide sequences of host target binding sites, such as BINDING SITE-I, BINDING SITE-II and BINDING SITE-III of FIG. 1, found on VGAM645 host target RNA, and schematic representation of the complementarity of each of these host target binding sites to VGAM645 RNA, herein designated VGAM RNA, are described hereinbelow with reference to Table 2.

As mentioned hereinabove with reference to FIG. 1, a function of VGAM645 gene, herein designated VGAM is inhibition of expression of VGAM645 target genes. It is appreciated that specific functions, and accordingly utilities, of VGAM645 correlate with, and may be deduced from, the identity of the target genes which VGAM645 binds and inhibits, and the function of these target genes, as elaborated hereinbelow.

Zinc Finger Protein 2 (A1-5) (ZNF2, Accession NM_021088) is a VGAM645 host target gene. ZNF2 BINDING SITE is HOST TARGET binding site found in the 3' untranslated region of mRNA encoded by ZNF2, corresponding to a HOST TARGET binding site such as BINDING SITE I, BINDING SITE II or BINDING SITE III. Table 2 illustrates the complementarity of the nucleotide sequences of ZNF2 BINDING SITE, designated SEQ ID:22065, to the nucleotide sequence of VGAM645 RNA, herein designated VGAM RNA, also designated SEQ ID:3356.

A function of VGAM645 is therefore inhibition of Zinc Finger Protein 2 (A1-5) (ZNF2, Accession NM_021088). Accordingly, utilities of VGAM645 include diagnosis, prevention and treatment of diseases and clinical conditions associated with ZNF2. FIG. 1 further provides a conceptual description of a novel bioinformatically detected viral gene of the present invention, referred to here as Viral Genomic Address Messenger 646 (VGAM646) viral gene, which modulates expression of respective host target genes thereof, the function and utility of which host target genes is known in the art.

VGAM646 is a novel bioinformatically detected regulatory, non protein coding, viral micro RNA (miRNA) gene. The method by which VGAM646 was detected is described hereinabove with reference to FIGS. 1-8.

VGAM646 gene, herein designated VGAM GENE, is a viral gene contained in the genome of Lactate Dehydrogenase-elevating Virus. VGAM646 host target gene, herein designated VGAM HOST TARGET GENE, is a human gene contained in the human genome.

VGAM646 gene encodes a VGAM646 precursor RNA, herein designated VGAM PRECURSOR RNA. Similar to other miRNA genes, and unlike most ordinary genes, VGAM646 precursor RNA does not encode a protein. A nucleotide sequence identical or highly similar to the nucleotide sequence of VGAM646 precursor RNA is designated SEQ ID:632, and is provided hereinbelow with reference to the sequence listing part. Nucleotide sequence SEQ ID:632 is located at position 1908 relative to the genome of Lactate Dehydrogenase-elevating Virus.

VGAM646 precursor RNA folds onto itself, forming VGAM646 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM646 folded precursor RNA into VGAM646 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM646 RNA is designated SEQ ID:3357, and is provided hereinbelow with reference to the sequence listing part.

VGAM646 host target gene, herein designated VGAM HOST TARGET GENE, encodes a corresponding messenger RNA, VGAM646 host target RNA, herein designated VGAM HOST TARGET RNA. VGAM646 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM646 RNA, herein designated VGAM RNA, binds complementarily to one or more host target binding sites located in untranslated regions of VGAM646 host target RNA, herein designated VGAM HOST TARGET RNA. This complementary binding is due to the fact that the nucleotide sequence of VGAM646 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM646 RNA, herein designated VGAM RNA, may have a different number of host target binding sites in untranslated regions of a VGAM646 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM646 RNA, herein designated VGAM RNA, to host target binding sites on VGAM646 host target RNA, herein designated VGAM HOST TARGET RNA, such as BINDING SITE I, BINDING SITE II and BINDING SITE III, inhibits translation of VGAM646 host target RNA into VGAM646 host target protein, herein designated VGAM HOST TARGET PROTEIN. VGAM host target protein is therefore outlined by a broken line.

It is appreciated that VGAM646 host target gene, herein designated VGAM HOST TARGET GENE, in fact represents a plurality of VGAM646 host target genes. The mRNA of each one of this plurality of VGAM646 host target genes comprises one or more host target binding sites, each having a nucleotide sequence which is at least partly complementary to VGAM646 RNA, herein designated VGAM RNA, and which when bound by VGAM646 RNA causes inhibition of translation of respective one or more VGAM646 host target proteins.

It is further appreciated by one skilled in the art that the mode of translational inhibition illustrated by FIG. 1 with specific reference to translational inhibition exerted by VGAM646 gene, herein designated VGAM GENE, on one or more VGAM646 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM646 is inhibition of expression of host target genes, as part of a novel viral mechanism of attacking a host. Accordingly, utilities of VGAM646 include diagnosis, prevention and treatment of viral infection by Lactate Dehydrogenase-elevating Virus. Specific functions, and accordingly utilities, of VGAM646 correlate with, and may be deduced from, the identity of the host target genes which VGAM646 binds and inhibits, and the function of these host target genes, as elaborated hereinbelow.

Nucleotide sequences of the VGAM646 precursor RNA, herein designated VGAM PRECURSOR RNA, and of the 'diced' VGAM646 RNA, herein designated VGAM RNA, and a schematic representation of the secondary folding of VGAM646 folded precursor RNA, herein designated VGAM FOLDED PRECURSOR RNA, of VGAM646 are further described hereinbelow with reference to Table 1.

Nucleotide sequences of host target binding sites, such as BINDING SITE-I, BINDING SITE-II and BINDING SITE-III of FIG. 1, found on VGAM646 host target RNA, and schematic representation of the complementarity of each of these host target binding sites to VGAM646 RNA, herein designated VGAM RNA, are described hereinbelow with reference to Table 2.

As mentioned hereinabove with reference to FIG. 1, a function of VGAM646 gene, herein designated VGAM is inhibition of expression of VGAM646 target genes. It is appreciated that specific functions, and accordingly utilities, of VGAM646 correlate with, and may be deduced from, the identity of the target genes which VGAM646 binds and inhibits, and the function of these target genes, as elaborated hereinbelow.

ABH (Accession XM_007409) is a VGAM646 host target gene. ABH BINDING SITE is HOST TARGET binding site found in the 3' untranslated region of mRNA encoded by ABH, corresponding to a HOST TARGET binding site such as BINDING SITE I, BINDING SITE II or BINDING SITE III. Table 2 illustrates the complementarity of the nucleotide sequences of ABH BINDING SITE, designated SEQ ID:30054, to the nucleotide sequence of VGAM646 RNA, herein designated VGAM RNA, also designated SEQ ID:3357.

A function of VGAM646 is therefore inhibition of ABH (Accession XM_007409). Accordingly, utilities of VGAM646 include diagnosis, prevention and treatment of diseases and clinical conditions associated with ABH. Oxidative-stress Responsive 1 (OSR1, Accession NM_005109) is another VGAM646 host target gene. OSR1 BINDING SITE is HOST TARGET binding site found in the 3' untranslated region of mRNA encoded by OSR1, corresponding to a HOST TARGET binding site such as BINDING SITE I, BINDING SITE II or BINDING SITE III. Table 2 illustrates the complementarity of the nucleotide sequences of OSR1 BINDING SITE, designated SEQ ID:11586, to the nucleotide sequence of VGAM646 RNA, herein designated VGAM RNA, also designated SEQ ID:3357.

Another function of VGAM646 is therefore inhibition of Oxidative-stress Responsive 1 (OSR1, Accession NM_005109), a gene which mediats stress-activated signals. Accordingly, utilities of VGAM646 include diagnosis, prevention and treatment of diseases and clinical conditions associated with OSR1. The function of OSR1 and its association with various diseases and clinical conditions, has been established by previous studies, as described hereinabove with reference to VGAM538. KIAA0408 (Accession NM_014702) is another VGAM646 host target gene. KIAA0408 BINDING SITE is HOST TARGET binding site found in the 3' untranslated region of mRNA encoded by KIAA0408, corresponding to a HOST TARGET binding site such as BINDING SITE I, BINDING SITE II or BINDING SITE III. Table 2 illustrates the complementarity of the nucleotide sequences of KIAA0408 BINDING SITE, designated SEQ ID:16231, to the nucleotide sequence of VGAM646 RNA, herein designated VGAM RNA, also designated SEQ ID:3357.

Another function of VGAM646 is therefore inhibition of KIAA0408 (Accession NM_014702). Accordingly, utilities of VGAM646 include diagnosis, prevention and treatment of diseases and clinical conditions associated with KIAA0408. PA26 (Accession NM_014454) is another VGAM646 host target gene. PA26 BINDING SITE is HOST TARGET binding site found in the 3' untranslated region of mRNA encoded by PA26, corresponding to a HOST TARGET binding site such as BINDING SITE I, BINDING SITE II or BINDING SITE III. Table 2 illustrates the complementarity of the nucleotide sequences of PA26 BINDING SITE, designated SEQ ID:15805, to the nucleotide sequence of VGAM646 RNA, herein designated VGAM RNA, also designated SEQ ID:3357.

Another function of VGAM646 is therefore inhibition of PA26 (Accession NM_014454). Accordingly, utilities of VGAM646 include diagnosis, prevention and treatment of diseases and clinical conditions associated with PA26. RENT2 (Accession NM_015542) is another VGAM646 host target gene. RENT2 BINDING SITE1 and RENT2 BINDING SITE2 are HOST TARGET binding sites found in untranslated regions of mRNA encoded by RENT2, corresponding to HOST TARGET binding sites such as BINDING SITE I, BINDING SITE II or BINDING SITE III. Table 2 illustrates the complementarity of the nucleotide sequences of RENT2 BINDING SITE1 and RENT2 BINDING SITE2, designated SEQ ID:17802 and SEQ ID:27908 respectively, to the nucleotide sequence of VGAM646 RNA, herein designated VGAM RNA, also designated SEQ ID:3357.

Another function of VGAM646 is therefore inhibition of RENT2 (Accession NM_015542). Accordingly, utilities of VGAM646 include diagnosis, prevention and treatment of diseases and clinical conditions associated with RENT2. LOC152245 (Accession XM_098182) is another VGAM646 host target gene. LOC152245 BINDING SITE is HOST TARGET binding site found in the 3' untranslated region of mRNA encoded by LOC152245, corresponding to a HOST TARGET binding site such as BINDING SITE I, BINDING SITE II or BINDING SITE III. Table 2 illustrates the complementarity of the nucleotide sequences of LOC152245 BINDING SITE, designated SEQ ID:41449, to the nucleotide sequence of VGAM646 RNA, herein designated VGAM RNA, also designated SEQ ID:3357.

Another function of VGAM646 is therefore inhibition of LOC152245 (Accession XM_098182). Accordingly, utilities of VGAM646 include diagnosis, prevention and treatment of diseases and clinical conditions associated with LOC152245. LOC200933 (Accession XM_117294) is another VGAM646 host target gene. LOC200933 BINDING SITE is HOST TARGET binding site found in the 3' untranslated region of mRNA encoded by LOC200933, corresponding to a HOST TARGET binding site such as BINDING SITE I, BINDING SITE II or BINDING SITE III. Table 2 illustrates the complementarity of the nucleotide sequences of LOC200933 BINDING SITE, designated SEQ ID:43364, to the nucleotide sequence of VGAM646 RNA, herein designated VGAM RNA, also designated SEQ ID:3357.

Another function of VGAM646 is therefore inhibition of LOC200933 (Accession XM_117294). Accordingly, utilities of VGAM646 include diagnosis, prevention and treatment of diseases and clinical conditions associated with LOC200933. FIG. 1 further provides a conceptual description of a novel bioinformatically detected viral gene of the present invention, referred to here as Viral Genomic Address Messenger 647 (VGAM647) viral gene, which modulates expression of respective host target genes thereof, the function and utility of which host target genes is known in the art.

VGAM647 is a novel bioinformatically detected regulatory, non protein coding, viral micro RNA (miRNA) gene. The method by which VGAM647 was detected is described hereinabove with reference to FIGS. 1-8.

VGAM647 gene, herein designated VGAM GENE, is a viral gene contained in the genome of Acute Bee Paralysis Virus. VGAM647 host target gene, herein designated VGAM HOST TARGET GENE, is a human gene contained in the human genome.

VGAM647 gene encodes a VGAM647 precursor RNA, herein designated VGAM PRECURSOR RNA. Similar to other miRNA genes, and unlike most ordinary genes, VGAM647 precursor RNA does not encode a protein. A nucleotide sequence identical or highly similar to the nucleotide sequence of VGAM647 precursor RNA is designated SEQ ID:633, and is provided hereinbelow with reference to the sequence listing part. Nucleotide sequence SEQ ID:633 is located at position 5839 relative to the genome of Acute Bee Paralysis Virus.

VGAM647 precursor RNA folds onto itself, forming VGAM647 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM647 folded precursor RNA into VGAM647 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM647 RNA is designated SEQ ID:3358, and is provided hereinbelow with reference to the sequence listing part.

VGAM647 host target gene, herein designated VGAM HOST TARGET GENE, encodes a corresponding messenger RNA, VGAM647 host target RNA, herein designated VGAM HOST TARGET RNA. VGAM647 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM647 RNA, herein designated VGAM RNA, binds complementarily to one or more host target binding sites located in untranslated regions of VGAM647 host target RNA, herein designated VGAM HOST TARGET RNA. This complementary binding is due to the fact that the nucleotide sequence of VGAM647 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM647 RNA, herein designated VGAM RNA, may have a different number of host target binding sites in untranslated regions of a VGAM647 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM647 RNA, herein designated VGAM RNA, to host target binding sites on VGAM647 host target RNA, herein designated VGAM HOST TARGET RNA, such as BINDING SITE I, BINDING SITE II and BINDING SITE III, inhibits translation of VGAM647 host target RNA into VGAM647 host target protein, herein designated VGAM HOST TARGET PROTEIN. VGAM host target protein is therefore outlined by a broken line.

It is appreciated that VGAM647 host target gene, herein designated VGAM HOST TARGET GENE, in fact represents a plurality of VGAM647 host target genes. The mRNA of each one of this plurality of VGAM647 host target genes comprises one or more host target binding sites, each having a nucleotide sequence which is at least partly complementary to VGAM647 RNA, herein designated VGAM RNA, and which when bound by VGAM647 RNA causes inhibition of translation of respective one or more VGAM647 host target proteins.

It is further appreciated by one skilled in the art that the mode of translational inhibition illustrated by FIG. 1 with specific reference to translational inhibition exerted by VGAM647 gene, herein designated VGAM GENE, on one or more VGAM647 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM647 is inhibition of expression of host target genes, as part of a novel viral mechanism of attacking a host. Accordingly, utilities of VGAM647 include diagnosis, prevention and treatment of viral infection by Acute Bee Paralysis Virus. Specific functions, and accordingly utilities, of VGAM647 correlate with, and may be deduced from, the identity of the host target genes which VGAM647 binds and inhibits, and the function of these host target genes, as elaborated hereinbelow.

Nucleotide sequences of the VGAM647 precursor RNA, herein designated VGAM PRECURSOR RNA, and of the 'diced' VGAM647 RNA, herein designated VGAM RNA, and a schematic representation of the secondary folding of VGAM647 folded precursor RNA, herein designated VGAM FOLDED PRECURSOR RNA, of VGAM647 are further described hereinbelow with reference to Table 1.

Nucleotide sequences of host target binding sites, such as BINDING SITE-I, BINDING SITE-II and BINDING SITE-III of FIG. 1, found on VGAM647 host target RNA, and schematic representation of the complementarity of each of these host target binding sites to VGAM647 RNA, herein designated VGAM RNA, are described hereinbelow with reference to Table 2.

As mentioned hereinabove with reference to FIG. 1, a function of VGAM647 gene, herein designated VGAM is inhibition of expression of VGAM647 target genes. It is appreciated that specific functions, and accordingly utilities, of VGAM647 correlate with, and may be deduced from, the identity of the target genes which VGAM647 binds and inhibits, and the function of these target genes, as elaborated hereinbelow.

Phosphoinositide-3-kinase, Regulatory Subunit, Polypeptide 2 (p85 beta) (PIK3R2, Accession NM_005027) is a VGAM647 host target gene. PIK3R2 BINDING SITE is HOST TARGET binding site found in the 3' untranslated region of mRNA encoded by PIK3R2, corresponding to a HOST TARGET binding site such as BINDING SITE I, BINDING SITE II or BINDING SITE III. Table 2 illustrates the complementarity of the nucleotide sequences of PIK3R2 BINDING SITE, designated SEQ ID:11466, to the nucleotide sequence of VGAM647 RNA, herein designated VGAM RNA, also designated SEQ ID:3358.

A function of VGAM647 is therefore inhibition of Phosphoinositide-3-kinase, Regulatory Subunit, Polypeptide 2 (p85 beta) (PIK3R2, Accession NM_005027), a gene which acts as an adapter and is regulatory subunit (p85 beta) of phosphatidylinositol 3-kinase. Accordingly, utilities of VGAM647 include diagnosis, prevention and treatment of diseases and clinical conditions associated with PIK3R2. The function of PIK3R2 has been established by previous studies. Otsu et al. (1991) showed that the bovine PI3-kinase p85 subunit consists of 2 closely related proteins, p85-alpha (OMIM Ref. No. 171833) and p85-beta. They cloned cDNAs encoding both p85 subunits, each of which is 724 amino acids long. The subunits share 62% amino acid identity across their entire length. Both sequences contain an N-terminal SH3 region, 2 SH2 regions, and a region of homology to BCR (OMIM Ref. No. 151410). Functional expression studies showed that both p85 subunits bind to tyrosine kinase receptors. Janssen et al. (1998) analyzed DNA from a patient with chronic myeloproliferative disorder. They identified an oncogenic fusion of the 5-prime end of p85-beta and the 3-prime end of HUMORF8 (OMIM Ref. No. 603158). Janssen et al. (1998) determined the human p85-beta cDNA sequence.

Full details of the abovementioned studies are described in the following publications, the disclosure of which are hereby incorporated by reference:

Janssen, J. W. G.; Schleithoff, L.; Bartram, C. R.; Schulz, A. S.: An oncogenic fusion product of the phosphatidylinositol 3-kinase p85-beta subunit and HUMORF8, a putative deubiquitinating enzyme. Oncogene 16:1767-1772, 1998; and Otsu, M.; Hiles, I.; Gout, I.; Fry, M. J.; Ruiz-Larrea, F.; Panayotou, G.; Thompson, A.; Dhand, R.; Hsuan, J.; Totty, N.; Smith, A. D.; Morgan, S. J.; Courtneidge, S. A.; Parker, P. J.

Further studies establishing the function and utilities of PIK3R2 are found in John Hopkins OMIM database record ID 603157, and in sited publications numbered 2427, 383 and 3842 listed in the bibliography section hereinbelow, which are also hereby incorporated by reference. Protein Tyrosine Phosphatase, Receptor Type, C (PTPRC, Accession NM_002838) is another VGAM647 host target gene. PTPRC BINDING SITE1 and PTPRC BINDING SITE2 are HOST TARGET binding sites found in untranslated regions of mRNA encoded by PTPRC, corresponding to HOST TARGET binding sites such as BINDING SITE I, BINDING SITE II or BINDING SITE III. Table 2 illustrates the complementarity of the nucleotide sequences of PTPRC BINDING SITE1 and PTPRC BINDING SITE2, designated SEQ ID:8718 and SEQ ID:28144 respectively, to the nucleotide sequence of VGAM647 RNA, herein designated VGAM RNA, also designated SEQ ID:3358.

Another function of VGAM647 is therefore inhibition of Protein Tyrosine Phosphatase, Receptor Type, C (PTPRC, Accession NM_002838). Accordingly, utilities of VGAM647 include diagnosis, prevention and treatment of diseases and clinical conditions associated with PTPRC. TAF5 RNA Polymerase II, TATA Box Binding Protein (TBP)-associated Factor, 100 kDa (TAF5, Accession NM_006951) is another VGAM647 host target gene. TAF5 BINDING SITE1 and TAF5 BINDING SITE2 are HOST TARGET binding sites found in untranslated regions of mRNA encoded by TAF5, corresponding to HOST TARGET binding sites such as BINDING SITE I, BINDING SITE II or BINDING SITE III. Table 2 illustrates the complementarity of the nucleotide sequences of TAF5 BINDING SITE1 and TAF5 BINDING SITE2, designated SEQ ID:13837 and SEQ ID:14337 respectively, to the nucleotide sequence of VGAM647 RNA, herein designated VGAM RNA, also designated SEQ ID:3358.

Another function of VGAM647 is therefore inhibition of TAF5 RNA Polymerase II, TATA Box Binding Protein (TBP)-associated Factor, 100 kDa (TAF5, Accession NM_006951), a gene which is involved as a modulator or transducer in various transmembrane signaling systems. Accordingly, utilities of VGAM647 include diagnosis, prevention and treatment of diseases and clinical conditions associated with TAF5. The function of TAF5 has been established by previous studies. Dubrovskaya et al. (1996) characterized a human TAF, called TAFII100 by them, which is homologous to Drosophila TAFII80 (65% similar) and yeast TAFII90 (57% similar). They cloned a TAFII100 cDNA that encodes a 799-amino acid polypeptide with a calculated molecular mass of 87.9 kD; however, both endogenous and recombinant proteins have an electrophoretically determined relative mass of 100 kD. By deletional analysis, Dubrovskaya et al. (1996) showed that the C-terminal, WD-40 repeat-containing domain is not required for incorporation into the TFIID complex. Independently, Tanese et al. (1996) cloned and characterized the C-terminal 801 amino acids of TAFII100. They suggested that, since the N-terminal amino acid sequence obtained from sequencing the endogenous protein is different from the N-terminal sequence predicted by the cloned gene, the full-length TAFII100 gene (also symbolized TAF2D) probably encodes a short peptide sequence upstream of their putative initiation methionine and that of Dubrovskaya et al. (1996).

Full details of the abovementioned studies are described in the following publications, the disclosure of which are hereby incorporated by reference:

Dubrovskaya, V.; Lavigne, A.-C.; Davidson, I.; Acker, J.; Staub, A.; Tora, L.: Distinct domains of hTAFII100 are required for functional interaction with transcription factor TFIIF-beta (RAP30) and incorporation into the TFIID complex. EMBO J. 15:3702-3712, 1996; and Tanese, N.; Saluja, D.; Vassallo, M. F.; Chen, J.-L.; Admon, A.: Molecular cloning and analysis of two subunits of the human TFIID complex: hTAFII130 and hTAFII100. Proc. Nat. Acad. Sc.

Further studies establishing the function and utilities of TAF5 are found in John Hopkins OMIM database record ID 601787, and in sited publications numbered 1276-1279 listed in the bibliography section hereinbelow, which are also hereby incorporated by reference. KIAA0061 (Accession XM_043094) is another VGAM647 host target gene. KIAA0061 BINDING SITE is HOST TARGET binding site found in the 3' untranslated region of mRNA encoded by KIAA0061, corresponding to a HOST TARGET binding site such as BINDING SITE I, BINDING SITE II or BINDING SITE III. Table 2 illustrates the complementarity of the nucleotide sequences of KIAA0061 BINDING SITE, designated SEQ ID:33894, to the nucleotide sequence of VGAM647 RNA, herein designated VGAM RNA, also designated SEQ ID:3358.

Another function of VGAM647 is therefore inhibition of KIAA0061 (Accession XM_043094). Accordingly, utilities of VGAM647 include diagnosis, prevention and treatment of diseases and clinical conditions associated with KIAA0061. NAG73 (Accession NM_032570) is another VGAM647 host target gene. NAG73 BINDING SITE is HOST TARGET binding site found in the 5' untranslated region of mRNA encoded by NAG73, corresponding to a HOST TARGET binding site such as BINDING SITE I, BINDING SITE II or BINDING SITE III. Table 2 illustrates the complementarity of the nucleotide sequences of NAG73 BINDING SITE, designated SEQ ID:26301, to the nucleotide sequence of VGAM647 RNA, herein designated VGAM RNA, also designated SEQ ID:3358.

Another function of VGAM647 is therefore inhibition of NAG73 (Accession NM_032570). Accordingly, utilities of VGAM647 include diagnosis, prevention and treatment of diseases and clinical conditions associated with NAG73. P450RAI-2 (Accession NM_019885) is another VGAM647 host target gene. P450RAI-2 BINDING SITE is HOST TARGET binding site found in the 3' untranslated region of mRNA encoded by P450RAI-2, corresponding to a HOST TARGET binding site such as BINDING SITE I, BINDING SITE II or BINDING SITE III. Table 2 illustrates the complementarity of the nucleotide sequences of P450RAI-2 BINDING SITE, designated SEQ ID:21266, to the nucleotide sequence of VGAM647 RNA, herein designated VGAM RNA, also designated SEQ ID:3358.

Another function of VGAM647 is therefore inhibition of P450RAI-2 (Accession NM_019885). Accordingly, utilities of VGAM647 include diagnosis, prevention and treatment of diseases and clinical conditions associated with P450RAI-2. LOC123242 (Accession XM_063548) is another VGAM647 host target gene. LOC123242 BINDING SITE is HOST TARGET binding site found in the 5' untranslated region of mRNA encoded by LOC123242, corresponding to a HOST TARGET binding site such as BINDING SITE I, BINDING SITE II or BINDING SITE III. Table 2 illustrates the complementarity of the nucleotide sequences of LOC123242 BINDING SITE, designated SEQ ID:37249, to the nucleotide sequence of VGAM647 RNA, herein designated VGAM RNA, also designated SEQ ID:3358.

Another function of VGAM647 is therefore inhibition of LOC123242 (Accession XM_063548). Accordingly, utilities of VGAM647 include diagnosis, prevention and treatment of diseases and clinical conditions associated with LOC123242. LOC253001 (Accession XM_171711) is another VGAM647 host target gene. LOC253001 BINDING SITE is HOST TARGET binding site found in the 5' untranslated region of mRNA encoded by LOC253001, corresponding to a HOST TARGET binding site such as BINDING SITE I, BINDING SITE II or BINDING SITE III. Table 2 illustrates the complementarity of the nucleotide sequences of LOC253001 BINDING SITE, designated SEQ ID:46063, to the nucleotide sequence of VGAM647 RNA, herein designated VGAM RNA, also designated SEQ ID:3358.

Another function of VGAM647 is therefore inhibition of LOC253001 (Accession XM_171711). Accordingly, utilities of VGAM647 include diagnosis, prevention and treatment of diseases and clinical conditions associated with LOC253001. FIG. 1 further provides a conceptual description of a novel bioinformatically detected viral gene of the present invention, referred to here as Viral Genomic Address Messenger 648 (VGAM648) viral gene, which modulates expression of respective host target genes thereof, the function and utility of which host target genes is known in the art.

VGAM648 is a novel bioinformatically detected regulatory, non protein coding, viral micro RNA (miRNA) gene. The method by which VGAM648 was detected is described hereinabove with reference to FIGS. 1-8.

VGAM648 gene, herein designated VGAM GENE, is a viral gene contained in the genome of Acute Bee Paralysis Virus. VGAM648 host target gene, herein designated VGAM HOST TARGET GENE, is a human gene contained in the human genome.

VGAM648 gene encodes a VGAM648 precursor RNA, herein designated VGAM PRECURSOR RNA. Similar to other miRNA genes, and unlike most ordinary genes, VGAM648 precursor RNA does not encode a protein. A nucleotide sequence identical or highly similar to the nucleotide sequence of VGAM648 precursor RNA is designated SEQ ID:634, and is provided hereinbelow with reference to the sequence listing part. Nucleotide sequence SEQ ID:634 is located at position 5074 relative to the genome of Acute Bee Paralysis Virus.

VGAM648 precursor RNA folds onto itself, forming VGAM648 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM648 folded precursor RNA into VGAM648 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 86%) nucleotide sequence of VGAM648 RNA is designated SEQ ID:3359, and is provided hereinbelow with reference to the sequence listing part.

VGAM648 host target gene, herein designated VGAM HOST TARGET GENE, encodes a corresponding messenger RNA, VGAM648 host target RNA, herein designated VGAM HOST TARGET RNA. VGAM648 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM648 RNA, herein designated VGAM RNA, binds complementarily to one or more host target binding sites located in untranslated regions of VGAM648 host target RNA, herein designated VGAM HOST TARGET RNA. This complementary binding is due to the fact that the nucleotide sequence of VGAM648 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM648 RNA, herein designated VGAM RNA, may have a different number of host target binding sites in untranslated regions of a VGAM648 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM648 RNA, herein designated VGAM RNA, to host target binding sites on VGAM648 host target RNA, herein designated VGAM HOST TARGET RNA, such as BINDING SITE I, BINDING SITE II and BINDING SITE III, inhibits translation of VGAM648 host target RNA into VGAM648 host target protein, herein designated VGAM HOST TARGET PROTEIN. VGAM host target protein is therefore outlined by a broken line.

It is appreciated that VGAM648 host target gene, herein designated VGAM HOST TARGET GENE, in fact represents a plurality of VGAM648 host target genes. The mRNA of each one of this plurality of VGAM648 host target genes comprises one or more host target binding sites, each having a nucleotide sequence which is at least partly complementary to VGAM648 RNA, herein designated VGAM RNA, and which when bound by VGAM648 RNA causes inhibition of translation of respective one or more VGAM648 host target proteins.

It is further appreciated by one skilled in the art that the mode of translational inhibition illustrated by FIG. 1 with specific reference to translational inhibition exerted by VGAM648 gene, herein designated VGAM GENE, on one or more VGAM648 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM648 is inhibition of expression of host target genes, as part of a novel viral mechanism of attacking a host. Accordingly, utilities of VGAM648 include diagnosis, prevention and treatment of viral infection by Acute Bee Paralysis Virus. Specific functions, and accordingly utilities, of VGAM648 correlate with, and may be deduced from, the identity of the host target genes which VGAM648 binds and inhibits, and the function of these host target genes, as elaborated hereinbelow.

Nucleotide sequences of the VGAM648 precursor RNA, herein designated VGAM PRECURSOR RNA, and of the 'diced' VGAM648 RNA, herein designated VGAM RNA, and a schematic representation of the secondary folding of VGAM648 folded precursor RNA, herein designated VGAM FOLDED PRECURSOR RNA, of VGAM648 are further described hereinbelow with reference to Table 1.

Nucleotide sequences of host target binding sites, such as BINDING SITE-I, BINDING SITE-II and BINDING SITE-III of FIG. 1, found on VGAM648 host target RNA, and schematic representation of the complementarity of each of these host target binding sites to VGAM648 RNA, herein designated VGAM RNA, are described hereinbelow with reference to Table 2.

As mentioned hereinabove with reference to FIG. 1, a function of VGAM648 gene, herein designated VGAM is inhibition of expression of VGAM648 target genes. It is appreciated that specific functions, and accordingly utilities, of VGAM648 correlate with, and may be deduced from, the identity of the target genes which VGAM648 binds and inhibits, and the function of these target genes, as elaborated hereinbelow.

Cytochrome P450, Subfamily XIX (aromatization of androgens) (CYP19, Accession NM_000103) is a VGAM648 host target gene. CYP19 BINDING SITE1 and CYP19 BINDING SITE2 are HOST TARGET binding sites found in untranslated regions of mRNA encoded by CYP19, corresponding to HOST TARGET binding sites such as BINDING SITE I, BINDING SITE II or BINDING SITE III. Table 2 illustrates the complementarity of the nucleotide sequences of CYP19 BINDING SITE1 and CYP19 BINDING SITE2, designated SEQ ID:5561 and SEQ ID:25271 respectively, to the nucleotide sequence of VGAM648 RNA, herein designated VGAM RNA, also designated SEQ ID:3359.

A function of VGAM648 is therefore inhibition of Cytochrome P450, Subfamily XIX (aromatization of androgens)

(CYP19, Accession NM_000103), a gene which catalyzes the last steps of estrogen biosynthesis. Accordingly, utilities of VGAM648 include diagnosis, prevention and treatment of diseases and clinical conditions associated with CYP19. The function of CYP19 and its association with various diseases and clinical conditions, has been established by previous studies, as described hereinabove with reference to VGAM508. Jerky Homolog (mouse) (JRK, Accession XM_098818) is another VGAM648 host target gene. JRK BINDING SITE is HOST TARGET binding site found in the 5' untranslated region of mRNA encoded by JRK, corresponding to a HOST TARGET binding site such as BINDING SITE I, BINDING SITE II or BINDING SITE III. Table 2 illustrates the complementarity of the nucleotide sequences of JRK BINDING SITE, designated SEQ ID:41835, to the nucleotide sequence of VGAM648 RNA, herein designated VGAM RNA, also designated SEQ ID:3359.

Another function of VGAM648 is therefore inhibition of Jerky Homolog (mouse) (JRK, Accession XM_098818), a gene which might function as a DNA-binding protein. Accordingly, utilities of VGAM648 include diagnosis, prevention and treatment of diseases and clinical conditions associated with JRK. The function of JRK and its association with various diseases and clinical conditions, has been established by previous studies, as described hereinabove with reference to VGAM210. Killer Cell Lectin-like Receptor Subfamily G, Member 1 (KLRG1, Accession NM_005810) is another VGAM648 host target gene. KLRG1 BINDING SITE is HOST TARGET binding site found in the 3' untranslated region of mRNA encoded by KLRG1, corresponding to a HOST TARGET binding site such as BINDING SITE I, BINDING SITE II or BINDING SITE III. Table 2 illustrates the complementarity of the nucleotide sequences of KLRG1 BINDING SITE, designated SEQ ID:12392, to the nucleotide sequence of VGAM648 RNA, herein designated VGAM RNA, also designated SEQ ID:3359.

Another function of VGAM648 is therefore inhibition of Killer Cell Lectin-like Receptor Subfamily G, Member 1 (KLRG1, Accession NM_005810), a gene which plays a role in host defense. Accordingly, utilities of VGAM648 include diagnosis, prevention and treatment of diseases and clinical conditions associated with KLRG1. The function of KLRG1 has been established by previous studies. Inhibitory lectin-like receptors expressed on the surface of hematopoietic cells regulate immunocyte effector functions through interactions with specific ligands. For example, major histocompatibility complex (MHC) class I molecules are recognized by natural killer (NK) cells. All of these inhibitory receptors contain a cytoplasmic immunoreceptor tyrosine-based inhibitory motif, or ITIM. Upon MHC I engagement and tyrosine phosphorylation of the ITIM, intracellular tyrosine protein phosphatases such as SHP1 (PTPN6; 176883) are recruited to the ITIM, and an inhibitory signal cascade leads to the abrogation of NK cell activation. By searching an EST database for sequences similar to the ITIM-bearing rat mast cell function-associated antigen (MAFA), Butcher et al. (1998) and Hanke et al. (1998) identified clones encoding KLRG1, which Butcher et al. (1998) designated 'MAFA-like' (MAFAL). Using PCR analysis on a basophil-like leukemia cell line and human lung mast cells, Lamers et al. (1998) also isolated a cDNA encoding KLRG1, which they called MAFA. The deduced 189-amino acid KLRG1 is a type II transmembrane protein containing a C-type lectin carbohydrate recognition domain, an intracellular ITIM-like motif, and 4 potential N-glycosylation sites. Northern blot analysis by Butcher et al. (1998) detected a 1-kb KLRG1 transcript in spleen, lymph node, and peripheral blood leukocytes. By RT-PCR analysis, Butcher et al. (1998) found expression of KLRG1 in peripheral blood NK cells, a monocytic cell line, and a basophilic leukemia cell line; expression was not found in decidual NK cells, B cells, and T cells.

Full details of the abovementioned studies are described in the following publications, the disclosure of which are hereby incorporated by reference:

Lamers, M. B. A. C.; Lamont, A. G.; Williams, D. H.: Human MAFA has alternatively spliced variants. Biochim. Biophys. Acta 1399:209-212, 1998. ; and Voehringer, D.; Kaufmann, M.; Pircher, H.: Genomic structure, alternative splicing, and physical mapping of the killer cell lectin-like receptor G1 gene (KLRG1), the mouse homologue of.

Further studies establishing the function and utilities of KLRG1 are found in John Hopkins OMIM database record ID 604874, and in sited publications numbered 6754-6757 listed in the bibliography section hereinbelow, which are also hereby incorporated by reference. ERp44 (Accession XM_088476) is another VGAM648 host target gene. ERp44 BINDING SITE is HOST TARGET binding site found in the 3' untranslated region of mRNA encoded by ERp44, corresponding to a HOST TARGET binding site such as BINDING SITE I, BINDING SITE II or BINDING SITE III. Table 2 illustrates the complementarity of the nucleotide sequences of ERp44 BINDING SITE, designated SEQ ID:39725, to the nucleotide sequence of VGAM648 RNA, herein designated VGAM RNA, also designated SEQ ID:3359.

Another function of VGAM648 is therefore inhibition of ERp44 (Accession XM_088476). Accordingly, utilities of VGAM648 include diagnosis, prevention and treatment of diseases and clinical conditions associated with ERp44. FLJ10546 (Accession XM_002989) is another VGAM648 host target gene. FLJ10546 BINDING SITE is HOST TARGET binding site found in the 3' untranslated region of mRNA encoded by FLJ10546, corresponding to a HOST TARGET binding site such as BINDING SITE I, BINDING SITE II or BINDING SITE III. Table 2 illustrates the complementarity of the nucleotide sequences of FLJ10546 BINDING SITE, designated SEQ ID:29914, to the nucleotide sequence of VGAM648 RNA, herein designated VGAM RNA, also designated SEQ ID:3359.

Another function of VGAM648 is therefore inhibition of FLJ10546 (Accession XM_002989). Accordingly, utilities of VGAM648 include diagnosis, prevention and treatment of diseases and clinical conditions associated with FLJ10546. FLJ21438 (Accession XM_029084) is another VGAM648 host target gene. FLJ21438 BINDING SITE is HOST TARGET binding site found in the 3' untranslated region of mRNA encoded by FLJ21438, corresponding to a HOST TARGET binding site such as BINDING SITE I, BINDING SITE II or BINDING SITE III. Table 2 illustrates the complementarity of the nucleotide sequences of FLJ21438 BINDING SITE, designated SEQ ID:30847, to the nucleotide sequence of VGAM648 RNA, herein designated VGAM RNA, also designated SEQ ID:3359.

Another function of VGAM648 is therefore inhibition of FLJ21438 (Accession XM_029084). Accordingly, utilities of VGAM648 include diagnosis, prevention and treatment of diseases and clinical conditions associated with FLJ21438. KIAA1115 (Accession NM_014931) is another VGAM648 host target gene. KIAA1115 BINDING SITE is HOST TARGET binding site found in the 5' untranslated region of mRNA encoded by KIAA1115, corresponding to a HOST TARGET binding site such as BINDING SITE I, BINDING SITE II or BINDING SITE III. Table 2 illustrates the complementarity of the nucleotide sequences of KIAA1115 BIND- ING SITE, designated SEQ ID:17228, to the nucleotide sequence of VGAM648 RNA, herein designated VGAM RNA, also designated SEQ ID:3359.

Another function of VGAM648 is therefore inhibition of KIAA1115 (Accession NM_014931). Accordingly, utilities of VGAM648 include diagnosis, prevention and treatment of diseases and clinical conditions associated with KIAA1115. SWI/SNF Related, Matrix Associated, Actin Dependent Regulator of Chromatin, Subfamily F, Member 1 (SMARCF1, Accession NM_018450) is another VGAM648 host target gene. SMARCF1 BINDING SITE is HOST TARGET binding site found in the 3' untranslated region of mRNA encoded by SMARCF1, corresponding to a HOST TARGET binding site such as BINDING SITE I, BINDING SITE II or BINDING SITE III. Table 2 illustrates the complementarity of the nucleotide sequences of SMARCF1 BINDING SITE, designated SEQ ID:20522, to the nucleotide sequence of VGAM648 RNA, herein designated VGAM RNA, also designated SEQ ID:3359.

Another function of VGAM648 is therefore inhibition of SWI/SNF Related, Matrix Associated, Actin Dependent Regulator of Chromatin, Subfamily F, Member 1 (SMARCF1, Accession NM_018450). Accordingly, utilities of VGAM648 include diagnosis, prevention and treatment of diseases and clinical conditions associated with SMARCF1. LOC90297 (Accession XM_030742) is another VGAM648 host target gene. LOC90297 BINDING SITE is HOST TARGET binding site found in the 5' untranslated region of mRNA encoded by LOC90297, corresponding to a HOST TARGET binding site such as BINDING SITE I, BINDING SITE II or BINDING SITE III. Table 2 illustrates the complementarity of the nucleotide sequences of LOC90297 BINDING SITE, designated SEQ ID:31131, to the nucleotide sequence of VGAM648 RNA, herein designated VGAM RNA, also designated SEQ ID:3359.

Another function of VGAM648 is therefore inhibition of LOC90297 (Accession XM_030742). Accordingly, utilities of VGAM648 include diagnosis, prevention and treatment of diseases and clinical conditions associated with LOC90297. LOC90785 (Accession XM_034110) is another VGAM648 host target gene. LOC90785 BINDING SITE is HOST TARGET binding site found in the 3' untranslated region of mRNA encoded by LOC90785, corresponding to a HOST TARGET binding site such as BINDING SITE I, BINDING SITE II or BINDING SITE III. Table 2 illustrates the complementarity of the nucleotide sequences of LOC90785 BINDING SITE, designated SEQ ID:32007, to the nucleotide sequence of VGAM648 RNA, herein designated VGAM RNA, also designated SEQ ID:3359.

Another function of VGAM648 is therefore inhibition of LOC90785 (Accession XM_034110). Accordingly, utilities of VGAM648 include diagnosis, prevention and treatment of diseases and clinical conditions associated with LOC90785. FIG. 1 further provides a conceptual description of a novel bioinformatically detected viral gene of the present invention, referred to here as Viral Genomic Address Messenger 649 (VGAM649) viral gene, which modulates expression of respective host target genes thereof, the function and utility of which host target genes is known in the art.

VGAM649 is a novel bioinformatically detected regulatory, non protein coding, viral micro RNA (miRNA) gene. The method by which VGAM649 was detected is described hereinabove with reference to FIGS. 1-8.

VGAM649 gene, herein designated VGAM GENE, is a viral gene contained in the genome of Acute Bee Paralysis Virus. VGAM649 host target gene, herein designated VGAM HOST TARGET GENE, is a human gene contained in the human genome.

VGAM649 gene encodes a VGAM649 precursor RNA, herein designated VGAM PRECURSOR RNA. Similar to other miRNA genes, and unlike most ordinary genes, VGAM649 precursor RNA does not encode a protein. A nucleotide sequence identical or highly similar to the nucleotide sequence of VGAM649 precursor RNA is designated SEQ ID:635, and is provided hereinbelow with reference to the sequence listing part. Nucleotide sequence SEQ ID:635 is located at position 5290 relative to the genome of Acute Bee Paralysis Virus.

VGAM649 precursor RNA folds onto itself, forming VGAM649 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM649 folded precursor RNA into VGAM649 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM649 RNA is designated SEQ ID:3360, and is provided hereinbelow with reference to the sequence listing part.

VGAM649 host target gene, herein designated VGAM HOST TARGET GENE, encodes a corresponding messenger RNA, VGAM649 host target RNA, herein designated VGAM HOST TARGET RNA. VGAM649 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM649 RNA, herein designated VGAM RNA, binds complementarily to one or more host target binding sites located in untranslated regions of VGAM649 host target RNA, herein designated VGAM HOST TARGET RNA. This complementary binding is due to the fact that the nucleotide sequence of VGAM649 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM649 RNA, herein designated VGAM RNA, may have a different number of host target binding sites in untranslated regions of a VGAM649 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM649 RNA, herein designated VGAM RNA, to host target binding sites on VGAM649 host target RNA, herein designated VGAM HOST TARGET RNA, such as BINDING SITE I, BINDING SITE II and BINDING SITE III, inhibits translation of VGAM649 host target RNA into VGAM649 host target protein, herein designated VGAM HOST TARGET PROTEIN.

VGAM host target protein is therefore outlined by a broken line.

It is appreciated that VGAM649 host target gene, herein designated VGAM HOST TARGET GENE, in fact represents a plurality of VGAM649 host target genes. The mRNA of each one of this plurality of VGAM649 host target genes comprises one or more host target binding sites, each having a nucleotide sequence which is at least partly complementary to VGAM649 RNA, herein designated VGAM RNA, and which when bound by VGAM649 RNA causes inhibition of translation of respective one or more VGAM649 host target proteins.

It is further appreciated by one skilled in the art that the mode of translational inhibition illustrated by FIG. 1 with specific reference to translational inhibition exerted by VGAM649 gene, herein designated VGAM GENE, on one or more VGAM649 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM649 is inhibition of expression of host target genes, as part of a novel viral mechanism of attacking a host. Accordingly, utilities of VGAM649 include diagnosis, prevention and treatment of viral infection by Acute Bee Paralysis Virus. Specific functions, and accordingly utilities, of VGAM649 correlate with, and may be deduced from, the identity of the host target genes which VGAM649 binds and inhibits, and the function of these host target genes, as elaborated hereinbelow.

Nucleotide sequences of the VGAM649 precursor RNA, herein designated VGAM PRECURSOR RNA, and of the 'diced' VGAM649 RNA, herein designated VGAM RNA, and a schematic representation of the secondary folding of VGAM649 folded precursor RNA, herein designated VGAM FOLDED PRECURSOR RNA, of VGAM649 are further described hereinbelow with reference to Table 1.

Nucleotide sequences of host target binding sites, such as BINDING SITE-I, BINDING SITE-II and BINDING SITE-III of FIG. 1, found on VGAM649 host target RNA, and schematic representation of the complementarity of each of these host target binding sites to VGAM649 RNA, herein designated VGAM RNA, are described hereinbelow with reference to Table 2.

As mentioned hereinabove with reference to FIG. 1, a function of VGAM649 gene, herein designated VGAM is inhibition of expression of VGAM649 target genes. It is appreciated that specific functions, and accordingly utilities, of VGAM649 correlate with, and may be deduced from, the identity of the target genes which VGAM649 binds and inhibits, and the function of these target genes, as elaborated hereinbelow.

Forkhead Box E3 (FOXE3, Accession NM_012186) is a VGAM649 host target gene. FOXE3 BINDING SITE is HOST TARGET binding site found in the 3' untranslated region of mRNA encoded by FOXE3, corresponding to a HOST TARGET binding site such as BINDING SITE I, BINDING SITE II or BINDING SITE III. Table 2 illustrates the complementarity of the nucleotide sequences of FOXE3 BINDING SITE, designated SEQ ID:14470, to the nucleotide sequence of VGAM649 RNA, herein designated VGAM RNA, also designated SEQ ID:3360.

A function of VGAM649 is therefore inhibition of Forkhead Box E3 (FOXE3, Accession NM_012186), a gene which regulates embryonic development. Accordingly, utilities of VGAM649 include diagnosis, prevention and treatment of diseases and clinical conditions associated with FOXE3. The function of FOXE3 and its association with various diseases and clinical conditions, has been established by previous studies, as described hereinabove with reference to VGAM632. Low Density Lipoprotein Receptor-related Protein 8, Apolipoprotein E Receptor (LRP8, Accession NM_004631) is another VGAM649 host target gene. LRP8 BINDING SITE1 and LRP8 BINDING SITE2 are HOST TARGET binding sites found in untranslated regions of mRNA encoded by LRP8, corresponding to HOST TARGET binding sites such as BINDING SITE I, BINDING SITE II or BINDING SITE III. Table 2 illustrates the complementarity of the nucleotide sequences of LRP8 BINDING SITE1 and LRP8 BINDING SITE2, designated SEQ ID:11008 and SEQ ID:27132 respectively, to the nucleotide sequence of VGAM649 RNA, herein designated VGAM RNA, also designated SEQ ID:3360.

Another function of VGAM649 is therefore inhibition of Low Density Lipoprotein Receptor-related Protein 8, Apolipoprotein E Receptor (LRP8, Accession NM_004631), a gene which binds vldl and transports it into cells by endocytosis. Accordingly, utilities of VGAM649 include diagnosis, prevention and treatment of diseases and clinical conditions associated with LRP8. The function of LRP8 and its association with various diseases and clinical conditions, has been established by previous studies, as described hereinabove with reference to VGAM191. Trichorhinophalangeal Syndrome I (TRPS1, Accession NM_014112) is another VGAM649 host target gene. TRPS1 BINDING SITE is HOST TARGET binding site found in the 3' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15359, to the nucleotide sequence of VGAM649 RNA, herein designated VGAM RNA, also designated SEQ ID:3360.

Another function of VGAM649 is therefore inhibition of Trichorhinophalangeal Syndrome I (TRPS1, Accession NM_014112), a gene which may function as a transcriptional activator protein. Accordingly, utilities of VGAM649 include diagnosis, prevention and treatment of diseases and clinical conditions associated with TRPS1. The function of TRPS1 and its association with various diseases and clinical conditions, has been established by previous studies, as described hereinabove with reference to VGAM172. Wilms Tumor 1 (WT1, Accession NM_024424) is another VGAM649 host target gene. WT1 BINDING SITE1 through WT1 BINDING SITE4 are HOST TARGET binding sites found in untranslated regions of mRNA encoded by WT1, corresponding to HOST TARGET binding sites such as BINDING SITE I, BINDING SITE II or BINDING SITE III. Table 2 illustrates the complementarity of the nucleotide sequences of WT1 BINDING SITE1 through WT1 BINDING SITE4, designated SEQ ID:23669, SEQ ID:23673, SEQ ID:23677 and SEQ ID:5953 respectively, to the nucleotide sequence of VGAM649 RNA, herein designated VGAM RNA, also designated SEQ ID:3360.

Another function of VGAM649 is therefore inhibition of Wilms Tumor 1 (WT1, Accession NM_024424). Accordingly, utilities of VGAM649 include diagnosis, prevention and treatment of diseases and clinical conditions associated with WT1. DAMS (Accession NM_022001) is another VGAM649 host target gene. DAMS BINDING SITE is HOST TARGET binding site found in the 3' untranslated region of mRNA encoded by DAMS, corresponding to a HOST TARGET binding site such as BINDING SITE I, BINDING SITE II or BINDING SITE III. Table 2 illustrates the complementarity of the nucleotide sequences of DAMS BINDING SITE, designated SEQ ID:22543, to the nucleotide sequence of VGAM649 RNA, herein designated VGAM RNA, also designated SEQ ID:3360.

Another function of VGAM649 is therefore inhibition of DAMS (Accession NM_022001). Accordingly, utilities of VGAM649 include diagnosis, prevention and treatment of diseases and clinical conditions associated with DAMS. DRIL2 (Accession NM_006465) is another VGAM649 host target gene. DRIL2 BINDING SITE is HOST TARGET binding site found in the 3' untranslated region of mRNA encoded by DRIL2, corresponding to a HOST TARGET binding site such as BINDING SITE I, BINDING SITE II or BINDING SITE III. Table 2 illustrates the complementarity of the nucleotide sequences of DRIL2 BINDING SITE, designated SEQ ID:13191, to the nucleotide sequence of VGAM649 RNA, herein designated VGAM RNA, also designated SEQ ID:3360.

Another function of VGAM649 is therefore inhibition of DRIL2 (Accession NM_006465). Accordingly, utilities of VGAM649 include diagnosis, prevention and treatment of diseases and clinical conditions associated with DRIL2. FLJ13102 (Accession NM_024887) is another VGAM649 host target gene. FLJ13102 BINDING SITE is HOST TARGET binding site found in the 3' untranslated region of mRNA encoded by FLJ13102, corresponding to a HOST TARGET binding site such as BINDING SITE I, BINDING SITE II or BINDING SITE III. Table 2 illustrates the complementarity of the nucleotide sequences of FLJ13102 BINDING SITE, designated SEQ ID:24346, to the nucleotide sequence of VGAM649 RNA, herein designated VGAM RNA, also designated SEQ ID:3360.

Another function of VGAM649 is therefore inhibition of FLJ13102 (Accession NM_024887). Accordingly, utilities of VGAM649 include diagnosis, prevention and treatment of diseases and clinical conditions associated with FLJ13102. FLJ20033 (Accession NM_017629) is another VGAM649 host target gene. FLJ20033 BINDING SITE is HOST TARGET binding site found in the 3' untranslated region of mRNA encoded by FLJ20033, corresponding to a HOST TARGET binding site such as BINDING SITE I, BINDING SITE II or BINDING SITE III. Table 2 illustrates the complementarity of the nucleotide sequences of FLJ20033 BINDING SITE, designated SEQ ID:19127, to the nucleotide sequence of VGAM649 RNA, herein designated VGAM RNA, also designated SEQ ID:3360.

Another function of VGAM649 is therefore inhibition of FLJ20033 (Accession NM_017629). Accordingly, utilities of VGAM649 include diagnosis, prevention and treatment of diseases and clinical conditions associated with FLJ20033. FLJ23441 (Accession NM_024678) is another VGAM649 host target gene. FLJ23441 BINDING SITE is HOST TARGET binding site found in the 5' untranslated region of mRNA encoded by FLJ23441, corresponding to a HOST TARGET binding site such as BINDING SITE I, BINDING SITE II or BINDING SITE III. Table 2 illustrates the complementarity of the nucleotide sequences of FLJ23441 BINDING SITE, designated SEQ ID:23987, to the nucleotide sequence of VGAM649 RNA, herein designated VGAM RNA, also designated SEQ ID:3360.

Another function of VGAM649 is therefore inhibition of FLJ23441 (Accession NM_024678). Accordingly, utilities of VGAM649 include diagnosis, prevention and treatment of diseases and clinical conditions associated with FLJ23441. KIAA1735 (Accession XM_113686) is another VGAM649 host target gene. KIAA1735 BINDING SITE is HOST TARGET binding site found in the 3' untranslated region of mRNA encoded by KIAA1735, corresponding to a HOST TARGET binding site such as BINDING SITE I, BINDING SITE II or BINDING SITE III. Table 2 illustrates the complementarity of the nucleotide sequences of KIAA1735 BINDING SITE, designated SEQ ID:42344, to the nucleotide sequence of VGAM649 RNA, herein designated VGAM RNA, also designated SEQ ID:3360.

Another function of VGAM649 is therefore inhibition of KIAA1735 (Accession XM_113686). Accordingly, utilities of VGAM649 include diagnosis, prevention and treatment of diseases and clinical conditions associated with KIAA1735. MGC2452 (Accession NM_032644) is another VGAM649 host target gene. MGC2452 BINDING SITE is HOST TARGET binding site found in the 3' untranslated region of mRNA encoded by MGC2452, corresponding to a HOST TARGET binding site such as BINDING SITE I, BINDING SITE II or BINDING SITE III. Table 2 illustrates the complementarity of the nucleotide sequences of MGC2452 BINDING SITE, designated SEQ ID:26368, to the nucleotide sequence of VGAM649 RNA, herein designated VGAM RNA, also designated SEQ ID:3360.

Another function of VGAM649 is therefore inhibition of MGC2452 (Accession NM_032644). Accordingly, utilities of VGAM649 include diagnosis, prevention and treatment of diseases and clinical conditions associated with MGC2452. LOC150225 (Accession XM_097870) is another VGAM649 host target gene. LOC150225 BINDING SITE is HOST TARGET binding site found in the 3' untranslated region of mRNA encoded by LOC150225, corresponding to a HOST TARGET binding site such as BINDING SITE I, BINDING SITE II or BINDING SITE III. Table 2 illustrates the complementarity of the nucleotide sequences of LOC150225 BINDING SITE, designated SEQ ID:41186, to the nucleotide sequence of VGAM649 RNA, herein designated VGAM RNA, also designated SEQ ID:3360.

Another function of VGAM649 is therefore inhibition of LOC150225 (Accession XM_097870). Accordingly, utilities of VGAM649 include diagnosis, prevention and treatment of diseases and clinical conditions associated with LOC150225. LOC157627 (Accession XM_088347) is another VGAM649 host target gene. LOC157627 BINDING SITE is HOST TARGET binding site found in the 3' untranslated region of mRNA encoded by LOC157627, corresponding to a HOST TARGET binding site such as BINDING SITE I, BINDING SITE II or BINDING SITE III. Table 2 illustrates the complementarity of the nucleotide sequences of LOC157627 BINDING SITE, designated SEQ ID:39622, to the nucleotide sequence of VGAM649 RNA, herein designated VGAM RNA, also designated SEQ ID:3360.

Another function of VGAM649 is therefore inhibition of LOC157627 (Accession XM_088347). Accordingly, utilities of VGAM649 include diagnosis, prevention and treatment of diseases and clinical conditions associated with LOC157627. LOC196264 (Accession XM_113683) is another VGAM649 host target gene. LOC196264 BINDING SITE is HOST TARGET binding site found in the 3' untranslated region of mRNA encoded by LOC196264, corresponding to a HOST TARGET binding site such as BINDING SITE I, BINDING SITE II or BINDING SITE III. Table 2 illustrates the complementarity of the nucleotide sequences of LOC196264 BIND- ING SITE, designated SEQ ID:42330, to the nucleotide sequence of VGAM649 RNA, herein designated VGAM RNA, also designated SEQ ID:3360.

Another function of VGAM649 is therefore inhibition of LOC196264 (Accession XM_113683). Accordingly, utilities of VGAM649 include diagnosis, prevention and treatment of diseases and clinical conditions associated with LOC196264. LOC253832 (Accession XM_170739) is another VGAM649 host target gene. LOC253832 BINDING SITE is HOST TARGET binding site found in the 3' untranslated region of mRNA encoded by LOC253832, corresponding to a HOST TARGET binding site such as BINDING SITE I, BINDING SITE II or BINDING SITE III. Table 2 illustrates the complementarity of the nucleotide sequences of LOC253832 BINDING SITE, designated SEQ ID:45499, to the nucleotide sequence of VGAM649 RNA, herein designated VGAM RNA, also designated SEQ ID:3360.

Another function of VGAM649 is therefore inhibition of LOC253832 (Accession XM_170739). Accordingly, utilities of VGAM649 include diagnosis, prevention and treatment of diseases and clinical conditions associated with LOC253832. LOC255082 (Accession XM_172843) is another VGAM649 host target gene. LOC255082 BINDING SITE is HOST TARGET binding site found in the 5' untranslated region of mRNA encoded by LOC255082, corresponding to a HOST TARGET binding site such as BINDING SITE I, BINDING SITE II or BINDING SITE III. Table 2 illustrates the complementarity of the nucleotide sequences of LOC255082 BINDING SITE, designated SEQ ID:46116, to the nucleotide sequence of VGAM649 RNA, herein designated VGAM RNA, also designated SEQ ID:3360.

Another function of VGAM649 is therefore inhibition of LOC255082 (Accession XM_172843). Accordingly, utilities of VGAM649 include diagnosis, prevention and treatment of diseases and clinical conditions associated with LOC255082. FIG. 1 further provides a conceptual description of a novel bioinformatically detected viral gene of the present invention, referred to here as Viral Genomic Address Messenger 650 (VGAM650) viral gene, which modulates expression of respective host target genes thereof, the function and utility of which host target genes is known in the art.

VGAM650 is a novel bioinformatically detected regulatory, non protein coding, viral micro RNA (miRNA) gene. The method by which VGAM650 was detected is described hereinabove with reference to FIGS. 1-8.

VGAM650 gene, herein designated VGAM GENE, is a viral gene contained in the genome of Saimiriine Herpesvirus 2. VGAM650 host target gene, herein designated VGAM HOST TARGET GENE, is a human gene contained in the human genome.

VGAM650 gene encodes a VGAM650 precursor RNA, herein designated VGAM PRECURSOR RNA. Similar to other miRNA genes, and unlike most ordinary genes, VGAM650 precursor RNA does not encode a protein. A nucleotide sequence identical or highly similar to the nucleotide sequence of VGAM650 precursor RNA is designated SEQ ID:636, and is provided hereinbelow with reference to the sequence listing part. Nucleotide sequence SEQ ID:636 is located at position 10659 relative to the genome of Saimiriine Herpesvirus 2.

VGAM650 precursor RNA folds onto itself, forming VGAM650 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM650 folded precursor RNA into VGAM650 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM650 RNA is designated SEQ ID:3361, and is provided hereinbelow with reference to the sequence listing part.

VGAM650 host target gene, herein designated VGAM HOST TARGET GENE, encodes a corresponding messenger RNA, VGAM650 host target RNA, herein designated VGAM HOST TARGET RNA. VGAM650 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM650 RNA, herein designated VGAM RNA, binds complementarily to one or more host target binding sites located in untranslated regions of VGAM650 host target RNA, herein designated VGAM HOST TARGET RNA. This complementary binding is due to the fact that the nucleotide sequence of VGAM650 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM650 RNA, herein designated VGAM RNA, may have a different number of host target binding sites in untranslated regions of a VGAM650 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM650 RNA, herein designated VGAM RNA, to host target binding sites on VGAM650 host target RNA, herein designated VGAM HOST TARGET RNA, such as BINDING SITE I, BINDING SITE II and BINDING SITE III, inhibits translation of VGAM650 host target RNA into VGAM650 host target protein, herein designated VGAM HOST TARGET PROTEIN. VGAM host target protein is therefore outlined by a broken line.

It is appreciated that VGAM650 host target gene, herein designated VGAM HOST TARGET GENE, in fact represents a plurality of VGAM650 host target genes. The mRNA of each one of this plurality of VGAM650 host target genes comprises one or more host target binding sites, each having a nucleotide sequence which is at least partly complementary to VGAM650 RNA, herein designated VGAM RNA, and which when bound by VGAM650 RNA causes inhibition of translation of respective one or more VGAM650 host target proteins.

It is further appreciated by one skilled in the art that the mode of translational inhibition illustrated by FIG. 1 with specific reference to translational inhibition exerted by VGAM650 gene, herein designated VGAM GENE, on one or more VGAM650 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM650 is inhibition of expression of host target genes, as part of a novel viral mechanism of attacking a host. Accordingly, utilities of VGAM650 include diagnosis, prevention and treatment of viral infection by Saimiriine Herpesvirus 2. Specific functions, and accordingly utilities, of VGAM650 correlate with, and may be deduced from, the identity of the host target genes which VGAM650 binds and inhibits, and the function of these host target genes, as elaborated hereinbelow.

Nucleotide sequences of the VGAM650 precursor RNA, herein designated VGAM PRECURSOR RNA, and of the 'diced' VGAM650 RNA, herein designated VGAM RNA, and a schematic representation of the secondary folding of VGAM650 folded precursor RNA, herein designated VGAM FOLDED PRECURSOR RNA, of VGAM650 are further described hereinbelow with reference to Table 1.

Nucleotide sequences of host target binding sites, such as BINDING SITE-I, BINDING SITE-II and BINDING SITE-III of FIG. 1, found on VGAM650 host target RNA, and schematic representation of the complementarity of each of these host target binding sites to VGAM650 RNA, herein designated VGAM RNA, are described hereinbelow with reference to Table 2.

As mentioned hereinabove with reference to FIG. 1, a function of VGAM650 gene, herein designated VGAM is inhibition of expression of VGAM650 target genes. It is appreciated that specific functions, and accordingly utilities, of VGAM650 correlate with, and may be deduced from, the identity of the target genes which VGAM650 binds and inhibits, and the function of these target genes, as elaborated hereinbelow.

Chorea Acanthocytosis (CHAC, Accession NM_033305) is a VGAM650 host target gene. CHAC BINDING SITE is HOST TARGET binding site found in the 3' untranslated region of mRNA encoded by CHAC, corresponding to a HOST TARGET binding site such as BINDING SITE I, BINDING SITE II or BINDING SITE III. Table 2 illustrates the complementarity of the nucleotide sequences of CHAC BINDING SITE, designated SEQ ID:27138, to the nucleotide sequence of VGAM650 RNA, herein designated VGAM RNA, also designated SEQ ID:3361.

A function of VGAM650 is therefore inhibition of Chorea Acanthocytosis (CHAC, Accession NM_033305), a gene which may regulate the cycling of proteins. Accordingly, utilities of VGAM650 include diagnosis, prevention and treatment of diseases and clinical conditions associated with CHAC. The function of CHAC has been established by previous studies. Rampoldi et al. (2001) identified a novel gene in the choreoacanthocytosis (CHAC; 200150) critical region of 9q with an open reading frame of 9,525 nucleotides encoding a 3,174-amino acid protein. Alignment of the RNA with the genomic sequence demonstrated that the gene is organized into 73 exons in a genomic region of about 250 kb. Northern blot analysis detected 2 bands of high molecular weight corresponding to 2 splice variants in all tissues analyzed. Additionally, RT-PCR detected expression in the erythrocyte precursor cell line K562. Rampoldi et al. (2001) found 16 different mutations in individuals with choreoacanthocytosis. They showed that the CHAC gene encodes an evolutionarily conserved protein and suggested that this protein is involved in protein sorting. In a patient with choreoacanthocytosis (OMIM Ref. No. 200150), Rampoldi et al. (2001) found compound heterozygosity for a 269T-A transversion in exon 4 of the CHAC gene and an insertion of a T between nucleotides 6404 and 6405 in exon 48. The mutations resulted in an ile90-to-lys (I90K) amino acid change and a frameshift, respectively.

Full details of the abovementioned studies are described in the following publications, the disclosure of which are hereby incorporated by reference:

Rampoldi, L.; Dobson-Stone, C.; Rubio, J. P.; Danek, A.; Chalmers, R. M.; Wood, N. W.; Verellen, C.; Ferrer, X.; Malandrini, A.; Fabrizi, G. M.; Brown, R.; Vance, J.; Pericak-Vance, M.; Rudolf, G.; Carre, S.; Alonso, E.; Manfredi, M.; Nemeth, A. H.; Monaco, A. P.: A conserved sorting-associated protein is mutant in chorea-acanthocytosis. Nature Genet. 28:119-120, 2001; and Ueno, S.; Maruki, Y.; Nakamura, M.; Tomemori, Y.; Kamae, K.; Tanabe, H.; Yamashita, Y.; Matsuda, S.; Kaneko, S.; Sano, A.: The gene encoding a newly discovered protein, chorein, is mu.

Further studies establishing the function and utilities of CHAC are found in John Hopkins OMIM database record ID 605978, and in sited publications numbered 10457 listed in the bibliography section hereinbelow, which are also hereby incorporated by reference. HTEX4 (Accession XM_166378) is another VGAM650 host target gene. HTEX4 BINDING SITE1 through HTEX4 BINDING SITE3 are HOST TARGET binding sites found in untranslated regions of mRNA encoded by HTEX4, corresponding to HOST TARGET binding sites such as BINDING SITE I, BINDING SITE II or BINDING SITE III. Table 2 illustrates the complementarity of the nucleotide sequences of HTEX4 BINDING SITE1 through HTEX4 BINDING SITE3, designated SEQ ID:44212, SEQ ID:46648 and SEQ ID:46717 respectively, to the nucleotide sequence of VGAM650 RNA, herein designated VGAM RNA, also designated SEQ ID:3361.

Another function of VGAM650 is therefore inhibition of HTEX4 (Accession XM_166378). Accordingly, utilities of VGAM650 include diagnosis, prevention and treatment of diseases and clinical conditions associated with HTEX4. FIG. 1 further provides a conceptual description of a novel bioinformatically detected viral gene of the present invention, referred to here as Viral Genomic Address Messenger 651 (VGAM651) viral gene, which modulates expression of respective host target genes thereof, the function and utility of which host target genes is known in the art.

VGAM651 is a novel bioinformatically detected regulatory, non protein coding, viral micro RNA (miRNA) gene. The method by which VGAM651 was detected is described hereinabove with reference to FIGS. 1-8.

VGAM651 gene, herein designated VGAM GENE, is a viral gene contained in the genome of Meleagrid Herpesvirus 1. VGAM651 host target gene, herein designated VGAM HOST TARGET GENE, is a human gene contained in the human genome.

VGAM651 gene encodes a VGAM651 precursor RNA, herein designated VGAM PRECURSOR RNA. Similar to other miRNA genes, and unlike most ordinary genes, VGAM651 precursor RNA does not encode a protein. A nucleotide sequence identical or highly similar to the nucleotide sequence of VGAM651 precursor RNA is designated SEQ ID:637, and is provided hereinbelow with reference to the sequence listing part. Nucleotide sequence SEQ ID:637 is located at position 57033 relative to the genome of Meleagrid Herpesvirus 1.

VGAM651 precursor RNA folds onto itself, forming VGAM651 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM651 folded precursor RNA into VGAM651 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM651 RNA is designated SEQ ID:3362, and is provided hereinbelow with reference to the sequence listing part.

VGAM651 host target gene, herein designated VGAM HOST TARGET GENE, encodes a corresponding messenger RNA, VGAM651 host target RNA, herein designated VGAM HOST TARGET RNA. VGAM651 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM651 RNA, herein designated VGAM RNA, binds complementarily to one or more host target binding sites located in untranslated regions of VGAM651 host target RNA, herein designated VGAM HOST TARGET RNA. This complementary binding is due to the fact that the nucleotide sequence of VGAM651 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM651 RNA, herein designated VGAM RNA, may have a different number of host target binding sites in untranslated regions of a VGAM651 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM651 RNA, herein designated VGAM RNA, to host target binding sites on VGAM651 host target RNA, herein designated VGAM HOST TARGET RNA, such as BINDING SITE I, BINDING SITE II and BINDING SITE III, inhibits translation of VGAM651 host target RNA into VGAM651 host target protein, herein designated VGAM HOST TARGET PROTEIN. VGAM host target protein is therefore outlined by a broken line.

It is appreciated that VGAM651 host target gene, herein designated VGAM HOST TARGET GENE, in fact represents a plurality of VGAM651 host target genes. The mRNA of each one of this plurality of VGAM651 host target genes comprises one or more host target binding sites, each having a nucleotide sequence which is at least partly complementary to VGAM651 RNA, herein designated VGAM RNA, and which when bound by VGAM651 RNA causes inhibition of translation of respective one or more VGAM651 host target proteins.

It is further appreciated by one skilled in the art that the mode of translational inhibition illustrated by FIG. 1 with specific reference to translational inhibition exerted by VGAM651 gene, herein designated VGAM GENE, on one or more VGAM651 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM651 is inhibition of expression of host target genes, as part of a novel viral mechanism of attacking a host. Accordingly, utilities of VGAM651 include diagnosis, prevention and treatment of viral infection by Meleagrid Herpesvirus 1. Specific functions, and accordingly utilities, of VGAM651 correlate with, and may be deduced from, the identity of the host target genes which VGAM651 binds and inhibits, and the function of these host target genes, as elaborated hereinbelow.

Nucleotide sequences of the VGAM651 precursor RNA, herein designated VGAM PRECURSOR RNA, and of the 'diced' VGAM651 RNA, herein designated VGAM RNA, and a schematic representation of the secondary folding of VGAM651 folded precursor RNA, herein designated VGAM FOLDED PRECURSOR RNA, of VGAM651 are further described hereinbelow with reference to Table 1.

Nucleotide sequences of host target binding sites, such as BINDING SITE-I, BINDING SITE-II and BINDING SITE-III of FIG. 1, found on VGAM651 host target RNA, and schematic representation of the complementarity of each of these host target binding sites to VGAM651 RNA, herein designated VGAM RNA, are described hereinbelow with reference to Table 2.

As mentioned hereinabove with reference to FIG. 1, a function of VGAM651 gene, herein designated VGAM is inhibition of expression of VGAM651 target genes. It is appreciated that specific functions, and accordingly utilities, of VGAM651 correlate with, and may be deduced from, the identity of the target genes which VGAM651 binds and inhibits, and the function of these target genes, as elaborated hereinbelow.

DKFZP434I092 (Accession XM_042042) is a VGAM651 host target gene. DKFZP434I092 BINDING SITE is HOST TARGET binding site found in the 3' untranslated region of mRNA encoded by DKFZP434I092, corresponding to a HOST TARGET binding site such as BINDING SITE I, BINDING SITE II or BINDING SITE III. Table 2 illustrates the complementarity of the nucleotide sequences of DKFZP434I092 BINDING SITE, designated SEQ ID:33674, to the nucleotide sequence of VGAM651 RNA, herein designated VGAM RNA, also designated SEQ ID:3362.

A function of VGAM651 is therefore inhibition of DKFZP434I092 (Accession XM_042042). Accordingly, utilities of VGAM651 include diagnosis, prevention and treatment of diseases and clinical conditions associated with DKFZP434I092. KIAA0556 (Accession XM_044632) is another VGAM651 host target gene. KIAA0556 BINDING SITE is HOST TARGET binding site found in the 3' untranslated region of mRNA encoded by KIAA0556, corresponding to a HOST TARGET binding site such as BINDING SITE I, BINDING SITE II or BINDING SITE III. Table 2 illustrates the complementarity of the nucleotide sequences of KIAA0556 BINDING SITE, designated SEQ ID:34252, to the nucleotide sequence of VGAM651 RNA, herein designated VGAM RNA, also designated SEQ ID:3362.

Another function of VGAM651 is therefore inhibition of KIAA0556 (Accession XM_044632). Accordingly, utilities of VGAM651 include diagnosis, prevention and treatment of diseases and clinical conditions associated with KIAA0556. LIG-1 (Accession XM_033712) is another VGAM651 host target gene. LIG-1 BINDING SITE is HOST TARGET binding site found in the 3' untranslated region of mRNA encoded by LIG-1, corresponding to a HOST TARGET binding site such as BINDING SITE I, BINDING SITE II or BINDING SITE III. Table 2 illustrates the complementarity of the nucleotide sequences of LIG-1 BINDING SITE, designated SEQ ID:31951, to the nucleotide sequence of VGAM651 RNA, herein designated VGAM RNA, also designated SEQ ID:3362.

Another function of VGAM651 is therefore inhibition of LIG-1 (Accession XM_033712). Accordingly, utilities of VGAM651 include diagnosis, prevention and treatment of diseases and clinical conditions associated with LIG-1. LOC164382 (Accession XM_104390) is another VGAM651 host target gene. LOC164382 BINDING SITE is HOST TARGET binding site found in the 3' untranslated region of mRNA encoded by LOC164382, corresponding to a HOST TARGET binding site such as BINDING SITE I, BINDING SITE II or BINDING SITE III. Table 2 illustrates the complementarity of the nucleotide sequences of LOC164382 BINDING SITE, designated SEQ ID:42163, to the nucleotide sequence of VGAM651 RNA, herein designated VGAM RNA, also designated SEQ ID:3362.

Another function of VGAM651 is therefore inhibition of LOC164382 (Accession XM_104390). Accordingly, utilities of VGAM651 include diagnosis, prevention and treatment of diseases and clinical conditions associated with LOC164382. FIG. 1 further provides a conceptual description of a novel bioinformatically detected viral gene of the present invention, referred to here as Viral Genomic Address Messenger 652 (VGAM652) viral gene, which modulates expression of respective host target genes thereof, the function and utility of which host target genes is known in the art.

VGAM652 is a novel bioinformatically detected regulatory, non protein coding, viral micro RNA (miRNA) gene. The method by which VGAM652 was detected is described hereinabove with reference to FIGS. 1-8.

VGAM652 gene, herein designated VGAM GENE, is a viral gene contained in the genome of Meleagrid Herpesvirus 1. VGAM652 host target gene, herein designated VGAM HOST TARGET GENE, is a human gene contained in the human genome.

VGAM652 gene encodes a VGAM652 precursor RNA, herein designated VGAM PRECURSOR RNA. Similar to other miRNA genes, and unlike most ordinary genes, VGAM652 precursor RNA does not encode a protein. A nucleotide sequence identical or highly similar to the nucleotide sequence of VGAM652 precursor RNA is designated SEQ ID:638, and is provided hereinbelow with reference to the sequence listing part. Nucleotide sequence SEQ ID:638 is located at position 62005 relative to the genome of Meleagrid Herpesvirus 1.

VGAM652 precursor RNA folds onto itself, forming VGAM652 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM652 folded precursor RNA into VGAM652 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM652 RNA is designated SEQ ID:3363, and is provided hereinbelow with reference to the sequence listing part.

VGAM652 host target gene, herein designated VGAM HOST TARGET GENE, encodes a corresponding messenger RNA, VGAM652 host target RNA, herein designated VGAM HOST TARGET RNA. VGAM652 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM652 RNA, herein designated VGAM RNA, binds complementarily to one or more host target binding sites located in untranslated regions of VGAM652 host target RNA, herein designated VGAM HOST TARGET RNA. This complementary binding is due to the fact that the nucleotide sequence of VGAM652 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM652 RNA, herein designated VGAM RNA, may have a different number of host target binding sites in untranslated regions of a VGAM652 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM652 RNA, herein designated VGAM RNA, to host target binding sites on VGAM652 host target RNA, herein designated VGAM HOST TARGET RNA, such as BINDING SITE I, BINDING SITE II and BINDING SITE III, inhibits translation of VGAM652 host target RNA into VGAM652 host target protein, herein designated VGAM HOST TARGET PROTEIN. VGAM host target protein is therefore outlined by a broken line.

It is appreciated that VGAM652 host target gene, herein designated VGAM HOST TARGET GENE, in fact represents a plurality of VGAM652 host target genes. The mRNA of each one of this plurality of VGAM652 host target genes comprises one or more host target binding sites, each having a nucleotide sequence which is at least partly complementary to VGAM652 RNA, herein designated VGAM RNA, and which when bound by VGAM652 RNA causes inhibition of translation of respective one or more VGAM652 host target proteins.

It is further appreciated by one skilled in the art that the mode of translational inhibition illustrated by FIG. 1 with specific reference to translational inhibition exerted by VGAM652 gene, herein designated VGAM GENE, on one or more VGAM652 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM652 is inhibition of expression of host target genes, as part of a novel viral mechanism of attacking a host. Accordingly, utilities of VGAM652 include diagnosis, prevention and treatment of viral infection by Meleagrid Herpesvirus 1. Specific functions, and accordingly utilities, of VGAM652 correlate with, and may be deduced from, the identity of the host target genes which VGAM652 binds and inhibits, and the function of these host target genes, as elaborated hereinbelow.

Nucleotide sequences of the VGAM652 precursor RNA, herein designated VGAM PRECURSOR RNA, and of the 'diced' VGAM652 RNA, herein designated VGAM RNA, and a schematic representation of the secondary folding of VGAM652 folded precursor RNA, herein designated VGAM FOLDED PRECURSOR RNA, of VGAM652 are further described hereinbelow with reference to Table 1.

Nucleotide sequences of host target binding sites, such as BINDING SITE-I, BINDING SITE-II and BINDING SITE-III of FIG. 1, found on VGAM652 host target RNA, and schematic representation of the complementarity of each of these host target binding sites to VGAM652 RNA, herein designated VGAM RNA, are described hereinbelow with reference to Table 2.

As mentioned hereinabove with reference to FIG. 1, a function of VGAM652 gene, herein designated VGAM is inhibition of expression of VGAM652 target genes. It is appreciated that specific functions, and accordingly utilities, of VGAM652 correlate with, and may be deduced from, the identity of the target genes which VGAM652 binds and inhibits, and the function of these target genes, as elaborated hereinbelow.

A Disintegrin and Metalloproteinase Domain 29 (ADAM29, Accession XM_113428) is a VGAM652 host target gene. ADAM29 BINDING SITE is HOST TARGET binding site found in the 5' untranslated region of mRNA encoded by ADAM29, corresponding to a HOST TARGET binding site such as BINDING SITE I, BINDING SITE II or BINDING SITE III. Table 2 illustrates the complementarity of the nucleotide sequences of ADAM29 BINDING SITE, designated SEQ ID:42261, to the nucleotide sequence of VGAM652 RNA, herein designated VGAM RNA, also designated SEQ ID:3363.

A function of VGAM652 is therefore inhibition of A Disintegrin and Metalloproteinase Domain 29 (ADAM29, Accession XM_113428), a gene which Testis-specific member of ADAM family of zinc metalloproteases. Accordingly, utilities of VGAM652 include diagnosis, prevention and treatment of diseases and clinical conditions associated with ADAM29. The function of ADAM29 has been established by previous studies. ADAMs are a family of cell surface proteins with a domain structure composed of a signal sequence, a prodomain with a cysteine switch, a metalloproteinase-like domain, a disintegrin-like domain, a cysteine-rich domain, a transmembrane domain, and a C-terminal cytoplasmic domain. Members of this family have been implicated in a variety of biologic processes involving cell-cell and cell-matrix interactions, including fertilization, muscle development, and neurogenesis. By searching a DNA sequence database, Cerretti et al. (1999) identified 2 ESTs representing the novel ADAMs ADAM29 and ADAM30 (OMIM Ref. No. 604779). The ADAM29 EST encodes a polypeptide with sequence similarity to the cysteine-rich region of ADAM20 (OMIM Ref. No. 603712). Cerretti et al. (1999) screened a human testis cDNA library with the ADAM29 EST and isolated cDNAs encoding 3 forms of ADAM29 that differ in the cytoplasmic domain. By searching an EST database using ADAM20 as the query, Xu et al. (1999) identified an ADAM29 EST. Using a PCR-based 'walking' strategy, they cloned a full-length ADAM29 coding sequence. By radiation hybrid mapping, Xu et al. (1999) mapped the ADAM29 gene to 4q34.2-qter. Cerretti et al. (1999) mapped the ADAM29 gene to 4q34 using radiation hybrid mapping.

Full details of the abovementioned studies are described in the following publications, the disclosure of which are hereby incorporated by reference:

Cerretti, D. P.; DuBose, R. F.; Black, R. A.; Nelson, N.: Isolation of two novel metalloproteinase-disintegrin (ADAM) cDNAs that show testis-specific gene expression. Biochem. Biophys. Res. Commun. 263:810-815, 1999; and Xu, R.; Cai, J.; Xu, T.; Zhou, W.; Ying, B.; Deng, K.; Zhao, S.; Li, C.: Molecular cloning and mapping of a novel ADAM gene (ADAM29) to human chromosome 4. Genomics 62:537-539, 1999.

Further studies establishing the function and utilities of ADAM29 are found in John Hopkins OMIM database record ID 604778, and in sited publications numbered 6649-6650 listed in the bibliography section hereinbelow, which are also hereby incorporated by reference. Neural Precursor Cell Expressed, Developmentally Down-regulated 4 (NEDD4, Accession XM_046129) is another VGAM652 host target gene. NEDD4 BINDING SITE is HOST TARGET binding site found in the 3' untranslated region of mRNA encoded by NEDD4, corresponding to a HOST TARGET binding site such as BINDING SITE I, BINDING SITE II or BINDING SITE III. Table 2 illustrates the complementarity of the nucleotide sequences of NEDD4 BINDING SITE, designated SEQ ID:34691, to the nucleotide sequence of VGAM652 RNA, herein designated VGAM RNA, also designated SEQ ID:3363.

Another function of VGAM652 is therefore inhibition of Neural Precursor Cell Expressed, Developmentally Down-regulated 4 (NEDD4, Accession XM_046129), a gene which ubiquitinates regulatory proteins involved in transcription. Accordingly, utilities of VGAM652 include diagnosis, prevention and treatment of diseases and clinical conditions associated with NEDD4. The function of NEDD4 and its association with various diseases and clinical conditions, has been established by previous studies, as described hereinabove with reference to VGAM209. E2F Transcription Factor 6 (E2F6, Accession NM_001952) is another VGAM652 host target gene. E2F6 BINDING SITE is HOST TARGET binding site found in the 3' untranslated region of mRNA encoded by E2F6, corresponding to a HOST TARGET binding site such as BINDING SITE I, BINDING SITE II or BINDING SITE III. Table 2 illustrates the complementarity of the nucleotide sequences of E2F6 BINDING SITE, designated SEQ ID:7675, to the nucleotide sequence of VGAM652 RNA, herein designated VGAM RNA, also designated SEQ ID:3363.

Another function of VGAM652 is therefore inhibition of E2F Transcription Factor 6 (E2F6, Accession NM_001952).

Accordingly, utilities of VGAM652 include diagnosis, prevention and treatment of diseases and clinical conditions associated with E2F6. ENDOGLYX1 (Accession NM_024756) is another VGAM652 host target gene. ENDOGLYX1 BINDING SITE is HOST TARGET binding site found in the 3' untranslated region of mRNA encoded by ENDOGLYX1, corresponding to a HOST TARGET binding site such as BINDING SITE I, BINDING SITE II or BINDING SITE III. Table 2 illustrates the complementarity of the nucleotide sequences of ENDOGLYX1 BINDING SITE, designated SEQ ID:24102, to the nucleotide sequence of VGAM652 RNA, herein designated VGAM RNA, also designated SEQ ID:3363.

Another function of VGAM652 is therefore inhibition of ENDOGLYX1 (Accession NM_024756). Accordingly, utilities of VGAM652 include diagnosis, prevention and treatment of diseases and clinical conditions associated with ENDOGLYX1. FLJ22795 (Accession NM_025084) is another VGAM652 host target gene. FLJ22795 BINDING SITE is HOST TARGET binding site found in the 3' untranslated region of mRNA encoded by FLJ22795, corresponding to a HOST TARGET binding site such as BINDING SITE I, BINDING SITE II or BINDING SITE III. Table 2 illustrates the complementarity of the nucleotide sequences of FLJ22795 BINDING SITE, designated SEQ ID:24687, to the nucleotide sequence of VGAM652 RNA, herein designated VGAM RNA, also designated SEQ ID:3363.

Another function of VGAM652 is therefore inhibition of FLJ22795 (Accession NM_025084). Accordingly, utilities of VGAM652 include diagnosis, prevention and treatment of diseases and clinical conditions associated with FLJ22795. MGC22014 (Accession XM_035307) is another VGAM652 host target gene. MGC22014 BINDING SITE is HOST TARGET binding site found in the 3' untranslated region of mRNA encoded by MGC22014, corresponding to a HOST TARGET binding site such as BINDING SITE I, BINDING SITE II or BINDING SITE III. Table 2 illustrates the complementarity of the nucleotide sequences of MGC22014 BINDING SITE, designated SEQ ID:32215, to the nucleotide sequence of VGAM652 RNA, herein designated VGAM RNA, also designated SEQ ID:3363.

Another function of VGAM652 is therefore inhibition of MGC22014 (Accession XM_035307). Accordingly, utilities of VGAM652 include diagnosis, prevention and treatment of diseases and clinical conditions associated with MGC22014. LOC145717 (Accession XM_039771) is another VGAM652 host target gene. LOC145717 BINDING SITE is HOST TARGET binding site found in the 3' untranslated region of mRNA encoded by LOC145717, corresponding to a HOST TARGET binding site such as BINDING SITE I, BINDING SITE II or BINDING SITE III. Table 2 illustrates the complementarity of the nucleotide sequences of LOC145717 BINDING SITE, designated SEQ ID:33188, to the nucleotide sequence of VGAM652 RNA, herein designated VGAM RNA, also designated SEQ ID:3363.

Another function of VGAM652 is therefore inhibition of LOC145717 (Accession XM_039771). Accordingly, utilities of VGAM652 include diagnosis, prevention and treatment of diseases and clinical conditions associated with LOC145717. LOC145725 (Accession XM_085211) is another VGAM652 host target gene. LOC145725 BINDING SITE is HOST TARGET binding site found in the 5' untranslated region of mRNA encoded by LOC145725, corresponding to a HOST TARGET binding site such as BINDING SITE I, BINDING SITE II or BINDING SITE III. Table 2 illustrates the complementarity of the nucleotide sequences of LOC145725 BINDING SITE, designated SEQ ID:37945, to the nucleotide sequence of VGAM652 RNA, herein designated VGAM RNA, also designated SEQ ID:3363.

Another function of VGAM652 is therefore inhibition of LOC145725 (Accession XM_085211). Accordingly, utilities of VGAM652 include diagnosis, prevention and treatment of diseases and clinical conditions associated with LOC145725. LOC145732 (Accession XM_085218) is another VGAM652 host target gene. LOC145732 BINDING SITE is HOST TARGET binding site found in the 5' untranslated region of mRNA encoded by LOC145732, corresponding to a HOST TARGET binding site such as BINDING SITE I, BINDING SITE II or BINDING SITE III. Table 2 illustrates the complementarity of the nucleotide sequences of LOC145732 BINDING SITE, designated SEQ ID:37954, to the nucleotide sequence of VGAM652 RNA, herein designated VGAM RNA, also designated SEQ ID:3363.

Another function of VGAM652 is therefore inhibition of LOC145732 (Accession XM_085218). Accordingly, utilities of VGAM652 include diagnosis, prevention and treatment of diseases and clinical conditions associated with LOC145732. LOC149076 (Accession XM_086415) is another VGAM652 host target gene. LOC149076 BINDING SITE is HOST TARGET binding site found in the 3' untranslated region of mRNA encoded by LOC149076, corresponding to a HOST TARGET binding site such as BINDING SITE I, BINDING SITE II or BINDING SITE III. Table 2 illustrates the complementarity of the nucleotide sequences of LOC149076 BINDING SITE, designated SEQ ID:38636, to the nucleotide sequence of VGAM652 RNA, herein designated VGAM RNA, also designated SEQ ID:3363.

Another function of VGAM652 is therefore inhibition of LOC149076 (Accession XM_086415). Accordingly, utilities of VGAM652 include diagnosis, prevention and treatment of diseases and clinical conditions associated with LOC149076. LOC196326 (Accession XM_118268) is another VGAM652 host target gene. LOC196326 BINDING SITE is HOST TARGET binding site found in the 5' untranslated region of mRNA encoded by LOC196326, corresponding to a HOST TARGET binding site such as BINDING SITE I, BINDING SITE II or BINDING SITE III. Table 2 illustrates the complementarity of the nucleotide sequences of LOC196326 BINDING SITE, designated SEQ ID:43576, to the nucleotide sequence of VGAM652 RNA, herein designated VGAM RNA, also designated SEQ ID:3363.

Another function of VGAM652 is therefore inhibition of LOC196326 (Accession XM_118268). Accordingly, utilities of VGAM652 include diagnosis, prevention and treatment of diseases and clinical conditions associated with LOC196326. LOC196957 (Accession XM_113789) is another VGAM652 host target gene. LOC196957 BINDING SITE is HOST TARGET binding site found in the 5' untranslated region of mRNA encoded by LOC196957, corresponding to a HOST TARGET binding site such as BINDING SITE I, BINDING SITE II or BINDING SITE III. Table 2 illustrates the complementarity of the nucleotide sequences of LOC196957 BINDING SITE, designated SEQ ID:42427, to the nucleotide sequence of VGAM652 RNA, herein designated VGAM RNA, also designated SEQ ID:3363.

Another function of VGAM652 is therefore inhibition of LOC196957 (Accession XM_113789). Accordingly, utilities of VGAM652 include diagnosis, prevention and treatment of diseases and clinical conditions associated with LOC196957. LOC196961 (Accession XM_113790) is another VGAM652 host target gene. LOC196961 BINDING SITE is HOST TARGET binding site found in the 5' untranslated region of mRNA encoded by LOC196961, corresponding to a HOST TARGET binding site such as BINDING SITE I, BINDING SITE II or BINDING SITE III. Table 2 illustrates the complementarity of the nucleotide sequences of LOC196961 BINDING SITE, designated SEQ ID:42436, to the nucleotide sequence of VGAM652 RNA, herein designated VGAM RNA, also designated SEQ ID:3363.

Another function of VGAM652 is therefore inhibition of LOC196961 (Accession XM_113790). Accordingly, utilities of VGAM652 include diagnosis, prevention and treatment of diseases and clinical conditions associated with LOC196961. LOC197138 (Accession XM_113829) is another VGAM652 host target gene. LOC197138 BINDING SITE is HOST TARGET binding site found in the 5' untranslated region of mRNA encoded by LOC197138, corresponding to a HOST TARGET binding site such as BINDING SITE I, BINDING SITE II or BINDING SITE III. Table 2 illustrates the complementarity of the nucleotide sequences of LOC197138 BINDING SITE, designated SEQ ID:42454, to the nucleotide sequence of VGAM652 RNA, herein designated VGAM RNA, also designated SEQ ID:3363.

Another function of VGAM652 is therefore inhibition of LOC197138 (Accession XM_113829). Accordingly, utilities of VGAM652 include diagnosis, prevention and treatment of diseases and clinical conditions associated with LOC197138. LOC220537 (Accession XM_165406) is another VGAM652 host target gene. LOC220537 BINDING SITE is HOST TARGET binding site found in the 3' untranslated region of mRNA encoded by LOC220537, corresponding to a HOST TARGET binding site such as BINDING SITE I, BINDING SITE II or BINDING SITE III. Table 2 illustrates the complementarity of the nucleotide sequences of LOC220537 BINDING SITE, designated SEQ ID:43620, to the nucleotide sequence of VGAM652 RNA, herein designated VGAM RNA, also designated SEQ ID:3363.

Another function of VGAM652 is therefore inhibition of LOC220537 (Accession XM_165406). Accordingly, utilities of VGAM652 include diagnosis, prevention and treatment of diseases and clinical conditions associated with LOC220537. LOC245727 (Accession XM_165913) is another VGAM652 host target gene. LOC245727 BINDING SITE is HOST TARGET binding site found in the 5' untranslated region of mRNA encoded by LOC245727, corresponding to a HOST TARGET binding site such as BINDING SITE I, BINDING SITE II or BINDING SITE III. Table 2 illustrates the complementarity of the nucleotide sequences of LOC245727 BINDING SITE, designated SEQ ID:43795, to the nucleotide sequence of VGAM652 RNA, herein designated VGAM RNA, also designated SEQ ID:3363.

Another function of VGAM652 is therefore inhibition of LOC245727 (Accession XM_165913). Accordingly, utilities of VGAM652 include diagnosis, prevention and treatment of diseases and clinical conditions associated with LOC245727. FIG. 1 further provides a conceptual description of a novel bioinformatically detected viral gene of the present invention, referred to here as Viral Genomic Address Messenger 653 (VGAM653) viral gene, which modulates expression of respective host target genes thereof, the function and utility of which host target genes is known in the art.

VGAM653 is a novel bioinformatically detected regulatory, non protein coding, viral micro RNA (miRNA) gene. The method by which VGAM653 was detected is described hereinabove with reference to FIGS. 1-8.

VGAM653 gene, herein designated VGAM GENE, is a viral gene contained in the genome of Meleagrid Herpesvirus 1. VGAM653 host target gene, herein designated VGAM HOST TARGET GENE, is a human gene contained in the human genome.

VGAM653 gene encodes a VGAM653 precursor RNA, herein designated VGAM PRECURSOR RNA. Similar to other miRNA genes, and unlike most ordinary genes, VGAM653 precursor RNA does not encode a protein. A nucleotide sequence identical or highly similar to the nucleotide sequence of VGAM653 precursor RNA is designated SEQ ID:639, and is provided hereinbelow with reference to the sequence listing part. Nucleotide sequence SEQ ID:639 is located at position 62995 relative to the genome of Meleagrid Herpesvirus 1.

VGAM653 precursor RNA folds onto itself, forming VGAM653 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM653 folded precursor RNA into VGAM653 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM653 RNA is designated SEQ ID:3364, and is provided hereinbelow with reference to the sequence listing part.

VGAM653 host target gene, herein designated VGAM HOST TARGET GENE, encodes a corresponding messenger RNA, VGAM653 host target RNA, herein designated VGAM HOST TARGET RNA. VGAM653 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM653 RNA, herein designated VGAM RNA, binds complementarily to one or more host target binding sites located in untranslated regions of VGAM653 host target RNA, herein designated VGAM HOST TARGET RNA. This complementary binding is due to the fact that the nucleotide sequence of VGAM653 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM653 RNA, herein designated VGAM RNA, may have a different number of host target binding sites in untranslated regions of a VGAM653 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM653 RNA, herein designated VGAM RNA, to host target binding sites on VGAM653 host target RNA, herein designated VGAM HOST TARGET RNA, such as BINDING SITE I, BINDING SITE II and BINDING SITE III, inhibits translation of VGAM653 host target RNA into VGAM653 host target protein, herein designated VGAM HOST TARGET PROTEIN. VGAM host target protein is therefore outlined by a broken line.

It is appreciated that VGAM653 host target gene, herein designated VGAM HOST TARGET GENE, in fact represents a plurality of VGAM653 host target genes. The mRNA of each one of this plurality of VGAM653 host target genes comprises one or more host target binding sites, each having a nucleotide sequence which is at least partly complementary to VGAM653 RNA, herein designated VGAM RNA, and which when bound by VGAM653 RNA causes inhibition of translation of respective one or more VGAM653 host target proteins.

It is further appreciated by one skilled in the art that the mode of translational inhibition illustrated by FIG. 1 with specific reference to translational inhibition exerted by VGAM653 gene, herein designated VGAM GENE, on one or more VGAM653 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM653 is inhibition of expression of host target genes, as part of a novel viral mechanism of attacking a host. Accordingly, utilities of VGAM653 include diagnosis, prevention and treatment of viral infection by Meleagrid Herpesvirus 1. Specific functions, and accordingly utilities, of VGAM653 correlate with, and may be deduced from, the identity of the host target genes which VGAM653 binds and inhibits, and the function of these host target genes, as elaborated hereinbelow.

Nucleotide sequences of the VGAM653 precursor RNA, herein designated VGAM PRECURSOR RNA, and of the 'diced' VGAM653 RNA, herein designated VGAM RNA, and a schematic representation of the secondary folding of VGAM653 folded precursor RNA, herein designated VGAM FOLDED PRECURSOR RNA, of VGAM653 are further described hereinbelow with reference to Table 1.

Nucleotide sequences of host target binding sites, such as BINDING SITE-I, BINDING SITE-II and BINDING SITE-III of FIG. 1, found on VGAM653 host target RNA, and a schematic representation of the complementarity of each of these host target binding sites to VGAM653 RNA, herein designated VGAM RNA, are described hereinbelow with reference to Table 2.

As mentioned hereinabove with reference to FIG. 1, a function of VGAM653 gene, herein designated VGAM is inhibition of expression of VGAM653 target genes. It is appreciated that specific functions, and accordingly utilities, of VGAM653 correlate with, and may be deduced from, the identity of the target genes which VGAM653 binds and inhibits, and the function of these target genes, as elaborated hereinbelow.

Transient Receptor Potential Cation Channel, Subfamily V, Member 1 (TRPV1, Accession NM_018727) is a VGAM653 host target gene. TRPV1 BINDING SITE1 through TRPV1 BINDING SITE4 are HOST TARGET binding sites found in untranslated regions of mRNA encoded by TRPV1, corresponding to HOST TARGET binding sites such as BINDING SITE I, BINDING SITE II or BINDING SITE III. Table 2 illustrates the complementarity of the nucleotide sequences of TRPV1 BINDING SITE1 through TRPV1 BINDING SITE4, designated SEQ ID:20809, SEQ ID:27989, SEQ ID:27997 and SEQ ID:28005 respectively, to the nucleotide sequence of VGAM653 RNA, herein designated VGAM RNA, also designated SEQ ID:3364.

A function of VGAM653 is therefore inhibition of Transient Receptor Potential Cation Channel, Subfamily V, Member 1 (TRPV1, Accession NM_018727), a gene which functions as a receptor for capsaicin. Accordingly, utilities of VGAM653 include diagnosis, prevention and treatment of diseases and clinical conditions associated with TRPV1. The function of TRPV1 and its association with various diseases and clinical conditions, has been established by previous studies, as described hereinabove with reference to VGAM146. LOC255147 (Accession XM_171024) is another VGAM653 host target gene. LOC255147 BINDING SITE is HOST TARGET binding site found in the 3' untranslated region of mRNA encoded by LOC255147, corresponding to a HOST TARGET binding site such as BINDING SITE I, BINDING SITE II or BINDING SITE III. Table 2 illustrates the complementarity of the nucleotide sequences of LOC255147 BINDING SITE, designated SEQ ID:45802, to the nucleotide sequence of VGAM653 RNA, herein designated VGAM RNA, also designated SEQ ID:3364.

Another function of VGAM653 is therefore inhibition of LOC255147 (Accession XM_171024). Accordingly, utilities of VGAM653 include diagnosis, prevention and treatment of diseases and clinical conditions associated with LOC255147.

FIG. 1 further provides a conceptual description of a novel bioinformatically detected viral gene of the present invention, referred to here as Viral Genomic Address Messenger 654 (VGAM654) viral gene, which modulates expression of respective host target genes thereof, the function and utility of which host target genes is known in the art.

VGAM654 is a novel bioinformatically detected regulatory, non protein coding, viral micro RNA (miRNA) gene. The method by which VGAM654 was detected is described hereinabove with reference to FIGS. 1-8.

VGAM654 gene, herein designated VGAM GENE, is a viral gene contained in the genome of Meleagrid Herpesvirus 1. VGAM654 host target gene, herein designated VGAM HOST TARGET GENE, is a human gene contained in the human genome.

VGAM654 gene encodes a VGAM654 precursor RNA, herein designated VGAM PRECURSOR RNA. Similar to other miRNA genes, and unlike most ordinary genes, VGAM654 precursor RNA does not encode a protein. A nucleotide sequence identical or highly similar to the nucleotide sequence of VGAM654 precursor RNA is designated SEQ ID:640, and is provided hereinbelow with reference to the sequence listing part. Nucleotide sequence SEQ ID:640 is located at position 75545 relative to the genome of Meleagrid Herpesvirus 1.

VGAM654 precursor RNA folds onto itself, forming VGAM654 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM654 folded precursor RNA into VGAM654 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM654 RNA is designated SEQ ID:3365, and is provided hereinbelow with reference to the sequence listing part.

VGAM654 host target gene, herein designated VGAM HOST TARGET GENE, encodes a corresponding messenger RNA, VGAM654 host target RNA, herein designated VGAM HOST TARGET RNA. VGAM654 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM654 RNA, herein designated VGAM RNA, binds complementarily to one or more host target binding sites located in untranslated regions of VGAM654 host target RNA, herein designated VGAM HOST TARGET RNA. This complementary binding is due to the fact that the nucleotide sequence of VGAM654 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM654 RNA, herein designated VGAM RNA, may have a different number of host target binding sites in untranslated regions of a VGAM654 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM654 RNA, herein designated VGAM RNA, to host target binding sites on VGAM654 host target RNA, herein designated VGAM HOST TARGET RNA, such as BINDING SITE I, BINDING SITE II and BINDING SITE III, inhibits translation of VGAM654 host target RNA into VGAM654 host target protein, herein designated VGAM HOST TARGET PROTEIN. VGAM host target protein is therefore outlined by a broken line.

It is appreciated that VGAM654 host target gene, herein designated VGAM HOST TARGET GENE, in fact represents a plurality of VGAM654 host target genes. The mRNA of each one of this plurality of VGAM654 host target genes comprises one or more host target binding sites, each having a nucleotide sequence which is at least partly complementary to VGAM654 RNA, herein designated VGAM RNA, and which when bound by VGAM654 RNA causes inhibition of translation of respective one or more VGAM654 host target proteins.

It is further appreciated by one skilled in the art that the mode of translational inhibition illustrated by FIG. 1 with specific reference to translational inhibition exerted by VGAM654 gene, herein designated VGAM GENE, on one or more VGAM654 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM654 is inhibition of expression of host target genes, as part of a novel viral mechanism of attacking a host. Accordingly, utilities of VGAM654 include diagnosis, prevention and treatment of viral infection by Meleagrid Herpesvirus 1. Specific functions, and accordingly utilities, of VGAM654 correlate with, and may be deduced from, the identity of the host target genes which VGAM654 binds and inhibits, and the function of these host target genes, as elaborated hereinbelow.

Nucleotide sequences of the VGAM654 precursor RNA, herein designated VGAM PRECURSOR RNA, and of the 'diced' VGAM654 RNA, herein designated VGAM RNA, and a schematic representation of the secondary folding of VGAM654 folded precursor RNA, herein designated VGAM FOLDED PRECURSOR RNA, of VGAM654 are further described hereinbelow with reference to Table 1.

Nucleotide sequences of host target binding sites, such as BINDING SITE-I, BINDING SITE-II and BINDING SITE-III of FIG. 1, found on VGAM654 host target RNA, and schematic representation of the complementarity of each of these host target binding sites to VGAM654 RNA, herein designated VGAM RNA, are described hereinbelow with reference to Table 2.

As mentioned hereinabove with reference to FIG. 1, a function of VGAM654 gene, herein designated VGAM is inhibition of expression of VGAM654 target genes. It is appreciated that specific functions, and accordingly utilities, of VGAM654 correlate with, and may be deduced from, the identity of the target genes which VGAM654 binds and inhibits, and the function of these target genes, as elaborated hereinbelow.

Centrosomal Protein 2 (CEP2, Accession NM_006779) is a VGAM654 host target gene. CEP2 BINDING SITE is HOST TARGET binding site found in the 3' untranslated region of mRNA encoded by CEP2, corresponding to a HOST TARGET binding site such as BINDING SITE I, BINDING SITE II or BINDING SITE III. Table 2 illustrates the complementarity of the nucleotide sequences of CEP2 BINDING SITE, designated SEQ ID:13649, to the nucleotide sequence of VGAM654 RNA, herein designated VGAM RNA, also designated SEQ ID:3365.

A function of VGAM654 is therefore inhibition of Centrosomal Protein 2 (CEP2, Accession NM_006779), a gene which interacts with TC10 and CDC42. Accordingly, utilities of VGAM654 include diagnosis, prevention and treatment of diseases and clinical conditions associated with CEP2. The function of CEP2 and its association with various diseases and clinical conditions, has been established by previous studies, as described hereinabove with reference to VGAM329. DKFZP564I052 (Accession XM_039660) is another VGAM654 host target gene. DKFZP564I052 BINDING SITE is HOST TARGET binding site found in the 3' untranslated region of mRNA encoded by DKFZP564I052, corresponding to a HOST TARGET binding site such as BINDING SITE I, BINDING SITE II or BINDING SITE III. Table 2 illustrates the complementarity of the nucleotide sequences of DKFZP564I052 BINDING SITE, designated SEQ ID:33138, to the nucleotide sequence of VGAM654 RNA, herein designated VGAM RNA, also designated SEQ ID:3365.

Another function of VGAM654 is therefore inhibition of DKFZP564I052 (Accession XM_039660). Accordingly, utilities of VGAM654 include diagnosis, prevention and treatment of diseases and clinical conditions associated with DKFZP564I052. Glucocorticoid Modulatory Element Binding Protein 2 (GMEB2, Accession NM_012384) is another VGAM654 host target gene. GMEB2 BINDING SITE is HOST TARGET binding site found in the 5' untranslated region of mRNA encoded by GMEB2, corresponding to a HOST TARGET binding site such as BINDING SITE I, BINDING SITE II or BINDING SITE III. Table 2 illustrates the complementarity of the nucleotide sequences of GMEB2 BINDING SITE, designated SEQ ID:14741, to the nucleotide sequence of VGAM654 RNA, herein designated VGAM RNA, also designated SEQ ID:3365.

Another function of VGAM654 is therefore inhibition of Glucocorticoid Modulatory Element Binding Protein 2 (GMEB2, Accession NM_012384). Accordingly, utilities of VGAM654 include diagnosis, prevention and treatment of diseases and clinical conditions associated with GMEB2. KIAA1024 (Accession XM_044580) is another VGAM654 host target gene. KIAA1024 BINDING SITE is HOST TARGET binding site found in the 3" untranslated region of mRNA encoded by KIAA1024, corresponding to a HOST TARGET binding site such as BINDING SITE I, BINDING SITE II or BINDING SITE III. Table 2 illustrates the complementarity of the nucleotide sequences of KIAA1024 BINDING SITE, designated SEQ ID:34232, to the nucleotide sequence of VGAM654 RNA, herein designated VGAM RNA, also designated SEQ ID:3365.

Another function of VGAM654 is therefore inhibition of KIAA1024 (Accession XM_044580). Accordingly, utilities of VGAM654 include diagnosis, prevention and treatment of diseases and clinical conditions associated with KIAA1024. MGC27434 (Accession NM_145050) is another VGAM654 host target gene. MGC27434 BINDING SITE is HOST TARGET binding site found in the 3' untranslated region of mRNA encoded by MGC27434, corresponding to a HOST TARGET binding site such as BINDING SITE I, BINDING SITE II or BINDING SITE III. Table 2 illustrates the complementarity of the nucleotide sequences of MGC27434 BINDING SITE, designated SEQ ID:29681, to the nucleotide sequence of VGAM654 RNA, herein designated VGAM RNA, also designated SEQ ID:3365.

Another function of VGAM654 is therefore inhibition of MGC27434 (Accession NM_145050). Accordingly, utilities of VGAM654 include diagnosis, prevention and treatment of diseases and clinical conditions associated with MGC27434. Tousled-like Kinase 2 (TLK2, Accession XM_085650) is another VGAM654 host target gene. TLK2 BINDING SITE1 and TLK2 BINDING SITE2 are HOST TARGET binding sites found in untranslated regions of mRNA encoded by TLK2, corresponding to HOST TARGET binding sites such as BINDING SITE I, BINDING SITE II or BINDING SITE III. Table 2 illustrates the complementarity of the nucleotide sequences of TLK2 BINDING SITE1 and TLK2 BINDING SITE2, designated SEQ ID:38276 and SEQ ID:13722 respectively, to the nucleotide sequence of VGAM654 RNA, herein designated VGAM RNA, also designated SEQ ID:3365.

Another function of VGAM654 is therefore inhibition of Tousled-like Kinase 2 (TLK2, Accession XM_085650). Accordingly, utilities of VGAM654 include diagnosis, prevention and treatment of diseases and clinical conditions associated with TLK2. LOC151584 (Accession XM_098089) is another VGAM654 host target gene. LOC151584 BINDING SITE is HOST TARGET binding site found in the 3' untranslated region of mRNA encoded by LOC151584, corresponding to a HOST TARGET binding site such as BINDING SITE I, BINDING SITE II or BINDING SITE III. Table 2 illustrates the complementarity of the nucleotide sequences of LOC151584 BINDING SITE, designated SEQ ID:41377, to the nucleotide sequence of VGAM654 RNA, herein designated VGAM RNA, also designated SEQ ID:3365.

Another function of VGAM654 is therefore inhibition of LOC151584 (Accession XM_098089). Accordingly, utilities of VGAM654 include diagnosis, prevention and treatment of diseases and clinical conditions associated with LOC151584. LOC221410 (Accession XM_166373) is another VGAM654 host target gene. LOC221410 BINDING SITE is HOST TARGET binding site found in the 3' untranslated region of mRNA encoded by LOC221410, corresponding to a HOST TARGET binding site such as BINDING SITE I, BINDING SITE II or BINDING SITE III. Table 2 illustrates the complementarity of the nucleotide sequences of LOC221410 BINDING SITE, designated SEQ ID:44196, to the nucleotide sequence of VGAM654 RNA, herein designated VGAM RNA, also designated SEQ ID:3365.

Another function of VGAM654 is therefore inhibition of LOC221410 (Accession XM_166373). Accordingly, utilities of VGAM654 include diagnosis, prevention and treatment of diseases and clinical conditions associated with LOC221410. LOC257249 (Accession XM_171092) is another VGAM654 host target gene. LOC257249 BINDING SITE is HOST TARGET binding site found in the 5' untranslated region of mRNA encoded by LOC257249, corresponding to a HOST TARGET binding site such as BINDING SITE I, BINDING SITE II or BINDING SITE III. Table 2 illustrates the complementarity of the nucleotide sequences of LOC257249 BINDING SITE, designated SEQ ID:45904, to the nucleotide sequence of VGAM654 RNA, herein designated VGAM RNA, also designated SEQ ID:3365.

Another function of VGAM654 is therefore inhibition of LOC257249 (Accession XM_171092). Accordingly, utilities of VGAM654 include diagnosis, prevention and treatment of diseases and clinical conditions associated with LOC257249. FIG. 1 further provides a conceptual description of a novel bioinformatically detected viral gene of the present invention, referred to here as Viral Genomic Address Messenger 655 (VGAM655) viral gene, which modulates expression of respective host target genes thereof, the function and utility of which host target genes is known in the art.

VGAM655 is a novel bioinformatically detected regulatory, non protein coding, viral micro RNA (miRNA) gene. The method by which VGAM655 was detected is described hereinabove with reference to FIGS. 1-8.

VGAM655 gene, herein designated VGAM GENE, is a viral gene contained in the genome of Meleagrid Herpesvirus 1. VGAM655 host target gene, herein designated VGAM HOST TARGET GENE, is a human gene contained in the human genome.

VGAM655 gene encodes a VGAM655 precursor RNA, herein designated VGAM PRECURSOR RNA. Similar to other miRNA genes, and unlike most ordinary genes, VGAM655 precursor RNA does not encode a protein. A nucleotide sequence identical or highly similar to the nucleotide sequence of VGAM655 precursor RNA is designated SEQ ID:641, and is provided hereinbelow with reference to the sequence listing part. Nucleotide sequence SEQ ID:641 is located at position 76605 relative to the genome of Meleagrid Herpesvirus 1.

VGAM655 precursor RNA folds onto itself, forming VGAM655 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM655 folded precursor RNA into VGAM655 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM655 RNA is designated SEQ ID:3366, and is provided hereinbelow with reference to the sequence listing part.

VGAM655 host target gene, herein designated VGAM HOST TARGET GENE, encodes a corresponding messenger RNA, VGAM655 host target RNA, herein designated VGAM HOST TARGET RNA. VGAM655 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM655 RNA, herein designated VGAM RNA, binds complementarily to one or more host target binding sites located in untranslated regions of VGAM655 host target RNA, herein designated VGAM HOST TARGET RNA. This complementary binding is due to the fact that the nucleotide sequence of VGAM655 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM655 RNA, herein designated VGAM RNA, may have a different number of host target binding sites in untranslated regions of a VGAM655 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM655 RNA, herein designated VGAM RNA, to host target binding sites on VGAM655 host target RNA, herein designated VGAM HOST TARGET RNA, such as BINDING SITE I, BINDING SITE II and BINDING SITE III, inhibits translation of VGAM655 host target RNA into VGAM655 host target protein, herein designated VGAM HOST TARGET PROTEIN. VGAM host target protein is therefore outlined by a broken line.

It is appreciated that VGAM655 host target gene, herein designated VGAM HOST TARGET GENE, in fact represents a plurality of VGAM655 host target genes. The mRNA of each one of this plurality of VGAM655 host target genes comprises one or more host target binding sites, each having a nucleotide sequence which is at least partly complementary to VGAM655 RNA, herein designated VGAM RNA, and which when bound by VGAM655 RNA causes inhibition of translation of respective one or more VGAM655 host target proteins.

It is further appreciated by one skilled in the art that the mode of translational inhibition illustrated by FIG. 1 with specific reference to translational inhibition exerted by VGAM655 gene, herein designated VGAM GENE, on one or more VGAM655 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM655 is inhibition of expression of host target genes, as part of a novel viral mechanism of attacking a host. Accordingly, utilities of VGAM655 include diagnosis, prevention and treatment of viral infection by Meleagrid Herpesvirus 1. Specific functions, and accordingly utilities, of VGAM655 correlate with, and may be deduced from, the identity of the host target genes which VGAM655 binds and inhibits, and the function of these host target genes, as elaborated hereinbelow.

Nucleotide sequences of the VGAM655 precursor RNA, herein designated VGAM PRECURSOR RNA, and of the 'diced' VGAM655 RNA, herein designated VGAM RNA, and a schematic representation of the secondary folding of VGAM655 folded precursor RNA, herein designated VGAM FOLDED PRECURSOR RNA, of VGAM655 are further described hereinbelow with reference to Table 1.

Nucleotide sequences of host target binding sites, such as BINDING SITE-I, BINDING SITE-II and BINDING SITE-III of FIG. 1, found on VGAM655 host target RNA, and schematic representation of the complementarity of each of these host target binding sites to VGAM655 RNA, herein designated VGAM RNA, are described hereinbelow with reference to Table 2.

As mentioned hereinabove with reference to FIG. 1, a function of VGAM655 gene, herein designated VGAM is inhibition of expression of VGAM655 target genes. It is appreciated that specific functions, and accordingly utilities, of VGAM655 correlate with, and may be deduced from, the identity of the target genes which VGAM655 binds and inhibits, and the function of these target genes, as elaborated hereinbelow.

Adrenergic, Alpha-2A-, Receptor (ADRA2A, Accession NM_000681) is a VGAM655 host target gene. ADRA2A BINDING SITE is HOST TARGET binding site found in the 3' untranslated region of mRNA encoded by ADRA2A, corresponding to a HOST TARGET binding site such as BINDING SITE I, BINDING SITE II or BINDING SITE III. Table 2 illustrates the complementarity of the nucleotide sequences of ADRA2A BINDING SITE, designated SEQ ID:6335, to the nucleotide sequence of VGAM655 RNA, herein designated VGAM RNA, also designated SEQ ID:3366.

A function of VGAM655 is therefore inhibition of Adrenergic, Alpha-2A-, Receptor (ADRA2A, Accession NM_000681), a gene which mediates the effects of epinephrine and norepinephrine. Accordingly, utilities of VGAM655 include diagnosis, prevention and treatment of diseases and clinical conditions associated with ADRA2A. The function of ADRA2A and its association with various diseases and clinical conditions, has been established by previous studies, as described hereinabove with reference to VGAM602. Amylo-1, 6-glucosidase, 4-alpha-glucanotransferase (glycogen debranching enzyme, glycogen storage disease type III) (AGL, Accession NM_000645) is another VGAM655 host target gene. AGL BINDING SITE1 through AGL BINDING SITE6 are HOST TARGET binding sites found in untranslated regions of mRNA encoded by AGL, corresponding to HOST TARGET binding sites such as BINDING SITE I, BINDING SITE II or BINDING SITE III. Table 2 illustrates the complementarity of the nucleotide sequences of AGL BINDING SITE1 through AGL BINDING SITE6, designated SEQ ID:6296, SEQ ID:6303, SEQ ID:5464, SEQ ID:6281, SEQ ID:6286 and SEQ ID:6291 respectively, to the nucleotide sequence of VGAM655 RNA, herein designated VGAM RNA, also designated SEQ ID:3366.

Another function of VGAM655 is therefore inhibition of Amylo-1, 6-glucosidase, 4-alpha-glucanotransferase (glycogen debranching enzyme, glycogen storage disease type III) (AGL, Accession NM_000645). Accordingly, utilities of VGAM655 include diagnosis, prevention and treatment of diseases and clinical conditions associated with AGL. Mitogen-activated Protein Kinase 4 (MAPK4, Accession NM_002747) is another VGAM655 host target gene. MAPK4 BINDING SITE is HOST TARGET binding site found in the 3' untranslated region of mRNA encoded by MAPK4, corresponding to a HOST TARGET binding site such as BINDING SITE I, BINDING SITE II or BINDING SITE III. Table 2 illustrates the complementarity of the nucleotide sequences of MAPK4 BINDING SITE, designated SEQ ID:8620, to the nucleotide sequence of VGAM655 RNA, herein designated VGAM RNA, also designated SEQ ID:3366.

Another function of VGAM655 is therefore inhibition of Mitogen-activated Protein Kinase 4 (MAPK4, Accession NM_002747), a gene which phosphorylates microtubule-associated protein-2 may promote entry into the cell cycle. Accordingly, utilities of VGAM655 include diagnosis, prevention and treatment of diseases and clinical conditions associated with MAPK4. The function of MAPK4 has been established by previous studies. See MAPK1 (OMIM Ref. No. 176948). Gonzalez et al. (1992) reported the molecular cloning of genes for 4 human proteins with high homology to members of the mitogen-activated protein kinase group of enzymes. Of the 4, 2 probably resulted from alternative processing of transcripts from a single gene. Zhu et al. (1994) stated that p63MAPK, which had been known as ERK3, shares only 73% protein sequence identity with rat ERK3. They suggested that p97MAPK (MAPK6; 602904) is the true ERK3 homolog, and that p63MAPK is a member of the ERK3 subfamily. Garcia et al. (1996) reported that a gene they referred to as MNK2 is the rat homolog of p63MAPK. The 2 protein sequences are 95% identical. Li et al. (1994) used Southern blotting of DNA from a panel of human hamster cell hybrids and fluorescence in situ hybridization to map the MAPK4 gene to 18q12-q21

Full details of the abovementioned studies are described in the following publications, the disclosure of which are hereby incorporated by reference:

Garcia, J. I.; Zalba, G.; Detera-Wadleigh, S. D.; de Miguel, C.: Isolation of a cDNA encoding the rat MAP-kinase homolog of human p63mapk. Mammalian Genome 7:810-814, 1996; and Li, L.; Wysk, M.; Gonzalez, F. A.; Davis, R. J.: Genomic loci of human mitogen-activated protein kinases. Oncogene 9:647-649, 1994.

Further studies establishing the function and utilities of MAPK4 are found in John Hopkins OMIM database record ID 176949, and in sited publications numbered 1540-1541, 153 and 1542 listed in the bibliography section hereinbelow, which are also hereby incorporated by reference. Muscleblind-like (Drosophila) (MBNL, Accession NM_021038) is another VGAM655 host target gene. MBNL BINDING SITE is HOST TARGET binding site found in the 3" untranslated region of mRNA encoded by MBNL, corresponding to a HOST TARGET binding site such as BINDING SITE I, BINDING SITE II or BINDING SITE III. Table 2 illustrates the complementarity of the nucleotide sequences of MBNL BINDING SITE, designated SEQ ID:22022, to the nucleotide sequence of VGAM655 RNA, herein designated VGAM RNA, also designated SEQ ID:3366.

Another function of VGAM655 is therefore inhibition of Muscleblind-like (Drosophila) (MBNL, Accession NM_021038), a gene which binds to cug triplet repeat expansion dsrna (by similarity). Accordingly, utilities of VGAM655 include diagnosis, prevention and treatment of diseases and clinical conditions associated with MBNL. The function of MBNL and its association with various diseases and clinical conditions, has been established by previous studies, as described hereinabove with reference to VGAM95. Tumor Necrosis Factor (ligand) Superfamily, Member 8 (TNFSF8, Accession NM_001244) is another VGAM655 host target gene. TNFSF8 BINDING SITE is HOST TARGET binding site found in the 3' untranslated region of mRNA encoded by TNFSF8, corresponding to a HOST TARGET binding site such as BINDING SITE I, BINDING SITE II or BINDING SITE III. Table 2 illustrates the complementarity of the nucleotide sequences of TNFSF8 BINDING SITE, designated SEQ ID:6914, to the nucleotide sequence of VGAM655 RNA, herein designated VGAM RNA, also designated SEQ ID:3366.

Another function of VGAM655 is therefore inhibition of Tumor Necrosis Factor (ligand) Superfamily, Member 8 (TNFSF8, Accession NM_001244), a gene which cytokine that binds to tnfrsf8/cd30. induces proliferation of t cells. Accordingly, utilities of VGAM655 include diagnosis, prevention and treatment of diseases and clinical conditions associated with TNFSF8. The function of TNFSF8 has been established by previous studies. CD30 (TNFRSF8; 153243), a member of the tumor necrosis factor (TNF; OMIM Ref. No. TNF-alpha 191160) receptor superfamily, is a surface antigen used as a clinical marker for Hodgkin lymphoma and related hematologic malignancies. By performing an expression cloning screen using a chimeric protein containing the extracellular domain of CD30 as a probe, Smith et al. (1993) identified murine cells expressing a CD30 ligand. They isolated the corresponding mouse cDNA and used it to recover a homologous human cDNA from a peripheral blood T-cell (PBT) library. The predicted 234-amino acid human CD30L (CD30 ligand) protein is 72% identical to mouse Cd30l. CD30L has the characteristics of a type II membrane protein, with no apparent signal peptide and a transmembrane domain followed by a C-terminal extracellular domain. The C-terminal receptor-binding region of CD30L shares sequence similarity with other members of the TNF family, including TNF-alpha, TNF-beta (OMIM Ref. No. 153440), and CD40LG (OMIM Ref. No. 300386). Although it has a predicted molecular weight of 26 kD, recombinant CD30L expressed in mammalian cells migrated at 40 kD by SDS-PAGE. Smith et al. (1993) attributed this discrepancy to extensive glycosylation of the extracellular domain in vivo. The recombinant human CD30L enhanced the proliferation of CD3 (OMIM Ref. No. 186790)-activated T cells, but induced differential responses, including cell death, in several CD30-positive lymphoma-derived cell lines. Northern blot analysis suggested that CD30L expression is limited to specifically induced T cells and monocytes/macrophages. Croager and Abraham (1997) determined that the CD30L gene contains 4 exons and spans more than 17.1 kb. Cerutti et al. (2000) noted that CD153 is expressed on the surface of B cells and found that this expression is upregulated upon CD154 (OMIM Ref. No. CD40LG), IL4 (OMIM Ref. No. 147780), and B-cell receptor engagement. In these cells, engagement of CD153 by T cell CD30 inhibits immunoglobulin class switch recognition as well as IgG, IgA, and IgE production, suggesting that this 'reverse signaling' modulates the CD154-dependent switching of B cells into the pool producing IgG, IgA, and IgE. By analysis of an interspecific backcross, Smith et al. (1993) mapped the Cd30l gene to the proximal region of mouse chromosome 4. These authors used fluorescence in situ hybridization to map the human CD30L gene to 9q33.

Full details of the abovementioned studies are described in the following publications, the disclosure of which are hereby incorporated by reference:

Cerutti, A.; Schaffer, A.; Goodwin, R. G.; Shah, S.; Zan, H.; Ely, S.; Casali, P.: Engagement of CD153 (CD30 ligand) by CD30-positive T cells inhibits class switch DNA recombination and antibody production in human IgD-positive IgM-positive B cells. J. Immun. 165:786-794, 2000; and Croager, E. J.; Abraham, L. J.: Characterisation of the human CD30 ligand gene structure. Biochim. Biophys. Acta 1353:231-235, 1997.

Further studies establishing the function and utilities of TNFSF8 are found in John Hopkins OMIM database record ID 603875, and in sited publications numbered 7602-760 and 7607 listed in the bibliography section hereinbelow, which are also hereby incorporated by reference. Chemokine (C motif) Ligand 1 (XCL1, Accession NM_002995) is another VGAM655 host target gene. XCL1 BINDING SITE is HOST TARGET binding site found in the 3' untranslated region of mRNA encoded by XCL1, corresponding to a HOST TARGET binding site such as BINDING SITE I, BINDING SITE II or BINDING SITE III. Table 2 illustrates the complementarity of the nucleotide sequences of XCL1 BINDING SITE, designated SEQ ID:8886, to the nucleotide sequence of VGAM655 RNA, herein designated VGAM RNA, also designated SEQ ID:3366.

Another function of VGAM655 is therefore inhibition of Chemokine (C motif) Ligand 1 (XCL1, Accession NM_002995), a gene which shows chemotactic activity for lymphocytes but not for monocytes or neutrophils. Accordingly, utilities of VGAM655 include diagnosis, prevention and treatment of diseases and clinical conditions associated with XCL1. The function of XCL1 has been established by previous studies. Chemokines are a group of small (approximately 8 to 14 kD), mostly basic, structurally related molecules that regulate cell trafficking of various types of leukocytes through interactions with a subset of 7-transmembrane G protein-coupled receptors. Chemokines also play fundamental roles in the development, homeostasis, and function of the immune system, and they have effects on cells of the central nervous system as well as on endothelial cells involved in angiogenesis or angiostasis. Chemokines are divided into 2 major subfamilies, CXC and CC, based on the arrangement of the first 2 of the 4 conserved cysteine residues; the 2 cysteines are separated by a single amino acid in CXC chemokines and are adjacent in CC chemokines. By screening a CD8+ T-lymphocyte cDNA library with a mouse lymphotactin probe, Kennedy et al. (1995) isolated cDNAs encoding the lymphotactin XCL1, later designated SCYC1. The sequence of the deduced 114-amino acid protein is most homologous to the CC chemokines CCL8 and CCL3, but differs in that it lacks the first and third cysteines characteristic of CC and CXC chemokines. By Northern blot analysis, Kennedy et al. (1995) and Yoshida et al. (1995) revealed expression of an 0.8-kb SCYC1 transcript in activated thymic and peripheral blood CD8+ but not CD4+ T cells. In normal tissues, SCYC1 is expressed at high levels in spleen, thymus, small intestine, and peripheral blood leukocytes, as well as at low levels in lung, prostate, and ovary; it shows little or no expression in colon and testis. Lymphotactin is chemotactic for CD4+ and CD8+ T cells but not for monocytes, and induces a rise in intracellular calcium in peripheral blood lymphocytes. Yoshida et al. (1995) and Muller et al. (1995) had identified the same sequence, termed SCM1 and ATAC, respectively, homologous to mouse lymphotactin, but were unable to demonstrate chemotaxis or calcium mobilization.

Full details of the abovementioned studies are described in the following publications, the disclosure of which are hereby incorporated by reference:

Kennedy, J.; Kelner, G. S.; Kleyensteuber, S.; Schall, T. J.; Weiss, M. C.; Yssel, H.; Schneider, P. V.; Cocks, B. G.; Bacon, K. B.; Zlotnik, A.: Molecular cloning and functional characterization of human lymphotactin. J. Immun. 155:203-209, 1995; and Yoshida, T.; Imai, T.; Kakizaki, M.; Nishimura, M.; Yoshie, O.: Molecular cloning of a novel C or gamma type chemokine, SCM-1. FEBS Lett. 360:155-159, 1995.

Further studies establishing the function and utilities of XCL1 are found in John Hopkins OMIM database record ID 600250, and in sited publications numbered 7923-7928 listed in the bibliography section hereinbelow, which are also hereby incorporated by reference. FLJ12056 (Accession NM_024933) is another VGAM655 host target gene. FLJ12056 BINDING SITE is HOST TARGET binding site found in the 3' untranslated region of mRNA encoded by FLJ12056, corresponding to a HOST TARGET binding site such as BINDING SITE I, BINDING SITE II or BINDING SITE III. Table 2 illustrates the complementarity of the nucleotide sequences of FLJ12056 BINDING SITE, designated SEQ ID:24468, to the nucleotide sequence of VGAM655 RNA, herein designated VGAM RNA, also designated SEQ ID:3366.

Another function of VGAM655 is therefore inhibition of FLJ12056 (Accession NM_024933). Accordingly, utilities of VGAM655 include diagnosis, prevention and treatment of diseases and clinical conditions associated with FLJ12056. HTMP10 (Accession NM_033207) is another VGAM655 host target gene. HTMP10 BINDING SITE is HOST TARGET binding site found in the 3' untranslated region of mRNA encoded by HTMP10, corresponding to a HOST TARGET binding site such as BINDING SITE I, BINDING SITE II or BINDING SITE III. Table 2 illustrates the complementarity of the nucleotide sequences of HTMP10 BINDING SITE, designated SEQ ID:27047, to the nucleotide sequence of VGAM655 RNA, herein designated VGAM RNA, also designated SEQ ID:3366.

Another function of VGAM655 is therefore inhibition of HTMP10 (Accession NM_033207). Accordingly, utilities of VGAM655 include diagnosis, prevention and treatment of diseases and clinical conditions associated with HTMP10. KIAA0125 (Accession NM_014792) is another VGAM655 host target gene. KIAA0125 BINDING SITE is HOST TARGET binding site found in the 5' untranslated region of mRNA encoded by KIAA0125, corresponding to a HOST TARGET binding site such as BINDING SITE I, BINDING SITE II or BINDING SITE III. Table 2 illustrates the complementarity of the nucleotide sequences of KIAA0125 BINDING SITE, designated SEQ ID:16687, to the nucleotide sequence of VGAM655 RNA, herein designated VGAM RNA, also designated SEQ ID:3366.

Another function of VGAM655 is therefore inhibition of KIAA0125 (Accession NM_014792). Accordingly, utilities of VGAM655 include diagnosis, prevention and treatment of diseases and clinical conditions associated with KIAA0125. KIAA0232 (Accession XM_052627) is another VGAM655 host target gene. KIAA0232 BINDING SITE is HOST TARGET binding site found in the 3' untranslated region of mRNA encoded by KIAA0232, corresponding to a HOST TARGET binding site such as BINDING SITE I, BINDING SITE II or BINDING SITE III. Table 2 illustrates the complementarity of the nucleotide sequences of KIAA0232 BINDING SITE, designated SEQ ID:36033, to the nucleotide sequence of VGAM655 RNA, herein designated VGAM RNA, also designated SEQ ID:3366.

Another function of VGAM655 is therefore inhibition of KIAA0232 (Accession XM_052627). Accordingly, utilities of VGAM655 include diagnosis, prevention and treatment of diseases and clinical conditions associated with KIAA0232. KIAA0774 (Accession XM_166270) is another VGAM655 host target gene. KIAA0774 BINDING SITE is HOST TARGET binding site found in the 5' untranslated region of mRNA encoded by KIAA0774, corresponding to a HOST TARGET binding site such as BINDING SITE I, BINDING SITE II or BINDING SITE III. Table 2 illustrates the complementarity of the nucleotide sequences of KIAA0774 BINDING SITE, designated SEQ ID:44088, to the nucleotide sequence of VGAM655 RNA, herein designated VGAM RNA, also designated SEQ ID:3366.

Another function of VGAM655 is therefore inhibition of KIAA0774 (Accession XM_166270). Accordingly, utilities of VGAM655 include diagnosis, prevention and treatment of diseases and clinical conditions associated with KIAA0774. KIAA0847 (Accession XM_085298) is another VGAM655 host target gene. KIAA0847 BINDING SITE is HOST TARGET binding site found in the 3' untranslated region of mRNA encoded by KIAA0847, corresponding to a HOST TARGET binding site such as BINDING SITE I, BINDING SITE II or BINDING SITE III. Table 2 illustrates the complementarity of the nucleotide sequences of KIAA0847 BINDING SITE, designated SEQ ID:38045, to the nucleotide sequence of VGAM655 RNA, herein designated VGAM RNA, also designated SEQ ID:3366.

Another function of VGAM655 is therefore inhibition of KIAA0847 (Accession XM_085298). Accordingly, utilities of VGAM655 include diagnosis, prevention and treatment of diseases and clinical conditions associated with KIAA0847. SENP7 (Accession NM_020654) is another VGAM655 host target gene. SENP7 BINDING SITE is HOST TARGET binding site found in the 3' untranslated region of mRNA encoded by SENP7, corresponding to a HOST TARGET binding site such as BINDING SITE I, BINDING SITE II or BINDING SITE III. Table 2 illustrates the complementarity of the nucleotide sequences of SENP7 BINDING SITE, designated SEQ ID:21822, to the nucleotide sequence of VGAM655 RNA, herein designated VGAM RNA, also designated SEQ ID:3366.

Another function of VGAM655 is therefore inhibition of SENP7 (Accession NM_020654). Accordingly, utilities of VGAM655 include diagnosis, prevention and treatment of diseases and clinical conditions associated with SENP7. LOC158886 (Accession XM_096300) is another VGAM655 host target gene. LOC158886 BINDING SITE is HOST TARGET binding site found in the 5' untranslated region of mRNA encoded by LOC158886, corresponding to a HOST TARGET binding site such as BINDING SITE I, BINDING SITE II or BINDING SITE III. Table 2 illustrates the complementarity of the nucleotide sequences of LOC158886 BINDING SITE, designated SEQ ID:40311, to the nucleotide sequence of VGAM655 RNA, herein designated VGAM RNA, also designated SEQ ID:3366.

Another function of VGAM655 is therefore inhibition of LOC158886 (Accession XM_096300). Accordingly, utilities of VGAM655 include diagnosis, prevention and treatment of diseases and clinical conditions associated with LOC158886. FIG. 1 further provides a conceptual description of a novel bioinformatically detected viral gene of the present invention, referred to here as Viral Genomic Address Messenger 656 (VGAM656) viral gene, which modulates expression of respective host target genes thereof, the function and utility of which host target genes is known in the art.

VGAM656 is a novel bioinformatically detected regulatory, non protein coding, viral micro RNA (miRNA) gene. The method by which VGAM656 was detected is described hereinabove with reference to FIGS. 1-8.

VGAM656 gene, herein designated VGAM GENE, is a viral gene contained in the genome of Meleagrid Herpesvirus 1. VGAM656 host target gene, herein designated VGAM HOST TARGET GENE, is a human gene contained in the human genome.

VGAM656 gene encodes a VGAM656 precursor RNA, herein designated VGAM PRECURSOR RNA. Similar to other miRNA genes, and unlike most ordinary genes, VGAM656 precursor RNA does not encode a protein. A nucleotide sequence identical or highly similar to the nucleotide sequence of VGAM656 precursor RNA is designated SEQ ID:642, and is provided hereinbelow with reference to the sequence listing part. Nucleotide sequence SEQ ID:642 is located at position 77387 relative to the genome of Meleagrid Herpesvirus 1.

VGAM656 precursor RNA folds onto itself, forming VGAM656 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM656 folded precursor RNA into VGAM656 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM656 RNA is designated SEQ ID:3367, and is provided hereinbelow with reference to the sequence listing part.

VGAM656 host target gene, herein designated VGAM HOST TARGET GENE, encodes a corresponding messenger RNA, VGAM656 host target RNA, herein designated VGAM HOST TARGET RNA. VGAM656 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM656 RNA, herein designated VGAM RNA, binds complementarily to one or more host target binding sites located in untranslated regions of VGAM656 host target RNA, herein designated VGAM HOST TARGET RNA. This complementary binding is due to the fact that the nucleotide sequence of VGAM656 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM656 RNA, herein designated VGAM RNA, may have a different number of host target binding sites in untranslated regions of a VGAM656 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM656 RNA, herein designated VGAM RNA, to host target binding sites on VGAM656 host target RNA, herein designated VGAM HOST TARGET RNA, such as BINDING SITE I, BINDING SITE II and BINDING SITE III, inhibits translation of VGAM656 host target RNA into VGAM656 host target protein, herein designated VGAM HOST TARGET PROTEIN. VGAM host target protein is therefore outlined by a broken line.

It is appreciated that VGAM656 host target gene, herein designated VGAM HOST TARGET GENE, in fact represents a plurality of VGAM656 host target genes. The mRNA of each one of this plurality of VGAM656 host target genes comprises one or more host target binding sites, each having a nucleotide sequence which is at least partly complementary to VGAM656 RNA, herein designated VGAM RNA, and which when bound by VGAM656 RNA causes inhibition of translation of respective one or more VGAM656 host target proteins.

It is further appreciated by one skilled in the art that the mode of translational inhibition illustrated by FIG. 1 with specific reference to translational inhibition exerted by VGAM656 gene, herein designated VGAM GENE, on one or more VGAM656 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM656 is inhibition of expression of host target genes, as part of a novel viral mechanism of attacking a host. Accordingly, utilities of VGAM656 include diagnosis, prevention and treatment of viral infection by Meleagrid Herpesvirus 1. Specific functions, and accordingly utilities, of VGAM656 correlate with, and may be deduced from, the identity of the host target genes which VGAM656 binds and inhibits, and the function of these host target genes, as elaborated hereinbelow.

Nucleotide sequences of the VGAM656 precursor RNA, herein designated VGAM PRECURSOR RNA, and of the 'diced' VGAM656 RNA, herein designated VGAM RNA, and a schematic representation of the secondary folding of VGAM656 folded precursor RNA, herein designated VGAM FOLDED PRECURSOR RNA, of VGAM656 are further described hereinbelow with reference to Table 1.

Nucleotide sequences of host target binding sites, such as BINDING SITE-I, BINDING SITE-II and BINDING SITE-III of FIG. 1, found on VGAM656 host target RNA, and schematic representation of the complementarity of each of these host target binding sites to VGAM656 RNA, herein designated VGAM RNA, are described hereinbelow with reference to Table 2.

As mentioned hereinabove with reference to FIG. 1, a function of VGAM656 gene, herein designated VGAM is inhibition of expression of VGAM656 target genes. It is appreciated that specific functions, and accordingly utilities, of VGAM656 correlate with, and may be deduced from, the identity of the target genes which VGAM656 binds and inhibits, and the function of these target genes, as elaborated hereinbelow.

Calpain 2, (m/II) Large Subunit (CAPN2, Accession NM_001748) is a VGAM656 host target gene. CAPN2 BINDING SITE is HOST TARGET binding site found in the 3' untranslated region of mRNA encoded by CAPN2, corresponding to a HOST TARGET binding site such as BINDING SITE I, BINDING SITE II or BINDING SITE III. Table 2 illustrates the complementarity of the nucleotide sequences of CAPN2 BINDING SITE, designated SEQ ID:7484, to the nucleotide sequence of VGAM656 RNA, herein designated VGAM RNA, also designated SEQ ID:3367.

A function of VGAM656 is therefore inhibition of Calpain 2, (m/II) Large Subunit (CAPN2, Accession NM_001748). Accordingly, utilities of VGAM656 include diagnosis, prevention and treatment of diseases and clinical conditions associated with CAPN2. Dihydrolipoamide S-succinyltransferase (E2 component of 2-oxo-glutarate complex) (DLST, Accession NM_001933) is another VGAM656 host target gene. DLST BINDING SITE is HOST TARGET binding site found in the 3' untranslated region of mRNA encoded by DLST, corresponding to a HOST TARGET binding site such as BINDING SITE I, BINDING SITE II or BINDING SITE III. Table 2 illustrates the complementarity of the nucleotide sequences of DLST BINDING SITE, designated SEQ ID:7645, to the nucleotide sequence of VGAM656 RNA, herein designated VGAM RNA, also designated SEQ ID:3367.

Another function of VGAM656 is therefore inhibition of Dihydrolipoamide S-succinyltransferase (E2 component of 2-oxo-glutarate complex) (DLST, Accession NM_001933), a gene which catalyzes the oxidative decarboxylation of alpha-keto acids. Accordingly, utilities of VGAM656 include diagnosis, prevention and treatment of diseases and clinical conditions associated with DLST. The function of DLST has been established by previous studies. The alpha-keto acid dehydrogenase complexes (pyruvate dehydrogenase complex, alpha-ketoglutarate dehydrogenase complex, and branched chain alpha-keto acid dehydrogenase complex) are a family of multienzyme complexes. They are localized in mitochondria and catalyze the oxidative decarboxylation of alpha-keto acids. These 3 alpha-keto acid dehydrogenase complexes are composed of 3 different enzymes: alpha-keto acid dehydrogenase (E1), dihydrolipoamide acyltransferase (E2), and dihydrolipoamide dehydrogenase (E3). Dihydrolipoamide succinyltransferase, which is a component of the structural core of the alpha-keto glutarate dehydrogenase complex, was studied by Nakano et al. (1993), who isolated a cDNA from a human fibroblast cDNA library. They found that the DLST gene contains 3 exons and 4 introns and that the nucleotide sequence at the 5-prime donor and 3-prime acceptor sites of all introns conformed to the gt-ag rule. Amino acid sequences of the 3 exons supported their previous observation (Nakano et al., 1993) that human dihydrolipoamide succinyltransferase lacks a sequence motif for an E1 (OMIM Ref. No. 312170) and/or E3 (OMIM Ref. No. 246900) binding site. By fluorescence in situ hybridization, they found that the DLST gene is located on 14q24.2-q24.3 and that a related sequence is located on 1p31. The gene for the dihydrolipoamide acyltransferase of the branched chain alpha-keto acid dehydrogenase complex (DBT; 248610), the site of the mutation in type 2 maple syrup urine disease, is located on 1p31. Nakano et al. (1993) mentioned the possibility that mutation of the DLST gene may be a cause of familial Alzheimer disease that maps to 14q24.3 (AD3; 104311). Ali et al. (1994) mapped the DLST gene (symbolized by them KGDHC) to 14q24.3 by isotopic in situ hybridization. The cDNA they used also cross-hybridized to an apparent E2k pseudogene on 1p31. Northern analysis demonstrated that the gene is ubiquitously expressed in peripheral tissues and brain. Ali et al. (1994) mentioned Machado-Joseph disease as another candidate for mutation in the DLST gene. DLST is the E2 component of the alpha-ketoglutarate dehydrogenase complex. In contrast to the E2 components of the other 2 alpha-keto acid dehydrogenase complexes, the pyruvate dehydrogenase complex, and the branched-chain alpha-keto acid dehydrogenase complex, the alpha-KGDC E2 has a unique structure consisting of 2 domains and lacking a sequence motif of an E3 and/or E1 binding site (Patel and Harris, 1995).

Full details of the abovementioned studies are described in the following publications, the disclosure of which are hereby incorporated by reference:

Nakano, K.; Takase, C.; Sakamoto, T.; Ohta, S.; Nakagawa, S.; Ariyama, T.; Inazawa, J.; Abe, T.; Matuda, S.: An unspliced cDNA for human dihydrolipoamide succinyltransferase: characterization and mapping of the gene to chromosome 14q24.2-q24.3. Biochem. Biophys. Res. Commun. 196:527-533, 1993; and Patel, M. S.; Harris, R. A.: Mammalian alpha-keto acid dehydrogenase complexes: gene regulation and genetic defects. FASEB J. 9:1164-1172, 1995.

Further studies establishing the function and utilities of DLST are found in John Hopkins OMIM database record ID 126063, and in sited publications numbered 4003-4006 listed in the bibliography section hereinbelow, which are also hereby incorporated by reference. Kelch-like 3 (Drosophila) (KLHL3, Accession XM_113450) is another VGAM656 host target gene. KLHL3 BINDING SITE is HOST TARGET binding site found in the 3' untranslated region of mRNA encoded by KLHL3, corresponding to a HOST TARGET binding site such as BINDING SITE I, BINDING SITE II or BINDING SITE III. Table 2 illustrates the complementarity of the nucleotide sequences of KLHL3 BINDING SITE, designated SEQ ID:42267, to the nucleotide sequence of VGAM656 RNA, herein designated VGAM RNA, also designated SEQ ID:3367.

Another function of VGAM656 is therefore inhibition of Kelch-like 3 (Drosophila) (KLHL3, Accession XM_113450). Accordingly, utilities of VGAM656 include diagnosis, prevention and treatment of diseases and clinical conditions associated with KLHL3. LanC Lantibiotic Synthetase Component C-like 1 (bacterial) (LANCL1, Accession NM_006055) is another VGAM656 host target gene. LANCL1 BINDING SITE is HOST TARGET binding site found in the 3' untranslated region of mRNA encoded by LANCL1, corresponding to a HOST TARGET binding site such as BINDING SITE I, BINDING SITE II or BINDING SITE III. Table 2 illustrates the complementarity of the nucleotide sequences of LANCL1 BINDING SITE, designated SEQ ID:12696, to the nucleotide sequence of VGAM656 RNA, herein designated VGAM RNA, also designated SEQ ID:3367.

Another function of VGAM656 is therefore inhibition of LanC Lantibiotic Synthetase Component C-like 1 (bacterial) (LANCL1, Accession NM_006055), a gene which binds the C-terminus of stomatin. Accordingly, utilities of VGAM656 include diagnosis, prevention and treatment of diseases and clinical conditions associated with LANCL1. The function of LANCL1 has been established by previous studies. By affinity chromatography of solubilized human erythrocyte membrane proteins, Mayer et al. (1998) identified p40, a 40-kD protein that interacts with the C-terminus of the membrane protein stomatin (OMIM Ref. No. 133090). They used the sequence of p40 peptides to identify partial cDNAs in an EST database, and then cloned cDNAs corresponding to the entire coding region using a PCR strategy. The predicted 399-amino acid protein contains the characteristic features of G protein-coupled receptors (GPCRs), including 7 transmembrane domains. Northern blot analysis revealed that p40 is expressed as a major 4.8-kb mRNA and as a minor 1.9-kb mRNA in all tissues. Dot blot experiments indicated that the highest levels of expression were in brain, spinal cord, testis, pituitary gland, and kidney. Using in situ hybridization to monkey tissues, Mayer et al. (1998) determined that p40 is expressed at high levels in neurons of the brain and spinal cord, in thymocytes, megakaryocytes, and macrophages. Bauer et al. (2000) determined that LANCL1 is not an integral membrane protein, but rather a weakly associated peripheral membrane protein, and is not a GPCR. They found that LANCL1 contains 7 highly conserved hydrophobic repeats and may play a role in peptide modification. Western blot analysis showed that LANCL1 is mainly expressed in brain, testis, ovary, and kidney. Mayer et al. (2001) determined that the human and mouse LANCL1 genes span 45 kb and 38 kb, respectively, each comprising 10 exons Full details of the abovementioned studies are described in the following publications, the disclosure of which are hereby incorporated by reference:

Bauer, H.; Mayer, H.; Marchler-Bauer, A.; Salzer, U.; Prohaska, R.: Characterization of p40/GPR69A as a peripheral membrane protein related to the lantibiotic synthetase component C. Biochem. Biophys. Res. Commun. 275:69-74, 2000; and Mayer, H.; Bauer, H.; Prohaska, R.: Organization and chromosomal localization of the human and mouse genes coding for LanC-like protein 1 (LANCL1). Cytogenet. Cell Genet. 93:100-104.

Further studies establishing the function and utilities of LANCL1 are found in John Hopkins OMIM database record ID 604155, and in sited publications numbered 417-419 listed in the bibliography section hereinbelow, which are also hereby incorporated by reference. Mesoderm Specific Transcript Homolog (mouse) (MEST, Accession XM_046001) is another VGAM656 host target gene. MEST BINDING SITE is HOST TARGET binding site found in the 3' untranslated region of mRNA encoded by MEST, corresponding to a HOST TARGET binding site such as BINDING SITE I, BINDING SITE II or BINDING SITE III. Table 2 illustrates the complementarity of the nucleotide sequences of MEST BINDING SITE, designated SEQ ID:34639, to the nucleotide sequence of VGAM656 RNA, herein designated VGAM RNA, also designated SEQ ID:3367.

Another function of VGAM656 is therefore inhibition of Mesoderm Specific Transcript Homolog (mouse) (MEST, Accession XM_046001), a gene which appears to be required for the appropriate immediate response of females to their pups. Accordingly, utilities of VGAM656 include diagnosis, prevention and treatment of diseases and clinical conditions associated with MEST. The function of MEST has been established by previous studies. The Mest gene maps to an imprinted region of mouse chromosome 6 and is expressed monoallelically from the paternal allele. When the null allele is paternally transmitted, the offspring exhibits severe intrauterine growth retardation. Uniparental disomy of mouse chromosome 6 is associated with a similar phenotype, presumably as a result of lack of expression of the Mest gene (Ferguson-Smith et al., 1991). The human homolog, MEST, maps to 7q31.3, within a region of conserved synteny corresponding to mouse chromosome 6, and is monoallelically expressed from the paternal allele in a wide variety of tissues during prenatal and postnatal development. Uniparental disomy of chromosome 7 in human S is associated with phenotypic features of Silver-Russell syndrome (SRS; 180860), a heterogeneous disorder characterized by intrauterine and postnatal growth retardation, with or without additional dysmorphic features. Kotzot et al. (1995) predicted the presence of at least one maternally repressed gene on human chromosome 7, because they found maternal uniparental disomy for this chromosome in 4 of 35 patients with SRS. Nishita et al. (1996) suggested that MEST, the first imprinted gene to be identified on chromosome 7, is involved in the causation of this syndrome. Riesewijk et al. (1998) performed a mutation screen of the PEG1/MEST gene in 49 patients with SRS and 9 patients with primordial growth retardation (PGR). As background for this, they determined the complete genomic structure of the MEST gene, which comprises 12 exons. Apart from 1 silent mutation and 2 novel polymorphisms, nucleotide changes were not detected in any of the SRS or PGR patients. Moreover, methylation patterns of the 5-prime region of PEG1/MEST were found to be normal in 35 SRS and 9 PGR patients and different from the pattern seen in patients with maternal uniparental disomy 7. Kobayashi et al. (2001) presented findings indicating that PEG1/MEST can be excluded as a major determinant of SRS. In a screening of 15 SRS patients, no aberrant expression patterns of 2 splice variants were detected in lymphocytes. Direct sequence analysis failed to detect any mutations in the coding region of isoform-1, which the authors called alpha, and there were no significant mutations in the 5-prime flanking upstream region containing the predicted promoter and the genomic region that is highly conserved between human and mouse. Differential methylation patterns of the CpG islands for the alpha isoform were normally maintained and resulted in the same patterns as in normal controls, suggesting that there was no loss of imprinting.

Full details of the abovementioned studies are described in the following publications, the disclosure of which are hereby incorporated by reference:

Nishita, Y.; Yoshida, I.; Sado, T.; Takagi, N.: Genomic imprinting and chromosomal localization of the human MEST gene. Genomics 36:539-542, 1996; and Kobayashi, S.; Uemura, H.; Kohda, T.; Nagai, T.; Chinen, Y.; Naritomi, K.; Kinoshita, E.; Ohashi, H.; Imaizumi, K.; Tsukahara, M.; Sugio, Y.; Tonoki, H.; Kishino, T.; Tanaka, T.; Yamada, M.

Further studies establishing the function and utilities of MEST are found in John Hopkins OMIM database record ID 601029, and in sited publications numbered 4307, 9967-9968, 9332, 9969-9972, 1024 and 10675-10677 listed in the bibliography section hereinbelow, which are also hereby incorporated by reference. Myosin X (MYO10, Accession NM_012334) is another VGAM656 host target gene. MYO10 BINDING SITE is HOST TARGET binding site found in the 3' untranslated region of mRNA encoded by MYO10, corresponding to a HOST TARGET binding site such as BINDING SITE I, BINDING SITE II or BINDING SITE III. Table 2 illustrates the complementarity of the nucleotide sequences of MYO10 BINDING SITE, designated SEQ ID:14732, to the nucleotide sequence of VGAM656 RNA, herein designated VGAM RNA, also designated SEQ ID:3367.

Another function of VGAM656 is therefore inhibition of Myosin X (MYO10, Accession NM_012334), a gene which is an unconventional myosin. Accordingly, utilities of VGAM656 include diagnosis, prevention and treatment of diseases and clinical conditions associated with MYO10. The function of MYO10 and its association with various diseases and clinical conditions, has been established by previous studies, as described hereinabove with reference to VGAM28. Polymeric Immunoglobulin Receptor (PIGR, Accession XM_052013) is another VGAM656 host target gene. PIGR BINDING SITE is HOST TARGET binding site found in the 3' untranslated region of mRNA encoded by PIGR, corresponding to a HOST TARGET binding site such as BINDING SITE I, BINDING SITE II or BINDING SITE III. Table 2 illustrates the complementarity of the nucleotide sequences of PIGR BINDING SITE, designated SEQ ID:35937, to the nucleotide sequence of VGAM656 RNA, herein designated VGAM RNA, also designated SEQ ID:3367.

Another function of VGAM656 is therefore inhibition of Polymeric Immunoglobulin Receptor (PIGR, Accession XM_052013). Accordingly, utilities of VGAM656 include diagnosis, prevention and treatment of diseases and clinical conditions associated with PIGR. Pleckstrin Homology, Sec7 and Coiled/coil Domains 4 (PSCD4, Accession NM_013385) is another VGAM656 host target gene. PSCD4 BINDING SITE is HOST TARGET binding site found in the 3' untranslated region of mRNA encoded by PSCD4, corresponding to a HOST TARGET binding site such as BINDING SITE I, BINDING SITE II or BINDING SITE III. Table 2 illustrates the complementarity of the nucleotide sequences of PSCD4 BINDING SITE, designated SEQ ID:15035, to the nucleotide sequence of VGAM656 RNA, herein designated VGAM RNA, also designated SEQ ID:3367.

Another function of VGAM656 is therefore inhibition of Pleckstrin Homology, Sec7 and Coiled/coil Domains 4 (PSCD4, Accession NM_013385), a gene which promotes guanine-nucleotide exchange on arf1 and arf5. Accordingly, utilities of VGAM656 include diagnosis, prevention and treatment of diseases and clinical conditions associated with PSCD4. The function of PSCD4 and its association with various diseases and clinical conditions, has been established by previous studies, as described hereinabove with reference to VGAM615. Solute Carrier Family 16 (monocarboxylic acid transporters), Member 2 (putative transporter) (SLC16A2, Accession NM_006517) is another VGAM656 host target gene. SLC16A2 BINDING SITE is HOST TARGET binding site found in the 3' untranslated region of mRNA encoded by SLC16A2, corresponding to a HOST TARGET binding site such as BINDING SITE I, BINDING SITE II or BINDING SITE III. Table 2 illustrates the complementarity of the nucleotide sequences of SLC16A2 BINDING SITE, designated SEQ ID:13271, to the nucleotide sequence of VGAM656 RNA, herein designated VGAM RNA, also designated SEQ ID:3367.

Another function of VGAM656 is therefore inhibition of Solute Carrier Family 16 (monocarboxylic acid transporters), Member 2 (putative transporter) (SLC16A2, Accession NM_006517). Accordingly, utilities of VGAM656 include diagnosis, prevention and treatment of diseases and clinical conditions associated with SLC16A2. Stress 70 Protein Chaperone, Microsome-associated, 60 kDa (STCH, Accession NM_006948) is another VGAM656 host target gene. STCH BINDING SITE is HOST TARGET binding site found in the 3' untranslated region of mRNA encoded by STCH, corresponding to a HOST TARGET binding site such as BINDING SITE I, BINDING SITE II or BINDING SITE III. Table 2 illustrates the complementarity of the nucleotide sequences of STCH BINDING SITE, designated SEQ ID:13835, to the nucleotide sequence of VGAM656 RNA, herein designated VGAM RNA, also designated SEQ ID:3367.

Another function of VGAM656 is therefore inhibition of Stress 70 Protein Chaperone, Microsome-associated, 60 kDa (STCH, Accession NM_006948), a gene which has peptide-independent atpase activity. Accordingly, utilities of VGAM656 include diagnosis, prevention and treatment of diseases and clinical conditions associated with STCH. The function of STCH and its association with various diseases and clinical conditions, has been established by previous studies, as described hereinabove with reference to VGAM550. Sulfotransferase Family, Cytosolic, 1C, Member 1 (SULT1C1, Accession NM_001056) is another VGAM656 host target gene. SULT1C1 BINDING SITE is HOST TARGET binding site found in the 3' untranslated region of mRNA encoded by SULT1C1, corresponding to a HOST TARGET binding site such as BINDING SITE I, BINDING SITE II or BINDING SITE III. Table 2 illustrates the complementarity of the nucleotide sequences of SULT1C1 BINDING SITE, designated SEQ ID:6722, to the nucleotide sequence of VGAM656 RNA, herein designated VGAM RNA, also designated SEQ ID:3367.

Another function of VGAM656 is therefore inhibition of Sulfotransferase Family, Cytosolic, 1C, Member 1 (SULT1C1, Accession NM_001056). Accordingly, utilities of VGAM656 include diagnosis, prevention and treatment of diseases and clinical conditions associated with SULT1C1. Thiamin Pyrophosphokinase 1 (TPK1, Accession NM_022445) is another VGAM656 host target gene. TPK1 BINDING SITE is HOST TARGET binding site found in the 3' untranslated region of mRNA encoded by TPK1, corresponding to a HOST TARGET binding site such as BINDING SITE I, BINDING SITE II or BINDING SITE III. Table 2 illustrates the complementarity of the nucleotide sequences of TPK1 BINDING SITE, designated SEQ ID:22781, to the nucleotide sequence of VGAM656 RNA, herein designated VGAM RNA, also designated SEQ ID:3367.

Another function of VGAM656 is therefore inhibition of Thiamin Pyrophosphokinase 1 (TPK1, Accession NM_022445), a gene which catalyzes the conversion of thiamine, a form of vitamin B1, to thiamine pyrophosphate. Accordingly, utilities of VGAM656 include diagnosis, prevention and treatment of diseases and clinical conditions associated with TPK1. The function of TPK1 and its association with various diseases and clinical conditions, has been established by previous studies, as described hereinabove with reference to VGAM475. Tyrosine 3-monooxygenase/tryptophan 5-monooxygenase Activation Protein, Epsilon Polypeptide (YWHAE, Accession NM_006761) is another VGAM656 host target gene. YWHAE BINDING SITE is HOST TARGET binding site found in the 3' untranslated region of mRNA encoded by YWHAE, corresponding to a HOST TARGET binding site such as BINDING SITE I, BINDING SITE II or BINDING SITE III. Table 2 illustrates the complementarity of the nucleotide sequences of YWHAE BINDING SITE, designated SEQ ID:13612, to the nucleotide sequence of VGAM656 RNA, herein designated VGAM RNA, also designated SEQ ID:3367.

Another function of VGAM656 is therefore inhibition of Tyrosine 3-monooxygenase/tryptophan 5-monooxygenase Activation Protein, Epsilon Polypeptide (YWHAE, Accession NM_006761), a gene which binds to cdc25 and may facilitate cdc25 interaction with Raf-1 in vivo. Accordingly, utilities of VGAM656 include diagnosis, prevention and treatment of diseases and clinical conditions associated with YWHAE. The function of YWHAE has been established by previous studies. Using a yeast 2-hybrid screen to probe a HeLa cell library with CDC25A (OMIM Ref. No. 116947) and CDC25B (OMIM Ref. No. 116949) as bait, Conklin et al. (1995) isolated cDNAs encoding YWHAB (OMIM Ref. No. 601289), which they called 14-3-3-beta, and YWHAE, which they called 14-3-3-epsilon. YWHAE encodes a deduced 260-amino acid protein that is 100% identical to the mouse sequence. Both 14-3-3 proteins interacted with either CDC protein but did not affect their phosphatase activities. Like YWHAB, YWHAE interacted with RAF1 (OMIM Ref. No. 164760) but not RAS (OMIM Ref. No. 190020) in yeast 2-hybrid screens and may facilitate the association of CDC25 with RAF1. The binding of insulin (OMIM Ref. No. 176730) to its receptor induces the phosphorylation of the cytosolic substrates IRS1 (OMIM Ref. No. 147545) and IRS2 (OMIM Ref. No. 600797), which associate with several Src homology-2 (SH2) domain-containing proteins. To identify unique IRS1-binding proteins, Ogihara et al. (1997) screened a human heart cDNA expression library with recombinant IRS1. They obtained 2 isoforms of the 14-3-3 protein family, 14-3-3-zeta (YWHAZ; 601288) and -epsilon. 14-3-3 protein has been shown to associate with IRS1 in L6 myotubes, HepG2 hepatoma cells, Chinese hamster ovary cells, and bovine brain tissue. IRS2, a protein structurally similar to IRS1, was also shown to form a complex with 14-3-3 protein using a baculovirus expression system. The amount of 14-3-3 protein associated with IRS1 was not affected by insulin stimulation but was increased significantly by treatment with okadaic acid, a potent serine/threonine phosphatase inhibitor. The authors identified a putative 14-3-3 protein-binding site within the phosphotyrosine-binding (PTB) domain of IRS1. Ogihara et al. (1997) suggested that the association with 14-3-3 protein may play a role in the regulation of insulin sensitivity by interrupting the association between the insulin receptor and IRS1.

Full details of the abovementioned studies are described in the following publications, the disclosure of which are hereby incorporated by reference:

Conklin, D. S.; Galaktionov, K.; Beach, D.:14-3-3 proteins associate with cdc25 phosphatases. Proc. Nat. Acad. Sci. 92:7892-7896, 1995; and Ogihara, T.; Isobe, T.; Ichimura, T.; Taoka, M.; Funaki, M.; Sakoda, H.; Onishi, Y.; Inukai, K.; Anai, M.; Fukushima, Y.; Kikuchi, M.; Yazaki, Y.; Oka, Y.; Asano, T.:14-3-3 protein bin.

Further studies establishing the function and utilities of YWHAE are found in John Hopkins OMIM database record ID 605066, and in sited publications numbered 6799-6800, 10093-680 and 4469 listed in the bibliography section hereinbelow, which are also hereby incorporated by reference. Zinc Finger Protein 144 (Mel-18) (ZNF144, Accession NM_007144) is another VGAM656 host target gene. ZNF144 BINDING SITE is HOST TARGET binding site found in the 3' untranslated region of mRNA encoded by ZN144, corresponding to a HOST TARGET binding site such as BINDING SITE I, BINDING SITE II or BINDING SITE III. Table 2 illustrates the complementarity of the nucleotide sequences of ZNF144 BINDING SITE, designated SEQ ID:13989, to the nucleotide sequence of VGAM656 RNA, herein designated VGAM RNA, also designated SEQ ID:3367.

Another function of VGAM656 is therefore inhibition of Zinc Finger Protein 144 (Mel-18) (ZNF144, Accession NM_007144), a gene which is a transcriptional repressor and may play a role in the control of cell proliferation. Accordingly, utilities of VGAM656 include diagnosis, prevention and treatment of diseases and clinical conditions associated with ZNF144. The function of ZNF144 and its association with various diseases and clinical conditions, has been established by previous studies, as described hereinabove with reference to VGAM380. Apolipoprotein L, 4 (APOL4, Accession NM_030643) is another VGAM656 host target gene. APOL4 BINDING SITE is HOST TARGET binding site found in the 5' untranslated region of mRNA encoded by APOL4, corresponding to a HOST TARGET binding site such as BINDING SITE I, BINDING SITE II or BINDING SITE III. Table 2 illustrates the complementarity of the nucleotide sequences of APOL4 BINDING SITE, designated SEQ ID:24977, to the nucleotide sequence of VGAM656 RNA, herein designated VGAM RNA, also designated SEQ ID:3367.

Another function of VGAM656 is therefore inhibition of Apolipoprotein L, 4 (APOL4, Accession NM_030643). Accordingly, utilities of VGAM656 include diagnosis, prevention and treatment of diseases and clinical conditions associated with APOL4. Chromosome 20 Open Reading Frame 30 (C20orf30, Accession NM_014145) is another VGAM656 host target gene. C20orf30 BINDING SITE is HOST TARGET binding site found in the 3' untranslated region of mRNA encoded by C20orf30, corresponding to a HOST TARGET binding site such as BINDING SITE I, BINDING SITE II or BINDING SITE III. Table 2 illustrates the complementarity of the nucleotide sequences of C20orf30 BINDING SITE, designated SEQ ID:15432, to the nucleotide sequence of VGAM656 RNA, herein designated VGAM RNA, also designated SEQ ID:3367.

Another function of VGAM656 is therefore inhibition of Chromosome 20 Open Reading Frame 30 (C20orf30, Accession NM_014145). Accordingly, utilities of VGAM656 include diagnosis, prevention and treatment of diseases and clinical conditions associated with C20orf30. FLJ12985 (Accession NM_024924) is another VGAM656 host target gene. FLJ12985 BINDING SITE is HOST TARGET binding site found in the 3' untranslated region of mRNA encoded by FLJ12985, corresponding to a HOST TARGET binding site such as BINDING SITE I, BINDING SITE II or BINDING SITE III. Table 2 illustrates the complementarity of the nucleotide sequences of FLJ12985 BINDING SITE, designated SEQ ID:24462, to the nucleotide sequence of VGAM656 RNA, herein designated VGAM RNA, also designated SEQ ID:3367.

Another function of VGAM656 is therefore inhibition of FLJ12985 (Accession NM_024924). Accordingly, utilities of VGAM656 include diagnosis, prevention and treatment of diseases and clinical conditions associated with FLJ12985. KIAA0179 (Accession XM_035973) is another VGAM656 host target gene. KIAA0179 BINDING SITE is HOST TARGET binding site found in the 3' untranslated region of mRNA encoded by KIAA0179, corresponding to a HOST TARGET binding site such as BINDING SITE I, BINDING SITE II or BINDING SITE III. Table 2 illustrates the complementarity of the nucleotide sequences of KIAA0179 BINDING SITE, designated SEQ ID:32364, to the nucleotide sequence of VGAM656 RNA, herein designated VGAM RNA, also designated SEQ ID:3367.

Another function of VGAM656 is therefore inhibition of KIAA0179 (Accession XM_035973). Accordingly, utilities of VGAM656 include diagnosis, prevention and treatment of diseases and clinical conditions associated with KIAA0179. KIAA1877 (Accession XM_038616) is another VGAM656 host target gene. KIAA1877 BINDING SITE is HOST TARGET binding site found in the 3' untranslated region of mRNA encoded by KIAA1877, corresponding to a HOST TARGET binding site such as BINDING SITE I, BINDING SITE II or BINDING SITE III. Table 2 illustrates the complementarity of the nucleotide sequences of KIAA1877 BINDING SITE, designated SEQ ID:32878, to the nucleotide sequence of VGAM656 RNA, herein designated VGAM RNA, also designated SEQ ID:3367.

Another function of VGAM656 is therefore inhibition of KIAA1877 (Accession XM_038616). Accordingly, utilities of VGAM656 include diagnosis, prevention and treatment of diseases and clinical conditions associated with KIAA1877. PRO0767 (Accession NM_014083) is another VGAM656 host target gene. PRO0767 BINDING SITE is HOST TARGET binding site found in the 5' untranslated region of mRNA encoded by PRO0767, corresponding to a HOST TARGET binding site such as BINDING SITE I, BINDING SITE II or BINDING SITE III. Table 2 illustrates the complementarity of the nucleotide sequences of PRO0767 BINDING SITE, designated SEQ ID:15309, to the nucleotide sequence of VGAM656 RNA, herein designated VGAM RNA, also designated SEQ ID:3367.

Another function of VGAM656 is therefore inhibition of PRO0767 (Accession NM_014083). Accordingly, utilities of VGAM656 include diagnosis, prevention and treatment of diseases and clinical conditions associated with PRO0767. Serine Protease Inhibitor-like, with Kunitz and WAP Domains 1 (eppin) (SPINLW1, Accession NM_020398) is another VGAM656 host target gene. SPINLW1 BINDING SITE is HOST TARGET binding site found in the 3' untranslated region of mRNA encoded by SPINLW1, corresponding to a HOST TARGET binding site such as BINDING SITE I, BINDING SITE II or BINDING SITE III. Table 2 illustrates the complementarity of the nucleotide sequences of SPINLW1 BINDING SITE, designated SEQ ID:21665, to the nucleotide sequence of VGAM656 RNA, herein designated VGAM RNA, also designated SEQ ID:3367.

Another function of VGAM656 is therefore inhibition of Serine Protease Inhibitor-like, with Kunitz and WAP Domains 1 (eppin) (SPINLW1, Accession NM_020398). Accordingly, utilities of VGAM656 include diagnosis, prevention and treatment of diseases and clinical conditions associated with SPINLW1. LOC138307 (Accession XM_059963) is another VGAM656 host target gene. LOC138307 BINDING SITE is HOST TARGET binding site found in the 5' untranslated region of mRNA encoded by LOC138307, corresponding to a HOST TARGET binding site such as BINDING SITE I, BINDING SITE II or BINDING SITE III. Table 2 illustrates the complementarity of the nucleotide sequences of LOC138307 BINDING SITE, designated SEQ ID:37122, to the nucleotide sequence of VGAM656 RNA, herein designated VGAM RNA, also designated SEQ ID:3367.

Another function of VGAM656 is therefore inhibition of LOC138307 (Accession XM_059963). Accordingly, utilities of VGAM656 include diagnosis, prevention and treatment of diseases and clinical conditions associated with LOC138307. LOC144182 (Accession NM_139136) is another VGAM656 host target gene. LOC144182 BINDING SITE is HOST TARGET binding site found in the 3' untranslated region of mRNA encoded by LOC144182, corresponding to a HOST TARGET binding site such as BINDING SITE I, BINDING SITE II or BINDING SITE III. Table 2 illustrates the complementarity of the nucleotide sequences of LOC144182 BINDING SITE, designated SEQ ID:29166, to the nucleotide sequence of VGAM656 RNA, herein designated VGAM RNA, also designated SEQ ID:3367.

Another function of VGAM656 is therefore inhibition of LOC144182 (Accession NM_139136). Accordingly, utilities of VGAM656 include diagnosis, prevention and treatment of diseases and clinical conditions associated with LOC144182. LOC149734 (Accession XM_097713) is another VGAM656 host target gene. LOC149734 BINDING SITE is HOST TARGET binding site found in the 3' untranslated region of mRNA encoded by LOC149734, corresponding to a HOST TARGET binding site such as BINDING SITE I, BINDING SITE II or BINDING SITE III. Table 2 illustrates the complementarity of the nucleotide sequences of LOC149734 BINDING SITE, designated SEQ ID:41054, to the nucleotide sequence of VGAM656 RNA, herein designated VGAM RNA, also designated SEQ ID:3367.

Another function of VGAM656 is therefore inhibition of LOC149734 (Accession XM_097713). Accordingly, utilities of VGAM656 include diagnosis, prevention and treatment of diseases and clinical conditions associated with LOC149734. LOC157983 (Accession XM_088433) is another VGAM656 host target gene. LOC157983 BINDING SITE is HOST TARGET binding site found in the 3' untranslated region of mRNA encoded by LOC157983, corresponding to a HOST TARGET binding site such as BINDING SITE I, BINDING SITE II or BINDING SITE III. Table 2 illustrates the complementarity of the nucleotide sequences of LOC157983 BINDING SITE, designated SEQ ID:39687, to the nucleotide sequence of VGAM656 RNA, herein designated VGAM RNA, also designated SEQ ID:3367.

Another function of VGAM656 is therefore inhibition of LOC157983 (Accession XM_088433). Accordingly, utilities of VGAM656 include diagnosis, prevention and treatment of diseases and clinical conditions associated with LOC157983. LOC158857 (Accession XM_098997) is another VGAM656 host target gene. LOC158857 BINDING SITE is HOST TARGET binding site found in the 5' untranslated region of mRNA encoded by LOC158857, corresponding to a HOST TARGET binding site such as BINDING SITE I, BINDING SITE II or BINDING SITE III. Table 2 illustrates the complementarity of the nucleotide sequences of LOC158857 BINDING SITE, designated SEQ ID:42030, to the nucleotide sequence of VGAM656 RNA, herein designated VGAM RNA, also designated SEQ ID:3367.

Another function of VGAM656 is therefore inhibition of LOC158857 (Accession XM_098997). Accordingly, utilities of VGAM656 include diagnosis, prevention and treatment of diseases and clinical conditions associated with LOC158857. LOC159049 (Accession XM_099020) is another VGAM656 host target gene. LOC159049 BINDING SITE is HOST TARGET binding site found in the 5' untranslated region of mRNA encoded by LOC159049, corresponding to a HOST TARGET binding site such as BINDING SITE I, BINDING SITE II or BINDING SITE III. Table 2 illustrates the complementarity of the nucleotide sequences of LOC159049 BINDING SITE, designated SEQ ID:42056, to the nucleotide sequence of VGAM656 RNA, herein designated VGAM RNA, also designated SEQ ID:3367.

Another function of VGAM656 is therefore inhibition of LOC159049 (Accession XM_099020). Accordingly, utilities of VGAM656 include diagnosis, prevention and treatment of diseases and clinical conditions associated with LOC159049. LOC168283 (Accession XM_094966) is another VGAM656 host target gene. LOC168283 BINDING SITE is HOST TARGET binding site found in the 5' untranslated region of mRNA encoded by LOC168283, corresponding to a HOST TARGET binding site such as BINDING SITE I, BINDING SITE II or BINDING SITE III. Table 2 illustrates the complementarity of the nucleotide sequences of LOC168283 BINDING SITE, designated SEQ ID:40240, to the nucleotide sequence of VGAM656 RNA, herein designated VGAM RNA, also designated SEQ ID:3367.

Another function of VGAM656 is therefore inhibition of LOC168283 (Accession XM_094966). Accordingly, utilities of VGAM656 include diagnosis, prevention and treatment of diseases and clinical conditions associated with LOC168283. LOC203289 (Accession XM_114672) is another VGAM656 host target gene. LOC203289 BINDING SITE is HOST TARGET binding site found in the 3' untranslated region of mRNA encoded by LOC203289, corresponding to a HOST TARGET binding site such as BINDING SITE I, BINDING SITE II or BINDING SITE III. Table 2 illustrates the complementarity of the nucleotide sequences of LOC203289 BINDING SITE, designated SEQ ID:43029, to the nucleotide sequence of VGAM656 RNA, herein designated VGAM RNA, also designated SEQ ID:3367.

Another function of VGAM656 is therefore inhibition of LOC203289 (Accession XM_114672). Accordingly, utilities of VGAM656 include diagnosis, prevention and treatment of diseases and clinical conditions associated with LOC203289. LOC203378 (Accession XM_117541) is another VGAM656 host target gene. LOC203378 BINDING SITE is HOST TARGET binding site found in the 5' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43545, to the nucleotide sequence of VGAM656 RNA, herein designated VGAM RNA, also designated SEQ ID:3367.

Another function of VGAM656 is therefore inhibition of LOC203378 (Accession XM_117541). Accordingly, utilities of VGAM656 include diagnosis, prevention and treatment of diseases and clinical conditions associated with LOC203378. LOC255624 (Accession XM_170531) is another VGAM656 host target gene. LOC255624 BINDING SITE is HOST TARGET binding site found in the 3' untranslated region of mRNA encoded by LOC255624, corresponding to a HOST TARGET binding site such as BINDING SITE I, BINDING SITE II or BINDING SITE III. Table 2 illustrates the complementarity of the nucleotide sequences of LOC255624 BINDING SITE, designated SEQ ID:45350, to the nucleotide sequence of VGAM656 RNA, herein designated VGAM RNA, also designated SEQ ID:3367.

Another function of VGAM656 is therefore inhibition of LOC255624 (Accession XM_170531). Accordingly, utilities of VGAM656 include diagnosis, prevention and treatment of diseases and clinical conditions associated with LOC255624. LOC256544 (Accession XM_171228) is another VGAM656 host target gene. LOC256544 BINDING SITE is HOST TARGET binding site found in the 3' untranslated region of mRNA encoded by LOC256544, corresponding to a HOST TARGET binding site such as BINDING SITE I, BINDING SITE II or BINDING SITE III. Table 2 illustrates the complementarity of the nucleotide sequences of LOC256544 BINDING SITE, designated SEQ ID:46016, to the nucleotide sequence of VGAM656 RNA, herein designated VGAM RNA, also designated SEQ ID:3367.

Another function of VGAM656 is therefore inhibition of LOC256544 (Accession XM_171228). Accordingly, utilities of VGAM656 include diagnosis, prevention and treatment of diseases and clinical conditions associated with LOC256544. LOC91151 (Accession NM_033208) is another VGAM656 host target gene. LOC91151 BINDING SITE is HOST TARGET binding site found in the 5' untranslated region of mRNA encoded by LOC91151, corresponding to a HOST TARGET binding site such as BINDING SITE I, BINDING SITE II or BINDING SITE III. Table 2 illustrates the complementarity of the nucleotide sequences of LOC91151 BINDING SITE, designated SEQ ID:27052, to the nucleotide sequence of VGAM656 RNA, herein designated VGAM RNA, also designated SEQ ID:3367.

Another function of VGAM656 is therefore inhibition of LOC91151 (Accession NM_033208). Accordingly, utilities of VGAM656 include diagnosis, prevention and treatment of diseases and clinical conditions associated with LOC91151. LOC92492 (Accession XM_045396) is another VGAM656 host target gene. LOC92492 BINDING SITE is HOST TARGET binding site found in the 5' untranslated region of mRNA encoded by LOC92492, corresponding to a HOST TARGET binding site such as BINDING SITE I, BINDING SITE II or BINDING SITE III. Table 2 illustrates the complementarity of the nucleotide sequences of LOC92492 BINDING SITE, designated SEQ ID:34454, to the nucleotide sequence of VGAM656 RNA, herein designated VGAM RNA, also designated SEQ ID:3367.

Another function of VGAM656 is therefore inhibition of LOC92492 (Accession XM_045396). Accordingly, utilities of VGAM656 include diagnosis, prevention and treatment of diseases and clinical conditions associated with LOC92492. LOC92573 (Accession XM_045884) is another VGAM656 host target gene. LOC92573 BINDING SITE is HOST TARGET binding site found in the 5' untranslated region of mRNA encoded by LOC92573, corresponding to a HOST TARGET binding site such as BINDING SITE I, BINDING SITE II or BINDING SITE III. Table 2 illustrates the complementarity of the nucleotide sequences of LOC92573 BINDING SITE, designated SEQ ID:34594, to the nucleotide sequence of VGAM656 RNA, herein designated VGAM RNA, also designated SEQ ID:3367.

Another function of VGAM656 is therefore inhibition of LOC92573 (Accession XM_045884). Accordingly, utilities of VGAM656 include diagnosis, prevention and treatment of diseases and clinical conditions associated with LOC92573. FIG. 1 further provides a conceptual description of a novel bioinformatically detected viral gene of the present invention, referred to here as Viral Genomic Address Messenger 657 (VGAM657) viral gene, which modulates expression of respective host target genes thereof, the function and utility of which host target genes is known in the art.

VGAM657 is a novel bioinformatically detected regulatory, non protein coding, viral micro RNA (miRNA) gene. The method by which VGAM657 was detected is described hereinabove with reference to FIGS. 1-8.

VGAM657 gene, herein designated VGAM GENE, is a viral gene contained in the genome of Meleagrid Herpesvirus 1. VGAM657 host target gene, herein designated VGAM HOST TARGET GENE, is a human gene contained in the human genome.

VGAM657 gene encodes a VGAM657 precursor RNA, herein designated VGAM PRECURSOR RNA. Similar to other miRNA genes, and unlike most ordinary genes, VGAM657 precursor RNA does not encode a protein. A nucleotide sequence identical or highly similar to the nucleotide sequence of VGAM657 precursor RNA is designated SEQ ID:643, and is provided hereinbelow with reference to the sequence listing part. Nucleotide sequence SEQ ID:643 is located at position 75089 relative to the genome of Meleagrid Herpesvirus 1.

VGAM657 precursor RNA folds onto itself, forming VGAM657 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM657 folded precursor RNA into VGAM657 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM657 RNA is designated SEQ ID:3368, and is provided hereinbelow with reference to the sequence listing part.

VGAM657 host target gene, herein designated VGAM HOST TARGET GENE, encodes a corresponding messenger RNA, VGAM657 host target RNA, herein designated VGAM HOST TARGET RNA. VGAM657 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM657 RNA, herein designated VGAM RNA, binds complementarily to one or more host target binding sites located in untranslated regions of VGAM657 host target RNA, herein designated VGAM HOST TARGET RNA. This complementary binding is due to the fact that the nucleotide sequence of VGAM657 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM657 RNA, herein designated VGAM RNA, may have a different number of host target binding sites in untranslated regions of a VGAM657 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM657 RNA, herein designated VGAM RNA, to host target binding sites on VGAM657 host target RNA, herein designated VGAM HOST TARGET RNA, such as BINDING SITE I, BINDING SITE II and BINDING SITE III, inhibits translation of VGAM657 host target RNA into VGAM657 host target protein, herein designated VGAM HOST TARGET PROTEIN. VGAM host target protein is therefore outlined by a broken line.

It is appreciated that VGAM657 host target gene, herein designated VGAM HOST TARGET GENE, in fact represents a plurality of VGAM657 host target genes. The mRNA of each one of this plurality of VGAM657 host target genes comprises one or more host target binding sites, each having a nucleotide sequence which is at least partly complementary to VGAM657 RNA, herein designated VGAM RNA, and which when bound by VGAM657 RNA causes inhibition of translation of respective one or more VGAM657 host target proteins.

It is further appreciated by one skilled in the art that the mode of translational inhibition illustrated by FIG. 1 with specific reference to translational inhibition exerted by VGAM657 gene, herein designated VGAM GENE, on one or more VGAM657 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM657 is inhibition of expression of host target genes, as part of a novel viral mechanism of attacking a host. Accordingly, utilities of VGAM657 include diagnosis, prevention and treatment of viral infection by Meleagrid Herpesvirus 1. Specific functions, and accordingly utilities, of VGAM657 correlate with, and may be deduced from, the identity of the host target genes which VGAM657 binds and inhibits, and the function of these host target genes, as elaborated hereinbelow.

Nucleotide sequences of the VGAM657 precursor RNA, herein designated VGAM PRECURSOR RNA, and of the 'diced' VGAM657 RNA, herein designated VGAM RNA, and a schematic representation of the secondary folding of VGAM657 folded precursor RNA, herein designated VGAM FOLDED PRECURSOR RNA, of VGAM657 are further described hereinbelow with reference to Table 1.

Nucleotide sequences of host target binding sites, such as BINDING SITE-I, BINDING SITE-II and BINDING SITE-III of FIG. 1, found on VGAM657 host target RNA, and schematic representation of the complementarity of each of these host target binding sites to VGAM657 RNA, herein designated VGAM RNA, are described hereinbelow with reference to Table 2.

As mentioned hereinabove with reference to FIG. 1, a function of VGAM657 gene, herein designated VGAM is inhibition of expression of VGAM657 target genes. It is appreciated that specific functions, and accordingly utilities, of VGAM657 correlate with, and may be deduced from, the identity of the target genes which VGAM657 binds and inhibits, and the function of these target genes, as elaborated hereinbelow.

LanC Lantibiotic Synthetase Component C-like 1 (bacterial) (LANCL1, Accession NM_006055) is a VGAM657 host target gene. LANCL1 BINDING SITE is HOST TARGET binding site found in the 3' untranslated region of mRNA encoded by LANCL1, corresponding to a HOST TARGET binding site such as BINDING SITE I, BINDING SITE II or BINDING SITE III. Table 2 illustrates the complementarity of the nucleotide sequences of LANCL1 BINDING SITE, designated SEQ ID:12694, to the nucleotide sequence of VGAM657 RNA, herein designated VGAM RNA, also designated SEQ ID:3368.

A function of VGAM657 is therefore inhibition of LanC Lantibiotic Synthetase Component C-like 1 (bacterial) (LANCL1, Accession NM_006055), a gene which binds the C-terminus of stomatin. Accordingly, utilities of VGAM657 include diagnosis, prevention and treatment of diseases and clinical conditions associated with LANCL1. The function of LANCL1 and its association with various diseases and clinical conditions, has been established by previous studies, as described hereinabove with reference to VGAM656. Family with Sequence Similarity 8, Member A1 (FAM8A1, Accession NM_016255) is another VGAM657 host target gene. FAM8A1 BINDING SITE is HOST TARGET binding site found in the 3' untranslated region of mRNA encoded by FAM8A1, corresponding to a HOST TARGET binding site such as BINDING SITE I, BINDING SITE II or BINDING SITE III. Table 2 illustrates the complementarity of the nucleotide sequences of FAM8A1 BINDING SITE, designated SEQ ID:18381, to the nucleotide sequence of VGAM657 RNA, herein designated VGAM RNA, also designated SEQ ID:3368.

Another function of VGAM657 is therefore inhibition of Family with Sequence Similarity 8, Member A1 (FAM8A1, Accession NM_016255). Accordingly, utilities of VGAM657 include diagnosis, prevention and treatment of diseases and clinical conditions associated with FAM8A1. Origin Recognition Complex, Subunit 6 Homolog-like (yeast) (ORC6L, Accession NM_014321) is another VGAM657 host target gene. ORC6L BINDING SITE is HOST TARGET binding site found in the 3' untranslated region of mRNA encoded by ORC6L, corresponding to a HOST TARGET binding site such as BINDING SITE I, BINDING SITE II or BINDING SITE III. Table 2 illustrates the complementarity of the nucleotide sequences of ORC6L BINDING SITE, designated SEQ ID:15620, to the nucleotide sequence of VGAM657 RNA, herein designated VGAM RNA, also designated SEQ ID:3368.

Another function of VGAM657 is therefore inhibition of Origin Recognition Complex, Subunit 6 Homolog-like (yeast) (ORC6L, Accession NM_014321). Accordingly, utilities of VGAM657 include diagnosis, prevention and treatment of diseases and clinical conditions associated with ORC6L. Serine/threonine Kinase 38 Like (STK38L, Accession XM_044823) is another VGAM657 host target gene. STK38L BINDING SITE is HOST TARGET binding site found in the 3' untranslated region of mRNA encoded by STK38L, corresponding to a HOST TARGET binding site such as BINDING SITE I, BINDING SITE II or BINDING SITE III. Table 2 illustrates the complementarity of the nucleotide sequences of STK38L BINDING SITE, designated SEQ ID:34291, to the nucleotide sequence of VGAM657 RNA, herein designated VGAM RNA, also designated SEQ ID:3368.

Another function of VGAM657 is therefore inhibition of Serine/threonine Kinase 38 Like (STK38L, Accession XM_044823). Accordingly, utilities of VGAM657 include diagnosis, prevention and treatment of diseases and clinical conditions associated with STK38L. ZER6 (Accession XM_032742) is another VGAM657 host target gene. ZER6 BINDING SITE is HOST TARGET binding site found in the 3' untranslated region of mRNA encoded by ZER6, corresponding to a HOST TARGET binding site such as BINDING SITE I, BINDING SITE II or BINDING SITE III. Table 2 illustrates the complementarity of the nucleotide sequences of ZER6 BINDING SITE, designated SEQ ID:31741, to the nucleotide sequence of VGAM657 RNA, herein designated VGAM RNA, also designated SEQ ID:3368.

Another function of VGAM657 is therefore inhibition of ZER6 (Accession XM_032742). Accordingly, utilities of VGAM657 include diagnosis, prevention and treatment of diseases and clinical conditions associated with ZER6. Zinc Finger RNA Binding Protein (ZFR, Accession NM_016107) is another VGAM657 host target gene. ZFR BINDING SITE is HOST TARGET binding site found in the 3' untranslated region of mRNA encoded by ZFR, corresponding to a HOST TARGET binding site such as BINDING SITE I, BINDING SITE II or BINDING SITE III. Table 2 illustrates the complementarity of the nucleotide sequences of ZFR BINDING SITE, designated SEQ ID:18187, to the nucleotide sequence of VGAM657 RNA, herein designated VGAM RNA, also designated SEQ ID:3368.

Another function of VGAM657 is therefore inhibition of Zinc Finger RNA Binding Protein (ZFR, Accession NM_016107). Accordingly, utilities of VGAM657 include diagnosis, prevention and treatment of diseases and clinical conditions associated with ZFR. LOC152765 (Accession XM_087519) is another VGAM657 host target gene. LOC152765 BINDING SITE is HOST TARGET binding site found in the 3' untranslated region of mRNA encoded by LOC152765, corresponding to a HOST TARGET binding site such as BINDING SITE I, BINDING SITE II or BINDING SITE III. Table 2 illustrates the complementarity of the nucleotide sequences of LOC152765 BINDING SITE, designated SEQ ID:39317, to the nucleotide sequence of VGAM657 RNA, herein designated VGAM RNA, also designated SEQ ID:3368.

Another function of VGAM657 is therefore inhibition of LOC152765 (Accession XM_087519). Accordingly, utilities of VGAM657 include diagnosis, prevention and treatment of diseases and clinical conditions associated with LOC152765. LOC256401 (Accession XM_171149) is another VGAM657 host target gene. LOC256401 BINDING SITE is HOST TARGET binding site found in the 5' untranslated region of mRNA encoded by LOC256401, corresponding to a HOST TARGET binding site such as BINDING SITE I, BINDING SITE II or BINDING SITE III. Table 2 illustrates the complementarity of the nucleotide sequences of LOC256401 BINDING SITE, designated SEQ ID:45946, to the nucleotide sequence of VGAM657 RNA, herein designated VGAM RNA, also designated SEQ ID:3368.

Another function of VGAM657 is therefore inhibition of LOC256401 (Accession XM_171149). Accordingly, utilities of VGAM657 include diagnosis, prevention and treatment of diseases and clinical conditions associated with LOC256401. FIG. 1 further provides a conceptual description of a novel bioinformatically detected viral gene of the present invention, referred to here as Viral Genomic Address Messenger 658 (VGAM658) viral gene, which modulates expression of respective host target genes thereof, the function and utility of which host target genes is known in the art.

VGAM658 is a novel bioinformatically detected regulatory, non protein coding, viral micro RNA (miRNA) gene. The method by which VGAM658 was detected is described hereinabove with reference to FIGS. 1-8.

VGAM658 gene, herein designated VGAM GENE, is a viral gene contained in the genome of Meleagrid Herpesvirus 1. VGAM658 host target gene, herein designated VGAM HOST TARGET GENE, is a human gene contained in the human genome.

VGAM658 gene encodes a VGAM658 precursor RNA, herein designated VGAM PRECURSOR RNA. Similar to other miRNA genes, and unlike most ordinary genes, VGAM658 precursor RNA does not encode a protein. A nucleotide sequence identical or highly similar to the nucleotide sequence of VGAM658 precursor RNA is designated SEQ ID:644, and is provided hereinbelow with reference to the sequence listing part. Nucleotide sequence SEQ ID:644 is located at position 79923 relative to the genome of Meleagrid Herpesvirus 1.

VGAM658 precursor RNA folds onto itself, forming VGAM658 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM658 folded precursor RNA into VGAM658 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM658 RNA is designated SEQ ID:3369, and is provided hereinbelow with reference to the sequence listing part.

VGAM658 host target gene, herein designated VGAM HOST TARGET GENE, encodes a corresponding messenger RNA, VGAM658 host target RNA, herein designated VGAM HOST TARGET RNA. VGAM658 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM658 RNA, herein designated VGAM RNA, binds complementarily to one or more host target binding sites located in untranslated regions of VGAM658 host target RNA, herein designated VGAM HOST TARGET RNA. This complementary binding is due to the fact that the nucleotide sequence of VGAM658 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM658 RNA, herein designated VGAM RNA, may have a different number of host target binding sites in untranslated regions of a VGAM658 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM658 RNA, herein designated VGAM RNA, to host target binding sites on VGAM658 host target RNA, herein designated VGAM HOST TARGET RNA, such as BINDING SITE I, BINDING SITE II and BINDING SITE III, inhibits translation of VGAM658 host target RNA into VGAM658 host target protein, herein designated VGAM HOST TARGET PROTEIN. VGAM host target protein is therefore outlined by a broken line.

It is appreciated that VGAM658 host target gene, herein designated VGAM HOST TARGET GENE, in fact represents a plurality of VGAM658 host target genes. The mRNA of each one of this plurality of VGAM658 host target genes comprises one or more host target binding sites, each having a nucleotide sequence which is at least partly complementary to VGAM658 RNA, herein designated VGAM RNA, and which when bound by VGAM658 RNA causes inhibition of translation of respective one or more VGAM658 host target proteins.

It is further appreciated by one skilled in the art that the mode of translational inhibition illustrated by FIG. 1 with specific reference to translational inhibition exerted by VGAM658 gene, herein designated VGAM GENE, on one or more VGAM658 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM658 is inhibition of expression of host target genes, as part of a novel viral mechanism of attacking a host. Accordingly, utilities of VGAM658 include diagnosis, prevention and treatment of viral infection by Meleagrid Herpesvirus 1. Specific functions, and accordingly utilities, of VGAM658 correlate with, and may be deduced from, the identity of the host target genes which VGAM658 binds and inhibits, and the function of these host target genes, as elaborated hereinbelow.

Nucleotide sequences of the VGAM658 precursor RNA, herein designated VGAM PRECURSOR RNA, and of the 'diced' VGAM658 RNA, herein designated VGAM RNA, and a schematic representation of the secondary folding of VGAM658 folded precursor RNA, herein designated VGAM FOLDED PRECURSOR RNA, of VGAM658 are further described hereinbelow with reference to Table 1.

Nucleotide sequences of host target binding sites, such as BINDING SITE-I, BINDING SITE-II and BINDING SITE-III of FIG. 1, found on VGAM658 host target RNA, and schematic representation of the complementarity of each of these host target binding sites to VGAM658 RNA, herein designated VGAM RNA, are described hereinbelow with reference to Table 2.

As mentioned hereinabove with reference to FIG. 1, a function of VGAM658 gene, herein designated VGAM is inhibition of expression of VGAM658 target genes. It is appreciated that specific functions, and accordingly utilities, of VGAM658 correlate with, and may be deduced from, the identity of the target genes which VGAM658 binds and inhibits, and the function of these target genes, as elaborated hereinbelow.

CMG2 (Accession NM_058172) is a VGAM658 host target gene. CMG2 BINDING SITE is HOST TARGET binding site found in the 3' untranslated region of mRNA encoded by CMG2, corresponding to a HOST TARGET binding site such as BINDING SITE I, BINDING SITE II or BINDING SITE III. Table 2 illustrates the complementarity of the nucleotide sequences of CMG2 BINDING SITE, designated SEQ ID:27716, to the nucleotide sequence of VGAM658 RNA, herein designated VGAM RNA, also designated SEQ ID:3369.

A function of VGAM658 is therefore inhibition of CMG2 (Accession NM_058172). Accordingly, utilities of VGAM658 include diagnosis, prevention and treatment of diseases and clinical conditions associated with CMG2. LOC91664 (Accession XM_039908) is another VGAM658 host target gene. LOC91664 BINDING SITE is HOST TARGET binding site found in the 3' untranslated region of mRNA encoded by LOC91664, corresponding to a HOST TARGET binding site such as BINDING SITE I, BINDING SITE II or BINDING SITE III. Table 2 illustrates the complementarity of the nucleotide sequences of LOC91664 BINDING SITE, designated SEQ ID:33214, to the nucleotide sequence of VGAM658 RNA, herein designated VGAM RNA, also designated SEQ ID:3369.

Another function of VGAM658 is therefore inhibition of LOC91664 (Accession XM_039908). Accordingly, utilities of VGAM658 include diagnosis, prevention and treatment of diseases and clinical conditions associated with LOC91664. FIG. 1 further provides a conceptual description of a novel bioinformatically detected viral gene of the present invention, referred to here as Viral Genomic Address Messenger 659 (VGAM659) viral gene, which modulates expression of respective host target genes thereof, the function and utility of which host target genes is known in the art.

VGAM659 is a novel bioinformatically detected regulatory, non protein coding, viral micro RNA (miRNA) gene. The method by which VGAM659 was detected is described hereinabove with reference to FIGS. 1-8.

VGAM659 gene, herein designated VGAM GENE, is a viral gene contained in the genome of Meleagrid Herpesvirus 1. VGAM659 host target gene, herein designated VGAM HOST TARGET GENE, is a human gene contained in the human genome.

VGAM659 gene encodes a VGAM659 precursor RNA, herein designated VGAM PRECURSOR RNA. Similar to other miRNA genes, and unlike most ordinary genes, VGAM659 precursor RNA does not encode a protein. A nucleotide sequence identical or highly similar to the nucleotide sequence of VGAM659 precursor RNA is designated SEQ ID:645, and is provided hereinbelow with reference to the sequence listing part. Nucleotide sequence SEQ ID:645 is located at position 80037 relative to the genome of Meleagrid Herpesvirus 1.

VGAM659 precursor RNA folds onto itself, forming VGAM659 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM659 folded precursor RNA into VGAM659 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 57%) nucleotide sequence of VGAM659 RNA is designated SEQ ID:3370, and is provided hereinbelow with reference to the sequence listing part.

VGAM659 host target gene, herein designated VGAM HOST TARGET GENE, encodes a corresponding messenger RNA, VGAM659 host target RNA, herein designated VGAM HOST TARGET RNA. VGAM659 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM659 RNA, herein designated VGAM RNA, binds complementarily to one or more host target binding sites located in untranslated regions of VGAM659 host target RNA, herein designated VGAM HOST TARGET RNA. This complementary binding is due to the fact that the nucleotide sequence of VGAM659 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM659 RNA, herein designated VGAM RNA, may have a different number of host target binding sites in untranslated regions of a VGAM659 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM659 RNA, herein designated VGAM RNA, to host target binding sites on VGAM659 host target RNA, herein designated VGAM HOST TARGET RNA, such as BINDING SITE I, BINDING SITE II and BINDING SITE III, inhibits translation of VGAM659 host target RNA into VGAM659 host target protein, herein designated VGAM HOST TARGET PROTEIN. VGAM host target protein is therefore outlined by a broken line.

It is appreciated that VGAM659 host target gene, herein designated VGAM HOST TARGET GENE, in fact represents a plurality of VGAM659 host target genes. The mRNA of each one of this plurality of VGAM659 host target genes comprises one or more host target binding sites, each having a nucleotide sequence which is at least partly complementary to VGAM659 RNA, herein designated VGAM RNA, and which when bound by VGAM659 RNA causes inhibition of translation of respective one or more VGAM659 host target proteins.

It is further appreciated by one skilled in the art that the mode of translational inhibition illustrated by FIG. 1 with specific reference to translational inhibition exerted by VGAM659 gene, herein designated VGAM GENE, on one or more VGAM659 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM659 is inhibition of expression of host target genes, as part of a novel viral mechanism of attacking a host. Accordingly, utilities of VGAM659 include diagnosis, prevention and treatment of viral infection by Meleagrid Herpesvirus 1. Specific functions, and accordingly utilities, of VGAM659 correlate with, and may be deduced from, the identity of the host target genes which VGAM659 binds and inhibits, and the function of these host target genes, as elaborated hereinbelow.

Nucleotide sequences of the VGAM659 precursor RNA, herein designated VGAM PRECURSOR RNA, and of the 'diced' VGAM659 RNA, herein designated VGAM RNA, and a schematic representation of the secondary folding of VGAM659 folded precursor RNA, herein designated VGAM FOLDED PRECURSOR RNA, of VGAM659 are further described hereinbelow with reference to Table 1.

Nucleotide sequences of host target binding sites, such as BINDING SITE-I, BINDING SITE-II and BINDING SITE-III of FIG. 1, found on VGAM659 host target RNA, and schematic representation of the complementarity of each of these host target binding sites to VGAM659 RNA, herein designated VGAM RNA, are described hereinbelow with reference to Table 2.

As mentioned hereinabove with reference to FIG. 1, a function of VGAM659 gene, herein designated VGAM is inhibition of expression of VGAM659 target genes. It is appreciated that specific functions, and accordingly utilities, of VGAM659 correlate with, and may be deduced from, the identity of the target genes which VGAM659 binds and inhibits, and the function of these target genes, as elaborated hereinbelow.

ATPase, Na+/K+ Transporting, Beta 2 Polypeptide (ATP1B2, Accession NM_001678) is a VGAM659 host target gene. ATP1B2 BINDING SITE is HOST TARGET binding site found in the 3' untranslated region of mRNA encoded by ATP1B2, corresponding to a HOST TARGET binding site such as BINDING SITE I, BINDING SITE II or BINDING SITE III. Table 2 illustrates the complementarity of the nucleotide sequences of ATP1B2 BINDING SITE, designated SEQ ID:7389, to the nucleotide sequence of VGAM659 RNA, herein designated VGAM RNA, also designated SEQ ID:3370.

A function of VGAM659 is therefore inhibition of ATPase, Na+/K+ Transporting, Beta 2 Polypeptide (ATP1B2, Accession NM_001678), a gene which catalyzes the hydrolysis of ATP coupled with the exchange of Na +/K+ ions across the plasma membrane. Accordingly, utilities of VGAM659 include diagnosis, prevention and treatment of diseases and clinical conditions associated with ATP1B2. The function of ATP1B2 and its association with various diseases and clinical conditions, has been established by previous studies, as described hereinabove with reference to VGAM152. Disabled Homolog 2, Mitogen-responsive Phosphoprotein (Drosophila) (DAB2, Accession NM_001343) is another VGAM659 host target gene. DAB2 BINDING SITE is HOST TARGET binding site found in the 3' untranslated region of mRNA encoded by DAB2, corresponding to a HOST TARGET binding site such as BINDING SITE I, BINDING SITE II or BINDING SITE III. Table 2 illustrates the complementarity of the nucleotide sequences of DAB2 BINDING SITE, designated SEQ ID:7021, to the nucleotide sequence of VGAM659 RNA, herein designated VGAM RNA, also designated SEQ ID:3370.

Another function of VGAM659 is therefore inhibition of Disabled Homolog 2, Mitogen-responsive Phosphoprotein (Drosophila) (DAB2, Accession NM_001343), a gene which may be a component of the csf-1 signal transduction pathway. Accordingly, utilities of VGAM659 include diagnosis, prevention and treatment of diseases and clinical conditions associated with DAB2. The function of DAB2 has been established by previous studies. Mok et al. (1994) used a PCR-based differential display method to identify genes expressed in ovarian cancer. Two cDNAs, termed DOC1 and DOC2 by them (for Differentially expressed in Ovarian Cancer), were identified that were expressed in normal ovarian epithelial cells but were down-regulated or absent from ovarian carcinoma cell lines. Albertsen et al. (1996) determined the complete sequence of the 3.2-kb DOC2 cDNA. They also cloned a genomic fragment at the 5-prime end of the gene which includes exons 1 to 8. The 770-amino acid predicted protein has an overall 83% identity with the mouse p96 protein, a putative mitogen-responsive phosphoprotein; homology is strongest in the amino-terminal end of the protein in a region corresponding to the phosphotyrosine interaction domain. The mouse p96 protein is phosphorylated on serine residues rather than tyrosines; phosphorylation is lowest in the G1 cell cycle stage but rapidly increases following mitogenic stimulation with colony stimulating factor (OMIM Ref. No. 120420)(Xu et al., 1995). Albertsen et al. (1996) mapped the DOC2 gene to 5p13 by fluorescence in situ hybridization and confirmed the mapping through analysis of a human/rodent somatic cell hybrid mapping panel. The authors stated that DOC2 is expressed in at least 7 different human tissues and that it and its murine homolog are likely expressed in a tissue-independent manner. Mok et al. (1998) reported that when DOC2 was transfected into an ovarian carcinoma cell line, the stable transfectants showed significantly reduced growth rate and ability to form tumors in nude mice.

Full details of the abovementioned studies are described in the following publications, the disclosure of which are hereby incorporated by reference:

Mok, S. C.; Chan, W. Y.; Wong, K. K.; Cheung, K. K.; Lau, C. C.; Ng, S. W.; Baldini, A.; Colitti, C. V.; Rock, C. O.; Berkowitz, R. S.: DOC-2, a candidate tumor suppressor gene in human epithelial ovarian cancer. Oncogene 16:2381-2387, 1998; and Xu, X.-X.; Yang, W.; Jackowski, S.; Rock, C. O.: Cloning of a novel phosphoprotein regulated by colony-stimulating factor 1 shares a domain with the Drosophila disabled gene product. J.

Further studies establishing the function and utilities of DAB2 are found in John Hopkins OMIM database record ID 601236, and in sited publications numbered 2837-283 and 2827-2828 listed in the bibliography section hereinbelow, which are also hereby incorporated by reference. Potassium Voltage-gated Channel, Shaker-related Subfamily, Beta Member 2 (KCNAB2, Accession NM_003636) is another VGAM659 host target gene. KCNAB2 BINDING SITE is HOST TARGET binding site found in the 3' untranslated region of mRNA encoded by KCNAB2, corresponding to a HOST TARGET binding site such as BINDING SITE I, BINDING SITE II or BINDING SITE III. Table 2 illustrates the complementarity of the nucleotide sequences of KCNAB2 BINDING SITE, designated SEQ ID:9704, to the nucleotide sequence of VGAM659 RNA, herein designated VGAM RNA, also designated SEQ ID:3370.

Another function of VGAM659 is therefore inhibition of Potassium Voltage-gated Channel, Shaker-related Subfamily, Beta Member 2 (KCNAB2, Accession NM_003636), a gene which is the beta subunit of shaker voltage-gated potassium channels. Accordingly, utilities of VGAM659 include diagnosis, prevention and treatment of diseases and clinical conditions associated with KCNAB2. The function of KCNAB2 has been established by previous studies. 'Shaker' and other voltage-dependent potassium channel proteins help to determine the electrical properties of excitable cells and play additional physiological roles in nonexcitable cell types. See KCNA1 (OMIM Ref. No. 176260). Mammalian Shaker potassium channel alpha subunits associate with cytoplasmic beta subunits that modulate the inactivation of the channel. The beta subunits belong to a superfamily of NAD(P)H-dependent enzymes, suggesting that they may be involved in additional physiologic processes. Shaker potassium channel complexes are thought to be composed of 4 alpha and 4 beta subunits. By PCR of a human hippocampal library with degenerate primers based on conserved regions of rat beta-1 (KCNA1B; 601141) and beta-2 subunits, McCormack et al. (1995) isolated cDNAs encoding human beta-1 and beta-2. The predicted 367-amino acid human, bovine, and rat beta-2 subunits are 99% identical. Unlike beta-1, the beta-2 subunit does not contain an N-terminal inactivation 'ball' domain. Instead, functional studies of beta-2 expressed in Xenopus oocytes indicated that it increased the rate of the endogenous Kv1.4 alpha subunit (OMIM Ref. No. 176266) inactivation process. Leicher et al. (1998) reported that the KCNA2B gene contains 15 exons and spans approximately 70 kb. The exon/intron structure of KCNA2B is comparable to that of KCNA1B and KCNA3B (OMIM Ref. No. 604111), although the size of the introns varies significantly among the genes. By analysis of somatic cell hybrids and by FISH, Schultz et al. (1996) mapped the KCNA2B gene to 1p36.3. The results of Gong et al. (1999) suggested that ZIP, the rat homolog of p62 (OMIM Ref. No. 601530), acts as a link that targets the activity of Kv-beta-2 and PKC-zeta Full details of the abovementioned studies are described in the following publications, the disclosure of which are hereby incorporated by reference:

Gong, J.; Xu, J.; Bezanilla, M.; van Huizen, R.; Derin, R.; Li, M.: Differential stimulation of PKC phosphorylation of potassium channels by ZIP1 and ZIP2. Science 285:1565-1569, 1999; and Leicher, T.; Bahring, R.; Isbrandt, D.; Pongs, O.: Coexpression of the KCNA3B gene product with Kv1.5 leads to a novel A-type potassium channel. J. Biol. Chem. 273:35095-35101, 1998.

Further studies establishing the function and utilities of KCNAB2 are found in John Hopkins OMIM database record ID 601142, and in sited publications numbered 1548, 284 and 2848-2849 listed in the bibliography section hereinbelow, which are also hereby incorporated by reference. Metastasis-associated 1-like 1 (MTA1L1, Accession NM_004739) is another VGAM659 host target gene. MTA1L1 BINDING SITE is HOST TARGET binding site found in the 3' untranslated region of mRNA encoded by MTA1L1, corresponding to a HOST TARGET binding site such as BINDING SITE I, BINDING SITE II or BINDING SITE III. Table 2 illustrates the complementarity of the nucleotide sequences of MTA1L1 BINDING SITE, designated SEQ ID:11137, to the nucleotide sequence of VGAM659 RNA, herein designated VGAM RNA, also designated SEQ ID:3370.

Another function of VGAM659 is therefore inhibition of Metastasis-associated 1-like 1 (MTA1L1, Accession NM_004739), a gene which regulates histone deacetylase core complex enzymatic activity. Accordingly, utilities of VGAM659 include diagnosis, prevention and treatment of diseases and clinical conditions associated with MTA1L1. The function of MTA1L1 has been established by previous studies. The p53 tumor suppressor (OMIM Ref. No. 191170) is a transcriptional factor whose activity is modulated by protein stability and posttranslational modifications including acetylation. Luo et al. (2000) showed that deacetylation of p53 is mediated by a histone deacetylase-1 (HDAC1; 601241)-containing complex. They also purified a p53 target protein, which they named PID, in the deacetylase complexes. PID is identical to MTA1L1, also called MTA2, which had been identified as a component of the nucleosome remodeling and histone deacetylation (NURD) complex. The authors found that MTA1L1 specifically interacts with p53 both in vitro and in vivo, and its expression reduces significantly the steady-state levels of acetylated p53. MTA1L1 expression strongly represses p53-dependent transcriptional activation, and, notably, it modulates p53-mediated cell growth arrest and apoptosis. Luo et al. (2000) concluded that their results show that deacetylation and functional interactions between the MTA1L1-associated NURD complex may represent an important pathway to regulate p53 function. Zhang et al. (1999) showed that MTA2 and the 32-kD MBD3 (OMIM Ref. No. 603573) protein are subunits of the NURD complex. Immunoprecipitation analysis showed that MBD3 interacts with HDAC1, RBBP4 (OMIM Ref. No. 602923), and RBBP7 (OMIM Ref. No. 602922), but not with MI2 (CHD4; 603277), suggesting that MBD3 is embedded within the NURD complex. The authors found that MTA2 directs the assembly of an active histone deacetylase complex and that the association of MTA2 with the complex requires MBD3. Gel mobility shift analysis determined that both NURD and MBD3 are unable to bind to methylated DNA in the absence of MBD2 (OMIM Ref. No. 603547). Zhang et al. (1999) proposed that NURD is involved in the transcriptional repression of methylated DNA. Wade et al. (1999) also identified MTA1, MTA1L, and MBD3 as components of the NURD complex, which they referred to as the MI2 complex.

Full details of the abovementioned studies are described in the following publications, the disclosure of which are hereby incorporated by reference:

Futamura, M.; Nishimori, H.; Shiratsuchi, T.; Saji, S.; Nakamura, Y.; Tokino, T.: Molecular cloning, mapping, and characterization of a novel human gene, MTA1-L1, showing homology to a metastasis-associated gene, MTA1. J. Hum. Genet. 44:52-56, 1999; and Luo, J.; Su, F.; Chen, D.; Shiloh, A.; Gu, W.: Deacetylation of p53 modulates its effect on cell growth and apoptosis. Nature 408:377-381, 2000.

Further studies establishing the function and utilities of MTA1L1 are found in John Hopkins OMIM database record ID 603947, and in sited publications numbered 635, 752 and 5173 listed in the bibliography section hereinbelow, which are also hereby incorporated by reference. Neuroligin 1 (NLGN1, Accession NM_014932) is another VGAM659 host target gene. NLGN1 BINDING SITE is HOST TARGET binding site found in the 3' untranslated region of mRNA encoded by NLGN1, corresponding to a HOST TARGET binding site such as BINDING SITE I, BINDING SITE II or BINDING SITE III. Table 2 illustrates the complementarity of the nucleotide sequences of NLGN1 BINDING SITE, designated SEQ ID:17230, to the nucleotide sequence of VGAM659 RNA, herein designated VGAM RNA, also designated SEQ ID:3370.

Another function of VGAM659 is therefore inhibition of Neuroligin 1 (NLGN1, Accession NM_014932), a gene which may trigger the de novo formation of presynaptic structure. Accordingly, utilities of VGAM659 include diagnosis, prevention and treatment of diseases and clinical conditions associated with NLGN1. The function of NLGN1 has been established by previous studies. Neurexins (see OMIM Ref. No. NRXN1; 600565) are neuronal cell surface proteins first identified in rat brain with hundreds of isoforms generated by alternative splicing. Ichtchenko et al. (1995) described neuroligin I, a neuronal cell surface protein that is enriched in rat synaptic plasma membranes and acts as a splice site-specific ligand for beta-neurexins. (Each of 3 genes encoding neurexins--NRXN1, NRXN2, and NRXN3--has 2 independent promoters and generates 2 classes of mRNAs. The longer mRNAs encode alpha-neurexins and the shorter mRNAs beta-neurexins.) Neuroligin I binds to beta-neurexins only if they lack an insert in the alternatively spliced sequence of the G domain, and not if they contain an insert. The extracellular sequence of rat neuroligin I is composed of a catalytically inactive esterase domain homologous to acetylcholinesterase. Ichtchenko et al. (1995) used in situ hybridization to demonstrate that alternative splicing of neurexins at the binding site recognized by neuroligin I is highly regulated. These findings support a model whereby alternative splicing of neurexins creates a family of cell surface receptors that confer interactive specificity on their resident neurons. Using an in vitro system, Scheiffele et al. (2000) demonstrated that mouse neuroligin-1 and -2, postsynaptically localized proteins, can trigger the de novo formation of presynaptic structure. Nonneuronal cells engineered to express neuroligins induced morphologic and functional presynaptic differentiation in contacting axons. This activity could be inhibited by addition of a soluble version of beta-neurexin. Furthermore, addition of soluble beta-neurexin to a coculture of defined pre- and postsynaptic central nervous system (CNS) neurons inhibited synaptic vesicle clustering in axons contacting target neurons. These results suggested that neuroligins are part of the machinery employed during the formation and remodeling of CNS synapses.

Full details of the abovementioned studies are described in the following publications, the disclosure of which are hereby incorporated by reference:

Ichtchenko, K.; Hata, Y.; Nguyen, T.; Ullrich, B.; Missler, M.; Moomaw, C.; Sudhof, T. C.: Neuroligin 1: a splice site-specific ligand for beta-neurexins. Cell 81:435-443, 1995; and Scheiffele, P.; Fan, J.; Choih, J.; Fetter, R.; Serafini, T.: Neuroligin expressed in nonneuronal cells triggers presynaptic development in contacting axons. Cell 101:657-669, 2000.

Further studies establishing the function and utilities of NLGN1 are found in John Hopkins OMIM database record ID 600568, and in sited publications numbered 8170, 836 and 9531 listed in the bibliography section hereinbelow, which are also hereby incorporated by reference. O-linked N-acetylglucosamine (GlcNAc) Transferase (UDP-N-acetylglucosamine:polypeptide-N-acetylglucosaminyl transferase) (OGT, Accession NM_003605) is another VGAM659 host target gene. OGT BINDING SITE is HOST TARGET binding site found in the 3' untranslated region of mRNA encoded by OGT, corresponding to a HOST TARGET binding site such as BINDING SITE I, BINDING SITE II or BINDING SITE III. Table 2 illustrates the complementarity of the nucleotide sequences of OGT BINDING SITE, designated SEQ ID:9660, to the nucleotide sequence of VGAM659 RNA, herein designated VGAM RNA, also designated SEQ ID:3370.

Another function of VGAM659 is therefore inhibition of O-linked N-acetylglucosamine (GlcNAc) Transferase (UDP-N-acetylglucosamine:polypeptide-N-acetylglucosaminyl transferase) (OGT, Accession NM_003605), a gene which has a role in the glycosylation of nuclear and cytoplasmic proteins. Accordingly, utilities of VGAM659 include diagnosis, prevention and treatment of diseases and clinical conditions associated with OGT. The function of OGT and its association with various diseases and clinical conditions, has been established by previous studies, as described hereinabove with reference to VGAM464. Transient Receptor Potential Cation Channel, Subfamily M, Member 6 (TRPM6, Accession NM_017662) is another VGAM659 host target gene. TRPM6 BINDING SITE is HOST TARGET binding site found in the 3' untranslated region of mRNA encoded by TRPM6, corresponding to a HOST TARGET binding site such as BINDING SITE I, BINDING SITE II or BINDING SITE III. Table 2 illustrates the complementarity of the nucleotide sequences of TRPM6 BINDING SITE, designated SEQ ID:19203, to the nucleotide sequence of VGAM659 RNA, herein designated VGAM RNA, also designated SEQ ID:3370.

Another function of VGAM659 is therefore inhibition of Transient Receptor Potential Cation Channel, Subfamily M, Member 6 (TRPM6, Accession NM_017662), a gene which contains a predicted ion channel domain and a protein kinase domain. Accordingly, utilities of VGAM659 include diagnosis, prevention and treatment of diseases and clinical conditions associated with TRPM6. The function of TRPM6 and its association with various diseases and clinical conditions, has been established by previous studies, as described hereinabove with reference to VGAM173. Von Hippel-Lindau Syndrome (VHL, Accession NM_000551) is another VGAM659 host target gene. VHL BINDING SITE is HOST TARGET binding site found in the 3' untranslated region of mRNA encoded by VHL, corresponding to a HOST TARGET binding site such as BINDING SITE I, BINDING SITE II or BINDING SITE III. Table 2 illustrates the complementarity of the nucleotide sequences of VHL BINDING SITE, designated SEQ ID:6162, to the nucleotide sequence of VGAM659 RNA, herein designated VGAM RNA, also designated SEQ ID:3370.

Another function of VGAM659 is therefore inhibition of Von Hippel-Lindau Syndrome (VHL, Accession NM_000551), a gene which may control rna stability through the selective degradation of rna-bound proteins. Accordingly, utilities of VGAM659 include diagnosis, prevention and treatment of diseases and clinical conditions associated with VHL. The function of VHL and its association with various diseases and clinical conditions, has been established by previous studies, as described hereinabove with reference to VGAM197. DKFZp434H2226 (Accession XM_043863) is another VGAM659 host target gene. DKFZp434H2226 BINDING SITE is HOST TARGET binding site found in the 5' untranslated region of mRNA encoded by DKFZp434H2226, corresponding to a HOST TARGET binding site such as BINDING SITE I, BINDING SITE II or BINDING SITE III. Table 2 illustrates the complementarity of the nucleotide sequences of DKFZp434H2226 BINDING SITE, designated SEQ ID:34034, to the nucleotide sequence of VGAM659 RNA, herein designated VGAM RNA, also designated SEQ ID:3370.

Another function of VGAM659 is therefore inhibition of DKFZp434H2226 (Accession XM_043863). Accordingly, utilities of VGAM659 include diagnosis, prevention and treatment of diseases and clinical conditions associated with DKFZp434H2226. FLJ20758 (Accession NM_017952) is another VGAM659 host target gene. FLJ20758 BINDING SITE is HOST TARGET binding site found in the 5' untranslated region of mRNA encoded by FLJ20758, corresponding to a HOST TARGET binding site such as BINDING SITE I, BINDING SITE II or BINDING SITE III. Table 2 illustrates the complementarity of the nucleotide sequences of FLJ20758 BINDING SITE, designated SEQ ID:19654, to the nucleotide sequence of VGAM659 RNA, herein designated VGAM RNA, also designated SEQ ID:3370.

Another function of VGAM659 is therefore inhibition of FLJ20758 (Accession NM_017952). Accordingly, utilities of VGAM659 include diagnosis, prevention and treatment of diseases and clinical conditions associated with FLJ20758. KIAA0215 (Accession NM_014735) is another VGAM659 host target gene. KIAA0215 BINDING SITE is HOST TARGET binding site found in the 5' untranslated region of mRNA encoded by KIAA0215, corresponding to a HOST TARGET binding site such as BINDING SITE I, BINDING SITE II or BINDING SITE III. Table 2 illustrates the complementarity of the nucleotide sequences of KIAA0215 BINDING SITE, designated SEQ ID:16384, to the nucleotide sequence of VGAM659 RNA, herein designated VGAM RNA, also designated SEQ ID:3370.

Another function of VGAM659 is therefore inhibition of KIAA0215 (Accession NM_014735). Accordingly, utilities of VGAM659 include diagnosis, prevention and treatment of diseases and clinical conditions associated with KIAA0215. LOC152317 (Accession XM_098189) is another VGAM659 host target gene. LOC152317 BINDING SITE is HOST TARGET binding site found in the 5' untranslated region of mRNA encoded by LOC152317, corresponding to a HOST TARGET binding site such as BINDING SITE I, BINDING SITE II or BINDING SITE III. Table 2 illustrates the complementarity of the nucleotide sequences of LOC152317 BINDING SITE, designated SEQ ID:41465, to the nucleotide sequence of VGAM659 RNA, herein designated VGAM RNA, also designated SEQ ID:3370.

Another function of VGAM659 is therefore inhibition of LOC152317 (Accession XM_098189). Accordingly, utilities of VGAM659 include diagnosis, prevention and treatment of diseases and clinical conditions associated with LOC152317.

FIG. 1 further provides a conceptual description of a novel bioinformatically detected viral gene of the present invention, referred to here as Viral Genomic Address Messenger 660 (VGAM660) viral gene, which modulates expression of respective host target genes thereof, the function and utility of which host target genes is known in the art.

VGAM660 is a novel bioinformatically detected regulatory, non protein coding, viral micro RNA (miRNA) gene. The method by which VGAM660 was detected is described hereinabove with reference to FIGS. 1-8.

VGAM660 gene, herein designated VGAM GENE, is a viral gene contained in the genome of Meleagrid Herpesvirus 1. VGAM660 host target gene, herein designated VGAM HOST TARGET GENE, is a human gene contained in the human genome.

VGAM660 gene encodes a VGAM660 precursor RNA, herein designated VGAM PRECURSOR RNA. Similar to other miRNA genes, and unlike most ordinary genes, VGAM660 precursor RNA does not encode a protein. A nucleotide sequence identical or highly similar to the nucleotide sequence of VGAM660 precursor RNA is designated SEQ ID:646, and is provided hereinbelow with reference to the sequence listing part. Nucleotide sequence SEQ ID:646 is located at position 80746 relative to the genome of Meleagrid Herpesvirus 1.

VGAM660 precursor RNA folds onto itself, forming VGAM660 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM660 folded precursor RNA into VGAM660 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM660 RNA is designated SEQ ID:3371, and is provided hereinbelow with reference to the sequence listing part.

VGAM660 host target gene, herein designated VGAM HOST TARGET GENE, encodes a corresponding messenger RNA, VGAM660 host target RNA, herein designated VGAM HOST TARGET RNA. VGAM660 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM660 RNA, herein designated VGAM RNA, binds complementarily to one or more host target binding sites located in untranslated regions of VGAM660 host target RNA, herein designated VGAM HOST TARGET RNA. This complementary binding is due to the fact that the nucleotide sequence of VGAM660 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM660 RNA, herein designated VGAM RNA, may have a different number of host target binding sites in untranslated regions of a VGAM660 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM660 RNA, herein designated VGAM RNA, to host target binding sites on VGAM660 host target RNA, herein designated VGAM HOST TARGET RNA, such as BINDING SITE I, BINDING SITE II and BINDING SITE III, inhibits translation of VGAM660 host target RNA into VGAM660 host target protein, herein designated VGAM HOST TARGET PROTEIN. VGAM host target protein is therefore outlined by a broken line.

It is appreciated that VGAM660 host target gene, herein designated VGAM HOST TARGET GENE, in fact represents a plurality of VGAM660 host target genes. The mRNA of each one of this plurality of VGAM660 host target genes comprises one or more host target binding sites, each having a nucleotide sequence which is at least partly complementary to VGAM660 RNA, herein designated VGAM RNA, and which when bound by VGAM660 RNA causes inhibition of translation of respective one or more VGAM660 host target proteins.

It is further appreciated by one skilled in the art that the mode of translational inhibition illustrated by FIG. 1 with specific reference to translational inhibition exerted by VGAM660 gene, herein designated VGAM GENE, on one or more VGAM660 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM660 is inhibition of expression of host target genes, as part of a novel viral mechanism of attacking a host. Accordingly, utilities of VGAM660 include diagnosis, prevention and treatment of viral infection by Meleagrid Herpesvirus 1. Specific functions, and accordingly utilities, of VGAM660 correlate with, and may be deduced from, the identity of the host target genes which VGAM660 binds and inhibits, and the function of these host target genes, as elaborated hereinbelow.

Nucleotide sequences of the VGAM660 precursor RNA, herein designated VGAM PRECURSOR RNA, and of the 'diced' VGAM660 RNA, herein designated VGAM RNA, and a schematic representation of the secondary folding of VGAM660 folded precursor RNA, herein designated VGAM FOLDED PRECURSOR RNA, of VGAM660 are further described hereinbelow with reference to Table 1.

Nucleotide sequences of host target binding sites, such as BINDING SITE-I, BINDING SITE-II and BINDING SITE-III of FIG. 1, found on VGAM660 host target RNA, and schematic representation of the complementarity of each of these host target binding sites to VGAM660 RNA, herein designated VGAM RNA, are described hereinbelow with reference to Table 2.

As mentioned hereinabove with reference to FIG. 1, a function of VGAM660 gene, herein designated VGAM is inhibition of expression of VGAM660 target genes. It is appreciated that specific functions, and accordingly utilities, of VGAM660 correlate with, and may be deduced from, the identity of the target genes which VGAM660 binds and inhibits, and the function of these target genes, as elaborated hereinbelow.

LOC92106 (Accession NM_138381) is a VGAM660 host target gene. LOC92106 BINDING SITE is HOST TARGET binding site found in the 5' untranslated region of mRNA encoded by LOC92106, corresponding to a HOST TARGET binding site such as BINDING SITE I, BINDING SITE II or BINDING SITE III. Table 2 illustrates the complementarity of the nucleotide sequences of LOC92106 BINDING SITE, designated SEQ ID:28755, to the nucleotide sequence of VGAM660 RNA, herein designated VGAM RNA, also designated SEQ ID:3371.

A function of VGAM660 is therefore inhibition of LOC92106 (Accession NM_138381). Accordingly, utilities of VGAM660 include diagnosis, prevention and treatment of diseases and clinical conditions associated with LOC92106. FIG. 1 further provides a conceptual description of a novel bioinformatically detected viral gene of the present invention, referred to here as Viral Genomic Address Messenger 661 (VGAM661) viral gene, which modulates expression of respective host target genes thereof, the function and utility of which host target genes is known in the art.

VGAM661 is a novel bioinformatically detected regulatory, non protein coding, viral micro RNA (miRNA) gene. The method by which VGAM661 was detected is described hereinabove with reference to FIGS. 1-8.

VGAM661 gene, herein designated VGAM GENE, is a viral gene contained in the genome of Heliothis Zea Virus 1 (HZV-1). VGAM661 host target gene, herein designated VGAM HOST TARGET GENE, is a human gene contained in the human genome.

VGAM661 gene encodes a VGAM661 precursor RNA, herein designated VGAM PRECURSOR RNA. Similar to other miRNA genes, and unlike most ordinary genes, VGAM661 precursor RNA does not encode a protein. A nucleotide sequence identical or highly similar to the nucleotide sequence of VGAM661 precursor RNA is designated SEQ ID:647, and is provided hereinbelow with reference to the sequence listing part. Nucleotide sequence SEQ ID:647 is located at position 4270 relative to the genome of Heliothis Zea Virus 1 (HZV-1).

VGAM661 precursor RNA folds onto itself, forming VGAM661 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM661 folded precursor RNA into VGAM661 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM661 RNA is designated SEQ ID:3372, and is provided hereinbelow with reference to the sequence listing part.

VGAM661 host target gene, herein designated VGAM HOST TARGET GENE, encodes a corresponding messenger RNA, VGAM661 host target RNA, herein designated VGAM HOST TARGET RNA. VGAM661 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM661 RNA, herein designated VGAM RNA, binds complementarily to one or more host target binding sites located in untranslated regions of VGAM661 host target RNA, herein designated VGAM HOST TARGET RNA. This complementary binding is due to the fact that the nucleotide sequence of VGAM661 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM661 RNA, herein designated VGAM RNA, may have a different number of host target binding sites in untranslated regions of a VGAM661 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM661 RNA, herein designated VGAM RNA, to host target binding sites on VGAM661 host target RNA, herein designated VGAM HOST TARGET RNA, such as BINDING SITE I, BINDING SITE II and BINDING SITE III, inhibits translation of VGAM661 host target RNA into VGAM661 host target protein, herein designated VGAM HOST TARGET PROTEIN. VGAM host target protein is therefore outlined by a broken line.

It is appreciated that VGAM661 host target gene, herein designated VGAM HOST TARGET GENE, in fact represents a plurality of VGAM661 host target genes. The mRNA of each one of this plurality of VGAM661 host target genes comprises one or more host target binding sites, each having a nucleotide sequence which is at least partly complementary to VGAM661 RNA, herein designated VGAM RNA, and which when bound by VGAM661 RNA causes inhibition of translation of respective one or more VGAM661 host target proteins.

It is further appreciated by one skilled in the art that the mode of translational inhibition illustrated by FIG. 1 with specific reference to translational inhibition exerted by VGAM661 gene, herein designated VGAM GENE, on one or more VGAM661 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM661 is inhibition of expression of host target genes, as part of a novel viral mechanism of attacking a host. Accordingly, utilities of VGAM661 include diagnosis, prevention and treatment of viral infection by Heliothis Zea Virus 1 (HZV-1). Specific functions, and accordingly utilities, of VGAM661 correlate with, and may be deduced from, the identity of the host target genes which VGAM661 binds and inhibits, and the function of these host target genes, as elaborated hereinbelow.

Nucleotide sequences of the VGAM661 precursor RNA, herein designated VGAM PRECURSOR RNA, and of the 'diced' VGAM661 RNA, herein designated VGAM RNA, and a schematic representation of the secondary folding of VGAM661 folded precursor RNA, herein designated VGAM FOLDED PRECURSOR RNA, of VGAM661 are further described hereinbelow with reference to Table 1.

Nucleotide sequences of host target binding sites, such as BINDING SITE-I, BINDING SITE-II and BINDING SITE-III of FIG. 1, found on VGAM661 host target RNA, and schematic representation of the complementarity of each of these host target binding sites to VGAM661 RNA, herein designated VGAM RNA, are described hereinbelow with reference to Table 2.

As mentioned hereinabove with reference to FIG. 1, a function of VGAM661 gene, herein designated VGAM is inhibition of expression of VGAM661 target genes. It is appreciated that specific functions, and accordingly utilities, of VGAM661 correlate with, and may be deduced from, the identity of the target genes which VGAM661 binds and inhibits, and the function of these target genes, as elaborated hereinbelow.

TSG (Accession NM_020648) is a VGAM661 host target gene. TSG BINDING SITE is HOST TARGET binding site found in the 3' untranslated region of mRNA encoded by TSG, corresponding to a HOST TARGET binding site such as BINDING SITE I, BINDING SITE II or BINDING SITE III. Table 2 illustrates the complementarity of the nucleotide sequences of TSG BINDING SITE, designated SEQ ID:21810, to the nucleotide sequence of VGAM661 RNA, herein designated VGAM RNA, also designated SEQ ID:3372.

A function of VGAM661 is therefore inhibition of TSG (Accession NM_020648). Accordingly, utilities of VGAM661 include diagnosis, prevention and treatment of diseases and clinical conditions associated with TSG. Zinc Finger Protein 214 (ZNF214, Accession NM_013249) is another VGAM661 host target gene. ZNF214 BINDING SITE is HOST TARGET binding site found in the 5' untranslated region of mRNA encoded by ZNF214, corresponding to a HOST TARGET binding site such as BINDING SITE I, BINDING SITE II or BINDING SITE III. Table 2 illustrates the complementarity of the nucleotide sequences of ZNF214 BINDING SITE, designated SEQ ID:14910, to the nucleotide sequence of VGAM661 RNA, herein designated VGAM RNA, also designated SEQ ID:3372.

Another function of VGAM661 is therefore inhibition of Zinc Finger Protein 214 (ZNF214, Accession NM_013249). Accordingly, utilities of VGAM661 include diagnosis, prevention and treatment of diseases and clinical conditions associated with ZNF214. ALDH9 (Accession NM_000696) is another VGAM661 host target gene. ALDH9 BINDING SITE is HOST TARGET binding site found in the 5' untranslated region of mRNA encoded by ALDH9, corresponding to a HOST TARGET binding site such as BINDING SITE I, BINDING SITE II or BINDING SITE III. Table 2 illustrates the complementarity of the nucleotide sequences of ALDH9 BINDING SITE, designated SEQ ID:6359, to the nucleotide sequence of VGAM661 RNA, herein designated VGAM RNA, also designated SEQ ID:3372.

Another function of VGAM661 is therefore inhibition of ALDH9 (Accession NM_000696). Accordingly, utilities of VGAM661 include diagnosis, prevention and treatment of diseases and clinical conditions associated with ALDH9. LIM and SH3 Protein 1 (LASP1, Accession NM_006148) is another VGAM661 host target gene. LASP1 BINDING SITE is HOST TARGET binding site found in the 3' untranslated region of mRNA encoded by LASP1, corresponding to a HOST TARGET binding site such as BINDING SITE I, BINDING SITE II or BINDING SITE III. Table 2 illustrates the complementarity of the nucleotide sequences of LASP1 BINDING SITE, designated SEQ ID:12790, to the nucleotide sequence of VGAM661 RNA, herein designated VGAM RNA, also designated SEQ ID:3372.

Another function of VGAM661 is therefore inhibition of LIM and SH3 Protein 1 (LASP1, Accession NM_006148). Accordingly, utilities of VGAM661 include diagnosis, prevention and treatment of diseases and clinical conditions associated with LASP1. LOC121504 (Accession XM_058571) is another VGAM661 host target gene. LOC121504 BINDING SITE is HOST TARGET binding site found in the 3' untranslated region of mRNA encoded by LOC121504, corresponding to a HOST TARGET binding site such as BINDING SITE I, BINDING SITE II or BINDING SITE III. Table 2 illustrates the complementarity of the nucleotide sequences of LOC121504 BINDING SITE, designated SEQ ID:36669, to the nucleotide sequence of VGAM661 RNA, herein designated VGAM RNA, also designated SEQ ID:3372.

Another function of VGAM661 is therefore inhibition of LOC121504 (Accession XM_058571). Accordingly, utilities of VGAM661 include diagnosis, prevention and treatment of diseases and clinical conditions associated with LOC121504. LOC153937 (Accession XM_087813) is another VGAM661 host target gene. LOC153937 BINDING SITE is HOST TARGET binding site found in the 5' untranslated region of mRNA encoded by LOC153937, corresponding to a HOST TARGET binding site such as BINDING SITE I, BINDING SITE II or BINDING SITE III. Table 2 illustrates the complementarity of the nucleotide sequences of LOC153937 BINDING SITE, designated SEQ ID:39444, to the nucleotide sequence of VGAM661 RNA, herein designated VGAM RNA, also designated SEQ ID:3372.

Another function of VGAM661 is therefore inhibition of LOC153937 (Accession XM_087813). Accordingly, utilities of VGAM661 include diagnosis, prevention and treatment of diseases and clinical conditions associated with LOC153937. FIG. 1 further provides a conceptual description of a novel bioinformatically detected viral gene of the present invention, referred to here as Viral Genomic Address Messenger 662 (VGAM662) viral gene, which modulates expression of respective host target genes thereof, the function and utility of which host target genes is known in the art.

VGAM662 is a novel bioinformatically detected regulatory, non protein coding, viral micro RNA (miRNA) gene. The method by which VGAM662 was detected is described hereinabove with reference to FIGS. 1-8.

VGAM662 gene, herein designated VGAM GENE, is a viral gene contained in the genome of Vaccinia Virus. VGAM662 host target gene, herein designated VGAM HOST TARGET GENE, is a human gene contained in the human genome.

VGAM662 gene encodes a VGAM662 precursor RNA, herein designated VGAM PRECURSOR RNA. Similar to other miRNA genes, and unlike most ordinary genes, VGAM662 precursor RNA does not encode a protein. A nucleotide sequence identical or highly similar to the nucleotide sequence of VGAM662 precursor RNA is designated SEQ ID:648, and is provided hereinbelow with reference to the sequence listing part. Nucleotide sequence SEQ ID:648 is located at position 123220 relative to the genome of Vaccinia Virus.

VGAM662 precursor RNA folds onto itself, forming VGAM662 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM662 folded precursor RNA into VGAM662 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM662 RNA is designated SEQ ID:3373, and is provided hereinbelow with reference to the sequence listing part.

VGAM662 host target gene, herein designated VGAM HOST TARGET GENE, encodes a corresponding messenger RNA, VGAM662 host target RNA, herein designated VGAM HOST TARGET RNA. VGAM662 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM662 RNA, herein designated VGAM RNA, binds complementarily to one or more host target binding sites located in untranslated regions of VGAM662 host target RNA, herein designated VGAM HOST TARGET RNA. This complementary binding is due to the fact that the nucleotide sequence of VGAM662 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM662 RNA, herein designated VGAM RNA, may have a different number of host target binding sites in untranslated regions of a VGAM662 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM662 RNA, herein designated VGAM RNA, to host target binding sites on VGAM662 host target RNA, herein designated VGAM HOST TARGET RNA, such as BINDING SITE I, BINDING SITE II and BINDING SITE III, inhibits translation of VGAM662 host target RNA into VGAM662 host target protein, herein designated VGAM HOST TARGET PROTEIN. VGAM host target protein is therefore outlined by a broken line.

It is appreciated that VGAM662 host target gene, herein designated VGAM HOST TARGET GENE, in fact represents a plurality of VGAM662 host target genes. The mRNA of each one of this plurality of VGAM662 host target genes comprises one or more host target binding sites, each having a nucleotide sequence which is at least partly complementary to VGAM662 RNA, herein designated VGAM RNA, and which when bound by VGAM662 RNA causes inhibition of translation of respective one or more VGAM662 host target proteins.

It is further appreciated by one skilled in the art that the mode of translational inhibition illustrated by FIG. 1 with specific reference to translational inhibition exerted by VGAM662 gene, herein designated VGAM GENE, on one or more VGAM662 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM662 is inhibition of expression of host target genes, as part of a novel viral mechanism of attacking a host. Accordingly, utilities of VGAM662 include diagnosis, prevention and treatment of viral infection by Vaccinia Virus. Specific functions, and accordingly utilities, of VGAM662 correlate with, and may be deduced from, the identity of the host target genes which VGAM662 binds and inhibits, and the function of these host target genes, as elaborated hereinbelow.

Nucleotide sequences of the VGAM662 precursor RNA, herein designated VGAM PRECURSOR RNA, and of the 'diced' VGAM662 RNA, herein designated VGAM RNA, and a schematic representation of the secondary folding of VGAM662 folded precursor RNA, herein designated VGAM FOLDED PRECURSOR RNA, of VGAM662 are further described hereinbelow with reference to Table 1.

Nucleotide sequences of host target binding sites, such as BINDING SITE-I, BINDING SITE-II and BINDING SITE-III of FIG. 1, found on VGAM662 host target RNA, and schematic representation of the complementarity of each of these host target binding sites to VGAM662 RNA, herein designated VGAM RNA, are described hereinbelow with reference to Table 2.

As mentioned hereinabove with reference to FIG. 1, a function of VGAM662 gene, herein designated VGAM is inhibition of expression of VGAM662 target genes. It is appreciated that specific functions, and accordingly utilities, of VGAM662 correlate with, and may be deduced from, the identity of the target genes which VGAM662 binds and inhibits, and the function of these target genes, as elaborated hereinbelow.

Calcitonin Receptor (CALCR, Accession NM_001742) is a VGAM662 host target gene. CALCR BINDING SITE is HOST TARGET binding site found in the 3' untranslated region of mRNA encoded by CALCR, corresponding to a HOST TARGET binding site such as BINDING SITE I, BINDING SITE II or BINDING SITE III. Table 2 illustrates the complementarity of the nucleotide sequences of CALCR BINDING SITE, designated SEQ ID:7479, to the nucleotide sequence of VGAM662 RNA, herein designated VGAM RNA, also designated SEQ ID:3373.

A function of VGAM662 is therefore inhibition of Calcitonin Receptor (CALCR, Accession NM_001742), a gene which is a receptor for calcitonin, is mediated by g proteins which activate adenylyl cyclase, and thought to couple to the heterotrimeric guanosine triphosphate-binding protein that is sensitive to cholera toxin. Accordingly, utilities of VGAM662 include diagnosis, prevention and treatment of diseases and clinical conditions associated with CALCR. The function of CALCR and its association with various diseases and clinical conditions, has been established by previous studies, as described hereinabove with reference to VGAM94. Lymphotoxin Alpha (TNF superfamily, member 1) (LTA, Accession NM_000595) is another VGAM662 host target gene. LTA BINDING SITE is HOST TARGET binding site found in the 3' untranslated region of mRNA encoded by LTA, corresponding to a HOST TARGET binding site such as BINDING SITE I, BINDING SITE II or BINDING SITE III. Table 2 illustrates the complementarity of the nucleotide sequences of LTA BINDING SITE, designated SEQ ID:6194, to the nucleotide sequence of VGAM662 RNA, herein designated VGAM RNA, also designated SEQ ID:3373.

Another function of VGAM662 is therefore inhibition of Lymphotoxin Alpha (TNF superfamily, member 1) (LTA, Accession NM_000595), a gene which is a cytokine that in its homotrimeric form binds to tnfrsf1a/tnfr1, tnfrsf1b/tnfbr and tnfrsf14/hvem. Accordingly, utilities of VGAM662 include diagnosis, prevention and treatment of diseases and clinical conditions associated with LTA. The function of LTA has been established by previous studies. Lymphotoxin was first characterized as a biologic factor in mitogen-stimulated lymphocytes having anticellular activity on neoplastic cell lines. It is a glycoprotein with a relative molecular mass (Mr) of 60,000-70,000, whereas monomeric lymphotoxin has an Mr of 25,000. Gray et al. (1984) isolated a chemically synthesized gene and natural complementary DNA coding for human lymphotoxin and engineered them for expression in E. coli. Cytotoxic and necrosis effects were observed in murine and human tumor cell lines in vitro and in murine sarcomas in vivo. TNF-beta (also known as lymphotoxin-alpha, or LTA) shows 35% identity and 50% homology in amino acid sequence with the TNF-alpha (OMIM Ref. No. 191160). Aggarwal et al. (1985) showed that the 2 TNFs share a common receptor on tumor cells See 191160 for information on the situation of both TNFA and TNFB on 6p. By analysis of deletions induced in lymphoblastoid cells by gamma-irradiation, Evans et al. (1989) concluded that TNFB maps to the interval between C4 and HLA-B. Spies et al. (1989) showed that the TNF-alpha and TNF-beta gene cluster is about 210 kb from HLA-B on 6p21.3. Jongeneel et al. (1991) described polymorphic microsatellites within a 12-kb region of the major histocompatibility complex that includes the TNFB locus. Lymphotoxin-alpha in a homotrimeric form is a soluble protein secreted by activated lymphocytes and presumed to act as a modulator in the immune response. The LT-alpha homotrimer shares its receptor with tumor necrosis factor and binds to both TNF receptor-1 (OMIM Ref. No. 191190) and -2 (191191

Full details of the abovementioned studies are described in the following publications, the disclosure of which are hereby incorporated by reference:

Aggarwal, B. B.; Eessalu, T. E.; Hass, P. E.: Characterization of receptors for human tumour necrosis factor and their regulation by gamma-interferon. Nature 318:665-667, 1985; and Evans, A. M.; Petersen, J. W.; Sekhon, G. S.; DeMars, R.: Mapping of prolactin and tumor necrosis factor-beta genes on human chromosome 6p using lymphoblastoid cell deletion mutants. Somat.

Further studies establishing the function and utilities of LTA are found in John Hopkins OMIM database record ID 153440, and in sited publications numbered 663-66 and 3544 listed in the bibliography section hereinbelow, which are also hereby incorporated by reference. Zinc-fingers and Homeoboxes 1 (ZHX1, Accession NM_007222) is another VGAM662 host target gene. ZHX1 BINDING SITE is HOST TARGET binding site found in the 3' untranslated region of mRNA encoded by ZHX1, corresponding to a HOST TARGET binding site such as BINDING SITE I, BINDING SITE II or BINDING SITE III. Table 2 illustrates the complementarity of the nucleotide sequences of ZHX1 BINDING SITE, designated SEQ ID:14091, to the nucleotide sequence of VGAM662 RNA, herein designated VGAM RNA, also designated SEQ ID:3373.

Another function of VGAM662 is therefore inhibition of Zinc-fingers and Homeoboxes 1 (ZHX1, Accession NM_007222). Accordingly, utilities of VGAM662 include diagnosis, prevention and treatment of diseases and clinical conditions associated with ZHX1. DKFZP434C1715 (Accession XM_098421) is another VGAM662 host target gene. DKFZP434C1715 BINDING SITE is HOST TARGET binding site found in the 3' untranslated region of mRNA encoded by DKFZP434C1715, corresponding to a HOST TARGET binding site such as BINDING SITE I, BINDING SITE II or BINDING SITE III. Table 2 illustrates the complementarity of the nucleotide sequences of DKFZP434C1715 BINDING SITE, designated SEQ ID:41672, to the nucleotide sequence of VGAM662 RNA, herein designated VGAM RNA, also designated SEQ ID:3373.

Another function of VGAM662 is therefore inhibition of DKFZP434C1715 (Accession XM_098421). Accordingly, utilities of VGAM662 include diagnosis, prevention and treatment of diseases and clinical conditions associated with DKFZP434C1715. FLJ23556 (Accession NM_024880) is another VGAM662 host target gene. FLJ23556 BINDING SITE is HOST TARGET binding site found in the 3' untranslated region of mRNA encoded by FLJ23556, corresponding to a HOST TARGET binding site such as BINDING SITE I, BINDING SITE II or BINDING SITE III. Table 2 illustrates the complementarity of the nucleotide sequences of FLJ23556 BINDING SITE, designated SEQ ID:24318, to the nucleotide sequence of VGAM662 RNA, herein designated VGAM RNA, also designated SEQ ID:3373.

Another function of VGAM662 is therefore inhibition of FLJ23556 (Accession NM_024880). Accordingly, utilities of VGAM662 include diagnosis, prevention and treatment of diseases and clinical conditions associated with FLJ23556. IDN3 (Accession NM_133433) is another VGAM662 host target gene. IDN3 BINDING SITE is HOST TARGET binding site found in the 3' untranslated region of mRNA encoded by IDN3, corresponding to a HOST TARGET binding site such as BINDING SITE I, BINDING SITE II or BINDING SITE III. Table 2 illustrates the complementarity of the nucleotide sequences of IDN3 BINDING SITE, designated SEQ ID:28510, to the nucleotide sequence of VGAM662 RNA, herein designated VGAM RNA, also designated SEQ ID:3373.

Another function of VGAM662 is therefore inhibition of IDN3 (Accession NM_133433). Accordingly, utilities of VGAM662 include diagnosis, prevention and treatment of diseases and clinical conditions associated with IDN3. KIAA1456 (Accession XM_040100) is another VGAM662 host target gene. KIAA1456 BINDING SITE is HOST TARGET binding site found in the 3' untranslated region of mRNA encoded by KIAA1456, corresponding to a HOST TARGET binding site such as BINDING SITE I, BINDING SITE II or BINDING SITE III. Table 2 illustrates the complementarity of the nucleotide sequences of KIAA1456 BINDING SITE, designated SEQ ID:33262, to the nucleotide sequence of VGAM662 RNA, herein designated VGAM RNA, also designated SEQ ID:3373.

Another function of VGAM662 is therefore inhibition of KIAA1456 (Accession XM_040100). Accordingly, utilities of VGAM662 include diagnosis, prevention and treatment of diseases and clinical conditions associated with KIAA1456. Neurexophilin 3 (NXPH3, Accession XM_037847) is another VGAM662 host target gene. NXPH3 BINDING SITE is HOST TARGET binding site found in the 3' untranslated region of mRNA encoded by NXPH3, corresponding to a HOST TARGET binding site such as BINDING SITE I, BINDING SITE II or BINDING SITE III. Table 2 illustrates the complementarity of the nucleotide sequences of NXPH3 BINDING SITE, designated SEQ ID:32714, to the nucleotide sequence of VGAM662 RNA, herein designated VGAM RNA, also designated SEQ ID:3373.

Another function of VGAM662 is therefore inhibition of Neurexophilin 3 (NXPH3, Accession XM_037847). Accordingly, utilities of VGAM662 include diagnosis, prevention and treatment of diseases and clinical conditions associated with NXPH3. PNPASE (Accession XM_048088) is another VGAM662 host target gene. PNPASE BINDING SITE is HOST TARGET binding site found in the 3' untranslated region of mRNA encoded by PNPASE, corresponding to a HOST TARGET binding site such as BINDING SITE I, BINDING SITE II or BINDING SITE III. Table 2 illustrates the complementarity of the nucleotide sequences of PNPASE BINDING SITE, designated SEQ ID:35103, to the nucleotide sequence of VGAM662 RNA, herein designated VGAM RNA, also designated SEQ ID:3373.

Another function of VGAM662 is therefore inhibition of PNPASE (Accession XM_048088). Accordingly, utilities of VGAM662 include diagnosis, prevention and treatment of diseases and clinical conditions associated with PNPASE. Zinc Finger Protein 33a (KOX 31) (ZNF33A, Accession XM_166119) is another VGAM662 host target gene. ZNF33A BINDING SITE is HOST TARGET binding site found in the 3' untranslated region of mRNA encoded by ZNF33A, corresponding to a HOST TARGET binding site such as BINDING SITE I, BINDING SITE II or BINDING SITE III. Table 2 illustrates the complementarity of the nucleotide sequences of ZNF33A BINDING SITE, designated SEQ ID:43896, to the nucleotide sequence of VGAM662 RNA, herein designated VGAM RNA, also designated SEQ ID:3373.

Another function of VGAM662 is therefore inhibition of Zinc Finger Protein 33a (KOX 31) (ZNF33A, Accession XM_166119). Accordingly, utilities of VGAM662 include diagnosis, prevention and treatment of diseases and clinical conditions associated with ZNF33A. LOC126282 (Accession XM_059012) is another VGAM662 host target gene. LOC126282 BINDING SITE is HOST TARGET binding site found in the 3' untranslated region of mRNA encoded by LOC126282, corresponding to a HOST TARGET binding site such as BINDING SITE I, BINDING SITE II or BINDING SITE III. Table 2 illustrates the complementarity of the nucleotide sequences of LOC126282 BINDING SITE, designated SEQ ID:36816, to the nucleotide sequence of VGAM662 RNA, herein designated VGAM RNA, also designated SEQ ID:3373.

Another function of VGAM662 is therefore inhibition of LOC126282 (Accession XM_059012). Accordingly, utilities of VGAM662 include diagnosis, prevention and treatment of diseases and clinical conditions associated with LOC126282. LOC144583 (Accession XM_084907) is another VGAM662 host target gene. LOC144583 BINDING SITE is HOST TARGET binding site found in the 3' untranslated region of mRNA encoded by LOC144583, corresponding to a HOST TARGET binding site such as BINDING SITE I, BINDING SITE II or BINDING SITE III. Table 2 illustrates the complementarity of the nucleotide sequences of LOC144583 BINDING SITE, designated SEQ ID:37767, to the nucleotide sequence of VGAM662 RNA, herein designated VGAM RNA, also designated SEQ ID:3373.

Another function of VGAM662 is therefore inhibition of LOC144583 (Accession XM_084907). Accordingly, utilities of VGAM662 include diagnosis, prevention and treatment of diseases and clinical conditions associated with LOC144583. LOC145231 (Accession XM_096740) is another VGAM662 host target gene. LOC145231 BINDING SITE is HOST TARGET binding site found in the 3' untranslated region of mRNA encoded by LOC145231, corresponding to a HOST TARGET binding site such as BINDING SITE I, BINDING SITE II or BINDING SITE III. Table 2 illustrates the complementarity of the nucleotide sequences of LOC145231 BINDING SITE, designated SEQ ID:40518, to the nucleotide sequence of VGAM662 RNA, herein designated VGAM RNA, also designated SEQ ID:3373.

Another function of VGAM662 is therefore inhibition of LOC145231 (Accession XM_096740). Accordingly, utilities of VGAM662 include diagnosis, prevention and treatment of diseases and clinical conditions associated with LOC145231. LOC147837 (Accession XM_085915) is another VGAM662 host target gene. LOC147837 BINDING SITE is HOST TARGET binding site found in the 3' untranslated region of mRNA encoded by LOC147837, corresponding to a HOST TARGET binding site such as BINDING SITE I, BINDING SITE II or BINDING SITE III. Table 2 illustrates the complementarity of the nucleotide sequences of LOC147837 BINDING SITE, designated SEQ ID:38392, to the nucleotide sequence of VGAM662 RNA, herein designated VGAM RNA, also designated SEQ ID:3373.

Another function of VGAM662 is therefore inhibition of LOC147837 (Accession XM_085915). Accordingly, utilities of VGAM662 include diagnosis, prevention and treatment of diseases and clinical conditions associated with LOC147837. LOC149910 (Accession XM_086699) is another VGAM662 host target gene. LOC149910 BINDING SITE is HOST TARGET binding site found in the 3' untranslated region of mRNA encoded by LOC149910, corresponding to a HOST TARGET binding site such as BINDING SITE I, BINDING SITE II or BINDING SITE III. Table 2 illustrates the complementarity of the nucleotide sequences of LOC149910 BINDING SITE, designated SEQ ID:38827, to the nucleotide sequence of VGAM662 RNA, herein designated VGAM RNA, also designated SEQ ID:3373.

Another function of VGAM662 is therefore inhibition of LOC149910 (Accession XM_086699). Accordingly, utilities of VGAM662 include diagnosis, prevention and treatment of diseases and clinical conditions associated with LOC149910. LOC158160 (Accession XM_054490) is another VGAM662 host target gene. LOC158160 BINDING SITE is HOST TARGET binding site found in the 3' untranslated region of mRNA encoded by LOC158160, corresponding to a HOST TARGET binding site such as BINDING SITE I, BINDING SITE II or BINDING SITE III. Table 2 illustrates the complementarity of the nucleotide sequences of LOC158160 BINDING SITE, designated SEQ ID:36168, to the nucleotide sequence of VGAM662 RNA, herein designated VGAM RNA, also designated SEQ ID:3373.

Another function of VGAM662 is therefore inhibition of LOC158160 (Accession XM_054490). Accordingly, utilities of VGAM662 include diagnosis, prevention and treatment of diseases and clinical conditions associated with LOC158160. LOC158292 (Accession XM_098914) is another VGAM662 host target gene. LOC158292 BINDING SITE is HOST TARGET binding site found in the 5' untranslated region of mRNA encoded by LOC158292, corresponding to a HOST TARGET binding site such as BINDING SITE I, BINDING SITE II or BINDING SITE III. Table 2 illustrates the complementarity of the nucleotide sequences of LOC158292 BINDING SITE, designated SEQ ID:41932, to the nucleotide sequence of VGAM662 RNA, herein designated VGAM RNA, also designated SEQ ID:3373.

Another function of VGAM662 is therefore inhibition of LOC158292 (Accession XM_098914). Accordingly, utilities of VGAM662 include diagnosis, prevention and treatment of diseases and clinical conditions associated with LOC158292. LOC162333 (Accession XM_102591) is another VGAM662 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42129, to the nucleotide sequence of VGAM662 RNA, herein designated VGAM RNA, also designated SEQ ID:3373.

Another function of VGAM662 is therefore inhibition of LOC162333 (Accession XM_102591). Accordingly, utilities of VGAM662 include diagnosis, prevention and treatment of diseases and clinical conditions associated with LOC162333. LOC202018 (Accession XM_114420) is another VGAM662 host target gene. LOC202018 BINDING SITE is HOST TARGET binding site found in the 3' untranslated region of mRNA encoded by LOC202018, corresponding to a HOST TARGET binding site such as BINDING SITE I, BINDING SITE II or BINDING SITE III. Table 2 illustrates the complementarity of the nucleotide sequences of LOC202018 BINDING SITE, designated SEQ ID:42958, to the nucleotide sequence of VGAM662 RNA, herein designated VGAM RNA, also designated SEQ ID:3373.

Another function of VGAM662 is therefore inhibition of LOC202018 (Accession XM_114420). Accordingly, utilities of VGAM662 include diagnosis, prevention and treatment of diseases and clinical conditions associated with LOC202018. LOC219392 (Accession XM_165921) is another VGAM662 host target gene. LOC219392 BINDING SITE is HOST TARGET binding site found in the 5' untranslated region of mRNA encoded by LOC219392, corresponding to a HOST TARGET binding site such as BINDING SITE I, BINDING SITE II or BINDING SITE III. Table 2 illustrates the complementarity of the nucleotide sequences of LOC219392 BINDING SITE, designated SEQ ID:43799, to the nucleotide sequence of VGAM662 RNA, herein designated VGAM RNA, also designated SEQ ID:3373.

Another function of VGAM662 is therefore inhibition of LOC219392 (Accession XM_165921). Accordingly, utilities of VGAM662 include diagnosis, prevention and treatment of diseases and clinical conditions associated with LOC219392. FIG. 1 further provides a conceptual description of a novel bioinformatically detected viral gene of the present invention, referred to here as Viral Genomic Address Messenger 663 (VGAM663) viral gene, which modulates expression of respective host target genes thereof, the function and utility of which host target genes is known in the art.

VGAM663 is a novel bioinformatically detected regulatory, non protein coding, viral micro RNA (miRNA) gene. The method by which VGAM663 was detected is described hereinabove with reference to FIGS. 1-8.

VGAM663 gene, herein designated VGAM GENE, is a viral gene contained in the genome of Rachiplusia Ou Multiple Nucleopolyhedrovirus. VGAM663 host target gene, herein designated VGAM HOST TARGET GENE, is a human gene contained in the human genome.

VGAM663 gene encodes a VGAM663 precursor RNA, herein designated VGAM PRECURSOR RNA. Similar to other miRNA genes, and unlike most ordinary genes, VGAM663 precursor RNA does not encode a protein. A nucleotide sequence identical or highly similar to the nucleotide sequence of VGAM663 precursor RNA is designated SEQ ID:649, and is provided hereinbelow with reference to the sequence listing part. Nucleotide sequence SEQ ID:649 is located at position 325 relative to the genome of Rachiplusia Ou Multiple Nucleopolyhedrovirus.

VGAM663 precursor RNA folds onto itself, forming VGAM663 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM663 folded precursor RNA into VGAM663 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM663 RNA is designated SEQ ID:3374, and is provided hereinbelow with reference to the sequence listing part.

VGAM663 host target gene, herein designated VGAM HOST TARGET GENE, encodes a corresponding messenger RNA, VGAM663 host target RNA, herein designated VGAM HOST TARGET RNA. VGAM663 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM663 RNA, herein designated VGAM RNA, binds complementarily to one or more host target binding sites located in untranslated regions of VGAM663 host target RNA, herein designated VGAM HOST TARGET RNA. This complementary binding is due to the fact that the nucleotide sequence of VGAM663 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM663 RNA, herein designated VGAM RNA, may have a different number of host target binding sites in untranslated regions of a VGAM663 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM663 RNA, herein designated VGAM RNA, to host target binding sites on VGAM663 host target RNA, herein designated VGAM HOST TARGET RNA, such as BINDING SITE I, BINDING SITE II and BINDING SITE III, inhibits translation of VGAM663 host target RNA into VGAM663 host target protein, herein designated VGAM HOST TARGET PROTEIN. VGAM host target protein is therefore outlined by a broken line.

It is appreciated that VGAM663 host target gene, herein designated VGAM HOST TARGET GENE, in fact represents a plurality of VGAM663 host target genes. The mRNA of each one of this plurality of VGAM663 host target genes comprises one or more host target binding sites, each having a nucleotide sequence which is at least partly complementary to VGAM663 RNA, herein designated VGAM RNA, and which when bound by VGAM663 RNA causes inhibition of translation of respective one or more VGAM663 host target proteins.

It is further appreciated by one skilled in the art that the mode of translational inhibition illustrated by FIG. 1 with specific reference to translational inhibition exerted by VGAM663 gene, herein designated VGAM GENE, on one or more VGAM663 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM663 is inhibition of expression of host target genes, as part of a novel viral mechanism of attacking a host. Accordingly, utilities of VGAM663 include diagnosis, prevention and treatment of viral infection by Rachiplusia Ou Multiple Nucleopolyhedrovirus. Specific functions, and accordingly utilities, of VGAM663 correlate with, and may be deduced from, the identity of the host target genes which VGAM663 binds and inhibits, and the function of these host target genes, as elaborated hereinbelow.

Nucleotide sequences of the VGAM663 precursor RNA, herein designated VGAM PRECURSOR RNA, and of the 'diced' VGAM663 RNA, herein designated VGAM RNA, and a schematic representation of the secondary folding of VGAM663 folded precursor RNA, herein designated VGAM FOLDED PRECURSOR RNA, of VGAM663 are further described hereinbelow with reference to Table 1.

Nucleotide sequences of host target binding sites, such as BINDING SITE-I, BINDING SITE-II and BINDING SITE-III of FIG. 1, found on VGAM663 host target RNA, and schematic representation of the complementarity of each of these host target binding sites to VGAM663 RNA, herein designated VGAM RNA, are described hereinbelow with reference to Table 2.

As mentioned hereinabove with reference to FIG. 1, a function of VGAM663 gene, herein designated VGAM is inhibition of expression of VGAM663 target genes. It is appreciated that specific functions, and accordingly utilities, of VGAM663 correlate with, and may be deduced from, the identity of the target genes which VGAM663 binds and inhibits, and the function of these target genes, as elaborated hereinbelow.

B-cell CLL/lymphoma 7A (BCL7A, Accession NM_020993) is a VGAM663 host target gene. BCL7A BINDING SITE is HOST TARGET binding site found in the 3' untranslated region of mRNA encoded by BCL7A, corresponding to a HOST TARGET binding site such as BINDING SITE I, BINDING SITE II or BINDING SITE III. Table 2 illustrates the complementarity of the nucleotide sequences of BCL7A BINDING SITE, designated SEQ ID:21985, to the nucleotide sequence of VGAM663 RNA, herein designated VGAM RNA, also designated SEQ ID:3374.

A function of VGAM663 is therefore inhibition of B-cell CLL/lymphoma 7A (BCL7A, Accession NM_020993). Accordingly, utilities of VGAM663 include diagnosis, prevention and treatment of diseases and clinical conditions associated with BCL7A. Chloride Channel 4 (CLCN4, Accession NM_001830) is another VGAM663 host target gene. CLCN4 BINDING SITE is HOST TARGET binding site found in the 5' untranslated region of mRNA encoded by CLCN4, corresponding to a HOST TARGET binding site such as BINDING SITE I, BINDING SITE II or BINDING SITE III. Table 2 illustrates the complementarity of the nucleotide sequences of CLCN4 BINDING SITE, designated SEQ ID:7573, to the nucleotide sequence of VGAM663 RNA, herein designated VGAM RNA, also designated SEQ ID:3374.

Another function of VGAM663 is therefore inhibition of Chloride Channel 4 (CLCN4, Accession NM_001830), a gene which is regulation of cell volume; membrane potential stabilization, signal transduction and transepithelial transport. Accordingly, utilities of VGAM663 include diagnosis, prevention and treatment of diseases and clinical conditions associated with CLCN4. The function of CLCN4 and its association with various diseases and clinical conditions, has been established by previous studies, as described hereinabove with reference to VGAM558. Zinc Finger Protein 264 (ZNF264, Accession NM_003417) is another VGAM663 host target gene. ZNF264 BINDING SITE is HOST TARGET binding site found in the 3' untranslated region of mRNA encoded by ZNF264, corresponding to a HOST TARGET binding site such as BINDING SITE I, BINDING SITE II or BINDING SITE III. Table 2 illustrates the complementarity of the nucleotide sequences of ZNF264 BINDING SITE, designated SEQ ID:9458, to the nucleotide sequence of VGAM663 RNA, herein designated VGAM RNA, also designated SEQ ID:3374.

Another function of VGAM663 is therefore inhibition of Zinc Finger Protein 264 (ZNF264, Accession NM_003417). Accordingly, utilities of VGAM663 include diagnosis, prevention and treatment of diseases and clinical conditions associated with ZNF264. DKFZP761F241 (Accession NM_031455) is another VGAM663 host target gene. DKFZP761F241 BINDING SITE is HOST TARGET binding site found in the 3' untranslated region of mRNA encoded by DKFZP761F241, corresponding to a HOST TARGET binding site such as BINDING SITE I, BINDING SITE II or BINDING SITE III. Table 2 illustrates the complementarity of the nucleotide sequences of DKFZP761F241 BINDING SITE, designated SEQ ID:25474, to the nucleotide sequence of VGAM663 RNA, herein designated VGAM RNA, also designated SEQ ID:3374.

Another function of VGAM663 is therefore inhibition of DKFZP761F241 (Accession NM_031455). Accordingly, utilities of VGAM663 include diagnosis, prevention and treatment of diseases and clinical conditions associated with DKFZP761F241. FLJ10008 (Accession NM_017970) is another VGAM663 host target gene. FLJ10008 BINDING SITE is HOST TARGET binding site found in the 5' untranslated region of mRNA encoded by FLJ10008, corresponding to a HOST TARGET binding site such as BINDING SITE I, BINDING SITE II or BINDING SITE III. Table 2 illustrates the complementarity of the nucleotide sequences of FLJ10008 BINDING SITE, designated SEQ ID:19690, to the nucleotide sequence of VGAM663 RNA, herein designated VGAM RNA, also designated SEQ ID:3374.

Another function of VGAM663 is therefore inhibition of FLJ10008 (Accession NM_017970). Accordingly, utilities of VGAM663 include diagnosis, prevention and treatment of diseases and clinical conditions associated with FLJ10008. TSPAN-2 (Accession NM_005725) is another VGAM663 host target gene. TSPAN-2 BINDING SITE is HOST TARGET binding site found in the 3' untranslated region of mRNA encoded by TSPAN-2, corresponding to a HOST TARGET binding site such as BINDING SITE I, BINDING SITE II or BINDING SITE III. Table 2 illustrates the complementarity of the nucleotide sequences of TSPAN-2 BINDING SITE, designated SEQ ID:12279, to the nucleotide sequence of VGAM663 RNA, herein designated VGAM RNA, also designated SEQ ID:3374.

Another function of VGAM663 is therefore inhibition of TSPAN-2 (Accession NM_005725). Accordingly, utilities of VGAM663 include diagnosis, prevention and treatment of diseases and clinical conditions associated with TSPAN-2. Zinc Finger, DHHC Domain Containing 3 (ZDHHC3, Accession NM_016598) is another VGAM663 host target gene. ZDHHC3 BINDING SITE is HOST TARGET binding site found in the 3' untranslated region of mRNA encoded by ZDHHC3, corresponding to a HOST TARGET binding site such as BINDING SITE I, BINDING SITE II or BINDING SITE III. Table 2 illustrates the complementarity of the nucleotide sequences of ZDHHC3 BINDING SITE, designated SEQ ID:18685, to the nucleotide sequence of VGAM663 RNA, herein designated VGAM RNA, also designated SEQ ID:3374.

Another function of VGAM663 is therefore inhibition of Zinc Finger, DHHC Domain Containing 3 (ZDHHC3, Accession NM_016598). Accordingly, utilities of VGAM663 include diagnosis, prevention and treatment of diseases and clinical conditions associated with ZDHHC3. LOC205095 (Accession XM_119820) is another VGAM663 host target gene. LOC205095 BINDING SITE is HOST TARGET binding site found in the 3' untranslated region of mRNA encoded by LOC205095, corresponding to a HOST TARGET binding site such as BINDING SITE I, BINDING SITE II or BINDING SITE III. Table 2 illustrates the complementarity of the nucleotide sequences of LOC205095 BINDING SITE, designated SEQ ID:43600, to the nucleotide sequence of VGAM663 RNA, herein designated VGAM RNA, also designated SEQ ID:3374.

Another function of VGAM663 is therefore inhibition of LOC205095 (Accession XM_119820). Accordingly, utilities of VGAM663 include diagnosis, prevention and treatment of diseases and clinical conditions associated with LOC205095. LOC221272 (Accession XM_168050) is another VGAM663 host target gene. LOC221272 BINDING SITE is HOST TARGET binding site found in the 5' untranslated region of mRNA encoded by LOC221272, corresponding to a HOST TARGET binding site such as BINDING SITE I, BINDING SITE II or BINDING SITE III. Table 2 illustrates the complementarity of the nucleotide sequences of LOC221272 BINDING SITE, designated SEQ ID:44963, to the nucleotide sequence of VGAM663 RNA, herein designated VGAM RNA, also designated SEQ ID:3374.

Another function of VGAM663 is therefore inhibition of LOC221272 (Accession XM_168050). Accordingly, utilities of VGAM663 include diagnosis, prevention and treatment of diseases and clinical conditions associated with LOC221272. LOC92078 (Accession XM_042684) is another VGAM663 host target gene. LOC92078 BINDING SITE is HOST TAR- GET binding site found in the 5' untranslated region of mRNA encoded by LOC92078, corresponding to a HOST TARGET binding site such as BINDING SITE I, BINDING SITE II or BINDING SITE III. Table 2 illustrates the complementarity of the nucleotide sequences of LOC92078 BINDING SITE, designated SEQ ID:33739, to the nucleotide sequence of VGAM663 RNA, herein designated VGAM RNA, also designated SEQ ID:3374.

Another function of VGAM663 is therefore inhibition of LOC92078 (Accession XM_042684). Accordingly, utilities of VGAM663 include diagnosis, prevention and treatment of diseases and clinical conditions associated with LOC92078. FIG. 1 further provides a conceptual description of a novel bioinformatically detected viral gene of the present invention, referred to here as Viral Genomic Address Messenger 664 (VGAM664) viral gene, which modulates expression of respective host target genes thereof, the function and utility of which host target genes is known in the art.

VGAM664 is a novel bioinformatically detected regulatory, non protein coding, viral micro RNA (miRNA) gene. The method by which VGAM664 was detected is described hereinabove with reference to FIGS. 1-8.

VGAM664 gene, herein designated VGAM GENE, is a viral gene contained in the genome of Rachiplusia Ou Multiple Nucleopolyhedrovirus. VGAM664 host target gene, herein designated VGAM HOST TARGET GENE, is a human gene contained in the human genome.

VGAM664 gene encodes a VGAM664 precursor RNA, herein designated VGAM PRECURSOR RNA. Similar to other miRNA genes, and unlike most ordinary genes, VGAM664 precursor RNA does not encode a protein. A nucleotide sequence identical or highly similar to the nucleotide sequence of VGAM664 precursor RNA is designated SEQ ID:650, and is provided hereinbelow with reference to the sequence listing part. Nucleotide sequence SEQ ID:650 is located at position 18 relative to the genome of Rachiplusia Ou Multiple Nucleopolyhedrovirus.

VGAM664 precursor RNA folds onto itself, forming VGAM664 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM664 folded precursor RNA into VGAM664 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM664 RNA is designated SEQ ID:3375, and is provided hereinbelow with reference to the sequence listing part.

VGAM664 host target gene, herein designated VGAM HOST TARGET GENE, encodes a corresponding messenger RNA, VGAM664 host target RNA, herein designated VGAM HOST TARGET RNA. VGAM664 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM664 RNA, herein designated VGAM RNA, binds complementarily to one or more host target binding sites located in untranslated regions of VGAM664 host target RNA, herein designated VGAM HOST TARGET RNA. This complementary binding is due to the fact that the nucleotide sequence of VGAM664 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM664 RNA, herein designated VGAM RNA, may have a different number of host target binding sites in untranslated regions of a VGAM664 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM664 RNA, herein designated VGAM RNA, to host target binding sites on VGAM664 host target RNA, herein designated VGAM HOST TARGET RNA, such as BINDING SITE I, BINDING SITE II and BINDING SITE III, inhibits translation of VGAM664 host target RNA into VGAM664 host target protein, herein designated VGAM HOST TARGET PROTEIN. VGAM host target protein is therefore outlined by a broken line.

It is appreciated that VGAM664 host target gene, herein designated VGAM HOST TARGET GENE, in fact represents a plurality of VGAM664 host target genes. The mRNA of each one of this plurality of VGAM664 host target genes comprises one or more host target binding sites, each having a nucleotide sequence which is at least partly complementary to VGAM664 RNA, herein designated VGAM RNA, and which when bound by VGAM664 RNA causes inhibition of translation of respective one or more VGAM664 host target proteins.

It is further appreciated by one skilled in the art that the mode of translational inhibition illustrated by FIG. 1 with specific reference to translational inhibition exerted by VGAM664 gene, herein designated VGAM GENE, on one or more VGAM664 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM664 is inhibition of expression of host target genes, as part of a novel viral mechanism of attacking a host. Accordingly, utilities of VGAM664 include diagnosis, prevention and treatment of viral infection by Rachiplusia Ou Multiple Nucleopolyhedrovirus. Specific functions, and accordingly utilities, of VGAM664 correlate with, and may be deduced from, the identity of the host target genes which VGAM664 binds and inhibits, and the function of these host target genes, as elaborated hereinbelow.

Nucleotide sequences of the VGAM664 precursor RNA, herein designated VGAM PRECURSOR RNA, and of the 'diced' VGAM664 RNA, herein designated VGAM RNA, and a schematic representation of the secondary folding of VGAM664 folded precursor RNA, herein designated VGAM FOLDED PRECURSOR RNA, of VGAM664 are further described hereinbelow with reference to Table 1.

Nucleotide sequences of host target binding sites, such as BINDING SITE-I, BINDING SITE-II and BINDING SITE-III of FIG. 1, found on VGAM664 host target RNA, and schematic representation of the complementarity of each of these host target binding sites to VGAM664 RNA, herein designated VGAM RNA, are described hereinbelow with reference to Table 2.

As mentioned hereinabove with reference to FIG. 1, a function of VGAM664 gene, herein designated VGAM is inhibition of expression of VGAM664 target genes. It is appreciated that specific functions, and accordingly utilities, of VGAM664 correlate with, and may be deduced from, the identity of the target genes which VGAM664 binds and inhibits, and the function of these target genes, as elaborated hereinbelow.

BCMP1 (Accession NM_031442) is a VGAM664 host target gene. BCMP1 BINDING SITE is HOST TARGET binding site found in the 3' untranslated region of mRNA encoded by BCMP1, corresponding to a HOST TARGET binding site such as BINDING SITE I, BINDING SITE II or BINDING SITE III. Table 2 illustrates the complementarity of the nucleotide sequences of BCMP1 BINDING SITE, designated SEQ ID:25458, to the nucleotide sequence of VGAM664 RNA, herein designated VGAM RNA, also designated SEQ ID:3375.

A function of VGAM664 is therefore inhibition of BCMP1 (Accession NM_031442). Accordingly, utilities of VGAM664 include diagnosis, prevention and treatment of diseases and clinical conditions associated with BCMP1. FLJ20294 (Accession NM_017749) is another VGAM664 host target gene. FLJ20294 BINDING SITE is HOST TARGET binding site found in the 3' untranslated region of mRNA encoded by FLJ20294, corresponding to a HOST TARGET binding site such as BINDING SITE I, BINDING SITE II or BINDING SITE III. Table 2 illustrates the complementarity of the nucleotide sequences of FLJ20294 BINDING SITE, designated SEQ ID:19350, to the nucleotide sequence of VGAM664 RNA, herein designated VGAM RNA, also designated SEQ ID:3375.

Another function of VGAM664 is therefore inhibition of FLJ20294 (Accession NM_017749). Accordingly, utilities of VGAM664 include diagnosis, prevention and treatment of diseases and clinical conditions associated with FLJ20294. KIAA0446 (Accession XM_044155) is another VGAM664 host target gene. KIAA0446 BINDING SITE is HOST TARGET binding site found in the 5' untranslated region of mRNA encoded by KIAA0446, corresponding to a HOST TARGET binding site such as BINDING SITE I, BINDING SITE II or BINDING SITE III. Table 2 illustrates the complementarity of the nucleotide sequences of KIAA0446 BINDING SITE, designated SEQ ID:34145, to the nucleotide sequence of VGAM664 RNA, herein designated VGAM RNA, also designated SEQ ID:3375.

Another function of VGAM664 is therefore inhibition of KIAA0446 (Accession XM_044155). Accordingly, utilities of VGAM664 include diagnosis, prevention and treatment of diseases and clinical conditions associated with KIAA0446. START Domain Containing 7 (STARD7, Accession NM_139267) is another VGAM664 host target gene. STARD7 BINDING SITE1 and STARD7 BINDING SITE2 are HOST TARGET binding sites found in untranslated regions of mRNA encoded by STARD7, corresponding to HOST TARGET binding sites such as BINDING SITE I, BINDING SITE II or BINDING SITE III. Table 2 illustrates the complementarity of the nucleotide sequences of STARD7 BINDING SITE1 and STARD7 BINDING SITE2, designated SEQ ID:29258 and SEQ ID:21354 respectively, to the nucleotide sequence of VGAM664 RNA, herein designated VGAM RNA, also designated SEQ ID:3375.

Another function of VGAM664 is therefore inhibition of START Domain Containing 7 (STARD7, Accession NM_139267). Accordingly, utilities of VGAM664 include diagnosis, prevention and treatment of diseases and clinical conditions associated with STARD7. LOC122786 (Accession XM_058660) is another VGAM664 host target gene. LOC122786 BINDING SITE is HOST TARGET binding site found in the 3' untranslated region of mRNA encoded by LOC122786, corresponding to a HOST TARGET binding site such as BINDING SITE I, BINDING SITE II or BINDING SITE III. Table 2 illustrates the complementarity of the nucleotide sequences of LOC122786 BINDING SITE, designated SEQ ID:36698, to the nucleotide sequence of VGAM664 RNA, herein designated VGAM RNA, also designated SEQ ID:3375.

Another function of VGAM664 is therefore inhibition of LOC122786 (Accession XM_058660). Accordingly, utilities of VGAM664 include diagnosis, prevention and treatment of diseases and clinical conditions associated with LOC122786. LOC158696 (Accession XM_088644) is another VGAM664 host target gene. LOC158696 BINDING SITE is HOST TARGET binding site found in the 3' untranslated region of mRNA encoded by LOC158696, corresponding to a HOST TARGET binding site such as BINDING SITE I, BINDING SITE II or BINDING SITE III. Table 2 illustrates the complementarity of the nucleotide sequences of LOC158696 BINDING SITE, designated SEQ ID:39881, to the nucleotide sequence of VGAM664 RNA, herein designated VGAM RNA, also designated SEQ ID:3375.

Another function of VGAM664 is therefore inhibition of LOC158696 (Accession XM_088644). Accordingly, utilities of VGAM664 include diagnosis, prevention and treatment of diseases and clinical conditions associated with LOC158696. FIG. 1 further provides a conceptual description of a novel bioinformatically detected viral gene of the present invention, referred to here as Viral Genomic Address Messenger 665 (VGAM665) viral gene, which modulates expression of respective host target genes thereof, the function and utility of which host target genes is known in the art.

VGAM665 is a novel bioinformatically detected regulatory, non protein coding, viral micro RNA (miRNA) gene. The method by which VGAM665 was detected is described hereinabove with reference to FIGS. 1-8.

VGAM665 gene, herein designated VGAM GENE, is a viral gene contained in the genome of Rachiplusia Ou Multiple Nucleopolyhedrovirus. VGAM665 host target gene, herein designated VGAM HOST TARGET GENE, is a human gene contained in the human genome.

VGAM665 gene encodes a VGAM665 precursor RNA, herein designated VGAM PRECURSOR RNA. Similar to other miRNA genes, and unlike most ordinary genes, VGAM665 precursor RNA does not encode a protein. A nucleotide sequence identical or highly similar to the nucleotide sequence of VGAM665 precursor RNA is designated SEQ ID:651, and is provided hereinbelow with reference to the sequence listing part. Nucleotide sequence SEQ ID:651 is located at position 235 relative to the genome of Rachiplusia Ou Multiple Nucleopolyhedrovirus.

VGAM665 precursor RNA folds onto itself, forming VGAM665 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM665 folded precursor RNA into VGAM665 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM665 RNA is designated SEQ ID:3376, and is provided hereinbelow with reference to the sequence listing part.

VGAM665 host target gene, herein designated VGAM HOST TARGET GENE, encodes a corresponding messenger RNA, VGAM665 host target RNA, herein designated VGAM HOST TARGET RNA. VGAM665 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM665 RNA, herein designated VGAM RNA, binds complementarily to one or more host target binding sites located in untranslated regions of VGAM665 host target RNA, herein designated VGAM HOST TARGET RNA. This complementary binding is due to the fact that the nucleotide sequence of VGAM665 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM665 RNA, herein designated VGAM RNA, may have a different number of host target binding sites in untranslated regions of a VGAM665 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM665 RNA, herein designated VGAM RNA, to host target binding sites on VGAM665 host target RNA, herein designated VGAM HOST TARGET RNA, such as BINDING SITE I, BINDING SITE II and BINDING SITE III, inhibits translation of VGAM665 host target RNA into VGAM665 host target protein, herein designated VGAM HOST TARGET PROTEIN. VGAM host target protein is therefore outlined by a broken line.

It is appreciated that VGAM665 host target gene, herein designated VGAM HOST TARGET GENE, in fact represents a plurality of VGAM665 host target genes. The mRNA of each one of this plurality of VGAM665 host target genes comprises one or more host target binding sites, each having a nucleotide sequence which is at least partly complementary to VGAM665 RNA, herein designated VGAM RNA, and which when bound by VGAM665 RNA causes inhibition of translation of respective one or more VGAM665 host target proteins.

It is further appreciated by one skilled in the art that the mode of translational inhibition illustrated by FIG. 1 with specific reference to translational inhibition exerted by VGAM665 gene, herein designated VGAM GENE, on one or more VGAM665 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM665 is inhibition of expression of host target genes, as part of a novel viral mechanism of attacking a host. Accordingly, utilities of VGAM665 include diagnosis, prevention and treatment of viral infection by Rachiplusia Ou Multiple Nucleopolyhedrovirus. Specific functions, and accordingly utilities, of VGAM665 correlate with, and may be deduced from, the identity of the host target genes which VGAM665 binds and inhibits, and the function of these host target genes, as elaborated hereinbelow.

Nucleotide sequences of the VGAM665 precursor RNA, herein designated VGAM PRECURSOR RNA, and of the 'diced' VGAM665 RNA, herein designated VGAM RNA, and a schematic representation of the secondary folding of VGAM665 folded precursor RNA, herein designated VGAM FOLDED PRECURSOR RNA, of VGAM665 are further described hereinbelow with reference to Table 1.

Nucleotide sequences of host target binding sites, such as BINDING SITE-I, BINDING SITE-II and BINDING SITE-III of FIG. 1, found on VGAM665 host target RNA, and schematic representation of the complementarity of each of these host target binding sites to VGAM665 RNA, herein designated VGAM RNA, are described hereinbelow with reference to Table 2.

As mentioned hereinabove with reference to FIG. 1, a function of VGAM665 gene, herein designated VGAM is inhibition of expression of VGAM665 target genes. It is appreciated that specific functions, and accordingly utilities, of VGAM665 correlate with, and may be deduced from, the identity of the target genes which VGAM665 binds and inhibits, and the function of these target genes, as elaborated hereinbelow.

ATPase, Class VI, Type 11B (ATP11B, Accession XM_087254) is a VGAM665 host target gene. ATP11B BINDING SITE is HOST TARGET binding site found in the 3' untranslated region of mRNA encoded by ATP11B, corresponding to a HOST TARGET binding site such as BINDING SITE I, BINDING SITE II or BINDING SITE III. Table 2 illustrates the complementarity of the nucleotide sequences of ATP11B BINDING SITE, designated SEQ ID:39144, to the nucleotide sequence of VGAM665 RNA, herein designated VGAM RNA, also designated SEQ ID:3376.

A function of VGAM665 is therefore inhibition of ATPase, Class VI, Type 11B (ATP11B, Accession XM_087254), a gene which is phosphorylated in their intermediate state, drives uphill transport of ions across membranes. Accordingly, utilities of VGAM665 include diagnosis, prevention and treatment of diseases and clinical conditions associated with ATP11B. The function of ATP11B has been established by previous studies. Nagase et al. (1999) isolated a partial cDNA encoding ATP11B, which they called KIAA0956, from a brain cDNA library. Based on homology analysis, they predicted that the KIAA0956 protein is a chromaffin granule ATPase. RT-PCR analysis detected wide expression, with highest levels in kidney, followed by ovary, corpus callosum, and testis. RUSH proteins are SWI/SNF-related transcription factors with uteroglobin promoter-binding RING finger signatures near their C termini (see OMIM Ref. No. 603257). Mansharamani et al. (2001) isolated a nearly full-length rabbit cDNA encoding Rfbp, a RUSH-binding protein that shares 93% amino acid identity with KIAA0956.

Full details of the abovementioned studies are described in the following publications, the disclosure of which are hereby incorporated by reference:

Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human genes. XIII. The complete sequences of 100 new cDNA clones from brain which code for large proteins in vitro. DNA Res. 6:63-70, 1999; and Mansharamani, M.; Hewetson, A.; Chilton, B. S.: Cloning and characterization of an atypical type IV P-type ATPase that binds to the RING motif of RUSH transcription factors. J. Biol. C.

Further studies establishing the function and utilities of ATP11B are found in John Hopkins OMIM database record ID 605869, and in sited publications numbered 6623, 700 and 8593 listed in the bibliography section hereinbelow, which are also hereby incorporated by reference. B-cell CLL/lymphoma 2 (BCL2, Accession NM_000633) is another VGAM665 host target gene. BCL2 BINDING SITE is HOST TARGET binding site found in the 3' untranslated region of mRNA encoded by BCL2, corresponding to a HOST TARGET binding site such as BINDING SITE I, BINDING SITE II or BINDING SITE III. Table 2 illustrates the complementarity of the nucleotide sequences of BCL2 BINDING SITE, designated SEQ ID:6260, to the nucleotide sequence of VGAM665 RNA, herein designated VGAM RNA, also designated SEQ ID:3376.

Another function of VGAM665 is therefore inhibition of B-cell CLL/lymphoma 2 (BCL2, Accession NM_000633). Accordingly, utilities of VGAM665 include diagnosis, prevention and treatment of diseases and clinical conditions associated with BCL2. F-box and Leucine-rich Repeat Protein 5 (FBXL5, Accession NM_012161) is another VGAM665 host target gene. FBXL5 BINDING SITE1 and FBXL5 BINDING SITE2 are HOST TARGET binding sites found in untranslated regions of mRNA encoded by FBXL5, corresponding to HOST TARGET binding sites such as BINDING SITE I, BINDING SITE II or BINDING SITE III. Table 2 illustrates the complementarity of the nucleotide sequences of FBXL5 BINDING SITE1 and FBXL5 BINDING SITE2, designated SEQ ID:14461 and SEQ ID:27303 respectively, to the nucleotide sequence of VGAM665 RNA, herein designated VGAM RNA, also designated SEQ ID:3376.

Another function of VGAM665 is therefore inhibition of F-box and Leucine-rich Repeat Protein 5 (FBXL5, Accession NM_012161), a gene which is a putative SCF ubiquitin ligase subunit involved in protein degradation. Accordingly, utilities of VGAM665 include diagnosis, prevention and treatment of diseases and clinical conditions associated with FBXL5. The function of FBXL5 and its association with various diseases and clinical conditions, has been established by previous studies, as described hereinabove with reference to VGAM61. Fibroblast Growth Factor 5 (FGF5, Accession NM_033143) is another VGAM665 host target gene. FGF5 BINDING SITE1 and FGF5 BINDING SITE2 are HOST TARGET binding sites found in untranslated regions of mRNA encoded by FGF5, corresponding to HOST TARGET binding sites such as BINDING SITE I, BINDING SITE II or BINDING SITE III. Table 2 illustrates the complementarity of the nucleotide sequences of FGF5 BINDING SITE1 and FGF5 BINDING SITE2, designated SEQ ID:27003 and SEQ ID:7782 respectively, to the nucleotide sequence of VGAM665 RNA, herein designated VGAM RNA, also designated SEQ ID:3376.

Another function of VGAM665 is therefore inhibition of Fibroblast Growth Factor 5 (FGF5, Accession NM_033143), a gene which induces transformation and may regulate neuronal differentiation. Accordingly, utilities of VGAM665 include diagnosis, prevention and treatment of diseases and clinical conditions associated with FGF5. The function of FGF5 and its association with various diseases and clinical conditions, has been established by previous studies, as described hereinabove with reference to VGAM276. Interleukin 1 Receptor Antagonist (IL1RN, Accession NM_000577) is another VGAM665 host target gene. IL1RN BINDING SITE is HOST TARGET binding site found in the 3' untranslated region of mRNA encoded by IL1RN, corresponding to a HOST TARGET binding site such as BINDING SITE I, BINDING SITE II or BINDING SITE III. Table 2 illustrates the complementarity of the nucleotide sequences of IL1RN BINDING SITE, designated SEQ ID:6177, to the nucleotide sequence of VGAM665 RNA, herein designated VGAM RNA, also designated SEQ ID:3376.

Another function of VGAM665 is therefore inhibition of Interleukin 1 Receptor Antagonist (IL1RN, Accession NM_000577), a gene which inhibits the activity of il-1 by binding to its receptor. il-1ra has no il-1 like activity. Accordingly, utilities of VGAM665 include diagnosis, prevention and treatment of diseases and clinical conditions associated with IL1RN. The function of IL1RN and its association with various diseases and clinical conditions, has been established by previous studies, as described hereinabove with reference to VGAM193. Protein Phosphatase 1, Catalytic Subunit, Beta Isoform (PPP1CB, Accession NM_002709) is another VGAM665 host target gene. PPP1CB BINDING SITE is HOST TARGET binding site found in the 3' untranslated region of mRNA encoded by PPP1CB, corresponding to a HOST TARGET binding site such as BINDING SITE I, BINDING SITE II or BINDING SITE III. Table 2 illustrates the complementarity of the nucleotide sequences of PPP1CB BINDING SITE, designated SEQ ID:8560, to the nucleotide sequence of VGAM665 RNA, herein designated VGAM RNA, also designated SEQ ID:3376.

Another function of VGAM665 is therefore inhibition of Protein Phosphatase 1, Catalytic Subunit, Beta Isoform (PPP1CB, Accession NM_002709), a gene which is the catalytic subunit of protein phosphatase 1. Accordingly, utilities of VGAM665 include diagnosis, prevention and treatment of diseases and clinical conditions associated with PPP1CB. The function of PPP1CB and its association with various diseases and clinical conditions, has been established by previous studies, as described hereinabove with reference to VGAM46. Selectin E (endothelial adhesion molecule 1) (SELE, Accession NM_000450) is another VGAM665 host target gene. SELE BINDING SITE is HOST TARGET binding site found in the 3' untranslated region of mRNA encoded by SELE, corresponding to a HOST TARGET binding site such as BINDING SITE I, BINDING SITE II or BINDING SITE III. Table 2 illustrates the complementarity of the nucleotide sequences of SELE BINDING SITE, designated SEQ ID:6052, to the nucleotide sequence of VGAM665 RNA, herein designated VGAM RNA, also designated SEQ ID:3376.

Another function of VGAM665 is therefore inhibition of Selectin E (endothelial adhesion molecule 1) (SELE, Accession NM_000450), a gene which expressed on cytokine induced endothelial cells and mediates their binding to leukocytes. Accordingly, utilities of VGAM665 include diagnosis, prevention and treatment of diseases and clinical conditions associated with SELE. The function of SELE and its association with various diseases and clinical conditions, has been established by previous studies, as described hereinabove with reference to VGAM508. Single-minded Homolog 1 (Drosophila) (SIM1, Accession NM_005068) is another VGAM665 host target gene. SIM1 BINDING SITE is HOST TARGET binding site found in the 3' untranslated region of mRNA encoded by SIM1, corresponding to a HOST TARGET binding site such as BINDING SITE I, BINDING SITE II or BINDING SITE III. Table 2 illustrates the complementarity of the nucleotide sequences of SIM1 BINDING SITE, designated SEQ ID:11512, to the nucleotide sequence of VGAM665 RNA, herein designated VGAM RNA, also designated SEQ ID:3376.

Another function of VGAM665 is therefore inhibition of Single-minded Homolog 1 (Drosophila) (SIM1, Accession NM_005068), a gene which may have pleiotropic effects during embryogenesis and in the adult. Accordingly, utilities of VGAM665 include diagnosis, prevention and treatment of diseases and clinical conditions associated with SIM1. The function of SIM1 has been established by previous studies. Studies of mice and human S have revealed a number of genes that when mutated result in severe obesity. Holder et al. (2000) studied a girl with early-onset obesity and a balanced translocation between 1p22.1 and 6q16.2. At 67 months of age she weighed 47.5 kg (+9.3 SD) and was 127.2 cm tall (+3.2 SD); her weight for height was +6.3 SD. The child displayed an aggressive, voracious appetite, and the obesity was thought to be due to high intake, since measured energy expenditure was normal. Holder et al. (2000) cloned and sequenced both translocation breakpoints. The translocation did not appear to affect any transcription unit on 1p, but it disrupted the SIM1 gene on 6q, separating the 5-prime promoter region and the bHLH domain from the 3-prime PAS and putative transcriptional regulation domains. The transcriptional targets of SIM1 were not known. Mouse Sim1 is expressed in the developing kidney and central nervous system and is essential for formation of the supraoptic and paraventricular (PVN) nuclei of the hypothalamus. Previous neuroanatomic and pharmacologic studies had implicated the PVN in the regulation of body weight: PVN neurons express the melanocortin-4 receptor (MC4R; 155541) and appear to be physiologic targets of alpha-melanocyte-stimulating hormone (OMIM Ref. No. 176830), which inhibits food intake. Holder et al. (2000) hypothesized that haploinsufficiency of SIM1, possibly acting upstream or downstream of MC4R in the PVN, was responsible for severe obesity in their patient. Animal model experiments lend further support to the function of SIM1. Mice homozygous for a null allele of Sim1 (Sim1 -/-) lack a paraventricular nucleus (PVN) and die perinatally. In contrast, Michaud et al. (2001) showed that Sim1 heterozygous mice were viable but developed early-onset obesity, with increased linear growth, hyperinsulinemia, and hyperleptinemia. Sim1 +/- mice were hyperphagic but their energy expenditure was not decreased, distinguishing them from other mouse models of early-onset obesity such as deficiencies in leptin (OMIM Ref. No. 164160) and melanocortin receptor-4 (OMIM Ref. No. 155541). Quantitative histologic comparison with normal littermates showed that the PVN of Sim1 +/- mice contains on average 24% fewer cells without a selective loss of any identifiable major cell type. Since acquired lesions in the PVN also induce increased appetite without a decrease in energy expenditure, the authors proposed that abnormalities of PVN development may cause the obesity of Sim1 +/- mice.

It is appreciated that the abovementioned animal model for SIM1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Holder, J. L., Jr.; Butte, N. F.; Zinn, A. R.: Profound obesity associated with a balanced translocation that disrupts the SIM1 gene. Hum. Molec. Genet. 9:101-108, 2000; and Michaud, J. L.; Boucher, F.; Melnyk, A.; Gauthier, F.; Goshu, E.; Levy, E.; Mitchell, G. A.; Himms-Hagen, J.; Fan, C.-M.: Sim1 haploinsufficiency causes hyperphagia, obesity and redu.

Further studies establishing the function and utilities of SIM1 are found in John Hopkins OMIM database record ID 603128, and in sited publications numbered 64 and 647-646 listed in the bibliography section hereinbelow, which are also hereby incorporated by reference. Visual System Homeobox 1 Homolog, CHX10-like (zebrafish) (VSX1, Accession NM_014588) is another VGAM665 host target gene. VSX1 BINDING SITE is HOST TARGET binding site found in the 3' untranslated region of mRNA encoded by VSX1, corresponding to a HOST TARGET binding site such as BINDING SITE I, BINDING SITE II or BINDING SITE III. Table 2 illustrates the complementarity of the nucleotide sequences of VSX1 BINDING SITE, designated SEQ ID:15955, to the nucleotide sequence of VGAM665 RNA, herein designated VGAM RNA, also designated SEQ ID:3376.

Another function of VGAM665 is therefore inhibition of Visual System Homeobox 1 Homolog, CHX10-like (zebrafish) (VSX1, Accession NM_014588), a gene which is implicated in ocular development. Accordingly, utilities of VGAM665 include diagnosis, prevention and treatment of diseases and clinical conditions associated with VSX1. The function of VSX1 has been established by previous studies. Using a yeast 1-hybrid screen of an adult bovine retinal cDNA library with the conserved core of the red/green visual pigment locus control region (see OMIM Ref. No. CBD; 303800) as bait, followed by RT-PCR of a human retinal library, Hayashi et al. (2000) isolated a cDNA encoding VSX1, which they termed RINX for 'retinal inner nuclear layer (INL) homeo box.' Hayashi et al. (2000) also identified 5 splice variants of VSX1. RT-PCR analysis indicated that the 2 major VSX1 transcripts are expressed in retina and WERI, a retinoblastoma cell line expressing retinal cone genes, but not in other tissues or in a rhodopsin-expressing retinoblastoma cell line. Northern blot analysis detected a 2.0-kb main VSX1 transcript in retina but not heart. In situ hybridization analysis of bovine retinal sections demonstrated exclusive localization of VSX1 to cell nuclei in the middle of the INL, likely belonging to bipolar cells. By PCR of a human embryonic craniofacial cDNA library using degenerate oligonucleotides based on highly conserved motifs within the paired-like homeodomain, Semina et al. (2000) isolated a cDNA encoding VSX1. The predicted 365-amino acid VSX1 protein contains a paired-like homeodomain and a CVC domain. Human VSX1 shares 55% overall sequence identity with the zebrafish and goldfish Vsx1 proteins and 35% overall identity with the goldfish Vsx2 and mouse Chx10 proteins. PCR of a panel of cDNA libraries detected VSX1 expression in embryonic craniofacial, adult retina, and adult cornea libraries but not in adult lens, embryonic or adult brain, heart, kidney, liver, lung, skeletal muscle, spleen, or thymus libraries.

Full details of the abovementioned studies are described in the following publications, the disclosure of which are hereby incorporated by reference:

Hayashi, T.; Huang, J.; Deeb, S. S.: RINX(VSX1), a novel homeobox gene expressed in the inner nuclear layer of the adult retina. Genomics 67:128-139, 2000; and Semina, E. V.; Mintz-Hittner, H. A.; Murray, J. C.: Isolation and characterization of a novel human paired-like homeodomain-containing transcription factor gene, VSX1, expressed in ocula.

Further studies establishing the function and utilities of VSX1 are found in John Hopkins OMIM database record ID 605020, and in sited publications numbered 4387-4389 listed in the bibliography section hereinbelow, which are also hereby incorporated by reference. Zinc Finger Protein 264 (ZNF264, Accession NM_003417) is another VGAM665 host target gene. ZNF264 BINDING SITE is HOST TARGET binding site found in the 3' untranslated region of mRNA encoded by ZNF264, corresponding to a HOST TARGET binding site such as BINDING SITE I, BINDING SITE II or BINDING SITE III. Table 2 illustrates the complementarity of the nucleotide sequences of ZNF264 BINDING SITE, designated SEQ ID:9459, to the nucleotide sequence of VGAM665 RNA, herein designated VGAM RNA, also designated SEQ ID:3376.

Another function of VGAM665 is therefore inhibition of Zinc Finger Protein 264 (ZNF264, Accession NM_003417). Accordingly, utilities of VGAM665 include diagnosis, prevention and treatment of diseases and clinical conditions associated with ZNF264. DKFZP564O0463 (Accession NM_014156) is another VGAM665 host target gene. DKFZP564O0463 BINDING SITE is HOST TARGET binding site found in the 3' untranslated region of mRNA encoded by DKFZP564O0463, corresponding to a HOST TARGET binding site such as BINDING SITE I, BINDING SITE II or BINDING SITE III. Table 2 illustrates the complementarity of the nucleotide sequences of DKFZP564O0463 BINDING SITE, designated SEQ ID:15441, to the nucleotide sequence of VGAM665 RNA, herein designated VGAM RNA, also designated SEQ ID:3376.

Another function of VGAM665 is therefore inhibition of DKFZP564O0463 (Accession NM_014156). Accordingly, utilities of VGAM665 include diagnosis, prevention and treatment of diseases and clinical conditions associated with DKFZP564O0463. KIAA0226 (Accession XM_032901) is another VGAM665 host target gene. KIAA0226 BINDING SITE is HOST TARGET binding site found in the 3' untranslated region of mRNA encoded by KIAA0226, corresponding to a HOST TARGET binding site such as BINDING SITE I, BINDING SITE II or BINDING SITE III. Table 2 illustrates the complementarity of the nucleotide sequences of KIAA0226 BINDING SITE, designated SEQ ID:31787, to the nucleotide sequence of VGAM665 RNA, herein designated VGAM RNA, also designated SEQ ID:3376.

Another function of VGAM665 is therefore inhibition of KIAA0226 (Accession XM_032901). Accordingly, utilities of VGAM665 include diagnosis, prevention and treatment of diseases and clinical conditions associated with KIAA0226. KIAA0534 (Accession XM_049349) is another VGAM665 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35377, to the nucleotide sequence of VGAM665 RNA, herein designated VGAM RNA, also designated SEQ ID:3376.

Another function of VGAM665 is therefore inhibition of KIAA0534 (Accession XM_049349). Accordingly, utilities of VGAM665 include diagnosis, prevention and treatment of diseases and clinical conditions associated with KIAA0534. KIAA1193 (Accession XM_041843) is another VGAM665 host target gene. KIAA1193 BINDING SITE is HOST TARGET binding site found in the 3' untranslated region of mRNA encoded by KIAA1193, corresponding to a HOST TARGET binding site such as BINDING SITE I, BINDING SITE II or BINDING SITE III. Table 2 illustrates the complementarity of the nucleotide sequences of KIAA1193 BINDING SITE, designated SEQ ID:33579, to the nucleotide sequence of VGAM665 RNA, herein designated VGAM RNA, also designated SEQ ID:3376.

Another function of VGAM665 is therefore inhibition of KIAA1193 (Accession XM_041843). Accordingly, utilities of VGAM665 include diagnosis, prevention and treatment of diseases and clinical conditions associated with KIAA1193. KIAA1622 (Accession NM_058237) is another VGAM665 host target gene. KIAA1622 BINDING SITE is HOST TARGET binding site found in the 3' untranslated region of mRNA encoded by KIAA1622, corresponding to a HOST TARGET binding site such as BINDING SITE I, BINDING SITE II or BINDING SITE III. Table 2 illustrates the complementarity of the nucleotide sequences of KIAA1622 BINDING SITE, designated SEQ ID:27765, to the nucleotide sequence of VGAM665 RNA, herein designated VGAM RNA, also designated SEQ ID:3376.

Another function of VGAM665 is therefore inhibition of KIAA1622 (Accession NM_058237). Accordingly, utilities of VGAM665 include diagnosis, prevention and treatment of diseases and clinical conditions associated with KIAA1622. LOC116064 (Accession XM_057296) is another VGAM665 host target gene. LOC116064 BINDING SITE is HOST TARGET binding site found in the 3' untranslated region of mRNA encoded by LOC116064, corresponding to a HOST TARGET binding site such as BINDING SITE I, BINDING SITE II or BINDING SITE III. Table 2 illustrates the complementarity of the nucleotide sequences of LOC116064 BINDING SITE, designated SEQ ID:36496, to the nucleotide sequence of VGAM665 RNA, herein designated VGAM RNA, also designated SEQ ID:3376.

Another function of VGAM665 is therefore inhibition of LOC116064 (Accession XM_057296). Accordingly, utilities of VGAM665 include diagnosis, prevention and treatment of diseases and clinical conditions associated with LOC116064. FIG. 1 further provides a conceptual description of a novel bioinformatically detected viral gene of the present invention, referred to here as Viral Genomic Address Messenger 666 (VGAM666) viral gene, which modulates expression of respective host target genes thereof, the function and utility of which host target genes is known in the art.

VGAM666 is a novel bioinformatically detected regulatory, non protein coding, viral micro RNA (miRNA) gene. The method by which VGAM666 was detected is described hereinabove with reference to FIGS. 1-8.

VGAM666 gene, herein designated VGAM GENE, is a viral gene contained in the genome of Yaba-like Disease Virus. VGAM666 host target gene, herein designated VGAM HOST TARGET GENE, is a human gene contained in the human genome.

VGAM666 gene encodes a VGAM666 precursor RNA, herein designated VGAM PRECURSOR RNA. Similar to other miRNA genes, and unlike most ordinary genes, VGAM666 precursor RNA does not encode a protein. A nucleotide sequence identical or highly similar to the nucleotide sequence of VGAM666 precursor RNA is designated SEQ ID:652, and is provided hereinbelow with reference to the sequence listing part. Nucleotide sequence SEQ ID:652 is located at position 27927 relative to the genome of Yaba-like Disease Virus.

VGAM666 precursor RNA folds onto itself, forming VGAM666 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM666 folded precursor RNA into VGAM666 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 78%) nucleotide sequence of VGAM666 RNA is designated SEQ ID:3377, and is provided hereinbelow with reference to the sequence listing part.

VGAM666 host target gene, herein designated VGAM HOST TARGET GENE, encodes a corresponding messenger RNA, VGAM666 host target RNA, herein designated VGAM HOST TARGET RNA. VGAM666 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM666 RNA, herein designated VGAM RNA, binds complementarily to one or more host target binding sites located in untranslated regions of VGAM666 host target RNA, herein designated VGAM HOST TARGET RNA. This complementary binding is due to the fact that the nucleotide sequence of VGAM666 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM666 RNA, herein designated VGAM RNA, may have a different number of host target binding sites in untranslated regions of a VGAM666 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM666 RNA, herein designated VGAM RNA, to host target binding sites on VGAM666 host target RNA, herein designated VGAM HOST TARGET RNA, such as BINDING SITE I, BINDING SITE II and BINDING SITE III, inhibits translation of VGAM666 host target RNA into VGAM666 host target protein, herein designated VGAM HOST TARGET PROTEIN. VGAM host target protein is therefore outlined by a broken line.

It is appreciated that VGAM666 host target gene, herein designated VGAM HOST TARGET GENE, in fact represents a plurality of VGAM666 host target genes. The mRNA of each one of this plurality of VGAM666 host target genes comprises one or more host target binding sites, each having a nucleotide sequence which is at least partly complementary to VGAM666 RNA, herein designated VGAM RNA, and which when bound by VGAM666 RNA causes inhibition of translation of respective one or more VGAM666 host target proteins.

It is further appreciated by one skilled in the art that the mode of translational inhibition illustrated by FIG. 1 with specific reference to translational inhibition exerted by VGAM666 gene, herein designated VGAM GENE, on one or more VGAM666 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM666 is inhibition of expression of host target genes, as part of a novel viral mechanism of attacking a host. Accordingly, utilities of VGAM666 include diagnosis, prevention and treatment of viral infection by Yaba-like Disease Virus. Specific functions, and accordingly utilities, of VGAM666 correlate with, and may be deduced from, the identity of the host target genes which VGAM666 binds and inhibits, and the function of these host target genes, as elaborated hereinbelow.

Nucleotide sequences of the VGAM666 precursor RNA, herein designated VGAM PRECURSOR RNA, and of the 'diced' VGAM666 RNA, herein designated VGAM RNA, and a schematic representation of the secondary folding of VGAM666 folded precursor RNA, herein designated VGAM FOLDED PRECURSOR RNA, of VGAM666 are further described hereinbelow with reference to Table 1.

Nucleotide sequences of host target binding sites, such as BINDING SITE-I, BINDING SITE-II and BINDING SITE-III of FIG. 1, found on VGAM666 host target RNA, and schematic representation of the complementarity of each of these host target binding sites to VGAM666 RNA, herein designated VGAM RNA, are described hereinbelow with reference to Table 2.

As mentioned hereinabove with reference to FIG. 1, a function of VGAM666 gene, herein designated VGAM is inhibition of expression of VGAM666 target genes. It is appreciated that specific functions, and accordingly utilities, of VGAM666 correlate with, and may be deduced from, the identity of the target genes which VGAM666 binds and inhibits, and the function of these target genes, as elaborated hereinbelow.

A Kinase (PRKA) Anchor Protein 13 (AKAP13, Accession XM_116974) is a VGAM666 host target gene. AKAP13 BINDING SITE is HOST TARGET binding site found in the 3' untranslated region of mRNA encoded by AKAP13, corresponding to a HOST TARGET binding site such as BINDING SITE I, BINDING SITE II or BINDING SITE III. Table 2 illustrates the complementarity of the nucleotide sequences of AKAP13 BINDING SITE, designated SEQ ID:43175, to the nucleotide sequence of VGAM666 RNA, herein designated VGAM RNA, also designated SEQ ID:3377.

A function of VGAM666 is therefore inhibition of A Kinase (PRKA) Anchor Protein 13 (AKAP13, Accession XM_116974), a gene which regulates subcellular localization of type II cAMP-dependent PKA. Accordingly, utilities of VGAM666 include diagnosis, prevention and treatment of diseases and clinical conditions associated with AKAP13. The function of AKAP13 and its association with various diseases and clinical conditions, has been established by previous studies, as described hereinabove with reference to VGAM17. Ret Proto-oncogene (multiple endocrine neoplasia and medullary thyroid carcinoma 1, Hirschsprung disease) (RET, Accession NM_020630) is another VGAM666 host target gene. RET BINDING SITE is HOST TARGET binding site found in the 3" untranslated region of mRNA encoded by RET, corresponding to a HOST TARGET binding site such as BINDING SITE I, BINDING SITE II or BINDING SITE III. Table 2 illustrates the complementarity of the nucleotide sequences of RET BINDING SITE, designated SEQ ID:21781, to the nucleotide sequence of VGAM666 RNA, herein designated VGAM RNA, also designated SEQ ID:3377.

Another function of VGAM666 is therefore inhibition of Ret Proto-oncogene (multiple endocrine neoplasia and medullary thyroid carcinoma 1, Hirschsprung disease) (RET, Accession NM_020630), a gene which transduces signals for cell growth and differentiation. Accordingly, utilities of VGAM666 include diagnosis, prevention and treatment of diseases and clinical conditions associated with RET. The function of RET and its association with various diseases and clinical conditions, has been established by previous studies, as described hereinabove with reference to VGAM381. Zinc Finger, DHHC Domain Containing 2 (ZDHHC2, Accession NM_016353) is another VGAM666 host target gene. ZDHHC2 BINDING SITE is HOST TARGET binding site found in the 3' untranslated region of mRNA encoded by ZDHHC2, corresponding to a HOST TARGET binding site such as BINDING SITE I, BINDING SITE II or BINDING SITE III. Table 2 illustrates the complementarity of the nucleotide sequences of ZDHHC2 BINDING SITE, designated SEQ ID:18485, to the nucleotide sequence of VGAM666 RNA, herein designated VGAM RNA, also designated SEQ ID:3377.

Another function of VGAM666 is therefore inhibition of Zinc Finger, DHHC Domain Containing 2 (ZDHHC2, Accession NM_016353). Accordingly, utilities of VGAM666 include diagnosis, prevention and treatment of diseases and clinical conditions associated with ZDHHC2. LOC158263 (Accession XM_088530) is another VGAM666 host target gene. LOC158263 BINDING SITE is HOST TARGET binding site found in the 3' untranslated region of mRNA encoded by LOC158263, corresponding to a HOST TARGET binding site such as BINDING SITE I, BINDING SITE II or BINDING SITE III. Table 2 illustrates the complementarity of the nucleotide sequences of LOC158263 BINDING SITE, designated SEQ ID:39796, to the nucleotide sequence of VGAM666 RNA, herein designated VGAM RNA, also designated SEQ ID:3377.

Another function of VGAM666 is therefore inhibition of LOC158263 (Accession XM_088530). Accordingly, utilities of VGAM666 include diagnosis, prevention and treatment of diseases and clinical conditions associated with LOC158263. LOC221656 (Accession XM_166418) is another VGAM666 host target gene. LOC221656 BINDING SITE is HOST TARGET binding site found in the 3' untranslated region of mRNA encoded by LOC221656, corresponding to a HOST TARGET binding site such as BINDING SITE I, BINDING SITE II or BINDING SITE III. Table 2 illustrates the complementarity of the nucleotide sequences of LOC221656 BINDING SITE, designated SEQ ID:44291, to the nucleotide sequence of VGAM666 RNA, herein designated VGAM RNA, also designated SEQ ID:3377.

Another function of VGAM666 is therefore inhibition of LOC221656 (Accession XM_166418). Accordingly, utilities of VGAM666 include diagnosis, prevention and treatment of diseases and clinical conditions associated with LOC221656. FIG. 1 further provides a conceptual description of a novel bioinformatically detected viral gene of the present invention, referred to here as Viral Genomic Address Messenger 667 (VGAM667) viral gene, which modulates expression of respective host target genes thereof, the function and utility of which host target genes is known in the art.

VGAM667 is a novel bioinformatically detected regulatory, non protein coding, viral micro RNA (miRNA) gene. The method by which VGAM667 was detected is described hereinabove with reference to FIGS. 1-8.

VGAM667 gene, herein designated VGAM GENE, is a viral gene contained in the genome of Fowlpox Virus. VGAM667 host target gene, herein designated VGAM HOST TARGET GENE, is a human gene contained in the human genome.

VGAM667 gene encodes a VGAM667 precursor RNA, herein designated VGAM PRECURSOR RNA. Similar to other miRNA genes, and unlike most ordinary genes, VGAM667 precursor RNA does not encode a protein. A nucleotide sequence identical or highly similar to the nucleotide sequence of VGAM667 precursor RNA is designated SEQ ID:653, and is provided hereinbelow with reference to the sequence listing part. Nucleotide sequence SEQ ID:653 is located at position 242236 relative to the genome of Fowlpox Virus.

VGAM667 precursor RNA folds onto itself, forming VGAM667 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM667 folded precursor RNA into VGAM667 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM667 RNA is designated SEQ ID:3378, and is provided hereinbelow with reference to the sequence listing part.

VGAM667 host target gene, herein designated VGAM HOST TARGET GENE, encodes a corresponding messenger RNA, VGAM667 host target RNA, herein designated VGAM HOST TARGET RNA. VGAM667 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM667 RNA, herein designated VGAM RNA, binds complementarily to one or more host target binding sites located in untranslated regions of VGAM667 host target RNA, herein designated VGAM HOST TARGET RNA. This complementary binding is due to the fact that the nucleotide sequence of VGAM667 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM667 RNA, herein designated VGAM RNA, may have a different number of host target binding sites in untranslated regions of a VGAM667 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM667 RNA, herein designated VGAM RNA, to host target binding sites on VGAM667 host target RNA, herein designated VGAM HOST TARGET RNA, such as BINDING SITE I, BINDING SITE II and BINDING SITE III, inhibits translation of VGAM667 host target RNA into VGAM667 host target protein, herein designated VGAM HOST TARGET PROTEIN. VGAM host target protein is therefore outlined by a broken line.

It is appreciated that VGAM667 host target gene, herein designated VGAM HOST TARGET GENE, in fact represents a plurality of VGAM667 host target genes. The mRNA of each one of this plurality of VGAM667 host target genes comprises one or more host target binding sites, each having a nucleotide sequence which is at least partly complementary to VGAM667 RNA, herein designated VGAM RNA, and which when bound by VGAM667 RNA causes inhibition of translation of respective one or more VGAM667 host target proteins.

It is further appreciated by one skilled in the art that the mode of translational inhibition illustrated by FIG. 1 with specific reference to translational inhibition exerted by VGAM667 gene, herein designated VGAM GENE, on one or more VGAM667 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM667 is inhibition of expression of host target genes, as part of a novel viral mechanism of attacking a host. Accordingly, utilities of VGAM667 include diagnosis, prevention and treatment of viral infection by Fowlpox Virus. Specific functions, and accordingly utilities, of VGAM667 correlate with, and may be deduced from, the identity of the host target genes which VGAM667 binds and inhibits, and the function of these host target genes, as elaborated hereinbelow.

Nucleotide sequences of the VGAM667 precursor RNA, herein designated VGAM PRECURSOR RNA, and of the 'diced' VGAM667 RNA, herein designated VGAM RNA, and a schematic representation of the secondary folding of VGAM667 folded precursor RNA, herein designated VGAM FOLDED PRECURSOR RNA, of VGAM667 are further described hereinbelow with reference to Table 1.

Nucleotide sequences of host target binding sites, such as BINDING SITE-I, BINDING SITE-II and BINDING SITE-III of FIG. 1, found on VGAM667 host target RNA, and schematic representation of the complementarity of each of these host target binding sites to VGAM667 RNA, herein designated VGAM RNA, are described hereinbelow with reference to Table 2.

As mentioned hereinabove with reference to FIG. 1, a function of VGAM667 gene, herein designated VGAM is inhibition of expression of VGAM667 target genes. It is appreciated that specific functions, and accordingly utilities, of VGAM667 correlate with, and may be deduced from, the identity of the target genes which VGAM667 binds and inhibits, and the function of these target genes, as elaborated hereinbelow.

Glucose-6-phosphatase, Catalytic (glycogen storage disease type I, von Gierke disease) (G6PC, Accession NM_000151) is a VGAM667 host target gene. G6PC BINDING SITE is HOST TARGET binding site found in the 3" untranslated region of mRNA encoded by G6PC, corresponding to a HOST TARGET binding site such as BINDING SITE I, BINDING SITE II or BINDING SITE III. Table 2 illustrates the complementarity of the nucleotide sequences of G6PC BINDING SITE, designated SEQ ID:5653, to the nucleotide sequence of VGAM667 RNA, herein designated VGAM RNA, also designated SEQ ID:3378.

A function of VGAM667 is therefore inhibition of Glucose-6-phosphatase, Catalytic (glycogen storage disease type I, von Gierke disease) (G6PC, Accession NM_000151). Accordingly, utilities of VGAM667 include diagnosis, prevention and treatment of diseases and clinical conditions associated with G6PC. Solute Carrier Family 16 (monocarboxylic acid transporters), Member 2 (putative transporter) (SLC16A2, Accession NM_006517) is another VGAM667 host target gene. SLC16A2 BINDING SITE is HOST TARGET binding site found in the 3' untranslated region of mRNA encoded by SLC16A2, corresponding to a HOST TARGET binding site such as BINDING SITE I, BINDING SITE II or BINDING SITE III. Table 2 illustrates the complementarity of the nucleotide sequences of SLC16A2 BINDING SITE, designated SEQ ID:13266, to the nucleotide sequence of VGAM667 RNA, herein designated VGAM RNA, also designated SEQ ID:3378.

Another function of VGAM667 is therefore inhibition of Solute Carrier Family 16 (monocarboxylic acid transporters), Member 2 (putative transporter) (SLC16A2, Accession NM_006517). Accordingly, utilities of VGAM667 include diagnosis, prevention and treatment of diseases and clinical conditions associated with SLC16A2. LOC140139 (Accession XM_067102) is another VGAM667 host target gene. LOC140139 BINDING SITE is HOST TARGET binding site found in the 5' untranslated region of mRNA encoded by LOC140139, corresponding to a HOST TARGET binding site such as BINDING SITE I, BINDING SITE II or BINDING SITE III. Table 2 illustrates the complementarity of the nucleotide sequences of LOC140139 BINDING SITE, designated SEQ ID:37347, to the nucleotide sequence of VGAM667 RNA, herein designated VGAM RNA, also designated SEQ ID:3378.

Another function of VGAM667 is therefore inhibition of LOC140139 (Accession XM_067102). Accordingly, utilities of VGAM667 include diagnosis, prevention and treatment of diseases and clinical conditions associated with LOC140139. FIG. 1 further provides a conceptual description of a novel bioinformatically detected viral gene of the present invention, referred to here as Viral Genomic Address Messenger 668 (VGAM668) viral gene, which modulates expression of respective host target genes thereof, the function and utility of which host target genes is known in the art.

VGAM668 is a novel bioinformatically detected regulatory, non protein coding, viral micro RNA (miRNA) gene.

The method by which VGAM668 was detected is described hereinabove with reference to FIGS. 1-8.

VGAM668 gene, herein designated VGAM GENE, is a viral gene contained in the genome of Fowlpox Virus. VGAM668 host target gene, herein designated VGAM HOST TARGET GENE, is a human gene contained in the human genome.

VGAM668 gene encodes a VGAM668 precursor RNA, herein designated VGAM PRECURSOR RNA. Similar to other miRNA genes, and unlike most ordinary genes, VGAM668 precursor RNA does not encode a protein. A nucleotide sequence identical or highly similar to the nucleotide sequence of VGAM668 precursor RNA is designated SEQ ID:654, and is provided hereinbelow with reference to the sequence listing part. Nucleotide sequence SEQ ID:654 is located at position 267154 relative to the genome of Fowlpox Virus.

VGAM668 precursor RNA folds onto itself, forming VGAM668 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM668 folded precursor RNA into VGAM668 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM668 RNA is designated SEQ ID:3379, and is provided hereinbelow with reference to the sequence listing part.

VGAM668 host target gene, herein designated VGAM HOST TARGET GENE, encodes a corresponding messenger RNA, VGAM668 host target RNA, herein designated VGAM HOST TARGET RNA. VGAM668 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM668 RNA, herein designated VGAM RNA, binds complementarily to one or more host target binding sites located in untranslated regions of VGAM668 host target RNA, herein designated VGAM HOST TARGET RNA. This complementary binding is due to the fact that the nucleotide sequence of VGAM668 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM668 RNA, herein designated VGAM RNA, may have a different number of host target binding sites in untranslated regions of a VGAM668 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM668 RNA, herein designated VGAM RNA, to host target binding sites on VGAM668 host target RNA, herein designated VGAM HOST TARGET RNA, such as BINDING SITE I, BINDING SITE II and BINDING SITE III, inhibits translation of VGAM668 host target RNA into VGAM668 host target protein, herein designated VGAM HOST TARGET PROTEIN. VGAM host target protein is therefore outlined by a broken line.

It is appreciated that VGAM668 host target gene, herein designated VGAM HOST TARGET GENE, in fact represents a plurality of VGAM668 host target genes. The mRNA of each one of this plurality of VGAM668 host target genes comprises one or more host target binding sites, each having a nucleotide sequence which is at least partly complementary to VGAM668 RNA, herein designated VGAM RNA, and which when bound by VGAM668 RNA causes inhibition of translation of respective one or more VGAM668 host target proteins.

It is further appreciated by one skilled in the art that the mode of translational inhibition illustrated by FIG. 1 with specific reference to translational inhibition exerted by VGAM668 gene, herein designated VGAM GENE, on one or more VGAM668 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM668 is inhibition of expression of host target genes, as part of a novel viral mechanism of attacking a host. Accordingly, utilities of VGAM668 include diagnosis, prevention and treatment of viral infection by Fowlpox Virus. Specific functions, and accordingly utilities, of VGAM668 correlate with, and may be deduced from, the identity of the host target genes which VGAM668 binds and inhibits, and the function of these host target genes, as elaborated hereinbelow.

Nucleotide sequences of the VGAM668 precursor RNA, herein designated VGAM PRECURSOR RNA, and of the 'diced' VGAM668 RNA, herein designated VGAM RNA, and a schematic representation of the secondary folding of VGAM668 folded precursor RNA, herein designated VGAM FOLDED PRECURSOR RNA, of VGAM668 are further described hereinbelow with reference to Table 1.

Nucleotide sequences of host target binding sites, such as BINDING SITE-I, BINDING SITE-II and BINDING SITE-III of FIG. 1, found on VGAM668 host target RNA, and schematic representation of the complementarity of each of these host target binding sites to VGAM668 RNA, herein designated VGAM RNA, are described hereinbelow with reference to Table 2.

As mentioned hereinabove with reference to FIG. 1, a function of VGAM668 gene, herein designated VGAM is inhibition of expression of VGAM668 target genes. It is appreciated that specific functions, and accordingly utilities, of VGAM668 correlate with, and may be deduced from, the identity of the target genes which VGAM668 binds and inhibits, and the function of these target genes, as elaborated hereinbelow.

Golgi Complex Associated Protein 1, 60 kDa (GOCAP1, Accession NM_022735) is a VGAM668 host target gene. GOCAP1 BINDING SITE is HOST TARGET binding site found in the 3' untranslated region of mRNA encoded by GOCAP1, corresponding to a HOST TARGET binding site such as BINDING SITE I, BINDING SITE II or BINDING SITE III. Table 2 illustrates the complementarity of the nucleotide sequences of GOCAP1 BINDING SITE, designated SEQ ID:22940, to the nucleotide sequence of VGAM668 RNA, herein designated VGAM RNA, also designated SEQ ID:3379.

A function of VGAM668 is therefore inhibition of Golgi Complex Associated Protein 1, 60 kDa (GOCAP1, Accession NM_022735). Accordingly, utilities of VGAM668 include diagnosis, prevention and treatment of diseases and clinical conditions associated with GOCAP1. Leucine Zipper Transcription Factor-like 1 (LZTFL1, Accession NM_020347) is another VGAM668 host target gene. LZTFL1 BINDING SITE is HOST TARGET binding site found in the 3' untranslated region of mRNA encoded by LZTFL1, corresponding to a HOST TARGET binding site such as BINDING SITE I, BINDING SITE II or BINDING SITE III. Table 2 illustrates the complementarity of the nucleotide sequences of LZTFL1 BINDING SITE, designated SEQ ID:21598, to the nucleotide sequence of VGAM668 RNA, herein designated VGAM RNA, also designated SEQ ID:3379.

Another function of VGAM668 is therefore inhibition of Leucine Zipper Transcription Factor-like 1 (LZTFL1, Accession NM_020347). Accordingly, utilities of VGAM668 include diagnosis, prevention and treatment of diseases and clinical conditions associated with LZTFL1. Solute Carrier Family 13 (sodium/sulfate symporters), Member 1 (SLC13A1, Accession NM_022444) is another VGAM668 host target gene. SLC13A1 BINDING SITE is HOST TARGET binding site found in the 3' untranslated region of mRNA encoded by SLC13A1, corresponding to a HOST TARGET binding site such as BINDING SITE I, BINDING SITE II or BINDING SITE III. Table 2 illustrates the complementarity of the nucleotide sequences of SLC13A1 BINDING SITE, designated SEQ ID:22777, to the nucleotide sequence of VGAM668 RNA, herein designated VGAM RNA, also designated SEQ ID:3379.

Another function of VGAM668 is therefore inhibition of Solute Carrier Family 13 (sodium/sulfate symporters), Member 1 (SLC13A1, Accession NM_022444). Accordingly, utilities of VGAM668 include diagnosis, prevention and treatment of diseases and clinical conditions associated with SLC13A1. DKFZp547I224 (Accession NM_020221) is another VGAM668 host target gene. DKFZp547I224 BINDING SITE is HOST TARGET binding site found in the 3' untranslated region of mRNA encoded by DKFZp547I224, corresponding to a HOST TARGET binding site such as BINDING SITE I, BINDING SITE II or BINDING SITE III. Table 2 illustrates the complementarity of the nucleotide sequences of DKFZp547I224 BINDING SITE, designated SEQ ID:21475, to the nucleotide sequence of VGAM668 RNA, herein designated VGAM RNA, also designated SEQ ID:3379.

Another function of VGAM668 is therefore inhibition of DKFZp547I224 (Accession NM_020221). Accordingly, utilities of VGAM668 include diagnosis, prevention and treatment of diseases and clinical conditions associated with DKFZp547I224. FLJ12331 (Accession NM_024986) is another VGAM668 host target gene. FLJ12331 BINDING SITE is HOST TARGET binding site found in the 3' untranslated region of mRNA encoded by FLJ12331, corresponding to a HOST TARGET binding site such as BINDING SITE I, BINDING SITE II or BINDING SITE III. Table 2 illustrates the complementarity of the nucleotide sequences of FLJ12331 BINDING SITE, designated SEQ ID:24542, to the nucleotide sequence of VGAM668 RNA, herein designated VGAM RNA, also designated SEQ ID:3379.

Another function of VGAM668 is therefore inhibition of FLJ12331 (Accession NM_024986). Accordingly, utilities of VGAM668 include diagnosis, prevention and treatment of diseases and clinical conditions associated with FLJ12331. FLJ20220 (Accession NM_017718) is another VGAM668 host target gene. FLJ20220 BINDING SITE is HOST TARGET binding site found in the 3' untranslated region of mRNA encoded by FLJ20220, corresponding to a HOST TARGET binding site such as BINDING SITE I, BINDING SITE II or BINDING SITE III. Table 2 illustrates the complementarity of the nucleotide sequences of FLJ20220 BINDING SITE, designated SEQ ID:19304, to the nucleotide sequence of VGAM668 RNA, herein designated VGAM RNA, also designated SEQ ID:3379.

Another function of VGAM668 is therefore inhibition of FLJ20220 (Accession NM_017718). Accordingly, utilities of VGAM668 include diagnosis, prevention and treatment of diseases and clinical conditions associated with FLJ20220. Oxysterol Binding Protein-like 3 (OSBPL3, Accession NM_015550) is another VGAM668 host target gene. OSBPL3 BINDING SITE is HOST TARGET binding site found in the 3' untranslated region of mRNA encoded by OSBPL3, corresponding to a HOST TARGET binding site such as BINDING SITE I, BINDING SITE II or BINDING SITE III. Table 2 illustrates the complementarity of the nucleotide sequences of OSBPL3 BINDING SITE, designated SEQ ID:17820, to the nucleotide sequence of VGAM668 RNA, herein designated VGAM RNA, also designated SEQ ID:3379.

Another function of VGAM668 is therefore inhibition of Oxysterol Binding Protein-like 3 (OSBPL3, Accession NM_015550). Accordingly, utilities of VGAM668 include diagnosis, prevention and treatment of diseases and clinical conditions associated with OSBPL3. TSPAN-3 (Accession NM_005724) is another VGAM668 host target gene. TSPAN-3 BINDING SITE is HOST TARGET binding site found in the 3' untranslated region of mRNA encoded by TSPAN-3, corresponding to a HOST TARGET binding site such as BINDING SITE I, BINDING SITE II or BINDING SITE III. Table 2 illustrates the complementarity of the nucleotide sequences of TSPAN-3 BINDING SITE, designated SEQ ID:12277, to the nucleotide sequence of VGAM668 RNA, herein designated VGAM RNA, also designated SEQ ID:3379.

Another function of VGAM668 is therefore inhibition of TSPAN-3 (Accession NM_005724). Accordingly, utilities of VGAM668 include diagnosis, prevention and treatment of diseases and clinical conditions associated with TSPAN-3. LOC122830 (Accession XM_058661) is another VGAM668 host target gene. LOC122830 BINDING SITE is HOST TARGET binding site found in the 3' untranslated region of mRNA encoded by LOC122830, corresponding to a HOST TARGET binding site such as BINDING SITE I, BINDING SITE II or BINDING SITE III. Table 2 illustrates the complementarity of the nucleotide sequences of LOC122830 BINDING SITE, designated SEQ ID:36707, to the nucleotide sequence of VGAM668 RNA, herein designated VGAM RNA, also designated SEQ ID:3379.

Another function of VGAM668 is therefore inhibition of LOC122830 (Accession XM_058661). Accordingly, utilities of VGAM668 include diagnosis, prevention and treatment of diseases and clinical conditions associated with LOC122830. LOC138199 (Accession XM_059950) is another VGAM668 host target gene. LOC138199 BINDING SITE is HOST TARGET binding site found in the 3' untranslated region of mRNA encoded by LOC138199, corresponding to a HOST TARGET binding site such as BINDING SITE I, BINDING SITE II or BINDING SITE III. Table 2 illustrates the complementarity of the nucleotide sequences of LOC138199 BINDING SITE, designated SEQ ID:37119, to the nucleotide sequence of VGAM668 RNA, herein designated VGAM RNA, also designated SEQ ID:3379.

Another function of VGAM668 is therefore inhibition of LOC138199 (Accession XM_059950). Accordingly, utilities of VGAM668 include diagnosis, prevention and treatment of diseases and clinical conditions associated with LOC138199. LOC158357 (Accession XM_088553) is another VGAM668 host target gene. LOC158357 BINDING SITE is HOST TARGET binding site found in the 3' untranslated region of mRNA encoded by LOC158357, corresponding to a HOST TARGET binding site such as BINDING SITE I, BINDING SITE II or BINDING SITE III. Table 2 illustrates the complementarity of the nucleotide sequences of LOC158357 BINDING SITE, designated SEQ ID:39821, to the nucleotide sequence of VGAM668 RNA, herein designated VGAM RNA, also designated SEQ ID:3379.

Another function of VGAM668 is therefore inhibition of LOC158357 (Accession XM_088553). Accordingly, utilities of VGAM668 include diagnosis, prevention and treatment of diseases and clinical conditions associated with LOC158357. LOC221687 (Accession XM_166423) is another VGAM668 host target gene. LOC221687 BINDING SITE is HOST TARGET binding site found in the 3' untranslated region of mRNA encoded by LOC221687, corresponding to a HOST TARGET binding site such as BINDING SITE I, BINDING SITE II or BINDING SITE III. Table 2 illustrates the complementarity of the nucleotide sequences of LOC221687 BINDING SITE, designated SEQ ID:44309, to the nucleotide sequence of VGAM668 RNA, herein designated VGAM RNA, also designated SEQ ID:3379.

Another function of VGAM668 is therefore inhibition of LOC221687 (Accession XM_166423). Accordingly, utilities of VGAM668 include diagnosis, prevention and treatment of diseases and clinical conditions associated with LOC221687. FIG. 1 further provides a conceptual description of a novel bioinformatically detected viral gene of the present invention, referred to here as Viral Genomic Address Messenger 669 (VGAM669) viral gene, which modulates expression of respective host target genes thereof, the function and utility of which host target genes is known in the art.

VGAM669 is a novel bioinformatically detected regulatory, non protein coding, viral micro RNA (miRNA) gene. The method by which VGAM669 was detected is described hereinabove with reference to FIGS. 1-8.

VGAM669 gene, herein designated VGAM GENE, is a viral gene contained in the genome of Yaba-like Disease Virus. VGAM669 host target gene, herein designated VGAM HOST TARGET GENE, is a human gene contained in the human genome.

VGAM669 gene encodes a VGAM669 precursor RNA, herein designated VGAM PRECURSOR RNA. Similar to other miRNA genes, and unlike most ordinary genes, VGAM669 precursor RNA does not encode a protein. A nucleotide sequence identical or highly similar to the nucleotide sequence of VGAM669 precursor RNA is designated SEQ ID:655, and is provided hereinbelow with reference to the sequence listing part. Nucleotide sequence SEQ ID:655 is located at position 42333 relative to the genome of Yaba-like Disease Virus.

VGAM669 precursor RNA folds onto itself, forming VGAM669 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM669 folded precursor RNA into VGAM669 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM669 RNA is designated SEQ ID:3380, and is provided hereinbelow with reference to the sequence listing part.

VGAM669 host target gene, herein designated VGAM HOST TARGET GENE, encodes a corresponding messenger RNA, VGAM669 host target RNA, herein designated VGAM HOST TARGET RNA. VGAM669 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM669 RNA, herein designated VGAM RNA, binds complementarily to one or more host target binding sites located in untranslated regions of VGAM669 host target RNA, herein designated VGAM HOST TARGET RNA. This complementary binding is due to the fact that the nucleotide sequence of VGAM669 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM669 RNA, herein designated VGAM RNA, may have a different number of host target binding sites in untranslated regions of a VGAM669 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM669 RNA, herein designated VGAM RNA, to host target binding sites on VGAM669 host target RNA, herein designated VGAM HOST TARGET RNA, such as BINDING SITE I, BINDING SITE II and BINDING SITE III, inhibits translation of VGAM669 host target RNA into VGAM669 host target protein, herein designated VGAM HOST TARGET PROTEIN. VGAM host target protein is therefore outlined by a broken line.

It is appreciated that VGAM669 host target gene, herein designated VGAM HOST TARGET GENE, in fact represents a plurality of VGAM669 host target genes. The mRNA of each one of this plurality of VGAM669 host target genes comprises one or more host target binding sites, each having a nucleotide sequence which is at least partly complementary to VGAM669 RNA, herein designated VGAM RNA, and which when bound by VGAM669 RNA causes inhibition of translation of respective one or more VGAM669 host target proteins.

It is further appreciated by one skilled in the art that the mode of translational inhibition illustrated by FIG. 1 with specific reference to translational inhibition exerted by VGAM669 gene, herein designated VGAM GENE, on one or more VGAM669 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM669 is inhibition of expression of host target genes, as part of a novel viral mechanism of attacking a host. Accordingly, utilities of VGAM669 include diagnosis, prevention and treatment of viral infection by Yaba-like Disease Virus. Specific functions, and accordingly utilities, of VGAM669 correlate with, and may be deduced from, the identity of the host target genes which VGAM669 binds and inhibits, and the function of these host target genes, as elaborated hereinbelow.

Nucleotide sequences of the VGAM669 precursor RNA, herein designated VGAM PRECURSOR RNA, and of the 'diced' VGAM669 RNA, herein designated VGAM RNA, and a schematic representation of the secondary folding of VGAM669 folded precursor RNA, herein designated VGAM FOLDED PRECURSOR RNA, of VGAM669 are further described hereinbelow with reference to Table 1.

Nucleotide sequences of host target binding sites, such as BINDING SITE-I, BINDING SITE-II and BINDING SITE-III of FIG. 1, found on VGAM669 host target RNA, and schematic representation of the complementarity of each of these host target binding sites to VGAM669 RNA, herein designated VGAM RNA, are described hereinbelow with reference to Table 2.

As mentioned hereinabove with reference to FIG. 1, a function of VGAM669 gene, herein designated VGAM is inhibition of expression of VGAM669 target genes. It is appreciated that specific functions, and accordingly utilities, of VGAM669 correlate with, and may be deduced from, the identity of the target genes which VGAM669 binds and inhibits, and the function of these target genes, as elaborated hereinbelow.

Prion Protein (p27-30) (Creutzfeld-Jakob disease, Gerstmann-Strausler-Scheinker syndrome, fatal familial insomnia) (PRNP, Accession NM_000311) is a VGAM669 host target gene. PRNP BINDING SITE is HOST TARGET binding site found in the 3' untranslated region of mRNA encoded by PRNP, corresponding to a HOST TARGET binding site such as BINDING SITE I, BINDING SITE II or BINDING SITE III. Table 2 illustrates the complementarity of the nucleotide sequences of PRNP BINDING SITE, designated SEQ ID:5849, to the nucleotide sequence of VGAM669 RNA, herein designated VGAM RNA, also designated SEQ ID:3380.

A function of VGAM669 is therefore inhibition of Prion Protein (p27-30) (Creutzfeld-Jakob disease, Gerstmann-Strausler-Scheinker syndrome, fatal familial insomnia) (PRNP, Accession NM_000311), a gene which the function of prp is not known. prp is encoded in the host genome and is expressed both in normal and infected cells. Accordingly, utilities of VGAM669 include diagnosis, prevention and treatment of diseases and clinical conditions associated with PRNP. The function of PRNP has been established by previous studies. Mutations in the prion protein gene are associated with Gerstmann-Straussler disease (GSD; 137440), Creutzfeldt-Jakob disease (CJD; 123400), and familial fatal insomnia (OMIM Ref. No. 600072), and aberrant isoforms of the prion protein can act as an infectious agent in these disorders as well as in kuru (OMIM Ref. No. 245300) and in scrapie in sheep. Riek et al. (1998) used the refined NMR structure of the mouse prion protein to investigate the structural basis of inherited human transmissible spongiform encephalopathies. In the cellular form of mouse prion protein, no spatial clustering of mutation sites was observed that would indicate the existence of disease-specific subdomains. A hydrogen bond between residues 128 and 178 provided a structural basis for the observed highly specific influence of a polymorphism at position 129 in human PRNP on the disease phenotype that segregates with the asp178-to-asn (D178N; 176640.0007) mutation. Overall, the NMR structure implied that only some of the disease-related amino acid replacements lead to reduced stability of the cellular form of PRNP, indicating that subtle structural differences in the mutant proteins may affect intermolecular signaling in a variety of different ways. Windl et al. (1999) searched for mutations and polymorphisms in the coding region of the PRNP gene in 578 patients with suspect prion diseases referred to the German Creutzfeldt-Jakob disease surveillance unit over a period of 4.5 years. They found 40 cases with a missense mutation previously reported as pathogenic. Among these, the D178N mutation was the most common. In all of these cases, D178N was coupled with methionine at codon 129, resulting in the typical fatal familial insomnia genotype. Two novel missense mutations and several silent polymorphisms were found. In their FIG. 1, Windl et al. (1999) diagrammed the known pathogenic mutations in the coding region of PRNP. Mead et al. (2001) analyzed the PRNP locus for tightly linked susceptibility factors for prion disease. They identified 56 polymorphic sites within 25 kb of the PRNP open reading frame, including sites within the PRNP promoter and the PRNP 3-prime untranslated region. These were characterized in 61 CEPH families, demonstrating extensive linkage disequilibrium around PRNP and the existence of 11 major European PRNP haplotypes. A common haplotype was overrepresented in patients with sporadic Creutzfeldt-Jakob disease. They could demonstrate that, in addition to the strong susceptibility conferred by codon 129, there was a significant independent association between sporadic CJD and a polymorphism upstream of PRNP. Although their sample size was necessarily small, no association was found between these polymorphisms and variant CJD or iatrogenic CJD, in keeping with their having distinct disease mechanisms. Cousens et al. (2001) described a cluster of variant CJD near the Leicestershire village of Queniborough in the U. K. Mead et al. (2001) could find no evidence of a PRNP founder susceptibility effect in that cluster. Animal model experiments lend further support to the function of PRNP. The incubation period and the neuropathology of transmissible spongiform encephalopathies have been extensively used to distinguish prion isolates (or strains) inoculated into panels of inbred mouse strains. Such studies have shown that the bovine spongiform encephalopathy (BSE) agent is indistinguishable from the agent causing variant Creutzfeldt-Jakob disease (vCJD), but differs from isolates of sporadic CJD, reinforcing the idea that the vCJD epidemic in Britain results from consumption of contaminated beef products. Manolakou et al. (2001) presented a mouse model for genetic and environmental factors that modify the incubation period of BSE cross-species transmission. They used 2 mouse strains that carried the same PrP allele, but displayed a 100-day difference in their mean incubation period following intracerebral inoculation with primary BSE isolate. They reported genetic effects on incubation period that map to 4 chromosomal regions in the mouse, and in addition they found significant factors of host environment, namely, the age of the host's mother, the age of the host at infection, and an interaction between the X chromosome and the cytoplasm in the host. Miele et al. (2002) identified 3 genes involved in mitochondrial physiology that were differentially expressed in the postnatal developing brains of normal mice and Prnp -/- mice. Further analysis showed that compared to the hippocampal CA1 regions of Prnp +/+ mice, those of Prnp -/- mice contained 40% fewer mitochondria, unusual mitochondrial morphology, and significantly increased activity of mitochondrial manganese-dependent antioxidant superoxide dismutase (SOD2; 147460), suggesting greater levels of oxidative assault. These results suggested that there is a relationship between normal cellular PrP expression and quality and quantity of mitochondria.

It is appreciated that the abovementioned animal model for PRNP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Miele, G.; Jeffrey, M.; Turnbull, D.; Manson, J.; Clinton, M.: Ablation of cellular prion protein expression affects mitochondrial numbers and morphology. Biochem. Biophys. Res. Commun. 291:372-377, 2002; and Cousens, J.; Smith, P. G.; Ward, H.; Everington, D.; Knight, R. S. G.; Zeidler, M.; Stewart, G.; Smith-Bathgate, E. A. B.; Macleod, M.-A.; Mackenzie, J.; Will, R. G.: Geographical dis.

Further studies establishing the function and utilities of PRNP are found in John Hopkins OMIM database record ID 176640, and in sited publications numbered 51-52, 3735, 55-73, 75, 76-78, 3736, 12642-12651, 1655, 12652-12659, 357, 12660-12664, 5469, 5619-5643, 5708, 5712-5718, 5720, 5721-5723, 35 and 5724-5727 listed in the bibliography section hereinbelow, which are also hereby incorporated by reference. Tripartite Motif-containing 9 (TRIM9, Accession NM_052978) is another VGAM669 host target gene. TRIM9 BINDING SITE is HOST TARGET binding site found in the 3' untranslated region of mRNA encoded by TRIM9, corresponding to a HOST TARGET binding site such as BINDING SITE I, BINDING SITE II or BINDING SITE III. Table 2 illustrates the complementarity of the nucleotide sequences of TRIM9 BINDING SITE, designated SEQ ID:27549, to the nucleotide sequence of VGAM669 RNA, herein designated VGAM RNA, also designated SEQ ID:3380.

Another function of VGAM669 is therefore inhibition of Tripartite Motif-containing 9 (TRIM9, Accession NM_052978), a gene which may function as a positive regulator for mannosylphosphate transferase and is required to mediate mannosylphosphate transfer in both the core and outer chain portions of n-linked. oligosaccharides. Accordingly, utilities of VGAM669 include diagnosis, prevention and treatment of diseases and clinical conditions associated with TRIM9. The function of TRIM9 and its association with various diseases and clinical conditions, has been established by previous studies, as described hereinabove with reference to VGAM74.pcnp (Accession NM_020357) is another VGAM669 host target gene. pcnp BINDING SITE is HOST TARGET binding site found in the 3' untranslated region of mRNA encoded by pcnp, corresponding to a HOST TARGET binding site such as BINDING SITE I, BINDING SITE II or BINDING SITE III. Table 2 illustrates the complementarity of the nucleotide sequences of pcnp BINDING SITE, designated SEQ ID:21627, to the nucleotide sequence of VGAM669 RNA, herein designated VGAM RNA, also designated SEQ ID:3380.

Another function of VGAM669 is therefore inhibition of pcnp (Accession NM_020357). Accordingly, utilities of VGAM669 include diagnosis, prevention and treatment of diseases and clinical conditions associated with pcnp. FIG. 1 further provides a conceptual description of a novel bioinformatically detected viral gene of the present invention, referred to here as Viral Genomic Address Messenger 670 (VGAM670) viral gene, which modulates expression of respective host target genes thereof, the function and utility of which host target genes is known in the art.

VGAM670 is a novel bioinformatically detected regulatory, non protein coding, viral micro RNA (miRNA) gene. The method by which VGAM670 was detected is described hereinabove with reference to FIGS. 1-8.

VGAM670 gene, herein designated VGAM GENE, is a viral gene contained in the genome of Yaba-like Disease Virus. VGAM670 host target gene, herein designated VGAM HOST TARGET GENE, is a human gene contained in the human genome.

VGAM670 gene encodes a VGAM670 precursor RNA, herein designated VGAM PRECURSOR RNA. Similar to other miRNA genes, and unlike most ordinary genes, VGAM670 precursor RNA does not encode a protein. A nucleotide sequence identical or highly similar to the nucleotide sequence of VGAM670 precursor RNA is designated SEQ ID:656, and is provided hereinbelow with reference to the sequence listing part. Nucleotide sequence SEQ ID:656 is located at position 116988 relative to the genome of Yaba-like Disease Virus.

VGAM670 precursor RNA folds onto itself, forming VGAM670 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM670 folded precursor RNA into VGAM670 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM670 RNA is designated SEQ ID:3381, and is provided hereinbelow with reference to the sequence listing part.

VGAM670 host target gene, herein designated VGAM HOST TARGET GENE, encodes a corresponding messenger RNA, VGAM670 host target RNA, herein designated VGAM HOST TARGET RNA. VGAM670 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM670 RNA, herein designated VGAM RNA, binds complementarily to one or more host target binding sites located in untranslated regions of VGAM670 host target RNA, herein designated VGAM HOST TARGET RNA. This complementary binding is due to the fact that the nucleotide sequence of VGAM670 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM670 RNA, herein designated VGAM RNA, may have a different number of host target binding sites in untranslated regions of a VGAM670 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM670 RNA, herein designated VGAM RNA, to host target binding sites on VGAM670 host target RNA, herein designated VGAM HOST TARGET RNA, such as BINDING SITE I, BINDING SITE II and BINDING SITE III, inhibits translation of VGAM670 host target RNA into VGAM670 host target protein, herein designated VGAM HOST TARGET PROTEIN. VGAM host target protein is therefore outlined by a broken line.

It is appreciated that VGAM670 host target gene, herein designated VGAM HOST TARGET GENE, in fact represents a plurality of VGAM670 host target genes. The mRNA of each one of this plurality of VGAM670 host target genes comprises one or more host target binding sites, each having a nucleotide sequence which is at least partly complementary to VGAM670 RNA, herein designated VGAM RNA, and which when bound by VGAM670 RNA causes inhibition of translation of respective one or more VGAM670 host target proteins.

It is further appreciated by one skilled in the art that the mode of translational inhibition illustrated by FIG. 1 with specific reference to translational inhibition exerted by VGAM670 gene, herein designated VGAM GENE, on one or more VGAM670 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM670 is inhibition of expression of host target genes, as part of a novel viral mechanism of attacking a host. Accordingly, utilities of VGAM670 include diagnosis, prevention and treatment of viral infection by Yaba-like Disease Virus. Specific functions, and accordingly utilities, of VGAM670 correlate with, and may be deduced from, the identity of the host target genes which VGAM670 binds and inhibits, and the function of these target genes, as elaborated hereinbelow.

Nucleotide sequences of the VGAM670 precursor RNA, herein designated VGAM PRECURSOR RNA, and of the 'diced' VGAM670 RNA, herein designated VGAM RNA, and a schematic representation of the secondary folding of VGAM670 folded precursor RNA, herein designated VGAM FOLDED PRECURSOR RNA, of VGAM670 are further described hereinbelow with reference to Table 1.

Nucleotide sequences of host target binding sites, such as BINDING SITE-I, BINDING SITE-II and BINDING SITE-III of FIG. 1, found on VGAM670 host target RNA, and schematic representation of the complementarity of each of these host target binding sites to VGAM670 RNA, herein designated VGAM RNA, are described hereinbelow with reference to Table 2.

As mentioned hereinabove with reference to FIG. 1, a function of VGAM670 gene, herein designated VGAM is inhibition of expression of VGAM670 target genes. It is appreciated that specific functions, and accordingly utilities, of VGAM670 correlate with, and may be deduced from, the identity of the target genes which VGAM670 binds and inhibits, and the function of these target genes, as elaborated hereinbelow.

Aldo-keto Reductase Family 1, Member D1 (delta 4-3-ketosteroid-5-beta-reductase) (AKR1D1, Accession NM_005989) is a VGAM670 host target gene. AKR1D1 BINDING SITE is HOST TARGET binding site found in the 3' untranslated region of mRNA encoded by AKR1D1, corresponding to a HOST TARGET binding site such as BINDING SITE I, BINDING SITE II or BINDING SITE III. Table 2 illustrates the complementarity of the nucleotide sequences of AKR1D1 BINDING SITE, designated SEQ ID:12610, to the nucleotide sequence of VGAM670 RNA, herein designated VGAM RNA, also designated SEQ ID:3381.

A function of VGAM670 is therefore inhibition of Aldo-keto Reductase Family 1, Member D1 (delta 4-3-ketosteroid-5-beta-reductase) (AKR1D1, Accession NM_005989). Accordingly, utilities of VGAM670 include diagnosis, prevention and treatment of diseases and clinical conditions associated with AKR1D1. Reserved (C8orf13, Accession XM_088377) is another VGAM670 host target gene. C8orf13 BINDING SITE is HOST TARGET binding site found in the 3' untranslated region of mRNA encoded by C8orf13, corresponding to a HOST TARGET binding site such as BINDING SITE I, BINDING SITE II or BINDING SITE III. Table 2 illustrates the complementarity of the nucleotide sequences of C8orf13 BINDING SITE, designated SEQ ID:39653, to the nucleotide sequence of VGAM670 RNA, herein designated VGAM RNA, also designated SEQ ID:3381.

Another function of VGAM670 is therefore inhibition of Reserved (C8orf13, Accession XM_088377). Accordingly, utilities of VGAM670 include diagnosis, prevention and treatment of diseases and clinical conditions associated with C8orf13. CED-6 (Accession NM_016315) is another VGAM670 host target gene. CED-6 BINDING SITE is HOST TARGET binding site found in the 3' untranslated region of mRNA encoded by CED-6, corresponding to a HOST TARGET binding site such as BINDING SITE I, BINDING SITE II or BINDING SITE III. Table 2 illustrates the complementarity of the nucleotide sequences of CED-6 BINDING SITE, designated SEQ ID:18431, to the nucleotide sequence of VGAM670 RNA, herein designated VGAM RNA, also designated SEQ ID:3381.

Another function of VGAM670 is therefore inhibition of CED-6 (Accession NM_016315). Accordingly, utilities of VGAM670 include diagnosis, prevention and treatment of diseases and clinical conditions associated with CED-6. FIG. 1 further provides a conceptual description of a novel bioinformatically detected viral gene of the present invention, referred to here as Viral Genomic Address Messenger 671 (VGAM671) viral gene, which modulates expression of respective host target genes thereof, the function and utility of which host target genes is known in the art.

VGAM671 is a novel bioinformatically detected regulatory, non protein coding, viral micro RNA (miRNA) gene. The method by which VGAM671 was detected is described hereinabove with reference to FIGS. 1-8.

VGAM671 gene, herein designated VGAM GENE, is a viral gene contained in the genome of Yaba-like Disease Virus. VGAM671 host target gene, herein designated VGAM HOST TARGET GENE, is a human gene contained in the human genome.

VGAM671 gene encodes a VGAM671 precursor RNA, herein designated VGAM PRECURSOR RNA. Similar to other miRNA genes, and unlike most ordinary genes, VGAM671 precursor RNA does not encode a protein. A nucleotide sequence identical or highly similar to the nucleotide sequence of VGAM671 precursor RNA is designated SEQ ID:657, and is provided hereinbelow with reference to the sequence listing part. Nucleotide sequence SEQ ID:657 is located at position 134323 relative to the genome of Yaba-like Disease Virus.

VGAM671 precursor RNA folds onto itself, forming VGAM671 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM671 folded precursor RNA into VGAM671 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 85%) nucleotide sequence of VGAM671 RNA is designated SEQ ID:3382, and is provided hereinbelow with reference to the sequence listing part.

VGAM671 host target gene, herein designated VGAM HOST TARGET GENE, encodes a corresponding messenger RNA, VGAM671 host target RNA, herein designated VGAM HOST TARGET RNA. VGAM671 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM671 RNA, herein designated VGAM RNA, binds complementarily to one or more host target binding sites located in untranslated regions of VGAM671 host target RNA, herein designated VGAM HOST TARGET RNA. This complementary binding is due to the fact that the nucleotide sequence of VGAM671 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM671 RNA, herein designated VGAM RNA, may have a different number of host target binding sites in untranslated regions of a VGAM671 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM671 RNA, herein designated VGAM RNA, to host target binding sites on VGAM671 host target RNA, herein designated VGAM HOST TARGET RNA, such as BINDING SITE I, BINDING SITE II and BINDING SITE III, inhibits translation of VGAM671 host target RNA into VGAM671 host target protein, herein designated VGAM HOST TARGET PROTEIN. VGAM host target protein is therefore outlined by a broken line.

It is appreciated that VGAM671 host target gene, herein designated VGAM HOST TARGET GENE, in fact represents a plurality of VGAM671 host target genes. The mRNA of each one of this plurality of VGAM671 host target genes comprises one or more host target binding sites, each having a nucleotide sequence which is at least partly complementary to VGAM671 RNA, herein designated VGAM RNA, and which when bound by VGAM671 RNA causes inhibition of translation of respective one or more VGAM671 host target proteins.

It is further appreciated by one skilled in the art that the mode of translational inhibition illustrated by FIG. 1 with specific reference to translational inhibition exerted by VGAM671 gene, herein designated VGAM GENE, on one or more VGAM671 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM671 is inhibition of expression of host target genes, as part of a novel viral mechanism of attacking a host. Accordingly, utilities of VGAM671 include diagnosis, prevention and treatment of viral infection by Yaba-like Disease Virus. Specific functions, and accordingly utilities, of VGAM671 correlate with, and may be deduced from, the identity of the host target genes which VGAM671 binds and inhibits, and the function of these host target genes, as elaborated hereinbelow.

Nucleotide sequences of the VGAM671 precursor RNA, herein designated VGAM PRECURSOR RNA, and of the 'diced' VGAM671 RNA, herein designated VGAM RNA, and a schematic representation of the secondary folding of VGAM671 folded precursor RNA, herein designated VGAM FOLDED PRECURSOR RNA, of VGAM671 are further described hereinbelow with reference to Table 1.

Nucleotide sequences of host target binding sites, such as BINDING SITE-I, BINDING SITE-II and BINDING SITE-III of FIG. 1, found on VGAM671 host target RNA, and schematic representation of the complementarity of each of these host target binding sites to VGAM671 RNA, herein designated VGAM RNA, are described hereinbelow with reference to Table 2.

As mentioned hereinabove with reference to FIG. 1, a function of VGAM671 gene, herein designated VGAM is inhibition of expression of VGAM671 target genes. It is appreciated that specific functions, and accordingly utilities, of VGAM671 correlate with, and may be deduced from, the identity of the target genes which VGAM671 binds and inhibits, and the function of these target genes, as elaborated hereinbelow.

Syntaxin 7 (STX7, Accession NM_003569) is a VGAM671 host target gene. STX7 BINDING SITE is HOST TARGET binding site found in the 3' untranslated region of mRNA encoded by STX7, corresponding to a HOST TARGET binding site such as BINDING SITE I, BINDING SITE II or BINDING SITE III. Table 2 illustrates the complementarity of the nucleotide sequences of STX7 BINDING SITE, designated SEQ ID:9624, to the nucleotide sequence of VGAM671 RNA, herein designated VGAM RNA, also designated SEQ ID:3382.

A function of VGAM671 is therefore inhibition of Syntaxin 7 (STX7, Accession NM_003569). Accordingly, utilities of VGAM671 include diagnosis, prevention and treatment of diseases and clinical conditions associated with STX7. FIG. 1 further provides a conceptual description of a novel bioinformatically detected viral gene of the present invention, referred to here as Viral Genomic Address Messenger 672 (VGAM672) viral gene, which modulates expression of respective host target genes thereof, the function and utility of which host target genes is known in the art.

VGAM672 is a novel bioinformatically detected regulatory, non protein coding, viral micro RNA (miRNA) gene. The method by which VGAM672 was detected is described hereinabove with reference to FIGS. 1-8.

VGAM672 gene, herein designated VGAM GENE, is a viral gene contained in the genome of Yaba-like Disease Virus. VGAM672 host target gene, herein designated VGAM HOST TARGET GENE, is a human gene contained in the human genome.

VGAM672 gene encodes a VGAM672 precursor RNA, herein designated VGAM PRECURSOR RNA. Similar to other miRNA genes, and unlike most ordinary genes, VGAM672 precursor RNA does not encode a protein. A nucleotide sequence identical or highly similar to the nucleotide sequence of VGAM672 precursor RNA is designated SEQ ID:658, and is provided hereinbelow with reference to the sequence listing part. Nucleotide sequence SEQ ID:658 is located at position 134123 relative to the genome of Yaba-like Disease Virus.

VGAM672 precursor RNA folds onto itself, forming VGAM672 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM672 folded precursor RNA into VGAM672 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM672 RNA is designated SEQ ID:3383, and is provided hereinbelow with reference to the sequence listing part.

VGAM672 host target gene, herein designated VGAM HOST TARGET GENE, encodes a corresponding messenger RNA, VGAM672 host target RNA, herein designated VGAM HOST TARGET RNA. VGAM672 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM672 RNA, herein designated VGAM RNA, binds complementarily to one or more host target binding sites located in untranslated regions of VGAM672 host target RNA, herein designated VGAM HOST TARGET RNA. This complementary binding is due to the fact that the nucleotide sequence of VGAM672 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM672 RNA, herein designated VGAM RNA, may have a different number of host target binding sites in untranslated regions of a VGAM672 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM672 RNA, herein designated VGAM RNA, to host target binding sites on VGAM672 host target RNA, herein designated VGAM HOST TARGET RNA, such as BINDING SITE I, BINDING SITE II and BINDING SITE III, inhibits translation of VGAM672 host target RNA into VGAM672 host target protein, herein designated VGAM HOST TARGET PROTEIN. VGAM host target protein is therefore outlined by a broken line.

It is appreciated that VGAM672 host target gene, herein designated VGAM HOST TARGET GENE, in fact represents a plurality of VGAM672 host target genes. The mRNA of each one of this plurality of VGAM672 host target genes comprises one or more host target binding sites, each having a nucleotide sequence which is at least partly complementary to VGAM672 RNA, herein designated VGAM RNA, and which when bound by VGAM672 RNA causes inhibition of translation of respective one or more VGAM672 host target proteins.

It is further appreciated by one skilled in the art that the mode of translational inhibition illustrated by FIG. 1 with specific reference to translational inhibition exerted by VGAM672 gene, herein designated VGAM GENE, on one or more VGAM672 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM672 is inhibition of expression of host target genes, as part of a novel viral mechanism of attacking a host. Accordingly, utilities of VGAM672 include diagnosis, prevention and treatment of viral infection by Yaba-like Disease Virus. Specific functions, and accordingly utilities, of VGAM672 correlate with, and may be deduced from, the identity of the host target genes which VGAM672 binds and inhibits, and the function of these host target genes, as elaborated hereinbelow.

Nucleotide sequences of the VGAM672 precursor RNA, herein designated VGAM PRECURSOR RNA, and of the 'diced' VGAM672 RNA, herein designated VGAM RNA, and a schematic representation of the secondary folding of VGAM672 folded precursor RNA, herein designated VGAM FOLDED PRECURSOR RNA, of VGAM672 are further described hereinbelow with reference to Table 1.

Nucleotide sequences of host target binding sites, such as BINDING SITE-I, BINDING SITE-II and BINDING SITE-III of FIG. 1, found on VGAM672 host target RNA, and schematic representation of the complementarity of each of these host target binding sites to VGAM672 RNA, herein designated VGAM RNA, are described hereinbelow with reference to Table 2.

As mentioned hereinabove with reference to FIG. 1, a function of VGAM672 gene, herein designated VGAM is inhibition of expression of VGAM672 target genes. It is appreciated that specific functions, and accordingly utilities, of VGAM672 correlate with, and may be deduced from, the identity of the target genes which VGAM672 binds and inhibits, and the function of these target genes, as elaborated hereinbelow.

SH2 Domain Containing Phosphatase Anchor Protein 1 (SPAP1, Accession NM_030764) is a VGAM672 host target gene. SPAP1 BINDING SITE is HOST TARGET binding site found in the 3' untranslated region of mRNA encoded by SPAP1, corresponding to a HOST TARGET binding site such as BINDING SITE I, BINDING SITE II or BINDING SITE III. Table 2 illustrates the complementarity of the nucleotide sequences of SPAP1 BINDING SITE, designated SEQ ID:25046, to the nucleotide sequence of VGAM672 RNA, herein designated VGAM RNA, also designated SEQ ID:3383.

A function of VGAM672 is therefore inhibition of SH2 Domain Containing Phosphatase Anchor Protein 1 (SPAP1, Accession NM_030764), a gene which regulation of immunologic function. Accordingly, utilities of VGAM672 include diagnosis, prevention and treatment of diseases and clinical conditions associated with SPAP1. The function of SPAP1 has been established by previous studies. Davis et al. (2001) identified 2 BAC clones located at chromosome 1q21.1-q22. They found that one of these clones contained 3 novel putative Ig superfamily genes, which they designated FCRH1 (OMIM Ref. No. 606508), FCRH2, and FCRH3 (OMIM Ref. No. 606510), as well as 2 previously identified members of this family, FCRH4 (IRTA1; 605876) and FCRH5 (IRTA2; 605877). Sequence analysis predicted that the 508-amino acid type I transmembrane protein possesses a hydrophobic signal peptide, 4 extracellular C2 type Ig-like domains, 5 N-linked glycosylation sites, an uncharged transmembrane segment, and an 86-amino acid cytoplasmic tail with 1 ITAM (immunoreceptor tyrosine-based activation motif) and 2 ITIMs. Northern blot analysis revealed expression of approximately 3.0-, 4.4- and 5.5-kb transcripts chiefly in spleen and lymph nodes and a 2.4-kb transcript in kidney. RT-PCR analysis detected expression in mature B-cell lines. Davis et al. (2001) suggested that FCRH2 may have an activating/inhibitory or a fine-tuning role in regulation of immunologic function Full details of the abovementioned studies are described in the following publications, the disclosure of which are hereby incorporated by reference:

Davis, R. S.; Wang, Y.-H.; Kubagawa, H.; Cooper, M. D.: Identification of a family of Fc receptor homologs with preferential B cell expression. Proc. Nat. Acad. Sci. 98:9772-9777, 2001; and Xu, M.; Zhao, R.; Zhao, Z. J.: Molecular cloning and characterization of SPAP1, an inhibitory receptor. Biochem. Biophys. Res. Commun. 280:768-775, 2001.

Further studies establishing the function and utilities of SPAP1 are found in John Hopkins OMIM database record ID 606509, and in sited publications numbered 6106-6107 listed in the bibliography section hereinbelow, which are also hereby incorporated by reference. FENS-1 (Accession NM_020830) is another VGAM672 host target gene. FENS-1 BINDING SITE is HOST TARGET binding site found in the 3' untranslated region of mRNA encoded by FENS-1, corresponding to a HOST TARGET binding site such as BINDING SITE I, BINDING SITE II or BINDING SITE III. Table 2 illustrates the complementarity of the nucleotide sequences of FENS-1 BINDING SITE, designated SEQ ID:21891, to the nucleotide sequence of VGAM672 RNA, herein designated VGAM RNA, also designated SEQ ID:3383.

Another function of VGAM672 is therefore inhibition of FENS-1 (Accession NM_020830). Accordingly, utilities of VGAM672 include diagnosis, prevention and treatment of diseases and clinical conditions associated with FENS-1. FLJ20689 (Accession NM_017972) is another VGAM672 host target gene. FLJ20689 BINDING SITE1 and FLJ20689 BINDING SITE2 are HOST TARGET binding sites found in untranslated regions of mRNA encoded by FLJ20689, corresponding to HOST TARGET binding sites such as BINDING SITE I, BINDING SITE II or BINDING SITE III. Table 2 illustrates the complementarity of the nucleotide sequences of FLJ20689 BINDING SITE1 and FLJ20689 BINDING SITE2, designated SEQ ID:19703 and SEQ ID:19599 respectively, to the nucleotide sequence of VGAM672 RNA, herein designated VGAM RNA, also designated SEQ ID:3383.

Another function of VGAM672 is therefore inhibition of FLJ20689 (Accession NM_017972). Accordingly, utilities of VGAM672 include diagnosis, prevention and treatment of diseases and clinical conditions associated with FLJ20689. FIG. 1 further provides a conceptual description of a novel bioinformatically detected viral gene of the present invention, referred to here as Viral Genomic Address Messenger 674 (VGAM674) viral gene, which modulates expression of respective host target genes thereof, the function and utility of which host target genes is known in the art.

VGAM674 is a novel bioinformatically detected regulatory, non protein coding, viral micro RNA (miRNA) gene. The method by which VGAM674 was detected is described hereinabove with reference to FIGS. 1-8.

VGAM674 gene, herein designated VGAM GENE, is a viral gene contained in the genome of Human Coronavirus 229E. VGAM674 host target gene, herein designated VGAM HOST TARGET GENE, is a human gene contained in the human genome.

VGAM674 gene encodes a VGAM674 precursor RNA, herein designated VGAM PRECURSOR RNA. Similar to other miRNA genes, and unlike most ordinary genes, VGAM674 precursor RNA does not encode a protein. A nucleotide sequence identical or highly similar to the nucleotide sequence of VGAM674 precursor RNA is designated SEQ ID:660, and is provided hereinbelow with reference to the sequence listing part. Nucleotide sequence SEQ ID:660 is located at position 10541 relative to the genome of Human Coronavirus 229E.

VGAM674 precursor RNA folds onto itself, forming VGAM674 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM674 folded precursor RNA into VGAM674 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM674 RNA is designated SEQ ID:3385, and is provided hereinbelow with reference to the sequence listing part.

VGAM674 host target gene, herein designated VGAM HOST TARGET GENE, encodes a corresponding messenger RNA, VGAM674 host target RNA, herein designated VGAM HOST TARGET RNA. VGAM674 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM674 RNA, herein designated VGAM RNA, binds complementarily to one or more host target binding sites located in untranslated regions of VGAM674 host target RNA, herein designated VGAM HOST TARGET RNA. This complementary binding is due to the fact that the nucleotide sequence of VGAM674 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM674 RNA, herein designated VGAM RNA, may have a different number of host target binding sites in untranslated regions of a VGAM674 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM674 RNA, herein designated VGAM RNA, to host target binding sites on VGAM674 host target RNA, herein designated VGAM HOST TARGET RNA, such as BINDING SITE I, BINDING SITE II and BINDING SITE III, inhibits translation of VGAM674 host target RNA into VGAM674 host target protein, herein designated VGAM HOST TARGET PROTEIN. VGAM host target protein is therefore outlined by a broken line.

It is appreciated that VGAM674 host target gene, herein designated VGAM HOST TARGET GENE, in fact represents a plurality of VGAM674 host target genes. The mRNA of each one of this plurality of VGAM674 host target genes comprises one or more host target binding sites, each having a nucleotide sequence which is at least partly complementary to VGAM674 RNA, herein designated VGAM RNA, and which when bound by VGAM674 RNA causes inhibition of translation of respective one or more VGAM674 host target proteins.

It is further appreciated by one skilled in the art that the mode of translational inhibition illustrated by FIG. 1 with specific reference to translational inhibition exerted by VGAM674 gene, herein designated VGAM GENE, on one or more VGAM674 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM674 is inhibition of expression of host target genes, as part of a novel viral mechanism of attacking a host. Accordingly, utilities of VGAM674 include diagnosis, prevention and treatment of viral infection by Human Coronavirus 229E. Specific functions, and accordingly utilities, of VGAM674 correlate with, and may be deduced from, the identity of the host target genes which VGAM674 binds and inhibits, and the function of these host target genes, as elaborated hereinbelow.

Nucleotide sequences of the VGAM674 precursor RNA, herein designated VGAM PRECURSOR RNA, and of the 'diced' VGAM674 RNA, herein designated VGAM RNA, and a schematic representation of the secondary folding of VGAM674 folded precursor RNA, herein designated VGAM FOLDED PRECURSOR RNA, of VGAM674 are further described hereinbelow with reference to Table 1.

Nucleotide sequences of host target binding sites, such as BINDING SITE-I, BINDING SITE-II and BINDING SITE-III of FIG. 1, found on VGAM674 host target RNA, and schematic representation of the complementarity of each of these host target binding sites to VGAM674 RNA, herein designated VGAM RNA, are described hereinbelow with reference to Table 2.

As mentioned hereinabove with reference to FIG. 1, a function of VGAM674 gene, herein designated VGAM is inhibition of expression of VGAM674 target genes. It is appreciated that specific functions, and accordingly utilities, of VGAM674 correlate with, and may be deduced from, the identity of the target genes which VGAM674 binds and inhibits, and the function of these target genes, as elaborated hereinbelow.

Diacylglycerol Kinase, Beta 90 kDa (DGKB, Accession XM_166516) is a VGAM674 host target gene. DGKB BINDING SITE is HOST TARGET binding site found in the 3' untranslated region of mRNA encoded by DGKB, corresponding to a HOST TARGET binding site such as BINDING SITE I, BINDING SITE II or BINDING SITE III. Table 2 illustrates the complementarity of the nucleotide sequences of DGKB BINDING SITE, designated SEQ ID:44450, to the nucleotide sequence of VGAM674 RNA, herein designated VGAM RNA, also designated SEQ ID:3385.

A function of VGAM674 is therefore inhibition of Diacylglycerol Kinase, Beta 90 kDa (DGKB, Accession XM_166516), a gene which regulates the intracellular concentration of the second messenger diacylglycerol (DAG). Accordingly, utilities of VGAM674 include diagnosis, prevention and treatment of diseases and clinical conditions associated with DGKB. The function of DGKB and its association with various diseases and clinical conditions, has been established by previous studies, as described hereinabove with reference to VGAM497. Hepatocyte Growth Factor (hepapoietin A; scatter factor) (HGF, Accession XM_168542) is another VGAM674 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45226, to the nucleotide sequence of VGAM674 RNA, herein designated VGAM RNA, also designated SEQ ID:3385.

Another function of VGAM674 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM674 include diagnosis, prevention and treatment of diseases and clinical conditions associated with HGF. The function of HGF and its association with various diseases and clinical conditions, has been established by previous studies, as described hereinabove with reference to VGAM174. Zinc Finger Protein 192 (ZNF192, Accession NM_006298) is another VGAM674 host target gene. ZNF192 BINDING SITE is HOST TARGET binding site found in the 3' untranslated region of mRNA encoded by ZNF192, corresponding to a HOST TARGET binding site such as BINDING SITE I, BINDING SITE II or BINDING SITE III. Table 2 illustrates the complementarity of the nucleotide sequences of ZNF192 BINDING SITE, designated SEQ ID:12991, to the nucleotide sequence of VGAM674 RNA, herein designated VGAM RNA, also designated SEQ ID:3385.

Another function of VGAM674 is therefore inhibition of Zinc Finger Protein 192 (ZNF192, Accession NM_006298). Accordingly, utilities of VGAM674 include diagnosis, prevention and treatment of diseases and clinical conditions associated with ZNF192. DKFZP434G1411 (Accession XM_166383) is another VGAM674 host target gene. DKFZP434G1411 BINDING SITE is HOST TARGET binding site found in the 3' untranslated region of mRNA encoded by DKFZP434G1411, corresponding to a HOST TARGET binding site such as BINDING SITE I, BINDING SITE II or BINDING SITE III. Table 2 illustrates the complementarity of the nucleotide sequences of DKFZP434G1411 BINDING SITE, designated SEQ ID:44229, to the nucleotide sequence of VGAM674 RNA, herein designated VGAM RNA, also designated SEQ ID:3385.

Another function of VGAM674 is therefore inhibition of DKFZP434G1411 (Accession XM_166383). Accordingly, utilities of VGAM674 include diagnosis, prevention and treatment of diseases and clinical conditions associated with DKFZP434G1411. DKFZP762D096 (Accession XM_037662) is another VGAM674 host target gene. DKFZP762D096 BINDING SITE is HOST TARGET binding site found in the 3' untranslated region of mRNA encoded by DKFZP762D096, corresponding to a HOST TARGET binding site such as BINDING SITE I, BINDING SITE II or BINDING SITE III. Table 2 illustrates the complementarity of the nucleotide sequences of DKFZP762D096 BINDING SITE, designated SEQ ID:32664, to the nucleotide sequence of VGAM674 RNA, herein designated VGAM RNA, also designated SEQ ID:3385.

Another function of VGAM674 is therefore inhibition of DKFZP762D096 (Accession XM_037662). Accordingly, utilities of VGAM674 include diagnosis, prevention and treatment of diseases and clinical conditions associated with DKFZP762D096. N4BP3 (Accession XM_038920) is another VGAM674 host target gene. N4BP3 BINDING SITE is HOST TARGET binding site found in the 3' untranslated region of mRNA encoded by N4BP3, corresponding to a HOST TARGET binding site such as BINDING SITE I, BINDING SITE II or BINDING SITE III. Table 2 illustrates the complementarity of the nucleotide sequences of N4BP3 BINDING SITE, designated SEQ ID:32943, to the nucleotide sequence of VGAM674 RNA, herein designated VGAM RNA, also designated SEQ ID:3385.

Another function of VGAM674 is therefore inhibition of N4BP3 (Accession XM_038920). Accordingly, utilities of VGAM674 include diagnosis, prevention and treatment of diseases and clinical conditions associated with N4BP3. LOC134637 (Accession XM_059727) is another VGAM674 host target gene. LOC134637 BINDING SITE is HOST TARGET binding site found in the 3' untranslated region of mRNA encoded by LOC134637, corresponding to a HOST TARGET binding site such as BINDING SITE I, BINDING SITE II or BINDING SITE III. Table 2 illustrates the complementarity of the nucleotide sequences of LOC134637 BINDING SITE, designated SEQ ID:37079, to the nucleotide sequence of VGAM674 RNA, herein designated VGAM RNA, also designated SEQ ID:3385.

Another function of VGAM674 is therefore inhibition of LOC134637 (Accession XM_059727). Accordingly, utilities of VGAM674 include diagnosis, prevention and treatment of diseases and clinical conditions associated with LOC134637. LOC147622 (Accession XM_097255) is another VGAM674 host target gene. LOC147622 BINDING SITE is HOST TARGET binding site found in the 5' untranslated region of mRNA encoded by LOC147622, corresponding to a HOST TARGET binding site such as BINDING SITE I, BINDING SITE II or BINDING SITE III. Table 2 illustrates the complementarity of the nucleotide sequences of LOC147622 BINDING SITE, designated SEQ ID:40850, to the nucleotide sequence of VGAM674 RNA, herein designated VGAM RNA, also designated SEQ ID:3385.

Another function of VGAM674 is therefore inhibition of LOC147622 (Accession XM_097255). Accordingly, utilities of VGAM674 include diagnosis, prevention and treatment of diseases and clinical conditions associated with LOC147622. LOC151361 (Accession XM_098048) is another VGAM674 host target gene. LOC151361 BINDING SITE is HOST TARGET binding site found in the 5' untranslated region of mRNA encoded by LOC151361, corresponding to a HOST TARGET binding site such as BINDING SITE I, BINDING SITE II or BINDING SITE III. Table 2 illustrates the complementarity of the nucleotide sequences of LOC151361 BINDING SITE, designated SEQ ID:41332, to the nucleotide sequence of VGAM674 RNA, herein designated VGAM RNA, also designated SEQ ID:3385.

Another function of VGAM674 is therefore inhibition of LOC151361 (Accession XM_098048). Accordingly, utilities of VGAM674 include diagnosis, prevention and treatment of diseases and clinical conditions associated with LOC151361. LOC152263 (Accession XM_098195) is another VGAM674 host target gene. LOC152263 BINDING SITE is HOST TARGET binding site found in the 3' untranslated region of mRNA encoded by LOC152263, corresponding to a HOST TARGET binding site such as BINDING SITE I, BINDING SITE II or BINDING SITE III. Table 2 illustrates the complementarity of the nucleotide sequences of LOC152263 BINDING SITE, designated SEQ ID:41483, to the nucleotide sequence of VGAM674 RNA, herein designated VGAM RNA, also designated SEQ ID:3385.

Another function of VGAM674 is therefore inhibition of LOC152263 (Accession XM_098195). Accordingly, utilities of VGAM674 include diagnosis, prevention and treatment of diseases and clinical conditions associated with LOC152263. LOC51580 (Accession NM_015874) is another VGAM674 host target gene. LOC51580 BINDING SITE is HOST TARGET binding site found in the 3' untranslated region of mRNA encoded by LOC51580, corresponding to a HOST TARGET binding site such as BINDING SITE I, BINDING SITE II or BINDING SITE III. Table 2 illustrates the complementarity of the nucleotide sequences of LOC51580 BINDING SITE, designated SEQ ID:18018, to the nucleotide sequence of VGAM674 RNA, herein designated VGAM RNA, also designated SEQ ID:3385.

Another function of VGAM674 is therefore inhibition of LOC51580 (Accession NM_015874). Accordingly, utilities of VGAM674 include diagnosis, prevention and treatment of diseases and clinical conditions associated with LOC51580.

FIG. 1 further provides a conceptual description of a novel bioinformatically detected viral gene of the present invention, referred to here as Viral Genomic Address Messenger 675 (VGAM675) viral gene, which modulates expression of respective host target genes thereof, the function and utility of which host target genes is known in the art.

VGAM675 is a novel bioinformatically detected regulatory, non protein coding, viral micro RNA (miRNA) gene. The method by which VGAM675 was detected is described hereinabove with reference to FIGS. 1-8.

VGAM675 gene, herein designated VGAM GENE, is a viral gene contained in the genome of Human Coronavirus 229E. VGAM675 host target gene, herein designated VGAM HOST TARGET GENE, is a human gene contained in the human genome.

VGAM675 gene encodes a VGAM675 precursor RNA, herein designated VGAM PRECURSOR RNA. Similar to other miRNA genes, and unlike most ordinary genes, VGAM675 precursor RNA does not encode a protein. A nucleotide sequence identical or highly similar to the nucleotide sequence of VGAM675 precursor RNA is designated SEQ ID:661, and is provided hereinbelow with reference to the sequence listing part. Nucleotide sequence SEQ ID:661 is located at position 12342 relative to the genome of Human Coronavirus 229E.

VGAM675 precursor RNA folds onto itself, forming VGAM675 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM675 folded precursor RNA into VGAM675 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM675 RNA is designated SEQ ID:3386, and is provided hereinbelow with reference to the sequence listing part.

VGAM675 host target gene, herein designated VGAM HOST TARGET GENE, encodes a corresponding messenger RNA, VGAM675 host target RNA, herein designated VGAM HOST TARGET RNA. VGAM675 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM675 RNA, herein designated VGAM RNA, binds complementarily to one or more host target binding sites located in untranslated regions of VGAM675 host target RNA, herein designated VGAM HOST TARGET RNA. This complementary binding is due to the fact that the nucleotide sequence of VGAM675 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM675 RNA, herein designated VGAM RNA, may have a different number of host target binding sites in untranslated regions of a VGAM675 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM675 RNA, herein designated VGAM RNA, to host target binding sites on VGAM675 host target RNA, herein designated VGAM HOST TARGET RNA, such as BINDING SITE I, BINDING SITE II and BINDING SITE III, inhibits translation of VGAM675 host target RNA into VGAM675 host target protein, herein designated VGAM HOST TARGET PROTEIN. VGAM host target protein is therefore outlined by a broken line.

It is appreciated that VGAM675 host target gene, herein designated VGAM HOST TARGET GENE, in fact represents a plurality of VGAM675 host target genes. The mRNA of each one of this plurality of VGAM675 host target genes comprises one or more host target binding sites, each having a nucleotide sequence which is at least partly complementary to VGAM675 RNA, herein designated VGAM RNA, and which when bound by VGAM675 RNA causes inhibition of translation of respective one or more VGAM675 host target proteins.

It is further appreciated by one skilled in the art that the mode of translational inhibition illustrated by FIG. 1 with specific reference to translational inhibition exerted by VGAM675 gene, herein designated VGAM GENE, on one or more VGAM675 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM675 is inhibition of expression of host target genes, as part of a novel viral mechanism of attacking a host. Accordingly, utilities of VGAM675 include diagnosis, prevention and treatment of viral infection by Human Coronavirus 229E. Specific functions, and accordingly utilities, of VGAM675 correlate with, and may be deduced from, the identity of the host target genes which VGAM675 binds and inhibits, and the function of these host target genes, as elaborated hereinbelow.

Nucleotide sequences of the VGAM675 precursor RNA, herein designated VGAM PRECURSOR RNA, and of the 'diced' VGAM675 RNA, herein designated VGAM RNA, and a schematic representation of the secondary folding of VGAM675 folded precursor RNA, herein designated VGAM FOLDED PRECURSOR RNA, of VGAM675 are further described hereinbelow with reference to Table 1.

Nucleotide sequences of host target binding sites, such as BINDING SITE-I, BINDING SITE-II and BINDING SITE-III of FIG. 1, found on VGAM675 host target RNA, and schematic representation of the complementarity of each of these host target binding sites to VGAM675 RNA, herein designated VGAM RNA, are described hereinbelow with reference to Table 2.

As mentioned hereinabove with reference to FIG. 1, a function of VGAM675 gene, herein designated VGAM is inhibition of expression of VGAM675 target genes. It is appreciated that specific functions, and accordingly utilities, of VGAM675 correlate with, and may be deduced from, the identity of the target genes which VGAM675 binds and inhibits, and the function of these target genes, as elaborated hereinbelow.

A Disintegrin and Metalloproteinase Domain 12 (meltrin alpha) (ADAM12, Accession NM_003474) is a VGAM675 host target gene. ADAM12 BINDING SITE is HOST TARGET binding site found in the 3' untranslated region of mRNA encoded by ADAM12, corresponding to a HOST TARGET binding site such as BINDING SITE I, BINDING SITE II or BINDING SITE III. Table 2 illustrates the complementarity of the nucleotide sequences of ADAM12 BINDING SITE, designated SEQ ID:9543, to the nucleotide sequence of VGAM675 RNA, herein designated VGAM RNA, also designated SEQ ID:3386.

A function of VGAM675 is therefore inhibition of A Disintegrin and Metalloproteinase Domain 12 (meltrin alpha) (ADAM12, Accession NM_003474), a gene which involved in skeletal muscle regeneration, specifically at the onset of cell fusion. Accordingly, utilities of VGAM675 include diagnosis, prevention and treatment of diseases and clinical conditions associated with ADAM12. The function of ADAM12 has been established by previous studies. To isolate genes related to fertilin expressed in muscle, Yagami-Hiromasa et al. (1995) amplified cDNAs prepared from a mouse myogenic cell line by PCR using degenerative primers for conserved amino acids between fertilin-alpha and -beta (OMIM Ref. No. 601533). They identified 3 novel mouse sequences, which they called meltrins. Similarly to myogenin, a marker of early muscle differentiation, mouse meltrin-alpha is expressed in neonatal muscle and bone, and its expression increases dramatically in response to the induction of differentiation. Immunocytochemical localization and functional expression studies suggested that meltrin-alpha may be involved in myotube formation. Galliano et al. (2000) found by RT-PCR and immunoblot analyses that expression of mouse Adam12 increases during muscle regeneration, while the levels of other ADAMs remain constant. Immunofluorescence analysis revealed staining of small, newly formed muscle fibers in regenerating but not normal adult muscle cells. Using a yeast 2-hybrid screen of a human skeletal muscle cDNA library with the cytoplasmic tail of human ADAM12 as bait, Galliano et al. (2000) determined that the membrane proximal portion of the C-terminal half of myristoylated ADAM12 interacts with muscle-specific alpha-actinin-2 (ACTN2; 102573). Galliano et al. (2000) determined that overexpression of cytosolic ADAM12 containing the ACTN2-binding site inhibits mouse myoblast fusion.

Full details of the abovementioned studies are described in the following publications, the disclosure of which are hereby incorporated by reference:

Galliano, M.-F.; Huet, C.; Frygelius, J.; Polgren, A.; Wewer, U. M.; Engvall, E. : Binding of ADAM12, a marker of skeletal muscle regeneration, to the muscle-specific actin-binding protein, alpha-actinin-2, is required for myoblast fusion. J. Biol. Chem. 275:13933-13939, 2000; and Yagami-Hiromasa, T.; Sato, T.; Kurisaki, T.; Kamijo, K.; Nabeshima, Y.; Fujisawa-Sehara, A.: A metalloprotease-disintegrin participating in myoblast fusion. Nature 377:652-656, 1995.

Further studies establishing the function and utilities of ADAM12 are found in John Hopkins OMIM database record ID 602714, and in sited publications numbered 1124-1126 listed in the bibliography section hereinbelow, which are also hereby incorporated by reference. Arachidonate 12-lipoxygenase, 12R Type (ALOX12B, Accession NM_001139) is another VGAM675 host target gene. ALOX12B BINDING SITE is HOST TARGET binding site found in the 5' untranslated region of mRNA encoded by ALOX12B, corresponding to a HOST TARGET binding site such as BINDING SITE I, BINDING SITE II or BINDING SITE III. Table 2 illustrates the complementarity of the nucleotide sequences of ALOX12B BINDING SITE, designated SEQ ID:6807, to the nucleotide sequence of VGAM675 RNA, herein designated VGAM RNA, also designated SEQ ID:3386.

Another function of VGAM675 is therefore inhibition of Arachidonate 12-lipoxygenase, 12R Type (ALOX12B, Accession NM_001139), a gene which converts arachidonic acid to 12r- hydroperoxyeicosatetraenoic acid (12r-hpete). Accordingly, utilities of VGAM675 include diagnosis, prevention and treatment of diseases and clinical conditions associated with ALOX12B. The function of ALOX12B has been established by previous studies. 12R-lipoxygenase catalyzes the conversion of arachidonic acid to 12R-hydroxyeicosatetraenoic acid (12R-HETE). In a database search for novel lipoxygenases, Sun et al. (1998) identified a novel lipoxygenase gene. The cDNA encoded a 701-amino acid polypeptide which when expressed produced a protein with specific 12R-lipoxygenase activity. By RT-PCR, but not by Northern blot analysis, Sun et al. (1998) detected 12R-lipoxygenase mRNA in B cells and adult skin. Boeglin et al. (1998) also cloned the ALOX12B gene. The ALOX12B cDNA showed the greatest sequence similarity to the second type of human 15S-lipoxygenase (ALOX15B; 603697), and was more distantly related to human 12S-lipoxygenase (ALOX12; 152391). They showed that ALOX12B is expressed in keratinocytes and psoriatic scales, but they were not able to detect any transcription of the gene on several multiple-tissue Northern blots. Boeglin et al. (1998) provided mechanistic evidence for a lipoxygenase route to 12R-HETE in human psoriatic tissue and described a 12R-lipoxygenase that could account for the biosynthesis.

Full details of the abovementioned studies are described in the following publications, the disclosure of which are hereby incorporated by reference:

Boeglin, W. E.; Kim, R. B.; Brash, A. R.: A 12R-lipoxygenase in human skin: mechanistic evidence, molecular cloning, and expression. Proc. Nat. Acad. Sci. 95:6744-6749, 1998; and Jobard, F.; Lefevre, C.; Karaduman, A.; Blanchet-Bardon, C.; Emre, S.; Weissenbach, J.; Ozguc, M.; Lathrop, M.; Prud'homme, J.-F.; Fischer, J.: Lipoxygenase-3 (ALOXE3) and 12(R)-lipoxy.

Further studies establishing the function and utilities of ALOX12B are found in John Hopkins OMIM database record ID 603741, and in sited publications numbered 289 and 9437 listed in the bibliography section hereinbelow, which are also hereby incorporated by reference. ASH1 (Accession NM_018489) is another VGAM675 host target gene. ASH1 BINDING SITE is HOST TARGET binding site found in the 3' untranslated region of mRNA encoded by ASH1, corresponding to a HOST TARGET binding site such as BINDING SITE I, BINDING SITE II or BINDING SITE III. Table 2 illustrates the complementarity of the nucleotide sequences of ASH1 BINDING SITE, designated SEQ ID:20548, to the nucleotide sequence of VGAM675 RNA, herein designated VGAM RNA, also designated SEQ ID:3386.

Another function of VGAM675 is therefore inhibition of ASH1 (Accession NM_018489), a gene which is a candidate regulator of development in the mammalian central nervous system and neural crest. Accordingly, utilities of VGAM675 include diagnosis, prevention and treatment of diseases and clinical conditions associated with ASH1. The function of ASH1 has been established by previous studies. Using retroviral labeling in organotypic slice cultures of the embryonic human forebrain, Letinic et al. (2002) demonstrated the existence of 2 distinct lineages of neocortical GABAergic neurons. One lineage expresses DLX1 (OMIM Ref. No. 600029) and DLX2 (OMIM Ref. No. 126255) and MASH1 transcription factors, represents 65% of neocortical GABAergic neurons in human S, and originates from MASH1-expressing progenitors of the neocortical ventricular and subventricular zone of the dorsal forebrain. The second lineage, characterized by the expression of DLX1 and DLX2 but not MASH1, forms around 35% of the GABAergic neurons and originates from the ganglionic eminence of the ventral forebrain. Letinic et al. (2002) suggested that modifications in the expression pattern of transcription factors in the forebrain may underlie species-specific programs for the generation of neocortical local circuit neurons and that distinct lineages of cortical interneurons may be differentially affected in genetic and acquired diseases of the human brain Animal model experiments lend further support to the function of ASH1. By homologous recombination in embryonic stem cells, Guillemot et al. (1993) created a null allele of the Mash1 gene. Homozygous mice died at birth with apparent breathing and feeding defects. The brain and spinal cord appeared normal, but the olfactory epithelium and sympathetic, parasympathetic, and enteric ganglia were severely affected. These observations suggested that the Mash1 gene, like its Drosophila homologs, controls a basic operation in development of neuronal progenitors in distinct neural lineages It is appreciated that the abovementioned animal model for ASH1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Letinic, K.; Zoncu, R.; Rakic, P.: Origin of GABAergic neurons in the human neocortex. Nature 417:645-649, 2002; and Guillemot, F.; Lo, L.-C.; Johnson, J. E.; Auerbach, A.; Anderson, D. J.; Joyner, A. L.: Mammalian achaete-scute homolog 1 is required for the early development of olfactory and autonom.

Further studies establishing the function and utilities of ASH1 are found in John Hopkins OMIM database record ID 100790, and in sited publications numbered 12331-1233 and 12762 listed in the bibliography section hereinbelow, which are also hereby incorporated by reference. ATP Synthase, H+ Transporting, Mitochondrial F0 Complex, Subunit F6 (ATP5J, Accession NM_001685) is another VGAM675 host target gene. ATP5J BINDING SITE is HOST TARGET binding site found in the 5' untranslated region of mRNA encoded by ATP5J, corresponding to a HOST TARGET binding site such as BINDING SITE I, BINDING SITE II or BINDING SITE III. Table 2 illustrates the complementarity of the nucleotide sequences of ATP5J BINDING SITE, designated SEQ ID:7408, to the nucleotide sequence of VGAM675 RNA, herein designated VGAM RNA, also designated SEQ ID:3386.

Another function of VGAM675 is therefore inhibition of ATP Synthase, H+ Transporting, Mitochondrial F0 Complex, Subunit F6 (ATP5J, Accession NM_001685), a gene which is one of the chains of the nonenzymatic component of the mitochondrial ATPase complex. Accordingly, utilities of VGAM675 include diagnosis, prevention and treatment of diseases and clinical conditions associated with ATP5J. The function of ATP5J and its association with various diseases and clinical conditions, has been established by previous studies, as described hereinabove with reference to VGAM556. DEAD/H (Asp-Glu-Ala-Asp/His) Box Polypeptide, Y Chromosome (DBY, Accession NM_004660) is another VGAM675 host target gene. DBY BINDING SITE is HOST TARGET binding site found in the 3' untranslated region of mRNA encoded by DBY, corresponding to a HOST TARGET binding site such as BINDING SITE I, BINDING SITE II or BINDING SITE III. Table 2 illustrates the complementarity of the nucleotide sequences of DBY BINDING SITE, designated SEQ ID:11026, to the nucleotide sequence of VGAM675 RNA, herein designated VGAM RNA, also designated SEQ ID:3386.

Another function of VGAM675 is therefore inhibition of DEAD/H (Asp-Glu-Ala-Asp/His) Box Polypeptide, Y Chromosome (DBY, Accession NM_004660), a gene which plays a key role in the spermatogenic process. Accordingly, utilities of VGAM675 include diagnosis, prevention and treatment of diseases and clinical conditions associated with DBY. The function of DBY and its association with various diseases and clinical conditions, has been established by previous studies, as described hereinabove with reference to VGAM374. Hexokinase 1 (HK1, Accession NM_033497) is another VGAM675 host target gene. HK1 BINDING SITE1 through HK1 BINDING SITE3 are HOST TARGET binding sites found in untranslated regions of mRNA encoded by HK1, corresponding to HOST TARGET binding sites such as BINDING SITE I, BINDING SITE II or BINDING SITE III. Table 2 illustrates the complementarity of the nucleotide sequences of HK1 BINDING SITE1 through HK1 BINDING SITE3, designated SEQ ID:27269, SEQ ID:27272 and SEQ ID:27275 respectively, to the nucleotide sequence of VGAM675 RNA, herein designated VGAM RNA, also designated SEQ ID:3386.

Another function of VGAM675 is therefore inhibition of Hexokinase 1 (HK1, Accession NM_033497). Accordingly, utilities of VGAM675 include diagnosis, prevention and treatment of diseases and clinical conditions associated with HK1. KiSS-1 Metastasis-suppressor (KISS1, Accession NM_002256) is another VGAM675 host target gene. KISS1 BINDING SITE is HOST TARGET binding site found in the 5' untranslated region of mRNA encoded by KISS1, corresponding to a HOST TARGET binding site such as BINDING SITE I, BINDING SITE II or BINDING SITE III. Table 2 illustrates the complementarity of the nucleotide sequences of KISS1 BINDING SITE, designated SEQ ID:8061, to the nucleotide sequence of VGAM675 RNA, herein designated VGAM RNA, also designated SEQ ID:3386.

Another function of VGAM675 is therefore inhibition of KiSS-1 Metastasis-suppressor (KISS1, Accession NM_002256), a gene which suppresses metastases of melanomas and breast carcinomas without affecting tumorigenicity. Accordingly, utilities of VGAM675 include diagnosis, prevention and treatment of diseases and clinical conditions associated with KISS1. The function of KISS1 has been established by previous studies. Welch et al. (1994) found that microcell-mediated transfer of human chromosome 6 into human metastatic melanoma cells (C8161 or MelJuSo) suppressed their ability to metastasize in athymic nude mice by at least 95% without affecting the tumorigenicity of the cells. Using a modified subtractive hybridization approach, Lee et al. (1996) isolated a cDNA expressed in hybrid chromosome 6-C8161 cells but not in parental C8161 cells. They designated the cDNA KISS1, combining laboratory nomenclature for putative suppressor sequences with acknowledgment of the gene's discovery in Hershey, Pennsylvania. Lee et al.

(1996) reported the sequence of the predicted KISS1 protein and a corrected sequence in a published erratum. The KISS1 protein consists of 145 amino acids. Northern blot analysis revealed that KISS1 was expressed as a 1-kb mRNA in chromosome 6-C8161 hybrid cell lines as well as in normal placenta tissue. Low levels of smaller transcripts were observed in pancreas and kidney. Lee et al. (1996) did not detect KISS1 expression in any cell line capable of metastasizing in athymic nude mice.

Full details of the abovementioned studies are described in the following publications, the disclosure of which are hereby incorporated by reference:

Lee, J.-H.; Welch, D. R.: Suppression of metastasis in human breast carcinoma MDA-MB-435 cells after transfection with the metastasis suppressor gene, KiSS-1. Cancer Res. 57:2384-2387, 1997; and Ohtaki, T.; Shintani, Y.; Honda, S.; Matsumoto, H.; Hori, A.; Kanehashi, K.; Terao, Y.; Kumano, S.; Takatsu, Y.; Masuda, Y.; Ishibashi, Y.; Watanabe, T.; and 9 others: Metastasis suppr.

Further studies establishing the function and utilities of KISS1 are found in John Hopkins OMIM database record ID 603286, and in sited publications numbered 5276-5280 listed in the bibliography section hereinbelow, which are also hereby incorporated by reference. Outer Dense Fiber of Sperm Tails 2 (ODF2, Accession NM_002540) is another VGAM675 host target gene. ODF2 BINDING SITE is HOST TARGET binding site found in the 3' untranslated region of mRNA encoded by ODF2, corresponding to a HOST TARGET binding site such as BINDING SITE I, BINDING SITE II or BINDING SITE III. Table 2 illustrates the complementarity of the nucleotide sequences of ODF2 BINDING SITE, designated SEQ ID:8387, to the nucleotide sequence of VGAM675 RNA, herein designated VGAM RNA, also designated SEQ ID:3386.

Another function of VGAM675 is therefore inhibition of Outer Dense Fiber of Sperm Tails 2 (ODF2, Accession NM_002540), a gene which is very strongly similar to rat Odf2. Accordingly, utilities of VGAM675 include diagnosis, prevention and treatment of diseases and clinical conditions associated with ODF2. The function of ODF2 and its association with various diseases and clinical conditions, has been established by previous studies, as described hereinabove with reference to VGAM363. Pyrimidinergic Receptor P2Y, G-protein Coupled, 6 (P2RY6, Accession NM_004154) is another VGAM675 host target gene. P2RY6 BINDING SITE is HOST TARGET binding site found in the 5' untranslated region of mRNA encoded by P2RY6, corresponding to a HOST TARGET binding site such as BINDING SITE I, BINDING SITE II or BINDING SITE III. Table 2 illustrates the complementarity of the nucleotide sequences of P2RY6 BINDING SITE, designated SEQ ID:10354, to the nucleotide sequence of VGAM675 RNA, herein designated VGAM RNA, also designated SEQ ID:3386.

Another function of VGAM675 is therefore inhibition of Pyrimidinergic Receptor P2Y, G-protein Coupled, 6 (P2RY6, Accession NM_004154), a gene which mediates cellular responses to nucleotides. Accordingly, utilities of VGAM675 include diagnosis, prevention and treatment of diseases and clinical conditions associated with P2RY6. The function of P2RY6 and its association with various diseases and clinical conditions, has been established by previous studies, as described hereinabove with reference to VGAM445. Protein Phosphatase 2 (formerly 2A), Regulatory Subunit B (PR 52), Beta Isoform (PPP2R2B, Accession NM_004576) is another VGAM675 host target gene. PPP2R2B BINDING SITE is HOST TARGET binding site found in the 3' untranslated region of mRNA encoded by PPP2R2B, corresponding to a HOST TARGET binding site such as BINDING SITE I, BINDING SITE II or BINDING SITE III. Table 2 illustrates the complementarity of the nucleotide sequences of PPP2R2B BINDING SITE, designated SEQ ID:10922, to the nucleotide sequence of VGAM675 RNA, herein designated VGAM RNA, also designated SEQ ID:3386.

Another function of VGAM675 is therefore inhibition of Protein Phosphatase 2 (formerly 2A), Regulatory Subunit B (PR 52), Beta Isoform (PPP2R2B, Accession NM_004576). Accordingly, utilities of VGAM675 include diagnosis, prevention and treatment of diseases and clinical conditions associated with PPP2R2B. Protein Phosphatase 2, Regulatory Subunit B (B56), Alpha Isoform (PPP2R5A, Accession NM_006243) is another VGAM675 host target gene. PPP2R5A BINDING SITE is HOST TARGET binding site found in the 3' untranslated region of mRNA encoded by PPP2R5A, corresponding to a HOST TARGET binding site such as BINDING SITE I, BINDING SITE II or BINDING SITE III. Table 2 illustrates the complementarity of the nucleotide sequences of PPP2R5A BINDING SITE, designated SEQ ID:12908, to the nucleotide sequence of VGAM675 RNA, herein designated VGAM RNA, also designated SEQ ID:3386.

Another function of VGAM675 is therefore inhibition of Protein Phosphatase 2, Regulatory Subunit B (B56), Alpha Isoform (PPP2R5A, Accession NM_006243), a gene which is a regulatory subunit of protein phosphatase 2A. Accordingly, utilities of VGAM675 include diagnosis, prevention and treatment of diseases and clinical conditions associated with PPP2R5A. The function of PPP2R5A has been established by previous studies. Protein phosphorylation is a regulatory mechanism commonly employed in cellular processes such as cell cycle progression, growth factor signaling, and cell transformation. Protein phosphatase 2A (PP2A), a heterotrimeric serine/threonine phosphatase, has been implicated in a variety of regulatory processes including cell growth and division, muscle contraction, and gene transcription. PP2A is a trimeric enzyme composed of a catalytic subunit (OMIM Ref. No. 176915), a structural subunit, and any of several different regulatory subunits which control its specificity. One family of related PP2A regulatory subunits is designated the B56 family and contains at least 5 different members (McCright and Virshup (1995)). The alpha subunit gene encodes a cytoplasmic phosphoprotein. The alpha and gamma (OMIM Ref. No. 601645) subunits are expressed at highest levels in skeletal and cardiac muscle. See also the entries describing the beta (OMIM Ref. No. 601644), delta (OMIM Ref. No. 601646), and epsilon (OMIM Ref. No. 601647) subunits. McCright et al. (1996) mapped the gene for the alpha subunit, designated PPP2R5A, to 1q41 by fluorescence in situ hybridization.

Full details of the abovementioned studies are described in the following publications, the disclosure of which are hereby incorporated by reference:

McCright, B.; Brothman, A. R.; Virshup, D. M.: Assignment of human protein phosphatase 2A regulatory subunit genes B56-alpha, B56-beta, B56-gamma, B56-delta, and B56-epsilon (PPP2R5A--PPP2R5E), highly expressed in muscle and brain, to chromosome regions 1q41, 11q12, 3p21, 6p21.1, and 7p11.2-to-p12. Genomics 36:168-170, 1996; and McCright, B.; Virshup, D. M.: Identification of a new family of protein phosphatase 2A regulatory subunits. J. Biol. Chem. 270:26123-26128, 1995.

Further studies establishing the function and utilities of PPP2R5A are found in John Hopkins OMIM database record ID 601643, and in sited publications numbered 6687-6688 listed in the bibliography section hereinbelow, which are also hereby incorporated by reference. SNL (Accession NM_003088) is another VGAM675 host target gene. SNL BINDING SITE is HOST TARGET binding site found in the 3' untranslated region of mRNA encoded by SNL, corresponding to a HOST TARGET binding site such as BINDING SITE I, BINDING SITE II or BINDING SITE III. Table 2 illustrates the complementarity of the nucleotide sequences of SNL BINDING SITE, designated SEQ ID:9066, to the nucleotide sequence of VGAM675 RNA, herein designated VGAM RNA, also designated SEQ ID:3386.

Another function of VGAM675 is therefore inhibition of SNL (Accession NM_003088), a gene which organizes filamentous actin into bundles with a minimum of 4.1:1 actin/fascin ratio. Accordingly, utilities of VGAM675 include diagnosis, prevention and treatment of diseases and clinical conditions associated with SNL. The function of SNL has been established by previous studies. Sea urchin fascin, one of the first actin-bundling proteins extensively characterized, can crosslink actin filaments in vitro (Bryan and Kane, 1982). The cloning of a fascin cDNA by Bryan et al. (1993) showed that fascin is homologous to the Drosophila singed gene product. Duh et al. (1994) isolated cDNAs encoding the human homolog of sea urchin fascin and Drosophila singed, called HSN by them, from a human teratocarcinoma cDNA library. The HSN mRNA was expressed at various levels in all human tissues analyzed, and it was highly expressed in actively growing renal carcinoma cell lines and in activated but not in resting lymphocytes, suggesting a functional role for HSN in proliferation. The HSN gene is predicted to encode a 493-amino acid protein with a molecular mass of 55 kD. Based on peptide sequence identity and immunocrossreactivity, Duh et al. (1994) indicated that the HSN protein is the 55-kD actin-bundling protein purified from HeLa cells (Yamashiro-Matsumura and Matsumura, 1985). This HeLa cell-derived 55-kD protein is thought to be involved in the assembly of actin filament bundles present in microspikes, membrane ruffles, and stress fibers (Yamashiro-Matsumura and Matsumura, 1986). Using immunohistochemistry, Pinkus et al. (1997) found that nearly all Reed-Sternberg cells in Hodgkin disease (OMIM Ref. No. 236000), except in the nodular lymphocyte predominance type, express fascin. They proposed that fascin expression may be helpful in distinguishing Hodgkin from non-Hodgkin lymphoma and suggested that Reed-Sternberg cells may have a dendritic cell derivation.

Full details of the abovementioned studies are described in the following publications, the disclosure of which are hereby incorporated by reference:

Pinkus, G. S.; Pinkus, J. L.; Langhoff, E.; Matsumura, F.; Yamashiro, S.; Mosialos, G.; Said, J. W.: Fascin, a sensitive new marker for Reed-Sternberg cells of Hodgkin's disease: evidence for a dendritic or B cell derivation? Am. J. Path. 150:543-562, 1997; and Sonderbye, L.; Magerstadt, R.; Blatman, R. N.; Preffer, F. I.; Langhoff, E.: Selective expression of human fascin (p55) by dendritic leukocytes. Adv. Exp. Med. Biol. 471:41-46, 1997.

Further studies establishing the function and utilities of SNL are found in John Hopkins OMIM database record ID 602689, and in sited publications numbered 544 and 7640-7647 listed in the bibliography section hereinbelow, which are also hereby incorporated by reference. TEM7 (Accession NM_020405) is another VGAM675 host target gene. TEM7 BINDING SITE is HOST TARGET binding site found in the 3' untranslated region of mRNA encoded by TEM7, corresponding to a HOST TARGET binding site such as BINDING SITE I, BINDING SITE II or BINDING SITE III. Table 2 illustrates the complementarity of the nucleotide sequences of TEM7 BINDING SITE, designated SEQ ID:21669, to the nucleotide sequence of VGAM675 RNA, herein designated VGAM RNA, also designated SEQ ID:3386.

Another function of VGAM675 is therefore inhibition of TEM7 (Accession NM_020405), a gene which involves in angiogenesis. Accordingly, utilities of VGAM675 include diagnosis, prevention and treatment of diseases and clinical conditions associated with TEM7. The function of TEM7 and its association with various diseases and clinical conditions, has been established by previous studies, as described hereinabove with reference to VGAM23. F-box Only Protein 27 (FBXO27, Accession XM_059045) is another VGAM675 host target gene. FBXO27 BINDING SITE is HOST TARGET binding site found in the 3' untranslated region of mRNA encoded by FBXO27, corresponding to a HOST TARGET binding site such as BINDING SITE I, BINDING SITE II or BINDING SITE III. Table 2 illustrates the complementarity of the nucleotide sequences of FBXO27 BINDING SITE, designated SEQ ID:36838, to the nucleotide sequence of VGAM675 RNA, herein designated VGAM RNA, also designated SEQ ID:3386.

Another function of VGAM675 is therefore inhibition of F-box Only Protein 27 (FBXO27, Accession XM_059045). Accordingly, utilities of VGAM675 include diagnosis, prevention and treatment of diseases and clinical conditions associated with FBXO27. FLJ10521 (Accession NM_018125) is another VGAM675 host target gene. FLJ10521 BINDING SITE is HOST TARGET binding site found in the 3' untranslated region of mRNA encoded by FLJ10521, corresponding to a HOST TARGET binding site such as BINDING SITE I, BINDING SITE II or BINDING SITE III. Table 2 illustrates the complementarity of the nucleotide sequences of FLJ10521 BINDING SITE, designated SEQ ID:19911, to the nucleotide sequence of VGAM675 RNA, herein designated VGAM RNA, also designated SEQ ID:3386.

Another function of VGAM675 is therefore inhibition of FLJ10521 (Accession NM_018125). Accordingly, utilities of VGAM675 include diagnosis, prevention and treatment of diseases and clinical conditions associated with FLJ10521. Hepatitis B Virus X Associated Protein (HBXAP, Accession NM_016578) is another VGAM675 host target gene. HBXAP BINDING SITE is HOST TARGET binding site found in the 3' untranslated region of mRNA encoded by HBXAP, corresponding to a HOST TARGET binding site such as BINDING SITE I, BINDING SITE II or BINDING SITE III. Table 2 illustrates the complementarity of the nucleotide sequences of HBXAP BINDING SITE, designated SEQ ID:18656, to the nucleotide sequence of VGAM675 RNA, herein designated VGAM RNA, also designated SEQ ID:3386.

Another function of VGAM675 is therefore inhibition of Hepatitis B Virus X Associated Protein (HBXAP, Accession NM_016578). Accordingly, utilities of VGAM675 include diagnosis, prevention and treatment of diseases and clinical conditions associated with HBXAP. Histamine Receptor H4 (HRH4, Accession NM_021624) is another VGAM675 host target gene. HRH4 BINDING SITE is HOST TARGET binding site found in the 3' untranslated region of mRNA encoded by HRH4, corresponding to a HOST TARGET binding site such as BINDING SITE I, BINDING SITE II or BINDING SITE III. Table 2 illustrates the complementarity of the nucleotide sequences of HRH4 BINDING SITE, designated SEQ ID:22257, to the nucleotide sequence of VGAM675 RNA, herein designated VGAM RNA, also designated SEQ ID:3386.

Another function of VGAM675 is therefore inhibition of Histamine Receptor H4 (HRH4, Accession NM_021624). Accordingly, utilities of VGAM675 include diagnosis, prevention and treatment of diseases and clinical conditions associated with HRH4. KIAA0089 (Accession XM_046056) is another VGAM675 host target gene. KIAA0089 BINDING SITE is HOST TARGET binding site found in the 3' untranslated region of mRNA encoded by KIAA0089, corresponding to a HOST TARGET binding site such as BINDING SITE I, BINDING SITE II or BINDING SITE III. Table 2 illustrates the complementarity of the nucleotide sequences of KIAA0089 BINDING SITE, designated SEQ ID:34666, to the nucleotide sequence of VGAM675 RNA, herein designated VGAM RNA, also designated SEQ ID:3386.

Another function of VGAM675 is therefore inhibition of KIAA0089 (Accession XM_046056). Accordingly, utilities of VGAM675 include diagnosis, prevention and treatment of diseases and clinical conditions associated with KIAA0089. KIAA0547 (Accession NM_014793) is another VGAM675 host target gene. KIAA0547 BINDING SITE is HOST TARGET binding site found in the 3' untranslated region of mRNA encoded by KIAA0547, corresponding to a HOST TARGET binding site such as BINDING SITE I, BINDING SITE II or BINDING SITE III. Table 2 illustrates the complementarity of the nucleotide sequences of KIAA0547 BINDING SITE, designated SEQ ID:16695, to the nucleotide sequence of VGAM675 RNA, herein designated VGAM RNA, also designated SEQ ID:3386.

Another function of VGAM675 is therefore inhibition of KIAA0547 (Accession NM_014793). Accordingly, utilities of VGAM675 include diagnosis, prevention and treatment of diseases and clinical conditions associated with KIAA0547. KIAA1318 (Accession XM_041080) is another VGAM675 host target gene. KIAA1318 BINDING SITE is HOST TARGET binding site found in the 3' untranslated region of mRNA encoded by KIAA1318, corresponding to a HOST TARGET binding site such as BINDING SITE I, BINDING SITE II or BINDING SITE III. Table 2 illustrates the complementarity of the nucleotide sequences of KIAA1318 BINDING SITE, designated SEQ ID:33429, to the nucleotide sequence of VGAM675 RNA, herein designated VGAM RNA, also designated SEQ ID:3386.

Another function of VGAM675 is therefore inhibition of KIAA1318 (Accession XM_041080). Accordingly, utilities of VGAM675 include diagnosis, prevention and treatment of diseases and clinical conditions associated with KIAA1318. MGC16175 (Accession NM_032765) is another VGAM675 host target gene. MGC16175 BINDING SITE is HOST TARGET binding site found in the 3' untranslated region of mRNA encoded by MGC16175, corresponding to a HOST TARGET binding site such as BINDING SITE I, BINDING SITE II or BINDING SITE III. Table 2 illustrates the complementarity of the nucleotide sequences of MGC16175 BINDING SITE, designated SEQ ID:26511, to the nucleotide sequence of VGAM675 RNA, herein designated VGAM RNA, also designated SEQ ID:3386.

Another function of VGAM675 is therefore inhibition of MGC16175 (Accession NM_032765). Accordingly, utilities of VGAM675 include diagnosis, prevention and treatment of diseases and clinical conditions associated with MGC16175. PRO1866 (Accession NM_018510) is another VGAM675 host target gene. PRO1866 BINDING SITE is HOST TARGET binding site found in the 5' untranslated region of mRNA encoded by PRO1866, corresponding to a HOST TARGET binding site such as BINDING SITE I, BINDING SITE II or BINDING SITE III. Table 2 illustrates the complementarity of the nucleotide sequences of PRO1866 BINDING SITE, designated SEQ ID:20580, to the nucleotide sequence of VGAM675 RNA, herein designated VGAM RNA, also designated SEQ ID:3386.

Another function of VGAM675 is therefore inhibition of PRO1866 (Accession NM_018510). Accordingly, utilities of VGAM675 include diagnosis, prevention and treatment of diseases and clinical conditions associated with PRO1866. Williams Beuren Syndrome Chromosome Region 22 (WBSCR22, Accession NM_017528) is another VGAM675 host target gene. WBSCR22 BINDING SITE is HOST TARGET binding site found in the 3' untranslated region of mRNA encoded by WBSCR22, corresponding to a HOST TARGET binding site such as BINDING SITE I, BINDING SITE II or BINDING SITE III. Table 2 illustrates the complementarity of the nucleotide sequences of WBSCR22 BINDING SITE, designated SEQ ID:18971, to the nucleotide sequence of VGAM675 RNA, herein designated VGAM RNA, also designated SEQ ID:3386.

Another function of VGAM675 is therefore inhibition of Williams Beuren Syndrome Chromosome Region 22 (WBSCR22, Accession NM_017528). Accordingly, utilities of VGAM675 include diagnosis, prevention and treatment of diseases and clinical conditions associated with WBSCR22. Zinc Finger Protein 230 (ZNF230, Accession NM_006300) is another VGAM675 host target gene. ZNF230 BINDING SITE is HOST TARGET binding site found in the 5' untranslated region of mRNA encoded by ZNF230, corresponding to a HOST TARGET binding site such as BINDING SITE I, BINDING SITE II or BINDING SITE III. Table 2 illustrates the complementarity of the nucleotide sequences of ZNF230 BINDING SITE, designated SEQ ID:12994, to the nucleotide sequence of VGAM675 RNA, herein designated VGAM RNA, also designated SEQ ID:3386.

Another function of VGAM675 is therefore inhibition of Zinc Finger Protein 230 (ZNF230, Accession NM_006300). Accordingly, utilities of VGAM675 include diagnosis, prevention and treatment of diseases and clinical conditions associated with ZNF230. LOC145989 (Accession XM_004815) is another VGAM675 host target gene. LOC145989 BINDING SITE is HOST TARGET binding site found in the 3' untranslated region of mRNA encoded by LOC145989, corresponding to a HOST TARGET binding site such as BINDING SITE I, BINDING SITE II or BINDING SITE III. Table 2 illustrates the complementarity of the nucleotide sequences of LOC145989 BINDING SITE, designated SEQ ID:29954, to the nucleotide sequence of VGAM675 RNA, herein designated VGAM RNA, also designated SEQ ID:3386.

Another function of VGAM675 is therefore inhibition of LOC145989 (Accession XM_004815). Accordingly, utilities of VGAM675 include diagnosis, prevention and treatment of diseases and clinical conditions associated with LOC145989. LOC148018 (Accession XM_092020) is another VGAM675 host target gene. LOC148018 BINDING SITE is HOST TARGET binding site found in the 5' untranslated region of mRNA encoded by LOC148018, corresponding to a HOST TARGET binding site such as BINDING SITE I, BINDING SITE II or BINDING SITE III. Table 2 illustrates the complementarity of the nucleotide sequences of LOC148018 BINDING SITE, designated SEQ ID:40090, to the nucleotide sequence of VGAM675 RNA, herein designated VGAM RNA, also designated SEQ ID:3386.

Another function of VGAM675 is therefore inhibition of LOC148018 (Accession XM_092020). Accordingly, utilities of VGAM675 include diagnosis, prevention and treatment of diseases and clinical conditions associated with LOC148018. LOC148223 (Accession XM_086101) is another VGAM675 host target gene. LOC148223 BINDING SITE is HOST TARGET binding site found in the 3' untranslated region of mRNA encoded by LOC148223, corresponding to a HOST TARGET binding site such as BINDING SITE I, BINDING SITE II or BINDING SITE III. Table 2 illustrates the complementarity of the nucleotide sequences of LOC148223 BINDING SITE, designated SEQ ID:38494, to the nucleotide sequence of VGAM675 RNA, herein designated VGAM RNA, also designated SEQ ID:3386.

Another function of VGAM675 is therefore inhibition of LOC148223 (Accession XM_086101). Accordingly, utilities of VGAM675 include diagnosis, prevention and treatment of diseases and clinical conditions associated with LOC148223. LOC158401 (Accession XM_088568) is another VGAM675 host target gene. LOC158401 BINDING SITE is HOST TARGET binding site found in the 5' untranslated region of mRNA encoded by LOC158401, corresponding to a HOST TARGET binding site such as BINDING SITE I, BINDING SITE II or BINDING SITE III. Table 2 illustrates the complementarity of the nucleotide sequences of LOC158401 BINDING SITE, designated SEQ ID:39836, to the nucleotide sequence of VGAM675 RNA, herein designated VGAM RNA, also designated SEQ ID:3386.

Another function of VGAM675 is therefore inhibition of LOC158401 (Accession XM_088568). Accordingly, utilities of VGAM675 include diagnosis, prevention and treatment of diseases and clinical conditions associated with LOC158401. LOC203378 (Accession XM_117541) is another VGAM675 host target gene. LOC203378 BINDING SITE is HOST TARGET binding site found in the 3' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43549, to the nucleotide sequence of VGAM675 RNA, herein designated VGAM RNA, also designated SEQ ID:3386.

Another function of VGAM675 is therefore inhibition of LOC203378 (Accession XM_117541). Accordingly, utilities of VGAM675 include diagnosis, prevention and treatment of diseases and clinical conditions associated with LOC203378. LOC220549 (Accession XM_167521) is another VGAM675 host target gene. LOC220549 BINDING SITE is HOST TARGET binding site found in the 5' untranslated region of mRNA encoded by LOC220549, corresponding to a HOST TARGET binding site such as BINDING SITE I, BINDING SITE II or BINDING SITE III. Table 2 illustrates the complementarity of the nucleotide sequences of LOC220549 BINDING SITE, designated SEQ ID:44648, to the nucleotide sequence of VGAM675 RNA, herein designated VGAM RNA, also designated SEQ ID:3386.

Another function of VGAM675 is therefore inhibition of LOC220549 (Accession XM_167521). Accordingly, utilities of VGAM675 include diagnosis, prevention and treatment of diseases and clinical conditions associated with LOC220549. LOC221490 (Accession XM_168084) is another VGAM675 host target gene. LOC221490 BINDING SITE is HOST TARGET binding site found in the 5' untranslated region of mRNA encoded by LOC221490, corresponding to a HOST TARGET binding site such as BINDING SITE I, BINDING SITE II or BINDING SITE III. Table 2 illustrates the complementarity of the nucleotide sequences of LOC221490 BINDING SITE, designated SEQ ID:44985, to the nucleotide sequence of VGAM675 RNA, herein designated VGAM RNA, also designated SEQ ID:3386.

Another function of VGAM675 is therefore inhibition of LOC221490 (Accession XM_168084). Accordingly, utilities of VGAM675 include diagnosis, prevention and treatment of diseases and clinical conditions associated with LOC221490. LOC255146 (Accession XM_170985) is another VGAM675 host target gene. LOC255146 BINDING SITE is HOST TARGET binding site found in the 3' untranslated region of mRNA encoded by LOC255146, corresponding to a HOST TARGET binding site such as BINDING SITE I, BINDING SITE II or BINDING SITE III. Table 2 illustrates the complementarity of the nucleotide sequences of LOC255146 BINDING SITE, designated SEQ ID:45755, to the nucleotide sequence of VGAM675 RNA, herein designated VGAM RNA, also designated SEQ ID:3386.

Another function of VGAM675 is therefore inhibition of LOC255146 (Accession XM_170985). Accordingly, utilities of VGAM675 include diagnosis, prevention and treatment of diseases and clinical conditions associated with LOC255146. LOC255452 (Accession XM_174088) is another VGAM675 host target gene. LOC255452 BINDING SITE is HOST TARGET binding site found in the 3' untranslated region of mRNA encoded by LOC255452, corresponding to a HOST TARGET binding site such as BINDING SITE I, BINDING SITE II or BINDING SITE III. Table 2 illustrates the complementarity of the nucleotide sequences of LOC255452 BINDING SITE, designated SEQ ID:46576, to the nucleotide sequence of VGAM675 RNA, herein designated VGAM RNA, also designated SEQ ID:3386.

Another function of VGAM675 is therefore inhibition of LOC255452 (Accession XM_174088). Accordingly, utilities of VGAM675 include diagnosis, prevention and treatment of diseases and clinical conditions associated with LOC255452. LOC257000 (Accession XM_172999) is another VGAM675 host target gene. LOC257000 BINDING SITE is HOST TARGET binding site found in the 3' untranslated region of mRNA encoded by LOC257000, corresponding to a HOST TARGET binding site such as BINDING SITE I, BINDING SITE II or BINDING SITE III. Table 2 illustrates the complementarity of the nucleotide sequences of LOC257000 BINDING SITE, designated SEQ ID:46271, to the nucleotide sequence of VGAM675 RNA, herein designated VGAM RNA, also designated SEQ ID:3386.

Another function of VGAM675 is therefore inhibition of LOC257000 (Accession XM_172999). Accordingly, utilities of VGAM675 include diagnosis, prevention and treatment of diseases and clinical conditions associated with LOC257000. LOC90785 (Accession XM_034110) is another VGAM675 host target gene. LOC90785 BINDING SITE is HOST TARGET binding site found in the 3' untranslated region of mRNA encoded by LOC90785, corresponding to a HOST TARGET binding site such as BINDING SITE I, BINDING SITE II or BINDING SITE III. Table 2 illustrates the complementarity of the nucleotide sequences of LOC90785 BINDING SITE, designated SEQ ID:32005, to the nucleotide sequence of VGAM675 RNA, herein designated VGAM RNA, also designated SEQ ID:3386.

Another function of VGAM675 is therefore inhibition of LOC90785 (Accession XM_034110). Accordingly, utilities of VGAM675 include diagnosis, prevention and treatment of diseases and clinical conditions associated with LOC90785. FIG. 1 further provides a conceptual description of a novel bioinformatically detected viral gene of the present invention, referred to here as Viral Genomic Address Messenger 676 (VGAM676) viral gene, which modulates expression of respective host target genes thereof, the function and utility of which host target genes is known in the art.

VGAM676 is a novel bioinformatically detected regulatory, non protein coding, viral micro RNA (miRNA) gene. The method by which VGAM676 was detected is described hereinabove with reference to FIGS. 1-8.

VGAM676 gene, herein designated VGAM GENE, is a viral gene contained in the genome of Human Coronavirus 229E. VGAM676 host target gene, herein designated VGAM HOST TARGET GENE, is a human gene contained in the human genome.

VGAM676 gene encodes a VGAM676 precursor RNA, herein designated VGAM PRECURSOR RNA. Similar to other miRNA genes, and unlike most ordinary genes, VGAM676 precursor RNA does not encode a protein. A nucleotide sequence identical or highly similar to the nucleotide sequence of VGAM676 precursor RNA is designated SEQ ID:662, and is provided hereinbelow with reference to the sequence listing part. Nucleotide sequence SEQ ID:662 is located at position 13267 relative to the genome of Human Coronavirus 229E.

VGAM676 precursor RNA folds onto itself, forming VGAM676 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM676 folded precursor RNA into VGAM676 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM676 RNA is designated SEQ ID:3387, and is provided hereinbelow with reference to the sequence listing part.

VGAM676 host target gene, herein designated VGAM HOST TARGET GENE, encodes a corresponding messenger RNA, VGAM676 host target RNA, herein designated VGAM HOST TARGET RNA. VGAM676 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM676 RNA, herein designated VGAM RNA, binds complementarily to one or more host target binding sites located in untranslated regions of VGAM676 host target RNA, herein designated VGAM HOST TARGET RNA. This complementary binding is due to the fact that the nucleotide sequence of VGAM676 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM676 RNA, herein designated VGAM RNA, may have a different number of host target binding sites in untranslated regions of a VGAM676 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM676 RNA, herein designated VGAM RNA, to host target binding sites on VGAM676 host target RNA, herein designated VGAM HOST TARGET RNA, such as BINDING SITE I, BINDING SITE II and BINDING SITE III, inhibits translation of VGAM676 host target RNA into VGAM676 host target protein, herein designated VGAM HOST TARGET PROTEIN. VGAM host target protein is therefore outlined by a broken line.

It is appreciated that VGAM676 host target gene, herein designated VGAM HOST TARGET GENE, in fact represents a plurality of VGAM676 host target genes. The mRNA of each one of this plurality of VGAM676 host target genes comprises one or more host target binding sites, each having a nucleotide sequence which is at least partly complementary to VGAM676 RNA, herein designated VGAM RNA, and which when bound by VGAM676 RNA causes inhibition of translation of respective one or more VGAM676 host target proteins.

It is further appreciated by one skilled in the art that the mode of translational inhibition illustrated by FIG. 1 with specific reference to translational inhibition exerted by VGAM676 gene, herein designated VGAM GENE, on one or more VGAM676 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM676 is inhibition of expression of host target genes, as part of a novel viral mechanism of attacking a host. Accordingly, utilities of VGAM676 include diagnosis, prevention and treatment of viral infection by Human Coronavirus 229E. Specific functions, and accordingly utilities, of VGAM676 correlate with, and may be deduced from, the identity of the host target genes which VGAM676 binds and inhibits, and the function of these host target genes, as elaborated hereinbelow.

Nucleotide sequences of the VGAM676 precursor RNA, herein designated VGAM PRECURSOR RNA, and of the 'diced' VGAM676 RNA, herein designated VGAM RNA, and a schematic representation of the secondary folding of VGAM676 folded precursor RNA, herein designated VGAM FOLDED PRECURSOR RNA, of VGAM676 are further described hereinbelow with reference to Table 1.

Nucleotide sequences of host target binding sites, such as BINDING SITE-I, BINDING SITE-II and BINDING SITE-III of FIG. 1, found on VGAM676 host target RNA, and schematic representation of the complementarity of each of these host target binding sites to VGAM676 RNA, herein designated VGAM RNA, are described hereinbelow with reference to Table 2.

As mentioned hereinabove with reference to FIG. 1, a function of VGAM676 gene, herein designated VGAM is inhibition of expression of VGAM676 target genes. It is appreciated that specific functions, and accordingly utilities, of VGAM676 correlate with, and may be deduced from, the identity of the target genes which VGAM676 binds and inhibits, and the function of these target genes, as elaborated hereinbelow.

Fatty-acid-Coenzyme A Ligase, Long-chain 5 (FACL5, Accession XM_034424) is a VGAM676 host target gene. FACL5 BINDING SITE is HOST TARGET binding site found in the 3' untranslated region of mRNA encoded by FACL5, corresponding to a HOST TARGET binding site such as BINDING SITE I, BINDING SITE II or BINDING SITE III. Table 2 illustrates the complementarity of the nucleotide sequences of FACL5 BINDING SITE, designated SEQ ID:32105, to the nucleotide sequence of VGAM676 RNA, herein designated VGAM RNA, also designated SEQ ID:3387.

A function of VGAM676 is therefore inhibition of Fatty-acid-Coenzyme A Ligase, Long-chain 5 (FACL5, Accession XM_034424), a gene which may be involved in fatty acid metabolism; contains an AMP-binding domain. Accordingly, utilities of VGAM676 include diagnosis, prevention and treatment of diseases and clinical conditions associated with FACL5. The function of FACL5 and its association with various diseases and clinical conditions, has been established by previous studies, as described hereinabove with reference to VGAM357. Frizzled Homolog 10 (Drosophila) (FZD10, Accession NM_007197) is another VGAM676 host target gene. FZD10 BINDING SITE is HOST TARGET binding site found in the 3' untranslated region of mRNA encoded by FZD10, corresponding to a HOST TARGET binding site such as BINDING SITE I, BINDING SITE II or BINDING SITE III. Table 2 illustrates the complementarity of the nucleotide sequences of FZD10 BINDING SITE, designated SEQ ID:14049, to the nucleotide sequence of VGAM676 RNA, herein designated VGAM RNA, also designated SEQ ID:3387.

Another function of VGAM676 is therefore inhibition of Frizzled Homolog 10 (Drosophila) (FZD10, Accession NM_007197). Accordingly, utilities of VGAM676 include diagnosis, prevention and treatment of diseases and clinical conditions associated with FZD10. Transforming, Acidic Coiled-coil Containing Protein 1 (TACC1, Accession NM_006283) is another VGAM676 host target gene. TACC1 BINDING SITE is HOST TARGET binding site found in the 3' untranslated region of mRNA encoded by TACC1, corresponding to a HOST TARGET binding site such as BINDING SITE I, BINDING SITE II or BINDING SITE III. Table 2 illustrates the complementarity of the nucleotide sequences of TACC1 BINDING SITE, designated SEQ ID:12959, to the nucleotide sequence of VGAM676 RNA, herein designated VGAM RNA, also designated SEQ ID:3387.

Another function of VGAM676 is therefore inhibition of Transforming, Acidic Coiled-coil Containing Protein 1 (TACC1, Accession NM_006283). Accordingly, utilities of VGAM676 include diagnosis, prevention and treatment of diseases and clinical conditions associated with TACC1. Wolf-Hirschhorn Syndrome Candidate 1 (WHSC1, Accession NM_133333) is another VGAM676 host target gene. WHSC1 BINDING SITE1 through WHSC1 BINDING SITE3 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE3, designated SEQ ID:28457, SEQ ID:28472 and SEQ ID:28440 respectively, to the nucleotide sequence of VGAM676 RNA, herein designated VGAM RNA, also designated SEQ ID:3387.

Another function of VGAM676 is therefore inhibition of Wolf-Hirschhorn Syndrome Candidate 1 (WHSC1, Accession NM_133333), a gene which binds covalently to and repairs g/t mismatches. Accordingly, utilities of VGAM676 include diagnosis, prevention and treatment of diseases and clinical conditions associated with WHSC1. The function of WHSC1 and its association with various diseases and clinical conditions, has been established by previous studies, as described hereinabove with reference to VGAM200. DEPP (Accession NM_007021) is another VGAM676 host target gene. DEPP BINDING SITE is HOST TARGET binding site found in the 3' untranslated region of mRNA encoded by DEPP, corresponding to a HOST TARGET binding site such as BINDING SITE I, BINDING SITE II or BINDING SITE III. Table 2 illustrates the complementarity of the nucleotide sequences of DEPP BINDING SITE, designated SEQ ID:13876, to the nucleotide sequence of VGAM676 RNA, herein designated VGAM RNA, also designated SEQ ID:3387.

Another function of VGAM676 is therefore inhibition of DEPP (Accession NM_007021). Accordingly, utilities of VGAM676 include diagnosis, prevention and treatment of diseases and clinical conditions associated with DEPP. DKFZP761I2123 (Accession NM_031449) is another VGAM676 host target gene. DKFZP761I2123 BINDING SITE is HOST TARGET binding site found in the 3' untranslated region of mRNA encoded by DKFZP761I2123, corresponding to a HOST TARGET binding site such as BINDING SITE I, BINDING SITE II or BINDING SITE III. Table 2 illustrates the complementarity of the nucleotide sequences of DKFZP761I2123 BINDING SITE, designated SEQ ID:25462, to the nucleotide sequence of VGAM676 RNA, herein designated VGAM RNA, also designated SEQ ID:3387.

Another function of VGAM676 is therefore inhibition of DKFZP761I2123 (Accession NM_031449). Accordingly, utilities of VGAM676 include diagnosis, prevention and treatment of diseases and clinical conditions associated with DKFZP761I2123. FLJ14768 (Accession NM_032836) is another VGAM676 host target gene. FLJ14768 BINDING SITE is HOST TARGET binding site found in the 3' untranslated region of mRNA encoded by FLJ14768, corresponding to a HOST TARGET binding site such as BINDING SITE I, BINDING SITE II or BINDING SITE III. Table 2 illustrates the complementarity of the nucleotide sequences of FLJ14768 BINDING SITE, designated SEQ ID:26616, to the nucleotide sequence of VGAM676 RNA, herein designated VGAM RNA, also designated SEQ ID:3387.

Another function of VGAM676 is therefore inhibition of FLJ14768 (Accession NM_032836). Accordingly, utilities of VGAM676 include diagnosis, prevention and treatment of diseases and clinical conditions associated with FLJ14768. GMPPB (Accession XM_171044) is another VGAM676 host target gene. GMPPB BINDING SITE is HOST TARGET binding site found in the 5" untranslated region of mRNA encoded by GMPPB, corresponding to a HOST TARGET binding site such as BINDING SITE I, BINDING SITE II or BINDING SITE III. Table 2 illustrates the complementarity of the nucleotide sequences of GMPPB BINDING SITE, designated SEQ ID:45815, to the nucleotide sequence of VGAM676 RNA, herein designated VGAM RNA, also designated SEQ ID:3387.

Another function of VGAM676 is therefore inhibition of GMPPB (Accession XM_171044). Accordingly, utilities of VGAM676 include diagnosis, prevention and treatment of diseases and clinical conditions associated with GMPPB. KIAA0335 (Accession NM_014803) is another VGAM676 host target gene. KIAA0335 BINDING SITE is HOST TARGET binding site found in the 3' untranslated region of mRNA encoded by KIAA0335, corresponding to a HOST TARGET binding site such as BINDING SITE I, BINDING SITE II or BINDING SITE III. Table 2 illustrates the complementarity of the nucleotide sequences of KIAA0335 BINDING SITE, designated SEQ ID:16730, to the nucleotide sequence of VGAM676 RNA, herein designated VGAM RNA, also designated SEQ ID:3387.

Another function of VGAM676 is therefore inhibition of KIAA0335 (Accession NM_014803). Accordingly, utilities of VGAM676 include diagnosis, prevention and treatment of diseases and clinical conditions associated with KIAA0335. KIAA1553 (Accession XM_166320) is another VGAM676 host target gene. KIAA1553 BINDING SITE is HOST TARGET binding site found in the 3' untranslated region of mRNA encoded by KIAA1553, corresponding to a HOST TARGET binding site such as BINDING SITE I, BINDING SITE II or BINDING SITE III. Table 2 illustrates the complementarity of the nucleotide sequences of KIAA1553 BINDING SITE, designated SEQ ID:44141, to the nucleotide sequence of VGAM676 RNA, herein designated VGAM RNA, also designated SEQ ID:3387.

Another function of VGAM676 is therefore inhibition of KIAA1553 (Accession XM_166320). Accordingly, utilities of VGAM676 include diagnosis, prevention and treatment of diseases and clinical conditions associated with KIAA1553. Rpo1-2 (Accession NM_019014) is another VGAM676 host target gene. Rpo1-2 BINDING SITE is HOST TARGET binding site found in the 3' untranslated region of mRNA encoded by Rpo1-2, corresponding to a HOST TARGET binding site such as BINDING SITE I, BINDING SITE II or BINDING SITE III. Table 2 illustrates the complementarity of the nucleotide sequences of Rpo1-2 BINDING SITE, designated SEQ ID:21101, to the nucleotide sequence of VGAM676 RNA, herein designated VGAM RNA, also designated SEQ ID:3387.

Another function of VGAM676 is therefore inhibition of Rpo1-2 (Accession NM_019014). Accordingly, utilities of VGAM676 include diagnosis, prevention and treatment of diseases and clinical conditions associated with Rpo1-2. Solute Carrier Family 17 (sodium-dependent inorganic phosphate cotransporter), Member 6 (SLC17A6, Accession NM_020346) is another VGAM676 host target gene. SLC17A6 BINDING SITE is HOST TARGET binding site found in the 3' untranslated region of mRNA encoded by SLC17A6, corresponding to a HOST TARGET binding site such as BINDING SITE I, BINDING SITE II or BINDING SITE III. Table 2 illustrates the complementarity of the nucleotide sequences of SLC17A6 BINDING SITE, designated SEQ ID:21593, to the nucleotide sequence of VGAM676 RNA, herein designated VGAM RNA, also designated SEQ ID:3387.

Another function of VGAM676 is therefore inhibition of Solute Carrier Family 17 (sodium-dependent inorganic phosphate cotransporter), Member 6 (SLC17A6, Accession NM_020346). Accordingly, utilities of VGAM676 include diagnosis, prevention and treatment of diseases and clinical conditions associated with SLC17A6. LOC143392 (Accession XM_096423) is another VGAM676 host target gene. LOC143392 BINDING SITE is HOST TARGET binding site found in the 5' untranslated region of mRNA encoded by LOC143392, corresponding to a HOST TARGET binding site such as BINDING SITE I, BINDING SITE II or BINDING SITE III. Table 2 illustrates the complementarity of the nucleotide sequences of LOC143392 BINDING SITE, designated SEQ ID:40357, to the nucleotide sequence of VGAM676 RNA, herein designated VGAM RNA, also designated SEQ ID:3387.

Another function of VGAM676 is therefore inhibition of LOC143392 (Accession XM_096423). Accordingly, utilities of VGAM676 include diagnosis, prevention and treatment of diseases and clinical conditions associated with LOC143392. LOC148189 (Accession XM_086087) is another VGAM676 host target gene. LOC148189 BINDING SITE is HOST TARGET binding site found in the 5' untranslated region of mRNA encoded by LOC148189, corresponding to a HOST TARGET binding site such as BINDING SITE I, BINDING SITE II or BINDING SITE III. Table 2 illustrates the complementarity of the nucleotide sequences of LOC148189 BINDING SITE, designated SEQ ID:38482, to the nucleotide sequence of VGAM676 RNA, herein designated VGAM RNA, also designated SEQ ID:3387.

Another function of VGAM676 is therefore inhibition of LOC148189 (Accession XM_086087). Accordingly, utilities of VGAM676 include diagnosis, prevention and treatment of diseases and clinical conditions associated with LOC148189. LOC149271 (Accession XM_086475) is another VGAM676 host target gene. LOC149271 BINDING SITE is HOST TARGET binding site found in the 5' untranslated region of mRNA encoded by LOC149271, corresponding to a HOST TARGET binding site such as BINDING SITE I, BINDING SITE II or BINDING SITE III. Table 2 illustrates the complementarity of the nucleotide sequences of LOC149271 BINDING SITE, designated SEQ ID:38678, to the nucleotide sequence of VGAM676 RNA, herein designated VGAM RNA, also designated SEQ ID:3387.

Another function of VGAM676 is therefore inhibition of LOC149271 (Accession XM_086475). Accordingly, utilities of VGAM676 include diagnosis, prevention and treatment of diseases and clinical conditions associated with LOC149271. LOC157623 (Accession XM_088346) is another VGAM676 host target gene. LOC157623 BINDING SITE is HOST TARGET binding site found in the 5' untranslated region of mRNA encoded by LOC157623, corresponding to a HOST TARGET binding site such as BINDING SITE I, BINDING SITE II or BINDING SITE III. Table 2 illustrates the complementarity of the nucleotide sequences of LOC157623 BINDING SITE, designated SEQ ID:39617, to the nucleotide sequence of VGAM676 RNA, herein designated VGAM RNA, also designated SEQ ID:3387.

Another function of VGAM676 is therefore inhibition of LOC157623 (Accession XM_088346). Accordingly, utilities of VGAM676 include diagnosis, prevention and treatment of diseases and clinical conditions associated with LOC157623. LOC203197 (Accession XM_114645) is another VGAM676 host target gene. LOC203197 BINDING SITE is HOST TARGET binding site found in the 3' untranslated region of mRNA encoded by LOC203197, corresponding to a HOST TARGET binding site such as BINDING SITE I, BINDING SITE II or BINDING SITE III. Table 2 illustrates the complementarity of the nucleotide sequences of LOC203197 BINDING SITE, designated SEQ ID:43010, to the nucleotide sequence of VGAM676 RNA, herein designated VGAM RNA, also designated SEQ ID:3387.

Another function of VGAM676 is therefore inhibition of LOC203197 (Accession XM_114645). Accordingly, utilities of VGAM676 include diagnosis, prevention and treatment of diseases and clinical conditions associated with LOC203197. FIG. 1 further provides a conceptual description of a novel bioinformatically detected viral gene of the present invention, referred to here as Viral Genomic Address Messenger 677 (VGAM677) viral gene, which modulates expression of respective host target genes thereof, the function and utility of which host target genes is known in the art.

VGAM677 is a novel bioinformatically detected regulatory, non protein coding, viral micro RNA (miRNA) gene. The method by which VGAM677 was detected is described hereinabove with reference to FIGS. 1-8.

VGAM677 gene, herein designated VGAM GENE, is a viral gene contained in the genome of Human Coronavirus 229E. VGAM677 host target gene, herein designated VGAM HOST TARGET GENE, is a human gene contained in the human genome.

VGAM677 gene encodes a VGAM677 precursor RNA, herein designated VGAM PRECURSOR RNA. Similar to other miRNA genes, and unlike most ordinary genes, VGAM677 precursor RNA does not encode a protein. A nucleotide sequence identical or highly similar to the nucleotide sequence of VGAM677 precursor RNA is designated SEQ ID:663, and is provided hereinbelow with reference to the sequence listing part. Nucleotide sequence SEQ ID:663 is located at position 4047 relative to the genome of Human Coronavirus 229E.

VGAM677 precursor RNA folds onto itself, forming VGAM677 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM677 folded precursor RNA into VGAM677 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM677 RNA is designated SEQ ID:3388, and is provided hereinbelow with reference to the sequence listing part.

VGAM677 host target gene, herein designated VGAM HOST TARGET GENE, encodes a corresponding messenger RNA, VGAM677 host target RNA, herein designated VGAM HOST TARGET RNA. VGAM677 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM677 RNA, herein designated VGAM RNA, binds complementarily to one or more host target binding sites located in untranslated regions of VGAM677 host target RNA, herein designated VGAM HOST TARGET RNA. This complementary binding is due to the fact that the nucleotide sequence of VGAM677 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM677 RNA, herein designated VGAM RNA, may have a different number of host target binding sites in untranslated regions of a VGAM677 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM677 RNA, herein designated VGAM RNA, to host target binding sites on VGAM677 host target RNA, herein designated VGAM HOST TARGET RNA, such as BINDING SITE I, BINDING SITE II and BINDING SITE III, inhibits translation of VGAM677 host target RNA into VGAM677 host target protein, herein designated VGAM HOST TARGET PROTEIN. VGAM host target protein is therefore outlined by a broken line.

It is appreciated that VGAM677 host target gene, herein designated VGAM HOST TARGET GENE, in fact represents a plurality of VGAM677 host target genes. The mRNA of each one of this plurality of VGAM677 host target genes comprises one or more host target binding sites, each having a nucleotide sequence which is at least partly complementary to VGAM677 RNA, herein designated VGAM RNA, and which when bound by VGAM677 RNA causes inhibition of translation of respective one or more VGAM677 host target proteins.

It is further appreciated by one skilled in the art that the mode of translational inhibition illustrated by FIG. 1 with specific reference to translational inhibition exerted by VGAM677 gene, herein designated VGAM GENE, on one or more VGAM677 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM677 is inhibition of expression of host target genes, as part of a novel viral mechanism of attacking a host. Accordingly, utilities of VGAM677 include diagnosis, prevention and treatment of viral infection by Human Coronavirus 229E. Specific functions, and accordingly utilities, of VGAM677 correlate with, and may be deduced from, the identity of the host target genes which VGAM677 binds and inhibits, and the function of these host target genes, as elaborated hereinbelow.

Nucleotide sequences of the VGAM677 precursor RNA, herein designated VGAM PRECURSOR RNA, and of the 'diced' VGAM677 RNA, herein designated VGAM RNA, and a schematic representation of the secondary folding of VGAM677 folded precursor RNA, herein designated VGAM FOLDED PRECURSOR RNA, of VGAM677 are further described hereinbelow with reference to Table 1.

Nucleotide sequences of host target binding sites, such as BINDING SITE-I, BINDING SITE-II and BINDING SITE-III of FIG. 1, found on VGAM677 host target RNA, and schematic representation of the complementarity of each of these host target binding sites to VGAM677 RNA, herein designated VGAM RNA, are described hereinbelow with reference to Table 2.

As mentioned hereinabove with reference to FIG. 1, a function of VGAM677 gene, herein designated VGAM is inhibition of expression of VGAM677 target genes. It is appreciated that specific functions, and accordingly utilities, of VGAM677 correlate with, and may be deduced from, the identity of the target genes which VGAM677 binds and inhibits, and the function of these target genes, as elaborated hereinbelow.

Adducin 1 (alpha) (ADD1, Accession NM_014189) is a VGAM677 host target gene. ADD1 BINDING SITE1 and ADD1 BINDING SITE2 are HOST TARGET binding sites found in untranslated regions of mRNA encoded by ADD1, corresponding to HOST TARGET binding sites such as BINDING SITE I, BINDING SITE II or BINDING SITE III. Table 2 illustrates the complementarity of the nucleotide sequences of ADD1 BINDING SITE1 and ADD1 BINDING SITE2, designated SEQ ID:15469 and SEQ ID:15473 respectively, to the nucleotide sequence of VGAM677 RNA, herein designated VGAM RNA, also designated SEQ ID:3388.

A function of VGAM677 is therefore inhibition of Adducin 1 (alpha) (ADD1, Accession NM_014189), a gene which membrane-cytoskeleton- protein that promotes the assembly of the spectrin-actin network. Accordingly, utilities of VGAM677 include diagnosis, prevention and treatment of diseases and clinical conditions associated with ADD1. The function of ADD1 and its association with various diseases and clinical conditions, has been established by previous studies, as described hereinabove with reference to VGAM474. FXYD Domain Containing Ion Transport Regulator 6 (FXYD6, Accession NM_022003) is another VGAM677 host target gene. FXYD6 BINDING SITE is HOST TARGET binding site found in the 3' untranslated region of mRNA encoded by FXYD6, corresponding to a HOST TARGET binding site such as BINDING SITE I, BINDING SITE II or BINDING SITE III. Table 2 illustrates the complementarity of the nucleotide sequences of FXYD6 BINDING SITE, designated SEQ ID:22551, to the nucleotide sequence of VGAM677 RNA, herein designated VGAM RNA, also designated SEQ ID:3388.

Another function of VGAM677 is therefore inhibition of FXYD Domain Containing Ion Transport Regulator 6 (FXYD6, Accession NM_022003). Accordingly, utilities of VGAM677 include diagnosis, prevention and treatment of diseases and clinical conditions associated with FXYD6. Hepatocyte Growth Factor (hepapoietin A; scatter factor) (HGF, Accession XM_168542) is another VGAM677 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45229, to the nucleotide sequence of VGAM677 RNA, herein designated VGAM RNA, also designated SEQ ID:3388.

Another function of VGAM677 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM677 include diagnosis, prevention and treatment of diseases and clinical conditions associated with HGF. The function of HGF and its association with various diseases and clinical conditions, has been established by previous studies, as described hereinabove with reference to VGAM174. Transient Receptor Potential Cation Channel, Subfamily V, Member 1 (TRPV1, Accession NM_080706) is another VGAM677 host target gene. TRPV1 BINDING SITE1 through TRPV1 BINDING SITE4 are HOST TARGET binding sites found in untranslated regions of mRNA encoded by TRPV1, corresponding to HOST TARGET binding sites such as BINDING SITE I, BINDING SITE II or BINDING SITE III. Table 2 illustrates the complementarity of the nucleotide sequences of TRPV1 BINDING SITE1 through TRPV1 BINDING SITE4, designated SEQ ID:28011, SEQ ID:27995, SEQ ID:28003 and SEQ ID:20815 respectively, to the nucleotide sequence of VGAM677 RNA, herein designated VGAM RNA, also designated SEQ ID:3388.

Another function of VGAM677 is therefore inhibition of Transient Receptor Potential Cation Channel, Subfamily V, Member 1 (TRPV1, Accession NM_080706), a gene which functions as a receptor for capsaicin. Accordingly, utilities of VGAM677 include diagnosis, prevention and treatment of diseases and clinical conditions associated with TRPV1. The function of TRPV1 and its association with various diseases and clinical conditions, has been established by previous studies, as described hereinabove with reference to VGAM146. KIAA0240 (Accession XM_166479) is another VGAM677 host target gene. KIAA0240 BINDING SITE is HOST TARGET binding site found in the 3' untranslated region of mRNA encoded by KIAA0240, corresponding to a HOST TARGET binding site such as BINDING SITE I, BINDING SITE II or BINDING SITE III. Table 2 illustrates the complementarity of the nucleotide sequences of KIAA0240 BINDING SITE, designated SEQ ID:44407, to the nucleotide sequence of VGAM677 RNA, herein designated VGAM RNA, also designated SEQ ID:3388.

Another function of VGAM677 is therefore inhibition of KIAA0240 (Accession XM_166479). Accordingly, utilities of VGAM677 include diagnosis, prevention and treatment of diseases and clinical conditions associated with KIAA0240. Phosphodiesterase 11A (PDE11A, Accession NM_016953) is another VGAM677 host target gene. PDE11A BINDING SITE is HOST TARGET binding site found in the 3' untranslated region of mRNA encoded by PDE11A, corresponding to a HOST TARGET binding site such as BINDING SITE I, BINDING SITE II or BINDING SITE III. Table 2 illustrates the complementarity of the nucleotide sequences of PDE11A BINDING SITE, designated SEQ ID:18868, to the nucleotide sequence of VGAM677 RNA, herein designated VGAM RNA, also designated SEQ ID:3388.

Another function of VGAM677 is therefore inhibition of Phosphodiesterase 11A (PDE11A, Accession NM_016953). Accordingly, utilities of VGAM677 include diagnosis, prevention and treatment of diseases and clinical conditions associated with PDE11A. LOC146268 (Accession XM_085397) is another VGAM677 host target gene. LOC146268 BINDING SITE is HOST TARGET binding site found in the 3' untranslated region of mRNA encoded by LOC146268, corresponding to a HOST TARGET binding site such as BINDING SITE I, BINDING SITE II or BINDING SITE III. Table 2 illustrates the complementarity of the nucleotide sequences of LOC146268 BINDING SITE, designated SEQ ID:38125, to the nucleotide sequence of VGAM677 RNA, herein designated VGAM RNA, also designated SEQ ID:3388.

Another function of VGAM677 is therefore inhibition of LOC146268 (Accession XM_085397). Accordingly, utilities of VGAM677 include diagnosis, prevention and treatment of diseases and clinical conditions associated with LOC146268. FIG. 1 further provides a conceptual description of a novel bioinformatically detected viral gene of the present invention, referred to here as Viral Genomic Address Messenger 678 (VGAM678) viral gene, which modulates expression of respective host target genes thereof, the function and utility of which host target genes is known in the art.

VGAM678 is a novel bioinformatically detected regulatory, non protein coding, viral micro RNA (miRNA) gene. The method by which VGAM678 was detected is described hereinabove with reference to FIGS. 1-8.

VGAM678 gene, herein designated VGAM GENE, is a viral gene contained in the genome of Human Coronavirus 229E. VGAM678 host target gene, herein designated VGAM HOST TARGET GENE, is a human gene contained in the human genome.

VGAM678 gene encodes a VGAM678 precursor RNA, herein designated VGAM PRECURSOR RNA. Similar to other miRNA genes, and unlike most ordinary genes, VGAM678 precursor RNA does not encode a protein. A nucleotide sequence identical or highly similar to the nucleotide sequence of VGAM678 precursor RNA is designated SEQ ID:664, and is provided hereinbelow with reference to the sequence listing part. Nucleotide sequence SEQ ID:664 is located at position 16921 relative to the genome of Human Coronavirus 229E.

VGAM678 precursor RNA folds onto itself, forming VGAM678 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM678 folded precursor RNA into VGAM678 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM678 RNA is designated SEQ ID:3389, and is provided hereinbelow with reference to the sequence listing part.

VGAM678 host target gene, herein designated VGAM HOST TARGET GENE, encodes a corresponding messenger RNA, VGAM678 host target RNA, herein designated VGAM HOST TARGET RNA. VGAM678 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM678 RNA, herein designated VGAM RNA, binds complementarily to one or more host target binding sites located in untranslated regions of VGAM678 host target RNA, herein designated VGAM HOST TARGET RNA. This complementary binding is due to the fact that the nucleotide sequence of VGAM678 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM678 RNA, herein designated VGAM RNA, may have a different number of host target binding sites in untranslated regions of a VGAM678 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM678 RNA, herein designated VGAM RNA, to host target binding sites on VGAM678 host target RNA, herein designated VGAM HOST TARGET RNA, such as BINDING SITE I, BINDING SITE II and BINDING SITE III, inhibits translation of VGAM678 host target RNA into VGAM678 host target protein, herein designated VGAM HOST TARGET PROTEIN. VGAM host target protein is therefore outlined by a broken line.

It is appreciated that VGAM678 host target gene, herein designated VGAM HOST TARGET GENE, in fact represents a plurality of VGAM678 host target genes. The mRNA of each one of this plurality of VGAM678 host target genes comprises one or more host target binding sites, each having a nucleotide sequence which is at least partly complementary to VGAM678 RNA, herein designated VGAM RNA, and which when bound by VGAM678 RNA causes inhibition of translation of respective one or more VGAM678 host target proteins.

It is further appreciated by one skilled in the art that the mode of translational inhibition illustrated by FIG. 1 with specific reference to translational inhibition exerted by VGAM678 gene, herein designated VGAM GENE, on one or more VGAM678 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM678 is inhibition of expression of host target genes, as part of a novel viral mechanism of attacking a host. Accordingly, utilities of VGAM678 include diagnosis, prevention and treatment of viral infection by Human Coronavirus 229E. Specific functions, and accordingly utilities, of VGAM678 correlate with, and may be deduced from, the identity of the host target genes which VGAM678 binds and inhibits, and the function of these host target genes, as elaborated hereinbelow.

Nucleotide sequences of the VGAM678 precursor RNA, herein designated VGAM PRECURSOR RNA, and of the 'diced' VGAM678 RNA, herein designated VGAM RNA, and a schematic representation of the secondary folding of VGAM678 folded precursor RNA, herein designated VGAM FOLDED PRECURSOR RNA, of VGAM678 are further described hereinbelow with reference to Table 1.

Nucleotide sequences of host target binding sites, such as BINDING SITE-I, BINDING SITE-II and BINDING SITE-III of FIG. 1, found on VGAM678 host target RNA, and schematic representation of the complementarity of each of these host target binding sites to VGAM678 RNA, herein designated VGAM RNA, are described hereinbelow with reference to Table 2.

As mentioned hereinabove with reference to FIG. 1, a function of VGAM678 gene, herein designated VGAM is inhibition of expression of VGAM678 target genes. It is appreciated that specific functions, and accordingly utilities, of VGAM678 correlate with, and may be deduced from, the identity of the target genes which VGAM678 binds and inhibits, and the function of these target genes, as elaborated hereinbelow.

Fibroblast Growth Factor 7 (keratinocyte growth factor) (FGF7, Accession NM_002009) is a VGAM678 host target gene. FGF7 BINDING SITE is HOST TARGET binding site found in the 3' untranslated region of mRNA encoded by FGF7, corresponding to a HOST TARGET binding site such as BINDING SITE I, BINDING SITE II or BINDING SITE III. Table 2 illustrates the complementarity of the nucleotide sequences of FGF7 BINDING SITE, designated SEQ ID:7747, to the nucleotide sequence of VGAM678 RNA, herein designated VGAM RNA, also designated SEQ ID:3389.

A function of VGAM678 is therefore inhibition of Fibroblast Growth Factor 7 (keratinocyte growth factor) (FGF7, Accession NM_002009), a gene which growth factor active on keratinocytes. Accordingly, utilities of VGAM678 include diagnosis, prevention and treatment of diseases and clinical conditions associated with FGF7. The function of FGF7 has been established by previous studies. Rubin et al. (1989) identified a growth factor specific for epithelial cells in conditioned medium of a human embryonic lung fibroblast cell line. Because of its predominant activity in keratinocytes, it was referred to as keratinocyte growth factor. KGF was found to consist of a single polypeptide chain of about 28 kD. It was a potent mitogen for epithelial cells but lacked mitogenic activity on either fibroblasts or endothelial cells. Microsequencing showed an amino-terminal sequence containing no significant homology to any known protein. The release of this growth factor by human embryonic fibroblasts raised the possibility that KGF may play a role in mesenchymal stimulation of normal epithelial cell proliferation. In an addendum, Rubin et al. (1989) noted that by use of all the nucleotide probes based on the N-terminal sequence reported in their paper, they had isolated clones encoding KGF and had found significant structural homology between KGF and the other 5 known members of the fibroblast growth factor (FGF) family. Werner et al. (1994) assessed the function of KGF in normal and wounded skin by expression of a dominant-negative KGF receptor (OMIM Ref. No. 176943) in basal keratinocytes. The skin of transgenic mice was characterized by epidermal atrophy, abnormalities in the hair follicles, and dermal hyperthickening. Upon skin injury, inhibition of KGF receptor signaling reduced the proliferation rate of epidermal keratinocytes at the wound edge, resulting in substantially delayed reepithelialization of the wound. Using a cosmid probe encoding KGF exon 1 for fluorescence in situ hybridization, Zimonjic et al. (1997) assigned the KGF7 gene to 15q15-q21.1. In addition, copies of KGF-like sequences hybridizing only with a cosmid probe encoding exons 2 and 3 were localized to dispersed sites on chromosome 2q21, 9p11, 9q12-q13, 18p11, 18q11, 21q11, and 21q21.1. The distribution of KGF-like sequences suggested a role for alphoid DNA in their amplification and dispersion. In chimpanzee, KGF-like sequences were observed at 5 chromosomal sites, which were each homologous to sites in human, while in gorilla a subset of 4 of these homologous sites was identified. In orangutan 2 sites were identified, while gibbon exhibited only a single site. The chromosomal localization of KGF sequences in human and great ape genomes indicated that amplification and dispersion occurred in multiple discrete steps, with initial KGF gene duplication and dispersion occurring in multiple discrete steps, with initial KGF gene duplication and dispersion taking place in gibbon and involving loci corresponding to human chromosomes 15 and 21. The findings of Zimonjic et al. (1997) supported the concept of a closer evolutionary relationship of human with chimpanzee and with primates and a possible selective pressure for KGF dispersion during the evolution of higher primates.

Full details of the abovementioned studies are described in the following publications, the disclosure of which are hereby incorporated by reference:

Rubin, J. S.; Osada, H.; Finch, P. W.; Taylor, W. G.; Rudikoff, S.; Aaronson, S. A.: Purification and characterization of a newly identified growth factor specific for epithelial cells. Proc. Nat. Acad. Sci. 86:802-806, 1989; and Werner, S.; Smola, H.; Liao, X.; Longaker, M. T.; Krieg, T.; Hofschneider, P. H.; Williams, L. T.: The function of KGF in morphogenesis of epithelium and reepithelialization of wounds.

Further studies establishing the function and utilities of FGF7 are found in John Hopkins OMIM database record ID 148180, and in sited publications numbered 11377-11381 listed in the bibliography section hereinbelow, which are also hereby incorporated by reference. Integrin, Alpha 1 (ITGA1, Accession XM_032902) is another VGAM678 host target gene. ITGA1 BINDING SITE is HOST TARGET binding site found in the 3' untranslated region of mRNA encoded by ITGA1, corresponding to a HOST TARGET binding site such as BINDING SITE I, BINDING SITE II or BINDING SITE III. Table 2 illustrates the complementarity of the nucleotide sequences of ITGA1 BINDING SITE, designated SEQ ID:31792, to the nucleotide sequence of VGAM678 RNA, herein designated VGAM RNA, also designated SEQ ID:3389.

Another function of VGAM678 is therefore inhibition of Integrin, Alpha 1 (ITGA1, Accession XM_032902). Accordingly, utilities of VGAM678 include diagnosis, prevention and treatment of diseases and clinical conditions associated with ITGA1. Chromosome 20 Open Reading Frame 64 (C20orf64, Accession NM_033550) is another VGAM678 host target gene. C20orf64 BINDING SITE is HOST TARGET binding site found in the 3' untranslated region of mRNA encoded by C20orf64, corresponding to a HOST TARGET binding site such as BINDING SITE I, BINDING SITE II or BINDING SITE III. Table 2 illustrates the complementarity of the nucleotide sequences of C20orf64 BINDING SITE, designated SEQ ID:27309, to the nucleotide sequence of VGAM678 RNA, herein designated VGAM RNA, also designated SEQ ID:3389.

Another function of VGAM678 is therefore inhibition of Chromosome 20 Open Reading Frame 64 (C20orf64, Accession NM_033550). Accordingly, utilities of VGAM678 include diagnosis, prevention and treatment of diseases and clinical conditions associated with C20orf64. Sialyltransferase 8D (alpha-2, 8-polysialytransferase) (SIAT8D, Accession NM_005668) is another VGAM678 host target gene. SIAT8D BINDING SITE is HOST TARGET binding site found in the 3' untranslated region of mRNA encoded by SIAT8D, corresponding to a HOST TARGET binding site such as BINDING SITE I, BINDING SITE II or BINDING SITE III. Table 2 illustrates the complementarity of the nucleotide sequences of SIAT8D BINDING SITE, designated SEQ ID:12222, to the nucleotide sequence of VGAM678 RNA, herein designated VGAM RNA, also designated SEQ ID:3389.

Another function of VGAM678 is therefore inhibition of Sialyltransferase 8D (alpha-2, 8-polysialytransferase) (SIAT8D, Accession NM_005668). Accordingly, utilities of VGAM678 include diagnosis, prevention and treatment of diseases and clinical conditions associated with SIAT8D. SNIP1 (Accession NM_024700) is another VGAM678 host target gene. SNIP1 BINDING SITE is HOST TARGET binding site found in the 3' untranslated region of mRNA encoded by SNIP1, corresponding to a HOST TARGET binding site such as BINDING SITE I, BINDING SITE II or BINDING SITE III. Table 2 illustrates the complementarity of the nucleotide sequences of SNIP1 BINDING SITE, designated SEQ ID:24010, to the nucleotide sequence of VGAM678 RNA, herein designated VGAM RNA, also designated SEQ ID:3389.

Another function of VGAM678 is therefore inhibition of SNIP1 (Accession NM_024700). Accordingly, utilities of VGAM678 include diagnosis, prevention and treatment of diseases and clinical conditions associated with SNIP1.

LOC120448 (Accession XM_062032) is another VGAM678 host target gene. LOC120448 BINDING SITE is HOST TARGET binding site found in the 5' untranslated region of mRNA encoded by LOC120448, corresponding to a HOST TARGET binding site such as BINDING SITE I, BINDING SITE II or BINDING SITE III. Table 2 illustrates the complementarity of the nucleotide sequences of LOC120448 BINDING SITE, designated SEQ ID:37221, to the nucleotide sequence of VGAM678 RNA, herein designated VGAM RNA, also designated SEQ ID:3389.

Another function of VGAM678 is therefore inhibition of LOC120448 (Accession XM_062032). Accordingly, utilities of VGAM678 include diagnosis, prevention and treatment of diseases and clinical conditions associated with LOC120448.

LOC145216 (Accession XM_096730) is another VGAM678 host target gene. LOC145216 BINDING SITE is HOST TARGET binding site found in the 3' untranslated region of mRNA encoded by LOC145216, corresponding to a HOST TARGET binding site such as BINDING SITE I, BINDING SITE II or BINDING SITE III. Table 2 illustrates the complementarity of the nucleotide sequences of LOC145216 BINDING SITE, designated SEQ ID:40504, to the nucleotide sequence of VGAM678 RNA, herein designated VGAM RNA, also designated SEQ ID:3389.

Another function of VGAM678 is therefore inhibition of LOC145216 (Accession XM_096730). Accordingly, utilities of VGAM678 include diagnosis, prevention and treatment of diseases and clinical conditions associated with LOC145216.

LOC154743 (Accession XM_088029) is another VGAM678 host target gene. LOC154743 BINDING SITE is HOST TARGET binding site found in the 3' untranslated region of mRNA encoded by LOC154743, corresponding to a HOST TARGET binding site such as BINDING SITE I, BINDING SITE II or BINDING SITE III. Table 2 illustrates the complementarity of the nucleotide sequences of LOC154743 BINDING SITE, designated SEQ ID:39481, to the nucleotide sequence of VGAM678 RNA, herein designated VGAM RNA, also designated SEQ ID:3389.

Another function of VGAM678 is therefore inhibition of LOC154743 (Accession XM_088029). Accordingly, utilities of VGAM678 include diagnosis, prevention and treatment of diseases and clinical conditions associated with LOC154743.

LOC196812 (Accession XM_116868) is another VGAM678 host target gene. LOC196812 BINDING SITE is HOST TARGET binding site found in the 3' untranslated region of mRNA encoded by LOC196812, corresponding to a HOST TARGET binding site such as BINDING SITE I, BINDING SITE II or BINDING SITE III. Table 2 illustrates the complementarity of the nucleotide sequences of LOC196812 BINDING SITE, designated SEQ ID:43134, to the nucleotide sequence of VGAM678 RNA, herein designated VGAM RNA, also designated SEQ ID:3389.

Another function of VGAM678 is therefore inhibition of LOC196812 (Accession XM_116868). Accordingly, utilities of VGAM678 include diagnosis, prevention and treatment of diseases and clinical conditions associated with LOC196812.

FIG. 1 further provides a conceptual description of a novel bioinformatically detected viral gene of the present invention, referred to here as Viral Genomic Address Messenger 679 (VGAM679) viral gene, which modulates expression of respective host target genes thereof, the function and utility of which host target genes is known in the art.

VGAM679 is a novel bioinformatically detected regulatory, non protein coding, viral micro RNA (miRNA) gene. The method by which VGAM679 was detected is described hereinabove with reference to FIGS. 1-8.

VGAM679 gene, herein designated VGAM GENE, is a viral gene contained in the genome of Human Coronavirus 229E. VGAM679 host target gene, herein designated VGAM HOST TARGET GENE, is a human gene contained in the human genome.

VGAM679 gene encodes a VGAM679 precursor RNA, herein designated VGAM PRECURSOR RNA. Similar to other miRNA genes, and unlike most ordinary genes, VGAM679 precursor RNA does not encode a protein. A nucleotide sequence identical or highly similar to the nucleotide sequence of VGAM679 precursor RNA is designated SEQ ID:665, and is provided hereinbelow with reference to the sequence listing part. Nucleotide sequence SEQ ID:665 is located at position 1569 relative to the genome of Human Coronavirus 229E.

VGAM679 precursor RNA folds onto itself, forming VGAM679 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM679 folded precursor RNA into VGAM679 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM679 RNA is designated SEQ ID:3390, and is provided hereinbelow with reference to the sequence listing part.

VGAM679 host target gene, herein designated VGAM HOST TARGET GENE, encodes a corresponding messenger RNA, VGAM679 host target RNA, herein designated VGAM HOST TARGET RNA. VGAM679 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM679 RNA, herein designated VGAM RNA, binds complementarily to one or more host target binding sites located in untranslated regions of VGAM679 host target RNA, herein designated VGAM HOST TARGET RNA. This complementary binding is due to the fact that the nucleotide sequence of VGAM679 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM679 RNA, herein designated VGAM RNA, may have a different number of host target binding sites in untranslated regions of a VGAM679 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM679 RNA, herein designated VGAM RNA, to host target binding sites on VGAM679 host target RNA, herein designated VGAM HOST TARGET RNA, such as BINDING SITE I, BINDING SITE II and BINDING SITE III, inhibits translation of VGAM679 host target RNA into VGAM679 host target protein, herein designated VGAM HOST TARGET PROTEIN. VGAM host target protein is therefore outlined by a broken line.

It is appreciated that VGAM679 host target gene, herein designated VGAM HOST TARGET GENE, in fact represents a plurality of VGAM679 host target genes. The mRNA of each one of this plurality of VGAM679 host target genes comprises one or more host target binding sites, each having a nucleotide sequence which is at least partly complementary to VGAM679 RNA, herein designated VGAM RNA, and which when bound by VGAM679 RNA causes inhibition of translation of respective one or more VGAM679 host target proteins.

It is further appreciated by one skilled in the art that the mode of translational inhibition illustrated by FIG. 1 with specific reference to translational inhibition exerted by VGAM679 gene, herein designated VGAM GENE, on one or more VGAM679 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM679 is inhibition of expression of host target genes, as part of a novel viral mechanism of attacking a host. Accordingly, utilities of VGAM679 include diagnosis, prevention and treatment of viral infection by Human Coronavirus 229E. Specific functions, and accordingly utilities, of VGAM679 correlate with, and may be deduced from, the identity of the host target genes which VGAM679 binds and inhibits, and the function of these host target genes, as elaborated hereinbelow.

Nucleotide sequences of the VGAM679 precursor RNA, herein designated VGAM PRECURSOR RNA, and of the 'diced' VGAM679 RNA, herein designated VGAM RNA, and a schematic representation of the secondary folding of VGAM679 folded precursor RNA, herein designated VGAM FOLDED PRECURSOR RNA, of VGAM679 are further described hereinbelow with reference to Table 1.

Nucleotide sequences of host target binding sites, such as BINDING SITE-I, BINDING SITE-II and BINDING SITE-III of FIG. 1, found on VGAM679 host target RNA, and schematic representation of the complementarity of each of these host target binding sites to VGAM679 RNA, herein designated VGAM RNA, are described hereinbelow with reference to Table 2.

As mentioned hereinabove with reference to FIG. 1, a function of VGAM679 gene, herein designated VGAM is inhibition of expression of VGAM679 target genes. It is appreciated that specific functions, and accordingly utilities, of VGAM679 correlate with, and may be deduced from, the identity of the target genes which VGAM679 binds and inhibits, and the function of these target genes, as elaborated hereinbelow.

V-abl Abelson Murine Leukemia Viral Oncogene Homolog 1 (ABL1, Accession NM_005157) is a VGAM679 host target gene. ABL1 BINDING SITE1 and ABL1 BINDING SITE2 are HOST TARGET binding sites found in untranslated regions of mRNA encoded by ABL1, corresponding to HOST TARGET binding sites such as BINDING SITE I, BINDING SITE II or BINDING SITE III. Table 2 illustrates the complementarity of the nucleotide sequences of ABL1 BINDING SITE1 and ABL1 BINDING SITE2, designated SEQ ID:11635 and SEQ ID:14224 respectively, to the nucleotide sequence of VGAM679 RNA, herein designated VGAM RNA, also designated SEQ ID:3390.

A function of VGAM679 is therefore inhibition of V-abl Abelson Murine Leukemia Viral Oncogene Homolog 1 (ABL1, Accession NM_005157). Accordingly, utilities of VGAM679 include diagnosis, prevention and treatment of diseases and clinical conditions associated with ABL1. Parkinson Disease (autosomal recessive, juvenile) 2, Parkin (PARK2, Accession NM_013988) is another VGAM679 host target gene. PARK2 BINDING SITE1 through PARK2 BINDING SITE3 are HOST TARGET binding sites found in untranslated regions of mRNA encoded by PARK2, corresponding to HOST TARGET binding sites such as BINDING SITE I, BINDING SITE II or BINDING SITE III. Table 2 illustrates the complementarity of the nucleotide sequences of PARK2 BINDING SITE1 through PARK2 BINDING SITE3, designated SEQ ID:15155, SEQ ID:10901 and SEQ ID:15148 respectively, to the nucleotide sequence of VGAM679 RNA, herein designated VGAM RNA, also designated SEQ ID:3390.

Another function of VGAM679 is therefore inhibition of Parkinson Disease (autosomal recessive, juvenile) 2, Parkin (PARK2, Accession NM_013988). Accordingly, utilities of VGAM679 include diagnosis, prevention and treatment of diseases and clinical conditions associated with PARK2. SAC2 Suppressor of Actin Mutations 2-like (yeast) (SACM2L, Accession NM_080564) is another VGAM679 host target gene. SACM2L BINDING SITE1 and SACM2L BINDING SITE2 are HOST TARGET binding sites found in untranslated regions of mRNA encoded by SACM2L, corresponding to HOST TARGET binding sites such as BINDING SITE I, BINDING SITE II or BINDING SITE III. Table 2 illustrates the complementarity of the nucleotide sequences of SACM2L BINDING SITE1 and SACM2L BINDING SITE2, designated SEQ ID:27885 and SEQ ID:21841 respectively, to the nucleotide sequence of VGAM679 RNA, herein designated VGAM RNA, also designated SEQ ID:3390.

Another function of VGAM679 is therefore inhibition of SAC2 Suppressor of Actin Mutations 2-like (yeast) (SACM2L, Accession NM_080564). Accordingly, utilities of VGAM679 include diagnosis, prevention and treatment of diseases and clinical conditions associated with SACM2L. FIG. 1 further provides a conceptual description of a novel bioinformatically detected viral gene of the present invention, referred to here as Viral Genomic Address Messenger 680 (VGAM680) viral gene, which modulates expression of respective host target genes thereof, the function and utility of which host target genes is known in the art.

VGAM680 is a novel bioinformatically detected regulatory, non protein coding, viral micro RNA (miRNA) gene. The method by which VGAM680 was detected is described hereinabove with reference to FIGS. 1-8.

VGAM680 gene, herein designated VGAM GENE, is a viral gene contained in the genome of Human Coronavirus 229E. VGAM680 host target gene, herein designated VGAM HOST TARGET GENE, is a human gene contained in the human genome.

VGAM680 gene encodes a VGAM680 precursor RNA, herein designated VGAM PRECURSOR RNA. Similar to other miRNA genes, and unlike most ordinary genes, VGAM680 precursor RNA does not encode a protein. A nucleotide sequence identical or highly similar to the nucleotide sequence of VGAM680 precursor RNA is designated SEQ ID:666, and is provided hereinbelow with reference to the sequence listing part. Nucleotide sequence SEQ ID:666 is located at position 14292 relative to the genome of Human Coronavirus 229E.

VGAM680 precursor RNA folds onto itself, forming VGAM680 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM680 folded precursor RNA into VGAM680 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM680 RNA is designated SEQ ID:3391, and is provided hereinbelow with reference to the sequence listing part.

VGAM680 host target gene, herein designated VGAM HOST TARGET GENE, encodes a corresponding messenger RNA, VGAM680 host target RNA, herein designated VGAM HOST TARGET RNA. VGAM680 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM680 RNA, herein designated VGAM RNA, binds complementarily to one or more host target binding sites located in untranslated regions of VGAM680 host target RNA, herein designated VGAM HOST TARGET RNA. This complementary binding is due to the fact that the nucleotide sequence of VGAM680 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM680 RNA, herein designated VGAM RNA, may have a different number of host target binding sites in untranslated regions of a VGAM680 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM680 RNA, herein designated VGAM RNA, to host target binding sites on VGAM680 host target RNA, herein designated VGAM HOST TARGET RNA, such as BINDING SITE I, BINDING SITE II and BINDING SITE III, inhibits translation of VGAM680 host target RNA into VGAM680 host target protein, herein designated VGAM HOST TARGET PROTEIN. VGAM host target protein is therefore outlined by a broken line.

It is appreciated that VGAM680 host target gene, herein designated VGAM HOST TARGET GENE, in fact represents a plurality of VGAM680 host target genes. The mRNA of each one of this plurality of VGAM680 host target genes comprises one or more host target binding sites, each having a nucleotide sequence which is at least partly complementary to VGAM680 RNA, herein designated VGAM RNA, and which when bound by VGAM680 RNA causes inhibition of translation of respective one or more VGAM680 host target proteins.

It is further appreciated by one skilled in the art that the mode of translational inhibition illustrated by FIG. 1 with specific reference to translational inhibition exerted by VGAM680 gene, herein designated VGAM GENE, on one or more VGAM680 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM680 is inhibition of expression of host target genes, as part of a novel viral mechanism of attacking a host. Accordingly, utilities of VGAM680 include diagnosis, prevention and treatment of viral infection by Human Coronavirus 229E. Specific functions, and accordingly utilities, of VGAM680 correlate with, and may be deduced from, the identity of the host target genes which VGAM680 binds and inhibits, and the function of these host target genes, as elaborated hereinbelow.

Nucleotide sequences of the VGAM680 precursor RNA, herein designated VGAM PRECURSOR RNA, and of the 'diced' VGAM680 RNA, herein designated VGAM RNA, and a schematic representation of the secondary folding of VGAM680 folded precursor RNA, herein designated VGAM FOLDED PRECURSOR RNA, of VGAM680 are further described hereinbelow with reference to Table 1.

Nucleotide sequences of host target binding sites, such as BINDING SITE-I, BINDING SITE-II and BINDING SITE-III of FIG. 1, found on VGAM680 host target RNA, and schematic representation of the complementarity of each of these host target binding sites to VGAM680 RNA, herein designated VGAM RNA, are described hereinbelow with reference to Table 2.

As mentioned hereinabove with reference to FIG. 1, a function of VGAM680 gene, herein designated VGAM is inhibition of expression of VGAM680 target genes. It is appreciated that specific functions, and accordingly utilities, of VGAM680 correlate with, and may be deduced from, the identity of the target genes which VGAM680 binds and inhibits, and the function of these target genes, as elaborated hereinbelow.

ATPase, H+ Transporting, Lysosomal 13 kDa, V1 Subunit G Isoform 2 (ATP6V1G2, Accession NM_130463) is a VGAM680 host target gene. ATP6V1G2 BINDING SITE is HOST TARGET binding site found in the 5' untranslated region of mRNA encoded by ATP6V1G2, corresponding to a HOST TARGET binding site such as BINDING SITE I, BINDING SITE II or BINDING SITE III. Table 2 illustrates the complementarity of the nucleotide sequences of ATP6V1G2 BINDING SITE, designated SEQ ID:28224, to the nucleotide sequence of VGAM680 RNA, herein designated VGAM RNA, also designated SEQ ID:3391.

A function of VGAM680 is therefore inhibition of ATPase, H+ Transporting, Lysosomal 13 kDa, V1 Subunit G Isoform 2 (ATP6V1G2, Accession NM_130463). Accordingly, utilities of VGAM680 include diagnosis, prevention and treatment of diseases and clinical conditions associated with ATP6V1G2. Inositol 1,4,5-triphosphate Receptor, Type 2 (ITPR2, Accession NM_002223) is another VGAM680 host target gene. ITPR2 BINDING SITE is HOST TARGET binding site found in the 3' untranslated region of mRNA encoded by ITPR2, corresponding to a HOST TARGET binding site such as BINDING SITE I, BINDING SITE II or BINDING SITE III. Table 2 illustrates the complementarity of the nucleotide sequences of ITPR2 BINDING SITE, designated SEQ ID:7988, to the nucleotide sequence of VGAM680 RNA, herein designated VGAM RNA, also designated SEQ ID:3391.

Another function of VGAM680 is therefore inhibition of Inositol 1,4,5-triphosphate Receptor, Type 2 (ITPR2, Accession NM_002223). Accordingly, utilities of VGAM680 include diagnosis, prevention and treatment of diseases and clinical conditions associated with ITPR2. PSA (Accession NM_021154) is another VGAM680 host target gene. PSA BINDING SITE1 and PSA BINDING SITE2 are HOST TARGET binding sites found in untranslated regions of mRNA encoded by PSA, corresponding to HOST TARGET binding sites such as BINDING SITE I, BINDING SITE II or BINDING SITE III. Table 2 illustrates the complementarity of the nucleotide sequences of PSA BINDING SITE1 and PSA BINDING SITE2, designated SEQ ID:22128 and SEQ ID:27737 respectively, to the nucleotide sequence of VGAM680 RNA, herein designated VGAM RNA, also designated SEQ ID:3391.

Another function of VGAM680 is therefore inhibition of PSA (Accession NM_021154), a gene which is puromycin-sensitive aminopeptidase and has metallopeptidase activity. Accordingly, utilities of VGAM680 include diagnosis, prevention and treatment of diseases and clinical conditions associated with PSA. The function of PSA and its association with various diseases and clinical conditions, has been established by previous studies, as described hereinabove with reference to VGAM65. LOC146455 (Accession XM_085471) is another VGAM680 host target gene. LOC146455 BINDING SITE is HOST TARGET binding site found in the 5' untranslated region of mRNA encoded by LOC146455, corresponding to a HOST TARGET binding site such as BINDING SITE I, BINDING SITE II or BINDING SITE III. Table 2 illustrates the complementarity of the nucleotide sequences of LOC146455 BINDING SITE, designated SEQ ID:38155, to the nucleotide sequence of VGAM680 RNA, herein designated VGAM RNA, also designated SEQ ID:3391.

Another function of VGAM680 is therefore inhibition of LOC146455 (Accession XM_085471). Accordingly, utilities of VGAM680 include diagnosis, prevention and treatment of diseases and clinical conditions associated with LOC146455. FIG. 1 further provides a conceptual description of a novel bioinformatically detected viral gene of the present invention, referred to here as Viral Genomic Address Messenger 681 (VGAM681) viral gene, which modulates expression of respective host target genes thereof, the function and utility of which host target genes is known in the art.

VGAM681 is a novel bioinformatically detected regulatory, non protein coding, viral micro RNA (miRNA) gene. The method by which VGAM681 was detected is described hereinabove with reference to FIGS. 1-8.

VGAM681 gene, herein designated VGAM GENE, is a viral gene contained in the genome of Human Coronavirus 229E. VGAM681 host target gene, herein designated VGAM HOST TARGET GENE, is a human gene contained in the human genome.

VGAM681 gene encodes a VGAM681 precursor RNA, herein designated VGAM PRECURSOR RNA. Similar to other miRNA genes, and unlike most ordinary genes, VGAM681 precursor RNA does not encode a protein. A nucleotide sequence identical or highly similar to the nucleotide sequence of VGAM681 precursor RNA is designated SEQ ID:667, and is provided hereinbelow with reference to the sequence listing part. Nucleotide sequence SEQ ID:667 is located at position 9140 relative to the genome of Human Coronavirus 229E.

VGAM681 precursor RNA folds onto itself, forming VGAM681 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM681 folded precursor RNA into VGAM681 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM681 RNA is designated SEQ ID:3392, and is provided hereinbelow with reference to the sequence listing part.

VGAM681 host target gene, herein designated VGAM HOST TARGET GENE, encodes a corresponding messenger RNA, VGAM681 host target RNA, herein designated VGAM HOST TARGET RNA. VGAM681 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM681 RNA, herein designated VGAM RNA, binds complementarily to one or more host target binding sites located in untranslated regions of VGAM681 host target RNA, herein designated VGAM HOST TARGET RNA. This complementary binding is due to the fact that the nucleotide sequence of VGAM681 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM681 RNA, herein designated VGAM RNA, may have a different number of host target binding sites in untranslated regions of a VGAM681 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM681 RNA, herein designated VGAM RNA, to host target binding sites on VGAM681 host target RNA, herein designated VGAM HOST TARGET RNA, such as BINDING SITE I, BINDING SITE II and BINDING SITE III, inhibits translation of VGAM681 host target RNA into VGAM681 host target protein, herein designated VGAM HOST TARGET PROTEIN.

VGAM host target protein is therefore outlined by a broken line.

It is appreciated that VGAM681 host target gene, herein designated VGAM HOST TARGET GENE, in fact represents a plurality of VGAM681 host target genes. The mRNA of each one of this plurality of VGAM681 host target genes comprises one or more host target binding sites, each having a nucleotide sequence which is at least partly complementary to VGAM681 RNA, herein designated VGAM RNA, and which when bound by VGAM681 RNA causes inhibition of translation of respective one or more VGAM681 host target proteins.

It is further appreciated by one skilled in the art that the mode of translational inhibition illustrated by FIG. 1 with specific reference to translational inhibition exerted by VGAM681 gene, herein designated VGAM GENE, on one or more VGAM681 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM681 is inhibition of expression of host target genes, as part of a novel viral mechanism of attacking a host. Accordingly, utilities of VGAM681 include diagnosis, prevention and treatment of viral infection by Human Coronavirus 229E. Specific functions, and accordingly utilities, of VGAM681 correlate with, and may be deduced from, the identity of the host target genes which VGAM681 binds and inhibits, and the function of these host target genes, as elaborated hereinbelow.

Nucleotide sequences of the VGAM681 precursor RNA, herein designated VGAM PRECURSOR RNA, and of the 'diced' VGAM681 RNA, herein designated VGAM RNA, and a schematic representation of the secondary folding of VGAM681 folded precursor RNA, herein designated VGAM FOLDED PRECURSOR RNA, of VGAM681 are further described hereinbelow with reference to Table 1.

Nucleotide sequences of host target binding sites, such as BINDING SITE-I, BINDING SITE-II and BINDING SITE-III of FIG. 1, found on VGAM681 host target RNA, and schematic representation of the complementarity of each of these host target binding sites to VGAM681 RNA, herein designated VGAM RNA, are described hereinbelow with reference to Table 2.

As mentioned hereinabove with reference to FIG. 1, a function of VGAM681 gene, herein designated VGAM is inhibition of expression of VGAM681 target genes. It is appreciated that specific functions, and accordingly utilities, of VGAM681 correlate with, and may be deduced from, the identity of the target genes which VGAM681 binds and inhibits, and the function of these target genes, as elaborated hereinbelow.

NKX3A (Accession NM_006167) is a VGAM681 host target gene. NKX3A BINDING SITE is HOST TARGET binding site found in the 3' untranslated region of mRNA encoded by NKX3A, corresponding to a HOST TARGET binding site such as BINDING SITE I, BINDING SITE II or BINDING SITE III. Table 2 illustrates the complementarity of the nucleotide sequences of NKX3A BINDING SITE, designated SEQ ID:12830, to the nucleotide sequence of VGAM681 RNA, herein designated VGAM RNA, also designated SEQ ID:3392.

A function of VGAM681 is therefore inhibition of NKX3A (Accession NM_006167), a gene which may regulate gene expression and control cell differentiation. Accordingly, utilities of VGAM681 include diagnosis, prevention and treatment of diseases and clinical conditions associated with NKX3A. The function of NKX3A and its association with various diseases and clinical conditions, has been established by previous studies, as described hereinabove with reference to VGAM481. Ankyrin Repeat and SOCS Box-containing 13 (ASB13, Accession NM_024701) is another VGAM681 host target gene. ASB13 BINDING SITE is HOST TARGET binding site found in the 3' untranslated region of mRNA encoded by ASB13, corresponding to a HOST TARGET binding site such as BINDING SITE I, BINDING SITE II or BINDING SITE III. Table 2 illustrates the complementarity of the nucleotide sequences of ASB13 BINDING SITE, designated SEQ ID:24011, to the nucleotide sequence of VGAM681 RNA, herein designated VGAM RNA, also designated SEQ ID:3392.

Another function of VGAM681 is therefore inhibition of Ankyrin Repeat and SOCS Box-containing 13 (ASB13, Accession NM_024701). Accordingly, utilities of VGAM681 include diagnosis, prevention and treatment of diseases and clinical conditions associated with ASB13. FLJ20273 (Accession NM_019027) is another VGAM681 host target gene. FLJ20273 BINDING SITE is HOST TARGET binding site found in the 3' untranslated region of mRNA encoded by FLJ20273, corresponding to a HOST TARGET binding site such as BINDING SITE I, BINDING SITE II or BINDING SITE III. Table 2 illustrates the complementarity of the nucleotide sequences of FLJ20273 BINDING SITE, designated SEQ ID:21113, to the nucleotide sequence of VGAM681 RNA, herein designated VGAM RNA, also designated SEQ ID:3392.

Another function of VGAM681 is therefore inhibition of FLJ20273 (Accession NM_019027). Accordingly, utilities of VGAM681 include diagnosis, prevention and treatment of diseases and clinical conditions associated with FLJ20273. KIAA1336 (Accession XM_051306) is another VGAM681 host target gene. KIAA1336 BINDING SITE is HOST TARGET binding site found in the 3' untranslated region of mRNA encoded by KIAA1336, corresponding to a HOST TARGET binding site such as BINDING SITE I, BINDING SITE II or BINDING SITE III. Table 2 illustrates the complementarity of the nucleotide sequences of KIAA1336 BINDING SITE, designated SEQ ID:35799, to the nucleotide sequence of VGAM681 RNA, herein designated VGAM RNA, also designated SEQ ID:3392.

Another function of VGAM681 is therefore inhibition of KIAA1336 (Accession XM_051306). Accordingly, utilities of VGAM681 include diagnosis, prevention and treatment of diseases and clinical conditions associated with KIAA1336. LOC161742 (Accession XM_091095) is another VGAM681 host target gene. LOC161742 BINDING SITE is HOST TARGET binding site found in the 3' untranslated region of mRNA encoded by LOC161742, corresponding to a HOST TARGET binding site such as BINDING SITE I, BINDING SITE II or BINDING SITE III. Table 2 illustrates the complementarity of the nucleotide sequences of LOC161742 BINDING SITE, designated SEQ ID:40025, to the nucleotide sequence of VGAM681 RNA, herein designated VGAM RNA, also designated SEQ ID:3392.

Another function of VGAM681 is therefore inhibition of LOC161742 (Accession XM_091095). Accordingly, utilities of VGAM681 include diagnosis, prevention and treatment of diseases and clinical conditions associated with LOC161742. LOC255919 (Accession XM_170794) is another VGAM681 host target gene. LOC255919 BINDING SITE is HOST TARGET binding site found in the 3' untranslated region of mRNA encoded by LOC255919, corresponding to a HOST TARGET binding site such as BINDING SITE I, BINDING SITE II or BINDING SITE III. Table 2 illustrates the complementarity of the nucleotide sequences of LOC255919 BINDING SITE, designated SEQ ID:45554, to the nucleotide sequence of VGAM681 RNA, herein designated VGAM RNA, also designated SEQ ID:3392.

Another function of VGAM681 is therefore inhibition of LOC255919 (Accession XM_170794). Accordingly, utilities of VGAM681 include diagnosis, prevention and treatment of diseases and clinical conditions associated with LOC255919. FIG. 1 further provides a conceptual description of a novel bioinformatically detected viral gene of the present invention, referred to here as Viral Genomic Address Messenger 682 (VGAM682) viral gene, which modulates expression of respective host target genes thereof, the function and utility of which host target genes is known in the art.

VGAM682 is a novel bioinformatically detected regulatory, non protein coding, viral micro RNA (miRNA) gene. The method by which VGAM682 was detected is described hereinabove with reference to FIGS. 1-8.

VGAM682 gene, herein designated VGAM GENE, is a viral gene contained in the genome of Human Coronavirus 229E. VGAM682 host target gene, herein designated VGAM HOST TARGET GENE, is a human gene contained in the human genome.

VGAM682 gene encodes a VGAM682 precursor RNA, herein designated VGAM PRECURSOR RNA. Similar to other miRNA genes, and unlike most ordinary genes, VGAM682 precursor RNA does not encode a protein. A nucleotide sequence identical or highly similar to the nucleotide sequence of VGAM682 precursor RNA is designated SEQ ID:668, and is provided hereinbelow with reference to the sequence listing part. Nucleotide sequence SEQ ID:668 is located at position 7304 relative to the genome of Human Coronavirus 229E.

VGAM682 precursor RNA folds onto itself, forming VGAM682 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM682 folded precursor RNA into VGAM682 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM682 RNA is designated SEQ ID:3393, and is provided hereinbelow with reference to the sequence listing part.

VGAM682 host target gene, herein designated VGAM HOST TARGET GENE, encodes a corresponding messenger RNA, VGAM682 host target RNA, herein designated VGAM HOST TARGET RNA. VGAM682 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM682 RNA, herein designated VGAM RNA, binds complementarily to one or more host target binding sites located in untranslated regions of VGAM682 host target RNA, herein designated VGAM HOST TARGET RNA. This complementary binding is due to the fact that the nucleotide sequence of VGAM682 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM682 RNA, herein designated VGAM RNA, may have a different number of host target binding sites in untranslated regions of a VGAM682 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM682 RNA, herein designated VGAM RNA, to host target binding sites on VGAM682 host target RNA, herein designated VGAM HOST TARGET RNA, such as BINDING SITE I, BINDING SITE II and BINDING SITE III, inhibits translation of VGAM682 host target RNA into VGAM682 host target protein, herein designated VGAM HOST TARGET PROTEIN. VGAM host target protein is therefore outlined by a broken line.

It is appreciated that VGAM682 host target gene, herein designated VGAM HOST TARGET GENE, in fact represents a plurality of VGAM682 host target genes. The mRNA of each one of this plurality of VGAM682 host target genes comprises one or more host target binding sites, each having a nucleotide sequence which is at least partly complementary to VGAM682 RNA, herein designated VGAM RNA, and which when bound by VGAM682 RNA causes inhibition of translation of respective one or more VGAM682 host target proteins.

It is further appreciated by one skilled in the art that the mode of translational inhibition illustrated by FIG. 1 with specific reference to translational inhibition exerted by VGAM682 gene, herein designated VGAM GENE, on one or more VGAM682 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM682 is inhibition of expression of host target genes, as part of a novel viral mechanism of attacking a host. Accordingly, utilities of VGAM682 include diagnosis, prevention and treatment of viral infection by Human Coronavirus 229E. Specific functions, and accordingly utilities, of VGAM682 correlate with, and may be deduced from, the identity of the host target genes which VGAM682 binds and inhibits, and the function of these host target genes, as elaborated hereinbelow.

Nucleotide sequences of the VGAM682 precursor RNA, herein designated VGAM PRECURSOR RNA, and of the 'diced' VGAM682 RNA, herein designated VGAM RNA, and a schematic representation of the secondary folding of VGAM682 folded precursor RNA, herein designated VGAM FOLDED PRECURSOR RNA, of VGAM682 are further described hereinbelow with reference to Table 1.

Nucleotide sequences of host target binding sites, such as BINDING SITE-I, BINDING SITE-II and BINDING SITE-III of FIG. 1, found on VGAM682 host target RNA, and schematic representation of the complementarity of each of these host target binding sites to VGAM682 RNA, herein designated VGAM RNA, are described hereinbelow with reference to Table 2.

As mentioned hereinabove with reference to FIG. 1, a function of VGAM682 gene, herein designated VGAM is inhibition of expression of VGAM682 target genes. It is appreciated that specific functions, and accordingly utilities, of VGAM682 correlate with, and may be deduced from, the identity of the target genes which VGAM682 binds and inhibits, and the function of these target genes, as elaborated hereinbelow.

Myeloid/lymphoid Or Mixed-lineage Leukemia (trithorax homolog, Drosophila); Translocated To, 2 (MLLT2, Accession NM_005935) is a VGAM682 host target gene. MLLT2 BINDING SITE is HOST TARGET binding site found in the 3' untranslated region of mRNA encoded by MLLT2, corresponding to a HOST TARGET binding site such as BINDING SITE I, BINDING SITE II or BINDING SITE III. Table 2 illustrates the complementarity of the nucleotide sequences of MLLT2 BINDING SITE, designated SEQ ID:12570, to the nucleotide sequence of VGAM682 RNA, herein designated VGAM RNA, also designated SEQ ID:3393.

A function of VGAM682 is therefore inhibition of Myeloid/lymphoid Or Mixed-lineage Leukemia (trithorax homolog, Drosophila); Translocated To, 2 (MLLT2, Accession NM_005935), a gene which is a Putative transcription factor. Accordingly, utilities of VGAM682 include diagnosis, prevention and treatment of diseases and clinical conditions associated with MLLT2. The function of MLLT2 and its association with various diseases and clinical conditions, has been established by previous studies, as described hereinabove with reference to VGAM57. Protein S (alpha) (PROS1, Accession XM_113400) is another VGAM682 host target gene. PROS1 BINDING SITE is HOST TARGET binding site found in the 3' untranslated region of mRNA encoded by PROS1, corresponding to a HOST TARGET binding site such as BINDING SITE I, BINDING SITE II or BINDING SITE III. Table 2 illustrates the complementarity of the nucleotide sequences of PROS1 BINDING SITE, designated SEQ ID:42255, to the nucleotide sequence of VGAM682 RNA, herein designated VGAM RNA, also designated SEQ ID:3393.

Another function of VGAM682 is therefore inhibition of Protein S (alpha) (PROS1, Accession XM_113400). Accordingly, utilities of VGAM682 include diagnosis, prevention and treatment of diseases and clinical conditions associated with PROS1. Thiopurine S-methyltransferase (TPMT, Accession NM_000367) is another VGAM682 host target gene. TPMT BINDING SITE is HOST TARGET binding site found in the 3' untranslated region of mRNA encoded by TPMT, corresponding to a HOST TARGET binding site such as BINDING SITE I, BINDING SITE II or BINDING SITE III. Table 2 illustrates the complementarity of the nucleotide sequences of TPMT BINDING SITE, designated SEQ ID:5940, to the nucleotide sequence of VGAM682 RNA, herein designated VGAM RNA, also designated SEQ ID:3393.

Another function of VGAM682 is therefore inhibition of Thiopurine S-methyltransferase (TPMT, Accession NM_000367), a gene which catalyzes the s-methylation of thiopurine drugs such as 6-mercaptopurine. Accordingly, utilities of VGAM682 include diagnosis, prevention and treatment of diseases and clinical conditions associated with TPMT. The function of TPMT has been established by previous studies. Thiopurine S-methyltransferase (TPMT; S-adenosyl-L-methionine:thiopurine S-methyltransferase; EC 2.1.1.67) catalyzes thiopurine S-methylation, an important metabolic pathway for drugs such as 6-mercaptopurine. Weinshilboum and Sladek (1980) found trimodality for level of red cell TPMT among 298 randomly selected subjects: 88.6% had high enzyme activity; 11.1% had intermediate activity and 0.3% had undetectable activity. This distribution conforms to Hardy-Weinberg expectations for a pair of autosomal codominant alleles for low and high activity, TPMT-L and TPMT-H, with frequencies of 0.059 and 0.941, respectively. Segregation in families ascertained through probands with undetectable activity was consistent with this hypothesis. This genetic polymorphism may be an important factor in individual variations in sensitivity to thiopurines. 6-Mercaptopurine (6-MP) can be inactivated by S-methylation, which is catalyzed by thiopurine methyltransferase. An alternative metabolic route leads to the formation of cytotoxic 6-thioguanine nucleotides (6-TGN). Lennard et al. (1990) investigated whether these 2 pathways compete to affect the therapeutic response to 6-MP, by measuring 6-TGN concentrations and TPMT enzymatic activity in red cells of 95 children on long-term 6-MP therapy for acute lymphoblastic leukemia (ALL). Red cell TPMT activities were also measured in 130 control children and 104 long-term survivors of ALL no longer on treatment. In the children on 6-MP, red cell 6-TGN correlated negatively with red cell TPMT activity. Children with 6-TGN concentrations below the group mean had higher TPMT activities and a higher subsequent relapse rate. Fifty of the 104 long-term survivors had been treated with low-dose protocols; this subgroup contained an excess of children with lower TPMT activities. The results indicated that genetically determined TPMT activity may be an important regulator of the cytotoxic effect of 6-MP, an effect which in turn may be important in influencing the outcome of therapy for childhood ALL. Klemetsdal et al. (1993) found in a group of healthy subjects that red blood cell TPMT activity was 8.3% higher in male subjects than in female subjects. Alves et al. (1999) applied a PCR-SSCP method for TPMT-specific detection which introduces a substantial technical simplification, avoiding the use of restriction enzyme treatment after PCR amplification. Additionally, the method allowed the simultaneous detection of a 474T-C transition, a frequent silent mutation in the non-Portuguese population (TPMT*1S = 0.215). In a sample of 310 unrelated Northern Portuguese individuals, 15 were found to be heterozygous for the TPMT*3A allele (187680.0002) which is associated with TPMT enzymatic deficiency; the corresponding gene frequency estimate was 0.024. In an attempt to evaluate the relationship between the molecular TPMT genotype and reaction to treatments involving thiopurine drugs, Alves et al. (1999) analyzed a sample of 24 children who received curative therapy of acute lymphoblastic leukemia. Four of them were shown to be heterozygous for the TPMT*3A allele. An examination of their clinical histories showed that all 4 patients exhibited signs of severe hepatic toxicity during treatment. McLeod et al. (1999) studied the frequency of common TPMT variant alleles in 101 Kenyan individuals and 199 Caucasians. The frequency of mutant alleles was similar between the Caucasian (10.1%) and Kenyan (10.9%) populations; however, all mutant alleles in the Kenyan population were TPMT*3C (187680.0005) compared with 4.8% in Caucasians. In contrast, TPMT*3A (187680.0002) was the most common mutant allele in the Caucasian individuals.

Full details of the abovementioned studies are described in the following publications, the disclosure of which are hereby incorporated by reference:

Alves, S.; Prata, M.-J.; Ferreira, F.; Amorim, A.: Thiopurine methyltransferase pharmacogenetics: alternative molecular diagnosis and preliminary data from Northern Portugal. Pharmacogenetics 9:257-261, 1999; and Ameyaw, M.-M.; Collie-Duguid, E. S. R.; Powrie, R. H.; Ofori-Adjei, D.; McLeod, H. L.: Thiopurine methyltransferase alleles in British and Ghanaian populations. Hum. Molec. Genet. 8:3.

Further studies establishing the function and utilities of TPMT are found in John Hopkins OMIM database record ID 187680, and in sited publications numbered 540-556 listed in the bibliography section hereinbelow, which are also hereby incorporated by reference. DKFZP566J091 (Accession NM_030915) is another VGAM682 host target gene. DKFZP566J091 BINDING SITE is HOST TARGET binding site found in the 3' untranslated region of mRNA encoded by DKFZP566J091, corresponding to a HOST TARGET binding site such as BINDING SITE I, BINDING SITE II or BINDING SITE III. Table 2 illustrates the complementarity of the nucleotide sequences of DKFZP566J091 BINDING SITE, designated SEQ ID:25186, to the nucleotide sequence of VGAM682 RNA, herein designated VGAM RNA, also designated SEQ ID:3393.

Another function of VGAM682 is therefore inhibition of DKFZP566J091 (Accession NM_030915). Accordingly, utilities of VGAM682 include diagnosis, prevention and treatment of diseases and clinical conditions associated with DKFZP566J091. ERAP140 (Accession XM_059748) is another VGAM682 host target gene. ERAP140 BINDING SITE is HOST TARGET binding site found in the 3' untranslated region of mRNA encoded by ERAP140, corresponding to a HOST TARGET binding site such as BINDING SITE I, BINDING SITE II or BINDING SITE III. Table 2 illustrates the complementarity of the nucleotide sequences of ERAP140 BINDING SITE, designated SEQ ID:37082, to the nucleotide sequence of VGAM682 RNA, herein designated VGAM RNA, also designated SEQ ID:3393.

Another function of VGAM682 is therefore inhibition of ERAP140 (Accession XM_059748). Accordingly, utilities of VGAM682 include diagnosis, prevention and treatment of diseases and clinical conditions associated with ERAP140. FIG. 1 further provides a conceptual description of a novel bioinformatically detected viral gene of the present invention, referred to here as Viral Genomic Address Messenger 683 (VGAM683) viral gene, which modulates expression of respective host target genes thereof, the function and utility of which host target genes is known in the art.

VGAM683 is a novel bioinformatically detected regulatory, non protein coding, viral micro RNA (miRNA) gene. The method by which VGAM683 was detected is described hereinabove with reference to FIGS. 1-8.

VGAM683 gene, herein designated VGAM GENE, is a viral gene contained in the genome of Human Coronavirus 229E. VGAM683 host target gene, herein designated VGAM HOST TARGET GENE, is a human gene contained in the human genome.

VGAM683 gene encodes a VGAM683 precursor RNA, herein designated VGAM PRECURSOR RNA. Similar to other miRNA genes, and unlike most ordinary genes, VGAM683 precursor RNA does not encode a protein. A nucleotide sequence identical or highly similar to the nucleotide sequence of VGAM683 precursor RNA is designated SEQ ID:669, and is provided hereinbelow with reference to the sequence listing part. Nucleotide sequence SEQ ID:669 is located at position 19339 relative to the genome of Human Coronavirus 229E.

VGAM683 precursor RNA folds onto itself, forming VGAM683 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM683 folded precursor RNA into VGAM683 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM683 RNA is designated SEQ ID:3394, and is provided hereinbelow with reference to the sequence listing part.

VGAM683 host target gene, herein designated VGAM HOST TARGET GENE, encodes a corresponding messenger RNA, VGAM683 host target RNA, herein designated VGAM HOST TARGET RNA. VGAM683 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM683 RNA, herein designated VGAM RNA, binds complementarily to one or more host target binding sites located in untranslated regions of VGAM683 host target RNA, herein designated VGAM HOST TARGET RNA. This complementary binding is due to the fact that the nucleotide sequence of VGAM683 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM683 RNA, herein designated VGAM RNA, may have a different number of host target binding sites in untranslated regions of a VGAM683 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM683 RNA, herein designated VGAM RNA, to host target binding sites on VGAM683 host target RNA, herein designated VGAM HOST TARGET RNA, such as BINDING SITE I, BINDING SITE II and BINDING SITE III, inhibits translation of VGAM683 host target RNA into VGAM683 host target protein, herein designated VGAM HOST TARGET PROTEIN. VGAM host target protein is therefore outlined by a broken line.

It is appreciated that VGAM683 host target gene, herein designated VGAM HOST TARGET GENE, in fact represents a plurality of VGAM683 host target genes. The mRNA of each one of this plurality of VGAM683 host target genes comprises one or more host target binding sites, each having a nucleotide sequence which is at least partly complementary to VGAM683 RNA, herein designated VGAM RNA, and which when bound by VGAM683 RNA causes inhibition of translation of respective one or more VGAM683 host target proteins.

It is further appreciated by one skilled in the art that the mode of translational inhibition illustrated by FIG. 1 with specific reference to translational inhibition exerted by VGAM683 gene, herein designated VGAM GENE, on one or more VGAM683 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM683 is inhibition of expression of host target genes, as part of a novel viral mechanism of attacking a host. Accordingly, utilities of VGAM683 include diagnosis, prevention and treatment of viral infection by Human Coronavirus 229E. Specific functions, and accordingly utilities, of VGAM683 correlate with, and may be deduced from, the identity of the host target genes which VGAM683 binds and inhibits, and the function of these host target genes, as elaborated hereinbelow.

Nucleotide sequences of the VGAM683 precursor RNA, herein designated VGAM PRECURSOR RNA, and of the 'diced' VGAM683 RNA, herein designated VGAM RNA, and a schematic representation of the secondary folding of VGAM683 folded precursor RNA, herein designated VGAM FOLDED PRECURSOR RNA, of VGAM683 are further described hereinbelow with reference to Table 1.

Nucleotide sequences of host target binding sites, such as BINDING SITE-I, BINDING SITE-II and BINDING SITE-III of FIG. 1, found on VGAM683 host target RNA, and schematic representation of the complementarity of each of these host target binding sites to VGAM683 RNA, herein designated VGAM RNA, are described hereinbelow with reference to Table 2.

As mentioned hereinabove with reference to FIG. 1, a function of VGAM683 gene, herein designated VGAM is inhibition of expression of VGAM683 target genes. It is appreciated that specific functions, and accordingly utilities, of VGAM683 correlate with, and may be deduced from, the identity of the target genes which VGAM683 binds and inhibits, and the function of these target genes, as elaborated hereinbelow.

Nuclear Factor I/A (NFIA, Accession XM_046827) is a VGAM683 host target gene. NFIA BINDING SITE is HOST TARGET binding site found in the 3" untranslated region of mRNA encoded by NFIA, corresponding to a HOST TARGET binding site such as BINDING SITE I, BINDING SITE II or BINDING SITE III. Table 2 illustrates the complementarity of the nucleotide sequences of NFIA BINDING SITE, designated SEQ ID:34838, to the nucleotide sequence of VGAM683 RNA, herein designated VGAM RNA, also designated SEQ ID:3394.

A function of VGAM683 is therefore inhibition of Nuclear Factor I/A (NFIA, Accession XM_046827). Accordingly, utilities of VGAM683 include diagnosis, prevention and treatment of diseases and clinical conditions associated with NFIA. Solute Carrier Family 20 (phosphate transporter), Member 1 (SLC20A1, Accession XM_002217) is another VGAM683 host target gene. SLC20A1 BINDING SITE is HOST TARGET binding site found in the 5' untranslated region of mRNA encoded by SLC20A1, corresponding to a HOST TARGET binding site such as BINDING SITE I, BINDING SITE II or BINDING SITE III. Table 2 illustrates the complementarity of the nucleotide sequences of SLC20A1 BINDING SITE, designated SEQ ID:29872, to the nucleotide sequence of VGAM683 RNA, herein designated VGAM RNA, also designated SEQ ID:3394.

Another function of VGAM683 is therefore inhibition of Solute Carrier Family 20 (phosphate transporter), Member 1 (SLC20A1, Accession XM_002217), a gene which could be a sodium-phosphate symporter. Accordingly, utilities of VGAM683 include diagnosis, prevention and treatment of diseases and clinical conditions associated with SLC20A1. The function of SLC20A1 and its association with various diseases and clinical conditions, has been established by previous studies, as described hereinabove with reference to VGAM608. FLJ13782 (Accession NM_024915) is another VGAM683 host target gene. FLJ13782 BINDING SITE is HOST TARGET binding site found in the 3' untranslated region of mRNA encoded by FLJ13782, corresponding to a HOST TARGET binding site such as BINDING SITE I, BINDING SITE II or BINDING SITE III. Table 2 illustrates the complementarity of the nucleotide sequences of FLJ13782 BINDING SITE, designated SEQ ID:24438, to the nucleotide sequence of VGAM683 RNA, herein designated VGAM RNA, also designated SEQ ID:3394.

Another function of VGAM683 is therefore inhibition of FLJ13782 (Accession NM_024915). Accordingly, utilities of VGAM683 include diagnosis, prevention and treatment of diseases and clinical conditions associated with FLJ13782. FLJ14054 (Accession NM_024563) is another VGAM683 host target gene. FLJ14054 BINDING SITE is HOST TARGET binding site found in the 3' untranslated region of mRNA encoded by FLJ14054, corresponding to a HOST TARGET binding site such as BINDING SITE I, BINDING SITE II or BINDING SITE III. Table 2 illustrates the complementarity of the nucleotide sequences of FLJ14054 BINDING SITE, designated SEQ ID:23782, to the nucleotide sequence of VGAM683 RNA, herein designated VGAM RNA, also designated SEQ ID:3394.

Another function of VGAM683 is therefore inhibition of FLJ14054 (Accession NM_024563). Accordingly, utilities of VGAM683 include diagnosis, prevention and treatment of diseases and clinical conditions associated with FLJ14054. GCN2 (Accession XM_031612) is another VGAM683 host target gene. GCN2 BINDING SITE is HOST TARGET binding site found in the 5' untranslated region of mRNA encoded by GCN2, corresponding to a HOST TARGET binding site such as BINDING SITE I, BINDING SITE II or BINDING SITE III. Table 2 illustrates the complementarity of the nucleotide sequences of GCN2 BINDING SITE, designated SEQ ID:31445, to the nucleotide sequence of VGAM683 RNA, herein designated VGAM RNA, also designated SEQ ID:3394.

Another function of VGAM683 is therefore inhibition of GCN2 (Accession XM_031612). Accordingly, utilities of VGAM683 include diagnosis, prevention and treatment of diseases and clinical conditions associated with GCN2. KIAA0570 (Accession NM_014709) is another VGAM683 host target gene. KIAA0570 BINDING SITE is HOST TARGET binding site found in the 3' untranslated region of mRNA encoded by KIAA0570, corresponding to a HOST TARGET binding site such as BINDING SITE I, BINDING SITE II or BINDING SITE III. Table 2 illustrates the complementarity of the nucleotide sequences of KIAA0570 BINDING SITE, designated SEQ ID:16254, to the nucleotide sequence of VGAM683 RNA, herein designated VGAM RNA, also designated SEQ ID:3394.

Another function of VGAM683 is therefore inhibition of KIAA0570 (Accession NM_014709). Accordingly, utilities of VGAM683 include diagnosis, prevention and treatment of diseases and clinical conditions associated with KIAA0570. TIP-1 (Accession NM_014604) is another VGAM683 host target gene. TIP-1 BINDING SITE is HOST TARGET binding site found in the 3' untranslated region of mRNA encoded by TIP-1, corresponding to a HOST TARGET binding site such as BINDING SITE I, BINDING SITE II or BINDING SITE III. Table 2 illustrates the complementarity of the nucleotide sequences of TIP-1 BINDING SITE, designated SEQ ID:15967, to the nucleotide sequence of VGAM683 RNA, herein designated VGAM RNA, also designated SEQ ID:3394.

Another function of VGAM683 is therefore inhibition of TIP-1 (Accession NM_014604). Accordingly, utilities of VGAM683 include diagnosis, prevention and treatment of diseases and clinical conditions associated with TIP-1. LOC152765 (Accession XM_087519) is another VGAM683 host target gene. LOC152765 BINDING SITE is HOST TARGET binding site found in the 3' untranslated region of mRNA encoded by LOC152765, corresponding to a HOST TARGET binding site such as BINDING SITE I, BINDING SITE II or BINDING SITE III. Table 2 illustrates the complementarity of the nucleotide sequences of LOC152765 BINDING SITE, designated SEQ ID:39313, to the nucleotide sequence of VGAM683 RNA, herein designated VGAM RNA, also designated SEQ ID:3394.

Another function of VGAM683 is therefore inhibition of LOC152765 (Accession XM_087519). Accordingly, utilities of VGAM683 include diagnosis, prevention and treatment of diseases and clinical conditions associated with LOC152765. LOC163412 (Accession XM_088868) is another VGAM683 host target gene. LOC163412 BINDING SITE is HOST TARGET binding site found in the 5' untranslated region of mRNA encoded by LOC163412, corresponding to a HOST TARGET binding site such as BINDING SITE I, BINDING SITE II or BINDING SITE III. Table 2 illustrates the complementarity of the nucleotide sequences of LOC163412 BINDING SITE, designated SEQ ID:39954, to the nucleotide sequence of VGAM683 RNA, herein designated VGAM RNA, also designated SEQ ID:3394.

Another function of VGAM683 is therefore inhibition of LOC163412 (Accession XM_088868). Accordingly, utilities of VGAM683 include diagnosis, prevention and treatment of diseases and clinical conditions associated with LOC163412. FIG. 1 further provides a conceptual description of a novel bioinformatically detected viral gene of the present invention, referred to here as Viral Genomic Address Messenger 684 (VGAM684) viral gene, which modulates expression of respective host target genes thereof, the function and utility of which host target genes is known in the art.

VGAM684 is a novel bioinformatically detected regulatory, non protein coding, viral micro RNA (miRNA) gene. The method by which VGAM684 was detected is described hereinabove with reference to FIGS. 1-8.

VGAM684 gene, herein designated VGAM GENE, is a viral gene contained in the genome of Human Coronavirus 229E. VGAM684 host target gene, herein designated VGAM HOST TARGET GENE, is a human gene contained in the human genome.

VGAM684 gene encodes a VGAM684 precursor RNA, herein designated VGAM PRECURSOR RNA. Similar to other miRNA genes, and unlike most ordinary genes, VGAM684 precursor RNA does not encode a protein. A nucleotide sequence identical or highly similar to the nucleotide sequence of VGAM684 precursor RNA is designated SEQ ID:670, and is provided hereinbelow with reference to the sequence listing part. Nucleotide sequence SEQ ID:670 is located at position 18943 relative to the genome of Human Coronavirus 229E.

VGAM684 precursor RNA folds onto itself, forming VGAM684 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM684 folded precursor RNA into VGAM684 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM684 RNA is designated SEQ ID:3395, and is provided hereinbelow with reference to the sequence listing part.

VGAM684 host target gene, herein designated VGAM HOST TARGET GENE, encodes a corresponding messenger RNA, VGAM684 host target RNA, herein designated VGAM HOST TARGET RNA. VGAM684 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM684 RNA, herein designated VGAM RNA, binds complementarily to one or more host target binding sites located in untranslated regions of VGAM684 host target RNA, herein designated VGAM HOST TARGET RNA. This complementary binding is due to the fact that the nucleotide sequence of VGAM684 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM684 RNA, herein designated VGAM RNA, may have a different number of host target binding sites in untranslated regions of a VGAM684 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM684 RNA, herein designated VGAM RNA, to host target binding sites on VGAM684 host target RNA, herein designated VGAM HOST TARGET RNA, such as BINDING SITE I, BINDING SITE II and BINDING SITE III, inhibits translation of VGAM684 host target RNA into VGAM684 host target protein, herein designated VGAM HOST TARGET PROTEIN. VGAM host target protein is therefore outlined by a broken line.

It is appreciated that VGAM684 host target gene, herein designated VGAM HOST TARGET GENE, in fact represents a plurality of VGAM684 host target genes. The mRNA of each one of this plurality of VGAM684 host target genes comprises one or more host target binding sites, each having a nucleotide sequence which is at least partly complementary to VGAM684 RNA, herein designated VGAM RNA, and which when bound by VGAM684 RNA causes inhibition of translation of respective one or more VGAM684 host target proteins.

It is further appreciated by one skilled in the art that the mode of translational inhibition illustrated by FIG. 1 with specific reference to translational inhibition exerted by VGAM684 gene, herein designated VGAM GENE, on one or more VGAM684 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM684 is inhibition of expression of host target genes, as part of a novel viral mechanism of attacking a host. Accordingly, utilities of VGAM684 include diagnosis, prevention and treatment of viral infection by Human Coronavirus 229E. Specific functions, and accordingly utilities, of VGAM684 correlate with, and may be deduced from, the identity of the host target genes which VGAM684 binds and inhibits, and the function of these host target genes, as elaborated hereinbelow.

Nucleotide sequences of the VGAM684 precursor RNA, herein designated VGAM PRECURSOR RNA, and of the 'diced' VGAM684 RNA, herein designated VGAM RNA, and a schematic representation of the secondary folding of VGAM684 folded precursor RNA, herein designated VGAM FOLDED PRECURSOR RNA, of VGAM684 are further described hereinbelow with reference to Table 1.

Nucleotide sequences of host target binding sites, such as BINDING SITE-I, BINDING SITE-II and BINDING SITE-III of FIG. 1, found on VGAM684 host target RNA, and schematic representation of the complementarity of each of these host target binding sites to VGAM684 RNA, herein designated VGAM RNA, are described hereinbelow with reference to Table 2.

As mentioned hereinabove with reference to FIG. 1, a function of VGAM684 gene, herein designated VGAM is inhibition of expression of VGAM684 target genes. It is appreciated that specific functions, and accordingly utilities, of VGAM684 correlate with, and may be deduced from, the identity of the target genes which VGAM684 binds and inhibits, and the function of these target genes, as elaborated hereinbelow.

Guanine Nucleotide Binding Protein (G protein), Alpha 15 (Gq class) (GNA15, Accession XM_009220) is a VGAM684 host target gene. GNA15 BINDING SITE is HOST TARGET binding site found in the 3' untranslated region of mRNA encoded by GNA15, corresponding to a HOST TARGET binding site such as BINDING SITE I, BINDING SITE II or BINDING SITE III. Table 2 illustrates the complementarity of the nucleotide sequences of GNA15 BINDING SITE, designated SEQ ID:30106, to the nucleotide sequence of VGAM684 RNA, herein designated VGAM RNA, also designated SEQ ID:3395.

A function of VGAM684 is therefore inhibition of Guanine Nucleotide Binding Protein (G protein), Alpha 15 (Gq class) (GNA15, Accession XM_009220). Accordingly, utilities of VGAM684 include diagnosis, prevention and treatment of diseases and clinical conditions associated with GNA15. FLJ10620 (Accession NM_018157) is another VGAM684 host target gene. FLJ10620 BINDING SITE is HOST TARGET binding site found in the 3" untranslated region of mRNA encoded by FLJ10620, corresponding to a HOST TARGET binding site such as BINDING SITE I, BINDING SITE II or BINDING SITE III. Table 2 illustrates the complementarity of the nucleotide sequences of FLJ10620 BINDING SITE, designated SEQ ID:19972, to the nucleotide sequence of VGAM684 RNA, herein designated VGAM RNA, also designated SEQ ID:3395.

Another function of VGAM684 is therefore inhibition of FLJ10620 (Accession NM_018157). Accordingly, utilities of VGAM684 include diagnosis, prevention and treatment of diseases and clinical conditions associated with FLJ10620. HCGIV.9 (Accession NM_018985) is another VGAM684 host target gene. HCGIV.9 BINDING SITE is HOST TARGET binding site found in the 5' untranslated region of mRNA encoded by HCGIV.9, corresponding to a HOST TARGET binding site such as BINDING SITE I, BINDING SITE II or BINDING SITE III. Table 2 illustrates the complementarity of the nucleotide sequences of HCGIV.9 BINDING SITE, designated SEQ ID:21057, to the nucleotide sequence of VGAM684 RNA, herein designated VGAM RNA, also designated SEQ ID:3395.

Another function of VGAM684 is therefore inhibition of HCGIV.9 (Accession NM_018985). Accordingly, utilities of VGAM684 include diagnosis, prevention and treatment of diseases and clinical conditions associated with HCGIV.9. TNF Receptor-associated Factor 3 (TRAF3, Accession XM_007256) is another VGAM684 host target gene. TRAF3 BINDING SITE is HOST TARGET binding site found in the 3' untranslated region of mRNA encoded by TRAF3, corresponding to a HOST TARGET binding site such as BINDING SITE I, BINDING SITE II or BINDING SITE III. Table 2 illustrates the complementarity of the nucleotide sequences of TRAF3 BINDING SITE, designated SEQ ID:30048, to the nucleotide sequence of VGAM684 RNA, herein designated VGAM RNA, also designated SEQ ID:3395.

Another function of VGAM684 is therefore inhibition of TNF Receptor-associated Factor 3 (TRAF3, Accession XM_007256). Accordingly, utilities of VGAM684 include diagnosis, prevention and treatment of diseases and clinical conditions associated with TRAF3. LOC145255 (Accession XM_096748) is another VGAM684 host target gene. LOC145255 BINDING SITE is HOST TARGET binding site found in the 3' untranslated region of mRNA encoded by LOC145255, corresponding to a HOST TARGET binding site such as BINDING SITE I, BINDING SITE II or BINDING SITE III. Table 2 illustrates the complementarity of the nucleotide sequences of LOC145255 BINDING SITE, designated SEQ ID:40527, to the nucleotide sequence of VGAM684 RNA, herein designated VGAM RNA, also designated SEQ ID:3395.

Another function of VGAM684 is therefore inhibition of LOC145255 (Accession XM_096748). Accordingly, utilities of VGAM684 include diagnosis, prevention and treatment of diseases and clinical conditions associated with LOC145255. FIG. 1 further provides a conceptual description of a novel bioinformatically detected viral gene of the present invention, referred to here as Viral Genomic Address Messenger 685

(VGAM685) viral gene, which modulates expression of respective host target genes thereof, the function and utility of which host target genes is known in the art.

VGAM685 is a novel bioinformatically detected regulatory, non protein coding, viral micro RNA (miRNA) gene. The method by which VGAM685 was detected is described hereinabove with reference to FIGS. 1-8.

VGAM685 gene, herein designated VGAM GENE, is a viral gene contained in the genome of Human Coronavirus 229E. VGAM685 host target gene, herein designated VGAM HOST TARGET GENE, is a human gene contained in the human genome.

VGAM685 gene encodes a VGAM685 precursor RNA, herein designated VGAM PRECURSOR RNA. Similar to other miRNA genes, and unlike most ordinary genes, VGAM685 precursor RNA does not encode a protein. A nucleotide sequence identical or highly similar to the nucleotide sequence of VGAM685 precursor RNA is designated SEQ ID:671, and is provided hereinbelow with reference to the sequence listing part. Nucleotide sequence SEQ ID:671 is located at position 8018 relative to the genome of Human Coronavirus 229E.

VGAM685 precursor RNA folds onto itself, forming VGAM685 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM685 folded precursor RNA into VGAM685 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM685 RNA is designated SEQ ID:3396, and is provided hereinbelow with reference to the sequence listing part.

VGAM685 host target gene, herein designated VGAM HOST TARGET GENE, encodes a corresponding messenger RNA, VGAM685 host target RNA, herein designated VGAM HOST TARGET RNA. VGAM685 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM685 RNA, herein designated VGAM RNA, binds complementarily to one or more host target binding sites located in untranslated regions of VGAM685 host target RNA, herein designated VGAM HOST TARGET RNA. This complementary binding is due to the fact that the nucleotide sequence of VGAM685 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM685 RNA, herein designated VGAM RNA, may have a different number of host target binding sites in untranslated regions of a VGAM685 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM685 RNA, herein designated VGAM RNA, to host target binding sites on VGAM685 host target RNA, herein designated VGAM HOST TARGET RNA, such as BINDING SITE I, BINDING SITE II and BINDING SITE III, inhibits translation of VGAM685 host target RNA into VGAM685 host target protein, herein designated VGAM HOST TARGET PROTEIN. VGAM host target protein is therefore outlined by a broken line.

It is appreciated that VGAM685 host target gene, herein designated VGAM HOST TARGET GENE, in fact represents a plurality of VGAM685 host target genes. The mRNA of each one of this plurality of VGAM685 host target genes comprises one or more host target binding sites, each having a nucleotide sequence which is at least partly complementary to VGAM685 RNA, herein designated VGAM RNA, and which when bound by VGAM685 RNA causes inhibition of translation of respective one or more VGAM685 host target proteins.

It is further appreciated by one skilled in the art that the mode of translational inhibition illustrated by FIG. 1 with specific reference to translational inhibition exerted by VGAM685 gene, herein designated VGAM GENE, on one or more VGAM685 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM685 is inhibition of expression of host target genes, as part of a novel viral mechanism of attacking a host. Accordingly, utilities of VGAM685 include diagnosis, prevention and treatment of viral infection by Human Coronavirus 229E. Specific functions, and accordingly utilities, of VGAM685 correlate with, and may be deduced from, the identity of the host target genes which VGAM685 binds and inhibits, and the function of these host target genes, as elaborated hereinbelow.

Nucleotide sequences of the VGAM685 precursor RNA, herein designated VGAM PRECURSOR RNA, and of the 'diced' VGAM685 RNA, herein designated VGAM RNA, and a schematic representation of the secondary folding of VGAM685 folded precursor RNA, herein designated VGAM FOLDED PRECURSOR RNA, of VGAM685 are further described hereinbelow with reference to Table 1.

Nucleotide sequences of host target binding sites, such as BINDING SITE-I, BINDING SITE-II and BINDING SITE-III of FIG. 1, found on VGAM685 host target RNA, and schematic representation of the complementarity of each of these host target binding sites to VGAM685 RNA, herein designated VGAM RNA, are described hereinbelow with reference to Table 2.

As mentioned hereinabove with reference to FIG. 1, a function of VGAM685 gene, herein designated VGAM is inhibition of expression of VGAM685 target genes. It is appreciated that specific functions, and accordingly utilities, of VGAM685 correlate with, and may be deduced from, the identity of the target genes which VGAM685 binds and inhibits, and the function of these target genes, as elaborated hereinbelow.

Potassium Inwardly-rectifying Channel, Subfamily J, Member 14 (KCNJ14, Accession NM_013348) is a VGAM685 host target gene. KCNJ14 BINDING SITE is HOST TARGET binding site found in the 3' untranslated region of mRNA encoded by KCNJ14, corresponding to a HOST TARGET binding site such as BINDING SITE I, BINDING SITE II or BINDING SITE III. Table 2 illustrates the complementarity of the nucleotide sequences of KCNJ14 BINDING SITE, designated SEQ ID:14993, to the nucleotide sequence of VGAM685 RNA, herein designated VGAM RNA, also designated SEQ ID:3396.

A function of VGAM685 is therefore inhibition of Potassium Inwardly-rectifying Channel, Subfamily J, Member 14 (KCNJ14, Accession NM_013348). Accordingly, utilities of VGAM685 include diagnosis, prevention and treatment of diseases and clinical conditions associated with KCNJ14. KIAA0431 (Accession NM_015251) is another VGAM685 host target gene. KIAA0431 BINDING SITE is HOST TARGET binding site found in the 3' untranslated region of mRNA encoded by KIAA0431, corresponding to a HOST TARGET binding site such as BINDING SITE I, BINDING SITE II or BINDING SITE III. Table 2 illustrates the complementarity of the nucleotide sequences of KIAA0431 BINDING SITE, designated SEQ ID:17580, to the nucleotide sequence of VGAM685 RNA, herein designated VGAM RNA, also designated SEQ ID:3396.

Another function of VGAM685 is therefore inhibition of KIAA0431 (Accession NM_015251). Accordingly, utilities of VGAM685 include diagnosis, prevention and treatment of diseases and clinical conditions associated with KIAA0431. KIAA1371 (Accession XM_114371) is another VGAM685 host target gene. KIAA1371 BINDING SITE is HOST TARGET binding site found in the 3' untranslated region of mRNA encoded by KIAA1371, corresponding to a HOST TARGET binding site such as BINDING SITE I, BINDING SITE II or BINDING SITE III. Table 2 illustrates the complementarity of the nucleotide sequences of KIAA1371 BINDING SITE, designated SEQ ID:42909, to the nucleotide sequence of VGAM685 RNA, herein designated VGAM RNA, also designated SEQ ID:3396.

Another function of VGAM685 is therefore inhibition of KIAA1371 (Accession XM_114371). Accordingly, utilities of VGAM685 include diagnosis, prevention and treatment of diseases and clinical conditions associated with KIAA1371. FIG. 1 further provides a conceptual description of a novel bioinformatically detected viral gene of the present invention, referred to here as Viral Genomic Address Messenger 686 (VGAM686) viral gene, which modulates expression of respective host target genes thereof, the function and utility of which host target genes is known in the art.

VGAM686 is a novel bioinformatically detected regulatory, non protein coding, viral micro RNA (miRNA) gene. The method by which VGAM686 was detected is described hereinabove with reference to FIGS. 1-8.

VGAM686 gene, herein designated VGAM GENE, is a viral gene contained in the genome of Human Coronavirus 229E. VGAM686 host target gene, herein designated VGAM HOST TARGET GENE, is a human gene contained in the human genome.

VGAM686 gene encodes a VGAM686 precursor RNA, herein designated VGAM PRECURSOR RNA. Similar to other miRNA genes, and unlike most ordinary genes, VGAM686 precursor RNA does not encode a protein. A nucleotide sequence identical or highly similar to the nucleotide sequence of VGAM686 precursor RNA is designated SEQ ID:672, and is provided hereinbelow with reference to the sequence listing part. Nucleotide sequence SEQ ID:672 is located at position 14152 relative to the genome of Human Coronavirus 229E.

VGAM686 precursor RNA folds onto itself, forming VGAM686 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM686 folded precursor RNA into VGAM686 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM686 RNA is designated SEQ ID:3397, and is provided hereinbelow with reference to the sequence listing part.

VGAM686 host target gene, herein designated VGAM HOST TARGET GENE, encodes a corresponding messenger RNA, VGAM686 host target RNA, herein designated VGAM HOST TARGET RNA. VGAM686 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM686 RNA, herein designated VGAM RNA, binds complementarily to one or more host target binding sites located in untranslated regions of VGAM686 host target RNA, herein designated VGAM HOST TARGET RNA. This complementary binding is due to the fact that the nucleotide sequence of VGAM686 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM686 RNA, herein designated VGAM RNA, may have a different number of host target binding sites in untranslated regions of a VGAM686 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM686 RNA, herein designated VGAM RNA, to host target binding sites on VGAM686 host target RNA, herein designated VGAM HOST TARGET RNA, such as BINDING SITE I, BINDING SITE II and BINDING SITE III, inhibits translation of VGAM686 host target RNA into VGAM686 host target protein, herein designated VGAM HOST TARGET PROTEIN. VGAM host target protein is therefore outlined by a broken line.

It is appreciated that VGAM686 host target gene, herein designated VGAM HOST TARGET GENE, in fact represents a plurality of VGAM686 host target genes. The mRNA of each one of this plurality of VGAM686 host target genes comprises one or more host target binding sites, each having a nucleotide sequence which is at least partly complementary to VGAM686 RNA, herein designated VGAM RNA, and which when bound by VGAM686 RNA causes inhibition of translation of respective one or more VGAM686 host target proteins.

It is further appreciated by one skilled in the art that the mode of translational inhibition illustrated by FIG. 1 with specific reference to translational inhibition exerted by VGAM686 gene, herein designated VGAM GENE, on one or more VGAM686 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM686 is inhibition of expression of host target genes, as part of a novel viral mechanism of attacking a host. Accordingly, utilities of VGAM686 include diagnosis, prevention and treatment of viral infection by Human Coronavirus 229E. Specific functions, and accordingly utilities, of VGAM686 correlate with, and may be deduced from, the identity of the host target genes which VGAM686 binds and inhibits, and the function of these host target genes, as elaborated hereinbelow.

Nucleotide sequences of the VGAM686 precursor RNA, herein designated VGAM PRECURSOR RNA, and of the 'diced' VGAM686 RNA, herein designated VGAM RNA, and a schematic representation of the secondary folding of VGAM686 folded precursor RNA, herein designated VGAM FOLDED PRECURSOR RNA, of VGAM686 are further described hereinbelow with reference to Table 1.

Nucleotide sequences of host target binding sites, such as BINDING SITE-I, BINDING SITE-II and BINDING SITE-III of FIG. 1, found on VGAM686 host target RNA, and schematic representation of the complementarity of each of these host target binding sites to VGAM686 RNA, herein designated VGAM RNA, are described hereinbelow with reference to Table 2.

As mentioned hereinabove with reference to FIG. 1, a function of VGAM686 gene, herein designated VGAM is inhibition of expression of VGAM686 target genes. It is appreciated that specific functions, and accordingly utilities, of VGAM686 correlate with, and may be deduced from, the identity of the target genes which VGAM686 binds and inhibits, and the function of these target genes, as elaborated hereinbelow.

COX11 Homolog, Cytochrome C Oxidase Assembly Protein (yeast) (COX11, Accession NM_004375) is a VGAM686 host target gene. COX11 BINDING SITE is HOST TARGET binding site found in the 3' untranslated region of mRNA encoded by COX11, corresponding to a HOST TARGET binding site such as BINDING SITE I, BINDING SITE II or BINDING SITE III. Table 2 illustrates the complementarity of the nucleotide sequences of COX11 BINDING SITE, designated SEQ ID:10595, to the nucleotide sequence of VGAM686 RNA, herein designated VGAM RNA, also designated SEQ ID:3397.

A function of VGAM686 is therefore inhibition of COX11 Homolog, Cytochrome C Oxidase Assembly Protein (yeast) (COX11, Accession NM_004375). Accordingly, utilities of VGAM686 include diagnosis, prevention and treatment of diseases and clinical conditions associated with COX11. UDP-N-acetyl-alpha-D-galactosamine:polypeptide N-acetylgalactosaminyltransferase 7 (GalNAc-T7) (GALNT7, Accession NM_017423) is another VGAM686 host target gene. GALNT7 BINDING SITE is HOST TARGET binding site found in the 3' untranslated region of mRNA encoded by GALNT7, corresponding to a HOST TARGET binding site such as BINDING SITE I, BINDING SITE II or BINDING SITE III. Table 2 illustrates the complementarity of the nucleotide sequences of GALNT7 BINDING SITE, designated SEQ ID:18880, to the nucleotide sequence of VGAM686 RNA, herein designated VGAM RNA, also designated SEQ ID:3397.

Another function of VGAM686 is therefore inhibition of UDP-N-acetyl-alpha-D-galactosamine:polypeptide N-acetylgalactosaminyltransferase 7 (GalNAc-T7) (GALNT7, Accession NM_017423). Accordingly, utilities of VGAM686 include diagnosis, prevention and treatment of diseases and clinical conditions associated with GALNT7. BTB (POZ) Domain Containing 1 (BTBD1, Accession NM_025238) is another VGAM686 host target gene. BTBD1 BINDING SITE is HOST TARGET binding site found in the 3' untranslated region of mRNA encoded by BTBD1, corresponding to a HOST TARGET binding site such as BINDING SITE I, BINDING SITE II or BINDING SITE III. Table 2 illustrates the complementarity of the nucleotide sequences of BTBD1 BINDING SITE, designated SEQ ID:24922, to the nucleotide sequence of VGAM686 RNA, herein designated VGAM RNA, also designated SEQ ID:3397.

Another function of VGAM686 is therefore inhibition of BTB (POZ) Domain Containing 1 (BTBD1, Accession NM_025238). Accordingly, utilities of VGAM686 include diagnosis, prevention and treatment of diseases and clinical conditions associated with BTBD1. DKFZP564D166 (Accession NM_030658) is another VGAM686 host target gene. DKFZP564D166 BINDING SITE is HOST TARGET binding site found in the 3' untranslated region of mRNA encoded by DKFZP564D166, corresponding to a HOST TARGET binding site such as BINDING SITE I, BINDING SITE II or BINDING SITE III. Table 2 illustrates the complementarity of the nucleotide sequences of DKFZP564D166 BINDING SITE, designated SEQ ID:24990, to the nucleotide sequence of VGAM686 RNA, herein designated VGAM RNA, also designated SEQ ID:3397.

Another function of VGAM686 is therefore inhibition of DKFZP564D166 (Accession NM_030658). Accordingly, utilities of VGAM686 include diagnosis, prevention and treatment of diseases and clinical conditions associated with DKFZP564D166. FLJ23053 (Accession NM_022907) is another VGAM686 host target gene. FLJ23053 BINDING SITE is HOST TARGET binding site found in the 3' untranslated region of mRNA encoded by FLJ23053, corresponding to a HOST TARGET binding site such as BINDING SITE I, BINDING SITE II or BINDING SITE III. Table 2 illustrates the complementarity of the nucleotide sequences of FLJ23053 BINDING SITE, designated SEQ ID:23205, to the nucleotide sequence of VGAM686 RNA, herein designated VGAM RNA, also designated SEQ ID:3397.

Another function of VGAM686 is therefore inhibition of FLJ23053 (Accession NM_022907). Accordingly, utilities of VGAM686 include diagnosis, prevention and treatment of diseases and clinical conditions associated with FLJ23053. KH Domain Containing, RNA Binding, Signal Transduction Associated 1 (KHDRBS1, Accession NM_006559) is another VGAM686 host target gene. KHDRBS1 BINDING SITE is HOST TARGET binding site found in the 3' untranslated region of mRNA encoded by KHDRBS1, corresponding to a HOST TARGET binding site such as BINDING SITE I, BINDING SITE II or BINDING SITE III. Table 2 illustrates the complementarity of the nucleotide sequences of KHDRBS1 BINDING SITE, designated SEQ ID:13329, to the nucleotide sequence of VGAM686 RNA, herein designated VGAM RNA, also designated SEQ ID:3397.

Another function of VGAM686 is therefore inhibition of KH Domain Containing, RNA Binding, Signal Transduction Associated 1 (KHDRBS1, Accession NM_006559). Accordingly, utilities of VGAM686 include diagnosis, prevention and treatment of diseases and clinical conditions associated with KHDRBS1. KIAA1393 (Accession XM_050793) is another VGAM686 host target gene. KIAA1393 BINDING SITE is HOST TARGET binding site found in the 5' untranslated region of mRNA encoded by KIAA1393, corresponding to a HOST TARGET binding site such as BINDING SITE I, BINDING SITE II or BINDING SITE III. Table 2 illustrates the complementarity of the nucleotide sequences of KIAA1393 BINDING SITE, designated SEQ ID:35690, to the nucleotide sequence of VGAM686 RNA, herein designated VGAM RNA, also designated SEQ ID:3397.

Another function of VGAM686 is therefore inhibition of KIAA1393 (Accession XM_050793). Accordingly, utilities of VGAM686 include diagnosis, prevention and treatment of diseases and clinical conditions associated with KIAA1393. PORIMIN (Accession NM_052932) is another VGAM686 host target gene. PORIMIN BINDING SITE is HOST TARGET binding site found in the 3' untranslated region of mRNA encoded by PORIMIN, corresponding to a HOST TARGET binding site such as BINDING SITE I, BINDING SITE II or BINDING SITE III. Table 2 illustrates the complementarity of the nucleotide sequences of PORIMIN BINDING SITE, designated SEQ ID:27490, to the nucleotide sequence of VGAM686 RNA, herein designated VGAM RNA, also designated SEQ ID:3397.

Another function of VGAM686 is therefore inhibition of PORIMIN (Accession NM_052932). Accordingly, utilities of VGAM686 include diagnosis, prevention and treatment of diseases and clinical conditions associated with PORIMIN. RNAH (Accession XM_030392) is another VGAM686 host target gene. RNAH BINDING SITE is HOST TARGET binding site found in the 3' untranslated region of mRNA encoded by RNAH, corresponding to a HOST TARGET binding site such as BINDING SITE I, BINDING SITE II or BINDING SITE III. Table 2 illustrates the complementarity of the nucleotide sequences of RNAH BINDING SITE, designated SEQ ID:31038, to the nucleotide sequence of VGAM686 RNA, herein designated VGAM RNA, also designated SEQ ID:3397.

Another function of VGAM686 is therefore inhibition of RNAH (Accession XM_030392). Accordingly, utilities of VGAM686 include diagnosis, prevention and treatment of diseases and clinical conditions associated with RNAH. LOC158714 (Accession XM_088650) is another VGAM686 host target gene. LOC158714 BINDING SITE is HOST TARGET binding site found in the 3' untranslated region of mRNA encoded by LOC158714, corresponding to a HOST TARGET binding site such as BINDING SITE I, BINDING SITE II or BINDING SITE III. Table 2 illustrates the complementarity of the nucleotide sequences of LOC158714 BINDING SITE, designated SEQ ID:39886, to the nucleotide sequence of VGAM686 RNA, herein designated VGAM RNA, also designated SEQ ID:3397.

Another function of VGAM686 is therefore inhibition of LOC158714 (Accession XM_088650). Accordingly, utilities of VGAM686 include diagnosis, prevention and treatment of diseases and clinical conditions associated with LOC158714. LOC221362 (Accession XM_168093) is another VGAM686 host target gene. LOC221362 BINDING SITE is HOST TARGET binding site found in the 3' untranslated region of mRNA encoded by LOC221362, corresponding to a HOST TARGET binding site such as BINDING SITE I, BINDING SITE II or BINDING SITE III. Table 2 illustrates the complementarity of the nucleotide sequences of LOC221362 BINDING SITE, designated SEQ ID:45023, to the nucleotide sequence of VGAM686 RNA, herein designated VGAM RNA, also designated SEQ ID:3397.

Another function of VGAM686 is therefore inhibition of LOC221362 (Accession XM_168093). Accordingly, utilities of VGAM686 include diagnosis, prevention and treatment of diseases and clinical conditions associated with LOC221362. LOC255158 (Accession XM_171213) is another VGAM686 host target gene. LOC255158 BINDING SITE is HOST TARGET binding site found in the 3' untranslated region of mRNA encoded by LOC255158, corresponding to a HOST TARGET binding site such as BINDING SITE I, BINDING SITE II or BINDING SITE III. Table 2 illustrates the complementarity of the nucleotide sequences of LOC255158 BINDING SITE, designated SEQ ID:46000, to the nucleotide sequence of VGAM686 RNA, herein designated VGAM RNA, also designated SEQ ID:3397.

Another function of VGAM686 is therefore inhibition of LOC255158 (Accession XM_171213). Accordingly, utilities of VGAM686 include diagnosis, prevention and treatment of diseases and clinical conditions associated with LOC255158. FIG. 1 further provides a conceptual description of a novel bioinformatically detected viral gene of the present invention, referred to here as Viral Genomic Address Messenger 687 (VGAM687) viral gene, which modulates expression of respective host target genes thereof, the function and utility of which host target genes is known in the art.

VGAM687 is a novel bioinformatically detected regulatory, non protein coding, viral micro RNA (miRNA) gene. The method by which VGAM687 was detected is described hereinabove with reference to FIGS. 1-8.

VGAM687 gene, herein designated VGAM GENE, is a viral gene contained in the genome of Human Coronavirus 229E. VGAM687 host target gene, herein designated VGAM HOST TARGET GENE, is a human gene contained in the human genome.

VGAM687 gene encodes a VGAM687 precursor RNA, herein designated VGAM PRECURSOR RNA. Similar to other miRNA genes, and unlike most ordinary genes, VGAM687 precursor RNA does not encode a protein. A nucleotide sequence identical or highly similar to the nucleotide sequence of VGAM687 precursor RNA is designated SEQ ID:673, and is provided hereinbelow with reference to the sequence listing part. Nucleotide sequence SEQ ID:673 is located at position 14557 relative to the genome of Human Coronavirus 229E.

VGAM687 precursor RNA folds onto itself, forming VGAM687 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM687 folded precursor RNA into VGAM687 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM687 RNA is designated SEQ ID:3398, and is provided hereinbelow with reference to the sequence listing part.

VGAM687 host target gene, herein designated VGAM HOST TARGET GENE, encodes a corresponding messenger RNA, VGAM687 host target RNA, herein designated VGAM HOST TARGET RNA. VGAM687 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM687 RNA, herein designated VGAM RNA, binds complementarily to one or more host target binding sites located in untranslated regions of VGAM687 host target RNA, herein designated VGAM HOST TARGET RNA. This complementary binding is due to the fact that the nucleotide sequence of VGAM687 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM687 RNA, herein designated VGAM RNA, may have a different number of host target binding sites in untranslated regions of a VGAM687 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM687 RNA, herein designated VGAM RNA, to host target binding sites on VGAM687 host target RNA, herein designated VGAM HOST TARGET RNA, such as BINDING SITE I, BINDING SITE II and BINDING SITE III, inhibits translation of VGAM687 host target RNA into VGAM687 host target protein, herein designated VGAM HOST TARGET PROTEIN. VGAM host target protein is therefore outlined by a broken line.

It is appreciated that VGAM687 host target gene, herein designated VGAM HOST TARGET GENE, in fact represents a plurality of VGAM687 host target genes. The mRNA of each one of this plurality of VGAM687 host target genes comprises one or more host target binding sites, each having a nucleotide sequence which is at least partly complementary to VGAM687 RNA, herein designated VGAM RNA, and which when bound by VGAM687 RNA causes inhibition of translation of respective one or more VGAM687 host target proteins.

It is further appreciated by one skilled in the art that the mode of translational inhibition illustrated by FIG. 1 with specific reference to translational inhibition exerted by VGAM687 gene, herein designated VGAM GENE, on one or more VGAM687 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM687 is inhibition of expression of host target genes, as part of a novel viral mechanism of attacking a host. Accordingly, utilities of VGAM687 include diagnosis, prevention and treatment of viral infection by Human Coronavirus 229E. Specific functions, and accordingly utilities, of VGAM687 correlate with, and may be deduced from, the identity of the host target genes which VGAM687 binds and inhibits, and the function of these host target genes, as elaborated hereinbelow.

Nucleotide sequences of the VGAM687 precursor RNA, herein designated VGAM PRECURSOR RNA, and of the 'diced' VGAM687 RNA, herein designated VGAM RNA, and a schematic representation of the secondary folding of VGAM687 folded precursor RNA, herein designated VGAM FOLDED PRECURSOR RNA, of VGAM687 are further described hereinbelow with reference to Table 1.

Nucleotide sequences of host target binding sites, such as BINDING SITE-I, BINDING SITE-II and BINDING SITE-III of FIG. 1, found on VGAM687 host target RNA, and schematic representation of the complementarity of each of these host target binding sites to VGAM687 RNA, herein designated VGAM RNA, are described hereinbelow with reference to Table 2.

As mentioned hereinabove with reference to FIG. 1, a function of VGAM687 gene, herein designated VGAM is inhibition of expression of VGAM687 target genes. It is appreciated that specific functions, and accordingly utilities, of VGAM687 correlate with, and may be deduced from, the identity of the target genes which VGAM687 binds and inhibits, and the function of these target genes, as elaborated hereinbelow.

KIAA0022 (Accession NM_014880) is a VGAM687 host target gene. KIAA0022 BINDING SITE is HOST TARGET binding site found in the 3' untranslated region of mRNA encoded by KIAA0022, corresponding to a HOST TARGET binding site such as BINDING SITE I, BINDING SITE II or BINDING SITE III. Table 2 illustrates the complementarity of the nucleotide sequences of KIAA0022 BINDING SITE, designated SEQ ID:17024, to the nucleotide sequence of VGAM687 RNA, herein designated VGAM RNA, also designated SEQ ID:3398.

A function of VGAM687 is therefore inhibition of KIAA0022 (Accession NM_014880). Accordingly, utilities of VGAM687 include diagnosis, prevention and treatment of diseases and clinical conditions associated with KIAA0022. FIG. 1 further provides a conceptual description of a novel bioinformatically detected viral gene of the present invention, referred to here as Viral Genomic Address Messenger 688 (VGAM688) viral gene, which modulates expression of respective host target genes thereof, the function and utility of which host target genes is known in the art.

VGAM688 is a novel bioinformatically detected regulatory, non protein coding, viral micro RNA (miRNA) gene. The method by which VGAM688 was detected is described hereinabove with reference to FIGS. 1-8.

VGAM688 gene, herein designated VGAM GENE, is a viral gene contained in the genome of Human Coronavirus 229E. VGAM688 host target gene, herein designated VGAM HOST TARGET GENE, is a human gene contained in the human genome.

VGAM688 gene encodes a VGAM688 precursor RNA, herein designated VGAM PRECURSOR RNA. Similar to other miRNA genes, and unlike most ordinary genes, VGAM688 precursor RNA does not encode a protein. A nucleotide sequence identical or highly similar to the nucleotide sequence of VGAM688 precursor RNA is designated SEQ ID:674, and is provided hereinbelow with reference to the sequence listing part. Nucleotide sequence SEQ ID:674 is located at position 7056 relative to the genome of Human Coronavirus 229E.

VGAM688 precursor RNA folds onto itself, forming VGAM688 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM688 folded precursor RNA into VGAM688 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM688 RNA is designated SEQ ID:3399, and is provided hereinbelow with reference to the sequence listing part.

VGAM688 host target gene, herein designated VGAM HOST TARGET GENE, encodes a corresponding messenger RNA, VGAM688 host target RNA, herein designated VGAM HOST TARGET RNA. VGAM688 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM688 RNA, herein designated VGAM RNA, binds complementarily to one or more host target binding sites located in untranslated regions of VGAM688 host target RNA, herein designated VGAM HOST TARGET RNA. This complementary binding is due to the fact that the nucleotide sequence of VGAM688 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM688 RNA, herein designated VGAM RNA, may have a different number of host target binding sites in untranslated regions of a VGAM688 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM688 RNA, herein designated VGAM RNA, to host target binding sites on VGAM688 host target RNA, herein designated VGAM HOST TARGET RNA, such as BINDING SITE I, BINDING SITE II and BINDING SITE III, inhibits translation of VGAM688 host target RNA into VGAM688 host target protein, herein designated VGAM HOST TARGET PROTEIN. VGAM host target protein is therefore outlined by a broken line.

It is appreciated that VGAM688 host target gene, herein designated VGAM HOST TARGET GENE, in fact represents a plurality of VGAM688 host target genes. The mRNA of each one of this plurality of VGAM688 host target genes comprises one or more host target binding sites, each having a nucleotide sequence which is at least partly complementary to VGAM688 RNA, herein designated VGAM RNA, and which when bound by VGAM688 RNA causes inhibition of translation of respective one or more VGAM688 host target proteins.

It is further appreciated by one skilled in the art that the mode of translational inhibition illustrated by FIG. 1 with specific reference to translational inhibition exerted by VGAM688 gene, herein designated VGAM GENE, on one or more VGAM688 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM688 is inhibition of expression of host target genes, as part of a novel viral mechanism of attacking a host. Accordingly, utilities of VGAM688 include diagnosis, prevention and treatment of viral infection by Human Coronavirus 229E. Specific functions, and accordingly utilities, of VGAM688 correlate with, and may be deduced from, the identity of the host target genes which VGAM688 binds and inhibits, and the function of these host target genes, as elaborated hereinbelow.

Nucleotide sequences of the VGAM688 precursor RNA, herein designated VGAM PRECURSOR RNA, and of the 'diced' VGAM688 RNA, herein designated VGAM RNA, and a schematic representation of the secondary folding of VGAM688 folded precursor RNA, herein designated VGAM FOLDED PRECURSOR RNA, of VGAM688 are further described hereinbelow with reference to Table 1.

Nucleotide sequences of host target binding sites, such as BINDING SITE-I, BINDING SITE-II and BINDING SITE-III of FIG. 1, found on VGAM688 host target RNA, and schematic representation of the complementarity of each of these host target binding sites to VGAM688 RNA, herein designated VGAM RNA, are described hereinbelow with reference to Table 2.

As mentioned hereinabove with reference to FIG. 1, a function of VGAM688 gene, herein designated VGAM is inhibition of expression of VGAM688 target genes. It is appreciated that specific functions, and accordingly utilities, of VGAM688 correlate with, and may be deduced from, the identity of the target genes which VGAM688 binds and inhibits, and the function of these target genes, as elaborated hereinbelow.

LANGERIN (Accession NM_015717) is a VGAM688 host target gene. LANGERIN BINDING SITE is HOST TARGET binding site found in the 3' untranslated region of mRNA encoded by LANGERIN, corresponding to a HOST TARGET binding site such as BINDING SITE I, BINDING SITE II or BINDING SITE III. Table 2 illustrates the complementarity of the nucleotide sequences of LANGERIN BINDING SITE, designated SEQ ID:17930, to the nucleotide sequence of VGAM688 RNA, herein designated VGAM RNA, also designated SEQ ID:3399.

A function of VGAM688 is therefore inhibition of LANGERIN (Accession NM_015717), a gene which could be involved in endocytosis. Accordingly, utilities of VGAM688 include diagnosis, prevention and treatment of diseases and clinical conditions associated with LANGERIN. The function of LANGERIN has been established by previous studies. Dendritic cells (DCs) process exogenous antigen within major histocompatibility complex (MHC) class II-rich endosome/lysosome compartments to allow presentation to CD4 (OMIM Ref. No. 186940)-positive T cells. They also route exogenous antigen into the MHC class I pathway for presentation to CD8 (OMIM Ref. No. 186910)-positive T cells by a mechanism known as cross priming. Langerhans cells (LCs) are immature DCs of the epidermis and mucosal tissues; see 604856. Birbeck granules (BGs) are organelles in the cytoplasm of LCs that have a 'tennis racket' appearance consisting of superimposed and zippered membranes. Using a monoclonal antibody to screen a DC cDNA library expressed in fibroblasts, Valladeau et al. (2000) isolated a cDNA encoding a 328-amino acid type II transmembrane protein, which they named langerin. Sequence analysis identified a calcium dependent (OMIM Ref. No. C-type) lectin domain; a glu-pro-asn motif, predicting mannose recognition; a proline-rich potential signal-transduction motif; and 2 potential N-glycosylation sites. The langerin protein is 66% identical to its mouse homolog (Valladeau et al., 2002). RT-PCR analysis detected abundant expression of langerin in freshly isolated LCs. Lower levels were detected in cultured DCs, and no expression was detected in monocytes, T lymphocytes, granulocytes, B lymphocytes, and skin basal cells. Northern blot analysis of normal tissues detected strong expression of a 2.0-kb langerin transcript in lung but not in pancreas, kidney, skeletal muscle, liver, placenta, brain, heart, bone marrow, and peripheral blood leukocytes. Western blot analysis of DCs cultured with transforming growth factor-beta (OMIM Ref. No. 190180) showed expression of a 40-kD protein, similar to the predicted molecular mass. Confocal microscopy detected langerin at the LC cell surface and also in the cytoplasm. Electron microscopy detected langerin inside intracellular BGs but not in MHC class II-rich compartments. Valladeau et al. (2000) showed that expression of langerin induces membrane superimposition and zippering to produce BGs. They proposed that mannose binding by langerin leads to internalization of antigen into BGs and possibly access to the class I pathway.

Full details of the abovementioned studies are described in the following publications, the disclosure of which are hereby incorporated by reference:

Valladeau, J.; Clair-Moninot, V.; Dezutter-Dambuyant, C.; Pin, J.-J.; Kissenpfennig, A.; Mattei, M.-G.; Ait-Yahia, S.; Bates, E. E. M.; Malissen, B.; Koch, F.; Fossiez, F.; Romani, N.; Lebecque, S.; Saeland, S.: Identification of mouse langerin/CD207 in Langerhans cells and some dendritic cells of lymphoid tissues. J. Immun. 168:782-792, 2002; and Valladeau, J.; Ravel, O.; Dezutter-Dambuyant, C.; Moore, K.; Kleijmeer, M.; Liu, Y.; Duvert-Frances, V.; Vincent, C.; Schmitt, D.; Davoust, J.; Caux, C.; Lebecque, S.; Saeland, S.: Lan.

Further studies establishing the function and utilities of LANGERIN are found in John Hopkins OMIM database record ID 604862, and in sited publications numbered 7298-7299 listed in the bibliography section hereinbelow, which are also hereby incorporated by reference. Midline 1 (Opitz/BBB syndrome) (MID1, Accession NM_000381) is another VGAM688 host target gene. MID1 BINDING SITE is HOST TARGET binding site found in the 3' untranslated region of mRNA encoded by MID1, corresponding to a HOST TARGET binding site such as BINDING SITE I, BINDING SITE II or BINDING SITE III. Table 2 illustrates the complementarity of the nucleotide sequences of MID1 BINDING SITE, designated SEQ ID:5956, to the nucleotide sequence of VGAM688 RNA, herein designated VGAM RNA, also designated SEQ ID:3399.

Another function of VGAM688 is therefore inhibition of Midline 1 (Opitz/BBB syndrome) (MID1, Accession NM_000381). Accordingly, utilities of VGAM688 include diagnosis, prevention and treatment of diseases and clinical conditions associated with MID1. KIAA0461 (Accession XM_047883) is another VGAM688 host target gene. KIAA0461 BINDING SITE is HOST TARGET binding site found in the 3' untranslated region of mRNA encoded by KIAA0461, corresponding to a HOST TARGET binding site such as BINDING SITE I, BINDING SITE II or BINDING SITE III. Table 2 illustrates the complementarity of the nucleotide sequences of KIAA0461 BINDING SITE, designated SEQ ID:35076, to the nucleotide sequence of VGAM688 RNA, herein designated VGAM RNA, also designated SEQ ID:3399.

Another function of VGAM688 is therefore inhibition of KIAA0461 (Accession XM_047883). Accordingly, utilities of VGAM688 include diagnosis, prevention and treatment of diseases and clinical conditions associated with KIAA0461. LOC131000 (Accession XM_067145) is another VGAM688 host target gene. LOC131000 BINDING SITE is HOST TARGET binding site found in the 5' untranslated region of mRNA encoded by LOC131000, corresponding to a HOST TARGET binding site such as BINDING SITE I, BINDING SITE II or BINDING SITE III. Table 2 illustrates the complementarity of the nucleotide sequences of LOC131000 BINDING SITE, designated SEQ ID:37350, to the nucleotide sequence of VGAM688 RNA, herein designated VGAM RNA, also designated SEQ ID:3399.

Another function of VGAM688 is therefore inhibition of LOC131000 (Accession XM_067145). Accordingly, utilities of VGAM688 include diagnosis, prevention and treatment of diseases and clinical conditions associated with LOC131000. FIG. 1 further provides a conceptual description of a novel bioinformatically detected viral gene of the present invention, referred to here as Viral Genomic Address Messenger 689 (VGAM689) viral gene, which modulates expression of respective host target genes thereof, the function and utility of which host target genes is known in the art.

VGAM689 is a novel bioinformatically detected regulatory, non protein coding, viral micro RNA (miRNA) gene. The method by which VGAM689 was detected is described hereinabove with reference to FIGS. 1-8.

VGAM689 gene, herein designated VGAM GENE, is a viral gene contained in the genome of Human Coronavirus 229E. VGAM689 host target gene, herein designated VGAM HOST TARGET GENE, is a human gene contained in the human genome.

VGAM689 gene encodes a VGAM689 precursor RNA, herein designated VGAM PRECURSOR RNA. Similar to other miRNA genes, and unlike most ordinary genes, VGAM689 precursor RNA does not encode a protein. A nucleotide sequence identical or highly similar to the nucleotide sequence of VGAM689 precursor RNA is designated SEQ ID:675, and is provided hereinbelow with reference to the sequence listing part. Nucleotide sequence SEQ ID:675 is located at position 19049 relative to the genome of Human Coronavirus 229E.

VGAM689 precursor RNA folds onto itself, forming VGAM689 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM689 folded precursor RNA into VGAM689 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM689 RNA is designated SEQ ID:3400, and is provided hereinbelow with reference to the sequence listing part.

VGAM689 host target gene, herein designated VGAM HOST TARGET GENE, encodes a corresponding messenger RNA, VGAM689 host target RNA, herein designated VGAM HOST TARGET RNA. VGAM689 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM689 RNA, herein designated VGAM RNA, binds complementarily to one or more host target binding sites located in untranslated regions of VGAM689 host target RNA, herein designated VGAM HOST TARGET RNA. This complementary binding is due to the fact that the nucleotide sequence of VGAM689 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM689 RNA, herein designated VGAM RNA, may have a different number of host target binding sites in untranslated regions of a VGAM689 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM689 RNA, herein designated VGAM RNA, to host target binding sites on VGAM689 host target RNA, herein designated VGAM HOST TARGET RNA, such as BINDING SITE I, BINDING SITE II and BINDING SITE III, inhibits translation of VGAM689 host target RNA into VGAM689 host target protein, herein designated VGAM HOST TARGET PROTEIN. VGAM host target protein is therefore outlined by a broken line.

It is appreciated that VGAM689 host target gene, herein designated VGAM HOST TARGET GENE, in fact represents a plurality of VGAM689 host target genes. The mRNA of each one of this plurality of VGAM689 host target genes comprises one or more host target binding sites, each having a nucleotide sequence which is at least partly complementary to VGAM689 RNA, herein designated VGAM RNA, and which when bound by VGAM689 RNA causes inhibition of translation of respective one or more VGAM689 host target proteins.

It is further appreciated by one skilled in the art that the mode of translational inhibition illustrated by FIG. 1 with specific reference to translational inhibition exerted by VGAM689 gene, herein designated VGAM GENE, on one or more VGAM689 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM689 is inhibition of expression of host target genes, as part of a novel viral mechanism of attacking a host. Accordingly, utilities of VGAM689 include diagnosis, prevention and treatment of viral infection by Human Coronavirus 229E. Specific functions, and accordingly utilities, of VGAM689 correlate with, and may be deduced from, the identity of the host target genes which VGAM689 binds and inhibits, and the function of these host target genes, as elaborated hereinbelow.

Nucleotide sequences of the VGAM689 precursor RNA, herein designated VGAM PRECURSOR RNA, and of the 'diced' VGAM689 RNA, herein designated VGAM RNA, and a schematic representation of the secondary folding of VGAM689 folded precursor RNA, herein designated VGAM FOLDED PRECURSOR RNA, of VGAM689 are further described hereinbelow with reference to Table 1.

Nucleotide sequences of host target binding sites, such as BINDING SITE-I, BINDING SITE-II and BINDING SITE-III of FIG. 1, found on VGAM689 host target RNA, and schematic representation of the complementarity of each of these host target binding sites to VGAM689 RNA, herein designated VGAM RNA, are described hereinbelow with reference to Table 2.

As mentioned hereinabove with reference to FIG. 1, a function of VGAM689 gene, herein designated VGAM is inhibition of expression of VGAM689 target genes. It is appreciated that specific functions, and accordingly utilities, of VGAM689 correlate with, and may be deduced from, the identity of the target genes which VGAM689 binds and inhibits, and the function of these target genes, as elaborated hereinbelow.

Nuclear Receptor Subfamily 2, Group E, Member 1 (NR2E1, Accession NM_003269) is a VGAM689 host target gene. NR2E1 BINDING SITE is HOST TARGET binding site found in the 3' untranslated region of mRNA encoded by NR2E1, corresponding to a HOST TARGET binding site such as BINDING SITE I, BINDING SITE II or BINDING SITE III. Table 2 illustrates the complementarity of the nucleotide sequences of NR2E1 BINDING SITE, designated SEQ ID:9277, to the nucleotide sequence of VGAM689 RNA, herein designated VGAM RNA, also designated SEQ ID:3400.

A function of VGAM689 is therefore inhibition of Nuclear Receptor Subfamily 2, Group E, Member 1 (NR2E1, Accession NM_003269), a gene which may be required for brain development and be involved in the regulation of retinal development. Accordingly, utilities of VGAM689 include diagnosis, prevention and treatment of diseases and clinical conditions associated with NR2E1. The function of NR2E1 has been established by previous studies. The product of the Drosophila terminal/gap gene 'tailless' (tll) is expressed in the embryonic brain and is required for brain development in flies. The tll protein is a ligand-activated nuclear receptor-type transcription factor. In 2 discrete subregions of the DNA-binding domain (DBD) that modulate the mode of DNA binding, the tll protein contains changes that distinguish it from all other nuclear receptors. Yu et al. (1994) identified the chick and mouse Tlx genes, encoding the vertebrate tll homolog. The vertebrate Tlx proteins are highly conserved, and both avian and mammalian Tlx contain the distinct tll DBD sequences. In vitro DNA-binding assays demonstrated that Tlx and tll share a target gene specificity that is unique among the nuclear receptor superfamily. Ectopic expression of chick Tlx in fly embryos caused a repression of segmentation comparable to that elicited by tll. In situ hybridization to chick and mouse embryos revealed that Tlx is expressed in the head ectoderm in early embryos. At later stages, cells expressing Tlx are localized in the ventricular zone of the neuroepithelial layer, suggesting that Tlx is involved in transcriptional control in undifferentiated neuroepithelial cells in the anterior regions of the developing vertebrate brain. By searching for genes located within the 6q21-q23 region of minimal deletion (RMD) associated with hematologic malignancies, Jackson et al. (1998) identified the human TLX homolog, also called NR2E1. The TLX gene contains 9 exons and spans 24 kb. By a combination of direct sequencing, exon trapping, and library screening, they isolated human TLX cDNAs. The predicted 386-amino acid human protein shares 97% and 99% identity with chick and mouse TLX, respectively. The highest degree of similarity between TLX and Drosophila tll is within the DBDs and the ligand-binding domains (LBDs) of the proteins. Northern blot analysis revealed that the approximately 3.9-kb TLX mRNA is expressed exclusively in brain.

Full details of the abovementioned studies are described in the following publications, the disclosure of which are hereby incorporated by reference:

Jackson, A.; Panayiotidis, P.; Foroni, L.: The human homologue of the Drosophila tailless gene (TLX): characterization and mapping to a region of common deletion in human lymphoid leukemia on chromosome 6q21. Genomics 50:34-43, 1998; and Yu, R. T.; McKeown, M.; Evans, R. M.; Umesono, K.: Relationship between Drosophila gap gene tailless and a vertebrate nuclear receptor Tlx. Nature 370:375-379, 1994.

Further studies establishing the function and utilities of NR2E1 are found in John Hopkins OMIM database record ID 603849, and in sited publications numbered 2416-2418 listed in the bibliography section hereinbelow, which are also hereby incorporated by reference. Synaptogyrin 1 (SYNGR1, Accession NM_004711) is another VGAM689 host target gene. SYNGR1 BINDING SITE is HOST TARGET binding site found in the 3' untranslated region of mRNA encoded by SYNGR1, corresponding to a HOST TARGET binding site such as BINDING SITE I, BINDING SITE II or BINDING SITE III. Table 2 illustrates the complementarity of the nucleotide sequences of SYNGR1 BINDING SITE, designated SEQ ID:11059, to the nucleotide sequence of VGAM689 RNA, herein designated VGAM RNA, also designated SEQ ID:3400.

Another function of VGAM689 is therefore inhibition of Synaptogyrin 1 (SYNGR1, Accession NM_004711), a gene which belongs to transmembrane synaptic vesicle protein and may function in membrane recycling. Accordingly, utilities of VGAM689 include diagnosis, prevention and treatment of diseases and clinical conditions associated with SYNGR1. The function of SYNGR1 and its association with various diseases and clinical conditions, has been established by previous studies, as described hereinabove with reference to VGAM107. Chromosome 12 Open Reading Frame 2 (C12orf2, Accession XM_096040) is another VGAM689 host target gene. C12orf2 BINDING SITE is HOST TARGET binding site found in the 3' untranslated region of mRNA encoded by C12orf2, corresponding to a HOST TARGET binding site such as BINDING SITE I, BINDING SITE II or BINDING SITE III. Table 2 illustrates the complementarity of the nucleotide sequences of C12orf2 BINDING SITE, designated SEQ ID:40291, to the nucleotide sequence of VGAM689 RNA, herein designated VGAM RNA, also designated SEQ ID:3400.

Another function of VGAM689 is therefore inhibition of Chromosome 12 Open Reading Frame 2 (C12orf2, Accession XM_096040). Accordingly, utilities of VGAM689 include diagnosis, prevention and treatment of diseases and clinical conditions associated with C12orf2. Chromosome 20 Open Reading Frame 21 (C20orf21, Accession NM_017798) is another VGAM689 host target gene. C20orf21 BINDING SITE is HOST TARGET binding site found in the 3' untranslated region of mRNA encoded by C20orf21, corresponding to a HOST TARGET binding site such as BINDING SITE I, BINDING SITE II or BINDING SITE III. Table 2 illustrates the complementarity of the nucleotide sequences of C20orf21 BINDING SITE, designated SEQ ID:19441, to the nucleotide sequence of VGAM689 RNA, herein designated VGAM RNA, also designated SEQ ID:3400.

Another function of VGAM689 is therefore inhibition of Chromosome 20 Open Reading Frame 21 (C20orf21, Accession NM_017798). Accordingly, utilities of VGAM689 include diagnosis, prevention and treatment of diseases and clinical conditions associated with C20orf21. MGC17330 (Accession NM_052880) is another VGAM689 host target gene. MGC17330 BINDING SITE is HOST TARGET binding site found in the 3' untranslated region of mRNA encoded by MGC17330, corresponding to a HOST TARGET binding site such as BINDING SITE I, BINDING SITE II or BINDING SITE III. Table 2 illustrates the complementarity of the nucleotide sequences of MGC17330 BINDING SITE, designated SEQ ID:27459, to the nucleotide sequence of VGAM689 RNA, herein designated VGAM RNA, also designated SEQ ID:3400.

Another function of VGAM689 is therefore inhibition of MGC17330 (Accession NM_052880). Accordingly, utilities of VGAM689 include diagnosis, prevention and treatment of diseases and clinical conditions associated with MGC17330. LOC150225 (Accession XM_097870) is another VGAM689 host target gene. LOC150225 BINDING SITE is HOST TARGET binding site found in the 3' untranslated region of mRNA encoded by LOC150225, corresponding to a HOST TARGET binding site such as BINDING SITE I, BINDING SITE II or BINDING SITE III. Table 2 illustrates the complementarity of the nucleotide sequences of LOC150225 BINDING SITE, designated SEQ ID:41193, to the nucleotide sequence of VGAM689 RNA, herein designated VGAM RNA, also designated SEQ ID:3400.

Another function of VGAM689 is therefore inhibition of LOC150225 (Accession XM_097870). Accordingly, utilities of VGAM689 include diagnosis, prevention and treatment of diseases and clinical conditions associated with LOC150225. LOC150481 (Accession XM_086929) is another VGAM689 host target gene. LOC150481 BINDING SITE is HOST TARGET binding site found in the 3' untranslated region of mRNA encoded by LOC150481, corresponding to a HOST TARGET binding site such as BINDING SITE I, BINDING SITE II or BINDING SITE III. Table 2 illustrates the complementarity of the nucleotide sequences of LOC150481 BINDING SITE, designated SEQ ID:38982, to the nucleotide sequence of VGAM689 RNA, herein designated VGAM RNA, also designated SEQ ID:3400.

Another function of VGAM689 is therefore inhibition of LOC150481 (Accession XM_086929). Accordingly, utilities of VGAM689 include diagnosis, prevention and treatment of diseases and clinical conditions associated with LOC150481.

LOC152316 (Accession XM_098185) is another VGAM689 host target gene. LOC152316 BINDING SITE is HOST TARGET binding site found in the 3' untranslated region of mRNA encoded by LOC152316, corresponding to a HOST TARGET binding site such as BINDING SITE I, BINDING SITE II or BINDING SITE III. Table 2 illustrates the complementarity of the nucleotide sequences of LOC152316 BINDING SITE, designated SEQ ID:41455, to the nucleotide sequence of VGAM689 RNA, herein designated VGAM RNA, also designated SEQ ID:3400.

Another function of VGAM689 is therefore inhibition of LOC152316 (Accession XM_098185). Accordingly, utilities of VGAM689 include diagnosis, prevention and treatment of diseases and clinical conditions associated with LOC152316. LOC158191 (Accession XM_088505) is another VGAM689 host target gene. LOC158191 BINDING SITE is HOST TARGET binding site found in the 3' untranslated region of mRNA encoded by LOC158191, corresponding to a HOST TARGET binding site such as BINDING SITE I, BINDING SITE II or BINDING SITE III. Table 2 illustrates the complementarity of the nucleotide sequences of LOC158191 BINDING SITE, designated SEQ ID:39760, to the nucleotide sequence of VGAM689 RNA, herein designated VGAM RNA, also designated SEQ ID:3400.

Another function of VGAM689 is therefore inhibition of LOC158191 (Accession XM_088505). Accordingly, utilities of VGAM689 include diagnosis, prevention and treatment of diseases and clinical conditions associated with LOC158191. LOC90072 (Accession XM_028702) is another VGAM689 host target gene. LOC90072 BINDING SITE is HOST TARGET binding site found in the 5' untranslated region of mRNA encoded by LOC90072, corresponding to a HOST TARGET binding site such as BINDING SITE I, BINDING SITE II or BINDING SITE III. Table 2 illustrates the complementarity of the nucleotide sequences of LOC90072 BINDING SITE, designated SEQ ID:30732, to the nucleotide sequence of VGAM689 RNA, herein designated VGAM RNA, also designated SEQ ID:3400.

Another function of VGAM689 is therefore inhibition of LOC90072 (Accession XM_028702). Accordingly, utilities of VGAM689 include diagnosis, prevention and treatment of diseases and clinical conditions associated with LOC90072. FIG. 1 further provides a conceptual description of a novel bioinformatically detected viral gene of the present invention, referred to here as Viral Genomic Address Messenger 690 (VGAM690) viral gene, which modulates expression of respective host target genes thereof, the function and utility of which host target genes is known in the art.

VGAM690 is a novel bioinformatically detected regulatory, non protein coding, viral micro RNA (miRNA) gene. The method by which VGAM690 was detected is described hereinabove with reference to FIGS. 1-8.

VGAM690 gene, herein designated VGAM GENE, is a viral gene contained in the genome of Human Coronavirus 229E. VGAM690 host target gene, herein designated VGAM HOST TARGET GENE, is a human gene contained in the human genome.

VGAM690 gene encodes a VGAM690 precursor RNA, herein designated VGAM PRECURSOR RNA. Similar to other miRNA genes, and unlike most ordinary genes, VGAM690 precursor RNA does not encode a protein. A nucleotide sequence identical or highly similar to the nucleotide sequence of VGAM690 precursor RNA is designated SEQ ID:676, and is provided hereinbelow with reference to the sequence listing part. Nucleotide sequence SEQ ID:676 is located at position 5793 relative to the genome of Human Coronavirus 229E.

VGAM690 precursor RNA folds onto itself, forming VGAM690 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM690 folded precursor RNA into VGAM690 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM690 RNA is designated SEQ ID:3401, and is provided hereinbelow with reference to the sequence listing part.

VGAM690 host target gene, herein designated VGAM HOST TARGET GENE, encodes a corresponding messenger RNA, VGAM690 host target RNA, herein designated VGAM HOST TARGET RNA. VGAM690 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM690 RNA, herein designated VGAM RNA, binds complementarily to one or more host target binding sites located in untranslated regions of VGAM690 host target RNA, herein designated VGAM HOST TARGET RNA. This complementary binding is due to the fact that the nucleotide sequence of VGAM690 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM690 RNA, herein designated VGAM RNA, may have a different number of host target binding sites in untranslated regions of a VGAM690 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM690 RNA, herein designated VGAM RNA, to host target binding sites on VGAM690 host target RNA, herein designated VGAM HOST TARGET RNA, such as BINDING SITE I, BINDING SITE II and BINDING SITE III, inhibits translation of VGAM690 host target RNA into VGAM690 host target protein, herein designated VGAM HOST TARGET PROTEIN. VGAM host target protein is therefore outlined by a broken line.

It is appreciated that VGAM690 host target gene, herein designated VGAM HOST TARGET GENE, in fact represents a plurality of VGAM690 host target genes. The mRNA of each one of this plurality of VGAM690 host target genes comprises one or more host target binding sites, each having a nucleotide sequence which is at least partly complementary to VGAM690 RNA, herein designated VGAM RNA, and which when bound by VGAM690 RNA causes inhibition of translation of respective one or more VGAM690 host target proteins.

It is further appreciated by one skilled in the art that the mode of translational inhibition illustrated by FIG. 1 with specific reference to translational inhibition exerted by VGAM690 gene, herein designated VGAM GENE, on one or more VGAM690 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM690 is inhibition of expression of host target genes, as part of a novel viral mechanism of attacking a host. Accordingly, utilities of VGAM690 include diagnosis, prevention and treatment of viral infection by Human Coronavirus 229E. Specific functions, and accordingly utilities, of VGAM690 correlate with, and may be deduced from, the identity of the host target genes which VGAM690 binds and inhibits, and the function of these host target genes, as elaborated hereinbelow.

Nucleotide sequences of the VGAM690 precursor RNA, herein designated VGAM PRECURSOR RNA, and of the 'diced' VGAM690 RNA, herein designated VGAM RNA, and a schematic representation of the secondary folding of VGAM690 folded precursor RNA, herein designated VGAM FOLDED PRECURSOR RNA, of VGAM690 are further described hereinbelow with reference to Table 1.

Nucleotide sequences of host target binding sites, such as BINDING SITE-I, BINDING SITE-II and BINDING SITE-III of FIG. 1, found on VGAM690 host target RNA, and schematic representation of the complementarity of each of these host target binding sites to VGAM690 RNA, herein designated VGAM RNA, are described hereinbelow with reference to Table 2.

As mentioned hereinabove with reference to FIG. 1, a function of VGAM690 gene, herein designated VGAM is inhibition of expression of VGAM690 target genes. It is appreciated that specific functions, and accordingly utilities, of VGAM690 correlate with, and may be deduced from, the identity of the target genes which VGAM690 binds and inhibits, and the function of these target genes, as elaborated hereinbelow.

Eyes Absent Homolog 2 (Drosophila) (EYA2, Accession NM_005244) is a VGAM690 host target gene. EYA2 BINDING SITE is HOST TARGET binding site found in the 3' untranslated region of mRNA encoded by EYA2, corresponding to a HOST TARGET binding site such as BINDING SITE I, BINDING SITE II or BINDING SITE III. Table 2 illustrates the complementarity of the nucleotide sequences of EYA2 BINDING SITE, designated SEQ ID:11752, to the nucleotide sequence of VGAM690 RNA, herein designated VGAM RNA, also designated SEQ ID:3401.

A function of VGAM690 is therefore inhibition of Eyes Absent Homolog 2 (Drosophila) (EYA2, Accession NM_005244), a gene which may be involved in development of the eye. Accordingly, utilities of VGAM690 include diagnosis, prevention and treatment of diseases and clinical conditions associated with EYA2. The function of EYA2 has been established by previous studies. Abdelhak et al. (1997) identified, by positional cloning, a gene at 8q13.3, which contains mutations in patients with branchiootorenal dysplasia (BOR; 113650). The gene is a human homolog of the Drosophila 'eyes absent' (eya), and was therefore called EYA1 (OMIM Ref. No. 601653). A highly conserved 271-amino acid C-terminal region was also found in the products of 2 other human genes that were subsequently called EYA2 and EYA3 (OMIM Ref. No. 601655), demonstrating the existence of a novel gene family. Some of these other members of the EYA gene family may underlie developmental defects because Abdelhak et al. (1997) demonstrated that all 3 of these genes are expressed in the ninth week of human development. Gene identification strategies that rely on cross-species comparison are based on the observation that functionally significant regions of the genome are highly conserved during evolution. Banfi et al. (1996) applied the power of Drosophila genetics to the vast resource of human cDNAs represented in the expressed sequence tag (EST) database to identify novel human genes of biologic interest. One human cDNA (GenBank H07988) showing significant homology to the gene causing the Drosophila mutant phenotype 'clift' ('eyes absent') was reported by Abdelhak et al. (1997) to be the EYA2 gene. Banfi et al. (1996) mapped the human gene to 20q13.1 using both fluorescence in situ hybridization and radiation hybrid mapping. Zimmerman et al. (1997) mapped the mouse Eya2 gene to chromosome 2 in a region syntenic with human 20q13. Duncan et al. (1997) likewise mapped EYA2 to human 20q13.1 and Eya2 to mouse chromosome 2. Duncan et al. (1997) found that Eya2 shows a dynamic pattern of expression during mouse development. Its expression was first detected in 8.5-day embryos in the region of head ectoderm fated to become the forebrain. At later stages of development, Eya2 was expressed in the olfactory placode and in a variety of neural crest derivatives. In the eye, expression of Eya2 was first detected after formation of the lens vesicle. At day 17.5, the highest level of Eya2 mRNA was observed in primary lens fibers. Low levels of Eya2 expression were detected in retina, sclera, and cornea. Duncan et al. (1997) stated that, although Eya2 is expressed relatively late in eye development, it belongs to a growing list of factors that may be essential for eye development among metazoan phyla. Like members of the PAX6 gene family (see OMIM Ref. No. 607108), 'eyes absent' gene family members were probably first involved in functions not related to vision, with recruitment for visual system formation and function occurring later. Xu et al. (1997) showed that in the limbs of 10.5-day mouse embryos, Eya1 expression was largely restricted to the flexor tendons, whereas Eya2 was expressed in the extensor tendons and probably also in the ligaments of the phalanges. They demonstrated that the proline/serine/threonine-rich N-terminal regions of the protein products of the Eya1, Eya2, and Eya3 genes have transcriptional activator activity. These results supported a role for the Eya genes in connective tissue patterning in the limbs.

Full details of the abovementioned studies are described in the following publications, the disclosure of which are hereby incorporated by reference:

Abdelhak, S.; Kalatzis, V.; Heilig, R.; Compain, S.; Samson, D.; Vincent, C.; Weil, D.; Cruaud, C.; Sahly, I.; Leibovici, M.; Bitner-Glindzicz, M.; Francis, M.; Lacombe, D.; Vigneron, J.; Charachon, R.; Boven, K.; Bedbeder, P.; Van Regemorter, N.; Weissenbach, J.; Petit, C.: A human homologue of the Drosophila eyes absent gene underlies branchio-oto-renal (BOR) syndrome and identifies a novel gene family. Nature Genet. 15:157-164, 1997; and Xu, P.-X.; Cheng, J.; Epstein, J. A.; Maas, R. L.: Mouse Eya genes are expressed during limb tendon development and encode a transcriptional activation function. Proc. Nat. Acad. Sci. 9.

Further studies establishing the function and utilities of EYA2 are found in John Hopkins OMIM database record ID 601654, and in sited publications numbered 12159-6024 listed in the bibliography section hereinbelow, which are also hereby incorporated by reference. Solute Carrier Family 35 (UDP-N-acetylglucosamine (UDP-GlcNAc) Transporter), Member 3 (SLC35A3, Accession NM_012243) is another VGAM690 host target gene. SLC35A3 BINDING SITE is HOST TARGET binding site found in the 3" untranslated region of mRNA encoded by SLC35A3, corresponding to a HOST TARGET binding site such as BINDING SITE I, BINDING SITE II or BINDING SITE III. Table 2 illustrates the complementarity of the nucleotide sequences of SLC35A3 BINDING SITE, designated SEQ ID:14549, to the nucleotide sequence of VGAM690 RNA, herein designated VGAM RNA, also designated SEQ ID:3401.

Another function of VGAM690 is therefore inhibition of Solute Carrier Family 35 (UDP-N-acetylglucosamine (UDP-GlcNAc) Transporter), Member 3 (SLC35A3, Accession NM_012243). Accordingly, utilities of VGAM690 include diagnosis, prevention and treatment of diseases and clinical conditions associated with SLC35A3. FLJ32499 (Accession NM_144607) is another VGAM690 host target gene. FLJ32499 BINDING SITE is HOST TARGET binding site found in the 3' untranslated region of mRNA encoded by FLJ32499, corresponding to a HOST TARGET binding site such as BINDING SITE I, BINDING SITE II or BINDING SITE III. Table 2 illustrates the complementarity of the nucleotide sequences of FLJ32499 BINDING SITE, designated SEQ ID:29421, to the nucleotide sequence of VGAM690 RNA, herein designated VGAM RNA, also designated SEQ ID:3401.

Another function of VGAM690 is therefore inhibition of FLJ32499 (Accession NM_144607). Accordingly, utilities of VGAM690 include diagnosis, prevention and treatment of diseases and clinical conditions associated with FLJ32499. KIAA1233 (Accession XM_032181) is another VGAM690 host target gene. KIAA1233 BINDING SITE is HOST TARGET binding site found in the 3' untranslated region of mRNA encoded by KIAA1233, corresponding to a HOST TARGET binding site such as BINDING SITE I, BINDING SITE II or BINDING SITE III. Table 2 illustrates the complementarity of the nucleotide sequences of KIAA1233 BINDING SITE, designated SEQ ID:31590, to the nucleotide sequence of VGAM690 RNA, herein designated VGAM RNA, also designated SEQ ID:3401.

Another function of VGAM690 is therefore inhibition of KIAA1233 (Accession XM_032181). Accordingly, utilities of VGAM690 include diagnosis, prevention and treatment of diseases and clinical conditions associated with KIAA1233. KIAA1910 (Accession XM_055514) is another VGAM690 host target gene. KIAA1910 BINDING SITE is HOST TARGET binding site found in the 3' untranslated region of mRNA encoded by KIAA1910, corresponding to a HOST TARGET binding site such as BINDING SITE I, BINDING SITE II or BINDING SITE III. Table 2 illustrates the complementarity of the nucleotide sequences of KIAA1910 BINDING SITE, designated SEQ ID:36284, to the nucleotide sequence of VGAM690 RNA, herein designated VGAM RNA, also designated SEQ ID:3401.

Another function of VGAM690 is therefore inhibition of KIAA1910 (Accession XM_055514). Accordingly, utilities of VGAM690 include diagnosis, prevention and treatment of diseases and clinical conditions associated with KIAA1910. MGC19556 (Accession NM_033551) is another VGAM690 host target gene. MGC19556 BINDING SITE is HOST TARGET binding site found in the 5' untranslated region of mRNA encoded by MGC19556, corresponding to a HOST TARGET binding site such as BINDING SITE I, BINDING SITE II or BINDING SITE III. Table 2 illustrates the complementarity of the nucleotide sequences of MGC19556 BINDING SITE, designated SEQ ID:27313, to the nucleotide sequence of VGAM690 RNA, herein designated VGAM RNA, also designated SEQ ID:3401.

Another function of VGAM690 is therefore inhibition of MGC19556 (Accession NM_033551). Accordingly, utilities of VGAM690 include diagnosis, prevention and treatment of diseases and clinical conditions associated with MGC19556. LOC150606 (Accession XM_097928) is another VGAM690 host target gene. LOC150606 BINDING SITE is HOST TARGET binding site found in the 5' untranslated region of mRNA encoded by LOC150606, corresponding to a HOST TARGET binding site such as BINDING SITE I, BINDING SITE II or BINDING SITE III. Table 2 illustrates the complementarity of the nucleotide sequences of LOC150606 BINDING SITE, designated SEQ ID:41232, to the nucleotide sequence of VGAM690 RNA, herein designated VGAM RNA, also designated SEQ ID:3401.

Another function of VGAM690 is therefore inhibition of LOC150606 (Accession XM_097928). Accordingly, utilities of VGAM690 include diagnosis, prevention and treatment of diseases and clinical conditions associated with LOC150606. LOC221683 (Accession XM_168089) is another VGAM690 host target gene. LOC221683 BINDING SITE is HOST TARGET binding site found in the 5' untranslated region of mRNA encoded by LOC221683, corresponding to a HOST TARGET binding site such as BINDING SITE I, BINDING SITE II or BINDING SITE III. Table 2 illustrates the complementarity of the nucleotide sequences of LOC221683 BINDING SITE, designated SEQ ID:45003, to the nucleotide sequence of VGAM690 RNA, herein designated VGAM RNA, also designated SEQ ID:3401.

Another function of VGAM690 is therefore inhibition of LOC221683 (Accession XM_168089). Accordingly, utilities of VGAM690 include diagnosis, prevention and treatment of diseases and clinical conditions associated with LOC221683. LOC93589 (Accession XM_052387) is another VGAM690 host target gene. LOC93589 BINDING SITE is HOST TARGET binding site found in the 3' untranslated region of mRNA encoded by LOC93589, corresponding to a HOST TARGET binding site such as BINDING SITE I, BINDING SITE II or BINDING SITE III. Table 2 illustrates the complementarity of the nucleotide sequences of LOC93589 BINDING SITE, designated SEQ ID:35976, to the nucleotide sequence of VGAM690 RNA, herein designated VGAM RNA, also designated SEQ ID:3401.

Another function of VGAM690 is therefore inhibition of LOC93589 (Accession XM_052387). Accordingly, utilities of VGAM690 include diagnosis, prevention and treatment of diseases and clinical conditions associated with LOC93589. FIG. 1 further provides a conceptual description of a novel bioinformatically detected viral gene of the present invention, referred to here as Viral Genomic Address Messenger 691 (VGAM691) viral gene, which modulates expression of respective host target genes thereof, the function and utility of which host target genes is known in the art.

VGAM691 is a novel bioinformatically detected regulatory, non protein coding, viral micro RNA (miRNA) gene. The method by which VGAM691 was detected is described hereinabove with reference to FIGS. 1-8.

VGAM691 gene, herein designated VGAM GENE, is a viral gene contained in the genome of Human Coronavirus 229E. VGAM691 host target gene, herein designated VGAM HOST TARGET GENE, is a human gene contained in the human genome.

VGAM691 gene encodes a VGAM691 precursor RNA, herein designated VGAM PRECURSOR RNA. Similar to other miRNA genes, and unlike most ordinary genes, VGAM691 precursor RNA does not encode a protein. A nucleotide sequence identical or highly similar to the nucleotide sequence of VGAM691 precursor RNA is designated SEQ ID:677, and is provided hereinbelow with reference to the sequence listing part. Nucleotide sequence SEQ ID:677 is located at position 13850 relative to the genome of Human Coronavirus 229E.

VGAM691 precursor RNA folds onto itself, forming VGAM691 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM691 folded precursor RNA into VGAM691 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM691 RNA is designated SEQ ID:3402, and is provided hereinbelow with reference to the sequence listing part.

VGAM691 host target gene, herein designated VGAM HOST TARGET GENE, encodes a corresponding messenger RNA, VGAM691 host target RNA, herein designated VGAM HOST TARGET RNA. VGAM691 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM691 RNA, herein designated VGAM RNA, binds complementarily to one or more host target binding sites located in untranslated regions of VGAM691 host target RNA, herein designated VGAM HOST TARGET RNA. This complementary binding is due to the fact that the nucleotide sequence of VGAM691 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM691 RNA, herein designated VGAM RNA, may have a different number of host target binding sites in untranslated regions of a VGAM691 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM691 RNA, herein designated VGAM RNA, to host target binding sites on VGAM691 host target RNA, herein designated VGAM HOST TARGET RNA, such as BINDING SITE I, BINDING SITE II and BINDING SITE III, inhibits translation of VGAM691 host target RNA into VGAM691 host target protein, herein designated VGAM HOST TARGET PROTEIN.

VGAM host target protein is therefore outlined by a broken line.

It is appreciated that VGAM691 host target gene, herein designated VGAM HOST TARGET GENE, in fact represents a plurality of VGAM691 host target genes. The mRNA of each one of this plurality of VGAM691 host target genes comprises one or more host target binding sites, each having a nucleotide sequence which is at least partly complementary to VGAM691 RNA, herein designated VGAM RNA, and which when bound by VGAM691 RNA causes inhibition of translation of respective one or more VGAM691 host target proteins.

It is further appreciated by one skilled in the art that the mode of translational inhibition illustrated by FIG. 1 with specific reference to translational inhibition exerted by VGAM691 gene, herein designated VGAM GENE, on one or more VGAM691 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM691 is inhibition of expression of host target genes, as part of a novel viral mechanism of attacking a host. Accordingly, utilities of VGAM691 include diagnosis, prevention and treatment of viral infection by Human Coronavirus 229E. Specific functions, and accordingly utilities, of VGAM691 correlate with, and may be deduced from, the identity of the host target genes which VGAM691 binds and inhibits, and the function of these host target genes, as elaborated hereinbelow.

Nucleotide sequences of the VGAM691 precursor RNA, herein designated VGAM PRECURSOR RNA, and of the 'diced' VGAM691 RNA, herein designated VGAM RNA, and a schematic representation of the secondary folding of VGAM691 folded precursor RNA, herein designated VGAM FOLDED PRECURSOR RNA, of VGAM691 are further described hereinbelow with reference to Table 1.

Nucleotide sequences of host target binding sites, such as BINDING SITE-I, BINDING SITE-II and BINDING SITE-III of FIG. 1, found on VGAM691 host target RNA, and schematic representation of the complementarity of each of these host target binding sites to VGAM691 RNA, herein designated VGAM RNA, are described hereinbelow with reference to Table 2.

As mentioned hereinabove with reference to FIG. 1, a function of VGAM691 gene, herein designated VGAM is inhibition of expression of VGAM691 target genes. It is appreciated that specific functions, and accordingly utilities, of VGAM691 correlate with, and may be deduced from, the identity of the target genes which VGAM691 binds and inhibits, and the function of these target genes, as elaborated hereinbelow.

Glutamate Decarboxylase 1 (brain, 67 kDa) (GAD1, Accession NM_000817) is a VGAM691 host target gene. GAD1 BINDING SITE is HOST TARGET binding site found in the 3' untranslated region of mRNA encoded by GAD1, corresponding to a HOST TARGET binding site such as BINDING SITE I, BINDING SITE II or BINDING SITE III. Table 2 illustrates the complementarity of the nucleotide sequences of GAD1 BINDING SITE, designated SEQ ID:6479, to the nucleotide sequence of VGAM691 RNA, herein designated VGAM RNA, also designated SEQ ID:3402.

A function of VGAM691 is therefore inhibition of Glutamate Decarboxylase 1 (brain, 67 kDa) (GAD1, Accession NM_000817), a gene which catalyzes the conversion of glutamic acid to gamma-aminobutyric acid. Accordingly, utilities of VGAM691 include diagnosis, prevention and treatment of diseases and clinical conditions associated with GAD1. The function of GAD1 has been established by previous studies. Using a genomic probe from a human fetal brain library, Sparkes et al. (1987) probed the DNA of a mouse/human somatic cell hybrid panel and assigned the GAD gene to human chromosome 2. Kelly et al. (1992) confirmed the assignment of GAD1 to chromosome 2, using PCR to amplify specifically the human sequence in rodent/human somatic cell hybrid DNAs. They also reported the full nucleotide sequence of the cDNA and the deduced amino acid sequence. Bu et al. (1992) mapped the GAD1 gene to 2q31 by in situ hybridization of fluorescently labeled GAD probes to human chromosomes. They demonstrated that the GAD1 gene encodes a polypeptide of 67,000 molecular weight, with 594 amino acid residues. The GAD2 gene (OMIM Ref. No. 138275), located on 10p11.23, encodes a polypeptide of 65,000 molecular weight (GAD65), with 585 amino acid residues. Brilliant et al. (1990) showed by Southern analysis of mouse-hamster hybrid cells and by interspecific backcrosses and recombinant inbred strains that the mouse equivalent (Gad1) is located on chromosome 2 and that an apparent pseudogene is located on mouse chromosome 10. The mouse Gad1 locus is part of a conserved homology between mouse chromosome 2 and human 2q. By in situ hybridization, Edelhoff et al. (1993) also assigned GAD1 to human 2q31 and to mouse chromosome 2D in a known region of conservation between human and mouse. Animal model experiments lend further support to the function of GAD1. The remaining exon-intron boundaries occur at identical positions in the 2 cDNAs, suggesting that they derive from a common ancestral GAD gene. In addition to its role as an inhibitory neurotransmitter, GABA is presumed to be involved in the development and plasticity of the nervous system. GABA is synthesized by glutamic acid decarboxylase, but the respective roles of its 2 isoforms, GAD65 and GAD67, had not been determined. Asada et al. (1996, 1997) undertook the selective elimination of each GAD isoform by gene targeting to clarify this issue. Asada et al. (1996) found that GAD65 -/- mice showed no change in brain GABA content or animal behavior, except for a slight increase in susceptibility to seizures. Asada et al. (1997) produced GAD67 -/- mice. These mice were born at the expected frequency but died of severe cleft palate during the first morning after birth. GAD activities and GABA contents were reduced to 20 and 7%, respectively, in the cerebral cortex of the newborn GAD67 -/- mice. Their brains, however, did not show any discernible defects. Previous pharmacologic and genetic investigations suggested the involvement of GABA in palate formation, but this was the first demonstration of a role for GAD67-derived GABA in the development of nonneural tissue. Independently, Condie et al. (1997) found defects in the formation of the palate in mice with a targeted mutation in the gene encoding GAD67. Previous observations had suggested a role of GABA in palate development. Analysis of mice with mutations in the beta-3 gamma-GABA receptor (GABRB3; 137192) had demonstrated that these mutations are associated with cleft secondary palate in mice. The phenotype in the GABRB3 mutants showed that this gene is somehow involved in palate development but did not demonstrate that GABA is the ligand involved in this particular function. The results of Condie et al. (1997), demonstrating a similar phenotype between the receptor and ligand mutations, demonstrated a role for GABA signaling in normal palate development.

It is appreciated that the abovementioned animal model for GAD1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Asada, H.; Kawamura, Y.; Maruyama, K.; Kume, H.; Ding, R.-G.; Ji, F. Y.; Kanbara, N.; Kuzume, H.; Sanbo, M.; Yagi, T.; Obata, K.: Mice lacking the 65 kDa isoform of glutamic acid decarboxylase (GAD65) maintain normal levels of GAD67 and GABA in their brains but are susceptible to seizures. Biochem. Biophys. Res. Commun. 229:891-895, 1996; and Scriver, C. R.; Hutchison, J. H.: The vitamin B6 deficiency syndrome in human infancy: biochemical and clinical observations. Pediatrics 31:240-250, 1963.

Further studies establishing the function and utilities of GAD1 are found in John Hopkins OMIM database record ID 605363, and in sited publications numbered 11924-6634, 11925-6636, 11926-6639, 1241-124 and 6640 listed in the bibliography section hereinbelow, which are also hereby incorporated by reference. FLJ22028 (Accession NM_024854) is another VGAM691 host target gene. FLJ22028 BINDING SITE is HOST TARGET binding site found in the 3' untranslated region of mRNA encoded by FLJ22028, corresponding to a HOST TARGET binding site such as BINDING SITE I, BINDING SITE II or BINDING SITE III. Table 2 illustrates the complementarity of the nucleotide sequences of FLJ22028 BINDING SITE, designated SEQ ID:24284, to the nucleotide sequence of VGAM691 RNA, herein designated VGAM RNA, also designated SEQ ID:3402.

Another function of VGAM691 is therefore inhibition of FLJ22028 (Accession NM_024854). Accordingly, utilities of VGAM691 include diagnosis, prevention and treatment of diseases and clinical conditions associated with FLJ22028. FIG. 1 further provides a conceptual description of a novel bioinformatically detected viral gene of the present invention, referred to here as Viral Genomic Address Messenger 692 (VGAM692) viral gene, which modulates expression of respective host target genes thereof, the function and utility of which host target genes is known in the art.

VGAM692 is a novel bioinformatically detected regulatory, non protein coding, viral micro RNA (miRNA) gene. The method by which VGAM692 was detected is described hereinabove with reference to FIGS. 1-8.

VGAM692 gene, herein designated VGAM GENE, is a viral gene contained in the genome of Human Coronavirus 229E. VGAM692 host target gene, herein designated VGAM HOST TARGET GENE, is a human gene contained in the human genome.

VGAM692 gene encodes a VGAM692 precursor RNA, herein designated VGAM PRECURSOR RNA. Similar to other miRNA genes, and unlike most ordinary genes, VGAM692 precursor RNA does not encode a protein. A nucleotide sequence identical or highly similar to the nucleotide sequence of VGAM692 precursor RNA is designated SEQ ID:678, and is provided hereinbelow with reference to the sequence listing part. Nucleotide sequence SEQ ID:678 is located at position 6444 relative to the genome of Human Coronavirus 229E.

VGAM692 precursor RNA folds onto itself, forming VGAM692 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM692 folded precursor RNA into VGAM692 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM692 RNA is designated SEQ ID:3403, and is provided hereinbelow with reference to the sequence listing part.

VGAM692 host target gene, herein designated VGAM HOST TARGET GENE, encodes a corresponding messenger RNA, VGAM692 host target RNA, herein designated VGAM HOST TARGET RNA. VGAM692 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM692 RNA, herein designated VGAM RNA, binds complementarily to one or more host target binding sites located in untranslated regions of VGAM692 host target RNA, herein designated VGAM HOST TARGET RNA. This complementary binding is due to the fact that the nucleotide sequence of VGAM692 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM692 RNA, herein designated VGAM RNA, may have a different number of host target binding sites in untranslated regions of a VGAM692 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM692 RNA, herein designated VGAM RNA, to host target binding sites on VGAM692 host target RNA, herein designated VGAM HOST TARGET RNA, such as BINDING SITE I, BINDING SITE II and BINDING SITE III, inhibits translation of VGAM692 host target RNA into VGAM692 host target protein, herein designated VGAM HOST TARGET PROTEIN. VGAM host target protein is therefore outlined by a broken line.

It is appreciated that VGAM692 host target gene, herein designated VGAM HOST TARGET GENE, in fact represents a plurality of VGAM692 host target genes. The mRNA of each one of this plurality of VGAM692 host target genes comprises one or more host target binding sites, each having a nucleotide sequence which is at least partly complementary to VGAM692 RNA, herein designated VGAM RNA, and which when bound by VGAM692 RNA causes inhibition of translation of respective one or more VGAM692 host target proteins.

It is further appreciated by one skilled in the art that the mode of translational inhibition illustrated by FIG. 1 with specific reference to translational inhibition exerted by VGAM692 gene, herein designated VGAM GENE, on one or more VGAM692 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM692 is inhibition of expression of host target genes, as part of a novel viral mechanism of attacking a host. Accordingly, utilities of VGAM692 include diagnosis, prevention and treatment of viral infection by Human Coronavirus 229E. Specific functions, and accordingly utilities, of VGAM692 correlate with, and may be deduced from, the identity of the host target genes which VGAM692 binds and inhibits, and the function of these host target genes, as elaborated hereinbelow.

Nucleotide sequences of the VGAM692 precursor RNA, herein designated VGAM PRECURSOR RNA, and of the 'diced' VGAM692 RNA, herein designated VGAM RNA, and a schematic representation of the secondary folding of VGAM692 folded precursor RNA, herein designated VGAM FOLDED PRECURSOR RNA, of VGAM692 are further described hereinbelow with reference to Table 1.

Nucleotide sequences of host target binding sites, such as BINDING SITE-I, BINDING SITE-II and BINDING SITE-III of FIG. 1, found on VGAM692 host target RNA, and schematic representation of the complementarity of each of these host target binding sites to VGAM692 RNA, herein designated VGAM RNA, are described hereinbelow with reference to Table 2.

As mentioned hereinabove with reference to FIG. 1, a function of VGAM692 gene, herein designated VGAM is inhibition of expression of VGAM692 target genes. It is appreciated that specific functions, and accordingly utilities, of VGAM692 correlate with, and may be deduced from, the identity of the target genes which VGAM692 binds and inhibits, and the function of these target genes, as elaborated hereinbelow.

CGI-142 (Accession NM_016073) is a VGAM692 host target gene. CGI-142 BINDING SITE is HOST TARGET binding site found in the 3' untranslated region of mRNA encoded by CGI-142, corresponding to a HOST TARGET binding site such as BINDING SITE I, BINDING SITE II or BINDING SITE III. Table 2 illustrates the complementarity of the nucleotide sequences of CGI-142 BINDING SITE, designated SEQ ID:18145, to the nucleotide sequence of VGAM692 RNA, herein designated VGAM RNA, also designated SEQ ID:3403.

A function of VGAM692 is therefore inhibition of CGI-142 (Accession NM_016073). Accordingly, utilities of VGAM692 include diagnosis, prevention and treatment of diseases and clinical conditions associated with CGI-142. FLJ10701 (Accession NM_018183) is another VGAM692 host target gene. FLJ10701 BINDING SITE is HOST TARGET binding site found in the 3' untranslated region of mRNA encoded by FLJ10701, corresponding to a HOST TARGET binding site such as BINDING SITE I, BINDING SITE II or BINDING SITE III. Table 2 illustrates the complementarity of the nucleotide sequences of FLJ10701 BINDING SITE, designated SEQ ID:20022, to the nucleotide sequence of VGAM692 RNA, herein designated VGAM RNA, also designated SEQ ID:3403.

Another function of VGAM692 is therefore inhibition of FLJ10701 (Accession NM_018183). Accordingly, utilities of VGAM692 include diagnosis, prevention and treatment of diseases and clinical conditions associated with FLJ10701. KIAA1363 (Accession XM_045056) is another VGAM692 host target gene. KIAA1363 BINDING SITE is HOST TARGET binding site found in the 3' untranslated region of mRNA encoded by KIAA1363, corresponding to a HOST TARGET binding site such as BINDING SITE I, BINDING SITE II or BINDING SITE III. Table 2 illustrates the complementarity of the nucleotide sequences of KIAA1363 BINDING SITE, designated SEQ ID:34331, to the nucleotide sequence of VGAM692 RNA, herein designated VGAM RNA, also designated SEQ ID:3403.

Another function of VGAM692 is therefore inhibition of KIAA1363 (Accession XM_045056). Accordingly, utilities of VGAM692 include diagnosis, prevention and treatment of diseases and clinical conditions associated with KIAA1363. FIG. 1 further provides a conceptual description of a novel bioinformatically detected viral gene of the present invention, referred to here as Viral Genomic Address Messenger 693 (VGAM693) viral gene, which modulates expression of respective host target genes thereof, the function and utility of which host target genes is known in the art.

VGAM693 is a novel bioinformatically detected regulatory, non protein coding, viral micro RNA (miRNA) gene. The method by which VGAM693 was detected is described hereinabove with reference to FIGS. 1-8.

VGAM693 gene, herein designated VGAM GENE, is a viral gene contained in the genome of Human Coronavirus 229E. VGAM693 host target gene, herein designated VGAM HOST TARGET GENE, is a human gene contained in the human genome.

VGAM693 gene encodes a VGAM693 precursor RNA, herein designated VGAM PRECURSOR RNA. Similar to other miRNA genes, and unlike most ordinary genes, VGAM693 precursor RNA does not encode a protein. A nucleotide sequence identical or highly similar to the nucleotide sequence of VGAM693 precursor RNA is designated SEQ ID:679, and is provided hereinbelow with reference to the sequence listing part. Nucleotide sequence SEQ ID:679 is located at position 4759 relative to the genome of Human Coronavirus 229E.

VGAM693 precursor RNA folds onto itself, forming VGAM693 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM693 folded precursor RNA into VGAM693 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM693 RNA is designated SEQ ID:3404, and is provided hereinbelow with reference to the sequence listing part.

VGAM693 host target gene, herein designated VGAM HOST TARGET GENE, encodes a corresponding messenger RNA, VGAM693 host target RNA, herein designated VGAM HOST TARGET RNA. VGAM693 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM693 RNA, herein designated VGAM RNA, binds complementarily to one or more host target binding sites located in untranslated regions of VGAM693 host target RNA, herein designated VGAM HOST TARGET RNA. This complementary binding is due to the fact that the nucleotide sequence of VGAM693 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM693 RNA, herein designated VGAM RNA, may have a different number of host target binding sites in untranslated regions of a VGAM693 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM693 RNA, herein designated VGAM RNA, to host target binding sites on VGAM693 host target RNA, herein designated VGAM HOST TARGET RNA, such as BINDING SITE I, BINDING SITE II and BINDING SITE III, inhibits translation of VGAM693 host target RNA into VGAM693 host target protein, herein designated VGAM HOST TARGET PROTEIN. VGAM host target protein is therefore outlined by a broken line.

It is appreciated that VGAM693 host target gene, herein designated VGAM HOST TARGET GENE, in fact represents a plurality of VGAM693 host target genes. The mRNA of each one of this plurality of VGAM693 host target genes comprises one or more host target binding sites, each having a nucleotide sequence which is at least partly complementary to VGAM693 RNA, herein designated VGAM RNA, and which when bound by VGAM693 RNA causes inhibition of translation of respective one or more VGAM693 host target proteins.

It is further appreciated by one skilled in the art that the mode of translational inhibition illustrated by FIG. 1 with specific reference to translational inhibition exerted by VGAM693 gene, herein designated VGAM GENE, on one or more VGAM693 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM693 is inhibition of expression of host target genes, as part of a novel viral mechanism of attacking a host. Accordingly, utilities of VGAM693 include diagnosis, prevention and treatment of viral infection by Human Coronavirus 229E. Specific functions, and accordingly utilities, of VGAM693 correlate with, and may be deduced from, the identity of the host target genes which VGAM693 binds and inhibits, and the function of these host target genes, as elaborated hereinbelow.

Nucleotide sequences of the VGAM693 precursor RNA, herein designated VGAM PRECURSOR RNA, and of the 'diced' VGAM693 RNA, herein designated VGAM RNA, and a schematic representation of the secondary folding of VGAM693 folded precursor RNA, herein designated VGAM FOLDED PRECURSOR RNA, of VGAM693 are further described hereinbelow with reference to Table 1.

Nucleotide sequences of host target binding sites, such as BINDING SITE-I, BINDING SITE-II and BINDING SITE-III of FIG. 1, found on VGAM693 host target RNA, and schematic representation of the complementarity of each of these host target binding sites to VGAM693 RNA, herein designated VGAM RNA, are described hereinbelow with reference to Table 2.

As mentioned hereinabove with reference to FIG. 1, a function of VGAM693 gene, herein designated VGAM is inhibition of expression of VGAM693 target genes. It is appreciated that specific functions, and accordingly utilities, of VGAM693 correlate with, and may be deduced from, the identity of the target genes which VGAM693 binds and inhibits, and the function of these target genes, as elaborated hereinbelow.

Contactin Associated Protein-like 2 (CNTNAP2, Accession NM_014141) is a VGAM693 host target gene. CNTNAP2 BINDING SITE is HOST TARGET binding site found in the 3' untranslated region of mRNA encoded by CNTNAP2, corresponding to a HOST TARGET binding site such as BINDING SITE I, BINDING SITE II or BINDING SITE III. Table 2 illustrates the complementarity of the nucleotide sequences of CNTNAP2 BINDING SITE, designated SEQ ID:15423, to the nucleotide sequence of VGAM693 RNA, herein designated VGAM RNA, also designated SEQ ID:3404.

A function of VGAM693 is therefore inhibition of Contactin Associated Protein-like 2 (CNTNAP2, Accession NM_014141). Accordingly, utilities of VGAM693 include diagnosis, prevention and treatment of diseases and clinical conditions associated with CNTNAP2. Protocadherin Beta 12 (PCDHB12, Accession NM_018932) is another VGAM693 host target gene. PCDHB12 BINDING SITE is HOST TARGET binding site found in the 3' untranslated region of mRNA encoded by PCDHB12, corresponding to a HOST TARGET binding site such as BINDING SITE I, BINDING SITE II or BINDING SITE III. Table 2 illustrates the complementarity of the nucleotide sequences of PCDHB12 BINDING SITE, designated SEQ ID:21003, to the nucleotide sequence of VGAM693 RNA, herein designated VGAM RNA, also designated SEQ ID:3404.

Another function of VGAM693 is therefore inhibition of Protocadherin Beta 12 (PCDHB12, Accession NM_018932). Accordingly, utilities of VGAM693 include diagnosis, prevention and treatment of diseases and clinical conditions associated with PCDHB12. Protocadherin Beta 7 (PCDHB7, Accession NM_018940) is another VGAM693 host target gene. PCDHB7 BINDING SITE is HOST TARGET binding site found in the 3' untranslated region of mRNA encoded by PCDHB7, corresponding to a HOST TARGET binding site such as BINDING SITE I, BINDING SITE II or BINDING SITE III. Table 2 illustrates the complementarity of the nucleotide sequences of PCDHB7 BINDING SITE, designated SEQ ID:21009, to the nucleotide sequence of VGAM693 RNA, herein designated VGAM RNA, also designated SEQ ID:3404.

Another function of VGAM693 is therefore inhibition of Protocadherin Beta 7 (PCDHB7, Accession NM_018940). Accordingly, utilities of VGAM693 include diagnosis, prevention and treatment of diseases and clinical conditions associated with PCDHB7. FLJ21302 (Accession NM_022901) is another VGAM693 host target gene. FLJ21302 BINDING SITE is HOST TARGET binding site found in the 3' untranslated region of mRNA encoded by FLJ21302, corresponding to a HOST TARGET binding site such as BINDING SITE I, BINDING SITE II or BINDING SITE III. Table 2 illustrates the complementarity of the nucleotide sequences of FLJ21302 BINDING SITE, designated SEQ ID:23185, to the nucleotide sequence of VGAM693 RNA, herein designated VGAM RNA, also designated SEQ ID:3404.

Another function of VGAM693 is therefore inhibition of FLJ21302 (Accession NM_022901). Accordingly, utilities of VGAM693 include diagnosis, prevention and treatment of diseases and clinical conditions associated with FLJ21302. FLJ22557 (Accession NM_024713) is another VGAM693 host target gene. FLJ22557 BINDING SITE is HOST TARGET binding site found in the 3' untranslated region of mRNA encoded by FLJ22557, corresponding to a HOST TARGET binding site such as BINDING SITE I, BINDING SITE II or BINDING SITE III. Table 2 illustrates the complementarity of the nucleotide sequences of FLJ22557 BINDING SITE, designated SEQ ID:24039, to the nucleotide sequence of VGAM693 RNA, herein designated VGAM RNA, also designated SEQ ID:3404.

Another function of VGAM693 is therefore inhibition of FLJ22557 (Accession NM_024713). Accordingly, utilities of VGAM693 include diagnosis, prevention and treatment of diseases and clinical conditions associated with FLJ22557. KIAA1228 (Accession XM_036408) is another VGAM693 host target gene. KIAA1228 BINDING SITE is HOST TARGET binding site found in the 3' untranslated region of mRNA encoded by KIAA1228, corresponding to a HOST TARGET binding site such as BINDING SITE I, BINDING SITE II or BINDING SITE III. Table 2 illustrates the complementarity of the nucleotide sequences of KIAA1228 BINDING SITE, designated SEQ ID:32448, to the nucleotide sequence of VGAM693 RNA, herein designated VGAM RNA, also designated SEQ ID:3404.

Another function of VGAM693 is therefore inhibition of KIAA1228 (Accession XM_036408). Accordingly, utilities of VGAM693 include diagnosis, prevention and treatment of diseases and clinical conditions associated with KIAA1228. Protocadherin 10 (PCDH10, Accession NM_032961) is another VGAM693 host target gene. PCDH10 BINDING SITE is HOST TARGET binding site found in the 3' untranslated region of mRNA encoded by PCDH10, corresponding to a HOST TARGET binding site such as BINDING SITE I, BINDING SITE II or BINDING SITE III. Table 2 illustrates the complementarity of the nucleotide sequences of PCDH10 BINDING SITE, designated SEQ ID:26772, to the nucleotide sequence of VGAM693 RNA, herein designated VGAM RNA, also designated SEQ ID:3404.

Another function of VGAM693 is therefore inhibition of Protocadherin 10 (PCDH10, Accession NM_032961). Accordingly, utilities of VGAM693 include diagnosis, prevention and treatment of diseases and clinical conditions associated with PCDH10. FIG. 1 further provides a conceptual description of a novel bioinformatically detected viral gene of the present invention, referred to here as Viral Genomic Address Messenger 694 (VGAM694) viral gene, which modulates expression of respective host target genes thereof, the function and utility of which host target genes is known in the art.

VGAM694 is a novel bioinformatically detected regulatory, non protein coding, viral micro RNA (miRNA) gene. The method by which VGAM694 was detected is described hereinabove with reference to FIGS. 1-8.

VGAM694 gene, herein designated VGAM GENE, is a viral gene contained in the genome of Human Coronavirus 229E. VGAM694 host target gene, herein designated VGAM HOST TARGET GENE, is a human gene contained in the human genome.

VGAM694 gene encodes a VGAM694 precursor RNA, herein designated VGAM PRECURSOR RNA. Similar to other miRNA genes, and unlike most ordinary genes, VGAM694 precursor RNA does not encode a protein. A nucleotide sequence identical or highly similar to the nucleotide sequence of VGAM694 precursor RNA is designated SEQ ID:680, and is provided hereinbelow with reference to the sequence listing part. Nucleotide sequence SEQ ID:680 is located at position 9591 relative to the genome of Human Coronavirus 229E.

VGAM694 precursor RNA folds onto itself, forming VGAM694 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM694 folded precursor RNA into VGAM694 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM694 RNA is designated SEQ ID:3405, and is provided hereinbelow with reference to the sequence listing part.

VGAM694 host target gene, herein designated VGAM HOST TARGET GENE, encodes a corresponding messenger RNA, VGAM694 host target RNA, herein designated VGAM HOST TARGET RNA. VGAM694 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM694 RNA, herein designated VGAM RNA, binds complementarily to one or more host target binding sites located in untranslated regions of VGAM694 host target RNA, herein designated VGAM HOST TARGET RNA. This complementary binding is due to the fact that the nucleotide sequence of VGAM694 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM694 RNA, herein designated VGAM RNA, may have a different number of host target binding sites in untranslated regions of a VGAM694 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM694 RNA, herein designated VGAM RNA, to host target binding sites on VGAM694 host target RNA, herein designated VGAM HOST TARGET RNA, such as BINDING SITE I, BINDING SITE II and BINDING SITE III, inhibits translation of VGAM694 host target RNA into VGAM694 host target protein, herein designated VGAM HOST TARGET PROTEIN. VGAM host target protein is therefore outlined by a broken line.

It is appreciated that VGAM694 host target gene, herein designated VGAM HOST TARGET GENE, in fact represents a plurality of VGAM694 host target genes. The mRNA of each one of this plurality of VGAM694 host target genes comprises one or more host target binding sites, each having a nucleotide sequence which is at least partly complementary to VGAM694 RNA, herein designated VGAM RNA, and which when bound by VGAM694 RNA causes inhibition of translation of respective one or more VGAM694 host target proteins.

It is further appreciated by one skilled in the art that the mode of translational inhibition illustrated by FIG. 1 with specific reference to translational inhibition exerted by VGAM694 gene, herein designated VGAM GENE, on one or more VGAM694 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM694 is inhibition of expression of host target genes, as part of a novel viral mechanism of attacking a host. Accordingly, utilities of VGAM694 include diagnosis, prevention and treatment of viral infection by Human Coronavirus 229E. Specific functions, and accordingly utilities, of VGAM694 correlate with, and may be deduced from, the identity of the host target genes which VGAM694 binds and inhibits, and the function of these host target genes, as elaborated hereinbelow.

Nucleotide sequences of the VGAM694 precursor RNA, herein designated VGAM PRECURSOR RNA, and of the 'diced' VGAM694 RNA, herein designated VGAM RNA, and a schematic representation of the secondary folding of VGAM694 folded precursor RNA, herein designated VGAM FOLDED PRECURSOR RNA, of VGAM694 are further described hereinbelow with reference to Table 1.

Nucleotide sequences of host target binding sites, such as BINDING SITE-I, BINDING SITE-II and BINDING SITE-III of FIG. 1, found on VGAM694 host target RNA, and schematic representation of the complementarity of each of these host target binding sites to VGAM694 RNA, herein designated VGAM RNA, are described hereinbelow with reference to Table 2.

As mentioned hereinabove with reference to FIG. 1, a function of VGAM694 gene, herein designated VGAM is inhibition of expression of VGAM694 target genes. It is appreciated that specific functions, and accordingly utilities, of VGAM694 correlate with, and may be deduced from, the identity of the target genes which VGAM694 binds and inhibits, and the function of these target genes, as elaborated hereinbelow.

Adenylate Cyclase 7 (ADCY7, Accession NM_001114) is a VGAM694 host target gene. ADCY7 BINDING SITE is HOST TARGET binding site found in the 3' untranslated region of mRNA encoded by ADCY7, corresponding to a HOST TARGET binding site such as BINDING SITE I, BINDING SITE II or BINDING SITE III. Table 2 illustrates the complementarity of the nucleotide sequences of ADCY7 BINDING SITE, designated SEQ ID:6780, to the nucleotide sequence of VGAM694 RNA, herein designated VGAM RNA, also designated SEQ ID:3405.

A function of VGAM694 is therefore inhibition of Adenylate Cyclase 7 (ADCY7, Accession NM_001114), a gene which this a membrane-bound, ca (2+)-inhibitable adenylyl cyclase. Accordingly, utilities of VGAM694 include diagnosis, prevention and treatment of diseases and clinical conditions associated with ADCY7. The function of ADCY7 and its association with various diseases and clinical conditions, has been established by previous studies, as described hereinabove with reference to VGAM108. EGF-like-domain, Multiple 4 (EGFL4, Accession XM_029883) is another VGAM694 host target gene. EGFL4 BINDING SITE is HOST TARGET binding site found in the 3' untranslated region of mRNA encoded by EGFL4, corresponding to a HOST TARGET binding site such as BINDING SITE I, BINDING SITE II or BINDING SITE III. Table 2 illustrates the complementarity of the nucleotide sequences of EGFL4 BINDING SITE, designated SEQ ID:30963, to the nucleotide sequence of VGAM694 RNA, herein designated VGAM RNA, also designated SEQ ID:3405.

Another function of VGAM694 is therefore inhibition of EGF-like-domain, Multiple 4 (EGFL4, Accession XM_029883). Accordingly, utilities of VGAM694 include diagnosis, prevention and treatment of diseases and clinical conditions associated with EGFL4. Glutaminase (GLS, Accession NM_014905) is another VGAM694 host target gene. GLS BINDING SITE is HOST TARGET binding site found in the 3' untranslated region of mRNA encoded by GLS, corresponding to a HOST TARGET binding site such as BINDING SITE I, BINDING SITE II or BINDING SITE III. Table 2 illustrates the complementarity of the nucleotide sequences of GLS BINDING SITE, designated SEQ ID:17105, to the nucleotide sequence of VGAM694 RNA, herein designated VGAM RNA, also designated SEQ ID:3405.

Another function of VGAM694 is therefore inhibition of Glutaminase (GLS, Accession NM_014905). Accordingly, utilities of VGAM694 include diagnosis, prevention and treatment of diseases and clinical conditions associated with GLS. Vanin 1 (VNN1, Accession NM_004666) is another VGAM694 host target gene. VNN1 BINDING SITE is HOST TARGET binding site found in the 3' untranslated region of mRNA encoded by VNN1, corresponding to a HOST TARGET binding site such as BINDING SITE I, BINDING SITE II or BINDING SITE III. Table 2 illustrates the complementarity of the nucleotide sequences of VNN1 BINDING SITE, designated SEQ ID:11038, to the nucleotide sequence of VGAM694 RNA, herein designated VGAM RNA, also designated SEQ ID:3405.

Another function of VGAM694 is therefore inhibition of Vanin 1 (VNN1, Accession NM_004666), a gene which may regulate steps in thymus homing and play a role in mammalian sexual development. Accordingly, utilities of VGAM694 include diagnosis, prevention and treatment of diseases and clinical conditions associated with VNN1. The function of VNN1 and its association with various diseases and clinical conditions, has been established by previous studies, as described hereinabove with reference to VGAM419. LOC56920 (Accession NM_020163) is another VGAM694 host target gene. LOC56920 BINDING SITE is HOST TARGET binding site found in the 3' untranslated region of mRNA encoded by LOC56920, corresponding to a HOST TARGET binding site such as BINDING SITE I, BINDING SITE II or BINDING SITE III. Table 2 illustrates the complementarity of the nucleotide sequences of LOC56920 BINDING SITE, designated SEQ ID:21380, to the nucleotide sequence of VGAM694 RNA, herein designated VGAM RNA, also designated SEQ ID:3405.

Another function of VGAM694 is therefore inhibition of LOC56920 (Accession NM_020163). Accordingly, utilities of VGAM694 include diagnosis, prevention and treatment of diseases and clinical conditions associated with LOC56920. LOC93463 (Accession XM_051528) is another VGAM694 host target gene. LOC93463 BINDING SITE is HOST TARGET binding site found in the 3' untranslated region of mRNA encoded by LOC93463, corresponding to a HOST TARGET binding site such as BINDING SITE I, BINDING SITE II or BINDING SITE III. Table 2 illustrates the complementarity of the nucleotide sequences of LOC93463 BINDING SITE, designated SEQ ID:35850, to the nucleotide sequence of VGAM694 RNA, herein designated VGAM RNA, also designated SEQ ID:3405.

Another function of VGAM694 is therefore inhibition of LOC93463 (Accession XM_051528). Accordingly, utilities of VGAM694 include diagnosis, prevention and treatment of diseases and clinical conditions associated with LOC93463. FIG. 1 further provides a conceptual description of a novel bioinformatically detected viral gene of the present invention, referred to here as Viral Genomic Address Messenger 695 (VGAM695) viral gene, which modulates expression of respective host target genes thereof, the function and utility of which host target genes is known in the art.

VGAM695 is a novel bioinformatically detected regulatory, non protein coding, viral micro RNA (miRNA) gene. The method by which VGAM695 was detected is described hereinabove with reference to FIGS. 1-8.

VGAM695 gene, herein designated VGAM GENE, is a viral gene contained in the genome of Human Coronavirus 229E. VGAM695 host target gene, herein designated VGAM HOST TARGET GENE, is a human gene contained in the human genome.

VGAM695 gene encodes a VGAM695 precursor RNA, herein designated VGAM PRECURSOR RNA. Similar to other miRNA genes, and unlike most ordinary genes, VGAM695 precursor RNA does not encode a protein. A nucleotide sequence identical or highly similar to the nucleotide sequence of VGAM695 precursor RNA is designated SEQ ID:681, and is provided hereinbelow with reference to the sequence listing part. Nucleotide sequence SEQ ID:681 is located at position 2788 relative to the genome of Human Coronavirus 229E.

VGAM695 precursor RNA folds onto itself, forming VGAM695 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM695 folded precursor RNA into VGAM695 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM695 RNA is designated SEQ ID:3406, and is provided hereinbelow with reference to the sequence listing part.

VGAM695 host target gene, herein designated VGAM HOST TARGET GENE, encodes a corresponding messenger RNA, VGAM695 host target RNA, herein designated VGAM HOST TARGET RNA. VGAM695 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM695 RNA, herein designated VGAM RNA, binds complementarily to one or more host target binding sites located in untranslated regions of VGAM695 host target RNA, herein designated VGAM HOST TARGET RNA. This complementary binding is due to the fact that the nucleotide sequence of VGAM695 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM695 RNA, herein designated VGAM RNA, may have a different number of host target binding sites in untranslated regions of a VGAM695 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM695 RNA, herein designated VGAM RNA, to host target binding sites on VGAM695 host target RNA, herein designated VGAM HOST TARGET RNA, such as BINDING SITE I, BINDING SITE II and BINDING SITE III, inhibits translation of VGAM695 host target RNA into VGAM695 host target protein, herein designated VGAM HOST TARGET PROTEIN. VGAM host target protein is therefore outlined by a broken line.

It is appreciated that VGAM695 host target gene, herein designated VGAM HOST TARGET GENE, in fact represents a plurality of VGAM695 host target genes. The mRNA of each one of this plurality of VGAM695 host target genes comprises one or more host target binding sites, each having a nucleotide sequence which is at least partly complementary to VGAM695 RNA, herein designated VGAM RNA, and which when bound by VGAM695 RNA causes inhibition of translation of respective one or more VGAM695 host target proteins.

It is further appreciated by one skilled in the art that the mode of translational inhibition illustrated by FIG. 1 with specific reference to translational inhibition exerted by VGAM695 gene, herein designated VGAM GENE, on one or more VGAM695 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM695 is inhibition of expression of host target genes, as part of a novel viral mechanism of attacking a host. Accordingly, utilities of VGAM695 include diagnosis, prevention and treatment of viral infection by Human Coronavirus 229E. Specific functions, and accordingly utilities, of VGAM695 correlate with, and may be deduced from, the identity of the host target genes which VGAM695 binds and inhibits, and the function of these host target genes, as elaborated hereinbelow.

Nucleotide sequences of the VGAM695 precursor RNA, herein designated VGAM PRECURSOR RNA, and of the 'diced' VGAM695 RNA, herein designated VGAM RNA, and a schematic representation of the secondary folding of VGAM695 folded precursor RNA, herein designated VGAM FOLDED PRECURSOR RNA, of VGAM695 are further described hereinbelow with reference to Table 1.

Nucleotide sequences of host target binding sites, such as BINDING SITE-I, BINDING SITE-II and BINDING SITE-III of FIG. 1, found on VGAM695 host target RNA, and schematic representation of the complementarity of each of these host target binding sites to VGAM695 RNA, herein designated VGAM RNA, are described hereinbelow with reference to Table 2.

As mentioned hereinabove with reference to FIG. 1, a function of VGAM695 gene, herein designated VGAM is inhibition of expression of VGAM695 target genes. It is appreciated that specific functions, and accordingly utilities, of VGAM695 correlate with, and may be deduced from, the identity of the target genes which VGAM695 binds and inhibits, and the function of these target genes, as elaborated hereinbelow.

Estrogen Receptor 1 (ESR1, Accession NM_000125) is a VGAM695 host target gene. ESR1 BINDING SITE is HOST TARGET binding site found in the 3' untranslated region of mRNA encoded by ESR1, corresponding to a HOST TARGET binding site such as BINDING SITE I, BINDING SITE II or BINDING SITE III. Table 2 illustrates the complementarity of the nucleotide sequences of ESR1 BINDING SITE, designated SEQ ID:5602, to the nucleotide sequence of VGAM695 RNA, herein designated VGAM RNA, also designated SEQ ID:3406.

A function of VGAM695 is therefore inhibition of Estrogen Receptor 1 (ESR1, Accession NM_000125), a gene which involved in hormone-mediated inhibition of gene expression. Accordingly, utilities of VGAM695 include diagnosis, prevention and treatment of diseases and clinical conditions associated with ESR1. The function of ESR1 has been established by previous studies. The estrogen receptor (ESR) is a ligand-activated transcription factor composed of several domains important for hormone binding, DNA binding, and activation of transcription. Walter et al. (1985) cloned and Greene et al. (1986) sequenced a cDNA for the entire translated portion of the messenger RNA for the estrogen receptor of MCF-7 human breast cancer cells. Expression with production of a functional protein was accomplished in Chinese hamster ovary cells. The 1,785 nucleotides of the cDNA correspond to a polypeptide of 595 amino acids and a molecular weight of 66,200 (about that estimated from other studies of the estrogen receptor). Amino acid sequence comparisons showed considerable similarities between human ESR, human GCR (OMIM Ref. No. 138040), and the putative v-erbA (OMIM Ref. No. 190120) oncogene product. Both ESR and GCR exert their effects by binding directly to an intranuclear receptor molecule that is weakly associated with nuclear components in the absence of ligand. Binding of hormone to its receptor results in conversion of the receptor-steroid complex to a form that binds with high affinity to nuclear components. Green et al. (1986) also cloned and sequenced human estrogen receptor cDNA, using the breast cancer cell line MCF-7. They found extensive homology between ESR cDNA and the ERBA oncogene. Chaidarun and Alexander (1998) examined the effects of a human ESR1 isoform on estrogen-mediated gene activation in U2-OS osteosarcoma cells. ESR1-5, an ESR1 variant generated by an alternate splice event that omits exon 5 and alters the reading frame of the resulting mRNA, was coexpressed with normal ESR1 in several estrogen-responsive neoplastic tissues. ESR1-5 encodes the hormone-independent trans-activating function (AF-1), as well as the constitutive receptor dimerization and DNA-binding domains. The ESR1-5 protein is prematurely truncated and lacks the majority of the hormone-binding and activating function-2 (AF-2) domains. When ESR1-5 was cotransfected with normal ESR1, both basal and estrogen-stimulated reporter activation were increased approximately 500% over the levels observed when cells were transfected with ESR1 alone. Electromobility shift/supershift assays using nuclear extracts of U2-OS cells stably transfected with ESR1 and ESR1-5 confirmed the constitutive binding of ESR1-5 and ESR1 protein to the estrogen-response element (ERE) sequence independent of estrogen, and also showed an increase in ESR1-5/ESR1-ERE complexes with estrogen treatment. These data were considered to be consistent with the interactive effects of normal ESR1 and ESR1-5 on transcription from classic ERE gene promoters. Chaidarun and Alexander (1998) concluded that ESR1-5 acts as a dominant-positive receptor that increases both basal and estrogen-stimulated gene transactivation of normal ESR1. Walter et al. (1985) determined that the human ESR gene maps to chromosome 6. By in situ hybridization, using a cDNA probe containing the coding sequence for the estrogen receptor, Gosden et al. (1986) assigned the gene to 6q24-q27. To localize ESR more precisely, Menasce et al. (1993) isolated a YAC containing the gene and mapped it to 6q25.1 by fluorescence in situ hybridization (FISH) and a new simple method of post-FISH chromosome banding. Using a single interspecific backcross, Justice et al. (1990) demonstrated the genetic location of the Esr gene in relation to other loci on mouse chromosome 10. Animal model experiments lend further support to the function of ESR1. Davis et al. (2002) noted that studies in human S and rodent models had suggested that estrogen may provide protection against age-related cataracts. The presence of estrogen receptors in the eye indicates that estrogen protection may result from direct interactions with its receptors in the eye, instead of being an indirect consequence from effects on another tissue. Davis et al. (2002) validated the concept that estrogen is beneficial for the eye. In transgenic mice expressing ER-delta-3, a natural variant of ESR1 with an in-frame deletion of exon 3 resulting from alternative splicing, they found that cortical cataracts spontaneously formed in females after puberty and progressed with age.

It is appreciated that the abovementioned animal model for ESR1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Greene, G. L.; Gilna, P.; Waterfield, M.; Baker, A.; Hort, Y.; Shine, J.: Sequence and expression of human estrogen receptor complementary DNA. Science 231:1150-1154, 1986; and Davis, V. L.; Chan, C.-C.; Schoen, T. J.; Couse, J. F.; Chader, G. J.; Korach, K. S.: An estrogen receptor repressor induces cataract formation in transgenic mice. Proc. Nat. Acad. Sci.

Further studies establishing the function and utilities of ESR1 are found in John Hopkins OMIM database record ID 133430, and in sited publications numbered 2132-2152, 877, 3104-313 and 3444-3446 listed in the bibliography section hereinbelow, which are also hereby incorporated by reference. Potassium Channel, Subfamily K, Member 4 (KCNK4, Accession NM_016611) is another VGAM695 host target gene. KCNK4 BINDING SITE is HOST TARGET binding site found in the 3' untranslated region of mRNA encoded by KCNK4, corresponding to a HOST TARGET binding site such as BINDING SITE I, BINDING SITE II or BINDING SITE III. Table 2 illustrates the complementarity of the nucleotide sequences of KCNK4 BINDING SITE, designated SEQ ID:18717, to the nucleotide sequence of VGAM695 RNA, herein designated VGAM RNA, also designated SEQ ID:3406.

Another function of VGAM695 is therefore inhibition of Potassium Channel, Subfamily K, Member 4 (KCNK4, Accession NM_016611). Accordingly, utilities of VGAM695 include diagnosis, prevention and treatment of diseases and clinical conditions associated with KCNK4. Neogenin Homolog 1 (chicken) (NEO1, Accession NM_002499) is another VGAM695 host target gene. NEO1 BINDING SITE is HOST TARGET binding site found in the 3' untranslated region of mRNA encoded by NEO1, corresponding to a HOST TARGET binding site such as BINDING SITE I, BINDING SITE II or BINDING SITE III. Table 2 illustrates the complementarity of the nucleotide sequences of NEO1 BINDING SITE, designated SEQ ID:8319, to the nucleotide sequence of VGAM695 RNA, herein designated VGAM RNA, also designated SEQ ID:3406.

Another function of VGAM695 is therefore inhibition of Neogenin Homolog 1 (chicken) (NEO1, Accession NM_002499), a gene which regulates the transition of undifferentiated proliferating cells to their differentiated state. Accordingly, utilities of VGAM695 include diagnosis, prevention and treatment of diseases and clinical conditions associated with NEO1. The function of NEO1 and its association with various diseases and clinical conditions, has been established by previous studies, as described hereinabove with reference to VGAM329. HDAC9-PENDING (Accession NM_014707) is another VGAM695 host target gene. HDAC9-PENDING BINDING SITE is HOST TARGET binding site found in the 3' untranslated region of mRNA encoded by HDAC9-PENDING, corresponding to a HOST TARGET binding site such as BINDING SITE I, BINDING SITE II or BINDING SITE III. Table 2 illustrates the complementarity of the nucleotide sequences of HDAC9-PENDING BINDING SITE, designated SEQ ID:16252, to the nucleotide sequence of VGAM695 RNA, herein designated VGAM RNA, also designated SEQ ID:3406.

Another function of VGAM695 is therefore inhibition of HDAC9-PENDING (Accession NM_014707). Accordingly, utilities of VGAM695 include diagnosis, prevention and treatment of diseases and clinical conditions associated with HDAC9-PENDING. KIAA1634 (Accession XM_032749) is another VGAM695 host target gene. KIAA1634 BINDING SITE is HOST TARGET binding site found in the 3' untranslated region of mRNA encoded by KIAA1634, corresponding to a HOST TARGET binding site such as BINDING SITE I, BINDING SITE II or BINDING SITE III. Table 2 illustrates the complementarity of the nucleotide sequences of KIAA1634 BINDING SITE, designated SEQ ID:31754, to the nucleotide sequence of VGAM695 RNA, herein designated VGAM RNA, also designated SEQ ID:3406.

Another function of VGAM695 is therefore inhibition of KIAA1634 (Accession XM_032749). Accordingly, utilities of VGAM695 include diagnosis, prevention and treatment of diseases and clinical conditions associated with KIAA1634. Tumor Protein P53 Inducible Nuclear Protein 1 (TP53INP1, Accession XM_053740) is another VGAM695 host target gene. TP53INP1 BINDING SITE1 and TP53INP1 BINDING SITE2 are HOST TARGET binding sites found in untranslated regions of mRNA encoded by TP53INP1, corresponding to HOST TARGET binding sites such as BINDING SITE I, BINDING SITE II or BINDING SITE III. Table 2 illustrates the complementarity of the nucleotide sequences of TP53INP1 BINDING SITE1 and TP53INP1 BINDING SITE2, designated SEQ ID:36120 and SEQ ID:27111 respectively, to the nucleotide sequence of VGAM695 RNA, herein designated VGAM RNA, also designated SEQ ID:3406.

Another function of VGAM695 is therefore inhibition of Tumor Protein P53 Inducible Nuclear Protein 1 (TP53INP1, Accession XM_053740). Accordingly, utilities of VGAM695 include diagnosis, prevention and treatment of diseases and clinical conditions associated with TP53INP1. FIG. 1 further provides a conceptual description of a novel bioinformatically detected viral gene of the present invention, referred to here as Viral Genomic Address Messenger 696 (VGAM696) viral gene, which modulates expression of respective host target genes thereof, the function and utility of which host target genes is known in the art.

VGAM696 is a novel bioinformatically detected regulatory, non protein coding, viral micro RNA (miRNA) gene. The method by which VGAM696 was detected is described hereinabove with reference to FIGS. 1-8.

VGAM696 gene, herein designated VGAM GENE, is a viral gene contained in the genome of Human Coronavirus 229E. VGAM696 host target gene, herein designated VGAM HOST TARGET GENE, is a human gene contained in the human genome.

VGAM696 gene encodes a VGAM696 precursor RNA, herein designated VGAM PRECURSOR RNA. Similar to other miRNA genes, and unlike most ordinary genes, VGAM696 precursor RNA does not encode a protein. A nucleotide sequence identical or highly similar to the nucleotide sequence of VGAM696 precursor RNA is designated SEQ ID:682, and is provided hereinbelow with reference to the sequence listing part. Nucleotide sequence SEQ ID:682 is located at position 13163 relative to the genome of Human Coronavirus 229E.

VGAM696 precursor RNA folds onto itself, forming VGAM696 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM696 folded precursor RNA into VGAM696 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM696 RNA is designated SEQ ID:3407, and is provided hereinbelow with reference to the sequence listing part.

VGAM696 host target gene, herein designated VGAM HOST TARGET GENE, encodes a corresponding messenger RNA, VGAM696 host target RNA, herein designated VGAM HOST TARGET RNA. VGAM696 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM696 RNA, herein designated VGAM RNA, binds complementarily to one or more host target binding sites located in untranslated regions of VGAM696 host target RNA, herein designated VGAM HOST TARGET RNA. This complementary binding is due to the fact that the nucleotide sequence of VGAM696 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM696 RNA, herein designated VGAM RNA, may have a different number of host target binding sites in untranslated regions of a VGAM696 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM696 RNA, herein designated VGAM RNA, to host target binding sites on VGAM696 host target RNA, herein designated VGAM HOST TARGET RNA, such as BINDING SITE I, BINDING SITE II and BINDING SITE III, inhibits translation of VGAM696 host target RNA into VGAM696 host target protein, herein designated VGAM HOST TARGET PROTEIN. VGAM host target protein is therefore outlined by a broken line.

It is appreciated that VGAM696 host target gene, herein designated VGAM HOST TARGET GENE, in fact represents a plurality of VGAM696 host target genes. The mRNA of each one of this plurality of VGAM696 host target genes comprises one or more host target binding sites, each having a nucleotide sequence which is at least partly complementary to VGAM696 RNA, herein designated VGAM RNA, and which when bound by VGAM696 RNA causes inhibition of translation of respective one or more VGAM696 host target proteins.

It is further appreciated by one skilled in the art that the mode of translational inhibition illustrated by FIG. 1 with specific reference to translational inhibition exerted by VGAM696 gene, herein designated VGAM GENE, on one or more VGAM696 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM696 is inhibition of expression of host target genes, as part of a novel viral mechanism of attacking a host. Accordingly, utilities of VGAM696 include diagnosis, prevention and treatment of viral infection by Human Coronavirus 229E. Specific functions, and accordingly utilities, of VGAM696 correlate with, and may be deduced from, the identity of the host target genes which VGAM696 binds and inhibits, and the function of these host target genes, as elaborated hereinbelow.

Nucleotide sequences of the VGAM696 precursor RNA, herein designated VGAM PRECURSOR RNA, and of the 'diced' VGAM696 RNA, herein designated VGAM RNA, and a schematic representation of the secondary folding of VGAM696 folded precursor RNA, herein designated VGAM FOLDED PRECURSOR RNA, of VGAM696 are further described hereinbelow with reference to Table 1.

Nucleotide sequences of host target binding sites, such as BINDING SITE-I, BINDING SITE-II and BINDING SITE-III of FIG. 1, found on VGAM696 host target RNA, and schematic representation of the complementarity of each of these host target binding sites to VGAM696 RNA, herein designated VGAM RNA, are described hereinbelow with reference to Table 2.

As mentioned hereinabove with reference to FIG. 1, a function of VGAM696 gene, herein designated VGAM is inhibition of expression of VGAM696 target genes. It is appreciated that specific functions, and accordingly utilities, of VGAM696 correlate with, and may be deduced from, the identity of the target genes which VGAM696 binds and inhibits, and the function of these target genes, as elaborated hereinbelow.

CGTHBA (Accession NM_012075) is a VGAM696 host target gene. CGTHBA BINDING SITE is HOST TARGET binding site found in the 3' untranslated region of mRNA encoded by CGTHBA, corresponding to a HOST TARGET binding site such as BINDING SITE I, BINDING SITE II or BINDING SITE III. Table 2 illustrates the complementarity of the nucleotide sequences of CGTHBA BINDING SITE, designated SEQ ID:14361, to the nucleotide sequence of VGAM696 RNA, herein designated VGAM RNA, also designated SEQ ID:3407.

A function of VGAM696 is therefore inhibition of CGTHBA (Accession NM_012075). Accordingly, utilities of VGAM696 include diagnosis, prevention and treatment of diseases and clinical conditions associated with CGTHBA. SORCS2 (Accession NM_020777) is another VGAM696 host target gene. SORCS2 BINDING SITE is HOST TARGET binding site found in the 3' untranslated region of mRNA encoded by SORCS2, corresponding to a HOST TARGET binding site such as BINDING SITE I, BINDING SITE II or BINDING SITE III. Table 2 illustrates the complementarity of the nucleotide sequences of SORCS2 BINDING SITE, designated SEQ ID:21871, to the nucleotide sequence of VGAM696 RNA, herein designated VGAM RNA, also designated SEQ ID:3407.

Another function of VGAM696 is therefore inhibition of SORCS2 (Accession NM_020777). Accordingly, utilities of VGAM696 include diagnosis, prevention and treatment of diseases and clinical conditions associated with SORCS2. Carbohydrate (chondroitin 6) Sulfotransferase 3 (CHST3, Accession NM_004273) is another VGAM696 host target gene. CHST3 BINDING SITE is HOST TARGET binding site found in the 3' untranslated region of mRNA encoded by CHST3, corresponding to a HOST TARGET binding site such as BINDING SITE I, BINDING SITE II or BINDING SITE III. Table 2 illustrates the complementarity of the nucleotide sequences of CHST3 BINDING SITE, designated SEQ ID:10478, to the nucleotide sequence of VGAM696 RNA, herein designated VGAM RNA, also designated SEQ ID:3407.

Another function of VGAM696 is therefore inhibition of Carbohydrate (chondroitin 6) Sulfotransferase 3 (CHST3, Accession NM_004273). Accordingly, utilities of VGAM696 include diagnosis, prevention and treatment of diseases and clinical conditions associated with CHST3. KIAA0205 (Accession NM_014873) is another VGAM696 host target gene. KIAA0205 BINDING SITE is HOST TARGET binding site found in the 3" untranslated region of mRNA encoded by KIAA0205, corresponding to a HOST TARGET binding site such as BINDING SITE I, BINDING SITE II or BINDING SITE III. Table 2 illustrates the complementarity of the nucleotide sequences of KIAA0205 BINDING SITE, designated SEQ ID:17004, to the nucleotide sequence of VGAM696 RNA, herein designated VGAM RNA, also designated SEQ ID:3407.

Another function of VGAM696 is therefore inhibition of KIAA0205 (Accession NM_014873). Accordingly, utilities of VGAM696 include diagnosis, prevention and treatment of diseases and clinical conditions associated with KIAA0205. MIG-6 (Accession NM_018948) is another VGAM696 host target gene. MIG-6 BINDING SITE is HOST TARGET binding site found in the 3' untranslated region of mRNA encoded by MIG-6, corresponding to a HOST TARGET binding site such as BINDING SITE I, BINDING SITE II or BINDING SITE III. Table 2 illustrates the complementarity of the nucleotide sequences of MIG-6 BINDING SITE, designated SEQ ID:21019, to the nucleotide sequence of VGAM696 RNA, herein designated VGAM RNA, also designated SEQ ID:3407.

Another function of VGAM696 is therefore inhibition of MIG-6 (Accession NM_018948). Accordingly, utilities of VGAM696 include diagnosis, prevention and treatment of diseases and clinical conditions associated with MIG-6. STAF65(gamma) (Accession NM_014860) is another VGAM696 host target gene. STAF65(gamma) BINDING SITE is HOST TARGET binding site found in the 3' untranslated region of mRNA encoded by STAF65(gamma), corresponding to a HOST TARGET binding site such as BINDING SITE I, BINDING SITE II or BINDING SITE III. Table 2 illustrates the complementarity of the nucleotide sequences of STAF65(gamma) BINDING SITE, designated SEQ ID:16921, to the nucleotide sequence of VGAM696 RNA, herein designated VGAM RNA, also designated SEQ ID:3407.

Another function of VGAM696 is therefore inhibition of STAF65(gamma) (Accession NM_014860). Accordingly, utilities of VGAM696 include diagnosis, prevention and treatment of diseases and clinical conditions associated with STAF65(gamma). LOC201685 (Accession XM_117325) is another VGAM696 host target gene. LOC201685 BINDING SITE is HOST TARGET binding site found in the 5' untranslated region of mRNA encoded by LOC201685, corresponding to a HOST TARGET binding site such as BINDING SITE I, BINDING SITE II or BINDING SITE III. Table 2 illustrates the complementarity of the nucleotide sequences of LOC201685 BINDING SITE, designated SEQ ID:43387, to the nucleotide sequence of VGAM696 RNA, herein designated VGAM RNA, also designated SEQ ID:3407.

Another function of VGAM696 is therefore inhibition of LOC201685 (Accession XM_117325). Accordingly, utilities of VGAM696 include diagnosis, prevention and treatment of diseases and clinical conditions associated with LOC201685. FIG. 1 further provides a conceptual description of a novel bioinformatically detected viral gene of the present invention, referred to here as Viral Genomic Address Messenger 697 (VGAM697) viral gene, which modulates expression of respective host target genes thereof, the function and utility of which host target genes is known in the art.

VGAM697 is a novel bioinformatically detected regulatory, non protein coding, viral micro RNA (miRNA) gene. The method by which VGAM697 was detected is described hereinabove with reference to FIGS. 1-8.

VGAM697 gene, herein designated VGAM GENE, is a viral gene contained in the genome of Human Coronavirus 229E. VGAM697 host target gene, herein designated VGAM HOST TARGET GENE, is a human gene contained in the human genome.

VGAM697 gene encodes a VGAM697 precursor RNA, herein designated VGAM PRECURSOR RNA. Similar to other miRNA genes, and unlike most ordinary genes, VGAM697 precursor RNA does not encode a protein. A nucleotide sequence identical or highly similar to the nucleotide sequence of VGAM697 precursor RNA is designated SEQ ID:683, and is provided hereinbelow with reference to the sequence listing part. Nucleotide sequence SEQ ID:683 is located at position 2149 relative to the genome of Human Coronavirus 229E.

VGAM697 precursor RNA folds onto itself, forming VGAM697 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM697 folded precursor RNA into VGAM697 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 68%) nucleotide sequence of VGAM697 RNA is designated SEQ ID:3408, and is provided hereinbelow with reference to the sequence listing part.

VGAM697 host target gene, herein designated VGAM HOST TARGET GENE, encodes a corresponding messenger RNA, VGAM697 host target RNA, herein designated VGAM HOST TARGET RNA. VGAM697 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM697 RNA, herein designated VGAM RNA, binds complementarily to one or more host target binding sites located in untranslated regions of VGAM697 host target RNA, herein designated VGAM HOST TARGET RNA. This complementary binding is due to the fact that the nucleotide sequence of VGAM697 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM697 RNA, herein designated VGAM RNA, may have a different number of host target binding sites in untranslated regions of a VGAM697 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM697 RNA, herein designated VGAM RNA, to host target binding sites on VGAM697 host target RNA, herein designated VGAM HOST TARGET RNA, such as BINDING SITE I, BINDING SITE II and BINDING SITE III, inhibits translation of VGAM697 host target RNA into VGAM697 host target protein, herein designated VGAM HOST TARGET PROTEIN. VGAM host target protein is therefore outlined by a broken line.

It is appreciated that VGAM697 host target gene, herein designated VGAM HOST TARGET GENE, in fact represents a plurality of VGAM697 host target genes. The mRNA of each one of this plurality of VGAM697 host target genes comprises one or more host target binding sites, each having a nucleotide sequence which is at least partly complementary to VGAM697 RNA, herein designated VGAM RNA, and which when bound by VGAM697 RNA causes inhibition of translation of respective one or more VGAM697 host target proteins.

It is further appreciated by one skilled in the art that the mode of translational inhibition illustrated by FIG. 1 with specific reference to translational inhibition exerted by VGAM697 gene, herein designated VGAM GENE, on one or more VGAM697 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM697 is inhibition of expression of host target genes, as part of a novel viral mechanism of attacking a host. Accordingly, utilities of VGAM697 include diagnosis, prevention and treatment of viral infection by Human Coronavirus 229E. Specific functions, and accordingly utilities, of VGAM697 correlate with, and may be deduced from, the identity of the host target genes which VGAM697 binds and inhibits, and the function of these host target genes, as elaborated hereinbelow.

Nucleotide sequences of the VGAM697 precursor RNA, herein designated VGAM PRECURSOR RNA, and of the 'diced' VGAM697 RNA, herein designated VGAM RNA, and a schematic representation of the secondary folding of VGAM697 folded precursor RNA, herein designated VGAM FOLDED PRECURSOR RNA, of VGAM697 are further described hereinbelow with reference to Table 1.

Nucleotide sequences of host target binding sites, such as BINDING SITE-I, BINDING SITE-II and BINDING SITE-III of FIG. 1, found on VGAM697 host target RNA, and schematic representation of the complementarity of each of these host target binding sites to VGAM697 RNA, herein designated VGAM RNA, are described hereinbelow with reference to Table 2.

As mentioned hereinabove with reference to FIG. 1, a function of VGAM697 gene, herein designated VGAM is inhibition of expression of VGAM697 target genes. It is appreciated that specific functions, and accordingly utilities, of VGAM697 correlate with, and may be deduced from, the identity of the target genes which VGAM697 binds and inhibits, and the function of these target genes, as elaborated hereinbelow.

Epithelial Membrane Protein 1 (EMP1, Accession NM_001423) is a VGAM697 host target gene. EMP1 BINDING SITE is HOST TARGET binding site found in the 3' untranslated region of mRNA encoded by EMP1, corresponding to a HOST TARGET binding site such as BINDING SITE I, BINDING SITE II or BINDING SITE III. Table 2 illustrates the complementarity of the nucleotide sequences of EMP1 BINDING SITE, designated SEQ ID:7135, to the nucleotide sequence of VGAM697 RNA, herein designated VGAM RNA, also designated SEQ ID:3408.

A function of VGAM697 is therefore inhibition of Epithelial Membrane Protein 1 (EMP1, Accession NM_001423), a gene which plays a role in squamous cell differentiation; member of the PMP22/EMP/MP20 family of membrane glycoproteins. Accordingly, utilities of VGAM697 include diagnosis, prevention and treatment of diseases and clinical conditions associated with EMP1. The function of EMP1 and its association with various diseases and clinical conditions, has been established by previous studies, as described hereinabove with reference to VGAM107. McKusick-Kaufman Syndrome (MKKS, Accession NM_018848) is another VGAM697 host target gene. MKKS BINDING SITE is HOST TARGET binding site found in the 5' untranslated region of mRNA encoded by MKKS, corresponding to a HOST TARGET binding site such as BINDING SITE I, BINDING SITE II or BINDING SITE III. Table 2 illustrates the complementarity of the nucleotide sequences of MKKS BINDING SITE, designated SEQ ID:20833, to the nucleotide sequence of VGAM697 RNA, herein designated VGAM RNA, also designated SEQ ID:3408.

Another function of VGAM697 is therefore inhibition of McKusick-Kaufman Syndrome (MKKS, Accession NM_018848). Accordingly, utilities of VGAM697 include diagnosis, prevention and treatment of diseases and clinical conditions associated with MKKS. Protocadherin Alpha 9 (PCDHA9, Accession NM_014005) is another VGAM697 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:15211, to the nucleotide sequence of VGAM697 RNA, herein designated VGAM RNA, also designated SEQ ID:3408.

Another function of VGAM697 is therefore inhibition of Protocadherin Alpha 9 (PCDHA9, Accession NM_014005), a gene which is a calcium-dependent cell-adhesion protein. Accordingly, utilities of VGAM697 include diagnosis, prevention and treatment of diseases and clinical conditions associated with PCDHA9. The function of PCDHA9 and its association with various diseases and clinical conditions, has been established by previous studies, as described hereinabove with reference to VGAM71. Tripartite Motif-containing 9 (TRIM9, Accession NM_015163) is another VGAM697 host target gene. TRIM9 BINDING SITE is HOST TARGET binding site found in the 3' untranslated region of mRNA encoded by TRIM9, corresponding to a HOST TARGET binding site such as BINDING SITE I, BINDING SITE II or BINDING SITE III. Table 2 illustrates the complementarity of the nucleotide sequences of TRIM9 BINDING SITE, designated SEQ ID:17512, to the nucleotide sequence of VGAM697 RNA, herein designated VGAM RNA, also designated SEQ ID:3408.

Another function of VGAM697 is therefore inhibition of Tripartite Motif-containing 9 (TRIM9, Accession NM_015163), a gene which may function as a positive regulator for mannosylphosphate transferase and is required to mediate mannosylphosphate transfer in both the core and outer chain portions of n-linked. oligosaccharides. Accordingly, utilities of VGAM697 include diagnosis, prevention and treatment of diseases and clinical conditions associated with TRIM9. The function of TRIM9 and its association with various diseases and clinical conditions, has been established by previous studies, as described hereinabove with reference to VGAM74. F-box Only Protein 21 (FBXO21, Accession NM_033624) is another VGAM697 host target gene. FBXO21 BINDING SITE is HOST TARGET binding site found in the 3' untranslated region of mRNA encoded by FBXO21, corresponding to a HOST TARGET binding site such as BINDING SITE I, BINDING SITE II or BINDING SITE III. Table 2 illustrates the complementarity of the nucleotide sequences of FBXO21 BINDING SITE, designated SEQ ID:27320, to the nucleotide sequence of VGAM697 RNA, herein designated VGAM RNA, also designated SEQ ID:3408.

Another function of VGAM697 is therefore inhibition of F-box Only Protein 21 (FBXO21, Accession NM_033624). Accordingly, utilities of VGAM697 include diagnosis, prevention and treatment of diseases and clinical conditions associated with FBXO21. KIAA0721 (Accession XM_171125) is another VGAM697 host target gene. KIAA0721 BINDING SITE1 and KIAA0721 BINDING SITE2 are HOST TARGET binding sites found in untranslated regions of mRNA encoded by KIAA0721, corresponding to HOST TARGET binding sites such as BINDING SITE I, BINDING SITE II or BINDING SITE III. Table 2 illustrates the complementarity of the nucleotide sequences of KIAA0721 BINDING SITE1 and KIAA0721 BINDING SITE2, designated SEQ ID:45927 and SEQ ID:22320 respectively, to the nucleotide sequence of VGAM697 RNA, herein designated VGAM RNA, also designated SEQ ID:3408.

Another function of VGAM697 is therefore inhibition of KIAA0721 (Accession XM_171125). Accordingly, utilities of VGAM697 include diagnosis, prevention and treatment of diseases and clinical conditions associated with KIAA0721. LOC157798 (Accession XM_098827) is another VGAM697 host target gene. LOC157798 BINDING SITE is HOST TARGET binding site found in the 5' untranslated region of mRNA encoded by LOC157798, corresponding to a HOST TARGET binding site such as BINDING SITE I, BINDING SITE II or BINDING SITE III. Table 2 illustrates the complementarity of the nucleotide sequences of LOC157798 BINDING SITE, designated SEQ ID:41849, to the nucleotide sequence of VGAM697 RNA, herein designated VGAM RNA, also designated SEQ ID:3408.

Another function of VGAM697 is therefore inhibition of LOC157798 (Accession XM_098827). Accordingly, utilities of VGAM697 include diagnosis, prevention and treatment of diseases and clinical conditions associated with LOC157798. FIG. 1 further provides a conceptual description of a novel bioinformatically detected viral gene of the present invention, referred to here as Viral Genomic Address Messenger 698 (VGAM698) viral gene, which modulates expression of respective host target genes thereof, the function and utility of which host target genes is known in the art.

VGAM698 is a novel bioinformatically detected regulatory, non protein coding, viral micro RNA (miRNA) gene. The method by which VGAM698 was detected is described hereinabove with reference to FIGS. 1-8.

VGAM698 gene, herein designated VGAM GENE, is a viral gene contained in the genome of Human Coronavirus 229E. VGAM698 host target gene, herein designated VGAM HOST TARGET GENE, is a human gene contained in the human genome.

VGAM698 gene encodes a VGAM698 precursor RNA, herein designated VGAM PRECURSOR RNA. Similar to other miRNA genes, and unlike most ordinary genes, VGAM698 precursor RNA does not encode a protein. A nucleotide sequence identical or highly similar to the nucleotide sequence of VGAM698 precursor RNA is designated SEQ ID:684, and is provided hereinbelow with reference to the sequence listing part. Nucleotide sequence SEQ ID:684 is located at position 16358 relative to the genome of Human Coronavirus 229E.

VGAM698 precursor RNA folds onto itself, forming VGAM698 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM698 folded precursor RNA into VGAM698 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM698 RNA is designated SEQ ID:3409, and is provided hereinbelow with reference to the sequence listing part.

VGAM698 host target gene, herein designated VGAM HOST TARGET GENE, encodes a corresponding messenger RNA, VGAM698 host target RNA, herein designated VGAM HOST TARGET RNA. VGAM698 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM698 RNA, herein designated VGAM RNA, binds complementarily to one or more host target binding sites located in untranslated regions of VGAM698 host target RNA, herein designated VGAM HOST TARGET RNA. This complementary binding is due to the fact that the nucleotide sequence of VGAM698 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM698 RNA, herein designated VGAM RNA, may have a different number of host target binding sites in untranslated regions of a VGAM698 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM698 RNA, herein designated VGAM RNA, to host target binding sites on VGAM698 host target RNA, herein designated VGAM HOST TARGET RNA, such as BINDING SITE I, BINDING SITE II and BINDING SITE III, inhibits translation of VGAM698 host target RNA into VGAM698 host target protein, herein designated VGAM HOST TARGET PROTEIN. VGAM host target protein is therefore outlined by a broken line.

It is appreciated that VGAM698 host target gene, herein designated VGAM HOST TARGET GENE, in fact represents a plurality of VGAM698 host target genes. The mRNA of each one of this plurality of VGAM698 host target genes comprises one or more host target binding sites, each having a nucleotide sequence which is at least partly complementary to VGAM698 RNA, herein designated VGAM RNA, and which when bound by VGAM698 RNA causes inhibition of translation of respective one or more VGAM698 host target proteins.

It is further appreciated by one skilled in the art that the mode of translational inhibition illustrated by FIG. 1 with specific reference to translational inhibition exerted by VGAM698 gene, herein designated VGAM GENE, on one or more VGAM698 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM698 is inhibition of expression of host target genes, as part of a novel viral mechanism of attacking a host. Accordingly, utilities of VGAM698 include diagnosis, prevention and treatment of viral infection by Human Coronavirus 229E. Specific functions, and accordingly utilities, of VGAM698 correlate with, and may be deduced from, the identity of the host target genes which VGAM698 binds and inhibits, and the function of these host target genes, as elaborated hereinbelow.

Nucleotide sequences of the VGAM698 precursor RNA, herein designated VGAM PRECURSOR RNA, and of the 'diced' VGAM698 RNA, herein designated VGAM RNA, and a schematic representation of the secondary folding of VGAM698 folded precursor RNA, herein designated VGAM FOLDED PRECURSOR RNA, of VGAM698 are further described hereinbelow with reference to Table 1.

Nucleotide sequences of host target binding sites, such as BINDING SITE-I, BINDING SITE-II and BINDING SITE-III of FIG. 1, found on VGAM698 host target RNA, and schematic representation of the complementarity of each of these host target binding sites to VGAM698 RNA, herein designated VGAM RNA, are described hereinbelow with reference to Table 2.

As mentioned hereinabove with reference to FIG. 1, a function of VGAM698 gene, herein designated VGAM is inhibition of expression of VGAM698 target genes. It is appreciated that specific functions, and accordingly utilities, of VGAM698 correlate with, and may be deduced from, the identity of the target genes which VGAM698 binds and inhibits, and the function of these target genes, as elaborated hereinbelow.

DKFZp547M072 (Accession XM_028067) is a VGAM698 host target gene. DKFZp547M072 BINDING SITE is HOST TARGET binding site found in the 3' untranslated region of mRNA encoded by DKFZp547M072, corresponding to a HOST TARGET binding site such as BIND- ING SITE I, BINDING SITE II or BINDING SITE III. Table 2 illustrates the complementarity of the nucleotide sequences of DKFZp547M072 BINDING SITE, designated SEQ ID:30614, to the nucleotide sequence of VGAM698 RNA, herein designated VGAM RNA, also designated SEQ ID:3409.

A function of VGAM698 is therefore inhibition of DKFZp547M072 (Accession XM_028067). Accordingly, utilities of VGAM698 include diagnosis, prevention and treatment of diseases and clinical conditions associated with DKFZp547M072. KIAA1130 (Accession XM_031104) is another VGAM698 host target gene. KIAA1130 BINDING SITE is HOST TARGET binding site found in the 3' untranslated region of mRNA encoded by KIAA1130, corresponding to a HOST TARGET binding site such as BINDING SITE I, BINDING SITE II or BINDING SITE III. Table 2 illustrates the complementarity of the nucleotide sequences of KIAA1130 BINDING SITE, designated SEQ ID:31285, to the nucleotide sequence of VGAM698 RNA, herein designated VGAM RNA, also designated SEQ ID:3409.

Another function of VGAM698 is therefore inhibition of KIAA1130 (Accession XM_031104). Accordingly, utilities of VGAM698 include diagnosis, prevention and treatment of diseases and clinical conditions associated with KIAA1130. p25 (Accession NM_007030) is another VGAM698 host target gene. p25 BINDING SITE is HOST TARGET binding site found in the 3' untranslated region of mRNA encoded by p25, corresponding to a HOST TARGET binding site such as BINDING SITE I, BINDING SITE II or BINDING SITE III. Table 2 illustrates the complementarity of the nucleotide sequences of p25 BINDING SITE, designated SEQ ID:13893, to the nucleotide sequence of VGAM698 RNA, herein designated VGAM RNA, also designated SEQ ID:3409.

Another function of VGAM698 is therefore inhibition of p25 (Accession NM_007030). Accordingly, utilities of VGAM698 include diagnosis, prevention and treatment of diseases and clinical conditions associated with p25. LOC144501 (Accession XM_096612) is another VGAM698 host target gene. LOC144501 BINDING SITE is HOST TARGET binding site found in the 3' untranslated region of mRNA encoded by LOC144501, corresponding to a HOST TARGET binding site such as BINDING SITE I, BINDING SITE II or BINDING SITE III. Table 2 illustrates the complementarity of the nucleotide sequences of LOC144501 BINDING SITE, designated SEQ ID:40426, to the nucleotide sequence of VGAM698 RNA, herein designated VGAM RNA, also designated SEQ ID:3409.

Another function of VGAM698 is therefore inhibition of LOC144501 (Accession XM_096612). Accordingly, utilities of VGAM698 include diagnosis, prevention and treatment of diseases and clinical conditions associated with LOC144501. LOC150333 (Accession XM_097874) is another VGAM698 host target gene. LOC150333 BINDING SITE is HOST TARGET binding site found in the 5' untranslated region of mRNA encoded by LOC150333, corresponding to a HOST TARGET binding site such as BINDING SITE I, BINDING SITE II or BINDING SITE III. Table 2 illustrates the complementarity of the nucleotide sequences of LOC150333 BINDING SITE, designated SEQ ID:41198, to the nucleotide sequence of VGAM698 RNA, herein designated VGAM RNA, also designated SEQ ID:3409.

Another function of VGAM698 is therefore inhibition of LOC150333 (Accession XM_097874). Accordingly, utilities of VGAM698 include diagnosis, prevention and treatment of diseases and clinical conditions associated with LOC150333. FIG. 1 further provides a conceptual description of a novel bioinformatically detected viral gene of the present invention, referred to here as Viral Genomic Address Messenger 699 (VGAM699) viral gene, which modulates expression of respective host target genes thereof, the function and utility of which host target genes is known in the art.

VGAM699 is a novel bioinformatically detected regulatory, non protein coding, viral micro RNA (miRNA) gene. The method by which VGAM699 was detected is described hereinabove with reference to FIGS. 1-8.

VGAM699 gene, herein designated VGAM GENE, is a viral gene contained in the genome of Human Coronavirus 229E. VGAM699 host target gene, herein designated VGAM HOST TARGET GENE, is a human gene contained in the human genome.

VGAM699 gene encodes a VGAM699 precursor RNA, herein designated VGAM PRECURSOR RNA. Similar to other miRNA genes, and unlike most ordinary genes, VGAM699 precursor RNA does not encode a protein. A nucleotide sequence identical or highly similar to the nucleotide sequence of VGAM699 precursor RNA is designated SEQ ID:685, and is provided hereinbelow with reference to the sequence listing part. Nucleotide sequence SEQ ID:685 is located at position 2991 relative to the genome of Human Coronavirus 229E.

VGAM699 precursor RNA folds onto itself, forming VGAM699 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM699 folded precursor RNA into VGAM699 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM699 RNA is designated SEQ ID:3410, and is provided hereinbelow with reference to the sequence listing part.

VGAM699 host target gene, herein designated VGAM HOST TARGET GENE, encodes a corresponding messenger RNA, VGAM699 host target RNA, herein designated VGAM HOST TARGET RNA. VGAM699 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM699 RNA, herein designated VGAM RNA, binds complementarily to one or more host target binding sites located in untranslated regions of VGAM699 host target RNA, herein designated VGAM HOST TARGET RNA. This complementary binding is due to the fact that the nucleotide sequence of VGAM699 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM699 RNA, herein designated VGAM RNA, may have a different number of host target binding sites in untranslated regions of a VGAM699 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM699 RNA, herein designated VGAM RNA, to host target binding sites on VGAM699 host target RNA, herein designated VGAM HOST TARGET RNA, such as BINDING SITE I, BINDING SITE II and BINDING SITE III, inhibits translation of VGAM699 host target RNA into VGAM699 host target protein, herein designated VGAM HOST TARGET PROTEIN. VGAM host target protein is therefore outlined by a broken line.

It is appreciated that VGAM699 host target gene, herein designated VGAM HOST TARGET GENE, in fact represents a plurality of VGAM699 host target genes. The mRNA of each one of this plurality of VGAM699 host target genes comprises one or more host target binding sites, each having a nucleotide sequence which is at least partly complementary to VGAM699 RNA, herein designated VGAM RNA, and which when bound by VGAM699 RNA causes inhibition of translation of respective one or more VGAM699 host target proteins.

It is further appreciated by one skilled in the art that the mode of translational inhibition illustrated by FIG. 1 with specific reference to translational inhibition exerted by VGAM699 gene, herein designated VGAM GENE, on one or more VGAM699 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM699 is inhibition of expression of host target genes, as part of a novel viral mechanism of attacking a host. Accordingly, utilities of VGAM699 include diagnosis, prevention and treatment of viral infection by Human Coronavirus 229E. Specific functions, and accordingly utilities, of VGAM699 correlate with, and may be deduced from, the identity of the host target genes which VGAM699 binds and inhibits, and the function of these host target genes, as elaborated hereinbelow.

Nucleotide sequences of the VGAM699 precursor RNA, herein designated VGAM PRECURSOR RNA, and of the 'diced' VGAM699 RNA, herein designated VGAM RNA, and a schematic representation of the secondary folding of VGAM699 folded precursor RNA, herein designated VGAM FOLDED PRECURSOR RNA, of VGAM699 are further described hereinbelow with reference to Table 1.

Nucleotide sequences of host target binding sites, such as BINDING SITE-I, BINDING SITE-II and BINDING SITE-III of FIG. 1, found on VGAM699 host target RNA, and schematic representation of the complementarity of each of these host target binding sites to VGAM699 RNA, herein designated VGAM RNA, are described hereinbelow with reference to Table 2.

As mentioned hereinabove with reference to FIG. 1, a function of VGAM699 gene, herein designated VGAM is inhibition of expression of VGAM699 target genes. It is appreciated that specific functions, and accordingly utilities, of VGAM699 correlate with, and may be deduced from, the identity of the target genes which VGAM699 binds and inhibits, and the function of these target genes, as elaborated hereinbelow.

Amylo-1, 6-glucosidase, 4-alpha-glucanotransferase (glycogen debranching enzyme, glycogen storage disease type III) (AGL, Accession NM_000646) is a VGAM699 host target gene. AGL BINDING SITE is HOST TARGET binding site found in the 5' untranslated region of mRNA encoded by AGL, corresponding to a HOST TARGET binding site such as BINDING SITE I, BINDING SITE II or BINDING SITE III. Table 2 illustrates the complementarity of the nucleotide sequences of AGL BINDING SITE, designated SEQ ID:6302, to the nucleotide sequence of VGAM699 RNA, herein designated VGAM RNA, also designated SEQ ID:3410.

A function of VGAM699 is therefore inhibition of Amylo-1, 6-glucosidase, 4-alpha-glucanotransferase (glycogen debranching enzyme, glycogen storage disease type III) (AGL, Accession NM_000646). Accordingly, utilities of VGAM699 include diagnosis, prevention and treatment of diseases and clinical conditions associated with AGL. ATPase, Class I, Type 8B, Member 2 (ATP8B2, Accession XM_036933) is another VGAM699 host target gene. ATP8B2 BINDING SITE is HOST TARGET binding site found in the 3' untranslated region of mRNA encoded by ATP8B2, corresponding to a HOST TARGET binding site such as BINDING SITE I, BINDING SITE II or BINDING SITE III. Table 2 illustrates the complementarity of the nucleotide sequences of ATP8B2 BINDING SITE, designated SEQ ID:32510, to the nucleotide sequence of VGAM699 RNA, herein designated VGAM RNA, also designated SEQ ID:3410.

Another function of VGAM699 is therefore inhibition of ATPase, Class I, Type 8B, Member 2 (ATP8B2, Accession XM_036933). Accordingly, utilities of VGAM699 include diagnosis, prevention and treatment of diseases and clinical conditions associated with ATP8B2. Cholinergic Receptor, Nicotinic, Beta Polypeptide 2 (neuronal) (CHRNB2, Accession NM_000748) is another VGAM699 host target gene. CHRNB2 BINDING SITE is HOST TARGET binding site found in the 3' untranslated region of mRNA encoded by CHRNB2, corresponding to a HOST TARGET binding site such as BINDING SITE I, BINDING SITE II or BINDING SITE III. Table 2 illustrates the complementarity of the nucleotide sequences of CHRNB2 BINDING SITE, designated SEQ ID:6400, to the nucleotide sequence of VGAM699 RNA, herein designated VGAM RNA, also designated SEQ ID:3410.

Another function of VGAM699 is therefore inhibition of Cholinergic Receptor, Nicotinic, Beta Polypeptide 2 (neuronal) (CHRNB2, Accession NM_000748), a gene which mediates fast signal transmission at synapses. Accordingly, utilities of VGAM699 include diagnosis, prevention and treatment of diseases and clinical conditions associated with CHRNB2. The function of CHRNB2 and its association with various diseases and clinical conditions, has been established by previous studies, as described hereinabove with reference to VGAM166. Paired Box Gene 9 (PAX9, Accession NM_006194) is another VGAM699 host target gene. PAX9 BINDING SITE is HOST TARGET binding site found in the 5' untranslated region of mRNA encoded by PAX9, corresponding to a HOST TARGET binding site such as BINDING SITE I, BINDING SITE II or BINDING SITE III. Table 2 illustrates the complementarity of the nucleotide sequences of PAX9 BINDING SITE, designated SEQ ID:12866, to the nucleotide sequence of VGAM699 RNA, herein designated VGAM RNA, also designated SEQ ID:3410.

Another function of VGAM699 is therefore inhibition of Paired Box Gene 9 (PAX9, Accession NM_006194), a gene which is a key regulator during the development of a wide range of organ hypodontia. Accordingly, utilities of VGAM699 include diagnosis, prevention and treatment of diseases and clinical conditions associated with PAX9. The function of PAX9 has been established by previous studies. Stockton et al. (2000) identified a frameshift mutation within the paired domain of PAX9, following genomewide analysis of a family segregating autosomal dominant oligodontia (OMIM Ref. No. 604625). Affected members had normal primary dentition but lacked most permanent molars. In addition to lack of permanent molars, some individuals also lacked maxillary and/or mandibular second premolars, as well as mandibular central incisors. Stockton et al. (2000) first performed a genomewide search using microsatellite markers and identified a critical region that included the PAX9 gene on chromosome 14. Mutation analysis of the coding regions of exons 2-4 of PAX9 demonstrated an insertion of a G at nucleotide 219, resulting in frameshift. Relative to the finding of other abnormalities in PAX9 knockout mice, Stockton et al. (2000) noted that affected members of this family showed no limb anomalies and no evidence for calcium metabolism abnormalities or compromised immune system. Oligodontia is defined as agenesis of 6 or more permanent teeth without associated systemic disorders, and hypodontia as absence of less than 6 teeth. The incidence of familial tooth agenesis varies with each class of teeth. Most commonly affected are third molars ('wisdom teeth'), followed by either upper lateral incisors or lower second premolars; agenesis involving first and second molars is very rare. The homeo box gene MSX1 (OMIM Ref. No. 142983) was found to be mutant in a single family with agenesis of the second premolars and third molars. Animal model experiments lend further support to the function of PAX9. Peters et al. (1998) generated Pax9-deficient mice and showed that PAX9 is essential for the development of a variety of organs and skeletal elements. Homozygous Pax9 mutant mice died shortly after birth, most likely as a consequence of a cleft secondary palate. Homozygous knockout mice lacked a thymus, parathyroid glands, and ultimobranchial bodies, organs which are derived from the pharyngeal pouches. In all limbs, a supernumerary preaxial digit was formed, but the flexor of the hindlimb toes was missing. Furthermore, craniofacial and visceral skeletogenesis was disturbed, and all teeth were absent. In Pax9-deficient embryos, tooth development was arrested at the bud stage. At that stage, Pax9 is required for the mesenchymal expression of Bmp4, Msx1, and Lef1, suggesting a role for Pax9 in the establishment of the inductive capacity of the tooth mesenchyme.

It is appreciated that the abovementioned animal model for PAX9 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Stockton, D. W.; Das, P.; Goldenberg, M.; D'Souza, R. N.; Patel, P. I.: Mutation of PAX9 is associated with oligodontia. (Letter) Nature Genet. 24: 18-19, 2000; and Peters, H.; Neubuser, A.; Kratochwil, K.; Balling, R.: Pax9-deficient mice lack pharyngeal pouch derivatives and teeth and exhibit craniofacial and limb abnormalities. Genes Dev. 12:2.

Further studies establishing the function and utilities of PAX9 are found in John Hopkins OMIM database record ID 167416, and in sited publications numbered 10949-10952, 1071 and 10953-10954 listed in the bibliography section hereinbelow, which are also hereby incorporated by reference. Tumor Necrosis Factor (ligand) Superfamily, Member 8 (TNFSF8, Accession NM_001244) is another VGAM699 host target gene. TNFSF8 BINDING SITE is HOST TARGET binding site found in the 3' untranslated region of mRNA encoded by TNFSF8, corresponding to a HOST TARGET binding site such as BINDING SITE I, BINDING SITE II or BINDING SITE III. Table 2 illustrates the complementarity of the nucleotide sequences of TNFSF8 BINDING SITE, designated SEQ ID:6913, to the nucleotide sequence of VGAM699 RNA, herein designated VGAM RNA, also designated SEQ ID:3410.

Another function of VGAM699 is therefore inhibition of Tumor Necrosis Factor (ligand) Superfamily, Member 8 (TNFSF8, Accession NM_001244), a gene which cytokine that binds to tnfrsf8/cd30. induces proliferation of t cells. Accordingly, utilities of VGAM699 include diagnosis, prevention and treatment of diseases and clinical conditions associated with TNFSF8. The function of TNFSF8 and its association with various diseases and clinical conditions, has been established by previous studies, as described hereinabove with reference to VGAM655. Tetratricopeptide Repeat Domain 3 (TTC3, Accession NM_003316) is another VGAM699 host target gene. TTC3 BINDING SITE is HOST TARGET binding site found in the 5' untranslated region of mRNA encoded by TTC3, corresponding to a HOST TARGET binding site such as BINDING SITE I, BINDING SITE II or BINDING SITE III. Table 2 illustrates the complementarity of the nucleotide sequences of TTC3 BINDING SITE, designated SEQ ID:9313, to the nucleotide sequence of VGAM699 RNA, herein designated VGAM RNA, also designated SEQ ID:3410.

Another function of VGAM699 is therefore inhibition of Tetratricopeptide Repeat Domain 3 (TTC3, Accession NM_003316), a gene which contains tetratricopeptide repeat (TPR) motifs. Accordingly, utilities of VGAM699 include diagnosis, prevention and treatment of diseases and clinical conditions associated with TTC3. The function of TTC3 has been established by previous studies. The Down syndrome (DS; 190685) region on chromosome 21, which is responsible for the main features of DS, has been defined by analysis of DS patients with partial trisomy 21. Within the DS region, Ohira et al. (1996) constructed a 1.6-Mb P1 contig map on 21q22.2 and performed cDNA library screening and exon trapping using these P1 clones and a human fetal brain cDNA library. They obtained 67 cDNA fragments and 52 possible exons. Among them, 23 cDNA fragments and 4 exons were derived from a single gene by localization on P1 clones and by Northern analysis. To obtain the full-length cDNA sequence, longer cDNA clones were further screened from another human cDNA library that was enriched with longer cDNA species. These clones were assembled to a sequence of 9,045 bp. The cDNA encodes a 2,025-amino acid protein containing 3 tetratricopeptide repeat (TPR) motifs (amino acid residues 231-264, 265-298, and 299-332). The authors symbolized the gene TPRD for a gene containing the TPR motifs on the Down syndrome region. The TPR domain has been found in protein phosphatases and in other proteins involved in the regulation of RNA synthesis or mitosis. Independently, Tsukahara et al. (1996) identified and cloned a 9,078-bp cDNA, which they designated TPRDI, from the Down syndrome critical region by exon trapping. The cDNA encodes a putative protein (TPRDI) of 2,025 amino acid residues. Two isoforms, TPRDII (8,992 bp) and TPRDIII (7,416 bp), were also isolated. TPRDII, which is probably an alternative splicing product from the TPRD gene transcript, encodes 2 large open reading frames of 200 and 1,792 amino acid residues, respectively. TPRDIII, which is probably generated by transcription from an alternative start site of the TPRD gene, encodes a putative protein of 1,715 amino acid residues. Northern blot analysis revealed that TPRDI and its isoforms are present in 7- to 17-day mouse embryos and in all the human adult and fetal tissues examined. TPRDI has 3 units of the 34-amino acid TPR motif, which may mediate interaction with various proteins. A larger open reading frame encoded by TPRDII also has 3 units of the TPR motif, but TPRDIII has only two-thirds of this motif unit. Thus, the TPRD gene may belong to the TPR gene family. Near-central and C-terminal regions of TPRDs showed some homology to several matrix proteins such as trichohyalin and bullous pemphigoid antigen. The authors speculated that overexpression of the TPRD gene may cause several morphologic anomalies observed in Down syndrome.

Full details of the abovementioned studies are described in the following publications, the disclosure of which are hereby incorporated by reference:

Ohira, M.; Ootsuyama A.; Suzuki, E.; Ichikawa, H.; Seki, N.; Nagase, T.; Monura, N.; Ohki, M.: Identification of a novel human gene containing the tetratricopeptide repeat domain from the Down syndrome region of chromosome 21. DNA Res. 3: 9-16, 1996; and Tsukahara, F.; Hattori, M.; Muraki, T.; Sakaki, Y.: Identification and cloning of a novel cDNA belonging to tetratricopeptide repeat gene family from Down syndrome-critical region 21q22.2.

Further studies establishing the function and utilities of TTC3 are found in John Hopkins OMIM database record ID 602259, and in sited publications numbered 931-932 listed in the bibliography section hereinbelow, which are also hereby incorporated by reference. ATP-binding Cassette, Sub-family A (ABC1), Member 10 (ABCA10, Accession NM_080282) is another VGAM699 host target gene. ABCA10 BINDING SITE is HOST TARGET binding site found in the 3' untranslated region of mRNA encoded by ABCA10, corresponding to a HOST TARGET binding site such as BINDING SITE I, BINDING SITE II or BINDING SITE III. Table 2 illustrates the complementarity of the nucleotide sequences of ABCA10 BINDING SITE, designated SEQ ID:27824, to the nucleotide sequence of VGAM699 RNA, herein designated VGAM RNA, also designated SEQ ID:3410.

Another function of VGAM699 is therefore inhibition of ATP-binding Cassette, Sub-family A (ABC1), Member 10 (ABCA10, Accession NM_080282). Accordingly, utilities of VGAM699 include diagnosis, prevention and treatment of diseases and clinical conditions associated with ABCA10. ADMP (Accession NM_145035) is another VGAM699 host target gene. ADMP BINDING SITE is HOST TARGET binding site found in the 3' untranslated region of mRNA encoded by ADMP, corresponding to a HOST TARGET binding site such as BINDING SITE I, BINDING SITE II or BINDING SITE III. Table 2 illustrates the complementarity of the nucleotide sequences of ADMP BINDING SITE, designated SEQ ID:29654, to the nucleotide sequence of VGAM699 RNA, herein designated VGAM RNA, also designated SEQ ID:3410.

Another function of VGAM699 is therefore inhibition of ADMP (Accession NM_145035). Accordingly, utilities of VGAM699 include diagnosis, prevention and treatment of diseases and clinical conditions associated with ADMP. AP1 Gamma Subunit Binding Protein 1 (AP1GBP1, Accession NM_080551) is another VGAM699 host target gene. AP1GBP1 BINDING SITE is HOST TARGET binding site found in the 3' untranslated region of mRNA encoded by AP1GBP1, corresponding to a HOST TARGET binding site such as BINDING SITE I, BINDING SITE II or BINDING SITE III. Table 2 illustrates the complementarity of the nucleotide sequences of AP1GBP1 BINDING SITE, designated SEQ ID:27876, to the nucleotide sequence of VGAM699 RNA, herein designated VGAM RNA, also designated SEQ ID:3410.

Another function of VGAM699 is therefore inhibition of AP1 Gamma Subunit Binding Protein 1 (AP1GBP1, Accession NM_080551). Accordingly, utilities of VGAM699 include diagnosis, prevention and treatment of diseases and clinical conditions associated with AP1GBP1. Chloride Intracellular Channel 2 (CLIC2, Accession NM_001289) is another VGAM699 host target gene. CLIC2 BINDING SITE is HOST TARGET binding site found in the 3' untranslated region of mRNA encoded by CLIC2, corresponding to a HOST TARGET binding site such as BINDING SITE I, BINDING SITE II or BINDING SITE III. Table 2 illustrates the complementarity of the nucleotide sequences of CLIC2 BINDING SITE, designated SEQ ID:6965, to the nucleotide sequence of VGAM699 RNA, herein designated VGAM RNA, also designated SEQ ID:3410.

Another function of VGAM699 is therefore inhibition of Chloride Intracellular Channel 2 (CLIC2, Accession NM_001289). Accordingly, utilities of VGAM699 include diagnosis, prevention and treatment of diseases and clinical conditions associated with CLIC2. FLJ10246 (Accession NM_018038) is another VGAM699 host target gene. FLJ10246 BINDING SITE is HOST TARGET binding site found in the 3' untranslated region of mRNA encoded by FLJ10246, corresponding to a HOST TARGET binding site such as BINDING SITE I, BINDING SITE II or BINDING SITE III. Table 2 illustrates the complementarity of the nucleotide sequences of FLJ10246 BINDING SITE, designated SEQ ID:19783, to the nucleotide sequence of VGAM699 RNA, herein designated VGAM RNA, also designated SEQ ID:3410.

Another function of VGAM699 is therefore inhibition of FLJ10246 (Accession NM_018038). Accordingly, utilities of VGAM699 include diagnosis, prevention and treatment of diseases and clinical conditions associated with FLJ10246. FLJ10701 (Accession NM_018183) is another VGAM699 host target gene. FLJ10701 BINDING SITE is HOST TARGET binding site found in the 3' untranslated region of mRNA encoded by FLJ10701, corresponding to a HOST TARGET binding site such as BINDING SITE I, BINDING SITE II or BINDING SITE III. Table 2 illustrates the complementarity of the nucleotide sequences of FLJ10701 BINDING SITE, designated SEQ ID:20023, to the nucleotide sequence of VGAM699 RNA, herein designated VGAM RNA, also designated SEQ ID:3410.

Another function of VGAM699 is therefore inhibition of FLJ10701 (Accession NM_018183). Accordingly, utilities of VGAM699 include diagnosis, prevention and treatment of diseases and clinical conditions associated with FLJ10701. FLJ14297 (Accession NM_024903) is another VGAM699 host target gene. FLJ14297 BINDING SITE is HOST TARGET binding site found in the 3' untranslated region of mRNA encoded by FLJ14297, corresponding to a HOST TARGET binding site such as BINDING SITE I, BINDING SITE II or BINDING SITE III. Table 2 illustrates the complementarity of the nucleotide sequences of FLJ14297 BINDING SITE, designated SEQ ID:24390, to the nucleotide sequence of VGAM699 RNA, herein designated VGAM RNA, also designated SEQ ID:3410.

Another function of VGAM699 is therefore inhibition of FLJ14297 (Accession NM_024903). Accordingly, utilities of VGAM699 include diagnosis, prevention and treatment of diseases and clinical conditions associated with FLJ14297. FLJ20618 (Accession NM_017903) is another VGAM699 host target gene. FLJ20618 BINDING SITE is HOST TARGET binding site found in the 3' untranslated region of mRNA encoded by FLJ20618, corresponding to a HOST TARGET binding site such as BINDING SITE I, BINDING SITE II or BINDING SITE III. Table 2 illustrates the complementarity of the nucleotide sequences of FLJ20618 BINDING SITE, designated SEQ ID:19568, to the nucleotide sequence of VGAM699 RNA, herein designated VGAM RNA, also designated SEQ ID:3410.

Another function of VGAM699 is therefore inhibition of FLJ20618 (Accession NM_017903). Accordingly, utilities of VGAM699 include diagnosis, prevention and treatment of diseases and clinical conditions associated with FLJ20618. Keratin, Hair, Basic, 2 (KRTHB2, Accession NM_033033) is another VGAM699 host target gene. KRTHB2 BINDING SITE is HOST TARGET binding site found in the 3' untranslated region of mRNA encoded by KRTHB2, corresponding to a HOST TARGET binding site such as BINDING SITE I, BINDING SITE II or BINDING SITE III. Table 2 illustrates the complementarity of the nucleotide sequences of KRTHB2 BINDING SITE, designated SEQ ID:26923, to the nucleotide sequence of VGAM699 RNA, herein designated VGAM RNA, also designated SEQ ID:3410.

Another function of VGAM699 is therefore inhibition of Keratin, Hair, Basic, 2 (KRTHB2, Accession NM_033033). Accordingly, utilities of VGAM699 include diagnosis, prevention and treatment of diseases and clinical conditions associated with KRTHB2. MGC21675 (Accession NM_052861) is another VGAM699 host target gene. MGC21675 BINDING SITE is HOST TARGET binding site found in the 3' untranslated region of mRNA encoded by MGC21675, corresponding to a HOST TARGET binding site such as BINDING SITE I, BINDING SITE II or BINDING SITE III. Table 2 illustrates the complementarity of the nucleotide sequences of MGC21675 BINDING SITE, designated SEQ ID:27443, to the nucleotide sequence of VGAM699 RNA, herein designated VGAM RNA, also designated SEQ ID:3410.

Another function of VGAM699 is therefore inhibition of MGC21675 (Accession NM_052861). Accordingly, utilities of VGAM699 include diagnosis, prevention and treatment of diseases and clinical conditions associated with MGC21675. Squamous Cell Carcinoma Antigen Recognised By T Cells 3 (SART3, Accession NM_014706) is another VGAM699 host target gene. SART3 BINDING SITE is HOST TARGET binding site found in the 3' untranslated region of mRNA encoded by SART3, corresponding to a HOST TARGET binding site such as BINDING SITE I, BINDING SITE II or BINDING SITE III. Table 2 illustrates the complementarity of the nucleotide sequences of SART3 BINDING SITE, designated SEQ ID:16249, to the nucleotide sequence of VGAM699 RNA, herein designated VGAM RNA, also designated SEQ ID:3410.

Another function of VGAM699 is therefore inhibition of Squamous Cell Carcinoma Antigen Recognised By T Cells 3 (SART3, Accession NM_014706). Accordingly, utilities of VGAM699 include diagnosis, prevention and treatment of diseases and clinical conditions associated with SART3. Ubiquitin-like, Containing PHD and RING Finger Domains, 2 (UHRF2, Accession XM_055929) is another VGAM699 host target gene. UHRF2 BINDING SITE is HOST TARGET binding site found in the 3' untranslated region of mRNA encoded by UHRF2, corresponding to a HOST TARGET binding site such as BINDING SITE I, BINDING SITE II or BINDING SITE III. Table 2 illustrates the complementarity of the nucleotide sequences of UHRF2 BINDING SITE, designated SEQ ID:36354, to the nucleotide sequence of VGAM699 RNA, herein designated VGAM RNA, also designated SEQ ID:3410.

Another function of VGAM699 is therefore inhibition of Ubiquitin-like, Containing PHD and RING Finger Domains, 2 (UHRF2, Accession XM_055929). Accordingly, utilities of VGAM699 include diagnosis, prevention and treatment of diseases and clinical conditions associated with UHRF2. LOC147093 (Accession XM_097184) is another VGAM699 host target gene. LOC147093 BINDING SITE is HOST TARGET binding site found in the 3' untranslated region of mRNA encoded by LOC147093, corresponding to a HOST TARGET binding site such as BINDING SITE I, BINDING SITE II or BINDING SITE III. Table 2 illustrates the complementarity of the nucleotide sequences of LOC147093 BINDING SITE, designated SEQ ID:40799, to the nucleotide sequence of VGAM699 RNA, herein designated VGAM RNA, also designated SEQ ID:3410.

Another function of VGAM699 is therefore inhibition of LOC147093 (Accession XM_097184). Accordingly, utilities of VGAM699 include diagnosis, prevention and treatment of diseases and clinical conditions associated with LOC147093. FIG. 1 further provides a conceptual description of a novel bioinformatically detected viral gene of the present invention, referred to here as Viral Genomic Address Messenger 700 (VGAM700) viral gene, which modulates expression of respective host target genes thereof, the function and utility of which host target genes is known in the art.

VGAM700 is a novel bioinformatically detected regulatory, non protein coding, viral micro RNA (miRNA) gene. The method by which VGAM700 was detected is described hereinabove with reference to FIGS. 1-8.

VGAM700 gene, herein designated VGAM GENE, is a viral gene contained in the genome of Human Coronavirus 229E. VGAM700 host target gene, herein designated VGAM HOST TARGET GENE, is a human gene contained in the human genome.

VGAM700 gene encodes a VGAM700 precursor RNA, herein designated VGAM PRECURSOR RNA. Similar to other miRNA genes, and unlike most ordinary genes, VGAM700 precursor RNA does not encode a protein. A nucleotide sequence identical or highly similar to the nucleotide sequence of VGAM700 precursor RNA is designated SEQ ID:686, and is provided hereinbelow with reference to the sequence listing part. Nucleotide sequence SEQ ID:686 is located at position 5282 relative to the genome of Human Coronavirus 229E.

VGAM700 precursor RNA folds onto itself, forming VGAM700 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM700 folded precursor RNA into VGAM700 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM700 RNA is designated SEQ ID:3411, and is provided hereinbelow with reference to the sequence listing part.

VGAM700 host target gene, herein designated VGAM HOST TARGET GENE, encodes a corresponding messenger RNA, VGAM700 host target RNA, herein designated VGAM HOST TARGET RNA. VGAM700 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM700 RNA, herein designated VGAM RNA, binds complementarily to one or more host target binding sites located in untranslated regions of VGAM700 host target RNA, herein designated VGAM HOST TARGET RNA. This complementary binding is due to the fact that the nucleotide sequence of VGAM700 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM700 RNA, herein designated VGAM RNA, may have a different number of host target binding sites in untranslated regions of a VGAM700 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM700 RNA, herein designated VGAM RNA, to host target binding sites on VGAM700 host target RNA, herein designated VGAM HOST TARGET RNA, such as BINDING SITE I, BINDING SITE II and BINDING SITE III, inhibits translation of VGAM700 host target RNA into VGAM700 host target protein, herein designated VGAM HOST TARGET PROTEIN. VGAM host target protein is therefore outlined by a broken line.

It is appreciated that VGAM700 host target gene, herein designated VGAM HOST TARGET GENE, in fact represents a plurality of VGAM700 host target genes. The mRNA of each one of this plurality of VGAM700 host target genes comprises one or more host target binding sites, each having a nucleotide sequence which is at least partly complementary to VGAM700 RNA, herein designated VGAM RNA, and which when bound by VGAM700 RNA causes inhibition of translation of respective one or more VGAM700 host target proteins.

It is further appreciated by one skilled in the art that the mode of translational inhibition illustrated by FIG. 1 with specific reference to translational inhibition exerted by VGAM700 gene, herein designated VGAM GENE, on one or more VGAM700 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM700 is inhibition of expression of host target genes, as part of a novel viral mechanism of attacking a host. Accordingly, utilities of VGAM700 include diagnosis, prevention and treatment of viral infection by Human Coronavirus 229E. Specific functions, and accordingly utilities, of VGAM700 correlate with, and may be deduced from, the identity of the host target genes which VGAM700 binds and inhibits, and the function of these host target genes, as elaborated hereinbelow.

Nucleotide sequences of the VGAM700 precursor RNA, herein designated VGAM PRECURSOR RNA, and of the 'diced' VGAM700 RNA, herein designated VGAM RNA, and a schematic representation of the secondary folding of VGAM700 folded precursor RNA, herein designated VGAM FOLDED PRECURSOR RNA, of VGAM700 are further described hereinbelow with reference to Table 1.

Nucleotide sequences of host target binding sites, such as BINDING SITE-I, BINDING SITE-II and BINDING SITE-III of FIG. 1, found on VGAM700 host target RNA, and schematic representation of the complementarity of each of these host target binding sites to VGAM700 RNA, herein designated VGAM RNA, are described hereinbelow with reference to Table 2.

As mentioned hereinabove with reference to FIG. 1, a function of VGAM700 gene, herein designated VGAM is inhibition of expression of VGAM700 target genes. It is appreciated that specific functions, and accordingly utilities, of VGAM700 correlate with, and may be deduced from, the identity of the target genes which VGAM700 binds and inhibits, and the function of these target genes, as elaborated hereinbelow.

Splicing Factor, Arginine/serine-rich 2, Interacting Protein (SFRS2IP, Accession NM_004719) is a VGAM700 host target gene. SFRS2IP BINDING SITE is HOST TARGET binding site found in the 3' untranslated region of mRNA encoded by SFRS2IP, corresponding to a HOST TARGET binding site such as BINDING SITE I, BINDING SITE II or BINDING SITE III. Table 2 illustrates the complementarity of the nucleotide sequences of SFRS2IP BINDING SITE, designated SEQ ID:11083, to the nucleotide sequence of VGAM700 RNA, herein designated VGAM RNA, also designated SEQ ID:3411.

A function of VGAM700 is therefore inhibition of Splicing Factor, Arginine/serine-rich 2, Interacting Protein (SFRS2IP, Accession NM_004719), a gene which plays an essential role in pre-mRNA splicing. Accordingly, utilities of VGAM700 include diagnosis, prevention and treatment of diseases and clinical conditions associated with SFRS2IP. The function of SFRS2IP has been established by previous studies. Like other SR proteins, the SC35 (OMIM Ref. No. 600813) splicing factor contains an arginine/serine-rich (RS) domain and an RNA-binding motif. Using a yeast 2-hybrid screen with SC35 as bait, Zhang and Wu (1998) isolated a HeLa cell partial cDNA encoding SIP1, a novel SC35-interacting protein. They used the partial cDNA to screen a HeLa cell library and recovered cDNAs corresponding to the entire SIP1 coding region. The predicted 1,403-amino acid protein contains an RS domain similar to those found in several SR proteins and a region of weak similarity to the Drosophila splicing regulator suppressor of white-apricot (SWAP; 601945). In addition, the C-terminal region of SIP1 contains an RNA polymerase II C-terminal domain (CTD)-binding motif. Although the predicted molecular mass of SIP1 is 158 kD, the protein migrates at 210 kD by SDS-PAGE. The authors suggested that this discrepancy might result from posttranslational modifications such as phosphorylation, which is known to cause aberrant migration of several RS domain-containing proteins in SDS-PAGE. Yeast 2-hybrid assays and immunoprecipitation studies showed that SIP1 interacts with several SR proteins as well as with U2AF65 (OMIM Ref. No. 191318) and U1-70K (OMIM Ref. No. 180740), proteins associated with the 3-prime and 5-prime splice sites, respectively. Antibodies against SIP1 depleted splicing activity from a HeLa cell nuclear extract. In the SIP1-depleted nuclear extracts, the authors found that the formation of prespliceosomal complexes A and B was deficient. Zhang and Wu (1998) concluded that SIP1 is a novel RS domain protein required for pre-mRNA splicing. By performing a yeast 2-hybrid assay to identify proteins that interact with CTD, Tanner et al. (1997) isolated partial cDNAs encoding SIP1, which they called CTD-associated SR protein 11 (OMIM Ref. No. CASP11) or SR-related protein of 129 kD (SRrp129). Northern blot analysis detected expression of the approximately 6-kb SRrp129 mRNA in all tissues tested.

Full details of the abovementioned studies are described in the following publications, the disclosure of which are hereby incorporated by reference:

Zhang, W.-J.; Wu, J. Y.: Sip1, a novel RS domain-containing protein essential for pre-mRNA splicing. Molec. Cell. Biol. 18:676-684, 1998. ; and Tanner, S.; Stagljar, I.; Georgiev, O.; Schaffner, W.; Bourquin, J.-P.: A novel SR-related protein specifically interacts with the carboxy-terminal domain (CTD) of RNA polymerase II throug.

Further studies establishing the function and utilities of SFRS2IP are found in John Hopkins OMIM database record ID 603668, and in sited publications numbered 992-993 listed in the bibliography section hereinbelow, which are also hereby incorporated by reference. FLJ21477 (Accession NM_025153) is another VGAM700 host target gene. FLJ21477 BINDING SITE is HOST TARGET binding site found in the 3' untranslated region of mRNA encoded by FLJ21477, corresponding to a HOST TARGET binding site such as BINDING SITE I, BINDING SITE II or BINDING SITE III. Table 2 illustrates the complementarity of the nucleotide sequences of FLJ21477 BINDING SITE, designated SEQ ID:24791, to the nucleotide sequence of VGAM700 RNA, herein designated VGAM RNA, also designated SEQ ID:3411.

Another function of VGAM700 is therefore inhibition of FLJ21477 (Accession NM_025153). Accordingly, utilities of VGAM700 include diagnosis, prevention and treatment of diseases and clinical conditions associated with FLJ21477. LOC220477 (Accession XM_071675) is another VGAM700 host target gene. LOC220477 BINDING SITE is HOST TARGET binding site found in the 5' untranslated region of mRNA encoded by LOC220477, corresponding to a HOST TARGET binding site such as BINDING SITE I, BINDING SITE II or BINDING SITE III. Table 2 illustrates the complementarity of the nucleotide sequences of LOC220477 BINDING SITE, designated SEQ ID:37410, to the nucleotide sequence of VGAM700 RNA, herein designated VGAM RNA, also designated SEQ ID:3411.

Another function of VGAM700 is therefore inhibition of LOC220477 (Accession XM_071675). Accordingly, utilities of VGAM700 include diagnosis, prevention and treatment of diseases and clinical conditions associated with LOC220477. LOC255147 (Accession XM_171024) is another VGAM700 host target gene. LOC255147 BINDING SITE is HOST TARGET binding site found in the 3' untranslated region of mRNA encoded by LOC255147, corresponding to a HOST TARGET binding site such as BINDING SITE I, BINDING SITE II or BINDING SITE III. Table 2 illustrates the complementarity of the nucleotide sequences of LOC255147 BINDING SITE, designated SEQ ID:45803, to the nucleotide sequence of VGAM700 RNA, herein designated VGAM RNA, also designated SEQ ID:3411.

Another function of VGAM700 is therefore inhibition of LOC255147 (Accession XM_171024). Accordingly, utilities of VGAM700 include diagnosis, prevention and treatment of diseases and clinical conditions associated with LOC255147. FIG. 1 further provides a conceptual description of a novel bioinformatically detected viral gene of the present invention, referred to here as Viral Genomic Address Messenger 701 (VGAM701) viral gene, which modulates expression of respective host target genes thereof, the function and utility of which host target genes is known in the art.

VGAM701 is a novel bioinformatically detected regulatory, non protein coding, viral micro RNA (miRNA) gene. The method by which VGAM701 was detected is described hereinabove with reference to FIGS. 1-8.

VGAM701 gene, herein designated VGAM GENE, is a viral gene contained in the genome of Human Coronavirus 229E. VGAM701 host target gene, herein designated VGAM HOST TARGET GENE, is a human gene contained in the human genome.

VGAM701 gene encodes a VGAM701 precursor RNA, herein designated VGAM PRECURSOR RNA. Similar to other miRNA genes, and unlike most ordinary genes, VGAM701 precursor RNA does not encode a protein. A nucleotide sequence identical or highly similar to the nucleotide sequence of VGAM701 precursor RNA is designated SEQ ID:687, and is provided hereinbelow with reference to the sequence listing part. Nucleotide sequence SEQ ID:687 is located at position 21134 relative to the genome of Human Coronavirus 229E.

VGAM701 precursor RNA folds onto itself, forming VGAM701 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM701 folded precursor RNA into VGAM701 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 40%) nucleotide sequence of VGAM701 RNA is designated SEQ ID:3412, and is provided hereinbelow with reference to the sequence listing part.

VGAM701 host target gene, herein designated VGAM HOST TARGET GENE, encodes a corresponding messenger RNA, VGAM701 host target RNA, herein designated VGAM HOST TARGET RNA. VGAM701 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM701 RNA, herein designated VGAM RNA, binds complementarily to one or more host target binding sites located in untranslated regions of VGAM701 host target RNA, herein designated VGAM HOST TARGET RNA. This complementary binding is due to the fact that the nucleotide sequence of VGAM701 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM701 RNA, herein designated VGAM RNA, may have a different number of host target binding sites in untranslated regions of a VGAM701 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM701 RNA, herein designated VGAM RNA, to host target binding sites on VGAM701 host target RNA, herein designated VGAM HOST TARGET RNA, such as BINDING SITE I, BINDING SITE II and BINDING SITE III, inhibits translation of VGAM701 host target RNA into VGAM701 host target protein, herein designated VGAM HOST TARGET PROTEIN. VGAM host target protein is therefore outlined by a broken line.

It is appreciated that VGAM701 host target gene, herein designated VGAM HOST TARGET GENE, in fact represents a plurality of VGAM701 host target genes. The mRNA of each one of this plurality of VGAM701 host target genes comprises one or more host target binding sites, each having a nucleotide sequence which is at least partly complementary to VGAM701 RNA, herein designated VGAM RNA, and which when bound by VGAM701 RNA causes inhibition of translation of respective one or more VGAM701 host target proteins.

It is further appreciated by one skilled in the art that the mode of translational inhibition illustrated by FIG. 1 with specific reference to translational inhibition exerted by VGAM701 gene, herein designated VGAM GENE, on one or more VGAM701 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM701 is inhibition of expression of host target genes, as part of a novel viral mechanism of attacking a host. Accordingly, utilities of VGAM701 include diagnosis, prevention and treatment of viral infection by Human Coronavirus 229E. Specific functions, and accordingly utilities, of VGAM701 correlate with, and may be deduced from, the identity of the host target genes which VGAM701 binds and inhibits, and the function of these host target genes, as elaborated hereinbelow.

Nucleotide sequences of the VGAM701 precursor RNA, herein designated VGAM PRECURSOR RNA, and of the 'diced' VGAM701 RNA, herein designated VGAM RNA, and a schematic representation of the secondary folding of VGAM701 folded precursor RNA, herein designated VGAM FOLDED PRECURSOR RNA, of VGAM701 are further described hereinbelow with reference to Table 1.

Nucleotide sequences of host target binding sites, such as BINDING SITE-I, BINDING SITE-II and BINDING SITE-III of FIG. 1, found on VGAM701 host target RNA, and schematic representation of the complementarity of each of these host target binding sites to VGAM701 RNA, herein designated VGAM RNA, are described hereinbelow with reference to Table 2.

As mentioned hereinabove with reference to FIG. 1, a function of VGAM701 gene, herein designated VGAM is inhibition of expression of VGAM701 target genes. It is appreciated that specific functions, and accordingly utilities, of VGAM701 correlate with, and may be deduced from, the identity of the target genes which VGAM701 binds and inhibits, and the function of these target genes, as elaborated hereinbelow.

Chromosome 20 Open Reading Frame 45 (C20orf45, Accession NM_016045) is a VGAM701 host target gene. C20orf45 BINDING SITE is HOST TARGET binding site found in the 3' untranslated region of mRNA encoded by C20orf45, corresponding to a HOST TARGET binding site such as BINDING SITE I, BINDING SITE II or BINDING SITE III. Table 2 illustrates the complementarity of the nucleotide sequences of C20orf45 BINDING SITE, designated SEQ ID:18120, to the nucleotide sequence of VGAM701 RNA, herein designated VGAM RNA, also designated SEQ ID:3412.

A function of VGAM701 is therefore inhibition of Chromosome 20 Open Reading Frame 45 (C20orf45, Accession NM_016045). Accordingly, utilities of VGAM701 include diagnosis, prevention and treatment of diseases and clinical conditions associated with C20orf45. FLJ22060 (Accession NM_024612) is another VGAM701 host target gene. FLJ22060 BINDING SITE is HOST TARGET binding site found in the 3' untranslated region of mRNA encoded by FLJ22060, corresponding to a HOST TARGET binding site such as BINDING SITE I, BINDING SITE II or BINDING SITE III. Table 2 illustrates the complementarity of the nucleotide sequences of FLJ22060 BINDING SITE, designated SEQ ID:23865, to the nucleotide sequence of VGAM701 RNA, herein designated VGAM RNA, also designated SEQ ID:3412.

Another function of VGAM701 is therefore inhibition of FLJ22060 (Accession NM_024612). Accordingly, utilities of VGAM701 include diagnosis, prevention and treatment of diseases and clinical conditions associated with FLJ22060. LOC130507 (Accession XM_059440) is another VGAM701 host target gene. LOC130507 BINDING SITE is HOST TARGET binding site found in the 3' untranslated region of mRNA encoded by LOC130507, corresponding to a HOST TARGET binding site such as BINDING SITE I, BINDING SITE II or BINDING SITE III. Table 2 illustrates the complementarity of the nucleotide sequences of LOC130507 BINDING SITE, designated SEQ ID:36996, to the nucleotide sequence of VGAM701 RNA, herein designated VGAM RNA, also designated SEQ ID:3412.

Another function of VGAM701 is therefore inhibition of LOC130507 (Accession XM_059440). Accordingly, utilities of VGAM701 include diagnosis, prevention and treatment of diseases and clinical conditions associated with LOC130507. LOC152185 (Accession NM_144718) is another VGAM701 host target gene. LOC152185 BINDING SITE is HOST TARGET binding site found in the 3' untranslated region of mRNA encoded by LOC152185, corresponding to a HOST TARGET binding site such as BINDING SITE I, BINDING SITE II or BINDING SITE III. Table 2 illustrates the complementarity of the nucleotide sequences of LOC152185 BINDING SITE, designated SEQ ID:29538, to the nucleotide sequence of VGAM701 RNA, herein designated VGAM RNA, also designated SEQ ID:3412.

Another function of VGAM701 is therefore inhibition of LOC152185 (Accession NM_144718). Accordingly, utilities of VGAM701 include diagnosis, prevention and treatment of diseases and clinical conditions associated with LOC152185. LOC154089 (Accession XM_087846) is another VGAM701 host target gene. LOC154089 BINDING SITE is HOST TARGET binding site found in the 3' untranslated region of mRNA encoded by LOC154089, corresponding to a HOST TARGET binding site such as BINDING SITE I, BINDING SITE II or BINDING SITE III. Table 2 illustrates the complementarity of the nucleotide sequences of LOC154089 BINDING SITE, designated SEQ ID:39462, to the nucleotide sequence of VGAM701 RNA, herein designated VGAM RNA, also designated SEQ ID:3412.

Another function of VGAM701 is therefore inhibition of LOC154089 (Accession XM_087846). Accordingly, utilities of VGAM701 include diagnosis, prevention and treatment of diseases and clinical conditions associated with LOC154089. LOC203411 (Accession XM_117547) is another VGAM701 host target gene. LOC203411 BINDING SITE is HOST TARGET binding site found in the 3' untranslated region of mRNA encoded by LOC203411, corresponding to a HOST TARGET binding site such as BINDING SITE I, BINDING SITE II or BINDING SITE III. Table 2 illustrates the complementarity of the nucleotide sequences of LOC203411 BINDING SITE, designated SEQ ID:43564, to the nucleotide sequence of VGAM701 RNA, herein designated VGAM RNA, also designated SEQ ID:3412.

Another function of VGAM701 is therefore inhibition of LOC203411 (Accession XM_117547). Accordingly, utilities of VGAM701 include diagnosis, prevention and treatment of diseases and clinical conditions associated with LOC203411. LOC51634 (Accession NM_016024) is another VGAM701 host target gene. LOC51634 BINDING SITE is HOST TARGET binding site found in the 3' untranslated region of mRNA encoded by LOC51634, corresponding to a HOST TARGET binding site such as BINDING SITE I, BINDING SITE II or BINDING SITE III. Table 2 illustrates the complementarity of the nucleotide sequences of LOC51634 BINDING SITE, designated SEQ ID:18104, to the nucleotide sequence of VGAM701 RNA, herein designated VGAM RNA, also designated SEQ ID:3412.

Another function of VGAM701 is therefore inhibition of LOC51634 (Accession NM_016024). Accordingly, utilities of VGAM701 include diagnosis, prevention and treatment of diseases and clinical conditions associated with LOC51634. LOC91923 (Accession XM_041526) is another VGAM701 host target gene. LOC91923 BINDING SITE is HOST TARGET binding site found in the 5' untranslated region of mRNA encoded by LOC91923, corresponding to a HOST TARGET binding site such as BINDING SITE I, BINDING SITE II or BINDING SITE III. Table 2 illustrates the complementarity of the nucleotide sequences of LOC91923 BINDING SITE, designated SEQ ID:33542, to the nucleotide sequence of VGAM701 RNA, herein designated VGAM RNA, also designated SEQ ID:3412.

Another function of VGAM701 is therefore inhibition of LOC91923 (Accession XM_041526). Accordingly, utilities of VGAM701 include diagnosis, prevention and treatment of diseases and clinical conditions associated with LOC91923. FIG. 1 further provides a conceptual description of a novel bioinformatically detected viral gene of the present invention, referred to here as Viral Genomic Address Messenger 702 (VGAM702) viral gene, which modulates expression of respective host target genes thereof, the function and utility of which host target genes is known in the art.

VGAM702 is a novel bioinformatically detected regulatory, non protein coding, viral micro RNA (miRNA) gene. The method by which VGAM702 was detected is described hereinabove with reference to FIGS. 1-8.

VGAM702 gene, herein designated VGAM GENE, is a viral gene contained in the genome of Human Coronavirus 229E. VGAM702 host target gene, herein designated VGAM HOST TARGET GENE, is a human gene contained in the human genome.

VGAM702 gene encodes a VGAM702 precursor RNA, herein designated VGAM PRECURSOR RNA. Similar to other miRNA genes, and unlike most ordinary genes, VGAM702 precursor RNA does not encode a protein. A nucleotide sequence identical or highly similar to the nucleotide sequence of VGAM702 precursor RNA is designated SEQ ID:688, and is provided hereinbelow with reference to the sequence listing part. Nucleotide sequence SEQ ID:688 is located at position 22902 relative to the genome of Human Coronavirus 229E.

VGAM702 precursor RNA folds onto itself, forming VGAM702 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM702 folded precursor RNA into VGAM702 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM702 RNA is designated SEQ ID:3413, and is provided hereinbelow with reference to the sequence listing part.

VGAM702 host target gene, herein designated VGAM HOST TARGET GENE, encodes a corresponding messenger RNA, VGAM702 host target RNA, herein designated VGAM HOST TARGET RNA. VGAM702 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM702 RNA, herein designated VGAM RNA, binds complementarily to one or more host target binding sites located in untranslated regions of VGAM702 host target RNA, herein designated VGAM HOST TARGET RNA. This complementary binding is due to the fact that the nucleotide sequence of VGAM702 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM702 RNA, herein designated VGAM RNA, may have a different number of host target binding sites in untranslated regions of a VGAM702 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM702 RNA, herein designated VGAM RNA, to host target binding sites on VGAM702 host target RNA, herein designated VGAM HOST TARGET RNA, such as BINDING SITE I, BINDING SITE II and BINDING SITE III, inhibits translation of VGAM702 host target RNA into VGAM702 host target protein, herein designated VGAM HOST TARGET PROTEIN. VGAM host target protein is therefore outlined by a broken line.

It is appreciated that VGAM702 host target gene, herein designated VGAM HOST TARGET GENE, in fact represents a plurality of VGAM702 host target genes. The mRNA of each one of this plurality of VGAM702 host target genes comprises one or more host target binding sites, each having a nucleotide sequence which is at least partly complementary to VGAM702 RNA, herein designated VGAM RNA, and which when bound by VGAM702 RNA causes inhibition of translation of respective one or more VGAM702 host target proteins.

It is further appreciated by one skilled in the art that the mode of translational inhibition illustrated by FIG. 1 with specific reference to translational inhibition exerted by VGAM702 gene, herein designated VGAM GENE, on one or more VGAM702 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM702 is inhibition of expression of host target genes, as part of a novel viral mechanism of attacking a host. Accordingly, utilities of VGAM702 include diagnosis, prevention and treatment of viral infection by Human Coronavirus 229E. Specific functions, and accordingly utilities, of VGAM702 correlate with, and may be deduced from, the identity of the host target genes which VGAM702 binds and inhibits, and the function of these host target genes, as elaborated hereinbelow.

Nucleotide sequences of the VGAM702 precursor RNA, herein designated VGAM PRECURSOR RNA, and of the 'diced' VGAM702 RNA, herein designated VGAM RNA, and a schematic representation of the secondary folding of VGAM702 folded precursor RNA, herein designated VGAM FOLDED PRECURSOR RNA, of VGAM702 are further described hereinbelow with reference to Table 1.

Nucleotide sequences of host target binding sites, such as BINDING SITE-I, BINDING SITE-II and BINDING SITE-III of FIG. 1, found on VGAM702 host target RNA, and schematic representation of the complementarity of each of these host target binding sites to VGAM702 RNA, herein designated VGAM RNA, are described hereinbelow with reference to Table 2.

As mentioned hereinabove with reference to FIG. 1, a function of VGAM702 gene, herein designated VGAM is inhibition of expression of VGAM702 target genes. It is appreciated that specific functions, and accordingly utilities, of VGAM702 correlate with, and may be deduced from, the identity of the target genes which VGAM702 binds and inhibits, and the function of these target genes, as elaborated hereinbelow.

Splicing Factor, Arginine/serine-rich 2, Interacting Protein (SFRS2IP, Accession NM_004719) is a VGAM702 host target gene. SFRS2IP BINDING SITE is HOST TARGET binding site found in the 3' untranslated region of mRNA encoded by SFRS2IP, corresponding to a HOST TARGET binding site such as BINDING SITE I, BINDING SITE II or BINDING SITE III. Table 2 illustrates the complementarity of the nucleotide sequences of SFRS2IP BINDING SITE, designated SEQ ID:11082, to the nucleotide sequence of VGAM702 RNA, herein designated VGAM RNA, also designated SEQ ID:3413.

A function of VGAM702 is therefore inhibition of Splicing Factor, Arginine/serine-rich 2, Interacting Protein (SFRS2IP, Accession NM_004719), a gene which plays an essential role in pre-mRNA splicing. Accordingly, utilities of VGAM702 include diagnosis, prevention and treatment of diseases and clinical conditions associated with SFRS2IP. The function of SFRS2IP and its association with various diseases and clinical conditions, has been established by previous studies, as described hereinabove with reference to VGAM700. FLJ13456 (Accession XM_038291) is another VGAM702 host target gene. FLJ13456 BINDING SITE is HOST TARGET binding site found in the 3" untranslated region of mRNA encoded by FLJ13456, corresponding to a HOST TARGET binding site such as BINDING SITE I, BINDING SITE II or BINDING SITE III. Table 2 illustrates the complementarity of the nucleotide sequences of FLJ13456 BINDING SITE, designated SEQ ID:32795, to the nucleotide sequence of VGAM702 RNA, herein designated VGAM RNA, also designated SEQ ID:3413.

Another function of VGAM702 is therefore inhibition of FLJ13456 (Accession XM_038291). Accordingly, utilities of VGAM702 include diagnosis, prevention and treatment of diseases and clinical conditions associated with FLJ13456. FLJ21276 (Accession NM_024633) is another VGAM702 host target gene. FLJ21276 BINDING SITE is HOST TARGET binding site found in the 3' untranslated region of mRNA encoded by FLJ21276, corresponding to a HOST TARGET binding site such as BINDING SITE I, BINDING SITE II or BINDING SITE III. Table 2 illustrates the complementarity of the nucleotide sequences of FLJ21276 BINDING SITE, designated SEQ ID:23903, to the nucleotide sequence of VGAM702 RNA, herein designated VGAM RNA, also designated SEQ ID:3413.

Another function of VGAM702 is therefore inhibition of FLJ21276 (Accession NM_024633). Accordingly, utilities of VGAM702 include diagnosis, prevention and treatment of diseases and clinical conditions associated with FLJ21276. KIAA0940 (Accession NM_014912) is another VGAM702 host target gene. KIAA0940 BINDING SITE is HOST TARGET binding site found in the 3' untranslated region of mRNA encoded by KIAA0940, corresponding to a HOST TARGET binding site such as BINDING SITE I, BINDING SITE II or BINDING SITE III. Table 2 illustrates the complementarity of the nucleotide sequences of KIAA0940 BINDING SITE, designated SEQ ID:17149, to the nucleotide sequence of VGAM702 RNA, herein designated VGAM RNA, also designated SEQ ID:3413.

Another function of VGAM702 is therefore inhibition of KIAA0940 (Accession NM_014912). Accordingly, utilities of VGAM702 include diagnosis, prevention and treatment of diseases and clinical conditions associated with KIAA0940. KIAA1363 (Accession XM_045056) is another VGAM702 host target gene. KIAA1363 BINDING SITE is HOST TARGET binding site found in the 3' untranslated region of mRNA encoded by KIAA1363, corresponding to a HOST TARGET binding site such as BINDING SITE I, BINDING SITE II or BINDING SITE III. Table 2 illustrates the complementarity of the nucleotide sequences of KIAA1363 BINDING SITE, designated SEQ ID:34330, to the nucleotide sequence of VGAM702 RNA, herein designated VGAM RNA, also designated SEQ ID:3413.

Another function of VGAM702 is therefore inhibition of KIAA1363 (Accession XM_045056). Accordingly, utilities of VGAM702 include diagnosis, prevention and treatment of diseases and clinical conditions associated with KIAA1363. Keratin, Hair, Basic, 5 (KRTHB5, Accession NM_002283) is another VGAM702 host target gene. KRTHB5 BINDING SITE is HOST TARGET binding site found in the 3' untranslated region of mRNA encoded by KRTHB5, corresponding to a HOST TARGET binding site such as BINDING SITE I, BINDING SITE II or BINDING SITE III. Table 2 illustrates the complementarity of the nucleotide sequences of KRTHB5 BINDING SITE, designated SEQ ID:8065, to the nucleotide sequence of VGAM702 RNA, herein designated VGAM RNA, also designated SEQ ID:3413.

Another function of VGAM702 is therefore inhibition of Keratin, Hair, Basic, 5 (KRTHB5, Accession NM_002283). Accordingly, utilities of VGAM702 include diagnosis, prevention and treatment of diseases and clinical conditions associated with KRTHB5. MGC12466 (Accession NM_033213) is another VGAM702 host target gene. MGC12466 BINDING SITE is HOST TARGET binding site found in the 3' untranslated region of mRNA encoded by MGC12466, corresponding to a HOST TARGET binding site such as BINDING SITE I, BINDING SITE II or BINDING SITE III. Table 2 illustrates the complementarity of the nucleotide sequences of MGC12466 BINDING SITE, designated SEQ ID:27065, to the nucleotide sequence of VGAM702 RNA, herein designated VGAM RNA, also designated SEQ ID:3413.

Another function of VGAM702 is therefore inhibition of MGC12466 (Accession NM_033213). Accordingly, utilities of VGAM702 include diagnosis, prevention and treatment of diseases and clinical conditions associated with MGC12466. Protocadherin 17 (PCDH17, Accession NM_014459) is another VGAM702 host target gene. PCDH17 BINDING SITE is HOST TARGET binding site found in the 5' untranslated region of mRNA encoded by PCDH17, corresponding to a HOST TARGET binding site such as BINDING SITE I, BINDING SITE II or BINDING SITE III. Table 2 illustrates the complementarity of the nucleotide sequences of PCDH17 BINDING SITE, designated SEQ ID:15813, to the nucleotide sequence of VGAM702 RNA, herein designated VGAM RNA, also designated SEQ ID:3413.

Another function of VGAM702 is therefore inhibition of Protocadherin 17 (PCDH17, Accession NM_014459). Accordingly, utilities of VGAM702 include diagnosis, prevention and treatment of diseases and clinical conditions associated with PCDH17. UBA2 (Accession NM_005499) is another VGAM702 host target gene. UBA2 BINDING SITE is HOST TARGET binding site found in the 3' untranslated region of mRNA encoded by UBA2, corresponding to a HOST TARGET binding site such as BINDING SITE I, BINDING SITE II or BINDING SITE III. Table 2 illustrates the complementarity of the nucleotide sequences of UBA2 BINDING SITE, designated SEQ ID:12002, to the nucleotide sequence of VGAM702 RNA, herein designated VGAM RNA, also designated SEQ ID:3413.

Another function of VGAM702 is therefore inhibition of UBA2 (Accession NM_005499). Accordingly, utilities of VGAM702 include diagnosis, prevention and treatment of diseases and clinical conditions associated with UBA2. LOC88523 (Accession NM_033111) is another VGAM702 host target gene. LOC88523 BINDING SITE is HOST TARGET binding site found in the 5' untranslated region of mRNA encoded by LOC88523, corresponding to a HOST TARGET binding site such as BINDING SITE I, BINDING SITE II or BINDING SITE III. Table 2 illustrates the complementarity of the nucleotide sequences of LOC88523 BINDING SITE, designated SEQ ID:26960, to the nucleotide sequence of VGAM702 RNA, herein designated VGAM RNA, also designated SEQ ID:3413.

Another function of VGAM702 is therefore inhibition of LOC88523 (Accession NM_033111). Accordingly, utilities of VGAM702 include diagnosis, prevention and treatment of diseases and clinical conditions associated with LOC88523. FIG. 1 further provides a conceptual description of a novel bioinformatically detected viral gene of the present invention, referred to here as Viral Genomic Address Messenger 703 (VGAM703) viral gene, which modulates expression of respective host target genes thereof, the function and utility of which host target genes is known in the art.

VGAM703 is a novel bioinformatically detected regulatory, non protein coding, viral micro RNA (miRNA) gene. The method by which VGAM703 was detected is described hereinabove with reference to FIGS. 1-8.

VGAM703 gene, herein designated VGAM GENE, is a viral gene contained in the genome of Human Coronavirus 229E. VGAM703 host target gene, herein designated VGAM HOST TARGET GENE, is a human gene contained in the human genome.

VGAM703 gene encodes a VGAM703 precursor RNA, herein designated VGAM PRECURSOR RNA. Similar to other miRNA genes, and unlike most ordinary genes, VGAM703 precursor RNA does not encode a protein. A nucleotide sequence identical or highly similar to the nucleotide sequence of VGAM703 precursor RNA is designated SEQ ID:689, and is provided hereinbelow with reference to the sequence listing part. Nucleotide sequence SEQ ID:689 is located at position 22503 relative to the genome of Human Coronavirus 229E.

VGAM703 precursor RNA folds onto itself, forming VGAM703 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM703 folded precursor RNA into VGAM703 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM703 RNA is designated SEQ ID:3414, and is provided hereinbelow with reference to the sequence listing part.

VGAM703 host target gene, herein designated VGAM HOST TARGET GENE, encodes a corresponding messenger RNA, VGAM703 host target RNA, herein designated VGAM HOST TARGET RNA. VGAM703 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM703 RNA, herein designated VGAM RNA, binds complementarily to one or more host target binding sites located in untranslated regions of VGAM703 host target RNA, herein designated VGAM HOST TARGET RNA. This complementary binding is due to the fact that the nucleotide sequence of VGAM703 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM703 RNA, herein designated VGAM RNA, may have a different number of host target binding sites in untranslated regions of a VGAM703 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM703 RNA, herein designated VGAM RNA, to host target binding sites on VGAM703 host target RNA, herein designated VGAM HOST TARGET RNA, such as BINDING SITE I, BINDING SITE II and BINDING SITE III, inhibits translation of VGAM703 host target RNA into VGAM703 host target protein, herein designated VGAM HOST TARGET PROTEIN. VGAM host target protein is therefore outlined by a broken line.

It is appreciated that VGAM703 host target gene, herein designated VGAM HOST TARGET GENE, in fact represents a plurality of VGAM703 host target genes. The mRNA of each one of this plurality of VGAM703 host target genes comprises one or more host target binding sites, each having a nucleotide sequence which is at least partly complementary to VGAM703 RNA, herein designated VGAM RNA, and which when bound by VGAM703 RNA causes inhibition of translation of respective one or more VGAM703 host target proteins.

It is further appreciated by one skilled in the art that the mode of translational inhibition illustrated by FIG. 1 with specific reference to translational inhibition exerted by VGAM703 gene, herein designated VGAM GENE, on one or more VGAM703 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM703 is inhibition of expression of host target genes, as part of a novel viral mechanism of attacking a host. Accordingly, utilities of VGAM703 include diagnosis, prevention and treatment of viral infection by Human Coronavirus 229E. Specific functions, and accordingly utilities, of VGAM703 correlate with, and may be deduced from, the identity of the host target genes which VGAM703 binds and inhibits, and the function of these host target genes, as elaborated hereinbelow.

Nucleotide sequences of the VGAM703 precursor RNA, herein designated VGAM PRECURSOR RNA, and of the 'diced' VGAM703 RNA, herein designated VGAM RNA, and a schematic representation of the secondary folding of VGAM703 folded precursor RNA, herein designated VGAM FOLDED PRECURSOR RNA, of VGAM703 are further described hereinbelow with reference to Table 1.

Nucleotide sequences of host target binding sites, such as BINDING SITE-I, BINDING SITE-II and BINDING SITE-III of FIG. 1, found on VGAM703 host target RNA, and schematic representation of the complementarity of each of these host target binding sites to VGAM703 RNA, herein designated VGAM RNA, are described hereinbelow with reference to Table 2.

As mentioned hereinabove with reference to FIG. 1, a function of VGAM703 gene, herein designated VGAM is inhibition of expression of VGAM703 target genes. It is appreciated that specific functions, and accordingly utilities, of VGAM703 correlate with, and may be deduced from, the identity of the target genes which VGAM703 binds and inhibits, and the function of these target genes, as elaborated hereinbelow.

Chloride Channel 6 (CLCN6, Accession NM_001286) is a VGAM703 host target gene. CLCN6 BINDING SITE1 through CLCN6 BINDING SITE3 are HOST TARGET binding sites found in untranslated regions of mRNA encoded by CLCN6, corresponding to HOST TARGET binding sites such as BINDING SITE I, BINDING SITE II or BINDING SITE III. Table 2 illustrates the complementarity of the nucleotide sequences of CLCN6 BINDING SITE1 through CLCN6 BINDING SITE3, designated SEQ ID:6958, SEQ ID:22335 and SEQ ID:22340 respectively, to the nucleotide sequence of VGAM703 RNA, herein designated VGAM RNA, also designated SEQ ID:3414.

A function of VGAM703 is therefore inhibition of Chloride Channel 6 (CLCN6, Accession NM_001286), a gene which is a voltage-gated chloride channel. Accordingly, utilities of VGAM703 include diagnosis, prevention and treatment of diseases and clinical conditions associated with CLCN6. The function of CLCN6 and its association with various diseases and clinical conditions, has been established by previous studies, as described hereinabove with reference to VGAM599. LOC150951 (Accession XM_097975) is another VGAM703 host target gene. LOC150951 BINDING SITE is HOST TARGET binding site found in the 5' untranslated region of mRNA encoded by LOC150951, corresponding to a HOST TARGET binding site such as BINDING SITE I, BINDING SITE II or BINDING SITE III. Table 2 illustrates the complementarity of the nucleotide sequences of LOC150951 BINDING SITE, designated SEQ ID:41275, to the nucleotide sequence of VGAM703 RNA, herein designated VGAM RNA, also designated SEQ ID:3414.

Another function of VGAM703 is therefore inhibition of LOC150951 (Accession XM_097975). Accordingly, utilities of VGAM703 include diagnosis, prevention and treatment of diseases and clinical conditions associated with LOC150951. FIG. 1 further provides a conceptual description of a novel bioinformatically detected viral gene of the present invention, referred to here as Viral Genomic Address Messenger 704 (VGAM704) viral gene, which modulates expression of respective host target genes thereof, the function and utility of which host target genes is known in the art.

VGAM704 is a novel bioinformatically detected regulatory, non protein coding, viral micro RNA (miRNA) gene. The method by which VGAM704 was detected is described hereinabove with reference to FIGS. 1-8.

VGAM704 gene, herein designated VGAM GENE, is a viral gene contained in the genome of Human Coronavirus 229E. VGAM704 host target gene, herein designated VGAM HOST TARGET GENE, is a human gene contained in the human genome.

VGAM704 gene encodes a VGAM704 precursor RNA, herein designated VGAM PRECURSOR RNA. Similar to other miRNA genes, and unlike most ordinary genes, VGAM704 precursor RNA does not encode a protein. A nucleotide sequence identical or highly similar to the nucleotide sequence of VGAM704 precursor RNA is designated SEQ ID:690, and is provided hereinbelow with reference to the sequence listing part. Nucleotide sequence SEQ ID:690 is located at position 21569 relative to the genome of Human Coronavirus 229E.

VGAM704 precursor RNA folds onto itself, forming VGAM704 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM704 folded precursor RNA into VGAM704 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM704 RNA is designated SEQ ID:3415, and is provided hereinbelow with reference to the sequence listing part.

VGAM704 host target gene, herein designated VGAM HOST TARGET GENE, encodes a corresponding messenger RNA, VGAM704 host target RNA, herein designated VGAM HOST TARGET RNA. VGAM704 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM704 RNA, herein designated VGAM RNA, binds complementarily to one or more host target binding sites located in untranslated regions of VGAM704 host target RNA, herein designated VGAM HOST TARGET RNA. This complementary binding is due to the fact that the nucleotide sequence of VGAM704 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM704 RNA, herein designated VGAM RNA, may have a different number of host target binding sites in untranslated regions of a VGAM704 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM704 RNA, herein designated VGAM RNA, to host target binding sites on VGAM704 host target RNA, herein designated VGAM HOST TARGET RNA, such as BINDING SITE I, BINDING SITE II and BINDING SITE III, inhibits translation of VGAM704 host target RNA into VGAM704 host target protein, herein designated VGAM HOST TARGET PROTEIN. VGAM host target protein is therefore outlined by a broken line.

It is appreciated that VGAM704 host target gene, herein designated VGAM HOST TARGET GENE, in fact represents a plurality of VGAM704 host target genes. The mRNA of each one of this plurality of VGAM704 host target genes comprises one or more host target binding sites, each having a nucleotide sequence which is at least partly complementary to VGAM704 RNA, herein designated VGAM RNA, and which when bound by VGAM704 RNA causes inhibition of translation of respective one or more VGAM704 host target proteins.

It is further appreciated by one skilled in the art that the mode of translational inhibition illustrated by FIG. 1 with specific reference to translational inhibition exerted by VGAM704 gene, herein designated VGAM GENE, on one or more VGAM704 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM704 is inhibition of expression of host target genes, as part of a novel viral mechanism of attacking a host. Accordingly, utilities of VGAM704 include diagnosis, prevention and treatment of viral infection by Human Coronavirus 229E. Specific functions, and accordingly utilities, of VGAM704 correlate with, and may be deduced from, the identity of the host target genes which VGAM704 binds and inhibits, and the function of these host target genes, as elaborated hereinbelow.

Nucleotide sequences of the VGAM704 precursor RNA, herein designated VGAM PRECURSOR RNA, and of the 'diced' VGAM704 RNA, herein designated VGAM RNA, and a schematic representation of the secondary folding of VGAM704 folded precursor RNA, herein designated VGAM FOLDED PRECURSOR RNA, of VGAM704 are further described hereinbelow with reference to Table 1.

Nucleotide sequences of host target binding sites, such as BINDING SITE-I, BINDING SITE-II and BINDING SITE-III of FIG. 1, found on VGAM704 host target RNA, and schematic representation of the complementarity of each of these host target binding sites to VGAM704 RNA, herein designated VGAM RNA, are described hereinbelow with reference to Table 2.

As mentioned hereinabove with reference to FIG. 1, a function of VGAM704 gene, herein designated VGAM is inhibition of expression of VGAM704 target genes. It is appreciated that specific functions, and accordingly utilities, of VGAM704 correlate with, and may be deduced from, the identity of the target genes which VGAM704 binds and inhibits, and the function of these target genes, as elaborated hereinbelow.

Interleukin 1 Receptor, Type I (IL1R1, Accession NM_000877) is a VGAM704 host target gene. IL1R1 BINDING SITE is HOST TARGET binding site found in the 3' untranslated region of mRNA encoded by IL1R1, corresponding to a HOST TARGET binding site such as BINDING SITE I, BINDING SITE II or BINDING SITE III. Table 2 illustrates the complementarity of the nucleotide sequences of IL1R1 BINDING SITE, designated SEQ ID:6561, to the nucleotide sequence of VGAM704 RNA, herein designated VGAM RNA, also designated SEQ ID:3415.

A function of VGAM704 is therefore inhibition of Interleukin 1 Receptor, Type I (IL1R1, Accession NM_000877), a gene which is a receptor for interleukin-1 alpha (il-1a), beta (il-1b), and interleukin-1 receptor antagonist protein (il-1ra). Accordingly, utilities of VGAM704 include diagnosis, prevention and treatment of diseases and clinical conditions associated with IL1R1. The function of IL1R1 has been established by previous studies. Interleukin-1, which has a role as a mediator in inflammation, actually consists of 2 separate but related proteins, IL1-alpha (OMIM Ref. No. 147720) and IL1-beta (OMIM Ref. No. 147760). Dower et al. (1986) showed that the cell surface receptors for the 2 forms of interleukin-1 are identical. Sims et al. (1989) cloned the human IL1R gene and compared it with the mouse gene. Both contain a single membrane-spanning segment, a large cytoplasmic region, and an extracellular, IL1-binding portion composed of 3 immunoglobulin-like domains. The IL1R gene expressed in human dermal fibroblasts was found to be identical to that expressed in T cells. By a combination of somatic cell hybrid analysis and chromosomal in situ hybridization, Copeland et al. (1991) mapped the IL1R gene to human chromosome 2q12. By RFLP analysis in interspecific backcrosses, Copeland et al. (1991) mapped the corresponding mouse gene at the centromeric end of chromosome 1, a region homologous to a portion of human chromosome 2

Full details of the abovementioned studies are described in the following publications, the disclosure of which are hereby incorporated by reference:

Dower, S. K.; Kronheim, S. R.; Hopp, T. P.; Cantrell, M.; Deeley, M.; Gillis, S.; Henney, C. S.; Urdal, D. L.: The cell surface receptors for interleukin-1(alpha) and interleukin-1 (beta) are identical. Nature 324:266-268, 1986; and Sims, J. E.; Acres, R. B.; Grubin, C. E.; McMahan, C. J.; Wignall, J. M.; March, C. J.; Dower, S. K.: Cloning the interleukin 1 receptor from human T cells. Proc. Nat. Acad. Sci. 86:89.

Further studies establishing the function and utilities of IL1R1 are found in John Hopkins OMIM database record ID 147810, and in sited publications numbered 3041-3044 listed in the bibliography section hereinbelow, which are also hereby incorporated by reference. Phosphodiesterase 4D, CAMP-specific (phosphodiesterase E3 dunce homolog, Drosophila) (PDE4D, Accession XM_056815) is another VGAM704 host target gene. PDE4D BINDING SITE is HOST TARGET binding site found in the 3' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36430, to the nucleotide sequence of VGAM704 RNA, herein designated VGAM RNA, also designated SEQ ID:3415.

Another function of VGAM704 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM704 include diagnosis, prevention and treatment of diseases and clinical conditions associated with PDE4D. The function of PDE4D and its association with various diseases and clinical conditions, has been established by previous studies, as described hereinabove with reference to VGAM180. Sarcoma Amplified Sequence (SAS, Accession NM_005981) is another VGAM704 host target gene. SAS BINDING SITE is HOST TARGET binding site found in the 3" untranslated region of mRNA encoded by SAS, corresponding to a HOST TARGET binding site such as BINDING SITE I, BINDING SITE II or BINDING SITE III. Table 2 illustrates the complementarity of the nucleotide sequences of SAS BINDING SITE, designated SEQ ID:12605, to the nucleotide sequence of VGAM704 RNA, herein designated VGAM RNA, also designated SEQ ID:3415.

Another function of VGAM704 is therefore inhibition of Sarcoma Amplified Sequence (SAS, Accession NM_005981), a gene which is a member of the transmembrane 4 superfamily (TM4SF) and may be involved in growth-related cellular processes T. Accordingly, utilities of VGAM704 include diagnosis, prevention and treatment of diseases and clinical conditions associated with SAS. The function of SAS has been established by previous studies. SAS is a member of the transmembrane 4 superfamily, all members of which have 4 hydrophobic domains. This family includes various tumor-associated antigens such as CO-029 (OMIM Ref. No. 600769), L6 (M3S1; 191155), and ME491 (CD63; 155740), hematopoietic cell antigens such as CD9 (OMIM Ref. No. 143030), CD53 (OMIM Ref. No. 151525), CD37 (OMIM Ref. No. 151523), and TAPA1 (OMIM Ref. No. 186845), as well as the parasitic trematode surface proteins Sm23 and Sj23. Meltzer et al. (1991) identified and partially cloned a gene that is amplified in human malignant fibrous histiocytoma. They demonstrated that the gene, designated sarcoma amplified sequence, is located on chromosome 12 by hybridization to a rodent/human somatic cell hybrid mapping panel. They further regionalized the assignment to 12q13-q14 by fluorescence in situ hybridization. This chromosomal region is commonly involved in rearrangements in myxoid liposarcoma, benign lipoma, and uterine leiomyoma. Meltzer et al. (1991) identified SAS amplification in 5 of 29 malignant fibrous histiocytoma biopsies, 4 of 12 liposarcoma biopsies, and 1 osteogenic sarcoma cell line. Since amplification of cellular oncogenes occurs frequently in human cancers, identification of amplified genes in tumor cells is a useful approach for understanding genetic alterations. Jankowski et al. (1995) characterized the genomic structure of SAS and showed that it has 6 exons spanning approximately 3.2 kb.

Full details of the abovementioned studies are described in the following publications, the disclosure of which are hereby incorporated by reference:

Jankowski, S. A.; De Jong, P.; Meltzer, P. S.: Genomic structure of SAS, a member of the transmembrane 4 superfamily amplified in human sarcomas. Genomics 25:501-506, 1995; and Meltzer, P. S.; Jankowski, S. A.; Dal Cin, P.; Sandberg, A. A.; Paz, I. B.; Coccia, M. A.; Smith, S. H.: Identification and cloning of a novel amplified DNA sequence in human malignant.

Further studies establishing the function and utilities of SAS are found in John Hopkins OMIM database record ID 181035, and in sited publications numbered 5704-5705 listed in the bibliography section hereinbelow, which are also hereby incorporated by reference. Transcription Factor 7 (T-cell specific, HMG-box) (TCF7, Accession NM_003202) is another VGAM704 host target gene. TCF7 BINDING SITE is HOST TARGET binding site found in the 3' untranslated region of mRNA encoded by TCF7, corresponding to a HOST TARGET binding site such as BINDING SITE I, BINDING SITE II or BINDING SITE III. Table 2 illustrates the complementarity of the nucleotide sequences of TCF7 BINDING SITE, designated SEQ ID:9190, to the nucleotide sequence of VGAM704 RNA, herein designated VGAM RNA, also designated SEQ ID:3415.

Another function of VGAM704 is therefore inhibition of Transcription Factor 7 (T-cell specific, HMG-box) (TCF7, Accession NM_003202). Accordingly, utilities of VGAM704 include diagnosis, prevention and treatment of diseases and clinical conditions associated with TCF7. Adaptor-related Protein Complex 3, Mu 2 Subunit (AP3M2, Accession NM_006803) is another VGAM704 host target gene. AP3M2 BINDING SITE is HOST TARGET binding site found in the 3' untranslated region of mRNA encoded by AP3M2, corresponding to a HOST TARGET binding site such as BINDING SITE I, BINDING SITE II or BINDING SITE III. Table 2 illustrates the complementarity of the nucleotide sequences of AP3M2 BINDING SITE, designated SEQ ID:13675, to the nucleotide sequence of VGAM704 RNA, herein designated VGAM RNA, also designated SEQ ID:3415.

Another function of VGAM704 is therefore inhibition of Adaptor-related Protein Complex 3, Mu 2 Subunit (AP3M2, Accession NM_006803). Accordingly, utilities of VGAM704 include diagnosis, prevention and treatment of diseases and clinical conditions associated with AP3M2. DKFZP564I1171 (Accession XM_049568) is another VGAM704 host target gene. DKFZP564I1171 BINDING SITE is HOST TARGET binding site found in the 3' untranslated region of mRNA encoded by DKFZP564I1171, corresponding to a HOST TARGET binding site such as BINDING SITE I, BINDING SITE II or BINDING SITE III. Table 2 illustrates the complementarity of the nucleotide sequences of DKFZP564I1171 BINDING SITE, designated SEQ ID:35444, to the nucleotide sequence of VGAM704 RNA, herein designated VGAM RNA, also designated SEQ ID:3415.

Another function of VGAM704 is therefore inhibition of DKFZP564I1171 (Accession XM_049568). Accordingly, utilities of VGAM704 include diagnosis, prevention and treatment of diseases and clinical conditions associated with DKFZP564I1171. KIAA0433 (Accession NM_015216) is another VGAM704 host target gene. KIAA0433 BINDING SITE is HOST TARGET binding site found in the 3' untranslated region of mRNA encoded by KIAA0433, corresponding to a HOST TARGET binding site such as BINDING SITE I, BINDING SITE II or BINDING SITE III. Table 2 illustrates the complementarity of the nucleotide sequences of KIAA0433 BINDING SITE, designated SEQ ID:17547, to the nucleotide sequence of VGAM704 RNA, herein designated VGAM RNA, also designated SEQ ID:3415.

Another function of VGAM704 is therefore inhibition of KIAA0433 (Accession NM_015216). Accordingly, utilities of VGAM704 include diagnosis, prevention and treatment of diseases and clinical conditions associated with KIAA0433. KIAA0557 (Accession XM_085507) is another VGAM704 host target gene. KIAA0557 BINDING SITE is HOST TARGET binding site found in the 5' untranslated region of mRNA encoded by KIAA0557, corresponding to a HOST TARGET binding site such as BINDING SITE I, BINDING SITE II or BINDING SITE III. Table 2 illustrates the complementarity of the nucleotide sequences of KIAA0557 BINDING SITE, designated SEQ ID:38206, to the nucleotide sequence of VGAM704 RNA, herein designated VGAM RNA, also designated SEQ ID:3415.

Another function of VGAM704 is therefore inhibition of KIAA0557 (Accession XM_085507). Accordingly, utilities of VGAM704 include diagnosis, prevention and treatment of diseases and clinical conditions associated with KIAA0557. KIAA1350 (Accession XM_052597) is another VGAM704 host target gene. KIAA1350 BINDING SITE is HOST TARGET binding site found in the 3' untranslated region of mRNA encoded by KIAA1350, corresponding to a HOST TARGET binding site such as BINDING SITE I, BINDING SITE II or BINDING SITE III. Table 2 illustrates the complementarity of the nucleotide sequences of KIAA1350 BINDING SITE, designated SEQ ID:36000, to the nucleotide sequence of VGAM704 RNA, herein designated VGAM RNA, also designated SEQ ID:3415.

Another function of VGAM704 is therefore inhibition of KIAA1350 (Accession XM_052597). Accordingly, utilities of VGAM704 include diagnosis, prevention and treatment of diseases and clinical conditions associated with KIAA1350. KIAA1557 (Accession XM_028289) is another VGAM704 host target gene. KIAA1557 BINDING SITE is HOST TARGET binding site found in the 3' untranslated region of mRNA encoded by KIAA1557, corresponding to a HOST TARGET binding site such as BINDING SITE I, BINDING SITE II or BINDING SITE III. Table 2 illustrates the complementarity of the nucleotide sequences of KIAA1557 BINDING SITE, designated SEQ ID:30640, to the nucleotide sequence of VGAM704 RNA, herein designated VGAM RNA, also designated SEQ ID:3415.

Another function of VGAM704 is therefore inhibition of KIAA1557 (Accession XM_028289). Accordingly, utilities of VGAM704 include diagnosis, prevention and treatment of diseases and clinical conditions associated with KIAA1557. KIAA1735 (Accession XM_113686) is another VGAM704 host target gene. KIAA1735 BINDING SITE is HOST TARGET binding site found in the 3' untranslated region of mRNA encoded by KIAA1735, corresponding to a HOST TARGET binding site such as BINDING SITE I, BINDING SITE II or BINDING SITE III. Table 2 illustrates the complementarity of the nucleotide sequences of KIAA1735 BINDING SITE, designated SEQ ID:42345, to the nucleotide sequence of VGAM704 RNA, herein designated VGAM RNA, also designated SEQ ID:3415.

Another function of VGAM704 is therefore inhibition of KIAA1735 (Accession XM_113686). Accordingly, utilities of VGAM704 include diagnosis, prevention and treatment of diseases and clinical conditions associated with KIAA1735. MGC5466 (Accession XM_054436) is another VGAM704 host target gene. MGC5466 BINDING SITE is HOST TARGET binding site found in the 3' untranslated region of mRNA encoded by MGC5466, corresponding to a HOST TARGET binding site such as BINDING SITE I, BINDING SITE II or BINDING SITE III. Table 2 illustrates the complementarity of the nucleotide sequences of MGC5466 BINDING SITE, designated SEQ ID:36158, to the nucleotide sequence of VGAM704 RNA, herein designated VGAM RNA, also designated SEQ ID:3415.

Another function of VGAM704 is therefore inhibition of MGC5466 (Accession XM_054436). Accordingly, utilities of VGAM704 include diagnosis, prevention and treatment of diseases and clinical conditions associated with MGC5466. Retinoic Acid Induced 17 (RAI17, Accession XM_166091) is another VGAM704 host target gene. RAI17 BINDING SITE is HOST TARGET binding site found in the 3' untranslated region of mRNA encoded by RAI17, corresponding to a HOST TARGET binding site such as BINDING SITE I, BINDING SITE II or BINDING SITE III. Table 2 illustrates the complementarity of the nucleotide sequences of RAI17 BINDING SITE, designated SEQ ID:43861, to the nucleotide sequence of VGAM704 RNA, herein designated VGAM RNA, also designated SEQ ID:3415.

Another function of VGAM704 is therefore inhibition of Retinoic Acid Induced 17 (RAI17, Accession XM_166091).

Accordingly, utilities of VGAM704 include diagnosis, prevention and treatment of diseases and clinical conditions associated with RAI17. Spi-B Transcription Factor (Spi-1/PU.1 related) (SPIB, Accession NM_003121) is another VGAM704 host target gene. SPIB BINDING SITE is HOST TARGET binding site found in the 3' untranslated region of mRNA encoded by SPIB, corresponding to a HOST TARGET binding site such as BINDING SITE I, BINDING SITE II or BINDING SITE III. Table 2 illustrates the complementarity of the nucleotide sequences of SPIB BINDING SITE, designated SEQ ID:9092, to the nucleotide sequence of VGAM704 RNA, herein designated VGAM RNA, also designated SEQ ID:3415.

Another function of VGAM704 is therefore inhibition of Spi-B Transcription Factor (Spi-1/PU.1 related) (SPIB, Accession NM_003121). Accordingly, utilities of VGAM704 include diagnosis, prevention and treatment of diseases and clinical conditions associated with SPIB. Sperm Specific Antigen 2 (SSFA2, Accession XM_057458) is another VGAM704 host target gene. SSFA2 BINDING SITE is HOST TARGET binding site found in the 3' untranslated region of mRNA encoded by SSFA2, corresponding to a HOST TARGET binding site such as BINDING SITE I, BINDING SITE II or BINDING SITE III. Table 2 illustrates the complementarity of the nucleotide sequences of SSFA2 BINDING SITE, designated SEQ ID:36514, to the nucleotide sequence of VGAM704 RNA, herein designated VGAM RNA, also designated SEQ ID:3415.

Another function of VGAM704 is therefore inhibition of Sperm Specific Antigen 2 (SSFA2, Accession XM_057458). Accordingly, utilities of VGAM704 include diagnosis, prevention and treatment of diseases and clinical conditions associated with SSFA2. SSH-3 (Accession NM_017857) is another VGAM704 host target gene. SSH-3 BINDING SITE is HOST TARGET binding site found in the 3' untranslated region of mRNA encoded by SSH-3, corresponding to a HOST TARGET binding site such as BINDING SITE I, BINDING SITE II or BINDING SITE III. Table 2 illustrates the complementarity of the nucleotide sequences of SSH-3 BINDING SITE, designated SEQ ID:19535, to the nucleotide sequence of VGAM704 RNA, herein designated VGAM RNA, also designated SEQ ID:3415.

Another function of VGAM704 is therefore inhibition of SSH-3 (Accession NM_017857). Accordingly, utilities of VGAM704 include diagnosis, prevention and treatment of diseases and clinical conditions associated with SSH-3. LOC153474 (Accession XM_087684) is another VGAM704 host target gene. LOC153474 BINDING SITE is HOST TARGET binding site found in the 3' untranslated region of mRNA encoded by LOC153474, corresponding to a HOST TARGET binding site such as BINDING SITE I, BINDING SITE II or BINDING SITE III. Table 2 illustrates the complementarity of the nucleotide sequences of LOC153474 BINDING SITE, designated SEQ ID:39380, to the nucleotide sequence of VGAM704 RNA, herein designated VGAM RNA, also designated SEQ ID:3415.

Another function of VGAM704 is therefore inhibition of LOC153474 (Accession XM_087684). Accordingly, utilities of VGAM704 include diagnosis, prevention and treatment of diseases and clinical conditions associated with LOC153474. LOC200734 (Accession XM_114286) is another VGAM704 host target gene. LOC200734 BINDING SITE is HOST TARGET binding site found in the 3' untranslated region of mRNA encoded by LOC200734, corresponding to a HOST TARGET binding site such as BINDING SITE I, BINDING SITE II or BINDING SITE III. Table 2 illustrates the complementarity of the nucleotide sequences of LOC200734 BINDING SITE, designated SEQ ID:42839, to the nucleotide sequence of VGAM704 RNA, herein designated VGAM RNA, also designated SEQ ID:3415.

Another function of VGAM704 is therefore inhibition of LOC200734 (Accession XM_114286). Accordingly, utilities of VGAM704 include diagnosis, prevention and treatment of diseases and clinical conditions associated with LOC200734. LOC202347 (Accession XM_117390) is another VGAM704 host target gene. LOC202347 BINDING SITE is HOST TARGET binding site found in the 3' untranslated region of mRNA encoded by LOC202347, corresponding to a HOST TARGET binding site such as BINDING SITE I, BINDING SITE II or BINDING SITE III. Table 2 illustrates the complementarity of the nucleotide sequences of LOC202347 BINDING SITE, designated SEQ ID:43429, to the nucleotide sequence of VGAM704 RNA, herein designated VGAM RNA, also designated SEQ ID:3415.

Another function of VGAM704 is therefore inhibition of LOC202347 (Accession XM_117390). Accordingly, utilities of VGAM704 include diagnosis, prevention and treatment of diseases and clinical conditions associated with LOC202347. LOC89919 (Accession XM_027244) is another VGAM704 host target gene. LOC89919 BINDING SITE is HOST TARGET binding site found in the 3' untranslated region of mRNA encoded by LOC89919, corresponding to a HOST TARGET binding site such as BINDING SITE I, BINDING SITE II or BINDING SITE III. Table 2 illustrates the complementarity of the nucleotide sequences of LOC89919 BINDING SITE, designated SEQ ID:30463, to the nucleotide sequence of VGAM704 RNA, herein designated VGAM RNA, also designated SEQ ID:3415.

Another function of VGAM704 is therefore inhibition of LOC89919 (Accession XM_027244). Accordingly, utilities of VGAM704 include diagnosis, prevention and treatment of diseases and clinical conditions associated with LOC89919. LOC93550 (Accession XM_051999) is another VGAM704 host target gene. LOC93550 BINDING SITE is HOST TARGET binding site found in the 3' untranslated region of mRNA encoded by LOC93550, corresponding to a HOST TARGET binding site such as BINDING SITE I, BINDING SITE II or BINDING SITE III. Table 2 illustrates the complementarity of the nucleotide sequences of LOC93550 BINDING SITE, designated SEQ ID:35930, to the nucleotide sequence of VGAM704 RNA, herein designated VGAM RNA, also designated SEQ ID:3415.

Another function of VGAM704 is therefore inhibition of LOC93550 (Accession XM_051999). Accordingly, utilities of VGAM704 include diagnosis, prevention and treatment of diseases and clinical conditions associated with LOC93550. FIG. 1 further provides a conceptual description of a novel bioinformatically detected viral gene of the present invention, referred to here as Viral Genomic Address Messenger 705 (VGAM705) viral gene, which modulates expression of respective host target genes thereof, the function and utility of which host target genes is known in the art.

VGAM705 is a novel bioinformatically detected regulatory, non protein coding, viral micro RNA (miRNA) gene. The method by which VGAM705 was detected is described hereinabove with reference to FIGS. 1-8.

VGAM705 gene, herein designated VGAM GENE, is a viral gene contained in the genome of Human Coronavirus 229E. VGAM705 host target gene, herein designated VGAM HOST TARGET GENE, is a human gene contained in the human genome.

VGAM705 gene encodes a VGAM705 precursor RNA, herein designated VGAM PRECURSOR RNA. Similar to other miRNA genes, and unlike most ordinary genes, VGAM705 precursor RNA does not encode a protein. A nucleotide sequence identical or highly similar to the nucleotide sequence of VGAM705 precursor RNA is designated SEQ ID:691, and is provided hereinbelow with reference to the sequence listing part. Nucleotide sequence SEQ ID:691 is located at position 23467 relative to the genome of Human Coronavirus 229E.

VGAM705 precursor RNA folds onto itself, forming VGAM705 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM705 folded precursor RNA into VGAM705 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM705 RNA is designated SEQ ID:3416, and is provided hereinbelow with reference to the sequence listing part.

VGAM705 host target gene, herein designated VGAM HOST TARGET GENE, encodes a corresponding messenger RNA, VGAM705 host target RNA, herein designated VGAM HOST TARGET RNA. VGAM705 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM705 RNA, herein designated VGAM RNA, binds complementarily to one or more host target binding sites located in untranslated regions of VGAM705 host target RNA, herein designated VGAM HOST TARGET RNA. This complementary binding is due to the fact that the nucleotide sequence of VGAM705 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM705 RNA, herein designated VGAM RNA, may have a different number of host target binding sites in untranslated regions of a VGAM705 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM705 RNA, herein designated VGAM RNA, to host target binding sites on VGAM705 host target RNA, herein designated VGAM HOST TARGET RNA, such as BINDING SITE I, BINDING SITE II and BINDING SITE III, inhibits translation of VGAM705 host target RNA into VGAM705 host target protein, herein designated VGAM HOST TARGET PROTEIN. VGAM host target protein is therefore outlined by a broken line.

It is appreciated that VGAM705 host target gene, herein designated VGAM HOST TARGET GENE, in fact represents a plurality of VGAM705 host target genes. The mRNA of each one of this plurality of VGAM705 host target genes comprises one or more host target binding sites, each having a nucleotide sequence which is at least partly complementary to VGAM705 RNA, herein designated VGAM RNA, and which when bound by VGAM705 RNA causes inhibition of translation of respective one or more VGAM705 host target proteins.

It is further appreciated by one skilled in the art that the mode of translational inhibition illustrated by FIG. 1 with specific reference to translational inhibition exerted by VGAM705 gene, herein designated VGAM GENE, on one or more VGAM705 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM705 is inhibition of expression of host target genes, as part of a novel viral mechanism of attacking a host. Accordingly, utilities of VGAM705 include diagnosis, prevention and treatment of viral infection by Human Coronavirus 229E. Specific functions, and accordingly utilities, of VGAM705 correlate with, and may be deduced from, the identity of the host target genes which VGAM705 binds and inhibits, and the function of these host target genes, as elaborated hereinbelow.

Nucleotide sequences of the VGAM705 precursor RNA, herein designated VGAM PRECURSOR RNA, and of the 'diced' VGAM705 RNA, herein designated VGAM RNA, and a schematic representation of the secondary folding of VGAM705 folded precursor RNA, herein designated VGAM FOLDED PRECURSOR RNA, of VGAM705 are further described hereinbelow with reference to Table 1.

Nucleotide sequences of host target binding sites, such as BINDING SITE-I, BINDING SITE-II and BINDING SITE-III of FIG. 1, found on VGAM705 host target RNA, and schematic representation of the complementarity of each of these host target binding sites to VGAM705 RNA, herein designated VGAM RNA, are described hereinbelow with reference to Table 2.

As mentioned hereinabove with reference to FIG. 1, a function of VGAM705 gene, herein designated VGAM is inhibition of expression of VGAM705 target genes. It is appreciated that specific functions, and accordingly utilities, of VGAM705 correlate with, and may be deduced from, the identity of the target genes which VGAM705 binds and inhibits, and the function of these target genes, as elaborated hereinbelow.

Aldehyde Dehydrogenase 1 Family, Member A3 (ALDH1A3, Accession NM_000693) is a VGAM705 host target gene. ALDH1A3 BINDING SITE is HOST TARGET binding site found in the 3' untranslated region of mRNA encoded by ALDH1A3, corresponding to a HOST TARGET binding site such as BINDING SITE I, BINDING SITE II or BINDING SITE III. Table 2 illustrates the complementarity of the nucleotide sequences of ALDH1A3 BINDING SITE, designated SEQ ID:6351, to the nucleotide sequence of VGAM705 RNA, herein designated VGAM RNA, also designated SEQ ID:3416.

A function of VGAM705 is therefore inhibition of Aldehyde Dehydrogenase 1 Family, Member A3 (ALDH1A3, Accession NM_000693), a gene which plays a major role in the detoxification of aldehydes generated by alcohol metabolism and lipid peroxidation. Accordingly, utilities of VGAM705 include diagnosis, prevention and treatment of diseases and clinical conditions associated with ALDH1A3. The function of ALDH1A3 and its association with various diseases and clinical conditions, has been established by previous studies, as described hereinabove with reference to VGAM565. Chromosome 9 Open Reading Frame 9 (C9orf9, Accession NM_018956) is another VGAM705 host target gene. C9orf9 BINDING SITE is HOST TARGET binding site found in the 3' untranslated region of mRNA encoded by C9orf9, corresponding to a HOST TARGET binding site such as BINDING SITE I, BINDING SITE II or BINDING SITE III. Table 2 illustrates the complementarity of the nucleotide sequences of C9orf9 BINDING SITE, designated SEQ ID:21025, to the nucleotide sequence of VGAM705 RNA, herein designated VGAM RNA, also designated SEQ ID:3416.

Another function of VGAM705 is therefore inhibition of Chromosome 9 Open Reading Frame 9 (C9orf9, Accession NM_018956). Accordingly, utilities of VGAM705 include diagnosis, prevention and treatment of diseases and clinical conditions associated with C9orf9. DKFZP727C091 (Accession XM_038689) is another VGAM705 host target gene. DKFZP727C091 BINDING SITE is HOST TARGET binding site found in the 3' untranslated region of mRNA encoded by DKFZP727C091, corresponding to a HOST TARGET binding site such as BINDING SITE I, BINDING SITE II or BINDING SITE III. Table 2 illustrates the complementarity of the nucleotide sequences of DKFZP727C091 BINDING SITE, designated SEQ ID:32909, to the nucleotide sequence of VGAM705 RNA, herein designated VGAM RNA, also designated SEQ ID:3416.

Another function of VGAM705 is therefore inhibition of DKFZP727C091 (Accession XM_038689). Accordingly, utilities of VGAM705 include diagnosis, prevention and treatment of diseases and clinical conditions associated with DKFZP727C091. Endothelial Cell-specific Molecule 1 (ESM1, Accession NM_007036) is another VGAM705 host target gene. ESM1 BINDING SITE is HOST TARGET binding site found in the 3' untranslated region of mRNA encoded by ESM1, corresponding to a HOST TARGET binding site such as BINDING SITE I, BINDING SITE II or BINDING SITE III. Table 2 illustrates the complementarity of the nucleotide sequences of ESM1 BINDING SITE, designated SEQ ID:13916, to the nucleotide sequence of VGAM705 RNA, herein designated VGAM RNA, also designated SEQ ID:3416.

Another function of VGAM705 is therefore inhibition of Endothelial Cell-specific Molecule 1 (ESM1, Accession NM_007036). Accordingly, utilities of VGAM705 include diagnosis, prevention and treatment of diseases and clinical conditions associated with ESM1. F-box Only Protein 4 (FBXO4, Accession NM_033484) is another VGAM705 host target gene. FBXO4 BINDING SITE is HOST TARGET binding site found in the 3' untranslated region of mRNA encoded by FBXO4, corresponding to a HOST TARGET binding site such as BINDING SITE I, BINDING SITE II or BINDING SITE III. Table 2 illustrates the complementarity of the nucleotide sequences of FBXO4 BINDING SITE, designated SEQ ID:27263, to the nucleotide sequence of VGAM705 RNA, herein designated VGAM RNA, also designated SEQ ID:3416.

Another function of VGAM705 is therefore inhibition of F-box Only Protein 4 (FBXO4, Accession NM_033484). Accordingly, utilities of VGAM705 include diagnosis, prevention and treatment of diseases and clinical conditions associated with FBXO4. FLJ11273 (Accession NM_018374) is another VGAM705 host target gene. FLJ11273 BINDING SITE is HOST TARGET binding site found in the 3' untranslated region of mRNA encoded by FLJ11273, corresponding to a HOST TARGET binding site such as BINDING SITE I, BINDING SITE II or BINDING SITE III. Table 2 illustrates the complementarity of the nucleotide sequences of FLJ11273 BINDING SITE, designated SEQ ID:20396, to the nucleotide sequence of VGAM705 RNA, herein designated VGAM RNA, also designated SEQ ID:3416.

Another function of VGAM705 is therefore inhibition of FLJ11273 (Accession NM_018374). Accordingly, utilities of VGAM705 include diagnosis, prevention and treatment of diseases and clinical conditions associated with FLJ11273. FLJ21916 (Accession NM_023112) is another VGAM705 host target gene. FLJ21916 BINDING SITE is HOST TARGET binding site found in the 3' untranslated region of mRNA encoded by FLJ21916, corresponding to a HOST TARGET binding site such as BINDING SITE I, BINDING SITE II or BINDING SITE III. Table 2 illustrates the complementarity of the nucleotide sequences of FLJ21916 BINDING SITE, designated SEQ ID:23382, to the nucleotide sequence of VGAM705 RNA, herein designated VGAM RNA, also designated SEQ ID:3416.

Another function of VGAM705 is therefore inhibition of FLJ21916 (Accession NM_023112). Accordingly, utilities of VGAM705 include diagnosis, prevention and treatment of diseases and clinical conditions associated with FLJ21916. Lipoma HMGIC Fusion Partner-like 2 (LHFPL2, Accession XM_046054) is another VGAM705 host target gene. LHFPL2 BINDING SITE is HOST TARGET binding site found in the 3' untranslated region of mRNA encoded by LHFPL2, corresponding to a HOST TARGET binding site such as BINDING SITE I, BINDING SITE II or BINDING SITE III. Table 2 illustrates the complementarity of the nucleotide sequences of LHFPL2 BINDING SITE, designated SEQ ID:34662, to the nucleotide sequence of VGAM705 RNA, herein designated VGAM RNA, also designated SEQ ID:3416.

Another function of VGAM705 is therefore inhibition of Lipoma HMGIC Fusion Partner-like 2 (LHFPL2, Accession XM_046054). Accordingly, utilities of VGAM705 include diagnosis, prevention and treatment of diseases and clinical conditions associated with LHFPL2. Seizure Related 6 Homolog (mouse) (SEZ6, Accession XM_058869) is another VGAM705 host target gene. SEZ6 BINDING SITE is HOST TARGET binding site found in the 5' untranslated region of mRNA encoded by SEZ6, corresponding to a HOST TARGET binding site such as BINDING SITE I, BINDING SITE II or BINDING SITE III. Table 2 illustrates the complementarity of the nucleotide sequences of SEZ6 BINDING SITE, designated SEQ ID:36776, to the nucleotide sequence of VGAM705 RNA, herein designated VGAM RNA, also designated SEQ ID:3416.

Another function of VGAM705 is therefore inhibition of Seizure Related 6 Homolog (mouse) (SEZ6, Accession XM_058869). Accordingly, utilities of VGAM705 include diagnosis, prevention and treatment of diseases and clinical conditions associated with SEZ6. Sialyltransferase 8C (alpha2,3Galbeta1,4GlcNAcalpha 2,8-sialyl transferase) (SIAT8C, Accession NM_015879) is another VGAM705 host target gene. SIAT8C BINDING SITE is HOST TARGET binding site found in the 5' untranslated region of mRNA encoded by SIAT8C, corresponding to a HOST TARGET binding site such as BINDING SITE I, BINDING SITE II or BINDING SITE III. Table 2 illustrates the complementarity of the nucleotide sequences of SIAT8C BINDING SITE, designated SEQ ID:18028, to the nucleotide sequence of VGAM705 RNA, herein designated VGAM RNA, also designated SEQ ID:3416.

Another function of VGAM705 is therefore inhibition of Sialyltransferase 8C (alpha2,3Galbeta1,4GlcNAcalpha 2,8-sialyl transferase) (SIAT8C, Accession NM_015879). Accordingly, utilities of VGAM705 include diagnosis, prevention and treatment of diseases and clinical conditions associated with SIAT8C. LOC163255 (Accession XM_092121) is another VGAM705 host target gene. LOC163255 BINDING SITE is HOST TARGET binding site found in the 5' untranslated region of mRNA encoded by LOC163255, corresponding to a HOST TARGET binding site such as BINDING SITE I, BINDING SITE II or BINDING SITE III. Table 2 illustrates the complementarity of the nucleotide sequences of LOC163255 BINDING SITE, designated SEQ ID:40107, to the nucleotide sequence of VGAM705 RNA, herein designated VGAM RNA, also designated SEQ ID:3416.

Another function of VGAM705 is therefore inhibition of LOC163255 (Accession XM_092121). Accordingly, utilities of VGAM705 include diagnosis, prevention and treatment of diseases and clinical conditions associated with LOC163255. LOC164397 (Accession XM_092780) is another VGAM705 host target gene. LOC164397 BINDING SITE is HOST TARGET binding site found in the 5' untranslated region of mRNA encoded by LOC164397, corresponding to a HOST TARGET binding site such as BINDING SITE I, BINDING SITE II or BINDING SITE III. Table 2 illustrates the complementarity of the nucleotide sequences of LOC164397 BINDING SITE, designated SEQ ID:40149, to the nucleotide sequence of VGAM705 RNA, herein designated VGAM RNA, also designated SEQ ID:3416.

Another function of VGAM705 is therefore inhibition of LOC164397 (Accession XM_092780). Accordingly, utilities of VGAM705 include diagnosis, prevention and treatment of diseases and clinical conditions associated with LOC164397. LOC255862 (Accession XM_170505) is another VGAM705 host target gene. LOC255862 BINDING SITE is HOST TARGET binding site found in the 3' untranslated region of mRNA encoded by LOC255862, corresponding to a HOST TARGET binding site such as BINDING SITE I, BINDING SITE II or BINDING SITE III. Table 2 illustrates the complementarity of the nucleotide sequences of LOC255862 BINDING SITE, designated SEQ ID:45341, to the nucleotide sequence of VGAM705 RNA, herein designated VGAM RNA, also designated SEQ ID:3416.

Another function of VGAM705 is therefore inhibition of LOC255862 (Accession XM_170505). Accordingly, utilities of VGAM705 include diagnosis, prevention and treatment of diseases and clinical conditions associated with LOC255862. LOC256176 (Accession XM_172889) is another VGAM705 host target gene. LOC256176 BINDING SITE is HOST TARGET binding site found in the 5' untranslated region of mRNA encoded by LOC256176, corresponding to a HOST TARGET binding site such as BINDING SITE I, BINDING SITE II or BINDING SITE III. Table 2 illustrates the complementarity of the nucleotide sequences of LOC256176 BINDING SITE, designated SEQ ID:46171, to the nucleotide sequence of VGAM705 RNA, herein designated VGAM RNA, also designated SEQ ID:3416.

Another function of VGAM705 is therefore inhibition of LOC256176 (Accession XM_172889). Accordingly, utilities of VGAM705 include diagnosis, prevention and treatment of diseases and clinical conditions associated with LOC256176. LOC91050 (Accession XM_035703) is another VGAM705 host target gene. LOC91050 BINDING SITE is HOST TARGET binding site found in the 3' untranslated region of mRNA encoded by LOC91050, corresponding to a HOST TARGET binding site such as BINDING SITE I, BINDING SITE II or BINDING SITE III. Table 2 illustrates the complementarity of the nucleotide sequences of LOC91050 BINDING SITE, designated SEQ ID:32338, to the nucleotide sequence of VGAM705 RNA, herein designated VGAM RNA, also designated SEQ ID:3416.

Another function of VGAM705 is therefore inhibition of LOC91050 (Accession XM_035703). Accordingly, utilities of VGAM705 include diagnosis, prevention and treatment of diseases and clinical conditions associated with LOC91050. FIG. 1 further provides a conceptual description of a novel bioinformatically detected viral gene of the present invention, referred to here as Viral Genomic Address Messenger 706 (VGAM706) viral gene, which modulates expression of respective host target genes thereof, the function and utility of which host target genes is known in the art.

VGAM706 is a novel bioinformatically detected regulatory, non protein coding, viral micro RNA (miRNA) gene. The method by which VGAM706 was detected is described hereinabove with reference to FIGS. 1-8.

VGAM706 gene, herein designated VGAM GENE, is a viral gene contained in the genome of Human Coronavirus 229E. VGAM706 host target gene, herein designated VGAM HOST TARGET GENE, is a human gene contained in the human genome.

VGAM706 gene encodes a VGAM706 precursor RNA, herein designated VGAM PRECURSOR RNA. Similar to other miRNA genes, and unlike most ordinary genes, VGAM706 precursor RNA does not encode a protein. A nucleotide sequence identical or highly similar to the nucleotide sequence of VGAM706 precursor RNA is designated SEQ ID:692, and is provided hereinbelow with reference to the sequence listing part. Nucleotide sequence SEQ ID:692 is located at position 23583 relative to the genome of Human Coronavirus 229E.

VGAM706 precursor RNA folds onto itself, forming VGAM706 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM706 folded precursor RNA into VGAM706 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM706 RNA is designated SEQ ID:3417, and is provided hereinbelow with reference to the sequence listing part.

VGAM706 host target gene, herein designated VGAM HOST TARGET GENE, encodes a corresponding messenger RNA, VGAM706 host target RNA, herein designated VGAM HOST TARGET RNA. VGAM706 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM706 RNA, herein designated VGAM RNA, binds complementarily to one or more host target binding sites located in untranslated regions of VGAM706 host target RNA, herein designated VGAM HOST TARGET RNA. This complementary binding is due to the fact that the nucleotide sequence of VGAM706 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM706 RNA, herein designated VGAM RNA, may have a different number of host target binding sites in untranslated regions of a VGAM706 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM706 RNA, herein designated VGAM RNA, to host target binding sites on VGAM706 host target RNA, herein designated VGAM HOST TARGET RNA, such as BINDING SITE I, BINDING SITE II and BINDING SITE III, inhibits translation of VGAM706 host target RNA into VGAM706 host target protein, herein designated VGAM HOST TARGET PROTEIN. VGAM host target protein is therefore outlined by a broken line.

It is appreciated that VGAM706 host target gene, herein designated VGAM HOST TARGET GENE, in fact represents a plurality of VGAM706 host target genes. The mRNA of each one of this plurality of VGAM706 host target genes comprises one or more host target binding sites, each having a nucleotide sequence which is at least partly complementary to VGAM706 RNA, herein designated VGAM RNA, and which when bound by VGAM706 RNA causes inhibition of translation of respective one or more VGAM706 host target proteins.

It is further appreciated by one skilled in the art that the mode of translational inhibition illustrated by FIG. 1 with specific reference to translational inhibition exerted by VGAM706 gene, herein designated VGAM GENE, on one or more VGAM706 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM706 is inhibition of expression of host target genes, as part of a novel viral mechanism of attacking a host. Accordingly, utilities of VGAM706 include diagnosis, prevention and treatment of viral infection by Human Coronavirus 229E. Specific functions, and accordingly utilities, of VGAM706 correlate with, and may be deduced from, the identity of the host target genes which VGAM706 binds and inhibits, and the function of these host target genes, as elaborated hereinbelow.

Nucleotide sequences of the VGAM706 precursor RNA, herein designated VGAM PRECURSOR RNA, and of the 'diced' VGAM706 RNA, herein designated VGAM RNA, and a schematic representation of the secondary folding of VGAM706 folded precursor RNA, herein designated VGAM FOLDED PRECURSOR RNA, of VGAM706 are further described hereinbelow with reference to Table 1.

Nucleotide sequences of host target binding sites, such as BINDING SITE-I, BINDING SITE-II and BINDING SITE-III of FIG. 1, found on VGAM706 host target RNA, and schematic representation of the complementarity of each of these host target binding sites to VGAM706 RNA, herein designated VGAM RNA, are described hereinbelow with reference to Table 2.

As mentioned hereinabove with reference to FIG. 1, a function of VGAM706 gene, herein designated VGAM is inhibition of expression of VGAM706 target genes. It is appreciated that specific functions, and accordingly utilities, of VGAM706 correlate with, and may be deduced from, the identity of the target genes which VGAM706 binds and inhibits, and the function of these target genes, as elaborated hereinbelow.

A Disintegrin and Metalloproteinase Domain 10 (ADAM10, Accession NM_001110) is a VGAM706 host target gene. ADAM10 BINDING SITE is HOST TARGET binding site found in the 3' untranslated region of mRNA encoded by ADAM10, corresponding to a HOST TARGET binding site such as BINDING SITE I, BINDING SITE II or BINDING SITE III. Table 2 illustrates the complementarity of the nucleotide sequences of ADAM10 BINDING SITE, designated SEQ ID:6769, to the nucleotide sequence of VGAM706 RNA, herein designated VGAM RNA, also designated SEQ ID:3417.

A function of VGAM706 is therefore inhibition of A Disintegrin and Metalloproteinase Domain 10 (ADAM10, Accession NM_001110), a gene which Member of ADAM family of zinc metalloproteases. Accordingly, utilities of VGAM706 include diagnosis, prevention and treatment of diseases and clinical conditions associated with ADAM10. The function of ADAM10 has been established by previous studies. Wolfsberg et al. (1995) identified a family of proteins containing a disintegrin and metalloproteinase (ADAM) domain. Members of this family are cell surface proteins with a unique structure possessing both potential adhesion and protease domains. Tumor necrosis factor-alpha (TNFA; 191160) is synthesized as a proinflammatory cytokine from a 233-amino acid precursor. Conversion of the membrane-bound precursor to a secreted mature protein is mediated by a protease termed TNFA convertase. Lunn et al. (1997) found that ADAM10 possesses TNFA convertase activity. TNFA is involved in a variety of diseases. To elucidate whether the ADAM10 locus maps to the same region as a disease susceptibility, Yamazaki et al. (1997) mapped the ADAM10 locus. Using a radiation hybrid mapping method, they showed that ADAM10 is located on 15q21.3-q23. Although ephrins form a high-affinity multivalent complex with their receptors present on axons, axons can be rapidly repelled rather than being bound. Hattori et al. (2000) showed that ephrin-A2 (OMIM Ref. No. 602756) forms a stable complex with the metalloproteinase Kuzbanian (OMIM Ref. No. ADAM10) involving interactions outside the cleavage region and the protease domain. Eph receptor binding triggered ephrin-A2 cleavage in a localized reaction specific to the cognate ligand. The cleavage-inhibiting mutation in ephrin-A2 delayed axon withdrawal. Hattori et al. (2000) concluded that their studies reveal mechanisms for protease recognition and control of cell surface proteins, and, for ephrin-A2, they may provide a means for efficient axon detachment and termination of signaling.

Full details of the abovementioned studies are described in the following publications, the disclosure of which are hereby incorporated by reference:

Lunn, C. A.; Fan, X.; Dalie, B.; Miller, K.; Zavodny, P. J.; Narula, S. K.; Lundell, D.: Purification of ADAM 10 from bovine spleen as a TNFalpha convertase. FEBS Lett. 400: 333-335, 1997; and Hattori, M.; Osterfield, M.; Flanagan, J. G.: Regulated cleavage of a contact-mediated axon repellent. Science 289: 1360-1365, 2000.

Further studies establishing the function and utilities of ADAM10 are found in John Hopkins OMIM database record ID 602192, and in sited publications numbered 1267 and 5852-5853 listed in the bibliography section hereinbelow, which are also hereby incorporated by reference. Zinc Finger, Imprinted 2 (ZIM2, Accession NM_015363) is another VGAM706 host target gene. ZIM2 BINDING SITE is HOST TARGET binding site found in the 3' untranslated region of mRNA encoded by ZIM2, corresponding to a HOST TARGET binding site such as BINDING SITE I, BINDING SITE II or BINDING SITE III. Table 2 illustrates the complementarity of the nucleotide sequences of ZIM2 BINDING SITE, designated SEQ ID:17664, to the nucleotide sequence of VGAM706 RNA, herein designated VGAM RNA, also designated SEQ ID:3417.

Another function of VGAM706 is therefore inhibition of Zinc Finger, Imprinted 2 (ZIM2, Accession NM_015363). Accordingly, utilities of VGAM706 include diagnosis, prevention and treatment of diseases and clinical conditions associated with ZIM2. LOC221715 (Accession XM_168092) is another VGAM706 host target gene. LOC221715 BINDING SITE is HOST TARGET binding site found in the 5' untranslated region of mRNA encoded by LOC221715, corresponding to a HOST TARGET binding site such as BINDING SITE I, BINDING SITE II or BINDING SITE III. Table 2 illustrates the complementarity of the nucleotide sequences of LOC221715 BINDING SITE, designated SEQ ID:45018, to the nucleotide sequence of VGAM706 RNA, herein designated VGAM RNA, also designated SEQ ID:3417.

Another function of VGAM706 is therefore inhibition of LOC221715 (Accession XM_168092). Accordingly, utilities of VGAM706 include diagnosis, prevention and treatment of diseases and clinical conditions associated with LOC221715. FIG. 1 further provides a conceptual description of a novel bioinformatically detected viral gene of the present invention, referred to here as Viral Genomic Address Messenger 707 (VGAM707) viral gene, which modulates expression of respective host target genes thereof, the function and utility of which host target genes is known in the art.

VGAM707 is a novel bioinformatically detected regulatory, non protein coding, viral micro RNA (miRNA) gene. The method by which VGAM707 was detected is described hereinabove with reference to FIGS. 1-8.

VGAM707 gene, herein designated VGAM GENE, is a viral gene contained in the genome of Invertebrate Iridescent Virus 6. VGAM707 host target gene, herein designated VGAM HOST TARGET GENE, is a human gene contained in the human genome.

VGAM707 gene encodes a VGAM707 precursor RNA, herein designated VGAM PRECURSOR RNA. Similar to other miRNA genes, and unlike most ordinary genes, VGAM707 precursor RNA does not encode a protein. A nucleotide sequence identical or highly similar to the nucleotide sequence of VGAM707 precursor RNA is designated SEQ ID:693, and is provided hereinbelow with reference to the sequence listing part. Nucleotide sequence SEQ ID:693 is located at position 129865 relative to the genome of Invertebrate Iridescent Virus 6.

VGAM707 precursor RNA folds onto itself, forming VGAM707 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM707 folded precursor RNA into VGAM707 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM707 RNA is designated SEQ ID:3418, and is provided hereinbelow with reference to the sequence listing part.

VGAM707 host target gene, herein designated VGAM HOST TARGET GENE, encodes a corresponding messenger RNA, VGAM707 host target RNA, herein designated VGAM HOST TARGET RNA. VGAM707 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM707 RNA, herein designated VGAM RNA, binds complementarily to one or more host target binding sites located in untranslated regions of VGAM707 host target RNA, herein designated VGAM HOST TARGET RNA. This complementary binding is due to the fact that the nucleotide sequence of VGAM707 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM707 RNA, herein designated VGAM RNA, may have a different number of host target binding sites in untranslated regions of a VGAM707 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM707 RNA, herein designated VGAM RNA, to host target binding sites on VGAM707 host target RNA, herein designated VGAM HOST TARGET RNA, such as BINDING SITE I, BINDING SITE II and BINDING SITE III, inhibits translation of VGAM707 host target RNA into VGAM707 host target protein, herein designated VGAM HOST TARGET PROTEIN. VGAM host target protein is therefore outlined by a broken line.

It is appreciated that VGAM707 host target gene, herein designated VGAM HOST TARGET GENE, in fact represents a plurality of VGAM707 host target genes. The mRNA of each one of this plurality of VGAM707 host target genes comprises one or more host target binding sites, each having a nucleotide sequence which is at least partly complementary to VGAM707 RNA, herein designated VGAM RNA, and which when bound by VGAM707 RNA causes inhibition of translation of respective one or more VGAM707 host target proteins.

It is further appreciated by one skilled in the art that the mode of translational inhibition illustrated by FIG. 1 with specific reference to translational inhibition exerted by VGAM707 gene, herein designated VGAM GENE, on one or more VGAM707 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM707 is inhibition of expression of host target genes, as part of a novel viral mechanism of attacking a host. Accordingly, utilities of VGAM707 include diagnosis, prevention and treatment of viral infection by Invertebrate Iridescent Virus 6. Specific functions, and accordingly utilities, of VGAM707 correlate with, and may be deduced from, the identity of the host target genes which VGAM707 binds and inhibits, and the function of these host target genes, as elaborated hereinbelow.

Nucleotide sequences of the VGAM707 precursor RNA, herein designated VGAM PRECURSOR RNA, and of the 'diced' VGAM707 RNA, herein designated VGAM RNA, and a schematic representation of the secondary folding of VGAM707 folded precursor RNA, herein designated VGAM FOLDED PRECURSOR RNA, of VGAM707 are further described hereinbelow with reference to Table 1.

Nucleotide sequences of host target binding sites, such as BINDING SITE-I, BINDING SITE-II and BINDING SITE-III of FIG. 1, found on VGAM707 host target RNA, and schematic representation of the complementarity of each of these host target binding sites to VGAM707 RNA, herein designated VGAM RNA, are described hereinbelow with reference to Table 2.

As mentioned hereinabove with reference to FIG. 1, a function of VGAM707 gene, herein designated VGAM is inhibition of expression of VGAM707 target genes. It is appreciated that specific functions, and accordingly utilities, of VGAM707 correlate with, and may be deduced from, the identity of the target genes which VGAM707 binds and inhibits, and the function of these target genes, as elaborated hereinbelow.

Eyes Absent Homolog 4 (Drosophila) (EYA4, Accession NM_004100) is a VGAM707 host target gene. EYA4 BINDING SITE is HOST TARGET binding site found in the 3' untranslated region of mRNA encoded by EYA4, corresponding to a HOST TARGET binding site such as BINDING SITE I, BINDING SITE II or BINDING SITE III. Table 2 illustrates the complementarity of the nucleotide sequences of EYA4 BINDING SITE, designated SEQ ID:10308, to the nucleotide sequence of VGAM707 RNA, herein designated VGAM RNA, also designated SEQ ID:3418.

A function of VGAM707 is therefore inhibition of Eyes Absent Homolog 4 (Drosophila) (EYA4, Accession NM_004100), a gene which may be involved in development of the eye (by similarity). Accordingly, utilities of VGAM707 include diagnosis, prevention and treatment of diseases and clinical conditions associated with EYA4. The function of EYA4 has been established by previous studies. Borsani et al. (1999) presented the detailed characterization of a fourth vertebrate gene, designated EYA4, that is homologous to 'eyes absent' (eya), a key regulator of ocular development in Drosophila. See also EYA1 (OMIM Ref. No. 601653), EYA2 (OMIM Ref. No. 601654), and EYA3 (OMIM Ref. No. 601655). The authors found that EYA4 encodes a 640-amino acid protein containing a highly conserved C-terminal domain of 271 amino acids. In Drosophila, eya is known to mediate developmentally important protein-protein interactions. By radiation hybrid analysis and fluorescence in situ hybridization, Borsani et al. (1999) mapped the human EYA4 gene to 6q23. They also detected linkage, with a lod score of greater than 3, to previously mapped reference markers. They genetically mapped the mouse Eya4 gene to chromosome 10 in the vicinity of Aco2 (OMIM Ref. No. 100850), in a region homologous to human chromosome 6q22-q23. In the developing mouse embryo, Eya4 was expressed primarily in the craniofacial mesenchyme, the dermamyotome, and the limb. On the basis of map position and expression pattern, EYA4 was considered a candidate for oculodentodigital dysplasia (OMIM Ref. No. 164200), but Borsani et al. (1999) found no EYA4 mutations in a panel of patients with this disorder. Wayne et al. (2001) identified mutations in the EYA4 gene that were responsible for postlingual, progressive, autosomal dominant hearing loss at the DFNA10 locus (OMIM Ref. No. 601316). Just as EYA proteins interact with members of the SIX (OMIM Ref. No. 601205) and DACH (OMIM Ref. No. 603803) protein families during early embryonic development, the authors suggested that EYA4 is also important postdevelopmentally for continued function of the mature organ of Corti.

Full details of the abovementioned studies are described in the following publications, the disclosure of which are hereby incorporated by reference:

Borsani, G.; DeGrandi, A.; Ballabio, A.; Bulfone, A.; Bernard, L.; Banfi, S.; Gattuso, C.; Mariani, M.; Dixon, M.; Donnai, D.; Metcalfe, K.; Winter, R.; Robertson, M.; Axton, R.; Brown, A.; van Heyningen, V.; Hanson, I.: EYA4, a novel vertebrate gene related to Drosophila eyes absent. Hum. Molec. Genet. 8:11-23, 1999; and Wayne, S.; Robertson, N. G.; DeClau, F.; Chen, N.; Verhoeven, K.; Prasad, S.; Tranebjarg, L.; Morton, C. C.; Ryan, A. F.; Van Camp, G.; Smith, R. J. H.: Mutations in the transcriptiona.

Further studies establishing the function and utilities of EYA4 are found in John Hopkins OMIM database record ID 603550, and in sited publications numbered 494 and 9384 listed in the bibliography section hereinbelow, which are also hereby incorporated by reference. C20orf180 (Accession NM_018431) is another VGAM707 host target gene. C20orf180 BINDING SITE is HOST TARGET binding site found in the 3' untranslated region of mRNA encoded by C20orf180, corresponding to a HOST TARGET binding site such as BINDING SITE I, BINDING SITE II or BINDING SITE III. Table 2 illustrates the complementarity of the nucleotide sequences of C20orf180 BINDING SITE, designated SEQ ID:20496, to the nucleotide sequence of VGAM707 RNA, herein designated VGAM RNA, also designated SEQ ID:3418.

Another function of VGAM707 is therefore inhibition of C20orf180 (Accession NM_018431). Accordingly, utilities of VGAM707 include diagnosis, prevention and treatment of diseases and clinical conditions associated with C20orf180. LOC145474 (Accession XM_085147) is another VGAM707 host target gene. LOC145474 BINDING SITE is HOST TARGET binding site found in the 3' untranslated region of mRNA encoded by LOC145474, corresponding to a HOST TARGET binding site such as BINDING SITE I, BINDING SITE II or BINDING SITE III. Table 2 illustrates the complementarity of the nucleotide sequences of LOC145474 BINDING SITE, designated SEQ ID:37870, to the nucleotide sequence of VGAM707 RNA, herein designated VGAM RNA, also designated SEQ ID:3418.

Another function of VGAM707 is therefore inhibition of LOC145474 (Accession XM_085147). Accordingly, utilities of VGAM707 include diagnosis, prevention and treatment of diseases and clinical conditions associated with LOC145474. LOC146229 (Accession XM_085387) is another VGAM707 host target gene. LOC146229 BINDING SITE is HOST TARGET binding site found in the 3' untranslated region of mRNA encoded by LOC146229, corresponding to a HOST TARGET binding site such as BINDING SITE I, BINDING SITE II or BINDING SITE III. Table 2 illustrates the complementarity of the nucleotide sequences of LOC146229 BINDING SITE, designated SEQ ID:38112, to the nucleotide sequence of VGAM707 RNA, herein designated VGAM RNA, also designated SEQ ID:3418.

Another function of VGAM707 is therefore inhibition of LOC146229 (Accession XM_085387). Accordingly, utilities of VGAM707 include diagnosis, prevention and treatment of diseases and clinical conditions associated with LOC146229. LOC158382 (Accession XM_098931) is another VGAM707 host target gene. LOC158382 BINDING SITE is HOST TARGET binding site found in the 5' untranslated region of mRNA encoded by LOC158382, corresponding to a HOST TARGET binding site such as BINDING SITE I, BINDING SITE II or BINDING SITE III. Table 2 illustrates the complementarity of the nucleotide sequences of LOC158382 BINDING SITE, designated SEQ ID:41967, to the nucleotide sequence of VGAM707 RNA, herein designated VGAM RNA, also designated SEQ ID:3418.

Another function of VGAM707 is therefore inhibition of LOC158382 (Accession XM_098931). Accordingly, utilities of VGAM707 include diagnosis, prevention and treatment of diseases and clinical conditions associated with LOC158382. LOC163255 (Accession XM_092121) is another VGAM707 host target gene. LOC163255 BINDING SITE is HOST TARGET binding site found in the 5' untranslated region of mRNA encoded by LOC163255, corresponding to a HOST TARGET binding site such as BINDING SITE I, BINDING SITE II or BINDING SITE III. Table 2 illustrates the complementarity of the nucleotide sequences of LOC163255 BINDING SITE, designated SEQ ID:40108, to the nucleotide sequence of VGAM707 RNA, herein designated VGAM RNA, also designated SEQ ID:3418.

Another function of VGAM707 is therefore inhibition of LOC163255 (Accession XM_092121). Accordingly, utilities of VGAM707 include diagnosis, prevention and treatment of diseases and clinical conditions associated with LOC163255. LOC200420 (Accession NM_145300) is another VGAM707 host target gene. LOC200420 BINDING SITE is HOST TARGET binding site found in the 5' untranslated region of mRNA encoded by LOC200420, corresponding to a HOST TARGET binding site such as BINDING SITE I, BINDING SITE II or BINDING SITE III. Table 2 illustrates the complementarity of the nucleotide sequences of LOC200420 BINDING SITE, designated SEQ ID:29813, to the nucleotide sequence of VGAM707 RNA, herein designated VGAM RNA, also designated SEQ ID:3418.

Another function of VGAM707 is therefore inhibition of LOC200420 (Accession NM_145300). Accordingly, utilities of VGAM707 include diagnosis, prevention and treatment of diseases and clinical conditions associated with LOC200420.

FIG. 1 further provides a conceptual description of a novel bioinformatically detected viral gene of the present invention, referred to here as Viral Genomic Address Messenger 708 (VGAM708) viral gene, which modulates expression of respective host target genes thereof, the function and utility of which host target genes is known in the art.

VGAM708 is a novel bioinformatically detected regulatory, non protein coding, viral micro RNA (miRNA) gene. The method by which VGAM708 was detected is described hereinabove with reference to FIGS. 1-8.

VGAM708 gene, herein designated VGAM GENE, is a viral gene contained in the genome of Potato Virus V. VGAM708 host target gene, herein designated VGAM HOST TARGET GENE, is a human gene contained in the human genome.

VGAM708 gene encodes a VGAM708 precursor RNA, herein designated VGAM PRECURSOR RNA. Similar to other miRNA genes, and unlike most ordinary genes, VGAM708 precursor RNA does not encode a protein. A nucleotide sequence identical or highly similar to the nucleotide sequence of VGAM708 precursor RNA is designated SEQ ID:694, and is provided hereinbelow with reference to the sequence listing part. Nucleotide sequence SEQ ID:694 is located at position 9696 relative to the genome of Potato Virus V.

VGAM708 precursor RNA folds onto itself, forming VGAM708 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM708 folded precursor RNA into VGAM708 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM708 RNA is designated SEQ ID:3419, and is provided hereinbelow with reference to the sequence listing part.

VGAM708 host target gene, herein designated VGAM HOST TARGET GENE, encodes a corresponding messenger RNA, VGAM708 host target RNA, herein designated VGAM HOST TARGET RNA. VGAM708 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM708 RNA, herein designated VGAM RNA, binds complementarily to one or more host target binding sites located in untranslated regions of VGAM708 host target RNA, herein designated VGAM HOST TARGET RNA. This complementary binding is due to the fact that the nucleotide sequence of VGAM708 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM708 RNA, herein designated VGAM RNA, may have a different number of host target binding sites in untranslated regions of a VGAM708 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM708 RNA, herein designated VGAM RNA, to host target binding sites on VGAM708 host target RNA, herein designated VGAM HOST TARGET RNA, such as BINDING SITE I, BINDING SITE II and BINDING SITE III, inhibits translation of VGAM708 host target RNA into VGAM708 host target protein, herein designated VGAM HOST TARGET PROTEIN. VGAM host target protein is therefore outlined by a broken line.

It is appreciated that VGAM708 host target gene, herein designated VGAM HOST TARGET GENE, in fact represents a plurality of VGAM708 host target genes. The mRNA of each one of this plurality of VGAM708 host target genes comprises one or more host target binding sites, each having a nucleotide sequence which is at least partly complementary to VGAM708 RNA, herein designated VGAM RNA, and which when bound by VGAM708 RNA causes inhibition of translation of respective one or more VGAM708 host target proteins.

It is further appreciated by one skilled in the art that the mode of translational inhibition illustrated by FIG. 1 with specific reference to translational inhibition exerted by VGAM708 gene, herein designated VGAM GENE, on one or more VGAM708 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM708 is inhibition of expression of host target genes, as part of a novel viral mechanism of attacking a host. Accordingly, utilities of VGAM708 include diagnosis, prevention and treatment of viral infection by Potato Virus V. Specific functions, and accordingly utilities, of VGAM708 correlate with, and may be deduced from, the identity of the host target genes which VGAM708 binds and inhibits, and the function of these host target genes, as elaborated hereinbelow.

Nucleotide sequences of the VGAM708 precursor RNA, herein designated VGAM PRECURSOR RNA, and of the 'diced' VGAM708 RNA, herein designated VGAM RNA, and a schematic representation of the secondary folding of VGAM708 folded precursor RNA, herein designated VGAM FOLDED PRECURSOR RNA, of VGAM708 are further described hereinbelow with reference to Table 1.

Nucleotide sequences of host target binding sites, such as BINDING SITE-I, BINDING SITE-II and BINDING SITE-III of FIG. 1, found on VGAM708 host target RNA, and schematic representation of the complementarity of each of these host target binding sites to VGAM708 RNA, herein designated VGAM RNA, are described hereinbelow with reference to Table 2.

As mentioned hereinabove with reference to FIG. 1, a function of VGAM708 gene, herein designated VGAM is inhibition of expression of VGAM708 target genes. It is appreciated that specific functions, and accordingly utilities, of VGAM708 correlate with, and may be deduced from, the identity of the target genes which VGAM708 binds and inhibits, and the function of these target genes, as elaborated hereinbelow.

ATPase, Cu++ Transporting, Beta Polypeptide (Wilson disease) (ATP7B, Accession NM_000053) is a VGAM708 host target gene. ATP7B BINDING SITE is HOST TARGET binding site found in the 3' untranslated region of mRNA encoded by ATP7B, corresponding to a HOST TARGET binding site such as BINDING SITE I, BINDING SITE II or BINDING SITE III. Table 2 illustrates the complementarity of the nucleotide sequences of ATP7B BINDING SITE, designated SEQ ID:5509, to the nucleotide sequence of VGAM708 RNA, herein designated VGAM RNA, also designated SEQ ID:3419.

A function of VGAM708 is therefore inhibition of ATPase, Cu++ Transporting, Beta Polypeptide (Wilson disease) (ATP7B, Accession NM_000053). Accordingly, utilities of VGAM708 include diagnosis, prevention and treatment of diseases and clinical conditions associated with ATP7B. Egl Nine Homolog 2 (C. elegans) (EGLN2, Accession NM_017555) is another VGAM708 host target gene. EGLN2 BINDING SITE is HOST TARGET binding site found in the 3' untranslated region of mRNA encoded by EGLN2, corresponding to a HOST TARGET binding site such as BINDING SITE I, BINDING SITE II or BINDING SITE III. Table 2 illustrates the complementarity of the nucleotide sequences of EGLN2 BINDING SITE, designated SEQ ID:18990, to the nucleotide sequence of VGAM708 RNA, herein designated VGAM RNA, also designated SEQ ID:3419.

Another function of VGAM708 is therefore inhibition of Egl Nine Homolog 2 (C. elegans) (EGLN2, Accession NM_017555), a gene which is an essential component of the pathway. Accordingly, utilities of VGAM708 include diagnosis, prevention and treatment of diseases and clinical conditions associated with EGLN2. The function of EGLN2 and its association with various diseases and clinical conditions, has been established by previous studies, as described hereinabove with reference to VGAM432. NADH Dehydrogenase (ubiquinone) 1 Alpha Subcomplex, 5, 13 kDa (NDUFA5, Accession NM_005000) is another VGAM708 host target gene. NDUFA5 BINDING SITE is HOST TARGET binding site found in the 3' untranslated region of mRNA encoded by NDUFA5, corresponding to a HOST TARGET binding site such as BINDING SITE I, BINDING SITE II or BINDING SITE III. Table 2 illustrates the complementarity of the nucleotide sequences of NDUFA5 BINDING SITE, designated SEQ ID:11443, to the nucleotide sequence of VGAM708 RNA, herein designated VGAM RNA, also designated SEQ ID:3419.

Another function of VGAM708 is therefore inhibition of NADH Dehydrogenase (ubiquinone) 1 Alpha Subcomplex, 5, 13 kDa (NDUFA5, Accession NM_005000), a gene which transfers electrons from nadh to the respiratory chain. Accordingly, utilities of VGAM708 include diagnosis, prevention and treatment of diseases and clinical conditions associated with NDUFA5. The function of NDUFA5 has been established by previous studies. The multisubunit NADH: ubiquinone oxidoreductase (complex I) is the first enzyme complex in the electron transport chain of mitochondria. The iron-sulfur protein (IP) fraction of complex I is made up of 7 subunits, including B13. See NDUFS1 (OMIM Ref. No. 157655). By a combination of EST database screening and PCR, Pata et al. (1997) isolated cDNAs encoding the human homolog of bovine B13. The deduced 116-amino acid human protein has a calculated molecular weight of approximately 13 kD. Human and bovine B13 are 87% identical on the amino acid level. Northern blot analysis revealed that the 1.6-kb B13 mRNA was expressed in all human tissues tested, with the highest levels in heart, skeletal muscle, and brain. Two additional smaller transcripts were also detected. Using Southern blots, Pata et al. (1997) determined that B13 is part of a multigene family in human S. During the course of a physical mapping project on 11p15.5, Russell et al. (1997) identified sequence with a high degree of similarity to the bovine NADH:ubiquinone oxidoreductase subunit B13. Following up on this lead, they isolated a clone with nucleotide sequence 88% and 83% identical over the predicted open reading frame with bovine and rat B13 subunit genes, respectively. The position of the initiation and termination codons was conserved. To determine the chromosomal localization of the B13 subunit gene, they screened a monochromosome somatic cell hybrid panel and showed that only the hybrid containing human chromosome 7 was positive.

Full details of the abovementioned studies are described in the following publications, the disclosure of which are hereby incorporated by reference:

Pata, I.; Tensing, K.; Metspalu, A.: A human cDNA encoding the homologue of NADH:ubiquinone oxidoreductase subunit B13. Biochim. Biophys. Acta 1350: 115-118, 1997; and Russell, M. W.; du Manoir, S.; Collins, F. S.; Brody, L. C.: Cloning of the human NADH:ubiquinone oxidoreductase subunit B13: localization to chromosome 7q32 and identification of a ps.

Further studies establishing the function and utilities of NDUFA5 are found in John Hopkins OMIM database record ID 601677, and in sited publications numbered 6195-6196 listed in the bibliography section hereinbelow, which are also hereby incorporated by reference. Syntaxin Binding Protein 1 (STXBP1, Accession NM_003165) is another VGAM708 host target gene. STXBP1 BINDING SITE is HOST TARGET binding site found in the 3' untranslated region of mRNA encoded by STXBP1, corresponding to a HOST TARGET binding site such as BINDING SITE I, BINDING SITE II or BINDING SITE III. Table 2 illustrates the complementarity of the nucleotide sequences of STXBP1 BINDING SITE, designated SEQ ID:9142, to the nucleotide sequence of VGAM708 RNA, herein designated VGAM RNA, also designated SEQ ID:3419.

Another function of VGAM708 is therefore inhibition of Syntaxin Binding Protein 1 (STXBP1, Accession NM_003165), a gene which may play a role in determining the specificity of intracellular fusion reactions. Accordingly, utilities of VGAM708 include diagnosis, prevention and treatment of diseases and clinical conditions associated with STXBP1. The function of STXBP1 has been established by previous studies. Within the secretory pathway, proteins and other cargo are transferred from one compartment to another by vesicular traffic. Transport vesicles bud from donor membranes and dock to specific acceptor compartments. The S. cerevisiae protein Sec1p participates in the constitutive secretory pathway between the Golgi apparatus and the plasma membrane. Pevsner et al. (1994) identified n-Sec1, a rat brain protein homologous to Sec1p. They found that n-Sec1 is a neural-specific, syntaxin (see OMIM Ref. No. 186590)-binding protein that may participate in the regulation of synaptic vesicle docking and fusion. Animal model experiments lend further support to the function of STXBP1. Verhage et al. (2000) abolished Munc18-1 in mice by homologous recombination. This resulted in a completely paralyzed organism. Null mutant embryos were alive until birth but died immediately after birth, probably because they could not breathe. Despite the general, complete, and permanent loss of synaptic transmission in knockout mice, their brains were assembled correctly. Neuronal proliferation, migration, and differentiation into specific brain areas were unaffected. By embryonic day 12, brains from null mutant and control littermates were morphologically indistinguishable. At birth, late-forming brain areas such as the neocortex appeared identical in null mutant and control littermates. After initial brain assembly, extensive cell death of mature neurons was observed in null mutants, occurring first in lower brain areas that mature and form synapses relatively early. The degeneration in the mutant brains exhibited all characteristics of apoptosis. Ablation of Munc18-1 renders the brain synaptically silent, identifying Munc18-1 as the currently most upstream essential protein in neurotransmitter release. Verhage et al. (2000) concluded that synaptic connectivity does not depend on neurotransmitter secretion, but its maintenance does. Neurotransmitter secretion probably functions to validate already established synaptic connections.

It is appreciated that the abovementioned animal model for STXBP1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pevsner, J.; Hsu, S.-C.; Scheller, R. H.: n-Sec1: a neural-specific syntaxin-binding protein. Proc. Nat. Acad. Sci. 91:1445-1449, 1994; and Verhage, M.; Mala, A. S.; Plomp, J. J.; Brussaard, A. B.; Heeroma, J. H.; Vermeer, H.; Toonen, R. F.; Hammer, R. E.; van den Berg, T. K.; Missler, M.; Geuze, H. J.; Sudhof, T. C.: Synap.

Further studies establishing the function and utilities of STXBP1 are found in John Hopkins OMIM database record ID 602926, and in sited publications numbered 176 and 7747-7750 listed in the bibliography section hereinbelow, which are also hereby incorporated by reference. DKFZp434M0331 (Accession NM_017600) is another VGAM708 host target gene. DKFZp434M0331 BINDING SITE is HOST TARGET binding site found in the 5' untranslated region of mRNA encoded by DKFZp434M0331, corresponding to a HOST TARGET binding site such as BINDING SITE I, BINDING SITE II or BINDING SITE III. Table 2 illustrates the complementarity of the nucleotide sequences of DKFZp434M0331 BINDING SITE, designated SEQ ID:19075, to the nucleotide sequence of VGAM708 RNA, herein designated VGAM RNA, also designated SEQ ID:3419.

Another function of VGAM708 is therefore inhibition of DKFZp434M0331 (Accession NM_017600). Accordingly, utilities of VGAM708 include diagnosis, prevention and treatment of diseases and clinical conditions associated with DKFZp434M0331. DKFZP547E2110 (Accession XM_165676) is another VGAM708 host target gene. DKFZP547E2110 BINDING SITE is HOST TARGET binding site found in the 3' untranslated region of mRNA encoded by DKFZP547E2110, corresponding to a HOST TARGET binding site such as BINDING SITE I, BINDING SITE II or BINDING SITE III. Table 2 illustrates the complementarity of the nucleotide sequences of DKFZP547E2110 BINDING SITE, designated SEQ ID:43733, to the nucleotide sequence of VGAM708 RNA, herein designated VGAM RNA, also designated SEQ ID:3419.

Another function of VGAM708 is therefore inhibition of DKFZP547E2110 (Accession XM_165676). Accordingly, utilities of VGAM708 include diagnosis, prevention and treatment of diseases and clinical conditions associated with DKFZP547E2110. DRIL2 (Accession NM_006465) is another VGAM708 host target gene. DRIL2 BINDING SITE is HOST TARGET binding site found in the 3' untranslated region of mRNA encoded by DRIL2, corresponding to a HOST TARGET binding site such as BINDING SITE I, BINDING SITE II or BINDING SITE III. Table 2 illustrates the complementarity of the nucleotide sequences of DRIL2 BINDING SITE, designated SEQ ID:13193, to the nucleotide sequence of VGAM708 RNA, herein designated VGAM RNA, also designated SEQ ID:3419.

Another function of VGAM708 is therefore inhibition of DRIL2 (Accession NM_006465). Accordingly, utilities of VGAM708 include diagnosis, prevention and treatment of diseases and clinical conditions associated with DRIL2. FLJ12671 (Accession NM_030980) is another VGAM708 host target gene. FLJ12671 BINDING SITE is HOST TARGET binding site found in the 5' untranslated region of mRNA encoded by FLJ12671, corresponding to a HOST TARGET binding site such as BINDING SITE I, BINDING SITE II or BINDING SITE III. Table 2 illustrates the complementarity of the nucleotide sequences of FLJ12671 BINDING SITE, designated SEQ ID:25243, to the nucleotide sequence of VGAM708 RNA, herein designated VGAM RNA, also designated SEQ ID:3419.

Another function of VGAM708 is therefore inhibition of FLJ12671 (Accession NM_030980). Accordingly, utilities of VGAM708 include diagnosis, prevention and treatment of diseases and clinical conditions associated with FLJ12671. FLJ12891 (Accession NM_024950) is another VGAM708 host target gene. FLJ12891 BINDING SITE is HOST TARGET binding site found in the 3' untranslated region of mRNA encoded by FLJ12891, corresponding to a HOST TARGET binding site such as BINDING SITE I, BINDING SITE II or BINDING SITE III. Table 2 illustrates the complementarity of the nucleotide sequences of FLJ12891 BINDING SITE, designated SEQ ID:24511, to the nucleotide sequence of VGAM708 RNA, herein designated VGAM RNA, also designated SEQ ID:3419.

Another function of VGAM708 is therefore inhibition of FLJ12891 (Accession NM_024950). Accordingly, utilities of VGAM708 include diagnosis, prevention and treatment of diseases and clinical conditions associated with FLJ12891. H2A Histone Family, Member J (H2AFJ, Accession NM_018267) is another VGAM708 host target gene. H2AFJ BINDING SITE is HOST TARGET binding site found in the 3' untranslated region of mRNA encoded by H2AFJ, corresponding to a HOST TARGET binding site such as BINDING SITE I, BINDING SITE II or BINDING SITE III. Table 2 illustrates the complementarity of the nucleotide sequences of H2AFJ BINDING SITE, designated SEQ ID:20238, to the nucleotide sequence of VGAM708 RNA, herein designated VGAM RNA, also designated SEQ ID:3419.

Another function of VGAM708 is therefore inhibition of H2A Histone Family, Member J (H2AFJ, Accession NM_018267). Accordingly, utilities of VGAM708 include diagnosis, prevention and treatment of diseases and clinical conditions associated with H2AFJ. KIAA0261 (Accession XM_042946) is another VGAM708 host target gene. KIAA0261 BINDING SITE is HOST TARGET binding site found in the 3' untranslated region of mRNA encoded by KIAA0261, corresponding to a HOST TARGET binding site such as BINDING SITE I, BINDING SITE II or BINDING SITE III. Table 2 illustrates the complementarity of the nucleotide sequences of KIAA0261 BINDING SITE, designated SEQ ID:33836, to the nucleotide sequence of VGAM708 RNA, herein designated VGAM RNA, also designated SEQ ID:3419.

Another function of VGAM708 is therefore inhibition of KIAA0261 (Accession XM_042946). Accordingly, utilities of VGAM708 include diagnosis, prevention and treatment of diseases and clinical conditions associated with KIAA0261. KIAA1045 (Accession XM_048592) is another VGAM708 host target gene. KIAA1045 BINDING SITE is HOST TARGET binding site found in the 3' untranslated region of mRNA encoded by KIAA1045, corresponding to a HOST TARGET binding site such as BINDING SITE I, BINDING SITE II or BINDING SITE III. Table 2 illustrates the complementarity of the nucleotide sequences of KIAA1045 BINDING SITE, designated SEQ ID:35202, to the nucleotide sequence of VGAM708 RNA, herein designated VGAM RNA, also designated SEQ ID:3419.

Another function of VGAM708 is therefore inhibition of KIAA1045 (Accession XM_048592). Accordingly, utilities of VGAM708 include diagnosis, prevention and treatment of diseases and clinical conditions associated with KIAA1045. KIAA1432 (Accession XM_039698) is another VGAM708 host target gene. KIAA1432 BINDING SITE is HOST TARGET binding site found in the 5' untranslated region of mRNA encoded by KIAA1432, corresponding to a HOST TARGET binding site such as BINDING SITE I, BINDING SITE II or BINDING SITE III. Table 2 illustrates the complementarity of the nucleotide sequences of KIAA1432 BINDING SITE, designated SEQ ID:33154, to the nucleotide sequence of VGAM708 RNA, herein designated VGAM RNA, also designated SEQ ID:3419.

Another function of VGAM708 is therefore inhibition of KIAA1432 (Accession XM_039698). Accordingly, utilities of VGAM708 include diagnosis, prevention and treatment of diseases and clinical conditions associated with KIAA1432. MGC11034 (Accession NM_031453) is another VGAM708 host target gene. MGC11034 BINDING SITE is HOST TARGET binding site found in the 3' untranslated region of mRNA encoded by MGC11034, corresponding to a HOST TARGET binding site such as BINDING SITE I, BINDING SITE II or BINDING SITE III. Table 2 illustrates the complementarity of the nucleotide sequences of MGC11034 BINDING SITE, designated SEQ ID:25473, to the nucleotide sequence of VGAM708 RNA, herein designated VGAM RNA, also designated SEQ ID:3419.

Another function of VGAM708 is therefore inhibition of MGC11034 (Accession NM_031453). Accordingly, utilities of VGAM708 include diagnosis, prevention and treatment of diseases and clinical conditions associated with MGC11034. RA-GEF-2 (Accession NM_016340) is another VGAM708 host target gene. RA-GEF-2 BINDING SITE is HOST TARGET binding site found in the 3' untranslated region of mRNA encoded by RA-GEF-2, corresponding to a HOST TARGET binding site such as BINDING SITE I, BINDING SITE II or BINDING SITE III. Table 2 illustrates the complementarity of the nucleotide sequences of RA-GEF-2 BINDING SITE, designated SEQ ID:18466, to the nucleotide sequence of VGAM708 RNA, herein designated VGAM RNA, also designated SEQ ID:3419.

Another function of VGAM708 is therefore inhibition of RA-GEF-2 (Accession NM_016340). Accordingly, utilities of VGAM708 include diagnosis, prevention and treatment of diseases and clinical conditions associated with RA-GEF-2. LOC145844 (Accession XM_085255) is another VGAM708 host target gene. LOC145844 BINDING SITE is HOST TARGET binding site found in the 3' untranslated region of mRNA encoded by LOC145844, corresponding to a HOST TARGET binding site such as BINDING SITE I, BINDING SITE II or BINDING SITE III. Table 2 illustrates the complementarity of the nucleotide sequences of LOC145844 BINDING SITE, designated SEQ ID:38000, to the nucleotide sequence of VGAM708 RNA, herein designated VGAM RNA, also designated SEQ ID:3419.

Another function of VGAM708 is therefore inhibition of LOC145844 (Accession XM_085255). Accordingly, utilities of VGAM708 include diagnosis, prevention and treatment of diseases and clinical conditions associated with LOC145844.

LOC147180 (Accession XM_097207) is another VGAM708 host target gene. LOC147180 BINDING SITE is HOST TARGET binding site found in the 5' untranslated region of mRNA encoded by LOC147180, corresponding to a HOST TARGET binding site such as BINDING SITE I, BINDING SITE II or BINDING SITE III. Table 2 illustrates the complementarity of the nucleotide sequences of LOC147180 BINDING SITE, designated SEQ ID:40819, to the nucleotide sequence of VGAM708 RNA, herein designated VGAM RNA, also designated SEQ ID:3419.

Another function of VGAM708 is therefore inhibition of LOC147180 (Accession XM_097207). Accordingly, utilities of VGAM708 include diagnosis, prevention and treatment of diseases and clinical conditions associated with LOC147180.

LOC150933 (Accession XM_097971) is another VGAM708 host target gene. LOC150933 BINDING SITE is HOST TARGET binding site found in the 3' untranslated region of mRNA encoded by LOC150933, corresponding to a HOST TARGET binding site such as BINDING SITE I, BINDING SITE II or BINDING SITE III. Table 2 illustrates the complementarity of the nucleotide sequences of LOC150933 BINDING SITE, designated SEQ ID:41274, to the nucleotide sequence of VGAM708 RNA, herein designated VGAM RNA, also designated SEQ ID:3419.

Another function of VGAM708 is therefore inhibition of LOC150933 (Accession XM_097971). Accordingly, utilities of VGAM708 include diagnosis, prevention and treatment of diseases and clinical conditions associated with LOC150933.

LOC157450 (Accession XM_048209) is another VGAM708 host target gene. LOC157450 BINDING SITE is HOST TARGET binding site found in the 3' untranslated region of mRNA encoded by LOC157450, corresponding to a HOST TARGET binding site such as BINDING SITE I, BINDING SITE II or BINDING SITE III. Table 2 illustrates the complementarity of the nucleotide sequences of LOC157450 BINDING SITE, designated SEQ ID:35149, to the nucleotide sequence of VGAM708 RNA, herein designated VGAM RNA, also designated SEQ ID:3419.

Another function of VGAM708 is therefore inhibition of LOC157450 (Accession XM_048209). Accordingly, utilities of VGAM708 include diagnosis, prevention and treatment of diseases and clinical conditions associated with LOC157450.

LOC221486 (Accession XM_165760) is another VGAM708 host target gene. LOC221486 BINDING SITE is HOST TARGET binding site found in the 3' untranslated region of mRNA encoded by LOC221486, corresponding to a HOST TARGET binding site such as BINDING SITE I, BINDING SITE II or BINDING SITE III. Table 2 illustrates the complementarity of the nucleotide sequences of LOC221486 BINDING SITE, designated SEQ ID:43747, to the nucleotide sequence of VGAM708 RNA, herein designated VGAM RNA, also designated SEQ ID:3419.

Another function of VGAM708 is therefore inhibition of LOC221486 (Accession XM_165760). Accordingly, utilities of VGAM708 include diagnosis, prevention and treatment of diseases and clinical conditions associated with LOC221486.

FIG. 1 further provides a conceptual description of a novel bioinformatically detected viral gene of the present invention, referred to here as Viral Genomic Address Messenger 709 (VGAM709) viral gene, which modulates expression of respective host target genes thereof, the function and utility of which host target genes is known in the art.

VGAM709 is a novel bioinformatically detected regulatory, non protein coding, viral micro RNA (miRNA) gene. The method by which VGAM709 was detected is described hereinabove with reference to FIGS. 1-8.

VGAM709 gene, herein designated VGAM GENE, is a viral gene contained in the genome of Helicoverpa Armigera Nuclear Polyhedrosis Virus. VGAM709 host target gene, herein designated VGAM HOST TARGET GENE, is a human gene contained in the human genome.

VGAM709 gene encodes a VGAM709 precursor RNA, herein designated VGAM PRECURSOR RNA. Similar to other miRNA genes, and unlike most ordinary genes, VGAM709 precursor RNA does not encode a protein. A nucleotide sequence identical or highly similar to the nucleotide sequence of VGAM709 precursor RNA is designated SEQ ID:695, and is provided hereinbelow with reference to the sequence listing part. Nucleotide sequence SEQ ID:695 is located at position 70255 relative to the genome of Helicoverpa Armigera Nuclear Polyhedrosis Virus.

VGAM709 precursor RNA folds onto itself, forming VGAM709 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM709 folded precursor RNA into VGAM709 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM709 RNA is designated SEQ ID:3420, and is provided hereinbelow with reference to the sequence listing part.

VGAM709 host target gene, herein designated VGAM HOST TARGET GENE, encodes a corresponding messenger RNA, VGAM709 host target RNA, herein designated VGAM HOST TARGET RNA. VGAM709 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM709 RNA, herein designated VGAM RNA, binds complementarily to one or more host target binding sites located in untranslated regions of VGAM709 host target RNA, herein designated VGAM HOST TARGET RNA. This complementary binding is due to the fact that the nucleotide sequence of VGAM709 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM709 RNA, herein designated VGAM RNA, may have a different number of host target binding sites in untranslated regions of a VGAM709 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM709 RNA, herein designated VGAM RNA, to host target binding sites on VGAM709 host target RNA, herein designated VGAM HOST TARGET RNA, such as BINDING SITE I, BINDING SITE II and BINDING SITE III, inhibits translation of VGAM709 host target RNA into VGAM709 host target protein, herein designated VGAM HOST TARGET PROTEIN. VGAM host target protein is therefore outlined by a broken line.

It is appreciated that VGAM709 host target gene, herein designated VGAM HOST TARGET GENE, in fact represents a plurality of VGAM709 host target genes. The mRNA of each one of this plurality of VGAM709 host target genes comprises one or more host target binding sites, each having a nucleotide sequence which is at least partly complementary to VGAM709 RNA, herein designated VGAM RNA, and which when bound by VGAM709 RNA causes inhibition of translation of respective one or more VGAM709 host target proteins.

It is further appreciated by one skilled in the art that the mode of translational inhibition illustrated by FIG. 1 with specific reference to translational inhibition exerted by VGAM709 gene, herein designated VGAM GENE, on one or more VGAM709 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM709 is inhibition of expression of host target genes, as part of a novel viral mechanism of attacking a host. Accordingly, utilities of VGAM709 include diagnosis, prevention and treatment of viral infection by Helicoverpa Armigera Nuclear Polyhedrosis Virus. Specific functions, and accordingly utilities, of VGAM709 correlate with, and may be deduced from, the identity of the host target genes which VGAM709 binds and inhibits, and the function of these host target genes, as elaborated hereinbelow.

Nucleotide sequences of the VGAM709 precursor RNA, herein designated VGAM PRECURSOR RNA, and of the 'diced' VGAM709 RNA, herein designated VGAM RNA, and a schematic representation of the secondary folding of VGAM709 folded precursor RNA, herein designated VGAM FOLDED PRECURSOR RNA, of VGAM709 are further described hereinbelow with reference to Table 1.

Nucleotide sequences of host target binding sites, such as BINDING SITE-I, BINDING SITE-II and BINDING SITE-III of FIG. 1, found on VGAM709 host target RNA, and schematic representation of the complementarity of each of these host target binding sites to VGAM709 RNA, herein designated VGAM RNA, are described hereinbelow with reference to Table 2.

As mentioned hereinabove with reference to FIG. 1, a function of VGAM709 gene, herein designated VGAM is inhibition of expression of VGAM709 target genes. It is appreciated that specific functions, and accordingly utilities, of VGAM709 correlate with, and may be deduced from, the identity of the target genes which VGAM709 binds and inhibits, and the function of these target genes, as elaborated hereinbelow.

RALBP1 Associated Eps Domain Containing 2 (REPS2, Accession NM_004726) is a VGAM709 host target gene. REPS2 BINDING SITE is HOST TARGET binding site found in the 5' untranslated region of mRNA encoded by REPS2, corresponding to a HOST TARGET binding site such as BINDING SITE I, BINDING SITE II or BINDING SITE III. Table 2 illustrates the complementarity of the nucleotide sequences of REPS2 BINDING SITE, designated SEQ ID:11097, to the nucleotide sequence of VGAM709 RNA, herein designated VGAM RNA, also designated SEQ ID:3420.

A function of VGAM709 is therefore inhibition of RALBP1 Associated Eps Domain Containing 2 (REPS2, Accession NM_004726), a gene which interacts with the active form of RAS with adaptor protein GRB2 and binds calcium. Accordingly, utilities of VGAM709 include diagnosis, prevention and treatment of diseases and clinical conditions associated with REPS2. The function of REPS2 has been established by previous studies. Small G proteins have GDP-bound inactive and GTP-bound active forms; RAL proteins (e.g., RALA; 179550) shift from the inactive to the active state through the actions of RALGDS (OMIM Ref. No. 601619). RALGDS interacts with the active form of RAS (see OMIM Ref. No. HRAS; 190020). Using RALA-binding protein-1 (RALBP1; 605801) as bait in a yeast 2-hybrid screen of a brain cDNA library, Ikeda et al. (1998) isolated cDNAs encoding REPS2, which they termed POB1. Sequence analysis predicted that the 521-amino acid protein has 2 potential initiator methionines in its N terminus, a central EPS15 (OMIM Ref. No. 600051)-like domain, and 2 proline-rich regions and a putative coiled-coil structure in its C terminus. Northern blot analysis revealed strong expression in rat cerebrum, cerebellum, lung, and testis, with weak expression in kidney and no expression in heart, thymus, liver, spleen, or adrenal gland. Immunoprecipitation and immunoblot analyses confirmed that the C-terminal 146 amino acids of REPS2 and the C-terminal 147 residues of RALBP1 interact in intact cells. RAL interacts with a distinct region of RALBP1, just N terminal of the REPS2-binding domain, and both proteins can interact simultaneously with RALBP1. Immunoblot analysis established that REPS2 is tyrosine phosphorylated in response to epidermal growth factor (EGF; 131530) and interacts with the EGF receptor (EGFR; 131550), possibly through the adaptor protein GRB2 (OMIM Ref. No. 108355), with which REPS2 interacts specifically. Using nuclear magnetic resonance spectroscopy, Koshiba et al. (1999) showed that the EPS15 homology domain of REPS2 consists of 2 EF-hand structures, the second of which binds calcium.

Full details of the abovementioned studies are described in the following publications, the disclosure of which are hereby incorporated by reference:

Ikeda, M.; Ishida, O.; Hinoi, T.; Kishida, S.; Kikuchi, A.: Identification and characterization of a novel protein interacting with Ral-binding protein 1, a putative effector protein of Ral. J. Biol. Chem. 273:814-821, 1998; and Koshiba, S.; Kigawa, T.; Iwahara, J.; Kikuchi, A.; Yokoyama, S.: Solution structure of the Eps15 homology domain of a human POB1 (partner of RalBP1). FEBS Lett. 442:138-142, 1999.

Further studies establishing the function and utilities of REPS2 are found in John Hopkins OMIM database record ID 300317, and in sited publications numbered 9445-9446 listed in the bibliography section hereinbelow, which are also hereby incorporated by reference. Transient Receptor Potential Cation Channel, Subfamily M, Member 8 (TRPM8, Accession NM_024080) is another VGAM709 host target gene. TRPM8 BINDING SITE is HOST TARGET binding site found in the 3' untranslated region of mRNA encoded by TRPM8, corresponding to a HOST TARGET binding site such as BINDING SITE I, BINDING SITE II or BINDING SITE III. Table 2 illustrates the complementarity of the nucleotide sequences of TRPM8 BINDING SITE, designated SEQ ID:23514, to the nucleotide sequence of VGAM709 RNA, herein designated VGAM RNA, also designated SEQ ID:3420.

Another function of VGAM709 is therefore inhibition of Transient Receptor Potential Cation Channel, Subfamily M, Member 8 (TRPM8, Accession NM_024080), a gene which is thought to form a receptor-activated calcium permeant cation channel. Accordingly, utilities of VGAM709 include diagnosis, prevention and treatment of diseases and clinical conditions associated with TRPM8. The function of TRPM8 and its association with various diseases and clinical conditions, has been established by previous studies, as described hereinabove with reference to VGAM201. LOC199923 (Accession XM_114057) is another VGAM709 host target gene. LOC199923 BINDING SITE is HOST TARGET binding site found in the 3' untranslated region of mRNA encoded by LOC199923, corresponding to a HOST TARGET binding site such as BINDING SITE I, BINDING SITE II or BINDING SITE III. Table 2 illustrates the complementarity of the nucleotide sequences of LOC199923 BINDING SITE, designated SEQ ID:42667, to the nucleotide sequence of VGAM709 RNA, herein designated VGAM RNA, also designated SEQ ID:3420.

Another function of VGAM709 is therefore inhibition of LOC199923 (Accession XM_114057). Accordingly, utilities of VGAM709 include diagnosis, prevention and treatment of diseases and clinical conditions associated with LOC199923.

FIG. 1 further provides a conceptual description of a novel bioinformatically detected viral gene of the present invention, referred to here as Viral Genomic Address Messenger 710 (VGAM710) viral gene, which modulates expression of respective host target genes thereof, the function and utility of which host target genes is known in the art.

VGAM710 is a novel bioinformatically detected regulatory, non protein coding, viral micro RNA (miRNA) gene. The method by which VGAM710 was detected is described hereinabove with reference to FIGS. 1-8.

VGAM710 gene, herein designated VGAM GENE, is a viral gene contained in the genome of Pestivirus Type 2. VGAM710 host target gene, herein designated VGAM HOST TARGET GENE, is a human gene contained in the human genome.

VGAM710 gene encodes a VGAM710 precursor RNA, herein designated VGAM PRECURSOR RNA. Similar to other miRNA genes, and unlike most ordinary genes, VGAM710 precursor RNA does not encode a protein. A nucleotide sequence identical or highly similar to the nucleotide sequence of VGAM710 precursor RNA is designated SEQ ID:696, and is provided hereinbelow with reference to the sequence listing part. Nucleotide sequence SEQ ID:696 is located at position 4562 relative to the genome of Pestivirus Type 2.

VGAM710 precursor RNA folds onto itself, forming VGAM710 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM710 folded precursor RNA into VGAM710 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM710 RNA is designated SEQ ID:3421, and is provided hereinbelow with reference to the sequence listing part.

VGAM710 host target gene, herein designated VGAM HOST TARGET GENE, encodes a corresponding messenger RNA, VGAM710 host target RNA, herein designated VGAM HOST TARGET RNA. VGAM710 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM710 RNA, herein designated VGAM RNA, binds complementarily to one or more host target binding sites located in untranslated regions of VGAM710 host target RNA, herein designated VGAM HOST TARGET RNA. This complementary binding is due to the fact that the nucleotide sequence of VGAM710 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM710 RNA, herein designated VGAM RNA, may have a different number of host target binding sites in untranslated regions of a VGAM710 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM710 RNA, herein designated VGAM RNA, to host target binding sites on VGAM710 host target RNA, herein designated VGAM HOST TARGET RNA, such as BINDING SITE I, BINDING SITE II and BINDING SITE III, inhibits translation of VGAM710 host target RNA into VGAM710 host target protein, herein designated VGAM HOST TARGET PROTEIN. VGAM host target protein is therefore outlined by a broken line.

It is appreciated that VGAM710 host target gene, herein designated VGAM HOST TARGET GENE, in fact represents a plurality of VGAM710 host target genes. The mRNA of each one of this plurality of VGAM710 host target genes comprises one or more host target binding sites, each having a nucleotide sequence which is at least partly complementary to VGAM710 RNA, herein designated VGAM RNA, and which when bound by VGAM710 RNA causes inhibition of translation of respective one or more VGAM710 host target proteins.

It is further appreciated by one skilled in the art that the mode of translational inhibition illustrated by FIG. 1 with specific reference to translational inhibition exerted by VGAM710 gene, herein designated VGAM GENE, on one or more VGAM710 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM710 is inhibition of expression of host target genes, as part of a novel viral mechanism of attacking a host. Accordingly, utilities of VGAM710 include diagnosis, prevention and treatment of viral infection by Pestivirus Type 2. Specific functions, and accordingly utilities, of VGAM710 correlate with, and may be deduced from, the identity of the host target genes which VGAM710 binds and inhibits, and the function of these host target genes, as elaborated hereinbelow.

Nucleotide sequences of the VGAM710 precursor RNA, herein designated VGAM PRECURSOR RNA, and of the 'diced' VGAM710 RNA, herein designated VGAM RNA, and a schematic representation of the secondary folding of VGAM710 folded precursor RNA, herein designated VGAM FOLDED PRECURSOR RNA, of VGAM710 are further described hereinbelow with reference to Table 1.

Nucleotide sequences of host target binding sites, such as BINDING SITE-I, BINDING SITE-II and BINDING SITE-III of FIG. 1, found on VGAM710 host target RNA, and schematic representation of the complementarity of each of these host target binding sites to VGAM710 RNA, herein designated VGAM RNA, are described hereinbelow with reference to Table 2.

As mentioned hereinabove with reference to FIG. 1, a function of VGAM710 gene, herein designated VGAM is inhibition of expression of VGAM710 target genes. It is appreciated that specific functions, and accordingly utilities, of VGAM710 correlate with, and may be deduced from, the identity of the target genes which VGAM710 binds and inhibits, and the function of these target genes, as elaborated hereinbelow.

Periaxin (PRX, Accession NM_020956) is a VGAM710 host target gene. PRX BINDING SITE1 and PRX BINDING SITE2 are HOST TARGET binding sites found in untranslated regions of mRNA encoded by PRX, corresponding to HOST TARGET binding sites such as BINDING SITE I, BINDING SITE II or BINDING SITE III. Table 2 illustrates the complementarity of the nucleotide sequences of PRX BINDING SITE1 and PRX BINDING SITE2, designated SEQ ID:21936 and SEQ ID:21942 respectively, to the nucleotide sequence of VGAM710 RNA, herein designated VGAM RNA, also designated SEQ ID:3421.

A function of VGAM710 is therefore inhibition of Periaxin (PRX, Accession NM_020956), a gene which seems to be required for maintenance of peripheral nerve myelin sheath. may have a role in axon-glial interactions, possibly by interacting with the cytoplasmic domains of integral membrane proteins such as myelin-associated glycoprotein in the periaxonal regions of the schwann cell plasma membrane. may have a role in the early phases of myelin deposition. Accordingly, utilities of VGAM710 include diagnosis, prevention and treatment of diseases and clinical conditions associated with PRX. The function of PRX and its association with various diseases and clinical conditions, has been established by previous studies, as described hereinabove with reference to VGAM476. FLJ14082 (Accession NM_025024) is another VGAM710 host target gene. FLJ14082 BINDING SITE is HOST TARGET binding site found in the 3' untranslated region of mRNA encoded by FLJ14082, corresponding to a HOST TARGET binding site such as BINDING SITE I, BINDING SITE II or BINDING SITE III. Table 2 illustrates the complementarity of the nucleotide sequences of FLJ14082 BINDING SITE, designated SEQ ID:24612, to the nucleotide sequence of VGAM710 RNA, herein designated VGAM RNA, also designated SEQ ID:3421.

Another function of VGAM710 is therefore inhibition of FLJ14082 (Accession NM_025024). Accordingly, utilities of VGAM710 include diagnosis, prevention and treatment of diseases and clinical conditions associated with FLJ14082. KIAA0444 (Accession XM_030999) is another VGAM710 host target gene. KIAA0444 BINDING SITE is HOST TARGET binding site found in the 3' untranslated region of mRNA encoded by KIAA0444, corresponding to a HOST TARGET binding site such as BINDING SITE I, BINDING SITE II or BINDING SITE III. Table 2 illustrates the complementarity of the nucleotide sequences of KIAA0444 BINDING SITE, designated SEQ ID:31244, to the nucleotide sequence of VGAM710 RNA, herein designated VGAM RNA, also designated SEQ ID:3421.

Another function of VGAM710 is therefore inhibition of KIAA0444 (Accession XM_030999). Accordingly, utilities of VGAM710 include diagnosis, prevention and treatment of diseases and clinical conditions associated with KIAA0444. KIAA0574 (Accession XM_045076) is another VGAM710 host target gene. KIAA0574 BINDING SITE is HOST TARGET binding site found in the 3' untranslated region of mRNA encoded by KIAA0574, corresponding to a HOST TARGET binding site such as BINDING SITE I, BINDING SITE II or BINDING SITE III. Table 2 illustrates the complementarity of the nucleotide sequences of KIAA0574 BINDING SITE, designated SEQ ID:34348, to the nucleotide sequence of VGAM710 RNA, herein designated VGAM RNA, also designated SEQ ID:3421.

Another function of VGAM710 is therefore inhibition of KIAA0574 (Accession XM_045076). Accordingly, utilities of VGAM710 include diagnosis, prevention and treatment of diseases and clinical conditions associated with KIAA0574. KIAA1209 (Accession XM_027307) is another VGAM710 host target gene. KIAA1209 BINDING SITE is HOST TARGET binding site found in the 3' untranslated region of mRNA encoded by KIAA1209, corresponding to a HOST TARGET binding site such as BINDING SITE I, BINDING SITE II or BINDING SITE III. Table 2 illustrates the complementarity of the nucleotide sequences of KIAA1209 BINDING SITE, designated SEQ ID:30471, to the nucleotide sequence of VGAM710 RNA, herein designated VGAM RNA, also designated SEQ ID:3421.

Another function of VGAM710 is therefore inhibition of KIAA1209 (Accession XM_027307). Accordingly, utilities of VGAM710 include diagnosis, prevention and treatment of diseases and clinical conditions associated with KIAA1209. P450RAI-2 (Accession NM_019885) is another VGAM710 host target gene. P450RAI-2 BINDING SITE is HOST TARGET binding site found in the 3' untranslated region of mRNA encoded by P450RAI-2, corresponding to a HOST TARGET binding site such as BINDING SITE I, BINDING SITE II or BINDING SITE III. Table 2 illustrates the complementarity of the nucleotide sequences of P450RAI-2 BINDING SITE, designated SEQ ID:21271, to the nucleotide sequence of VGAM710 RNA, herein designated VGAM RNA, also designated SEQ ID:3421.

Another function of VGAM710 is therefore inhibition of P450RAI-2 (Accession NM_019885). Accordingly, utilities of VGAM710 include diagnosis, prevention and treatment of diseases and clinical conditions associated with P450RAI-2.

RAB, Member of RAS Oncogene Family-like 4 (RABL4, Accession NM_006860) is another VGAM710 host target gene. RABL4 BINDING SITE is HOST TARGET binding site found in the 5' untranslated region of mRNA encoded by RABL4, corresponding to a HOST TARGET binding site such as BINDING SITE I, BINDING SITE II or BINDING SITE III. Table 2 illustrates the complementarity of the nucleotide sequences of RABL4 BINDING SITE, designated SEQ ID:13729, to the nucleotide sequence of VGAM710 RNA, herein designated VGAM RNA, also designated SEQ ID:3421.

Another function of VGAM710 is therefore inhibition of RAB, Member of RAS Oncogene Family-like 4 (RABL4, Accession NM_006860). Accordingly, utilities of VGAM710 include diagnosis, prevention and treatment of diseases and clinical conditions associated with RABL4. SEC61A1 (Accession NM_013336) is another VGAM710 host target gene. SEC61A1 BINDING SITE is HOST TARGET binding site found in the 3" untranslated region of mRNA encoded by SEC61A1, corresponding to a HOST TARGET binding site such as BINDING SITE I, BINDING SITE II or BINDING SITE III. Table 2 illustrates the complementarity of the nucleotide sequences of SEC61A1 BINDING SITE, designated SEQ ID:14986, to the nucleotide sequence of VGAM710 RNA, herein designated VGAM RNA, also designated SEQ ID:3421.

Another function of VGAM710 is therefore inhibition of SEC61A1 (Accession NM_013336). Accordingly, utilities of VGAM710 include diagnosis, prevention and treatment of diseases and clinical conditions associated with SEC61A1. T-cell Leukemia/lymphoma 6 (TCL6, Accession NM_020553) is another VGAM710 host target gene. TCL6 BINDING SITE1 and TCL6 BINDING SITE2 are HOST TARGET binding sites found in untranslated regions of mRNA encoded by TCL6, corresponding to HOST TARGET binding sites such as BINDING SITE I, BINDING SITE II or BINDING SITE III. Table 2 illustrates the complementarity of the nucleotide sequences of TCL6 BINDING SITE1 and TCL6 BINDING SITE2, designated SEQ ID:21776 and SEQ ID:21778 respectively, to the nucleotide sequence of VGAM710 RNA, herein designated VGAM RNA, also designated SEQ ID:3421.

Another function of VGAM710 is therefore inhibition of T-cell Leukemia/lymphoma 6 (TCL6, Accession NM_020553). Accordingly, utilities of VGAM710 include diagnosis, prevention and treatment of diseases and clinical conditions associated with TCL6. LOC257596 (Accession XM_175296) is another VGAM710 host target gene. LOC257596 BINDING SITE is HOST TARGET binding site found in the 3' untranslated region of mRNA encoded by LOC257596, corresponding to a HOST TARGET binding site such as BINDING SITE I, BINDING SITE II or BINDING SITE III. Table 2 illustrates the complementarity of the nucleotide sequences of LOC257596 BINDING SITE, designated SEQ ID:46753, to the nucleotide sequence of VGAM710 RNA, herein designated VGAM RNA, also designated SEQ ID:3421.

Another function of VGAM710 is therefore inhibition of LOC257596 (Accession XM_175296). Accordingly, utilities of VGAM710 include diagnosis, prevention and treatment of diseases and clinical conditions associated with LOC257596. LOC63923 (Accession XM_040527) is another VGAM710 host target gene. LOC63923 BINDING SITE is HOST TARGET binding site found in the 3' untranslated region of mRNA encoded by LOC63923, corresponding to a HOST TARGET binding site such as BINDING SITE I, BINDING SITE II or BINDING SITE III. Table 2 illustrates the complementarity of the nucleotide sequences of LOC63923 BINDING SITE, designated SEQ ID:33323, to the nucleotide sequence of VGAM710 RNA, herein designated VGAM RNA, also designated SEQ ID:3421.

Another function of VGAM710 is therefore inhibition of LOC63923 (Accession XM_040527). Accordingly, utilities of VGAM710 include diagnosis, prevention and treatment of diseases and clinical conditions associated with LOC63923. LOC92080 (Accession XM_042704) is another VGAM710 host target gene. LOC92080 BINDING SITE is HOST TARGET binding site found in the 5' untranslated region of mRNA encoded by LOC92080, corresponding to a HOST TARGET binding site such as BINDING SITE I, BINDING SITE II or BINDING SITE III. Table 2 illustrates the complementarity of the nucleotide sequences of LOC92080 BINDING SITE, designated SEQ ID:33760, to the nucleotide sequence of VGAM710 RNA, herein designated VGAM RNA, also designated SEQ ID:3421.

Another function of VGAM710 is therefore inhibition of LOC92080 (Accession XM_042704). Accordingly, utilities of VGAM710 include diagnosis, prevention and treatment of diseases and clinical conditions associated with LOC92080. FIG. 1 further provides a conceptual description of a novel bioinformatically detected viral gene of the present invention, referred to here as Viral Genomic Address Messenger 711 (VGAM711) viral gene, which modulates expression of respective host target genes thereof, the function and utility of which host target genes is known in the art.

VGAM711 is a novel bioinformatically detected regulatory, non protein coding, viral micro RNA (miRNA) gene. The method by which VGAM711 was detected is described hereinabove with reference to FIGS. 1-8.

VGAM711 gene, herein designated VGAM GENE, is a viral gene contained in the genome of Pestivirus Type 2. VGAM711 host target gene, herein designated VGAM HOST TARGET GENE, is a human gene contained in the human genome.

VGAM711 gene encodes a VGAM711 precursor RNA, herein designated VGAM PRECURSOR RNA. Similar to other miRNA genes, and unlike most ordinary genes, VGAM711 precursor RNA does not encode a protein. A nucleotide sequence identical or highly similar to the nucleotide sequence of VGAM711 precursor RNA is designated SEQ ID:697, and is provided hereinbelow with reference to the sequence listing part. Nucleotide sequence SEQ ID:697 is located at position 2306 relative to the genome of Pestivirus Type 2.

VGAM711 precursor RNA folds onto itself, forming VGAM711 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM711 folded precursor RNA into VGAM711 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 86%) nucleotide sequence of VGAM711 RNA is designated SEQ ID:3422, and is provided hereinbelow with reference to the sequence listing part.

VGAM711 host target gene, herein designated VGAM HOST TARGET GENE, encodes a corresponding messenger RNA, VGAM711 host target RNA, herein designated VGAM HOST TARGET RNA. VGAM711 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM711 RNA, herein designated VGAM RNA, binds complementarily to one or more host target binding sites located in untranslated regions of VGAM711 host target RNA, herein designated VGAM HOST TARGET RNA. This complementary binding is due to the fact that the nucleotide sequence of VGAM711 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM711 RNA, herein designated VGAM RNA, may have a different number of host target binding sites in untranslated regions of a VGAM711 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM711 RNA, herein designated VGAM RNA, to host target binding sites on VGAM711 host target RNA, herein designated VGAM HOST TARGET RNA, such as BINDING SITE I, BINDING SITE II and BINDING SITE III, inhibits translation of VGAM711 host target RNA into VGAM711 host target protein, herein designated VGAM HOST TARGET PROTEIN. VGAM host target protein is therefore outlined by a broken line.

It is appreciated that VGAM711 host target gene, herein designated VGAM HOST TARGET GENE, in fact represents a plurality of VGAM711 host target genes. The mRNA of each one of this plurality of VGAM711 host target genes comprises one or more host target binding sites, each having a nucleotide sequence which is at least partly complementary to VGAM711 RNA, herein designated VGAM RNA, and which when bound by VGAM711 RNA causes inhibition of translation of respective one or more VGAM711 host target proteins.

It is further appreciated by one skilled in the art that the mode of translational inhibition illustrated by FIG. 1 with specific reference to translational inhibition exerted by VGAM711 gene, herein designated VGAM GENE, on one or more VGAM711 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM711 is inhibition of expression of host target genes, as part of a novel viral mechanism of attacking a host. Accordingly, utilities of VGAM711 include diagnosis, prevention and treatment of viral infection by Pestivirus Type 2. Specific functions, and accordingly utilities, of VGAM711 correlate with, and may be deduced from, the identity of the host target genes which VGAM711 binds and inhibits, and the function of these host target genes, as elaborated hereinbelow.

Nucleotide sequences of the VGAM711 precursor RNA, herein designated VGAM PRECURSOR RNA, and of the 'diced' VGAM711 RNA, herein designated VGAM RNA, and a schematic representation of the secondary folding of VGAM711 folded precursor RNA, herein designated VGAM FOLDED PRECURSOR RNA, of VGAM711 are further described hereinbelow with reference to Table 1.

Nucleotide sequences of host target binding sites, such as BINDING SITE-I, BINDING SITE-II and BINDING SITE-III of FIG. 1, found on VGAM711 host target RNA, and schematic representation of the complementarity of each of these host target binding sites to VGAM711 RNA, herein designated VGAM RNA, are described hereinbelow with reference to Table 2.

As mentioned hereinabove with reference to FIG. 1, a function of VGAM711 gene, herein designated VGAM is inhibition of expression of VGAM711 target genes. It is appreciated that specific functions, and accordingly utilities, of VGAM711 correlate with, and may be deduced from, the identity of the target genes which VGAM711 binds and inhibits, and the function of these target genes, as elaborated hereinbelow.

ATPase, Ca++ Transporting, Plasma Membrane 2 (ATP2B2, Accession NM_001683) is a VGAM711 host target gene. ATP2B2 BINDING SITE is HOST TARGET binding site found in the 5' untranslated region of mRNA encoded by ATP2B2, corresponding to a HOST TARGET binding site such as BINDING SITE I, BINDING SITE II or BINDING SITE III. Table 2 illustrates the complementarity of the nucleotide sequences of ATP2B2 BINDING SITE, designated SEQ ID:7404, to the nucleotide sequence of VGAM711 RNA, herein designated VGAM RNA, also designated SEQ ID:3422.

A function of VGAM711 is therefore inhibition of ATPase, Ca++ Transporting, Plasma Membrane 2 (ATP2B2, Accession NM_001683), a gene which catalyzes the hydrolysis of ATP coupled with the transport of the calcium out of the cell . Accordingly, utilities of VGAM711 include diagnosis, prevention and treatment of diseases and clinical conditions associated with ATP2B2. The function of ATP2B2 has been established by previous studies. Street et al. (1998) demonstrated that the deafwaddler (dfw) mouse mutant, which is deaf and displays vestibular/motor imbalance, has a mutation in the Atp2b2 gene. A A-to-G nucleotide transition in dfw DNA caused a glycine-to-serine substitution at a highly conserved amino acid position, whereas a second mutant allele carried a 2-bp deletion that caused a frameshift predicted to result in a truncated protein. In the cochlea, the Atp2b2 protein is localized to stereocilia and the basolateral wall of hair cells in wildtype mice, but is not detected in deafwaddler mice. This indicates that mutation of Atp2b2 may cause deafness and imbalance by affecting sensory transduction in stereocilia as well as neurotransmitter release from the basolateral membrane. These mutations affecting Atp2b2 were the first to be found in a mammalian plasma membrane calcium pump and defined a new class of deafness genes that directly affect hair-cell physiology. PMCA2 exhibits a highly restricted tissue distribution, suggesting that it serves more specialized physiologic functions than some of the other PMCA isoforms. A unique role in hearing is suggested by the high levels of PMCA2 expression in cochlear outer hair cells and spiral ganglion cells. Animal model experiments lend further support to the function of ATP2B2. To analyze the physiologic role of PMCA2, Kozel et al. (1998) produced PMCA2-deficient mice by gene targeting. Homozygous PMCA2-null mice grew more slowly than heterozygous and wildtype mice and exhibited an unsteady gait and difficulties in maintaining balance. Histologic analysis of the cerebellum and inner ear of mutant and wildtype mice showed that null mutants have slightly increased numbers of Purkinje neurons (in which PMCA2 is highly expressed), a decreased thickness of the molecular layer, an absence of otoconia in the vestibular system, and a range of abnormalities of the organ of Corti. Analysis of auditory-evoked brain stem responses showed that homozygous mutants were deaf and that heterozygous mice had a significant hearing loss. These data demonstrated that PMCA2 is required for both balance and hearing and suggested that it may be a major source of the calcium used in the formation and maintenance of otoconia.

It is appreciated that the abovementioned animal model for ATP2B2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Street, V. A.; McKee-Johnson, J. W.; Fonseca, R. C.; Tempel, B. L.; Noben-Trauth, K.: Mutations in a plasma membrane Ca (2+)-ATPase gene cause deafness in deafwaddler mice. Nature Genet. 19:390-394, 1998; and Kozel, P. J.; Friedman, R. A.; Erway, L. C.; Yamoah, E. N.; Liu, L. H.; Riddle, T.; Duffy, J. J.; Doetschman, T.; Miller, M. L.; Cardell, E. L.; Shull, G. E.: Balance and hearing defic.

Further studies establishing the function and utilities of ATP2B2 are found in John Hopkins OMIM database record ID 108733, and in sited publications numbered 3692-3696 listed in the bibliography section hereinbelow, which are also hereby incorporated by reference. Down-regulator of Transcription 1, TBP-binding (negative cofactor 2) (DR1, Accession XM_002015) is another VGAM711 host target gene. DR1 BINDING SITE is HOST TARGET binding site found in the 5' untranslated region of mRNA encoded by DR1, corresponding to a HOST TARGET binding site such as BINDING SITE I, BINDING SITE II or BINDING SITE III. Table 2 illustrates the complementarity of the nucleotide sequences of DR1 BINDING SITE, designated SEQ ID:29856, to the nucleotide sequence of VGAM711 RNA, herein designated VGAM RNA, also designated SEQ ID:3422.

Another function of VGAM711 is therefore inhibition of Down-regulator of Transcription 1, TBP-binding (negative cofactor 2) (DR1, Accession XM_002015), a gene which influences functional repression of both activated and basal transcription of class ii genes. Accordingly, utilities of VGAM711 include diagnosis, prevention and treatment of diseases and clinical conditions associated with DR1. The function of DR1 has been established by previous studies. Several phosphoproteins are known to interact with TBP, the TATA box-binding protein (OMIM Ref. No. 600075). Among them, DR1 is a TBP-associated phosphoprotein that represses both basal and activated levels of transcription. Inostroza et al. (1992) biochemically characterized DR1 purified from HeLa cells and cloned the human gene from a HeLa cell cDNA library. The gene encodes a 176-amino acid polypeptide of 19 kD. They showed that DR1 is phosphorylated in vivo and that phosphorylation of DR1 affected its interaction with TBP. The DR1 protein contains 3 domains: a histone fold motif at the N terminus, a TBP-binding domain, and a glutamine- and alanine-rich region. Mermelstein et al. (1996) showed that the histone fold motif of DR1 is required for DR1-DRAP1 interaction. Both the TBP-binding domain and the glutamine- and alanine-rich region are required for DR1-mediated repression of transcription. Yeung et al. (1997) demonstrated that the TBP-binding domain has 2 functions: it tethers the DR1 repressor complex to the promoter by interacting with TBP, and it is required for the corepression activity of DRAP1, although it is not required for DR1-DRAP1 interaction. Yeung et al. (1997) determined that the glutamine- and alanine-rich region is the repressor domain of DR1 and that this domain interacts with TBP. Goppelt et al. (1996) proposed that binding of DR1 repressor complexes to TBP-promoter complexes establishes a mechanism in which an altered DNA conformation, together with the formation of higher order complexes, inhibits the assembly of the preinitiation complex and controls the rate of RNA polymerase II transcription.

Full details of the abovementioned studies are described in the following publications, the disclosure of which are hereby incorporated by reference:

Inostroza, J. A.; Mermeistein, F. H.; Ha, I.; Lane, W. S.; Reinberg, D.: Dr1, a TATA-binding protein-associated phosphoprotein and inhibitor of class II gene transcription. Cell 70:477-489, 1992; and Mermelstein, F.; Yeung, K.; Cao, J.; Inostroza, J. A.; Erdjument-Bromage, H.; Eagelson, K.; Landsman, D.; Levitt, P.; Tempst, P.; Reinberg, D.: Requirement of a corepressor for Dr1-med.

Further studies establishing the function and utilities of DR1 are found in John Hopkins OMIM database record ID 601482, and in sited publications numbered 6516-651 and 9241-6523 listed in the bibliography section hereinbelow, which are also hereby incorporated by reference. E2F Transcription Factor 1 (E2F1, Accession XM_097772) is another VGAM711 host target gene. E2F1 BINDING SITE is HOST TARGET binding site found in the 3' untranslated region of mRNA encoded by E2F1, corresponding to a HOST TARGET binding site such as BINDING SITE I, BINDING SITE II or BINDING SITE III. Table 2 illustrates the complementarity of the nucleotide sequences of E2F1 BINDING SITE, designated SEQ ID:41119, to the nucleotide sequence of VGAM711 RNA, herein designated VGAM RNA, also designated SEQ ID:3422.

Another function of VGAM711 is therefore inhibition of E2F Transcription Factor 1 (E2F1, Accession XM_097772), a gene which involved in cell cycle regulation, mediates G1 arrest when bound to Rb. Accordingly, utilities of VGAM711 include diagnosis, prevention and treatment of diseases and clinical conditions associated with E2F1. The function of E2F1 and its association with various diseases and clinical conditions, has been established by previous studies, as described hereinabove with reference to VGAM430. Fatty Acid Amide Hydrolase (FAAH, Accession NM_024306) is another VGAM711 host target gene. FAAH BINDING SITE is HOST TARGET binding site found in the 3' untranslated region of mRNA encoded by FAAH, corresponding to a HOST TARGET binding site such as BINDING SITE I, BINDING SITE II or BINDING SITE III. Table 2 illustrates the complementarity of the nucleotide sequences of FAAH BINDING SITE, designated SEQ ID:23596, to the nucleotide sequence of VGAM711 RNA, herein designated VGAM RNA, also designated SEQ ID:3422.

Another function of VGAM711 is therefore inhibition of Fatty Acid Amide Hydrolase (FAAH, Accession NM_024306), a gene which function as an electron carrier for several membrane bound oxygenases (by similarity). Accordingly, utilities of VGAM711 include diagnosis, prevention and treatment of diseases and clinical conditions associated with FAAH. The function of FAAH has been established by previous studies. To evaluate FAAH genes as candidates for neurogenetic diseases in human S and mice, Wan et al. (1998) mapped the loci in both species and determined their intron-exon structures using PCR analysis of somatic cell hybrids and radiation hybrid mapping panels. Analysis of a somatic cell hybrid mapping panel and a mouse interspecific backcross panel localized the Faah gene to the conserved syntenic region on mouse chromosome 4, close to the neurologic mutation 'clasper.' No sequence abnormality or rearrangement of the Faah gene was found to explain the clasper phenotype. Furthermore, FAAH protein levels were normal in clasper mouse tissues. Problem drug use and dependence are neurobehavioral disorders of complex origin. Although environmental factors contribute to drug abuse and addiction, genetic factors play a significant role estimated at 40 to 60% of the total risk. In the course of a search for the human genes that confer vulnerability to problem drug use, Sipe et al. (2002) identified a single-nucleotide polymorphism (SNP) in the FAAH gene, that in homozygous form is strongly associated with both street drug use and problem drug/alcohol use. This SNP (OMIM Ref. No. 385C-A) results in a missense mutation that converts a conserved proline residue to threonine (pro129 OMIM Ref. No. 602935.0001), producing an FAAH variant that displays normal catalytic properties but at enhanced sensitivity to proteolytic degradation. Collectively, these results suggested that genetic mutations in FAAH may constitute important risk factors for problem drug use and support a potential link between functional abnormalities in the endogenous cannabinoid system and drug abuse and dependence.

Full details of the abovementioned studies are described in the following publications, the disclosure of which are hereby incorporated by reference:

Sipe, J. C.; Chiang, K.; Gerber, A. L.; Beutler, E.; Cravatt, B. F.: A missense mutation in human fatty acid amide hydrolase associated with problem drug use. Proc. Nat. Acad. Sci. 99:8394-8399, 2002; and Wan, M.; Cravatt, B. F.; Ring, H. Z.; Zhang, X.; Francke, U.: Conserved chromosomal location and genomic structure of human and mouse fatty-acid amide hydrolase genes and evaluation of.

Further studies establishing the function and utilities of FAAH are found in John Hopkins OMIM database record ID 602935, and in sited publications numbered 7974-7977 listed in the bibliography section hereinbelow, which are also hereby incorporated by reference. Sorbin and SH3 Domain Containing 1 (SORBS1, Accession NM_015385) is another VGAM711 host target gene. SORBS1 BINDING SITE is HOST TARGET binding site found in the 3' untranslated region of mRNA encoded by SORBS1, corresponding to a HOST TARGET binding site such as BINDING SITE I, BINDING SITE II or BINDING SITE III. Table 2 illustrates the complementarity of the nucleotide sequences of SORBS1 BINDING SITE, designated SEQ ID:17686, to the nucleotide sequence of VGAM711 RNA, herein designated VGAM RNA, also designated SEQ ID:3422.

Another function of VGAM711 is therefore inhibition of Sorbin and SH3 Domain Containing 1 (SORBS1, Accession NM_015385), a gene which necessary for cell polarization during vegetative growth. Accordingly, utilities of VGAM711 include diagnosis, prevention and treatment of diseases and clinical conditions associated with SORBS1. The function of SORBS1 and its association with various diseases and clinical conditions, has been established by previous studies, as described hereinabove with reference to VGAM475. TYRO3 Protein Tyrosine Kinase (TYRO3, Accession NM_006293) is another VGAM711 host target gene. TYRO3 BINDING SITE is HOST TARGET binding site found in the 3' untranslated region of mRNA encoded by TYRO3, corresponding to a HOST TARGET binding site such as BINDING SITE I, BINDING SITE II or BINDING SITE III. Table 2 illustrates the complementarity of the nucleotide sequences of TYRO3 BINDING SITE, designated SEQ ID:12985, to the nucleotide sequence of VGAM711 RNA, herein designated VGAM RNA, also designated SEQ ID:3422.

Another function of VGAM711 is therefore inhibition of TYRO3 Protein Tyrosine Kinase (TYRO3, Accession NM_006293), a gene which may be involved in cell adhesion processes, particularly in the central nervous system. Accordingly, utilities of VGAM711 include diagnosis, prevention and treatment of diseases and clinical conditions associated with TYRO3. The function of TYRO3 has been established by previous studies. Polvi et al. (1993) cloned partial cDNAs of the human TYRO3 gene encoding a putative receptor tyrosine kinase and its processed pseudogene (OMIM Ref. No. TYRO3P) from human teratocarcinoma cell, bone marrow, and melanocyte cDNA libraries. The tyrosine kinase homologous domains of the 2 genes were sequenced and compared with each other and with the mouse Tyro3 gene. Abundant levels of the 4.2-kb TYRO3 mRNA were detected in human brain and lower levels in other human tissues. Animal model experiments lend further support to the function of TYRO3. Regulation of lymphocyte numbers is mediated by cytokines signaling through receptors coupled to cytoplasmic protein-tyrosine kinases. Lu and Lemke (2001) generated mice deficient in Mertk (OMIM Ref. No. 604705), Axl (OMIM Ref. No. 109135), and Tyro3. Like their ligands, GAS6 (OMIM Ref. No. 600441) and PROS1 (OMIM Ref. No. 176880), these receptors are widely expressed in monocytes and macrophages but not in B or T lymphocytes. Although the peripheral lymphoid organs of mutant mice were indistinguishable from those of wildtype mice at birth, by 4 weeks of age spleens and lymph nodes grew at elevated rates. This was primarily due to the hyperproliferation of constitutively activated B and T cells, particularly CD4-positive T cells, with ectopic colonies in every adult organ examined. All triple mutants developed autoimmunity with symptoms histologically similar to human rheumatoid arthritis (OMIM Ref. No. 180300), pemphigus vulgaris (OMIM Ref. No. 169610), and systemic lupus erythematosus (OMIM Ref. No. 152700), and were characterized by antibodies against normal cellular antigens, including phospholipids and double-stranded DNA. Females were particularly prone to thromboses and recurrent fetal loss. Flow cytometric analysis demonstrated that wildtype B and T cells underwent multiple rounds of cell division after injection into mutant mice and that their antigen-presenting cells expressed elevated levels of activation markers. Lu and Lemke (2001) proposed that the cells that initiate lymphoproliferation and autoimmunity in the Tyro3 family mutants were the macrophages and dendritic cells that normally express the 3 receptor genes.

It is appreciated that the abovementioned animal model for TYRO3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Polvi, A.; Armstrong, E.; Lai, C.; Lemke, G.; Huebner, K.; Spritz, R. A.; Guida, L. C.; Nicholls, R. D.; Alitalo, K.: The human TYRO3 gene and pseudogene are located in chromosome 15q14-q25. Gene 134:289-293, 1993; and Lu, Q.; Lemke, G.: Homeostatic regulation of the immune system by receptor tyrosine kinases of the Tyro 3 family. Science 293:306-311, 2001.

Further studies establishing the function and utilities of TYRO3 are found in John Hopkins OMIM database record ID 600341, and in sited publications numbered 507 and 12302 listed in the bibliography section hereinbelow, which are also hereby incorporated by reference. Ubiquitin-conjugating Enzyme E2L 3 (UBE2L3, Accession NM_003347) is another VGAM711 host target gene. UBE2L3 BINDING SITE is HOST TARGET binding site found in the 3' untranslated region of mRNA encoded by UBE2L3, corresponding to a HOST TARGET binding site such as BINDING SITE I, BINDING SITE II or BINDING SITE III. Table 2 illustrates the complementarity of the nucleotide sequences of UBE2L3 BINDING SITE, designated SEQ ID:9357, to the nucleotide sequence of VGAM711 RNA, herein designated VGAM RNA, also designated SEQ ID:3422.

Another function of VGAM711 is therefore inhibition of Ubiquitin-conjugating Enzyme E2L 3 (UBE2L3, Accession NM_003347), a gene which catalyzes the covalent attachment of ubiquitin to other proteins. Accordingly, utilities of VGAM711 include diagnosis, prevention and treatment of diseases and clinical conditions associated with UBE2L3. The function of UBE2L3 and its association with various diseases and clinical conditions, has been established by previous studies, as described hereinabove with reference to VGAM215. Chromosome 1 Open Reading Frame 34 (C1orf34, Accession XM_027172) is another VGAM711 host target gene. C1orf34 BINDING SITE is HOST TARGET binding site found in the 3' untranslated region of mRNA encoded by C1orf34, corresponding to a HOST TARGET binding site such as BINDING SITE I, BINDING SITE II or BINDING SITE III. Table 2 illustrates the complementarity of the nucleotide sequences of C1orf34 BINDING SITE, designated SEQ ID:30438, to the nucleotide sequence of VGAM711 RNA, herein designated VGAM RNA, also designated SEQ ID:3422.

Another function of VGAM711 is therefore inhibition of Chromosome 1 Open Reading Frame 34 (C1orf34, Accession XM_027172). Accordingly, utilities of VGAM711 include diagnosis, prevention and treatment of diseases and clinical conditions associated with C1orf34. FLJ13305 (Accession XM_117270) is another VGAM711 host target gene. FLJ13305 BINDING SITE is HOST TARGET binding site found in the 5' untranslated region of mRNA encoded by FLJ13305, corresponding to a HOST TARGET binding site such as BINDING SITE I, BINDING SITE II or BINDING SITE III. Table 2 illustrates the complementarity of the nucleotide sequences of FLJ13305 BINDING SITE, designated SEQ ID:43344, to the nucleotide sequence of VGAM711 RNA, herein designated VGAM RNA, also designated SEQ ID:3422.

Another function of VGAM711 is therefore inhibition of FLJ13305 (Accession XM_117270). Accordingly, utilities of VGAM711 include diagnosis, prevention and treatment of diseases and clinical conditions associated with FLJ13305. KIAA1634 (Accession XM_032749) is another VGAM711 host target gene. KIAA1634 BINDING SITE is HOST TARGET binding site found in the 3' untranslated region of mRNA encoded by KIAA1634, corresponding to a HOST TARGET binding site such as BINDING SITE I, BINDING SITE II or BINDING SITE III. Table 2 illustrates the complementarity of the nucleotide sequences of KIAA1634 BINDING SITE, designated SEQ ID:31753, to the nucleotide sequence of VGAM711 RNA, herein designated VGAM RNA, also designated SEQ ID:3422.

Another function of VGAM711 is therefore inhibition of KIAA1634 (Accession XM_032749). Accordingly, utilities of VGAM711 include diagnosis, prevention and treatment of diseases and clinical conditions associated with KIAA1634. MGC11287 (Accession NM_031464) is another VGAM711 host target gene. MGC11287 BINDING SITE is HOST TARGET binding site found in the 3' untranslated region of mRNA encoded by MGC11287, corresponding to a HOST TARGET binding site such as BINDING SITE I, BINDING SITE II or BINDING SITE III. Table 2 illustrates the complementarity of the nucleotide sequences of MGC11287 BINDING SITE, designated SEQ ID:25502, to the nucleotide sequence of VGAM711 RNA, herein designated VGAM RNA, also designated SEQ ID:3422.

Another function of VGAM711 is therefore inhibition of MGC11287 (Accession NM_031464). Accordingly, utilities of VGAM711 include diagnosis, prevention and treatment of diseases and clinical conditions associated with MGC11287. P114-RHO-GEF (Accession NM_015318) is another VGAM711 host target gene. P114-RHO-GEF BINDING SITE is HOST TARGET binding site found in the 3' untranslated region of mRNA encoded by P114-RHO-GEF, corresponding to a HOST TARGET binding site such as BINDING SITE I, BINDING SITE II or BINDING SITE III. Table 2 illustrates the complementarity of the nucleotide sequences of P114-RHO-GEF BINDING SITE, designated SEQ ID:17638, to the nucleotide sequence of VGAM711 RNA, herein designated VGAM RNA, also designated SEQ ID:3422.

Another function of VGAM711 is therefore inhibition of P114-RHO-GEF (Accession NM_015318). Accordingly, utilities of VGAM711 include diagnosis, prevention and treatment of diseases and clinical conditions associated with P114-RHO-GEF. Protein Phosphatase 1, Regulatory (inhibitor) Subunit 16B (PPP1R16B, Accession XM_028840) is another VGAM711 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30770, to the nucleotide sequence of VGAM711 RNA, herein designated VGAM RNA, also designated SEQ ID:3422.

Another function of VGAM711 is therefore inhibition of Protein Phosphatase 1, Regulatory (inhibitor) Subunit 16B (PPP1R16B, Accession XM_028840). Accordingly, utilities of VGAM711 include diagnosis, prevention and treatment of diseases and clinical conditions associated with PPP1R16B. Retinoic Acid Induced 16 (RAI16, Accession NM_022749) is another VGAM711 host target gene. RAI16 BINDING SITE is HOST TARGET binding site found in the 3' untranslated region of mRNA encoded by RAI16, corresponding to a HOST TARGET binding site such as BINDING SITE I, BINDING SITE II or BINDING SITE III. Table 2 illustrates the complementarity of the nucleotide sequences of RAI16 BINDING SITE, designated SEQ ID:22969, to the nucleotide sequence of VGAM711 RNA, herein designated VGAM RNA, also designated SEQ ID:3422.

Another function of VGAM711 is therefore inhibition of Retinoic Acid Induced 16 (RAI16, Accession NM_022749). Accordingly, utilities of VGAM711 include diagnosis, prevention and treatment of diseases and clinical conditions associated with RAI16. T-cell Lymphoma Invasion and Metastasis 2 (TIAM2, Accession NM_012454) is another VGAM711 host target gene. TIAM2 BINDING SITE is HOST TARGET binding site found in the 3' untranslated region of mRNA encoded by TIAM2, corresponding to a HOST TARGET binding site such as BINDING SITE I, BINDING SITE II or BINDING SITE III. Table 2 illustrates the complementarity of the nucleotide sequences of TIAM2 BINDING SITE, designated SEQ ID:14824, to the nucleotide sequence of VGAM711 RNA, herein designated VGAM RNA, also designated SEQ ID:3422.

Another function of VGAM711 is therefore inhibition of T-cell Lymphoma Invasion and Metastasis 2 (TIAM2, Accession NM_012454). Accordingly, utilities of VGAM711 include diagnosis, prevention and treatment of diseases and clinical conditions associated with TIAM2. Translocase of Inner Mitochondrial Membrane 9 Homolog (yeast) (TIMM9, Accession NM_012460) is another VGAM711 host target gene. TIMM9 BINDING SITE is HOST TARGET binding site found in the 5' untranslated region of mRNA encoded by TIMM9, corresponding to a HOST TARGET binding site such as BINDING SITE I, BINDING SITE II or BINDING SITE III. Table 2 illustrates the complementarity of the nucleotide sequences of TIMM9 BINDING SITE, designated SEQ ID:14832, to the nucleotide sequence of VGAM711 RNA, herein designated VGAM RNA, also designated SEQ ID:3422.

Another function of VGAM711 is therefore inhibition of Translocase of Inner Mitochondrial Membrane 9 Homolog (yeast) (TIMM9, Accession NM_012460). Accordingly, utilities of VGAM711 include diagnosis, prevention and treatment of diseases and clinical conditions associated with TIMM9. LOC112868 (Accession XM_053402) is another VGAM711 host target gene. LOC112868 BINDING SITE is HOST TARGET binding site found in the 3' untranslated region of mRNA encoded by LOC112868, corresponding to a HOST TARGET binding site such as BINDING SITE I, BINDING SITE II or BINDING SITE III. Table 2 illustrates the complementarity of the nucleotide sequences of LOC112868 BINDING SITE, designated SEQ ID:36077, to the nucleotide sequence of VGAM711 RNA, herein designated VGAM RNA, also designated SEQ ID:3422.

Another function of VGAM711 is therefore inhibition of LOC112868 (Accession XM_053402). Accordingly, utilities of VGAM711 include diagnosis, prevention and treatment of diseases and clinical conditions associated with LOC112868. LOC116228 (Accession XM_057659) is another VGAM711 host target gene. LOC116228 BINDING SITE is HOST TARGET binding site found in the 3' untranslated region of mRNA encoded by LOC116228, corresponding to a HOST TARGET binding site such as BINDING SITE I, BINDING SITE II or BINDING SITE III. Table 2 illustrates the complementarity of the nucleotide sequences of LOC116228 BINDING SITE, designated SEQ ID:36534, to the nucleotide sequence of VGAM711 RNA, herein designated VGAM RNA, also designated SEQ ID:3422.

Another function of VGAM711 is therefore inhibition of LOC116228 (Accession XM_057659). Accordingly, utilities of VGAM711 include diagnosis, prevention and treatment of diseases and clinical conditions associated with LOC116228. LOC201910 (Accession XM_114403) is another VGAM711 host target gene. LOC201910 BINDING SITE is HOST TARGET binding site found in the 3' untranslated region of mRNA encoded by LOC201910, corresponding to a HOST TARGET binding site such as BINDING SITE I, BINDING SITE II or BINDING SITE III. Table 2 illustrates the complementarity of the nucleotide sequences of LOC201910 BINDING SITE, designated SEQ ID:42929, to the nucleotide sequence of VGAM711 RNA, herein designated VGAM RNA, also designated SEQ ID:3422.

Another function of VGAM711 is therefore inhibition of LOC201910 (Accession XM_114403). Accordingly, utilities of VGAM711 include diagnosis, prevention and treatment of diseases and clinical conditions associated with LOC201910. FIG. 1 further provides a conceptual description of a novel bioinformatically detected viral gene of the present invention, referred to here as Viral Genomic Address Messenger 712 (VGAM712) viral gene, which modulates expression of respective host target genes thereof, the function and utility of which host target genes is known in the art.

VGAM712 is a novel bioinformatically detected regulatory, non protein coding, viral micro RNA (miRNA) gene. The method by which VGAM712 was detected is described hereinabove with reference to FIGS. 1-8.

VGAM712 gene, herein designated VGAM GENE, is a viral gene contained in the genome of Pestivirus Type 2. VGAM712 host target gene, herein designated VGAM HOST TARGET GENE, is a human gene contained in the human genome.

VGAM712 gene encodes a VGAM712 precursor RNA, herein designated VGAM PRECURSOR RNA. Similar to other miRNA genes, and unlike most ordinary genes, VGAM712 precursor RNA does not encode a protein. A nucleotide sequence identical or highly similar to the nucleotide sequence of VGAM712 precursor RNA is designated SEQ ID:698, and is provided hereinbelow with reference to the sequence listing part. Nucleotide sequence SEQ ID:698 is located at position 2668 relative to the genome of Pestivirus Type 2.

VGAM712 precursor RNA folds onto itself, forming VGAM712 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM712 folded precursor RNA into VGAM712 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM712 RNA is designated SEQ ID:3423, and is provided hereinbelow with reference to the sequence listing part.

VGAM712 host target gene, herein designated VGAM HOST TARGET GENE, encodes a corresponding messenger RNA, VGAM712 host target RNA, herein designated VGAM HOST TARGET RNA. VGAM712 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM712 RNA, herein designated VGAM RNA, binds complementarily to one or more host target binding sites located in untranslated regions of VGAM712 host target RNA, herein designated VGAM HOST TARGET RNA. This complementary binding is due to the fact that the nucleotide sequence of VGAM712 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM712 RNA, herein designated VGAM RNA, may have a different number of host target binding sites in untranslated regions of a VGAM712 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM712 RNA, herein designated VGAM RNA, to host target binding sites on VGAM712 host target RNA, herein designated VGAM HOST TARGET RNA, such as BINDING SITE I, BINDING SITE II and BINDING SITE III, inhibits translation of VGAM712 host target RNA into VGAM712 host target protein, herein designated VGAM HOST TARGET PROTEIN. VGAM host target protein is therefore outlined by a broken line.

It is appreciated that VGAM712 host target gene, herein designated VGAM HOST TARGET GENE, in fact represents a plurality of VGAM712 host target genes. The mRNA of each one of this plurality of VGAM712 host target genes comprises one or more host target binding sites, each having a nucleotide sequence which is at least partly complementary to VGAM712 RNA, herein designated VGAM RNA, and which when bound by VGAM712 RNA causes inhibition of translation of respective one or more VGAM712 host target proteins.

It is further appreciated by one skilled in the art that the mode of translational inhibition illustrated by FIG. 1 with specific reference to translational inhibition exerted by VGAM712 gene, herein designated VGAM GENE, on one or more VGAM712 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM712 is inhibition of expression of host target genes, as part of a novel viral mechanism of attacking a host. Accordingly, utilities of VGAM712 include diagnosis, prevention and treatment of viral infection by Pestivirus Type 2. Specific functions, and accordingly utilities, of VGAM712 correlate with, and may be deduced from, the identity of the host target genes which VGAM712 binds and inhibits, and the function of these host target genes, as elaborated hereinbelow.

Nucleotide sequences of the VGAM712 precursor RNA, herein designated VGAM PRECURSOR RNA, and of the 'diced' VGAM712 RNA, herein designated VGAM RNA, and a schematic representation of the secondary folding of VGAM712 folded precursor RNA, herein designated VGAM FOLDED PRECURSOR RNA, of VGAM712 are further described hereinbelow with reference to Table 1.

Nucleotide sequences of host target binding sites, such as BINDING SITE-I, BINDING SITE-II and BINDING SITE-III of FIG. 1, found on VGAM712 host target RNA, and schematic representation of the complementarity of each of these host target binding sites to VGAM712 RNA, herein designated VGAM RNA, are described hereinbelow with reference to Table 2.

As mentioned hereinabove with reference to FIG. 1, a function of VGAM712 gene, herein designated VGAM is inhibition of expression of VGAM712 target genes. It is appreciated that specific functions, and accordingly utilities, of VGAM712 correlate with, and may be deduced from, the identity of the target genes which VGAM712 binds and inhibits, and the function of these target genes, as elaborated hereinbelow.

DKFZp566D234 (Accession XM_030162) is a VGAM712 host target gene. DKFZp566D234 BINDING SITE is HOST TARGET binding site found in the 5' untranslated region of mRNA encoded by DKFZp566D234, corresponding to a HOST TARGET binding site such as BINDING SITE I, BINDING SITE II or BINDING SITE III. Table 2 illustrates the complementarity of the nucleotide sequences of DKFZp566D234 BINDING SITE, designated SEQ ID:30991, to the nucleotide sequence of VGAM712 RNA, herein designated VGAM RNA, also designated SEQ ID:3423.

A function of VGAM712 is therefore inhibition of DKFZp566D234 (Accession XM_030162). Accordingly, utilities of VGAM712 include diagnosis, prevention and treatment of diseases and clinical conditions associated with DKFZp566D234. FIG. 1 further provides a conceptual description of a novel bioinformatically detected viral gene of the present invention, referred to here as Viral Genomic Address Messenger 713 (VGAM713) viral gene, which modulates expression of respective host target genes thereof, the function and utility of which host target genes is known in the art.

VGAM713 is a novel bioinformatically detected regulatory, non protein coding, viral micro RNA (miRNA) gene. The method by which VGAM713 was detected is described hereinabove with reference to FIGS. 1-8.

VGAM713 gene, herein designated VGAM GENE, is a viral gene contained in the genome of Bovine Herpesvirus 4. VGAM713 host target gene, herein designated VGAM HOST TARGET GENE, is a human gene contained in the human genome.

VGAM713 gene encodes a VGAM713 precursor RNA, herein designated VGAM PRECURSOR RNA. Similar to other miRNA genes, and unlike most ordinary genes, VGAM713 precursor RNA does not encode a protein. A nucleotide sequence identical or highly similar to the nucleotide sequence of VGAM713 precursor RNA is designated SEQ ID:699, and is provided hereinbelow with reference to the sequence listing part. Nucleotide sequence SEQ ID:699 is located at position 103800 relative to the genome of Bovine Herpesvirus 4.

VGAM713 precursor RNA folds onto itself, forming VGAM713 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM713 folded precursor RNA into VGAM713 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM713 RNA is designated SEQ ID:3424, and is provided hereinbelow with reference to the sequence listing part.

VGAM713 host target gene, herein designated VGAM HOST TARGET GENE, encodes a corresponding messenger RNA, VGAM713 host target RNA, herein designated VGAM HOST TARGET RNA. VGAM713 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM713 RNA, herein designated VGAM RNA, binds complementarily to one or more host target binding sites located in untranslated regions of VGAM713 host target RNA, herein designated VGAM HOST TARGET RNA. This complementary binding is due to the fact that the nucleotide sequence of VGAM713 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM713 RNA, herein designated VGAM RNA, may have a different number of host target binding sites in untranslated regions of a VGAM713 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM713 RNA, herein designated VGAM RNA, to host target binding sites on VGAM713 host target RNA, herein designated VGAM HOST TARGET RNA, such as BINDING SITE I, BINDING SITE II and BINDING SITE III, inhibits translation of VGAM713 host target RNA into VGAM713 host target protein, herein designated VGAM HOST TARGET PROTEIN. VGAM host target protein is therefore outlined by a broken line.

It is appreciated that VGAM713 host target gene, herein designated VGAM HOST TARGET GENE, in fact represents a plurality of VGAM713 host target genes. The mRNA of each one of this plurality of VGAM713 host target genes comprises one or more host target binding sites, each having a nucleotide sequence which is at least partly complementary to VGAM713 RNA, herein designated VGAM RNA, and which when bound by VGAM713 RNA causes inhibition of translation of respective one or more VGAM713 host target proteins.

It is further appreciated by one skilled in the art that the mode of translational inhibition illustrated by FIG. 1 with specific reference to translational inhibition exerted by VGAM713 gene, herein designated VGAM GENE, on one or more VGAM713 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM713 is inhibition of expression of host target genes, as part of a novel viral mechanism of attacking a host. Accordingly, utilities of VGAM713 include diagnosis, prevention and treatment of viral infection by Bovine Herpesvirus 4. Specific functions, and accordingly utilities, of VGAM713 correlate with, and may be deduced from, the identity of the host target genes which VGAM713 binds and inhibits, and the function of these host target genes, as elaborated hereinbelow.

Nucleotide sequences of the VGAM713 precursor RNA, herein designated VGAM PRECURSOR RNA, and of the 'diced' VGAM713 RNA, herein designated VGAM RNA, and a schematic representation of the secondary folding of VGAM713 folded precursor RNA, herein designated VGAM FOLDED PRECURSOR RNA, of VGAM713 are further described hereinbelow with reference to Table 1.

Nucleotide sequences of host target binding sites, such as BINDING SITE-I, BINDING SITE-II and BINDING SITE-III of FIG. 1, found on VGAM713 host target RNA, and schematic representation of the complementarity of each of these host target binding sites to VGAM713 RNA, herein designated VGAM RNA, are described hereinbelow with reference to Table 2.

As mentioned hereinabove with reference to FIG. 1, a function of VGAM713 gene, herein designated VGAM is inhibition of expression of VGAM713 target genes. It is appreciated that specific functions, and accordingly utilities, of VGAM713 correlate with, and may be deduced from, the identity of the target genes which VGAM713 binds and inhibits, and the function of these target genes, as elaborated hereinbelow.

Core-binding Factor, Runt Domain, Alpha Subunit 2; Translocated To, 1; Cyclin D-related (CBFA2T1, Accession NM_004349) is a VGAM713 host target gene. CBFA2T1 BINDING SITE is HOST TARGET binding site found in the 3' untranslated region of mRNA encoded by CBFA2T1, corresponding to a HOST TARGET binding site such as BINDING SITE I, BINDING SITE II or BINDING SITE III. Table 2 illustrates the complementarity of the nucleotide sequences of CBFA2T1 BINDING SITE, designated SEQ ID:10544, to the nucleotide sequence of VGAM713 RNA, herein designated VGAM RNA, also designated SEQ ID:3424.

A function of VGAM713 is therefore inhibition of Core-binding Factor, Runt Domain, Alpha Subunit 2; Translocated To, 1; Cyclin D-related (CBFA2T1, Accession NM_004349), a gene which produces a chimeric gene made up of the 5-prime region of the AML1 gene fused to the 3-prime region of the ETO gene through translocation. Accordingly, utilities of VGAM713 include diagnosis, prevention and treatment of diseases and clinical conditions associated with CBFA2T1. The function of CBFA2T1 and its association with various diseases and clinical conditions, has been established by previous studies, as described hereinabove with reference to VGAM113. Diacylglycerol O-acyltransferase Homolog 2 (mouse) (DGAT2, Accession NM_032564) is another VGAM713 host target gene. DGAT2 BINDING SITE is HOST TARGET binding site found in the 3' untranslated region of mRNA encoded by DGAT2, corresponding to a HOST TARGET binding site such as BINDING SITE I, BINDING SITE II or BINDING SITE III. Table 2 illustrates the complementarity of the nucleotide sequences of DGAT2 BINDING SITE, designated SEQ ID:26293, to the nucleotide sequence of VGAM713 RNA, herein designated VGAM RNA, also designated SEQ ID:3424.

Another function of VGAM713 is therefore inhibition of Diacylglycerol O-acyltransferase Homolog 2 (mouse) (DGAT2, Accession NM_032564). Accordingly, utilities of VGAM713 include diagnosis, prevention and treatment of diseases and clinical conditions associated with DGAT2. Interleukin 24 (IL24, Accession NM_006850) is another VGAM713 host target gene. IL24 BINDING SITE is HOST TARGET binding site found in the 3' untranslated region of mRNA encoded by IL24, corresponding to a HOST TARGET binding site such as BINDING SITE I, BINDING SITE II or BINDING SITE III. Table 2 illustrates the complementarity of the nucleotide sequences of IL24 BINDING SITE, designated SEQ ID:13721, to the nucleotide sequence of VGAM713 RNA, herein designated VGAM RNA, also designated SEQ ID:3424.

Another function of VGAM713 is therefore inhibition of Interleukin 24 (IL24, Accession NM_006850), a gene which may contribute to terminal cell differentiation. Accordingly, utilities of VGAM713 include diagnosis, prevention and treatment of diseases and clinical conditions associated with IL24. The function of IL24 and its association with various diseases and clinical conditions, has been established by previous studies, as described hereinabove with reference to VGAM258. Microtubule-associated Protein, RP/EB Family, Member 1 (MAPRE1, Accession NM_012325) is another VGAM713 host target gene. MAPRE1 BINDING SITE is HOST TARGET binding site found in the 3' untranslated region of mRNA encoded by MAPRE1, corresponding to a HOST TARGET binding site such as BINDING SITE I, BINDING SITE II or BINDING SITE III. Table 2 illustrates the complementarity of the nucleotide sequences of MAPRE1 BINDING SITE, designated SEQ ID:14707, to the nucleotide sequence of VGAM713 RNA, herein designated VGAM RNA, also designated SEQ ID:3424.

Another function of VGAM713 is therefore inhibition of Microtubule-associated Protein, RP/EB Family, Member 1 (MAPRE1, Accession NM_012325). Accordingly, utilities of VGAM713 include diagnosis, prevention and treatment of diseases and clinical conditions associated with MAPRE1. Neogenin Homolog 1 (chicken) (NEO1, Accession NM_002499) is another VGAM713 host target gene. NEO1 BINDING SITE is HOST TARGET binding site found in the 3' untranslated region of mRNA encoded by NEO1, corresponding to a HOST TARGET binding site such as BINDING SITE I, BINDING SITE II or BINDING SITE III. Table 2 illustrates the complementarity of the nucleotide sequences of NEO1 BINDING SITE, designated SEQ ID:8316, to the nucleotide sequence of VGAM713 RNA, herein designated VGAM RNA, also designated SEQ ID:3424.

Another function of VGAM713 is therefore inhibition of Neogenin Homolog 1 (chicken) (NEO1, Accession NM_002499), a gene which regulates the transition of undifferentiated proliferating cells to their differentiated state. Accordingly, utilities of VGAM713 include diagnosis, prevention and treatment of diseases and clinical conditions associated with NEO1. The function of NEO1 and its association with various diseases and clinical conditions, has been established by previous studies, as described hereinabove with reference to VGAM329. Phosphotriesterase Related (PTER, Accession NM_030664) is another VGAM713 host target gene. PTER BINDING SITE is HOST TARGET binding site found in the 3' untranslated region of mRNA encoded by PTER, corresponding to a HOST TARGET binding site such as BINDING SITE I, BINDING SITE II or BINDING SITE III. Table 2 illustrates the complementarity of the nucleotide sequences of PTER BINDING SITE, designated SEQ ID:25000, to the nucleotide sequence of VGAM713 RNA, herein designated VGAM RNA, also designated SEQ ID:3424.

Another function of VGAM713 is therefore inhibition of Phosphotriesterase Related (PTER, Accession NM_030664), a gene which is a phosphotriesterase homology protein. Accordingly, utilities of VGAM713 include diagnosis, prevention and treatment of diseases and clinical conditions associated with PTER. The function of PTER has been established by previous studies. Microbial phosphotriesterases are a group of zinc metalloenzymes that catalyze the hydrolysis of a range of phosphotriester compounds. Davies et al. (1997) isolated rat cDNAs encoding a phosphotriesterase homolog, which they named rpr1. Using a rat rpr1 cDNA as a hybridization probe, Alimova-Kost et al. (1998) isolated human genomic sequences of PTER, a homolog of phosphotriesterases. By FISH, Alimova-Kost et al. (1998) mapped the human PTER gene to 10p12

Full details of the abovementioned studies are described in the following publications, the disclosure of which are hereby incorporated by reference:

Alimova-Kost, M. V.; Imreh, S.; Buchman, V. L.; Ninkina, N. N.: Assignment of phosphotriesterase-related gene (PTER) to human chromosome band 10p12 by in situ hybridization. Cytogenet. Cell Genet. 83:16-17, 1998; and Davies, J. A.; Buchman, V. L.; Krylova, O.; Ninkina, N. N.: Molecular cloning and expression pattern of rpr-1, a resiniferatoxin-binding, phosphotriesterase-related protein, expressed.

Further studies establishing the function and utilities of PTER are found in John Hopkins OMIM database record ID 604446, and in sited publications numbered 1096-1097 listed in the bibliography section hereinbelow, which are also hereby incorporated by reference. Recombination Activating Gene 1 (RAG1, Accession NM_000448) is another VGAM713 host target gene. RAG1 BINDING SITE is HOST TARGET binding site found in the 3' untranslated region of mRNA encoded by RAG1, corresponding to a HOST TARGET binding site such as BINDING SITE I, BINDING SITE II or BINDING SITE III. Table 2 illustrates the complementarity of the nucleotide sequences of RAG1 BINDING SITE, designated SEQ ID:6041, to the nucleotide sequence of VGAM713 RNA, herein designated VGAM RNA, also designated SEQ ID:3424.

Another function of VGAM713 is therefore inhibition of Recombination Activating Gene 1 (RAG1, Accession NM_000448). Accordingly, utilities of VGAM713 include diagnosis, prevention and treatment of diseases and clinical conditions associated with RAG1. Sirtuin Silent Mating Type Information Regulation 2 Homolog 3 (S. cerevisiae) (SIRT3, Accession NM_012239) is another VGAM713 host target gene. SIRT3 BINDING SITE is HOST TARGET binding site found in the 3' untranslated region of mRNA encoded by SIRT3, corresponding to a HOST TARGET binding site such as BINDING SITE I, BINDING SITE II or BINDING SITE III. Table 2 illustrates the complementarity of the nucleotide sequences of SIRT3 BINDING SITE, designated SEQ ID:14546, to the nucleotide sequence of VGAM713 RNA, herein designated VGAM RNA, also designated SEQ ID:3424.

Another function of VGAM713 is therefore inhibition of Sirtuin Silent Mating Type Information Regulation 2 Homolog 3 (S. cerevisiae) (SIRT3, Accession NM_012239), a gene which might function in telomeric silencing, cell cycle progression and chromosome stability. Accordingly, utilities of VGAM713 include diagnosis, prevention and treatment of diseases and clinical conditions associated with SIRT3. The function of SIRT3 and its association with various diseases and clinical conditions, has been established by previous studies, as described hereinabove with reference to VGAM140. Spondin 1, (f-spondin) Extracellular Matrix Protein (SPON1, Accession XM_031184) is another VGAM713 host target gene. SPON1 BINDING SITE is HOST TARGET binding site found in the 3' untranslated region of mRNA encoded by SPON1, corresponding to a HOST TARGET binding site such as BINDING SITE I, BINDING SITE II or BINDING SITE III. Table 2 illustrates the complementarity of the nucleotide sequences of SPON1 BINDING SITE, designated SEQ ID:31305, to the nucleotide sequence of VGAM713 RNA, herein designated VGAM RNA, also designated SEQ ID:3424.

Another function of VGAM713 is therefore inhibition of Spondin 1, (f-spondin) Extracellular Matrix Protein (SPON1, Accession XM_031184). Accordingly, utilities of VGAM713 include diagnosis, prevention and treatment of diseases and clinical conditions associated with SPON1. Zinc Finger Protein 74 (Cos52) (ZNF74, Accession NM_003426) is another VGAM713 host target gene. ZNF74 BINDING SITE is HOST TARGET binding site found in the 3' untranslated region of mRNA encoded by ZNF74, corresponding to a HOST TARGET binding site such as BINDING SITE I, BINDING SITE II or BINDING SITE III. Table 2 illustrates the complementarity of the nucleotide sequences of ZNF74 BINDING SITE, designated SEQ ID:9473, to the nucleotide sequence of VGAM713 RNA, herein designated VGAM RNA, also designated SEQ ID:3424.

Another function of VGAM713 is therefore inhibition of Zinc Finger Protein 74 (Cos52) (ZNF74, Accession NM_003426). Accordingly, utilities of VGAM713 include diagnosis, prevention and treatment of diseases and clinical conditions associated with ZNF74. Chromosome 21 Open Reading Frame 69 (C21orf69, Accession NM_058189) is another VGAM713 host target gene. C21orf69 BINDING SITE is HOST TARGET binding site found in the 5' untranslated region of mRNA encoded by C21orf69, corresponding to a HOST TARGET binding site such as BINDING SITE I, BINDING SITE II or BINDING SITE III. Table 2 illustrates the complementarity of the nucleotide sequences of C21orf69 BINDING SITE, designated SEQ ID:27752, to the nucleotide sequence of VGAM713 RNA, herein designated VGAM RNA, also designated SEQ ID:3424.

Another function of VGAM713 is therefore inhibition of Chromosome 21 Open Reading Frame 69 (C21orf69, Accession NM_058189). Accordingly, utilities of VGAM713 include diagnosis, prevention and treatment of diseases and clinical conditions associated with C21orf69. Choline Kinase (CHK, Accession NM_001277) is another VGAM713 host target gene. CHK BINDING SITE is HOST TARGET binding site found in the 3" untranslated region of mRNA encoded by CHK, corresponding to a HOST TARGET binding site such as BINDING SITE I, BINDING SITE II or BINDING SITE III. Table 2 illustrates the complementarity of the nucleotide sequences of CHK BINDING SITE, designated SEQ ID:6946, to the nucleotide sequence of VGAM713 RNA, herein designated VGAM RNA, also designated SEQ ID:3424.

Another function of VGAM713 is therefore inhibition of Choline Kinase (CHK, Accession NM_001277). Accordingly, utilities of VGAM713 include diagnosis, prevention and treatment of diseases and clinical conditions associated with CHK. DKFZP434N1235 (Accession NM_031291) is another VGAM713 host target gene. DKFZP434N1235 BINDING SITE is HOST TARGET binding site found in the 3' untranslated region of mRNA encoded by DKFZP434N1235, corresponding to a HOST TARGET binding site such as BINDING SITE I, BINDING SITE II or BINDING SITE III. Table 2 illustrates the complementarity of the nucleotide sequences of DKFZP434N1235 BINDING SITE, designated SEQ ID:25313, to the nucleotide sequence of VGAM713 RNA, herein designated VGAM RNA, also designated SEQ ID:3424.

Another function of VGAM713 is therefore inhibition of DKFZP434N1235 (Accession NM_031291). Accordingly, utilities of VGAM713 include diagnosis, prevention and treatment of diseases and clinical conditions associated with DKFZP434N1235. DKFZp547H025 (Accession NM_020161) is another VGAM713 host target gene. DKFZp547H025 BINDING SITE is HOST TARGET binding site found in the 3' untranslated region of mRNA encoded by DKFZp547H025, corresponding to a HOST TARGET binding site such as BINDING SITE I, BINDING SITE II or BINDING SITE III. Table 2 illustrates the complementarity of the nucleotide sequences of DKFZp547H025 BINDING SITE, designated SEQ ID:21376, to the nucleotide sequence of VGAM713 RNA, herein designated VGAM RNA, also designated SEQ ID:3424.

Another function of VGAM713 is therefore inhibition of DKFZp547H025 (Accession NM_020161). Accordingly, utilities of VGAM713 include diagnosis, prevention and treatment of diseases and clinical conditions associated with DKFZp547H025. DRIL2 (Accession NM_006465) is another VGAM713 host target gene. DRIL2 BINDING SITE is HOST TARGET binding site found in the 3' untranslated region of mRNA encoded by DRIL2, corresponding to a HOST TARGET binding site such as BINDING SITE I, BINDING SITE II or BINDING SITE III. Table 2 illustrates the complementarity of the nucleotide sequences of DRIL2 BINDING SITE, designated SEQ ID:13192, to the nucleotide sequence of VGAM713 RNA, herein designated VGAM RNA, also designated SEQ ID:3424.

Another function of VGAM713 is therefore inhibition of DRIL2 (Accession NM_006465). Accordingly, utilities of VGAM713 include diagnosis, prevention and treatment of diseases and clinical conditions associated with DRIL2. FLJ12294 (Accession NM_025100) is another VGAM713 host target gene. FLJ12294 BINDING SITE is HOST TARGET binding site found in the 3' untranslated region of mRNA encoded by FLJ12294, corresponding to a HOST TARGET binding site such as BINDING SITE I, BINDING SITE II or BINDING SITE III. Table 2 illustrates the complementarity of the nucleotide sequences of FLJ12294 BINDING SITE, designated SEQ ID:24745, to the nucleotide sequence of VGAM713 RNA, herein designated VGAM RNA, also designated SEQ ID:3424.

Another function of VGAM713 is therefore inhibition of FLJ12294 (Accession NM_025100). Accordingly, utilities of VGAM713 include diagnosis, prevention and treatment of diseases and clinical conditions associated with FLJ12294. FLJ12476 (Accession NM_022784) is another VGAM713 host target gene. FLJ12476 BINDING SITE is HOST TARGET binding site found in the 5' untranslated region of mRNA encoded by FLJ12476, corresponding to a HOST TARGET binding site such as BINDING SITE I, BINDING SITE II or BINDING SITE III. Table 2 illustrates the complementarity of the nucleotide sequences of FLJ12476 BINDING SITE, designated SEQ ID:23068, to the nucleotide sequence of VGAM713 RNA, herein designated VGAM RNA, also designated SEQ ID:3424.

Another function of VGAM713 is therefore inhibition of FLJ12476 (Accession NM_022784). Accordingly, utilities of VGAM713 include diagnosis, prevention and treatment of diseases and clinical conditions associated with FLJ12476.

FLJ14525 (Accession NM_032800) is another VGAM713 host target gene. FLJ14525 BINDING SITE is HOST TARGET binding site found in the 3' untranslated region of mRNA encoded by FLJ14525, corresponding to a HOST TARGET binding site such as BINDING SITE I, BINDING SITE II or BINDING SITE III. Table 2 illustrates the complementarity of the nucleotide sequences of FLJ14525 BINDING SITE, designated SEQ ID:26551, to the nucleotide sequence of VGAM713 RNA, herein designated VGAM RNA, also designated SEQ ID:3424.

Another function of VGAM713 is therefore inhibition of FLJ14525 (Accession NM_032800). Accordingly, utilities of VGAM713 include diagnosis, prevention and treatment of diseases and clinical conditions associated with FLJ14525. FLJ20511 (Accession NM_017853) is another VGAM713 host target gene. FLJ20511 BINDING SITE is HOST TARGET binding site found in the 3' untranslated region of mRNA encoded by FLJ20511, corresponding to a HOST TARGET binding site such as BINDING SITE I, BINDING SITE II or BINDING SITE III. Table 2 illustrates the complementarity of the nucleotide sequences of FLJ20511 BINDING SITE, designated SEQ ID:19528, to the nucleotide sequence of VGAM713 RNA, herein designated VGAM RNA, also designated SEQ ID:3424.

Another function of VGAM713 is therefore inhibition of FLJ20511 (Accession NM_017853). Accordingly, utilities of VGAM713 include diagnosis, prevention and treatment of diseases and clinical conditions associated with FLJ20511. FLJ23120 (Accession XM_097961) is another VGAM713 host target gene. FLJ23120 BINDING SITE is HOST TARGET binding site found in the 3' untranslated region of mRNA encoded by FLJ23120, corresponding to a HOST TARGET binding site such as BINDING SITE I, BINDING SITE II or BINDING SITE III. Table 2 illustrates the complementarity of the nucleotide sequences of FLJ23120 BINDING SITE, designated SEQ ID:41264, to the nucleotide sequence of VGAM713 RNA, herein designated VGAM RNA, also designated SEQ ID:3424.

Another function of VGAM713 is therefore inhibition of FLJ23120 (Accession XM_097961). Accordingly, utilities of VGAM713 include diagnosis, prevention and treatment of diseases and clinical conditions associated with FLJ23120. FLJ31951 (Accession NM_144726) is another VGAM713 host target gene. FLJ31951 BINDING SITE is HOST TARGET binding site found in the 3' untranslated region of mRNA encoded by FLJ31951, corresponding to a HOST TARGET binding site such as BINDING SITE I, BINDING SITE II or BINDING SITE III. Table 2 illustrates the complementarity of the nucleotide sequences of FLJ31951 BINDING SITE, designated SEQ ID:29552, to the nucleotide sequence of VGAM713 RNA, herein designated VGAM RNA, also designated SEQ ID:3424.

Another function of VGAM713 is therefore inhibition of FLJ31951 (Accession NM_144726). Accordingly, utilities of VGAM713 include diagnosis, prevention and treatment of diseases and clinical conditions associated with FLJ31951. KIAA0317 (Accession NM_014821) is another VGAM713 host target gene. KIAA0317 BINDING SITE is HOST TARGET binding site found in the 3' untranslated region of mRNA encoded by KIAA0317, corresponding to a HOST TARGET binding site such as BINDING SITE I, BINDING SITE II or BINDING SITE III. Table 2 illustrates the complementarity of the nucleotide sequences of KIAA0317 BINDING SITE, designated SEQ ID:16798, to the nucleotide sequence of VGAM713 RNA, herein designated VGAM RNA, also designated SEQ ID:3424.

Another function of VGAM713 is therefore inhibition of KIAA0317 (Accession NM_014821). Accordingly, utilities of VGAM713 include diagnosis, prevention and treatment of diseases and clinical conditions associated with KIAA0317. KIAA0321 (Accession XM_031077) is another VGAM713 host target gene. KIAA0321 BINDING SITE is HOST TARGET binding site found in the 5' untranslated region of mRNA encoded by KIAA0321, corresponding to a HOST TARGET binding site such as BINDING SITE I, BINDING SITE II or BINDING SITE III. Table 2 illustrates the complementarity of the nucleotide sequences of KIAA0321 BINDING SITE, designated SEQ ID:31269, to the nucleotide sequence of VGAM713 RNA, herein designated VGAM RNA, also designated SEQ ID:3424.

Another function of VGAM713 is therefore inhibition of KIAA0321 (Accession XM_031077). Accordingly, utilities of VGAM713 include diagnosis, prevention and treatment of diseases and clinical conditions associated with KIAA0321. KIAA0523 (Accession XM_041964) is another VGAM713 host target gene. KIAA0523 BINDING SITE is HOST TARGET binding site found in the 3' untranslated region of mRNA encoded by KIAA0523, corresponding to a HOST TARGET binding site such as BINDING SITE I, BINDING SITE II or BINDING SITE III. Table 2 illustrates the complementarity of the nucleotide sequences of KIAA0523 BINDING SITE, designated SEQ ID:33647, to the nucleotide sequence of VGAM713 RNA, herein designated VGAM RNA, also designated SEQ ID:3424.

Another function of VGAM713 is therefore inhibition of KIAA0523 (Accession XM_041964). Accordingly, utilities of VGAM713 include diagnosis, prevention and treatment of diseases and clinical conditions associated with KIAA0523. KIAA1598 (Accession NM_018330) is another VGAM713 host target gene. KIAA1598 BINDING SITE is HOST TARGET binding site found in the 3' untranslated region of mRNA encoded by KIAA1598, corresponding to a HOST TARGET binding site such as BINDING SITE I, BINDING SITE II or BINDING SITE III. Table 2 illustrates the complementarity of the nucleotide sequences of KIAA1598 BINDING SITE, designated SEQ ID:20330, to the nucleotide sequence of VGAM713 RNA, herein designated VGAM RNA, also designated SEQ ID:3424.

Another function of VGAM713 is therefore inhibition of KIAA1598 (Accession NM_018330). Accordingly, utilities of VGAM713 include diagnosis, prevention and treatment of diseases and clinical conditions associated with KIAA1598. KIAA1607 (Accession XM_033379) is another VGAM713 host target gene. KIAA1607 BINDING SITE is HOST TARGET binding site found in the 3' untranslated region of mRNA encoded by KIAA1607, corresponding to a HOST TARGET binding site such as BINDING SITE I, BINDING SITE II or BINDING SITE III. Table 2 illustrates the complementarity of the nucleotide sequences of KIAA1607 BINDING SITE, designated SEQ ID:31914, to the nucleotide sequence of VGAM713 RNA, herein designated VGAM RNA, also designated SEQ ID:3424.

Another function of VGAM713 is therefore inhibition of KIAA1607 (Accession XM_033379). Accordingly, utilities of VGAM713 include diagnosis, prevention and treatment of diseases and clinical conditions associated with KIAA1607. KIAA1911 (Accession XM_056302) is another VGAM713 host target gene. KIAA1911 BINDING SITE is HOST TARGET binding site found in the 3' untranslated region of mRNA encoded by KIAA1911, corresponding to a HOST TARGET binding site such as BINDING SITE I, BINDING SITE II or BINDING SITE III. Table 2 illustrates the complementarity of the nucleotide sequences of KIAA1911 BIND- ING SITE, designated SEQ ID:36394, to the nucleotide sequence of VGAM713 RNA, herein designated VGAM RNA, also designated SEQ ID:3424.

Another function of VGAM713 is therefore inhibition of KIAA1911 (Accession XM_056302). Accordingly, utilities of VGAM713 include diagnosis, prevention and treatment of diseases and clinical conditions associated with KIAA1911. MGC10818 (Accession NM_030568) is another VGAM713 host target gene. MGC10818 BINDING SITE is HOST TARGET binding site found in the 3' untranslated region of mRNA encoded by MGC10818, corresponding to a HOST TARGET binding site such as BINDING SITE I, BINDING SITE II or BINDING SITE III. Table 2 illustrates the complementarity of the nucleotide sequences of MGC10818 BINDING SITE, designated SEQ ID:24941, to the nucleotide sequence of VGAM713 RNA, herein designated VGAM RNA, also designated SEQ ID:3424.

Another function of VGAM713 is therefore inhibition of MGC10818 (Accession NM_030568). Accordingly, utilities of VGAM713 include diagnosis, prevention and treatment of diseases and clinical conditions associated with MGC10818. Monocyte to Macrophage Differentiation-associated (MMD, Accession XM_008269) is another VGAM713 host target gene. MMD BINDING SITE is HOST TARGET binding site found in the 3' untranslated region of mRNA encoded by MMD, corresponding to a HOST TARGET binding site such as BINDING SITE I, BINDING SITE II or BINDING SITE III. Table 2 illustrates the complementarity of the nucleotide sequences of MMD BINDING SITE, designated SEQ ID:30076, to the nucleotide sequence of VGAM713 RNA, herein designated VGAM RNA, also designated SEQ ID:3424.

Another function of VGAM713 is therefore inhibition of Monocyte to Macrophage Differentiation-associated (MMD, Accession XM_008269). Accordingly, utilities of VGAM713 include diagnosis, prevention and treatment of diseases and clinical conditions associated with MMD. RAP2B, Member of RAS Oncogene Family (RAP2B, Accession XM_171061) is another VGAM713 host target gene. RAP2B BINDING SITE is HOST TARGET binding site found in the 3" untranslated region of mRNA encoded by RAP2B, corresponding to a HOST TARGET binding site such as BINDING SITE I, BINDING SITE II or BINDING SITE III. Table 2 illustrates the complementarity of the nucleotide sequences of RAP2B BINDING SITE, designated SEQ ID:45862, to the nucleotide sequence of VGAM713 RNA, herein designated VGAM RNA, also designated SEQ ID:3424.

Another function of VGAM713 is therefore inhibition of RAP2B, Member of RAS Oncogene Family (RAP2B, Accession XM_171061). Accordingly, utilities of VGAM713 include diagnosis, prevention and treatment of diseases and clinical conditions associated with RAP2B. SEC15B (Accession XM_039570) is another VGAM713 host target gene. SEC15B BINDING SITE is HOST TARGET binding site found in the 3' untranslated region of mRNA encoded by SEC15B, corresponding to a HOST TARGET binding site such as BINDING SITE I, BINDING SITE II or BINDING SITE III. Table 2 illustrates the complementarity of the nucleotide sequences of SEC15B BINDING SITE, designated SEQ ID:33130, to the nucleotide sequence of VGAM713 RNA, herein designated VGAM RNA, also designated SEQ ID:3424.

Another function of VGAM713 is therefore inhibition of SEC15B (Accession XM_039570). Accordingly, utilities of VGAM713 include diagnosis, prevention and treatment of diseases and clinical conditions associated with SEC15B.

Tripartite Motif-containing 26 (TRIM26, Accession NM_003449) is another VGAM713 host target gene. TRIM26 BINDING SITE is HOST TARGET binding site found in the 3' untranslated region of mRNA encoded by TRIM26, corresponding to a HOST TARGET binding site such as BINDING SITE I, BINDING SITE II or BINDING SITE III. Table 2 illustrates the complementarity of the nucleotide sequences of TRIM26 BINDING SITE, designated SEQ ID:9500, to the nucleotide sequence of VGAM713 RNA, herein designated VGAM RNA, also designated SEQ ID:3424.

Another function of VGAM713 is therefore inhibition of Tripartite Motif-containing 26 (TRIM26, Accession NM_003449). Accordingly, utilities of VGAM713 include diagnosis, prevention and treatment of diseases and clinical conditions associated with TRIM26. TU3A (Accession NM_007177) is another VGAM713 host target gene. TU3A BINDING SITE is HOST TARGET binding site found in the 5' untranslated region of mRNA encoded by TU3A, corresponding to a HOST TARGET binding site such as BINDING SITE I, BINDING SITE II or BINDING SITE III. Table 2 illustrates the complementarity of the nucleotide sequences of TU3A BINDING SITE, designated SEQ ID:14037, to the nucleotide sequence of VGAM713 RNA, herein designated VGAM RNA, also designated SEQ ID:3424.

Another function of VGAM713 is therefore inhibition of TU3A (Accession NM_007177). Accordingly, utilities of VGAM713 include diagnosis, prevention and treatment of diseases and clinical conditions associated with TU3A. ZER6 (Accession XM_032742) is another VGAM713 host target gene. ZER6 BINDING SITE is HOST TARGET binding site found in the 3' untranslated region of mRNA encoded by ZER6, corresponding to a HOST TARGET binding site such as BINDING SITE I, BINDING SITE II or BINDING SITE III. Table 2 illustrates the complementarity of the nucleotide sequences of ZER6 BINDING SITE, designated SEQ ID:31743, to the nucleotide sequence of VGAM713 RNA, herein designated VGAM RNA, also designated SEQ ID:3424.

Another function of VGAM713 is therefore inhibition of ZER6 (Accession XM_032742). Accordingly, utilities of VGAM713 include diagnosis, prevention and treatment of diseases and clinical conditions associated with ZER6. Zinc Finger Protein 337 (ZNF337, Accession XM_042807) is another VGAM713 host target gene. ZNF337 BINDING SITE is HOST TARGET binding site found in the 3' untranslated region of mRNA encoded by ZNF337, corresponding to a HOST TARGET binding site such as BINDING SITE I, BINDING SITE II or BINDING SITE III. Table 2 illustrates the complementarity of the nucleotide sequences of ZNF337 BINDING SITE, designated SEQ ID:33772, to the nucleotide sequence of VGAM713 RNA, herein designated VGAM RNA, also designated SEQ ID:3424.

Another function of VGAM713 is therefore inhibition of Zinc Finger Protein 337 (ZNF337, Accession XM_042807). Accordingly, utilities of VGAM713 include diagnosis, prevention and treatment of diseases and clinical conditions associated with ZNF337. LOC127702 (Accession XM_060619) is another VGAM713 host target gene. LOC127702 BINDING SITE is HOST TARGET binding site found in the 3' untranslated region of mRNA encoded by LOC127702, corresponding to a HOST TARGET binding site such as BINDING SITE I, BINDING SITE II or BINDING SITE III. Table 2 illustrates the complementarity of the nucleotide sequences of LOC127702 BINDING SITE, designated SEQ ID:37184, to the nucleotide sequence of VGAM713 RNA, herein designated VGAM RNA, also designated SEQ ID:3424.

Another function of VGAM713 is therefore inhibition of LOC127702 (Accession XM_060619). Accordingly, utilities of VGAM713 include diagnosis, prevention and treatment of diseases and clinical conditions associated with LOC127702. LOC146669 (Accession XM_085534) is another VGAM713 host target gene. LOC146669 BINDING SITE is HOST TARGET binding site found in the 3' untranslated region of mRNA encoded by LOC146669, corresponding to a HOST TARGET binding site such as BINDING SITE I, BINDING SITE II or BINDING SITE III. Table 2 illustrates the complementarity of the nucleotide sequences of LOC146669 BINDING SITE, designated SEQ ID:38224, to the nucleotide sequence of VGAM713 RNA, herein designated VGAM RNA, also designated SEQ ID:3424.

Another function of VGAM713 is therefore inhibition of LOC146669 (Accession XM_085534). Accordingly, utilities of VGAM713 include diagnosis, prevention and treatment of diseases and clinical conditions associated with LOC146669. LOC146856 (Accession XM_096086) is another VGAM713 host target gene. LOC146856 BINDING SITE is HOST TARGET binding site found in the 5' untranslated region of mRNA encoded by LOC146856, corresponding to a HOST TARGET binding site such as BINDING SITE I, BINDING SITE II or BINDING SITE III. Table 2 illustrates the complementarity of the nucleotide sequences of LOC146856 BINDING SITE, designated SEQ ID:40300, to the nucleotide sequence of VGAM713 RNA, herein designated VGAM RNA, also designated SEQ ID:3424.

Another function of VGAM713 is therefore inhibition of LOC146856 (Accession XM_096086). Accordingly, utilities of VGAM713 include diagnosis, prevention and treatment of diseases and clinical conditions associated with LOC146856. LOC150225 (Accession XM_097870) is another VGAM713 host target gene. LOC150225 BINDING SITE is HOST TARGET binding site found in the 3' untranslated region of mRNA encoded by LOC150225, corresponding to a HOST TARGET binding site such as BINDING SITE I, BINDING SITE II or BINDING SITE III. Table 2 illustrates the complementarity of the nucleotide sequences of LOC150225 BINDING SITE, designated SEQ ID:41192, to the nucleotide sequence of VGAM713 RNA, herein designated VGAM RNA, also designated SEQ ID:3424.

Another function of VGAM713 is therefore inhibition of LOC150225 (Accession XM_097870). Accordingly, utilities of VGAM713 include diagnosis, prevention and treatment of diseases and clinical conditions associated with LOC150225. LOC150406 (Accession XM_086908) is another VGAM713 host target gene. LOC150406 BINDING SITE is HOST TARGET binding site found in the 3' untranslated region of mRNA encoded by LOC150406, corresponding to a HOST TARGET binding site such as BINDING SITE I, BINDING SITE II or BINDING SITE III. Table 2 illustrates the complementarity of the nucleotide sequences of LOC150406 BINDING SITE, designated SEQ ID:38965, to the nucleotide sequence of VGAM713 RNA, herein designated VGAM RNA, also designated SEQ ID:3424.

Another function of VGAM713 is therefore inhibition of LOC150406 (Accession XM_086908). Accordingly, utilities of VGAM713 include diagnosis, prevention and treatment of diseases and clinical conditions associated with LOC150406. LOC152300 (Accession XM_087432) is another VGAM713 host target gene. LOC152300 BINDING SITE is HOST TARGET binding site found in the 3' untranslated region of mRNA encoded by LOC152300, corresponding to a HOST TARGET binding site such as BINDING SITE I, BINDING SITE II or BINDING SITE III. Table 2 illustrates the complementarity of the nucleotide sequences of LOC152300 BINDING SITE, designated SEQ ID:39253, to the nucleotide sequence of VGAM713 RNA, herein designated VGAM RNA, also designated SEQ ID:3424.

Another function of VGAM713 is therefore inhibition of LOC152300 (Accession XM_087432). Accordingly, utilities of VGAM713 include diagnosis, prevention and treatment of diseases and clinical conditions associated with LOC152300. LOC154790 (Accession XM_088044) is another VGAM713 host target gene. LOC154790 BINDING SITE is HOST TARGET binding site found in the 5' untranslated region of mRNA encoded by LOC154790, corresponding to a HOST TARGET binding site such as BINDING SITE I, BINDING SITE II or BINDING SITE III. Table 2 illustrates the complementarity of the nucleotide sequences of LOC154790 BINDING SITE, designated SEQ ID:39491, to the nucleotide sequence of VGAM713 RNA, herein designated VGAM RNA, also designated SEQ ID:3424.

Another function of VGAM713 is therefore inhibition of LOC154790 (Accession XM_088044). Accordingly, utilities of VGAM713 include diagnosis, prevention and treatment of diseases and clinical conditions associated with LOC154790. LOC155081 (Accession XM_088145) is another VGAM713 host target gene. LOC155081 BINDING SITE is HOST TARGET binding site found in the 3' untranslated region of mRNA encoded by LOC155081, corresponding to a HOST TARGET binding site such as BINDING SITE I, BINDING SITE II or BINDING SITE III. Table 2 illustrates the complementarity of the nucleotide sequences of LOC155081 BINDING SITE, designated SEQ ID:39544, to the nucleotide sequence of VGAM713 RNA, herein designated VGAM RNA, also designated SEQ ID:3424.

Another function of VGAM713 is therefore inhibition of LOC155081 (Accession XM_088145). Accordingly, utilities of VGAM713 include diagnosis, prevention and treatment of diseases and clinical conditions associated with LOC155081. LOC170372 (Accession XM_084317) is another VGAM713 host target gene. LOC170372 BINDING SITE is HOST TARGET binding site found in the 5' untranslated region of mRNA encoded by LOC170372, corresponding to a HOST TARGET binding site such as BINDING SITE I, BINDING SITE II or BINDING SITE III. Table 2 illustrates the complementarity of the nucleotide sequences of LOC170372 BINDING SITE, designated SEQ ID:37540, to the nucleotide sequence of VGAM713 RNA, herein designated VGAM RNA, also designated SEQ ID:3424.

Another function of VGAM713 is therefore inhibition of LOC170372 (Accession XM_084317). Accordingly, utilities of VGAM713 include diagnosis, prevention and treatment of diseases and clinical conditions associated with LOC170372. LOC170425 (Accession XM_084330) is another VGAM713 host target gene. LOC170425 BINDING SITE is HOST TARGET binding site found in the 3' untranslated region of mRNA encoded by LOC170425, corresponding to a HOST TARGET binding site such as BINDING SITE I, BINDING SITE II or BINDING SITE III. Table 2 illustrates the complementarity of the nucleotide sequences of LOC170425 BINDING SITE, designated SEQ ID:37553, to the nucleotide sequence of VGAM713 RNA, herein designated VGAM RNA, also designated SEQ ID:3424.

Another function of VGAM713 is therefore inhibition of LOC170425 (Accession XM_084330). Accordingly, utilities of VGAM713 include diagnosis, prevention and treatment of diseases and clinical conditions associated with LOC170425. LOC202802 (Accession XM_114560) is another VGAM713 host target gene. LOC202802 BINDING SITE is HOST TARGET binding site found in the 3' untranslated region of mRNA encoded by LOC202802, corresponding to a HOST TARGET binding site such as BINDING SITE I, BINDING SITE II or BINDING SITE III. Table 2 illustrates the complementarity of the nucleotide sequences of LOC202802 BINDING SITE, designated SEQ ID:42989, to the nucleotide sequence of VGAM713 RNA, herein designated VGAM RNA, also designated SEQ ID:3424.

Another function of VGAM713 is therefore inhibition of LOC202802 (Accession XM_114560). Accordingly, utilities of VGAM713 include diagnosis, prevention and treatment of diseases and clinical conditions associated with LOC202802. LOC221810 (Accession XM_168222) is another VGAM713 host target gene. LOC221810 BINDING SITE is HOST TARGET binding site found in the 3' untranslated region of mRNA encoded by LOC221810, corresponding to a HOST TARGET binding site such as BINDING SITE I, BINDING SITE II or BINDING SITE III. Table 2 illustrates the complementarity of the nucleotide sequences of LOC221810 BINDING SITE, designated SEQ ID:45086, to the nucleotide sequence of VGAM713 RNA, herein designated VGAM RNA, also designated SEQ ID:3424.

Another function of VGAM713 is therefore inhibition of LOC221810 (Accession XM_168222). Accordingly, utilities of VGAM713 include diagnosis, prevention and treatment of diseases and clinical conditions associated with LOC221810. LOC222228 (Accession XM_168627) is another VGAM713 host target gene. LOC222228 BINDING SITE is HOST TARGET binding site found in the 3' untranslated region of mRNA encoded by LOC222228, corresponding to a HOST TARGET binding site such as BINDING SITE I, BINDING SITE II or BINDING SITE III. Table 2 illustrates the complementarity of the nucleotide sequences of LOC222228 BINDING SITE, designated SEQ ID:45275, to the nucleotide sequence of VGAM713 RNA, herein designated VGAM RNA, also designated SEQ ID:3424.

Another function of VGAM713 is therefore inhibition of LOC222228 (Accession XM_168627). Accordingly, utilities of VGAM713 include diagnosis, prevention and treatment of diseases and clinical conditions associated with LOC222228. LOC222233 (Accession XM_168560) is another VGAM713 host target gene. LOC222233 BINDING SITE is HOST TARGET binding site found in the 3' untranslated region of mRNA encoded by LOC222233, corresponding to a HOST TARGET binding site such as BINDING SITE I, BINDING SITE II or BINDING SITE III. Table 2 illustrates the complementarity of the nucleotide sequences of LOC222233 BINDING SITE, designated SEQ ID:45244, to the nucleotide sequence of VGAM713 RNA, herein designated VGAM RNA, also designated SEQ ID:3424.

Another function of VGAM713 is therefore inhibition of LOC222233 (Accession XM_168560). Accordingly, utilities of VGAM713 include diagnosis, prevention and treatment of diseases and clinical conditions associated with LOC222233. LOC253502 (Accession XM_170561) is another VGAM713 host target gene. LOC253502 BINDING SITE is HOST TARGET binding site found in the 3' untranslated region of mRNA encoded by LOC253502, corresponding to a HOST TARGET binding site such as BINDING SITE I, BINDING SITE II or BINDING SITE III. Table 2 illustrates the complementarity of the nucleotide sequences of LOC253502 BINDING SITE, designated SEQ ID:45381, to the nucleotide sequence of VGAM713 RNA, herein designated VGAM RNA, also designated SEQ ID:3424.

Another function of VGAM713 is therefore inhibition of LOC253502 (Accession XM_170561). Accordingly, utilities of VGAM713 include diagnosis, prevention and treatment of diseases and clinical conditions associated with LOC253502. LOC255242 (Accession XM_171095) is another VGAM713 host target gene. LOC255242 BINDING SITE is HOST TARGET binding site found in the 5' untranslated region of mRNA encoded by LOC255242, corresponding to a HOST TARGET binding site such as BINDING SITE I, BINDING SITE II or BINDING SITE III. Table 2 illustrates the complementarity of the nucleotide sequences of LOC255242 BINDING SITE, designated SEQ ID:45906, to the nucleotide sequence of VGAM713 RNA, herein designated VGAM RNA, also designated SEQ ID:3424.

Another function of VGAM713 is therefore inhibition of LOC255242 (Accession XM_171095). Accordingly, utilities of VGAM713 include diagnosis, prevention and treatment of diseases and clinical conditions associated with LOC255242. LOC257494 (Accession XM_175212) is another VGAM713 host target gene. LOC257494 BINDING SITE is HOST TARGET binding site found in the 3' untranslated region of mRNA encoded by LOC257494, corresponding to a HOST TARGET binding site such as BINDING SITE I, BINDING SITE II or BINDING SITE III. Table 2 illustrates the complementarity of the nucleotide sequences of LOC257494 BINDING SITE, designated SEQ ID:46687, to the nucleotide sequence of VGAM713 RNA, herein designated VGAM RNA, also designated SEQ ID:3424.

Another function of VGAM713 is therefore inhibition of LOC257494 (Accession XM_175212). Accordingly, utilities of VGAM713 include diagnosis, prevention and treatment of diseases and clinical conditions associated with LOC257494. LOC57115 (Accession NM_020393) is another VGAM713 host target gene. LOC57115 BINDING SITE is HOST TARGET binding site found in the 3' untranslated region of mRNA encoded by LOC57115, corresponding to a HOST TARGET binding site such as BINDING SITE I, BINDING SITE II or BINDING SITE III. Table 2 illustrates the complementarity of the nucleotide sequences of LOC57115 BINDING SITE, designated SEQ ID:21663, to the nucleotide sequence of VGAM713 RNA, herein designated VGAM RNA, also designated SEQ ID:3424.

Another function of VGAM713 is therefore inhibition of LOC57115 (Accession NM_020393). Accordingly, utilities of VGAM713 include diagnosis, prevention and treatment of diseases and clinical conditions associated with LOC57115. FIG. 1 further provides a conceptual description of a novel bioinformatically detected viral gene of the present invention, referred to here as Viral Genomic Address Messenger 714 (VGAM714) viral gene, which modulates expression of respective host target genes thereof, the function and utility of which host target genes is known in the art.

VGAM714 is a novel bioinformatically detected regulatory, non protein coding, viral micro RNA (miRNA) gene. The method by which VGAM714 was detected is described hereinabove with reference to FIGS. 1-8.

VGAM714 gene, herein designated VGAM GENE, is a viral gene contained in the genome of Bovine Herpesvirus 4. VGAM714 host target gene, herein designated VGAM HOST TARGET GENE, is a human gene contained in the human genome.

VGAM714 gene encodes a VGAM714 precursor RNA, herein designated VGAM PRECURSOR RNA. Similar to other miRNA genes, and unlike most ordinary genes, VGAM714 precursor RNA does not encode a protein. A nucleotide sequence identical or highly similar to the nucleotide sequence of VGAM714 precursor RNA is designated SEQ ID:700, and is provided hereinbelow with reference to the sequence listing part. Nucleotide sequence SEQ ID:700 is located at position 102811 relative to the genome of Bovine Herpesvirus 4.

VGAM714 precursor RNA folds onto itself, forming VGAM714 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM714 folded precursor RNA into VGAM714 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM714 RNA is designated SEQ ID:3425, and is provided hereinbelow with reference to the sequence listing part.

VGAM714 host target gene, herein designated VGAM HOST TARGET GENE, encodes a corresponding messenger RNA, VGAM714 host target RNA, herein designated VGAM HOST TARGET RNA. VGAM714 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM714 RNA, herein designated VGAM RNA, binds complementarily to one or more host target binding sites located in untranslated regions of VGAM714 host target RNA, herein designated VGAM HOST TARGET RNA. This complementary binding is due to the fact that the nucleotide sequence of VGAM714 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM714 RNA, herein designated VGAM RNA, may have a different number of host target binding sites in untranslated regions of a VGAM714 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM714 RNA, herein designated VGAM RNA, to host target binding sites on VGAM714 host target RNA, herein designated VGAM HOST TARGET RNA, such as BINDING SITE I, BINDING SITE II and BINDING SITE III, inhibits translation of VGAM714 host target RNA into VGAM714 host target protein, herein designated VGAM HOST TARGET PROTEIN. VGAM host target protein is therefore outlined by a broken line.

It is appreciated that VGAM714 host target gene, herein designated VGAM HOST TARGET GENE, in fact represents a plurality of VGAM714 host target genes. The mRNA of each one of this plurality of VGAM714 host target genes comprises one or more host target binding sites, each having a nucleotide sequence which is at least partly complementary to VGAM714 RNA, herein designated VGAM RNA, and which when bound by VGAM714 RNA causes inhibition of translation of respective one or more VGAM714 host target proteins.

It is further appreciated by one skilled in the art that the mode of translational inhibition illustrated by FIG. 1 with specific reference to translational inhibition exerted by VGAM714 gene, herein designated VGAM GENE, on one or more VGAM714 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM714 is inhibition of expression of host target genes, as part of a novel viral mechanism of attacking a host. Accordingly, utilities of VGAM714 include diagnosis, prevention and treatment of viral infection by Bovine Herpesvirus 4. Specific functions, and accordingly utilities, of VGAM714 correlate with, and may be deduced from, the identity of the host target genes which VGAM714 binds and inhibits, and the function of these host target genes, as elaborated hereinbelow.

Nucleotide sequences of the VGAM714 precursor RNA, herein designated VGAM PRECURSOR RNA, and of the 'diced' VGAM714 RNA, herein designated VGAM RNA, and a schematic representation of the secondary folding of VGAM714 folded precursor RNA, herein designated VGAM FOLDED PRECURSOR RNA, of VGAM714 are further described hereinbelow with reference to Table 1.

Nucleotide sequences of host target binding sites, such as BINDING SITE-I, BINDING SITE-II and BINDING SITE-III of FIG. 1, found on VGAM714 host target RNA, and schematic representation of the complementarity of each of these host target binding sites to VGAM714 RNA, herein designated VGAM RNA, are described hereinbelow with reference to Table 2.

As mentioned hereinabove with reference to FIG. 1, a function of VGAM714 gene, herein designated VGAM is inhibition of expression of VGAM714 target genes. It is appreciated that specific functions, and accordingly utilities, of VGAM714 correlate with, and may be deduced from, the identity of the target genes which VGAM714 binds and inhibits, and the function of these target genes, as elaborated hereinbelow.

Insulin-like Growth Factor Binding Protein 3 (IGFBP3, Accession NM_000598) is a VGAM714 host target gene. IGFBP3 BINDING SITE is HOST TARGET binding site found in the 3' untranslated region of mRNA encoded by IGFBP3, corresponding to a HOST TARGET binding site such as BINDING SITE I, BINDING SITE II or BINDING SITE III. Table 2 illustrates the complementarity of the nucleotide sequences of IGFBP3 BINDING SITE, designated SEQ ID:6200, to the nucleotide sequence of VGAM714 RNA, herein designated VGAM RNA, also designated SEQ ID:3425.

A function of VGAM714 is therefore inhibition of Insulin-like Growth Factor Binding Protein 3 (IGFBP3, Accession NM_000598). Accordingly, utilities of VGAM714 include diagnosis, prevention and treatment of diseases and clinical conditions associated with IGFBP3. Sulfotransferase Family, Cytosolic, 1C, Member 1 (SULT1C1, Accession NM_001056) is another VGAM714 host target gene.

SULT1C1 BINDING SITE is HOST TARGET binding site found in the 3' untranslated region of mRNA encoded by SULT1C1, corresponding to a HOST TARGET binding site such as BINDING SITE I, BINDING SITE II or BINDING SITE III. Table 2 illustrates the complementarity of the nucleotide sequences of SULT1C1 BINDING SITE, designated SEQ ID:6723, to the nucleotide sequence of VGAM714 RNA, herein designated VGAM RNA, also designated SEQ ID:3425.

Another function of VGAM714 is therefore inhibition of Sulfotransferase Family, Cytosolic, 1C, Member 1 (SULT1C1, Accession NM_001056). Accordingly, utilities of VGAM714 include diagnosis, prevention and treatment of diseases and clinical conditions associated with SULT1C1. CGI-142 (Accession NM_016073) is another VGAM714 host target gene. CGI-142 BINDING SITE is HOST TARGET binding site found in the 3' untranslated region of mRNA encoded by CGI-142, corresponding to a HOST TARGET binding site such as BINDING SITE I, BINDING SITE II or BINDING SITE III. Table 2 illustrates the complementarity of the nucleotide sequences of CGI-142 BINDING SITE, designated SEQ ID:18148, to the nucleotide sequence of VGAM714 RNA, herein designated VGAM RNA, also designated SEQ ID:3425.

Another function of VGAM714 is therefore inhibition of CGI-142 (Accession NM_016073). Accordingly, utilities of VGAM714 include diagnosis, prevention and treatment of diseases and clinical conditions associated with CGI-142. FLJ20783 (Accession NM_017958) is another VGAM714 host target gene. FLJ20783 BINDING SITE is HOST TARGET binding site found in the 3' untranslated region of mRNA encoded by FLJ20783, corresponding to a HOST TARGET binding site such as BINDING SITE I, BINDING SITE II or BINDING SITE III. Table 2 illustrates the complementarity of the nucleotide sequences of FLJ20783 BINDING SITE, designated SEQ ID:19669, to the nucleotide sequence of VGAM714 RNA, herein designated VGAM RNA, also designated SEQ ID:3425.

Another function of VGAM714 is therefore inhibition of FLJ20783 (Accession NM_017958). Accordingly, utilities of VGAM714 include diagnosis, prevention and treatment of diseases and clinical conditions associated with FLJ20783. FLJ22625 (Accession NM_024715) is another VGAM714 host target gene. FLJ22625 BINDING SITE is HOST TARGET binding site found in the 3' untranslated region of mRNA encoded by FLJ22625, corresponding to a HOST TARGET binding site such as BINDING SITE I, BINDING SITE II or BINDING SITE III. Table 2 illustrates the complementarity of the nucleotide sequences of FLJ22625 BINDING SITE, designated SEQ ID:24043, to the nucleotide sequence of VGAM714 RNA, herein designated VGAM RNA, also designated SEQ ID:3425.

Another function of VGAM714 is therefore inhibition of FLJ22625 (Accession NM_024715). Accordingly, utilities of VGAM714 include diagnosis, prevention and treatment of diseases and clinical conditions associated with FLJ22625. KIAA1966 (Accession NM_133370) is another VGAM714 host target gene. KIAA1966 BINDING SITE is HOST TARGET binding site found in the 3' untranslated region of mRNA encoded by KIAA1966, corresponding to a HOST TARGET binding site such as BINDING SITE I, BINDING SITE II or BINDING SITE III. Table 2 illustrates the complementarity of the nucleotide sequences of KIAA1966 BINDING SITE, designated SEQ ID:28495, to the nucleotide sequence of VGAM714 RNA, herein designated VGAM RNA, also designated SEQ ID:3425.

Another function of VGAM714 is therefore inhibition of KIAA1966 (Accession NM_133370). Accordingly, utilities of VGAM714 include diagnosis, prevention and treatment of diseases and clinical conditions associated with KIAA1966. Lymphoid-restricted Membrane Protein (LRMP, Accession NM_006152) is another VGAM714 host target gene. LRMP BINDING SITE is HOST TARGET binding site found in the 5' untranslated region of mRNA encoded by LRMP, corresponding to a HOST TARGET binding site such as BINDING SITE I, BINDING SITE II or BINDING SITE III. Table 2 illustrates the complementarity of the nucleotide sequences of LRMP BINDING SITE, designated SEQ ID:12806, to the nucleotide sequence of VGAM714 RNA, herein designated VGAM RNA, also designated SEQ ID:3425.

Another function of VGAM714 is therefore inhibition of Lymphoid-restricted Membrane Protein (LRMP, Accession NM_006152). Accordingly, utilities of VGAM714 include diagnosis, prevention and treatment of diseases and clinical conditions associated with LRMP. SV2 (Accession NM_014849) is another VGAM714 host target gene. SV2 BINDING SITE is HOST TARGET binding site found in the 3' untranslated region of mRNA encoded by SV2, corresponding to a HOST TARGET binding site such as BINDING SITE I, BINDING SITE II or BINDING SITE III. Table 2 illustrates the complementarity of the nucleotide sequences of SV2 BINDING SITE, designated SEQ ID:16887, to the nucleotide sequence of VGAM714 RNA, herein designated VGAM RNA, also designated SEQ ID:3425.

Another function of VGAM714 is therefore inhibition of SV2 (Accession NM_014849). Accordingly, utilities of VGAM714 include diagnosis, prevention and treatment of diseases and clinical conditions associated with SV2. LOC152756 (Accession XM_098262) is another VGAM714 host target gene. LOC152756 BINDING SITE is HOST TARGET binding site found in the 3' untranslated region of mRNA encoded by LOC152756, corresponding to a HOST TARGET binding site such as BINDING SITE I, BINDING SITE II or BINDING SITE III. Table 2 illustrates the complementarity of the nucleotide sequences of LOC152756 BINDING SITE, designated SEQ ID:41550, to the nucleotide sequence of VGAM714 RNA, herein designated VGAM RNA, also designated SEQ ID:3425.

Another function of VGAM714 is therefore inhibition of LOC152756 (Accession XM_098262). Accordingly, utilities of VGAM714 include diagnosis, prevention and treatment of diseases and clinical conditions associated with LOC152756. LOC84549 (Accession NM_032509) is another VGAM714 host target gene. LOC84549 BINDING SITE is HOST TARGET binding site found in the 3' untranslated region of mRNA encoded by LOC84549, corresponding to a HOST TARGET binding site such as BINDING SITE I, BINDING SITE II or BINDING SITE III. Table 2 illustrates the complementarity of the nucleotide sequences of LOC84549 BINDING SITE, designated SEQ ID:26256, to the nucleotide sequence of VGAM714 RNA, herein designated VGAM RNA, also designated SEQ ID:3425.

Another function of VGAM714 is therefore inhibition of LOC84549 (Accession NM_032509). Accordingly, utilities of VGAM714 include diagnosis, prevention and treatment of diseases and clinical conditions associated with LOC84549. FIG. 1 further provides a conceptual description of a novel bioinformatically detected viral gene of the present invention, referred to here as Viral Genomic Address Messenger 715 (VGAM715) viral gene, which modulates expression of respective host target genes thereof, the function and utility of which host target genes is known in the art.

VGAM715 is a novel bioinformatically detected regulatory, non protein coding, viral micro RNA (miRNA) gene. The method by which VGAM715 was detected is described hereinabove with reference to FIGS. 1-8.

VGAM715 gene, herein designated VGAM GENE, is a viral gene contained in the genome of Cercopithecine Herpesvirus 7. VGAM715 host target gene, herein designated VGAM HOST TARGET GENE, is a human gene contained in the human genome.

VGAM715 gene encodes a VGAM715 precursor RNA, herein designated VGAM PRECURSOR RNA. Similar to other miRNA genes, and unlike most ordinary genes, VGAM715 precursor RNA does not encode a protein. A nucleotide sequence identical or highly similar to the nucleotide sequence of VGAM715 precursor RNA is designated SEQ ID:701, and is provided hereinbelow with reference to the sequence listing part. Nucleotide sequence SEQ ID:701 is located at position 36568 relative to the genome of Cercopithecine Herpesvirus 7.

VGAM715 precursor RNA folds onto itself, forming VGAM715 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM715 folded precursor RNA into VGAM715 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM715 RNA is designated SEQ ID:3426, and is provided hereinbelow with reference to the sequence listing part.

VGAM715 host target gene, herein designated VGAM HOST TARGET GENE, encodes a corresponding messenger RNA, VGAM715 host target RNA, herein designated VGAM HOST TARGET RNA. VGAM715 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM715 RNA, herein designated VGAM RNA, binds complementarily to one or more host target binding sites located in untranslated regions of VGAM715 host target RNA, herein designated VGAM HOST TARGET RNA. This complementary binding is due to the fact that the nucleotide sequence of VGAM715 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM715 RNA, herein designated VGAM RNA, may have a different number of host target binding sites in untranslated regions of a VGAM715 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM715 RNA, herein designated VGAM RNA, to host target binding sites on VGAM715 host target RNA, herein designated VGAM HOST TARGET RNA, such as BINDING SITE I, BINDING SITE II and BINDING SITE III, inhibits translation of VGAM715 host target RNA into VGAM715 host target protein, herein designated VGAM HOST TARGET PROTEIN. VGAM host target protein is therefore outlined by a broken line.

It is appreciated that VGAM715 host target gene, herein designated VGAM HOST TARGET GENE, in fact represents a plurality of VGAM715 host target genes. The mRNA of each one of this plurality of VGAM715 host target genes comprises one or more host target binding sites, each having a nucleotide sequence which is at least partly complementary to VGAM715 RNA, herein designated VGAM RNA, and which when bound by VGAM715 RNA causes inhibition of translation of respective one or more VGAM715 host target proteins.

It is further appreciated by one skilled in the art that the mode of translational inhibition illustrated by FIG. 1 with specific reference to translational inhibition exerted by VGAM715 gene, herein designated VGAM GENE, on one or more VGAM715 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM715 is inhibition of expression of host target genes, as part of a novel viral mechanism of attacking a host. Accordingly, utilities of VGAM715 include diagnosis, prevention and treatment of viral infection by Cercopithecine Herpesvirus 7. Specific functions, and accordingly utilities, of VGAM715 correlate with, and may be deduced from, the identity of the host target genes which VGAM715 binds and inhibits, and the function of these host target genes, as elaborated hereinbelow.

Nucleotide sequences of the VGAM715 precursor RNA, herein designated VGAM PRECURSOR RNA, and of the 'diced' VGAM715 RNA, herein designated VGAM RNA, and a schematic representation of the secondary folding of VGAM715 folded precursor RNA, herein designated VGAM FOLDED PRECURSOR RNA, of VGAM715 are further described hereinbelow with reference to Table 1.

Nucleotide sequences of host target binding sites, such as BINDING SITE-I, BINDING SITE-II and BINDING SITE-III of FIG. 1, found on VGAM715 host target RNA, and schematic representation of the complementarity of each of these host target binding sites to VGAM715 RNA, herein designated VGAM RNA, are described hereinbelow with reference to Table 2.

As mentioned hereinabove with reference to FIG. 1, a function of VGAM715 gene, herein designated VGAM is inhibition of expression of VGAM715 target genes. It is appreciated that specific functions, and accordingly utilities, of VGAM715 correlate with, and may be deduced from, the identity of the target genes which VGAM715 binds and inhibits, and the function of these target genes, as elaborated hereinbelow.

FLJ11259 (Accession NM_018370) is a VGAM715 host target gene. FLJ11259 BINDING SITE is HOST TARGET binding site found in the 3' untranslated region of mRNA encoded by FLJ11259, corresponding to a HOST TARGET binding site such as BINDING SITE I, BINDING SITE II or BINDING SITE III. Table 2 illustrates the complementarity of the nucleotide sequences of FLJ11259 BINDING SITE, designated SEQ ID:20386, to the nucleotide sequence of VGAM715 RNA, herein designated VGAM RNA, also designated SEQ ID:3426.

A function of VGAM715 is therefore inhibition of FLJ11259 (Accession NM_018370). Accordingly, utilities of VGAM715 include diagnosis, prevention and treatment of diseases and clinical conditions associated with FLJ11259. MGC10946 (Accession NM_030572) is another VGAM715 host target gene. MGC10946 BINDING SITE is HOST TARGET binding site found in the 5' untranslated region of mRNA encoded by MGC10946, corresponding to a HOST TARGET binding site such as BINDING SITE I, BINDING SITE II or BINDING SITE III. Table 2 illustrates the complementarity of the nucleotide sequences of MGC10946 BINDING SITE, designated SEQ ID:24946, to the nucleotide sequence of VGAM715 RNA, herein designated VGAM RNA, also designated SEQ ID:3426.

Another function of VGAM715 is therefore inhibition of MGC10946 (Accession NM_030572). Accordingly, utilities of VGAM715 include diagnosis, prevention and treatment of diseases and clinical conditions associated with MGC10946. LOC149650 (Accession XM_086623) is another VGAM715 host target gene. LOC149650 BINDING SITE is HOST TARGET binding site found in the 3' untranslated region of mRNA encoded by LOC149650, corresponding to a HOST TARGET binding site such as BINDING SITE I, BINDING SITE II or BINDING SITE III. Table 2 illustrates the complementarity of the nucleotide sequences of LOC149650 BINDING SITE, designated SEQ ID:38796, to the nucleotide sequence of VGAM715 RNA, herein designated VGAM RNA, also designated SEQ ID:3426.

Another function of VGAM715 is therefore inhibition of LOC149650 (Accession XM_086623). Accordingly, utilities of VGAM715 include diagnosis, prevention and treatment of diseases and clinical conditions associated with LOC149650. FIG. 1 further provides a conceptual description of a novel bioinformatically detected viral gene of the present invention, referred to here as Viral Genomic Address Messenger 716 (VGAM716) viral gene, which modulates expression of respective host target genes thereof, the function and utility of which host target genes is known in the art.

VGAM716 is a novel bioinformatically detected regulatory, non protein coding, viral micro RNA (miRNA) gene. The method by which VGAM716 was detected is described hereinabove with reference to FIGS. 1-8.

VGAM716 gene, herein designated VGAM GENE, is a viral gene contained in the genome of Cercopithecine Herpesvirus 7. VGAM716 host target gene, herein designated VGAM HOST TARGET GENE, is a human gene contained in the human genome.

VGAM716 gene encodes a VGAM716 precursor RNA, herein designated VGAM PRECURSOR RNA. Similar to other miRNA genes, and unlike most ordinary genes, VGAM716 precursor RNA does not encode a protein. A nucleotide sequence identical or highly similar to the nucleotide sequence of VGAM716 precursor RNA is designated SEQ ID:702, and is provided hereinbelow with reference to the sequence listing part. Nucleotide sequence SEQ ID:702 is located at position 34593 relative to the genome of Cercopithecine Herpesvirus 7.

VGAM716 precursor RNA folds onto itself, forming VGAM716 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM716 folded precursor RNA into VGAM716 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM716 RNA is designated SEQ ID:3427, and is provided hereinbelow with reference to the sequence listing part.

VGAM716 host target gene, herein designated VGAM HOST TARGET GENE, encodes a corresponding messenger RNA, VGAM716 host target RNA, herein designated VGAM HOST TARGET RNA. VGAM716 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM716 RNA, herein designated VGAM RNA, binds complementarily to one or more host target binding sites located in untranslated regions of VGAM716 host target RNA, herein designated VGAM HOST TARGET RNA. This complementary binding is due to the fact that the nucleotide sequence of VGAM716 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM716 RNA, herein designated VGAM RNA, may have a different number of host target binding sites in untranslated regions of a VGAM716 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM716 RNA, herein designated VGAM RNA, to host target binding sites on VGAM716 host target RNA, herein designated VGAM HOST TARGET RNA, such as BINDING SITE I, BINDING SITE II and BINDING SITE III, inhibits translation of VGAM716 host target RNA into VGAM716 host target protein, herein designated VGAM HOST TARGET PROTEIN. VGAM host target protein is therefore outlined by a broken line.

It is appreciated that VGAM716 host target gene, herein designated VGAM HOST TARGET GENE, in fact represents a plurality of VGAM716 host target genes. The mRNA of each one of this plurality of VGAM716 host target genes comprises one or more host target binding sites, each having a nucleotide sequence which is at least partly complementary to VGAM716 RNA, herein designated VGAM RNA, and which when bound by VGAM716 RNA causes inhibition of translation of respective one or more VGAM716 host target proteins.

It is further appreciated by one skilled in the art that the mode of translational inhibition illustrated by FIG. 1 with specific reference to translational inhibition exerted by VGAM716 gene, herein designated VGAM GENE, on one or more VGAM716 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM716 is inhibition of expression of host target genes, as part of a novel viral mechanism of attacking a host. Accordingly, utilities of VGAM716 include diagnosis, prevention and treatment of viral infection by Cercopithecine Herpesvirus 7. Specific functions, and accordingly utilities, of VGAM716 correlate with, and may be deduced from, the identity of the host target genes which VGAM716 binds and inhibits, and the function of these host target genes, as elaborated hereinbelow.

Nucleotide sequences of the VGAM716 precursor RNA, herein designated VGAM PRECURSOR RNA, and of the 'diced' VGAM716 RNA, herein designated VGAM RNA, and a schematic representation of the secondary folding of VGAM716 folded precursor RNA, herein designated VGAM FOLDED PRECURSOR RNA, of VGAM716 are further described hereinbelow with reference to Table 1.

Nucleotide sequences of host target binding sites, such as BINDING SITE-I, BINDING SITE-II and BINDING SITE-III of FIG. 1, found on VGAM716 host target RNA, and schematic representation of the complementarity of each of these host target binding sites to VGAM716 RNA, herein designated VGAM RNA, are described hereinbelow with reference to Table 2.

As mentioned hereinabove with reference to FIG. 1, a function of VGAM716 gene, herein designated VGAM is inhibition of expression of VGAM716 target genes. It is appreciated that specific functions, and accordingly utilities, of VGAM716 correlate with, and may be deduced from, the identity of the target genes which VGAM716 binds and inhibits, and the function of these target genes, as elaborated hereinbelow.

POU Domain, Class 3, Transcription Factor 1 (POU3F1, Accession XM_001334) is a VGAM716 host target gene. POU3F1 BINDING SITE is HOST TARGET binding site found in the 3' untranslated region of mRNA encoded by POU3F1, corresponding to a HOST TARGET binding site such as BINDING SITE I, BINDING SITE II or BINDING SITE III. Table 2 illustrates the complementarity of the nucleotide sequences of POU3F1 BINDING SITE, designated SEQ ID:29830, to the nucleotide sequence of VGAM716 RNA, herein designated VGAM RNA, also designated SEQ ID:3427.

A function of VGAM716 is therefore inhibition of POU Domain, Class 3, Transcription Factor 1 (POU3F1, Accession XM_001334), a gene which involves in early embryogenesis and neurogenesis. Accordingly, utilities of VGAM716 include diagnosis, prevention and treatment of diseases and clinical conditions associated with POU3F1. The function of POU3F1 and its association with various diseases and clinical conditions, has been established by previous studies, as described hereinabove with reference to VGAM85. Tropomodulin (TMOD, Accession NM_003275) is another VGAM716 host target gene. TMOD BINDING SITE is HOST TARGET binding site found in the 3' untranslated region of mRNA encoded by TMOD, corresponding to a HOST TARGET binding site such as BINDING SITE I, BINDING SITE II or BINDING SITE III. Table 2 illustrates the complementarity of the nucleotide sequences of TMOD BINDING SITE, designated SEQ ID:9293, to the nucleotide sequence of VGAM716 RNA, herein designated VGAM RNA, also designated SEQ ID:3427.

Another function of VGAM716 is therefore inhibition of Tropomodulin (TMOD, Accession NM_003275), a gene which blocks the elongation and depolymerization of the actin filaments at the pointed end. Accordingly, utilities of VGAM716 include diagnosis, prevention and treatment of diseases and clinical conditions associated with TMOD. The function of TMOD has been established by previous studies. Tropomodulin is associated with the pointed end of the actin filaments (Fowler et al., 1993). It binds specifically to the N terminus of tropomyosin and blocks the elongation and depolarization of tropomyosin-coated actin filaments. By Northern blot analysis, Sung et al. (1996) showed that the TMOD gene is expressed in major human tissues at different levels in the following order: heart and skeletal muscle much greater than in brain, lung, and pancreas, which is greater than in placenta, liver, and kidney. They pointed to structural similarities between tropomodulin and the 64-kD autoantigen in Graves disease (OMIM Ref. No. 139080) and suggested that the 2 genes evolved from a common ancestral gene. Chu et al. (2000) noted that erythrocyte TMOD is a 359-amino acid globular protein. Using PCR methods to obtain TMOD genomic clones, they determined that the TMOD gene contains 9 exons. Chu et al. (2000) suggested that the use of alternative promoters may account for tissue-specific expression and regulation.

Full details of the abovementioned studies are described in the following publications, the disclosure of which are hereby incorporated by reference:

Fowler, V. M.; Sussmann, M. A.; Miller, P. G.; Flucher, B. E.; Daniels, M. P.: Tropomodulin is associated with the free (pointed) ends of the thin filaments in rat skeletal muscle. J. Cell Biol. 120:411-420, 1993; and Chu, X.; Thompson, D.; Yee, L. J.; Sung, L. A.: Genomic organization of mouse and human erythrocyte tropomodulin genes encoding the pointed end capping protein for the actin filaments.

Further studies establishing the function and utilities of TMOD are found in John Hopkins OMIM database record ID 190930, and in sited publications numbered 3262-3265, 80 and 3266-3270 listed in the bibliography section hereinbelow, which are also hereby incorporated by reference. Zinc Finger Protein 80 (pT17) (ZNF80, Accession NM_007136) is another VGAM716 host target gene. ZNF80 BINDING SITE is HOST TARGET binding site found in the 5' untranslated region of mRNA encoded by ZNF80, corresponding to a HOST TARGET binding site such as BINDING SITE I, BINDING SITE II or BINDING SITE III. Table 2 illustrates the complementarity of the nucleotide sequences of ZNF80 BINDING SITE, designated SEQ ID:13987, to the nucleotide sequence of VGAM716 RNA, herein designated VGAM RNA, also designated SEQ ID:3427.

Another function of VGAM716 is therefore inhibition of Zinc Finger Protein 80 (pT17) (ZNF80, Accession NM_007136). Accordingly, utilities of VGAM716 include diagnosis, prevention and treatment of diseases and clinical conditions associated with ZNF80. Lysyl Oxidase-like 4 (LOXL4, Accession NM_032211) is another VGAM716 host target gene. LOXL4 BINDING SITE is HOST TARGET binding site found in the 3' untranslated region of mRNA encoded by LOXL4, corresponding to a HOST TARGET binding site such as BINDING SITE I, BINDING SITE II or BINDING SITE III. Table 2 illustrates the complementarity of the nucleotide sequences of LOXL4 BINDING SITE, designated SEQ ID:25927, to the nucleotide sequence of VGAM716 RNA, herein designated VGAM RNA, also designated SEQ ID:3427.

Another function of VGAM716 is therefore inhibition of Lysyl Oxidase-like 4 (LOXL4, Accession NM_032211). Accordingly, utilities of VGAM716 include diagnosis, prevention and treatment of diseases and clinical conditions associated with LOXL4. Sideroflexin 2 (SFXN2, Accession XM_058359) is another VGAM716 host target gene. SFXN2 BINDING SITE is HOST TARGET binding site found in the 3' untranslated region of mRNA encoded by SFXN2, corresponding to a HOST TARGET binding site such as BINDING SITE I, BINDING SITE II or BINDING SITE III. Table 2 illustrates the complementarity of the nucleotide sequences of SFXN2 BINDING SITE, designated SEQ ID:36605, to the nucleotide sequence of VGAM716 RNA, herein designated VGAM RNA, also designated SEQ ID:3427.

Another function of VGAM716 is therefore inhibition of Sideroflexin 2 (SFXN2, Accession XM_058359). Accordingly, utilities of VGAM716 include diagnosis, prevention and treatment of diseases and clinical conditions associated with SFXN2. LOC145814 (Accession XM_085243) is another VGAM716 host target gene. LOC145814 BINDING SITE is HOST TARGET binding site found in the 5' untranslated region of mRNA encoded by LOC145814, corresponding to a HOST TARGET binding site such as BINDING SITE I, BINDING SITE II or BINDING SITE III. Table 2 illustrates the complementarity of the nucleotide sequences of LOC145814 BINDING SITE, designated SEQ ID:37986, to the nucleotide sequence of VGAM716 RNA, herein designated VGAM RNA, also designated SEQ ID:3427.

Another function of VGAM716 is therefore inhibition of LOC145814 (Accession XM_085243). Accordingly, utilities of VGAM716 include diagnosis, prevention and treatment of diseases and clinical conditions associated with LOC145814. LOC147042 (Accession XM_097167) is another VGAM716 host target gene. LOC147042 BINDING SITE is HOST TARGET binding site found in the 3' untranslated region of mRNA encoded by LOC147042, corresponding to a HOST TARGET binding site such as BINDING SITE I, BINDING SITE II or BINDING SITE III. Table 2 illustrates the complementarity of the nucleotide sequences of LOC147042 BINDING SITE, designated SEQ ID:40786, to the nucleotide sequence of VGAM716 RNA, herein designated VGAM RNA, also designated SEQ ID:3427.

Another function of VGAM716 is therefore inhibition of LOC147042 (Accession XM_097167). Accordingly, utilities of VGAM716 include diagnosis, prevention and treatment of diseases and clinical conditions associated with LOC147042. LOC196540 (Accession XM_116933) is another VGAM716 host target gene. LOC196540 BINDING SITE is HOST TARGET binding site found in the 3' untranslated region of mRNA encoded by LOC196540, corresponding to a HOST TARGET binding site such as BINDING SITE I, BINDING SITE II or BINDING SITE III. Table 2 illustrates the complementarity of the nucleotide sequences of LOC196540 BINDING SITE, designated SEQ ID:43149, to the nucleotide sequence of VGAM716 RNA, herein designated VGAM RNA, also designated SEQ ID:3427.

Another function of VGAM716 is therefore inhibition of LOC196540 (Accession XM_116933). Accordingly, utilities of VGAM716 include diagnosis, prevention and treatment of diseases and clinical conditions associated with LOC196540. LOC51141 (Accession XM_043953) is another VGAM716 host target gene. LOC51141 BINDING SITE is HOST TARGET binding site found in the 3' untranslated region of mRNA encoded by LOC51141, corresponding to a HOST TARGET binding site such as BINDING SITE I, BINDING SITE II or BINDING SITE III. Table 2 illustrates the complementarity of the nucleotide sequences of LOC51141 BINDING SITE, designated SEQ ID:34046, to the nucleotide sequence of VGAM716 RNA, herein designated VGAM RNA, also designated SEQ ID:3427.

Another function of VGAM716 is therefore inhibition of LOC51141 (Accession XM_043953). Accordingly, utilities of VGAM716 include diagnosis, prevention and treatment of diseases and clinical conditions associated with LOC51141.

FIG. 1 further provides a conceptual description of a novel bioinformatically detected viral gene of the present invention, referred to here as Viral Genomic Address Messenger 717 (VGAM717) viral gene, which modulates expression of respective host target genes thereof, the function and utility of which host target genes is known in the art.

VGAM717 is a novel bioinformatically detected regulatory, non protein coding, viral micro RNA (miRNA) gene. The method by which VGAM717 was detected is described hereinabove with reference to FIGS. 1-8.

VGAM717 gene, herein designated VGAM GENE, is a viral gene contained in the genome of Cercopithecine Herpesvirus 7. VGAM717 host target gene, herein designated VGAM HOST TARGET GENE, is a human gene contained in the human genome.

VGAM717 gene encodes a VGAM717 precursor RNA, herein designated VGAM PRECURSOR RNA. Similar to other miRNA genes, and unlike most ordinary genes, VGAM717 precursor RNA does not encode a protein. A nucleotide sequence identical or highly similar to the nucleotide sequence of VGAM717 precursor RNA is designated SEQ ID:703, and is provided hereinbelow with reference to the sequence listing part. Nucleotide sequence SEQ ID:703 is located at position 37440 relative to the genome of Cercopithecine Herpesvirus 7.

VGAM717 precursor RNA folds onto itself, forming VGAM717 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM717 folded precursor RNA into VGAM717 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM717 RNA is designated SEQ ID:3428, and is provided hereinbelow with reference to the sequence listing part.

VGAM717 host target gene, herein designated VGAM HOST TARGET GENE, encodes a corresponding messenger RNA, VGAM717 host target RNA, herein designated VGAM HOST TARGET RNA. VGAM717 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM717 RNA, herein designated VGAM RNA, binds complementarily to one or more host target binding sites located in untranslated regions of VGAM717 host target RNA, herein designated VGAM HOST TARGET RNA. This complementary binding is due to the fact that the nucleotide sequence of VGAM717 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM717 RNA, herein designated VGAM RNA, may have a different number of host target binding sites in untranslated regions of a VGAM717 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM717 RNA, herein designated VGAM RNA, to host target binding sites on VGAM717 host target RNA, herein designated VGAM HOST TARGET RNA, such as BINDING SITE I, BINDING SITE II and BINDING SITE III, inhibits translation of VGAM717 host target RNA into VGAM717 host target protein, herein designated VGAM HOST TARGET PROTEIN. VGAM host target protein is therefore outlined by a broken line.

It is appreciated that VGAM717 host target gene, herein designated VGAM HOST TARGET GENE, in fact represents a plurality of VGAM717 host target genes. The mRNA of each one of this plurality of VGAM717 host target genes comprises one or more host target binding sites, each having a nucleotide sequence which is at least partly complementary to VGAM717 RNA, herein designated VGAM RNA, and which when bound by VGAM717 RNA causes inhibition of translation of respective one or more VGAM717 host target proteins.

It is further appreciated by one skilled in the art that the mode of translational inhibition illustrated by FIG. 1 with specific reference to translational inhibition exerted by VGAM717 gene, herein designated VGAM GENE, on one or more VGAM717 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM717 is inhibition of expression of host target genes, as part of a novel viral mechanism of attacking a host. Accordingly, utilities of VGAM717 include diagnosis, prevention and treatment of viral infection by Cercopithecine Herpesvirus 7. Specific functions, and accordingly utilities, of VGAM717 correlate with, and may be deduced from, the identity of the host target genes which VGAM717 binds and inhibits, and the function of these host target genes, as elaborated hereinbelow.

Nucleotide sequences of the VGAM717 precursor RNA, herein designated VGAM PRECURSOR RNA, and of the 'diced' VGAM717 RNA, herein designated VGAM RNA, and a schematic representation of the secondary folding of VGAM717 folded precursor RNA, herein designated VGAM FOLDED PRECURSOR RNA, of VGAM717 are further described hereinbelow with reference to Table 1.

Nucleotide sequences of host target binding sites, such as BINDING SITE-I, BINDING SITE-II and BINDING SITE-III of FIG. 1, found on VGAM717 host target RNA, and schematic representation of the complementarity of each of these host target binding sites to VGAM717 RNA, herein designated VGAM RNA, are described hereinbelow with reference to Table 2.

As mentioned hereinabove with reference to FIG. 1, a function of VGAM717 gene, herein designated VGAM is inhibition of expression of VGAM717 target genes. It is appreciated that specific functions, and accordingly utilities, of VGAM717 correlate with, and may be deduced from, the identity of the target genes which VGAM717 binds and inhibits, and the function of these target genes, as elaborated hereinbelow.

B-cell CLL/lymphoma 2 (BCL2, Accession NM_000633) is a VGAM717 host target gene. BCL2 BINDING SITE is HOST TARGET binding site found in the 3' untranslated region of mRNA encoded by BCL2, corresponding to a HOST TARGET binding site such as BINDING SITE I, BINDING SITE II or BINDING SITE III. Table 2 illustrates the complementarity of the nucleotide sequences of BCL2 BINDING SITE, designated SEQ ID:6255, to the nucleotide sequence of VGAM717 RNA, herein designated VGAM RNA, also designated SEQ ID:3428.

A function of VGAM717 is therefore inhibition of B-cell CLL/lymphoma 2 (BCL2, Accession NM_000633). Accordingly, utilities of VGAM717 include diagnosis, prevention and treatment of diseases and clinical conditions associated with BCL2. LOC120939 (Accession XM_073688) is another VGAM717 host target gene. LOC120939 BINDING SITE is HOST TARGET binding site found in the 3' untranslated region of mRNA encoded by LOC120939, corresponding to a HOST TARGET binding site such as BINDING SITE I, BINDING SITE II or BINDING SITE III. Table 2 illustrates the complementarity of the nucleotide sequences of LOC120939 BINDING SITE, designated SEQ ID:37515, to the nucleotide sequence of VGAM717 RNA, herein designated VGAM RNA, also designated SEQ ID:3428.

Another function of VGAM717 is therefore inhibition of LOC120939 (Accession XM_073688). Accordingly, utilities of VGAM717 include diagnosis, prevention and treatment of diseases and clinical conditions associated with LOC120939. LOC143381 (Accession XM_084501) is another VGAM717 host target gene. LOC143381 BINDING SITE is HOST TARGET binding site found in the 3' untranslated region of mRNA encoded by LOC143381, corresponding to a HOST TARGET binding site such as BINDING SITE I, BINDING SITE II or BINDING SITE III. Table 2 illustrates the complementarity of the nucleotide sequences of LOC143381 BINDING SITE, designated SEQ ID:37612, to the nucleotide sequence of VGAM717 RNA, herein designated VGAM RNA, also designated SEQ ID:3428.

Another function of VGAM717 is therefore inhibition of LOC143381 (Accession XM_084501). Accordingly, utilities of VGAM717 include diagnosis, prevention and treatment of diseases and clinical conditions associated with LOC143381. LOC257095 (Accession XM_173058) is another VGAM717 host target gene. LOC257095 BINDING SITE is HOST TARGET binding site found in the 5' untranslated region of mRNA encoded by LOC257095, corresponding to a HOST TARGET binding site such as BINDING SITE I, BINDING SITE II or BINDING SITE III. Table 2 illustrates the complementarity of the nucleotide sequences of LOC257095 BINDING SITE, designated SEQ ID:46312, to the nucleotide sequence of VGAM717 RNA, herein designated VGAM RNA, also designated SEQ ID:3428.

Another function of VGAM717 is therefore inhibition of LOC257095 (Accession XM_173058). Accordingly, utilities of VGAM717 include diagnosis, prevention and treatment of diseases and clinical conditions associated with LOC257095. LOC51055 (Accession NM_015901) is another VGAM717 host target gene. LOC51055 BINDING SITE is HOST TARGET binding site found in the 5' untranslated region of mRNA encoded by LOC51055, corresponding to a HOST TARGET binding site such as BINDING SITE I, BINDING SITE II or BINDING SITE III. Table 2 illustrates the complementarity of the nucleotide sequences of LOC51055 BINDING SITE, designated SEQ ID:18044, to the nucleotide sequence of VGAM717 RNA, herein designated VGAM RNA, also designated SEQ ID:3428.

Another function of VGAM717 is therefore inhibition of LOC51055 (Accession NM_015901). Accordingly, utilities of VGAM717 include diagnosis, prevention and treatment of diseases and clinical conditions associated with LOC51055. LOC92597 (Accession XM_046066) is another VGAM717 host target gene. LOC92597 BINDING SITE is HOST TARGET binding site found in the 3' untranslated region of mRNA encoded by LOC92597, corresponding to a HOST TARGET binding site such as BINDING SITE I, BINDING SITE II or BINDING SITE III. Table 2 illustrates the complementarity of the nucleotide sequences of LOC92597 BINDING SITE, designated SEQ ID:34673, to the nucleotide sequence of VGAM717 RNA, herein designated VGAM RNA, also designated SEQ ID:3428.

Another function of VGAM717 is therefore inhibition of LOC92597 (Accession XM_046066). Accordingly, utilities of VGAM717 include diagnosis, prevention and treatment of diseases and clinical conditions associated with LOC92597. FIG. 1 further provides a conceptual description of a novel bioinformatically detected viral gene of the present invention, referred to here as Viral Genomic Address Messenger 718 (VGAM718) viral gene, which modulates expression of respective host target genes thereof, the function and utility of which host target genes is known in the art.

VGAM718 is a novel bioinformatically detected regulatory, non protein coding, viral micro RNA (miRNA) gene. The method by which VGAM718 was detected is described hereinabove with reference to FIGS. 1-8.

VGAM718 gene, herein designated VGAM GENE, is a viral gene contained in the genome of Cercopithecine Herpesvirus 7. VGAM718 host target gene, herein designated VGAM HOST TARGET GENE, is a human gene contained in the human genome.

VGAM718 gene encodes a VGAM718 precursor RNA, herein designated VGAM PRECURSOR RNA. Similar to other miRNA genes, and unlike most ordinary genes, VGAM718 precursor RNA does not encode a protein. A nucleotide sequence identical or highly similar to the nucleotide sequence of VGAM718 precursor RNA is designated SEQ ID:704, and is provided hereinbelow with reference to the sequence listing part. Nucleotide sequence SEQ ID:704 is located at position 39450 relative to the genome of Cercopithecine Herpesvirus 7.

VGAM718 precursor RNA folds onto itself, forming VGAM718 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM718 folded precursor RNA into VGAM718 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM718 RNA is designated SEQ ID:3429, and is provided hereinbelow with reference to the sequence listing part.

VGAM718 host target gene, herein designated VGAM HOST TARGET GENE, encodes a corresponding messenger RNA, VGAM718 host target RNA, herein designated VGAM HOST TARGET RNA. VGAM718 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM718 RNA, herein designated VGAM RNA, binds complementarily to one or more host target binding sites located in untranslated regions of VGAM718 host target RNA, herein designated VGAM HOST TARGET RNA. This complementary binding is due to the fact that the nucleotide sequence of VGAM718 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM718 RNA, herein designated VGAM RNA, may have a different number of host target binding sites in untranslated regions of a VGAM718 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM718 RNA, herein designated VGAM RNA, to host target binding sites on VGAM718 host target RNA, herein designated VGAM HOST TARGET RNA, such as BINDING SITE I, BINDING SITE II and BINDING SITE III, inhibits translation of VGAM718 host target RNA into VGAM718 host target protein, herein designated VGAM HOST TARGET PROTEIN. VGAM host target protein is therefore outlined by a broken line.

It is appreciated that VGAM718 host target gene, herein designated VGAM HOST TARGET GENE, in fact represents a plurality of VGAM718 host target genes. The mRNA of each one of this plurality of VGAM718 host target genes comprises one or more host target binding sites, each having a nucleotide sequence which is at least partly complementary to VGAM718 RNA, herein designated VGAM RNA, and which when bound by VGAM718 RNA causes inhibition of translation of respective one or more VGAM718 host target proteins.

It is further appreciated by one skilled in the art that the mode of translational inhibition illustrated by FIG. 1 with specific reference to translational inhibition exerted by VGAM718 gene, herein designated VGAM GENE, on one or more VGAM718 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM718 is inhibition of expression of host target genes, as part of a novel viral mechanism of attacking a host. Accordingly, utilities of VGAM718 include diagnosis, prevention and treatment of viral infection by Cercopithecine Herpesvirus 7. Specific functions, and accordingly utilities, of VGAM718 correlate with, and may be deduced from, the identity of the host target genes which VGAM718 binds and inhibits, and the function of these host target genes, as elaborated hereinbelow.

Nucleotide sequences of the VGAM718 precursor RNA, herein designated VGAM PRECURSOR RNA, and of the 'diced' VGAM718 RNA, herein designated VGAM RNA, and a schematic representation of the secondary folding of VGAM718 folded precursor RNA, herein designated VGAM FOLDED PRECURSOR RNA, of VGAM718 are further described hereinbelow with reference to Table 1.

Nucleotide sequences of host target binding sites, such as BINDING SITE-I, BINDING SITE-II and BINDING SITE-III of FIG. 1, found on VGAM718 host target RNA, and schematic representation of the complementarity of each of these host target binding sites to VGAM718 RNA, herein designated VGAM RNA, are described hereinbelow with reference to Table 2.

As mentioned hereinabove with reference to FIG. 1, a function of VGAM718 gene, herein designated VGAM is inhibition of expression of VGAM718 target genes. It is appreciated that specific functions, and accordingly utilities, of VGAM718 correlate with, and may be deduced from, the identity of the target genes which VGAM718 binds and inhibits, and the function of these target genes, as elaborated hereinbelow.

Fibrinogen, A Alpha Polypeptide (FGA, Accession NM_000508) is a VGAM718 host target gene. FGA BINDING SITE is HOST TARGET binding site found in the 3' untranslated region of mRNA encoded by FGA, corresponding to a HOST TARGET binding site such as BINDING SITE I, BINDING SITE II or BINDING SITE III. Table 2 illustrates the complementarity of the nucleotide sequences of FGA BINDING SITE, designated SEQ ID:6118, to the nucleotide sequence of VGAM718 RNA, herein designated VGAM RNA, also designated SEQ ID:3429.

A function of VGAM718 is therefore inhibition of Fibrinogen, A Alpha Polypeptide (FGA, Accession NM_000508). Accordingly, utilities of VGAM718 include diagnosis, prevention and treatment of diseases and clinical conditions associated with FGA. Pleiomorphic Adenoma Gene-like 2 (PLAGL2, Accession XM_047007) is another VGAM718 host target gene. PLAGL2 BINDING SITE is HOST TARGET binding site found in the 3' untranslated region of mRNA encoded by PLAGL2, corresponding to a HOST TARGET binding site such as BINDING SITE I, BINDING SITE II or BINDING SITE III. Table 2 illustrates the complementarity of the nucleotide sequences of PLAGL2 BINDING SITE, designated SEQ ID:34872, to the nucleotide sequence of VGAM718 RNA, herein designated VGAM RNA, also designated SEQ ID:3429.

Another function of VGAM718 is therefore inhibition of Pleiomorphic Adenoma Gene-like 2 (PLAGL2, Accession XM_047007). Accordingly, utilities of VGAM718 include diagnosis, prevention and treatment of diseases and clinical conditions associated with PLAGL2. LOC256112 (Accession XM_172829) is another VGAM718 host target gene. LOC256112 BINDING SITE is HOST TARGET binding site found in the 3' untranslated region of mRNA encoded by LOC256112, corresponding to a HOST TARGET binding site such as BINDING SITE I, BINDING SITE II or BINDING SITE III. Table 2 illustrates the complementarity of the nucleotide sequences of LOC256112 BINDING SITE, designated SEQ ID:46101, to the nucleotide sequence of VGAM718 RNA, herein designated VGAM RNA, also designated SEQ ID:3429.

Another function of VGAM718 is therefore inhibition of LOC256112 (Accession XM_172829). Accordingly, utilities of VGAM718 include diagnosis, prevention and treatment of diseases and clinical conditions associated with LOC256112. LOC92979 (Accession NM_138396) is another VGAM718 host target gene. LOC92979 BINDING SITE is HOST TARGET binding site found in the 5' untranslated region of mRNA encoded by LOC92979, corresponding to a HOST TARGET binding site such as BINDING SITE I, BINDING SITE II or BINDING SITE III. Table 2 illustrates the complementarity of the nucleotide sequences of LOC92979 BINDING SITE, designated SEQ ID:28765, to the nucleotide sequence of VGAM718 RNA, herein designated VGAM RNA, also designated SEQ ID:3429.

Another function of VGAM718 is therefore inhibition of LOC92979 (Accession NM_138396). Accordingly, utilities of VGAM718 include diagnosis, prevention and treatment of diseases and clinical conditions associated with LOC92979. FIG. 1 further provides a conceptual description of a novel bioinformatically detected viral gene of the present invention, referred to here as Viral Genomic Address Messenger 719 (VGAM719) viral gene, which modulates expression of respective host target genes thereof, the function and utility of which host target genes is known in the art.

VGAM719 is a novel bioinformatically detected regulatory, non protein coding, viral micro RNA (miRNA) gene. The method by which VGAM719 was detected is described hereinabove with reference to FIGS. 1-8.

VGAM719 gene, herein designated VGAM GENE, is a viral gene contained in the genome of Ectocarpus Siliculosus Virus. VGAM719 host target gene, herein designated VGAM HOST TARGET GENE, is a human gene contained in the human genome.

VGAM719 gene encodes a VGAM719 precursor RNA, herein designated VGAM PRECURSOR RNA. Similar to other miRNA genes, and unlike most ordinary genes, VGAM719 precursor RNA does not encode a protein. A nucleotide sequence identical or highly similar to the nucleotide sequence of VGAM719 precursor RNA is designated SEQ ID:705, and is provided hereinbelow with reference to the sequence listing part. Nucleotide sequence SEQ ID:705 is located at position 32262 relative to the genome of Ectocarpus Siliculosus Virus.

VGAM719 precursor RNA folds onto itself, forming VGAM719 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM719 folded precursor RNA into VGAM719 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM719 RNA is designated SEQ ID:3430, and is provided hereinbelow with reference to the sequence listing part.

VGAM719 host target gene, herein designated VGAM HOST TARGET GENE, encodes a corresponding messenger RNA, VGAM719 host target RNA, herein designated VGAM HOST TARGET RNA. VGAM719 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM719 RNA, herein designated VGAM RNA, binds complementarily to one or more host target binding sites located in untranslated regions of VGAM719 host target RNA, herein designated VGAM HOST TARGET RNA. This complementary binding is due to the fact that the nucleotide sequence of VGAM719 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM719 RNA, herein designated VGAM RNA, may have a different number of host target binding sites in untranslated regions of a VGAM719 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM719 RNA, herein designated VGAM RNA, to host target binding sites on VGAM719 host target RNA, herein designated VGAM HOST TARGET RNA, such as BINDING SITE I, BINDING SITE II and BINDING SITE III, inhibits translation of VGAM719 host target RNA into VGAM719 host target protein, herein designated VGAM HOST TARGET PROTEIN. VGAM host target protein is therefore outlined by a broken line.

It is appreciated that VGAM719 host target gene, herein designated VGAM HOST TARGET GENE, in fact represents a plurality of VGAM719 host target genes. The mRNA of each one of this plurality of VGAM719 host target genes comprises one or more host target binding sites, each having a nucleotide sequence which is at least partly complementary to VGAM719 RNA, herein designated VGAM RNA, and which when bound by VGAM719 RNA causes inhibition of translation of respective one or more VGAM719 host target proteins.

It is further appreciated by one skilled in the art that the mode of translational inhibition illustrated by FIG. 1 with specific reference to translational inhibition exerted by VGAM719 gene, herein designated VGAM GENE, on one or more VGAM719 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM719 is inhibition of expression of host target genes, as part of a novel viral mechanism of attacking a host. Accordingly, utilities of VGAM719 include diagnosis, prevention and treatment of viral infection by Ectocarpus Siliculosus Virus. Specific functions, and accordingly utilities, of VGAM719 correlate with, and may be deduced from, the identity of the host target genes which VGAM719 binds and inhibits, and the function of these host target genes, as elaborated hereinbelow.

Nucleotide sequences of the VGAM719 precursor RNA, herein designated VGAM PRECURSOR RNA, and of the 'diced' VGAM719 RNA, herein designated VGAM RNA, and a schematic representation of the secondary folding of VGAM719 folded precursor RNA, herein designated VGAM FOLDED PRECURSOR RNA, of VGAM719 are further described hereinbelow with reference to Table 1.

Nucleotide sequences of host target binding sites, such as BINDING SITE-I, BINDING SITE-II and BINDING SITE-III of FIG. 1, found on VGAM719 host target RNA, and schematic representation of the complementarity of each of these host target binding sites to VGAM719 RNA, herein designated VGAM RNA, are described hereinbelow with reference to Table 2.

As mentioned hereinabove with reference to FIG. 1, a function of VGAM719 gene, herein designated VGAM is inhibition of expression of VGAM719 target genes. It is appreciated that specific functions, and accordingly utilities, of VGAM719 correlate with, and may be deduced from, the identity of the target genes which VGAM719 binds and inhibits, and the function of these target genes, as elaborated hereinbelow.

Fibroblast Growth Factor 4 (heparin secretory transforming protein 1, Kaposi sarcoma oncogene) (FGF4, Accession NM_002007) is a VGAM719 host target gene. FGF4 BINDING SITE is HOST TARGET binding site found in the 5' untranslated region of mRNA encoded by FGF4, corresponding to a HOST TARGET binding site such as BINDING SITE I, BINDING SITE II or BINDING SITE III. Table 2 illustrates the complementarity of the nucleotide sequences of FGF4 BINDING SITE, designated SEQ ID:7745, to the nucleotide sequence of VGAM719 RNA, herein designated VGAM RNA, also designated SEQ ID:3430.

A function of VGAM719 is therefore inhibition of Fibroblast Growth Factor 4 (heparin secretory transforming protein 1, Kaposi sarcoma oncogene) (FGF4, Accession NM_002007), a gene which can transform nih 3t3 cells from a human stomach tumor (hst) and from karposi's sarcoma (ks3). Accordingly, utilities of VGAM719 include diagnosis, prevention and treatment of diseases and clinical conditions associated with FGF4. The function of FGF4 has been established by previous studies. Sakamoto et al. (1986) tested the capacity for malignant transformation of DNA from 21 stomach cancers, 16 stomach cancers metastatic to lymph nodes, and 21 specimens of apparently noncancerous stomach mucosa from a total of 26 patients with stomach cancer. The DNA was transferred to NIH 3T3 cells by the calcium precipitation technique. Transforming ability was shown by 3 samples: a primary cancer, a metastatic cancer, and a presumably normal gastric mucosa. The transforming gene from the primary cancer was cloned. It bore no homology with previously reported transforming sequences. Taira et al. (1987) isolated an HST cDNA clone that had an efficient transforming activity in a focus-forming assay when it was inserted into an expression vector. Characterization of this clone allowed Taira et al. (1987) to predict that a 206-amino acid protein product was responsible for this transforming activity. In an addendum, Taira et al. (1987) indicated that 42.3% homology existed between the amino acid residues of 1 ORF (open reading frame) of HST and part of bovine basic fibroblast growth factor. They suggested that further studies would elucidate the role of the HST gene in the development of stomach cancer which, they stated, has the highest incidence of all known cancers. By in situ hybridization, Adelaide et al. (1988) mapped the HST gene to chromosome 11q13. This is also the location of the INT2 gene. Furthermore, Adelaide et al. (1988) found the 2 genes to be coamplified in a human melanoma. Huebner et al. (1988) mapped the K-FGF oncogene to 11q11-q23 by hybridization studies using DNA from rodent-human somatic cell hybrids and then localized it more precisely to 11q13 by in situ hybridization. The 11q13 region is also the site of the BCL1 gene (OMIM Ref. No. 168461), which is involved in the 11;14 translocation characteristic of some B-cell tumors; see 151400. The oncogene SEA (OMIM Ref. No. 165110) has also been mapped to 11q13. By pulsed-field gel electrophoresis and by analysis of overlapping cosmid clones, Wada et al. (1988) concluded that HST1 is located about 35 kb downstream of INT2 in the same transcriptional orientation. Animal model experiments lend further support to the function of FGF4. Feldman et al. (1995) demonstrated that Fgf4 -/- embryos die on embryonic day 5.0. To circumvent this early lethality and assess Fgf4 function in limb development, Sun et al. (2000) used the Cre/loxP system and found that Shh expression is maintained and limb formation is normal when Fgf4 is inactivated in mouse limbs, contradicting another model which suggested that Fgf4 expression is not maintained in Shh -/- mouse limbs. Sun et al. (2000) also found that maintenance of Fgf9 (OMIM Ref. No. 600921) and Fgf17 (OMIM Ref. No. 603725) expression is dependent on Shh, whereas Fgf8 (OMIM Ref. No. 600483) expression is not. Sun et al. (2000) developed a model in which no individual Fgf expressed in the apical ectodermal ridge is solely necessary to maintain Shh expression, but instead the combined activity of 2 or more apical ectodermal ridge Fgfs function in a positive feedback loop with Shh to control limb development.

It is appreciated that the abovementioned animal model for FGF4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Taira, M.; Yoshida, T.; Miyagawa, K.; Sakamoto, H.; Terada, M.; Sugimura, T.: cDNA sequence of human transforming gene hst and identification of the coding sequence required for transforming activity. Proc. Nat. Acad. Sci. 84:2980-2984, 1987; and Huebner, K.; Ferrari, A. C.; Delli Bovi, P.; Croce, C. M.; Basilico, C.: The FGF-related oncogene, K-FGF, maps to human chromosome region 11q13, possibly near int-2. Oncogene Res. 3:26.

Further studies establishing the function and utilities of FGF4 are found in John Hopkins OMIM database record ID 164980, and in sited publications numbered 3284-3287, 2604, 3288-3290, 11445, 11531-1153 and 2130 listed in the bibliography section hereinbelow, which are also hereby incorporated by reference. Natriuretic Peptide Receptor A/guanylate Cyclase A (atrionatriuretic peptide receptor A) (NPR1, Accession XM_113360) is another VGAM719 host target gene. NPR1 BINDING SITE is HOST TARGET binding site found in the 5' untranslated region of mRNA encoded by NPR1, corresponding to a HOST TARGET binding site such as BINDING SITE I, BINDING SITE II or BINDING SITE III. Table 2 illustrates the complementarity of the nucleotide sequences of NPR1 BINDING SITE, designated SEQ ID:42233, to the nucleotide sequence of VGAM719 RNA, herein designated VGAM RNA, also designated SEQ ID:3430.

Another function of VGAM719 is therefore inhibition of Natriuretic Peptide Receptor A/guanylate Cyclase A (atrionatriuretic peptide receptor A) (NPR1, Accession XM_113360), a gene which has guanylate cyclase activity on binding of anf. Accordingly, utilities of VGAM719 include diagnosis, prevention and treatment of diseases and clinical conditions associated with NPR1. The function of NPR1 has been established by previous studies. The precursor of atrial natriuretic peptide (ANP; 108780) is produced and stored mainly in the right atrium of the heart (see OMIM Ref. No. Oliver et al., 1997). ANP formed from this precursor is released in response to atrial stretch. Once in the circulation, ANP binds to the natriuretic peptide receptor A (ANPRA, or NPR1), also known as guanylate cyclase A (or GC-A), mainly in the kidney, vascular tissue, and adrenal gland. This binding induces an increase in intracellular cGMP and initiates natriuresis, diuresis, and vasodilation, all of which contribute to lowering blood pressure. ‘B-type’ natriuretic peptide, a structurally related peptide formed mainly in the cardiac ventricles, also acts through ANPRA and has effects similar to ANP. Lowe et al. (1990) assigned the ANPRA gene to 1q12-qter by PCR analysis of genomic DNA from somatic cell hybrids. By in situ hybridization, the gene was further localized to 1q21-q22. Animal model experiments lend further support to the function of NPR1. To study the role of NPRA in the regulation of blood pressure and in the cardiovascular response to sustained hypertension, Oliver et al. (1997) made mice completely lacking this receptor. They found that mice lacking a functional Npr1 gene coding for NPRA had elevated blood pressures and heart exhibiting marked hypertrophy with interstitial fibrosis resembling that seen in human hypertensive heart disease. Echocardiographic evaluation of the mice demonstrated a compensated state of systemic hypertension in which cardiac hypertrophy and dilatation were evident but with no reduction in ventricular performance. Nevertheless, sudden death, with morphologic evidence indicative in some animals of congestive heart failure and in others of aortic dissection, occurred in all 15 male mice lacking Npr1 before 6 months of age, and in 1 of 16 females in this study.

It is appreciated that the abovementioned animal model for NPR1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lowe, D. G.; Klisak, I.; Sparkes, R. S.; Mohandas, T.; Goeddel, D. V.: Chromosomal distribution of three members of the human natriuretic peptide receptor/guanylyl cyclase gene family. Genomics 8:304-312, 1990; and Oliver, P. M.; Fox, J. E.; Kim, R.; Rockman, H. A.; Kim, H.-S.; Reddick, R. L.; Pandey, K. N.; Milgram, S. L.; Smithies, O.; Maeda, N.: Hypertension, cardiac hypertrophy, and sudden dea.

Further studies establishing the function and utilities of NPR1 are found in John Hopkins OMIM database record ID 108960, and in sited publications numbered 4235-423 and 4318-4319 listed in the bibliography section hereinbelow, which are also hereby incorporated by reference. T-box, Brain, 1 (TBR1, Accession NM_006593) is another VGAM719 host target gene. TBR1 BINDING SITE is HOST TARGET binding site found in the 3' untranslated region of mRNA encoded by TBR1, corresponding to a HOST TARGET binding site such as BINDING SITE I, BINDING SITE II or BINDING SITE III. Table 2 illustrates the complementarity of the nucleotide sequences of TBR1 BINDING SITE, designated SEQ ID:13357, to the nucleotide sequence of VGAM719 RNA, herein designated VGAM RNA, also designated SEQ ID:3430.

Another function of VGAM719 is therefore inhibition of T-box, Brain, 1 (TBR1, Accession NM_006593), a gene which is of unknown function. Accordingly, utilities of VGAM719 include diagnosis, prevention and treatment of diseases and clinical conditions associated with TBR1. The function of TBR1 has been established by previous studies. Using subtractive hybridization of day 14.5 embryonic telencephalon and adult telencephalon, Bulfone et al. (1995) identified a mouse cDNA for Tbr1 (T-brain-1). Using mouse Tbr1 as a probe to screen a week 17 human fetal cDNA library, the authors identified a TBR1 cDNA encoding a 682-amino acid protein. The sequence of the TBR1 protein is 99% identical to the mouse sequence; both show high homology, particularly in the T-box DNA-binding domain, with the protein product of the T (Brachyury) gene (see OMIM Ref. No. 601397). Northern blot and in situ hybridization analyses revealed that expression of mouse Tbr1 is largely restricted to the cerebral cortex. It is expressed in postmitotic cells in the forebrain with onset during embryogenesis and continues to be expressed in the adult brain. Expression is 10-fold more abundant in embryonic than in adult tissue. To identify binding partners for the guanylate kinase domain of CASK (OMIM Ref. No. 300172), Hsueh et al. (2000) carried out a yeast 2-hybrid screen of brain cDNA libraries, from which TBR1 was isolated. By deletion analysis, the C-terminal region of TBR1 (residues 342 to 681) was found to be necessary and sufficient for association with the guanylate kinase domain of CASK. When coexpressed in COS-7 cells, TBR1 and CASK were readily coprecipitated by antibodies directed against either individual protein. Hsueh et al. (2000) demonstrated that CASK enters the nucleus and binds to a specific DNA sequence (the T element) in a complex with TBR1. CASK acts as a coactivator of TBR1 to induce transcription of T element-containing genes, including reelin, a gene that is essential for cerebrocortical development.

Full details of the abovementioned studies are described in the following publications, the disclosure of which are hereby incorporated by reference:

Bulfone, A.; Smiga, S. M.; Shimamura, K.; Peterson, A.; Puelles, L.; Rubenstein, J. L. R.: T-brain-1: a homolog of Brachyury whose expression defines molecularly distinct domains within the cerebral cortex. Neuron 15:63-78, 1995; and Hsueh, Y.-P.; Wang, T.-F.; Yang, F.-C.; Sheng, M.: Nuclear transcription and transcription regulation by the membrane-associated guanylate kinase CASK/LIN-2. Nature 404:298-302, 2000.

Further studies establishing the function and utilities of TBR1 are found in John Hopkins OMIM database record ID 604616, and in sited publications numbered 504 and 7047 listed in the bibliography section hereinbelow, which are also hereby incorporated by reference. KIAA0125 (Accession XM_018203) is another VGAM719 host target gene. KIAA0125 BINDING SITE is HOST TARGET binding site found in the 3' untranslated region of mRNA encoded by KIAA0125, corresponding to a HOST TARGET binding site such as BINDING SITE I, BINDING SITE II or BINDING SITE III. Table 2 illustrates the complementarity of the nucleotide sequences of KIAA0125 BINDING SITE, designated SEQ ID:30342, to the nucleotide sequence of VGAM719 RNA, herein designated VGAM RNA, also designated SEQ ID:3430.

Another function of VGAM719 is therefore inhibition of KIAA0125 (Accession XM_018203). Accordingly, utilities of VGAM719 include diagnosis, prevention and treatment of diseases and clinical conditions associated with KIAA0125. FIG. 1 further provides a conceptual description of a novel bioinformatically detected viral gene of the present invention, referred to here as Viral Genomic Address Messenger 720 (VGAM720) viral gene, which modulates expression of respective host target genes thereof, the function and utility of which host target genes is known in the art.

VGAM720 is a novel bioinformatically detected regulatory, non protein coding, viral micro RNA (miRNA) gene. The method by which VGAM720 was detected is described hereinabove with reference to FIGS. 1-8.

VGAM720 gene, herein designated VGAM GENE, is a viral gene contained in the genome of Ectocarpus Siliculosus Virus. VGAM720 host target gene, herein designated VGAM HOST TARGET GENE, is a human gene contained in the human genome.

VGAM720 gene encodes a VGAM720 precursor RNA, herein designated VGAM PRECURSOR RNA. Similar to other miRNA genes, and unlike most ordinary genes, VGAM720 precursor RNA does not encode a protein. A nucleotide sequence identical or highly similar to the nucleotide sequence of VGAM720 precursor RNA is designated SEQ ID:706, and is provided hereinbelow with reference to the sequence listing part. Nucleotide sequence SEQ ID:706 is located at position 33937 relative to the genome of Ectocarpus Siliculosus Virus.

VGAM720 precursor RNA folds onto itself, forming VGAM720 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM720 folded precursor RNA into VGAM720 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM720 RNA is designated SEQ ID:3431, and is provided hereinbelow with reference to the sequence listing part.

VGAM720 host target gene, herein designated VGAM HOST TARGET GENE, encodes a corresponding messenger RNA, VGAM720 host target RNA, herein designated VGAM HOST TARGET RNA. VGAM720 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM720 RNA, herein designated VGAM RNA, binds complementarily to one or more host target binding sites located in untranslated regions of VGAM720 host target RNA, herein designated VGAM HOST TARGET RNA. This complementary binding is due to the fact that the nucleotide sequence of VGAM720 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM720 RNA, herein designated VGAM RNA, may have a different number of host target binding sites in untranslated regions of a VGAM720 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM720 RNA, herein designated VGAM RNA, to host target binding sites on VGAM720 host target RNA, herein designated VGAM HOST TARGET RNA, such as BINDING SITE I, BINDING SITE II and BINDING SITE III, inhibits translation of VGAM720 host target RNA into VGAM720 host target protein, herein designated VGAM HOST TARGET PROTEIN. VGAM host target protein is therefore outlined by a broken line.

It is appreciated that VGAM720 host target gene, herein designated VGAM HOST TARGET GENE, in fact represents a plurality of VGAM720 host target genes. The mRNA of each one of this plurality of VGAM720 host target genes comprises one or more host target binding sites, each having a nucleotide sequence which is at least partly complementary to VGAM720 RNA, herein designated VGAM RNA, and which when bound by VGAM720 RNA causes inhibition of translation of respective one or more VGAM720 host target proteins.

It is further appreciated by one skilled in the art that the mode of translational inhibition illustrated by FIG. 1 with specific reference to translational inhibition exerted by VGAM720 gene, herein designated VGAM GENE, on one or more VGAM720 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM720 is inhibition of expression of host target genes, as part of a novel viral mechanism of attacking a host. Accordingly, utilities of VGAM720 include diagnosis, prevention and treatment of viral infection by Ectocarpus Siliculosus Virus. Specific functions, and accordingly utilities, of VGAM720 correlate with, and may be deduced from, the identity of the host target genes which VGAM720 binds and inhibits, and the function of these target genes, as elaborated hereinbelow.

Nucleotide sequences of the VGAM720 precursor RNA, herein designated VGAM PRECURSOR RNA, and of the 'diced' VGAM720 RNA, herein designated VGAM RNA, and a schematic representation of the secondary folding of VGAM720 folded precursor RNA, herein designated VGAM FOLDED PRECURSOR RNA, of VGAM720 are further described hereinbelow with reference to Table 1.

Nucleotide sequences of host target binding sites, such as BINDING SITE-I, BINDING SITE-II and BINDING SITE-III of FIG. 1, found on VGAM720 host target RNA, and schematic representation of the complementarity of each of these host target binding sites to VGAM720 RNA, herein designated VGAM RNA, are described hereinbelow with reference to Table 2.

As mentioned hereinabove with reference to FIG. 1, a function of VGAM720 gene, herein designated VGAM is inhibition of expression of VGAM720 target genes. It is appreciated that specific functions, and accordingly utilities, of VGAM720 correlate with, and may be deduced from, the identity of the target genes which VGAM720 binds and inhibits, and the function of these target genes, as elaborated hereinbelow.

MLL Sep.in-like Fusion (MSF, Accession XM_113892) is a VGAM720 host target gene. MSF BINDING SITE is HOST TARGET binding site found in the 3" untranslated region of mRNA encoded by MSF, corresponding to a HOST TARGET binding site such as BINDING SITE I, BINDING SITE II or BINDING SITE III. Table 2 illustrates the complementarity of the nucleotide sequences of MSF BINDING SITE, designated SEQ ID:42520, to the nucleotide sequence of VGAM720 RNA, herein designated VGAM RNA, also designated SEQ ID:3431.

A function of VGAM720 is therefore inhibition of MLL Sep.in-like Fusion (MSF, Accession XM_113892), a gene which plays a role in the cell cycle. Accordingly, utilities of VGAM720 include diagnosis, prevention and treatment of diseases and clinical conditions associated with MSF. The function of MSF and its association with various diseases and clinical conditions, has been established by previous studies, as described hereinabove with reference to VGAM514. Carbohydrate (N-acetylgalactosamine 4-0) Sulfotransferase 8 (CHST8, Accession NM_022467) is another VGAM720 host target gene. CHST8 BINDING SITE is HOST TARGET binding site found in the 5' untranslated region of mRNA encoded by CHST8, corresponding to a HOST TARGET binding site such as BINDING SITE I, BINDING SITE II or BINDING SITE III. Table 2 illustrates the complementarity of the nucleotide sequences of CHST8 BINDING SITE, designated SEQ ID:22817, to the nucleotide sequence of VGAM720 RNA, herein designated VGAM RNA, also designated SEQ ID:3431.

Another function of VGAM720 is therefore inhibition of Carbohydrate (N-acetylgalactosamine 4-0) Sulfotransferase 8 (CHST8, Accession NM_022467). Accordingly, utilities of VGAM720 include diagnosis, prevention and treatment of diseases and clinical conditions associated with CHST8. KIAA0435 (Accession NM_014801) is another VGAM720 host target gene. KIAA0435 BINDING SITE is HOST TARGET binding site found in the 3' untranslated region of mRNA encoded by KIAA0435, corresponding to a HOST TARGET binding site such as BINDING SITE I, BINDING SITE II or BINDING SITE III. Table 2 illustrates the complementarity of the nucleotide sequences of KIAA0435 BINDING SITE, designated SEQ ID:16718, to the nucleotide sequence of VGAM720 RNA, herein designated VGAM RNA, also designated SEQ ID:3431.

Another function of VGAM720 is therefore inhibition of KIAA0435 (Accession NM_014801). Accordingly, utilities of VGAM720 include diagnosis, prevention and treatment of diseases and clinical conditions associated with KIAA0435.

FIG. 1 further provides a conceptual description of a novel bioinformatically detected viral gene of the present invention, referred to here as Viral Genomic Address Messenger 721 (VGAM721) viral gene, which modulates expression of respective host target genes thereof, the function and utility of which host target genes is known in the art.

VGAM721 is a novel bioinformatically detected regulatory, non protein coding, viral micro RNA (miRNA) gene. The method by which VGAM721 was detected is described hereinabove with reference to FIGS. 1-8.

VGAM721 gene, herein designated VGAM GENE, is a viral gene contained in the genome of Tomato Mosaic Virus. VGAM721 host target gene, herein designated VGAM HOST TARGET GENE, is a human gene contained in the human genome.

VGAM721 gene encodes a VGAM721 precursor RNA, herein designated VGAM PRECURSOR RNA. Similar to other miRNA genes, and unlike most ordinary genes, VGAM721 precursor RNA does not encode a protein. A nucleotide sequence identical or highly similar to the nucleotide sequence of VGAM721 precursor RNA is designated SEQ ID:707, and is provided hereinbelow with reference to the sequence listing part. Nucleotide sequence SEQ ID:707 is located at position 1715 relative to the genome of Tomato Mosaic Virus.

VGAM721 precursor RNA folds onto itself, forming VGAM721 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM721 folded precursor RNA into VGAM721 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM721 RNA is designated SEQ ID:3432, and is provided hereinbelow with reference to the sequence listing part.

VGAM721 host target gene, herein designated VGAM HOST TARGET GENE, encodes a corresponding messenger RNA, VGAM721 host target RNA, herein designated VGAM HOST TARGET RNA. VGAM721 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM721 RNA, herein designated VGAM RNA, binds complementarily to one or more host target binding sites located in untranslated regions of VGAM721 host target RNA, herein designated VGAM HOST TARGET RNA. This complementary binding is due to the fact that the nucleotide sequence of VGAM721 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM721 RNA, herein designated VGAM RNA, may have a different number of host target binding sites in untranslated regions of a VGAM721 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM721 RNA, herein designated VGAM RNA, to host target binding sites on VGAM721 host target RNA, herein designated VGAM HOST TARGET RNA, such as BINDING SITE I, BINDING SITE II and BINDING SITE III, inhibits translation of VGAM721 host target RNA into VGAM721 host target protein, herein designated VGAM HOST TARGET PROTEIN. VGAM host target protein is therefore outlined by a broken line.

It is appreciated that VGAM721 host target gene, herein designated VGAM HOST TARGET GENE, in fact represents a plurality of VGAM721 host target genes. The mRNA of each one of this plurality of VGAM721 host target genes comprises one or more host target binding sites, each having a nucleotide sequence which is at least partly complementary to VGAM721 RNA, herein designated VGAM RNA, and which when bound by VGAM721 RNA causes inhibition of translation of respective one or more VGAM721 host target proteins.

It is further appreciated by one skilled in the art that the mode of translational inhibition illustrated by FIG. 1 with specific reference to translational inhibition exerted by VGAM721 gene, herein designated VGAM GENE, on one or more VGAM721 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM721 is inhibition of expression of host target genes, as part of a novel viral mechanism of attacking a host. Accordingly, utilities of VGAM721 include diagnosis, prevention and treatment of viral infection by Tomato Mosaic Virus. Specific functions, and accordingly utilities, of VGAM721 correlate with, and may be deduced from, the identity of the host target genes which VGAM721 binds and inhibits, and the function of these host target genes, as elaborated hereinbelow.

Nucleotide sequences of the VGAM721 precursor RNA, herein designated VGAM PRECURSOR RNA, and of the 'diced' VGAM721 RNA, herein designated VGAM RNA, and a schematic representation of the secondary folding of VGAM721 folded precursor RNA, herein designated VGAM FOLDED PRECURSOR RNA, of VGAM721 are further described hereinbelow with reference to Table 1.

Nucleotide sequences of host target binding sites, such as BINDING SITE-I, BINDING SITE-II and BINDING SITE-III of FIG. 1, found on VGAM721 host target RNA, and schematic representation of the complementarity of each of these host target binding sites to VGAM721 RNA, herein designated VGAM RNA, are described hereinbelow with reference to Table 2.

As mentioned hereinabove with reference to FIG. 1, a function of VGAM721 gene, herein designated VGAM is inhibition of expression of VGAM721 target genes. It is appreciated that specific functions, and accordingly utilities, of VGAM721 correlate with, and may be deduced from, the identity of the target genes which VGAM721 binds and inhibits, and the function of these target genes, as elaborated hereinbelow.

DNA (cytosine-5-)-methyltransferase 3 Beta (DNMT3B, Accession NM_006892) is a VGAM721 host target gene. DNMT3B BINDING SITE is HOST TARGET binding site found in the 3' untranslated region of mRNA encoded by DNMT3B, corresponding to a HOST TARGET binding site such as BINDING SITE I, BINDING SITE II or BINDING SITE III. Table 2 illustrates the complementarity of the nucleotide sequences of DNMT3B BINDING SITE, designated SEQ ID:13758, to the nucleotide sequence of VGAM721 RNA, herein designated VGAM RNA, also designated SEQ ID:3432.

A function of VGAM721 is therefore inhibition of DNA (cytosine-5-)-methyltransferase 3 Beta (DNMT3B, Accession NM_006892), a gene which is required for genome wide de novo methylation. Accordingly, utilities of VGAM721 include diagnosis, prevention and treatment of diseases and clinical conditions associated with DNMT3B. The function of DNMT3B and its association with various diseases and clinical conditions, has been established by previous studies, as described hereinabove with reference to VGAM280. Oxidation Resistance 1 (OXR1, Accession NM_018002) is another VGAM721 host target gene. OXR1 BINDING SITE is HOST TARGET binding site found in the 3' untranslated region of mRNA encoded by OXR1, corresponding to a HOST TARGET binding site such as BINDING SITE I, BINDING SITE II or BINDING SITE III. Table 2 illustrates the complementarity of the nucleotide sequences of OXR1 BINDING SITE, designated SEQ ID:19731, to the nucleotide sequence of VGAM721 RNA, herein designated VGAM RNA, also designated SEQ ID:3432.

Another function of VGAM721 is therefore inhibition of Oxidation Resistance 1 (OXR1, Accession NM_018002). Accordingly, utilities of VGAM721 include diagnosis, prevention and treatment of diseases and clinical conditions associated with OXR1. V-src Sarcoma (Schmidt-Ruppin A-2) Viral Oncogene Homolog (avian) (SRC, Accession NM_005417) is another VGAM721 host target gene. SRC BINDING SITE is HOST TARGET binding site found in the 3' untranslated region of mRNA encoded by SRC, corresponding to a HOST TARGET binding site such as BINDING SITE I, BINDING SITE II or BINDING SITE III. Table 2 illustrates the complementarity of the nucleotide sequences of SRC BINDING SITE, designated SEQ ID:11886, to the nucleotide sequence of VGAM721 RNA, herein designated VGAM RNA, also designated SEQ ID:3432.

Another function of VGAM721 is therefore inhibition of V-src Sarcoma (Schmidt-Ruppin A-2) Viral Oncogene Homolog (avian) (SRC, Accession NM_005417), a gene which is a tyrosine kinase. Accordingly, utilities of VGAM721 include diagnosis, prevention and treatment of diseases and clinical conditions associated with SRC. The function of SRC has been established by previous studies. Elevated c-src tyrosine kinase activity has been found in colon cancers, particularly in those metastatic to the liver. Studies of the mechanism of SRC regulation suggested that SRC kinase activity is downregulated by phosphorylation of a critical C-terminal tyrosine (tyr530 in human SRC, equivalent to tyr527 in chicken Src) and have implied the existence of activating mutations in this C-terminal regulatory region. Irby et al. (1999) reported the identification of a truncating mutation in SRC at codon 531 in 12% of cases of advanced human colon cancer tested and demonstrated that the mutation is activating, transforming, tumorigenic, and metastasis-promoting. The results provided, for the first time, genetic evidence that activating SRC mutations may have a role in the malignant progression of human colon cancer. SRC is the symbol for the human gene homologous in sequence to the v-src gene of the Rous sarcoma virus (also called avian sarcoma virus, ASV). The human proto-oncogene was assigned to chromosome 20 by somatic cell hybrid studies (Sakaguchi et al., 1982). Le Beau et al. (1984) assigned the SRC gene to 20q12-q13 by in situ hybridization. Lebo et al. (1984) and Parker et al. (1985) confirmed the assignment by dual-beam chromosome sorting and spot blot DNA analysis. Le Beau et al. (1985) found that deletions of 20q in myeloid disorders were actually interstitial although they appeared to be terminal; thus, the interstitial deletion had resulted in a shift at the SRC locus from 20q313 to the 20q breakpoint region. (FGR OMIM Ref. No. 164940.) Azarnia et al. (1988) found that overexpression of the SRC gene in NIH 3T3 cells caused reduction of cell-to-cell transmission of molecules in the 400- to 700-dalton range. down regulation was enhanced by point mutation of tyrosine-527, whereas mutation of tyrosine-416 suppressed both the down regulation of communication by the tyr-527 mutation and that by gene overexpression. The regulation of communication by SRC may be important in the control of embryonic development and cellular growth. By in situ hybridization, Morris et al. (1989) placed the SRC gene at 20q11.2. They observed a secondary peak of grains in the region 20q13.2-qter, the localization of SRC suggested by previous in situ studies. Furthermore, Morris et al. (1989) found that 1 allele of the SRC gene was lost in 2 patients with leukemia and a deletion in 20q. They suggested that the deletions were interstitial. The new assignment, 20q11.2, is consistent with the assignment of HCK (OMIM Ref. No. 142370) which presumably belongs to the same gene family, having originated from a common ancestral gene.

Full details of the abovementioned studies are described in the following publications, the disclosure of which are hereby incorporated by reference:

Irby, R. B.; Mao, W.; Coppola, D.; Kang, J.; Loubeau, J. M.; Trudeau, W.; Karl, R.; Fujita, D. J.; Jove, R.; Yeatman, T. J.: Activating SRC mutation in a subset of advanced human colon cancers. Nature Genet. 21:187-190, 1999; and Azarnia, R.; Reddy, S.; Kmiecik, T. E.; Shalloway, D.; Loewenstein, W. R.: The cellular src gene product regulates junctional cell-to-cell communication. Science 239:398-401, 1988.

Further studies establishing the function and utilities of SRC are found in John Hopkins OMIM database record ID 190090, and in sited publications numbered 9787-9791, 10883-10884, 9792, 12536, 10801-9796, 355 and 9797 listed in the bibliography section hereinbelow, which are also hereby incorporated by reference. Suppressor of Fused Homolog (Drosophila) (SUFU, Accession NM_016169) is another VGAM721 host target gene. SUFU BINDING SITE is HOST TARGET binding site found in the 3' untranslated region of mRNA encoded by SUFU, corresponding to a HOST TARGET binding site such as BINDING SITE I, BINDING SITE II or BINDING SITE III. Table 2 illustrates the complementarity of the nucleotide sequences of SUFU BINDING SITE, designated SEQ ID:18254, to the nucleotide sequence of VGAM721 RNA, herein designated VGAM RNA, also designated SEQ ID:3432.

Another function of VGAM721 is therefore inhibition of Suppressor of Fused Homolog (Drosophila) (SUFU, Accession NM_016169). Accordingly, utilities of VGAM721 include diagnosis, prevention and treatment of diseases and clinical conditions associated with SUFU. FLJ22596 (Accession NM_025086) is another VGAM721 host target gene. FLJ22596 BINDING SITE is HOST TARGET binding site found in the 5' untranslated region of mRNA encoded by FLJ22596, corresponding to a HOST TARGET binding site such as BINDING SITE I, BINDING SITE II or BINDING SITE III. Table 2 illustrates the complementarity of the nucleotide sequences of FLJ22596 BINDING SITE, designated SEQ ID:24704, to the nucleotide sequence of VGAM721 RNA, herein designated VGAM RNA, also designated SEQ ID:3432.

Another function of VGAM721 is therefore inhibition of FLJ22596 (Accession NM_025086). Accordingly, utilities of VGAM721 include diagnosis, prevention and treatment of diseases and clinical conditions associated with FLJ22596. KIAA0229 (Accession XM_166478) is another VGAM721 host target gene. KIAA0229 BINDING SITE is HOST TARGET binding site found in the 3' untranslated region of mRNA encoded by KIAA0229, corresponding to a HOST TARGET binding site such as BINDING SITE I, BINDING SITE II or BINDING SITE III. Table 2 illustrates the complementarity of the nucleotide sequences of KIAA0229 BINDING SITE, designated SEQ ID:44402, to the nucleotide sequence of VGAM721 RNA, herein designated VGAM RNA, also designated SEQ ID:3432.

Another function of VGAM721 is therefore inhibition of KIAA0229 (Accession XM_166478). Accordingly, utilities of VGAM721 include diagnosis, prevention and treatment of diseases and clinical conditions associated with KIAA0229. KIAA1228 (Accession XM_036408) is another VGAM721 host target gene. KIAA1228 BINDING SITE is HOST TARGET binding site found in the 3' untranslated region of mRNA encoded by KIAA1228, corresponding to a HOST TARGET binding site such as BINDING SITE I, BINDING SITE II or BINDING SITE III. Table 2 illustrates the complementarity of the nucleotide sequences of KIAA1228 BINDING SITE, designated SEQ ID:32443, to the nucleotide sequence of VGAM721 RNA, herein designated VGAM RNA, also designated SEQ ID:3432.

Another function of VGAM721 is therefore inhibition of KIAA1228 (Accession XM_036408). Accordingly, utilities of VGAM721 include diagnosis, prevention and treatment of diseases and clinical conditions associated with KIAA1228. Syntaxin 6 (STX6, Accession NM_005819) is another VGAM721 host target gene. STX6 BINDING SITE is HOST TARGET binding site found in the 3' untranslated region of mRNA encoded by STX6, corresponding to a HOST TARGET binding site such as BINDING SITE I, BINDING SITE II or BINDING SITE III. Table 2 illustrates the complementarity of the nucleotide sequences of STX6 BINDING SITE, designated SEQ ID:12419, to the nucleotide sequence of VGAM721 RNA, herein designated VGAM RNA, also designated SEQ ID:3432.

Another function of VGAM721 is therefore inhibition of Syntaxin 6 (STX6, Accession NM_005819). Accordingly, utilities of VGAM721 include diagnosis, prevention and treatment of diseases and clinical conditions associated with STX6. LOC126661 (Accession XM_059061) is another VGAM721 host target gene. LOC126661 BINDING SITE is HOST TARGET binding site found in the 3' untranslated region of mRNA encoded by LOC126661, corresponding to a HOST TARGET binding site such as BINDING SITE I, BINDING SITE II or BINDING SITE III. Table 2 illustrates the complementarity of the nucleotide sequences of LOC126661 BINDING SITE, designated SEQ ID:36852, to the nucleotide sequence of VGAM721 RNA, herein designated VGAM RNA, also designated SEQ ID:3432.

Another function of VGAM721 is therefore inhibition of LOC126661 (Accession XM_059061). Accordingly, utilities of VGAM721 include diagnosis, prevention and treatment of diseases and clinical conditions associated with LOC126661. LOC146823 (Accession XM_097105) is another VGAM721 host target gene. LOC146823 BINDING SITE is HOST TARGET binding site found in the 3' untranslated region of mRNA encoded by LOC146823, corresponding to a HOST TARGET binding site such as BINDING SITE I, BINDING SITE II or BINDING SITE III. Table 2 illustrates the complementarity of the nucleotide sequences of LOC146823 BINDING SITE, designated SEQ ID:40749, to the nucleotide sequence of VGAM721 RNA, herein designated VGAM RNA, also designated SEQ ID:3432.

Another function of VGAM721 is therefore inhibition of LOC146823 (Accession XM_097105). Accordingly, utilities of VGAM721 include diagnosis, prevention and treatment of diseases and clinical conditions associated with LOC146823. LOC152018 (Accession XM_098156) is another VGAM721 host target gene. LOC152018 BINDING SITE is HOST TARGET binding site found in the 3' untranslated region of mRNA encoded by LOC152018, corresponding to a HOST TARGET binding site such as BINDING SITE I, BINDING SITE II or BINDING SITE III. Table 2 illustrates the complementarity of the nucleotide sequences of LOC152018 BINDING SITE, designated SEQ ID:41419, to the nucleotide sequence of VGAM721 RNA, herein designated VGAM RNA, also designated SEQ ID:3432.

Another function of VGAM721 is therefore inhibition of LOC152018 (Accession XM_098156). Accordingly, utilities of VGAM721 include diagnosis, prevention and treatment of diseases and clinical conditions associated with LOC152018. LOC157278 (Accession XM_098741) is another VGAM721 host target gene. LOC157278 BINDING SITE is HOST TARGET binding site found in the 3' untranslated region of mRNA encoded by LOC157278, corresponding to a HOST TARGET binding site such as BINDING SITE I, BINDING SITE II or BINDING SITE III. Table 2 illustrates the complementarity of the nucleotide sequences of LOC157278 BINDING SITE, designated SEQ ID:41776, to the nucleotide sequence of VGAM721 RNA, herein designated VGAM RNA, also designated SEQ ID:3432.

Another function of VGAM721 is therefore inhibition of LOC157278 (Accession XM_098741). Accordingly, utilities of VGAM721 include diagnosis, prevention and treatment of diseases and clinical conditions associated with LOC157278. LOC219855 (Accession XM_166184) is another VGAM721 host target gene. LOC219855 BINDING SITE is HOST TARGET binding site found in the 3' untranslated region of mRNA encoded by LOC219855, corresponding to a HOST TARGET binding site such as BINDING SITE I, BINDING SITE II or BINDING SITE III. Table 2 illustrates the complementarity of the nucleotide sequences of LOC219855 BINDING SITE, designated SEQ ID:43995, to the nucleotide sequence of VGAM721 RNA, herein designated VGAM RNA, also designated SEQ ID:3432.

Another function of VGAM721 is therefore inhibition of LOC219855 (Accession XM_166184). Accordingly, utilities of VGAM721 include diagnosis, prevention and treatment of diseases and clinical conditions associated with LOC219855. LOC255461 (Accession XM_173207) is another VGAM721 host target gene. LOC255461 BINDING SITE is HOST TARGET binding site found in the 3' untranslated region of mRNA encoded by LOC255461, corresponding to a HOST TARGET binding site such as BINDING SITE I, BINDING SITE II or BINDING SITE III. Table 2 illustrates the complementarity of the nucleotide sequences of LOC255461 BINDING SITE, designated SEQ ID:46462, to the nucleotide sequence of VGAM721 RNA, herein designated VGAM RNA, also designated SEQ ID:3432.

Another function of VGAM721 is therefore inhibition of LOC255461 (Accession XM_173207). Accordingly, utilities of VGAM721 include diagnosis, prevention and treatment of diseases and clinical conditions associated with LOC255461. LOC255516 (Accession XM_173212) is another VGAM721 host target gene. LOC255516 BINDING SITE is HOST TARGET binding site found in the 3' untranslated region of mRNA encoded by LOC255516, corresponding to a HOST TARGET binding site such as BINDING SITE I, BINDING SITE II or BINDING SITE III. Table 2 illustrates the complementarity of the nucleotide sequences of LOC255516 BINDING SITE, designated SEQ ID:46468, to the nucleotide sequence of VGAM721 RNA, herein designated VGAM RNA, also designated SEQ ID:3432.

Another function of VGAM721 is therefore inhibition of LOC255516 (Accession XM_173212). Accordingly, utilities of VGAM721 include diagnosis, prevention and treatment of diseases and clinical conditions associated with LOC255516.

FIG. 1 further provides a conceptual description of a novel bioinformatically detected viral gene of the present invention, referred to here as Viral Genomic Address Messenger 722 (VGAM722) viral gene, which modulates expression of respective host target genes thereof, the function and utility of which host target genes is known in the art.

VGAM722 is a novel bioinformatically detected regulatory, non protein coding, viral micro RNA (miRNA) gene. The method by which VGAM722 was detected is described hereinabove with reference to FIGS. 1-8.

VGAM722 gene, herein designated VGAM GENE, is a viral gene contained in the genome of Tomato Mosaic Virus. VGAM722 host target gene, herein designated VGAM HOST TARGET GENE, is a human gene contained in the human genome.

VGAM722 gene encodes a VGAM722 precursor RNA, herein designated VGAM PRECURSOR RNA. Similar to other miRNA genes, and unlike most ordinary genes, VGAM722 precursor RNA does not encode a protein. A nucleotide sequence identical or highly similar to the nucleotide sequence of VGAM722 precursor RNA is designated SEQ ID:708, and is provided hereinbelow with reference to the sequence listing part. Nucleotide sequence SEQ ID:708 is located at position 1585 relative to the genome of Tomato Mosaic Virus.

VGAM722 precursor RNA folds onto itself, forming VGAM722 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM722 folded precursor RNA into VGAM722 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM722 RNA is designated SEQ ID:3433, and is provided hereinbelow with reference to the sequence listing part.

VGAM722 host target gene, herein designated VGAM HOST TARGET GENE, encodes a corresponding messenger RNA, VGAM722 host target RNA, herein designated VGAM HOST TARGET RNA. VGAM722 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM722 RNA, herein designated VGAM RNA, binds complementarily to one or more host target binding sites located in untranslated regions of VGAM722 host target RNA, herein designated VGAM HOST TARGET RNA. This complementary binding is due to the fact that the nucleotide sequence of VGAM722 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM722 RNA, herein designated VGAM RNA, may have a different number of host target binding sites in untranslated regions of a VGAM722 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM722 RNA, herein designated VGAM RNA, to host target binding sites on VGAM722 host target RNA, herein designated VGAM HOST TARGET RNA, such as BINDING SITE I, BINDING SITE II and BINDING SITE III, inhibits translation of VGAM722 host target RNA into VGAM722 host target protein, herein designated VGAM HOST TARGET PROTEIN. VGAM host target protein is therefore outlined by a broken line.

It is appreciated that VGAM722 host target gene, herein designated VGAM HOST TARGET GENE, in fact represents a plurality of VGAM722 host target genes. The mRNA of each one of this plurality of VGAM722 host target genes comprises one or more host target binding sites, each having a nucleotide sequence which is at least partly complementary to VGAM722 RNA, herein designated VGAM RNA, and which when bound by VGAM722 RNA causes inhibition of translation of respective one or more VGAM722 host target proteins.

It is further appreciated by one skilled in the art that the mode of translational inhibition illustrated by FIG. 1 with specific reference to translational inhibition exerted by VGAM722 gene, herein designated VGAM GENE, on one or more VGAM722 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM722 is inhibition of expression of host target genes, as part of a novel viral mechanism of attacking a host. Accordingly, utilities of VGAM722 include diagnosis, prevention and treatment of viral infection by Tomato Mosaic Virus. Specific functions, and accordingly utilities, of VGAM722 correlate with, and may be deduced from, the identity of the host target genes which VGAM722 binds and inhibits, and the function of these host target genes, as elaborated hereinbelow.

Nucleotide sequences of the VGAM722 precursor RNA, herein designated VGAM PRECURSOR RNA, and of the 'diced' VGAM722 RNA, herein designated VGAM RNA, and a schematic representation of the secondary folding of VGAM722 folded precursor RNA, herein designated VGAM FOLDED PRECURSOR RNA, of VGAM722 are further described hereinbelow with reference to Table 1.

Nucleotide sequences of host target binding sites, such as BINDING SITE-I, BINDING SITE-II and BINDING SITE-III of FIG. 1, found on VGAM722 host target RNA, and schematic representation of the complementarity of each of these host target binding sites to VGAM722 RNA, herein designated VGAM RNA, are described hereinbelow with reference to Table 2.

As mentioned hereinabove with reference to FIG. 1, a function of VGAM722 gene, herein designated VGAM is inhibition of expression of VGAM722 target genes. It is appreciated that specific functions, and accordingly utilities, of VGAM722 correlate with, and may be deduced from, the identity of the target genes which VGAM722 binds and inhibits, and the function of these target genes, as elaborated hereinbelow.

Beta-site APP-cleaving Enzyme (BACE, Accession NM_012104) is a VGAM722 host target gene. BACE BINDING SITE1 and BACE BINDING SITE2 are HOST TARGET binding sites found in untranslated regions of mRNA encoded by BACE, corresponding to HOST TARGET binding sites such as BINDING SITE I, BINDING SITE II or BINDING SITE III. Table 2 illustrates the complementarity of the nucleotide sequences of BACE BINDING SITE1 and BACE BINDING SITE2, designated SEQ ID:14413 and SEQ ID:29081 respectively, to the nucleotide sequence of VGAM722 RNA, herein designated VGAM RNA, also designated SEQ ID:3433.

A function of VGAM722 is therefore inhibition of Beta-site APP-cleaving Enzyme (BACE, Accession NM_012104), a gene which is responsible for the proteolytic processing of the amyloid precursor protein. Accordingly, utilities of VGAM722 include diagnosis, prevention and treatment of diseases and clinical conditions associated with BACE. The function of BACE and its association with various diseases and clinical conditions, has been established by previous studies, as described hereinabove with reference to VGAM173. Carbohydrate (N-acetylglucosamine 6-O) Sulfotransferase 6 (CHST6, Accession NM_021615) is another VGAM722 host target gene. CHST6 BINDING SITE is HOST TARGET binding site found in the 3' untranslated region of mRNA encoded by CHST6, corresponding to a HOST TARGET binding site such as BINDING SITE I, BINDING SITE II or BINDING SITE III. Table 2 illustrates the complementarity of the nucleotide sequences of CHST6 BINDING SITE, designated SEQ ID:22243, to the nucleotide sequence of VGAM722 RNA, herein designated VGAM RNA, also designated SEQ ID:3433.

Another function of VGAM722 is therefore inhibition of Carbohydrate (N-acetylglucosamine 6-O) Sulfotransferase 6 (CHST6, Accession NM_021615). Accordingly, utilities of VGAM722 include diagnosis, prevention and treatment of diseases and clinical conditions associated with CHST6. Formin 2 (FMN2, Accession XM_086525) is another VGAM722 host target gene. FMN2 BINDING SITE is HOST TARGET binding site found in the 3' untranslated region of mRNA encoded by FMN2, corresponding to a HOST TARGET binding site such as BINDING SITE I, BINDING SITE II or BINDING SITE III. Table 2 illustrates the complementarity of the nucleotide sequences of FMN2 BINDING SITE, designated SEQ ID:38740, to the nucleotide sequence of VGAM722 RNA, herein designated VGAM RNA, also designated SEQ ID:3433.

Another function of VGAM722 is therefore inhibition of Formin 2 (FMN2, Accession XM_086525). Accordingly, utilities of VGAM722 include diagnosis, prevention and treatment of diseases and clinical conditions associated with FMN2. Interleukin 20 Receptor, Alpha (IL20RA, Accession NM_014432) is another VGAM722 host target gene. IL20RA BINDING SITE is HOST TARGET binding site found in the 3' untranslated region of mRNA encoded by IL20RA, corresponding to a HOST TARGET binding site such as BINDING SITE I, BINDING SITE II or BINDING SITE III. Table 2 illustrates the complementarity of the nucleotide sequences of IL20RA BINDING SITE, designated SEQ ID:15788, to the nucleotide sequence of VGAM722 RNA, herein designated VGAM RNA, also designated SEQ ID:3433.

Another function of VGAM722 is therefore inhibition of Interleukin 20 Receptor, Alpha (IL20RA, Accession NM_014432), a gene which is the receptor for interleukin-20. Accordingly, utilities of VGAM722 include diagnosis, prevention and treatment of diseases and clinical conditions associated with IL20RA. The function of IL20RA and its association with various diseases and clinical conditions, has been established by previous studies, as described hereinabove with reference to VGAM315. Protocadherin Beta 12 (PCDHB12, Accession NM_018932) is another VGAM722 host target gene. PCDHB12 BINDING SITE is HOST TARGET binding site found in the 3' untranslated region of mRNA encoded by PCDHB12, corresponding to a HOST TARGET binding site such as BINDING SITE I, BINDING SITE II or BINDING SITE III. Table 2 illustrates the complementarity of the nucleotide sequences of PCDHB12 BINDING SITE, designated SEQ ID:21002, to the nucleotide sequence of VGAM722 RNA, herein designated VGAM RNA, also designated SEQ ID:3433.

Another function of VGAM722 is therefore inhibition of Protocadherin Beta 12 (PCDHB12, Accession NM_018932). Accordingly, utilities of VGAM722 include diagnosis, prevention and treatment of diseases and clinical conditions associated with PCDHB12. Protocadherin Beta 7 (PCDHB7, Accession NM_018940) is another VGAM722 host target gene. PCDHB7 BINDING SITE is HOST TARGET binding site found in the 3' untranslated region of mRNA encoded by PCDHB7, corresponding to a HOST TARGET binding site such as BINDING SITE I, BINDING SITE II or BINDING SITE III. Table 2 illustrates the complementarity of the nucleotide sequences of PCDHB7 BINDING SITE, designated SEQ ID:21007, to the nucleotide sequence of VGAM722 RNA, herein designated VGAM RNA, also designated SEQ ID:3433.

Another function of VGAM722 is therefore inhibition of Protocadherin Beta 7 (PCDHB7, Accession NM_018940). Accordingly, utilities of VGAM722 include diagnosis, prevention and treatment of diseases and clinical conditions associated with PCDHB7. FLJ22167 (Accession NM_024533) is another VGAM722 host target gene. FLJ22167 BINDING SITE is HOST TARGET binding site found in the 3' untranslated region of mRNA encoded by FLJ22167, corresponding to a HOST TARGET binding site such as BINDING SITE I, BINDING SITE II or BINDING SITE III. Table 2 illustrates the complementarity of the nucleotide sequences of FLJ22167 BINDING SITE, designated SEQ ID:23738, to the nucleotide sequence of VGAM722 RNA, herein designated VGAM RNA, also designated SEQ ID:3433.

Another function of VGAM722 is therefore inhibition of FLJ22167 (Accession NM_024533). Accordingly, utilities of VGAM722 include diagnosis, prevention and treatment of diseases and clinical conditions associated with FLJ22167. KIAA0737 (Accession NM_014828) is another VGAM722 host target gene. KIAA0737 BINDING SITE is HOST TARGET binding site found in the 3' untranslated region of mRNA encoded by KIAA0737, corresponding to a HOST TARGET binding site such as BINDING SITE I, BINDING SITE II or BINDING SITE III. Table 2 illustrates the complementarity of the nucleotide sequences of KIAA0737 BINDING SITE, designated SEQ ID:16817, to the nucleotide sequence of VGAM722 RNA, herein designated VGAM RNA, also designated SEQ ID:3433.

Another function of VGAM722 is therefore inhibition of KIAA0737 (Accession NM_014828). Accordingly, utilities of VGAM722 include diagnosis, prevention and treatment of diseases and clinical conditions associated with KIAA0737. SE70-2 (Accession NM_022118) is another VGAM722 host target gene. SE70-2 BINDING SITE is HOST TARGET binding site found in the 5' untranslated region of mRNA encoded by SE70-2, corresponding to a HOST TARGET binding site such as BINDING SITE I, BINDING SITE II or BINDING SITE III. Table 2 illustrates the complementarity of the nucleotide sequences of SE70-2 BINDING SITE, designated SEQ ID:22662, to the nucleotide sequence of VGAM722 RNA, herein designated VGAM RNA, also designated SEQ ID:3433.

Another function of VGAM722 is therefore inhibition of SE70-2 (Accession NM_022118). Accordingly, utilities of VGAM722 include diagnosis, prevention and treatment of diseases and clinical conditions associated with SE70-2. LOC112817 (Accession NM_138413) is another VGAM722 host target gene. LOC112817 BINDING SITE is HOST TARGET binding site found in the 3' untranslated region of mRNA encoded by LOC112817, corresponding to a HOST TARGET binding site such as BINDING SITE I, BINDING SITE II or BINDING SITE III. Table 2 illustrates the complementarity of the nucleotide sequences of LOC112817 BINDING SITE, designated SEQ ID:28779, to the nucleotide sequence of VGAM722 RNA, herein designated VGAM RNA, also designated SEQ ID:3433.

Another function of VGAM722 is therefore inhibition of LOC112817 (Accession NM_138413). Accordingly, utilities of VGAM722 include diagnosis, prevention and treatment of diseases and clinical conditions associated with LOC112817. LOC112840 (Accession NM_080666) is another VGAM722 host target gene. LOC112840 BINDING SITE is HOST TARGET binding site found in the 3' untranslated region of mRNA encoded by LOC112840, corresponding to a HOST TARGET binding site such as BINDING SITE I, BINDING SITE II or BINDING SITE III. Table 2 illustrates the complementarity of the nucleotide sequences of LOC112840 BINDING SITE, designated SEQ ID:27954, to the nucleotide sequence of VGAM722 RNA, herein designated VGAM RNA, also designated SEQ ID:3433.

Another function of VGAM722 is therefore inhibition of LOC112840 (Accession NM_080666). Accordingly, utilities of VGAM722 include diagnosis, prevention and treatment of diseases and clinical conditions associated with LOC112840. LOC158332 (Accession XM_088554) is another VGAM722 host target gene. LOC158332 BINDING SITE is HOST TARGET binding site found in the 3' untranslated region of mRNA encoded by LOC158332, corresponding to a HOST TARGET binding site such as BINDING SITE I, BINDING SITE II or BINDING SITE III. Table 2 illustrates the complementarity of the nucleotide sequences of LOC158332 BINDING SITE, designated SEQ ID:39822, to the nucleotide sequence of VGAM722 RNA, herein designated VGAM RNA, also designated SEQ ID:3433.

Another function of VGAM722 is therefore inhibition of LOC158332 (Accession XM_088554). Accordingly, utilities of VGAM722 include diagnosis, prevention and treatment of diseases and clinical conditions associated with LOC158332. LOC254549 (Accession XM_171404) is another VGAM722 host target gene. LOC254549 BINDING SITE is HOST TARGET binding site found in the 5' untranslated region of mRNA encoded by LOC254549, corresponding to a HOST TARGET binding site such as BINDING SITE I, BINDING SITE II or BINDING SITE III. Table 2 illustrates the complementarity of the nucleotide sequences of LOC254549 BINDING SITE, designated SEQ ID:46045, to the nucleotide sequence of VGAM722 RNA, herein designated VGAM RNA, also designated SEQ ID:3433.

Another function of VGAM722 is therefore inhibition of LOC254549 (Accession XM_171404). Accordingly, utilities of VGAM722 include diagnosis, prevention and treatment of diseases and clinical conditions associated with LOC254549. FIG. 1 further provides a conceptual description of a novel bioinformatically detected viral gene of the present invention, referred to here as Viral Genomic Address Messenger 723 (VGAM723) viral gene, which modulates expression of respective host target genes thereof, the function and utility of which host target genes is known in the art.

VGAM723 is a novel bioinformatically detected regulatory, non protein coding, viral micro RNA (miRNA) gene. The method by which VGAM723 was detected is described hereinabove with reference to FIGS. 1-8.

VGAM723 gene, herein designated VGAM GENE, is a viral gene contained in the genome of Tomato Mosaic Virus. VGAM723 host target gene, herein designated VGAM HOST TARGET GENE, is a human gene contained in the human genome.

VGAM723 gene encodes a VGAM723 precursor RNA, herein designated VGAM PRECURSOR RNA. Similar to other miRNA genes, and unlike most ordinary genes, VGAM723 precursor RNA does not encode a protein. A nucleotide sequence identical or highly similar to the nucleotide sequence of VGAM723 precursor RNA is designated SEQ ID:709, and is provided hereinbelow with reference to the sequence listing part. Nucleotide sequence SEQ ID:709 is located at position 2545 relative to the genome of Tomato Mosaic Virus.

VGAM723 precursor RNA folds onto itself, forming VGAM723 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM723 folded precursor RNA into VGAM723 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM723 RNA is designated SEQ ID:3434, and is provided hereinbelow with reference to the sequence listing part.

VGAM723 host target gene, herein designated VGAM HOST TARGET GENE, encodes a corresponding messenger RNA, VGAM723 host target RNA, herein designated VGAM HOST TARGET RNA. VGAM723 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM723 RNA, herein designated VGAM RNA, binds complementarily to one or more host target binding sites located in untranslated regions of VGAM723 host target RNA, herein designated VGAM HOST TARGET RNA. This complementary binding is due to the fact that the nucleotide sequence of VGAM723 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM723 RNA, herein designated VGAM RNA, may have a different number of host target binding sites in untranslated regions of a VGAM723 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM723 RNA, herein designated VGAM RNA, to host target binding sites on VGAM723 host target RNA, herein designated VGAM HOST TARGET RNA, such as BINDING SITE I, BINDING SITE II and BINDING SITE III, inhibits translation of VGAM723 host target RNA into VGAM723 host target protein, herein designated VGAM HOST TARGET PROTEIN. VGAM host target protein is therefore outlined by a broken line.

It is appreciated that VGAM723 host target gene, herein designated VGAM HOST TARGET GENE, in fact represents a plurality of VGAM723 host target genes. The mRNA of each one of this plurality of VGAM723 host target genes comprises one or more host target binding sites, each having a nucleotide sequence which is at least partly complementary to VGAM723 RNA, herein designated VGAM RNA, and which when bound by VGAM723 RNA causes inhibition of translation of respective one or more VGAM723 host target proteins.

It is further appreciated by one skilled in the art that the mode of translational inhibition illustrated by FIG. 1 with specific reference to translational inhibition exerted by VGAM723 gene, herein designated VGAM GENE, on one or more VGAM723 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM723 is inhibition of expression of host target genes, as part of a novel viral mechanism of attacking a host. Accordingly, utilities of VGAM723 include diagnosis, prevention and treatment of viral infection by Tomato Mosaic Virus. Specific functions, and accordingly utilities, of VGAM723 correlate with, and may be deduced from, the identity of the host target genes which VGAM723 binds and inhibits, and the function of these host target genes, as elaborated hereinbelow.

Nucleotide sequences of the VGAM723 precursor RNA, herein designated VGAM PRECURSOR RNA, and of the 'diced' VGAM723 RNA, herein designated VGAM RNA, and a schematic representation of the secondary folding of VGAM723 folded precursor RNA, herein designated VGAM FOLDED PRECURSOR RNA, of VGAM723 are further described hereinbelow with reference to Table 1.

Nucleotide sequences of host target binding sites, such as BINDING SITE-I, BINDING SITE-II and BINDING SITE-III of FIG. 1, found on VGAM723 host target RNA, and schematic representation of the complementarity of each of these host target binding sites to VGAM723 RNA, herein designated VGAM RNA, are described hereinbelow with reference to Table 2.

As mentioned hereinabove with reference to FIG. 1, a function of VGAM723 gene, herein designated VGAM is inhibition of expression of VGAM723 target genes. It is appreciated that specific functions, and accordingly utilities, of VGAM723 correlate with, and may be deduced from, the identity of the target genes which VGAM723 binds and inhibits, and the function of these target genes, as elaborated hereinbelow.

Aldolase A, Fructose-bisphosphate (ALDOA, Accession NM_000034) is a VGAM723 host target gene. ALDOA BINDING SITE is HOST TARGET binding site found in the 5' untranslated region of mRNA encoded by ALDOA, corresponding to a HOST TARGET binding site such as BINDING SITE I, BINDING SITE II or BINDING SITE III. Table 2 illustrates the complementarity of the nucleotide sequences of ALDOA BINDING SITE, designated SEQ ID:5473, to the nucleotide sequence of VGAM723 RNA, herein designated VGAM RNA, also designated SEQ ID:3434.

A function of VGAM723 is therefore inhibition of Aldolase A, Fructose-bisphosphate (ALDOA, Accession NM_000034). Accordingly, utilities of VGAM723 include diagnosis, prevention and treatment of diseases and clinical conditions associated with ALDOA. Keratocan (KERA, Accession NM_007035) is another VGAM723 host target gene. KERA BINDING SITE is HOST TARGET binding site found in the 5' untranslated region of mRNA encoded by KERA, corresponding to a HOST TARGET binding site such as BINDING SITE I, BINDING SITE II or BINDING SITE III. Table 2 illustrates the complementarity of the nucleotide sequences of KERA BINDING SITE, designated SEQ ID:13906, to the nucleotide sequence of VGAM723 RNA, herein designated VGAM RNA, also designated SEQ ID:3434.

Another function of VGAM723 is therefore inhibition of Keratocan (KERA, Accession NM_007035), a gene which may be important in developing and maintaining corneal transparency and for the structure of the stromal matrix. Accordingly, utilities of VGAM723 include diagnosis, prevention and treatment of diseases and clinical conditions associated with KERA. The function of KERA has been established by previous studies. Keratan sulfate proteoglycans (KSPGs) are members of the small leucine-rich proteoglycan (SLRP) family. KSPGs, particularly keratocan, lumican (OMIM Ref. No. 600616), and mimecan (OMIM Ref. No. 602383), are important to the transparency of the cornea. Liu et al. (1998) isolated mouse keratocan cDNA and genomic DNA. Mouse keratocan cDNA predicts a 351-amino acid polypeptide containing a conserved central leucine-rich repeat region. Northern blot analysis of mouse tissues revealed that keratocan is expressed selectively in the eye throughout development. In situ hybridization demonstrated that keratocan is expressed early in neural crest development and later in corneal stromal cells. Tasheva et al. (1999) isolated the cDNA and identified the genomic structure of the human keratocan gene. The gene is spread over 7.65 kb of DNA and contains 3 exons. An open reading frame starting at the beginning of the second exon encodes a protein of 352 amino acids. The amino acid sequence of keratocan shows high identity among mammalian species. This evolutionary conservation between the keratocan proteins as well as the restricted expression of the KERA gene in cornea suggests that this molecule might be important in developing and maintaining corneal transparency.

Full details of the abovementioned studies are described in the following publications, the disclosure of which are hereby incorporated by reference:

Liu, C.-Y.; Shiraishi, A.; Kao, C. W.-C.; Converse, R. L.; Funderburgh, J. L.; Corpuz, L. M.; Conrad, G. W.; Kao, W. W.-Y.: The cloning of mouse keratocan cDNA and genomic DNA and the characterization of its expression during eye development. J. Biol. Chem. 273:22584-22588, 1998; and Tasheva, E. S.; Funderburgh, J. L.; Funderburgh, M. L.; Corpuz, L. M.; Conrad, G. W.: Structure and sequence of the gene encoding human keratocan. DNA Seq. 10: 67-74, 1999.

Further studies establishing the function and utilities of KERA are found in John Hopkins OMIM database record ID 603288, and in sited publications numbered 5339, 10027, 359 and 5341-5342 listed in the bibliography section hereinbelow, which are also hereby incorporated by reference. Phospholipase A2, Group IID (PLA2G2D, Accession NM_012400) is another VGAM723 host target gene. PLA2G2D BINDING SITE is HOST TARGET binding site found in the 3' untranslated region of mRNA encoded by PLA2G2D, corresponding to a HOST TARGET binding site such as BINDING SITE I, BINDING SITE II or BINDING SITE III. Table 2 illustrates the complementarity of the nucleotide sequences of PLA2G2D BINDING SITE, designated SEQ ID:14775, to the nucleotide sequence of VGAM723 RNA, herein designated VGAM RNA, also designated SEQ ID:3434.

Another function of VGAM723 is therefore inhibition of Phospholipase A2, Group IID (PLA2G2D, Accession NM_012400), a gene which is involved in phospholipid digestion, remodeling of cell membranes, and host defense, as well as pathophysiologic processes. Accordingly, utilities of VGAM723 include diagnosis, prevention and treatment of diseases and clinical conditions associated with PLA2G2D. The function of PLA2G2D and its association with various diseases and clinical conditions, has been established by previous studies, as described hereinabove with reference to VGAM74. Podocalyxin-like (PODXL, Accession NM_005397) is another VGAM723 host target gene. PODXL BINDING SITE is HOST TARGET binding site found in the 3' untranslated region of mRNA encoded by PODXL, corresponding to a HOST TARGET binding site such as BINDING SITE I, BINDING SITE II or BINDING SITE III. Table 2 illustrates the complementarity of the nucleotide sequences of PODXL BINDING SITE, designated SEQ ID:11870, to the nucleotide sequence of VGAM723 RNA, herein designated VGAM RNA, also designated SEQ ID:3434.

Another function of VGAM723 is therefore inhibition of Podocalyxin-like (PODXL, Accession NM_005397), a gene which is an antiadhesin. Accordingly, utilities of VGAM723 include diagnosis, prevention and treatment of diseases and clinical conditions associated with PODXL. The function of PODXL and its association with various diseases and clinical conditions, has been established by previous studies, as described hereinabove with reference to VGAM247. Adaptor-related Protein Complex 3, Sigma 2 Subunit (AP3S2, Accession NM_005829) is another VGAM723 host target gene. AP3S2 BINDING SITE is HOST TARGET binding site found in the 3' untranslated region of mRNA encoded by AP3S2, corresponding to a HOST TARGET binding site such as BINDING SITE I, BINDING SITE II or BINDING SITE III. Table 2 illustrates the complementarity of the nucleotide sequences of AP3S2 BINDING SITE, designated SEQ ID:12439, to the nucleotide sequence of VGAM723 RNA, herein designated VGAM RNA, also designated SEQ ID:3434.

Another function of VGAM723 is therefore inhibition of Adaptor-related Protein Complex 3, Sigma 2 Subunit (AP3S2, Accession NM_005829). Accordingly, utilities of VGAM723 include diagnosis, prevention and treatment of diseases and clinical conditions associated with AP3S2. Phytanoyl-CoA Hydroxylase Interacting Protein (PHYHIP, Accession NM_014759) is another VGAM723 host target gene. PHYHIP BINDING SITE is HOST TARGET binding site found in the 3' untranslated region of mRNA encoded by PHYHIP, corresponding to a HOST TARGET binding site such as BINDING SITE I, BINDING SITE II or BINDING SITE III. Table 2 illustrates the complementarity of the nucleotide sequences of PHYHIP BINDING SITE, designated SEQ ID:16509, to the nucleotide sequence of VGAM723 RNA, herein designated VGAM RNA, also designated SEQ ID:3434.

Another function of VGAM723 is therefore inhibition of Phytanoyl-CoA Hydroxylase Interacting Protein (PHYHIP, Accession NM_014759). Accordingly, utilities of VGAM723 include diagnosis, prevention and treatment of diseases and clinical conditions associated with PHYHIP. LOC136183 (Accession XM_069753) is another VGAM723 host target gene. LOC136183 BINDING SITE is HOST TARGET binding site found in the 5' untranslated region of mRNA encoded by LOC136183, corresponding to a HOST TARGET binding site such as BINDING SITE I, BINDING SITE II or BINDING SITE III. Table 2 illustrates the complementarity of the nucleotide sequences of LOC136183 BINDING SITE, designated SEQ ID:37391, to the nucleotide sequence of VGAM723 RNA, herein designated VGAM RNA, also designated SEQ ID:3434.

Another function of VGAM723 is therefore inhibition of LOC136183 (Accession XM_069753). Accordingly, utilities of VGAM723 include diagnosis, prevention and treatment of diseases and clinical conditions associated with LOC136183. LOC150819 (Accession XM_097954) is another VGAM723 host target gene. LOC150819 BINDING SITE is HOST TARGET binding site found in the 5' untranslated region of mRNA encoded by LOC150819, corresponding to a HOST TARGET binding site such as BINDING SITE I, BINDING SITE II or BINDING SITE III. Table 2 illustrates the complementarity of the nucleotide sequences of LOC150819 BINDING SITE, designated SEQ ID:41245, to the nucleotide sequence of VGAM723 RNA, herein designated VGAM RNA, also designated SEQ ID:3434.

Another function of VGAM723 is therefore inhibition of LOC150819 (Accession XM_097954). Accordingly, utilities of VGAM723 include diagnosis, prevention and treatment of diseases and clinical conditions associated with LOC150819. FIG. 1 further provides a conceptual description of a novel bioinformatically detected viral gene of the present invention, referred to here as Viral Genomic Address Messenger 724 (VGAM724) viral gene, which modulates expression of respective host target genes thereof, the function and utility of which host target genes is known in the art.

VGAM724 is a novel bioinformatically detected regulatory, non protein coding, viral micro RNA (miRNA) gene. The method by which VGAM724 was detected is described hereinabove with reference to FIGS. 1-8.

VGAM724 gene, herein designated VGAM GENE, is a viral gene contained in the genome of Tomato Mosaic Virus. VGAM724 host target gene, herein designated VGAM HOST TARGET GENE, is a human gene contained in the human genome.

VGAM724 gene encodes a VGAM724 precursor RNA, herein designated VGAM PRECURSOR RNA. Similar to other miRNA genes, and unlike most ordinary genes, VGAM724 precursor RNA does not encode a protein. A nucleotide sequence identical or highly similar to the nucleotide sequence of VGAM724 precursor RNA is designated SEQ ID:710, and is provided hereinbelow with reference to the sequence listing part. Nucleotide sequence SEQ ID:710 is located at position 3312 relative to the genome of Tomato Mosaic Virus.

VGAM724 precursor RNA folds onto itself, forming VGAM724 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM724 folded precursor RNA into VGAM724 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM724 RNA is designated SEQ ID:3435, and is provided hereinbelow with reference to the sequence listing part.

VGAM724 host target gene, herein designated VGAM HOST TARGET GENE, encodes a corresponding messenger RNA, VGAM724 host target RNA, herein designated VGAM HOST TARGET RNA. VGAM724 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM724 RNA, herein designated VGAM RNA, binds complementarily to one or more host target binding sites located in untranslated regions of VGAM724 host target RNA, herein designated VGAM HOST TARGET RNA. This complementary binding is due to the fact that the nucleotide sequence of VGAM724 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM724 RNA, herein designated VGAM RNA, may have a different number of host target binding sites in untranslated regions of a VGAM724 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM724 RNA, herein designated VGAM RNA, to host target binding sites on VGAM724 host target RNA, herein designated VGAM HOST TARGET RNA, such as BINDING SITE I, BINDING SITE II and BINDING SITE III, inhibits translation of VGAM724 host target RNA into VGAM724 host target protein, herein designated VGAM HOST TARGET PROTEIN. VGAM host target protein is therefore outlined by a broken line.

It is appreciated that VGAM724 host target gene, herein designated VGAM HOST TARGET GENE, in fact represents a plurality of VGAM724 host target genes. The mRNA of each one of this plurality of VGAM724 host target genes comprises one or more host target binding sites, each having a nucleotide sequence which is at least partly complementary to VGAM724 RNA, herein designated VGAM RNA, and which when bound by VGAM724 RNA causes inhibition of translation of respective one or more VGAM724 host target proteins.

It is further appreciated by one skilled in the art that the mode of translational inhibition illustrated by FIG. 1 with specific reference to translational inhibition exerted by VGAM724 gene, herein designated VGAM GENE, on one or more VGAM724 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM724 is inhibition of expression of host target genes, as part of a novel viral mechanism of attacking a host. Accordingly, utilities of VGAM724 include diagnosis, prevention and treatment of viral infection by Tomato Mosaic Virus. Specific functions, and accordingly utilities, of VGAM724 correlate with, and may be deduced from, the identity of the host target genes which VGAM724 binds and inhibits, and the function of these host target genes, as elaborated hereinbelow.

Nucleotide sequences of the VGAM724 precursor RNA, herein designated VGAM PRECURSOR RNA, and of the 'diced' VGAM724 RNA, herein designated VGAM RNA, and a schematic representation of the secondary folding of VGAM724 folded precursor RNA, herein designated VGAM FOLDED PRECURSOR RNA, of VGAM724 are further described hereinbelow with reference to Table 1.

Nucleotide sequences of host target binding sites, such as BINDING SITE-I, BINDING SITE-II and BINDING SITE-III of FIG. 1, found on VGAM724 host target RNA, and schematic representation of the complementarity of each of these host target binding sites to VGAM724 RNA, herein designated VGAM RNA, are described hereinbelow with reference to Table 2.

As mentioned hereinabove with reference to FIG. 1, a function of VGAM724 gene, herein designated VGAM is inhibition of expression of VGAM724 target genes. It is appreciated that specific functions, and accordingly utilities, of VGAM724 correlate with, and may be deduced from, the identity of the target genes which VGAM724 binds and inhibits, and the function of these target genes, as elaborated hereinbelow.

Amyloid Beta Precursor Protein (cytoplasmic tail) Binding Protein 2 (APPBP2, Accession NM_006380) is a VGAM724 host target gene. APPBP2 BINDING SITE is HOST TARGET binding site found in the 3' untranslated region of mRNA encoded by APPBP2, corresponding to a HOST TARGET binding site such as BINDING SITE I, BINDING SITE II or BINDING SITE III. Table 2 illustrates the complementarity of the nucleotide sequences of APPBP2 BINDING SITE, designated SEQ ID:13078, to the nucleotide sequence of VGAM724 RNA, herein designated VGAM RNA, also designated SEQ ID:3435.

A function of VGAM724 is therefore inhibition of Amyloid Beta Precursor Protein (cytoplasmic tail) Binding Protein 2 (APPBP2, Accession NM_006380), a gene which interacts with the basolateral sorting signal of amyloid precursor protein. Accordingly, utilities of VGAM724 include diagnosis, prevention and treatment of diseases and clinical conditions associated with APPBP2. The function of APPBP2 and its association with various diseases and clinical conditions, has been established by previous studies, as described hereinabove with reference to VGAM525. BTB and CNC Homology 1, Basic Leucine Zipper Transcription Factor 1 (BACH1, Accession NM_001186) is another VGAM724 host target gene. BACH1 BINDING SITE is HOST TARGET binding site found in the 3' untranslated region of mRNA encoded by BACH1, corresponding to a HOST TARGET binding site such as BINDING SITE I, BINDING SITE II or BINDING SITE III. Table 2 illustrates the complementarity of the nucleotide sequences of BACH1 BINDING SITE, designated SEQ ID:6853, to the nucleotide sequence of VGAM724 RNA, herein designated VGAM RNA, also designated SEQ ID:3435.

Another function of VGAM724 is therefore inhibition of BTB and CNC Homology 1, Basic Leucine Zipper Transcription Factor 1 (BACH1, Accession NM_001186), a gene which acts as repressor or activator, binds to nf-e2 binding sites. Accordingly, utilities of VGAM724 include diagnosis, prevention and treatment of diseases and clinical conditions associated with BACH1. The function of BACH1 has been established by previous studies. Members of the small Maf family are basic region leucine zipper (bZip) proteins that can function as transcriptional activators or repressors (see OMIM Ref. No. MAFG, 602020). Small Maf proteins can switch from transcriptional repressors to activators, depending on the proteins with which they form heterodimers. Using a yeast 2 hybrid screen to identify MafK (OMIM Ref. No. 600197) heterodimerization partners, Oyake et al. (1996) identified mouse cDNAs encoding Bach1 and Bach2. Both Bach proteins contained a BTB (broad complex-tramtrack-bric-a-brac) or POZ (poxvirus and zinc finger) protein interaction domain and a CNC (Cap'n'collar)-type bZip domain. Oyake et al. (1996) demonstrated that Bach1 and Bach2 (OMIM Ref. No. 605394) form heterodimers with MafK, and function as transcriptional activators or repressors when expressed in mammalian cells. Therefore, the authors suggested that the Bach proteins play important roles in coordinating transcription activation and repression by MafK. While developing a physical map of chromosome 21, both Ohira et al. (1998) and Blouin et al. (1998) isolated cDNAs encoding human BACH1. Ohira et al. (1998) reported that the sequence of the predicted 736-amino acid human protein is 80% identical to that of mouse Bach1. Human BACH1, like mouse Bach1, contains a BTB domain and CNC bZip domain. Northern analysis revealed that BACH1 is expressed ubiquitously as a 5.5-kb mRNA. An additional strong 3-kb signal was seen in testis.

Full details of the abovementioned studies are described in the following publications, the disclosure of which are hereby incorporated by reference:

Ohira, M.; Seki, N.; Nagase, T.; Ishikawa, K.; Nomura, N.; Ohara, O.: Characterization of a human homolog (BACH1) of the mouse Bach1 gene encoding a BTB-basic leucine zipper transcription factor and its mapping to chromosome 21q22.1. Genomics 47:300-306, 1998; and Oyake, T.; Itoh, K.; Motohashi 1. Blouin, J.-L.; Sail, G. D.; Guipponi, M.; Rossier, C.; Pappasavas, M.-P.; Antonarakis, S. E.: Isolation of the human BACH1 transcription regulator gene.

Further studies establishing the function and utilities of BACH1 are found in John Hopkins OMIM database record ID 602751, and in sited publications numbered 2414, 586 and 5881-5882 listed in the bibliography section hereinbelow, which are also hereby incorporated by reference. LOC145371 (Accession XM_085123) is another VGAM724 host target gene. LOC145371 BINDING SITE is HOST TARGET binding site found in the 3' untranslated region of mRNA encoded by LOC145371, corresponding to a HOST TARGET binding site such as BINDING SITE I, BINDING SITE II or BINDING SITE III. Table 2 illustrates the complementarity of the nucleotide sequences of LOC145371 BINDING SITE, designated SEQ ID:37839, to the nucleotide sequence of VGAM724 RNA, herein designated VGAM RNA, also designated SEQ ID:3435.

Another function of VGAM724 is therefore inhibition of LOC145371 (Accession XM_085123). Accordingly, utilities of VGAM724 include diagnosis, prevention and treatment of diseases and clinical conditions associated with LOC145371. FIG. 1 further provides a conceptual description of a novel bioinformatically detected viral gene of the present invention, referred to here as Viral Genomic Address Messenger 725 (VGAM725) viral gene, which modulates expression of respective host target genes thereof, the function and utility of which host target genes is known in the art.

VGAM725 is a novel bioinformatically detected regulatory, non protein coding, viral micro RNA (miRNA) gene. The method by which VGAM725 was detected is described hereinabove with reference to FIGS. 1-8.

VGAM725 gene, herein designated VGAM GENE, is a viral gene contained in the genome of Tomato Mosaic Virus. VGAM725 host target gene, herein designated VGAM HOST TARGET GENE, is a human gene contained in the human genome.

VGAM725 gene encodes a VGAM725 precursor RNA, herein designated VGAM PRECURSOR RNA. Similar to other miRNA genes, and unlike most ordinary genes, VGAM725 precursor RNA does not encode a protein. A nucleotide sequence identical or highly similar to the nucleotide sequence of VGAM725 precursor RNA is designated SEQ ID:711, and is provided hereinbelow with reference to the sequence listing part. Nucleotide sequence SEQ ID:711 is located at position 4413 relative to the genome of Tomato Mosaic Virus.

VGAM725 precursor RNA folds onto itself, forming VGAM725 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM725 folded precursor RNA into VGAM725 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM725 RNA is designated SEQ ID:3436, and is provided hereinbelow with reference to the sequence listing part.

VGAM725 host target gene, herein designated VGAM HOST TARGET GENE, encodes a corresponding messenger RNA, VGAM725 host target RNA, herein designated VGAM HOST TARGET RNA. VGAM725 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM725 RNA, herein designated VGAM RNA, binds complementarily to one or more host target binding sites located in untranslated regions of VGAM725 host target RNA, herein designated VGAM HOST TARGET RNA. This complementary binding is due to the fact that the nucleotide sequence of VGAM725 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM725 RNA, herein designated VGAM RNA, may have a different number of host target binding sites in untranslated regions of a VGAM725 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM725 RNA, herein designated VGAM RNA, to host target binding sites on VGAM725 host target RNA, herein designated VGAM HOST TARGET RNA, such as BINDING SITE I, BINDING SITE II and BINDING SITE III, inhibits translation of VGAM725 host target RNA into VGAM725 host target protein, herein designated VGAM HOST TARGET PROTEIN. VGAM host target protein is therefore outlined by a broken line.

It is appreciated that VGAM725 host target gene, herein designated VGAM HOST TARGET GENE, in fact represents a plurality of VGAM725 host target genes. The mRNA of each one of this plurality of VGAM725 host target genes comprises one or more host target binding sites, each having a nucleotide sequence which is at least partly complementary to VGAM725 RNA, herein designated VGAM RNA, and which when bound by VGAM725 RNA causes inhibition of translation of respective one or more VGAM725 host target proteins.

It is further appreciated by one skilled in the art that the mode of translational inhibition illustrated by FIG. 1 with specific reference to translational inhibition exerted by VGAM725 gene, herein designated VGAM GENE, on one or more VGAM725 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM725 is inhibition of expression of host target genes, as part of a novel viral mechanism of attacking a host. Accordingly, utilities of VGAM725 include diagnosis, prevention and treatment of viral infection by Tomato Mosaic Virus. Specific functions, and accordingly utilities, of VGAM725 correlate with, and may be deduced from, the identity of the host target genes which VGAM725 binds and inhibits, and the function of these host target genes, as elaborated hereinbelow.

Nucleotide sequences of the VGAM725 precursor RNA, herein designated VGAM PRECURSOR RNA, and of the 'diced' VGAM725 RNA, herein designated VGAM RNA, and a schematic representation of the secondary folding of VGAM725 folded precursor RNA, herein designated VGAM FOLDED PRECURSOR RNA, of VGAM725 are further described hereinbelow with reference to Table 1.

Nucleotide sequences of host target binding sites, such as BINDING SITE-I, BINDING SITE-II and BINDING SITE-III of FIG. 1, found on VGAM725 host target RNA, and schematic representation of the complementarity of each of these host target binding sites to VGAM725 RNA, herein designated VGAM RNA, are described hereinbelow with reference to Table 2.

As mentioned hereinabove with reference to FIG. 1, a function of VGAM725 gene, herein designated VGAM is inhibition of expression of VGAM725 target genes. It is appreciated that specific functions, and accordingly utilities, of VGAM725 correlate with, and may be deduced from, the identity of the target genes which VGAM725 binds and inhibits, and the function of these target genes, as elaborated hereinbelow.

Amyloid Beta (A4) Precursor Protein-binding, Family A, Member 1 (X11) (APBA1, Accession XM_046018) is a VGAM725 host target gene. APBA1 BINDING SITE is HOST TARGET binding site found in the 3' untranslated region of mRNA encoded by APBA1, corresponding to a HOST TARGET binding site such as BINDING SITE I, BINDING SITE II or BINDING SITE III. Table 2 illustrates the complementarity of the nucleotide sequences of APBA1 BINDING SITE, designated SEQ ID:34648, to the nucleotide sequence of VGAM725 RNA, herein designated VGAM RNA, also designated SEQ ID:3436.

A function of VGAM725 is therefore inhibition of Amyloid Beta (A4) Precursor Protein-binding, Family A, Member 1 (X11) (APBA1, Accession XM_046018), a gene which stabilises APP and inhibits production of proteolytic APP fragments. Accordingly, utilities of VGAM725 include diagnosis, prevention and treatment of diseases and clinical conditions associated with APBA1. The function of APBA1 and its association with various diseases and clinical conditions, has been established by previous studies, as described hereinabove with reference to VGAM247. Histone Deacetylase 5 (HDAC5, Accession NM_139205) is another VGAM725 host target gene. HDAC5 BINDING SITE is HOST TARGET binding site found in the 3' untranslated region of mRNA encoded by HDAC5, corresponding to a HOST TARGET binding site such as BINDING SITE I, BINDING SITE II or BINDING SITE III. Table 2 illustrates the complementarity of the nucleotide sequences of HDAC5 BINDING SITE, designated SEQ ID:29222, to the nucleotide sequence of VGAM725 RNA, herein designated VGAM RNA, also designated SEQ ID:3436.

Another function of VGAM725 is therefore inhibition of Histone Deacetylase 5 (HDAC5, Accession NM_139205), a gene which is responsible for the deacetylation of lysine residues on the n-terminal part of the core histones and mediate transcriptional regulation. Accordingly, utilities of VGAM725 include diagnosis, prevention and treatment of diseases and clinical conditions associated with HDAC5. The function of HDAC5 and its association with various diseases and clinical conditions, has been established by previous studies, as described hereinabove with reference to VGAM263. Potassium Voltage-gated Channel, Shal-related Subfamily, Member 2 (KCND2, Accession NM_012281) is another VGAM725 host target gene. KCND2 BINDING SITE is HOST TARGET binding site found in the 3' untranslated region of mRNA encoded by KCND2, corresponding to a HOST TARGET binding site such as BINDING SITE I, BINDING SITE II or BINDING SITE III. Table 2 illustrates the complementarity of the nucleotide sequences of KCND2 BINDING SITE, designated SEQ ID:14608, to the nucleotide sequence of VGAM725 RNA, herein designated VGAM RNA, also designated SEQ ID:3436.

Another function of VGAM725 is therefore inhibition of Potassium Voltage-gated Channel, Shal-related Subfamily, Member 2 (KCND2, Accession NM_012281), a gene which is prominent in the repolarization phase of the action potential. Accordingly, utilities of VGAM725 include diagnosis, prevention and treatment of diseases and clinical conditions associated with KCND2. The function of KCND2 and its association with various diseases and clinical conditions, has been established by previous studies, as described hereinabove with reference to VGAM449. N-myc Downstream Regulated Gene 1 (NDRG1, Accession XM_005243) is another VGAM725 host target gene. NDRG1 BINDING SITE is HOST TARGET binding site found in the 3' untranslated region of mRNA encoded by NDRG1, corresponding to a HOST TARGET binding site such as BINDING SITE I, BINDING SITE II or BINDING SITE III. Table 2 illustrates the complementarity of the nucleotide sequences of NDRG1 BINDING SITE, designated SEQ ID:29966, to the nucleotide sequence of VGAM725 RNA, herein designated VGAM RNA, also designated SEQ ID:3436.

Another function of VGAM725 is therefore inhibition of N-myc Downstream Regulated Gene 1 (NDRG1, Accession XM_005243), a gene which may have a growth inhibitory role. Accordingly, utilities of VGAM725 include diagnosis, prevention and treatment of diseases and clinical conditions associated with NDRG1. The function of NDRG1 and its association with various diseases and clinical conditions, has been established by previous studies, as described hereinabove with reference to VGAM144. KIAA1297 (Accession XM_051005) is another VGAM725 host target gene. KIAA1297 BINDING SITE is HOST TARGET binding site found in the 5' untranslated region of mRNA encoded by KIAA1297, corresponding to a HOST TARGET binding site such as BINDING SITE I, BINDING SITE II or BINDING SITE III. Table 2 illustrates the complementarity of the nucleotide sequences of KIAA1297 BINDING SITE, designated SEQ ID:35710, to the nucleotide sequence of VGAM725 RNA, herein designated VGAM RNA, also designated SEQ ID:3436.

Another function of VGAM725 is therefore inhibition of KIAA1297 (Accession XM_051005). Accordingly, utilities of VGAM725 include diagnosis, prevention and treatment of diseases and clinical conditions associated with KIAA1297. Opiate Receptor-like 1 (OPRL1, Accession NM_000913) is another VGAM725 host target gene. OPRL1 BINDING SITE is HOST TARGET binding site found in the 3' untranslated region of mRNA encoded by OPRL1, corresponding to a HOST TARGET binding site such as BINDING SITE I, BINDING SITE II or BINDING SITE III. Table 2 illustrates the complementarity of the nucleotide sequences of OPRL1 BINDING SITE, designated SEQ ID:6615, to the nucleotide sequence of VGAM725 RNA, herein designated VGAM RNA, also designated SEQ ID:3436.

Another function of VGAM725 is therefore inhibition of Opiate Receptor-like 1 (OPRL1, Accession NM_000913). Accordingly, utilities of VGAM725 include diagnosis, prevention and treatment of diseases and clinical conditions associated with OPRL1. Protein Phosphatase 2 (formerly 2A), Regulatory Subunit B", Alpha (PPP2R3A, Accession NM_002718) is another VGAM725 host target gene. PPP2R3A BINDING SITE is HOST TARGET binding site found in the 3' untranslated region of mRNA encoded by PPP2R3A, corresponding to a HOST TARGET binding site such as BINDING SITE I, BINDING SITE II or BINDING SITE III. Table 2 illustrates the complementarity of the nucleotide sequences of PPP2R3A BINDING SITE, designated SEQ ID:8584, to the nucleotide sequence of VGAM725 RNA, herein designated VGAM RNA, also designated SEQ ID:3436.

Another function of VGAM725 is therefore inhibition of Protein Phosphatase 2 (formerly 2A), Regulatory Subunit B", Alpha (PPP2R3A, Accession NM_002718). Accordingly, utilities of VGAM725 include diagnosis, prevention and treatment of diseases and clinical conditions associated with PPP2R3A. RA-GEF-2 (Accession NM_016340) is another VGAM725 host target gene. RA-GEF-2 BINDING SITE is HOST TARGET binding site found in the 3' untranslated region of mRNA encoded by RA-GEF-2, corresponding to a HOST TARGET binding site such as BINDING SITE I, BINDING SITE II or BINDING SITE III. Table 2 illustrates the complementarity of the nucleotide sequences of RA-GEF-2 BINDING SITE, designated SEQ ID:18464, to the nucleotide sequence of VGAM725 RNA, herein designated VGAM RNA, also designated SEQ ID:3436.

Another function of VGAM725 is therefore inhibition of RA-GEF-2 (Accession NM_016340). Accordingly, utilities of VGAM725 include diagnosis, prevention and treatment of diseases and clinical conditions associated with RA-GEF-2. LOC126961 (Accession XM_059101) is another VGAM725 host target gene. LOC126961 BINDING SITE is HOST TARGET binding site found in the 3' untranslated region of mRNA encoded by LOC126961, corresponding to a HOST TARGET binding site such as BINDING SITE I, BINDING SITE II or BINDING SITE III. Table 2 illustrates the complementarity of the nucleotide sequences of LOC126961 BINDING SITE, designated SEQ ID:36886, to the nucleotide sequence of VGAM725 RNA, herein designated VGAM RNA, also designated SEQ ID:3436.

Another function of VGAM725 is therefore inhibition of LOC126961 (Accession XM_059101). Accordingly, utilities of VGAM725 include diagnosis, prevention and treatment of diseases and clinical conditions associated with LOC126961. LOC201696 (Accession XM_032269) is another VGAM725 host target gene. LOC201696 BINDING SITE is HOST TARGET binding site found in the 3' untranslated region of mRNA encoded by LOC201696, corresponding to a HOST TARGET binding site such as BINDING SITE I, BINDING SITE II or BINDING SITE III. Table 2 illustrates the complementarity of the nucleotide sequences of LOC201696 BINDING SITE, designated SEQ ID:31627, to the nucleotide sequence of VGAM725 RNA, herein designated VGAM RNA, also designated SEQ ID:3436.

Another function of VGAM725 is therefore inhibition of LOC201696 (Accession XM_032269). Accordingly, utilities of VGAM725 include diagnosis, prevention and treatment of diseases and clinical conditions associated with LOC201696. LOC255042 (Accession XM_170896) is another VGAM725 host target gene. LOC255042 BINDING SITE is HOST TARGET binding site found in the 5' untranslated region of mRNA encoded by LOC255042, corresponding to a HOST TARGET binding site such as BINDING SITE I, BINDING SITE II or BINDING SITE III. Table 2 illustrates the complementarity of the nucleotide sequences of LOC255042 BINDING SITE, designated SEQ ID:45648, to the nucleotide sequence of VGAM725 RNA, herein designated VGAM RNA, also designated SEQ ID:3436.

Another function of VGAM725 is therefore inhibition of LOC255042 (Accession XM_170896). Accordingly, utilities of VGAM725 include diagnosis, prevention and treatment of diseases and clinical conditions associated with LOC255042. LOC257395 (Accession XM_170919) is another VGAM725 host target gene. LOC257395 BINDING SITE is HOST TARGET binding site found in the 3' untranslated region of mRNA encoded by LOC257395, corresponding to a HOST TARGET binding site such as BINDING SITE I, BINDING SITE II or BINDING SITE III. Table 2 illustrates the complementarity of the nucleotide sequences of LOC257395 BINDING SITE, designated SEQ ID:45694, to the nucleotide sequence of VGAM725 RNA, herein designated VGAM RNA, also designated SEQ ID:3436.

Another function of VGAM725 is therefore inhibition of LOC257395 (Accession XM_170919). Accordingly, utilities of VGAM725 include diagnosis, prevention and treatment of diseases and clinical conditions associated with LOC257395.

FIG. 1 further provides a conceptual description of a novel bioinformatically detected viral gene of the present invention, referred to here as Viral Genomic Address Messenger 726 (VGAM726) viral gene, which modulates expression of respective host target genes thereof, the function and utility of which host target genes is known in the art.

VGAM726 is a novel bioinformatically detected regulatory, non protein coding, viral micro RNA (miRNA) gene. The method by which VGAM726 was detected is described hereinabove with reference to FIGS. 1-8.

VGAM726 gene, herein designated VGAM GENE, is a viral gene contained in the genome of Tomato Mosaic Virus. VGAM726 host target gene, herein designated VGAM HOST TARGET GENE, is a human gene contained in the human genome.

VGAM726 gene encodes a VGAM726 precursor RNA, herein designated VGAM PRECURSOR RNA. Similar to other miRNA genes, and unlike most ordinary genes, VGAM726 precursor RNA does not encode a protein. A nucleotide sequence identical or highly similar to the nucleotide sequence of VGAM726 precursor RNA is designated SEQ ID:712, and is provided hereinbelow with reference to the sequence listing part. Nucleotide sequence SEQ ID:712 is located at position 3315 relative to the genome of Tomato Mosaic Virus.

VGAM726 precursor RNA folds onto itself, forming VGAM726 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM726 folded precursor RNA into VGAM726 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM726 RNA is designated SEQ ID:3437, and is provided hereinbelow with reference to the sequence listing part.

VGAM726 host target gene, herein designated VGAM HOST TARGET GENE, encodes a corresponding messenger RNA, VGAM726 host target RNA, herein designated VGAM HOST TARGET RNA. VGAM726 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM726 RNA, herein designated VGAM RNA, binds complementarily to one or more host target binding sites located in untranslated regions of VGAM726 host target RNA, herein designated VGAM HOST TARGET RNA. This complementary binding is due to the fact that the nucleotide sequence of VGAM726 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM726 RNA, herein designated VGAM RNA, may have a different number of host target binding sites in untranslated regions of a VGAM726 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM726 RNA, herein designated VGAM RNA, to host target binding sites on VGAM726 host target RNA, herein designated VGAM HOST TARGET RNA, such as BINDING SITE I, BINDING SITE II and BINDING SITE III, inhibits translation of VGAM726 host target RNA into VGAM726 host target protein, herein designated VGAM HOST TARGET PROTEIN. VGAM host target protein is therefore outlined by a broken line.

It is appreciated that VGAM726 host target gene, herein designated VGAM HOST TARGET GENE, in fact represents a plurality of VGAM726 host target genes. The mRNA of each one of this plurality of VGAM726 host target genes comprises one or more host target binding sites, each having a nucleotide sequence which is at least partly complementary to VGAM726 RNA, herein designated VGAM RNA, and which when bound by VGAM726 RNA causes inhibition of translation of respective one or more VGAM726 host target proteins.

It is further appreciated by one skilled in the art that the mode of translational inhibition illustrated by FIG. 1 with specific reference to translational inhibition exerted by VGAM726 gene, herein designated VGAM GENE, on one or more VGAM726 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM726 is inhibition of expression of host target genes, as part of a novel viral mechanism of attacking a host. Accordingly, utilities of VGAM726 include diagnosis, prevention and treatment of viral infection by Tomato Mosaic Virus. Specific functions, and accordingly utilities, of VGAM726 correlate with, and may be deduced from, the identity of the host target genes which VGAM726 binds and inhibits, and the function of these host target genes, as elaborated hereinbelow.

Nucleotide sequences of the VGAM726 precursor RNA, herein designated VGAM PRECURSOR RNA, and of the 'diced' VGAM726 RNA, herein designated VGAM RNA, and a schematic representation of the secondary folding of VGAM726 folded precursor RNA, herein designated VGAM FOLDED PRECURSOR RNA, of VGAM726 are further described hereinbelow with reference to Table 1.

Nucleotide sequences of host target binding sites, such as BINDING SITE-I, BINDING SITE-II and BINDING SITE-III of FIG. 1, found on VGAM726 host target RNA, and schematic representation of the complementarity of each of these host target binding sites to VGAM726 RNA, herein designated VGAM RNA, are described hereinbelow with reference to Table 2.

As mentioned hereinabove with reference to FIG. 1, a function of VGAM726 gene, herein designated VGAM is inhibition of expression of VGAM726 target genes. It is appreciated that specific functions, and accordingly utilities, of VGAM726 correlate with, and may be deduced from, the identity of the target genes which VGAM726 binds and inhibits, and the function of these target genes, as elaborated hereinbelow.

BTB and CNC Homology 1, Basic Leucine Zipper Transcription Factor 1 (BACH1, Accession NM_001186) is a VGAM726 host target gene. BACH1 BINDING SITE is HOST TARGET binding site found in the 3' untranslated region of mRNA encoded by BACH1, corresponding to a HOST TARGET binding site such as BINDING SITE I, BINDING SITE II or BINDING SITE III. Table 2 illustrates the complementarity of the nucleotide sequences of BACH1 BINDING SITE, designated SEQ ID:6854, to the nucleotide sequence of VGAM726 RNA, herein designated VGAM RNA, also designated SEQ ID:3437.

A function of VGAM726 is therefore inhibition of BTB and CNC Homology 1, Basic Leucine Zipper Transcription Factor 1 (BACH1, Accession NM_001186), a gene which acts as repressor or activator, binds to nf-e2 binding sites. Accordingly, utilities of VGAM726 include diagnosis, prevention and treatment of diseases and clinical conditions associated with BACH1. The function of BACH1 and its association with various diseases and clinical conditions, has been established by previous studies, as described hereinabove with reference to VGAM724. Solute Carrier Family 4, Sodium Bicarbonate Cotransporter, Member 4 (SLC4A4, Accession NM_003759) is another VGAM726 host target gene. SLC4A4 BINDING SITE is HOST TARGET binding site found in the 3' untranslated region of mRNA encoded by SLC4A4, corresponding to a HOST TARGET binding site such as BINDING SITE I, BINDING SITE II or BINDING SITE III. Table 2 illustrates the complementarity of the nucleotide sequences of SLC4A4 BINDING SITE, designated SEQ ID:9834, to the nucleotide sequence of VGAM726 RNA, herein designated VGAM RNA, also designated SEQ ID:3437.

Another function of VGAM726 is therefore inhibition of Solute Carrier Family 4, Sodium Bicarbonate Cotransporter, Member 4 (SLC4A4, Accession NM_003759), a gene which is a sodium bicarbonate cotransporter. Accordingly, utilities of VGAM726 include diagnosis, prevention and treatment of diseases and clinical conditions associated with SLC4A4. The function of SLC4A4 and its association with various diseases and clinical conditions, has been established by previous studies, as described hereinabove with reference to VGAM222. UC28 (Accession NM_021635) is another VGAM726 host target gene. UC28 BINDING SITE is HOST TARGET binding site found in the 3' untranslated region of mRNA encoded by UC28, corresponding to a HOST TARGET binding site such as BINDING SITE I, BINDING SITE II or BINDING SITE III. Table 2 illustrates the complementarity of the nucleotide sequences of UC28 BINDING SITE, designated SEQ ID:22278, to the nucleotide sequence of VGAM726 RNA, herein designated VGAM RNA, also designated SEQ ID:3437.

Another function of VGAM726 is therefore inhibition of UC28 (Accession NM_021635). Accordingly, utilities of VGAM726 include diagnosis, prevention and treatment of diseases and clinical conditions associated with UC28. FLJ10933 (Accession NM_018278) is another VGAM726 host target gene. FLJ10933 BINDING SITE is HOST TARGET binding site found in the 3' untranslated region of mRNA encoded by FLJ10933, corresponding to a HOST TARGET binding site such as BINDING SITE I, BINDING SITE II or BINDING SITE III. Table 2 illustrates the complementarity of the nucleotide sequences of FLJ10933 BINDING SITE, designated SEQ ID:20267, to the nucleotide sequence of VGAM726 RNA, herein designated VGAM RNA, also designated SEQ ID:3437.

Another function of VGAM726 is therefore inhibition of FLJ10933 (Accession NM_018278). Accordingly, utilities of VGAM726 include diagnosis, prevention and treatment of diseases and clinical conditions associated with FLJ10933. FLJ13659 (Accession NM_025189) is another VGAM726 host target gene. FLJ13659 BINDING SITE is HOST TARGET binding site found in the 3' untranslated region of mRNA encoded by FLJ13659, corresponding to a HOST TARGET binding site such as BINDING SITE I, BINDING SITE II or BINDING SITE III. Table 2 illustrates the complementarity of the nucleotide sequences of FLJ13659 BINDING SITE, designated SEQ ID:24831, to the nucleotide sequence of VGAM726 RNA, herein designated VGAM RNA, also designated SEQ ID:3437.

Another function of VGAM726 is therefore inhibition of FLJ13659 (Accession NM_025189). Accordingly, utilities of VGAM726 include diagnosis, prevention and treatment of diseases and clinical conditions associated with FLJ13659. KIAA1321 (Accession XM_030856) is another VGAM726 host target gene. KIAA1321 BINDING SITE is HOST TARGET binding site found in the 3' untranslated region of mRNA encoded by KIAA1321, corresponding to a HOST TARGET binding site such as BINDING SITE I, BINDING SITE II or BINDING SITE III. Table 2 illustrates the complementarity of the nucleotide sequences of KIAA1321 BINDING SITE, designated SEQ ID:31191, to the nucleotide sequence of VGAM726 RNA, herein designated VGAM RNA, also designated SEQ ID:3437.

Another function of VGAM726 is therefore inhibition of KIAA1321 (Accession XM_030856). Accordingly, utilities of VGAM726 include diagnosis, prevention and treatment of diseases and clinical conditions associated with KIAA1321. LOC145371 (Accession XM_085123) is another VGAM726 host target gene. LOC145371 BINDING SITE is HOST TARGET binding site found in the 3' untranslated region of mRNA encoded by LOC145371, corresponding to a HOST TARGET binding site such as BINDING SITE I, BINDING SITE II or BINDING SITE III. Table 2 illustrates the complementarity of the nucleotide sequences of LOC145371 BINDING SITE, designated SEQ ID:37840, to the nucleotide sequence of VGAM726 RNA, herein designated VGAM RNA, also designated SEQ ID:3437.

Another function of VGAM726 is therefore inhibition of LOC145371 (Accession XM_085123). Accordingly, utilities of VGAM726 include diagnosis, prevention and treatment of diseases and clinical conditions associated with LOC145371. LOC90288 (Accession XM_030669) is another VGAM726 host target gene. LOC90288 BINDING SITE is HOST TARGET binding site found in the 3' untranslated region of mRNA encoded by LOC90288, corresponding to a HOST TARGET binding site such as BINDING SITE I, BINDING SITE II or BINDING SITE III. Table 2 illustrates the complementarity of the nucleotide sequences of LOC90288 BINDING SITE, designated SEQ ID:31103, to the nucleotide sequence of VGAM726 RNA, herein designated VGAM RNA, also designated SEQ ID:3437.

Another function of VGAM726 is therefore inhibition of LOC90288 (Accession XM_030669). Accordingly, utilities of VGAM726 include diagnosis, prevention and treatment of diseases and clinical conditions associated with LOC90288. FIG. 1 further provides a conceptual description of a novel bioinformatically detected viral gene of the present invention, referred to here as Viral Genomic Address Messenger 727 (VGAM727) viral gene, which modulates expression of respective host target genes thereof, the function and utility of which host target genes is known in the art.

VGAM727 is a novel bioinformatically detected regulatory, non protein coding, viral micro RNA (miRNA) gene. The method by which VGAM727 was detected is described hereinabove with reference to FIGS. 1-8.

VGAM727 gene, herein designated VGAM GENE, is a viral gene contained in the genome of Aconitum Latent Virus. VGAM727 host target gene, herein designated VGAM HOST TARGET GENE, is a human gene contained in the human genome.

VGAM727 gene encodes a VGAM727 precursor RNA, herein designated VGAM PRECURSOR RNA. Similar to other miRNA genes, and unlike most ordinary genes, VGAM727 precursor RNA does not encode a protein. A nucleotide sequence identical or highly similar to the nucleotide sequence of VGAM727 precursor RNA is designated SEQ ID:713, and is provided hereinbelow with reference to the sequence listing part. Nucleotide sequence SEQ ID:713 is located at position 3494 relative to the genome of Aconitum Latent Virus.

VGAM727 precursor RNA folds onto itself, forming VGAM727 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or a partial inversed-reversed sequence of the nucleotide sequence of the second half thereof.

An enzyme complex designated DICER COMPLEX, 'dices' the VGAM727 folded precursor RNA into VGAM727 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 90%) nucleotide sequence of VGAM727 RNA is designated SEQ ID:3438, and is provided hereinbelow with reference to the sequence listing part.

VGAM727 host target gene, herein designated VGAM HOST TARGET GENE, encodes a corresponding messenger RNA, VGAM727 host target RNA, herein designated VGAM HOST TARGET RNA. VGAM727 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM727 RNA, herein designated VGAM RNA, binds complementarily to one or more host target binding sites located in untranslated regions of VGAM727 host target RNA, herein designated VGAM HOST TARGET RNA. This complementary binding is due to the fact that the nucleotide sequence of VGAM727 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM727 RNA, herein designated VGAM RNA, may have a different number of host target binding sites in untranslated regions of a VGAM727 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM727 RNA, herein designated VGAM RNA, to host target binding sites on VGAM727 host target RNA, herein designated VGAM HOST TARGET RNA, such as BINDING SITE I, BINDING SITE II and BINDING SITE III, inhibits translation of VGAM727 host target RNA into VGAM727 host target protein, herein designated VGAM HOST TARGET PROTEIN. VGAM host target protein is therefore outlined by a broken line.

It is appreciated that VGAM727 host target gene, herein designated VGAM HOST TARGET GENE, in fact represents a plurality of VGAM727 host target genes. The mRNA of each one of this plurality of VGAM727 host target genes comprises one or more host target binding sites, each having a nucleotide sequence which is at least partly complementary to VGAM727 RNA, herein designated VGAM RNA, and which when bound by VGAM727 RNA causes inhibition of translation of respective one or more VGAM727 host target proteins.

It is further appreciated by one skilled in the art that the mode of translational inhibition illustrated by FIG. 1 with specific reference to translational inhibition exerted by VGAM727 gene, herein designated VGAM GENE, on one or more VGAM727 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM727 is inhibition of expression of host target genes, as part of a novel viral mechanism of attacking a host. Accordingly, utilities of VGAM727 include diagnosis, prevention and treatment of viral infection by Aconitum Latent Virus. Specific functions, and accordingly utilities, of VGAM727 correlate with, and may be deduced from, the identity of the host target genes which VGAM727 binds and inhibits, and the function of these host target genes, as elaborated hereinbelow.

Nucleotide sequences of the VGAM727 precursor RNA, herein designated VGAM PRECURSOR RNA, and of the 'diced' VGAM727 RNA, herein designated VGAM RNA, and a schematic representation of the secondary folding of VGAM727 folded precursor RNA, herein designated VGAM FOLDED PRECURSOR RNA, of VGAM727 are further described hereinbelow with reference to Table 1.

Nucleotide sequences of host target binding sites, such as BINDING SITE-I, BINDING SITE-II and BINDING SITE-III of FIG. 1, found on VGAM727 host target RNA, and schematic representation of the complementarity of each of these host target binding sites to VGAM727 RNA, herein designated VGAM RNA, are described hereinbelow with reference to Table 2.

As mentioned hereinabove with reference to FIG. 1, a function of VGAM727 gene, herein designated VGAM is inhibition of expression of VGAM727 target genes. It is appreciated that specific functions, and accordingly utilities, of VGAM727 correlate with, and may be deduced from, the identity of the target genes which VGAM727 binds and inhibits, and the function of these target genes, as elaborated hereinbelow.

A Disintegrin and Metalloproteinase Domain 19 (meltrin beta) (ADAM19, Accession NM_033274) is a VGAM727 host target gene. ADAM19 BINDING SITE is HOST TARGET binding site found in the 3' untranslated region of mRNA encoded by ADAM19, corresponding to a HOST TARGET binding site such as BINDING SITE I, BINDING SITE II or BINDING SITE III. Table 2 illustrates the complementarity of the nucleotide sequences of ADAM19 BINDING SITE, designated SEQ ID:27098, to the nucleotide sequence of VGAM727 RNA, herein designated VGAM RNA, also designated SEQ ID:3438.

A function of VGAM727 is therefore inhibition of A Disintegrin and Metalloproteinase Domain 19 (meltrin beta) (ADAM19, Accession NM_033274), a gene which participates in the proteolytic processing of beta-type neuregulin isoforms. Accordingly, utilities of VGAM727 include diagnosis, prevention and treatment of diseases and clinical conditions associated with ADAM19. The function of ADAM19 and its association with various diseases and clinical conditions, has been established by previous studies, as described hereinabove with reference to VGAM179. Potassium Voltage-gated Channel, Shaker-related Subfamily, Beta Member 1 (KCNAB1, Accession XM_027634) is another VGAM727 host target gene. KCNAB1 BINDING SITE is HOST TARGET binding site found in the 3' untranslated region of mRNA encoded by KCNAB1, corresponding to a HOST TARGET binding site such as BINDING SITE I, BINDING SITE II or BINDING SITE III. Table 2 illustrates the complementarity of the nucleotide sequences of KCNAB1 BINDING SITE, designated SEQ ID:30547, to the nucleotide sequence of VGAM727 RNA, herein designated VGAM RNA, also designated SEQ ID:3438.

Another function of VGAM727 is therefore inhibition of Potassium Voltage-gated Channel, Shaker-related Subfamily, Beta Member 1 (KCNAB1, Accession XM_027634), a gene which is the regulatory beta subunit for a shaker-related voltage-gated potassium channel. Accordingly, utilities of VGAM727 include diagnosis, prevention and treatment of diseases and clinical conditions associated with KCNAB1. The function of KCNAB1 has been established by previous studies. 'Shaker' and other voltage-dependent potassium channel proteins help to determine the electrical properties of excitable cells and play additional physiologic roles in non-excitable cell types. Voltage-activated, outwardly rectifying potassium channels (Kv) are heterooligomers that are assembled from alpha and beta subunits in a 1:1 molar ratio. Schultz et al. (1996) noted that mammals contain a large number of alpha-subunit potassium channel genes, often clustered within the genome, that may have arisen through local and chromosomal duplication events. The associated beta subunits modulate the gating properties and amplitudes of the Shaker potassium currents. England et al. (1995) cloned a human heart cDNA encoding a beta subunit that they designated Kv-beta-1.3. Sequence analysis revealed that Kv-beta-1.3 and the previously identified human Kv-beta-1 (England et al., 1995) and Kv-beta-3 (McCormack et al., 1995) subunits differ only at their N termini and are encoded by alternatively spliced mRNAs from a single gene. The authors suggested that Kv-beta-1 and Kv-beta-3 be renamed Kv-beta-1.1 and Kv-beta-1.2, respectively. The predicted 419-amino acid Kv-beta-1.3 subunit does not contain a hydrophobic domain and is likely to be a cytoplasmic protein, like other beta subunits. When coexpressed in Xenopus oocytes, the Kv-beta-1.3 subunit altered the functional properties of Kv1.5 (KCNA5; 176267), converting it from a delayed rectifier to a channel with rapid but partial inactivation. In addition, Kv-beta-1.3 converted the Kv1.5 outwardly rectifying current-voltage relationship to one showing strong inward rectification. England et al. (1995) concluded that Kv channel current diversity may arise from association with alternatively spliced Kv-beta subunits. By Northern blot analysis, Leicher et al. (1996) found that the KCNA1B gene was expressed as 3.4- and 3.8-kb mRNAs in human brain. The pattern of expression of Kv1-alpha and Kv-beta subunits suggested an intricate and cell-specific regulatory mechanism that produces distinct combinations of alpha and beta subunits in different nuclei of the brain. The Kv-beta-1.1 and Kv-beta-1.2 splice variants contain an N-terminal inactivating domain similar to that found in A-type Kv channels (see OMIM Ref. No. KCNA4; 176266). When coexpressed in mammalian cells, Kv-beta-1.1 and Kv-beta-1.2 conferred rapid inactivation on Kv1.5 channels, with different potencies Full details of the abovementioned studies are described in the following publications, the disclosure of which are hereby incorporated by reference:

Leicher, T. Roeper, J.; Weber, K.; Wang, X.; Pongs, O.: Structural and functional characterization of human potassium channel subunit beta-1 (KCNA1B). Neuropharmacology 35:787-795, 1996; and Schultz, D.; Litt, M.; Smith, L.; Thayer, M.; McCormack, K.: Localization of two potassium channel beta subunit genes, KCNA1B and KCNA2B. Genomics 31:389-391, 1996.

Further studies establishing the function and utilities of KCNAB1 are found in John Hopkins OMIM database record ID 601141, and in sited publications numbered 6841-2849 listed in the bibliography section hereinbelow, which are also hereby incorporated by reference. Polycystic Kidney Disease (polycystin) and REJ (sperm receptor for egg jelly homolog, sea urchin)-like (PKDREJ, Accession NM_006071) is another VGAM727 host target gene. PKDREJ BINDING SITE is HOST TARGET binding site found in the 3' untranslated region of mRNA encoded by PKDREJ, corresponding to a HOST TARGET binding site such as BINDING SITE I, BINDING SITE II or BINDING SITE III. Table 2 illustrates the complementarity of the nucleotide sequences of PKDREJ BINDING SITE, designated SEQ ID:12715, to the nucleotide sequence of VGAM727 RNA, herein designated VGAM RNA, also designated SEQ ID:3438.

Another function of VGAM727 is therefore inhibition of Polycystic Kidney Disease (polycystin) and REJ (sperm receptor for egg jelly homolog, sea urchin)-like (PKDREJ, Accession NM_006071), a gene which may intervene in fertilization. Accordingly, utilities of VGAM727 include diagnosis, prevention and treatment of diseases and clinical conditions associated with PKDREJ. The function of PKDREJ and its association with various diseases and clinical conditions, has been established by previous studies, as described hereinabove with reference to VGAM641. RAD54B (Accession NM_134434) is another VGAM727 host target gene. RAD54B BINDING SITE is HOST TARGET binding site found in the 3" untranslated region of mRNA encoded by RAD54B, corresponding to a HOST TARGET binding site such as BINDING SITE I, BINDING SITE II or BINDING SITE III. Table 2 illustrates the complementarity of the nucleotide sequences of RAD54B BINDING SITE, designated SEQ ID:28676, to the nucleotide sequence of VGAM727 RNA, herein designated VGAM RNA, also designated SEQ ID:3438.

Another function of VGAM727 is therefore inhibition of RAD54B (Accession NM_134434), a gene which is involved in dna repair and mitotic recombination. Accordingly, utilities of VGAM727 include diagnosis, prevention and treatment of diseases and clinical conditions associated with RAD54B. The function of RAD54B and its association with various diseases and clinical conditions, has been established by previous studies, as described hereinabove with reference to VGAM595. Sorting Nexin 10 (SNX10, Accession NM_013322) is another VGAM727 host target gene. SNX10 BINDING SITE is HOST TARGET binding site found in the 3' untranslated region of mRNA encoded by SNX10, corresponding to a HOST TARGET binding site such as BINDING SITE I, BINDING SITE II or BINDING SITE III. Table 2 illustrates the complementarity of the nucleotide sequences of SNX10 BINDING SITE, designated SEQ ID:14967, to the nucleotide sequence of VGAM727 RNA, herein designated VGAM RNA, also designated SEQ ID:3438.

Another function of VGAM727 is therefore inhibition of Sorting Nexin 10 (SNX10, Accession NM_013322). Accordingly, utilities of VGAM727 include diagnosis, prevention and treatment of diseases and clinical conditions associated with SNX10. LOC115294 (Accession XM_054302) is another VGAM727 host target gene. LOC115294 BINDING SITE is HOST TARGET binding site found in the 3' untranslated region of mRNA encoded by LOC115294, corresponding to a HOST TARGET binding site such as BINDING SITE I, BINDING SITE II or BINDING SITE III. Table 2 illustrates the complementarity of the nucleotide sequences of LOC115294 BINDING SITE, designated SEQ ID:36148, to the nucleotide sequence of VGAM727 RNA, herein designated VGAM RNA, also designated SEQ ID:3438.

Another function of VGAM727 is therefore inhibition of LOC115294 (Accession XM_054302). Accordingly, utilities of VGAM727 include diagnosis, prevention and treatment of diseases and clinical conditions associated with LOC115294. LOC148254 (Accession XM_086121) is another VGAM727 host target gene. LOC148254 BINDING SITE is HOST TARGET binding site found in the 3' untranslated region of mRNA encoded by LOC148254, corresponding to a HOST TARGET binding site such as BINDING SITE I, BINDING SITE II or BINDING SITE III. Table 2 illustrates the complementarity of the nucleotide sequences of LOC148254 BINDING SITE, designated SEQ ID:38503, to the nucleotide sequence of VGAM727 RNA, herein designated VGAM RNA, also designated SEQ ID:3438.

Another function of VGAM727 is therefore inhibition of LOC148254 (Accession XM_086121). Accordingly, utilities of VGAM727 include diagnosis, prevention and treatment of diseases and clinical conditions associated with LOC148254. LOC164714 (Accession XM_104657) is another VGAM727 host target gene. LOC164714 BINDING SITE is HOST TARGET binding site found in the 5' untranslated region of mRNA encoded by LOC164714, corresponding to a HOST TARGET binding site such as BINDING SITE I, BINDING SITE II or BINDING SITE III. Table 2 illustrates the complementarity of the nucleotide sequences of LOC164714 BINDING SITE, designated SEQ ID:42181, to the nucleotide sequence of VGAM727 RNA, herein designated VGAM RNA, also designated SEQ ID:3438.

Another function of VGAM727 is therefore inhibition of LOC164714 (Accession XM_104657). Accordingly, utilities of VGAM727 include diagnosis, prevention and treatment of diseases and clinical conditions associated with LOC164714. LOC166424 (Accession XM_105867) is another VGAM727 host target gene. LOC166424 BINDING SITE is HOST TARGET binding site found in the 5' untranslated region of mRNA encoded by LOC166424, corresponding to a HOST TARGET binding site such as BINDING SITE I, BINDING SITE II or BINDING SITE III. Table 2 illustrates the complementarity of the nucleotide sequences of LOC166424 BINDING SITE, designated SEQ ID:42195, to the nucleotide sequence of VGAM727 RNA, herein designated VGAM RNA, also designated SEQ ID:3438.

Another function of VGAM727 is therefore inhibition of LOC166424 (Accession XM_105867). Accordingly, utilities of VGAM727 include diagnosis, prevention and treatment of diseases and clinical conditions associated with LOC166424. LOC255096 (Accession XM_174913) is another VGAM727 host target gene. LOC255096 BINDING SITE is HOST TARGET binding site found in the 5' untranslated region of mRNA encoded by LOC255096, corresponding to a HOST TARGET binding site such as BINDING SITE I, BINDING SITE II or BINDING SITE III. Table 2 illustrates the complementarity of the nucleotide sequences of LOC255096 BINDING SITE, designated SEQ ID:46608, to the nucleotide sequence of VGAM727 RNA, herein designated VGAM RNA, also designated SEQ ID:3438.

Another function of VGAM727 is therefore inhibition of LOC255096 (Accession XM_174913). Accordingly, utilities of VGAM727 include diagnosis, prevention and treatment of diseases and clinical conditions associated with LOC255096. LOC91380 (Accession XM_038134) is another VGAM727 host target gene. LOC91380 BINDING SITE is HOST TARGET binding site found in the 3' untranslated region of mRNA encoded by LOC91380, corresponding to a HOST TARGET binding site such as BINDING SITE I, BINDING SITE II or BINDING SITE III. Table 2 illustrates the complementarity of the nucleotide sequences of LOC91380 BINDING SITE, designated SEQ ID:32756, to the nucleotide sequence of VGAM727 RNA, herein designated VGAM RNA, also designated SEQ ID:3438.

Another function of VGAM727 is therefore inhibition of LOC91380 (Accession XM_038134). Accordingly, utilities of VGAM727 include diagnosis, prevention and treatment of diseases and clinical conditions associated with LOC91380. FIG. 1 further provides a conceptual description of a novel bioinformatically detected viral gene of the present invention, referred to here as Viral Genomic Address Messenger 728 (VGAM728) viral gene, which modulates expression of respective host target genes thereof, the function and utility of which host target genes is known in the art.

VGAM728 is a novel bioinformatically detected regulatory, non protein coding, viral micro RNA (miRNA) gene. The method by which VGAM728 was detected is described hereinabove with reference to FIGS. 1-8.

VGAM728 gene, herein designated VGAM GENE, is a viral gene contained in the genome of Aconitum Latent Virus. VGAM728 host target gene, herein designated VGAM HOST TARGET GENE, is a human gene contained in the human genome.

VGAM728 gene encodes a VGAM728 precursor RNA, herein designated VGAM PRECURSOR RNA. Similar to other miRNA genes, and unlike most ordinary genes, VGAM728 precursor RNA does not encode a protein. A nucleotide sequence identical or highly similar to the nucleotide sequence of VGAM728 precursor RNA is designated SEQ ID:714, and is provided hereinbelow with reference to the sequence listing part. Nucleotide sequence SEQ ID:714 is located at position 3248 relative to the genome of Aconitum Latent Virus.

VGAM728 precursor RNA folds onto itself, forming VGAM728 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM728 folded precursor RNA into VGAM728 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM728 RNA is designated SEQ ID:3439, and is provided hereinbelow with reference to the sequence listing part.

VGAM728 host target gene, herein designated VGAM HOST TARGET GENE, encodes a corresponding messenger RNA, VGAM728 host target RNA, herein designated VGAM HOST TARGET RNA. VGAM728 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM728 RNA, herein designated VGAM RNA, binds complementarily to one or more host target binding sites located in untranslated regions of VGAM728 host target RNA, herein designated VGAM HOST TARGET RNA. This complementary binding is due to the fact that the nucleotide sequence of VGAM728 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM728 RNA, herein designated VGAM RNA, may have a different number of host target binding sites in untranslated regions of a VGAM728 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM728 RNA, herein designated VGAM RNA, to host target binding sites on VGAM728 host target RNA, herein designated VGAM HOST TARGET RNA, such as BINDING SITE I, BINDING SITE II and BINDING SITE III, inhibits translation of VGAM728 host target RNA into VGAM728 host target protein, herein designated VGAM HOST TARGET PROTEIN. VGAM host target protein is therefore outlined by a broken line.

It is appreciated that VGAM728 host target gene, herein designated VGAM HOST TARGET GENE, in fact represents a plurality of VGAM728 host target genes. The mRNA of each one of this plurality of VGAM728 host target genes comprises one or more host target binding sites, each having a nucleotide sequence which is at least partly complementary to VGAM728 RNA, herein designated VGAM RNA, and which when bound by VGAM728 RNA causes inhibition of translation of respective one or more VGAM728 host target proteins.

It is further appreciated by one skilled in the art that the mode of translational inhibition illustrated by FIG. 1 with specific reference to translational inhibition exerted by VGAM728 gene, herein designated VGAM GENE, on one or more VGAM728 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM728 is inhibition of expression of host target genes, as part of a novel viral mechanism of attacking a host. Accordingly, utilities of VGAM728 include diagnosis, prevention and treatment of viral infection by Aconitum Latent Virus. Specific functions, and accordingly utilities, of VGAM728 correlate with, and may be deduced from, the identity of the host target genes which VGAM728 binds and inhibits, and the function of these host target genes, as elaborated hereinbelow.

Nucleotide sequences of the VGAM728 precursor RNA, herein designated VGAM PRECURSOR RNA, and of the 'diced' VGAM728 RNA, herein designated VGAM RNA, and a schematic representation of the secondary folding of VGAM728 folded precursor RNA, herein designated VGAM FOLDED PRECURSOR RNA, of VGAM728 are further described hereinbelow with reference to Table 1.

Nucleotide sequences of host target binding sites, such as BINDING SITE-I, BINDING SITE-II and BINDING SITE-III of FIG. 1, found on VGAM728 host target RNA, and schematic representation of the complementarity of each of these host target binding sites to VGAM728 RNA, herein designated VGAM RNA, are described hereinbelow with reference to Table 2.

As mentioned hereinabove with reference to FIG. 1, a function of VGAM728 gene, herein designated VGAM is inhibition of expression of VGAM728 target genes. It is appreciated that specific functions, and accordingly utilities, of VGAM728 correlate with, and may be deduced from, the identity of the target genes which VGAM728 binds and inhibits, and the function of these target genes, as elaborated hereinbelow.

B-cell CLL/lymphoma 11B (zinc finger protein) (BCL11B, Accession NM_022898) is a VGAM728 host target gene. BCL11B BINDING SITE is HOST TARGET binding site found in the 3' untranslated region of mRNA encoded by BCL11B, corresponding to a HOST TARGET binding site such as BINDING SITE I, BINDING SITE II or BINDING SITE III. Table 2 illustrates the complementarity of the nucleotide sequences of BCL11B BINDING SITE, designated SEQ ID:23159, to the nucleotide sequence of VGAM728 RNA, herein designated VGAM RNA, also designated SEQ ID:3439.

A function of VGAM728 is therefore inhibition of B-cell CLL/lymphoma 11B (zinc finger protein) (BCL11B, Accession NM_022898). Accordingly, utilities of VGAM728 include diagnosis, prevention and treatment of diseases and clinical conditions associated with BCL11B. Chromosome 20 Open Reading Frame 64 (C20orf64, Accession NM_033550) is another VGAM728 host target gene. C20orf64 BINDING SITE is HOST TARGET binding site found in the 5' untranslated region of mRNA encoded by C20orf64, corresponding to a HOST TARGET binding site such as BINDING SITE I, BINDING SITE II or BINDING SITE III. Table 2 illustrates the complementarity of the nucleotide sequences of C20orf64 BINDING SITE, designated SEQ ID:27310, to the nucleotide sequence of VGAM728 RNA, herein designated VGAM RNA, also designated SEQ ID:3439.

Another function of VGAM728 is therefore inhibition of Chromosome 20 Open Reading Frame 64 (C20orf64, Accession NM_033550). Accordingly, utilities of VGAM728 include diagnosis, prevention and treatment of diseases and clinical conditions associated with C20orf64. KIAA1958 (Accession XM_088566) is another VGAM728 host target gene. KIAA1958 BINDING SITE is HOST TARGET binding site found in the 5' untranslated region of mRNA encoded by KIAA1958, corresponding to a HOST TARGET binding site such as BINDING SITE I, BINDING SITE II or BINDING SITE III. Table 2 illustrates the complementarity of the nucleotide sequences of KIAA1958 BINDING SITE, designated SEQ ID:39827, to the nucleotide sequence of VGAM728 RNA, herein designated VGAM RNA, also designated SEQ ID:3439.

Another function of VGAM728 is therefore inhibition of KIAA1958 (Accession XM_088566). Accordingly, utilities of VGAM728 include diagnosis, prevention and treatment of diseases and clinical conditions associated with KIAA1958. FIG. 1 further provides a conceptual description of a novel bioinformatically detected viral gene of the present invention, referred to here as Viral Genomic Address Messenger 729 (VGAM729) viral gene, which modulates expression of respective host target genes thereof, the function and utility of which host target genes is known in the art.

VGAM729 is a novel bioinformatically detected regulatory, non protein coding, viral micro RNA (miRNA) gene. The method by which VGAM729 was detected is described hereinabove with reference to FIGS. 1-8.

VGAM729 gene, herein designated VGAM GENE, is a viral gene contained in the genome of Cydia Pomonella Granulovirus. VGAM729 host target gene, herein designated VGAM HOST TARGET GENE, is a human gene contained in the human genome.

VGAM729 gene encodes a VGAM729 precursor RNA, herein designated VGAM PRECURSOR RNA. Similar to other miRNA genes, and unlike most ordinary genes, VGAM729 precursor RNA does not encode a protein. A nucleotide sequence identical or highly similar to the nucleotide sequence of VGAM729 precursor RNA is designated SEQ ID:715, and is provided hereinbelow with reference to the sequence listing part. Nucleotide sequence SEQ ID:715 is located at position 72517 relative to the genome of Cydia Pomonella Granulovirus.

VGAM729 precursor RNA folds onto itself, forming VGAM729 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM729 folded precursor RNA into VGAM729 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM729 RNA is designated SEQ ID:3440, and is provided hereinbelow with reference to the sequence listing part.

VGAM729 host target gene, herein designated VGAM HOST TARGET GENE, encodes a corresponding messenger RNA, VGAM729 host target RNA, herein designated VGAM HOST TARGET RNA. VGAM729 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM729 RNA, herein designated VGAM RNA, binds complementarily to one or more host target binding sites located in untranslated regions of VGAM729 host target RNA, herein designated VGAM HOST TARGET RNA. This complementary binding is due to the fact that the nucleotide sequence of VGAM729 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM729 RNA, herein designated VGAM RNA, may have a different number of host target binding sites in untranslated regions of a VGAM729 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM729 RNA, herein designated VGAM RNA, to host target binding sites on VGAM729 host target RNA, herein designated VGAM HOST TARGET RNA, such as BINDING SITE I, BINDING SITE II and BINDING SITE III, inhibits translation of VGAM729 host target RNA into VGAM729 host target protein, herein designated VGAM HOST TARGET PROTEIN. VGAM host target protein is therefore outlined by a broken line.

It is appreciated that VGAM729 host target gene, herein designated VGAM HOST TARGET GENE, in fact represents a plurality of VGAM729 host target genes. The mRNA of each one of this plurality of VGAM729 host target genes comprises one or more host target binding sites, each having a nucleotide sequence which is at least partly complementary to VGAM729 RNA, herein designated VGAM RNA, and which when bound by VGAM729 RNA causes inhibition of translation of respective one or more VGAM729 host target proteins.

It is further appreciated by one skilled in the art that the mode of translational inhibition illustrated by FIG. 1 with specific reference to translational inhibition exerted by VGAM729 gene, herein designated VGAM GENE, on one or more VGAM729 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM729 is inhibition of expression of host target genes, as part of a novel viral mechanism of attacking a host. Accordingly, utilities of VGAM729 include diagnosis, prevention and treatment of viral infection by Cydia Pomonella Granulovirus. Specific functions, and accordingly utilities, of VGAM729 correlate with, and may be deduced from, the identity of the host target genes which VGAM729 binds and inhibits, and the function of these host target genes, as elaborated hereinbelow.

Nucleotide sequences of the VGAM729 precursor RNA, herein designated VGAM PRECURSOR RNA, and of the 'diced' VGAM729 RNA, herein designated VGAM RNA, and a schematic representation of the secondary folding of VGAM729 folded precursor RNA, herein designated VGAM FOLDED PRECURSOR RNA, of VGAM729 are further described hereinbelow with reference to Table 1.

Nucleotide sequences of host target binding sites, such as BINDING SITE-I, BINDING SITE-II and BINDING SITE-III of FIG. 1, found on VGAM729 host target RNA, and schematic representation of the complementarity of each of these host target binding sites to VGAM729 RNA, herein designated VGAM RNA, are described hereinbelow with reference to Table 2.

As mentioned hereinabove with reference to FIG. 1, a function of VGAM729 gene, herein designated VGAM is inhibition of expression of VGAM729 target genes. It is appreciated that specific functions, and accordingly utilities, of VGAM729 correlate with, and may be deduced from, the identity of the target genes which VGAM729 binds and inhibits, and the function of these target genes, as elaborated hereinbelow.

FLJ10716 (Accession NM_018191) is a VGAM729 host target gene. FLJ10716 BINDING SITE is HOST TARGET binding site found in the 3' untranslated region of mRNA encoded by FLJ10716, corresponding to a HOST TARGET binding site such as BINDING SITE I, BINDING SITE II or BINDING SITE III. Table 2 illustrates the complementarity of the nucleotide sequences of FLJ10716 BINDING SITE, designated SEQ ID:20046, to the nucleotide sequence of VGAM729 RNA, herein designated VGAM RNA, also designated SEQ ID:3440.

A function of VGAM729 is therefore inhibition of FLJ10716 (Accession NM_018191). Accordingly, utilities of VGAM729 include diagnosis, prevention and treatment of diseases and clinical conditions associated with FLJ10716. NTT73 (Accession NM_018057) is another VGAM729 host target gene. NTT73 BINDING SITE is HOST TARGET binding site found in the 3' untranslated region of mRNA encoded by NTT73, corresponding to a HOST TARGET binding site such as BINDING SITE I, BINDING SITE II or BINDING SITE III. Table 2 illustrates the complementarity of the nucleotide sequences of NTT73 BINDING SITE, designated SEQ ID:19822, to the nucleotide sequence of VGAM729 RNA, herein designated VGAM RNA, also designated SEQ ID:3440.

Another function of VGAM729 is therefore inhibition of NTT73 (Accession NM_018057). Accordingly, utilities of VGAM729 include diagnosis, prevention and treatment of diseases and clinical conditions associated with NTT73. LOC157562 (Accession XM_098779) is another VGAM729 host target gene. LOC157562 BINDING SITE is HOST TARGET binding site found in the 5' untranslated region of mRNA encoded by LOC157562, corresponding to a HOST TARGET binding site such as BINDING SITE I, BINDING SITE II or BINDING SITE III. Table 2 illustrates the complementarity of the nucleotide sequences of LOC157562 BINDING SITE, designated SEQ ID:41818, to the nucleotide sequence of VGAM729 RNA, herein designated VGAM RNA, also designated SEQ ID:3440.

Another function of VGAM729 is therefore inhibition of LOC157562 (Accession XM_098779). Accordingly, utilities of VGAM729 include diagnosis, prevention and treatment of diseases and clinical conditions associated with LOC157562. FIG. 1 further provides a conceptual description of a novel bioinformatically detected viral gene of the present invention, referred to here as Viral Genomic Address Messenger 730 (VGAM730) viral gene, which modulates expression of respective host target genes thereof, the function and utility of which host target genes is known in the art.

VGAM730 is a novel bioinformatically detected regulatory, non protein coding, viral micro RNA (miRNA) gene. The method by which VGAM730 was detected is described hereinabove with reference to FIGS. 1-8.

VGAM730 gene, herein designated VGAM GENE, is a viral gene contained in the genome of Cydia Pomonella Granulovirus. VGAM730 host target gene, herein designated VGAM HOST TARGET GENE, is a human gene contained in the human genome.

VGAM730 gene encodes a VGAM730 precursor RNA, herein designated VGAM PRECURSOR RNA. Similar to other miRNA genes, and unlike most ordinary genes, VGAM730 precursor RNA does not encode a protein. A nucleotide sequence identical or highly similar to the nucleotide sequence of VGAM730 precursor RNA is designated SEQ ID:716, and is provided hereinbelow with reference to the sequence listing part. Nucleotide sequence SEQ ID:716 is located at position 72933 relative to the genome of Cydia Pomonella Granulovirus.

VGAM730 precursor RNA folds onto itself, forming VGAM730 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM730 folded precursor RNA into VGAM730 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM730 RNA is designated SEQ ID:3441, and is provided hereinbelow with reference to the sequence listing part.

VGAM730 host target gene, herein designated VGAM HOST TARGET GENE, encodes a corresponding messenger RNA, VGAM730 host target RNA, herein designated VGAM HOST TARGET RNA. VGAM730 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM730 RNA, herein designated VGAM RNA, binds complementarily to one or more host target binding sites located in untranslated regions of VGAM730 host target RNA, herein designated VGAM HOST TARGET RNA. This complementary binding is due to the fact that the nucleotide sequence of VGAM730 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM730 RNA, herein designated VGAM RNA, may have a different number of host target binding sites in untranslated regions of a VGAM730 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM730 RNA, herein designated VGAM RNA, to host target binding sites on VGAM730 host target RNA, herein designated VGAM HOST TARGET RNA, such as BINDING SITE I, BINDING SITE II and BINDING SITE III, inhibits translation of VGAM730 host target RNA into VGAM730 host target protein, herein designated VGAM HOST TARGET PROTEIN. VGAM host target protein is therefore outlined by a broken line.

It is appreciated that VGAM730 host target gene, herein designated VGAM HOST TARGET GENE, in fact represents a plurality of VGAM730 host target genes. The mRNA of each one of this plurality of VGAM730 host target genes comprises one or more host target binding sites, each having a nucleotide sequence which is at least partly complementary to VGAM730 RNA, herein designated VGAM RNA, and which when bound by VGAM730 RNA causes inhibition of translation of respective one or more VGAM730 host target proteins.

It is further appreciated by one skilled in the art that the mode of translational inhibition illustrated by FIG. 1 with specific reference to translational inhibition exerted by VGAM730 gene, herein designated VGAM GENE, on one or more VGAM730 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM730 is inhibition of expression of host target genes, as part of a novel viral mechanism of attacking a host. Accordingly, utilities of VGAM730 include diagnosis, prevention and treatment of viral infection by Cydia Pomonella Granulovirus. Specific functions, and accordingly utilities, of VGAM730 correlate with, and may be deduced from, the identity of the host target genes which VGAM730 binds and inhibits, and the function of these host target genes, as elaborated hereinbelow.

Nucleotide sequences of the VGAM730 precursor RNA, herein designated VGAM PRECURSOR RNA, and of the 'diced' VGAM730 RNA, herein designated VGAM RNA, and a schematic representation of the secondary folding of VGAM730 folded precursor RNA, herein designated VGAM FOLDED PRECURSOR RNA, of VGAM730 are further described hereinbelow with reference to Table 1.

Nucleotide sequences of host target binding sites, such as BINDING SITE-I, BINDING SITE-II and BINDING SITE-III of FIG. 1, found on VGAM730 host target RNA, and schematic representation of the complementarity of each of these host target binding sites to VGAM730 RNA, herein designated VGAM RNA, are described hereinbelow with reference to Table 2.

As mentioned hereinabove with reference to FIG. 1, a function of VGAM730 gene, herein designated VGAM is inhibition of expression of VGAM730 target genes. It is appreciated that specific functions, and accordingly utilities, of VGAM730 correlate with, and may be deduced from, the identity of the target genes which VGAM730 binds and inhibits, and the function of these target genes, as elaborated hereinbelow.

ATP-binding Cassette, Sub-family D (ALD), Member 1 (ABCD1, Accession NM_000033) is a VGAM730 host target gene. ABCD1 BINDING SITE is HOST TARGET binding site found in the 5' untranslated region of mRNA encoded by ABCD1, corresponding to a HOST TARGET binding site such as BINDING SITE I, BINDING SITE II or BINDING SITE III. Table 2 illustrates the complementarity of the nucleotide sequences of ABCD1 BINDING SITE, designated SEQ ID:5470, to the nucleotide sequence of VGAM730 RNA, herein designated VGAM RNA, also designated SEQ ID:3441.

A function of VGAM730 is therefore inhibition of ATP-binding Cassette, Sub-family D (ALD), Member 1 (ABCD1, Accession NM_000033). Accordingly, utilities of VGAM730 include diagnosis, prevention and treatment of diseases and clinical conditions associated with ABCD1. Chromosome 14 Open Reading Frame 1 (C14orf1, Accession NM_007176) is another VGAM730 host target gene. C14orf1 BINDING SITE is HOST TARGET binding site found in the 3' untranslated region of mRNA encoded by C14orf1, corresponding to a HOST TARGET binding site such as BINDING SITE I, BINDING SITE II or BINDING SITE III. Table 2 illustrates the complementarity of the nucleotide sequences of C14orf1 BINDING SITE, designated SEQ ID:14027, to the nucleotide sequence of VGAM730

RNA, herein designated VGAM RNA, also designated SEQ ID:3441.

Another function of VGAM730 is therefore inhibition of Chromosome 14 Open Reading Frame 1 (C14orf1, Accession NM_007176). Accordingly, utilities of VGAM730 include diagnosis, prevention and treatment of diseases and clinical conditions associated with C14orf1. Dead Ringer-like 1 (Drosophila) (DRIL1, Accession NM_005224) is another VGAM730 host target gene. DRIL1 BINDING SITE is HOST TARGET binding site found in the 3' untranslated region of mRNA encoded by DRIL1, corresponding to a HOST TARGET binding site such as BINDING SITE I, BINDING SITE II or BINDING SITE III. Table 2 illustrates the complementarity of the nucleotide sequences of DRIL1 BINDING SITE, designated SEQ ID:11718, to the nucleotide sequence of VGAM730 RNA, herein designated VGAM RNA, also designated SEQ ID:3441.

Another function of VGAM730 is therefore inhibition of Dead Ringer-like 1 (Drosophila) (DRIL1, Accession NM_005224), a gene which binds a vh promoter proximal site necessary for induced mu-heavy-chain transcription. Accordingly, utilities of VGAM730 include diagnosis, prevention and treatment of diseases and clinical conditions associated with DRIL1. The function of DRIL1 has been established by previous studies. Herrscher et al. (1995) identified the mouse Bright (B-cell regulator of IgH transcription) gene. They found that the Bright protein is expressed specifically in B cells and transactivates an IgH enhancer in transient transfection assays. Bright and the Drosophila 'dead ringer' (dri) gene product belong to a protein family whose members share a conserved DNA-binding domain termed the 'A/T-rich interaction domain' (ARID). By PCR using degenerate primers based on the ARID sequence, Kortschak et al. (1998) isolated a HeLa cell cDNA encoding DRIL1. Overall, the predicted protein is 79% identical to mouse Bright. The DNA-binding domain of DRIL1 is highly conserved, sharing 97% and 79% identity with the DNA-binding domain of Bright and DRI, respectively. Northern and dot blot analyses revealed that DRIL1 was expressed as a 4.4-kb mRNA in all tissues tested. The DRIL1 gene contains 8 exons. Kortschak et al. (1998) mapped the DRIL1 gene to 19p13.3 by fluorescence in situ hybridization and by analysis of cosmids from this region.

Full details of the abovementioned studies are described in the following publications, the disclosure of which are hereby incorporated by reference:

Herrscher, R. F.; Kaplan, M. H.; Lelsz, D. L.; Das, C.; Scheuermann, R.; Tucker, P. W.: The immunoglobulin heavy-chain matrix-associating regions are bound by Bright: a B cell-specific trans-activator that describes a new DNA-binding protein family. Genes Dev. 9:3067-3082, 1995; and Kortschak, R. D.; Reimann, H.; Zimmer, M.; Eyre, H. J.; Saint, R.; Jenne, D. E.: The human dead ringer/bright homolog, DRIL1: cDNA cloning, gene structure, and mapping to D19S886, a ma.

Further studies establishing the function and utilities of DRIL1 are found in John Hopkins OMIM database record ID 603265, and in sited publications numbered 6329-6330 listed in the bibliography section hereinbelow, which are also hereby incorporated by reference. Isoprenylcysteine Carboxyl Methyltransferase (ICMT, Accession NM_012405) is another VGAM730 host target gene. ICMT BINDING SITE is HOST TARGET binding site found in the 3' untranslated region of mRNA encoded by ICMT, corresponding to a HOST TARGET binding site such as BINDING SITE I, BINDING SITE II or BINDING SITE III. Table 2 illustrates the complementarity of the nucleotide sequences of ICMT BINDING SITE, designated SEQ ID:14780, to the nucleotide sequence of VGAM730 RNA, herein designated VGAM RNA, also designated SEQ ID:3441.

Another function of VGAM730 is therefore inhibition of Isoprenylcysteine Carboxyl Methyltransferase (ICMT, Accession NM_012405). Accordingly, utilities of VGAM730 include diagnosis, prevention and treatment of diseases and clinical conditions associated with ICMT. Ubiquitin-conjugating Enzyme E2L 3 (UBE2L3, Accession NM_003347) is another VGAM730 host target gene. UBE2L3 BINDING SITE is HOST TARGET binding site found in the 3' untranslated region of mRNA encoded by UBE2L3, corresponding to a HOST TARGET binding site such as BINDING SITE I, BINDING SITE II or BINDING SITE III. Table 2 illustrates the complementarity of the nucleotide sequences of UBE2L3 BINDING SITE, designated SEQ ID:9356, to the nucleotide sequence of VGAM730 RNA, herein designated VGAM RNA, also designated SEQ ID:3441.

Another function of VGAM730 is therefore inhibition of Ubiquitin-conjugating Enzyme E2L 3 (UBE2L3, Accession NM_003347), a gene which catalyzes the covalent attachment of ubiquitin to other proteins. Accordingly, utilities of VGAM730 include diagnosis, prevention and treatment of diseases and clinical conditions associated with UBE2L3. The function of UBE2L3 and its association with various diseases and clinical conditions, has been established by previous studies, as described hereinabove with reference to VGAM215. KIAA0329 (Accession NM_014844) is another VGAM730 host target gene. KIAA0329 BINDING SITE is HOST TARGET binding site found in the 3' untranslated region of mRNA encoded by KIAA0329, corresponding to a HOST TARGET binding site such as BINDING SITE I, BINDING SITE II or BINDING SITE III. Table 2 illustrates the complementarity of the nucleotide sequences of KIAA0329 BINDING SITE, designated SEQ ID:16872, to the nucleotide sequence of VGAM730 RNA, herein designated VGAM RNA, also designated SEQ ID:3441.

Another function of VGAM730 is therefore inhibition of KIAA0329 (Accession NM_014844). Accordingly, utilities of VGAM730 include diagnosis, prevention and treatment of diseases and clinical conditions associated with KIAA0329. KIAA1554 (Accession XM_170834) is another VGAM730 host target gene. KIAA1554 BINDING SITE is HOST TARGET binding site found in the 3' untranslated region of mRNA encoded by KIAA1554, corresponding to a HOST TARGET binding site such as BINDING SITE I, BINDING SITE II or BINDING SITE III. Table 2 illustrates the complementarity of the nucleotide sequences of KIAA1554 BINDING SITE, designated SEQ ID:45607, to the nucleotide sequence of VGAM730 RNA, herein designated VGAM RNA, also designated SEQ ID:3441.

Another function of VGAM730 is therefore inhibition of KIAA1554 (Accession XM_170834). Accordingly, utilities of VGAM730 include diagnosis, prevention and treatment of diseases and clinical conditions associated with KIAA1554. PR Domain Containing 7 (PRDM7, Accession NM_052996) is another VGAM730 host target gene. PRDM7 BINDING SITE is HOST TARGET binding site found in the 3' untranslated region of mRNA encoded by PRDM7, corresponding to a HOST TARGET binding site such as BINDING SITE I, BINDING SITE II or BINDING SITE III. Table 2 illustrates the complementarity of the nucleotide sequences of PRDM7 BINDING SITE, designated SEQ ID:27566, to the nucleotide sequence of VGAM730 RNA, herein designated VGAM RNA, also designated SEQ ID:3441.

Another function of VGAM730 is therefore inhibition of PR Domain Containing 7 (PRDM7, Accession NM_052996). Accordingly, utilities of VGAM730 include diagnosis, prevention and treatment of diseases and clinical conditions associated with PRDM7. PR Domain Containing 9 (PRDM9, Accession NM_020227) is another VGAM730 host target gene. PRDM9 BINDING SITE is HOST TARGET binding site found in the 3' untranslated region of mRNA encoded by PRDM9, corresponding to a HOST TARGET binding site such as BINDING SITE I, BINDING SITE II or BINDING SITE III. Table 2 illustrates the complementarity of the nucleotide sequences of PRDM9 BINDING SITE, designated SEQ ID:21493, to the nucleotide sequence of VGAM730 RNA, herein designated VGAM RNA, also designated SEQ ID:3441.

Another function of VGAM730 is therefore inhibition of PR Domain Containing 9 (PRDM9, Accession NM_020227). Accordingly, utilities of VGAM730 include diagnosis, prevention and treatment of diseases and clinical conditions associated with PRDM9. RAB40C, Member RAS Oncogene Family (RAB40C, Accession NM_021168) is another VGAM730 host target gene. RAB40C BINDING SITE is HOST TARGET binding site found in the 3' untranslated region of mRNA encoded by RAB40C, corresponding to a HOST TARGET binding site such as BINDING SITE I, BINDING SITE II or BINDING SITE III. Table 2 illustrates the complementarity of the nucleotide sequences of RAB40C BINDING SITE, designated SEQ ID:22144, to the nucleotide sequence of VGAM730 RNA, herein designated VGAM RNA, also designated SEQ ID:3441.

Another function of VGAM730 is therefore inhibition of RAB40C, Member RAS Oncogene Family (RAB40C, Accession NM_021168). Accordingly, utilities of VGAM730 include diagnosis, prevention and treatment of diseases and clinical conditions associated with RAB40C. SEC8 (Accession NM_021807) is another VGAM730 host target gene. SEC8 BINDING SITE is HOST TARGET binding site found in the 3' untranslated region of mRNA encoded by SEC8, corresponding to a HOST TARGET binding site such as BINDING SITE I, BINDING SITE II or BINDING SITE III. Table 2 illustrates the complementarity of the nucleotide sequences of SEC8 BINDING SITE, designated SEQ ID:22359, to the nucleotide sequence of VGAM730 RNA, herein designated VGAM RNA, also designated SEQ ID:3441.

Another function of VGAM730 is therefore inhibition of SEC8 (Accession NM_021807). Accordingly, utilities of VGAM730 include diagnosis, prevention and treatment of diseases and clinical conditions associated with SEC8. Transmembrane Protease, Serine 5 (spinesin) (TMPRSS5, Accession NM_030770) is another VGAM730 host target gene. TMPRSS5 BINDING SITE is HOST TARGET binding site found in the 3' untranslated region of mRNA encoded by TMPRSS5, corresponding to a HOST TARGET binding site such as BINDING SITE I, BINDING SITE II or BINDING SITE III. Table 2 illustrates the complementarity of the nucleotide sequences of TMPRSS5 BINDING SITE, designated SEQ ID:25054, to the nucleotide sequence of VGAM730 RNA, herein designated VGAM RNA, also designated SEQ ID:3441.

Another function of VGAM730 is therefore inhibition of Transmembrane Protease, Serine 5 (spinesin) (TMPRSS5, Accession NM_030770). Accordingly, utilities of VGAM730 include diagnosis, prevention and treatment of diseases and clinical conditions associated with TMPRSS5. LOC149319 (Accession XM_086495) is another VGAM730 host target gene. LOC149319 BINDING SITE is HOST TARGET binding site found in the 5' untranslated region of mRNA encoded by LOC149319, corresponding to a HOST TARGET binding site such as BINDING SITE I, BINDING SITE II or BINDING SITE III. Table 2 illustrates the complementarity of the nucleotide sequences of LOC149319 BINDING SITE, designated SEQ ID:38712, to the nucleotide sequence of VGAM730 RNA, herein designated VGAM RNA, also designated SEQ ID:3441.

Another function of VGAM730 is therefore inhibition of LOC149319 (Accession XM_086495). Accordingly, utilities of VGAM730 include diagnosis, prevention and treatment of diseases and clinical conditions associated with LOC149319. LOC254423 (Accession XM_173286) is another VGAM730 host target gene. LOC254423 BINDING SITE is HOST TARGET binding site found in the 5' untranslated region of mRNA encoded by LOC254423, corresponding to a HOST TARGET binding site such as BINDING SITE I, BINDING SITE II or BINDING SITE III. Table 2 illustrates the complementarity of the nucleotide sequences of LOC254423 BINDING SITE, designated SEQ ID:46528, to the nucleotide sequence of VGAM730 RNA, herein designated VGAM RNA, also designated SEQ ID:3441.

Another function of VGAM730 is therefore inhibition of LOC254423 (Accession XM_173286). Accordingly, utilities of VGAM730 include diagnosis, prevention and treatment of diseases and clinical conditions associated with LOC254423. LOC89919 (Accession XM_027244) is another VGAM730 host target gene. LOC89919 BINDING SITE is HOST TARGET binding site found in the 5' untranslated region of mRNA encoded by LOC89919, corresponding to a HOST TARGET binding site such as BINDING SITE I, BINDING SITE II or BINDING SITE III. Table 2 illustrates the complementarity of the nucleotide sequences of LOC89919 BINDING SITE, designated SEQ ID:30461, to the nucleotide sequence of VGAM730 RNA, herein designated VGAM RNA, also designated SEQ ID:3441.

Another function of VGAM730 is therefore inhibition of LOC89919 (Accession XM_027244). Accordingly, utilities of VGAM730 include diagnosis, prevention and treatment of diseases and clinical conditions associated with LOC89919. LOC91812 (Accession XM_040857) is another VGAM730 host target gene. LOC91812 BINDING SITE is HOST TARGET binding site found in the 5' untranslated region of mRNA encoded by LOC91812, corresponding to a HOST TARGET binding site such as BINDING SITE I, BINDING SITE II or BINDING SITE III. Table 2 illustrates the complementarity of the nucleotide sequences of LOC91812 BINDING SITE, designated SEQ ID:33389, to the nucleotide sequence of VGAM730 RNA, herein designated VGAM RNA, also designated SEQ ID:3441.

Another function of VGAM730 is therefore inhibition of LOC91812 (Accession XM_040857). Accordingly, utilities of VGAM730 include diagnosis, prevention and treatment of diseases and clinical conditions associated with LOC91812. LOC91813 (Accession XM_040862) is another VGAM730 host target gene. LOC91813 BINDING SITE is HOST TARGET binding site found in the 5' untranslated region of mRNA encoded by LOC91813, corresponding to a HOST TARGET binding site such as BINDING SITE I, BINDING SITE II or BINDING SITE III. Table 2 illustrates the complementarity of the nucleotide sequences of LOC91813 BINDING SITE, designated SEQ ID:33393, to the nucleotide sequence of VGAM730 RNA, herein designated VGAM RNA, also designated SEQ ID:3441.

Another function of VGAM730 is therefore inhibition of LOC91813 (Accession XM_040862). Accordingly, utilities of VGAM730 include diagnosis, prevention and treatment of diseases and clinical conditions associated with LOC91813. FIG. 1 further provides a conceptual description of a novel bioinformatically detected viral gene of the present invention, referred to here as Viral Genomic Address Messenger 731 (VGAM731) viral gene, which modulates expression of respective host target genes thereof, the function and utility of which host target genes is known in the art.

VGAM731 is a novel bioinformatically detected regulatory, non protein coding, viral micro RNA (miRNA) gene. The method by which VGAM731 was detected is described hereinabove with reference to FIGS. 1-8.

VGAM731 gene, herein designated VGAM GENE, is a viral gene contained in the genome of Cydia Pomonella Granulovirus. VGAM731 host target gene, herein designated VGAM HOST TARGET GENE, is a human gene contained in the human genome.

VGAM731 gene encodes a VGAM731 precursor RNA, herein designated VGAM PRECURSOR RNA. Similar to other miRNA genes, and unlike most ordinary genes, VGAM731 precursor RNA does not encode a protein. A nucleotide sequence identical or highly similar to the nucleotide sequence of VGAM731 precursor RNA is designated SEQ ID:717, and is provided hereinbelow with reference to the sequence listing part. Nucleotide sequence SEQ ID:717 is located at position 71312 relative to the genome of Cydia Pomonella Granulovirus.

VGAM731 precursor RNA folds onto itself, forming VGAM731 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM731 folded precursor RNA into VGAM731 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM731 RNA is designated SEQ ID:3442, and is provided hereinbelow with reference to the sequence listing part.

VGAM731 host target gene, herein designated VGAM HOST TARGET GENE, encodes a corresponding messenger RNA, VGAM731 host target RNA, herein designated VGAM HOST TARGET RNA. VGAM731 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM731 RNA, herein designated VGAM RNA, binds complementarily to one or more host target binding sites located in untranslated regions of VGAM731 host target RNA, herein designated VGAM HOST TARGET RNA. This complementary binding is due to the fact that the nucleotide sequence of VGAM731 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM731 RNA, herein designated VGAM RNA, may have a different number of host target binding sites in untranslated regions of a VGAM731 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM731 RNA, herein designated VGAM RNA, to host target binding sites on VGAM731 host target RNA, herein designated VGAM HOST TARGET RNA, such as BINDING SITE I, BINDING SITE II and BINDING SITE III, inhibits translation of VGAM731 host target RNA into VGAM731 host target protein, herein designated VGAM HOST TARGET PROTEIN. VGAM host target protein is therefore outlined by a broken line.

It is appreciated that VGAM731 host target gene, herein designated VGAM HOST TARGET GENE, in fact represents a plurality of VGAM731 host target genes. The mRNA of each one of this plurality of VGAM731 host target genes comprises one or more host target binding sites, each having a nucleotide sequence which is at least partly complementary to VGAM731 RNA, herein designated VGAM RNA, and which when bound by VGAM731 RNA causes inhibition of translation of respective one or more VGAM731 host target proteins.

It is further appreciated by one skilled in the art that the mode of translational inhibition illustrated by FIG. 1 with specific reference to translational inhibition exerted by VGAM731 gene, herein designated VGAM GENE, on one or more VGAM731 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM731 is inhibition of expression of host target genes, as part of a novel viral mechanism of attacking a host. Accordingly, utilities of VGAM731 include diagnosis, prevention and treatment of viral infection by Cydia Pomonella Granulovirus. Specific functions, and accordingly utilities, of VGAM731 correlate with, and may be deduced from, the identity of the host target genes which VGAM731 binds and inhibits, and the function of these host target genes, as elaborated hereinbelow.

Nucleotide sequences of the VGAM731 precursor RNA, herein designated VGAM PRECURSOR RNA, and of the 'diced' VGAM731 RNA, herein designated VGAM RNA, and a schematic representation of the secondary folding of VGAM731 folded precursor RNA, herein designated VGAM FOLDED PRECURSOR RNA, of VGAM731 are further described hereinbelow with reference to Table 1.

Nucleotide sequences of host target binding sites, such as BINDING SITE-I, BINDING SITE-II and BINDING SITE-III of FIG. 1, found on VGAM731 host target RNA, and schematic representation of the complementarity of each of these host target binding sites to VGAM731 RNA, herein designated VGAM RNA, are described hereinbelow with reference to Table 2.

As mentioned hereinabove with reference to FIG. 1, a function of VGAM731 gene, herein designated VGAM is inhibition of expression of VGAM731 target genes. It is appreciated that specific functions, and accordingly utilities, of VGAM731 correlate with, and may be deduced from, the identity of the target genes which VGAM731 binds and inhibits, and the function of these target genes, as elaborated hereinbelow.

Component of Oligomeric Golgi Complex 7 (COG7, Accession XM_041725) is a VGAM731 host target gene. COG7 BINDING SITE is HOST TARGET binding site found in the 3' untranslated region of mRNA encoded by COG7, corresponding to a HOST TARGET binding site such as BINDING SITE I, BINDING SITE II or BINDING SITE III. Table 2 illustrates the complementarity of the nucleotide sequences of COG7 BINDING SITE, designated SEQ ID:33577, to the nucleotide sequence of VGAM731 RNA, herein designated VGAM RNA, also designated SEQ ID:3442.

A function of VGAM731 is therefore inhibition of Component of Oligomeric Golgi Complex 7 (COG7, Accession XM_041725). Accordingly, utilities of VGAM731 include diagnosis, prevention and treatment of diseases and clinical conditions associated with COG7. FLJ13710 (Accession NM_024817) is another VGAM731 host target gene. FLJ13710 BINDING SITE is HOST TARGET binding site found in the 3' untranslated region of mRNA encoded by FLJ13710, corresponding to a HOST TARGET binding site such as BINDING SITE I, BINDING SITE II or BINDING SITE III. Table 2 illustrates the complementarity of the nucleotide sequences of FLJ13710 BINDING SITE, designated SEQ ID:24208, to the nucleotide sequence of VGAM731 RNA, herein designated VGAM RNA, also designated SEQ ID:3442.

Another function of VGAM731 is therefore inhibition of FLJ13710 (Accession NM_024817). Accordingly, utilities of VGAM731 include diagnosis, prevention and treatment of diseases and clinical conditions associated with FLJ13710. KIAA1486 (Accession XM_041126) is another VGAM731 host target gene. KIAA1486 BINDING SITE is HOST TARGET binding site found in the 3' untranslated region of mRNA encoded by KIAA1486, corresponding to a HOST TARGET binding site such as BINDING SITE I, BINDING SITE II or BINDING SITE III. Table 2 illustrates the complementarity of the nucleotide sequences of KIAA1486 BINDING SITE, designated SEQ ID:33461, to the nucleotide sequence of VGAM731 RNA, herein designated VGAM RNA, also designated SEQ ID:3442.

Another function of VGAM731 is therefore inhibition of KIAA1486 (Accession XM_041126). Accordingly, utilities of VGAM731 include diagnosis, prevention and treatment of diseases and clinical conditions associated with KIAA1486. KIAA1954 (Accession XM_085375) is another VGAM731 host target gene. KIAA1954 BINDING SITE is HOST TARGET binding site found in the 3' untranslated region of mRNA encoded by KIAA1954, corresponding to a HOST TARGET binding site such as BINDING SITE I, BINDING SITE II or BINDING SITE III. Table 2 illustrates the complementarity of the nucleotide sequences of KIAA1954 BINDING SITE, designated SEQ ID:38095, to the nucleotide sequence of VGAM731 RNA, herein designated VGAM RNA, also designated SEQ ID:3442.

Another function of VGAM731 is therefore inhibition of KIAA1954 (Accession XM_085375). Accordingly, utilities of VGAM731 include diagnosis, prevention and treatment of diseases and clinical conditions associated with KIAA1954. MGC2541 (Accession NM_080670) is another VGAM731 host target gene. MGC2541 BINDING SITE is HOST TARGET binding site found in the 3' untranslated region of mRNA encoded by MGC2541, corresponding to a HOST TARGET binding site such as BINDING SITE I, BINDING SITE II or BINDING SITE III. Table 2 illustrates the complementarity of the nucleotide sequences of MGC2541 BINDING SITE, designated SEQ ID:27962, to the nucleotide sequence of VGAM731 RNA, herein designated VGAM RNA, also designated SEQ ID:3442.

Another function of VGAM731 is therefore inhibition of MGC2541 (Accession NM_080670). Accordingly, utilities of VGAM731 include diagnosis, prevention and treatment of diseases and clinical conditions associated with MGC2541. Sep.in 3 (SEPT3, Accession NM_019106) is another VGAM731 host target gene. SEPT3 BINDING SITE is HOST TARGET binding site found in the 3' untranslated region of mRNA encoded by SEPT3, corresponding to a HOST TARGET binding site such as BINDING SITE I, BINDING SITE II or BINDING SITE III. Table 2 illustrates the complementarity of the nucleotide sequences of SEPT3 BINDING SITE, designated SEQ ID:21180, to the nucleotide sequence of VGAM731 RNA, herein designated VGAM RNA, also designated SEQ ID:3442.

Another function of VGAM731 is therefore inhibition of Sep.in 3 (SEPT3, Accession NM_019106). Accordingly, utilities of VGAM731 include diagnosis, prevention and treatment of diseases and clinical conditions associated with SEPT3. LOC146958 (Accession XM_097142) is another VGAM731 host target gene. LOC146958 BINDING SITE is HOST TARGET binding site found in the 5' untranslated region of mRNA encoded by LOC146958, corresponding to a HOST TARGET binding site such as BINDING SITE I, BINDING SITE II or BINDING SITE III. Table 2 illustrates the complementarity of the nucleotide sequences of LOC146958 BINDING SITE, designated SEQ ID:40775, to the nucleotide sequence of VGAM731 RNA, herein designated VGAM RNA, also designated SEQ ID:3442.

Another function of VGAM731 is therefore inhibition of LOC146958 (Accession XM_097142). Accordingly, utilities of VGAM731 include diagnosis, prevention and treatment of diseases and clinical conditions associated with LOC146958. FIG. 1 further provides a conceptual description of a novel bioinformatically detected viral gene of the present invention, referred to here as Viral Genomic Address Messenger 732 (VGAM732) viral gene, which modulates expression of respective host target genes thereof, the function and utility of which host target genes is known in the art.

VGAM732 is a novel bioinformatically detected regulatory, non protein coding, viral micro RNA (miRNA) gene. The method by which VGAM732 was detected is described hereinabove with reference to FIGS. 1-8.

VGAM732 gene, herein designated VGAM GENE, is a viral gene contained in the genome of Cydia Pomonella Granulovirus. VGAM732 host target gene, herein designated VGAM HOST TARGET GENE, is a human gene contained in the human genome.

VGAM732 gene encodes a VGAM732 precursor RNA, herein designated VGAM PRECURSOR RNA. Similar to other miRNA genes, and unlike most ordinary genes, VGAM732 precursor RNA does not encode a protein. A nucleotide sequence identical or highly similar to the nucleotide sequence of VGAM732 precursor RNA is designated SEQ ID:718, and is provided hereinbelow with reference to the sequence listing part. Nucleotide sequence SEQ ID:718 is located at position 73500 relative to the genome of Cydia Pomonella Granulovirus.

VGAM732 precursor RNA folds onto itself, forming VGAM732 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM732 folded precursor RNA into VGAM732 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM732 RNA is designated SEQ ID:3443, and is provided hereinbelow with reference to the sequence listing part.

VGAM732 host target gene, herein designated VGAM HOST TARGET GENE, encodes a corresponding messenger RNA, VGAM732 host target RNA, herein designated VGAM HOST TARGET RNA. VGAM732 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM732 RNA, herein designated VGAM RNA, binds complementarily to one or more host target binding sites located in untranslated regions of VGAM732 host target RNA, herein designated VGAM HOST TARGET RNA. This complementary binding is due to the fact that the nucleotide sequence of VGAM732 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM732 RNA, herein designated VGAM RNA, may have a different number of host target binding sites in untranslated regions of a VGAM732 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM732 RNA, herein designated VGAM RNA, to host target binding sites on VGAM732 host target RNA, herein designated VGAM HOST TARGET RNA, such as BINDING SITE I, BINDING SITE II and BINDING SITE III, inhibits translation of VGAM732 host target RNA into VGAM732 host target protein, herein designated VGAM HOST TARGET PROTEIN. VGAM host target protein is therefore outlined by a broken line.

It is appreciated that VGAM732 host target gene, herein designated VGAM HOST TARGET GENE, in fact represents a plurality of VGAM732 host target genes. The mRNA of each one of this plurality of VGAM732 host target genes comprises one or more host target binding sites, each having a nucleotide sequence which is at least partly complementary to VGAM732 RNA, herein designated VGAM RNA, and which when bound by VGAM732 RNA causes inhibition of translation of respective one or more VGAM732 host target proteins.

It is further appreciated by one skilled in the art that the mode of translational inhibition illustrated by FIG. 1 with specific reference to translational inhibition exerted by VGAM732 gene, herein designated VGAM GENE, on one or more VGAM732 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM732 is inhibition of expression of host target genes, as part of a novel viral mechanism of attacking a host. Accordingly, utilities of VGAM732 include diagnosis, prevention and treatment of viral infection by Cydia Pomonella Granulovirus. Specific functions, and accordingly utilities, of VGAM732 correlate with, and may be deduced from, the identity of the host target genes which VGAM732 binds and inhibits, and the function of these host target genes, as elaborated hereinbelow.

Nucleotide sequences of the VGAM732 precursor RNA, herein designated VGAM PRECURSOR RNA, and of the 'diced' VGAM732 RNA, herein designated VGAM RNA, and a schematic representation of the secondary folding of VGAM732 folded precursor RNA, herein designated VGAM FOLDED PRECURSOR RNA, of VGAM732 are further described hereinbelow with reference to Table 1.

Nucleotide sequences of host target binding sites, such as BINDING SITE-I, BINDING SITE-II and BINDING SITE-III of FIG. 1, found on VGAM732 host target RNA, and schematic representation of the complementarity of each of these host target binding sites to VGAM732 RNA, herein designated VGAM RNA, are described hereinbelow with reference to Table 2.

As mentioned hereinabove with reference to FIG. 1, a function of VGAM732 gene, herein designated VGAM is inhibition of expression of VGAM732 target genes. It is appreciated that specific functions, and accordingly utilities, of VGAM732 correlate with, and may be deduced from, the identity of the target genes which VGAM732 binds and inhibits, and the function of these target genes, as elaborated hereinbelow.

RP42 (Accession NM_020640) is a VGAM732 host target gene. RP42 BINDING SITE is HOST TARGET binding site found in the 3' untranslated region of mRNA encoded by RP42, corresponding to a HOST TARGET binding site such as BINDING SITE I, BINDING SITE II or BINDING SITE III. Table 2 illustrates the complementarity of the nucleotide sequences of RP42 BINDING SITE, designated SEQ ID:21800, to the nucleotide sequence of VGAM732 RNA, herein designated VGAM RNA, also designated SEQ ID:3443.

A function of VGAM732 is therefore inhibition of RP42 (Accession NM_020640), a gene which not clear yet. Accordingly, utilities of VGAM732 include diagnosis, prevention and treatment of diseases and clinical conditions associated with RP42. The function of RP42 and its association with various diseases and clinical conditions, has been established by previous studies, as described hereinabove with reference to VGAM47. Retinoschisis (X-linked, juvenile) 1 (RS1, Accession NM_000330) is another VGAM732 host target gene. RS1 BINDING SITE is HOST TARGET binding site found in the 3' untranslated region of mRNA encoded by RS1, corresponding to a HOST TARGET binding site such as BINDING SITE I, BINDING SITE II or BINDING SITE III. Table 2 illustrates the complementarity of the nucleotide sequences of RS1 BINDING SITE, designated SEQ ID:5876, to the nucleotide sequence of VGAM732 RNA, herein designated VGAM RNA, also designated SEQ ID:3443.

Another function of VGAM732 is therefore inhibition of Retinoschisis (X-linked, juvenile) 1 (RS1, Accession NM_000330). Accordingly, utilities of VGAM732 include diagnosis, prevention and treatment of diseases and clinical conditions associated with RS1. FLJ22940 (Accession NM_024571) is another VGAM732 host target gene. FLJ22940 BINDING SITE is HOST TARGET binding site found in the 5' untranslated region of mRNA encoded by FLJ22940, corresponding to a HOST TARGET binding site such as BINDING SITE I, BINDING SITE II or BINDING SITE III. Table 2 illustrates the complementarity of the nucleotide sequences of FLJ22940 BINDING SITE, designated SEQ ID:23797, to the nucleotide sequence of VGAM732 RNA, herein designated VGAM RNA, also designated SEQ ID:3443.

Another function of VGAM732 is therefore inhibition of FLJ22940 (Accession NM_024571). Accordingly, utilities of VGAM732 include diagnosis, prevention and treatment of diseases and clinical conditions associated with FLJ22940. Mal, T-cell Differentiation Protein 2 (MAL2, Accession NM_052886) is another VGAM732 host target gene. MAL2 BINDING SITE is HOST TARGET binding site found in the 3' untranslated region of mRNA encoded by MAL2, corresponding to a HOST TARGET binding site such as BINDING SITE I, BINDING SITE II or BINDING SITE III. Table 2 illustrates the complementarity of the nucleotide sequences of MAL2 BINDING SITE, designated SEQ ID:27468, to the nucleotide sequence of VGAM732 RNA, herein designated VGAM RNA, also designated SEQ ID:3443.

Another function of VGAM732 is therefore inhibition of Mal, T-cell Differentiation Protein 2 (MAL2, Accession NM_052886). Accordingly, utilities of VGAM732 include diagnosis, prevention and treatment of diseases and clinical conditions associated with MAL2. TU3A (Accession NM_007177) is another VGAM732 host target gene. TU3A BINDING SITE is HOST TARGET binding site found in the 3' untranslated region of mRNA encoded by TU3A, corresponding to a HOST TARGET binding site such as BINDING SITE I, BINDING SITE II or BINDING SITE III. Table 2 illustrates the complementarity of the nucleotide sequences of TU3A BINDING SITE, designated SEQ ID:14032, to the nucleotide sequence of VGAM732 RNA, herein designated VGAM RNA, also designated SEQ ID:3443.

Another function of VGAM732 is therefore inhibition of TU3A (Accession NM_007177). Accordingly, utilities of VGAM732 include diagnosis, prevention and treatment of diseases and clinical conditions associated with TU3A. FIG. 1 further provides a conceptual description of a novel bioinformatically detected viral gene of the present invention, referred to here as Viral Genomic Address Messenger 733 (VGAM733) viral gene, which modulates expression of respective host target genes thereof, the function and utility of which host target genes is known in the art.

VGAM733 is a novel bioinformatically detected regulatory, non protein coding, viral micro RNA (miRNA) gene. The method by which VGAM733 was detected is described hereinabove with reference to FIGS. 1-8.

VGAM733 gene, herein designated VGAM GENE, is a viral gene contained in the genome of Barley Yellow Mosaic Virus. VGAM733 host target gene, herein designated VGAM HOST TARGET GENE, is a human gene contained in the human genome.

VGAM733 gene encodes a VGAM733 precursor RNA, herein designated VGAM PRECURSOR RNA. Similar to other miRNA genes, and unlike most ordinary genes, VGAM733 precursor RNA does not encode a protein. A nucleotide sequence identical or highly similar to the nucleotide sequence of VGAM733 precursor RNA is designated SEQ ID:719, and is provided hereinbelow with reference to the sequence listing part. Nucleotide sequence SEQ ID:719 is located at position 6830 relative to the genome of Barley Yellow Mosaic Virus.

VGAM733 precursor RNA folds onto itself, forming VGAM733 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM733 folded precursor RNA into VGAM733 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 78%) nucleotide sequence of VGAM733 RNA is designated SEQ ID:3444, and is provided hereinbelow with reference to the sequence listing part.

VGAM733 host target gene, herein designated VGAM HOST TARGET GENE, encodes a corresponding messenger RNA, VGAM733 host target RNA, herein designated VGAM HOST TARGET RNA. VGAM733 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM733 RNA, herein designated VGAM RNA, binds complementarily to one or more host target binding sites located in untranslated regions of VGAM733 host target RNA, herein designated VGAM HOST TARGET RNA. This complementary binding is due to the fact that the nucleotide sequence of VGAM733 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM733 RNA, herein designated VGAM RNA, may have a different number of host target binding sites in untranslated regions of a VGAM733 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM733 RNA, herein designated VGAM RNA, to host target binding sites on VGAM733 host target RNA, herein designated VGAM HOST TARGET RNA, such as BINDING SITE I, BINDING SITE II and BINDING SITE III, inhibits translation of VGAM733 host target RNA into VGAM733 host target protein, herein designated VGAM HOST TARGET PROTEIN. VGAM host target protein is therefore outlined by a broken line.

It is appreciated that VGAM733 host target gene, herein designated VGAM HOST TARGET GENE, in fact represents a plurality of VGAM733 host target genes. The mRNA of each one of this plurality of VGAM733 host target genes comprises one or more host target binding sites, each having a nucleotide sequence which is at least partly complementary to VGAM733 RNA, herein designated VGAM RNA, and which when bound by VGAM733 RNA causes inhibition of translation of respective one or more VGAM733 host target proteins.

It is further appreciated by one skilled in the art that the mode of translational inhibition illustrated by FIG. 1 with specific reference to translational inhibition exerted by VGAM733 gene, herein designated VGAM GENE, on one or more VGAM733 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM733 is inhibition of expression of host target genes, as part of a novel viral mechanism of attacking a host. Accordingly, utilities of VGAM733 include diagnosis, prevention and treatment of viral infection by Barley Yellow Mosaic Virus. Specific functions, and accordingly utilities, of VGAM733 correlate with, and may be deduced from, the identity of the host target genes which VGAM733 binds and inhibits, and the function of these host target genes, as elaborated hereinbelow.

Nucleotide sequences of the VGAM733 precursor RNA, herein designated VGAM PRECURSOR RNA, and of the 'diced' VGAM733 RNA, herein designated VGAM RNA, and a schematic representation of the secondary folding of VGAM733 folded precursor RNA, herein designated VGAM FOLDED PRECURSOR RNA, of VGAM733 are further described hereinbelow with reference to Table 1.

Nucleotide sequences of host target binding sites, such as BINDING SITE-I, BINDING SITE-II and BINDING SITE-III of FIG. 1, found on VGAM733 host target RNA, and schematic representation of the complementarity of each of these host target binding sites to VGAM733 RNA, herein designated VGAM RNA, are described hereinbelow with reference to Table 2.

As mentioned hereinabove with reference to FIG. 1, a function of VGAM733 gene, herein designated VGAM is inhibition of expression of VGAM733 target genes. It is appreciated that specific functions, and accordingly utilities, of VGAM733 correlate with, and may be deduced from, the identity of the target genes which VGAM733 binds and inhibits, and the function of these target genes, as elaborated hereinbelow.

ATP-binding Cassette, Sub-family C (CFTR/MRP), Member 3 (ABCC3, Accession NM_020038) is a VGAM733 host target gene. ABCC3 BINDING SITE1 and ABCC3 BINDING SITE2 are HOST TARGET binding sites found in untranslated regions of mRNA encoded by ABCC3, corresponding to HOST TARGET binding sites such as BINDING SITE I, BINDING SITE II or BINDING SITE III. Table 2 illustrates the complementarity of the nucleotide sequences of ABCC3 BINDING SITE1 and ABCC3 BINDING SITE2, designated SEQ ID:21290 and SEQ ID:21289 respectively, to the nucleotide sequence of VGAM733 RNA, herein designated VGAM RNA, also designated SEQ ID:3444.

A function of VGAM733 is therefore inhibition of ATP-binding Cassette, Sub-family C (CFTR/MRP), Member 3 (ABCC3, Accession NM_020038), a gene which may act as an inducible transporter in the biliary and intestinal excretion of organic anions. Accordingly, utilities of VGAM733 include diagnosis, prevention and treatment of diseases and clinical conditions associated with ABCC3. The function of ABCC3 and its association with various diseases and clinical conditions, has been established by previous studies, as described hereinabove with reference to VGAM505. Parkinson Disease (autosomal recessive, juvenile) 2, Parkin (PARK2, Accession NM_004562) is another VGAM733 host target gene. PARK2 BINDING SITE1 through PARK2 BINDING SITE3 are HOST TARGET binding sites found in untranslated regions of mRNA encoded by PARK2, corresponding to HOST TARGET binding sites such as BINDING SITE I, BINDING SITE II or BINDING SITE III. Table 2 illustrates the complementarity of the nucleotide sequences of PARK2 BINDING SITE1 through PARK2 BINDING SITE3, designated SEQ ID:10905, SEQ ID:15152 and SEQ ID:15159 respectively, to the nucleotide sequence of VGAM733 RNA, herein designated VGAM RNA, also designated SEQ ID:3444.

Another function of VGAM733 is therefore inhibition of Parkinson Disease (autosomal recessive, juvenile) 2, Parkin (PARK2, Accession NM_004562). Accordingly, utilities of VGAM733 include diagnosis, prevention and treatment of diseases and clinical conditions associated with PARK2. Olfactomedin 3 (OLFM3, Accession XM_088951) is another VGAM733 host target gene. OLFM3 BINDING SITE is HOST TARGET binding site found in the 3' untranslated region of mRNA encoded by OLFM3, corresponding to a HOST TARGET binding site such as BINDING SITE I, BINDING SITE II or BINDING SITE III. Table 2 illustrates the complementarity of the nucleotide sequences of OLFM3 BINDING SITE, designated SEQ ID:39961, to the nucleotide sequence of VGAM733 RNA, herein designated VGAM RNA, also designated SEQ ID:3444.

Another function of VGAM733 is therefore inhibition of Olfactomedin 3 (OLFM3, Accession XM_088951). Accordingly, utilities of VGAM733 include diagnosis, prevention and treatment of diseases and clinical conditions associated with OLFM3. FIG. 1 further provides a conceptual description of a novel bioinformatically detected viral gene of the present invention, referred to here as Viral Genomic Address Messenger 734 (VGAM734) viral gene, which modulates expression of respective host target genes thereof, the function and utility of which host target genes is known in the art.

VGAM734 is a novel bioinformatically detected regulatory, non protein coding, viral micro RNA (miRNA) gene. The method by which VGAM734 was detected is described hereinabove with reference to FIGS. 1-8.

VGAM734 gene, herein designated VGAM GENE, is a viral gene contained in the genome of Barley Yellow Mosaic Virus. VGAM734 host target gene, herein designated VGAM HOST TARGET GENE, is a human gene contained in the human genome.

VGAM734 gene encodes a VGAM734 precursor RNA, herein designated VGAM PRECURSOR RNA. Similar to other miRNA genes, and unlike most ordinary genes, VGAM734 precursor RNA does not encode a protein. A nucleotide sequence identical or highly similar to the nucleotide sequence of VGAM734 precursor RNA is designated SEQ ID:720, and is provided hereinbelow with reference to the sequence listing part. Nucleotide sequence SEQ ID:720 is located at position 4284 relative to the genome of Barley Yellow Mosaic Virus.

VGAM734 precursor RNA folds onto itself, forming VGAM734 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM734 folded precursor RNA into VGAM734 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM734 RNA is designated SEQ ID:3445, and is provided hereinbelow with reference to the sequence listing part.

VGAM734 host target gene, herein designated VGAM HOST TARGET GENE, encodes a corresponding messenger RNA, VGAM734 host target RNA, herein designated VGAM HOST TARGET RNA. VGAM734 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM734 RNA, herein designated VGAM RNA, binds complementarily to one or more host target binding sites located in untranslated regions of VGAM734 host target RNA, herein designated VGAM HOST TARGET RNA. This complementary binding is due to the fact that the nucleotide sequence of VGAM734 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM734 RNA, herein designated VGAM RNA, may have a different number of host target binding sites in untranslated regions of a VGAM734 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM734 RNA, herein designated VGAM RNA, to host target binding sites on VGAM734 host target RNA, herein designated VGAM HOST TARGET RNA, such as BINDING SITE I, BINDING SITE II and BINDING SITE III, inhibits translation of VGAM734 host target RNA into VGAM734 host target protein, herein designated VGAM HOST TARGET PROTEIN. VGAM host target protein is therefore outlined by a broken line.

It is appreciated that VGAM734 host target gene, herein designated VGAM HOST TARGET GENE, in fact represents a plurality of VGAM734 host target genes. The mRNA of each one of this plurality of VGAM734 host target genes comprises one or more host target binding sites, each having a nucleotide sequence which is at least partly complementary to VGAM734 RNA, herein designated VGAM RNA, and which when bound by VGAM734 RNA causes inhibition of translation of respective one or more VGAM734 host target proteins.

It is further appreciated by one skilled in the art that the mode of translational inhibition illustrated by FIG. 1 with specific reference to translational inhibition exerted by VGAM734 gene, herein designated VGAM GENE, on one or more VGAM734 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM734 is inhibition of expression of host target genes, as part of a novel viral mechanism of attacking a host. Accordingly, utilities of VGAM734 include diagnosis, prevention and treatment of viral infection by Barley Yellow Mosaic Virus. Specific functions, and accordingly utilities, of VGAM734 correlate with, and may be deduced from, the identity of the host target genes which VGAM734 binds and inhibits, and the function of these host target genes, as elaborated hereinbelow.

Nucleotide sequences of the VGAM734 precursor RNA, herein designated VGAM PRECURSOR RNA, and of the 'diced' VGAM734 RNA, herein designated VGAM RNA, and a schematic representation of the secondary folding of VGAM734 folded precursor RNA, herein designated VGAM FOLDED PRECURSOR RNA, of VGAM734 are further described hereinbelow with reference to Table 1.

Nucleotide sequences of host target binding sites, such as BINDING SITE-I, BINDING SITE-II and BINDING SITE-III of FIG. 1, found on VGAM734 host target RNA, and schematic representation of the complementarity of each of these host target binding sites to VGAM734 RNA, herein designated VGAM RNA, are described hereinbelow with reference to Table 2.

As mentioned hereinabove with reference to FIG. 1, a function of VGAM734 gene, herein designated VGAM is inhibition of expression of VGAM734 target genes. It is appreciated that specific functions, and accordingly utilities, of VGAM734 correlate with, and may be deduced from, the identity of the target genes which VGAM734 binds and inhibits, and the function of these target genes, as elaborated hereinbelow.

APPL (Accession NM_012096) is a VGAM734 host target gene. APPL BINDING SITE is HOST TARGET binding site found in the 3' untranslated region of mRNA encoded by APPL, corresponding to a HOST TARGET binding site such as BINDING SITE I, BINDING SITE II or BINDING SITE III. Table 2 illustrates the complementarity of the nucleotide sequences of APPL BINDING SITE, designated SEQ ID:14399, to the nucleotide sequence of VGAM734 RNA, herein designated VGAM RNA, also designated SEQ ID:3445.

A function of VGAM734 is therefore inhibition of APPL (Accession NM_012096). Accordingly, utilities of VGAM734 include diagnosis, prevention and treatment of diseases and clinical conditions associated with APPL. Protein Phosphatase 3 (formerly 2B), Catalytic Subunit, Beta Isoform (calcineurin A beta) (PPP3CB, Accession NM_021132) is another VGAM734 host target gene. PPP3CB BINDING SITE is HOST TARGET binding site found in the 3' untranslated region of mRNA encoded by PPP3CB, corresponding to a HOST TARGET binding site such as BINDING SITE I, BINDING SITE II or BINDING SITE III. Table 2 illustrates the complementarity of the nucleotide sequences of PPP3CB BINDING SITE, designated SEQ ID:22104, to the nucleotide sequence of VGAM734 RNA, herein designated VGAM RNA, also designated SEQ ID:3445.

Another function of VGAM734 is therefore inhibition of Protein Phosphatase 3 (formerly 2B), Catalytic Subunit, Beta Isoform (calcineurin A beta) (PPP3CB, Accession NM_021132), a gene which is the catalytic subunit of calmodulin-stimulated protein phosphatase 3. Accordingly, utilities of VGAM734 include diagnosis, prevention and treatment of diseases and clinical conditions associated with PPP3CB. The function of PPP3CB has been established by previous studies. See 114105. Guerini et al. (1989) identified and cloned human cDNA for the Ca (2+)-binding subunit of calcineurin, the brain isozyme of the Ca (2+)/calmodulin-stimulated protein phosphatase. The 2.5-kb cDNA had an open reading frame of 510 bp, a leader sequence of at least 500 bp, and a 1,277-bp 3-prime-noncoding sequence. As was observed with protein levels, mRNA abundance in brain was 20 to 60 times that found in other tissues with the exception of HeLa cells which, like brain, contained abundant calcineurin B mRNA. Animal model experiments lend further support to the function of PPP3CB. In cardiomyocytes, calcineurin signaling has been implicated in the regulation of the hypertrophic response caused by pressure overload or neuroendocrine stimulation. Bueno et al. (2002) evaluated the necessary function of calcineurin as a hypertrophic regulatory factor by disrupting 1 of the 3 genes that encode the catalytic subunit, calcineurin A-beta, in the mouse. Calcineurin A-beta-deficient mice were viable, fertile, and overtly normal into adulthood, but displayed an 80% decrease in calcineurin enzymatic activity in the heart that was associated with a 12% reduction in basal heart size. Deficient mice were dramatically impaired in their ability to mount a productive hypertrophic response induced by pressure overload, angiotensin II (OMIM Ref. No. 300034) infusion, or isoproterenol infusion. Analysis of marker genes associated with the hypertrophic response revealed a partial defect in the molecular program of hypertrophy. Collectively, these data solidified the hypothesis that calcineurin functions as a central regulator of the cardiac hypertrophic growth response in vivo.

It is appreciated that the abovementioned animal model for PPP3CB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Guerini, D.; Krinks, M. H.; Sikela, J. M.; Hahn, W. E.; Klee, C. B.: Isolation and sequence of a cDNA clone for human calcineurin B, the Ca (2+)-binding subunit of the Ca (2+)/calmodulin-stimulated protein phosphatase. DNA 8:675-682, 1989; and Bueno, O. F.; Wilkins, B. J.; Tymitz, K. M.; Glascock, B. J.; Kimball, T. F.; Lorenz, J. N.; Molkentin, J. D.: Impaired cardiac hypertrophic response in calcineurin A-beta-deficient mic.

Further studies establishing the function and utilities of PPP3CB are found in John Hopkins OMIM database record ID 114106, and in sited publications numbered 469 and 4691-4692 listed in the bibliography section hereinbelow, which are also hereby incorporated by reference. ARPP-19 (Accession NM_006628) is another VGAM734 host target gene. ARPP-19 BINDING SITE is HOST TARGET binding site found in the 3' untranslated region of mRNA encoded by ARPP-19, corresponding to a HOST TARGET binding site such as BINDING SITE I, BINDING SITE II or BINDING SITE III. Table 2 illustrates the complementarity of the nucleotide sequences of ARPP-19 BINDING SITE, designated SEQ ID:13423, to the nucleotide sequence of VGAM734 RNA, herein designated VGAM RNA, also designated SEQ ID:3445.

Another function of VGAM734 is therefore inhibition of ARPP-19 (Accession NM_006628). Accordingly, utilities of VGAM734 include diagnosis, prevention and treatment of diseases and clinical conditions associated with ARPP-19. Chromosome 20 Open Reading Frame 26 (C20orf26, Accession XM_046598) is another VGAM734 host target gene. C20orf26 BINDING SITE is HOST TARGET binding site found in the 5" untranslated region of mRNA encoded by C20orf26, corresponding to a HOST TARGET binding site such as BINDING SITE I, BINDING SITE II or BINDING SITE III. Table 2 illustrates the complementarity of the nucleotide sequences of C20orf26 BINDING SITE, designated SEQ ID:34758, to the nucleotide sequence of VGAM734 RNA, herein designated VGAM RNA, also designated SEQ ID:3445.

Another function of VGAM734 is therefore inhibition of Chromosome 20 Open Reading Frame 26 (C20orf26, Accession XM_046598). Accordingly, utilities of VGAM734 include diagnosis, prevention and treatment of diseases and clinical conditions associated with C20orf26. Claudin 1 (CLDN1, Accession NM_021101) is another VGAM734 host target gene. CLDN1 BINDING SITE is HOST TARGET binding site found in the 3' untranslated region of mRNA encoded by CLDN1, corresponding to a HOST TARGET binding site such as BINDING SITE I, BINDING SITE II or BINDING SITE III. Table 2 illustrates the complementarity of the nucleotide sequences of CLDN1 BINDING SITE, designated SEQ ID:22081, to the nucleotide sequence of VGAM734 RNA, herein designated VGAM RNA, also designated SEQ ID:3445.

Another function of VGAM734 is therefore inhibition of Claudin 1 (CLDN1, Accession NM_021101). Accordingly, utilities of VGAM734 include diagnosis, prevention and treatment of diseases and clinical conditions associated with CLDN1. FLJ12697 (Accession XM_166526) is another VGAM734 host target gene. FLJ12697 BINDING SITE is HOST TARGET binding site found in the 3' untranslated region of mRNA encoded by FLJ12697, corresponding to a HOST TARGET binding site such as BINDING SITE I, BINDING SITE II or BINDING SITE III. Table 2 illustrates the complementarity of the nucleotide sequences of FLJ12697 BINDING SITE, designated SEQ ID:44472, to the nucleotide sequence of VGAM734 RNA, herein designated VGAM RNA, also designated SEQ ID:3445.

Another function of VGAM734 is therefore inhibition of FLJ12697 (Accession XM_166526). Accordingly, utilities of VGAM734 include diagnosis, prevention and treatment of diseases and clinical conditions associated with FLJ12697. FLJ14154 (Accession NM_024845) is another VGAM734 host target gene. FLJ14154 BINDING SITE is HOST TARGET binding site found in the 3' untranslated region of mRNA encoded by FLJ14154, corresponding to a HOST TARGET binding site such as BINDING SITE I, BINDING SITE II or BINDING SITE III. Table 2 illustrates the complementarity of the nucleotide sequences of FLJ14154 BINDING SITE, designated SEQ ID:24270, to the nucleotide sequence of VGAM734 RNA, herein designated VGAM RNA, also designated SEQ ID:3445.

Another function of VGAM734 is therefore inhibition of FLJ14154 (Accession NM_024845). Accordingly, utilities of VGAM734 include diagnosis, prevention and treatment of diseases and clinical conditions associated with FLJ14154. ICAP-1A (Accession NM_004763) is another VGAM734 host target gene. ICAP-1A BINDING SITE is HOST TARGET binding site found in the 3' untranslated region of mRNA encoded by ICAP-1A, corresponding to a HOST TARGET binding site such as BINDING SITE I, BINDING SITE II or BINDING SITE III. Table 2 illustrates the complementarity of the nucleotide sequences of ICAP-1A BINDING SITE, designated SEQ ID:11155, to the nucleotide sequence of VGAM734 RNA, herein designated VGAM RNA, also designated SEQ ID:3445.

Another function of VGAM734 is therefore inhibition of ICAP-1A (Accession NM_004763). Accordingly, utilities of VGAM734 include diagnosis, prevention and treatment of diseases and clinical conditions associated with ICAP-1A. KIAA0186 (Accession NM_021067) is another VGAM734 host target gene. KIAA0186 BINDING SITE is HOST TARGET binding site found in the 3' untranslated region of mRNA encoded by KIAA0186, corresponding to a HOST TARGET binding site such as BINDING SITE I, BINDING SITE II or BINDING SITE III. Table 2 illustrates the complementarity of the nucleotide sequences of KIAA0186 BINDING SITE, designated SEQ ID:22037, to the nucleotide sequence of VGAM734 RNA, herein designated VGAM RNA, also designated SEQ ID:3445.

Another function of VGAM734 is therefore inhibition of KIAA0186 (Accession NM_021067). Accordingly, utilities of VGAM734 include diagnosis, prevention and treatment of diseases and clinical conditions associated with KIAA0186. KIAA0527 (Accession XM_171054) is another VGAM734 host target gene. KIAA0527 BINDING SITE is HOST TARGET binding site found in the 3' untranslated region of mRNA encoded by KIAA0527, corresponding to a HOST TARGET binding site such as BINDING SITE I, BINDING SITE II or BINDING SITE III. Table 2 illustrates the complementarity of the nucleotide sequences of KIAA0527 BINDING SITE, designated SEQ ID:45848, to the nucleotide sequence of VGAM734 RNA, herein designated VGAM RNA, also designated SEQ ID:3445.

Another function of VGAM734 is therefore inhibition of KIAA0527 (Accession XM_171054). Accordingly, utilities of VGAM734 include diagnosis, prevention and treatment of diseases and clinical conditions associated with KIAA0527. MGC15438 (Accession NM_032874) is another VGAM734 host target gene. MGC15438 BINDING SITE is HOST TARGET binding site found in the 3' untranslated region of mRNA encoded by MGC15438, corresponding to a HOST TARGET binding site such as BINDING SITE I, BINDING SITE II or BINDING SITE III. Table 2 illustrates the complementarity of the nucleotide sequences of MGC15438 BINDING SITE, designated SEQ ID:26692, to the nucleotide sequence of VGAM734 RNA, herein designated VGAM RNA, also designated SEQ ID:3445.

Another function of VGAM734 is therefore inhibition of MGC15438 (Accession NM_032874). Accordingly, utilities of VGAM734 include diagnosis, prevention and treatment of diseases and clinical conditions associated with MGC15438. poly (A) Polymerase Gamma (PAPOLG, Accession NM_022894) is another VGAM734 host target gene. PAPOLG BINDING SITE is HOST TARGET binding site found in the 3' untranslated region of mRNA encoded by PAPOLG, corresponding to a HOST TARGET binding site such as BINDING SITE I, BINDING SITE II or BINDING SITE III. Table 2 illustrates the complementarity of the nucleotide sequences of PAPOLG BINDING SITE, designated SEQ ID:23155, to the nucleotide sequence of VGAM734 RNA, herein designated VGAM RNA, also designated SEQ ID:3445.

Another function of VGAM734 is therefore inhibition of poly (A) Polymerase Gamma (PAPOLG, Accession NM_022894). Accordingly, utilities of VGAM734 include diagnosis, prevention and treatment of diseases and clinical conditions associated with PAPOLG. LOC161742 (Accession XM_091095) is another VGAM734 host target gene. LOC161742 BINDING SITE is HOST TARGET binding site found in the 3' untranslated region of mRNA encoded by LOC161742, corresponding to a HOST TARGET binding site such as BINDING SITE I, BINDING SITE II or BINDING SITE III. Table 2 illustrates the complementarity of the nucleotide sequences of LOC161742 BINDING SITE, designated SEQ ID:40027, to the nucleotide sequence of VGAM734 RNA, herein designated VGAM RNA, also designated SEQ ID:3445.

Another function of VGAM734 is therefore inhibition of LOC161742 (Accession XM_091095). Accordingly, utilities of VGAM734 include diagnosis, prevention and treatment of diseases and clinical conditions associated with LOC161742. FIG. 1 further provides a conceptual description of a novel bioinformatically detected viral gene of the present invention, referred to here as Viral Genomic Address Messenger 735 (VGAM735) viral gene, which modulates expression of respective host target genes thereof, the function and utility of which host target genes is known in the art.

VGAM735 is a novel bioinformatically detected regulatory, non protein coding, viral micro RNA (miRNA) gene. The method by which VGAM735 was detected is described hereinabove with reference to FIGS. 1-8.

VGAM735 gene, herein designated VGAM GENE, is a viral gene contained in the genome of Barley Yellow Mosaic Virus. VGAM735 host target gene, herein designated VGAM HOST TARGET GENE, is a human gene contained in the human genome.

VGAM735 gene encodes a VGAM735 precursor RNA, herein designated VGAM PRECURSOR RNA. Similar to other miRNA genes, and unlike most ordinary genes, VGAM735 precursor RNA does not encode a protein. A nucleotide sequence identical or highly similar to the nucleotide sequence of VGAM735 precursor RNA is designated SEQ ID:721, and is provided hereinbelow with reference to the sequence listing part. Nucleotide sequence SEQ ID:721 is located at position 755 relative to the genome of Barley Yellow Mosaic Virus.

VGAM735 precursor RNA folds onto itself, forming VGAM735 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM735 folded precursor RNA into VGAM735 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM735 RNA is designated SEQ ID:3446, and is provided hereinbelow with reference to the sequence listing part.

VGAM735 host target gene, herein designated VGAM HOST TARGET GENE, encodes a corresponding messenger RNA, VGAM735 host target RNA, herein designated VGAM HOST TARGET RNA. VGAM735 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM735 RNA, herein designated VGAM RNA, binds complementarily to one or more host target binding sites located in untranslated regions of VGAM735 host target RNA, herein designated VGAM HOST TARGET RNA. This complementary binding is due to the fact that the nucleotide sequence of VGAM735 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM735 RNA, herein designated VGAM RNA, may have a different number of host target binding sites in untranslated regions of a VGAM735 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM735 RNA, herein designated VGAM RNA, to host target binding sites on VGAM735 host target RNA, herein designated VGAM HOST TARGET RNA, such as BINDING SITE I, BINDING SITE II and BINDING SITE III, inhibits translation of VGAM735 host target RNA into VGAM735 host target protein, herein designated VGAM HOST TARGET PROTEIN. VGAM host target protein is therefore outlined by a broken line.

It is appreciated that VGAM735 host target gene, herein designated VGAM HOST TARGET GENE, in fact represents a plurality of VGAM735 host target genes. The mRNA of each one of this plurality of VGAM735 host target genes comprises one or more host target binding sites, each having a nucleotide sequence which is at least partly complementary to VGAM735 RNA, herein designated VGAM RNA, and which when bound by VGAM735 RNA causes inhibition of translation of respective one or more VGAM735 host target proteins.

It is further appreciated by one skilled in the art that the mode of translational inhibition illustrated by FIG. 1 with specific reference to translational inhibition exerted by VGAM735 gene, herein designated VGAM GENE, on one or more VGAM735 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM735 is inhibition of expression of host target genes, as part of a novel viral mechanism of attacking a host. Accordingly, utilities of VGAM735 include diagnosis, prevention and treatment of viral infection by Barley Yellow Mosaic Virus. Specific functions, and accordingly utilities, of VGAM735 correlate with, and may be deduced from, the identity of the host target genes which VGAM735 binds and inhibits, and the function of these host target genes, as elaborated hereinbelow.

Nucleotide sequences of the VGAM735 precursor RNA, herein designated VGAM PRECURSOR RNA, and of the 'diced' VGAM735 RNA, herein designated VGAM RNA, and a schematic representation of the secondary folding of VGAM735 folded precursor RNA, herein designated VGAM FOLDED PRECURSOR RNA, of VGAM735 are further described hereinbelow with reference to Table 1.

Nucleotide sequences of host target binding sites, such as BINDING SITE-I, BINDING SITE-II and BINDING SITE-III of FIG. 1, found on VGAM735 host target RNA, and schematic representation of the complementarity of each of these host target binding sites to VGAM735 RNA, herein designated VGAM RNA, are described hereinbelow with reference to Table 2.

As mentioned hereinabove with reference to FIG. 1, a function of VGAM735 gene, herein designated VGAM is inhibition of expression of VGAM735 target genes. It is appreciated that specific functions, and accordingly utilities, of VGAM735 correlate with, and may be deduced from, the identity of the target genes which VGAM735 binds and inhibits, and the function of these target genes, as elaborated hereinbelow.

SH2 Domain Containing Phosphatase Anchor Protein 1 (SPAP1, Accession NM_030764) is a VGAM735 host target gene. SPAP1 BINDING SITE is HOST TARGET binding site found in the 3' untranslated region of mRNA encoded by SPAP1, corresponding to a HOST TARGET binding site such as BINDING SITE I, BINDING SITE II or BINDING SITE III. Table 2 illustrates the complementarity of the nucleotide sequences of SPAP1 BINDING SITE, designated SEQ ID:25047, to the nucleotide sequence of VGAM735 RNA, herein designated VGAM RNA, also designated SEQ ID:3446.

A function of VGAM735 is therefore inhibition of SH2 Domain Containing Phosphatase Anchor Protein 1 (SPAP1, Accession NM_030764), a gene which regulation of immunologic function. Accordingly, utilities of VGAM735 include diagnosis, prevention and treatment of diseases and clinical conditions associated with SPAP1. The function of SPAP1 and its association with various diseases and clinical conditions, has been established by previous studies, as described hereinabove with reference to VGAM672. FIG. 1 further provides a conceptual description of a novel bioinformatically detected viral gene of the present invention, referred to here as Viral Genomic Address Messenger 736 (VGAM736) viral gene, which modulates expression of respective host target genes thereof, the function and utility of which host target genes is known in the art.

VGAM736 is a novel bioinformatically detected regulatory, non protein coding, viral micro RNA (miRNA) gene. The method by which VGAM736 was detected is described hereinabove with reference to FIGS. 1-8.

VGAM736 gene, herein designated VGAM GENE, is a viral gene contained in the genome of Barley Yellow Mosaic Virus. VGAM736 host target gene, herein designated VGAM HOST TARGET GENE, is a human gene contained in the human genome.

VGAM736 gene encodes a VGAM736 precursor RNA, herein designated VGAM PRECURSOR RNA. Similar to other miRNA genes, and unlike most ordinary genes, VGAM736 precursor RNA does not encode a protein. A nucleotide sequence identical or highly similar to the nucleotide sequence of VGAM736 precursor RNA is designated SEQ ID:722, and is provided hereinbelow with reference to the sequence listing part. Nucleotide sequence SEQ ID:722 is located at position 3609 relative to the genome of Barley Yellow Mosaic Virus.

VGAM736 precursor RNA folds onto itself, forming VGAM736 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM736 folded precursor RNA into VGAM736 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM736 RNA is designated SEQ ID:3447, and is provided hereinbelow with reference to the sequence listing part.

VGAM736 host target gene, herein designated VGAM HOST TARGET GENE, encodes a corresponding messenger RNA, VGAM736 host target RNA, herein designated VGAM HOST TARGET RNA. VGAM736 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM736 RNA, herein designated VGAM RNA, binds complementarily to one or more host target binding sites located in untranslated regions of VGAM736 host target RNA, herein designated VGAM HOST TARGET RNA. This complementary binding is due to the fact that the nucleotide sequence of VGAM736 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM736 RNA, herein designated VGAM RNA, may have a different number of host target binding sites in untranslated regions of a VGAM736 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM736 RNA, herein designated VGAM RNA, to host target binding sites on VGAM736 host target RNA, herein designated VGAM HOST TARGET RNA, such as BINDING SITE I, BINDING SITE II and BINDING SITE III, inhibits translation of VGAM736 host target RNA into VGAM736 host target protein, herein designated VGAM HOST TARGET PROTEIN. VGAM host target protein is therefore outlined by a broken line.

It is appreciated that VGAM736 host target gene, herein designated VGAM HOST TARGET GENE, in fact represents a plurality of VGAM736 host target genes. The mRNA of each one of this plurality of VGAM736 host target genes comprises one or more host target binding sites, each having a nucleotide sequence which is at least partly complementary to VGAM736 RNA, herein designated VGAM RNA, and which when bound by VGAM736 RNA causes inhibition of translation of respective one or more VGAM736 host target proteins.

It is further appreciated by one skilled in the art that the mode of translational inhibition illustrated by FIG. 1 with specific reference to translational inhibition exerted by VGAM736 gene, herein designated VGAM GENE, on one or more VGAM736 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM736 is inhibition of expression of host target genes, as part of a novel viral mechanism of attacking a host. Accordingly, utilities of VGAM736 include diagnosis, prevention and treatment of viral infection by Barley Yellow Mosaic Virus. Specific functions, and accordingly utilities, of VGAM736 correlate with, and may be deduced from, the identity of the host target genes which VGAM736 binds and inhibits, and the function of these host target genes, as elaborated hereinbelow.

Nucleotide sequences of the VGAM736 precursor RNA, herein designated VGAM PRECURSOR RNA, and of the 'diced' VGAM736 RNA, herein designated VGAM RNA, and a schematic representation of the secondary folding of VGAM736 folded precursor RNA, herein designated VGAM FOLDED PRECURSOR RNA, of VGAM736 are further described hereinbelow with reference to Table 1.

Nucleotide sequences of host target binding sites, such as BINDING SITE-I, BINDING SITE-II and BINDING SITE-III of FIG. 1, found on VGAM736 host target RNA, and schematic representation of the complementarity of each of these host target binding sites to VGAM736 RNA, herein designated VGAM RNA, are described hereinbelow with reference to Table 2.

As mentioned hereinabove with reference to FIG. 1, a function of VGAM736 gene, herein designated VGAM is inhibition of expression of VGAM736 target genes. It is appreciated that specific functions, and accordingly utilities, of VGAM736 correlate with, and may be deduced from, the identity of the target genes which VGAM736 binds and inhibits, and the function of these target genes, as elaborated hereinbelow.

Tensin (TNS, Accession NM_022648) is a VGAM736 host target gene. TNS BINDING SITE is HOST TARGET binding site found in the 5' untranslated region of mRNA encoded by TNS, corresponding to a HOST TARGET binding site such as BINDING SITE I, BINDING SITE II or BINDING SITE III. Table 2 illustrates the complementarity of the nucleotide sequences of TNS BINDING SITE, designated SEQ ID:22899, to the nucleotide sequence of VGAM736 RNA, herein designated VGAM RNA, also designated SEQ ID:3447.

A function of VGAM736 is therefore inhibition of Tensin (TNS, Accession NM_022648). Accordingly, utilities of VGAM736 include diagnosis, prevention and treatment of diseases and clinical conditions associated with TNS.

FLJ21438 (Accession XM_029084) is another VGAM736 host target gene. FLJ21438 BINDING SITE is HOST TARGET binding site found in the 5" untranslated region of mRNA encoded by FLJ21438, corresponding to a HOST TARGET binding site such as BINDING SITE I, BINDING SITE II or BINDING SITE III. Table 2 illustrates the complementarity of the nucleotide sequences of FLJ21438 BINDING SITE, designated SEQ ID:30844, to the nucleotide sequence of VGAM736 RNA, herein designated VGAM RNA, also designated SEQ ID:3447.

Another function of VGAM736 is therefore inhibition of FLJ21438 (Accession XM_029084). Accordingly, utilities of VGAM736 include diagnosis, prevention and treatment of diseases and clinical conditions associated with FLJ21438. KIAA1036 (Accession NM_014909) is another VGAM736 host target gene. KIAA1036 BINDING SITE is HOST TARGET binding site found in the 3' untranslated region of mRNA encoded by KIAA1036, corresponding to a HOST TARGET binding site such as BINDING SITE I, BINDING SITE II or BINDING SITE III. Table 2 illustrates the complementarity of the nucleotide sequences of KIAA1036 BINDING SITE, designated SEQ ID:17128, to the nucleotide sequence of VGAM736 RNA, herein designated VGAM RNA, also designated SEQ ID:3447.

Another function of VGAM736 is therefore inhibition of KIAA1036 (Accession NM_014909). Accordingly, utilities of VGAM736 include diagnosis, prevention and treatment of diseases and clinical conditions associated with KIAA1036. KIAA1950 (Accession XM_166532) is another VGAM736 host target gene. KIAA1950 BINDING SITE is HOST TARGET binding site found in the 3' untranslated region of mRNA encoded by KIAA1950, corresponding to a HOST TARGET binding site such as BINDING SITE I, BINDING SITE II or BINDING SITE III. Table 2 illustrates the complementarity of the nucleotide sequences of KIAA1950 BINDING SITE, designated SEQ ID:44488, to the nucleotide sequence of VGAM736 RNA, herein designated VGAM RNA, also designated SEQ ID:3447.

Another function of VGAM736 is therefore inhibition of KIAA1950 (Accession XM_166532). Accordingly, utilities of VGAM736 include diagnosis, prevention and treatment of diseases and clinical conditions associated with KIAA1950. MGC19556 (Accession NM_033551) is another VGAM736 host target gene. MGC19556 BINDING SITE is HOST TARGET binding site found in the 3' untranslated region of mRNA encoded by MGC19556, corresponding to a HOST TARGET binding site such as BINDING SITE I, BINDING SITE II or BINDING SITE III. Table 2 illustrates the complementarity of the nucleotide sequences of MGC19556 BINDING SITE, designated SEQ ID:27314, to the nucleotide sequence of VGAM736 RNA, herein designated VGAM RNA, also designated SEQ ID:3447.

Another function of VGAM736 is therefore inhibition of MGC19556 (Accession NM_033551). Accordingly, utilities of VGAM736 include diagnosis, prevention and treatment of diseases and clinical conditions associated with MGC19556. LOC254428 (Accession XM_170932) is another VGAM736 host target gene. LOC254428 BINDING SITE is HOST TARGET binding site found in the 3' untranslated region of mRNA encoded by LOC254428, corresponding to a HOST TARGET binding site such as BINDING SITE I, BINDING SITE II or BINDING SITE III. Table 2 illustrates the complementarity of the nucleotide sequences of LOC254428 BINDING SITE, designated SEQ ID:45714, to the nucleotide sequence of VGAM736 RNA, herein designated VGAM RNA, also designated SEQ ID:3447.

Another function of VGAM736 is therefore inhibition of LOC254428 (Accession XM_170932). Accordingly, utilities of VGAM736 include diagnosis, prevention and treatment of diseases and clinical conditions associated with LOC254428.

FIG. 1 further provides a conceptual description of a novel bioinformatically detected viral gene of the present invention, referred to here as Viral Genomic Address Messenger 737 (VGAM737) viral gene, which modulates expression of respective host target genes thereof, the function and utility of which host target genes is known in the art.

VGAM737 is a novel bioinformatically detected regulatory, non protein coding, viral micro RNA (miRNA) gene. The method by which VGAM737 was detected is described hereinabove with reference to FIGS. 1-8.

VGAM737 gene, herein designated VGAM GENE, is a viral gene contained in the genome of Barley Yellow Mosaic Virus. VGAM737 host target gene, herein designated VGAM HOST TARGET GENE, is a human gene contained in the human genome.

VGAM737 gene encodes a VGAM737 precursor RNA, herein designated VGAM PRECURSOR RNA. Similar to other miRNA genes, and unlike most ordinary genes, VGAM737 precursor RNA does not encode a protein. A nucleotide sequence identical or highly similar to the nucleotide sequence of VGAM737 precursor RNA is designated SEQ ID:723, and is provided hereinbelow with reference to the sequence listing part. Nucleotide sequence SEQ ID:723 is located at position 2030 relative to the genome of Barley Yellow Mosaic Virus.

VGAM737 precursor RNA folds onto itself, forming VGAM737 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM737 folded precursor RNA into VGAM737 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM737 RNA is designated SEQ ID:3448, and is provided hereinbelow with reference to the sequence listing part.

VGAM737 host target gene, herein designated VGAM HOST TARGET GENE, encodes a corresponding messenger RNA, VGAM737 host target RNA, herein designated VGAM HOST TARGET RNA. VGAM737 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM737 RNA, herein designated VGAM RNA, binds complementarily to one or more host target binding sites located in untranslated regions of VGAM737 host target RNA, herein designated VGAM HOST TARGET RNA. This complementary binding is due to the fact that the nucleotide sequence of VGAM737 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM737 RNA, herein designated VGAM RNA, may have a different number of host target binding sites in untranslated regions of a VGAM737 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM737 RNA, herein designated VGAM RNA, to host target binding sites on VGAM737 host target RNA, herein designated VGAM HOST TARGET RNA, such as BINDING SITE I, BINDING SITE II and BINDING SITE III, inhibits translation of VGAM737 host target RNA into VGAM737 host target protein, herein designated VGAM HOST TARGET PROTEIN. VGAM host target protein is therefore outlined by a broken line.

It is appreciated that VGAM737 host target gene, herein designated VGAM HOST TARGET GENE, in fact represents a plurality of VGAM737 host target genes. The mRNA of each one of this plurality of VGAM737 host target genes comprises one or more host target binding sites, each having a nucleotide sequence which is at least partly complementary to VGAM737 RNA, herein designated VGAM RNA, and which when bound by VGAM737 RNA causes inhibition of translation of respective one or more VGAM737 host target proteins.

It is further appreciated by one skilled in the art that the mode of translational inhibition illustrated by FIG. 1 with specific reference to translational inhibition exerted by VGAM737 gene, herein designated VGAM GENE, on one or more VGAM737 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM737 is inhibition of expression of host target genes, as part of a novel viral mechanism of attacking a host. Accordingly, utilities of VGAM737 include diagnosis, prevention and treatment of viral infection by Barley Yellow Mosaic Virus. Specific functions, and accordingly utilities, of VGAM737 correlate with, and may be deduced from, the identity of the host target genes which VGAM737 binds and inhibits, and the function of these host target genes, as elaborated hereinbelow.

Nucleotide sequences of the VGAM737 precursor RNA, herein designated VGAM PRECURSOR RNA, and of the 'diced' VGAM737 RNA, herein designated VGAM RNA, and a schematic representation of the secondary folding of VGAM737 folded precursor RNA, herein designated VGAM FOLDED PRECURSOR RNA, of VGAM737 are further described hereinbelow with reference to Table 1.

Nucleotide sequences of host target binding sites, such as BINDING SITE-I, BINDING SITE-II and BINDING SITE-III of FIG. 1, found on VGAM737 host target RNA, and schematic representation of the complementarity of each of these host target binding sites to VGAM737 RNA, herein designated VGAM RNA, are described hereinbelow with reference to Table 2.

As mentioned hereinabove with reference to FIG. 1, a function of VGAM737 gene, herein designated VGAM is inhibition of expression of VGAM737 target genes. It is appreciated that specific functions, and accordingly utilities, of VGAM737 correlate with, and may be deduced from, the identity of the target genes which VGAM737 binds and inhibits, and the function of these target genes, as elaborated hereinbelow.

Calpain 2, (m/II) Large Subunit (CAPN2, Accession NM_001748) is a VGAM737 host target gene. CAPN2 BINDING SITE is HOST TARGET binding site found in the 3' untranslated region of mRNA encoded by CAPN2, corresponding to a HOST TARGET binding site such as BINDING SITE I, BINDING SITE II or BINDING SITE III. Table 2 illustrates the complementarity of the nucleotide sequences of CAPN2 BINDING SITE, designated SEQ ID:7486, to the nucleotide sequence of VGAM737 RNA, herein designated VGAM RNA, also designated SEQ ID:3448.

A function of VGAM737 is therefore inhibition of Calpain 2, (m/II) Large Subunit (CAPN2, Accession NM_001748). Accordingly, utilities of VGAM737 include diagnosis, prevention and treatment of diseases and clinical conditions associated with CAPN2. Corticotropin Releasing Hormone Receptor 2 (CRHR2, Accession NM_001883) is another VGAM737 host target gene. CRHR2 BINDING SITE is HOST TARGET binding site found in the 3' untranslated region of mRNA encoded by CRHR2, corresponding to a HOST TARGET binding site such as BINDING SITE I, BINDING SITE II or BINDING SITE III. Table 2 illustrates the complementarity of the nucleotide sequences of CRHR2 BINDING SITE, designated SEQ ID:7609, to the nucleotide sequence of VGAM737 RNA, herein designated VGAM RNA, also designated SEQ ID:3448.

Another function of VGAM737 is therefore inhibition of Corticotropin Releasing Hormone Receptor 2 (CRHR2, Accession NM_001883), a gene which is a corticotropin releasing factor receptor type II. Accordingly, utilities of VGAM737 include diagnosis, prevention and treatment of diseases and clinical conditions associated with CRHR2. The function of CRHR2 has been established by previous studies. Corticotropin-releasing hormone (CRH; 122560) is a 41-amino acid peptide synthesized in the hypothalamus. It is the principal neuroregulator of the hypothalamic-pituitary-adrenocortical axis and plays an important role in coordinating the endocrine, autonomic, and behavioral responses to stress and immune challenge. Liaw et al. (1996) stated that there are 2 G protein-coupled CRH receptors, CRHR1 (OMIM Ref. No. 122561) and CRHR2, which they termed the CRF2 receptor. The investigators used clones of the rat CRF2 receptor to isolate the human gene from brain and kidney genomic DNA libraries. The gene consists of 12 exons spanning approximately 30 kb. The predicted protein, which is 411 amino acids in length and 70% identical to the CRF1 receptor, contains a putative N-terminal secretory signal sequence and 7 putative transmembrane domains. Liaw et al. (1996) expressed the CRF2 receptor and found that transfected cells responded to the binding of CRH with an increase in intracellular cAMP. Although the rat receptor has 2 alternatively spliced variants, termed CRF2-alpha and CRF2-beta, Liaw et al. (1996) found no evidence for alternative splicing of the human receptor. Liaw et al. (1996) reported that the pharmacologic profile of this protein was similar to that of the rat CRF2-alpha protein but distinct from the human CRF1 receptor Kostich et al. (1998) reported a novel CRHR2 splice isoform, which they referred to as 'CRF2-gamma,' found in human brain. CRF2-gamma cDNA encodes a 397-amino acid receptor containing an amino terminus with no significant homology to the already reported alpha- and beta-termini. PCR and Southern blot analysis of CRF2-gamma RNA expression in human brain detected expression in the septum and hippocampus, with weaker but detectable expression in the amygdala, nucleus accumbens, midbrain, and frontal cortex. Animal model experiments lend further support to the function of CRHR2. Kishimoto et al. (2000) generated mice deficient for Crhr2 by targeted disruption. They reported that male but not female Crhr2-deficient mice exhibited enhanced anxious behavior in several tests of anxiety in contrast to mice lacking Crhr1. The enhanced anxiety of Crhr2-deficient mice was not due to changes in hypothalamic-pituitary-adrenal axis activity, but rather reflected impaired responses in specific brain regions involved in emotional and autonomic functions, as monitored by a reduction in Creb phosphorylation in male, but not female, Crhr2 -/- mice. Kishimoto et al. (2000) proposed that CRHR1 predominantly mediates a central anxiolytic response, opposing the general anxiogenic effect of CRH mediated by CRHR1. Kishimoto et al. (2000) found that neither male nor female Crhr2-deficient mice showed alterations of baseline feeding behavior. Both responded with increased edema formation in response to thermal exposure, however, indicating that in contrast to its central role in anxiety, the peripheral role of CRHR2 in vascular permeability is independent of gender.

It is appreciated that the abovementioned animal model for CRHR2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kostich, W. A.; Chen, A.; Sperle, K.; Largent, B. L.: Molecular identification and analysis of a novel human corticotropin-releasing factor (CRF) receptor: the CRF2-gamma receptor. Molec. Endocr. 12:1077-1085, 1998; and Kishimoto, T.; Radulovic, J.; Radulovic, M.; Lin, C. R.; Schrick, C.; Hooshmand, F.; Hermanson, O.; Rosenfeld, M. G.; Spiess, J.: Deletion of Crhr2 reveals an anxiolytic role for cortic.

Further studies establishing the function and utilities of CRHR2 are found in John Hopkins OMIM database record ID 602034, and in sited publications numbered 943-94 and 1988-950 listed in the bibliography section hereinbelow, which are also hereby incorporated by reference. Muscleblind-like (Drosophila) (MBNL, Accession NM_021038) is another VGAM737 host target gene. MBNL BINDING SITE is HOST TARGET binding site found in the 3" untranslated region of mRNA encoded by MBNL, corresponding to a HOST TARGET binding site such as BINDING SITE I, BINDING SITE II or BINDING SITE III. Table 2 illustrates the complementarity of the nucleotide sequences of MBNL BINDING SITE, designated SEQ ID:22030, to the nucleotide sequence of VGAM737 RNA, herein designated VGAM RNA, also designated SEQ ID:3448.

Another function of VGAM737 is therefore inhibition of Muscleblind-like (Drosophila) (MBNL, Accession NM_021038), a gene which binds to cug triplet repeat expansion dsrna (by similarity). Accordingly, utilities of VGAM737 include diagnosis, prevention and treatment of diseases and clinical conditions associated with MBNL. The function of MBNL and its association with various diseases and clinical conditions, has been established by previous studies, as described hereinabove with reference to VGAM95. MADS Box Transcription Enhancer Factor 2, Polypeptide C (myocyte enhancer factor 2C) (MEF2C, Accession NM_002397) is another VGAM737 host target gene. MEF2C BINDING SITE is HOST TARGET binding site found in the 3' untranslated region of mRNA encoded by MEF2C, corresponding to a HOST TARGET binding site such as BINDING SITE I, BINDING SITE II or BINDING SITE III. Table 2 illustrates the complementarity of the nucleotide sequences of MEF2C BINDING SITE, designated SEQ ID:8212, to the nucleotide sequence of VGAM737 RNA, herein designated VGAM RNA, also designated SEQ ID:3448.

Another function of VGAM737 is therefore inhibition of MADS Box Transcription Enhancer Factor 2, Polypeptide C (myocyte enhancer factor 2C) (MEF2C, Accession NM_002397), a gene which regulates muscle-specific and mitogen-inducible genes. Accordingly, utilities of VGAM737 include diagnosis, prevention and treatment of diseases and clinical conditions associated with MEF2C. The function of MEF2C and its association with various diseases and clinical conditions, has been established by previous studies, as described hereinabove with reference to VGAM386.8-oxoguanine DNA Glycosylase (OGG1, Accession NM_002542) is another VGAM737 host target gene. OGG1 BINDING SITE1 through OGG1 BINDING SITE3 are HOST TARGET binding sites found in untranslated regions of mRNA encoded by OGG1, corresponding to HOST TARGET binding sites such as BINDING SITE I, BINDING SITE II or BINDING SITE III. Table 2 illustrates the complementarity of the nucleotide sequences of OGG1 BINDING SITE1 through OGG1 BINDING SITE3, designated SEQ ID:8393, SEQ ID:18810 and SEQ ID:18815 respectively, to the nucleotide sequence of VGAM737 RNA, herein designated VGAM RNA, also designated SEQ ID:3448.

Another function of VGAM737 is therefore inhibition of 8-oxoguanine DNA Glycosylase (OGG1, Accession NM_002542), a gene which is involved in base excision DNA repair and removal of 8-oxyguanine. Accordingly, utilities of VGAM737 include diagnosis, prevention and treatment of diseases and clinical conditions associated with OGG1. The function of OGG1 and its association with various diseases and clinical conditions, has been established by previous studies, as described hereinabove with reference to VGAM390. Phosphotriesterase Related (PTER, Accession NM_030664) is another VGAM737 host target gene. PTER BINDING SITE is HOST TARGET binding site found in the 3' untranslated region of mRNA encoded by PTER, corresponding to a HOST TARGET binding site such as BINDING SITE I, BINDING SITE II or BINDING SITE III. Table 2 illustrates the complementarity of the nucleotide sequences of PTER BINDING SITE, designated SEQ ID:24999, to the nucleotide sequence of VGAM737 RNA, herein designated VGAM RNA, also designated SEQ ID:3448.

Another function of VGAM737 is therefore inhibition of Phosphotriesterase Related (PTER, Accession NM_030664), a gene which is a phosphotriesterase homology protein. Accordingly, utilities of VGAM737 include diagnosis, prevention and treatment of diseases and clinical conditions associated with PTER. The function of PTER and its association with various diseases and clinical conditions, has been established by previous studies, as described hereinabove with reference to VGAM713. Retinoic Acid Receptor, Beta (RARB, Accession NM_016152) is another VGAM737 host target gene. RARB BINDING SITE1 and RARB BINDING SITE2 are HOST TARGET binding sites found in untranslated regions of mRNA encoded by RARB, corresponding to HOST TARGET binding sites such as BINDING SITE I, BINDING SITE II or BINDING SITE III. Table 2 illustrates the complementarity of the nucleotide sequences of RARB BINDING SITE1 and RARB BINDING SITE2, designated SEQ ID:18239 and SEQ ID:6693 respectively, to the nucleotide sequence of VGAM737 RNA, herein designated VGAM RNA, also designated SEQ ID:3448.

Another function of VGAM737 is therefore inhibition of Retinoic Acid Receptor, Beta (RARB, Accession NM_016152), a gene which is one member of the steroid/thyroid hormone receptor family of ligand-activated transcription factors. Accordingly, utilities of VGAM737 include diagnosis, prevention and treatment of diseases and clinical conditions associated with RARB. The function of RARB and its association with various diseases and clinical conditions, has been established by previous studies, as described hereinabove with reference to VGAM179. Thioredoxin Interacting Protein (TXNIP, Accession NM_006472) is another VGAM737 host target gene. TXNIP BINDING SITE is HOST TARGET binding site found in the 3' untranslated region of mRNA encoded by TXNIP, corresponding to a HOST TARGET binding site such as BINDING SITE I, BINDING SITE II or BINDING SITE III. Table 2 illustrates the complementarity of the nucleotide sequences of TXNIP BINDING SITE, designated SEQ ID:13196, to the nucleotide sequence of VGAM737 RNA, herein designated VGAM RNA, also designated SEQ ID:3448.

Another function of VGAM737 is therefore inhibition of Thioredoxin Interacting Protein (TXNIP, Accession NM_006472), a gene which binds and inhibits thioredoxin, a major regulator of cellular redox state. Accordingly, utilities of VGAM737 include diagnosis, prevention and treatment of diseases and clinical conditions associated with TXNIP. The function of TXNIP has been established by previous studies. Exposure to vitamin D3 (1,25-dihydroxyvitamin D3) or phorbol ester induces the bipotent HL-60 cell promyelocytic leukemia cell line to differentiate into monocytes/macrophages, whereas retinoic acid and dimethylsulfoxide induce differentiation towards granulocytes. The differentiation is accompanied by regulation of MYC (OMIM Ref. No. 190080), FOS (OMIM Ref. No. 164810), FMS (CSF1R; 164770), and myeloblastin (PRTN3; 177020). By differential screening of HL60 cell lines, Chen and DeLuca (1994) identified a cDNA encoding TXNIP, which they termed VDUP1. The deduced TXNIP protein has 391 amino acids. Ribonuclease protection analysis showed dramatically increased expression of TXNIP in response to vitamin D3 but not to phorbol ester. Chen and DeLuca (1994) concluded that TXNIP is not involved in the differentiation process. Familial combined hyperlipidemia (OMIM Ref. No. 144250) is a common, multifactorial and heterogeneous dyslipidemia predisposing to premature coronary artery disease and characterized by elevated plasma triglycerides, cholesterol, or both. Castellani et al. (1998) identified a mouse mutant strain, HcB-19, that shares features with familial combined hyperlipidemia, including hypertriglyceridemia, hypercholesterolemia, elevated plasma apolipoprotein B, and increased secretion of triglyceride-rich lipoproteins. This disorder was shown to result from spontaneous mutation at a locus, designated Hyplip1, on distal mouse chromosome 3 in a region syntenic to 1q21-q23, where a locus for familial combined hyperlipidemia was identified in Finnish, German, Chinese, and U. S. families. By positional cloning, Bodnar et al. (2002) demonstrated that the Hyplip1 gene is Txnip, and they demonstrated a Txnip nonsense mutation in the HcB-19 strain that was absent in its normolipidemic parental strains. Txnip encodes a cytoplasmic protein that binds and inhibits thioredoxin, a major regulator of cellular redox state. The mutant mice showed a decreased flux of fatty acids through the TCA cycle, resulting in increased availability for ketogenesis and triglyceride synthesis. The authors suggested further studies to elucidate the potential role of the human homolog in familial combined hyperlipidemia and other metabolic disorder Full details of the abovementioned studies are described in the following publications, the disclosure of which are hereby incorporated by reference:

Chen, K.-S.; DeLuca, H. F.: Isolation and characterization of a novel cDNA from HL-60 cells treated with 1,25-dihydroxyvitamin D-3. Biochim. Biophys. Acta 1219:26-32, 1994; and Bodnar, J. S.; Chatterjee, A.; Castellani, L. W.; Ross, D. A.; Ohmen, J.; Cavalcoli, J.; Wu, C.; Dains, K. M.; Catanese, J.; Chu, M.; Sheth, S. S.; Charugundla, K.; Demant, P.; West, D. B.

Further studies establishing the function and utilities of TXNIP are found in John Hopkins OMIM database record ID 606599, and in sited publications numbered 103 and 4515-4516 listed in the bibliography section hereinbelow, which are also hereby incorporated by reference. KIAA0935 (Accession XM_052620) is another VGAM737 host target gene. KIAA0935 BINDING SITE is HOST TARGET binding site found in the 3' untranslated region of mRNA encoded by KIAA0935, corresponding to a HOST TARGET binding site such as BINDING SITE I, BINDING SITE II or BINDING SITE III. Table 2 illustrates the complementarity of the nucleotide sequences of KIAA0935 BINDING SITE, designated SEQ ID:36013, to the nucleotide sequence of VGAM737 RNA, herein designated VGAM RNA, also designated SEQ ID:3448.

Another function of VGAM737 is therefore inhibition of KIAA0935 (Accession XM_052620). Accordingly, utilities of VGAM737 include diagnosis, prevention and treatment of diseases and clinical conditions associated with KIAA0935. KIAA0937 (Accession XM_166213) is another VGAM737 host target gene. KIAA0937 BINDING SITE is HOST TARGET binding site found in the 3' untranslated region of mRNA encoded by KIAA0937, corresponding to a HOST TARGET binding site such as BINDING SITE I, BINDING SITE II or BINDING SITE III. Table 2 illustrates the complementarity of the nucleotide sequences of KIAA0937 BINDING SITE, designated SEQ ID:44019, to the nucleotide sequence of VGAM737 RNA, herein designated VGAM RNA, also designated SEQ ID:3448.

Another function of VGAM737 is therefore inhibition of KIAA0937 (Accession XM_166213). Accordingly, utilities of VGAM737 include diagnosis, prevention and treatment of diseases and clinical conditions associated with KIAA0937. KIAA1303 (Accession XM_038376) is another VGAM737 host target gene. KIAA1303 BINDING SITE is HOST TARGET binding site found in the 3' untranslated region of mRNA encoded by KIAA1303, corresponding to a HOST TARGET binding site such as BINDING SITE I, BINDING SITE II or BINDING SITE III. Table 2 illustrates the complementarity of the nucleotide sequences of KIAA1303 BINDING SITE, designated SEQ ID:32831, to the nucleotide sequence of VGAM737 RNA, herein designated VGAM RNA, also designated SEQ ID:3448.

Another function of VGAM737 is therefore inhibition of KIAA1303 (Accession XM_038376). Accordingly, utilities of VGAM737 include diagnosis, prevention and treatment of diseases and clinical conditions associated with KIAA1303. OS-9 (Accession NM_006812) is another VGAM737 host target gene. OS-9 BINDING SITE is HOST TARGET binding site found in the 3' untranslated region of mRNA encoded by OS-9, corresponding to a HOST TARGET binding site such as BINDING SITE I, BINDING SITE II or BINDING SITE III. Table 2 illustrates the complementarity of the nucleotide sequences of OS-9 BINDING SITE, designated SEQ ID:13683, to the nucleotide sequence of VGAM737 RNA, herein designated VGAM RNA, also designated SEQ ID:3448.

Another function of VGAM737 is therefore inhibition of OS-9 (Accession NM_006812). Accordingly, utilities of VGAM737 include diagnosis, prevention and treatment of diseases and clinical conditions associated with OS-9. Sideroflexin 2 (SFXN2, Accession XM_058359) is another VGAM737 host target gene. SFXN2 BINDING SITE is HOST TARGET binding site found in the 3' untranslated region of mRNA encoded by SFXN2, corresponding to a HOST TARGET binding site such as BINDING SITE I, BINDING SITE II or BINDING SITE III. Table 2 illustrates the complementarity of the nucleotide sequences of SFXN2 BINDING SITE, designated SEQ ID:36601, to the nucleotide sequence of VGAM737 RNA, herein designated VGAM RNA, also designated SEQ ID:3448.

Another function of VGAM737 is therefore inhibition of Sideroflexin 2 (SFXN2, Accession XM_058359). Accordingly, utilities of VGAM737 include diagnosis, prevention and treatment of diseases and clinical conditions associated with SFXN2. Smith-Magenis Syndrome Chromosome Region, Candidate 5 (SMCR5, Accession NM_144774) is another VGAM737 host target gene. SMCR5 BINDING SITE is HOST TARGET binding site found in the 3' untranslated region of mRNA encoded by SMCR5, corresponding to a HOST TARGET binding site such as BINDING SITE I, BINDING SITE II or BINDING SITE III. Table 2 illustrates the complementarity of the nucleotide sequences of SMCR5 BINDING SITE, designated SEQ ID:29565, to the nucleotide sequence of VGAM737 RNA, herein designated VGAM RNA, also designated SEQ ID:3448.

Another function of VGAM737 is therefore inhibition of Smith-Magenis Syndrome Chromosome Region, Candidate 5 (SMCR5, Accession NM_144774). Accordingly, utilities of VGAM737 include diagnosis, prevention and treatment of diseases and clinical conditions associated with SMCR5. Signal Sequence Receptor, Alpha (translocon-associated protein alpha) (SSR1, Accession NM_003144) is another VGAM737 host target gene. SSR1 BINDING SITE is HOST TARGET binding site found in the 3' untranslated region of mRNA encoded by SSR1, corresponding to a HOST TARGET binding site such as BINDING SITE I, BINDING SITE II or BINDING SITE III. Table 2 illustrates the complementarity of the nucleotide sequences of SSR1 BINDING SITE, designated SEQ ID:9112, to the nucleotide sequence of VGAM737 RNA, herein designated VGAM RNA, also designated SEQ ID:3448.

Another function of VGAM737 is therefore inhibition of Signal Sequence Receptor, Alpha (translocon-associated protein alpha) (SSR1, Accession NM_003144). Accordingly, utilities of VGAM737 include diagnosis, prevention and treatment of diseases and clinical conditions associated with SSR1. Syntaxin 3A (STX3A, Accession NM_004177) is another VGAM737 host target gene. STX3A BINDING SITE is HOST TARGET binding site found in the 3' untranslated region of mRNA encoded by STX3A, corresponding to a HOST TARGET binding site such as BINDING SITE I, BINDING SITE II or BINDING SITE III. Table 2 illustrates the complementarity of the nucleotide sequences of STX3A BINDING SITE, designated SEQ ID:10388, to the nucleotide sequence of VGAM737 RNA, herein designated VGAM RNA, also designated SEQ ID:3448.

Another function of VGAM737 is therefore inhibition of Syntaxin 3A (STX3A, Accession NM_004177). Accordingly, utilities of VGAM737 include diagnosis, prevention and treatment of diseases and clinical conditions associated with STX3A. LOC149842 (Accession XM_097745) is another VGAM737 host target gene. LOC149842 BINDING SITE is HOST TARGET binding site found in the 3' untranslated region of mRNA encoded by LOC149842, corresponding to a HOST TARGET binding site such as BINDING SITE I, BINDING SITE II or BINDING SITE III. Table 2 illustrates the complementarity of the nucleotide sequences of LOC149842 BINDING SITE, designated SEQ ID:41091, to the nucleotide sequence of VGAM737 RNA, herein designated VGAM RNA, also designated SEQ ID:3448.

Another function of VGAM737 is therefore inhibition of LOC149842 (Accession XM_097745). Accordingly, utilities of VGAM737 include diagnosis, prevention and treatment of diseases and clinical conditions associated with LOC149842. LOC221143 (Accession XM_167986) is another VGAM737 host target gene. LOC221143 BINDING SITE is HOST TARGET binding site found in the 3' untranslated region of mRNA encoded by LOC221143, corresponding to a HOST TARGET binding site such as BINDING SITE I, BINDING SITE II or BINDING SITE III. Table 2 illustrates the complementarity of the nucleotide sequences of LOC221143 BINDING SITE, designated SEQ ID:44944, to the nucleotide sequence of VGAM737 RNA, herein designated VGAM RNA, also designated SEQ ID:3448.

Another function of VGAM737 is therefore inhibition of LOC221143 (Accession XM_167986). Accordingly, utilities of VGAM737 include diagnosis, prevention and treatment of diseases and clinical conditions associated with LOC221143. LOC254394 (Accession XM_171127) is another VGAM737 host target gene. LOC254394 BINDING SITE is HOST TARGET binding site found in the 3' untranslated region of mRNA encoded by LOC254394, corresponding to a HOST TARGET binding site such as BINDING SITE I, BINDING SITE II or BINDING SITE III. Table 2 illustrates the complementarity of the nucleotide sequences of LOC254394 BINDING SITE, designated SEQ ID:45930, to the nucleotide sequence of VGAM737 RNA, herein designated VGAM RNA, also designated SEQ ID:3448.

Another function of VGAM737 is therefore inhibition of LOC254394 (Accession XM_171127). Accordingly, utilities of VGAM737 include diagnosis, prevention and treatment of diseases and clinical conditions associated with LOC254394. FIG. 1 further provides a conceptual description of a novel bioinformatically detected viral gene of the present invention, referred to here as Viral Genomic Address Messenger 738 (VGAM738) viral gene, which modulates expression of respective host target genes thereof, the function and utility of which host target genes is known in the art.

VGAM738 is a novel bioinformatically detected regulatory, non protein coding, viral micro RNA (miRNA) gene. The method by which VGAM738 was detected is described hereinabove with reference to FIGS. 1-8.

VGAM738 gene, herein designated VGAM GENE, is a viral gene contained in the genome of Barley Yellow Mosaic Virus. VGAM738 host target gene, herein designated VGAM HOST TARGET GENE, is a human gene contained in the human genome.

VGAM738 gene encodes a VGAM738 precursor RNA, herein designated VGAM PRECURSOR RNA. Similar to other miRNA genes, and unlike most ordinary genes, VGAM738 precursor RNA does not encode a protein. A nucleotide sequence identical or highly similar to the nucleotide sequence of VGAM738 precursor RNA is designated SEQ ID:724, and is provided hereinbelow with reference to the sequence listing part. Nucleotide sequence SEQ ID:724 is located at position 3974 relative to the genome of Barley Yellow Mosaic Virus.

VGAM738 precursor RNA folds onto itself, forming VGAM738 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM738 folded precursor RNA into VGAM738 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM738 RNA is designated SEQ ID:3449, and is provided hereinbelow with reference to the sequence listing part.

VGAM738 host target gene, herein designated VGAM HOST TARGET GENE, encodes a corresponding messenger RNA, VGAM738 host target RNA, herein designated VGAM HOST TARGET RNA. VGAM738 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM738 RNA, herein designated VGAM RNA, binds complementarily to one or more host target binding sites located in untranslated regions of VGAM738 host target RNA, herein designated VGAM HOST TARGET RNA. This complementary binding is due to the fact that the nucleotide sequence of VGAM738 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM738 RNA, herein designated VGAM RNA, may have a different number of host target binding sites in untranslated regions of a VGAM738 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM738 RNA, herein designated VGAM RNA, to host target binding sites on VGAM738 host target RNA, herein designated VGAM HOST TARGET RNA, such as BINDING SITE I, BINDING SITE II and BINDING SITE III, inhibits translation of VGAM738 host target RNA into VGAM738 host target protein, herein designated VGAM HOST TARGET PROTEIN. VGAM host target protein is therefore outlined by a broken line.

It is appreciated that VGAM738 host target gene, herein designated VGAM HOST TARGET GENE, in fact represents a plurality of VGAM738 host target genes. The mRNA of each one of this plurality of VGAM738 host target genes comprises one or more host target binding sites, each having a nucleotide sequence which is at least partly complementary to VGAM738 RNA, herein designated VGAM RNA, and which when bound by VGAM738 RNA causes inhibition of translation of respective one or more VGAM738 host target proteins.

It is further appreciated by one skilled in the art that the mode of translational inhibition illustrated by FIG. 1 with specific reference to translational inhibition exerted by VGAM738 gene, herein designated VGAM GENE, on one or more VGAM738 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM738 is inhibition of expression of host target genes, as part of a novel viral mechanism of attacking a host. Accordingly, utilities of VGAM738 include diagnosis, prevention and treatment of viral infection by Barley Yellow Mosaic Virus. Specific functions, and accordingly utilities, of VGAM738 correlate with, and may be deduced from, the identity of the host target genes which VGAM738 binds and inhibits, and the function of these host target genes, as elaborated hereinbelow.

Nucleotide sequences of the VGAM738 precursor RNA, herein designated VGAM PRECURSOR RNA, and of the 'diced' VGAM738 RNA, herein designated VGAM RNA, and a schematic representation of the secondary folding of VGAM738 folded precursor RNA, herein designated VGAM FOLDED PRECURSOR RNA, of VGAM738 are further described hereinbelow with reference to Table 1.

Nucleotide sequences of host target binding sites, such as BINDING SITE-I, BINDING SITE-II and BINDING SITE-III of FIG. 1, found on VGAM738 host target RNA, and schematic representation of the complementarity of each of these host target binding sites to VGAM738 RNA, herein designated VGAM RNA, are described hereinbelow with reference to Table 2.

As mentioned hereinabove with reference to FIG. 1, a function of VGAM738 gene, herein designated VGAM is inhibition of expression of VGAM738 target genes. It is appreciated that specific functions, and accordingly utilities, of VGAM738 correlate with, and may be deduced from, the identity of the target genes which VGAM738 binds and inhibits, and the function of these target genes, as elaborated hereinbelow.

Ecotropic Viral Integration Site 2A (EVI2A, Accession NM_014210) is a VGAM738 host target gene. EVI2A BINDING SITE is HOST TARGET binding site found in the 5' untranslated region of mRNA encoded by EVI2A, corresponding to a HOST TARGET binding site such as BINDING SITE I, BINDING SITE II or BINDING SITE III. Table 2 illustrates the complementarity of the nucleotide sequences of EVI2A BINDING SITE, designated SEQ ID:15477, to the nucleotide sequence of VGAM738 RNA, herein designated VGAM RNA, also designated SEQ ID:3449.

A function of VGAM738 is therefore inhibition of Ecotropic Viral Integration Site 2A (EVI2A, Accession NM_014210), a gene which may complex with itself or/and other proteins within the membrane, to function as part of a cell-surface receptor. Accordingly, utilities of VGAM738 include diagnosis, prevention and treatment of diseases and clinical conditions associated with EVI2A. The function of EVI2A has been established by previous studies. O'Connell et al. (1989, 1990) demonstrated by genetic linkage and by somatic cell hybrid and pulsed field gel electrophoresis that EVI2, the human homolog of the mouse myeloid leukemia-associated gene Evi2, maps between 2 breakpoints on the proximal part of 17q that define the location of the gene for neurofibromatosis (OMIM Ref. No. 162200). Sequencing studies predicted an EVI2 protein of 232 amino acids and structural features consistent with the view that EVI2 is a membrane protein that may complex with itself and/or other proteins within the membrane, perhaps to function as part of a cell-surface receptor. In the course of these studies of the structure of the EVI2 gene, Cawthon et al. (1990) identified 2 other transcripts that map between the NF1 translocation breakpoints. Collins (1993) symbolized this gene EVDA.

Full details of the abovementioned studies are described in the following publications, the disclosure of which are hereby incorporated by reference:

O'Connell, P.; Viskochil, D.; Buchberg, A. M.; Fountain, J.; Cawthon, R. M.; Culver, M.; Stevens, J.; Rich, D. C.; Ledbetter, D. H.; Wallace, M.; Carey, J. C.; Jenkins, N. A.; Copeland, N. G.; Collins, F. S.; White, R.: The human homolog of murine Evi-2 lies between two von Recklinghausen neurofibromatosis translocations. Genomics 7:547-554, 1990; and Cawthon, R. M.; O'Connell, P.; Buchberg, A. M.; Viskochil, D.; Weiss, R. B.; Culver, M.; Stevens, J.; Jenkins, N. A.; Copeland, N. G.; White, R.: Identification and characterization of.

Further studies establishing the function and utilities of EVI2A are found in John Hopkins OMIM database record ID 158380, and in sited publications numbered 3803-3806 listed in the bibliography section hereinbelow, which are also hereby incorporated by reference. RecQ Protein-like 5 (RECQL5, Accession NM_004259) is another VGAM738 host target gene. RECQL5 BINDING SITE is HOST TARGET binding site found in the 3' untranslated region of mRNA encoded by RECQL5, corresponding to a HOST TARGET binding site such as BINDING SITE I, BINDING SITE II or BINDING SITE III. Table 2 illustrates the complementarity of the nucleotide sequences of RECQL5 BINDING SITE, designated SEQ ID:10446, to the nucleotide sequence of VGAM738 RNA, herein designated VGAM RNA, also designated SEQ ID:3449.

Another function of VGAM738 is therefore inhibition of RecQ Protein-like 5 (RECQL5, Accession NM_004259). Accordingly, utilities of VGAM738 include diagnosis, prevention and treatment of diseases and clinical conditions associated with RECQL5. Thrombospondin 1 (THBS1, Accession NM_003246) is another VGAM738 host target gene. THBS1 BINDING SITE is HOST TARGET binding site found in the 3' untranslated region of mRNA encoded by THBS1, corresponding to a HOST TARGET binding site such as BINDING SITE I, BINDING SITE II or BINDING SITE III. Table 2 illustrates the complementarity of the nucleotide sequences of THBS1 BINDING SITE, designated SEQ ID:9254, to the nucleotide sequence of VGAM738 RNA, herein designated VGAM RNA, also designated SEQ ID:3449.

Another function of VGAM738 is therefore inhibition of Thrombospondin 1 (THBS1, Accession NM_003246), a gene which is a member of a family of adhesive molecules, involves in blood clotting and in angiogenesis. Accordingly, utilities of VGAM738 include diagnosis, prevention and treatment of diseases and clinical conditions associated with THBS1. The function of THBS1 and its association with various diseases and clinical conditions, has been established by previous studies, as described hereinabove with reference to VGAM20. Ras Homolog Gene Family, Member E (ARHE, Accession NM_005168) is another VGAM738 host target gene. ARHE BINDING SITE is HOST TARGET binding site found in the 3' untranslated region of mRNA encoded by ARHE, corresponding to a HOST TARGET binding site such as BINDING SITE I, BINDING SITE II or BINDING SITE III. Table 2 illustrates the complementarity of the nucleotide sequences of ARHE BINDING SITE, designated SEQ ID:11666, to the nucleotide sequence of VGAM738 RNA, herein designated VGAM RNA, also designated SEQ ID:3449.

Another function of VGAM738 is therefore inhibition of Ras Homolog Gene Family, Member E (ARHE, Accession NM_005168). Accordingly, utilities of VGAM738 include diagnosis, prevention and treatment of diseases and clinical conditions associated with ARHE. Eukaryotic Translation Initiation Factor 3, Subunit 1 Alpha, 35 kDa (EIF3S1, Accession XM_032384) is another VGAM738 host target gene. EIF3S1 BINDING SITE is HOST TARGET binding site found in the 3' untranslated region of mRNA encoded by EIF3S1, corresponding to a HOST TARGET binding site such as BINDING SITE I, BINDING SITE II or BINDING SITE III. Table 2 illustrates the complementarity of the nucleotide sequences of EIF3S1 BINDING SITE, designated SEQ ID:31640, to the nucleotide sequence of VGAM738 RNA, herein designated VGAM RNA, also designated SEQ ID:3449.

Another function of VGAM738 is therefore inhibition of Eukaryotic Translation Initiation Factor 3, Subunit 1 Alpha, 35 kDa (EIF3S1, Accession XM_032384). Accordingly, utilities of VGAM738 include diagnosis, prevention and treatment of diseases and clinical conditions associated with EIF3S1. FLJ20330 (Accession NM_018988) is another VGAM738 host target gene. FLJ20330 BINDING SITE is HOST TARGET binding site found in the 3' untranslated region of mRNA encoded by FLJ20330, corresponding to a HOST TARGET binding site such as BINDING SITE I, BINDING SITE II or BINDING SITE III. Table 2 illustrates the complementarity of the nucleotide sequences of FLJ20330 BINDING SITE, designated SEQ ID:21058, to the nucleotide sequence of VGAM738 RNA, herein designated VGAM RNA, also designated SEQ ID:3449.

Another function of VGAM738 is therefore inhibition of FLJ20330 (Accession NM_018988). Accordingly, utilities of VGAM738 include diagnosis, prevention and treatment of diseases and clinical conditions associated with FLJ20330. KIAA1432 (Accession XM_039698) is another VGAM738 host target gene. KIAA1432 BINDING SITE is HOST TARGET binding site found in the 5' untranslated region of mRNA encoded by KIAA1432, corresponding to a HOST TARGET binding site such as BINDING SITE I, BINDING SITE II or BINDING SITE III. Table 2 illustrates the complementarity of the nucleotide sequences of KIAA1432 BINDING SITE, designated SEQ ID:33149, to the nucleotide sequence of VGAM738 RNA, herein designated VGAM RNA, also designated SEQ ID:3449.

Another function of VGAM738 is therefore inhibition of KIAA1432 (Accession XM_039698). Accordingly, utilities of VGAM738 include diagnosis, prevention and treatment of diseases and clinical conditions associated with KIAA1432. P66 (Accession NM_020699) is another VGAM738 host target gene. P66 BINDING SITE is HOST TARGET binding site found in the 3' untranslated region of mRNA encoded by P66, corresponding to a HOST TARGET binding site such as BINDING SITE I, BINDING SITE II or BINDING SITE III.

Table 2 illustrates the complementarity of the nucleotide sequences of P66 BINDING SITE, designated SEQ ID:21847, to the nucleotide sequence of VGAM738 RNA, herein designated VGAM RNA, also designated SEQ ID:3449.

Another function of VGAM738 is therefore inhibition of P66 (Accession NM_020699). Accordingly, utilities of VGAM738 include diagnosis, prevention and treatment of diseases and clinical conditions associated with P66. Phosphatidylinositol-4-phosphate 5-kinase, Type II, Alpha (PIP5K2A, Accession NM_005028) is another VGAM738 host target gene. PIP5K2A BINDING SITE is HOST TARGET binding site found in the 5' untranslated region of mRNA encoded by PIP5K2A, corresponding to a HOST TARGET binding site such as BINDING SITE I, BINDING SITE II or BINDING SITE III. Table 2 illustrates the complementarity of the nucleotide sequences of PIP5K2A BINDING SITE, designated SEQ ID:11469, to the nucleotide sequence of VGAM738 RNA, herein designated VGAM RNA, also designated SEQ ID:3449.

Another function of VGAM738 is therefore inhibition of Phosphatidylinositol-4-phosphate 5-kinase, Type II, Alpha (PIP5K2A, Accession NM_005028). Accordingly, utilities of VGAM738 include diagnosis, prevention and treatment of diseases and clinical conditions associated with PIP5K2A. Testis-specific Transcript, Y-linked 2 (TTTY2, Accession XM_099029) is another VGAM738 host target gene. TTTY2 BINDING SITE is HOST TARGET binding site found in the 5' untranslated region of mRNA encoded by TTTY2, corresponding to a HOST TARGET binding site such as BINDING SITE I, BINDING SITE II or BINDING SITE III. Table 2 illustrates the complementarity of the nucleotide sequences of TTTY2 BINDING SITE, designated SEQ ID:42067, to the nucleotide sequence of VGAM738 RNA, herein designated VGAM RNA, also designated SEQ ID:3449.

Another function of VGAM738 is therefore inhibition of Testis-specific Transcript, Y-linked 2 (TTTY2, Accession XM_099029). Accordingly, utilities of VGAM738 include diagnosis, prevention and treatment of diseases and clinical conditions associated with TTTY2. LOC159148 (Accession XM_099030) is another VGAM738 host target gene. LOC159148 BINDING SITE is HOST TARGET binding site found in the 5' untranslated region of mRNA encoded by LOC159148, corresponding to a HOST TARGET binding site such as BINDING SITE I, BINDING SITE II or BINDING SITE III. Table 2 illustrates the complementarity of the nucleotide sequences of LOC159148 BINDING SITE, designated SEQ ID:42074, to the nucleotide sequence of VGAM738 RNA, herein designated VGAM RNA, also designated SEQ ID:3449.

Another function of VGAM738 is therefore inhibition of LOC159148 (Accession XM_099030). Accordingly, utilities of VGAM738 include diagnosis, prevention and treatment of diseases and clinical conditions associated with LOC159148. LOC221718 (Accession XM_168062) is another VGAM738 host target gene. LOC221718 BINDING SITE is HOST TARGET binding site found in the 5' untranslated region of mRNA encoded by LOC221718, corresponding to a HOST TARGET binding site such as BINDING SITE I, BINDING SITE II or BINDING SITE III. Table 2 illustrates the complementarity of the nucleotide sequences of LOC221718 BINDING SITE, designated SEQ ID:44981, to the nucleotide sequence of VGAM738 RNA, herein designated VGAM RNA, also designated SEQ ID:3449.

Another function of VGAM738 is therefore inhibition of LOC221718 (Accession XM_168062). Accordingly, utilities of VGAM738 include diagnosis, prevention and treatment of diseases and clinical conditions associated with LOC221718. LOC256880 (Accession XM_173135) is another VGAM738 host target gene. LOC256880 BINDING SITE is HOST TARGET binding site found in the 5' untranslated region of mRNA encoded by LOC256880, corresponding to a HOST TARGET binding site such as BINDING SITE I, BINDING SITE II or BINDING SITE III. Table 2 illustrates the complementarity of the nucleotide sequences of LOC256880 BINDING SITE, designated SEQ ID:46384, to the nucleotide sequence of VGAM738 RNA, herein designated VGAM RNA, also designated SEQ ID:3449.

Another function of VGAM738 is therefore inhibition of LOC256880 (Accession XM_173135). Accordingly, utilities of VGAM738 include diagnosis, prevention and treatment of diseases and clinical conditions associated with LOC256880. LOC90246 (Accession XM_030283) is another VGAM738 host target gene. LOC90246 BINDING SITE is HOST TARGET binding site found in the 3' untranslated region of mRNA encoded by LOC90246, corresponding to a HOST TARGET binding site such as BINDING SITE I, BINDING SITE II or BINDING SITE III. Table 2 illustrates the complementarity of the nucleotide sequences of LOC90246 BINDING SITE, designated SEQ ID:31001, to the nucleotide sequence of VGAM738 RNA, herein designated VGAM RNA, also designated SEQ ID:3449.

Another function of VGAM738 is therefore inhibition of LOC90246 (Accession XM_030283). Accordingly, utilities of VGAM738 include diagnosis, prevention and treatment of diseases and clinical conditions associated with LOC90246. FIG. 1 further provides a conceptual description of a novel bioinformatically detected viral gene of the present invention, referred to here as Viral Genomic Address Messenger 739 (VGAM739) viral gene, which modulates expression of respective host target genes thereof, the function and utility of which host target genes is known in the art.

VGAM739 is a novel bioinformatically detected regulatory, non protein coding, viral micro RNA (miRNA) gene. The method by which VGAM739 was detected is described hereinabove with reference to FIGS. 1-8.

VGAM739 gene, herein designated VGAM GENE, is a viral gene contained in the genome of Taura Syndrome Virus. VGAM739 host target gene, herein designated VGAM HOST TARGET GENE, is a human gene contained in the human genome.

VGAM739 gene encodes a VGAM739 precursor RNA, herein designated VGAM PRECURSOR RNA. Similar to other miRNA genes, and unlike most ordinary genes, VGAM739 precursor RNA does not encode a protein. A nucleotide sequence identical or highly similar to the nucleotide sequence of VGAM739 precursor RNA is designated SEQ ID:725, and is provided hereinbelow with reference to the sequence listing part. Nucleotide sequence SEQ ID:725 is located at position 4695 relative to the genome of Taura Syndrome Virus.

VGAM739 precursor RNA folds onto itself, forming VGAM739 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM739 folded precursor RNA into VGAM739 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM739 RNA is designated SEQ ID:3450, and is provided hereinbelow with reference to the sequence listing part.

VGAM739 host target gene, herein designated VGAM HOST TARGET GENE, encodes a corresponding messenger RNA, VGAM739 host target RNA, herein designated VGAM HOST TARGET RNA. VGAM739 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM739 RNA, herein designated VGAM RNA, binds complementarily to one or more host target binding sites located in untranslated regions of VGAM739 host target RNA, herein designated VGAM HOST TARGET RNA. This complementary binding is due to the fact that the nucleotide sequence of VGAM739 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM739 RNA, herein designated VGAM RNA, may have a different number of host target binding sites in untranslated regions of a VGAM739 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM739 RNA, herein designated VGAM RNA, to host target binding sites on VGAM739 host target RNA, herein designated VGAM HOST TARGET RNA, such as BINDING SITE I, BINDING SITE II and BINDING SITE III, inhibits translation of VGAM739 host target RNA into VGAM739 host target protein, herein designated VGAM HOST TARGET PROTEIN. VGAM host target protein is therefore outlined by a broken line.

It is appreciated that VGAM739 host target gene, herein designated VGAM HOST TARGET GENE, in fact represents a plurality of VGAM739 host target genes. The mRNA of each one of this plurality of VGAM739 host target genes comprises one or more host target binding sites, each having a nucleotide sequence which is at least partly complementary to VGAM739 RNA, herein designated VGAM RNA, and which when bound by VGAM739 RNA causes inhibition of translation of respective one or more VGAM739 host target proteins.

It is further appreciated by one skilled in the art that the mode of translational inhibition illustrated by FIG. 1 with specific reference to translational inhibition exerted by VGAM739 gene, herein designated VGAM GENE, on one or more VGAM739 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM739 is inhibition of expression of host target genes, as part of a novel viral mechanism of attacking a host. Accordingly, utilities of VGAM739 include diagnosis, prevention and treatment of viral infection by Taura Syndrome Virus. Specific functions, and accordingly utilities, of VGAM739 correlate with, and may be deduced from, the identity of the host target genes which VGAM739 binds and inhibits, and the function of these host target genes, as elaborated hereinbelow.

Nucleotide sequences of the VGAM739 precursor RNA, herein designated VGAM PRECURSOR RNA, and of the 'diced' VGAM739 RNA, herein designated VGAM RNA, and a schematic representation of the secondary folding of VGAM739 folded precursor RNA, herein designated VGAM FOLDED PRECURSOR RNA, of VGAM739 are further described hereinbelow with reference to Table 1.

Nucleotide sequences of host target binding sites, such as BINDING SITE-I, BINDING SITE-II and BINDING SITE-III of FIG. 1, found on VGAM739 host target RNA, and schematic representation of the complementarity of each of these host target binding sites to VGAM739 RNA, herein designated VGAM RNA, are described hereinbelow with reference to Table 2.

As mentioned hereinabove with reference to FIG. 1, a function of VGAM739 gene, herein designated VGAM is inhibition of expression of VGAM739 target genes. It is appreciated that specific functions, and accordingly utilities, of VGAM739 correlate with, and may be deduced from, the identity of the target genes which VGAM739 binds and inhibits, and the function of these target genes, as elaborated hereinbelow.

Inhibitor of Kappa Light Polypeptide Gene Enhancer In B-cells, Kinase Gamma (IKBKG, Accession NM_003639) is a VGAM739 host target gene. IKBKG BINDING SITE is HOST TARGET binding site found in the 3' untranslated region of mRNA encoded by IKBKG, corresponding to a HOST TARGET binding site such as BINDING SITE I, BINDING SITE II or BINDING SITE III. Table 2 illustrates the complementarity of the nucleotide sequences of IKBKG BINDING SITE, designated SEQ ID:9712, to the nucleotide sequence of VGAM739 RNA, herein designated VGAM RNA, also designated SEQ ID:3450.

A function of VGAM739 is therefore inhibition of Inhibitor of Kappa Light Polypeptide Gene Enhancer In B-cells, Kinase Gamma (IKBKG, Accession NM_003639), a gene which regulatory subunit part of the ikk-signalosome complex activation. also considered to be a mediator for tax activation of nf-kappa-b. could be implicated in nf-kappa-b-mediated protection from cytokine toxicity. Accordingly, utilities of VGAM739 include diagnosis, prevention and treatment of diseases and clinical conditions associated with IKBKG. The function of IKBKG and its association with various diseases and clinical conditions, has been established by previous studies, as described hereinabove with reference to VGAM471. Mdm4, Transformed 3T3 Cell Double Minute 4, P53 Binding Protein (mouse) (MDM4, Accession NM_002393) is another VGAM739 host target gene. MDM4 BINDING SITE is HOST TARGET binding site found in the 3' untranslated region of mRNA encoded by MDM4, corresponding to a HOST TARGET binding site such as BINDING SITE I, BINDING SITE II or BINDING SITE III. Table 2 illustrates the complementarity of the nucleotide sequences of MDM4 BINDING SITE, designated SEQ ID:8209, to the nucleotide sequence of VGAM739 RNA, herein designated VGAM RNA, also designated SEQ ID:3450.

Another function of VGAM739 is therefore inhibition of Mdm4, Transformed 3T3 Cell Double Minute 4, P53 Binding Protein (mouse) (MDM4, Accession NM_002393), a gene which Strongly similar to murine Mdm4; may interact with p53. Accordingly, utilities of VGAM739 include diagnosis, prevention and treatment of diseases and clinical conditions associated with MDM4. The function of MDM4 has been established by previous studies. Shvarts et al. (1997) isolated cDNAs encoding MDM4 by screening a human cDNA library from a colonic tumorigenic cell line with a mouse mdmx probe. The human MDM4 gene encodes a 490-amino acid protein containing a RING finger domain and a putative nuclear localization signal. The predicted mass of the protein was 54 kD, while the observed mass was 80 kD, a difference which Shvarts et al. (1997) stated was probably due to phosphorylation or other posttranslational modification. Northern blot analysis revealed a 10-kb mRNA expressed at a high level in thymus and at lower levels in all other tissues tested. A 2.2-kb mRNA was detected in testis. MDM4 protein produced by in vitro translation interacts with p53 (OMIM Ref. No. 191170) via a binding domain located in the N-terminal region of the MDM4 protein. MDM4 shows significant structural similarity to p53-binding protein MDM2 (OMIM Ref. No. 164785), an E3 ubiquitin ligase. The interaction between MDM2 and p53 is critical for cell viability; loss of Mdm2 causes cell death in vitro and in vivo in a p53-dependent manner. MDM4 has some of the same properties as MDM2, but unlike MDM2, it does not cause nuclear export or degradation of p53. To study MDM4 function in vivo, Parant et al. (2001) deleted the Mdm4 gene in mice. Mdm4-null mice died at 7.5 to 8.5 days postcoitum due to loss of cell proliferation. When Parant et al. (2001) crossed in a p53-null allele, they found that loss of p53 completely rescued the Mdm4 -/- embryonic lethality. Thus, MDM2 and MDM4 are nonoverlapping critical regulators of p53 in vivo. These data defined a new pathway of p53 regulation and raised the possibility that increased MDM4 levels and the resulting inactivation of p53 contribute to the development of human tumors. By fluorescence in situ hybridization, Shvarts et al. (1997) mapped the MDM4 gene to human chromosome 1q32.

Full details of the abovementioned studies are described in the following publications, the disclosure of which are hereby incorporated by reference:

Parant, J.; Chavez-Reyes, A.; Little, N. A.; Yan, W.; Reinke, V.; Jochemsen, A. G.; Lozano, G.: Rescue of embryonic lethality in Mdm4-null mice by loss of Trp53 suggests a nonoverlapping pathway with MDM2 to regulate p53. Nature Genet. 29:92-95, 2001; and Shvarts, A.; Bazuine, M.; Dekker, P.; Ramos, Y. F. M.; Steegenga, W. T.; Merckx, G.; van Ham, R. C. A.; van der Houven van Oordt, W.; van der Eb, A. J.; Jochemsen, A. G.: Isolation an.

Further studies establishing the function and utilities of MDM4 are found in John Hopkins OMIM database record ID 602704, and in sited publications numbered 1046-1047 listed in the bibliography section hereinbelow, which are also hereby incorporated by reference. Protein Phosphatase 2 (formerly 2A), Catalytic Subunit, Alpha Isoform (PPP2CA, Accession NM_002715) is another VGAM739 host target gene. PPP2CA BINDING SITE is HOST TARGET binding site found in the 3' untranslated region of mRNA encoded by PPP2CA, corresponding to a HOST TARGET binding site such as BINDING SITE I, BINDING SITE II or BINDING SITE III. Table 2 illustrates the complementarity of the nucleotide sequences of PPP2CA BINDING SITE, designated SEQ ID:8582, to the nucleotide sequence of VGAM739 RNA, herein designated VGAM RNA, also designated SEQ ID:3450.

Another function of VGAM739 is therefore inhibition of Protein Phosphatase 2 (formerly 2A), Catalytic Subunit, Alpha Isoform (PPP2CA, Accession NM_002715), a gene which plays a role in the regulation of most major metabolic pathways. Accordingly, utilities of VGAM739 include diagnosis, prevention and treatment of diseases and clinical conditions associated with PPP2CA. The function of PPP2CA and its association with various diseases and clinical conditions, has been established by previous studies, as described hereinabove with reference to VGAM399. Synaptotagmin I (SYT1, Accession NM_005639) is another VGAM739 host target gene. SYT1 BINDING SITE is HOST TARGET binding site found in the 3' untranslated region of mRNA encoded by SYT1, corresponding to a HOST TARGET binding site such as BINDING SITE I, BINDING SITE II or BINDING SITE III. Table 2 illustrates the complementarity of the nucleotide sequences of SYT1 BINDING SITE, designated SEQ ID:12173, to the nucleotide sequence of VGAM739 RNA, herein designated VGAM RNA, also designated SEQ ID:3450.

Another function of VGAM739 is therefore inhibition of Synaptotagmin I (SYT1, Accession NM_005639), a gene which may have a regulatory role in the membrane interactions during trafficking of synaptic vesicles at the active zone of the synapse. Accordingly, utilities of VGAM739 include diagnosis, prevention and treatment of diseases and clinical conditions associated with SYT1. The function of SYT1 has been established by previous studies. Perin et al. (1991) characterized full-length cDNAs encoding human and Drosophila synaptotagmins. Similarity of the phospholipid binding properties of the cytoplasmic domains of rat, human, and Drosophila synaptotagmins and selective conservation of the sequences that are homologous to protein kinase C (see OMIM Ref. No. 176960) suggested that these may be involved in phospholipid binding. Neurons release neurotransmitters by calcium-dependent exocytosis of synaptic vesicles. Brose et al. (1992) reported that synaptotagmin, a highly conserved synaptic vesicle protein, binds calcium at physiologic concentrations in a complex with negatively charged phospholipids. This binding is specific for calcium and involves the cytoplasmic domain of synaptotagmin. Calcium binding is dependent on the intact oligomeric structure of synaptotagmin; it is abolished by proteolytic cleavage at a single site. Brose et al. (1992) interpreted the results as suggesting that synaptotagmin acts as a cooperative calcium receptor in exocytosis. Synaptotagmin contains 2 copies of a sequence that is homologous to the regulatory region of protein kinase C (OMIM Ref. No. 176960).

Full details of the abovementioned studies are described in the following publications, the disclosure of which are hereby incorporated by reference:

Brose, N.; Petrenko, A. G.; Sudhof, T. C.; Jahn, R.: Synaptotagmin: a calcium sensor on the synaptic vesicle surface. Science 256:1021-1025, 1992; and Perin, M. S.; Johnston, P. A.; Ozcelik, T.; Jahn, R.; Francke, U.; Sudhof, T. C. : Structural and functional conservation of synaptotagmin (p65) in Drosophila and human S. J. Biol. Chem.

Further studies establishing the function and utilities of SYT1 are found in John Hopkins OMIM database record ID 185605, and in sited publications numbered 1569-1580 listed in the bibliography section hereinbelow, which are also hereby incorporated by reference. FLJ22167 (Accession NM_024533) is another VGAM739 host target gene.

FLJ22167 BINDING SITE is HOST TARGET binding site found in the 5' untranslated region of mRNA encoded by FLJ22167, corresponding to a HOST TARGET binding site such as BINDING SITE I, BINDING SITE II or BINDING SITE III. Table 2 illustrates the complementarity of the nucleotide sequences of FLJ22167 BINDING SITE, designated SEQ ID:23739, to the nucleotide sequence of VGAM739 RNA, herein designated VGAM RNA, also designated SEQ ID:3450.

Another function of VGAM739 is therefore inhibition of FLJ22167 (Accession NM_024533). Accordingly, utilities of VGAM739 include diagnosis, prevention and treatment of diseases and clinical conditions associated with FLJ22167. General Transcription Factor IIE, Polypeptide 1, Alpha 56kDa (GTF2E1, Accession NM_005513) is another VGAM739 host target gene. GTF2E1 BINDING SITE is HOST TARGET binding site found in the 3' untranslated region of mRNA encoded by GTF2E1, corresponding to a HOST TARGET binding site such as BINDING SITE I, BINDING SITE II or BINDING SITE III. Table 2 illustrates the complementarity of the nucleotide sequences of GTF2E1 BINDING SITE, designated SEQ ID:12039, to the nucleotide sequence of VGAM739 RNA, herein designated VGAM RNA, also designated SEQ ID:3450.

Another function of VGAM739 is therefore inhibition of General Transcription Factor IIE, Polypeptide 1, Alpha 56 kDa (GTF2E1, Accession NM_005513). Accordingly, utilities of VGAM739 include diagnosis, prevention and treatment of diseases and clinical conditions associated with GTF2E1. KIAA0186 (Accession NM_021067) is another VGAM739 host target gene. KIAA0186 BINDING SITE is HOST TARGET binding site found in the 3' untranslated region of mRNA encoded by KIAA0186, corresponding to a HOST TARGET binding site such as BINDING SITE I, BINDING SITE II or BINDING SITE III. Table 2 illustrates the complementarity of the nucleotide sequences of KIAA0186 BINDING SITE, designated SEQ ID:22041, to the nucleotide sequence of VGAM739 RNA, herein designated VGAM RNA, also designated SEQ ID:3450.

Another function of VGAM739 is therefore inhibition of KIAA0186 (Accession NM_021067). Accordingly, utilities of VGAM739 include diagnosis, prevention and treatment of diseases and clinical conditions associated with KIAA0186. KIAA1610 (Accession XM_040622) is another VGAM739 host target gene. KIAA1610 BINDING SITE is HOST TARGET binding site found in the 3' untranslated region of mRNA encoded by KIAA1610, corresponding to a HOST TARGET binding site such as BINDING SITE I, BINDING SITE II or BINDING SITE III. Table 2 illustrates the complementarity of the nucleotide sequences of KIAA1610 BINDING SITE, designated SEQ ID:33343, to the nucleotide sequence of VGAM739 RNA, herein designated VGAM RNA, also designated SEQ ID:3450.

Another function of VGAM739 is therefore inhibition of KIAA1610 (Accession XM_040622). Accordingly, utilities of VGAM739 include diagnosis, prevention and treatment of diseases and clinical conditions associated with KIAA1610. PRO2012 (Accession NM_018614) is another VGAM739 host target gene. PRO2012 BINDING SITE is HOST TARGET binding site found in the 3' untranslated region of mRNA encoded by PRO2012, corresponding to a HOST TARGET binding site such as BINDING SITE I, BINDING SITE II or BINDING SITE III. Table 2 illustrates the complementarity of the nucleotide sequences of PRO2012 BINDING SITE, designated SEQ ID:20683, to the nucleotide sequence of VGAM739 RNA, herein designated VGAM RNA, also designated SEQ ID:3450.

Another function of VGAM739 is therefore inhibition of PRO2012 (Accession NM_018614). Accordingly, utilities of VGAM739 include diagnosis, prevention and treatment of diseases and clinical conditions associated with PRO2012. LOC145758 (Accession XM_096858) is another VGAM739 host target gene. LOC145758 BINDING SITE is HOST TARGET binding site found in the 5' untranslated region of mRNA encoded by LOC145758, corresponding to a HOST TARGET binding site such as BINDING SITE I, BINDING SITE II or BINDING SITE III. Table 2 illustrates the complementarity of the nucleotide sequences of LOC145758 BINDING SITE, designated SEQ ID:40588, to the nucleotide sequence of VGAM739 RNA, herein designated VGAM RNA, also designated SEQ ID:3450.

Another function of VGAM739 is therefore inhibition of LOC145758 (Accession XM_096858). Accordingly, utilities of VGAM739 include diagnosis, prevention and treatment of diseases and clinical conditions associated with LOC145758. LOC149506 (Accession XM_097661) is another VGAM739 host target gene. LOC149506 BINDING SITE is HOST TARGET binding site found in the 3' untranslated region of mRNA encoded by LOC149506, corresponding to a HOST TARGET binding site such as BINDING SITE I, BINDING SITE II or BINDING SITE III. Table 2 illustrates the complementarity of the nucleotide sequences of LOC149506 BINDING SITE, designated SEQ ID:41011, to the nucleotide sequence of VGAM739 RNA, herein designated VGAM RNA, also designated SEQ ID:3450.

Another function of VGAM739 is therefore inhibition of LOC149506 (Accession XM_097661). Accordingly, utilities of VGAM739 include diagnosis, prevention and treatment of diseases and clinical conditions associated with LOC149506. LOC158014 (Accession XM_088442) is another VGAM739 host target gene. LOC158014 BINDING SITE is HOST TARGET binding site found in the 5' untranslated region of mRNA encoded by LOC158014, corresponding to a HOST TARGET binding site such as BINDING SITE I, BINDING SITE II or BINDING SITE III. Table 2 illustrates the complementarity of the nucleotide sequences of LOC158014 BINDING SITE, designated SEQ ID:39697, to the nucleotide sequence of VGAM739 RNA, herein designated VGAM RNA, also designated SEQ ID:3450.

Another function of VGAM739 is therefore inhibition of LOC158014 (Accession XM_088442). Accordingly, utilities of VGAM739 include diagnosis, prevention and treatment of diseases and clinical conditions associated with LOC158014. LOC202316 (Accession XM_117380) is another VGAM739 host target gene. LOC202316 BINDING SITE is HOST TARGET binding site found in the 3' untranslated region of mRNA encoded by LOC202316, corresponding to a HOST TARGET binding site such as BINDING SITE I, BINDING SITE II or BINDING SITE III. Table 2 illustrates the complementarity of the nucleotide sequences of LOC202316 BINDING SITE, designated SEQ ID:43428, to the nucleotide sequence of VGAM739 RNA, herein designated VGAM RNA, also designated SEQ ID:3450.

Another function of VGAM739 is therefore inhibition of LOC202316 (Accession XM_117380). Accordingly, utilities of VGAM739 include diagnosis, prevention and treatment of diseases and clinical conditions associated with LOC202316. LOC254196 (Accession XM_173220) is another VGAM739 host target gene. LOC254196 BINDING SITE is HOST TARGET binding site found in the 3' untranslated region of mRNA encoded by LOC254196, corresponding to a HOST TARGET binding site such as BINDING SITE I, BINDING SITE II or BINDING SITE III. Table 2 illustrates the complementarity of the nucleotide sequences of LOC254196 BIND- ING SITE, designated SEQ ID:46478, to the nucleotide sequence of VGAM739 RNA, herein designated VGAM RNA, also designated SEQ ID:3450.

Another function of VGAM739 is therefore inhibition of LOC254196 (Accession XM_173220). Accordingly, utilities of VGAM739 include diagnosis, prevention and treatment of diseases and clinical conditions associated with LOC254196. LOC90538 (Accession XM_032401) is another VGAM739 host target gene. LOC90538 BINDING SITE is HOST TARGET binding site found in the 3' untranslated region of mRNA encoded by LOC90538, corresponding to a HOST TARGET binding site such as BINDING SITE I, BINDING SITE II or BINDING SITE III. Table 2 illustrates the complementarity of the nucleotide sequences of LOC90538 BINDING SITE, designated SEQ ID:31661, to the nucleotide sequence of VGAM739 RNA, herein designated VGAM RNA, also designated SEQ ID:3450.

Another function of VGAM739 is therefore inhibition of LOC90538 (Accession XM_032401). Accordingly, utilities of VGAM739 include diagnosis, prevention and treatment of diseases and clinical conditions associated with LOC90538. LOC91585 (Accession XM_039395) is another VGAM739 host target gene. LOC91585 BINDING SITE is HOST TARGET binding site found in the 3' untranslated region of mRNA encoded by LOC91585, corresponding to a HOST TARGET binding site such as BINDING SITE I, BINDING SITE II or BINDING SITE III. Table 2 illustrates the complementarity of the nucleotide sequences of LOC91585 BINDING SITE, designated SEQ ID:33078, to the nucleotide sequence of VGAM739 RNA, herein designated VGAM RNA, also designated SEQ ID:3450.

Another function of VGAM739 is therefore inhibition of LOC91585 (Accession XM_039395). Accordingly, utilities of VGAM739 include diagnosis, prevention and treatment of diseases and clinical conditions associated with LOC91585. FIG. 1 further provides a conceptual description of a novel bioinformatically detected viral gene of the present invention, referred to here as Viral Genomic Address Messenger 740 (VGAM740) viral gene, which modulates expression of respective host target genes thereof, the function and utility of which host target genes is known in the art.

VGAM740 is a novel bioinformatically detected regulatory, non protein coding, viral micro RNA (miRNA) gene. The method by which VGAM740 was detected is described hereinabove with reference to FIGS. 1-8.

VGAM740 gene, herein designated VGAM GENE, is a viral gene contained in the genome of Taura Syndrome Virus. VGAM740 host target gene, herein designated VGAM HOST TARGET GENE, is a human gene contained in the human genome.

VGAM740 gene encodes a VGAM740 precursor RNA, herein designated VGAM PRECURSOR RNA. Similar to other miRNA genes, and unlike most ordinary genes, VGAM740 precursor RNA does not encode a protein. A nucleotide sequence identical or highly similar to the nucleotide sequence of VGAM740 precursor RNA is designated SEQ ID:726, and is provided hereinbelow with reference to the sequence listing part. Nucleotide sequence SEQ ID:726 is located at position 5382 relative to the genome of Taura Syndrome Virus.

VGAM740 precursor RNA folds onto itself, forming VGAM740 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or a partial inversed-reversed sequence of the nucleotide sequence of the second half thereof.

An enzyme complex designated DICER COMPLEX, 'dices' the VGAM740 folded precursor RNA into VGAM740 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM740 RNA is designated SEQ ID:3451, and is provided hereinbelow with reference to the sequence listing part.

VGAM740 host target gene, herein designated VGAM HOST TARGET GENE, encodes a corresponding messenger RNA, VGAM740 host target RNA, herein designated VGAM HOST TARGET RNA. VGAM740 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM740 RNA, herein designated VGAM RNA, binds complementarily to one or more host target binding sites located in untranslated regions of VGAM740 host target RNA, herein designated VGAM HOST TARGET RNA. This complementary binding is due to the fact that the nucleotide sequence of VGAM740 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM740 RNA, herein designated VGAM RNA, may have a different number of host target binding sites in untranslated regions of a VGAM740 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM740 RNA, herein designated VGAM RNA, to host target binding sites on VGAM740 host target RNA, herein designated VGAM HOST TARGET RNA, such as BINDING SITE I, BINDING SITE II and BINDING SITE III, inhibits translation of VGAM740 host target RNA into VGAM740 host target protein, herein designated VGAM HOST TARGET PROTEIN. VGAM host target protein is therefore outlined by a broken line.

It is appreciated that VGAM740 host target gene, herein designated VGAM HOST TARGET GENE, in fact represents a plurality of VGAM740 host target genes. The mRNA of each one of this plurality of VGAM740 host target genes comprises one or more host target binding sites, each having a nucleotide sequence which is at least partly complementary to VGAM740 RNA, herein designated VGAM RNA, and which when bound by VGAM740 RNA causes inhibition of translation of respective one or more VGAM740 host target proteins.

It is further appreciated by one skilled in the art that the mode of translational inhibition illustrated by FIG. 1 with specific reference to translational inhibition exerted by VGAM740 gene, herein designated VGAM GENE, on one or more VGAM740 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM740 is inhibition of expression of host target genes, as part of a novel viral mechanism of attacking a host. Accordingly, utilities of VGAM740 include diagnosis, prevention and treatment of viral infection by Taura Syndrome Virus. Specific functions, and accordingly utilities, of VGAM740 correlate with, and may be deduced from, the identity of the host target genes which VGAM740 binds and inhibits, and the function of these host target genes, as elaborated hereinbelow.

Nucleotide sequences of the VGAM740 precursor RNA, herein designated VGAM PRECURSOR RNA, and of the 'diced' VGAM740 RNA, herein designated VGAM RNA, and a schematic representation of the secondary folding of VGAM740 folded precursor RNA, herein designated VGAM FOLDED PRECURSOR RNA, of VGAM740 are further described hereinbelow with reference to Table 1.

Nucleotide sequences of host target binding sites, such as BINDING SITE-I, BINDING SITE-II and BINDING SITE-III of FIG. 1, found on VGAM740 host target RNA, and schematic representation of the complementarity of each of these host target binding sites to VGAM740 RNA, herein designated VGAM RNA, are described hereinbelow with reference to Table 2.

As mentioned hereinabove with reference to FIG. 1, a function of VGAM740 gene, herein designated VGAM is inhibition of expression of VGAM740 target genes. It is appreciated that specific functions, and accordingly utilities, of VGAM740 correlate with, and may be deduced from, the identity of the target genes which VGAM740 binds and inhibits, and the function of these target genes, as elaborated hereinbelow.

FLJ13322 (Accession NM_024722) is a VGAM740 host target gene. FLJ13322 BINDING SITE is HOST TARGET binding site found in the 3' untranslated region of mRNA encoded by FLJ13322, corresponding to a HOST TARGET binding site such as BINDING SITE I, BINDING SITE II or BINDING SITE III. Table 2 illustrates the complementarity of the nucleotide sequences of FLJ13322 BINDING SITE, designated SEQ ID:24057, to the nucleotide sequence of VGAM740 RNA, herein designated VGAM RNA, also designated SEQ ID:3451.

A function of VGAM740 is therefore inhibition of FLJ13322 (Accession NM_024722). Accordingly, utilities of VGAM740 include diagnosis, prevention and treatment of diseases and clinical conditions associated with FLJ13322. MGC9912 (Accession NM_080664) is another VGAM740 host target gene. MGC9912 BINDING SITE is HOST TARGET binding site found in the 3' untranslated region of mRNA encoded by MGC9912, corresponding to a HOST TARGET binding site such as BINDING SITE I, BINDING SITE II or BINDING SITE III. Table 2 illustrates the complementarity of the nucleotide sequences of MGC9912 BINDING SITE, designated SEQ ID:27950, to the nucleotide sequence of VGAM740 RNA, herein designated VGAM RNA, also designated SEQ ID:3451.

Another function of VGAM740 is therefore inhibition of MGC9912 (Accession NM_080664). Accordingly, utilities of VGAM740 include diagnosis, prevention and treatment of diseases and clinical conditions associated with MGC9912. Nuclear Transcription Factor, X-box Binding 1 (NFX1, Accession NM_002504) is another VGAM740 host target gene. NFX1 BINDING SITE is HOST TARGET binding site found in the 3' untranslated region of mRNA encoded by NFX1, corresponding to a HOST TARGET binding site such as BINDING SITE I, BINDING SITE II or BINDING SITE III. Table 2 illustrates the complementarity of the nucleotide sequences of NFX1 BINDING SITE, designated SEQ ID:8326, to the nucleotide sequence of VGAM740 RNA, herein designated VGAM RNA, also designated SEQ ID:3451.

Another function of VGAM740 is therefore inhibition of Nuclear Transcription Factor, X-box Binding 1 (NFX1, Accession NM_002504). Accordingly, utilities of VGAM740 include diagnosis, prevention and treatment of diseases and clinical conditions associated with NFX1. Ribosomal Protein S6 Kinase, 90 kDa, Polypeptide 4 (RPS6KA4, Accession NM_003942) is another VGAM740 host target gene. RPS6KA4 BINDING SITE is HOST TARGET binding site found in the 3' untranslated region of mRNA encoded by RPS6KA4, corresponding to a HOST TARGET binding site such as BINDING SITE I, BINDING SITE II or BINDING SITE III. Table 2 illustrates the complementarity of the nucleotide sequences of RPS6KA4 BINDING SITE, designated SEQ ID:10056, to the nucleotide sequence of VGAM740 RNA, herein designated VGAM RNA, also designated SEQ ID:3451.

Another function of VGAM740 is therefore inhibition of Ribosomal Protein S6 Kinase, 90 kDa, Polypeptide 4 (RPS6KA4, Accession NM_003942). Accordingly, utilities of VGAM740 include diagnosis, prevention and treatment of diseases and clinical conditions associated with RPS6KA4. LOC255027 (Accession XM_170806) is another VGAM740 host target gene. LOC255027 BINDING SITE is HOST TARGET binding site found in the 3' untranslated region of mRNA encoded by LOC255027, corresponding to a HOST TARGET binding site such as BINDING SITE I, BINDING SITE II or BINDING SITE III. Table 2 illustrates the complementarity of the nucleotide sequences of LOC255027 BINDING SITE, designated SEQ ID:45571, to the nucleotide sequence of VGAM740 RNA, herein designated VGAM RNA, also designated SEQ ID:3451.

Another function of VGAM740 is therefore inhibition of LOC255027 (Accession XM_170806). Accordingly, utilities of VGAM740 include diagnosis, prevention and treatment of diseases and clinical conditions associated with LOC255027. FIG. 1 further provides a conceptual description of a novel bioinformatically detected viral gene of the present invention, referred to here as Viral Genomic Address Messenger 741 (VGAM741) viral gene, which modulates expression of respective host target genes thereof, the function and utility of which host target genes is known in the art.

VGAM741 is a novel bioinformatically detected regulatory, non protein coding, viral micro RNA (miRNA) gene. The method by which VGAM741 was detected is described hereinabove with reference to FIGS. 1-8.

VGAM741 gene, herein designated VGAM GENE, is a viral gene contained in the genome of Taura Syndrome Virus. VGAM741 host target gene, herein designated VGAM HOST TARGET GENE, is a human gene contained in the human genome.

VGAM741 gene encodes a VGAM741 precursor RNA, herein designated VGAM PRECURSOR RNA. Similar to other miRNA genes, and unlike most ordinary genes, VGAM741 precursor RNA does not encode a protein. A nucleotide sequence identical or highly similar to the nucleotide sequence of VGAM741 precursor RNA is designated SEQ ID:727, and is provided hereinbelow with reference to the sequence listing part. Nucleotide sequence SEQ ID:727 is located at position 2942 relative to the genome of Taura Syndrome Virus.

VGAM741 precursor RNA folds onto itself, forming VGAM741 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM741 folded precursor RNA into VGAM741 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM741 RNA is designated SEQ ID:3452, and is provided hereinbelow with reference to the sequence listing part.

VGAM741 host target gene, herein designated VGAM HOST TARGET GENE, encodes a corresponding messenger RNA, VGAM741 host target RNA, herein designated VGAM HOST TARGET RNA. VGAM741 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM741 RNA, herein designated VGAM RNA, binds complementarily to one or more host target binding sites located in untranslated regions of VGAM741 host target RNA, herein designated VGAM HOST TARGET RNA. This complementary binding is due to the fact that the nucleotide sequence of VGAM741 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM741 RNA, herein designated VGAM RNA, may have a different number of host target binding sites in untranslated regions of a VGAM741 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM741 RNA, herein designated VGAM RNA, to host target binding sites on VGAM741 host target RNA, herein designated VGAM HOST TARGET RNA, such as BINDING SITE I, BINDING SITE II and BINDING SITE III, inhibits translation of VGAM741 host target RNA into VGAM741 host target protein, herein designated VGAM HOST TARGET PROTEIN. VGAM host target protein is therefore outlined by a broken line.

It is appreciated that VGAM741 host target gene, herein designated VGAM HOST TARGET GENE, in fact represents a plurality of VGAM741 host target genes. The mRNA of each one of this plurality of VGAM741 host target genes comprises one or more host target binding sites, each having a nucleotide sequence which is at least partly complementary to VGAM741 RNA, herein designated VGAM RNA, and which when bound by VGAM741 RNA causes inhibition of translation of respective one or more VGAM741 host target proteins.

It is further appreciated by one skilled in the art that the mode of translational inhibition illustrated by FIG. 1 with specific reference to translational inhibition exerted by VGAM741 gene, herein designated VGAM GENE, on one or more VGAM741 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM741 is inhibition of expression of host target genes, as part of a novel viral mechanism of attacking a host. Accordingly, utilities of VGAM741 include diagnosis, prevention and treatment of viral infection by Taura Syndrome Virus. Specific functions, and accordingly utilities, of VGAM741 correlate with, and may be deduced from, the identity of the host target genes which VGAM741 binds and inhibits, and the function of these host target genes, as elaborated hereinbelow.

Nucleotide sequences of the VGAM741 precursor RNA, herein designated VGAM PRECURSOR RNA, and of the 'diced' VGAM741 RNA, herein designated VGAM RNA, and a schematic representation of the secondary folding of VGAM741 folded precursor RNA, herein designated VGAM FOLDED PRECURSOR RNA, of VGAM741 are further described hereinbelow with reference to Table 1.

Nucleotide sequences of host target binding sites, such as BINDING SITE-I, BINDING SITE-II and BINDING SITE-III of FIG. 1, found on VGAM741 host target RNA, and schematic representation of the complementarity of each of these host target binding sites to VGAM741 RNA, herein designated VGAM RNA, are described hereinbelow with reference to Table 2.

As mentioned hereinabove with reference to FIG. 1, a function of VGAM741 gene, herein designated VGAM is inhibition of expression of VGAM741 target genes. It is appreciated that specific functions, and accordingly utilities, of VGAM741 correlate with, and may be deduced from, the identity of the target genes which VGAM741 binds and inhibits, and the function of these target genes, as elaborated hereinbelow.

Beta-site APP-cleaving Enzyme (BACE, Accession NM_012104) is a VGAM741 host target gene. BACE BINDING SITE1 and BACE BINDING SITE2 are HOST TARGET binding sites found in untranslated regions of mRNA encoded by BACE, corresponding to HOST TARGET binding sites such as BINDING SITE I, BINDING SITE II or BINDING SITE III. Table 2 illustrates the complementarity of the nucleotide sequences of BACE BINDING SITE1 and BACE BINDING SITE2, designated SEQ ID:14415 and SEQ ID:29083 respectively, to the nucleotide sequence of VGAM741 RNA, herein designated VGAM RNA, also designated SEQ ID:3452.

A function of VGAM741 is therefore inhibition of Beta-site APP-cleaving Enzyme (BACE, Accession NM_012104), a gene which is responsible for the proteolytic processing of the amyloid precursor protein. Accordingly, utilities of VGAM741 include diagnosis, prevention and treatment of diseases and clinical conditions associated with BACE. The function of BACE and its association with various diseases and clinical conditions, has been established by previous studies, as described hereinabove with reference to VGAM173. Smoothened Homolog (Drosophila) (SMOH, Accession NM_005631) is another VGAM741 host target gene. SMOH BINDING SITE is HOST TARGET binding site found in the 3' untranslated region of mRNA encoded by SMOH, corresponding to a HOST TARGET binding site such as BINDING SITE I, BINDING SITE II or BINDING SITE III. Table 2 illustrates the complementarity of the nucleotide sequences of SMOH BINDING SITE, designated SEQ ID:12162, to the nucleotide sequence of VGAM741 RNA, herein designated VGAM RNA, also designated SEQ ID:3452.

Another function of VGAM741 is therefore inhibition of Smoothened Homolog (Drosophila) (SMOH, Accession NM_005631). Accordingly, utilities of VGAM741 include diagnosis, prevention and treatment of diseases and clinical conditions associated with SMOH. HSA243666 (Accession NM_017582) is another VGAM741 host target gene. HSA243666 BINDING SITE is HOST TARGET binding site found in the 3' untranslated region of mRNA encoded by HSA243666, corresponding to a HOST TARGET binding site such as BINDING SITE I, BINDING SITE II or BINDING SITE III. Table 2 illustrates the complementarity of the nucleotide sequences of HSA243666 BINDING SITE, designated SEQ ID:19018, to the nucleotide sequence of VGAM741 RNA, herein designated VGAM RNA, also designated SEQ ID:3452.

Another function of VGAM741 is therefore inhibition of HSA243666 (Accession NM_017582). Accordingly, utilities of VGAM741 include diagnosis, prevention and treatment of diseases and clinical conditions associated with HSA243666. LHPP (Accession NM_022126) is another VGAM741 host target gene. LHPP BINDING SITE is HOST TARGET binding site found in the 3' untranslated region of mRNA encoded by LHPP, corresponding to a HOST TARGET binding site such as BINDING SITE I, BINDING SITE II or BINDING SITE III. Table 2 illustrates the complementarity of the nucleotide sequences of LHPP BINDING SITE, designated SEQ ID:22672, to the nucleotide sequence of VGAM741 RNA, herein designated VGAM RNA, also designated SEQ ID:3452.

Another function of VGAM741 is therefore inhibition of LHPP (Accession NM_022126). Accordingly, utilities of VGAM741 include diagnosis, prevention and treatment of diseases and clinical conditions associated with LHPP. RIP60 (Accession NM_013400) is another VGAM741 host target gene. RIP60 BINDING SITE is HOST TARGET binding site found in the 3' untranslated region of mRNA encoded by RIP60, corresponding to a HOST TARGET binding site such as BINDING SITE I, BINDING SITE II or BINDING SITE III. Table 2 illustrates the complementarity of the nucleotide sequences of RIP60 BINDING SITE, designated SEQ ID:15058, to the nucleotide sequence of VGAM741 RNA, herein designated VGAM RNA, also designated SEQ ID:3452.

Another function of VGAM741 is therefore inhibition of RIP60 (Accession NM_013400). Accordingly, utilities of VGAM741 include diagnosis, prevention and treatment of diseases and clinical conditions associated with RIP60. LOC123624 (Accession XM_063761) is another VGAM741 host target gene. LOC123624 BINDING SITE is HOST TARGET binding site found in the 3' untranslated region of mRNA encoded by LOC123624, corresponding to a HOST TARGET binding site such as BINDING SITE I, BINDING SITE II or BINDING SITE III. Table 2 illustrates the complementarity of the nucleotide sequences of LOC123624 BINDING SITE, designated SEQ ID:37253, to the nucleotide sequence of VGAM741 RNA, herein designated VGAM RNA, also designated SEQ ID:3452.

Another function of VGAM741 is therefore inhibition of LOC123624 (Accession XM_063761). Accordingly, utilities of VGAM741 include diagnosis, prevention and treatment of diseases and clinical conditions associated with LOC123624. LOC131873 (Accession XM_067585) is another VGAM741 host target gene. LOC131873 BINDING SITE is HOST TARGET binding site found in the 5' untranslated region of mRNA encoded by LOC131873, corresponding to a HOST TARGET binding site such as BINDING SITE I, BINDING SITE II or BINDING SITE III. Table 2 illustrates the complementarity of the nucleotide sequences of LOC131873 BINDING SITE, designated SEQ ID:37361, to the nucleotide sequence of VGAM741 RNA, herein designated VGAM RNA, also designated SEQ ID:3452.

Another function of VGAM741 is therefore inhibition of LOC131873 (Accession XM_067585). Accordingly, utilities of VGAM741 include diagnosis, prevention and treatment of diseases and clinical conditions associated with LOC131873. LOC150174 (Accession XM_086802) is another VGAM741 host target gene. LOC150174 BINDING SITE is HOST TARGET binding site found in the 3' untranslated region of mRNA encoded by LOC150174, corresponding to a HOST TARGET binding site such as BINDING SITE I, BINDING SITE II or BINDING SITE III. Table 2 illustrates the complementarity of the nucleotide sequences of LOC150174 BINDING SITE, designated SEQ ID:38869, to the nucleotide sequence of VGAM741 RNA, herein designated VGAM RNA, also designated SEQ ID:3452.

Another function of VGAM741 is therefore inhibition of LOC150174 (Accession XM_086802). Accordingly, utilities of VGAM741 include diagnosis, prevention and treatment of diseases and clinical conditions associated with LOC150174. LOC151979 (Accession XM_087354) is another VGAM741 host target gene. LOC151979 BINDING SITE is HOST TARGET binding site found in the 5' untranslated region of mRNA encoded by LOC151979, corresponding to a HOST TARGET binding site such as BINDING SITE I, BINDING SITE II or BINDING SITE III. Table 2 illustrates the complementarity of the nucleotide sequences of LOC151979 BINDING SITE, designated SEQ ID:39189, to the nucleotide sequence of VGAM741 RNA, herein designated VGAM RNA, also designated SEQ ID:3452.

Another function of VGAM741 is therefore inhibition of LOC151979 (Accession XM_087354). Accordingly, utilities of VGAM741 include diagnosis, prevention and treatment of diseases and clinical conditions associated with LOC151979. LOC219397 (Accession XM_167889) is another VGAM741 host target gene. LOC219397 BINDING SITE is HOST TARGET binding site found in the 3' untranslated region of mRNA encoded by LOC219397, corresponding to a HOST TARGET binding site such as BINDING SITE I, BINDING SITE II or BINDING SITE III. Table 2 illustrates the complementarity of the nucleotide sequences of LOC219397 BINDING SITE, designated SEQ ID:44898, to the nucleotide sequence of VGAM741 RNA, herein designated VGAM RNA, also designated SEQ ID:3452.

Another function of VGAM741 is therefore inhibition of LOC219397 (Accession XM_167889). Accordingly, utilities of VGAM741 include diagnosis, prevention and treatment of diseases and clinical conditions associated with LOC219397.

LOC256158 (Accession XM_175125) is another VGAM741 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46617, to the nucleotide sequence of VGAM741 RNA, herein designated VGAM RNA, also designated SEQ ID:3452.

Another function of VGAM741 is therefore inhibition of LOC256158 (Accession XM_175125). Accordingly, utilities of VGAM741 include diagnosis, prevention and treatment of diseases and clinical conditions associated with LOC256158. LOC92223 (Accession XM_043674) is another VGAM741 host target gene. LOC92223 BINDING SITE is HOST TARGET binding site found in the 5' untranslated region of mRNA encoded by LOC92223, corresponding to a HOST TARGET binding site such as BINDING SITE I, BINDING SITE II or BINDING SITE III. Table 2 illustrates the complementarity of the nucleotide sequences of LOC92223 BINDING SITE, designated SEQ ID:33994, to the nucleotide sequence of VGAM741 RNA, herein designated VGAM RNA, also designated SEQ ID:3452.

Another function of VGAM741 is therefore inhibition of LOC92223 (Accession XM_043674). Accordingly, utilities of VGAM741 include diagnosis, prevention and treatment of diseases and clinical conditions associated with LOC92223. FIG. 1 further provides a conceptual description of a novel bioinformatically detected viral gene of the present invention, referred to here as Viral Genomic Address Messenger 742 (VGAM742) viral gene, which modulates expression of respective host target genes thereof, the function and utility of which host target genes is known in the art.

VGAM742 is a novel bioinformatically detected regulatory, non protein coding, viral micro RNA (miRNA) gene. The method by which VGAM742 was detected is described hereinabove with reference to FIGS. 1-8.

VGAM742 gene, herein designated VGAM GENE, is a viral gene contained in the genome of Taura Syndrome Virus. VGAM742 host target gene, herein designated VGAM HOST TARGET GENE, is a human gene contained in the human genome.

VGAM742 gene encodes a VGAM742 precursor RNA, herein designated VGAM PRECURSOR RNA. Similar to other miRNA genes, and unlike most ordinary genes, VGAM742 precursor RNA does not encode a protein. A nucleotide sequence identical or highly similar to the nucleotide sequence of VGAM742 precursor RNA is designated SEQ ID:728, and is provided hereinbelow with reference to the sequence listing part. Nucleotide sequence SEQ ID:728 is located at position 1402 relative to the genome of Taura Syndrome Virus.

VGAM742 precursor RNA folds onto itself, forming VGAM742 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM742 folded precursor RNA into VGAM742 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM742 RNA is designated SEQ ID:3453, and is provided hereinbelow with reference to the sequence listing part.

VGAM742 host target gene, herein designated VGAM HOST TARGET GENE, encodes a corresponding messenger RNA, VGAM742 host target RNA, herein designated VGAM HOST TARGET RNA. VGAM742 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM742 RNA, herein designated VGAM RNA, binds complementarily to one or more host target binding sites located in untranslated regions of VGAM742 host target RNA, herein designated VGAM HOST TARGET RNA. This complementary binding is due to the fact that the nucleotide sequence of VGAM742 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM742 RNA, herein designated VGAM RNA, may have a different number of host target binding sites in untranslated regions of a VGAM742 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM742 RNA, herein designated VGAM RNA, to host target binding sites on VGAM742 host target RNA, herein designated VGAM HOST TARGET RNA, such as BINDING SITE I, BINDING SITE II and BINDING SITE III, inhibits translation of VGAM742 host target RNA into VGAM742 host target protein, herein designated VGAM HOST TARGET PROTEIN. VGAM host target protein is therefore outlined by a broken line.

It is appreciated that VGAM742 host target gene, herein designated VGAM HOST TARGET GENE, in fact represents a plurality of VGAM742 host target genes. The mRNA of each one of this plurality of VGAM742 host target genes comprises one or more host target binding sites, each having a nucleotide sequence which is at least partly complementary to VGAM742 RNA, herein designated VGAM RNA, and which when bound by VGAM742 RNA causes inhibition of translation of respective one or more VGAM742 host target proteins.

It is further appreciated by one skilled in the art that the mode of translational inhibition illustrated by FIG. 1 with specific reference to translational inhibition exerted by VGAM742 gene, herein designated VGAM GENE, on one or more VGAM742 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM742 is inhibition of expression of host target genes, as part of a novel viral mechanism of attacking a host. Accordingly, utilities of VGAM742 include diagnosis, prevention and treatment of viral infection by Taura Syndrome Virus. Specific functions, and accordingly utilities, of VGAM742 correlate with, and may be deduced from, the identity of the host target genes which VGAM742 binds and inhibits, and the function of these host target genes, as elaborated hereinbelow.

Nucleotide sequences of the VGAM742 precursor RNA, herein designated VGAM PRECURSOR RNA, and of the 'diced' VGAM742 RNA, herein designated VGAM RNA, and a schematic representation of the secondary folding of VGAM742 folded precursor RNA, herein designated VGAM FOLDED PRECURSOR RNA, of VGAM742 are further described hereinbelow with reference to Table 1.

Nucleotide sequences of host target binding sites, such as BINDING SITE-I, BINDING SITE-II and BINDING SITE-III of FIG. 1, found on VGAM742 host target RNA, and schematic representation of the complementarity of each of these host target binding sites to VGAM742 RNA, herein designated VGAM RNA, are described hereinbelow with reference to Table 2.

As mentioned hereinabove with reference to FIG. 1, a function of VGAM742 gene, herein designated VGAM is inhibition of expression of VGAM742 target genes. It is appreciated that specific functions, and accordingly utilities, of VGAM742 correlate with, and may be deduced from, the identity of the target genes which VGAM742 binds and inhibits, and the function of these target genes, as elaborated hereinbelow.

BTB and CNC Homology 1, Basic Leucine Zipper Transcription Factor 2 (BACH2, Accession NM_021813) is a VGAM742 host target gene. BACH2 BINDING SITE is HOST TARGET binding site found in the 3' untranslated region of mRNA encoded by BACH2, corresponding to a HOST TARGET binding site such as BINDING SITE I, BINDING SITE II or BINDING SITE III. Table 2 illustrates the complementarity of the nucleotide sequences of BACH2 BINDING SITE, designated SEQ ID:22377, to the nucleotide sequence of VGAM742 RNA, herein designated VGAM RNA, also designated SEQ ID:3453.

A function of VGAM742 is therefore inhibition of BTB and CNC Homology 1, Basic Leucine Zipper Transcription Factor 2 (BACH2, Accession NM_021813), a gene which acts as repressor or activator, binds to maf recognition elements. Accordingly, utilities of VGAM742 include diagnosis, prevention and treatment of diseases and clinical conditions associated with BACH2. The function of BACH2 and its association with various diseases and clinical conditions, has been established by previous studies, as described hereinabove with reference to VGAM331. Coronin, Actin Binding Protein, 1C (CORO1C, Accession NM_014325) is another VGAM742 host target gene. CORO1C BINDING SITE is HOST TARGET binding site found in the 3' untranslated region of mRNA encoded by CORO1C, corresponding to a HOST TARGET binding site such as BINDING SITE I, BINDING SITE II or BINDING SITE III. Table 2 illustrates the complementarity of the nucleotide sequences of CORO1C BINDING SITE, designated SEQ ID:15629, to the nucleotide sequence of VGAM742 RNA, herein designated VGAM RNA, also designated SEQ ID:3453.

Another function of VGAM742 is therefore inhibition of Coronin, Actin Binding Protein, 1C (CORO1C, Accession NM_014325). Accordingly, utilities of VGAM742 include diagnosis, prevention and treatment of diseases and clinical conditions associated with CORO1C. Deoxycytidine Kinase (DCK, Accession NM_000788) is another VGAM742 host target gene. DCK BINDING SITE is HOST TARGET binding site found in the 3' untranslated region of mRNA encoded by DCK, corresponding to a HOST TARGET binding site such as BINDING SITE I, BINDING SITE II or BINDING SITE III. Table 2 illustrates the complementarity of the nucleotide sequences of DCK BINDING SITE, designated SEQ ID:6444, to the nucleotide sequence of VGAM742 RNA, herein designated VGAM RNA, also designated SEQ ID:3453.

Another function of VGAM742 is therefore inhibition of Deoxycytidine Kinase (DCK, Accession NM_000788), a gene which mediates the phosphorylation of several deoxyribonucleosides and their analogs. Accordingly, utilities of VGAM742 include diagnosis, prevention and treatment of diseases and clinical conditions associated with DCK. The function of DCK and its association with various diseases and clinical conditions, has been established by previous studies, as described hereinabove with reference to VGAM538. Secreted Frizzled-related Protein 1 (SFRP1, Accession NM_003012) is another VGAM742 host target gene. SFRP1 BINDING SITE is HOST TARGET binding site found in the 3' untranslated region of mRNA encoded by SFRP1, corresponding to a HOST TARGET binding site such as BINDING SITE I, BINDING SITE II or BINDING SITE III. Table 2 illustrates the complementarity of the nucleotide sequences of SFRP1 BINDING SITE, designated SEQ ID:8927, to the nucleotide sequence of VGAM742 RNA, herein designated VGAM RNA, also designated SEQ ID:3453.

Another function of VGAM742 is therefore inhibition of Secreted Frizzled-related Protein 1 (SFRP1, Accession NM_003012), a gene which is a receptor for wnt proteins that may have an anti-apoptotic function. Accordingly, utilities of VGAM742 include diagnosis, prevention and treatment of diseases and clinical conditions associated with SFRP1. The function of SFRP1 and its association with various diseases and clinical conditions, has been established by previous studies, as described hereinabove with reference to VGAM250. Cell Adhesion Molecule with Homology to L1CAM (close homolog of L1) (CHL1, Accession NM_006614) is another VGAM742 host target gene. CHL1 BINDING SITE is HOST TARGET binding site found in the 3' untranslated region of mRNA encoded by CHL1, corresponding to a HOST TARGET binding site such as BINDING SITE I, BINDING SITE II or BINDING SITE III. Table 2 illustrates the complementarity of the nucleotide sequences of CHL1 BINDING SITE, designated SEQ ID:13396, to the nucleotide sequence of VGAM742 RNA, herein designated VGAM RNA, also designated SEQ ID:3453.

Another function of VGAM742 is therefore inhibition of Cell Adhesion Molecule with Homology to L1CAM (close homolog of L1) (CHL1, Accession NM_006614). Accordingly, utilities of VGAM742 include diagnosis, prevention and treatment of diseases and clinical conditions associated with CHL1. CUB and Sushi Multiple Domains 1 (CSMD1, Accession XM_054838) is another VGAM742 host target gene. CSMD1 BINDING SITE is HOST TARGET binding site found in the 3' untranslated region of mRNA encoded by CSMD1, corresponding to a HOST TARGET binding site such as BINDING SITE I, BINDING SITE II or BINDING SITE III. Table 2 illustrates the complementarity of the nucleotide sequences of CSMD1 BINDING SITE, designated SEQ ID:36185, to the nucleotide sequence of VGAM742 RNA, herein designated VGAM RNA, also designated SEQ ID:3453.

Another function of VGAM742 is therefore inhibition of CUB and Sushi Multiple Domains 1 (CSMD1, Accession XM_054838). Accordingly, utilities of VGAM742 include diagnosis, prevention and treatment of diseases and clinical conditions associated with CSMD1. Nudix (nucleoside diphosphate linked moiety X)-type Motif 11 (NUDT11, Accession XM_010230) is another VGAM742 host target gene. NUDT11 BINDING SITE is HOST TARGET binding site found in the 3' untranslated region of mRNA encoded by NUDT11, corresponding to a HOST TARGET binding site such as BINDING SITE I, BINDING SITE II or BINDING SITE III. Table 2 illustrates the complementarity of the nucleotide sequences of NUDT11 BINDING SITE, designated SEQ ID:30140, to the nucleotide sequence of VGAM742 RNA, herein designated VGAM RNA, also designated SEQ ID:3453.

Another function of VGAM742 is therefore inhibition of Nudix (nucleoside diphosphate linked moiety X)-type Motif 11 (NUDT11, Accession XM_010230). Accordingly, utilities of VGAM742 include diagnosis, prevention and treatment of diseases and clinical conditions associated with NUDT11. Phosphodiesterase 10A (PDE10A, Accession NM_006661) is another VGAM742 host target gene. PDE10A BINDING SITE is HOST TARGET binding site found in the 3' untranslated region of mRNA encoded by PDE10A, corresponding to a HOST TARGET binding site such as BINDING SITE I, BINDING SITE II or BINDING SITE III. Table 2 illustrates the complementarity of the nucleotide sequences of PDE10A BINDING SITE, designated SEQ ID:13461, to the nucleotide sequence of VGAM742 RNA, herein designated VGAM RNA, also designated SEQ ID:3453.

Another function of VGAM742 is therefore inhibition of Phosphodiesterase 10A (PDE10A, Accession NM_006661). Accordingly, utilities of VGAM742 include diagnosis, prevention and treatment of diseases and clinical conditions associated with PDE10A. RAP140 (Accession NM_015224) is another VGAM742 host target gene. RAP140 BINDING SITE is HOST TARGET binding site found in the 3' untranslated region of mRNA encoded by RAP140, corresponding to a HOST TARGET binding site such as BINDING SITE I, BINDING SITE II or BINDING SITE III. Table 2 illustrates the complementarity of the nucleotide sequences of RAP140 BINDING SITE, designated SEQ ID:17553, to the nucleotide sequence of VGAM742 RNA, herein designated VGAM RNA, also designated SEQ ID:3453.

Another function of VGAM742 is therefore inhibition of RAP140 (Accession NM_015224). Accordingly, utilities of VGAM742 include diagnosis, prevention and treatment of diseases and clinical conditions associated with RAP140. LOC146488 (Accession XM_047748) is another VGAM742 host target gene. LOC146488 BINDING SITE is HOST TARGET binding site found in the 5' untranslated region of mRNA encoded by LOC146488, corresponding to a HOST TARGET binding site such as BINDING SITE I, BINDING SITE II or BINDING SITE III. Table 2 illustrates the complementarity of the nucleotide sequences of LOC146488 BINDING SITE, designated SEQ ID:35040, to the nucleotide sequence of VGAM742 RNA, herein designated VGAM RNA, also designated SEQ ID:3453.

Another function of VGAM742 is therefore inhibition of LOC146488 (Accession XM_047748). Accordingly, utilities of VGAM742 include diagnosis, prevention and treatment of diseases and clinical conditions associated with LOC146488. LOC162083 (Accession XM_091339) is another VGAM742 host target gene. LOC162083 BINDING SITE is HOST TARGET binding site found in the 5' untranslated region of mRNA encoded by LOC162083, corresponding to a HOST TARGET binding site such as BINDING SITE I, BINDING SITE II or BINDING SITE III. Table 2 illustrates the complementarity of the nucleotide sequences of LOC162083 BINDING SITE, designated SEQ ID:40046, to the nucleotide sequence of VGAM742 RNA, herein designated VGAM RNA, also designated SEQ ID:3453.

Another function of VGAM742 is therefore inhibition of LOC162083 (Accession XM_091339). Accordingly, utilities of VGAM742 include diagnosis, prevention and treatment of diseases and clinical conditions associated with LOC162083. FIG. 1 further provides a conceptual description of a novel bioinformatically detected viral gene of the present invention, referred to here as Viral Genomic Address Messenger 743 (VGAM743) viral gene, which modulates expression of respective host target genes thereof, the function and utility of which host target genes is known in the art.

VGAM743 is a novel bioinformatically detected regulatory, non protein coding, viral micro RNA (miRNA) gene. The method by which VGAM743 was detected is described hereinabove with reference to FIGS. 1-8.

VGAM743 gene, herein designated VGAM GENE, is a viral gene contained in the genome of Invertebrate Iridescent Virus 6. VGAM743 host target gene, herein designated VGAM HOST TARGET GENE, is a human gene contained in the human genome.

VGAM743 gene encodes a VGAM743 precursor RNA, herein designated VGAM PRECURSOR RNA. Similar to other miRNA genes, and unlike most ordinary genes, VGAM743 precursor RNA does not encode a protein. A nucleotide sequence identical or highly similar to the nucleotide sequence of VGAM743 precursor RNA is designated SEQ ID:729, and is provided hereinbelow with reference to the sequence listing part. Nucleotide sequence SEQ ID:729 is located at position 189563 relative to the genome of Invertebrate Iridescent Virus 6.

VGAM743 precursor RNA folds onto itself, forming VGAM743 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM743 folded precursor RNA into VGAM743 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM743 RNA is designated SEQ ID:3454, and is provided hereinbelow with reference to the sequence listing part.

VGAM743 host target gene, herein designated VGAM HOST TARGET GENE, encodes a corresponding messenger RNA, VGAM743 host target RNA, herein designated VGAM HOST TARGET RNA. VGAM743 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM743 RNA, herein designated VGAM RNA, binds complementarily to one or more host target binding sites located in untranslated regions of VGAM743 host target RNA, herein designated VGAM HOST TARGET RNA. This complementary binding is due to the fact that the nucleotide sequence of VGAM743 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM743 RNA, herein designated VGAM RNA, may have a different number of host target binding sites in untranslated regions of a VGAM743 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM743 RNA, herein designated VGAM RNA, to host target binding sites on VGAM743 host target RNA, herein designated VGAM HOST TARGET RNA, such as BINDING SITE I, BINDING SITE II and BINDING SITE III, inhibits translation of VGAM743 host target RNA into VGAM743 host target protein, herein designated VGAM HOST TARGET PROTEIN. VGAM host target protein is therefore outlined by a broken line.

It is appreciated that VGAM743 host target gene, herein designated VGAM HOST TARGET GENE, in fact represents a plurality of VGAM743 host target genes. The mRNA of each one of this plurality of VGAM743 host target genes comprises one or more host target binding sites, each having a nucleotide sequence which is at least partly complementary to VGAM743 RNA, herein designated VGAM RNA, and which when bound by VGAM743 RNA causes inhibition of translation of respective one or more VGAM743 host target proteins.

It is further appreciated by one skilled in the art that the mode of translational inhibition illustrated by FIG. 1 with specific reference to translational inhibition exerted by VGAM743 gene, herein designated VGAM GENE, on one or more VGAM743 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM743 is inhibition of expression of host target genes, as part of a novel viral mechanism of attacking a host. Accordingly, utilities of VGAM743 include diagnosis, prevention and treatment of viral infection by Invertebrate Iridescent Virus 6. Specific functions, and accordingly utilities, of VGAM743 correlate with, and may be deduced from, the identity of the host target genes which VGAM743 binds and inhibits, and the function of these host target genes, as elaborated hereinbelow.

Nucleotide sequences of the VGAM743 precursor RNA, herein designated VGAM PRECURSOR RNA, and of the 'diced' VGAM743 RNA, herein designated VGAM RNA, and a schematic representation of the secondary folding of VGAM743 folded precursor RNA, herein designated VGAM FOLDED PRECURSOR RNA, of VGAM743 are further described hereinbelow with reference to Table 1.

Nucleotide sequences of host target binding sites, such as BINDING SITE-I, BINDING SITE-II and BINDING SITE-III of FIG. 1, found on VGAM743 host target RNA, and schematic representation of the complementarity of each of these host target binding sites to VGAM743 RNA, herein designated VGAM RNA, are described hereinbelow with reference to Table 2.

As mentioned hereinabove with reference to FIG. 1, a function of VGAM743 gene, herein designated VGAM is inhibition of expression of VGAM743 target genes. It is appreciated that specific functions, and accordingly utilities, of VGAM743 correlate with, and may be deduced from, the identity of the target genes which VGAM743 binds and inhibits, and the function of these target genes, as elaborated hereinbelow.

COX15 Homolog, Cytochrome C Oxidase Assembly Protein (yeast) (COX15, Accession NM_078470) is a VGAM743 host target gene. COX15 BINDING SITE is HOST TARGET binding site found in the 3' untranslated region of mRNA encoded by COX15, corresponding to a HOST TARGET binding site such as BINDING SITE I, BINDING SITE II or BINDING SITE III. Table 2 illustrates the complementarity of the nucleotide sequences of COX15 BINDING SITE, designated SEQ ID:27788, to the nucleotide sequence of VGAM743 RNA, herein designated VGAM RNA, also designated SEQ ID:3454.

A function of VGAM743 is therefore inhibition of COX15 Homolog, Cytochrome C Oxidase Assembly Protein (yeast) (COX15, Accession NM_078470). Accordingly, utilities of VGAM743 include diagnosis, prevention and treatment of diseases and clinical conditions associated with COX15. Cysteine and Glycine-rich Protein 1 (CSRP1, Accession NM_004078) is another VGAM743 host target gene. CSRP1 BINDING SITE is HOST TARGET binding site found in the 3' untranslated region of mRNA encoded by CSRP1, corresponding to a HOST TARGET binding site such as BINDING SITE I, BINDING SITE II or BINDING SITE III. Table 2 illustrates the complementarity of the nucleotide sequences of CSRP1 BINDING SITE, designated SEQ ID:10278, to the nucleotide sequence of VGAM743 RNA, herein designated VGAM RNA, also designated SEQ ID:3454.

Another function of VGAM743 is therefore inhibition of Cysteine and Glycine-rich Protein 1 (CSRP1, Accession NM_004078), a gene which could play a role in neuronal development. Accordingly, utilities of VGAM743 include diagnosis, prevention and treatment of diseases and clinical conditions associated with CSRP1. The function of CSRP1 has been established by previous studies. The human gene encoding cysteine-rich protein (CSRP) is a highly conserved, cell cycle-regulated gene that is induced in the immediate early response to serum repletion in serum-starved, noncycling cells. The LIM/double zinc finger motif found in cysteine-rich protein is found in an expanding group of proteins with critical functions in gene regulation, cell growth, and somatic differentiation (Wang et al., 1992). Other members of the group include cysteine-rich intestinal protein (CRIP; 123875), CSRP2 (OMIM Ref. No. 601871), CSRP3 (OMIM Ref. No. 600824), and the rhombotin genes RBTN1 (OMIM Ref. No. 186921), RBTN2 (OMIM Ref. No. 180385), and RBTN3 (OMIM Ref. No. 180386). Weiskirchen et al. (1995) described the CRP family of LIM domain proteins Wang et al. (1992) cloned the human CRP genomic sequence. The CRP gene spans approximately 23.2 kb from the cap site to the polyadenylation site. It contains 6 exons, with a 10.4-kb first intron. The authors showed that CRP is a primary response gene in both human fibroblasts and mouse Balb/c 3T3 cells; in the mouse cells, the kinetic profile of its induction closely paralleled that of c-myc (190080

Full details of the abovementioned studies are described in the following publications, the disclosure of which are hereby incorporated by reference:

Wang, X.; Ray, K.; Szpirer, J.; Levan, G.; Liebhaber, S. A.; Cooke, N. E.: Analysis of the human cysteine-rich protein gene (CSRP), assignment to chromosome 1q24-1q32, and identification of an associated MspI polymorphism. Genomics 14:391-397, 1992; and Liebhaber, S. A.; Emery, J. G.; Urbanek, M.; Wang, X.; Cooke, N. E.: Characterization of a human cDNA encoding a widely expressed and highly conserved cysteine-rich protein with an unus.

Further studies establishing the function and utilities of CSRP1 are found in John Hopkins OMIM database record ID 123876, and in sited publications numbered 3977-3979, 3982-398 and 3980 listed in the bibliography section hereinbelow, which are also hereby incorporated by reference. Exostoses (multiple)-like 2 (EXTL2, Accession NM_001439) is another VGAM743 host target gene. EXTL2 BINDING SITE is HOST TARGET binding site found in the 3' untranslated region of mRNA encoded by EXTL2, corresponding to a HOST TARGET binding site such as BINDING SITE I, BINDING SITE II or BINDING SITE III. Table 2 illustrates the complementarity of the nucleotide sequences of EXTL2 BINDING SITE, designated SEQ ID:7163, to the nucleotide sequence of VGAM743 RNA, herein designated VGAM RNA, also designated SEQ ID:3454.

Another function of VGAM743 is therefore inhibition of Exostoses (multiple)-like 2 (EXTL2, Accession NM_001439), a gene which is homologous to the EXT and EXTL genes. Accordingly, utilities of VGAM743 include diagnosis, prevention and treatment of diseases and clinical conditions associated with EXTL2. The function of EXTL2 has been established by previous studies. In patients with multiple exostoses, mutations in 2 different genes have been found: EXT1 (OMIM Ref. No. 133700) on 8q and EXT2 (OMIM Ref. No. 133701) on 11p. In addition, linkage has demonstrated a third locus, EXT3 (OMIM Ref. No. 600209), on 19p as the site of mutations causing multiple exostoses. The family of EXT genes was extended by the identification of an EXT-like gene (EXTL1; 601738) showing a high degree of homology with the EXT genes. Wuyts et al. (1997) described a second EXT-like gene, EXTL2, that is homologous to the EXT and EXTL genes. EXTL2 was found to consist of 5 exons encoding a ubiquitously expressed 330-amino acid protein. In addition, a putative pseudogene, EXTL2P, was identified. Saito et al. (1998) also cloned an EXTL2 cDNA, which they called EXTR2. By Northern blot analysis, they detected a 3.4-kb transcript in all tissues tested except leukocyte, where the gene was hardly transcribed. Its expression was relatively constant among tissues, but was weak in liver, lung, and thymus. By fluorescence in situ hybridization, Wuyts et al. (1997) mapped the EXTL2 gene to 1p12-p11 and the EXTL2 pseudogene to 2q24-q31. By somatic cell hybrid and radiation hybrid analyses, Saito et al. (1998) mapped the EXTL2 gene to chromosome 1p21. Wuyts and Van Hul (2000) cloned mouse Extl2, which has the same genomic structure as the human gene, encodes a protein identical in size, and has a sequence that is 87% identical to the human sequence. By radiation hybrid analysis, they mapped the mouse gene to chromosome 3.

Full details of the abovementioned studies are described in the following publications, the disclosure of which are hereby incorporated by reference:

Wuyts, W.; Van Hul, W.; Hendrickx, J.; Speleman, F.; Wauters, J.; De Boulle, K.; Van Roy, N.; Van Agtmael, T.; Bossuyt, P.; Willems, P. J.: Identification and characterization of a novel member of the EXT gene family, EXTL2. Europ. J. Hum. Genet. 5:382-389, 1997; and Wuyts, W.; Van Hul, W.: Characterization and genomic localization of the mouse Extl2 gene. Cytogenet. Cell Genet. 89:185-188, 2000.

Further studies establishing the function and utilities of EXTL2 are found in John Hopkins OMIM database record ID 602411, and in sited publications numbered 6016-6018 listed in the bibliography section hereinbelow, which are also hereby incorporated by reference. Sparc/osteonectin, Cwcv and Kazal-like Domains Proteoglycan (testican) (SPOCK, Accession XM_031696) is another VGAM743 host target gene. SPOCK BINDING SITE is HOST TARGET binding site found in the 3' untranslated region of mRNA encoded by SPOCK, corresponding to a HOST TARGET binding site such as BINDING SITE I, BINDING SITE II or BINDING SITE III. Table 2 illustrates the complementarity of the nucleotide sequences of SPOCK BINDING SITE, designated SEQ ID:31457, to the nucleotide sequence of VGAM743 RNA, herein designated VGAM RNA, also designated SEQ ID:3454.

Another function of VGAM743 is therefore inhibition of Sparc/osteonectin, Cwcv and Kazal-like Domains Proteoglycan (testican) (SPOCK, Accession XM_031696). Accordingly, utilities of VGAM743 include diagnosis, prevention and treatment of diseases and clinical conditions associated with SPOCK. Bromodomain Containing 2 (BRD2, Accession NM_005104) is another VGAM743 host target gene. BRD2 BINDING SITE is HOST TARGET binding site found in the 5' untranslated region of mRNA encoded by BRD2, corresponding to a HOST TARGET binding site such as BINDING SITE I, BINDING SITE II or BINDING SITE III. Table 2 illustrates the complementarity of the nucleotide sequences of BRD2 BINDING SITE, designated SEQ ID:11575, to the nucleotide sequence of VGAM743 RNA, herein designated VGAM RNA, also designated SEQ ID:3454.

Another function of VGAM743 is therefore inhibition of Bromodomain Containing 2 (BRD2, Accession NM_005104). Accordingly, utilities of VGAM743 include diagnosis, prevention and treatment of diseases and clinical conditions associated with BRD2. FLJ12747 (Accession NM_032173) is another VGAM743 host target gene. FLJ12747 BINDING SITE is HOST TARGET binding site found in the 3' untranslated region of mRNA encoded by FLJ12747, corresponding to a HOST TARGET binding site such as BINDING SITE I, BINDING SITE II or BINDING SITE III. Table 2 illustrates the complementarity of the nucleotide sequences of FLJ12747 BINDING SITE, designated SEQ ID:25880, to the nucleotide sequence of VGAM743 RNA, herein designated VGAM RNA, also designated SEQ ID:3454.

Another function of VGAM743 is therefore inhibition of FLJ12747 (Accession NM_032173). Accordingly, utilities of VGAM743 include diagnosis, prevention and treatment of diseases and clinical conditions associated with FLJ12747. Glutamate Receptor, Ionotropic, N-methyl-D-aspartate 3A (GRIN3A, Accession NM_133445) is another VGAM743 host target gene. GRIN3A BINDING SITE is HOST TARGET binding site found in the 3' untranslated region of mRNA encoded by GRIN3A, corresponding to a HOST TARGET binding site such as BINDING SITE I, BINDING SITE II or BINDING SITE III. Table 2 illustrates the complementarity of the nucleotide sequences of GRIN3A BINDING SITE, designated SEQ ID:28540, to the nucleotide sequence of VGAM743 RNA, herein designated VGAM RNA, also designated SEQ ID:3454.

Another function of VGAM743 is therefore inhibition of Glutamate Receptor, Ionotropic, N-methyl-D-aspartate 3A (GRIN3A, Accession NM_133445). Accordingly, utilities of VGAM743 include diagnosis, prevention and treatment of diseases and clinical conditions associated with GRIN3A. HSPC054 (Accession NM_014152) is another VGAM743 host target gene. HSPC054 BINDING SITE is HOST TARGET binding site found in the 3" untranslated region of mRNA encoded by HSPC054, corresponding to a HOST TARGET binding site such as BINDING SITE I, BINDING SITE II or BINDING SITE III. Table 2 illustrates the complementarity of the nucleotide sequences of HSPC054 BINDING SITE, designated SEQ ID:15434, to the nucleotide sequence of VGAM743 RNA, herein designated VGAM RNA, also designated SEQ ID:3454.

Another function of VGAM743 is therefore inhibition of HSPC054 (Accession NM_014152). Accordingly, utilities of VGAM743 include diagnosis, prevention and treatment of diseases and clinical conditions associated with HSPC054. KIAA0016 (Accession NM_014765) is another VGAM743 host target gene. KIAA0016 BINDING SITE is HOST TARGET binding site found in the 3' untranslated region of mRNA encoded by KIAA0016, corresponding to a HOST TARGET binding site such as BINDING SITE I, BINDING SITE II or BINDING SITE III. Table 2 illustrates the complementarity of the nucleotide sequences of KIAA0016 BINDING SITE, designated SEQ ID:16534, to the nucleotide sequence of VGAM743 RNA, herein designated VGAM RNA, also designated SEQ ID:3454.

Another function of VGAM743 is therefore inhibition of KIAA0016 (Accession NM_014765). Accordingly, utilities of VGAM743 include diagnosis, prevention and treatment of diseases and clinical conditions associated with KIAA0016. P311 (Accession NM_004772) is another VGAM743 host target gene. P311 BINDING SITE is HOST TARGET binding site found in the 3' untranslated region of mRNA encoded by P311, corresponding to a HOST TARGET binding site such as BINDING SITE I, BINDING SITE II or BINDING SITE III. Table 2 illustrates the complementarity of the nucleotide sequences of P311 BINDING SITE, designated SEQ ID:11163, to the nucleotide sequence of VGAM743 RNA, herein designated VGAM RNA, also designated SEQ ID:3454.

Another function of VGAM743 is therefore inhibition of P311 (Accession NM_004772). Accordingly, utilities of VGAM743 include diagnosis, prevention and treatment of diseases and clinical conditions associated with P311. PA26 (Accession NM_014454) is another VGAM743 host target gene. PA26 BINDING SITE is HOST TARGET binding site found in the 3' untranslated region of mRNA encoded by PA26, corresponding to a HOST TARGET binding site such as BINDING SITE I, BINDING SITE II or BINDING SITE III. Table 2 illustrates the complementarity of the nucleotide sequences of PA26 BINDING SITE, designated SEQ ID:15807, to the nucleotide sequence of VGAM743 RNA, herein designated VGAM RNA, also designated SEQ ID:3454.

Another function of VGAM743 is therefore inhibition of PA26 (Accession NM_014454). Accordingly, utilities of VGAM743 include diagnosis, prevention and treatment of diseases and clinical conditions associated with PA26. Sideroflexin 5 (SFXN5, Accession NM_144579) is another VGAM743 host target gene. SFXN5 BINDING SITE is HOST TARGET binding site found in the 3' untranslated region of mRNA encoded by SFXN5, corresponding to a HOST TARGET binding site such as BINDING SITE I, BINDING SITE II or BINDING SITE III. Table 2 illustrates the complementarity of the nucleotide sequences of SFXN5 BINDING SITE, designated SEQ ID:29386, to the nucleotide sequence of VGAM743 RNA, herein designated VGAM RNA, also designated SEQ ID:3454.

Another function of VGAM743 is therefore inhibition of Sideroflexin 5 (SFXN5, Accession NM_144579). Accordingly, utilities of VGAM743 include diagnosis, prevention and treatment of diseases and clinical conditions associated with SFXN5. LOC196027 (Accession XM_113633) is another VGAM743 host target gene. LOC196027 BINDING SITE is HOST TARGET binding site found in the 3' untranslated region of mRNA encoded by LOC196027, corresponding to a HOST TARGET binding site such as BINDING SITE I, BINDING SITE II or BINDING SITE III. Table 2 illustrates the complementarity of the nucleotide sequences of LOC196027 BINDING SITE, designated SEQ ID:42305, to the nucleotide sequence of VGAM743 RNA, herein designated VGAM RNA, also designated SEQ ID:3454.

Another function of VGAM743 is therefore inhibition of LOC196027 (Accession XM_113633). Accordingly, utilities of VGAM743 include diagnosis, prevention and treatment of diseases and clinical conditions associated with LOC196027. LOC81034 (Accession NM_030780) is another VGAM743 host target gene. LOC81034 BINDING SITE is HOST TARGET binding site found in the 3' untranslated region of mRNA encoded by LOC81034, corresponding to a HOST TARGET binding site such as BINDING SITE I, BINDING SITE II or BINDING SITE III. Table 2 illustrates the complementarity of the nucleotide sequences of LOC81034 BINDING SITE, designated SEQ ID:25070, to the nucleotide sequence of VGAM743 RNA, herein designated VGAM RNA, also designated SEQ ID:3454.

Another function of VGAM743 is therefore inhibition of LOC81034 (Accession NM_030780). Accordingly, utilities of VGAM743 include diagnosis, prevention and treatment of diseases and clinical conditions associated with LOC81034. FIG. 1 further provides a conceptual description of a novel bioinformatically detected viral gene of the present invention, referred to here as Viral Genomic Address Messenger 744 (VGAM744) viral gene, which modulates expression of respective host target genes thereof, the function and utility of which host target genes is known in the art.

VGAM744 is a novel bioinformatically detected regulatory, non protein coding, viral micro RNA (miRNA) gene. The method by which VGAM744 was detected is described hereinabove with reference to FIGS. 1-8.

VGAM744 gene, herein designated VGAM GENE, is a viral gene contained in the genome of Bovine Coronavirus. VGAM744 host target gene, herein designated VGAM HOST TARGET GENE, is a human gene contained in the human genome.

VGAM744 gene encodes a VGAM744 precursor RNA, herein designated VGAM PRECURSOR RNA. Similar to other miRNA genes, and unlike most ordinary genes, VGAM744 precursor RNA does not encode a protein. A nucleotide sequence identical or highly similar to the nucleotide sequence of VGAM744 precursor RNA is designated SEQ ID:730, and is provided hereinbelow with reference to the sequence listing part. Nucleotide sequence SEQ ID:730 is located at position 1346 relative to the genome of Bovine Coronavirus.

VGAM744 precursor RNA folds onto itself, forming VGAM744 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM744 folded precursor RNA into VGAM744 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM744 RNA is designated SEQ ID:3455, and is provided hereinbelow with reference to the sequence listing part.

VGAM744 host target gene, herein designated VGAM HOST TARGET GENE, encodes a corresponding messenger RNA, VGAM744 host target RNA, herein designated VGAM HOST TARGET RNA. VGAM744 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM744 RNA, herein designated VGAM RNA, binds complementarily to one or more host target binding sites located in untranslated regions of VGAM744 host target RNA, herein designated VGAM HOST TARGET RNA. This complementary binding is due to the fact that the nucleotide sequence of VGAM744 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM744 RNA, herein designated VGAM RNA, may have a different number of host target binding sites in untranslated regions of a VGAM744 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM744 RNA, herein designated VGAM RNA, to host target binding sites on VGAM744 host target RNA, herein designated VGAM HOST TARGET RNA, such as BINDING SITE I, BINDING SITE II and BINDING SITE III, inhibits translation of VGAM744 host target RNA into VGAM744 host target protein, herein designated VGAM HOST TARGET PROTEIN. VGAM host target protein is therefore outlined by a broken line.

It is appreciated that VGAM744 host target gene, herein designated VGAM HOST TARGET GENE, in fact represents a plurality of VGAM744 host target genes. The mRNA of each one of this plurality of VGAM744 host target genes comprises one or more host target binding sites, each having a nucleotide sequence which is at least partly complementary to VGAM744 RNA, herein designated VGAM RNA, and which when bound by VGAM744 RNA causes inhibition of translation of respective one or more VGAM744 host target proteins.

It is further appreciated by one skilled in the art that the mode of translational inhibition illustrated by FIG. 1 with specific reference to translational inhibition exerted by VGAM744 gene, herein designated VGAM GENE, on one or more VGAM744 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM744 is inhibition of expression of host target genes, as part of a novel viral mechanism of attacking a host. Accordingly, utilities of VGAM744 include diagnosis, prevention and treatment of viral infection by Bovine Coronavirus. Specific functions, and accordingly utilities, of VGAM744 correlate with, and may be deduced from, the identity of the host target genes which VGAM744 binds and inhibits, and the function of these host target genes, as elaborated hereinbelow.

Nucleotide sequences of the VGAM744 precursor RNA, herein designated VGAM PRECURSOR RNA, and of the 'diced' VGAM744 RNA, herein designated VGAM RNA, and a schematic representation of the secondary folding of VGAM744 folded precursor RNA, herein designated VGAM FOLDED PRECURSOR RNA, of VGAM744 are further described hereinbelow with reference to Table 1.

Nucleotide sequences of host target binding sites, such as BINDING SITE-I, BINDING SITE-II and BINDING SITE-III of FIG. 1, found on VGAM744 host target RNA, and schematic representation of the complementarity of each of these host target binding sites to VGAM744 RNA, herein designated VGAM RNA, are described hereinbelow with reference to Table 2.

As mentioned hereinabove with reference to FIG. 1, a function of VGAM744 gene, herein designated VGAM is inhibition of expression of VGAM744 target genes. It is appreciated that specific functions, and accordingly utilities, of VGAM744 correlate with, and may be deduced from, the identity of the target genes which VGAM744 binds and inhibits, and the function of these target genes, as elaborated hereinbelow.

Tropomyosin 4 (TPM4, Accession NM_003290) is a VGAM744 host target gene. TPM4 BINDING SITE is HOST TARGET binding site found in the 3' untranslated region of mRNA encoded by TPM4, corresponding to a HOST TARGET binding site such as BINDING SITE I, BINDING SITE II or BINDING SITE III. Table 2 illustrates the complementarity of the nucleotide sequences of TPM4 BINDING SITE, designated SEQ ID:9299, to the nucleotide sequence of VGAM744 RNA, herein designated VGAM RNA, also designated SEQ ID:3455.

A function of VGAM744 is therefore inhibition of Tropomyosin 4 (TPM4, Accession NM_003290), a gene which plays a central role, in association with the troponin complex, in the calcium dependent regulation of vertebrate striated muscle contraction. Accordingly, utilities of VGAM744 include diagnosis, prevention and treatment of diseases and clinical conditions associated with TPM4. The function of TPM4 has been established by previous studies. Vertebrates have at least 4 different tropomyosin genes; in human S, they are named TPM1 (OMIM Ref. No. 191010), TPM2 (OMIM Ref. No. 190990), TPM3 (OMIM Ref. No. 191030), and TPM4. Both the muscle and nonmuscle isoforms of the tropomyosins are expressed through alternative splicing of each of the 4 genes. Laing et al. (1995) referred to unpublished observations indicating that the TPM4 gene maps to human chromosome 19. Wilton et al. (1996) developed sequence tagged sites (STS) for the TPM4 gene. One STS was used to amplify DNA from somatic cell hybrids to localize TPM4 to chromosome 19. The other, a product from a long-range PCR, was used directly as a probe to refine the localization of TPM4 to 19p13.1 by fluorescence in situ hybridization to metaphase chromosome spreads.

Full details of the abovementioned studies are described in the following publications, the disclosure of which are hereby incorporated by reference:

Laing, N. G.; Wilton, S. D.; Akkari, P. A.; Dorosz, S.; Boundy, K.; Kneebone, C.; Blumbergs, P.; White, S.; Watkins, H.; Love, D. R.; Haan, E.: A mutation in the alpha tropomyosin gene TPM3 associated with autosomal dominant nemaline myopathy. Nature Genet. 9:75-79, 1995; and Wilton, S. D.; Lim, L.; Dorosz, S. D.; Gunn, H. C.; Eyre, H. J.; Callen, D. F.; Laing, N. G.: Assignment of the human alpha-tropomyosin gene TPM4 to band 19p13.1 by fluorescence in situ hy.

Further studies establishing the function and utilities of TPM4 are found in John Hopkins OMIM database record ID 600317, and in sited publications numbered 300 and 7225 listed in the bibliography section hereinbelow, which are also hereby incorporated by reference. Zinc Finger Protein 135 (clone pHZ-17) (ZNF135, Accession NM_003436) is another VGAM744 host target gene. ZNF135 BINDING SITE is HOST TARGET binding site found in the 3' untranslated region of mRNA encoded by ZNF135, corresponding to a HOST TARGET binding site such as BINDING SITE I, BINDING SITE II or BINDING SITE III. Table 2 illustrates the complementarity of the nucleotide sequences of ZNF135 BINDING SITE, designated SEQ ID:9488, to the nucleotide sequence of VGAM744 RNA, herein designated VGAM RNA, also designated SEQ ID:3455.

Another function of VGAM744 is therefore inhibition of Zinc Finger Protein 135 (clone pHZ-17) (ZNF135, Accession NM_003436). Accordingly, utilities of VGAM744 include diagnosis, prevention and treatment of diseases and clinical conditions associated with ZNF135. DKFZp434C0923 (Accession NM_017598) is another VGAM744 host target gene. DKFZp434C0923 BINDING SITE is HOST TARGET binding site found in the 5' untranslated region of mRNA encoded by DKFZp434C0923, corresponding to a HOST TARGET binding site such as BINDING SITE I, BINDING SITE II or BINDING SITE III. Table 2 illustrates the complementarity of the nucleotide sequences of DKFZp434C0923 BINDING SITE, designated SEQ ID:19060, to the nucleotide sequence of VGAM744 RNA, herein designated VGAM RNA, also designated SEQ ID:3455.

Another function of VGAM744 is therefore inhibition of DKFZp434C0923 (Accession NM_017598). Accordingly, utilities of VGAM744 include diagnosis, prevention and treatment of diseases and clinical conditions associated with DKFZp434C0923. DKFZp566H0824 (Accession NM_017535) is another VGAM744 host target gene. DKFZp566H0824 BINDING SITE is HOST TARGET binding site found in the 5' untranslated region of mRNA encoded by DKFZp566H0824, corresponding to a HOST TARGET binding site such as BINDING SITE I, BINDING SITE II or BINDING SITE III. Table 2 illustrates the complementarity of the nucleotide sequences of DKFZp566H0824 BINDING SITE, designated SEQ ID:18972, to the nucleotide sequence of VGAM744 RNA, herein designated VGAM RNA, also designated SEQ ID:3455.

Another function of VGAM744 is therefore inhibition of DKFZp566H0824 (Accession NM_017535). Accordingly, utilities of VGAM744 include diagnosis, prevention and treatment of diseases and clinical conditions associated with DKFZp566H0824. LOC152106 (Accession XM_046399) is another VGAM744 host target gene. LOC152106 BINDING SITE is HOST TARGET binding site found in the 3' untranslated region of mRNA encoded by LOC152106, corresponding to a HOST TARGET binding site such as BINDING SITE I, BINDING SITE II or BINDING SITE III. Table 2 illustrates the complementarity of the nucleotide sequences of LOC152106 BINDING SITE, designated SEQ ID:34708, to the nucleotide sequence of VGAM744 RNA, herein designated VGAM RNA, also designated SEQ ID:3455.

Another function of VGAM744 is therefore inhibition of LOC152106 (Accession XM_046399). Accordingly, utilities of VGAM744 include diagnosis, prevention and treatment of diseases and clinical conditions associated with LOC152106. LOC255152 (Accession XM_173310) is another VGAM744 host target gene. LOC255152 BINDING SITE is HOST TARGET binding site found in the 5' untranslated region of mRNA encoded by LOC255152, corresponding to a HOST TARGET binding site such as BINDING SITE I, BINDING SITE II or BINDING SITE III. Table 2 illustrates the complementarity of the nucleotide sequences of LOC255152 BINDING SITE, designated SEQ ID:46533, to the nucleotide sequence of VGAM744 RNA, herein designated VGAM RNA, also designated SEQ ID:3455.

Another function of VGAM744 is therefore inhibition of LOC255152 (Accession XM_173310). Accordingly, utilities of VGAM744 include diagnosis, prevention and treatment of diseases and clinical conditions associated with LOC255152. FIG. 1 further provides a conceptual description of a novel bioinformatically detected viral gene of the present invention, referred to here as Viral Genomic Address Messenger 745 (VGAM745) viral gene, which modulates expression of respective host target genes thereof, the function and utility of which host target genes is known in the art.

VGAM745 is a novel bioinformatically detected regulatory, non protein coding, viral micro RNA (miRNA) gene. The method by which VGAM745 was detected is described hereinabove with reference to FIGS. 1-8.

VGAM745 gene, herein designated VGAM GENE, is a viral gene contained in the genome of Bovine Coronavirus. VGAM745 host target gene, herein designated VGAM HOST TARGET GENE, is a human gene contained in the human genome.

VGAM745 gene encodes a VGAM745 precursor RNA, herein designated VGAM PRECURSOR RNA. Similar to other miRNA genes, and unlike most ordinary genes, VGAM745 precursor RNA does not encode a protein. A nucleotide sequence identical or highly similar to the nucleotide sequence of VGAM745 precursor RNA is designated SEQ ID:731, and is provided hereinbelow with reference to the sequence listing part. Nucleotide sequence SEQ ID:731 is located at position 18815 relative to the genome of Bovine Coronavirus.

VGAM745 precursor RNA folds onto itself, forming VGAM745 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM745 folded precursor RNA into VGAM745 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM745 RNA is designated SEQ ID:3456, and is provided hereinbelow with reference to the sequence listing part.

VGAM745 host target gene, herein designated VGAM HOST TARGET GENE, encodes a corresponding messenger RNA, VGAM745 host target RNA, herein designated VGAM HOST TARGET RNA. VGAM745 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM745 RNA, herein designated VGAM RNA, binds complementarily to one or more host target binding sites located in untranslated regions of VGAM745 host target RNA, herein designated VGAM HOST TARGET RNA. This complementary binding is due to the fact that the nucleotide sequence of VGAM745 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM745 RNA, herein designated VGAM RNA, may have a different number of host target binding sites in untranslated regions of a VGAM745 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM745 RNA, herein designated VGAM RNA, to host target binding sites on VGAM745 host target RNA, herein designated VGAM HOST TARGET RNA, such as BINDING SITE I, BINDING SITE II and BINDING SITE III, inhibits translation of VGAM745 host target RNA into VGAM745 host target protein, herein designated VGAM HOST TARGET PROTEIN. VGAM host target protein is therefore outlined by a broken line.

It is appreciated that VGAM745 host target gene, herein designated VGAM HOST TARGET GENE, in fact represents a plurality of VGAM745 host target genes. The mRNA of each one of this plurality of VGAM745 host target genes comprises one or more host target binding sites, each having a nucleotide sequence which is at least partly complementary to VGAM745 RNA, herein designated VGAM RNA, and which when bound by VGAM745 RNA causes inhibition of translation of respective one or more VGAM745 host target proteins.

It is further appreciated by one skilled in the art that the mode of translational inhibition illustrated by FIG. 1 with specific reference to translational inhibition exerted by VGAM745 gene, herein designated VGAM GENE, on one or more VGAM745 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM745 is inhibition of expression of host target genes, as part of a novel viral mechanism of attacking a host. Accordingly, utilities of VGAM745 include diagnosis, prevention and treatment of viral infection by Bovine Coronavirus. Specific functions, and accordingly utilities, of VGAM745 correlate with, and may be deduced from, the identity of the host target genes which VGAM745 binds and inhibits, and the function of these host target genes, as elaborated hereinbelow.

Nucleotide sequences of the VGAM745 precursor RNA, herein designated VGAM PRECURSOR RNA, and of the 'diced' VGAM745 RNA, herein designated VGAM RNA, and a schematic representation of the secondary folding of VGAM745 folded precursor RNA, herein designated VGAM FOLDED PRECURSOR RNA, of VGAM745 are further described hereinbelow with reference to Table 1.

Nucleotide sequences of host target binding sites, such as BINDING SITE-I, BINDING SITE-II and BINDING SITE-III of FIG. 1, found on VGAM745 host target RNA, and schematic representation of the complementarity of each of these host target binding sites to VGAM745 RNA, herein designated VGAM RNA, are described hereinbelow with reference to Table 2.

As mentioned hereinabove with reference to FIG. 1, a function of VGAM745 gene, herein designated VGAM is inhibition of expression of VGAM745 target genes. It is appreciated that specific functions, and accordingly utilities, of VGAM745 correlate with, and may be deduced from, the identity of the target genes which VGAM745 binds and inhibits, and the function of these target genes, as elaborated hereinbelow.

ATP-binding Cassette, Sub-family C (CFTR/MRP), Member 1 (ABCC1, Accession NM_019900) is a VGAM745 host target gene. ABCC1 BINDING SITE1 through ABCC1 BINDING SITE3 are HOST TARGET binding sites found in untranslated regions of mRNA encoded by ABCC1, corresponding to HOST TARGET binding sites such as BINDING SITE I, BINDING SITE II or BINDING SITE III. Table 2 illustrates the complementarity of the nucleotide sequences of ABCC1 BINDING SITE1 through ABCC1 BINDING SITE3, designated SEQ ID:21283, SEQ ID:21287 and SEQ ID:11439 respectively, to the nucleotide sequence of VGAM745 RNA, herein designated VGAM RNA, also designated SEQ ID:3456.

A function of VGAM745 is therefore inhibition of ATP-binding Cassette, Sub-family C (CFTR/MRP), Member 1 (ABCC1, Accession NM_019900), a gene which may participate directly in the active transport of drugs into subcellular organelles or influence drug distribution indirectly. Accordingly, utilities of VGAM745 include diagnosis, prevention and treatment of diseases and clinical conditions associated with ABCC1. The function of ABCC1 and its association with various diseases and clinical conditions, has been established by previous studies, as described hereinabove with reference to VGAM479. Chloride Intracellular Channel 4 (CLIC4, Accession NM_013943) is another VGAM745 host target gene. CLIC4 BINDING SITE is HOST TARGET binding site found in the 3' untranslated region of mRNA encoded by CLIC4, corresponding to a HOST TARGET binding site such as BINDING SITE I, BINDING SITE II or BINDING SITE III. Table 2 illustrates the complementarity of the nucleotide sequences of CLIC4 BINDING SITE, designated SEQ ID:15131, to the nucleotide sequence of VGAM745 RNA, herein designated VGAM RNA, also designated SEQ ID:3456.

Another function of VGAM745 is therefore inhibition of Chloride Intracellular Channel 4 (CLIC4, Accession NM_013943). Accordingly, utilities of VGAM745 include diagnosis, prevention and treatment of diseases and clinical conditions associated with CLIC4. FLJ13194 (Accession NM_025146) is another VGAM745 host target gene. FLJ13194 BINDING SITE is HOST TARGET binding site found in the 3' untranslated region of mRNA encoded by FLJ13194, corresponding to a HOST TARGET binding site such as BINDING SITE I, BINDING SITE II or BINDING SITE III. Table 2 illustrates the complementarity of the nucleotide sequences of FLJ13194 BINDING SITE, designated SEQ ID:24786, to the nucleotide sequence of VGAM745 RNA, herein designated VGAM RNA, also designated SEQ ID:3456.

Another function of VGAM745 is therefore inhibition of FLJ13194 (Accession NM_025146). Accordingly, utilities of VGAM745 include diagnosis, prevention and treatment of diseases and clinical conditions associated with FLJ13194. KIAA1753 (Accession XM_036115) is another VGAM745 host target gene. KIAA1753 BINDING SITE is HOST TARGET binding site found in the 3' untranslated region of mRNA encoded by KIAA1753, corresponding to a HOST TARGET binding site such as BINDING SITE I, BINDING SITE II or BINDING SITE III. Table 2 illustrates the complementarity of the nucleotide sequences of KIAA1753 BINDING SITE, designated SEQ ID:32383, to the nucleotide sequence of VGAM745 RNA, herein designated VGAM RNA, also designated SEQ ID:3456.

Another function of VGAM745 is therefore inhibition of KIAA1753 (Accession XM_036115). Accordingly, utilities of VGAM745 include diagnosis, prevention and treatment of diseases and clinical conditions associated with KIAA1753. Kelch-like 4 (Drosophila) (KLHL4, Accession NM_019117) is another VGAM745 host target gene. KLHL4 BINDING SITE is HOST TARGET binding site found in the 3' untranslated region of mRNA encoded by KLHL4, corresponding to a HOST TARGET binding site such as BINDING SITE I, BINDING SITE II or BINDING SITE III. Table 2 illustrates the complementarity of the nucleotide sequences of KLHL4 BINDING SITE, designated SEQ ID:21196, to the nucleotide sequence of VGAM745 RNA, herein designated VGAM RNA, also designated SEQ ID:3456.

Another function of VGAM745 is therefore inhibition of Kelch-like 4 (Drosophila) (KLHL4, Accession NM_019117). Accordingly, utilities of VGAM745 include diagnosis, prevention and treatment of diseases and clinical conditions associated with KLHL4. LOC200609 (Accession XM_117256) is another VGAM745 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43330, to the nucleotide sequence of VGAM745 RNA, herein designated VGAM RNA, also designated SEQ ID:3456.

Another function of VGAM745 is therefore inhibition of LOC200609 (Accession XM_117256). Accordingly, utilities of VGAM745 include diagnosis, prevention and treatment of diseases and clinical conditions associated with LOC200609. LOC220980 (Accession XM_167629) is another VGAM745 host target gene. LOC220980 BINDING SITE is HOST TARGET binding site found in the 5' untranslated region of mRNA encoded by LOC220980, corresponding to a HOST TARGET binding site such as BINDING SITE I, BINDING SITE II or BINDING SITE III. Table 2 illustrates the complementarity of the nucleotide sequences of LOC220980 BINDING SITE, designated SEQ ID:44739, to the nucleotide sequence of VGAM745 RNA, herein designated VGAM RNA, also designated SEQ ID:3456.

Another function of VGAM745 is therefore inhibition of LOC220980 (Accession XM_167629). Accordingly, utilities of VGAM745 include diagnosis, prevention and treatment of diseases and clinical conditions associated with LOC220980. LOC254556 (Accession XM_170588) is another VGAM745 host target gene. LOC254556 BINDING SITE is HOST TARGET binding site found in the 3' untranslated region of mRNA encoded by LOC254556, corresponding to a HOST TARGET binding site such as BINDING SITE I, BINDING SITE II or BINDING SITE III. Table 2 illustrates the complementarity of the nucleotide sequences of LOC254556 BINDING SITE, designated SEQ ID:45394, to the nucleotide sequence of VGAM745 RNA, herein designated VGAM RNA, also designated SEQ ID:3456.

Another function of VGAM745 is therefore inhibition of LOC254556 (Accession XM_170588). Accordingly, utilities of VGAM745 include diagnosis, prevention and treatment of diseases and clinical conditions associated with LOC254556. LOC93538 (Accession XM_051927) is another VGAM745 host target gene. LOC93538 BINDING SITE is HOST TARGET binding site found in the 3' untranslated region of mRNA encoded by LOC93538, corresponding to a HOST TARGET binding site such as BINDING SITE I, BINDING SITE II or BINDING SITE III. Table 2 illustrates the complementarity of the nucleotide sequences of LOC93538 BINDING SITE, designated SEQ ID:35922, to the nucleotide sequence of VGAM745 RNA, herein designated VGAM RNA, also designated SEQ ID:3456.

Another function of VGAM745 is therefore inhibition of LOC93538 (Accession XM_051927). Accordingly, utilities of VGAM745 include diagnosis, prevention and treatment of diseases and clinical conditions associated with LOC93538. FIG. 1 further provides a conceptual description of a novel bioinformatically detected viral gene of the present invention, referred to here as Viral Genomic Address Messenger 746 (VGAM746) viral gene, which modulates expression of respective host target genes thereof, the function and utility of which host target genes is known in the art.

VGAM746 is a novel bioinformatically detected regulatory, non protein coding, viral micro RNA (miRNA) gene. The method by which VGAM746 was detected is described hereinabove with reference to FIGS. 1-8.

VGAM746 gene, herein designated VGAM GENE, is a viral gene contained in the genome of Bovine Coronavirus. VGAM746 host target gene, herein designated VGAM HOST TARGET GENE, is a human gene contained in the human genome.

VGAM746 gene encodes a VGAM746 precursor RNA, herein designated VGAM PRECURSOR RNA. Similar to other miRNA genes, and unlike most ordinary genes, VGAM746 precursor RNA does not encode a protein. A nucleotide sequence identical or highly similar to the nucleotide sequence of VGAM746 precursor RNA is designated SEQ ID:732, and is provided hereinbelow with reference to the sequence listing part. Nucleotide sequence SEQ ID:732 is located at position 13256 relative to the genome of Bovine Coronavirus.

VGAM746 precursor RNA folds onto itself, forming VGAM746 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM746 folded precursor RNA into VGAM746 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM746 RNA is designated SEQ ID:3457, and is provided hereinbelow with reference to the sequence listing part.

VGAM746 host target gene, herein designated VGAM HOST TARGET GENE, encodes a corresponding messenger RNA, VGAM746 host target RNA, herein designated VGAM HOST TARGET RNA. VGAM746 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM746 RNA, herein designated VGAM RNA, binds complementarily to one or more host target binding sites located in untranslated regions of VGAM746 host target RNA, herein designated VGAM HOST TARGET RNA. This complementary binding is due to the fact that the nucleotide sequence of VGAM746 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM746 RNA, herein designated VGAM RNA, may have a different number of host target binding sites in untranslated regions of a VGAM746 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM746 RNA, herein designated VGAM RNA, to host target binding sites on VGAM746 host target RNA, herein designated VGAM HOST TARGET RNA, such as BINDING SITE I, BINDING SITE II and BINDING SITE III, inhibits translation of VGAM746 host target RNA into VGAM746 host target protein, herein designated VGAM HOST TARGET PROTEIN. VGAM host target protein is therefore outlined by a broken line.

It is appreciated that VGAM746 host target gene, herein designated VGAM HOST TARGET GENE, in fact represents a plurality of VGAM746 host target genes. The mRNA of each one of this plurality of VGAM746 host target genes comprises one or more host target binding sites, each having a nucleotide sequence which is at least partly complementary to VGAM746 RNA, herein designated VGAM RNA, and which when bound by VGAM746 RNA causes inhibition of translation of respective one or more VGAM746 host target proteins.

It is further appreciated by one skilled in the art that the mode of translational inhibition illustrated by FIG. 1 with specific reference to translational inhibition exerted by VGAM746 gene, herein designated VGAM GENE, on one or more VGAM746 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM746 is inhibition of expression of host target genes, as part of a novel viral mechanism of attacking a host. Accordingly, utilities of VGAM746 include diagnosis, prevention and treatment of viral infection by Bovine Coronavirus. Specific functions, and accordingly utilities, of VGAM746 correlate with, and may be deduced from, the identity of the host target genes which VGAM746 binds and inhibits, and the function of these host target genes, as elaborated hereinbelow.

Nucleotide sequences of the VGAM746 precursor RNA, herein designated VGAM PRECURSOR RNA, and of the 'diced' VGAM746 RNA, herein designated VGAM RNA, and a schematic representation of the secondary folding of VGAM746 folded precursor RNA, herein designated VGAM FOLDED PRECURSOR RNA, of VGAM746 are further described hereinbelow with reference to Table 1.

Nucleotide sequences of host target binding sites, such as BINDING SITE-I, BINDING SITE-II and BINDING SITE-III of FIG. 1, found on VGAM746 host target RNA, and schematic representation of the complementarity of each of these host target binding sites to VGAM746 RNA, herein designated VGAM RNA, are described hereinbelow with reference to Table 2.

As mentioned hereinabove with reference to FIG. 1, a function of VGAM746 gene, herein designated VGAM is inhibition of expression of VGAM746 target genes. It is appreciated that specific functions, and accordingly utilities, of VGAM746 correlate with, and may be deduced from, the identity of the target genes which VGAM746 binds and inhibits, and the function of these target genes, as elaborated hereinbelow.

Glutamate Receptor, Metabotropic 7 (GRM7, Accession NM_000844) is a VGAM746 host target gene. GRM7 BINDING SITE is HOST TARGET binding site found in the 3' untranslated region of mRNA encoded by GRM7, corresponding to a HOST TARGET binding site such as BINDING SITE I, BINDING SITE II or BINDING SITE III. Table 2 illustrates the complementarity of the nucleotide sequences of GRM7 BINDING SITE, designated SEQ ID:6518, to the nucleotide sequence of VGAM746 RNA, herein designated VGAM RNA, also designated SEQ ID:3457.

A function of VGAM746 is therefore inhibition of Glutamate Receptor, Metabotropic 7 (GRM7, Accession NM_000844), a gene which is mediated by a g-protein that inhibits adenylate cyclase activity. Accordingly, utilities of VGAM746 include diagnosis, prevention and treatment of diseases and clinical conditions associated with GRM7. The function of GRM7 has been established by previous studies. L-glutamate, a major excitatory neurotransmitter, interacts with both ionotropic and metabotropic glutamate receptors. See mGluR3 (OMIM Ref. No. 601115). The metabotropic glutamate receptors (OMIM Ref. No. mGluRs), which are G protein-coupled receptors, have been divided into 3 groups on the basis of sequence homology, putative signal transduction mechanisms, and pharmacologic properties. Group II and group III mGluRs are linked to the inhibition of the cyclic AMP cascade, but differ in their agonist selectivities. Okamoto et al. (1994) isolated cDNAs encoding rat mGluR7. The predicted mGluR7 protein shares the structural profile of other mGluRs, with a signal peptide and a large extracellular domain followed by 7 membrane-spanning domains. This receptor shows a high degree of similarity to the group III receptors mGluR4 (OMIM Ref. No. 604100) and mGluR6 (OMIM Ref. No. 604096) in terms of both amino acid sequence and agonist selectivity. In situ hybridization to rat brain tissues indicated that the mGluR7 gene is expressed widely, unlike mGluR4 and mGluR6. Wu et al. (1998) and Makoff et al. (1996) isolated human brain cDNAs encoding mGluR7. They both reported that the predicted 915-amino acid human protein is 99% identical to rat mGluR7. Wu et al. (1998) stated that the group III human receptors, mGluR7, mGluR4, and mGluR8 (OMIM Ref. No. 601116), share 67 to 70% protein sequence similarity with each other and 42 to 45% similarity with the group I and group II receptors. Using in situ hybridization, Makoff et al. (1996) determined that mGluR7 is expressed in many areas of the human brain, especially in the cerebral cortex, hippocampus, and cerebellum.

Full details of the abovementioned studies are described in the following publications, the disclosure of which are hereby incorporated by reference:

Okamoto, N.; Hori, S.; Akazawa, C.; Hayashi, Y.; Shigemoto, R.; Mizuno, N.; Nakanishi, S.: Molecular characterization of a new metabotropic glutamate receptor mGluR7 coupled to inhibitory cyclic AMP signal transduction. J. Biol. Chem. 269:1231-1236, 1994; and Wu, S.; Wright, R. A.; Rockey, P. K.; Burgett, S. G.; Arnold, J. S.; Rosteck, P. R., Jr.; Johnson, B. G.; Schoepp, D. D.; Belagaje, R. M.: Group III human metabotropic glutamate recept.

Further studies establishing the function and utilities of GRM7 are found in John Hopkins OMIM database record ID 604101, and in sited publications numbered 504 and 7055 listed in the bibliography section hereinbelow, which are also hereby incorporated by reference. Mannosyl (alpha-1,6-)-glycoprotein Beta-1,6-N-acetyl-glucosaminyltransferase (MGAT5, Accession NM_002410) is another VGAM746 host target gene. MGAT5 BINDING SITE is HOST TARGET binding site found in the 5' untranslated region of mRNA encoded by MGAT5, corresponding to a HOST TARGET binding site such as BINDING SITE I, BINDING SITE II or BINDING SITE III. Table 2 illustrates the complementarity of the nucleotide sequences of MGAT5 BINDING SITE, designated SEQ ID:8240, to the nucleotide sequence of VGAM746 RNA, herein designated VGAM RNA, also designated SEQ ID:3457.

Another function of VGAM746 is therefore inhibition of Mannosyl (alpha-1,6-)-glycoprotein Beta-1,6-N-acetyl-glucosaminyltransferase (MGAT5, Accession NM_002410). Accordingly, utilities of VGAM746 include diagnosis, prevention and treatment of diseases and clinical conditions associated with MGAT5. X-box Binding Protein 1 (XBP1, Accession NM_005080) is another VGAM746 host target gene. XBP1 BINDING SITE is HOST TARGET binding site found in the 3' untranslated region of mRNA encoded by XBP1, corresponding to a HOST TARGET binding site such as BINDING SITE I, BINDING SITE II or BINDING SITE III. Table 2 illustrates the complementarity of the nucleotide sequences of XBP1 BINDING SITE, designated SEQ ID:11533, to the nucleotide sequence of VGAM746 RNA, herein designated VGAM RNA, also designated SEQ ID:3457.

Another function of VGAM746 is therefore inhibition of X-box Binding Protein 1 (XBP1, Accession NM_005080), a gene which has a role in transcriptional regulation. Accordingly, utilities of VGAM746 include diagnosis, prevention and treatment of diseases and clinical conditions associated with XBP1. The function of XBP1 has been established by previous studies. The class II major histocompatibility complex antigens are a family of integral membrane proteins whose expression is tissue-specific and developmentally regulated. Three consensus sequences, X1, X2, and Y, separated by an interspace element, are found upstream from all class II genes. Deletion of each of these sequences eliminates expression of class II genes in vitro and in transgenic mice. Liou et al. (1990) isolated a cDNA encoding a DNA-binding protein whose target is the X boxes of DR-alpha and DP-beta. Liou et al. (1991) found that the protein, which they referred to as XBP1, acts as a transcription factor in B cells by recognizing both the X2 promoter element of both the human DR-alpha and DP-beta and mouse A-alpha genes. The cDNA for the XBP1 gene hybridized to human RNA species of approximately 2.2 kb and 2.6 kb, which were expressed in class II negative as well as class II positive cells. By in situ hybridization analysis, Reimold et al. (2001) demonstrated that XBP1 was expressed at high levels in plasma cells in rheumatoid synovium from 2 patients. By analysis of interspecies somatic cell hybrids, Liou et al. (1991) demonstrated that the XBP1 gene is located in the region 22pter-q13. A pseudogene was shown to be located on chromosome 5. Calfon et al. (2002) showed that the unfolded protein response (UPR) requires intact Ire1 (OMIM Ref. No. 604033) and Xbp1 in C. elegans. Both mouse and worm Ire1 splice a small intron from Xbp1 mRNA in response to UPR activation. Immunoblot analysis showed that, in the mouse, the processed, but not the unprocessed, 54-kD Xbp1 protein accumulates during the UPR and depends on Ire1. Calfon et al. (2002) proposed that an increased load of proteins in the endoplasmic reticulum activates Xbp1 and triggers the development of an elaborate secretory process, as seen in plasma cells Animal model experiments lend further support to the function of XBP1. By injecting Xbp1-deficient embryonic stem cells into Rag2 (OMIM Ref. No. 179616)-deficient blastocysts, Reimold et al. (2001) generated viable Xbp1 -/- mice. In these chimeric animals, Xbp1-deficient cells were abundant in lymphoid organs, variably expressed in other organs, and nearly absent from liver, consistent with the essential role of XBP1 in hepatocyte development. ELISA analysis showed low levels of immunoglobulin produced by Xbp1 -/- B cells, which could be reversed by transduction of Xbp1 into the B cells. Phenotype analysis indicated that Xbp1-deficient B and T cells could be activated to undergo proliferation, cell-surface activation-marker expression, class switch recombination, and cytokine secretion at normal levels. Histologic analysis revealed a dearth of plasma cells in the organs of Xbp1 -/- mice, and the cells did not express syndecan-1 (SDC1; 186355), a marker for terminally differentiated plasma cells, after immunization with DNP-albumin. Although B cells were generated in normal numbers and germinal center formation was normal, Xbp1 -/- mice did not make serum antibody in response to either T cell-dependent or -independent antigens or to polyoma virus, which is normally controlled by antibodies alone. Reimold et al. (2001) concluded that the defect in Xbp1-deficient mice is distal to the effects of transcription factors essential for germinal-center formation, such as Bcl3 (OMIM Ref. No. 109560), Bcl6 (OMIM Ref. No. 109565), Nfkb (OMIM Ref. No. 164011), and Irf4 (OMIM Ref. No. 601900), and distal to the expression of Irf4 and Blimp1 (PRDM1; 603423) in immature plasma cells exiting from germinal centers. They proposed that XBP1 has target genes that are essential in plasma-cell generation It is appreciated that the abovementioned animal model for XBP1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Calfon, M.; Zeng, H.; Urano, F.; Till, J. H.; Hubbard, S. R.; Harding, H. P.; Clark, S. G.; Ron, D.: IRE1 couples endoplasmic reticulum load to secretory capacity by processing the XBP-1 mRNA. Nature 415:92-96, 2002; and Reimold, A. M.; Iwakoshi, N. N.; Manis, J.; Vallabhajosyula, P.; Szomolanyi-Tsuda, E.; Gravallese, E. M.; Friend, D.; Grusby, M. J.; Alt, F.; Glimcher, L. H.: Plasma cell differentiati.

Further studies establishing the function and utilities of XBP1 are found in John Hopkins OMIM database record ID 194355, and in sited publications numbered 6040-6043 listed in the bibliography section hereinbelow, which are also hereby incorporated by reference. DKFZP434B044 (Accession NM_031476) is another VGAM746 host target gene. DKFZP434B044 BINDING SITE is HOST TARGET binding site found in the 3' untranslated region of mRNA encoded by DKFZP434B044, corresponding to a HOST TARGET binding site such as BINDING SITE I, BINDING SITE II or BINDING SITE III. Table 2 illustrates the complementarity of the nucleotide sequences of DKFZP434B044 BINDING SITE, designated SEQ ID:25553, to the nucleotide sequence of VGAM746 RNA, herein designated VGAM RNA, also designated SEQ ID:3457.

Another function of VGAM746 is therefore inhibition of DKFZP434B044 (Accession NM_031476). Accordingly, utilities of VGAM746 include diagnosis, prevention and treatment of diseases and clinical conditions associated with DKFZP434B044. FLJ12806 (Accession NM_022831) is another VGAM746 host target gene. FLJ12806 BINDING SITE is HOST TARGET binding site found in the 3' untranslated region of mRNA encoded by FLJ12806, corresponding to a HOST TARGET binding site such as BINDING SITE I, BINDING SITE II or BINDING SITE III. Table 2 illustrates the complementarity of the nucleotide sequences of FLJ12806 BINDING SITE, designated SEQ ID:23112, to the nucleotide sequence of VGAM746 RNA, herein designated VGAM RNA, also designated SEQ ID:3457.

Another function of VGAM746 is therefore inhibition of FLJ12806 (Accession NM_022831). Accordingly, utilities of VGAM746 include diagnosis, prevention and treatment of diseases and clinical conditions associated with FLJ12806. FLJ22635 (Accession NM_025092) is another VGAM746 host target gene. FLJ22635 BINDING SITE is HOST TARGET binding site found in the 3' untranslated region of mRNA encoded by FLJ22635, corresponding to a HOST TARGET binding site such as BINDING SITE I, BINDING SITE II or BINDING SITE III. Table 2 illustrates the complementarity of the nucleotide sequences of FLJ22635 BINDING SITE, designated SEQ ID:24716, to the nucleotide sequence of VGAM746 RNA, herein designated VGAM RNA, also designated SEQ ID:3457.

Another function of VGAM746 is therefore inhibition of FLJ22635 (Accession NM_025092). Accordingly, utilities of VGAM746 include diagnosis, prevention and treatment of diseases and clinical conditions associated with FLJ22635. FLJ23604 (Accession NM_025064) is another VGAM746 host target gene. FLJ23604 BINDING SITE is HOST TARGET binding site found in the 3' untranslated region of mRNA encoded by FLJ23604, corresponding to a HOST TARGET binding site such as BINDING SITE I, BINDING SITE II or BINDING SITE III. Table 2 illustrates the complementarity of the nucleotide sequences of FLJ23604 BINDING SITE, designated SEQ ID:24661, to the nucleotide sequence of VGAM746 RNA, herein designated VGAM RNA, also designated SEQ ID:3457.

Another function of VGAM746 is therefore inhibition of FLJ23604 (Accession NM_025064). Accordingly, utilities of VGAM746 include diagnosis, prevention and treatment of diseases and clinical conditions associated with FLJ23604. KIAA0557 (Accession XM_085507) is another VGAM746 host target gene. KIAA0557 BINDING SITE is HOST TARGET binding site found in the 3' untranslated region of mRNA encoded by KIAA0557, corresponding to a HOST TARGET binding site such as BINDING SITE I, BINDING SITE II or BINDING SITE III. Table 2 illustrates the complementarity of the nucleotide sequences of KIAA0557 BINDING SITE, designated SEQ ID:38202, to the nucleotide sequence of VGAM746 RNA, herein designated VGAM RNA, also designated SEQ ID:3457.

Another function of VGAM746 is therefore inhibition of KIAA0557 (Accession XM_085507). Accordingly, utilities of VGAM746 include diagnosis, prevention and treatment of diseases and clinical conditions associated with KIAA0557. LOC144742 (Accession XM_084949) is another VGAM746 host target gene. LOC144742 BINDING SITE is HOST TARGET binding site found in the 5' untranslated region of mRNA encoded by LOC144742, corresponding to a HOST TARGET binding site such as BINDING SITE I, BINDING SITE II or BINDING SITE III. Table 2 illustrates the complementarity of the nucleotide sequences of LOC144742 BINDING SITE, designated SEQ ID:37777, to the nucleotide sequence of VGAM746 RNA, herein designated VGAM RNA, also designated SEQ ID:3457.

Another function of VGAM746 is therefore inhibition of LOC144742 (Accession XM_084949). Accordingly, utilities of VGAM746 include diagnosis, prevention and treatment of diseases and clinical conditions associated with LOC144742. LOC145842 (Accession XM_085254) is another VGAM746 host target gene. LOC145842 BINDING SITE is HOST TARGET binding site found in the 5' untranslated region of mRNA encoded by LOC145842, corresponding to a HOST TARGET binding site such as BINDING SITE I, BINDING SITE II or BINDING SITE III. Table 2 illustrates the complementarity of the nucleotide sequences of LOC145842 BINDING SITE, designated SEQ ID:37997, to the nucleotide sequence of VGAM746 RNA, herein designated VGAM RNA, also designated SEQ ID:3457.

Another function of VGAM746 is therefore inhibition of LOC145842 (Accession XM_085254). Accordingly, utilities of VGAM746 include diagnosis, prevention and treatment of diseases and clinical conditions associated with LOC145842. LOC153711 (Accession XM_098419) is another VGAM746 host target gene. LOC153711 BINDING SITE is HOST TARGET binding site found in the 3' untranslated region of mRNA encoded by LOC153711, corresponding to a HOST TARGET binding site such as BINDING SITE I, BINDING SITE II or BINDING SITE III. Table 2 illustrates the complementarity of the nucleotide sequences of LOC153711 BINDING SITE, designated SEQ ID:41668, to the nucleotide sequence of VGAM746 RNA, herein designated VGAM RNA, also designated SEQ ID:3457.

Another function of VGAM746 is therefore inhibition of LOC153711 (Accession XM_098419). Accordingly, utilities of VGAM746 include diagnosis, prevention and treatment of diseases and clinical conditions associated with LOC153711. LOC51008 (Accession NM_015947) is another VGAM746 host target gene. LOC51008 BINDING SITE is HOST TARGET binding site found in the 3' untranslated region of mRNA encoded by LOC51008, corresponding to a HOST TARGET binding site such as BINDING SITE I, BINDING SITE II or BINDING SITE III. Table 2 illustrates the complementarity of the nucleotide sequences of LOC51008 BINDING SITE, designated SEQ ID:18064, to the nucleotide sequence of VGAM746 RNA, herein designated VGAM RNA, also designated SEQ ID:3457.

Another function of VGAM746 is therefore inhibition of LOC51008 (Accession NM_015947). Accordingly, utilities of VGAM746 include diagnosis, prevention and treatment of diseases and clinical conditions associated with LOC51008. FIG. 1 further provides a conceptual description of a novel bioinformatically detected viral gene of the present invention, referred to here as Viral Genomic Address Messenger 747 (VGAM747) viral gene, which modulates expression of respective host target genes thereof, the function and utility of which host target genes is known in the art.

VGAM747 is a novel bioinformatically detected regulatory, non protein coding, viral micro RNA (miRNA) gene. The method by which VGAM747 was detected is described hereinabove with reference to FIGS. 1-8.

VGAM747 gene, herein designated VGAM GENE, is a viral gene contained in the genome of Bovine Coronavirus. VGAM747 host target gene, herein designated VGAM HOST TARGET GENE, is a human gene contained in the human genome.

VGAM747 gene encodes a VGAM747 precursor RNA, herein designated VGAM PRECURSOR RNA. Similar to other miRNA genes, and unlike most ordinary genes, VGAM747 precursor RNA does not encode a protein. A nucleotide sequence identical or highly similar to the nucleotide sequence of VGAM747 precursor RNA is designated SEQ ID:733, and is provided hereinbelow with reference to the sequence listing part. Nucleotide sequence SEQ ID:733 is located at position 1579 relative to the genome of Bovine Coronavirus.

VGAM747 precursor RNA folds onto itself, forming VGAM747 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM747 folded precursor RNA into VGAM747 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM747 RNA is designated SEQ ID:3458, and is provided hereinbelow with reference to the sequence listing part.

VGAM747 host target gene, herein designated VGAM HOST TARGET GENE, encodes a corresponding messenger RNA, VGAM747 host target RNA, herein designated VGAM HOST TARGET RNA. VGAM747 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM747 RNA, herein designated VGAM RNA, binds complementarily to one or more host target binding sites located in untranslated regions of VGAM747 host target RNA, herein designated VGAM HOST TARGET RNA. This complementary binding is due to the fact that the nucleotide sequence of VGAM747 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM747 RNA, herein designated VGAM RNA, may have a different number of host target binding sites in untranslated regions of a VGAM747 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM747 RNA, herein designated VGAM RNA, to host target binding sites on VGAM747 host target RNA, herein designated VGAM HOST TARGET RNA, such as BINDING SITE I, BINDING SITE II and BINDING SITE III, inhibits translation of VGAM747 host target RNA into VGAM747 host target protein, herein designated VGAM HOST TARGET PROTEIN. VGAM host target protein is therefore outlined by a broken line.

It is appreciated that VGAM747 host target gene, herein designated VGAM HOST TARGET GENE, in fact represents a plurality of VGAM747 host target genes. The mRNA of each one of this plurality of VGAM747 host target genes comprises one or more host target binding sites, each having a nucleotide sequence which is at least partly complementary to VGAM747 RNA, herein designated VGAM RNA, and which when bound by VGAM747 RNA causes inhibition of translation of respective one or more VGAM747 host target proteins.

It is further appreciated by one skilled in the art that the mode of translational inhibition illustrated by FIG. 1 with specific reference to translational inhibition exerted by VGAM747 gene, herein designated VGAM GENE, on one or more VGAM747 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM747 is inhibition of expression of host target genes, as part of a novel viral mechanism of attacking a host. Accordingly, utilities of VGAM747 include diagnosis, prevention and treatment of viral infection by Bovine Coronavirus. Specific functions, and accordingly utilities, of VGAM747 correlate with, and may be deduced from, the identity of the host target genes which VGAM747 binds and inhibits, and the function of these host target genes, as elaborated hereinbelow.

Nucleotide sequences of the VGAM747 precursor RNA, herein designated VGAM PRECURSOR RNA, and of the 'diced' VGAM747 RNA, herein designated VGAM RNA, and a schematic representation of the secondary folding of VGAM747 folded precursor RNA, herein designated VGAM FOLDED PRECURSOR RNA, of VGAM747 are further described hereinbelow with reference to Table 1.

Nucleotide sequences of host target binding sites, such as BINDING SITE-I, BINDING SITE-II and BINDING SITE-III of FIG. 1, found on VGAM747 host target RNA, and schematic representation of the complementarity of each of these host target binding sites to VGAM747 RNA, herein designated VGAM RNA, are described hereinbelow with reference to Table 2.

As mentioned hereinabove with reference to FIG. 1, a function of VGAM747 gene, herein designated VGAM is inhibition of expression of VGAM747 target genes. It is appreciated that specific functions, and accordingly utilities, of VGAM747 correlate with, and may be deduced from, the identity of the target genes which VGAM747 binds and inhibits, and the function of these target genes, as elaborated hereinbelow.

Discs, Large (Drosophila) Homolog 5 (DLG5, Accession XM_096398) is a VGAM747 host target gene. DLG5 BINDING SITE is HOST TARGET binding site found in the 5' untranslated region of mRNA encoded by DLG5, corresponding to a HOST TARGET binding site such as BINDING SITE I, BINDING SITE II or BINDING SITE III. Table 2 illustrates the complementarity of the nucleotide sequences of DLG5 BINDING SITE, designated SEQ ID:40331, to the nucleotide sequence of VGAM747 RNA, herein designated VGAM RNA, also designated SEQ ID:3458.

A function of VGAM747 is therefore inhibition of Discs, Large (Drosophila) Homolog 5 (DLG5, Accession XM_096398), a gene which may transmit extracellular signals to inhibit cell proliferation. Accordingly, utilities of VGAM747 include diagnosis, prevention and treatment of diseases and clinical conditions associated with DLG5. The function of DLG5 and its association with various diseases and clinical conditions, has been established by previous studies, as described hereinabove with reference to VGAM444. FBJ Murine Osteosarcoma Viral Oncogene Homolog B (FOSB, Accession NM_006732) is another VGAM747 host target gene. FOSB BINDING SITE is HOST TARGET binding site found in the 3' untranslated region of mRNA encoded by FOSB, corresponding to a HOST TARGET binding site such as BINDING SITE I, BINDING SITE II or BINDING SITE III. Table 2 illustrates the complementarity of the nucleotide sequences of FOSB BINDING SITE, designated SEQ ID:13580, to the nucleotide sequence of VGAM747 RNA, herein designated VGAM RNA, also designated SEQ ID:3458.

Another function of VGAM747 is therefore inhibition of FBJ Murine Osteosarcoma Viral Oncogene Homolog B (FOSB, Accession NM_006732), a gene which interacts with jun proteins enhancing their dna binding activity. Accordingly, utilities of VGAM747 include diagnosis, prevention and treatment of diseases and clinical conditions associated with FOSB. The function of FOSB has been established by previous studies. Cocaine enhances dopamine-mediated neurotransmission by blocking dopamine reuptake at axon terminals. Most dopamine-containing nerve terminals innervate medium spiny neurons in the striatum of the brain. Cocaine addiction is thought to stem, in part, from neural adaptations that act to maintain equilibrium by countering the effects of repeated drug administration. Chronic exposure to cocaine upregulates several transcription factors that alter gene expression and which could mediate such compensatory neural and behavioral changes. One such transcription factor is delta-FosB, a protein that persists in striatum long after the end of cocaine exposure. Using DNA array analysis of striatal material from inducible transgenic mice, Bibb et al. (2001) identified Cdk5 (OMIM Ref. No. 123831) as a downstream target of delta-FosB. Overexpression of delta-FosB, or chronic cocaine administration, raised levels of Cdk5 mRNA, protein, and activity in the striatum. Moreover, injection of Cdk5 inhibitors into the striatum potentiated behavioral effects of repeated cocaine administration. Bibb et al. (2001) concluded that changes in Cdk5 levels mediated by delta-FosB, and resulting alterations in signaling involving D1 dopamine receptors, contribute to adaptive changes in the brain related to cocaine addiction. Animal model experiments lend further support to the function of FOSB. Brown et al. (1996) demonstrated that mice in whom the FOSB gene had been inactivated by homologous recombination displayed a profound defect in reproduction. The reproductive failure of fosB mutant mice was due to a specific behavioral defect that resulted in an inability to nurture young. This nurturing defect was seen not only in postpartum females but also in young females and males. Together, these findings provided evidence that nurturing behavior in mammals is genetically controlled and that an immediate early gene, FOSB, is critical for an adaptive neuronal response. Brown et al. (1996) speculated that the nurturing defect is likely due to the absence of FOSB in the preoptic area, a region of the hypothalamus that is critical for nurturing. They stated that this is an example of a transcription factor that controls a complex behavior by regulating a specific neuronal circuit.

It is appreciated that the abovementioned animal model for FOSB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bibb, J. A.; Chen, J.; Taylor, J. R.; Svenningsson, P.; Nishi, A.; Snyder, G. L.; Yan, Z.; Sagawa, Z. K.; Ouimet, C. C.; Nairn, A. C.; Nestler, E. J.; Greengard, P.: Effects of chronic exposure to cocaine are regulated by the neuronal protein Cdk5. Nature 410:376-380, 2001; and Brown, J. R.; Ye, H.; Bronson, R. T.; Dikkes, P.; Greenberg, M. E.: A defect in nurturing in mice lacking the immediate early gene fosB. Cell 86:297-309, 1996.

Further studies establishing the function and utilities of FOSB are found in John Hopkins OMIM database record ID 164772, and in sited publications numbered 4341-3828, 383 and 3830-3831 listed in the bibliography section hereinbelow, which are also hereby incorporated by reference.

LOC130813 (Accession XM_065904) is another VGAM747 host target gene. LOC130813 BINDING SITE is HOST TARGET binding site found in the 3' untranslated region of mRNA encoded by LOC130813, corresponding to a HOST TARGET binding site such as BINDING SITE I, BINDING SITE II or BINDING SITE III. Table 2 illustrates the complementarity of the nucleotide sequences of LOC130813 BINDING SITE, designated SEQ ID:37305, to the nucleotide sequence of VGAM747 RNA, herein designated VGAM RNA, also designated SEQ ID:3458.

Another function of VGAM747 is therefore inhibition of LOC130813 (Accession XM_065904). Accordingly, utilities of VGAM747 include diagnosis, prevention and treatment of diseases and clinical conditions associated with LOC130813. LOC202460 (Accession XM_114493) is another VGAM747 host target gene. LOC202460 BINDING SITE is HOST TARGET binding site found in the 5' untranslated region of mRNA encoded by LOC202460, corresponding to a HOST TARGET binding site such as BINDING SITE I, BINDING SITE II or BINDING SITE III. Table 2 illustrates the complementarity of the nucleotide sequences of LOC202460 BINDING SITE, designated SEQ ID:42979, to the nucleotide sequence of VGAM747 RNA, herein designated VGAM RNA, also designated SEQ ID:3458.

Another function of VGAM747 is therefore inhibition of LOC202460 (Accession XM_114493). Accordingly, utilities of VGAM747 include diagnosis, prevention and treatment of diseases and clinical conditions associated with LOC202460. LOC221895 (Accession XM_166511) is another VGAM747 host target gene. LOC221895 BINDING SITE is HOST TARGET binding site found in the 3' untranslated region of mRNA encoded by LOC221895, corresponding to a HOST TARGET binding site such as BINDING SITE I, BINDING SITE II or BINDING SITE III. Table 2 illustrates the complementarity of the nucleotide sequences of LOC221895 BINDING SITE, designated SEQ ID:44441, to the nucleotide sequence of VGAM747 RNA, herein designated VGAM RNA, also designated SEQ ID:3458.

Another function of VGAM747 is therefore inhibition of LOC221895 (Accession XM_166511). Accordingly, utilities of VGAM747 include diagnosis, prevention and treatment of diseases and clinical conditions associated with LOC221895.

FIG. 1 further provides a conceptual description of a novel bioinformatically detected viral gene of the present invention, referred to here as Viral Genomic Address Messenger 748 (VGAM748) viral gene, which modulates expression of respective host target genes thereof, the function and utility of which host target genes is known in the art.

VGAM748 is a novel bioinformatically detected regulatory, non protein coding, viral micro RNA (miRNA) gene. The method by which VGAM748 was detected is described hereinabove with reference to FIGS. 1-8.

VGAM748 gene, herein designated VGAM GENE, is a viral gene contained in the genome of Bovine Coronavirus. VGAM748 host target gene, herein designated VGAM HOST TARGET GENE, is a human gene contained in the human genome.

VGAM748 gene encodes a VGAM748 precursor RNA, herein designated VGAM PRECURSOR RNA. Similar to other miRNA genes, and unlike most ordinary genes, VGAM748 precursor RNA does not encode a protein. A nucleotide sequence identical or highly similar to the nucleotide sequence of VGAM748 precursor RNA is designated SEQ ID:734, and is provided hereinbelow with reference to the sequence listing part. Nucleotide sequence SEQ ID:734 is located at position 20531 relative to the genome of Bovine Coronavirus.

VGAM748 precursor RNA folds onto itself, forming VGAM748 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM748 folded precursor RNA into VGAM748 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM748 RNA is designated SEQ ID:3459, and is provided hereinbelow with reference to the sequence listing part.

VGAM748 host target gene, herein designated VGAM HOST TARGET GENE, encodes a corresponding messenger RNA, VGAM748 host target RNA, herein designated VGAM HOST TARGET RNA. VGAM748 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM748 RNA, herein designated VGAM RNA, binds complementarily to one or more host target binding sites located in untranslated regions of VGAM748 host target RNA, herein designated VGAM HOST TARGET RNA. This complementary binding is due to the fact that the nucleotide sequence of VGAM748 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM748 RNA, herein designated VGAM RNA, may have a different number of host target binding sites in untranslated regions of a VGAM748 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM748 RNA, herein designated VGAM RNA, to host target binding sites on VGAM748 host target RNA, herein designated VGAM HOST TARGET RNA, such as BINDING SITE I, BINDING SITE II and BINDING SITE III, inhibits translation of VGAM748 host target RNA into VGAM748 host target protein, herein designated VGAM HOST TARGET PROTEIN. VGAM host target protein is therefore outlined by a broken line.

It is appreciated that VGAM748 host target gene, herein designated VGAM HOST TARGET GENE, in fact represents a plurality of VGAM748 host target genes. The mRNA of each one of this plurality of VGAM748 host target genes comprises one or more host target binding sites, each having a nucleotide sequence which is at least partly complementary to VGAM748 RNA, herein designated VGAM RNA, and which when bound by VGAM748 RNA causes inhibition of translation of respective one or more VGAM748 host target proteins.

It is further appreciated by one skilled in the art that the mode of translational inhibition illustrated by FIG. 1 with specific reference to translational inhibition exerted by VGAM748 gene, herein designated VGAM GENE, on one or more VGAM748 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM748 is inhibition of expression of host target genes, as part of a novel viral mechanism of attacking a host. Accordingly, utilities of VGAM748 include diagnosis, prevention and treatment of viral infection by Bovine Coronavirus. Specific functions, and accordingly utilities, of VGAM748 correlate with, and may be deduced from, the identity of the host target genes which VGAM748 binds and inhibits, and the function of these host target genes, as elaborated hereinbelow.

Nucleotide sequences of the VGAM748 precursor RNA, herein designated VGAM PRECURSOR RNA, and of the 'diced' VGAM748 RNA, herein designated VGAM RNA, and a schematic representation of the secondary folding of VGAM748 folded precursor RNA, herein designated VGAM FOLDED PRECURSOR RNA, of VGAM748 are further described hereinbelow with reference to Table 1.

Nucleotide sequences of host target binding sites, such as BINDING SITE-I, BINDING SITE-II and BINDING SITE-III of FIG. 1, found on VGAM748 host target RNA, and schematic representation of the complementarity of each of these host target binding sites to VGAM748 RNA, herein designated VGAM RNA, are described hereinbelow with reference to Table 2.

As mentioned hereinabove with reference to FIG. 1, a function of VGAM748 gene, herein designated VGAM is inhibition of expression of VGAM748 target genes. It is appreciated that specific functions, and accordingly utilities, of VGAM748 correlate with, and may be deduced from, the identity of the target genes which VGAM748 binds and inhibits, and the function of these target genes, as elaborated hereinbelow.

FLJ11280 (Accession NM_018379) is a VGAM748 host target gene. FLJ11280 BINDING SITE is HOST TARGET binding site found in the 5' untranslated region of mRNA encoded by FLJ11280, corresponding to a HOST TARGET binding site such as BINDING SITE I, BINDING SITE II or BINDING SITE III. Table 2 illustrates the complementarity of the nucleotide sequences of FLJ11280 BINDING SITE, designated SEQ ID:20405, to the nucleotide sequence of VGAM748 RNA, herein designated VGAM RNA, also designated SEQ ID:3459.

A function of VGAM748 is therefore inhibition of FLJ11280 (Accession NM_018379). Accordingly, utilities of VGAM748 include diagnosis, prevention and treatment of diseases and clinical conditions associated with FLJ11280. KIAA0172 (Accession XM_036295) is another VGAM748 host target gene. KIAA0172 BINDING SITE is HOST TARGET binding site found in the 5' untranslated region of mRNA encoded by KIAA0172, corresponding to a HOST TARGET binding site such as BINDING SITE I, BINDING SITE II or BINDING SITE III. Table 2 illustrates the complementarity of the nucleotide sequences of KIAA0172 BINDING SITE, designated SEQ ID:32410, to the nucleotide sequence of VGAM748 RNA, herein designated VGAM RNA, also designated SEQ ID:3459.

Another function of VGAM748 is therefore inhibition of KIAA0172 (Accession XM_036295). Accordingly, utilities of VGAM748 include diagnosis, prevention and treatment of diseases and clinical conditions associated with KIAA0172. Solute Carrier Family 17 (sodium-dependent inorganic phosphate cotransporter), Member 6 (SLC17A6, Accession NM_020346) is another VGAM748 host target gene. SLC17A6 BINDING SITE is HOST TARGET binding site found in the 3' untranslated region of mRNA encoded by SLC17A6, corresponding to a HOST TARGET binding site such as BINDING SITE I, BINDING SITE II or BINDING SITE III. Table 2 illustrates the complementarity of the nucleotide sequences of SLC17A6 BINDING SITE, designated SEQ ID:21596, to the nucleotide sequence of VGAM748 RNA, herein designated VGAM RNA, also designated SEQ ID:3459.

Another function of VGAM748 is therefore inhibition of Solute Carrier Family 17 (sodium-dependent inorganic phosphate cotransporter), Member 6 (SLC17A6, Accession NM_020346). Accordingly, utilities of VGAM748 include diagnosis, prevention and treatment of diseases and clinical conditions associated with SLC17A6. LOC200488 (Accession XM_117240) is another VGAM748 host target gene. LOC200488 BINDING SITE is HOST TARGET binding site found in the 5' untranslated region of mRNA encoded by LOC200488, corresponding to a HOST TARGET binding site such as BINDING SITE I, BINDING SITE II or BINDING SITE III. Table 2 illustrates the complementarity of the nucleotide sequences of LOC200488 BINDING SITE, designated SEQ ID:43313, to the nucleotide sequence of VGAM748 RNA, herein designated VGAM RNA, also designated SEQ ID:3459.

Another function of VGAM748 is therefore inhibition of LOC200488 (Accession XM_117240). Accordingly, utilities of VGAM748 include diagnosis, prevention and treatment of diseases and clinical conditions associated with LOC200488. FIG. 1 further provides a conceptual description of a novel bioinformatically detected viral gene of the present invention, referred to here as Viral Genomic Address Messenger 749 (VGAM749) viral gene, which modulates expression of respective host target genes thereof, the function and utility of which host target genes is known in the art.

VGAM749 is a novel bioinformatically detected regulatory, non protein coding, viral micro RNA (miRNA) gene. The method by which VGAM749 was detected is described hereinabove with reference to FIGS. 1-8.

VGAM749 gene, herein designated VGAM GENE, is a viral gene contained in the genome of Bovine Coronavirus. VGAM749 host target gene, herein designated VGAM HOST TARGET GENE, is a human gene contained in the human genome.

VGAM749 gene encodes a VGAM749 precursor RNA, herein designated VGAM PRECURSOR RNA. Similar to other miRNA genes, and unlike most ordinary genes, VGAM749 precursor RNA does not encode a protein. A nucleotide sequence identical or highly similar to the nucleotide sequence of VGAM749 precursor RNA is designated SEQ ID:735, and is provided hereinbelow with reference to the sequence listing part. Nucleotide sequence SEQ ID:735 is located at position 20005 relative to the genome of Bovine Coronavirus.

VGAM749 precursor RNA folds onto itself, forming VGAM749 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM749 folded precursor RNA into VGAM749 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM749 RNA is designated SEQ ID:3460, and is provided hereinbelow with reference to the sequence listing part.

VGAM749 host target gene, herein designated VGAM HOST TARGET GENE, encodes a corresponding messenger RNA, VGAM749 host target RNA, herein designated VGAM HOST TARGET RNA. VGAM749 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM749 RNA, herein designated VGAM RNA, binds complementarily to one or more host target binding sites located in untranslated regions of VGAM749 host target RNA, herein designated VGAM HOST TARGET RNA. This complementary binding is due to the fact that the nucleotide sequence of VGAM749 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM749 RNA, herein designated VGAM RNA, may have a different number of host target binding sites in untranslated regions of a VGAM749 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM749 RNA, herein designated VGAM RNA, to host target binding sites on VGAM749 host target RNA, herein designated VGAM HOST TARGET RNA, such as BINDING SITE I, BINDING SITE II and BINDING SITE III, inhibits translation of VGAM749 host target RNA into VGAM749 host target protein, herein designated VGAM HOST TARGET PROTEIN. VGAM host target protein is therefore outlined by a broken line.

It is appreciated that VGAM749 host target gene, herein designated VGAM HOST TARGET GENE, in fact represents a plurality of VGAM749 host target genes. The mRNA of each one of this plurality of VGAM749 host target genes comprises one or more host target binding sites, each having a nucleotide sequence which is at least partly complementary to VGAM749 RNA, herein designated VGAM RNA, and which when bound by VGAM749 RNA causes inhibition of translation of respective one or more VGAM749 host target proteins.

It is further appreciated by one skilled in the art that the mode of translational inhibition illustrated by FIG. 1 with specific reference to translational inhibition exerted by VGAM749 gene, herein designated VGAM GENE, on one or more VGAM749 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM749 is inhibition of expression of host target genes, as part of a novel viral mechanism of attacking a host. Accordingly, utilities of VGAM749 include diagnosis, prevention and treatment of viral infection by Bovine Coronavirus. Specific functions, and accordingly utilities, of VGAM749 correlate with, and may be deduced from, the identity of the host target genes which VGAM749 binds and inhibits, and the function of these host target genes, as elaborated hereinbelow.

Nucleotide sequences of the VGAM749 precursor RNA, herein designated VGAM PRECURSOR RNA, and of the 'diced' VGAM749 RNA, herein designated VGAM RNA, and a schematic representation of the secondary folding of VGAM749 folded precursor RNA, herein designated VGAM FOLDED PRECURSOR RNA, of VGAM749 are further described hereinbelow with reference to Table 1.

Nucleotide sequences of host target binding sites, such as BINDING SITE-I, BINDING SITE-II and BINDING SITE-III of FIG. 1, found on VGAM749 host target RNA, and schematic representation of the complementarity of each of these host target binding sites to VGAM749 RNA, herein designated VGAM RNA, are described hereinbelow with reference to Table 2.

As mentioned hereinabove with reference to FIG. 1, a function of VGAM749 gene, herein designated VGAM is inhibition of expression of VGAM749 target genes. It is appreciated that specific functions, and accordingly utilities, of VGAM749 correlate with, and may be deduced from, the identity of the target genes which VGAM749 binds and inhibits, and the function of these target genes, as elaborated hereinbelow.

Activin A Receptor, Type I (ACVR1, Accession NM_001105) is a VGAM749 host target gene. ACVR1 BINDING SITE is HOST TARGET binding site found in the 3' untranslated region of mRNA encoded by ACVR1, corresponding to a HOST TARGET binding site such as BINDING SITE I, BINDING SITE II or BINDING SITE III. Table 2 illustrates the complementarity of the nucleotide sequences of ACVR1 BINDING SITE, designated SEQ ID:6762, to the nucleotide sequence of VGAM749 RNA, herein designated VGAM RNA, also designated SEQ ID:3460.

A function of VGAM749 is therefore inhibition of Activin A Receptor, Type I (ACVR1, Accession NM_001105), a gene which Activin receptor-like kinase; similar to activin, TGF-beta, and C. elegans daf-1 receptors. Accordingly, utilities of VGAM749 include diagnosis, prevention and treatment of diseases and clinical conditions associated with ACVR1. The function of ACVR1 and its association with various diseases and clinical conditions, has been established by previous studies, as described hereinabove with reference to VGAM217. Hexokinase 1 (HK1, Accession NM_000188) is another VGAM749 host target gene. HK1 BINDING SITE1 through HK1 BINDING SITE5 are HOST TARGET binding sites found in untranslated regions of mRNA encoded by HK1, corresponding to HOST TARGET binding sites such as BINDING SITE I, BINDING SITE II or BINDING SITE III. Table 2 illustrates the complementarity of the nucleotide sequences of HK1 BINDING SITE1 through HK1 BINDING SITE5, designated SEQ ID:5689, SEQ ID:27267, SEQ ID:27270, SEQ ID:27273 and SEQ ID:27266 respectively, to the nucleotide sequence of VGAM749 RNA, herein designated VGAM RNA, also designated SEQ ID:3460.

Another function of VGAM749 is therefore inhibition of Hexokinase 1 (HK1, Accession NM_000188). Accordingly, utilities of VGAM749 include diagnosis, prevention and treatment of diseases and clinical conditions associated with HK1. Kinesin Family Member 5C (KIF5C, Accession NM_004522) is another VGAM749 host target gene. KIF5C BINDING SITE is HOST TARGET binding site found in the 3' untranslated region of mRNA encoded by KIF5C, corresponding to a HOST TARGET binding site such as BINDING SITE I, BINDING SITE II or BINDING SITE III. Table 2 illustrates the complementarity of the nucleotide sequences of KIF5C BINDING SITE, designated SEQ ID:10852, to the nucleotide sequence of VGAM749 RNA, herein designated VGAM RNA, also designated SEQ ID:3460.

Another function of VGAM749 is therefore inhibition of Kinesin Family Member 5C (KIF5C, Accession NM_004522). Accordingly, utilities of VGAM749 include diagnosis, prevention and treatment of diseases and clinical conditions associated with KIF5C. Steroid-5-alpha-reductase, Alpha Polypeptide 1 (3-oxo-5 alpha-steroid delta 4-dehydrogenase alpha 1) (SRD5A1, Accession NM_001047) is another VGAM749 host target gene. SRD5A1 BINDING SITE is HOST TARGET binding site found in the 3' untranslated region of mRNA encoded by SRD5A1, corresponding to a HOST TARGET binding site such as BINDING SITE I, BINDING SITE II or BINDING SITE III. Table 2 illustrates the complementarity of the nucleotide sequences of SRD5A1 BINDING SITE, designated SEQ ID:6714, to the nucleotide sequence of VGAM749 RNA, herein designated VGAM RNA, also designated SEQ ID:3460.

Another function of VGAM749 is therefore inhibition of Steroid-5-alpha-reductase, Alpha Polypeptide 1 (3-oxo-5 alpha-steroid delta 4-dehydrogenase alpha 1) (SRD5A1, Accession NM_001047), a gene which catalyzes the conversion of testosterone into 5-alpha-dihydrotestosterone and progesterone. Accordingly, utilities of VGAM749 include diagnosis, prevention and treatment of diseases and clinical conditions associated with SRD5A1. The function of SRD5A1 has been established by previous studies. Harris et al. (1992) concluded that SRD5A1 is a minor component of the reductase activity in prostate although the gene was originally cloned from prostate. On the other hand, SRD5A1 appears to be the predominant isozyme of steroid 5-alpha-reductase in the scalp and elsewhere in the skin. The possibility of scalp-selective inhibitors being useful in the treatment of male pattern baldness, acne, and hirsutism, all 'disorders' that appear to be dihydrotestosterone dependent, was raised. Jenkins et al. (1992) used RFLPs of the SRD5A1 gene to exclude the gene as the site of the mutation in classic 5-alpha-reductase deficiency (pseudovaginal perineoscrotal hypospadias; 264600). They further showed that in contrast to the major steroid 5-alpha-reductase in the prostate and cultured skin fibroblasts, which was designated SRD5A2, the cDNA-encoded enzyme, representing SRD5A1, exhibited a neutral to basic pH optimum and was much less sensitive to inhibition by the 4-aza steroid finasteride.

Full details of the abovementioned studies are described in the following publications, the disclosure of which are hereby incorporated by reference:

Harris, G.; Azzolina, B.; Baginsky, W.; Cimis, G.; Rasmusson, G. H.; Tolman, R. L.; Raetz, C. R. H.; Ellsworth, K.: Identification and selective inhibition of an isozyme of steroid 5-alpha-reductase in human scalp. Proc. Nat. Acad. Sci. 89: 10787-10791, 1992; and Jenkins, E. P.; Andersson, S.; Imperato-McGinley, J.; Wilson, J. D.; Russell, D. W.: Genetic and pharmacological evidence for more than one human steroid 5-alpha-reductase. J. Clin. Invest.

Further studies establishing the function and utilities of SRD5A1 are found in John Hopkins OMIM database record ID 184753, and in sited publications numbered 12628-12631, 190 and 12632-12634 listed in the bibliography section hereinbelow, which are also hereby incorporated by reference. MGC13159 (Accession NM_032927) is another VGAM749 host target gene. MGC13159 BINDING SITE is HOST TARGET binding site found in the 3' untranslated region of mRNA encoded by MGC13159, corresponding to a HOST TARGET binding site such as BINDING SITE I, BINDING SITE II or BINDING SITE III. Table 2 illustrates the complementarity of the nucleotide sequences of MGC13159 BINDING SITE, designated SEQ ID:26751, to the nucleotide sequence of VGAM749 RNA, herein designated VGAM RNA, also designated SEQ ID:3460.

Another function of VGAM749 is therefore inhibition of MGC13159 (Accession NM_032927). Accordingly, utilities of VGAM749 include diagnosis, prevention and treatment of diseases and clinical conditions associated with MGC13159. MGC3020 (Accession NM_024048) is another VGAM749 host target gene. MGC3020 BINDING SITE is HOST TARGET binding site found in the 3' untranslated region of mRNA encoded by MGC3020, corresponding to a HOST TARGET binding site such as BINDING SITE I, BINDING SITE II or BINDING SITE III. Table 2 illustrates the complementarity of the nucleotide sequences of MGC3020 BINDING SITE, designated SEQ ID:23483, to the nucleotide sequence of VGAM749 RNA, herein designated VGAM RNA, also designated SEQ ID:3460.

Another function of VGAM749 is therefore inhibition of MGC3020 (Accession NM_024048). Accordingly, utilities of VGAM749 include diagnosis, prevention and treatment of diseases and clinical conditions associated with MGC3020. LOC146227 (Accession XM_085374) is another VGAM749 host target gene. LOC146227 BINDING SITE is HOST TARGET binding site found in the 5' untranslated region of mRNA encoded by LOC146227, corresponding to a HOST TARGET binding site such as BINDING SITE I, BINDING SITE II or BINDING SITE III. Table 2 illustrates the complementarity of the nucleotide sequences of LOC146227 BINDING SITE, designated SEQ ID:38081, to the nucleotide sequence of VGAM749 RNA, herein designated VGAM RNA, also designated SEQ ID:3460.

Another function of VGAM749 is therefore inhibition of LOC146227 (Accession XM_085374). Accordingly, utilities of VGAM749 include diagnosis, prevention and treatment of diseases and clinical conditions associated with LOC146227. LOC151719 (Accession XM_087280) is another VGAM749 host target gene. LOC151719 BINDING SITE is HOST TARGET binding site found in the 5' untranslated region of mRNA encoded by LOC151719, corresponding to a HOST TARGET binding site such as BINDING SITE I, BINDING SITE II or BINDING SITE III. Table 2 illustrates the complementarity of the nucleotide sequences of LOC151719 BINDING SITE, designated SEQ ID:39161, to the nucleotide sequence of VGAM749 RNA, herein designated VGAM RNA, also designated SEQ ID:3460.

Another function of VGAM749 is therefore inhibition of LOC151719 (Accession XM_087280). Accordingly, utilities of VGAM749 include diagnosis, prevention and treatment of diseases and clinical conditions associated with LOC151719. FIG. 1 further provides a conceptual description of a novel bioinformatically detected viral gene of the present invention, referred to here as Viral Genomic Address Messenger 750 (VGAM750) viral gene, which modulates expression of respective host target genes thereof, the function and utility of which host target genes is known in the art.

VGAM750 is a novel bioinformatically detected regulatory, non protein coding, viral micro RNA (miRNA) gene. The method by which VGAM750 was detected is described hereinabove with reference to FIGS. 1-8.

VGAM750 gene, herein designated VGAM GENE, is a viral gene contained in the genome of Bovine Coronavirus. VGAM750 host target gene, herein designated VGAM HOST TARGET GENE, is a human gene contained in the human genome.

VGAM750 gene encodes a VGAM750 precursor RNA, herein designated VGAM PRECURSOR RNA. Similar to other miRNA genes, and unlike most ordinary genes, VGAM750 precursor RNA does not encode a protein. A nucleotide sequence identical or highly similar to the nucleotide sequence of VGAM750 precursor RNA is designated SEQ ID:736, and is provided hereinbelow with reference to the sequence listing part. Nucleotide sequence SEQ ID:736 is located at position 9253 relative to the genome of Bovine Coronavirus.

VGAM750 precursor RNA folds onto itself, forming VGAM750 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM750 folded precursor RNA into VGAM750 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM750 RNA is designated SEQ ID:3461, and is provided hereinbelow with reference to the sequence listing part.

VGAM750 host target gene, herein designated VGAM HOST TARGET GENE, encodes a corresponding messenger RNA, VGAM750 host target RNA, herein designated VGAM HOST TARGET RNA. VGAM750 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM750 RNA, herein designated VGAM RNA, binds complementarily to one or more host target binding sites located in untranslated regions of VGAM750 host target RNA, herein designated VGAM HOST TARGET RNA. This complementary binding is due to the fact that the nucleotide sequence of VGAM750 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM750 RNA, herein designated VGAM RNA, may have a different number of host target binding sites in untranslated regions of a VGAM750 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM750 RNA, herein designated VGAM RNA, to host target binding sites on VGAM750 host target RNA, herein designated VGAM HOST TARGET RNA, such as BINDING SITE I, BINDING SITE II and BINDING SITE III, inhibits translation of VGAM750 host target RNA into VGAM750 host target protein, herein designated VGAM HOST TARGET PROTEIN. VGAM host target protein is therefore outlined by a broken line.

It is appreciated that VGAM750 host target gene, herein designated VGAM HOST TARGET GENE, in fact represents a plurality of VGAM750 host target genes. The mRNA of each one of this plurality of VGAM750 host target genes comprises one or more host target binding sites, each having a nucleotide sequence which is at least partly complementary to VGAM750 RNA, herein designated VGAM RNA, and which when bound by VGAM750 RNA causes inhibition of translation of respective one or more VGAM750 host target proteins.

It is further appreciated by one skilled in the art that the mode of translational inhibition illustrated by FIG. 1 with specific reference to translational inhibition exerted by VGAM750 gene, herein designated VGAM GENE, on one or more VGAM750 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM750 is inhibition of expression of host target genes, as part of a novel viral mechanism of attacking a host. Accordingly, utilities of VGAM750 include diagnosis, prevention and treatment of viral infection by Bovine Coronavirus. Specific functions, and accordingly utilities, of VGAM750 correlate with, and may be deduced from, the identity of the host target genes which VGAM750 binds and inhibits, and the function of these host target genes, as elaborated hereinbelow.

Nucleotide sequences of the VGAM750 precursor RNA, herein designated VGAM PRECURSOR RNA, and of the 'diced' VGAM750 RNA, herein designated VGAM RNA, and a schematic representation of the secondary folding of VGAM750 folded precursor RNA, herein designated VGAM FOLDED PRECURSOR RNA, of VGAM750 are further described hereinbelow with reference to Table 1.

Nucleotide sequences of host target binding sites, such as BINDING SITE-I, BINDING SITE-II and BINDING SITE-III of FIG. 1, found on VGAM750 host target RNA, and schematic representation of the complementarity of each of these host target binding sites to VGAM750 RNA, herein designated VGAM RNA, are described hereinbelow with reference to Table 2.

As mentioned hereinabove with reference to FIG. 1, a function of VGAM750 gene, herein designated VGAM is inhibition of expression of VGAM750 target genes. It is appreciated that specific functions, and accordingly utilities, of VGAM750 correlate with, and may be deduced from, the identity of the target genes which VGAM750 binds and inhibits, and the function of these target genes, as elaborated hereinbelow.

Reelin (RELN, Accession XM_168628) is a VGAM750 host target gene. RELN BINDING SITE is HOST TARGET binding site found in the 3' untranslated region of mRNA encoded by RELN, corresponding to a HOST TARGET binding site such as BINDING SITE I, BINDING SITE II or BINDING SITE III. Table 2 illustrates the complementarity of the nucleotide sequences of RELN BINDING SITE, designated SEQ ID:45279, to the nucleotide sequence of VGAM750 RNA, herein designated VGAM RNA, also designated SEQ ID:3461.

A function of VGAM750 is therefore inhibition of Reelin (RELN, Accession XM_168628), a gene which regulates microtubule function in neurons and neuronal migration. Accordingly, utilities of VGAM750 include diagnosis, prevention and treatment of diseases and clinical conditions associated with RELN. The function of RELN and its association with various diseases and clinical conditions, has been established by previous studies, as described hereinabove with reference to VGAM35. Spinocerebellar Ataxia 7 (olivopontocerebellar atrophy with retinal degeneration) (SCA7, Accession NM_000333) is another VGAM750 host target gene. SCA7 BINDING SITE is HOST TARGET binding site found in the 3' untranslated region of mRNA encoded by SCA7, corresponding to a HOST TARGET binding site such as BINDING SITE I, BINDING SITE II or BINDING SITE III. Table 2 illustrates the complementarity of the nucleotide sequences of SCA7 BINDING SITE, designated SEQ ID:5882, to the nucleotide sequence of VGAM750 RNA, herein designated VGAM RNA, also designated SEQ ID:3461.

Another function of VGAM750 is therefore inhibition of Spinocerebellar Ataxia 7 (olivopontocerebellar atrophy with retinal degeneration) (SCA7, Accession NM_000333). Accordingly, utilities of VGAM750 include diagnosis, prevention and treatment of diseases and clinical conditions associated with SCA7. FLJ20171 (Accession NM_017697) is another VGAM750 host target gene. FLJ20171 BINDING SITE is HOST TARGET binding site found in the 3' untranslated region of mRNA encoded by FLJ20171, corresponding to a HOST TARGET binding site such as BINDING SITE I, BINDING SITE II or BINDING SITE III. Table 2 illustrates the complementarity of the nucleotide sequences of FLJ20171 BINDING SITE, designated SEQ ID:19260, to the nucleotide sequence of VGAM750 RNA, herein designated VGAM RNA, also designated SEQ ID:3461.

Another function of VGAM750 is therefore inhibition of FLJ20171 (Accession NM_017697). Accordingly, utilities of VGAM750 include diagnosis, prevention and treatment of diseases and clinical conditions associated with FLJ20171. GG2-1 (Accession NM_014350) is another VGAM750 host target gene. GG2-1 BINDING SITE is HOST TARGET binding site found in the 3' untranslated region of mRNA encoded by GG2-1, corresponding to a HOST TARGET binding site such as BINDING SITE I, BINDING SITE II or BINDING SITE III. Table 2 illustrates the complementarity of the nucleotide sequences of GG2-1 BINDING SITE, designated SEQ ID:15677, to the nucleotide sequence of VGAM750 RNA, herein designated VGAM RNA, also designated SEQ ID:3461.

Another function of VGAM750 is therefore inhibition of GG2-1 (Accession NM_014350). Accordingly, utilities of VGAM750 include diagnosis, prevention and treatment of diseases and clinical conditions associated with GG2-1. LOC132235 (Accession XM_072302) is another VGAM750 host target gene. LOC132235 BINDING SITE is HOST TARGET binding site found in the 5' untranslated region of mRNA encoded by LOC132235, corresponding to a HOST TARGET binding site such as BINDING SITE I, BINDING SITE II or BINDING SITE III. Table 2 illustrates the complementarity of the nucleotide sequences of LOC132235 BINDING SITE, designated SEQ ID:37480, to the nucleotide sequence of VGAM750 RNA, herein designated VGAM RNA, also designated SEQ ID:3461.

Another function of VGAM750 is therefore inhibition of LOC132235 (Accession XM_072302). Accordingly, utilities of VGAM750 include diagnosis, prevention and treatment of diseases and clinical conditions associated with LOC132235. LOC255104 (Accession XM_170911) is another VGAM750 host target gene. LOC255104 BINDING SITE is HOST TARGET binding site found in the 3' untranslated region of mRNA encoded by LOC255104, corresponding to a HOST TARGET binding site such as BINDING SITE I, BINDING SITE II or BINDING SITE III. Table 2 illustrates the complementarity of the nucleotide sequences of LOC255104 BINDING SITE, designated SEQ ID:45681, to the nucleotide sequence of VGAM750 RNA, herein designated VGAM RNA, also designated SEQ ID:3461.

Another function of VGAM750 is therefore inhibition of LOC255104 (Accession XM_170911). Accordingly, utilities of VGAM750 include diagnosis, prevention and treatment of diseases and clinical conditions associated with LOC255104. FIG. 1 further provides a conceptual description of a novel bioinformatically detected viral gene of the present invention, referred to here as Viral Genomic Address Messenger 751 (VGAM751) viral gene, which modulates expression of respective host target genes thereof, the function and utility of which host target genes is known in the art.

VGAM751 is a novel bioinformatically detected regulatory, non protein coding, viral micro RNA (miRNA) gene. The method by which VGAM751 was detected is described hereinabove with reference to FIGS. 1-8.

VGAM751 gene, herein designated VGAM GENE, is a viral gene contained in the genome of Bovine Coronavirus. VGAM751 host target gene, herein designated VGAM HOST TARGET GENE, is a human gene contained in the human genome.

VGAM751 gene encodes a VGAM751 precursor RNA, herein designated VGAM PRECURSOR RNA. Similar to other miRNA genes, and unlike most ordinary genes, VGAM751 precursor RNA does not encode a protein. A nucleotide sequence identical or highly similar to the nucleotide sequence of VGAM751 precursor RNA is designated SEQ ID:737, and is provided hereinbelow with reference to the sequence listing part. Nucleotide sequence SEQ ID:737 is located at position 17776 relative to the genome of Bovine Coronavirus.

VGAM751 precursor RNA folds onto itself, forming VGAM751 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM751 folded precursor RNA into VGAM751 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM751 RNA is designated SEQ ID:3462, and is provided hereinbelow with reference to the sequence listing part.

VGAM751 host target gene, herein designated VGAM HOST TARGET GENE, encodes a corresponding messenger RNA, VGAM751 host target RNA, herein designated VGAM HOST TARGET RNA. VGAM751 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM751 RNA, herein designated VGAM RNA, binds complementarily to one or more host target binding sites located in untranslated regions of VGAM751 host target RNA, herein designated VGAM HOST TARGET RNA. This complementary binding is due to the fact that the nucleotide sequence of VGAM751 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM751 RNA, herein designated VGAM RNA, may have a different number of host target binding sites in untranslated regions of a VGAM751 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM751 RNA, herein designated VGAM RNA, to host target binding sites on VGAM751 host target RNA, herein designated VGAM HOST TARGET RNA, such as BINDING SITE I, BINDING SITE II and BINDING SITE III, inhibits translation of VGAM751 host target RNA into VGAM751 host target protein, herein designated VGAM HOST TARGET PROTEIN. VGAM host target protein is therefore outlined by a broken line.

It is appreciated that VGAM751 host target gene, herein designated VGAM HOST TARGET GENE, in fact represents a plurality of VGAM751 host target genes. The mRNA of each one of this plurality of VGAM751 host target genes comprises one or more host target binding sites, each having a nucleotide sequence which is at least partly complementary to VGAM751 RNA, herein designated VGAM RNA, and which when bound by VGAM751 RNA causes inhibition of translation of respective one or more VGAM751 host target proteins.

It is further appreciated by one skilled in the art that the mode of translational inhibition illustrated by FIG. 1 with specific reference to translational inhibition exerted by VGAM751 gene, herein designated VGAM GENE, on one or more VGAM751 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM751 is inhibition of expression of host target genes, as part of a novel viral mechanism of attacking a host. Accordingly, utilities of VGAM751 include diagnosis, prevention and treatment of viral infection by Bovine Coronavirus. Specific functions, and accordingly utilities, of VGAM751 correlate with, and may be deduced from, the identity of the host target genes which VGAM751 binds and inhibits, and the function of these host target genes, as elaborated hereinbelow.

Nucleotide sequences of the VGAM751 precursor RNA, herein designated VGAM PRECURSOR RNA, and of the 'diced' VGAM751 RNA, herein designated VGAM RNA, and a schematic representation of the secondary folding of VGAM751 folded precursor RNA, herein designated VGAM FOLDED PRECURSOR RNA, of VGAM751 are further described hereinbelow with reference to Table 1.

Nucleotide sequences of host target binding sites, such as BINDING SITE-I, BINDING SITE-II and BINDING SITE-III of FIG. 1, found on VGAM751 host target RNA, and schematic representation of the complementarity of each of these host target binding sites to VGAM751 RNA, herein designated VGAM RNA, are described hereinbelow with reference to Table 2.

As mentioned hereinabove with reference to FIG. 1, a function of VGAM751 gene, herein designated VGAM is inhibition of expression of VGAM751 target genes. It is appreciated that specific functions, and accordingly utilities, of VGAM751 correlate with, and may be deduced from, the identity of the target genes which VGAM751 binds and inhibits, and the function of these target genes, as elaborated hereinbelow.

Chemokine (C-X3-C motif) Receptor 1 (CX3CR1, Accession XM_047502) is a VGAM751 host target gene. CX3CR1 BINDING SITE is HOST TARGET binding site found in the 3' untranslated region of mRNA encoded by CX3CR1, corresponding to a HOST TARGET binding site such as BINDING SITE I, BINDING SITE II or BINDING SITE III. Table 2 illustrates the complementarity of the nucleotide sequences of CX3CR1 BINDING SITE, designated SEQ ID:34976, to the nucleotide sequence of VGAM751 RNA, herein designated VGAM RNA, also designated SEQ ID:3462.

A function of VGAM751 is therefore inhibition of Chemokine (C-X3-C motif) Receptor 1 (CX3CR1, Accession XM_047502), a gene which mediates both the adhesive and migratory functions of fractalkine. Accordingly, utilities of VGAM751 include diagnosis, prevention and treatment of diseases and clinical conditions associated with CX3CR1. The function of CX3CR1 and its association with various diseases and clinical conditions, has been established by previous studies, as described hereinabove with reference to VGAM25. Oxidation Resistance 1 (OXR1, Accession NM_018002) is another VGAM751 host target gene. OXR1 BINDING SITE is HOST TARGET binding site found in the 3' untranslated region of mRNA encoded by OXR1, corresponding to a HOST TARGET binding site such as BINDING SITE I, BINDING SITE II or BINDING SITE III. Table 2 illustrates the complementarity of the nucleotide sequences of OXR1 BINDING SITE, designated SEQ ID:19732, to the nucleotide sequence of VGAM751 RNA, herein designated VGAM RNA, also designated SEQ ID:3462.

Another function of VGAM751 is therefore inhibition of Oxidation Resistance 1 (OXR1, Accession NM_018002). Accordingly, utilities of VGAM751 include diagnosis, prevention and treatment of diseases and clinical conditions associated with OXR1. KIAA1036 (Accession NM_014909) is another VGAM751 host target gene. KIAA1036 BINDING SITE is HOST TARGET binding site found in the 3' untranslated region of mRNA encoded by KIAA1036, corresponding to a HOST TARGET binding site such as BINDING SITE I, BINDING SITE II or BINDING SITE III. Table 2 illustrates the complementarity of the nucleotide sequences of KIAA1036 BINDING SITE, designated SEQ ID:17122, to the nucleotide sequence of VGAM751 RNA, herein designated VGAM RNA, also designated SEQ ID:3462.

Another function of VGAM751 is therefore inhibition of KIAA1036 (Accession NM_014909). Accordingly, utilities of VGAM751 include diagnosis, prevention and treatment of diseases and clinical conditions associated with KIAA1036. LOC120856 (Accession XM_058509) is another VGAM751 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36644, to the nucleotide sequence of VGAM751 RNA, herein designated VGAM RNA, also designated SEQ ID:3462.

Another function of VGAM751 is therefore inhibition of LOC120856 (Accession XM_058509). Accordingly, utilities of VGAM751 include diagnosis, prevention and treatment of diseases and clinical conditions associated with LOC120856. LOC221474 (Accession XM_166464) is another VGAM751 host target gene. LOC221474 BINDING SITE is HOST TARGET binding site found in the 5' untranslated region of mRNA encoded by LOC221474, corresponding to a HOST TARGET binding site such as BINDING SITE I, BINDING SITE II or BINDING SITE III. Table 2 illustrates the complementarity of the nucleotide sequences of LOC221474 BINDING SITE, designated SEQ ID:44379, to the nucleotide sequence of VGAM751 RNA, herein designated VGAM RNA, also designated SEQ ID:3462.

Another function of VGAM751 is therefore inhibition of LOC221474 (Accession XM_166464). Accordingly, utilities of VGAM751 include diagnosis, prevention and treatment of diseases and clinical conditions associated with LOC221474. FIG. 1 further provides a conceptual description of a novel bioinformatically detected viral gene of the present invention, referred to here as Viral Genomic Address Messenger 752 (VGAM752) viral gene, which modulates expression of respective host target genes thereof, the function and utility of which host target genes is known in the art.

VGAM752 is a novel bioinformatically detected regulatory, non protein coding, viral micro RNA (miRNA) gene. The method by which VGAM752 was detected is described hereinabove with reference to FIGS. 1-8.

VGAM752 gene, herein designated VGAM GENE, is a viral gene contained in the genome of Bovine Coronavirus. VGAM752 host target gene, herein designated VGAM HOST TARGET GENE, is a human gene contained in the human genome.

VGAM752 gene encodes a VGAM752 precursor RNA, herein designated VGAM PRECURSOR RNA. Similar to other miRNA genes, and unlike most ordinary genes, VGAM752 precursor RNA does not encode a protein. A nucleotide sequence identical or highly similar to the nucleotide sequence of VGAM752 precursor RNA is designated SEQ ID:738, and is provided hereinbelow with reference to the sequence listing part. Nucleotide sequence SEQ ID:738 is located at position 18144 relative to the genome of Bovine Coronavirus.

VGAM752 precursor RNA folds onto itself, forming VGAM752 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM752 folded precursor RNA into VGAM752 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM752 RNA is designated SEQ ID:3463, and is provided hereinbelow with reference to the sequence listing part.

VGAM752 host target gene, herein designated VGAM HOST TARGET GENE, encodes a corresponding messenger RNA, VGAM752 host target RNA, herein designated VGAM HOST TARGET RNA. VGAM752 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM752 RNA, herein designated VGAM RNA, binds complementarily to one or more host target binding sites located in untranslated regions of VGAM752 host target RNA, herein designated VGAM HOST TARGET RNA. This complementary binding is due to the fact that the nucleotide sequence of VGAM752 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM752 RNA, herein designated VGAM RNA, may have a different number of host target binding sites in untranslated regions of a VGAM752 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM752 RNA, herein designated VGAM RNA, to host target binding sites on VGAM752 host target RNA, herein designated VGAM HOST TARGET RNA, such as BINDING SITE I, BINDING SITE II and BINDING SITE III, inhibits translation of VGAM752 host target RNA into VGAM752 host target protein, herein designated VGAM HOST TARGET PROTEIN. VGAM host target protein is therefore outlined by a broken line.

It is appreciated that VGAM752 host target gene, herein designated VGAM HOST TARGET GENE, in fact represents a plurality of VGAM752 host target genes. The mRNA of each one of this plurality of VGAM752 host target genes comprises one or more host target binding sites, each having a nucleotide sequence which is at least partly complementary to VGAM752 RNA, herein designated VGAM RNA, and which when bound by VGAM752 RNA causes inhibition of translation of respective one or more VGAM752 host target proteins.

It is further appreciated by one skilled in the art that the mode of translational inhibition illustrated by FIG. 1 with specific reference to translational inhibition exerted by VGAM752 gene, herein designated VGAM GENE, on one or more VGAM752 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM752 is inhibition of expression of host target genes, as part of a novel viral mechanism of attacking a host. Accordingly, utilities of VGAM752 include diagnosis, prevention and treatment of viral infection by Bovine Coronavirus. Specific functions, and accordingly utilities, of VGAM752 correlate with, and may be deduced from, the identity of the host target genes which VGAM752 binds and inhibits, and the function of these host target genes, as elaborated hereinbelow.

Nucleotide sequences of the VGAM752 precursor RNA, herein designated VGAM PRECURSOR RNA, and of the 'diced' VGAM752 RNA, herein designated VGAM RNA, and a schematic representation of the secondary folding of VGAM752 folded precursor RNA, herein designated VGAM FOLDED PRECURSOR RNA, of VGAM752 are further described hereinbelow with reference to Table 1.

Nucleotide sequences of host target binding sites, such as BINDING SITE-I, BINDING SITE-II and BINDING SITE-III of FIG. 1, found on VGAM752 host target RNA, and schematic representation of the complementarity of each of these host target binding sites to VGAM752 RNA, herein designated VGAM RNA, are described hereinbelow with reference to Table 2.

As mentioned hereinabove with reference to FIG. 1, a function of VGAM752 gene, herein designated VGAM is inhibition of expression of VGAM752 target genes. It is appreciated that specific functions, and accordingly utilities, of VGAM752 correlate with, and may be deduced from, the identity of the target genes which VGAM752 binds and inhibits, and the function of these target genes, as elaborated hereinbelow.

ATPase, Aminophospholipid Transporter-like, Class I, Type 8A, Member 2 (ATP8A2, Accession XM_167916) is a VGAM752 host target gene. ATP8A2 BINDING SITE is HOST TARGET binding site found in the 3' untranslated region of mRNA encoded by ATP8A2, corresponding to a HOST TARGET binding site such as BINDING SITE I, BINDING SITE II or BINDING SITE III. Table 2 illustrates the complementarity of the nucleotide sequences of ATP8A2 BINDING SITE, designated SEQ ID:44916, to the nucleotide sequence of VGAM752 RNA, herein designated VGAM RNA, also designated SEQ ID:3463.

A function of VGAM752 is therefore inhibition of ATPase, Aminophospholipid Transporter-like, Class I, Type 8A, Member 2 (ATP8A2, Accession XM_167916). Accordingly, utilities of VGAM752 include diagnosis, prevention and treatment of diseases and clinical conditions associated with ATP8A2. KIAA1229 (Accession XM_030665) is another VGAM752 host target gene. KIAA1229 BINDING SITE is HOST TARGET binding site found in the 3' untranslated region of mRNA encoded by KIAA1229, corresponding to a HOST TARGET binding site such as BINDING SITE I, BINDING SITE II or BINDING SITE III. Table 2 illustrates the complementarity of the nucleotide sequences of KIAA1229 BINDING SITE, designated SEQ ID:31099, to the nucleotide sequence of VGAM752 RNA, herein designated VGAM RNA, also designated SEQ ID:3463.

Another function of VGAM752 is therefore inhibition of KIAA1229 (Accession XM_030665). Accordingly, utilities of VGAM752 include diagnosis, prevention and treatment of diseases and clinical conditions associated with KIAA1229. KIAA1509 (Accession XM_029353) is another VGAM752 host target gene. KIAA1509 BINDING SITE is HOST TARGET binding site found in the 3' untranslated region of mRNA encoded by KIAA1509, corresponding to a HOST TARGET binding site such as BINDING SITE I, BINDING SITE II or BINDING SITE III. Table 2 illustrates the complementarity of the nucleotide sequences of KIAA1509 BINDING SITE, designated SEQ ID:30871, to the nucleotide sequence of VGAM752 RNA, herein designated VGAM RNA, also designated SEQ ID:3463.

Another function of VGAM752 is therefore inhibition of KIAA1509 (Accession XM_029353). Accordingly, utilities of VGAM752 include diagnosis, prevention and treatment of diseases and clinical conditions associated with KIAA1509. Ubc6p (Accession NM_058167) is another VGAM752 host target gene. Ubc6p BINDING SITE is HOST TARGET binding site found in the 3' untranslated region of mRNA encoded by Ubc6p, corresponding to a HOST TARGET binding site such as BINDING SITE I, BINDING SITE II or BINDING SITE III. Table 2 illustrates the complementarity of the nucleotide sequences of Ubc6p BINDING SITE, designated SEQ ID:27714, to the nucleotide sequence of VGAM752 RNA, herein designated VGAM RNA, also designated SEQ ID:3463.

Another function of VGAM752 is therefore inhibition of Ubc6p (Accession NM_058167). Accordingly, utilities of VGAM752 include diagnosis, prevention and treatment of diseases and clinical conditions associated with Ubc6p. LOC165904 (Accession XM_093522) is another VGAM752 host target gene. LOC165904 BINDING SITE is HOST TARGET binding site found in the 3' untranslated region of mRNA encoded by LOC165904, corresponding to a HOST TARGET binding site such as BINDING SITE I, BINDING SITE II or BINDING SITE III. Table 2 illustrates the complementarity of the nucleotide sequences of LOC165904 BINDING SITE, designated SEQ ID:40194, to the nucleotide sequence of VGAM752 RNA, herein designated VGAM RNA, also designated SEQ ID:3463.

Another function of VGAM752 is therefore inhibition of LOC165904 (Accession XM_093522). Accordingly, utilities of VGAM752 include diagnosis, prevention and treatment of diseases and clinical conditions associated with LOC165904. FIG. 1 further provides a conceptual description of a novel bioinformatically detected viral gene of the present invention, referred to here as Viral Genomic Address Messenger 753 (VGAM753) viral gene, which modulates expression of respective host target genes thereof, the function and utility of which host target genes is known in the art.

VGAM753 is a novel bioinformatically detected regulatory, non protein coding, viral micro RNA (miRNA) gene. The method by which VGAM753 was detected is described hereinabove with reference to FIGS. 1-8.

VGAM753 gene, herein designated VGAM GENE, is a viral gene contained in the genome of Bovine Coronavirus. VGAM753 host target gene, herein designated VGAM HOST TARGET GENE, is a human gene contained in the human genome.

VGAM753 gene encodes a VGAM753 precursor RNA, herein designated VGAM PRECURSOR RNA. Similar to other miRNA genes, and unlike most ordinary genes, VGAM753 precursor RNA does not encode a protein. A nucleotide sequence identical or highly similar to the nucleotide sequence of VGAM753 precursor RNA is designated SEQ ID:739, and is provided hereinbelow with reference to the sequence listing part. Nucleotide sequence SEQ ID:739 is located at position 10788 relative to the genome of Bovine Coronavirus.

VGAM753 precursor RNA folds onto itself, forming VGAM753 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM753 folded precursor RNA into VGAM753 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM753 RNA is designated SEQ ID:3464, and is provided hereinbelow with reference to the sequence listing part.

VGAM753 host target gene, herein designated VGAM HOST TARGET GENE, encodes a corresponding messenger RNA, VGAM753 host target RNA, herein designated VGAM HOST TARGET RNA. VGAM753 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM753 RNA, herein designated VGAM RNA, binds complementarily to one or more host target binding sites located in untranslated regions of VGAM753 host target RNA, herein designated VGAM HOST TARGET RNA. This complementary binding is due to the fact that the nucleotide sequence of VGAM753 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM753 RNA, herein designated VGAM RNA, may have a different number of host target binding sites in untranslated regions of a VGAM753 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM753 RNA, herein designated VGAM RNA, to host target binding sites on VGAM753 host target RNA, herein designated VGAM HOST TARGET RNA, such as BINDING SITE I, BINDING SITE II and BINDING SITE III, inhibits translation of VGAM753 host target RNA into VGAM753 host target protein, herein designated VGAM HOST TARGET PROTEIN. VGAM host target protein is therefore outlined by a broken line.

It is appreciated that VGAM753 host target gene, herein designated VGAM HOST TARGET GENE, in fact represents a plurality of VGAM753 host target genes. The mRNA of each one of this plurality of VGAM753 host target genes comprises one or more host target binding sites, each having a nucleotide sequence which is at least partly complementary to VGAM753 RNA, herein designated VGAM RNA, and which when bound by VGAM753 RNA causes inhibition of translation of respective one or more VGAM753 host target proteins.

It is further appreciated by one skilled in the art that the mode of translational inhibition illustrated by FIG. 1 with specific reference to translational inhibition exerted by VGAM753 gene, herein designated VGAM GENE, on one or more VGAM753 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM753 is inhibition of expression of host target genes, as part of a novel viral mechanism of attacking a host. Accordingly, utilities of VGAM753 include diagnosis, prevention and treatment of viral infection by Bovine Coronavirus. Specific functions, and accordingly utilities, of VGAM753 correlate with, and may be deduced from, the identity of the host target genes which VGAM753 binds and inhibits, and the function of these host target genes, as elaborated hereinbelow.

Nucleotide sequences of the VGAM753 precursor RNA, herein designated VGAM PRECURSOR RNA, and of the 'diced' VGAM753 RNA, herein designated VGAM RNA, and a schematic representation of the secondary folding of VGAM753 folded precursor RNA, herein designated VGAM FOLDED PRECURSOR RNA, of VGAM753 are further described hereinbelow with reference to Table 1.

Nucleotide sequences of host target binding sites, such as BINDING SITE-I, BINDING SITE-II and BINDING SITE-III of FIG. 1, found on VGAM753 host target RNA, and schematic representation of the complementarity of each of these host target binding sites to VGAM753 RNA, herein designated VGAM RNA, are described hereinbelow with reference to Table 2.

As mentioned hereinabove with reference to FIG. 1, a function of VGAM753 gene, herein designated VGAM is inhibition of expression of VGAM753 target genes. It is appreciated that specific functions, and accordingly utilities, of VGAM753 correlate with, and may be deduced from, the identity of the target genes which VGAM753 binds and inhibits, and the function of these target genes, as elaborated hereinbelow.

EDR1 (Accession NM_004426) is a VGAM753 host target gene. EDR1 BINDING SITE is HOST TARGET binding site found in the 3' untranslated region of mRNA encoded by EDR1, corresponding to a HOST TARGET binding site such as BINDING SITE I, BINDING SITE II or BINDING SITE III. Table 2 illustrates the complementarity of the nucleotide sequences of EDR1 BINDING SITE, designated SEQ ID:10702, to the nucleotide sequence of VGAM753 RNA, herein designated VGAM RNA, also designated SEQ ID:3464.

A function of VGAM753 is therefore inhibition of EDR1 (Accession NM_004426). Accordingly, utilities of VGAM753 include diagnosis, prevention and treatment of diseases and clinical conditions associated with EDR1. KIAA1423 (Accession XM_029703) is another VGAM753 host target gene. KIAA1423 BINDING SITE is HOST TAR- GET binding site found in the 3' untranslated region of mRNA encoded by KIAA1423, corresponding to a HOST TARGET binding site such as BINDING SITE I, BINDING SITE II or BINDING SITE III. Table 2 illustrates the complementarity of the nucleotide sequences of KIAA1423 BINDING SITE, designated SEQ ID:30921, to the nucleotide sequence of VGAM753 RNA, herein designated VGAM RNA, also designated SEQ ID:3464.

Another function of VGAM753 is therefore inhibition of KIAA1423 (Accession XM_029703). Accordingly, utilities of VGAM753 include diagnosis, prevention and treatment of diseases and clinical conditions associated with KIAA1423. LOC149844 (Accession XM_086675) is another VGAM753 host target gene. LOC149844 BINDING SITE is HOST TARGET binding site found in the 5' untranslated region of mRNA encoded by LOC149844, corresponding to a HOST TARGET binding site such as BINDING SITE I, BINDING SITE II or BINDING SITE III. Table 2 illustrates the complementarity of the nucleotide sequences of LOC149844 BINDING SITE, designated SEQ ID:38822, to the nucleotide sequence of VGAM753 RNA, herein designated VGAM RNA, also designated SEQ ID:3464.

Another function of VGAM753 is therefore inhibition of LOC149844 (Accession XM_086675). Accordingly, utilities of VGAM753 include diagnosis, prevention and treatment of diseases and clinical conditions associated with LOC149844. FIG. 1 further provides a conceptual description of a novel bioinformatically detected viral gene of the present invention, referred to here as Viral Genomic Address Messenger 754 (VGAM754) viral gene, which modulates expression of respective host target genes thereof, the function and utility of which host target genes is known in the art.

VGAM754 is a novel bioinformatically detected regulatory, non protein coding, viral micro RNA (miRNA) gene. The method by which VGAM754 was detected is described hereinabove with reference to FIGS. 1-8.

VGAM754 gene, herein designated VGAM GENE, is a viral gene contained in the genome of Bovine Coronavirus. VGAM754 host target gene, herein designated VGAM HOST TARGET GENE, is a human gene contained in the human genome.

VGAM754 gene encodes a VGAM754 precursor RNA, herein designated VGAM PRECURSOR RNA. Similar to other miRNA genes, and unlike most ordinary genes, VGAM754 precursor RNA does not encode a protein. A nucleotide sequence identical or highly similar to the nucleotide sequence of VGAM754 precursor RNA is designated SEQ ID:740, and is provided hereinbelow with reference to the sequence listing part. Nucleotide sequence SEQ ID:740 is located at position 8401 relative to the genome of Bovine Coronavirus.

VGAM754 precursor RNA folds onto itself, forming VGAM754 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM754 folded precursor RNA into VGAM754 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM754 RNA is designated SEQ ID:3465, and is provided hereinbelow with reference to the sequence listing part.

VGAM754 host target gene, herein designated VGAM HOST TARGET GENE, encodes a corresponding messenger RNA, VGAM754 host target RNA, herein designated VGAM HOST TARGET RNA. VGAM754 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM754 RNA, herein designated VGAM RNA, binds complementarily to one or more host target binding sites located in untranslated regions of VGAM754 host target RNA, herein designated VGAM HOST TARGET RNA. This complementary binding is due to the fact that the nucleotide sequence of VGAM754 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM754 RNA, herein designated VGAM RNA, may have a different number of host target binding sites in untranslated regions of a VGAM754 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM754 RNA, herein designated VGAM RNA, to host target binding sites on VGAM754 host target RNA, herein designated VGAM HOST TARGET RNA, such as BINDING SITE I, BINDING SITE II and BINDING SITE III, inhibits translation of VGAM754 host target RNA into VGAM754 host target protein, herein designated VGAM HOST TARGET PROTEIN. VGAM host target protein is therefore outlined by a broken line.

It is appreciated that VGAM754 host target gene, herein designated VGAM HOST TARGET GENE, in fact represents a plurality of VGAM754 host target genes. The mRNA of each one of this plurality of VGAM754 host target genes comprises one or more host target binding sites, each having a nucleotide sequence which is at least partly complementary to VGAM754 RNA, herein designated VGAM RNA, and which when bound by VGAM754 RNA causes inhibition of translation of respective one or more VGAM754 host target proteins.

It is further appreciated by one skilled in the art that the mode of translational inhibition illustrated by FIG. 1 with specific reference to translational inhibition exerted by VGAM754 gene, herein designated VGAM GENE, on one or more VGAM754 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM754 is inhibition of expression of host target genes, as part of a novel viral mechanism of attacking a host. Accordingly, utilities of VGAM754 include diagnosis, prevention and treatment of viral infection by Bovine Coronavirus. Specific functions, and accordingly utilities, of VGAM754 correlate with, and may be deduced from, the identity of the host target genes which VGAM754 binds and inhibits, and the function of these host target genes, as elaborated hereinbelow.

Nucleotide sequences of the VGAM754 precursor RNA, herein designated VGAM PRECURSOR RNA, and of the 'diced' VGAM754 RNA, herein designated VGAM RNA, and a schematic representation of the secondary folding of VGAM754 folded precursor RNA, herein designated VGAM FOLDED PRECURSOR RNA, of VGAM754 are further described hereinbelow with reference to Table 1.

Nucleotide sequences of host target binding sites, such as BINDING SITE-I, BINDING SITE-II and BINDING SITE-III of FIG. 1, found on VGAM754 host target RNA, and schematic representation of the complementarity of each of these host target binding sites to VGAM754 RNA, herein designated VGAM RNA, are described hereinbelow with reference to Table 2.

As mentioned hereinabove with reference to FIG. 1, a function of VGAM754 gene, herein designated VGAM is inhibition of expression of VGAM754 target genes. It is appreciated that specific functions, and accordingly utilities, of VGAM754 correlate with, and may be deduced from, the identity of the target genes which VGAM754 binds and inhibits, and the function of these target genes, as elaborated hereinbelow.

Runt-related Transcription Factor 1 (acute myeloid leukemia 1; aml1 oncogene) (RUNX1, Accession NM_001754) is a VGAM754 host target gene. RUNX1 BINDING SITE is HOST TARGET binding site found in the 3' untranslated region of mRNA encoded by RUNX1, corresponding to a HOST TARGET binding site such as BINDING SITE I, BINDING SITE II or BINDING SITE III. Table 2 illustrates the complementarity of the nucleotide sequences of RUNX1 BINDING SITE, designated SEQ ID:7493, to the nucleotide sequence of VGAM754 RNA, herein designated VGAM RNA, also designated SEQ ID:3465.

A function of VGAM754 is therefore inhibition of Runt-related Transcription Factor 1 (acute myeloid leukemia 1; aml1 oncogene) (RUNX1, Accession NM_001754). Accordingly, utilities of VGAM754 include diagnosis, prevention and treatment of diseases and clinical conditions associated with RUNX1. 1-acylglycerol-3-phosphate O-acyltransferase 1 (lysophosphatidic acid acyltransferase, alpha) (AGPAT1, Accession NM_006411) is another VGAM754 host target gene. AGPAT1 BINDING SITE is HOST TARGET binding site found in the 5' untranslated region of mRNA encoded by AGPAT1, corresponding to a HOST TARGET binding site such as BINDING SITE I, BINDING SITE II or BINDING SITE III. Table 2 illustrates the complementarity of the nucleotide sequences of AGPAT1 BINDING SITE, designated SEQ ID:13117, to the nucleotide sequence of VGAM754 RNA, herein designated VGAM RNA, also designated SEQ ID:3465.

Another function of VGAM754 is therefore inhibition of 1-acylglycerol-3-phosphate O-acyltransferase 1 (lysophosphatidic acid acyltransferase, alpha) (AGPAT1, Accession NM_006411). Accordingly, utilities of VGAM754 include diagnosis, prevention and treatment of diseases and clinical conditions associated with AGPAT1. DKFZP434E2135 (Accession NM_030804) is another VGAM754 host target gene. DKFZP434E2135 BINDING SITE is HOST TARGET binding site found in the 5' untranslated region of mRNA encoded by DKFZP434E2135, corresponding to a HOST TARGET binding site such as BINDING SITE I, BINDING SITE II or BINDING SITE III. Table 2 illustrates the complementarity of the nucleotide sequences of DKFZP434E2135 BINDING SITE, designated SEQ ID:25112, to the nucleotide sequence of VGAM754 RNA, herein designated VGAM RNA, also designated SEQ ID:3465.

Another function of VGAM754 is therefore inhibition of DKFZP434E2135 (Accession NM_030804). Accordingly, utilities of VGAM754 include diagnosis, prevention and treatment of diseases and clinical conditions associated with DKFZP434E2135. M-phase Phosphoprotein 10 (U3 small nucleolar ribonucleoprotein) (MPHOSPH10, Accession XM_030865) is another VGAM754 host target gene. MPHOSPH10 BINDING SITE is HOST TARGET binding site found in the 5' untranslated region of mRNA encoded by MPHOSPH10, corresponding to a HOST TARGET binding site such as BINDING SITE I, BINDING SITE II or BINDING SITE III. Table 2 illustrates the complementarity of the nucleotide sequences of MPHOSPH10 BINDING SITE, designated SEQ ID:31204, to the nucleotide sequence of VGAM754 RNA, herein designated VGAM RNA, also designated SEQ ID:3465.

Another function of VGAM754 is therefore inhibition of M-phase Phosphoprotein 10 (U3 small nucleolar ribonucleoprotein) (MPHOSPH10, Accession XM_030865). Accordingly, utilities of VGAM754 include diagnosis, prevention and treatment of diseases and clinical conditions associated with MPHOSPH10. RENT2 (Accession NM_080599) is another VGAM754 host target gene. RENT2 BINDING SITE1 and RENT2 BINDING SITE2 are HOST TARGET binding sites found in untranslated regions of mRNA encoded by RENT2, corresponding to HOST TARGET binding sites such as BINDING SITE I, BINDING SITE II or BINDING SITE III. Table 2 illustrates the complementarity of the nucleotide sequences of RENT2 BINDING SITE1 and RENT2 BINDING SITE2, designated SEQ ID:27909 and SEQ ID:17803 respectively, to the nucleotide sequence of VGAM754 RNA, herein designated VGAM RNA, also designated SEQ ID:3465.

Another function of VGAM754 is therefore inhibition of RENT2 (Accession NM_080599). Accordingly, utilities of VGAM754 include diagnosis, prevention and treatment of diseases and clinical conditions associated with RENT2. LOC146332 (Accession XM_085413) is another VGAM754 host target gene. LOC146332 BINDING SITE is HOST TARGET binding site found in the 3' untranslated region of mRNA encoded by LOC146332, corresponding to a HOST TARGET binding site such as BINDING SITE I, BINDING SITE II or BINDING SITE III. Table 2 illustrates the complementarity of the nucleotide sequences of LOC146332 BINDING SITE, designated SEQ ID:38129, to the nucleotide sequence of VGAM754 RNA, herein designated VGAM RNA, also designated SEQ ID:3465.

Another function of VGAM754 is therefore inhibition of LOC146332 (Accession XM_085413). Accordingly, utilities of VGAM754 include diagnosis, prevention and treatment of diseases and clinical conditions associated with LOC146332. LOC150519 (Accession XM_086937) is another VGAM754 host target gene. LOC150519 BINDING SITE is HOST TARGET binding site found in the 3' untranslated region of mRNA encoded by LOC150519, corresponding to a HOST TARGET binding site such as BINDING SITE I, BINDING SITE II or BINDING SITE III. Table 2 illustrates the complementarity of the nucleotide sequences of LOC150519 BINDING SITE, designated SEQ ID:38987, to the nucleotide sequence of VGAM754 RNA, herein designated VGAM RNA, also designated SEQ ID:3465.

Another function of VGAM754 is therefore inhibition of LOC150519 (Accession XM_086937). Accordingly, utilities of VGAM754 include diagnosis, prevention and treatment of diseases and clinical conditions associated with LOC150519. LOC196446 (Accession XM_113722) is another VGAM754 host target gene. LOC196446 BINDING SITE is HOST TARGET binding site found in the 5' untranslated region of mRNA encoded by LOC196446, corresponding to a HOST TARGET binding site such as BINDING SITE I, BINDING SITE II or BINDING SITE III. Table 2 illustrates the complementarity of the nucleotide sequences of LOC196446 BINDING SITE, designated SEQ ID:42371, to the nucleotide sequence of VGAM754 RNA, herein designated VGAM RNA, also designated SEQ ID:3465.

Another function of VGAM754 is therefore inhibition of LOC196446 (Accession XM_113722). Accordingly, utilities of VGAM754 include diagnosis, prevention and treatment of diseases and clinical conditions associated with LOC196446. LOC90233 (Accession NM_138347) is another VGAM754 host target gene. LOC90233 BINDING SITE is HOST TARGET binding site found in the 3' untranslated region of mRNA encoded by LOC90233, corresponding to a HOST TARGET binding site such as BINDING SITE I, BINDING SITE II or BINDING SITE III. Table 2 illustrates the complementarity of the nucleotide sequences of LOC90233 BINDING SITE, designated SEQ ID:28744, to the nucleotide sequence of VGAM754 RNA, herein designated VGAM RNA, also designated SEQ ID:3465.

Another function of VGAM754 is therefore inhibition of LOC90233 (Accession NM_138347). Accordingly, utilities of VGAM754 include diagnosis, prevention and treatment of diseases and clinical conditions associated with LOC90233. FIG. 1 further provides a conceptual description of a novel bioinformatically detected viral gene of the present invention, referred to here as Viral Genomic Address Messenger 755 (VGAM755) viral gene, which modulates expression of respective host target genes thereof, the function and utility of which host target genes is known in the art.

VGAM755 is a novel bioinformatically detected regulatory, non protein coding, viral micro RNA (miRNA) gene. The method by which VGAM755 was detected is described hereinabove with reference to FIGS. 1-8.

VGAM755 gene, herein designated VGAM GENE, is a viral gene contained in the genome of Bovine Coronavirus. VGAM755 host target gene, herein designated VGAM HOST TARGET GENE, is a human gene contained in the human genome.

VGAM755 gene encodes a VGAM755 precursor RNA, herein designated VGAM PRECURSOR RNA. Similar to other miRNA genes, and unlike most ordinary genes, VGAM755 precursor RNA does not encode a protein. A nucleotide sequence identical or highly similar to the nucleotide sequence of VGAM755 precursor RNA is designated SEQ ID:741, and is provided hereinbelow with reference to the sequence listing part. Nucleotide sequence SEQ ID:741 is located at position 5925 relative to the genome of Bovine Coronavirus.

VGAM755 precursor RNA folds onto itself, forming VGAM755 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM755 folded precursor RNA into VGAM755 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM755 RNA is designated SEQ ID:3466, and is provided hereinbelow with reference to the sequence listing part.

VGAM755 host target gene, herein designated VGAM HOST TARGET GENE, encodes a corresponding messenger RNA, VGAM755 host target RNA, herein designated VGAM HOST TARGET RNA. VGAM755 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM755 RNA, herein designated VGAM RNA, binds complementarily to one or more host target binding sites located in untranslated regions of VGAM755 host target RNA, herein designated VGAM HOST TARGET RNA. This complementary binding is due to the fact that the nucleotide sequence of VGAM755 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM755 RNA, herein designated VGAM RNA, may have a different number of host target binding sites in untranslated regions of a VGAM755 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM755 RNA, herein designated VGAM RNA, to host target binding sites on VGAM755 host target RNA, herein designated VGAM HOST TARGET RNA, such as BINDING SITE I, BINDING SITE II and BINDING SITE III, inhibits translation of VGAM755 host target RNA into VGAM755 host target protein, herein designated VGAM HOST TARGET PROTEIN. VGAM host target protein is therefore outlined by a broken line.

It is appreciated that VGAM755 host target gene, herein designated VGAM HOST TARGET GENE, in fact represents a plurality of VGAM755 host target genes. The mRNA of each one of this plurality of VGAM755 host target genes comprises one or more host target binding sites, each having a nucleotide sequence which is at least partly complementary to VGAM755 RNA, herein designated VGAM RNA, and which when bound by VGAM755 RNA causes inhibition of translation of respective one or more VGAM755 host target proteins.

It is further appreciated by one skilled in the art that the mode of translational inhibition illustrated by FIG. 1 with specific reference to translational inhibition exerted by VGAM755 gene, herein designated VGAM GENE, on one or more VGAM755 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM755 is inhibition of expression of host target genes, as part of a novel viral mechanism of attacking a host. Accordingly, utilities of VGAM755 include diagnosis, prevention and treatment of viral infection by Bovine Coronavirus. Specific functions, and accordingly utilities, of VGAM755 correlate with, and may be deduced from, the identity of the host target genes which VGAM755 binds and inhibits, and the function of these host target genes, as elaborated hereinbelow.

Nucleotide sequences of the VGAM755 precursor RNA, herein designated VGAM PRECURSOR RNA, and of the 'diced' VGAM755 RNA, herein designated VGAM RNA, and a schematic representation of the secondary folding of VGAM755 folded precursor RNA, herein designated VGAM FOLDED PRECURSOR RNA, of VGAM755 are further described hereinbelow with reference to Table 1.

Nucleotide sequences of host target binding sites, such as BINDING SITE-I, BINDING SITE-II and BINDING SITE-III of FIG. 1, found on VGAM755 host target RNA, and schematic representation of the complementarity of each of these host target binding sites to VGAM755 RNA, herein designated VGAM RNA, are described hereinbelow with reference to Table 2.

As mentioned hereinabove with reference to FIG. 1, a function of VGAM755 gene, herein designated VGAM is inhibition of expression of VGAM755 target genes. It is appreciated that specific functions, and accordingly utilities, of VGAM755 correlate with, and may be deduced from, the identity of the target genes which VGAM755 binds and inhibits, and the function of these target genes, as elaborated hereinbelow.

GDP Dissociation Inhibitor 2 (GDI2, Accession NM_001494) is a VGAM755 host target gene. GDI2 BINDING SITE is HOST TARGET binding site found in the 3' untranslated region of mRNA encoded by GDI2, corresponding to a HOST TARGET binding site such as BINDING SITE I, BINDING SITE II or BINDING SITE III. Table 2 illustrates the complementarity of the nucleotide sequences of GDI2 BINDING SITE, designated SEQ ID:7241, to the nucleotide sequence of VGAM755 RNA, herein designated VGAM RNA, also designated SEQ ID:3466.

A function of VGAM755 is therefore inhibition of GDP Dissociation Inhibitor 2 (GDI2, Accession NM_001494), a gene which regulates the gdp/gtp exchange reaction of most rab proteins by inhibiting the dissociation of gdp from them, and the subsequent binding of gtp to them. Accordingly, utilities of VGAM755 include diagnosis, prevention and treatment of diseases and clinical conditions associated with GDI2. The function of GDI2 has been established by previous studies. Various rab GDI-beta (RABGDIB) genes have been identified in a variety of species. It is a member of the GDP-dissociation inhibitor family, which includes GDI-alpha (RABGDIA; 300104). Shisheva et al. (1994) cloned mouse RABGDIB (which they referred to as 'smg p25A GDI') and reported the sequence. Sedlacek et al. (1995) found that the human RABGDIB sequence is 86.5% similar to RABGDIA, which they referred to as 'XAP-4.' Bachner et al. (1995) studied expression patterns of the 2 human genes. They showed that the 2.5-kb mRNA for RABGDIB is ubiquitously expressed, in contrast to RABGDIA, which is expressed primarily in neural and sensory tissues. By in situ hybridization, Sedlacek et al. (1998) demonstrated that the GDI2 gene maps to 10p15; a processed pseudogene mapped to 7p13-p11.

Full details of the abovementioned studies are described in the following publications, the disclosure of which are hereby incorporated by reference:

Sedlacek, Z.; Munstermann, E.; Mincheva, A.; Lichter, P.; Poustka, A.: The human rab GDI beta gene with long retroposon-rich introns maps to 10p15 and its pseudogene to 7p11-p13. Mammalian Genome 9:78-80, 1998; and Shisheva, A.; Sudhof, T. C.; Czech, M. P.: Cloning, characterization, and expression of a novel GDP dissociation inhibitor isoform from skeletal muscle. Molec. Cell. Biol. 14:3459-346.

Further studies establishing the function and utilities of GDI2 are found in John Hopkins OMIM database record ID 600767, and in sited publications numbered 8799, 9601-960 and 9062 listed in the bibliography section hereinbelow, which are also hereby incorporated by reference. Chromosome 20 Open Reading Frame 43 (C20orf43, Accession XM_009549) is another VGAM755 host target gene. C20orf43 BINDING SITE is HOST TARGET binding site found in the 3' untranslated region of mRNA encoded by C20orf43, corresponding to a HOST TARGET binding site such as BINDING SITE I, BINDING SITE II or BINDING SITE III. Table 2 illustrates the complementarity of the nucleotide sequences of C20orf43 BINDING SITE, designated SEQ ID:30112, to the nucleotide sequence of VGAM755 RNA, herein designated VGAM RNA, also designated SEQ ID:3466.

Another function of VGAM755 is therefore inhibition of Chromosome 20 Open Reading Frame 43 (C20orf43, Accession XM_009549). Accordingly, utilities of VGAM755 include diagnosis, prevention and treatment of diseases and clinical conditions associated with C20orf43. Chromosome 20 Open Reading Frame 82 (C20orf82, Accession XM_097736) is another VGAM755 host target gene. C20orf82 BINDING SITE is HOST TARGET binding site found in the 3' untranslated region of mRNA encoded by C20orf82, corresponding to a HOST TARGET binding site such as BINDING SITE I, BINDING SITE II or BINDING SITE III. Table 2 illustrates the complementarity of the nucleotide sequences of C20orf82 BINDING SITE, designated SEQ ID:41085, to the nucleotide sequence of VGAM755 RNA, herein designated VGAM RNA, also designated SEQ ID:3466.

Another function of VGAM755 is therefore inhibition of Chromosome 20 Open Reading Frame 82 (C20orf82, Accession XM_097736). Accordingly, utilities of VGAM755 include diagnosis, prevention and treatment of diseases and clinical conditions associated with C20orf82. MGC12966 (Accession NM_032706) is another VGAM755 host target gene. MGC12966 BINDING SITE is HOST TARGET binding site found in the 3' untranslated region of mRNA encoded by MGC12966, corresponding to a HOST TARGET binding site such as BINDING SITE I, BINDING SITE II or BINDING SITE III. Table 2 illustrates the complementarity of the nucleotide sequences of MGC12966 BINDING SITE, designated SEQ ID:26418, to the nucleotide sequence of VGAM755 RNA, herein designated VGAM RNA, also designated SEQ ID:3466.

Another function of VGAM755 is therefore inhibition of MGC12966 (Accession NM_032706). Accordingly, utilities of VGAM755 include diagnosis, prevention and treatment of diseases and clinical conditions associated with MGC12966.

FIG. 1 further provides a conceptual description of a novel bioinformatically detected viral gene of the present invention, referred to here as Viral Genomic Address Messenger 756 (VGAM756) viral gene, which modulates expression of respective host target genes thereof, the function and utility of which host target genes is known in the art.

VGAM756 is a novel bioinformatically detected regulatory, non protein coding, viral micro RNA (miRNA) gene. The method by which VGAM756 was detected is described hereinabove with reference to FIGS. 1-8.

VGAM756 gene, herein designated VGAM GENE, is a viral gene contained in the genome of Bovine Coronavirus. VGAM756 host target gene, herein designated VGAM HOST TARGET GENE, is a human gene contained in the human genome.

VGAM756 gene encodes a VGAM756 precursor RNA, herein designated VGAM PRECURSOR RNA. Similar to other miRNA genes, and unlike most ordinary genes, VGAM756 precursor RNA does not encode a protein. A nucleotide sequence identical or highly similar to the nucleotide sequence of VGAM756 precursor RNA is designated SEQ ID:742, and is provided hereinbelow with reference to the sequence listing part. Nucleotide sequence SEQ ID:742 is located at position 15954 relative to the genome of Bovine Coronavirus.

VGAM756 precursor RNA folds onto itself, forming VGAM756 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM756 folded precursor RNA into VGAM756 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM756 RNA is designated SEQ ID:3467, and is provided hereinbelow with reference to the sequence listing part.

VGAM756 host target gene, herein designated VGAM HOST TARGET GENE, encodes a corresponding messenger RNA, VGAM756 host target RNA, herein designated VGAM HOST TARGET RNA. VGAM756 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM756 RNA, herein designated VGAM RNA, binds complementarily to one or more host target binding sites located in untranslated regions of VGAM756 host target RNA, herein designated VGAM HOST TARGET RNA. This complementary binding is due to the fact that the nucleotide sequence of VGAM756 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM756 RNA, herein designated VGAM RNA, may have a different number of host target binding sites in untranslated regions of a VGAM756 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM756 RNA, herein designated VGAM RNA, to host target binding sites on VGAM756 host target RNA, herein designated VGAM HOST TARGET RNA, such as BINDING SITE I, BINDING SITE II and BINDING SITE III, inhibits translation of VGAM756 host target RNA into VGAM756 host target protein, herein designated VGAM HOST TARGET PROTEIN. VGAM host target protein is therefore outlined by a broken line.

It is appreciated that VGAM756 host target gene, herein designated VGAM HOST TARGET GENE, in fact represents a plurality of VGAM756 host target genes. The mRNA of each one of this plurality of VGAM756 host target genes comprises one or more host target binding sites, each having a nucleotide sequence which is at least partly complementary to VGAM756 RNA, herein designated VGAM RNA, and which when bound by VGAM756 RNA causes inhibition of translation of respective one or more VGAM756 host target proteins.

It is further appreciated by one skilled in the art that the mode of translational inhibition illustrated by FIG. 1 with specific reference to translational inhibition exerted by VGAM756 gene, herein designated VGAM GENE, on one or more VGAM756 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM756 is inhibition of expression of host target genes, as part of a novel viral mechanism of attacking a host. Accordingly, utilities of VGAM756 include diagnosis, prevention and treatment of viral infection by Bovine Coronavirus. Specific functions, and accordingly utilities, of VGAM756 correlate with, and may be deduced from, the identity of the host target genes which VGAM756 binds and inhibits, and the function of these host target genes, as elaborated hereinbelow.

Nucleotide sequences of the VGAM756 precursor RNA, herein designated VGAM PRECURSOR RNA, and of the 'diced' VGAM756 RNA, herein designated VGAM RNA, and a schematic representation of the secondary folding of VGAM756 folded precursor RNA, herein designated VGAM FOLDED PRECURSOR RNA, of VGAM756 are further described hereinbelow with reference to Table 1.

Nucleotide sequences of host target binding sites, such as BINDING SITE-I, BINDING SITE-II and BINDING SITE-III of FIG. 1, found on VGAM756 host target RNA, and schematic representation of the complementarity of each of these host target binding sites to VGAM756 RNA, herein designated VGAM RNA, are described hereinbelow with reference to Table 2.

As mentioned hereinabove with reference to FIG. 1, a function of VGAM756 gene, herein designated VGAM is inhibition of expression of VGAM756 target genes. It is appreciated that specific functions, and accordingly utilities, of VGAM756 correlate with, and may be deduced from, the identity of the target genes which VGAM756 binds and inhibits, and the function of these target genes, as elaborated hereinbelow.

Ubiquitin-conjugating Enzyme E2L 3 (UBE2L3, Accession NM_003347) is a VGAM756 host target gene. UBE2L3 BINDING SITE is HOST TARGET binding site found in the 3' untranslated region of mRNA encoded by UBE2L3, corresponding to a HOST TARGET binding site such as BINDING SITE I, BINDING SITE II or BINDING SITE III. Table 2 illustrates the complementarity of the nucleotide sequences of UBE2L3 BINDING SITE, designated SEQ ID:9354, to the nucleotide sequence of VGAM756 RNA, herein designated VGAM RNA, also designated SEQ ID:3467.

A function of VGAM756 is therefore inhibition of Ubiquitin-conjugating Enzyme E2L 3 (UBE2L3, Accession NM_003347), a gene which catalyzes the covalent attachment of ubiquitin to other proteins. Accordingly, utilities of VGAM756 include diagnosis, prevention and treatment of diseases and clinical conditions associated with UBE2L3. The function of UBE2L3 and its association with various diseases and clinical conditions, has been established by previous studies, as described hereinabove with reference to VGAM215. Angiomotin (AMOT, Accession NM_133265) is another VGAM756 host target gene. AMOT BINDING SITE is HOST TARGET binding site found in the 3' untranslated region of mRNA encoded by AMOT, corresponding to a HOST TARGET binding site such as BINDING SITE I, BINDING SITE II or BINDING SITE III. Table 2 illustrates the complementarity of the nucleotide sequences of AMOT BINDING SITE, designated SEQ ID:28416, to the nucleotide sequence of VGAM756 RNA, herein designated VGAM RNA, also designated SEQ ID:3467.

Another function of VGAM756 is therefore inhibition of Angiomotin (AMOT, Accession NM_133265). Accordingly, utilities of VGAM756 include diagnosis, prevention and treatment of diseases and clinical conditions associated with AMOT. FLJ13195 (Accession NM_022906) is another VGAM756 host target gene. FLJ13195 BINDING SITE is HOST TARGET binding site found in the 3' untranslated region of mRNA encoded by FLJ13195, corresponding to a HOST TARGET binding site such as BINDING SITE I, BINDING SITE II or BINDING SITE III. Table 2 illustrates the complementarity of the nucleotide sequences of FLJ13195 BINDING SITE, designated SEQ ID:23203, to the nucleotide sequence of VGAM756 RNA, herein designated VGAM RNA, also designated SEQ ID:3467.

Another function of VGAM756 is therefore inhibition of FLJ13195 (Accession NM_022906). Accordingly, utilities of VGAM756 include diagnosis, prevention and treatment of diseases and clinical conditions associated with FLJ13195. FLJ23132 (Accession XM_171194) is another VGAM756 host target gene. FLJ23132 BINDING SITE is HOST TARGET binding site found in the 3' untranslated region of mRNA encoded by FLJ23132, corresponding to a HOST TARGET binding site such as BINDING SITE I, BINDING SITE II or BINDING SITE III. Table 2 illustrates the complementarity of the nucleotide sequences of FLJ23132 BINDING SITE, designated SEQ ID:45983, to the nucleotide sequence of VGAM756 RNA, herein designated VGAM RNA, also designated SEQ ID:3467.

Another function of VGAM756 is therefore inhibition of FLJ23132 (Accession XM_171194). Accordingly, utilities of VGAM756 include diagnosis, prevention and treatment of diseases and clinical conditions associated with FLJ23132. HSPC039 (Accession NM_016097) is another VGAM756 host target gene. HSPC039 BINDING SITE is HOST TARGET binding site found in the 3' untranslated region of mRNA encoded by HSPC039, corresponding to a HOST TARGET binding site such as BINDING SITE I, BINDING SITE II or BINDING SITE III. Table 2 illustrates the complementarity of the nucleotide sequences of HSPC039 BINDING SITE, designated SEQ ID:18180, to the nucleotide sequence of VGAM756 RNA, herein designated VGAM RNA, also designated SEQ ID:3467.

Another function of VGAM756 is therefore inhibition of HSPC039 (Accession NM_016097). Accordingly, utilities of VGAM756 include diagnosis, prevention and treatment of diseases and clinical conditions associated with HSPC039. PTPRF Interacting Protein, Binding Protein 1 (liprin beta 1) (PPFIBP1, Accession NM_003622) is another VGAM756 host target gene. PPFIBP1 BINDING SITE is HOST TARGET binding site found in the 3' untranslated region of mRNA encoded by PPFIBP1, corresponding to a HOST TARGET binding site such as BINDING SITE I, BINDING SITE II or BINDING SITE III. Table 2 illustrates the complementarity of the nucleotide sequences of PPFIBP1 BINDING SITE, designated SEQ ID:9685, to the nucleotide sequence of VGAM756 RNA, herein designated VGAM RNA, also designated SEQ ID:3467.

Another function of VGAM756 is therefore inhibition of PTPRF Interacting Protein, Binding Protein 1 (liprin beta 1) (PPFIBP1, Accession NM_003622). Accordingly, utilities of VGAM756 include diagnosis, prevention and treatment of diseases and clinical conditions associated with PPFIBP1. PR Domain Containing 8 (PRDM8, Accession NM_020226) is another VGAM756 host target gene. PRDM8 BINDING SITE is HOST TARGET binding site found in the 5' untranslated region of mRNA encoded by PRDM8, corresponding to a HOST TARGET binding site such as BINDING SITE I, BINDING SITE II or BINDING SITE III. Table 2 illustrates the complementarity of the nucleotide sequences of PRDM8 BINDING SITE, designated SEQ ID:21488, to the nucleotide sequence of VGAM756 RNA, herein designated VGAM RNA, also designated SEQ ID:3467.

Another function of VGAM756 is therefore inhibition of PR Domain Containing 8 (PRDM8, Accession NM_020226). Accordingly, utilities of VGAM756 include diagnosis, prevention and treatment of diseases and clinical conditions associated with PRDM8. LOC122726 (Accession XM_063296) is another VGAM756 host target gene. LOC122726 BINDING SITE is HOST TARGET binding site found in the 5' untranslated region of mRNA encoded by LOC122726, corresponding to a HOST TARGET binding site such as BINDING SITE I, BINDING SITE II or BINDING SITE III. Table 2 illustrates the complementarity of the nucleotide sequences of LOC122726 BINDING SITE, designated SEQ ID:37236, to the nucleotide sequence of VGAM756 RNA, herein designated VGAM RNA, also designated SEQ ID:3467.

Another function of VGAM756 is therefore inhibition of LOC122726 (Accession XM_063296). Accordingly, utilities of VGAM756 include diagnosis, prevention and treatment of diseases and clinical conditions associated with LOC122726. LOC83690 (Accession NM_031461) is another VGAM756 host target gene. LOC83690 BINDING SITE is HOST TARGET binding site found in the 3' untranslated region of mRNA encoded by LOC83690, corresponding to a HOST TARGET binding site such as BINDING SITE I, BINDING SITE II or BINDING SITE III. Table 2 illustrates the complementarity of the nucleotide sequences of LOC83690 BINDING SITE, designated SEQ ID:25485, to the nucleotide sequence of VGAM756 RNA, herein designated VGAM RNA, also designated SEQ ID:3467.

Another function of VGAM756 is therefore inhibition of LOC83690 (Accession NM_031461). Accordingly, utilities of VGAM756 include diagnosis, prevention and treatment of diseases and clinical conditions associated with LOC83690. FIG. 1 further provides a conceptual description of a novel bioinformatically detected viral gene of the present invention, referred to here as Viral Genomic Address Messenger 757 (VGAM757) viral gene, which modulates expression of respective host target genes thereof, the function and utility of which host target genes is known in the art.

VGAM757 is a novel bioinformatically detected regulatory, non protein coding, viral micro RNA (miRNA) gene. The method by which VGAM757 was detected is described hereinabove with reference to FIGS. 1-8.

VGAM757 gene, herein designated VGAM GENE, is a viral gene contained in the genome of Bovine Coronavirus. VGAM757 host target gene, herein designated VGAM HOST TARGET GENE, is a human gene contained in the human genome.

VGAM757 gene encodes a VGAM757 precursor RNA, herein designated VGAM PRECURSOR RNA. Similar to other miRNA genes, and unlike most ordinary genes, VGAM757 precursor RNA does not encode a protein. A nucleotide sequence identical or highly similar to the nucleotide sequence of VGAM757 precursor RNA is designated SEQ ID:743, and is provided hereinbelow with reference to the sequence listing part. Nucleotide sequence SEQ ID:743 is located at position 378 relative to the genome of Bovine Coronavirus.

VGAM757 precursor RNA folds onto itself, forming VGAM757 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM757 folded precursor RNA into VGAM757 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM757 RNA is designated SEQ ID:3468, and is provided hereinbelow with reference to the sequence listing part.

VGAM757 host target gene, herein designated VGAM HOST TARGET GENE, encodes a corresponding messenger RNA, VGAM757 host target RNA, herein designated VGAM HOST TARGET RNA. VGAM757 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM757 RNA, herein designated VGAM RNA, binds complementarily to one or more host target binding sites located in untranslated regions of VGAM757 host target RNA, herein designated VGAM HOST TARGET RNA. This complementary binding is due to the fact that the nucleotide sequence of VGAM757 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM757 RNA, herein designated VGAM RNA, may have a different number of host target binding sites in untranslated regions of a VGAM757 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM757 RNA, herein designated VGAM RNA, to host target binding sites on VGAM757 host target RNA, herein designated VGAM HOST TARGET RNA, such as BINDING SITE I, BINDING SITE II and BINDING SITE III, inhibits translation of VGAM757 host target RNA into VGAM757 host target protein, herein designated VGAM HOST TARGET PROTEIN. VGAM host target protein is therefore outlined by a broken line.

It is appreciated that VGAM757 host target gene, herein designated VGAM HOST TARGET GENE, in fact represents a plurality of VGAM757 host target genes. The mRNA of each one of this plurality of VGAM757 host target genes comprises one or more host target binding sites, each having a nucleotide sequence which is at least partly complementary to VGAM757 RNA, herein designated VGAM RNA, and which when bound by VGAM757 RNA causes inhibition of translation of respective one or more VGAM757 host target proteins.

It is further appreciated by one skilled in the art that the mode of translational inhibition illustrated by FIG. 1 with specific reference to translational inhibition exerted by VGAM757 gene, herein designated VGAM GENE, on one or more VGAM757 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM757 is inhibition of expression of host target genes, as part of a novel viral mechanism of attacking a host. Accordingly, utilities of VGAM757 include diagnosis, prevention and treatment of viral infection by Bovine Coronavirus. Specific functions, and accordingly utilities, of VGAM757 correlate with, and may be deduced from, the identity of the host target genes which VGAM757 binds and inhibits, and the function of these host target genes, as elaborated hereinbelow.

Nucleotide sequences of the VGAM757 precursor RNA, herein designated VGAM PRECURSOR RNA, and of the 'diced' VGAM757 RNA, herein designated VGAM RNA, and a schematic representation of the secondary folding of VGAM757 folded precursor RNA, herein designated VGAM FOLDED PRECURSOR RNA, of VGAM757 are further described hereinbelow with reference to Table 1.

Nucleotide sequences of host target binding sites, such as BINDING SITE-I, BINDING SITE-II and BINDING SITE-III of FIG. 1, found on VGAM757 host target RNA, and schematic representation of the complementarity of each of these host target binding sites to VGAM757 RNA, herein designated VGAM RNA, are described hereinbelow with reference to Table 2.

As mentioned hereinabove with reference to FIG. 1, a function of VGAM757 gene, herein designated VGAM is inhibition of expression of VGAM757 target genes. It is appreciated that specific functions, and accordingly utilities, of VGAM757 correlate with, and may be deduced from, the identity of the target genes which VGAM757 binds and inhibits, and the function of these target genes, as elaborated hereinbelow.

Zinc Finger Protein 207 (ZNF207, Accession NM_003457) is a VGAM757 host target gene. ZNF207 BINDING SITE is HOST TARGET binding site found in the 3' untranslated region of mRNA encoded by ZNF207, corresponding to a HOST TARGET binding site such as BINDING SITE I, BINDING SITE II or BINDING SITE III. Table 2 illustrates the complementarity of the nucleotide sequences of ZNF207 BINDING SITE, designated SEQ ID:9515, to the nucleotide sequence of VGAM757 RNA, herein designated VGAM RNA, also designated SEQ ID:3468.

A function of VGAM757 is therefore inhibition of Zinc Finger Protein 207 (ZNF207, Accession NM_003457). Accordingly, utilities of VGAM757 include diagnosis, prevention and treatment of diseases and clinical conditions associated with ZNF207. FLJ23309 (Accession NM_024896) is another VGAM757 host target gene. FLJ23309 BINDING SITE is HOST TARGET binding site found in the 3' untranslated region of mRNA encoded by FLJ23309, corresponding to a HOST TARGET binding site such as BINDING SITE I, BINDING SITE II or BINDING SITE III. Table 2 illustrates the complementarity of the nucleotide sequences of FLJ23309 BINDING SITE, designated SEQ ID:24381, to the nucleotide sequence of VGAM757 RNA, herein designated VGAM RNA, also designated SEQ ID:3468.

Another function of VGAM757 is therefore inhibition of FLJ23309 (Accession NM_024896). Accordingly, utilities of VGAM757 include diagnosis, prevention and treatment of diseases and clinical conditions associated with FLJ23309. Sprouty Homolog 1, Antagonist of FGF Signaling (Drosophila) (SPRY1, Accession XM_036349) is another VGAM757 host target gene. SPRY1 BINDING SITE is HOST TARGET binding site found in the 5' untranslated region of mRNA encoded by SPRY1, corresponding to a HOST TARGET binding site such as BINDING SITE I, BINDING SITE II or BINDING SITE III. Table 2 illustrates the complementarity of the nucleotide sequences of SPRY1 BINDING SITE, designated SEQ ID:32429, to the nucleotide sequence of VGAM757 RNA, herein designated VGAM RNA, also designated SEQ ID:3468.

Another function of VGAM757 is therefore inhibition of Sprouty Homolog 1, Antagonist of FGF Signaling (Drosophila) (SPRY1, Accession XM_036349). Accordingly, utilities of VGAM757 include diagnosis, prevention and treatment of diseases and clinical conditions associated with SPRY1. LOC91431 (Accession NM_138698) is another VGAM757 host target gene. LOC91431 BINDING SITE is HOST TARGET binding site found in the 5" untranslated region of mRNA encoded by LOC91431, corresponding to a HOST TARGET binding site such as BINDING SITE I, BINDING SITE II or BINDING SITE III. Table 2 illustrates the complementarity of the nucleotide sequences of LOC91431 BINDING SITE, designated SEQ ID:28948, to the nucleotide sequence of VGAM757 RNA, herein designated VGAM RNA, also designated SEQ ID:3468.

Another function of VGAM757 is therefore inhibition of LOC91431 (Accession NM_138698). Accordingly, utilities of VGAM757 include diagnosis, prevention and treatment of diseases and clinical conditions associated with LOC91431.

FIG. 1 further provides a conceptual description of a novel bioinformatically detected viral gene of the present invention, referred to here as Viral Genomic Address Messenger 758 (VGAM758) viral gene, which modulates expression of respective host target genes thereof, the function and utility of which host target genes is known in the art.

VGAM758 is a novel bioinformatically detected regulatory, non protein coding, viral micro RNA (miRNA) gene. The method by which VGAM758 was detected is described hereinabove with reference to FIGS. 1-8.

VGAM758 gene, herein designated VGAM GENE, is a viral gene contained in the genome of Bovine Coronavirus. VGAM758 host target gene, herein designated VGAM HOST TARGET GENE, is a human gene contained in the human genome.

VGAM758 gene encodes a VGAM758 precursor RNA, herein designated VGAM PRECURSOR RNA. Similar to other miRNA genes, and unlike most ordinary genes, VGAM758 precursor RNA does not encode a protein. A nucleotide sequence identical or highly similar to the nucleotide sequence of VGAM758 precursor RNA is designated SEQ ID:744, and is provided hereinbelow with reference to the sequence listing part. Nucleotide sequence SEQ ID:744 is located at position 14862 relative to the genome of Bovine Coronavirus.

VGAM758 precursor RNA folds onto itself, forming VGAM758 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM758 folded precursor RNA into VGAM758 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM758 RNA is designated SEQ ID:3469, and is provided hereinbelow with reference to the sequence listing part.

VGAM758 host target gene, herein designated VGAM HOST TARGET GENE, encodes a corresponding messenger RNA, VGAM758 host target RNA, herein designated VGAM HOST TARGET RNA. VGAM758 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM758 RNA, herein designated VGAM RNA, binds complementarily to one or more host target binding sites located in untranslated regions of VGAM758 host target RNA, herein designated VGAM HOST TARGET RNA. This complementary binding is due to the fact that the nucleotide sequence of VGAM758 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM758 RNA, herein designated VGAM RNA, may have a different number of host target binding sites in untranslated regions of a VGAM758 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM758 RNA, herein designated VGAM RNA, to host target binding sites on VGAM758 host target RNA, herein designated VGAM HOST TARGET RNA, such as BINDING SITE I, BINDING SITE II and BINDING SITE III, inhibits translation of VGAM758 host target RNA into VGAM758 host target protein, herein designated VGAM HOST TARGET PROTEIN. VGAM host target protein is therefore outlined by a broken line.

It is appreciated that VGAM758 host target gene, herein designated VGAM HOST TARGET GENE, in fact represents a plurality of VGAM758 host target genes. The mRNA of each one of this plurality of VGAM758 host target genes comprises one or more host target binding sites, each having a nucleotide sequence which is at least partly complementary to VGAM758 RNA, herein designated VGAM RNA, and which when bound by VGAM758 RNA causes inhibition of translation of respective one or more VGAM758 host target proteins.

It is further appreciated by one skilled in the art that the mode of translational inhibition illustrated by FIG. 1 with specific reference to translational inhibition exerted by VGAM758 gene, herein designated VGAM GENE, on one or more VGAM758 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM758 is inhibition of expression of host target genes, as part of a novel viral mechanism of attacking a host. Accordingly, utilities of VGAM758 include diagnosis, prevention and treatment of viral infection by Bovine Coronavirus. Specific functions, and accordingly utilities, of VGAM758 correlate with, and may be deduced from, the identity of the host target genes which VGAM758 binds and inhibits, and the function of these host target genes, as elaborated hereinbelow.

Nucleotide sequences of the VGAM758 precursor RNA, herein designated VGAM PRECURSOR RNA, and of the 'diced' VGAM758 RNA, herein designated VGAM RNA, and a schematic representation of the secondary folding of VGAM758 folded precursor RNA, herein designated VGAM FOLDED PRECURSOR RNA, of VGAM758 are further described hereinbelow with reference to Table 1.

Nucleotide sequences of host target binding sites, such as BINDING SITE-I, BINDING SITE-II and BINDING SITE-III of FIG. 1, found on VGAM758 host target RNA, and schematic representation of the complementarity of each of these host target binding sites to VGAM758 RNA, herein designated VGAM RNA, are described hereinbelow with reference to Table 2.

As mentioned hereinabove with reference to FIG. 1, a function of VGAM758 gene, herein designated VGAM is inhibition of expression of VGAM758 target genes. It is appreciated that specific functions, and accordingly utilities, of VGAM758 correlate with, and may be deduced from, the identity of the target genes which VGAM758 binds and inhibits, and the function of these target genes, as elaborated hereinbelow.

Polycystic Kidney and Hepatic Disease 1 (autosomal recessive) (PKHD1, Accession NM_138694) is a VGAM758 host target gene. PKHD1 BINDING SITE is HOST TARGET binding site found in the 3' untranslated region of mRNA encoded by PKHD1, corresponding to a HOST TARGET binding site such as BINDING SITE I, BINDING SITE II or BINDING SITE III. Table 2 illustrates the complementarity of the nucleotide sequences of PKHD1 BINDING SITE, designated SEQ ID:28945, to the nucleotide sequence of VGAM758 RNA, herein designated VGAM RNA, also designated SEQ ID:3469.

A function of VGAM758 is therefore inhibition of Polycystic Kidney and Hepatic Disease 1 (autosomal recessive) (PKHD1, Accession NM_138694). Accordingly, utilities of VGAM758 include diagnosis, prevention and treatment of diseases and clinical conditions associated with PKHD1. RNA (guanine-7-) Methyltransferase (RNMT, Accession NM_003799) is another VGAM758 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9893, to the nucleotide sequence of VGAM758 RNA, herein designated VGAM RNA, also designated SEQ ID:3469.

Another function of VGAM758 is therefore inhibition of RNA (guanine-7-) Methyltransferase (RNMT, Accession NM_003799), a gene which catalyzes the methylation of GpppN- at the guanine N7 position. Accordingly, utilities of VGAM758 include diagnosis, prevention and treatment of diseases and clinical conditions associated with RNMT. The function of RNMT and its association with various diseases and clinical conditions, has been established by previous studies, as described hereinabove with reference to VGAM178. FLJ23056 (Accession NM_024582) is another VGAM758 host target gene. FLJ23056 BINDING SITE is HOST TARGET binding site found in the 3' untranslated region of mRNA encoded by FLJ23056, corresponding to a HOST TARGET binding site such as BINDING SITE I, BINDING SITE II or BINDING SITE III. Table 2 illustrates the complementarity of the nucleotide sequences of FLJ23056 BINDING SITE, designated SEQ ID:23807, to the nucleotide sequence of VGAM758 RNA, herein designated VGAM RNA, also designated SEQ ID:3469.

Another function of VGAM758 is therefore inhibition of FLJ23056 (Accession NM_024582). Accordingly, utilities of VGAM758 include diagnosis, prevention and treatment of diseases and clinical conditions associated with FLJ23056. IPT (Accession NM_017646) is another VGAM758 host target gene. IPT BINDING SITE is HOST TARGET binding site found in the 3" untranslated region of mRNA encoded by IPT, corresponding to a HOST TARGET binding site such as BINDING SITE I, BINDING SITE II or BINDING SITE III. Table 2 illustrates the complementarity of the nucleotide sequences of IPT BINDING SITE, designated SEQ ID:19151, to the nucleotide sequence of VGAM758 RNA, herein designated VGAM RNA, also designated SEQ ID:3469.

Another function of VGAM758 is therefore inhibition of IPT (Accession NM_017646). Accordingly, utilities of VGAM758 include diagnosis, prevention and treatment of diseases and clinical conditions associated with IPT. MDS028 (Accession NM_018463) is another VGAM758 host target gene. MDS028 BINDING SITE is HOST TARGET binding site found in the 3' untranslated region of mRNA encoded by MDS028, corresponding to a HOST TARGET binding site such as BINDING SITE I, BINDING SITE II or BINDING SITE III. Table 2 illustrates the complementarity of the nucleotide sequences of MDS028 BINDING SITE, designated SEQ ID:20535, to the nucleotide sequence of VGAM758 RNA, herein designated VGAM RNA, also designated SEQ ID:3469.

Another function of VGAM758 is therefore inhibition of MDS028 (Accession NM_018463). Accordingly, utilities of VGAM758 include diagnosis, prevention and treatment of diseases and clinical conditions associated with MDS028. LOC137492 (Accession XM_059910) is another VGAM758 host target gene. LOC137492 BINDING SITE is HOST TARGET binding site found in the 5' untranslated region of mRNA encoded by LOC137492, corresponding to a HOST TARGET binding site such as BINDING SITE I, BINDING SITE II or BINDING SITE III. Table 2 illustrates the complementarity of the nucleotide sequences of LOC137492 BINDING SITE, designated SEQ ID:37107, to the nucleotide sequence of VGAM758 RNA, herein designated VGAM RNA, also designated SEQ ID:3469.

Another function of VGAM758 is therefore inhibition of LOC137492 (Accession XM_059910). Accordingly, utilities of VGAM758 include diagnosis, prevention and treatment of diseases and clinical conditions associated with LOC137492. FIG. 1 further provides a conceptual description of a novel bioinformatically detected viral gene of the present invention, referred to here as Viral Genomic Address Messenger 759 (VGAM759) viral gene, which modulates expression of respective host target genes thereof, the function and utility of which host target genes is known in the art.

VGAM759 is a novel bioinformatically detected regulatory, non protein coding, viral micro RNA (miRNA) gene. The method by which VGAM759 was detected is described hereinabove with reference to FIGS. 1-8.

VGAM759 gene, herein designated VGAM GENE, is a viral gene contained in the genome of Bovine Coronavirus. VGAM759 host target gene, herein designated VGAM HOST TARGET GENE, is a human gene contained in the human genome.

VGAM759 gene encodes a VGAM759 precursor RNA, herein designated VGAM PRECURSOR RNA. Similar to other miRNA genes, and unlike most ordinary genes, VGAM759 precursor RNA does not encode a protein. A nucleotide sequence identical or highly similar to the nucleotide sequence of VGAM759 precursor RNA is designated SEQ ID:745, and is provided hereinbelow with reference to the sequence listing part. Nucleotide sequence SEQ ID:745 is located at position 7762 relative to the genome of Bovine Coronavirus.

VGAM759 precursor RNA folds onto itself, forming VGAM759 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM759 folded precursor RNA into VGAM759 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM759 RNA is designated SEQ ID:3470, and is provided hereinbelow with reference to the sequence listing part.

VGAM759 host target gene, herein designated VGAM HOST TARGET GENE, encodes a corresponding messenger RNA, VGAM759 host target RNA, herein designated VGAM HOST TARGET RNA. VGAM759 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM759 RNA, herein designated VGAM RNA, binds complementarily to one or more host target binding sites located in untranslated regions of VGAM759 host target RNA, herein designated VGAM HOST TARGET RNA. This complementary binding is due to the fact that the nucleotide sequence of VGAM759 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM759 RNA, herein designated VGAM RNA, may have a different number of host target binding sites in untranslated regions of a VGAM759 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM759 RNA, herein designated VGAM RNA, to host target binding sites on VGAM759 host target RNA, herein designated VGAM HOST TARGET RNA, such as BINDING SITE I, BINDING SITE II and BINDING SITE III, inhibits translation of VGAM759 host target RNA into VGAM759 host target protein, herein designated VGAM HOST TARGET PROTEIN. VGAM host target protein is therefore outlined by a broken line.

It is appreciated that VGAM759 host target gene, herein designated VGAM HOST TARGET GENE, in fact represents a plurality of VGAM759 host target genes. The mRNA of each one of this plurality of VGAM759 host target genes comprises one or more host target binding sites, each having a nucleotide sequence which is at least partly complementary to VGAM759 RNA, herein designated VGAM RNA, and which when bound by VGAM759 RNA causes inhibition of translation of respective one or more VGAM759 host target proteins.

It is further appreciated by one skilled in the art that the mode of translational inhibition illustrated by FIG. 1 with specific reference to translational inhibition exerted by VGAM759 gene, herein designated VGAM GENE, on one or more VGAM759 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM759 is inhibition of expression of host target genes, as part of a novel viral mechanism of attacking a host. Accordingly, utilities of VGAM759 include diagnosis, prevention and treatment of viral infection by Bovine Coronavirus. Specific functions, and accordingly utilities, of VGAM759 correlate with, and may be deduced from, the identity of the host target genes which VGAM759 binds and inhibits, and the function of these host target genes, as elaborated hereinbelow.

Nucleotide sequences of the VGAM759 precursor RNA, herein designated VGAM PRECURSOR RNA, and of the 'diced' VGAM759 RNA, herein designated VGAM RNA, and a schematic representation of the secondary folding of VGAM759 folded precursor RNA, herein designated VGAM FOLDED PRECURSOR RNA, of VGAM759 are further described hereinbelow with reference to Table 1.

Nucleotide sequences of host target binding sites, such as BINDING SITE-I, BINDING SITE-II and BINDING SITE-III of FIG. 1, found on VGAM759 host target RNA, and schematic representation of the complementarity of each of these host target binding sites to VGAM759 RNA, herein designated VGAM RNA, are described hereinbelow with reference to Table 2.

As mentioned hereinabove with reference to FIG. 1, a function of VGAM759 gene, herein designated VGAM is inhibition of expression of VGAM759 target genes. It is appreciated that specific functions, and accordingly utilities, of VGAM759 correlate with, and may be deduced from, the identity of the target genes which VGAM759 binds and inhibits, and the function of these target genes, as elaborated hereinbelow.

Transient Receptor Potential Cation Channel, Subfamily C, Member 5 (TRPC5, Accession NM_012471) is a VGAM759 host target gene. TRPC5 BINDING SITE is HOST TARGET binding site found in the 3' untranslated region of mRNA encoded by TRPC5, corresponding to a HOST TARGET binding site such as BINDING SITE I, BINDING SITE II or BINDING SITE III. Table 2 illustrates the complementarity of the nucleotide sequences of TRPC5 BINDING SITE, designated SEQ ID:14849, to the nucleotide sequence of VGAM759 RNA, herein designated VGAM RNA, also designated SEQ ID:3470.

A function of VGAM759 is therefore inhibition of Transient Receptor Potential Cation Channel, Subfamily C, Member 5 (TRPC5, Accession NM_012471). Accordingly, utilities of VGAM759 include diagnosis, prevention and treatment of diseases and clinical conditions associated with TRPC5. KIAA0090 (Accession XM_114045) is another VGAM759 host target gene. KIAA0090 BINDING SITE is HOST TARGET binding site found in the 3" untranslated region of mRNA encoded by KIAA0090, corresponding to a HOST TARGET binding site such as BINDING SITE I, BINDING SITE II or BINDING SITE III. Table 2 illustrates the complementarity of the nucleotide sequences of KIAA0090 BINDING SITE, designated SEQ ID:42651, to the nucleotide sequence of VGAM759 RNA, herein designated VGAM RNA, also designated SEQ ID:3470.

Another function of VGAM759 is therefore inhibition of KIAA0090 (Accession XM_114045). Accordingly, utilities of VGAM759 include diagnosis, prevention and treatment of diseases and clinical conditions associated with KIAA0090. LOC138199 (Accession XM_059950) is another VGAM759 host target gene. LOC138199 BINDING SITE is HOST TARGET binding site found in the 3' untranslated region of mRNA encoded by LOC138199, corresponding to a HOST TARGET binding site such as BINDING SITE I, BINDING SITE II or BINDING SITE III. Table 2 illustrates the complementarity of the nucleotide sequences of LOC138199 BINDING SITE, designated SEQ ID:37117, to the nucleotide sequence of VGAM759 RNA, herein designated VGAM RNA, also designated SEQ ID:3470.

Another function of VGAM759 is therefore inhibition of LOC138199 (Accession XM_059950). Accordingly, utilities of VGAM759 include diagnosis, prevention and treatment of diseases and clinical conditions associated with LOC138199. LOC254228 (Accession XM_171123) is another VGAM759 host target gene. LOC254228 BINDING SITE is HOST TARGET binding site found in the 3' untranslated region of mRNA encoded by LOC254228, corresponding to a HOST TARGET binding site such as BINDING SITE I, BINDING SITE II or BINDING SITE III. Table 2 illustrates the complementarity of the nucleotide sequences of LOC254228 BINDING SITE, designated SEQ ID:45916, to the nucleotide sequence of VGAM759 RNA, herein designated VGAM RNA, also designated SEQ ID:3470.

Another function of VGAM759 is therefore inhibition of LOC254228 (Accession XM_171123). Accordingly, utilities of VGAM759 include diagnosis, prevention and treatment of diseases and clinical conditions associated with LOC254228. LOC254251 (Accession XM_171088) is another VGAM759 host target gene. LOC254251 BINDING SITE is HOST TARGET binding site found in the 5' untranslated region of mRNA encoded by LOC254251, corresponding to a HOST TARGET binding site such as BINDING SITE I, BINDING SITE II or BINDING SITE III. Table 2 illustrates the complementarity of the nucleotide sequences of LOC254251 BINDING SITE, designated SEQ ID:45900, to the nucleotide sequence of VGAM759 RNA, herein designated VGAM RNA, also designated SEQ ID:3470.

Another function of VGAM759 is therefore inhibition of LOC254251 (Accession XM_171088). Accordingly, utilities of VGAM759 include diagnosis, prevention and treatment of diseases and clinical conditions associated with LOC254251. FIG. 1 further provides a conceptual description of a novel bioinformatically detected viral gene of the present invention, referred to here as Viral Genomic Address Messenger 760 (VGAM760) viral gene, which modulates expression of respective host target genes thereof, the function and utility of which host target genes is known in the art.

VGAM760 is a novel bioinformatically detected regulatory, non protein coding, viral micro RNA (miRNA) gene. The method by which VGAM760 was detected is described hereinabove with reference to FIGS. 1-8.

VGAM760 gene, herein designated VGAM GENE, is a viral gene contained in the genome of Bovine Coronavirus. VGAM760 host target gene, herein designated VGAM HOST TARGET GENE, is a human gene contained in the human genome.

VGAM760 gene encodes a VGAM760 precursor RNA, herein designated VGAM PRECURSOR RNA. Similar to other miRNA genes, and unlike most ordinary genes, VGAM760 precursor RNA does not encode a protein. A nucleotide sequence identical or highly similar to the nucleotide sequence of VGAM760 precursor RNA is designated SEQ ID:746, and is provided hereinbelow with reference to the sequence listing part. Nucleotide sequence SEQ ID:746 is located at position 14942 relative to the genome of Bovine Coronavirus.

VGAM760 precursor RNA folds onto itself, forming VGAM760 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM760 folded precursor RNA into VGAM760 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM760 RNA is designated SEQ ID:3471, and is provided hereinbelow with reference to the sequence listing part.

VGAM760 host target gene, herein designated VGAM HOST TARGET GENE, encodes a corresponding messenger RNA, VGAM760 host target RNA, herein designated VGAM HOST TARGET RNA. VGAM760 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM760 RNA, herein designated VGAM RNA, binds complementarily to one or more host target binding sites located in untranslated regions of VGAM760 host target RNA, herein designated VGAM HOST TARGET RNA. This complementary binding is due to the fact that the nucleotide sequence of VGAM760 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM760 RNA, herein designated VGAM RNA, may have a different number of host target binding sites in untranslated regions of a VGAM760 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM760 RNA, herein designated VGAM RNA, to host target binding sites on VGAM760 host target RNA, herein designated VGAM HOST TARGET RNA, such as BINDING SITE I, BINDING SITE II and BINDING SITE III, inhibits translation of VGAM760 host target RNA into VGAM760 host target protein, herein designated VGAM HOST TARGET PROTEIN. VGAM host target protein is therefore outlined by a broken line.

It is appreciated that VGAM760 host target gene, herein designated VGAM HOST TARGET GENE, in fact represents a plurality of VGAM760 host target genes. The mRNA of each one of this plurality of VGAM760 host target genes comprises one or more host target binding sites, each having a nucleotide sequence which is at least partly complementary to VGAM760 RNA, herein designated VGAM RNA, and which when bound by VGAM760 RNA causes inhibition of translation of respective one or more VGAM760 host target proteins.

It is further appreciated by one skilled in the art that the mode of translational inhibition illustrated by FIG. 1 with specific reference to translational inhibition exerted by VGAM760 gene, herein designated VGAM GENE, on one or more VGAM760 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM760 is inhibition of expression of host target genes, as part of a novel viral mechanism of attacking a host. Accordingly, utilities of VGAM760 include diagnosis, prevention and treatment of viral infection by Bovine Coronavirus. Specific functions, and accordingly utilities, of VGAM760 correlate with, and may be deduced from, the identity of the host target genes which VGAM760 binds and inhibits, and the function of these host target genes, as elaborated hereinbelow.

Nucleotide sequences of the VGAM760 precursor RNA, herein designated VGAM PRECURSOR RNA, and of the 'diced' VGAM760 RNA, herein designated VGAM RNA, and a schematic representation of the secondary folding of VGAM760 folded precursor RNA, herein designated VGAM FOLDED PRECURSOR RNA, of VGAM760 are further described hereinbelow with reference to Table 1.

Nucleotide sequences of host target binding sites, such as BINDING SITE-I, BINDING SITE-II and BINDING SITE-III of FIG. 1, found on VGAM760 host target RNA, and schematic representation of the complementarity of each of these host target binding sites to VGAM760 RNA, herein designated VGAM RNA, are described hereinbelow with reference to Table 2.

As mentioned hereinabove with reference to FIG. 1, a function of VGAM760 gene, herein designated VGAM is inhibition of expression of VGAM760 target genes. It is appreciated that specific functions, and accordingly utilities, of VGAM760 correlate with, and may be deduced from, the identity of the target genes which VGAM760 binds and inhibits, and the function of these target genes, as elaborated hereinbelow.

Erythrocyte Membrane Protein Band 4.9 (dematin) (EPB49, Accession NM_001978) is a VGAM760 host target gene. EPB49 BINDING SITE is HOST TARGET binding site found in the 3' untranslated region of mRNA encoded by EPB49, corresponding to a HOST TARGET binding site such as BINDING SITE I, BINDING SITE II or BINDING SITE III. Table 2 illustrates the complementarity of the nucleotide sequences of EPB49 BINDING SITE, designated SEQ ID:7710, to the nucleotide sequence of VGAM760 RNA, herein designated VGAM RNA, also designated SEQ ID:3471.

A function of VGAM760 is therefore inhibition of Erythrocyte Membrane Protein Band 4.9 (dematin) (EPB49, Accession NM_001978), a gene which is an actin-bundling protein. Accordingly, utilities of VGAM760 include diagnosis, prevention and treatment of diseases and clinical conditions associated with EPB49. The function of EPB49 has been established by previous studies. Chishti et al. (1989) proposed the name dematin (from the Greek 'dema,' a bundle) for an actin-bundling protein originally identified in the human erythroid membrane skeleton. It consists of 2 polypeptide chains of 48 and 52 kD that have been identified as protein 4.9 on SDS/polyacrylamide gels. In solution, dematin exists as a trimer and bundles actin filaments in a phosphorylation-dependent manner. Its actin-bundling activity is abolished upon phosphorylation by cAMP-dependent protein kinase and is restored after dephosphorylation. See review of Gilligan and Bennett (1993). Rana et al. (1993) reported the complete primary structure of human erythroid dematin, whose sequence includes a homolog of the 'headpiece' sequence found at the C-terminus of villin (OMIM Ref. No. 193040). The headpiece is essential for villin function in inducing microvillar development and actin redistribution. The widespread expression of dematin transcripts in human tissue suggests that dematin and its homologs may substitute for villin in villin-negative tissues to regulate actin reorganization by a phosphorylation-regulated mechanism. Peters et al. (1995) demonstrated that the murine dematin gene, symbolized Epb4.9, maps to chromosome 14. They raised the possibility that dematin mutations may be involved in neurologic abnormalities in the mouse. Although dematin is an actin-bundling protein of the erythroid membrane skeleton, it is abundantly expressed in human brain, heart, skeletal muscle, kidney, and lung. Azim et al. (1995) noted that the 48-kD subunit of dematin contains the headpiece domain of villin which is essential for its morphogenic function in vivo. Azim et al. (1995) reported the primary structure of the 52-kD subunit of dematin which differs from the 48-kD subunit by a 22-amino acid insertion within its headpiece domain. A unique feature of the insertion sequence of the 52-kD subunit is its homology to erythrocyte protein 4.2 (OMIM Ref. No. 177070). Using somatic cell hybrid panels and fluorescence in situ hybridization, Azim et al. (1995) localized the dematin gene to 8p21.1, a site distal to the locus of ankyrin (OMIM Ref. No. 182900) at 8p11.2. Azim et al. (1996) demonstrated that dematin and protein 4.2 (OMIM Ref. No. 177070) bind ATP. Although the functional significance is not clear, the findings open new perspectives for the function of these 2 proteins in vivo. By using homologous recombination in mouse embryonic stem cells, Khanna et al. (2002) deleted the headpiece domain of dematin to evaluate its function in vivo. Dematin headpiece-null mice were viable and born at the expected mendelian ratio. Hematologic evaluation showed evidence of compensated anemia and spherocytosis in these mice, however. The headpiece-null erythrocytes were osmotically fragile, and displayed reduced deformability and filterability. In vitro, significantly greater membrane fragmentation of these erythrocytes was demonstrated. Biochemical characterization showed a weakened membrane skeleton evidenced by reduced association of spectrin and actin to the plasma membrane. Together, these results provided evidence for the physiologic significance of dematin and demonstrated a role for the headpiece domain in the maintenance of structural integrity and mechanical properties of red cells in vivo.

Full details of the abovementioned studies are described in the following publications, the disclosure of which are hereby incorporated by reference:

Khanna, R.; Chang, S. H.; Andrabi, S.; Azam, M.; Kim, A.; Rivera, A.; Brugnara, C.; Low, P. S.; Liu, S.-C.; Chishti, A. H.: Headpiece domain of dematin is required for the stability of the erythrocyte membrane. Proc. Nat. Acad. Sci. 99:6637-6642, 2002; and Peters, L. L.; Eicher, E. M.; Azim, A. C.; Chishti, A. H.: The gene encoding the erythrocyte membrane skeleton protein dematin (Epb4.9) maps to mouse chromosome 14. Genomics 26:634-63.

Further studies establishing the function and utilities of EPB49 are found in John Hopkins OMIM database record ID 125305, and in sited publications numbered 2664-2670 listed in the bibliography section hereinbelow, which are also hereby incorporated by reference. Coagulation Factor II (thrombin) Receptor-like 3 (F2RL3, Accession NM_003950) is another VGAM760 host target gene. F2RL3 BINDING SITE is HOST TARGET binding site found in the 3' untranslated region of mRNA encoded by F2RL3, corresponding to a HOST TARGET binding site such as BINDING SITE I, BINDING SITE II or BINDING SITE III. Table 2 illustrates the complementarity of the nucleotide sequences of F2RL3 BINDING SITE, designated SEQ ID:10082, to the nucleotide sequence of VGAM760 RNA, herein designated VGAM RNA, also designated SEQ ID:3471.

Another function of VGAM760 is therefore inhibition of Coagulation Factor II (thrombin) Receptor-like 3 (F2RL3, Accession NM_003950), a gene which Protease-activated receptor 4; G protein-coupled receptor that increases phosphoinositide hydrolysis. Accordingly, utilities of VGAM760 include diagnosis, prevention and treatment of diseases and clinical conditions associated with F2RL3. The function of F2RL3 and its association with various diseases and clinical conditions, has been established by previous studies, as described hereinabove with reference to VGAM193. FLJ11029 (Accession XM_027783) is another VGAM760 host target gene. FLJ11029 BINDING SITE is HOST TARGET binding site found in the 5' untranslated region of mRNA encoded by FLJ11029, corresponding to a HOST TARGET binding site such as BINDING SITE I, BINDING SITE II or BINDING SITE III. Table 2 illustrates the complementarity of the nucleotide sequences of FLJ11029 BINDING SITE, designated SEQ ID:30569, to the nucleotide sequence of VGAM760 RNA, herein designated VGAM RNA, also designated SEQ ID:3471.

Another function of VGAM760 is therefore inhibition of FLJ11029 (Accession XM_027783). Accordingly, utilities of VGAM760 include diagnosis, prevention and treatment of diseases and clinical conditions associated with FLJ11029. FLJ21168 (Accession NM_025073) is another VGAM760 host target gene. FLJ21168 BINDING SITE is HOST TARGET binding site found in the 3' untranslated region of mRNA encoded by FLJ21168, corresponding to a HOST TARGET binding site such as BINDING SITE I, BINDING SITE II or BINDING SITE III. Table 2 illustrates the complementarity of the nucleotide sequences of FLJ21168 BINDING SITE, designated SEQ ID:24674, to the nucleotide sequence of VGAM760 RNA, herein designated VGAM RNA, also designated SEQ ID:3471.

Another function of VGAM760 is therefore inhibition of FLJ21168 (Accession NM_025073). Accordingly, utilities of VGAM760 include diagnosis, prevention and treatment of diseases and clinical conditions associated with FLJ21168. Guanine Nucleotide Binding Protein (G protein), Gamma 10 (GNG10, Accession NM_004125) is another VGAM760 host target gene. GNG10 BINDING SITE is HOST TARGET binding site found in the 3' untranslated region of mRNA encoded by GNG10, corresponding to a HOST TARGET binding site such as BINDING SITE I, BINDING SITE II or BINDING SITE III. Table 2 illustrates the complementarity of the nucleotide sequences of GNG10 BINDING SITE, designated SEQ ID:10332, to the nucleotide sequence of VGAM760 RNA, herein designated VGAM RNA, also designated SEQ ID:3471.

Another function of VGAM760 is therefore inhibition of Guanine Nucleotide Binding Protein (G protein), Gamma 10 (GNG10, Accession NM_004125). Accordingly, utilities of VGAM760 include diagnosis, prevention and treatment of diseases and clinical conditions associated with GNG10. GR6 (Accession NM_007354) is another VGAM760 host target gene. GR6 BINDING SITE is HOST TARGET binding site found in the 5' untranslated region of mRNA encoded by GR6, corresponding to a HOST TARGET binding site such as BINDING SITE I, BINDING SITE II or BINDING SITE III. Table 2 illustrates the complementarity of the nucleotide sequences of GR6 BINDING SITE, designated SEQ ID:14283, to the nucleotide sequence of VGAM760 RNA, herein designated VGAM RNA, also designated SEQ ID:3471.

Another function of VGAM760 is therefore inhibition of GR6 (Accession NM_007354). Accordingly, utilities of VGAM760 include diagnosis, prevention and treatment of diseases and clinical conditions associated with GR6. HBOA (Accession NM_007067) is another VGAM760 host target gene. HBOA BINDING SITE is HOST TARGET binding site found in the 3' untranslated region of mRNA encoded by HBOA, corresponding to a HOST TARGET binding site such as BINDING SITE I, BINDING SITE II or BINDING SITE III. Table 2 illustrates the complementarity of the nucleotide sequences of HBOA BINDING SITE, designated SEQ ID:13931, to the nucleotide sequence of VGAM760 RNA, herein designated VGAM RNA, also designated SEQ ID:3471.

Another function of VGAM760 is therefore inhibition of HBOA (Accession NM_007067). Accordingly, utilities of VGAM760 include diagnosis, prevention and treatment of diseases and clinical conditions associated with HBOA. KIAA0319 (Accession NM_014809) is another VGAM760 host target gene. KIAA0319 BINDING SITE is HOST TARGET binding site found in the 3" untranslated region of mRNA encoded by KIAA0319, corresponding to a HOST TARGET binding site such as BINDING SITE I, BINDING SITE II or BINDING SITE III. Table 2 illustrates the complementarity of the nucleotide sequences of KIAA0319 BINDING SITE, designated SEQ ID:16766, to the nucleotide sequence of VGAM760 RNA, herein designated VGAM RNA, also designated SEQ ID:3471.

Another function of VGAM760 is therefore inhibition of KIAA0319 (Accession NM_014809). Accordingly, utilities of VGAM760 include diagnosis, prevention and treatment of diseases and clinical conditions associated with KIAA0319. KIAA0472 (Accession XM_050147) is another VGAM760 host target gene. KIAA0472 BINDING SITE is HOST TARGET binding site found in the 3' untranslated region of mRNA encoded by KIAA0472, corresponding to a HOST TARGET binding site such as BINDING SITE I, BINDING SITE II or BINDING SITE III. Table 2 illustrates the complementarity of the nucleotide sequences of KIAA0472 BINDING SITE, designated SEQ ID:35576, to the nucleotide sequence of VGAM760 RNA, herein designated VGAM RNA, also designated SEQ ID:3471.

Another function of VGAM760 is therefore inhibition of KIAA0472 (Accession XM_050147). Accordingly, utilities of VGAM760 include diagnosis, prevention and treatment of diseases and clinical conditions associated with KIAA0472. PAS Domain Containing Serine/threonine Kinase (PASK, Accession NM_015148) is another VGAM760 host target gene. PASK BINDING SITE is HOST TARGET binding site found in the 5' untranslated region of mRNA encoded by PASK, corresponding to a HOST TARGET binding site such as BINDING SITE I, BINDING SITE II or BINDING SITE III. Table 2 illustrates the complementarity of the nucleotide sequences of PASK BINDING SITE, designated SEQ ID:17502, to the nucleotide sequence of VGAM760 RNA, herein designated VGAM RNA, also designated SEQ ID:3471.

Another function of VGAM760 is therefore inhibition of PAS Domain Containing Serine/threonine Kinase (PASK, Accession NM_015148). Accordingly, utilities of VGAM760 include diagnosis, prevention and treatment of diseases and clinical conditions associated with PASK. LOC220883 (Accession XM_166076) is another VGAM760 host target gene. LOC220883 BINDING SITE is HOST TARGET binding site found in the 3' untranslated region of mRNA encoded by LOC220883, corresponding to a HOST TARGET binding site such as BINDING SITE I, BINDING SITE II or BINDING SITE III. Table 2 illustrates the complementarity of the nucleotide sequences of LOC220883 BINDING SITE, designated SEQ ID:43852, to the nucleotide sequence of VGAM760 RNA, herein designated VGAM RNA, also designated SEQ ID:3471.

Another function of VGAM760 is therefore inhibition of LOC220883 (Accession XM_166076). Accordingly, utilities of VGAM760 include diagnosis, prevention and treatment of diseases and clinical conditions associated with LOC220883. LOC221662 (Accession XM_166466) is another VGAM760 host target gene. LOC221662 BINDING SITE is HOST TARGET binding site found in the 3' untranslated region of mRNA encoded by LOC221662, corresponding to a HOST TARGET binding site such as BINDING SITE I, BINDING SITE II or BINDING SITE III. Table 2 illustrates the complementarity of the nucleotide sequences of LOC221662 BINDING SITE, designated SEQ ID:44390, to the nucleotide sequence of VGAM760 RNA, herein designated VGAM RNA, also designated SEQ ID:3471.

Another function of VGAM760 is therefore inhibition of LOC221662 (Accession XM_166466). Accordingly, utilities of VGAM760 include diagnosis, prevention and treatment of diseases and clinical conditions associated with LOC221662. FIG. 1 further provides a conceptual description of a novel bioinformatically detected viral gene of the present invention, referred to here as Viral Genomic Address Messenger 761 (VGAM761) viral gene, which modulates expression of respective host target genes thereof, the function and utility of which host target genes is known in the art.

VGAM761 is a novel bioinformatically detected regulatory, non protein coding, viral micro RNA (miRNA) gene. The method by which VGAM761 was detected is described hereinabove with reference to FIGS. 1-8.

VGAM761 gene, herein designated VGAM GENE, is a viral gene contained in the genome of Bovine Coronavirus. VGAM761 host target gene, herein designated VGAM HOST TARGET GENE, is a human gene contained in the human genome.

VGAM761 gene encodes a VGAM761 precursor RNA, herein designated VGAM PRECURSOR RNA. Similar to other miRNA genes, and unlike most ordinary genes, VGAM761 precursor RNA does not encode a protein. A nucleotide sequence identical or highly similar to the nucleotide sequence of VGAM761 precursor RNA is designated SEQ ID:747, and is provided hereinbelow with reference to the sequence listing part. Nucleotide sequence SEQ ID:747 is located at position 5511 relative to the genome of Bovine Coronavirus.

VGAM761 precursor RNA folds onto itself, forming VGAM761 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM761 folded precursor RNA into VGAM761 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM761 RNA is designated SEQ ID:3472, and is provided hereinbelow with reference to the sequence listing part.

VGAM761 host target gene, herein designated VGAM HOST TARGET GENE, encodes a corresponding messenger RNA, VGAM761 host target RNA, herein designated VGAM HOST TARGET RNA. VGAM761 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM761 RNA, herein designated VGAM RNA, binds complementarily to one or more host target binding sites located in untranslated regions of VGAM761 host target RNA, herein designated VGAM HOST TARGET RNA. This complementary binding is due to the fact that the nucleotide sequence of VGAM761 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM761 RNA, herein designated VGAM RNA, may have a different number of host target binding sites in untranslated regions of a VGAM761 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM761 RNA, herein designated VGAM RNA, to host target binding sites on VGAM761 host target RNA, herein designated VGAM HOST TARGET RNA, such as BINDING SITE I, BINDING SITE II and BINDING SITE III, inhibits translation of VGAM761 host target RNA into VGAM761 host target protein, herein designated VGAM HOST TARGET PROTEIN. VGAM host target protein is therefore outlined by a broken line.

It is appreciated that VGAM761 host target gene, herein designated VGAM HOST TARGET GENE, in fact represents a plurality of VGAM761 host target genes. The mRNA of each one of this plurality of VGAM761 host target genes comprises one or more host target binding sites, each having a nucleotide sequence which is at least partly complementary to VGAM761 RNA, herein designated VGAM RNA, and which when bound by VGAM761 RNA causes inhibition of translation of respective one or more VGAM761 host target proteins.

It is further appreciated by one skilled in the art that the mode of translational inhibition illustrated by FIG. 1 with specific reference to translational inhibition exerted by VGAM761 gene, herein designated VGAM GENE, on one or more VGAM761 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM761 is inhibition of expression of host target genes, as part of a novel viral mechanism of attacking a host. Accordingly, utilities of VGAM761 include diagnosis, prevention and treatment of viral infection by Bovine Coronavirus. Specific functions, and accordingly utilities, of VGAM761 correlate with, and may be deduced from, the identity of the host target genes which VGAM761 binds and inhibits, and the function of these host target genes, as elaborated hereinbelow.

Nucleotide sequences of the VGAM761 precursor RNA, herein designated VGAM PRECURSOR RNA, and of the 'diced' VGAM761 RNA, herein designated VGAM RNA, and a schematic representation of the secondary folding of VGAM761 folded precursor RNA, herein designated VGAM FOLDED PRECURSOR RNA, of VGAM761 are further described hereinbelow with reference to Table 1.

Nucleotide sequences of host target binding sites, such as BINDING SITE-I, BINDING SITE-II and BINDING SITE-III of FIG. 1, found on VGAM761 host target RNA, and schematic representation of the complementarity of each of these host target binding sites to VGAM761 RNA, herein designated VGAM RNA, are described hereinbelow with reference to Table 2.

As mentioned hereinabove with reference to FIG. 1, a function of VGAM761 gene, herein designated VGAM is inhibition of expression of VGAM761 target genes. It is appreciated that specific functions, and accordingly utilities, of VGAM761 correlate with, and may be deduced from, the identity of the target genes which VGAM761 binds and inhibits, and the function of these target genes, as elaborated hereinbelow.

GTP Binding Protein 5 (putative) (GTPBP5, Accession XM_037206) is a VGAM761 host target gene. GTPBP5 BINDING SITE is HOST TARGET binding site found in the 3' untranslated region of mRNA encoded by GTPBP5, corresponding to a HOST TARGET binding site such as BINDING SITE I, BINDING SITE II or BINDING SITE III. Table 2 illustrates the complementarity of the nucleotide sequences of GTPBP5 BINDING SITE, designated SEQ ID:32575, to the nucleotide sequence of VGAM761 RNA, herein designated VGAM RNA, also designated SEQ ID:3472.

A function of VGAM761 is therefore inhibition of GTP Binding Protein 5 (putative) (GTPBP5, Accession XM_037206). Accordingly, utilities of VGAM761 include diagnosis, prevention and treatment of diseases and clinical conditions associated with GTPBP5. KIAA0625 (Accession NM_015046) is another VGAM761 host target gene. KIAA0625 BINDING SITE is HOST TARGET binding site found in the 5' untranslated region of mRNA encoded by KIAA0625, corresponding to a HOST TARGET binding site such as BINDING SITE I, BINDING SITE II or BINDING SITE III. Table 2 illustrates the complementarity of the nucleotide sequences of KIAA0625 BINDING SITE, designated SEQ ID:17407, to the nucleotide sequence of VGAM761 RNA, herein designated VGAM RNA, also designated SEQ ID:3472.

Another function of VGAM761 is therefore inhibition of KIAA0625 (Accession NM_015046). Accordingly, utilities of VGAM761 include diagnosis, prevention and treatment of diseases and clinical conditions associated with KIAA0625. KIAA1493 (Accession XM_034415) is another VGAM761 host target gene. KIAA1493 BINDING SITE is HOST TARGET binding site found in the 3' untranslated region of mRNA encoded by KIAA1493, corresponding to a HOST TARGET binding site such as BINDING SITE I, BINDING SITE II or BINDING SITE III. Table 2 illustrates the complementarity of the nucleotide sequences of KIAA1493 BINDING SITE, designated SEQ ID:32087, to the nucleotide sequence of VGAM761 RNA, herein designated VGAM RNA, also designated SEQ ID:3472.

Another function of VGAM761 is therefore inhibition of KIAA1493 (Accession XM_034415). Accordingly, utilities of VGAM761 include diagnosis, prevention and treatment of diseases and clinical conditions associated with KIAA1493. FIG. 1 further provides a conceptual description of a novel bioinformatically detected viral gene of the present invention, referred to here as Viral Genomic Address Messenger 762 (VGAM762) viral gene, which modulates expression of respective host target genes thereof, the function and utility of which host target genes is known in the art.

VGAM762 is a novel bioinformatically detected regulatory, non protein coding, viral micro RNA (miRNA) gene. The method by which VGAM762 was detected is described hereinabove with reference to FIGS. 1-8.

VGAM762 gene, herein designated VGAM GENE, is a viral gene contained in the genome of Bovine Coronavirus. VGAM762 host target gene, herein designated VGAM HOST TARGET GENE, is a human gene contained in the human genome.

VGAM762 gene encodes a VGAM762 precursor RNA, herein designated VGAM PRECURSOR RNA. Similar to other miRNA genes, and unlike most ordinary genes, VGAM762 precursor RNA does not encode a protein. A nucleotide sequence identical or highly similar to the nucleotide sequence of VGAM762 precursor RNA is designated SEQ ID:748, and is provided hereinbelow with reference to the sequence listing part. Nucleotide sequence SEQ ID:748 is located at position 3576 relative to the genome of Bovine Coronavirus.

VGAM762 precursor RNA folds onto itself, forming VGAM762 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM762 folded precursor RNA into VGAM762 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM762 RNA is designated SEQ ID:3473, and is provided hereinbelow with reference to the sequence listing part.

VGAM762 host target gene, herein designated VGAM HOST TARGET GENE, encodes a corresponding messenger RNA, VGAM762 host target RNA, herein designated VGAM HOST TARGET RNA. VGAM762 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM762 RNA, herein designated VGAM RNA, binds complementarily to one or more host target binding sites located in untranslated regions of VGAM762 host target RNA, herein designated VGAM HOST TARGET RNA. This complementary binding is due to the fact that the nucleotide sequence of VGAM762 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM762 RNA, herein designated VGAM RNA, may have a different number of host target binding sites in untranslated regions of a VGAM762 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM762 RNA, herein designated VGAM RNA, to host target binding sites on VGAM762 host target RNA, herein designated VGAM HOST TARGET RNA, such as BINDING SITE I, BINDING SITE II and BINDING SITE III, inhibits translation of VGAM762 host target RNA into VGAM762 host target protein, herein designated VGAM HOST TARGET PROTEIN. VGAM host target protein is therefore outlined by a broken line.

It is appreciated that VGAM762 host target gene, herein designated VGAM HOST TARGET GENE, in fact represents a plurality of VGAM762 host target genes. The mRNA of each one of this plurality of VGAM762 host target genes comprises one or more host target binding sites, each having a nucleotide sequence which is at least partly complementary to VGAM762 RNA, herein designated VGAM RNA, and which when bound by VGAM762 RNA causes inhibition of translation of respective one or more VGAM762 host target proteins.

It is further appreciated by one skilled in the art that the mode of translational inhibition illustrated by FIG. 1 with specific reference to translational inhibition exerted by VGAM762 gene, herein designated VGAM GENE, on one or more VGAM762 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM762 is inhibition of expression of host target genes, as part of a novel viral mechanism of attacking a host. Accordingly, utilities of VGAM762 include diagnosis, prevention and treatment of viral infection by Bovine Coronavirus. Specific functions, and accordingly utilities, of VGAM762 correlate with, and may be deduced from, the identity of the host target genes which VGAM762 binds and inhibits, and the function of these host target genes, as elaborated hereinbelow.

Nucleotide sequences of the VGAM762 precursor RNA, herein designated VGAM PRECURSOR RNA, and of the 'diced' VGAM762 RNA, herein designated VGAM RNA, and a schematic representation of the secondary folding of VGAM762 folded precursor RNA, herein designated VGAM FOLDED PRECURSOR RNA, of VGAM762 are further described hereinbelow with reference to Table 1.

Nucleotide sequences of host target binding sites, such as BINDING SITE-I, BINDING SITE-II and BINDING SITE-III of FIG. 1, found on VGAM762 host target RNA, and schematic representation of the complementarity of each of these host target binding sites to VGAM762 RNA, herein designated VGAM RNA, are described hereinbelow with reference to Table 2.

As mentioned hereinabove with reference to FIG. 1, a function of VGAM762 gene, herein designated VGAM is inhibition of expression of VGAM762 target genes. It is appreciated that specific functions, and accordingly utilities, of VGAM762 correlate with, and may be deduced from, the identity of the target genes which VGAM762 binds and inhibits, and the function of these target genes, as elaborated hereinbelow.

Apolipoprotein B MRNA Editing Enzyme, Catalytic Polypeptide 1 (APOBEC1, Accession NM_005889) is a VGAM762 host target gene. APOBEC1 BINDING SITE is HOST TARGET binding site found in the 3' untranslated region of mRNA encoded by APOBEC1, corresponding to a HOST TARGET binding site such as BINDING SITE I, BINDING SITE II or BINDING SITE III. Table 2 illustrates the complementarity of the nucleotide sequences of APOBEC1 BINDING SITE, designated SEQ ID:12510, to the nucleotide sequence of VGAM762 RNA, herein designated VGAM RNA, also designated SEQ ID:3473.

A function of VGAM762 is therefore inhibition of Apolipoprotein B MRNA Editing Enzyme, Catalytic Polypeptide 1 (APOBEC1, Accession NM_005889). Accordingly, utilities of VGAM762 include diagnosis, prevention and treatment of diseases and clinical conditions associated with APOBEC1. Chloride Channel 4 (CLCN4, Accession NM_001830) is another VGAM762 host target gene. CLCN4 BINDING SITE is HOST TARGET binding site found in the 3' untranslated region of mRNA encoded by CLCN4, corresponding to a HOST TARGET binding site such as BINDING SITE I, BINDING SITE II or BINDING SITE III. Table 2 illustrates the complementarity of the nucleotide sequences of CLCN4 BINDING SITE, designated SEQ ID:7570, to the nucleotide sequence of VGAM762 RNA, herein designated VGAM RNA, also designated SEQ ID:3473.

Another function of VGAM762 is therefore inhibition of Chloride Channel 4 (CLCN4, Accession NM_001830), a gene which is regulation of cell volume; membrane potential stabilization, signal transduction and transepithelial transport. Accordingly, utilities of VGAM762 include diagnosis, prevention and treatment of diseases and clinical conditions associated with CLCN4. The function of CLCN4 and its association with various diseases and clinical conditions, has been established by previous studies, as described hereinabove with reference to VGAM558. Protocadherin Alpha 1 (PCDHA1, Accession NM_018900) is another VGAM762 host target gene. PCDHA1 BINDING SITE1 and PCDHA1 BINDING SITE2 are HOST TARGET binding sites found in untranslated regions of mRNA encoded by PCDHA1, corresponding to HOST TARGET binding sites such as BINDING SITE I, BINDING SITE II or BINDING SITE III. Table 2 illustrates the complementarity of the nucleotide sequences of PCDHA1 BINDING SITE1 and PCDHA1 BINDING SITE2, designated SEQ ID:20868 and SEQ ID:25387 respectively, to the nucleotide sequence of VGAM762 RNA, herein designated VGAM RNA, also designated SEQ ID:3473.

Another function of VGAM762 is therefore inhibition of Protocadherin Alpha 1 (PCDHA1, Accession NM_018900). Accordingly, utilities of VGAM762 include diagnosis, prevention and treatment of diseases and clinical conditions associated with PCDHA1. Protocadherin Alpha 10 (PCDHA10, Accession NM_031860) is another VGAM762 host target gene. PCDHA10 BINDING SITE1 and PCDHA10 BINDING SITE2 are HOST TARGET binding sites found in untranslated regions of mRNA encoded by PCDHA10, corresponding to HOST TARGET binding sites such as BINDING SITE I, BINDING SITE II or BINDING SITE III. Table 2 illustrates the complementarity of the nucleotide sequences of PCDHA10 BINDING SITE1 and PCDHA10 BINDING SITE2, designated SEQ ID:25619 and SEQ ID:20889 respectively, to the nucleotide sequence of VGAM762 RNA, herein designated VGAM RNA, also designated SEQ ID:3473.

Another function of VGAM762 is therefore inhibition of Protocadherin Alpha 10 (PCDHA10, Accession NM_031860). Accordingly, utilities of VGAM762 include diagnosis, prevention and treatment of diseases and clinical conditions associated with PCDHA10. Protocadherin Alpha 13 (PCDHA13, Accession NM_018904) is another VGAM762 host target gene. PCDHA13 BINDING SITE is HOST TARGET binding site found in the 3' untranslated region of mRNA encoded by PCDHA13, corresponding to a HOST TARGET binding site such as BINDING SITE I, BINDING SITE II or BINDING SITE III. Table 2 illustrates the complementarity of the nucleotide sequences of PCDHA13 BINDING SITE, designated SEQ ID:20909, to the nucleotide sequence of VGAM762 RNA, herein designated VGAM RNA, also designated SEQ ID:3473.

Another function of VGAM762 is therefore inhibition of Protocadherin Alpha 13 (PCDHA13, Accession NM_018904). Accordingly, utilities of VGAM762 include diagnosis, prevention and treatment of diseases and clinical conditions associated with PCDHA13. Protocadherin Alpha 2 (PCDHA2, Accession NM_018905) is another VGAM762 host target gene. PCDHA2 BINDING SITE is HOST TARGET binding site found in the 3' untranslated region of mRNA encoded by PCDHA2, corresponding to a HOST TARGET binding site such as BINDING SITE I, BINDING SITE II or BINDING SITE III. Table 2 illustrates the complementarity of the nucleotide sequences of PCDHA2 BINDING SITE, designated SEQ ID:20919, to the nucleotide sequence of VGAM762 RNA, herein designated VGAM RNA, also designated SEQ ID:3473.

Another function of VGAM762 is therefore inhibition of Protocadherin Alpha 2 (PCDHA2, Accession NM_018905). Accordingly, utilities of VGAM762 include diagnosis, prevention and treatment of diseases and clinical conditions associated with PCDHA2. Protocadherin Alpha 3 (PCDHA3, Accession NM_018906) is another VGAM762 host target gene. PCDHA3 BINDING SITE is HOST TARGET binding site found in the 3' untranslated region of mRNA encoded by PCDHA3, corresponding to a HOST TARGET binding site such as BINDING SITE I, BINDING SITE II or BINDING SITE III. Table 2 illustrates the complementarity of the nucleotide sequences of PCDHA3 BINDING SITE, designated SEQ ID:20929, to the nucleotide sequence of VGAM762

RNA, herein designated VGAM RNA, also designated SEQ ID:3473.

Another function of VGAM762 is therefore inhibition of Protocadherin Alpha 3 (PCDHA3, Accession NM_018906). Accordingly, utilities of VGAM762 include diagnosis, prevention and treatment of diseases and clinical conditions associated with PCDHA3. Protocadherin Alpha 4 (PCDHA4, Accession NM_018907) is another VGAM762 host target gene. PCDHA4 BINDING SITE is HOST TARGET binding site found in the 3' untranslated region of mRNA encoded by PCDHA4, corresponding to a HOST TARGET binding site such as BINDING SITE I, BINDING SITE II or BINDING SITE III. Table 2 illustrates the complementarity of the nucleotide sequences of PCDHA4 BINDING SITE, designated SEQ ID:20939, to the nucleotide sequence of VGAM762 RNA, herein designated VGAM RNA, also designated SEQ ID:3473.

Another function of VGAM762 is therefore inhibition of Protocadherin Alpha 4 (PCDHA4, Accession NM_018907). Accordingly, utilities of VGAM762 include diagnosis, prevention and treatment of diseases and clinical conditions associated with PCDHA4. Protocadherin Alpha 5 (PCDHA5, Accession NM_018908) is another VGAM762 host target gene. PCDHA5 BINDING SITE is HOST TARGET binding site found in the 3' untranslated region of mRNA encoded by PCDHA5, corresponding to a HOST TARGET binding site such as BINDING SITE I, BINDING SITE II or BINDING SITE III. Table 2 illustrates the complementarity of the nucleotide sequences of PCDHA5 BINDING SITE, designated SEQ ID:20949, to the nucleotide sequence of VGAM762 RNA, herein designated VGAM RNA, also designated SEQ ID:3473.

Another function of VGAM762 is therefore inhibition of Protocadherin Alpha 5 (PCDHA5, Accession NM_018908). Accordingly, utilities of VGAM762 include diagnosis, prevention and treatment of diseases and clinical conditions associated with PCDHA5. Protocadherin Alpha 6 (PCDHA6, Accession NM_018909) is another VGAM762 host target gene. PCDHA6 BINDING SITE1 and PCDHA6 BINDING SITE2 are HOST TARGET binding sites found in untranslated regions of mRNA encoded by PCDHA6, corresponding to HOST TARGET binding sites such as BINDING SITE I, BINDING SITE II or BINDING SITE III. Table 2 illustrates the complementarity of the nucleotide sequences of PCDHA6 BINDING SITE1 and PCDHA6 BINDING SITE2, designated SEQ ID:20959 and SEQ ID:25591 respectively, to the nucleotide sequence of VGAM762 RNA, herein designated VGAM RNA, also designated SEQ ID:3473.

Another function of VGAM762 is therefore inhibition of Protocadherin Alpha 6 (PCDHA6, Accession NM_018909). Accordingly, utilities of VGAM762 include diagnosis, prevention and treatment of diseases and clinical conditions associated with PCDHA6. Protocadherin Alpha 8 (PCDHA8, Accession NM_018911) is another VGAM762 host target gene. PCDHA8 BINDING SITE is HOST TARGET binding site found in the 3' untranslated region of mRNA encoded by PCDHA8, corresponding to a HOST TARGET binding site such as BINDING SITE I, BINDING SITE II or BINDING SITE III. Table 2 illustrates the complementarity of the nucleotide sequences of PCDHA8 BINDING SITE, designated SEQ ID:20979, to the nucleotide sequence of VGAM762 RNA, herein designated VGAM RNA, also designated SEQ ID:3473.

Another function of VGAM762 is therefore inhibition of Protocadherin Alpha 8 (PCDHA8, Accession NM_018911). Accordingly, utilities of VGAM762 include diagnosis, prevention and treatment of diseases and clinical conditions associated with PCDHA8. Protocadherin Alpha 9 (PCDHA9, Accession NM_031857) is another VGAM762 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:25605, to the nucleotide sequence of VGAM762 RNA, herein designated VGAM RNA, also designated SEQ ID:3473.

Another function of VGAM762 is therefore inhibition of Protocadherin Alpha 9 (PCDHA9, Accession NM_031857), a gene which is a calcium-dependent cell-adhesion protein. Accordingly, utilities of VGAM762 include diagnosis, prevention and treatment of diseases and clinical conditions associated with PCDHA9. The function of PCDHA9 and its association with various diseases and clinical conditions, has been established by previous studies, as described hereinabove with reference to VGAM71. Protocadherin Alpha Subfamily C, 1 (PCDHAC1, Accession NM_018898) is another VGAM762 host target gene. PCDHAC1 BINDING SITE is HOST TARGET binding site found in the 3' untranslated region of mRNA encoded by PCDHAC1, corresponding to a HOST TARGET binding site such as BINDING SITE I, BINDING SITE II or BINDING SITE III. Table 2 illustrates the complementarity of the nucleotide sequences of PCDHAC1 BINDING SITE, designated SEQ ID:20848, to the nucleotide sequence of VGAM762 RNA, herein designated VGAM RNA, also designated SEQ ID:3473.

Another function of VGAM762 is therefore inhibition of Protocadherin Alpha Subfamily C, 1 (PCDHAC1, Accession NM_018898). Accordingly, utilities of VGAM762 include diagnosis, prevention and treatment of diseases and clinical conditions associated with PCDHAC1. Protocadherin Alpha Subfamily C, 2 (PCDHAC2, Accession NM_018899) is another VGAM762 host target gene. PCDHAC2 BINDING SITE is HOST TARGET binding site found in the 3' untranslated region of mRNA encoded by PCDHAC2, corresponding to a HOST TARGET binding site such as BINDING SITE I, BINDING SITE II or BINDING SITE III. Table 2 illustrates the complementarity of the nucleotide sequences of PCDHAC2 BINDING SITE, designated SEQ ID:20858, to the nucleotide sequence of VGAM762 RNA, herein designated VGAM RNA, also designated SEQ ID:3473.

Another function of VGAM762 is therefore inhibition of Protocadherin Alpha Subfamily C, 2 (PCDHAC2, Accession NM_018899). Accordingly, utilities of VGAM762 include diagnosis, prevention and treatment of diseases and clinical conditions associated with PCDHAC2. Calmodulin Binding Transcription Activator 1 (CAMTA1, Accession XM_042323) is another VGAM762 host target gene. CAMTA1 BINDING SITE is HOST TARGET binding site found in the 3' untranslated region of mRNA encoded by CAMTA1, corresponding to a HOST TARGET binding site such as BINDING SITE I, BINDING SITE II or BINDING SITE III. Table 2 illustrates the complementarity of the nucleotide sequences of CAMTA1 BINDING SITE, designated SEQ ID:33718, to the nucleotide sequence of VGAM762 RNA, herein designated VGAM RNA, also designated SEQ ID:3473.

Another function of VGAM762 is therefore inhibition of Calmodulin Binding Transcription Activator 1 (CAMTA1, Accession XM_042323). Accordingly, utilities of VGAM762 include diagnosis, prevention and treatment of diseases and clinical conditions associated with CAMTA1. FLJ12121 (Accession NM_024978) is another VGAM762 host target gene. FLJ12121 BINDING SITE is HOST TARGET binding site found in the 3' untranslated region of mRNA encoded by FLJ12121, corresponding to a HOST TARGET binding site such as BINDING SITE I, BINDING SITE II or BINDING SITE III. Table 2 illustrates the complementarity of the nucleotide sequences of FLJ12121 BINDING SITE, designated SEQ ID:24537, to the nucleotide sequence of VGAM762 RNA, herein designated VGAM RNA, also designated SEQ ID:3473.

Another function of VGAM762 is therefore inhibition of FLJ12121 (Accession NM_024978). Accordingly, utilities of VGAM762 include diagnosis, prevention and treatment of diseases and clinical conditions associated with FLJ12121. KIAA0329 (Accession NM_014844) is another VGAM762 host target gene. KIAA0329 BINDING SITE is HOST TARGET binding site found in the 3' untranslated region of mRNA encoded by KIAA0329, corresponding to a HOST TARGET binding site such as BINDING SITE I, BINDING SITE II or BINDING SITE III. Table 2 illustrates the complementarity of the nucleotide sequences of KIAA0329 BINDING SITE, designated SEQ ID:16876, to the nucleotide sequence of VGAM762 RNA, herein designated VGAM RNA, also designated SEQ ID:3473.

Another function of VGAM762 is therefore inhibition of KIAA0329 (Accession NM_014844). Accordingly, utilities of VGAM762 include diagnosis, prevention and treatment of diseases and clinical conditions associated with KIAA0329. KIAA0390 (Accession NM_014717) is another VGAM762 host target gene. KIAA0390 BINDING SITE is HOST TARGET binding site found in the 3' untranslated region of mRNA encoded by KIAA0390, corresponding to a HOST TARGET binding site such as BINDING SITE I, BINDING SITE II or BINDING SITE III. Table 2 illustrates the complementarity of the nucleotide sequences of KIAA0390 BINDING SITE, designated SEQ ID:16269, to the nucleotide sequence of VGAM762 RNA, herein designated VGAM RNA, also designated SEQ ID:3473.

Another function of VGAM762 is therefore inhibition of KIAA0390 (Accession NM_014717). Accordingly, utilities of VGAM762 include diagnosis, prevention and treatment of diseases and clinical conditions associated with KIAA0390. KIAA1550 (Accession XM_039393) is another VGAM762 host target gene. KIAA1550 BINDING SITE is HOST TARGET binding site found in the 3' untranslated region of mRNA encoded by KIAA1550, corresponding to a HOST TARGET binding site such as BINDING SITE I, BINDING SITE II or BINDING SITE III. Table 2 illustrates the complementarity of the nucleotide sequences of KIAA1550 BINDING SITE, designated SEQ ID:33071, to the nucleotide sequence of VGAM762 RNA, herein designated VGAM RNA, also designated SEQ ID:3473.

Another function of VGAM762 is therefore inhibition of KIAA1550 (Accession XM_039393). Accordingly, utilities of VGAM762 include diagnosis, prevention and treatment of diseases and clinical conditions associated with KIAA1550. Methyl-CpG Binding Domain Protein 2 (MBD2, Accession NM_015832) is another VGAM762 host target gene. MBD2 BINDING SITE is HOST TARGET binding site found in the 3' untranslated region of mRNA encoded by MBD2, corresponding to a HOST TARGET binding site such as BINDING SITE I, BINDING SITE II or BINDING SITE III. Table 2 illustrates the complementarity of the nucleotide sequences of MBD2 BINDING SITE, designated SEQ ID:17946, to the nucleotide sequence of VGAM762 RNA, herein designated VGAM RNA, also designated SEQ ID:3473.

Another function of VGAM762 is therefore inhibition of Methyl-CpG Binding Domain Protein 2 (MBD2, Accession NM_015832). Accordingly, utilities of VGAM762 include diagnosis, prevention and treatment of diseases and clinical conditions associated with MBD2. Signaling Lymphocytic Activation Molecule (SLAM, Accession NM_003037) is another VGAM762 host target gene. SLAM BINDING SITE is HOST TARGET binding site found in the 3' untranslated region of mRNA encoded by SLAM, corresponding to a HOST TARGET binding site such as BINDING SITE I, BINDING SITE II or BINDING SITE III. Table 2 illustrates the complementarity of the nucleotide sequences of SLAM BINDING SITE, designated SEQ ID:8992, to the nucleotide sequence of VGAM762 RNA, herein designated VGAM RNA, also designated SEQ ID:3473.

Another function of VGAM762 is therefore inhibition of Signaling Lymphocytic Activation Molecule (SLAM, Accession NM_003037). Accordingly, utilities of VGAM762 include diagnosis, prevention and treatment of diseases and clinical conditions associated with SLAM. LOC118851 (Accession XM_061180) is another VGAM762 host target gene. LOC118851 BINDING SITE is HOST TARGET binding site found in the 5' untranslated region of mRNA encoded by LOC118851, corresponding to a HOST TARGET binding site such as BINDING SITE I, BINDING SITE II or BINDING SITE III. Table 2 illustrates the complementarity of the nucleotide sequences of LOC118851 BINDING SITE, designated SEQ ID:37200, to the nucleotide sequence of VGAM762 RNA, herein designated VGAM RNA, also designated SEQ ID:3473.

Another function of VGAM762 is therefore inhibition of LOC118851 (Accession XM_061180). Accordingly, utilities of VGAM762 include diagnosis, prevention and treatment of diseases and clinical conditions associated with LOC118851. LOC146890 (Accession XM_097128) is another VGAM762 host target gene. LOC146890 BINDING SITE is HOST TARGET binding site found in the 5' untranslated region of mRNA encoded by LOC146890, corresponding to a HOST TARGET binding site such as BINDING SITE I, BINDING SITE II or BINDING SITE III. Table 2 illustrates the complementarity of the nucleotide sequences of LOC146890 BINDING SITE, designated SEQ ID:40764, to the nucleotide sequence of VGAM762 RNA, herein designated VGAM RNA, also designated SEQ ID:3473.

Another function of VGAM762 is therefore inhibition of LOC146890 (Accession XM_097128). Accordingly, utilities of VGAM762 include diagnosis, prevention and treatment of diseases and clinical conditions associated with LOC146890. LOC157627 (Accession XM_088347) is another VGAM762 host target gene. LOC157627 BINDING SITE is HOST TARGET binding site found in the 3' untranslated region of mRNA encoded by LOC157627, corresponding to a HOST TARGET binding site such as BINDING SITE I, BINDING SITE II or BINDING SITE III. Table 2 illustrates the complementarity of the nucleotide sequences of LOC157627 BINDING SITE, designated SEQ ID:39621, to the nucleotide sequence of VGAM762 RNA, herein designated VGAM RNA, also designated SEQ ID:3473.

Another function of VGAM762 is therefore inhibition of LOC157627 (Accession XM_088347). Accordingly, utilities of VGAM762 include diagnosis, prevention and treatment of diseases and clinical conditions associated with LOC157627. LOC163682 (Accession XM_099402) is another VGAM762 host target gene. LOC163682 BINDING SITE is HOST TARGET binding site found in the 5' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BIND- ING SITE, designated SEQ ID:42093, to the nucleotide sequence of VGAM762 RNA, herein designated VGAM RNA, also designated SEQ ID:3473.

Another function of VGAM762 is therefore inhibition of LOC163682 (Accession XM_099402). Accordingly, utilities of VGAM762 include diagnosis, prevention and treatment of diseases and clinical conditions associated with LOC163682. FIG. 1 further provides a conceptual description of a novel bioinformatically detected viral gene of the present invention, referred to here as Viral Genomic Address Messenger 763 (VGAM763) viral gene, which modulates expression of respective host target genes thereof, the function and utility of which host target genes is known in the art.

VGAM763 is a novel bioinformatically detected regulatory, non protein coding, viral micro RNA (miRNA) gene. The method by which VGAM763 was detected is described hereinabove with reference to FIGS. 1-8.

VGAM763 gene, herein designated VGAM GENE, is a viral gene contained in the genome of Bovine Coronavirus. VGAM763 host target gene, herein designated VGAM HOST TARGET GENE, is a human gene contained in the human genome.

VGAM763 gene encodes a VGAM763 precursor RNA, herein designated VGAM PRECURSOR RNA. Similar to other miRNA genes, and unlike most ordinary genes, VGAM763 precursor RNA does not encode a protein. A nucleotide sequence identical or highly similar to the nucleotide sequence of VGAM763 precursor RNA is designated SEQ ID:749, and is provided hereinbelow with reference to the sequence listing part. Nucleotide sequence SEQ ID:749 is located at position 18582 relative to the genome of Bovine Coronavirus.

VGAM763 precursor RNA folds onto itself, forming VGAM763 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM763 folded precursor RNA into VGAM763 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM763 RNA is designated SEQ ID:3474, and is provided hereinbelow with reference to the sequence listing part.

VGAM763 host target gene, herein designated VGAM HOST TARGET GENE, encodes a corresponding messenger RNA, VGAM763 host target RNA, herein designated VGAM HOST TARGET RNA. VGAM763 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM763 RNA, herein designated VGAM RNA, binds complementarily to one or more host target binding sites located in untranslated regions of VGAM763 host target RNA, herein designated VGAM HOST TARGET RNA. This complementary binding is due to the fact that the nucleotide sequence of VGAM763 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM763 RNA, herein designated VGAM RNA, may have a different number of host target binding sites in untranslated regions of a VGAM763 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM763 RNA, herein designated VGAM RNA, to host target binding sites on VGAM763 host target RNA, herein designated VGAM HOST TARGET RNA, such as BINDING SITE I, BINDING SITE II and BINDING SITE III, inhibits translation of VGAM763 host target RNA into VGAM763 host target protein, herein designated VGAM HOST TARGET PROTEIN. VGAM host target protein is therefore outlined by a broken line.

It is appreciated that VGAM763 host target gene, herein designated VGAM HOST TARGET GENE, in fact represents a plurality of VGAM763 host target genes. The mRNA of each one of this plurality of VGAM763 host target genes comprises one or more host target binding sites, each having a nucleotide sequence which is at least partly complementary to VGAM763 RNA, herein designated VGAM RNA, and which when bound by VGAM763 RNA causes inhibition of translation of respective one or more VGAM763 host target proteins.

It is further appreciated by one skilled in the art that the mode of translational inhibition illustrated by FIG. 1 with specific reference to translational inhibition exerted by VGAM763 gene, herein designated VGAM GENE, on one or more VGAM763 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM763 is inhibition of expression of host target genes, as part of a novel viral mechanism of attacking a host. Accordingly, utilities of VGAM763 include diagnosis, prevention and treatment of viral infection by Bovine Coronavirus. Specific functions, and accordingly utilities, of VGAM763 correlate with, and may be deduced from, the identity of the host target genes which VGAM763 binds and inhibits, and the function of these host target genes, as elaborated hereinbelow.

Nucleotide sequences of the VGAM763 precursor RNA, herein designated VGAM PRECURSOR RNA, and of the 'diced' VGAM763 RNA, herein designated VGAM RNA, and a schematic representation of the secondary folding of VGAM763 folded precursor RNA, herein designated VGAM FOLDED PRECURSOR RNA, of VGAM763 are further described hereinbelow with reference to Table 1.

Nucleotide sequences of host target binding sites, such as BINDING SITE-I, BINDING SITE-II and BINDING SITE-III of FIG. 1, found on VGAM763 host target RNA, and schematic representation of the complementarity of each of these host target binding sites to VGAM763 RNA, herein designated VGAM RNA, are described hereinbelow with reference to Table 2.

As mentioned hereinabove with reference to FIG. 1, a function of VGAM763 gene, herein designated VGAM is inhibition of expression of VGAM763 target genes. It is appreciated that specific functions, and accordingly utilities, of VGAM763 correlate with, and may be deduced from, the identity of the target genes which VGAM763 binds and inhibits, and the function of these target genes, as elaborated hereinbelow.

MCF.2 Cell Line Derived Transforming Sequence (MCF2, Accession NM_005369) is a VGAM763 host target gene. MCF2 BINDING SITE is HOST TARGET binding site found in the 3' untranslated region of mRNA encoded by MCF2, corresponding to a HOST TARGET binding site such as BINDING SITE I, BINDING SITE II or BINDING SITE III. Table 2 illustrates the complementarity of the nucleotide sequences of MCF2 BINDING SITE, designated SEQ ID:11840, to the nucleotide sequence of VGAM763 RNA, herein designated VGAM RNA, also designated SEQ ID:3474.

A function of VGAM763 is therefore inhibition of MCF.2 Cell Line Derived Transforming Sequence (MCF2, Accession NM_005369), a gene which Cytoplasmic oncoprotein similar to vimentin. Accordingly, utilities of VGAM763 include diagnosis, prevention and treatment of diseases and clinical conditions associated with MCF2. The function of MCF2 has been established by previous studies. MCF2 is the designation of a transforming sequence identified using cotransfection of DNA from a human mammary carcinoma cell line. Noguchi et al. (1987) cloned this sequence and found that it did not cross-hybridize with the known oncogenes tested. By in situ hybridization, Noguchi et al. (1987) localized it to Xq27. This localization was confirmed by hybridization to DNA from a panel of human-rodent somatic cell hybrid lines. By pulsed field gel electrophoresis, Nguyen et al. (1987) found that the MCF2 gene and the F9 gene (OMIM Ref. No. 306900) are separated by a maximum distance of about 270 kb. Furthermore, they located several HTF islands in this region, i.e., CpG-rich, unmethylated sequences, containing several sites for 'rare cutter' enzymes, which are believed to be associated with expressed 'housekeeping' genes. Anson et al. (1988) further narrowed the interval separating MCF2 and F9, locating MCF2 to a region between 29 and 61 kb 3-prime to F9. In 2 unrelated hemophilia B (OMIM Ref. No. 306900) patients who raised antibodies to infused factor IX, they found deletions in excess of 273 kb encompassing the F9 and MCF2 genes and a CG-rich island. This appears to have been the first reported nullisomic deletion of a transforming gene. No clinical condition could be attributed to the loss of the MCF2 gene. The CG-rich island may be a marker for an as yet undefined gene lying just 5-prime or just 3-prime off the island. Nguyen et al. (1989) concluded from pulsed field gel electrophoresis studies of the Xq27 region that MCF2 is located telomeric to F9. Grant et al. (1990) demonstrated that Mcf-2 in the mouse lies in the same order as the corresponding gene on the human X chromosome: Hprt--Cf-9--Mcf-2--G6pd. In situ hybridization indicated that the gene lies in the same region as Cf-9 and linkage studies in interspecific mouse backcross populations demonstrated that the Cf-9 and Mcf-2 genes were separated by about 0.5 cM. A comparison of the restriction maps of the DBL and MCF2 oncogenes, together with their chromosomal localization, indicates that they represent the same genetic locus. The DBL oncogene was initially detected as a transforming gene from a human diffuse B-cell lymphoma and was isolated as a 45-kb transforming human DNA sequence by cosmid cloning (Eva and Aaronson, 1985). By molecular hybridization, DBL lacks detectable homology with a large number of cellular or retroviral oncogenes, including members of the tyrosine kinase family. Srivastava et al. (1986) demonstrated that antiserum from mice bearing tumors induced by this oncogene specifically detected a protein of about 66 kD in DBL transformants. Using DBL cDNA, they isolated mRNA from a transfectant clone and found that it directed the in vitro synthesis of this protein. Subcellular localization studies showed that the protein, also known as p66, is a cytoplasmic protein distributed between cytosol and crude membrane fractions. They showed, furthermore, that p66 is a phosphoprotein, with phosphorylation specific to serine residues. Ron et al. (1988) showed that overexpression of DBL is sufficient to transform NIH 3T3 cells. Ron et al. (1988) cloned and characterized the DBL oncogene. The DBL oncogene was generated by rearrangements involving 3 discontinuous regions of the human genome. By analysis of DNA from human/rodent somatic cell hybrids, Tronick et al. (1989) demonstrated that the DBL gene located on the X chromosome underwent recombination at its 5-prime and 3-prime ends with sequences derived from chromosomes 3 (pter-p21) and 16 (p13-q22), respectively. By in situ hybridization, Tronick et al. (1989) located the DBL gene more precisely to Xq27. Oncogenic activation of the MCF2 gene occurs through substitution of part of its 5-prime coding region by unrelated nonsyntenic sequences. Galland et al. (1992) demonstrated that the upstream replacing sequence, referred to as URS, represents the farthest 5-prime portion of the locus and that it is derived from the D15S93 locus on human chromosome 15q15-q23.

Full details of the abovementioned studies are described in the following publications, the disclosure of which are hereby incorporated by reference:

Grant, S. G.; Mattei, M.-G.; Galland, F.; Stephenson, D. A.; Keitz, B. T.; Birnbaum, D.; Chapman, V. M.: Localization of the mouse Mcf-2 (Dbl) proto-oncogene within a conserved linkage group on the mouse X chromosome. Cytogenet. Cell Genet. 54: 175-181, 1990; and Anson, D. S.; Blake, D. J.; Winship, P. R.; Birnbaum, D.; Brownlee, G. G.: Nullisomic deletion of the mcf.2 transforming gene in two haemophilia B patients. EMBO J. 7:2795-2799, 1988.

Further studies establishing the function and utilities of MCF2 are found in John Hopkins OMIM database record ID 311030, and in sited publications numbered 1139 and 8618-8626 listed in the bibliography section hereinbelow, which are also hereby incorporated by reference. KIAA0293 (Accession XM_027045) is another VGAM763 host target gene. KIAA0293 BINDING SITE is HOST TARGET binding site found in the 3' untranslated region of mRNA encoded by KIAA0293, corresponding to a HOST TARGET binding site such as BINDING SITE I, BINDING SITE II or BINDING SITE III. Table 2 illustrates the complementarity of the nucleotide sequences of KIAA0293 BINDING SITE, designated SEQ ID:30392, to the nucleotide sequence of VGAM763 RNA, herein designated VGAM RNA, also designated SEQ ID:3474.

Another function of VGAM763 is therefore inhibition of KIAA0293 (Accession XM_027045). Accordingly, utilities of VGAM763 include diagnosis, prevention and treatment of diseases and clinical conditions associated with KIAA0293. LOC91664 (Accession XM_039908) is another VGAM763 host target gene. LOC91664 BINDING SITE is HOST TARGET binding site found in the 3' untranslated region of mRNA encoded by LOC91664, corresponding to a HOST TARGET binding site such as BINDING SITE I, BINDING SITE II or BINDING SITE III. Table 2 illustrates the complementarity of the nucleotide sequences of LOC91664 BINDING SITE, designated SEQ ID:33211, to the nucleotide sequence of VGAM763 RNA, herein designated VGAM RNA, also designated SEQ ID:3474.

Another function of VGAM763 is therefore inhibition of LOC91664 (Accession XM_039908). Accordingly, utilities of VGAM763 include diagnosis, prevention and treatment of diseases and clinical conditions associated with LOC91664. FIG. 1 further provides a conceptual description of a novel bioinformatically detected viral gene of the present invention, referred to here as Viral Genomic Address Messenger 764 (VGAM764) viral gene, which modulates expression of respective host target genes thereof, the function and utility of which host target genes is known in the art.

VGAM764 is a novel bioinformatically detected regulatory, non protein coding, viral micro RNA (miRNA) gene. The method by which VGAM764 was detected is described hereinabove with reference to FIGS. 1-8.

VGAM764 gene, herein designated VGAM GENE, is a viral gene contained in the genome of Bovine Coronavirus. VGAM764 host target gene, herein designated VGAM HOST TARGET GENE, is a human gene contained in the human genome.

VGAM764 gene encodes a VGAM764 precursor RNA, herein designated VGAM PRECURSOR RNA. Similar to other miRNA genes, and unlike most ordinary genes, VGAM764 precursor RNA does not encode a protein. A nucleotide sequence identical or highly similar to the nucleotide sequence of VGAM764 precursor RNA is designated SEQ ID:750, and is provided hereinbelow with reference to the sequence listing part. Nucleotide sequence SEQ ID:750 is located at position 11280 relative to the genome of Bovine Coronavirus.

VGAM764 precursor RNA folds onto itself, forming VGAM764 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM764 folded precursor RNA into VGAM764 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM764 RNA is designated SEQ ID:3475, and is provided hereinbelow with reference to the sequence listing part.

VGAM764 host target gene, herein designated VGAM HOST TARGET GENE, encodes a corresponding messenger RNA, VGAM764 host target RNA, herein designated VGAM HOST TARGET RNA. VGAM764 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM764 RNA, herein designated VGAM RNA, binds complementarily to one or more host target binding sites located in untranslated regions of VGAM764 host target RNA, herein designated VGAM HOST TARGET RNA. This complementary binding is due to the fact that the nucleotide sequence of VGAM764 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM764 RNA, herein designated VGAM RNA, may have a different number of host target binding sites in untranslated regions of a VGAM764 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM764 RNA, herein designated VGAM RNA, to host target binding sites on VGAM764 host target RNA, herein designated VGAM HOST TARGET RNA, such as BINDING SITE I, BINDING SITE II and BINDING SITE III, inhibits translation of VGAM764 host target RNA into VGAM764 host target protein, herein designated VGAM HOST TARGET PROTEIN. VGAM host target protein is therefore outlined by a broken line.

It is appreciated that VGAM764 host target gene, herein designated VGAM HOST TARGET GENE, in fact represents a plurality of VGAM764 host target genes. The mRNA of each one of this plurality of VGAM764 host target genes comprises one or more host target binding sites, each having a nucleotide sequence which is at least partly complementary to VGAM764 RNA, herein designated VGAM RNA, and which when bound by VGAM764 RNA causes inhibition of translation of respective one or more VGAM764 host target proteins.

It is further appreciated by one skilled in the art that the mode of translational inhibition illustrated by FIG. 1 with specific reference to translational inhibition exerted by VGAM764 gene, herein designated VGAM GENE, on one or more VGAM764 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM764 is inhibition of expression of host target genes, as part of a novel viral mechanism of attacking a host. Accordingly, utilities of VGAM764 include diagnosis, prevention and treatment of viral infection by Bovine Coronavirus. Specific functions, and accordingly utilities, of VGAM764 correlate with, and may be deduced from, the identity of the host target genes which VGAM764 binds and inhibits, and the function of these host target genes, as elaborated hereinbelow.

Nucleotide sequences of the VGAM764 precursor RNA, herein designated VGAM PRECURSOR RNA, and of the 'diced' VGAM764 RNA, herein designated VGAM RNA, and a schematic representation of the secondary folding of VGAM764 folded precursor RNA, herein designated VGAM FOLDED PRECURSOR RNA, of VGAM764 are further described hereinbelow with reference to Table 1.

Nucleotide sequences of host target binding sites, such as BINDING SITE-I, BINDING SITE-II and BINDING SITE-III of FIG. 1, found on VGAM764 host target RNA, and schematic representation of the complementarity of each of these host target binding sites to VGAM764 RNA, herein designated VGAM RNA, are described hereinbelow with reference to Table 2.

As mentioned hereinabove with reference to FIG. 1, a function of VGAM764 gene, herein designated VGAM is inhibition of expression of VGAM764 target genes. It is appreciated that specific functions, and accordingly utilities, of VGAM764 correlate with, and may be deduced from, the identity of the target genes which VGAM764 binds and inhibits, and the function of these target genes, as elaborated hereinbelow.

Chromosome 21 Open Reading Frame 25 (C21orf25, Accession XM_032945) is a VGAM764 host target gene. C21orf25 BINDING SITE is HOST TARGET binding site found in the 3' untranslated region of mRNA encoded by C21orf25, corresponding to a HOST TARGET binding site such as BINDING SITE I, BINDING SITE II or BINDING SITE III. Table 2 illustrates the complementarity of the nucleotide sequences of C21orf25 BINDING SITE, designated SEQ ID:31794, to the nucleotide sequence of VGAM764 RNA, herein designated VGAM RNA, also designated SEQ ID:3475.

A function of VGAM764 is therefore inhibition of Chromosome 21 Open Reading Frame 25 (C21orf25, Accession XM_032945). Accordingly, utilities of VGAM764 include diagnosis, prevention and treatment of diseases and clinical conditions associated with C21orf25. FIG. 1 further provides a conceptual description of a novel bioinformatically detected viral gene of the present invention, referred to here as Viral Genomic Address Messenger 765 (VGAM765) viral gene, which modulates expression of respective host target genes thereof, the function and utility of which host target genes is known in the art.

VGAM765 is a novel bioinformatically detected regulatory, non protein coding, viral micro RNA (miRNA) gene. The method by which VGAM765 was detected is described hereinabove with reference to FIGS. 1-8.

VGAM765 gene, herein designated VGAM GENE, is a viral gene contained in the genome of Bovine Coronavirus. VGAM765 host target gene, herein designated VGAM HOST TARGET GENE, is a human gene contained in the human genome.

VGAM765 gene encodes a VGAM765 precursor RNA, herein designated VGAM PRECURSOR RNA. Similar to other miRNA genes, and unlike most ordinary genes, VGAM765 precursor RNA does not encode a protein. A nucleotide sequence identical or highly similar to the nucleotide sequence of VGAM765 precursor RNA is designated SEQ ID:751, and is provided hereinbelow with reference to the sequence listing part. Nucleotide sequence SEQ ID:751 is located at position 8100 relative to the genome of Bovine Coronavirus.

VGAM765 precursor RNA folds onto itself, forming VGAM765 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM765 folded precursor RNA into VGAM765 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM765 RNA is designated SEQ ID:3476, and is provided hereinbelow with reference to the sequence listing part.

VGAM765 host target gene, herein designated VGAM HOST TARGET GENE, encodes a corresponding messenger RNA, VGAM765 host target RNA, herein designated VGAM HOST TARGET RNA. VGAM765 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM765 RNA, herein designated VGAM RNA, binds complementarily to one or more host target binding sites located in untranslated regions of VGAM765 host target RNA, herein designated VGAM HOST TARGET RNA. This complementary binding is due to the fact that the nucleotide sequence of VGAM765 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM765 RNA, herein designated VGAM RNA, may have a different number of host target binding sites in untranslated regions of a VGAM765 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM765 RNA, herein designated VGAM RNA, to host target binding sites on VGAM765 host target RNA, herein designated VGAM HOST TARGET RNA, such as BINDING SITE I, BINDING SITE II and BINDING SITE III, inhibits translation of VGAM765 host target RNA into VGAM765 host target protein, herein designated VGAM HOST TARGET PROTEIN. VGAM host target protein is therefore outlined by a broken line.

It is appreciated that VGAM765 host target gene, herein designated VGAM HOST TARGET GENE, in fact represents a plurality of VGAM765 host target genes. The mRNA of each one of this plurality of VGAM765 host target genes comprises one or more host target binding sites, each having a nucleotide sequence which is at least partly complementary to VGAM765 RNA, herein designated VGAM RNA, and which when bound by VGAM765 RNA causes inhibition of translation of respective one or more VGAM765 host target proteins.

It is further appreciated by one skilled in the art that the mode of translational inhibition illustrated by FIG. 1 with specific reference to translational inhibition exerted by VGAM765 gene, herein designated VGAM GENE, on one or more VGAM765 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM765 is inhibition of expression of host target genes, as part of a novel viral mechanism of attacking a host. Accordingly, utilities of VGAM765 include diagnosis, prevention and treatment of viral infection by Bovine Coronavirus. Specific functions, and accordingly utilities, of VGAM765 correlate with, and may be deduced from, the identity of the host target genes which VGAM765 binds and inhibits, and the function of these host target genes, as elaborated hereinbelow.

Nucleotide sequences of the VGAM765 precursor RNA, herein designated VGAM PRECURSOR RNA, and of the 'diced' VGAM765 RNA, herein designated VGAM RNA, and a schematic representation of the secondary folding of VGAM765 folded precursor RNA, herein designated VGAM FOLDED PRECURSOR RNA, of VGAM765 are further described hereinbelow with reference to Table 1.

Nucleotide sequences of host target binding sites, such as BINDING SITE-I, BINDING SITE-II and BINDING SITE-III of FIG. 1, found on VGAM765 host target RNA, and schematic representation of the complementarity of each of these host target binding sites to VGAM765 RNA, herein designated VGAM RNA, are described hereinbelow with reference to Table 2.

As mentioned hereinabove with reference to FIG. 1, a function of VGAM765 gene, herein designated VGAM is inhibition of expression of VGAM765 target genes. It is appreciated that specific functions, and accordingly utilities, of VGAM765 correlate with, and may be deduced from, the identity of the target genes which VGAM765 binds and inhibits, and the function of these target genes, as elaborated hereinbelow.

Potassium Inwardly-rectifying Channel, Subfamily J, Member 16 (KCNJ16, Accession NM_018658) is a VGAM765 host target gene. KCNJ16 BINDING SITE is HOST TARGET binding site found in the 3' untranslated region of mRNA encoded by KCNJ16, corresponding to a HOST TARGET binding site such as BINDING SITE I, BINDING SITE II or BINDING SITE III. Table 2 illustrates the complementarity of the nucleotide sequences of KCNJ16 BINDING SITE, designated SEQ ID:20727, to the nucleotide sequence of VGAM765 RNA, herein designated VGAM RNA, also designated SEQ ID:3476.

A function of VGAM765 is therefore inhibition of Potassium Inwardly-rectifying Channel, Subfamily J, Member 16 (KCNJ16, Accession NM_018658). Accordingly, utilities of VGAM765 include diagnosis, prevention and treatment of diseases and clinical conditions associated with KCNJ16. CG005 (Accession NM_014887) is another VGAM765 host target gene. CG005 BINDING SITE is HOST TARGET binding site found in the 3' untranslated region of mRNA encoded by CG005, corresponding to a HOST TARGET binding site such as BINDING SITE I, BINDING SITE II or BINDING SITE III. Table 2 illustrates the complementarity of the nucleotide sequences of CG005 BINDING SITE, designated SEQ ID:17038, to the nucleotide sequence of VGAM765 RNA, herein designated VGAM RNA, also designated SEQ ID:3476.

Another function of VGAM765 is therefore inhibition of CG005 (Accession NM_014887). Accordingly, utilities of VGAM765 include diagnosis, prevention and treatment of diseases and clinical conditions associated with CG005. LOC219401 (Accession XM_166706) is another VGAM765 host target gene. LOC219401 BINDING SITE is HOST TARGET binding site found in the 3' untranslated region of mRNA encoded by LOC219401, corresponding to a HOST TARGET binding site such as BINDING SITE I, BINDING SITE II or BINDING SITE III. Table 2 illustrates the complementarity of the nucleotide sequences of LOC219401 BINDING SITE, designated SEQ ID:44584, to the nucleotide sequence of VGAM765 RNA, herein designated VGAM RNA, also designated SEQ ID:3476.

Another function of VGAM765 is therefore inhibition of LOC219401 (Accession XM_166706). Accordingly, utilities of VGAM765 include diagnosis, prevention and treatment of diseases and clinical conditions associated with LOC219401. LOC90462 (Accession XM_031852) is another VGAM765 host target gene. LOC90462 BINDING SITE is HOST TARGET binding site found in the 3' untranslated region of mRNA encoded by LOC90462, corresponding to a HOST TARGET binding site such as BINDING SITE I, BINDING SITE II or BINDING SITE III. Table 2 illustrates the complementarity of the nucleotide sequences of LOC90462 BINDING SITE, designated SEQ ID:31503, to the nucleotide sequence of VGAM765 RNA, herein designated VGAM RNA, also designated SEQ ID:3476.

Another function of VGAM765 is therefore inhibition of LOC90462 (Accession XM_031852). Accordingly, utilities of VGAM765 include diagnosis, prevention and treatment of diseases and clinical conditions associated with LOC90462. FIG. 1 further provides a conceptual description of a novel bioinformatically detected viral gene of the present invention, referred to here as Viral Genomic Address Messenger 766 (VGAM766) viral gene, which modulates expression of respective host target genes thereof, the function and utility of which host target genes is known in the art.

VGAM766 is a novel bioinformatically detected regulatory, non protein coding, viral micro RNA (miRNA) gene. The method by which VGAM766 was detected is described hereinabove with reference to FIGS. 1-8.

VGAM766 gene, herein designated VGAM GENE, is a viral gene contained in the genome of Bovine Coronavirus. VGAM766 host target gene, herein designated VGAM HOST TARGET GENE, is a human gene contained in the human genome.

VGAM766 gene encodes a VGAM766 precursor RNA, herein designated VGAM PRECURSOR RNA. Similar to other miRNA genes, and unlike most ordinary genes, VGAM766 precursor RNA does not encode a protein. A nucleotide sequence identical or highly similar to the nucleotide sequence of VGAM766 precursor RNA is designated SEQ ID:752, and is provided hereinbelow with reference to the sequence listing part. Nucleotide sequence SEQ ID:752 is located at position 8663 relative to the genome of Bovine Coronavirus.

VGAM766 precursor RNA folds onto itself, forming VGAM766 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM766 folded precursor RNA into VGAM766 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM766 RNA is designated SEQ ID:3477, and is provided hereinbelow with reference to the sequence listing part.

VGAM766 host target gene, herein designated VGAM HOST TARGET GENE, encodes a corresponding messenger RNA, VGAM766 host target RNA, herein designated VGAM HOST TARGET RNA. VGAM766 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM766 RNA, herein designated VGAM RNA, binds complementarily to one or more host target binding sites located in untranslated regions of VGAM766 host target RNA, herein designated VGAM HOST TARGET RNA. This complementary binding is due to the fact that the nucleotide sequence of VGAM766 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM766 RNA, herein designated VGAM RNA, may have a different number of host target binding sites in untranslated regions of a VGAM766 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM766 RNA, herein designated VGAM RNA, to host target binding sites on VGAM766 host target RNA, herein designated VGAM HOST TARGET RNA, such as BINDING SITE I, BINDING SITE II and BINDING SITE III, inhibits translation of VGAM766 host target RNA into VGAM766 host target protein, herein designated VGAM HOST TARGET PROTEIN. VGAM host target protein is therefore outlined by a broken line.

It is appreciated that VGAM766 host target gene, herein designated VGAM HOST TARGET GENE, in fact represents a plurality of VGAM766 host target genes. The mRNA of each one of this plurality of VGAM766 host target genes comprises one or more host target binding sites, each having a nucleotide sequence which is at least partly complementary to VGAM766 RNA, herein designated VGAM RNA, and which when bound by VGAM766 RNA causes inhibition of translation of respective one or more VGAM766 host target proteins.

It is further appreciated by one skilled in the art that the mode of translational inhibition illustrated by FIG. 1 with specific reference to translational inhibition exerted by VGAM766 gene, herein designated VGAM GENE, on one or more VGAM766 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM766 is inhibition of expression of host target genes, as part of a novel viral mechanism of attacking a host. Accordingly, utilities of VGAM766 include diagnosis, prevention and treatment of viral infection by Bovine Coronavirus. Specific functions, and accordingly utilities, of VGAM766 correlate with, and may be deduced from, the identity of the host target genes which VGAM766 binds and inhibits, and the function of these host target genes, as elaborated hereinbelow.

Nucleotide sequences of the VGAM766 precursor RNA, herein designated VGAM PRECURSOR RNA, and of the 'diced' VGAM766 RNA, herein designated VGAM RNA, and a schematic representation of the secondary folding of VGAM766 folded precursor RNA, herein designated VGAM FOLDED PRECURSOR RNA, of VGAM766 are further described hereinbelow with reference to Table 1.

Nucleotide sequences of host target binding sites, such as BINDING SITE-I, BINDING SITE-II and BINDING SITE-III of FIG. 1, found on VGAM766 host target RNA, and schematic representation of the complementarity of each of these host target binding sites to VGAM766 RNA, herein designated VGAM RNA, are described hereinbelow with reference to Table 2.

As mentioned hereinabove with reference to FIG. 1, a function of VGAM766 gene, herein designated VGAM is inhibition of expression of VGAM766 target genes. It is appreciated that specific functions, and accordingly utilities, of VGAM766 correlate with, and may be deduced from, the identity of the target genes which VGAM766 binds and inhibits, and the function of these target genes, as elaborated hereinbelow.

Adenylate Kinase 1 (AK1, Accession NM_000476) is a VGAM766 host target gene. AK1 BINDING SITE is HOST TARGET binding site found in the 3' untranslated region of mRNA encoded by AK1, corresponding to a HOST TARGET binding site such as BINDING SITE I, BINDING SITE II or BINDING SITE III. Table 2 illustrates the complementarity of the nucleotide sequences of AK1 BINDING SITE, designated SEQ ID:6087, to the nucleotide sequence of VGAM766 RNA, herein designated VGAM RNA, also designated SEQ ID:3477.

A function of VGAM766 is therefore inhibition of Adenylate Kinase 1 (AK1, Accession NM_000476). Accordingly, utilities of VGAM766 include diagnosis, prevention and treatment of diseases and clinical conditions associated with AK1. DMC1 Dosage Suppressor of Mck1 Homolog, Meiosis-specific Homologous Recombination (yeast) (DMC1, Accession NM_007068) is another VGAM766 host target gene. DMC1 BINDING SITE is HOST TARGET binding site found in the 3' untranslated region of mRNA encoded by DMC1, corresponding to a HOST TARGET binding site such as BINDING SITE I, BINDING SITE II or BINDING SITE III. Table 2 illustrates the complementarity of the nucleotide sequences of DMC1 BINDING SITE, designated SEQ ID:13933, to the nucleotide sequence of VGAM766 RNA, herein designated VGAM RNA, also designated SEQ ID:3477.

Another function of VGAM766 is therefore inhibition of DMC1 Dosage Suppressor of Mck1 Homolog, Meiosis-specific Homologous Recombination (yeast) (DMC1, Accession NM_007068). Accordingly, utilities of VGAM766 include diagnosis, prevention and treatment of diseases and clinical conditions associated with DMC1. DXYS155E (Accession NM_005088) is another VGAM766 host target gene. DXYS155E BINDING SITE is HOST TARGET binding site found in the 3' untranslated region of mRNA encoded by DXYS155E, corresponding to a HOST TARGET binding site such as BINDING SITE I, BINDING SITE II or BINDING SITE III. Table 2 illustrates the complementarity of the nucleotide sequences of DXYS155E BINDING SITE, designated SEQ ID:11540, to the nucleotide sequence of VGAM766 RNA, herein designated VGAM RNA, also designated SEQ ID:3477.

Another function of VGAM766 is therefore inhibition of DXYS155E (Accession NM_005088), a gene which may be involved in b-cell activation. may also be involved in signal transduction and gene regulation. Accordingly, utilities of VGAM766 include diagnosis, prevention and treatment of diseases and clinical conditions associated with DXYS155E. The function of DXYS155E has been established by previous studies. In the 2.6-megabase segment of the distal short arms of the X and Y chromosomes, called the pseudoautosomal region, Ellison et al. (1992) identified an expressed gene designated XE7. (See also 465000.) They reported the structure of the XE7 gene and its expression in various human tissues. The analysis of genomic and cDNA clones showed that alternative RNA splicing results in the production of 2 protein isoforms, one containing 385 amino acids and the other containing 695 residues. The smaller polypeptide is a truncated version of the larger and results from the inclusion of a cassette exon that has an in-frame stop codon. The XE7 gene appears to be ubiquitously expressed, and the production of both protein isoforms was predicted in each of the several tissues examined.

Full details of the abovementioned studies are described in the following publications, the disclosure of which are hereby incorporated by reference:

Ellison, J.; Passage, M.; Yu, L.-C.; Yen, P.; Mohandas, T. K.; Shapiro, L.: Directed isolation of human genes that escape X inactivation. Somat. Cell Molec. Genet. 18:259-268, 1992; and Ellison, J. W.; Ramos, C.; Yen, P. H.; Shapiro, L. J.: Structure and expression of the human pseudoautosomal gene XE7. Hum. Molec. Genet. 1:691-696, 1992.

Further studies establishing the function and utilities of DXYS155E are found in John Hopkins OMIM database record ID 312095, and in sited publications numbered 2916-2917 listed in the bibliography section hereinbelow, which are also hereby incorporated by reference. Fibronectin Leucine Rich Transmembrane Protein 2 (FLRT2, Accession NM_013231) is another VGAM766 host target gene. FLRT2 BINDING SITE is HOST TARGET binding site found in the 5' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14875, to the nucleotide sequence of VGAM766 RNA, herein designated VGAM RNA, also designated SEQ ID:3477.

Another function of VGAM766 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM766 include diagnosis, prevention and treatment of diseases and clinical conditions associated with FLRT2. The function of FLRT2 and its association with various diseases and clinical conditions, has been established by previous studies, as described hereinabove with reference to VGAM247. Histamine Receptor H1 (HRH1, Accession NM_000861) is another VGAM766 host target gene. HRH1 BINDING SITE is HOST TARGET binding site found in the 3' untranslated region of mRNA encoded by HRH1, corresponding to a HOST TARGET binding site such as BINDING SITE I, BINDING SITE II or BINDING SITE III. Table 2 illustrates the complementarity of the nucleotide sequences of HRH1 BINDING SITE, designated SEQ ID:6525, to the nucleotide sequence of VGAM766 RNA, herein designated VGAM RNA, also designated SEQ ID:3477.

Another function of VGAM766 is therefore inhibition of Histamine Receptor H1 (HRH1, Accession NM_000861), a gene which stimulates the synthesis of inositol phosphate. Accordingly, utilities of VGAM766 include diagnosis, prevention and treatment of diseases and clinical conditions associated with HRH1. The function of HRH1 has been established by previous studies. Histamine is a ubiquitous messenger molecule released from mast cells, enterochromaffin-like cells, and neurons. Its various actions are mediated by 3 pharmacologically defined receptors termed the H1, H2 (OMIM Ref. No. 142703), and H3 (OMIM Ref. No. 604525) receptors. The H1 receptor was the first member of this family to be pharmacologically defined with the design of selective antagonists, the 'antihistamines,' which are used to treat allergic and inflammatory reactions. The H1 receptor is expressed by various peripheral tissues, such as smooth muscle, and by neurons in the brain, where histamine may be involved in the control of wakefulness, mood, and hormone secretion. Yamashita et al. (1991) cloned a bovine H1 receptor cDNA and established its nucleotide sequence. Its homology with the corresponding sequence of other receptors confirmed that it belongs to the superfamily of receptors coupled with G proteins with 7 putative transmembrane domains. In addition to their expression in neuronal, gastric, and muscular tissue, the G protein-coupled receptors HRH1 and HRH2 are also expressed on T-helper lymphocytes and trigger different intracellular events upon activation. Using flow cytometric analysis, Jutel et al. (2001) demonstrated that histamine binds more strongly to Th1 than to Th2 cells. Flow cytometry and RT-PCR analysis showed that HRH1 is predominantly expressed on Th1 cells in an IL3 (OMIM Ref. No. 147740)-upregulatable manner, while HRH2 is predominant on Th2 cells. Stimulation of naive, CD45RA+ (see OMIM Ref. No. 151460) T cells with IL12 (OMIM Ref. No. 161560) resulted in preferential expression of HRH1, but stimulation with IL4 (OMIM Ref. No. 147780) resulted in suppressed expression of HRH1, demonstrating that mature CD45RO+ Th1 and Th2 lymphocytes preferentially but not exclusively express HRH1 and HRH2, and that HRH1 and HRH2 are regulated by cytokines present in the immune environment. Histamine stimulation of Th1 cells resulted in significant calcium flux that could be blocked by an HRH1 antagonist, while stimulation of Th2 cells led to cAMP formation that could be blocked by an HRH2, but not an HRH1, antagonist. Furthermore, histamine enhanced Th1 but inhibited Th2 responses to anti-CD3. Histamine also enhanced peripheral blood mononuclear cell responses in sensitized individuals to a predominantly Th1 antigen, but suppressed responses to Th2 allergens. Animal model experiments lend further support to the function of HRH1. Ma et al. (2002) noted that pertussis toxin (PTX) elicits a range of responses in mice, including sensitization to vasoactive amines (VAAS) and increased vascular permeability subsequent to PTX-induced changes in vascular endothelial cells. Susceptible mouse strains die from hypotensive and hypovolemic shock on vasoactive amine challenge, whereas resistant strains do not. This hypersensitivity is controlled by an autosomal dominant locus, designated Bphs, localized to mouse chromosome 6. Using positional cloning, Ma et al. (2002) linked the Bphs locus to Hrh1. Mice lacking Hrh1 were protected from VAAS hypersensitivity, as well as from experimental allergic encephalomyelitis and experimental autoimmune orchitis. Sequence analysis showed that leu263-to-pro (L263P), met313-to-val (M313V), and ser331-to-pro (S331P) polymorphisms were associated with resistance to vasoactive amine challenge. The authors concluded that these Hrh1 alleles control both the autoimmune T-cell and vascular responses regulated by histamine after PTX sensitization.

It is appreciated that the abovementioned animal model for HRH1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Jutel, M.; Watanabe, T.; Klunker, S.; Akdis, M.; Thomet, O. A. R.; Malolepszy, J.; Zak-Nejmark, T.; Koga, R.; Kobayashi, T.; Blaser, K.; Akdis, C. A.: Histamine regulates T-cell and antibody responses by differential expression of H1 and H2 receptors. Nature 413:420-425, 2001; and Ma, R. Z.; Gao, J.; Meeker, N. D.; Fillmore, P. D.; Tung, K. S. K.; Watanabe, T.; Zachary, J. F.; Offner, H.; Blankenhorn, E. P.; Teuscher, C.: Identification of Bphs, an autoimmune di.

Further studies establishing the function and utilities of HRH1 are found in John Hopkins OMIM database record ID 600167, and in sited publications numbered 790 and 7906-7908 listed in the bibliography section hereinbelow, which are also hereby incorporated by reference. Hormonally Upregulated Neu-associated Kinase (HUNK, Accession NM_014586) is another VGAM766 host target gene. HUNK BINDING SITE is HOST TARGET binding site found in the 3' untranslated region of mRNA encoded by HUNK, corresponding to a HOST TARGET binding site such as BINDING SITE I, BINDING SITE II or BINDING SITE III. Table 2 illustrates the complementarity of the nucleotide sequences of HUNK BINDING SITE, designated SEQ ID:15950, to the nucleotide sequence of VGAM766 RNA, herein designated VGAM RNA, also designated SEQ ID:3477.

Another function of VGAM766 is therefore inhibition of Hormonally Upregulated Neu-associated Kinase (HUNK, Accession NM_014586). Accordingly, utilities of VGAM766 include diagnosis, prevention and treatment of diseases and clinical conditions associated with HUNK. Potassium Inwardly-rectifying Channel, Subfamily J, Member 5 (KCNJ5, Accession NM_000890) is another VGAM766 host target gene. KCNJ5 BINDING SITE is HOST TARGET binding site found in the 3' untranslated region of mRNA encoded by KCNJ5, corresponding to a HOST TARGET binding site such as BINDING SITE I, BINDING SITE II or BINDING SITE III. Table 2 illustrates the complementarity of the nucleotide sequences of KCNJ5 BINDING SITE, designated SEQ ID:6588, to the nucleotide sequence of VGAM766 RNA, herein designated VGAM RNA, also designated SEQ ID:3477.

Another function of VGAM766 is therefore inhibition of Potassium Inwardly-rectifying Channel, Subfamily J, Member 5 (KCNJ5, Accession NM_000890), a gene which is a potassium inwardly-rectifying channel. Accordingly, utilities of VGAM766 include diagnosis, prevention and treatment of diseases and clinical conditions associated with KCNJ5. The function of KCNJ5 has been established by previous studies. Potassium channels inhibited by cytosolic ATP are found in a wide variety of tissues. Tucker et al. (1995) noted that in the pancreatic beta-cell, potassium channels play a critical role in the regulation of insulin secretion, and in smooth muscle they are responsible for hypoxic vasodilatation. Moreover, these channels are the targets for several important classes of therapeutic drugs, including the antidiabetic sulfonamides and the antihypertensive potassium channel openers. In the heart, as in other tissues, K(ATP) channels are thought to couple the membrane potential to the metabolic status of the cell, and these normally quiescent channels are activated during transient ischemic and hypoxic periods when they contribute to shortening of the cardiac action potential duration. Ashford et al. (1994) cloned the rat heart K(ATP) channel, thus enabling the isolation of the human homolog. The primary structure of KATP1 placed it in the J subfamily of inwardly rectifying potassium channels (Bond et al., 1994), such as KCNJ2 (OMIM Ref. No. 600681) and KCNJ4 (OMIM Ref. No. 600504); thus, the human homolog was designated KCNJ5. Wickman et al. (1997) reported a partial sequence of human GIRK4. They used human/rodent somatic cell hybrids to localize the human gene to chromosome 11, consistent with previous studies that localized the gene to 11q23-ter. Wickman et al. (1997) cloned the mouse Girk4 gene. They showed that the gene is expressed almost exclusively in the mouse heart. Using interspecific backcross analysis, Wickman et al. (1997) mapped the mouse Girk4 gene to chromosome 9, consistent with the mapping to human chromosome 11.

Full details of the abovementioned studies are described in the following publications, the disclosure of which are hereby incorporated by reference:

Ashford, M. L. J.; Bond, C. T.; Blair, T. A.; Adelman, J. P.: Cloning and functional expression of a rat heart KATP channel. Nature 370:456-459, 1994; and Bond, C. T.; Pessia, M.; Xia, X.-M.; Lagrutta, A.; Kavanaugh, M. P.; Adelman, J. P.: Cloning and expression of a family of inward rectifier potassium channels. Receptors Channels 2:183.

Further studies establishing the function and utilities of KCNJ5 are found in John Hopkins OMIM database record ID 600734, and in sited publications numbered 7511-7514 listed in the bibliography section hereinbelow, which are also hereby incorporated by reference. Leptin (obesity homolog, mouse) (LEP, Accession NM_000230) is another VGAM766 host target gene. LEP BINDING SITE is HOST TARGET binding site found in the 3' untranslated region of mRNA encoded by LEP, corresponding to a HOST TARGET binding site such as BINDING SITE I, BINDING SITE II or BINDING SITE III. Table 2 illustrates the complementarity of the nucleotide sequences of LEP BINDING SITE, designated SEQ ID:5738, to the nucleotide sequence of VGAM766 RNA, herein designated VGAM RNA, also designated SEQ ID:3477.

Another function of VGAM766 is therefore inhibition of Leptin (obesity homolog, mouse) (LEP, Accession NM_000230). Accordingly, utilities of VGAM766 include diagnosis, prevention and treatment of diseases and clinical conditions associated with LEP. Nucleoporin 62 kDa (NUP62, Accession NM_016553) is another VGAM766 host target gene. NUP62 BINDING SITE is HOST TARGET binding site found in the 3' untranslated region of mRNA encoded by NUP62, corresponding to a HOST TARGET binding site such as BINDING SITE I, BINDING SITE II or BINDING SITE III. Table 2 illustrates the complementarity of the nucleotide sequences of NUP62 BINDING SITE, designated SEQ ID:18628, to the nucleotide sequence of VGAM766 RNA, herein designated VGAM RNA, also designated SEQ ID:3477.

Another function of VGAM766 is therefore inhibition of Nucleoporin 62kDa (NUP62, Accession NM_016553). Accordingly, utilities of VGAM766 include diagnosis, prevention and treatment of diseases and clinical conditions associated with NUP62. Pim-1 Oncogene (PIM1, Accession XM_165800) is another VGAM766 host target gene. PIM1

BINDING SITE is HOST TARGET binding site found in the 3' untranslated region of mRNA encoded by PIM1, corresponding to a HOST TARGET binding site such as BINDING SITE I, BINDING SITE II or BINDING SITE III. Table 2 illustrates the complementarity of the nucleotide sequences of PIM1 BINDING SITE, designated SEQ ID:43754, to the nucleotide sequence of VGAM766 RNA, herein designated VGAM RNA, also designated SEQ ID:3477.

Another function of VGAM766 is therefore inhibition of Pim-1 Oncogene (PIM1, Accession XM_165800), a gene which is a proto-oncogene. Accordingly, utilities of VGAM766 include diagnosis, prevention and treatment of diseases and clinical conditions associated with PIM1. The function of PIM1 and its association with various diseases and clinical conditions, has been established by previous studies, as described hereinabove with reference to VGAM95. Src Family Associated Phosphoprotein 2 (SCAP2, Accession NM_003930) is another VGAM766 host target gene. SCAP2 BINDING SITE is HOST TARGET binding site found in the 3' untranslated region of mRNA encoded by SCAP2, corresponding to a HOST TARGET binding site such as BINDING SITE I, BINDING SITE II or BINDING SITE III. Table 2 illustrates the complementarity of the nucleotide sequences of SCAP2 BINDING SITE, designated SEQ ID:10029, to the nucleotide sequence of VGAM766 RNA, herein designated VGAM RNA, also designated SEQ ID:3477.

Another function of VGAM766 is therefore inhibition of Src Family Associated Phosphoprotein 2 (SCAP2, Accession NM_003930), a gene which interacts with Src family protein tyrosine kinases and SLAP/FYB (SLA). Accordingly, utilities of VGAM766 include diagnosis, prevention and treatment of diseases and clinical conditions associated with SCAP2. The function of SCAP2 and its association with various diseases and clinical conditions, has been established by previous studies, as described hereinabove with reference to VGAM134. Solute Carrier Family 17 (anion/sugar transporter), Member 5 (SLC17A5, Accession NM_012434) is another VGAM766 host target gene. SLC17A5 BINDING SITE is HOST TARGET binding site found in the 3' untranslated region of mRNA encoded by SLC17A5, corresponding to a HOST TARGET binding site such as BINDING SITE I, BINDING SITE II or BINDING SITE III. Table 2 illustrates the complementarity of the nucleotide sequences of SLC17A5 BINDING SITE, designated SEQ ID:14814, to the nucleotide sequence of VGAM766 RNA, herein designated VGAM RNA, also designated SEQ ID:3477.

Another function of VGAM766 is therefore inhibition of Solute Carrier Family 17 (anion/sugar transporter), Member 5 (SLC17A5, Accession NM_012434), a gene which is a member of a family of anion/cation symporters. Accordingly, utilities of VGAM766 include diagnosis, prevention and treatment of diseases and clinical conditions associated with SLC17A5. The function of SLC17A5 has been established by previous studies. Aula et al. (2000) identified a large number of mutations in SLC17A5 in patients presenting with either Salla disease or the infantile sialic acid storage disorder. All 80 Finnish patients with Salla disease had the R39C mutation (604322.0001); 91% of them were homozygous for this old founder mutation. The compound heterozygous patients, with the founder mutation in only 1 allele, presented with a more severe phenotype than did the homozygous patients. The same R39C mutation was also found in most of the Swedish patients with SD and in heterozygous form in 5 patients from central Europe who presented with an unusually severe (intermediate) SD phenotype. Ten different mutations, including deletions, insertions, and missense and nonsense mutations, were identified in patients with the most severe ISSD phenotype. Using a positional cloning approach in a search for the gene that is mutant in sialic acid storage diseases (see OMIM Ref. No. 269920), Verheijen et al. (1999) identified an EST from the region of mapping on 6q14-q15 that they labeled SLC17A5 and subsequently showed to be mutant in these disorders. The sequence they isolated included an open reading frame (ORF) of 1,485 bp, predicting a protein sequence of 495 amino acids. A database search showed that the new sequence had homology to members of the anion/cation symporter (ACS) family of transporters. This family contains eukaryotic inorganic anion transporters (such as Na+/phosphate cotransporters) as well as prokaryotic organic anion transporters (including H+/acid sugar symporters for hexuronate and glucarate). Verheijen et al. (1999) suggested that the product of the SLC17A5 gene be designated 'sialin' because of its relation to sialic acid storage diseases. Sialin contains a characteristic motif in the fourth transmembrane-spanning domain that is present in all members of the ACS family. They could demonstrate homology of sialin with human Na+/phosphate symporters by sequence alignment. For example, sialin shows 34% sequence identity with NPT1 (SLC17A1; 182308). Only the N- and C-terminal regions do not show homology. Verheijen et al. (1999) found extensive homology of human sialin with proteins in other species. On Northern blot analysis of human tissues, Verheijen et al. (1999) found ubiquitous expression of an approximately 4.5-kb major transcript of SLC17A5, and an additional transcript of approximately 3.5 kb. They also observed a ubiquitously expressed 1.8-kb band after very long exposures. They suspected that these different transcripts are due to multiple poly (A) addition sites. The SLC17A5 gene is also known as AST. Biancheri et al. (2002) described 2 Italian brothers with sialic acid storage disease that resembled Salla disease as observed in the Finnish population (OMIM Ref. No. 604369) rather than ISSD. Both brothers showed moderate intellectual disability, spastic ataxic syndrome, hypomyelination and cerebellar ataxia on MRI, and lysosomal storage, all typical of Salla disease. In one of the alleles of the younger brother, Biancheri et al. (2002) found the same 15-bp deletion in exon 6 that had been found by Verheijen et al. (1999). No R39C mutation (604322.0001) was found. The older brother had died at the age of 20 years and DNA testing was not performed. The second mutation in the younger brother was presumed to lie in a noncoding area of the gene.

Full details of the abovementioned studies are described in the following publications, the disclosure of which are hereby incorporated by reference:

Aula, N.; Salomaki, P.; Timonen, R.; Verheijen, F.; Mancini, G.; Mansson, J.-E.; Aula, P.; Peltonen, L.: The spectrum of SLC17A5-gene mutations resulting in free sialic acid-storage diseases indicates some genotype-phenotype correlation. Am. J. Hum. Genet. 67:832-840, 2000; and Verheijen, F. W.; Verbeek, E.; Aula, N.; Beerens, C. E. M. T.; Havelaar, A. C.; Joosse, M.; Peltonen, L.; Aula, P.; Galjaard, H.; van der Spek, P. J.; Mancini, G. M. S.: A new gene.

Further studies establishing the function and utilities of SLC17A5 are found in John Hopkins OMIM database record ID 604322, and in sited publications numbered 5011, 10827, 10828-1082 and 1656-1661 listed in the bibliography section hereinbelow, which are also hereby incorporated by reference. Sulfotransferase Family, Cytosolic, 2A, Dehydroepiandrosterone (DHEA) -preferring, Member 1 (SULT2A1, Accession XM_049895) is another VGAM766 host target gene. SULT2A1 BINDING SITE is HOST TARGET binding site found in the 3' untranslated region of mRNA encoded by SULT2A1, corresponding to a HOST TARGET binding site such as BINDING SITE I, BINDING SITE II or BINDING SITE III. Table 2 illustrates the complementarity of the nucleotide sequences of SULT2A1 BINDING SITE, designated SEQ ID:35540, to the nucleotide sequence of VGAM766 RNA, herein designated VGAM RNA, also designated SEQ ID:3477.

Another function of VGAM766 is therefore inhibition of Sulfotransferase Family, Cytosolic, 2A, Dehydroepiandrosterone (DHEA) -preferring, Member 1 (SULT2A1, Accession XM_049895), a gene which catalyzes the sulfation of steroids and bile acids in the liver and adrenal glands. Accordingly, utilities of VGAM766 include diagnosis, prevention and treatment of diseases and clinical conditions associated with SULT2A1. The function of SULT2A1 has been established by previous studies. One of the major roles of the sulfotransferases (ST) in the metabolism of drugs and endogenous compounds is the conversion of these substances into more hydrophilic water-soluble sulfate conjugates that can be easily excreted. Sulfation may also play a regulatory role for many endogenous compounds, such as steroids and neurotransmitters, by altering the biologic properties of these compounds. Otterness et al. (1992), Kong et al. (1992), and Comer et al. (1993) reported the cloning of cDNAs encoding liver dehydroepiandrosterone (DHEA) sulfotransferase. The predicted protein has 285 amino acids. Although Northern blot analysis of human liver RNA detected transcripts of 3 different sizes, Southern blot analysis of human DNA suggested that only 1 gene is present in the genome. This gene has an important role in the sulfation of both bile acids and steroids in the liver and adrenals. The human adrenal form of this enzyme is physically, immunologically, and kinetically similar, perhaps identical, to the liver form. Dehydroepiandrosterone sulfate is quantitatively one of the major steroids secreted from the adrenal cortex. Since 20 to 25% of subjects have a high level of hepatic DHEA sulfotransferase activity, the possibility that this enzyme activity may be controlled by a genetic polymorphism was raised. Otterness et al. (1995) cloned the STD gene and demonstrated that it spans at least 17 kb and is composed of 6 exons and 5 introns.

Full details of the abovementioned studies are described in the following publications, the disclosure of which are hereby incorporated by reference:

Comer, K. A.; Falany, J. L.; Falany, C. N.: Cloning and expression of human liver dehydroepiandrosterone sulphotransferase. Biochem. J. 289:233-240, 1993; and Otterness, D. M.; Her, C.; Aksoy, S.; Kimura, S.; Wieben, E. D.; Weinshilboum, R. M.: Human dehydroepiandrosterone sulfotransferase gene: molecular cloning and structural characterizat.

Further studies establishing the function and utilities of SULT2A1 are found in John Hopkins OMIM database record ID 125263, and in sited publications numbered 1999-2004 listed in the bibliography section hereinbelow, which are also hereby incorporated by reference. SUV39H2 (Accession NM_024670) is another VGAM766 host target gene. SUV39H2 BINDING SITE is HOST TARGET binding site found in the 3' untranslated region of mRNA encoded by SUV39H2, corresponding to a HOST TARGET binding site such as BINDING SITE I, BINDING SITE II or BINDING SITE III. Table 2 illustrates the complementarity of the nucleotide sequences of SUV39H2 BINDING SITE, designated SEQ ID:23975, to the nucleotide sequence of VGAM766 RNA, herein designated VGAM RNA, also designated SEQ ID:3477.

Another function of VGAM766 is therefore inhibition of SUV39H2 (Accession NM_024670), a gene which is involved in gene repression and the modification of position-effect- variegation. Accordingly, utilities of VGAM766 include diagnosis, prevention and treatment of diseases and clinical conditions associated with SUV39H2. The function of SUV39H2 and its association with various diseases and clinical conditions, has been established by previous studies, as described hereinabove with reference to VGAM424. Transient Receptor Potential Cation Channel, Subfamily M, Member 8 (TRPM8, Accession NM_024080) is another VGAM766 host target gene. TRPM8 BINDING SITE is HOST TARGET binding site found in the 3' untranslated region of mRNA encoded by TRPM8, corresponding to a HOST TARGET binding site such as BINDING SITE I, BINDING SITE II or BINDING SITE III. Table 2 illustrates the complementarity of the nucleotide sequences of TRPM8 BINDING SITE, designated SEQ ID:23517, to the nucleotide sequence of VGAM766 RNA, herein designated VGAM RNA, also designated SEQ ID:3477.

Another function of VGAM766 is therefore inhibition of Transient Receptor Potential Cation Channel, Subfamily M, Member 8 (TRPM8, Accession NM_024080), a gene which is thought to form a receptor-activated calcium permeant cation channel. Accordingly, utilities of VGAM766 include diagnosis, prevention and treatment of diseases and clinical conditions associated with TRPM8. The function of TRPM8 and its association with various diseases and clinical conditions, has been established by previous studies, as described hereinabove with reference to VGAM201. XT3 (Accession NM_020208) is another VGAM766 host target gene. XT3 BINDING SITE is HOST TARGET binding site found in the 3' untranslated region of mRNA encoded by XT3, corresponding to a HOST TARGET binding site such as BINDING SITE I, BINDING SITE II or BINDING SITE III. Table 2 illustrates the complementarity of the nucleotide sequences of XT3 BINDING SITE, designated SEQ ID:21445, to the nucleotide sequence of VGAM766 RNA, herein designated VGAM RNA, also designated SEQ ID:3477.

Another function of VGAM766 is therefore inhibition of XT3 (Accession NM_020208), a gene which is a Kidney-specific orphan transporter. Accordingly, utilities of VGAM766 include diagnosis, prevention and treatment of diseases and clinical conditions associated with XT3. The function of XT3 and its association with various diseases and clinical conditions, has been established by previous studies, as described hereinabove with reference to VGAM21. Ac-like Transposable Element (ALTE, Accession NM_004729) is another VGAM766 host target gene. ALTE BINDING SITE is HOST TARGET binding site found in the 3' untranslated region of mRNA encoded by ALTE, corresponding to a HOST TARGET binding site such as BINDING SITE I, BINDING SITE II or BINDING SITE III. Table 2 illustrates the complementarity of the nucleotide sequences of ALTE BINDING SITE, designated SEQ ID:11104, to the nucleotide sequence of VGAM766 RNA, herein designated VGAM RNA, also designated SEQ ID:3477.

Another function of VGAM766 is therefore inhibition of Ac-like Transposable Element (ALTE, Accession NM_004729). Accordingly, utilities of VGAM766 include diagnosis, prevention and treatment of diseases and clinical conditions associated with ALTE. ARNTL2 (Accession NM_020183) is another VGAM766 host target gene. ARNTL2 BINDING SITE is HOST TARGET binding site found in the 3' untranslated region of mRNA encoded by ARNTL2, corresponding to a HOST TARGET binding site such as BINDING SITE I, BINDING SITE II or BINDING SITE III. Table 2 illustrates the complementarity of the nucleotide sequences of ARNTL2 BINDING SITE, designated SEQ ID:21414, to the nucleotide sequence of VGAM766 RNA, herein designated VGAM RNA, also designated SEQ ID:3477.

Another function of VGAM766 is therefore inhibition of ARNTL2 (Accession NM_020183). Accordingly, utilities of VGAM766 include diagnosis, prevention and treatment of diseases and clinical conditions associated with ARNTL2. Baculoviral IAP Repeat-containing 1 (BIRC1, Accession NM_004536) is another VGAM766 host target gene. BIRC1 BINDING SITE is HOST TARGET binding site found in the 3' untranslated region of mRNA encoded by BIRC1, corresponding to a HOST TARGET binding site such as BINDING SITE I, BINDING SITE II or BINDING SITE III. Table 2 illustrates the complementarity of the nucleotide sequences of BIRC1 BINDING SITE, designated SEQ ID:10886, to the nucleotide sequence of VGAM766 RNA, herein designated VGAM RNA, also designated SEQ ID:3477.

Another function of VGAM766 is therefore inhibition of Baculoviral IAP Repeat-containing 1 (BIRC1, Accession NM_004536). Accordingly, utilities of VGAM766 include diagnosis, prevention and treatment of diseases and clinical conditions associated with BIRC1. BLOV1 (Accession XM_083866) is another VGAM766 host target gene. BLOV1 BINDING SITE is HOST TARGET binding site found in the 3' untranslated region of mRNA encoded by BLOV1, corresponding to a HOST TARGET binding site such as BINDING SITE I, BINDING SITE II or BINDING SITE III. Table 2 illustrates the complementarity of the nucleotide sequences of BLOV1 BINDING SITE, designated SEQ ID:37521, to the nucleotide sequence of VGAM766 RNA, herein designated VGAM RNA, also designated SEQ ID:3477.

Another function of VGAM766 is therefore inhibition of BLOV1 (Accession XM_083866). Accordingly, utilities of VGAM766 include diagnosis, prevention and treatment of diseases and clinical conditions associated with BLOV1. Chromosome 20 Open Reading Frame 108 (C20orf108, Accession NM_080821) is another VGAM766 host target gene. C20orf108 BINDING SITE is HOST TARGET binding site found in the 3" untranslated region of mRNA encoded by C20orf108, corresponding to a HOST TARGET binding site such as BINDING SITE I, BINDING SITE II or BINDING SITE III. Table 2 illustrates the complementarity of the nucleotide sequences of C20orf108 BINDING SITE, designated SEQ ID:28085, to the nucleotide sequence of VGAM766 RNA, herein designated VGAM RNA, also designated SEQ ID:3477.

Another function of VGAM766 is therefore inhibition of Chromosome 20 Open Reading Frame 108 (C20orf108, Accession NM_080821). Accordingly, utilities of VGAM766 include diagnosis, prevention and treatment of diseases and clinical conditions associated with C20orf108. Chromosome 9 Open Reading Frame 5 (C9orf5, Accession NM_032012) is another VGAM766 host target gene. C9orf5 BINDING SITE is HOST TARGET binding site found in the 3' untranslated region of mRNA encoded by C9orf5, corresponding to a HOST TARGET binding site such as BINDING SITE I, BINDING SITE II or BINDING SITE III. Table 2 illustrates the complementarity of the nucleotide sequences of C9orf5 BINDING SITE, designated SEQ ID:25714, to the nucleotide sequence of VGAM766 RNA, herein designated VGAM RNA, also designated SEQ ID:3477.

Another function of VGAM766 is therefore inhibition of Chromosome 9 Open Reading Frame 5 (C9orf5, Accession NM_032012). Accordingly, utilities of VGAM766 include diagnosis, prevention and treatment of diseases and clinical conditions associated with C9orf5. Ceramide Kinase (cerk, Accession NM_022766) is another VGAM766 host target gene. cerk BINDING SITE is HOST TARGET binding site found in the 3' untranslated region of mRNA encoded by cerk, corresponding to a HOST TARGET binding site such as BINDING SITE I, BINDING SITE II or BINDING SITE III. Table 2 illustrates the complementarity of the nucleotide sequences of cerk BINDING SITE, designated SEQ ID:23013, to the nucleotide sequence of VGAM766 RNA, herein designated VGAM RNA, also designated SEQ ID:3477.

Another function of VGAM766 is therefore inhibition of Ceramide Kinase (cerk, Accession NM_022766). Accordingly, utilities of VGAM766 include diagnosis, prevention and treatment of diseases and clinical conditions associated with cerk. CG012 (Accession XM_096710) is another VGAM766 host target gene. CG012 BINDING SITE is HOST TARGET binding site found in the 5' untranslated region of mRNA encoded by CG012, corresponding to a HOST TARGET binding site such as BINDING SITE I, BINDING SITE II or BINDING SITE III. Table 2 illustrates the complementarity of the nucleotide sequences of CG012 BINDING SITE, designated SEQ ID:40488, to the nucleotide sequence of VGAM766 RNA, herein designated VGAM RNA, also designated SEQ ID:3477.

Another function of VGAM766 is therefore inhibition of CG012 (Accession XM_096710). Accordingly, utilities of VGAM766 include diagnosis, prevention and treatment of diseases and clinical conditions associated with CG012. COE2 (Accession XM_034639) is another VGAM766 host target gene. COE2 BINDING SITE is HOST TARGET binding site found in the 3' untranslated region of mRNA encoded by COE2, corresponding to a HOST TARGET binding site such as BINDING SITE I, BINDING SITE II or BINDING SITE III. Table 2 illustrates the complementarity of the nucleotide sequences of COE2 BINDING SITE, designated SEQ ID:32127, to the nucleotide sequence of VGAM766 RNA, herein designated VGAM RNA, also designated SEQ ID:3477.

Another function of VGAM766 is therefore inhibition of COE2 (Accession XM_034639). Accordingly, utilities of VGAM766 include diagnosis, prevention and treatment of diseases and clinical conditions associated with COE2. DEAD/H (Asp-Glu-Ala-Asp/His) Box Polypeptide 34 (DDX34, Accession NM_014681) is another VGAM766 host target gene. DDX34 BINDING SITE is HOST TARGET binding site found in the 3' untranslated region of mRNA encoded by DDX34, corresponding to a HOST TARGET binding site such as BINDING SITE I, BINDING SITE II or BINDING SITE III. Table 2 illustrates the complementarity of the nucleotide sequences of DDX34 BINDING SITE, designated SEQ ID:16162, to the nucleotide sequence of VGAM766 RNA, herein designated VGAM RNA, also designated SEQ ID:3477.

Another function of VGAM766 is therefore inhibition of DEAD/H (Asp-Glu-Ala-Asp/His) Box Polypeptide 34 (DDX34, Accession NM_014681). Accordingly, utilities of VGAM766 include diagnosis, prevention and treatment of diseases and clinical conditions associated with DDX34. DIS3 (Accession NM_014953) is another VGAM766 host target gene. DIS3 BINDING SITE is HOST TARGET binding site found in the 3' untranslated region of mRNA encoded by DIS3, corresponding to a HOST TARGET binding site such as BINDING SITE I, BINDING SITE II or BINDING SITE III. Table 2 illustrates the complementarity of the nucleotide sequences of DIS3 BINDING SITE, designated SEQ ID:17301, to the nucleotide sequence of VGAM766 RNA, herein designated VGAM RNA, also designated SEQ ID:3477.

Another function of VGAM766 is therefore inhibition of DIS3 (Accession NM_014953). Accordingly, utilities of VGAM766 include diagnosis, prevention and treatment of diseases and clinical conditions associated with DIS3. DKFZP434I1735 (Accession XM_113763) is another VGAM766 host target gene. DKFZP434I1735 BINDING SITE is HOST TARGET binding site found in the 3' untranslated region of mRNA encoded by DKFZP434I1735, corresponding to a HOST TARGET binding site such as BINDING SITE I, BINDING SITE II or BINDING SITE III. Table 2 illustrates the complementarity of the nucleotide sequences of DKFZP434I1735 BINDING SITE, designated SEQ ID:42421, to the nucleotide sequence of VGAM766 RNA, herein designated VGAM RNA, also designated SEQ ID:3477.

Another function of VGAM766 is therefore inhibition of DKFZP434I1735 (Accession XM_113763). Accordingly, utilities of VGAM766 include diagnosis, prevention and treatment of diseases and clinical conditions associated with DKFZP434I1735. DKFZP564B1023 (Accession NM_031306) is another VGAM766 host target gene. DKFZP564B1023 BINDING SITE is HOST TARGET binding site found in the 3' untranslated region of mRNA encoded by DKFZP564B1023, corresponding to a HOST TARGET binding site such as BINDING SITE I, BINDING SITE II or BINDING SITE III. Table 2 illustrates the complementarity of the nucleotide sequences of DKFZP564B1023 BINDING SITE, designated SEQ ID:25343, to the nucleotide sequence of VGAM766 RNA, herein designated VGAM RNA, also designated SEQ ID:3477.

Another function of VGAM766 is therefore inhibition of DKFZP564B1023 (Accession NM_031306). Accordingly, utilities of VGAM766 include diagnosis, prevention and treatment of diseases and clinical conditions associated with DKFZP564B1023. DKFZP586D2223 (Accession NM_018561) is another VGAM766 host target gene. DKFZP586D2223 BINDING SITE is HOST TARGET binding site found in the 3' untranslated region of mRNA encoded by DKFZP586D2223, corresponding to a HOST TARGET binding site such as BINDING SITE I, BINDING SITE II or BINDING SITE III. Table 2 illustrates the complementarity of the nucleotide sequences of DKFZP586D2223 BINDING SITE, designated SEQ ID:20645, to the nucleotide sequence of VGAM766 RNA, herein designated VGAM RNA, also designated SEQ ID:3477.

Another function of VGAM766 is therefore inhibition of DKFZP586D2223 (Accession NM_018561). Accordingly, utilities of VGAM766 include diagnosis, prevention and treatment of diseases and clinical conditions associated with DKFZP586D2223. DKFZp586I021 (Accession NM_032271) is another VGAM766 host target gene. DKFZp586I021 BINDING SITE is HOST TARGET binding site found in the 3' untranslated region of mRNA encoded by DKFZp586I021, corresponding to a HOST TARGET binding site such as BINDING SITE I, BINDING SITE II or BINDING SITE III. Table 2 illustrates the complementarity of the nucleotide sequences of DKFZp586I021 BINDING SITE, designated SEQ ID:26018, to the nucleotide sequence of VGAM766 RNA, herein designated VGAM RNA, also designated SEQ ID:3477.

Another function of VGAM766 is therefore inhibition of DKFZp586I021 (Accession NM_032271). Accordingly, utilities of VGAM766 include diagnosis, prevention and treatment of diseases and clinical conditions associated with DKFZp586I021. DKFZp761J139 (Accession NM_032280) is another VGAM766 host target gene. DKFZp761J139 BINDING SITE is HOST TARGET binding site found in the 5' untranslated region of mRNA encoded by DKFZp761J139, corresponding to a HOST TARGET binding site such as BINDING SITE I, BINDING SITE II or BINDING SITE III. Table 2 illustrates the complementarity of the nucleotide sequences of DKFZp761J139 BINDING SITE, designated SEQ ID:26036, to the nucleotide sequence of VGAM766 RNA, herein designated VGAM RNA, also designated SEQ ID:3477.

Another function of VGAM766 is therefore inhibition of DKFZp761J139 (Accession NM_032280). Accordingly, utilities of VGAM766 include diagnosis, prevention and treatment of diseases and clinical conditions associated with DKFZp761J139. ERAP140 (Accession XM_059748) is another VGAM766 host target gene. ERAP140 BINDING SITE is HOST TARGET binding site found in the 3' untranslated region of mRNA encoded by ERAP140, corresponding to a HOST TARGET binding site such as BINDING SITE I, BINDING SITE II or BINDING SITE III. Table 2 illustrates the complementarity of the nucleotide sequences of ERAP140 BINDING SITE, designated SEQ ID:37086, to the nucleotide sequence of VGAM766 RNA, herein designated VGAM RNA, also designated SEQ ID:3477.

Another function of VGAM766 is therefore inhibition of ERAP140 (Accession XM_059748). Accordingly, utilities of VGAM766 include diagnosis, prevention and treatment of diseases and clinical conditions associated with ERAP140. F-box Only Protein 27 (FBXO27, Accession XM_059045) is another VGAM766 host target gene. FBXO27 BINDING SITE is HOST TARGET binding site found in the 3' untranslated region of mRNA encoded by FBXO27, corresponding to a HOST TARGET binding site such as BINDING SITE I, BINDING SITE II or BINDING SITE III. Table 2 illustrates the complementarity of the nucleotide sequences of FBXO27 BINDING SITE, designated SEQ ID:36836, to the nucleotide sequence of VGAM766 RNA, herein designated VGAM RNA, also designated SEQ ID:3477.

Another function of VGAM766 is therefore inhibition of F-box Only Protein 27 (FBXO27, Accession XM_059045). Accordingly, utilities of VGAM766 include diagnosis, prevention and treatment of diseases and clinical conditions associated with FBXO27. FK506 Binding Protein 14, 22 KDa (FKBP14, Accession NM_017946) is another VGAM766 host target gene. FKBP14 BINDING SITE is HOST TARGET binding site found in the 3' untranslated region of mRNA encoded by FKBP14, corresponding to a HOST TARGET binding site such as BINDING SITE I, BINDING SITE II or BINDING SITE III. Table 2 illustrates the complementarity of the nucleotide sequences of FKBP14 BINDING SITE, designated SEQ ID:19645, to the nucleotide sequence of VGAM766 RNA, herein designated VGAM RNA, also designated SEQ ID:3477.

Another function of VGAM766 is therefore inhibition of FK506 Binding Protein 14, 22 KDa (FKBP14, Accession NM_017946). Accordingly, utilities of VGAM766 include diagnosis, prevention and treatment of diseases and clinical conditions associated with FKBP14. FLJ10008 (Accession NM_017970) is another VGAM766 host target gene. FLJ10008 BINDING SITE is HOST TARGET binding site found in the 3' untranslated region of mRNA encoded by FLJ10008, corresponding to a HOST TARGET binding site such as BINDING SITE I, BINDING SITE II or BINDING SITE III. Table 2 illustrates the complementarity of the nucleotide sequences of FLJ10008 BINDING SITE, designated SEQ ID:19692, to the nucleotide sequence of VGAM766 RNA, herein designated VGAM RNA, also designated SEQ ID:3477.

Another function of VGAM766 is therefore inhibition of FLJ10008 (Accession NM_017970). Accordingly, utilities of VGAM766 include diagnosis, prevention and treatment of diseases and clinical conditions associated with FLJ10008.

FLJ10650 (Accession NM_018168) is another VGAM766 host target gene. FLJ10650 BINDING SITE is HOST TARGET binding site found in the 3' untranslated region of mRNA encoded by FLJ10650, corresponding to a HOST TARGET binding site such as BINDING SITE I, BINDING SITE II or BINDING SITE III. Table 2 illustrates the complementarity of the nucleotide sequences of FLJ10650 BINDING SITE, designated SEQ ID:19986, to the nucleotide sequence of VGAM766 RNA, herein designated VGAM RNA, also designated SEQ ID:3477.

Another function of VGAM766 is therefore inhibition of FLJ10650 (Accession NM_018168). Accordingly, utilities of VGAM766 include diagnosis, prevention and treatment of diseases and clinical conditions associated with FLJ10650.

FLJ10803 (Accession NM_018224) is another VGAM766 host target gene. FLJ10803 BINDING SITE is HOST TARGET binding site found in the 3' untranslated region of mRNA encoded by FLJ10803, corresponding to a HOST TARGET binding site such as BINDING SITE I, BINDING SITE II or BINDING SITE III. Table 2 illustrates the complementarity of the nucleotide sequences of FLJ10803 BINDING SITE, designated SEQ ID:20155, to the nucleotide sequence of VGAM766 RNA, herein designated VGAM RNA, also designated SEQ ID:3477.

Another function of VGAM766 is therefore inhibition of FLJ10803 (Accession NM_018224). Accordingly, utilities of VGAM766 include diagnosis, prevention and treatment of diseases and clinical conditions associated with FLJ10803.

FLJ11151 (Accession XM_042224) is another VGAM766 host target gene. FLJ11151 BINDING SITE is HOST TARGET binding site found in the 3' untranslated region of mRNA encoded by FLJ11151, corresponding to a HOST TARGET binding site such as BINDING SITE I, BINDING SITE II or BINDING SITE III. Table 2 illustrates the complementarity of the nucleotide sequences of FLJ11151 BINDING SITE, designated SEQ ID:33706, to the nucleotide sequence of VGAM766 RNA, herein designated VGAM RNA, also designated SEQ ID:3477.

Another function of VGAM766 is therefore inhibition of FLJ11151 (Accession XM_042224). Accordingly, utilities of VGAM766 include diagnosis, prevention and treatment of diseases and clinical conditions associated with FLJ11151.

FLJ11700 (Accession NM_024892) is another VGAM766 host target gene. FLJ11700 BINDING SITE is HOST TARGET binding site found in the 3' untranslated region of mRNA encoded by FLJ11700, corresponding to a HOST TARGET binding site such as BINDING SITE I, BINDING SITE II or BINDING SITE III. Table 2 illustrates the complementarity of the nucleotide sequences of FLJ11700 BINDING SITE, designated SEQ ID:24367, to the nucleotide sequence of VGAM766 RNA, herein designated VGAM RNA, also designated SEQ ID:3477.

Another function of VGAM766 is therefore inhibition of FLJ11700 (Accession NM_024892). Accordingly, utilities of VGAM766 include diagnosis, prevention and treatment of diseases and clinical conditions associated with FLJ11700.

FLJ12800 (Accession NM_022903) is another VGAM766 host target gene. FLJ12800 BINDING SITE is HOST TARGET binding site found in the 3' untranslated region of mRNA encoded by FLJ12800, corresponding to a HOST TARGET binding site such as BINDING SITE I, BINDING SITE II or BINDING SITE III. Table 2 illustrates the complementarity of the nucleotide sequences of FLJ12800 BINDING SITE, designated SEQ ID:23191, to the nucleotide sequence of VGAM766 RNA, herein designated VGAM RNA, also designated SEQ ID:3477.

Another function of VGAM766 is therefore inhibition of FLJ12800 (Accession NM_022903). Accordingly, utilities of VGAM766 include diagnosis, prevention and treatment of diseases and clinical conditions associated with FLJ12800.

FLJ14641 (Accession NM_032817) is another VGAM766 host target gene. FLJ14641 BINDING SITE is HOST TARGET binding site found in the 3' untranslated region of mRNA encoded by FLJ14641, corresponding to a HOST TARGET binding site such as BINDING SITE I, BINDING SITE II or BINDING SITE III. Table 2 illustrates the complementarity of the nucleotide sequences of FLJ14641 BINDING SITE, designated SEQ ID:26587, to the nucleotide sequence of VGAM766 RNA, herein designated VGAM RNA, also designated SEQ ID:3477.

Another function of VGAM766 is therefore inhibition of FLJ14641 (Accession NM_032817). Accordingly, utilities of VGAM766 include diagnosis, prevention and treatment of diseases and clinical conditions associated with FLJ14641.

FLJ20013 (Accession NM_017621) is another VGAM766 host target gene. FLJ20013 BINDING SITE is HOST TARGET binding site found in the 3' untranslated region of mRNA encoded by FLJ20013, corresponding to a HOST TARGET binding site such as BINDING SITE I, BINDING SITE II or BINDING SITE III. Table 2 illustrates the complementarity of the nucleotide sequences of FLJ20013 BINDING SITE, designated SEQ ID:19121, to the nucleotide sequence of VGAM766 RNA, herein designated VGAM RNA, also designated SEQ ID:3477.

Another function of VGAM766 is therefore inhibition of FLJ20013 (Accession NM_017621). Accordingly, utilities of VGAM766 include diagnosis, prevention and treatment of diseases and clinical conditions associated with FLJ20013.

FLJ20211 (Accession NM_017713) is another VGAM766 host target gene. FLJ20211 BINDING SITE is HOST TARGET binding site found in the 3' untranslated region of mRNA encoded by FLJ20211, corresponding to a HOST TARGET binding site such as BINDING SITE I, BINDING SITE II or BINDING SITE III. Table 2 illustrates the complementarity of the nucleotide sequences of FLJ20211 BINDING SITE, designated SEQ ID:19296, to the nucleotide sequence of VGAM766 RNA, herein designated VGAM RNA, also designated SEQ ID:3477.

Another function of VGAM766 is therefore inhibition of FLJ20211 (Accession NM_017713). Accordingly, utilities of VGAM766 include diagnosis, prevention and treatment of diseases and clinical conditions associated with FLJ20211.

FLJ20783 (Accession NM_017958) is another VGAM766 host target gene. FLJ20783 BINDING SITE is HOST TARGET binding site found in the 3' untranslated region of mRNA encoded by FLJ20783, corresponding to a HOST TARGET binding site such as BINDING SITE I, BINDING SITE II or BINDING SITE III. Table 2 illustrates the complementarity of the nucleotide sequences of FLJ20783 BINDING SITE, designated SEQ ID:19670, to the nucleotide sequence of VGAM766 RNA, herein designated VGAM RNA, also designated SEQ ID:3477.

Another function of VGAM766 is therefore inhibition of FLJ20783 (Accession NM_017958). Accordingly, utilities of VGAM766 include diagnosis, prevention and treatment of diseases and clinical conditions associated with FLJ20783.

FLJ20825 (Accession NM_017962) is another VGAM766 host target gene. FLJ20825 BINDING SITE is HOST TARGET binding site found in the 3' untranslated region of mRNA encoded by FLJ20825, corresponding to a HOST TARGET binding site such as BINDING SITE I, BINDING SITE II or BINDING SITE III. Table 2 illustrates the complementarity of the nucleotide sequences of FLJ20825 BINDING SITE, designated SEQ ID:19681, to the nucleotide sequence of VGAM766 RNA, herein designated VGAM RNA, also designated SEQ ID:3477.

Another function of VGAM766 is therefore inhibition of FLJ20825 (Accession NM_017962). Accordingly, utilities of VGAM766 include diagnosis, prevention and treatment of diseases and clinical conditions associated with FLJ20825. FLJ21687 (Accession NM_024859) is another VGAM766 host target gene. FLJ21687 BINDING SITE is HOST TARGET binding site found in the 3' untranslated region of mRNA encoded by FLJ21687, corresponding to a HOST TARGET binding site such as BINDING SITE I, BINDING SITE II or BINDING SITE III. Table 2 illustrates the complementarity of the nucleotide sequences of FLJ21687 BINDING SITE, designated SEQ ID:24289, to the nucleotide sequence of VGAM766 RNA, herein designated VGAM RNA, also designated SEQ ID:3477.

Another function of VGAM766 is therefore inhibition of FLJ21687 (Accession NM_024859). Accordingly, utilities of VGAM766 include diagnosis, prevention and treatment of diseases and clinical conditions associated with FLJ21687. FLJ21870 (Accession NM_023016) is another VGAM766 host target gene. FLJ21870 BINDING SITE is HOST TARGET binding site found in the 3' untranslated region of mRNA encoded by FLJ21870, corresponding to a HOST TARGET binding site such as BINDING SITE I, BINDING SITE II or BINDING SITE III. Table 2 illustrates the complementarity of the nucleotide sequences of FLJ21870 BINDING SITE, designated SEQ ID:23280, to the nucleotide sequence of VGAM766 RNA, herein designated VGAM RNA, also designated SEQ ID:3477.

Another function of VGAM766 is therefore inhibition of FLJ21870 (Accession NM_023016). Accordingly, utilities of VGAM766 include diagnosis, prevention and treatment of diseases and clinical conditions associated with FLJ21870. FLJ22692 (Accession NM_025049) is another VGAM766 host target gene. FLJ22692 BINDING SITE is HOST TARGET binding site found in the 3' untranslated region of mRNA encoded by FLJ22692, corresponding to a HOST TARGET binding site such as BINDING SITE I, BINDING SITE II or BINDING SITE III. Table 2 illustrates the complementarity of the nucleotide sequences of FLJ22692 BINDING SITE, designated SEQ ID:24645, to the nucleotide sequence of VGAM766 RNA, herein designated VGAM RNA, also designated SEQ ID:3477.

Another function of VGAM766 is therefore inhibition of FLJ22692 (Accession NM_025049). Accordingly, utilities of VGAM766 include diagnosis, prevention and treatment of diseases and clinical conditions associated with FLJ22692. FLJ22814 (Accession NM_024916) is another VGAM766 host target gene. FLJ22814 BINDING SITE is HOST TARGET binding site found in the 3' untranslated region of mRNA encoded by FLJ22814, corresponding to a HOST TARGET binding site such as BINDING SITE I, BINDING SITE II or BINDING SITE III. Table 2 illustrates the complementarity of the nucleotide sequences of FLJ22814 BINDING SITE, designated SEQ ID:24441, to the nucleotide sequence of VGAM766 RNA, herein designated VGAM RNA, also designated SEQ ID:3477.

Another function of VGAM766 is therefore inhibition of FLJ22814 (Accession NM_024916). Accordingly, utilities of VGAM766 include diagnosis, prevention and treatment of diseases and clinical conditions associated with FLJ22814. FLJ23235 (Accession NM_024943) is another VGAM766 host target gene. FLJ23235 BINDING SITE is HOST TARGET binding site found in the 3' untranslated region of mRNA encoded by FLJ23235, corresponding to a HOST TARGET binding site such as BINDING SITE I, BINDING SITE II or BINDING SITE III. Table 2 illustrates the complementarity of the nucleotide sequences of FLJ23235 BINDING SITE, designated SEQ ID:24488, to the nucleotide sequence of VGAM766 RNA, herein designated VGAM RNA, also designated SEQ ID:3477.

Another function of VGAM766 is therefore inhibition of FLJ23235 (Accession NM_024943). Accordingly, utilities of VGAM766 include diagnosis, prevention and treatment of diseases and clinical conditions associated with FLJ23235. FLJ31737 (Accession NM_144984) is another VGAM766 host target gene. FLJ31737 BINDING SITE is HOST TARGET binding site found in the 3' untranslated region of mRNA encoded by FLJ31737, corresponding to a HOST TARGET binding site such as BINDING SITE I, BINDING SITE II or BINDING SITE III. Table 2 illustrates the complementarity of the nucleotide sequences of FLJ31737 BINDING SITE, designated SEQ ID:29590, to the nucleotide sequence of VGAM766 RNA, herein designated VGAM RNA, also designated SEQ ID:3477.

Another function of VGAM766 is therefore inhibition of FLJ31737 (Accession NM_144984). Accordingly, utilities of VGAM766 include diagnosis, prevention and treatment of diseases and clinical conditions associated with FLJ31737. KIAA0252 (Accession XM_031646) is another VGAM766 host target gene. KIAA0252 BINDING SITE is HOST TARGET binding site found in the 3' untranslated region of mRNA encoded by KIAA0252, corresponding to a HOST TARGET binding site such as BINDING SITE I, BINDING SITE II or BINDING SITE III. Table 2 illustrates the complementarity of the nucleotide sequences of KIAA0252 BINDING SITE, designated SEQ ID:31448, to the nucleotide sequence of VGAM766 RNA, herein designated VGAM RNA, also designated SEQ ID:3477.

Another function of VGAM766 is therefore inhibition of KIAA0252 (Accession XM_031646). Accordingly, utilities of VGAM766 include diagnosis, prevention and treatment of diseases and clinical conditions associated with KIAA0252. KIAA0266 (Accession NM_021645) is another VGAM766 host target gene. KIAA0266 BINDING SITE is HOST TARGET binding site found in the 3' untranslated region of mRNA encoded by KIAA0266, corresponding to a HOST TARGET binding site such as BINDING SITE I, BINDING SITE II or BINDING SITE III. Table 2 illustrates the complementarity of the nucleotide sequences of KIAA0266 BINDING SITE, designated SEQ ID:22310, to the nucleotide sequence of VGAM766 RNA, herein designated VGAM RNA, also designated SEQ ID:3477.

Another function of VGAM766 is therefore inhibition of KIAA0266 (Accession NM_021645). Accordingly, utilities of VGAM766 include diagnosis, prevention and treatment of diseases and clinical conditions associated with KIAA0266. KIAA0420 (Accession XM_032693) is another VGAM766 host target gene. KIAA0420 BINDING SITE is HOST TARGET binding site found in the 3' untranslated region of mRNA encoded by KIAA0420, corresponding to a HOST TARGET binding site such as BINDING SITE I, BINDING SITE II or BINDING SITE III. Table 2 illustrates the complementarity of the nucleotide sequences of KIAA0420 BINDING SITE, designated SEQ ID:31723, to the nucleotide sequence of VGAM766 RNA, herein designated VGAM RNA, also designated SEQ ID:3477.

Another function of VGAM766 is therefore inhibition of KIAA0420 (Accession XM_032693). Accordingly, utilities of VGAM766 include diagnosis, prevention and treatment of diseases and clinical conditions associated with KIAA0420.

KIAA0472 (Accession XM_050147) is another VGAM766 host target gene. KIAA0472 BINDING SITE is HOST TARGET binding site found in the 3' untranslated region of mRNA encoded by KIAA0472, corresponding to a HOST TARGET binding site such as BINDING SITE I, BINDING SITE II or BINDING SITE III. Table 2 illustrates the complementarity of the nucleotide sequences of KIAA0472 BINDING SITE, designated SEQ ID:35578, to the nucleotide sequence of VGAM766 RNA, herein designated VGAM RNA, also designated SEQ ID:3477.

Another function of VGAM766 is therefore inhibition of KIAA0472 (Accession XM_050147). Accordingly, utilities of VGAM766 include diagnosis, prevention and treatment of diseases and clinical conditions associated with KIAA0472.

KIAA0527 (Accession XM_171054) is another VGAM766 host target gene. KIAA0527 BINDING SITE is HOST TARGET binding site found in the 3' untranslated region of mRNA encoded by KIAA0527, corresponding to a HOST TARGET binding site such as BINDING SITE I, BINDING SITE II or BINDING SITE III. Table 2 illustrates the complementarity of the nucleotide sequences of KIAA0527 BINDING SITE, designated SEQ ID:45841, to the nucleotide sequence of VGAM766 RNA, herein designated VGAM RNA, also designated SEQ ID:3477.

Another function of VGAM766 is therefore inhibition of KIAA0527 (Accession XM_171054). Accordingly, utilities of VGAM766 include diagnosis, prevention and treatment of diseases and clinical conditions associated with KIAA0527.

KIAA0794 (Accession XM_087353) is another VGAM766 host target gene. KIAA0794 BINDING SITE is HOST TARGET binding site found in the 3' untranslated region of mRNA encoded by KIAA0794, corresponding to a HOST TARGET binding site such as BINDING SITE I, BINDING SITE II or BINDING SITE III. Table 2 illustrates the complementarity of the nucleotide sequences of KIAA0794 BINDING SITE, designated SEQ ID:39181, to the nucleotide sequence of VGAM766 RNA, herein designated VGAM RNA, also designated SEQ ID:3477.

Another function of VGAM766 is therefore inhibition of KIAA0794 (Accession XM_087353). Accordingly, utilities of VGAM766 include diagnosis, prevention and treatment of diseases and clinical conditions associated with KIAA0794.

KIAA1228 (Accession XM_036408) is another VGAM766 host target gene. KIAA1228 BINDING SITE is HOST TARGET binding site found in the 3' untranslated region of mRNA encoded by KIAA1228, corresponding to a HOST TARGET binding site such as BINDING SITE I, BINDING SITE II or BINDING SITE III. Table 2 illustrates the complementarity of the nucleotide sequences of KIAA1228 BINDING SITE, designated SEQ ID:32444, to the nucleotide sequence of VGAM766 RNA, herein designated VGAM RNA, also designated SEQ ID:3477.

Another function of VGAM766 is therefore inhibition of KIAA1228 (Accession XM_036408). Accordingly, utilities of VGAM766 include diagnosis, prevention and treatment of diseases and clinical conditions associated with KIAA1228.

KIAA1641 (Accession XM_087167) is another VGAM766 host target gene. KIAA1641 BINDING SITE is HOST TARGET binding site found in the 3' untranslated region of mRNA encoded by KIAA1641, corresponding to a HOST TARGET binding site such as BINDING SITE I, BINDING SITE II or BINDING SITE III. Table 2 illustrates the complementarity of the nucleotide sequences of KIAA1641 BINDING SITE, designated SEQ ID:39100, to the nucleotide sequence of VGAM766 RNA, herein designated VGAM RNA, also designated SEQ ID:3477.

Another function of VGAM766 is therefore inhibition of KIAA1641 (Accession XM_087167). Accordingly, utilities of VGAM766 include diagnosis, prevention and treatment of diseases and clinical conditions associated with KIAA1641.

KIAA1871 (Accession XM_028409) is another VGAM766 host target gene. KIAA1871 BINDING SITE is HOST TARGET binding site found in the 3' untranslated region of mRNA encoded by KIAA1871, corresponding to a HOST TARGET binding site such as BINDING SITE I, BINDING SITE II or BINDING SITE III. Table 2 illustrates the complementarity of the nucleotide sequences of KIAA1871 BINDING SITE, designated SEQ ID:30705, to the nucleotide sequence of VGAM766 RNA, herein designated VGAM RNA, also designated SEQ ID:3477.

Another function of VGAM766 is therefore inhibition of KIAA1871 (Accession XM_028409). Accordingly, utilities of VGAM766 include diagnosis, prevention and treatment of diseases and clinical conditions associated with KIAA1871.

KIAA1872 (Accession XM_031917) is another VGAM766 host target gene. KIAA1872 BINDING SITE is HOST TARGET binding site found in the 3' untranslated region of mRNA encoded by KIAA1872, corresponding to a HOST TARGET binding site such as BINDING SITE I, BINDING SITE II or BINDING SITE III. Table 2 illustrates the complementarity of the nucleotide sequences of KIAA1872 BINDING SITE, designated SEQ ID:31519, to the nucleotide sequence of VGAM766 RNA, herein designated VGAM RNA, also designated SEQ ID:3477.

Another function of VGAM766 is therefore inhibition of KIAA1872 (Accession XM_031917). Accordingly, utilities of VGAM766 include diagnosis, prevention and treatment of diseases and clinical conditions associated with KIAA1872.

KIAA1969 (Accession XM_086098) is another VGAM766 host target gene. KIAA1969 BINDING SITE is HOST TARGET binding site found in the 3' untranslated region of mRNA encoded by KIAA1969, corresponding to a HOST TARGET binding site such as BINDING SITE I, BINDING SITE II or BINDING SITE III. Table 2 illustrates the complementarity of the nucleotide sequences of KIAA1969 BINDING SITE, designated SEQ ID:38491, to the nucleotide sequence of VGAM766 RNA, herein designated VGAM RNA, also designated SEQ ID:3477.

Another function of VGAM766 is therefore inhibition of KIAA1969 (Accession XM_086098). Accordingly, utilities of VGAM766 include diagnosis, prevention and treatment of diseases and clinical conditions associated with KIAA1969.

KR18 (Accession NM_033288) is another VGAM766 host target gene. KR18 BINDING SITE is HOST TARGET binding site found in the 3' untranslated region of mRNA encoded by KR18, corresponding to a HOST TARGET binding site such as BINDING SITE I, BINDING SITE II or BINDING SITE III. Table 2 illustrates the complementarity of the nucleotide sequences of KR18 BINDING SITE, designated SEQ ID:27118, to the nucleotide sequence of VGAM766 RNA, herein designated VGAM RNA, also designated SEQ ID:3477.

Another function of VGAM766 is therefore inhibition of KR18 (Accession NM_033288). Accordingly, utilities of VGAM766 include diagnosis, prevention and treatment of diseases and clinical conditions associated with KR18. LIM (Accession NM_006457) is another VGAM766 host target gene. LIM BINDING SITE is HOST TARGET binding site found in the 3' untranslated region of mRNA encoded by LIM, corresponding to a HOST TARGET binding site such as BINDING SITE I, BINDING SITE II or BINDING SITE III.

Table 2 illustrates the complementarity of the nucleotide sequences of LIM BINDING SITE, designated SEQ ID:13178, to the nucleotide sequence of VGAM766 RNA, herein designated VGAM RNA, also designated SEQ ID:3477.

Another function of VGAM766 is therefore inhibition of LIM (Accession NM_006457). Accordingly, utilities of VGAM766 include diagnosis, prevention and treatment of diseases and clinical conditions associated with LIM. LRG (Accession NM_052972) is another VGAM766 host target gene. LRG BINDING SITE is HOST TARGET binding site found in the 3' untranslated region of mRNA encoded by LRG, corresponding to a HOST TARGET binding site such as BINDING SITE I, BINDING SITE II or BINDING SITE III. Table 2 illustrates the complementarity of the nucleotide sequences of LRG BINDING SITE, designated SEQ ID:27546, to the nucleotide sequence of VGAM766 RNA, herein designated VGAM RNA, also designated SEQ ID:3477.

Another function of VGAM766 is therefore inhibition of LRG (Accession NM_052972). Accordingly, utilities of VGAM766 include diagnosis, prevention and treatment of diseases and clinical conditions associated with LRG. Mesoderm Development Candidate 2 (MESDC2, Accession XM_051854) is another VGAM766 host target gene. MESDC2 BINDING SITE is HOST TARGET binding site found in the 3' untranslated region of mRNA encoded by MESDC2, corresponding to a HOST TARGET binding site such as BINDING SITE I, BINDING SITE II or BINDING SITE III. Table 2 illustrates the complementarity of the nucleotide sequences of MESDC2 BINDING SITE, designated SEQ ID:35893, to the nucleotide sequence of VGAM766 RNA, herein designated VGAM RNA, also designated SEQ ID:3477.

Another function of VGAM766 is therefore inhibition of Mesoderm Development Candidate 2 (MESDC2, Accession XM_051854). Accordingly, utilities of VGAM766 include diagnosis, prevention and treatment of diseases and clinical conditions associated with MESDC2. MGC14407 (Accession NM_032908) is another VGAM766 host target gene. MGC14407 BINDING SITE is HOST TARGET binding site found in the 3' untranslated region of mRNA encoded by MGC14407, corresponding to a HOST TARGET binding site such as BINDING SITE I, BINDING SITE II or BINDING SITE III. Table 2 illustrates the complementarity of the nucleotide sequences of MGC14407 BINDING SITE, designated SEQ ID:26728, to the nucleotide sequence of VGAM766 RNA, herein designated VGAM RNA, also designated SEQ ID:3477.

Another function of VGAM766 is therefore inhibition of MGC14407 (Accession NM_032908). Accordingly, utilities of VGAM766 include diagnosis, prevention and treatment of diseases and clinical conditions associated with MGC14407. MGC2562 (Accession NM_032374) is another VGAM766 host target gene. MGC2562 BINDING SITE1 and MGC2562 BINDING SITE2 are HOST TARGET binding sites found in untranslated regions of mRNA encoded by MGC2562, corresponding to HOST TARGET binding sites such as BINDING SITE I, BINDING SITE II or BINDING SITE III. Table 2 illustrates the complementarity of the nucleotide sequences of MGC2562 BINDING SITE1 and MGC2562 BINDING SITE2, designated SEQ ID:26162 and SEQ ID:26164 respectively, to the nucleotide sequence of VGAM766 RNA, herein designated VGAM RNA, also designated SEQ ID:3477.

Another function of VGAM766 is therefore inhibition of MGC2562 (Accession NM_032374). Accordingly, utilities of VGAM766 include diagnosis, prevention and treatment of diseases and clinical conditions associated with MGC2562. MGC4840 (Accession XM_049476) is another VGAM766 host target gene. MGC4840 BINDING SITE is HOST TARGET binding site found in the 3' untranslated region of mRNA encoded by MGC4840, corresponding to a HOST TARGET binding site such as BINDING SITE I, BINDING SITE II or BINDING SITE III. Table 2 illustrates the complementarity of the nucleotide sequences of MGC4840 BINDING SITE, designated SEQ ID:35439, to the nucleotide sequence of VGAM766 RNA, herein designated VGAM RNA, also designated SEQ ID:3477.

Another function of VGAM766 is therefore inhibition of MGC4840 (Accession XM_049476). Accordingly, utilities of VGAM766 include diagnosis, prevention and treatment of diseases and clinical conditions associated with MGC4840. PRO0478 (Accession NM_014129) is another VGAM766 host target gene. PRO0478 BINDING SITE is HOST TARGET binding site found in the 5' untranslated region of mRNA encoded by PRO0478, corresponding to a HOST TARGET binding site such as BINDING SITE I, BINDING SITE II or BINDING SITE III. Table 2 illustrates the complementarity of the nucleotide sequences of PRO0478 BINDING SITE, designated SEQ ID:15397, to the nucleotide sequence of VGAM766 RNA, herein designated VGAM RNA, also designated SEQ ID:3477.

Another function of VGAM766 is therefore inhibition of PRO0478 (Accession NM_014129). Accordingly, utilities of VGAM766 include diagnosis, prevention and treatment of diseases and clinical conditions associated with PRO0478. Rpo1-2 (Accession NM_019014) is another VGAM766 host target gene. Rpo1-2 BINDING SITE1 and Rpo1-2 BINDING SITE2 are HOST TARGET binding sites found in untranslated regions of mRNA encoded by Rpo1-2, corresponding to HOST TARGET binding sites such as BINDING SITE I, BINDING SITE II or BINDING SITE III. Table 2 illustrates the complementarity of the nucleotide sequences of Rpo1-2 BINDING SITE1 and Rpo1-2 BINDING SITE2, designated SEQ ID:21102 and SEQ ID:21103 respectively, to the nucleotide sequence of VGAM766 RNA, herein designated VGAM RNA, also designated SEQ ID:3477.

Another function of VGAM766 is therefore inhibition of Rpo1-2 (Accession NM_019014). Accordingly, utilities of VGAM766 include diagnosis, prevention and treatment of diseases and clinical conditions associated with Rpo1-2. Sodium Channel, Voltage-gated, Type XII, Alpha Polypeptide (SCN12A, Accession NM_014139) is another VGAM766 host target gene. SCN12A BINDING SITE is HOST TARGET binding site found in the 3' untranslated region of mRNA encoded by SCN12A, corresponding to a HOST TARGET binding site such as BINDING SITE I, BINDING SITE II or BINDING SITE III. Table 2 illustrates the complementarity of the nucleotide sequences of SCN12A BINDING SITE, designated SEQ ID:15409, to the nucleotide sequence of VGAM766 RNA, herein designated VGAM RNA, also designated SEQ ID:3477.

Another function of VGAM766 is therefore inhibition of Sodium Channel, Voltage-gated, Type XII, Alpha Polypeptide (SCN12A, Accession NM_014139). Accordingly, utilities of VGAM766 include diagnosis, prevention and treatment of diseases and clinical conditions associated with SCN12A. Serine Palmitoyltransferase, Long Chain Base Subunit 2 (SPTLC2, Accession NM_004863) is another VGAM766 host target gene. SPTLC2 BINDING SITE is HOST TARGET binding site found in the 3' untranslated region of mRNA encoded by SPTLC2, corresponding to a HOST TARGET binding site such as BINDING SITE I, BINDING SITE II or BINDING SITE III. Table 2 illustrates the complementarity of the nucleotide sequences of SPTLC2 BINDING SITE, designated SEQ ID:11281, to the nucleotide sequence of VGAM766 RNA, herein designated VGAM RNA, also designated SEQ ID:3477.

Another function of VGAM766 is therefore inhibition of Serine Palmitoyltransferase, Long Chain Base Subunit 2 (SPTLC2, Accession NM_004863). Accordingly, utilities of VGAM766 include diagnosis, prevention and treatment of diseases and clinical conditions associated with SPTLC2. TRIAD3 (Accession XM_170517) is another VGAM766 host target gene. TRIAD3 BINDING SITE is HOST TARGET binding site found in the 3' untranslated region of mRNA encoded by TRIAD3, corresponding to a HOST TARGET binding site such as BINDING SITE I, BINDING SITE II or BINDING SITE III. Table 2 illustrates the complementarity of the nucleotide sequences of TRIAD3 BINDING SITE, designated SEQ ID:45347, to the nucleotide sequence of VGAM766 RNA, herein designated VGAM RNA, also designated SEQ ID:3477.

Another function of VGAM766 is therefore inhibition of TRIAD3 (Accession XM_170517). Accordingly, utilities of VGAM766 include diagnosis, prevention and treatment of diseases and clinical conditions associated with TRIAD3. Williams-Beuren Syndrome Chromosome Region 23 (WBSCR23, Accession NM_025042) is another VGAM766 host target gene. WBSCR23 BINDING SITE is HOST TARGET binding site found in the 3' untranslated region of mRNA encoded by WBSCR23, corresponding to a HOST TARGET binding site such as BINDING SITE I, BINDING SITE II or BINDING SITE III. Table 2 illustrates the complementarity of the nucleotide sequences of WBSCR23 BINDING SITE, designated SEQ ID:24640, to the nucleotide sequence of VGAM766 RNA, herein designated VGAM RNA, also designated SEQ ID:3477.

Another function of VGAM766 is therefore inhibition of Williams-Beuren Syndrome Chromosome Region 23 (WBSCR23, Accession NM_025042). Accordingly, utilities of VGAM766 include diagnosis, prevention and treatment of diseases and clinical conditions associated with WBSCR23. WSB1 (Accession NM_134264) is another VGAM766 host target gene. WSB1 BINDING SITE1 and WSB1 BINDING SITE2 are HOST TARGET binding sites found in untranslated regions of mRNA encoded by WSB1, corresponding to HOST TARGET binding sites such as BINDING SITE I, BINDING SITE II or BINDING SITE III. Table 2 illustrates the complementarity of the nucleotide sequences of WSB1 BINDING SITE1 and WSB1 BINDING SITE2, designated SEQ ID:28615 and SEQ ID:28621 respectively, to the nucleotide sequence of VGAM766 RNA, herein designated VGAM RNA, also designated SEQ ID:3477.

Another function of VGAM766 is therefore inhibition of WSB1 (Accession NM_134264). Accordingly, utilities of VGAM766 include diagnosis, prevention and treatment of diseases and clinical conditions associated with WSB1. LOC115129 (Accession XM_055292) is another VGAM766 host target gene. LOC115129 BINDING SITE is HOST TARGET binding site found in the 5' untranslated region of mRNA encoded by LOC115129, corresponding to a HOST TARGET binding site such as BINDING SITE I, BINDING SITE II or BINDING SITE III. Table 2 illustrates the complementarity of the nucleotide sequences of LOC115129 BINDING SITE, designated SEQ ID:36251, to the nucleotide sequence of VGAM766 RNA, herein designated VGAM RNA, also designated SEQ ID:3477.

Another function of VGAM766 is therefore inhibition of LOC115129 (Accession XM_055292). Accordingly, utilities of VGAM766 include diagnosis, prevention and treatment of diseases and clinical conditions associated with LOC115129. LOC127428 (Accession XM_059144) is another VGAM766 host target gene. LOC127428 BINDING SITE is HOST TARGET binding site found in the 3' untranslated region of mRNA encoded by LOC127428, corresponding to a HOST TARGET binding site such as BINDING SITE I, BINDING SITE II or BINDING SITE III. Table 2 illustrates the complementarity of the nucleotide sequences of LOC127428 BINDING SITE, designated SEQ ID:36896, to the nucleotide sequence of VGAM766 RNA, herein designated VGAM RNA, also designated SEQ ID:3477.

Another function of VGAM766 is therefore inhibition of LOC127428 (Accession XM_059144). Accordingly, utilities of VGAM766 include diagnosis, prevention and treatment of diseases and clinical conditions associated with LOC127428. LOC134147 (Accession NM_138809) is another VGAM766 host target gene. LOC134147 BINDING SITE is HOST TARGET binding site found in the 3' untranslated region of mRNA encoded by LOC134147, corresponding to a HOST TARGET binding site such as BINDING SITE I, BINDING SITE II or BINDING SITE III. Table 2 illustrates the complementarity of the nucleotide sequences of LOC134147 BINDING SITE, designated SEQ ID:29031, to the nucleotide sequence of VGAM766 RNA, herein designated VGAM RNA, also designated SEQ ID:3477.

Another function of VGAM766 is therefore inhibition of LOC134147 (Accession NM_138809). Accordingly, utilities of VGAM766 include diagnosis, prevention and treatment of diseases and clinical conditions associated with LOC134147. LOC145988 (Accession XM_085290) is another VGAM766 host target gene. LOC145988 BINDING SITE is HOST TARGET binding site found in the 5' untranslated region of mRNA encoded by LOC145988, corresponding to a HOST TARGET binding site such as BINDING SITE I, BINDING SITE II or BINDING SITE III. Table 2 illustrates the complementarity of the nucleotide sequences of LOC145988 BINDING SITE, designated SEQ ID:38038, to the nucleotide sequence of VGAM766 RNA, herein designated VGAM RNA, also designated SEQ ID:3477.

Another function of VGAM766 is therefore inhibition of LOC145988 (Accession XM_085290). Accordingly, utilities of VGAM766 include diagnosis, prevention and treatment of diseases and clinical conditions associated with LOC145988. LOC146229 (Accession XM_085387) is another VGAM766 host target gene. LOC146229 BINDING SITE is HOST TARGET binding site found in the 3' untranslated region of mRNA encoded by LOC146229, corresponding to a HOST TARGET binding site such as BINDING SITE I, BINDING SITE II or BINDING SITE III. Table 2 illustrates the complementarity of the nucleotide sequences of LOC146229 BINDING SITE, designated SEQ ID:38110, to the nucleotide sequence of VGAM766 RNA, herein designated VGAM RNA, also designated SEQ ID:3477.

Another function of VGAM766 is therefore inhibition of LOC146229 (Accession XM_085387). Accordingly, utilities of VGAM766 include diagnosis, prevention and treatment of diseases and clinical conditions associated with LOC146229. LOC147837 (Accession XM_085915) is another VGAM766 host target gene. LOC147837 BINDING SITE is HOST TARGET binding site found in the 3' untranslated region of mRNA encoded by LOC147837, corresponding to a HOST TARGET binding site such as BINDING SITE I, BINDING SITE II or BINDING SITE III. Table 2 illustrates the complementarity of the nucleotide sequences of LOC147837 BINDING SITE, designated SEQ ID:38393, to the nucleotide sequence of VGAM766 RNA, herein designated VGAM RNA, also designated SEQ ID:3477.

Another function of VGAM766 is therefore inhibition of LOC147837 (Accession XM_085915). Accordingly, utilities of VGAM766 include diagnosis, prevention and treatment of diseases and clinical conditions associated with LOC147837.

LOC148147 (Accession XM_086071) is another VGAM766 host target gene. LOC148147 BINDING SITE is HOST TARGET binding site found in the 3' untranslated region of mRNA encoded by LOC148147, corresponding to a HOST TARGET binding site such as BINDING SITE I, BINDING SITE II or BINDING SITE III. Table 2 illustrates the complementarity of the nucleotide sequences of LOC148147 BINDING SITE, designated SEQ ID:38476, to the nucleotide sequence of VGAM766 RNA, herein designated VGAM RNA, also designated SEQ ID:3477.

Another function of VGAM766 is therefore inhibition of LOC148147 (Accession XM_086071). Accordingly, utilities of VGAM766 include diagnosis, prevention and treatment of diseases and clinical conditions associated with LOC148147.

LOC148254 (Accession XM_086121) is another VGAM766 host target gene. LOC148254 BINDING SITE is HOST TARGET binding site found in the 3' untranslated region of mRNA encoded by LOC148254, corresponding to a HOST TARGET binding site such as BINDING SITE I, BINDING SITE II or BINDING SITE III. Table 2 illustrates the complementarity of the nucleotide sequences of LOC148254 BINDING SITE, designated SEQ ID:38502, to the nucleotide sequence of VGAM766 RNA, herein designated VGAM RNA, also designated SEQ ID:3477.

Another function of VGAM766 is therefore inhibition of LOC148254 (Accession XM_086121). Accordingly, utilities of VGAM766 include diagnosis, prevention and treatment of diseases and clinical conditions associated with LOC148254.

LOC149705 (Accession XM_097711) is another VGAM766 host target gene. LOC149705 BINDING SITE is HOST TARGET binding site found in the 3' untranslated region of mRNA encoded by LOC149705, corresponding to a HOST TARGET binding site such as BINDING SITE I, BINDING SITE II or BINDING SITE III. Table 2 illustrates the complementarity of the nucleotide sequences of LOC149705 BINDING SITE, designated SEQ ID:41052, to the nucleotide sequence of VGAM766 RNA, herein designated VGAM RNA, also designated SEQ ID:3477.

Another function of VGAM766 is therefore inhibition of LOC149705 (Accession XM_097711). Accordingly, utilities of VGAM766 include diagnosis, prevention and treatment of diseases and clinical conditions associated with LOC149705.

LOC150245 (Accession XM_097843) is another VGAM766 host target gene. LOC150245 BINDING SITE is HOST TARGET binding site found in the 3' untranslated region of mRNA encoded by LOC150245, corresponding to a HOST TARGET binding site such as BINDING SITE I, BINDING SITE II or BINDING SITE III. Table 2 illustrates the complementarity of the nucleotide sequences of LOC150245 BINDING SITE, designated SEQ ID:41162, to the nucleotide sequence of VGAM766 RNA, herein designated VGAM RNA, also designated SEQ ID:3477.

Another function of VGAM766 is therefore inhibition of LOC150245 (Accession XM_097843). Accordingly, utilities of VGAM766 include diagnosis, prevention and treatment of diseases and clinical conditions associated with LOC150245.

LOC150481 (Accession XM_086929) is another VGAM766 host target gene. LOC150481 BINDING SITE is HOST TARGET binding site found in the 3' untranslated region of mRNA encoded by LOC150481, corresponding to a HOST TARGET binding site such as BINDING SITE I, BINDING SITE II or BINDING SITE III. Table 2 illustrates the complementarity of the nucleotide sequences of LOC150481 BINDING SITE, designated SEQ ID:38980, to the nucleotide sequence of VGAM766 RNA, herein designated VGAM RNA, also designated SEQ ID:3477.

Another function of VGAM766 is therefore inhibition of LOC150481 (Accession XM_086929). Accordingly, utilities of VGAM766 include diagnosis, prevention and treatment of diseases and clinical conditions associated with LOC150481.

LOC151248 (Accession XM_087143) is another VGAM766 host target gene. LOC151248 BINDING SITE is HOST TARGET binding site found in the 3' untranslated region of mRNA encoded by LOC151248, corresponding to a HOST TARGET binding site such as BINDING SITE I, BINDING SITE II or BINDING SITE III. Table 2 illustrates the complementarity of the nucleotide sequences of LOC151248 BINDING SITE, designated SEQ ID:39088, to the nucleotide sequence of VGAM766 RNA, herein designated VGAM RNA, also designated SEQ ID:3477.

Another function of VGAM766 is therefore inhibition of LOC151248 (Accession XM_087143). Accordingly, utilities of VGAM766 include diagnosis, prevention and treatment of diseases and clinical conditions associated with LOC151248.

LOC152426 (Accession XM_098225) is another VGAM766 host target gene. LOC152426 BINDING SITE is HOST TARGET binding site found in the 3' untranslated region of mRNA encoded by LOC152426, corresponding to a HOST TARGET binding site such as BINDING SITE I, BINDING SITE II or BINDING SITE III. Table 2 illustrates the complementarity of the nucleotide sequences of LOC152426 BINDING SITE, designated SEQ ID:41499, to the nucleotide sequence of VGAM766 RNA, herein designated VGAM RNA, also designated SEQ ID:3477.

Another function of VGAM766 is therefore inhibition of LOC152426 (Accession XM_098225). Accordingly, utilities of VGAM766 include diagnosis, prevention and treatment of diseases and clinical conditions associated with LOC152426.

LOC153727 (Accession XM_098422) is another VGAM766 host target gene. LOC153727 BINDING SITE is HOST TARGET binding site found in the 3' untranslated region of mRNA encoded by LOC153727, corresponding to a HOST TARGET binding site such as BINDING SITE I, BINDING SITE II or BINDING SITE III. Table 2 illustrates the complementarity of the nucleotide sequences of LOC153727 BINDING SITE, designated SEQ ID:41681, to the nucleotide sequence of VGAM766 RNA, herein designated VGAM RNA, also designated SEQ ID:3477.

Another function of VGAM766 is therefore inhibition of LOC153727 (Accession XM_098422). Accordingly, utilities of VGAM766 include diagnosis, prevention and treatment of diseases and clinical conditions associated with LOC153727.

LOC155006 (Accession XM_088117) is another VGAM766 host target gene. LOC155006 BINDING SITE is HOST TARGET binding site found in the 3' untranslated region of mRNA encoded by LOC155006, corresponding to a HOST TARGET binding site such as BINDING SITE I, BINDING SITE II or BINDING SITE III. Table 2 illustrates the complementarity of the nucleotide sequences of LOC155006 BINDING SITE, designated SEQ ID:39526, to the nucleotide sequence of VGAM766 RNA, herein designated VGAM RNA, also designated SEQ ID:3477.

Another function of VGAM766 is therefore inhibition of LOC155006 (Accession XM_088117). Accordingly, utilities of VGAM766 include diagnosis, prevention and treatment of diseases and clinical conditions associated with LOC155006.

LOC158088 (Accession XM_098872) is another VGAM766 host target gene. LOC158088 BINDING SITE is HOST TARGET binding site found in the 3' untranslated region of mRNA encoded by LOC158088, corresponding to a HOST TARGET binding site such as BINDING SITE I, BINDING SITE II or BINDING SITE III. Table 2 illustrates the complementarity of the nucleotide sequences of LOC158088 BINDING SITE, designated SEQ ID:41917, to the nucleotide sequence of VGAM766 RNA, herein designated VGAM RNA, also designated SEQ ID:3477.

Another function of VGAM766 is therefore inhibition of LOC158088 (Accession XM_098872). Accordingly, utilities of VGAM766 include diagnosis, prevention and treatment of diseases and clinical conditions associated with LOC158088. LOC158677 (Accession XM_098976) is another VGAM766 host target gene. LOC158677 BINDING SITE is HOST TARGET binding site found in the 5' untranslated region of mRNA encoded by LOC158677, corresponding to a HOST TARGET binding site such as BINDING SITE I, BINDING SITE II or BINDING SITE III. Table 2 illustrates the complementarity of the nucleotide sequences of LOC158677 BINDING SITE, designated SEQ ID:42023, to the nucleotide sequence of VGAM766 RNA, herein designated VGAM RNA, also designated SEQ ID:3477.

Another function of VGAM766 is therefore inhibition of LOC158677 (Accession XM_098976). Accordingly, utilities of VGAM766 include diagnosis, prevention and treatment of diseases and clinical conditions associated with LOC158677. LOC158819 (Accession XM_098995) is another VGAM766 host target gene. LOC158819 BINDING SITE is HOST TARGET binding site found in the 3' untranslated region of mRNA encoded by LOC158819, corresponding to a HOST TARGET binding site such as BINDING SITE I, BINDING SITE II or BINDING SITE III. Table 2 illustrates the complementarity of the nucleotide sequences of LOC158819 BINDING SITE, designated SEQ ID:42026, to the nucleotide sequence of VGAM766 RNA, herein designated VGAM RNA, also designated SEQ ID:3477.

Another function of VGAM766 is therefore inhibition of LOC158819 (Accession XM_098995). Accordingly, utilities of VGAM766 include diagnosis, prevention and treatment of diseases and clinical conditions associated with LOC158819. LOC159036 (Accession XM_099018) is another VGAM766 host target gene. LOC159036 BINDING SITE is HOST TARGET binding site found in the 3' untranslated region of mRNA encoded by LOC159036, corresponding to a HOST TARGET binding site such as BINDING SITE I, BINDING SITE II or BINDING SITE III. Table 2 illustrates the complementarity of the nucleotide sequences of LOC159036 BINDING SITE, designated SEQ ID:42054, to the nucleotide sequence of VGAM766 RNA, herein designated VGAM RNA, also designated SEQ ID:3477.

Another function of VGAM766 is therefore inhibition of LOC159036 (Accession XM_099018). Accordingly, utilities of VGAM766 include diagnosis, prevention and treatment of diseases and clinical conditions associated with LOC159036. LOC200251 (Accession XM_114173) is another VGAM766 host target gene. LOC200251 BINDING SITE is HOST TARGET binding site found in the 5' untranslated region of mRNA encoded by LOC200251, corresponding to a HOST TARGET binding site such as BINDING SITE I, BINDING SITE II or BINDING SITE III. Table 2 illustrates the complementarity of the nucleotide sequences of LOC200251 BINDING SITE, designated SEQ ID:42756, to the nucleotide sequence of VGAM766 RNA, herein designated VGAM RNA, also designated SEQ ID:3477.

Another function of VGAM766 is therefore inhibition of LOC200251 (Accession XM_114173). Accordingly, utilities of VGAM766 include diagnosis, prevention and treatment of diseases and clinical conditions associated with LOC200251. LOC201220 (Accession XM_113321) is another VGAM766 host target gene. LOC201220 BINDING SITE is HOST TARGET binding site found in the 3' untranslated region of mRNA encoded by LOC201220, corresponding to a HOST TARGET binding site such as BINDING SITE I, BINDING SITE II or BINDING SITE III. Table 2 illustrates the complementarity of the nucleotide sequences of LOC201220 BINDING SITE, designated SEQ ID:42224, to the nucleotide sequence of VGAM766 RNA, herein designated VGAM RNA, also designated SEQ ID:3477.

Another function of VGAM766 is therefore inhibition of LOC201220 (Accession XM_113321). Accordingly, utilities of VGAM766 include diagnosis, prevention and treatment of diseases and clinical conditions associated with LOC201220. LOC201895 (Accession XM_114396) is another VGAM766 host target gene. LOC201895 BINDING SITE is HOST TARGET binding site found in the 3' untranslated region of mRNA encoded by LOC201895, corresponding to a HOST TARGET binding site such as BINDING SITE I, BINDING SITE II or BINDING SITE III. Table 2 illustrates the complementarity of the nucleotide sequences of LOC201895 BINDING SITE, designated SEQ ID:42926, to the nucleotide sequence of VGAM766 RNA, herein designated VGAM RNA, also designated SEQ ID:3477.

Another function of VGAM766 is therefore inhibition of LOC201895 (Accession XM_114396). Accordingly, utilities of VGAM766 include diagnosis, prevention and treatment of diseases and clinical conditions associated with LOC201895. LOC203378 (Accession XM_117541) is another VGAM766 host target gene. LOC203378 BINDING SITE is HOST TARGET binding site found in the 3' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43553, to the nucleotide sequence of VGAM766 RNA, herein designated VGAM RNA, also designated SEQ ID:3477.

Another function of VGAM766 is therefore inhibition of LOC203378 (Accession XM_117541). Accordingly, utilities of VGAM766 include diagnosis, prevention and treatment of diseases and clinical conditions associated with LOC203378. LOC220662 (Accession XM_165978) is another VGAM766 host target gene. LOC220662 BINDING SITE is HOST TARGET binding site found in the 3' untranslated region of mRNA encoded by LOC220662, corresponding to a HOST TARGET binding site such as BINDING SITE I, BINDING SITE II or BINDING SITE III. Table 2 illustrates the complementarity of the nucleotide sequences of LOC220662 BINDING SITE, designated SEQ ID:43823, to the nucleotide sequence of VGAM766 RNA, herein designated VGAM RNA, also designated SEQ ID:3477.

Another function of VGAM766 is therefore inhibition of LOC220662 (Accession XM_165978). Accordingly, utilities of VGAM766 include diagnosis, prevention and treatment of diseases and clinical conditions associated with LOC220662. LOC221477 (Accession XM_166397) is another VGAM766 host target gene. LOC221477 BINDING SITE is HOST TARGET binding site found in the 3' untranslated region of mRNA encoded by LOC221477, corresponding to a HOST TARGET binding site such as BINDING SITE I, BINDING SITE II or BINDING SITE III. Table 2 illustrates the complementarity of the nucleotide sequences of LOC221477 BINDING SITE, designated SEQ ID:44254, to the nucleotide sequence of VGAM766 RNA, herein designated VGAM RNA, also designated SEQ ID:3477.

Another function of VGAM766 is therefore inhibition of LOC221477 (Accession XM_166397). Accordingly, utilities of VGAM766 include diagnosis, prevention and treatment of diseases and clinical conditions associated with LOC221477.

LOC221543 (Accession XM_168091) is another VGAM766 host target gene. LOC221543 BINDING SITE is HOST TARGET binding site found in the 5' untranslated region of mRNA encoded by LOC221543, corresponding to a HOST TARGET binding site such as BINDING SITE I, BINDING SITE II or BINDING SITE III. Table 2 illustrates the complementarity of the nucleotide sequences of LOC221543 BINDING SITE, designated SEQ ID:45013, to the nucleotide sequence of VGAM766 RNA, herein designated VGAM RNA, also designated SEQ ID:3477.

Another function of VGAM766 is therefore inhibition of LOC221543 (Accession XM_168091). Accordingly, utilities of VGAM766 include diagnosis, prevention and treatment of diseases and clinical conditions associated with LOC221543.

LOC221755 (Accession XM_166465) is another VGAM766 host target gene. LOC221755 BINDING SITE is HOST TARGET binding site found in the 3' untranslated region of mRNA encoded by LOC221755, corresponding to a HOST TARGET binding site such as BINDING SITE I, BINDING SITE II or BINDING SITE III. Table 2 illustrates the complementarity of the nucleotide sequences of LOC221755 BINDING SITE, designated SEQ ID:44386, to the nucleotide sequence of VGAM766 RNA, herein designated VGAM RNA, also designated SEQ ID:3477.

Another function of VGAM766 is therefore inhibition of LOC221755 (Accession XM_166465). Accordingly, utilities of VGAM766 include diagnosis, prevention and treatment of diseases and clinical conditions associated with LOC221755.

LOC254122 (Accession XM_170660) is another VGAM766 host target gene. LOC254122 BINDING SITE is HOST TARGET binding site found in the 3' untranslated region of mRNA encoded by LOC254122, corresponding to a HOST TARGET binding site such as BINDING SITE I, BINDING SITE II or BINDING SITE III. Table 2 illustrates the complementarity of the nucleotide sequences of LOC254122 BINDING SITE, designated SEQ ID:45436, to the nucleotide sequence of VGAM766 RNA, herein designated VGAM RNA, also designated SEQ ID:3477.

Another function of VGAM766 is therefore inhibition of LOC254122 (Accession XM_170660). Accordingly, utilities of VGAM766 include diagnosis, prevention and treatment of diseases and clinical conditions associated with LOC254122.

LOC255196 (Accession XM_173157) is another VGAM766 host target gene. LOC255196 BINDING SITE is HOST TARGET binding site found in the 3' untranslated region of mRNA encoded by LOC255196, corresponding to a HOST TARGET binding site such as BINDING SITE I, BINDING SITE II or BINDING SITE III. Table 2 illustrates the complementarity of the nucleotide sequences of LOC255196 BINDING SITE, designated SEQ ID:46413, to the nucleotide sequence of VGAM766 RNA, herein designated VGAM RNA, also designated SEQ ID:3477.

Another function of VGAM766 is therefore inhibition of LOC255196 (Accession XM_173157). Accordingly, utilities of VGAM766 include diagnosis, prevention and treatment of diseases and clinical conditions associated with LOC255196.

LOC257354 (Accession XM_170810) is another VGAM766 host target gene. LOC257354 BINDING SITE is HOST TARGET binding site found in the 3' untranslated region of mRNA encoded by LOC257354, corresponding to a HOST TARGET binding site such as BINDING SITE I, BINDING SITE II or BINDING SITE III. Table 2 illustrates the complementarity of the nucleotide sequences of LOC257354 BINDING SITE, designated SEQ ID:45576, to the nucleotide sequence of VGAM766 RNA, herein designated VGAM RNA, also designated SEQ ID:3477.

Another function of VGAM766 is therefore inhibition of LOC257354 (Accession XM_170810). Accordingly, utilities of VGAM766 include diagnosis, prevention and treatment of diseases and clinical conditions associated with LOC257354.

LOC51336 (Accession NM_016646) is another VGAM766 host target gene. LOC51336 BINDING SITE is HOST TARGET binding site found in the 3' untranslated region of mRNA encoded by LOC51336, corresponding to a HOST TARGET binding site such as BINDING SITE I, BINDING SITE II or BINDING SITE III. Table 2 illustrates the complementarity of the nucleotide sequences of LOC51336 BINDING SITE, designated SEQ ID:18757, to the nucleotide sequence of VGAM766 RNA, herein designated VGAM RNA, also designated SEQ ID:3477.

Another function of VGAM766 is therefore inhibition of LOC51336 (Accession NM_016646). Accordingly, utilities of VGAM766 include diagnosis, prevention and treatment of diseases and clinical conditions associated with LOC51336.

LOC90979 (Accession XM_035323) is another VGAM766 host target gene. LOC90979 BINDING SITE is HOST TARGET binding site found in the 3' untranslated region of mRNA encoded by LOC90979, corresponding to a HOST TARGET binding site such as BINDING SITE I, BINDING SITE II or BINDING SITE III. Table 2 illustrates the complementarity of the nucleotide sequences of LOC90979 BINDING SITE, designated SEQ ID:32232, to the nucleotide sequence of VGAM766 RNA, herein designated VGAM RNA, also designated SEQ ID:3477.

Another function of VGAM766 is therefore inhibition of LOC90979 (Accession XM_035323). Accordingly, utilities of VGAM766 include diagnosis, prevention and treatment of diseases and clinical conditions associated with LOC90979.

LOC92078 (Accession XM_042684) is another VGAM766 host target gene. LOC92078 BINDING SITE is HOST TARGET binding site found in the 3' untranslated region of mRNA encoded by LOC92078, corresponding to a HOST TARGET binding site such as BINDING SITE I, BINDING SITE II or BINDING SITE III. Table 2 illustrates the complementarity of the nucleotide sequences of LOC92078 BINDING SITE, designated SEQ ID:33743, to the nucleotide sequence of VGAM766 RNA, herein designated VGAM RNA, also designated SEQ ID:3477.

Another function of VGAM766 is therefore inhibition of LOC92078 (Accession XM_042684). Accordingly, utilities of VGAM766 include diagnosis, prevention and treatment of diseases and clinical conditions associated with LOC92078.

LOC92421 (Accession XM_044996) is another VGAM766 host target gene. LOC92421 BINDING SITE is HOST TARGET binding site found in the 3' untranslated region of mRNA encoded by LOC92421, corresponding to a HOST TARGET binding site such as BINDING SITE I, BINDING SITE II or BINDING SITE III. Table 2 illustrates the complementarity of the nucleotide sequences of LOC92421 BINDING SITE, designated SEQ ID:34310, to the nucleotide sequence of VGAM766 RNA, herein designated VGAM RNA, also designated SEQ ID:3477.

Another function of VGAM766 is therefore inhibition of LOC92421 (Accession XM_044996). Accordingly, utilities of VGAM766 include diagnosis, prevention and treatment of diseases and clinical conditions associated with LOC92421.

LOC92771 (Accession NM_033424) is another VGAM766 host target gene. LOC92771 BINDING SITE is HOST TARGET binding site found in the 3' untranslated region of mRNA encoded by LOC92771, corresponding to a HOST TARGET binding site such as BINDING SITE I, BINDING SITE II or BINDING SITE III. Table 2 illustrates the complementarity of the nucleotide sequences of LOC92771 BINDING SITE, designated SEQ ID:27249, to the nucleotide sequence of VGAM766 RNA, herein designated VGAM RNA, also designated SEQ ID:3477.

Another function of VGAM766 is therefore inhibition of LOC92771 (Accession NM_033424). Accordingly, utilities of VGAM766 include diagnosis, prevention and treatment of diseases and clinical conditions associated with LOC92771. LOC93132 (Accession XM_049396) is another VGAM766 host target gene. LOC93132 BINDING SITE is HOST TARGET binding site found in the 5' untranslated region of mRNA encoded by LOC93132, corresponding to a HOST TARGET binding site such as BINDING SITE I, BINDING SITE II or BINDING SITE III. Table 2 illustrates the complementarity of the nucleotide sequences of LOC93132 BINDING SITE, designated SEQ ID:35409, to the nucleotide sequence of VGAM766 RNA, herein designated VGAM RNA, also designated SEQ ID:3477.

Another function of VGAM766 is therefore inhibition of LOC93132 (Accession XM_049396). Accordingly, utilities of VGAM766 include diagnosis, prevention and treatment of diseases and clinical conditions associated with LOC93132. FIG. 1 further provides a conceptual description of a novel bioinformatically detected viral gene of the present invention, referred to here as Viral Genomic Address Messenger 767 (VGAM767) viral gene, which modulates expression of respective host target genes thereof, the function and utility of which host target genes is known in the art.

VGAM767 is a novel bioinformatically detected regulatory, non protein coding, viral micro RNA (miRNA) gene. The method by which VGAM767 was detected is described hereinabove with reference to FIGS. 1-8.

VGAM767 gene, herein designated VGAM GENE, is a viral gene contained in the genome of Bovine Coronavirus. VGAM767 host target gene, herein designated VGAM HOST TARGET GENE, is a human gene contained in the human genome.

VGAM767 gene encodes a VGAM767 precursor RNA, herein designated VGAM PRECURSOR RNA. Similar to other miRNA genes, and unlike most ordinary genes, VGAM767 precursor RNA does not encode a protein. A nucleotide sequence identical or highly similar to the nucleotide sequence of VGAM767 precursor RNA is designated SEQ ID:753, and is provided hereinbelow with reference to the sequence listing part. Nucleotide sequence SEQ ID:753 is located at position 6557 relative to the genome of Bovine Coronavirus.

VGAM767 precursor RNA folds onto itself, forming VGAM767 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM767 folded precursor RNA into VGAM767 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 68%) nucleotide sequence of VGAM767 RNA is designated SEQ ID:3478, and is provided hereinbelow with reference to the sequence listing part.

VGAM767 host target gene, herein designated VGAM HOST TARGET GENE, encodes a corresponding messenger RNA, VGAM767 host target RNA, herein designated VGAM HOST TARGET RNA. VGAM767 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM767 RNA, herein designated VGAM RNA, binds complementarily to one or more host target binding sites located in untranslated regions of VGAM767 host target RNA, herein designated VGAM HOST TARGET RNA. This complementary binding is due to the fact that the nucleotide sequence of VGAM767 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM767 RNA, herein designated VGAM RNA, may have a different number of host target binding sites in untranslated regions of a VGAM767 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM767 RNA, herein designated VGAM RNA, to host target binding sites on VGAM767 host target RNA, herein designated VGAM HOST TARGET RNA, such as BINDING SITE I, BINDING SITE II and BINDING SITE III, inhibits translation of VGAM767 host target RNA into VGAM767 host target protein, herein designated VGAM HOST TARGET PROTEIN. VGAM host target protein is therefore outlined by a broken line.

It is appreciated that VGAM767 host target gene, herein designated VGAM HOST TARGET GENE, in fact represents a plurality of VGAM767 host target genes. The mRNA of each one of this plurality of VGAM767 host target genes comprises one or more host target binding sites, each having a nucleotide sequence which is at least partly complementary to VGAM767 RNA, herein designated VGAM RNA, and which when bound by VGAM767 RNA causes inhibition of translation of respective one or more VGAM767 host target proteins.

It is further appreciated by one skilled in the art that the mode of translational inhibition illustrated by FIG. 1 with specific reference to translational inhibition exerted by VGAM767 gene, herein designated VGAM GENE, on one or more VGAM767 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM767 is inhibition of expression of host target genes, as part of a novel viral mechanism of attacking a host. Accordingly, utilities of VGAM767 include diagnosis, prevention and treatment of viral infection by Bovine Coronavirus. Specific functions, and accordingly utilities, of VGAM767 correlate with, and may be deduced from, the identity of the host target genes which VGAM767 binds and inhibits, and the function of these host target genes, as elaborated hereinbelow.

Nucleotide sequences of the VGAM767 precursor RNA, herein designated VGAM PRECURSOR RNA, and of the 'diced' VGAM767 RNA, herein designated VGAM RNA, and a schematic representation of the secondary folding of VGAM767 folded precursor RNA, herein designated VGAM FOLDED PRECURSOR RNA, of VGAM767 are further described hereinbelow with reference to Table 1.

Nucleotide sequences of host target binding sites, such as BINDING SITE-I, BINDING SITE-II and BINDING SITE-III of FIG. 1, found on VGAM767 host target RNA, and schematic representation of the complementarity of each of these host target binding sites to VGAM767 RNA, herein designated VGAM RNA, are described hereinbelow with reference to Table 2.

As mentioned hereinabove with reference to FIG. 1, a function of VGAM767 gene, herein designated VGAM is inhibition of expression of VGAM767 target genes. It is appreciated that specific functions, and accordingly utilities, of VGAM767 correlate with, and may be deduced from, the identity of the target genes which VGAM767 binds and inhibits, and the function of these target genes, as elaborated hereinbelow.

LOC93587 (Accession XM_052377) is a VGAM767 host target gene. LOC93587 BINDING SITE is HOST TARGET binding site found in the 3' untranslated region of mRNA encoded by LOC93587, corresponding to a HOST TARGET binding site such as BINDING SITE I, BINDING SITE II or BINDING SITE III. Table 2 illustrates the complementarity of the nucleotide sequences of LOC93587 BINDING SITE, designated SEQ ID:35963, to the nucleotide sequence of VGAM767 RNA, herein designated VGAM RNA, also designated SEQ ID:3478.

A function of VGAM767 is therefore inhibition of LOC93587 (Accession XM_052377). Accordingly, utilities of VGAM767 include diagnosis, prevention and treatment of diseases and clinical conditions associated with LOC93587.

FIG. 1 further provides a conceptual description of a novel bioinformatically detected viral gene of the present invention, referred to here as Viral Genomic Address Messenger 768 (VGAM768) viral gene, which modulates expression of respective host target genes thereof, the function and utility of which host target genes is known in the art.

VGAM768 is a novel bioinformatically detected regulatory, non protein coding, viral micro RNA (miRNA) gene. The method by which VGAM768 was detected is described hereinabove with reference to FIGS. 1-8.

VGAM768 gene, herein designated VGAM GENE, is a viral gene contained in the genome of Bovine Coronavirus. VGAM768 host target gene, herein designated VGAM HOST TARGET GENE, is a human gene contained in the human genome.

VGAM768 gene encodes a VGAM768 precursor RNA, herein designated VGAM PRECURSOR RNA. Similar to other miRNA genes, and unlike most ordinary genes, VGAM768 precursor RNA does not encode a protein. A nucleotide sequence identical or highly similar to the nucleotide sequence of VGAM768 precursor RNA is designated SEQ ID:754, and is provided hereinbelow with reference to the sequence listing part. Nucleotide sequence SEQ ID:754 is located at position 13125 relative to the genome of Bovine Coronavirus.

VGAM768 precursor RNA folds onto itself, forming VGAM768 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM768 folded precursor RNA into VGAM768 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM768 RNA is designated SEQ ID:3479, and is provided hereinbelow with reference to the sequence listing part.

VGAM768 host target gene, herein designated VGAM HOST TARGET GENE, encodes a corresponding messenger RNA, VGAM768 host target RNA, herein designated VGAM HOST TARGET RNA. VGAM768 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM768 RNA, herein designated VGAM RNA, binds complementarily to one or more host target binding sites located in untranslated regions of VGAM768 host target RNA, herein designated VGAM HOST TARGET RNA. This complementary binding is due to the fact that the nucleotide sequence of VGAM768 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM768 RNA, herein designated VGAM RNA, may have a different number of host target binding sites in untranslated regions of a VGAM768 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM768 RNA, herein designated VGAM RNA, to host target binding sites on VGAM768 host target RNA, herein designated VGAM HOST TARGET RNA, such as BINDING SITE I, BINDING SITE II and BINDING SITE III, inhibits translation of VGAM768 host target RNA into VGAM768 host target protein, herein designated VGAM HOST TARGET PROTEIN. VGAM host target protein is therefore outlined by a broken line.

It is appreciated that VGAM768 host target gene, herein designated VGAM HOST TARGET GENE, in fact represents a plurality of VGAM768 host target genes. The mRNA of each one of this plurality of VGAM768 host target genes comprises one or more host target binding sites, each having a nucleotide sequence which is at least partly complementary to VGAM768 RNA, herein designated VGAM RNA, and which when bound by VGAM768 RNA causes inhibition of translation of respective one or more VGAM768 host target proteins.

It is further appreciated by one skilled in the art that the mode of translational inhibition illustrated by FIG. 1 with specific reference to translational inhibition exerted by VGAM768 gene, herein designated VGAM GENE, on one or more VGAM768 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM768 is inhibition of expression of host target genes, as part of a novel viral mechanism of attacking a host. Accordingly, utilities of VGAM768 include diagnosis, prevention and treatment of viral infection by Bovine Coronavirus. Specific functions, and accordingly utilities, of VGAM768 correlate with, and may be deduced from, the identity of the host target genes which VGAM768 binds and inhibits, and the function of these host target genes, as elaborated hereinbelow.

Nucleotide sequences of the VGAM768 precursor RNA, herein designated VGAM PRECURSOR RNA, and of the 'diced' VGAM768 RNA, herein designated VGAM RNA, and a schematic representation of the secondary folding of VGAM768 folded precursor RNA, herein designated VGAM FOLDED PRECURSOR RNA, of VGAM768 are further described hereinbelow with reference to Table 1.

Nucleotide sequences of host target binding sites, such as BINDING SITE-I, BINDING SITE-II and BINDING SITE-III of FIG. 1, found on VGAM768 host target RNA, and schematic representation of the complementarity of each of these host target binding sites to VGAM768 RNA, herein designated VGAM RNA, are described hereinbelow with reference to Table 2.

As mentioned hereinabove with reference to FIG. 1, a function of VGAM768 gene, herein designated VGAM is inhibition of expression of VGAM768 target genes. It is appreciated that specific functions, and accordingly utilities, of VGAM768 correlate with, and may be deduced from, the identity of the target genes which VGAM768 binds and inhibits, and the function of these target genes, as elaborated hereinbelow.

Protein Tyrosine Phosphatase, Receptor Type, C (PTPRC, Accession NM_080923) is a VGAM768 host target gene. PTPRC BINDING SITE is HOST TARGET binding site found in the 3' untranslated region of mRNA encoded by PTPRC, corresponding to a HOST TARGET binding site such as BINDING SITE I, BINDING SITE II or BINDING SITE III. Table 2 illustrates the complementarity of the nucleotide sequences of PTPRC BINDING SITE, designated SEQ ID:28148, to the nucleotide sequence of VGAM768 RNA, herein designated VGAM RNA, also designated SEQ ID:3479.

A function of VGAM768 is therefore inhibition of Protein Tyrosine Phosphatase, Receptor Type, C (PTPRC, Accession NM_080923). Accordingly, utilities of VGAM768 include diagnosis, prevention and treatment of diseases and clinical conditions associated with PTPRC. GLP (Accession NM_018652) is another VGAM768 host target gene. GLP BINDING SITE is HOST TARGET binding site found in the 3' untranslated region of mRNA encoded by GLP, corresponding to a HOST TARGET binding site such as BINDING SITE I, BINDING SITE II or BINDING SITE III. Table 2 illustrates the complementarity of the nucleotide sequences of GLP BINDING SITE, designated SEQ ID:20722, to the nucleotide sequence of VGAM768 RNA, herein designated VGAM RNA, also designated SEQ ID:3479.

Another function of VGAM768 is therefore inhibition of GLP (Accession NM_018652). Accordingly, utilities of VGAM768 include diagnosis, prevention and treatment of diseases and clinical conditions associated with GLP. LOC220538 (Accession XM_165407) is another VGAM768 host target gene. LOC220538 BINDING SITE is HOST TARGET binding site found in the 3' untranslated region of mRNA encoded by LOC220538, corresponding to a HOST TARGET binding site such as BINDING SITE I, BINDING SITE II or BINDING SITE III. Table 2 illustrates the complementarity of the nucleotide sequences of LOC220538 BINDING SITE, designated SEQ ID:43625, to the nucleotide sequence of VGAM768 RNA, herein designated VGAM RNA, also designated SEQ ID:3479.

Another function of VGAM768 is therefore inhibition of LOC220538 (Accession XM_165407). Accordingly, utilities of VGAM768 include diagnosis, prevention and treatment of diseases and clinical conditions associated with LOC220538. LOC257286 (Accession XM_170549) is another VGAM768 host target gene. LOC257286 BINDING SITE is HOST TARGET binding site found in the 3' untranslated region of mRNA encoded by LOC257286, corresponding to a HOST TARGET binding site such as BINDING SITE I, BINDING SITE II or BINDING SITE III. Table 2 illustrates the complementarity of the nucleotide sequences of LOC257286 BINDING SITE, designated SEQ ID:45372, to the nucleotide sequence of VGAM768 RNA, herein designated VGAM RNA, also designated SEQ ID:3479.

Another function of VGAM768 is therefore inhibition of LOC257286 (Accession XM_170549). Accordingly, utilities of VGAM768 include diagnosis, prevention and treatment of diseases and clinical conditions associated with LOC257286. FIG. 1 further provides a conceptual description of a novel bioinformatically detected viral gene of the present invention, referred to here as Viral Genomic Address Messenger 769 (VGAM769) viral gene, which modulates expression of respective host target genes thereof, the function and utility of which host target genes is known in the art.

VGAM769 is a novel bioinformatically detected regulatory, non protein coding, viral micro RNA (miRNA) gene. The method by which VGAM769 was detected is described hereinabove with reference to FIGS. 1-8.

VGAM769 gene, herein designated VGAM GENE, is a viral gene contained in the genome of Bovine Coronavirus. VGAM769 host target gene, herein designated VGAM HOST TARGET GENE, is a human gene contained in the human genome.

VGAM769 gene encodes a VGAM769 precursor RNA, herein designated VGAM PRECURSOR RNA. Similar to other miRNA genes, and unlike most ordinary genes, VGAM769 precursor RNA does not encode a protein. A nucleotide sequence identical or highly similar to the nucleotide sequence of VGAM769 precursor RNA is designated SEQ ID:755, and is provided hereinbelow with reference to the sequence listing part. Nucleotide sequence SEQ ID:755 is located at position 16313 relative to the genome of Bovine Coronavirus.

VGAM769 precursor RNA folds onto itself, forming VGAM769 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM769 folded precursor RNA into VGAM769 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM769 RNA is designated SEQ ID:3480, and is provided hereinbelow with reference to the sequence listing part.

VGAM769 host target gene, herein designated VGAM HOST TARGET GENE, encodes a corresponding messenger RNA, VGAM769 host target RNA, herein designated VGAM HOST TARGET RNA. VGAM769 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM769 RNA, herein designated VGAM RNA, binds complementarily to one or more host target binding sites located in untranslated regions of VGAM769 host target RNA, herein designated VGAM HOST TARGET RNA. This complementary binding is due to the fact that the nucleotide sequence of VGAM769 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM769 RNA, herein designated VGAM RNA, may have a different number of host target binding sites in untranslated regions of a VGAM769 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM769 RNA, herein designated VGAM RNA, to host target binding sites on VGAM769 host target RNA, herein designated VGAM HOST TARGET RNA, such as BINDING SITE I, BINDING SITE II and BINDING SITE III, inhibits translation of VGAM769 host target RNA into VGAM769 host target protein, herein designated VGAM HOST TARGET PROTEIN. VGAM host target protein is therefore outlined by a broken line.

It is appreciated that VGAM769 host target gene, herein designated VGAM HOST TARGET GENE, in fact represents a plurality of VGAM769 host target genes. The mRNA of each one of this plurality of VGAM769 host target genes comprises one or more host target binding sites, each having a nucleotide sequence which is at least partly complementary to VGAM769 RNA, herein designated VGAM RNA, and which when bound by VGAM769 RNA causes inhibition of translation of respective one or more VGAM769 host target proteins.

It is further appreciated by one skilled in the art that the mode of translational inhibition illustrated by FIG. 1 with specific reference to translational inhibition exerted by VGAM769 gene, herein designated VGAM GENE, on one or more VGAM769 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM769 is inhibition of expression of host target genes, as part of a novel viral mechanism of attacking a host. Accordingly, utilities of VGAM769 include diagnosis, prevention and treatment of viral infection by Bovine Coronavirus. Specific functions, and accordingly utilities, of VGAM769 correlate with, and may be deduced from, the identity of the host target genes which VGAM769 binds and inhibits, and the function of these host target genes, as elaborated hereinbelow.

Nucleotide sequences of the VGAM769 precursor RNA, herein designated VGAM PRECURSOR RNA, and of the 'diced' VGAM769 RNA, herein designated VGAM RNA, and a schematic representation of the secondary folding of VGAM769 folded precursor RNA, herein designated VGAM FOLDED PRECURSOR RNA, of VGAM769 are further described hereinbelow with reference to Table 1.

Nucleotide sequences of host target binding sites, such as BINDING SITE-I, BINDING SITE-II and BINDING SITE-III of FIG. 1, found on VGAM769 host target RNA, and schematic representation of the complementarity of each of these host target binding sites to VGAM769 RNA, herein designated VGAM RNA, are described hereinbelow with reference to Table 2.

As mentioned hereinabove with reference to FIG. 1, a function of VGAM769 gene, herein designated VGAM is inhibition of expression of VGAM769 target genes. It is appreciated that specific functions, and accordingly utilities, of VGAM769 correlate with, and may be deduced from, the identity of the target genes which VGAM769 binds and inhibits, and the function of these target genes, as elaborated hereinbelow.

Ankyrin 2, Neuronal (ANK2, Accession NM_001148) is a VGAM769 host target gene. ANK2 BINDING SITE1 and ANK2 BINDING SITE2 are HOST TARGET binding sites found in untranslated regions of mRNA encoded by ANK2, corresponding to HOST TARGET binding sites such as BINDING SITE I, BINDING SITE II or BINDING SITE III. Table 2 illustrates the complementarity of the nucleotide sequences of ANK2 BINDING SITE1 and ANK2 BINDING SITE2, designated SEQ ID:6820 and SEQ ID:21964 respectively, to the nucleotide sequence of VGAM769 RNA, herein designated VGAM RNA, also designated SEQ ID:3480.

A function of VGAM769 is therefore inhibition of Ankyrin 2, Neuronal (ANK2, Accession NM_001148), a gene which attaches integral membrane proteins to cytoskeletal elements. also binds to cytoskeletal proteins. Accordingly, utilities of VGAM769 include diagnosis, prevention and treatment of diseases and clinical conditions associated with ANK2. The function of ANK2 has been established by previous studies. Tse et al. (1991) studied immunoreactive isoforms of erythrocyte ankyrin found in nonerythroid tissues. Using an erythrocyte ankyrin cDNA clone as a hybridization probe, they isolated a clone from a human genomic library that hybridized at low but not at high stringency. Further studies suggested that the clone represented part of a gene for nonerythroid ankyrin, which they designated ANK2. By analysis of somatic cell hybrids and by fluorescence in situ hybridization, they assigned ANK2 to 4q25-q27. Otto et al. (1991) isolated and sequenced cDNAs related to 2 brain ankyrin isoforms and showed that they are produced through alternative splicing of the mRNA from a single gene. By analysis of human/rodent cell hybrids, Otto et al. (1991) assigned the brain ankyrin gene to chromosome 4.

Full details of the abovementioned studies are described in the following publications, the disclosure of which are hereby incorporated by reference:

Otto, E.; Kunimoto, M.; McLaughlin, T.; Bennett, V.: Isolation and characterization of cDNAs encoding human brain ankyrins reveal a family of alternatively spliced genes. J. Cell Biol. 114:241-253, 1991; and Tse, W. T.; Menninger, J. C.; Yang-Feng, T. L.; Francke, U.; Sahr, K. E.; Lux, S. E.; Ward, D. C.; Forget, B. G.: Isolation and chromosomal localization of a novel non-erythroid ankyri.

Further studies establishing the function and utilities of ANK2 are found in John Hopkins OMIM database record ID 106410, and in sited publications numbered 4840-4841 listed in the bibliography section hereinbelow, which are also hereby incorporated by reference. Transmembrane 4 Superfamily Member 6 (TM4SF6, Accession NM_003270) is another VGAM769 host target gene. TM4SF6 BINDING SITE is HOST TARGET binding site found in the 3' untranslated region of mRNA encoded by TM4SF6, corresponding to a HOST TARGET binding site such as BINDING SITE I, BINDING SITE II or BINDING SITE III. Table 2 illustrates the complementarity of the nucleotide sequences of TM4SF6 BINDING SITE, designated SEQ ID:9283, to the nucleotide sequence of VGAM769 RNA, herein designated VGAM RNA, also designated SEQ ID:3480.

Another function of VGAM769 is therefore inhibition of Transmembrane 4 Superfamily Member 6 (TM4SF6, Accession NM_003270), a gene which plays a role in the regulation of cell development, activation, growth and motility. Accordingly, utilities of VGAM769 include diagnosis, prevention and treatment of diseases and clinical conditions associated with TM4SF6. The function of TM4SF6 and its association with various diseases and clinical conditions, has been established by previous studies, as described hereinabove with reference to VGAM84. FLJ12595 (Accession NM_024994) is another VGAM769 host target gene. FLJ12595 BINDING SITE is HOST TARGET binding site found in the 3' untranslated region of mRNA encoded by FLJ12595, corresponding to a HOST TARGET binding site such as BINDING SITE I, BINDING SITE II or BINDING SITE III. Table 2 illustrates the complementarity of the nucleotide sequences of FLJ12595 BINDING SITE, designated SEQ ID:24556, to the nucleotide sequence of VGAM769 RNA, herein designated VGAM RNA, also designated SEQ ID:3480.

Another function of VGAM769 is therefore inhibition of FLJ12595 (Accession NM_024994). Accordingly, utilities of VGAM769 include diagnosis, prevention and treatment of diseases and clinical conditions associated with FLJ12595. KIAA1582 (Accession XM_037262) is another VGAM769 host target gene. KIAA1582 BINDING SITE is HOST TARGET binding site found in the 5' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32591, to the nucleotide sequence of VGAM769 RNA, herein designated VGAM RNA, also designated SEQ ID:3480.

Another function of VGAM769 is therefore inhibition of KIAA1582 (Accession XM_037262). Accordingly, utilities of VGAM769 include diagnosis, prevention and treatment of diseases and clinical conditions associated with KIAA1582. LOC196993 (Accession XM_116971) is another VGAM769 host target gene. LOC196993 BINDING SITE is HOST TARGET binding site found in the 5' untranslated region of mRNA encoded by LOC196993, corresponding to a HOST TARGET binding site such as BINDING SITE I, BINDING SITE II or BINDING SITE III. Table 2 illustrates the complementarity of the nucleotide sequences of LOC196993 BINDING SITE, designated SEQ ID:43159, to the nucleotide sequence of VGAM769 RNA, herein designated VGAM RNA, also designated SEQ ID:3480.

Another function of VGAM769 is therefore inhibition of LOC196993 (Accession XM_116971). Accordingly, utilities of VGAM769 include diagnosis, prevention and treatment of diseases and clinical conditions associated with LOC196993. FIG. 1 further provides a conceptual description of a novel bioinformatically detected viral gene of the present invention, referred to here as Viral Genomic Address Messenger 770 (VGAM770) viral gene, which modulates expression of respective host target genes thereof, the function and utility of which host target genes is known in the art.

VGAM770 is a novel bioinformatically detected regulatory, non protein coding, viral micro RNA (miRNA) gene. The method by which VGAM770 was detected is described hereinabove with reference to FIGS. 1-8.

VGAM770 gene, herein designated VGAM GENE, is a viral gene contained in the genome of Bovine Coronavirus. VGAM770 host target gene, herein designated VGAM HOST TARGET GENE, is a human gene contained in the human genome.

VGAM770 gene encodes a VGAM770 precursor RNA, herein designated VGAM PRECURSOR RNA. Similar to other miRNA genes, and unlike most ordinary genes, VGAM770 precursor RNA does not encode a protein. A nucleotide sequence identical or highly similar to the nucleotide sequence of VGAM770 precursor RNA is designated SEQ ID:756, and is provided hereinbelow with reference to the sequence listing part. Nucleotide sequence SEQ ID:756 is located at position 13249 relative to the genome of Bovine Coronavirus.

VGAM770 precursor RNA folds onto itself, forming VGAM770 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM770 folded precursor RNA into VGAM770 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM770 RNA is designated SEQ ID:3481, and is provided hereinbelow with reference to the sequence listing part.

VGAM770 host target gene, herein designated VGAM HOST TARGET GENE, encodes a corresponding messenger RNA, VGAM770 host target RNA, herein designated VGAM HOST TARGET RNA. VGAM770 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM770 RNA, herein designated VGAM RNA, binds complementarily to one or more host target binding sites located in untranslated regions of VGAM770 host target RNA, herein designated VGAM HOST TARGET RNA. This complementary binding is due to the fact that the nucleotide sequence of VGAM770 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM770 RNA, herein designated VGAM RNA, may have a different number of host target binding sites in untranslated regions of a VGAM770 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM770 RNA, herein designated VGAM RNA, to host target binding sites on VGAM770 host target RNA, herein designated VGAM HOST TARGET RNA, such as BINDING SITE I, BINDING SITE II and BINDING SITE III, inhibits translation of VGAM770 host target RNA into VGAM770 host target protein, herein designated VGAM HOST TARGET PROTEIN. VGAM host target protein is therefore outlined by a broken line.

It is appreciated that VGAM770 host target gene, herein designated VGAM HOST TARGET GENE, in fact represents a plurality of VGAM770 host target genes. The mRNA of each one of this plurality of VGAM770 host target genes comprises one or more host target binding sites, each having a nucleotide sequence which is at least partly complementary to VGAM770 RNA, herein designated VGAM RNA, and which when bound by VGAM770 RNA causes inhibition of translation of respective one or more VGAM770 host target proteins.

It is further appreciated by one skilled in the art that the mode of translational inhibition illustrated by FIG. 1 with specific reference to translational inhibition exerted by VGAM770 gene, herein designated VGAM GENE, on one or more VGAM770 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM770 is inhibition of expression of host target genes, as part of a novel viral mechanism of attacking a host. Accordingly, utilities of VGAM770 include diagnosis, prevention and treatment of viral infection by Bovine Coronavirus. Specific functions, and accordingly utilities, of VGAM770 correlate with, and may be deduced from, the identity of the host target genes which VGAM770 binds and inhibits, and the function of these host target genes, as elaborated hereinbelow.

Nucleotide sequences of the VGAM770 precursor RNA, herein designated VGAM PRECURSOR RNA, and of the 'diced' VGAM770 RNA, herein designated VGAM RNA, and a schematic representation of the secondary folding of VGAM770 folded precursor RNA, herein designated VGAM FOLDED PRECURSOR RNA, of VGAM770 are further described hereinbelow with reference to Table 1.

Nucleotide sequences of host target binding sites, such as BINDING SITE-I, BINDING SITE-II and BINDING SITE-III of FIG. 1, found on VGAM770 host target RNA, and schematic representation of the complementarity of each of these host target binding sites to VGAM770 RNA, herein designated VGAM RNA, are described hereinbelow with reference to Table 2.

As mentioned hereinabove with reference to FIG. 1, a function of VGAM770 gene, herein designated VGAM is inhibition of expression of VGAM770 target genes. It is appreciated that specific functions, and accordingly utilities, of VGAM770 correlate with, and may be deduced from, the identity of the target genes which VGAM770 binds and inhibits, and the function of these target genes, as elaborated hereinbelow.

Glutamate Receptor, Metabotropic 7 (GRM7, Accession NM_000844) is a VGAM770 host target gene. GRM7 BINDING SITE is HOST TARGET binding site found in the 3' untranslated region of mRNA encoded by GRM7, corresponding to a HOST TARGET binding site such as BINDING SITE I, BINDING SITE II or BINDING SITE III. Table 2 illustrates the complementarity of the nucleotide sequences of GRM7 BINDING SITE, designated SEQ ID:6518, to the nucleotide sequence of VGAM770 RNA, herein designated VGAM RNA, also designated SEQ ID:3481.

A function of VGAM770 is therefore inhibition of Glutamate Receptor, Metabotropic 7 (GRM7, Accession NM_000844), a gene which is mediated by a g-protein that inhibits adenylate cyclase activity. Accordingly, utilities of VGAM770 include diagnosis, prevention and treatment of diseases and clinical conditions associated with GRM7. The function of GRM7 and its association with various diseases and clinical conditions, has been established by previous studies, as described hereinabove with reference to VGAM746. Mannosyl (alpha-1,6-)-glycoprotein Beta-1,6-N-acetyl-glucosaminyltransferase (MGAT5, Accession NM_002410) is another VGAM770 host target gene. MGAT5 BINDING SITE is HOST TARGET binding site found in the 5' untranslated region of mRNA encoded by MGAT5, corresponding to a HOST TARGET binding site such as BINDING SITE I, BINDING SITE II or BINDING SITE III. Table 2 illustrates the complementarity of the nucleotide sequences of MGAT5 BINDING SITE, designated SEQ ID:8240, to the nucleotide sequence of VGAM770 RNA, herein designated VGAM RNA, also designated SEQ ID:3481.

Another function of VGAM770 is therefore inhibition of Mannosyl (alpha-1,6-)-glycoprotein Beta-1,6-N-acetyl-glucosaminyltransferase (MGAT5, Accession NM_002410). Accordingly, utilities of VGAM770 include diagnosis, prevention and treatment of diseases and clinical conditions associated with MGAT5. X-box Binding Protein 1 (XBP1, Accession NM_005080) is another VGAM770 host target gene. XBP1 BINDING SITE is HOST TARGET binding site found in the 3' untranslated region of mRNA encoded by XBP1, corresponding to a HOST TARGET binding site such as BINDING SITE I, BINDING SITE II or BINDING SITE III. Table 2 illustrates the complementarity of the nucleotide sequences of XBP1 BINDING SITE, designated SEQ ID:11533, to the nucleotide sequence of VGAM770 RNA, herein designated VGAM RNA, also designated SEQ ID:3481.

Another function of VGAM770 is therefore inhibition of X-box Binding Protein 1 (XBP1, Accession NM_005080), a gene which has a role in transcriptional regulation. Accordingly, utilities of VGAM770 include diagnosis, prevention and treatment of diseases and clinical conditions associated with XBP1. The function of XBP1 and its association with various diseases and clinical conditions, has been established by previous studies, as described hereinabove with reference to VGAM746. DKFZP434B044 (Accession NM_031476) is another VGAM770 host target gene. DKFZP434B044 BINDING SITE is HOST TARGET binding site found in the 3' untranslated region of mRNA encoded by DKFZP434B044, corresponding to a HOST TARGET binding site such as BINDING SITE I, BINDING SITE II or BINDING SITE III. Table 2 illustrates the complementarity of the nucleotide sequences of DKFZP434B044 BINDING SITE, designated SEQ ID:25553, to the nucleotide sequence of VGAM770 RNA, herein designated VGAM RNA, also designated SEQ ID:3481.

Another function of VGAM770 is therefore inhibition of DKFZP434B044 (Accession NM_031476). Accordingly, utilities of VGAM770 include diagnosis, prevention and treatment of diseases and clinical conditions associated with DKFZP434B044. FLJ12806 (Accession NM_022831) is another VGAM770 host target gene. FLJ12806 BINDING SITE is HOST TARGET binding site found in the 3' untranslated region of mRNA encoded by FLJ12806, corresponding to a HOST TARGET binding site such as BINDING SITE I, BINDING SITE II or BINDING SITE III. Table 2 illustrates the complementarity of the nucleotide sequences of FLJ12806 BINDING SITE, designated SEQ ID:23112, to the nucleotide sequence of VGAM770 RNA, herein designated VGAM RNA, also designated SEQ ID:3481.

Another function of VGAM770 is therefore inhibition of FLJ12806 (Accession NM_022831). Accordingly, utilities of VGAM770 include diagnosis, prevention and treatment of diseases and clinical conditions associated with FLJ12806. FLJ22635 (Accession NM_025092) is another VGAM770 host target gene. FLJ22635 BINDING SITE is HOST TARGET binding site found in the 3' untranslated region of mRNA encoded by FLJ22635, corresponding to a HOST TARGET binding site such as BINDING SITE I, BINDING SITE II or BINDING SITE III. Table 2 illustrates the complementarity of the nucleotide sequences of FLJ22635 BINDING SITE, designated SEQ ID:24716, to the nucleotide sequence of VGAM770 RNA, herein designated VGAM RNA, also designated SEQ ID:3481.

Another function of VGAM770 is therefore inhibition of FLJ22635 (Accession NM_025092). Accordingly, utilities of VGAM770 include diagnosis, prevention and treatment of diseases and clinical conditions associated with FLJ22635. FLJ23604 (Accession NM_025064) is another VGAM770 host target gene. FLJ23604 BINDING SITE is HOST TARGET binding site found in the 3' untranslated region of mRNA encoded by FLJ23604, corresponding to a HOST TARGET binding site such as BINDING SITE I, BINDING SITE II or BINDING SITE III. Table 2 illustrates the complementarity of the nucleotide sequences of FLJ23604 BINDING SITE, designated SEQ ID:24661, to the nucleotide sequence of VGAM770 RNA, herein designated VGAM RNA, also designated SEQ ID:3481.

Another function of VGAM770 is therefore inhibition of FLJ23604 (Accession NM_025064). Accordingly, utilities of VGAM770 include diagnosis, prevention and treatment of diseases and clinical conditions associated with FLJ23604. KIAA0557 (Accession XM_085507) is another VGAM770 host target gene. KIAA0557 BINDING SITE is HOST TARGET binding site found in the 3' untranslated region of mRNA encoded by KIAA0557, corresponding to a HOST TARGET binding site such as BINDING SITE I, BINDING SITE II or BINDING SITE III. Table 2 illustrates the complementarity of the nucleotide sequences of KIAA0557 BINDING SITE, designated SEQ ID:38202, to the nucleotide sequence of VGAM770 RNA, herein designated VGAM RNA, also designated SEQ ID:3481.

Another function of VGAM770 is therefore inhibition of KIAA0557 (Accession XM_085507). Accordingly, utilities of VGAM770 include diagnosis, prevention and treatment of diseases and clinical conditions associated with KIAA0557. LOC144742 (Accession XM_084949) is another VGAM770 host target gene. LOC144742 BINDING SITE is HOST TARGET binding site found in the 5' untranslated region of mRNA encoded by LOC144742, corresponding to a HOST TARGET binding site such as BINDING SITE I, BINDING SITE II or BINDING SITE III. Table 2 illustrates the complementarity of the nucleotide sequences of LOC144742 BINDING SITE, designated SEQ ID:37777, to the nucleotide sequence of VGAM770 RNA, herein designated VGAM RNA, also designated SEQ ID:3481.

Another function of VGAM770 is therefore inhibition of LOC144742 (Accession XM_084949). Accordingly, utilities of VGAM770 include diagnosis, prevention and treatment of diseases and clinical conditions associated with LOC144742. LOC145842 (Accession XM_085254) is another VGAM770 host target gene. LOC145842 BINDING SITE is HOST TARGET binding site found in the 5' untranslated region of mRNA encoded by LOC145842, corresponding to a HOST TARGET binding site such as BINDING SITE I, BINDING SITE II or BINDING SITE III. Table 2 illustrates the complementarity of the nucleotide sequences of LOC145842 BINDING SITE, designated SEQ ID:37997, to the nucleotide sequence of VGAM770 RNA, herein designated VGAM RNA, also designated SEQ ID:3481.

Another function of VGAM770 is therefore inhibition of LOC145842 (Accession XM_085254). Accordingly, utilities of VGAM770 include diagnosis, prevention and treatment of diseases and clinical conditions associated with LOC145842. LOC153711 (Accession XM_098419) is another VGAM770 host target gene. LOC153711 BINDING SITE is HOST TARGET binding site found in the 3' untranslated region of mRNA encoded by LOC153711, corresponding to a HOST TARGET binding site such as BINDING SITE I, BINDING SITE II or BINDING SITE III. Table 2 illustrates the complementarity of the nucleotide sequences of LOC153711 BINDING SITE, designated SEQ ID:41668, to the nucleotide sequence of VGAM770 RNA, herein designated VGAM RNA, also designated SEQ ID:3481.

Another function of VGAM770 is therefore inhibition of LOC153711 (Accession XM_098419). Accordingly, utilities of VGAM770 include diagnosis, prevention and treatment of diseases and clinical conditions associated with LOC153711. LOC51008 (Accession NM_015947) is another VGAM770 host target gene. LOC51008 BINDING SITE is HOST TARGET binding site found in the 3' untranslated region of mRNA encoded by LOC51008, corresponding to a HOST TARGET binding site such as BINDING SITE I, BINDING SITE II or BINDING SITE III. Table 2 illustrates the complementarity of the nucleotide sequences of LOC51008 BINDING SITE, designated SEQ ID:18064, to the nucleotide sequence of VGAM770 RNA, herein designated VGAM RNA, also designated SEQ ID:3481.

Another function of VGAM770 is therefore inhibition of LOC51008 (Accession NM_015947). Accordingly, utilities of VGAM770 include diagnosis, prevention and treatment of diseases and clinical conditions associated with LOC51008. FIG. 1 further provides a conceptual description of a novel bioinformatically detected viral gene of the present invention, referred to here as Viral Genomic Address Messenger 771 (VGAM771) viral gene, which modulates expression of respective host target genes thereof, the function and utility of which host target genes is known in the art.

VGAM771 is a novel bioinformatically detected regulatory, non protein coding, viral micro RNA (miRNA) gene. The method by which VGAM771 was detected is described hereinabove with reference to FIGS. 1-8.

VGAM771 gene, herein designated VGAM GENE, is a viral gene contained in the genome of Bovine Coronavirus. VGAM771 host target gene, herein designated VGAM HOST TARGET GENE, is a human gene contained in the human genome.

VGAM771 gene encodes a VGAM771 precursor RNA, herein designated VGAM PRECURSOR RNA. Similar to other miRNA genes, and unlike most ordinary genes, VGAM771 precursor RNA does not encode a protein. A nucleotide sequence identical or highly similar to the nucleotide sequence of VGAM771 precursor RNA is designated SEQ ID:757, and is provided hereinbelow with reference to the sequence listing part. Nucleotide sequence SEQ ID:757 is located at position 25459 relative to the genome of Bovine Coronavirus.

VGAM771 precursor RNA folds onto itself, forming VGAM771 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM771 folded precursor RNA into VGAM771 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM771 RNA is designated SEQ ID:3482, and is provided hereinbelow with reference to the sequence listing part.

VGAM771 host target gene, herein designated VGAM HOST TARGET GENE, encodes a corresponding messenger RNA, VGAM771 host target RNA, herein designated VGAM HOST TARGET RNA. VGAM771 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM771 RNA, herein designated VGAM RNA, binds complementarily to one or more host target binding sites located in untranslated regions of VGAM771 host target RNA, herein designated VGAM HOST TARGET RNA. This complementary binding is due to the fact that the nucleotide sequence of VGAM771 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM771 RNA, herein designated VGAM RNA, may have a different number of host target binding sites in untranslated regions of a VGAM771 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM771 RNA, herein designated VGAM RNA, to host target binding sites on VGAM771 host target RNA, herein designated VGAM HOST TARGET RNA, such as BINDING SITE I, BINDING SITE II and BINDING SITE III, inhibits translation of VGAM771 host target RNA into VGAM771 host target protein, herein designated VGAM HOST TARGET PROTEIN. VGAM host target protein is therefore outlined by a broken line.

It is appreciated that VGAM771 host target gene, herein designated VGAM HOST TARGET GENE, in fact represents a plurality of VGAM771 host target genes. The mRNA of each one of this plurality of VGAM771 host target genes comprises one or more host target binding sites, each having a nucleotide sequence which is at least partly complementary to VGAM771 RNA, herein designated VGAM RNA, and which when bound by VGAM771 RNA causes inhibition of translation of respective one or more VGAM771 host target proteins.

It is further appreciated by one skilled in the art that the mode of translational inhibition illustrated by FIG. 1 with specific reference to translational inhibition exerted by VGAM771 gene, herein designated VGAM GENE, on one or more VGAM771 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM771 is inhibition of expression of host target genes, as part of a novel viral mechanism of attacking a host. Accordingly, utilities of VGAM771 include diagnosis, prevention and treatment of viral infection by Bovine Coronavirus. Specific functions, and accordingly utilities, of VGAM771 correlate with, and may be deduced from, the identity of the host target genes which VGAM771 binds and inhibits, and the function of these host target genes, as elaborated hereinbelow.

Nucleotide sequences of the VGAM771 precursor RNA, herein designated VGAM PRECURSOR RNA, and of the 'diced' VGAM771 RNA, herein designated VGAM RNA, and a schematic representation of the secondary folding of VGAM771 folded precursor RNA, herein designated VGAM FOLDED PRECURSOR RNA, of VGAM771 are further described hereinbelow with reference to Table 1.

Nucleotide sequences of host target binding sites, such as BINDING SITE-I, BINDING SITE-II and BINDING SITE-III of FIG. 1, found on VGAM771 host target RNA, and schematic representation of the complementarity of each of these host target binding sites to VGAM771 RNA, herein designated VGAM RNA, are described hereinbelow with reference to Table 2.

As mentioned hereinabove with reference to FIG. 1, a function of VGAM771 gene, herein designated VGAM is inhibition of expression of VGAM771 target genes. It is appreciated that specific functions, and accordingly utilities, of VGAM771 correlate with, and may be deduced from, the identity of the target genes which VGAM771 binds and inhibits, and the function of these target genes, as elaborated hereinbelow.

Dystrophin (muscular dystrophy, Duchenne and Becker types) (DMD, Accession NM_000109) is a VGAM771 host target gene. DMD BINDING SITE1 through DMD BINDING SITE13 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 through DMD BINDING SITE13, designated SEQ ID:5569, SEQ ID:10154, SEQ ID:10159, SEQ ID:10166, SEQ ID:10172, SEQ ID:10180, SEQ ID:10185, SEQ ID:10191, SEQ ID:10202, SEQ ID:10207, SEQ ID:10212, SEQ ID:10218 and SEQ ID:10230 respectively, to the nucleotide sequence of VGAM771 RNA, herein designated VGAM RNA, also designated SEQ ID:3482.

A function of VGAM771 is therefore inhibition of Dystrophin (muscular dystrophy, Duchenne and Becker types) (DMD, Accession NM_000109), a gene which muscular dystrophy. Accordingly, utilities of VGAM771 include diagnosis, prevention and treatment of diseases and clinical conditions associated with DMD. The function of DMD and its association with various diseases and clinical conditions, has been established by previous studies, as described hereinabove with reference to VGAM218. KIAA1219 (Accession XM_028835) is another VGAM771 host target gene. KIAA1219 BINDING SITE is HOST TARGET binding site found in the 3' untranslated region of mRNA encoded by KIAA1219, corresponding to a HOST TARGET binding site such as BINDING SITE I, BINDING SITE II or BINDING SITE III. Table 2 illustrates the complementarity of the nucleotide sequences of KIAA1219 BINDING SITE, designated SEQ ID:30755, to the nucleotide sequence of VGAM771 RNA, herein designated VGAM RNA, also designated SEQ ID:3482.

Another function of VGAM771 is therefore inhibition of KIAA1219 (Accession XM_028835). Accordingly, utilities of VGAM771 include diagnosis, prevention and treatment of diseases and clinical conditions associated with KIAA1219. LOC92979 (Accession NM_138396) is another VGAM771 host target gene. LOC92979 BINDING SITE is HOST TARGET binding site found in the 5' untranslated region of mRNA encoded by LOC92979, corresponding to a HOST TARGET binding site such as BINDING SITE I, BINDING SITE II or BINDING SITE III. Table 2 illustrates the complementarity of the nucleotide sequences of LOC92979 BINDING SITE, designated SEQ ID:28764, to the nucleotide sequence of VGAM771 RNA, herein designated VGAM RNA, also designated SEQ ID:3482.

Another function of VGAM771 is therefore inhibition of LOC92979 (Accession NM_138396). Accordingly, utilities of VGAM771 include diagnosis, prevention and treatment of diseases and clinical conditions associated with LOC92979. FIG. 1 further provides a conceptual description of a novel bioinformatically detected viral gene of the present invention, referred to here as Viral Genomic Address Messenger 772 (VGAM772) viral gene, which modulates expression of respective host target genes thereof, the function and utility of which host target genes is known in the art.

VGAM772 is a novel bioinformatically detected regulatory, non protein coding, viral micro RNA (miRNA) gene. The method by which VGAM772 was detected is described hereinabove with reference to FIGS. 1-8.

VGAM772 gene, herein designated VGAM GENE, is a viral gene contained in the genome of Bovine Coronavirus. VGAM772 host target gene, herein designated VGAM HOST TARGET GENE, is a human gene contained in the human genome.

VGAM772 gene encodes a VGAM772 precursor RNA, herein designated VGAM PRECURSOR RNA. Similar to other miRNA genes, and unlike most ordinary genes, VGAM772 precursor RNA does not encode a protein. A nucleotide sequence identical or highly similar to the nucleotide sequence of VGAM772 precursor RNA is designated SEQ ID:758, and is provided hereinbelow with reference to the sequence listing part. Nucleotide sequence SEQ ID:758 is located at position 24433 relative to the genome of Bovine Coronavirus.

VGAM772 precursor RNA folds onto itself, forming VGAM772 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM772 folded precursor RNA into VGAM772 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM772 RNA is designated SEQ ID:3483, and is provided hereinbelow with reference to the sequence listing part.

VGAM772 host target gene, herein designated VGAM HOST TARGET GENE, encodes a corresponding messenger RNA, VGAM772 host target RNA, herein designated VGAM HOST TARGET RNA. VGAM772 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM772 RNA, herein designated VGAM RNA, binds complementarily to one or more host target binding sites located in untranslated regions of VGAM772 host target RNA, herein designated VGAM HOST TARGET RNA. This complementary binding is due to the fact that the nucleotide sequence of VGAM772 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM772 RNA, herein designated VGAM RNA, may have a different number of host target binding sites in untranslated regions of a VGAM772 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM772 RNA, herein designated VGAM RNA, to host target binding sites on VGAM772 host target RNA, herein designated VGAM HOST TARGET RNA, such as BINDING SITE I, BINDING SITE II and BINDING SITE III, inhibits translation of VGAM772 host target RNA into VGAM772 host target protein, herein designated VGAM HOST TARGET PROTEIN. VGAM host target protein is therefore outlined by a broken line.

It is appreciated that VGAM772 host target gene, herein designated VGAM HOST TARGET GENE, in fact represents a plurality of VGAM772 host target genes. The mRNA of each one of this plurality of VGAM772 host target genes comprises one or more host target binding sites, each having a nucleotide sequence which is at least partly complementary to VGAM772 RNA, herein designated VGAM RNA, and which when bound by VGAM772 RNA causes inhibition of translation of respective one or more VGAM772 host target proteins.

It is further appreciated by one skilled in the art that the mode of translational inhibition illustrated by FIG. 1 with specific reference to translational inhibition exerted by VGAM772 gene, herein designated VGAM GENE, on one or more VGAM772 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM772 is inhibition of expression of host target genes, as part of a novel viral mechanism of attacking a host. Accordingly, utilities of VGAM772 include diagnosis, prevention and treatment of viral infection by Bovine Coronavirus. Specific functions, and accordingly utilities, of VGAM772 correlate with, and may be deduced from, the identity of the host target genes which VGAM772 binds and inhibits, and the function of these host target genes, as elaborated hereinbelow.

Nucleotide sequences of the VGAM772 precursor RNA, herein designated VGAM PRECURSOR RNA, and of the 'diced' VGAM772 RNA, herein designated VGAM RNA, and a schematic representation of the secondary folding of VGAM772 folded precursor RNA, herein designated VGAM FOLDED PRECURSOR RNA, of VGAM772 are further described hereinbelow with reference to Table 1.

Nucleotide sequences of host target binding sites, such as BINDING SITE-I, BINDING SITE-II and BINDING SITE-III of FIG. 1, found on VGAM772 host target RNA, and schematic representation of the complementarity of each of these host target binding sites to VGAM772 RNA, herein designated VGAM RNA, are described hereinbelow with reference to Table 2.

As mentioned hereinabove with reference to FIG. 1, a function of VGAM772 gene, herein designated VGAM is inhibition of expression of VGAM772 target genes. It is appreciated that specific functions, and accordingly utilities, of VGAM772 correlate with, and may be deduced from, the identity of the target genes which VGAM772 binds and inhibits, and the function of these target genes, as elaborated hereinbelow.

FLJ10178 (Accession NM_018015) is a VGAM772 host target gene. FLJ10178 BINDING SITE is HOST TARGET binding site found in the 3' untranslated region of mRNA encoded by FLJ10178, corresponding to a HOST TARGET binding site such as BINDING SITE I, BINDING SITE II or BINDING SITE III. Table 2 illustrates the complementarity of the nucleotide sequences of FLJ10178 BINDING SITE, designated SEQ ID:19755, to the nucleotide sequence of VGAM772 RNA, herein designated VGAM RNA, also designated SEQ ID:3483.

A function of VGAM772 is therefore inhibition of FLJ10178 (Accession NM_018015). Accordingly, utilities of VGAM772 include diagnosis, prevention and treatment of diseases and clinical conditions associated with FLJ10178.

LOC158014 (Accession XM_088442) is another VGAM772 host target gene. LOC158014 BINDING SITE is HOST TARGET binding site found in the 5' untranslated region of mRNA encoded by LOC158014, corresponding to a HOST TARGET binding site such as BINDING SITE I, BINDING SITE II or BINDING SITE III. Table 2 illustrates the complementarity of the nucleotide sequences of LOC158014 BINDING SITE, designated SEQ ID:39695, to the nucleotide sequence of VGAM772 RNA, herein designated VGAM RNA, also designated SEQ ID:3483.

Another function of VGAM772 is therefore inhibition of LOC158014 (Accession XM_088442). Accordingly, utilities of VGAM772 include diagnosis, prevention and treatment of diseases and clinical conditions associated with LOC158014.

LOC255231 (Accession XM_170908) is another VGAM772 host target gene. LOC255231 BINDING SITE is HOST TARGET binding site found in the 3' untranslated region of mRNA encoded by LOC255231, corresponding to a HOST TARGET binding site such as BINDING SITE I, BINDING SITE II or BINDING SITE III. Table 2 illustrates the complementarity of the nucleotide sequences of LOC255231 BINDING SITE, designated SEQ ID:45670, to the nucleotide sequence of VGAM772 RNA, herein designated VGAM RNA, also designated SEQ ID:3483.

Another function of VGAM772 is therefore inhibition of LOC255231 (Accession XM_170908). Accordingly, utilities of VGAM772 include diagnosis, prevention and treatment of diseases and clinical conditions associated with LOC255231.

FIG. 1 further provides a conceptual description of a novel bioinformatically detected viral gene of the present invention, referred to here as Viral Genomic Address Messenger 773 (VGAM773) viral gene, which modulates expression of respective host target genes thereof, the function and utility of which host target genes is known in the art.

VGAM773 is a novel bioinformatically detected regulatory, non protein coding, viral micro RNA (miRNA) gene. The method by which VGAM773 was detected is described hereinabove with reference to FIGS. 1-8.

VGAM773 gene, herein designated VGAM GENE, is a viral gene contained in the genome of Bovine Coronavirus. VGAM773 host target gene, herein designated VGAM HOST TARGET GENE, is a human gene contained in the human genome.

VGAM773 gene encodes a VGAM773 precursor RNA, herein designated VGAM PRECURSOR RNA. Similar to other miRNA genes, and unlike most ordinary genes, VGAM773 precursor RNA does not encode a protein. A nucleotide sequence identical or highly similar to the nucleotide sequence of VGAM773 precursor RNA is designated SEQ ID:759, and is provided hereinbelow with reference to the sequence listing part. Nucleotide sequence SEQ ID:759 is located at position 23974 relative to the genome of Bovine Coronavirus.

VGAM773 precursor RNA folds onto itself, forming VGAM773 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM773 folded precursor RNA into VGAM773 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM773 RNA is designated SEQ ID:3484, and is provided hereinbelow with reference to the sequence listing part.

VGAM773 host target gene, herein designated VGAM HOST TARGET GENE, encodes a corresponding messenger RNA, VGAM773 host target RNA, herein designated VGAM HOST TARGET RNA. VGAM773 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM773 RNA, herein designated VGAM RNA, binds complementarily to one or more host target binding sites located in untranslated regions of VGAM773 host target RNA, herein designated VGAM HOST TARGET RNA. This complementary binding is due to the fact that the nucleotide sequence of VGAM773 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM773 RNA, herein designated VGAM RNA, may have a different number of host target binding sites in untranslated regions of a VGAM773 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM773 RNA, herein designated VGAM RNA, to host target binding sites on VGAM773 host target RNA, herein designated VGAM HOST TARGET RNA, such as BINDING SITE I, BINDING SITE II and BINDING SITE III, inhibits translation of VGAM773 host target RNA into VGAM773 host target protein, herein designated VGAM HOST TARGET PROTEIN. VGAM host target protein is therefore outlined by a broken line.

It is appreciated that VGAM773 host target gene, herein designated VGAM HOST TARGET GENE, in fact represents a plurality of VGAM773 host target genes. The mRNA of each one of this plurality of VGAM773 host target genes comprises one or more host target binding sites, each having a nucleotide sequence which is at least partly complementary to VGAM773 RNA, herein designated VGAM RNA, and which when bound by VGAM773 RNA causes inhibition of translation of respective one or more VGAM773 host target proteins.

It is further appreciated by one skilled in the art that the mode of translational inhibition illustrated by FIG. 1 with specific reference to translational inhibition exerted by VGAM773 gene, herein designated VGAM GENE, on one or more VGAM773 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM773 is inhibition of expression of host target genes, as part of a novel viral mechanism of attacking a host. Accordingly, utilities of VGAM773 include diagnosis, prevention and treatment of viral infection by Bovine Coronavirus. Specific functions, and accordingly utilities, of VGAM773 correlate with, and may be deduced from, the identity of the host target genes which VGAM773 binds and inhibits, and the function of these host target genes, as elaborated hereinbelow.

Nucleotide sequences of the VGAM773 precursor RNA, herein designated VGAM PRECURSOR RNA, and of the 'diced' VGAM773 RNA, herein designated VGAM RNA, and a schematic representation of the secondary folding of VGAM773 folded precursor RNA, herein designated VGAM FOLDED PRECURSOR RNA, of VGAM773 are further described hereinbelow with reference to Table 1.

Nucleotide sequences of host target binding sites, such as BINDING SITE-I, BINDING SITE-II and BINDING SITE-III of FIG. 1, found on VGAM773 host target RNA, and schematic representation of the complementarity of each of these host target binding sites to VGAM773 RNA, herein designated VGAM RNA, are described hereinbelow with reference to Table 2.

As mentioned hereinabove with reference to FIG. 1, a function of VGAM773 gene, herein designated VGAM is inhibition of expression of VGAM773 target genes. It is appreciated that specific functions, and accordingly utilities, of VGAM773 correlate with, and may be deduced from, the identity of the target genes which VGAM773 binds and inhibits, and the function of these target genes, as elaborated hereinbelow.

Fanconi Anemia, Complementation Group F (FANCF, Accession NM_022725) is a VGAM773 host target gene. FANCF BINDING SITE is HOST TARGET binding site found in the 3' untranslated region of mRNA encoded by FANCF, corresponding to a HOST TARGET binding site such as BINDING SITE I, BINDING SITE II or BINDING SITE III. Table 2 illustrates the complementarity of the nucleotide sequences of FANCF BINDING SITE, designated SEQ ID:22926, to the nucleotide sequence of VGAM773 RNA, herein designated VGAM RNA, also designated SEQ ID:3484.

A function of VGAM773 is therefore inhibition of Fanconi Anemia, Complementation Group F (FANCF, Accession NM_022725). Accordingly, utilities of VGAM773 include diagnosis, prevention and treatment of diseases and clinical conditions associated with FANCF. NCK-associated Protein 1 (NCKAP1, Accession NM_013436) is another VGAM773 host target gene. NCKAP1 BINDING SITE is HOST TAR- GET binding site found in the 3' untranslated region of mRNA encoded by NCKAP1, corresponding to a HOST TARGET binding site such as BINDING SITE I, BINDING SITE II or BINDING SITE III. Table 2 illustrates the complementarity of the nucleotide sequences of NCKAP1 BINDING SITE, designated SEQ ID:15097, to the nucleotide sequence of VGAM773 RNA, herein designated VGAM RNA, also designated SEQ ID:3484.

Another function of VGAM773 is therefore inhibition of NCK-associated Protein 1 (NCKAP1, Accession NM_013436). Accordingly, utilities of VGAM773 include diagnosis, prevention and treatment of diseases and clinical conditions associated with NCKAP1. Spinocerebellar Ataxia 7 (olivopontocerebellar atrophy with retinal degeneration) (SCA7, Accession NM_000333) is another VGAM773 host target gene. SCA7 BINDING SITE is HOST TARGET binding site found in the 5' untranslated region of mRNA encoded by SCA7, corresponding to a HOST TARGET binding site such as BINDING SITE I, BINDING SITE II or BINDING SITE III. Table 2 illustrates the complementarity of the nucleotide sequences of SCA7 BINDING SITE, designated SEQ ID:5887, to the nucleotide sequence of VGAM773 RNA, herein designated VGAM RNA, also designated SEQ ID:3484.

Another function of VGAM773 is therefore inhibition of Spinocerebellar Ataxia 7 (olivopontocerebellar atrophy with retinal degeneration) (SCA7, Accession NM_000333). Accordingly, utilities of VGAM773 include diagnosis, prevention and treatment of diseases and clinical conditions associated with SCA7. FLJ11259 (Accession NM_018370) is another VGAM773 host target gene. FLJ11259 BINDING SITE is HOST TARGET binding site found in the 3' untranslated region of mRNA encoded by FLJ11259, corresponding to a HOST TARGET binding site such as BINDING SITE I, BINDING SITE II or BINDING SITE III. Table 2 illustrates the complementarity of the nucleotide sequences of FLJ11259 BINDING SITE, designated SEQ ID:20388, to the nucleotide sequence of VGAM773 RNA, herein designated VGAM RNA, also designated SEQ ID:3484.

Another function of VGAM773 is therefore inhibition of FLJ11259 (Accession NM_018370). Accordingly, utilities of VGAM773 include diagnosis, prevention and treatment of diseases and clinical conditions associated with FLJ11259. FLJ20139 (Accession NM_017685) is another VGAM773 host target gene. FLJ20139 BINDING SITE is HOST TARGET binding site found in the 3' untranslated region of mRNA encoded by FLJ20139, corresponding to a HOST TARGET binding site such as BINDING SITE I, BINDING SITE II or BINDING SITE III. Table 2 illustrates the complementarity of the nucleotide sequences of FLJ20139 BINDING SITE, designated SEQ ID:19237, to the nucleotide sequence of VGAM773 RNA, herein designated VGAM RNA, also designated SEQ ID:3484.

Another function of VGAM773 is therefore inhibition of FLJ20139 (Accession NM_017685). Accordingly, utilities of VGAM773 include diagnosis, prevention and treatment of diseases and clinical conditions associated with FLJ20139. KIAA0853 (Accession NM_015070) is another VGAM773 host target gene. KIAA0853 BINDING SITE is HOST TARGET binding site found in the 3' untranslated region of mRNA encoded by KIAA0853, corresponding to a HOST TARGET binding site such as BINDING SITE I, BINDING SITE II or BINDING SITE III. Table 2 illustrates the complementarity of the nucleotide sequences of KIAA0853 BINDING SITE, designated SEQ ID:17439, to the nucleotide sequence of VGAM773 RNA, herein designated VGAM RNA, also designated SEQ ID:3484.

Another function of VGAM773 is therefore inhibition of KIAA0853 (Accession NM_015070). Accordingly, utilities of VGAM773 include diagnosis, prevention and treatment of diseases and clinical conditions associated with KIAA0853. KIAA1189 (Accession XM_050508) is another VGAM773 host target gene. KIAA1189 BINDING SITE is HOST TARGET binding site found in the 3' untranslated region of mRNA encoded by KIAA1189, corresponding to a HOST TARGET binding site such as BINDING SITE I, BINDING SITE II or BINDING SITE III. Table 2 illustrates the complementarity of the nucleotide sequences of KIAA1189 BINDING SITE, designated SEQ ID:35654, to the nucleotide sequence of VGAM773 RNA, herein designated VGAM RNA, also designated SEQ ID:3484.

Another function of VGAM773 is therefore inhibition of KIAA1189 (Accession XM_050508). Accordingly, utilities of VGAM773 include diagnosis, prevention and treatment of diseases and clinical conditions associated with KIAA1189. KIAA1423 (Accession XM_029703) is another VGAM773 host target gene. KIAA1423 BINDING SITE is HOST TARGET binding site found in the 3' untranslated region of mRNA encoded by KIAA1423, corresponding to a HOST TARGET binding site such as BINDING SITE I, BINDING SITE II or BINDING SITE III. Table 2 illustrates the complementarity of the nucleotide sequences of KIAA1423 BINDING SITE, designated SEQ ID:30924, to the nucleotide sequence of VGAM773 RNA, herein designated VGAM RNA, also designated SEQ ID:3484.

Another function of VGAM773 is therefore inhibition of KIAA1423 (Accession XM_029703). Accordingly, utilities of VGAM773 include diagnosis, prevention and treatment of diseases and clinical conditions associated with KIAA1423. LOC143879 (Accession XM_084666) is another VGAM773 host target gene. LOC143879 BINDING SITE is HOST TARGET binding site found in the 3' untranslated region of mRNA encoded by LOC143879, corresponding to a HOST TARGET binding site such as BINDING SITE I, BINDING SITE II or BINDING SITE III. Table 2 illustrates the complementarity of the nucleotide sequences of LOC143879 BINDING SITE, designated SEQ ID:37663, to the nucleotide sequence of VGAM773 RNA, herein designated VGAM RNA, also designated SEQ ID:3484.

Another function of VGAM773 is therefore inhibition of LOC143879 (Accession XM_084666). Accordingly, utilities of VGAM773 include diagnosis, prevention and treatment of diseases and clinical conditions associated with LOC143879. LOC152905 (Accession XM_017966) is another VGAM773 host target gene. LOC152905 BINDING SITE is HOST TARGET binding site found in the 3' untranslated region of mRNA encoded by LOC152905, corresponding to a HOST TARGET binding site such as BINDING SITE I, BINDING SITE II or BINDING SITE III. Table 2 illustrates the complementarity of the nucleotide sequences of LOC152905 BINDING SITE, designated SEQ ID:30333, to the nucleotide sequence of VGAM773 RNA, herein designated VGAM RNA, also designated SEQ ID:3484.

Another function of VGAM773 is therefore inhibition of LOC152905 (Accession XM_017966). Accordingly, utilities of VGAM773 include diagnosis, prevention and treatment of diseases and clinical conditions associated with LOC152905. LOC170395 (Accession XM_084325) is another VGAM773 host target gene. LOC170395 BINDING SITE is HOST TARGET binding site found in the 3' untranslated region of mRNA encoded by LOC170395, corresponding to a HOST TARGET binding site such as BINDING SITE I, BINDING SITE II or BINDING SITE III. Table 2 illustrates the complementarity of the nucleotide sequences of LOC170395 BIND- ING SITE, designated SEQ ID:37547, to the nucleotide sequence of VGAM773 RNA, herein designated VGAM RNA, also designated SEQ ID:3484.

Another function of VGAM773 is therefore inhibition of LOC170395 (Accession XM_084325). Accordingly, utilities of VGAM773 include diagnosis, prevention and treatment of diseases and clinical conditions associated with LOC170395. LOC200268 (Accession XM_114178) is another VGAM773 host target gene. LOC200268 BINDING SITE is HOST TARGET binding site found in the 3' untranslated region of mRNA encoded by LOC200268, corresponding to a HOST TARGET binding site such as BINDING SITE I, BINDING SITE II or BINDING SITE III. Table 2 illustrates the complementarity of the nucleotide sequences of LOC200268 BINDING SITE, designated SEQ ID:42764, to the nucleotide sequence of VGAM773 RNA, herein designated VGAM RNA, also designated SEQ ID:3484.

Another function of VGAM773 is therefore inhibition of LOC200268 (Accession XM_114178). Accordingly, utilities of VGAM773 include diagnosis, prevention and treatment of diseases and clinical conditions associated with LOC200268. FIG. 1 further provides a conceptual description of a novel bioinformatically detected viral gene of the present invention, referred to here as Viral Genomic Address Messenger 774 (VGAM774) viral gene, which modulates expression of respective host target genes thereof, the function and utility of which host target genes is known in the art.

VGAM774 is a novel bioinformatically detected regulatory, non protein coding, viral micro RNA (miRNA) gene. The method by which VGAM774 was detected is described hereinabove with reference to FIGS. 1-8.

VGAM774 gene, herein designated VGAM GENE, is a viral gene contained in the genome of Bovine Coronavirus. VGAM774 host target gene, herein designated VGAM HOST TARGET GENE, is a human gene contained in the human genome.

VGAM774 gene encodes a VGAM774 precursor RNA, herein designated VGAM PRECURSOR RNA. Similar to other miRNA genes, and unlike most ordinary genes, VGAM774 precursor RNA does not encode a protein. A nucleotide sequence identical or highly similar to the nucleotide sequence of VGAM774 precursor RNA is designated SEQ ID:760, and is provided hereinbelow with reference to the sequence listing part. Nucleotide sequence SEQ ID:760 is located at position 23642 relative to the genome of Bovine Coronavirus.

VGAM774 precursor RNA folds onto itself, forming VGAM774 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM774 folded precursor RNA into VGAM774 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM774 RNA is designated SEQ ID:3485, and is provided hereinbelow with reference to the sequence listing part.

VGAM774 host target gene, herein designated VGAM HOST TARGET GENE, encodes a corresponding messenger RNA, VGAM774 host target RNA, herein designated VGAM HOST TARGET RNA. VGAM774 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM774 RNA, herein designated VGAM RNA, binds complementarily to one or more host target binding sites located in untranslated regions of VGAM774 host target RNA, herein designated VGAM HOST TARGET RNA. This complementary binding is due to the fact that the nucleotide sequence of VGAM774 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM774 RNA, herein designated VGAM RNA, may have a different number of host target binding sites in untranslated regions of a VGAM774 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM774 RNA, herein designated VGAM RNA, to host target binding sites on VGAM774 host target RNA, herein designated VGAM HOST TARGET RNA, such as BINDING SITE I, BINDING SITE II and BINDING SITE III, inhibits translation of VGAM774 host target RNA into VGAM774 host target protein, herein designated VGAM HOST TARGET PROTEIN. VGAM host target protein is therefore outlined by a broken line.

It is appreciated that VGAM774 host target gene, herein designated VGAM HOST TARGET GENE, in fact represents a plurality of VGAM774 host target genes. The mRNA of each one of this plurality of VGAM774 host target genes comprises one or more host target binding sites, each having a nucleotide sequence which is at least partly complementary to VGAM774 RNA, herein designated VGAM RNA, and which when bound by VGAM774 RNA causes inhibition of translation of respective one or more VGAM774 host target proteins.

It is further appreciated by one skilled in the art that the mode of translational inhibition illustrated by FIG. 1 with specific reference to translational inhibition exerted by VGAM774 gene, herein designated VGAM GENE, on one or more VGAM774 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM774 is inhibition of expression of host target genes, as part of a novel viral mechanism of attacking a host. Accordingly, utilities of VGAM774 include diagnosis, prevention and treatment of viral infection by Bovine Coronavirus. Specific functions, and accordingly utilities, of VGAM774 correlate with, and may be deduced from, the identity of the host target genes which VGAM774 binds and inhibits, and the function of these host target genes, as elaborated hereinbelow.

Nucleotide sequences of the VGAM774 precursor RNA, herein designated VGAM PRECURSOR RNA, and of the 'diced' VGAM774 RNA, herein designated VGAM RNA, and a schematic representation of the secondary folding of VGAM774 folded precursor RNA, herein designated VGAM FOLDED PRECURSOR RNA, of VGAM774 are further described hereinbelow with reference to Table 1.

Nucleotide sequences of host target binding sites, such as BINDING SITE-I, BINDING SITE-II and BINDING SITE-III of FIG. 1, found on VGAM774 host target RNA, and schematic representation of the complementarity of each of these host target binding sites to VGAM774 RNA, herein designated VGAM RNA, are described hereinbelow with reference to Table 2.

As mentioned hereinabove with reference to FIG. 1, a function of VGAM774 gene, herein designated VGAM is inhibition of expression of VGAM774 target genes. It is appreciated that specific functions, and accordingly utilities, of VGAM774 correlate with, and may be deduced from, the identity of the target genes which VGAM774 binds and inhibits, and the function of these target genes, as elaborated hereinbelow.

Eukaryotic Translation Initiation Factor 1A (EIF1A, Accession XM_114147) is a VGAM774 host target gene. EIF1A BINDING SITE is HOST TARGET binding site found in the 3' untranslated region of mRNA encoded by EIF1A, corresponding to a HOST TARGET binding site such as BINDING SITE I, BINDING SITE II or BINDING SITE III. Table 2 illustrates the complementarity of the nucleotide sequences of EIF1A BINDING SITE, designated SEQ ID:42724, to the nucleotide sequence of VGAM774 RNA, herein designated VGAM RNA, also designated SEQ ID:3485.

A function of VGAM774 is therefore inhibition of Eukaryotic Translation Initiation Factor 1A (EIF1A, Accession XM_114147), a gene which seems to be required for maximal rate of protein biosynthesis. Accordingly, utilities of VGAM774 include diagnosis, prevention and treatment of diseases and clinical conditions associated with EIF1A. The function of EIF1A and its association with various diseases and clinical conditions, has been established by previous studies, as described hereinabove with reference to VGAM120. FIG. 1 further provides a conceptual description of a novel bioinformatically detected viral gene of the present invention, referred to here as Viral Genomic Address Messenger 775 (VGAM775) viral gene, which modulates expression of respective host target genes thereof, the function and utility of which host target genes is known in the art.

VGAM775 is a novel bioinformatically detected regulatory, non protein coding, viral micro RNA (miRNA) gene. The method by which VGAM775 was detected is described hereinabove with reference to FIGS. 1-8.

VGAM775 gene, herein designated VGAM GENE, is a viral gene contained in the genome of Bovine Coronavirus. VGAM775 host target gene, herein designated VGAM HOST TARGET GENE, is a human gene contained in the human genome.

VGAM775 gene encodes a VGAM775 precursor RNA, herein designated VGAM PRECURSOR RNA. Similar to other miRNA genes, and unlike most ordinary genes, VGAM775 precursor RNA does not encode a protein. A nucleotide sequence identical or highly similar to the nucleotide sequence of VGAM775 precursor RNA is designated SEQ ID:761, and is provided hereinbelow with reference to the sequence listing part. Nucleotide sequence SEQ ID:761 is located at position 24623 relative to the genome of Bovine Coronavirus.

VGAM775 precursor RNA folds onto itself, forming VGAM775 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM775 folded precursor RNA into VGAM775 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM775 RNA is designated SEQ ID:3486, and is provided hereinbelow with reference to the sequence listing part.

VGAM775 host target gene, herein designated VGAM HOST TARGET GENE, encodes a corresponding messenger RNA, VGAM775 host target RNA, herein designated VGAM HOST TARGET RNA. VGAM775 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM775 RNA, herein designated VGAM RNA, binds complementarily to one or more host target binding sites located in untranslated regions of VGAM775 host target RNA, herein designated VGAM HOST TARGET RNA. This complementary binding is due to the fact that the nucleotide sequence of VGAM775 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM775 RNA, herein designated VGAM RNA, may have a different number of host target binding sites in untranslated regions of a VGAM775 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM775 RNA, herein designated VGAM RNA, to host target binding sites on VGAM775 host target RNA, herein designated VGAM HOST TARGET RNA, such as BINDING SITE I, BINDING SITE II and BINDING SITE III, inhibits translation of VGAM775 host target RNA into VGAM775 host target protein, herein designated VGAM HOST TARGET PROTEIN. VGAM host target protein is therefore outlined by a broken line.

It is appreciated that VGAM775 host target gene, herein designated VGAM HOST TARGET GENE, in fact represents a plurality of VGAM775 host target genes. The mRNA of each one of this plurality of VGAM775 host target genes comprises one or more host target binding sites, each having a nucleotide sequence which is at least partly complementary to VGAM775 RNA, herein designated VGAM RNA, and which when bound by VGAM775 RNA causes inhibition of translation of respective one or more VGAM775 host target proteins.

It is further appreciated by one skilled in the art that the mode of translational inhibition illustrated by FIG. 1 with specific reference to translational inhibition exerted by VGAM775 gene, herein designated VGAM GENE, on one or more VGAM775 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM775 is inhibition of expression of host target genes, as part of a novel viral mechanism of attacking a host. Accordingly, utilities of VGAM775 include diagnosis, prevention and treatment of viral infection by Bovine Coronavirus. Specific functions, and accordingly utilities, of VGAM775 correlate with, and may be deduced from, the identity of the host target genes which VGAM775 binds and inhibits, and the function of these host target genes, as elaborated hereinbelow.

Nucleotide sequences of the VGAM775 precursor RNA, herein designated VGAM PRECURSOR RNA, and of the 'diced' VGAM775 RNA, herein designated VGAM RNA, and a schematic representation of the secondary folding of VGAM775 folded precursor RNA, herein designated VGAM FOLDED PRECURSOR RNA, of VGAM775 are further described hereinbelow with reference to Table 1.

Nucleotide sequences of host target binding sites, such as BINDING SITE-I, BINDING SITE-II and BINDING SITE-III of FIG. 1, found on VGAM775 host target RNA, and schematic representation of the complementarity of each of these host target binding sites to VGAM775 RNA, herein designated VGAM RNA, are described hereinbelow with reference to Table 2.

As mentioned hereinabove with reference to FIG. 1, a function of VGAM775 gene, herein designated VGAM is inhibition of expression of VGAM775 target genes. It is appreciated that specific functions, and accordingly utilities, of VGAM775 correlate with, and may be deduced from, the identity of the target genes which VGAM775 binds and inhibits, and the function of these target genes, as elaborated hereinbelow.

Tissue Inhibitor of Metalloproteinase 3 (Sorsby fundus dystrophy, pseudoinflammatory) (TIMP3, Accession NM_000362) is a VGAM775 host target gene. TIMP3 BINDING SITE is HOST TARGET binding site found in the 3' untranslated region of mRNA encoded by TIMP3, corresponding to a HOST TARGET binding site such as BINDING SITE I, BINDING SITE II or BINDING SITE III. Table 2 illustrates the complementarity of the nucleotide sequences of TIMP3 BINDING SITE, designated SEQ ID:5926, to the nucleotide sequence of VGAM775 RNA, herein designated VGAM RNA, also designated SEQ ID:3486.

A function of VGAM775 is therefore inhibition of Tissue Inhibitor of Metalloproteinase 3 (Sorsby fundus dystrophy, pseudoinflammatory) (TIMP3, Accession NM_000362). Accordingly, utilities of VGAM775 include diagnosis, prevention and treatment of diseases and clinical conditions associated with TIMP3. LOC90785 (Accession XM_034110) is another VGAM775 host target gene. LOC90785 BINDING SITE is HOST TARGET binding site found in the 3' untranslated region of mRNA encoded by LOC90785, corresponding to a HOST TARGET binding site such as BINDING SITE I, BINDING SITE II or BINDING SITE III. Table 2 illustrates the complementarity of the nucleotide sequences of LOC90785 BINDING SITE, designated SEQ ID:32006, to the nucleotide sequence of VGAM775 RNA, herein designated VGAM RNA, also designated SEQ ID:3486.

Another function of VGAM775 is therefore inhibition of LOC90785 (Accession XM_034110). Accordingly, utilities of VGAM775 include diagnosis, prevention and treatment of diseases and clinical conditions associated with LOC90785. FIG. 1 further provides a conceptual description of a novel bioinformatically detected viral gene of the present invention, referred to here as Viral Genomic Address Messenger 776 (VGAM776) viral gene, which modulates expression of respective host target genes thereof, the function and utility of which host target genes is known in the art.

VGAM776 is a novel bioinformatically detected regulatory, non protein coding, viral micro RNA (miRNA) gene. The method by which VGAM776 was detected is described hereinabove with reference to FIGS. 1-8.

VGAM776 gene, herein designated VGAM GENE, is a viral gene contained in the genome of Culex Nigripalpus Baculovirus. VGAM776 host target gene, herein designated VGAM HOST TARGET GENE, is a human gene contained in the human genome.

VGAM776 gene encodes a VGAM776 precursor RNA, herein designated VGAM PRECURSOR RNA. Similar to other miRNA genes, and unlike most ordinary genes, VGAM776 precursor RNA does not encode a protein. A nucleotide sequence identical or highly similar to the nucleotide sequence of VGAM776 precursor RNA is designated SEQ ID:762, and is provided hereinbelow with reference to the sequence listing part. Nucleotide sequence SEQ ID:762 is located at position 29557 relative to the genome of Culex Nigripalpus Baculovirus.

VGAM776 precursor RNA folds onto itself, forming VGAM776 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM776 folded precursor RNA into VGAM776 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM776 RNA is designated SEQ ID:3487, and is provided hereinbelow with reference to the sequence listing part.

VGAM776 host target gene, herein designated VGAM HOST TARGET GENE, encodes a corresponding messenger RNA, VGAM776 host target RNA, herein designated VGAM HOST TARGET RNA. VGAM776 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM776 RNA, herein designated VGAM RNA, binds complementarily to one or more host target binding sites located in untranslated regions of VGAM776 host target RNA, herein designated VGAM HOST TARGET RNA. This complementary binding is due to the fact that the nucleotide sequence of VGAM776 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM776 RNA, herein designated VGAM RNA, may have a different number of host target binding sites in untranslated regions of a VGAM776 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM776 RNA, herein designated VGAM RNA, to host target binding sites on VGAM776 host target RNA, herein designated VGAM HOST TARGET RNA, such as BINDING SITE I, BINDING SITE II and BINDING SITE III, inhibits translation of VGAM776 host target RNA into VGAM776 host target protein, herein designated VGAM HOST TARGET PROTEIN. VGAM host target protein is therefore outlined by a broken line.

It is appreciated that VGAM776 host target gene, herein designated VGAM HOST TARGET GENE, in fact represents a plurality of VGAM776 host target genes. The mRNA of each one of this plurality of VGAM776 host target genes comprises one or more host target binding sites, each having a nucleotide sequence which is at least partly complementary to VGAM776 RNA, herein designated VGAM RNA, and which when bound by VGAM776 RNA causes inhibition of translation of respective one or more VGAM776 host target proteins.

It is further appreciated by one skilled in the art that the mode of translational inhibition illustrated by FIG. 1 with specific reference to translational inhibition exerted by VGAM776 gene, herein designated VGAM GENE, on one or more VGAM776 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM776 is inhibition of expression of host target genes, as part of a novel viral mechanism of attacking a host. Accordingly, utilities of VGAM776 include diagnosis, prevention and treatment of viral infection by Culex Nigripalpus Baculovirus. Specific functions, and accordingly utilities, of VGAM776 correlate with, and may be deduced from, the identity of the host target genes which VGAM776 binds and inhibits, and the function of these host target genes, as elaborated hereinbelow.

Nucleotide sequences of the VGAM776 precursor RNA, herein designated VGAM PRECURSOR RNA, and of the 'diced' VGAM776 RNA, herein designated VGAM RNA, and a schematic representation of the secondary folding of VGAM776 folded precursor RNA, herein designated VGAM FOLDED PRECURSOR RNA, of VGAM776 are further described hereinbelow with reference to Table 1.

Nucleotide sequences of host target binding sites, such as BINDING SITE-I, BINDING SITE-II and BINDING SITE-III of FIG. 1, found on VGAM776 host target RNA, and schematic representation of the complementarity of each of these host target binding sites to VGAM776 RNA, herein designated VGAM RNA, are described hereinbelow with reference to Table 2.

As mentioned hereinabove with reference to FIG. 1, a function of VGAM776 gene, herein designated VGAM is inhibition of expression of VGAM776 target genes. It is appreciated that specific functions, and accordingly utilities, of VGAM776 correlate with, and may be deduced from, the identity of the target genes which VGAM776 binds and inhibits, and the function of these target genes, as elaborated hereinbelow.

KIAA0826 (Accession XM_093839) is a VGAM776 host target gene. KIAA0826 BINDING SITE is HOST TARGET binding site found in the 5' untranslated region of mRNA encoded by KIAA0826, corresponding to a HOST TARGET binding site such as BINDING SITE I, BINDING SITE II or BINDING SITE III. Table 2 illustrates the complementarity of the nucleotide sequences of KIAA0826 BINDING SITE, designated SEQ ID:40216, to the nucleotide sequence of VGAM776 RNA, herein designated VGAM RNA, also designated SEQ ID:3487.

A function of VGAM776 is therefore inhibition of KIAA0826 (Accession XM_093839). Accordingly, utilities of VGAM776 include diagnosis, prevention and treatment of diseases and clinical conditions associated with KIAA0826. MGC2654 (Accession NM_024109) is another VGAM776 host target gene. MGC2654 BINDING SITE is HOST TARGET binding site found in the 3' untranslated region of mRNA encoded by MGC2654, corresponding to a HOST TARGET binding site such as BINDING SITE I, BINDING SITE II or BINDING SITE III. Table 2 illustrates the complementarity of the nucleotide sequences of MGC2654 BINDING SITE, designated SEQ ID:23554, to the nucleotide sequence of VGAM776 RNA, herein designated VGAM RNA, also designated SEQ ID:3487.

Another function of VGAM776 is therefore inhibition of MGC2654 (Accession NM_024109). Accordingly, utilities of VGAM776 include diagnosis, prevention and treatment of diseases and clinical conditions associated with MGC2654. FIG. 1 further provides a conceptual description of a novel bioinformatically detected viral gene of the present invention, referred to here as Viral Genomic Address Messenger 777 (VGAM777) viral gene, which modulates expression of respective host target genes thereof, the function and utility of which host target genes is known in the art.

VGAM777 is a novel bioinformatically detected regulatory, non protein coding, viral micro RNA (miRNA) gene. The method by which VGAM777 was detected is described hereinabove with reference to FIGS. 1-8.

VGAM777 gene, herein designated VGAM GENE, is a viral gene contained in the genome of Culex Nigripalpus Baculovirus. VGAM777 host target gene, herein designated VGAM HOST TARGET GENE, is a human gene contained in the human genome.

VGAM777 gene encodes a VGAM777 precursor RNA, herein designated VGAM PRECURSOR RNA. Similar to other miRNA genes, and unlike most ordinary genes, VGAM777 precursor RNA does not encode a protein. A nucleotide sequence identical or highly similar to the nucleotide sequence of VGAM777 precursor RNA is designated SEQ ID:763, and is provided hereinbelow with reference to the sequence listing part. Nucleotide sequence SEQ ID:763 is located at position 71215 relative to the genome of Culex Nigripalpus Baculovirus.

VGAM777 precursor RNA folds onto itself, forming VGAM777 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM777 folded precursor RNA into VGAM777 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM777 RNA is designated SEQ ID:3488, and is provided hereinbelow with reference to the sequence listing part.

VGAM777 host target gene, herein designated VGAM HOST TARGET GENE, encodes a corresponding messenger RNA, VGAM777 host target RNA, herein designated VGAM HOST TARGET RNA. VGAM777 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM777 RNA, herein designated VGAM RNA, binds complementarily to one or more host target binding sites located in untranslated regions of VGAM777 host target RNA, herein designated VGAM HOST TARGET RNA. This complementary binding is due to the fact that the nucleotide sequence of VGAM777 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM777 RNA, herein designated VGAM RNA, may have a different number of host target binding sites in untranslated regions of a VGAM777 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM777 RNA, herein designated VGAM RNA, to host target binding sites on VGAM777 host target RNA, herein designated VGAM HOST TARGET RNA, such as BINDING SITE I, BINDING SITE II and BINDING SITE III, inhibits translation of VGAM777 host target RNA into VGAM777 host target protein, herein designated VGAM HOST TARGET PROTEIN. VGAM host target protein is therefore outlined by a broken line.

It is appreciated that VGAM777 host target gene, herein designated VGAM HOST TARGET GENE, in fact represents a plurality of VGAM777 host target genes. The mRNA of each one of this plurality of VGAM777 host target genes comprises one or more host target binding sites, each having a nucleotide sequence which is at least partly complementary to VGAM777 RNA, herein designated VGAM RNA, and which when bound by VGAM777 RNA causes inhibition of translation of respective one or more VGAM777 host target proteins.

It is further appreciated by one skilled in the art that the mode of translational inhibition illustrated by FIG. 1 with specific reference to translational inhibition exerted by VGAM777 gene, herein designated VGAM GENE, on one or more VGAM777 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM777 is inhibition of expression of host target genes, as part of a novel viral mechanism of attacking a host. Accordingly, utilities of VGAM777 include diagnosis, prevention and treatment of viral infection by Culex Nigripalpus Baculovirus. Specific functions, and accordingly utilities, of VGAM777 correlate with, and may be deduced from, the identity of the host target genes which VGAM777 binds and inhibits, and the function of these host target genes, as elaborated hereinbelow.

Nucleotide sequences of the VGAM777 precursor RNA, herein designated VGAM PRECURSOR RNA, and of the 'diced' VGAM777 RNA, herein designated VGAM RNA, and a schematic representation of the secondary folding of VGAM777 folded precursor RNA, herein designated VGAM FOLDED PRECURSOR RNA, of VGAM777 are further described hereinbelow with reference to Table 1.

Nucleotide sequences of host target binding sites, such as BINDING SITE-I, BINDING SITE-II and BINDING SITE-III of FIG. 1, found on VGAM777 host target RNA, and schematic representation of the complementarity of each of these host target binding sites to VGAM777 RNA, herein designated VGAM RNA, are described hereinbelow with reference to Table 2.

As mentioned hereinabove with reference to FIG. 1, a function of VGAM777 gene, herein designated VGAM is inhibition of expression of VGAM777 target genes. It is appreciated that specific functions, and accordingly utilities, of VGAM777 correlate with, and may be deduced from, the identity of the target genes which VGAM777 binds and inhibits, and the function of these target genes, as elaborated hereinbelow.

Ankyrin 1, Erythrocytic (ANK1, Accession XM_016774) is a VGAM777 host target gene. ANK1 BINDING SITE is HOST TARGET binding site found in the 3' untranslated region of mRNA encoded by ANK1, corresponding to a HOST TARGET binding site such as BINDING SITE I, BINDING SITE II or BINDING SITE III. Table 2 illustrates the complementarity of the nucleotide sequences of ANK1 BINDING SITE, designated SEQ ID:30288, to the nucleotide sequence of VGAM777 RNA, herein designated VGAM RNA, also designated SEQ ID:3488.

A function of VGAM777 is therefore inhibition of Ankyrin 1, Erythrocytic (ANK1, Accession XM_016774). Accordingly, utilities of VGAM777 include diagnosis, prevention and treatment of diseases and clinical conditions associated with ANK1. Glycogenin (GYG, Accession NM_004130) is another VGAM777 host target gene. GYG BINDING SITE is HOST TARGET binding site found in the 3' untranslated region of mRNA encoded by GYG, corresponding to a HOST TARGET binding site such as BINDING SITE I, BINDING SITE II or BINDING SITE III. Table 2 illustrates the complementarity of the nucleotide sequences of GYG BINDING SITE, designated SEQ ID:10339, to the nucleotide sequence of VGAM777 RNA, herein designated VGAM RNA, also designated SEQ ID:3488.

Another function of VGAM777 is therefore inhibition of Glycogenin (GYG, Accession NM_004130), a gene which primes de novo glycogen synthesis. Accordingly, utilities of VGAM777 include diagnosis, prevention and treatment of diseases and clinical conditions associated with GYG. The function of GYG has been established by previous studies. Glycogenin is a self-glucosylating protein involved in the initiation reactions of glycogen synthesis. During initiation, the covalent attachment of a glucose residue to glycogenin is followed by elongation to form an oligosaccharide chain. Viskupic et al. (1992) isolated cDNAs encoding glycogenin from rabbit muscle, rat, and cow. Recombinant mammalian glycogenin was enzymatically active and capable of self-glucosylation. After incubation with UDP-glucose, the recombinant protein was able to serve as a substrate for glycogen synthase, leading to the production of high M(r) polysaccharide. Barbetti et al. (1996) identified a human glycogenin cDNA. The predicted 333-amino acid human protein shares 93% identity with rabbit muscle glycogenin. Northern blot analysis revealed that the 2.4-kb glycogenin mRNA was expressed prominently in human skeletal muscle and heart, and to a lesser extent in several other tissues. Mu et al. (1997) isolated cDNAs encoding a related protein, which they designated glycogenin-2 (OMIM Ref. No. 300198). They suggested that muscle glycogenin be referred to as glycogenin-1.

Full details of the abovementioned studies are described in the following publications, the disclosure of which are hereby incorporated by reference:

Barbetti, F.; Rocchi, M.; Bossolasco, M.; Cordera, R.; Sbraccia, P.; Finelli, P.; Consalez, G. G.: The human skeletal muscle glycogenin gene: cDNA, tissue expression, and chromosomal localization. Biochem. Biophys. Res. Commun. 220:72-77, 1996; and Mu, J.; Skurat, A. V.; Roach, P. J.: Glycogenin-2, a novel self-glucosylating protein involved in liver glycogen biosynthesis. J. Biol. Chem. 272:27589-27597, 1997.

Further studies establishing the function and utilities of GYG are found in John Hopkins OMIM database record ID 603942, and in sited publications numbered 5043, 518 and 11401 listed in the bibliography section hereinbelow, which are also hereby incorporated by reference. Heterogeneous Nuclear Ribonucleoprotein F (HNRPF, Accession NM_004966) is another VGAM777 host target gene. HNRPF BINDING SITE is HOST TARGET binding site found in the 3' untranslated region of mRNA encoded by HNRPF, corresponding to a HOST TARGET binding site such as BINDING SITE I, BINDING SITE II or BINDING SITE III. Table 2 illustrates the complementarity of the nucleotide sequences of HNRPF BINDING SITE, designated SEQ ID:11414, to the nucleotide sequence of VGAM777 RNA, herein designated VGAM RNA, also designated SEQ ID:3488.

Another function of VGAM777 is therefore inhibition of Heterogeneous Nuclear Ribonucleoprotein F (HNRPF, Accession NM_004966). Accordingly, utilities of VGAM777 include diagnosis, prevention and treatment of diseases and clinical conditions associated with HNRPF. inositol (myo)-1(or 4)-monophosphatase 2 (IMPA2, Accession XM_170862) is another VGAM777 host target gene. IMPA2 BINDING SITE is HOST TARGET binding site found in the 5' untranslated region of mRNA encoded by IMPA2, corresponding to a HOST TARGET binding site such as BINDING SITE I, BINDING SITE II or BINDING SITE III. Table 2 illustrates the complementarity of the nucleotide sequences of IMPA2 BINDING SITE, designated SEQ ID:45631, to the nucleotide sequence of VGAM777 RNA, herein designated VGAM RNA, also designated SEQ ID:3488.

Another function of VGAM777 is therefore inhibition of inositol (myo)-1(or 4)-monophosphatase 2 (IMPA2, Accession XM_170862). Accordingly, utilities of VGAM777 include diagnosis, prevention and treatment of diseases and clinical conditions associated with IMPA2. MAD, Mothers Against Decapentaplegic Homolog 4 (Drosophila) (MADH4, Accession NM_005359) is another VGAM777 host target gene. MADH4 BINDING SITE is HOST TARGET binding site found in the 3' untranslated region of mRNA encoded by MADH4, corresponding to a HOST TARGET binding site such as BINDING SITE I, BINDING SITE II or BINDING SITE III. Table 2 illustrates the complementarity of the nucleotide sequences of MADH4 BINDING SITE, designated SEQ ID:11830, to the nucleotide sequence of VGAM777 RNA, herein designated VGAM RNA, also designated SEQ ID:3488.

Another function of VGAM777 is therefore inhibition of MAD, Mothers Against Decapentaplegic Homolog 4 (Drosophila) (MADH4, Accession NM_005359), a gene which common mediator of signal transduction by tgf-beta (transforming growth factor) superfamily; smad4 is the common smad (co-smad). promotes binding of the smad2/smad4/fast-1 complex to dna and provides an activation function required for smad1 or smad2 to stimulate transcription. may act as a tumor suppressor. Accordingly, utilities of VGAM777 include diagnosis, prevention and treatment of diseases and clinical conditions associated with MADH4. The function of MADH4 and its association with various diseases and clinical conditions, has been established by previous studies, as described hereinabove with reference to VGAM217. Ribosomal Protein S6 Kinase, 90 kDa, Polypeptide 5 (RPS6KA5, Accession NM_004755) is another VGAM777 host target gene. RPS6KA5 BINDING SITE is HOST TARGET binding site found in the 3' untranslated region of mRNA encoded by RPS6KA5, corresponding to a HOST TARGET binding site such as BINDING SITE I, BINDING SITE II or BINDING SITE III. Table 2 illustrates the complementarity of the nucleotide sequences of RPS6KA5 BINDING SITE, designated SEQ ID:11143, to the nucleotide sequence of VGAM777 RNA, herein designated VGAM RNA, also designated SEQ ID:3488.

Another function of VGAM777 is therefore inhibition of Ribosomal Protein S6 Kinase, 90 kDa, Polypeptide 5 (RPS6KA5, Accession NM_004755), a gene which plays an essential role in the proliferation of yeast cells. Accordingly, utilities of VGAM777 include diagnosis, prevention and treatment of diseases and clinical conditions associated with RPS6KA5. The function of RPS6KA5 and its association with various diseases and clinical conditions, has been established by previous studies, as described hereinabove with reference to VGAM191. FLJ20519 (Accession NM_017860) is another VGAM777 host target gene. FLJ20519 BINDING SITE is HOST TARGET binding site found in the 3' untranslated region of mRNA encoded by FLJ20519, corresponding to a HOST TARGET binding site such as BINDING SITE I, BINDING SITE II or BINDING SITE III. Table 2 illustrates the complementarity of the nucleotide sequences of FLJ20519 BINDING SITE, designated SEQ ID:19536, to the nucleotide sequence of VGAM777 RNA, herein designated VGAM RNA, also designated SEQ ID:3488.

Another function of VGAM777 is therefore inhibition of FLJ20519 (Accession NM_017860). Accordingly, utilities of VGAM777 include diagnosis, prevention and treatment of diseases and clinical conditions associated with FLJ20519. HSPC072 (Accession NM_014162) is another VGAM777 host target gene. HSPC072 BINDING SITE is HOST TARGET binding site found in the 5' untranslated region of mRNA encoded by HSPC072, corresponding to a HOST TARGET binding site such as BINDING SITE I, BINDING SITE II or BINDING SITE III. Table 2 illustrates the complementarity of the nucleotide sequences of HSPC072 BINDING SITE, designated SEQ ID:15460, to the nucleotide sequence of VGAM777 RNA, herein designated VGAM RNA, also designated SEQ ID:3488.

Another function of VGAM777 is therefore inhibition of HSPC072 (Accession NM_014162). Accordingly, utilities of VGAM777 include diagnosis, prevention and treatment of diseases and clinical conditions associated with HSPC072. KIAA0678 (Accession XM_039828) is another VGAM777 host target gene. KIAA0678 BINDING SITE is HOST TARGET binding site found in the 3' untranslated region of mRNA encoded by KIAA0678, corresponding to a HOST TARGET binding site such as BINDING SITE I, BINDING SITE II or BINDING SITE III. Table 2 illustrates the complementarity of the nucleotide sequences of KIAA0678 BINDING SITE, designated SEQ ID:33196, to the nucleotide sequence of VGAM777 RNA, herein designated VGAM RNA, also designated SEQ ID:3488.

Another function of VGAM777 is therefore inhibition of KIAA0678 (Accession XM_039828). Accordingly, utilities of VGAM777 include diagnosis, prevention and treatment of diseases and clinical conditions associated with KIAA0678. Zinc Finger, DHHC Domain Containing 5 (ZDHHC5, Accession XM_166204) is another VGAM777 host target gene. ZDHHC5 BINDING SITE is HOST TARGET binding site found in the 5' untranslated region of mRNA encoded by ZDHHC5, corresponding to a HOST TARGET binding site such as BINDING SITE I, BINDING SITE II or BINDING SITE III. Table 2 illustrates the complementarity of the nucleotide sequences of ZDHHC5 BINDING SITE, designated SEQ ID:44007, to the nucleotide sequence of VGAM777 RNA, herein designated VGAM RNA, also designated SEQ ID:3488.

Another function of VGAM777 is therefore inhibition of Zinc Finger, DHHC Domain Containing 5 (ZDHHC5, Accession XM_166204). Accordingly, utilities of VGAM777 include diagnosis, prevention and treatment of diseases and clinical conditions associated with ZDHHC5. LOC199990 (Accession XM_114083) is another VGAM777 host target gene. LOC199990 BINDING SITE is HOST TARGET binding site found in the 3' untranslated region of mRNA encoded by LOC199990, corresponding to a HOST TARGET binding site such as BINDING SITE I, BINDING SITE II or BINDING SITE III. Table 2 illustrates the complementarity of the nucleotide sequences of LOC199990 BINDING SITE, designated SEQ ID:42679, to the nucleotide sequence of VGAM777 RNA, herein designated VGAM RNA, also designated SEQ ID:3488.

Another function of VGAM777 is therefore inhibition of LOC199990 (Accession XM_114083). Accordingly, utilities of VGAM777 include diagnosis, prevention and treatment of diseases and clinical conditions associated with LOC199990. FIG. 1 further provides a conceptual description of a novel bioinformatically detected viral gene of the present invention, referred to here as Viral Genomic Address Messenger 778 (VGAM778) viral gene, which modulates expression of respective host target genes thereof, the function and utility of which host target genes is known in the art.

VGAM778 is a novel bioinformatically detected regulatory, non protein coding, viral micro RNA (miRNA) gene. The method by which VGAM778 was detected is described hereinabove with reference to FIGS. 1-8.

VGAM778 gene, herein designated VGAM GENE, is a viral gene contained in the genome of Culex Nigripalpus Baculovirus. VGAM778 host target gene, herein designated VGAM HOST TARGET GENE, is a human gene contained in the human genome.

VGAM778 gene encodes a VGAM778 precursor RNA, herein designated VGAM PRECURSOR RNA. Similar to other miRNA genes, and unlike most ordinary genes, VGAM778 precursor RNA does not encode a protein. A nucleotide sequence identical or highly similar to the nucleotide sequence of VGAM778 precursor RNA is designated SEQ ID:764, and is provided hereinbelow with reference to the sequence listing part. Nucleotide sequence SEQ ID:764 is located at position 84607 relative to the genome of Culex Nigripalpus Baculovirus.

VGAM778 precursor RNA folds onto itself, forming VGAM778 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM778 folded precursor RNA into VGAM778 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 86%) nucleotide sequence of VGAM778 RNA is designated SEQ ID:3489, and is provided hereinbelow with reference to the sequence listing part.

VGAM778 host target gene, herein designated VGAM HOST TARGET GENE, encodes a corresponding messenger RNA, VGAM778 host target RNA, herein designated VGAM HOST TARGET RNA. VGAM778 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM778 RNA, herein designated VGAM RNA, binds complementarily to one or more host target binding sites located in untranslated regions of VGAM778 host target RNA, herein designated VGAM HOST TARGET RNA. This complementary binding is due to the fact that the nucleotide sequence of VGAM778 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM778 RNA, herein designated VGAM RNA, may have a different number of host target binding sites in untranslated regions of a VGAM778 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM778 RNA, herein designated VGAM RNA, to host target binding sites on VGAM778 host target RNA, herein designated VGAM HOST TARGET RNA, such as BINDING SITE I, BINDING SITE II and BINDING SITE III, inhibits translation of VGAM778 host target RNA into VGAM778 host target protein, herein designated VGAM HOST TARGET PROTEIN. VGAM host target protein is therefore outlined by a broken line.

It is appreciated that VGAM778 host target gene, herein designated VGAM HOST TARGET GENE, in fact represents a plurality of VGAM778 host target genes. The mRNA of each one of this plurality of VGAM778 host target genes comprises one or more host target binding sites, each having a nucleotide sequence which is at least partly complementary to VGAM778 RNA, herein designated VGAM RNA, and which when bound by VGAM778 RNA causes inhibition of translation of respective one or more VGAM778 host target proteins.

It is further appreciated by one skilled in the art that the mode of translational inhibition illustrated by FIG. 1 with specific reference to translational inhibition exerted by VGAM778 gene, herein designated VGAM GENE, on one or more VGAM778 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM778 is inhibition of expression of host target genes, as part of a novel viral mechanism of attacking a host. Accordingly, utilities of VGAM778 include diagnosis, prevention and treatment of viral infection by Culex Nigripalpus Baculovirus. Specific functions, and accordingly utilities, of VGAM778 correlate with, and may be deduced from, the identity of the host target genes which VGAM778 binds and inhibits, and the function of these host target genes, as elaborated hereinbelow.

Nucleotide sequences of the VGAM778 precursor RNA, herein designated VGAM PRECURSOR RNA, and of the 'diced' VGAM778 RNA, herein designated VGAM RNA, and a schematic representation of the secondary folding of VGAM778 folded precursor RNA, herein designated VGAM FOLDED PRECURSOR RNA, of VGAM778 are further described hereinbelow with reference to Table 1.

Nucleotide sequences of host target binding sites, such as BINDING SITE-I, BINDING SITE-II and BINDING SITE-III of FIG. 1, found on VGAM778 host target RNA, and schematic representation of the complementarity of each of these host target binding sites to VGAM778 RNA, herein designated VGAM RNA, are described hereinbelow with reference to Table 2.

As mentioned hereinabove with reference to FIG. 1, a function of VGAM778 gene, herein designated VGAM is inhibition of expression of VGAM778 target genes. It is appreciated that specific functions, and accordingly utilities, of VGAM778 correlate with, and may be deduced from, the identity of the target genes which VGAM778 binds and inhibits, and the function of these target genes, as elaborated hereinbelow.

Nucleoporin 98 kDa (NUP98, Accession NM_016320) is a VGAM778 host target gene. NUP98 BINDING SITE is HOST TARGET binding site found in the 3' untranslated region of mRNA encoded by NUP98, corresponding to a HOST TARGET binding site such as BINDING SITE I, BINDING SITE II or BINDING SITE III. Table 2 illustrates the complementarity of the nucleotide sequences of NUP98 BINDING SITE, designated SEQ ID:18440, to the nucleotide sequence of VGAM778 RNA, herein designated VGAM RNA, also designated SEQ ID:3489.

A function of VGAM778 is therefore inhibition of Nucleoporin 98 kDa (NUP98, Accession NM_016320), a gene which functions in the nuclear transport of protein and RNA. Accordingly, utilities of VGAM778 include diagnosis, prevention and treatment of diseases and clinical conditions associated with NUP98. The function of NUP98 and its association with various diseases and clinical conditions, has been established by previous studies, as described hereinabove with reference to VGAM55. Oxytocin Receptor (OXTR, Accession NM_000916) is another VGAM778 host target gene. OXTR BINDING SITE is HOST TARGET binding site found in the 5' untranslated region of mRNA encoded by OXTR, corresponding to a HOST TARGET binding site such as BINDING SITE I, BINDING SITE II or BINDING SITE III. Table 2 illustrates the complementarity of the nucleotide sequences of OXTR BINDING SITE, designated SEQ ID:6620, to the nucleotide sequence of VGAM778 RNA, herein designated VGAM RNA, also designated SEQ ID:3489.

Another function of VGAM778 is therefore inhibition of Oxytocin Receptor (OXTR, Accession NM_000916), a gene which induces inward ion currents. Accordingly, utilities of VGAM778 include diagnosis, prevention and treatment of diseases and clinical conditions associated with OXTR. The function of OXTR and its association with various diseases and clinical conditions, has been established by previous studies, as described hereinabove with reference to VGAM636. PRV1 (Accession XM_056490) is another VGAM778 host target gene. PRV1 BINDING SITE is HOST TARGET binding site found in the 3' untranslated region of mRNA encoded by PRV1, corresponding to a HOST TARGET binding site such as BINDING SITE I, BINDING SITE II or BINDING SITE III. Table 2 illustrates the complementarity of the nucleotide sequences of PRV1 BINDING SITE, designated SEQ ID:36399, to the nucleotide sequence of VGAM778 RNA, herein designated VGAM RNA, also designated SEQ ID:3489.

Another function of VGAM778 is therefore inhibition of PRV1 (Accession XM_056490), a gene which may function as a hematopoietic receptor. Accordingly, utilities of VGAM778 include diagnosis, prevention and treatment of diseases and clinical conditions associated with PRV1. The function of PRV1 has been established by previous studies. Using subtractive hybridization of mRNA from polycythemia vera (OMIM Ref. No. 263300) patient granulocytes and mRNA from normal granulocytes, Temerinac et al. (2000) isolated a cDNA encoding NB1, which they called PRV1. Northern blot analysis revealed expression of 2.1- and 3.1-kb transcripts in granulocytes from PV patients but not normal granulocytes. Weak expression of PRV1 was seen in a patient with idiopathic myelofibrosis (see OMIM Ref. No. 254450) and in some patients with essential thrombocythemia (see OMIM Ref. No. 187950), but no expression was seen in patients with acute or chronic myelogenous leukemia (see OMIM Ref. No. 601626 and 151410, respectively) or in patients with polycythemic secondary erythrocytosis. Strong expression in bone marrow and slight expression in fetal liver was detected, but PRV1 was not expressed in other tissues. Treatment of normal stem cell donors or, in vitro, normal granulocytes, with GCSF (CSF3; 138970) or CSF2 (OMIM Ref. No. 138960) induced expression initially of the 3.1-kb transcript and, subsequently, the 2.1 kb transcript. The deduced 437-amino acid PRV1 protein contains an N-terminal signal sequence, 2 highly homologous 188-residue cysteine-rich domains that share homology with UPAR domains (see OMIM Ref. No. 606119), and a highly hydrophobic C-terminal sequence probably encoding a GPI link. Western blot and flow cytometric analyses showed cell surface expression of a 60-kD protein, 14 kD greater than the predicted size, probably due to the presence of 3 potential N-glycosylation sites. Immunohistochemistry demonstrated expression in bone marrow early erythroblasts, megakaryocytes, promyelocytes, and myelocytes. Independently, Kissel et al. (2001) cloned and characterized NB1, which they also referred to as CD177 and HNA2A. They obtained the cDNA after purification and microsequence analysis of NB1 protein from normal resting granulocytes. Kissel et al. (2001) noted amino acid differences between the PRV1 (Temerinac et al., 2000) and NB1 sequences at positions 3, 119, 323, and 379 and suggested that 2 different, highly homologous genes may exist. By genomic sequence analysis and PCR, Kissel et al. (2002) determined that the NB1 gene contains 9 exons. By genomic sequence analysis, Kissel et al. (2001) mapped the NB1 gene to chromosome 19q13.2. Kissel et al. (2002) reported that 2 women with no cell-surface NB1 expression but with NB1-specific alloantibodies after delivery of babies with alloimmune neonatal neutropenia possessed genomic NB1. The authors determined that the NB1-negative phenotype resulted from different off-frame insertions at the RNA level causing an absence of GPI linkage sites and transmembrane segments. Kissel et al. (2002) concluded that any putative soluble fragments produced were unable to prevent alloimmunization.

Full details of the abovementioned studies are described in the following publications, the disclosure of which are hereby incorporated by reference:

Kissel, K.; Santoso, S.; Hofmann, C.; Stroncek, D.; Bux, J.: Molecular basis of the neutrophil glycoprotein NB1 (CD177) involved in the pathogenesis of immune neutropenias and transfusion reactions. Europ. J. Immun. 31:1301-1309, 2001; and Kissel, K.; Scheffler, S.; Kerowgan, M.; Bux, J.: Molecular basis of NB1 (HNA-2a, CD177) deficiency. Blood 99:4231-4233, 2002.

Further studies establishing the function and utilities of PRV1 are found in John Hopkins OMIM database record ID 162860, and in sited publications numbered 693-696 listed in the bibliography section hereinbelow, which are also hereby incorporated by reference. Tissue Inhibitor of Metalloproteinase 3 (Sorsby fundus dystrophy, pseudoinflammatory) (TIMP3, Accession NM_000362) is another VGAM778 host target gene. TIMP3 BINDING SITE is HOST TARGET binding site found in the 5' untranslated region of mRNA encoded by TIMP3, corresponding to a HOST TARGET binding site such as BINDING SITE I, BINDING SITE II or BINDING SITE III. Table 2 illustrates the complementarity of the nucleotide sequences of TIMP3 BINDING SITE, designated SEQ ID:5928, to the nucleotide sequence of VGAM778 RNA, herein designated VGAM RNA, also designated SEQ ID:3489.

Another function of VGAM778 is therefore inhibition of Tissue Inhibitor of Metalloproteinase 3 (Sorsby fundus dystrophy, pseudoinflammatory) (TIMP3, Accession NM_000362). Accordingly, utilities of VGAM778 include diagnosis, prevention and treatment of diseases and clinical conditions associated with TIMP3. CLONE24945 (Accession NM_015683) is another VGAM778 host target gene. CLONE24945 BINDING SITE is HOST TARGET binding site found in the 3' untranslated region of mRNA encoded by CLONE24945, corresponding to a HOST TARGET binding site such as BINDING SITE I, BINDING SITE II or BINDING SITE III. Table 2 illustrates the complementarity of the nucleotide sequences of CLONE24945 BINDING SITE, designated SEQ ID:17905, to the nucleotide sequence of VGAM778 RNA, herein designated VGAM RNA, also designated SEQ ID:3489.

Another function of VGAM778 is therefore inhibition of CLONE24945 (Accession NM_015683). Accordingly, utilities of VGAM778 include diagnosis, prevention and treatment of diseases and clinical conditions associated with CLONE24945. HUMAGCGB (Accession NM_013286) is another VGAM778 host target gene. HUMAGCGB BINDING SITE is HOST TARGET binding site found in the 5' untranslated region of mRNA encoded by HUMAGCGB, corresponding to a HOST TARGET binding site such as BINDING SITE I, BINDING SITE II or BINDING SITE III. Table 2 illustrates the complementarity of the nucleotide sequences of HUMAGCGB BINDING SITE, designated SEQ ID:14956, to the nucleotide sequence of VGAM778 RNA, herein designated VGAM RNA, also designated SEQ ID:3489.

Another function of VGAM778 is therefore inhibition of HUMAGCGB (Accession NM_013286). Accordingly, utilities of VGAM778 include diagnosis, prevention and treatment of diseases and clinical conditions associated with HUMAGCGB. KIAA0062 (Accession XM_046677) is another VGAM778 host target gene. KIAA0062 BINDING SITE is HOST TARGET binding site found in the 3' untranslated region of mRNA encoded by KIAA0062, corresponding to a HOST TARGET binding site such as BINDING SITE I, BINDING SITE II or BINDING SITE III. Table 2 illustrates the complementarity of the nucleotide sequences of KIAA0062 BINDING SITE, designated SEQ ID:34794, to the nucleotide sequence of VGAM778 RNA, herein designated VGAM RNA, also designated SEQ ID:3489.

Another function of VGAM778 is therefore inhibition of KIAA0062 (Accession XM_046677). Accordingly, utilities of VGAM778 include diagnosis, prevention and treatment of diseases and clinical conditions associated with KIAA0062. MGC4737 (Accession NM_031466) is another VGAM778 host target gene. MGC4737 BINDING SITE is HOST TARGET binding site found in the 5' untranslated region of mRNA encoded by MGC4737, corresponding to a HOST TARGET binding site such as BINDING SITE I, BINDING SITE II or BINDING SITE III. Table 2 illustrates the complementarity of the nucleotide sequences of MGC4737 BINDING SITE, designated SEQ ID:25508, to the nucleotide sequence of VGAM778 RNA, herein designated VGAM RNA, also designated SEQ ID:3489.

Another function of VGAM778 is therefore inhibition of MGC4737 (Accession NM_031466). Accordingly, utilities of VGAM778 include diagnosis, prevention and treatment of diseases and clinical conditions associated with MGC4737. LOC118611 (Accession XM_061055) is another VGAM778 host target gene. LOC118611 BINDING SITE is HOST TARGET binding site found in the 5' untranslated region of mRNA encoded by LOC118611, corresponding to a HOST TARGET binding site such as BINDING SITE I, BINDING SITE II or BINDING SITE III. Table 2 illustrates the complementarity of the nucleotide sequences of LOC118611 BINDING SITE, designated SEQ ID:37188, to the nucleotide sequence of VGAM778 RNA, herein designated VGAM RNA, also designated SEQ ID:3489.

Another function of VGAM778 is therefore inhibition of LOC118611 (Accession XM_061055). Accordingly, utilities of VGAM778 include diagnosis, prevention and treatment of diseases and clinical conditions associated with LOC118611. LOC146880 (Accession XM_085627) is another VGAM778 host target gene. LOC146880 BINDING SITE is HOST TARGET binding site found in the 3' untranslated region of mRNA encoded by LOC146880, corresponding to a HOST TARGET binding site such as BINDING SITE I, BINDING SITE II or BINDING SITE III. Table 2 illustrates the complementarity of the nucleotide sequences of LOC146880 BINDING SITE, designated SEQ ID:38261, to the nucleotide sequence of VGAM778 RNA, herein designated VGAM RNA, also designated SEQ ID:3489.

Another function of VGAM778 is therefore inhibition of LOC146880 (Accession XM_085627). Accordingly, utilities of VGAM778 include diagnosis, prevention and treatment of diseases and clinical conditions associated with LOC146880. LOC148811 (Accession XM_086326) is another VGAM778 host target gene. LOC148811 BINDING SITE is HOST TARGET binding site found in the 3' untranslated region of mRNA encoded by LOC148811, corresponding to a HOST TARGET binding site such as BINDING SITE I, BINDING SITE II or BINDING SITE III. Table 2 illustrates the complementarity of the nucleotide sequences of LOC148811 BINDING SITE, designated SEQ ID:38600, to the nucleotide sequence of VGAM778 RNA, herein designated VGAM RNA, also designated SEQ ID:3489.

Another function of VGAM778 is therefore inhibition of LOC148811 (Accession XM_086326). Accordingly, utilities of VGAM778 include diagnosis, prevention and treatment of diseases and clinical conditions associated with LOC148811. LOC150605 (Accession XM_097927) is another VGAM778 host target gene. LOC150605 BINDING SITE is HOST TARGET binding site found in the 5' untranslated region of mRNA encoded by LOC150605, corresponding to a HOST TARGET binding site such as BINDING SITE I, BINDING SITE II or BINDING SITE III. Table 2 illustrates the complementarity of the nucleotide sequences of LOC150605 BINDING SITE, designated SEQ ID:41229, to the nucleotide sequence of VGAM778 RNA, herein designated VGAM RNA, also designated SEQ ID:3489.

Another function of VGAM778 is therefore inhibition of LOC150605 (Accession XM_097927). Accordingly, utilities of VGAM778 include diagnosis, prevention and treatment of diseases and clinical conditions associated with LOC150605. LOC152065 (Accession XM_098159) is another VGAM778 host target gene. LOC152065 BINDING SITE is HOST TARGET binding site found in the 5' untranslated region of mRNA encoded by LOC152065, corresponding to a HOST TARGET binding site such as BINDING SITE I, BINDING SITE II or BINDING SITE III. Table 2 illustrates the complementarity of the nucleotide sequences of LOC152065 BINDING SITE, designated SEQ ID:41429, to the nucleotide sequence of VGAM778 RNA, herein designated VGAM RNA, also designated SEQ ID:3489.

Another function of VGAM778 is therefore inhibition of LOC152065 (Accession XM_098159). Accordingly, utilities of VGAM778 include diagnosis, prevention and treatment of diseases and clinical conditions associated with LOC152065. LOC221300 (Accession XM_166322) is another VGAM778 host target gene. LOC221300 BINDING SITE is HOST TARGET binding site found in the 3' untranslated region of mRNA encoded by LOC221300, corresponding to a HOST TARGET binding site such as BINDING SITE I, BINDING SITE II or BINDING SITE III. Table 2 illustrates the complementarity of the nucleotide sequences of LOC221300 BINDING SITE, designated SEQ ID:44147, to the nucleotide sequence of VGAM778 RNA, herein designated VGAM RNA, also designated SEQ ID:3489.

Another function of VGAM778 is therefore inhibition of LOC221300 (Accession XM_166322). Accordingly, utilities of VGAM778 include diagnosis, prevention and treatment of diseases and clinical conditions associated with LOC221300. LOC221895 (Accession XM_166511) is another VGAM778 host target gene. LOC221895 BINDING SITE is HOST TARGET binding site found in the 3' untranslated region of mRNA encoded by LOC221895, corresponding to a HOST TARGET binding site such as BINDING SITE I, BINDING SITE II or BINDING SITE III. Table 2 illustrates the complementarity of the nucleotide sequences of LOC221895 BINDING SITE, designated SEQ ID:44445, to the nucleotide sequence of VGAM778 RNA, herein designated VGAM RNA, also designated SEQ ID:3489.

Another function of VGAM778 is therefore inhibition of LOC221895 (Accession XM_166511). Accordingly, utilities of VGAM778 include diagnosis, prevention and treatment of diseases and clinical conditions associated with LOC221895. LOC90170 (Accession XM_029589) is another VGAM778 host target gene. LOC90170 BINDING SITE is HOST TARGET binding site found in the 5' untranslated region of mRNA encoded by LOC90170, corresponding to a HOST TARGET binding site such as BINDING SITE I, BINDING SITE II or BINDING SITE III. Table 2 illustrates the complementarity of the nucleotide sequences of LOC90170 BINDING SITE, designated SEQ ID:30906, to the nucleotide sequence of VGAM778 RNA, herein designated VGAM RNA, also designated SEQ ID:3489.

Another function of VGAM778 is therefore inhibition of LOC90170 (Accession XM_029589). Accordingly, utilities of VGAM778 include diagnosis, prevention and treatment of diseases and clinical conditions associated with LOC90170. FIG. 1 further provides a conceptual description of a novel bioinformatically detected viral gene of the present invention, referred to here as Viral Genomic Address Messenger 779 (VGAM779) viral gene, which modulates expression of respective host target genes thereof, the function and utility of which host target genes is known in the art.

VGAM779 is a novel bioinformatically detected regulatory, non protein coding, viral micro RNA (miRNA) gene. The method by which VGAM779 was detected is described hereinabove with reference to FIGS. 1-8.

VGAM779 gene, herein designated VGAM GENE, is a viral gene contained in the genome of Spodoptera Litura Nucleopolyhedrovirus. VGAM779 host target gene, herein designated VGAM HOST TARGET GENE, is a human gene contained in the human genome.

VGAM779 gene encodes a VGAM779 precursor RNA, herein designated VGAM PRECURSOR RNA. Similar to other miRNA genes, and unlike most ordinary genes, VGAM779 precursor RNA does not encode a protein. A nucleotide sequence identical or highly similar to the nucleotide sequence of VGAM779 precursor RNA is designated SEQ ID:765, and is provided hereinbelow with reference to the sequence listing part. Nucleotide sequence SEQ ID:765 is located at position 23915 relative to the genome of Spodoptera Litura Nucleopolyhedrovirus.

VGAM779 precursor RNA folds onto itself, forming VGAM779 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM779 folded precursor RNA into VGAM779 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM779 RNA is designated SEQ ID:3490, and is provided hereinbelow with reference to the sequence listing part.

VGAM779 host target gene, herein designated VGAM HOST TARGET GENE, encodes a corresponding messenger RNA, VGAM779 host target RNA, herein designated VGAM HOST TARGET RNA. VGAM779 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM779 RNA, herein designated VGAM RNA, binds complementarily to one or more host target binding sites located in untranslated regions of VGAM779 host target RNA, herein designated VGAM HOST TARGET RNA. This complementary binding is due to the fact that the nucleotide sequence of VGAM779 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM779 RNA, herein designated VGAM RNA, may have a different number of host target binding sites in untranslated regions of a VGAM779 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM779 RNA, herein designated VGAM RNA, to host target binding sites on VGAM779 host target RNA, herein designated VGAM HOST TARGET RNA, such as BINDING SITE I, BINDING SITE II and BINDING SITE III, inhibits translation of VGAM779 host target RNA into VGAM779 host target protein, herein designated VGAM HOST TARGET PROTEIN. VGAM host target protein is therefore outlined by a broken line.

It is appreciated that VGAM779 host target gene, herein designated VGAM HOST TARGET GENE, in fact represents a plurality of VGAM779 host target genes. The mRNA of each one of this plurality of VGAM779 host target genes comprises one or more host target binding sites, each having a nucleotide sequence which is at least partly complementary to VGAM779 RNA, herein designated VGAM RNA, and which when bound by VGAM779 RNA causes inhibition of translation of respective one or more VGAM779 host target proteins.

It is further appreciated by one skilled in the art that the mode of translational inhibition illustrated by FIG. 1 with specific reference to translational inhibition exerted by VGAM779 gene, herein designated VGAM GENE, on one or more VGAM779 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM779 is inhibition of expression of host target genes, as part of a novel viral mechanism of attacking a host. Accordingly, utilities of VGAM779 include diagnosis, prevention and treatment of viral infection by Spodoptera Litura Nucleopolyhedrovirus. Specific functions, and accordingly utilities, of VGAM779 correlate with, and may be deduced from, the identity of the host target genes which VGAM779 binds and inhibits, and the function of these host target genes, as elaborated hereinbelow.

Nucleotide sequences of the VGAM779 precursor RNA, herein designated VGAM PRECURSOR RNA, and of the 'diced' VGAM779 RNA, herein designated VGAM RNA, and a schematic representation of the secondary folding of VGAM779 folded precursor RNA, herein designated VGAM FOLDED PRECURSOR RNA, of VGAM779 are further described hereinbelow with reference to Table 1.

Nucleotide sequences of host target binding sites, such as BINDING SITE-I, BINDING SITE-II and BINDING SITE-III of FIG. 1, found on VGAM779 host target RNA, and schematic representation of the complementarity of each of these host target binding sites to VGAM779 RNA, herein designated VGAM RNA, are described hereinbelow with reference to Table 2.

As mentioned hereinabove with reference to FIG. 1, a function of VGAM779 gene, herein designated VGAM is inhibition of expression of VGAM779 target genes. It is appreciated that specific functions, and accordingly utilities, of VGAM779 correlate with, and may be deduced from, the identity of the target genes which VGAM779 binds and inhibits, and the function of these target genes, as elaborated hereinbelow.

Pentaxin-related Gene, Rapidly Induced By IL-1 Beta (PTX3, Accession NM_002852) is a VGAM779 host target gene. PTX3 BINDING SITE is HOST TARGET binding site found in the 3' untranslated region of mRNA encoded by PTX3, corresponding to a HOST TARGET binding site such as BINDING SITE I, BINDING SITE II or BINDING SITE III. Table 2 illustrates the complementarity of the nucleotide sequences of PTX3 BINDING SITE, designated SEQ ID:8746, to the nucleotide sequence of VGAM779 RNA, herein designated VGAM RNA, also designated SEQ ID:3490.

A function of VGAM779 is therefore inhibition of Pentaxin-related Gene, Rapidly Induced By IL-1 Beta (PTX3, Accession NM_002852), a gene which is similar to the pentaxin subclass of inflammatory acute-phase proteins. Accordingly, utilities of VGAM779 include diagnosis, prevention and treatment of diseases and clinical conditions associated with PTX3. The function of PTX3 has been established by previous studies. In a search for genes that can serve as markers of inflammatory reactions involving the vessel wall, Breviario et al. (1992) used differential hybridization to identify several cDNAs that are induced in human umbilical vein endothelial cells by interleukin-1-beta (IL1B; 147720). The only novel gene among these cDNAs, named PTX3, encoded a predicted 381-amino acid protein with homology to the pentraxin protein family (see OMIM Ref. No. 600750). Based on the Greek derivation, Breviario et al. (1992) suggested that this family be named pentaxin. The PTX3 gene contains 3 exons and is transcribed as a 1,861-nucleotide mRNA. Breviario et al. (1992) mapped PTX3 to 3q25 using somatic cell hybrid analysis and fluorescence in situ hybridization. Basile et al. (1997) suggested that PTX3 belongs to the family of 'long pentraxins', which have C-terminal pentraxin domains and novel amino-terminal domains. They studied the PTX3 promoter and found a 1,317-bp fragment, located 5-prime to the transcriptional start site, that confers TNF- and IL1B-inducible transcriptional activity in transfected fibroblasts. They also identified a functional NF-kappa-B (164011, 164012) site in the promoter.

Full details of the abovementioned studies are described in the following publications, the disclosure of which are hereby incorporated by reference:

Basile, A.; Sica, A.; d'Aniello, E.; Breviario, F.; Garrido, G.; Castellano, M.; Mantovani, A.; Introna, M.: Characterization of the promoter for the human long pentraxin PTX3: role of NF-kappa-B in tumor necrosis factor-alpha and interleukin-1-beta regulation. J. Biol. Chem. 272:8172-8178, 1997; and Breviario, F.; d'Aniello, E. M.; Golay, J.; Peri, G.; Bottazzi, B.; Bairoch, A.; Saccone, S.; Marzella, R.; Predazzi, V.; Rocchi, M.; Della Valle, G.; Dejana, E.; Mantovani, A.; Introna.

Further studies establishing the function and utilities of PTX3 are found in John Hopkins OMIM database record ID 602492, and in sited publications numbered 103 and 8250-8251 listed in the bibliography section hereinbelow, which are also hereby incorporated by reference. Solute Carrier Family 1 (neuronal/epithelial high affinity glutamate transporter, system Xag), Member 1 (SLC1A1, Accession NM_004170) is another VGAM779 host target gene. SLC1A1 BINDING SITE is HOST TARGET binding site found in the 3' untranslated region of mRNA encoded by SLC1A1, corresponding to a HOST TARGET binding site such as BINDING SITE I, BINDING SITE II or BINDING SITE III. Table 2 illustrates the complementarity of the nucleotide sequences of SLC1A1 BINDING SITE, designated SEQ ID:10376, to the nucleotide sequence of VGAM779 RNA, herein designated VGAM RNA, also designated SEQ ID:3490.

Another function of VGAM779 is therefore inhibition of Solute Carrier Family 1 (neuronal/epithelial high affinity glutamate transporter, system Xag), Member 1 (SLC1A1, Accession NM_004170), a gene which is a glutamate transporter, essential for terminating the postsynaptic action of glutamate by rapidly removing it from the synaptic cleft. Accordingly, utilities of VGAM779 include diagnosis, prevention and treatment of diseases and clinical conditions associated with SLC1A1. The function of SLC1A1 and its association with various diseases and clinical conditions, has been established by previous studies, as described hereinabove with reference to VGAM206. Potassium Channel, Subfamily V, Member 1 (KCNV1, Accession NM_014379) is another VGAM779 host target gene. KCNV1 BINDING SITE is HOST TARGET binding site found in the 3' untranslated region of mRNA encoded by KCNV1, corresponding to a HOST TARGET binding site such as BINDING SITE I, BINDING SITE II or BINDING SITE III. Table 2 illustrates the complementarity of the nucleotide sequences of KCNV1 BINDING SITE, designated SEQ ID:15714, to the nucleotide sequence of VGAM779 RNA, herein designated VGAM RNA, also designated SEQ ID:3490.

Another function of VGAM779 is therefore inhibition of Potassium Channel, Subfamily V, Member 1 (KCNV1, Accession NM_014379). Accordingly, utilities of VGAM779 include diagnosis, prevention and treatment of diseases and clinical conditions associated with KCNV1. KIAA1028 (Accession XM_166324) is another VGAM779 host target gene. KIAA1028 BINDING SITE is HOST TARGET binding site found in the 3' untranslated region of mRNA encoded by KIAA1028, corresponding to a HOST TARGET binding site such as BINDING SITE I, BINDING SITE II or BINDING SITE III. Table 2 illustrates the complementarity of the nucleotide sequences of KIAA1028 BINDING SITE, designated SEQ ID:44153, to the nucleotide sequence of VGAM779 RNA, herein designated VGAM RNA, also designated SEQ ID:3490.

Another function of VGAM779 is therefore inhibition of KIAA1028 (Accession XM_166324). Accordingly, utilities of VGAM779 include diagnosis, prevention and treatment of diseases and clinical conditions associated with KIAA1028. LOC201203 (Accession XM_113920) is another VGAM779 host target gene. LOC201203 BINDING SITE is HOST TARGET binding site found in the 3' untranslated region of mRNA encoded by LOC201203, corresponding to a HOST TARGET binding site such as BINDING SITE I, BINDING SITE II or BINDING SITE III. Table 2 illustrates the complementarity of the nucleotide sequences of LOC201203 BINDING SITE, designated SEQ ID:42536, to the nucleotide sequence of VGAM779 RNA, herein designated VGAM RNA, also designated SEQ ID:3490.

Another function of VGAM779 is therefore inhibition of LOC201203 (Accession XM_113920). Accordingly, utilities of VGAM779 include diagnosis, prevention and treatment of diseases and clinical conditions associated with LOC201203. LOC221895 (Accession XM_166511) is another VGAM779 host target gene. LOC221895 BINDING SITE is HOST TARGET binding site found in the 3' untranslated region of mRNA encoded by LOC221895, corresponding to a HOST TARGET binding site such as BINDING SITE I, BINDING SITE II or BINDING SITE III. Table 2 illustrates the complementarity of the nucleotide sequences of LOC221895 BINDING SITE, designated SEQ ID:44446, to the nucleotide sequence of VGAM779 RNA, herein designated VGAM RNA, also designated SEQ ID:3490.

Another function of VGAM779 is therefore inhibition of LOC221895 (Accession XM_166511). Accordingly, utilities of VGAM779 include diagnosis, prevention and treatment of diseases and clinical conditions associated with LOC221895. FIG. 1 further provides a conceptual description of a novel bioinformatically detected viral gene of the present invention, referred to here as Viral Genomic Address Messenger 780 (VGAM780) viral gene, which modulates expression of respective host target genes thereof, the function and utility of which host target genes is known in the art.

VGAM780 is a novel bioinformatically detected regulatory, non protein coding, viral micro RNA (miRNA) gene. The method by which VGAM780 was detected is described hereinabove with reference to FIGS. 1-8.

VGAM780 gene, herein designated VGAM GENE, is a viral gene contained in the genome of Spodoptera Litura Nucleopolyhedrovirus. VGAM780 host target gene, herein designated VGAM HOST TARGET GENE, is a human gene contained in the human genome.

VGAM780 gene encodes a VGAM780 precursor RNA, herein designated VGAM PRECURSOR RNA. Similar to other miRNA genes, and unlike most ordinary genes, VGAM780 precursor RNA does not encode a protein. A nucleotide sequence identical or highly similar to the nucleotide sequence of VGAM780 precursor RNA is designated SEQ ID:766, and is provided hereinbelow with reference to the sequence listing part. Nucleotide sequence SEQ ID:766 is located at position 95927 relative to the genome of Spodoptera Litura Nucleopolyhedrovirus.

VGAM780 precursor RNA folds onto itself, forming VGAM780 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM780 folded precursor RNA into VGAM780 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM780 RNA is designated SEQ ID:3491, and is provided hereinbelow with reference to the sequence listing part.

VGAM780 host target gene, herein designated VGAM HOST TARGET GENE, encodes a corresponding messenger RNA, VGAM780 host target RNA, herein designated VGAM HOST TARGET RNA. VGAM780 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM780 RNA, herein designated VGAM RNA, binds complementarily to one or more host target binding sites located in untranslated regions of VGAM780 host target RNA, herein designated VGAM HOST TARGET RNA. This complementary binding is due to the fact that the nucleotide sequence of VGAM780 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM780 RNA, herein designated VGAM RNA, may have a different number of host target binding sites in untranslated regions of a VGAM780 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM780 RNA, herein designated VGAM RNA, to host target binding sites on VGAM780 host target RNA, herein designated VGAM HOST TARGET RNA, such as BINDING SITE I, BINDING SITE II and BINDING SITE III, inhibits translation of VGAM780 host target RNA into VGAM780 host target protein, herein designated VGAM HOST TARGET PROTEIN. VGAM host target protein is therefore outlined by a broken line.

It is appreciated that VGAM780 host target gene, herein designated VGAM HOST TARGET GENE, in fact represents a plurality of VGAM780 host target genes. The mRNA of each one of this plurality of VGAM780 host target genes comprises one or more host target binding sites, each having a nucleotide sequence which is at least partly complementary to VGAM780 RNA, herein designated VGAM RNA, and which when bound by VGAM780 RNA causes inhibition of translation of respective one or more VGAM780 host target proteins.

It is further appreciated by one skilled in the art that the mode of translational inhibition illustrated by FIG. 1 with specific reference to translational inhibition exerted by VGAM780 gene, herein designated VGAM GENE, on one or more VGAM780 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM780 is inhibition of expression of host target genes, as part of a novel viral mechanism of attacking a host. Accordingly, utilities of VGAM780 include diagnosis, prevention and treatment of viral infection by Spodoptera Litura Nucleopolyhedrovirus. Specific functions, and accordingly utilities, of VGAM780 correlate with, and may be deduced from, the identity of the host target genes which VGAM780 binds and inhibits, and the function of these host target genes, as elaborated hereinbelow.

Nucleotide sequences of the VGAM780 precursor RNA, herein designated VGAM PRECURSOR RNA, and of the 'diced' VGAM780 RNA, herein designated VGAM RNA, and a schematic representation of the secondary folding of VGAM780 folded precursor RNA, herein designated VGAM FOLDED PRECURSOR RNA, of VGAM780 are further described hereinbelow with reference to Table 1.

Nucleotide sequences of host target binding sites, such as BINDING SITE-I, BINDING SITE-II and BINDING SITE-III of FIG. 1, found on VGAM780 host target RNA, and schematic representation of the complementarity of each of these host target binding sites to VGAM780 RNA, herein designated VGAM RNA, are described hereinbelow with reference to Table 2.

As mentioned hereinabove with reference to FIG. 1, a function of VGAM780 gene, herein designated VGAM is inhibition of expression of VGAM780 target genes. It is appreciated that specific functions, and accordingly utilities, of VGAM780 correlate with, and may be deduced from, the identity of the target genes which VGAM780 binds and inhibits, and the function of these target genes, as elaborated hereinbelow.

KIAA0471 (Accession NM_014857) is a VGAM780 host target gene. KIAA0471 BINDING SITE is HOST TARGET binding site found in the 3' untranslated region of mRNA encoded by KIAA0471, corresponding to a HOST TARGET binding site such as BINDING SITE I, BINDING SITE II or BINDING SITE III. Table 2 illustrates the complementarity of the nucleotide sequences of KIAA0471 BINDING SITE, designated SEQ ID:16915, to the nucleotide sequence of VGAM780 RNA, herein designated VGAM RNA, also designated SEQ ID:3491.

A function of VGAM780 is therefore inhibition of KIAA0471 (Accession NM_014857). Accordingly, utilities of VGAM780 include diagnosis, prevention and treatment of diseases and clinical conditions associated with KIAA0471. FIG. 1 further provides a conceptual description of a novel bioinformatically detected viral gene of the present invention, referred to here as Viral Genomic Address Messenger 781 (VGAM781) viral gene, which modulates expression of respective host target genes thereof, the function and utility of which host target genes is known in the art.

VGAM781 is a novel bioinformatically detected regulatory, non protein coding, viral micro RNA (miRNA) gene. The method by which VGAM781 was detected is described hereinabove with reference to FIGS. 1-8.

VGAM781 gene, herein designated VGAM GENE, is a viral gene contained in the genome of Deer Tick Virus. VGAM781 host target gene, herein designated VGAM HOST TARGET GENE, is a human gene contained in the human genome.

VGAM781 gene encodes a VGAM781 precursor RNA, herein designated VGAM PRECURSOR RNA. Similar to other miRNA genes, and unlike most ordinary genes, VGAM781 precursor RNA does not encode a protein. A nucleotide sequence identical or highly similar to the nucleotide sequence of VGAM781 precursor RNA is designated SEQ ID:767, and is provided hereinbelow with reference to the sequence listing part. Nucleotide sequence SEQ ID:767 is located at position 6107 relative to the genome of Deer Tick Virus.

VGAM781 precursor RNA folds onto itself, forming VGAM781 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM781 folded precursor RNA into VGAM781 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM781 RNA is designated SEQ ID:3492, and is provided hereinbelow with reference to the sequence listing part.

VGAM781 host target gene, herein designated VGAM HOST TARGET GENE, encodes a corresponding messenger RNA, VGAM781 host target RNA, herein designated VGAM HOST TARGET RNA. VGAM781 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM781 RNA, herein designated VGAM RNA, binds complementarily to one or more host target binding sites located in untranslated regions of VGAM781 host target RNA, herein designated VGAM HOST TARGET RNA. This complementary binding is due to the fact that the nucleotide sequence of VGAM781 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM781 RNA, herein designated VGAM RNA, may have a different number of host target binding sites in untranslated regions of a VGAM781 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM781 RNA, herein designated VGAM RNA, to host target binding sites on VGAM781 host target RNA, herein designated VGAM HOST TARGET RNA, such as BINDING SITE I, BINDING SITE II and BINDING SITE III, inhibits translation of VGAM781 host target RNA into VGAM781 host target protein, herein designated VGAM HOST TARGET PROTEIN. VGAM host target protein is therefore outlined by a broken line.

It is appreciated that VGAM781 host target gene, herein designated VGAM HOST TARGET GENE, in fact represents a plurality of VGAM781 host target genes. The mRNA of each one of this plurality of VGAM781 host target genes comprises one or more host target binding sites, each having a nucleotide sequence which is at least partly complementary to VGAM781 RNA, herein designated VGAM RNA, and which when bound by VGAM781 RNA causes inhibition of translation of respective one or more VGAM781 host target proteins.

It is further appreciated by one skilled in the art that the mode of translational inhibition illustrated by FIG. 1 with specific reference to translational inhibition exerted by VGAM781 gene, herein designated VGAM GENE, on one or more VGAM781 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM781 is inhibition of expression of host target genes, as part of a novel viral mechanism of attacking a host. Accordingly, utilities of VGAM781 include diagnosis, prevention and treatment of viral infection by Deer Tick Virus. Specific functions, and accordingly utilities, of VGAM781 correlate with, and may be deduced from, the identity of the host target genes which VGAM781 binds and inhibits, and the function of these host target genes, as elaborated hereinbelow.

Nucleotide sequences of the VGAM781 precursor RNA, herein designated VGAM PRECURSOR RNA, and of the 'diced' VGAM781 RNA, herein designated VGAM RNA, and a schematic representation of the secondary folding of VGAM781 folded precursor RNA, herein designated VGAM FOLDED PRECURSOR RNA, of VGAM781 are further described hereinbelow with reference to Table 1.

Nucleotide sequences of host target binding sites, such as BINDING SITE-I, BINDING SITE-II and BINDING SITE-III of FIG. 1, found on VGAM781 host target RNA, and schematic representation of the complementarity of each of these host target binding sites to VGAM781 RNA, herein designated VGAM RNA, are described hereinbelow with reference to Table 2.

As mentioned hereinabove with reference to FIG. 1, a function of VGAM781 gene, herein designated VGAM is inhibition of expression of VGAM781 target genes. It is appreciated that specific functions, and accordingly utilities, of VGAM781 correlate with, and may be deduced from, the identity of the target genes which VGAM781 binds and inhibits, and the function of these target genes, as elaborated hereinbelow.

DKFZp762L0311 (Accession NM_018719) is a VGAM781 host target gene. DKFZp762L0311 BINDING SITE is HOST TARGET binding site found in the 3' untranslated region of mRNA encoded by DKFZp762L0311, corresponding to a HOST TARGET binding site such as BINDING SITE I, BINDING SITE II or BINDING SITE III. Table 2 illustrates the complementarity of the nucleotide sequences of DKFZp762L0311 BINDING SITE, designated SEQ ID:20798, to the nucleotide sequence of VGAM781 RNA, herein designated VGAM RNA, also designated SEQ ID:3492.

A function of VGAM781 is therefore inhibition of DKFZp762L0311 (Accession NM_018719). Accordingly, utilities of VGAM781 include diagnosis, prevention and treatment of diseases and clinical conditions associated with DKFZp762L0311. KIAA0182 (Accession XM_050495) is another VGAM781 host target gene. KIAA0182 BINDING SITE is HOST TARGET binding site found in the 3' untranslated region of mRNA encoded by KIAA0182, corresponding to a HOST TARGET binding site such as BINDING SITE I, BINDING SITE II or BINDING SITE III. Table 2 illustrates the complementarity of the nucleotide sequences of KIAA0182 BINDING SITE, designated SEQ ID:35641, to the nucleotide sequence of VGAM781 RNA, herein designated VGAM RNA, also designated SEQ ID:3492.

Another function of VGAM781 is therefore inhibition of KIAA0182 (Accession XM_050495). Accordingly, utilities of VGAM781 include diagnosis, prevention and treatment of diseases and clinical conditions associated with KIAA0182. KIAA1671 (Accession XM_037809) is another VGAM781 host target gene. KIAA1671 BINDING SITE is HOST TARGET binding site found in the 3' untranslated region of mRNA encoded by KIAA1671, corresponding to a HOST TARGET binding site such as BINDING SITE I, BINDING SITE II or BINDING SITE III. Table 2 illustrates the complementarity of the nucleotide sequences of KIAA1671 BINDING SITE, designated SEQ ID:32690, to the nucleotide sequence of VGAM781 RNA, herein designated VGAM RNA, also designated SEQ ID:3492.

Another function of VGAM781 is therefore inhibition of KIAA1671 (Accession XM_037809). Accordingly, utilities of VGAM781 include diagnosis, prevention and treatment of diseases and clinical conditions associated with KIAA1671. LOC148823 (Accession NM_145278) is another VGAM781 host target gene. LOC148823 BINDING SITE is HOST TARGET binding site found in the 3' untranslated region of mRNA encoded by LOC148823, corresponding to a HOST TARGET binding site such as BINDING SITE I, BINDING SITE II or BINDING SITE III. Table 2 illustrates the complementarity of the nucleotide sequences of LOC148823 BINDING SITE, designated SEQ ID:29790, to the nucleotide sequence of VGAM781 RNA, herein designated VGAM RNA, also designated SEQ ID:3492.

Another function of VGAM781 is therefore inhibition of LOC148823 (Accession NM_145278). Accordingly, utilities of VGAM781 include diagnosis, prevention and treatment of diseases and clinical conditions associated with LOC148823. FIG. 1 further provides a conceptual description of a novel bioinformatically detected viral gene of the present invention, referred to here as Viral Genomic Address Messenger 782 (VGAM782) viral gene, which modulates expression of respective host target genes thereof, the function and utility of which host target genes is known in the art.

VGAM782 is a novel bioinformatically detected regulatory, non protein coding, viral micro RNA (miRNA) gene. The method by which VGAM782 was detected is described hereinabove with reference to FIGS. 1-8.

VGAM782 gene, herein designated VGAM GENE, is a viral gene contained in the genome of Deer Tick Virus. VGAM782 host target gene, herein designated VGAM HOST TARGET GENE, is a human gene contained in the human genome.

VGAM782 gene encodes a VGAM782 precursor RNA, herein designated VGAM PRECURSOR RNA. Similar to other miRNA genes, and unlike most ordinary genes, VGAM782 precursor RNA does not encode a protein. A nucleotide sequence identical or highly similar to the nucleotide sequence of VGAM782 precursor RNA is designated SEQ ID:768, and is provided hereinbelow with reference to the sequence listing part. Nucleotide sequence SEQ ID:768 is located at position 4906 relative to the genome of Deer Tick Virus.

VGAM782 precursor RNA folds onto itself, forming VGAM782 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM782 folded precursor RNA into VGAM782 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM782 RNA is designated SEQ ID:3493, and is provided hereinbelow with reference to the sequence listing part.

VGAM782 host target gene, herein designated VGAM HOST TARGET GENE, encodes a corresponding messenger RNA, VGAM782 host target RNA, herein designated VGAM HOST TARGET RNA. VGAM782 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM782 RNA, herein designated VGAM RNA, binds complementarily to one or more host target binding sites located in untranslated regions of VGAM782 host target RNA, herein designated VGAM HOST TARGET RNA. This complementary binding is due to the fact that the nucleotide sequence of VGAM782 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM782 RNA, herein designated VGAM RNA, may have a different number of host target binding sites in untranslated regions of a VGAM782 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM782 RNA, herein designated VGAM RNA, to host target binding sites on VGAM782 host target RNA, herein designated VGAM HOST TARGET RNA, such as BINDING SITE I, BINDING SITE II and BINDING SITE III, inhibits translation of VGAM782 host target RNA into VGAM782 host target protein, herein designated VGAM HOST TARGET PROTEIN. VGAM host target protein is therefore outlined by a broken line.

It is appreciated that VGAM782 host target gene, herein designated VGAM HOST TARGET GENE, in fact represents a plurality of VGAM782 host target genes. The mRNA of each one of this plurality of VGAM782 host target genes comprises one or more host target binding sites, each having a nucleotide sequence which is at least partly complementary to VGAM782 RNA, herein designated VGAM RNA, and which when bound by VGAM782 RNA causes inhibition of translation of respective one or more VGAM782 host target proteins.

It is further appreciated by one skilled in the art that the mode of translational inhibition illustrated by FIG. 1 with specific reference to translational inhibition exerted by VGAM782 gene, herein designated VGAM GENE, on one or more VGAM782 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM782 is inhibition of expression of host target genes, as part of a novel viral mechanism of attacking a host. Accordingly, utilities of VGAM782 include diagnosis, prevention and treatment of viral infection by Deer Tick Virus. Specific functions, and accordingly utilities, of VGAM782 correlate with, and may be deduced from, the identity of the host target genes which VGAM782 binds and inhibits, and the function of these host target genes, as elaborated hereinbelow.

Nucleotide sequences of the VGAM782 precursor RNA, herein designated VGAM PRECURSOR RNA, and of the ‘diced’ VGAM782 RNA, herein designated VGAM RNA, and a schematic representation of the secondary folding of VGAM782 folded precursor RNA, herein designated VGAM FOLDED PRECURSOR RNA, of VGAM782 are further described hereinbelow with reference to Table 1.

Nucleotide sequences of host target binding sites, such as BINDING SITE-I, BINDING SITE-II and BINDING SITE-III of FIG. 1, found on VGAM782 host target RNA, and schematic representation of the complementarity of each of these host target binding sites to VGAM782 RNA, herein designated VGAM RNA, are described hereinbelow with reference to Table 2.

As mentioned hereinabove with reference to FIG. 1, a function of VGAM782 gene, herein designated VGAM is inhibition of expression of VGAM782 target genes. It is appreciated that specific functions, and accordingly utilities, of VGAM782 correlate with, and may be deduced from, the identity of the target genes which VGAM782 binds and inhibits, and the function of these target genes, as elaborated hereinbelow.

Rho GDP Dissociation Inhibitor (GDI) Alpha (ARHGDIA, Accession NM_004309) is a VGAM782 host target gene. ARHGDIA BINDING SITE is HOST TARGET binding site found in the 3' untranslated region of mRNA encoded by ARHGDIA, corresponding to a HOST TARGET binding site such as BINDING SITE I, BINDING SITE II or BINDING SITE III. Table 2 illustrates the complementarity of the nucleotide sequences of ARHGDIA BINDING SITE, designated SEQ ID:10515, to the nucleotide sequence of VGAM782 RNA, herein designated VGAM RNA, also designated SEQ ID:3493.

A function of VGAM782 is therefore inhibition of Rho GDP Dissociation Inhibitor (GDI) Alpha (ARHGDIA, Accession NM_004309), a gene which is a small guanine nucleotide exchange (GTP/GDP) factor. Accordingly, utilities of VGAM782 include diagnosis, prevention and treatment of diseases and clinical conditions associated with ARHGDIA. The function of ARHGDIA and its association with various diseases and clinical conditions, has been established by previous studies, as described hereinabove with reference to VGAM435. Attractin (ATRN, Accession NM_139321) is another VGAM782 host target gene. ATRN BINDING SITE is HOST TARGET binding site found in the 3' untranslated region of mRNA encoded by ATRN, corresponding to a HOST TARGET binding site such as BINDING SITE I, BINDING SITE II or BINDING SITE III. Table 2 illustrates the complementarity of the nucleotide sequences of ATRN BINDING SITE, designated SEQ ID:29298, to the nucleotide sequence of VGAM782 RNA, herein designated VGAM RNA, also designated SEQ ID:3493.

Another function of VGAM782 is therefore inhibition of Attractin (ATRN, Accession NM_139321), a gene which is involved in the initial immune cell clustering during inflammatory response. Accordingly, utilities of VGAM782 include diagnosis, prevention and treatment of diseases and clinical conditions associated with ATRN. The function of ATRN and its association with various diseases and clinical conditions, has been established by previous studies, as described hereinabove with reference to VGAM53. Core-binding Factor, Runt Domain, Alpha Subunit 2; Translocated To, 3 (CBFA2T3, Accession NM_005187) is another VGAM782 host target gene. CBFA2T3 BINDING SITE is HOST TARGET binding site found in the 3' untranslated region of mRNA encoded by CBFA2T3, corresponding to a HOST TARGET binding site such as BINDING SITE I, BINDING SITE II or BINDING SITE III. Table 2 illustrates the complementarity of the nucleotide sequences of CBFA2T3 BINDING SITE, designated SEQ ID:11688, to the nucleotide sequence of VGAM782 RNA, herein designated VGAM RNA, also designated SEQ ID:3493.

Another function of VGAM782 is therefore inhibition of Core-binding Factor, Runt Domain, Alpha Subunit 2; Translocated To, 3 (CBFA2T3, Accession NM_005187). Accordingly, utilities of VGAM782 include diagnosis, prevention and treatment of diseases and clinical conditions associated with CBFA2T3. Centaurin, Delta 2 (CENTD2, Accession NM_139181) is another VGAM782 host target gene. CENTD2 BINDING SITE is HOST TARGET binding site found in the 5' untranslated region of mRNA encoded by CENTD2, corresponding to a HOST TARGET binding site such as BINDING SITE I, BINDING SITE II or BINDING SITE III. Table 2 illustrates the complementarity of the nucleotide sequences of CENTD2 BINDING SITE, designated SEQ ID:29196, to the nucleotide sequence of VGAM782 RNA, herein designated VGAM RNA, also designated SEQ ID:3493.

Another function of VGAM782 is therefore inhibition of Centaurin, Delta 2 (CENTD2, Accession NM_139181), a gene which involved in cell signaling/communication. Accordingly, utilities of VGAM782 include diagnosis, prevention and treatment of diseases and clinical conditions associated with CENTD2. The function of CENTD2 has been established by previous studies. Miura et al. (2002) examined ARAP1 as a possible link between phosphoinositide-, ARF-, and RHO-mediated cell signaling. In vitro, ARAP1 had RHO-GAP and phosphatidylinositol (3,4,5) trisphosphate (PIP3; OMIM Ref. No. 171834)-dependent ARF-GAP activity. ARAP1 associated with the Golgi. The RHO-GAP activity mediated cell rounding and loss of stress fibers when ARAP1 was overexpressed. The ARF-GAP activity mediated changes in the Golgi apparatus and the formation of filopodia, the latter a consequence of increased cellular activity of CDC42 (OMIM Ref. No. 116952). The ARF-GAP and RHO-GAP activities both contributed to inhibiting cell spreading. Thus, ARAP1 is a PIP3-dependent ARF-GAP that regulates ARF-, RHO-, and CDC42-dependent cell activities.

Full details of the abovementioned studies are described in the following publications, the disclosure of which are hereby incorporated by reference:

Miura, K.; Jacques, K. M.; Stauffer, S.; Kubosaki, A.; Zhu, K.; Hirsch, D. S.; Resau, J.; Zheng, Y.; Randazzo, P. A.: ARAP1: a point of convergence for Arf and Rho signaling. Molec. Cell 9:109-119, 2002; and Nagase, T.; Ishikawa, K.; Suyama, M.; Kikuno, R.; Miyajima, N.; Tanaka, A.; Kotani, H.; Nomura, N.; Ohara, O.: Prediction of the coding sequences of unidentified human genes. XI. The.

Further studies establishing the function and utilities of CENTD2 are found in John Hopkins OMIM database record ID 606646, and in sited publications numbered 612 and 7048 listed in the bibliography section hereinbelow, which are also hereby incorporated by reference. Discs, Large (Drosophila) Homolog 3 (neuroendocrine-dlg) (DLG3, Accession NM_021120) is another VGAM782 host target gene. DLG3 BINDING SITE is HOST TARGET binding site found in the 5' untranslated region of mRNA encoded by DLG3, corresponding to a HOST TARGET binding site such as BINDING SITE I, BINDING SITE II or BINDING SITE III. Table 2 illustrates the complementarity of the nucleotide sequences of DLG3 BINDING SITE, designated SEQ ID:22094, to the nucleotide sequence of VGAM782 RNA, herein designated VGAM RNA, also designated SEQ ID:3493.

Another function of VGAM782 is therefore inhibition of Discs, Large (Drosophila) Homolog 3 (neuroendocrine-dlg) (DLG3, Accession NM_021120), a gene which may interact with the cytoplasmic tail of the nmda receptor subunit nr2b . Accordingly, utilities of VGAM782 include diagnosis, prevention and treatment of diseases and clinical conditions associated with DLG3. The function of DLG3 has been established by previous studies. Mutations of the 'discs large' (dlg) tumor suppressor locus in Drosophila lead to imaginal disc neoplasia and a prolonged larval period followed by death. Drosophila dlg and related proteins form a subfamily of the membrane-associated guanylate kinase (MAGUK) protein family and are important components of specialized cell junctions. See DLG1 (OMIM Ref. No. 601014). By searching an EST database for sequences related to dlg and DLG1, Makino et al. (1997) isolated a partial cDNA encoding NEDLG (neuroendocrine DLG). Using PCR, they cloned a cDNA corresponding to the entire NEDLG coding region. The predicted 817-amino acid protein contains the 3 DHR (discs large homologous region) segments, central SH3 motif, and C-terminal guanylate kinase domain characteristic of MAGUK proteins. NEDLG shares 75% and 60% protein sequence identity with DLG1 and Drosophila dlg, respectively. Northern blot analysis revealed that NEDLG is highly expressed in neuronal and endocrine tissues. Immunolocalization studies indicated that the protein was expressed mainly in nonproliferating cells, such as neurons, cells in Langerhans islets of the pancreas, myocytes of heart muscles, and the prickle and functional layer cells of the esophageal epithelium. In a yeast 2-hybrid assay, NEDLG interacted with the C-terminal region of the APC (OMIM Ref. No. 175100) tumor suppressor protein. The authors suggested that NEDLG may negatively regulate cell proliferation through its interaction with the APC protein.

Full details of the abovementioned studies are described in the following publications, the disclosure of which are hereby incorporated by reference:

Makino, K.; Kuwahara, H.; Masuko, N.; Nishiyama, Y.; Morisaki, T.; Sasaki, J.; Nakao, M.; Kuwano, A.; Nakata, M.; Ushio, Y.; Saya, H.: Cloning and characterization of NE-dlg: a novel human homolog of the Drosophila discs large (dlg) tumor suppressor protein interacts with the APC protein. Oncogene 14:2425-2433, 1997.; and Stathakis, D. G.; Lee, D.; Bryant, P. J.: DLG3, the gene encoding human neuroendocrine Dlg (NE-Dlg), is located within the 1.8-Mb dystonia-parkinsonism region at Xq13.1. Genomics 49:3.

Further studies establishing the function and utilities of DLG3 are found in John Hopkins OMIM database record ID 300189, and in sited publications numbered 11386-11387 listed in the bibliography section hereinbelow, which are also hereby incorporated by reference. Coagulation Factor VII (serum prothrombin conversion accelerator) (F7, Accession NM_019616) is another VGAM782 host target gene. F7 BINDING SITE1 and F7 BINDING SITE2 are HOST TARGET binding sites found in untranslated regions of mRNA encoded by F7, corresponding to HOST TARGET binding sites such as BINDING SITE I, BINDING SITE II or BINDING SITE III. Table 2 illustrates the complementarity of the nucleotide sequences of F7 BINDING SITE1 and F7 BINDING SITE2, designated SEQ ID:21235 and SEQ ID:5606 respectively, to the nucleotide sequence of VGAM782 RNA, herein designated VGAM RNA, also designated SEQ ID:3493.

Another function of VGAM782 is therefore inhibition of Coagulation Factor VII (serum prothrombin conversion accelerator) (F7, Accession NM_019616). Accordingly, utilities of VGAM782 include diagnosis, prevention and treatment of diseases and clinical conditions associated with F7. G Protein-coupled Receptor 56 (GPR56, Accession NM_005682) is another VGAM782 host target gene. GPR56 BINDING SITE is HOST TARGET binding site found in the 3' untranslated region of mRNA encoded by GPR56, corresponding to a HOST TARGET binding site such as BINDING SITE I, BINDING SITE II or BINDING SITE III. Table 2 illustrates the complementarity of the nucleotide sequences of GPR56 BINDING SITE, designated SEQ ID:12238, to the nucleotide sequence of VGAM782 RNA, herein designated VGAM RNA, also designated SEQ ID:3493.

Another function of VGAM782 is therefore inhibition of G Protein-coupled Receptor 56 (GPR56, Accession NM_005682), a gene which transduces extracellular signals through heterotrimeric G proteins. Accordingly, utilities of VGAM782 include diagnosis, prevention and treatment of diseases and clinical conditions associated with GPR56. The function of GPR56 has been established by previous studies. G protein-coupled receptors (GPRs), which are characterized by the presence of 7 transmembrane domains, are divided into several classes based on sequence characteristics. Class B GPRs, or the secretin-like receptors, include the secretin receptor (OMIM Ref. No. 182098) and the calcitonin receptor (OMIM Ref. No. 114131). The orphan receptors HE6 (OMIM Ref. No. 602657), CD97 (OMIM Ref. No. 601211), EMR1 (OMIM Ref. No. 600493), and BAI1 (OMIM Ref. No. 602682) share significant homology with class B GPRs across the 7-transmembrane region, but have a distinct N-terminal region containing a characteristic cysteine box, which precedes the first membrane-spanning domain, and a mucin-like domain. By PCR of human cDNAs with degenerate primers based on conserved regions from secretin-like receptors, Liu et al. (1999) isolated a cDNA encoding a novel receptor, which they designated GPR56. The predicted 693-amino acid GPR56 protein shares 26 to 32% sequence identity with the 4 class B-like orphan receptors. Like these receptors, GPR56 contains 7 transmembrane domains as well as a mucin-like domain and cysteine box in the N-terminal region. Northern blot analysis revealed that the GPR56 gene was expressed as a 3-kb mRNA in a wide range of tissues, with the highest levels in thyroid. Using in situ hybridization, Liu et al. (1999) determined that the GPR56 gene was expressed selectively within the monolayer of cuboidal epithelial cells of the smaller, more actively secreting follicles of human thyroid. The GPR56 gene contains 13 exons and spans approximately 15 kb. Using differential display, Zendman et al. (1999) identified a GPR56 cDNA as a transcript that was differentially expressed in melanoma cell lines with different metastatic potential. They designated the gene TM7XN1 (7-transmembrane protein with no EGF-like N-terminal domains-1) because the protein lacks the EGF-like domains found in the related GPRs CD97 and EMR1. Zendman et al. (1999) reported that the TM7XN1 protein contains 687 amino acids. RT-PCR and Northern blot analyses indicated that TM7XN1 gene expression was inversely correlated with metastatic potential in melanoma cell lines.

Full details of the abovementioned studies are described in the following publications, the disclosure of which are hereby incorporated by reference:

Liu, M.; Parker, R. M. C.; Darby, K.; Eyre, H. J.; Copeland, N. G.; Crawford, J.; Gilbert, D. J.; Sutherland, G. R.; Jenkins, N. A.; Herzog, H.: GPR56, a novel secretin-like human G-protein-coupled receptor gene. Genomics 55:296-305, 1999; and Zendman, A. J. W.; Cornelissen, I. M. H. A.; Weidle, U. H.; Ruiter, D. J.; van Muijen, G. N. P.: TM7XN1, a novel human EGF-TM7-like cDNA, detected with mRNA differential display using.

Further studies establishing the function and utilities of GPR56 are found in John Hopkins OMIM database record ID 604110, and in sited publications numbered 7062-7063 listed in the bibliography section hereinbelow, which are also hereby incorporated by reference. Membrane Protein, Palmitoylated 2 (MAGUK p55 subfamily member 2) (MPP2, Accession XM_008355) is another VGAM782 host target gene. MPP2 BINDING SITE is HOST TARGET binding site found in the 3' untranslated region of mRNA encoded by MPP2, corresponding to a HOST TARGET binding site such as BINDING SITE I, BINDING SITE II or BINDING SITE III. Table 2 illustrates the complementarity of the nucleotide sequences of MPP2 BINDING SITE, designated SEQ ID:30084, to the nucleotide sequence of VGAM782 RNA, herein designated VGAM RNA, also designated SEQ ID:3493.

Another function of VGAM782 is therefore inhibition of Membrane Protein, Palmitoylated 2 (MAGUK p55 subfamily member 2) (MPP2, Accession XM_008355). Accordingly, utilities of VGAM782 include diagnosis, prevention and treatment of diseases and clinical conditions associated with MPP2. Male-specific Lethal 3-like 1 (Drosophila) (MSL3L1, Accession NM_078630) is another VGAM782 host target gene. MSL3L1 BINDING SITE1 and MSL3L1 BINDING SITE2 are HOST TARGET binding sites found in untranslated regions of mRNA encoded by MSL3L1, corresponding to HOST TARGET binding sites such as BINDING SITE I, BINDING SITE II or BINDING SITE III. Table 2 illustrates the complementarity of the nucleotide sequences of MSL3L1 BINDING SITE1 and MSL3L1 BINDING SITE2, designated SEQ ID:27814 and SEQ ID:27815 respectively, to the nucleotide sequence of VGAM782 RNA, herein designated VGAM RNA, also designated SEQ ID:3493.

Another function of VGAM782 is therefore inhibition of Male-specific Lethal 3-like 1 (Drosophila) (MSL3L1, Accession NM_078630). Accordingly, utilities of VGAM782 include diagnosis, prevention and treatment of diseases and clinical conditions associated with MSL3L1. ADAR3 (Accession NM_018702) is another VGAM782 host target gene. ADAR3 BINDING SITE is HOST TARGET binding site found in the 5' untranslated region of mRNA encoded by ADAR3, corresponding to a HOST TARGET binding site such as BINDING SITE I, BINDING SITE II or BINDING SITE III. Table 2 illustrates the complementarity of the nucleotide sequences of ADAR3 BINDING SITE, designated SEQ ID:20786, to the nucleotide sequence of VGAM782 RNA, herein designated VGAM RNA, also designated SEQ ID:3493.

Another function of VGAM782 is therefore inhibition of ADAR3 (Accession NM_018702). Accordingly, utilities of VGAM782 include diagnosis, prevention and treatment of diseases and clinical conditions associated with ADAR3. Chromosome 6 Open Reading Frame 9 (C6orf9, Accession NM_022107) is another VGAM782 host target gene. C6orf9 BINDING SITE is HOST TARGET binding site found in the 3' untranslated region of mRNA encoded by C6orf9, corresponding to a HOST TARGET binding site such as BINDING SITE I, BINDING SITE II or BINDING SITE III. Table 2 illustrates the complementarity of the nucleotide sequences of C6orf9 BINDING SITE, designated SEQ ID:22654, to the nucleotide sequence of VGAM782 RNA, herein designated VGAM RNA, also designated SEQ ID:3493.

Another function of VGAM782 is therefore inhibition of Chromosome 6 Open Reading Frame 9 (C6orf9, Accession NM_022107). Accordingly, utilities of VGAM782 include diagnosis, prevention and treatment of diseases and clinical conditions associated with C6orf9. Cadherin-like 22 (CDH22, Accession NM_021248) is another VGAM782 host target gene. CDH22 BINDING SITE is HOST TARGET binding site found in the 3' untranslated region of mRNA encoded by CDH22, corresponding to a HOST TARGET binding site such as BINDING SITE I, BINDING SITE II or BINDING SITE III. Table 2 illustrates the complementarity of the nucleotide sequences of CDH22 BINDING SITE, designated SEQ ID:22214, to the nucleotide sequence of VGAM782 RNA, herein designated VGAM RNA, also designated SEQ ID:3493.

Another function of VGAM782 is therefore inhibition of Cadherin-like 22 (CDH22, Accession NM_021248). Accordingly, utilities of VGAM782 include diagnosis, prevention and treatment of diseases and clinical conditions associated with CDH22. DKFZp547O146 (Accession NM_020224) is another VGAM782 host target gene. DKFZp547O146 BINDING SITE is HOST TARGET binding site found in the 3' untranslated region of mRNA encoded by DKFZp547O146, corresponding to a HOST TARGET binding site such as BINDING SITE I, BINDING SITE II or BINDING SITE III. Table 2 illustrates the complementarity of the nucleotide sequences of DKFZp547O146 BINDING SITE, designated SEQ ID:21483, to the nucleotide sequence of VGAM782 RNA, herein designated VGAM RNA, also designated SEQ ID:3493.

Another function of VGAM782 is therefore inhibition of DKFZp547O146 (Accession NM_020224). Accordingly, utilities of VGAM782 include diagnosis, prevention and treatment of diseases and clinical conditions associated with DKFZp547O146. Fatty Acid Desaturase 2 (FADS2, Accession NM_004265) is another VGAM782 host target gene. FADS2 BINDING SITE is HOST TARGET binding site found in the 3' untranslated region of mRNA encoded by FADS2, corresponding to a HOST TARGET binding site such as BINDING SITE I, BINDING SITE II or BINDING SITE III. Table 2 illustrates the complementarity of the nucleotide sequences of FADS2 BINDING SITE, designated SEQ ID:10466, to the nucleotide sequence of VGAM782 RNA, herein designated VGAM RNA, also designated SEQ ID:3493.

Another function of VGAM782 is therefore inhibition of Fatty Acid Desaturase 2 (FADS2, Accession NM_004265). Accordingly, utilities of VGAM782 include diagnosis, prevention and treatment of diseases and clinical conditions associated with FADS2. FLJ11320 (Accession NM_018389) is another VGAM782 host target gene. FLJ11320 BINDING SITE is HOST TARGET binding site found in the 3' untranslated region of mRNA encoded by FLJ11320, corresponding to a HOST TARGET binding site such as BINDING SITE I, BINDING SITE II or BINDING SITE III. Table 2 illustrates the complementarity of the nucleotide sequences of FLJ11320 BINDING SITE, designated SEQ ID:20427, to the nucleotide sequence of VGAM782 RNA, herein designated VGAM RNA, also designated SEQ ID:3493.

Another function of VGAM782 is therefore inhibition of FLJ11320 (Accession NM_018389). Accordingly, utilities of VGAM782 include diagnosis, prevention and treatment of diseases and clinical conditions associated with FLJ11320. FLJ14351 (Accession NM_024732) is another VGAM782 host target gene. FLJ14351 BINDING SITE is HOST TARGET binding site found in the 5' untranslated region of mRNA encoded by FLJ14351, corresponding to a HOST TARGET binding site such as BINDING SITE I, BINDING SITE II or BINDING SITE III. Table 2 illustrates the complementarity of the nucleotide sequences of FLJ14351 BINDING SITE, designated SEQ ID:24071, to the nucleotide sequence of VGAM782 RNA, herein designated VGAM RNA, also designated SEQ ID:3493.

Another function of VGAM782 is therefore inhibition of FLJ14351 (Accession NM_024732). Accordingly, utilities of VGAM782 include diagnosis, prevention and treatment of diseases and clinical conditions associated with FLJ14351. FLJ14816 (Accession NM_032845) is another VGAM782 host target gene. FLJ14816 BINDING SITE is HOST TARGET binding site found in the 3' untranslated region of mRNA encoded by FLJ14816, corresponding to a HOST TARGET binding site such as BINDING SITE I, BINDING SITE II or BINDING SITE III. Table 2 illustrates the complementarity of the nucleotide sequences of FLJ14816 BINDING SITE, designated SEQ ID:26637, to the nucleotide sequence of VGAM782 RNA, herein designated VGAM RNA, also designated SEQ ID:3493.

Another function of VGAM782 is therefore inhibition of FLJ14816 (Accession NM_032845). Accordingly, utilities of VGAM782 include diagnosis, prevention and treatment of diseases and clinical conditions associated with FLJ14816. Gamma-glutamyltransferase-like Activity 4 (GGTLA4, Accession NM_080920) is another VGAM782 host target gene. GGTLA4 BINDING SITE is HOST TARGET binding site found in the 5' untranslated region of mRNA encoded by GGTLA4, corresponding to a HOST TARGET binding site such as BINDING SITE I, BINDING SITE II or BINDING SITE III. Table 2 illustrates the complementarity of the nucleotide sequences of GGTLA4 BINDING SITE, designated SEQ ID:28141, to the nucleotide sequence of VGAM782 RNA, herein designated VGAM RNA, also designated SEQ ID:3493.

Another function of VGAM782 is therefore inhibition of Gamma-glutamyltransferase-like Activity 4 (GGTLA4, Accession NM_080920). Accordingly, utilities of VGAM782 include diagnosis, prevention and treatment of diseases and clinical conditions associated with GGTLA4. KIAA0153 (Accession NM_015140) is another VGAM782 host target gene. KIAA0153 BINDING SITE is HOST TARGET binding site found in the 3' untranslated region of mRNA encoded by KIAA0153, corresponding to a HOST TARGET binding site such as BINDING SITE I, BINDING SITE II or BINDING SITE III. Table 2 illustrates the complementarity of the nucleotide sequences of KIAA0153 BINDING SITE, designated SEQ ID:17497, to the nucleotide sequence of VGAM782 RNA, herein designated VGAM RNA, also designated SEQ ID:3493.

Another function of VGAM782 is therefore inhibition of KIAA0153 (Accession NM_015140). Accordingly, utilities of VGAM782 include diagnosis, prevention and treatment of diseases and clinical conditions associated with KIAA0153. KIAA0285 (Accession NM_014807) is another VGAM782 host target gene. KIAA0285 BINDING SITE is HOST TARGET binding site found in the 3' untranslated region of mRNA encoded by KIAA0285, corresponding to a HOST TARGET binding site such as BINDING SITE I, BINDING SITE II or BINDING SITE III. Table 2 illustrates the complementarity of the nucleotide sequences of KIAA0285 BINDING SITE, designated SEQ ID:16751, to the nucleotide sequence of VGAM782 RNA, herein designated VGAM RNA, also designated SEQ ID:3493.

Another function of VGAM782 is therefore inhibition of KIAA0285 (Accession NM_014807). Accordingly, utilities of VGAM782 include diagnosis, prevention and treatment of diseases and clinical conditions associated with KIAA0285. KIAA0298 (Accession XM_084529) is another VGAM782 host target gene. KIAA0298 BINDING SITE is HOST TARGET binding site found in the 5' untranslated region of mRNA encoded by KIAA0298, corresponding to a HOST TARGET binding site such as BINDING SITE I, BINDING SITE II or BINDING SITE III. Table 2 illustrates the complementarity of the nucleotide sequences of KIAA0298 BINDING SITE, designated SEQ ID:37625, to the nucleotide sequence of VGAM782 RNA, herein designated VGAM RNA, also designated SEQ ID:3493.

Another function of VGAM782 is therefore inhibition of KIAA0298 (Accession XM_084529). Accordingly, utilities of VGAM782 include diagnosis, prevention and treatment of diseases and clinical conditions associated with KIAA0298. KIAA0376 (Accession XM_037759) is another VGAM782 host target gene. KIAA0376 BINDING SITE is HOST TARGET binding site found in the 3' untranslated region of mRNA encoded by KIAA0376, corresponding to a HOST TARGET binding site such as BINDING SITE I, BINDING SITE II or BINDING SITE III. Table 2 illustrates the complementarity of the nucleotide sequences of KIAA0376 BINDING SITE, designated SEQ ID:32674, to the nucleotide sequence of VGAM782 RNA, herein designated VGAM RNA, also designated SEQ ID:3493.

Another function of VGAM782 is therefore inhibition of KIAA0376 (Accession XM_037759). Accordingly, utilities of VGAM782 include diagnosis, prevention and treatment of diseases and clinical conditions associated with KIAA0376. KIAA0563 (Accession NM_014834) is another VGAM782 host target gene. KIAA0563 BINDING SITE is HOST TARGET binding site found in the 5' untranslated region of mRNA encoded by KIAA0563, corresponding to a HOST TARGET binding site such as BINDING SITE I, BINDING SITE II or BINDING SITE III. Table 2 illustrates the complementarity of the nucleotide sequences of KIAA0563 BINDING SITE, designated SEQ ID:16842, to the nucleotide sequence of VGAM782 RNA, herein designated VGAM RNA, also designated SEQ ID:3493.

Another function of VGAM782 is therefore inhibition of KIAA0563 (Accession NM_014834). Accordingly, utilities of VGAM782 include diagnosis, prevention and treatment of diseases and clinical conditions associated with KIAA0563. KIAA1076 (Accession XM_037523) is another VGAM782 host target gene. KIAA1076 BINDING SITE is HOST TARGET binding site found in the 3' untranslated region of mRNA encoded by KIAA1076, corresponding to a HOST TARGET binding site such as BINDING SITE I, BINDING SITE II or BINDING SITE III. Table 2 illustrates the complementarity of the nucleotide sequences of KIAA1076 BINDING SITE, designated SEQ ID:32638, to the nucleotide sequence of VGAM782 RNA, herein designated VGAM RNA, also designated SEQ ID:3493.

Another function of VGAM782 is therefore inhibition of KIAA1076 (Accession XM_037523). Accordingly, utilities of VGAM782 include diagnosis, prevention and treatment of diseases and clinical conditions associated with KIAA1076. KIAA1862 (Accession XM_044212) is another VGAM782 host target gene. KIAA1862 BINDING SITE is HOST TARGET binding site found in the 3' untranslated region of mRNA encoded by KIAA1862, corresponding to a HOST TARGET binding site such as BINDING SITE I, BINDING SITE II or BINDING SITE III. Table 2 illustrates the complementarity of the nucleotide sequences of KIAA1862 BINDING SITE, designated SEQ ID:34174, to the nucleotide sequence of VGAM782 RNA, herein designated VGAM RNA, also designated SEQ ID:3493.

Another function of VGAM782 is therefore inhibition of KIAA1862 (Accession XM_044212). Accordingly, utilities of VGAM782 include diagnosis, prevention and treatment of diseases and clinical conditions associated with KIAA1862. Myristoylated Alanine-rich Protein Kinase C Substrate (MARCKS, Accession NM_002356) is another VGAM782 host target gene. MARCKS BINDING SITE is HOST TARGET binding site found in the 5' untranslated region of mRNA encoded by MARCKS, corresponding to a HOST TARGET binding site such as BINDING SITE I, BINDING SITE II or BINDING SITE III. Table 2 illustrates the complementarity of the nucleotide sequences of MARCKS BINDING SITE, designated SEQ ID:8167, to the nucleotide sequence of VGAM782 RNA, herein designated VGAM RNA, also designated SEQ ID:3493.

Another function of VGAM782 is therefore inhibition of Myristoylated Alanine-rich Protein Kinase C Substrate (MARCKS, Accession NM_002356). Accordingly, utilities of VGAM782 include diagnosis, prevention and treatment of diseases and clinical conditions associated with MARCKS. MGC4415 (Accession NM_031484) is another VGAM782 host target gene. MGC4415 BINDING SITE is HOST TARGET binding site found in the 3' untranslated region of mRNA encoded by MGC4415, corresponding to a HOST TARGET binding site such as BINDING SITE I, BINDING SITE II or BINDING SITE III. Table 2 illustrates the complementarity of the nucleotide sequences of MGC4415 BINDING SITE, designated SEQ ID:25567, to the nucleotide sequence of VGAM782 RNA, herein designated VGAM RNA, also designated SEQ ID:3493.

Another function of VGAM782 is therefore inhibition of MGC4415 (Accession NM_031484). Accordingly, utilities of VGAM782 include diagnosis, prevention and treatment of diseases and clinical conditions associated with MGC4415. Serum Response Factor (c-fos serum response element-binding transcription factor) (SRF, Accession NM_003131) is another VGAM782 host target gene. SRF BINDING SITE is HOST TARGET binding site found in the 3' untranslated region of mRNA encoded by SRF, corresponding to a HOST TARGET binding site such as BINDING SITE I, BINDING SITE II or BINDING SITE III. Table 2 illustrates the complementarity of the nucleotide sequences of SRF BINDING SITE, designated SEQ ID:9098, to the nucleotide sequence of VGAM782 RNA, herein designated VGAM RNA, also designated SEQ ID:3493.

Another function of VGAM782 is therefore inhibition of Serum Response Factor (c-fos serum response element-binding transcription factor) (SRF, Accession NM_003131). Accordingly, utilities of VGAM782 include diagnosis, prevention and treatment of diseases and clinical conditions associated with SRF. STRAIT11499 (Accession NM_021242) is another VGAM782 host target gene. STRAIT11499 BINDING SITE1 and STRAIT11499 BINDING SITE2 are HOST TARGET binding sites found in untranslated regions of mRNA encoded by STRAIT11499, corresponding to HOST TARGET binding sites such as BINDING SITE I, BINDING SITE II or BINDING SITE III. Table 2 illustrates the complementarity of the nucleotide sequences of STRAIT11499 BINDING SITE1 and STRAIT11499 BINDING SITE2, designated SEQ ID:22209 and SEQ ID:22210 respectively, to the nucleotide sequence of VGAM782 RNA, herein designated VGAM RNA, also designated SEQ ID:3493.

Another function of VGAM782 is therefore inhibition of STRAIT11499 (Accession NM_021242). Accordingly, utilities of VGAM782 include diagnosis, prevention and treatment of diseases and clinical conditions associated with STRAIT11499. LOC146562 (Accession NM_139170) is another VGAM782 host target gene. LOC146562 BINDING SITE is HOST TARGET binding site found in the 3' untranslated region of mRNA encoded by LOC146562, corresponding to a HOST TARGET binding site such as BINDING SITE I, BINDING SITE II or BINDING SITE III. Table 2 illustrates the complementarity of the nucleotide sequences of LOC146562 BINDING SITE, designated SEQ ID:29179, to the nucleotide sequence of VGAM782 RNA, herein designated VGAM RNA, also designated SEQ ID:3493.

Another function of VGAM782 is therefore inhibition of LOC146562 (Accession NM_139170). Accordingly, utilities of VGAM782 include diagnosis, prevention and treatment of diseases and clinical conditions associated with LOC146562. LOC158856 (Accession XM_098998) is another VGAM782 host target gene. LOC158856 BINDING SITE is HOST TARGET binding site found in the 5' untranslated region of mRNA encoded by LOC158856, corresponding to a HOST TARGET binding site such as BINDING SITE I, BINDING SITE II or BINDING SITE III. Table 2 illustrates the complementarity of the nucleotide sequences of LOC158856 BINDING SITE, designated SEQ ID:42033, to the nucleotide sequence of VGAM782 RNA, herein designated VGAM RNA, also designated SEQ ID:3493.

Another function of VGAM782 is therefore inhibition of LOC158856 (Accession XM_098998). Accordingly, utilities of VGAM782 include diagnosis, prevention and treatment of diseases and clinical conditions associated with LOC158856. LOC201220 (Accession XM_113321) is another VGAM782 host target gene. LOC201220 BINDING SITE is HOST TARGET binding site found in the 5' untranslated region of mRNA encoded by LOC201220, corresponding to a HOST TARGET binding site such as BINDING SITE I, BINDING SITE II or BINDING SITE III. Table 2 illustrates the complementarity of the nucleotide sequences of LOC201220 BINDING SITE, designated SEQ ID:42225, to the nucleotide sequence of VGAM782 RNA, herein designated VGAM RNA, also designated SEQ ID:3493.

Another function of VGAM782 is therefore inhibition of LOC201220 (Accession XM_113321). Accordingly, utilities of VGAM782 include diagnosis, prevention and treatment of diseases and clinical conditions associated with LOC201220. LOC254057 (Accession XM_173085) is another VGAM782 host target gene. LOC254057 BINDING SITE is HOST TARGET binding site found in the 5' untranslated region of mRNA encoded by LOC254057, corresponding to a HOST TARGET binding site such as BINDING SITE I, BINDING SITE II or BINDING SITE III. Table 2 illustrates the complementarity of the nucleotide sequences of LOC254057 BINDING SITE, designated SEQ ID:46342, to the nucleotide sequence of VGAM782 RNA, herein designated VGAM RNA, also designated SEQ ID:3493.

Another function of VGAM782 is therefore inhibition of LOC254057 (Accession XM_173085). Accordingly, utilities of VGAM782 include diagnosis, prevention and treatment of diseases and clinical conditions associated with LOC254057. LOC254205 (Accession XM_172962) is another VGAM782 host target gene. LOC254205 BINDING SITE is HOST TARGET binding site found in the 5' untranslated region of mRNA encoded by LOC254205, corresponding to a HOST TARGET binding site such as BINDING SITE I, BINDING SITE II or BINDING SITE III. Table 2 illustrates the complementarity of the nucleotide sequences of LOC254205 BINDING SITE, designated SEQ ID:46217, to the nucleotide sequence of VGAM782 RNA, herein designated VGAM RNA, also designated SEQ ID:3493.

Another function of VGAM782 is therefore inhibition of LOC254205 (Accession XM_172962). Accordingly, utilities of VGAM782 include diagnosis, prevention and treatment of diseases and clinical conditions associated with LOC254205. LOC92340 (Accession XM_044426) is another VGAM782 host target gene. LOC92340 BINDING SITE is HOST TARGET binding site found in the 3' untranslated region of mRNA encoded by LOC92340, corresponding to a HOST TARGET binding site such as BINDING SITE I, BINDING SITE II or BINDING SITE III. Table 2 illustrates the complementarity of the nucleotide sequences of LOC92340 BINDING SITE, designated SEQ ID:34199, to the nucleotide sequence of VGAM782 RNA, herein designated VGAM RNA, also designated SEQ ID:3493.

Another function of VGAM782 is therefore inhibition of LOC92340 (Accession XM_044426). Accordingly, utilities of VGAM782 include diagnosis, prevention and treatment of diseases and clinical conditions associated with LOC92340.
FIG. 1 further provides a conceptual description of a novel bioinformatically detected viral gene of the present invention, referred to here as Viral Genomic Address Messenger 783 (VGAM783) viral gene, which modulates expression of respective host target genes thereof, the function and utility of which host target genes is known in the art.

VGAM783 is a novel bioinformatically detected regulatory, non protein coding, viral micro RNA (miRNA) gene. The method by which VGAM783 was detected is described hereinabove with reference to FIGS. 1-8.

VGAM783 gene, herein designated VGAM GENE, is a viral gene contained in the genome of Deer Tick Virus. VGAM783 host target gene, herein designated VGAM HOST TARGET GENE, is a human gene contained in the human genome.

VGAM783 gene encodes a VGAM783 precursor RNA, herein designated VGAM PRECURSOR RNA. Similar to other miRNA genes, and unlike most ordinary genes, VGAM783 precursor RNA does not encode a protein. A nucleotide sequence identical or highly similar to the nucleotide sequence of VGAM783 precursor RNA is designated SEQ ID:769, and is provided hereinbelow with reference to the sequence listing part. Nucleotide sequence SEQ ID:769 is located at position 1240 relative to the genome of Deer Tick Virus.

VGAM783 precursor RNA folds onto itself, forming VGAM783 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM783 folded precursor RNA into VGAM783 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM783 RNA is designated SEQ ID:3494, and is provided hereinbelow with reference to the sequence listing part.

VGAM783 host target gene, herein designated VGAM HOST TARGET GENE, encodes a corresponding messenger RNA, VGAM783 host target RNA, herein designated VGAM HOST TARGET RNA. VGAM783 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM783 RNA, herein designated VGAM RNA, binds complementarily to one or more host target binding sites located in untranslated regions of VGAM783 host target RNA, herein designated VGAM HOST TARGET RNA. This complementary binding is due to the fact that the nucleotide sequence of VGAM783 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM783 RNA, herein designated VGAM RNA, may have a different number of host target binding sites in untranslated regions of a VGAM783 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM783 RNA, herein designated VGAM RNA, to host target binding sites on VGAM783 host target RNA, herein designated VGAM HOST TARGET RNA, such as BINDING SITE I, BINDING SITE II and BINDING SITE III, inhibits translation of VGAM783 host target RNA into VGAM783 host target protein, herein designated VGAM HOST TARGET PROTEIN. VGAM host target protein is therefore outlined by a broken line.

It is appreciated that VGAM783 host target gene, herein designated VGAM HOST TARGET GENE, in fact represents a plurality of VGAM783 host target genes. The mRNA of each one of this plurality of VGAM783 host target genes comprises one or more host target binding sites, each having a nucleotide sequence which is at least partly complementary to VGAM783 RNA, herein designated VGAM RNA, and which when bound by VGAM783 RNA causes inhibition of translation of respective one or more VGAM783 host target proteins.

It is further appreciated by one skilled in the art that the mode of translational inhibition illustrated by FIG. 1 with specific reference to translational inhibition exerted by VGAM783 gene, herein designated VGAM GENE, on one or more VGAM783 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM783 is inhibition of expression of host target genes, as part of a novel viral mechanism of attacking a host. Accordingly, utilities of VGAM783 include diagnosis, prevention and treatment of viral infection by Deer Tick Virus. Specific functions, and accordingly utilities, of VGAM783 correlate with, and may be deduced from, the identity of the host target genes which VGAM783 binds and inhibits, and the function of these host target genes, as elaborated hereinbelow.

Nucleotide sequences of the VGAM783 precursor RNA, herein designated VGAM PRECURSOR RNA, and of the 'diced' VGAM783 RNA, herein designated VGAM RNA, and a schematic representation of the secondary folding of VGAM783 folded precursor RNA, herein designated VGAM FOLDED PRECURSOR RNA, of VGAM783 are further described hereinbelow with reference to Table 1.

Nucleotide sequences of host target binding sites, such as BINDING SITE-I, BINDING SITE-II and BINDING SITE-III of FIG. 1, found on VGAM783 host target RNA, and schematic representation of the complementarity of each of these host target binding sites to VGAM783 RNA, herein designated VGAM RNA, are described hereinbelow with reference to Table 2.

As mentioned hereinabove with reference to FIG. 1, a function of VGAM783 gene, herein designated VGAM is inhibition of expression of VGAM783 target genes. It is appreciated that specific functions, and accordingly utilities, of VGAM783 correlate with, and may be deduced from, the identity of the target genes which VGAM783 binds and inhibits, and the function of these target genes, as elaborated hereinbelow.

MGC15429 (Accession NM_032750) is a VGAM783 host target gene. MGC15429 BINDING SITE is HOST TARGET binding site found in the 3' untranslated region of mRNA encoded by MGC15429, corresponding to a HOST TARGET binding site such as BINDING SITE I, BINDING SITE II or BINDING SITE III. Table 2 illustrates the complementarity of the nucleotide sequences of MGC15429 BINDING SITE, designated SEQ ID:26487, to the nucleotide sequence of VGAM783 RNA, herein designated VGAM RNA, also designated SEQ ID:3494.

A function of VGAM783 is therefore inhibition of MGC15429 (Accession NM_032750). Accordingly, utilities of VGAM783 include diagnosis, prevention and treatment of diseases and clinical conditions associated with MGC15429. Phospholipid Scramblase 4 (PLSCR4, Accession NM_020353) is another VGAM783 host target gene. PLSCR4 BINDING SITE is HOST TARGET binding site found in the 3' untranslated region of mRNA encoded by PLSCR4, corresponding to a HOST TARGET binding site such as BINDING SITE I, BINDING SITE II or BINDING SITE III. Table 2 illustrates the complementarity of the nucleotide sequences of PLSCR4 BINDING SITE, designated SEQ ID:21622, to the nucleotide sequence of VGAM783 RNA, herein designated VGAM RNA, also designated SEQ ID:3494.

Another function of VGAM783 is therefore inhibition of Phospholipid Scramblase 4 (PLSCR4, Accession NM_020353). Accordingly, utilities of VGAM783 include diagnosis, prevention and treatment of diseases and clinical conditions associated with PLSCR4. Regulator of G-protein Signalling 18 (RGS18, Accession NM_130782) is another VGAM783 host target gene. RGS18 BINDING SITE is HOST TARGET binding site found in the 3' untranslated region of mRNA encoded by RGS18, corresponding to a HOST TARGET binding site such as BINDING SITE I, BINDING SITE II or BINDING SITE III. Table 2 illustrates the complementarity of the nucleotide sequences of RGS18 BINDING SITE, designated SEQ ID:28270, to the nucleotide sequence of VGAM783 RNA, herein designated VGAM RNA, also designated SEQ ID:3494.

Another function of VGAM783 is therefore inhibition of Regulator of G-protein Signalling 18 (RGS18, Accession NM_130782). Accordingly, utilities of VGAM783 include diagnosis, prevention and treatment of diseases and clinical conditions associated with RGS18. LOC122553 (Accession XM_058630) is another VGAM783 host target gene. LOC122553 BINDING SITE is HOST TARGET binding site found in the 3' untranslated region of mRNA encoded by LOC122553, corresponding to a HOST TARGET binding site such as BINDING SITE I, BINDING SITE II or BINDING SITE III. Table 2 illustrates the complementarity of the nucleotide sequences of LOC122553 BINDING SITE, designated SEQ ID:36692, to the nucleotide sequence of VGAM783 RNA, herein designated VGAM RNA, also designated SEQ ID:3494.

Another function of VGAM783 is therefore inhibition of LOC122553 (Accession XM_058630). Accordingly, utilities of VGAM783 include diagnosis, prevention and treatment of diseases and clinical conditions associated with LOC122553. LOC148195 (Accession XM_097419) is another VGAM783 host target gene. LOC148195 BINDING SITE is HOST TARGET binding site found in the 5' untranslated region of mRNA encoded by LOC148195, corresponding to a HOST TARGET binding site such as BINDING SITE I, BINDING SITE II or BINDING SITE III. Table 2 illustrates the complementarity of the nucleotide sequences of LOC148195 BINDING SITE, designated SEQ ID:40880, to the nucleotide sequence of VGAM783 RNA, herein designated VGAM RNA, also designated SEQ ID:3494.

Another function of VGAM783 is therefore inhibition of LOC148195 (Accession XM_097419). Accordingly, utilities of VGAM783 include diagnosis, prevention and treatment of diseases and clinical conditions associated with LOC148195. LOC166341 (Accession XM_093804) is another VGAM783 host target gene. LOC166341 BINDING SITE is HOST TARGET binding site found in the 3' untranslated region of mRNA encoded by LOC166341, corresponding to a HOST TARGET binding site such as BINDING SITE I, BINDING SITE II or BINDING SITE III. Table 2 illustrates the complementarity of the nucleotide sequences of LOC166341 BINDING SITE, designated SEQ ID:40213, to the nucleotide sequence of VGAM783 RNA, herein designated VGAM RNA, also designated SEQ ID:3494.

Another function of VGAM783 is therefore inhibition of LOC166341 (Accession XM_093804). Accordingly, utilities of VGAM783 include diagnosis, prevention and treatment of diseases and clinical conditions associated with LOC166341. LOC254532 (Accession XM_172961) is another VGAM783 host target gene. LOC254532 BINDING SITE is HOST TARGET binding site found in the 3' untranslated region of mRNA encoded by LOC254532, corresponding to a HOST TARGET binding site such as BINDING SITE I, BINDING SITE II or BINDING SITE III. Table 2 illustrates the complementarity of the nucleotide sequences of LOC254532 BINDING SITE, designated SEQ ID:46216, to the nucleotide sequence of VGAM783 RNA, herein designated VGAM RNA, also designated SEQ ID:3494.

Another function of VGAM783 is therefore inhibition of LOC254532 (Accession XM_172961). Accordingly, utilities of VGAM783 include diagnosis, prevention and treatment of diseases and clinical conditions associated with LOC254532. LOC257319 (Accession XM_171049) is another VGAM783 host target gene. LOC257319 BINDING SITE is HOST TARGET binding site found in the 3' untranslated region of mRNA encoded by LOC257319, corresponding to a HOST TARGET binding site such as BINDING SITE I, BINDING SITE II or BINDING SITE III. Table 2 illustrates the complementarity of the nucleotide sequences of LOC257319 BINDING SITE, designated SEQ ID:45836, to the nucleotide sequence of VGAM783 RNA, herein designated VGAM RNA, also designated SEQ ID:3494.

Another function of VGAM783 is therefore inhibition of LOC257319 (Accession XM_171049). Accordingly, utilities of VGAM783 include diagnosis, prevention and treatment of diseases and clinical conditions associated with LOC257319. LOC51289 (Accession NM_016568) is another VGAM783 host target gene. LOC51289 BINDING SITE is HOST TARGET binding site found in the 5' untranslated region of mRNA encoded by LOC51289, corresponding to a HOST TARGET binding site such as BINDING SITE I, BINDING SITE II or BINDING SITE III. Table 2 illustrates the complementarity of the nucleotide sequences of LOC51289 BINDING SITE, designated SEQ ID:18640, to the nucleotide sequence of VGAM783 RNA, herein designated VGAM RNA, also designated SEQ ID:3494.

Another function of VGAM783 is therefore inhibition of LOC51289 (Accession NM_016568). Accordingly, utilities of VGAM783 include diagnosis, prevention and treatment of diseases and clinical conditions associated with LOC51289. FIG. 1 further provides a conceptual description of a novel bioinformatically detected viral gene of the present invention, referred to here as Viral Genomic Address Messenger 784 (VGAM784) viral gene, which modulates expression of respective host target genes thereof, the function and utility of which host target genes is known in the art.

VGAM784 is a novel bioinformatically detected regulatory, non protein coding, viral micro RNA (miRNA) gene. The method by which VGAM784 was detected is described hereinabove with reference to FIGS. 1-8.

VGAM784 gene, herein designated VGAM GENE, is a viral gene contained in the genome of Deer Tick Virus. VGAM784 host target gene, herein designated VGAM HOST TARGET GENE, is a human gene contained in the human genome.

VGAM784 gene encodes a VGAM784 precursor RNA, herein designated VGAM PRECURSOR RNA. Similar to other miRNA genes, and unlike most ordinary genes, VGAM784 precursor RNA does not encode a protein. A nucleotide sequence identical or highly similar to the nucleotide sequence of VGAM784 precursor RNA is designated SEQ ID:770, and is provided hereinbelow with reference to the sequence listing part. Nucleotide sequence SEQ ID:770 is located at position 834 relative to the genome of Deer Tick Virus.

VGAM784 precursor RNA folds onto itself, forming VGAM784 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM784 folded precursor RNA into VGAM784 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM784 RNA is designated SEQ ID:3495, and is provided hereinbelow with reference to the sequence listing part.

VGAM784 host target gene, herein designated VGAM HOST TARGET GENE, encodes a corresponding messenger RNA, VGAM784 host target RNA, herein designated VGAM HOST TARGET RNA. VGAM784 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM784 RNA, herein designated VGAM RNA, binds complementarily to one or more host target binding sites located in untranslated regions of VGAM784 host target RNA, herein designated VGAM HOST TARGET RNA. This complementary binding is due to the fact that the nucleotide sequence of VGAM784 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM784 RNA, herein designated VGAM RNA, may have a different number of host target binding sites in untranslated regions of a VGAM784 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM784 RNA, herein designated VGAM RNA, to host target binding sites on VGAM784 host target RNA, herein designated VGAM HOST TARGET RNA, such as BINDING SITE I, BINDING SITE II and BINDING SITE III, inhibits translation of VGAM784 host target RNA into VGAM784 host target protein, herein designated VGAM HOST TARGET PROTEIN. VGAM host target protein is therefore outlined by a broken line.

It is appreciated that VGAM784 host target gene, herein designated VGAM HOST TARGET GENE, in fact represents a plurality of VGAM784 host target genes. The mRNA of each one of this plurality of VGAM784 host target genes comprises one or more host target binding sites, each having a nucleotide sequence which is at least partly complementary to VGAM784 RNA, herein designated VGAM RNA, and which when bound by VGAM784 RNA causes inhibition of translation of respective one or more VGAM784 host target proteins.

It is further appreciated by one skilled in the art that the mode of translational inhibition illustrated by FIG. 1 with specific reference to translational inhibition exerted by VGAM784 gene, herein designated VGAM GENE, on one or more VGAM784 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM784 is inhibition of expression of host target genes, as part of a novel viral mechanism of attacking a host. Accordingly, utilities of VGAM784 include diagnosis, prevention and treatment of viral infection by Deer Tick Virus. Specific functions, and accordingly utilities, of VGAM784 correlate with, and may be deduced from, the identity of the host target genes which VGAM784 binds and inhibits, and the function of these host target genes, as elaborated hereinbelow.

Nucleotide sequences of the VGAM784 precursor RNA, herein designated VGAM PRECURSOR RNA, and of the 'diced' VGAM784 RNA, herein designated VGAM RNA, and a schematic representation of the secondary folding of VGAM784 folded precursor RNA, herein designated VGAM FOLDED PRECURSOR RNA, of VGAM784 are further described hereinbelow with reference to Table 1.

Nucleotide sequences of host target binding sites, such as BINDING SITE-I, BINDING SITE-II and BINDING SITE-III of FIG. 1, found on VGAM784 host target RNA, and schematic representation of the complementarity of each of these host target binding sites to VGAM784 RNA, herein designated VGAM RNA, are described hereinbelow with reference to Table 2.

As mentioned hereinabove with reference to FIG. 1, a function of VGAM784 gene, herein designated VGAM is inhibition of expression of VGAM784 target genes. It is appreciated that specific functions, and accordingly utilities, of VGAM784 correlate with, and may be deduced from, the identity of the target genes which VGAM784 binds and inhibits, and the function of these target genes, as elaborated hereinbelow.

Ras Homolog Gene Family, Member U (ARHU, Accession NM_021205) is a VGAM784 host target gene. ARHU BINDING SITE is HOST TARGET binding site found in the 3' untranslated region of mRNA encoded by ARHU, corresponding to a HOST TARGET binding site such as BINDING SITE I, BINDING SITE II or BINDING SITE III. Table 2 illustrates the complementarity of the nucleotide sequences of ARHU BINDING SITE, designated SEQ ID:22181, to the nucleotide sequence of VGAM784 RNA, herein designated VGAM RNA, also designated SEQ ID:3495.

A function of VGAM784 is therefore inhibition of Ras Homolog Gene Family, Member U (ARHU, Accession NM_021205). Accordingly, utilities of VGAM784 include diagnosis, prevention and treatment of diseases and clinical conditions associated with ARHU. Chromosome 20 Open Reading Frame 42 (C20orf42, Accession NM_017671) is another VGAM784 host target gene. C20orf42 BINDING SITE is HOST TARGET binding site found in the 3' untranslated region of mRNA encoded by C20orf42, corresponding to a HOST TARGET binding site such as BINDING SITE I, BINDING SITE II or BINDING SITE III. Table 2 illustrates the complementarity of the nucleotide sequences of C20orf42 BINDING SITE, designated SEQ ID:19213, to the nucleotide sequence of VGAM784 RNA, herein designated VGAM RNA, also designated SEQ ID:3495.

Another function of VGAM784 is therefore inhibition of Chromosome 20 Open Reading Frame 42 (C20orf42, Accession NM_017671). Accordingly, utilities of VGAM784 include diagnosis, prevention and treatment of diseases and clinical conditions associated with C20orf42. DKFZp761D0614 (Accession XM_113634) is another VGAM784 host target gene. DKFZp761D0614 BINDING SITE is HOST TARGET binding site found in the 3' untranslated region of mRNA encoded by DKFZp761D0614, corresponding to a HOST TARGET binding site such as BINDING SITE I, BINDING SITE II or BINDING SITE III. Table 2 illustrates the complementarity of the nucleotide sequences of DKFZp761D0614 BINDING SITE, designated SEQ ID:42309, to the nucleotide sequence of VGAM784 RNA, herein designated VGAM RNA, also designated SEQ ID:3495.

Another function of VGAM784 is therefore inhibition of DKFZp761D0614 (Accession XM_113634). Accordingly, utilities of VGAM784 include diagnosis, prevention and treatment of diseases and clinical conditions associated with DKFZp761D0614. KIAA1228 (Accession XM_036408) is another VGAM784 host target gene. KIAA1228 BINDING SITE is HOST TARGET binding site found in the 3' untranslated region of mRNA encoded by KIAA1228, corresponding to a HOST TARGET binding site such as BINDING SITE I, BINDING SITE II or BINDING SITE III. Table 2 illustrates the complementarity of the nucleotide sequences of KIAA1228 BINDING SITE, designated SEQ ID:32442, to the nucleotide sequence of VGAM784 RNA, herein designated VGAM RNA, also designated SEQ ID:3495.

Another function of VGAM784 is therefore inhibition of KIAA1228 (Accession XM_036408). Accordingly, utilities of VGAM784 include diagnosis, prevention and treatment of diseases and clinical conditions associated with KIAA1228. LOC200473 (Accession XM_117237) is another VGAM784 host target gene. LOC200473 BINDING SITE is HOST TARGET binding site found in the 5' untranslated region of mRNA encoded by LOC200473, corresponding to a HOST TARGET binding site such as BINDING SITE I, BINDING SITE II or BINDING SITE III. Table 2 illustrates the complementarity of the nucleotide sequences of LOC200473 BINDING SITE, designated SEQ ID:43312, to the nucleotide sequence of VGAM784 RNA, herein designated VGAM RNA, also designated SEQ ID:3495.

Another function of VGAM784 is therefore inhibition of LOC200473 (Accession XM_117237). Accordingly, utilities of VGAM784 include diagnosis, prevention and treatment of diseases and clinical conditions associated with LOC200473. LOC221296 (Accession XM_166325) is another VGAM784 host target gene. LOC221296 BINDING SITE is HOST TARGET binding site found in the 3' untranslated region of mRNA encoded by LOC221296, corresponding to a HOST TARGET binding site such as BINDING SITE I, BINDING SITE II or BINDING SITE III. Table 2 illustrates the complementarity of the nucleotide sequences of LOC221296 BINDING SITE, designated SEQ ID:44170, to the nucleotide sequence of VGAM784 RNA, herein designated VGAM RNA, also designated SEQ ID:3495.

Another function of VGAM784 is therefore inhibition of LOC221296 (Accession XM_166325). Accordingly, utilities of VGAM784 include diagnosis, prevention and treatment of diseases and clinical conditions associated with LOC221296. FIG. 1 further provides a conceptual description of a novel bioinformatically detected viral gene of the present invention, referred to here as Viral Genomic Address Messenger 785 (VGAM785) viral gene, which modulates expression of respective host target genes thereof, the function and utility of which host target genes is known in the art.

VGAM785 is a novel bioinformatically detected regulatory, non protein coding, viral micro RNA (miRNA) gene. The method by which VGAM785 was detected is described hereinabove with reference to FIGS. 1-8.

VGAM785 gene, herein designated VGAM GENE, is a viral gene contained in the genome of Zucchini Yellow Mosaic Virus. VGAM785 host target gene, herein designated VGAM HOST TARGET GENE, is a human gene contained in the human genome.

VGAM785 gene encodes a VGAM785 precursor RNA, herein designated VGAM PRECURSOR RNA. Similar to other miRNA genes, and unlike most ordinary genes, VGAM785 precursor RNA does not encode a protein. A nucleotide sequence identical or highly similar to the nucleotide sequence of VGAM785 precursor RNA is designated SEQ ID:771, and is provided hereinbelow with reference to the sequence listing part. Nucleotide sequence SEQ ID:771 is located at position 7220 relative to the genome of Zucchini Yellow Mosaic Virus.

VGAM785 precursor RNA folds onto itself, forming VGAM785 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM785 folded precursor RNA into VGAM785 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM785 RNA is designated SEQ ID:3496, and is provided hereinbelow with reference to the sequence listing part.

VGAM785 host target gene, herein designated VGAM HOST TARGET GENE, encodes a corresponding messenger RNA, VGAM785 host target RNA, herein designated VGAM HOST TARGET RNA. VGAM785 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM785 RNA, herein designated VGAM RNA, binds complementarily to one or more host target binding sites located in untranslated regions of VGAM785 host target RNA, herein designated VGAM HOST TARGET RNA. This complementary binding is due to the fact that the nucleotide sequence of VGAM785 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM785 RNA, herein designated VGAM RNA, may have a different number of host target binding sites in untranslated regions of a VGAM785 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM785 RNA, herein designated VGAM RNA, to host target binding sites on VGAM785 host target RNA, herein designated VGAM HOST TARGET RNA, such as BINDING SITE I, BINDING SITE II and BINDING SITE III, inhibits translation of VGAM785 host target RNA into VGAM785 host target protein, herein designated VGAM HOST TARGET PROTEIN. VGAM host target protein is therefore outlined by a broken line.

It is appreciated that VGAM785 host target gene, herein designated VGAM HOST TARGET GENE, in fact represents a plurality of VGAM785 host target genes. The mRNA of each one of this plurality of VGAM785 host target genes comprises one or more host target binding sites, each having a nucleotide sequence which is at least partly complementary to VGAM785 RNA, herein designated VGAM RNA, and which when bound by VGAM785 RNA causes inhibition of translation of respective one or more VGAM785 host target proteins.

It is further appreciated by one skilled in the art that the mode of translational inhibition illustrated by FIG. 1 with specific reference to translational inhibition exerted by VGAM785 gene, herein designated VGAM GENE, on one or more VGAM785 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM785 is inhibition of expression of host target genes, as part of a novel viral mechanism of attacking a host. Accordingly, utilities of VGAM785 include diagnosis, prevention and treatment of viral infection by Zucchini Yellow Mosaic Virus. Specific functions, and accordingly utilities, of VGAM785 correlate with, and may be deduced from, the identity of the host target genes which VGAM785 binds and inhibits, and the function of these host target genes, as elaborated hereinbelow.

Nucleotide sequences of the VGAM785 precursor RNA, herein designated VGAM PRECURSOR RNA, and of the 'diced' VGAM785 RNA, herein designated VGAM RNA, and a schematic representation of the secondary folding of VGAM785 folded precursor RNA, herein designated VGAM FOLDED PRECURSOR RNA, of VGAM785 are further described hereinbelow with reference to Table 1.

Nucleotide sequences of host target binding sites, such as BINDING SITE-I, BINDING SITE-II and BINDING SITE-III of FIG. 1, found on VGAM785 host target RNA, and schematic representation of the complementarity of each of these host target binding sites to VGAM785 RNA, herein designated VGAM RNA, are described hereinbelow with reference to Table 2.

As mentioned hereinabove with reference to FIG. 1, a function of VGAM785 gene, herein designated VGAM is inhibition of expression of VGAM785 target genes. It is appreciated that specific functions, and accordingly utilities, of VGAM785 correlate with, and may be deduced from, the identity of the target genes which VGAM785 binds and inhibits, and the function of these target genes, as elaborated hereinbelow.

Calmodulin 3 (phosphorylase kinase, delta) (CALM3, Accession NM_005184) is a VGAM785 host target gene. CALM3 BINDING SITE is HOST TARGET binding site found in the 3' untranslated region of mRNA encoded by CALM3, corresponding to a HOST TARGET binding site such as BINDING SITE I, BINDING SITE II or BINDING SITE III. Table 2 illustrates the complementarity of the nucleotide sequences of CALM3 BINDING SITE, designated SEQ ID:11682, to the nucleotide sequence of VGAM785 RNA, herein designated VGAM RNA, also designated SEQ ID:3496.

A function of VGAM785 is therefore inhibition of Calmodulin 3 (phosphorylase kinase, delta) (CALM3, Accession NM_005184), a gene which mediates the control of a large number of enzymes by ca (++). Accordingly, utilities of VGAM785 include diagnosis, prevention and treatment of diseases and clinical conditions associated with CALM3. The function of CALM3 has been established by previous studies. McPherson et al. (1991) assigned the CALM3 gene to chromosome 19 by study of somatic cell hybrids. By PCR-based amplification of CALM3-specific sequences using DNA from human/hamster cell hybrids as template, Berchtold et al. (1993) confirmed the assignment to chromosome 19 and regionalized the gene to 19q13.2-q13.3 by in situ hybridization.

Full details of the abovementioned studies are described in the following publications, the disclosure of which are hereby incorporated by reference:

Berchtold, M. W.; Egli, R.; Rhyner, J. A.; Hameister, H.; Strehler, E. E.: Localization of the human bona fide calmodulin genes CALM1, CALM2, and CALM3 to chromosomes 14q24-q31, 2p21.1-p21.3, and 19q13.2-q13.3. Genomics 16:461-465, 1993.; and McPherson, J. D.; Hickie, R. A.; Wasmuth, J. J.; Meyskens, F. L.; Perham, R. N.; Strehler, E. E.; Graham, M. T.: Chromosomal localization of multiple genes encoding calmodulin. (Abstra.

Further studies establishing the function and utilities of CALM3 are found in John Hopkins OMIM database record ID 114183, and in sited publications numbered 1257 and 12578 listed in the bibliography section hereinbelow, which are also hereby incorporated by reference. LFG (Accession XM_084780) is another VGAM785 host target gene. LFG BINDING SITE is HOST TARGET binding site found in the 3' untranslated region of mRNA encoded by LFG, corresponding to a HOST TARGET binding site such as BINDING SITE I, BINDING SITE II or BINDING SITE III. Table 2 illustrates the complementarity of the nucleotide sequences of LFG BINDING SITE, designated SEQ ID:37691, to the nucleotide sequence of VGAM785 RNA, herein designated VGAM RNA, also designated SEQ ID:3496.

Another function of VGAM785 is therefore inhibition of LFG (Accession XM_084780). Accordingly, utilities of VGAM785 include diagnosis, prevention and treatment of diseases and clinical conditions associated with LFG. FLJ22029 (Accession NM_024949) is another VGAM785 host target gene. FLJ22029 BINDING SITE is HOST TARGET binding site found in the 3" untranslated region of mRNA encoded by FLJ22029, corresponding to a HOST TARGET binding site such as BINDING SITE I, BINDING SITE II or BINDING SITE III. Table 2 illustrates the complementarity of the nucleotide sequences of FLJ22029 BINDING SITE, designated SEQ ID:24504, to the nucleotide sequence of VGAM785 RNA, herein designated VGAM RNA, also designated SEQ ID:3496.

Another function of VGAM785 is therefore inhibition of FLJ22029 (Accession NM_024949). Accordingly, utilities of VGAM785 include diagnosis, prevention and treatment of diseases and clinical conditions associated with FLJ22029. SSH2 (Accession XM_030846) is another VGAM785 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31178, to the nucleotide sequence of VGAM785 RNA, herein designated VGAM RNA, also designated SEQ ID:3496.

Another function of VGAM785 is therefore inhibition of SSH2 (Accession XM_030846). Accordingly, utilities of VGAM785 include diagnosis, prevention and treatment of diseases and clinical conditions associated with SSH2. FIG. 1 further provides a conceptual description of a novel bioinformatically detected viral gene of the present invention, referred to here as Viral Genomic Address Messenger 786 (VGAM786) viral gene, which modulates expression of respective host target genes thereof, the function and utility of which host target genes is known in the art.

VGAM786 is a novel bioinformatically detected regulatory, non protein coding, viral micro RNA (miRNA) gene. The method by which VGAM786 was detected is described hereinabove with reference to FIGS. 1-8.

VGAM786 gene, herein designated VGAM GENE, is a viral gene contained in the genome of Zucchini Yellow Mosaic Virus. VGAM786 host target gene, herein designated VGAM HOST TARGET GENE, is a human gene contained in the human genome.

VGAM786 gene encodes a VGAM786 precursor RNA, herein designated VGAM PRECURSOR RNA. Similar to other miRNA genes, and unlike most ordinary genes, VGAM786 precursor RNA does not encode a protein. A nucleotide sequence identical or highly similar to the nucleotide sequence of VGAM786 precursor RNA is designated SEQ ID:772, and is provided hereinbelow with reference to the sequence listing part. Nucleotide sequence SEQ ID:772 is located at position 8631 relative to the genome of Zucchini Yellow Mosaic Virus.

VGAM786 precursor RNA folds onto itself, forming VGAM786 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM786 folded precursor RNA into VGAM786 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM786 RNA is designated SEQ ID:3497, and is provided hereinbelow with reference to the sequence listing part.

VGAM786 host target gene, herein designated VGAM HOST TARGET GENE, encodes a corresponding messenger RNA, VGAM786 host target RNA, herein designated VGAM HOST TARGET RNA. VGAM786 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM786 RNA, herein designated VGAM RNA, binds complementarily to one or more host target binding sites located in untranslated regions of VGAM786 host target RNA, herein designated VGAM HOST TARGET RNA. This complementary binding is due to the fact that the nucleotide sequence of VGAM786 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM786 RNA, herein designated VGAM RNA, may have a different number of host target binding sites in untranslated regions of a VGAM786 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM786 RNA, herein designated VGAM RNA, to host target binding sites on VGAM786 host target RNA, herein designated VGAM HOST TARGET RNA, such as BINDING SITE I, BINDING SITE II and BINDING SITE III, inhibits translation of VGAM786 host target RNA into VGAM786 host target protein, herein designated VGAM HOST TARGET PROTEIN. VGAM host target protein is therefore outlined by a broken line.

It is appreciated that VGAM786 host target gene, herein designated VGAM HOST TARGET GENE, in fact represents a plurality of VGAM786 host target genes. The mRNA of each one of this plurality of VGAM786 host target genes comprises one or more host target binding sites, each having a nucleotide sequence which is at least partly complementary to VGAM786 RNA, herein designated VGAM RNA, and which when bound by VGAM786 RNA causes inhibition of translation of respective one or more VGAM786 host target proteins.

It is further appreciated by one skilled in the art that the mode of translational inhibition illustrated by FIG. 1 with specific reference to translational inhibition exerted by VGAM786 gene, herein designated VGAM GENE, on one or more VGAM786 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM786 is inhibition of expression of host target genes, as part of a novel viral mechanism of attacking a host. Accordingly, utilities of VGAM786 include diagnosis, prevention and treatment of viral infection by Zucchini Yellow Mosaic Virus. Specific functions, and accordingly utilities, of VGAM786 correlate with, and may be deduced from, the identity of the host target genes which VGAM786 binds and inhibits, and the function of these host target genes, as elaborated hereinbelow.

Nucleotide sequences of the VGAM786 precursor RNA, herein designated VGAM PRECURSOR RNA, and of the 'diced' VGAM786 RNA, herein designated VGAM RNA, and a schematic representation of the secondary folding of VGAM786 folded precursor RNA, herein designated VGAM FOLDED PRECURSOR RNA, of VGAM786 are further described hereinbelow with reference to Table 1.

Nucleotide sequences of host target binding sites, such as BINDING SITE-I, BINDING SITE-II and BINDING SITE-III of FIG. 1, found on VGAM786 host target RNA, and schematic representation of the complementarity of each of these host target binding sites to VGAM786 RNA, herein designated VGAM RNA, are described hereinbelow with reference to Table 2.

As mentioned hereinabove with reference to FIG. 1, a function of VGAM786 gene, herein designated VGAM is inhibition of expression of VGAM786 target genes. It is appreciated that specific functions, and accordingly utilities, of VGAM786 correlate with, and may be deduced from, the identity of the target genes which VGAM786 binds and inhibits, and the function of these target genes, as elaborated hereinbelow.

Aristaless-like Homeobox 3 (ALX3, Accession NM_006492) is a VGAM786 host target gene. ALX3 BINDING SITE is HOST TARGET binding site found in the 3' untranslated region of mRNA encoded by ALX3, corresponding to a HOST TARGET binding site such as BINDING SITE I, BINDING SITE II or BINDING SITE III. Table 2 illustrates the complementarity of the nucleotide sequences of ALX3 BINDING SITE, designated SEQ ID:13220, to the nucleotide sequence of VGAM786 RNA, herein designated VGAM RNA, also designated SEQ ID:3497.

A function of VGAM786 is therefore inhibition of Aristaless-like Homeobox 3 (ALX3, Accession NM_006492), a gene which is involved in cell-type differentiation and development. Accordingly, utilities of VGAM786 include diagnosis, prevention and treatment of diseases and clinical conditions associated with ALX3. The function of ALX3 and its association with various diseases and clinical conditions, has been established by previous studies, as described hereinabove with reference to VGAM55. Asparagine Synthetase (ASNS, Accession NM_133436) is another VGAM786 host target gene. ASNS BINDING SITE is HOST TARGET binding site found in the 5' untranslated region of mRNA encoded by ASNS, corresponding to a HOST TARGET binding site such as BINDING SITE I, BINDING SITE II or BINDING SITE III. Table 2 illustrates the complementarity of the nucleotide sequences of ASNS BINDING SITE, designated SEQ ID:28515, to the nucleotide sequence of VGAM786 RNA, herein designated VGAM RNA, also designated SEQ ID:3497.

Another function of VGAM786 is therefore inhibition of Asparagine Synthetase (ASNS, Accession NM_133436). Accordingly, utilities of VGAM786 include diagnosis, prevention and treatment of diseases and clinical conditions associated with ASNS. Erythrocyte Membrane Protein Band 4.9 (dematin) (EPB49, Accession NM_001978) is another VGAM786 host target gene. EPB49 BINDING SITE is HOST TARGET binding site found in the 3' untranslated region of mRNA encoded by EPB49, corresponding to a HOST TARGET binding site such as BINDING SITE I, BINDING SITE II or BINDING SITE III. Table 2 illustrates the complementarity of the nucleotide sequences of EPB49 BINDING SITE, designated SEQ ID:7708, to the nucleotide sequence of VGAM786 RNA, herein designated VGAM RNA, also designated SEQ ID:3497.

Another function of VGAM786 is therefore inhibition of Erythrocyte Membrane Protein Band 4.9 (dematin) (EPB49, Accession NM_001978), a gene which is an actin-bundling protein. Accordingly, utilities of VGAM786 include diagnosis, prevention and treatment of diseases and clinical conditions associated with EPB49. The function of EPB49 and its association with various diseases and clinical conditions, has been established by previous studies, as described hereinabove with reference to VGAM760. Fibroblast Growth Factor Receptor 2 (bacteria-expressed kinase, keratinocyte growth factor receptor, craniofacial dysostosis 1, Crouzon syndrome, Pfeiffer syndrome, Jackson-Weiss syndrome) (FGFR2, Accession NM_000141) is another VGAM786 host target gene. FGFR2 BINDING SITE1 through FGFR2 BINDING SITE6 are HOST TARGET binding sites found in untranslated regions of mRNA encoded by FGFR2, corresponding to HOST TARGET binding sites such as BINDING SITE I, BINDING SITE II or BINDING SITE III. Table 2 illustrates the complementarity of the nucleotide sequences of FGFR2 BINDING SITE1 through FGFR2 BINDING SITE6, designated SEQ ID:5638, SEQ ID:23300, SEQ ID:23234, SEQ ID:23241, SEQ ID:23288 and SEQ ID:23294 respectively, to the nucleotide sequence of VGAM786 RNA, herein designated VGAM RNA, also designated SEQ ID:3497.

Another function of VGAM786 is therefore inhibition of Fibroblast Growth Factor Receptor 2 (bacteria-expressed kinase, keratinocyte growth factor receptor, craniofacial dysostosis 1, Crouzon syndrome, Pfeiffer syndrome, Jackson-Weiss syndrome) (FGFR2, Accession NM_000141). Accordingly, utilities of VGAM786 include diagnosis, prevention and treatment of diseases and clinical conditions associated with FGFR2. Glutamate Receptor, Metabotropic 1 (GRM1, Accession NM_000838) is another VGAM786 host target gene. GRM1 BINDING SITE is HOST TARGET binding site found in the 3' untranslated region of mRNA encoded by GRM1, corresponding to a HOST TARGET binding site such as BINDING SITE I, BINDING SITE II or BINDING SITE III. Table 2 illustrates the complementarity of the nucleotide sequences of GRM1 BINDING SITE, designated SEQ ID:6496, to the nucleotide sequence of VGAM786 RNA, herein designated VGAM RNA, also designated SEQ ID:3497.

Another function of VGAM786 is therefore inhibition of Glutamate Receptor, Metabotropic 1 (GRM1, Accession NM_000838), a gene which promotes phosphoinositide hydrolysis. Accordingly, utilities of VGAM786 include diagnosis, prevention and treatment of diseases and clinical conditions associated with GRM1. The function of GRM1 has been established by previous studies. Stephan et al. (1996) isolated 2 splice variants of mGluR1 from a human cerebellum cDNA library. The 3.3- and 5.6-kb clones encoded mGluR1-beta and mGluR1-alpha, respectively. Northern blot analysis showed that mGluR1 mRNA was expressed in the highest levels in the cerebellum, followed by cerebral cortex, thalamus, subthalamic nucleus, and amygdala. Lower levels were also detected in the hippocampus, substantia nigra, caudate nucleus, and putamen. Little or no mRNA was detected in spinal cord or corpus callosum. Animal model experiments lend further support to the function of GRM1. Aiba et al. (1994) generated a mouse strain deficient in GluR1 by targeted disruption. Gross anatomy of the hippocampus, excitatory synaptic transmission, long-term depression, and short-term potentiation in the hippocampal CA1 region were all apparently normal in the mutant mice. In contrast, long-term potentiation was substantially reduced, and a moderate level of impairment was observed in context-specific associative learning. Aiba et al. (1994) proposed that GluR1 is not 'in line' in long-term potentiation production, but rather modulates the plasticity process, and hence affects context-specific associative learning. Aiba et al. (1994) found that the GluR1 mutant mice were viable but showed characteristic cerebellar symptoms, such as ataxic gait and intention tremor. The anatomy of the cerebellum was not overtly disturbed. Excitatory synaptic transmission from parallel fibers to Purkinje cells and that from climbing fibers to Purkinje cells appeared to be functional, and voltage-gated calcium channels of Purkinje cells were normal. Both parallel fibers and climbing fiber synapses displayed normal short-term synaptic plasticity to paired stimuli. By marked contrast, long-term depression was clearly deficient and conditioned eyeblink response was impaired. Aiba et al. (1994) concluded that GluR1 was required for the induction of long-term depression.

It is appreciated that the abovementioned animal model for GRM1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Aiba, A.; Chen, C.; Herrup, K.; Rosenmund, C.; Stevens, C. F.; Tonegawa, S.: Reduced hippocampal long-term potentiation and context-specific deficit in associative learning in mGluR1 mutant mice. Cell 79:365-375, 1994; and Stephan, D.; Bon, C.; Holzwarth, J. A.; Galvan, M.; Pruss, R. M.: Human metabotropic glutamate receptor 1: mRNA distribution, chromosome localization and functional expression of two.

Further studies establishing the function and utilities of GRM1 are found in John Hopkins OMIM database record ID 604473, and in sited publications numbered 4924-4925, 7056-493 and 4920 listed in the bibliography section hereinbelow, which are also hereby incorporated by reference. Kallmann Syndrome 1 Sequence (KAL1, Accession NM_000216) is another VGAM786 host target gene. KAL1 BINDING SITE is HOST TARGET binding site found in the 3' untranslated region of mRNA encoded by KAL1, corresponding to a HOST TARGET binding site such as BINDING SITE I, BINDING SITE II or BINDING SITE III. Table 2 illustrates the complementarity of the nucleotide sequences of KAL1 BINDING SITE, designated SEQ ID:5717, to the nucleotide sequence of VGAM786 RNA, herein designated VGAM RNA, also designated SEQ ID:3497.

Another function of VGAM786 is therefore inhibition of Kallmann Syndrome 1 Sequence (KAL1, Accession NM_000216). Accordingly, utilities of VGAM786 include diagnosis, prevention and treatment of diseases and clinical conditions associated with KAL1. Antigen Identified By Monoclonal Antibody Ki-67 (MKI67, Accession NM_002417) is another VGAM786 host target gene. MKI67 BINDING SITE is HOST TARGET binding site found in the 3' untranslated region of mRNA encoded by MKI67, corresponding to a HOST TARGET binding site such as BINDING SITE I, BINDING SITE II or BINDING SITE III. Table 2 illustrates the complementarity of the nucleotide sequences of MKI67 BINDING SITE, designated SEQ ID:8254, to the nucleotide sequence of VGAM786 RNA, herein designated VGAM RNA, also designated SEQ ID:3497.

Another function of VGAM786 is therefore inhibition of Antigen Identified By Monoclonal Antibody Ki-67 (MKI67, Accession NM_002417), a gene which thought to be required for maintaining cell proliferation. Accordingly, utilities of VGAM786 include diagnosis, prevention and treatment of diseases and clinical conditions associated with MKI67. The function of MKI67 has been established by previous studies. Ki-67 is a commercially available monoclonal antibody that reacts with a nuclear antigen expressed in proliferating cells but not in quiescent cells. Expression of this antigen occurs preferentially during late G1, S, G2, and M phases of the cell cycle, while in cells in G0 phase the antigen cannot be detected. Consequently, the antibody is used in tumor pathology to detect proliferating cells in neoplastic diseases. In cultured cells an antigen in the nucleolus of interphase cells stains with Ki-67, which, furthermore, reacts with an interchromatinous network during mitosis. From study of a panel of human-rodent somatic cell hybrids, Schonk et al. (1989) demonstrated that a gene involved in the expression of the antigen is located on chromosome 10. By in situ hybridization, Fonatsch et al. (1991) regionalized the MKI67 gene to 10q25-qter. By FISH, Traut et al. (1998) mapped the mouse Mki67 gene to chromosome 7F3-F5. By immunoscreening a cDNA expression library, followed by RT-PCR and 5-prime and 3-prime RACE, Schluter et al. (1993) isolated 2 cDNAs encoding isoforms of Ki-67. Genomic sequence analysis determined that the Ki-67 gene contains 15 exons. The Ki-67 repeat region, within which there is a 22-amino acid Ki-67 motif, is encoded by exon 13. The shorter isoform lacks exon 7. Northern blot analysis revealed multiple transcripts ranging from approximately 8.9 to 12.5 kb in proliferating but not quiescent cells. Immunoblot analysis showed expression of 320- and 359-kD proteins. Sequence analysis predicted that the short-lived 2,896- and 3,256-amino acid protein isoforms contain potential nuclear targeting signals, over 200 potential phosphorylation sites, 19 N-myristoylation sites, 3 amidation sites, and numerous PEST sites. Antisense oligonucleotides inhibited cellular proliferation in a dose-dependent manner, suggesting that Ki-67 protein expression may be an absolute requirement for cell proliferation.

Full details of the abovementioned studies are described in the following publications, the disclosure of which are hereby incorporated by reference:

Schluter, C.; Duchrow, M.; Wohlenberg, C.; Becker, M. H. G; Key, G.; Flad, H.-D.; Gerdes, J.: The cell proliferation-associated antigen of antibody Ki-67: a very large, ubiquitous nuclear protein with numerous repeated elements, representing a new kind of cell cycle-maintaining proteins. J. Cell. Biol. 123:513-522, 1993; and Traut, W.; Scholzen, T.; Winking, H.; Kubbutat, M. H. G.; Gerdes, J.: Assignment of the murine Ki-67 gene (Mki67) to chromosome band 7F3-F5 by in situ hybridization. Cytogenet. Cell Ge.

Further studies establishing the function and utilities of MKI67 are found in John Hopkins OMIM database record ID 176741, and in sited publications numbered 1794-1797 listed in the bibliography section hereinbelow, which are also hereby incorporated by reference. Serine (or cysteine) Proteinase Inhibitor, Clade H (heat shock protein 47), Member 2 (SERPINH2, Accession NM_001235) is another VGAM786 host target gene. SERPINH2 BINDING SITE is HOST TARGET binding site found in the 3' untranslated region of mRNA encoded by SERPINH2, corresponding to a HOST TARGET binding site such as BINDING SITE I, BINDING SITE II or BINDING SITE III. Table 2 illustrates the complementarity of the nucleotide sequences of SERPINH2 BINDING SITE, designated SEQ ID:6905, to the nucleotide sequence of VGAM786 RNA, herein designated VGAM RNA, also designated SEQ ID:3497.

Another function of VGAM786 is therefore inhibition of Serine (or cysteine) Proteinase Inhibitor, Clade H (heat shock protein 47), Member 2 (SERPINH2, Accession NM_001235), a gene which binds to collagen. could be involved as a chaperone in the biosynthetic pathway of collagen. Accordingly, utilities of VGAM786 include diagnosis, prevention and treatment of diseases and clinical conditions associated with SERPINH2. The function of SERPINH2 has been established by previous studies. Collagen-binding proteins, or colligins, are glycoproteins localized to endoplasmic reticulum that belong to the serpin (serine protease inhibitor) family. Ikegawa et al. (1995) isolated and characterized a full-length human cDNA clone that encodes a 418-amino acid peptide highly homologous (97% identity) to the human colligin-1 gene (OMIM Ref. No. 600942) previously reported by Clarke and Sanwal (1992). Ikegawa et al. (1995) called the novel gene colligin-2 and identified a genomic clone that contained the entire coding sequence of the cDNA. By fluorescence in situ hybridization they determined its chromosomal localization on 11q13.5. The authors found that the colligin-2 gene is expressed ubiquitously among all normal human tissues except brain and circulating leukocytes. Ikegawa and Nakamura (1997) found that the CBP2 gene spans approximately 11 kb of genomic DNA and consists of 5 exons. The promoter sequence of the human gene shows significant homology to that of its murine counterpart, which contains several regulatory sequences including heat-shock and retinoic acid-responsive elements. The findings suggested that colligin may function as a collagen-specific molecular chaperone and play a role in the process of retinoic acid-induced differentiation.

Full details of the abovementioned studies are described in the following publications, the disclosure of which are hereby incorporated by reference:

Ikegawa, S.; Sudo, K.; Okui, K.; Nakamura, Y.: Isolation, characterization and chromosomal assignment of human colligin-2 gene (CBP2). Cytogenet. Cell Genet. 71:182-186, 1995; and Ikegawa, S.; Sudo, K.; Okui, K.; Nakamura, Y.: Isolation, characterization and chromosomal assignment of human colligin-2 gene (CBP2). Cytogenet. Cell Genet. 71:182-186, 1995.

Further studies establishing the function and utilities of SERPINH2 are found in John Hopkins OMIM database record ID 600943, and in sited publications numbered 1288-1290 listed in the bibliography section hereinbelow, which are also hereby incorporated by reference. DKFZP434O125 (Accession XM_036284) is another VGAM786 host target gene. DKFZP434O125 BINDING SITE is HOST TARGET binding site found in the 3' untranslated region of mRNA encoded by DKFZP434O125, corresponding to a HOST TARGET binding site such as BINDING SITE I, BINDING SITE II or BINDING SITE III. Table 2 illustrates the complementarity of the nucleotide sequences of DKFZP434O125 BINDING SITE, designated SEQ ID:32404, to the nucleotide sequence of VGAM786 RNA, herein designated VGAM RNA, also designated SEQ ID:3497.

Another function of VGAM786 is therefore inhibition of DKFZP434O125 (Accession XM_036284). Accordingly, utilities of VGAM786 include diagnosis, prevention and treatment of diseases and clinical conditions associated with DKFZP434O125. Dystrophia Myotonica-containing WD Repeat Motif (DMWD, Accession XM_027569) is another VGAM786 host target gene. DMWD BINDING SITE is HOST TARGET binding site found in the 5' untranslated region of mRNA encoded by DMWD, corresponding to a HOST TARGET binding site such as BINDING SITE I, BINDING SITE II or BINDING SITE III. Table 2 illustrates the complementarity of the nucleotide sequences of DMWD BINDING SITE, designated SEQ ID:30527, to the nucleotide sequence of VGAM786 RNA, herein designated VGAM RNA, also designated SEQ ID:3497.

Another function of VGAM786 is therefore inhibition of Dystrophia Myotonica-containing WD Repeat Motif (DMWD, Accession XM_027569). Accordingly, utilities of VGAM786 include diagnosis, prevention and treatment of diseases and clinical conditions associated with DMWD. FLJ14106 (Accession NM_025067) is another VGAM786 host target gene. FLJ14106 BINDING SITE is HOST TARGET binding site found in the 3' untranslated region of mRNA encoded by FLJ14106, corresponding to a HOST TARGET binding site such as BINDING SITE I, BINDING SITE II or BINDING SITE III. Table 2 illustrates the complementarity of the nucleotide sequences of FLJ14106 BINDING SITE, designated SEQ ID:24664, to the nucleotide sequence of VGAM786 RNA, herein designated VGAM RNA, also designated SEQ ID:3497.

Another function of VGAM786 is therefore inhibition of FLJ14106 (Accession NM_025067). Accordingly, utilities of VGAM786 include diagnosis, prevention and treatment of diseases and clinical conditions associated with FLJ14106. FLJ20202 (Accession NM_017709) is another VGAM786 host target gene. FLJ20202 BINDING SITE is HOST TARGET binding site found in the 3' untranslated region of mRNA encoded by FLJ20202, corresponding to a HOST TARGET binding site such as BINDING SITE I, BINDING SITE II or BINDING SITE III. Table 2 illustrates the complementarity of the nucleotide sequences of FLJ20202 BINDING SITE, designated SEQ ID:19288, to the nucleotide sequence of VGAM786 RNA, herein designated VGAM RNA, also designated SEQ ID:3497.

Another function of VGAM786 is therefore inhibition of FLJ20202 (Accession NM_017709). Accordingly, utilities of VGAM786 include diagnosis, prevention and treatment of diseases and clinical conditions associated with FLJ20202. FLJ20255 (Accession NM_017728) is another VGAM786 host target gene. FLJ20255 BINDING SITE is HOST TARGET binding site found in the 3' untranslated region of mRNA encoded by FLJ20255, corresponding to a HOST TARGET binding site such as BINDING SITE I, BINDING SITE II or BINDING SITE III. Table 2 illustrates the complementarity of the nucleotide sequences of FLJ20255 BINDING SITE, designated SEQ ID:19317, to the nucleotide sequence of VGAM786 RNA, herein designated VGAM RNA, also designated SEQ ID:3497.

Another function of VGAM786 is therefore inhibition of FLJ20255 (Accession NM_017728). Accordingly, utilities of VGAM786 include diagnosis, prevention and treatment of diseases and clinical conditions associated with FLJ20255. KIAA0426 (Accession NM_014724) is another VGAM786 host target gene. KIAA0426 BINDING SITE is HOST TARGET binding site found in the 3' untranslated region of mRNA encoded by KIAA0426, corresponding to a HOST TARGET binding site such as BINDING SITE I, BINDING SITE II or BINDING SITE III. Table 2 illustrates the complementarity of the nucleotide sequences of KIAA0426 BINDING SITE, designated SEQ ID:16311, to the nucleotide sequence of VGAM786 RNA, herein designated VGAM RNA, also designated SEQ ID:3497.

Another function of VGAM786 is therefore inhibition of KIAA0426 (Accession NM_014724). Accordingly, utilities of VGAM786 include diagnosis, prevention and treatment of diseases and clinical conditions associated with KIAA0426. LEC3 (Accession NM_015236) is another VGAM786 host target gene. LEC3 BINDING SITE is HOST TARGET binding site found in the 3' untranslated region of mRNA encoded by LEC3, corresponding to a HOST TARGET binding site such as BINDING SITE I, BINDING SITE II or BINDING SITE III. Table 2 illustrates the complementarity of the nucleotide sequences of LEC3 BINDING SITE, designated SEQ ID:17568, to the nucleotide sequence of VGAM786 RNA, herein designated VGAM RNA, also designated SEQ ID:3497.

Another function of VGAM786 is therefore inhibition of LEC3 (Accession NM_015236). Accordingly, utilities of VGAM786 include diagnosis, prevention and treatment of diseases and clinical conditions associated with LEC3. MGC16384 (Accession NM_053048) is another VGAM786 host target gene. MGC16384 BINDING SITE is HOST TARGET binding site found in the 5' untranslated region of mRNA encoded by MGC16384, corresponding to a HOST TARGET binding site such as BINDING SITE I, BINDING SITE II or BINDING SITE III. Table 2 illustrates the complementarity of the nucleotide sequences of MGC16384 BINDING SITE, designated SEQ ID:27594, to the nucleotide sequence of VGAM786 RNA, herein designated VGAM RNA, also designated SEQ ID:3497.

Another function of VGAM786 is therefore inhibition of MGC16384 (Accession NM_053048). Accordingly, utilities of VGAM786 include diagnosis, prevention and treatment of diseases and clinical conditions associated with MGC16384. NDP52 (Accession NM_005831) is another VGAM786 host target gene. NDP52 BINDING SITE is HOST TARGET binding site found in the 3' untranslated region of mRNA encoded by NDP52, corresponding to a HOST TARGET binding site such as BINDING SITE I, BINDING SITE II or BINDING SITE III. Table 2 illustrates the complementarity of the nucleotide sequences of NDP52 BINDING SITE, designated SEQ ID:12441, to the nucleotide sequence of VGAM786 RNA, herein designated VGAM RNA, also designated SEQ ID:3497.

Another function of VGAM786 is therefore inhibition of NDP52 (Accession NM_005831). Accordingly, utilities of VGAM786 include diagnosis, prevention and treatment of diseases and clinical conditions associated with NDP52. SCMH1 (Accession NM_012236) is another VGAM786 host target gene. SCMH1 BINDING SITE is HOST TARGET binding site found in the 3' untranslated region of mRNA encoded by SCMH1, corresponding to a HOST TARGET binding site such as BINDING SITE I, BINDING SITE II or BINDING SITE III. Table 2 illustrates the complementarity of the nucleotide sequences of SCMH1 BINDING SITE, designated SEQ ID:14538, to the nucleotide sequence of VGAM786 RNA, herein designated VGAM RNA, also designated SEQ ID:3497.

Another function of VGAM786 is therefore inhibition of SCMH1 (Accession NM_012236). Accordingly, utilities of VGAM786 include diagnosis, prevention and treatment of diseases and clinical conditions associated with SCMH1. Serine (or cysteine) Proteinase Inhibitor, Clade H (heat shock protein 47), Member 1, (collagen binding protein 1) (SERPINH1, Accession NM_004353) is another VGAM786 host target gene. SERPINH1 BINDING SITE is HOST TARGET binding site found in the 3' untranslated region of mRNA encoded by SERPINH1, corresponding to a HOST TARGET binding site such as BINDING SITE I, BINDING SITE II or BINDING SITE III. Table 2 illustrates the complementarity of the nucleotide sequences of SERPINH1 BINDING SITE, designated SEQ ID:10559, to the nucleotide sequence of VGAM786 RNA, herein designated VGAM RNA, also designated SEQ ID:3497.

Another function of VGAM786 is therefore inhibition of Serine (or cysteine) Proteinase Inhibitor, Clade H (heat shock protein 47), Member 1, (collagen binding protein 1) (SERPINH1, Accession NM_004353). Accordingly, utilities of VGAM786 include diagnosis, prevention and treatment of diseases and clinical conditions associated with SERPINH1. Zinc Finger Protein 317 (ZNF317, Accession XM_050435) is another VGAM786 host target gene. ZNF317 BINDING SITE is HOST TARGET binding site found in the 3' untranslated region of mRNA encoded by ZNF317, corresponding to a HOST TARGET binding site such as BINDING SITE I, BINDING SITE II or BINDING SITE III. Table 2 illustrates the complementarity of the nucleotide sequences of ZNF317 BINDING SITE, designated SEQ ID:35637, to the nucleotide sequence of VGAM786 RNA, herein designated VGAM RNA, also designated SEQ ID:3497.

Another function of VGAM786 is therefore inhibition of Zinc Finger Protein 317 (ZNF317, Accession XM_050435). Accordingly, utilities of VGAM786 include diagnosis, prevention and treatment of diseases and clinical conditions associated with ZNF317. LOC201229 (Accession XM_113925) is another VGAM786 host target gene. LOC201229 BINDING SITE is HOST TARGET binding site found in the 3' untranslated region of mRNA encoded by LOC201229, corresponding to a HOST TARGET binding site such as BINDING SITE I, BINDING SITE II or BINDING SITE III. Table 2 illustrates the complementarity of the nucleotide sequences of LOC201229 BINDING SITE, designated SEQ ID:42538, to the nucleotide sequence of VGAM786 RNA, herein designated VGAM RNA, also designated SEQ ID:3497.

Another function of VGAM786 is therefore inhibition of LOC201229 (Accession XM_113925). Accordingly, utilities of VGAM786 include diagnosis, prevention and treatment of diseases and clinical conditions associated with LOC201229. LOC201799 (Accession XM_114380) is another VGAM786 host target gene. LOC201799 BINDING SITE is HOST TARGET binding site found in the 3' untranslated region of mRNA encoded by LOC201799, corresponding to a HOST TARGET binding site such as BINDING SITE I, BINDING SITE II or BINDING SITE III. Table 2 illustrates the complementarity of the nucleotide sequences of LOC201799 BINDING SITE, designated SEQ ID:42915, to the nucleotide sequence of VGAM786 RNA, herein designated VGAM RNA, also designated SEQ ID:3497.

Another function of VGAM786 is therefore inhibition of LOC201799 (Accession XM_114380). Accordingly, utilities of VGAM786 include diagnosis, prevention and treatment of diseases and clinical conditions associated with LOC201799. LOC221272 (Accession XM_168050) is another VGAM786 host target gene. LOC221272 BINDING SITE is HOST TARGET binding site found in the 3' untranslated region of mRNA encoded by LOC221272, corresponding to a HOST TARGET binding site such as BINDING SITE I, BINDING SITE II or BINDING SITE III. Table 2 illustrates the complementarity of the nucleotide sequences of LOC221272 BINDING SITE, designated SEQ ID:44962, to the nucleotide sequence of VGAM786 RNA, herein designated VGAM RNA, also designated SEQ ID:3497.

Another function of VGAM786 is therefore inhibition of LOC221272 (Accession XM_168050). Accordingly, utilities of VGAM786 include diagnosis, prevention and treatment of diseases and clinical conditions associated with LOC221272. LOC91056 (Accession XM_170662) is another VGAM786 host target gene. LOC91056 BINDING SITE is HOST TARGET binding site found in the 3' untranslated region of mRNA encoded by LOC91056, corresponding to a HOST TARGET binding site such as BINDING SITE I, BINDING SITE II or BINDING SITE III. Table 2 illustrates the complementarity of the nucleotide sequences of LOC91056 BINDING SITE, designated SEQ ID:45439, to the nucleotide sequence of VGAM786 RNA, herein designated VGAM RNA, also designated SEQ ID:3497.

Another function of VGAM786 is therefore inhibition of LOC91056 (Accession XM_170662). Accordingly, utilities of VGAM786 include diagnosis, prevention and treatment of diseases and clinical conditions associated with LOC91056. FIG. 1 further provides a conceptual description of a novel bioinformatically detected viral gene of the present invention, referred to here as Viral Genomic Address Messenger 787 (VGAM787) viral gene, which modulates expression of respective host target genes thereof, the function and utility of which host target genes is known in the art.

VGAM787 is a novel bioinformatically detected regulatory, non protein coding, viral micro RNA (miRNA) gene. The method by which VGAM787 was detected is described hereinabove with reference to FIGS. 1-8.

VGAM787 gene, herein designated VGAM GENE, is a viral gene contained in the genome of Zucchini Yellow Mosaic Virus. VGAM787 host target gene, herein designated VGAM HOST TARGET GENE, is a human gene contained in the human genome.

VGAM787 gene encodes a VGAM787 precursor RNA, herein designated VGAM PRECURSOR RNA. Similar to other miRNA genes, and unlike most ordinary genes, VGAM787 precursor RNA does not encode a protein. A nucleotide sequence identical or highly similar to the nucleotide sequence of VGAM787 precursor RNA is designated SEQ ID:773, and is provided hereinbelow with reference to the sequence listing part. Nucleotide sequence SEQ ID:773 is located at position 3152 relative to the genome of Zucchini Yellow Mosaic Virus.

VGAM787 precursor RNA folds onto itself, forming VGAM787 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM787 folded precursor RNA into VGAM787 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM787 RNA is designated SEQ ID:3498, and is provided hereinbelow with reference to the sequence listing part.

VGAM787 host target gene, herein designated VGAM HOST TARGET GENE, encodes a corresponding messenger RNA, VGAM787 host target RNA, herein designated VGAM HOST TARGET RNA. VGAM787 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM787 RNA, herein designated VGAM RNA, binds complementarily to one or more host target binding sites located in untranslated regions of VGAM787 host target RNA, herein designated VGAM HOST TARGET RNA. This complementary binding is due to the fact that the nucleotide sequence of VGAM787 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM787 RNA, herein designated VGAM RNA, may have a different number of host target binding sites in untranslated regions of a VGAM787 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM787 RNA, herein designated VGAM RNA, to host target binding sites on VGAM787 host target RNA, herein designated VGAM HOST TARGET RNA, such as BINDING SITE I, BINDING SITE II and BINDING SITE III, inhibits translation of VGAM787 host target RNA into VGAM787 host target protein, herein designated VGAM HOST TARGET PROTEIN. VGAM host target protein is therefore outlined by a broken line.

It is appreciated that VGAM787 host target gene, herein designated VGAM HOST TARGET GENE, in fact represents a plurality of VGAM787 host target genes. The mRNA of each one of this plurality of VGAM787 host target genes comprises one or more host target binding sites, each having a nucleotide sequence which is at least partly complementary to VGAM787 RNA, herein designated VGAM RNA, and which when bound by VGAM787 RNA causes inhibition of translation of respective one or more VGAM787 host target proteins.

It is further appreciated by one skilled in the art that the mode of translational inhibition illustrated by FIG. 1 with specific reference to translational inhibition exerted by VGAM787 gene, herein designated VGAM GENE, on one or more VGAM787 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM787 is inhibition of expression of host target genes, as part of a novel viral mechanism of attacking a host. Accordingly, utilities of VGAM787 include diagnosis, prevention and treatment of viral infection by Zucchini Yellow Mosaic Virus. Specific functions, and accordingly utilities, of VGAM787 correlate with, and may be deduced from, the identity of the host target genes which VGAM787 binds and inhibits, and the function of these host target genes, as elaborated hereinbelow.

Nucleotide sequences of the VGAM787 precursor RNA, herein designated VGAM PRECURSOR RNA, and of the 'diced' VGAM787 RNA, herein designated VGAM RNA, and a schematic representation of the secondary folding of VGAM787 folded precursor RNA, herein designated VGAM FOLDED PRECURSOR RNA, of VGAM787 are further described hereinbelow with reference to Table 1.

Nucleotide sequences of host target binding sites, such as BINDING SITE-I, BINDING SITE-II and BINDING SITE-III of FIG. 1, found on VGAM787 host target RNA, and schematic representation of the complementarity of each of these host target binding sites to VGAM787 RNA, herein designated VGAM RNA, are described hereinbelow with reference to Table 2.

As mentioned hereinabove with reference to FIG. 1, a function of VGAM787 gene, herein designated VGAM is inhibition of expression of VGAM787 target genes. It is appreciated that specific functions, and accordingly utilities, of VGAM787 correlate with, and may be deduced from, the identity of the target genes which VGAM787 binds and inhibits, and the function of these target genes, as elaborated hereinbelow.

Chloride Channel 4 (CLCN4, Accession NM_001830) is a VGAM787 host target gene. CLCN4 BINDING SITE is HOST TARGET binding site found in the 3' untranslated region of mRNA encoded by CLCN4, corresponding to a HOST TARGET binding site such as BINDING SITE I, BINDING SITE II or BINDING SITE III. Table 2 illustrates the complementarity of the nucleotide sequences of CLCN4 BINDING SITE, designated SEQ ID:7571, to the nucleotide sequence of VGAM787 RNA, herein designated VGAM RNA, also designated SEQ ID:3498.

A function of VGAM787 is therefore inhibition of Chloride Channel 4 (CLCN4, Accession NM_001830), a gene which is regulation of cell volume; membrane potential stabilization, signal transduction and transepithelial transport. Accordingly, utilities of VGAM787 include diagnosis, prevention and treatment of diseases and clinical conditions associated with CLCN4. The function of CLCN4 and its association with various diseases and clinical conditions, has been established by previous studies, as described hereinabove with reference to VGAM558. Chromosome X Open Reading Frame 1 (CXorf1, Accession NM_004709) is another VGAM787 host target gene. CXorf1 BINDING SITE is HOST TARGET binding site found in the 3' untranslated region of mRNA encoded by CXorf1, corresponding to a HOST TARGET binding site such as BINDING SITE I, BINDING SITE II or BINDING SITE III. Table 2 illustrates the complementarity of the nucleotide sequences of CXorf1 BINDING SITE, designated SEQ ID:11055, to the nucleotide sequence of VGAM787 RNA, herein designated VGAM RNA, also designated SEQ ID:3498.

Another function of VGAM787 is therefore inhibition of Chromosome X Open Reading Frame 1 (CXorf1, Accession NM_004709). Accordingly, utilities of VGAM787 include diagnosis, prevention and treatment of diseases and clinical conditions associated with CXorf1. General Transcription Factor IIE, Polypeptide 1, Alpha 56 kDa (GTF2E1, Accession NM_005513) is another VGAM787 host target gene. GTF2E1 BINDING SITE is HOST TARGET binding site found in the 3' untranslated region of mRNA encoded by GTF2E1, corresponding to a HOST TARGET binding site such as BINDING SITE I, BINDING SITE II or BINDING SITE III. Table 2 illustrates the complementarity of the nucleotide sequences of GTF2E1 BINDING SITE, designated SEQ ID:12038, to the nucleotide sequence of VGAM787 RNA, herein designated VGAM RNA, also designated SEQ ID:3498.

Another function of VGAM787 is therefore inhibition of General Transcription Factor IIE, Polypeptide 1, Alpha 56 kDa (GTF2E1, Accession NM_005513). Accordingly, utilities of VGAM787 include diagnosis, prevention and treatment of diseases and clinical conditions associated with GTF2E1. MADP-1 (Accession NM_033114) is another VGAM787 host target gene. MADP-1 BINDING SITE is HOST TARGET binding site found in the 3' untranslated region of mRNA encoded by MADP-1, corresponding to a HOST TARGET binding site such as BINDING SITE I, BINDING SITE II or BINDING SITE III. Table 2 illustrates the complementarity of the nucleotide sequences of MADP-1 BINDING SITE, designated SEQ ID:26962, to the nucleotide sequence of VGAM787 RNA, herein designated VGAM RNA, also designated SEQ ID:3498.

Another function of VGAM787 is therefore inhibition of MADP-1 (Accession NM_033114). Accordingly, utilities of VGAM787 include diagnosis, prevention and treatment of diseases and clinical conditions associated with MADP-1. LOC120856 (Accession XM_058509) is another VGAM787 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36637, to the nucleotide sequence of VGAM787 RNA, herein designated VGAM RNA, also designated SEQ ID:3498.

Another function of VGAM787 is therefore inhibition of LOC120856 (Accession XM_058509). Accordingly, utilities of VGAM787 include diagnosis, prevention and treatment of diseases and clinical conditions associated with LOC120856. LOC152756 (Accession XM_098262) is another VGAM787 host target gene. LOC152756 BINDING SITE is HOST TARGET binding site found in the 3' untranslated region of mRNA encoded by LOC152756, corresponding to a HOST TARGET binding site such as BINDING SITE I, BINDING SITE II or BINDING SITE III. Table 2 illustrates the complementarity of the nucleotide sequences of LOC152756 BINDING SITE, designated SEQ ID:41548, to the nucleotide sequence of VGAM787 RNA, herein designated VGAM RNA, also designated SEQ ID:3498.

Another function of VGAM787 is therefore inhibition of LOC152756 (Accession XM_098262). Accordingly, utilities of VGAM787 include diagnosis, prevention and treatment of diseases and clinical conditions associated with LOC152756. LOC157931 (Accession XM_098845) is another VGAM787 host target gene. LOC157931 BINDING SITE is HOST TARGET binding site found in the 3' untranslated region of mRNA encoded by LOC157931, corresponding to a HOST TARGET binding site such as BINDING SITE I, BINDING SITE II or BINDING SITE III. Table 2 illustrates the complementarity of the nucleotide sequences of LOC157931 BINDING SITE, designated SEQ ID:41904, to the nucleotide sequence of VGAM787 RNA, herein designated VGAM RNA, also designated SEQ ID:3498.

Another function of VGAM787 is therefore inhibition of LOC157931 (Accession XM_098845). Accordingly, utilities of VGAM787 include diagnosis, prevention and treatment of diseases and clinical conditions associated with LOC157931.

FIG. 1 further provides a conceptual description of a novel bioinformatically detected viral gene of the present invention, referred to here as Viral Genomic Address Messenger 788 (VGAM788) viral gene, which modulates expression of respective host target genes thereof, the function and utility of which host target genes is known in the art.

VGAM788 is a novel bioinformatically detected regulatory, non protein coding, viral micro RNA (miRNA) gene. The method by which VGAM788 was detected is described hereinabove with reference to FIGS. 1-8.

VGAM788 gene, herein designated VGAM GENE, is a viral gene contained in the genome of Zucchini Yellow Mosaic Virus. VGAM788 host target gene, herein designated VGAM HOST TARGET GENE, is a human gene contained in the human genome.

VGAM788 gene encodes a VGAM788 precursor RNA, herein designated VGAM PRECURSOR RNA. Similar to other miRNA genes, and unlike most ordinary genes, VGAM788 precursor RNA does not encode a protein. A nucleotide sequence identical or highly similar to the nucleotide sequence of VGAM788 precursor RNA is designated SEQ ID:774, and is provided hereinbelow with reference to the sequence listing part. Nucleotide sequence SEQ ID:774 is located at position 2523 relative to the genome of Zucchini Yellow Mosaic Virus.

VGAM788 precursor RNA folds onto itself, forming VGAM788 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM788 folded precursor RNA into VGAM788 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM788 RNA is designated SEQ ID:3499, and is provided hereinbelow with reference to the sequence listing part.

VGAM788 host target gene, herein designated VGAM HOST TARGET GENE, encodes a corresponding messenger RNA, VGAM788 host target RNA, herein designated VGAM HOST TARGET RNA. VGAM788 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM788 RNA, herein designated VGAM RNA, binds complementarily to one or more host target binding sites located in untranslated regions of VGAM788 host target RNA, herein designated VGAM HOST TARGET RNA. This complementary binding is due to the fact that the nucleotide sequence of VGAM788 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM788 RNA, herein designated VGAM RNA, may have a different number of host target binding sites in untranslated regions of a VGAM788 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM788 RNA, herein designated VGAM RNA, to host target binding sites on VGAM788 host target RNA, herein designated VGAM HOST TARGET RNA, such as BINDING SITE I, BINDING SITE II and BINDING SITE III, inhibits translation of VGAM788 host target RNA into VGAM788 host target protein, herein designated VGAM HOST TARGET PROTEIN. VGAM host target protein is therefore outlined by a broken line.

It is appreciated that VGAM788 host target gene, herein designated VGAM HOST TARGET GENE, in fact represents a plurality of VGAM788 host target genes. The mRNA of each one of this plurality of VGAM788 host target genes comprises one or more host target binding sites, each having a nucleotide sequence which is at least partly complementary to VGAM788 RNA, herein designated VGAM RNA, and which when bound by VGAM788 RNA causes inhibition of translation of respective one or more VGAM788 host target proteins.

It is further appreciated by one skilled in the art that the mode of translational inhibition illustrated by FIG. 1 with specific reference to translational inhibition exerted by VGAM788 gene, herein designated VGAM GENE, on one or more VGAM788 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM788 is inhibition of expression of host target genes, as part of a novel viral mechanism of attacking a host. Accordingly, utilities of VGAM788 include diagnosis, prevention and treatment of viral infection by Zucchini Yellow Mosaic Virus. Specific functions, and accordingly utilities, of VGAM788 correlate with, and may be deduced from, the identity of the host target genes which VGAM788 binds and inhibits, and the function of these host target genes, as elaborated hereinbelow.

Nucleotide sequences of the VGAM788 precursor RNA, herein designated VGAM PRECURSOR RNA, and of the 'diced' VGAM788 RNA, herein designated VGAM RNA, and a schematic representation of the secondary folding of VGAM788 folded precursor RNA, herein designated VGAM FOLDED PRECURSOR RNA, of VGAM788 are further described hereinbelow with reference to Table 1.

Nucleotide sequences of host target binding sites, such as BINDING SITE-I, BINDING SITE-II and BINDING SITE-III of FIG. 1, found on VGAM788 host target RNA, and schematic representation of the complementarity of each of these host target binding sites to VGAM788 RNA, herein designated VGAM RNA, are described hereinbelow with reference to Table 2.

As mentioned hereinabove with reference to FIG. 1, a function of VGAM788 gene, herein designated VGAM is inhibition of expression of VGAM788 target genes. It is appreciated that specific functions, and accordingly utilities, of VGAM788 correlate with, and may be deduced from, the identity of the target genes which VGAM788 binds and inhibits, and the function of these target genes, as elaborated hereinbelow.

FLJ10178 (Accession NM_018015) is a VGAM788 host target gene. FLJ10178 BINDING SITE is HOST TARGET binding site found in the 3' untranslated region of mRNA encoded by FLJ10178, corresponding to a HOST TARGET binding site such as BINDING SITE I, BINDING SITE II or BINDING SITE III. Table 2 illustrates the complementarity of the nucleotide sequences of FLJ10178 BINDING SITE, designated SEQ ID:19753, to the nucleotide sequence of VGAM788 RNA, herein designated VGAM RNA, also designated SEQ ID:3499.

A function of VGAM788 is therefore inhibition of FLJ10178 (Accession NM_018015). Accordingly, utilities of VGAM788 include diagnosis, prevention and treatment of diseases and clinical conditions associated with FLJ10178. FLJ12681 (Accession NM_022773) is another VGAM788 host target gene. FLJ12681 BINDING SITE is HOST TARGET binding site found in the 3' untranslated region of mRNA encoded by FLJ12681, corresponding to a HOST TARGET binding site such as BINDING SITE I, BINDING SITE II or BINDING SITE III. Table 2 illustrates the complementarity of the nucleotide sequences of FLJ12681 BINDING SITE, designated SEQ ID:23036, to the nucleotide sequence of VGAM788 RNA, herein designated VGAM RNA, also designated SEQ ID:3499.

Another function of VGAM788 is therefore inhibition of FLJ12681 (Accession NM_022773). Accordingly, utilities of VGAM788 include diagnosis, prevention and treatment of diseases and clinical conditions associated with FLJ12681. FLJ32865 (Accession NM_144613) is another VGAM788 host target gene. FLJ32865 BINDING SITE is HOST TARGET binding site found in the 3' untranslated region of mRNA encoded by FLJ32865, corresponding to a HOST TARGET binding site such as BINDING SITE I, BINDING SITE II or BINDING SITE III. Table 2 illustrates the complementarity of the nucleotide sequences of FLJ32865 BINDING SITE, designated SEQ ID:29430, to the nucleotide sequence of VGAM788 RNA, herein designated VGAM RNA, also designated SEQ ID:3499.

Another function of VGAM788 is therefore inhibition of FLJ32865 (Accession NM_144613). Accordingly, utilities of VGAM788 include diagnosis, prevention and treatment of diseases and clinical conditions associated with FLJ32865.

FIG. 1 further provides a conceptual description of a novel bioinformatically detected viral gene of the present invention, referred to here as Viral Genomic Address Messenger 789 (VGAM789) viral gene, which modulates expression of respective host target genes thereof, the function and utility of which host target genes is known in the art.

VGAM789 is a novel bioinformatically detected regulatory, non protein coding, viral micro RNA (miRNA) gene. The method by which VGAM789 was detected is described hereinabove with reference to FIGS. 1-8.

VGAM789 gene, herein designated VGAM GENE, is a viral gene contained in the genome of Shrimp White Spot Syndrome Virus (white spot bacilliform virus). VGAM789 host target gene, herein designated VGAM HOST TARGET GENE, is a human gene contained in the human genome.

VGAM789 gene encodes a VGAM789 precursor RNA, herein designated VGAM PRECURSOR RNA. Similar to other miRNA genes, and unlike most ordinary genes, VGAM789 precursor RNA does not encode a protein. A nucleotide sequence identical or highly similar to the nucleotide sequence of VGAM789 precursor RNA is designated SEQ ID:775, and is provided hereinbelow with reference to the sequence listing part. Nucleotide sequence SEQ ID:775 is located at position 4478 relative to the genome of Shrimp White Spot Syndrome Virus (white spot bacilliform virus).

VGAM789 precursor RNA folds onto itself, forming VGAM789 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM789 folded precursor RNA into VGAM789 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM789 RNA is designated SEQ ID:3500, and is provided hereinbelow with reference to the sequence listing part.

VGAM789 host target gene, herein designated VGAM HOST TARGET GENE, encodes a corresponding messenger RNA, VGAM789 host target RNA, herein designated VGAM HOST TARGET RNA. VGAM789 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM789 RNA, herein designated VGAM RNA, binds complementarily to one or more host target binding sites located in untranslated regions of VGAM789 host target RNA, herein designated VGAM HOST TARGET RNA. This complementary binding is due to the fact that the nucleotide sequence of VGAM789 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM789 RNA, herein designated VGAM RNA, may have a different number of host target binding sites in untranslated regions of a VGAM789 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM789 RNA, herein designated VGAM RNA, to host target binding sites on VGAM789 host target RNA, herein designated VGAM HOST TARGET RNA, such as BINDING SITE I, BINDING SITE II and BINDING SITE III, inhibits translation of VGAM789 host target RNA into VGAM789 host target protein, herein designated VGAM HOST TARGET PROTEIN. VGAM host target protein is therefore outlined by a broken line.

It is appreciated that VGAM789 host target gene, herein designated VGAM HOST TARGET GENE, in fact represents a plurality of VGAM789 host target genes. The mRNA of each one of this plurality of VGAM789 host target genes comprises one or more host target binding sites, each having a nucleotide sequence which is at least partly complementary to VGAM789 RNA, herein designated VGAM RNA, and which when bound by VGAM789 RNA causes inhibition of translation of respective one or more VGAM789 host target proteins.

It is further appreciated by one skilled in the art that the mode of translational inhibition illustrated by FIG. 1 with specific reference to translational inhibition exerted by VGAM789 gene, herein designated VGAM GENE, on one or more VGAM789 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM789 is inhibition of expression of host target genes, as part of a novel viral mechanism of attacking a host. Accordingly, utilities of VGAM789 include diagnosis, prevention and treatment of viral infection by Shrimp White Spot Syndrome Virus (white spot bacilliform virus). Specific functions, and accordingly utilities, of VGAM789 correlate with, and may be deduced from, the identity of the host target genes which VGAM789 binds and inhibits, and the function of these host target genes, as elaborated hereinbelow.

Nucleotide sequences of the VGAM789 precursor RNA, herein designated VGAM PRECURSOR RNA, and of the 'diced' VGAM789 RNA, herein designated VGAM RNA, and a schematic representation of the secondary folding of VGAM789 folded precursor RNA, herein designated VGAM FOLDED PRECURSOR RNA, of VGAM789 are further described hereinbelow with reference to Table 1.

Nucleotide sequences of host target binding sites, such as BINDING SITE-I, BINDING SITE-II and BINDING SITE-III of FIG. 1, found on VGAM789 host target RNA, and schematic representation of the complementarity of each of these host target binding sites to VGAM789 RNA, herein designated VGAM RNA, are described hereinbelow with reference to Table 2.

As mentioned hereinabove with reference to FIG. 1, a function of VGAM789 gene, herein designated VGAM is inhibition of expression of VGAM789 target genes. It is appreciated that specific functions, and accordingly utilities, of VGAM789 correlate with, and may be deduced from, the identity of the target genes which VGAM789 binds and inhibits, and the function of these target genes, as elaborated hereinbelow.

Vesicle Amine Transport Protein 1 Homolog (T californica) (VAT1, Accession NM_006373) is a VGAM789 host target gene. VAT1 BINDING SITE is HOST TARGET binding site found in the 3' untranslated region of mRNA encoded by VAT1, corresponding to a HOST TARGET binding site such as BINDING SITE I, BINDING SITE II or BINDING SITE III. Table 2 illustrates the complementarity of the nucleotide sequences of VAT1 BINDING SITE, designated SEQ ID:13066, to the nucleotide sequence of VGAM789 RNA, herein designated VGAM RNA, also designated SEQ ID:3500.

A function of VGAM789 is therefore inhibition of Vesicle Amine Transport Protein 1 Homolog (T californica) (VAT1, Accession NM_006373), a gene which is a membrane protein of cholinergic synaptic vesicles. Accordingly, utilities of VGAM789 include diagnosis, prevention and treatment of diseases and clinical conditions associated with VAT1. The function of VAT1 and its association with various diseases and clinical conditions, has been established by previous studies, as described hereinabove with reference to VGAM212. Bladder Cancer Associated Protein (BLCAP, Accession NM_006698) is another VGAM789 host target gene. BLCAP BINDING SITE is HOST TARGET binding site found in the 3' untranslated region of mRNA encoded by BLCAP, corresponding to a HOST TARGET binding site such as BINDING SITE I, BINDING SITE II or BINDING SITE III. Table 2 illustrates the complementarity of the nucleotide sequences of BLCAP BINDING SITE, designated SEQ ID:13523, to the nucleotide sequence of VGAM789 RNA, herein designated VGAM RNA, also designated SEQ ID:3500.

Another function of VGAM789 is therefore inhibition of Bladder Cancer Associated Protein (BLCAP, Accession NM_006698). Accordingly, utilities of VGAM789 include diagnosis, prevention and treatment of diseases and clinical conditions associated with BLCAP. LOC152790 (Accession XM_098264) is another VGAM789 host target gene. LOC152790 BINDING SITE is HOST TARGET binding site found in the 5' untranslated region of mRNA encoded by LOC152790, corresponding to a HOST TARGET binding site such as BINDING SITE I, BINDING SITE II or BINDING SITE III. Table 2 illustrates the complementarity of the nucleotide sequences of LOC152790 BINDING SITE, designated SEQ ID:41554, to the nucleotide sequence of VGAM789 RNA, herein designated VGAM RNA, also designated SEQ ID:3500.

Another function of VGAM789 is therefore inhibition of LOC152790 (Accession XM_098264). Accordingly, utilities of VGAM789 include diagnosis, prevention and treatment of diseases and clinical conditions associated with LOC152790. LOC162333 (Accession XM_102591) is another VGAM789 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42121, to the nucleotide sequence of VGAM789 RNA, herein designated VGAM RNA, also designated SEQ ID:3500.

Another function of VGAM789 is therefore inhibition of LOC162333 (Accession XM_102591). Accordingly, utilities of VGAM789 include diagnosis, prevention and treatment of diseases and clinical conditions associated with LOC162333. LOC202126 (Accession XM_117362) is another VGAM789 host target gene. LOC202126 BINDING SITE is HOST TARGET binding site found in the 3' untranslated region of mRNA encoded by LOC202126, corresponding to a HOST TARGET binding site such as BINDING SITE I, BINDING SITE II or BINDING SITE III. Table 2 illustrates the complementarity of the nucleotide sequences of LOC202126 BINDING SITE, designated SEQ ID:43412, to the nucleotide sequence of VGAM789 RNA, herein designated VGAM RNA, also designated SEQ ID:3500.

Another function of VGAM789 is therefore inhibition of LOC202126 (Accession XM_117362). Accordingly, utilities of VGAM789 include diagnosis, prevention and treatment of diseases and clinical conditions associated with LOC202126. FIG. 1 further provides a conceptual description of a novel bioinformatically detected viral gene of the present invention, referred to here as Viral Genomic Address Messenger 790 (VGAM790) viral gene, which modulates expression of respective host target genes thereof, the function and utility of which host target genes is known in the art.

VGAM790 is a novel bioinformatically detected regulatory, non protein coding, viral micro RNA (miRNA) gene. The method by which VGAM790 was detected is described hereinabove with reference to FIGS. 1-8.

VGAM790 gene, herein designated VGAM GENE, is a viral gene contained in the genome of Shrimp White Spot Syndrome Virus (white spot bacilliform virus). VGAM790 host target gene, herein designated VGAM HOST TARGET GENE, is a human gene contained in the human genome.

VGAM790 gene encodes a VGAM790 precursor RNA, herein designated VGAM PRECURSOR RNA. Similar to other miRNA genes, and unlike most ordinary genes, VGAM790 precursor RNA does not encode a protein. A nucleotide sequence identical or highly similar to the nucleotide sequence of VGAM790 precursor RNA is designated SEQ ID:776, and is provided hereinbelow with reference to the sequence listing part. Nucleotide sequence SEQ ID:776 is located at position 5279 relative to the genome of Shrimp White Spot Syndrome Virus (white spot bacilliform virus).

VGAM790 precursor RNA folds onto itself, forming VGAM790 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM790 folded precursor RNA into VGAM790 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM790 RNA is designated SEQ ID:3501, and is provided hereinbelow with reference to the sequence listing part.

VGAM790 host target gene, herein designated VGAM HOST TARGET GENE, encodes a corresponding messenger RNA, VGAM790 host target RNA, herein designated VGAM HOST TARGET RNA. VGAM790 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM790 RNA, herein designated VGAM RNA, binds complementarily to one or more host target binding sites located in untranslated regions of VGAM790 host target RNA, herein designated VGAM HOST TARGET RNA. This complementary binding is due to the fact that the nucleotide sequence of VGAM790 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM790 RNA, herein designated VGAM RNA, may have a different number of host target binding sites in untranslated regions of a VGAM790 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM790 RNA, herein designated VGAM RNA, to host target binding sites on VGAM790 host target RNA, herein designated VGAM HOST TARGET RNA, such as BINDING SITE I, BINDING SITE II and BINDING SITE III, inhibits translation of VGAM790 host target RNA into VGAM790 host target protein, herein designated VGAM HOST TARGET PROTEIN. VGAM host target protein is therefore outlined by a broken line.

It is appreciated that VGAM790 host target gene, herein designated VGAM HOST TARGET GENE, in fact represents a plurality of VGAM790 host target genes. The mRNA of each one of this plurality of VGAM790 host target genes comprises one or more host target binding sites, each having a nucleotide sequence which is at least partly complementary to VGAM790 RNA, herein designated VGAM RNA, and which when bound by VGAM790 RNA causes inhibition of translation of respective one or more VGAM790 host target proteins.

It is further appreciated by one skilled in the art that the mode of translational inhibition illustrated by FIG. 1 with specific reference to translational inhibition exerted by VGAM790 gene, herein designated VGAM GENE, on one or more VGAM790 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM790 is inhibition of expression of host target genes, as part of a novel viral mechanism of attacking a host. Accordingly, utilities of VGAM790 include diagnosis, prevention and treatment of viral infection by Shrimp White Spot Syndrome Virus (white spot bacilliform virus). Specific functions, and accordingly utilities, of VGAM790 correlate with, and may be deduced from, the identity of the host target genes which VGAM790 binds and inhibits, and the function of these host target genes, as elaborated hereinbelow.

Nucleotide sequences of the VGAM790 precursor RNA, herein designated VGAM PRECURSOR RNA, and of the 'diced' VGAM790 RNA, herein designated VGAM RNA, and a schematic representation of the secondary folding of VGAM790 folded precursor RNA, herein designated VGAM FOLDED PRECURSOR RNA, of VGAM790 are further described hereinbelow with reference to Table 1.

Nucleotide sequences of host target binding sites, such as BINDING SITE-I, BINDING SITE-II and BINDING SITE-III of FIG. 1, found on VGAM790 host target RNA, and schematic representation of the complementarity of each of these host target binding sites to VGAM790 RNA, herein designated VGAM RNA, are described hereinbelow with reference to Table 2.

As mentioned hereinabove with reference to FIG. 1, a function of VGAM790 gene, herein designated VGAM is inhibition of expression of VGAM790 target genes. It is appreciated that specific functions, and accordingly utilities, of VGAM790 correlate with, and may be deduced from, the identity of the target genes which VGAM790 binds and inhibits, and the function of these target genes, as elaborated hereinbelow.

KIAA0635 (Accession NM_014645) is a VGAM790 host target gene. KIAA0635 BINDING SITE is HOST TARGET binding site found in the 3' untranslated region of mRNA encoded by KIAA0635, corresponding to a HOST TARGET binding site such as BINDING SITE I, BINDING SITE II or BINDING SITE III. Table 2 illustrates the complementarity of the nucleotide sequences of KIAA0635 BINDING SITE, designated SEQ ID:16056, to the nucleotide sequence of VGAM790 RNA, herein designated VGAM RNA, also designated SEQ ID:3501.

A function of VGAM790 is therefore inhibition of KIAA0635 (Accession NM_014645). Accordingly, utilities of VGAM790 include diagnosis, prevention and treatment of diseases and clinical conditions associated with KIAA0635. LOC150142 (Accession XM_086791) is another VGAM790 host target gene. LOC150142 BINDING SITE is HOST TARGET binding site found in the 5' untranslated region of mRNA encoded by LOC150142, corresponding to a HOST TARGET binding site such as BINDING SITE I, BINDING SITE II or BINDING SITE III. Table 2 illustrates the complementarity of the nucleotide sequences of LOC150142 BINDING SITE, designated SEQ ID:38850, to the nucleotide sequence of VGAM790 RNA, herein designated VGAM RNA, also designated SEQ ID:3501.

Another function of VGAM790 is therefore inhibition of LOC150142 (Accession XM_086791). Accordingly, utilities of VGAM790 include diagnosis, prevention and treatment of diseases and clinical conditions associated with LOC150142. LOC158187 (Accession XM_098892) is another VGAM790 host target gene. LOC158187 BINDING SITE is HOST TARGET binding site found in the 3' untranslated region of mRNA encoded by LOC158187, corresponding to a HOST TARGET binding site such as BINDING SITE I, BINDING SITE II or BINDING SITE III. Table 2 illustrates the complementarity of the nucleotide sequences of LOC158187 BINDING SITE, designated SEQ ID:41922, to the nucleotide sequence of VGAM790 RNA, herein designated VGAM RNA, also designated SEQ ID:3501.

Another function of VGAM790 is therefore inhibition of LOC158187 (Accession XM_098892). Accordingly, utilities of VGAM790 include diagnosis, prevention and treatment of diseases and clinical conditions associated with LOC158187. FIG. 1 further provides a conceptual description of a novel bioinformatically detected viral gene of the present invention, referred to here as Viral Genomic Address Messenger 791 (VGAM791) viral gene, which modulates expression of respective host target genes thereof, the function and utility of which host target genes is known in the art.

VGAM791 is a novel bioinformatically detected regulatory, non protein coding, viral micro RNA (miRNA) gene. The method by which VGAM791 was detected is described hereinabove with reference to FIGS. 1-8.

VGAM791 gene, herein designated VGAM GENE, is a viral gene contained in the genome of Shrimp White Spot Syndrome Virus (white spot bacilliform virus). VGAM791 host target gene, herein designated VGAM HOST TARGET GENE, is a human gene contained in the human genome.

VGAM791 gene encodes a VGAM791 precursor RNA, herein designated VGAM PRECURSOR RNA. Similar to other miRNA genes, and unlike most ordinary genes, VGAM791 precursor RNA does not encode a protein. A nucleotide sequence identical or highly similar to the nucleotide sequence of VGAM791 precursor RNA is designated SEQ ID:777, and is provided hereinbelow with reference to the sequence listing part. Nucleotide sequence SEQ ID:777 is located at position 6245 relative to the genome of Shrimp White Spot Syndrome Virus (white spot bacilliform virus).

VGAM791 precursor RNA folds onto itself, forming VGAM791 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM791 folded precursor RNA into VGAM791 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM791 RNA is designated SEQ ID:3502, and is provided hereinbelow with reference to the sequence listing part.

VGAM791 host target gene, herein designated VGAM HOST TARGET GENE, encodes a corresponding messenger RNA, VGAM791 host target RNA, herein designated VGAM HOST TARGET RNA. VGAM791 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM791 RNA, herein designated VGAM RNA, binds complementarily to one or more host target binding sites located in untranslated regions of VGAM791 host target RNA, herein designated VGAM HOST TARGET RNA. This complementary binding is due to the fact that the nucleotide sequence of VGAM791 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM791 RNA, herein designated VGAM RNA, may have a different number of host target binding sites in untranslated regions of a VGAM791 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM791 RNA, herein designated VGAM RNA, to host target binding sites on VGAM791 host target RNA, herein designated VGAM HOST TARGET RNA, such as BINDING SITE I, BINDING SITE II and BINDING SITE III, inhibits translation of VGAM791 host target RNA into VGAM791 host target protein, herein designated VGAM HOST TARGET PROTEIN. VGAM host target protein is therefore outlined by a broken line.

It is appreciated that VGAM791 host target gene, herein designated VGAM HOST TARGET GENE, in fact represents a plurality of VGAM791 host target genes. The mRNA of each one of this plurality of VGAM791 host target genes comprises one or more host target binding sites, each having a nucleotide sequence which is at least partly complementary to VGAM791 RNA, herein designated VGAM RNA, and which when bound by VGAM791 RNA causes inhibition of translation of respective one or more VGAM791 host target proteins.

It is further appreciated by one skilled in the art that the mode of translational inhibition illustrated by FIG. 1 with specific reference to translational inhibition exerted by VGAM791 gene, herein designated VGAM GENE, on one or more VGAM791 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM791 is inhibition of expression of host target genes, as part of a novel viral mechanism of attacking a host. Accordingly, utilities of VGAM791 include diagnosis, prevention and treatment of viral infection by Shrimp White Spot Syndrome Virus (white spot bacilliform virus). Specific functions, and accordingly utilities, of VGAM791 correlate with, and may be deduced from, the identity of the host target genes which VGAM791 binds and inhibits, and the function of these host target genes, as elaborated hereinbelow.

Nucleotide sequences of the VGAM791 precursor RNA, herein designated VGAM PRECURSOR RNA, and of the 'diced' VGAM791 RNA, herein designated VGAM RNA, and a schematic representation of the secondary folding of VGAM791 folded precursor RNA, herein designated VGAM FOLDED PRECURSOR RNA, of VGAM791 are further described hereinbelow with reference to Table 1.

Nucleotide sequences of host target binding sites, such as BINDING SITE-I, BINDING SITE-II and BINDING SITE-III of FIG. 1, found on VGAM791 host target RNA, and schematic representation of the complementarity of each of these host target binding sites to VGAM791 RNA, herein designated VGAM RNA, are described hereinbelow with reference to Table 2.

As mentioned hereinabove with reference to FIG. 1, a function of VGAM791 gene, herein designated VGAM is inhibition of expression of VGAM791 target genes. It is appreciated that specific functions, and accordingly utilities, of VGAM791 correlate with, and may be deduced from, the identity of the target genes which VGAM791 binds and inhibits, and the function of these target genes, as elaborated hereinbelow.

S-adenosylhomocysteine Hydrolase (AHCY, Accession NM_000687) is a VGAM791 host target gene. AHCY BINDING SITE is HOST TARGET binding site found in the 3' untranslated region of mRNA encoded by AHCY, corresponding to a HOST TARGET binding site such as BINDING SITE I, BINDING SITE II or BINDING SITE III. Table 2 illustrates the complementarity of the nucleotide sequences of AHCY BINDING SITE, designated SEQ ID:6345, to the nucleotide sequence of VGAM791 RNA, herein designated VGAM RNA, also designated SEQ ID:3502.

A function of VGAM791 is therefore inhibition of S-adenosylhomocysteine Hydrolase (AHCY, Accession NM_000687). Accordingly, utilities of VGAM791 include diagnosis, prevention and treatment of diseases and clinical conditions associated with AHCY. Core-binding Factor, Runt Domain, Alpha Subunit 2; Translocated To, 2 (CBFA2T2, Accession NM_005093) is another VGAM791 host target gene. CBFA2T2 BINDING SITE is HOST TARGET binding site found in the 3' untranslated region of mRNA encoded by CBFA2T2, corresponding to a HOST TARGET binding site such as BINDING SITE I, BINDING SITE II or BINDING SITE III. Table 2 illustrates the complementarity of the nucleotide sequences of CBFA2T2 BINDING SITE, designated SEQ ID:11554, to the nucleotide sequence of VGAM791 RNA, herein designated VGAM RNA, also designated SEQ ID:3502.

Another function of VGAM791 is therefore inhibition of Core-binding Factor, Runt Domain, Alpha Subunit 2; Translocated To, 2 (CBFA2T2, Accession NM_005093), a gene which is a putative transcription factor. Accordingly, utilities of VGAM791 include diagnosis, prevention and treatment of diseases and clinical conditions associated with CBFA2T2. The function of CBFA2T2 and its association with various diseases and clinical conditions, has been established by previous studies, as described hereinabove with reference to VGAM152. Cystathionine-beta-synthase (CBS, Accession NM_000071) is another VGAM791 host target gene. CBS BINDING SITE is HOST TARGET binding site found in the 3' untranslated region of mRNA encoded by CBS, corresponding to a HOST TARGET binding site such as BINDING SITE I, BINDING SITE II or BINDING SITE III. Table 2 illustrates the complementarity of the nucleotide sequences of CBS BINDING SITE, designated SEQ ID:5516, to the nucleotide sequence of VGAM791 RNA, herein designated VGAM RNA, also designated SEQ ID:3502.

Another function of VGAM791 is therefore inhibition of Cystathionine-beta-synthase (CBS, Accession NM_000071). Accordingly, utilities of VGAM791 include diagnosis, prevention and treatment of diseases and clinical conditions associated with CBS. Ets Variant Gene 3 (ETV3, Accession NM_005240) is another VGAM791 host target gene. ETV3 BINDING SITE is HOST TARGET binding site found in the 3' untranslated region of mRNA encoded by ETV3, corresponding to a HOST TARGET binding site such as BINDING SITE I, BINDING SITE II or BINDING SITE III. Table 2 illustrates the complementarity of the nucleotide sequences of ETV3 BINDING SITE, designated SEQ ID:11751, to the nucleotide sequence of VGAM791 RNA, herein designated VGAM RNA, also designated SEQ ID:3502.

Another function of VGAM791 is therefore inhibition of Ets Variant Gene 3 (ETV3, Accession NM_005240), a gene which Member of the ETS oncoprotein family. Accordingly, utilities of VGAM791 include diagnosis, prevention and treatment of diseases and clinical conditions associated with ETV3. The function of ETV3 has been established by previous studies. The ETS oncogene (OMIM Ref. No. 164720) was first described as part of a fusion gene transduced by the avian retrovirus E26. In E26, v-ets and v-myb (OMIM Ref. No. 189990) were fused to a portion of GAG to form the transforming gene. The ETS oncogene family shares a conserved peptide motif called the ETS domain that mediates sequence-specific DNA binding. This motif is unique among transcription factor families. Using partially degenerate oligonucleotides from conserved regions of the ETS domain and the polymerase chain reaction, Klemsz et al. (1994) isolated a new member of the ETS family, designated PE1, from HL60 cells. The PE1 gene was expressed as an approximately 5-kb transcript in most cell lines tested. Klappacher et al. (2002) described a mechanism in which induction of the ETS repressor METS links terminal differentiation to cell cycle arrest. Using macrophages as a model, they provided evidence that METS blocks RAS (OMIM Ref. No. 190020)-dependent proliferation without inhibiting RAS-dependent expression of cell type-specific genes by selectively replacing ETS activators on the promoters of cell cycle control genes. The antiproliferative effects of METS required its interaction with DP103 (DDX20; 606168), a DEAD box-containing protein that assembles a novel corepressor complex. Functional interactions between the METS/DP103 complex and E2F (see OMIM Ref. No. 189971)/RB (see OMIM Ref. No. 180200) family proteins were also necessary for inhibition of cellular proliferation, suggesting a combinatorial code that directs permanent cell cycle exit during terminal differentiation. Using both in situ hybridization and study of human/hamster cell hybrids, Klemsz et al. (1994) demonstrated that the PE1 gene is located on 1q21-q23.

Full details of the abovementioned studies are described in the following publications, the disclosure of which are hereby incorporated by reference:

Klappacher, G. W.; Lunyak, V. V.; Sykes, D. B.; Sawka-Verhelle, D.; Sage, J.; Brard, G.; Ngo, S. D.; Gangadharan, D.; Jacks, T.; Kamps, M. P.; Rose, D. W.; Rosenfeld, M. G.: An induced Ets repressor complex regulates growth arrest during terminal macrophage differentiation. Cell 109:169-180, 2002; and Klemsz, M.; Hromas, R.; Raskind, W.; Bruno, E.; Hoffman, R.: PE-1, a novel ETS oncogene family member, localizes to chromosome 1q21-q23. Genomics 20:291-294, 1994.

Further studies establishing the function and utilities of ETV3 are found in John Hopkins OMIM database record ID 164873, and in sited publications numbered 3141-3142 listed in the bibliography section hereinbelow, which are also hereby incorporated by reference. Follistatin-like 1 (FSTL1, Accession NM_007085) is another VGAM791 host target gene. FSTL1 BINDING SITE is HOST TARGET binding site found in the 3' untranslated region of mRNA encoded by FSTL1, corresponding to a HOST TARGET binding site such as BINDING SITE I, BINDING SITE II or BINDING SITE III. Table 2 illustrates the complementarity of the nucleotide sequences of FSTL1 BINDING SITE, designated SEQ ID:13950, to the nucleotide sequence of VGAM791 RNA, herein designated VGAM RNA, also designated SEQ ID:3502.

Another function of VGAM791 is therefore inhibition of Follistatin-like 1 (FSTL1, Accession NM_007085), a gene which may modulate the action of some growth factors on cell proliferation and differentiation. Accordingly, utilities of VGAM791 include diagnosis, prevention and treatment of diseases and clinical conditions associated with FSTL1. The function of FSTL1 has been established by previous studies. Using degenerate primers designed against a peptide purified from a rat glioma cell line, Zwijsen et al. (1994) isolated a full-length follistatin-like cDNA (FSTL1), which they called FRP, from a human glioma cDNA library. FSTL1 encodes a deduced 308-amino acid protein with an N-terminal signal peptide of 20 amino acids. FSTL1 contains an FS module, a follistatin-like sequence containing 10 conserved cysteine residues. The number and distribution of the cysteine residues supports the existence of several intramolecular disulfide bridges. Zwijsen et al. (1994) did not detect any membrane-spanning or membrane-associated sequences in the FSTL1 sequence, but they predicted 3 putative N-glycosylation sites and several phosphorylation sites. Under denaturing conditions, Zwijsen et al. (1994) detected several isoforms of FSTL1 with molecular masses of 40 to 48 kD which differs from the 50- to 55-kD products detected by Tanaka et al. (1998). Tanaka et al. (1998) hypothesized that the difference results from the molecular conditions affected by posttranslational modification. FSTL1 shares greater than 92% amino acid identity with the mouse homolog, known as Fstl or TSC-36, identified as a transforming growth factor-beta-inducible protein by Shibanuma et al. (1993). Zwijsen et al. (1994) also noted sequence similarity to follistatin (OMIM Ref. No. 136470) and agrin (OMIM Ref. No. 103320), and could not detect any effect of FSTL1 on the cell growth inhibition of TGF-beta (OMIM Ref. No. 190180). Using Northern blot analysis, Tanaka et al. (1998) detected a broadly expressed 4.4-kb FSTL1 transcript most strongly in the heart, placenta, prostate, ovary, and small intestine. Expression was not detected in peripheral blood leukocytes. Tanaka et al. (1998) constructed synovium expression cDNA libraries made from rheumatoid arthritis (RA; 180300) patient-derived synovial cell mRNA. By screening the libraries by IgG purified from synovial fluids from RA patients, they identified FSTL1. Using immunoblotting analysis, they detected anti-FSTL1 antibodies as more frequent in the synovial fluids and serum of RA patients than in patients with other systemic rheumatic diseases or in healthy individuals. patients. Immunoprecipitation analysis showed no difference between these groups in the amount of synovial FSTL1 protein, suggesting an elevated turnover in RA.

Full details of the abovementioned studies are described in the following publications, the disclosure of which are hereby incorporated by reference:

Tanaka, M.; Ozaki, S.; Osakada, F.; Mori, K.; Okubo, M.; Nakao, K.: Cloning of follistatin-related protein as a novel autoantigen in systemic rheumatic diseases. Int. Immun. 10:1305-1314, 1998; and Zwijsen, A.; Blockx, H.; van Arnhem, W.; Willems, J.; Fransen, L.; Devos, K.; Raymackers, J.; van de Voorde, A.; Slegers, H.: Characterization of a rat C6 glioma-secreted follistatin-r.

Further studies establishing the function and utilities of FSTL1 are found in John Hopkins OMIM database record ID 605547, and in sited publications numbered 6399-6401 listed in the bibliography section hereinbelow, which are also hereby incorporated by reference. GA (Accession NM_013267) is another VGAM791 host target gene. GA BINDING SITE is HOST TARGET binding site found in the 5' untranslated region of mRNA encoded by GA, corresponding to a HOST TARGET binding site such as BINDING SITE I, BINDING SITE II or BINDING SITE III. Table 2 illustrates the complementarity of the nucleotide sequences of GA BINDING SITE, designated SEQ ID:14935, to the nucleotide sequence of VGAM791 RNA, herein designated VGAM RNA, also designated SEQ ID:3502.

Another function of VGAM791 is therefore inhibition of GA (Accession NM_013267). Accordingly, utilities of VGAM791 include diagnosis, prevention and treatment of diseases and clinical conditions associated with GA. Maltase-glucoamylase (alpha-glucosidase) (MGAM, Accession XM_051351) is another VGAM791 host target gene. MGAM BINDING SITE is HOST TARGET binding site found in the 3' untranslated region of mRNA encoded by MGAM, corresponding to a HOST TARGET binding site such as BINDING SITE I, BINDING SITE II or BINDING SITE III. Table 2 illustrates the complementarity of the nucleotide sequences of MGAM BINDING SITE, designated SEQ ID:35821, to the nucleotide sequence of VGAM791 RNA, herein designated VGAM RNA, also designated SEQ ID:3502.

Another function of VGAM791 is therefore inhibition of Maltase-glucoamylase (alpha-glucosidase) (MGAM, Accession XM_051351), a gene which plays a role in the final steps of digestion of starch. Accordingly, utilities of VGAM791 include diagnosis, prevention and treatment of diseases and clinical conditions associated with MGAM. The function of MGAM has been established by previous studies. Maltase-glucoamylase (MGA; EC 3.2.1.20) is a brush border membrane enzyme that plays a role in the final steps of digestion of starch. Naim et al. (1988) showed that it is synthesized as a single-chain polypeptide precursor, acquires N- and O-linked carbohydrates, and does not undergo intracellular or extracellular proteolytic cleavage. Nichols et al. (1998) purified and partially sequenced the human maltase-glucoamylase protein. By RT-PCR using degenerate oligonucleotides based on the MGA protein sequence, they isolated human small intestine MGA cDNAs. The deduced 1,857-amino acid MGA protein has a putative type II membrane anchor, 2 WIDMNE catalytic sites, which are characteristic of carbohydrate hydrolases such as sucrase-isomaltase (SI; 222900), and 2 glycosyl hydrolase family 31 signature 2 sequences. MGA also has 19 potential N-glycosylation sites and 253 potential O-glycosylation sites. The MGA protein shares 59% sequence identity with SI. RT-PCR detected MGA expression in human small intestine, granulocyte, and kidney but not in salivary gland or pancreas.

Full details of the abovementioned studies are described in the following publications, the disclosure of which are hereby incorporated by reference:

Naim, H. Y.; Sterchi, E. E.; Lentze, M. J.: Structure, biosynthesis, and glycosylation of human small intestinal maltase-glucoamylase. J. Biol. Chem. 263:19709-19717, 1988; and Nichols, B. L.; Eldering, J.; Avery, S.; Hahn, D.; Quaroni, A.; Sterchi, E.: Human small intestinal maltase-glucoamylase cDNA cloning: homology to sucrase-isomaltase. J. Biol. Chem. 273:3.

Further studies establishing the function and utilities of MGAM are found in John Hopkins OMIM database record ID 154360, and in sited publications numbered 12706-12708 listed in the bibliography section hereinbelow, which are also hereby incorporated by reference. SH3-domain GRB2-like 1 (SH3GL1, Accession NM_003025) is another VGAM791 host target gene. SH3GL1 BINDING SITE is HOST TARGET binding site found in the 3' untranslated region of mRNA encoded by SH3GL1, corresponding to a HOST TARGET binding site such as BINDING SITE I, BINDING SITE II or BINDING SITE III. Table 2 illustrates the complementarity of the nucleotide sequences of SH3GL1 BINDING SITE, designated SEQ ID:8960, to the nucleotide sequence of VGAM791 RNA, herein designated VGAM RNA, also designated SEQ ID:3502.

Another function of VGAM791 is therefore inhibition of SH3-domain GRB2-like 1 (SH3GL1, Accession NM_003025). Accordingly, utilities of VGAM791 include diagnosis, prevention and treatment of diseases and clinical conditions associated with SH3GL1. Sorbin and SH3 Domain Containing 1 (SORBS1, Accession NM_015385) is another VGAM791 host target gene. SORBS1 BINDING SITE is HOST TARGET binding site found in the 3' untranslated region of mRNA encoded by SORBS1, corresponding to a HOST TARGET binding site such as BINDING SITE I, BINDING SITE II or BINDING SITE III. Table 2 illustrates the complementarity of the nucleotide sequences of SORBS1 BINDING SITE, designated SEQ ID:17691, to the nucleotide sequence of VGAM791 RNA, herein designated VGAM RNA, also designated SEQ ID:3502.

Another function of VGAM791 is therefore inhibition of Sorbin and SH3 Domain Containing 1 (SORBS1, Accession NM_015385), a gene which necessary for cell polarization during vegetative growth. Accordingly, utilities of VGAM791 include diagnosis, prevention and treatment of diseases and clinical conditions associated with SORBS1. The function of SORBS1 and its association with various diseases and clinical conditions, has been established by previous studies, as described hereinabove with reference to VGAM475. Tropomodulin 2 (neuronal) (TMOD2, Accession NM_014548) is another VGAM791 host target gene. TMOD2 BINDING SITE is HOST TARGET binding site found in the 3' untranslated region of mRNA encoded by TMOD2, corresponding to a HOST TARGET binding site such as BINDING SITE I, BINDING SITE II or BINDING SITE III. Table 2 illustrates the complementarity of the nucleotide sequences of TMOD2 BINDING SITE, designated SEQ ID:15862, to the nucleotide sequence of VGAM791 RNA, herein designated VGAM RNA, also designated SEQ ID:3502.

Another function of VGAM791 is therefore inhibition of Tropomodulin 2 (neuronal) (TMOD2, Accession NM_014548), a gene which is an actin-capping protein for the slow-growing end of filamentous actin. Accordingly, utilities of VGAM791 include diagnosis, prevention and treatment of diseases and clinical conditions associated with TMOD2. The function of TMOD2 has been established by previous studies. Watakabe et al. (1996) identified and purified rat NTMOD as a protein that binds to the neuron-specific tropomyosin isoform, Tmbr3. Using degenerate oligonucleotides based on peptide sequences of NTMOD, they cloned an NTMOD cDNA from a rat brain cDNA library. Northern blot and RNase protection analyses detected NTMOD mRNA expression predominantly in brain. Immunofluorescence of primary frontal cortex cell cultures showed that NTMOD is specifically expressed in neurons. By screening a human cerebellar cDNA library with a portion of the rat NTMOD as probe, Cox and Zoghbi (2000) cloned a human NTMOD cDNA, designated TMOD2. TMOD2 encodes a deduced 351-amino acid protein. Northern blot analysis demonstrated restricted expression of TMOD2 in neuronal tissues; an approximately 9.5-kb transcript was seen in all brain regions. Cox and Zoghbi (2000) also cloned the mouse ortholog. Northern blot analysis showed that expression of mouse Tmod2 occurred as early as embryonic day 7 and progressively increased during development.

Full details of the abovementioned studies are described in the following publications, the disclosure of which are hereby incorporated by reference:

Watakabe, A.; Kobayashi, R.; Helfman, D. M.: N-tropomodulin: a novel isoform of tropomodulin identified as the major binding protein to brain tropomyosin. J. Cell Sci. 109: 2299-2310, 1996; and Cox, P. R.; Zoghbi, H. Y.: Sequencing, expression analysis, and mapping of three unique human tropomodulin genes and their mouse orthologs. Genomics 63:97-107, 2000.

Further studies establishing the function and utilities of TMOD2 are found in John Hopkins OMIM database record ID 602928, and in sited publications numbered 7751-7752 listed in the bibliography section hereinbelow, which are also hereby incorporated by reference. Tumor Necrosis Factor Receptor Superfamily, Member 8 (TNFRSF8, Accession NM_001243) is another VGAM791 host target gene. TNFRSF8 BINDING SITE is HOST TARGET binding site found in the 3' untranslated region of mRNA encoded by TNFRSF8, corresponding to a HOST TARGET binding site such as BINDING SITE I, BINDING SITE II or BINDING SITE III. Table 2 illustrates the complementarity of the nucleotide sequences of TNFRSF8 BINDING SITE, designated SEQ ID:6912, to the nucleotide sequence of VGAM791 RNA, herein designated VGAM RNA, also designated SEQ ID:3502.

Another function of VGAM791 is therefore inhibition of Tumor Necrosis Factor Receptor Superfamily, Member 8 (TNFRSF8, Accession NM_001243), a gene which regulates gene expression through activation of nf-kappab. Accordingly, utilities of VGAM791 include diagnosis, prevention and treatment of diseases and clinical conditions associated with TNFRSF8. The function of TNFRSF8 and its association with various diseases and clinical conditions, has been established by previous studies, as described hereinabove with reference to VGAM154. ATP-binding Cassette, Sub-family A (ABC1), Member 5 (ABCA5, Accession NM_018672) is another VGAM791 host target gene. ABCA5 BINDING SITE is HOST TARGET binding site found in the 5' untranslated region of mRNA encoded by ABCA5, corresponding to a HOST TARGET binding site such as BINDING SITE I, BINDING SITE II or BINDING SITE III. Table 2 illustrates the complementarity of the nucleotide sequences of ABCA5 BINDING SITE, designated SEQ ID:20747, to the nucleotide sequence of VGAM791 RNA, herein designated VGAM RNA, also designated SEQ ID:3502.

Another function of VGAM791 is therefore inhibition of ATP-binding Cassette, Sub-family A (ABC1), Member 5 (ABCA5, Accession NM_018672). Accordingly, utilities of VGAM791 include diagnosis, prevention and treatment of diseases and clinical conditions associated with ABCA5. Calsenilin, Presenilin Binding Protein, EF Hand Transcription Factor (CSEN, Accession NM_013434) is another VGAM791 host target gene. CSEN BINDING SITE is HOST TARGET binding site found in the 3' untranslated region of mRNA encoded by CSEN, corresponding to a HOST TARGET binding site such as BINDING SITE I, BINDING SITE II or BINDING SITE III. Table 2 illustrates the complementarity of the nucleotide sequences of CSEN BINDING SITE, designated SEQ ID:15088, to the nucleotide sequence of VGAM791 RNA, herein designated VGAM RNA, also designated SEQ ID:3502.

Another function of VGAM791 is therefore inhibition of Calsenilin, Presenilin Binding Protein, EF Hand Transcription Factor (CSEN, Accession NM_013434). Accordingly, utilities of VGAM791 include diagnosis, prevention and treatment of diseases and clinical conditions associated with CSEN. DKFZP667O116 (Accession XM_168586) is another VGAM791 host target gene. DKFZP667O116 BINDING SITE is HOST TARGET binding site found in the 3' untranslated region of mRNA encoded by DKFZP667O116, corresponding to a HOST TARGET binding site such as BINDING SITE I, BINDING SITE II or BINDING SITE III. Table 2 illustrates the complementarity of the nucleotide sequences of DKFZP667O116 BINDING SITE, designated SEQ ID:45264, to the nucleotide sequence of VGAM791 RNA, herein designated VGAM RNA, also designated SEQ ID:3502.

Another function of VGAM791 is therefore inhibition of DKFZP667O116 (Accession XM_168586). Accordingly, utilities of VGAM791 include diagnosis, prevention and treatment of diseases and clinical conditions associated with DKFZP667O116. FLJ14326 (Accession NM_032191) is another VGAM791 host target gene. FLJ14326 BINDING SITE is HOST TARGET binding site found in the 3' untranslated region of mRNA encoded by FLJ14326, corresponding to a HOST TARGET binding site such as BINDING SITE I, BINDING SITE II or BINDING SITE III. Table 2 illustrates the complementarity of the nucleotide sequences of FLJ14326 BINDING SITE, designated SEQ ID:25905, to the nucleotide sequence of VGAM791 RNA, herein designated VGAM RNA, also designated SEQ ID:3502.

Another function of VGAM791 is therefore inhibition of FLJ14326 (Accession NM_032191). Accordingly, utilities of VGAM791 include diagnosis, prevention and treatment of diseases and clinical conditions associated with FLJ14326. FLJ20359 (Accession NM_017781) is another VGAM791 host target gene. FLJ20359 BINDING SITE is HOST TARGET binding site found in the 3' untranslated region of mRNA encoded by FLJ20359, corresponding to a HOST TARGET binding site such as BINDING SITE I, BINDING SITE II or BINDING SITE III. Table 2 illustrates the complementarity of the nucleotide sequences of FLJ20359 BINDING SITE, designated SEQ ID:19412, to the nucleotide sequence of VGAM791 RNA, herein designated VGAM RNA, also designated SEQ ID:3502.

Another function of VGAM791 is therefore inhibition of FLJ20359 (Accession NM_017781). Accordingly, utilities of VGAM791 include diagnosis, prevention and treatment of diseases and clinical conditions associated with FLJ20359. FLJ22471 (Accession NM_025140) is another VGAM791 host target gene. FLJ22471 BINDING SITE is HOST TARGET binding site found in the 3' untranslated region of mRNA encoded by FLJ22471, corresponding to a HOST TARGET binding site such as BINDING SITE I, BINDING SITE II or BINDING SITE III. Table 2 illustrates the complementarity of the nucleotide sequences of FLJ22471 BINDING SITE, designated SEQ ID:24778, to the nucleotide sequence of VGAM791 RNA, herein designated VGAM RNA, also designated SEQ ID:3502.

Another function of VGAM791 is therefore inhibition of FLJ22471 (Accession NM_025140). Accordingly, utilities of VGAM791 include diagnosis, prevention and treatment of diseases and clinical conditions associated with FLJ22471. KIAA0543 (Accession XM_044213) is another VGAM791 host target gene. KIAA0543 BINDING SITE is HOST TARGET binding site found in the 3' untranslated region of mRNA encoded by KIAA0543, corresponding to a HOST TARGET binding site such as BINDING SITE I, BINDING SITE II or BINDING SITE III. Table 2 illustrates the complementarity of the nucleotide sequences of KIAA0543 BINDING SITE, designated SEQ ID:34178, to the nucleotide sequence of VGAM791 RNA, herein designated VGAM RNA, also designated SEQ ID:3502.

Another function of VGAM791 is therefore inhibition of KIAA0543 (Accession XM_044213). Accordingly, utilities of VGAM791 include diagnosis, prevention and treatment of diseases and clinical conditions associated with KIAA0543. KIAA0775 (Accession NM_014726) is another VGAM791 host target gene. KIAA0775 BINDING SITE is HOST TARGET binding site found in the 3' untranslated region of mRNA encoded by KIAA0775, corresponding to a HOST TARGET binding site such as BINDING SITE I, BINDING SITE II or BINDING SITE III. Table 2 illustrates the complementarity of the nucleotide sequences of KIAA0775 BINDING SITE, designated SEQ ID:16320, to the nucleotide sequence of VGAM791 RNA, herein designated VGAM RNA, also designated SEQ ID:3502.

Another function of VGAM791 is therefore inhibition of KIAA0775 (Accession NM_014726). Accordingly, utilities of VGAM791 include diagnosis, prevention and treatment of diseases and clinical conditions associated with KIAA0775. KIAA0939 (Accession XM_030524) is another VGAM791 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31067, to the nucleotide sequence of VGAM791 RNA, herein designated VGAM RNA, also designated SEQ ID:3502.

Another function of VGAM791 is therefore inhibition of KIAA0939 (Accession XM_030524). Accordingly, utilities of VGAM791 include diagnosis, prevention and treatment of diseases and clinical conditions associated with KIAA0939. KIAA1054 (Accession XM_043493) is another VGAM791 host target gene. KIAA1054 BINDING SITE is HOST TARGET binding site found in the 3' untranslated region of mRNA encoded by KIAA1054, corresponding to a HOST TARGET binding site such as BINDING SITE I, BINDING SITE II or BINDING SITE III. Table 2 illustrates the complementarity of the nucleotide sequences of KIAA1054 BINDING SITE, designated SEQ ID:33958, to the nucleotide sequence of VGAM791 RNA, herein designated VGAM RNA, also designated SEQ ID:3502.

Another function of VGAM791 is therefore inhibition of KIAA1054 (Accession XM_043493). Accordingly, utilities of VGAM791 include diagnosis, prevention and treatment of diseases and clinical conditions associated with KIAA1054. KIAA1155 (Accession XM_030864) is another VGAM791 host target gene. KIAA1155 BINDING SITE is HOST TARGET binding site found in the 3' untranslated region of mRNA encoded by KIAA1155, corresponding to a HOST TARGET binding site such as BINDING SITE I, BINDING SITE II or BINDING SITE III. Table 2 illustrates the complementarity of the nucleotide sequences of KIAA1155 BINDING SITE, designated SEQ ID:31202, to the nucleotide sequence of VGAM791 RNA, herein designated VGAM RNA, also designated SEQ ID:3502.

Another function of VGAM791 is therefore inhibition of KIAA1155 (Accession XM_030864). Accordingly, utilities of VGAM791 include diagnosis, prevention and treatment of diseases and clinical conditions associated with KIAA1155. Protocadherin 19 (PCDH19, Accession XM_033173) is another VGAM791 host target gene. PCDH19 BINDING SITE is HOST TARGET binding site found in the 3' untranslated region of mRNA encoded by PCDH19, corresponding to a HOST TARGET binding site such as BINDING SITE I, BINDING SITE II or BINDING SITE III. Table 2 illustrates the complementarity of the nucleotide sequences of PCDH19 BINDING SITE, designated SEQ ID:31862, to the nucleotide sequence of VGAM791 RNA, herein designated VGAM RNA, also designated SEQ ID:3502.

Another function of VGAM791 is therefore inhibition of Protocadherin 19 (PCDH19, Accession XM_033173). Accordingly, utilities of VGAM791 include diagnosis, prevention and treatment of diseases and clinical conditions associated with PCDH19. Prefoldin 1 (PFDN1, Accession NM_002622) is another VGAM791 host target gene. PFDN1 BINDING SITE is HOST TARGET binding site found in the 3' untranslated region of mRNA encoded by PFDN1, corresponding to a HOST TARGET binding site such as BINDING SITE I, BINDING SITE II or BINDING SITE III. Table 2 illustrates the complementarity of the nucleotide sequences of PFDN1 BINDING SITE, designated SEQ ID:8484, to the nucleotide sequence of VGAM791 RNA, herein designated VGAM RNA, also designated SEQ ID:3502.

Another function of VGAM791 is therefore inhibition of Prefoldin 1 (PFDN1, Accession NM_002622). Accordingly, utilities of VGAM791 include diagnosis, prevention and treatment of diseases and clinical conditions associated with PFDN1. Retinoic Acid Induced 16 (RAI16, Accession NM_022749) is another VGAM791 host target gene. RAI16 BINDING SITE is HOST TARGET binding site found in the 3' untranslated region of mRNA encoded by RAI16, corresponding to a HOST TARGET binding site such as BINDING SITE I, BINDING SITE II or BINDING SITE III. Table 2 illustrates the complementarity of the nucleotide sequences of RAI16 BINDING SITE, designated SEQ ID:22971, to the nucleotide sequence of VGAM791 RNA, herein designated VGAM RNA, also designated SEQ ID:3502.

Another function of VGAM791 is therefore inhibition of Retinoic Acid Induced 16 (RAI16, Accession NM_022749). Accordingly, utilities of VGAM791 include diagnosis, prevention and treatment of diseases and clinical conditions associated with RAI16. LOC115509 (Accession XM_056092) is another VGAM791 host target gene. LOC115509 BINDING SITE is HOST TARGET binding site found in the 3' untranslated region of mRNA encoded by LOC115509, corresponding to a HOST TARGET binding site such as BINDING SITE I, BINDING SITE II or BINDING SITE III. Table 2 illustrates the complementarity of the nucleotide sequences of LOC115509 BINDING SITE, designated SEQ ID:36365, to the nucleotide sequence of VGAM791 RNA, herein designated VGAM RNA, also designated SEQ ID:3502.

Another function of VGAM791 is therefore inhibition of LOC115509 (Accession XM_056092). Accordingly, utilities of VGAM791 include diagnosis, prevention and treatment of diseases and clinical conditions associated with LOC115509. LOC127281 (Accession XM_059128) is another VGAM791 host target gene. LOC127281 BINDING SITE is HOST TARGET binding site found in the 3' untranslated region of mRNA encoded by LOC127281, corresponding to a HOST TARGET binding site such as BINDING SITE I, BINDING SITE II or BINDING SITE III. Table 2 illustrates the complementarity of the nucleotide sequences of LOC127281 BINDING SITE, designated SEQ ID:36892, to the nucleotide sequence of VGAM791 RNA, herein designated VGAM RNA, also designated SEQ ID:3502.

Another function of VGAM791 is therefore inhibition of LOC127281 (Accession XM_059128). Accordingly, utilities of VGAM791 include diagnosis, prevention and treatment of diseases and clinical conditions associated with LOC127281. LOC130813 (Accession XM_065904) is another VGAM791 host target gene. LOC130813 BINDING SITE is HOST TARGET binding site found in the 3' untranslated region of mRNA encoded by LOC130813, corresponding to a HOST TARGET binding site such as BINDING SITE I, BINDING SITE II or BINDING SITE III. Table 2 illustrates the complementarity of the nucleotide sequences of LOC130813 BINDING SITE, designated SEQ ID:37314, to the nucleotide sequence of VGAM791 RNA, herein designated VGAM RNA, also designated SEQ ID:3502.

Another function of VGAM791 is therefore inhibition of LOC130813 (Accession XM_065904). Accordingly, utilities of VGAM791 include diagnosis, prevention and treatment of diseases and clinical conditions associated with LOC130813. LOC145468 (Accession XM_057874) is another VGAM791 host target gene. LOC145468 BINDING SITE is HOST TARGET binding site found in the 3' untranslated region of mRNA encoded by LOC145468, corresponding to a HOST TARGET binding site such as BINDING SITE I, BINDING SITE II or BINDING SITE III. Table 2 illustrates the complementarity of the nucleotide sequences of LOC145468 BINDING SITE, designated SEQ ID:36550, to the nucleotide sequence of VGAM791 RNA, herein designated VGAM RNA, also designated SEQ ID:3502.

Another function of VGAM791 is therefore inhibition of LOC145468 (Accession XM_057874). Accordingly, utilities of VGAM791 include diagnosis, prevention and treatment of diseases and clinical conditions associated with LOC145468. LOC150155 (Accession XM_047977) is another VGAM791 host target gene. LOC150155 BINDING SITE is HOST TARGET binding site found in the 3' untranslated region of mRNA encoded by LOC150155, corresponding to a HOST TARGET binding site such as BINDING SITE I, BINDING SITE II or BINDING SITE III. Table 2 illustrates the complementarity of the nucleotide sequences of LOC150155 BINDING SITE, designated SEQ ID:35092, to the nucleotide sequence of VGAM791 RNA, herein designated VGAM RNA, also designated SEQ ID:3502.

Another function of VGAM791 is therefore inhibition of LOC150155 (Accession XM_047977). Accordingly, utilities of VGAM791 include diagnosis, prevention and treatment of diseases and clinical conditions associated with LOC150155. LOC200982 (Accession XM_117305) is another VGAM791 host target gene. LOC200982 BINDING SITE is HOST TARGET binding site found in the 3' untranslated region of mRNA encoded by LOC200982, corresponding to a HOST TARGET binding site such as BINDING SITE I, BINDING SITE II or BINDING SITE III. Table 2 illustrates the complementarity of the nucleotide sequences of LOC200982 BINDING SITE, designated SEQ ID:43378, to the nucleotide sequence of VGAM791 RNA, herein designated VGAM RNA, also designated SEQ ID:3502.

Another function of VGAM791 is therefore inhibition of LOC200982 (Accession XM_117305). Accordingly, utilities of VGAM791 include diagnosis, prevention and treatment of diseases and clinical conditions associated with LOC200982. LOC204301 (Accession XM_115306) is another VGAM791 host target gene. LOC204301 BINDING SITE is HOST TARGET binding site found in the 3' untranslated region of mRNA encoded by LOC204301, corresponding to a HOST TARGET binding site such as BINDING SITE I, BINDING SITE II or BINDING SITE III. Table 2 illustrates the complementarity of the nucleotide sequences of LOC204301 BINDING SITE, designated SEQ ID:43096, to the nucleotide sequence of VGAM791 RNA, herein designated VGAM RNA, also designated SEQ ID:3502.

Another function of VGAM791 is therefore inhibition of LOC204301 (Accession XM_115306). Accordingly, utilities of VGAM791 include diagnosis, prevention and treatment of diseases and clinical conditions associated with LOC204301. LOC221968 (Accession XM_166524) is another VGAM791 host target gene. LOC221968 BINDING SITE is HOST TARGET binding site found in the 3' untranslated region of mRNA encoded by LOC221968, corresponding to a HOST TARGET binding site such as BINDING SITE I, BINDING SITE II or BINDING SITE III. Table 2 illustrates the complementarity of the nucleotide sequences of LOC221968 BINDING SITE, designated SEQ ID:44470, to the nucleotide sequence of VGAM791 RNA, herein designated VGAM RNA, also designated SEQ ID:3502.

Another function of VGAM791 is therefore inhibition of LOC221968 (Accession XM_166524). Accordingly, utilities of VGAM791 include diagnosis, prevention and treatment of diseases and clinical conditions associated with LOC221968.

LOC253128 (Accession XM_170726) is another VGAM791 host target gene. LOC253128 BINDING SITE is HOST TARGET binding site found in the 3' untranslated region of mRNA encoded by LOC253128, corresponding to a HOST TARGET binding site such as BINDING SITE I, BINDING SITE II or BINDING SITE III. Table 2 illustrates the complementarity of the nucleotide sequences of LOC253128 BINDING SITE, designated SEQ ID:45485, to the nucleotide sequence of VGAM791 RNA, herein designated VGAM RNA, also designated SEQ ID:3502.

Another function of VGAM791 is therefore inhibition of LOC253128 (Accession XM_170726). Accordingly, utilities of VGAM791 include diagnosis, prevention and treatment of diseases and clinical conditions associated with LOC253128.

LOC254358 (Accession XM_170771) is another VGAM791 host target gene. LOC254358 BINDING SITE is HOST TARGET binding site found in the 3' untranslated region of mRNA encoded by LOC254358, corresponding to a HOST TARGET binding site such as BINDING SITE I, BINDING SITE II or BINDING SITE III. Table 2 illustrates the complementarity of the nucleotide sequences of LOC254358 BINDING SITE, designated SEQ ID:45534, to the nucleotide sequence of VGAM791 RNA, herein designated VGAM RNA, also designated SEQ ID:3502.

Another function of VGAM791 is therefore inhibition of LOC254358 (Accession XM_170771). Accordingly, utilities of VGAM791 include diagnosis, prevention and treatment of diseases and clinical conditions associated with LOC254358.

LOC254413 (Accession XM_173141) is another VGAM791 host target gene. LOC254413 BINDING SITE is HOST TARGET binding site found in the 5' untranslated region of mRNA encoded by LOC254413, corresponding to a HOST TARGET binding site such as BINDING SITE I, BINDING SITE II or BINDING SITE III. Table 2 illustrates the complementarity of the nucleotide sequences of LOC254413 BINDING SITE, designated SEQ ID:46404, to the nucleotide sequence of VGAM791 RNA, herein designated VGAM RNA, also designated SEQ ID:3502.

Another function of VGAM791 is therefore inhibition of LOC254413 (Accession XM_173141). Accordingly, utilities of VGAM791 include diagnosis, prevention and treatment of diseases and clinical conditions associated with LOC254413.

LOC254428 (Accession XM_170932) is another VGAM791 host target gene. LOC254428 BINDING SITE is HOST TARGET binding site found in the 3' untranslated region of mRNA encoded by LOC254428, corresponding to a HOST TARGET binding site such as BINDING SITE I, BINDING SITE II or BINDING SITE III. Table 2 illustrates the complementarity of the nucleotide sequences of LOC254428 BINDING SITE, designated SEQ ID:45717, to the nucleotide sequence of VGAM791 RNA, herein designated VGAM RNA, also designated SEQ ID:3502.

Another function of VGAM791 is therefore inhibition of LOC254428 (Accession XM_170932). Accordingly, utilities of VGAM791 include diagnosis, prevention and treatment of diseases and clinical conditions associated with LOC254428.

LOC254659 (Accession XM_170822) is another VGAM791 host target gene. LOC254659 BINDING SITE is HOST TARGET binding site found in the 5' untranslated region of mRNA encoded by LOC254659, corresponding to a HOST TARGET binding site such as BINDING SITE I, BINDING SITE II or BINDING SITE III. Table 2 illustrates the complementarity of the nucleotide sequences of LOC254659 BINDING SITE, designated SEQ ID:45601, to the nucleotide sequence of VGAM791 RNA, herein designated VGAM RNA, also designated SEQ ID:3502.

Another function of VGAM791 is therefore inhibition of LOC254659 (Accession XM_170822). Accordingly, utilities of VGAM791 include diagnosis, prevention and treatment of diseases and clinical conditions associated with LOC254659.

LOC254755 (Accession XM_173224) is another VGAM791 host target gene. LOC254755 BINDING SITE is HOST TARGET binding site found in the 3' untranslated region of mRNA encoded by LOC254755, corresponding to a HOST TARGET binding site such as BINDING SITE I, BINDING SITE II or BINDING SITE III. Table 2 illustrates the complementarity of the nucleotide sequences of LOC254755 BINDING SITE, designated SEQ ID:46489, to the nucleotide sequence of VGAM791 RNA, herein designated VGAM RNA, also designated SEQ ID:3502.

Another function of VGAM791 is therefore inhibition of LOC254755 (Accession XM_173224). Accordingly, utilities of VGAM791 include diagnosis, prevention and treatment of diseases and clinical conditions associated with LOC254755.

LOC254848 (Accession XM_173133) is another VGAM791 host target gene. LOC254848 BINDING SITE is HOST TARGET binding site found in the 5' untranslated region of mRNA encoded by LOC254848, corresponding to a HOST TARGET binding site such as BINDING SITE I, BINDING SITE II or BINDING SITE III. Table 2 illustrates the complementarity of the nucleotide sequences of LOC254848 BINDING SITE, designated SEQ ID:46379, to the nucleotide sequence of VGAM791 RNA, herein designated VGAM RNA, also designated SEQ ID:3502.

Another function of VGAM791 is therefore inhibition of LOC254848 (Accession XM_173133). Accordingly, utilities of VGAM791 include diagnosis, prevention and treatment of diseases and clinical conditions associated with LOC254848.

LOC51107 (Accession NM_016022) is another VGAM791 host target gene. LOC51107 BINDING SITE is HOST TARGET binding site found in the 3' untranslated region of mRNA encoded by LOC51107, corresponding to a HOST TARGET binding site such as BINDING SITE I, BINDING SITE II or BINDING SITE III. Table 2 illustrates the complementarity of the nucleotide sequences of LOC51107 BINDING SITE, designated SEQ ID:18098, to the nucleotide sequence of VGAM791 RNA, herein designated VGAM RNA, also designated SEQ ID:3502.

Another function of VGAM791 is therefore inhibition of LOC51107 (Accession NM_016022). Accordingly, utilities of VGAM791 include diagnosis, prevention and treatment of diseases and clinical conditions associated with LOC51107.

FIG. 1 further provides a conceptual description of a novel bioinformatically detected viral gene of the present invention, referred to here as Viral Genomic Address Messenger 792 (VGAM792) viral gene, which modulates expression of respective host target genes thereof, the function and utility of which host target genes is known in the art.

VGAM792 is a novel bioinformatically detected regulatory, non protein coding, viral micro RNA (miRNA) gene. The method by which VGAM792 was detected is described hereinabove with reference to FIGS. 1-8.

VGAM792 gene, herein designated VGAM GENE, is a viral gene contained in the genome of Shrimp White Spot Syndrome Virus (white spot bacilliform virus). VGAM792 host target gene, herein designated VGAM HOST TARGET GENE, is a human gene contained in the human genome.

VGAM792 gene encodes a VGAM792 precursor RNA, herein designated VGAM PRECURSOR RNA. Similar to other miRNA genes, and unlike most ordinary genes, VGAM792 precursor RNA does not encode a protein. A nucleotide sequence identical or highly similar to the nucleotide sequence of VGAM792 precursor RNA is designated SEQ ID:778, and is provided hereinbelow with reference to the sequence listing part. Nucleotide sequence SEQ ID:778 is located at position 13192 relative to the genome of Shrimp White Spot Syndrome Virus (white spot bacilliform virus).

VGAM792 precursor RNA folds onto itself, forming VGAM792 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM792 folded precursor RNA into VGAM792 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM792 RNA is designated SEQ ID:3503, and is provided hereinbelow with reference to the sequence listing part.

VGAM792 host target gene, herein designated VGAM HOST TARGET GENE, encodes a corresponding messenger RNA, VGAM792 host target RNA, herein designated VGAM HOST TARGET RNA. VGAM792 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM792 RNA, herein designated VGAM RNA, binds complementarily to one or more host target binding sites located in untranslated regions of VGAM792 host target RNA, herein designated VGAM HOST TARGET RNA. This complementary binding is due to the fact that the nucleotide sequence of VGAM792 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM792 RNA, herein designated VGAM RNA, may have a different number of host target binding sites in untranslated regions of a VGAM792 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM792 RNA, herein designated VGAM RNA, to host target binding sites on VGAM792 host target RNA, herein designated VGAM HOST TARGET RNA, such as BINDING SITE I, BINDING SITE II and BINDING SITE III, inhibits translation of VGAM792 host target RNA into VGAM792 host target protein, herein designated VGAM HOST TARGET PROTEIN. VGAM host target protein is therefore outlined by a broken line.

It is appreciated that VGAM792 host target gene, herein designated VGAM HOST TARGET GENE, in fact represents a plurality of VGAM792 host target genes. The mRNA of each one of this plurality of VGAM792 host target genes comprises one or more host target binding sites, each having a nucleotide sequence which is at least partly complementary to VGAM792 RNA, herein designated VGAM RNA, and which when bound by VGAM792 RNA causes inhibition of translation of respective one or more VGAM792 host target proteins.

It is further appreciated by one skilled in the art that the mode of translational inhibition illustrated by FIG. 1 with specific reference to translational inhibition exerted by VGAM792 gene, herein designated VGAM GENE, on one or more VGAM792 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM792 is inhibition of expression of host target genes, as part of a novel viral mechanism of attacking a host. Accordingly, utilities of VGAM792 include diagnosis, prevention and treatment of viral infection by Shrimp White Spot Syndrome Virus (white spot bacilliform virus). Specific functions, and accordingly utilities, of VGAM792 correlate with, and may be deduced from, the identity of the host target genes which VGAM792 binds and inhibits, and the function of these host target genes, as elaborated hereinbelow.

Nucleotide sequences of the VGAM792 precursor RNA, herein designated VGAM PRECURSOR RNA, and of the 'diced' VGAM792 RNA, herein designated VGAM RNA, and a schematic representation of the secondary folding of VGAM792 folded precursor RNA, herein designated VGAM FOLDED PRECURSOR RNA, of VGAM792 are further described hereinbelow with reference to Table 1.

Nucleotide sequences of host target binding sites, such as BINDING SITE-I, BINDING SITE-II and BINDING SITE-III of FIG. 1, found on VGAM792 host target RNA, and schematic representation of the complementarity of each of these host target binding sites to VGAM792 RNA, herein designated VGAM RNA, are described hereinbelow with reference to Table 2.

As mentioned hereinabove with reference to FIG. 1, a function of VGAM792 gene, herein designated VGAM is inhibition of expression of VGAM792 target genes. It is appreciated that specific functions, and accordingly utilities, of VGAM792 correlate with, and may be deduced from, the identity of the target genes which VGAM792 binds and inhibits, and the function of these target genes, as elaborated hereinbelow.

EGF-containing Fibulin-like Extracellular Matrix Protein 1 (EFEMP1, Accession NM_004105) is a VGAM792 host target gene. EFEMP1 BINDING SITE1 and EFEMP1 BINDING SITE2 are HOST TARGET binding sites found in untranslated regions of mRNA encoded by EFEMP1, corresponding to HOST TARGET binding sites such as BINDING SITE I, BINDING SITE II or BINDING SITE III. Table 2 illustrates the complementarity of the nucleotide sequences of EFEMP1 BINDING SITE1 and EFEMP1 BINDING SITE2, designated SEQ ID:10317 and SEQ ID:20837 respectively, to the nucleotide sequence of VGAM792 RNA, herein designated VGAM RNA, also designated SEQ ID:3503.

A function of VGAM792 is therefore inhibition of EGF-containing Fibulin-like Extracellular Matrix Protein 1 (EFEMP1, Accession NM_004105). Accordingly, utilities of VGAM792 include diagnosis, prevention and treatment of diseases and clinical conditions associated with EFEMP1. Solute Carrier Family 6 (neurotransmitter transporter, taurine), Member 6 (SLC6A6, Accession NM_003043) is another VGAM792 host target gene. SLC6A6 BINDING SITE is HOST TARGET binding site found in the 3' untranslated region of mRNA encoded by SLC6A6, corresponding to a HOST TARGET binding site such as BINDING SITE I, BINDING SITE II or BINDING SITE III. Table 2 illustrates the complementarity of the nucleotide sequences of SLC6A6 BINDING SITE, designated SEQ ID:9005, to the nucleotide sequence of VGAM792 RNA, herein designated VGAM RNA, also designated SEQ ID:3503.

Another function of VGAM792 is therefore inhibition of Solute Carrier Family 6 (neurotransmitter transporter, taurine), Member 6 (SLC6A6, Accession NM_003043), a gene which transports taurine and other beta-amino acids like beta-alanine. Accordingly, utilities of VGAM792 include diagnosis, prevention and treatment of diseases and clinical conditions associated with SLC6A6. The function of SLC6A6 and its association with various diseases and clinical conditions, has been established by previous studies, as described hereinabove with reference to VGAM36. ARHGAP10 (Accession NM_020824) is another VGAM792 host target gene. ARHGAP10 BINDING SITE is HOST TARGET binding site found in the 3' untranslated region of mRNA encoded by ARHGAP10, corresponding to a HOST TARGET binding site such as BINDING SITE I, BINDING SITE II or BINDING SITE III. Table 2 illustrates the complementarity of the nucleotide sequences of ARHGAP10 BINDING SITE, designated SEQ ID:21887, to the nucleotide sequence of VGAM792 RNA, herein designated VGAM RNA, also designated SEQ ID:3503.

Another function of VGAM792 is therefore inhibition of ARHGAP10 (Accession NM_020824). Accordingly, utilities of VGAM792 include diagnosis, prevention and treatment of diseases and clinical conditions associated with ARHGAP10. FLJ21126 (Accession XM_117367) is another VGAM792 host target gene. FLJ21126 BINDING SITE is HOST TARGET binding site found in the 3' untranslated region of mRNA encoded by FLJ21126, corresponding to a HOST TARGET binding site such as BINDING SITE I, BINDING SITE II or BINDING SITE III. Table 2 illustrates the complementarity of the nucleotide sequences of FLJ21126 BINDING SITE, designated SEQ ID:43417, to the nucleotide sequence of VGAM792 RNA, herein designated VGAM RNA, also designated SEQ ID:3503.

Another function of VGAM792 is therefore inhibition of FLJ21126 (Accession XM_117367). Accordingly, utilities of VGAM792 include diagnosis, prevention and treatment of diseases and clinical conditions associated with FLJ21126. FIG. 1 further provides a conceptual description of a novel bioinformatically detected viral gene of the present invention, referred to here as Viral Genomic Address Messenger 793 (VGAM793) viral gene, which modulates expression of respective host target genes thereof, the function and utility of which host target genes is known in the art.

VGAM793 is a novel bioinformatically detected regulatory, non protein coding, viral micro RNA (miRNA) gene. The method by which VGAM793 was detected is described hereinabove with reference to FIGS. 1-8.

VGAM793 gene, herein designated VGAM GENE, is a viral gene contained in the genome of Shrimp White Spot Syndrome Virus (white spot bacilliform virus). VGAM793 host target gene, herein designated VGAM HOST TARGET GENE, is a human gene contained in the human genome.

VGAM793 gene encodes a VGAM793 precursor RNA, herein designated VGAM PRECURSOR RNA. Similar to other miRNA genes, and unlike most ordinary genes, VGAM793 precursor RNA does not encode a protein. A nucleotide sequence identical or highly similar to the nucleotide sequence of VGAM793 precursor RNA is designated SEQ ID:779, and is provided hereinbelow with reference to the sequence listing part. Nucleotide sequence SEQ ID:779 is located at position 10748 relative to the genome of Shrimp White Spot Syndrome Virus (white spot bacilliform virus).

VGAM793 precursor RNA folds onto itself, forming VGAM793 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM793 folded precursor RNA into VGAM793 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM793 RNA is designated SEQ ID:3504, and is provided hereinbelow with reference to the sequence listing part.

VGAM793 host target gene, herein designated VGAM HOST TARGET GENE, encodes a corresponding messenger RNA, VGAM793 host target RNA, herein designated VGAM HOST TARGET RNA. VGAM793 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM793 RNA, herein designated VGAM RNA, binds complementarily to one or more host target binding sites located in untranslated regions of VGAM793 host target RNA, herein designated VGAM HOST TARGET RNA. This complementary binding is due to the fact that the nucleotide sequence of VGAM793 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM793 RNA, herein designated VGAM RNA, may have a different number of host target binding sites in untranslated regions of a VGAM793 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM793 RNA, herein designated VGAM RNA, to host target binding sites on VGAM793 host target RNA, herein designated VGAM HOST TARGET RNA, such as BINDING SITE I, BINDING SITE II and BINDING SITE III, inhibits translation of VGAM793 host target RNA into VGAM793 host target protein, herein designated VGAM HOST TARGET PROTEIN.

VGAM host target protein is therefore outlined by a broken line.

It is appreciated that VGAM793 host target gene, herein designated VGAM HOST TARGET GENE, in fact represents a plurality of VGAM793 host target genes. The mRNA of each one of this plurality of VGAM793 host target genes comprises one or more host target binding sites, each having a nucleotide sequence which is at least partly complementary to VGAM793 RNA, herein designated VGAM RNA, and which when bound by VGAM793 RNA causes inhibition of translation of respective one or more VGAM793 host target proteins.

It is further appreciated by one skilled in the art that the mode of translational inhibition illustrated by FIG. 1 with specific reference to translational inhibition exerted by VGAM793 gene, herein designated VGAM GENE, on one or more VGAM793 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM793 is inhibition of expression of host target genes, as part of a novel viral mechanism of attacking a host. Accordingly, utilities of VGAM793 include diagnosis, prevention and treatment of viral infection by Shrimp White Spot Syndrome Virus (white spot bacilliform virus). Specific functions, and accordingly utilities, of VGAM793 correlate with, and may be deduced from, the identity of the host target genes which VGAM793 binds and inhibits, and the function of these host target genes, as elaborated hereinbelow.

Nucleotide sequences of the VGAM793 precursor RNA, herein designated VGAM PRECURSOR RNA, and of the 'diced' VGAM793 RNA, herein designated VGAM RNA, and a schematic representation of the secondary folding of VGAM793 folded precursor RNA, herein designated VGAM FOLDED PRECURSOR RNA, of VGAM793 are further described hereinbelow with reference to Table 1.

Nucleotide sequences of host target binding sites, such as BINDING SITE-I, BINDING SITE-II and BINDING SITE-III of FIG. 1, found on VGAM793 host target RNA, and schematic representation of the complementarity of each of these host target binding sites to VGAM793 RNA, herein designated VGAM RNA, are described hereinbelow with reference to Table 2.

As mentioned hereinabove with reference to FIG. 1, a function of VGAM793 gene, herein designated VGAM is inhibition of expression of VGAM793 target genes. It is appreciated that specific functions, and accordingly utilities, of VGAM793 correlate with, and may be deduced from, the identity of the target genes which VGAM793 binds and inhibits, and the function of these target genes, as elaborated hereinbelow.

Myosin, Light Polypeptide Kinase (MYLK, Accession XM_173098) is a VGAM793 host target gene. MYLK BINDING SITE is HOST TARGET binding site found in the 3' untranslated region of mRNA encoded by MYLK, corresponding to a HOST TARGET binding site such as BINDING SITE I, BINDING SITE II or BINDING SITE III. Table 2 illustrates the complementarity of the nucleotide sequences of MYLK BINDING SITE, designated SEQ ID:46357, to the nucleotide sequence of VGAM793 RNA, herein designated VGAM RNA, also designated SEQ ID:3504.

A function of VGAM793 is therefore inhibition of Myosin, Light Polypeptide Kinase (MYLK, Accession XM_173098), a gene which is involved in contraction of smooth muscle. Accordingly, utilities of VGAM793 include diagnosis, prevention and treatment of diseases and clinical conditions associated with MYLK. The function of MYLK has been established by previous studies. The contraction of smooth muscle begins with the phosphorylation of the light chain of myosin (e.g., 160781), a reaction catalyzed by myosin light chain kinase that is itself activated by the binding of calcium-calmodulin (see OMIM Ref. No. 114180). This key enzyme in muscle contraction, which exists in both nonmuscle and smooth muscle isoforms, has been shown by immunohistology to be present in neurons and glia.

Full details of the abovementioned studies are described in the following publications, the disclosure of which are hereby incorporated by reference:

Potier, M.-C.; Chelot, E.; Pekarsky, Y.; Gardiner, K.; Rossier, J.; Turnell, W. G.: The human myosin light chain kinase (MLCK) from hippocampus: cloning, sequencing, expression, and localization to 3cen-q21. Genomics 29:562-570, 1995; and Watterson, D. M.; Schavocky, J. P.; Guo, L.; Weiss, C.; Chlenski, A.; Shirinsky, V. P.; Van Eldik, L. J.; Haiech, J.: Analysis of the kinase-related protein gene found at human chromo.

Further studies establishing the function and utilities of MYLK are found in John Hopkins OMIM database record ID 600922, and in sited publications numbered 9958-9963 listed in the bibliography section hereinbelow, which are also hereby incorporated by reference. DEPC-1 (Accession NM_139178) is another VGAM793 host target gene. DEPC-1 BINDING SITE is HOST TARGET binding site found in the 5' untranslated region of mRNA encoded by DEPC-1, corresponding to a HOST TARGET binding site such as BINDING SITE I, BINDING SITE II or BINDING SITE III. Table 2 illustrates the complementarity of the nucleotide sequences of DEPC-1 BINDING SITE, designated SEQ ID:29192, to the nucleotide sequence of VGAM793 RNA, herein designated VGAM RNA, also designated SEQ ID:3504.

Another function of VGAM793 is therefore inhibition of DEPC-1 (Accession NM_139178). Accordingly, utilities of VGAM793 include diagnosis, prevention and treatment of diseases and clinical conditions associated with DEPC-1. LOC154007 (Accession XM_087824) is another VGAM793 host target gene. LOC154007 BINDING SITE is HOST TARGET binding site found in the 3' untranslated region of mRNA encoded by LOC154007, corresponding to a HOST TARGET binding site such as BINDING SITE I, BINDING SITE II or BINDING SITE III. Table 2 illustrates the complementarity of the nucleotide sequences of LOC154007 BINDING SITE, designated SEQ ID:39450, to the nucleotide sequence of VGAM793 RNA, herein designated VGAM RNA, also designated SEQ ID:3504.

Another function of VGAM793 is therefore inhibition of LOC154007 (Accession XM_087824). Accordingly, utilities of VGAM793 include diagnosis, prevention and treatment of diseases and clinical conditions associated with LOC154007.

FIG. 1 further provides a conceptual description of a novel bioinformatically detected viral gene of the present invention, referred to here as Viral Genomic Address Messenger 794 (VGAM794) viral gene, which modulates expression of respective host target genes thereof, the function and utility of which host target genes is known in the art.

VGAM794 is a novel bioinformatically detected regulatory, non protein coding, viral micro RNA (miRNA) gene. The method by which VGAM794 was detected is described hereinabove with reference to FIGS. 1-8.

VGAM794 gene, herein designated VGAM GENE, is a viral gene contained in the genome of Shrimp White Spot Syndrome Virus (white spot bacilliform virus). VGAM794 host target gene, herein designated VGAM HOST TARGET GENE, is a human gene contained in the human genome.

VGAM794 gene encodes a VGAM794 precursor RNA, herein designated VGAM PRECURSOR RNA. Similar to other miRNA genes, and unlike most ordinary genes, VGAM794 precursor RNA does not encode a protein. A nucleotide sequence identical or highly similar to the nucleotide sequence of VGAM794 precursor RNA is designated SEQ ID:780, and is provided hereinbelow with reference to the sequence listing part. Nucleotide sequence SEQ ID:780 is located at position 80483 relative to the genome of Shrimp White Spot Syndrome Virus (white spot bacilliform virus).

VGAM794 precursor RNA folds onto itself, forming VGAM794 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM794 folded precursor RNA into VGAM794 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM794 RNA is designated SEQ ID:3505, and is provided hereinbelow with reference to the sequence listing part.

VGAM794 host target gene, herein designated VGAM HOST TARGET GENE, encodes a corresponding messenger RNA, VGAM794 host target RNA, herein designated VGAM HOST TARGET RNA. VGAM794 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM794 RNA, herein designated VGAM RNA, binds complementarily to one or more host target binding sites located in untranslated regions of VGAM794 host target RNA, herein designated VGAM HOST TARGET RNA. This complementary binding is due to the fact that the nucleotide sequence of VGAM794 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM794 RNA, herein designated VGAM RNA, may have a different number of host target binding sites in untranslated regions of a VGAM794 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM794 RNA, herein designated VGAM RNA, to host target binding sites on VGAM794 host target RNA, herein designated VGAM HOST TARGET RNA, such as BINDING SITE I, BINDING SITE II and BINDING SITE III, inhibits translation of VGAM794 host target RNA into VGAM794 host target protein, herein designated VGAM HOST TARGET PROTEIN. VGAM host target protein is therefore outlined by a broken line.

It is appreciated that VGAM794 host target gene, herein designated VGAM HOST TARGET GENE, in fact represents a plurality of VGAM794 host target genes. The mRNA of each one of this plurality of VGAM794 host target genes comprises one or more host target binding sites, each having a nucleotide sequence which is at least partly complementary to VGAM794 RNA, herein designated VGAM RNA, and which when bound by VGAM794 RNA causes inhibition of translation of respective one or more VGAM794 host target proteins.

It is further appreciated by one skilled in the art that the mode of translational inhibition illustrated by FIG. 1 with specific reference to translational inhibition exerted by VGAM794 gene, herein designated VGAM GENE, on one or more VGAM794 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM794 is inhibition of expression of host target genes, as part of a novel viral mechanism of attacking a host. Accordingly, utilities of VGAM794 include diagnosis, prevention and treatment of viral infection by Shrimp White Spot Syndrome Virus (white spot bacilliform virus). Specific functions, and accordingly utilities, of VGAM794 correlate with, and may be deduced from, the identity of the host target genes which VGAM794 binds and inhibits, and the function of these host target genes, as elaborated hereinbelow.

Nucleotide sequences of the VGAM794 precursor RNA, herein designated VGAM PRECURSOR RNA, and of the 'diced' VGAM794 RNA, herein designated VGAM RNA, and a schematic representation of the secondary folding of VGAM794 folded precursor RNA, herein designated VGAM FOLDED PRECURSOR RNA, of VGAM794 are further described hereinbelow with reference to Table 1.

Nucleotide sequences of host target binding sites, such as BINDING SITE-I, BINDING SITE-II and BINDING SITE-III of FIG. 1, found on VGAM794 host target RNA, and schematic representation of the complementarity of each of these host target binding sites to VGAM794 RNA, herein designated VGAM RNA, are described hereinbelow with reference to Table 2.

As mentioned hereinabove with reference to FIG. 1, a function of VGAM794 gene, herein designated VGAM is inhibition of expression of VGAM794 target genes. It is appreciated that specific functions, and accordingly utilities, of VGAM794 correlate with, and may be deduced from, the identity of the target genes which VGAM794 binds and inhibits, and the function of these target genes, as elaborated hereinbelow.

Platelet-derived Growth Factor Receptor, Alpha Polypeptide (PDGFRA, Accession NM_006206) is a VGAM794 host target gene. PDGFRA BINDING SITE is HOST TARGET binding site found in the 3' untranslated region of mRNA encoded by PDGFRA, corresponding to a HOST TARGET binding site such as BINDING SITE I, BINDING SITE II or BINDING SITE III. Table 2 illustrates the complementarity of the nucleotide sequences of PDGFRA BINDING SITE, designated SEQ ID:12879, to the nucleotide sequence of VGAM794 RNA, herein designated VGAM RNA, also designated SEQ ID:3505.

A function of VGAM794 is therefore inhibition of Platelet-derived Growth Factor Receptor, Alpha Polypeptide (PDGFRA, Accession NM_006206), a gene which this receptor binds platelet-derived growth factor and has a tyrosine-protein kinase activity. Accordingly, utilities of VGAM794 include diagnosis, prevention and treatment of diseases and clinical conditions associated with PDGFRA. The function of PDGFRA and its association with various diseases and clinical conditions, has been established by previous studies, as described hereinabove with reference to VGAM117. KIAA0222 (Accession NM_014643) is another VGAM794 host target gene. KIAA0222 BINDING SITE is HOST TARGET binding site found in the 3' untranslated region of mRNA encoded by KIAA0222, corresponding to a HOST TARGET binding site such as BINDING SITE I, BINDING SITE II or BINDING SITE III. Table 2 illustrates the complementarity of the nucleotide sequences of KIAA0222 BINDING SITE, designated SEQ ID:16047, to the nucleotide sequence of VGAM794 RNA, herein designated VGAM RNA, also designated SEQ ID:3505.

Another function of VGAM794 is therefore inhibition of KIAA0222 (Accession NM_014643). Accordingly, utilities of VGAM794 include diagnosis, prevention and treatment of diseases and clinical conditions associated with KIAA0222. PRO1600 (Accession NM_014095) is another VGAM794 host target gene. PRO1600 BINDING SITE is HOST TARGET binding site found in the 5' untranslated region of mRNA encoded by PRO1600, corresponding to a HOST TARGET binding site such as BINDING SITE I, BINDING SITE II or BINDING SITE III. Table 2 illustrates the complementarity of the nucleotide sequences of PRO1600 BINDING SITE, designated SEQ ID:15315, to the nucleotide sequence of VGAM794 RNA, herein designated VGAM RNA, also designated SEQ ID:3505.

Another function of VGAM794 is therefore inhibition of PRO1600 (Accession NM_014095). Accordingly, utilities of VGAM794 include diagnosis, prevention and treatment of diseases and clinical conditions associated with PRO1600. TEB4 (Accession XM_027156) is another VGAM794 host target gene. TEB4 BINDING SITE is HOST TARGET binding site found in the 3' untranslated region of mRNA encoded by TEB4, corresponding to a HOST TARGET binding site such as BINDING SITE I, BINDING SITE II or BINDING SITE III. Table 2 illustrates the complementarity of the nucleotide sequences of TEB4 BINDING SITE, designated SEQ ID:30429, to the nucleotide sequence of VGAM794 RNA, herein designated VGAM RNA, also designated SEQ ID:3505.

Another function of VGAM794 is therefore inhibition of TEB4 (Accession XM_027156). Accordingly, utilities of VGAM794 include diagnosis, prevention and treatment of diseases and clinical conditions associated with TEB4. LOC125268 (Accession XM_071960) is another VGAM794 host target gene. LOC125268 BINDING SITE is HOST TARGET binding site found in the 3' untranslated region of mRNA encoded by LOC125268, corresponding to a HOST TARGET binding site such as BINDING SITE I, BINDING SITE II or BINDING SITE III. Table 2 illustrates the complementarity of the nucleotide sequences of LOC125268 BINDING SITE, designated SEQ ID:37452, to the nucleotide sequence of VGAM794 RNA, herein designated VGAM RNA, also designated SEQ ID:3505.

Another function of VGAM794 is therefore inhibition of LOC125268 (Accession XM_071960). Accordingly, utilities of VGAM794 include diagnosis, prevention and treatment of diseases and clinical conditions associated with LOC125268. LOC220469 (Accession XM_084334) is another VGAM794 host target gene. LOC220469 BINDING SITE is HOST TARGET binding site found in the 3' untranslated region of mRNA encoded by LOC220469, corresponding to a HOST TARGET binding site such as BINDING SITE I, BINDING SITE II or BINDING SITE III. Table 2 illustrates the complementarity of the nucleotide sequences of LOC220469 BINDING SITE, designated SEQ ID:37556, to the nucleotide sequence of VGAM794 RNA, herein designated VGAM RNA, also designated SEQ ID:3505.

Another function of VGAM794 is therefore inhibition of LOC220469 (Accession XM_084334). Accordingly, utilities of VGAM794 include diagnosis, prevention and treatment of diseases and clinical conditions associated with LOC220469. FIG. 1 further provides a conceptual description of a novel bioinformatically detected viral gene of the present invention, referred to here as Viral Genomic Address Messenger 795 (VGAM795) viral gene, which modulates expression of respective host target genes thereof, the function and utility of which host target genes is known in the art.

VGAM795 is a novel bioinformatically detected regulatory, non protein coding, viral micro RNA (miRNA) gene. The method by which VGAM795 was detected is described hereinabove with reference to FIGS. 1-8.

VGAM795 gene, herein designated VGAM GENE, is a viral gene contained in the genome of Shrimp White Spot Syndrome Virus (white spot bacilliform virus). VGAM795 host target gene, herein designated VGAM HOST TARGET GENE, is a human gene contained in the human genome.

VGAM795 gene encodes a VGAM795 precursor RNA, herein designated VGAM PRECURSOR RNA. Similar to other miRNA genes, and unlike most ordinary genes, VGAM795 precursor RNA does not encode a protein. A nucleotide sequence identical or highly similar to the nucleotide sequence of VGAM795 precursor RNA is designated SEQ ID:781, and is provided hereinbelow with reference to the sequence listing part. Nucleotide sequence SEQ ID:781 is located at position 88141 relative to the genome of Shrimp White Spot Syndrome Virus (white spot bacilliform virus).

VGAM795 precursor RNA folds onto itself, forming VGAM795 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM795 folded precursor RNA into VGAM795 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM795 RNA is designated SEQ ID:3506, and is provided hereinbelow with reference to the sequence listing part.

VGAM795 host target gene, herein designated VGAM HOST TARGET GENE, encodes a corresponding messenger RNA, VGAM795 host target RNA, herein designated VGAM HOST TARGET RNA. VGAM795 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM795 RNA, herein designated VGAM RNA, binds complementarily to one or more host target binding sites located in untranslated regions of VGAM795 host target RNA, herein designated VGAM HOST TARGET RNA. This complementary binding is due to the fact that the nucleotide sequence of VGAM795 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM795 RNA, herein designated VGAM RNA, may have a different number of host target binding sites in untranslated regions of a VGAM795 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM795 RNA, herein designated VGAM RNA, to host target binding sites on VGAM795 host target RNA, herein designated VGAM HOST TARGET RNA, such as BINDING SITE I, BINDING SITE II and BINDING SITE III, inhibits translation of VGAM795 host target RNA into VGAM795 host target protein, herein designated VGAM HOST TARGET PROTEIN. VGAM host target protein is therefore outlined by a broken line.

It is appreciated that VGAM795 host target gene, herein designated VGAM HOST TARGET GENE, in fact represents a plurality of VGAM795 host target genes. The mRNA of each one of this plurality of VGAM795 host target genes comprises one or more host target binding sites, each having a nucleotide sequence which is at least partly complementary to VGAM795 RNA, herein designated VGAM RNA, and which when bound by VGAM795 RNA causes inhibition of translation of respective one or more VGAM795 host target proteins.

It is further appreciated by one skilled in the art that the mode of translational inhibition illustrated by FIG. 1 with specific reference to translational inhibition exerted by VGAM795 gene, herein designated VGAM GENE, on one or more VGAM795 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM795 is inhibition of expression of host target genes, as part of a novel viral mechanism of attacking a host. Accordingly, utilities of VGAM795 include diagnosis, prevention and treatment of viral infection by Shrimp White Spot Syndrome Virus (white spot bacilliform virus). Specific functions, and accordingly utilities, of VGAM795 correlate with, and may be deduced from, the identity of the host target genes which VGAM795 binds and inhibits, and the function of these host target genes, as elaborated hereinbelow.

Nucleotide sequences of the VGAM795 precursor RNA, herein designated VGAM PRECURSOR RNA, and of the 'diced' VGAM795 RNA, herein designated VGAM RNA, and a schematic representation of the secondary folding of VGAM795 folded precursor RNA, herein designated VGAM FOLDED PRECURSOR RNA, of VGAM795 are further described hereinbelow with reference to Table 1.

Nucleotide sequences of host target binding sites, such as BINDING SITE-I, BINDING SITE-II and BINDING SITE-III of FIG. 1, found on VGAM795 host target RNA, and schematic representation of the complementarity of each of these host target binding sites to VGAM795 RNA, herein designated VGAM RNA, are described hereinbelow with reference to Table 2.

As mentioned hereinabove with reference to FIG. 1, a function of VGAM795 gene, herein designated VGAM is inhibition of expression of VGAM795 target genes. It is appreciated that specific functions, and accordingly utilities, of VGAM795 correlate with, and may be deduced from, the identity of the target genes which VGAM795 binds and inhibits, and the function of these target genes, as elaborated hereinbelow.

Apoptotic Protease Activating Factor (APAF1, Accession NM_001160) is a VGAM795 host target gene. APAF1 BINDING SITE1 and APAF1 BINDING SITE2 are HOST TARGET binding sites found in untranslated regions of mRNA encoded by APAF1, corresponding to HOST TARGET binding sites such as BINDING SITE I, BINDING SITE II or BINDING SITE III. Table 2 illustrates the complementarity of the nucleotide sequences of APAF1 BINDING SITE1 and APAF1 BINDING SITE2, designated SEQ ID:6832 and SEQ ID:14871 respectively, to the nucleotide sequence of VGAM795 RNA, herein designated VGAM RNA, also designated SEQ ID:3506.

A function of VGAM795 is therefore inhibition of Apoptotic Protease Activating Factor (APAF1, Accession NM_001160), a gene which functions in the mitochondrial apoptotic pathway that leads to caspase 9 dependent activation of caspase 3. Accordingly, utilities of VGAM795 include diagnosis, prevention and treatment of diseases and clinical conditions associated with APAF1. The function of APAF1 and its association with various diseases and clinical conditions, has been established by previous studies, as described hereinabove with reference to VGAM552. DEK Oncogene (DNA binding) (DEK, Accession NM_003472) is another VGAM795 host target gene. DEK BINDING SITE is HOST TARGET binding site found in the 3' untranslated region of mRNA encoded by DEK, corresponding to a HOST TARGET binding site such as BINDING SITE I, BINDING SITE II or BINDING SITE III. Table 2 illustrates the complementarity of the nucleotide sequences of DEK BINDING SITE, designated SEQ ID:9538, to the nucleotide sequence of VGAM795 RNA, herein designated VGAM RNA, also designated SEQ ID:3506.

Another function of VGAM795 is therefore inhibition of DEK Oncogene (DNA binding) (DEK, Accession NM_003472), a gene which interacts in transcriptional regulation and signal transduction. Accordingly, utilities of VGAM795 include diagnosis, prevention and treatment of diseases and clinical conditions associated with DEK. The function of DEK has been established by previous studies. By agarose gel electrophoresis analysis of HeLa nuclear extracts, Alexiadis et al. (2000) detected DEK-induced alterations of the superhelical density of DNA in chromatin in the presence of topoisomerase I (TOP1; 126420) or II (TOP2A; 126430). The change in topology was not observed in naked DNA. SDS-PAGE analysis indicated that DEK does not induce displacement of histones but that histone H2A/H2B (see OMIM Ref. No. 142711) is required for the DEK-mediated change in nucleosomal DNA topology. Agarose gel electrophoresis analysis showed that DEK reduces the efficiency with which chromatin is replicated. Pre-mRNA splicing involves the step-wise assembly of large RNA-protein complexes, termed spliceosomes, that contain small nuclear ribonucleoprotein particles (OMIM Ref. No. snRNPs) and many non-snRNP splicing factors, many of which contain RS domains (i.e., alternating arg/ser residues). Members of the SR protein family have N-terminal RNA recognition motifs and a phosphorylated C-terminal RS domain. Using splicing and immunoprecipitation assays, McGarvey et al. (2000) identified DEK as one of the first components of the splicing complex that remains associated with spliced exons dependent on prior splicing of pre-mRNA. The association is mediated by specific interactions involving SR proteins such as SRM160 (OMIM Ref. No. 605975).

Full details of the abovementioned studies are described in the following publications, the disclosure of which are hereby incorporated by reference:

Alexiadis, V.; Waldmann, T.; Andersen, J.; Mann, M.; Knippers, R.; Gruss, C.: The protein encoded by the proto-oncogene DEK changes the topology of chromatin and reduces the efficiency of DNA replication in a chromatin-specific manner. Genes Dev. 14:1308-1312, 2000; and McGarvey, T.; Rosonina, E.; McCracken, S.; Li, Q.; Arnaout, R.; Mientjes, E.; Nickerson, J. A.; Awrey, D.; Greenblatt, J.; Grosveld, G.; Blencowe, B. J.: The acute myeloid leukemia-a.

Further studies establishing the function and utilities of DEK are found in John Hopkins OMIM database record ID 125264, and in sited publications numbered 2005-2009 listed in the bibliography section hereinbelow, which are also hereby incorporated by reference. Egl Nine Homolog 1 (C. elegans) (EGLN1, Accession NM_022051) is another VGAM795 host target gene. EGLN1 BINDING SITE is HOST TARGET binding site found in the 3' untranslated region of mRNA encoded by EGLN1, corresponding to a HOST TARGET binding site such as BINDING SITE I, BINDING SITE II or BINDING SITE III. Table 2 illustrates the complementarity of the nucleotide sequences of EGLN1 BINDING SITE, designated SEQ ID:22587, to the nucleotide sequence of VGAM795 RNA, herein designated VGAM RNA, also designated SEQ ID:3506.

Another function of VGAM795 is therefore inhibition of Egl Nine Homolog 1 (C. elegans) (EGLN1, Accession NM_022051), a gene which is expressed in the cytoplasm of arterial smooth muscle cells. Accordingly, utilities of VGAM795 include diagnosis, prevention and treatment of diseases and clinical conditions associated with EGLN1. The function of EGLN1 and its association with various diseases and clinical conditions, has been established by previous studies, as described hereinabove with reference to VGAM216. Early Growth Response 3 (EGR3, Accession XM_005040) is another VGAM795 host target gene. EGR3 BINDING SITE is HOST TARGET binding site found in the 3' untranslated region of mRNA encoded by EGR3, corresponding to a HOST TARGET binding site such as BINDING SITE I, BINDING SITE II or BINDING SITE III. Table 2 illustrates the complementarity of the nucleotide sequences of EGR3 BINDING SITE, designated SEQ ID:29958, to the nucleotide sequence of VGAM795 RNA, herein designated VGAM RNA, also designated SEQ ID:3506.

Another function of VGAM795 is therefore inhibition of Early Growth Response 3 (EGR3, Accession XM_005040), a gene which is a putative transcription factor. Accordingly, utilities of VGAM795 include diagnosis, prevention and treatment of diseases and clinical conditions associated with EGR3. The function of EGR3 and its association with various diseases and clinical conditions, has been established by previous studies, as described hereinabove with reference to VGAM189. Gamma-aminobutyric Acid (GABA) A Receptor, Pi (GABRP, Accession NM_014211) is another VGAM795 host target gene. GABRP BINDING SITE is HOST TARGET binding site found in the 3' untranslated region of mRNA encoded by GABRP, corresponding to a HOST TARGET binding site such as BINDING SITE I, BINDING SITE II or BINDING SITE III. Table 2 illustrates the complementarity of the nucleotide sequences of GABRP BINDING SITE, designated SEQ ID:15480, to the nucleotide sequence of VGAM795 RNA, herein designated VGAM RNA, also designated SEQ ID:3506.

Another function of VGAM795 is therefore inhibition of Gamma-aminobutyric Acid (GABA) A Receptor, Pi (GABRP, Accession NM_014211), a gene which mediates neuronal inhibition by binding to the gaba/benzodiazepine receptor and opening an integral chloride channel. Accordingly, utilities of VGAM795 include diagnosis, prevention and treatment of diseases and clinical conditions associated with GABRP. The function of GABRP has been established by previous studies. GABA is the major inhibitory neurotransmitter in the mammalian central nervous system and acts by binding to GABA-A receptors (see OMIM Ref. No. 137192). By searching a human EST database with a GABA-A receptor consensus sequence, Hedblom and Kirkness (1997) identified a cDNA encoding GABRP. Sequence analysis revealed that GABRP represented a novel class of GABA-A receptor subunits, being 30 to 40% identical to the 5 subunit classes previously identified. Northern blot analysis showed that the 3.3-kb GABRP mRNA was expressed in several tissues, with particular abundance in the uterus. Hedblom and Kirkness (1997) also cloned cDNAs encoding the rat GABRP homolog. The predicted 440-amino acid sequence of human GABRP is 93% identical to that of rat Gabrp. Expression of human GABRP in mammalian cells indicated that GABRP can combine with other GABA-A receptor subunits and alter the sensitivity of recombinant receptors to modulatory agents such as the steroid pregnanolone. In a review of GABA-A receptors, Whiting et al. (1999) stated that the GABRP gene maps to 5q32-q33.

Full details of the abovementioned studies are described in the following publications, the disclosure of which are hereby incorporated by reference:

Hedblom, E.; Kirkness, E. F.: A novel class of GABA-A receptor subunit in tissues of the reproductive system. J. Biol. Chem. 272:15346-15350, 1997; and Whiting, P. J.; Bonnert, T. P.; McKernan, R. M.; Farrar, S.; le Bourdelles, B.; Heavens, R. P.; Smith, D. W.; Hewson, L.; Rigby, M. R.; Sirinathsinghji, D. J. S.; Thompson, S. A.; Waffo.

Further studies establishing the function and utilities of GABRP are found in John Hopkins OMIM database record ID 602729, and in sited publications numbered 8591 listed in the bibliography section hereinbelow, which are also hereby incorporated by reference. MTERF (Accession NM_006980) is another VGAM795 host target gene. MTERF BINDING SITE is HOST TARGET binding site found in the 3' untranslated region of mRNA encoded by MTERF, corresponding to a HOST TARGET binding site such as BINDING SITE I, BINDING SITE II or BINDING SITE III. Table 2 illustrates the complementarity of the nucleotide sequences of MTERF BINDING SITE, designated SEQ ID:13842, to the nucleotide sequence of VGAM795 RNA, herein designated VGAM RNA, also designated SEQ ID:3506.

Another function of VGAM795 is therefore inhibition of MTERF (Accession NM_006980), a gene which plays a central role in attenuating transcription between the 16S ribosomal RNA and the tRNA-leu genes in the heavy strand of mitochondrial DNA. Accordingly, utilities of VGAM795 include diagnosis, prevention and treatment of diseases and clinical conditions associated with MTERF. The function of MTERF has been established by previous studies. The mitochondrial transcription termination factor, or MTERF, plays a central role in attenuating transcription between the 16S ribosomal RNA (OMIM Ref. No. 561010) and the tRNA-leu (OMIM Ref. No. 590050) genes in the heavy strand of mitochondrial DNA, and therefore is part of the regulatory system that allows high levels of ribosomal RNA expression relative to downstream genes. From HeLa cells, Daga et al. (1993) purified 2 related 34-kD polypeptides that had MTERF activity. Fernandez-Silva et al. (1997) cloned the MTERF cDNA by RT-PCR of HeLa cell mRNA using primers derived from peptide sequences of the purified protein. The cDNA encoded a predicted 399-amino acid protein containing a mitochondrial targeting sequence. The mature MTERF protein is 342 amino acids long and contains 3 leucine zipper and 2 basic domains. Mutational analysis showed that all of these domains are necessary for DNA binding, and that the 2 basic domains are involved in directly binding MTERF to its target DNA sequence. Fernandez-Silva et al. (1997) showed that MTERF binds to DNA as a monomer.

Full details of the abovementioned studies are described in the following publications, the disclosure of which are hereby incorporated by reference:

Daga, A.; Micol, V.; Hess, D.; Aebersold, R.; Attardi, G.: Molecular characterization of the transcription termination factor from human mitochondria. J. Biol. Chem. 268:8123-8130, 1993; and Fernandez-Silva, P.; Martinez-Azorin, F.; Micol, V.; Attardi, G.: The human mitochondrial transcription termination factor (mTERF) is a multizipper protein but binds to DNA as a monome.

Further studies establishing the function and utilities of MTERF are found in John Hopkins OMIM database record ID 602318, and in sited publications numbered 6299-6301 listed in the bibliography section hereinbelow, which are also hereby incorporated by reference. Protein Kinase, CAMP-dependent, Catalytic, Beta (PRKACB, Accession NM_002731) is another VGAM795 host target gene. PRKACB BINDING SITE is HOST TARGET binding site found in the 3' untranslated region of mRNA encoded by PRKACB, corresponding to a HOST TARGET binding site such as BINDING SITE I, BINDING SITE II or BINDING SITE III. Table 2 illustrates the complementarity of the nucleotide sequences of PRKACB BINDING SITE, designated SEQ ID:8604, to the nucleotide sequence of VGAM795 RNA, herein designated VGAM RNA, also designated SEQ ID:3506.

Another function of VGAM795 is therefore inhibition of Protein Kinase, CAMP-dependent, Catalytic, Beta (PRKACB, Accession NM_002731), a gene which is the catalytic beta subunit of cAMP-dependent protein kinase (PKA). Accordingly, utilities of VGAM795 include diagnosis, prevention and treatment of diseases and clinical conditions associated with PRKACB. The function of PRKACB has been established by previous studies. Most of the effects of cAMP in the eukaryotic cell are mediated through the phosphorylation of target proteins on serine or threonine residues by the cAMP-dependent protein kinase (EC 2.7.1.37). The inactive cAMP-dependent protein kinase is a tetramer composed of 2 regulatory and 2 catalytic subunits. The cooperative binding of 4 molecules of cAMP dissociates the enzyme in a regulatory subunit dimer and 2 free active catalytic subunits. In the human, 4 different regulatory subunits (PRKAR1A, 188830; PRKAR1B, 176911; PRKAR2A, 176910; and PRKAR2B, 176912) and 3 catalytic subunits (PRKACA; PRKACB, 176892; and PRKACG 176893) have been identified. Animal model experiments lend further support to the function of PRKACB. The intracellular second messenger cAMP affects cell physiology by directly interacting with effector molecules that include cyclic nucleotide-gated ion channels, cAMP-regulated G protein exchange factors, and cAMP-dependent protein kinases (PKA). Two catalytic subunits, C-alpha (OMIM Ref. No. PRKACA) and C-beta (OMIM Ref. No. PRKACB), are expressed in the mouse and mediate the effects of PKA. Skalhegg et al. (2002) generated a null mutation in the major catalytic subunit of PKA, C-alpha, and observed early postnatal lethality in the majority of C-alpha knockout mice. Surprisingly, a small percentage of C-alpha knockout mice, although runted, survived to adulthood. This growth retardation was not due to decreased GH (OMIM Ref. No. 139250) production but did correlate with a reduction in IGF1 (OMIM Ref. No. 147440) mRNA in the liver and diminished production of the major urinary proteins in kidney. In these animals, compensatory increases in C-beta levels occurred in brain whereas many tissues, including skeletal muscle, heart, and sperm, contained less than 10% of the normal PKA activity. Analysis of sperm in C-alpha knockout males revealed that spermatogenesis progressed normally but that mature sperm had defective forward motility It is appreciated that the abovementioned animal model for PRKACB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Skalhegg, B. S.; Huang, Y.; Su, T.; Idzerda, R. L.; McKnight, G. S.; Burton, K. A. : Mutation of the C-alpha subunit of PKA leads to growth retardation and sperm dysfunction. Molec. Endocr. 16:630-639, 2002; and Tasken, K.; Solberg, R.; Zhao, Y.; Hansson, V.; Jahnsen, T.; Siciliano, M. J.: The gene encoding the catalytic subunit C-alpha of cAMP-dependent protein kinase (locus PRKACA) localize.

Further studies establishing the function and utilities of PRKACB are found in John Hopkins OMIM database record ID 176892, and in sited publications numbered 11263 listed in the bibliography section hereinbelow, which are also hereby incorporated by reference. Protein Kinase, Lysine Deficient 3 (PRKWNK3, Accession XM_029183) is another VGAM795 host target gene. PRKWNK3 BINDING SITE is HOST TARGET binding site found in the 3' untranslated region of mRNA encoded by PRKWNK3, corresponding to a HOST TARGET binding site such as BINDING SITE I, BINDING SITE II or BINDING SITE III. Table 2 illustrates the complementarity of the nucleotide sequences of PRKWNK3 BINDING SITE, designated SEQ ID:30856, to the nucleotide sequence of VGAM795 RNA, herein designated VGAM RNA, also designated SEQ ID:3506.

Another function of VGAM795 is therefore inhibition of Protein Kinase, Lysine Deficient 3 (PRKWNK3, Accession XM_029183). Accordingly, utilities of VGAM795 include diagnosis, prevention and treatment of diseases and clinical conditions associated with PRKWNK3. RAB30, Member RAS Oncogene Family (RAB30, Accession NM_014488) is another VGAM795 host target gene. RAB30 BINDING SITE is HOST TARGET binding site found in the 3' untranslated region of mRNA encoded by RAB30, corresponding to a HOST TARGET binding site such as BINDING SITE I, BINDING SITE II or BINDING SITE III. Table 2 illustrates the complementarity of the nucleotide sequences of RAB30 BINDING SITE, designated SEQ ID:15833, to the nucleotide sequence of VGAM795 RNA, herein designated VGAM RNA, also designated SEQ ID:3506.

Another function of VGAM795 is therefore inhibition of RAB30, Member RAS Oncogene Family (RAB30, Accession NM_014488), a gene which is a GTP-binding protein. Accordingly, utilities of VGAM795 include diagnosis, prevention and treatment of diseases and clinical conditions associated with RAB30. The function of RAB30 has been established by previous studies. Chen et al. (1996) isolated a cDNA encoding RAB30, a small GTP-binding protein of the RAB family, from a human melanocyte cDNA library and from melanoma cells. The deduced 203-amino acid RAB30 protein shares minimal homology with previously documented GTPases. Northern blot analysis detected RAB30 transcripts ranging from 1.7 to 11 kb in most tissues tested. By somatic cell hybrid analysis, Chen et al. (1996) mapped the RAB30 gene to chromosome 11. Scott (2001) localized the RAB30 gene to 11q12-q14 based on sequence similarity between the RAB30 sequence (GenBank U57092) and chromosome 11 clones (GenBank AP000893 and AP000905).

Full details of the abovementioned studies are described in the following publications, the disclosure of which are hereby incorporated by reference:

Chen, D.; Guo, J.; Miki, T.; Tachibana, M.; Gahl, W. A.: Molecular cloning of two novel rab genes from human melanocytes. Gene 174:129-134, 1996; and Scott, A. F.: Personal Communication. Baltimore, Md., Feb. 26, 2001.

Further studies establishing the function and utilities of RAB30 are found in John Hopkins OMIM database record ID 605693, and in sited publications numbered 6469 listed in the bibliography section hereinbelow, which are also hereby incorporated by reference. Retinoblastoma 1 (including osteosarcoma) (RB1, Accession XM_165641) is another VGAM795 host target gene. RB1 BINDING SITE is HOST TARGET binding site found in the 3' untranslated region of mRNA encoded by RB1, corresponding to a HOST TARGET binding site such as BINDING SITE I, BINDING SITE II or BINDING SITE III. Table 2 illustrates the complementarity of the nucleotide sequences of RB1 BINDING SITE, designated SEQ ID:43706, to the nucleotide sequence of VGAM795 RNA, herein designated VGAM RNA, also designated SEQ ID:3506.

Another function of VGAM795 is therefore inhibition of Retinoblastoma 1 (including osteosarcoma) (RB1, Accession XM_165641), a gene which probably acts as a regulator of other genes. Accordingly, utilities of VGAM795 include diagnosis, prevention and treatment of diseases and clinical conditions associated with RB1. The function of RB1 has been established by previous studies. Retinoblastoma (RB) is an embryonic neoplasm of retinal origin. It almost always presents in early childhood and is often bilateral. Spontaneous regression (OMIM Ref. No. 'cure') occurs in some cases. Connolly et al. (1983) reported a 4-generation family with 3 patterns of expression of the retinoblastoma gene: frank retinoblastoma, unilateral or bilateral; retinoma; and no visible retinal pathology except for 'normal degeneration' with age. ('Paving stone degeneration' of the type observed in 2 of 3 RB carriers, aged 49 and 59, is said by Duane (1980) to occur in about 20% of the adult population.) Gallie and Phillips (1982) described benign lesions in the retina in retinoblastoma patients. The distinctive characteristics of these lesions, referred to by the authors as retinomas, included a translucent, grayish retinal mass protruding into the vitreous, 'cottage-cheese' calcification in 75%, and retinal pigment epithelial migration and proliferation in 60%. They suggested that retinomas represent not the heterozygous state postulated by the Knudson 2-stage model of carcinogenesis but rather the homozygous state occurring in differentiated cell (s). Gallie et al. (1982) suggested that retinomas represent either spontaneous regression of a retinoblastoma or a benign manifestation of the RB gene. Animal model experiments lend further support to the function of RB1. Windle et al. (1990) created transgenic mice by microinjecting fertilized ova with a chimeric gene containing the protein coding region of the SV40 T antigen (Tag) driven by the promoter of the luteinizing hormone beta-subunit gene. One of the male founders developed bilateral retinoblastomas at about age 5 months. The phenotype was heritable with complete penetrance in transgenic offspring in whom the tumors were first observed at about 2 months. Windle et al. (1990) demonstrated specific association between p105(Rb) and T antigen in mouse retinoblastoma tumor cells. Thus, evidence is provided for oncogenesis due to the ocular-specific expression of an Rb-binding oncoprotein that can functionally inactivate the Rb protein.

It is appreciated that the abovementioned animal model for RB1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Connolly, M. J.; Payne, R. H.; Johnson, G.; Gallie, B. L.; Allderdice, P. W.; Marshall, W. H.; Lawton, R. D.: Familial, EsD-linked, retinoblastoma with reduced penetrance and variable expressivity. Hum. Genet. 65:122-124, 1983; and Gallie, B. L.; Ellsworth, R. M.; Abramson, D. M.; Phillips, R. A.: Retinoma: spontaneous regression of retinoblastoma or benign manifestation of the mutation? Brit. J. Cancer 45:513-5.

Further studies establishing the function and utilities of RB1 are found in John Hopkins OMIM database record ID 180200, and in sited publications numbered 11148-11159, 10077-10078, 43, 82-87, 2358-2378, 4980-2384, 705-711, 4714-715, 3239-730, 5644-5656, 16 and 5657-5664 listed in the bibliography section hereinbelow, which are also hereby incorporated by reference. Transforming Growth Factor, Beta Receptor III (betaglycan, 300 kDa) (TGFBR3, Accession NM_003243) is another VGAM795 host target gene. TGFBR3 BINDING SITE is HOST TARGET binding site found in the 3' untranslated region of mRNA encoded by TGFBR3, corresponding to a HOST TARGET binding site such as BINDING SITE I, BINDING SITE II or BINDING SITE III. Table 2 illustrates the complementarity of the nucleotide sequences of TGFBR3 BINDING SITE, designated SEQ ID:9252, to the nucleotide sequence of VGAM795

RNA, herein designated VGAM RNA, also designated SEQ ID:3506.

Another function of VGAM795 is therefore inhibition of Transforming Growth Factor, Beta Receptor III (betaglycan, 300 kDa) (TGFBR3, Accession NM_003243), a gene which involves in capturing and retaining TGF-beta for presentation to the signaling receptors. Accordingly, utilities of VGAM795 include diagnosis, prevention and treatment of diseases and clinical conditions associated with TGFBR3. The function of TGFBR3 and its association with various diseases and clinical conditions, has been established by previous studies, as described hereinabove with reference to VGAM139. APCL (Accession NM_005883) is another VGAM795 host target gene. APCL BINDING SITE is HOST TARGET binding site found in the 3' untranslated region of mRNA encoded by APCL, corresponding to a HOST TARGET binding site such as BINDING SITE I, BINDING SITE II or BINDING SITE III. Table 2 illustrates the complementarity of the nucleotide sequences of APCL BINDING SITE, designated SEQ ID:12499, to the nucleotide sequence of VGAM795 RNA, herein designated VGAM RNA, also designated SEQ ID:3506.

Another function of VGAM795 is therefore inhibition of APCL (Accession NM_005883). Accordingly, utilities of VGAM795 include diagnosis, prevention and treatment of diseases and clinical conditions associated with APCL. Cat Eye Syndrome Chromosome Region, Candidate 7 (CECR7, Accession XM_086803) is another VGAM795 host target gene. CECR7 BINDING SITE is HOST TARGET binding site found in the 5' untranslated region of mRNA encoded by CECR7, corresponding to a HOST TARGET binding site such as BINDING SITE I, BINDING SITE II or BINDING SITE III. Table 2 illustrates the complementarity of the nucleotide sequences of CECR7 BINDING SITE, designated SEQ ID:38882, to the nucleotide sequence of VGAM795 RNA, herein designated VGAM RNA, also designated SEQ ID:3506.

Another function of VGAM795 is therefore inhibition of Cat Eye Syndrome Chromosome Region, Candidate 7 (CECR7, Accession XM_086803). Accordingly, utilities of VGAM795 include diagnosis, prevention and treatment of diseases and clinical conditions associated with CECR7. FHX (Accession NM_018416) is another VGAM795 host target gene. FHX BINDING SITE is HOST TARGET binding site found in the 3' untranslated region of mRNA encoded by FHX, corresponding to a HOST TARGET binding site such as BINDING SITE I, BINDING SITE II or BINDING SITE III. Table 2 illustrates the complementarity of the nucleotide sequences of FHX BINDING SITE, designated SEQ ID:20459, to the nucleotide sequence of VGAM795 RNA, herein designated VGAM RNA, also designated SEQ ID:3506.

Another function of VGAM795 is therefore inhibition of FHX (Accession NM_018416). Accordingly, utilities of VGAM795 include diagnosis, prevention and treatment of diseases and clinical conditions associated with FHX. FLJ10079 (Accession XM_012540) is another VGAM795 host target gene. FLJ10079 BINDING SITE is HOST TARGET binding site found in the 3" untranslated region of mRNA encoded by FLJ10079, corresponding to a HOST TARGET binding site such as BINDING SITE I, BINDING SITE II or BINDING SITE III. Table 2 illustrates the complementarity of the nucleotide sequences of FLJ10079 BINDING SITE, designated SEQ ID:30217, to the nucleotide sequence of VGAM795 RNA, herein designated VGAM RNA, also designated SEQ ID:3506.

Another function of VGAM795 is therefore inhibition of FLJ10079 (Accession XM_012540). Accordingly, utilities of VGAM795 include diagnosis, prevention and treatment of diseases and clinical conditions associated with FLJ10079. FLJ20371 (Accession NM_017791) is another VGAM795 host target gene. FLJ20371 BINDING SITE is HOST TARGET binding site found in the 3' untranslated region of mRNA encoded by FLJ20371, corresponding to a HOST TARGET binding site such as BINDING SITE I, BINDING SITE II or BINDING SITE III. Table 2 illustrates the complementarity of the nucleotide sequences of FLJ20371 BINDING SITE, designated SEQ ID:19425, to the nucleotide sequence of VGAM795 RNA, herein designated VGAM RNA, also designated SEQ ID:3506.

Another function of VGAM795 is therefore inhibition of FLJ20371 (Accession NM_017791). Accordingly, utilities of VGAM795 include diagnosis, prevention and treatment of diseases and clinical conditions associated with FLJ20371. FLJ22408 (Accession NM_024794) is another VGAM795 host target gene. FLJ22408 BINDING SITE is HOST TARGET binding site found in the 5' untranslated region of mRNA encoded by FLJ22408, corresponding to a HOST TARGET binding site such as BINDING SITE I, BINDING SITE II or BINDING SITE III. Table 2 illustrates the complementarity of the nucleotide sequences of FLJ22408 BINDING SITE, designated SEQ ID:24174, to the nucleotide sequence of VGAM795 RNA, herein designated VGAM RNA, also designated SEQ ID:3506.

Another function of VGAM795 is therefore inhibition of FLJ22408 (Accession NM_024794). Accordingly, utilities of VGAM795 include diagnosis, prevention and treatment of diseases and clinical conditions associated with FLJ22408. FLJ22471 (Accession NM_025140) is another VGAM795 host target gene. FLJ22471 BINDING SITE is HOST TARGET binding site found in the 3' untranslated region of mRNA encoded by FLJ22471, corresponding to a HOST TARGET binding site such as BINDING SITE I, BINDING SITE II or BINDING SITE III. Table 2 illustrates the complementarity of the nucleotide sequences of FLJ22471 BINDING SITE, designated SEQ ID:24779, to the nucleotide sequence of VGAM795 RNA, herein designated VGAM RNA, also designated SEQ ID:3506.

Another function of VGAM795 is therefore inhibition of FLJ22471 (Accession NM_025140). Accordingly, utilities of VGAM795 include diagnosis, prevention and treatment of diseases and clinical conditions associated with FLJ22471. Glutamate Receptor, Ionotropic, N-methyl-D-aspartate 3A (GRIN3A, Accession NM_133445) is another VGAM795 host target gene. GRIN3A BINDING SITE is HOST TARGET binding site found in the 3' untranslated region of mRNA encoded by GRIN3A, corresponding to a HOST TARGET binding site such as BINDING SITE I, BINDING SITE II or BINDING SITE III. Table 2 illustrates the complementarity of the nucleotide sequences of GRIN3A BINDING SITE, designated SEQ ID:28534, to the nucleotide sequence of VGAM795 RNA, herein designated VGAM RNA, also designated SEQ ID:3506.

Another function of VGAM795 is therefore inhibition of Glutamate Receptor, Ionotropic, N-methyl-D-aspartate 3A (GRIN3A, Accession NM_133445). Accordingly, utilities of VGAM795 include diagnosis, prevention and treatment of diseases and clinical conditions associated with GRIN3A. KIAA0286 (Accession XM_043118) is another VGAM795 host target gene. KIAA0286 BINDING SITE is HOST TARGET binding site found in the 3" untranslated region of mRNA encoded by KIAA0286, corresponding to a HOST TARGET binding site such as BINDING SITE I, BINDING SITE II or BINDING SITE III. Table 2 illustrates the complementarity of the nucleotide sequences of KIAA0286 BINDING SITE, designated SEQ ID:33908, to the nucleotide sequence of VGAM795 RNA, herein designated VGAM RNA, also designated SEQ ID:3506.

Another function of VGAM795 is therefore inhibition of KIAA0286 (Accession XM_043118). Accordingly, utilities of VGAM795 include diagnosis, prevention and treatment of diseases and clinical conditions associated with KIAA0286. KIAA0471 (Accession NM_014857) is another VGAM795 host target gene. KIAA0471 BINDING SITE is HOST TARGET binding site found in the 3' untranslated region of mRNA encoded by KIAA0471, corresponding to a HOST TARGET binding site such as BINDING SITE I, BINDING SITE II or BINDING SITE III. Table 2 illustrates the complementarity of the nucleotide sequences of KIAA0471 BINDING SITE, designated SEQ ID:16917, to the nucleotide sequence of VGAM795 RNA, herein designated VGAM RNA, also designated SEQ ID:3506.

Another function of VGAM795 is therefore inhibition of KIAA0471 (Accession NM_014857). Accordingly, utilities of VGAM795 include diagnosis, prevention and treatment of diseases and clinical conditions associated with KIAA0471. KIAA0523 (Accession XM_041964) is another VGAM795 host target gene. KIAA0523 BINDING SITE is HOST TARGET binding site found in the 3' untranslated region of mRNA encoded by KIAA0523, corresponding to a HOST TARGET binding site such as BINDING SITE I, BINDING SITE II or BINDING SITE III. Table 2 illustrates the complementarity of the nucleotide sequences of KIAA0523 BINDING SITE, designated SEQ ID:33649, to the nucleotide sequence of VGAM795 RNA, herein designated VGAM RNA, also designated SEQ ID:3506.

Another function of VGAM795 is therefore inhibition of KIAA0523 (Accession XM_041964). Accordingly, utilities of VGAM795 include diagnosis, prevention and treatment of diseases and clinical conditions associated with KIAA0523. KIAA0560 (Accession XM_029045) is another VGAM795 host target gene. KIAA0560 BINDING SITE is HOST TARGET binding site found in the 3' untranslated region of mRNA encoded by KIAA0560, corresponding to a HOST TARGET binding site such as BINDING SITE I, BINDING SITE II or BINDING SITE III. Table 2 illustrates the complementarity of the nucleotide sequences of KIAA0560 BINDING SITE, designated SEQ ID:30839, to the nucleotide sequence of VGAM795 RNA, herein designated VGAM RNA, also designated SEQ ID:3506.

Another function of VGAM795 is therefore inhibition of KIAA0560 (Accession XM_029045). Accordingly, utilities of VGAM795 include diagnosis, prevention and treatment of diseases and clinical conditions associated with KIAA0560. KIAA1069 (Accession XM_042635) is another VGAM795 host target gene. KIAA1069 BINDING SITE is HOST TARGET binding site found in the 3' untranslated region of mRNA encoded by KIAA1069, corresponding to a HOST TARGET binding site such as BINDING SITE I, BINDING SITE II or BINDING SITE III. Table 2 illustrates the complementarity of the nucleotide sequences of KIAA1069 BINDING SITE, designated SEQ ID:33727, to the nucleotide sequence of VGAM795 RNA, herein designated VGAM RNA, also designated SEQ ID:3506.

Another function of VGAM795 is therefore inhibition of KIAA1069 (Accession XM_042635). Accordingly, utilities of VGAM795 include diagnosis, prevention and treatment of diseases and clinical conditions associated with KIAA1069. Neurexophilin 3 (NXPH3, Accession XM_037847) is another VGAM795 host target gene. NXPH3 BINDING SITE is HOST TARGET binding site found in the 3' untranslated region of mRNA encoded by NXPH3, corresponding to a HOST TARGET binding site such as BINDING SITE I, BINDING SITE II or BINDING SITE III. Table 2 illustrates the complementarity of the nucleotide sequences of NXPH3 BINDING SITE, designated SEQ ID:32724, to the nucleotide sequence of VGAM795 RNA, herein designated VGAM RNA, also designated SEQ ID:3506.

Another function of VGAM795 is therefore inhibition of Neurexophilin 3 (NXPH3, Accession XM_037847). Accordingly, utilities of VGAM795 include diagnosis, prevention and treatment of diseases and clinical conditions associated with NXPH3. PFTAIRE Protein Kinase 1 (PFTK1, Accession NM_012395) is another VGAM795 host target gene. PFTK1 BINDING SITE is HOST TARGET binding site found in the 3' untranslated region of mRNA encoded by PFTK1, corresponding to a HOST TARGET binding site such as BINDING SITE I, BINDING SITE II or BINDING SITE III. Table 2 illustrates the complementarity of the nucleotide sequences of PFTK1 BINDING SITE, designated SEQ ID:14755, to the nucleotide sequence of VGAM795 RNA, herein designated VGAM RNA, also designated SEQ ID:3506.

Another function of VGAM795 is therefore inhibition of PFTAIRE Protein Kinase 1 (PFTK1, Accession NM_012395). Accordingly, utilities of VGAM795 include diagnosis, prevention and treatment of diseases and clinical conditions associated with PFTK1. PRO2893 (Accession NM_018634) is another VGAM795 host target gene. PRO2893 BINDING SITE is HOST TARGET binding site found in the 5' untranslated region of mRNA encoded by PRO2893, corresponding to a HOST TARGET binding site such as BINDING SITE I, BINDING SITE II or BINDING SITE III. Table 2 illustrates the complementarity of the nucleotide sequences of PRO2893 BINDING SITE, designated SEQ ID:20705, to the nucleotide sequence of VGAM795 RNA, herein designated VGAM RNA, also designated SEQ ID:3506.

Another function of VGAM795 is therefore inhibition of PRO2893 (Accession NM_018634). Accordingly, utilities of VGAM795 include diagnosis, prevention and treatment of diseases and clinical conditions associated with PRO2893. ZFP (Accession NM_018651) is another VGAM795 host target gene. ZFP BINDING SITE is HOST TARGET binding site found in the 3' untranslated region of mRNA encoded by ZFP, corresponding to a HOST TARGET binding site such as BINDING SITE I, BINDING SITE II or BINDING SITE III. Table 2 illustrates the complementarity of the nucleotide sequences of ZFP BINDING SITE, designated SEQ ID:20721, to the nucleotide sequence of VGAM795 RNA, herein designated VGAM RNA, also designated SEQ ID:3506.

Another function of VGAM795 is therefore inhibition of ZFP (Accession NM_018651). Accordingly, utilities of VGAM795 include diagnosis, prevention and treatment of diseases and clinical conditions associated with ZFP. LOC124599 (Accession XM_064218) is another VGAM795 host target gene. LOC124599 BINDING SITE is HOST TARGET binding site found in the 3' untranslated region of mRNA encoded by LOC124599, corresponding to a HOST TARGET binding site such as BINDING SITE I, BINDING SITE II or BINDING SITE III. Table 2 illustrates the complementarity of the nucleotide sequences of LOC124599 BINDING SITE, designated SEQ ID:37258, to the nucleotide sequence of VGAM795 RNA, herein designated VGAM RNA, also designated SEQ ID:3506.

Another function of VGAM795 is therefore inhibition of LOC124599 (Accession XM_064218). Accordingly, utilities of VGAM795 include diagnosis, prevention and treatment of diseases and clinical conditions associated with LOC124599.

LOC145622 (Accession XM_085186) is another VGAM795 host target gene. LOC145622 BINDING SITE is HOST TARGET binding site found in the 3' untranslated region of mRNA encoded by LOC145622, corresponding to a HOST TARGET binding site such as BINDING SITE I, BINDING SITE II or BINDING SITE III. Table 2 illustrates the complementarity of the nucleotide sequences of LOC145622 BINDING SITE, designated SEQ ID:37909, to the nucleotide sequence of VGAM795 RNA, herein designated VGAM RNA, also designated SEQ ID:3506.

Another function of VGAM795 is therefore inhibition of LOC145622 (Accession XM_085186). Accordingly, utilities of VGAM795 include diagnosis, prevention and treatment of diseases and clinical conditions associated with LOC145622.

LOC148479 (Accession XM_086204) is another VGAM795 host target gene. LOC148479 BINDING SITE is HOST TARGET binding site found in the 3' untranslated region of mRNA encoded by LOC148479, corresponding to a HOST TARGET binding site such as BINDING SITE I, BINDING SITE II or BINDING SITE III. Table 2 illustrates the complementarity of the nucleotide sequences of LOC148479 BINDING SITE, designated SEQ ID:38544, to the nucleotide sequence of VGAM795 RNA, herein designated VGAM RNA, also designated SEQ ID:3506.

Another function of VGAM795 is therefore inhibition of LOC148479 (Accession XM_086204). Accordingly, utilities of VGAM795 include diagnosis, prevention and treatment of diseases and clinical conditions associated with LOC148479.

LOC151996 (Accession XM_098151) is another VGAM795 host target gene. LOC151996 BINDING SITE is HOST TARGET binding site found in the 5' untranslated region of mRNA encoded by LOC151996, corresponding to a HOST TARGET binding site such as BINDING SITE I, BINDING SITE II or BINDING SITE III. Table 2 illustrates the complementarity of the nucleotide sequences of LOC151996 BINDING SITE, designated SEQ ID:41418, to the nucleotide sequence of VGAM795 RNA, herein designated VGAM RNA, also designated SEQ ID:3506.

Another function of VGAM795 is therefore inhibition of LOC151996 (Accession XM_098151). Accordingly, utilities of VGAM795 include diagnosis, prevention and treatment of diseases and clinical conditions associated with LOC151996.

LOC152674 (Accession XM_098251) is another VGAM795 host target gene. LOC152674 BINDING SITE is HOST TARGET binding site found in the 5' untranslated region of mRNA encoded by LOC152674, corresponding to a HOST TARGET binding site such as BINDING SITE I, BINDING SITE II or BINDING SITE III. Table 2 illustrates the complementarity of the nucleotide sequences of LOC152674 BINDING SITE, designated SEQ ID:41540, to the nucleotide sequence of VGAM795 RNA, herein designated VGAM RNA, also designated SEQ ID:3506.

Another function of VGAM795 is therefore inhibition of LOC152674 (Accession XM_098251). Accordingly, utilities of VGAM795 include diagnosis, prevention and treatment of diseases and clinical conditions associated with LOC152674.

LOC154743 (Accession XM_088029) is another VGAM795 host target gene. LOC154743 BINDING SITE is HOST TARGET binding site found in the 3' untranslated region of mRNA encoded by LOC154743, corresponding to a HOST TARGET binding site such as BINDING SITE I, BINDING SITE II or BINDING SITE III. Table 2 illustrates the complementarity of the nucleotide sequences of LOC154743 BINDING SITE, designated SEQ ID:39482, to the nucleotide sequence of VGAM795 RNA, herein designated VGAM RNA, also designated SEQ ID:3506.

Another function of VGAM795 is therefore inhibition of LOC154743 (Accession XM_088029). Accordingly, utilities of VGAM795 include diagnosis, prevention and treatment of diseases and clinical conditions associated with LOC154743.

LOC163231 (Accession XM_092094) is another VGAM795 host target gene. LOC163231 BINDING SITE is HOST TARGET binding site found in the 5' untranslated region of mRNA encoded by LOC163231, corresponding to a HOST TARGET binding site such as BINDING SITE I, BINDING SITE II or BINDING SITE III. Table 2 illustrates the complementarity of the nucleotide sequences of LOC163231 BINDING SITE, designated SEQ ID:40102, to the nucleotide sequence of VGAM795 RNA, herein designated VGAM RNA, also designated SEQ ID:3506.

Another function of VGAM795 is therefore inhibition of LOC163231 (Accession XM_092094). Accordingly, utilities of VGAM795 include diagnosis, prevention and treatment of diseases and clinical conditions associated with LOC163231.

LOC200845 (Accession XM_114305) is another VGAM795 host target gene. LOC200845 BINDING SITE is HOST TARGET binding site found in the 3' untranslated region of mRNA encoded by LOC200845, corresponding to a HOST TARGET binding site such as BINDING SITE I, BINDING SITE II or BINDING SITE III. Table 2 illustrates the complementarity of the nucleotide sequences of LOC200845 BINDING SITE, designated SEQ ID:42865, to the nucleotide sequence of VGAM795 RNA, herein designated VGAM RNA, also designated SEQ ID:3506.

Another function of VGAM795 is therefore inhibition of LOC200845 (Accession XM_114305). Accordingly, utilities of VGAM795 include diagnosis, prevention and treatment of diseases and clinical conditions associated with LOC200845.

LOC219700 (Accession XM_167570) is another VGAM795 host target gene. LOC219700 BINDING SITE is HOST TARGET binding site found in the 5' untranslated region of mRNA encoded by LOC219700, corresponding to a HOST TARGET binding site such as BINDING SITE I, BINDING SITE II or BINDING SITE III. Table 2 illustrates the complementarity of the nucleotide sequences of LOC219700 BINDING SITE, designated SEQ ID:44703, to the nucleotide sequence of VGAM795 RNA, herein designated VGAM RNA, also designated SEQ ID:3506.

Another function of VGAM795 is therefore inhibition of LOC219700 (Accession XM_167570). Accordingly, utilities of VGAM795 include diagnosis, prevention and treatment of diseases and clinical conditions associated with LOC219700.

LOC221468 (Accession NM_145316) is another VGAM795 host target gene. LOC221468 BINDING SITE is HOST TARGET binding site found in the 3' untranslated region of mRNA encoded by LOC221468, corresponding to a HOST TARGET binding site such as BINDING SITE I, BINDING SITE II or BINDING SITE III. Table 2 illustrates the complementarity of the nucleotide sequences of LOC221468 BINDING SITE, designated SEQ ID:29828, to the nucleotide sequence of VGAM795 RNA, herein designated VGAM RNA, also designated SEQ ID:3506.

Another function of VGAM795 is therefore inhibition of LOC221468 (Accession NM_145316). Accordingly, utilities of VGAM795 include diagnosis, prevention and treatment of diseases and clinical conditions associated with LOC221468.

LOC254042 (Accession XM_171022) is another VGAM795 host target gene. LOC254042 BINDING SITE is HOST TARGET binding site found in the 3' untranslated region of mRNA encoded by LOC254042, corresponding to a HOST TARGET binding site such as BINDING SITE I, BINDING SITE II or BINDING SITE III. Table 2 illustrates the complementarity of the nucleotide sequences of LOC254042 BINDING SITE, designated SEQ ID:45792, to the nucleotide sequence of VGAM795 RNA, herein designated VGAM RNA, also designated SEQ ID:3506.

Another function of VGAM795 is therefore inhibition of LOC254042 (Accession XM_171022). Accordingly, utilities of VGAM795 include diagnosis, prevention and treatment of diseases and clinical conditions associated with LOC254042. LOC90075 (Accession XM_028742) is another VGAM795 host target gene. LOC90075 BINDING SITE1 and LOC90075 BINDING SITE2 are HOST TARGET binding sites found in untranslated regions of mRNA encoded by LOC90075, corresponding to HOST TARGET binding sites such as BINDING SITE I, BINDING SITE II or BINDING SITE III. Table 2 illustrates the complementarity of the nucleotide sequences of LOC90075 BINDING SITE1 and LOC90075 BINDING SITE2, designated SEQ ID:30738 and SEQ ID:30740 respectively, to the nucleotide sequence of VGAM795 RNA, herein designated VGAM RNA, also designated SEQ ID:3506.

Another function of VGAM795 is therefore inhibition of LOC90075 (Accession XM_028742). Accordingly, utilities of VGAM795 include diagnosis, prevention and treatment of diseases and clinical conditions associated with LOC90075. LOC90982 (Accession XM_035332) is another VGAM795 host target gene. LOC90982 BINDING SITE is HOST TARGET binding site found in the 5' untranslated region of mRNA encoded by LOC90982, corresponding to a HOST TARGET binding site such as BINDING SITE I, BINDING SITE II or BINDING SITE III. Table 2 illustrates the complementarity of the nucleotide sequences of LOC90982 BINDING SITE, designated SEQ ID:32235, to the nucleotide sequence of VGAM795 RNA, herein designated VGAM RNA, also designated SEQ ID:3506.

Another function of VGAM795 is therefore inhibition of LOC90982 (Accession XM_035332). Accordingly, utilities of VGAM795 include diagnosis, prevention and treatment of diseases and clinical conditions associated with LOC90982. LOC92391 (Accession XM_044793) is another VGAM795 host target gene. LOC92391 BINDING SITE is HOST TARGET binding site found in the 3' untranslated region of mRNA encoded by LOC92391, corresponding to a HOST TARGET binding site such as BINDING SITE I, BINDING SITE II or BINDING SITE III. Table 2 illustrates the complementarity of the nucleotide sequences of LOC92391 BINDING SITE, designated SEQ ID:34274, to the nucleotide sequence of VGAM795 RNA, herein designated VGAM RNA, also designated SEQ ID:3506.

Another function of VGAM795 is therefore inhibition of LOC92391 (Accession XM_044793). Accordingly, utilities of VGAM795 include diagnosis, prevention and treatment of diseases and clinical conditions associated with LOC92391.

FIG. 1 further provides a conceptual description of a novel bioinformatically detected viral gene of the present invention, referred to here as Viral Genomic Address Messenger 796 (VGAM796) viral gene, which modulates expression of respective host target genes thereof, the function and utility of which host target genes is known in the art.

VGAM796 is a novel bioinformatically detected regulatory, non protein coding, viral micro RNA (miRNA) gene. The method by which VGAM796 was detected is described hereinabove with reference to FIGS. 1-8.

VGAM796 gene, herein designated VGAM GENE, is a viral gene contained in the genome of Shrimp White Spot Syndrome Virus (white spot bacilliform virus). VGAM796 host target gene, herein designated VGAM HOST TARGET GENE, is a human gene contained in the human genome.

VGAM796 gene encodes a VGAM796 precursor RNA, herein designated VGAM PRECURSOR RNA. Similar to other miRNA genes, and unlike most ordinary genes, VGAM796 precursor RNA does not encode a protein. A nucleotide sequence identical or highly similar to the nucleotide sequence of VGAM796 precursor RNA is designated SEQ ID:782, and is provided hereinbelow with reference to the sequence listing part. Nucleotide sequence SEQ ID:782 is located at position 85864 relative to the genome of Shrimp White Spot Syndrome Virus (white spot bacilliform virus).

VGAM796 precursor RNA folds onto itself, forming VGAM796 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM796 folded precursor RNA into VGAM796 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM796 RNA is designated SEQ ID:3507, and is provided hereinbelow with reference to the sequence listing part.

VGAM796 host target gene, herein designated VGAM HOST TARGET GENE, encodes a corresponding messenger RNA, VGAM796 host target RNA, herein designated VGAM HOST TARGET RNA. VGAM796 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM796 RNA, herein designated VGAM RNA, binds complementarily to one or more host target binding sites located in untranslated regions of VGAM796 host target RNA, herein designated VGAM HOST TARGET RNA. This complementary binding is due to the fact that the nucleotide sequence of VGAM796 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM796 RNA, herein designated VGAM RNA, may have a different number of host target binding sites in untranslated regions of a VGAM796 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM796 RNA, herein designated VGAM RNA, to host target binding sites on VGAM796 host target RNA, herein designated VGAM HOST TARGET RNA, such as BINDING SITE I, BINDING SITE II and BINDING SITE III, inhibits translation of VGAM796 host target RNA into VGAM796 host target protein, herein designated VGAM HOST TARGET PROTEIN.

VGAM host target protein is therefore outlined by a broken line.

It is appreciated that VGAM796 host target gene, herein designated VGAM HOST TARGET GENE, in fact represents a plurality of VGAM796 host target genes. The mRNA of each one of this plurality of VGAM796 host target genes comprises one or more host target binding sites, each having a nucleotide sequence which is at least partly complementary to VGAM796 RNA, herein designated VGAM RNA, and which when bound by VGAM796 RNA causes inhibition of translation of respective one or more VGAM796 host target proteins.

It is further appreciated by one skilled in the art that the mode of translational inhibition illustrated by FIG. 1 with specific reference to translational inhibition exerted by VGAM796 gene, herein designated VGAM GENE, on one or more VGAM796 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM796 is inhibition of expression of host target genes, as part of a novel viral mechanism of attacking a host. Accordingly, utilities of VGAM796 include diagnosis, prevention and treatment of viral infection by Shrimp White Spot Syndrome Virus (white spot bacilliform virus). Specific functions, and accordingly utilities, of VGAM796 correlate with, and may be deduced from, the identity of the host target genes which VGAM796 binds and inhibits, and the function of these host target genes, as elaborated hereinbelow.

Nucleotide sequences of the VGAM796 precursor RNA, herein designated VGAM PRECURSOR RNA, and of the 'diced' VGAM796 RNA, herein designated VGAM RNA, and a schematic representation of the secondary folding of VGAM796 folded precursor RNA, herein designated VGAM FOLDED PRECURSOR RNA, of VGAM796 are further described hereinbelow with reference to Table 1.

Nucleotide sequences of host target binding sites, such as BINDING SITE-I, BINDING SITE-II and BINDING SITE-III of FIG. 1, found on VGAM796 host target RNA, and schematic representation of the complementarity of each of these host target binding sites to VGAM796 RNA, herein designated VGAM RNA, are described hereinbelow with reference to Table 2.

As mentioned hereinabove with reference to FIG. 1, a function of VGAM796 gene, herein designated VGAM is inhibition of expression of VGAM796 target genes. It is appreciated that specific functions, and accordingly utilities, of VGAM796 correlate with, and may be deduced from, the identity of the target genes which VGAM796 binds and inhibits, and the function of these target genes, as elaborated hereinbelow.

FLJ10842 (Accession NM_018238) is a VGAM796 host target gene. FLJ10842 BINDING SITE is HOST TARGET binding site found in the 3' untranslated region of mRNA encoded by FLJ10842, corresponding to a HOST TARGET binding site such as BINDING SITE I, BINDING SITE II or BINDING SITE III. Table 2 illustrates the complementarity of the nucleotide sequences of FLJ10842 BINDING SITE, designated SEQ ID:20186, to the nucleotide sequence of VGAM796 RNA, herein designated VGAM RNA, also designated SEQ ID:3507.

A function of VGAM796 is therefore inhibition of FLJ10842 (Accession NM_018238). Accordingly, utilities of VGAM796 include diagnosis, prevention and treatment of diseases and clinical conditions associated with FLJ10842. LOC202309 (Accession XM_117375) is another VGAM796 host target gene. LOC202309 BINDING SITE is HOST TARGET binding site found in the 5' untranslated region of mRNA encoded by LOC202309, corresponding to a HOST TARGET binding site such as BINDING SITE I, BINDING SITE II or BINDING SITE III. Table 2 illustrates the complementarity of the nucleotide sequences of LOC202309 BINDING SITE, designated SEQ ID:43421, to the nucleotide sequence of VGAM796 RNA, herein designated VGAM RNA, also designated SEQ ID:3507.

Another function of VGAM796 is therefore inhibition of LOC202309 (Accession XM_117375). Accordingly, utilities of VGAM796 include diagnosis, prevention and treatment of diseases and clinical conditions associated with LOC202309. FIG. 1 further provides a conceptual description of a novel bioinformatically detected viral gene of the present invention, referred to here as Viral Genomic Address Messenger 797 (VGAM797) viral gene, which modulates expression of respective host target genes thereof, the function and utility of which host target genes is known in the art.

VGAM797 is a novel bioinformatically detected regulatory, non protein coding, viral micro RNA (miRNA) gene. The method by which VGAM797 was detected is described hereinabove with reference to FIGS. 1-8.

VGAM797 gene, herein designated VGAM GENE, is a viral gene contained in the genome of Shrimp White Spot Syndrome Virus (white spot bacilliform virus). VGAM797 host target gene, herein designated VGAM HOST TARGET GENE, is a human gene contained in the human genome.

VGAM797 gene encodes a VGAM797 precursor RNA, herein designated VGAM PRECURSOR RNA. Similar to other miRNA genes, and unlike most ordinary genes, VGAM797 precursor RNA does not encode a protein. A nucleotide sequence identical or highly similar to the nucleotide sequence of VGAM797 precursor RNA is designated SEQ ID:783, and is provided hereinbelow with reference to the sequence listing part. Nucleotide sequence SEQ ID:783 is located at position 100499 relative to the genome of Shrimp White Spot Syndrome Virus (white spot bacilliform virus).

VGAM797 precursor RNA folds onto itself, forming VGAM797 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM797 folded precursor RNA into VGAM797 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM797 RNA is designated SEQ ID:3508, and is provided hereinbelow with reference to the sequence listing part.

VGAM797 host target gene, herein designated VGAM HOST TARGET GENE, encodes a corresponding messenger RNA, VGAM797 host target RNA, herein designated VGAM HOST TARGET RNA. VGAM797 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM797 RNA, herein designated VGAM RNA, binds complementarily to one or more host target binding sites located in untranslated regions of VGAM797 host target RNA, herein designated VGAM HOST TARGET RNA. This complementary binding is due to the fact that the nucleotide sequence of VGAM797 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM797 RNA, herein designated VGAM RNA, may have a different number of host target binding sites in untranslated regions of a VGAM797 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM797 RNA, herein designated VGAM RNA, to host target binding sites on VGAM797 host target RNA, herein designated VGAM HOST TARGET RNA, such as BINDING SITE I, BINDING SITE II and BINDING SITE III, inhibits translation of VGAM797 host target RNA into VGAM797 host target protein, herein designated VGAM HOST TARGET PROTEIN. VGAM host target protein is therefore outlined by a broken line.

It is appreciated that VGAM797 host target gene, herein designated VGAM HOST TARGET GENE, in fact represents a plurality of VGAM797 host target genes. The mRNA of each one of this plurality of VGAM797 host target genes comprises one or more host target binding sites, each having a nucleotide sequence which is at least partly complementary to VGAM797 RNA, herein designated VGAM RNA, and which when bound by VGAM797 RNA causes inhibition of translation of respective one or more VGAM797 host target proteins.

It is further appreciated by one skilled in the art that the mode of translational inhibition illustrated by FIG. 1 with specific reference to translational inhibition exerted by VGAM797 gene, herein designated VGAM GENE, on one or more VGAM797 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM797 is inhibition of expression of host target genes, as part of a novel viral mechanism of attacking a host. Accordingly, utilities of VGAM797 include diagnosis, prevention and treatment of viral infection by Shrimp White Spot Syndrome Virus (white spot bacilliform virus). Specific functions, and accordingly utilities, of VGAM797 correlate with, and may be deduced from, the identity of the host target genes which VGAM797 binds and inhibits, and the function of these host target genes, as elaborated hereinbelow.

Nucleotide sequences of the VGAM797 precursor RNA, herein designated VGAM PRECURSOR RNA, and of the 'diced' VGAM797 RNA, herein designated VGAM RNA, and a schematic representation of the secondary folding of VGAM797 folded precursor RNA, herein designated VGAM FOLDED PRECURSOR RNA, of VGAM797 are further described hereinbelow with reference to Table 1.

Nucleotide sequences of host target binding sites, such as BINDING SITE-I, BINDING SITE-II and BINDING SITE-III of FIG. 1, found on VGAM797 host target RNA, and schematic representation of the complementarity of each of these host target binding sites to VGAM797 RNA, herein designated VGAM RNA, are described hereinbelow with reference to Table 2.

As mentioned hereinabove with reference to FIG. 1, a function of VGAM797 gene, herein designated VGAM is inhibition of expression of VGAM797 target genes. It is appreciated that specific functions, and accordingly utilities, of VGAM797 correlate with, and may be deduced from, the identity of the target genes which VGAM797 binds and inhibits, and the function of these target genes, as elaborated hereinbelow.

Endothelin Receptor Type A (EDNRA, Accession XM_034331) is a VGAM797 host target gene. EDNRA BINDING SITE is HOST TARGET binding site found in the 5' untranslated region of mRNA encoded by EDNRA, corresponding to a HOST TARGET binding site such as BINDING SITE I, BINDING SITE II or BINDING SITE III. Table 2 illustrates the complementarity of the nucleotide sequences of EDNRA BINDING SITE, designated SEQ ID:32058, to the nucleotide sequence of VGAM797 RNA, herein designated VGAM RNA, also designated SEQ ID:3508.

A function of VGAM797 is therefore inhibition of Endothelin Receptor Type A (EDNRA, Accession XM_034331), a gene which binds endothelins, and induces intracellular calcium flux and arachidonic acid accumulation. Accordingly, utilities of VGAM797 include diagnosis, prevention and treatment of diseases and clinical conditions associated with EDNRA. The function of EDNRA and its association with various diseases and clinical conditions, has been established by previous studies, as described hereinabove with reference to VGAM441. Estrogen-related Receptor Gamma (ESRRG, Accession XM_039053) is another VGAM797 host target gene. ESRRG BINDING SITE is HOST TARGET binding site found in the 3' untranslated region of mRNA encoded by ESRRG, corresponding to a HOST TARGET binding site such as BINDING SITE I, BINDING SITE II or BINDING SITE III. Table 2 illustrates the complementarity of the nucleotide sequences of ESRRG BINDING SITE, designated SEQ ID:32995, to the nucleotide sequence of VGAM797 RNA, herein designated VGAM RNA, also designated SEQ ID:3508.

Another function of VGAM797 is therefore inhibition of Estrogen-related Receptor Gamma (ESRRG, Accession XM_039053), a gene which Estrogen-related receptor gamma. Accordingly, utilities of VGAM797 include diagnosis, prevention and treatment of diseases and clinical conditions associated with ESRRG. The function of ESRRG and its association with various diseases and clinical conditions, has been established by previous studies, as described hereinabove with reference to VGAM359. GTP Cyclohydrolase 1 (dopa-responsive dystonia) (GCH1, Accession NM_000161)

is another VGAM797 host target gene. GCH1 BINDING SITE is HOST TARGET binding site found in the 3' untranslated region of mRNA encoded by GCH1, corresponding to a HOST TARGET binding site such as BINDING SITE I, BINDING SITE II or BINDING SITE III. Table 2 illustrates the complementarity of the nucleotide sequences of GCH1 BINDING SITE, designated SEQ ID:5668, to the nucleotide sequence of VGAM797 RNA, herein designated VGAM RNA, also designated SEQ ID:3508.

Another function of VGAM797 is therefore inhibition of GTP Cyclohydrolase 1 (dopa-responsive dystonia) (GCH1, Accession NM_000161). Accordingly, utilities of VGAM797 include diagnosis, prevention and treatment of diseases and clinical conditions associated with GCH1. Neuroligin 1 (NLGN1, Accession NM_014932) is another VGAM797 host target gene. NLGN1 BINDING SITE is HOST TARGET binding site found in the 5' untranslated region of mRNA encoded by NLGN1, corresponding to a HOST TARGET binding site such as BINDING SITE I, BINDING SITE II or BINDING SITE III. Table 2 illustrates the complementarity of the nucleotide sequences of NLGN1 BINDING SITE, designated SEQ ID:17231, to the nucleotide sequence of VGAM797 RNA, herein designated VGAM RNA, also designated SEQ ID:3508.

Another function of VGAM797 is therefore inhibition of Neuroligin 1 (NLGN1, Accession NM_014932), a gene which may trigger the de novo formation of presynaptic structure. Accordingly, utilities of VGAM797 include diagnosis, prevention and treatment of diseases and clinical conditions associated with NLGN1. The function of NLGN1 and its association with various diseases and clinical conditions, has been established by previous studies, as described hereinabove with reference to VGAM659. Regulatory Factor X-associated Protein (RFXAP, Accession NM_000538) is another VGAM797 host target gene. RFXAP BINDING SITE is HOST TARGET binding site found in the 5' untranslated region of mRNA encoded by RFXAP, corresponding to a HOST TARGET binding site such as BINDING SITE I, BINDING SITE II or BINDING SITE III. Table 2 illustrates the complementarity of the nucleotide sequences of RFXAP BINDING SITE, designated SEQ ID:6136, to the nucleotide sequence of VGAM797 RNA, herein designated VGAM RNA, also designated SEQ ID:3508.

Another function of VGAM797 is therefore inhibition of Regulatory Factor X-associated Protein (RFXAP, Accession NM_000538), a gene which binds to the x-box of mhc ii promoters and is a transcriptional regulator. Accordingly, utilities of VGAM797 include diagnosis, prevention and treatment of diseases and clinical conditions associated with RFXAP. The function of RFXAP has been established by previous studies. Yanagisawa et al. (2000) isolated and analyzed a gene that shares a notable motif with DRPLA, namely that of arginine-glutamic acid (RE) dipeptide repeats. The gene that was isolated, designated RERE, has an open reading frame of 1,566 amino acids, of which the C-terminal portion has 67% homology to DRPLA, whereas the N-terminal portion is distinctive. RERE also contains arginine-aspartic acid (RD) dipeptide repeats and putative nuclear localization signal sequences, but no polyglutamine tracts. Northern blot analysis detected 2 RERE transcripts: one of 9 kb, expressed exclusively in pancreas and testis; and one of 7 kb, expressed most strongly in skeletal muscle with weaker expression in other tissues tested, including brain. The RERE protein migrated at an apparent molecular weight of 212 kD in SDS-PAGE. An RERE fusion protein localized predominantly in the nucleus. Immunoprecipitation and in vitro binding assays demonstrated that the DRPLA and RERE proteins bind each other, which is facilitated by one of the RE repeats, and that extension of the DRPLA polyglutamine tract enhances the binding By study of a YAC spanning a translocation/duplication breakpoint within the minimally defined loss of heterozygosity region at 1p36.2-p36.1 in a neuroblastoma cell line, Amler et al. (2000) identified the RERE gene, which they designated DNB1/ARP (deleted in neuroblastoma-1/atrophin-related protein Full details of the abovementioned studies are described in the following publications, the disclosure of which are hereby incorporated by reference:

Amler, L. C.; Bauer, A.; Corvi, R.; Dihlmann, S.; Praml, C.; Cavenee, W. K.; Schwab, M.; Hampton, G. M.: Identification and characterization of novel genes located at the t (1;15) (p36.2; q24) translocation breakpoint in the neuroblastoma cell line NGP. Genomics 64:195-202, 2000; and Yanagisawa, H.; Bundo, M.; Miyashita, T.; Okamura-Oho, Y.; Tadokoro, K.; Tokunaga, K.; Yamada, M.: Protein binding of a DRPLA family through arginine-glutamic acid dipeptide repeats i.

Further studies establishing the function and utilities of RFXAP are found in John Hopkins OMIM database record ID 601861, and in sited publications numbered 5800-5801, 8317-580 and 6077 listed in the bibliography section hereinbelow, which are also hereby incorporated by reference. Serine Racemase (SRR, Accession NM_021947) is another VGAM797 host target gene. SRR BINDING SITE is HOST TARGET binding site found in the 3' untranslated region of mRNA encoded by SRR, corresponding to a HOST TARGET binding site such as BINDING SITE I, BINDING SITE II or BINDING SITE III. Table 2 illustrates the complementarity of the nucleotide sequences of SRR BINDING SITE, designated SEQ ID:22473, to the nucleotide sequence of VGAM797 RNA, herein designated VGAM RNA, also designated SEQ ID:3508.

Another function of VGAM797 is therefore inhibition of Serine Racemase (SRR, Accession NM_021947). Accordingly, utilities of VGAM797 include diagnosis, prevention and treatment of diseases and clinical conditions associated with SRR. Src Homology Three (SH3) and Cysteine Rich Domain (STAC, Accession NM_003149) is another VGAM797 host target gene. STAC BINDING SITE is HOST TARGET binding site found in the 3' untranslated region of mRNA encoded by STAC, corresponding to a HOST TARGET binding site such as BINDING SITE I, BINDING SITE II or BINDING SITE III. Table 2 illustrates the complementarity of the nucleotide sequences of STAC BINDING SITE, designated SEQ ID:9120, to the nucleotide sequence of VGAM797 RNA, herein designated VGAM RNA, also designated SEQ ID:3508.

Another function of VGAM797 is therefore inhibition of Src Homology Three (SH3) and Cysteine Rich Domain (STAC, Accession NM_003149), a gene which is probably involved in a neuron-specific signal transduction. Accordingly, utilities of VGAM797 include diagnosis, prevention and treatment of diseases and clinical conditions associated with STAC. The function of STAC and its association with various diseases and clinical conditions, has been established by previous studies, as described hereinabove with reference to VGAM331. FLJ10922 (Accession NM_018273) is another VGAM797 host target gene. FLJ10922 BINDING SITE is HOST TARGET binding site found in the 3' untranslated region of mRNA encoded by FLJ10922, corresponding to a HOST TARGET binding site such as BINDING SITE I, BINDING SITE II or BINDING SITE III. Table 2 illustrates the complementarity of the nucleotide sequences of FLJ10922 BINDING SITE, designated SEQ ID:20256, to the nucleotide sequence of VGAM797 RNA, herein designated VGAM RNA, also designated SEQ ID:3508.

Another function of VGAM797 is therefore inhibition of FLJ10922 (Accession NM_018273). Accordingly, utilities of VGAM797 include diagnosis, prevention and treatment of diseases and clinical conditions associated with FLJ10922. KIAA1900 (Accession XM_055299) is another VGAM797 host target gene. KIAA1900 BINDING SITE is HOST TARGET binding site found in the 3' untranslated region of mRNA encoded by KIAA1900, corresponding to a HOST TARGET binding site such as BINDING SITE I, BINDING SITE II or BINDING SITE III. Table 2 illustrates the complementarity of the nucleotide sequences of KIAA1900 BINDING SITE, designated SEQ ID:36261, to the nucleotide sequence of VGAM797 RNA, herein designated VGAM RNA, also designated SEQ ID:3508.

Another function of VGAM797 is therefore inhibition of KIAA1900 (Accession XM_055299). Accordingly, utilities of VGAM797 include diagnosis, prevention and treatment of diseases and clinical conditions associated with KIAA1900. MEGF11 (Accession NM_032445) is another VGAM797 host target gene. MEGF11 BINDING SITE is HOST TARGET binding site found in the 3' untranslated region of mRNA encoded by MEGF11, corresponding to a HOST TARGET binding site such as BINDING SITE I, BINDING SITE II or BINDING SITE III. Table 2 illustrates the complementarity of the nucleotide sequences of MEGF11 BINDING SITE, designated SEQ ID:26206, to the nucleotide sequence of VGAM797 RNA, herein designated VGAM RNA, also designated SEQ ID:3508.

Another function of VGAM797 is therefore inhibition of MEGF11 (Accession NM_032445). Accordingly, utilities of VGAM797 include diagnosis, prevention and treatment of diseases and clinical conditions associated with MEGF11. Rab11-FIP2 (Accession NM_014904) is another VGAM797 host target gene. Rab11-FIP2 BINDING SITE is HOST TARGET binding site found in the 3' untranslated region of mRNA encoded by Rab11-FIP2, corresponding to a HOST TARGET binding site such as BINDING SITE I, BINDING SITE II or BINDING SITE III. Table 2 illustrates the complementarity of the nucleotide sequences of Rab11-FIP2 BINDING SITE, designated SEQ ID:17100, to the nucleotide sequence of VGAM797 RNA, herein designated VGAM RNA, also designated SEQ ID:3508.

Another function of VGAM797 is therefore inhibition of Rab11-FIP2 (Accession NM_014904). Accordingly, utilities of VGAM797 include diagnosis, prevention and treatment of diseases and clinical conditions associated with Rab11-FIP2. Ring Finger Protein (C3HC4 type) 8 (RNF8, Accession NM_003958) is another VGAM797 host target gene. RNF8 BINDING SITE is HOST TARGET binding site found in the 3' untranslated region of mRNA encoded by RNF8, corresponding to a HOST TARGET binding site such as BINDING SITE I, BINDING SITE II or BINDING SITE III. Table 2 illustrates the complementarity of the nucleotide sequences of RNF8 BINDING SITE, designated SEQ ID:10096, to the nucleotide sequence of VGAM797 RNA, herein designated VGAM RNA, also designated SEQ ID:3508.

Another function of VGAM797 is therefore inhibition of Ring Finger Protein (C3HC4 type) 8 (RNF8, Accession NM_003958). Accordingly, utilities of VGAM797 include diagnosis, prevention and treatment of diseases and clinical conditions associated with RNF8. LOC146894 (Accession NM_145273) is another VGAM797 host target gene. LOC146894 BINDING SITE is HOST TARGET binding site found in the 3' untranslated region of mRNA encoded by LOC146894, corresponding to a HOST TARGET binding site such as BINDING SITE I, BINDING SITE II or BINDING SITE III. Table 2 illustrates the complementarity of the nucleotide sequences of LOC146894 BINDING SITE, designated SEQ ID:29782, to the nucleotide sequence of VGAM797 RNA, herein designated VGAM RNA, also designated SEQ ID:3508.

Another function of VGAM797 is therefore inhibition of LOC146894 (Accession NM_145273). Accordingly, utilities of VGAM797 include diagnosis, prevention and treatment of diseases and clinical conditions associated with LOC146894. LOC168391 (Accession XM_095061) is another VGAM797 host target gene. LOC168391 BINDING SITE is HOST TARGET binding site found in the 5' untranslated region of mRNA encoded by LOC168391, corresponding to a HOST TARGET binding site such as BINDING SITE I, BINDING SITE II or BINDING SITE III. Table 2 illustrates the complementarity of the nucleotide sequences of LOC168391 BINDING SITE, designated SEQ ID:40244, to the nucleotide sequence of VGAM797 RNA, herein designated VGAM RNA, also designated SEQ ID:3508.

Another function of VGAM797 is therefore inhibition of LOC168391 (Accession XM_095061). Accordingly, utilities of VGAM797 include diagnosis, prevention and treatment of diseases and clinical conditions associated with LOC168391. LOC255328 (Accession XM_172920) is another VGAM797 host target gene. LOC255328 BINDING SITE is HOST TARGET binding site found in the 3' untranslated region of mRNA encoded by LOC255328, corresponding to a HOST TARGET binding site such as BINDING SITE I, BINDING SITE II or BINDING SITE III. Table 2 illustrates the complementarity of the nucleotide sequences of LOC255328 BINDING SITE, designated SEQ ID:46179, to the nucleotide sequence of VGAM797 RNA, herein designated VGAM RNA, also designated SEQ ID:3508.

Another function of VGAM797 is therefore inhibition of LOC255328 (Accession XM_172920). Accordingly, utilities of VGAM797 include diagnosis, prevention and treatment of diseases and clinical conditions associated with LOC255328. FIG. 1 further provides a conceptual description of a novel bioinformatically detected viral gene of the present invention, referred to here as Viral Genomic Address Messenger 798 (VGAM798) viral gene, which modulates expression of respective host target genes thereof, the function and utility of which host target genes is known in the art.

VGAM798 is a novel bioinformatically detected regulatory, non protein coding, viral micro RNA (miRNA) gene. The method by which VGAM798 was detected is described hereinabove with reference to FIGS. 1-8.

VGAM798 gene, herein designated VGAM GENE, is a viral gene contained in the genome of Shrimp White Spot Syndrome Virus (white spot bacilliform virus). VGAM798 host target gene, herein designated VGAM HOST TARGET GENE, is a human gene contained in the human genome.

VGAM798 gene encodes a VGAM798 precursor RNA, herein designated VGAM PRECURSOR RNA. Similar to other miRNA genes, and unlike most ordinary genes, VGAM798 precursor RNA does not encode a protein. A nucleotide sequence identical or highly similar to the nucleotide sequence of VGAM798 precursor RNA is designated SEQ ID:784, and is provided hereinbelow with reference to the sequence listing part. Nucleotide sequence SEQ ID:784 is located at position 102198 relative to the genome of Shrimp White Spot Syndrome Virus (white spot bacilliform virus).

VGAM798 precursor RNA folds onto itself, forming VGAM798 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM798 folded precursor RNA into VGAM798 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM798 RNA is designated SEQ ID:3509, and is provided hereinbelow with reference to the sequence listing part.

VGAM798 host target gene, herein designated VGAM HOST TARGET GENE, encodes a corresponding messenger RNA, VGAM798 host target RNA, herein designated VGAM HOST TARGET RNA. VGAM798 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM798 RNA, herein designated VGAM RNA, binds complementarily to one or more host target binding sites located in untranslated regions of VGAM798 host target RNA, herein designated VGAM HOST TARGET RNA. This complementary binding is due to the fact that the nucleotide sequence of VGAM798 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM798 RNA, herein designated VGAM RNA, may have a different number of host target binding sites in untranslated regions of a VGAM798 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM798 RNA, herein designated VGAM RNA, to host target binding sites on VGAM798 host target RNA, herein designated VGAM HOST TARGET RNA, such as BINDING SITE I, BINDING SITE II and BINDING SITE III, inhibits translation of VGAM798 host target RNA into VGAM798 host target protein, herein designated VGAM HOST TARGET PROTEIN. VGAM host target protein is therefore outlined by a broken line.

It is appreciated that VGAM798 host target gene, herein designated VGAM HOST TARGET GENE, in fact represents a plurality of VGAM798 host target genes. The mRNA of each one of this plurality of VGAM798 host target genes comprises one or more host target binding sites, each having a nucleotide sequence which is at least partly complementary to VGAM798 RNA, herein designated VGAM RNA, and which when bound by VGAM798 RNA causes inhibition of translation of respective one or more VGAM798 host target proteins.

It is further appreciated by one skilled in the art that the mode of translational inhibition illustrated by FIG. 1 with specific reference to translational inhibition exerted by VGAM798 gene, herein designated VGAM GENE, on one or more VGAM798 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM798 is inhibition of expression of host target genes, as part of a novel viral mechanism of attacking a host. Accordingly, utilities of VGAM798 include diagnosis, prevention and treatment of viral infection by Shrimp White Spot Syndrome Virus (white spot bacilliform virus). Specific functions, and accordingly utilities, of VGAM798 correlate with, and may be deduced from, the identity of the host target genes which VGAM798 binds and inhibits, and the function of these host target genes, as elaborated hereinbelow.

Nucleotide sequences of the VGAM798 precursor RNA, herein designated VGAM PRECURSOR RNA, and of the 'diced' VGAM798 RNA, herein designated VGAM RNA, and a schematic representation of the secondary folding of VGAM798 folded precursor RNA, herein designated VGAM FOLDED PRECURSOR RNA, of VGAM798 are further described hereinbelow with reference to Table 1.

Nucleotide sequences of host target binding sites, such as BINDING SITE-I, BINDING SITE-II and BINDING SITE-III of FIG. 1, found on VGAM798 host target RNA, and schematic representation of the complementarity of each of these host target binding sites to VGAM798 RNA, herein designated VGAM RNA, are described hereinbelow with reference to Table 2.

As mentioned hereinabove with reference to FIG. 1, a function of VGAM798 gene, herein designated VGAM is inhibition of expression of VGAM798 target genes. It is appreciated that specific functions, and accordingly utilities, of VGAM798 correlate with, and may be deduced from, the identity of the target genes which VGAM798 binds and inhibits, and the function of these target genes, as elaborated hereinbelow.

Cysteine and Glycine-rich Protein 1 (CSRP1, Accession NM_004078) is a VGAM798 host target gene. CSRP1 BINDING SITE is HOST TARGET binding site found in the 3' untranslated region of mRNA encoded by CSRP1, corresponding to a HOST TARGET binding site such as BINDING SITE I, BINDING SITE II or BINDING SITE III. Table 2 illustrates the complementarity of the nucleotide sequences of CSRP1 BINDING SITE, designated SEQ ID:10280, to the nucleotide sequence of VGAM798 RNA, herein designated VGAM RNA, also designated SEQ ID:3509.

A function of VGAM798 is therefore inhibition of Cysteine and Glycine-rich Protein 1 (CSRP1, Accession NM_004078), a gene which could play a role in neuronal development. Accordingly, utilities of VGAM798 include diagnosis, prevention and treatment of diseases and clinical conditions associated with CSRP1. The function of CSRP1 and its association with various diseases and clinical conditions, has been established by previous studies, as described hereinabove with reference to VGAM743. Cullin 5 (CUL5, Accession NM_003478) is another VGAM798 host target gene. CUL5 BINDING SITE is HOST TARGET binding site found in the 3' untranslated region of mRNA encoded by CUL5, corresponding to a HOST TARGET binding site such as BINDING SITE I, BINDING SITE II or BINDING SITE III. Table 2 illustrates the complementarity of the nucleotide sequences of CUL5 BINDING SITE, designated SEQ ID:9548, to the nucleotide sequence of VGAM798 RNA, herein designated VGAM RNA, also designated SEQ ID:3509.

Another function of VGAM798 is therefore inhibition of Cullin 5 (CUL5, Accession NM_003478), a gene which may target other proteins for ubiquitin-dependent proteolysis. Accordingly, utilities of VGAM798 include diagnosis, prevention and treatment of diseases and clinical conditions associated with CUL5. The function of CUL5 has been established by previous studies. The arginine vasopressin (AVP)-activated calcium-mobilizing receptor (OMIM Ref. No. VACM-1) is a cell surface protein involved in intracellular signal transduction. The gene encoding rabbit VACM-1 was isolated by Burnatowska-Hledin et al. (1995) from a renal medullary cDNA library by expression cloning in Xenopus laevis oocytes. While searching for expressed genes in the ataxia-telangiectasia (OMIM Ref. No. 208900) gene region on chromosome 11q22-q23, Byrd et al. (1997) identified the gene encoding the human homolog of rabbit VACM-1 and determined the complete amino acid sequence for the protein. The 780-amino acid predicted polypeptide differs from the rabbit sequence by only 7 residues. Northern hybridization analysis showed expression in a wide range of human tissues. Byrd et al. (1997) noted that the human VACM1 gene shares homology with the C. elegans gene Ce-cul-5, a member of the family of cullin genes that are involved in cell cycle regulation.

Full details of the abovementioned studies are described in the following publications, the disclosure of which are hereby incorporated by reference:

Burnatowska-Hledin, M. A.; Spielman, W. S.; Smith, W. L.; Shi, P.; Meyer, J. M.; Dewitt, D. L.: Expression cloning of an AVP-activated, calcium-mobilizing receptor from rabbit kidney medulla. Am. J. Physiol. 268: F1198-F1210, 1995; and Byrd, P. J.; Stankovic, T.; McConville, C. M.; Smith, A. D.; Cooper, P. R.; Taylor, A. M. R.: Identification and analysis of expression of human VACM-1, a cullin gene family member loc.

Further studies establishing the function and utilities of CUL5 are found in John Hopkins OMIM database record ID 601741, and in sited publications numbered 6200-6201 listed in the bibliography section hereinbelow, which are also hereby incorporated by reference. Cytochrome P450, Subfamily IVA, Polypeptide 11 (CYP4A11, Accession NM_000778) is another VGAM798 host target gene. CYP4A11 BINDING SITE is HOST TARGET binding site found in the 3' untranslated region of mRNA encoded by CYP4A11, corresponding to a HOST TARGET binding site such as BINDING SITE I, BINDING SITE II or BINDING SITE III. Table 2 illustrates the complementarity of the nucleotide sequences of CYP4A11 BINDING SITE, designated SEQ ID:6420, to the nucleotide sequence of VGAM798 RNA, herein designated VGAM RNA, also designated SEQ ID:3509.

Another function of VGAM798 is therefore inhibition of Cytochrome P450, Subfamily IVA, Polypeptide 11 (CYP4A11, Accession NM_000778), a gene which catalyzes the omega- and (omega-1)-hydroxylation of various fatty acids. Accordingly, utilities of VGAM798 include diagnosis, prevention and treatment of diseases and clinical conditions associated with CYP4A11. The function of CYP4A11 has been established by previous studies. The human P450 enzymes encoded by CYP4 genes (see OMIM Ref. No. 124075) represent a distinct lineage of the P450 family. Palmer et al. (1993) noted that mammalian CYP4A enzymes catalyze selective hydroxylation of a primary carbon-hydrogen bond in medium- and long-chain fatty acids. Palmer et al. (1993) cloned and characterized a CYP4A-encoding gene (designated CYP4AII by them) by screening a human kidney cDNA library using a rabbit CYP4A cDNA probe. By Northern and RNase protection analysis, they showed that the gene (also symbolized CYP4A11) is expressed predominantly in kidney and somewhat in liver. Palmer et al. (1993) characterized the catalytic activity of expressed recombinant CYP4A11 on various fatty acids and prostaglandins and concluded that the enzyme is a fatty acid omega-hydroxylase with turnover numbers of 9.8, 2.2, and 0.55 per min for lauric, palmitic, and arachidonic acids, respectively Imaoka et al. (1993) cloned a variant cDNA of CYP4A11, called CYP4A11v, from a human kidney cDNA library. The CYP4A11v cDNA contains a deletion of a single adenine residue, resulting in a frameshift and the production of a predicted 591-amino acid protein. Several differences in the 3-prime untranslated region of the CYP4A11v cDNA were also detected. Baculovirus-mediated expression of the CYP4A11v cDNA yielded an unstable protein that did not efficiently metabolize lauric acid.

Full details of the abovementioned studies are described in the following publications, the disclosure of which are hereby incorporated by reference:

Imaoka, S.; Ogawa, H.; Kimura, S.; Gonzalez, F. J.: Complete cDNA sequence and cDNA-directed expression of CYP4A11, a fatty acid omega-hydroxylase expressed in human kidney. DNA Cell Biol. 12:893-899, 1993; and Kawashima, H.; Kusunose, E.; Kikuta, Y.; Kinoshita, H.; Tanaka, S.; Yamamoto, S.; Kishimoto, T.; Kusunose, M.: Purification and cDNA cloning of human liver CYP4A fatty acid omega-hydro.

Further studies establishing the function and utilities of CYP4A11 are found in John Hopkins OMIM database record ID 601310, and in sited publications numbered 7041-7044 listed in the bibliography section hereinbelow, which are also hereby incorporated by reference. Glutamate Dehydrogenase 1 (GLUD1, Accession NM_005271) is another VGAM798 host target gene. GLUD1 BINDING SITE is HOST TARGET binding site found in the 3' untranslated region of mRNA encoded by GLUD1, corresponding to a HOST TARGET binding site such as BINDING SITE I, BINDING SITE II or BINDING SITE III. Table 2 illustrates the complementarity of the nucleotide sequences of GLUD1 BINDING SITE, designated SEQ ID:11776, to the nucleotide sequence of VGAM798 RNA, herein designated VGAM RNA, also designated SEQ ID:3509.

Another function of VGAM798 is therefore inhibition of Glutamate Dehydrogenase 1 (GLUD1, Accession NM_005271). Accordingly, utilities of VGAM798 include diagnosis, prevention and treatment of diseases and clinical conditions associated with GLUD1. Roundabout, Axon Guidance Receptor, Homolog 1 (Drosophila) (ROBO1, Accession NM_133631) is another VGAM798 host target gene. ROBO1 BINDING SITE1 and ROBO1 BINDING SITE2 are HOST TARGET binding sites found in untranslated regions of mRNA encoded by ROBO1, corresponding to HOST TARGET binding sites such as BINDING SITE I, BINDING SITE II or BINDING SITE III. Table 2 illustrates the complementarity of the nucleotide sequences of ROBO1 BINDING SITE1 and ROBO1 BINDING SITE2, designated SEQ ID:28590 and SEQ ID:8853 respectively, to the nucleotide sequence of VGAM798 RNA, herein designated VGAM RNA, also designated SEQ ID:3509.

Another function of VGAM798 is therefore inhibition of Roundabout, Axon Guidance Receptor, Homolog 1 (Drosophila) (ROBO1, Accession NM_133631), a gene which is an axon guidance receptor. Accordingly, utilities of VGAM798 include diagnosis, prevention and treatment of diseases and clinical conditions associated with ROBO1. The function of ROBO1 and its association with various diseases and clinical conditions, has been established by previous studies, as described hereinabove with reference to VGAM37. Solute Carrier Family 18 (vesicular monoamine), Member 1 (SLC18A1, Accession NM_003053) is another VGAM798 host target gene. SLC18A1 BINDING SITE is HOST TARGET binding site found in the 3' untranslated region of mRNA encoded by SLC18A1, corresponding to a HOST TARGET binding site such as BINDING SITE I, BINDING SITE II or BINDING SITE III. Table 2 illustrates the complementarity of the nucleotide sequences of SLC18A1 BINDING SITE, designated SEQ ID:9018, to the nucleotide sequence of VGAM798 RNA, herein designated VGAM RNA, also designated SEQ ID:3509.

Another function of VGAM798 is therefore inhibition of Solute Carrier Family 18 (vesicular monoamine), Member 1 (SLC18A1, Accession NM_003053), a gene which is involved in the vesicular transport of biogenic amines. Accordingly, utilities of VGAM798 include diagnosis, prevention and treatment of diseases and clinical conditions associated with SLC18A1. The function of SLC18A1 and its association with various diseases and clinical conditions, has been established by previous studies, as described hereinabove with reference to VGAM18. FLJ11539 (Accession NM_024748) is another VGAM798 host target gene. FLJ11539 BINDING SITE is HOST TARGET binding site found in the 3' untranslated region of mRNA encoded by FLJ11539, corresponding to a HOST TARGET binding site such as BINDING SITE I, BINDING SITE II or BINDING SITE III. Table 2 illustrates the complementarity of the nucleotide sequences of FLJ11539 BINDING SITE, designated SEQ ID:24090, to the nucleotide sequence of VGAM798 RNA, herein designated VGAM RNA, also designated SEQ ID:3509.

Another function of VGAM798 is therefore inhibition of FLJ11539 (Accession NM_024748). Accordingly, utilities of VGAM798 include diagnosis, prevention and treatment of diseases and clinical conditions associated with FLJ11539. FLJ14326 (Accession NM_032191) is another VGAM798 host target gene. FLJ14326 BINDING SITE is HOST TARGET binding site found in the 3' untranslated region of mRNA encoded by FLJ14326, corresponding to a HOST TARGET binding site such as BINDING SITE I, BINDING SITE II or BINDING SITE III. Table 2 illustrates the complementarity of the nucleotide sequences of FLJ14326 BINDING SITE, designated SEQ ID:25906, to the nucleotide sequence of VGAM798 RNA, herein designated VGAM RNA, also designated SEQ ID:3509.

Another function of VGAM798 is therefore inhibition of FLJ14326 (Accession NM_032191). Accordingly, utilities of VGAM798 include diagnosis, prevention and treatment of diseases and clinical conditions associated with FLJ14326. KIAA0057 (Accession NM_012288) is another VGAM798 host target gene. KIAA0057 BINDING SITE is HOST TARGET binding site found in the 3' untranslated region of mRNA encoded by KIAA0057, corresponding to a HOST TARGET binding site such as BINDING SITE I, BINDING SITE II or BINDING SITE III. Table 2 illustrates the complementarity of the nucleotide sequences of KIAA0057 BINDING SITE, designated SEQ ID:14628, to the nucleotide sequence of VGAM798 RNA, herein designated VGAM RNA, also designated SEQ ID:3509.

Another function of VGAM798 is therefore inhibition of KIAA0057 (Accession NM_012288). Accordingly, utilities of VGAM798 include diagnosis, prevention and treatment of diseases and clinical conditions associated with KIAA0057. KIAA0961 (Accession NM_014898) is another VGAM798 host target gene. KIAA0961 BINDING SITE is HOST TARGET binding site found in the 3' untranslated region of mRNA encoded by KIAA0961, corresponding to a HOST TARGET binding site such as BINDING SITE I, BINDING SITE II or BINDING SITE III. Table 2 illustrates the complementarity of the nucleotide sequences of KIAA0961 BINDING SITE, designated SEQ ID:17073, to the nucleotide sequence of VGAM798 RNA, herein designated VGAM RNA, also designated SEQ ID:3509.

Another function of VGAM798 is therefore inhibition of KIAA0961 (Accession NM_014898). Accordingly, utilities of VGAM798 include diagnosis, prevention and treatment of diseases and clinical conditions associated with KIAA0961. LHX6 (Accession NM_014368) is another VGAM798 host target gene. LHX6 BINDING SITE is HOST TARGET binding site found in the 3' untranslated region of mRNA encoded by LHX6, corresponding to a HOST TARGET binding site such as BINDING SITE I, BINDING SITE II or BINDING SITE III. Table 2 illustrates the complementarity of the nucleotide sequences of LHX6 BINDING SITE, designated SEQ ID:15700, to the nucleotide sequence of VGAM798 RNA, herein designated VGAM RNA, also designated SEQ ID:3509.

Another function of VGAM798 is therefore inhibition of LHX6 (Accession NM_014368). Accordingly, utilities of VGAM798 include diagnosis, prevention and treatment of diseases and clinical conditions associated with LHX6. MGC5139 (Accession XM_058587) is another VGAM798 host target gene. MGC5139 BINDING SITE is HOST TARGET binding site found in the 5' untranslated region of mRNA encoded by MGC5139, corresponding to a HOST TARGET binding site such as BINDING SITE I, BINDING SITE II or BINDING SITE III. Table 2 illustrates the complementarity of the nucleotide sequences of MGC5139 BINDING SITE, designated SEQ ID:36680, to the nucleotide sequence of VGAM798 RNA, herein designated VGAM RNA, also designated SEQ ID:3509.

Another function of VGAM798 is therefore inhibition of MGC5139 (Accession XM_058587). Accordingly, utilities of VGAM798 include diagnosis, prevention and treatment of diseases and clinical conditions associated with MGC5139. PFTAIRE Protein Kinase 1 (PFTK1, Accession NM_012395) is another VGAM798 host target gene. PFTK1 BINDING SITE is HOST TARGET binding site found in the 3' untranslated region of mRNA encoded by PFTK1, corresponding to a HOST TARGET binding site such as BINDING SITE I, BINDING SITE II or BINDING SITE III. Table 2 illustrates the complementarity of the nucleotide sequences of PFTK1 BINDING SITE, designated SEQ ID:14756, to the nucleotide sequence of VGAM798 RNA, herein designated VGAM RNA, also designated SEQ ID:3509.

Another function of VGAM798 is therefore inhibition of PFTAIRE Protein Kinase 1 (PFTK1, Accession NM_012395). Accordingly, utilities of VGAM798 include diagnosis, prevention and treatment of diseases and clinical conditions associated with PFTK1. LOC133418 (Accession XM_059649) is another VGAM798 host target gene. LOC133418 BINDING SITE is HOST TARGET binding site found in the 3' untranslated region of mRNA encoded by LOC133418, corresponding to a HOST TARGET binding site such as BINDING SITE I, BINDING SITE II or BINDING SITE III. Table 2 illustrates the complementarity of the nucleotide sequences of LOC133418 BINDING SITE, designated SEQ ID:37043, to the nucleotide sequence of VGAM798 RNA, herein designated VGAM RNA, also designated SEQ ID:3509.

Another function of VGAM798 is therefore inhibition of LOC133418 (Accession XM_059649). Accordingly, utilities of VGAM798 include diagnosis, prevention and treatment of diseases and clinical conditions associated with LOC133418. LOC51696 (Accession NM_016217) is another VGAM798 host target gene. LOC51696 BINDING SITE is HOST TARGET binding site found in the 3' untranslated region of mRNA encoded by LOC51696, corresponding to a HOST TARGET binding site such as BINDING SITE I, BINDING SITE II or BINDING SITE III. Table 2 illustrates the complementarity of the nucleotide sequences of LOC51696 BINDING SITE, designated SEQ ID:18317, to the nucleotide sequence of VGAM798 RNA, herein designated VGAM RNA, also designated SEQ ID:3509.

Another function of VGAM798 is therefore inhibition of LOC51696 (Accession NM_016217). Accordingly, utilities of VGAM798 include diagnosis, prevention and treatment of diseases and clinical conditions associated with LOC51696. FIG. 1 further provides a conceptual description of a novel bioinformatically detected viral gene of the present invention, referred to here as Viral Genomic Address Messenger 799 (VGAM799) viral gene, which modulates expression of respective host target genes thereof, the function and utility of which host target genes is known in the art.

VGAM799 is a novel bioinformatically detected regulatory, non protein coding, viral micro RNA (miRNA) gene. The method by which VGAM799 was detected is described hereinabove with reference to FIGS. 1-8.

VGAM799 gene, herein designated VGAM GENE, is a viral gene contained in the genome of Shrimp White Spot Syndrome Virus (white spot bacilliform virus). VGAM799 host target gene, herein designated VGAM HOST TARGET GENE, is a human gene contained in the human genome.

VGAM799 gene encodes a VGAM799 precursor RNA, herein designated VGAM PRECURSOR RNA. Similar to other miRNA genes, and unlike most ordinary genes, VGAM799 precursor RNA does not encode a protein. A nucleotide sequence identical or highly similar to the nucleotide sequence of VGAM799 precursor RNA is designated SEQ ID:785, and is provided hereinbelow with reference to the sequence listing part. Nucleotide sequence SEQ ID:785 is located at position 181145 relative to the genome of Shrimp White Spot Syndrome Virus (white spot bacilliform virus).

VGAM799 precursor RNA folds onto itself, forming VGAM799 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM799 folded precursor RNA into VGAM799 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM799 RNA is designated SEQ ID:3510, and is provided hereinbelow with reference to the sequence listing part.

VGAM799 host target gene, herein designated VGAM HOST TARGET GENE, encodes a corresponding messenger RNA, VGAM799 host target RNA, herein designated VGAM HOST TARGET RNA. VGAM799 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM799 RNA, herein designated VGAM RNA, binds complementarily to one or more host target binding sites located in untranslated regions of VGAM799 host target RNA, herein designated VGAM HOST TARGET RNA. This complementary binding is due to the fact that the nucleotide sequence of VGAM799 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM799 RNA, herein designated VGAM RNA, may have a different number of host target binding sites in untranslated regions of a VGAM799 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM799 RNA, herein designated VGAM RNA, to host target binding sites on VGAM799 host target RNA, herein designated VGAM HOST TARGET RNA, such as BINDING SITE I, BINDING SITE II and BINDING SITE III, inhibits translation of VGAM799 host target RNA into VGAM799 host target protein, herein designated VGAM HOST TARGET PROTEIN. VGAM host target protein is therefore outlined by a broken line.

It is appreciated that VGAM799 host target gene, herein designated VGAM HOST TARGET GENE, in fact represents a plurality of VGAM799 host target genes. The mRNA of each one of this plurality of VGAM799 host target genes comprises one or more host target binding sites, each having a nucleotide sequence which is at least partly complementary to VGAM799 RNA, herein designated VGAM RNA, and which when bound by VGAM799 RNA causes inhibition of translation of respective one or more VGAM799 host target proteins.

It is further appreciated by one skilled in the art that the mode of translational inhibition illustrated by FIG. 1 with specific reference to translational inhibition exerted by VGAM799 gene, herein designated VGAM GENE, on one or more VGAM799 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM799 is inhibition of expression of host target genes, as part of a novel viral mechanism of attacking a host. Accordingly, utilities of VGAM799 include diagnosis, prevention and treatment of viral infection by Shrimp White Spot Syndrome Virus (white spot bacilliform virus). Specific functions, and accordingly utilities, of VGAM799 correlate with, and may be deduced from, the identity of the host target genes which VGAM799 binds and inhibits, and the function of these host target genes, as elaborated hereinbelow.

Nucleotide sequences of the VGAM799 precursor RNA, herein designated VGAM PRECURSOR RNA, and of the 'diced' VGAM799 RNA, herein designated VGAM RNA, and a schematic representation of the secondary folding of VGAM799 folded precursor RNA, herein designated VGAM FOLDED PRECURSOR RNA, of VGAM799 are further described hereinbelow with reference to Table 1.

Nucleotide sequences of host target binding sites, such as BINDING SITE-I, BINDING SITE-II and BINDING SITE-III of FIG. 1, found on VGAM799 host target RNA, and schematic representation of the complementarity of each of these host target binding sites to VGAM799 RNA, herein designated VGAM RNA, are described hereinbelow with reference to Table 2.

As mentioned hereinabove with reference to FIG. 1, a function of VGAM799 gene, herein designated VGAM is inhibition of expression of VGAM799 target genes. It is appreciated that specific functions, and accordingly utilities, of VGAM799 correlate with, and may be deduced from, the identity of the target genes which VGAM799 binds and inhibits, and the function of these target genes, as elaborated hereinbelow.

Ankyrin 1, Erythrocytic (ANK1, Accession NM_000037) is a VGAM799 host target gene. ANK1 BINDING SITE1 through ANK1 BINDING SITE3 are HOST TARGET binding sites found in untranslated regions of mRNA encoded by ANK1, corresponding to HOST TARGET binding sites such as BINDING SITE I, BINDING SITE II or BINDING SITE III. Table 2 illustrates the complementarity of the nucleotide sequences of ANK1 BINDING SITE1 through ANK1 BINDING SITE3, designated SEQ ID:5474, SEQ ID:21727 and SEQ ID:30277 respectively, to the nucleotide sequence of VGAM799 RNA, herein designated VGAM RNA, also designated SEQ ID:3510.

A function of VGAM799 is therefore inhibition of Ankyrin 1, Erythrocytic (ANK1, Accession NM_000037). Accordingly, utilities of VGAM799 include diagnosis, prevention and treatment of diseases and clinical conditions associated with ANK1. KIAA1796 (Accession XM_166146) is another VGAM799 host target gene. KIAA1796 BINDING SITE is HOST TARGET binding site found in the 3' untranslated region of mRNA encoded by KIAA1796, corresponding to a HOST TARGET binding site such as BINDING SITE I, BINDING SITE II or BINDING SITE III. Table 2 illustrates the complementarity of the nucleotide sequences of KIAA1796 BINDING SITE, designated SEQ ID:43962, to the nucleotide sequence of VGAM799 RNA, herein designated VGAM RNA, also designated SEQ ID:3510.

Another function of VGAM799 is therefore inhibition of KIAA1796 (Accession XM_166146). Accordingly, utilities of VGAM799 include diagnosis, prevention and treatment of diseases and clinical conditions associated with KIAA1796. FIG. 1 further provides a conceptual description of a novel bioinformatically detected viral gene of the present invention, referred to here as Viral Genomic Address Messenger 800 (VGAM800) viral gene, which modulates expression of respective host target genes thereof, the function and utility of which host target genes is known in the art.

VGAM800 is a novel bioinformatically detected regulatory, non protein coding, viral micro RNA (miRNA) gene. The method by which VGAM800 was detected is described hereinabove with reference to FIGS. 1-8.

VGAM800 gene, herein designated VGAM GENE, is a viral gene contained in the genome of Shrimp White Spot Syndrome Virus (white spot bacilliform virus). VGAM800 host target gene, herein designated VGAM HOST TARGET GENE, is a human gene contained in the human genome.

VGAM800 gene encodes a VGAM800 precursor RNA, herein designated VGAM PRECURSOR RNA. Similar to other miRNA genes, and unlike most ordinary genes, VGAM800 precursor RNA does not encode a protein. A nucleotide sequence identical or highly similar to the nucleotide sequence of VGAM800 precursor RNA is designated SEQ ID:786, and is provided hereinbelow with reference to the sequence listing part. Nucleotide sequence SEQ ID:786 is located at position 181601 relative to the genome of Shrimp White Spot Syndrome Virus (white spot bacilliform virus).

VGAM800 precursor RNA folds onto itself, forming VGAM800 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM800 folded precursor RNA into VGAM800 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM800 RNA is designated SEQ ID:3511, and is provided hereinbelow with reference to the sequence listing part.

VGAM800 host target gene, herein designated VGAM HOST TARGET GENE, encodes a corresponding messenger RNA, VGAM800 host target RNA, herein designated VGAM HOST TARGET RNA. VGAM800 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM800 RNA, herein designated VGAM RNA, binds complementarily to one or more host target binding sites located in untranslated regions of VGAM800 host target RNA, herein designated VGAM HOST TARGET RNA. This complementary binding is due to the fact that the nucleotide sequence of VGAM800 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM800 RNA, herein designated VGAM RNA, may have a different number of host target binding sites in untranslated regions of a VGAM800 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM800 RNA, herein designated VGAM RNA, to host target binding sites on VGAM800 host target RNA, herein designated VGAM HOST TARGET RNA, such as BINDING SITE I, BINDING SITE II and BINDING SITE III, inhibits translation of VGAM800 host target RNA into VGAM800 host target protein, herein designated VGAM HOST TARGET PROTEIN. VGAM host target protein is therefore outlined by a broken line.

It is appreciated that VGAM800 host target gene, herein designated VGAM HOST TARGET GENE, in fact represents a plurality of VGAM800 host target genes. The mRNA of each one of this plurality of VGAM800 host target genes comprises one or more host target binding sites, each having a nucleotide sequence which is at least partly complementary to VGAM800 RNA, herein designated VGAM RNA, and which when bound by VGAM800 RNA causes inhibition of translation of respective one or more VGAM800 host target proteins.

It is further appreciated by one skilled in the art that the mode of translational inhibition illustrated by FIG. 1 with specific reference to translational inhibition exerted by VGAM800 gene, herein designated VGAM GENE, on one or more VGAM800 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM800 is inhibition of expression of host target genes, as part of a novel viral mechanism of attacking a host. Accordingly, utilities of VGAM800 include diagnosis, prevention and treatment of viral infection by Shrimp White Spot Syndrome Virus (white spot bacilliform virus). Specific functions, and accordingly utilities, of VGAM800 correlate with, and may be deduced from, the identity of the host target genes which VGAM800 binds and inhibits, and the function of these host target genes, as elaborated hereinbelow.

Nucleotide sequences of the VGAM800 precursor RNA, herein designated VGAM PRECURSOR RNA, and of the 'diced' VGAM800 RNA, herein designated VGAM RNA, and a schematic representation of the secondary folding of VGAM800 folded precursor RNA, herein designated VGAM FOLDED PRECURSOR RNA, of VGAM800 are further described hereinbelow with reference to Table 1.

Nucleotide sequences of host target binding sites, such as BINDING SITE-I, BINDING SITE-II and BINDING SITE-III of FIG. 1, found on VGAM800 host target RNA, and schematic representation of the complementarity of each of these host target binding sites to VGAM800 RNA, herein designated VGAM RNA, are described hereinbelow with reference to Table 2.

As mentioned hereinabove with reference to FIG. 1, a function of VGAM800 gene, herein designated VGAM is inhibition of expression of VGAM800 target genes. It is appreciated that specific functions, and accordingly utilities, of VGAM800 correlate with, and may be deduced from, the identity of the target genes which VGAM800 binds and inhibits, and the function of these target genes, as elaborated hereinbelow.

Ecotropic Viral Integration Site 5 (EVI5, Accession NM_005665) is a VGAM800 host target gene. EVI5 BINDING SITE is HOST TARGET binding site found in the 3' untranslated region of mRNA encoded by EVI5, corresponding to a HOST TARGET binding site such as BINDING SITE I, BINDING SITE II or BINDING SITE III. Table 2 illustrates the complementarity of the nucleotide sequences of EVI5 BINDING SITE, designated SEQ ID:12216, to the nucleotide sequence of VGAM800 RNA, herein designated VGAM RNA, also designated SEQ ID:3511.

A function of VGAM800 is therefore inhibition of Ecotropic Viral Integration Site 5 (EVI5, Accession NM_005665). Accordingly, utilities of VGAM800 include diagnosis, prevention and treatment of diseases and clinical conditions associated with EVI5. KIAA1789 (Accession XM_040486) is another VGAM800 host target gene. KIAA1789 BINDING SITE is HOST TARGET binding site found in the 5' untranslated region of mRNA encoded by KIAA1789, corresponding to a HOST TARGET binding site such as BINDING SITE I, BINDING SITE II or BINDING SITE III. Table 2 illustrates the complementarity of the nucleotide sequences of KIAA1789 BINDING SITE, designated SEQ ID:33314, to the nucleotide sequence of VGAM800 RNA, herein designated VGAM RNA, also designated SEQ ID:3511.

Another function of VGAM800 is therefore inhibition of KIAA1789 (Accession XM_040486). Accordingly, utilities of VGAM800 include diagnosis, prevention and treatment of diseases and clinical conditions associated with KIAA1789. LOC221773 (Accession XM_165802) is another VGAM800 host target gene. LOC221773 BINDING SITE is HOST TARGET binding site found in the 3' untranslated region of mRNA encoded by LOC221773, corresponding to a HOST TARGET binding site such as BINDING SITE I, BINDING SITE II or BINDING SITE III. Table 2 illustrates the complementarity of the nucleotide sequences of LOC221773 BINDING SITE, designated SEQ ID:43763, to the nucleotide sequence of VGAM800 RNA, herein designated VGAM RNA, also designated SEQ ID:3511.

Another function of VGAM800 is therefore inhibition of LOC221773 (Accession XM_165802). Accordingly, utilities of VGAM800 include diagnosis, prevention and treatment of diseases and clinical conditions associated with LOC221773. FIG. 1 further provides a conceptual description of a novel bioinformatically detected viral gene of the present invention, referred to here as Viral Genomic Address Messenger 801 (VGAM801) viral gene, which modulates expression of respective host target genes thereof, the function and utility of which host target genes is known in the art.

VGAM801 is a novel bioinformatically detected regulatory, non protein coding, viral micro RNA (miRNA) gene. The method by which VGAM801 was detected is described hereinabove with reference to FIGS. 1-8.

VGAM801 gene, herein designated VGAM GENE, is a viral gene contained in the genome of Murid Herpesvirus 4. VGAM801 host target gene, herein designated VGAM HOST TARGET GENE, is a human gene contained in the human genome.

VGAM801 gene encodes a VGAM801 precursor RNA, herein designated VGAM PRECURSOR RNA. Similar to other miRNA genes, and unlike most ordinary genes, VGAM801 precursor RNA does not encode a protein. A nucleotide sequence identical or highly similar to the nucleotide sequence of VGAM801 precursor RNA is designated SEQ ID:787, and is provided hereinbelow with reference to the sequence listing part. Nucleotide sequence SEQ ID:787 is located at position 962 relative to the genome of Murid Herpesvirus 4.

VGAM801 precursor RNA folds onto itself, forming VGAM801 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM801 folded precursor RNA into VGAM801 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM801 RNA is designated SEQ ID:3512, and is provided hereinbelow with reference to the sequence listing part.

VGAM801 host target gene, herein designated VGAM HOST TARGET GENE, encodes a corresponding messenger RNA, VGAM801 host target RNA, herein designated VGAM HOST TARGET RNA. VGAM801 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM801 RNA, herein designated VGAM RNA, binds complementarily to one or more host target binding sites located in untranslated regions of VGAM801 host target RNA, herein designated VGAM HOST TARGET RNA. This complementary binding is due to the fact that the nucleotide sequence of VGAM801 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM801 RNA, herein designated VGAM RNA, may have a different number of host target binding sites in untranslated regions of a VGAM801 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM801 RNA, herein designated VGAM RNA, to host target binding sites on VGAM801 host target RNA, herein designated VGAM HOST TARGET RNA, such as BINDING SITE I, BINDING SITE II and BINDING SITE III, inhibits translation of VGAM801 host target RNA into VGAM801 host target protein, herein designated VGAM HOST TARGET PROTEIN. VGAM host target protein is therefore outlined by a broken line.

It is appreciated that VGAM801 host target gene, herein designated VGAM HOST TARGET GENE, in fact represents a plurality of VGAM801 host target genes. The mRNA of each one of this plurality of VGAM801 host target genes comprises one or more host target binding sites, each having a nucleotide sequence which is at least partly complementary to VGAM801 RNA, herein designated VGAM RNA, and which when bound by VGAM801 RNA causes inhibition of translation of respective one or more VGAM801 host target proteins.

It is further appreciated by one skilled in the art that the mode of translational inhibition illustrated by FIG. 1 with specific reference to translational inhibition exerted by VGAM801 gene, herein designated VGAM GENE, on one or more VGAM801 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM801 is inhibition of expression of host target genes, as part of a novel viral mechanism of attacking a host. Accordingly, utilities of VGAM801 include diagnosis, prevention and treatment of viral infection by Murid Herpesvirus 4. Specific functions, and accordingly utilities, of VGAM801 correlate with, and may be deduced from, the identity of the host target genes which VGAM801 binds and inhibits, and the function of these host target genes, as elaborated hereinbelow.

Nucleotide sequences of the VGAM801 precursor RNA, herein designated VGAM PRECURSOR RNA, and of the 'diced' VGAM801 RNA, herein designated VGAM RNA, and a schematic representation of the secondary folding of VGAM801 folded precursor RNA, herein designated VGAM FOLDED PRECURSOR RNA, of VGAM801 are further described hereinbelow with reference to Table 1.

Nucleotide sequences of host target binding sites, such as BINDING SITE-I, BINDING SITE-II and BINDING SITE-III of FIG. 1, found on VGAM801 host target RNA, and schematic representation of the complementarity of each of these host target binding sites to VGAM801 RNA, herein designated VGAM RNA, are described hereinbelow with reference to Table 2.

As mentioned hereinabove with reference to FIG. 1, a function of VGAM801 gene, herein designated VGAM is inhibition of expression of VGAM801 target genes. It is appreciated that specific functions, and accordingly utilities, of VGAM801 correlate with, and may be deduced from, the identity of the target genes which VGAM801 binds and inhibits, and the function of these target genes, as elaborated hereinbelow.

ATP10C (Accession NM_024490) is a VGAM801 host target gene. ATP10C BINDING SITE is HOST TARGET binding site found in the 3' untranslated region of mRNA encoded by ATP10C, corresponding to a HOST TARGET binding site such as BINDING SITE I, BINDING SITE II or BINDING SITE III. Table 2 illustrates the complementarity of the nucleotide sequences of ATP10C BINDING SITE, designated SEQ ID:23685, to the nucleotide sequence of VGAM801 RNA, herein designated VGAM RNA, also designated SEQ ID:3512.

A function of VGAM801 is therefore inhibition of ATP10C (Accession NM_024490), a gene which is phosphorylated in their intermediate state, drives uphill transport of ions across membranes. Accordingly, utilities of VGAM801 include diagnosis, prevention and treatment of diseases and clinical conditions associated with ATP10C. The function of ATP10C has been established by previous studies. Meguro et al. (2001) reported that the ATP10C gene is maternally expressed, that it maps within the most common interval of deletion responsible for Angelman syndrome (AS; 105830) (15q11-q13), and that ATP10C expression is virtually absent from Angelman syndrome patients with imprinting mutations, as well as from patients with maternal deletions of 15q11-q13. Previously, although AS patients infrequently have mutations in the UBE3A gene (OMIM Ref. No. 601623), which encodes a ubiquitin ligase required for long-term synaptic potentiation (LTP), most cases were attributable to de novo maternal deletions of the critical 15q region. Herzing et al. (2001) reported that ATP10C maps within 200 kb distal to UBE3A and, like UBE3A, demonstrates imprinted, preferential maternal expression in human brain. They suggested that ATP10C is a candidate for chromosome 15-associated autism as well as the Angelman syndrome phenotype. Animal model experiments lend further support to the function of ATP10C. Dhar et al. (2000) reported that maternal inheritance of deletions of the mouse Atp10c gene resulted in increased body fat. The obese phenotype was consistently observed in the mouse model for Angelman syndrome with paternal uniparental disomy (Cattanach et al., 1997). Meguro et al. (2001) speculated that ATP10C may be an aminophospholipid translocase involved in phospholipid transport.

It is appreciated that the abovementioned animal model for ATP10C is acknowledged by those skilled in the art as a scientifically valid animal model, as can be further appreciated from the publications sited hereinbelow.

Full details of the abovementioned studies are described in the following publications, the disclosure of which are hereby incorporated by reference:

Meguro, M.; Kashiwagi, A.; Mitsuya, K.; Nakao, M.; Kondo, I.; Saitoh, S.; Oshimura, M.: A novel maternally expressed gene, ATP10C, encodes a putative aminophospholipid translocase associated with Angelman syndrome. Nature Genet. 28:19-20, 2001; and Cattanach, B. M.; Barr, J. A.; Beechey, C. V.; Martin, J.; Noebels, J.; Jones, J.: A candidate model for Angelman syndrome in the mouse. Mammalian Genome 8: 472-478, 1997.

Further studies establishing the function and utilities of ATP10C are found in John Hopkins OMIM database record ID 605855, and in sited publications numbered 6621-6622, 12269, 676 and 6779 listed in the bibliography section hereinbelow, which are also hereby incorporated by reference. Meningioma Expressed Antigen 5 (hyaluronidase) (MGEA5, Accession NM_012215) is another VGAM801 host target gene. MGEA5 BINDING SITE is HOST TARGET binding site found in the 3' untranslated region of mRNA encoded by MGEA5, corresponding to a HOST TARGET binding site such as BINDING SITE I, BINDING SITE II or BINDING SITE III. Table 2 illustrates the complementarity of the nucleotide sequences of MGEA5 BINDING SITE, designated SEQ ID:14516, to the nucleotide sequence of VGAM801 RNA, herein designated VGAM RNA, also designated SEQ ID:3512.

Another function of VGAM801 is therefore inhibition of Meningioma Expressed Antigen 5 (hyaluronidase) (MGEA5, Accession NM_012215), a gene which has a hyaluronidase activity. Accordingly, utilities of VGAM801 include diagnosis, prevention and treatment of diseases and clinical conditions associated with MGEA5. The function of MGEA5 has been established by previous studies. By screening a meningioma expression library with autologous serum, Heckel et al. (1998) identified 4 cDNA clones representing a novel gene, which they designated meningioma-expressed antigen-5, with striking homology to C. elegans hyaluronidase. MGEA5 was noted to have hyaluronidase activity, but was otherwise not characterized. By sequencing randomly selected cDNAs corresponding to relatively long transcripts from human brain, Ishikawa et al. (1998) isolated an MGEA5 cDNA, which they designated KIAA0679, encoding a deduced 767-amino acid protein.

Full details of the abovementioned studies are described in the following publications, the disclosure of which are hereby incorporated by reference:

Heckel, D.; Comtesse, N.; Brass, N.; Blin, N.; Zang, K. D.; Meese, E.: Novel immunogenic antigen homologous to hyaluronidase in meningioma. Hum. Molec. Genet. 7:1859-1872, 1998; and Ishikawa, K.; Nagase, T.; Suyama, M.; Miyajima, N.; Tanaka, A.; Kotani, H.; Nomura, N.; Ohara, O.: Prediction of the coding sequences of unidentified human genes. X. The complete sequences.

Further studies establishing the function and utilities of MGEA5 are found in John Hopkins OMIM database record ID 604039, and in sited publications numbered 820 and 9440 listed in the bibliography section hereinbelow, which are also hereby incorporated by reference. MSTP032 (Accession NM_025226) is another VGAM801 host target gene. MSTP032 BINDING SITE is HOST TARGET binding site found in the 3' untranslated region of mRNA encoded by MSTP032, corresponding to a HOST TARGET binding site such as BINDING SITE I, BINDING SITE II or BINDING SITE III. Table 2 illustrates the complementarity of the nucleotide sequences of MSTP032 BINDING SITE, designated SEQ ID:24903, to the nucleotide sequence of VGAM801 RNA, herein designated VGAM RNA, also designated SEQ ID:3512.

Another function of VGAM801 is therefore inhibition of MSTP032 (Accession NM_025226). Accordingly, utilities of VGAM801 include diagnosis, prevention and treatment of diseases and clinical conditions associated with MSTP032. TED (Accession NM_015686) is another VGAM801 host target gene. TED BINDING SITE is HOST TARGET binding site found in the 3' untranslated region of mRNA encoded by TED, corresponding to a HOST TARGET binding site such as BINDING SITE I, BINDING SITE II or BINDING SITE III. Table 2 illustrates the complementarity of the nucleotide sequences of TED BINDING SITE, designated SEQ ID:17910, to the nucleotide sequence of VGAM801 RNA, herein designated VGAM RNA, also designated SEQ ID:3512.

Another function of VGAM801 is therefore inhibition of TED (Accession NM_015686). Accordingly, utilities of VGAM801 include diagnosis, prevention and treatment of diseases and clinical conditions associated with TED. LOC151126 (Accession XM_087103) is another VGAM801 host target gene. LOC151126 BINDING SITE is HOST TARGET binding site found in the 5' untranslated region of mRNA encoded by LOC151126, corresponding to a HOST TARGET binding site such as BINDING SITE I, BINDING SITE II or BINDING SITE III. Table 2 illustrates the complementarity of the nucleotide sequences of LOC151126 BINDING SITE, designated SEQ ID:39055, to the nucleotide sequence of VGAM801 RNA, herein designated VGAM RNA, also designated SEQ ID:3512.

Another function of VGAM801 is therefore inhibition of LOC151126 (Accession XM_087103). Accordingly, utilities of VGAM801 include diagnosis, prevention and treatment of diseases and clinical conditions associated with LOC151126. FIG. 1 further provides a conceptual description of a novel bioinformatically detected viral gene of the present invention, referred to here as Viral Genomic Address Messenger 802 (VGAM802) viral gene, which modulates expression of respective host target genes thereof, the function and utility of which host target genes is known in the art.

VGAM802 is a novel bioinformatically detected regulatory, non protein coding, viral micro RNA (miRNA) gene. The method by which VGAM802 was detected is described hereinabove with reference to FIGS. 1-8.

VGAM802 gene, herein designated VGAM GENE, is a viral gene contained in the genome of Murid Herpesvirus 4. VGAM802 host target gene, herein designated VGAM HOST TARGET GENE, is a human gene contained in the human genome.

VGAM802 gene encodes a VGAM802 precursor RNA, herein designated VGAM PRECURSOR RNA. Similar to other miRNA genes, and unlike most ordinary genes, VGAM802 precursor RNA does not encode a protein. A nucleotide sequence identical or highly similar to the nucleotide sequence of VGAM802 precursor RNA is designated SEQ ID:788, and is provided hereinbelow with reference to the sequence listing part. Nucleotide sequence SEQ ID:788 is located at position 638 relative to the genome of Murid Herpesvirus 4.

VGAM802 precursor RNA folds onto itself, forming VGAM802 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM802 folded precursor RNA into VGAM802 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 88%) nucleotide sequence of VGAM802 RNA is designated SEQ ID:3513, and is provided hereinbelow with reference to the sequence listing part.

VGAM802 host target gene, herein designated VGAM HOST TARGET GENE, encodes a corresponding messenger RNA, VGAM802 host target RNA, herein designated VGAM HOST TARGET RNA. VGAM802 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM802 RNA, herein designated VGAM RNA, binds complementarily to one or more host target binding sites located in untranslated regions of VGAM802 host target RNA, herein designated VGAM HOST TARGET RNA. This complementary binding is due to the fact that the nucleotide sequence of VGAM802 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM802 RNA, herein designated VGAM RNA, may have a different number of host target binding sites in untranslated regions of a VGAM802 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM802 RNA, herein designated VGAM RNA, to host target binding sites on VGAM802 host target RNA, herein designated VGAM HOST TARGET RNA, such as BINDING SITE I, BINDING SITE II and BINDING SITE III, inhibits translation of VGAM802 host target RNA into VGAM802 host target protein, herein designated VGAM HOST TARGET PROTEIN. VGAM host target protein is therefore outlined by a broken line.

It is appreciated that VGAM802 host target gene, herein designated VGAM HOST TARGET GENE, in fact represents a plurality of VGAM802 host target genes. The mRNA of each one of this plurality of VGAM802 host target genes comprises one or more host target binding sites, each having a nucleotide sequence which is at least partly complementary to VGAM802 RNA, herein designated VGAM RNA, and which when bound by VGAM802 RNA causes inhibition of translation of respective one or more VGAM802 host target proteins.

It is further appreciated by one skilled in the art that the mode of translational inhibition illustrated by FIG. 1 with specific reference to translational inhibition exerted by VGAM802 gene, herein designated VGAM GENE, on one or more VGAM802 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM802 is inhibition of expression of host target genes, as part of a novel viral mechanism of attacking a host. Accordingly, utilities of VGAM802 include diagnosis, prevention and treatment of viral infection by Murid Herpesvirus 4. Specific functions, and accordingly utilities, of VGAM802 correlate with, and may be deduced from, the identity of the host target genes which VGAM802 binds and inhibits, and the function of these host target genes, as elaborated hereinbelow.

Nucleotide sequences of the VGAM802 precursor RNA, herein designated VGAM PRECURSOR RNA, and of the 'diced' VGAM802 RNA, herein designated VGAM RNA, and a schematic representation of the secondary folding of VGAM802 folded precursor RNA, herein designated VGAM FOLDED PRECURSOR RNA, of VGAM802 are further described hereinbelow with reference to Table 1.

Nucleotide sequences of host target binding sites, such as BINDING SITE-I, BINDING SITE-II and BINDING SITE-III of FIG. 1, found on VGAM802 host target RNA, and schematic representation of the complementarity of each of these host target binding sites to VGAM802 RNA, herein designated VGAM RNA, are described hereinbelow with reference to Table 2.

As mentioned hereinabove with reference to FIG. 1, a function of VGAM802 gene, herein designated VGAM is inhibition of expression of VGAM802 target genes. It is appreciated that specific functions, and accordingly utilities, of VGAM802 correlate with, and may be deduced from, the identity of the target genes which VGAM802 binds and inhibits, and the function of these target genes, as elaborated hereinbelow.

Cholinergic Receptor, Nicotinic, Beta Polypeptide 2 (neuronal) (CHRNB2, Accession NM_000748) is a VGAM802 host target gene. CHRNB2 BINDING SITE is HOST TARGET binding site found in the 5' untranslated region of mRNA encoded by CHRNB2, corresponding to a HOST TARGET binding site such as BINDING SITE I, BINDING SITE II or BINDING SITE III. Table 2 illustrates the complementarity of the nucleotide sequences of CHRNB2 BINDING SITE, designated SEQ ID:6402, to the nucleotide sequence of VGAM802 RNA, herein designated VGAM RNA, also designated SEQ ID:3513.

A function of VGAM802 is therefore inhibition of Cholinergic Receptor, Nicotinic, Beta Polypeptide 2 (neuronal) (CHRNB2, Accession NM_000748), a gene which mediates fast signal transmission at synapses. Accordingly, utilities of VGAM802 include diagnosis, prevention and treatment of diseases and clinical conditions associated with CHRNB2. The function of CHRNB2 and its association with various diseases and clinical conditions, has been established by previous studies, as described hereinabove with reference to VGAM166. Myeloid/lymphoid Or Mixed-lineage Leukemia (trithorax homolog, Drosophila); Translocated To, 2 (MLLT2, Accession NM_005935) is another VGAM802 host target gene. MLLT2 BINDING SITE is HOST TARGET binding site found in the 3' untranslated region of mRNA encoded by MLLT2, corresponding to a HOST TARGET binding site such as BINDING SITE I, BINDING SITE II or BINDING SITE III. Table 2 illustrates the complementarity of the nucleotide sequences of MLLT2 BINDING SITE, designated SEQ ID:12569, to the nucleotide sequence of VGAM802 RNA, herein designated VGAM RNA, also designated SEQ ID:3513.

Another function of VGAM802 is therefore inhibition of Myeloid/lymphoid Or Mixed-lineage Leukemia (trithorax homolog, Drosophila); Translocated To, 2 (MLLT2, Accession NM_005935), a gene which is a Putative transcription factor. Accordingly, utilities of VGAM802 include diagnosis, prevention and treatment of diseases and clinical conditions associated with MLLT2. The function of MLLT2 and its association with various diseases and clinical conditions, has been established by previous studies, as described hereinabove with reference to VGAM57. Thyroid Hormone Receptor, Beta (erythroblastic leukemia viral (v-erb-a) Oncogene Homolog 2, Avian) (THRB, Accession NM_000461) is another VGAM802 host target gene. THRB BINDING SITE is HOST TARGET binding site found in the 5' untranslated region of mRNA encoded by THRB, corresponding to a HOST TARGET binding site such as BINDING SITE I, BINDING SITE II or BINDING SITE III. Table 2 illustrates the complementarity of the nucleotide sequences of THRB BINDING SITE, designated SEQ ID:6076, to the nucleotide sequence of VGAM802 RNA, herein designated VGAM RNA, also designated SEQ ID:3513.

Another function of VGAM802 is therefore inhibition of Thyroid Hormone Receptor, Beta (erythroblastic leukemia viral (v-erb-a) Oncogene Homolog 2, Avian) (THRB, Accession NM_000461). Accordingly, utilities of VGAM802 include diagnosis, prevention and treatment of diseases and clinical conditions associated with THRB. FLJ11413 (Accession NM_024554) is another VGAM802 host target gene. FLJ11413 BINDING SITE is HOST TARGET binding site found in the 3' untranslated region of mRNA encoded by FLJ11413, corresponding to a HOST TARGET binding site such as BINDING SITE I, BINDING SITE II or BINDING SITE III. Table 2 illustrates the complementarity of the nucleotide sequences of FLJ11413 BINDING SITE, designated SEQ ID:23774, to the nucleotide sequence of VGAM802 RNA, herein designated VGAM RNA, also designated SEQ ID:3513.

Another function of VGAM802 is therefore inhibition of FLJ11413 (Accession NM_024554). Accordingly, utilities of VGAM802 include diagnosis, prevention and treatment of diseases and clinical conditions associated with FLJ11413. Interleukin 14 (IL14, Accession XM_170924) is another VGAM802 host target gene. IL14 BINDING SITE is HOST TARGET binding site found in the 5' untranslated region of mRNA encoded by IL14, corresponding to a HOST TARGET binding site such as BINDING SITE I, BINDING SITE II or BINDING SITE III. Table 2 illustrates the complementarity of the nucleotide sequences of IL14 BINDING SITE, designated SEQ ID:45702, to the nucleotide sequence of VGAM802 RNA, herein designated VGAM RNA, also designated SEQ ID:3513.

Another function of VGAM802 is therefore inhibition of Interleukin 14 (IL14, Accession XM_170924). Accordingly, utilities of VGAM802 include diagnosis, prevention and treatment of diseases and clinical conditions associated with IL14. KIAA0916 (Accession NM_015057) is another VGAM802 host target gene. KIAA0916 BINDING SITE is HOST TARGET binding site found in the 3' untranslated region of mRNA encoded by KIAA0916, corresponding to a HOST TARGET binding site such as BINDING SITE I, BINDING SITE II or BINDING SITE III. Table 2 illustrates the complementarity of the nucleotide sequences of KIAA0916 BINDING SITE, designated SEQ ID:17416, to the nucleotide sequence of VGAM802 RNA, herein designated VGAM RNA, also designated SEQ ID:3513.

Another function of VGAM802 is therefore inhibition of KIAA0916 (Accession NM_015057). Accordingly, utilities of VGAM802 include diagnosis, prevention and treatment of diseases and clinical conditions associated with KIAA0916. KRT6IRS (Accession NM_033448) is another VGAM802 host target gene. KRT6IRS BINDING SITE is HOST TARGET binding site found in the 3' untranslated region of mRNA encoded by KRT6IRS, corresponding to a HOST TARGET binding site such as BINDING SITE I, BINDING SITE II or BINDING SITE III. Table 2 illustrates the complementarity of the nucleotide sequences of KRT6IRS BINDING SITE, designated SEQ ID:27252, to the nucleotide sequence of VGAM802 RNA, herein designated VGAM RNA, also designated SEQ ID:3513.

Another function of VGAM802 is therefore inhibition of KRT6IRS (Accession NM_033448). Accordingly, utilities of VGAM802 include diagnosis, prevention and treatment of diseases and clinical conditions associated with KRT6IRS. LOC137991 (Accession XM_059934) is another VGAM802 host target gene. LOC137991 BINDING SITE is HOST TARGET binding site found in the 5' untranslated region of mRNA encoded by LOC137991, corresponding to a HOST TARGET binding site such as BINDING SITE I, BINDING SITE II or BINDING SITE III. Table 2 illustrates the complementarity of the nucleotide sequences of LOC137991 BINDING SITE, designated SEQ ID:37114, to the nucleotide sequence of VGAM802 RNA, herein designated VGAM RNA, also designated SEQ ID:3513.

Another function of VGAM802 is therefore inhibition of LOC137991 (Accession XM_059934). Accordingly, utilities of VGAM802 include diagnosis, prevention and treatment of diseases and clinical conditions associated with LOC137991. LOC151234 (Accession XM_087136) is another VGAM802 host target gene. LOC151234 BINDING SITE is HOST TARGET binding site found in the 3' untranslated region of mRNA encoded by LOC151234, corresponding to a HOST TARGET binding site such as BINDING SITE I, BINDING SITE II or BINDING SITE III. Table 2 illustrates the complementarity of the nucleotide sequences of LOC151234 BINDING SITE, designated SEQ ID:39077, to the nucleotide sequence of VGAM802 RNA, herein designated VGAM RNA, also designated SEQ ID:3513.

Another function of VGAM802 is therefore inhibition of LOC151234 (Accession XM_087136). Accordingly, utilities of VGAM802 include diagnosis, prevention and treatment of diseases and clinical conditions associated with LOC151234. FIG. 1 further provides a conceptual description of a novel bioinformatically detected viral gene of the present invention, referred to here as Viral Genomic Address Messenger 803 (VGAM803) viral gene, which modulates expression of respective host target genes thereof, the function and utility of which host target genes is known in the art.

VGAM803 is a novel bioinformatically detected regulatory, non protein coding, viral micro RNA (miRNA) gene. The method by which VGAM803 was detected is described hereinabove with reference to FIGS. 1-8.

VGAM803 gene, herein designated VGAM GENE, is a viral gene contained in the genome of Murid Herpesvirus 4. VGAM803 host target gene, herein designated VGAM HOST TARGET GENE, is a human gene contained in the human genome.

VGAM803 gene encodes a VGAM803 precursor RNA, herein designated VGAM PRECURSOR RNA. Similar to other miRNA genes, and unlike most ordinary genes, VGAM803 precursor RNA does not encode a protein. A nucleotide sequence identical or highly similar to the nucleotide sequence of VGAM803 precursor RNA is designated SEQ ID:789, and is provided hereinbelow with reference to the sequence listing part. Nucleotide sequence SEQ ID:789 is located at position 201 relative to the genome of Murid Herpesvirus 4.

VGAM803 precursor RNA folds onto itself, forming VGAM803 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM803 folded precursor RNA into VGAM803 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM803 RNA is designated SEQ ID:3514, and is provided hereinbelow with reference to the sequence listing part.

VGAM803 host target gene, herein designated VGAM HOST TARGET GENE, encodes a corresponding messenger RNA, VGAM803 host target RNA, herein designated VGAM HOST TARGET RNA. VGAM803 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM803 RNA, herein designated VGAM RNA, binds complementarily to one or more host target binding sites located in untranslated regions of VGAM803 host target RNA, herein designated VGAM HOST TARGET RNA. This complementary binding is due to the fact that the nucleotide sequence of VGAM803 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM803 RNA, herein designated VGAM RNA, may have a different number of host target binding sites in untranslated regions of a VGAM803 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM803 RNA, herein designated VGAM RNA, to host target binding sites on VGAM803 host target RNA, herein designated VGAM HOST TARGET RNA, such as BINDING SITE I, BINDING SITE II and BINDING SITE III, inhibits translation of VGAM803 host target RNA into VGAM803 host target protein, herein designated VGAM HOST TARGET PROTEIN. VGAM host target protein is therefore outlined by a broken line.

It is appreciated that VGAM803 host target gene, herein designated VGAM HOST TARGET GENE, in fact represents a plurality of VGAM803 host target genes. The mRNA of each one of this plurality of VGAM803 host target genes comprises one or more host target binding sites, each having a nucleotide sequence which is at least partly complementary to VGAM803 RNA, herein designated VGAM RNA, and which when bound by VGAM803 RNA causes inhibition of translation of respective one or more VGAM803 host target proteins.

It is further appreciated by one skilled in the art that the mode of translational inhibition illustrated by FIG. 1 with specific reference to translational inhibition exerted by VGAM803 gene, herein designated VGAM GENE, on one or more VGAM803 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM803 is inhibition of expression of host target genes, as part of a novel viral mechanism of attacking a host. Accordingly, utilities of VGAM803 include diagnosis, prevention and treatment of viral infection by Murid Herpesvirus 4. Specific functions, and accordingly utilities, of VGAM803 correlate with, and may be deduced from, the identity of the host target genes which VGAM803 binds and inhibits, and the function of these host target genes, as elaborated hereinbelow.

Nucleotide sequences of the VGAM803 precursor RNA, herein designated VGAM PRECURSOR RNA, and of the 'diced' VGAM803 RNA, herein designated VGAM RNA, and a schematic representation of the secondary folding of VGAM803 folded precursor RNA, herein designated VGAM FOLDED PRECURSOR RNA, of VGAM803 are further described hereinbelow with reference to Table 1.

Nucleotide sequences of host target binding sites, such as BINDING SITE-I, BINDING SITE-II and BINDING SITE-III of FIG. 1, found on VGAM803 host target RNA, and schematic representation of the complementarity of each of these host target binding sites to VGAM803 RNA, herein designated VGAM RNA, are described hereinbelow with reference to Table 2.

As mentioned hereinabove with reference to FIG. 1, a function of VGAM803 gene, herein designated VGAM is inhibition of expression of VGAM803 target genes. It is appreciated that specific functions, and accordingly utilities, of VGAM803 correlate with, and may be deduced from, the identity of the target genes which VGAM803 binds and inhibits, and the function of these target genes, as elaborated hereinbelow.

Beta-site APP-cleaving Enzyme (BACE, Accession NM_012104) is a VGAM803 host target gene. BACE BINDING SITE1 and BACE BINDING SITE2 are HOST TARGET binding sites found in untranslated regions of mRNA encoded by BACE, corresponding to HOST TARGET binding sites such as BINDING SITE I, BINDING SITE II or BINDING SITE III. Table 2 illustrates the complementarity of the nucleotide sequences of BACE BINDING SITE1 and BACE BINDING SITE2, designated SEQ ID:14416 and SEQ ID:29084 respectively, to the nucleotide sequence of VGAM803 RNA, herein designated VGAM RNA, also designated SEQ ID:3514.

A function of VGAM803 is therefore inhibition of Beta-site APP-cleaving Enzyme (BACE, Accession NM_012104), a gene which is responsible for the proteolytic processing of the amyloid precursor protein. Accordingly, utilities of VGAM803 include diagnosis, prevention and treatment of diseases and clinical conditions associated with BACE. The function of BACE and its association with various diseases and clinical conditions, has been established by previous studies, as described hereinabove with reference to VGAM173. Nuclear Receptor Coactivator 4 (NCOA4, Accession NM_005437) is another VGAM803 host target gene. NCOA4 BINDING SITE is HOST TARGET binding site found in the 3' untranslated region of mRNA encoded by NCOA4, corresponding to a HOST TARGET binding site such as BINDING SITE I, BINDING SITE II or BINDING SITE III. Table 2 illustrates the complementarity of the nucleotide sequences of NCOA4 BINDING SITE, designated SEQ ID:11924, to the nucleotide sequence of VGAM803 RNA, herein designated VGAM RNA, also designated SEQ ID:3514.

Another function of VGAM803 is therefore inhibition of Nuclear Receptor Coactivator 4 (NCOA4, Accession NM_005437), a gene which Binds and activates androgen receptor (AR) in ligand-dependent manner. Accordingly, utilities of VGAM803 include diagnosis, prevention and treatment of diseases and clinical conditions associated with NCOA4. The function of NCOA4 and its association with various diseases and clinical conditions, has been established by previous studies, as described hereinabove with reference to VGAM420. Phosphoinositide-3-kinase, Class 2, Beta Polypeptide (PIK3C2B, Accession NM_002646) is another VGAM803 host target gene. PIK3C2B BINDING SITE is HOST TARGET binding site found in the 3' untranslated region of mRNA encoded by PIK3C2B, corresponding to a HOST TARGET binding site such as BINDING SITE I, BINDING SITE II or BINDING SITE III. Table 2 illustrates the complementarity of the nucleotide sequences of PIK3C2B BINDING SITE, designated SEQ ID:8507, to the nucleotide sequence of VGAM803 RNA, herein designated VGAM RNA, also designated SEQ ID:3514.

Another function of VGAM803 is therefore inhibition of Phosphoinositide-3-kinase, Class 2, Beta Polypeptide (PIK3C2B, Accession NM_002646). Accordingly, utilities of VGAM803 include diagnosis, prevention and treatment of diseases and clinical conditions associated with PIK3C2B. Surfactant, Pulmonary-associated Protein A2 (SFTPA2, Accession NM_006926) is another VGAM803 host target gene. SFTPA2 BINDING SITE is HOST TARGET binding site found in the 3' untranslated region of mRNA encoded by SFTPA2, corresponding to a HOST TARGET binding site such as BINDING SITE I, BINDING SITE II or BINDING SITE III. Table 2 illustrates the complementarity of the nucleotide sequences of SFTPA2 BINDING SITE, designated SEQ ID:13807, to the nucleotide sequence of VGAM803 RNA, herein designated VGAM RNA, also designated SEQ ID:3514.

Another function of VGAM803 is therefore inhibition of Surfactant, Pulmonary-associated Protein A2 (SFTPA2, Accession NM_006926), a gene which plays a role in innate host defense in the lung. Accordingly, utilities of VGAM803 include diagnosis, prevention and treatment of diseases and clinical conditions associated with SFTPA2. The function of SFTPA2 and its association with various diseases and clinical conditions, has been established by previous studies, as described hereinabove with reference to VGAM148. Small Nuclear Ribonucleoprotein 70 kDa Polypeptide (RNP antigen) (SNRP70, Accession XM_085942) is another VGAM803 host target gene. SNRP70 BINDING SITE is HOST TARGET binding site found in the 5' untranslated region of mRNA encoded by SNRP70, corresponding to a HOST TARGET binding site such as BINDING SITE I, BINDING SITE II or BINDING SITE III. Table 2 illustrates the complementarity of the nucleotide sequences of SNRP70 BINDING SITE, designated SEQ ID:38406, to the nucleotide sequence of VGAM803 RNA, herein designated VGAM RNA, also designated SEQ ID:3514.

Another function of VGAM803 is therefore inhibition of Small Nuclear Ribonucleoprotein 70 kDa Polypeptide (RNP antigen) (SNRP70, Accession XM_085942), a gene which mediates the splicing of pre-mRNA by binding to the loop I region of U1-snRNA. Accordingly, utilities of VGAM803 include diagnosis, prevention and treatment of diseases and clinical conditions associated with SNRP70. The function of SNRP70 has been established by previous studies. The series of reactions leading to the removal of intervening sequences from pre-mRNAs to yield mature mRNA occurs in a complex known as the spliceosome. The spliceosome contains several small nuclear ribonucleoprotein complexes (OMIM Ref. No. snRNPs). One of these, the U1 snRNP, contains at least 3 specific proteins. For the largest of these, the 68-kD U1-snRNP protein, a cDNA has been isolated. By use of the cDNA clone and the study of somatic cell hybrids, Barton et al. (1987) demonstrated that the gene encoding this protein is located on chromosome 19. See also Spritz et al. (1987, 1987). Spritz et al. (1987, 1987) referred to the protein as U1-70K snRNP protein. They suggested that the actual size is probably 52 kD. The protein contains 3 regions similar to known nucleic acid-binding proteins, and it binds RNA in an in vitro assay. Multiple forms due to alternative splicing may exist, possibly with different functions in vivo. The human U1-70K snRNP protein is the major antigen recognized by anti-(U1)RNP sera from patients with autoimmune diseases. Montzka and Steitz (1988) demonstrated additional complexity of the human snRNPs and stated that there are at least 12 snRNPs. Spritz et al. (1990) mapped the SNRP70 gene to 19q13.3 by a combination of Southern analysis of DNAs from somatic cell hybrids and in situ hybridization. They reported that the gene is greater than 44 kb, with 11 exons. Nelissen et al. (1991) likewise mapped the gene to 19q and concluded that it is present in single copy, but stated that it consists of 6 exons and is 14 to 16 kb long.

Full details of the abovementioned studies are described in the following publications, the disclosure of which are hereby incorporated by reference:

Montzka, K. A.; Steitz, J. A.: Additional low-abundance human small nuclear ribonucleoproteins: U11, U12, etc. Proc. Nat. Acad. Sci. 85:8885-8889, 1988; and Nelissen, R. L.; Sillekens, P. T.; Beijer, R. P.; Geurts van Kessel, A. H.; van Venrooij, W. J.: Structure, chromosomal localization and evolutionary conservation of the gene encoding.

Further studies establishing the function and utilities of SNRP70 are found in John Hopkins OMIM database record ID 180740, and in sited publications numbered 746-75 and 1549 listed in the bibliography section hereinbelow, which are also hereby incorporated by reference. Thromboxane A Synthase 1 (platelet, cytochrome P450, subfamily V) (TBXAS1, Accession NM_030984) is another VGAM803 host target gene. TBXAS1 BINDING SITE1 and TBXAS1 BINDING SITE2 are HOST TARGET binding sites found in untranslated regions of mRNA encoded by TBXAS1, corresponding to HOST TARGET binding sites such as BINDING SITE I, BINDING SITE II or BINDING SITE III. Table 2 illustrates the complementarity of the nucleotide sequences of TBXAS1 BINDING SITE1 and TBXAS1 BINDING SITE2, designated SEQ ID:25246 and SEQ ID:6732 respectively, to the nucleotide sequence of VGAM803 RNA, herein designated VGAM RNA, also designated SEQ ID:3514.

Another function of VGAM803 is therefore inhibition of Thromboxane A Synthase 1 (platelet, cytochrome P450, subfamily V) (TBXAS1, Accession NM_030984). Accordingly, utilities of VGAM803 include diagnosis, prevention and treatment of diseases and clinical conditions associated with TBXAS1. Chromatin Accessibility Complex 1 (CHRAC1, Accession NM_017444) is another VGAM803 host target gene. CHRAC1 BINDING SITE is HOST TARGET binding site found in the 3' untranslated region of mRNA encoded by CHRAC1, corresponding to a HOST TARGET binding site such as BINDING SITE I, BINDING SITE II or BINDING SITE III. Table 2 illustrates the complementarity of the nucleotide sequences of CHRAC1 BINDING SITE, designated SEQ ID:18905, to the nucleotide sequence of VGAM803 RNA, herein designated VGAM RNA, also designated SEQ ID:3514.

Another function of VGAM803 is therefore inhibition of Chromatin Accessibility Complex 1 (CHRAC1, Accession NM_017444). Accordingly, utilities of VGAM803 include diagnosis, prevention and treatment of diseases and clinical conditions associated with CHRAC1. DKFZP586B2420 (Accession XM_059482) is another VGAM803 host target gene. DKFZP586B2420 BINDING SITE is HOST TARGET binding site found in the 3' untranslated region of mRNA encoded by DKFZP586B2420, corresponding to a HOST TARGET binding site such as BINDING SITE I, BINDING SITE II or BINDING SITE III. Table 2 illustrates the complementarity of the nucleotide sequences of DKFZP586B2420 BINDING SITE, designated SEQ ID:37011, to the nucleotide sequence of VGAM803 RNA, herein designated VGAM RNA, also designated SEQ ID:3514.

Another function of VGAM803 is therefore inhibition of DKFZP586B2420 (Accession XM_059482). Accordingly, utilities of VGAM803 include diagnosis, prevention and treatment of diseases and clinical conditions associated with DKFZP586B2420. FLJ10044 (Accession NM_017980) is another VGAM803 host target gene. FLJ10044 BINDING SITE is HOST TARGET binding site found in the 3' untranslated region of mRNA encoded by FLJ10044, corresponding to a HOST TARGET binding site such as BINDING SITE I, BINDING SITE II or BINDING SITE III. Table 2 illustrates the complementarity of the nucleotide sequences of FLJ10044 BINDING SITE, designated SEQ ID:19711, to the nucleotide sequence of VGAM803 RNA, herein designated VGAM RNA, also designated SEQ ID:3514.

Another function of VGAM803 is therefore inhibition of FLJ10044 (Accession NM_017980). Accordingly, utilities of VGAM803 include diagnosis, prevention and treatment of diseases and clinical conditions associated with FLJ10044. FLJ11320 (Accession NM_018389) is another VGAM803 host target gene. FLJ11320 BINDING SITE is HOST TARGET binding site found in the 3' untranslated region of mRNA encoded by FLJ11320, corresponding to a HOST TARGET binding site such as BINDING SITE I, BINDING SITE II or BINDING SITE III. Table 2 illustrates the complementarity of the nucleotide sequences of FLJ11320 BINDING SITE, designated SEQ ID:20424, to the nucleotide sequence of VGAM803 RNA, herein designated VGAM RNA, also designated SEQ ID:3514.

Another function of VGAM803 is therefore inhibition of FLJ11320 (Accession NM_018389). Accordingly, utilities of VGAM803 include diagnosis, prevention and treatment of diseases and clinical conditions associated with FLJ11320. FLJ21940 (Accession NM_022828) is another VGAM803 host target gene. FLJ21940 BINDING SITE is HOST TARGET binding site found in the 3' untranslated region of mRNA encoded by FLJ21940, corresponding to a HOST TARGET binding site such as BINDING SITE I, BINDING SITE II or BINDING SITE III. Table 2 illustrates the complementarity of the nucleotide sequences of FLJ21940 BINDING SITE, designated SEQ ID:23107, to the nucleotide sequence of VGAM803 RNA, herein designated VGAM RNA, also designated SEQ ID:3514.

Another function of VGAM803 is therefore inhibition of FLJ21940 (Accession NM_022828). Accordingly, utilities of VGAM803 include diagnosis, prevention and treatment of diseases and clinical conditions associated with FLJ21940. FLJ23047 (Accession NM_024548) is another VGAM803 host target gene. FLJ23047 BINDING SITE is HOST TARGET binding site found in the 3' untranslated region of mRNA encoded by FLJ23047, corresponding to a HOST TARGET binding site such as BINDING SITE I, BINDING SITE II or BINDING SITE III. Table 2 illustrates the complementarity of the nucleotide sequences of FLJ23047 BINDING SITE, designated SEQ ID:23762, to the nucleotide sequence of VGAM803 RNA, herein designated VGAM RNA, also designated SEQ ID:3514.

Another function of VGAM803 is therefore inhibition of FLJ23047 (Accession NM_024548). Accordingly, utilities of VGAM803 include diagnosis, prevention and treatment of diseases and clinical conditions associated with FLJ23047. FLJ23185 (Accession NM_025056) is another VGAM803 host target gene. FLJ23185 BINDING SITE is HOST TARGET binding site found in the 5' untranslated region of mRNA encoded by FLJ23185, corresponding to a HOST TARGET binding site such as BINDING SITE I, BINDING SITE II or BINDING SITE III. Table 2 illustrates the complementarity of the nucleotide sequences of FLJ23185 BINDING SITE, designated SEQ ID:24653, to the nucleotide sequence of VGAM803 RNA, herein designated VGAM RNA, also designated SEQ ID:3514.

Another function of VGAM803 is therefore inhibition of FLJ23185 (Accession NM_025056). Accordingly, utilities of VGAM803 include diagnosis, prevention and treatment of diseases and clinical conditions associated with FLJ23185. FLJ23309 (Accession NM_024896) is another VGAM803 host target gene. FLJ23309 BINDING SITE is HOST TARGET binding site found in the 3' untranslated region of mRNA encoded by FLJ23309, corresponding to a HOST TARGET binding site such as BINDING SITE I, BINDING SITE II or BINDING SITE III. Table 2 illustrates the complementarity of the nucleotide sequences of FLJ23309 BINDING SITE, designated SEQ ID:24378, to the nucleotide sequence of VGAM803 RNA, herein designated VGAM RNA, also designated SEQ ID:3514.

Another function of VGAM803 is therefore inhibition of FLJ23309 (Accession NM_024896). Accordingly, utilities of VGAM803 include diagnosis, prevention and treatment of diseases and clinical conditions associated with FLJ23309. Phosphatidylinositol-4-phosphate 5-kinase, Type I, Gamma (PIP5K1C, Accession XM_047620) is another VGAM803 host target gene. PIP5K1C BINDING SITE is HOST TARGET binding site found in the 3' untranslated region of mRNA encoded by PIP5K1C, corresponding to a HOST TARGET binding site such as BINDING SITE I, BINDING SITE II or BINDING SITE III. Table 2 illustrates the complementarity of the nucleotide sequences of PIP5K1C BINDING SITE, designated SEQ ID:35015, to the nucleotide sequence of VGAM803 RNA, herein designated VGAM RNA, also designated SEQ ID:3514.

Another function of VGAM803 is therefore inhibition of Phosphatidylinositol-4-phosphate 5-kinase, Type I, Gamma (PIP5K1C, Accession XM_047620). Accordingly, utilities of VGAM803 include diagnosis, prevention and treatment of diseases and clinical conditions associated with PIP5K1C. LOC144558 (Accession XM_096629) is another VGAM803 host target gene. LOC144558 BINDING SITE is HOST TARGET binding site found in the 3' untranslated region of mRNA encoded by LOC144558, corresponding to a HOST TARGET binding site such as BINDING SITE I, BINDING SITE II or BINDING SITE III. Table 2 illustrates the complementarity of the nucleotide sequences of LOC144558 BINDING SITE, designated SEQ ID:40437, to the nucleotide sequence of VGAM803 RNA, herein designated VGAM RNA, also designated SEQ ID:3514.

Another function of VGAM803 is therefore inhibition of LOC144558 (Accession XM_096629). Accordingly, utilities of VGAM803 include diagnosis, prevention and treatment of diseases and clinical conditions associated with LOC144558. LOC145371 (Accession XM_085123) is another VGAM803 host target gene. LOC145371 BINDING SITE1 and LOC145371 BINDING SITE2 are HOST TARGET binding sites found in untranslated regions of mRNA encoded by LOC145371, corresponding to HOST TARGET binding sites such as BINDING SITE I, BINDING SITE II or BINDING SITE III. Table 2 illustrates the complementarity of the nucleotide sequences of LOC145371 BINDING SITE1 and LOC145371 BINDING SITE2, designated SEQ ID:37848 and SEQ ID:37847 respectively, to the nucleotide sequence of VGAM803 RNA, herein designated VGAM RNA, also designated SEQ ID:3514.

Another function of VGAM803 is therefore inhibition of LOC145371 (Accession XM_085123). Accordingly, utilities of VGAM803 include diagnosis, prevention and treatment of diseases and clinical conditions associated with LOC145371. LOC161742 (Accession XM_091095) is another VGAM803 host target gene. LOC161742 BINDING SITE is HOST TARGET binding site found in the 3' untranslated region of mRNA encoded by LOC161742, corresponding to a HOST TARGET binding site such as BINDING SITE I, BINDING SITE II or BINDING SITE III. Table 2 illustrates the complementarity of the nucleotide sequences of LOC161742 BINDING SITE, designated SEQ ID:40026, to the nucleotide sequence of VGAM803 RNA, herein designated VGAM RNA, also designated SEQ ID:3514.

Another function of VGAM803 is therefore inhibition of LOC161742 (Accession XM_091095). Accordingly, utilities of VGAM803 include diagnosis, prevention and treatment of diseases and clinical conditions associated with LOC161742. LOC201191 (Accession XM_117058) is another VGAM803 host target gene. LOC201191 BINDING SITE is HOST TARGET binding site found in the 3' untranslated region of mRNA encoded by LOC201191, corresponding to a HOST TARGET binding site such as BINDING SITE I, BINDING SITE II or BINDING SITE III. Table 2 illustrates the complementarity of the nucleotide sequences of LOC201191 BINDING SITE, designated SEQ ID:43213, to the nucleotide sequence of VGAM803 RNA, herein designated VGAM RNA, also designated SEQ ID:3514.

Another function of VGAM803 is therefore inhibition of LOC201191 (Accession XM_117058). Accordingly, utilities of VGAM803 include diagnosis, prevention and treatment of diseases and clinical conditions associated with LOC201191. LOC221486 (Accession XM_165760) is another VGAM803 host target gene. LOC221486 BINDING SITE is HOST TARGET binding site found in the 3' untranslated region of mRNA encoded by LOC221486, corresponding to a HOST TARGET binding site such as BINDING SITE I, BINDING SITE II or BINDING SITE III. Table 2 illustrates the complementarity of the nucleotide sequences of LOC221486 BINDING SITE, designated SEQ ID:43740, to the nucleotide sequence of VGAM803 RNA, herein designated VGAM RNA, also designated SEQ ID:3514.

Another function of VGAM803 is therefore inhibition of LOC221486 (Accession XM_165760). Accordingly, utilities of VGAM803 include diagnosis, prevention and treatment of diseases and clinical conditions associated with LOC221486. FIG. 1 further provides a conceptual description of a novel bioinformatically detected viral gene of the present invention, referred to here as Viral Genomic Address Messenger 804 (VGAM804) viral gene, which modulates expression of respective host target genes thereof, the function and utility of which host target genes is known in the art.

VGAM804 is a novel bioinformatically detected regulatory, non protein coding, viral micro RNA (miRNA) gene. The method by which VGAM804 was detected is described hereinabove with reference to FIGS. 1-8.

VGAM804 gene, herein designated VGAM GENE, is a viral gene contained in the genome of Shrimp White Spot Syndrome Virus (white spot bacilliform virus). VGAM804 host target gene, herein designated VGAM HOST TARGET GENE, is a human gene contained in the human genome.

VGAM804 gene encodes a VGAM804 precursor RNA, herein designated VGAM PRECURSOR RNA. Similar to other miRNA genes, and unlike most ordinary genes, VGAM804 precursor RNA does not encode a protein. A nucleotide sequence identical or highly similar to the nucleotide sequence of VGAM804 precursor RNA is designated SEQ ID:790, and is provided hereinbelow with reference to the sequence listing part. Nucleotide sequence SEQ ID:790 is located at position 229000 relative to the genome of Shrimp White Spot Syndrome Virus (white spot bacilliform virus).

VGAM804 precursor RNA folds onto itself, forming VGAM804 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM804 folded precursor RNA into VGAM804 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM804 RNA is designated SEQ ID:3515, and is provided hereinbelow with reference to the sequence listing part.

VGAM804 host target gene, herein designated VGAM HOST TARGET GENE, encodes a corresponding messenger RNA, VGAM804 host target RNA, herein designated VGAM HOST TARGET RNA. VGAM804 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM804 RNA, herein designated VGAM RNA, binds complementarily to one or more host target binding sites located in untranslated regions of VGAM804 host target RNA, herein designated VGAM HOST TARGET RNA. This complementary binding is due to the fact that the nucleotide sequence of VGAM804 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM804 RNA, herein designated VGAM RNA, may have a different number of host target binding sites in untranslated regions of a VGAM804 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM804 RNA, herein designated VGAM RNA, to host target binding sites on VGAM804 host target RNA, herein designated VGAM HOST TARGET RNA, such as BINDING SITE I, BINDING SITE II and BINDING SITE III, inhibits translation of VGAM804 host target RNA into VGAM804 host target protein, herein designated VGAM HOST TARGET PROTEIN. VGAM host target protein is therefore outlined by a broken line.

It is appreciated that VGAM804 host target gene, herein designated VGAM HOST TARGET GENE, in fact represents a plurality of VGAM804 host target genes. The mRNA of each one of this plurality of VGAM804 host target genes comprises one or more host target binding sites, each having a nucleotide sequence which is at least partly complementary to VGAM804 RNA, herein designated VGAM RNA, and which when bound by VGAM804 RNA causes inhibition of translation of respective one or more VGAM804 host target proteins.

It is further appreciated by one skilled in the art that the mode of translational inhibition illustrated by FIG. 1 with specific reference to translational inhibition exerted by VGAM804 gene, herein designated VGAM GENE, on one or more VGAM804 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM804 is inhibition of expression of host target genes, as part of a novel viral mechanism of attacking a host. Accordingly, utilities of VGAM804 include diagnosis, prevention and treatment of viral infection by Shrimp White Spot Syndrome Virus (white spot bacilliform virus). Specific functions, and accordingly utilities, of VGAM804 correlate with, and may be deduced from, the identity of the host target genes which VGAM804 binds and inhibits, and the function of these host target genes, as elaborated hereinbelow.

Nucleotide sequences of the VGAM804 precursor RNA, herein designated VGAM PRECURSOR RNA, and of the 'diced' VGAM804 RNA, herein designated VGAM RNA, and a schematic representation of the secondary folding of VGAM804 folded precursor RNA, herein designated VGAM FOLDED PRECURSOR RNA, of VGAM804 are further described hereinbelow with reference to Table 1.

Nucleotide sequences of host target binding sites, such as BINDING SITE-I, BINDING SITE-II and BINDING SITE-III of FIG. 1, found on VGAM804 host target RNA, and schematic representation of the complementarity of each of these host target binding sites to VGAM804 RNA, herein designated VGAM RNA, are described hereinbelow with reference to Table 2.

As mentioned hereinabove with reference to FIG. 1, a function of VGAM804 gene, herein designated VGAM is inhibition of expression of VGAM804 target genes. It is appreciated that specific functions, and accordingly utilities, of VGAM804 correlate with, and may be deduced from, the identity of the target genes which VGAM804 binds and inhibits, and the function of these target genes, as elaborated hereinbelow.

Caveolin 1, Caveolae Protein, 22 kDa (CAV1, Accession NM_001753) is a VGAM804 host target gene. CAV1 BINDING SITE is HOST TARGET binding site found in the 5' untranslated region of mRNA encoded by CAV1, corresponding to a HOST TARGET binding site such as BINDING SITE I, BINDING SITE II or BINDING SITE III. Table 2 illustrates the complementarity of the nucleotide sequences of CAV1 BINDING SITE, designated SEQ ID:7492, to the nucleotide sequence of VGAM804 RNA, herein designated VGAM RNA, also designated SEQ ID:3515.

A function of VGAM804 is therefore inhibition of Caveolin 1, Caveolae Protein, 22 kDa (CAV1, Accession NM_001753), a gene which may act as a scaffolding protein within caveolar membranes, and interacts directly with g-protein alpha subunits and can functionally regulate their activity. Accordingly, utilities of VGAM804 include diagnosis, prevention and treatment of diseases and clinical conditions associated with CAV1. The function of CAV1 and its association with various diseases and clinical conditions, has been established by previous studies, as described hereinabove with reference to VGAM331. CD53 Antigen (CD53, Accession NM_000560) is another VGAM804 host target gene.

CD53 BINDING SITE is HOST TARGET binding site found in the 3' untranslated region of mRNA encoded by CD53, corresponding to a HOST TARGET binding site such as BINDING SITE I, BINDING SITE II or BINDING SITE III. Table 2 illustrates the complementarity of the nucleotide sequences of CD53 BINDING SITE, designated SEQ ID:6169, to the nucleotide sequence of VGAM804 RNA, herein designated VGAM RNA, also designated SEQ ID:3515.

Another function of VGAM804 is therefore inhibition of CD53 Antigen (CD53, Accession NM_000560). Accordingly, utilities of VGAM804 include diagnosis, prevention and treatment of diseases and clinical conditions associated with CD53. Cadherin, EGF LAG Seven-pass G-type Receptor 1 (flamingo homolog, Drosophila) (CELSR1, Accession NM_014246) is another VGAM804 host target gene. CELSR1 BINDING SITE is HOST TARGET binding site found in the 3' untranslated region of mRNA encoded by CELSR1, corresponding to a HOST TARGET binding site such as BINDING SITE I, BINDING SITE II or BINDING SITE III. Table 2 illustrates the complementarity of the nucleotide sequences of CELSR1 BINDING SITE, designated SEQ ID:15514, to the nucleotide sequence of VGAM804 RNA, herein designated VGAM RNA, also designated SEQ ID:3515.

Another function of VGAM804 is therefore inhibition of Cadherin, EGF LAG Seven-pass G-type Receptor 1 (flamingo homolog, Drosophila) (CELSR1, Accession NM_014246), a gene which is involved in contact-mediated communication. Accordingly, utilities of VGAM804 include diagnosis, prevention and treatment of diseases and clinical conditions associated with CELSR1. The function of CELSR1 and its association with various diseases and clinical conditions, has been established by previous studies, as described hereinabove with reference to VGAM459. Dual-specificity tyrosine-(Y)-phosphorylation Regulated Kinase 2 (DYRK2, Accession NM_003583) is another VGAM804 host target gene. DYRK2 BINDING SITE is HOST TARGET binding site found in the 5' untranslated region of mRNA encoded by DYRK2, corresponding to a HOST TARGET binding site such as BINDING SITE I, BINDING SITE II or BINDING SITE III. Table 2 illustrates the complementarity of the nucleotide sequences of DYRK2 BINDING SITE, designated SEQ ID:9634, to the nucleotide sequence of VGAM804 RNA, herein designated VGAM RNA, also designated SEQ ID:3515.

Another function of VGAM804 is therefore inhibition of Dual-specificity tyrosine-(Y)-phosphorylation Regulated Kinase 2 (DYRK2, Accession NM_003583). Accordingly, utilities of VGAM804 include diagnosis, prevention and treatment of diseases and clinical conditions associated with DYRK2. Eve, Even-skipped Homeo Box Homolog 1 (Drosophila) (EVX1, Accession NM_001989) is another VGAM804 host target gene. EVX1 BINDING SITE is HOST TARGET binding site found in the 5' untranslated region of mRNA encoded by EVX1, corresponding to a HOST TARGET binding site such as BINDING SITE I, BINDING SITE II or BINDING SITE III. Table 2 illustrates the complementarity of the nucleotide sequences of EVX1 BINDING SITE, designated SEQ ID:7714, to the nucleotide sequence of VGAM804 RNA, herein designated VGAM RNA, also designated SEQ ID:3515.

Another function of VGAM804 is therefore inhibition of Eve, Even-skipped Homeo Box Homolog 1 (Drosophila) (EVX1, Accession NM_001989). Accordingly, utilities of VGAM804 include diagnosis, prevention and treatment of diseases and clinical conditions associated with EVX1. Coagulation Factor II (thrombin) Receptor-like 3 (F2RL3, Accession NM_003950) is another VGAM804 host target gene. F2RL3 BINDING SITE is HOST TARGET binding site found in the 3' untranslated region of mRNA encoded by F2RL3, corresponding to a HOST TARGET binding site such as BINDING SITE I, BINDING SITE II or BINDING SITE III. Table 2 illustrates the complementarity of the nucleotide sequences of F2RL3 BINDING SITE, designated SEQ ID:10086, to the nucleotide sequence of VGAM804 RNA, herein designated VGAM RNA, also designated SEQ ID:3515.

Another function of VGAM804 is therefore inhibition of Coagulation Factor II (thrombin) Receptor-like 3 (F2RL3, Accession NM_003950), a gene which Protease-activated receptor 4; G protein-coupled receptor that increases phosphoinositide hydrolysis. Accordingly, utilities of VGAM804 include diagnosis, prevention and treatment of diseases and clinical conditions associated with F2RL3. The function of F2RL3 and its association with various diseases and clinical conditions, has been established by previous studies, as described hereinabove with reference to VGAM193. Fibronectin Leucine Rich Transmembrane Protein 2 (FLRT2, Accession NM_013231) is another VGAM804 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14888, to the nucleotide sequence of VGAM804 RNA, herein designated VGAM RNA, also designated SEQ ID:3515.

Another function of VGAM804 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM804 include diagnosis, prevention and treatment of diseases and clinical conditions associated with FLRT2. The function of FLRT2 and its association with various diseases and clinical conditions, has been established by previous studies, as described hereinabove with reference to VGAM247. Membrane-spanning 4-domains, Subfamily A, Member 2 (Fc fragment of IgE, high affinity I, receptor for; beta polypeptide) (MS4A2, Accession NM_021950) is another VGAM804 host target gene. MS4A2 BINDING SITE is HOST TARGET binding site found in the 3' untranslated region of mRNA encoded by MS4A2, corresponding to a HOST TARGET binding site such as BINDING SITE I, BINDING SITE II or BINDING SITE III. Table 2 illustrates the complementarity of the nucleotide sequences of MS4A2 BINDING SITE, designated SEQ ID:22478, to the nucleotide sequence of VGAM804 RNA, herein designated VGAM RNA, also designated SEQ ID:3515.

Another function of VGAM804 is therefore inhibition of Membrane-spanning 4-domains, Subfamily A, Member 2 (Fc fragment of IgE, high affinity I, receptor for; beta polypeptide) (MS4A2, Accession NM_021950), a gene which binds to the fc region of immunoglobulins epsilon. Accordingly, utilities of VGAM804 include diagnosis, prevention and treatment of diseases and clinical conditions associated with MS4A2. The function of MS4A2 and its association with various diseases and clinical conditions, has been established by previous studies, as described hereinabove with reference to VGAM636. Myeloma Overexpressed Gene (in a subset of t (11;14) Positive Multiple Myelomas) (MYEOV, Accession NM_138768) is another VGAM804 host target gene. MYEOV BINDING SITE is HOST TARGET binding site found in the 3' untranslated region of mRNA encoded by MYEOV, corresponding to a HOST TARGET binding site such as BINDING SITE I, BINDING SITE II or BINDING SITE III. Table 2 illustrates the complementarity of the nucleotide sequences of MYEOV BINDING SITE, designated SEQ ID:29003, to the nucleotide sequence of VGAM804 RNA, herein designated VGAM RNA, also designated SEQ ID:3515.

Another function of VGAM804 is therefore inhibition of Myeloma Overexpressed Gene (in a subset of t (11;14) Positive Multiple Myelomas) (MYEOV, Accession NM_138768), a gene which is encoded by MYELOMA OVEREXPRESSED GENE. Accordingly, utilities of VGAM804 include diagnosis, prevention and treatment of diseases and clinical conditions associated with MYEOV. The function of MYEOV and its association with various diseases and clinical conditions, has been established by previous studies, as described hereinabove with reference to VGAM471. Nuclear Receptor Coactivator 6 (NCOA6, Accession NM_014071) is another VGAM804 host target gene. NCOA6 BINDING SITE is HOST TARGET binding site found in the 5' untranslated region of mRNA encoded by NCOA6, corresponding to a HOST TARGET binding site such as BINDING SITE I, BINDING SITE II or BINDING SITE III. Table 2 illustrates the complementarity of the nucleotide sequences of NCOA6 BINDING SITE, designated SEQ ID:15296, to the nucleotide sequence of VGAM804 RNA, herein designated VGAM RNA, also designated SEQ ID:3515.

Another function of VGAM804 is therefore inhibition of Nuclear Receptor Coactivator 6 (NCOA6, Accession NM_014071), a gene which activates gene transcription through ligand-dependent association with coactivators. Accordingly, utilities of VGAM804 include diagnosis, prevention and treatment of diseases and clinical conditions associated with NCOA6. The function of NCOA6 and its association with various diseases and clinical conditions, has been established by previous studies, as described hereinabove with reference to VGAM25. Protein Kinase, CAMP-dependent, Catalytic, Alpha (PRKACA, Accession NM_002730) is another VGAM804 host target gene. PRKACA BINDING SITE is HOST TARGET binding site found in the 3' untranslated region of mRNA encoded by PRKACA, corresponding to a HOST TARGET binding site such as BINDING SITE I, BINDING SITE II or BINDING SITE III. Table 2 illustrates the complementarity of the nucleotide sequences of PRKACA BINDING SITE, designated SEQ ID:8600, to the nucleotide sequence of VGAM804 RNA, herein designated VGAM RNA, also designated SEQ ID:3515.

Another function of VGAM804 is therefore inhibition of Protein Kinase, CAMP-dependent, Catalytic, Alpha (PRKACA, Accession NM_002730), a gene which phosphorylates target proteins on serine or threonine residues. Accordingly, utilities of VGAM804 include diagnosis, prevention and treatment of diseases and clinical conditions associated with PRKACA. The function of PRKACA and its association with various diseases and clinical conditions, has been established by previous studies, as described hereinabove with reference to VGAM175. Arginine-glutamic Acid Dipeptide (RE) Repeats (RERE, Accession NM_012102) is another VGAM804 host target gene. RERE BINDING SITE is HOST TARGET binding site found in the 3' untranslated region of mRNA encoded by RERE, corresponding to a HOST TARGET binding site such as BINDING SITE I, BINDING SITE II or BINDING SITE III. Table 2 illustrates the complementarity of the nucleotide sequences of RERE BINDING SITE, designated SEQ ID:14412, to the nucleotide sequence of VGAM804 RNA, herein designated VGAM RNA, also designated SEQ ID:3515.

Another function of VGAM804 is therefore inhibition of Arginine-glutamic Acid Dipeptide (RE) Repeats (RERE, Accession NM_012102), a gene which binds DRPLA and locates in the nucleus. Accordingly, utilities of VGAM804 include diagnosis, prevention and treatment of diseases and clinical conditions associated with RERE. The function of RERE and its association with various diseases and clinical conditions, has been established by previous studies, as described hereinabove with reference to VGAM51. Selectin P Ligand (SELPLG, Accession XM_006867) is another VGAM804 host target gene. SELPLG BINDING SITE is HOST TARGET binding site found in the 3' untranslated region of mRNA encoded by SELPLG, corresponding to a HOST TARGET binding site such as BINDING SITE I, BINDING SITE II or BINDING SITE III. Table 2 illustrates the complementarity of the nucleotide sequences of SELPLG BINDING SITE, designated SEQ ID:30018, to the nucleotide sequence of VGAM804 RNA, herein designated VGAM RNA, also designated SEQ ID:3515.

Another function of VGAM804 is therefore inhibition of Selectin P Ligand (SELPLG, Accession XM_006867), a gene which binds to p-, e- and l-selectins, which mediates the tethering and rolling of neutrophils and t-lymphocytes on endothelial cells. Accordingly, utilities of VGAM804 include diagnosis, prevention and treatment of diseases and clinical conditions associated with SELPLG. The function of SELPLG and its association with various diseases and clinical conditions, has been established by previous studies, as described hereinabove with reference to VGAM200. Zinc Finger Protein 200 (ZNF200, Accession NM_003454) is another VGAM804 host target gene. ZNF200 BINDING SITE is HOST TARGET binding site found in the 3' untranslated region of mRNA encoded by ZNF200, corresponding to a HOST TARGET binding site such as BINDING SITE I, BINDING SITE II or BINDING SITE III. Table 2 illustrates the complementarity of the nucleotide sequences of ZNF200 BINDING SITE, designated SEQ ID:9505, to the nucleotide sequence of VGAM804 RNA, herein designated VGAM RNA, also designated SEQ ID:3515.

Another function of VGAM804 is therefore inhibition of Zinc Finger Protein 200 (ZNF200, Accession NM_003454). Accordingly, utilities of VGAM804 include diagnosis, prevention and treatment of diseases and clinical conditions associated with ZNF200. Zinc Finger Protein 36 (KOX 18) (ZNF36, Accession XM_168302) is another VGAM804 host target gene. ZNF36 BINDING SITE is HOST TARGET binding site found in the 3' untranslated region of mRNA encoded by ZNF36, corresponding to a HOST TARGET binding site such as BINDING SITE I, BINDING SITE II or BINDING SITE III. Table 2 illustrates the complementarity of the nucleotide sequences of ZNF36 BINDING SITE, designated SEQ ID:45103, to the nucleotide sequence of VGAM804 RNA, herein designated VGAM RNA, also designated SEQ ID:3515.

Another function of VGAM804 is therefore inhibition of Zinc Finger Protein 36 (KOX 18) (ZNF36, Accession XM_168302), a gene which may be involved in transcriptional regulation. Accordingly, utilities of VGAM804 include diagnosis, prevention and treatment of diseases and clinical conditions associated with ZNF36. The function of ZNF36 has been established by previous studies. By screening a human insulinoma cDNA library with a degenerate oligonucleotide corresponding to the H/C linker sequence, Tommerup et al. (1993) isolated cDNAs potentially encoding zinc finger proteins. Tommerup and Vissing (1995) performed sequence analysis on a number of these cDNAs and identified several novel zinc finger protein genes, including ZNF36, which they called ZNF139. The ZNF139 cDNA predicts a protein belonging to the Kruppel family of zinc finger proteins. By isotopic in situ hybridization, Rousseau-Merck et al. (1995) mapped the ZNF36 gene, which they called KOX18, to 7q21-q22. From pulsed field gel electrophoresis studies, they showed that KOX18 is within less than 250 kb of KOX25 (ZNF38; 601261). Rousseau-Merck et al. (1995) tabulated 18 different KOX genes that had been located in pairs within 9 DNA fragments of 200 to 580 kb on 7 different chromosomes. By FISH, Tommerup and Vissing (1995) mapped the ZNF36 gene to 7q21.3-q22.1.

Full details of the abovementioned studies are described in the following publications, the disclosure of which are hereby incorporated by reference:

Tommerup, N.; Vissing, H.: Isolation and fine mapping of 16 novel human zinc finger-encoding cDNAs identify putative candidate genes for developmental and malignant disorders. Genomics 27:259-264, 1995; and Rousseau-Merck, M.-F.; Duro, D.; Berger, R.; Thiesen, H. J.: Chromosomal localization of two KOX zinc finger genes on chromosome bands 7q21-q22. Ann. Genet. 38:81-84, 1995.

Further studies establishing the function and utilities of ZNF36 are found in John Hopkins OMIM database record ID 601260, and in sited publications numbered 925 and 9255 listed in the bibliography section hereinbelow, which are also hereby incorporated by reference. AD034 (Accession NM_031480) is another VGAM804 host target gene. AD034 BINDING SITE is HOST TARGET binding site found in the 3' untranslated region of mRNA encoded by AD034, corresponding to a HOST TARGET binding site such as BINDING SITE I, BINDING SITE II or BINDING SITE III. Table 2 illustrates the complementarity of the nucleotide sequences of AD034 BINDING SITE, designated SEQ ID:25560, to the nucleotide sequence of VGAM804 RNA, herein designated VGAM RNA, also designated SEQ ID:3515.

Another function of VGAM804 is therefore inhibition of AD034 (Accession NM_031480). Accordingly, utilities of VGAM804 include diagnosis, prevention and treatment of diseases and clinical conditions associated with AD034. Apolipoprotein L, 6 (APOL6, Accession NM_030641) is another VGAM804 host target gene. APOL6 BINDING SITE is HOST TARGET binding site found in the 3' untranslated region of mRNA encoded by APOL6, corresponding to a HOST TARGET binding site such as BINDING SITE I, BINDING SITE II or BINDING SITE III. Table 2 illustrates the complementarity of the nucleotide sequences of APOL6 BINDING SITE, designated SEQ ID:24971, to the nucleotide sequence of VGAM804 RNA, herein designated VGAM RNA, also designated SEQ ID:3515.

Another function of VGAM804 is therefore inhibition of Apolipoprotein L, 6 (APOL6, Accession NM_030641). Accordingly, utilities of VGAM804 include diagnosis, prevention and treatment of diseases and clinical conditions associated with APOL6. Rho GTPase Activating Protein 5 (ARHGAP5, Accession XM_085082) is another VGAM804 host target gene. ARHGAP5 BINDING SITE is HOST TARGET binding site found in the 3' untranslated region of mRNA encoded by ARHGAP5, corresponding to a HOST TARGET binding site such as BINDING SITE I, BINDING SITE II or BINDING SITE III. Table 2 illustrates the complementarity of the nucleotide sequences of ARHGAP5 BINDING SITE, designated SEQ ID:37823, to the nucleotide sequence of VGAM804 RNA, herein designated VGAM RNA, also designated SEQ ID:3515.

Another function of VGAM804 is therefore inhibition of Rho GTPase Activating Protein 5 (ARHGAP5, Accession XM_085082). Accordingly, utilities of VGAM804 include diagnosis, prevention and treatment of diseases and clinical conditions associated with ARHGAP5. BCAA (Accession NM_016374) is another VGAM804 host target gene. BCAA BINDING SITE is HOST TARGET binding site found in the 5' untranslated region of mRNA encoded by BCAA, corresponding to a HOST TARGET binding site such as BINDING SITE I, BINDING SITE II or BINDING SITE III. Table 2 illustrates the complementarity of the nucleotide sequences of BCAA BINDING SITE, designated SEQ ID:18510, to the nucleotide sequence of VGAM804 RNA, herein designated VGAM RNA, also designated SEQ ID:3515.

Another function of VGAM804 is therefore inhibition of BCAA (Accession NM_016374). Accordingly, utilities of VGAM804 include diagnosis, prevention and treatment of diseases and clinical conditions associated with BCAA. Chromosome 20 Open Reading Frame 13 (C20orf13, Accession NM_017714) is another VGAM804 host target gene. C20orf13 BINDING SITE is HOST TARGET binding site found in the 3' untranslated region of mRNA encoded by C20orf13, corresponding to a HOST TARGET binding site such as BINDING SITE I, BINDING SITE II or BINDING SITE III. Table 2 illustrates the complementarity of the nucleotide sequences of C20orf13 BINDING SITE, designated SEQ ID:19299, to the nucleotide sequence of VGAM804 RNA, herein designated VGAM RNA, also designated SEQ ID:3515.

Another function of VGAM804 is therefore inhibition of Chromosome 20 Open Reading Frame 13 (C20orf13, Accession NM_017714). Accordingly, utilities of VGAM804 include diagnosis, prevention and treatment of diseases and clinical conditions associated with C20orf13. C3F (Accession NM_005768) is another VGAM804 host target gene. C3F BINDING SITE is HOST TARGET binding site found in the 3' untranslated region of mRNA encoded by C3F, corresponding to a HOST TARGET binding site such as BINDING SITE I, BINDING SITE II or BINDING SITE III. Table 2 illustrates the complementarity of the nucleotide sequences of C3F BINDING SITE, designated SEQ ID:12333, to the nucleotide sequence of VGAM804 RNA, herein designated VGAM RNA, also designated SEQ ID:3515.

Another function of VGAM804 is therefore inhibition of C3F (Accession NM_005768). Accordingly, utilities of VGAM804 include diagnosis, prevention and treatment of diseases and clinical conditions associated with C3F. Cytoskeleton-associated Protein 4 (CKAP4, Accession NM_006825) is another VGAM804 host target gene. CKAP4 BINDING SITE is HOST TARGET binding site found in the 3' untranslated region of mRNA encoded by CKAP4, corresponding to a HOST TARGET binding site such as BINDING SITE I, BINDING SITE II or BINDING SITE III. Table 2 illustrates the complementarity of the nucleotide sequences of CKAP4 BINDING SITE, designated SEQ ID:13704, to the nucleotide sequence of VGAM804 RNA, herein designated VGAM RNA, also designated SEQ ID:3515.

Another function of VGAM804 is therefore inhibition of Cytoskeleton-associated Protein 4 (CKAP4, Accession NM_006825). Accordingly, utilities of VGAM804 include diagnosis, prevention and treatment of diseases and clinical conditions associated with CKAP4. CRIPT (Accession XM_057669) is another VGAM804 host target gene. CRIPT BINDING SITE is HOST TARGET binding site found in the 3' untranslated region of mRNA encoded by CRIPT, corresponding to a HOST TARGET binding site such as BINDING SITE I, BINDING SITE II or BINDING SITE III. Table 2 illustrates the complementarity of the nucleotide sequences of CRIPT BINDING SITE, designated SEQ ID:36540, to the nucleotide sequence of VGAM804 RNA, herein designated VGAM RNA, also designated SEQ ID:3515.

Another function of VGAM804 is therefore inhibition of CRIPT (Accession XM_057669). Accordingly, utilities of VGAM804 include diagnosis, prevention and treatment of diseases and clinical conditions associated with CRIPT. Deiodinase, Iodothyronine, Type II (DIO2, Accession NM_013989) is another VGAM804 host target gene. DIO2 BINDING SITE1 and DIO2 BINDING SITE2 are HOST TARGET binding sites found in untranslated regions of mRNA encoded by DIO2, corresponding to HOST TARGET binding sites such as BINDING SITE I, BINDING SITE II or BINDING SITE III. Table 2 illustrates the complementarity of the nucleotide sequences of DIO2 BINDING SITE1 and DIO2 BINDING SITE2, designated SEQ ID:15176 and SEQ ID:6464 respectively, to the nucleotide sequence of VGAM804 RNA, herein designated VGAM RNA, also designated SEQ ID:3515.

Another function of VGAM804 is therefore inhibition of Deiodinase, Iodothyronine, Type II (DIO2, Accession NM_013989). Accordingly, utilities of VGAM804 include diagnosis, prevention and treatment of diseases and clinical conditions associated with DIO2. DKFZP434D193 (Accession XM_114297) is another VGAM804 host target gene. DKFZP434D193 BINDING SITE is HOST TARGET binding site found in the 3' untranslated region of mRNA encoded by DKFZP434D193, corresponding to a HOST TARGET binding site such as BINDING SITE I, BINDING SITE II or BINDING SITE III. Table 2 illustrates the complementarity of the nucleotide sequences of DKFZP434D193 BINDING SITE, designated SEQ ID:42854, to the nucleotide sequence of VGAM804 RNA, herein designated VGAM RNA, also designated SEQ ID:3515.

Another function of VGAM804 is therefore inhibition of DKFZP434D193 (Accession XM_114297). Accordingly, utilities of VGAM804 include diagnosis, prevention and treatment of diseases and clinical conditions associated with DKFZP434D193. ESDN (Accession NM_080927) is another VGAM804 host target gene. ESDN BINDING SITE is HOST TARGET binding site found in the 3' untranslated region of mRNA encoded by ESDN, corresponding to a HOST TARGET binding site such as BINDING SITE I, BINDING SITE II or BINDING SITE III. Table 2 illustrates the complementarity of the nucleotide sequences of ESDN BINDING SITE, designated SEQ ID:28153, to the nucleotide sequence of VGAM804 RNA, herein designated VGAM RNA, also designated SEQ ID:3515.

Another function of VGAM804 is therefore inhibition of ESDN (Accession NM_080927). Accordingly, utilities of VGAM804 include diagnosis, prevention and treatment of diseases and clinical conditions associated with ESDN. FLJ10415 (Accession NM_018089) is another VGAM804 host target gene. FLJ10415 BINDING SITE is HOST TARGET binding site found in the 3" untranslated region of mRNA encoded by FLJ10415, corresponding to a HOST TARGET binding site such as BINDING SITE I, BINDING SITE II or BINDING SITE III. Table 2 illustrates the complementarity of the nucleotide sequences of FLJ10415 BINDING SITE, designated SEQ ID:19853, to the nucleotide sequence of VGAM804 RNA, herein designated VGAM RNA, also designated SEQ ID:3515.

Another function of VGAM804 is therefore inhibition of FLJ10415 (Accession NM_018089). Accordingly, utilities of VGAM804 include diagnosis, prevention and treatment of diseases and clinical conditions associated with FLJ10415. FLJ10743 (Accession NM_018201) is another VGAM804 host target gene. FLJ10743 BINDING SITE is HOST TARGET binding site found in the 3' untranslated region of mRNA encoded by FLJ10743, corresponding to a HOST TARGET binding site such as BINDING SITE I, BINDING SITE II or BINDING SITE III. Table 2 illustrates the complementarity of the nucleotide sequences of FLJ10743 BINDING SITE, designated SEQ ID:20083, to the nucleotide sequence of VGAM804 RNA, herein designated VGAM RNA, also designated SEQ ID:3515.

Another function of VGAM804 is therefore inhibition of FLJ10743 (Accession NM_018201). Accordingly, utilities of VGAM804 include diagnosis, prevention and treatment of diseases and clinical conditions associated with FLJ10743. Gamma-aminobutyric Acid (GABA) B Receptor, 1 (GABBR1, Accession NM_021903) is another VGAM804 host target gene. GABBR1 BINDING SITE is HOST TARGET binding site found in the 5' untranslated region of mRNA encoded by GABBR1, corresponding to a HOST TARGET binding site such as BINDING SITE I, BINDING SITE II or BINDING SITE III. Table 2 illustrates the complementarity of the nucleotide sequences of GABBR1 BINDING SITE, designated SEQ ID:22421, to the nucleotide sequence of VGAM804 RNA, herein designated VGAM RNA, also designated SEQ ID:3515.

Another function of VGAM804 is therefore inhibition of Gamma-aminobutyric Acid (GABA) B Receptor, 1 (GABBR1, Accession NM_021903). Accordingly, utilities of VGAM804 include diagnosis, prevention and treatment of diseases and clinical conditions associated with GABBR1. HRD1 (Accession XM_045498) is another VGAM804 host target gene. HRD1 BINDING SITE is HOST TARGET binding site found in the 3' untranslated region of mRNA encoded by HRD1, corresponding to a HOST TARGET binding site such as BINDING SITE I, BINDING SITE II or BINDING SITE III. Table 2 illustrates the complementarity of the nucleotide sequences of HRD1 BINDING SITE, designated SEQ ID:34471, to the nucleotide sequence of VGAM804 RNA, herein designated VGAM RNA, also designated SEQ ID:3515.

Another function of VGAM804 is therefore inhibition of HRD1 (Accession XM_045498). Accordingly, utilities of VGAM804 include diagnosis, prevention and treatment of diseases and clinical conditions associated with HRD1. HSPC063 (Accession NM_014155) is another VGAM804 host target gene. HSPC063 BINDING SITE is HOST TARGET binding site found in the 5' untranslated region of mRNA encoded by HSPC063, corresponding to a HOST TARGET binding site such as BINDING SITE I, BINDING SITE II or BINDING SITE III. Table 2 illustrates the complementarity of the nucleotide sequences of HSPC063 BINDING SITE, designated SEQ ID:15440, to the nucleotide sequence of VGAM804 RNA, herein designated VGAM RNA, also designated SEQ ID:3515.

Another function of VGAM804 is therefore inhibition of HSPC063 (Accession NM_014155). Accordingly, utilities of VGAM804 include diagnosis, prevention and treatment of diseases and clinical conditions associated with HSPC063. ICB-1 (Accession NM_004848) is another VGAM804 host target gene. ICB-1 BINDING SITE is HOST TARGET binding site found in the 3' untranslated region of mRNA encoded by ICB-1, corresponding to a HOST TARGET binding site such as BINDING SITE I, BINDING SITE II or BINDING SITE III. Table 2 illustrates the complementarity of the nucleotide sequences of ICB-1 BINDING SITE, designated SEQ ID:11260, to the nucleotide sequence of VGAM804 RNA, herein designated VGAM RNA, also designated SEQ ID:3515.

Another function of VGAM804 is therefore inhibition of ICB-1 (Accession NM_004848). Accordingly, utilities of VGAM804 include diagnosis, prevention and treatment of diseases and clinical conditions associated with ICB-1. KIAA0258 (Accession NM_014785) is another VGAM804 host target gene. KIAA0258 BINDING SITE is HOST TARGET binding site found in the 3' untranslated region of mRNA encoded by KIAA0258, corresponding to a HOST TARGET binding site such as BINDING SITE I, BINDING SITE II or BINDING SITE III. Table 2 illustrates the complementarity of the nucleotide sequences of KIAA0258 BINDING SITE, designated SEQ ID:16653, to the nucleotide sequence of VGAM804 RNA, herein designated VGAM RNA, also designated SEQ ID:3515.

Another function of VGAM804 is therefore inhibition of KIAA0258 (Accession NM_014785). Accordingly, utilities of VGAM804 include diagnosis, prevention and treatment of diseases and clinical conditions associated with KIAA0258. KIAA0326 (Accession XM_034819) is another VGAM804 host target gene. KIAA0326 BINDING SITE is HOST TARGET binding site found in the 3' untranslated region of mRNA encoded by KIAA0326, corresponding to a HOST TARGET binding site such as BINDING SITE I, BINDING SITE II or BINDING SITE III. Table 2 illustrates the complementarity of the nucleotide sequences of KIAA0326 BINDING SITE, designated SEQ ID:32162, to the nucleotide sequence of VGAM804 RNA, herein designated VGAM RNA, also designated SEQ ID:3515.

Another function of VGAM804 is therefore inhibition of KIAA0326 (Accession XM_034819). Accordingly, utilities of VGAM804 include diagnosis, prevention and treatment of diseases and clinical conditions associated with KIAA0326. KIAA0495 (Accession XM_031397) is another VGAM804 host target gene. KIAA0495 BINDING SITE is HOST TARGET binding site found in the 5' untranslated region of mRNA encoded by KIAA0495, corresponding to a HOST TARGET binding site such as BINDING SITE I, BINDING SITE II or BINDING SITE III. Table 2 illustrates the complementarity of the nucleotide sequences of KIAA0495 BINDING SITE, designated SEQ ID:31368, to the nucleotide sequence of VGAM804 RNA, herein designated VGAM RNA, also designated SEQ ID:3515.

Another function of VGAM804 is therefore inhibition of KIAA0495 (Accession XM_031397). Accordingly, utilities of VGAM804 include diagnosis, prevention and treatment of diseases and clinical conditions associated with KIAA0495. KIAA1332 (Accession XM_048774) is another VGAM804 host target gene. KIAA1332 BINDING SITE is HOST TARGET binding site found in the 3' untranslated region of mRNA encoded by KIAA1332, corresponding to a HOST TARGET binding site such as BINDING SITE I, BINDING SITE II or BINDING SITE III. Table 2 illustrates the complementarity of the nucleotide sequences of KIAA1332 BINDING SITE, designated SEQ ID:35263, to the nucleotide sequence of VGAM804 RNA, herein designated VGAM RNA, also designated SEQ ID:3515.

Another function of VGAM804 is therefore inhibition of KIAA1332 (Accession XM_048774). Accordingly, utilities of VGAM804 include diagnosis, prevention and treatment of diseases and clinical conditions associated with KIAA1332. KIAA1962 (Accession XM_088567) is another VGAM804 host target gene. KIAA1962 BINDING SITE is HOST TARGET binding site found in the 3' untranslated region of mRNA encoded by KIAA1962, corresponding to a HOST TARGET binding site such as BINDING SITE I, BINDING SITE II or BINDING SITE III. Table 2 illustrates the complementarity of the nucleotide sequences of KIAA1962 BINDING SITE, designated SEQ ID:39835, to the nucleotide sequence of VGAM804 RNA, herein designated VGAM RNA, also designated SEQ ID:3515.

Another function of VGAM804 is therefore inhibition of KIAA1962 (Accession XM_088567). Accordingly, utilities of VGAM804 include diagnosis, prevention and treatment of diseases and clinical conditions associated with KIAA1962. LAP1B (Accession XM_035429) is another VGAM804 host target gene. LAP1B BINDING SITE is HOST TARGET binding site found in the 3' untranslated region of mRNA encoded by LAP1B, corresponding to a HOST TARGET binding site such as BINDING SITE I, BINDING SITE II or BINDING SITE III. Table 2 illustrates the complementarity of the nucleotide sequences of LAP1B BINDING SITE, designated SEQ ID:32265, to the nucleotide sequence of VGAM804 RNA, herein designated VGAM RNA, also designated SEQ ID:3515.

Another function of VGAM804 is therefore inhibition of LAP1B (Accession XM_035429). Accordingly, utilities of VGAM804 include diagnosis, prevention and treatment of diseases and clinical conditions associated with LAP1B. MGC15396 (Accession NM_052855) is another VGAM804 host target gene. MGC15396 BINDING SITE is HOST TARGET binding site found in the 5' untranslated region of mRNA encoded by MGC15396, corresponding to a HOST TARGET binding site such as BINDING SITE I, BINDING SITE II or BINDING SITE III. Table 2 illustrates the complementarity of the nucleotide sequences of MGC15396 BINDING SITE, designated SEQ ID:27437, to the nucleotide sequence of VGAM804 RNA, herein designated VGAM RNA, also designated SEQ ID:3515.

Another function of VGAM804 is therefore inhibition of MGC15396 (Accession NM_052855). Accordingly, utilities of VGAM804 include diagnosis, prevention and treatment of diseases and clinical conditions associated with MGC15396. MGC29891 (Accession NM_144618) is another VGAM804 host target gene. MGC29891 BINDING SITE is HOST TARGET binding site found in the 3' untranslated region of mRNA encoded by MGC29891, corresponding to a HOST TARGET binding site such as BINDING SITE I, BINDING SITE II or BINDING SITE III. Table 2 illustrates the complementarity of the nucleotide sequences of MGC29891 BINDING SITE, designated SEQ ID:29440, to the nucleotide sequence of VGAM804 RNA, herein designated VGAM RNA, also designated SEQ ID:3515.

Another function of VGAM804 is therefore inhibition of MGC29891 (Accession NM_144618). Accordingly, utilities of VGAM804 include diagnosis, prevention and treatment of diseases and clinical conditions associated with MGC29891. MGC4549 (Accession NM_032377) is another VGAM804 host target gene. MGC4549 BINDING SITE is HOST TARGET binding site found in the 3' untranslated region of mRNA encoded by MGC4549, corresponding to a HOST TARGET binding site such as BINDING SITE I, BINDING SITE II or BINDING SITE III. Table 2 illustrates the complementarity of the nucleotide sequences of MGC4549 BINDING SITE, designated SEQ ID:26169, to the nucleotide sequence of VGAM804 RNA, herein designated VGAM RNA, also designated SEQ ID:3515.

Another function of VGAM804 is therefore inhibition of MGC4549 (Accession NM_032377). Accordingly, utilities of VGAM804 include diagnosis, prevention and treatment of diseases and clinical conditions associated with MGC4549. Neurogenic Differentiation 4 (NEUROD4, Accession NM_021191) is another VGAM804 host target gene. NEUROD4 BINDING SITE is HOST TARGET binding site found in the 5' untranslated region of mRNA encoded by NEUROD4, corresponding to a HOST TARGET binding site such as BINDING SITE I, BINDING SITE II or BINDING SITE III. Table 2 illustrates the complementarity of the nucleotide sequences of NEUROD4 BINDING SITE, designated SEQ ID:22169, to the nucleotide sequence of VGAM804 RNA, herein designated VGAM RNA, also designated SEQ ID:3515.

Another function of VGAM804 is therefore inhibition of Neurogenic Differentiation 4 (NEUROD4, Accession NM_021191). Accordingly, utilities of VGAM804 include diagnosis, prevention and treatment of diseases and clinical conditions associated with NEUROD4. PAS Domain Containing Serine/threonine Kinase (PASK, Accession NM_015148) is another VGAM804 host target gene. PASK BINDING SITE is HOST TARGET binding site found in the 5' untranslated region of mRNA encoded by PASK, corresponding to a HOST TARGET binding site such as BINDING SITE I, BINDING SITE II or BINDING SITE III. Table 2 illustrates the complementarity of the nucleotide sequences of PASK BINDING SITE, designated SEQ ID:17504, to the nucleotide sequence of VGAM804 RNA, herein designated VGAM RNA, also designated SEQ ID:3515.

Another function of VGAM804 is therefore inhibition of PAS Domain Containing Serine/threonine Kinase (PASK, Accession NM_015148). Accordingly, utilities of VGAM804 include diagnosis, prevention and treatment of diseases and clinical conditions associated with PASK. Protein Phosphatase 4, Regulatory Subunit 1-like (PPP4R1L, Accession XM_086650) is another VGAM804 host target gene. PPP4R1L BINDING SITE is HOST TARGET binding site found in the 5' untranslated region of mRNA encoded by PPP4R1L, corresponding to a HOST TARGET binding site such as BINDING SITE I, BINDING SITE II or BINDING SITE III. Table 2 illustrates the complementarity of the nucleotide sequences of PPP4R1L BINDING SITE, designated SEQ ID:38819, to the nucleotide sequence of VGAM804 RNA, herein designated VGAM RNA, also designated SEQ ID:3515.

Another function of VGAM804 is therefore inhibition of Protein Phosphatase 4, Regulatory Subunit 1-like (PPP4R1L, Accession XM_086650). Accordingly, utilities of VGAM804 include diagnosis, prevention and treatment of diseases and clinical conditions associated with PPP4R1L. PRO2214 (Accession NM_018517) is another VGAM804 host target gene. PRO2214 BINDING SITE is HOST TARGET binding site found in the 5' untranslated region of mRNA encoded by PRO2214, corresponding to a HOST TARGET binding site such as BINDING SITE I, BINDING SITE II or BINDING SITE III. Table 2 illustrates the complementarity of the nucleotide sequences of PRO2214 BINDING SITE, designated SEQ ID:20590, to the nucleotide sequence of VGAM804 RNA, herein designated VGAM RNA, also designated SEQ ID:3515.

Another function of VGAM804 is therefore inhibition of PRO2214 (Accession NM_018517). Accordingly, utilities of VGAM804 include diagnosis, prevention and treatment of diseases and clinical conditions associated with PRO2214. SBB103 (Accession NM_005785) is another VGAM804 host target gene. SBB103 BINDING SITE is HOST TARGET binding site found in the 3' untranslated region of mRNA encoded by SBB103, corresponding to a HOST TARGET binding site such as BINDING SITE I, BINDING SITE II or BINDING SITE III. Table 2 illustrates the complementarity of the nucleotide sequences of SBB103 BINDING SITE, designated SEQ ID:12365, to the nucleotide sequence of VGAM804 RNA, herein designated VGAM RNA, also designated SEQ ID:3515.

Another function of VGAM804 is therefore inhibition of SBB103 (Accession NM_005785). Accordingly, utilities of VGAM804 include diagnosis, prevention and treatment of diseases and clinical conditions associated with SBB103. Solute Carrier Family 25, (mitochondrial carrier), Member 18 (SLC25A18, Accession NM_031481) is another VGAM804 host target gene. SLC25A18 BINDING SITE is HOST TARGET binding site found in the 3' untranslated region of mRNA encoded by SLC25A18, corresponding to a HOST TARGET binding site such as BINDING SITE I, BINDING SITE II or BINDING SITE III. Table 2 illustrates the complementarity of the nucleotide sequences of SLC25A18 BINDING SITE, designated SEQ ID:25562, to the nucleotide sequence of VGAM804 RNA, herein designated VGAM RNA, also designated SEQ ID:3515.

Another function of VGAM804 is therefore inhibition of Solute Carrier Family 25, (mitochondrial carrier), Member 18 (SLC25A18, Accession NM_031481). Accordingly, utilities of VGAM804 include diagnosis, prevention and treatment of diseases and clinical conditions associated with SLC25A18. SYNE-2 (Accession NM_015180) is another VGAM804 host target gene. SYNE-2 BINDING SITE is HOST TARGET binding site found in the 3' untranslated region of mRNA encoded by SYNE-2, corresponding to a HOST TARGET binding site such as BINDING SITE I, BINDING SITE II or BINDING SITE III. Table 2 illustrates the complementarity of the nucleotide sequences of SYNE-2 BINDING SITE, designated SEQ ID:17533, to the nucleotide sequence of VGAM804 RNA, herein designated VGAM RNA, also designated SEQ ID:3515.

Another function of VGAM804 is therefore inhibition of SYNE-2 (Accession NM_015180). Accordingly, utilities of VGAM804 include diagnosis, prevention and treatment of diseases and clinical conditions associated with SYNE-2. Triple Homeobox 1 (TIX1, Accession XM_029734) is another VGAM804 host target gene. TIX1 BINDING SITE is HOST TARGET binding site found in the 3' untranslated region of mRNA encoded by TIX1, corresponding to a HOST TARGET binding site such as BINDING SITE I, BINDING SITE II or BINDING SITE III. Table 2 illustrates the complementarity of the nucleotide sequences of TIX1 BINDING SITE, designated SEQ ID:30932, to the nucleotide sequence of VGAM804 RNA, herein designated VGAM RNA, also designated SEQ ID:3515.

Another function of VGAM804 is therefore inhibition of Triple Homeobox 1 (TIX1, Accession XM_029734). Accordingly, utilities of VGAM804 include diagnosis, prevention and treatment of diseases and clinical conditions associated with TIX1. LOC112868 (Accession XM_053402) is another VGAM804 host target gene. LOC112868 BINDING SITE is HOST TARGET binding site found in the 3' untranslated region of mRNA encoded by LOC112868, corresponding to a HOST TARGET binding site such as BINDING SITE I, BINDING SITE II or BINDING SITE III. Table 2 illustrates the complementarity of the nucleotide sequences of LOC112868 BINDING SITE, designated SEQ ID:36085, to the nucleotide sequence of VGAM804 RNA, herein designated VGAM RNA, also designated SEQ ID:3515.

Another function of VGAM804 is therefore inhibition of LOC112868 (Accession XM_053402). Accordingly, utilities of VGAM804 include diagnosis, prevention and treatment of diseases and clinical conditions associated with LOC112868.

LOC130951 (Accession NM_138804) is another VGAM804 host target gene. LOC130951 BINDING SITE is HOST TARGET binding site found in the 3' untranslated region of mRNA encoded by LOC130951, corresponding to a HOST TARGET binding site such as BINDING SITE I, BINDING SITE II or BINDING SITE III. Table 2 illustrates the complementarity of the nucleotide sequences of LOC130951 BINDING SITE, designated SEQ ID:29028, to the nucleotide sequence of VGAM804 RNA, herein designated VGAM RNA, also designated SEQ ID:3515.

Another function of VGAM804 is therefore inhibition of LOC130951 (Accession NM_138804). Accordingly, utilities of VGAM804 include diagnosis, prevention and treatment of diseases and clinical conditions associated with LOC130951. LOC144512 (Accession XM_096623) is another VGAM804 host target gene. LOC144512 BINDING SITE is HOST TARGET binding site found in the 5' untranslated region of mRNA encoded by LOC144512, corresponding to a HOST TARGET binding site such as BINDING SITE I, BINDING SITE II or BINDING SITE III. Table 2 illustrates the complementarity of the nucleotide sequences of LOC144512 BINDING SITE, designated SEQ ID:40429, to the nucleotide sequence of VGAM804 RNA, herein designated VGAM RNA, also designated SEQ ID:3515.

Another function of VGAM804 is therefore inhibition of LOC144512 (Accession XM_096623). Accordingly, utilities of VGAM804 include diagnosis, prevention and treatment of diseases and clinical conditions associated with LOC144512. LOC145773 (Accession XM_085237) is another VGAM804 host target gene. LOC145773 BINDING SITE is HOST TARGET binding site found in the 5' untranslated region of mRNA encoded by LOC145773, corresponding to a HOST TARGET binding site such as BINDING SITE I, BINDING SITE II or BINDING SITE III. Table 2 illustrates the complementarity of the nucleotide sequences of LOC145773 BINDING SITE, designated SEQ ID:37982, to the nucleotide sequence of VGAM804 RNA, herein designated VGAM RNA, also designated SEQ ID:3515.

Another function of VGAM804 is therefore inhibition of LOC145773 (Accession XM_085237). Accordingly, utilities of VGAM804 include diagnosis, prevention and treatment of diseases and clinical conditions associated with LOC145773. LOC150848 (Accession XM_097959) is another VGAM804 host target gene. LOC150848 BINDING SITE is HOST TARGET binding site found in the 5' untranslated region of mRNA encoded by LOC150848, corresponding to a HOST TARGET binding site such as BINDING SITE I, BINDING SITE II or BINDING SITE III. Table 2 illustrates the complementarity of the nucleotide sequences of LOC150848 BINDING SITE, designated SEQ ID:41261, to the nucleotide sequence of VGAM804 RNA, herein designated VGAM RNA, also designated SEQ ID:3515.

Another function of VGAM804 is therefore inhibition of LOC150848 (Accession XM_097959). Accordingly, utilities of VGAM804 include diagnosis, prevention and treatment of diseases and clinical conditions associated with LOC150848. LOC157860 (Accession XM_098832) is another VGAM804 host target gene. LOC157860 BINDING SITE is HOST TARGET binding site found in the 3' untranslated region of mRNA encoded by LOC157860, corresponding to a HOST TARGET binding site such as BINDING SITE I, BINDING SITE II or BINDING SITE III. Table 2 illustrates the complementarity of the nucleotide sequences of LOC157860 BINDING SITE, designated SEQ ID:41863, to the nucleotide sequence of VGAM804 RNA, herein designated VGAM RNA, also designated SEQ ID:3515.

Another function of VGAM804 is therefore inhibition of LOC157860 (Accession XM_098832). Accordingly, utilities of VGAM804 include diagnosis, prevention and treatment of diseases and clinical conditions associated with LOC157860. LOC200609 (Accession XM_117256) is another VGAM804 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43337, to the nucleotide sequence of VGAM804 RNA, herein designated VGAM RNA, also designated SEQ ID:3515.

Another function of VGAM804 is therefore inhibition of LOC200609 (Accession XM_117256). Accordingly, utilities of VGAM804 include diagnosis, prevention and treatment of diseases and clinical conditions associated with LOC200609. LOC219988 (Accession XM_166223) is another VGAM804 host target gene. LOC219988 BINDING SITE is HOST TARGET binding site found in the 3' untranslated region of mRNA encoded by LOC219988, corresponding to a HOST TARGET binding site such as BINDING SITE I, BINDING SITE II or BINDING SITE III. Table 2 illustrates the complementarity of the nucleotide sequences of LOC219988 BINDING SITE, designated SEQ ID:44044, to the nucleotide sequence of VGAM804 RNA, herein designated VGAM RNA, also designated SEQ ID:3515.

Another function of VGAM804 is therefore inhibition of LOC219988 (Accession XM_166223). Accordingly, utilities of VGAM804 include diagnosis, prevention and treatment of diseases and clinical conditions associated with LOC219988. LOC221399 (Accession XM_168134) is another VGAM804 host target gene. LOC221399 BINDING SITE is HOST TARGET binding site found in the 5' untranslated region of mRNA encoded by LOC221399, corresponding to a HOST TARGET binding site such as BINDING SITE I, BINDING SITE II or BINDING SITE III. Table 2 illustrates the complementarity of the nucleotide sequences of LOC221399 BINDING SITE, designated SEQ ID:45050, to the nucleotide sequence of VGAM804 RNA, herein designated VGAM RNA, also designated SEQ ID:3515.

Another function of VGAM804 is therefore inhibition of LOC221399 (Accession XM_168134). Accordingly, utilities of VGAM804 include diagnosis, prevention and treatment of diseases and clinical conditions associated with LOC221399. LOC253675 (Accession XM_172990) is another VGAM804 host target gene. LOC253675 BINDING SITE is HOST TARGET binding site found in the 3' untranslated region of mRNA encoded by LOC253675, corresponding to a HOST TARGET binding site such as BINDING SITE I, BINDING SITE II or BINDING SITE III. Table 2 illustrates the complementarity of the nucleotide sequences of LOC253675 BINDING SITE, designated SEQ ID:46267, to the nucleotide sequence of VGAM804 RNA, herein designated VGAM RNA, also designated SEQ ID:3515.

Another function of VGAM804 is therefore inhibition of LOC253675 (Accession XM_172990). Accordingly, utilities of VGAM804 include diagnosis, prevention and treatment of diseases and clinical conditions associated with LOC253675. LOC253805 (Accession XM_172854) is another VGAM804 host target gene. LOC253805 BINDING SITE is HOST TARGET binding site found in the 3' untranslated region of mRNA encoded by LOC253805, corresponding to a HOST TARGET binding site such as BINDING SITE I, BINDING SITE II or BINDING SITE III. Table 2 illustrates the complementarity of the nucleotide sequences of LOC253805 BIND- ING SITE, designated SEQ ID:46137, to the nucleotide sequence of VGAM804 RNA, herein designated VGAM RNA, also designated SEQ ID:3515.

Another function of VGAM804 is therefore inhibition of LOC253805 (Accession XM_172854). Accordingly, utilities of VGAM804 include diagnosis, prevention and treatment of diseases and clinical conditions associated with LOC253805. LOC254042 (Accession XM_171022) is another VGAM804 host target gene. LOC254042 BINDING SITE is HOST TARGET binding site found in the 5' untranslated region of mRNA encoded by LOC254042, corresponding to a HOST TARGET binding site such as BINDING SITE I, BINDING SITE II or BINDING SITE III. Table 2 illustrates the complementarity of the nucleotide sequences of LOC254042 BINDING SITE, designated SEQ ID:45793, to the nucleotide sequence of VGAM804 RNA, herein designated VGAM RNA, also designated SEQ ID:3515.

Another function of VGAM804 is therefore inhibition of LOC254042 (Accession XM_171022). Accordingly, utilities of VGAM804 include diagnosis, prevention and treatment of diseases and clinical conditions associated with LOC254042. LOC254143 (Accession XM_172880) is another VGAM804 host target gene. LOC254143 BINDING SITE is HOST TARGET binding site found in the 5' untranslated region of mRNA encoded by LOC254143, corresponding to a HOST TARGET binding site such as BINDING SITE I, BINDING SITE II or BINDING SITE III. Table 2 illustrates the complementarity of the nucleotide sequences of LOC254143 BINDING SITE, designated SEQ ID:46158, to the nucleotide sequence of VGAM804 RNA, herein designated VGAM RNA, also designated SEQ ID:3515.

Another function of VGAM804 is therefore inhibition of LOC254143 (Accession XM_172880). Accordingly, utilities of VGAM804 include diagnosis, prevention and treatment of diseases and clinical conditions associated with LOC254143. LOC256942 (Accession XM_170544) is another VGAM804 host target gene. LOC256942 BINDING SITE is HOST TARGET binding site found in the 3' untranslated region of mRNA encoded by LOC256942, corresponding to a HOST TARGET binding site such as BINDING SITE I, BINDING SITE II or BINDING SITE III. Table 2 illustrates the complementarity of the nucleotide sequences of LOC256942 BINDING SITE, designated SEQ ID:45364, to the nucleotide sequence of VGAM804 RNA, herein designated VGAM RNA, also designated SEQ ID:3515.

Another function of VGAM804 is therefore inhibition of LOC256942 (Accession XM_170544). Accordingly, utilities of VGAM804 include diagnosis, prevention and treatment of diseases and clinical conditions associated with LOC256942. LOC57109 (Accession NM_020385) is another VGAM804 host target gene. LOC57109 BINDING SITE is HOST TARGET binding site found in the 3' untranslated region of mRNA encoded by LOC57109, corresponding to a HOST TARGET binding site such as BINDING SITE I, BINDING SITE II or BINDING SITE III. Table 2 illustrates the complementarity of the nucleotide sequences of LOC57109 BINDING SITE, designated SEQ ID:21657, to the nucleotide sequence of VGAM804 RNA, herein designated VGAM RNA, also designated SEQ ID:3515.

Another function of VGAM804 is therefore inhibition of LOC57109 (Accession NM_020385). Accordingly, utilities of VGAM804 include diagnosis, prevention and treatment of diseases and clinical conditions associated with LOC57109. LOC91263 (Accession XM_037264) is another VGAM804 host target gene. LOC91263 BINDING SITE is HOST TARGET binding site found in the 5' untranslated region of mRNA encoded by LOC91263, corresponding to a HOST TARGET binding site such as BINDING SITE I, BINDING SITE II or BINDING SITE III. Table 2 illustrates the complementarity of the nucleotide sequences of LOC91263 BINDING SITE, designated SEQ ID:32597, to the nucleotide sequence of VGAM804 RNA, herein designated VGAM RNA, also designated SEQ ID:3515.

Another function of VGAM804 is therefore inhibition of LOC91263 (Accession XM_037264). Accordingly, utilities of VGAM804 include diagnosis, prevention and treatment of diseases and clinical conditions associated with LOC91263. FIG. 1 further provides a conceptual description of a novel bioinformatically detected viral gene of the present invention, referred to here as Viral Genomic Address Messenger 805 (VGAM805) viral gene, which modulates expression of respective host target genes thereof, the function and utility of which host target genes is known in the art.

VGAM805 is a novel bioinformatically detected regulatory, non protein coding, viral micro RNA (miRNA) gene. The method by which VGAM805 was detected is described hereinabove with reference to FIGS. 1-8.

VGAM805 gene, herein designated VGAM GENE, is a viral gene contained in the genome of Feline Immunodeficiency Virus. VGAM805 host target gene, herein designated VGAM HOST TARGET GENE, is a human gene contained in the human genome.

VGAM805 gene encodes a VGAM805 precursor RNA, herein designated VGAM PRECURSOR RNA. Similar to other miRNA genes, and unlike most ordinary genes, VGAM805 precursor RNA does not encode a protein. A nucleotide sequence identical or highly similar to the nucleotide sequence of VGAM805 precursor RNA is designated SEQ ID:791, and is provided hereinbelow with reference to the sequence listing part. Nucleotide sequence SEQ ID:791 is located at position 8793 relative to the genome of Feline Immunodeficiency Virus.

VGAM805 precursor RNA folds onto itself, forming VGAM805 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM805 folded precursor RNA into VGAM805 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM805 RNA is designated SEQ ID:3516, and is provided hereinbelow with reference to the sequence listing part.

VGAM805 host target gene, herein designated VGAM HOST TARGET GENE, encodes a corresponding messenger RNA, VGAM805 host target RNA, herein designated VGAM HOST TARGET RNA. VGAM805 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM805 RNA, herein designated VGAM RNA, binds complementarily to one or more host target binding sites located in untranslated regions of VGAM805 host target RNA, herein designated VGAM HOST TARGET RNA. This complementary binding is due to the fact that the nucleotide sequence of VGAM805 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM805 RNA, herein designated VGAM RNA, may have a different number of host target binding sites in untranslated regions of a VGAM805 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM805 RNA, herein designated VGAM RNA, to host target binding sites on VGAM805 host target RNA, herein designated VGAM HOST TARGET RNA, such as BINDING SITE I, BINDING SITE II and BINDING SITE III, inhibits translation of VGAM805 host target RNA into VGAM805 host target protein, herein designated VGAM HOST TARGET PROTEIN. VGAM host target protein is therefore outlined by a broken line.

It is appreciated that VGAM805 host target gene, herein designated VGAM HOST TARGET GENE, in fact represents a plurality of VGAM805 host target genes. The mRNA of each one of this plurality of VGAM805 host target genes comprises one or more host target binding sites, each having a nucleotide sequence which is at least partly complementary to VGAM805 RNA, herein designated VGAM RNA, and which when bound by VGAM805 RNA causes inhibition of translation of respective one or more VGAM805 host target proteins.

It is further appreciated by one skilled in the art that the mode of translational inhibition illustrated by FIG. 1 with specific reference to translational inhibition exerted by VGAM805 gene, herein designated VGAM GENE, on one or more VGAM805 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM805 is inhibition of expression of host target genes, as part of a novel viral mechanism of attacking a host. Accordingly, utilities of VGAM805 include diagnosis, prevention and treatment of viral infection by Feline Immunodeficiency Virus. Specific functions, and accordingly utilities, of VGAM805 correlate with, and may be deduced from, the identity of the host target genes which VGAM805 binds and inhibits, and the function of these target genes, as elaborated hereinbelow.

Nucleotide sequences of the VGAM805 precursor RNA, herein designated VGAM PRECURSOR RNA, and of the 'diced' VGAM805 RNA, herein designated VGAM RNA, and a schematic representation of the secondary folding of VGAM805 folded precursor RNA, herein designated VGAM FOLDED PRECURSOR RNA, of VGAM805 are further described hereinbelow with reference to Table 1.

Nucleotide sequences of host target binding sites, such as BINDING SITE-I, BINDING SITE-II and BINDING SITE-III of FIG. 1, found on VGAM805 host target RNA, and schematic representation of the complementarity of each of these host target binding sites to VGAM805 RNA, herein designated VGAM RNA, are described hereinbelow with reference to Table 2.

As mentioned hereinabove with reference to FIG. 1, a function of VGAM805 gene, herein designated VGAM is inhibition of expression of VGAM805 target genes. It is appreciated that specific functions, and accordingly utilities, of VGAM805 correlate with, and may be deduced from, the identity of the target genes which VGAM805 binds and inhibits, and the function of these target genes, as elaborated hereinbelow.

BCL2-like 2 (BCL2L2, Accession NM_004050) is a VGAM805 host target gene. BCL2L2 BINDING SITE is HOST TARGET binding site found in the 3' untranslated region of mRNA encoded by BCL2L2, corresponding to a HOST TARGET binding site such as BINDING SITE I, BINDING SITE II or BINDING SITE III. Table 2 illustrates the complementarity of the nucleotide sequences of BCL2L2 BINDING SITE, designated SEQ ID:10265, to the nucleotide sequence of VGAM805 RNA, herein designated VGAM RNA, also designated SEQ ID:3516.

A function of VGAM805 is therefore inhibition of BCL2-like 2 (BCL2L2, Accession NM_004050), a gene which promotes cell survival. Accordingly, utilities of VGAM805 include diagnosis, prevention and treatment of diseases and clinical conditions associated with BCL2L2. The function of BCL2L2 and its association with various diseases and clinical conditions, has been established by previous studies, as described hereinabove with reference to VGAM431. Integrin, Alpha 1 (ITGA1, Accession XM_032902) is another VGAM805 host target gene. ITGA1 BINDING SITE is HOST TARGET binding site found in the 3' untranslated region of mRNA encoded by ITGA1, corresponding to a HOST TARGET binding site such as BINDING SITE I, BINDING SITE II or BINDING SITE III. Table 2 illustrates the complementarity of the nucleotide sequences of ITGA1 BINDING SITE, designated SEQ ID:31789, to the nucleotide sequence of VGAM805 RNA, herein designated VGAM RNA, also designated SEQ ID:3516.

Another function of VGAM805 is therefore inhibition of Integrin, Alpha 1 (ITGA1, Accession XM_032902). Accordingly, utilities of VGAM805 include diagnosis, prevention and treatment of diseases and clinical conditions associated with ITGA1. Angiomotin Like 1 (AMOTL1, Accession XM_057045) is another VGAM805 host target gene. AMOTL1 BINDING SITE is HOST TARGET binding site found in the 3' untranslated region of mRNA encoded by AMOTL1, corresponding to a HOST TARGET binding site such as BINDING SITE I, BINDING SITE II or BINDING SITE III. Table 2 illustrates the complementarity of the nucleotide sequences of AMOTL1 BINDING SITE, designated SEQ ID:36466, to the nucleotide sequence of VGAM805 RNA, herein designated VGAM RNA, also designated SEQ ID:3516.

Another function of VGAM805 is therefore inhibition of Angiomotin Like 1 (AMOTL1, Accession XM_057045). Accordingly, utilities of VGAM805 include diagnosis, prevention and treatment of diseases and clinical conditions associated with AMOTL1. Chromosome 20 Open Reading Frame 98 (C20orf98, Accession XM_049398) is another VGAM805 host target gene. C20orf98 BINDING SITE is HOST TARGET binding site found in the 3' untranslated region of mRNA encoded by C20orf98, corresponding to a HOST TARGET binding site such as BINDING SITE I, BINDING SITE II or BINDING SITE III. Table 2 illustrates the complementarity of the nucleotide sequences of C20orf98 BINDING SITE, designated SEQ ID:35418, to the nucleotide sequence of VGAM805 RNA, herein designated VGAM RNA, also designated SEQ ID:3516.

Another function of VGAM805 is therefore inhibition of Chromosome 20 Open Reading Frame 98 (C20orf98, Accession XM_049398). Accordingly, utilities of VGAM805 include diagnosis, prevention and treatment of diseases and clinical conditions associated with C20orf98. DKFZP762D096 (Accession XM_037662) is another VGAM805 host target gene. DKFZP762D096 BINDING SITE is HOST TARGET binding site found in the 3' untranslated region of mRNA encoded by DKFZP762D096, corresponding to a HOST TARGET binding site such as BINDING SITE I, BINDING SITE II or BINDING SITE III. Table 2 illustrates the complementarity of the nucleotide sequences of DKFZP762D096 BINDING SITE, designated SEQ ID:32667, to the nucleotide sequence of VGAM805 RNA, herein designated VGAM RNA, also designated SEQ ID:3516.

Another function of VGAM805 is therefore inhibition of DKFZP762D096 (Accession XM_037662). Accordingly, utilities of VGAM805 include diagnosis, prevention and treatment of diseases and clinical conditions associated with DKFZP762D096. Docking Protein 4 (DOK4, Accession NM_018110) is another VGAM805 host target gene. DOK4 BINDING SITE is HOST TARGET binding site found in the 3' untranslated region of mRNA encoded by DOK4, corresponding to a HOST TARGET binding site such as BINDING SITE I, BINDING SITE II or BINDING SITE III. Table 2 illustrates the complementarity of the nucleotide sequences of DOK4 BINDING SITE, designated SEQ ID:19882, to the nucleotide sequence of VGAM805 RNA, herein designated VGAM RNA, also designated SEQ ID:3516.

Another function of VGAM805 is therefore inhibition of Docking Protein 4 (DOK4, Accession NM_018110). Accordingly, utilities of VGAM805 include diagnosis, prevention and treatment of diseases and clinical conditions associated with DOK4. FLJ10043 (Accession NM_017979) is another VGAM805 host target gene. FLJ10043 BINDING SITE is HOST TARGET binding site found in the 3' untranslated region of mRNA encoded by FLJ10043, corresponding to a HOST TARGET binding site such as BINDING SITE I, BINDING SITE II or BINDING SITE III. Table 2 illustrates the complementarity of the nucleotide sequences of FLJ10043 BINDING SITE, designated SEQ ID:19707, to the nucleotide sequence of VGAM805 RNA, herein designated VGAM RNA, also designated SEQ ID:3516.

Another function of VGAM805 is therefore inhibition of FLJ10043 (Accession NM_017979). Accordingly, utilities of VGAM805 include diagnosis, prevention and treatment of diseases and clinical conditions associated with FLJ10043. FLJ14743 (Accession XM_042708) is another VGAM805 host target gene. FLJ14743 BINDING SITE is HOST TARGET binding site found in the 3' untranslated region of mRNA encoded by FLJ14743, corresponding to a HOST TARGET binding site such as BINDING SITE I, BINDING SITE II or BINDING SITE III. Table 2 illustrates the complementarity of the nucleotide sequences of FLJ14743 BINDING SITE, designated SEQ ID:33763, to the nucleotide sequence of VGAM805 RNA, herein designated VGAM RNA, also designated SEQ ID:3516.

Another function of VGAM805 is therefore inhibition of FLJ14743 (Accession XM_042708). Accordingly, utilities of VGAM805 include diagnosis, prevention and treatment of diseases and clinical conditions associated with FLJ14743. KIAA0889 (Accession NM_015377) is another VGAM805 host target gene. KIAA0889 BINDING SITE is HOST TARGET binding site found in the 3' untranslated region of mRNA encoded by KIAA0889, corresponding to a HOST TARGET binding site such as BINDING SITE I, BINDING SITE II or BINDING SITE III. Table 2 illustrates the complementarity of the nucleotide sequences of KIAA0889 BINDING SITE, designated SEQ ID:17677, to the nucleotide sequence of VGAM805 RNA, herein designated VGAM RNA, also designated SEQ ID:3516.

Another function of VGAM805 is therefore inhibition of KIAA0889 (Accession NM_015377). Accordingly, utilities of VGAM805 include diagnosis, prevention and treatment of diseases and clinical conditions associated with KIAA0889. MGC15476 (Accession NM_145056) is another VGAM805 host target gene. MGC15476 BINDING SITE is HOST TARGET binding site found in the 3' untranslated region of mRNA encoded by MGC15476, corresponding to a HOST TARGET binding site such as BINDING SITE I, BINDING SITE II or BINDING SITE III. Table 2 illustrates the complementarity of the nucleotide sequences of MGC15476 BINDING SITE, designated SEQ ID:29688, to the nucleotide sequence of VGAM805 RNA, herein designated VGAM RNA, also designated SEQ ID:3516.

Another function of VGAM805 is therefore inhibition of MGC15476 (Accession NM_145056). Accordingly, utilities of VGAM805 include diagnosis, prevention and treatment of diseases and clinical conditions associated with MGC15476. Phosphatidylinositol-4-phosphate 5-kinase, Type II, Beta (PIP5K2B, Accession NM_003559) is another VGAM805 host target gene. PIP5K2B BINDING SITE is HOST TARGET binding site found in the 3' untranslated region of mRNA encoded by PIP5K2B, corresponding to a HOST TARGET binding site such as BINDING SITE I, BINDING SITE II or BINDING SITE III. Table 2 illustrates the complementarity of the nucleotide sequences of PIP5K2B BINDING SITE, designated SEQ ID:9611, to the nucleotide sequence of VGAM805 RNA, herein designated VGAM RNA, also designated SEQ ID:3516.

Another function of VGAM805 is therefore inhibition of Phosphatidylinositol-4-phosphate 5-kinase, Type II, Beta (PIP5K2B, Accession NM_003559). Accordingly, utilities of VGAM805 include diagnosis, prevention and treatment of diseases and clinical conditions associated with PIP5K2B. Retinoic Acid Induced 16 (RAI16, Accession NM_022749) is another VGAM805 host target gene. RAI16 BINDING SITE is HOST TARGET binding site found in the 3' untranslated region of mRNA encoded by RAI16, corresponding to a HOST TARGET binding site such as BINDING SITE I, BINDING SITE II or BINDING SITE III. Table 2 illustrates the complementarity of the nucleotide sequences of RAI16 BINDING SITE, designated SEQ ID:22970, to the nucleotide sequence of VGAM805 RNA, herein designated VGAM RNA, also designated SEQ ID:3516.

Another function of VGAM805 is therefore inhibition of Retinoic Acid Induced 16 (RAI16, Accession NM_022749). Accordingly, utilities of VGAM805 include diagnosis, prevention and treatment of diseases and clinical conditions associated with RAI16. LOC115297 (Accession XM_053313) is another VGAM805 host target gene. LOC115297 BINDING SITE is HOST TARGET binding site found in the 3' untranslated region of mRNA encoded by LOC115297, corresponding to a HOST TARGET binding site such as BINDING SITE I, BINDING SITE II or BINDING SITE III. Table 2 illustrates the complementarity of the nucleotide sequences of LOC115297 BINDING SITE, designated SEQ ID:36072, to the nucleotide sequence of VGAM805 RNA, herein designated VGAM RNA, also designated SEQ ID:3516.

Another function of VGAM805 is therefore inhibition of LOC115297 (Accession XM_053313). Accordingly, utilities of VGAM805 include diagnosis, prevention and treatment of diseases and clinical conditions associated with LOC115297. LOC146988 (Accession XM_097150) is another VGAM805 host target gene. LOC146988 BINDING SITE is HOST TARGET binding site found in the 3' untranslated region of mRNA encoded by LOC146988, corresponding to a HOST TARGET binding site such as BINDING SITE I, BINDING SITE II or BINDING SITE III. Table 2 illustrates the complementarity of the nucleotide sequences of LOC146988 BINDING SITE, designated SEQ ID:40779, to the nucleotide sequence of VGAM805 RNA, herein designated VGAM RNA, also designated SEQ ID:3516.

Another function of VGAM805 is therefore inhibition of LOC146988 (Accession XM_097150). Accordingly, utilities of VGAM805 include diagnosis, prevention and treatment of diseases and clinical conditions associated with LOC146988. LOC254755 (Accession XM_173224) is another VGAM805 host target gene. LOC254755 BINDING SITE is HOST TARGET binding site found in the 3' untranslated region of mRNA encoded by LOC254755, corresponding to a HOST TARGET binding site such as BINDING SITE I, BINDING SITE II or BINDING SITE III. Table 2 illustrates the complementarity of the nucleotide sequences of LOC254755 BINDING SITE, designated SEQ ID:46488, to the nucleotide sequence of VGAM805 RNA, herein designated VGAM RNA, also designated SEQ ID:3516.

Another function of VGAM805 is therefore inhibition of LOC254755 (Accession XM_173224). Accordingly, utilities of VGAM805 include diagnosis, prevention and treatment of diseases and clinical conditions associated with LOC254755. LOC51075 (Accession NM_015959) is another VGAM805 host target gene. LOC51075 BINDING SITE is HOST TARGET binding site found in the 3' untranslated region of mRNA encoded by LOC51075, corresponding to a HOST TARGET binding site such as BINDING SITE I, BINDING SITE II or BINDING SITE III. Table 2 illustrates the complementarity of the nucleotide sequences of LOC51075 BINDING SITE, designated SEQ ID:18069, to the nucleotide sequence of VGAM805 RNA, herein designated VGAM RNA, also designated SEQ ID:3516.

Another function of VGAM805 is therefore inhibition of LOC51075 (Accession NM_015959). Accordingly, utilities of VGAM805 include diagnosis, prevention and treatment of diseases and clinical conditions associated with LOC51075. LOC90072 (Accession XM_028702) is another VGAM805 host target gene. LOC90072 BINDING SITE is HOST TARGET binding site found in the 3' untranslated region of mRNA encoded by LOC90072, corresponding to a HOST TARGET binding site such as BINDING SITE I, BINDING SITE II or BINDING SITE III. Table 2 illustrates the complementarity of the nucleotide sequences of LOC90072 BINDING SITE, designated SEQ ID:30728, to the nucleotide sequence of VGAM805 RNA, herein designated VGAM RNA, also designated SEQ ID:3516.

Another function of VGAM805 is therefore inhibition of LOC90072 (Accession XM_028702). Accordingly, utilities of VGAM805 include diagnosis, prevention and treatment of diseases and clinical conditions associated with LOC90072. FIG. 1 further provides a conceptual description of a novel bioinformatically detected viral gene of the present invention, referred to here as Viral Genomic Address Messenger 806 (VGAM806) viral gene, which modulates expression of respective host target genes thereof, the function and utility of which host target genes is known in the art.

VGAM806 is a novel bioinformatically detected regulatory, non protein coding, viral micro RNA (miRNA) gene. The method by which VGAM806 was detected is described hereinabove with reference to FIGS. 1-8.

VGAM806 gene, herein designated VGAM GENE, is a viral gene contained in the genome of Shrimp White Spot Syndrome Virus (white spot bacilliform virus). VGAM806 host target gene, herein designated VGAM HOST TARGET GENE, is a human gene contained in the human genome.

VGAM806 gene encodes a VGAM806 precursor RNA, herein designated VGAM PRECURSOR RNA. Similar to other miRNA genes, and unlike most ordinary genes, VGAM806 precursor RNA does not encode a protein. A nucleotide sequence identical or highly similar to the nucleotide sequence of VGAM806 precursor RNA is designated SEQ ID:792, and is provided hereinbelow with reference to the sequence listing part. Nucleotide sequence SEQ ID:792 is located at position 250093 relative to the genome of Shrimp White Spot Syndrome Virus (white spot bacilliform virus).

VGAM806 precursor RNA folds onto itself, forming VGAM806 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM806 folded precursor RNA into VGAM806 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM806 RNA is designated SEQ ID:3517, and is provided hereinbelow with reference to the sequence listing part.

VGAM806 host target gene, herein designated VGAM HOST TARGET GENE, encodes a corresponding messenger RNA, VGAM806 host target RNA, herein designated VGAM HOST TARGET RNA. VGAM806 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM806 RNA, herein designated VGAM RNA, binds complementarily to one or more host target binding sites located in untranslated regions of VGAM806 host target RNA, herein designated VGAM HOST TARGET RNA. This complementary binding is due to the fact that the nucleotide sequence of VGAM806 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM806 RNA, herein designated VGAM RNA, may have a different number of host target binding sites in untranslated regions of a VGAM806 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM806 RNA, herein designated VGAM RNA, to host target binding sites on VGAM806 host target RNA, herein designated VGAM HOST TARGET RNA, such as BINDING SITE I, BINDING SITE II and BINDING SITE III, inhibits translation of VGAM806 host target RNA into VGAM806 host target protein, herein designated VGAM HOST TARGET PROTEIN. VGAM host target protein is therefore outlined by a broken line.

It is appreciated that VGAM806 host target gene, herein designated VGAM HOST TARGET GENE, in fact represents a plurality of VGAM806 host target genes. The mRNA of each one of this plurality of VGAM806 host target genes comprises one or more host target binding sites, each having a nucleotide sequence which is at least partly complementary to VGAM806 RNA, herein designated VGAM RNA, and which when bound by VGAM806 RNA causes inhibition of translation of respective one or more VGAM806 host target proteins.

It is further appreciated by one skilled in the art that the mode of translational inhibition illustrated by FIG. 1 with specific reference to translational inhibition exerted by VGAM806 gene, herein designated VGAM GENE, on one or more VGAM806 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM806 is inhibition of expression of host target genes, as part of a novel viral mechanism of attacking a host. Accordingly, utilities of VGAM806 include diagnosis, prevention and treatment of viral infection by Shrimp White Spot Syndrome Virus (white spot bacilliform virus). Specific functions, and accordingly utilities, of VGAM806 correlate with, and may be deduced from, the identity of the host target genes which VGAM806 binds and inhibits, and the function of these host target genes, as elaborated hereinbelow.

Nucleotide sequences of the VGAM806 precursor RNA, herein designated VGAM PRECURSOR RNA, and of the 'diced' VGAM806 RNA, herein designated VGAM RNA, and a schematic representation of the secondary folding of VGAM806 folded precursor RNA, herein designated VGAM FOLDED PRECURSOR RNA, of VGAM806 are further described hereinbelow with reference to Table 1.

Nucleotide sequences of host target binding sites, such as BINDING SITE-I, BINDING SITE-II and BINDING SITE-III of FIG. 1, found on VGAM806 host target RNA, and schematic representation of the complementarity of each of these host target binding sites to VGAM806 RNA, herein designated VGAM RNA, are described hereinbelow with reference to Table 2.

As mentioned hereinabove with reference to FIG. 1, a function of VGAM806 gene, herein designated VGAM is inhibition of expression of VGAM806 target genes. It is appreciated that specific functions, and accordingly utilities, of VGAM806 correlate with, and may be deduced from, the identity of the target genes which VGAM806 binds and inhibits, and the function of these target genes, as elaborated hereinbelow.

Adrenergic, Beta, Receptor Kinase 2 (ADRBK2, Accession NM_005160) is a VGAM806 host target gene. ADRBK2 BINDING SITE is HOST TARGET binding site found in the 3' untranslated region of mRNA encoded by ADRBK2, corresponding to a HOST TARGET binding site such as BINDING SITE I, BINDING SITE II or BINDING SITE III. Table 2 illustrates the complementarity of the nucleotide sequences of ADRBK2 BINDING SITE, designated SEQ ID:11643, to the nucleotide sequence of VGAM806 RNA, herein designated VGAM RNA, also designated SEQ ID:3517.

A function of VGAM806 is therefore inhibition of Adrenergic, Beta, Receptor Kinase 2 (ADRBK2, Accession NM_005160), a gene which regulates desensitization of G protein-coupled receptors. Accordingly, utilities of VGAM806 include diagnosis, prevention and treatment of diseases and clinical conditions associated with ADRBK2. The function of ADRBK2 has been established by previous studies. In the rat and the mouse, Benovic et al. (1991) identified a second beta-adrenergic receptor kinase. See beta-adrenergic receptor kinase-1 (ADRBK1; 109635). They isolated the receptor by screening a bovine brain cDNA library with a catalytic domain fragment of the beta-adrenergic receptor kinase. The enzyme, which they termed BARK2, showed overall amino acid identity of 85% with BARK1, with the protein kinase catalytic domain having 95% identity. In the rat, BARK2 mRNA was localized predominantly in neuronal tissues, although low levels were also observed in various tissues. The gene encoding BARK2 mapped to mouse chromosome 5, whereas that encoding BARK1 was localized to mouse chromosome 19. This may indicate that the ADRBK2 gene is located on human chromosome 4 or chromosome 7 since these show extensive homology of synteny with mouse chromosome 5. In fact, however, Calabrese et al. (1994) demonstrated by fluorescence in situ hybridization that the ADRBK2 gene is located on human 22q11.

Full details of the abovementioned studies are described in the following publications, the disclosure of which are hereby incorporated by reference:

Benovic, J. L.; Onorato, J. J.; Arriza, J. L.; Stone, W. C.; Lohse, M.; Jenkins, N. A.; Gilbert, D. J.; Copeland, N. G.; Caron, M. G.; Lefkowitz, R. J.: Cloning, expression, and chromosomal localization of beta-adrenergic receptor kinase 2: a new member of the receptor kinase family. J. Biol. Chem. 266:14939-14946, 1991; and Calabrese, G.; Sallese, M.; Stornaiuolo, A.; Stuppia, L.; Palka, G.; De Blasi, A. : Chromosome mapping of the human arrestin (SAG), beta-arrestin 2 (ARRB2), and beta-adrenergic receptor.

Further studies establishing the function and utilities of ADRBK2 are found in John Hopkins OMIM database record ID 109636, and in sited publications numbered 145 and 5931 listed in the bibliography section hereinbelow, which are also hereby incorporated by reference. Exostoses (multiple)-like 1 (EXTL1, Accession NM_004455) is another VGAM806 host target gene. EXTL1 BINDING SITE is HOST TARGET binding site found in the 3' untranslated region of mRNA encoded by EXTL1, corresponding to a HOST TARGET binding site such as BINDING SITE I, BINDING SITE II or BINDING SITE III. Table 2 illustrates the complementarity of the nucleotide sequences of EXTL1 BINDING SITE, designated SEQ ID:10754, to the nucleotide sequence of VGAM806 RNA, herein designated VGAM RNA, also designated SEQ ID:3517.

Another function of VGAM806 is therefore inhibition of Exostoses (multiple)-like 1 (EXTL1, Accession NM_004455), a gene which probably contribute to the synthesis of heparan sulfate and heparin. Accordingly, utilities of VGAM806 include diagnosis, prevention and treatment of diseases and clinical conditions associated with EXTL1. The function of EXTL1 has been established by previous studies. The tumor suppressors EXT1 (OMIM Ref. No. 133700) and EXT2 (OMIM Ref. No. 133701) are associated with hereditary multiple exostoses and encode bifunctional glycosyltransferases essential for chain polymerization of heparan sulfate and its analog, heparin. Wise et al. (1997) identified another gene, termed EXTL by them, that showed striking sequence similarity to both EXT1 and EXT2 at the nucleotide and amino acid sequence levels. Although the mRNA transcribed from this gene is similar in size to that of EXT1 and EXT2, its pattern of expression was quite different. Of the 3 highly homologous EXT-like genes, EXTL1, EXTL2 (OMIM Ref. No. 602411), and EXTL3 (OMIM Ref. No. 605744), EXTL2 is an alpha-1,4-GlcNAc transferase I, the key enzyme that initiates the heparan sulfate/heparin synthesis. Kim et al. (2001) transiently expressed truncated forms of EXTL1 and EXTL3, lacking the putative NH2-terminal transmembrane and cytoplasmic domains, in COS-1 cells and found that the cells harbored alpha-GlcNAc transferase activity. Various results suggested that EXTL3 is most likely involved in both chain initiation and elongation, whereas EXTL1 is possibly involved only in the chain elongation of heparan sulfate, and perhaps of heparin as well. Thus, the acceptor specificities of the 5 family members are overlapping but distinct, except for EXT1 and EXT2, which have the same specificity. Thus, all of the 5 cloned human EXT gene family proteins harbor glycosyltransferase activities, which probably contribute to the synthesis of heparan sulfate and heparin. Xu et al. (1999) examined the EXTL1 and EXTL2 genes for the presence of germline mutations in hereditary multiple exostosis patients and found none. Hall et al. (2002) proposed the EXTL genes as candidates for second mutations leading to the development of exostoses. By radiation hybrid analysis and by fluorescence in situ hybridization, Wise et al. (1997) mapped EXTL to 1p36.1 between D1S458 and D1S511, a region that frequently shows loss of heterozygosity in a variety of tumor types.

Full details of the abovementioned studies are described in the following publications, the disclosure of which are hereby incorporated by reference:

Wise, C. A.; Clines, G. A.; Massa, H.; Trask, B. J.; Lovett, M.: Identification and localization of the gene for EXTL, a third member of the multiple exostoses gene family. Genome Res. 7:10-16, 1997; and Kim, B.-T.; Kitagawa, H.; Tamura, J.; Saito, T.; Kusche-Gullberg, M.; Lindahl, U.; Sugahara, K.: Human tumor suppressor EXT gene family members EXTL1 and EXTL3 encode alpha-1,4-N-acetyl.

Further studies establishing the function and utilities of EXTL1 are found in John Hopkins OMIM database record ID 601738, and in sited publications numbered 3588, 9324-932 and 11784 listed in the bibliography section hereinbelow, which are also hereby incorporated by reference. G Protein-coupled Receptor 65 (GPR65, Accession XM_007392) is another VGAM806 host target gene. GPR65 BINDING SITE is HOST TARGET binding site found in the 5' untranslated region of mRNA encoded by GPR65, corresponding to a HOST TARGET binding site such as BINDING SITE I, BINDING SITE II or BINDING SITE III. Table 2 illustrates the complementarity of the nucleotide sequences of GPR65 BINDING SITE, designated SEQ ID:30052, to the nucleotide sequence of VGAM806 RNA, herein designated VGAM RNA, also designated SEQ ID:3517.

Another function of VGAM806 is therefore inhibition of G Protein-coupled Receptor 65 (GPR65, Accession XM_007392). Accordingly, utilities of VGAM806 include diagnosis, prevention and treatment of diseases and clinical conditions associated with GPR65. Podocalyxin-like (PODXL, Accession NM_005397) is another VGAM806 host target gene. PODXL BINDING SITE is HOST TARGET binding site found in the 3' untranslated region of mRNA encoded by PODXL, corresponding to a HOST TARGET binding site such as BINDING SITE I, BINDING SITE II or BINDING SITE III. Table 2 illustrates the complementarity of the nucleotide sequences of PODXL BINDING SITE, designated SEQ ID:11869, to the nucleotide sequence of VGAM806 RNA, herein designated VGAM RNA, also designated SEQ ID:3517.

Another function of VGAM806 is therefore inhibition of Podocalyxin-like (PODXL, Accession NM_005397), a gene which is an antiadhesin. Accordingly, utilities of VGAM806 include diagnosis, prevention and treatment of diseases and clinical conditions associated with PODXL. The function of PODXL and its association with various diseases and clinical conditions, has been established by previous studies, as described hereinabove with reference to VGAM247. TSLP (Accession NM_033035) is another VGAM806 host target gene. TSLP BINDING SITE1 and TSLP BINDING SITE2 are HOST TARGET binding sites found in untranslated regions of mRNA encoded by TSLP, corresponding to HOST TARGET binding sites such as BINDING SITE I, BINDING SITE II or BINDING SITE III. Table 2 illustrates the complementarity of the nucleotide sequences of TSLP BINDING SITE1 and TSLP BINDING SITE2, designated SEQ ID:26928 and SEQ ID:28848 respectively, to the nucleotide sequence of VGAM806 RNA, herein designated VGAM RNA, also designated SEQ ID:3517.

Another function of VGAM806 is therefore inhibition of TSLP (Accession NM_033035), a gene which may contribute directly to the activation of Langerhans cells and inhibit apoptosis. Accordingly, utilities of VGAM806 include diagnosis, prevention and treatment of diseases and clinical conditions associated with TSLP. The function of TSLP and its association with various diseases and clinical conditions, has been established by previous studies, as described hereinabove with reference to VGAM558. Chromosome 20 Open Reading Frame 121 (C20orf121, Accession NM_024331) is another VGAM806 host target gene. C20orf121 BINDING SITE is HOST TARGET binding site found in the 3' untranslated region of mRNA encoded by C20orf121, corresponding to a HOST TARGET binding site such as BINDING SITE I, BINDING SITE II or BINDING SITE III. Table 2 illustrates the complementarity of the nucleotide sequences of C20orf121 BINDING SITE, designated SEQ ID:23628, to the nucleotide sequence of VGAM806 RNA, herein designated VGAM RNA, also designated SEQ ID:3517.

Another function of VGAM806 is therefore inhibition of Chromosome 20 Open Reading Frame 121 (C20orf121, Accession NM_024331). Accordingly, utilities of VGAM806 include diagnosis, prevention and treatment of diseases and clinical conditions associated with C20orf121. Chromosome 8 Open Reading Frame 14 (C8orf14, Accession NM_054029) is another VGAM806 host target gene. C8orf14 BINDING SITE is HOST TARGET binding site found in the 5' untranslated region of mRNA encoded by C8orf14, corresponding to a HOST TARGET binding site such as BINDING SITE I, BINDING SITE II or BINDING SITE III. Table 2 illustrates the complementarity of the nucleotide sequences of C8orf14 BINDING SITE, designated SEQ ID:27639, to the nucleotide sequence of VGAM806

RNA, herein designated VGAM RNA, also designated SEQ ID:3517.

Another function of VGAM806 is therefore inhibition of Chromosome 8 Open Reading Frame 14 (C8orf14, Accession NM_054029). Accordingly, utilities of VGAM806 include diagnosis, prevention and treatment of diseases and clinical conditions associated with C8orf14. FLJ11274 (Accession NM_018375) is another VGAM806 host target gene. FLJ11274 BINDING SITE is HOST TARGET binding site found in the 5' untranslated region of mRNA encoded by FLJ11274, corresponding to a HOST TARGET binding site such as BINDING SITE I, BINDING SITE II or BINDING SITE III. Table 2 illustrates the complementarity of the nucleotide sequences of FLJ11274 BINDING SITE, designated SEQ ID:20399, to the nucleotide sequence of VGAM806 RNA, herein designated VGAM RNA, also designated SEQ ID:3517.

Another function of VGAM806 is therefore inhibition of FLJ11274 (Accession NM_018375). Accordingly, utilities of VGAM806 include diagnosis, prevention and treatment of diseases and clinical conditions associated with FLJ11274. FLJ21657 (Accession NM_022483) is another VGAM806 host target gene. FLJ21657 BINDING SITE is HOST TARGET binding site found in the 3' untranslated region of mRNA encoded by FLJ21657, corresponding to a HOST TARGET binding site such as BINDING SITE I, BINDING SITE II or BINDING SITE III. Table 2 illustrates the complementarity of the nucleotide sequences of FLJ21657 BINDING SITE, designated SEQ ID:22857, to the nucleotide sequence of VGAM806 RNA, herein designated VGAM RNA, also designated SEQ ID:3517.

Another function of VGAM806 is therefore inhibition of FLJ21657 (Accession NM_022483). Accordingly, utilities of VGAM806 include diagnosis, prevention and treatment of diseases and clinical conditions associated with FLJ21657. FLJ32334 (Accession NM_144565) is another VGAM806 host target gene. FLJ32334 BINDING SITE is HOST TARGET binding site found in the 3' untranslated region of mRNA encoded by FLJ32334, corresponding to a HOST TARGET binding site such as BINDING SITE I, BINDING SITE II or BINDING SITE III. Table 2 illustrates the complementarity of the nucleotide sequences of FLJ32334 BINDING SITE, designated SEQ ID:29368, to the nucleotide sequence of VGAM806 RNA, herein designated VGAM RNA, also designated SEQ ID:3517.

Another function of VGAM806 is therefore inhibition of FLJ32334 (Accession NM_144565). Accordingly, utilities of VGAM806 include diagnosis, prevention and treatment of diseases and clinical conditions associated with FLJ32334. Protein-kinase, Interferon-inducible Double Stranded RNA Dependent Inhibitor, Repressor of (P58 repressor) (PRKRIR, Accession NM_004705) is another VGAM806 host target gene. PRKRIR BINDING SITE is HOST TARGET binding site found in the 3' untranslated region of mRNA encoded by PRKRIR, corresponding to a HOST TARGET binding site such as BINDING SITE I, BINDING SITE II or BINDING SITE III. Table 2 illustrates the complementarity of the nucleotide sequences of PRKRIR BINDING SITE, designated SEQ ID:11051, to the nucleotide sequence of VGAM806 RNA, herein designated VGAM RNA, also designated SEQ ID:3517.

Another function of VGAM806 is therefore inhibition of Protein-kinase, Interferon-inducible Double Stranded RNA Dependent Inhibitor, Repressor of (P58 repressor) (PRKRIR, Accession NM_004705). Accordingly, utilities of VGAM806 include diagnosis, prevention and treatment of diseases and clinical conditions associated with PRKRIR. Solute Carrier Family 26, Member 7 (SLC26A7, Accession NM_052832) is another VGAM806 host target gene. SLC26A7 BINDING SITE is HOST TARGET binding site found in the 3' untranslated region of mRNA encoded by SLC26A7, corresponding to a HOST TARGET binding site such as BINDING SITE I, BINDING SITE II or BINDING SITE III. Table 2 illustrates the complementarity of the nucleotide sequences of SLC26A7 BINDING SITE, designated SEQ ID:27414, to the nucleotide sequence of VGAM806 RNA, herein designated VGAM RNA, also designated SEQ ID:3517.

Another function of VGAM806 is therefore inhibition of Solute Carrier Family 26, Member 7 (SLC26A7, Accession NM_052832). Accordingly, utilities of VGAM806 include diagnosis, prevention and treatment of diseases and clinical conditions associated with SLC26A7. UBX Domain Containing 2 (UBXD2, Accession XM_043196) is another VGAM806 host target gene. UBXD2 BINDING SITE is HOST TARGET binding site found in the 3' untranslated region of mRNA encoded by UBXD2, corresponding to a HOST TARGET binding site such as BINDING SITE I, BINDING SITE II or BINDING SITE III. Table 2 illustrates the complementarity of the nucleotide sequences of UBXD2 BINDING SITE, designated SEQ ID:33911, to the nucleotide sequence of VGAM806 RNA, herein designated VGAM RNA, also designated SEQ ID:3517.

Another function of VGAM806 is therefore inhibition of UBX Domain Containing 2 (UBXD2, Accession XM_043196). Accordingly, utilities of VGAM806 include diagnosis, prevention and treatment of diseases and clinical conditions associated with UBXD2. LOC144473 (Accession XM_096606) is another VGAM806 host target gene. LOC144473 BINDING SITE is HOST TARGET binding site found in the 5' untranslated region of mRNA encoded by LOC144473, corresponding to a HOST TARGET binding site such as BINDING SITE I, BINDING SITE II or BINDING SITE III. Table 2 illustrates the complementarity of the nucleotide sequences of LOC144473 BINDING SITE, designated SEQ ID:40413, to the nucleotide sequence of VGAM806 RNA, herein designated VGAM RNA, also designated SEQ ID:3517.

Another function of VGAM806 is therefore inhibition of LOC144473 (Accession XM_096606). Accordingly, utilities of VGAM806 include diagnosis, prevention and treatment of diseases and clinical conditions associated with LOC144473. LOC152345 (Accession XM_087442) is another VGAM806 host target gene. LOC152345 BINDING SITE is HOST TARGET binding site found in the 3' untranslated region of mRNA encoded by LOC152345, corresponding to a HOST TARGET binding site such as BINDING SITE I, BINDING SITE II or BINDING SITE III. Table 2 illustrates the complementarity of the nucleotide sequences of LOC152345 BINDING SITE, designated SEQ ID:39265, to the nucleotide sequence of VGAM806 RNA, herein designated VGAM RNA, also designated SEQ ID:3517.

Another function of VGAM806 is therefore inhibition of LOC152345 (Accession XM_087442). Accordingly, utilities of VGAM806 include diagnosis, prevention and treatment of diseases and clinical conditions associated with LOC152345. LOC222678 (Accession XM_167111) is another VGAM806 host target gene. LOC222678 BINDING SITE is HOST TARGET binding site found in the 5' untranslated region of mRNA encoded by LOC222678, corresponding to a HOST TARGET binding site such as BINDING SITE I, BINDING SITE II or BINDING SITE III. Table 2 illustrates the complementarity of the nucleotide sequences of LOC222678 BINDING SITE, designated SEQ ID:44605, to the nucleotide sequence of VGAM806 RNA, herein designated VGAM RNA, also designated SEQ ID:3517.

Another function of VGAM806 is therefore inhibition of LOC222678 (Accession XM_167111). Accordingly, utilities of VGAM806 include diagnosis, prevention and treatment of diseases and clinical conditions associated with LOC222678. LOC91796 (Accession XM_040743) is another VGAM806 host target gene. LOC91796 BINDING SITE is HOST TARGET binding site found in the 3' untranslated region of mRNA encoded by LOC91796, corresponding to a HOST TARGET binding site such as BINDING SITE I, BINDING SITE II or BINDING SITE III. Table 2 illustrates the complementarity of the nucleotide sequences of LOC91796 BINDING SITE, designated SEQ ID:33372, to the nucleotide sequence of VGAM806 RNA, herein designated VGAM RNA, also designated SEQ ID:3517.

Another function of VGAM806 is therefore inhibition of LOC91796 (Accession XM_040743). Accordingly, utilities of VGAM806 include diagnosis, prevention and treatment of diseases and clinical conditions associated with LOC91796. FIG. 1 further provides a conceptual description of a novel bioinformatically detected viral gene of the present invention, referred to here as Viral Genomic Address Messenger 807 (VGAM807) viral gene, which modulates expression of respective host target genes thereof, the function and utility of which host target genes is known in the art.

VGAM807 is a novel bioinformatically detected regulatory, non protein coding, viral micro RNA (miRNA) gene. The method by which VGAM807 was detected is described hereinabove with reference to FIGS. 1-8.

VGAM807 gene, herein designated VGAM GENE, is a viral gene contained in the genome of Equine Herpesvirus 2. VGAM807 host target gene, herein designated VGAM HOST TARGET GENE, is a human gene contained in the human genome.

VGAM807 gene encodes a VGAM807 precursor RNA, herein designated VGAM PRECURSOR RNA. Similar to other miRNA genes, and unlike most ordinary genes, VGAM807 precursor RNA does not encode a protein. A nucleotide sequence identical or highly similar to the nucleotide sequence of VGAM807 precursor RNA is designated SEQ ID:793, and is provided hereinbelow with reference to the sequence listing part. Nucleotide sequence SEQ ID:793 is located at position 61419 relative to the genome of Equine Herpesvirus 2.

VGAM807 precursor RNA folds onto itself, forming VGAM807 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM807 folded precursor RNA into VGAM807 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM807 RNA is designated SEQ ID:3518, and is provided hereinbelow with reference to the sequence listing part.

VGAM807 host target gene, herein designated VGAM HOST TARGET GENE, encodes a corresponding messenger RNA, VGAM807 host target RNA, herein designated VGAM HOST TARGET RNA. VGAM807 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM807 RNA, herein designated VGAM RNA, binds complementarily to one or more host target binding sites located in untranslated regions of VGAM807 host target RNA, herein designated VGAM HOST TARGET RNA. This complementary binding is due to the fact that the nucleotide sequence of VGAM807 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM807 RNA, herein designated VGAM RNA, may have a different number of host target binding sites in untranslated regions of a VGAM807 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM807 RNA, herein designated VGAM RNA, to host target binding sites on VGAM807 host target RNA, herein designated VGAM HOST TARGET RNA, such as BINDING SITE I, BINDING SITE II and BINDING SITE III, inhibits translation of VGAM807 host target RNA into VGAM807 host target protein, herein designated VGAM HOST TARGET PROTEIN. VGAM host target protein is therefore outlined by a broken line.

It is appreciated that VGAM807 host target gene, herein designated VGAM HOST TARGET GENE, in fact represents a plurality of VGAM807 host target genes. The mRNA of each one of this plurality of VGAM807 host target genes comprises one or more host target binding sites, each having a nucleotide sequence which is at least partly complementary to VGAM807 RNA, herein designated VGAM RNA, and which when bound by VGAM807 RNA causes inhibition of translation of respective one or more VGAM807 host target proteins.

It is further appreciated by one skilled in the art that the mode of translational inhibition illustrated by FIG. 1 with specific reference to translational inhibition exerted by VGAM807 gene, herein designated VGAM GENE, on one or more VGAM807 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM807 is inhibition of expression of host target genes, as part of a novel viral mechanism of attacking a host. Accordingly, utilities of VGAM807 include diagnosis, prevention and treatment of viral infection by Equine Herpesvirus 2. Specific functions, and accordingly utilities, of VGAM807 correlate with, and may be deduced from, the identity of the host target genes which VGAM807 binds and inhibits, and the function of these host target genes, as elaborated hereinbelow.

Nucleotide sequences of the VGAM807 precursor RNA, herein designated VGAM PRECURSOR RNA, and of the 'diced' VGAM807 RNA, herein designated VGAM RNA, and a schematic representation of the secondary folding of VGAM807 folded precursor RNA, herein designated VGAM FOLDED PRECURSOR RNA, of VGAM807 are further described hereinbelow with reference to Table 1.

Nucleotide sequences of host target binding sites, such as BINDING SITE-I, BINDING SITE-II and BINDING SITE-III of FIG. 1, found on VGAM807 host target RNA, and schematic representation of the complementarity of each of these host target binding sites to VGAM807 RNA, herein designated VGAM RNA, are described hereinbelow with reference to Table 2.

As mentioned hereinabove with reference to FIG. 1, a function of VGAM807 gene, herein designated VGAM is inhibition of expression of VGAM807 target genes. It is appreciated that specific functions, and accordingly utilities, of VGAM807 correlate with, and may be deduced from, the identity of the target genes which VGAM807 binds and inhibits, and the function of these target genes, as elaborated hereinbelow.

Adenylate Cyclase 7 (ADCY7, Accession NM_001114) is a VGAM807 host target gene. ADCY7 BINDING SITE is HOST TARGET binding site found in the 3' untranslated region of mRNA encoded by ADCY7, corresponding to a HOST TARGET binding site such as BINDING SITE I, BINDING SITE II or BINDING SITE III. Table 2 illustrates the complementarity of the nucleotide sequences of ADCY7 BINDING SITE, designated SEQ ID:6781, to the nucleotide sequence of VGAM807 RNA, herein designated VGAM RNA, also designated SEQ ID:3518.

A function of VGAM807 is therefore inhibition of Adenylate Cyclase 7 (ADCY7, Accession NM_001114), a gene which this a membrane-bound, ca (2+)-inhibitable adenylyl cyclase. Accordingly, utilities of VGAM807 include diagnosis, prevention and treatment of diseases and clinical conditions associated with ADCY7. The function of ADCY7 and its association with various diseases and clinical conditions, has been established by previous studies, as described hereinabove with reference to VGAM108. Calmodulin 3 (phosphorylase kinase, delta) (CALM3, Accession NM_005184) is another VGAM807 host target gene. CALM3 BINDING SITE is HOST TARGET binding site found in the 3' untranslated region of mRNA encoded by CALM3, corresponding to a HOST TARGET binding site such as BINDING SITE I, BINDING SITE II or BINDING SITE III. Table 2 illustrates the complementarity of the nucleotide sequences of CALM3 BINDING SITE, designated SEQ ID:11685, to the nucleotide sequence of VGAM807 RNA, herein designated VGAM RNA, also designated SEQ ID:3518.

Another function of VGAM807 is therefore inhibition of Calmodulin 3 (phosphorylase kinase, delta) (CALM3, Accession NM_005184), a gene which mediates the control of a large number of enzymes by ca (++). Accordingly, utilities of VGAM807 include diagnosis, prevention and treatment of diseases and clinical conditions associated with CALM3. The function of CALM3 and its association with various diseases and clinical conditions, has been established by previous studies, as described hereinabove with reference to VGAM785. Cyclin-dependent Kinase 5, Regulatory Subunit 2 (p39) (CDK5R2, Accession NM_003936) is another VGAM807 host target gene. CDK5R2 BINDING SITE is HOST TARGET binding site found in the 3' untranslated region of mRNA encoded by CDK5R2, corresponding to a HOST TARGET binding site such as BINDING SITE I, BINDING SITE II or BINDING SITE III. Table 2 illustrates the complementarity of the nucleotide sequences of CDK5R2 BINDING SITE, designated SEQ ID:10041, to the nucleotide sequence of VGAM807 RNA, herein designated VGAM RNA, also designated SEQ ID:3518.

Another function of VGAM807 is therefore inhibition of Cyclin-dependent Kinase 5, Regulatory Subunit 2 (p39) (CDK5R2, Accession NM_003936), a gene which acts as a regulatory subunit for the cyclin-dependent CDK5. Accordingly, utilities of VGAM807 include diagnosis, prevention and treatment of diseases and clinical conditions associated with CDK5R2. The function of CDK5R2 and its association with various diseases and clinical conditions, has been established by previous studies, as described hereinabove with reference to VGAM403. Microtubule-associated Protein 1A (MAP1A, Accession NM_002373) is another VGAM807 host target gene. MAP1A BINDING SITE is HOST TARGET binding site found in the 3' untranslated region of mRNA encoded by MAP1A, corresponding to a HOST TARGET binding site such as BINDING SITE I, BINDING SITE II or BINDING SITE III. Table 2 illustrates the complementarity of the nucleotide sequences of MAP1A BINDING SITE, designated SEQ ID:8182, to the nucleotide sequence of VGAM807 RNA, herein designated VGAM RNA, also designated SEQ ID:3518.

Another function of VGAM807 is therefore inhibition of Microtubule-associated Protein 1A (MAP1A, Accession NM_002373), a gene which is a structural protein involved in the filamentous cross- bridging between microtubules and other skeletal elements. Accordingly, utilities of VGAM807 include diagnosis, prevention and treatment of diseases and clinical conditions associated with MAP1A. The function of MAP1A and its association with various diseases and clinical conditions, has been established by previous studies, as described hereinabove with reference to VGAM315. Carbohydrate (chondroitin 6) Sulfotransferase 3 (CHST3, Accession NM_004273) is another VGAM807 host target gene. CHST3 BINDING SITE is HOST TARGET binding site found in the 5' untranslated region of mRNA encoded by CHST3, corresponding to a HOST TARGET binding site such as BINDING SITE I, BINDING SITE II or BINDING SITE III. Table 2 illustrates the complementarity of the nucleotide sequences of CHST3 BINDING SITE, designated SEQ ID:10476, to the nucleotide sequence of VGAM807 RNA, herein designated VGAM RNA, also designated SEQ ID:3518.

Another function of VGAM807 is therefore inhibition of Carbohydrate (chondroitin 6) Sulfotransferase 3 (CHST3, Accession NM_004273). Accordingly, utilities of VGAM807 include diagnosis, prevention and treatment of diseases and clinical conditions associated with CHST3. FLJ10350 (Accession XM_170946) is another VGAM807 host target gene. FLJ10350 BINDING SITE is HOST TARGET binding site found in the 3" untranslated region of mRNA encoded by FLJ10350, corresponding to a HOST TARGET binding site such as BINDING SITE I, BINDING SITE II or BINDING SITE III. Table 2 illustrates the complementarity of the nucleotide sequences of FLJ10350 BINDING SITE, designated SEQ ID:45729, to the nucleotide sequence of VGAM807 RNA, herein designated VGAM RNA, also designated SEQ ID:3518.

Another function of VGAM807 is therefore inhibition of FLJ10350 (Accession XM_170946). Accordingly, utilities of VGAM807 include diagnosis, prevention and treatment of diseases and clinical conditions associated with FLJ10350.

Transducin (beta)-like 1Y-linked (TBL1Y, Accession NM_033284) is another VGAM807 host target gene. TBL1Y BINDING SITE1 through TBL1Y BINDING SITE3 are HOST TARGET binding sites found in untranslated regions of mRNA encoded by TBL1Y, corresponding to HOST TARGET binding sites such as BINDING SITE I, BINDING SITE II or BINDING SITE III. Table 2 illustrates the complementarity of the nucleotide sequences of TBL1Y BINDING SITE1 through TBL1Y BINDING SITE3, designated SEQ ID:27099, SEQ ID:28609 and SEQ ID:28610 respectively, to the nucleotide sequence of VGAM807 RNA, herein designated VGAM RNA, also designated SEQ ID:3518.

Another function of VGAM807 is therefore inhibition of Transducin (beta)-like 1Y-linked (TBL1Y, Accession NM_033284). Accordingly, utilities of VGAM807 include diagnosis, prevention and treatment of diseases and clinical conditions associated with TBL1Y. LOC125268 (Accession XM_071960) is another VGAM807 host target gene. LOC125268 BINDING SITE is HOST TARGET binding site found in the 3' untranslated region of mRNA encoded by LOC125268, corresponding to a HOST TARGET binding site such as BINDING SITE I, BINDING SITE II or BINDING SITE III. Table 2 illustrates the complementarity of the nucleotide sequences of LOC125268 BINDING SITE, designated SEQ ID:37449, to the nucleotide sequence of VGAM807 RNA, herein designated VGAM RNA, also designated SEQ ID:3518.

Another function of VGAM807 is therefore inhibition of LOC125268 (Accession XM_071960). Accordingly, utilities of VGAM807 include diagnosis, prevention and treatment of diseases and clinical conditions associated with LOC125268. FIG. 1 further provides a conceptual description of a novel bioinformatically detected viral gene of the present invention, referred to here as Viral Genomic Address Messenger 808 (VGAM808) viral gene, which modulates expression of respective host target genes thereof, the function and utility of which host target genes is known in the art.

VGAM808 is a novel bioinformatically detected regulatory, non protein coding, viral micro RNA (miRNA) gene. The method by which VGAM808 was detected is described hereinabove with reference to FIGS. 1-8.

VGAM808 gene, herein designated VGAM GENE, is a viral gene contained in the genome of Equine Herpesvirus 2. VGAM808 host target gene, herein designated VGAM HOST TARGET GENE, is a human gene contained in the human genome.

VGAM808 gene encodes a VGAM808 precursor RNA, herein designated VGAM PRECURSOR RNA. Similar to other miRNA genes, and unlike most ordinary genes, VGAM808 precursor RNA does not encode a protein. A nucleotide sequence identical or highly similar to the nucleotide sequence of VGAM808 precursor RNA is designated SEQ ID:794, and is provided hereinbelow with reference to the sequence listing part. Nucleotide sequence SEQ ID:794 is located at position 60546 relative to the genome of Equine Herpesvirus 2.

VGAM808 precursor RNA folds onto itself, forming VGAM808 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM808 folded precursor RNA into VGAM808 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM808 RNA is designated SEQ ID:3519, and is provided hereinbelow with reference to the sequence listing part.

VGAM808 host target gene, herein designated VGAM HOST TARGET GENE, encodes a corresponding messenger RNA, VGAM808 host target RNA, herein designated VGAM HOST TARGET RNA. VGAM808 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM808 RNA, herein designated VGAM RNA, binds complementarily to one or more host target binding sites located in untranslated regions of VGAM808 host target RNA, herein designated VGAM HOST TARGET RNA. This complementary binding is due to the fact that the nucleotide sequence of VGAM808 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM808 RNA, herein designated VGAM RNA, may have a different number of host target binding sites in untranslated regions of a VGAM808 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM808 RNA, herein designated VGAM RNA, to host target binding sites on VGAM808 host target RNA, herein designated VGAM HOST TARGET RNA, such as BINDING SITE I, BINDING SITE II and BINDING SITE III, inhibits translation of VGAM808 host target RNA into VGAM808 host target protein, herein designated VGAM HOST TARGET PROTEIN. VGAM host target protein is therefore outlined by a broken line.

It is appreciated that VGAM808 host target gene, herein designated VGAM HOST TARGET GENE, in fact represents a plurality of VGAM808 host target genes. The mRNA of each one of this plurality of VGAM808 host target genes comprises one or more host target binding sites, each having a nucleotide sequence which is at least partly complementary to VGAM808 RNA, herein designated VGAM RNA, and which when bound by VGAM808 RNA causes inhibition of translation of respective one or more VGAM808 host target proteins.

It is further appreciated by one skilled in the art that the mode of translational inhibition illustrated by FIG. 1 with specific reference to translational inhibition exerted by VGAM808 gene, herein designated VGAM GENE, on one or more VGAM808 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM808 is inhibition of expression of host target genes, as part of a novel viral mechanism of attacking a host. Accordingly, utilities of VGAM808 include diagnosis, prevention and treatment of viral infection by Equine Herpesvirus 2. Specific functions, and accordingly utilities, of VGAM808 correlate with, and may be deduced from, the identity of the host target genes which VGAM808 binds and inhibits, and the function of these host target genes, as elaborated hereinbelow.

Nucleotide sequences of the VGAM808 precursor RNA, herein designated VGAM PRECURSOR RNA, and of the 'diced' VGAM808 RNA, herein designated VGAM RNA, and a schematic representation of the secondary folding of VGAM808 folded precursor RNA, herein designated VGAM FOLDED PRECURSOR RNA, of VGAM808 are further described hereinbelow with reference to Table 1.

Nucleotide sequences of host target binding sites, such as BINDING SITE-I, BINDING SITE-II and BINDING SITE-III of FIG. 1, found on VGAM808 host target RNA, and schematic representation of the complementarity of each of these host target binding sites to VGAM808 RNA, herein designated VGAM RNA, are described hereinbelow with reference to Table 2.

As mentioned hereinabove with reference to FIG. 1, a function of VGAM808 gene, herein designated VGAM is inhibition of expression of VGAM808 target genes. It is appreciated that specific functions, and accordingly utilities, of VGAM808 correlate with, and may be deduced from, the identity of the target genes which VGAM808 binds and inhibits, and the function of these target genes, as elaborated hereinbelow.

Absent In Melanoma 1 (AIM1, Accession XM_166300) is a VGAM808 host target gene. AIM1 BINDING SITE is HOST TARGET binding site found in the 5' untranslated region of mRNA encoded by AIM1, corresponding to a HOST TARGET binding site such as BINDING SITE I, BINDING SITE II or BINDING SITE III. Table 2 illustrates the complementarity of the nucleotide sequences of AIM1 BINDING SITE, designated SEQ ID:44114, to the nucleotide sequence of VGAM808 RNA, herein designated VGAM RNA, also designated SEQ ID:3519.

A function of VGAM808 is therefore inhibition of Absent In Melanoma 1 (AIM1, Accession XM_166300), a gene which interactions with the cytoskeleton. Accordingly, utilities of VGAM808 include diagnosis, prevention and treatment of diseases and clinical conditions associated with AIM1. The function of AIM1 has been established by previous studies. The AIM1 gene encodes a melanocyte differentiation antigen that is expressed in a high percentage of melanoma cell lines. Its homolog in medaka, 'B,' encodes a transporter that mediates melanin synthesis. Harada et al. (2001) identified an antigen in human melanoma that they called AIM1 protein. The AIM1 gene was expressed in 3 melanoma cell lines, but not in a fibroblast cell line, and not at significant levels in any of 15 normal tissues. The human AIM1 gene encodes a protein of 530 amino acids. Northern blot analysis detected 2 transcripts, one of 1.7 kb and the other of 2.8 kb. Harada et al. (2001) concluded that the AIM1 gene encodes a melanocyte differentiation antigen that is expressed in a high percentage of melanoma cell lines. By sequence analysis, Newton et al. (2001) mapped the MATP gene to chromosome 5p.

Full details of the abovementioned studies are described in the following publications, the disclosure of which are hereby incorporated by reference:

Harada, M.; Li, Y. F.; El-Gamil, M.; Rosenberg, S. A.; Robbins, P. F.: Use of an in vitro immunoselected tumor line to identify shared melanoma antigens recognized by HLA-A*0201-restricted T cells. Cancer Res. 61:1089-1094, 2001; and Newton, J. M.; Cohen-Barak, O.; Hagiwara, N.; Gardner, J. M.; Davisson, M. T.; King, R. A.; Brilliant, M. H.: Mutations in the human orthologue of the mouse underwhite gene (uw) underl.

Further studies establishing the function and utilities of AIM1 are found in John Hopkins OMIM database record ID 606202, and in sited publications numbered 904-906 listed in the bibliography section hereinbelow, which are also hereby incorporated by reference. EphB4 (EPHB4, Accession NM_004444) is another VGAM808 host target gene. EPHB4 BINDING SITE is HOST TARGET binding site found in the 3' untranslated region of mRNA encoded by EPHB4, corresponding to a HOST TARGET binding site such as BINDING SITE I, BINDING SITE II or BINDING SITE III. Table 2 illustrates the complementarity of the nucleotide sequences of EPHB4 BINDING SITE, designated SEQ ID:10738, to the nucleotide sequence of VGAM808 RNA, herein designated VGAM RNA, also designated SEQ ID:3519.

Another function of VGAM808 is therefore inhibition of EphB4 (EPHB4, Accession NM_004444), a gene which receptor for members of the ephrin-b family. binds to ephrin-b2. Accordingly, utilities of VGAM808 include diagnosis, prevention and treatment of diseases and clinical conditions associated with EPHB4. The function of EPHB4 has been established by previous studies. See 179610 for background on Eph receptors and their ligands, the ephrins. In CD34+ human bone marrow cells and a human hepatocellular carcinoma cell line, Bennett et al. (1994) identified a novel transmembrane tyrosine kinase, which they called hepatoma transmembrane kinase, or HTK. They reported that the predicted 987-amino acid sequence of HTK includes a transmembrane region and signal sequence. The predicted extracellular domain contains a cysteine-rich region and tandem fibronectin type III repeats, while the intracellular domain contains the catalytic domain. Northern blot analysis demonstrated a single HTK transcript abundantly expressed in placenta and in a range of primary tissues and malignant cell lines. It is expressed in fetal, but not adult, brain, and in primitive and myeloid, but not lymphoid, hematopoietic cells. The protein shared amino acid similarity with the Eph subfamily of tyrosine kinases. Using 2 independent sets of primers specific for human HTK to amplify DNA from a panel of human-hamster hybrid cell lines, they demonstrated that the human gene is located on chromosome 7. Berclaz et al. (1996) examined the expression of HTK in normal and malignant breast tissue. They found that in normal breast, expression is confined to secretory luminal epithelial cells. They found elevated expression of HTK in several human breast carcinoma cell lines as well as in primary ductal carcinomas of the breast. The authors suggested that HTK may have a role in the differentiation or maintenance of secretory epithelia. Gerety et al. (1999) generated mice with a targeted disruption of EphB4 by introducing a tau-lacZ marker into the gene. Unlike the broadly expressed ephrin B2 gene (EFNB2; 600527), EphB4 is uniquely expressed in vascular endothelial and endocardial cells. The authors' analysis also confirmed that EphB4 is preferentially expressed on veins. Remarkably, the phenotype of homozygous EphB4 mutants was virtually symmetric to that of EfnB2 mutants. These data identified EphB4 as the major essential interaction partner of EFNB2 in angiogenesis and further indicated that the requisite function of this receptor is intrinsic to the circulatory system. In addition, these data indicated that EFNB2 and EphB4 mediate reciprocal interactions between arteries and veins that are essential for proper angiogenic remodeling of the capillary beds.

Full details of the abovementioned studies are described in the following publications, the disclosure of which are hereby incorporated by reference:

Bennett, B. D.; Wang, Z.; Kuang, W.-J.; Wang, A.; Groopman, J. E.; Goeddel, D. V.; Scadden, D. T.: Cloning and characterization of HTK, a novel transmembrane tyrosine kinase of the EPH subfamily. J. Biol. Chem. 269:14211-14218, 1994; and Gerety, S. S.; Wang, H. U.; Chen, Z.-F.; Anderson, D. J.: Symmetrical mutant phenotypes of the receptor EphB4 and its specific transmembrane ligand ephrin-B2 in cardiovascular developme.

Further studies establishing the function and utilities of EPHB4 are found in John Hopkins OMIM database record ID 600011, and in sited publications numbered 8346-8348 listed in the bibliography section hereinbelow, which are also hereby incorporated by reference. Homeo Box A3 (HOXA3, Accession NM_030661) is another VGAM808 host target gene. HOXA3 BINDING SITE is HOST TARGET binding site found in the 3' untranslated region of mRNA encoded by HOXA3, corresponding to a HOST TARGET binding site such as BINDING SITE I, BINDING SITE II or BINDING SITE III. Table 2 illustrates the complementarity of the nucleotide sequences of HOXA3 BINDING SITE, designated SEQ ID:24993, to the nucleotide sequence of VGAM808 RNA, herein designated VGAM RNA, also designated SEQ ID:3519.

Another function of VGAM808 is therefore inhibition of Homeo Box A3 (HOXA3, Accession NM_030661). Accordingly, utilities of VGAM808 include diagnosis, prevention and treatment of diseases and clinical conditions associated with HOXA3. Tenascin C (hexabrachion) (TNC, Accession NM_002160) is another VGAM808 host target gene. TNC BINDING SITE is HOST TARGET binding site found in the 3' untranslated region of mRNA encoded by TNC, corresponding to a HOST TARGET binding site such as BINDING SITE I, BINDING SITE II or BINDING SITE III. Table 2 illustrates the complementarity of the nucleotide sequences of TNC BINDING SITE, designated SEQ ID:7935, to the nucleotide sequence of VGAM808 RNA, herein designated VGAM RNA, also designated SEQ ID:3519.

Another function of VGAM808 is therefore inhibition of Tenascin C (hexabrachion) (TNC, Accession NM_002160), a gene which has epidermal growth factor-like repeats. Accordingly, utilities of VGAM808 include diagnosis, prevention and treatment of diseases and clinical conditions associated with TNC. The function of TNC has been established by previous studies. Tenascin, also known as hexabrachion and cytotactin, is an extracellular matrix protein with a spatially and temporally restricted tissue distribution. It is a hexomeric, multidomain protein with disulfide-linked subunits of 190 to 240 kD, originally characterized as 'myotendinous antigen.' In the embryo it is present in dense mesenchyme surrounding developing epithelia, in tendon anlagen, and in developing cartilage and bone. In the adult tenascin remains present in tendons and myotendinous junctions in the perichondrium and periosteum, as well as in smooth muscle. Pearson et al. (1988) isolated cDNA clones coding for tenascin from a chicken fibroblast cDNA expression library using a specific tenascin antiserum. They showed induction of tenascin in vitro by fetal calf serum as well as by transforming growth factor-beta (OMIM Ref. No. 190180). The gene is also called hexabrachion (HXB). Olson and Srivastava (1996) reviewed processes involved in separation of the cardiac tube into the atria, ventricles, and outflow tract. They noted that tenascin is upregulated and NCAM (OMIM Ref. No. 116930) is downregulated in the embryonic endocardial cushions. This upregulation of tenascin is thought to disrupt cell substrate adhesion and to allow cells to migrate through the extracellular component of the cardiac cushion. Olson and Srivastava (1996) suggested that abnormalities or arrests in these processes may be responsible for some of the AV canal and conotruncal defects in infants. Animal model experiments lend further support to the function of TNC. In the central nervous system, tenascin C is expressed primarily by astrocytes. Tenascin is precisely localized in the vibrissae-related barrel fields of the developing somatosensory cortex, suggesting that it may be important in the formation of barrel boundaries. Steindler et al. (1995) demonstrated normal barrels in homozygous knockout mice for tenascin C, finding no abnormalities of the barrel boundaries despite the absence of this molecule. However, Mitrovic and Schachner (1995) were able to detect tenascin C immunoreactivity, albeit in an abnormal pattern, in the knockout mice designed to be null mutants for tenascin C expression.

It is appreciated that the abovementioned animal model for TNC is acknowledged by those skilled in the art as a scientifically valid animal model, as can be further appreciated from the publications sited hereinbelow.

Full details of the abovementioned studies are described in the following publications, the disclosure of which are hereby incorporated by reference:

Olson, E.; Srivastava, D.: Molecular pathways controlling heart development. Science 272:671-676, 1996; and Steindler, D. A.; Settles, D.; Erickson, H. P.; Laywell, E. D.; Yoshiki, A.; Faissner, A.; Kusakabe, M.: Tenascin knockout mice: barrels, boundary molecules, and glial scars. J. Neurosc.

Further studies establishing the function and utilities of TNC are found in John Hopkins OMIM database record ID 187380, and in sited publications numbered 12678-12682, 12341-59 and 10840 listed in the bibliography section hereinbelow, which are also hereby incorporated by reference. DKFZP434G1415 (Accession NM_031292) is another VGAM808 host target gene. DKFZP434G1415 BINDING SITE is HOST TARGET binding site found in the 3' untranslated region of mRNA encoded by DKFZP434G1415, corresponding to a HOST TARGET binding site such as BINDING SITE I, BINDING SITE II or BINDING SITE III. Table 2 illustrates the complementarity of the nucleotide sequences of DKFZP434G1415 BINDING SITE, designated SEQ ID:25315, to the nucleotide sequence of VGAM808 RNA, herein designated VGAM RNA, also designated SEQ ID:3519.

Another function of VGAM808 is therefore inhibition of DKFZP434G1415 (Accession NM_031292). Accordingly, utilities of VGAM808 include diagnosis, prevention and treatment of diseases and clinical conditions associated with DKFZP434G1415. FLJ10508 (Accession NM_018118) is another VGAM808 host target gene. FLJ10508 BINDING SITE is HOST TARGET binding site found in the 3' untranslated region of mRNA encoded by FLJ10508, corresponding to a HOST TARGET binding site such as BINDING SITE I, BINDING SITE II or BINDING SITE III. Table 2 illustrates the complementarity of the nucleotide sequences of FLJ10508 BINDING SITE, designated SEQ ID:19894, to the nucleotide sequence of VGAM808 RNA, herein designated VGAM RNA, also designated SEQ ID:3519.

Another function of VGAM808 is therefore inhibition of FLJ10508 (Accession NM_018118). Accordingly, utilities of VGAM808 include diagnosis, prevention and treatment of diseases and clinical conditions associated with FLJ10508. FLJ14708 (Accession NM_032827) is another VGAM808 host target gene. FLJ14708 BINDING SITE is HOST TARGET binding site found in the 3' untranslated region of mRNA encoded by FLJ14708, corresponding to a HOST TARGET binding site such as BINDING SITE I, BINDING SITE II or BINDING SITE III. Table 2 illustrates the complementarity of the nucleotide sequences of FLJ14708 BINDING SITE, designated SEQ ID:26600, to the nucleotide sequence of VGAM808 RNA, herein designated VGAM RNA, also designated SEQ ID:3519.

Another function of VGAM808 is therefore inhibition of FLJ14708 (Accession NM_032827). Accordingly, utilities of VGAM808 include diagnosis, prevention and treatment of diseases and clinical conditions associated with FLJ14708. KIAA0930 (Accession XM_047214) is another VGAM808 host target gene. KIAA0930 BINDING SITE is HOST TARGET binding site found in the 3' untranslated region of mRNA encoded by KIAA0930, corresponding to a HOST TARGET binding site such as BINDING SITE I, BINDING SITE II or BINDING SITE III. Table 2 illustrates the complementarity of the nucleotide sequences of KIAA0930 BINDING SITE, designated SEQ ID:34917, to the nucleotide sequence of VGAM808 RNA, herein designated VGAM RNA, also designated SEQ ID:3519.

Another function of VGAM808 is therefore inhibition of KIAA0930 (Accession XM_047214). Accordingly, utilities of VGAM808 include diagnosis, prevention and treatment of diseases and clinical conditions associated with KIAA0930. KIAA1655 (Accession XM_039442) is another VGAM808 host target gene. KIAA1655 BINDING SITE is HOST TARGET binding site found in the 3' untranslated region of mRNA encoded by KIAA1655, corresponding to a HOST TARGET binding site such as BINDING SITE I, BINDING SITE II or BINDING SITE III. Table 2 illustrates the complementarity of the nucleotide sequences of KIAA1655 BINDING SITE, designated SEQ ID:33085, to the nucleotide sequence of VGAM808 RNA, herein designated VGAM RNA, also designated SEQ ID:3519.

Another function of VGAM808 is therefore inhibition of KIAA1655 (Accession XM_039442). Accordingly, utilities of VGAM808 include diagnosis, prevention and treatment of diseases and clinical conditions associated with KIAA1655. KIAA1924 (Accession XM_057091) is another VGAM808 host target gene. KIAA1924 BINDING SITE is HOST TARGET binding site found in the 3' untranslated region of mRNA encoded by KIAA1924, corresponding to a HOST TARGET binding site such as BINDING SITE I, BINDING SITE II or BINDING SITE III. Table 2 illustrates the complementarity of the nucleotide sequences of KIAA1924 BINDING SITE, designated SEQ ID:36478, to the nucleotide sequence of VGAM808 RNA, herein designated VGAM RNA, also designated SEQ ID:3519.

Another function of VGAM808 is therefore inhibition of KIAA1924 (Accession XM_057091). Accordingly, utilities of VGAM808 include diagnosis, prevention and treatment of diseases and clinical conditions associated with KIAA1924. LPS-responsive Vesicle Trafficking, Beach and Anchor Containing (LRBA, Accession NM_006726) is another VGAM808 host target gene. LRBA BINDING SITE is HOST TARGET binding site found in the 5' untranslated region of mRNA encoded by LRBA, corresponding to a HOST TARGET binding site such as BINDING SITE I, BINDING SITE II or BINDING SITE III. Table 2 illustrates the complementarity of the nucleotide sequences of LRBA BINDING SITE, designated SEQ ID:13556, to the nucleotide sequence of VGAM808 RNA, herein designated VGAM RNA, also designated SEQ ID:3519.

Another function of VGAM808 is therefore inhibition of LPS-responsive Vesicle Trafficking, Beach and Anchor Containing (LRBA, Accession NM_006726). Accordingly, utilities of VGAM808 include diagnosis, prevention and treatment of diseases and clinical conditions associated with LRBA. MGC9753 (Accession NM_033419) is another VGAM808 host target gene. MGC9753 BINDING SITE is HOST TARGET binding site found in the 5' untranslated region of mRNA encoded by MGC9753, corresponding to a HOST TARGET binding site such as BINDING SITE I, BINDING SITE II or BINDING SITE III. Table 2 illustrates the complementarity of the nucleotide sequences of MGC9753 BINDING SITE, designated SEQ ID:27240, to the nucleotide sequence of VGAM808 RNA, herein designated VGAM RNA, also designated SEQ ID:3519.

Another function of VGAM808 is therefore inhibition of MGC9753 (Accession NM_033419). Accordingly, utilities of VGAM808 include diagnosis, prevention and treatment of diseases and clinical conditions associated with MGC9753. Sema Domain, Immunoglobulin Domain (Ig), Transmembrane Domain (TM) and Short Cytoplasmic Domain, (semaphorin) 4C (SEMA4C, Accession NM_017789) is another VGAM808 host target gene. SEMA4C BINDING SITE is HOST TARGET binding site found in the 3' untranslated region of mRNA encoded by SEMA4C, corresponding to a HOST TARGET binding site such as BINDING SITE I, BINDING SITE II or BINDING SITE III. Table 2 illustrates the complementarity of the nucleotide sequences of SEMA4C BINDING SITE, designated SEQ ID:19421, to the nucleotide sequence of VGAM808 RNA, herein designated VGAM RNA, also designated SEQ ID:3519.

Another function of VGAM808 is therefore inhibition of Sema Domain, Immunoglobulin Domain (Ig), Transmembrane Domain (TM) and Short Cytoplasmic Domain, (semaphorin) 4C (SEMA4C, Accession NM_017789). Accordingly, utilities of VGAM808 include diagnosis, prevention and treatment of diseases and clinical conditions associated with SEMA4C. LOC255631 (Accession XM_171267) is another VGAM808 host target gene. LOC255631 BINDING SITE is HOST TARGET binding site found in the 5' untranslated region of mRNA encoded by LOC255631, corresponding to a HOST TARGET binding site such as BINDING SITE I, BINDING SITE II or BINDING SITE III. Table 2 illustrates the complementarity of the nucleotide sequences of LOC255631 BINDING SITE, designated SEQ ID:46038, to the nucleotide sequence of VGAM808 RNA, herein designated VGAM RNA, also designated SEQ ID:3519.

Another function of VGAM808 is therefore inhibition of LOC255631 (Accession XM_171267). Accordingly, utilities of VGAM808 include diagnosis, prevention and treatment of diseases and clinical conditions associated with LOC255631. FIG. 1 further provides a conceptual description of a novel bioinformatically detected viral gene of the present invention, referred to here as Viral Genomic Address Messenger 809 (VGAM809) viral gene, which modulates expression of respective host target genes thereof, the function and utility of which host target genes is known in the art.

VGAM809 is a novel bioinformatically detected regulatory, non protein coding, viral micro RNA (miRNA) gene. The method by which VGAM809 was detected is described hereinabove with reference to FIGS. 1-8.

VGAM809 gene, herein designated VGAM GENE, is a viral gene contained in the genome of Equine Herpesvirus 2. VGAM809 host target gene, herein designated VGAM HOST TARGET GENE, is a human gene contained in the human genome.

VGAM809 gene encodes a VGAM809 precursor RNA, herein designated VGAM PRECURSOR RNA. Similar to other miRNA genes, and unlike most ordinary genes, VGAM809 precursor RNA does not encode a protein. A nucleotide sequence identical or highly similar to the nucleotide sequence of VGAM809 precursor RNA is designated SEQ ID:795, and is provided hereinbelow with reference to the sequence listing part. Nucleotide sequence SEQ ID:795 is located at position 60052 relative to the genome of Equine Herpesvirus 2.

VGAM809 precursor RNA folds onto itself, forming VGAM809 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM809 folded precursor RNA into VGAM809 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM809 RNA is designated SEQ ID:3520, and is provided hereinbelow with reference to the sequence listing part.

VGAM809 host target gene, herein designated VGAM HOST TARGET GENE, encodes a corresponding messenger RNA, VGAM809 host target RNA, herein designated VGAM HOST TARGET RNA. VGAM809 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM809 RNA, herein designated VGAM RNA, binds complementarily to one or more host target binding sites located in untranslated regions of VGAM809 host target RNA, herein designated VGAM HOST TARGET RNA. This complementary binding is due to the fact that the nucleotide sequence of VGAM809 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM809 RNA, herein designated VGAM RNA, may have a different number of host target binding sites in untranslated regions of a VGAM809 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM809 RNA, herein designated VGAM RNA, to host target binding sites on VGAM809 host target RNA, herein designated VGAM HOST TARGET RNA, such as BINDING SITE I, BINDING SITE II and BINDING SITE III, inhibits translation of VGAM809 host target RNA into VGAM809 host target protein, herein designated VGAM HOST TARGET PROTEIN. VGAM host target protein is therefore outlined by a broken line.

It is appreciated that VGAM809 host target gene, herein designated VGAM HOST TARGET GENE, in fact represents a plurality of VGAM809 host target genes. The mRNA of each one of this plurality of VGAM809 host target genes comprises one or more host target binding sites, each having a nucleotide sequence which is at least partly complementary to VGAM809 RNA, herein designated VGAM RNA, and which when bound by VGAM809 RNA causes inhibition of translation of respective one or more VGAM809 host target proteins.

It is further appreciated by one skilled in the art that the mode of translational inhibition illustrated by FIG. 1 with specific reference to translational inhibition exerted by VGAM809 gene, herein designated VGAM GENE, on one or more VGAM809 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM809 is inhibition of expression of host target genes, as part of a novel viral mechanism of attacking a host. Accordingly, utilities of VGAM809 include diagnosis, prevention and treatment of viral infection by Equine Herpesvirus 2. Specific functions, and accordingly utilities, of VGAM809 correlate with, and may be deduced from, the identity of the host target genes which VGAM809 binds and inhibits, and the function of these host target genes, as elaborated hereinbelow.

Nucleotide sequences of the VGAM809 precursor RNA, herein designated VGAM PRECURSOR RNA, and of the 'diced' VGAM809 RNA, herein designated VGAM RNA, and a schematic representation of the secondary folding of VGAM809 folded precursor RNA, herein designated VGAM FOLDED PRECURSOR RNA, of VGAM809 are further described hereinbelow with reference to Table 1.

Nucleotide sequences of host target binding sites, such as BINDING SITE-I, BINDING SITE-II and BINDING SITE-III of FIG. 1, found on VGAM809 host target RNA, and schematic representation of the complementarity of each of these host target binding sites to VGAM809 RNA, herein designated VGAM RNA, are described hereinbelow with reference to Table 2.

As mentioned hereinabove with reference to FIG. 1, a function of VGAM809 gene, herein designated VGAM is inhibition of expression of VGAM809 target genes. It is appreciated that specific functions, and accordingly utilities, of VGAM809 correlate with, and may be deduced from, the identity of the target genes which VGAM809 binds and inhibits, and the function of these target genes, as elaborated hereinbelow.

A Disintegrin-like and Metalloprotease (reprolysin type) with Thrombospondin Type 1 Motif, 4 (ADAMTS4, Accession NM_005099) is a VGAM809 host target gene. ADAMTS4 BINDING SITE is HOST TARGET binding site found in the 5' untranslated region of mRNA encoded by ADAMTS4, corresponding to a HOST TARGET binding site such as BINDING SITE I, BINDING SITE II or BINDING SITE III. Table 2 illustrates the complementarity of the nucleotide sequences of ADAMTS4 BINDING SITE, designated SEQ ID:11566, to the nucleotide sequence of VGAM809 RNA, herein designated VGAM RNA, also designated SEQ ID:3520.

A function of VGAM809 is therefore inhibition of A Disintegrin-like and Metalloprotease (reprolysin type) with Thrombospondin Type 1 Motif, 4 (ADAMTS4, Accession NM_005099), a gene which cleaves aggrecan, a cartilage proteoglycan, and may be involved in its turnover. Accordingly, utilities of VGAM809 include diagnosis, prevention and treatment of diseases and clinical conditions associated with ADAMTS4. The function of ADAMTS4 has been established by previous studies. Aggrecan degradation is an important factor in the erosion of articular cartilage in arthritic diseases. This degradation involves proteolysis of the aggrecan core protein near the N terminus, where 2 major cleavage sites have been identified. Matrix metalloproteinases (MMPs) cleave aggrecan between asn341 and phe342. Aggrecanase cleaves aggrecan between glu373 and ala374. Tortorella et al. (1999) purified and partially sequenced bovine aggrecanase-1. By PCR with primers designed from a highly homologous murine EST, they cloned sequences from the homologous human cDNA. They assembled a full-length open reading frame from this initial human PCR product and from another human EST. The human aggrecanase-1 (ADAMTS4) open reading frame encodes an 837-amino acid protein with a signal sequence, a propeptide domain, a catalytic domain, a disintegrin-like domain, and a C-terminal domain with a thrombospondin (TSP) type 1 motif. There is a conserved zinc-binding domain and a furin-sensitive sequence. The presence of a probable cysteine switch sequence in aggrecanase-1 suggested that, like the MMPs, it is synthesized as a zymogen and is cleaved to remove the propeptide domain and generate the mature active enzyme. A cloned portion of the bovine aggrecanase-1 cDNA was 94% homologous to the human cDNA. Human aggrecanase-1 cleaved bovine aggrecan between the glu373-ala374, but not the asn341-phe342, bond. Tortorella et al. (1999) stated that ADAMTS4 mRNA is present in brain, lung, and heart, and at very low levels in placenta and muscle tissues. By RT-PCR, Tortorella et al. (1999) observed upregulation of the aggrecanase-1 message in stimulated human fetal chondrocytes and in joint tissues from adjuvant arthritic rats. Using a GeneBridge 4 radiation hybrid panel, Ishikawa et al. (1998) mapped the ADAMTS4 gene to chromosome 1. Hurskainen et al. (1999) mapped the human ADAMTS4 gene to chromosome 1 by somatic cell hybrid analysis. They mapped the mouse Adamts4 gene to chromosome 1.

Full details of the abovementioned studies are described in the following publications, the disclosure of which are hereby incorporated by reference:

Tortorella, M. D.; Burn, T. C.; Pratta, M. A.; Abbaszade, I.; Hollis, J. M.; Liu, R.; Rosenfeld, S. A.; Copeland, R. A.; Decicco, C. P.; Wynn, R.; Rockwell, A.; Yang, F.; and 16 others. Purification and cloning of aggrecanase-1: a member of the ADAMTS family of proteins. Science 284:1664-1666, 1999; and Hurskainen, T. L.; Hirohata, S.; Seldin, M. F.; Apte, S. S.: ADAM-TS5, ADAM-TS6, and ADAM-TS7, novel members of a new family of zinc metalloproteases: general features and genomic dist.

Further studies establishing the function and utilities of ADAMTS4 are found in John Hopkins OMIM database record ID 603876, and in sited publications numbered 760 and 8473-7606 listed in the bibliography section hereinbelow, which are also hereby incorporated by reference. Ankyrin 1, Erythrocytic (ANK1, Accession XM_016774) is another VGAM809 host target gene. ANK1 BINDING SITE is HOST TARGET binding site found in the 3' untranslated region of mRNA encoded by ANK1, corresponding to a HOST TARGET binding site such as BINDING SITE I, BINDING SITE II or BINDING SITE III. Table 2 illustrates the complementarity of the nucleotide sequences of ANK1 BINDING SITE, designated SEQ ID:30283, to the nucleotide sequence of VGAM809 RNA, herein designated VGAM RNA, also designated SEQ ID:3520.

Another function of VGAM809 is therefore inhibition of Ankyrin 1, Erythrocytic (ANK1, Accession XM_016774). Accordingly, utilities of VGAM809 include diagnosis, prevention and treatment of diseases and clinical conditions associated with ANK1. Methyl-CpG Binding Domain Protein 3 (MBD3, Accession NM_003926) is another VGAM809 host target gene. MBD3 BINDING SITE is HOST TARGET binding site found in the 3' untranslated region of mRNA encoded by MBD3, corresponding to a HOST TARGET binding site such as BINDING SITE I, BINDING SITE II or BINDING SITE III. Table 2 illustrates the complementarity of the nucleotide sequences of MBD3 BINDING SITE, designated SEQ ID:10021, to the nucleotide sequence of VGAM809 RNA, herein designated VGAM RNA, also designated SEQ ID:3520.

Another function of VGAM809 is therefore inhibition of Methyl-CpG Binding Domain Protein 3 (MBD3, Accession NM_003926), a gene which are subunits of the NURD (nucleosome remodeling and histone deacetylase) complex. Accordingly, utilities of VGAM809 include diagnosis, prevention and treatment of diseases and clinical conditions associated with MBD3. The function of MBD3 and its association with various diseases and clinical conditions, has been established by previous studies, as described hereinabove with reference to VGAM247. Spleen Focus Forming Virus (SFFV) Proviral Integration Oncogene Spi1 (SPI1, Accession NM_003120) is another VGAM809 host target gene. SPI1 BINDING SITE is HOST TARGET binding site found in the 5' untranslated region of mRNA encoded by SPI1, corresponding to a HOST TARGET binding site such as BINDING SITE I, BINDING SITE II or BINDING SITE III. Table 2 illustrates the complementarity of the nucleotide sequences of SPI1 BINDING SITE, designated SEQ ID:9091, to the nucleotide sequence of VGAM809 RNA, herein designated VGAM RNA, also designated SEQ ID:3520.

Another function of VGAM809 is therefore inhibition of Spleen Focus Forming Virus (SFFV) Proviral Integration Oncogene Spi1 (SPI1, Accession NM_003120), a gene which act as a lymphoid-specific enhancer. Accordingly, utilities of VGAM809 include diagnosis, prevention and treatment of diseases and clinical conditions associated with SPI1. The function of SPI1 has been established by previous studies. DeKoter and Singh (2000) used retroviral transduction of PU.1 cDNA into mutant hematopoietic progenitors to demonstrate that differing concentrations of the protein regulate the development of B lymphocytes as compared with macrophages. A low concentration of PU.1 protein induces the B cell fate, whereas a high concentration promotes macrophage differentiation and blocks B cell development. Conversely, a transcriptionally weakened mutant protein preferentially induces B cell generation. DeKoter and Singh (2000) concluded that graded expression of a transcription factor can be used to specify distinct cell fates in the hematopoietic system. DeKoter et al. (2002) showed that hemopoietic progenitor cells lacking PU.1 failed to express interleukin-7 receptor-alpha (IL7R; 146661) transcripts. Promoter and crosslinking analyses suggested that PU.1 directly regulates IL7R transcription. Expression of IL7R in PU.1 -/- progenitors restored IL7 (OMIM Ref. No. 146660)-dependent proliferation and induced, at low frequency, the generation of pro-B cells that underwent an apparently normal differentiation program. SPIB (OMIM Ref. No. 606802) could substitute for PU.1 early in B-cell development, but it was not required. DeKoter et al. (2002) concluded that PU.1 partially controls early B-cell development by regulating the expression of IL7R.

Full details of the abovementioned studies are described in the following publications, the disclosure of which are hereby incorporated by reference:

DeKoter, R. P.; Singh, H.: Regulation of B lymphocyte and macrophage development by graded expression of PU.1. Science 288:1439-1441, 2000; and DeKoter, R. P.; Lee, H.-J.; Singh, H.: PU.1 regulates expression of the interleukin-7 receptor in lymphoid progenitors. Immunity 16:297-309, 2002.

Further studies establishing the function and utilities of SPI1 are found in John Hopkins OMIM database record ID 165170, and in sited publications numbered 5127-513 and 2385 listed in the bibliography section hereinbelow, which are also hereby incorporated by reference. FLJ13841 (Accession NM_024702) is another VGAM809 host target gene. FLJ13841 BINDING SITE is HOST TARGET binding site found in the 5' untranslated region of mRNA encoded by FLJ13841, corresponding to a HOST TARGET binding site such as BINDING SITE I, BINDING SITE II or BINDING SITE III. Table 2 illustrates the complementarity of the nucleotide sequences of FLJ13841 BINDING SITE, designated SEQ ID:24016, to the nucleotide sequence of VGAM809 RNA, herein designated VGAM RNA, also designated SEQ ID:3520.

Another function of VGAM809 is therefore inhibition of FLJ13841 (Accession NM_024702). Accordingly, utilities of VGAM809 include diagnosis, prevention and treatment of diseases and clinical conditions associated with FLJ13841. FLJ20200 (Accession NM_017708) is another VGAM809 host target gene. FLJ20200 BINDING SITE is HOST TARGET binding site found in the 5' untranslated region of mRNA encoded by FLJ20200, corresponding to a HOST TARGET binding site such as BINDING SITE I, BINDING SITE II or BINDING SITE III. Table 2 illustrates the complementarity of the nucleotide sequences of FLJ20200 BINDING SITE, designated SEQ ID:19287, to the nucleotide sequence of VGAM809 RNA, herein designated VGAM RNA, also designated SEQ ID:3520.

Another function of VGAM809 is therefore inhibition of FLJ20200 (Accession NM_017708). Accordingly, utilities of VGAM809 include diagnosis, prevention and treatment of diseases and clinical conditions associated with FLJ20200. GMPPB (Accession NM_021971) is another VGAM809 host target gene. GMPPB BINDING SITE1 and GMPPB BINDING SITE2 are HOST TARGET binding sites found in untranslated regions of mRNA encoded by GMPPB, corresponding to HOST TARGET binding sites such as BINDING SITE I, BINDING SITE II or BINDING SITE III. Table 2 illustrates the complementarity of the nucleotide sequences of GMPPB BINDING SITE1 and GMPPB BINDING SITE2, designated SEQ ID:22499 and SEQ ID:14981 respectively, to the nucleotide sequence of VGAM809 RNA, herein designated VGAM RNA, also designated SEQ ID:3520.

Another function of VGAM809 is therefore inhibition of GMPPB (Accession NM_021971). Accordingly, utilities of VGAM809 include diagnosis, prevention and treatment of diseases and clinical conditions associated with GMPPB. Protein Phosphatase 1, Regulatory (inhibitor) Subunit 3B (PPP1R3B, Accession NM_024607) is another VGAM809 host target gene. PPP1R3B BINDING SITE is HOST TARGET binding site found in the 3' untranslated region of mRNA encoded by PPP1R3B, corresponding to a HOST TARGET binding site such as BINDING SITE I, BINDING SITE II or BINDING SITE III. Table 2 illustrates the complementarity of the nucleotide sequences of PPP1R3B BINDING SITE, designated SEQ ID:23859, to the nucleotide sequence of VGAM809 RNA, herein designated VGAM RNA, also designated SEQ ID:3520.

Another function of VGAM809 is therefore inhibition of Protein Phosphatase 1, Regulatory (inhibitor) Subunit 3B (PPP1R3B, Accession NM_024607). Accordingly, utilities of VGAM809 include diagnosis, prevention and treatment of diseases and clinical conditions associated with PPP1R3B. RBT1 (Accession NM_013368) is another VGAM809 host target gene. RBT1 BINDING SITE is HOST TARGET binding site found in the 3' untranslated region of mRNA encoded by RBT1, corresponding to a HOST TARGET binding site such as BINDING SITE I, BINDING SITE II or BINDING SITE III. Table 2 illustrates the complementarity of the nucleotide sequences of RBT1 BINDING SITE, designated SEQ ID:15012, to the nucleotide sequence of VGAM809 RNA, herein designated VGAM RNA, also designated SEQ ID:3520.

Another function of VGAM809 is therefore inhibition of RBT1 (Accession NM_013368). Accordingly, utilities of VGAM809 include diagnosis, prevention and treatment of diseases and clinical conditions associated with RBT1. Three Prime Repair Exonuclease 1 (TREX1, Accession NM_033627) is another VGAM809 host target gene. TREX1 BINDING SITE1 and TREX1 BINDING SITE2 are HOST TARGET binding sites found in untranslated regions of mRNA encoded by TREX1, corresponding to HOST TARGET binding sites such as BINDING SITE I, BINDING SITE II or BINDING SITE III. Table 2 illustrates the complementarity of the nucleotide sequences of TREX1 BINDING SITE1 and TREX1 BINDING SITE2, designated SEQ ID:27335 and SEQ ID:27344 respectively, to the nucleotide sequence of VGAM809 RNA, herein designated VGAM RNA, also designated SEQ ID:3520.

Another function of VGAM809 is therefore inhibition of Three Prime Repair Exonuclease 1 (TREX1, Accession NM_033627). Accordingly, utilities of VGAM809 include diagnosis, prevention and treatment of diseases and clinical conditions associated with TREX1. LOC124446 (Accession XM_058805) is another VGAM809 host target gene. LOC124446 BINDING SITE is HOST TARGET binding site found in the 5' untranslated region of mRNA encoded by LOC124446, corresponding to a HOST TARGET binding site such as BINDING SITE I, BINDING SITE II or BINDING SITE III. Table 2 illustrates the complementarity of the nucleotide sequences of LOC124446 BINDING SITE, designated SEQ ID:36749, to the nucleotide sequence of VGAM809 RNA, herein designated VGAM RNA, also designated SEQ ID:3520.

Another function of VGAM809 is therefore inhibition of LOC124446 (Accession XM_058805). Accordingly, utilities of VGAM809 include diagnosis, prevention and treatment of diseases and clinical conditions associated with LOC124446. LOC165229 (Accession XM_092464) is another VGAM809 host target gene. LOC165229 BINDING SITE is HOST TARGET binding site found in the 5' untranslated region of mRNA encoded by LOC165229, corresponding to a HOST TARGET binding site such as BINDING SITE I, BINDING SITE II or BINDING SITE III. Table 2 illustrates the complementarity of the nucleotide sequences of LOC165229 BINDING SITE, designated SEQ ID:40123, to the nucleotide sequence of VGAM809 RNA, herein designated VGAM RNA, also designated SEQ ID:3520.

Another function of VGAM809 is therefore inhibition of LOC165229 (Accession XM_092464). Accordingly, utilities of VGAM809 include diagnosis, prevention and treatment of diseases and clinical conditions associated with LOC165229. LOC165288 (Accession XM_092498) is another VGAM809 host target gene. LOC165288 BINDING SITE is HOST TARGET binding site found in the 5' untranslated region of mRNA encoded by LOC165288, corresponding to a HOST TARGET binding site such as BINDING SITE I, BINDING SITE II or BINDING SITE III. Table 2 illustrates the complementarity of the nucleotide sequences of LOC165288 BINDING SITE, designated SEQ ID:40129, to the nucleotide sequence of VGAM809 RNA, herein designated VGAM RNA, also designated SEQ ID:3520.

Another function of VGAM809 is therefore inhibition of LOC165288 (Accession XM_092498). Accordingly, utilities of VGAM809 include diagnosis, prevention and treatment of diseases and clinical conditions associated with LOC165288. LOC203871 (Accession XM_115029) is another VGAM809 host target gene. LOC203871 BINDING SITE is HOST TARGET binding site found in the 5' untranslated region of mRNA encoded by LOC203871, corresponding to a HOST TARGET binding site such as BINDING SITE I, BINDING SITE II or BINDING SITE III. Table 2 illustrates the complementarity of the nucleotide sequences of LOC203871 BINDING SITE, designated SEQ ID:43079, to the nucleotide sequence of VGAM809 RNA, herein designated VGAM RNA, also designated SEQ ID:3520.

Another function of VGAM809 is therefore inhibition of LOC203871 (Accession XM_115029). Accordingly, utilities of VGAM809 include diagnosis, prevention and treatment of diseases and clinical conditions associated with LOC203871. LOC253128 (Accession XM_170726) is another VGAM809 host target gene. LOC253128 BINDING SITE is HOST TARGET binding site found in the 5' untranslated region of mRNA encoded by LOC253128, corresponding to a HOST TARGET binding site such as BINDING SITE I, BINDING SITE II or BINDING SITE III. Table 2 illustrates the complementarity of the nucleotide sequences of LOC253128 BINDING SITE, designated SEQ ID:45486, to the nucleotide sequence of VGAM809 RNA, herein designated VGAM RNA, also designated SEQ ID:3520.

Another function of VGAM809 is therefore inhibition of LOC253128 (Accession XM_170726). Accordingly, utilities of VGAM809 include diagnosis, prevention and treatment of diseases and clinical conditions associated with LOC253128. LOC255714 (Accession XM_172861) is another VGAM809 host target gene. LOC255714 BINDING SITE is HOST TARGET binding site found in the 5' untranslated region of mRNA encoded by LOC255714, corresponding to a HOST TARGET binding site such as BINDING SITE I, BINDING SITE II or BINDING SITE III. Table 2 illustrates the complementarity of the nucleotide sequences of LOC255714 BINDING SITE, designated SEQ ID:46140, to the nucleotide sequence of VGAM809 RNA, herein designated VGAM RNA, also designated SEQ ID:3520.

Another function of VGAM809 is therefore inhibition of LOC255714 (Accession XM_172861). Accordingly, utilities of VGAM809 include diagnosis, prevention and treatment of diseases and clinical conditions associated with LOC255714. LOC51308 (Accession NM_016606) is another VGAM809 host target gene. LOC51308 BINDING SITE is HOST TARGET binding site found in the 3' untranslated region of mRNA encoded by LOC51308, corresponding to a HOST TARGET binding site such as BINDING SITE I, BINDING SITE II or BINDING SITE III. Table 2 illustrates the complementarity of the nucleotide sequences of LOC51308 BINDING SITE, designated SEQ ID:18708, to the nucleotide sequence of VGAM809 RNA, herein designated VGAM RNA, also designated SEQ ID:3520.

Another function of VGAM809 is therefore inhibition of LOC51308 (Accession NM_016606). Accordingly, utilities of VGAM809 include diagnosis, prevention and treatment of diseases and clinical conditions associated with LOC51308. LOC90170 (Accession XM_029589) is another VGAM809 host target gene. LOC90170 BINDING SITE is HOST TARGET binding site found in the 5' untranslated region of mRNA encoded by LOC90170, corresponding to a HOST TARGET binding site such as BINDING SITE I, BINDING SITE II or BINDING SITE III. Table 2 illustrates the complementarity of the nucleotide sequences of LOC90170 BINDING SITE, designated SEQ ID:30910, to the nucleotide sequence of VGAM809 RNA, herein designated VGAM RNA, also designated SEQ ID:3520.

Another function of VGAM809 is therefore inhibition of LOC90170 (Accession XM_029589). Accordingly, utilities of VGAM809 include diagnosis, prevention and treatment of diseases and clinical conditions associated with LOC90170. FIG. 1 further provides a conceptual description of a novel bioinformatically detected viral gene of the present invention, referred to here as Viral Genomic Address Messenger 810 (VGAM810) viral gene, which modulates expression of respective host target genes thereof, the function and utility of which host target genes is known in the art.

VGAM810 is a novel bioinformatically detected regulatory, non protein coding, viral micro RNA (miRNA) gene. The method by which VGAM810 was detected is described hereinabove with reference to FIGS. 1-8.

VGAM810 gene, herein designated VGAM GENE, is a viral gene contained in the genome of Amsacta Moorei Entomopoxvirus. VGAM810 host target gene, herein designated VGAM HOST TARGET GENE, is a human gene contained in the human genome.

VGAM810 gene encodes a VGAM810 precursor RNA, herein designated VGAM PRECURSOR RNA. Similar to other miRNA genes, and unlike most ordinary genes, VGAM810 precursor RNA does not encode a protein. A nucleotide sequence identical or highly similar to the nucleotide sequence of VGAM810 precursor RNA is designated SEQ ID:796, and is provided hereinbelow with reference to the sequence listing part. Nucleotide sequence SEQ ID:796 is located at position 84714 relative to the genome of Amsacta Moorei Entomopoxvirus.

VGAM810 precursor RNA folds onto itself, forming VGAM810 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM810 folded precursor RNA into VGAM810 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 51%) nucleotide sequence of VGAM810 RNA is designated SEQ ID:3521, and is provided hereinbelow with reference to the sequence listing part.

VGAM810 host target gene, herein designated VGAM HOST TARGET GENE, encodes a corresponding messenger RNA, VGAM810 host target RNA, herein designated VGAM HOST TARGET RNA. VGAM810 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM810 RNA, herein designated VGAM RNA, binds complementarily to one or more host target binding sites located in untranslated regions of VGAM810 host target RNA, herein designated VGAM HOST TARGET RNA. This complementary binding is due to the fact that the nucleotide sequence of VGAM810 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM810 RNA, herein designated VGAM RNA, may have a different number of host target binding sites in untranslated regions of a VGAM810 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM810 RNA, herein designated VGAM RNA, to host target binding sites on VGAM810 host target RNA, herein designated VGAM HOST TARGET RNA, such as BINDING SITE I, BINDING SITE II and BINDING SITE III, inhibits translation of VGAM810 host target RNA into VGAM810 host target protein, herein designated VGAM HOST TARGET PROTEIN. VGAM host target protein is therefore outlined by a broken line.

It is appreciated that VGAM810 host target gene, herein designated VGAM HOST TARGET GENE, in fact represents a plurality of VGAM810 host target genes. The mRNA of each one of this plurality of VGAM810 host target genes comprises one or more host target binding sites, each having a nucleotide sequence which is at least partly complementary to VGAM810 RNA, herein designated VGAM RNA, and which when bound by VGAM810 RNA causes inhibition of translation of respective one or more VGAM810 host target proteins.

It is further appreciated by one skilled in the art that the mode of translational inhibition illustrated by FIG. 1 with specific reference to translational inhibition exerted by VGAM810 gene, herein designated VGAM GENE, on one or more VGAM810 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM810 is inhibition of expression of host target genes, as part of a novel viral mechanism of attacking a host. Accordingly, utilities of VGAM810 include diagnosis, prevention and treatment of viral infection by Amsacta Moorei Entomopoxvirus. Specific functions, and accordingly utilities, of VGAM810 correlate with, and may be deduced from, the identity of the host target genes which VGAM810 binds and inhibits, and the function of these host target genes, as elaborated hereinbelow.

Nucleotide sequences of the VGAM810 precursor RNA, herein designated VGAM PRECURSOR RNA, and of the 'diced' VGAM810 RNA, herein designated VGAM RNA, and a schematic representation of the secondary folding of VGAM810 folded precursor RNA, herein designated VGAM FOLDED PRECURSOR RNA, of VGAM810 are further described hereinbelow with reference to Table 1.

Nucleotide sequences of host target binding sites, such as BINDING SITE-I, BINDING SITE-II and BINDING SITE-III of FIG. 1, found on VGAM810 host target RNA, and schematic representation of the complementarity of each of these host target binding sites to VGAM810 RNA, herein designated VGAM RNA, are described hereinbelow with reference to Table 2.

As mentioned hereinabove with reference to FIG. 1, a function of VGAM810 gene, herein designated VGAM is inhibition of expression of VGAM810 target genes. It is appreciated that specific functions, and accordingly utilities, of VGAM810 correlate with, and may be deduced from, the identity of the target genes which VGAM810 binds and inhibits, and the function of these target genes, as elaborated hereinbelow.

Aquaporin 9 (AQP9, Accession NM_020980) is a VGAM810 host target gene. AQP9 BINDING SITE is HOST TARGET binding site found in the 3' untranslated region of mRNA encoded by AQP9, corresponding to a HOST TARGET binding site such as BINDING SITE I, BINDING SITE II or BINDING SITE III. Table 2 illustrates the complementarity of the nucleotide sequences of AQP9 BINDING SITE, designated SEQ ID:21969, to the nucleotide sequence of VGAM810 RNA, herein designated VGAM RNA, also designated SEQ ID:3521.

A function of VGAM810 is therefore inhibition of Aquaporin 9 (AQP9, Accession NM_020980). Accordingly, utilities of VGAM810 include diagnosis, prevention and treatment of diseases and clinical conditions associated with AQP9. CED-6 (Accession NM_016315) is another VGAM810 host target gene. CED-6 BINDING SITE is HOST TARGET binding site found in the 3' untranslated region of mRNA encoded by CED-6, corresponding to a HOST TARGET binding site such as BINDING SITE I, BINDING SITE II or BINDING SITE III. Table 2 illustrates the complementarity of the nucleotide sequences of CED-6 BINDING SITE, designated SEQ ID:18430, to the nucleotide sequence of VGAM810 RNA, herein designated VGAM RNA, also designated SEQ ID:3521.

Another function of VGAM810 is therefore inhibition of CED-6 (Accession NM_016315). Accordingly, utilities of VGAM810 include diagnosis, prevention and treatment of diseases and clinical conditions associated with CED-6. EPLIN (Accession NM_016357) is another VGAM810 host target gene. EPLIN BINDING SITE is HOST TARGET binding site found in the 3" untranslated region of mRNA encoded by EPLIN, corresponding to a HOST TARGET binding site such as BINDING SITE I, BINDING SITE II or BINDING SITE III. Table 2 illustrates the complementarity of the nucleotide sequences of EPLIN BINDING SITE, designated SEQ ID:18496, to the nucleotide sequence of VGAM810 RNA, herein designated VGAM RNA, also designated SEQ ID:3521.

Another function of VGAM810 is therefore inhibition of EPLIN (Accession NM_016357). Accordingly, utilities of VGAM810 include diagnosis, prevention and treatment of diseases and clinical conditions associated with EPLIN. FLJ11827 (Accession NM_025093) is another VGAM810 host target gene. FLJ11827 BINDING SITE is HOST TARGET binding site found in the 3" untranslated region of mRNA encoded by FLJ11827, corresponding to a HOST TARGET binding site such as BINDING SITE I, BINDING SITE II or BINDING SITE III. Table 2 illustrates the complementarity of the nucleotide sequences of FLJ11827 BINDING SITE, designated SEQ ID:24725, to the nucleotide sequence of VGAM810 RNA, herein designated VGAM RNA, also designated SEQ ID:3521.

Another function of VGAM810 is therefore inhibition of FLJ11827 (Accession NM_025093). Accordingly, utilities of VGAM810 include diagnosis, prevention and treatment of diseases and clinical conditions associated with FLJ11827. KIAA0820 (Accession XM_044463) is another VGAM810 host target gene. KIAA0820 BINDING SITE is HOST TARGET binding site found in the 3' untranslated region of mRNA encoded by KIAA0820, corresponding to a HOST TARGET binding site such as BINDING SITE I, BINDING SITE II or BINDING SITE III. Table 2 illustrates the complementarity of the nucleotide sequences of KIAA0820 BINDING SITE, designated SEQ ID:34220, to the nucleotide sequence of VGAM810 RNA, herein designated VGAM RNA, also designated SEQ ID:3521.

Another function of VGAM810 is therefore inhibition of KIAA0820 (Accession XM_044463). Accordingly, utilities of VGAM810 include diagnosis, prevention and treatment of diseases and clinical conditions associated with KIAA0820. LOC116228 (Accession XM_057659) is another VGAM810 host target gene. LOC116228 BINDING SITE is HOST TARGET binding site found in the 3' untranslated region of mRNA encoded by LOC116228, corresponding to a HOST TARGET binding site such as BINDING SITE I, BINDING SITE II or BINDING SITE III. Table 2 illustrates the complementarity of the nucleotide sequences of LOC116228 BINDING SITE, designated SEQ ID:36532, to the nucleotide sequence of VGAM810 RNA, herein designated VGAM RNA, also designated SEQ ID:3521.

Another function of VGAM810 is therefore inhibition of LOC116228 (Accession XM_057659). Accordingly, utilities of VGAM810 include diagnosis, prevention and treatment of diseases and clinical conditions associated with LOC116228. LOC120856 (Accession XM_058509) is another VGAM810 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36641, to the nucleotide sequence of VGAM810 RNA, herein designated VGAM RNA, also designated SEQ ID:3521.

Another function of VGAM810 is therefore inhibition of LOC120856 (Accession XM_058509). Accordingly, utilities of VGAM810 include diagnosis, prevention and treatment of diseases and clinical conditions associated with LOC120856. LOC149711 (Accession XM_097720) is another VGAM810 host target gene. LOC149711 BINDING SITE is HOST TARGET binding site found in the 3' untranslated region of mRNA encoded by LOC149711, corresponding to a HOST TARGET binding site such as BINDING SITE I, BINDING SITE II or BINDING SITE III. Table 2 illustrates the complementarity of the nucleotide sequences of LOC149711 BINDING SITE, designated SEQ ID:41068, to the nucleotide sequence of VGAM810 RNA, herein designated VGAM RNA, also designated SEQ ID:3521.

Another function of VGAM810 is therefore inhibition of LOC149711 (Accession XM_097720). Accordingly, utilities of VGAM810 include diagnosis, prevention and treatment of diseases and clinical conditions associated with LOC149711. LOC163782 (Accession XM_089138) is another VGAM810 host target gene. LOC163782 BINDING SITE is HOST TARGET binding site found in the 5' untranslated region of mRNA encoded by LOC163782, corresponding to a HOST TARGET binding site such as BINDING SITE I, BINDING SITE II or BINDING SITE III. Table 2 illustrates the complementarity of the nucleotide sequences of LOC163782 BINDING SITE, designated SEQ ID:39964, to the nucleotide sequence of VGAM810 RNA, herein designated VGAM RNA, also designated SEQ ID:3521.

Another function of VGAM810 is therefore inhibition of LOC163782 (Accession XM_089138). Accordingly, utilities of VGAM810 include diagnosis, prevention and treatment of diseases and clinical conditions associated with LOC163782. LOC199675 (Accession XM_113982) is another VGAM810 host target gene. LOC199675 BINDING SITE is HOST TARGET binding site found in the 3' untranslated region of mRNA encoded by LOC199675, corresponding to a HOST TARGET binding site such as BINDING SITE I, BINDING SITE II or BINDING SITE III. Table 2 illustrates the complementarity of the nucleotide sequences of LOC199675 BINDING SITE, designated SEQ ID:42586, to the nucleotide sequence of VGAM810 RNA, herein designated VGAM RNA, also designated SEQ ID:3521.

Another function of VGAM810 is therefore inhibition of LOC199675 (Accession XM_113982). Accordingly, utilities of VGAM810 include diagnosis, prevention and treatment of diseases and clinical conditions associated with LOC199675. LOC253613 (Accession XM_171225) is another VGAM810 host target gene. LOC253613 BINDING SITE is HOST TARGET binding site found in the 3' untranslated region of mRNA encoded by LOC253613, corresponding to a HOST TARGET binding site such as BINDING SITE I, BINDING SITE II or BINDING SITE III. Table 2 illustrates the complementarity of the nucleotide sequences of LOC253613 BINDING SITE, designated SEQ ID:46012, to the nucleotide sequence of VGAM810 RNA, herein designated VGAM RNA, also designated SEQ ID:3521.

Another function of VGAM810 is therefore inhibition of LOC253613 (Accession XM_171225). Accordingly, utilities of VGAM810 include diagnosis, prevention and treatment of diseases and clinical conditions associated with LOC253613. FIG. 1 further provides a conceptual description of a novel bioinformatically detected viral gene of the present invention, referred to here as Viral Genomic Address Messenger 811 (VGAM811) viral gene, which modulates expression of respective host target genes thereof, the function and utility of which host target genes is known in the art.

VGAM811 is a novel bioinformatically detected regulatory, non protein coding, viral micro RNA (miRNA) gene. The method by which VGAM811 was detected is described hereinabove with reference to FIGS. 1-8.

VGAM811 gene, herein designated VGAM GENE, is a viral gene contained in the genome of Melanoplus Sanguinipes Entomopoxvirus. VGAM811 host target gene, herein designated VGAM HOST TARGET GENE, is a human gene contained in the human genome.

VGAM811 gene encodes a VGAM811 precursor RNA, herein designated VGAM PRECURSOR RNA. Similar to other miRNA genes, and unlike most ordinary genes, VGAM811 precursor RNA does not encode a protein. A nucleotide sequence identical or highly similar to the nucleotide sequence of VGAM811 precursor RNA is designated SEQ ID:797, and is provided hereinbelow with reference to the sequence listing part. Nucleotide sequence SEQ ID:797 is located at position 161607 relative to the genome of Melanoplus Sanguinipes Entomopoxvirus.

VGAM811 precursor RNA folds onto itself, forming VGAM811 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM811 folded precursor RNA into VGAM811 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM811 RNA is designated SEQ ID:3522, and is provided hereinbelow with reference to the sequence listing part.

VGAM811 host target gene, herein designated VGAM HOST TARGET GENE, encodes a corresponding messenger RNA, VGAM811 host target RNA, herein designated VGAM HOST TARGET RNA. VGAM811 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM811 RNA, herein designated VGAM RNA, binds complementarily to one or more host target binding sites located in untranslated regions of VGAM811 host target RNA, herein designated VGAM HOST TARGET RNA. This complementary binding is due to the fact that the nucleotide sequence of VGAM811 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM811 RNA, herein designated VGAM RNA, may have a different number of host target binding sites in untranslated regions of a VGAM811 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM811 RNA, herein designated VGAM RNA, to host target binding sites on VGAM811 host target RNA, herein designated VGAM HOST TARGET RNA, such as BINDING SITE I, BINDING SITE II and BINDING SITE III, inhibits translation of VGAM811 host target RNA into VGAM811 host target protein, herein designated VGAM HOST TARGET PROTEIN. VGAM host target protein is therefore outlined by a broken line.

It is appreciated that VGAM811 host target gene, herein designated VGAM HOST TARGET GENE, in fact represents a plurality of VGAM811 host target genes. The mRNA of each one of this plurality of VGAM811 host target genes comprises one or more host target binding sites, each having a nucleotide sequence which is at least partly complementary to VGAM811 RNA, herein designated VGAM RNA, and which when bound by VGAM811 RNA causes inhibition of translation of respective one or more VGAM811 host target proteins.

It is further appreciated by one skilled in the art that the mode of translational inhibition illustrated by FIG. 1 with specific reference to translational inhibition exerted by VGAM811 gene, herein designated VGAM GENE, on one or more VGAM811 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM811 is inhibition of expression of host target genes, as part of a novel viral mechanism of attacking a host. Accordingly, utilities of VGAM811 include diagnosis, prevention and treatment of viral infection by Melanoplus Sanguinipes Entomopoxvirus. Specific functions, and accordingly utilities, of VGAM811 correlate with, and may be deduced from, the identity of the host target genes which VGAM811 binds and inhibits, and the function of these host target genes, as elaborated hereinbelow.

Nucleotide sequences of the VGAM811 precursor RNA, herein designated VGAM PRECURSOR RNA, and of the 'diced' VGAM811 RNA, herein designated VGAM RNA, and a schematic representation of the secondary folding of VGAM811 folded precursor RNA, herein designated VGAM FOLDED PRECURSOR RNA, of VGAM811 are further described hereinbelow with reference to Table 1.

Nucleotide sequences of host target binding sites, such as BINDING SITE-I, BINDING SITE-II and BINDING SITE-III of FIG. 1, found on VGAM811 host target RNA, and schematic representation of the complementarity of each of these host target binding sites to VGAM811 RNA, herein designated VGAM RNA, are described hereinbelow with reference to Table 2.

As mentioned hereinabove with reference to FIG. 1, a function of VGAM811 gene, herein designated VGAM is inhibition of expression of VGAM811 target genes. It is appreciated that specific functions, and accordingly utilities, of VGAM811 correlate with, and may be deduced from, the identity of the target genes which VGAM811 binds and inhibits, and the function of these target genes, as elaborated hereinbelow.

Forkhead Box D2 (FOXD2, Accession NM_004474) is a VGAM811 host target gene. FOXD2 BINDING SITE is HOST TARGET binding site found in the 5' untranslated region of mRNA encoded by FOXD2, corresponding to a HOST TARGET binding site such as BINDING SITE I, BINDING SITE II or BINDING SITE III. Table 2 illustrates the complementarity of the nucleotide sequences of FOXD2 BINDING SITE, designated SEQ ID:10786, to the nucleotide sequence of VGAM811 RNA, herein designated VGAM RNA, also designated SEQ ID:3522.

A function of VGAM811 is therefore inhibition of Forkhead Box D2 (FOXD2, Accession NM_004474). Accordingly, utilities of VGAM811 include diagnosis, prevention and treatment of diseases and clinical conditions associated with FOXD2. Lumican (LUM, Accession NM_002345) is another VGAM811 host target gene. LUM BINDING SITE is HOST TARGET binding site found in the 3' untranslated region of mRNA encoded by LUM, corresponding to a HOST TARGET binding site such as BINDING SITE I, BINDING SITE II or BINDING SITE III. Table 2 illustrates the complementarity of the nucleotide sequences of LUM BINDING SITE, designated SEQ ID:8144, to the nucleotide sequence of VGAM811 RNA, herein designated VGAM RNA, also designated SEQ ID:3522.

Another function of VGAM811 is therefore inhibition of Lumican (LUM, Accession NM_002345). Accordingly, utilities of VGAM811 include diagnosis, prevention and treatment of diseases and clinical conditions associated with LUM. Ubiquitin-conjugating Enzyme E2H (UBC8 homolog, yeast) (UBE2H, Accession NM_003344) is another VGAM811 host target gene. UBE2H BINDING SITE is HOST TARGET binding site found in the 3' untranslated region of mRNA encoded by UBE2H, corresponding to a HOST TARGET binding site such as BINDING SITE I, BINDING SITE II or BINDING SITE III. Table 2 illustrates the complementarity of the nucleotide sequences of UBE2H BINDING SITE, designated SEQ ID:9351, to the nucleotide sequence of VGAM811 RNA, herein designated VGAM RNA, also designated SEQ ID:3522.

Another function of VGAM811 is therefore inhibition of Ubiquitin-conjugating Enzyme E2H (UBC8 homolog, yeast) (UBE2H, Accession NM_003344), a gene which catalyzes the covalent attachment of ubiquitin to other proteins. Accordingly, utilities of VGAM811 include diagnosis, prevention and treatment of diseases and clinical conditions associated with UBE2H. The function of UBE2H has been established by previous studies. Ubiquitin-conjugating enzymes catalyze the covalent attachment of ubiquitin to cellular substrates. Kaiser et al. (1994) isolated a novel ubiquitin-conjugating enzyme from human placenta and cloned the corresponding cDNA. DNA sequencing revealed that this gene, symbolized UBCH2 by them, encodes a protein with significant sequence similarity to yeast UBC8. They discovered that yeast UBC8 is interrupted by a single intron bearing an unusual branch point sequence. The authors noted that yeast UBC8 exhibited 54% amino acid sequence identity to human UBCH2. Moreover, full-length yeast and human enzymes expressed from the cDNAs showed similar enzymatic activities in vitro by catalyzing the ubiquitination of histones, suggesting that the 2 enzymes may fulfill similar functions in vivo. By study of hamster/human hybrid cell DNAs, Kaiser et al. (1994) demonstrated that the human UBC8 gene is located on chromosome 7. Hayashida et al. (2000) constructed a 1-Mb physical and transcript map of 7q32 and mapped UBE2H to a region between D7S530 and D7S649.

Full details of the abovementioned studies are described in the following publications, the disclosure of which are hereby incorporated by reference:

Hayashida, S.; Yamasaki, K.; Asada, Y.; Soeda, E.; Niikawa, N.; Kishino, T.: Construction of a physical and transcript map flanking the imprinted MEST/PEG1 region at 7q32. Genomics 66:221-225, 2000; and Kaiser, P.; Seufert, W.; Hofferer, L.; Kofler, B.; Sachsenmaier, C.; Herzog, H.; Jentsch, S.; Schweiger, M.; Schneider, R.: Human ubiquitin-conjugating enzyme homologous to yeast UBC8.

Further studies establishing the function and utilities of UBE2H are found in John Hopkins OMIM database record ID 601082, and in sited publications numbered 9924 listed in the bibliography section hereinbelow, which are also hereby incorporated by reference. Chromosome 6 Open Reading Frame 37 (C6orf37, Accession XM_041375) is another VGAM811 host target gene. C6orf37 BINDING SITE is HOST TARGET binding site found in the 3' untranslated region of mRNA encoded by C6orf37, corresponding to a HOST TARGET binding site such as BINDING SITE I, BINDING SITE II or BINDING SITE III. Table 2 illustrates the complementarity of the nucleotide sequences of C6orf37 BINDING SITE, designated SEQ ID:33507, to the nucleotide sequence of VGAM811 RNA, herein designated VGAM RNA, also designated SEQ ID:3522.

Another function of VGAM811 is therefore inhibition of Chromosome 6 Open Reading Frame 37 (C6orf37, Accession XM_041375). Accordingly, utilities of VGAM811 include diagnosis, prevention and treatment of diseases and clinical conditions associated with C6orf37. C6orf5 (Accession NM_015524) is another VGAM811 host target gene. C6orf5 BINDING SITE is HOST TARGET binding site found in the 3' untranslated region of mRNA encoded by C6orf5, corresponding to a HOST TARGET binding site such as BINDING SITE I, BINDING SITE II or BINDING SITE III. Table 2 illustrates the complementarity of the nucleotide sequences of C6orf5 BINDING SITE, designated SEQ ID:17778, to the nucleotide sequence of VGAM811 RNA, herein designated VGAM RNA, also designated SEQ ID:3522.

Another function of VGAM811 is therefore inhibition of C6orf5 (Accession NM_015524). Accordingly, utilities of VGAM811 include diagnosis, prevention and treatment of diseases and clinical conditions associated with C6orf5. DREV1 (Accession NM_016025) is another VGAM811 host target gene. DREV1 BINDING SITE is HOST TARGET binding site found in the 3' untranslated region of mRNA encoded by DREV1, corresponding to a HOST TARGET binding site such as BINDING SITE I, BINDING SITE II or BINDING SITE III. Table 2 illustrates the complementarity of the nucleotide sequences of DREV1 BINDING SITE, designated SEQ ID:18105, to the nucleotide sequence of VGAM811 RNA, herein designated VGAM RNA, also designated SEQ ID:3522.

Another function of VGAM811 is therefore inhibition of DREV1 (Accession NM_016025). Accordingly, utilities of VGAM811 include diagnosis, prevention and treatment of diseases and clinical conditions associated with DREV1. FLJ12716 (Accession NM_021942) is another VGAM811 host target gene. FLJ12716 BINDING SITE is HOST TARGET binding site found in the 3' untranslated region of mRNA encoded by FLJ12716, corresponding to a HOST TARGET binding site such as BINDING SITE I, BINDING SITE II or BINDING SITE III. Table 2 illustrates the complementarity of the nucleotide sequences of FLJ12716 BINDING SITE, designated SEQ ID:22457, to the nucleotide sequence of VGAM811 RNA, herein designated VGAM RNA, also designated SEQ ID:3522.

Another function of VGAM811 is therefore inhibition of FLJ12716 (Accession NM_021942). Accordingly, utilities of VGAM811 include diagnosis, prevention and treatment of diseases and clinical conditions associated with FLJ12716. FLJ13920 (Accession NM_024558) is another VGAM811 host target gene. FLJ13920 BINDING SITE is HOST TARGET binding site found in the 3' untranslated region of mRNA encoded by FLJ13920, corresponding to a HOST TARGET binding site such as BINDING SITE I, BINDING SITE II or BINDING SITE III. Table 2 illustrates the complementarity of the nucleotide sequences of FLJ13920 BINDING SITE, designated SEQ ID:23780, to the nucleotide sequence of VGAM811 RNA, herein designated VGAM RNA, also designated SEQ ID:3522.

Another function of VGAM811 is therefore inhibition of FLJ13920 (Accession NM_024558). Accordingly, utilities of VGAM811 include diagnosis, prevention and treatment of diseases and clinical conditions associated with FLJ13920. FLJ23071 (Accession NM_025192) is another VGAM811 host target gene. FLJ23071 BINDING SITE is HOST TARGET binding site found in the 3' untranslated region of mRNA encoded by FLJ23071, corresponding to a HOST TARGET binding site such as BINDING SITE I, BINDING SITE II or BINDING SITE III. Table 2 illustrates the complementarity of the nucleotide sequences of FLJ23071 BINDING SITE, designated SEQ ID:24845, to the nucleotide sequence of VGAM811 RNA, herein designated VGAM RNA, also designated SEQ ID:3522.

Another function of VGAM811 is therefore inhibition of FLJ23071 (Accession NM_025192). Accordingly, utilities of VGAM811 include diagnosis, prevention and treatment of diseases and clinical conditions associated with FLJ23071. FLJ23119 (Accession NM_024652) is another VGAM811 host target gene. FLJ23119 BINDING SITE is HOST TARGET binding site found in the 3' untranslated region of mRNA encoded by FLJ23119, corresponding to a HOST TARGET binding site such as BINDING SITE I, BINDING SITE II or BINDING SITE III. Table 2 illustrates the complementarity of the nucleotide sequences of FLJ23119 BINDING SITE, designated SEQ ID:23948, to the nucleotide sequence of VGAM811 RNA, herein designated VGAM RNA, also designated SEQ ID:3522.

Another function of VGAM811 is therefore inhibition of FLJ23119 (Accession NM_024652). Accordingly, utilities of VGAM811 include diagnosis, prevention and treatment of diseases and clinical conditions associated with FLJ23119. KIAA1500 (Accession XM_034353) is another VGAM811 host target gene. KIAA1500 BINDING SITE is HOST TARGET binding site found in the 3' untranslated region of mRNA encoded by KIAA1500, corresponding to a HOST TARGET binding site such as BINDING SITE I, BINDING SITE II or BINDING SITE III. Table 2 illustrates the complementarity of the nucleotide sequences of KIAA1500 BINDING SITE, designated SEQ ID:32067, to the nucleotide sequence of VGAM811 RNA, herein designated VGAM RNA, also designated SEQ ID:3522.

Another function of VGAM811 is therefore inhibition of KIAA1500 (Accession XM_034353). Accordingly, utilities of VGAM811 include diagnosis, prevention and treatment of diseases and clinical conditions associated with KIAA1500. KIAA1615 (Accession XM_044021) is another VGAM811 host target gene. KIAA1615 BINDING SITE is HOST TARGET binding site found in the 3' untranslated region of mRNA encoded by KIAA1615, corresponding to a HOST TARGET binding site such as BINDING SITE I, BINDING SITE II or BINDING SITE III. Table 2 illustrates the complementarity of the nucleotide sequences of KIAA1615 BINDING SITE, designated SEQ ID:34079, to the nucleotide sequence of VGAM811 RNA, herein designated VGAM RNA, also designated SEQ ID:3522.

Another function of VGAM811 is therefore inhibition of KIAA1615 (Accession XM_044021). Accordingly, utilities of VGAM811 include diagnosis, prevention and treatment of diseases and clinical conditions associated with KIAA1615. SRB7 Suppressor of RNA Polymerase B Homolog (yeast) (SURB7, Accession NM_004264) is another VGAM811 host target gene. SURB7 BINDING SITE is HOST TARGET binding site found in the 3' untranslated region of mRNA encoded by SURB7, corresponding to a HOST TARGET binding site such as BINDING SITE I, BINDING SITE II or BINDING SITE III. Table 2 illustrates the complementarity of the nucleotide sequences of SURB7 BINDING SITE, designated SEQ ID:10464, to the nucleotide sequence of VGAM811 RNA, herein designated VGAM RNA, also designated SEQ ID:3522.

Another function of VGAM811 is therefore inhibition of SRB7 Suppressor of RNA Polymerase B Homolog (yeast) (SURB7, Accession NM_004264). Accordingly, utilities of VGAM811 include diagnosis, prevention and treatment of diseases and clinical conditions associated with SURB7. LOC122792 (Accession NM_145251) is another VGAM811 host target gene. LOC122792 BINDING SITE is HOST TARGET binding site found in the 3' untranslated region of mRNA encoded by LOC122792, corresponding to a HOST TARGET binding site such as BINDING SITE I, BINDING SITE II or BINDING SITE III. Table 2 illustrates the complementarity of the nucleotide sequences of LOC122792 BINDING SITE, designated SEQ ID:29761, to the nucleotide sequence of VGAM811 RNA, herein designated VGAM RNA, also designated SEQ ID:3522.

Another function of VGAM811 is therefore inhibition of LOC122792 (Accession NM_145251). Accordingly, utilities of VGAM811 include diagnosis, prevention and treatment of diseases and clinical conditions associated with LOC122792. LOC127435 (Accession XM_072088) is another VGAM811 host target gene. LOC127435 BINDING SITE is HOST TARGET binding site found in the 3' untranslated region of mRNA encoded by LOC127435, corresponding to a HOST TARGET binding site such as BINDING SITE I, BINDING SITE II or BINDING SITE III. Table 2 illustrates the complementarity of the nucleotide sequences of LOC127435 BINDING SITE, designated SEQ ID:37462, to the nucleotide sequence of VGAM811 RNA, herein designated VGAM RNA, also designated SEQ ID:3522.

Another function of VGAM811 is therefore inhibition of LOC127435 (Accession XM_072088). Accordingly, utilities of VGAM811 include diagnosis, prevention and treatment of diseases and clinical conditions associated with LOC127435. FIG. 1 further provides a conceptual description of a novel bioinformatically detected viral gene of the present invention, referred to here as Viral Genomic Address Messenger 812 (VGAM812) viral gene, which modulates expression of respective host target genes thereof, the function and utility of which host target genes is known in the art.

VGAM812 is a novel bioinformatically detected regulatory, non protein coding, viral micro RNA (miRNA) gene. The method by which VGAM812 was detected is described hereinabove with reference to FIGS. 1-8.

VGAM812 gene, herein designated VGAM GENE, is a viral gene contained in the genome of Murid Herpesvirus 4. VGAM812 host target gene, herein designated VGAM HOST TARGET GENE, is a human gene contained in the human genome.

VGAM812 gene encodes a VGAM812 precursor RNA, herein designated VGAM PRECURSOR RNA. Similar to other miRNA genes, and unlike most ordinary genes, VGAM812 precursor RNA does not encode a protein. A nucleotide sequence identical or highly similar to the nucleotide sequence of VGAM812 precursor RNA is designated SEQ ID:798, and is provided hereinbelow with reference to the sequence listing part. Nucleotide sequence SEQ ID:798 is located at position 60284 relative to the genome of Murid Herpesvirus 4.

VGAM812 precursor RNA folds onto itself, forming VGAM812 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM812 folded precursor RNA into VGAM812 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM812 RNA is designated SEQ ID:3523, and is provided hereinbelow with reference to the sequence listing part.

VGAM812 host target gene, herein designated VGAM HOST TARGET GENE, encodes a corresponding messenger RNA, VGAM812 host target RNA, herein designated VGAM HOST TARGET RNA. VGAM812 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM812 RNA, herein designated VGAM RNA, binds complementarily to one or more host target binding sites located in untranslated regions of VGAM812 host target RNA, herein designated VGAM HOST TARGET RNA. This complementary binding is due to the fact that the nucleotide sequence of VGAM812 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM812 RNA, herein designated VGAM RNA, may have a different number of host target binding sites in untranslated regions of a VGAM812 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM812 RNA, herein designated VGAM RNA, to host target binding sites on VGAM812 host target RNA, herein designated VGAM HOST TARGET RNA, such as BINDING SITE I, BINDING SITE II and BINDING SITE III, inhibits translation of VGAM812 host target RNA into VGAM812 host target protein, herein designated VGAM HOST TARGET PROTEIN. VGAM host target protein is therefore outlined by a broken line.

It is appreciated that VGAM812 host target gene, herein designated VGAM HOST TARGET GENE, in fact represents a plurality of VGAM812 host target genes. The mRNA of each one of this plurality of VGAM812 host target genes comprises one or more host target binding sites, each having a nucleotide sequence which is at least partly complementary to VGAM812 RNA, herein designated VGAM RNA, and which when bound by VGAM812 RNA causes inhibition of translation of respective one or more VGAM812 host target proteins.

It is further appreciated by one skilled in the art that the mode of translational inhibition illustrated by FIG. 1 with specific reference to translational inhibition exerted by VGAM812 gene, herein designated VGAM GENE, on one or more VGAM812 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM812 is inhibition of expression of host target genes, as part of a novel viral mechanism of attacking a host. Accordingly, utilities of VGAM812 include diagnosis, prevention and treatment of viral infection by Murid Herpesvirus 4. Specific functions, and accordingly utilities, of VGAM812 correlate with, and may be deduced from, the identity of the host target genes which VGAM812 binds and inhibits, and the function of these host target genes, as elaborated hereinbelow.

Nucleotide sequences of the VGAM812 precursor RNA, herein designated VGAM PRECURSOR RNA, and of the 'diced' VGAM812 RNA, herein designated VGAM RNA, and a schematic representation of the secondary folding of VGAM812 folded precursor RNA, herein designated VGAM FOLDED PRECURSOR RNA, of VGAM812 are further described hereinbelow with reference to Table 1.

Nucleotide sequences of host target binding sites, such as BINDING SITE-I, BINDING SITE-II and BINDING SITE-III of FIG. 1, found on VGAM812 host target RNA, and schematic representation of the complementarity of each of these host target binding sites to VGAM812 RNA, herein designated VGAM RNA, are described hereinbelow with reference to Table 2.

As mentioned hereinabove with reference to FIG. 1, a function of VGAM812 gene, herein designated VGAM is inhibition of expression of VGAM812 target genes. It is appreciated that specific functions, and accordingly utilities, of VGAM812 correlate with, and may be deduced from, the identity of the target genes which VGAM812 binds and inhibits, and the function of these target genes, as elaborated hereinbelow.

DEAD/H (Asp-Glu-Ala-Asp/His) Box Polypeptide, Y Chromosome (DBY, Accession NM_004660) is a VGAM812 host target gene. DBY BINDING SITE is HOST TARGET binding site found in the 3' untranslated region of mRNA encoded by DBY, corresponding to a HOST TARGET binding site such as BINDING SITE I, BINDING SITE II or BINDING SITE III. Table 2 illustrates the complementarity of the nucleotide sequences of DBY BINDING SITE, designated SEQ ID:11030, to the nucleotide sequence of VGAM812 RNA, herein designated VGAM RNA, also designated SEQ ID:3523.

A function of VGAM812 is therefore inhibition of DEAD/H (Asp-Glu-Ala-Asp/His) Box Polypeptide, Y Chromosome (DBY, Accession NM_004660), a gene which plays a key role in the spermatogenic process. Accordingly, utilities of VGAM812 include diagnosis, prevention and treatment of diseases and clinical conditions associated with DBY. The function of DBY and its association with various diseases and clinical conditions, has been established by previous studies, as described hereinabove with reference to VGAM374. Laminin, Gamma 1 (formerly LAMB2) (LAMC1, Accession NM_002293) is another VGAM812 host target gene. LAMC1 BINDING SITE is HOST TARGET binding site found in the 3' untranslated region of mRNA encoded by LAMC1, corresponding to a HOST TARGET binding site such as BINDING SITE I, BINDING SITE II or BINDING SITE III. Table 2 illustrates the complementarity of the nucleotide sequences of LAMC1 BINDING SITE, designated SEQ ID:8080, to the nucleotide sequence of VGAM812 RNA, herein designated VGAM RNA, also designated SEQ ID:3523.

Another function of VGAM812 is therefore inhibition of Laminin, Gamma 1 (formerly LAMB2) (LAMC1, Accession NM_002293), a gene which may mediate the attachment, migration, and organization of cells into tissues. Accordingly, utilities of VGAM812 include diagnosis, prevention and treatment of diseases and clinical conditions associated with LAMC1. The function of LAMC1 has been established by previous studies. Laminin is a heterotrimeric extracellular matrix protein consisting of 3 chains: alpha (LAMA1; 150320), beta (LAMB1; 150240), and gamma (formerly A, B1, and B2, respectively). Several isoforms of each chain have been identified. Laminin gamma-1 is the most ubiquitously expressed laminin subunit (Burgeson et al., 1994; Miner et al., 1997). In mouse, the laminin subunits alpha-1, beta-1, and gamma-1 are expressed in the preimplantation embryo before the appearance of the first basement membrane of the trophectodermal epithelium. Smyth et al. (1999) targeted the LAMC1 gene by homologous recombination in mouse embryonic stem (ES) cells. Mice heterozygous for the mutation had a normal phenotype and were fertile, whereas homozygous mutant embryos did not survive beyond day 5.5 postcoitum. These embryos lacked basement membranes, and although the blastocysts had expanded, primitive endoderm cells remained in the inner mass, and the parietal yolk sac did not develop. Cultured ES cells appeared normal after targeting both LAMC1 genes, but the embryoid bodies derived from them also lacked basement membranes, having disorganized extracellular deposits of the basement membrane proteins collagen IV and perlecan, and the cells failed to differentiate into stable myotubes. Nomenclature: Burgeson et al. (1994), a group of 14 leading researchers in the field of connective tissue proteins, adopted a new nomenclature for the laminins. They were numbered with arabic numerals in the order discovered. The previous A, B1, and B2 chains, and their isoforms, are alpha, beta, and gamma, respectively, followed by an arabic numeral to identify the isoform. For example, the first laminin identified from the Engelbreth-Holm-Swarm tumor (EHS) was designated laminin-1 with the chain composition alpha-1/beta-1/gamma-1. The genes for these 3 chains are LAMA1, LAMB1 (OMIM Ref. No. 150240), and LAMC1.

Full details of the abovementioned studies are described in the following publications, the disclosure of which are hereby incorporated by reference:

Smyth, N.; Vatansever, H. S.; Murray, P.; Meyer, M.; Frie, C.; Paulsson, M.; Edgar, D.: Absence of basement membranes after targeting the LAMC1 gene results in embryonic lethality due to failure of endoderm differentiation. J. Cell Biol. 144:151-160, 1999; and Burgeson, R. E.; Chiquet, M.; Deutzmann, R.; Ekblom, P.; Engel, J.; Kleinman, H.; Martin, G. R.; Meneguzzi, G.; Paulsson, M.; Sanes, J.; Timpl, R.; Tryggvason, K.; Yamada, Y.; Yurchenco.

Further studies establishing the function and utilities of LAMC1 are found in John Hopkins OMIM database record ID 150290, and in sited publications numbered 11982-306 and 3913-3472 listed in the bibliography section hereinbelow, which are also hereby incorporated by reference. KIAA1941 (Accession XM_059318) is another VGAM812 host target gene. KIAA1941 BINDING SITE is HOST TARGET binding site found in the 3' untranslated region of mRNA encoded by KIAA1941, corresponding to a HOST TARGET binding site such as BINDING SITE I, BINDING SITE II or BINDING SITE III. Table 2 illustrates the complementarity of the nucleotide sequences of KIAA1941 BINDING SITE, designated SEQ ID:36953, to the nucleotide sequence of VGAM812 RNA, herein designated VGAM RNA, also designated SEQ ID:3523.

Another function of VGAM812 is therefore inhibition of KIAA1941 (Accession XM_059318). Accordingly, utilities of VGAM812 include diagnosis, prevention and treatment of diseases and clinical conditions associated with KIAA1941. RAB39, Member RAS Oncogene Family (RAB39, Accession XM_084662) is another VGAM812 host target gene. RAB39 BINDING SITE is HOST TARGET binding site found in the 3' untranslated region of mRNA encoded by RAB39, corresponding to a HOST TARGET binding site such as BINDING SITE I, BINDING SITE II or BINDING SITE III. Table 2 illustrates the complementarity of the nucleotide sequences of RAB39 BINDING SITE, designated SEQ ID:37648, to the nucleotide sequence of VGAM812 RNA, herein designated VGAM RNA, also designated SEQ ID:3523.

Another function of VGAM812 is therefore inhibition of RAB39, Member RAS Oncogene Family (RAB39, Accession XM_084662). Accordingly, utilities of VGAM812 include diagnosis, prevention and treatment of diseases and clinical conditions associated with RAB39. SWI/SNF Related, Matrix Associated, Actin Dependent Regulator of Chromatin, Subfamily F, Member 1 (SMARCF1, Accession NM_006015) is another VGAM812 host target gene. SMARCF1 BINDING SITE1 through SMARCF1 BINDING SITE3 are HOST TARGET binding sites found in untranslated regions of mRNA encoded by SMARCF1, corresponding to HOST TARGET binding sites such as BINDING SITE I, BINDING SITE II or BINDING SITE III. Table 2 illustrates the complementarity of the nucleotide sequences of SMARCF1 BINDING SITE1 through SMARCF1 BINDING SITE3, designated SEQ ID:12627, SEQ ID:20525 and SEQ ID:29165 respectively, to the nucleotide sequence of VGAM812 RNA, herein designated VGAM RNA, also designated SEQ ID:3523.

Another function of VGAM812 is therefore inhibition of SWI/SNF Related, Matrix Associated, Actin Dependent Regulator of Chromatin, Subfamily F, Member 1 (SMARCF1, Accession NM_006015). Accordingly, utilities of VGAM812 include diagnosis, prevention and treatment of diseases and clinical conditions associated with SMARCF1. TUSP (Accession NM_020245) is another VGAM812 host target gene. TUSP BINDING SITE is HOST TARGET binding site found in the 5' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21526, to the nucleotide sequence of VGAM812 RNA, herein designated VGAM RNA, also designated SEQ ID:3523.

Another function of VGAM812 is therefore inhibition of TUSP (Accession NM_020245). Accordingly, utilities of VGAM812 include diagnosis, prevention and treatment of diseases and clinical conditions associated with TUSP. LOC149420 (Accession XM_086530) is another VGAM812 host target gene. LOC149420 BINDING SITE is HOST TARGET binding site found in the 3' untranslated region of mRNA encoded by LOC149420, corresponding to a HOST TARGET binding site such as BINDING SITE I, BINDING SITE II or BINDING SITE III. Table 2 illustrates the complementarity of the nucleotide sequences of LOC149420 BINDING SITE, designated SEQ ID:38749, to the nucleotide sequence of VGAM812 RNA, herein designated VGAM RNA, also designated SEQ ID:3523.

Another function of VGAM812 is therefore inhibition of LOC149420 (Accession XM_086530). Accordingly, utilities of VGAM812 include diagnosis, prevention and treatment of diseases and clinical conditions associated with LOC149420. LOC90786 (Accession XM_034127) is another VGAM812 host target gene. LOC90786 BINDING SITE is HOST TARGET binding site found in the 3' untranslated region of mRNA encoded by LOC90786, corresponding to a HOST TARGET binding site such as BINDING SITE I, BINDING SITE II or BINDING SITE III. Table 2 illustrates the complementarity of the nucleotide sequences of LOC90786 BINDING SITE, designated SEQ ID:32014, to the nucleotide sequence of VGAM812 RNA, herein designated VGAM RNA, also designated SEQ ID:3523.

Another function of VGAM812 is therefore inhibition of LOC90786 (Accession XM_034127). Accordingly, utilities of VGAM812 include diagnosis, prevention and treatment of diseases and clinical conditions associated with LOC90786. LOC91661 (Accession NM_138372) is another VGAM812 host target gene. LOC91661 BINDING SITE is HOST TARGET binding site found in the 3' untranslated region of mRNA encoded by LOC91661, corresponding to a HOST TARGET binding site such as BINDING SITE I, BINDING SITE II or BINDING SITE III. Table 2 illustrates the complementarity of the nucleotide sequences of LOC91661 BINDING SITE, designated SEQ ID:28751, to the nucleotide sequence of VGAM812 RNA, herein designated VGAM RNA, also designated SEQ ID:3523.

Another function of VGAM812 is therefore inhibition of LOC91661 (Accession NM_138372). Accordingly, utilities of VGAM812 include diagnosis, prevention and treatment of diseases and clinical conditions associated with LOC91661.

FIG. 1 further provides a conceptual description of a novel bioinformatically detected viral gene of the present invention, referred to here as Viral Genomic Address Messenger 813 (VGAM813) viral gene, which modulates expression of respective host target genes thereof, the function and utility of which host target genes is known in the art.

VGAM813 is a novel bioinformatically detected regulatory, non protein coding, viral micro RNA (miRNA) gene. The method by which VGAM813 was detected is described hereinabove with reference to FIGS. 1-8.

VGAM813 gene, herein designated VGAM GENE, is a viral gene contained in the genome of Murid Herpesvirus 4. VGAM813 host target gene, herein designated VGAM HOST TARGET GENE, is a human gene contained in the human genome.

VGAM813 gene encodes a VGAM813 precursor RNA, herein designated VGAM PRECURSOR RNA. Similar to other miRNA genes, and unlike most ordinary genes, VGAM813 precursor RNA does not encode a protein. A nucleotide sequence identical or highly similar to the nucleotide sequence of VGAM813 precursor RNA is designated SEQ ID:799, and is provided hereinbelow with reference to the sequence listing part. Nucleotide sequence SEQ ID:799 is located at position 61060 relative to the genome of Murid Herpesvirus 4.

VGAM813 precursor RNA folds onto itself, forming VGAM813 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM813 folded precursor RNA into VGAM813 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM813 RNA is designated SEQ ID:3524, and is provided hereinbelow with reference to the sequence listing part.

VGAM813 host target gene, herein designated VGAM HOST TARGET GENE, encodes a corresponding messenger RNA, VGAM813 host target RNA, herein designated VGAM HOST TARGET RNA. VGAM813 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM813 RNA, herein designated VGAM RNA, binds complementarily to one or more host target binding sites located in untranslated regions of VGAM813 host target RNA, herein designated VGAM HOST TARGET RNA. This complementary binding is due to the fact that the nucleotide sequence of VGAM813 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM813 RNA, herein designated VGAM RNA, may have a different number of host target binding sites in untranslated regions of a VGAM813 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM813 RNA, herein designated VGAM RNA, to host target binding sites on VGAM813 host target RNA, herein designated VGAM HOST TARGET RNA, such as BINDING SITE I, BINDING SITE II and BINDING SITE III, inhibits translation of VGAM813 host target RNA into VGAM813 host target protein, herein designated VGAM HOST TARGET PROTEIN. VGAM host target protein is therefore outlined by a broken line.

It is appreciated that VGAM813 host target gene, herein designated VGAM HOST TARGET GENE, in fact represents a plurality of VGAM813 host target genes. The mRNA of each one of this plurality of VGAM813 host target genes comprises one or more host target binding sites, each having a nucleotide sequence which is at least partly complementary to VGAM813 RNA, herein designated VGAM RNA, and which when bound by VGAM813 RNA causes inhibition of translation of respective one or more VGAM813 host target proteins.

It is further appreciated by one skilled in the art that the mode of translational inhibition illustrated by FIG. 1 with specific reference to translational inhibition exerted by VGAM813 gene, herein designated VGAM GENE, on one or more VGAM813 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM813 is inhibition of expression of host target genes, as part of a novel viral mechanism of attacking a host. Accordingly, utilities of VGAM813 include diagnosis, prevention and treatment of viral infection by Murid Herpesvirus 4. Specific functions, and accordingly utilities, of VGAM813 correlate with, and may be deduced from, the identity of the host target genes which VGAM813 binds and inhibits, and the function of these host target genes, as elaborated hereinbelow.

Nucleotide sequences of the VGAM813 precursor RNA, herein designated VGAM PRECURSOR RNA, and of the 'diced' VGAM813 RNA, herein designated VGAM RNA, and a schematic representation of the secondary folding of VGAM813 folded precursor RNA, herein designated VGAM FOLDED PRECURSOR RNA, of VGAM813 are further described hereinbelow with reference to Table 1.

Nucleotide sequences of host target binding sites, such as BINDING SITE-I, BINDING SITE-II and BINDING SITE-III of FIG. 1, found on VGAM813 host target RNA, and schematic representation of the complementarity of each of these host target binding sites to VGAM813 RNA, herein designated VGAM RNA, are described hereinbelow with reference to Table 2.

As mentioned hereinabove with reference to FIG. 1, a function of VGAM813 gene, herein designated VGAM is inhibition of expression of VGAM813 target genes. It is appreciated that specific functions, and accordingly utilities, of VGAM813 correlate with, and may be deduced from, the identity of the target genes which VGAM813 binds and inhibits, and the function of these target genes, as elaborated hereinbelow.

Bromodomain Adjacent to Zinc Finger Domain, 2B (BAZ2B, Accession NM_013450) is a VGAM813 host target gene. BAZ2B BINDING SITE is HOST TARGET binding site found in the 5' untranslated region of mRNA encoded by BAZ2B, corresponding to a HOST TARGET binding site such as BINDING SITE I, BINDING SITE II or BINDING SITE III. Table 2 illustrates the complementarity of the nucleotide sequences of BAZ2B BINDING SITE, designated SEQ ID:15123, to the nucleotide sequence of VGAM813 RNA, herein designated VGAM RNA, also designated SEQ ID:3524.

A function of VGAM813 is therefore inhibition of Bromodomain Adjacent to Zinc Finger Domain, 2B (BAZ2B, Accession NM_013450). Accordingly, utilities of VGAM813 include diagnosis, prevention and treatment of diseases and clinical conditions associated with BAZ2B. CAMP Responsive Element Binding Protein-like 2 (CREBL2, Accession NM_001310) is another VGAM813 host target gene. CREBL2 BINDING SITE is HOST TARGET binding site found in the 3' untranslated region of mRNA encoded by CREBL2, corresponding to a HOST TARGET binding site such as BINDING SITE I, BINDING SITE II or BINDING SITE III. Table 2 illustrates the complementarity of the nucleotide sequences of CREBL2 BINDING SITE, designated SEQ ID:6994, to the nucleotide sequence of VGAM813 RNA, herein designated VGAM RNA, also designated SEQ ID:3524.

Another function of VGAM813 is therefore inhibition of CAMP Responsive Element Binding Protein-like 2 (CREBL2, Accession NM_001310). Accordingly, utilities of VGAM813 include diagnosis, prevention and treatment of diseases and clinical conditions associated with CREBL2. Fibronectin Leucine Rich Transmembrane Protein 2 (FLRT2, Accession NM_013231) is another VGAM813 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14873, to the nucleotide sequence of VGAM813 RNA, herein designated VGAM RNA, also designated SEQ ID:3524.

Another function of VGAM813 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM813 include diagnosis, prevention and treatment of diseases and clinical conditions associated with FLRT2. The function of FLRT2 and its association with various diseases and clinical conditions, has been established by previous studies, as described hereinabove with reference to VGAM247. Chemokine (C-C motif) Receptor 6 (CCR6, Accession NM_004367) is another VGAM813 host target gene. CCR6 BINDING SITE1 and CCR6 BINDING SITE2 are HOST TARGET binding sites found in untranslated regions of mRNA encoded by CCR6, corresponding to HOST TARGET binding sites such as BINDING SITE I, BINDING SITE II or BINDING SITE III. Table 2 illustrates the complementarity of the nucleotide sequences of CCR6 BINDING SITE1 and CCR6 BINDING SITE2, designated SEQ ID:10574 and SEQ ID:25366 respectively, to the nucleotide sequence of VGAM813 RNA, herein designated VGAM RNA, also designated SEQ ID:3524.

Another function of VGAM813 is therefore inhibition of Chemokine (C-C motif) Receptor 6 (CCR6, Accession NM_004367). Accordingly, utilities of VGAM813 include diagnosis, prevention and treatment of diseases and clinical conditions associated with CCR6. Heat Shock 90 kDa Protein 1, Alpha-like 3 (HSPCAL3, Accession XM_084514) is another VGAM813 host target gene. HSPCAL3 BINDING SITE is HOST TARGET binding site found in the 3' untranslated region of mRNA encoded by HSPCAL3, corresponding to a HOST TARGET binding site such as BINDING SITE I, BINDING SITE II or BINDING SITE III. Table 2 illustrates the complementarity of the nucleotide sequences of HSPCAL3 BINDING SITE, designated SEQ ID:37619, to the nucleotide sequence of VGAM813 RNA, herein designated VGAM RNA, also designated SEQ ID:3524.

Another function of VGAM813 is therefore inhibition of Heat Shock 90kDa Protein 1, Alpha-like 3 (HSPCAL3, Accession XM_084514). Accordingly, utilities of VGAM813 include diagnosis, prevention and treatment of diseases and clinical conditions associated with HSPCAL3. KIAA1529 (Accession XM_047336) is another VGAM813 host target gene. KIAA1529 BINDING SITE is HOST TARGET binding site found in the 5" untranslated region of mRNA encoded by KIAA1529, corresponding to a HOST TARGET binding site such as BINDING SITE I, BINDING SITE II or BINDING SITE III. Table 2 illustrates the complementarity of the nucleotide sequences of KIAA1529 BINDING SITE, designated SEQ ID:34950, to the nucleotide sequence of VGAM813 RNA, herein designated VGAM RNA, also designated SEQ ID:3524.

Another function of VGAM813 is therefore inhibition of KIAA1529 (Accession XM_047336). Accordingly, utilities of VGAM813 include diagnosis, prevention and treatment of diseases and clinical conditions associated with KIAA1529. Phorbol-12-myristate-13-acetate-induced Protein 1 (PMAIP1, Accession NM_021127) is another VGAM813 host target gene. PMAIP1 BINDING SITE is HOST TARGET binding site found in the 3' untranslated region of mRNA encoded by PMAIP1, corresponding to a HOST TARGET binding site such as BINDING SITE I, BINDING SITE II or BINDING SITE III. Table 2 illustrates the complementarity of the nucleotide sequences of PMAIP1 BINDING SITE, designated SEQ ID:22101, to the nucleotide sequence of VGAM813 RNA, herein designated VGAM RNA, also designated SEQ ID:3524.

Another function of VGAM813 is therefore inhibition of Phorbol-12-myristate-13-acetate-induced Protein 1 (PMAIP1, Accession NM_021127). Accordingly, utilities of VGAM813 include diagnosis, prevention and treatment of diseases and clinical conditions associated with PMAIP1. LOC162333 (Accession XM_102591) is another VGAM813 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42118, to the nucleotide sequence of VGAM813 RNA, herein designated VGAM RNA, also designated SEQ ID:3524.

Another function of VGAM813 is therefore inhibition of LOC162333 (Accession XM_102591). Accordingly, utilities of VGAM813 include diagnosis, prevention and treatment of diseases and clinical conditions associated with LOC162333. LOC169270 (Accession XM_095607) is another VGAM813 host target gene. LOC169270 BINDING SITE is HOST TARGET binding site found in the 3' untranslated region of mRNA encoded by LOC169270, corresponding to a HOST TARGET binding site such as BINDING SITE I, BINDING SITE II or BINDING SITE III. Table 2 illustrates the complementarity of the nucleotide sequences of LOC169270 BINDING SITE, designated SEQ ID:40273, to the nucleotide sequence of VGAM813 RNA, herein designated VGAM RNA, also designated SEQ ID:3524.

Another function of VGAM813 is therefore inhibition of LOC169270 (Accession XM_095607). Accordingly, utilities of VGAM813 include diagnosis, prevention and treatment of diseases and clinical conditions associated with LOC169270. LOC220763 (Accession XM_055551) is another VGAM813 host target gene. LOC220763 BINDING SITE is HOST TARGET binding site found in the 5' untranslated region of mRNA encoded by LOC220763, corresponding to a HOST TARGET binding site such as BINDING SITE I, BINDING SITE II or BINDING SITE III. Table 2 illustrates the complementarity of the nucleotide sequences of LOC220763 BINDING SITE, designated SEQ ID:36302, to the nucleotide sequence of VGAM813 RNA, herein designated VGAM RNA, also designated SEQ ID:3524.

Another function of VGAM813 is therefore inhibition of LOC220763 (Accession XM_055551). Accordingly, utilities of VGAM813 include diagnosis, prevention and treatment of diseases and clinical conditions associated with LOC220763. LOC51277 (Accession XM_087054) is another VGAM813 host target gene. LOC51277 BINDING SITE is HOST TARGET binding site found in the 3' untranslated region of mRNA encoded by LOC51277, corresponding to a HOST TARGET binding site such as BINDING SITE I, BINDING SITE II or BINDING SITE III. Table 2 illustrates the complementarity of the nucleotide sequences of LOC51277 BINDING SITE, designated SEQ ID:39022, to the nucleotide sequence of VGAM813 RNA, herein designated VGAM RNA, also designated SEQ ID:3524.

Another function of VGAM813 is therefore inhibition of LOC51277 (Accession XM_087054). Accordingly, utilities of VGAM813 include diagnosis, prevention and treatment of diseases and clinical conditions associated with LOC51277. FIG. 1 further provides a conceptual description of a novel bioinformatically detected viral gene of the present invention, referred to here as Viral Genomic Address Messenger 814 (VGAM814) viral gene, which modulates expression of respective host target genes thereof, the function and utility of which host target genes is known in the art.

VGAM814 is a novel bioinformatically detected regulatory, non protein coding, viral micro RNA (miRNA) gene. The method by which VGAM814 was detected is described hereinabove with reference to FIGS. 1-8.

VGAM814 gene, herein designated VGAM GENE, is a viral gene contained in the genome of Murid Herpesvirus 4. VGAM814 host target gene, herein designated VGAM HOST TARGET GENE, is a human gene contained in the human genome.

VGAM814 gene encodes a VGAM814 precursor RNA, herein designated VGAM PRECURSOR RNA. Similar to other miRNA genes, and unlike most ordinary genes, VGAM814 precursor RNA does not encode a protein. A nucleotide sequence identical or highly similar to the nucleotide sequence of VGAM814 precursor RNA is designated SEQ ID:800, and is provided hereinbelow with reference to the sequence listing part. Nucleotide sequence SEQ ID:800 is located at position 58920 relative to the genome of Murid Herpesvirus 4.

VGAM814 precursor RNA folds onto itself, forming VGAM814 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM814 folded precursor RNA into VGAM814 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM814 RNA is designated SEQ ID:3525, and is provided hereinbelow with reference to the sequence listing part.

VGAM814 host target gene, herein designated VGAM HOST TARGET GENE, encodes a corresponding messenger RNA, VGAM814 host target RNA, herein designated VGAM HOST TARGET RNA. VGAM814 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM814 RNA, herein designated VGAM RNA, binds complementarily to one or more host target binding sites located in untranslated regions of VGAM814 host target RNA, herein designated VGAM HOST TARGET RNA. This complementary binding is due to the fact that the nucleotide sequence of VGAM814 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM814 RNA, herein designated VGAM RNA, may have a different number of host target binding sites in untranslated regions of a VGAM814 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM814 RNA, herein designated VGAM RNA, to host target binding sites on VGAM814 host target RNA, herein designated VGAM HOST TARGET RNA, such as BINDING SITE I, BINDING SITE II and BINDING SITE III, inhibits translation of VGAM814 host target RNA into VGAM814 host target protein, herein designated VGAM HOST TARGET PROTEIN. VGAM host target protein is therefore outlined by a broken line.

It is appreciated that VGAM814 host target gene, herein designated VGAM HOST TARGET GENE, in fact represents a plurality of VGAM814 host target genes. The mRNA of each one of this plurality of VGAM814 host target genes comprises one or more host target binding sites, each having a nucleotide sequence which is at least partly complementary to VGAM814 RNA, herein designated VGAM RNA, and which when bound by VGAM814 RNA causes inhibition of translation of respective one or more VGAM814 host target proteins.

It is further appreciated by one skilled in the art that the mode of translational inhibition illustrated by FIG. 1 with specific reference to translational inhibition exerted by VGAM814 gene, herein designated VGAM GENE, on one or more VGAM814 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM814 is inhibition of expression of host target genes, as part of a novel viral mechanism of attacking a host. Accordingly, utilities of VGAM814 include diagnosis, prevention and treatment of viral infection by Murid Herpesvirus 4. Specific functions, and accordingly utilities, of VGAM814 correlate with, and may be deduced from, the identity of the host target genes which VGAM814 binds and inhibits, and the function of these host target genes, as elaborated hereinbelow.

Nucleotide sequences of the VGAM814 precursor RNA, herein designated VGAM PRECURSOR RNA, and of the 'diced' VGAM814 RNA, herein designated VGAM RNA, and a schematic representation of the secondary folding of VGAM814 folded precursor RNA, herein designated VGAM FOLDED PRECURSOR RNA, of VGAM814 are further described hereinbelow with reference to Table 1.

Nucleotide sequences of host target binding sites, such as BINDING SITE-I, BINDING SITE-II and BINDING SITE-III of FIG. 1, found on VGAM814 host target RNA, and schematic representation of the complementarity of each of these host target binding sites to VGAM814 RNA, herein designated VGAM RNA, are described hereinbelow with reference to Table 2.

As mentioned hereinabove with reference to FIG. 1, a function of VGAM814 gene, herein designated VGAM is inhibition of expression of VGAM814 target genes. It is appreciated that specific functions, and accordingly utilities, of VGAM814 correlate with, and may be deduced from, the identity of the target genes which VGAM814 binds and inhibits, and the function of these target genes, as elaborated hereinbelow.

FK506 Binding Protein 1A, 12 kDa (FKBP1A, Accession NM_000801) is a VGAM814 host target gene. FKBP1A BINDING SITE is HOST TARGET binding site found in the 3' untranslated region of mRNA encoded by FKBP1A, corresponding to a HOST TARGET binding site such as BINDING SITE I, BINDING SITE II or BINDING SITE III. Table 2 illustrates the complementarity of the nucleotide sequences of FKBP1A BINDING SITE, designated SEQ ID:6473, to the nucleotide sequence of VGAM814 RNA, herein designated VGAM RNA, also designated SEQ ID:3525.

A function of VGAM814 is therefore inhibition of FK506 Binding Protein 1A, 12 kDa (FKBP1A, Accession NM_000801), a gene which FK506-binding protein 1A. Accordingly, utilities of VGAM814 include diagnosis, prevention and treatment of diseases and clinical conditions associated with FKBP1A. The function of FKBP1A and its association with various diseases and clinical conditions, has been established by previous studies, as described hereinabove with reference to VGAM57. Follistatin-like 3 (secreted glycoprotein) (FSTL3, Accession NM_005860) is another VGAM814 host target gene. FSTL3 BINDING SITE is HOST TARGET binding site found in the 3' untranslated region of mRNA encoded by FSTL3, corresponding to a HOST TARGET binding site such as BINDING SITE I, BINDING SITE II or BINDING SITE III. Table 2 illustrates the complementarity of the nucleotide sequences of FSTL3 BINDING SITE, designated SEQ ID:12467, to the nucleotide sequence of VGAM814 RNA, herein designated VGAM RNA, also designated SEQ ID:3525.

Another function of VGAM814 is therefore inhibition of Follistatin-like 3 (secreted glycoprotein) (FSTL3, Accession NM_005860), a gene which is a member of the follistatin-module-protein family. Accordingly, utilities of VGAM814 include diagnosis, prevention and treatment of diseases and clinical conditions associated with FSTL3. The function of FSTL3 and its association with various diseases and clinical conditions, has been established by previous studies, as described hereinabove with reference to VGAM200. CGI-142 (Accession NM_016073) is another VGAM814 host target gene. CGI-142 BINDING SITE is HOST TARGET binding site found in the 3' untranslated region of mRNA encoded by CGI-142, corresponding to a HOST TARGET binding site such as BINDING SITE I, BINDING SITE II or BINDING SITE III. Table 2 illustrates the complementarity of the nucleotide sequences of CGI-142 BINDING SITE, designated SEQ ID:18146, to the nucleotide sequence of VGAM814 RNA, herein designated VGAM RNA, also designated SEQ ID:3525.

Another function of VGAM814 is therefore inhibition of CGI-142 (Accession NM_016073). Accordingly, utilities of VGAM814 include diagnosis, prevention and treatment of diseases and clinical conditions associated with CGI-142. FLJ21777 (Accession NM_032209) is another VGAM814 host target gene. FLJ21777 BINDING SITE is HOST TARGET binding site found in the 3' untranslated region of mRNA encoded by FLJ21777, corresponding to a HOST TARGET binding site such as BINDING SITE I, BINDING SITE II or BINDING SITE III. Table 2 illustrates the complementarity of the nucleotide sequences of FLJ21777 BINDING SITE, designated SEQ ID:25922, to the nucleotide sequence of VGAM814 RNA, herein designated VGAM RNA, also designated SEQ ID:3525.

Another function of VGAM814 is therefore inhibition of FLJ21777 (Accession NM_032209). Accordingly, utilities of VGAM814 include diagnosis, prevention and treatment of diseases and clinical conditions associated with FLJ21777. IMP13 (Accession NM_014652) is another VGAM814 host target gene. IMP13 BINDING SITE is HOST TARGET binding site found in the 5' untranslated region of mRNA encoded by IMP13, corresponding to a HOST TARGET binding site such as BINDING SITE I, BINDING SITE II or BINDING SITE III. Table 2 illustrates the complementarity of the nucleotide sequences of IMP13 BINDING SITE, designated SEQ ID:16074, to the nucleotide sequence of VGAM814 RNA, herein designated VGAM RNA, also designated SEQ ID:3525.

Another function of VGAM814 is therefore inhibition of IMP13 (Accession NM_014652). Accordingly, utilities of VGAM814 include diagnosis, prevention and treatment of diseases and clinical conditions associated with IMP13. KIAA1671 (Accession XM_037809) is another VGAM814 host target gene. KIAA1671 BINDING SITE is HOST TARGET binding site found in the 3' untranslated region of mRNA encoded by KIAA1671, corresponding to a HOST TARGET binding site such as BINDING SITE I, BINDING SITE II or BINDING SITE III. Table 2 illustrates the complementarity of the nucleotide sequences of KIAA1671 BINDING SITE, designated SEQ ID:32692, to the nucleotide sequence of VGAM814 RNA, herein designated VGAM RNA, also designated SEQ ID:3525.

Another function of VGAM814 is therefore inhibition of KIAA1671 (Accession XM_037809). Accordingly, utilities of VGAM814 include diagnosis, prevention and treatment of diseases and clinical conditions associated with KIAA1671. PPI5PIV (Accession NM_019892) is another VGAM814 host target gene. PPI5PIV BINDING SITE is HOST TARGET binding site found in the 3' untranslated region of mRNA encoded by PPI5PIV, corresponding to a HOST TARGET binding site such as BINDING SITE I, BINDING SITE II or BINDING SITE III. Table 2 illustrates the complementarity of the nucleotide sequences of PPI5PIV BINDING SITE, designated SEQ ID:21274, to the nucleotide sequence of VGAM814 RNA, herein designated VGAM RNA, also designated SEQ ID:3525.

Another function of VGAM814 is therefore inhibition of PPI5PIV (Accession NM_019892). Accordingly, utilities of VGAM814 include diagnosis, prevention and treatment of diseases and clinical conditions associated with PPI5PIV. STATI2 (Accession NM_003877) is another VGAM814 host target gene. STATI2 BINDING SITE1 and STATI2 BINDING SITE2 are HOST TARGET binding sites found in untranslated regions of mRNA encoded by STATI2, corresponding to HOST TARGET binding sites such as BINDING SITE I, BINDING SITE II or BINDING SITE III. Table 2 illustrates the complementarity of the nucleotide sequences of STATI2 BINDING SITE1 and STATI2 BINDING SITE2, designated SEQ ID:9958 and SEQ ID:45369 respectively, to the nucleotide sequence of VGAM814 RNA, herein designated VGAM RNA, also designated SEQ ID:3525.

Another function of VGAM814 is therefore inhibition of STATI2 (Accession NM_003877). Accordingly, utilities of VGAM814 include diagnosis, prevention and treatment of diseases and clinical conditions associated with STATI2. LOC201685 (Accession XM_117325) is another VGAM814 host target gene. LOC201685 BINDING SITE is HOST TARGET binding site found in the 5' untranslated region of mRNA encoded by LOC201685, corresponding to a HOST TARGET binding site such as BINDING SITE I, BINDING SITE II or BINDING SITE III. Table 2 illustrates the complementarity of the nucleotide sequences of LOC201685 BINDING SITE, designated SEQ ID:43388, to the nucleotide sequence of VGAM814 RNA, herein designated VGAM RNA, also designated SEQ ID:3525.

Another function of VGAM814 is therefore inhibition of LOC201685 (Accession XM_117325). Accordingly, utilities of VGAM814 include diagnosis, prevention and treatment of diseases and clinical conditions associated with LOC201685. FIG. 1 further provides a conceptual description of a novel bioinformatically detected viral gene of the present invention, referred to here as Viral Genomic Address Messenger 815 (VGAM815) viral gene, which modulates expression of respective host target genes thereof, the function and utility of which host target genes is known in the art.

VGAM815 is a novel bioinformatically detected regulatory, non protein coding, viral micro RNA (miRNA) gene. The method by which VGAM815 was detected is described hereinabove with reference to FIGS. 1-8.

VGAM815 gene, herein designated VGAM GENE, is a viral gene contained in the genome of Macaca Mulatta Rhadinovirus. VGAM815 host target gene, herein designated VGAM HOST TARGET GENE, is a human gene contained in the human genome.

VGAM815 gene encodes a VGAM815 precursor RNA, herein designated VGAM PRECURSOR RNA. Similar to other miRNA genes, and unlike most ordinary genes, VGAM815 precursor RNA does not encode a protein. A nucleotide sequence identical or highly similar to the nucleotide sequence of VGAM815 precursor RNA is designated SEQ ID:801, and is provided hereinbelow with reference to the sequence listing part. Nucleotide sequence SEQ ID:801 is located at position 59708 relative to the genome of Macaca Mulatta Rhadinovirus.

VGAM815 precursor RNA folds onto itself, forming VGAM815 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM815 folded precursor RNA into VGAM815 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM815 RNA is designated SEQ ID:3526, and is provided hereinbelow with reference to the sequence listing part.

VGAM815 host target gene, herein designated VGAM HOST TARGET GENE, encodes a corresponding messenger RNA, VGAM815 host target RNA, herein designated VGAM HOST TARGET RNA. VGAM815 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM815 RNA, herein designated VGAM RNA, binds complementarily to one or more host target binding sites located in untranslated regions of VGAM815 host target RNA, herein designated VGAM HOST TARGET RNA. This complementary binding is due to the fact that the nucleotide sequence of VGAM815 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM815 RNA, herein designated VGAM RNA, may have a different number of host target binding sites in untranslated regions of a VGAM815 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM815 RNA, herein designated VGAM RNA, to host target binding sites on VGAM815 host target RNA, herein designated VGAM HOST TARGET RNA, such as BINDING SITE I, BINDING SITE II and BINDING SITE III, inhibits translation of VGAM815 host target RNA into VGAM815 host target protein, herein designated VGAM HOST TARGET PROTEIN. VGAM host target protein is therefore outlined by a broken line.

It is appreciated that VGAM815 host target gene, herein designated VGAM HOST TARGET GENE, in fact represents a plurality of VGAM815 host target genes. The mRNA of each one of this plurality of VGAM815 host target genes comprises one or more host target binding sites, each having a nucleotide sequence which is at least partly complementary to VGAM815 RNA, herein designated VGAM RNA, and which when bound by VGAM815 RNA causes inhibition of translation of respective one or more VGAM815 host target proteins.

It is further appreciated by one skilled in the art that the mode of translational inhibition illustrated by FIG. 1 with specific reference to translational inhibition exerted by VGAM815 gene, herein designated VGAM GENE, on one or more VGAM815 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM815 is inhibition of expression of host target genes, as part of a novel viral mechanism of attacking a host. Accordingly, utilities of VGAM815 include diagnosis, prevention and treatment of viral infection by Macaca Mulatta Rhadinovirus. Specific functions, and accordingly utilities, of VGAM815 correlate with, and may be deduced from, the identity of the host target genes which VGAM815 binds and inhibits, and the function of these host target genes, as elaborated hereinbelow.

Nucleotide sequences of the VGAM815 precursor RNA, herein designated VGAM PRECURSOR RNA, and of the 'diced' VGAM815 RNA, herein designated VGAM RNA, and a schematic representation of the secondary folding of VGAM815 folded precursor RNA, herein designated VGAM FOLDED PRECURSOR RNA, of VGAM815 are further described hereinbelow with reference to Table 1.

Nucleotide sequences of host target binding sites, such as BINDING SITE-I, BINDING SITE-II and BINDING SITE-III of FIG. 1, found on VGAM815 host target RNA, and schematic representation of the complementarity of each of these host target binding sites to VGAM815 RNA, herein designated VGAM RNA, are described hereinbelow with reference to Table 2.

As mentioned hereinabove with reference to FIG. 1, a function of VGAM815 gene, herein designated VGAM is inhibition of expression of VGAM815 target genes. It is appreciated that specific functions, and accordingly utilities, of VGAM815 correlate with, and may be deduced from, the identity of the target genes which VGAM815 binds and inhibits, and the function of these target genes, as elaborated hereinbelow.

KIAA0089 (Accession XM_046056) is a VGAM815 host target gene. KIAA0089 BINDING SITE is HOST TARGET binding site found in the 3' untranslated region of mRNA encoded by KIAA0089, corresponding to a HOST TARGET binding site such as BINDING SITE I, BINDING SITE II or BINDING SITE III. Table 2 illustrates the complementarity of the nucleotide sequences of KIAA0089 BINDING SITE, designated SEQ ID:34663, to the nucleotide sequence of VGAM815 RNA, herein designated VGAM RNA, also designated SEQ ID:3526.

A function of VGAM815 is therefore inhibition of KIAA0089 (Accession XM_046056). Accordingly, utilities of VGAM815 include diagnosis, prevention and treatment of diseases and clinical conditions associated with KIAA0089. LOC197196 (Accession XM_117003) is another VGAM815 host target gene. LOC197196 BINDING SITE is HOST TARGET binding site found in the 3' untranslated region of mRNA encoded by LOC197196, corresponding to a HOST TARGET binding site such as BINDING SITE I, BINDING SITE II or BINDING SITE III. Table 2 illustrates the complementarity of the nucleotide sequences of LOC197196 BINDING SITE, designated SEQ ID:43200, to the nucleotide sequence of VGAM815 RNA, herein designated VGAM RNA, also designated SEQ ID:3526.

Another function of VGAM815 is therefore inhibition of LOC197196 (Accession XM_117003). Accordingly, utilities of VGAM815 include diagnosis, prevention and treatment of diseases and clinical conditions associated with LOC197196. LOC200982 (Accession XM_117305) is another VGAM815 host target gene. LOC200982 BINDING SITE is HOST TARGET binding site found in the 3' untranslated region of mRNA encoded by LOC200982, corresponding to a HOST TARGET binding site such as BINDING SITE I, BINDING SITE II or BINDING SITE III. Table 2 illustrates the complementarity of the nucleotide sequences of LOC200982 BINDING SITE, designated SEQ ID:43374, to the nucleotide sequence of VGAM815 RNA, herein designated VGAM RNA, also designated SEQ ID:3526.

Another function of VGAM815 is therefore inhibition of LOC200982 (Accession XM_117305). Accordingly, utilities of VGAM815 include diagnosis, prevention and treatment of diseases and clinical conditions associated with LOC200982. FIG. 1 further provides a conceptual description of a novel bioinformatically detected viral gene of the present invention, referred to here as Viral Genomic Address Messenger 816 (VGAM816) viral gene, which modulates expression of respective host target genes thereof, the function and utility of which host target genes is known in the art.

VGAM816 is a novel bioinformatically detected regulatory, non protein coding, viral micro RNA (miRNA) gene. The method by which VGAM816 was detected is described hereinabove with reference to FIGS. 1-8.

VGAM816 gene, herein designated VGAM GENE, is a viral gene contained in the genome of Macaca Mulatta Rhadinovirus. VGAM816 host target gene, herein designated VGAM HOST TARGET GENE, is a human gene contained in the human genome.

VGAM816 gene encodes a VGAM816 precursor RNA, herein designated VGAM PRECURSOR RNA. Similar to other miRNA genes, and unlike most ordinary genes, VGAM816 precursor RNA does not encode a protein. A nucleotide sequence identical or highly similar to the nucleotide sequence of VGAM816 precursor RNA is designated SEQ ID:802, and is provided hereinbelow with reference to the sequence listing part. Nucleotide sequence SEQ ID:802 is located at position 60360 relative to the genome of Macaca Mulatta Rhadinovirus.

VGAM816 precursor RNA folds onto itself, forming VGAM816 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM816 folded precursor RNA into VGAM816 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM816 RNA is designated SEQ ID:3527, and is provided hereinbelow with reference to the sequence listing part.

VGAM816 host target gene, herein designated VGAM HOST TARGET GENE, encodes a corresponding messenger RNA, VGAM816 host target RNA, herein designated VGAM HOST TARGET RNA. VGAM816 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM816 RNA, herein designated VGAM RNA, binds complementarily to one or more host target binding sites located in untranslated regions of VGAM816 host target RNA, herein designated VGAM HOST TARGET RNA. This complementary binding is due to the fact that the nucleotide sequence of VGAM816 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM816 RNA, herein designated VGAM RNA, may have a different number of host target binding sites in untranslated regions of a VGAM816 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM816 RNA, herein designated VGAM RNA, to host target binding sites on VGAM816 host target RNA, herein designated VGAM HOST TARGET RNA, such as BINDING SITE I, BINDING SITE II and BINDING SITE III, inhibits translation of VGAM816 host target RNA into VGAM816 host target protein, herein designated VGAM HOST TARGET PROTEIN. VGAM host target protein is therefore outlined by a broken line.

It is appreciated that VGAM816 host target gene, herein designated VGAM HOST TARGET GENE, in fact represents a plurality of VGAM816 host target genes. The mRNA of each one of this plurality of VGAM816 host target genes comprises one or more host target binding sites, each having a nucleotide sequence which is at least partly complementary to VGAM816 RNA, herein designated VGAM RNA, and which when bound by VGAM816 RNA causes inhibition of translation of respective one or more VGAM816 host target proteins.

It is further appreciated by one skilled in the art that the mode of translational inhibition illustrated by FIG. 1 with specific reference to translational inhibition exerted by VGAM816 gene, herein designated VGAM GENE, on one or more VGAM816 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM816 is inhibition of expression of host target genes, as part of a novel viral mechanism of attacking a host. Accordingly, utilities of VGAM816 include diagnosis, prevention and treatment of viral infection by Macaca Mulatta Rhadinovirus. Specific functions, and accordingly utilities, of VGAM816 correlate with, and may be deduced from, the identity of the host target genes which VGAM816 binds and inhibits, and the function of these host target genes, as elaborated hereinbelow.

Nucleotide sequences of the VGAM816 precursor RNA, herein designated VGAM PRECURSOR RNA, and of the 'diced' VGAM816 RNA, herein designated VGAM RNA, and a schematic representation of the secondary folding of VGAM816 folded precursor RNA, herein designated VGAM FOLDED PRECURSOR RNA, of VGAM816 are further described hereinbelow with reference to Table 1.

Nucleotide sequences of host target binding sites, such as BINDING SITE-I, BINDING SITE-II and BINDING SITE- III of FIG. 1, found on VGAM816 host target RNA, and schematic representation of the complementarity of each of these host target binding sites to VGAM816 RNA, herein designated VGAM RNA, are described hereinbelow with reference to Table 2.

As mentioned hereinabove with reference to FIG. 1, a function of VGAM816 gene, herein designated VGAM is inhibition of expression of VGAM816 target genes. It is appreciated that specific functions, and accordingly utilities, of VGAM816 correlate with, and may be deduced from, the identity of the target genes which VGAM816 binds and inhibits, and the function of these target genes, as elaborated hereinbelow.

ADP-ribosylation Factor 4-like (ARF4L, Accession XM_045890) is a VGAM816 host target gene. ARF4L BINDING SITE is HOST TARGET binding site found in the 3' untranslated region of mRNA encoded by ARF4L, corresponding to a HOST TARGET binding site such as BINDING SITE I, BINDING SITE II or BINDING SITE III. Table 2 illustrates the complementarity of the nucleotide sequences of ARF4L BINDING SITE, designated SEQ ID:34605, to the nucleotide sequence of VGAM816 RNA, herein designated VGAM RNA, also designated SEQ ID:3527.

A function of VGAM816 is therefore inhibition of ADP-ribosylation Factor 4-like (ARF4L, Accession XM_045890). Accordingly, utilities of VGAM816 include diagnosis, prevention and treatment of diseases and clinical conditions associated with ARF4L. Calcium Channel, Voltage-dependent, L Type, Alpha 1C Subunit (CACNA1C, Accession NM_000719) is another VGAM816 host target gene. CACNA1C BINDING SITE is HOST TARGET binding site found in the 3' untranslated region of mRNA encoded by CACNA1C, corresponding to a HOST TARGET binding site such as BINDING SITE I, BINDING SITE II or BINDING SITE III. Table 2 illustrates the complementarity of the nucleotide sequences of CACNA1C BINDING SITE, designated SEQ ID:6381, to the nucleotide sequence of VGAM816 RNA, herein designated VGAM RNA, also designated SEQ ID:3527.

Another function of VGAM816 is therefore inhibition of Calcium Channel, Voltage-dependent, L Type, Alpha 1C Subunit (CACNA1C, Accession NM_000719), a gene which is alpha-1 subunit of DHP-sensitive calcium channels from cardiac muscle and the brain. Accordingly, utilities of VGAM816 include diagnosis, prevention and treatment of diseases and clinical conditions associated with CACNA1C. The function of CACNA1C and its association with various diseases and clinical conditions, has been established by previous studies, as described hereinabove with reference to VGAM182. Prostaglandin F2 Receptor Negative Regulator (PTGFRN, Accession XM_040709) is another VGAM816 host target gene. PTGFRN BINDING SITE is HOST TARGET binding site found in the 5' untranslated region of mRNA encoded by PTGFRN, corresponding to a HOST TARGET binding site such as BINDING SITE I, BINDING SITE II or BINDING SITE III. Table 2 illustrates the complementarity of the nucleotide sequences of PTGFRN BINDING SITE, designated SEQ ID:33366, to the nucleotide sequence of VGAM816 RNA, herein designated VGAM RNA, also designated SEQ ID:3527.

Another function of VGAM816 is therefore inhibition of Prostaglandin F2 Receptor Negative Regulator (PTGFRN, Accession XM_040709), a gene which inhibits the binding of prostaglandin f2-alpha (pgf2- alpha) to its specific fp receptor. Accordingly, utilities of VGAM816 include diagnosis, prevention and treatment of diseases and clinical conditions associated with PTGFRN. The function of PTGFRN and its association with various diseases and clinical conditions, has been established by previous studies, as described hereinabove with reference to VGAM125. RAD52 Homolog (S. cerevisiae) (RAD52, Accession NM_134422) is another VGAM816 host target gene. RAD52 BINDING SITE1 through RAD52 BINDING SITE3 are HOST TARGET binding sites found in untranslated regions of mRNA encoded by RAD52, corresponding to HOST TARGET binding sites such as BINDING SITE I, BINDING SITE II or BINDING SITE III. Table 2 illustrates the complementarity of the nucleotide sequences of RAD52 BINDING SITE1 through RAD52 BINDING SITE3, designated SEQ ID:28646, SEQ ID:28654 and SEQ ID:28663 respectively, to the nucleotide sequence of VGAM816 RNA, herein designated VGAM RNA, also designated SEQ ID:3527.

Another function of VGAM816 is therefore inhibition of RAD52 Homolog (S. cerevisiae) (RAD52, Accession NM_134422). Accordingly, utilities of VGAM816 include diagnosis, prevention and treatment of diseases and clinical conditions associated with RAD52. Solute Carrier Family 4, Sodium Bicarbonate Cotransporter, Member 4 (SLC4A4, Accession NM_003759) is another VGAM816 host target gene. SLC4A4 BINDING SITE is HOST TARGET binding site found in the 3' untranslated region of mRNA encoded by SLC4A4, corresponding to a HOST TARGET binding site such as BINDING SITE I, BINDING SITE II or BINDING SITE III. Table 2 illustrates the complementarity of the nucleotide sequences of SLC4A4 BINDING SITE, designated SEQ ID:9839, to the nucleotide sequence of VGAM816 RNA, herein designated VGAM RNA, also designated SEQ ID:3527.

Another function of VGAM816 is therefore inhibition of Solute Carrier Family 4, Sodium Bicarbonate Cotransporter, Member 4 (SLC4A4, Accession NM_003759), a gene which is a sodium bicarbonate cotransporter. Accordingly, utilities of VGAM816 include diagnosis, prevention and treatment of diseases and clinical conditions associated with SLC4A4. The function of SLC4A4 and its association with various diseases and clinical conditions, has been established by previous studies, as described hereinabove with reference to VGAM222. Serine/arginine Repetitive Matrix 1 (SRRM1, Accession NM_005839) is another VGAM816 host target gene. SRRM1 BINDING SITE is HOST TARGET binding site found in the 3' untranslated region of mRNA encoded by SRRM1, corresponding to a HOST TARGET binding site such as BINDING SITE I, BINDING SITE II or BINDING SITE III. Table 2 illustrates the complementarity of the nucleotide sequences of SRRM1 BINDING SITE, designated SEQ ID:12452, to the nucleotide sequence of VGAM816 RNA, herein designated VGAM RNA, also designated SEQ ID:3527.

Another function of VGAM816 is therefore inhibition of Serine/arginine Repetitive Matrix 1 (SRRM1, Accession NM_005839). Accordingly, utilities of VGAM816 include diagnosis, prevention and treatment of diseases and clinical conditions associated with SRRM1. Transducin (beta)-like 2 (TBL2, Accession NM_032988) is another VGAM816 host target gene. TBL2 BINDING SITE is HOST TARGET binding site found in the 3' untranslated region of mRNA encoded by TBL2, corresponding to a HOST TARGET binding site such as BINDING SITE I, BINDING SITE II or BINDING SITE III. Table 2 illustrates the complementarity of the nucleotide sequences of TBL2 BINDING SITE, designated SEQ ID:26870, to the nucleotide sequence of VGAM816 RNA, herein designated VGAM RNA, also designated SEQ ID:3527.

Another function of VGAM816 is therefore inhibition of Transducin (beta)-like 2 (TBL2, Accession NM_032988), a gene which is of unknown function. Accordingly, utilities of VGAM816 include diagnosis, prevention and treatment of diseases and clinical conditions associated with TBL2. The function of TBL2 and its association with various diseases and clinical conditions, has been established by previous studies, as described hereinabove with reference to VGAM229. Translocase of Inner Mitochondrial Membrane 17 Homolog A (yeast) (TIMM17A, Accession NM_006335) is another VGAM816 host target gene. TIMM17A BINDING SITE is HOST TARGET binding site found in the 3' untranslated region of mRNA encoded by TIMM17A, corresponding to a HOST TARGET binding site such as BINDING SITE I, BINDING SITE II or BINDING SITE III. Table 2 illustrates the complementarity of the nucleotide sequences of TIMM17A BINDING SITE, designated SEQ ID:13035, to the nucleotide sequence of VGAM816 RNA, herein designated VGAM RNA, also designated SEQ ID:3527.

Another function of VGAM816 is therefore inhibition of Translocase of Inner Mitochondrial Membrane 17 Homolog A (yeast) (TIMM17A, Accession NM_006335), a gene which translocates nuclear-encoded proteins into the mitochondrion. Accordingly, utilities of VGAM816 include diagnosis, prevention and treatment of diseases and clinical conditions associated with TIMM17A. The function of TIMM17A has been established by previous studies. By searching EST databases for homologs of yeast Tim17, Bomer et al. (1996) isolated a cDNA encoding human TIMM17A. Using similar methods, Bauer et al. (1999) also cloned a TIMM17A cDNA. Sequence analysis predicted that the 171-amino acid TIMM17A protein shares 46% amino acid identity with yeast Tim17 and contains 4 hydrophobic membrane-spanning segments, conserving the N-out/C-out topology of the yeast protein. Bauer et al. (1999) found that TIMM17A is 76% identical to TIMM17B (OMIM Ref. No. 300249), differing primarily in the C terminus. Bomer et al. (1996) determined that TIMM17A is imported into the mitochondria via the TOMM70 rather than the more common TOMM20 (OMIM Ref. No. 601848) pathway. By Northern blot analysis, Bauer et al. (1999) detected ubiquitous expression of a 1.6-kb TIMM17A transcript that is most abundant in heart and brain, weaker in skeletal muscle, followed by pancreas, placenta, kidney, and liver. Western blot analysis showed that TIMM17A colocalizes with the inner membrane fraction of mitochondria as a 17-kD protein. Individually, TIMM17A and TIMM17B interact with TIMM23 (OMIM Ref. No. 605034), forming 2 distinct 110-kD complexes.

Full details of the abovementioned studies are described in the following publications, the disclosure of which are hereby incorporated by reference:

Bomer, U.; Rassow, J.; Zufall, N.; Pfanner, N.; Meijer, M.; Maarse, A. C.: The preprotein translocase of the inner mitochondrial membrane: evolutionary conservation of targeting and assembly of Tim17. J. Molec. Biol. 262:389-395, 1996; and Bauer, M. F.; Gempel, K.; Reichert, A. S.; Rappold, G. A.; Lichtner, P.; Gerbitz, K. D.; Neupert, W.; Brunner, M.; Hofmann, S.: Genetic and structural characterization of the human mito.

Further studies establishing the function and utilities of TIMM17A are found in John Hopkins OMIM database record ID 605057, and in sited publications numbered 5030-5031 listed in the bibliography section hereinbelow, which are also hereby incorporated by reference. Tumor Necrosis Factor Receptor Superfamily, Member 10b (TNFRSF10B, Accession NM_003842) is another VGAM816 host target gene. TNFRSF10B BINDING SITE is HOST TARGET binding site found in the 3' untranslated region of mRNA encoded by TNFRSF10B, corresponding to a HOST TARGET binding site such as BINDING SITE I, BINDING SITE II or BINDING SITE III. Table 2 illustrates the complementarity of the nucleotide sequences of TNFRSF10B BINDING SITE, designated SEQ ID:9941, to the nucleotide sequence of VGAM816 RNA, herein designated VGAM RNA, also designated SEQ ID:3527.

Another function of VGAM816 is therefore inhibition of Tumor Necrosis Factor Receptor Superfamily, Member 10b (TNFRSF10B, Accession NM_003842), a gene which forms complex that induces apoptosis. Accordingly, utilities of VGAM816 include diagnosis, prevention and treatment of diseases and clinical conditions associated with TNFRSF10B. The function of TNFRSF10B and its association with various diseases and clinical conditions, has been established by previous studies, as described hereinabove with reference to VGAM400. Zinc Finger Protein 205 (ZNF205, Accession NM_003456) is another VGAM816 host target gene. ZNF205 BINDING SITE is HOST TARGET binding site found in the 5' untranslated region of mRNA encoded by ZNF205, corresponding to a HOST TARGET binding site such as BINDING SITE I, BINDING SITE II or BINDING SITE III. Table 2 illustrates the complementarity of the nucleotide sequences of ZNF205 BINDING SITE, designated SEQ ID:9514, to the nucleotide sequence of VGAM816 RNA, herein designated VGAM RNA, also designated SEQ ID:3527.

Another function of VGAM816 is therefore inhibition of Zinc Finger Protein 205 (ZNF205, Accession NM_003456). Accordingly, utilities of VGAM816 include diagnosis, prevention and treatment of diseases and clinical conditions associated with ZNF205. ADG-90 (Accession NM_033069) is another VGAM816 host target gene. ADG-90 BINDING SITE is HOST TARGET binding site found in the 5' untranslated region of mRNA encoded by ADG-90, corresponding to a HOST TARGET binding site such as BINDING SITE I, BINDING SITE II or BINDING SITE III. Table 2 illustrates the complementarity of the nucleotide sequences of ADG-90 BINDING SITE, designated SEQ ID:26935, to the nucleotide sequence of VGAM816 RNA, herein designated VGAM RNA, also designated SEQ ID:3527.

Another function of VGAM816 is therefore inhibition of ADG-90 (Accession NM_033069). Accordingly, utilities of VGAM816 include diagnosis, prevention and treatment of diseases and clinical conditions associated with ADG-90. DKFZP434H132 (Accession NM_015492) is another VGAM816 host target gene. DKFZP434H132 BINDING SITE is HOST TARGET binding site found in the 3' untranslated region of mRNA encoded by DKFZP434H132, corresponding to a HOST TARGET binding site such as BINDING SITE I, BINDING SITE II or BINDING SITE III. Table 2 illustrates the complementarity of the nucleotide sequences of DKFZP434H132 BINDING SITE, designated SEQ ID:17762, to the nucleotide sequence of VGAM816 RNA, herein designated VGAM RNA, also designated SEQ ID:3527.

Another function of VGAM816 is therefore inhibition of DKFZP434H132 (Accession NM_015492). Accordingly, utilities of VGAM816 include diagnosis, prevention and treatment of diseases and clinical conditions associated with DKFZP434H132. FLJ11155 (Accession NM_018342) is another VGAM816 host target gene. FLJ11155 BINDING SITE is HOST TARGET binding site found in the 3' untranslated region of mRNA encoded by FLJ11155, corresponding to a HOST TARGET binding site such as BINDING SITE I, BINDING SITE II or BINDING SITE III. Table 2 illustrates the complementarity of the nucleotide sequences of FLJ11155 BINDING SITE, designated SEQ ID:20349, to the nucleotide sequence of VGAM816 RNA, herein designated VGAM RNA, also designated SEQ ID:3527.

Another function of VGAM816 is therefore inhibition of FLJ11155 (Accession NM_018342). Accordingly, utilities of VGAM816 include diagnosis, prevention and treatment of diseases and clinical conditions associated with FLJ11155. FLJ11259 (Accession NM_018370) is another VGAM816 host target gene. FLJ11259 BINDING SITE is HOST TARGET binding site found in the 3' untranslated region of mRNA encoded by FLJ11259, corresponding to a HOST TARGET binding site such as BINDING SITE I, BINDING SITE II or BINDING SITE III. Table 2 illustrates the complementarity of the nucleotide sequences of FLJ11259 BINDING SITE, designated SEQ ID:20387, to the nucleotide sequence of VGAM816 RNA, herein designated VGAM RNA, also designated SEQ ID:3527.

Another function of VGAM816 is therefore inhibition of FLJ11259 (Accession NM_018370). Accordingly, utilities of VGAM816 include diagnosis, prevention and treatment of diseases and clinical conditions associated with FLJ11259. FLJ20294 (Accession NM_017749) is another VGAM816 host target gene. FLJ20294 BINDING SITE is HOST TARGET binding site found in the 3' untranslated region of mRNA encoded by FLJ20294, corresponding to a HOST TARGET binding site such as BINDING SITE I, BINDING SITE II or BINDING SITE III. Table 2 illustrates the complementarity of the nucleotide sequences of FLJ20294 BINDING SITE, designated SEQ ID:19353, to the nucleotide sequence of VGAM816 RNA, herein designated VGAM RNA, also designated SEQ ID:3527.

Another function of VGAM816 is therefore inhibition of FLJ20294 (Accession NM_017749). Accordingly, utilities of VGAM816 include diagnosis, prevention and treatment of diseases and clinical conditions associated with FLJ20294. FLJ23604 (Accession NM_025064) is another VGAM816 host target gene. FLJ23604 BINDING SITE is HOST TARGET binding site found in the 3' untranslated region of mRNA encoded by FLJ23604, corresponding to a HOST TARGET binding site such as BINDING SITE I, BINDING SITE II or BINDING SITE III. Table 2 illustrates the complementarity of the nucleotide sequences of FLJ23604 BINDING SITE, designated SEQ ID:24662, to the nucleotide sequence of VGAM816 RNA, herein designated VGAM RNA, also designated SEQ ID:3527.

Another function of VGAM816 is therefore inhibition of FLJ23604 (Accession NM_025064). Accordingly, utilities of VGAM816 include diagnosis, prevention and treatment of diseases and clinical conditions associated with FLJ23604. Junctional Adhesion Molecule 1 (JAM1, Accession NM_144501) is another VGAM816 host target gene. JAM1 BINDING SITE1 through JAM1 BINDING SITE5 are HOST TARGET binding sites found in untranslated regions of mRNA encoded by JAM1, corresponding to HOST TARGET binding sites such as BINDING SITE I, BINDING SITE II or BINDING SITE III. Table 2 illustrates the complementarity of the nucleotide sequences of JAM1 BINDING SITE1 through JAM1 BINDING SITE5, designated SEQ ID:29323, SEQ ID:29332, SEQ ID:29353, SEQ ID:29343 and SEQ ID:18865 respectively, to the nucleotide sequence of VGAM816 RNA, herein designated VGAM RNA, also designated SEQ ID:3527.

Another function of VGAM816 is therefore inhibition of Junctional Adhesion Molecule 1 (JAM1, Accession NM_144501). Accordingly, utilities of VGAM816 include diagnosis, prevention and treatment of diseases and clinical conditions associated with JAM1. KIAA0339 (Accession XM_049380) is another VGAM816 host target gene. KIAA0339 BINDING SITE is HOST TARGET binding site found in the 3' untranslated region of mRNA encoded by KIAA0339, corresponding to a HOST TARGET binding site such as BINDING SITE I, BINDING SITE II or BINDING SITE III. Table 2 illustrates the complementarity of the nucleotide sequences of KIAA0339 BINDING SITE, designated SEQ ID:35405, to the nucleotide sequence of VGAM816 RNA, herein designated VGAM RNA, also designated SEQ ID:3527.

Another function of VGAM816 is therefore inhibition of KIAA0339 (Accession XM_049380). Accordingly, utilities of VGAM816 include diagnosis, prevention and treatment of diseases and clinical conditions associated with KIAA0339. KIAA0350 (Accession XM_028332) is another VGAM816 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30673, to the nucleotide sequence of VGAM816 RNA, herein designated VGAM RNA, also designated SEQ ID:3527.

Another function of VGAM816 is therefore inhibition of KIAA0350 (Accession XM_028332). Accordingly, utilities of VGAM816 include diagnosis, prevention and treatment of diseases and clinical conditions associated with KIAA0350. KIAA1795 (Accession XM_050988) is another VGAM816 host target gene. KIAA1795 BINDING SITE is HOST TARGET binding site found in the 3' untranslated region of mRNA encoded by KIAA1795, corresponding to a HOST TARGET binding site such as BINDING SITE I, BINDING SITE II or BINDING SITE III. Table 2 illustrates the complementarity of the nucleotide sequences of KIAA1795 BINDING SITE, designated SEQ ID:35704, to the nucleotide sequence of VGAM816 RNA, herein designated VGAM RNA, also designated SEQ ID:3527.

Another function of VGAM816 is therefore inhibition of KIAA1795 (Accession XM_050988). Accordingly, utilities of VGAM816 include diagnosis, prevention and treatment of diseases and clinical conditions associated with KIAA1795. PEF (Accession NM_012392) is another VGAM816 host target gene. PEF BINDING SITE is HOST TARGET binding site found in the 3" untranslated region of mRNA encoded by PEF, corresponding to a HOST TARGET binding site such as BINDING SITE I, BINDING SITE II or BINDING SITE III. Table 2 illustrates the complementarity of the nucleotide sequences of PEF BINDING SITE, designated SEQ ID:14748, to the nucleotide sequence of VGAM816 RNA, herein designated VGAM RNA, also designated SEQ ID:3527.

Another function of VGAM816 is therefore inhibition of PEF (Accession NM_012392). Accordingly, utilities of VGAM816 include diagnosis, prevention and treatment of diseases and clinical conditions associated with PEF. PRIC285 (Accession XM_028918) is another VGAM816 host target gene. PRIC285 BINDING SITE is HOST TARGET binding site found in the 3" untranslated region of mRNA encoded by PRIC285, corresponding to a HOST TARGET binding site such as BINDING SITE I, BINDING SITE II or BINDING SITE III. Table 2 illustrates the complementarity of the nucleotide sequences of PRIC285 BINDING SITE, designated SEQ ID:30806, to the nucleotide sequence of VGAM816 RNA, herein designated VGAM RNA, also designated SEQ ID:3527.

Another function of VGAM816 is therefore inhibition of PRIC285 (Accession XM_028918). Accordingly, utilities of VGAM816 include diagnosis, prevention and treatment of diseases and clinical conditions associated with PRIC285. Regulator of G-protein Signalling 20 (RGS20, Accession NM_003702) is another VGAM816 host target gene. RGS20 BINDING SITE is HOST TARGET binding site found in the 3' untranslated region of mRNA encoded by RGS20, corresponding to a HOST TARGET binding site such as BINDING SITE I, BINDING SITE II or BINDING SITE III. Table 2 illustrates the complementarity of the nucleotide sequences of RGS20 BINDING SITE, designated SEQ ID:9803, to the nucleotide sequence of VGAM816 RNA, herein designated VGAM RNA, also designated SEQ ID:3527.

Another function of VGAM816 is therefore inhibition of Regulator of G-protein Signalling 20 (RGS20, Accession NM_003702). Accordingly, utilities of VGAM816 include diagnosis, prevention and treatment of diseases and clinical conditions associated with RGS20. LOC120114 (Accession XM_061871) is another VGAM816 host target gene. LOC120114 BINDING SITE is HOST TARGET binding site found in the 3' untranslated region of mRNA encoded by LOC120114, corresponding to a HOST TARGET binding site such as BINDING SITE I, BINDING SITE II or BINDING SITE III. Table 2 illustrates the complementarity of the nucleotide sequences of LOC120114 BINDING SITE, designated SEQ ID:37216, to the nucleotide sequence of VGAM816 RNA, herein designated VGAM RNA, also designated SEQ ID:3527.

Another function of VGAM816 is therefore inhibition of LOC120114 (Accession XM_061871). Accordingly, utilities of VGAM816 include diagnosis, prevention and treatment of diseases and clinical conditions associated with LOC120114. LOC144817 (Accession XM_084972) is another VGAM816 host target gene. LOC144817 BINDING SITE is HOST TARGET binding site found in the 5' untranslated region of mRNA encoded by LOC144817, corresponding to a HOST TARGET binding site such as BINDING SITE I, BINDING SITE II or BINDING SITE III. Table 2 illustrates the complementarity of the nucleotide sequences of LOC144817 BINDING SITE, designated SEQ ID:37789, to the nucleotide sequence of VGAM816 RNA, herein designated VGAM RNA, also designated SEQ ID:3527.

Another function of VGAM816 is therefore inhibition of LOC144817 (Accession XM_084972). Accordingly, utilities of VGAM816 include diagnosis, prevention and treatment of diseases and clinical conditions associated with LOC144817. LOC151196 (Accession XM_098019) is another VGAM816 host target gene. LOC151196 BINDING SITE is HOST TARGET binding site found in the 5' untranslated region of mRNA encoded by LOC151196, corresponding to a HOST TARGET binding site such as BINDING SITE I, BINDING SITE II or BINDING SITE III. Table 2 illustrates the complementarity of the nucleotide sequences of LOC151196 BINDING SITE, designated SEQ ID:41318, to the nucleotide sequence of VGAM816 RNA, herein designated VGAM RNA, also designated SEQ ID:3527.

Another function of VGAM816 is therefore inhibition of LOC151196 (Accession XM_098019). Accordingly, utilities of VGAM816 include diagnosis, prevention and treatment of diseases and clinical conditions associated with LOC151196. LOC196955 (Accession XM_085210) is another VGAM816 host target gene. LOC196955 BINDING SITE is HOST TARGET binding site found in the 5' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37940, to the nucleotide sequence of VGAM816 RNA, herein designated VGAM RNA, also designated SEQ ID:3527.

Another function of VGAM816 is therefore inhibition of LOC196955 (Accession XM_085210). Accordingly, utilities of VGAM816 include diagnosis, prevention and treatment of diseases and clinical conditions associated with LOC196955. LOC200081 (Accession XM_114110) is another VGAM816 host target gene. LOC200081 BINDING SITE is HOST TARGET binding site found in the 3' untranslated region of mRNA encoded by LOC200081, corresponding to a HOST TARGET binding site such as BINDING SITE I, BINDING SITE II or BINDING SITE III. Table 2 illustrates the complementarity of the nucleotide sequences of LOC200081 BINDING SITE, designated SEQ ID:42706, to the nucleotide sequence of VGAM816 RNA, herein designated VGAM RNA, also designated SEQ ID:3527.

Another function of VGAM816 is therefore inhibition of LOC200081 (Accession XM_114110). Accordingly, utilities of VGAM816 include diagnosis, prevention and treatment of diseases and clinical conditions associated with LOC200081. LOC200488 (Accession XM_117240) is another VGAM816 host target gene. LOC200488 BINDING SITE is HOST TARGET binding site found in the 5' untranslated region of mRNA encoded by LOC200488, corresponding to a HOST TARGET binding site such as BINDING SITE I, BINDING SITE II or BINDING SITE III. Table 2 illustrates the complementarity of the nucleotide sequences of LOC200488 BINDING SITE, designated SEQ ID:43316, to the nucleotide sequence of VGAM816 RNA, herein designated VGAM RNA, also designated SEQ ID:3527.

Another function of VGAM816 is therefore inhibition of LOC200488 (Accession XM_117240). Accordingly, utilities of VGAM816 include diagnosis, prevention and treatment of diseases and clinical conditions associated with LOC200488. LOC58489 (Accession XM_051862) is another VGAM816 host target gene. LOC58489 BINDING SITE is HOST TARGET binding site found in the 3' untranslated region of mRNA encoded by LOC58489, corresponding to a HOST TARGET binding site such as BINDING SITE I, BINDING SITE II or BINDING SITE III. Table 2 illustrates the complementarity of the nucleotide sequences of LOC58489 BINDING SITE, designated SEQ ID:35909, to the nucleotide sequence of VGAM816 RNA, herein designated VGAM RNA, also designated SEQ ID:3527.

Another function of VGAM816 is therefore inhibition of LOC58489 (Accession XM_051862). Accordingly, utilities of VGAM816 include diagnosis, prevention and treatment of diseases and clinical conditions associated with LOC58489. LOC92609 (Accession XM_053074) is another VGAM816 host target gene. LOC92609 BINDING SITE is HOST TARGET binding site found in the 3' untranslated region of mRNA encoded by LOC92609, corresponding to a HOST TARGET binding site such as BINDING SITE I, BINDING SITE II or BINDING SITE III. Table 2 illustrates the complementarity of the nucleotide sequences of LOC92609 BINDING SITE, designated SEQ ID:36062, to the nucleotide sequence of VGAM816 RNA, herein designated VGAM RNA, also designated SEQ ID:3527.

Another function of VGAM816 is therefore inhibition of LOC92609 (Accession XM_053074). Accordingly, utilities of VGAM816 include diagnosis, prevention and treatment of diseases and clinical conditions associated with LOC92609. FIG. 1 further provides a conceptual description of a novel bioinformatically detected viral gene of the present invention, referred to here as Viral Genomic Address Messenger 817 (VGAM817) viral gene, which modulates expression of respective host target genes thereof, the function and utility of which host target genes is known in the art.

VGAM817 is a novel bioinformatically detected regulatory, non protein coding, viral micro RNA (miRNA) gene. The method by which VGAM817 was detected is described hereinabove with reference to FIGS. 1-8.

VGAM817 gene, herein designated VGAM GENE, is a viral gene contained in the genome of Monkeypox Virus. VGAM817 host target gene, herein designated VGAM HOST TARGET GENE, is a human gene contained in the human genome.

VGAM817 gene encodes a VGAM817 precursor RNA, herein designated VGAM PRECURSOR RNA. Similar to other miRNA genes, and unlike most ordinary genes, VGAM817 precursor RNA does not encode a protein. A nucleotide sequence identical or highly similar to the nucleotide sequence of VGAM817 precursor RNA is designated SEQ ID:803, and is provided hereinbelow with reference to the sequence listing part. Nucleotide sequence SEQ ID:803 is located at position 19278 relative to the genome of Monkeypox Virus.

VGAM817 precursor RNA folds onto itself, forming VGAM817 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM817 folded precursor RNA into VGAM817 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM817 RNA is designated SEQ ID:3528, and is provided hereinbelow with reference to the sequence listing part.

VGAM817 host target gene, herein designated VGAM HOST TARGET GENE, encodes a corresponding messenger RNA, VGAM817 host target RNA, herein designated VGAM HOST TARGET RNA. VGAM817 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM817 RNA, herein designated VGAM RNA, binds complementarily to one or more host target binding sites located in untranslated regions of VGAM817 host target RNA, herein designated VGAM HOST TARGET RNA. This complementary binding is due to the fact that the nucleotide sequence of VGAM817 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM817 RNA, herein designated VGAM RNA, may have a different number of host target binding sites in untranslated regions of a VGAM817 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM817 RNA, herein designated VGAM RNA, to host target binding sites on VGAM817 host target RNA, herein designated VGAM HOST TARGET RNA, such as BINDING SITE I, BINDING SITE II and BINDING SITE III, inhibits translation of VGAM817 host target RNA into VGAM817 host target protein, herein designated VGAM HOST TARGET PROTEIN. VGAM host target protein is therefore outlined by a broken line.

It is appreciated that VGAM817 host target gene, herein designated VGAM HOST TARGET GENE, in fact represents a plurality of VGAM817 host target genes. The mRNA of each one of this plurality of VGAM817 host target genes comprises one or more host target binding sites, each having a nucleotide sequence which is at least partly complementary to VGAM817 RNA, herein designated VGAM RNA, and which when bound by VGAM817 RNA causes inhibition of translation of respective one or more VGAM817 host target proteins.

It is further appreciated by one skilled in the art that the mode of translational inhibition illustrated by FIG. 1 with specific reference to translational inhibition exerted by VGAM817 gene, herein designated VGAM GENE, on one or more VGAM817 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM817 is inhibition of expression of host target genes, as part of a novel viral mechanism of attacking a host. Accordingly, utilities of VGAM817 include diagnosis, prevention and treatment of viral infection by Monkeypox Virus. Specific functions, and accordingly utilities, of VGAM817 correlate with, and may be deduced from, the identity of the host target genes which VGAM817 binds and inhibits, and the function of these host target genes, as elaborated hereinbelow.

Nucleotide sequences of the VGAM817 precursor RNA, herein designated VGAM PRECURSOR RNA, and of the 'diced' VGAM817 RNA, herein designated VGAM RNA, and a schematic representation of the secondary folding of VGAM817 folded precursor RNA, herein designated VGAM FOLDED PRECURSOR RNA, of VGAM817 are further described hereinbelow with reference to Table 1.

Nucleotide sequences of host target binding sites, such as BINDING SITE-I, BINDING SITE-II and BINDING SITE-III of FIG. 1, found on VGAM817 host target RNA, and schematic representation of the complementarity of each of these host target binding sites to VGAM817 RNA, herein designated VGAM RNA, are described hereinbelow with reference to Table 2.

As mentioned hereinabove with reference to FIG. 1, a function of VGAM817 gene, herein designated VGAM is inhibition of expression of VGAM817 target genes. It is appreciated that specific functions, and accordingly utilities, of VGAM817 correlate with, and may be deduced from, the identity of the target genes which VGAM817 binds and inhibits, and the function of these target genes, as elaborated hereinbelow.

Autocrine Motility Factor Receptor (AMFR, Accession NM_138958) is a VGAM817 host target gene. AMFR BINDING SITE is HOST TARGET binding site found in the 3' untranslated region of mRNA encoded by AMFR, corresponding to a HOST TARGET binding site such as BINDING SITE I, BINDING SITE II or BINDING SITE III. Table 2 illustrates the complementarity of the nucleotide sequences of AMFR BINDING SITE, designated SEQ ID:29064, to the nucleotide sequence of VGAM817 RNA, herein designated VGAM RNA, also designated SEQ ID:3528.

A function of VGAM817 is therefore inhibition of Autocrine Motility Factor Receptor (AMFR, Accession NM_138958), a gene which acts to stimulate migration of fibrosarcoma cells. Accordingly, utilities of VGAM817 include diagnosis, prevention and treatment of diseases and clinical conditions associated with AMFR. The function of AMFR and its association with various diseases and clinical conditions, has been established by previous studies, as described hereinabove with reference to VGAM440. Chromogranin A (parathyroid secretory protein 1) (CHGA, Accession NM_001275) is another VGAM817 host target gene. CHGA BINDING SITE is HOST TARGET binding site found in the 5' untranslated region of mRNA encoded by CHGA, corresponding to a HOST TARGET binding site such as BINDING SITE I, BINDING SITE II or BINDING SITE III. Table 2 illustrates the complementarity of the nucleotide sequences of CHGA BINDING SITE, designated SEQ ID:6939, to the nucleotide sequence of VGAM817 RNA, herein designated VGAM RNA, also designated SEQ ID:3528.

Another function of VGAM817 is therefore inhibition of Chromogranin A (parathyroid secretory protein 1) (CHGA, Accession NM_001275), a gene which regulates dense-core secretory granule biogenesis and hormone sequestration. Accordingly, utilities of VGAM817 include diagnosis, prevention and treatment of diseases and clinical conditions associated with CHGA. The function of CHGA and its association with various diseases and clinical conditions, has been established by previous studies, as described hereinabove with reference to VGAM440. Coagulation Factor III (thromboplastin, tissue factor) (F3, Accession XM_040465) is another VGAM817 host target gene. F3 BINDING SITE is HOST TARGET binding site found in the 3' untranslated region of mRNA encoded by F3, corresponding to a HOST TARGET binding site such as BINDING SITE I, BINDING SITE II or BINDING SITE III. Table 2 illustrates the complementarity of the nucleotide sequences of F3 BINDING SITE, designated SEQ ID:33297, to the nucleotide sequence of VGAM817 RNA, herein designated VGAM RNA, also designated SEQ ID:3528.

Another function of VGAM817 is therefore inhibition of Coagulation Factor III (thromboplastin, tissue factor) (F3, Accession XM_040465), a gene which functions in normal hemostasis. Accordingly, utilities of VGAM817 include diagnosis, prevention and treatment of diseases and clinical conditions associated with F3. The function of F3 has been established by previous studies. Factor III, a glycoprotein component of cell membranes, is an essential cofactor for factor VII-dependent activation of blood coagulation and activates the extrinsic pathway of blood coagulation in the presence of factor XII and calcium. It may be the primary physiologic initiator of blood coagulation. This may explain why factor III is the only protein in the coagulation pathway for which a congenital deficiency has not been described. Carson et al. (1985) mapped F3 to 1pter-p21 by study of somatic cell hybrids with a species-specific sensitive chromogenic assay. Spicer et al. (1987) isolated cDNA clones for tissue factor. The amino acid sequence deduced from the nucleotide sequence of the cDNAs indicates that tissue factor is synthesized as a higher molecular weight precursor with a leader sequence of 32 amino acids, while the sequence of the mature protein suggests that there are 3 distinct domains: extracellular (residues 1-219), hydrophobic (residues 220-242), and cytoplasmic (residues 243-263). Scarpati et al. (1987) screened a human placenta cDNA library in lambda-gt11 for expression of tissue factor antigens. Among 4 million recombinant clones screened, one that was positive expressed a protein that shares epitopes with authentic human brain tissue factor. The 1.1-kb cDNA insert encodes a peptide containing the N-terminal protein sequence of brain tissue factor. By means of this clone used in hybridization to flow-sorted human chromosomes, Scarpati et al. (1987) showed that the tissue factor gene is located on chromosome 1. Scarpati et al. (1987) used a RFLP to map factor 3 to proximal 1p by multipoint linkage analysis with probes known to span that region. Judging by the location arrived at by somatic cell hybridization, the location of F3 may be in the region 1p22-p21. By in situ hybridization, Kao et al. (1988) likewise mapped F3 to 1p22-p21. Mackman et al. (1989) presented the complete sequence of the F3 gene. It is 12.4 kb long and has 6 exons separated by 5 introns. Mackman et al. (1990) concluded that the tissue factor promoter is relatively complex. Tissue factor (TF) is an integral membrane glycoprotein that, when exposed to plasma, is a potent procoagulant. As stated earlier, it is believed to be the physiologic initiator of blood coagulation. Toomey et al. (1997) found that, in contrast to findings of earlier studies which showed that TF-null mouse embryos did not survive beyond midgestation, 14% of TF-deficient embryos from a hybrid background escaped this early mortality and survived to birth. On gross and microscopic inspection, these late gestation, TF-deficient embryos appeared normal. Furthermore, the growth and vascularity of TF +/+, TF +/-, and TF -/- teratomas and teratocarcinomas were indistinguishable. Toomey et al. (1997) concluded that tumor-derived TF is not required for tumor growth and angiogenesis and that the combined data do not support an essential role for TF in embryonic vascular development.

Full details of the abovementioned studies are described in the following publications, the disclosure of which are hereby incorporated by reference:

Mackman, N.; Fowler, B. J.; Edgington, T. S.; Morrissey, J. H.: Functional analysis of the human tissue factor promoter and induction by serum. Proc. Nat. Acad. Sci. 87:2254-2258, 1990; and Toomey, J. R.; Kratzer, K. E.; Lasky, N. M.; Broze, G. J., JR.: Effect of tissue factor deficiency on mouse and tumor development. Proc. Nat. Acad. Sci. 94: 6922-6926, 1997.

Further studies establishing the function and utilities of F3 are found in John Hopkins OMIM database record ID 134390, and in sited publications numbered 95-9 and 3181-91 listed in the bibliography section hereinbelow, which are also hereby incorporated by reference. Junctophilin 3 (JPH3, Accession NM_020655) is another VGAM817 host target gene. JPH3 BINDING SITE is HOST TARGET binding site found in the 3' untranslated region of mRNA encoded by JPH3, corresponding to a HOST TARGET binding site such as BINDING SITE I, BINDING SITE II or BINDING SITE III. Table 2 illustrates the complementarity of the nucleotide sequences of JPH3 BINDING SITE, designated SEQ ID:21825, to the nucleotide sequence of VGAM817 RNA, herein designated VGAM RNA, also designated SEQ ID:3528.

Another function of VGAM817 is therefore inhibition of Junctophilin 3 (JPH3, Accession NM_020655), a gene which is involved in cytoskeletal organization and cellular growth. Accordingly, utilities of VGAM817 include diagnosis, prevention and treatment of diseases and clinical conditions associated with JPH3. The function of JPH3 and its association with various diseases and clinical conditions, has been established by previous studies, as described hereinabove with reference to VGAM254. Zinc Finger Protein 192 (ZNF192, Accession NM_006298) is another VGAM817 host target gene. ZNF192 BINDING SITE is HOST TARGET binding site found in the 3' untranslated region of mRNA encoded by ZNF192, corresponding to a HOST TARGET binding site such as BINDING SITE I, BINDING SITE II or BINDING SITE III. Table 2 illustrates the complementarity of the nucleotide sequences of ZNF192 BINDING SITE, designated SEQ ID:12988, to the nucleotide sequence of VGAM817 RNA, herein designated VGAM RNA, also designated SEQ ID:3528.

Another function of VGAM817 is therefore inhibition of Zinc Finger Protein 192 (ZNF192, Accession NM_006298). Accordingly, utilities of VGAM817 include diagnosis, prevention and treatment of diseases and clinical conditions associated with ZNF192. Chromosome 1 Open Reading Frame 17 (C1orf17, Accession XM_042965) is another VGAM817 host target gene. C1orf17 BINDING SITE is HOST TARGET binding site found in the 3' untranslated region of mRNA encoded by C1orf17, corresponding to a HOST TARGET binding site such as BINDING SITE I, BINDING SITE II or BINDING SITE III. Table 2 illustrates the complementarity of the nucleotide sequences of C1orf17 BINDING SITE, designated SEQ ID:33852, to the nucleotide sequence of VGAM817 RNA, herein designated VGAM RNA, also designated SEQ ID:3528.

Another function of VGAM817 is therefore inhibition of Chromosome 1 Open Reading Frame 17 (C1orf17, Accession XM_042965). Accordingly, utilities of VGAM817 include diagnosis, prevention and treatment of diseases and clinical conditions associated with C1orf17. Elongation of Very Long Chain Fatty Acids (FEN1/Elo2, SUR4/Elo3, yeast)-like 1 (ELOVL1, Accession NM_022821) is another VGAM817 host target gene. ELOVL1 BINDING SITE is HOST TARGET binding site found in the 3' untranslated region of mRNA encoded by ELOVL1, corresponding to a HOST TARGET binding site such as BINDING SITE I, BINDING SITE II or BINDING SITE III. Table 2 illustrates the complementarity of the nucleotide sequences of ELOVL1 BINDING SITE, designated SEQ ID:23099, to the nucleotide sequence of VGAM817 RNA, herein designated VGAM RNA, also designated SEQ ID:3528.

Another function of VGAM817 is therefore inhibition of Elongation of Very Long Chain Fatty Acids (FEN1/Elo2, SUR4/Elo3, yeast)-like 1 (ELOVL1, Accession NM_022821). Accordingly, utilities of VGAM817 include diagnosis, prevention and treatment of diseases and clinical conditions associated with ELOVL1. FLJ10842 (Accession NM_018238) is another VGAM817 host target gene. FLJ10842 BINDING SITE is HOST TARGET binding site found in the 3' untranslated region of mRNA encoded by FLJ10842, corresponding to a HOST TARGET binding site such as BINDING SITE I, BINDING SITE II or BINDING SITE III. Table 2 illustrates the complementarity of the nucleotide sequences of FLJ10842 BINDING SITE, designated SEQ ID:20187, to the nucleotide sequence of VGAM817 RNA, herein designated VGAM RNA, also designated SEQ ID:3528.

Another function of VGAM817 is therefore inhibition of FLJ10842 (Accession NM_018238). Accordingly, utilities of VGAM817 include diagnosis, prevention and treatment of diseases and clinical conditions associated with FLJ10842. FLJ22969 (Accession XM_044006) is another VGAM817 host target gene. FLJ22969 BINDING SITE is HOST TARGET binding site found in the 3' untranslated region of mRNA encoded by FLJ22969, corresponding to a HOST TARGET binding site such as BINDING SITE I, BINDING SITE II or BINDING SITE III. Table 2 illustrates the complementarity of the nucleotide sequences of FLJ22969 BINDING SITE, designated SEQ ID:34067, to the nucleotide sequence of VGAM817 RNA, herein designated VGAM RNA, also designated SEQ ID:3528.

Another function of VGAM817 is therefore inhibition of FLJ22969 (Accession XM_044006). Accordingly, utilities of VGAM817 include diagnosis, prevention and treatment of diseases and clinical conditions associated with FLJ22969. FLJ23519 (Accession NM_032240) is another VGAM817 host target gene. FLJ23519 BINDING SITE is HOST TARGET binding site found in the 3' untranslated region of mRNA encoded by FLJ23519, corresponding to a HOST TARGET binding site such as BINDING SITE I, BINDING SITE II or BINDING SITE III. Table 2 illustrates the complementarity of the nucleotide sequences of FLJ23519 BINDING SITE, designated SEQ ID:25971, to the nucleotide sequence of VGAM817 RNA, herein designated VGAM RNA, also designated SEQ ID:3528.

Another function of VGAM817 is therefore inhibition of FLJ23519 (Accession NM_032240). Accordingly, utilities of VGAM817 include diagnosis, prevention and treatment of diseases and clinical conditions associated with FLJ23519. KIAA0876 (Accession XM_035625) is another VGAM817 host target gene. KIAA0876 BINDING SITE is HOST TARGET binding site found in the 3' untranslated region of mRNA encoded by KIAA0876, corresponding to a HOST TARGET binding site such as BINDING SITE I, BINDING SITE II or BINDING SITE III. Table 2 illustrates the complementarity of the nucleotide sequences of KIAA0876 BINDING SITE, designated SEQ ID:32294, to the nucleotide sequence of VGAM817 RNA, herein designated VGAM RNA, also designated SEQ ID:3528.

Another function of VGAM817 is therefore inhibition of KIAA0876 (Accession XM_035625). Accordingly, utilities of VGAM817 include diagnosis, prevention and treatment of diseases and clinical conditions associated with KIAA0876. KIAA0961 (Accession NM_014898) is another VGAM817 host target gene. KIAA0961 BINDING SITE is HOST TARGET binding site found in the 3' untranslated region of mRNA encoded by KIAA0961, corresponding to a HOST TARGET binding site such as BINDING SITE I, BINDING SITE II or BINDING SITE III. Table 2 illustrates the complementarity of the nucleotide sequences of KIAA0961 BINDING SITE, designated SEQ ID:17071, to the nucleotide sequence of VGAM817 RNA, herein designated VGAM RNA, also designated SEQ ID:3528.

Another function of VGAM817 is therefore inhibition of KIAA0961 (Accession NM_014898). Accordingly, utilities of VGAM817 include diagnosis, prevention and treatment of diseases and clinical conditions associated with KIAA0961. KIAA1265 (Accession XM_047707) is another VGAM817 host target gene. KIAA1265 BINDING SITE is HOST TARGET binding site found in the 3' untranslated region of mRNA encoded by KIAA1265, corresponding to a HOST TARGET binding site such as BINDING SITE I, BINDING SITE II or BINDING SITE III. Table 2 illustrates the complementarity of the nucleotide sequences of KIAA1265 BINDING SITE, designated SEQ ID:35034, to the nucleotide sequence of VGAM817 RNA, herein designated VGAM RNA, also designated SEQ ID:3528.

Another function of VGAM817 is therefore inhibition of KIAA1265 (Accession XM_047707). Accordingly, utilities of VGAM817 include diagnosis, prevention and treatment of diseases and clinical conditions associated with KIAA1265. KIAA1678 (Accession XM_051221) is another VGAM817 host target gene. KIAA1678 BINDING SITE is HOST TARGET binding site found in the 3' untranslated region of mRNA encoded by KIAA1678, corresponding to a HOST TARGET binding site such as BINDING SITE I, BINDING SITE II or BINDING SITE III. Table 2 illustrates the complementarity of the nucleotide sequences of KIAA1678 BINDING SITE, designated SEQ ID:35788, to the nucleotide sequence of VGAM817 RNA, herein designated VGAM RNA, also designated SEQ ID:3528.

Another function of VGAM817 is therefore inhibition of KIAA1678 (Accession XM_051221). Accordingly, utilities of VGAM817 include diagnosis, prevention and treatment of diseases and clinical conditions associated with KIAA1678. RAB17, Member RAS Oncogene Family (RAB17, Accession NM_022449) is another VGAM817 host target gene. RAB17 BINDING SITE is HOST TARGET binding site found in the 5' untranslated region of mRNA encoded by RAB17, corresponding to a HOST TARGET binding site such as BINDING SITE I, BINDING SITE II or BINDING SITE III. Table 2 illustrates the complementarity of the nucleotide sequences of RAB17 BINDING SITE, designated SEQ ID:22787, to the nucleotide sequence of VGAM817 RNA, herein designated VGAM RNA, also designated SEQ ID:3528.

Another function of VGAM817 is therefore inhibition of RAB17, Member RAS Oncogene Family (RAB17, Accession NM_022449). Accordingly, utilities of VGAM817 include diagnosis, prevention and treatment of diseases and clinical conditions associated with RAB17. Solute Carrier Family 6 (neurotransmitter transporter), Member 14 (SLC6A14, Accession NM_007231) is another VGAM817 host target gene. SLC6A14 BINDING SITE is HOST TARGET binding site found in the 3' untranslated region of mRNA encoded by SLC6A14, corresponding to a HOST TARGET binding site such as BINDING SITE I, BINDING SITE II or BINDING SITE III. Table 2 illustrates the complementarity of the nucleotide sequences of SLC6A14 BINDING SITE, designated SEQ ID:14100, to the nucleotide sequence of VGAM817 RNA, herein designated VGAM RNA, also designated SEQ ID:3528.

Another function of VGAM817 is therefore inhibition of Solute Carrier Family 6 (neurotransmitter transporter), Member 14 (SLC6A14, Accession NM_007231). Accordingly, utilities of VGAM817 include diagnosis, prevention and treatment of diseases and clinical conditions associated with SLC6A14. LOC146229 (Accession XM_085387) is another VGAM817 host target gene. LOC146229 BINDING SITE1 and LOC146229 BINDING SITE2 are HOST TARGET binding sites found in untranslated regions of mRNA encoded by LOC146229, corresponding to HOST TARGET binding sites such as BINDING SITE I, BINDING SITE II or BINDING SITE III. Table 2 illustrates the complementarity of the nucleotide sequences of LOC146229 BINDING SITE1 and LOC146229 BINDING SITE2, designated SEQ ID:38104 and SEQ ID:38105 respectively, to the nucleotide sequence of VGAM817 RNA, herein designated VGAM RNA, also designated SEQ ID:3528.

Another function of VGAM817 is therefore inhibition of LOC146229 (Accession XM_085387). Accordingly, utilities of VGAM817 include diagnosis, prevention and treatment of diseases and clinical conditions associated with LOC146229. LOC164395 (Accession XM_092778) is another VGAM817 host target gene. LOC164395 BINDING SITE is HOST TARGET binding site found in the 5' untranslated region of mRNA encoded by LOC164395, corresponding to a HOST TARGET binding site such as BINDING SITE I, BINDING SITE II or BINDING SITE III. Table 2 illustrates the complementarity of the nucleotide sequences of LOC164395 BINDING SITE, designated SEQ ID:40145, to the nucleotide sequence of VGAM817 RNA, herein designated VGAM RNA, also designated SEQ ID:3528.

Another function of VGAM817 is therefore inhibition of LOC164395 (Accession XM_092778). Accordingly, utilities of VGAM817 include diagnosis, prevention and treatment of diseases and clinical conditions associated with LOC164395. LOC196337 (Accession XM_113696) is another VGAM817 host target gene. LOC196337 BINDING SITE is HOST TARGET binding site found in the 5' untranslated region of mRNA encoded by LOC196337, corresponding to a HOST TARGET binding site such as BINDING SITE I, BINDING SITE II or BINDING SITE III. Table 2 illustrates the complementarity of the nucleotide sequences of LOC196337 BINDING SITE, designated SEQ ID:42358, to the nucleotide sequence of VGAM817 RNA, herein designated VGAM RNA, also designated SEQ ID:3528.

Another function of VGAM817 is therefore inhibition of LOC196337 (Accession XM_113696). Accordingly, utilities of VGAM817 include diagnosis, prevention and treatment of diseases and clinical conditions associated with LOC196337. LOC200197 (Accession XM_114148) is another VGAM817 host target gene. LOC200197 BINDING SITE is HOST TARGET binding site found in the 3' untranslated region of mRNA encoded by LOC200197, corresponding to a HOST TARGET binding site such as BINDING SITE I, BINDING SITE II or BINDING SITE III. Table 2 illustrates the complementarity of the nucleotide sequences of LOC200197 BINDING SITE, designated SEQ ID:42730, to the nucleotide sequence of VGAM817 RNA, herein designated VGAM RNA, also designated SEQ ID:3528.

Another function of VGAM817 is therefore inhibition of LOC200197 (Accession XM_114148). Accordingly, utilities of VGAM817 include diagnosis, prevention and treatment of diseases and clinical conditions associated with LOC200197. LOC200681 (Accession XM_117260) is another VGAM817 host target gene. LOC200681 BINDING SITE is HOST TARGET binding site found in the 5' untranslated region of mRNA encoded by LOC200681, corresponding to a HOST TARGET binding site such as BINDING SITE I, BINDING SITE II or BINDING SITE III. Table 2 illustrates the complementarity of the nucleotide sequences of LOC200681 BINDING SITE, designated SEQ ID:43341, to the nucleotide sequence of VGAM817 RNA, herein designated VGAM RNA, also designated SEQ ID:3528.

Another function of VGAM817 is therefore inhibition of LOC200681 (Accession XM_117260). Accordingly, utilities of VGAM817 include diagnosis, prevention and treatment of diseases and clinical conditions associated with LOC200681. LOC51301 (Accession NM_016591) is another VGAM817 host target gene. LOC51301 BINDING SITE is HOST TARGET binding site found in the 3' untranslated region of mRNA encoded by LOC51301, corresponding to a HOST TARGET binding site such as BINDING SITE I, BINDING SITE II or BINDING SITE III. Table 2 illustrates the complementarity of the nucleotide sequences of LOC51301 BIND- ING SITE, designated SEQ ID:18670, to the nucleotide sequence of VGAM817 RNA, herein designated VGAM RNA, also designated SEQ ID:3528.

Another function of VGAM817 is therefore inhibition of LOC51301 (Accession NM_016591). Accordingly, utilities of VGAM817 include diagnosis, prevention and treatment of diseases and clinical conditions associated with LOC51301. FIG. 1 further provides a conceptual description of a novel bioinformatically detected viral gene of the present invention, referred to here as Viral Genomic Address Messenger 818 (VGAM818) viral gene, which modulates expression of respective host target genes thereof, the function and utility of which host target genes is known in the art.

VGAM818 is a novel bioinformatically detected regulatory, non protein coding, viral micro RNA (miRNA) gene. The method by which VGAM818 was detected is described hereinabove with reference to FIGS. 1-8.

VGAM818 gene, herein designated VGAM GENE, is a viral gene contained in the genome of Monkeypox Virus. VGAM818 host target gene, herein designated VGAM HOST TARGET GENE, is a human gene contained in the human genome.

VGAM818 gene encodes a VGAM818 precursor RNA, herein designated VGAM PRECURSOR RNA. Similar to other miRNA genes, and unlike most ordinary genes, VGAM818 precursor RNA does not encode a protein. A nucleotide sequence identical or highly similar to the nucleotide sequence of VGAM818 precursor RNA is designated SEQ ID:804, and is provided hereinbelow with reference to the sequence listing part. Nucleotide sequence SEQ ID:804 is located at position 27338 relative to the genome of Monkeypox Virus.

VGAM818 precursor RNA folds onto itself, forming VGAM818 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM818 folded precursor RNA into VGAM818 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM818 RNA is designated SEQ ID:3529, and is provided hereinbelow with reference to the sequence listing part.

VGAM818 host target gene, herein designated VGAM HOST TARGET GENE, encodes a corresponding messenger RNA, VGAM818 host target RNA, herein designated VGAM HOST TARGET RNA. VGAM818 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM818 RNA, herein designated VGAM RNA, binds complementarily to one or more host target binding sites located in untranslated regions of VGAM818 host target RNA, herein designated VGAM HOST TARGET RNA. This complementary binding is due to the fact that the nucleotide sequence of VGAM818 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM818 RNA, herein designated VGAM RNA, may have a different number of host target binding sites in untranslated regions of a VGAM818 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM818 RNA, herein designated VGAM RNA, to host target binding sites on VGAM818 host target RNA, herein designated VGAM HOST TARGET RNA, such as BINDING SITE I, BINDING SITE II and BINDING SITE III, inhibits translation of VGAM818 host target RNA into VGAM818 host target protein, herein designated VGAM HOST TARGET PROTEIN. VGAM host target protein is therefore outlined by a broken line.

It is appreciated that VGAM818 host target gene, herein designated VGAM HOST TARGET GENE, in fact represents a plurality of VGAM818 host target genes. The mRNA of each one of this plurality of VGAM818 host target genes comprises one or more host target binding sites, each having a nucleotide sequence which is at least partly complementary to VGAM818 RNA, herein designated VGAM RNA, and which when bound by VGAM818 RNA causes inhibition of translation of respective one or more VGAM818 host target proteins.

It is further appreciated by one skilled in the art that the mode of translational inhibition illustrated by FIG. 1 with specific reference to translational inhibition exerted by VGAM818 gene, herein designated VGAM GENE, on one or more VGAM818 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM818 is inhibition of expression of host target genes, as part of a novel viral mechanism of attacking a host. Accordingly, utilities of VGAM818 include diagnosis, prevention and treatment of viral infection by Monkeypox Virus. Specific functions, and accordingly utilities, of VGAM818 correlate with, and may be deduced from, the identity of the host target genes which VGAM818 binds and inhibits, and the function of these host target genes, as elaborated hereinbelow.

Nucleotide sequences of the VGAM818 precursor RNA, herein designated VGAM PRECURSOR RNA, and of the 'diced' VGAM818 RNA, herein designated VGAM RNA, and a schematic representation of the secondary folding of VGAM818 folded precursor RNA, herein designated VGAM FOLDED PRECURSOR RNA, of VGAM818 are further described hereinbelow with reference to Table 1.

Nucleotide sequences of host target binding sites, such as BINDING SITE-I, BINDING SITE-II and BINDING SITE-III of FIG. 1, found on VGAM818 host target RNA, and schematic representation of the complementarity of each of these host target binding sites to VGAM818 RNA, herein designated VGAM RNA, are described hereinbelow with reference to Table 2.

As mentioned hereinabove with reference to FIG. 1, a function of VGAM818 gene, herein designated VGAM is inhibition of expression of VGAM818 target genes. It is appreciated that specific functions, and accordingly utilities, of VGAM818 correlate with, and may be deduced from, the identity of the target genes which VGAM818 binds and inhibits, and the function of these target genes, as elaborated hereinbelow.

Apical Protein-like (Xenopus laevis) (APXL, Accession NM_001649) is a VGAM818 host target gene. APXL BINDING SITE is HOST TARGET binding site found in the 3' untranslated region of mRNA encoded by APXL, corresponding to a HOST TARGET binding site such as BINDING SITE I, BINDING SITE II or BINDING SITE III. Table 2 illustrates the complementarity of the nucleotide sequences of APXL BINDING SITE, designated SEQ ID:7353, to the nucleotide sequence of VGAM818 RNA, herein designated VGAM RNA, also designated SEQ ID:3529.

A function of VGAM818 is therefore inhibition of Apical Protein-like (Xenopus laevis) (APXL, Accession NM_001649), a gene which is implicated in amiloride-sensitive sodium channel activity. Accordingly, utilities of VGAM818 include diagnosis, prevention and treatment of diseases and clinical conditions associated with APXL. The function of APXL and its association with various diseases and clinical conditions, has been established by previous studies, as described hereinabove with reference to VGAM152. LOC150142 (Accession XM_086791) is another VGAM818 host target gene. LOC150142 BINDING SITE is HOST TARGET binding site found in the 5' untranslated region of mRNA encoded by LOC150142, corresponding to a HOST TARGET binding site such as BINDING SITE I, BINDING SITE II or BINDING SITE III. Table 2 illustrates the complementarity of the nucleotide sequences of LOC150142 BINDING SITE, designated SEQ ID:38849, to the nucleotide sequence of VGAM818 RNA, herein designated VGAM RNA, also designated SEQ ID:3529.

Another function of VGAM818 is therefore inhibition of LOC150142 (Accession XM_086791). Accordingly, utilities of VGAM818 include diagnosis, prevention and treatment of diseases and clinical conditions associated with LOC150142. LOC202316 (Accession XM_117380) is another VGAM818 host target gene. LOC202316 BINDING SITE is HOST TARGET binding site found in the 3' untranslated region of mRNA encoded by LOC202316, corresponding to a HOST TARGET binding site such as BINDING SITE I, BINDING SITE II or BINDING SITE III. Table 2 illustrates the complementarity of the nucleotide sequences of LOC202316 BINDING SITE, designated SEQ ID:43424, to the nucleotide sequence of VGAM818 RNA, herein designated VGAM RNA, also designated SEQ ID:3529.

Another function of VGAM818 is therefore inhibition of LOC202316 (Accession XM_117380). Accordingly, utilities of VGAM818 include diagnosis, prevention and treatment of diseases and clinical conditions associated with LOC202316. LOC90190 (Accession XM_029758) is another VGAM818 host target gene. LOC90190 BINDING SITE is HOST TARGET binding site found in the 3' untranslated region of mRNA encoded by LOC90190, corresponding to a HOST TARGET binding site such as BINDING SITE I, BINDING SITE II or BINDING SITE III. Table 2 illustrates the complementarity of the nucleotide sequences of LOC90190 BINDING SITE, designated SEQ ID:30945, to the nucleotide sequence of VGAM818 RNA, herein designated VGAM RNA, also designated SEQ ID:3529.

Another function of VGAM818 is therefore inhibition of LOC90190 (Accession XM_029758). Accordingly, utilities of VGAM818 include diagnosis, prevention and treatment of diseases and clinical conditions associated with LOC90190. FIG. 1 further provides a conceptual description of a novel bioinformatically detected viral gene of the present invention, referred to here as Viral Genomic Address Messenger 819 (VGAM819) viral gene, which modulates expression of respective host target genes thereof, the function and utility of which host target genes is known in the art.

VGAM819 is a novel bioinformatically detected regulatory, non protein coding, viral micro RNA (miRNA) gene. The method by which VGAM819 was detected is described hereinabove with reference to FIGS. 1-8.

VGAM819 gene, herein designated VGAM GENE, is a viral gene contained in the genome of Ateline Herpesvirus 3. VGAM819 host target gene, herein designated VGAM HOST TARGET GENE, is a human gene contained in the human genome.

VGAM819 gene encodes a VGAM819 precursor RNA, herein designated VGAM PRECURSOR RNA. Similar to other miRNA genes, and unlike most ordinary genes, VGAM819 precursor RNA does not encode a protein. A nucleotide sequence identical or highly similar to the nucleotide sequence of VGAM819 precursor RNA is designated SEQ ID:805, and is provided hereinbelow with reference to the sequence listing part. Nucleotide sequence SEQ ID:805 is located at position 92255 relative to the genome of Ateline Herpesvirus 3.

VGAM819 precursor RNA folds onto itself, forming VGAM819 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM819 folded precursor RNA into VGAM819 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM819 RNA is designated SEQ ID:3530, and is provided hereinbelow with reference to the sequence listing part.

VGAM819 host target gene, herein designated VGAM HOST TARGET GENE, encodes a corresponding messenger RNA, VGAM819 host target RNA, herein designated VGAM HOST TARGET RNA. VGAM819 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM819 RNA, herein designated VGAM RNA, binds complementarily to one or more host target binding sites located in untranslated regions of VGAM819 host target RNA, herein designated VGAM HOST TARGET RNA. This complementary binding is due to the fact that the nucleotide sequence of VGAM819 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM819 RNA, herein designated VGAM RNA, may have a different number of host target binding sites in untranslated regions of a VGAM819 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM819 RNA, herein designated VGAM RNA, to host target binding sites on VGAM819 host target RNA, herein designated VGAM HOST TARGET RNA, such as BINDING SITE I, BINDING SITE II and BINDING SITE III, inhibits translation of VGAM819 host target RNA into VGAM819 host target protein, herein designated VGAM HOST TARGET PROTEIN. VGAM host target protein is therefore outlined by a broken line.

It is appreciated that VGAM819 host target gene, herein designated VGAM HOST TARGET GENE, in fact represents a plurality of VGAM819 host target genes. The mRNA of each one of this plurality of VGAM819 host target genes comprises one or more host target binding sites, each having a nucleotide sequence which is at least partly complementary to VGAM819 RNA, herein designated VGAM RNA, and which when bound by VGAM819 RNA causes inhibition of translation of respective one or more VGAM819 host target proteins.

It is further appreciated by one skilled in the art that the mode of translational inhibition illustrated by FIG. 1 with specific reference to translational inhibition exerted by VGAM819 gene, herein designated VGAM GENE, on one or more VGAM819 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM819 is inhibition of expression of host target genes, as part of a novel viral mechanism of attacking a host. Accordingly, utilities of VGAM819 include diagnosis, prevention and treatment of viral infection by Ateline Herpesvirus 3. Specific functions, and accordingly utilities, of VGAM819 correlate with, and may be deduced from, the identity of the host target genes which VGAM819 binds and inhibits, and the function of these host target genes, as elaborated hereinbelow.

Nucleotide sequences of the VGAM819 precursor RNA, herein designated VGAM PRECURSOR RNA, and of the 'diced' VGAM819 RNA, herein designated VGAM RNA, and a schematic representation of the secondary folding of VGAM819 folded precursor RNA, herein designated VGAM FOLDED PRECURSOR RNA, of VGAM819 are further described hereinbelow with reference to Table 1.

Nucleotide sequences of host target binding sites, such as BINDING SITE-I, BINDING SITE-II and BINDING SITE-III of FIG. 1, found on VGAM819 host target RNA, and schematic representation of the complementarity of each of these host target binding sites to VGAM819 RNA, herein designated VGAM RNA, are described hereinbelow with reference to Table 2.

As mentioned hereinabove with reference to FIG. 1, a function of VGAM819 gene, herein designated VGAM is inhibition of expression of VGAM819 target genes. It is appreciated that specific functions, and accordingly utilities, of VGAM819 correlate with, and may be deduced from, the identity of the target genes which VGAM819 binds and inhibits, and the function of these target genes, as elaborated hereinbelow.

Dystrophin (muscular dystrophy, Duchenne and Becker types) (DMD, Accession NM_000109) is a VGAM819 host target gene. DMD BINDING SITE1 through DMD BINDING SITE13 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 through DMD BINDING SITE13, designated SEQ ID:5575, SEQ ID:10158, SEQ ID:10165, SEQ ID:10189, SEQ ID:10206, SEQ ID:10179, SEQ ID:10216, SEQ ID:10240, SEQ ID:10228, SEQ ID:10171, SEQ ID:10184, SEQ ID:10211 and SEQ ID:10201 respectively, to the nucleotide sequence of VGAM819 RNA, herein designated VGAM RNA, also designated SEQ ID:3530.

A function of VGAM819 is therefore inhibition of Dystrophin (muscular dystrophy, Duchenne and Becker types) (DMD, Accession NM_000109), a gene which muscular dystrophy. Accordingly, utilities of VGAM819 include diagnosis, prevention and treatment of diseases and clinical conditions associated with DMD. The function of DMD and its association with various diseases and clinical conditions, has been established by previous studies, as described hereinabove with reference to VGAM218. SSH2 (Accession XM_030846) is another VGAM819 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31189, to the nucleotide sequence of VGAM819 RNA, herein designated VGAM RNA, also designated SEQ ID:3530.

Another function of VGAM819 is therefore inhibition of SSH2 (Accession XM_030846). Accordingly, utilities of VGAM819 include diagnosis, prevention and treatment of diseases and clinical conditions associated with SSH2. LOC123036 (Accession XM_058676) is another VGAM819 host target gene. LOC123036 BINDING SITE is HOST TARGET binding site found in the 3' untranslated region of mRNA encoded by LOC123036, corresponding to a HOST TARGET binding site such as BINDING SITE I, BINDING SITE II or BINDING SITE III. Table 2 illustrates the complementarity of the nucleotide sequences of LOC123036 BINDING SITE, designated SEQ ID:36719, to the nucleotide sequence of VGAM819 RNA, herein designated VGAM RNA, also designated SEQ ID:3530.

Another function of VGAM819 is therefore inhibition of LOC123036 (Accession XM_058676). Accordingly, utilities of VGAM819 include diagnosis, prevention and treatment of diseases and clinical conditions associated with LOC123036.

FIG. 1 further provides a conceptual description of a novel bioinformatically detected viral gene of the present invention, referred to here as Viral Genomic Address Messenger 820 (VGAM820) viral gene, which modulates expression of respective host target genes thereof, the function and utility of which host target genes is known in the art.

VGAM820 is a novel bioinformatically detected regulatory, non protein coding, viral micro RNA (miRNA) gene. The method by which VGAM820 was detected is described hereinabove with reference to FIGS. 1-8.

VGAM820 gene, herein designated VGAM GENE, is a viral gene contained in the genome of Saimiriine Herpesvirus 2. VGAM820 host target gene, herein designated VGAM HOST TARGET GENE, is a human gene contained in the human genome.

VGAM820 gene encodes a VGAM820 precursor RNA, herein designated VGAM PRECURSOR RNA. Similar to other miRNA genes, and unlike most ordinary genes, VGAM820 precursor RNA does not encode a protein. A nucleotide sequence identical or highly similar to the nucleotide sequence of VGAM820 precursor RNA is designated SEQ ID:806, and is provided hereinbelow with reference to the sequence listing part. Nucleotide sequence SEQ ID:806 is located at position 97653 relative to the genome of Saimiriine Herpesvirus 2.

VGAM820 precursor RNA folds onto itself, forming VGAM820 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM820 folded precursor RNA into VGAM820 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM820 RNA is designated SEQ ID:3531, and is provided hereinbelow with reference to the sequence listing part.

VGAM820 host target gene, herein designated VGAM HOST TARGET GENE, encodes a corresponding messenger RNA, VGAM820 host target RNA, herein designated VGAM HOST TARGET RNA. VGAM820 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM820 RNA, herein designated VGAM RNA, binds complementarily to one or more host target binding sites located in untranslated regions of VGAM820 host target RNA, herein designated VGAM HOST TARGET RNA. This complementary binding is due to the fact that the nucleotide sequence of VGAM820 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM820 RNA, herein designated VGAM RNA, may have a different number of host target binding sites in untranslated regions of a VGAM820 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM820 RNA, herein designated VGAM RNA, to host target binding sites on VGAM820 host target RNA, herein designated VGAM HOST TARGET RNA, such as BINDING SITE I, BINDING SITE II and BINDING SITE III, inhibits translation of VGAM820 host target RNA into VGAM820 host target protein, herein designated VGAM HOST TARGET PROTEIN. VGAM host target protein is therefore outlined by a broken line.

It is appreciated that VGAM820 host target gene, herein designated VGAM HOST TARGET GENE, in fact represents a plurality of VGAM820 host target genes. The mRNA of each one of this plurality of VGAM820 host target genes comprises one or more host target binding sites, each having a nucleotide sequence which is at least partly complementary to VGAM820 RNA, herein designated VGAM RNA, and which when bound by VGAM820 RNA causes inhibition of translation of respective one or more VGAM820 host target proteins.

It is further appreciated by one skilled in the art that the mode of translational inhibition illustrated by FIG. 1 with specific reference to translational inhibition exerted by VGAM820 gene, herein designated VGAM GENE, on one or more VGAM820 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM820 is inhibition of expression of host target genes, as part of a novel viral mechanism of attacking a host. Accordingly, utilities of VGAM820 include diagnosis, prevention and treatment of viral infection by Saimiriine Herpesvirus 2. Specific functions, and accordingly utilities, of VGAM820 correlate with, and may be deduced from, the identity of the host target genes which VGAM820 binds and inhibits, and the function of these host target genes, as elaborated hereinbelow.

Nucleotide sequences of the VGAM820 precursor RNA, herein designated VGAM PRECURSOR RNA, and of the 'diced' VGAM820 RNA, herein designated VGAM RNA, and a schematic representation of the secondary folding of VGAM820 folded precursor RNA, herein designated VGAM FOLDED PRECURSOR RNA, of VGAM820 are further described hereinbelow with reference to Table 1.

Nucleotide sequences of host target binding sites, such as BINDING SITE-I, BINDING SITE-II and BINDING SITE-III of FIG. 1, found on VGAM820 host target RNA, and schematic representation of the complementarity of each of these host target binding sites to VGAM820 RNA, herein designated VGAM RNA, are described hereinbelow with reference to Table 2.

As mentioned hereinabove with reference to FIG. 1, a function of VGAM820 gene, herein designated VGAM is inhibition of expression of VGAM820 target genes. It is appreciated that specific functions, and accordingly utilities, of VGAM820 correlate with, and may be deduced from, the identity of the target genes which VGAM820 binds and inhibits, and the function of these target genes, as elaborated hereinbelow.

Kelch-like 3 (Drosophila) (KLHL3, Accession XM_113450) is a VGAM820 host target gene. KLHL3 BINDING SITE is HOST TARGET binding site found in the 3' untranslated region of mRNA encoded by KLHL3, corresponding to a HOST TARGET binding site such as BINDING SITE I, BINDING SITE II or BINDING SITE III. Table 2 illustrates the complementarity of the nucleotide sequences of KLHL3 BINDING SITE, designated SEQ ID:42265, to the nucleotide sequence of VGAM820 RNA, herein designated VGAM RNA, also designated SEQ ID:3531.

A function of VGAM820 is therefore inhibition of Kelch-like 3 (Drosophila) (KLHL3, Accession XM_113450). Accordingly, utilities of VGAM820 include diagnosis, prevention and treatment of diseases and clinical conditions associated with KLHL3. Protocadherin 11 X-linked (PCDH11X, Accession NM_032969) is another VGAM820 host target gene. PCDH11X BINDING SITE1 and PCDH11X BINDING SITE2 are HOST TARGET binding sites found in untranslated regions of mRNA encoded by PCDH11X, corresponding to HOST TARGET binding sites such as BINDING SITE I, BINDING SITE II or BINDING SITE III. Table 2 illustrates the complementarity of the nucleotide sequences of PCDH11X BINDING SITE1 and PCDH11X BINDING SITE2, designated SEQ ID:26801 and SEQ ID:26786 respectively, to the nucleotide sequence of VGAM820 RNA, herein designated VGAM RNA, also designated SEQ ID:3531.

Another function of VGAM820 is therefore inhibition of Protocadherin 11 X-linked (PCDH11X, Accession NM_032969), a gene which is thought to play a fundamental role in cell-cell recognition essential for the segmental development and function of the central nervous system. Accordingly, utilities of VGAM820 include diagnosis, prevention and treatment of diseases and clinical conditions associated with PCDH11X. The function of PCDH11X and its association with various diseases and clinical conditions, has been established by previous studies, as described hereinabove with reference to VGAM433. FLJ12476 (Accession NM_022784) is another VGAM820 host target gene. FLJ12476 BINDING SITE is HOST TARGET binding site found in the 3' untranslated region of mRNA encoded by FLJ12476, corresponding to a HOST TARGET binding site such as BINDING SITE I, BINDING SITE II or BINDING SITE III. Table 2 illustrates the complementarity of the nucleotide sequences of FLJ12476 BINDING SITE, designated SEQ ID:23067, to the nucleotide sequence of VGAM820 RNA, herein designated VGAM RNA, also designated SEQ ID:3531.

Another function of VGAM820 is therefore inhibition of FLJ12476 (Accession NM_022784). Accordingly, utilities of VGAM820 include diagnosis, prevention and treatment of diseases and clinical conditions associated with FLJ12476. FIG. 1 further provides a conceptual description of a novel bioinformatically detected viral gene of the present invention, referred to here as Viral Genomic Address Messenger 821 (VGAM821) viral gene, which modulates expression of respective host target genes thereof, the function and utility of which host target genes is known in the art.

VGAM821 is a novel bioinformatically detected regulatory, non protein coding, viral micro RNA (miRNA) gene. The method by which VGAM821 was detected is described hereinabove with reference to FIGS. 1-8.

VGAM821 gene, herein designated VGAM GENE, is a viral gene contained in the genome of Human Herpesvirus 6. VGAM821 host target gene, herein designated VGAM HOST TARGET GENE, is a human gene contained in the human genome.

VGAM821 gene encodes a VGAM821 precursor RNA, herein designated VGAM PRECURSOR RNA. Similar to other miRNA genes, and unlike most ordinary genes, VGAM821 precursor RNA does not encode a protein. A nucleotide sequence identical or highly similar to the nucleotide sequence of VGAM821 precursor RNA is designated SEQ ID:807, and is provided hereinbelow with reference to the sequence listing part. Nucleotide sequence SEQ ID:807 is located at position 120037 relative to the genome of Human Herpesvirus 6.

VGAM821 precursor RNA folds onto itself, forming VGAM821 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM821 folded precursor RNA into VGAM821 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 90%) nucleotide sequence of VGAM821 RNA is designated SEQ ID:3532, and is provided hereinbelow with reference to the sequence listing part.

VGAM821 host target gene, herein designated VGAM HOST TARGET GENE, encodes a corresponding messenger RNA, VGAM821 host target RNA, herein designated VGAM HOST TARGET RNA. VGAM821 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM821 RNA, herein designated VGAM RNA, binds complementarily to one or more host target binding sites located in untranslated regions of VGAM821 host target RNA, herein designated VGAM HOST TARGET RNA. This complementary binding is due to the fact that the nucleotide sequence of VGAM821 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM821 RNA, herein designated VGAM RNA, may have a different number of host target binding sites in untranslated regions of a VGAM821 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM821 RNA, herein designated VGAM RNA, to host target binding sites on VGAM821 host target RNA, herein designated VGAM HOST TARGET RNA, such as BINDING SITE I, BINDING SITE II and BINDING SITE III, inhibits translation of VGAM821 host target RNA into VGAM821 host target protein, herein designated VGAM HOST TARGET PROTEIN.

VGAM host target protein is therefore outlined by a broken line.

It is appreciated that VGAM821 host target gene, herein designated VGAM HOST TARGET GENE, in fact represents a plurality of VGAM821 host target genes. The mRNA of each one of this plurality of VGAM821 host target genes comprises one or more host target binding sites, each having a nucleotide sequence which is at least partly complementary to VGAM821 RNA, herein designated VGAM RNA, and which when bound by VGAM821 RNA causes inhibition of translation of respective one or more VGAM821 host target proteins.

It is further appreciated by one skilled in the art that the mode of translational inhibition illustrated by FIG. 1 with specific reference to translational inhibition exerted by VGAM821 gene, herein designated VGAM GENE, on one or more VGAM821 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM821 is inhibition of expression of host target genes, as part of a novel viral mechanism of attacking a host. Accordingly, utilities of VGAM821 include diagnosis, prevention and treatment of viral infection by Human Herpesvirus 6. Specific functions, and accordingly utilities, of VGAM821 correlate with, and may be deduced from, the identity of the host target genes which VGAM821 binds and inhibits, and the function of these host target genes, as elaborated hereinbelow.

Nucleotide sequences of the VGAM821 precursor RNA, herein designated VGAM PRECURSOR RNA, and of the 'diced' VGAM821 RNA, herein designated VGAM RNA, and a schematic representation of the secondary folding of VGAM821 folded precursor RNA, herein designated VGAM FOLDED PRECURSOR RNA, of VGAM821 are further described hereinbelow with reference to Table 1.

Nucleotide sequences of host target binding sites, such as BINDING SITE-I, BINDING SITE-II and BINDING SITE-III of FIG. 1, found on VGAM821 host target RNA, and schematic representation of the complementarity of each of these host target binding sites to VGAM821 RNA, herein designated VGAM RNA, are described hereinbelow with reference to Table 2.

As mentioned hereinabove with reference to FIG. 1, a function of VGAM821 gene, herein designated VGAM is inhibition of expression of VGAM821 target genes. It is appreciated that specific functions, and accordingly utilities, of VGAM821 correlate with, and may be deduced from, the identity of the target genes which VGAM821 binds and inhibits, and the function of these target genes, as elaborated hereinbelow.

Deoxyguanosine Kinase (DGUOK, Accession NM_080915) is a VGAM821 host target gene. DGUOK BINDING SITE is HOST TARGET binding site found in the 3' untranslated region of mRNA encoded by DGUOK, corresponding to a HOST TARGET binding site such as BINDING SITE I, BINDING SITE II or BINDING SITE III. Table 2 illustrates the complementarity of the nucleotide sequences of DGUOK BINDING SITE, designated SEQ ID:28133, to the nucleotide sequence of VGAM821 RNA, herein designated VGAM RNA, also designated SEQ ID:3532.

A function of VGAM821 is therefore inhibition of Deoxyguanosine Kinase (DGUOK, Accession NM_080915), a gene which is deoxyguanosine kinase and mediates phosphorylation of several deoxyribonucleosides. Accordingly, utilities of VGAM821 include diagnosis, prevention and treatment of diseases and clinical conditions associated with DGUOK. The function of DGUOK and its association with various diseases and clinical conditions, has been established by previous studies, as described hereinabove with reference to VGAM121. Deleted In Lung and Esophageal Cancer 1 (DLEC1, Accession NM_007336) is another VGAM821 host target gene. DLEC1 BINDING SITE1 and DLEC1 BINDING SITE2 are HOST TARGET binding sites found in untranslated regions of mRNA encoded by DLEC1, corresponding to HOST TARGET binding sites such as BINDING SITE I, BINDING SITE II or BINDING SITE III. Table 2 illustrates the complementarity of the nucleotide sequences of DLEC1 BINDING SITE1 and DLEC1 BINDING SITE2, designated SEQ ID:14263 and SEQ ID:14269 respectively, to the nucleotide sequence of VGAM821 RNA, herein designated VGAM RNA, also designated SEQ ID:3532.

Another function of VGAM821 is therefore inhibition of Deleted In Lung and Esophageal Cancer 1 (DLEC1, Accession NM_007336). Accordingly, utilities of VGAM821 include diagnosis, prevention and treatment of diseases and clinical conditions associated with DLEC1. Neuronal Pentraxin I (NPTX1, Accession NM_002522) is another VGAM821 host target gene. NPTX1 BINDING SITE is HOST TARGET binding site found in the 3' untranslated region of mRNA encoded by NPTX1, corresponding to a HOST TARGET binding site such as BINDING SITE I, BINDING SITE II or BINDING SITE III. Table 2 illustrates the complementarity of the nucleotide sequences of NPTX1 BINDING SITE, designated SEQ ID:8352, to the nucleotide sequence of VGAM821 RNA, herein designated VGAM RNA, also designated SEQ ID:3532.

Another function of VGAM821 is therefore inhibition of Neuronal Pentraxin I (NPTX1, Accession NM_002522), a gene which may be involved in synaptic uptake of extracellular material and is very strongly similar to rat NP1. Accordingly, utilities of VGAM821 include diagnosis, prevention and treatment of diseases and clinical conditions associated with NPTX1. The function of NPTX1 and its association with various diseases and clinical conditions, has been established by previous studies, as described hereinabove with reference to VGAM111. Suppressor of Fused Homolog (Drosophila) (SUFU, Accession NM_016169) is another VGAM821 host target gene. SUFU BINDING SITE is HOST TARGET binding site found in the 3' untranslated region of mRNA encoded by SUFU, corresponding to a HOST TARGET binding site such as BINDING SITE I, BINDING SITE II or BINDING SITE III. Table 2 illustrates the complementarity of the nucleotide sequences of SUFU BINDING SITE, designated SEQ ID:18249, to the nucleotide sequence of VGAM821 RNA, herein designated VGAM RNA, also designated SEQ ID:3532.

Another function of VGAM821 is therefore inhibition of Suppressor of Fused Homolog (Drosophila) (SUFU, Accession NM_016169). Accordingly, utilities of VGAM821 include diagnosis, prevention and treatment of diseases and clinical conditions associated with SUFU. CG012 (Accession XM_096710) is another VGAM821 host target gene. CG012 BINDING SITE is HOST TARGET binding site found in the 3' untranslated region of mRNA encoded by CG012, corresponding to a HOST TARGET binding site such as BINDING SITE I, BINDING SITE II or BINDING SITE III. Table 2 illustrates the complementarity of the nucleotide sequences of CG012 BINDING SITE, designated SEQ ID:40491, to the nucleotide sequence of VGAM821 RNA, herein designated VGAM RNA, also designated SEQ ID:3532.

Another function of VGAM821 is therefore inhibition of CG012 (Accession XM_096710). Accordingly, utilities of VGAM821 include diagnosis, prevention and treatment of diseases and clinical conditions associated with CG012. FLJ20396 (Accession NM_017801) is another VGAM821 host target gene. FLJ20396 BINDING SITE is HOST TARGET binding site found in the 3' untranslated region of mRNA encoded by FLJ20396, corresponding to a HOST TARGET binding site such as BINDING SITE I, BINDING SITE II or BINDING SITE III. Table 2 illustrates the complementarity of the nucleotide sequences of FLJ20396 BINDING SITE, designated SEQ ID:19445, to the nucleotide sequence of VGAM821 RNA, herein designated VGAM RNA, also designated SEQ ID:3532.

Another function of VGAM821 is therefore inhibition of FLJ20396 (Accession NM_017801). Accordingly, utilities of VGAM821 include diagnosis, prevention and treatment of diseases and clinical conditions associated with FLJ20396. KIAA0276 (Accession XM_048199) is another VGAM821 host target gene. KIAA0276 BINDING SITE is HOST TARGET binding site found in the 3' untranslated region of mRNA encoded by KIAA0276, corresponding to a HOST TARGET binding site such as BINDING SITE I, BINDING SITE II or BINDING SITE III. Table 2 illustrates the complementarity of the nucleotide sequences of KIAA0276 BINDING SITE, designated SEQ ID:35134, to the nucleotide sequence of VGAM821 RNA, herein designated VGAM RNA, also designated SEQ ID:3532.

Another function of VGAM821 is therefore inhibition of KIAA0276 (Accession XM_048199). Accordingly, utilities of VGAM821 include diagnosis, prevention and treatment of diseases and clinical conditions associated with KIAA0276. FIG. 1 further provides a conceptual description of a novel bioinformatically detected viral gene of the present invention, referred to here as Viral Genomic Address Messenger 822 (VGAM822) viral gene, which modulates expression of respective host target genes thereof, the function and utility of which host target genes is known in the art.

VGAM822 is a novel bioinformatically detected regulatory, non protein coding, viral micro RNA (miRNA) gene. The method by which VGAM822 was detected is described hereinabove with reference to FIGS. 1-8.

VGAM822 gene, herein designated VGAM GENE, is a viral gene contained in the genome of Human Herpesvirus 6. VGAM822 host target gene, herein designated VGAM HOST TARGET GENE, is a human gene contained in the human genome.

VGAM822 gene encodes a VGAM822 precursor RNA, herein designated VGAM PRECURSOR RNA. Similar to other miRNA genes, and unlike most ordinary genes, VGAM822 precursor RNA does not encode a protein. A nucleotide sequence identical or highly similar to the nucleotide sequence of VGAM822 precursor RNA is designated SEQ ID:808, and is provided hereinbelow with reference to the sequence listing part. Nucleotide sequence SEQ ID:808 is located at position 117925 relative to the genome of Human Herpesvirus 6.

VGAM822 precursor RNA folds onto itself, forming VGAM822 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM822 folded precursor RNA into VGAM822 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM822 RNA is designated SEQ ID:3533, and is provided hereinbelow with reference to the sequence listing part.

VGAM822 host target gene, herein designated VGAM HOST TARGET GENE, encodes a corresponding messenger RNA, VGAM822 host target RNA, herein designated VGAM HOST TARGET RNA. VGAM822 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM822 RNA, herein designated VGAM RNA, binds complementarily to one or more host target binding sites located in untranslated regions of VGAM822 host target RNA, herein designated VGAM HOST TARGET RNA. This complementary binding is due to the fact that the nucleotide sequence of VGAM822 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM822 RNA, herein designated VGAM RNA, may have a different number of host target binding sites in untranslated regions of a VGAM822 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM822 RNA, herein designated VGAM RNA, to host target binding sites on VGAM822 host target RNA, herein designated VGAM HOST TARGET RNA, such as BINDING SITE I, BINDING SITE II and BINDING SITE III, inhibits translation of VGAM822 host target RNA into VGAM822 host target protein, herein designated VGAM HOST TARGET PROTEIN. VGAM host target protein is therefore outlined by a broken line.

It is appreciated that VGAM822 host target gene, herein designated VGAM HOST TARGET GENE, in fact represents a plurality of VGAM822 host target genes. The mRNA of each one of this plurality of VGAM822 host target genes comprises one or more host target binding sites, each having a nucleotide sequence which is at least partly complementary to VGAM822 RNA, herein designated VGAM RNA, and which when bound by VGAM822 RNA causes inhibition of translation of respective one or more VGAM822 host target proteins.

It is further appreciated by one skilled in the art that the mode of translational inhibition illustrated by FIG. 1 with specific reference to translational inhibition exerted by VGAM822 gene, herein designated VGAM GENE, on one or more VGAM822 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM822 is inhibition of expression of host target genes, as part of a novel viral mechanism of attacking a host. Accordingly, utilities of VGAM822 include diagnosis, prevention and treatment of viral infection by Human Herpesvirus 6. Specific functions, and accordingly utilities, of VGAM822 correlate with, and may be deduced from, the identity of the host target genes which VGAM822 binds and inhibits, and the function of these host target genes, as elaborated hereinbelow.

Nucleotide sequences of the VGAM822 precursor RNA, herein designated VGAM PRECURSOR RNA, and of the 'diced' VGAM822 RNA, herein designated VGAM RNA, and a schematic representation of the secondary folding of VGAM822 folded precursor RNA, herein designated VGAM FOLDED PRECURSOR RNA, of VGAM822 are further described hereinbelow with reference to Table 1.

Nucleotide sequences of host target binding sites, such as BINDING SITE-I, BINDING SITE-II and BINDING SITE-III of FIG. 1, found on VGAM822 host target RNA, and schematic representation of the complementarity of each of these host target binding sites to VGAM822 RNA, herein designated VGAM RNA, are described hereinbelow with reference to Table 2.

As mentioned hereinabove with reference to FIG. 1, a function of VGAM822 gene, herein designated VGAM is inhibition of expression of VGAM822 target genes. It is appreciated that specific functions, and accordingly utilities, of VGAM822 correlate with, and may be deduced from, the identity of the target genes which VGAM822 binds and inhibits, and the function of these target genes, as elaborated hereinbelow.

V-maf Musculoaponeurotic Fibrosarcoma Oncogene Homolog (avian) (MAF, Accession NM_005360) is a VGAM822 host target gene. MAF BINDING SITE is HOST TARGET binding site found in the 5' untranslated region of mRNA encoded by MAF, corresponding to a HOST TARGET binding site such as BINDING SITE I, BINDING SITE II or BINDING SITE III. Table 2 illustrates the complementarity of the nucleotide sequences of MAF BINDING SITE, designated SEQ ID:11838, to the nucleotide sequence of VGAM822 RNA, herein designated VGAM RNA, also designated SEQ ID:3533.

A function of VGAM822 is therefore inhibition of V-maf Musculoaponeurotic Fibrosarcoma Oncogene Homolog (avian) (MAF, Accession NM_005360), a gene which is a transcription factor; contains a leucine zipper motif. Accordingly, utilities of VGAM822 include diagnosis, prevention and treatment of diseases and clinical conditions associated with MAF. The function of MAF has been established by previous studies. Nishizawa et al. (1989) identified in the human genome a cellular analog of v-maf which was isolated from the provirus of the avian musculoaponeurotic fibrosarcoma virus AS42. The deduced amino acid sequence of the v-maf gene product contains a leucine zipper motif similar to that found in a number of DNA binding proteins, including the gene products of the FOS (OMIM Ref. No. 164810), JUN (OMIM Ref. No. 165160), and MYC (OMIM Ref. No. 190080) oncogenes. Through the use of a cDNA probe for in situ hybridization, Yoshida et al. (1991) localized the MAF gene to 16q22-q23. Blank and Andrews (1997) reviewed the MAF transcription factors, a unique subclass of basic-leucine zipper transcription (bZIP) factors. Members of the MAF family appear to play important roles in the regulation of differentiation. Human congenital cataract and ocular anterior segment dysgenesis both demonstrate extensive genetic and phenotypic heterogeneity. Kim et al. (1999) demonstrated that the homozygous null mutant Maf mouse embryo exhibits defective lens formation and microphthalmia. Jamieson et al. (2002) identified a family where ocular developmental abnormalities (cataract, anterior segment dysgenesis, and microphthalmia) cosegregated with a translocation, t (5;16)(p15.3; q23.2), in both balanced and unbalanced forms. Cloning the 16q23.2 breakpoint demonstrated that it transected the genomic-control domain of MAF. The 16q23.2 breakpoint transected the common fragile site FRA16D (see OMIM Ref. No. 605131), providing a molecular demonstration of a germline break in a common fragile site. Through mutation screening of a panel of patients with hereditary congenital cataract, Jamieson et al. (2002) identified a mutation in the MAF gene in a 3-generation family with cataract, microcornea, and iris coloboma Full details of the abovementioned studies are described in the following publications, the disclosure of which are hereby incorporated by reference:

Jamieson, R. V.; Perveen, R.; Kerr, B.; Carette, M.; Yardley, J.; Heon, E.; Wirth, M. G.; van Heyningen, V.; Donnai, D.; Munier, F.; Black, G. C. M.: Domain disruption and mutation of the bZIP transcription factor, MAF, associated with cataract, ocular anterior segment dysgenesis and coloboma. Hum. Molec. Genet. 11:33-42, 2002; and Kim, J. I.; Li, T.; Ho, I. C.; Grusby, M. J.; Glimcher, L. H.: Requirement for the c-Maf transcription factor in crystallin gene regulation and lens development. Proc. Nat. Acad. Sci. 96.

Further studies establishing the function and utilities of MAF are found in John Hopkins OMIM database record ID 177075, and in sited publications numbered 10095-10099 listed in the bibliography section hereinbelow, which are also hereby incorporated by reference. Glutamate Receptor, Ionotropic, N-methyl-D-aspartate 3A (GRIN3A, Accession NM_133445) is another VGAM822 host target gene. GRIN3A BINDING SITE is HOST TARGET binding site found in the 5' untranslated region of mRNA encoded by GRIN3A, corresponding to a HOST TARGET binding site such as BINDING SITE I, BINDING SITE II or BINDING SITE III. Table 2 illustrates the complementarity of the nucleotide sequences of GRIN3A BINDING SITE, designated SEQ ID:28532, to the nucleotide sequence of VGAM822 RNA, herein designated VGAM RNA, also designated SEQ ID:3533.

Another function of VGAM822 is therefore inhibition of Glutamate Receptor, Ionotropic, N-methyl-D-aspartate 3A (GRIN3A, Accession NM_133445). Accordingly, utilities of VGAM822 include diagnosis, prevention and treatment of diseases and clinical conditions associated with GRIN3A. KIAA1879 (Accession XM_056635) is another VGAM822 host target gene. KIAA1879 BINDING SITE is HOST TARGET binding site found in the 5" untranslated region of mRNA encoded by KIAA1879, corresponding to a HOST TARGET binding site such as BINDING SITE I, BINDING SITE II or BINDING SITE III. Table 2 illustrates the complementarity of the nucleotide sequences of KIAA1879 BIND- ING SITE, designated SEQ ID:36408, to the nucleotide sequence of VGAM822 RNA, herein designated VGAM RNA, also designated SEQ ID:3533.

Another function of VGAM822 is therefore inhibition of KIAA1879 (Accession XM_056635). Accordingly, utilities of VGAM822 include diagnosis, prevention and treatment of diseases and clinical conditions associated with KIAA1879. FIG. 1 further provides a conceptual description of a novel bioinformatically detected viral gene of the present invention, referred to here as Viral Genomic Address Messenger 823 (VGAM823) viral gene, which modulates expression of respective host target genes thereof, the function and utility of which host target genes is known in the art.

VGAM823 is a novel bioinformatically detected regulatory, non protein coding, viral micro RNA (miRNA) gene. The method by which VGAM823 was detected is described hereinabove with reference to FIGS. 1-8.

VGAM823 gene, herein designated VGAM GENE, is a viral gene contained in the genome of African Swine Fever Virus. VGAM823 host target gene, herein designated VGAM HOST TARGET GENE, is a human gene contained in the human genome.

VGAM823 gene encodes a VGAM823 precursor RNA, herein designated VGAM PRECURSOR RNA. Similar to other miRNA genes, and unlike most ordinary genes, VGAM823 precursor RNA does not encode a protein. A nucleotide sequence identical or highly similar to the nucleotide sequence of VGAM823 precursor RNA is designated SEQ ID:809, and is provided hereinbelow with reference to the sequence listing part. Nucleotide sequence SEQ ID:809 is located at position 2329 relative to the genome of African Swine Fever Virus.

VGAM823 precursor RNA folds onto itself, forming VGAM823 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM823 folded precursor RNA into VGAM823 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM823 RNA is designated SEQ ID:3534, and is provided hereinbelow with reference to the sequence listing part.

VGAM823 host target gene, herein designated VGAM HOST TARGET GENE, encodes a corresponding messenger RNA, VGAM823 host target RNA, herein designated VGAM HOST TARGET RNA. VGAM823 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM823 RNA, herein designated VGAM RNA, binds complementarily to one or more host target binding sites located in untranslated regions of VGAM823 host target RNA, herein designated VGAM HOST TARGET RNA. This complementary binding is due to the fact that the nucleotide sequence of VGAM823 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM823 RNA, herein designated VGAM RNA, may have a different number of host target binding sites in untranslated regions of a VGAM823 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM823 RNA, herein designated VGAM RNA, to host target binding sites on VGAM823 host target RNA, herein designated VGAM HOST TARGET RNA, such as BINDING SITE I, BINDING SITE II and BINDING SITE III, inhibits translation of VGAM823 host target RNA into VGAM823 host target protein, herein designated VGAM HOST TARGET PROTEIN. VGAM host target protein is therefore outlined by a broken line.

It is appreciated that VGAM823 host target gene, herein designated VGAM HOST TARGET GENE, in fact represents a plurality of VGAM823 host target genes. The mRNA of each one of this plurality of VGAM823 host target genes comprises one or more host target binding sites, each having a nucleotide sequence which is at least partly complementary to VGAM823 RNA, herein designated VGAM RNA, and which when bound by VGAM823 RNA causes inhibition of translation of respective one or more VGAM823 host target proteins.

It is further appreciated by one skilled in the art that the mode of translational inhibition illustrated by FIG. 1 with specific reference to translational inhibition exerted by VGAM823 gene, herein designated VGAM GENE, on one or more VGAM823 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM823 is inhibition of expression of host target genes, as part of a novel viral mechanism of attacking a host. Accordingly, utilities of VGAM823 include diagnosis, prevention and treatment of viral infection by African Swine Fever Virus. Specific functions, and accordingly utilities, of VGAM823 correlate with, and may be deduced from, the identity of the host target genes which VGAM823 binds and inhibits, and the function of these host target genes, as elaborated hereinbelow.

Nucleotide sequences of the VGAM823 precursor RNA, herein designated VGAM PRECURSOR RNA, and of the 'diced' VGAM823 RNA, herein designated VGAM RNA, and a schematic representation of the secondary folding of VGAM823 folded precursor RNA, herein designated VGAM FOLDED PRECURSOR RNA, of VGAM823 are further described hereinbelow with reference to Table 1.

Nucleotide sequences of host target binding sites, such as BINDING SITE-I, BINDING SITE-II and BINDING SITE-III of FIG. 1, found on VGAM823 host target RNA, and

5517 schematic representation of the complementarity of each of these host target binding sites to VGAM823 RNA, herein designated VGAM RNA, are described hereinbelow with reference to Table 2.

As mentioned hereinabove with reference to FIG. 1, a function of VGAM823 gene, herein designated VGAM is inhibition of expression of VGAM823 target genes. It is appreciated that specific functions, and accordingly utilities, of VGAM823 correlate with, and may be deduced from, the identity of the target genes which VGAM823 binds and inhibits, and the function of these target genes, as elaborated hereinbelow.

Nuclear Factor I/A (NFIA, Accession XM_046827) is a VGAM823 host target gene. NFIA BINDING SITE is HOST TARGET binding site found in the 3" untranslated region of mRNA encoded by NFIA, corresponding to a HOST TARGET binding site such as BINDING SITE I, BINDING SITE II or BINDING SITE III. Table 2 illustrates the complementarity of the nucleotide sequences of NFIA BINDING SITE, designated SEQ ID:34839, to the nucleotide sequence of VGAM823 RNA, herein designated VGAM RNA, also designated SEQ ID:3534.

A function of VGAM823 is therefore inhibition of Nuclear Factor I/A (NFIA, Accession XM_046827). Accordingly, utilities of VGAM823 include diagnosis, prevention and treatment of diseases and clinical conditions associated with NFIA. DKFZP434A043 (Accession NM_015396) is another VGAM823 host target gene. DKFZP434A043 BINDING SITE is HOST TARGET binding site found in the 3' untranslated region of mRNA encoded by DKFZP434A043, corresponding to a HOST TARGET binding site such as BINDING SITE I, BINDING SITE II or BINDING SITE III. Table 2 illustrates the complementarity of the nucleotide sequences of DKFZP434A043 BINDING SITE, designated SEQ ID:17700, to the nucleotide sequence of VGAM823 RNA, herein designated VGAM RNA, also designated SEQ ID:3534.

Another function of VGAM823 is therefore inhibition of DKFZP434A043 (Accession NM_015396). Accordingly, utilities of VGAM823 include diagnosis, prevention and treatment of diseases and clinical conditions associated with DKFZP434A043. LOC201799 (Accession XM_114380) is another VGAM823 host target gene. LOC201799 BINDING SITE is HOST TARGET binding site found in the 3' untranslated region of mRNA encoded by LOC201799, corresponding to a HOST TARGET binding site such as BINDING SITE I, BINDING SITE II or BINDING SITE III. Table 2 illustrates the complementarity of the nucleotide sequences of LOC201799 BINDING SITE, designated SEQ ID:42912, to the nucleotide sequence of VGAM823 RNA, herein designated VGAM RNA, also designated SEQ ID:3534.

Another function of VGAM823 is therefore inhibition of LOC201799 (Accession XM_114380). Accordingly, utilities of VGAM823 include diagnosis, prevention and treatment of diseases and clinical conditions associated with LOC201799. FIG. 1 further provides a conceptual description of a novel bioinformatically detected viral gene of the present invention, referred to here as Viral Genomic Address Messenger 824 (VGAM824) viral gene, which modulates expression of respective host target genes thereof, the function and utility of which host target genes is known in the art.

VGAM824 is a novel bioinformatically detected regulatory, non protein coding, viral micro RNA (miRNA) gene. The method by which VGAM824 was detected is described hereinabove with reference to FIGS. 1-8.

VGAM824 gene, herein designated VGAM GENE, is a viral gene contained in the genome of African Swine Fever Virus. VGAM824 host target gene, herein designated VGAM HOST TARGET GENE, is a human gene contained in the human genome.

5518

VGAM824 gene encodes a VGAM824 precursor RNA, herein designated VGAM PRECURSOR RNA. Similar to other miRNA genes, and unlike most ordinary genes, VGAM824 precursor RNA does not encode a protein. A nucleotide sequence identical or highly similar to the nucleotide sequence of VGAM824 precursor RNA is designated SEQ ID:810, and is provided hereinbelow with reference to the sequence listing part. Nucleotide sequence SEQ ID:810 is located at position 3473 relative to the genome of African Swine Fever Virus.

VGAM824 precursor RNA folds onto itself, forming VGAM824 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM824 folded precursor RNA into VGAM824 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM824 RNA is designated SEQ ID:3535, and is provided hereinbelow with reference to the sequence listing part.

VGAM824 host target gene, herein designated VGAM HOST TARGET GENE, encodes a corresponding messenger RNA, VGAM824 host target RNA, herein designated VGAM HOST TARGET RNA. VGAM824 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM824 RNA, herein designated VGAM RNA, binds complementarily to one or more host target binding sites located in untranslated regions of VGAM824 host target RNA, herein designated VGAM HOST TARGET RNA. This complementary binding is due to the fact that the nucleotide sequence of VGAM824 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM824 RNA, herein designated VGAM RNA, may have a different number of host target binding sites in untranslated regions of a VGAM824 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM824 RNA, herein designated VGAM RNA, to host target binding sites on VGAM824 host target RNA, herein designated VGAM HOST TARGET RNA, such as BINDING SITE I, BINDING SITE II and BINDING SITE III, inhibits translation of VGAM824 host target RNA into VGAM824 host target protein, herein designated VGAM HOST TARGET PROTEIN. VGAM host target protein is therefore outlined by a broken line.

It is appreciated that VGAM824 host target gene, herein designated VGAM HOST TARGET GENE, in fact represents a plurality of VGAM824 host target genes. The mRNA of each one of this plurality of VGAM824 host target genes comprises one or more host target binding sites, each having a nucleotide sequence which is at least partly complementary to VGAM824 RNA, herein designated VGAM RNA, and which when bound by VGAM824 RNA causes inhibition of translation of respective one or more VGAM824 host target proteins.

It is further appreciated by one skilled in the art that the mode of translational inhibition illustrated by FIG. 1 with specific reference to translational inhibition exerted by VGAM824 gene, herein designated VGAM GENE, on one or more VGAM824 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM824 is inhibition of expression of host target genes, as part of a novel viral mechanism of attacking a host. Accordingly, utilities of VGAM824 include diagnosis, prevention and treatment of viral infection by African Swine Fever Virus. Specific functions, and accordingly utilities, of VGAM824 correlate with, and may be deduced from, the identity of the host target genes which VGAM824 binds and inhibits, and the function of these host target genes, as elaborated hereinbelow.

Nucleotide sequences of the VGAM824 precursor RNA, herein designated VGAM PRECURSOR RNA, and of the 'diced' VGAM824 RNA, herein designated VGAM RNA, and a schematic representation of the secondary folding of VGAM824 folded precursor RNA, herein designated VGAM FOLDED PRECURSOR RNA, of VGAM824 are further described hereinbelow with reference to Table 1.

Nucleotide sequences of host target binding sites, such as BINDING SITE-I, BINDING SITE-II and BINDING SITE-III of FIG. 1, found on VGAM824 host target RNA, and schematic representation of the complementarity of each of these host target binding sites to VGAM824 RNA, herein designated VGAM RNA, are described hereinbelow with reference to Table 2.

As mentioned hereinabove with reference to FIG. 1, a function of VGAM824 gene, herein designated VGAM is inhibition of expression of VGAM824 target genes. It is appreciated that specific functions, and accordingly utilities, of VGAM824 correlate with, and may be deduced from, the identity of the target genes which VGAM824 binds and inhibits, and the function of these target genes, as elaborated hereinbelow.

Coagulation Factor C Homolog, Cochlin (Limulus polyphemus) (COCH, Accession NM_004086) is a VGAM824 host target gene. COCH BINDING SITE is HOST TARGET binding site found in the 3' untranslated region of mRNA encoded by COCH, corresponding to a HOST TARGET binding site such as BINDING SITE I, BINDING SITE II or BINDING SITE III. Table 2 illustrates the complementarity of the nucleotide sequences of COCH BINDING SITE, designated SEQ ID:10290, to the nucleotide sequence of VGAM824 RNA, herein designated VGAM RNA, also designated SEQ ID:3535.

A function of VGAM824 is therefore inhibition of Coagulation Factor C Homolog, Cochlin (Limulus polyphemus) (COCH, Accession NM_004086). Accordingly, utilities of VGAM824 include diagnosis, prevention and treatment of diseases and clinical conditions associated with COCH. Fyn-related Kinase (FRK, Accession NM_002031) is another VGAM824 host target gene. FRK BINDING SITE is HOST TARGET binding site found in the 3' untranslated region of mRNA encoded by FRK, corresponding to a HOST TARGET binding site such as BINDING SITE I, BINDING SITE II or BINDING SITE III. Table 2 illustrates the complementarity of the nucleotide sequences of FRK BINDING SITE, designated SEQ ID:7786, to the nucleotide sequence of VGAM824 RNA, herein designated VGAM RNA, also designated SEQ ID:3535.

Another function of VGAM824 is therefore inhibition of Fyn-related Kinase (FRK, Accession NM_002031), a gene which binds pRb (RB1) during G1 and S phase and suppresses growth. Accordingly, utilities of VGAM824 include diagnosis, prevention and treatment of diseases and clinical conditions associated with FRK. The function of FRK and its association with various diseases and clinical conditions, has been established by previous studies, as described hereinabove with reference to VGAM157. Sequestosome 1 (SQSTM1, Accession NM_003900) is another VGAM824 host target gene. SQSTM1 BINDING SITE is HOST TARGET binding site found in the 3' untranslated region of mRNA encoded by SQSTM1, corresponding to a HOST TARGET binding site such as BINDING SITE I, BINDING SITE II or BINDING SITE III. Table 2 illustrates the complementarity of the nucleotide sequences of SQSTM1 BINDING SITE, designated SEQ ID:9987, to the nucleotide sequence of VGAM824 RNA, herein designated VGAM RNA, also designated SEQ ID:3535.

Another function of VGAM824 is therefore inhibition of Sequestosome 1 (SQSTM1, Accession NM_003900), a gene which binds SH2 domain of p56lck and ubiquitin, and it is associated with a serine/threonine kinase activity. Accordingly, utilities of VGAM824 include diagnosis, prevention and treatment of diseases and clinical conditions associated with SQSTM1. The function of SQSTM1 has been established by previous studies. Using 24 French Canadian families and 112 unrelated individuals with Paget disease of bone (OMIM Ref. No. 602080), Laurin et al. (2002) confined the PDB3 locus (OMIM Ref. No. 606262) on 5q35-qter to a region of approximately 300 kb. Within this interval, 2 disease-related haplotype signatures were observed in 11 families and 18 unrelated patients. This region encoded the SQSTM1 gene, which is a candidate gene for PDB because of its association with the RANK pathway (see OMIM Ref. No. 603499). Screening SQSTM1 for mutations led to the identification of a recurrent nonconservative change (P392L; 601530.0001) flanking the ubiquitin-associated domain (UBA; position 394-440) of the protein that was not present in 291 control individuals. The data demonstrated that 2 independent mutational events at the same position in SQSTM1 cause Paget disease of bone in a high proportion of French Canadian patients. The Src homology type 2 (SH2) domain is a highly conserved motif of about 100 amino acids which mediates protein-protein interactions by binding to phosphotyrosine. p56-lck (OMIM Ref. No. 153390), a T-cell-specific src family tyrosine kinase with an SH2 domain, is involved in T-cell signal transduction. A 62-kD protein (p62) was identified by Park et al. (1995) as a ligand of the p56-lck SH2 domain. Park et al. (1995) found that the p56-lck SH2 domain binds to p62 at the ser59 of p62 only when that serine is phosphorylated. Moreover, Park et al. (1995) found that p62 is associated with a serine/threonine kinase activity and also binds to ras GTP-ase-activating protein, a negative regulator of the ras signaling pathway.

Full details of the abovementioned studies are described in the following publications, the disclosure of which are hereby incorporated by reference:

Laurin, N.; Brown, J. P.; Morissette, J.; Raymond, V.: Recurrent mutation of the gene encoding sequestosome 1 (SQSTM1/p62) in Paget disease of bone. Am. J. Hum. Genet. 70:1582-1588, 2002; and Park, I.; Chung, J.; Walsh, C. T.; Yun, Y.; Strominger, J. L.; Shin, J.: Phosphotyrosine-independent binding of a 62-kDa protein to the src homology 2 (SH2) domain of p56-lck and its regu.

Further studies establishing the function and utilities of SQSTM1 are found in John Hopkins OMIM database record ID 601530, and in sited publications numbered 154 and 7189-7192 listed in the bibliography section hereinbelow, which are also hereby incorporated by reference. Titin (TTN, Accession NM_133378) is another VGAM824 host target gene. TTN BINDING SITE1 through TTN BINDING SITE3 are HOST TARGET binding sites found in untranslated regions of mRNA encoded by TTN, corresponding to HOST TARGET binding sites such as BINDING SITE I, BINDING SITE II or BINDING SITE III. Table 2 illustrates the complementarity of the nucleotide sequences of TTN BINDING SITE1 through TTN BINDING SITE3, designated SEQ ID:28501, SEQ ID:28506 and SEQ ID:28516 respectively, to the nucleotide sequence of VGAM824 RNA, herein designated VGAM RNA, also designated SEQ ID:3535.

Another function of VGAM824 is therefore inhibition of Titin (TTN, Accession NM_133378). Accordingly, utilities of VGAM824 include diagnosis, prevention and treatment of diseases and clinical conditions associated with TTN. DKFZP434O047 (Accession NM_015594) is another VGAM824 host target gene. DKFZP434O047 BINDING SITE is HOST TARGET binding site found in the 5' untranslated region of mRNA encoded by DKFZP434O047, corresponding to a HOST TARGET binding site such as BINDING SITE I, BINDING SITE II or BINDING SITE III. Table 2 illustrates the complementarity of the nucleotide sequences of DKFZP434O047 BINDING SITE, designated SEQ ID:17861, to the nucleotide sequence of VGAM824 RNA, herein designated VGAM RNA, also designated SEQ ID:3535.

Another function of VGAM824 is therefore inhibition of DKFZP434O047 (Accession NM_015594). Accordingly, utilities of VGAM824 include diagnosis, prevention and treatment of diseases and clinical conditions associated with DKFZP434O047. Ecotropic Viral Integration Site 5 (EVI5, Accession NM_005665) is another VGAM824 host target gene. EVI5 BINDING SITE is HOST TARGET binding site found in the 3' untranslated region of mRNA encoded by EVI5, corresponding to a HOST TARGET binding site such as BINDING SITE I, BINDING SITE II or BINDING SITE III. Table 2 illustrates the complementarity of the nucleotide sequences of EVI5 BINDING SITE, designated SEQ ID:12212, to the nucleotide sequence of VGAM824 RNA, herein designated VGAM RNA, also designated SEQ ID:3535.

Another function of VGAM824 is therefore inhibition of Ecotropic Viral Integration Site 5 (EVI5, Accession NM_005665). Accordingly, utilities of VGAM824 include diagnosis, prevention and treatment of diseases and clinical conditions associated with EVI5. FENS-1 (Accession NM_020830) is another VGAM824 host target gene. FENS-1 BINDING SITE is HOST TARGET binding site found in the 3' untranslated region of mRNA encoded by FENS-1, corresponding to a HOST TARGET binding site such as BINDING SITE I, BINDING SITE II or BINDING SITE III. Table 2 illustrates the complementarity of the nucleotide sequences of FENS-1 BINDING SITE, designated SEQ ID:21895, to the nucleotide sequence of VGAM824 RNA, herein designated VGAM RNA, also designated SEQ ID:3535.

Another function of VGAM824 is therefore inhibition of FENS-1 (Accession NM_020830). Accordingly, utilities of VGAM824 include diagnosis, prevention and treatment of diseases and clinical conditions associated with FENS-1. KIAA1432 (Accession XM_039698) is another VGAM824 host target gene. KIAA1432 BINDING SITE is HOST TARGET binding site found in the 5' untranslated region of mRNA encoded by KIAA1432, corresponding to a HOST TARGET binding site such as BINDING SITE I, BINDING SITE II or BINDING SITE III. Table 2 illustrates the complementarity of the nucleotide sequences of KIAA1432 BINDING SITE, designated SEQ ID:33146, to the nucleotide sequence of VGAM824 RNA, herein designated VGAM RNA, also designated SEQ ID:3535.

Another function of VGAM824 is therefore inhibition of KIAA1432 (Accession XM_039698). Accordingly, utilities of VGAM824 include diagnosis, prevention and treatment of diseases and clinical conditions associated with KIAA1432. Stromal Antigen 2 (STAG2, Accession XM_047285) is another VGAM824 host target gene. STAG2 BINDING SITE is HOST TARGET binding site found in the 3' untranslated region of mRNA encoded by STAG2, corresponding to a HOST TARGET binding site such as BINDING SITE I, BINDING SITE II or BINDING SITE III. Table 2 illustrates the complementarity of the nucleotide sequences of STAG2 BINDING SITE, designated SEQ ID:34927, to the nucleotide sequence of VGAM824 RNA, herein designated VGAM RNA, also designated SEQ ID:3535.

Another function of VGAM824 is therefore inhibition of Stromal Antigen 2 (STAG2, Accession XM_047285). Accordingly, utilities of VGAM824 include diagnosis, prevention and treatment of diseases and clinical conditions associated with STAG2. LOC255654 (Accession XM_173036) is another VGAM824 host target gene. LOC255654 BINDING SITE is HOST TARGET binding site found in the 5' untranslated region of mRNA encoded by LOC255654, corresponding to a HOST TARGET binding site such as BINDING SITE I, BINDING SITE II or BINDING SITE III. Table 2 illustrates the complementarity of the nucleotide sequences of LOC255654 BINDING SITE, designated SEQ ID:46301, to the nucleotide sequence of VGAM824 RNA, herein designated VGAM RNA, also designated SEQ ID:3535.

Another function of VGAM824 is therefore inhibition of LOC255654 (Accession XM_173036). Accordingly, utilities of VGAM824 include diagnosis, prevention and treatment of diseases and clinical conditions associated with LOC255654. FIG. 1 further provides a conceptual description of a novel bioinformatically detected viral gene of the present invention, referred to here as Viral Genomic Address Messenger 825 (VGAM825) viral gene, which modulates expression of respective host target genes thereof, the function and utility of which host target genes is known in the art.

VGAM825 is a novel bioinformatically detected regulatory, non protein coding, viral micro RNA (miRNA) gene.

US 8,207,316 B1

The method by which VGAM825 was detected is described hereinabove with reference to FIGS. 1-8.

VGAM825 gene, herein designated VGAM GENE, is a viral gene contained in the genome of Monkeypox Virus. VGAM825 host target gene, herein designated VGAM HOST TARGET GENE, is a human gene contained in the human genome.

VGAM825 gene encodes a VGAM825 precursor RNA, herein designated VGAM PRECURSOR RNA. Similar to other miRNA genes, and unlike most ordinary genes, VGAM825 precursor RNA does not encode a protein. A nucleotide sequence identical or highly similar to the nucleotide sequence of VGAM825 precursor RNA is designated SEQ ID:811, and is provided hereinbelow with reference to the sequence listing part. Nucleotide sequence SEQ ID:811 is located at position 80642 relative to the genome of Monkeypox Virus.

VGAM825 precursor RNA folds onto itself, forming VGAM825 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM825 folded precursor RNA into VGAM825 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM825 RNA is designated SEQ ID:3536, and is provided hereinbelow with reference to the sequence listing part.

VGAM825 host target gene, herein designated VGAM HOST TARGET GENE, encodes a corresponding messenger RNA, VGAM825 host target RNA, herein designated VGAM HOST TARGET RNA. VGAM825 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM825 RNA, herein designated VGAM RNA, binds complementarily to one or more host target binding sites located in untranslated regions of VGAM825 host target RNA, herein designated VGAM HOST TARGET RNA. This complementary binding is due to the fact that the nucleotide sequence of VGAM825 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM825 RNA, herein designated VGAM RNA, may have a different number of host target binding sites in untranslated regions of a VGAM825 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM825 RNA, herein designated VGAM RNA, to host target binding sites on VGAM825 host target RNA, herein designated VGAM HOST TARGET RNA, such as BINDING SITE I, BINDING SITE II and BINDING SITE III, inhibits translation of VGAM825 host target RNA into VGAM825 host target protein, herein designated VGAM HOST TARGET PROTEIN. VGAM host target protein is therefore outlined by a broken line.

It is appreciated that VGAM825 host target gene, herein designated VGAM HOST TARGET GENE, in fact represents a plurality of VGAM825 host target genes. The mRNA of each one of this plurality of VGAM825 host target genes comprises one or more host target binding sites, each having a nucleotide sequence which is at least partly complementary to VGAM825 RNA, herein designated VGAM RNA, and which when bound by VGAM825 RNA causes inhibition of translation of respective one or more VGAM825 host target proteins.

It is further appreciated by one skilled in the art that the mode of translational inhibition illustrated by FIG. 1 with specific reference to translational inhibition exerted by VGAM825 gene, herein designated VGAM GENE, on one or more VGAM825 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM825 is inhibition of expression of host target genes, as part of a novel viral mechanism of attacking a host. Accordingly, utilities of VGAM825 include diagnosis, prevention and treatment of viral infection by Monkeypox Virus. Specific functions, and accordingly utilities, of VGAM825 correlate with, and may be deduced from, the identity of the host target genes which VGAM825 binds and inhibits, and the function of these host target genes, as elaborated hereinbelow.

Nucleotide sequences of the VGAM825 precursor RNA, herein designated VGAM PRECURSOR RNA, and of the 'diced' VGAM825 RNA, herein designated VGAM RNA, and a schematic representation of the secondary folding of VGAM825 folded precursor RNA, herein designated VGAM FOLDED PRECURSOR RNA, of VGAM825 are further described hereinbelow with reference to Table 1.

Nucleotide sequences of host target binding sites, such as BINDING SITE-I, BINDING SITE-II and BINDING SITE-III of FIG. 1, found on VGAM825 host target RNA, and schematic representation of the complementarity of each of these host target binding sites to VGAM825 RNA, herein designated VGAM RNA, are described hereinbelow with reference to Table 2.

As mentioned hereinabove with reference to FIG. 1, a function of VGAM825 gene, herein designated VGAM is inhibition of expression of VGAM825 target genes. It is appreciated that specific functions, and accordingly utilities, of VGAM825 correlate with, and may be deduced from, the identity of the target genes which VGAM825 binds and inhibits, and the function of these target genes, as elaborated hereinbelow.

Integrin, Alpha 6 (ITGA6, Accession NM_000210) is a VGAM825 host target gene. ITGA6 BINDING SITE is HOST TARGET binding site found in the 3' untranslated region of mRNA encoded by ITGA6, corresponding to a HOST TARGET binding site such as BINDING SITE I, BINDING SITE II or BINDING SITE III. Table 2 illustrates the complementarity of the nucleotide sequences of ITGA6 BINDING SITE, designated SEQ ID:5702, to the nucleotide sequence of VGAM825 RNA, herein designated VGAM RNA, also designated SEQ ID:3536.

A function of VGAM825 is therefore inhibition of Integrin, Alpha 6 (ITGA6, Accession NM_000210). Accordingly, utilities of VGAM825 include diagnosis, prevention and treatment of diseases and clinical conditions associated with ITGA6. Mitogen-activated Protein Kinase 3 (MAPK3, Accession XM_055766) is another VGAM825 host target gene. MAPK3 BINDING SITE is HOST TARGET binding site found in the 3' untranslated region of mRNA encoded by MAPK3, corresponding to a HOST TARGET binding site such as BINDING SITE I, BINDING SITE II or BINDING SITE III. Table 2 illustrates the complementarity of the nucleotide sequences of MAPK3 BINDING SITE, designated SEQ ID:36322, to the nucleotide sequence of VGAM825 RNA, herein designated VGAM RNA, also designated SEQ ID:3536.

Another function of VGAM825 is therefore inhibition of Mitogen-activated Protein Kinase 3 (MAPK3, Accession XM_055766), a gene which phosphorylates microtubule-associated protein-2, myelin basic protein, and elk-1; may promote entry into the cell cycle. Accordingly, utilities of VGAM825 include diagnosis, prevention and treatment of diseases and clinical conditions associated with MAPK3. The function of MAPK3 has been established by previous studies. Experience-dependent plasticity in the developing visual cortex depends on electrical activity and molecular signals involved in stabilization or removal of inputs. ERK1 and ERK2 (MAPK1) activation in the cortex is regulated by both factors. Di Cristo et al. (2001) demonstrated that 2 different inhibitors of the ERK pathway suppress the induction of 2 forms of long-term potentiation in rat cortical slices and that their intracortical administration to monocularly deprived rats prevents the shift in ocular dominance towards the non-deprived eye. Di Cristo et al. (2001) concluded that the ERK pathway is necessary for experience-dependent plasticity and for long-term potentiation of synaptic transmission in the developing visual cortex Forcet et al. (2002) showed that in embryonic kidney cells expressing full-length, but not cytoplasmic domain-truncated, DCC (OMIM Ref. No. 120470), NTN1 (OMIM Ref. No. 601614) causes increased transient phosphorylation and activity of ERK1 and ERK2 (OMIM Ref. No. 176948), but not of JNK1 (OMIM Ref. No. 601158), JNK2 (OMIM Ref. No. 602896), or p38 (MAPK14; 600289). This phosphorylation was mediated by MEK1 (MAP2K1; 176872) and/or MEK2 (MAP2K2; 601263). NTN1 also activated the transcription factor ELK1 (OMIM Ref. No. 311040) and serum response element-regulated gene expression. Immunoprecipitation analysis showed interaction of full-length DCC with MEK1/2 in the presence or absence of NTN1. Forcet et al. (2002) showed that activation of Dcc by Ntn1 in rat embryonic day-13 dorsal spinal cord stimulates and is required for the outgrowth of commissural axons and Erk1/2 activation. Immunohistochemical analysis demonstrated expression of activated Erk1/2 in embryonic commissural axons, and this expression was diminished in Dcc or Ntn1 knockout animals. Forcet et al. (2002) concluded that the MAPK pathway is involved in responses to NTN1 and proposed that ERK activation affects axonal growth by phosphorylation of microtubule-associated proteins and neurofilaments Animal model experiments lend further support to the function of MAPK3. Pages et al. (1999) generated p44 Mapk (Erk1)-deficient mice by homologous recombination in embryonic stem cells. The p44 Mapk were viable, fertile, and of normal size. Thus, Pages et al. (1999) concluded that p44 Mapk is apparently dispensable and that p42 Mapk (Erk2) may compensate for its loss. However, in p44 Mapk -/- mice, thymocyte maturation beyond the CD4+CD8+ stage was reduced by half, with a similar diminution in the thymocyte subpopulation expressing high levels of T cell receptor (CD3-high). In p44 Mapk -/- thymocytes, proliferation in response to activation with a monoclonal antibody to the T cell receptor in the presence of phorbol myristate acetate was severely reduced even though activation of p42 Mapk was more sustained in these cells. Thus, Pages et al. (1999) concluded that p44 Mapk apparently has a specific role in thymocyte development.

It is appreciated that the abovementioned animal model for MAPK3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pages, G.; Guerin, S.; Grall, D.; Bonino, F.; Smith, A.; Anjuere, F.; Auberger, P.; Pouyssegur, J.: Defective thymocyte maturation in p44 MAP kinase (Erk 1) knockout mice. Science 286:1374-1378, 1999; and Forcet, C.; Stein, E.; Pays, L.; Corset, V.; Llambi, F.; Tessier-Lavigne, M.; Mehlen, P.: Netrin-1-mediated axon outgrowth requires deleted in colorectal cancer-dependent MAPK activation.

Further studies establishing the function and utilities of MAPK3 are found in John Hopkins OMIM database record ID 601795, and in sited publications numbered 5785-1533, 6235, 623 and 6237 listed in the bibliography section hereinbelow, which are also hereby incorporated by reference. FLJ12903 (Accession NM_022753) is another VGAM825 host target gene. FLJ12903 BINDING SITE is HOST TARGET binding site found in the 3" untranslated region of mRNA encoded by FLJ12903, corresponding to a HOST TARGET binding site such as BINDING SITE I, BINDING SITE II or BINDING SITE III. Table 2 illustrates the complementarity of the nucleotide sequences of FLJ12903 BINDING SITE, designated SEQ ID:22982, to the nucleotide sequence of VGAM825 RNA, herein designated VGAM RNA, also designated SEQ ID:3536.

Another function of VGAM825 is therefore inhibition of FLJ12903 (Accession NM_022753). Accordingly, utilities of VGAM825 include diagnosis, prevention and treatment of diseases and clinical conditions associated with FLJ12903. UCH37 (Accession NM_015984) is another VGAM825 host target gene. UCH37 BINDING SITE is HOST TARGET binding site found in the 3' untranslated region of mRNA encoded by UCH37, corresponding to a HOST TARGET binding site such as BINDING SITE I, BINDING SITE II or BINDING SITE III. Table 2 illustrates the complementarity of the nucleotide sequences of UCH37 BINDING SITE, designated SEQ ID:18080, to the nucleotide sequence of VGAM825 RNA, herein designated VGAM RNA, also designated SEQ ID:3536.

Another function of VGAM825 is therefore inhibition of UCH37 (Accession NM_015984). Accordingly, utilities of VGAM825 include diagnosis, prevention and treatment of diseases and clinical conditions associated with UCH37. LOC132321 (Accession XM_059585) is another VGAM825 host target gene. LOC132321 BINDING SITE is HOST TARGET binding site found in the 3' untranslated region of mRNA encoded by LOC132321, corresponding to a HOST TARGET binding site such as BINDING SITE I, BINDING SITE II or BINDING SITE III. Table 2 illustrates the complementarity of the nucleotide sequences of LOC132321 BINDING SITE, designated SEQ ID:37026, to the nucleotide sequence of VGAM825 RNA, herein designated VGAM RNA, also designated SEQ ID:3536.

Another function of VGAM825 is therefore inhibition of LOC132321 (Accession XM_059585). Accordingly, utilities of VGAM825 include diagnosis, prevention and treatment of diseases and clinical conditions associated with LOC132321. LOC222066 (Accession XM_166582) is another VGAM825 host target gene. LOC222066 BINDING SITE is HOST TARGET binding site found in the 3' untranslated region of mRNA encoded by LOC222066, corresponding to a HOST TARGET binding site such as BINDING SITE I, BINDING SITE II or BINDING SITE III. Table 2 illustrates the complementarity of the nucleotide sequences of LOC222066 BINDING SITE, designated SEQ ID:44554, to the nucleotide sequence of VGAM825 RNA, herein designated VGAM RNA, also designated SEQ ID:3536.

Another function of VGAM825 is therefore inhibition of LOC222066 (Accession XM_166582). Accordingly, utilities of VGAM825 include diagnosis, prevention and treatment of diseases and clinical conditions associated with LOC222066. FIG. 1 further provides a conceptual description of a novel bioinformatically detected viral gene of the present invention, referred to here as Viral Genomic Address Messenger 826 (VGAM826) viral gene, which modulates expression of respective host target genes thereof, the function and utility of which host target genes is known in the art.

VGAM826 is a novel bioinformatically detected regulatory, non protein coding, viral micro RNA (miRNA) gene. The method by which VGAM826 was detected is described hereinabove with reference to FIGS. 1-8.

VGAM826 gene, herein designated VGAM GENE, is a viral gene contained in the genome of Bovine Herpesvirus 4. VGAM826 host target gene, herein designated VGAM HOST TARGET GENE, is a human gene contained in the human genome.

VGAM826 gene encodes a VGAM826 precursor RNA, herein designated VGAM PRECURSOR RNA. Similar to other miRNA genes, and unlike most ordinary genes, VGAM826 precursor RNA does not encode a protein. A nucleotide sequence identical or highly similar to the nucleotide sequence of VGAM826 precursor RNA is designated SEQ ID:812, and is provided hereinbelow with reference to the sequence listing part. Nucleotide sequence SEQ ID:812 is located at position 92205 relative to the genome of Bovine Herpesvirus 4.

VGAM826 precursor RNA folds onto itself, forming VGAM826 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM826 folded precursor RNA into VGAM826 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM826 RNA is designated SEQ ID:3537, and is provided hereinbelow with reference to the sequence listing part.

VGAM826 host target gene, herein designated VGAM HOST TARGET GENE, encodes a corresponding messenger RNA, VGAM826 host target RNA, herein designated VGAM HOST TARGET RNA. VGAM826 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM826 RNA, herein designated VGAM RNA, binds complementarily to one or more host target binding sites located in untranslated regions of VGAM826 host target RNA, herein designated VGAM HOST TARGET RNA. This complementary binding is due to the fact that the nucleotide sequence of VGAM826 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM826 RNA, herein designated VGAM RNA, may have a different number of host target binding sites in untranslated regions of a VGAM826 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM826 RNA, herein designated VGAM RNA, to host target binding sites on VGAM826 host target RNA, herein designated VGAM HOST TARGET RNA, such as BINDING SITE I, BINDING SITE II and BINDING SITE III, inhibits translation of VGAM826 host target RNA into VGAM826 host target protein, herein designated VGAM HOST TARGET PROTEIN. VGAM host target protein is therefore outlined by a broken line.

It is appreciated that VGAM826 host target gene, herein designated VGAM HOST TARGET GENE, in fact represents a plurality of VGAM826 host target genes. The mRNA of each one of this plurality of VGAM826 host target genes comprises one or more host target binding sites, each having a nucleotide sequence which is at least partly complementary to VGAM826 RNA, herein designated VGAM RNA, and which when bound by VGAM826 RNA causes inhibition of translation of respective one or more VGAM826 host target proteins.

It is further appreciated by one skilled in the art that the mode of translational inhibition illustrated by FIG. 1 with specific reference to translational inhibition exerted by VGAM826 gene, herein designated VGAM GENE, on one or more VGAM826 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM826 is inhibition of expression of host target genes, as part of a novel viral mechanism of attacking a host. Accordingly, utilities of VGAM826 include diagnosis, prevention and treatment of viral infection by Bovine Herpesvirus 4. Specific functions, and accordingly utilities, of VGAM826 correlate with, and may be deduced from, the identity of the host target genes which VGAM826 binds and inhibits, and the function of these host target genes, as elaborated hereinbelow.

Nucleotide sequences of the VGAM826 precursor RNA, herein designated VGAM PRECURSOR RNA, and of the 'diced' VGAM826 RNA, herein designated VGAM RNA, and a schematic representation of the secondary folding of VGAM826 folded precursor RNA, herein designated VGAM FOLDED PRECURSOR RNA, of VGAM826 are further described hereinbelow with reference to Table 1.

Nucleotide sequences of host target binding sites, such as BINDING SITE-I, BINDING SITE-II and BINDING SITE-III of FIG. 1, found on VGAM826 host target RNA, and schematic representation of the complementarity of each of these host target binding sites to VGAM826 RNA, herein designated VGAM RNA, are described hereinbelow with reference to Table 2.

As mentioned hereinabove with reference to FIG. 1, a function of VGAM826 gene, herein designated VGAM is inhibition of expression of VGAM826 target genes. It is appreciated that specific functions, and accordingly utilities, of VGAM826 correlate with, and may be deduced from, the identity of the target genes which VGAM826 binds and inhibits, and the function of these target genes, as elaborated hereinbelow.

Dihydrofolate Reductase (DHFR, Accession NM_000791) is a VGAM826 host target gene. DHFR BINDING SITE is HOST TARGET binding site found in the 5' untranslated region of mRNA encoded by DHFR, corresponding to a HOST TARGET binding site such as BINDING SITE I, BINDING SITE II or BINDING SITE III. Table 2 illustrates the complementarity of the nucleotide sequences of DHFR BINDING SITE, designated SEQ ID:6447, to the nucleotide sequence of VGAM826 RNA, herein designated VGAM RNA, also designated SEQ ID:3537.

A function of VGAM826 is therefore inhibition of Dihydrofolate Reductase (DHFR, Accession NM_000791), a gene which converts dihydrofolate into tetrahydrofolate. Accordingly, utilities of VGAM826 include diagnosis, prevention and treatment of diseases and clinical conditions associated with DHFR. The function of DHFR has been established by previous studies. Dihydrofolate reductase (EC 1.5.1.3) converts dihydrofolate into tetrahydrofolate, a methyl group shuttle required for the de novo synthesis of purines, thymidylic acid, and certain amino acids. DHFR is inhibited by methotrexate (MTX), a folate analog used as an antineoplastic and immunosuppressive agent. From comparisons of eukaryotic gene sequences and protein sequences of homologous enzymes from bacterial and mammalian organisms, Craik et al. (1983) noted that intron-exon junctions often coincide with variable surface loops of the protein structure. Proteins studied included DHFR, trypsin, and chymotrypsin. They pointed out that altered surface structures can account for functional differences among the members of a family, e.g., the serine proteases. 'Sliding' of the intron-exon junctions may constitute a mechanism for generating length polymorphisms and divergent sequences. Different function can thus be achieved without disrupting the stability of the protein core. DNA sequence amplification is one of the most frequent manifestations of genomic instability in human tumors. In most human tumor cells, amplified DNA sequences are borne on unstable, extrachromosomal double minutes (DMs). Singer et al. (2000) isolated a large number of independent methotrexate-resistant human cell lines, all of which contained DHFR-bearing DMs. All but one of these also had suffered partial or complete loss of one of the parental DHFR-bearing chromosomes. Cells in a few populations displayed what could be transient intermediates in the amplification process, including an initial homogeneously staining chromosome region (HSR), its subsequent breakage, the appearance of DHFR-containing fragments, and, finally, DMs. The studies suggested that both HSRs and DMs are initiated by chromosome breaks, but that cell types differ in how the extra sequences ultimately are processed and/or maintained.

Full details of the abovementioned studies are described in the following publications, the disclosure of which are hereby incorporated by reference:

Singer, M. J.; Mesner, L. D.; Friedman, C. L.; Trask, B. J.; Hamlin, J. L.: Amplification of the human dihydrofolate reductase gene via double minutes is initiated by chromosome breaks. Proc. Nat. Acad. Sci. 97:7921-7926, 2000; and Craik, C. S.; Rutter, W. J.; Fletterick, R.: Splice junctions: association with variation in protein structure. Science 220: 1125-1129, 1983.

Further studies establishing the function and utilities of DHFR are found in John Hopkins OMIM database record ID 126060, and in sited publications numbered 3985-4002 listed in the bibliography section hereinbelow, which are also hereby incorporated by reference. Heat Shock 70 kDa Protein 1B (HSPA1B, Accession NM_005346) is another VGAM826 host target gene. HSPA1B BINDING SITE is HOST TARGET binding site found in the 5' untranslated region of mRNA encoded by HSPA1B, corresponding to a HOST TARGET binding site such as BINDING SITE I, BINDING SITE II or BINDING SITE III. Table 2 illustrates the complementarity of the nucleotide sequences of HSPA1B BINDING SITE, designated SEQ ID:11819, to the nucleotide sequence of VGAM826 RNA, herein designated VGAM RNA, also designated SEQ ID:3537.

Another function of VGAM826 is therefore inhibition of Heat Shock 70 kDa Protein 1B (HSPA1B, Accession NM_005346), a gene which stabilizes preexistent proteins against aggregation and mediate the folding of newly translated polypeptides in the cytosol as well as within organelles. Accordingly, utilities of VGAM826 include diagnosis, prevention and treatment of diseases and clinical conditions associated with HSPA1B. The function of HSPA1B has been established by previous studies. Heat-shock proteins, or stress proteins, are expressed in response to heat shock and a variety of other stress stimuli including oxidative free radicals and toxic metal ions. The human HSP70, or HSPA, multigene family encodes several highly conserved 70-kD proteins with structural and functional properties in common, but which vary in their inducibility in response to metabolic stress. Sargent et al. (1989) identified a duplicated HSP70 locus in the class III region of the major histocompatibility complex on 6p21.3. These loci, HSP70-1 (HSPA1A; 140550) and HSP70-2 (OMIM Ref. No. HSPA1B), are 12 kb apart and lie 92 kb telomeric to the C2 gene (see OMIM Ref. No. 217000). Milner and Campbell (1990) determined that the HSP70-2 gene, like HSP70-1, lacks introns. The HSP70-1 and -2 coding sequences, which differ by 8 bp that do not alter the derived amino acid sequence, encode identical 641-amino acid proteins; the 3-prime untranslated regions of these genes are completely divergent. Northern blot analysis of HeLa cell RNA detected an approximately 2.4-kb HSP70-2 transcript that was expressed at elevated levels following heat shock. Milner and Campbell (1992) investigated the presence of sequence variation in the HSP70-2 gene among different HLA haplotypes. They found only very limited sequence variation, which did not result in amino acid substitutions.

Full details of the abovementioned studies are described in the following publications, the disclosure of which are hereby incorporated by reference:

Milner, C. M.; Campbell, R. D.: Structure and expression of the three MHC-linked HSP70 genes. Immunogenetics 32:242-251, 1990; and Milner, C. M.; Campbell, R. D.: Polymorphic analysis of the three MHC-linked HSP70 genes. Immunogenetics 36:357-362, 1992.

Further studies establishing the function and utilities of HSPA1B are found in John Hopkins OMIM database record ID 603012, and in sited publications numbered 1161 and 11611 listed in the bibliography section hereinbelow, which are also hereby incorporated by reference. Phosphoinositide-3-kinase, Regulatory Subunit, Polypeptide 1 (p85 alpha) (PIK3R1, Accession XM_043865) is another VGAM826 host target gene. PIK3R1 BINDING SITE is HOST TARGET binding site found in the 3' untranslated region of mRNA encoded by PIK3R1, corresponding to a HOST TARGET binding site such as BINDING SITE I, BINDING SITE II or BINDING SITE III. Table 2 illustrates the complementarity of the nucleotide sequences of PIK3R1 BINDING SITE, designated SEQ ID:34040, to the nucleotide sequence of VGAM826 RNA, herein designated VGAM RNA, also designated SEQ ID:3537.

Another function of VGAM826 is therefore inhibition of Phosphoinositide-3-kinase, Regulatory Subunit, Polypeptide 1 (p85 alpha) (PIK3R1, Accession XM_043865), a gene which acts as an adapter, for the insulin-stimulated increase in glucose uptake and glycogen synthesis. Accordingly, utilities of VGAM826 include diagnosis, prevention and treatment of diseases and clinical conditions associated with PIK3R1. The function of PIK3R1 has been established by previous studies. Phosphatidylinositol 3-kinase (PIK3) activity is implicated in diverse cellular responses triggered by mammalian cell surface receptors. Stoyanov et al. (1995) noted that receptors with tyrosine kinase activity recruit heterodimeric PIK3 kinases composed of a p110 catalytic subunit and a p85 adaptor subunit (OMIM Ref. No. 171833). Stoyanov et al. (1995) screened a human bone marrow cDNA library with primers based on the sequences of yeast and bovine PIK3 p110 subunits. They isolated a human cDNA for a novel p110 subunit, which they termed p110-gamma. The cDNA encodes a predicted 120-kD, 1,050-amino acid polypeptide with 36% identity to human p110-alpha (OMIM Ref. No. 171834). The 5.3-kb p110-alpha transcript was detectable by Northern blot in human pancreas, skeletal muscle, liver, and heart. Stoyanov et al. (1995) found that recombinant p110-gamma did not interact with the p85 subunit in vivo, in contrast to recombinant p110-alpha. The transducin G protein subunits G-beta (t) (OMIM Ref. No. 189974)/G-gamma (t) (OMIM Ref. No. 189970) did, however, activate p110-gamma in vitro, and the stimulation was suppressed by G-alpha (t)-GDP (OMIM Ref. No. 139330); G-alpha (t)-GDP could stimulate p110-gamma only in the presence of AlF(4-). In contrast, the p85-dependent p110-alpha was not similarly affected by the G protein subunits. Stoyanov et al. (1995) speculated that the p110-gamma isotype may link signaling through G protein-coupled receptors and generate phosphoinositide second messengers phosphorylated in the D-3 position Animal model experiments lend further support to the function of PIK3R1. Phosphoinositide 3-kinase (PI3K) activation is implicated in many responses, including fibroblast growth, transformation, survival, and chemotaxis. Although PI3K is activated by several agents that stimulate T and B cells, the role of PI3K in lymphocyte function remained to be clarified. Fruman et al. (1999) disrupted the mouse gene encoding the PI3K adaptor subunit p85-alpha and its splice variants p55-alpha and p50-alpha. Most mice homozygous for disruption for all 3 variants died within days after birth. Lymphocyte development and function were studied with the use of the RAG2-deficient blastocyst complementation system. Chimeric mice had reduced numbers of peripheral mature B cells and decreased serum immunoglobulin. The B cells that developed had diminished proliferative responses to antibody to immunoglobulin M, antibody to CD40, and lipopolysaccharide stimulation, as well as decreased survival after incubation with interleukin-4. In contrast, T-cell development and proliferation were normal. This phenotype was similar to defects observed in mice lacking the tyrosine kinase Btk and in patients with Bruton X-linked agammaglobulinemia (300300

It is appreciated that the abovementioned animal model for PIK3R1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Fruman, D. A.; Snapper, S. B.; Yballe, C. M.; Davidson, L.; Yu, J. Y.; Alt, F. W.; Cantley, L. C.: Impaired B cell development and proliferation in absence of phosphoinositide 3-kinase p85-alpha. Science 283:393-397, 1999; and Simoncini, T.; Hafezi-Moghadam, A.; Brazil, D. P.; Ley, K.; Chin, W. W.; Liao, J. K.: Interaction of oestrogen receptor with the regulatory subunit of phosphatidylinositol-3-OH kinase. N.

Further studies establishing the function and utilities of PIK3R1 are found in John Hopkins OMIM database record ID 171833, and in sited publications numbered 3521-3522, 3834-3837, 1085 and 3839-3842 listed in the bibliography section hereinbelow, which are also hereby incorporated by reference. Zinc Finger Protein 80 (pT17) (ZNF80, Accession NM_007136) is another VGAM826 host target gene. ZNF80 BINDING SITE is HOST TARGET binding site found in the 5' untranslated region of mRNA encoded by ZNF80, corresponding to a HOST TARGET binding site such as BINDING SITE I, BINDING SITE II or BINDING SITE III. Table 2 illustrates the complementarity of the nucleotide sequences of ZNF80 BINDING SITE, designated SEQ ID:13986, to the nucleotide sequence of VGAM826 RNA, herein designated VGAM RNA, also designated SEQ ID:3537.

Another function of VGAM826 is therefore inhibition of Zinc Finger Protein 80 (pT17) (ZNF80, Accession NM_007136). Accordingly, utilities of VGAM826 include diagnosis, prevention and treatment of diseases and clinical conditions associated with ZNF80. KIAA0562 (Accession NM_014704) is another VGAM826 host target gene. KIAA0562 BINDING SITE is HOST TARGET binding site found in the 3' untranslated region of mRNA encoded by KIAA0562, corresponding to a HOST TARGET binding site such as BINDING SITE I, BINDING SITE II or BINDING SITE III. Table 2 illustrates the complementarity of the nucleotide sequences of KIAA0562 BINDING SITE, designated SEQ ID:16244, to the nucleotide sequence of VGAM826 RNA, herein designated VGAM RNA, also designated SEQ ID:3537.

Another function of VGAM826 is therefore inhibition of KIAA0562 (Accession NM_014704). Accordingly, utilities of VGAM826 include diagnosis, prevention and treatment of diseases and clinical conditions associated with KIAA0562.

KIAA1219 (Accession XM_028835) is another VGAM826 host target gene. KIAA1219 BINDING SITE is HOST TARGET binding site found in the 3' untranslated region of mRNA encoded by KIAA1219, corresponding to a HOST TARGET binding site such as BINDING SITE I, BINDING SITE II or BINDING SITE III. Table 2 illustrates the complementarity of the nucleotide sequences of KIAA1219 BINDING SITE, designated SEQ ID:30761, to the nucleotide sequence of VGAM826 RNA, herein designated VGAM RNA, also designated SEQ ID:3537.

Another function of VGAM826 is therefore inhibition of KIAA1219 (Accession XM_028835). Accordingly, utilities of VGAM826 include diagnosis, prevention and treatment of diseases and clinical conditions associated with KIAA1219. Organic Cationic Transporter-like 3 (ORCTL3, Accession NM_004256) is another VGAM826 host target gene. ORCTL3 BINDING SITE is HOST TARGET binding site found in the 3' untranslated region of mRNA encoded by ORCTL3, corresponding to a HOST TARGET binding site such as BINDING SITE I, BINDING SITE II or BINDING SITE III. Table 2 illustrates the complementarity of the nucleotide sequences of ORCTL3 BINDING SITE, designated SEQ ID:10443, to the nucleotide sequence of VGAM826 RNA, herein designated VGAM RNA, also designated SEQ ID:3537.

Another function of VGAM826 is therefore inhibition of Organic Cationic Transporter-like 3 (ORCTL3, Accession NM_004256). Accordingly, utilities of VGAM826 include diagnosis and treatment of diseases and clinical conditions associated with ORCTL3. Syndecan 3 (N-syndecan) (SDC3, Accession NM_014654) is another VGAM826 host target gene. SDC3 BINDING SITE is HOST TARGET binding site found in the 5' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16079, to the nucleotide sequence of VGAM826 RNA, herein designated VGAM RNA, also designated SEQ ID:3537.

Another function of VGAM826 is therefore inhibition of Syndecan 3 (N-syndecan) (SDC3, Accession NM_014654). Accordingly, utilities of VGAM826 include diagnosis, prevention and treatment of diseases and clinical conditions associated with SDC3. LOC115219 (Accession XM_055499) is another VGAM826 host target gene. LOC115219 BINDING SITE is HOST TARGET binding site found in the 5' untranslated region of mRNA encoded by LOC115219, corresponding to a HOST TARGET binding site such as BINDING SITE I, BINDING SITE II or BINDING SITE III. Table 2 illustrates the complementarity of the nucleotide sequences of LOC115219 BINDING SITE, designated SEQ ID:36276, to the nucleotide sequence of VGAM826 RNA, herein designated VGAM RNA, also designated SEQ ID:3537.

Another function of VGAM826 is therefore inhibition of LOC115219 (Accession XM_055499). Accordingly, utilities of VGAM826 include diagnosis, prevention and treatment of diseases and clinical conditions associated with LOC115219. LOC223073 (Accession XM_170293) is another VGAM826 host target gene. LOC223073 BINDING SITE is HOST TARGET binding site found in the 5' untranslated region of mRNA encoded by LOC223073, corresponding to a HOST TARGET binding site such as BINDING SITE I, BINDING SITE II or BINDING SITE III. Table 2 illustrates the complementarity of the nucleotide sequences of LOC223073 BINDING SITE, designated SEQ ID:45317, to the nucleotide sequence of VGAM826 RNA, herein designated VGAM RNA, also designated SEQ ID:3537.

Another function of VGAM826 is therefore inhibition of LOC223073 (Accession XM_170293). Accordingly, utilities of VGAM826 include diagnosis, prevention and treatment of diseases and clinical conditions associated with LOC223073. FIG. 1 further provides a conceptual description of a novel bioinformatically detected viral gene of the present invention, referred to here as Viral Genomic Address Messenger 827 (VGAM827) viral gene, which modulates expression of respective host target genes thereof, the function and utility of which host target genes is known in the art.

VGAM827 is a novel bioinformatically detected regulatory, non protein coding, viral micro RNA (miRNA) gene. The method by which VGAM827 was detected is described hereinabove with reference to FIGS. 1-8.

VGAM827 gene, herein designated VGAM GENE, is a viral gene contained in the genome of Bovine Herpesvirus 4. VGAM827 host target gene, herein designated VGAM HOST TARGET GENE, is a human gene contained in the human genome.

VGAM827 gene encodes a VGAM827 precursor RNA, herein designated VGAM PRECURSOR RNA. Similar to other miRNA genes, and unlike most ordinary genes, VGAM827 precursor RNA does not encode a protein. A nucleotide sequence identical or highly similar to the nucleotide sequence of VGAM827 precursor RNA is designated SEQ ID:813, and is provided hereinbelow with reference to the sequence listing part. Nucleotide sequence SEQ ID:813 is located at position 90686 relative to the genome of Bovine Herpesvirus 4.

VGAM827 precursor RNA folds onto itself, forming VGAM827 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM827 folded precursor RNA into VGAM827 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM827 RNA is designated SEQ ID:3538, and is provided hereinbelow with reference to the sequence listing part.

VGAM827 host target gene, herein designated VGAM HOST TARGET GENE, encodes a corresponding messenger RNA, VGAM827 host target RNA, herein designated VGAM HOST TARGET RNA. VGAM827 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM827 RNA, herein designated VGAM RNA, binds complementarily to one or more host target binding sites located in untranslated regions of VGAM827 host target RNA, herein designated VGAM HOST TARGET RNA. This complementary binding is due to the fact that the nucleotide sequence of VGAM827 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM827 RNA, herein designated VGAM RNA, may have a different number of host target binding sites in untranslated regions of a VGAM827 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM827 RNA, herein designated VGAM RNA, to host target binding sites on VGAM827 host target RNA, herein designated VGAM HOST TARGET RNA, such as BINDING SITE I, BINDING SITE II and BINDING SITE III, inhibits translation of VGAM827 host target RNA into VGAM827 host target protein, herein designated VGAM HOST TARGET PROTEIN. VGAM host target protein is therefore outlined by a broken line.

It is appreciated that VGAM827 host target gene, herein designated VGAM HOST TARGET GENE, in fact represents a plurality of VGAM827 host target genes. The mRNA of each one of this plurality of VGAM827 host target genes comprises one or more host target binding sites, each having a nucleotide sequence which is at least partly complementary to VGAM827 RNA, herein designated VGAM RNA, and which when bound by VGAM827 RNA causes inhibition of translation of respective one or more VGAM827 host target proteins.

It is further appreciated by one skilled in the art that the mode of translational inhibition illustrated by FIG. 1 with specific reference to translational inhibition exerted by VGAM827 gene, herein designated VGAM GENE, on one or more VGAM827 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM827 is inhibition of expression of host target genes, as part of a novel viral mechanism of attacking a host. Accordingly, utilities of VGAM827 include diagnosis, prevention and treatment of viral infection by Bovine Herpesvirus 4. Specific functions, and accordingly utilities, of VGAM827 correlate with, and may be deduced from, the identity of the host target genes which VGAM827 binds and inhibits, and the function of these target genes, as elaborated hereinbelow.

Nucleotide sequences of the VGAM827 precursor RNA, herein designated VGAM PRECURSOR RNA, and of the 'diced' VGAM827 RNA, herein designated VGAM RNA, and a schematic representation of the secondary folding of VGAM827 folded precursor RNA, herein designated VGAM FOLDED PRECURSOR RNA, of VGAM827 are further described hereinbelow with reference to Table 1.

Nucleotide sequences of host target binding sites, such as BINDING SITE-I, BINDING SITE-II and BINDING SITE-III of FIG. 1, found on VGAM827 host target RNA, and schematic representation of the complementarity of each of these host target binding sites to VGAM827 RNA, herein designated VGAM RNA, are described hereinbelow with reference to Table 2.

As mentioned hereinabove with reference to FIG. 1, a function of VGAM827 gene, herein designated VGAM is inhibition of expression of VGAM827 target genes. It is appreciated that specific functions, and accordingly utilities, of VGAM827 correlate with, and may be deduced from, the identity of the target genes which VGAM827 binds and inhibits, and the function of these target genes, as elaborated hereinbelow.

ATPase, H+ Transporting, Lysosomal 70 kDa, V1 Subunit A, Isoform 1 (ATP6V1A1, Accession NM_001690) is a VGAM827 host target gene. ATP6V1A1 BINDING SITE is HOST TARGET binding site found in the 3' untranslated region of mRNA encoded by ATP6V1A1, corresponding to a HOST TARGET binding site such as BINDING SITE I, BINDING SITE II or BINDING SITE III. Table 2 illustrates the complementarity of the nucleotide sequences of ATP6V1A1 BINDING SITE, designated SEQ ID:7412, to the nucleotide sequence of VGAM827 RNA, herein designated VGAM RNA, also designated SEQ ID:3538.

A function of VGAM827 is therefore inhibition of ATPase, H+ Transporting, Lysosomal 70 kDa, V1 Subunit A, Isoform 1 (ATP6V1A1, Accession NM_001690), a gene which is responsible for acidifying a variety of intracellular compartments in eukaryotic cells. Accordingly, utilities of VGAM827 include diagnosis, prevention and treatment of diseases and clinical conditions associated with ATP6V1A1. The function of ATP6V1A1 has been established by previous studies. Van Hille et al. (1993) cloned a partial cDNA clone for an A subunit isoform, which they designated VA68, from a human osteoclastoma tumor cDNA library by PCR using degenerate primers based on the bovine sequence. They obtained a full-length clone from a genomic library. The deduced 617-amino acid protein has a predicted molecular mass of about 68 kD and shows 99% sequence identity with the bovine brain subunit A. Northern blot analysis revealed ubiquitous expression of a major 4.8-kb band and a minor 3.4-kb band. They also identified a variant, which they designated HO68, encoding a 615-amino acid protein. By RNase protection assays and in situ hybridization, van Hille et al. (1995) determined that expression of the HO68 variant was specific to the osteoclastoma originally used to construct the cDNA library.

Full details of the abovementioned studies are described in the following publications, the disclosure of which are hereby incorporated by reference:

van Hille, B.; Richener, H.; Evans, D. B.; Green, J. R.; Bilbe, G.: Identification of two subunit A isoforms of the vacuolar H(+)-ATPase in human osteoclastoma. J. Biol. Chem. 268:7075-7080, 1993; and van Hille, B.; Richener, H.; Green, J. R.; Bilbe, G.: The ubiquitous VA68 isoform of subunit A of the vacuolar H(+)-ATPase is highly expressed in human osteoclasts. Biochem. Biophys.

Further studies establishing the function and utilities of ATP6V1A1 are found in John Hopkins OMIM database record ID 607027, and in sited publications numbered 5382-5383 listed in the bibliography section hereinbelow, which are also hereby incorporated by reference. Dual-specificity tyrosine-(Y)-phosphorylation Regulated Kinase 1A (DYRK1A, Accession NM_130436) is another VGAM827 host target gene. DYRK1A BINDING SITE is HOST TARGET binding site found in the 5' untranslated region of mRNA encoded by DYRK1A, corresponding to a HOST TARGET binding site such as BINDING SITE I, BINDING SITE II or BINDING SITE III. Table 2 illustrates the complementarity of the nucleotide sequences of DYRK1A BINDING SITE, designated SEQ ID:28192, to the nucleotide sequence of VGAM827 RNA, herein designated VGAM RNA, also designated SEQ ID:3538.

Another function of VGAM827 is therefore inhibition of Dual-specificity tyrosine-(Y)-phosphorylation Regulated Kinase 1A (DYRK1A, Accession NM_130436), a gene which regulates cell proliferation and may be involved in brain development. Accordingly, utilities of VGAM827 include diagnosis, prevention and treatment of diseases and clinical conditions associated with DYRK1A. The function of DYRK1A and its association with various diseases and clinical conditions, has been established by previous studies, as described hereinabove with reference to VGAM42. Ectonucleoside Triphosphate Diphosphohydrolase 6 (putative function) (ENTPD6, Accession NM_001247) is another VGAM827 host target gene. ENTPD6 BINDING SITE is HOST TARGET binding site found in the 3' untranslated region of mRNA encoded by ENTPD6, corresponding to a HOST TARGET binding site such as BINDING SITE I, BINDING SITE II or BINDING SITE III. Table 2 illustrates the complementarity of the nucleotide sequences of ENTPD6 BINDING SITE, designated SEQ ID:6920, to the nucleotide sequence of VGAM827 RNA, herein designated VGAM RNA, also designated SEQ ID:3538.

Another function of VGAM827 is therefore inhibition of Ectonucleoside Triphosphate Diphosphohydrolase 6 (putative function) (ENTPD6, Accession NM_001247), a gene which might support glycosylation reactions in the golgi apparatus and, when released from cells, might catalyze the hydrolysis of extracellular nucleotides. Accordingly, utilities of VGAM827 include diagnosis, prevention and treatment of diseases and clinical conditions associated with ENTPD6. The function of ENTPD6 has been established by previous studies. Extracellular nucleotides serve as signaling molecules in many extracellular activities. The catabolism of extracellular nucleotides is mediated by several types of ectonucleotidases, including the divalent cation-dependent E-type nucleotidases (NTPases). The E-type NTPases include ectoapyrases, such as CD39 (OMIM Ref. No. 601752), which show a significant rate of ADP hydrolysis compared to ATP hydrolysis. NTPases are characterized by the presence of 4 motifs known as apyrase-conserved regions (ACRs). Chadwick et al. (1998) identified cDNAs encoding a mouse NTPase, symbolized MNTPase. By searching an EST database for sequences similar to that of MNTPase, Chadwick and Frischauf (1998) identified cDNAs corresponding to 2 human genes, CD39L2 and CD39L4 (OMIM Ref. No. 603162). The predicted 484-amino acid CD39L2 protein contains all 4 ACRs, a single N-terminal transmembrane segment, and a large extracellular C-terminal domain. Northern blot analysis revealed that CD39L2 was expressed as a major 2.6-kb and minor 4.4-kb mRNA in all tissues tested. Homology searches yielded ESTs likely to represent the mouse cd39l2 gene. By PCR and sequence analysis of cDNA libraries, and by Northern blot analysis, Yeung et al. (2000) detected CD39L2 predominantly in heart, with very low or no expression in other tissues. In situ hybridization analysis revealed expression distinctively in cardiac muscle and capillary endothelial cells. A larger variant, resulting from a 43-bp insertion in exon 14, was detected in fetal brain. Western blot analysis of cells expressing recombinant CD39L2 detected expression of an approximately 60-kD protein triplet primarily in the secreted fraction but also on membranes. Glycosidase treatment reduced the size of the protein to 57 kD, still greater than the predicted 53 kD, suggesting additional posttranslational modifications. Brefeldin A treatment decreased the secretion of CD39L2. Flow cytometric analysis demonstrated expression on the extracellular membrane. Functional analysis showed that, like CD39L4, CD39L2 preferentially hydrolyzes nucleotide diphosphates rather than triphospates. This hydrolysis is enhanced in the presence of magnesium or calcium. However, in contrast to CD39, calcium excess fails to inhibit CD39L2-mediated adenosine diphosphatase activity. On the basis of structural and biochemical features, Yeung et al. (2000) concluded that CD39L2 and CD39L4 are in a separate subclass, defined by the presence of only 1 N-terminal hydrophobic transmembrane domain, from CD39, CD39L1 (OMIM Ref. No. 602012), and CD39L3 (OMIM Ref. No. 603161), which have an N-terminal and a C-terminal transmembrane domain. By analysis of radiation hybrid and somatic cell hybrid panels, Chadwick and Frischauf (1998) mapped the CD39L2 gene to 20q11.2.

Full details of the abovementioned studies are described in the following publications, the disclosure of which are hereby incorporated by reference:

Chadwick, B. P.; Williamson, J.; Sheer, D.; Frischauf, A.-M.: cDNA cloning and chromosomal mapping of a mouse gene with homology to NTPases. Mammalian Genome 9:162-164, 1998; and Yeung, G.; Mulero, J. J.; McGowan, D. W.; Bajwa, S. S.; Ford, J. E.: CD39L2, a gene encoding a human nucleoside diphosphatase, predominantly expressed in the heart. Biochemistry 39:12.

Further studies establishing the function and utilities of ENTPD6 are found in John Hopkins OMIM database record ID 603160, and in sited publications numbered 6232-2429 listed in the bibliography section hereinbelow, which are also hereby incorporated by reference. Fibronectin Leucine Rich Transmembrane Protein 1 (FLRT1, Accession XM_006111) is another VGAM827 host target gene. FLRT1 BINDING SITE is HOST TARGET binding site found in the 3' untranslated region of mRNA encoded by FLRT1, corresponding to a HOST TARGET binding site such as BINDING SITE I, BINDING SITE II or BINDING SITE III. Table 2 illustrates the complementarity of the nucleotide sequences of FLRT1 BINDING SITE, designated SEQ ID:29992, to the nucleotide sequence of VGAM827 RNA, herein designated VGAM RNA, also designated SEQ ID:3538.

Another function of VGAM827 is therefore inhibition of Fibronectin Leucine Rich Transmembrane Protein 1 (FLRT1, Accession XM_006111). Accordingly, utilities of VGAM827 include diagnosis, prevention and treatment of diseases and clinical conditions associated with FLRT1. Glycoprotein M6A (GPM6A, Accession NM_005277) is another VGAM827 host target gene. GPM6A BINDING SITE is HOST TARGET binding site found in the 3" untranslated region of mRNA encoded by GPM6A, corresponding to a HOST TARGET binding site such as BINDING SITE I, BINDING SITE II or BINDING SITE III. Table 2 illustrates the complementarity of the nucleotide sequences of GPM6A BINDING SITE, designated SEQ ID:11782, to the nucleotide sequence of VGAM827 RNA, herein designated VGAM RNA, also designated SEQ ID:3538.

Another function of VGAM827 is therefore inhibition of Glycoprotein M6A (GPM6A, Accession NM_005277), a gene which may play a role in neuronal development. Accordingly, utilities of VGAM827 include diagnosis, prevention and treatment of diseases and clinical conditions associated with GPM6A. The function of GPM6A and its association with various diseases and clinical conditions, has been established by previous studies, as described hereinabove with reference to VGAM326. Integrin, Alpha 2 (CD49B, alpha 2 subunit of VLA-2 receptor) (ITGA2, Accession NM_002203) is another VGAM827 host target gene. ITGA2 BINDING SITE is HOST TARGET binding site found in the 3' untranslated region of mRNA encoded by ITGA2, corresponding to a HOST TARGET binding site such as BINDING SITE I, BINDING SITE II or BINDING SITE III. Table 2 illustrates the complementarity of the nucleotide sequences of ITGA2 BINDING SITE, designated SEQ ID:7963, to the nucleotide sequence of VGAM827 RNA, herein designated VGAM RNA, also designated SEQ ID:3538.

Another function of VGAM827 is therefore inhibition of Integrin, Alpha 2 (CD49B, alpha 2 subunit of VLA-2 receptor) (ITGA2, Accession NM_002203), a gene which has roles in blood clotting and angiogenesis, acts as a collagen and laminin receptor. Accordingly, utilities of VGAM827 include diagnosis, prevention and treatment of diseases and clinical conditions associated with ITGA2. The function of ITGA2 has been established by previous studies. By screening a uterus cDNA library with an integrin-like cDNA fragment isolated from a fetal myoblast cDNA library, Velling et al. (1999) obtained a full-length cDNA sequence encoding integrin alpha-11. ITGA11 encodes a deduced 1,188-amino acid protein, including a 22-amino acid signal peptide. The mature 1,166-amino acid protein contains a 23-amino acid transmembrane region and a 24-amino acid cytoplasmic tail. It differs from most other integrin alpha chains in that the cytoplasmic tail contains the sequence GFFRS instead of the conserved GFFKR sequence. The extracellular domain contains 7 FG-GAP repeats with an I domain of 195 amino acids between repeats 2 and 3 that includes a conserved metal ion-dependent adhesion site motif. Twenty cysteines are located in the extracellular domain and there are 16 potential N-glycosylation sites. ITGA11 is 42%, 37%, and 35% identical with I domain alpha-integrins ITGA10 (OMIM Ref. No. 604042), ITGA1 (OMIM Ref. No. 192968), and ITGA2 (OMIM Ref. No. 192974), respectively. Northern blot analysis revealed expression of an approximately 5.5-kb ITGA11 transcript. Expression was highest in uterus, strong in heart, intermediate in skeletal muscle, stomach, small intestine, bladder, prostate, and colon, and low in nonmuscle tissues such as pancreas, kidney, and placenta. The authors found that, in contrast, ITGA1 is not expressed in the uterus. Immunoprecipitation studies and SDS-PAGE analysis showed that ITGA11 encodes a 145-kD protein, intermediate in size between ITGA2 or ITGA10 and ITGA1; the authors suggested that the difference is probably due to differential glycosylation. Like other I domain-containing integrins, ITGA11 binds to collagen. By sequence analysis, Lehnert et al. (1999) found that the deduced ITGA11 protein contains an I domain of 207 amino acids and 15 N-glycosylation sites in a mature protein of 1167 amino acids. By FISH, Velling et al. (1999) mapped the ITGA11 gene to chromosome 15q23. By somatic cell hybrid analysis and FISH, Lehnert et al. (1999) mapped the gene to 15q22.3-q23.

Full details of the abovementioned studies are described in the following publications, the disclosure of which are hereby incorporated by reference:

Lehnert, K.; Ni, J.; Leung, E.; Gough, S. M.; Weaver, A.; Yao, W.-P.; Liu, D.; Wang, S.-X.; Morris, C. M.; Krissansen, G. W.: Cloning, sequence analysis, and chromosomal localization of the novel human integrin alpha-11 subunit (ITGA11). Genomics 60:179-187, 1999; and Velling, T.; Kusche-Gullberg, M.; Sejersen, T.; Gullberg, D.: cDNA cloning and chromosomal localization of human alpha-11 integrin: a collagen-binding, I domain-containing, beta-1-asso.

Further studies establishing the function and utilities of ITGA2 are found in John Hopkins OMIM database record ID 192974, and in sited publications numbered 6052-6053, 6381, 10003-1001 and 3351 listed in the bibliography section hereinbelow, which are also hereby incorporated by reference. Mesenchyme Homeo Box 2 (growth arrest-specific homeo box) (MEOX2, Accession NM_005924) is another VGAM827 host target gene. MEOX2 BINDING SITE is HOST TARGET binding site found in the 3' untranslated region of mRNA encoded by MEOX2, corresponding to a HOST TARGET binding site such as BINDING SITE I, BINDING SITE II or BINDING SITE III. Table 2 illustrates the complementarity of the nucleotide sequences of MEOX2 BINDING SITE, designated SEQ ID:12551, to the nucleotide sequence of VGAM827 RNA, herein designated VGAM RNA, also designated SEQ ID:3538.

Another function of VGAM827 is therefore inhibition of Mesenchyme Homeo Box 2 (growth arrest-specific homeo box) (MEOX2, Accession NM_005924), a gene which roles in mesoderm induction and, somitogenesis, and myogenic and sclerotomal differentiation. Accordingly, utilities of VGAM827 include diagnosis, prevention and treatment of diseases and clinical conditions associated with MEOX2. The function of MEOX2 has been established by previous studies. Candia et al. (1992) and Gorski et al. (1993) isolated and studied the murine Mox2 gene, which belongs to a family of nonclustered, diverged homeo box genes. In situ hybridization analysis during murine embryogenesis indicated that the Mox2 gene is expressed in a wide range of mesodermal structures, including somites and vertebrae, the developing limbs, groups of muscles of the head, and the developing palate. These findings suggested that mutations in the human homolog of the Mox2 gene may be involved in craniofacial and/or skeletal abnormalities in the human. They isolated and characterized cDNA clones for the human homolog, which they termed MOX2, and found that it contains all of the characteristic features of Mox2 proteins of other vertebrate species, namely the homeo box, the polyhistidine stretch, and a number of potential serine/threonine phosphorylation sites. The homeodomain of the Mox2 protein is identical to that in all other vertebrate species studied to that time (rodents and amphibians). By fluorescence in situ hybridization, Grigoriou et al. (1995) mapped the human MEOX2 gene to 7p22.1-p21.3. This is the region where the Saethre-Chotzen syndrome (OMIM Ref. No. 101400) maps, thus it became a candidate for the site of the mutation in that disorder. Mankoo et al. (1999) generated mice homozygous for a null mutation of Mox2 by targeted disruption. Mox2 -/- mice have a developmental defect of the limb musculature characterized by an overall reduction in muscle mass and elimination of specific muscles. Mox2 is not needed for the migration of myogenic precursors into the limb bud, but it is essential for normal appendicular muscle formation and for the normal regulation of myogenic genes, as demonstrated by the down regulation of Pax3 (OMIM Ref. No. 600535) and Myf5 (OMIM Ref. No. 159990) but not MyoD (OMIM Ref. No. 159970) in Mox2-deficient limb buds. Mankoo et al. (1999) concluded that MOX2 homeoprotein is an important regulator of vertebrate limb myogenesis.

Full details of the abovementioned studies are described in the following publications, the disclosure of which are hereby incorporated by reference:

Candia, A. F.; Hu, J.; Crosby, J.; Lalley, P. A.; Noden, D.; Nadeau, J. H.; Wright, C. V. E.: Mox-1 and Mox-2 define a novel homeobox gene subfamily and are differentially expressed during early mesodermal patterning in mouse embryos. Development 116:1123-1136, 1992; and Mankoo, B. S.; Collins, N. S.; Ashby, P.; Grigorievea, E.; Pevny, L. H.; Candia, A.; Wright, C. V. E.; Rigby, P. W. J.; Pachnis, V.: Mox2 is a component of the genetic hierarchy contro.

Further studies establishing the function and utilities of MEOX2 are found in John Hopkins OMIM database record ID 600535, and in sited publications numbered 7679-7683 listed in the bibliography section hereinbelow, which are also hereby incorporated by reference. Neurocalcin Delta (NCALD, Accession NM_032041) is another VGAM827 host target gene. NCALD BINDING SITE is HOST TARGET binding site found in the 3' untranslated region of mRNA encoded by NCALD, corresponding to a HOST TARGET binding site such as BINDING SITE I, BINDING SITE II or BINDING SITE III. Table 2 illustrates the complementarity of the nucleotide sequences of NCALD BINDING SITE, designated SEQ ID:25749, to the nucleotide sequence of VGAM827 RNA, herein designated VGAM RNA, also designated SEQ ID:3538.

Another function of VGAM827 is therefore inhibition of Neurocalcin Delta (NCALD, Accession NM_032041). Accordingly, utilities of VGAM827 include diagnosis, prevention and treatment of diseases and clinical conditions associated with NCALD. Neuralized-like (Drosophila) (NEURL, Accession NM_004210) is another VGAM827 host target gene. NEURL BINDING SITE is HOST TARGET binding site found in the 3' untranslated region of mRNA encoded by NEURL, corresponding to a HOST TARGET binding site such as BINDING SITE I, BINDING SITE II or BINDING SITE III. Table 2 illustrates the complementarity of the nucleotide sequences of NEURL BINDING SITE, designated SEQ ID:10412, to the nucleotide sequence of VGAM827 RNA, herein designated VGAM RNA, also designated SEQ ID:3538.

Another function of VGAM827 is therefore inhibition of Neuralized-like (Drosophila) (NEURL, Accession NM_004210). Accordingly, utilities of VGAM827 include diagnosis, prevention and treatment of diseases and clinical conditions associated with NEURL. Phosphoinositide-3-kinase, Regulatory Subunit, Polypeptide 3 (p55, gamma) (PIK3R3, Accession XM_027982) is another VGAM827 host target gene. PIK3R3 BINDING SITE is HOST TARGET binding site found in the 3' untranslated region of mRNA encoded by PIK3R3, corresponding to a HOST TARGET binding site such as BINDING SITE I, BINDING SITE II or BINDING SITE III. Table 2 illustrates the complementarity of the nucleotide sequences of PIK3R3 BINDING SITE, designated SEQ ID:30610, to the nucleotide sequence of VGAM827 RNA, herein designated VGAM RNA, also designated SEQ ID:3538.

Another function of VGAM827 is therefore inhibition of Phosphoinositide-3-kinase, Regulatory Subunit, Polypeptide 3 (p55, gamma) (PIK3R3, Accession XM_027982). Accordingly, utilities of VGAM827 include diagnosis, prevention and treatment of diseases and clinical conditions associated with PIK3R3. RAB3B, Member RAS Oncogene Family (RAB3B, Accession NM_002867) is another VGAM827 host target gene. RAB3B BINDING SITE is HOST TARGET binding site found in the 3' untranslated region of mRNA encoded by RAB3B, corresponding to a HOST TARGET binding site such as BINDING SITE I, BINDING SITE II or BINDING SITE III. Table 2 illustrates the complementarity of the nucleotide sequences of RAB3B BINDING SITE, designated SEQ ID:8772, to the nucleotide sequence of VGAM827 RNA, herein designated VGAM RNA, also designated SEQ ID:3538.

Another function of VGAM827 is therefore inhibition of RAB3B, Member RAS Oncogene Family (RAB3B, Accession NM_002867). Accordingly, utilities of VGAM827 include diagnosis, prevention and treatment of diseases and clinical conditions associated with RAB3B. Ring Finger Protein 14 (RNF14, Accession NM_004290) is another VGAM827 host target gene. RNF14 BINDING SITE is HOST TARGET binding site found in the 3' untranslated region of mRNA encoded by RNF14, corresponding to a HOST TARGET binding site such as BINDING SITE I, BINDING SITE II or BINDING SITE III. Table 2 illustrates the complementarity of the nucleotide sequences of RNF14 BINDING SITE, designated SEQ ID:10506, to the nucleotide sequence of VGAM827 RNA, herein designated VGAM RNA, also designated SEQ ID:3538.

Another function of VGAM827 is therefore inhibition of Ring Finger Protein 14 (RNF14, Accession NM_004290), a gene which associates with the androgen receptor (AR); functions as a transcriptional coactivator. Accordingly, utilities of VGAM827 include diagnosis, prevention and treatment of diseases and clinical conditions associated with RNF14. The function of RNF14 has been established by previous studies. The RING finger motif is a unique zinc-chelating domain involved in mediating protein-DNA and protein-protein interactions. Using the sequence of the partial cDNA clone HFB30 isolated by Ueki et al. (1998) to screen a human fetal brain cDNA library, Ueki et al. (1999) cloned the full-length cDNA, which encoded a novel ring finger protein, RNF14. The deduced 474-amino acid protein has a calculated molecular mass of approximately 53 kD. RT-PCR analysis revealed ubiquitous expression of RNF14 in a wide variety of human tissues. Kang et al. (1999) independently cloned RNF14, which they called ARA54 (androgen receptor-associated protein-54), by a yeast 2-hybrid screen of a prostate cDNA library. Northern blot analysis detected a major 3-kb transcript, with highest expression in testis, followed by thymus, spleen, colon, prostate, and uterus. Low expression was detected in small intestine and blood leukocytes. The RNF14 transcript was also strongly detected in 2 other prostate cell lines. A second transcript of 2 kb was detected in testis only. Kang et al. (1999) demonstrated that RNF14 can function as a coactivator for androgen-dependent transcription on both wildtype and mutant androgen receptor (OMIM Ref. No. 313700). They also showed that in the presence of a certain amount of 17-beta-estradiol or hydroxyflutamide, the transcriptional activity of a specific AR mutant was significantly enhanced, whereas that of wildtype and another AR mutant was not. The authors suggested that both RNF14 and the positions of the AR mutation might contribute to the specificity of AR-mediated transactivation. Ueki et al. (1999) determined that the RNF14 gene contains 9 exons and spans approximately 20 kb of genomic DNA. By somatic cell hybrid and radiation hybrid analyses, Ueki et al. (1999) mapped the RNF14 gene to chromosome 5q23.3-q31.1.

Full details of the abovementioned studies are described in the following publications, the disclosure of which are hereby incorporated by reference:

Ueki, N.; Seki, N.; Yano, K.; Masuho, Y.; Saito, T.; Muramatsu, M.: Isolation and characterization of a novel human gene (HFB30) which encodes a protein with a RING finger motif. Biochim. Biophys. Acta 232-236, 1999; and Kang, H.-Y.; Yeh, S.; Fujimoto, N.; Chang, C.: Cloning and characterization of human prostate coactivator ARA54, a novel protein that associates with the androgen receptor. J. Biol. Che.

Further studies establishing the function and utilities of RNF14 are found in John Hopkins OMIM database record ID 605675, and in sited publications numbered 8810-967 listed in the bibliography section hereinbelow, which are also hereby incorporated by reference. Solute Carrier Family 22 (organic cation transporter), Member 5 (SLC22A5, Accession NM_003060) is another VGAM827 host target gene. SLC22A5 BINDING SITE is HOST TARGET binding site found in the 3' untranslated region of mRNA encoded by SLC22A5, corresponding to a HOST TARGET binding site such as BINDING SITE I, BINDING SITE II or BINDING SITE III. Table 2 illustrates the complementarity of the nucleotide sequences of SLC22A5 BINDING SITE, designated SEQ ID:9029, to the nucleotide sequence of VGAM827 RNA, herein designated VGAM RNA, also designated SEQ ID:3538.

Another function of VGAM827 is therefore inhibition of Solute Carrier Family 22 (organic cation transporter), Member 5 (SLC22A5, Accession NM_003060). Accordingly, utilities of VGAM827 include diagnosis, prevention and treatment of diseases and clinical conditions associated with SLC22A5. Syntaxin 7 (STX7, Accession NM_003569) is another VGAM827 host target gene. STX7 BINDING SITE is HOST TARGET binding site found in the 3' untranslated region of mRNA encoded by STX7, corresponding to a HOST TARGET binding site such as BINDING SITE I, BINDING SITE II or BINDING SITE III. Table 2 illustrates the complementarity of the nucleotide sequences of STX7 BINDING SITE, designated SEQ ID:9625, to the nucleotide sequence of VGAM827 RNA, herein designated VGAM RNA, also designated SEQ ID:3538.

Another function of VGAM827 is therefore inhibition of Syntaxin 7 (STX7, Accession NM_003569). Accordingly, utilities of VGAM827 include diagnosis, prevention and treatment of diseases and clinical conditions associated with STX7. Surfeit 6 (SURF6, Accession NM_006753) is another VGAM827 host target gene. SURF6 BINDING SITE is HOST TARGET binding site found in the 3' untranslated region of mRNA encoded by SURF6, corresponding to a HOST TARGET binding site such as BINDING SITE I, BINDING SITE II or BINDING SITE III. Table 2 illustrates the complementarity of the nucleotide sequences of SURF6 BINDING SITE, designated SEQ ID:13610, to the nucleotide sequence of VGAM827 RNA, herein designated VGAM RNA, also designated SEQ ID:3538.

Another function of VGAM827 is therefore inhibition of Surfeit 6 (SURF6, Accession NM_006753). Accordingly, utilities of VGAM827 include diagnosis, prevention and treatment of diseases and clinical conditions associated with SURF6. Cdc42 Guanine Nucleotide Exchange Factor (GEF) 9 (ARHGEF9, Accession NM_015185) is another VGAM827 host target gene. ARHGEF9 BINDING SITE is HOST TARGET binding site found in the 5' untranslated region of mRNA encoded by ARHGEF9, corresponding to a HOST TARGET binding site such as BINDING SITE I, BINDING SITE II or BINDING SITE III. Table 2 illustrates the complementarity of the nucleotide sequences of ARHGEF9 BINDING SITE, designated SEQ ID:17539, to the nucleotide sequence of VGAM827 RNA, herein designated VGAM RNA, also designated SEQ ID:3538.

Another function of VGAM827 is therefore inhibition of Cdc42 Guanine Nucleotide Exchange Factor (GEF) 9 (ARHGEF9, Accession NM_015185). Accordingly, utilities of VGAM827 include diagnosis, prevention and treatment of diseases and clinical conditions associated with ARHGEF9. Dedicator of Cyto-kinesis 3 (DOCK3, Accession XM_039259) is another VGAM827 host target gene. DOCK3 BINDING SITE is HOST TARGET binding site found in the 3' untranslated region of mRNA encoded by DOCK3, corresponding to a HOST TARGET binding site such as BINDING SITE I, BINDING SITE II or BINDING SITE III. Table 2 illustrates the complementarity of the nucleotide sequences of DOCK3 BINDING SITE, designated SEQ ID:33042, to the nucleotide sequence of VGAM827 RNA, herein designated VGAM RNA, also designated SEQ ID:3538.

Another function of VGAM827 is therefore inhibition of Dedicator of Cyto-kinesis 3 (DOCK3, Accession XM_039259). Accordingly, utilities of VGAM827 include diagnosis, prevention and treatment of diseases and clinical conditions associated with DOCK3. FLJ14153 (Accession NM_022736) is another VGAM827 host target gene. FLJ14153 BINDING SITE is HOST TARGET binding site found in the 3' untranslated region of mRNA encoded by FLJ14153, corresponding to a HOST TARGET binding site such as BINDING SITE I, BINDING SITE II or BINDING SITE III. Table 2 illustrates the complementarity of the nucleotide sequences of FLJ14153 BINDING SITE, designated SEQ ID:22942, to the nucleotide sequence of VGAM827 RNA, herein designated VGAM RNA, also designated SEQ ID:3538.

Another function of VGAM827 is therefore inhibition of FLJ14153 (Accession NM_022736). Accordingly, utilities of VGAM827 include diagnosis, prevention and treatment of diseases and clinical conditions associated with FLJ14153. FLJ22127 (Accession NM_022775) is another VGAM827 host target gene. FLJ22127 BINDING SITE is HOST TARGET binding site found in the 3' untranslated region of mRNA encoded by FLJ22127, corresponding to a HOST TARGET binding site such as BINDING SITE I, BINDING SITE II or BINDING SITE III. Table 2 illustrates the complementarity of the nucleotide sequences of FLJ22127 BINDING SITE, designated SEQ ID:23044, to the nucleotide sequence of VGAM827 RNA, herein designated VGAM RNA, also designated SEQ ID:3538.

Another function of VGAM827 is therefore inhibition of FLJ22127 (Accession NM_022775). Accordingly, utilities of VGAM827 include diagnosis, prevention and treatment of diseases and clinical conditions associated with FLJ22127. KIAA0276 (Accession XM_048199) is another VGAM827 host target gene. KIAA0276 BINDING SITE is HOST TARGET binding site found in the 3' untranslated region of mRNA encoded by KIAA0276, corresponding to a HOST TARGET binding site such as BINDING SITE I, BINDING SITE II or BINDING SITE III. Table 2 illustrates the complementarity of the nucleotide sequences of KIAA0276 BINDING SITE, designated SEQ ID:35140, to the nucleotide sequence of VGAM827 RNA, herein designated VGAM RNA, also designated SEQ ID:3538.

Another function of VGAM827 is therefore inhibition of KIAA0276 (Accession XM_048199). Accordingly, utilities of VGAM827 include diagnosis, prevention and treatment of diseases and clinical conditions associated with KIAA0276. KIAA0367 (Accession XM_041018) is another VGAM827 host target gene. KIAA0367 BINDING SITE is HOST TARGET binding site found in the 3' untranslated region of mRNA encoded by KIAA0367, corresponding to a HOST TARGET binding site such as BINDING SITE I, BINDING SITE II or BINDING SITE III. Table 2 illustrates the complementarity of the nucleotide sequences of KIAA0367 BINDING SITE, designated SEQ ID:33427, to the nucleotide sequence of VGAM827 RNA, herein designated VGAM RNA, also designated SEQ ID:3538.

Another function of VGAM827 is therefore inhibition of KIAA0367 (Accession XM_041018). Accordingly, utilities of VGAM827 include diagnosis, prevention and treatment of diseases and clinical conditions associated with KIAA0367. KIAA0494 (Accession NM_014774) is another VGAM827 host target gene. KIAA0494 BINDING SITE is HOST TARGET binding site found in the 5' untranslated region of mRNA encoded by KIAA0494, corresponding to a HOST TARGET binding site such as BINDING SITE I, BINDING SITE II or BINDING SITE III. Table 2 illustrates the complementarity of the nucleotide sequences of KIAA0494 BINDING SITE, designated SEQ ID:16592, to the nucleotide sequence of VGAM827 RNA, herein designated VGAM RNA, also designated SEQ ID:3538.

Another function of VGAM827 is therefore inhibition of KIAA0494 (Accession NM_014774). Accordingly, utilities of VGAM827 include diagnosis, prevention and treatment of diseases and clinical conditions associated with KIAA0494. KIAA1000 (Accession XM_036988) is another VGAM827 host target gene. KIAA1000 BINDING SITE is HOST TARGET binding site found in the 3' untranslated region of mRNA encoded by KIAA1000, corresponding to a HOST TARGET binding site such as BINDING SITE I, BINDING SITE II or BINDING SITE III. Table 2 illustrates the complementarity of the nucleotide sequences of KIAA1000 BINDING SITE, designated SEQ ID:32536, to the nucleotide sequence of VGAM827 RNA, herein designated VGAM RNA, also designated SEQ ID:3538.

Another function of VGAM827 is therefore inhibition of KIAA1000 (Accession XM_036988). Accordingly, utilities of VGAM827 include diagnosis, prevention and treatment of diseases and clinical conditions associated with KIAA1000. KIAA1155 (Accession XM_030864) is another VGAM827 host target gene. KIAA1155 BINDING SITE is HOST TARGET binding site found in the 3' untranslated region of mRNA encoded by KIAA1155, corresponding to a HOST TARGET binding site such as BINDING SITE I, BINDING SITE II or BINDING SITE III. Table 2 illustrates the complementarity of the nucleotide sequences of KIAA1155 BINDING SITE, designated SEQ ID:31203, to the nucleotide sequence of VGAM827 RNA, herein designated VGAM RNA, also designated SEQ ID:3538.

Another function of VGAM827 is therefore inhibition of KIAA1155 (Accession XM_030864). Accordingly, utilities of VGAM827 include diagnosis, prevention and treatment of diseases and clinical conditions associated with KIAA1155. KIAA1437 (Accession XM_026998) is another VGAM827 host target gene. KIAA1437 BINDING SITE is HOST TARGET binding site found in the 3' untranslated region of mRNA encoded by KIAA1437, corresponding to a HOST TARGET binding site such as BINDING SITE I, BINDING SITE II or BINDING SITE III. Table 2 illustrates the complementarity of the nucleotide sequences of KIAA1437 BINDING SITE, designated SEQ ID:30386, to the nucleotide sequence of VGAM827 RNA, herein designated VGAM RNA, also designated SEQ ID:3538.

Another function of VGAM827 is therefore inhibition of KIAA1437 (Accession XM_026998). Accordingly, utilities of VGAM827 include diagnosis, prevention and treatment of diseases and clinical conditions associated with KIAA1437. KIAA1884 (Accession XM_055539) is another VGAM827 host target gene. KIAA1884 BINDING SITE is HOST TARGET binding site found in the 3' untranslated region of mRNA encoded by KIAA1884, corresponding to a HOST TARGET binding site such as BINDING SITE I, BINDING SITE II or BINDING SITE III. Table 2 illustrates the complementarity of the nucleotide sequences of KIAA1884 BINDING SITE, designated SEQ ID:36299, to the nucleotide sequence of VGAM827 RNA, herein designated VGAM RNA, also designated SEQ ID:3538.

Another function of VGAM827 is therefore inhibition of KIAA1884 (Accession XM_055539). Accordingly, utilities of VGAM827 include diagnosis, prevention and treatment of diseases and clinical conditions associated with KIAA1884. NX-17 (Accession NM_020665) is another VGAM827 host target gene. NX-17 BINDING SITE is HOST TARGET binding site found in the 3' untranslated region of mRNA encoded by NX-17, corresponding to a HOST TARGET binding site such as BINDING SITE I, BINDING SITE II or BINDING SITE III. Table 2 illustrates the complementarity of the nucleotide sequences of NX-17 BINDING SITE, designated SEQ ID:21836, to the nucleotide sequence of VGAM827 RNA, herein designated VGAM RNA, also designated SEQ ID:3538.

Another function of VGAM827 is therefore inhibition of NX-17 (Accession NM_020665). Accordingly, utilities of VGAM827 include diagnosis, prevention and treatment of diseases and clinical conditions associated with NX-17. Platelet-activating Factor Acetylhydrolase 2, 40 kDa (PAFAH2, Accession NM_000437) is another VGAM827 host target gene. PAFAH2 BINDING SITE is HOST TARGET binding site found in the 3' untranslated region of mRNA encoded by PAFAH2, corresponding to a HOST TARGET binding site such as BINDING SITE I, BINDING SITE II or BINDING SITE III. Table 2 illustrates the complementarity of the nucleotide sequences of PAFAH2 BINDING SITE, designated SEQ ID:6022, to the nucleotide sequence of VGAM827 RNA, herein designated VGAM RNA, also designated SEQ ID:3538.

Another function of VGAM827 is therefore inhibition of Platelet-activating Factor Acetylhydrolase 2, 40 kDa (PAFAH2, Accession NM_000437). Accordingly, utilities of VGAM827 include diagnosis, prevention and treatment of diseases and clinical conditions associated with PAFAH2. Placenta-specific 3 (PLAC3, Accession XM_045115) is another VGAM827 host target gene. PLAC3 BINDING SITE is HOST TARGET binding site found in the 5' untranslated region of mRNA encoded by PLAC3, corresponding to a HOST TARGET binding site such as BINDING SITE I, BINDING SITE II or BINDING SITE III. Table 2 illustrates the complementarity of the nucleotide sequences of PLAC3 BINDING SITE, designated SEQ ID:34369, to the nucleotide sequence of VGAM827 RNA, herein designated VGAM RNA, also designated SEQ ID:3538.

Another function of VGAM827 is therefore inhibition of Placenta-specific 3 (PLAC3, Accession XM_045115). Accordingly, utilities of VGAM827 include diagnosis, prevention and treatment of diseases and clinical conditions associated with PLAC3. PRO2405 (Accession NM_018627) is another VGAM827 host target gene. PRO2405 BINDING SITE is HOST TARGET binding site found in the 5' untranslated region of mRNA encoded by PRO2405, corresponding to a HOST TARGET binding site such as BINDING SITE I, BINDING SITE II or BINDING SITE III. Table 2 illustrates the complementarity of the nucleotide sequences of PRO2405 BINDING SITE, designated SEQ ID:20700, to the nucleotide sequence of VGAM827 RNA, herein designated VGAM RNA, also designated SEQ ID:3538.

Another function of VGAM827 is therefore inhibition of PRO2405 (Accession NM_018627). Accordingly, utilities of VGAM827 include diagnosis, prevention and treatment of diseases and clinical conditions associated with PRO2405. Roundabout, Axon Guidance Receptor, Homolog 2 (Drosophila) (ROBO2, Accession XM_031246) is another VGAM827 host target gene. ROBO2 BINDING SITE is HOST TARGET binding site found in the 3' untranslated region of mRNA encoded by ROBO2, corresponding to a HOST TARGET binding site such as BINDING SITE I, BINDING SITE II or BINDING SITE III. Table 2 illustrates the complementarity of the nucleotide sequences of ROBO2 BINDING SITE, designated SEQ ID:31318, to the nucleotide sequence of VGAM827 RNA, herein designated VGAM RNA, also designated SEQ ID:3538.

Another function of VGAM827 is therefore inhibition of Roundabout, Axon Guidance Receptor, Homolog 2 (Drosophila) (ROBO2, Accession XM_031246). Accordingly, utilities of VGAM827 include diagnosis, prevention and treatment of diseases and clinical conditions associated with ROBO2. Sema Domain, Seven Thrombospondin Repeats (type 1 and type 1-like), Transmembrane Domain (TM) and Short Cytoplasmic Domain, (semaphorin) 5A (SEMA5A, Accession NM_003966) is another VGAM827 host target gene. SEMA5A BINDING SITE is HOST TARGET binding site found in the 3' untranslated region of mRNA encoded by SEMA5A, corresponding to a HOST TARGET binding site such as BINDING SITE I, BINDING SITE II or BINDING SITE III. Table 2 illustrates the complementarity of the nucleotide sequences of SEMA5A BINDING SITE, designated SEQ ID:10107, to the nucleotide sequence of VGAM827 RNA, herein designated VGAM RNA, also designated SEQ ID:3538.

Another function of VGAM827 is therefore inhibition of Sema Domain, Seven Thrombospondin Repeats (type 1 and type 1-like), Transmembrane Domain (TM) and Short Cytoplasmic Domain, (semaphorin) 5A (SEMA5A, Accession NM_003966). Accordingly, utilities of VGAM827 include diagnosis, prevention and treatment of diseases and clinical conditions associated with SEMA5A. LOC133688 (Accession XM_059665) is another VGAM827 host target gene. LOC133688 BINDING SITE is HOST TARGET binding site found in the 3' untranslated region of mRNA encoded by LOC133688, corresponding to a HOST TARGET binding site such as BINDING SITE I, BINDING SITE II or BINDING SITE III. Table 2 illustrates the complementarity of the nucleotide sequences of LOC133688 BINDING SITE, designated SEQ ID:37051, to the nucleotide sequence of VGAM827 RNA, herein designated VGAM RNA, also designated SEQ ID:3538.

Another function of VGAM827 is therefore inhibition of LOC133688 (Accession XM_059665). Accordingly, utilities of VGAM827 include diagnosis, prevention and treatment of diseases and clinical conditions associated with LOC133688. LOC145815 (Accession XM_096874) is another VGAM827 host target gene. LOC145815 BINDING SITE is HOST TARGET binding site found in the 5' untranslated region of mRNA encoded by LOC145815, corresponding to a HOST TARGET binding site such as BINDING SITE I, BINDING SITE II or BINDING SITE III. Table 2 illustrates the complementarity of the nucleotide sequences of LOC145815 BINDING SITE, designated SEQ ID:40608, to the nucleotide sequence of VGAM827 RNA, herein designated VGAM RNA, also designated SEQ ID:3538.

Another function of VGAM827 is therefore inhibition of LOC145815 (Accession XM_096874). Accordingly, utilities of VGAM827 include diagnosis, prevention and treatment of diseases and clinical conditions associated with LOC145815. LOC153338 (Accession XM_098361) is another VGAM827 host target gene. LOC153338 BINDING SITE is HOST TARGET binding site found in the 3' untranslated region of mRNA encoded by LOC153338, corresponding to a HOST TARGET binding site such as BINDING SITE I, BINDING SITE II or BINDING SITE III. Table 2 illustrates the complementarity of the nucleotide sequences of LOC153338 BINDING SITE, designated SEQ ID:41612, to the nucleotide sequence of VGAM827 RNA, herein designated VGAM RNA, also designated SEQ ID:3538.

Another function of VGAM827 is therefore inhibition of LOC153338 (Accession XM_098361). Accordingly, utilities of VGAM827 include diagnosis, prevention and treatment of diseases and clinical conditions associated with LOC153338. LOC155032 (Accession XM_098647) is another VGAM827 host target gene. LOC155032 BINDING SITE is HOST TARGET binding site found in the 3' untranslated region of mRNA encoded by LOC155032, corresponding to a HOST TARGET binding site such as BINDING SITE I, BINDING SITE II or BINDING SITE III. Table 2 illustrates the complementarity of the nucleotide sequences of LOC155032 BINDING SITE, designated SEQ ID:41749, to the nucleotide sequence of VGAM827 RNA, herein designated VGAM RNA, also designated SEQ ID:3538.

Another function of VGAM827 is therefore inhibition of LOC155032 (Accession XM_098647). Accordingly, utilities of VGAM827 include diagnosis, prevention and treatment of diseases and clinical conditions associated with LOC155032. LOC155376 (Accession XM_088240) is another VGAM827 host target gene. LOC155376 BINDING SITE is HOST TARGET binding site found in the 5' untranslated region of mRNA encoded by LOC155376, corresponding to a HOST TARGET binding site such as BINDING SITE I, BINDING SITE II or BINDING SITE III. Table 2 illustrates the complementarity of the nucleotide sequences of LOC155376 BINDING SITE, designated SEQ ID:39564, to the nucleotide sequence of VGAM827 RNA, herein designated VGAM RNA, also designated SEQ ID:3538.

Another function of VGAM827 is therefore inhibition of LOC155376 (Accession XM_088240). Accordingly, utilities of VGAM827 include diagnosis, prevention and treatment of diseases and clinical conditions associated with LOC155376. LOC158046 (Accession NM_145283) is another VGAM827 host target gene. LOC158046 BINDING SITE is HOST TARGET binding site found in the 3' untranslated region of mRNA encoded by LOC158046, corresponding to a HOST TARGET binding site such as BINDING SITE I, BINDING SITE II or BINDING SITE III. Table 2 illustrates the complementarity of the nucleotide sequences of LOC158046 BINDING SITE, designated SEQ ID:29801, to the nucleotide sequence of VGAM827 RNA, herein designated VGAM RNA, also designated SEQ ID:3538.

Another function of VGAM827 is therefore inhibition of LOC158046 (Accession NM_145283). Accordingly, utilities of VGAM827 include diagnosis, prevention and treatment of diseases and clinical conditions associated with LOC158046. LOC196527 (Accession XM_113743) is another VGAM827 host target gene. LOC196527 BINDING SITE is HOST TARGET binding site found in the 3' untranslated region of mRNA encoded by LOC196527, corresponding to a HOST TARGET binding site such as BINDING SITE I, BINDING SITE II or BINDING SITE III. Table 2 illustrates the complementarity of the nucleotide sequences of LOC196527 BINDING SITE, designated SEQ ID:42403, to the nucleotide sequence of VGAM827 RNA, herein designated VGAM RNA, also designated SEQ ID:3538.

Another function of VGAM827 is therefore inhibition of LOC196527 (Accession XM_113743). Accordingly, utilities of VGAM827 include diagnosis, prevention and treatment of diseases and clinical conditions associated with LOC196527. LOC245728 (Accession XM_165922) is another VGAM827 host target gene. LOC245728 BINDING SITE is HOST TARGET binding site found in the 5' untranslated region of mRNA encoded by LOC245728, corresponding to a HOST TARGET binding site such as BINDING SITE I, BINDING SITE II or BINDING SITE III. Table 2 illustrates the complementarity of the nucleotide sequences of LOC245728 BINDING SITE, designated SEQ ID:43803, to the nucleotide sequence of VGAM827 RNA, herein designated VGAM RNA, also designated SEQ ID:3538.

Another function of VGAM827 is therefore inhibition of LOC245728 (Accession XM_165922). Accordingly, utilities of VGAM827 include diagnosis, prevention and treatment of diseases and clinical conditions associated with LOC245728. LOC253532 (Accession XM_171152) is another VGAM827 host target gene. LOC253532 BINDING SITE is HOST TARGET binding site found in the 5' untranslated region of mRNA encoded by LOC253532, corresponding to a HOST TARGET binding site such as BINDING SITE I, BINDING SITE II or BINDING SITE III. Table 2 illustrates the complementarity of the nucleotide sequences of LOC253532 BINDING SITE, designated SEQ ID:45950, to the nucleotide sequence of VGAM827 RNA, herein designated VGAM RNA, also designated SEQ ID:3538.

Another function of VGAM827 is therefore inhibition of LOC253532 (Accession XM_171152). Accordingly, utilities of VGAM827 include diagnosis, prevention and treatment of diseases and clinical conditions associated with LOC253532. LOC253613 (Accession XM_171225) is another VGAM827 host target gene. LOC253613 BINDING SITE is HOST TARGET binding site found in the 3' untranslated region of mRNA encoded by LOC253613, corresponding to a HOST TARGET binding site such as BINDING SITE I, BINDING SITE II or BINDING SITE III. Table 2 illustrates the complementarity of the nucleotide sequences of LOC253613 BINDING SITE, designated SEQ ID:46014, to the nucleotide sequence of VGAM827 RNA, herein designated VGAM RNA, also designated SEQ ID:3538.

Another function of VGAM827 is therefore inhibition of LOC253613 (Accession XM_171225). Accordingly, utilities of VGAM827 include diagnosis, prevention and treatment of diseases and clinical conditions associated with LOC253613. LOC254337 (Accession XM_172034) is another VGAM827 host target gene. LOC254337 BINDING SITE is HOST TARGET binding site found in the 5' untranslated region of mRNA encoded by LOC254337, corresponding to a HOST TARGET binding site such as BINDING SITE I, BINDING SITE II or BINDING SITE III. Table 2 illustrates the complementarity of the nucleotide sequences of LOC254337 BINDING SITE, designated SEQ ID:46066, to the nucleotide sequence of VGAM827 RNA, herein designated VGAM RNA, also designated SEQ ID:3538.

Another function of VGAM827 is therefore inhibition of LOC254337 (Accession XM_172034). Accordingly, utilities of VGAM827 include diagnosis, prevention and treatment of diseases and clinical conditions associated with LOC254337. LOC254875 (Accession XM_171170) is another VGAM827 host target gene. LOC254875 BINDING SITE is HOST TARGET binding site found in the 5' untranslated region of mRNA encoded by LOC254875, corresponding to a HOST TARGET binding site such as BINDING SITE I, BINDING SITE II or BINDING SITE III. Table 2 illustrates the complementarity of the nucleotide sequences of LOC254875 BINDING SITE, designated SEQ ID:45954, to the nucleotide sequence of VGAM827 RNA, herein designated VGAM RNA, also designated SEQ ID:3538.

Another function of VGAM827 is therefore inhibition of LOC254875 (Accession XM_171170). Accordingly, utilities of VGAM827 include diagnosis, prevention and treatment of diseases and clinical conditions associated with LOC254875. LOC51141 (Accession XM_043953) is another VGAM827 host target gene. LOC51141 BINDING SITE is HOST TARGET binding site found in the 3' untranslated region of mRNA encoded by LOC51141, corresponding to a HOST TARGET binding site such as BINDING SITE I, BINDING SITE II or BINDING SITE III. Table 2 illustrates the complementarity of the nucleotide sequences of LOC51141 BINDING SITE, designated SEQ ID:34052, to the nucleotide sequence of VGAM827 RNA, herein designated VGAM RNA, also designated SEQ ID:3538.

Another function of VGAM827 is therefore inhibition of LOC51141 (Accession XM_043953). Accordingly, utilities of VGAM827 include diagnosis, prevention and treatment of diseases and clinical conditions associated with LOC51141. LOC90321 (Accession XM_030896) is another VGAM827 host target gene. LOC90321 BINDING SITE is HOST TARGET binding site found in the 3' untranslated region of mRNA encoded by LOC90321, corresponding to a HOST TARGET binding site such as BINDING SITE I, BINDING SITE II or BINDING SITE III. Table 2 illustrates the complementarity of the nucleotide sequences of LOC90321 BINDING SITE, designated SEQ ID:31213, to the nucleotide sequence of VGAM827 RNA, herein designated VGAM RNA, also designated SEQ ID:3538.

Another function of VGAM827 is therefore inhibition of LOC90321 (Accession XM_030896). Accordingly, utilities of VGAM827 include diagnosis, prevention and treatment of diseases and clinical conditions associated with LOC90321. LOC93349 (Accession NM_138402) is another VGAM827 host target gene. LOC93349 BINDING SITE is HOST TARGET binding site found in the 3' untranslated region of mRNA encoded by LOC93349, corresponding to a HOST TARGET binding site such as BINDING SITE I, BINDING SITE II or BINDING SITE III. Table 2 illustrates the complementarity of the nucleotide sequences of LOC93349 BINDING SITE, designated SEQ ID:28770, to the nucleotide sequence of VGAM827 RNA, herein designated VGAM RNA, also designated SEQ ID:3538.

Another function of VGAM827 is therefore inhibition of LOC93349 (Accession NM_138402). Accordingly, utilities of VGAM827 include diagnosis, prevention and treatment of diseases and clinical conditions associated with LOC93349. FIG. 1 further provides a conceptual description of a novel bioinformatically detected viral gene of the present invention, referred to here as Viral Genomic Address Messenger 828 (VGAM828) viral gene, which modulates expression of respective host target genes thereof, the function and utility of which host target genes is known in the art.

VGAM828 is a novel bioinformatically detected regulatory, non protein coding, viral micro RNA (miRNA) gene. The method by which VGAM828 was detected is described hereinabove with reference to FIGS. 1-8.

VGAM828 gene, herein designated VGAM GENE, is a viral gene contained in the genome of African Swine Fever Virus. VGAM828 host target gene, herein designated VGAM HOST TARGET GENE, is a human gene contained in the human genome.

VGAM828 gene encodes a VGAM828 precursor RNA, herein designated VGAM PRECURSOR RNA. Similar to other miRNA genes, and unlike most ordinary genes, VGAM828 precursor RNA does not encode a protein. A nucleotide sequence identical or highly similar to the nucleotide sequence of VGAM828 precursor RNA is designated SEQ ID:814, and is provided hereinbelow with reference to the sequence listing part. Nucleotide sequence SEQ ID:814 is located at position 13516 relative to the genome of African Swine Fever Virus.

VGAM828 precursor RNA folds onto itself, forming VGAM828 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM828 folded precursor RNA into VGAM828 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM828 RNA is designated SEQ ID:3539, and is provided hereinbelow with reference to the sequence listing part.

VGAM828 host target gene, herein designated VGAM HOST TARGET GENE, encodes a corresponding messenger RNA, VGAM828 host target RNA, herein designated VGAM HOST TARGET RNA. VGAM828 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM828 RNA, herein designated VGAM RNA, binds complementarily to one or more host target binding sites located in untranslated regions of VGAM828 host target RNA, herein designated VGAM HOST TARGET RNA. This complementary binding is due to the fact that the nucleotide sequence of VGAM828 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM828 RNA, herein designated VGAM RNA, may have a different number of host target binding sites in untranslated regions of a VGAM828 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM828 RNA, herein designated VGAM RNA, to host target binding sites on VGAM828 host target RNA, herein designated VGAM HOST TARGET RNA, such as BINDING SITE I, BINDING SITE II and BINDING SITE III, inhibits translation of VGAM828 host target RNA into VGAM828 host target protein, herein designated VGAM HOST TARGET PROTEIN. VGAM host target protein is therefore outlined by a broken line.

It is appreciated that VGAM828 host target gene, herein designated VGAM HOST TARGET GENE, in fact represents a plurality of VGAM828 host target genes. The mRNA of each one of this plurality of VGAM828 host target genes comprises one or more host target binding sites, each having a nucleotide sequence which is at least partly complementary to VGAM828 RNA, herein designated VGAM RNA, and which when bound by VGAM828 RNA causes inhibition of translation of respective one or more VGAM828 host target proteins.

It is further appreciated by one skilled in the art that the mode of translational inhibition illustrated by FIG. 1 with specific reference to translational inhibition exerted by VGAM828 gene, herein designated VGAM GENE, on one or more VGAM828 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM828 is inhibition of expression of host target genes, as part of a novel viral mechanism of attacking a host. Accordingly, utilities of VGAM828 include diagnosis, prevention and treatment of viral infection by African Swine Fever Virus. Specific functions, and accordingly utilities, of VGAM828 correlate with, and may be deduced from, the identity of the host target genes which VGAM828 binds and inhibits, and the function of these host target genes, as elaborated hereinbelow.

Nucleotide sequences of the VGAM828 precursor RNA, herein designated VGAM PRECURSOR RNA, and of the 'diced' VGAM828 RNA, herein designated VGAM RNA, and a schematic representation of the secondary folding of VGAM828 folded precursor RNA, herein designated VGAM FOLDED PRECURSOR RNA, of VGAM828 are further described hereinbelow with reference to Table 1.

Nucleotide sequences of host target binding sites, such as BINDING SITE-I, BINDING SITE-II and BINDING SITE-III of FIG. 1, found on VGAM828 host target RNA, and schematic representation of the complementarity of each of these host target binding sites to VGAM828 RNA, herein designated VGAM RNA, are described hereinbelow with reference to Table 2.

As mentioned hereinabove with reference to FIG. 1, a function of VGAM828 gene, herein designated VGAM is inhibition of expression of VGAM828 target genes. It is appreciated that specific functions, and accordingly utilities, of VGAM828 correlate with, and may be deduced from, the identity of the target genes which VGAM828 binds and inhibits, and the function of these target genes, as elaborated hereinbelow.

D12S2489E (Accession NM_007360) is a VGAM828 host target gene. D12S2489E BINDING SITE is HOST TARGET binding site found in the 3' untranslated region of mRNA encoded by D12S2489E, corresponding to a HOST TARGET binding site such as BINDING SITE I, BINDING SITE II or BINDING SITE III. Table 2 illustrates the complementarity of the nucleotide sequences of D12S2489E BINDING SITE, designated SEQ ID:14293, to the nucleotide sequence of VGAM828 RNA, herein designated VGAM RNA, also designated SEQ ID:3539.

A function of VGAM828 is therefore inhibition of D12S2489E (Accession NM_007360), a gene which interacts in the inhibition and activation of NK cells. Accordingly, utilities of VGAM828 include diagnosis, prevention and treatment of diseases and clinical conditions associated with D12S2489E. The function of D12S2489E and its association with various diseases and clinical conditions, has been established by previous studies, as described hereinabove with reference to VGAM156. Nuclear Receptor Coactivator 6 (NCOA6, Accession NM_014071) is another VGAM828 host target gene. NCOA6 BINDING SITE is HOST TARGET binding site found in the 5' untranslated region of mRNA encoded by NCOA6, corresponding to a HOST TARGET binding site such as BINDING SITE I, BINDING SITE II or BINDING SITE III. Table 2 illustrates the complementarity of the nucleotide sequences of NCOA6 BINDING SITE, designated SEQ ID:15291, to the nucleotide sequence of VGAM828 RNA, herein designated VGAM RNA, also designated SEQ ID:3539.

Another function of VGAM828 is therefore inhibition of Nuclear Receptor Coactivator 6 (NCOA6, Accession NM_014071), a gene which activates gene transcription through ligand-dependent association with coactivators. Accordingly, utilities of VGAM828 include diagnosis, prevention and treatment of diseases and clinical conditions associated with NCOA6. The function of NCOA6 and its association with various diseases and clinical conditions, has been established by previous studies, as described hereinabove with reference to VGAM25. Phosphoribosyl Pyrophosphate Synthetase 2 (PRPS2, Accession NM_002765) is another VGAM828 host target gene. PRPS2 BINDING SITE is HOST TARGET binding site found in the 3' untranslated region of mRNA encoded by PRPS2, corresponding to a HOST TARGET binding site such as BINDING SITE I, BINDING SITE II or BINDING SITE III. Table 2 illustrates the complementarity of the nucleotide sequences of PRPS2 BINDING SITE, designated SEQ ID:8658, to the nucleotide sequence of VGAM828 RNA, herein designated VGAM RNA, also designated SEQ ID:3539.

Another function of VGAM828 is therefore inhibition of Phosphoribosyl Pyrophosphate Synthetase 2 (PRPS2, Accession NM_002765), a gene which generates the PRPP needed for initiation of purine biosynthesis. Accordingly, utilities of VGAM828 include diagnosis, prevention and treatment of diseases and clinical conditions associated with PRPS2. The function of PRPS2 has been established by previous studies. Five-phosphoribosyl 1-pyrophosphate (OMIM Ref. No. PPRibP), an essential substrate and a critical regulator in the purine, pyrimidine, and pyridine nucleotide production pathways, is synthesized from MgATP and ribose 5-phosphate by the enzyme PPRibP synthetase (EC 2.7.6.1). By cDNA cloning, Taira et al. (1987) found 2 distinct PPRibP synthetase subunits, PRS I (PRPS1; 311850) and PRS II. By screening a testis library with a rat PRS II cDNA, Iizasa et al. (1989) isolated cDNAs encoding human PRS II. The predicted 318-amino acid protein shares 99% identity with rat PRS II. Northern blot analysis revealed that PRS II is expressed as a 2.7-kb mRNA in testis. By using a rat cDNA probe for PRPS1 and a human cDNA probe for PRPS2, Taira et al. (1989) showed in DNA from somatic cell hybrids and in spot-blot hybridization of flow-sorted chromosomes that whereas PRPS1 is on Xq21-qter, PRPS2 is on Xpter-q21. Furthermore, 2 PRPS1-related genes were identified on chromosomes 7 and 9. By a combination of in situ hybridization and study of human/rodent somatic cell hybrids, Becker et al. (1990) assigned the PRPS2 locus to Xp22.3-p22.2. Despite the striking homology in the cDNA sequence and deduced amino acid sequence, PRPS1 and PRPS2 are encoded by genes on opposite arms of the X chromosome. Wang et al. (1992) demonstrated that the PRPS2 gene is inactivated with lyonization but that it lies between 2 genes that escape inactivation, STS (OMIM Ref. No. 308100) distally and ZFX (OMIM Ref. No. 314980) proximally. The PRPS1 gene also undergoes X inactivation. Wang et al. (1992) commented that it was not known which of the 2 PRPS loci is altered in patients with inherited PRPS superactivity. The ZFX gene, which escapes X-inactivation, is bracketed proximally by the POLA gene (OMIM Ref. No. 312040) which, like PRPS2, undergoes inactivation. The A1S9T (OMIM Ref. No. 314370) locus in the proximal short arm and the RPS4X gene (OMIM Ref. No. 312760) in the proximal long arm are other loci that escape inactivation and are interspersed among genes that do undergo X-inactivation. Furthermore, the XIST gene (OMIM Ref. No. 314670), located at Xq13, is transcribed only from the inactive X chromosome Full details of the abovementioned studies are described in the following publications, the disclosure of which are hereby incorporated by reference:

Taira, M.; Kudoh, J.; Minoshima, S.; Iizasa, T.; Shimada, H.; Shimizu, Y.; Tatibana, M.; Shimizu, N.: Localization of human phosphoribosylpyrophosphate synthetase subunit I and II genes (PRPS1 and PRPS2) to different regions of the X chromosome and assignment of two PRPS1-related genes to autosomes. Somat. Cell Molec. Genet. 15:29-37, 1989; and Wang, J. C.; Passage, M. B.; Ellison, J.; Becker, M. A.; Yen, P. H.; Shapiro, L. J.; Mohandas, T. K.: Physical mapping of loci in the distal half of the short arm of the human X chromos.

Further studies establishing the function and utilities of PRPS2 are found in John Hopkins OMIM database record ID 311860, and in sited publications numbered 8345-1234 listed in the bibliography section hereinbelow, which are also hereby incorporated by reference. Sex Comb On Midleg-like 1 (Drosophila) (SCML1, Accession NM_006746) is another VGAM828 host target gene. SCML1 BINDING SITE is HOST TARGET binding site found in the 3' untranslated region of mRNA encoded by SCML1, corresponding to a HOST TARGET binding site such as BINDING SITE I, BINDING SITE II or BINDING SITE III. Table 2 illustrates the complementarity of the nucleotide sequences of SCML1 BINDING SITE, designated SEQ ID:13594, to the nucleotide sequence of VGAM828 RNA, herein designated VGAM RNA, also designated SEQ ID:3539.

Another function of VGAM828 is therefore inhibition of Sex Comb On Midleg-like 1 (Drosophila) (SCML1, Accession NM_006746). Accordingly, utilities of VGAM828 include diagnosis, prevention and treatment of diseases and clinical conditions associated with SCML1. Sel-1 Suppressor of Lin-12-like (C. elegans) (SEL1L, Accession NM_005065) is another VGAM828 host target gene. SEL1L BINDING SITE is HOST TARGET binding site found in the 3' untranslated region of mRNA encoded by SEL1L, corresponding to a HOST TARGET binding site such as BINDING SITE I, BINDING SITE II or BINDING SITE III. Table 2 illustrates the complementarity of the nucleotide sequences of SEL1L BINDING SITE, designated SEQ ID:11504, to the nucleotide sequence of VGAM828 RNA, herein designated VGAM RNA, also designated SEQ ID:3539.

Another function of VGAM828 is therefore inhibition of Sel-1 Suppressor of Lin-12-like (C. elegans) (SEL1L, Accession NM_005065), a gene which may play a role in notch signaling (by similarity). Accordingly, utilities of VGAM828 include diagnosis, prevention and treatment of diseases and clinical conditions associated with SEL1L. The function of SEL1L and its association with various diseases and clinical conditions, has been established by previous studies, as described hereinabove with reference to VGAM245. Single-minded Homolog 1 (Drosophila) (SIM1, Accession NM_005068) is another VGAM828 host target gene. SIM1 BINDING SITE is HOST TARGET binding site found in the 3' untranslated region of mRNA encoded by SIM1, corresponding to a HOST TARGET binding site such as BINDING SITE I, BINDING SITE II or BINDING SITE III. Table 2 illustrates the complementarity of the nucleotide sequences of SIM1 BINDING SITE, designated SEQ ID:11514, to the nucleotide sequence of VGAM828 RNA, herein designated VGAM RNA, also designated SEQ ID:3539.

Another function of VGAM828 is therefore inhibition of Single-minded Homolog 1 (Drosophila) (SIM1, Accession NM_005068), a gene which may have pleiotropic effects during embryogenesis and in the adult. Accordingly, utilities of VGAM828 include diagnosis, prevention and treatment of diseases and clinical conditions associated with SIM1. The function of SIM1 and its association with various diseases and clinical conditions, has been established by previous studies, as described hereinabove with reference to VGAM665. Sparc/osteonectin, Cwcv and Kazal-like Domains Proteoglycan (testican) (SPOCK, Accession XM_031696) is another VGAM828 host target gene. SPOCK BINDING SITE is HOST TARGET binding site found in the 3' untranslated region of mRNA encoded by SPOCK, corresponding to a HOST TARGET binding site such as BINDING SITE I, BINDING SITE II or BINDING SITE III. Table 2 illustrates the complementarity of the nucleotide sequences of SPOCK BINDING SITE, designated SEQ ID:31459, to the nucleotide sequence of VGAM828 RNA, herein designated VGAM RNA, also designated SEQ ID:3539.

Another function of VGAM828 is therefore inhibition of Sparc/osteonectin, Cwcv and Kazal-like Domains Proteoglycan (testican) (SPOCK, Accession XM_031696). Accordingly, utilities of VGAM828 include diagnosis, prevention and treatment of diseases and clinical conditions associated with SPOCK. B1 (Accession NM_014451) is another VGAM828 host target gene. B1 BINDING SITE is HOST TARGET binding site found in the 3' untranslated region of mRNA encoded by B1, corresponding to a HOST TARGET binding site such as BINDING SITE I, BINDING SITE II or BINDING SITE III. Table 2 illustrates the complementarity of the nucleotide sequences of B1 BINDING SITE, designated SEQ ID:15801, to the nucleotide sequence of VGAM828 RNA, herein designated VGAM RNA, also designated SEQ ID:3539.

Another function of VGAM828 is therefore inhibition of B1 (Accession NM_014451). Accordingly, utilities of VGAM828 include diagnosis, prevention and treatment of diseases and clinical conditions associated with B1. FLJ14281 (Accession NM_024920) is another VGAM828 host target gene. FLJ14281 BINDING SITE is HOST TARGET binding site found in the 3' untranslated region of mRNA encoded by FLJ14281, corresponding to a HOST TARGET binding site such as BINDING SITE I, BINDING SITE II or BINDING SITE III. Table 2 illustrates the complementarity of the nucleotide sequences of FLJ14281 BINDING SITE, designated SEQ ID:24453, to the nucleotide sequence of VGAM828 RNA, herein designated VGAM RNA, also designated SEQ ID:3539.

Another function of VGAM828 is therefore inhibition of FLJ14281 (Accession NM_024920). Accordingly, utilities of VGAM828 include diagnosis, prevention and treatment of diseases and clinical conditions associated with FLJ14281. HSPC019 (Accession NM_014028) is another VGAM828 host target gene. HSPC019 BINDING SITE is HOST TARGET binding site found in the 3' untranslated region of mRNA encoded by HSPC019, corresponding to a HOST TARGET binding site such as BINDING SITE I, BINDING SITE II or BINDING SITE III. Table 2 illustrates the complementarity of the nucleotide sequences of HSPC019 BINDING SITE, designated SEQ ID:15254, to the nucleotide sequence of VGAM828 RNA, herein designated VGAM RNA, also designated SEQ ID:3539.

Another function of VGAM828 is therefore inhibition of HSPC019 (Accession NM_014028). Accordingly, utilities of VGAM828 include diagnosis, prevention and treatment of diseases and clinical conditions associated with HSPC019. KIAA0296 (Accession NM_014699) is another VGAM828 host target gene. KIAA0296 BINDING SITE is HOST TARGET binding site found in the 3' untranslated region of mRNA encoded by KIAA0296, corresponding to a HOST TARGET binding site such as BINDING SITE I, BINDING SITE II or BINDING SITE III. Table 2 illustrates the complementarity of the nucleotide sequences of KIAA0296 BINDING SITE, designated SEQ ID:16224, to the nucleotide sequence of VGAM828 RNA, herein designated VGAM RNA, also designated SEQ ID:3539.

Another function of VGAM828 is therefore inhibition of KIAA0296 (Accession NM_014699). Accordingly, utilities of VGAM828 include diagnosis, prevention and treatment of diseases and clinical conditions associated with KIAA0296. KIAA0453 (Accession XM_044546) is another VGAM828 host target gene. KIAA0453 BINDING SITE is HOST TARGET binding site found in the 3' untranslated region of mRNA encoded by KIAA0453, corresponding to a HOST TARGET binding site such as BINDING SITE I, BINDING SITE II or BINDING SITE III. Table 2 illustrates the complementarity of the nucleotide sequences of KIAA0453 BINDING SITE, designated SEQ ID:34231, to the nucleotide sequence of VGAM828 RNA, herein designated VGAM RNA, also designated SEQ ID:3539.

Another function of VGAM828 is therefore inhibition of KIAA0453 (Accession XM_044546). Accordingly, utilities of VGAM828 include diagnosis, prevention and treatment of diseases and clinical conditions associated with KIAA0453. KR18 (Accession NM_033288) is another VGAM828 host target gene. KR18 BINDING SITE is HOST TARGET binding site found in the 3' untranslated region of mRNA encoded by KR18, corresponding to a HOST TARGET binding site such as BINDING SITE I, BINDING SITE II or BINDING SITE III. Table 2 illustrates the complementarity of the nucleotide sequences of KR18 BINDING SITE, designated SEQ ID:27120, to the nucleotide sequence of VGAM828 RNA, herein designated VGAM RNA, also designated SEQ ID:3539.

Another function of VGAM828 is therefore inhibition of KR18 (Accession NM_033288). Accordingly, utilities of VGAM828 include diagnosis, prevention and treatment of diseases and clinical conditions associated with KR18. LAT1-3TM (Accession NM_031211) is another VGAM828 host target gene. LAT1-3TM BINDING SITE is HOST TARGET binding site found in the 3' untranslated region of mRNA encoded by LAT1-3TM, corresponding to a HOST TARGET binding site such as BINDING SITE I, BINDING SITE II or BINDING SITE III. Table 2 illustrates the complementarity of the nucleotide sequences of LAT1-3TM BINDING SITE, designated SEQ ID:25253, to the nucleotide sequence of VGAM828 RNA, herein designated VGAM RNA, also designated SEQ ID:3539.

Another function of VGAM828 is therefore inhibition of LAT1-3TM (Accession NM_031211). Accordingly, utilities of VGAM828 include diagnosis, prevention and treatment of diseases and clinical conditions associated with LAT1-3TM. MEGF10 (Accession NM_032446) is another VGAM828 host target gene. MEGF10 BINDING SITE is HOST TARGET binding site found in the 3' untranslated region of mRNA encoded by MEGF10, corresponding to a HOST TARGET binding site such as BINDING SITE I, BINDING SITE II or BINDING SITE III. Table 2 illustrates the complementarity of the nucleotide sequences of MEGF10 BINDING SITE, designated SEQ ID:26214, to the nucleotide sequence of VGAM828 RNA, herein designated VGAM RNA, also designated SEQ ID:3539.

Another function of VGAM828 is therefore inhibition of MEGF10 (Accession NM_032446). Accordingly, utilities of VGAM828 include diagnosis, prevention and treatment of diseases and clinical conditions associated with MEGF10. MGC2488 (Accession NM_024039) is another VGAM828 host target gene. MGC2488 BINDING SITE is HOST TARGET binding site found in the 3' untranslated region of mRNA encoded by MGC2488, corresponding to a HOST TARGET binding site such as BINDING SITE I, BINDING SITE II or BINDING SITE III. Table 2 illustrates the complementarity of the nucleotide sequences of MGC2488 BINDING SITE, designated SEQ ID:23474, to the nucleotide sequence of VGAM828 RNA, herein designated VGAM RNA, also designated SEQ ID:3539.

Another function of VGAM828 is therefore inhibition of MGC2488 (Accession NM_024039). Accordingly, utilities of VGAM828 include diagnosis, prevention and treatment of diseases and clinical conditions associated with MGC2488. Stromal Interaction Molecule 2 (STIM2, Accession NM_020860) is another VGAM828 host target gene. STIM2 BINDING SITE is HOST TARGET binding site found in the 3' untranslated region of mRNA encoded by STIM2, corresponding to a HOST TARGET binding site such as BINDING SITE I, BINDING SITE II or BINDING SITE III. Table 2 illustrates the complementarity of the nucleotide sequences of STIM2 BINDING SITE, designated SEQ ID:21917, to the nucleotide sequence of VGAM828 RNA, herein designated VGAM RNA, also designated SEQ ID:3539.

Another function of VGAM828 is therefore inhibition of Stromal Interaction Molecule 2 (STIM2, Accession NM_020860). Accordingly, utilities of VGAM828 include diagnosis, prevention and treatment of diseases and clinical conditions associated with STIM2. LOC120103 (Accession XM_058449) is another VGAM828 host target gene. LOC120103 BINDING SITE is HOST TARGET binding site found in the 3' untranslated region of mRNA encoded by LOC120103, corresponding to a HOST TARGET binding site such as BINDING SITE I, BINDING SITE II or BINDING SITE III. Table 2 illustrates the complementarity of the nucleotide sequences of LOC120103 BINDING SITE, designated SEQ ID:36619, to the nucleotide sequence of VGAM828 RNA, herein designated VGAM RNA, also designated SEQ ID:3539.

Another function of VGAM828 is therefore inhibition of LOC120103 (Accession XM_058449). Accordingly, utilities of VGAM828 include diagnosis, prevention and treatment of diseases and clinical conditions associated with LOC120103. LOC138639 (Accession XM_059988) is another VGAM828 host target gene. LOC138639 BINDING SITE is HOST TARGET binding site found in the 3' untranslated region of mRNA encoded by LOC138639, corresponding to a HOST TARGET binding site such as BINDING SITE I, BINDING SITE II or BINDING SITE III. Table 2 illustrates the complementarity of the nucleotide sequences of LOC138639 BINDING SITE, designated SEQ ID:37140, to the nucleotide sequence of VGAM828 RNA, herein designated VGAM RNA, also designated SEQ ID:3539.

Another function of VGAM828 is therefore inhibition of LOC138639 (Accession XM_059988). Accordingly, utilities of VGAM828 include diagnosis, prevention and treatment of diseases and clinical conditions associated with LOC138639. LOC145945 (Accession XM_096908) is another VGAM828 host target gene. LOC145945 BINDING SITE is HOST TARGET binding site found in the 5' untranslated region of mRNA encoded by LOC145945, corresponding to a HOST TARGET binding site such as BINDING SITE I, BINDING SITE II or BINDING SITE III. Table 2 illustrates the complementarity of the nucleotide sequences of LOC145945 BINDING SITE, designated SEQ ID:40635, to the nucleotide sequence of VGAM828 RNA, herein designated VGAM RNA, also designated SEQ ID:3539.

Another function of VGAM828 is therefore inhibition of LOC145945 (Accession XM_096908). Accordingly, utilities of VGAM828 include diagnosis, prevention and treatment of diseases and clinical conditions associated with LOC145945. LOC197423 (Accession XM_085436) is another VGAM828 host target gene. LOC197423 BINDING SITE is HOST TARGET binding site found in the 5' untranslated region of mRNA encoded by LOC197423, corresponding to a HOST TARGET binding site such as BINDING SITE I, BINDING SITE II or BINDING SITE III. Table 2 illustrates the complementarity of the nucleotide sequences of LOC197423 BINDING SITE, designated SEQ ID:38144, to the nucleotide sequence of VGAM828 RNA, herein designated VGAM RNA, also designated SEQ ID:3539.

Another function of VGAM828 is therefore inhibition of LOC197423 (Accession XM_085436). Accordingly, utilities of VGAM828 include diagnosis, prevention and treatment of diseases and clinical conditions associated with LOC197423. LOC220672 (Accession XM_017177) is another VGAM828 host target gene. LOC220672 BINDING SITE is HOST TARGET binding site found in the 3' untranslated region of mRNA encoded by LOC220672, corresponding to a HOST TARGET binding site such as BINDING SITE I, BINDING SITE II or BINDING SITE III. Table 2 illustrates the complementarity of the nucleotide sequences of LOC220672 BINDING SITE, designated SEQ ID:30310, to the nucleotide sequence of VGAM828 RNA, herein designated VGAM RNA, also designated SEQ ID:3539.

Another function of VGAM828 is therefore inhibition of LOC220672 (Accession XM_017177). Accordingly, utilities of VGAM828 include diagnosis, prevention and treatment of diseases and clinical conditions associated with LOC220672. FIG. 1 further provides a conceptual description of a novel bioinformatically detected viral gene of the present invention, referred to here as Viral Genomic Address Messenger 829 (VGAM829) viral gene, which modulates expression of respective host target genes thereof, the function and utility of which host target genes is known in the art.

VGAM829 is a novel bioinformatically detected regulatory, non protein coding, viral micro RNA (miRNA) gene. The method by which VGAM829 was detected is described hereinabove with reference to FIGS. 1-8.

VGAM829 gene, herein designated VGAM GENE, is a viral gene contained in the genome of African Swine Fever Virus. VGAM829 host target gene, herein designated VGAM HOST TARGET GENE, is a human gene contained in the human genome.

VGAM829 gene encodes a VGAM829 precursor RNA, herein designated VGAM PRECURSOR RNA. Similar to other miRNA genes, and unlike most ordinary genes, VGAM829 precursor RNA does not encode a protein. A nucleotide sequence identical or highly similar to the nucleotide sequence of VGAM829 precursor RNA is designated SEQ ID:815, and is provided hereinbelow with reference to the sequence listing part. Nucleotide sequence SEQ ID:815 is located at position 13995 relative to the genome of African Swine Fever Virus.

VGAM829 precursor RNA folds onto itself, forming VGAM829 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM829 folded precursor RNA into VGAM829 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM829 RNA is designated SEQ ID:3540, and is provided hereinbelow with reference to the sequence listing part.

VGAM829 host target gene, herein designated VGAM HOST TARGET GENE, encodes a corresponding messenger RNA, VGAM829 host target RNA, herein designated VGAM HOST TARGET RNA. VGAM829 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM829 RNA, herein designated VGAM RNA, binds complementarily to one or more host target binding sites located in untranslated regions of VGAM829 host target RNA, herein designated VGAM HOST TARGET RNA. This complementary binding is due to the fact that the nucleotide sequence of VGAM829 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM829 RNA, herein designated VGAM RNA, may have a different number of host target binding sites in untranslated regions of a VGAM829 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM829 RNA, herein designated VGAM RNA, to host target binding sites on VGAM829 host target RNA, herein designated VGAM HOST TARGET RNA, such as BINDING SITE I, BINDING SITE II and BINDING SITE III, inhibits translation of VGAM829 host target RNA into VGAM829 host target protein, herein designated VGAM HOST TARGET PROTEIN. VGAM host target protein is therefore outlined by a broken line.

It is appreciated that VGAM829 host target gene, herein designated VGAM HOST TARGET GENE, in fact represents a plurality of VGAM829 host target genes. The mRNA of each one of this plurality of VGAM829 host target genes comprises one or more host target binding sites, each having a nucleotide sequence which is at least partly complementary to VGAM829 RNA, herein designated VGAM RNA, and which when bound by VGAM829 RNA causes inhibition of translation of respective one or more VGAM829 host target proteins.

It is further appreciated by one skilled in the art that the mode of translational inhibition illustrated by FIG. 1 with specific reference to translational inhibition exerted by VGAM829 gene, herein designated VGAM GENE, on one or more VGAM829 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM829 is inhibition of expression of host target genes, as part of a novel viral mechanism of attacking a host. Accordingly, utilities of VGAM829 include diagnosis, prevention and treatment of viral infection by African Swine Fever Virus. Specific functions, and accordingly utilities, of VGAM829 correlate with, and may be deduced from, the identity of the host target genes which VGAM829 binds and inhibits, and the function of these host target genes, as elaborated hereinbelow.

Nucleotide sequences of the VGAM829 precursor RNA, herein designated VGAM PRECURSOR RNA, and of the 'diced' VGAM829 RNA, herein designated VGAM RNA, and a schematic representation of the secondary folding of VGAM829 folded precursor RNA, herein designated VGAM FOLDED PRECURSOR RNA, of VGAM829 are further described hereinbelow with reference to Table 1.

Nucleotide sequences of host target binding sites, such as BINDING SITE-I, BINDING SITE-II and BINDING SITE-III of FIG. 1, found on VGAM829 host target RNA, and schematic representation of the complementarity of each of these host target binding sites to VGAM829 RNA, herein designated VGAM RNA, are described hereinbelow with reference to Table 2.

As mentioned hereinabove with reference to FIG. 1, a function of VGAM829 gene, herein designated VGAM is inhibition of expression of VGAM829 target genes. It is appreciated that specific functions, and accordingly utilities, of VGAM829 correlate with, and may be deduced from, the identity of the target genes which VGAM829 binds and inhibits, and the function of these target genes, as elaborated hereinbelow.

Transcription Factor 12 (HTF4, helix-loop-helix transcription factors 4) (TCF12, Accession NM_003205) is a VGAM829 host target gene. TCF12 BINDING SITE is HOST TARGET binding site found in the 3' untranslated region of mRNA encoded by TCF12, corresponding to a HOST TARGET binding site such as BINDING SITE I, BINDING SITE II or BINDING SITE III. Table 2 illustrates the complementarity of the nucleotide sequences of TCF12 BINDING SITE, designated SEQ ID:9201, to the nucleotide sequence of VGAM829 RNA, herein designated VGAM RNA, also designated SEQ ID:3540.

A function of VGAM829 is therefore inhibition of Transcription Factor 12 (HTF4, helix-loop-helix transcription factors 4) (TCF12, Accession NM_003205), a gene which may play important roles during development of the nervous system as well as in other organ systems. Accordingly, utilities of VGAM829 include diagnosis, prevention and treatment of diseases and clinical conditions associated with TCF12. The function of TCF12 and its association with various diseases and clinical conditions, has been established by previous studies, as described hereinabove with reference to VGAM308. UDP-GlcNAc:betaGal Beta-1,3-N-acetylglucosaminyltransferase 7 (B3GNT7, Accession XM_048735) is another VGAM829 host target gene. B3GNT7 BINDING SITE is HOST TARGET binding site found in the 3' untranslated region of mRNA encoded by B3GNT7, corresponding to a HOST TARGET binding site such as BINDING SITE I, BINDING SITE II or BINDING SITE III. Table 2 illustrates the complementarity of the nucleotide sequences of B3GNT7 BINDING SITE, designated SEQ ID:35239, to the nucleotide sequence of VGAM829 RNA, herein designated VGAM RNA, also designated SEQ ID:3540.

Another function of VGAM829 is therefore inhibition of UDP-GlcNAc:betaGal Beta-1,3-N-acetylglucosaminyl-transferase 7 (B3GNT7, Accession XM_048735). Accordingly, utilities of VGAM829 include diagnosis, prevention and treatment of diseases and clinical conditions associated with B3GNT7. KIAA1344 (Accession XM_051699) is another VGAM829 host target gene. KIAA1344 BINDING SITE is HOST TARGET binding site found in the 3' untranslated region of mRNA encoded by KIAA1344, corresponding to a HOST TARGET binding site such as BINDING SITE I, BINDING SITE II or BINDING SITE III. Table 2 illustrates the complementarity of the nucleotide sequences of KIAA1344 BINDING SITE, designated SEQ ID:35872, to the nucleotide sequence of VGAM829 RNA, herein designated VGAM RNA, also designated SEQ ID:3540.

Another function of VGAM829 is therefore inhibition of KIAA1344 (Accession XM_051699). Accordingly, utilities of VGAM829 include diagnosis, prevention and treatment of diseases and clinical conditions associated with KIAA1344. KIAA1894 (Accession XM_058025) is another VGAM829 host target gene. KIAA1894 BINDING SITE is HOST TARGET binding site found in the 3' untranslated region of mRNA encoded by KIAA1894, corresponding to a HOST TARGET binding site such as BINDING SITE I, BINDING SITE II or BINDING SITE III. Table 2 illustrates the complementarity of the nucleotide sequences of KIAA1894 BINDING SITE, designated SEQ ID:36562, to the nucleotide sequence of VGAM829 RNA, herein designated VGAM RNA, also designated SEQ ID:3540.

Another function of VGAM829 is therefore inhibition of KIAA1894 (Accession XM_058025). Accordingly, utilities of VGAM829 include diagnosis, prevention and treatment of diseases and clinical conditions associated with KIAA1894. PIP3-E (Accession XM_039749) is another VGAM829 host target gene. PIP3-E BINDING SITE is HOST TARGET binding site found in the 3' untranslated region of mRNA encoded by PIP3-E, corresponding to a HOST TARGET binding site such as BINDING SITE I, BINDING SITE II or BINDING SITE III. Table 2 illustrates the complementarity of the nucleotide sequences of PIP3-E BINDING SITE, designated SEQ ID:33175, to the nucleotide sequence of VGAM829 RNA, herein designated VGAM RNA, also designated SEQ ID:3540.

Another function of VGAM829 is therefore inhibition of PIP3-E (Accession XM_039749). Accordingly, utilities of VGAM829 include diagnosis, prevention and treatment of diseases and clinical conditions associated with PIP3-E. Ubiquitin-conjugating Enzyme E2 Variant 2 (UBE2V2, Accession NM_003350) is another VGAM829 host target gene. UBE2V2 BINDING SITE is HOST TARGET binding site found in the 3' untranslated region of mRNA encoded by UBE2V2, corresponding to a HOST TARGET binding site such as BINDING SITE I, BINDING SITE II or BINDING SITE III. Table 2 illustrates the complementarity of the nucleotide sequences of UBE2V2 BINDING SITE, designated SEQ ID:9377, to the nucleotide sequence of VGAM829 RNA, herein designated VGAM RNA, also designated SEQ ID:3540.

Another function of VGAM829 is therefore inhibition of Ubiquitin-conjugating Enzyme E2 Variant 2 (UBE2V2, Accession NM_003350). Accordingly, utilities of VGAM829 include diagnosis, prevention and treatment of diseases and clinical conditions associated with UBE2V2. LOC253143 (Accession XM_173062) is another VGAM829 host target gene. LOC253143 BINDING SITE is HOST TARGET binding site found in the 5' untranslated region of mRNA encoded by LOC253143, corresponding to a HOST TARGET binding site such as BINDING SITE I, BINDING SITE II or BINDING SITE III. Table 2 illustrates the complementarity of the nucleotide sequences of LOC253143 BINDING SITE, designated SEQ ID:46316, to the nucleotide sequence of VGAM829 RNA, herein designated VGAM RNA, also designated SEQ ID:3540.

Another function of VGAM829 is therefore inhibition of LOC253143 (Accession XM_173062). Accordingly, utilities of VGAM829 include diagnosis, prevention and treatment of diseases and clinical conditions associated with LOC253143. LOC254170 (Accession XM_170746) is another VGAM829 host target gene. LOC254170 BINDING SITE is HOST TARGET binding site found in the 3' untranslated region of mRNA encoded by LOC254170, corresponding to a HOST TARGET binding site such as BINDING SITE I, BINDING SITE II or BINDING SITE III. Table 2 illustrates the complementarity of the nucleotide sequences of LOC254170 BINDING SITE, designated SEQ ID:45505, to the nucleotide sequence of VGAM829 RNA, herein designated VGAM RNA, also designated SEQ ID:3540.

Another function of VGAM829 is therefore inhibition of LOC254170 (Accession XM_170746). Accordingly, utilities of VGAM829 include diagnosis, prevention and treatment of diseases and clinical conditions associated with LOC254170. FIG. 1 further provides a conceptual description of a novel bioinformatically detected viral gene of the present invention, referred to here as Viral Genomic Address Messenger 830 (VGAM830) viral gene, which modulates expression of respective host target genes thereof, the function and utility of which host target genes is known in the art.

VGAM830 is a novel bioinformatically detected regulatory, non protein coding, viral micro RNA (miRNA) gene. The method by which VGAM830 was detected is described hereinabove with reference to FIGS. 1-8.

VGAM830 gene, herein designated VGAM GENE, is a viral gene contained in the genome of African Swine Fever Virus. VGAM830 host target gene, herein designated VGAM HOST TARGET GENE, is a human gene contained in the human genome.

VGAM830 gene encodes a VGAM830 precursor RNA, herein designated VGAM PRECURSOR RNA. Similar to other miRNA genes, and unlike most ordinary genes, VGAM830 precursor RNA does not encode a protein. A nucleotide sequence identical or highly similar to the nucleotide sequence of VGAM830 precursor RNA is designated SEQ ID:816, and is provided hereinbelow with reference to the sequence listing part. Nucleotide sequence SEQ ID:816 is located at position 11737 relative to the genome of African Swine Fever Virus.

VGAM830 precursor RNA folds onto itself, forming VGAM830 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM830 folded precursor RNA into VGAM830 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM830 RNA is designated SEQ ID:3541, and is provided hereinbelow with reference to the sequence listing part.

VGAM830 host target gene, herein designated VGAM HOST TARGET GENE, encodes a corresponding messenger RNA, VGAM830 host target RNA, herein designated VGAM HOST TARGET RNA. VGAM830 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM830 RNA, herein designated VGAM RNA, binds complementarily to one or more host target binding sites located in untranslated regions of VGAM830 host target RNA, herein designated VGAM HOST TARGET RNA. This complementary binding is due to the fact that the nucleotide sequence of VGAM830 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM830 RNA, herein designated VGAM RNA, may have a different number of host target binding sites in untranslated regions of a VGAM830 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM830 RNA, herein designated VGAM RNA, to host target binding sites on VGAM830 host target RNA, herein designated VGAM HOST TARGET RNA, such as BINDING SITE I, BINDING SITE II and BINDING SITE III, inhibits translation of VGAM830 host target RNA into VGAM830 host target protein, herein designated VGAM HOST TARGET PROTEIN. VGAM host target protein is therefore outlined by a broken line.

It is appreciated that VGAM830 host target gene, herein designated VGAM HOST TARGET GENE, in fact represents a plurality of VGAM830 host target genes. The mRNA of each one of this plurality of VGAM830 host target genes comprises one or more host target binding sites, each having a nucleotide sequence which is at least partly complementary to VGAM830 RNA, herein designated VGAM RNA, and which when bound by VGAM830 RNA causes inhibition of translation of respective one or more VGAM830 host target proteins.

It is further appreciated by one skilled in the art that the mode of translational inhibition illustrated by FIG. 1 with specific reference to translational inhibition exerted by VGAM830 gene, herein designated VGAM GENE, on one or more VGAM830 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM830 is inhibition of expression of host target genes, as part of a novel viral mechanism of attacking a host. Accordingly, utilities of VGAM830 include diagnosis, prevention and treatment of viral infection by African Swine Fever Virus. Specific functions, and accordingly utilities, of VGAM830 correlate with, and may be deduced from, the identity of the host target genes which VGAM830 binds and inhibits, and the function of these host target genes, as elaborated hereinbelow.

Nucleotide sequences of the VGAM830 precursor RNA, herein designated VGAM PRECURSOR RNA, and of the 'diced' VGAM830 RNA, herein designated VGAM RNA, and a schematic representation of the secondary folding of VGAM830 folded precursor RNA, herein designated VGAM FOLDED PRECURSOR RNA, of VGAM830 are further described hereinbelow with reference to Table 1.

Nucleotide sequences of host target binding sites, such as BINDING SITE-I, BINDING SITE-II and BINDING SITE-III of FIG. 1, found on VGAM830 host target RNA, and schematic representation of the complementarity of each of these host target binding sites to VGAM830 RNA, herein designated VGAM RNA, are described hereinbelow with reference to Table 2.

As mentioned hereinabove with reference to FIG. 1, a function of VGAM830 gene, herein designated VGAM is inhibition of expression of VGAM830 target genes. It is appreciated that specific functions, and accordingly utilities, of VGAM830 correlate with, and may be deduced from, the identity of the target genes which VGAM830 binds and inhibits, and the function of these target genes, as elaborated hereinbelow.

Moesin (MSN, Accession XM_013042) is a VGAM830 host target gene. MSN BINDING SITE is HOST TARGET binding site found in the 3' untranslated region of mRNA encoded by MSN, corresponding to a HOST TARGET binding site such as BINDING SITE I, BINDING SITE II or BINDING SITE III. Table 2 illustrates the complementarity of the nucleotide sequences of MSN BINDING SITE, designated SEQ ID:30225, to the nucleotide sequence of VGAM830 RNA, herein designated VGAM RNA, also designated SEQ ID:3541.

A function of VGAM830 is therefore inhibition of Moesin (MSN, Accession XM_013042), a gene which may have a role linking the cytoskeleton to the plasma membrane. Accordingly, utilities of VGAM830 include diagnosis, prevention and treatment of diseases and clinical conditions associated with MSN. The function of MSN and its association with various diseases and clinical conditions, has been established by previous studies, as described hereinabove with reference to VGAM248. Pleiomorphic Adenoma Gene 1 (PLAG1, Accession NM_002655) is another VGAM830 host target gene. PLAG1 BINDING SITE is HOST TARGET binding site found in the 3' untranslated region of mRNA encoded by PLAG1, corresponding to a HOST TARGET binding site such as BINDING SITE I, BINDING SITE II or BINDING SITE III. Table 2 illustrates the complementarity of the nucleotide sequences of PLAG1 BINDING SITE, designated SEQ ID:8523, to the nucleotide sequence of VGAM830 RNA, herein designated VGAM RNA, also designated SEQ ID:3541.

Another function of VGAM830 is therefore inhibition of Pleiomorphic Adenoma Gene 1 (PLAG1, Accession NM_002655), a gene which contains a zinc finger domain.

Accordingly, utilities of VGAM830 include diagnosis, prevention and treatment of diseases and clinical conditions associated with PLAG1. The function of PLAG1 and its association with various diseases and clinical conditions, has been established by previous studies, as described hereinabove with reference to VGAM29. Ubiquitously Transcribed Tetratricopeptide Repeat Gene, Y Chromosome (UTY, Accession NM_007125) is another VGAM830 host target gene. UTY BINDING SITE is HOST TARGET binding site found in the 3' untranslated region of mRNA encoded by UTY, corresponding to a HOST TARGET binding site such as BINDING SITE I, BINDING SITE II or BINDING SITE III. Table 2 illustrates the complementarity of the nucleotide sequences of UTY BINDING SITE, designated SEQ ID:13982, to the nucleotide sequence of VGAM830 RNA, herein designated VGAM RNA, also designated SEQ ID:3541.

Another function of VGAM830 is therefore inhibition of Ubiquitously Transcribed Tetratricopeptide Repeat Gene, Y Chromosome (UTY, Accession NM_007125), a gene which is an ubiquitous tetratricopeptide repeat protein with unknown function. Accordingly, utilities of VGAM830 include diagnosis, prevention and treatment of diseases and clinical conditions associated with UTY. The function of UTY and its association with various diseases and clinical conditions, has been established by previous studies, as described hereinabove with reference to VGAM497. ABLIM (Accession NM_002313) is another VGAM830 host target gene. ABLIM BINDING SITE1 and ABLIM BINDING SITE2 are HOST TARGET binding sites found in untranslated regions of mRNA encoded by ABLIM, corresponding to HOST TARGET binding sites such as BINDING SITE I, BINDING SITE II or BINDING SITE III. Table 2 illustrates the complementarity of the nucleotide sequences of ABLIM BINDING SITE1 and ABLIM BINDING SITE2, designated SEQ ID:8113 and SEQ ID:13546 respectively, to the nucleotide sequence of VGAM830 RNA, herein designated VGAM RNA, also designated SEQ ID:3541.

Another function of VGAM830 is therefore inhibition of ABLIM (Accession NM_002313). Accordingly, utilities of VGAM830 include diagnosis, prevention and treatment of diseases and clinical conditions associated with ABLIM. KIAA0650 (Accession XM_113962) is another VGAM830 host target gene. KIAA0650 BINDING SITE is HOST TARGET binding site found in the 3' untranslated region of mRNA encoded by KIAA0650, corresponding to a HOST TARGET binding site such as BINDING SITE I, BINDING SITE II or BINDING SITE III. Table 2 illustrates the complementarity of the nucleotide sequences of KIAA0650 BINDING SITE, designated SEQ ID:42570, to the nucleotide sequence of VGAM830 RNA, herein designated VGAM RNA, also designated SEQ ID:3541.

Another function of VGAM830 is therefore inhibition of KIAA0650 (Accession XM_113962). Accordingly, utilities of VGAM830 include diagnosis, prevention and treatment of diseases and clinical conditions associated with KIAA0650. KIAA1560 (Accession XM_034422) is another VGAM830 host target gene. KIAA1560 BINDING SITE is HOST TARGET binding site found in the 3' untranslated region of mRNA encoded by KIAA1560, corresponding to a HOST TARGET binding site such as BINDING SITE I, BINDING SITE II or BINDING SITE III. Table 2 illustrates the complementarity of the nucleotide sequences of KIAA1560 BINDING SITE, designated SEQ ID:32103, to the nucleotide sequence of VGAM830 RNA, herein designated VGAM RNA, also designated SEQ ID:3541.

Another function of VGAM830 is therefore inhibition of KIAA1560 (Accession XM_034422). Accordingly, utilities of VGAM830 include diagnosis, prevention and treatment of diseases and clinical conditions associated with KIAA1560. TUSP (Accession NM_020245) is another VGAM830 host target gene. TUSP BINDING SITE is HOST TARGET binding site found in the 3" untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21529, to the nucleotide sequence of VGAM830 RNA, herein designated VGAM RNA, also designated SEQ ID:3541.

Another function of VGAM830 is therefore inhibition of TUSP (Accession NM_020245). Accordingly, utilities of VGAM830 include diagnosis, prevention and treatment of diseases and clinical conditions associated with TUSP. LOC126731 (Accession NM_145257) is another VGAM830 host target gene. LOC126731 BINDING SITE is HOST TARGET binding site found in the 3' untranslated region of mRNA encoded by LOC126731, corresponding to a HOST TARGET binding site such as BINDING SITE I, BINDING SITE II or BINDING SITE III. Table 2 illustrates the complementarity of the nucleotide sequences of LOC126731 BINDING SITE, designated SEQ ID:29772, to the nucleotide sequence of VGAM830 RNA, herein designated VGAM RNA, also designated SEQ ID:3541.

Another function of VGAM830 is therefore inhibition of LOC126731 (Accession NM_145257). Accordingly, utilities of VGAM830 include diagnosis, prevention and treatment of diseases and clinical conditions associated with LOC126731. LOC129831 (Accession XM_059376) is another VGAM830 host target gene. LOC129831 BINDING SITE is HOST TARGET binding site found in the 3' untranslated region of mRNA encoded by LOC129831, corresponding to a HOST TARGET binding site such as BINDING SITE I, BINDING SITE II or BINDING SITE III. Table 2 illustrates the complementarity of the nucleotide sequences of LOC129831 BINDING SITE, designated SEQ ID:36979, to the nucleotide sequence of VGAM830 RNA, herein designated VGAM RNA, also designated SEQ ID:3541.

Another function of VGAM830 is therefore inhibition of LOC129831 (Accession XM_059376). Accordingly, utilities of VGAM830 include diagnosis, prevention and treatment of diseases and clinical conditions associated with LOC129831. LOC157858 (Accession XM_098833) is another VGAM830 host target gene. LOC157858 BINDING SITE is HOST TARGET binding site found in the 5' untranslated region of mRNA encoded by LOC157858, corresponding to a HOST TARGET binding site such as BINDING SITE I, BINDING SITE II or BINDING SITE III. Table 2 illustrates the complementarity of the nucleotide sequences of LOC157858 BINDING SITE, designated SEQ ID:41868, to the nucleotide sequence of VGAM830 RNA, herein designated VGAM RNA, also designated SEQ ID:3541.

Another function of VGAM830 is therefore inhibition of LOC157858 (Accession XM_098833). Accordingly, utilities of VGAM830 include diagnosis, prevention and treatment of diseases and clinical conditions associated with LOC157858. LOC199718 (Accession XM_113998) is another VGAM830 host target gene. LOC199718 BINDING SITE is HOST TARGET binding site found in the 5' untranslated region of mRNA encoded by LOC199718, corresponding to a HOST TARGET binding site such as BINDING SITE I, BINDING SITE II or BINDING SITE III. Table 2 illustrates the complementarity of the nucleotide sequences of LOC199718 BIND- ING SITE, designated SEQ ID:42606, to the nucleotide sequence of VGAM830 RNA, herein designated VGAM RNA, also designated SEQ ID:3541.

Another function of VGAM830 is therefore inhibition of LOC199718 (Accession XM_113998). Accordingly, utilities of VGAM830 include diagnosis, prevention and treatment of diseases and clinical conditions associated with LOC199718. LOC221288 (Accession XM_168058) is another VGAM830 host target gene. LOC221288 BINDING SITE is HOST TARGET binding site found in the 3' untranslated region of mRNA encoded by LOC221288, corresponding to a HOST TARGET binding site such as BINDING SITE I, BINDING SITE II or BINDING SITE III. Table 2 illustrates the complementarity of the nucleotide sequences of LOC221288 BINDING SITE, designated SEQ ID:44972, to the nucleotide sequence of VGAM830 RNA, herein designated VGAM RNA, also designated SEQ ID:3541.

Another function of VGAM830 is therefore inhibition of LOC221288 (Accession XM_168058). Accordingly, utilities of VGAM830 include diagnosis, prevention and treatment of diseases and clinical conditions associated with LOC221288. FIG. 1 further provides a conceptual description of a novel bioinformatically detected viral gene of the present invention, referred to here as Viral Genomic Address Messenger 831 (VGAM831) viral gene, which modulates expression of respective host target genes thereof, the function and utility of which host target genes is known in the art.

VGAM831 is a novel bioinformatically detected regulatory, non protein coding, viral micro RNA (miRNA) gene. The method by which VGAM831 was detected is described hereinabove with reference to FIGS. 1-8.

VGAM831 gene, herein designated VGAM GENE, is a viral gene contained in the genome of Human Herpesvirus 6B. VGAM831 host target gene, herein designated VGAM HOST TARGET GENE, is a human gene contained in the human genome.

VGAM831 gene encodes a VGAM831 precursor RNA, herein designated VGAM PRECURSOR RNA. Similar to other miRNA genes, and unlike most ordinary genes, VGAM831 precursor RNA does not encode a protein. A nucleotide sequence identical or highly similar to the nucleotide sequence of VGAM831 precursor RNA is designated SEQ ID:817, and is provided hereinbelow with reference to the sequence listing part. Nucleotide sequence SEQ ID:817 is located at position 53746 relative to the genome of Human Herpesvirus 6B.

VGAM831 precursor RNA folds onto itself, forming VGAM831 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM831 folded precursor RNA into VGAM831 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM831 RNA is designated SEQ ID:3542, and is provided hereinbelow with reference to the sequence listing part.

VGAM831 host target gene, herein designated VGAM HOST TARGET GENE, encodes a corresponding messenger RNA, VGAM831 host target RNA, herein designated VGAM HOST TARGET RNA. VGAM831 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM831 RNA, herein designated VGAM RNA, binds complementarily to one or more host target binding sites located in untranslated regions of VGAM831 host target RNA, herein designated VGAM HOST TARGET RNA. This complementary binding is due to the fact that the nucleotide sequence of VGAM831 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM831 RNA, herein designated VGAM RNA, may have a different number of host target binding sites in untranslated regions of a VGAM831 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM831 RNA, herein designated VGAM RNA, to host target binding sites on VGAM831 host target RNA, herein designated VGAM HOST TARGET RNA, such as BINDING SITE I, BINDING SITE II and BINDING SITE III, inhibits translation of VGAM831 host target RNA into VGAM831 host target protein, herein designated VGAM HOST TARGET PROTEIN. VGAM host target protein is therefore outlined by a broken line.

It is appreciated that VGAM831 host target gene, herein designated VGAM HOST TARGET GENE, in fact represents a plurality of VGAM831 host target genes. The mRNA of each one of this plurality of VGAM831 host target genes comprises one or more host target binding sites, each having a nucleotide sequence which is at least partly complementary to VGAM831 RNA, herein designated VGAM RNA, and which when bound by VGAM831 RNA causes inhibition of translation of respective one or more VGAM831 host target proteins.

It is further appreciated by one skilled in the art that the mode of translational inhibition illustrated by FIG. 1 with specific reference to translational inhibition exerted by VGAM831 gene, herein designated VGAM GENE, on one or more VGAM831 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM831 is inhibition of expression of host target genes, as part of a novel viral mechanism of attacking a host. Accordingly, utilities of VGAM831 include diagnosis, prevention and treatment of viral infection by Human Herpesvirus 6B. Specific functions, and accordingly utilities, of VGAM831 correlate with, and may be deduced from, the identity of the host target genes which VGAM831 binds and inhibits, and the function of these host target genes, as elaborated hereinbelow.

Nucleotide sequences of the VGAM831 precursor RNA, herein designated VGAM PRECURSOR RNA, and of the 'diced' VGAM831 RNA, herein designated VGAM RNA, and a schematic representation of the secondary folding of VGAM831 folded precursor RNA, herein designated VGAM FOLDED PRECURSOR RNA, of VGAM831 are further described hereinbelow with reference to Table 1.

Nucleotide sequences of host target binding sites, such as BINDING SITE-I, BINDING SITE-II and BINDING SITE-III of FIG. 1, found on VGAM831 host target RNA, and schematic representation of the complementarity of each of these host target binding sites to VGAM831 RNA, herein designated VGAM RNA, are described hereinbelow with reference to Table 2.

As mentioned hereinabove with reference to FIG. 1, a function of VGAM831 gene, herein designated VGAM is inhibition of expression of VGAM831 target genes. It is appreciated that specific functions, and accordingly utilities, of VGAM831 correlate with, and may be deduced from, the identity of the target genes which VGAM831 binds and inhibits, and the function of these target genes, as elaborated hereinbelow.

Deleted In Azoospermia (DAZ, Accession NM_004081) is a VGAM831 host target gene. DAZ BINDING SITE is HOST TARGET binding site found in the 3" untranslated region of mRNA encoded by DAZ, corresponding to a HOST TARGET binding site such as BINDING SITE I, BINDING SITE II or BINDING SITE III. Table 2 illustrates the complementarity of the nucleotide sequences of DAZ BINDING SITE, designated SEQ ID:10285, to the nucleotide sequence of VGAM831 RNA, herein designated VGAM RNA, also designated SEQ ID:3542.

A function of VGAM831 is therefore inhibition of Deleted In Azoospermia (DAZ, Accession NM_004081), a gene which may play a role in the germ-cell-specific patterns of RNA splicing and storage. Accordingly, utilities of VGAM831 include diagnosis, prevention and treatment of diseases and clinical conditions associated with DAZ. The function of DAZ and its association with various diseases and clinical conditions, has been established by previous studies, as described hereinabove with reference to VGAM206. DKFZp434N074 (Accession XM_031481) is another VGAM831 host target gene. DKFZp434N074 BINDING SITE is HOST TARGET binding site found in the 5' untranslated region of mRNA encoded by DKFZp434N074, corresponding to a HOST TARGET binding site such as BINDING SITE I, BINDING SITE II or BINDING SITE III. Table 2 illustrates the complementarity of the nucleotide sequences of DKFZp434N074 BINDING SITE, designated SEQ ID:31390, to the nucleotide sequence of VGAM831 RNA, herein designated VGAM RNA, also designated SEQ ID:3542.

Another function of VGAM831 is therefore inhibition of DKFZp434N074 (Accession XM_031481). Accordingly, utilities of VGAM831 include diagnosis, prevention and treatment of diseases and clinical conditions associated with DKFZp434N074. FLJ10140 (Accession NM_018006) is another VGAM831 host target gene. FLJ10140 BINDING SITE is HOST TARGET binding site found in the 3' untranslated region of mRNA encoded by FLJ10140, corresponding to a HOST TARGET binding site such as BINDING SITE I, BINDING SITE II or BINDING SITE III. Table 2 illustrates the complementarity of the nucleotide sequences of FLJ10140 BINDING SITE, designated SEQ ID:19738, to the nucleotide sequence of VGAM831 RNA, herein designated VGAM RNA, also designated SEQ ID:3542.

Another function of VGAM831 is therefore inhibition of FLJ10140 (Accession NM_018006). Accordingly, utilities of VGAM831 include diagnosis, prevention and treatment of diseases and clinical conditions associated with FLJ10140. LOC201780 (Accession XM_114378) is another VGAM831 host target gene. LOC201780 BINDING SITE is HOST TARGET binding site found in the 5' untranslated region of mRNA encoded by LOC201780, corresponding to a HOST TARGET binding site such as BINDING SITE I, BINDING SITE II or BINDING SITE III. Table 2 illustrates the complementarity of the nucleotide sequences of LOC201780 BINDING SITE, designated SEQ ID:42910, to the nucleotide sequence of VGAM831 RNA, herein designated VGAM RNA, also designated SEQ ID:3542.

Another function of VGAM831 is therefore inhibition of LOC201780 (Accession XM_114378). Accordingly, utilities of VGAM831 include diagnosis, prevention and treatment of diseases and clinical conditions associated with LOC201780. LOC256160 (Accession XM_171079) is another VGAM831 host target gene. LOC256160 BINDING SITE is HOST TARGET binding site found in the 5' untranslated region of mRNA encoded by LOC256160, corresponding to a HOST TARGET binding site such as BINDING SITE I, BINDING SITE II or BINDING SITE III. Table 2 illustrates the complementarity of the nucleotide sequences of LOC256160 BINDING SITE, designated SEQ ID:45886, to the nucleotide sequence of VGAM831 RNA, herein designated VGAM RNA, also designated SEQ ID:3542.

Another function of VGAM831 is therefore inhibition of LOC256160 (Accession XM_171079). Accordingly, utilities of VGAM831 include diagnosis, prevention and treatment of diseases and clinical conditions associated with LOC256160. FIG. 1 further provides a conceptual description of a novel bioinformatically detected viral gene of the present invention, referred to here as Viral Genomic Address Messenger 832 (VGAM832) viral gene, which modulates expression of respective host target genes thereof, the function and utility of which host target genes is known in the art.

VGAM832 is a novel bioinformatically detected regulatory, non protein coding, viral micro RNA (miRNA) gene. The method by which VGAM832 was detected is described hereinabove with reference to FIGS. 1-8.

VGAM832 gene, herein designated VGAM GENE, is a viral gene contained in the genome of Human Herpesvirus 6B. VGAM832 host target gene, herein designated VGAM HOST TARGET GENE, is a human gene contained in the human genome.

VGAM832 gene encodes a VGAM832 precursor RNA, herein designated VGAM PRECURSOR RNA. Similar to other miRNA genes, and unlike most ordinary genes, VGAM832 precursor RNA does not encode a protein. A nucleotide sequence identical or highly similar to the nucleotide sequence of VGAM832 precursor RNA is designated SEQ ID:818, and is provided hereinbelow with reference to the sequence listing part. Nucleotide sequence SEQ ID:818 is located at position 52788 relative to the genome of Human Herpesvirus 6B.

VGAM832 precursor RNA folds onto itself, forming VGAM832 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM832 folded precursor RNA into VGAM832 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM832 RNA is designated SEQ ID:3543, and is provided hereinbelow with reference to the sequence listing part.

VGAM832 host target gene, herein designated VGAM HOST TARGET GENE, encodes a corresponding messenger RNA, VGAM832 host target RNA, herein designated VGAM HOST TARGET RNA. VGAM832 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM832 RNA, herein designated VGAM RNA, binds complementarily to one or more host target binding sites located in untranslated regions of VGAM832 host target RNA, herein designated VGAM HOST TARGET RNA. This complementary binding is due to the fact that the nucleotide sequence of VGAM832 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM832 RNA, herein designated VGAM RNA, may have a different number of host target binding sites in untranslated regions of a VGAM832 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM832 RNA, herein designated VGAM RNA, to host target binding sites on VGAM832 host target RNA, herein designated VGAM HOST TARGET RNA, such as BINDING SITE I, BINDING SITE II and BINDING SITE III, inhibits translation of VGAM832 host target RNA into VGAM832 host target protein, herein designated VGAM HOST TARGET PROTEIN. VGAM host target protein is therefore outlined by a broken line.

It is appreciated that VGAM832 host target gene, herein designated VGAM HOST TARGET GENE, in fact represents a plurality of VGAM832 host target genes. The mRNA of each one of this plurality of VGAM832 host target genes comprises one or more host target binding sites, each having a nucleotide sequence which is at least partly complementary to VGAM832 RNA, herein designated VGAM RNA, and which when bound by VGAM832 RNA causes inhibition of translation of respective one or more VGAM832 host target proteins.

It is further appreciated by one skilled in the art that the mode of translational inhibition illustrated by FIG. 1 with specific reference to translational inhibition exerted by VGAM832 gene, herein designated VGAM GENE, on one or more VGAM832 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM832 is inhibition of expression of host target genes, as part of a novel viral mechanism of attacking a host. Accordingly, utilities of VGAM832 include diagnosis, prevention and treatment of viral infection by Human Herpesvirus 6B. Specific functions, and accordingly utilities, of VGAM832 correlate with, and may be deduced from, the identity of the host target genes which VGAM832 binds and inhibits, and the function of these host target genes, as elaborated hereinbelow.

Nucleotide sequences of the VGAM832 precursor RNA, herein designated VGAM PRECURSOR RNA, and of the 'diced' VGAM832 RNA, herein designated VGAM RNA, and a schematic representation of the secondary folding of VGAM832 folded precursor RNA, herein designated VGAM FOLDED PRECURSOR RNA, of VGAM832 are further described hereinbelow with reference to Table 1.

Nucleotide sequences of host target binding sites, such as BINDING SITE-I, BINDING SITE-II and BINDING SITE-III of FIG. 1, found on VGAM832 host target RNA, and schematic representation of the complementarity of each of these host target binding sites to VGAM832 RNA, herein designated VGAM RNA, are described hereinbelow with reference to Table 2.

As mentioned hereinabove with reference to FIG. 1, a function of VGAM832 gene, herein designated VGAM is inhibition of expression of VGAM832 target genes. It is appreciated that specific functions, and accordingly utilities, of VGAM832 correlate with, and may be deduced from, the identity of the target genes which VGAM832 binds and inhibits, and the function of these target genes, as elaborated hereinbelow.

Selenoprotein N, 1 (SEPN1, Accession XM_039033) is a VGAM832 host target gene. SEPN1 BINDING SITE is HOST TARGET binding site found in the 3' untranslated region of mRNA encoded by SEPN1, corresponding to a HOST TARGET binding site such as BINDING SITE I, BINDING SITE II or BINDING SITE III. Table 2 illustrates the complementarity of the nucleotide sequences of SEPN1 BINDING SITE, designated SEQ ID:32992, to the nucleotide sequence of VGAM832 RNA, herein designated VGAM RNA, also designated SEQ ID:3543.

A function of VGAM832 is therefore inhibition of Selenoprotein N, 1 (SEPN1, Accession XM_039033). Accordingly, utilities of VGAM832 include diagnosis, prevention and treatment of diseases and clinical conditions associated with SEPN1. KIAA1055 (Accession XM_038509) is another VGAM832 host target gene. KIAA1055 BINDING SITE is HOST TARGET binding site found in the 3' untranslated region of mRNA encoded by KIAA1055, corresponding to a HOST TARGET binding site such as BINDING SITE I, BINDING SITE II or BINDING SITE III. Table 2 illustrates the complementarity of the nucleotide sequences of KIAA1055 BINDING SITE, designated SEQ ID:32852, to the nucleotide sequence of VGAM832 RNA, herein designated VGAM RNA, also designated SEQ ID:3543.

Another function of VGAM832 is therefore inhibition of KIAA1055 (Accession XM_038509). Accordingly, utilities of VGAM832 include diagnosis, prevention and treatment of diseases and clinical conditions associated with KIAA1055. KIAA1951 (Accession XM_057401) is another VGAM832 host target gene. KIAA1951 BINDING SITE is HOST TARGET binding site found in the 3' untranslated region of mRNA encoded by KIAA1951, corresponding to a HOST TARGET binding site such as BINDING SITE I, BINDING SITE II or BINDING SITE III. Table 2 illustrates the complementarity of the nucleotide sequences of KIAA1951 BINDING SITE, designated SEQ ID:36513, to the nucleotide sequence of VGAM832 RNA, herein designated VGAM RNA, also designated SEQ ID:3543.

Another function of VGAM832 is therefore inhibition of KIAA1951 (Accession XM_057401). Accordingly, utilities of VGAM832 include diagnosis, prevention and treatment of diseases and clinical conditions associated with KIAA1951. NYD-SP27 (Accession NM_033123) is another VGAM832 host target gene. NYD-SP27 BINDING SITE is HOST TARGET binding site found in the 5' untranslated region of mRNA encoded by NYD-SP27, corresponding to a HOST TARGET binding site such as BINDING SITE I, BINDING SITE II or BINDING SITE III. Table 2 illustrates the complementarity of the nucleotide sequences of NYD-SP27 BINDING SITE, designated SEQ ID:26968, to the nucleotide sequence of VGAM832 RNA, herein designated VGAM RNA, also designated SEQ ID:3543.

Another function of VGAM832 is therefore inhibition of NYD-SP27 (Accession NM_033123). Accordingly, utilities of VGAM832 include diagnosis, prevention and treatment of diseases and clinical conditions associated with NYD-SP27. LOC92223 (Accession XM_043674) is another VGAM832 host target gene. LOC92223 BINDING SITE is HOST TARGET binding site found in the 5' untranslated region of mRNA encoded by LOC92223, corresponding to a HOST TARGET binding site such as BINDING SITE I, BINDING SITE II or BINDING SITE III. Table 2 illustrates the complementarity of the nucleotide sequences of LOC92223 BINDING SITE, designated SEQ ID:33995, to the nucleotide sequence of VGAM832 RNA, herein designated VGAM RNA, also designated SEQ ID:3543.

Another function of VGAM832 is therefore inhibition of LOC92223 (Accession XM_043674). Accordingly, utilities of VGAM832 include diagnosis, prevention and treatment of diseases and clinical conditions associated with LOC92223. FIG. 1 further provides a conceptual description of a novel bioinformatically detected viral gene of the present invention, referred to here as Viral Genomic Address Messenger 833 (VGAM833) viral gene, which modulates expression of respective host target genes thereof, the function and utility of which host target genes is known in the art.

VGAM833 is a novel bioinformatically detected regulatory, non protein coding, viral micro RNA (miRNA) gene. The method by which VGAM833 was detected is described hereinabove with reference to FIGS. 1-8.

VGAM833 gene, herein designated VGAM GENE, is a viral gene contained in the genome of Monkeypox Virus. VGAM833 host target gene, herein designated VGAM HOST TARGET GENE, is a human gene contained in the human genome.

VGAM833 gene encodes a VGAM833 precursor RNA, herein designated VGAM PRECURSOR RNA. Similar to other miRNA genes, and unlike most ordinary genes, VGAM833 precursor RNA does not encode a protein. A nucleotide sequence identical or highly similar to the nucleotide sequence of VGAM833 precursor RNA is designated SEQ ID:819, and is provided hereinbelow with reference to the sequence listing part. Nucleotide sequence SEQ ID:819 is located at position 185114 relative to the genome of Monkeypox Virus.

VGAM833 precursor RNA folds onto itself, forming VGAM833 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM833 folded precursor RNA into VGAM833 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM833 RNA is designated SEQ ID:3544, and is provided hereinbelow with reference to the sequence listing part.

VGAM833 host target gene, herein designated VGAM HOST TARGET GENE, encodes a corresponding messenger RNA, VGAM833 host target RNA, herein designated VGAM HOST TARGET RNA. VGAM833 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM833 RNA, herein designated VGAM RNA, binds complementarily to one or more host target binding sites located in untranslated regions of VGAM833 host target RNA, herein designated VGAM HOST TARGET RNA. This complementary binding is due to the fact that the nucleotide sequence of VGAM833 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM833 RNA, herein designated VGAM RNA, may have a different number of host target binding sites in untranslated regions of a VGAM833 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM833 RNA, herein designated VGAM RNA, to host target binding sites on VGAM833 host target RNA, herein designated VGAM HOST TARGET RNA, such as BINDING SITE I, BINDING SITE II and BINDING SITE III, inhibits translation of VGAM833 host target RNA into VGAM833 host target protein, herein designated VGAM HOST TARGET PROTEIN. VGAM host target protein is therefore outlined by a broken line.

It is appreciated that VGAM833 host target gene, herein designated VGAM HOST TARGET GENE, in fact represents a plurality of VGAM833 host target genes. The mRNA of each one of this plurality of VGAM833 host target genes comprises one or more host target binding sites, each having a nucleotide sequence which is at least partly complementary to VGAM833 RNA, herein designated VGAM RNA, and which when bound by VGAM833 RNA causes inhibition of translation of respective one or more VGAM833 host target proteins.

It is further appreciated by one skilled in the art that the mode of translational inhibition illustrated by FIG. 1 with specific reference to translational inhibition exerted by VGAM833 gene, herein designated VGAM GENE, on one or more VGAM833 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM833 is inhibition of expression of host target genes, as part of a novel viral mechanism of attacking a host. Accordingly, utilities of VGAM833 include diagnosis, prevention and treatment of viral infection by Monkeypox Virus. Specific functions, and accordingly utilities, of VGAM833 correlate with, and may be deduced from, the identity of the host target genes which VGAM833 binds and inhibits, and the function of these host target genes, as elaborated hereinbelow.

Nucleotide sequences of the VGAM833 precursor RNA, herein designated VGAM PRECURSOR RNA, and of the 'diced' VGAM833 RNA, herein designated VGAM RNA, and a schematic representation of the secondary folding of VGAM833 folded precursor RNA, herein designated VGAM FOLDED PRECURSOR RNA, of VGAM833 are further described hereinbelow with reference to Table 1.

Nucleotide sequences of host target binding sites, such as BINDING SITE-I, BINDING SITE-II and BINDING SITE-III of FIG. 1, found on VGAM833 host target RNA, and schematic representation of the complementarity of each of these host target binding sites to VGAM833 RNA, herein designated VGAM RNA, are described hereinbelow with reference to Table 2.

As mentioned hereinabove with reference to FIG. 1, a function of VGAM833 gene, herein designated VGAM is inhibition of expression of VGAM833 target genes. It is appreciated that specific functions, and accordingly utilities, of VGAM833 correlate with, and may be deduced from, the identity of the target genes which VGAM833 binds and inhibits, and the function of these target genes, as elaborated hereinbelow.

Core-binding Factor, Runt Domain, Alpha Subunit 2; Translocated To, 2 (CBFA2T2, Accession NM_005093) is a VGAM833 host target gene. CBFA2T2 BINDING SITE is HOST TARGET binding site found in the 3' untranslated region of mRNA encoded by CBFA2T2, corresponding to a HOST TARGET binding site such as BINDING SITE I, BINDING SITE II or BINDING SITE III. Table 2 illustrates the complementarity of the nucleotide sequences of CBFA2T2 BINDING SITE, designated SEQ ID:11546, to the nucleotide sequence of VGAM833 RNA, herein designated VGAM RNA, also designated SEQ ID:3544.

A function of VGAM833 is therefore inhibition of Corebinding Factor, Runt Domain, Alpha Subunit 2; Translocated To, 2 (CBFA2T2, Accession NM_005093), a gene which is a putative transcription factor. Accordingly, utilities of VGAM833 include diagnosis, prevention and treatment of diseases and clinical conditions associated with CBFA2T2. The function of CBFA2T2 and its association with various diseases and clinical conditions, has been established by previous studies, as described hereinabove with reference to VGAM152. T-cell Acute Lymphocytic Leukemia 1 (TAL1, Accession NM_003189) is another VGAM833 host target gene. TAL1 BINDING SITE is HOST TARGET binding site found in the 3' untranslated region of mRNA encoded by TAL1, corresponding to a HOST TARGET binding site such as BINDING SITE I, BINDING SITE II or BINDING SITE III. Table 2 illustrates the complementarity of the nucleotide sequences of TAL1 BINDING SITE, designated SEQ ID:9173, to the nucleotide sequence of VGAM833 RNA, herein designated VGAM RNA, also designated SEQ ID:3544.

Another function of VGAM833 is therefore inhibition of T-cell Acute Lymphocytic Leukemia 1 (TAL1, Accession NM_003189), a gene which may help control cell growth and differentiation. Accordingly, utilities of VGAM833 include diagnosis, prevention and treatment of diseases and clinical conditions associated with TAL1. The function of TAL1 and its association with various diseases and clinical conditions, has been established by previous studies, as described hereinabove with reference to VGAM172. KIAA0798 (Accession NM_014650) is another VGAM833 host target gene. KIAA0798 BINDING SITE is HOST TARGET binding site found in the 3' untranslated region of mRNA encoded by KIAA0798, corresponding to a HOST TARGET binding site such as BINDING SITE I, BINDING SITE II or BINDING SITE III. Table 2 illustrates the complementarity of the nucleotide sequences of KIAA0798 BINDING SITE, designated SEQ ID:16067, to the nucleotide sequence of VGAM833 RNA, herein designated VGAM RNA, also designated SEQ ID:3544.

Another function of VGAM833 is therefore inhibition of KIAA0798 (Accession NM_014650). Accordingly, utilities of VGAM833 include diagnosis, prevention and treatment of diseases and clinical conditions associated with KIAA0798. KIAA1155 (Accession XM_030864) is another VGAM833 host target gene. KIAA1155 BINDING SITE is HOST TARGET binding site found in the 3' untranslated region of mRNA encoded by KIAA1155, corresponding to a HOST TARGET binding site such as BINDING SITE I, BINDING SITE II or BINDING SITE III. Table 2 illustrates the complementarity of the nucleotide sequences of KIAA1155 BINDING SITE, designated SEQ ID:31198, to the nucleotide sequence of VGAM833 RNA, herein designated VGAM RNA, also designated SEQ ID:3544.

Another function of VGAM833 is therefore inhibition of KIAA1155 (Accession XM_030864). Accordingly, utilities of VGAM833 include diagnosis, prevention and treatment of diseases and clinical conditions associated with KIAA1155. Myosin, Heavy Polypeptide 10, Non-muscle (MYH10, Accession XM_044702) is another VGAM833 host target gene. MYH10 BINDING SITE is HOST TARGET binding site found in the 3' untranslated region of mRNA encoded by MYH10, corresponding to a HOST TARGET binding site such as BINDING SITE I, BINDING SITE II or BINDING SITE III. Table 2 illustrates the complementarity of the nucleotide sequences of MYH10 BINDING SITE, designated SEQ ID:34265, to the nucleotide sequence of VGAM833 RNA, herein designated VGAM RNA, also designated SEQ ID:3544.

Another function of VGAM833 is therefore inhibition of Myosin, Heavy Polypeptide 10, Non-muscle (MYH10, Accession XM_044702). Accordingly, utilities of VGAM833 include diagnosis, prevention and treatment of diseases and clinical conditions associated with MYH10. LOC154739 (Accession XM_098602) is another VGAM833 host target gene. LOC154739 BINDING SITE is HOST TARGET binding site found in the 5' untranslated region of mRNA encoded by LOC154739, corresponding to a HOST TARGET binding site such as BINDING SITE I, BINDING SITE II or BINDING SITE III. Table 2 illustrates the complementarity of the nucleotide sequences of LOC154739 BINDING SITE, designated SEQ ID:41713, to the nucleotide sequence of VGAM833 RNA, herein designated VGAM RNA, also designated SEQ ID:3544.

Another function of VGAM833 is therefore inhibition of LOC154739 (Accession XM_098602). Accordingly, utilities of VGAM833 include diagnosis, prevention and treatment of diseases and clinical conditions associated with LOC154739. LOC203276 (Accession XM_117523) is another VGAM833 host target gene. LOC203276 BINDING SITE is HOST TARGET binding site found in the 3' untranslated region of mRNA encoded by LOC203276, corresponding to a HOST TARGET binding site such as BINDING SITE I, BINDING SITE II or BINDING SITE III. Table 2 illustrates the complementarity of the nucleotide sequences of LOC203276 BINDING SITE, designated SEQ ID:43480, to the nucleotide sequence of VGAM833 RNA, herein designated VGAM RNA, also designated SEQ ID:3544.

Another function of VGAM833 is therefore inhibition of LOC203276 (Accession XM_117523). Accordingly, utilities of VGAM833 include diagnosis, prevention and treatment of diseases and clinical conditions associated with LOC203276. LOC203305 (Accession XM_117529) is another VGAM833 host target gene. LOC203305 BINDING SITE is HOST TARGET binding site found in the 3' untranslated region of mRNA encoded by LOC203305, corresponding to a HOST TARGET binding site such as BINDING SITE I, BINDING SITE II or BINDING SITE III. Table 2 illustrates the complementarity of the nucleotide sequences of LOC203305 BINDING SITE, designated SEQ ID:43504, to the nucleotide sequence of VGAM833 RNA, herein designated VGAM RNA, also designated SEQ ID:3544.

Another function of VGAM833 is therefore inhibition of LOC203305 (Accession XM_117529). Accordingly, utilities of VGAM833 include diagnosis, prevention and treatment of diseases and clinical conditions associated with LOC203305. LOC254243 (Accession XM_173233) is another VGAM833 host target gene. LOC254243 BINDING SITE is HOST TARGET binding site found in the 3' untranslated region of mRNA encoded by LOC254243, corresponding to a HOST TARGET binding site such as BINDING SITE I, BINDING SITE II or BINDING SITE III. Table 2 illustrates the complementarity of the nucleotide sequences of LOC254243 BINDING SITE, designated SEQ ID:46506, to the nucleotide sequence of VGAM833 RNA, herein designated VGAM RNA, also designated SEQ ID:3544.

Another function of VGAM833 is therefore inhibition of LOC254243 (Accession XM_173233). Accordingly, utilities of VGAM833 include diagnosis, prevention and treatment of diseases and clinical conditions associated with LOC254243. LOC51131 (Accession NM_016119) is another VGAM833 host target gene. LOC51131 BINDING SITE is HOST TARGET binding site found in the 3' untranslated region of mRNA encoded by LOC51131, corresponding to a HOST TARGET binding site such as BINDING SITE I, BINDING SITE II or BINDING SITE III. Table 2 illustrates the complementarity of the nucleotide sequences of LOC51131 BINDING SITE, designated SEQ ID:18201, to the nucleotide sequence of VGAM833 RNA, herein designated VGAM RNA, also designated SEQ ID:3544.

Another function of VGAM833 is therefore inhibition of LOC51131 (Accession NM_016119). Accordingly, utilities of VGAM833 include diagnosis, prevention and treatment of diseases and clinical conditions associated with LOC51131. LOC90038 (Accession XM_028305) is another VGAM833 host target gene. LOC90038 BINDING SITE is HOST TARGET binding site found in the 3' untranslated region of mRNA encoded by LOC90038, corresponding to a HOST TARGET binding site such as BINDING SITE I, BINDING SITE II or BINDING SITE III. Table 2 illustrates the complementarity of the nucleotide sequences of LOC90038 BINDING SITE, designated SEQ ID:30643, to the nucleotide sequence of VGAM833 RNA, herein designated VGAM RNA, also designated SEQ ID:3544.

Another function of VGAM833 is therefore inhibition of LOC90038 (Accession XM_028305). Accordingly, utilities of VGAM833 include diagnosis, prevention and treatment of diseases and clinical conditions associated with LOC90038. LOC91115 (Accession XM_036218) is another VGAM833 host target gene. LOC91115 BINDING SITE is HOST TARGET binding site found in the 3' untranslated region of mRNA encoded by LOC91115, corresponding to a HOST TARGET binding site such as BINDING SITE I, BINDING SITE II or BINDING SITE III. Table 2 illustrates the complementarity of the nucleotide sequences of LOC91115 BINDING SITE, designated SEQ ID:32392, to the nucleotide sequence of VGAM833 RNA, herein designated VGAM RNA, also designated SEQ ID:3544.

Another function of VGAM833 is therefore inhibition of LOC91115 (Accession XM_036218). Accordingly, utilities of VGAM833 include diagnosis, prevention and treatment of diseases and clinical conditions associated with LOC91115. FIG. 1 further provides a conceptual description of a novel bioinformatically detected viral gene of the present invention, referred to here as Viral Genomic Address Messenger 834 (VGAM834) viral gene, which modulates expression of respective host target genes thereof, the function and utility of which host target genes is known in the art.

VGAM834 is a novel bioinformatically detected regulatory, non protein coding, viral micro RNA (miRNA) gene. The method by which VGAM834 was detected is described hereinabove with reference to FIGS. 1-8.

VGAM834 gene, herein designated VGAM GENE, is a viral gene contained in the genome of Monkeypox Virus. VGAM834 host target gene, herein designated VGAM HOST TARGET GENE, is a human gene contained in the human genome.

VGAM834 gene encodes a VGAM834 precursor RNA, herein designated VGAM PRECURSOR RNA. Similar to other miRNA genes, and unlike most ordinary genes, VGAM834 precursor RNA does not encode a protein. A nucleotide sequence identical or highly similar to the nucleotide sequence of VGAM834 precursor RNA is designated SEQ ID:820, and is provided hereinbelow with reference to the sequence listing part. Nucleotide sequence SEQ ID:820 is located at position 183909 relative to the genome of Monkeypox Virus.

VGAM834 precursor RNA folds onto itself, forming VGAM834 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM834 folded precursor RNA into VGAM834 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM834 RNA is designated SEQ ID:3545, and is provided hereinbelow with reference to the sequence listing part.

VGAM834 host target gene, herein designated VGAM HOST TARGET GENE, encodes a corresponding messenger RNA, VGAM834 host target RNA, herein designated VGAM HOST TARGET RNA. VGAM834 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM834 RNA, herein designated VGAM RNA, binds complementarily to one or more host target binding sites located in untranslated regions of VGAM834 host target RNA, herein designated VGAM HOST TARGET RNA. This complementary binding is due to the fact that the nucleotide sequence of VGAM834 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM834 RNA, herein designated VGAM RNA, may have a different number of host target binding sites in untranslated regions of a VGAM834 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM834 RNA, herein designated VGAM RNA, to host target binding sites on VGAM834 host target RNA, herein designated VGAM HOST TARGET RNA, such as BINDING SITE I, BINDING SITE II and BINDING SITE III, inhibits translation of VGAM834 host target RNA into VGAM834 host target protein, herein designated VGAM HOST TARGET PROTEIN. VGAM host target protein is therefore outlined by a broken line.

It is appreciated that VGAM834 host target gene, herein designated VGAM HOST TARGET GENE, in fact represents a plurality of VGAM834 host target genes. The mRNA of each one of this plurality of VGAM834 host target genes comprises one or more host target binding sites, each having a nucleotide sequence which is at least partly complementary to VGAM834 RNA, herein designated VGAM RNA, and which when bound by VGAM834 RNA causes inhibition of translation of respective one or more VGAM834 host target proteins.

It is further appreciated by one skilled in the art that the mode of translational inhibition illustrated by FIG. 1 with specific reference to translational inhibition exerted by VGAM834 gene, herein designated VGAM GENE, on one or more VGAM834 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM834 is inhibition of expression of host target genes, as part of a novel viral mechanism of attacking a host. Accordingly, utilities of VGAM834 include diagnosis, prevention and treatment of viral infection by Monkeypox Virus. Specific functions, and accordingly utilities, of VGAM834 correlate with, and may be deduced from, the identity of the host target genes which VGAM834 binds and inhibits, and the function of these host target genes, as elaborated hereinbelow.

Nucleotide sequences of the VGAM834 precursor RNA, herein designated VGAM PRECURSOR RNA, and of the 'diced' VGAM834 RNA, herein designated VGAM RNA, and a schematic representation of the secondary folding of VGAM834 folded precursor RNA, herein designated VGAM FOLDED PRECURSOR RNA, of VGAM834 are further described hereinbelow with reference to Table 1.

Nucleotide sequences of host target binding sites, such as BINDING SITE-I, BINDING SITE-II and BINDING SITE-III of FIG. 1, found on VGAM834 host target RNA, and schematic representation of the complementarity of each of these host target binding sites to VGAM834 RNA, herein designated VGAM RNA, are described hereinbelow with reference to Table 2.

As mentioned hereinabove with reference to FIG. 1, a function of VGAM834 gene, herein designated VGAM is inhibition of expression of VGAM834 target genes. It is appreciated that specific functions, and accordingly utilities, of VGAM834 correlate with, and may be deduced from, the identity of the target genes which VGAM834 binds and inhibits, and the function of these target genes, as elaborated hereinbelow.

ALG6 (Accession NM_013339) is a VGAM834 host target gene. ALG6 BINDING SITE is HOST TARGET binding site found in the 5' untranslated region of mRNA encoded by ALG6, corresponding to a HOST TARGET binding site such as BINDING SITE I, BINDING SITE II or BINDING SITE III. Table 2 illustrates the complementarity of the nucleotide sequences of ALG6 BINDING SITE, designated SEQ ID:14987, to the nucleotide sequence of VGAM834 RNA, herein designated VGAM RNA, also designated SEQ ID:3545.

A function of VGAM834 is therefore inhibition of ALG6 (Accession NM_013339). Accordingly, utilities of VGAM834 include diagnosis, prevention and treatment of diseases and clinical conditions associated with ALG6. Bromodomain Adjacent to Zinc Finger Domain, 2A (BAZ2A, Accession NM_013449) is another VGAM834 host target gene. BAZ2A BINDING SITE is HOST TARGET binding site found in the 3' untranslated region of mRNA encoded by BAZ2A, corresponding to a HOST TARGET binding site such as BINDING SITE I, BINDING SITE II or BINDING SITE III. Table 2 illustrates the complementarity of the nucleotide sequences of BAZ2A BINDING SITE, designated SEQ ID:15119, to the nucleotide sequence of VGAM834 RNA, herein designated VGAM RNA, also designated SEQ ID:3545.

Another function of VGAM834 is therefore inhibition of Bromodomain Adjacent to Zinc Finger Domain, 2A (BAZ2A, Accession NM_013449). Accordingly, utilities of VGAM834 include diagnosis, prevention and treatment of diseases and clinical conditions associated with BAZ2A. B-cell CLL/lymphoma 2 (BCL2, Accession NM_000633) is another VGAM834 host target gene. BCL2 BINDING SITE is HOST TARGET binding site found in the 3' untranslated region of mRNA encoded by BCL2, corresponding to a HOST TARGET binding site such as BINDING SITE I, BINDING SITE II or BINDING SITE III. Table 2 illustrates the complementarity of the nucleotide sequences of BCL2 BINDING SITE, designated SEQ ID:6259, to the nucleotide sequence of VGAM834 RNA, herein designated VGAM RNA, also designated SEQ ID:3545.

Another function of VGAM834 is therefore inhibition of B-cell CLL/lymphoma 2 (BCL2, Accession NM_000633). Accordingly, utilities of VGAM834 include diagnosis, prevention and treatment of diseases and clinical conditions associated with BCL2. N-myc Downstream Regulated Gene 1 (NDRG1, Accession XM_005243) is another VGAM834 host target gene. NDRG1 BINDING SITE is HOST TARGET binding site found in the 3' untranslated region of mRNA encoded by NDRG1, corresponding to a HOST TARGET binding site such as BINDING SITE I, BINDING SITE II or BINDING SITE III. Table 2 illustrates the complementarity of the nucleotide sequences of NDRG1 BINDING SITE, designated SEQ ID:29964, to the nucleotide sequence of VGAM834 RNA, herein designated VGAM RNA, also designated SEQ ID:3545.

Another function of VGAM834 is therefore inhibition of N-myc Downstream Regulated Gene 1 (NDRG1, Accession XM_005243), a gene which may have a growth inhibitory role. Accordingly, utilities of VGAM834 include diagnosis, prevention and treatment of diseases and clinical conditions associated with NDRG1. The function of NDRG1 and its association with various diseases and clinical conditions, has been established by previous studies, as described hereinabove with reference to VGAM144. Epsin 2 (EPN2, Accession NM_014964) is another VGAM834 host target gene. EPN2 BINDING SITE is HOST TARGET binding site found in the 3' untranslated region of mRNA encoded by EPN2, corresponding to a HOST TARGET binding site such as BINDING SITE I, BINDING SITE II or BINDING SITE III. Table 2 illustrates the complementarity of the nucleotide sequences of EPN2 BINDING SITE, designated SEQ ID:17349, to the nucleotide sequence of VGAM834 RNA, herein designated VGAM RNA, also designated SEQ ID:3545.

Another function of VGAM834 is therefore inhibition of Epsin 2 (EPN2, Accession NM_014964). Accordingly, utilities of VGAM834 include diagnosis, prevention and treatment of diseases and clinical conditions associated with EPN2. FLJ31952 (Accession NM_144682) is another VGAM834 host target gene. FLJ31952 BINDING SITE is HOST TARGET binding site found in the 5' untranslated region of mRNA encoded by FLJ31952, corresponding to a HOST TARGET binding site such as BINDING SITE I, BINDING SITE II or BINDING SITE III. Table 2 illustrates the complementarity of the nucleotide sequences of FLJ31952 BINDING SITE, designated SEQ ID:29497, to the nucleotide sequence of VGAM834 RNA, herein designated VGAM RNA, also designated SEQ ID:3545.

Another function of VGAM834 is therefore inhibition of FLJ31952 (Accession NM_144682). Accordingly, utilities of VGAM834 include diagnosis, prevention and treatment of diseases and clinical conditions associated with FLJ31952. H326 (Accession NM_015726) is another VGAM834 host target gene. H326 BINDING SITE is HOST TARGET binding site found in the 3' untranslated region of mRNA encoded by H326, corresponding to a HOST TARGET binding site such as BINDING SITE I, BINDING SITE II or BINDING SITE III. Table 2 illustrates the complementarity of the nucleotide sequences of H326 BINDING SITE, designated SEQ ID:17937, to the nucleotide sequence of VGAM834 RNA, herein designated VGAM RNA, also designated SEQ ID:3545.

Another function of VGAM834 is therefore inhibition of H326 (Accession NM_015726). Accordingly, utilities of VGAM834 include diagnosis, prevention and treatment of diseases and clinical conditions associated with H326. Hyaluronan Binding Protein 4 (HABP4, Accession XM_047263) is another VGAM834 host target gene. HABP4 BINDING SITE is HOST TARGET binding site found in the 3' untranslated region of mRNA encoded by HABP4, corresponding to a HOST TARGET binding site such as BINDING SITE I, BINDING SITE II or BINDING SITE III. Table 2 illustrates the complementarity of the nucleotide sequences of HABP4 BINDING SITE, designated SEQ ID:34925, to the nucleotide sequence of VGAM834 RNA, herein designated VGAM RNA, also designated SEQ ID:3545.

Another function of VGAM834 is therefore inhibition of Hyaluronan Binding Protein 4 (HABP4, Accession XM_047263). Accordingly, utilities of VGAM834 include diagnosis, prevention and treatment of diseases and clinical conditions associated with HABP4. KIAA0894 (Accession NM_014896) is another VGAM834 host target gene. KIAA0894 BINDING SITE is HOST TARGET binding site found in the 3' untranslated region of mRNA encoded by KIAA0894, corresponding to a HOST TARGET binding site such as BINDING SITE I, BINDING SITE II or BINDING SITE III. Table 2 illustrates the complementarity of the nucleotide sequences of KIAA0894 BINDING SITE, designated SEQ ID:17054, to the nucleotide sequence of VGAM834 RNA, herein designated VGAM RNA, also designated SEQ ID:3545.

Another function of VGAM834 is therefore inhibition of KIAA0894 (Accession NM_014896). Accordingly, utilities of VGAM834 include diagnosis, prevention and treatment of diseases and clinical conditions associated with KIAA0894. KIAA1157 (Accession XM_051093) is another VGAM834 host target gene. KIAA1157 BINDING SITE is HOST TARGET binding site found in the 3' untranslated region of mRNA encoded by KIAA1157, corresponding to a HOST TARGET binding site such as BINDING SITE I, BINDING SITE II or BINDING SITE III. Table 2 illustrates the complementarity of the nucleotide sequences of KIAA1157 BINDING SITE, designated SEQ ID:35748, to the nucleotide sequence of VGAM834 RNA, herein designated VGAM RNA, also designated SEQ ID:3545.

Another function of VGAM834 is therefore inhibition of KIAA1157 (Accession XM_051093). Accordingly, utilities of VGAM834 include diagnosis, prevention and treatment of diseases and clinical conditions associated with KIAA1157. KIAA1594 (Accession XM_050754) is another VGAM834 host target gene. KIAA1594 BINDING SITE is HOST TARGET binding site found in the 3' untranslated region of mRNA encoded by KIAA1594, corresponding to a HOST TARGET binding site such as BINDING SITE I, BINDING SITE II or BINDING SITE III. Table 2 illustrates the complementarity of the nucleotide sequences of KIAA1594 BINDING SITE, designated SEQ ID:35675, to the nucleotide sequence of VGAM834 RNA, herein designated VGAM RNA, also designated SEQ ID:3545.

Another function of VGAM834 is therefore inhibition of KIAA1594 (Accession XM_050754). Accordingly, utilities of VGAM834 include diagnosis, prevention and treatment of diseases and clinical conditions associated with KIAA1594. MGC12928 (Accession NM_032891) is another VGAM834 host target gene. MGC12928 BINDING SITE is HOST TARGET binding site found in the 5' untranslated region of mRNA encoded by MGC12928, corresponding to a HOST TARGET binding site such as BINDING SITE I, BINDING SITE II or BINDING SITE III. Table 2 illustrates the complementarity of the nucleotide sequences of MGC12928 BINDING SITE, designated SEQ ID:26714, to the nucleotide sequence of VGAM834 RNA, herein designated VGAM RNA, also designated SEQ ID:3545.

Another function of VGAM834 is therefore inhibition of MGC12928 (Accession NM_032891). Accordingly, utilities of VGAM834 include diagnosis, prevention and treatment of diseases and clinical conditions associated with MGC12928. LOC142955 (Accession XM_084389) is another VGAM834 host target gene. LOC142955 BINDING SITE is HOST TARGET binding site found in the 5' untranslated region of mRNA encoded by LOC142955, corresponding to a HOST TARGET binding site such as BINDING SITE I, BINDING SITE II or BINDING SITE III. Table 2 illustrates the complementarity of the nucleotide sequences of LOC142955 BINDING SITE, designated SEQ ID:37574, to the nucleotide sequence of VGAM834 RNA, herein designated VGAM RNA, also designated SEQ ID:3545.

Another function of VGAM834 is therefore inhibition of LOC142955 (Accession XM_084389). Accordingly, utilities of VGAM834 include diagnosis, prevention and treatment of diseases and clinical conditions associated with LOC142955. LOC144519 (Accession XM_084890) is another VGAM834 host target gene. LOC144519 BINDING SITE is HOST TARGET binding site found in the 3' untranslated region of mRNA encoded by LOC144519, corresponding to a HOST TARGET binding site such as BINDING SITE I, BINDING SITE II or BINDING SITE III. Table 2 illustrates the complementarity of the nucleotide sequences of LOC144519 BINDING SITE, designated SEQ ID:37757, to the nucleotide sequence of VGAM834 RNA, herein designated VGAM RNA, also designated SEQ ID:3545.

Another function of VGAM834 is therefore inhibition of LOC144519 (Accession XM_084890). Accordingly, utilities of VGAM834 include diagnosis, prevention and treatment of diseases and clinical conditions associated with LOC144519. LOC146056 (Accession XM_085299) is another VGAM834 host target gene. LOC146056 BINDING SITE is HOST TARGET binding site found in the 3' untranslated region of mRNA encoded by LOC146056, corresponding to a HOST TARGET binding site such as BINDING SITE I, BINDING SITE II or BINDING SITE III. Table 2 illustrates the complementarity of the nucleotide sequences of LOC146056 BINDING SITE, designated SEQ ID:38051, to the nucleotide sequence of VGAM834 RNA, herein designated VGAM RNA, also designated SEQ ID:3545.

Another function of VGAM834 is therefore inhibition of LOC146056 (Accession XM_085299). Accordingly, utilities of VGAM834 include diagnosis, prevention and treatment of diseases and clinical conditions associated with LOC146056. LOC149153 (Accession XM_097599) is another VGAM834 host target gene. LOC149153 BINDING SITE is HOST TARGET binding site found in the 3' untranslated region of mRNA encoded by LOC149153, corresponding to a HOST TARGET binding site such as BINDING SITE I, BINDING SITE II or BINDING SITE III. Table 2 illustrates the complementarity of the nucleotide sequences of LOC149153 BINDING SITE, designated SEQ ID:40965, to the nucleotide sequence of VGAM834 RNA, herein designated VGAM RNA, also designated SEQ ID:3545.

Another function of VGAM834 is therefore inhibition of LOC149153 (Accession XM_097599). Accordingly, utilities of VGAM834 include diagnosis, prevention and treatment of diseases and clinical conditions associated with LOC149153. LOC149420 (Accession XM_086530) is another VGAM834 host target gene. LOC149420 BINDING SITE is HOST TARGET binding site found in the 3' untranslated region of mRNA encoded by LOC149420, corresponding to a HOST TARGET binding site such as BINDING SITE I, BINDING SITE II or BINDING SITE III. Table 2 illustrates the complementarity of the nucleotide sequences of LOC149420 BINDING SITE, designated SEQ ID:38747, to the nucleotide sequence of VGAM834 RNA, herein designated VGAM RNA, also designated SEQ ID:3545.

Another function of VGAM834 is therefore inhibition of LOC149420 (Accession XM_086530). Accordingly, utilities of VGAM834 include diagnosis, prevention and treatment of diseases and clinical conditions associated with LOC149420. LOC92106 (Accession NM_138381) is another VGAM834 host target gene. LOC92106 BINDING SITE is HOST TARGET binding site found in the 5' untranslated region of mRNA encoded by LOC92106, corresponding to a HOST TARGET binding site such as BINDING SITE I, BINDING SITE II or BINDING SITE III. Table 2 illustrates the complementarity of the nucleotide sequences of LOC92106 BINDING SITE, designated SEQ ID:28756, to the nucleotide sequence of VGAM834 RNA, herein designated VGAM RNA, also designated SEQ ID:3545.

Another function of VGAM834 is therefore inhibition of LOC92106 (Accession NM_138381). Accordingly, utilities of VGAM834 include diagnosis, prevention and treatment of diseases and clinical conditions associated with LOC92106. FIG. 1 further provides a conceptual description of a novel bioinformatically detected viral gene of the present invention, referred to here as Viral Genomic Address Messenger 835 (VGAM835) viral gene, which modulates expression of respective host target genes thereof, the function and utility of which host target genes is known in the art.

VGAM835 is a novel bioinformatically detected regulatory, non protein coding, viral micro RNA (miRNA) gene. The method by which VGAM835 was detected is described hereinabove with reference to FIGS. 1-8.

VGAM835 gene, herein designated VGAM GENE, is a viral gene contained in the genome of Monkeypox Virus. VGAM835 host target gene, herein designated VGAM HOST TARGET GENE, is a human gene contained in the human genome.

VGAM835 gene encodes a VGAM835 precursor RNA, herein designated VGAM PRECURSOR RNA. Similar to other miRNA genes, and unlike most ordinary genes, VGAM835 precursor RNA does not encode a protein. A nucleotide sequence identical or highly similar to the nucleotide sequence of VGAM835 precursor RNA is designated SEQ ID:821, and is provided hereinbelow with reference to the sequence listing part. Nucleotide sequence SEQ ID:821 is located at position 184176 relative to the genome of Monkeypox Virus.

VGAM835 precursor RNA folds onto itself, forming VGAM835 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM835 folded precursor RNA into VGAM835 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM835 RNA is designated SEQ ID:3546, and is provided hereinbelow with reference to the sequence listing part.

VGAM835 host target gene, herein designated VGAM HOST TARGET GENE, encodes a corresponding messenger RNA, VGAM835 host target RNA, herein designated VGAM HOST TARGET RNA. VGAM835 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM835 RNA, herein designated VGAM RNA, binds complementarily to one or more host target binding sites located in untranslated regions of VGAM835 host target RNA, herein designated VGAM HOST TARGET RNA. This complementary binding is due to the fact that the nucleotide sequence of VGAM835 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM835 RNA, herein designated VGAM RNA, may have a different number of host target binding sites in untranslated regions of a VGAM835 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM835 RNA, herein designated VGAM RNA, to host target binding sites on VGAM835 host target RNA, herein designated VGAM HOST TARGET RNA, such as BINDING SITE I, BINDING SITE II and BINDING SITE III, inhibits translation of VGAM835 host target RNA into VGAM835 host target protein, herein designated VGAM HOST TARGET PROTEIN. VGAM host target protein is therefore outlined by a broken line.

It is appreciated that VGAM835 host target gene, herein designated VGAM HOST TARGET GENE, in fact represents a plurality of VGAM835 host target genes. The mRNA of each one of this plurality of VGAM835 host target genes comprises one or more host target binding sites, each having a nucleotide sequence which is at least partly complementary to VGAM835 RNA, herein designated VGAM RNA, and which when bound by VGAM835 RNA causes inhibition of translation of respective one or more VGAM835 host target proteins.

It is further appreciated by one skilled in the art that the mode of translational inhibition illustrated by FIG. 1 with specific reference to translational inhibition exerted by VGAM835 gene, herein designated VGAM GENE, on one or more VGAM835 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM835 is inhibition of expression of host target genes, as part of a novel viral mechanism of attacking a host. Accordingly, utilities of VGAM835 include diagnosis, prevention and treatment of viral infection by Monkeypox Virus. Specific functions, and accordingly utilities, of VGAM835 correlate with, and may be deduced from, the identity of the host target genes which VGAM835 binds and inhibits, and the function of these host target genes, as elaborated hereinbelow.

Nucleotide sequences of the VGAM835 precursor RNA, herein designated VGAM PRECURSOR RNA, and of the 'diced' VGAM835 RNA, herein designated VGAM RNA, and a schematic representation of the secondary folding of VGAM835 folded precursor RNA, herein designated VGAM FOLDED PRECURSOR RNA, of VGAM835 are further described hereinbelow with reference to Table 1.

Nucleotide sequences of host target binding sites, such as BINDING SITE-I, BINDING SITE-II and BINDING SITE-III of FIG. 1, found on VGAM835 host target RNA, and schematic representation of the complementarity of each of these host target binding sites to VGAM835 RNA, herein designated VGAM RNA, are described hereinbelow with reference to Table 2.

As mentioned hereinabove with reference to FIG. 1, a function of VGAM835 gene, herein designated VGAM is inhibition of expression of VGAM835 target genes. It is appreciated that specific functions, and accordingly utilities, of VGAM835 correlate with, and may be deduced from, the identity of the target genes which VGAM835 binds and inhibits, and the function of these target genes, as elaborated hereinbelow.

Growth Arrest-specific 7 (GAS7, Accession NM_003644) is a VGAM835 host target gene. GAS7 BINDING SITE is HOST TARGET binding site found in the 3' untranslated region of mRNA encoded by GAS7, corresponding to a HOST TARGET binding site such as BINDING SITE I, BINDING SITE II or BINDING SITE III. Table 2 illustrates the complementarity of the nucleotide sequences of GAS7 BINDING SITE, designated SEQ ID:9714, to the nucleotide sequence of VGAM835 RNA, herein designated VGAM RNA, also designated SEQ ID:3546.

A function of VGAM835 is therefore inhibition of Growth Arrest-specific 7 (GAS7, Accession NM_003644), a gene which may play a role in promoting maturation and morphological differentiation of cerebellar neurons. Accordingly, utilities of VGAM835 include diagnosis, prevention and treatment of diseases and clinical conditions associated with GAS7. The function of GAS7 and its association with various diseases and clinical conditions, has been established by previous studies, as described hereinabove with reference to VGAM232. Heparan Sulfate 2-O-sulfotransferase 1 (HS2ST1, Accession NM_012262) is another VGAM835 host target gene. HS2ST1 BINDING SITE is HOST TARGET binding site found in the 3' untranslated region of mRNA encoded by HS2ST1, corresponding to a HOST TARGET binding site such as BINDING SITE I, BINDING SITE II or BINDING SITE III. Table 2 illustrates the complementarity of the nucleotide sequences of HS2ST1 BINDING SITE, designated SEQ ID:14577, to the nucleotide sequence of VGAM835 RNA, herein designated VGAM RNA, also designated SEQ ID:3546.

Another function of VGAM835 is therefore inhibition of Heparan Sulfate 2-O-sulfotransferase 1 (HS2ST1, Accession NM_012262). Accordingly, utilities of VGAM835 include diagnosis, prevention and treatment of diseases and clinical conditions associated with HS2ST1. Leucine Zipper Protein 1 (LUZP1, Accession NM_033631) is another VGAM835 host target gene. LUZP1 BINDING SITE is HOST TARGET binding site found in the 3' untranslated region of mRNA encoded by LUZP1, corresponding to a HOST TARGET binding site such as BINDING SITE I, BINDING SITE II or BINDING SITE III. Table 2 illustrates the complementarity of the nucleotide sequences of LUZP1 BINDING SITE, designated SEQ ID:27351, to the nucleotide sequence of VGAM835 RNA, herein designated VGAM RNA, also designated SEQ ID:3546.

Another function of VGAM835 is therefore inhibition of Leucine Zipper Protein 1 (LUZP1, Accession NM_033631). Accordingly, utilities of VGAM835 include diagnosis, prevention and treatment of diseases and clinical conditions associated with LUZP1. Synovial Sarcoma, X Breakpoint 3 (SSX3, Accession NM_021014) is another VGAM835 host target gene. SSX3 BINDING SITE is HOST TARGET binding site found in the 3' untranslated region of mRNA encoded by SSX3, corresponding to a HOST TARGET binding site such as BINDING SITE I, BINDING SITE II or BINDING SITE III. Table 2 illustrates the complementarity of the nucleotide sequences of SSX3 BINDING SITE, designated SEQ ID:22003, to the nucleotide sequence of VGAM835 RNA, herein designated VGAM RNA, also designated SEQ ID:3546.

Another function of VGAM835 is therefore inhibition of Synovial Sarcoma, X Breakpoint 3 (SSX3, Accession NM_021014), a gene which could act as a modulator of transcription. Accordingly, utilities of VGAM835 include diagnosis, prevention and treatment of diseases and clinical conditions associated with SSX3. The function of SSX3 has been established by previous studies. By screening a testis cDNA library with a partial fragment of the SSX2 (OMIM Ref. No. 300192) gene, de Leeuw et al. (1996) identified SSX3, a novel member of the Kruppel-associated box (KRAB)-containing SSX gene family. SSX3 encodes a deduced 188-amino acid protein that shares 90% sequence identity with SSX2. Unlike SSX1 (OMIM Ref. No. 312820) and SSX2, SSX3 appears not to be involved in the chromosome translocation t (X;18)(p11.2; q11.2) commonly found in synovial sarcomas. Gure et al. (1997) independently cloned the SSX3 gene and showed that it is expressed in normal testis only. Analysis of 12 melanoma cell lines detected no expression of SSX3.

Full details of the abovementioned studies are described in the following publications, the disclosure of which are hereby incorporated by reference:

de Leeuw, B.; Balemans, M.; Geurts van Kessel, A.: A novel Kruppel-associated box containing the SSX gene (SSX3) on the human X chromosome is not implicated in t (X;18)-positive synovial sarcomas. Cytogenet. Cell Genet. 73:179-183, 1996; and Gure, A. O.; Tureci, O.; Sahin, U.; Tsang, S.; Scanlan, M. J.; Jager, E.; Knuth, A.; Pfreundschuh, M.; Old, L. J.; Chen, Y.-T.: SSX: a multigene family with several members transcribed.

Further studies establishing the function and utilities of SSX3 are found in John Hopkins OMIM database record ID 300325, and in sited publications numbered 9146-9147 listed in the bibliography section hereinbelow, which are also hereby incorporated by reference. Chromosome 1 Open Reading Frame 24 (C1orf24, Accession NM_052966) is another VGAM835 host target gene. C1orf24 BINDING SITE is HOST TARGET binding site found in the 3' untranslated region of mRNA encoded by C1orf24, corresponding to a HOST TARGET binding site such as BINDING SITE I, BINDING SITE II or BINDING SITE III. Table 2 illustrates the complementarity of the nucleotide sequences of C1orf24 BINDING SITE, designated SEQ ID:27536, to the nucleotide sequence of VGAM835 RNA, herein designated VGAM RNA, also designated SEQ ID:3546.

Another function of VGAM835 is therefore inhibition of Chromosome 1 Open Reading Frame 24 (C1orf24, Accession NM_052966). Accordingly, utilities of VGAM835 include diagnosis, prevention and treatment of diseases and clinical conditions associated with C1orf24. DKFZP586C1619 (Accession XM_030350) is another VGAM835 host target gene. DKFZP586C1619 BINDING SITE is HOST TARGET binding site found in the 3' untranslated region of mRNA encoded by DKFZP586C1619, corresponding to a HOST TARGET binding site such as BINDING SITE I, BINDING SITE II or BINDING SITE III. Table 2 illustrates the complementarity of the nucleotide sequences of DKFZP586C1619 BINDING SITE, designated SEQ ID:31021, to the nucleotide sequence of VGAM835 RNA, herein designated VGAM RNA, also designated SEQ ID:3546.

Another function of VGAM835 is therefore inhibition of DKFZP586C1619 (Accession XM_030350). Accordingly, utilities of VGAM835 include diagnosis, prevention and treatment of diseases and clinical conditions associated with DKFZP586C1619. Dickkopf Homolog 2 (Xenopus laevis) (DKK2, Accession NM_014421) is another VGAM835 host target gene. DKK2 BINDING SITE is HOST TARGET binding site found in the 3' untranslated region of mRNA encoded by DKK2, corresponding to a HOST TARGET binding site such as BINDING SITE I, BINDING SITE II or BINDING SITE III. Table 2 illustrates the complementarity of the nucleotide sequences of DKK2 BINDING SITE, designated SEQ ID:15773, to the nucleotide sequence of VGAM835 RNA, herein designated VGAM RNA, also designated SEQ ID:3546.

Another function of VGAM835 is therefore inhibition of Dickkopf Homolog 2 (Xenopus laevis) (DKK2, Accession NM_014421). Accordingly, utilities of VGAM835 include diagnosis, prevention and treatment of diseases and clinical conditions associated with DKK2. FLJ14213 (Accession NM_024841) is another VGAM835 host target gene. FLJ14213 BINDING SITE is HOST TARGET binding site found in the 3' untranslated region of mRNA encoded by FLJ14213, corresponding to a HOST TARGET binding site such as BINDING SITE I, BINDING SITE II or BINDING SITE III. Table 2 illustrates the complementarity of the nucleotide sequences of FLJ14213 BINDING SITE, designated SEQ ID:24255, to the nucleotide sequence of VGAM835 RNA, herein designated VGAM RNA, also designated SEQ ID:3546.

Another function of VGAM835 is therefore inhibition of FLJ14213 (Accession NM_024841). Accordingly, utilities of VGAM835 include diagnosis, prevention and treatment of diseases and clinical conditions associated with FLJ14213. FLJ23548 (Accession NM_024590) is another VGAM835 host target gene. FLJ23548 BINDING SITE is HOST TARGET binding site found in the 5' untranslated region of mRNA encoded by FLJ23548, corresponding to a HOST TARGET binding site such as BINDING SITE I, BINDING SITE II or BINDING SITE III. Table 2 illustrates the complementarity of the nucleotide sequences of FLJ23548 BINDING SITE, designated SEQ ID:23825, to the nucleotide sequence of VGAM835 RNA, herein designated VGAM RNA, also designated SEQ ID:3546.

Another function of VGAM835 is therefore inhibition of FLJ23548 (Accession NM_024590). Accordingly, utilities of VGAM835 include diagnosis, prevention and treatment of diseases and clinical conditions associated with FLJ23548. KIAA0831 (Accession NM_014924) is another VGAM835 host target gene. KIAA0831 BINDING SITE is HOST TARGET binding site found in the 3' untranslated region of mRNA encoded by KIAA0831, corresponding to a HOST TARGET binding site such as BINDING SITE I, BINDING SITE II or BINDING SITE III. Table 2 illustrates the complementarity of the nucleotide sequences of KIAA0831 BINDING SITE, designated SEQ ID:17209, to the nucleotide sequence of VGAM835 RNA, herein designated VGAM RNA, also designated SEQ ID:3546.

Another function of VGAM835 is therefore inhibition of KIAA0831 (Accession NM_014924). Accordingly, utilities of VGAM835 include diagnosis, prevention and treatment of diseases and clinical conditions associated with KIAA0831. MGC13061 (Accession NM_032322) is another VGAM835 host target gene. MGC13061 BINDING SITE is HOST TARGET binding site found in the 3' untranslated region of mRNA encoded by MGC13061, corresponding to a HOST TARGET binding site such as BINDING SITE I, BINDING SITE II or BINDING SITE III. Table 2 illustrates the complementarity of the nucleotide sequences of MGC13061 BINDING SITE, designated SEQ ID:26129, to the nucleotide sequence of VGAM835 RNA, herein designated VGAM RNA, also designated SEQ ID:3546.

Another function of VGAM835 is therefore inhibition of MGC13061 (Accession NM_032322). Accordingly, utilities of VGAM835 include diagnosis, prevention and treatment of diseases and clinical conditions associated with MGC13061. LOC154739 (Accession XM_098602) is another VGAM835 host target gene. LOC154739 BINDING SITE is HOST TARGET binding site found in the 5' untranslated region of mRNA encoded by LOC154739, corresponding to a HOST TARGET binding site such as BINDING SITE I, BINDING SITE II or BINDING SITE III. Table 2 illustrates the complementarity of the nucleotide sequences of LOC154739 BINDING SITE, designated SEQ ID:41719, to the nucleotide sequence of VGAM835 RNA, herein designated VGAM RNA, also designated SEQ ID:3546.

Another function of VGAM835 is therefore inhibition of LOC154739 (Accession XM_098602). Accordingly, utilities of VGAM835 include diagnosis, prevention and treatment of diseases and clinical conditions associated with LOC154739. LOC203276 (Accession XM_117523) is another VGAM835 host target gene. LOC203276 BINDING SITE is HOST TARGET binding site found in the 3' untranslated region of mRNA encoded by LOC203276, corresponding to a HOST TARGET binding site such as BINDING SITE I, BINDING SITE II or BINDING SITE III. Table 2 illustrates the complementarity of the nucleotide sequences of LOC203276 BINDING SITE, designated SEQ ID:43487, to the nucleotide sequence of VGAM835 RNA, herein designated VGAM RNA, also designated SEQ ID:3546.

Another function of VGAM835 is therefore inhibition of LOC203276 (Accession XM_117523). Accordingly, utilities of VGAM835 include diagnosis, prevention and treatment of diseases and clinical conditions associated with LOC203276. LOC203305 (Accession XM_117529) is another VGAM835 host target gene. LOC203305 BINDING SITE is HOST TARGET binding site found in the 3' untranslated region of mRNA encoded by LOC203305, corresponding to a HOST TARGET binding site such as BINDING SITE I, BINDING SITE II or BINDING SITE III. Table 2 illustrates the complementarity of the nucleotide sequences of LOC203305 BINDING SITE, designated SEQ ID:43511, to the nucleotide sequence of VGAM835 RNA, herein designated VGAM RNA, also designated SEQ ID:3546.

Another function of VGAM835 is therefore inhibition of LOC203305 (Accession XM_117529). Accordingly, utilities of VGAM835 include diagnosis, prevention and treatment of diseases and clinical conditions associated with LOC203305. LOC219686 (Accession XM_165544) is another VGAM835 host target gene. LOC219686 BINDING SITE is HOST TARGET binding site found in the 3' untranslated region of mRNA encoded by LOC219686, corresponding to a HOST TARGET binding site such as BINDING SITE I, BINDING SITE II or BINDING SITE III. Table 2 illustrates the complementarity of the nucleotide sequences of LOC219686 BINDING SITE, designated SEQ ID:43675, to the nucleotide sequence of VGAM835 RNA, herein designated VGAM RNA, also designated SEQ ID:3546.

Another function of VGAM835 is therefore inhibition of LOC219686 (Accession XM_165544). Accordingly, utilities of VGAM835 include diagnosis, prevention and treatment of diseases and clinical conditions associated with LOC219686. LOC254243 (Accession XM_173233) is another VGAM835 host target gene. LOC254243 BINDING SITE is HOST TARGET binding site found in the 3' untranslated region of mRNA encoded by LOC254243, corresponding to a HOST TARGET binding site such as BINDING SITE I, BINDING SITE II or BINDING SITE III. Table 2 illustrates the complementarity of the nucleotide sequences of LOC254243 BINDING SITE, designated SEQ ID:46514, to the nucleotide sequence of VGAM835 RNA, herein designated VGAM RNA, also designated SEQ ID:3546.

Another function of VGAM835 is therefore inhibition of LOC254243 (Accession XM_173233). Accordingly, utilities of VGAM835 include diagnosis, prevention and treatment of diseases and clinical conditions associated with LOC254243. LOC63923 (Accession XM_040527) is another VGAM835 host target gene. LOC63923 BINDING SITE is HOST TARGET binding site found in the 3' untranslated region of mRNA encoded by LOC63923, corresponding to a HOST TARGET binding site such as BINDING SITE I, BINDING SITE II or BINDING SITE III. Table 2 illustrates the complementarity of the nucleotide sequences of LOC63923 BINDING SITE, designated SEQ ID:33324, to the nucleotide sequence of VGAM835 RNA, herein designated VGAM RNA, also designated SEQ ID:3546.

Another function of VGAM835 is therefore inhibition of LOC63923 (Accession XM_040527). Accordingly, utilities of VGAM835 include diagnosis, prevention and treatment of diseases and clinical conditions associated with LOC63923. LOC90038 (Accession XM_028305) is another VGAM835 host target gene. LOC90038 BINDING SITE is HOST TARGET binding site found in the 3' untranslated region of mRNA encoded by LOC90038, corresponding to a HOST TARGET binding site such as BINDING SITE I, BINDING SITE II or BINDING SITE III. Table 2 illustrates the complementarity of the nucleotide sequences of LOC90038 BINDING SITE, designated SEQ ID:30651, to the nucleotide sequence of VGAM835 RNA, herein designated VGAM RNA, also designated SEQ ID:3546.

Another function of VGAM835 is therefore inhibition of LOC90038 (Accession XM_028305). Accordingly, utilities of VGAM835 include diagnosis, prevention and treatment of diseases and clinical conditions associated with LOC90038. FIG. 1 further provides a conceptual description of a novel bioinformatically detected viral gene of the present invention, referred to here as Viral Genomic Address Messenger 836 (VGAM836) viral gene, which modulates expression of respective host target genes thereof, the function and utility of which host target genes is known in the art.

VGAM836 is a novel bioinformatically detected regulatory, non protein coding, viral micro RNA (miRNA) gene. The method by which VGAM836 was detected is described hereinabove with reference to FIGS. 1-8.

VGAM836 gene, herein designated VGAM GENE, is a viral gene contained in the genome of Monkeypox Virus. VGAM836 host target gene, herein designated VGAM HOST TARGET GENE, is a human gene contained in the human genome.

VGAM836 gene encodes a VGAM836 precursor RNA, herein designated VGAM PRECURSOR RNA. Similar to other miRNA genes, and unlike most ordinary genes, VGAM836 precursor RNA does not encode a protein. A nucleotide sequence identical or highly similar to the nucleotide sequence of VGAM836 precursor RNA is designated SEQ ID:822, and is provided hereinbelow with reference to the sequence listing part. Nucleotide sequence SEQ ID:822 is located at position 185395 relative to the genome of Monkeypox Virus.

VGAM836 precursor RNA folds onto itself, forming VGAM836 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM836 folded precursor RNA into VGAM836 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM836 RNA is designated SEQ ID:3547, and is provided hereinbelow with reference to the sequence listing part.

VGAM836 host target gene, herein designated VGAM HOST TARGET GENE, encodes a corresponding messenger RNA, VGAM836 host target RNA, herein designated VGAM HOST TARGET RNA. VGAM836 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM836 RNA, herein designated VGAM RNA, binds complementarily to one or more host target binding sites located in untranslated regions of VGAM836 host target RNA, herein designated VGAM HOST TARGET RNA. This complementary binding is due to the fact that the nucleotide sequence of VGAM836 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM836 RNA, herein designated VGAM RNA, may have a different number of host target binding sites in untranslated regions of a VGAM836 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM836 RNA, herein designated VGAM RNA, to host target binding sites on VGAM836 host target RNA, herein designated VGAM HOST TARGET RNA, such as BINDING SITE I, BINDING SITE II and BINDING SITE III, inhibits translation of VGAM836 host target RNA into VGAM836 host target protein, herein designated VGAM HOST TARGET PROTEIN. VGAM host target protein is therefore outlined by a broken line.

It is appreciated that VGAM836 host target gene, herein designated VGAM HOST TARGET GENE, in fact represents a plurality of VGAM836 host target genes. The mRNA of each one of this plurality of VGAM836 host target genes comprises one or more host target binding sites, each having a nucleotide sequence which is at least partly complementary to VGAM836 RNA, herein designated VGAM RNA, and which when bound by VGAM836 RNA causes inhibition of translation of respective one or more VGAM836 host target proteins.

It is further appreciated by one skilled in the art that the mode of translational inhibition illustrated by FIG. 1 with specific reference to translational inhibition exerted by VGAM836 gene, herein designated VGAM GENE, on one or more VGAM836 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM836 is inhibition of expression of host target genes, as part of a novel viral mechanism of attacking a host. Accordingly, utilities of VGAM836 include diagnosis, prevention and treatment of viral infection by Monkeypox Virus. Specific functions, and accordingly utilities, of VGAM836 correlate with, and may be deduced from, the identity of the host target genes which VGAM836 binds and inhibits, and the function of these host target genes, as elaborated hereinbelow.

Nucleotide sequences of the VGAM836 precursor RNA, herein designated VGAM PRECURSOR RNA, and of the 'diced' VGAM836 RNA, herein designated VGAM RNA, and a schematic representation of the secondary folding of VGAM836 folded precursor RNA, herein designated VGAM FOLDED PRECURSOR RNA, of VGAM836 are further described hereinbelow with reference to Table 1.

Nucleotide sequences of host target binding sites, such as BINDING SITE-I, BINDING SITE-II and BINDING SITE-III of FIG. 1, found on VGAM836 host target RNA, and schematic representation of the complementarity of each of these host target binding sites to VGAM836 RNA, herein designated VGAM RNA, are described hereinbelow with reference to Table 2.

As mentioned hereinabove with reference to FIG. 1, a function of VGAM836 gene, herein designated VGAM is inhibition of expression of VGAM836 target genes. It is appreciated that specific functions, and accordingly utilities, of VGAM836 correlate with, and may be deduced from, the identity of the target genes which VGAM836 binds and inhibits, and the function of these target genes, as elaborated hereinbelow.

Ribosomal Protein L15 (RPL15, Accession NM_002948) is a VGAM836 host target gene. RPL15 BINDING SITE is HOST TARGET binding site found in the 3' untranslated region of mRNA encoded by RPL15, corresponding to a HOST TARGET binding site such as BINDING SITE I, BINDING SITE II or BINDING SITE III. Table 2 illustrates the complementarity of the nucleotide sequences of RPL15 BINDING SITE, designated SEQ ID:8860, to the nucleotide sequence of VGAM836 RNA, herein designated VGAM RNA, also designated SEQ ID:3547.

A function of VGAM836 is therefore inhibition of Ribosomal Protein L15 (RPL15, Accession NM_002948). Accordingly, utilities of VGAM836 include diagnosis, prevention and treatment of diseases and clinical conditions associated with RPL15. BRCA2 and CDKN1A Interacting Protein (BCCIP, Accession NM_078469) is another VGAM836 host target gene. BCCIP BINDING SITE is HOST TARGET binding site found in the 3' untranslated region of mRNA encoded by BCCIP, corresponding to a HOST TARGET binding site such as BINDING SITE I, BINDING SITE II or BINDING SITE III. Table 2 illustrates the complementarity of the nucleotide sequences of BCCIP BINDING SITE, designated SEQ ID:27786, to the nucleotide sequence of VGAM836 RNA, herein designated VGAM RNA, also designated SEQ ID:3547.

Another function of VGAM836 is therefore inhibition of BRCA2 and CDKN1A Interacting Protein (BCCIP, Accession NM_078469). Accordingly, utilities of VGAM836 include diagnosis, prevention and treatment of diseases and clinical conditions associated with BCCIP. KIAA1110 (Accession XM_029973) is another VGAM836 host target gene. KIAA1110 BINDING SITE is HOST TARGET binding site found in the 3' untranslated region of mRNA encoded by KIAA1110, corresponding to a HOST TARGET binding site such as BINDING SITE I, BINDING SITE II or BINDING SITE III. Table 2 illustrates the complementarity of the nucleotide sequences of KIAA1110 BINDING SITE, designated SEQ ID:30981, to the nucleotide sequence of VGAM836 RNA, herein designated VGAM RNA, also designated SEQ ID:3547.

Another function of VGAM836 is therefore inhibition of KIAA1110 (Accession XM_029973). Accordingly, utilities of VGAM836 include diagnosis, prevention and treatment of diseases and clinical conditions associated with KIAA1110. KIAA1877 (Accession XM_038616) is another VGAM836 host target gene. KIAA1877 BINDING SITE is HOST TARGET binding site found in the 3' untranslated region of mRNA encoded by KIAA1877, corresponding to a HOST TARGET binding site such as BINDING SITE I, BINDING SITE II or BINDING SITE III. Table 2 illustrates the complementarity of the nucleotide sequences of KIAA1877 BINDING SITE, designated SEQ ID:32885, to the nucleotide sequence of VGAM836 RNA, herein designated VGAM RNA, also designated SEQ ID:3547.

Another function of VGAM836 is therefore inhibition of KIAA1877 (Accession XM_038616). Accordingly, utilities of VGAM836 include diagnosis, prevention and treatment of diseases and clinical conditions associated with KIAA1877. Proline-rich Gla (G-carboxyglutamic acid) Polypeptide 1 (PRRG1, Accession NM_000950) is another VGAM836 host target gene. PRRG1 BINDING SITE is HOST TARGET binding site found in the 3' untranslated region of mRNA encoded by PRRG1, corresponding to a HOST TARGET binding site such as BINDING SITE I, BINDING SITE II or BINDING SITE III. Table 2 illustrates the complementarity of the nucleotide sequences of PRRG1 BINDING SITE, designated SEQ ID:6656, to the nucleotide sequence of VGAM836 RNA, herein designated VGAM RNA, also designated SEQ ID:3547.

Another function of VGAM836 is therefore inhibition of Proline-rich Gla (G-carboxyglutamic acid) Polypeptide 1 (PRRG1, Accession NM_000950). Accordingly, utilities of VGAM836 include diagnosis, prevention and treatment of diseases and clinical conditions associated with PRRG1. LOC149910 (Accession XM_086699) is another VGAM836 host target gene. LOC149910 BINDING SITE is HOST TARGET binding site found in the 3' untranslated region of mRNA encoded by LOC149910, corresponding to a HOST TARGET binding site such as BINDING SITE I, BINDING SITE II or BINDING SITE III. Table 2 illustrates the complementarity of the nucleotide sequences of LOC149910 BINDING SITE, designated SEQ ID:38828, to the nucleotide sequence of VGAM836 RNA, herein designated VGAM RNA, also designated SEQ ID:3547.

Another function of VGAM836 is therefore inhibition of LOC149910 (Accession XM_086699). Accordingly, utilities of VGAM836 include diagnosis, prevention and treatment of diseases and clinical conditions associated with LOC149910. LOC151405 (Accession XM_098058) is another VGAM836 host target gene. LOC151405 BINDING SITE is HOST TARGET binding site found in the 5' untranslated region of mRNA encoded by LOC151405, corresponding to a HOST TARGET binding site such as BINDING SITE I, BINDING SITE II or BINDING SITE III. Table 2 illustrates the complementarity of the nucleotide sequences of LOC151405 BINDING SITE, designated SEQ ID:41338, to the nucleotide sequence of VGAM836 RNA, herein designated VGAM RNA, also designated SEQ ID:3547.

Another function of VGAM836 is therefore inhibition of LOC151405 (Accession XM_098058). Accordingly, utilities of VGAM836 include diagnosis, prevention and treatment of diseases and clinical conditions associated with LOC151405. LOC153196 (Accession XM_098323) is another VGAM836 host target gene. LOC153196 BINDING SITE is HOST TARGET binding site found in the 5' untranslated region of mRNA encoded by LOC153196, corresponding to a HOST TARGET binding site such as BINDING SITE I, BINDING SITE II or BINDING SITE III. Table 2 illustrates the complementarity of the nucleotide sequences of LOC153196 BINDING SITE, designated SEQ ID:41587, to the nucleotide sequence of VGAM836 RNA, herein designated VGAM RNA, also designated SEQ ID:3547.

Another function of VGAM836 is therefore inhibition of LOC153196 (Accession XM_098323). Accordingly, utilities of VGAM836 include diagnosis, prevention and treatment of diseases and clinical conditions associated with LOC153196. FIG. 1 further provides a conceptual description of a novel bioinformatically detected viral gene of the present invention, referred to here as Viral Genomic Address Messenger 837 (VGAM837) viral gene, which modulates expression of respective host target genes thereof, the function and utility of which host target genes is known in the art.

VGAM837 is a novel bioinformatically detected regulatory, non protein coding, viral micro RNA (miRNA) gene. The method by which VGAM837 was detected is described hereinabove with reference to FIGS. 1-8.

VGAM837 gene, herein designated VGAM GENE, is a viral gene contained in the genome of Monkeypox Virus. VGAM837 host target gene, herein designated VGAM HOST TARGET GENE, is a human gene contained in the human genome.

VGAM837 gene encodes a VGAM837 precursor RNA, herein designated VGAM PRECURSOR RNA. Similar to other miRNA genes, and unlike most ordinary genes, VGAM837 precursor RNA does not encode a protein. A nucleotide sequence identical or highly similar to the nucleotide sequence of VGAM837 precursor RNA is designated SEQ ID:823, and is provided hereinbelow with reference to the sequence listing part. Nucleotide sequence SEQ ID:823 is located at position 183768 relative to the genome of Monkeypox Virus.

VGAM837 precursor RNA folds onto itself, forming VGAM837 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM837 folded precursor RNA into VGAM837 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM837 RNA is designated SEQ ID:3548, and is provided hereinbelow with reference to the sequence listing part.

VGAM837 host target gene, herein designated VGAM HOST TARGET GENE, encodes a corresponding messenger RNA, VGAM837 host target RNA, herein designated VGAM HOST TARGET RNA. VGAM837 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM837 RNA, herein designated VGAM RNA, binds complementarily to one or more host target binding sites located in untranslated regions of VGAM837 host target RNA, herein designated VGAM HOST TARGET RNA. This complementary binding is due to the fact that the nucleotide sequence of VGAM837 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM837 RNA, herein designated VGAM RNA, may have a different number of host target binding sites in untranslated regions of a VGAM837 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM837 RNA, herein designated VGAM RNA, to host target binding sites on VGAM837 host target RNA, herein designated VGAM HOST TARGET RNA, such as BINDING SITE I, BINDING SITE II and BINDING SITE III, inhibits translation of VGAM837 host target RNA into VGAM837 host target protein, herein designated VGAM HOST TARGET PROTEIN. VGAM host target protein is therefore outlined by a broken line.

It is appreciated that VGAM837 host target gene, herein designated VGAM HOST TARGET GENE, in fact represents a plurality of VGAM837 host target genes. The mRNA of each one of this plurality of VGAM837 host target genes comprises one or more host target binding sites, each having a nucleotide sequence which is at least partly complementary to VGAM837 RNA, herein designated VGAM RNA, and which when bound by VGAM837 RNA causes inhibition of translation of respective one or more VGAM837 host target proteins.

It is further appreciated by one skilled in the art that the mode of translational inhibition illustrated by FIG. 1 with specific reference to translational inhibition exerted by VGAM837 gene, herein designated VGAM GENE, on one or more VGAM837 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM837 is inhibition of expression of host target genes, as part of a novel viral mechanism of attacking a host. Accordingly, utilities of VGAM837 include diagnosis, prevention and treatment of viral infection by Monkeypox Virus. Specific functions, and accordingly utilities, of VGAM837 correlate with, and may be deduced from, the identity of the host target genes which VGAM837 binds and inhibits, and the function of these host target genes, as elaborated hereinbelow.

Nucleotide sequences of the VGAM837 precursor RNA, herein designated VGAM PRECURSOR RNA, and of the 'diced' VGAM837 RNA, herein designated VGAM RNA, and a schematic representation of the secondary folding of VGAM837 folded precursor RNA, herein designated VGAM FOLDED PRECURSOR RNA, of VGAM837 are further described hereinbelow with reference to Table 1.

Nucleotide sequences of host target binding sites, such as BINDING SITE-I, BINDING SITE-II and BINDING SITE-III of FIG. 1, found on VGAM837 host target RNA, and schematic representation of the complementarity of each of these host target binding sites to VGAM837 RNA, herein designated VGAM RNA, are described hereinbelow with reference to Table 2.

As mentioned hereinabove with reference to FIG. 1, a function of VGAM837 gene, herein designated VGAM is inhibition of expression of VGAM837 target genes. It is appreciated that specific functions, and accordingly utilities, of VGAM837 correlate with, and may be deduced from, the identity of the target genes which VGAM837 binds and inhibits, and the function of these target genes, as elaborated hereinbelow.

Ubiquitin-like 3 (UBL3, Accession NM_007106) is a VGAM837 host target gene. UBL3 BINDING SITE is HOST TARGET binding site found in the 3' untranslated region of mRNA encoded by UBL3, corresponding to a HOST TARGET binding site such as BINDING SITE I, BINDING SITE II or BINDING SITE III. Table 2 illustrates the complementarity of the nucleotide sequences of UBL3 BINDING SITE, designated SEQ ID:13966, to the nucleotide sequence of VGAM837 RNA, herein designated VGAM RNA, also designated SEQ ID:3548.

A function of VGAM837 is therefore inhibition of Ubiquitin-like 3 (UBL3, Accession NM_007106), a gene which appears to have a diverse range of cellular functions. Accordingly, utilities of VGAM837 include diagnosis, prevention and treatment of diseases and clinical conditions associated with UBL3. The function of UBL3 and its association with various diseases and clinical conditions, has been established by previous studies, as described hereinabove with reference to VGAM459. FLJ13611 (Accession NM_024941) is another VGAM837 host target gene. FLJ13611 BINDING SITE is HOST TARGET binding site found in the 3' untranslated region of mRNA encoded by FLJ13611, corresponding to a HOST TARGET binding site such as BINDING SITE I, BINDING SITE II or BINDING SITE III. Table 2 illustrates the complementarity of the nucleotide sequences of FLJ13611 BINDING SITE, designated SEQ ID:24485, to the nucleotide sequence of VGAM837 RNA, herein designated VGAM RNA, also designated SEQ ID:3548.

Another function of VGAM837 is therefore inhibition of FLJ13611 (Accession NM_024941). Accordingly, utilities of VGAM837 include diagnosis, prevention and treatment of diseases and clinical conditions associated with FLJ13611. FIG. 1 further provides a conceptual description of a novel bioinformatically detected viral gene of the present invention, referred to here as Viral Genomic Address Messenger 838 (VGAM838) viral gene, which modulates expression of respective host target genes thereof, the function and utility of which host target genes is known in the art.

VGAM838 is a novel bioinformatically detected regulatory, non protein coding, viral micro RNA (miRNA) gene. The method by which VGAM838 was detected is described hereinabove with reference to FIGS. 1-8.

VGAM838 gene, herein designated VGAM GENE, is a viral gene contained in the genome of Monkeypox Virus. VGAM838 host target gene, herein designated VGAM HOST TARGET GENE, is a human gene contained in the human genome.

VGAM838 gene encodes a VGAM838 precursor RNA, herein designated VGAM PRECURSOR RNA. Similar to other miRNA genes, and unlike most ordinary genes, VGAM838 precursor RNA does not encode a protein. A nucleotide sequence identical or highly similar to the nucleotide sequence of VGAM838 precursor RNA is designated SEQ ID:824, and is provided hereinbelow with reference to the sequence listing part. Nucleotide sequence SEQ ID:824 is located at position 183284 relative to the genome of Monkeypox Virus.

VGAM838 precursor RNA folds onto itself, forming VGAM838 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM838 folded precursor RNA into VGAM838 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM838 RNA is designated SEQ ID:3549, and is provided hereinbelow with reference to the sequence listing part.

VGAM838 host target gene, herein designated VGAM HOST TARGET GENE, encodes a corresponding messenger RNA, VGAM838 host target RNA, herein designated VGAM HOST TARGET RNA. VGAM838 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM838 RNA, herein designated VGAM RNA, binds complementarily to one or more host target binding sites located in untranslated regions of VGAM838 host target RNA, herein designated VGAM HOST TARGET RNA. This complementary binding is due to the fact that the nucleotide sequence of VGAM838 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM838 RNA, herein designated VGAM RNA, may have a different number of host target binding sites in untranslated regions of a VGAM838 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM838 RNA, herein designated VGAM RNA, to host target binding sites on VGAM838 host target RNA, herein designated VGAM HOST TARGET RNA, such as BINDING SITE I, BINDING SITE II and BINDING SITE III, inhibits translation of VGAM838 host target RNA into VGAM838 host target protein, herein designated VGAM HOST TARGET PROTEIN. VGAM host target protein is therefore outlined by a broken line.

It is appreciated that VGAM838 host target gene, herein designated VGAM HOST TARGET GENE, in fact represents a plurality of VGAM838 host target genes. The mRNA of each one of this plurality of VGAM838 host target genes comprises one or more host target binding sites, each having a nucleotide sequence which is at least partly complementary to VGAM838 RNA, herein designated VGAM RNA, and which when bound by VGAM838 RNA causes inhibition of translation of respective one or more VGAM838 host target proteins.

It is further appreciated by one skilled in the art that the mode of translational inhibition illustrated by FIG. 1 with specific reference to translational inhibition exerted by VGAM838 gene, herein designated VGAM GENE, on one or more VGAM838 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM838 is inhibition of expression of host target genes, as part of a novel viral mechanism of attacking a host. Accordingly, utilities of VGAM838 include diagnosis, prevention and treatment of viral infection by Monkeypox Virus. Specific functions, and accordingly utilities, of VGAM838 correlate with, and may be deduced from, the identity of the host target genes which VGAM838 binds and inhibits, and the function of these host target genes, as elaborated hereinbelow.

Nucleotide sequences of the VGAM838 precursor RNA, herein designated VGAM PRECURSOR RNA, and of the 'diced' VGAM838 RNA, herein designated VGAM RNA, and a schematic representation of the secondary folding of VGAM838 folded precursor RNA, herein designated VGAM FOLDED PRECURSOR RNA, of VGAM838 are further described hereinbelow with reference to Table 1.

Nucleotide sequences of host target binding sites, such as BINDING SITE-I, BINDING SITE-II and BINDING SITE-III of FIG. 1, found on VGAM838 host target RNA, and schematic representation of the complementarity of each of these host target binding sites to VGAM838 RNA, herein designated VGAM RNA, are described hereinbelow with reference to Table 2.

As mentioned hereinabove with reference to FIG. 1, a function of VGAM838 gene, herein designated VGAM is inhibition of expression of VGAM838 target genes. It is appreciated that specific functions, and accordingly utilities, of VGAM838 correlate with, and may be deduced from, the identity of the target genes which VGAM838 binds and inhibits, and the function of these target genes, as elaborated hereinbelow.

AXIN1 Up-regulated 1 (AXUD1, Accession NM_033027) is a VGAM838 host target gene. AXUD1 BINDING SITE is HOST TARGET binding site found in the 3' untranslated region of mRNA encoded by AXUD1, corresponding to a HOST TARGET binding site such as BINDING SITE I, BINDING SITE II or BINDING SITE III. Table 2 illustrates the complementarity of the nucleotide sequences of AXUD1 BINDING SITE, designated SEQ ID:26917, to the nucleotide sequence of VGAM838 RNA, herein designated VGAM RNA, also designated SEQ ID:3549.

A function of VGAM838 is therefore inhibition of AXIN1 Up-regulated 1 (AXUD1, Accession NM_033027). Accordingly, utilities of VGAM838 include diagnosis, prevention and treatment of diseases and clinical conditions associated with AXUD1. Cadherin 13, H-cadherin (heart) (CDH13, Accession NM_001257) is another VGAM838 host target gene. CDH13 BINDING SITE is HOST TARGET binding site found in the 3' untranslated region of mRNA encoded by CDH13, corresponding to a HOST TARGET binding site such as BINDING SITE I, BINDING SITE II or BINDING SITE III. Table 2 illustrates the complementarity of the nucleotide sequences of CDH13 BINDING SITE, designated SEQ ID:6926, to the nucleotide sequence of VGAM838 RNA, herein designated VGAM RNA, also designated SEQ ID:3549.

Another function of VGAM838 is therefore inhibition of Cadherin 13, H-cadherin (heart) (CDH13, Accession NM_001257). Accordingly, utilities of VGAM838 include diagnosis, prevention and treatment of diseases and clinical conditions associated with CDH13. Cytochrome P450, Subfamily XXVIIB (25-hydroxyvitamin D-1-alpha-hydroxylase), Polypeptide 1 (CYP27B1, Accession NM_000785) is another VGAM838 host target gene. CYP27B1 BINDING SITE is HOST TARGET binding site found in the 3' untranslated region of mRNA encoded by CYP27B1, corresponding to a HOST TARGET binding site such as BINDING SITE I, BINDING SITE II or BINDING SITE III. Table 2 illustrates the complementarity of the nucleotide sequences of CYP27B1 BINDING SITE, designated SEQ ID:6431, to the nucleotide sequence of VGAM838 RNA, herein designated VGAM RNA, also designated SEQ ID:3549.

Another function of VGAM838 is therefore inhibition of Cytochrome P450, Subfamily XXVIIB (25-hydroxyvitamin D-1-alpha-hydroxylase), Polypeptide 1 (CYP27B1, Accession NM_000785). Accordingly, utilities of VGAM838 include diagnosis, prevention and treatment of diseases and clinical conditions associated with CYP27B1. Dishevelled Associated Activator of Morphogenesis 2 (DAAM2, Accession XM_166434) is another VGAM838 host target gene. DAAM2 BINDING SITE is HOST TARGET binding site found in the 3' untranslated region of mRNA encoded by DAAM2, corresponding to a HOST TARGET binding site such as BINDING SITE I, BINDING SITE II or BINDING SITE III. Table 2 illustrates the complementarity of the nucleotide sequences of DAAM2 BINDING SITE, designated SEQ ID:44335, to the nucleotide sequence of VGAM838 RNA, herein designated VGAM RNA, also designated SEQ ID:3549.

Another function of VGAM838 is therefore inhibition of Dishevelled Associated Activator of Morphogenesis 2 (DAAM2, Accession XM_166434), a gene which controls cell polarity and movement during development. Accordingly, utilities of VGAM838 include diagnosis, prevention and treatment of diseases and clinical conditions associated with DAAM2. The function of DAAM2 and its association with various diseases and clinical conditions, has been established by previous studies, as described hereinabove with reference to VGAM247. GRB2-associated Binding Protein 2 (GAB2, Accession NM_012296) is another VGAM838 host target gene. GAB2 BINDING SITE1 and GAB2 BINDING SITE2 are HOST TARGET binding sites found in untranslated regions of mRNA encoded by GAB2, corresponding to HOST TARGET binding sites such as BINDING SITE I, BINDING SITE II or BINDING SITE III. Table 2 illustrates the complementarity of the nucleotide sequences of GAB2 BINDING SITE1 and GAB2 BINDING SITE2, designated SEQ ID:14650 and SEQ ID:27845 respectively, to the nucleotide sequence of VGAM838 RNA, herein designated VGAM RNA, also designated SEQ ID:3549.

Another function of VGAM838 is therefore inhibition of GRB2-associated Binding Protein 2 (GAB2, Accession NM_012296), a gene which act as adapters for transmitting various signals. Accordingly, utilities of VGAM838 include diagnosis, prevention and treatment of diseases and clinical conditions associated with GAB2. The function of GAB2 and its association with various diseases and clinical conditions, has been established by previous studies, as described hereinabove with reference to VGAM53. Male-specific Lethal 3-like 1 (Drosophila) (MSL3L1, Accession NM_078628) is another VGAM838 host target gene. MSL3L1 BINDING SITE is HOST TARGET binding site found in the 3' untranslated region of mRNA encoded by MSL3L1, corresponding to a HOST TARGET binding site such as BINDING SITE I, BINDING SITE II or BINDING SITE III. Table 2 illustrates the complementarity of the nucleotide sequences of MSL3L1 BINDING SITE, designated SEQ ID:27811, to the nucleotide sequence of VGAM838 RNA, herein designated VGAM RNA, also designated SEQ ID:3549.

Another function of VGAM838 is therefore inhibition of Male-specific Lethal 3-like 1 (Drosophila) (MSL3L1, Accession NM_078628). Accordingly, utilities of VGAM838 include diagnosis, prevention and treatment of diseases and clinical conditions associated with MSL3L1. Microsomal Triglyceride Transfer Protein (large polypeptide, 88 kDa) (MTP, Accession NM_000253) is another VGAM838 host target gene. MTP BINDING SITE is HOST TARGET binding site found in the 3' untranslated region of mRNA encoded by MTP, corresponding to a HOST TARGET binding site such as BINDING SITE I, BINDING SITE II or BINDING SITE III. Table 2 illustrates the complementarity of the nucleotide sequences of MTP BINDING SITE, designated SEQ ID:5794, to the nucleotide sequence of VGAM838 RNA, herein designated VGAM RNA, also designated SEQ ID:3549.

Another function of VGAM838 is therefore inhibition of Microsomal Triglyceride Transfer Protein (large polypeptide, 88 kDa) (MTP, Accession NM_000253). Accordingly, utilities of VGAM838 include diagnosis, prevention and treatment of diseases and clinical conditions associated with MTP. Nitric Oxide Synthase 1 (neuronal) (NOS1, Accession NM_000620) is another VGAM838 host target gene. NOS1 BINDING SITE is HOST TARGET binding site found in the 3' untranslated region of mRNA encoded by NOS1, corresponding to a HOST TARGET binding site such as BINDING SITE I, BINDING SITE II or BINDING SITE III. Table 2 illustrates the complementarity of the nucleotide sequences of NOS1 BINDING SITE, designated SEQ ID:6233, to the nucleotide sequence of VGAM838 RNA, herein designated VGAM RNA, also designated SEQ ID:3549.

Another function of VGAM838 is therefore inhibition of Nitric Oxide Synthase 1 (neuronal) (NOS1, Accession NM_000620), a gene which produces nitric oxide (no) which is a messenger molecule with diverse functions throughout the body. Accordingly, utilities of VGAM838 include diagnosis, prevention and treatment of diseases and clinical conditions associated with NOS1. The function of NOS1 and its association with various diseases and clinical conditions, has been established by previous studies, as described hereinabove with reference to VGAM323. PATE (Accession NM_138294) is another VGAM838 host target gene. PATE BINDING SITE is HOST TARGET binding site found in the 3' untranslated region of mRNA encoded by PATE, corresponding to a HOST TARGET binding site such as BINDING SITE I, BINDING SITE II or BINDING SITE III. Table 2 illustrates the complementarity of the nucleotide sequences of PATE BINDING SITE, designated SEQ ID:28708, to the nucleotide sequence of VGAM838 RNA, herein designated VGAM RNA, also designated SEQ ID:3549.

Another function of VGAM838 is therefore inhibition of PATE (Accession NM_138294). Accordingly, utilities of VGAM838 include diagnosis, prevention and treatment of diseases and clinical conditions associated with PATE. Protein Phosphatase 1, Regulatory (inhibitor) Subunit 12A (PPP1R12A, Accession NM_002480) is another VGAM838 host target gene. PPP1R12A BINDING SITE is HOST TARGET binding site found in the 3' untranslated region of mRNA encoded by PPP1R12A, corresponding to a HOST TARGET binding site such as BINDING SITE I, BINDING SITE II or BINDING SITE III. Table 2 illustrates the complementarity of the nucleotide sequences of PPP1R12A BINDING SITE, designated SEQ ID:8305, to the nucleotide sequence of VGAM838 RNA, herein designated VGAM RNA, also designated SEQ ID:3549.

Another function of VGAM838 is therefore inhibition of Protein Phosphatase 1, Regulatory (inhibitor) Subunit 12A (PPP1R12A, Accession NM_002480), a gene which regulates the interaction of actin and myosin. Accordingly, utilities of VGAM838 include diagnosis, prevention and treatment of diseases and clinical conditions associated with PPP1R12A. The function of PPP1R12A has been established by previous studies. Kimura et al. (1996) demonstrated that myosin phosphatase regulates the interaction of actin (see OMIM Ref. No. 102540) and myosin (see OMIM Ref. No. 160710) downstream of the guanosine triphosphatase Rho. Rho appears to inhibit myosin phosphatase through the action of Rho-kinase. Using the rat Mypt1 cDNA as probe, Takahashi et al. (1997) cloned a 4,855-bp cDNA for a human gene they symbolized MYPT1. Sequencing analysis showed that human MYPT1 contains 1,030 amino acids with a calculated molecular mass of approximately 115 kD. By fluorescence in situ hybridization, Kimura et al. (1996) mapped the MYPT1 gene to 12q15-q21.2. By radiation hybrid analysis, they showed that MYPT1 is located close to a highly polymorphic marker that lies between D12S350 and D12S106.

Full details of the abovementioned studies are described in the following publications, the disclosure of which are hereby incorporated by reference:

Kimura, K.; Ito, M.; Amano, M.; Chihara, K.; Fukata, Y.; Nakafuku, M.; Yamamori, B.; Feng, J.; Nakano, T.; Okawa, K.; Iwamatsu, A.; Kaibuchi, K.: Regulation of myosin phosphatase by Rho and Rho-associated kinase (Rho-kinase). Science 273:245-248, 1996; and Takahashi, N.; Ito, M.; Tanaka, J.; Nakano, T.; Kaibuchi, K.; Odai, H.; Takemura, K.: Localization of the gene coding for myosin phosphatase, target subunit 1 (MYPT1) to human chromosom.

Further studies establishing the function and utilities of PPP1R12A are found in John Hopkins OMIM database record ID 602021, and in sited publications numbered 5829-5830 listed in the bibliography section hereinbelow, which are also hereby incorporated by reference. ABLIM (Accession NM_006720) is another VGAM838 host target gene. ABLIM BINDING SITE1 and ABLIM BINDING SITE2 are HOST TARGET binding sites found in untranslated regions of mRNA encoded by ABLIM, corresponding to HOST TARGET binding sites such as BINDING SITE I, BINDING SITE II or BINDING SITE III. Table 2 illustrates the complementarity of the nucleotide sequences of ABLIM BINDING SITE1 and ABLIM BINDING SITE2, designated SEQ ID:13552 and SEQ ID:8119 respectively, to the nucleotide sequence of VGAM838 RNA, herein designated VGAM RNA, also designated SEQ ID:3549.

Another function of VGAM838 is therefore inhibition of ABLIM (Accession NM_006720). Accordingly, utilities of VGAM838 include diagnosis, prevention and treatment of diseases and clinical conditions associated with ABLIM. FLJ12768 (Accession NM_025163) is another VGAM838 host target gene. FLJ12768 BINDING SITE is HOST TARGET binding site found in the 3" untranslated region of mRNA encoded by FLJ12768, corresponding to a HOST TARGET binding site such as BINDING SITE I, BINDING SITE II or BINDING SITE III. Table 2 illustrates the complementarity of the nucleotide sequences of FLJ12768 BINDING SITE, designated SEQ ID:24801, to the nucleotide sequence of VGAM838 RNA, herein designated VGAM RNA, also designated SEQ ID:3549.

Another function of VGAM838 is therefore inhibition of FLJ12768 (Accession NM_025163). Accordingly, utilities of VGAM838 include diagnosis, prevention and treatment of diseases and clinical conditions associated with FLJ12768. FLJ14547 (Accession NM_032804) is another VGAM838 host target gene. FLJ14547 BINDING SITE is HOST TARGET binding site found in the 3' untranslated region of mRNA encoded by FLJ14547, corresponding to a HOST TARGET binding site such as BINDING SITE I, BINDING SITE II or BINDING SITE III. Table 2 illustrates the complementarity of the nucleotide sequences of FLJ14547 BINDING SITE, designated SEQ ID:26558, to the nucleotide sequence of VGAM838 RNA, herein designated VGAM RNA, also designated SEQ ID:3549.

Another function of VGAM838 is therefore inhibition of FLJ14547 (Accession NM_032804). Accordingly, utilities of VGAM838 include diagnosis, prevention and treatment of diseases and clinical conditions associated with FLJ14547.

FLJ22477 (Accession NM_024735) is another VGAM838 host target gene. FLJ22477 BINDING SITE is HOST TARGET binding site found in the 3' untranslated region of mRNA encoded by FLJ22477, corresponding to a HOST TARGET binding site such as BINDING SITE I, BINDING SITE II or BINDING SITE III. Table 2 illustrates the complementarity of the nucleotide sequences of FLJ22477 BINDING SITE, designated SEQ ID:24076, to the nucleotide sequence of VGAM838 RNA, herein designated VGAM RNA, also designated SEQ ID:3549.

Another function of VGAM838 is therefore inhibition of FLJ22477 (Accession NM_024735). Accordingly, utilities of VGAM838 include diagnosis, prevention and treatment of diseases and clinical conditions associated with FLJ22477. KIAA0227 (Accession XM_027236) is another VGAM838 host target gene. KIAA0227 BINDING SITE is HOST TARGET binding site found in the 3' untranslated region of mRNA encoded by KIAA0227, corresponding to a HOST TARGET binding site such as BINDING SITE I, BINDING SITE II or BINDING SITE III. Table 2 illustrates the complementarity of the nucleotide sequences of KIAA0227 BINDING SITE, designated SEQ ID:30447, to the nucleotide sequence of VGAM838 RNA, herein designated VGAM RNA, also designated SEQ ID:3549.

Another function of VGAM838 is therefore inhibition of KIAA0227 (Accession XM_027236). Accordingly, utilities of VGAM838 include diagnosis, prevention and treatment of diseases and clinical conditions associated with KIAA0227. KIAA0265 (Accession XM_045954) is another VGAM838 host target gene. KIAA0265 BINDING SITE is HOST TARGET binding site found in the 3' untranslated region of mRNA encoded by KIAA0265, corresponding to a HOST TARGET binding site such as BINDING SITE I, BINDING SITE II or BINDING SITE III. Table 2 illustrates the complementarity of the nucleotide sequences of KIAA0265 BINDING SITE, designated SEQ ID:34619, to the nucleotide sequence of VGAM838 RNA, herein designated VGAM RNA, also designated SEQ ID:3549.

Another function of VGAM838 is therefore inhibition of KIAA0265 (Accession XM_045954). Accordingly, utilities of VGAM838 include diagnosis, prevention and treatment of diseases and clinical conditions associated with KIAA0265. KIAA0298 (Accession XM_084529) is another VGAM838 host target gene. KIAA0298 BINDING SITE is HOST TARGET binding site found in the 3' untranslated region of mRNA encoded by KIAA0298, corresponding to a HOST TARGET binding site such as BINDING SITE I, BINDING SITE II or BINDING SITE III. Table 2 illustrates the complementarity of the nucleotide sequences of KIAA0298 BINDING SITE, designated SEQ ID:37623, to the nucleotide sequence of VGAM838 RNA, herein designated VGAM RNA, also designated SEQ ID:3549.

Another function of VGAM838 is therefore inhibition of KIAA0298 (Accession XM_084529). Accordingly, utilities of VGAM838 include diagnosis, prevention and treatment of diseases and clinical conditions associated with KIAA0298. MGC4415 (Accession NM_031484) is another VGAM838 host target gene. MGC4415 BINDING SITE is HOST TARGET binding site found in the 3' untranslated region of mRNA encoded by MGC4415, corresponding to a HOST TARGET binding site such as BINDING SITE I, BINDING SITE II or BINDING SITE III. Table 2 illustrates the complementarity of the nucleotide sequences of MGC4415 BINDING SITE, designated SEQ ID:25565, to the nucleotide sequence of VGAM838 RNA, herein designated VGAM RNA, also designated SEQ ID:3549.

Another function of VGAM838 is therefore inhibition of MGC4415 (Accession NM_031484). Accordingly, utilities of VGAM838 include diagnosis, prevention and treatment of diseases and clinical conditions associated with MGC4415. Melanoma-derived Leucine Zipper, Extra-nuclear Factor (MLZE, Accession NM_031415) is another VGAM838 host target gene. MLZE BINDING SITE is HOST TARGET binding site found in the 5' untranslated region of mRNA encoded by MLZE, corresponding to a HOST TARGET binding site such as BINDING SITE I, BINDING SITE II or BINDING SITE III. Table 2 illustrates the complementarity of the nucleotide sequences of MLZE BINDING SITE, designated SEQ ID:25395, to the nucleotide sequence of VGAM838 RNA, herein designated VGAM RNA, also designated SEQ ID:3549.

Another function of VGAM838 is therefore inhibition of Melanoma-derived Leucine Zipper, Extra-nuclear Factor (MLZE, Accession NM_031415). Accordingly, utilities of VGAM838 include diagnosis, prevention and treatment of diseases and clinical conditions associated with MLZE. NCE2 (Accession NM_080678) is another VGAM838 host target gene. NCE2 BINDING SITE is HOST TARGET binding site found in the 3' untranslated region of mRNA encoded by NCE2, corresponding to a HOST TARGET binding site such as BINDING SITE I, BINDING SITE II or BINDING SITE III. Table 2 illustrates the complementarity of the nucleotide sequences of NCE2 BINDING SITE, designated SEQ ID:27972, to the nucleotide sequence of VGAM838 RNA, herein designated VGAM RNA, also designated SEQ ID:3549.

Another function of VGAM838 is therefore inhibition of NCE2 (Accession NM_080678). Accordingly, utilities of VGAM838 include diagnosis, prevention and treatment of diseases and clinical conditions associated with NCE2. p25 (Accession NM_007030) is another VGAM838 host target gene. p25 BINDING SITE is HOST TARGET binding site found in the 3' untranslated region of mRNA encoded by p25, corresponding to a HOST TARGET binding site such as BINDING SITE I, BINDING SITE II or BINDING SITE III. Table 2 illustrates the complementarity of the nucleotide sequences of p25 BINDING SITE, designated SEQ ID:13889, to the nucleotide sequence of VGAM838 RNA, herein designated VGAM RNA, also designated SEQ ID:3549.

Another function of VGAM838 is therefore inhibition of p25 (Accession NM_007030). Accordingly, utilities of VGAM838 include diagnosis, prevention and treatment of diseases and clinical conditions associated with p25. LOC149706 (Accession XM_097718) is another VGAM838 host target gene. LOC149706 BINDING SITE is HOST TARGET binding site found in the 5' untranslated region of mRNA encoded by LOC149706, corresponding to a HOST TARGET binding site such as BINDING SITE I, BINDING SITE II or BINDING SITE III. Table 2 illustrates the complementarity of the nucleotide sequences of LOC149706 BINDING SITE, designated SEQ ID:41061, to the nucleotide sequence of VGAM838 RNA, herein designated VGAM RNA, also designated SEQ ID:3549.

Another function of VGAM838 is therefore inhibition of LOC149706 (Accession XM_097718). Accordingly, utilities of VGAM838 include diagnosis, prevention and treatment of diseases and clinical conditions associated with LOC149706. LOC150208 (Accession XM_097841) is another VGAM838 host target gene. LOC150208 BINDING SITE is HOST TARGET binding site found in the 3' untranslated region of mRNA encoded by LOC150208, corresponding to a HOST TARGET binding site such as BINDING SITE I, BINDING SITE II or BINDING SITE III. Table 2 illustrates the complementarity of the nucleotide sequences of LOC150208 BINDING SITE, designated SEQ ID:41156, to the nucleotide sequence of VGAM838 RNA, herein designated VGAM RNA, also designated SEQ ID:3549.

Another function of VGAM838 is therefore inhibition of LOC150208 (Accession XM_097841). Accordingly, utilities of VGAM838 include diagnosis, prevention and treatment of diseases and clinical conditions associated with LOC150208. LOC157653 (Accession XM_088353) is another VGAM838 host target gene. LOC157653 BINDING SITE is HOST TARGET binding site found in the 5' untranslated region of mRNA encoded by LOC157653, corresponding to a HOST TARGET binding site such as BINDING SITE I, BINDING SITE II or BINDING SITE III. Table 2 illustrates the complementarity of the nucleotide sequences of LOC157653 BINDING SITE, designated SEQ ID:39630, to the nucleotide sequence of VGAM838 RNA, herein designated VGAM RNA, also designated SEQ ID:3549.

Another function of VGAM838 is therefore inhibition of LOC157653 (Accession XM_088353). Accordingly, utilities of VGAM838 include diagnosis, prevention and treatment of diseases and clinical conditions associated with LOC157653. LOC221495 (Accession XM_168136) is another VGAM838 host target gene. LOC221495 BINDING SITE is HOST TARGET binding site found in the 3' untranslated region of mRNA encoded by LOC221495, corresponding to a HOST TARGET binding site such as BINDING SITE I, BINDING SITE II or BINDING SITE III. Table 2 illustrates the complementarity of the nucleotide sequences of LOC221495 BINDING SITE, designated SEQ ID:45057, to the nucleotide sequence of VGAM838 RNA, herein designated VGAM RNA, also designated SEQ ID:3549.

Another function of VGAM838 is therefore inhibition of LOC221495 (Accession XM_168136). Accordingly, utilities of VGAM838 include diagnosis, prevention and treatment of diseases and clinical conditions associated with LOC221495. LOC221747 (Accession XM_166460) is another VGAM838 host target gene. LOC221747 BINDING SITE is HOST TARGET binding site found in the 3' untranslated region of mRNA encoded by LOC221747, corresponding to a HOST TARGET binding site such as BINDING SITE I, BINDING SITE II or BINDING SITE III. Table 2 illustrates the complementarity of the nucleotide sequences of LOC221747 BINDING SITE, designated SEQ ID:44365, to the nucleotide sequence of VGAM838 RNA, herein designated VGAM RNA, also designated SEQ ID:3549.

Another function of VGAM838 is therefore inhibition of LOC221747 (Accession XM_166460). Accordingly, utilities of VGAM838 include diagnosis, prevention and treatment of diseases and clinical conditions associated with LOC221747. FIG. 1 further provides a conceptual description of a novel bioinformatically detected viral gene of the present invention, referred to here as Viral Genomic Address Messenger 839 (VGAM839) viral gene, which modulates expression of respective host target genes thereof, the function and utility of which host target genes is known in the art.

VGAM839 is a novel bioinformatically detected regulatory, non protein coding, viral micro RNA (miRNA) gene. The method by which VGAM839 was detected is described hereinabove with reference to FIGS. 1-8.

VGAM839 gene, herein designated VGAM GENE, is a viral gene contained in the genome of Fowlpox Virus. VGAM839 host target gene, herein designated VGAM HOST TARGET GENE, is a human gene contained in the human genome.

VGAM839 gene encodes a VGAM839 precursor RNA, herein designated VGAM PRECURSOR RNA. Similar to other miRNA genes, and unlike most ordinary genes, VGAM839 precursor RNA does not encode a protein. A nucleotide sequence identical or highly similar to the nucleotide sequence of VGAM839 precursor RNA is designated SEQ ID:825, and is provided hereinbelow with reference to the sequence listing part. Nucleotide sequence SEQ ID:825 is located at position 208402 relative to the genome of Fowlpox Virus.

VGAM839 precursor RNA folds onto itself, forming VGAM839 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM839 folded precursor RNA into VGAM839 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM839 RNA is designated SEQ ID:3550, and is provided hereinbelow with reference to the sequence listing part.

VGAM839 host target gene, herein designated VGAM HOST TARGET GENE, encodes a corresponding messenger RNA, VGAM839 host target RNA, herein designated VGAM HOST TARGET RNA. VGAM839 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM839 RNA, herein designated VGAM RNA, binds complementarily to one or more host target binding sites located in untranslated regions of VGAM839 host target RNA, herein designated VGAM HOST TARGET RNA. This complementary binding is due to the fact that the nucleotide sequence of VGAM839 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM839 RNA, herein designated VGAM RNA, may have a different number of host target binding sites in untranslated regions of a VGAM839 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM839 RNA, herein designated VGAM RNA, to host target binding sites on VGAM839 host target RNA, herein designated VGAM HOST TARGET RNA, such as BINDING SITE I, BINDING SITE II and BINDING SITE III, inhibits translation of VGAM839 host target RNA into VGAM839 host target protein, herein designated VGAM HOST TARGET PROTEIN. VGAM host target protein is therefore outlined by a broken line.

It is appreciated that VGAM839 host target gene, herein designated VGAM HOST TARGET GENE, in fact represents a plurality of VGAM839 host target genes. The mRNA of each one of this plurality of VGAM839 host target genes comprises one or more host target binding sites, each having a nucleotide sequence which is at least partly complementary to VGAM839 RNA, herein designated VGAM RNA, and which when bound by VGAM839 RNA causes inhibition of translation of respective one or more VGAM839 host target proteins.

It is further appreciated by one skilled in the art that the mode of translational inhibition illustrated by FIG. 1 with specific reference to translational inhibition exerted by VGAM839 gene, herein designated VGAM GENE, on one or more VGAM839 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM839 is inhibition of expression of host target genes, as part of a novel viral mechanism of attacking a host. Accordingly, utilities of VGAM839 include diagnosis, prevention and treatment of viral infection by Fowlpox Virus. Specific functions, and accordingly utilities, of VGAM839 correlate with, and may be deduced from, the identity of the host target genes which VGAM839 binds and inhibits, and the function of these host target genes, as elaborated hereinbelow.

Nucleotide sequences of the VGAM839 precursor RNA, herein designated VGAM PRECURSOR RNA, and of the 'diced' VGAM839 RNA, herein designated VGAM RNA, and a schematic representation of the secondary folding of VGAM839 folded precursor RNA, herein designated VGAM FOLDED PRECURSOR RNA, of VGAM839 are further described hereinbelow with reference to Table 1.

Nucleotide sequences of host target binding sites, such as BINDING SITE-I, BINDING SITE-II and BINDING SITE-III of FIG. 1, found on VGAM839 host target RNA, and schematic representation of the complementarity of each of these host target binding sites to VGAM839 RNA, herein designated VGAM RNA, are described hereinbelow with reference to Table 2.

As mentioned hereinabove with reference to FIG. 1, a function of VGAM839 gene, herein designated VGAM is inhibition of expression of VGAM839 target genes. It is appreciated that specific functions, and accordingly utilities, of VGAM839 correlate with, and may be deduced from, the identity of the target genes which VGAM839 binds and inhibits, and the function of these target genes, as elaborated hereinbelow.

ATP-binding Cassette, Sub-family C (CFTR/MRP), Member 1 (ABCC1, Accession NM_019900) is a VGAM839 host target gene. ABCC1 BINDING SITE1 through ABCC1 BINDING SITE3 are HOST TARGET binding sites found in untranslated regions of mRNA encoded by ABCC1, corresponding to HOST TARGET binding sites such as BINDING SITE I, BINDING SITE II or BINDING SITE III. Table 2 illustrates the complementarity of the nucleotide sequences of ABCC1 BINDING SITE1 through ABCC1 BINDING SITE3, designated SEQ ID:21281, SEQ ID:21285 and SEQ ID:11437 respectively, to the nucleotide sequence of VGAM839 RNA, herein designated VGAM RNA, also designated SEQ ID:3550.

A function of VGAM839 is therefore inhibition of ATP-binding Cassette, Sub-family C (CFTR/MRP), Member 1 (ABCC1, Accession NM_019900), a gene which may participate directly in the active transport of drugs into subcellular organelles or influence drug distribution indirectly. Accordingly, utilities of VGAM839 include diagnosis, prevention and treatment of diseases and clinical conditions associated with ABCC1. The function of ABCC1 and its association with various diseases and clinical conditions, has been established by previous studies, as described hereinabove with reference to VGAM479. Corticotropin Releasing Hormone Receptor 2 (CRHR2, Accession NM_001883) is another VGAM839 host target gene. CRHR2 BINDING SITE is HOST TARGET binding site found in the 3' untranslated region of mRNA encoded by CRHR2, corresponding to a HOST TARGET binding site such as BINDING SITE I, BINDING SITE II or BINDING SITE III. Table 2 illustrates the complementarity of the nucleotide sequences of CRHR2 BINDING SITE, designated SEQ ID:7610, to the nucleotide sequence of VGAM839 RNA, herein designated VGAM RNA, also designated SEQ ID:3550.

Another function of VGAM839 is therefore inhibition of Corticotropin Releasing Hormone Receptor 2 (CRHR2, Accession NM_001883), a gene which is a corticotropin releasing factor receptor type II. Accordingly, utilities of VGAM839 include diagnosis, prevention and treatment of diseases and clinical conditions associated with CRHR2. The function of CRHR2 and its association with various diseases and clinical conditions, has been established by previous studies, as described hereinabove with reference to VGAM737. T-complex 10 (mouse) (TCP10, Accession NM_004610) is another VGAM839 host target gene. TCP10 BINDING SITE is HOST TARGET binding site found in the 3' untranslated region of mRNA encoded by TCP10, corresponding to a HOST TARGET binding site such as BINDING SITE I, BINDING SITE II or BINDING SITE III. Table 2 illustrates the complementarity of the nucleotide sequences of TCP10 BINDING SITE, designated SEQ ID:10950, to the nucleotide sequence of VGAM839 RNA, herein designated VGAM RNA, also designated SEQ ID:3550.

Another function of VGAM839 is therefore inhibition of T-complex 10 (mouse) (TCP10, Accession NM_004610). Accordingly, utilities of VGAM839 include diagnosis, prevention and treatment of diseases and clinical conditions associated with TCP10. ARPP-19 (Accession NM_006628) is another VGAM839 host target gene. ARPP-19 BINDING SITE is HOST TARGET binding site found in the 3' untranslated region of mRNA encoded by ARPP-19, corresponding to a HOST TARGET binding site such as BINDING SITE I, BINDING SITE II or BINDING SITE III. Table 2 illustrates the complementarity of the nucleotide sequences of ARPP-19 BINDING SITE, designated SEQ ID:13422, to the nucleotide sequence of VGAM839 RNA, herein designated VGAM RNA, also designated SEQ ID:3550.

Another function of VGAM839 is therefore inhibition of ARPP-19 (Accession NM_006628). Accordingly, utilities of VGAM839 include diagnosis, prevention and treatment of diseases and clinical conditions associated with ARPP-19. DKFZP586C1619 (Accession XM_030350) is another VGAM839 host target gene. DKFZP586C1619 BINDING SITE is HOST TARGET binding site found in the 3' untranslated region of mRNA encoded by DKFZP586C1619, corresponding to a HOST TARGET binding site such as BINDING SITE I, BINDING SITE II or BINDING SITE III. Table 2 illustrates the complementarity of the nucleotide sequences of DKFZP586C1619 BINDING SITE, designated SEQ ID:31016, to the nucleotide sequence of VGAM839 RNA, herein designated VGAM RNA, also designated SEQ ID:3550.

Another function of VGAM839 is therefore inhibition of DKFZP586C1619 (Accession XM_030350). Accordingly, utilities of VGAM839 include diagnosis, prevention and treatment of diseases and clinical conditions associated with DKFZP586C1619. Double C2-like Domains, Beta (DOC2B, Accession NM_003585) is another VGAM839 host target gene. DOC2B BINDING SITE is HOST TARGET binding site found in the 3' untranslated region of mRNA encoded by DOC2B, corresponding to a HOST TARGET binding site such as BINDING SITE I, BINDING SITE II or BINDING SITE III. Table 2 illustrates the complementarity of the nucleotide sequences of DOC2B BINDING SITE, designated SEQ ID:9637, to the nucleotide sequence of VGAM839 RNA, herein designated VGAM RNA, also designated SEQ ID:3550.

Another function of VGAM839 is therefore inhibition of Double C2-like Domains, Beta (DOC2B, Accession NM_003585). Accordingly, utilities of VGAM839 include diagnosis, prevention and treatment of diseases and clinical conditions associated with DOC2B. HSA243666 (Accession NM_017582) is another VGAM839 host target gene. HSA243666 BINDING SITE is HOST TARGET binding site found in the 3' untranslated region of mRNA encoded by HSA243666, corresponding to a HOST TARGET binding site such as BINDING SITE I, BINDING SITE II or BINDING SITE III. Table 2 illustrates the complementarity of the nucleotide sequences of HSA243666 BINDING SITE, designated SEQ ID:19021, to the nucleotide sequence of VGAM839 RNA, herein designated VGAM RNA, also designated SEQ ID:3550.

Another function of VGAM839 is therefore inhibition of HSA243666 (Accession NM_017582). Accordingly, utilities of VGAM839 include diagnosis, prevention and treatment of diseases and clinical conditions associated with HSA243666. KIAA0172 (Accession XM_036295) is another VGAM839 host target gene. KIAA0172 BINDING SITE is HOST TARGET binding site found in the 5' untranslated region of mRNA encoded by KIAA0172, corresponding to a HOST TARGET binding site such as BINDING SITE I, BINDING SITE II or BINDING SITE III. Table 2 illustrates the complementarity of the nucleotide sequences of KIAA0172 BINDING SITE, designated SEQ ID:32408, to the nucleotide sequence of VGAM839 RNA, herein designated VGAM RNA, also designated SEQ ID:3550.

Another function of VGAM839 is therefore inhibition of KIAA0172 (Accession XM_036295). Accordingly, utilities of VGAM839 include diagnosis, prevention and treatment of diseases and clinical conditions associated with KIAA0172. MGC15563 (Accession NM_032876) is another VGAM839 host target gene. MGC15563 BINDING SITE is HOST TARGET binding site found in the 3' untranslated region of mRNA encoded by MGC15563, corresponding to a HOST TARGET binding site such as BINDING SITE I, BINDING SITE II or BINDING SITE III. Table 2 illustrates the complementarity of the nucleotide sequences of MGC15563 BINDING SITE, designated SEQ ID:26698, to the nucleotide sequence of VGAM839 RNA, herein designated VGAM RNA, also designated SEQ ID:3550.

Another function of VGAM839 is therefore inhibition of MGC15563 (Accession NM_032876). Accordingly, utilities of VGAM839 include diagnosis, prevention and treatment of diseases and clinical conditions associated with MGC15563. Solute Carrier Family 39 (zinc transporter), Member 3 (SLC39A3, Accession NM_144564) is another VGAM839 host target gene. SLC39A3 BINDING SITE is HOST TARGET binding site found in the 3' untranslated region of mRNA encoded by SLC39A3, corresponding to a HOST TARGET binding site such as BINDING SITE I, BINDING SITE II or BINDING SITE III. Table 2 illustrates the complementarity of the nucleotide sequences of SLC39A3 BINDING SITE, designated SEQ ID:29361, to the nucleotide sequence of VGAM839 RNA, herein designated VGAM RNA, also designated SEQ ID:3550.

Another function of VGAM839 is therefore inhibition of Solute Carrier Family 39 (zinc transporter), Member 3 (SLC39A3, Accession NM_144564). Accordingly, utilities of VGAM839 include diagnosis, prevention and treatment of diseases and clinical conditions associated with SLC39A3. LOC145508 (Accession XM_085158) is another VGAM839 host target gene. LOC145508 BINDING SITE is HOST TARGET binding site found in the 3' untranslated region of mRNA encoded by LOC145508, corresponding to a HOST TARGET binding site such as BINDING SITE I, BINDING SITE II or BINDING SITE III. Table 2 illustrates the complementarity of the nucleotide sequences of LOC145508 BINDING SITE, designated SEQ ID:37886, to the nucleotide sequence of VGAM839 RNA, herein designated VGAM RNA, also designated SEQ ID:3550.

Another function of VGAM839 is therefore inhibition of LOC145508 (Accession XM_085158). Accordingly, utilities of VGAM839 include diagnosis, prevention and treatment of diseases and clinical conditions associated with LOC145508. LOC220753 (Accession XM_167549) is another VGAM839 host target gene. LOC220753 BINDING SITE is HOST TARGET binding site found in the 5' untranslated region of mRNA encoded by LOC220753, corresponding to a HOST TARGET binding site such as BINDING SITE I, BINDING SITE II or BINDING SITE III. Table 2 illustrates the complementarity of the nucleotide sequences of LOC220753 BINDING SITE, designated SEQ ID:44659, to the nucleotide sequence of VGAM839 RNA, herein designated VGAM RNA, also designated SEQ ID:3550.

Another function of VGAM839 is therefore inhibition of LOC220753 (Accession XM_167549). Accordingly, utilities of VGAM839 include diagnosis, prevention and treatment of diseases and clinical conditions associated with LOC220753. LOC92078 (Accession XM_042684) is another VGAM839 host target gene. LOC92078 BINDING SITE is HOST TARGET binding site found in the 3' untranslated region of mRNA encoded by LOC92078, corresponding to a HOST TARGET binding site such as BINDING SITE I, BINDING SITE II or BINDING SITE III. Table 2 illustrates the complementarity of the nucleotide sequences of LOC92078 BINDING SITE, designated SEQ ID:33746, to the nucleotide sequence of VGAM839 RNA, herein designated VGAM RNA, also designated SEQ ID:3550.

Another function of VGAM839 is therefore inhibition of LOC92078 (Accession XM_042684). Accordingly, utilities of VGAM839 include diagnosis, prevention and treatment of diseases and clinical conditions associated with LOC92078. FIG. 1 further provides a conceptual description of a novel bioinformatically detected viral gene of the present invention, referred to here as Viral Genomic Address Messenger 840 (VGAM840) viral gene, which modulates expression of respective host target genes thereof, the function and utility of which host target genes is known in the art.

VGAM840 is a novel bioinformatically detected regulatory, non protein coding, viral micro RNA (miRNA) gene.

The method by which VGAM840 was detected is described hereinabove with reference to FIGS. 1-8.

VGAM840 gene, herein designated VGAM GENE, is a viral gene contained in the genome of Ictalurid Herpesvirus 1. VGAM840 host target gene, herein designated VGAM HOST TARGET GENE, is a human gene contained in the human genome.

VGAM840 gene encodes a VGAM840 precursor RNA, herein designated VGAM PRECURSOR RNA. Similar to other miRNA genes, and unlike most ordinary genes, VGAM840 precursor RNA does not encode a protein. A nucleotide sequence identical or highly similar to the nucleotide sequence of VGAM840 precursor RNA is designated SEQ ID:826, and is provided hereinbelow with reference to the sequence listing part. Nucleotide sequence SEQ ID:826 is located at position 53374 relative to the genome of Ictalurid Herpesvirus 1.

VGAM840 precursor RNA folds onto itself, forming VGAM840 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM840 folded precursor RNA into VGAM840 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM840 RNA is designated SEQ ID:3551, and is provided hereinbelow with reference to the sequence listing part.

VGAM840 host target gene, herein designated VGAM HOST TARGET GENE, encodes a corresponding messenger RNA, VGAM840 host target RNA, herein designated VGAM HOST TARGET RNA. VGAM840 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM840 RNA, herein designated VGAM RNA, binds complementarily to one or more host target binding sites located in untranslated regions of VGAM840 host target RNA, herein designated VGAM HOST TARGET RNA. This complementary binding is due to the fact that the nucleotide sequence of VGAM840 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM840 RNA, herein designated VGAM RNA, may have a different number of host target binding sites in untranslated regions of a VGAM840 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM840 RNA, herein designated VGAM RNA, to host target binding sites on VGAM840 host target RNA, herein designated VGAM HOST TARGET RNA, such as BINDING SITE I, BINDING SITE II and BINDING SITE III, inhibits translation of VGAM840 host target RNA into VGAM840 host target protein, herein designated VGAM HOST TARGET PROTEIN. VGAM host target protein is therefore outlined by a broken line.

It is appreciated that VGAM840 host target gene, herein designated VGAM HOST TARGET GENE, in fact represents a plurality of VGAM840 host target genes. The mRNA of each one of this plurality of VGAM840 host target genes comprises one or more host target binding sites, each having a nucleotide sequence which is at least partly complementary to VGAM840 RNA, herein designated VGAM RNA, and which when bound by VGAM840 RNA causes inhibition of translation of respective one or more VGAM840 host target proteins.

It is further appreciated by one skilled in the art that the mode of translational inhibition illustrated by FIG. 1 with specific reference to translational inhibition exerted by VGAM840 gene, herein designated VGAM GENE, on one or more VGAM840 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM840 is inhibition of expression of host target genes, as part of a novel viral mechanism of attacking a host. Accordingly, utilities of VGAM840 include diagnosis, prevention and treatment of viral infection by Ictalurid Herpesvirus 1. Specific functions, and accordingly utilities, of VGAM840 correlate with, and may be deduced from, the identity of the host target genes which VGAM840 binds and inhibits, and the function of these host target genes, as elaborated hereinbelow.

Nucleotide sequences of the VGAM840 precursor RNA, herein designated VGAM PRECURSOR RNA, and of the 'diced' VGAM840 RNA, herein designated VGAM RNA, and a schematic representation of the secondary folding of VGAM840 folded precursor RNA, herein designated VGAM FOLDED PRECURSOR RNA, of VGAM840 are further described hereinbelow with reference to Table 1.

Nucleotide sequences of host target binding sites, such as BINDING SITE-I, BINDING SITE-II and BINDING SITE-III of FIG. 1, found on VGAM840 host target RNA, and schematic representation of the complementarity of each of these host target binding sites to VGAM840 RNA, herein designated VGAM RNA, are described hereinbelow with reference to Table 2.

As mentioned hereinabove with reference to FIG. 1, a function of VGAM840 gene, herein designated VGAM is inhibition of expression of VGAM840 target genes. It is appreciated that specific functions, and accordingly utilities, of VGAM840 correlate with, and may be deduced from, the identity of the target genes which VGAM840 binds and inhibits, and the function of these target genes, as elaborated hereinbelow.

Recombination Activating Gene 1 (RAG1, Accession NM_000448) is a VGAM840 host target gene. RAG1 BINDING SITE is HOST TARGET binding site found in the 3' untranslated region of mRNA encoded by RAG1, corresponding to a HOST TARGET binding site such as BINDING SITE I, BINDING SITE II or BINDING SITE III. Table 2 illustrates the complementarity of the nucleotide sequences of RAG1 BINDING SITE, designated SEQ ID:6039, to the nucleotide sequence of VGAM840 RNA, herein designated VGAM RNA, also designated SEQ ID:3551.

A function of VGAM840 is therefore inhibition of Recombination Activating Gene 1 (RAG1, Accession NM_000448). Accordingly, utilities of VGAM840 include diagnosis, prevention and treatment of diseases and clinical conditions associated with RAG1. Transmembrane Protein 1 (TMEM1, Accession NM_003274) is another VGAM840 host target gene. TMEM1 BINDING SITE is HOST TARGET binding site found in the 3' untranslated region of mRNA encoded by TMEM1, corresponding to a HOST TARGET binding site such as BINDING SITE I, BINDING SITE II or BINDING SITE III. Table 2 illustrates the complementarity of the nucleotide sequences of TMEM1 BINDING SITE, designated SEQ ID:9289, to the nucleotide sequence of VGAM840 RNA, herein designated VGAM RNA, also designated SEQ ID:3551.

Another function of VGAM840 is therefore inhibition of Transmembrane Protein 1 (TMEM1, Accession NM_003274). Accordingly, utilities of VGAM840 include diagnosis, prevention and treatment of diseases and clinical conditions associated with TMEM1. Tripartite Motif-containing 8 (TRIM8, Accession NM_030912) is another VGAM840 host target gene. TRIM8 BINDING SITE is HOST TARGET binding site found in the 3' untranslated region of mRNA encoded by TRIM8, corresponding to a HOST TARGET binding site such as BINDING SITE I, BINDING SITE II or BINDING SITE III. Table 2 illustrates the complementarity of the nucleotide sequences of TRIM8 BINDING SITE, designated SEQ ID:25180, to the nucleotide sequence of VGAM840 RNA, herein designated VGAM RNA, also designated SEQ ID:3551.

Another function of VGAM840 is therefore inhibition of Tripartite Motif-containing 8 (TRIM8, Accession NM_030912). Accordingly, utilities of VGAM840 include diagnosis, prevention and treatment of diseases and clinical conditions associated with TRIM8. DEAD/H (Asp-Glu-Ala-Asp/His) Box Polypeptide 33 (DDX33, Accession NM_020162) is another VGAM840 host target gene. DDX33 BINDING SITE is HOST TARGET binding site found in the 3' untranslated region of mRNA encoded by DDX33, corresponding to a HOST TARGET binding site such as BINDING SITE I, BINDING SITE II or BINDING SITE III. Table 2 illustrates the complementarity of the nucleotide sequences of DDX33 BINDING SITE, designated SEQ ID:21378, to the nucleotide sequence of VGAM840 RNA, herein designated VGAM RNA, also designated SEQ ID:3551.

Another function of VGAM840 is therefore inhibition of DEAD/H (Asp-Glu-Ala-Asp/His) Box Polypeptide 33 (DDX33, Accession NM_020162). Accordingly, utilities of VGAM840 include diagnosis, prevention and treatment of diseases and clinical conditions associated with DDX33. DKFZP586M1120 (Accession NM_031294) is another VGAM840 host target gene. DKFZP586M1120 BINDING SITE is HOST TARGET binding site found in the 5' untranslated region of mRNA encoded by DKFZP586M1120, corresponding to a HOST TARGET binding site such as BINDING SITE I, BINDING SITE II or BINDING SITE III. Table 2 illustrates the complementarity of the nucleotide sequences of DKFZP586M1120 BINDING SITE, designated SEQ ID:25324, to the nucleotide sequence of VGAM840 RNA, herein designated VGAM RNA, also designated SEQ ID:3551.

Another function of VGAM840 is therefore inhibition of DKFZP586M1120 (Accession NM_031294). Accordingly, utilities of VGAM840 include diagnosis, prevention and treatment of diseases and clinical conditions associated with DKFZP586M1120. KIAA0237 (Accession NM_014747) is another VGAM840 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16442, to the nucleotide sequence of VGAM840 RNA, herein designated VGAM RNA, also designated SEQ ID:3551.

Another function of VGAM840 is therefore inhibition of KIAA0237 (Accession NM_014747). Accordingly, utilities of VGAM840 include diagnosis, prevention and treatment of diseases and clinical conditions associated with KIAA0237. KIAA0711 (Accession NM_014867) is another VGAM840 host target gene. KIAA0711 BINDING SITE is HOST TARGET binding site found in the 5' untranslated region of mRNA encoded by KIAA0711, corresponding to a HOST TARGET binding site such as BINDING SITE I, BINDING SITE II or BINDING SITE III. Table 2 illustrates the complementarity of the nucleotide sequences of KIAA0711 BINDING SITE, designated SEQ ID:16956, to the nucleotide sequence of VGAM840 RNA, herein designated VGAM RNA, also designated SEQ ID:3551.

Another function of VGAM840 is therefore inhibition of KIAA0711 (Accession NM_014867). Accordingly, utilities of VGAM840 include diagnosis, prevention and treatment of diseases and clinical conditions associated with KIAA0711. VLCS-H1 (Accession NM_014031) is another VGAM840 host target gene. VLCS-H1 BINDING SITE is HOST TARGET binding site found in the 5' untranslated region of mRNA encoded by VLCS-H1, corresponding to a HOST TARGET binding site such as BINDING SITE I, BINDING SITE II or BINDING SITE III. Table 2 illustrates the complementarity of the nucleotide sequences of VLCS-H1 BINDING SITE, designated SEQ ID:15261, to the nucleotide sequence of VGAM840 RNA, herein designated VGAM RNA, also designated SEQ ID:3551.

Another function of VGAM840 is therefore inhibition of VLCS-H1 (Accession NM_014031). Accordingly, utilities of VGAM840 include diagnosis, prevention and treatment of diseases and clinical conditions associated with VLCS-H1. LOC147138 (Accession XM_085717) is another VGAM840 host target gene. LOC147138 BINDING SITE is HOST TARGET binding site found in the 5' untranslated region of mRNA encoded by LOC147138, corresponding to a HOST TARGET binding site such as BINDING SITE I, BINDING SITE II or BINDING SITE III. Table 2 illustrates the complementarity of the nucleotide sequences of LOC147138 BINDING SITE, designated SEQ ID:38308, to the nucleotide sequence of VGAM840 RNA, herein designated VGAM RNA, also designated SEQ ID:3551.

Another function of VGAM840 is therefore inhibition of LOC147138 (Accession XM_085717). Accordingly, utilities of VGAM840 include diagnosis, prevention and treatment of diseases and clinical conditions associated with LOC147138.

FIG. 1 further provides a conceptual description of a novel bioinformatically detected viral gene of the present invention, referred to here as Viral Genomic Address Messenger 841 (VGAM841) viral gene, which modulates expression of respective host target genes thereof, the function and utility of which host target genes is known in the art.

VGAM841 is a novel bioinformatically detected regulatory, non protein coding, viral micro RNA (miRNA) gene. The method by which VGAM841 was detected is described hereinabove with reference to FIGS. 1-8.

VGAM841 gene, herein designated VGAM GENE, is a viral gene contained in the genome of Equine Herpesvirus 2. VGAM841 host target gene, herein designated VGAM HOST TARGET GENE, is a human gene contained in the human genome.

VGAM841 gene encodes a VGAM841 precursor RNA, herein designated VGAM PRECURSOR RNA. Similar to other miRNA genes, and unlike most ordinary genes, VGAM841 precursor RNA does not encode a protein. A nucleotide sequence identical or highly similar to the nucleotide sequence of VGAM841 precursor RNA is designated SEQ ID:827, and is provided hereinbelow with reference to the sequence listing part. Nucleotide sequence SEQ ID:827 is located at position 161925 relative to the genome of Equine Herpesvirus 2.

VGAM841 precursor RNA folds onto itself, forming VGAM841 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM841 folded precursor RNA into VGAM841 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM841 RNA is designated SEQ ID:3552, and is provided hereinbelow with reference to the sequence listing part.

VGAM841 host target gene, herein designated VGAM HOST TARGET GENE, encodes a corresponding messenger RNA, VGAM841 host target RNA, herein designated VGAM HOST TARGET RNA. VGAM841 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM841 RNA, herein designated VGAM RNA, binds complementarily to one or more host target binding sites located in untranslated regions of VGAM841 host target RNA, herein designated VGAM HOST TARGET RNA. This complementary binding is due to the fact that the nucleotide sequence of VGAM841 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM841 RNA, herein designated VGAM RNA, may have a different number of host target binding sites in untranslated regions of a VGAM841 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM841 RNA, herein designated VGAM RNA, to host target binding sites on VGAM841 host target RNA, herein designated VGAM HOST TARGET RNA, such as BINDING SITE I, BINDING SITE II and BINDING SITE III, inhibits translation of VGAM841 host target RNA into VGAM841 host target protein, herein designated VGAM HOST TARGET PROTEIN. VGAM host target protein is therefore outlined by a broken line.

It is appreciated that VGAM841 host target gene, herein designated VGAM HOST TARGET GENE, in fact represents a plurality of VGAM841 host target genes. The mRNA of each one of this plurality of VGAM841 host target genes comprises one or more host target binding sites, each having a nucleotide sequence which is at least partly complementary to VGAM841 RNA, herein designated VGAM RNA, and which when bound by VGAM841 RNA causes inhibition of translation of respective one or more VGAM841 host target proteins.

It is further appreciated by one skilled in the art that the mode of translational inhibition illustrated by FIG. 1 with specific reference to translational inhibition exerted by VGAM841 gene, herein designated VGAM GENE, on one or more VGAM841 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM841 is inhibition of expression of host target genes, as part of a novel viral mechanism of attacking a host. Accordingly, utilities of VGAM841 include diagnosis, prevention and treatment of viral infection by Equine Herpesvirus 2. Specific functions, and accordingly utilities, of VGAM841 correlate with, and may be deduced from, the identity of the host target genes which VGAM841 binds and inhibits, and the function of these host target genes, as elaborated hereinbelow.

Nucleotide sequences of the VGAM841 precursor RNA, herein designated VGAM PRECURSOR RNA, and of the 'diced' VGAM841 RNA, herein designated VGAM RNA, and a schematic representation of the secondary folding of VGAM841 folded precursor RNA, herein designated VGAM FOLDED PRECURSOR RNA, of VGAM841 are further described hereinbelow with reference to Table 1.

Nucleotide sequences of host target binding sites, such as BINDING SITE-I, BINDING SITE-II and BINDING SITE-III of FIG. 1, found on VGAM841 host target RNA, and schematic representation of the complementarity of each of these host target binding sites to VGAM841 RNA, herein designated VGAM RNA, are described hereinbelow with reference to Table 2.

As mentioned hereinabove with reference to FIG. 1, a function of VGAM841 gene, herein designated VGAM is inhibition of expression of VGAM841 target genes. It is appreciated that specific functions, and accordingly utilities, of VGAM841 correlate with, and may be deduced from, the identity of the target genes which VGAM841 binds and inhibits, and the function of these target genes, as elaborated hereinbelow.

Giant Axonal Neuropathy (gigaxonin) (GAN, Accession NM_022041) is a VGAM841 host target gene. GAN BINDING SITE is HOST TARGET binding site found in the 3' untranslated region of mRNA encoded by GAN, corresponding to a HOST TARGET binding site such as BINDING SITE I, BINDING SITE II or BINDING SITE III. Table 2 illustrates the complementarity of the nucleotide sequences of GAN BINDING SITE, designated SEQ ID:22562, to the nucleotide sequence of VGAM841 RNA, herein designated VGAM RNA, also designated SEQ ID:3552.

A function of VGAM841 is therefore inhibition of Giant Axonal Neuropathy (gigaxonin) (GAN, Accession NM_022041), a gene which plays an important role in neurofilament architecture. Accordingly, utilities of VGAM841 include diagnosis, prevention and treatment of diseases and clinical conditions associated with GAN. The function of GAN and its association with various diseases and clinical conditions, has been established by previous studies, as described hereinabove with reference to VGAM606. Golgi Autoantigen, Golgin Subfamily A, 4 (GOLGA4, Accession XM_011069) is another VGAM841 host target gene. GOLGA4 BINDING SITE is HOST TARGET binding site found in the 5' untranslated region of mRNA encoded by GOLGA4, corresponding to a HOST TARGET binding site such as BINDING SITE I, BINDING SITE II or BINDING SITE III. Table 2 illustrates the complementarity of the nucleotide sequences of GOLGA4 BINDING SITE, designated SEQ ID:30164, to the nucleotide sequence of VGAM841 RNA, herein designated VGAM RNA, also designated SEQ ID:3552.

Another function of VGAM841 is therefore inhibition of Golgi Autoantigen, Golgin Subfamily A, 4 (GOLGA4, Accession XM_011069), a gene which may play a role in vesicular transport from the trans-golgi. Accordingly, utilities of VGAM841 include diagnosis, prevention and treatment of diseases and clinical conditions associated with GOLGA4. The function of GOLGA4 has been established by previous studies. To characterize the Golgi complex, Kooy et al. (1992) used serum from a Sjogren syndrome (OMIM Ref. No. 270150) patient with a high titer of anti-Golgi autoantibodies. The serum immunoprecipitated a 230-kD protein that was specifically localized to the cytosolic surface of what is probably the trans-face of the Golgi stack. The 230-kD Golgi protein appears to be a peripheral membrane component. The authors detected the 230-kD antigen in several cell types and species. By screening a HeLa cell cDNA expression library with the anti-Golgi autoantibodies, Erlich et al. (1996) identified a p230 cDNA. The 7.7-kb p230 mRNA encodes a 2,230-amino acid protein with a predicted coiled-coil structure, stabilized by heptad repeats. The p230 protein also contains a granin motif (see OMIM Ref. No. 113705). By SDS-PAGE, p230 from HeLa cells migrates as a 230-kD protein. Daigo et al. (1999) found that the trans-Golgi gene contains at least 11 exons. Independently, Fritzler et al. (1995) cloned a partial GOLGA4 cDNA using serum from a Sjogren syndrome patient. Based on its predicted molecular mass, they designated the GOLGA4 protein 'golgin-245.'

Full details of the abovementioned studies are described in the following publications, the disclosure of which are hereby incorporated by reference:

Daigo, Y.; Isomura, M.; Nishiwaki, T.; Tamari, M.; Ishikawa, S.; Kai, M.; Murata, Y.; Takeuchi, K.; Yamane, Y.; Hayashi, R.; Minami, M.; Fujino, M. A.; Hojo, Y.; Uchiyama, I.; Takagi, T.; Nakamura, Y.: Characterization of a 1200-kb genomic segment of chromosome 3p22-p21.3. DNA Res. 6:37-44, 1999; and Fritzler, M. J.; Lung, C.-C.; Hamel, J. C.; Griffith, K. J.; Chan, E. K. L.: Molecular characterization of golgin-245, a novel Golgi complex protein containing a granin signature. J. B.

Further studies establishing the function and utilities of GOLGA4 are found in John Hopkins OMIM database record ID 602509, and in sited publications numbered 9037-9038, 853 and 8544 listed in the bibliography section hereinbelow, which are also hereby incorporated by reference. Coenzyme Q7 Homolog, Ubiquinone (yeast) (COQ7, Accession NM_016138) is another VGAM841 host target gene. COQ7 BINDING SITE is HOST TARGET binding site found in the 3' untranslated region of mRNA encoded by COQ7, corresponding to a HOST TARGET binding site such as BINDING SITE I, BINDING SITE II or BINDING SITE III. Table 2 illustrates the complementarity of the nucleotide sequences of COQ7 BINDING SITE, designated SEQ ID:18223, to the nucleotide sequence of VGAM841 RNA, herein designated VGAM RNA, also designated SEQ ID:3552.

Another function of VGAM841 is therefore inhibition of Coenzyme Q7 Homolog, Ubiquinone (yeast) (COQ7, Accession NM_016138). Accordingly, utilities of VGAM841 include diagnosis, prevention and treatment of diseases and clinical conditions associated with COQ7. FLJ20136 (Accession NM_017684) is another VGAM841 host target gene. FLJ20136 BINDING SITE is HOST TARGET binding site found in the 3' untranslated region of mRNA encoded by FLJ20136, corresponding to a HOST TARGET binding site such as BINDING SITE I, BINDING SITE II or BINDING SITE III. Table 2 illustrates the complementarity of the nucleotide sequences of FLJ20136 BINDING SITE, designated SEQ ID:19229, to the nucleotide sequence of VGAM841 RNA, herein designated VGAM RNA, also designated SEQ ID:3552.

Another function of VGAM841 is therefore inhibition of FLJ20136 (Accession NM_017684). Accordingly, utilities of VGAM841 include diagnosis, prevention and treatment of diseases and clinical conditions associated with FLJ20136. G Protein-coupled Receptor 64 (GPR64, Accession NM_005756) is another VGAM841 host target gene. GPR64 BINDING SITE is HOST TARGET binding site found in the 3' untranslated region of mRNA encoded by GPR64, corresponding to a HOST TARGET binding site such as BINDING SITE I, BINDING SITE II or BINDING SITE III. Table 2 illustrates the complementarity of the nucleotide sequences of GPR64 BINDING SITE, designated SEQ ID:12315, to the nucleotide sequence of VGAM841 RNA, herein designated VGAM RNA, also designated SEQ ID:3552.

Another function of VGAM841 is therefore inhibition of G Protein-coupled Receptor 64 (GPR64, Accession NM_005756). Accordingly, utilities of VGAM841 include diagnosis, prevention and treatment of diseases and clinical conditions associated with GPR64. FIG. 1 further provides a conceptual description of a novel bioinformatically detected viral gene of the present invention, referred to here as Viral Genomic Address Messenger 842 (VGAM842) viral gene, which modulates expression of respective host target genes thereof, the function and utility of which host target genes is known in the art.

VGAM842 is a novel bioinformatically detected regulatory, non protein coding, viral micro RNA (miRNA) gene. The method by which VGAM842 was detected is described hereinabove with reference to FIGS. 1-8.

VGAM842 gene, herein designated VGAM GENE, is a viral gene contained in the genome of Equine Herpesvirus 2.

VGAM842 host target gene, herein designated VGAM HOST TARGET GENE, is a human gene contained in the human genome.

VGAM842 gene encodes a VGAM842 precursor RNA, herein designated VGAM PRECURSOR RNA. Similar to other miRNA genes, and unlike most ordinary genes, VGAM842 precursor RNA does not encode a protein. A nucleotide sequence identical or highly similar to the nucleotide sequence of VGAM842 precursor RNA is designated SEQ ID:828, and is provided hereinbelow with reference to the sequence listing part. Nucleotide sequence SEQ ID:828 is located at position 161225 relative to the genome of Equine Herpesvirus 2.

VGAM842 precursor RNA folds onto itself, forming VGAM842 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM842 folded precursor RNA into VGAM842 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM842 RNA is designated SEQ ID:3553, and is provided hereinbelow with reference to the sequence listing part.

VGAM842 host target gene, herein designated VGAM HOST TARGET GENE, encodes a corresponding messenger RNA, VGAM842 host target RNA, herein designated VGAM HOST TARGET RNA. VGAM842 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM842 RNA, herein designated VGAM RNA, binds complementarily to one or more host target binding sites located in untranslated regions of VGAM842 host target RNA, herein designated VGAM HOST TARGET RNA. This complementary binding is due to the fact that the nucleotide sequence of VGAM842 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM842 RNA, herein designated VGAM RNA, may have a different number of host target binding sites in untranslated regions of a VGAM842 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM842 RNA, herein designated VGAM RNA, to host target binding sites on VGAM842 host target RNA, herein designated VGAM HOST TARGET RNA, such as BINDING SITE I, BINDING SITE II and BINDING SITE III, inhibits translation of VGAM842 host target RNA into VGAM842 host target protein, herein designated VGAM HOST TARGET PROTEIN. VGAM host target protein is therefore outlined by a broken line.

It is appreciated that VGAM842 host target gene, herein designated VGAM HOST TARGET GENE, in fact represents a plurality of VGAM842 host target genes. The mRNA of each one of this plurality of VGAM842 host target genes comprises one or more host target binding sites, each having a nucleotide sequence which is at least partly complementary to VGAM842 RNA, herein designated VGAM RNA, and which when bound by VGAM842 RNA causes inhibition of translation of respective one or more VGAM842 host target proteins.

It is further appreciated by one skilled in the art that the mode of translational inhibition illustrated by FIG. 1 with specific reference to translational inhibition exerted by VGAM842 gene, herein designated VGAM GENE, on one or more VGAM842 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM842 is inhibition of expression of host target genes, as part of a novel viral mechanism of attacking a host. Accordingly, utilities of VGAM842 include diagnosis, prevention and treatment of viral infection by Equine Herpesvirus 2. Specific functions, and accordingly utilities, of VGAM842 correlate with, and may be deduced from, the identity of the host target genes which VGAM842 binds and inhibits, and the function of these host target genes, as elaborated hereinbelow.

Nucleotide sequences of the VGAM842 precursor RNA, herein designated VGAM PRECURSOR RNA, and of the 'diced' VGAM842 RNA, herein designated VGAM RNA, and a schematic representation of the secondary folding of VGAM842 folded precursor RNA, herein designated VGAM FOLDED PRECURSOR RNA, of VGAM842 are further described hereinbelow with reference to Table 1.

Nucleotide sequences of host target binding sites, such as BINDING SITE-I, BINDING SITE-II and BINDING SITE-III of FIG. 1, found on VGAM842 host target RNA, and schematic representation of the complementarity of each of these host target binding sites to VGAM842 RNA, herein designated VGAM RNA, are described hereinbelow with reference to Table 2.

As mentioned hereinabove with reference to FIG. 1, a function of VGAM842 gene, herein designated VGAM is inhibition of expression of VGAM842 target genes. It is appreciated that specific functions, and accordingly utilities, of VGAM842 correlate with, and may be deduced from, the identity of the target genes which VGAM842 binds and inhibits, and the function of these target genes, as elaborated hereinbelow.

Adrenomedullin (ADM, Accession NM_001124) is a VGAM842 host target gene. ADM BINDING SITE is HOST TARGET binding site found in the 3' untranslated region of mRNA encoded by ADM, corresponding to a HOST TARGET binding site such as BINDING SITE I, BINDING SITE II or BINDING SITE III. Table 2 illustrates the complementarity of the nucleotide sequences of ADM BINDING SITE, designated SEQ ID:6795, to the nucleotide sequence of VGAM842 RNA, herein designated VGAM RNA, also designated SEQ ID:3553.

A function of VGAM842 is therefore inhibition of Adrenomedullin (ADM, Accession NM_001124), a gene which regulates blood pressure and heart rate. Accordingly, utilities of VGAM842 include diagnosis, prevention and treatment of diseases and clinical conditions associated with ADM. The function of ADM has been established by previous studies. Adrenomedullin, a hypotensive peptide found in human pheochromocytoma, consists of 52 amino acids, has 1 intramolecular disulfide bond, and shows slight homology with the calcitonin gene-related peptide (CGRP; 114130). It may function as a hormone in circulation control because it is found in blood in a considerable concentration. Kitamura et al. (1993) constructed a cDNA library of pheochromocytoma and isolated therefrom a cDNA clone encoding an adrenomedullin precursor. The precursor, called preproadrenomedullin, is 185 amino acids long. By RNA-blot analysis, human adrenomedullin mRNA was found to be highly expressed in several tissues, including adrenal medulla, cardiac ventricle, lung, and kidney, as well as pheochromocytoma. By Southern blot analyses of human/hamster somatic hybrid cell lines, Ishimitsu et al. (1994) demonstrated that the ADM gene is represented by a single locus on chromosome 11. Okazaki et al. (1996) mapped the Adm gene to the distal region of mouse chromosome 7, a region that shows syntenic homology to human 11p15-q13; the human ADM gene is probably located at 11p15.4 (van Heyningen and Jones, 1993). Animal model experiments lend further support to the function of ADM. To elucidate the functions of adrenomedullin, Caron and Smithies (2001) replaced the coding region of the Adm gene in mice with a sequence encoding enhanced green fluorescent protein while leaving the Adm promoter intact.

It is appreciated that the abovementioned animal model for ADM is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kitamura, K.; Sakata, J.; Kangawa, K.; Kojima, M.; Matsuo, H.; Eto, T.: Cloning and characterization of cDNA encoding a precursor for human adrenomedullin. Biochem. Biophys. Res. Commun. 194:720-725, 1993; and Caron, K. M.; Smithies, O.: Extreme hydrops fetalis and cardiovascular abnormalities in mice lacking a functional adrenomedullin gene. Proc. Nat. Acad. Sci. 98: 615-619, 2001.

Further studies establishing the function and utilities of ADM are found in John Hopkins OMIM database record ID 103275, and in sited publications numbered 4298-4306 listed in the bibliography section hereinbelow, which are also hereby incorporated by reference. Cadherin 12, Type 2 (N-cadherin 2) (CDH12, Accession NM_004061) is another VGAM842 host target gene. CDH12 BINDING SITE is HOST TARGET binding site found in the 5' untranslated region of mRNA encoded by CDH12, corresponding to a HOST TARGET binding site such as BINDING SITE I, BINDING SITE II or BINDING SITE III. Table 2 illustrates the complementarity of the nucleotide sequences of CDH12 BINDING SITE, designated SEQ ID:10267, to the nucleotide sequence of VGAM842 RNA, herein designated VGAM RNA, also designated SEQ ID:3553.

Another function of VGAM842 is therefore inhibition of Cadherin 12, Type 2 (N-cadherin 2) (CDH12, Accession NM_004061). Accordingly, utilities of VGAM842 include diagnosis, prevention and treatment of diseases and clinical conditions associated with CDH12. Ceroid-lipofuscinosis, Neuronal 5 (CLN5, Accession NM_006493) is another VGAM842 host target gene. CLN5 BINDING SITE is HOST TARGET binding site found in the 3' untranslated region of mRNA encoded by CLN5, corresponding to a HOST TARGET binding site such as BINDING SITE I, BINDING SITE II or BINDING SITE III. Table 2 illustrates the complementarity of the nucleotide sequences of CLN5 BINDING SITE, designated SEQ ID:13229, to the nucleotide sequence of VGAM842 RNA, herein designated VGAM RNA, also designated SEQ ID:3553.

Another function of VGAM842 is therefore inhibition of Ceroid-lipofuscinosis, Neuronal 5 (CLN5, Accession NM_006493). Accordingly, utilities of VGAM842 include diagnosis, prevention and treatment of diseases and clinical conditions associated with CLN5. Chemokine (C-X3-C motif) Receptor 1 (CX3CR1, Accession XM_047502) is another VGAM842 host target gene. CX3CR1 BINDING SITE is HOST TARGET binding site found in the 3' untranslated region of mRNA encoded by CX3CR1, corresponding to a HOST TARGET binding site such as BINDING SITE I, BINDING SITE II or BINDING SITE III. Table 2 illustrates the complementarity of the nucleotide sequences of CX3CR1 BINDING SITE, designated SEQ ID:34978, to the nucleotide sequence of VGAM842 RNA, herein designated VGAM RNA, also designated SEQ ID:3553.

Another function of VGAM842 is therefore inhibition of Chemokine (C-X3-C motif) Receptor 1 (CX3CR1, Accession XM_047502), a gene which mediates both the adhesive and migratory functions of fractalkine. Accordingly, utilities of VGAM842 include diagnosis, prevention and treatment of diseases and clinical conditions associated with CX3CR1. The function of CX3CR1 and its association with various diseases and clinical conditions, has been established by previous studies, as described hereinabove with reference to VGAM25. Mannosidase, Alpha, Class 1A, Member 1 (MAN1A1, Accession XM_166312) is another VGAM842 host target gene. MAN1A1 BINDING SITE is HOST TARGET binding site found in the 3' untranslated region of mRNA encoded by MAN1A1, corresponding to a HOST TARGET binding site such as BINDING SITE I, BINDING SITE II or BINDING SITE III. Table 2 illustrates the complementarity of the nucleotide sequences of MAN1A1 BINDING SITE, designated SEQ ID:44134, to the nucleotide sequence of VGAM842 RNA, herein designated VGAM RNA, also designated SEQ ID:3553.

Another function of VGAM842 is therefore inhibition of Mannosidase, Alpha, Class 1A, Member 1 (MAN1A1, Accession XM_166312), a gene which removes 3 distinct mannose residues from peptide-bound Man (9)-GlcNAc (2) oligosaccharides. Accordingly, utilities of VGAM842 include diagnosis, prevention and treatment of diseases and clinical conditions associated with MAN1A1. The function of MAN1A1 and its association with various diseases and clinical conditions, has been established by previous studies, as described hereinabove with reference to VGAM172. Protein Tyrosine Phosphatase, Receptor Type, N (PTPRN, Accession NM_002846) is another VGAM842 host target gene. PTPRN BINDING SITE is HOST TARGET binding site found in the 3' untranslated region of mRNA encoded by PTPRN, corresponding to a HOST TARGET binding site such as BINDING SITE I, BINDING SITE II or BINDING SITE III. Table 2 illustrates the complementarity of the nucleotide sequences of PTPRN BINDING SITE, designated SEQ ID:8735, to the nucleotide sequence of VGAM842 RNA, herein designated VGAM RNA, also designated SEQ ID:3553.

Another function of VGAM842 is therefore inhibition of Protein Tyrosine Phosphatase, Receptor Type, N (PTPRN, Accession NM_002846). Accordingly, utilities of VGAM842 include diagnosis, prevention and treatment of diseases and clinical conditions associated with PTPRN. Secretogranin III (SCG3, Accession NM_013243) is another VGAM842 host target gene. SCG3 BINDING SITE is HOST TARGET binding site found in the 3' untranslated region of mRNA encoded by SCG3, corresponding to a HOST TARGET binding site such as BINDING SITE I, BINDING SITE II or BINDING SITE III. Table 2 illustrates the complementarity of the nucleotide sequences of SCG3 BINDING SITE, designated SEQ ID:14900, to the nucleotide sequence of VGAM842 RNA, herein designated VGAM RNA, also designated SEQ ID:3553.

Another function of VGAM842 is therefore inhibition of Secretogranin III (SCG3, Accession NM_013243). Accordingly, utilities of VGAM842 include diagnosis, prevention and treatment of diseases and clinical conditions associated with SCG3. Suppressor of Cytokine Signaling 5 (SOCS5, Accession NM_014011) is another VGAM842 host target gene. SOCS5 BINDING SITE is HOST TARGET binding site found in the 3' untranslated region of mRNA encoded by SOCS5, corresponding to a HOST TARGET binding site such as BINDING SITE I, BINDING SITE II or BINDING SITE III. Table 2 illustrates the complementarity of the nucleotide sequences of SOCS5 BINDING SITE, designated SEQ ID:15227, to the nucleotide sequence of VGAM842 RNA, herein designated VGAM RNA, also designated SEQ ID:3553.

Another function of VGAM842 is therefore inhibition of Suppressor of Cytokine Signaling 5 (SOCS5, Accession NM_014011). Accordingly, utilities of VGAM842 include diagnosis, prevention and treatment of diseases and clinical conditions associated with SOCS5. ABLIM (Accession NM_002313) is another VGAM842 host target gene. ABLIM BINDING SITE1 and ABLIM BINDING SITE2 are HOST TARGET binding sites found in untranslated regions of mRNA encoded by ABLIM, corresponding to HOST TARGET binding sites such as BINDING SITE I, BINDING SITE II or BINDING SITE III. Table 2 illustrates the complementarity of the nucleotide sequences of ABLIM BINDING SITE1 and ABLIM BINDING SITE2, designated SEQ ID:8118 and SEQ ID:13551 respectively, to the nucleotide sequence of VGAM842 RNA, herein designated VGAM RNA, also designated SEQ ID:3553.

Another function of VGAM842 is therefore inhibition of ABLIM (Accession NM_002313). Accordingly, utilities of VGAM842 include diagnosis, prevention and treatment of diseases and clinical conditions associated with ABLIM. DKFZp434O0320 (Accession XM_097012) is another VGAM842 host target gene. DKFZp434O0320 BINDING SITE is HOST TARGET binding site found in the 3' untranslated region of mRNA encoded by DKFZp434O0320, corresponding to a HOST TARGET binding site such as BINDING SITE I, BINDING SITE II or BINDING SITE III. Table 2 illustrates the complementarity of the nucleotide sequences of DKFZp434O0320 BINDING SITE, designated SEQ ID:40705, to the nucleotide sequence of VGAM842 RNA, herein designated VGAM RNA, also designated SEQ ID:3553.

Another function of VGAM842 is therefore inhibition of DKFZp434O0320 (Accession XM_097012). Accordingly, utilities of VGAM842 include diagnosis, prevention and treatment of diseases and clinical conditions associated with DKFZp434O0320. FLJ11040 (Accession NM_018307) is another VGAM842 host target gene. FLJ11040 BINDING SITE is HOST TARGET binding site found in the 3' untranslated region of mRNA encoded by FLJ11040, corresponding to a HOST TARGET binding site such as BINDING SITE I, BINDING SITE II or BINDING SITE III. Table 2 illustrates the complementarity of the nucleotide sequences of FLJ11040 BINDING SITE, designated SEQ ID:20295, to the nucleotide sequence of VGAM842 RNA, herein designated VGAM RNA, also designated SEQ ID:3553.

Another function of VGAM842 is therefore inhibition of FLJ11040 (Accession NM_018307). Accordingly, utilities of VGAM842 include diagnosis, prevention and treatment of diseases and clinical conditions associated with FLJ11040. HYPH (Accession XM_170722) is another VGAM842 host target gene. HYPH BINDING SITE is HOST TARGET binding site found in the 3" untranslated region of mRNA encoded by HYPH, corresponding to a HOST TARGET binding site such as BINDING SITE I, BINDING SITE II or BINDING SITE III. Table 2 illustrates the complementarity of the nucleotide sequences of HYPH BINDING SITE, designated SEQ ID:45482, to the nucleotide sequence of VGAM842 RNA, herein designated VGAM RNA, also designated SEQ ID:3553.

Another function of VGAM842 is therefore inhibition of HYPH (Accession XM_170722). Accordingly, utilities of VGAM842 include diagnosis, prevention and treatment of diseases and clinical conditions associated with HYPH. KIAA0261 (Accession XM_042946) is another VGAM842 host target gene. KIAA0261 BINDING SITE is HOST TARGET binding site found in the 3" untranslated region of mRNA encoded by KIAA0261, corresponding to a HOST TARGET binding site such as BINDING SITE I, BINDING SITE II or BINDING SITE III. Table 2 illustrates the complementarity of the nucleotide sequences of KIAA0261 BINDING SITE, designated SEQ ID:33832, to the nucleotide sequence of VGAM842 RNA, herein designated VGAM RNA, also designated SEQ ID:3553.

Another function of VGAM842 is therefore inhibition of KIAA0261 (Accession XM_042946). Accordingly, utilities of VGAM842 include diagnosis, prevention and treatment of diseases and clinical conditions associated with KIAA0261. KIAA0937 (Accession XM_166213) is another VGAM842 host target gene. KIAA0937 BINDING SITE is HOST TARGET binding site found in the 3' untranslated region of mRNA encoded by KIAA0937, corresponding to a HOST TARGET binding site such as BINDING SITE I, BINDING SITE II or BINDING SITE III. Table 2 illustrates the complementarity of the nucleotide sequences of KIAA0937 BINDING SITE, designated SEQ ID:44016, to the nucleotide sequence of VGAM842 RNA, herein designated VGAM RNA, also designated SEQ ID:3553.

Another function of VGAM842 is therefore inhibition of KIAA0937 (Accession XM_166213). Accordingly, utilities of VGAM842 include diagnosis, prevention and treatment of diseases and clinical conditions associated with KIAA0937. KIAA1091 (Accession XM_045750) is another VGAM842 host target gene. KIAA1091 BINDING SITE is HOST TARGET binding site found in the 3' untranslated region of mRNA encoded by KIAA1091, corresponding to a HOST TARGET binding site such as BINDING SITE I, BINDING SITE II or BINDING SITE III. Table 2 illustrates the complementarity of the nucleotide sequences of KIAA1091 BINDING SITE, designated SEQ ID:34541, to the nucleotide sequence of VGAM842 RNA, herein designated VGAM RNA, also designated SEQ ID:3553.

Another function of VGAM842 is therefore inhibition of KIAA1091 (Accession XM_045750). Accordingly, utilities of VGAM842 include diagnosis, prevention and treatment of diseases and clinical conditions associated with KIAA1091. KIAA1576 (Accession XM_038186) is another VGAM842 host target gene. KIAA1576 BINDING SITE is HOST TARGET binding site found in the 3' untranslated region of mRNA encoded by KIAA1576, corresponding to a HOST TARGET binding site such as BINDING SITE I, BINDING SITE II or BINDING SITE III. Table 2 illustrates the complementarity of the nucleotide sequences of KIAA1576 BINDING SITE, designated SEQ ID:32773, to the nucleotide sequence of VGAM842 RNA, herein designated VGAM RNA, also designated SEQ ID:3553.

Another function of VGAM842 is therefore inhibition of KIAA1576 (Accession XM_038186). Accordingly, utilities of VGAM842 include diagnosis, prevention and treatment of diseases and clinical conditions associated with KIAA1576. Meningioma Expressed Antigen 6 (coiled-coil proline-rich) (MGEA6, Accession NM_005930) is another VGAM842 host target gene. MGEA6 BINDING SITE is HOST TARGET binding site found in the 3' untranslated region of mRNA encoded by MGEA6, corresponding to a HOST TARGET binding site such as BINDING SITE I, BINDING SITE II or BINDING SITE III. Table 2 illustrates the complementarity of the nucleotide sequences of MGEA6 BINDING SITE, designated SEQ ID:12561, to the nucleotide sequence of VGAM842 RNA, herein designated VGAM RNA, also designated SEQ ID:3553.

Another function of VGAM842 is therefore inhibition of Meningioma Expressed Antigen 6 (coiled-coil proline-rich) (MGEA6, Accession NM_005930). Accordingly, utilities of VGAM842 include diagnosis, prevention and treatment of diseases and clinical conditions associated with MGEA6. NYD-SP20 (Accession NM_032598) is another VGAM842 host target gene. NYD-SP20 BINDING SITE is HOST TARGET binding site found in the 5" untranslated region of mRNA encoded by NYD-SP20, corresponding to a HOST TARGET binding site such as BINDING SITE I, BINDING SITE II or BINDING SITE III. Table 2 illustrates the complementarity of the nucleotide sequences of NYD-SP20 BINDING SITE, designated SEQ ID:26329, to the nucleotide sequence of VGAM842 RNA, herein designated VGAM RNA, also designated SEQ ID:3553.

Another function of VGAM842 is therefore inhibition of NYD-SP20 (Accession NM_032598). Accordingly, utilities of VGAM842 include diagnosis, prevention and treatment of diseases and clinical conditions associated with NYD-SP20. Sema Domain, Seven Thrombospondin Repeats (type 1 and type 1-like), Transmembrane Domain (TM) and Short Cytoplasmic Domain, (semaphorin) 5A (SEMA5A, Accession NM_003966) is another VGAM842 host target gene. SEMA5A BINDING SITE is HOST TARGET binding site found in the 3" untranslated region of mRNA encoded by SEMA5A, corresponding to a HOST TARGET binding site such as BINDING SITE I, BINDING SITE II or BINDING SITE III. Table 2 illustrates the complementarity of the nucleotide sequences of SEMA5A BINDING SITE, designated SEQ ID:10105, to the nucleotide sequence of VGAM842 RNA, herein designated VGAM RNA, also designated SEQ ID:3553.

Another function of VGAM842 is therefore inhibition of Sema Domain, Seven Thrombospondin Repeats (type 1 and type 1-like), Transmembrane Domain (TM) and Short Cytoplasmic Domain, (semaphorin) 5A (SEMA5A, Accession NM_003966). Accordingly, utilities of VGAM842 include diagnosis, prevention and treatment of diseases and clinical conditions associated with SEMA5A. LOC151473 (Accession XM_087215) is another VGAM842 host target gene. LOC151473 BINDING SITE is HOST TARGET binding site found in the 3' untranslated region of mRNA encoded by LOC151473, corresponding to a HOST TARGET binding site such as BINDING SITE I, BINDING SITE II or BINDING SITE III. Table 2 illustrates the complementarity of the nucleotide sequences of LOC151473 BINDING SITE, designated SEQ ID:39122, to the nucleotide sequence of VGAM842 RNA, herein designated VGAM RNA, also designated SEQ ID:3553.

Another function of VGAM842 is therefore inhibition of LOC151473 (Accession XM_087215). Accordingly, utilities of VGAM842 include diagnosis, prevention and treatment of diseases and clinical conditions associated with LOC151473. LOC219594 (Accession XM_165451) is another VGAM842 host target gene. LOC219594 BINDING SITE is HOST TARGET binding site found in the 3' untranslated region of mRNA encoded by LOC219594, corresponding to a HOST TARGET binding site such as BINDING SITE I, BINDING SITE II or BINDING SITE III. Table 2 illustrates the complementarity of the nucleotide sequences of LOC219594 BINDING SITE, designated SEQ ID:43640, to the nucleotide sequence of VGAM842 RNA, herein designated VGAM RNA, also designated SEQ ID:3553.

Another function of VGAM842 is therefore inhibition of LOC219594 (Accession XM_165451). Accordingly, utilities of VGAM842 include diagnosis, prevention and treatment of diseases and clinical conditions associated with LOC219594. LOC219673 (Accession XM_167567) is another VGAM842 host target gene. LOC219673 BINDING SITE is HOST TARGET binding site found in the 5' untranslated region of mRNA encoded by LOC219673, corresponding to a HOST TARGET binding site such as BINDING SITE I, BINDING SITE II or BINDING SITE III. Table 2 illustrates the complementarity of the nucleotide sequences of LOC219673 BINDING SITE, designated SEQ ID:44693, to the nucleotide sequence of VGAM842 RNA, herein designated VGAM RNA, also designated SEQ ID:3553.

Another function of VGAM842 is therefore inhibition of LOC219673 (Accession XM_167567). Accordingly, utilities of VGAM842 include diagnosis, prevention and treatment of diseases and clinical conditions associated with LOC219673. LOC221466 (Accession XM_168087) is another VGAM842 host target gene. LOC221466 BINDING SITE is HOST TARGET binding site found in the 5' untranslated region of mRNA encoded by LOC221466, corresponding to a HOST TARGET binding site such as BINDING SITE I, BINDING SITE II or BINDING SITE III. Table 2 illustrates the complementarity of the nucleotide sequences of LOC221466 BINDING SITE, designated SEQ ID:44993, to the nucleotide sequence of VGAM842 RNA, herein designated VGAM RNA, also designated SEQ ID:3553.

Another function of VGAM842 is therefore inhibition of LOC221466 (Accession XM_168087). Accordingly, utilities of VGAM842 include diagnosis, prevention and treatment of diseases and clinical conditions associated with LOC221466. LOC221477 (Accession XM_166397) is another VGAM842 host target gene. LOC221477 BINDING SITE is HOST TARGET binding site found in the 3' untranslated region of mRNA encoded by LOC221477, corresponding to a HOST TARGET binding site such as BINDING SITE I, BINDING SITE II or BINDING SITE III. Table 2 illustrates the complementarity of the nucleotide sequences of LOC221477 BINDING SITE, designated SEQ ID:44258, to the nucleotide sequence of VGAM842 RNA, herein designated VGAM RNA, also designated SEQ ID:3553.

Another function of VGAM842 is therefore inhibition of LOC221477 (Accession XM_166397). Accordingly, utilities of VGAM842 include diagnosis, prevention and treatment of diseases and clinical conditions associated with LOC221477.

LOC253820 (Accession XM_171040) is another VGAM842 host target gene. LOC253820 BINDING SITE is HOST TARGET binding site found in the 5' untranslated region of mRNA encoded by LOC253820, corresponding to a HOST TARGET binding site such as BINDING SITE I, BINDING SITE II or BINDING SITE III. Table 2 illustrates the complementarity of the nucleotide sequences of LOC253820 BINDING SITE, designated SEQ ID:45808, to the nucleotide sequence of VGAM842 RNA, herein designated VGAM RNA, also designated SEQ ID:3553.

Another function of VGAM842 is therefore inhibition of LOC253820 (Accession XM_171040). Accordingly, utilities of VGAM842 include diagnosis, prevention and treatment of diseases and clinical conditions associated with LOC253820.

LOC257282 (Accession XM_172844) is another VGAM842 host target gene. LOC257282 BINDING SITE is HOST TARGET binding site found in the 5' untranslated region of mRNA encoded by LOC257282, corresponding to a HOST TARGET binding site such as BINDING SITE I, BINDING SITE II or BINDING SITE III. Table 2 illustrates the complementarity of the nucleotide sequences of LOC257282 BINDING SITE, designated SEQ ID:46121, to the nucleotide sequence of VGAM842 RNA, herein designated VGAM RNA, also designated SEQ ID:3553.

Another function of VGAM842 is therefore inhibition of LOC257282 (Accession XM_172844). Accordingly, utilities of VGAM842 include diagnosis, prevention and treatment of diseases and clinical conditions associated with LOC257282.

LOC90333 (Accession XM_030958) is another VGAM842 host target gene. LOC90333 BINDING SITE is HOST TARGET binding site found in the 3' untranslated region of mRNA encoded by LOC90333, corresponding to a HOST TARGET binding site such as BINDING SITE I, BINDING SITE II or BINDING SITE III. Table 2 illustrates the complementarity of the nucleotide sequences of LOC90333 BINDING SITE, designated SEQ ID:31225, to the nucleotide sequence of VGAM842 RNA, herein designated VGAM RNA, also designated SEQ ID:3553.

Another function of VGAM842 is therefore inhibition of LOC90333 (Accession XM_030958). Accordingly, utilities of VGAM842 include diagnosis, prevention and treatment of diseases and clinical conditions associated with LOC90333.

LOC91547 (Accession XM_039093) is another VGAM842 host target gene. LOC91547 BINDING SITE is HOST TARGET binding site found in the 3' untranslated region of mRNA encoded by LOC91547, corresponding to a HOST TARGET binding site such as BINDING SITE I, BINDING SITE II or BINDING SITE III. Table 2 illustrates the complementarity of the nucleotide sequences of LOC91547 BINDING SITE, designated SEQ ID:33003, to the nucleotide sequence of VGAM842 RNA, herein designated VGAM RNA, also designated SEQ ID:3553.

Another function of VGAM842 is therefore inhibition of LOC91547 (Accession XM_039093). Accordingly, utilities of VGAM842 include diagnosis, prevention and treatment of diseases and clinical conditions associated with LOC91547.

FIG. 1 further provides a conceptual description of a novel bioinformatically detected viral gene of the present invention, referred to here as Viral Genomic Address Messenger 843 (VGAM843) viral gene, which modulates expression of respective host target genes thereof, the function and utility of which host target genes is known in the art.

VGAM843 is a novel bioinformatically detected regulatory, non protein coding, viral micro RNA (miRNA) gene. The method by which VGAM843 was detected is described hereinabove with reference to FIGS. 1-8.

VGAM843 gene, herein designated VGAM GENE, is a viral gene contained in the genome of Monkeypox Virus. VGAM843 host target gene, herein designated VGAM HOST TARGET GENE, is a human gene contained in the human genome.

VGAM843 gene encodes a VGAM843 precursor RNA, herein designated VGAM PRECURSOR RNA. Similar to other miRNA genes, and unlike most ordinary genes, VGAM843 precursor RNA does not encode a protein. A nucleotide sequence identical or highly similar to the nucleotide sequence of VGAM843 precursor RNA is designated SEQ ID:829, and is provided hereinbelow with reference to the sequence listing part. Nucleotide sequence SEQ ID:829 is located at position 120975 relative to the genome of Monkeypox Virus.

VGAM843 precursor RNA folds onto itself, forming VGAM843 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM843 folded precursor RNA into VGAM843 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 78%) nucleotide sequence of VGAM843 RNA is designated SEQ ID:3554, and is provided hereinbelow with reference to the sequence listing part.

VGAM843 host target gene, herein designated VGAM HOST TARGET GENE, encodes a corresponding messenger RNA, VGAM843 host target RNA, herein designated VGAM HOST TARGET RNA. VGAM843 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM843 RNA, herein designated VGAM RNA, binds complementarily to one or more host target binding sites located in untranslated regions of VGAM843 host target RNA, herein designated VGAM HOST TARGET RNA. This complementary binding is due to the fact that the nucleotide sequence of VGAM843 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM843 RNA, herein designated VGAM RNA, may have a different number of host target binding sites in untranslated regions of a VGAM843 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM843 RNA, herein designated VGAM RNA, to host target binding sites on VGAM843 host target RNA, herein designated VGAM HOST TARGET RNA, such as BINDING SITE I, BINDING SITE II and BINDING SITE III, inhibits translation of VGAM843 host target RNA into VGAM843 host target protein, herein designated VGAM HOST TARGET PROTEIN. VGAM host target protein is therefore outlined by a broken line.

It is appreciated that VGAM843 host target gene, herein designated VGAM HOST TARGET GENE, in fact represents a plurality of VGAM843 host target genes. The mRNA of each one of this plurality of VGAM843 host target genes comprises one or more host target binding sites, each having a nucleotide sequence which is at least partly complementary to VGAM843 RNA, herein designated VGAM RNA, and which when bound by VGAM843 RNA causes inhibition of translation of respective one or more VGAM843 host target proteins.

It is further appreciated by one skilled in the art that the mode of translational inhibition illustrated by FIG. 1 with specific reference to translational inhibition exerted by VGAM843 gene, herein designated VGAM GENE, on one or more VGAM843 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM843 is inhibition of expression of host target genes, as part of a novel viral mechanism of attacking a host. Accordingly, utilities of VGAM843 include diagnosis, prevention and treatment of viral infection by Monkeypox Virus. Specific functions, and accordingly utilities, of VGAM843 correlate with, and may be deduced from, the identity of the host target genes which VGAM843 binds and inhibits, and the function of these host target genes, as elaborated hereinbelow.

Nucleotide sequences of the VGAM843 precursor RNA, herein designated VGAM PRECURSOR RNA, and of the 'diced' VGAM843 RNA, herein designated VGAM RNA, and a schematic representation of the secondary folding of VGAM843 folded precursor RNA, herein designated VGAM FOLDED PRECURSOR RNA, of VGAM843 are further described hereinbelow with reference to Table 1.

Nucleotide sequences of host target binding sites, such as BINDING SITE-I, BINDING SITE-II and BINDING SITE-III of FIG. 1, found on VGAM843 host target RNA, and schematic representation of the complementarity of each of these host target binding sites to VGAM843 RNA, herein designated VGAM RNA, are described hereinbelow with reference to Table 2.

As mentioned hereinabove with reference to FIG. 1, a function of VGAM843 gene, herein designated VGAM is inhibition of expression of VGAM843 target genes. It is appreciated that specific functions, and accordingly utilities, of VGAM843 correlate with, and may be deduced from, the identity of the target genes which VGAM843 binds and inhibits, and the function of these target genes, as elaborated hereinbelow.

Butyrylcholinesterase (BCHE, Accession NM_000055) is a VGAM843 host target gene. BCHE BINDING SITE is HOST TARGET binding site found in the 5' untranslated region of mRNA encoded by BCHE, corresponding to a HOST TARGET binding site such as BINDING SITE I, BINDING SITE II or BINDING SITE III. Table 2 illustrates the complementarity of the nucleotide sequences of BCHE BINDING SITE, designated SEQ ID:5512, to the nucleotide sequence of VGAM843 RNA, herein designated VGAM RNA, also designated SEQ ID:3554.

A function of VGAM843 is therefore inhibition of Butyrylcholinesterase (BCHE, Accession NM_000055). Accordingly, utilities of VGAM843 include diagnosis, prevention and treatment of diseases and clinical conditions associated with BCHE. Ankyrin Repeat Domain 6 (ANKRD6, Accession NM_014942) is another VGAM843 host target gene. ANKRD6 BINDING SITE is HOST TARGET binding site found in the 3' untranslated region of mRNA encoded by ANKRD6, corresponding to a HOST TARGET binding site such as BINDING SITE I, BINDING SITE II or BINDING SITE III. Table 2 illustrates the complementarity of the nucleotide sequences of ANKRD6 BINDING SITE, designated SEQ ID:17250, to the nucleotide sequence of VGAM843 RNA, herein designated VGAM RNA, also designated SEQ ID:3554.

Another function of VGAM843 is therefore inhibition of Ankyrin Repeat Domain 6 (ANKRD6, Accession NM_014942). Accordingly, utilities of VGAM843 include diagnosis, prevention and treatment of diseases and clinical conditions associated with ANKRD6. CSE-C (Accession XM_166163) is another VGAM843 host target gene. CSE-C BINDING SITE is HOST TARGET binding site found in the 3' untranslated region of mRNA encoded by CSE-C, corresponding to a HOST TARGET binding site such as BINDING SITE I, BINDING SITE II or BINDING SITE III. Table 2 illustrates the complementarity of the nucleotide sequences of CSE-C BINDING SITE, designated SEQ ID:43979, to the nucleotide sequence of VGAM843 RNA, herein designated VGAM RNA, also designated SEQ ID:3554.

Another function of VGAM843 is therefore inhibition of CSE-C (Accession XM_166163). Accordingly, utilities of VGAM843 include diagnosis, prevention and treatment of diseases and clinical conditions associated with CSE-C. LOC145009 (Accession XM_016472) is another VGAM843 host target gene. LOC145009 BINDING SITE is HOST TARGET binding site found in the 5' untranslated region of mRNA encoded by LOC145009, corresponding to a HOST TARGET binding site such as BINDING SITE I, BINDING SITE II or BINDING SITE III. Table 2 illustrates the complementarity of the nucleotide sequences of LOC145009 BINDING SITE, designated SEQ ID:30262, to the nucleotide sequence of VGAM843 RNA, herein designated VGAM RNA, also designated SEQ ID:3554.

Another function of VGAM843 is therefore inhibition of LOC145009 (Accession XM_016472). Accordingly, utilities of VGAM843 include diagnosis, prevention and treatment of diseases and clinical conditions associated with LOC145009. FIG. 1 further provides a conceptual description of a novel bioinformatically detected viral gene of the present invention, referred to here as Viral Genomic Address Messenger 844 (VGAM844) viral gene, which modulates expression of respective host target genes thereof, the function and utility of which host target genes is known in the art.

VGAM844 is a novel bioinformatically detected regulatory, non protein coding, viral micro RNA (miRNA) gene. The method by which VGAM844 was detected is described hereinabove with reference to FIGS. 1-8.

VGAM844 gene, herein designated VGAM GENE, is a viral gene contained in the genome of Monkeypox Virus. VGAM844 host target gene, herein designated VGAM HOST TARGET GENE, is a human gene contained in the human genome.

VGAM844 gene encodes a VGAM844 precursor RNA, herein designated VGAM PRECURSOR RNA. Similar to other miRNA genes, and unlike most ordinary genes, VGAM844 precursor RNA does not encode a protein. A nucleotide sequence identical or highly similar to the nucleotide sequence of VGAM844 precursor RNA is designated SEQ ID:830, and is provided hereinbelow with reference to the sequence listing part. Nucleotide sequence SEQ ID:830 is located at position 121671 relative to the genome of Monkeypox Virus.

VGAM844 precursor RNA folds onto itself, forming VGAM844 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM844 folded precursor RNA into VGAM844 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM844 RNA is designated SEQ ID:3555, and is provided hereinbelow with reference to the sequence listing part.

VGAM844 host target gene, herein designated VGAM HOST TARGET GENE, encodes a corresponding messenger RNA, VGAM844 host target RNA, herein designated VGAM HOST TARGET RNA. VGAM844 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM844 RNA, herein designated VGAM RNA, binds complementarily to one or more host target binding sites located in untranslated regions of VGAM844 host target RNA, herein designated VGAM HOST TARGET RNA. This complementary binding is due to the fact that the nucleotide sequence of VGAM844 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM844 RNA, herein designated VGAM RNA, may have a different number of host target binding sites in untranslated regions of a VGAM844 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM844 RNA, herein designated VGAM RNA, to host target binding sites on VGAM844 host target RNA, herein designated VGAM HOST TARGET RNA, such as BINDING SITE I, BINDING SITE II and BINDING SITE III, inhibits translation of VGAM844 host target RNA into VGAM844 host target protein, herein designated VGAM HOST TARGET PROTEIN. VGAM host target protein is therefore outlined by a broken line.

It is appreciated that VGAM844 host target gene, herein designated VGAM HOST TARGET GENE, in fact represents a plurality of VGAM844 host target genes. The mRNA of each one of this plurality of VGAM844 host target genes comprises one or more host target binding sites, each having a nucleotide sequence which is at least partly complementary to VGAM844 RNA, herein designated VGAM RNA, and which when bound by VGAM844 RNA causes inhibition of translation of respective one or more VGAM844 host target proteins.

It is further appreciated by one skilled in the art that the mode of translational inhibition illustrated by FIG. 1 with specific reference to translational inhibition exerted by VGAM844 gene, herein designated VGAM GENE, on one or more VGAM844 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM844 is inhibition of expression of host target genes, as part of a novel viral mechanism of attacking a host. Accordingly, utilities of VGAM844 include diagnosis, prevention and treatment of viral infection by Monkeypox Virus. Specific functions, and accordingly utilities, of VGAM844 correlate with, and may be deduced from, the identity of the host target genes which VGAM844 binds and inhibits, and the function of these host target genes, as elaborated hereinbelow.

Nucleotide sequences of the VGAM844 precursor RNA, herein designated VGAM PRECURSOR RNA, and of the 'diced' VGAM844 RNA, herein designated VGAM RNA, and a schematic representation of the secondary folding of VGAM844 folded precursor RNA, herein designated VGAM FOLDED PRECURSOR RNA, of VGAM844 are further described hereinbelow with reference to Table 1.

Nucleotide sequences of host target binding sites, such as BINDING SITE-I, BINDING SITE-II and BINDING SITE-III of FIG. 1, found on VGAM844 host target RNA, and schematic representation of the complementarity of each of these host target binding sites to VGAM844 RNA, herein designated VGAM RNA, are described hereinbelow with reference to Table 2.

As mentioned hereinabove with reference to FIG. 1, a function of VGAM844 gene, herein designated VGAM is inhibition of expression of VGAM844 target genes. It is appreciated that specific functions, and accordingly utilities, of VGAM844 correlate with, and may be deduced from, the identity of the target genes which VGAM844 binds and inhibits, and the function of these target genes, as elaborated hereinbelow.

LATS, Large Tumor Suppressor, Homolog 1 (Drosophila) (LATS1, Accession XM_015547) is a VGAM844 host target gene. LATS1 BINDING SITE is HOST TARGET binding site found in the 3' untranslated region of mRNA encoded by LATS1, corresponding to a HOST TARGET binding site such as BINDING SITE I, BINDING SITE II or BINDING SITE III. Table 2 illustrates the complementarity of the nucleotide sequences of LATS1 BINDING SITE, designated SEQ ID:30237, to the nucleotide sequence of VGAM844 RNA, herein designated VGAM RNA, also designated SEQ ID:3555.

A function of VGAM844 is therefore inhibition of LATS, Large Tumor Suppressor, Homolog 1 (Drosophila) (LATS1, Accession XM_015547). Accordingly, utilities of VGAM844 include diagnosis, prevention and treatment of diseases and clinical conditions associated with LATS1. SCDGF-B (Accession NM_025208) is another VGAM844 host target gene. SCDGF-B BINDING SITE1 and SCDGF-B BINDING SITE2 are HOST TARGET binding sites found in untranslated regions of mRNA encoded by SCDGF-B, corresponding to HOST TARGET binding sites such as BINDING SITE I, BINDING SITE II or BINDING SITE III. Table 2 illustrates the complementarity of the nucleotide sequences of SCDGF-B BINDING SITE1 and SCDGF-B BINDING SITE2, designated SEQ ID:24877 and SEQ ID:26979 respectively, to the nucleotide sequence of VGAM844 RNA, herein designated VGAM RNA, also designated SEQ ID:3555.

Another function of VGAM844 is therefore inhibition of SCDGF-B (Accession NM_025208). Accordingly, utilities of VGAM844 include diagnosis, prevention and treatment of diseases and clinical conditions associated with SCDGF-B. Serologically Defined Colon Cancer Antigen 1 (SDCCAG1, Accession NM_004713) is another VGAM845 host target gene. SDCCAG1 BINDING SITE is HOST TARGET binding site found in the 3' untranslated region of mRNA encoded by SDCCAG1, corresponding to a HOST TARGET binding site such as BINDING SITE I, BINDING SITE II or BINDING SITE III. Table 2 illustrates the complementarity of the nucleotide sequences of SDCCAG1 BINDING SITE, designated SEQ ID:11069, to the nucleotide sequence of VGAM845 RNA, herein designated VGAM RNA, also designated SEQ ID:3556.

Another function of VGAM845 is therefore inhibition of Serologically Defined Colon Cancer Antigen 1 (SDCCAG1, Accession NM_004713). Accordingly, utilities of VGAM845 include diagnosis, prevention and treatment of diseases and clinical conditions associated with SDCCAG1.

FIG. 1 further provides a conceptual description of a novel bioinformatically detected viral gene of the present invention, referred to here as Viral Genomic Address Messenger 846 (VGAM846) viral gene, which modulates expression of respective host target genes thereof, the function and utility of which host target genes is known in the art.

VGAM846 is a novel bioinformatically detected regulatory, non protein coding, viral micro RNA (miRNA) gene. The method by which VGAM846 was detected is described hereinabove with reference to FIGS. 1-8.

VGAM846 gene, herein designated VGAM GENE, is a viral gene contained in the genome of Gallid Herpesvirus 2. VGAM846 host target gene, herein designated VGAM HOST TARGET GENE, is a human gene contained in the human genome.

VGAM846 gene encodes a VGAM846 precursor RNA, herein designated VGAM PRECURSOR RNA. Similar to other miRNA genes, and unlike most ordinary genes, VGAM846 precursor RNA does not encode a protein. A nucleotide sequence identical or highly similar to the nucleotide sequence of VGAM846 precursor RNA is designated SEQ ID:832, and is provided hereinbelow with reference to the sequence listing part. Nucleotide sequence SEQ ID:832 is located at position 132582 relative to the genome of Gallid Herpesvirus 2.

VGAM846 precursor RNA folds onto itself, forming VGAM846 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM846 folded precursor RNA into VGAM846 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM846 RNA is designated SEQ ID:3557, and is provided hereinbelow with reference to the sequence listing part.

VGAM846 host target gene, herein designated VGAM HOST TARGET GENE, encodes a corresponding messenger RNA, VGAM846 host target RNA, herein designated VGAM HOST TARGET RNA. VGAM846 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM846 RNA, herein designated VGAM RNA, binds complementarily to one or more host target binding sites located in untranslated regions of VGAM846 host target RNA, herein designated VGAM HOST TARGET RNA. This complementary binding is due to the fact that the nucleotide sequence of VGAM846 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM846 RNA, herein designated VGAM RNA, may have a different number of host target binding sites in untranslated regions of a VGAM846 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM846 RNA, herein designated VGAM RNA, to host target binding sites on VGAM846 host target RNA, herein designated VGAM HOST TARGET RNA, such as BINDING SITE I, BINDING SITE II and BINDING SITE III, inhibits translation of VGAM846 host target RNA into VGAM846 host target protein, herein designated VGAM HOST TARGET PROTEIN. VGAM host target protein is therefore outlined by a broken line.

It is appreciated that VGAM846 host target gene, herein designated VGAM HOST TARGET GENE, in fact represents a plurality of VGAM846 host target genes. The mRNA of each one of this plurality of VGAM846 host target genes comprises one or more host target binding sites, each having a nucleotide sequence which is at least partly complementary to VGAM846 RNA, herein designated VGAM RNA, and which when bound by VGAM846 RNA causes inhibition of translation of respective one or more VGAM846 host target proteins.

It is further appreciated by one skilled in the art that the mode of translational inhibition illustrated by FIG. 1 with specific reference to translational inhibition exerted by VGAM846 gene, herein designated VGAM GENE, on one or more VGAM846 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM846 is inhibition of expression of host target genes, as part of a novel viral mechanism of attacking a host. Accordingly, utilities of VGAM846 include diagnosis, prevention and treatment of viral infection by Gallid Herpesvirus 2. Specific functions, and accordingly utilities, of VGAM846 correlate with, and may be deduced from, the identity of the host target genes which VGAM846 binds and inhibits, and the function of these host target genes, as elaborated hereinbelow.

Nucleotide sequences of the VGAM846 precursor RNA, herein designated VGAM PRECURSOR RNA, and of the 'diced' VGAM846 RNA, herein designated VGAM RNA, and a schematic representation of the secondary folding of VGAM846 folded precursor RNA, herein designated VGAM FOLDED PRECURSOR RNA, of VGAM846 are further described hereinbelow with reference to Table 1.

Nucleotide sequences of host target binding sites, such as BINDING SITE-I, BINDING SITE-II and BINDING SITE-III of FIG. 1, found on VGAM846 host target RNA, and schematic representation of the complementarity of each of these host target binding sites to VGAM846 RNA, herein designated VGAM RNA, are described hereinbelow with reference to Table 2.

As mentioned hereinabove with reference to FIG. 1, a function of VGAM846 gene, herein designated VGAM is inhibition of expression of VGAM846 target genes. It is appreciated that specific functions, and accordingly utilities, of VGAM846 correlate with, and may be deduced from, the identity of the target genes which VGAM846 binds and inhibits, and the function of these target genes, as elaborated hereinbelow.

Aconitase 1, Soluble (ACO1, Accession NM_002197) is a VGAM846 host target gene. ACO1 BINDING SITE is HOST TARGET binding site found in the 3' untranslated region of mRNA encoded by ACO1, corresponding to a HOST TARGET binding site such as BINDING SITE I, BINDING SITE II or BINDING SITE III. Table 2 illustrates the complementarity of the nucleotide sequences of ACO1 BINDING SITE, designated SEQ ID:7953, to the nucleotide sequence of VGAM846 RNA, herein designated VGAM RNA, also designated SEQ ID:3557.

A function of VGAM846 is therefore inhibition of Aconitase 1, Soluble (ACO1, Accession NM_002197), a gene which an iron-dependent enzyme; catalyzes conversion of citrate to cis-aconitate in the TCA cycle. Accordingly, utilities of VGAM846 include diagnosis, prevention and treatment of diseases and clinical conditions associated with ACO1. The function of ACO1 and its association with various diseases and clinical conditions, has been established by previous studies, as described hereinabove with reference to VGAM53. Annexin A7 (ANXA7, Accession NM_004034) is another VGAM846 host target gene. ANXA7 BINDING SITE1 and ANXA7 BINDING SITE2 are HOST TARGET binding sites found in untranslated regions of mRNA encoded by ANXA7, corresponding to HOST TARGET binding sites such as BINDING SITE I, BINDING SITE II or BINDING SITE III. Table 2 illustrates the complementarity of the nucleotide sequences of ANXA7 BINDING SITE1 and ANXA7 BINDING SITE2, designated SEQ ID:10253 and SEQ ID:6824 respectively, to the nucleotide sequence of VGAM846 RNA, herein designated VGAM RNA, also designated SEQ ID:3557.

Another function of VGAM846 is therefore inhibition of Annexin A7 (ANXA7, Accession NM_004034), a gene which promotes membrane fusion and is involved in exocytosis. Accordingly, utilities of VGAM846 include diagnosis, prevention and treatment of diseases and clinical conditions associated with ANXA7. The function of ANXA7 has been established by previous studies. The ANX7 gene is located on chromosome 10q21, a site long hypothesized to harbor a tumor suppressor gene or genes associated with prostate and other cancers. To test this hypothesis, Srivastava et al. (2001) analyzed the action of the ANX7 gene on colony formation by human tumor cell lines. They also examined the expression of the ANX7 protein in a large number of prostate cancers using tumor tissue microarray technology. Finally, they tested a panel of primary and metastatic prostate cancers for evidence of loss of heterozygosity (LOH). They found that human tumor cell proliferation and colony formation were markedly reduced when the wildtype ANX7 gene was transfected into 2 prostate tumor cell lines. Consistently, analysis of ANX7 protein expression in human prostate tumor microarrays revealed a significantly higher rate of loss of ANX7 expression in metastatic and local recurrences of hormone refractory prostate cancer as compared with primary tumors (P=0.0001). Using 4 microsatellite markers at or near the ANX7 locus and laser capture microdissected tumor cells, 35% of 20 primary prostate tumors showed LOH. The microsatellite marker closest to the ANX7 locus showed the highest rate of LOH, including 1 homozygous deletion. Srivastava et al. (2001) concluded that the ANX7 gene exhibits many biologic and genetic properties expected of a tumor suppressor gene and may play a role in prostate cancer progression. Animal model experiments lend further support to the function of ANXA7. By gene targeting, Srivastava et al. (1999) developed Anxa7-null mice. The null phenotype was lethal at embryonic day 10. Heterozygous mice were viable and fertile, but showed a defect in insulin secretion and an increased insulin content within isolated pancreatic islets. Electrooptical recordings suggested that the mutation altered Ca (2+) release by agonists of inositol trisphosphate. Using mice with a different genetic background and an alternate strategy to introduce the null mutation, Herr et al. (2001) developed Anxa7 -/- mice that were viable, fertile, and showed no obvious defects. Analysis of insulin secretion from isolated islets revealed no evidence for the involvement of Anxa7 in Ca (2+)-dependent or cAMP-mediated exocytosis. In cardiomyocytes, however, they found a functional role for Anxa7 in electromechanical coupling. Cardiomyocytes from embryonic Anxa7-null mice displayed intact Ca (2+) homeostasis and unremarkable excitation-contraction coupling; however, adult Anxa7 -/- mice exhibited a decrease in frequency-induced cell shortening.

It is appreciated that the abovementioned animal model for ANXA7 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Srivastava, M.; Atwater, I.; Glasman, M.; Leighton, X.; Goping, G.; Caohuy, H.; Miller, G.; Pichel, J.; Westphal, H.; Mears, D.; Rojas, E.; Pollard, H. B.: Defects in inositol 1,4, 5-trisphosphate receptor expression, Ca (2+) signaling, and insulin secretion in the anx7(+/-) knockout mouse. Proc. Nat. Acad. Sci. 96:13783-13788, 1999; and Srivastava, M.; Bubendorf, L.; Srikantan, V.; Fossom, L.; Nolan, L.; Glasman, M.; Leighton, X.; Fehrle, W.; Pittaluga, S.; Raffeld, M.; Koivisto, P.; Willi, N.; Gasser, T. C.; Kononen.

Further studies establishing the function and utilities of ANXA7 are found in John Hopkins OMIM database record ID 186360, and in sited publications numbered 10507-10514 listed in the bibliography section hereinbelow, which are also hereby incorporated by reference. KIAA1729 (Accession XM_114418) is another VGAM846 host target gene. KIAA1729 BINDING SITE is HOST TARGET binding site found in the 5' untranslated region of mRNA encoded by KIAA1729, corresponding to a HOST TARGET binding site such as BINDING SITE I, BINDING SITE II or BINDING SITE III. Table 2 illustrates the complementarity of the nucleotide sequences of KIAA1729 BINDING SITE, designated SEQ ID:42946, to the nucleotide sequence of VGAM846 RNA, herein designated VGAM RNA, also designated SEQ ID:3557.

Another function of VGAM846 is therefore inhibition of KIAA1729 (Accession XM_114418). Accordingly, utilities of VGAM846 include diagnosis, prevention and treatment of diseases and clinical conditions associated with KIAA1729. PRO1575 (Accession NM_014092) is another VGAM846 host target gene. PRO1575 BINDING SITE is HOST TARGET binding site found in the 5' untranslated region of mRNA encoded by PRO1575, corresponding to a HOST TARGET binding site such as BINDING SITE I, BINDING SITE II or BINDING SITE III. Table 2 illustrates the complementarity of the nucleotide sequences of PRO1575 BINDING SITE, designated SEQ ID:15311, to the nucleotide sequence of VGAM846 RNA, herein designated VGAM RNA, also designated SEQ ID:3557.

Another function of VGAM846 is therefore inhibition of PRO1575 (Accession NM_014092). Accordingly, utilities of VGAM846 include diagnosis, prevention and treatment of diseases and clinical conditions associated with PRO1575. LOC51339 (Accession NM_016651) is another VGAM846 host target gene. LOC51339 BINDING SITE is HOST TARGET binding site found in the 3' untranslated region of mRNA encoded by LOC51339, corresponding to a HOST TARGET binding site such as BINDING SITE I, BINDING SITE II or BINDING SITE III. Table 2 illustrates the complementarity of the nucleotide sequences of LOC51339 BINDING SITE, designated SEQ ID:18767, to the nucleotide sequence of VGAM846 RNA, herein designated VGAM RNA, also designated SEQ ID:3557.

Another function of VGAM846 is therefore inhibition of LOC51339 (Accession NM_016651). Accordingly, utilities of VGAM846 include diagnosis, prevention and treatment of diseases and clinical conditions associated with LOC51339.

FIG. 1 further provides a conceptual description of a novel bioinformatically detected viral gene of the present invention, referred to here as Viral Genomic Address Messenger 847 (VGAM847) viral gene, which modulates expression of respective host target genes thereof, the function and utility of which host target genes is known in the art.

VGAM847 is a novel bioinformatically detected regulatory, non protein coding, viral micro RNA (miRNA) gene. The method by which VGAM847 was detected is described hereinabove with reference to FIGS. 1-8.

VGAM847 gene, herein designated VGAM GENE, is a viral gene contained in the genome of Gallid Herpesvirus 2. VGAM847 host target gene, herein designated VGAM HOST TARGET GENE, is a human gene contained in the human genome.

VGAM847 gene encodes a VGAM847 precursor RNA, herein designated VGAM PRECURSOR RNA. Similar to other miRNA genes, and unlike most ordinary genes, VGAM847 precursor RNA does not encode a protein. A nucleotide sequence identical or highly similar to the nucleotide sequence of VGAM847 precursor RNA is designated SEQ ID:833, and is provided hereinbelow with reference to the sequence listing part. Nucleotide sequence SEQ ID:833 is located at position 132873 relative to the genome of Gallid Herpesvirus 2.

VGAM847 precursor RNA folds onto itself, forming VGAM847 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM847 folded precursor RNA into VGAM847 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM847 RNA is designated SEQ ID:3558, and is provided hereinbelow with reference to the sequence listing part.

VGAM847 host target gene, herein designated VGAM HOST TARGET GENE, encodes a corresponding messenger RNA, VGAM847 host target RNA, herein designated VGAM HOST TARGET RNA. VGAM847 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM847 RNA, herein designated VGAM RNA, binds complementarily to one or more host target binding sites located in untranslated regions of VGAM847 host target RNA, herein designated VGAM HOST TARGET RNA. This complementary binding is due to the fact that the nucleotide sequence of VGAM847 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM847 RNA, herein designated VGAM RNA, may have a different number of host target binding sites in untranslated regions of a VGAM847 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM847 RNA, herein designated VGAM RNA, to host target binding sites on VGAM847 host target RNA, herein designated VGAM HOST TARGET RNA, such as BINDING SITE I, BINDING SITE II and BINDING SITE III, inhibits translation of VGAM847 host target RNA into VGAM847 host target protein, herein designated VGAM HOST TARGET PROTEIN. VGAM host target protein is therefore outlined by a broken line.

It is appreciated that VGAM847 host target gene, herein designated VGAM HOST TARGET GENE, in fact represents a plurality of VGAM847 host target genes. The mRNA of each one of this plurality of VGAM847 host target genes comprises one or more host target binding sites, each having a nucleotide sequence which is at least partly complementary to VGAM847 RNA, herein designated VGAM RNA, and which when bound by VGAM847 RNA causes inhibition of translation of respective one or more VGAM847 host target proteins.

It is further appreciated by one skilled in the art that the mode of translational inhibition illustrated by FIG. 1 with specific reference to translational inhibition exerted by VGAM847 gene, herein designated VGAM GENE, on one or more VGAM847 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM847 is inhibition of expression of host target genes, as part of a novel viral mechanism of attacking a host. Accordingly, utilities of VGAM847 include diagnosis, prevention and treatment of viral infection by Gallid Herpesvirus 2. Specific functions, and accordingly utilities, of VGAM847 correlate with, and may be deduced from, the identity of the host target genes which VGAM847 binds and inhibits, and the function of these host target genes, as elaborated hereinbelow.

Nucleotide sequences of the VGAM847 precursor RNA, herein designated VGAM PRECURSOR RNA, and of the 'diced' VGAM847 RNA, herein designated VGAM RNA, and a schematic representation of the secondary folding of VGAM847 folded precursor RNA, herein designated VGAM FOLDED PRECURSOR RNA, of VGAM847 are further described hereinbelow with reference to Table 1.

Nucleotide sequences of host target binding sites, such as BINDING SITE-I, BINDING SITE-II and BINDING SITE-III of FIG. 1, found on VGAM847 host target RNA, and schematic representation of the complementarity of each of these host target binding sites to VGAM847 RNA, herein designated VGAM RNA, are described hereinbelow with reference to Table 2.

As mentioned hereinabove with reference to FIG. 1, a function of VGAM847 gene, herein designated VGAM is inhibition of expression of VGAM847 target genes. It is appreciated that specific functions, and accordingly utilities, of VGAM847 correlate with, and may be deduced from, the identity of the target genes which VGAM847 binds and inhibits, and the function of these target genes, as elaborated hereinbelow.

ATP-binding Cassette, Sub-family C (CFTR/MRP), Member 3 (ABCC3, Accession NM_020038) is a VGAM847 host target gene. ABCC3 BINDING SITE is HOST TARGET binding site found in the 3' untranslated region of mRNA encoded by ABCC3, corresponding to a HOST TARGET binding site such as BINDING SITE I, BINDING SITE II or BINDING SITE III. Table 2 illustrates the complementarity of the nucleotide sequences of ABCC3 BINDING SITE, designated SEQ ID:21291, to the nucleotide sequence of VGAM847 RNA, herein designated VGAM RNA, also designated SEQ ID:3558.

A function of VGAM847 is therefore inhibition of ATP-binding Cassette, Sub-family C (CFTR/MRP), Member 3 (ABCC3, Accession NM_020038), a gene which may act as an inducible transporter in the biliary and intestinal excretion of organic anions. Accordingly, utilities of VGAM847 include diagnosis, prevention and treatment of diseases and clinical conditions associated with ABCC3. The function of ABCC3 and its association with various diseases and clinical conditions, has been established by previous studies, as described hereinabove with reference to VGAM505. Activin A Receptor, Type IB (ACVR1B, Accession NM_004302) is another VGAM847 host target gene. ACVR1B BINDING SITE is HOST TARGET binding site found in the 3' untranslated region of mRNA encoded by ACVR1B, corresponding to a HOST TARGET binding site such as BINDING SITE I, BINDING SITE II or BINDING SITE III. Table 2 illustrates the complementarity of the nucleotide sequences of ACVR1B BINDING SITE, designated SEQ ID:10512, to the nucleotide sequence of VGAM847 RNA, herein designated VGAM RNA, also designated SEQ ID:3558.

Another function of VGAM847 is therefore inhibition of Activin A Receptor, Type IB (ACVR1B, Accession NM_004302), a gene which Activin receptor-like kinase; similar to activin, TGF-beta, and C. elegans daf-1 receptors. Accordingly, utilities of VGAM847 include diagnosis, prevention and treatment of diseases and clinical conditions associated with ACVR1B. The function of ACVR1B and its association with various diseases and clinical conditions, has been established by previous studies, as described hereinabove with reference to VGAM208. BLTR2 (Accession NM_019839) is another VGAM847 host target gene. BLTR2 BINDING SITE is HOST TARGET binding site found in the 5' untranslated region of mRNA encoded by BLTR2, corresponding to a HOST TARGET binding site such as BINDING SITE I, BINDING SITE II or BINDING SITE III. Table 2 illustrates the complementarity of the nucleotide sequences of BLTR2 BINDING SITE, designated SEQ ID:21246, to the nucleotide sequence of VGAM847 RNA, herein designated VGAM RNA, also designated SEQ ID:3558.

Another function of VGAM847 is therefore inhibition of BLTR2 (Accession NM_019839). Accordingly, utilities of VGAM847 include diagnosis, prevention and treatment of diseases and clinical conditions associated with BLTR2. Immunoglobulin Superfamily, Member 8 (IGSF8, Accession NM_052868) is another VGAM847 host target gene. IGSF8 BINDING SITE is HOST TARGET binding site found in the 5' untranslated region of mRNA encoded by IGSF8, corresponding to a HOST TARGET binding site such as BINDING SITE I, BINDING SITE II or BINDING SITE III. Table 2 illustrates the complementarity of the nucleotide sequences of IGSF8 BINDING SITE, designated SEQ ID:27449, to the nucleotide sequence of VGAM847 RNA, herein designated VGAM RNA, also designated SEQ ID:3558.

Another function of VGAM847 is therefore inhibition of Immunoglobulin Superfamily, Member 8 (IGSF8, Accession NM_052868), a gene which inhibits the binding of prostaglandin f2-alpha to its specific fp receptor. Accordingly, utilities of VGAM847 include diagnosis, prevention and treatment of diseases and clinical conditions associated with IGSF8. The function of IGSF8 has been established by previous studies. Tetraspanins, such as CD81 (OMIM Ref. No. 186845), have 4 transmembrane domains and N- and C-terminal cytoplasmic regions and form extensive complexes, or webs, with other tetraspanins as well as with integrins, MHC molecules, and other proteins. The IGSF8 gene encodes a protein that forms highly proximal, specific, and stoichiometric complexes with CD81 and CD9 (OMIM Ref. No. 143030). By Brij-97 detergent lysis of a T cell line and immunoprecipitation with anti-CD81, micropeptide sequencing of the 75-kD protein, MALDI-TOF mass spectrometry, and PSD analysis, followed by database searching, Clark et al. (2001) obtained a cDNA encoding mouse Pgrl ('prostaglandin regulatory-like') and the amino acid sequence of human PGRL (IGSF8). Sequence analysis predicted that the 613-amino acid Ig superfamily protein, 90% identical to the mouse protein, possesses an N-terminal signal sequence, 4 Ig domains, 3 N-linked glycosylation sites, a transmembrane domain, and a short cytoplasmic tail. Genomic database analysis clustered PGRL into a family of proteins including IGSF2 (OMIM Ref. No. 604516), IGSF3 (OMIM Ref. No. 603491), and FPRP (OMIM Ref. No. 601204). Immunoprecipitation and mutation analysis indicated that CD81 interacts with PGRL containing all 4 Ig domains. Using Brij-96 detergent lysis of teratocarcinoma, embryonic kidney, and epithelial carcinoma cell lines and immunoprecipitation with anti-CD81, micropeptide sequencing of a 70-kD protein, and EST database searching, Stipp et al. (2001) isolated a cDNA encoding IGSF8, which they referred to as EWI40 ('glutamine-tryptophan-isoleucine-2'). Northern blot analysis of human tissues revealed expression of a 2.4-kb transcript with highest expression in brain, kidney, liver, and plgacenta, moderate expression in other tissues, and minimal expression in peripheral blood leukocytes. Immunoprecipitation and immunoblot analysis indicated that IGSF8, like FPRP, specifically associates highly stoichiometrically with CD81 and CD9, but not with other tetraspanins or integrins. Stipp et al. (2001) proposed that IGSF8 may be a necessary cofactor for other CD9 and CD81 functions such as sperm-egg fusion or hepatitis C virus receptor function.

Full details of the abovementioned studies are described in the following publications, the disclosure of which are hereby incorporated by reference:

Clark, K. L; Zeng, Z.; Langford, A. L; Bowen, S. M; Todd, S. C.: PGRL is a major CD81-associated protein on lymphocytes and distinguishes a new family of cell surface proteins. J. Immun. 167:5115-5121, 2001; and Stipp, C. S.; Kolesnikova, T. V.; Hemler, M. E.: EWI-2 is a major CD9 and CD81 partner and member of a novel Ig protein subfamily. J. Biol. Chem. 276:40545-40554, 2001.

Further studies establishing the function and utilities of IGSF8 are found in John Hopkins OMIM database record ID 606644, and in sited publications numbered 6125-6126 listed in the bibliography section hereinbelow, which are also hereby incorporated by reference. Lipin 1 (LPIN1, Accession XM_041136) is another VGAM847 host target gene. LPIN1 BINDING SITE is HOST TARGET binding site found in the 3' untranslated region of mRNA encoded by LPIN1, corresponding to a HOST TARGET binding site such as BINDING SITE I, BINDING SITE II or BINDING SITE III. Table 2 illustrates the complementarity of the nucleotide sequences of LPIN1 BINDING SITE, designated SEQ ID:33469, to the nucleotide sequence of VGAM847 RNA, herein designated VGAM RNA, also designated SEQ ID:3558.

Another function of VGAM847 is therefore inhibition of Lipin 1 (LPIN1, Accession XM_041136), a gene which is involved in adipocyte differenciation (by similarity). Accordingly, utilities of VGAM847 include diagnosis, prevention and treatment of diseases and clinical conditions associated with LPIN1. The function of LPIN1 and its association with various diseases and clinical conditions, has been established by previous studies, as described hereinabove with reference to VGAM35. SH3-domain Binding Protein 4 (SH3BP4, Accession NM_014521) is another VGAM847 host target gene. SH3BP4 BINDING SITE is HOST TARGET binding site found in the 3' untranslated region of mRNA encoded by SH3BP4, corresponding to a HOST TARGET binding site such as BINDING SITE I, BINDING SITE II or BINDING SITE III. Table 2 illustrates the complementarity of the nucleotide sequences of SH3BP4 BINDING SITE, designated SEQ ID:15854, to the nucleotide sequence of VGAM847 RNA, herein designated VGAM RNA, also designated SEQ ID:3558.

Another function of VGAM847 is therefore inhibition of SH3-domain Binding Protein 4 (SH3BP4, Accession NM_014521), a gene which is of unknown function, contains SH3-domain binding protein 4; similar to the EH-binding protein. Accordingly, utilities of VGAM847 include diagnosis, prevention and treatment of diseases and clinical conditions associated with SH3BP4. The function of SH3BP4 and its association with various diseases and clinical conditions, has been established by previous studies, as described hereinabove with reference to VGAM179. Tissue Inhibitor of Metalloproteinase 3 (Sorsby fundus dystrophy, pseudoinflammatory) (TIMP3, Accession NM_000362) is another VGAM847 host target gene. TIMP3 BINDING SITE is HOST TARGET binding site found in the 3' untranslated region of mRNA encoded by TIMP3, corresponding to a HOST TARGET binding site such as BINDING SITE I, BINDING SITE II or BINDING SITE III. Table 2 illustrates the complementarity of the nucleotide sequences of TIMP3 BINDING SITE, designated SEQ ID:5925, to the nucleotide sequence of VGAM847 RNA, herein designated VGAM RNA, also designated SEQ ID:3558.

Another function of VGAM847 is therefore inhibition of Tissue Inhibitor of Metalloproteinase 3 (Sorsby fundus dystrophy, pseudoinflammatory) (TIMP3, Accession NM_000362). Accordingly, utilities of VGAM847 include diagnosis, prevention and treatment of diseases and clinical conditions associated with TIMP3. AFAP (Accession NM_021638) is another VGAM847 host target gene. AFAP BINDING SITE is HOST TARGET binding site found in the 3' untranslated region of mRNA encoded by AFAP, corresponding to a HOST TARGET binding site such as BINDING SITE I, BINDING SITE II or BINDING SITE III. Table 2 illustrates the complementarity of the nucleotide sequences of AFAP BINDING SITE, designated SEQ ID:22292, to the nucleotide sequence of VGAM847 RNA, herein designated VGAM RNA, also designated SEQ ID:3558.

Another function of VGAM847 is therefore inhibition of AFAP (Accession NM_021638). Accordingly, utilities of VGAM847 include diagnosis, prevention and treatment of diseases and clinical conditions associated with AFAP. ADP-ribosylation Factor Domain Protein 1, 64 kDa (ARFD1, Accession NM_001656) is another VGAM847 host target gene. ARFD1 BINDING SITE is HOST TARGET binding site found in the 3' untranslated region of mRNA encoded by ARFD1, corresponding to a HOST TARGET binding site such as BINDING SITE I, BINDING SITE II or BINDING SITE III. Table 2 illustrates the complementarity of the nucleotide sequences of ARFD1 BINDING SITE, designated SEQ ID:7373, to the nucleotide sequence of VGAM847 RNA, herein designated VGAM RNA, also designated SEQ ID:3558.

Another function of VGAM847 is therefore inhibition of ADP-ribosylation Factor Domain Protein 1, 64 kDa (ARFD1, Accession NM_001656). Accordingly, utilities of VGAM847 include diagnosis, prevention and treatment of diseases and clinical conditions associated with ARFD1. ARNTL2 (Accession NM_020183) is another VGAM847 host target gene. ARNTL2 BINDING SITE is HOST TARGET binding site found in the 3' untranslated region of mRNA encoded by ARNTL2, corresponding to a HOST TARGET binding site such as BINDING SITE I, BINDING SITE II or BINDING SITE III. Table 2 illustrates the complementarity of the nucleotide sequences of ARNTL2 BINDING SITE, designated SEQ ID:21417, to the nucleotide sequence of VGAM847 RNA, herein designated VGAM RNA, also designated SEQ ID:3558.

Another function of VGAM847 is therefore inhibition of ARNTL2 (Accession NM_020183). Accordingly, utilities of VGAM847 include diagnosis, prevention and treatment of diseases and clinical conditions associated with ARNTL2. Cytochrome P450, Subfamily IIS, Polypeptide 1 (CYP2S1, Accession NM_030622) is another VGAM847 host target gene. CYP2S1 BINDING SITE is HOST TARGET binding site found in the 3' untranslated region of mRNA encoded by CYP2S1, corresponding to a HOST TARGET binding site such as BINDING SITE I, BINDING SITE II or BINDING SITE III. Table 2 illustrates the complementarity of the nucleotide sequences of CYP2S1 BINDING SITE, designated SEQ ID:24964, to the nucleotide sequence of VGAM847 RNA, herein designated VGAM RNA, also designated SEQ ID:3558.

Another function of VGAM847 is therefore inhibition of Cytochrome P450, Subfamily IIS, Polypeptide 1 (CYP2S1, Accession NM_030622). Accordingly, utilities of VGAM847 include diagnosis, prevention and treatment of diseases and clinical conditions associated with CYP2S1. F-box Only Protein 26 (FBXO26, Accession NM_024907) is another VGAM847 host target gene. FBXO26 BINDING SITE is HOST TARGET binding site found in the 5' untranslated region of mRNA encoded by FBXO26, corresponding to a HOST TARGET binding site such as BINDING SITE I, BINDING SITE II or BINDING SITE III. Table 2 illustrates the complementarity of the nucleotide sequences of FBXO26 BINDING SITE, designated SEQ ID:24404, to the nucleotide sequence of VGAM847 RNA, herein designated VGAM RNA, also designated SEQ ID:3558.

Another function of VGAM847 is therefore inhibition of F-box Only Protein 26 (FBXO26, Accession NM_024907). Accordingly, utilities of VGAM847 include diagnosis, prevention and treatment of diseases and clinical conditions associated with FBXO26. FLJ12587 (Accession NM_022480) is another VGAM847 host target gene. FLJ12587 BINDING SITE is HOST TARGET binding site found in the 3' untranslated region of mRNA encoded by FLJ12587, corresponding to a HOST TARGET binding site such as BINDING SITE I, BINDING SITE II or BINDING SITE III. Table 2 illustrates the complementarity of the nucleotide sequences of FLJ12587 BINDING SITE, designated SEQ ID:22853, to the nucleotide sequence of VGAM847 RNA, herein designated VGAM RNA, also designated SEQ ID:3558.

Another function of VGAM847 is therefore inhibition of FLJ12587 (Accession NM_022480). Accordingly, utilities of VGAM847 include diagnosis, prevention and treatment of diseases and clinical conditions associated with FLJ12587. FLJ20174 (Accession NM_017699) is another VGAM847 host target gene. FLJ20174 BINDING SITE is HOST TARGET binding site found in the 3' untranslated region of mRNA encoded by FLJ20174, corresponding to a HOST TARGET binding site such as BINDING SITE I, BINDING SITE II or BINDING SITE III. Table 2 illustrates the complementarity of the nucleotide sequences of FLJ20174 BINDING SITE, designated SEQ ID:19272, to the nucleotide sequence of VGAM847 RNA, herein designated VGAM RNA, also designated SEQ ID:3558.

Another function of VGAM847 is therefore inhibition of FLJ20174 (Accession NM_017699). Accordingly, utilities of VGAM847 include diagnosis, prevention and treatment of diseases and clinical conditions associated with FLJ20174. KIAA1396 (Accession XM_032054) is another VGAM847 host target gene. KIAA1396 BINDING SITE is HOST TARGET binding site found in the 3' untranslated region of mRNA encoded by KIAA1396, corresponding to a HOST TARGET binding site such as BINDING SITE I, BINDING SITE II or BINDING SITE III. Table 2 illustrates the complementarity of the nucleotide sequences of KIAA1396 BINDING SITE, designated SEQ ID:31548, to the nucleotide sequence of VGAM847 RNA, herein designated VGAM RNA, also designated SEQ ID:3558.

Another function of VGAM847 is therefore inhibition of KIAA1396 (Accession XM_032054). Accordingly, utilities of VGAM847 include diagnosis, prevention and treatment of diseases and clinical conditions associated with KIAA1396. MGC2752 (Accession XM_085842) is another VGAM847 host target gene. MGC2752 BINDING SITE is HOST TARGET binding site found in the 5' untranslated region of mRNA encoded by MGC2752, corresponding to a HOST TARGET binding site such as BINDING SITE I, BINDING SITE II or BINDING SITE III. Table 2 illustrates the complementarity of the nucleotide sequences of MGC2752 BINDING SITE, designated SEQ ID:38369, to the nucleotide sequence of VGAM847 RNA, herein designated VGAM RNA, also designated SEQ ID:3558.

Another function of VGAM847 is therefore inhibition of MGC2752 (Accession XM_085842). Accordingly, utilities of VGAM847 include diagnosis, prevention and treatment of diseases and clinical conditions associated with MGC2752. Neurexophilin 3 (NXPH3, Accession XM_037847) is another VGAM847 host target gene. NXPH3 BINDING SITE is HOST TARGET binding site found in the 3' untranslated region of mRNA encoded by NXPH3, corresponding to a HOST TARGET binding site such as BINDING SITE I, BINDING SITE II or BINDING SITE III. Table 2 illustrates the complementarity of the nucleotide sequences of NXPH3 BINDING SITE, designated SEQ ID:32716, to the nucleotide sequence of VGAM847 RNA, herein designated VGAM RNA, also designated SEQ ID:3558.

Another function of VGAM847 is therefore inhibition of Neurexophilin 3 (NXPH3, Accession XM_037847). Accordingly, utilities of VGAM847 include diagnosis, prevention and treatment of diseases and clinical conditions associated with NXPH3. LOC145501 (Accession XM_085157) is another VGAM847 host target gene. LOC145501 BINDING SITE is HOST TARGET binding site found in the 3' untranslated region of mRNA encoded by LOC145501, corresponding to a HOST TARGET binding site such as BINDING SITE I, BINDING SITE II or BINDING SITE III. Table 2 illustrates the complementarity of the nucleotide sequences of LOC145501 BINDING SITE, designated SEQ ID:37885, to the nucleotide sequence of VGAM847 RNA, herein designated VGAM RNA, also designated SEQ ID:3558.

Another function of VGAM847 is therefore inhibition of LOC145501 (Accession XM_085157). Accordingly, utilities of VGAM847 include diagnosis, prevention and treatment of diseases and clinical conditions associated with LOC145501.

FIG. 1 further provides a conceptual description of a novel bioinformatically detected viral gene of the present invention, referred to here as Viral Genomic Address Messenger 848 (VGAM848) viral gene, which modulates expression of respective host target genes thereof, the function and utility of which host target genes is known in the art.

VGAM848 is a novel bioinformatically detected regulatory, non protein coding, viral micro RNA (miRNA) gene. The method by which VGAM848 was detected is described hereinabove with reference to FIGS. 1-8.

VGAM848 gene, herein designated VGAM GENE, is a viral gene contained in the genome of Gallid Herpesvirus 2. VGAM848 host target gene, herein designated VGAM HOST TARGET GENE, is a human gene contained in the human genome.

VGAM848 gene encodes a VGAM848 precursor RNA, herein designated VGAM PRECURSOR RNA. Similar to other miRNA genes, and unlike most ordinary genes, VGAM848 precursor RNA does not encode a protein. A nucleotide sequence identical or highly similar to the nucleotide sequence of VGAM848 precursor RNA is designated SEQ ID:834, and is provided hereinbelow with reference to the sequence listing part. Nucleotide sequence SEQ ID:834 is located at position 132736 relative to the genome of Gallid Herpesvirus 2.

VGAM848 precursor RNA folds onto itself, forming VGAM848 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM848 folded precursor RNA into VGAM848 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM848 RNA is designated SEQ ID:3559, and is provided hereinbelow with reference to the sequence listing part.

VGAM848 host target gene, herein designated VGAM HOST TARGET GENE, encodes a corresponding messenger RNA, VGAM848 host target RNA, herein designated VGAM HOST TARGET RNA. VGAM848 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM848 RNA, herein designated VGAM RNA, binds complementarily to one or more host target binding sites located in untranslated regions of VGAM848 host target RNA, herein designated VGAM HOST TARGET RNA. This complementary binding is due to the fact that the nucleotide sequence of VGAM848 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM848 RNA, herein designated VGAM RNA, may have a different number of host target binding sites in untranslated regions of a VGAM848 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM848 RNA, herein designated VGAM RNA, to host target binding sites on VGAM848 host target RNA, herein designated VGAM HOST TARGET RNA, such as BINDING SITE I, BINDING SITE II and BINDING SITE III, inhibits translation of VGAM848 host target RNA into VGAM848 host target protein, herein designated VGAM HOST TARGET PROTEIN. VGAM host target protein is therefore outlined by a broken line.

It is appreciated that VGAM848 host target gene, herein designated VGAM HOST TARGET GENE, in fact represents a plurality of VGAM848 host target genes. The mRNA of each one of this plurality of VGAM848 host target genes comprises one or more host target binding sites, each having a nucleotide sequence which is at least partly complementary to VGAM848 RNA, herein designated VGAM RNA, and which when bound by VGAM848 RNA causes inhibition of translation of respective one or more VGAM848 host target proteins.

It is further appreciated by one skilled in the art that the mode of translational inhibition illustrated by FIG. 1 with specific reference to translational inhibition exerted by VGAM848 gene, herein designated VGAM GENE, on one or more VGAM848 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM848 is inhibition of expression of host target genes, as part of a novel viral mechanism of attacking a host. Accordingly, utilities of VGAM848 include diagnosis, prevention and treatment of viral infection by Gallid Herpesvirus 2. Specific functions, and accordingly utilities, of VGAM848 correlate with, and may be deduced from, the identity of the host target genes which VGAM848 binds and inhibits, and the function of these host target genes, as elaborated hereinbelow.

Nucleotide sequences of the VGAM848 precursor RNA, herein designated VGAM PRECURSOR RNA, and of the 'diced' VGAM848 RNA, herein designated VGAM RNA, and a schematic representation of the secondary folding of VGAM848 folded precursor RNA, herein designated VGAM FOLDED PRECURSOR RNA, of VGAM848 are further described hereinbelow with reference to Table 1.

Nucleotide sequences of host target binding sites, such as BINDING SITE-I, BINDING SITE-II and BINDING SITE-III of FIG. 1, found on VGAM848 host target RNA, and schematic representation of the complementarity of each of these host target binding sites to VGAM848 RNA, herein designated VGAM RNA, are described hereinbelow with reference to Table 2.

As mentioned hereinabove with reference to FIG. 1, a function of VGAM848 gene, herein designated VGAM is inhibition of expression of VGAM848 target genes. It is appreciated that specific functions, and accordingly utilities, of VGAM848 correlate with, and may be deduced from, the identity of the target genes which VGAM848 binds and inhibits, and the function of these target genes, as elaborated hereinbelow.

Carcinoembryonic Antigen-related Cell Adhesion Molecule 1 (biliary glycoprotein) (CEACAM1, Accession NM_001712) is a VGAM848 host target gene. CEACAM1 BINDING SITE is HOST TARGET binding site found in the 3' untranslated region of mRNA encoded by CEACAM1, corresponding to a HOST TARGET binding site such as BINDING SITE I, BINDING SITE II or BINDING SITE III. Table 2 illustrates the complementarity of the nucleotide sequences of CEACAM1 BINDING SITE, designated SEQ ID:7439, to the nucleotide sequence of VGAM848 RNA, herein designated VGAM RNA, also designated SEQ ID:3559.

A function of VGAM848 is therefore inhibition of Carcinoembryonic Antigen-related Cell Adhesion Molecule 1 (biliary glycoprotein) (CEACAM1, Accession NM_001712), a gene which is a major effector of VEGF and may be a target for the inhibition of tumor angiogenesis. Accordingly, utilities of VGAM848 include diagnosis, prevention and treatment of diseases and clinical conditions associated with CEACAM1. The function of CEACAM1 and its association with various diseases and clinical conditions, has been established by previous studies, as described hereinabove with reference to VGAM93. Erythrocyte Membrane Protein Band 4.9 (dematin) (EPB49, Accession NM_001978) is another VGAM848 host target gene. EPB49 BINDING SITE is HOST TARGET binding site found in the 3' untranslated region of mRNA encoded by EPB49, corresponding to a HOST TARGET binding site such as BINDING SITE I, BINDING SITE II or BINDING SITE III. Table 2 illustrates the complementarity of the nucleotide sequences of EPB49 BINDING SITE, designated SEQ ID:7707, to the nucleotide sequence of VGAM848 RNA, herein designated VGAM RNA, also designated SEQ ID:3559.

Another function of VGAM848 is therefore inhibition of Erythrocyte Membrane Protein Band 4.9 (dematin) (EPB49, Accession NM_001978), a gene which is an actin-bundling protein. Accordingly, utilities of VGAM848 include diagnosis, prevention and treatment of diseases and clinical conditions associated with EPB49. The function of EPB49 and its association with various diseases and clinical conditions, has been established by previous studies, as described hereinabove with reference to VGAM760. Mannosyl (alpha-1,6-)-glycoprotein Beta-1,2-N-acetylglucosaminyltransferase (MGAT2, Accession NM_002408) is another VGAM848 host target gene. MGAT2 BINDING SITE is HOST TARGET binding site found in the 3' untranslated region of mRNA encoded by MGAT2, corresponding to a HOST TARGET binding site such as BINDING SITE I, BINDING SITE II or BINDING SITE III. Table 2 illustrates the complementarity of the nucleotide sequences of MGAT2 BINDING SITE, designated SEQ ID:8230, to the nucleotide sequence of VGAM848 RNA, herein designated VGAM RNA, also designated SEQ ID:3559.

Another function of VGAM848 is therefore inhibition of Mannosyl (alpha-1,6-)-glycoprotein Beta-1,2-N-acetylglucosaminyltransferase (MGAT2, Accession NM_002408). Accordingly, utilities of VGAM848 include diagnosis, prevention and treatment of diseases and clinical conditions associated with MGAT2. Pleckstrin Homology-like Domain, Family A, Member 3 (PHLDA3, Accession NM_012396) is another VGAM848 host target gene. PHLDA3 BINDING SITE is HOST TARGET binding site found in the 3' untranslated region of mRNA encoded by PHLDA3, corresponding to a HOST TARGET binding site such as BINDING SITE I, BINDING SITE II or BINDING SITE III. Table 2 illustrates the complementarity of the nucleotide sequences of PHLDA3 BINDING SITE, designated SEQ ID:14758, to the nucleotide sequence of VGAM848 RNA, herein designated VGAM RNA, also designated SEQ ID:3559.

Another function of VGAM848 is therefore inhibition of Pleckstrin Homology-like Domain, Family A, Member 3 (PHLDA3, Accession NM_012396). Accordingly, utilities of VGAM848 include diagnosis, prevention and treatment of diseases and clinical conditions associated with PHLDA3. DRCTNNB1A (Accession NM_032581) is another VGAM848 host target gene. DRCTNNB1A BINDING SITE is HOST TARGET binding site found in the 3' untranslated region of mRNA encoded by DRCTNNB1A, corresponding to a HOST TARGET binding site such as BINDING SITE I, BINDING SITE II or BINDING SITE III. Table 2 illustrates the complementarity of the nucleotide sequences of DRCTNNB1A BINDING SITE, designated SEQ ID:26315, to the nucleotide sequence of VGAM848 RNA, herein designated VGAM RNA, also designated SEQ ID:3559.

Another function of VGAM848 is therefore inhibition of DRCTNNB1A (Accession NM_032581). Accordingly, utilities of VGAM848 include diagnosis, prevention and treatment of diseases and clinical conditions associated with DRCTNNB1A. KIAA0876 (Accession XM_035625) is another VGAM848 host target gene. KIAA0876 BINDING SITE is HOST TARGET binding site found in the 3' untranslated region of mRNA encoded by KIAA0876, corresponding to a HOST TARGET binding site such as BINDING SITE I, BINDING SITE II or BINDING SITE III. Table 2 illustrates the complementarity of the nucleotide sequences of KIAA0876 BINDING SITE, designated SEQ ID:32292, to the nucleotide sequence of VGAM848 RNA, herein designated VGAM RNA, also designated SEQ ID:3559.

Another function of VGAM848 is therefore inhibition of KIAA0876 (Accession XM_035625). Accordingly, utilities of VGAM848 include diagnosis, prevention and treatment of diseases and clinical conditions associated with KIAA0876. l (3) mbt-like 2 (Drosophila) (L3MBTL2, Accession XM_114201) is another VGAM848 host target gene. L3MBTL2 BINDING SITE is HOST TARGET binding site found in the 3' untranslated region of mRNA encoded by L3MBTL2, corresponding to a HOST TARGET binding site such as BINDING SITE I, BINDING SITE II or BINDING SITE III. Table 2 illustrates the complementarity of the nucleotide sequences of L3MBTL2 BINDING SITE, designated SEQ ID:42786, to the nucleotide sequence of VGAM848 RNA, herein designated VGAM RNA, also designated SEQ ID:3559.

Another function of VGAM848 is therefore inhibition of l (3) mbt-like 2 (Drosophila) (L3MBTL2, Accession XM_114201). Accordingly, utilities of VGAM848 include diagnosis, prevention and treatment of diseases and clinical conditions associated with L3MBTL2. Ornithine Decarboxylase Antizyme Inhibitor (OAZIN, Accession NM_015878) is another VGAM848 host target gene. OAZIN BINDING SITE is HOST TARGET binding site found in the 3' untranslated region of mRNA encoded by OAZIN, corresponding to a HOST TARGET binding site such as BINDING SITE I, BINDING SITE II or BINDING SITE III. Table 2 illustrates the complementarity of the nucleotide sequences of OAZIN BINDING SITE, designated SEQ ID:18019, to the nucleotide sequence of VGAM848 RNA, herein designated VGAM RNA, also designated SEQ ID:3559.

Another function of VGAM848 is therefore inhibition of Ornithine Decarboxylase Antizyme Inhibitor (OAZIN, Accession NM_015878). Accordingly, utilities of VGAM848 include diagnosis, prevention and treatment of diseases and clinical conditions associated with OAZIN. LOC146336 (Accession XM_085421) is another VGAM848 host target gene. LOC146336 BINDING SITE is HOST TARGET binding site found in the 3' untranslated region of mRNA encoded by LOC146336, corresponding to a HOST TARGET binding site such as BINDING SITE I, BINDING SITE II or BINDING SITE III. Table 2 illustrates the complementarity of the nucleotide sequences of LOC146336 BINDING SITE, designated SEQ ID:38132, to the nucleotide sequence of VGAM848 RNA, herein designated VGAM RNA, also designated SEQ ID:3559.

Another function of VGAM848 is therefore inhibition of LOC146336 (Accession XM_085421). Accordingly, utilities of VGAM848 include diagnosis, prevention and treatment of diseases and clinical conditions associated with LOC146336. FIG. 1 further provides a conceptual description of a novel bioinformatically detected viral gene of the present invention, referred to here as Viral Genomic Address Messenger 849 (VGAM849) viral gene, which modulates expression of respective host target genes thereof, the function and utility of which host target genes is known in the art.

VGAM849 is a novel bioinformatically detected regulatory, non protein coding, viral micro RNA (miRNA) gene. The method by which VGAM849 was detected is described hereinabove with reference to FIGS. 1-8.

VGAM849 gene, herein designated VGAM GENE, is a viral gene contained in the genome of Lymphocystis Disease Virus 1. VGAM849 host target gene, herein designated VGAM HOST TARGET GENE, is a human gene contained in the human genome.

VGAM849 gene encodes a VGAM849 precursor RNA, herein designated VGAM PRECURSOR RNA. Similar to other miRNA genes, and unlike most ordinary genes, VGAM849 precursor RNA does not encode a protein. A nucleotide sequence identical or highly similar to the nucleotide sequence of VGAM849 precursor RNA is designated SEQ ID:835, and is provided hereinbelow with reference to the sequence listing part. Nucleotide sequence SEQ ID:835 is located at position 12797 relative to the genome of Lymphocystis Disease Virus 1.

VGAM849 precursor RNA folds onto itself, forming VGAM849 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM849 folded precursor RNA into VGAM849 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM849 RNA is designated SEQ ID:3560, and is provided hereinbelow with reference to the sequence listing part.

VGAM849 host target gene, herein designated VGAM HOST TARGET GENE, encodes a corresponding messenger RNA, VGAM849 host target RNA, herein designated VGAM HOST TARGET RNA. VGAM849 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM849 RNA, herein designated VGAM RNA, binds complementarily to one or more host target binding sites located in untranslated regions of VGAM849 host target RNA, herein designated VGAM HOST TARGET RNA. This complementary binding is due to the fact that the nucleotide sequence of VGAM849 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM849 RNA, herein designated VGAM RNA, may have a different number of host target binding sites in untranslated regions of a VGAM849 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM849 RNA, herein designated VGAM RNA, to host target binding sites on VGAM849 host target RNA, herein designated VGAM HOST TARGET RNA, such as BINDING SITE I, BINDING SITE II and BINDING SITE III, inhibits translation of VGAM849 host target RNA into VGAM849 host target protein, herein designated VGAM HOST TARGET PROTEIN. VGAM host target protein is therefore outlined by a broken line.

It is appreciated that VGAM849 host target gene, herein designated VGAM HOST TARGET GENE, in fact represents a plurality of VGAM849 host target genes. The mRNA of each one of this plurality of VGAM849 host target genes comprises one or more host target binding sites, each having a nucleotide sequence which is at least partly complementary to VGAM849 RNA, herein designated VGAM RNA, and which when bound by VGAM849 RNA causes inhibition of translation of respective one or more VGAM849 host target proteins.

It is further appreciated by one skilled in the art that the mode of translational inhibition illustrated by FIG. 1 with specific reference to translational inhibition exerted by VGAM849 gene, herein designated VGAM GENE, on one or more VGAM849 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM849 is inhibition of expression of host target genes, as part of a novel viral mechanism of attacking a host. Accordingly, utilities of VGAM849 include diagnosis, prevention and treatment of viral infection by Lymphocystis Disease Virus 1. Specific functions, and accordingly utilities, of VGAM849 correlate with, and may be deduced from, the identity of the host target genes which VGAM849 binds and inhibits, and the function of these host target genes, as elaborated hereinbelow.

Nucleotide sequences of the VGAM849 precursor RNA, herein designated VGAM PRECURSOR RNA, and of the 'diced' VGAM849 RNA, herein designated VGAM RNA, and a schematic representation of the secondary folding of VGAM849 folded precursor RNA, herein designated VGAM FOLDED PRECURSOR RNA, of VGAM849 are further described hereinbelow with reference to Table 1.

Nucleotide sequences of host target binding sites, such as BINDING SITE-I, BINDING SITE-II and BINDING SITE-III of FIG. 1, found on VGAM849 host target RNA, and schematic representation of the complementarity of each of these host target binding sites to VGAM849 RNA, herein designated VGAM RNA, are described hereinbelow with reference to Table 2.

As mentioned hereinabove with reference to FIG. 1, a function of VGAM849 gene, herein designated VGAM is inhibition of expression of VGAM849 target genes. It is appreciated that specific functions, and accordingly utilities, of VGAM849 correlate with, and may be deduced from, the identity of the target genes which VGAM849 binds and inhibits, and the function of these target genes, as elaborated hereinbelow.

Heterogeneous Nuclear Ribonucleoprotein D-like (HNRPDL, Accession NM_005463) is a VGAM849 host target gene. HNRPDL BINDING SITE is HOST TARGET binding site found in the 3' untranslated region of mRNA encoded by HNRPDL, corresponding to a HOST TARGET binding site such as BINDING SITE I, BINDING SITE II or BINDING SITE III. Table 2 illustrates the complementarity of the nucleotide sequences of HNRPDL BINDING SITE, designated SEQ ID:11946, to the nucleotide sequence of VGAM849 RNA, herein designated VGAM RNA, also designated SEQ ID:3560.

A function of VGAM849 is therefore inhibition of Heterogeneous Nuclear Ribonucleoprotein D-like (HNRPDL, Accession NM_005463), a gene which binds to rna molecules that contain au-rich elements. Accordingly, utilities of VGAM849 include diagnosis, prevention and treatment of diseases and clinical conditions associated with HNRPDL. The function of HNRPDL and its association with various diseases and clinical conditions, has been established by previous studies, as described hereinabove with reference to VGAM144. Isocitrate Dehydrogenase 3 (NAD+) Alpha (IDH3A, Accession NM_005530) is another VGAM849 host target gene. IDH3A BINDING SITE is HOST TARGET binding site found in the 3' untranslated region of mRNA encoded by IDH3A, corresponding to a HOST TARGET binding site such as BINDING SITE I, BINDING SITE II or BINDING SITE III. Table 2 illustrates the complementarity of the nucleotide sequences of IDH3A BINDING SITE, designated SEQ ID:12050, to the nucleotide sequence of VGAM849 RNA, herein designated VGAM RNA, also designated SEQ ID:3560.

Another function of VGAM849 is therefore inhibition of Isocitrate Dehydrogenase 3 (NAD+) Alpha (IDH3A, Accession NM_005530), a gene which decarboxylates isocitrate into alpha-ketoglutarate in the TCA cycle. Accordingly, utilities of VGAM849 include diagnosis, prevention and treatment of diseases and clinical conditions associated with IDH3A. The function of IDH3A and its association with various diseases and clinical conditions, has been established by previous studies, as described hereinabove with reference to VGAM349. Insulin Receptor Substrate 1 (IRS1, Accession NM_005544) is another VGAM849 host target gene. IRS1 BINDING SITE is HOST TARGET binding site found in the 3' untranslated region of mRNA encoded by IRS1, corresponding to a HOST TARGET binding site such as BINDING SITE I, BINDING SITE II or BINDING SITE III. Table 2 illustrates the complementarity of the nucleotide sequences of IRS1 BINDING SITE, designated SEQ ID:12067, to the nucleotide sequence of VGAM849 RNA, herein designated VGAM RNA, also designated SEQ ID:3560.

Another function of VGAM849 is therefore inhibition of Insulin Receptor Substrate 1 (IRS1, Accession NM_005544), a gene which may mediate the control of various cellular processes by insulin. Accordingly, utilities of VGAM849 include diagnosis, prevention and treatment of diseases and clinical conditions associated with IRS1. The function of IRS1 and its association with various diseases and clinical conditions, has been established by previous studies, as described hereinabove with reference to VGAM281. PAG (Accession NM_018440) is another VGAM849 host target gene. PAG BINDING SITE is HOST TARGET binding site found in the 3' untranslated region of mRNA encoded by PAG, corresponding to a HOST TARGET binding site such as BINDING SITE I, BINDING SITE II or BINDING SITE III. Table 2 illustrates the complementarity of the nucleotide sequences of PAG BINDING SITE, designated SEQ ID:20507, to the nucleotide sequence of VGAM849 RNA, herein designated VGAM RNA, also designated SEQ ID:3560.

Another function of VGAM849 is therefore inhibition of PAG (Accession NM_018440). Accordingly, utilities of VGAM849 include diagnosis, prevention and treatment of diseases and clinical conditions associated with PAG. Tumor Protein P63 (TP63, Accession NM_003722) is another VGAM849 host target gene. TP63 BINDING SITE is HOST TARGET binding site found in the 3' untranslated region of mRNA encoded by TP63, corresponding to a HOST TARGET binding site such as BINDING SITE I, BINDING SITE II or BINDING SITE III. Table 2 illustrates the complementarity of the nucleotide sequences of TP63 BINDING SITE, designated SEQ ID:9813, to the nucleotide sequence of VGAM849 RNA, herein designated VGAM RNA, also designated SEQ ID:3560.

Another function of VGAM849 is therefore inhibition of Tumor Protein P63 (TP63, Accession NM_003722). Accordingly, utilities of VGAM849 include diagnosis, prevention and treatment of diseases and clinical conditions associated with TP63. Ras Homolog Gene Family, Member E (ARHE, Accession NM_005168) is another VGAM849 host target gene. ARHE BINDING SITE is HOST TARGET binding site found in the 3' untranslated region of mRNA encoded by ARHE, corresponding to a HOST TARGET binding site such as BINDING SITE I, BINDING SITE II or BINDING SITE III. Table 2 illustrates the complementarity of the nucleotide sequences of ARHE BINDING SITE, designated SEQ ID:11665, to the nucleotide sequence of VGAM849 RNA, herein designated VGAM RNA, also designated SEQ ID:3560.

Another function of VGAM849 is therefore inhibition of Ras Homolog Gene Family, Member E (ARHE, Accession NM_005168). Accordingly, utilities of VGAM849 include diagnosis, prevention and treatment of diseases and clinical conditions associated with ARHE. Chemokine (C-C motif) Receptor 8 (CCR8, Accession NM_005201) is another VGAM849 host target gene. CCR8 BINDING SITE is HOST TARGET binding site found in the 3' untranslated region of mRNA encoded by CCR8, corresponding to a HOST TARGET binding site such as BINDING SITE I, BINDING SITE II or BINDING SITE III. Table 2 illustrates the complementarity of the nucleotide sequences of CCR8 BINDING SITE, designated SEQ ID:11700, to the nucleotide sequence of VGAM849 RNA, herein designated VGAM RNA, also designated SEQ ID:3560.

Another function of VGAM849 is therefore inhibition of Chemokine (C-C motif) Receptor 8 (CCR8, Accession NM_005201). Accordingly, utilities of VGAM849 include diagnosis, prevention and treatment of diseases and clinical conditions associated with CCR8. FLJ10110 (Accession NM_017998) is another VGAM849 host target gene. FLJ10110 BINDING SITE is HOST TARGET binding site found in the 3' untranslated region of mRNA encoded by FLJ10110, corresponding to a HOST TARGET binding site such as BINDING SITE I, BINDING SITE II or BINDING SITE III. Table 2 illustrates the complementarity of the nucleotide sequences of FLJ10110 BINDING SITE, designated SEQ ID:19726, to the nucleotide sequence of VGAM849 RNA, herein designated VGAM RNA, also designated SEQ ID:3560.

Another function of VGAM849 is therefore inhibition of FLJ10110 (Accession NM_017998). Accordingly, utilities of VGAM849 include diagnosis, prevention and treatment of diseases and clinical conditions associated with FLJ10110. FLJ10895 (Accession NM_019084) is another VGAM849 host target gene. FLJ10895 BINDING SITE is HOST TARGET binding site found in the 3' untranslated region of mRNA encoded by FLJ10895, corresponding to a HOST TARGET binding site such as BINDING SITE I, BINDING SITE II or BINDING SITE III. Table 2 illustrates the complementarity of the nucleotide sequences of FLJ10895 BINDING SITE, designated SEQ ID:21156, to the nucleotide sequence of VGAM849 RNA, herein designated VGAM RNA, also designated SEQ ID:3560.

Another function of VGAM849 is therefore inhibition of FLJ10895 (Accession NM_019084). Accordingly, utilities of VGAM849 include diagnosis, prevention and treatment of diseases and clinical conditions associated with FLJ10895. KIAA0419 (Accession NM_014711) is another VGAM849 host target gene. KIAA0419 BINDING SITE is HOST TARGET binding site found in the 5' untranslated region of mRNA encoded by KIAA0419, corresponding to a HOST TARGET binding site such as BINDING SITE I, BINDING SITE II or BINDING SITE III. Table 2 illustrates the complementarity of the nucleotide sequences of KIAA0419 BINDING SITE, designated SEQ ID:16257, to the nucleotide sequence of VGAM849 RNA, herein designated VGAM RNA, also designated SEQ ID:3560.

Another function of VGAM849 is therefore inhibition of KIAA0419 (Accession NM_014711). Accordingly, utilities of VGAM849 include diagnosis, prevention and treatment of diseases and clinical conditions associated with KIAA0419. KIAA0445 (Accession NM_014675) is another VGAM849 host target gene. KIAA0445 BINDING SITE is HOST TARGET binding site found in the 5' untranslated region of mRNA encoded by KIAA0445, corresponding to a HOST TARGET binding site such as BINDING SITE I, BINDING SITE II or BINDING SITE III. Table 2 illustrates the complementarity of the nucleotide sequences of KIAA0445 BINDING SITE, designated SEQ ID:16144, to the nucleotide sequence of VGAM849 RNA, herein designated VGAM RNA, also designated SEQ ID:3560.

Another function of VGAM849 is therefore inhibition of KIAA0445 (Accession NM_014675). Accordingly, utilities of VGAM849 include diagnosis, prevention and treatment of diseases and clinical conditions associated with KIAA0445. KIAA1627 (Accession XM_087571) is another VGAM849 host target gene. KIAA1627 BINDING SITE is HOST TARGET binding site found in the 3' untranslated region of mRNA encoded by KIAA1627, corresponding to a HOST TARGET binding site such as BINDING SITE I, BINDING SITE II or BINDING SITE III. Table 2 illustrates the complementarity of the nucleotide sequences of KIAA1627 BINDING SITE, designated SEQ ID:39343, to the nucleotide sequence of VGAM849 RNA, herein designated VGAM RNA, also designated SEQ ID:3560.

Another function of VGAM849 is therefore inhibition of KIAA1627 (Accession XM_087571). Accordingly, utilities of VGAM849 include diagnosis, prevention and treatment of diseases and clinical conditions associated with KIAA1627. Mitogen-activated Protein Kinase Kinase 6 (MAP2K6, Accession NM_031988) is another VGAM849 host target gene. MAP2K6 BINDING SITE1 and MAP2K6 BINDING SITE2 are HOST TARGET binding sites found in untranslated regions of mRNA encoded by MAP2K6, corresponding to HOST TARGET binding sites such as BINDING SITE I, BINDING SITE II or BINDING SITE III. Table 2 illustrates the complementarity of the nucleotide sequences of MAP2K6 BINDING SITE1 and MAP2K6 BINDING SITE2, designated SEQ ID:25699 and SEQ ID:8639 respectively, to the nucleotide sequence of VGAM849 RNA, herein designated VGAM RNA, also designated SEQ ID:3560.

Another function of VGAM849 is therefore inhibition of Mitogen-activated Protein Kinase Kinase 6 (MAP2K6, Accession NM_031988). Accordingly, utilities of VGAM849 include diagnosis, prevention and treatment of diseases and clinical conditions associated with MAP2K6. LOC128338 (Accession XM_059238) is another VGAM849 host target gene. LOC128338 BINDING SITE is HOST TARGET binding site found in the 5' untranslated region of mRNA encoded by LOC128338, corresponding to a HOST TARGET binding site such as BINDING SITE I, BINDING SITE II or BINDING SITE III. Table 2 illustrates the complementarity of the nucleotide sequences of LOC128338 BINDING SITE, designated SEQ ID:36924, to the nucleotide sequence of VGAM849 RNA, herein designated VGAM RNA, also designated SEQ ID:3560.

Another function of VGAM849 is therefore inhibition of LOC128338 (Accession XM_059238). Accordingly, utilities of VGAM849 include diagnosis, prevention and treatment of diseases and clinical conditions associated with LOC128338. LOC130507 (Accession XM_059440) is another VGAM849 host target gene. LOC130507 BINDING SITE is HOST TARGET binding site found in the 3' untranslated region of mRNA encoded by LOC130507, corresponding to a HOST TARGET binding site such as BINDING SITE I, BINDING SITE II or BINDING SITE III. Table 2 illustrates the complementarity of the nucleotide sequences of LOC130507 BINDING SITE, designated SEQ ID:36994, to the nucleotide sequence of VGAM849 RNA, herein designated VGAM RNA, also designated SEQ ID:3560.

Another function of VGAM849 is therefore inhibition of LOC130507 (Accession XM_059440). Accordingly, utilities of VGAM849 include diagnosis, prevention and treatment of diseases and clinical conditions associated with LOC130507. LOC137090 (Accession XM_070226) is another VGAM849 host target gene. LOC137090 BINDING SITE is HOST TARGET binding site found in the 5' untranslated region of mRNA encoded by LOC137090, corresponding to a HOST TARGET binding site such as BINDING SITE I, BINDING SITE II or BINDING SITE III. Table 2 illustrates the complementarity of the nucleotide sequences of LOC137090 BIND- ING SITE, designated SEQ ID:37392, to the nucleotide sequence of VGAM849 RNA, herein designated VGAM RNA, also designated SEQ ID:3560.

Another function of VGAM849 is therefore inhibition of LOC137090 (Accession XM_070226). Accordingly, utilities of VGAM849 include diagnosis, prevention and treatment of diseases and clinical conditions associated with LOC137090. LOC144262 (Accession XM_084793) is another VGAM849 host target gene. LOC144262 BINDING SITE is HOST TARGET binding site found in the 5' untranslated region of mRNA encoded by LOC144262, corresponding to a HOST TARGET binding site such as BINDING SITE I, BINDING SITE II or BINDING SITE III. Table 2 illustrates the complementarity of the nucleotide sequences of LOC144262 BINDING SITE, designated SEQ ID:37702, to the nucleotide sequence of VGAM849 RNA, herein designated VGAM RNA, also designated SEQ ID:3560.

Another function of VGAM849 is therefore inhibition of LOC144262 (Accession XM_084793). Accordingly, utilities of VGAM849 include diagnosis, prevention and treatment of diseases and clinical conditions associated with LOC144262. LOC145482 (Accession XM_085154) is another VGAM849 host target gene. LOC145482 BINDING SITE is HOST TARGET binding site found in the 3' untranslated region of mRNA encoded by LOC145482, corresponding to a HOST TARGET binding site such as BINDING SITE I, BINDING SITE II or BINDING SITE III. Table 2 illustrates the complementarity of the nucleotide sequences of LOC145482 BINDING SITE, designated SEQ ID:37876, to the nucleotide sequence of VGAM849 RNA, herein designated VGAM RNA, also designated SEQ ID:3560.

Another function of VGAM849 is therefore inhibition of LOC145482 (Accession XM_085154). Accordingly, utilities of VGAM849 include diagnosis, prevention and treatment of diseases and clinical conditions associated with LOC145482. LOC149579 (Accession XM_048743) is another VGAM849 host target gene. LOC149579 BINDING SITE is HOST TARGET binding site found in the 5' untranslated region of mRNA encoded by LOC149579, corresponding to a HOST TARGET binding site such as BINDING SITE I, BINDING SITE II or BINDING SITE III. Table 2 illustrates the complementarity of the nucleotide sequences of LOC149579 BINDING SITE, designated SEQ ID:35240, to the nucleotide sequence of VGAM849 RNA, herein designated VGAM RNA, also designated SEQ ID:3560.

Another function of VGAM849 is therefore inhibition of LOC149579 (Accession XM_048743). Accordingly, utilities of VGAM849 include diagnosis, prevention and treatment of diseases and clinical conditions associated with LOC149579. LOC154792 (Accession XM_098608) is another VGAM849 host target gene. LOC154792 BINDING SITE is HOST TARGET binding site found in the 3' untranslated region of mRNA encoded by LOC154792, corresponding to a HOST TARGET binding site such as BINDING SITE I, BINDING SITE II or BINDING SITE III. Table 2 illustrates the complementarity of the nucleotide sequences of LOC154792 BINDING SITE, designated SEQ ID:41727, to the nucleotide sequence of VGAM849 RNA, herein designated VGAM RNA, also designated SEQ ID:3560.

Another function of VGAM849 is therefore inhibition of LOC154792 (Accession XM_098608). Accordingly, utilities of VGAM849 include diagnosis, prevention and treatment of diseases and clinical conditions associated with LOC154792. FIG. 1 further provides a conceptual description of a novel bioinformatically detected viral gene of the present invention, referred to here as Viral Genomic Address Messenger 850 (VGAM850) viral gene, which modulates expression of respective host target genes thereof, the function and utility of which host target genes is known in the art.

VGAM850 is a novel bioinformatically detected regulatory, non protein coding, viral micro RNA (miRNA) gene. The method by which VGAM850 was detected is described hereinabove with reference to FIGS. 1-8.

VGAM850 gene, herein designated VGAM GENE, is a viral gene contained in the genome of Lymphocystis Disease Virus 1. VGAM850 host target gene, herein designated VGAM HOST TARGET GENE, is a human gene contained in the human genome.

VGAM850 gene encodes a VGAM850 precursor RNA, herein designated VGAM PRECURSOR RNA. Similar to other miRNA genes, and unlike most ordinary genes, VGAM850 precursor RNA does not encode a protein. A nucleotide sequence identical or highly similar to the nucleotide sequence of VGAM850 precursor RNA is designated SEQ ID:836, and is provided hereinbelow with reference to the sequence listing part. Nucleotide sequence SEQ ID:836 is located at position 13536 relative to the genome of Lymphocystis Disease Virus 1.

VGAM850 precursor RNA folds onto itself, forming VGAM850 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM850 folded precursor RNA into VGAM850 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM850 RNA is designated SEQ ID:3561, and is provided hereinbelow with reference to the sequence listing part.

VGAM850 host target gene, herein designated VGAM HOST TARGET GENE, encodes a corresponding messenger RNA, VGAM850 host target RNA, herein designated VGAM HOST TARGET RNA. VGAM850 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM850 RNA, herein designated VGAM RNA, binds complementarily to one or more host target binding sites located in untranslated regions of VGAM850 host target RNA, herein designated VGAM HOST TARGET RNA. This complementary binding is due to the fact that the nucleotide sequence of VGAM850 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM850 RNA, herein designated VGAM RNA, may have a different number of host target binding sites in untranslated regions of a VGAM850 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM850 RNA, herein designated VGAM RNA, to host target binding sites on VGAM850 host target RNA, herein designated VGAM HOST TARGET RNA, such as BINDING SITE I, BINDING SITE II and BINDING SITE III, inhibits translation of VGAM850 host target RNA into VGAM850 host target protein, herein designated VGAM HOST TARGET PROTEIN. VGAM host target protein is therefore outlined by a broken line.

It is appreciated that VGAM850 host target gene, herein designated VGAM HOST TARGET GENE, in fact represents a plurality of VGAM850 host target genes. The mRNA of each one of this plurality of VGAM850 host target genes comprises one or more host target binding sites, each having a nucleotide sequence which is at least partly complementary to VGAM850 RNA, herein designated VGAM RNA, and which when bound by VGAM850 RNA causes inhibition of translation of respective one or more VGAM850 host target proteins.

It is further appreciated by one skilled in the art that the mode of translational inhibition illustrated by FIG. 1 with specific reference to translational inhibition exerted by VGAM850 gene, herein designated VGAM GENE, on one or more VGAM850 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM850 is inhibition of expression of host target genes, as part of a novel viral mechanism of attacking a host. Accordingly, utilities of VGAM850 include diagnosis, prevention and treatment of viral infection by Lymphocystis Disease Virus 1. Specific functions, and accordingly utilities, of VGAM850 correlate with, and may be deduced from, the identity of the host target genes which VGAM850 binds and inhibits, and the function of these host target genes, as elaborated hereinbelow.

Nucleotide sequences of the VGAM850 precursor RNA, herein designated VGAM PRECURSOR RNA, and of the 'diced' VGAM850 RNA, herein designated VGAM RNA, and a schematic representation of the secondary folding of VGAM850 folded precursor RNA, herein designated VGAM FOLDED PRECURSOR RNA, of VGAM850 are further described hereinbelow with reference to Table 1.

Nucleotide sequences of host target binding sites, such as BINDING SITE-I, BINDING SITE-II and BINDING SITE-III of FIG. 1, found on VGAM850 host target RNA, and schematic representation of the complementarity of each of these host target binding sites to VGAM850 RNA, herein designated VGAM RNA, are described hereinbelow with reference to Table 2.

As mentioned hereinabove with reference to FIG. 1, a function of VGAM850 gene, herein designated VGAM is inhibition of expression of VGAM850 target genes. It is appreciated that specific functions, and accordingly utilities, of VGAM850 correlate with, and may be deduced from, the identity of the target genes which VGAM850 binds and inhibits, and the function of these target genes, as elaborated hereinbelow.

Actinin, Alpha 2 (ACTN2, Accession NM_001103) is a VGAM850 host target gene. ACTN2 BINDING SITE is HOST TARGET binding site found in the 3' untranslated region of mRNA encoded by ACTN2, corresponding to a HOST TARGET binding site such as BINDING SITE I, BINDING SITE II or BINDING SITE III. Table 2 illustrates the complementarity of the nucleotide sequences of ACTN2 BINDING SITE, designated SEQ ID:6758, to the nucleotide sequence of VGAM850 RNA, herein designated VGAM RNA, also designated SEQ ID:3561.

A function of VGAM850 is therefore inhibition of Actinin, Alpha 2 (ACTN2, Accession NM_001103), a gene which an actin-binding protein with multiple roles in different cell types. Accordingly, utilities of VGAM850 include diagnosis, prevention and treatment of diseases and clinical conditions associated with ACTN2. The function of ACTN2 and its association with various diseases and clinical conditions, has been established by previous studies, as described hereinabove with reference to VGAM88. UDP-Gal:betaGlcNAc Beta 1,4- Galactosyltransferase, Polypeptide 1 (B4GALT1, Accession NM_001497) is another VGAM850 host target gene. B4GALT1 BINDING SITE is HOST TARGET binding site found in the 3' untranslated region of mRNA encoded by B4GALT1, corresponding to a HOST TARGET binding site such as BINDING SITE I, BINDING SITE II or BINDING SITE III. Table 2 illustrates the complementarity of the nucleotide sequences of B4GALT1 BINDING SITE, designated SEQ ID:7247, to the nucleotide sequence of VGAM850 RNA, herein designated VGAM RNA, also designated SEQ ID:3561.

Another function of VGAM850 is therefore inhibition of UDP-Gal:betaGlcNAc Beta 1,4-Galactosyltransferase, Polypeptide 1 (B4GALT1, Accession NM_001497). Accordingly, utilities of VGAM850 include diagnosis, prevention and treatment of diseases and clinical conditions associated with B4GALT1. Bromodomain and PHD Finger Containing, 1 (BRPF1, Accession XM_054520) is another VGAM850 host target gene. BRPF1 BINDING SITE is HOST TARGET binding site found in the 3' untranslated region of mRNA encoded by BRPF1, corresponding to a HOST TARGET binding site such as BINDING SITE I, BINDING SITE II or BINDING SITE III. Table 2 illustrates the complementarity of the nucleotide sequences of BRPF1 BINDING SITE, designated SEQ ID:36174, to the nucleotide sequence of VGAM850 RNA, herein designated VGAM RNA, also designated SEQ ID:3561.

Another function of VGAM850 is therefore inhibition of Bromodomain and PHD Finger Containing, 1 (BRPF1, Accession XM_054520), a gene which has 6 zinc finger motifs and a bromodomain. Accordingly, utilities of VGAM850 include diagnosis, prevention and treatment of diseases and clinical conditions associated with BRPF1. The function of BRPF1 and its association with various diseases and clinical conditions, has been established by previous studies, as described hereinabove with reference to VGAM497. Carcinoembryonic Antigen-related Cell Adhesion Molecule 6 (non-specific cross reacting antigen) (CEACAM6, Accession NM_002483) is another VGAM850 host target gene. CEACAM6 BINDING SITE is HOST TARGET binding site found in the 3' untranslated region of mRNA encoded by CEACAM6, corresponding to a HOST TARGET binding site such as BINDING SITE I, BINDING SITE II or BINDING SITE III. Table 2 illustrates the complementarity of the nucleotide sequences of CEACAM6 BINDING SITE, designated SEQ ID:8310, to the nucleotide sequence of VGAM850 RNA, herein designated VGAM RNA, also designated SEQ ID:3561.

Another function of VGAM850 is therefore inhibition of Carcinoembryonic Antigen-related Cell Adhesion Molecule 6 (non-specific cross reacting antigen) (CEACAM6, Accession NM_002483), a gene which Non-specific cross reacting antigen). Accordingly, utilities of VGAM850 include diagnosis, prevention and treatment of diseases and clinical conditions associated with CEACAM6. The function of CEACAM6 and its association with various diseases and clinical conditions, has been established by previous studies, as described hereinabove with reference to VGAM286. Cartilage Associated Protein (CRTAP, Accession NM_006371) is another VGAM850 host target gene. CRTAP BINDING SITE is HOST TARGET binding site found in the 3' untranslated region of mRNA encoded by CRTAP, corresponding to a HOST TARGET binding site such as BINDING SITE I, BINDING SITE II or BINDING SITE III. Table 2 illustrates the complementarity of the nucleotide sequences of CRTAP BINDING SITE, designated SEQ ID:13062, to the nucleotide sequence of VGAM850 RNA, herein designated VGAM RNA, also designated SEQ ID:3561.

Another function of VGAM850 is therefore inhibition of Cartilage Associated Protein (CRTAP, Accession NM_006371), a gene which is a novel developmentally regulated chick embryo protein. Accordingly, utilities of VGAM850 include diagnosis, prevention and treatment of diseases and clinical conditions associated with CRTAP. The function of CRTAP and its association with various diseases and clinical conditions, has been established by previous studies, as described hereinabove with reference to VGAM152. Dipeptidylpeptidase IV (CD26, adenosine deaminase complexing protein 2) (DPP4, Accession NM_001935) is another VGAM850 host target gene. DPP4 BINDING SITE is HOST TARGET binding site found in the 3' untranslated region of mRNA encoded by DPP4, corresponding to a HOST TARGET binding site such as BINDING SITE I, BINDING SITE II or BINDING SITE III. Table 2 illustrates the complementarity of the nucleotide sequences of DPP4 BINDING SITE, designated SEQ ID:7648, to the nucleotide sequence of VGAM850 RNA, herein designated VGAM RNA, also designated SEQ ID:3561.

Another function of VGAM850 is therefore inhibition of Dipeptidylpeptidase IV (CD26, adenosine deaminase complexing protein 2) (DPP4, Accession NM_001935), a gene which removes n-terminal dipeptides sequentially from polypeptides. Accordingly, utilities of VGAM850 include diagnosis, prevention and treatment of diseases and clinical conditions associated with DPP4. The function of DPP4 has been established by previous studies. Koch and Shows (1979, 1980) concluded that at least 3 genes are involved in the expression of adenosine deaminase complexing protein: ADA (OMIM Ref. No. 102700) on chromosome 20, ADCP1 (OMIM Ref. No. 102710) on chromosome 6, and ADCP2 on chromosome 2. On the other hand, from studies in mouse-man and hamster-man hybrid cells, Herbschleb-Voogt et al. (1981) concluded that a gene or genes on human chromosome 2 determine the expression of ADCP and that neither chromosome 6 nor any other of the chromosomes of man carries genes involved in the formation of ADCP. Van Cong et al. (1981) concluded that the gene for ADCP on chromosome 2 is located between MDH1 (OMIM Ref. No. 154200) and IDH1 (OMIM Ref. No. 147700), i.e., in the segment 2p23-q32. Could one form of adenosine deaminase deficiency (leading to severe combined immunodeficiency) represent, in fact, deficiency of the complexing protein? Dipeptidyl peptidase IV (DPP4; EC 3.4.14.5) is identical to ADA complexing protein-2 and to the T-cell activation antigen CD26. DPP4 is a serine exopeptidase that cleaves X-proline dipeptides from the N terminus of polypeptides. It is an intrinsic membrane glycoprotein anchored into the cell membrane by its N-terminal end. High levels of the enzyme are found in the brush-border membranes of the kidney proximal tubule and of the small intestine, but several other tissues also express the enzyme. The enzyme is present in the fetal colon but disappears at birth. It is ectopically expressed in some human colon adenocarcinomas and human colon cancer cell lines. From such a colon cancer cell line, Darmoul et al. (1990) isolated a cDNA probe for intestinal dipeptidyl peptidase IV and, by Southern analysis of somatic cell hybrids, assigned the gene to chromosome 2. This assignment was confirmed by Mathew et al. (1994), who sublocalized the DPP4 gene to 2q23 by fluorescence in situ hybridization. Misumi et al. (1992) isolated and sequenced the cDNA coding for DPP4. The nucleotide sequence (3,465 bp) of the cDNA contained an open reading frame encoding a polypeptide comprising 766 amino acids, 1 residue less than those of the rat protein. The predicted amino acid sequence exhibited 84.9% identity to that of the rat enzyme.

Full details of the abovementioned studies are described in the following publications, the disclosure of which are hereby incorporated by reference:

Mathew, S.; Morrison, M. E.; Murty, V. V. V. S.; Houghton, A. N.; Chaganti, R. S. K.: Assignment of the DPP4 gene encoding adenosine deaminase binding protein (CD26/dipeptidylpeptidase IV) to 2q23. Genomics 22:211-212, 1994; and Van Cong, N.; Weil, D.; Gross, M.-S.; Foubert, C.; Jami, J.; Frezal, J.: Controle genetique et epigenetique de l'expression de l'adenosine deaminase. Analyse des cellules humaines et h.

Further studies establishing the function and utilities of DPP4 are found in John Hopkins OMIM database record ID 102720, and in sited publications numbered 2347-235 and 12114-2357 listed in the bibliography section hereinbelow, which are also hereby incorporated by reference. Follistatin-like 1 (FSTL1, Accession NM_007085) is another VGAM850 host target gene. FSTL1 BINDING SITE is HOST TARGET binding site found in the 3' untranslated region of mRNA encoded by FSTL1, corresponding to a HOST TARGET binding site such as BINDING SITE I, BINDING SITE II or BINDING SITE III. Table 2 illustrates the complementarity of the nucleotide sequences of FSTL1 BINDING SITE, designated SEQ ID:13952, to the nucleotide sequence of VGAM850 RNA, herein designated VGAM RNA, also designated SEQ ID:3561.

Another function of VGAM850 is therefore inhibition of Follistatin-like 1 (FSTL1, Accession NM_007085), a gene which may modulate the action of some growth factors on cell proliferation and differentiation. Accordingly, utilities of VGAM850 include diagnosis, prevention and treatment of diseases and clinical conditions associated with FSTL1. The function of FSTL1 and its association with various diseases and clinical conditions, has been established by previous studies, as described hereinabove with reference to VGAM791. Fucosyltransferase 9 (alpha (1,3) Fucosyltransferase) (FUT9, Accession XM_042167) is another VGAM850 host target gene. FUT9 BINDING SITE is HOST TARGET binding site found in the 3' untranslated region of mRNA encoded by FUT9, corresponding to a HOST TARGET binding site such as BINDING SITE I, BINDING SITE II or BINDING SITE III. Table 2 illustrates the complementarity of the nucleotide sequences of FUT9 BINDING SITE, designated SEQ ID:33701, to the nucleotide sequence of VGAM850 RNA, herein designated VGAM RNA, also designated SEQ ID:3561.

Another function of VGAM850 is therefore inhibition of Fucosyltransferase 9 (alpha (1,3) Fucosyltransferase) (FUT9, Accession XM_042167), a gene which catalyzes alpha-1,3 glycosidic linkages. Accordingly, utilities of VGAM850 include diagnosis, prevention and treatment of diseases and clinical conditions associated with FUT9. The function of FUT9 and its association with various diseases and clinical conditions, has been established by previous studies, as described hereinabove with reference to VGAM206. GM2 Ganglioside Activator Protein (GM2A, Accession XM_041978) is another VGAM850 host target gene. GM2A BINDING SITE is HOST TARGET binding site found in the 3' untranslated region of mRNA encoded by GM2A, corresponding to a HOST TARGET binding site such as BINDING SITE I, BINDING SITE II or BINDING SITE III. Table 2 illustrates the complementarity of the nucleotide sequences of GM2A BINDING SITE, designated SEQ ID:33660, to the nucleotide sequence of VGAM850 RNA, herein designated VGAM RNA, also designated SEQ ID:3561.

Another function of VGAM850 is therefore inhibition of GM2 Ganglioside Activator Protein (GM2A, Accession XM_041978). Accordingly, utilities of VGAM850 include diagnosis, prevention and treatment of diseases and clinical conditions associated with GM2A. Nucleoporin 62 kDa (NUP62, Accession NM_016553) is another VGAM850 host target gene. NUP62 BINDING SITE is HOST TARGET binding site found in the 3' untranslated region of mRNA encoded by NUP62, corresponding to a HOST TARGET binding site such as BINDING SITE I, BINDING SITE II or BINDING SITE III. Table 2 illustrates the complementarity of the nucleotide sequences of NUP62 BINDING SITE, designated SEQ ID:18629, to the nucleotide sequence of VGAM850 RNA, herein designated VGAM RNA, also designated SEQ ID:3561.

Another function of VGAM850 is therefore inhibition of Nucleoporin 62 kDa (NUP62, Accession NM_016553). Accordingly, utilities of VGAM850 include diagnosis, prevention and treatment of diseases and clinical conditions associated with NUP62. Pleiomorphic Adenoma Gene 1 (PLAG1, Accession NM_002655) is another VGAM850 host target gene. PLAG1 BINDING SITE is HOST TARGET binding site found in the 3' untranslated region of mRNA encoded by PLAG1, corresponding to a HOST TARGET binding site such as BINDING SITE I, BINDING SITE II or BINDING SITE III. Table 2 illustrates the complementarity of the nucleotide sequences of PLAG1 BINDING SITE, designated SEQ ID:8522, to the nucleotide sequence of VGAM850 RNA, herein designated VGAM RNA, also designated SEQ ID:3561.

Another function of VGAM850 is therefore inhibition of Pleiomorphic Adenoma Gene 1 (PLAG1, Accession NM_002655), a gene which contains a zinc finger domain. Accordingly, utilities of VGAM850 include diagnosis, prevention and treatment of diseases and clinical conditions associated with PLAG1. The function of PLAG1 and its association with various diseases and clinical conditions, has been established by previous studies, as described hereinabove with reference to VGAM29. Plexin A2 (PLXNA2, Accession NM_025179) is another VGAM850 host target gene. PLXNA2 BINDING SITE is HOST TARGET binding site found in the 3' untranslated region of mRNA encoded by PLXNA2, corresponding to a HOST TARGET binding site such as BINDING SITE I, BINDING SITE II or BINDING SITE III. Table 2 illustrates the complementarity of the nucleotide sequences of PLXNA2 BINDING SITE, designated SEQ ID:24815, to the nucleotide sequence of VGAM850 RNA, herein designated VGAM RNA, also designated SEQ ID:3561.

Another function of VGAM850 is therefore inhibition of Plexin A2 (PLXNA2, Accession NM_025179), a gene which is a transmembrane protein. Accordingly, utilities of VGAM850 include diagnosis, prevention and treatment of diseases and clinical conditions associated with PLXNA2. The function of PLXNA2 and its association with various diseases and clinical conditions, has been established by previous studies, as described hereinabove with reference to VGAM538. Protein Phosphatase 2, Regulatory Subunit B (B56), Beta Isoform (PPP2R5B, Accession NM_006244) is another VGAM850 host target gene. PPP2R5B BINDING SITE is HOST TARGET binding site found in the 3' untranslated region of mRNA encoded by PPP2R5B, corresponding to a HOST TARGET binding site such as BINDING SITE I, BINDING SITE II or BINDING SITE III. Table 2 illustrates the complementarity of the nucleotide sequences of PPP2R5B BINDING SITE, designated SEQ ID:12914, to the nucleotide sequence of VGAM850 RNA, herein designated VGAM RNA, also designated SEQ ID:3561.

Another function of VGAM850 is therefore inhibition of Protein Phosphatase 2, Regulatory Subunit B (B56), Beta Isoform (PPP2R5B, Accession NM_006244), a gene which is a regulatory subunit of protein phosphatase 2A. Accordingly, utilities of VGAM850 include diagnosis, prevention and treatment of diseases and clinical conditions associated with PPP2R5B. The function of PPP2R5B and its association with various diseases and clinical conditions, has been established by previous studies, as described hereinabove with reference to VGAM264. Transformation/transcription Domain-associated Protein (TRRAP, Accession NM_003496) is another VGAM850 host target gene. TRRAP BINDING SITE is HOST TARGET binding site found in the 3' untranslated region of mRNA encoded by TRRAP, corresponding to a HOST TARGET binding site such as BINDING SITE I, BINDING SITE II or BINDING SITE III. Table 2 illustrates the complementarity of the nucleotide sequences of TRRAP BINDING SITE, designated SEQ ID:9590, to the nucleotide sequence of VGAM850 RNA, herein designated VGAM RNA, also designated SEQ ID:3561.

Another function of VGAM850 is therefore inhibition of Transformation/transcription Domain-associated Protein (TRRAP, Accession NM_003496). Accordingly, utilities of VGAM850 include diagnosis, prevention and treatment of diseases and clinical conditions associated with TRRAP. Vitronectin (serum spreading factor, somatomedin B, complement S-protein) (VTN, Accession NM_000638) is another VGAM850 host target gene. VTN BINDING SITE is HOST TARGET binding site found in the 5' untranslated region of mRNA encoded by VTN, corresponding to a HOST TARGET binding site such as BINDING SITE I, BINDING SITE II or BINDING SITE III. Table 2 illustrates the complementarity of the nucleotide sequences of VTN BINDING SITE, designated SEQ ID:6273, to the nucleotide sequence of VGAM850 RNA, herein designated VGAM RNA, also designated SEQ ID:3561.

Another function of VGAM850 is therefore inhibition of Vitronectin (serum spreading factor, somatomedin B, complement S-protein) (VTN, Accession NM_000638), a gene which is a cell adhesion and spreading factor found in serum and tissues. Accordingly, utilities of VGAM850 include diagnosis, prevention and treatment of diseases and clinical conditions associated with VTN. The function of VTN has been established by previous studies. Vitronectin, also called serum spreading factor or complement S-protein, is a 75-kD glycoprotein in plasma and tissue. (S-protein is not to be confused with protein S (OMIM Ref. No. 176880).) A multifunctional protein, it promotes attachment and spreading of animal cells in vitro, inhibits cytolysis by the complement C5b-9 complex, and modulates antithrombin III-thrombin action in blood coagulation. The primary structure of vitronectin has been deduced from the sequence of its cloned cDNA (Jenne and Stanley, 1985; Preissner et al., 1986). Polymorphism of vitronectin of plasma has been demonstrated (Conlon et al., 1988; Kubota et al., 1988). Sun and Mosher (1989) demonstrated that the frequencies are different in Orientals and Caucasians. By use of high resolution fluorescence in situ hybridization (FISH), Fink et al. (1992) mapped the VTN gene to 17q11. The localization was confirmed by cohybridization with a centromere-specific alphoid probe.

Full details of the abovementioned studies are described in the following publications, the disclosure of which are hereby incorporated by reference:

Kubota, K.; Katayama, S.; Matsuda, M.; Hayashi, M.: Three types of vitronectin in human blood. Cell Struct. Funct. 13:123-128, 1988; and Sun, W. H.; Mosher, D. F.: Polymorphism of vitronectin. (Letter) Blood 73: 353-354, 1989.

Further studies establishing the function and utilities of VTN are found in John Hopkins OMIM database record ID 193190, and in sited publications numbered 14-19 listed in the bibliography section hereinbelow, which are also hereby incorporated by reference. Chromosome 22 Open Reading Frame 5 (C22orf5, Accession NM_012264) is another VGAM850 host target gene. C22orf5 BINDING SITE is HOST TARGET binding site found in the 3' untranslated region of mRNA encoded by C22orf5, corresponding to a HOST TARGET binding site such as BINDING SITE I, BINDING SITE II or BINDING SITE III. Table 2 illustrates the complementarity of the nucleotide sequences of C22orf5 BINDING SITE, designated SEQ ID:14584, to the nucleotide sequence of VGAM850 RNA, herein designated VGAM RNA, also designated SEQ ID:3561.

Another function of VGAM850 is therefore inhibition of Chromosome 22 Open Reading Frame 5 (C22orf5, Accession NM_012264). Accordingly, utilities of VGAM850 include diagnosis, prevention and treatment of diseases and clinical conditions associated with C22orf5. Caspase Recruitment Domain Family, Member 14 (CARD14, Accession NM_024110) is another VGAM850 host target gene. CARD14 BINDING SITE is HOST TARGET binding site found in the 3' untranslated region of mRNA encoded by CARD14, corresponding to a HOST TARGET binding site such as BINDING SITE I, BINDING SITE II or BINDING SITE III. Table 2 illustrates the complementarity of the nucleotide sequences of CARD14 BINDING SITE, designated SEQ ID:23557, to the nucleotide sequence of VGAM850 RNA, herein designated VGAM RNA, also designated SEQ ID:3561.

Another function of VGAM850 is therefore inhibition of Caspase Recruitment Domain Family, Member 14 (CARD14, Accession NM_024110). Accordingly, utilities of VGAM850 include diagnosis, prevention and treatment of diseases and clinical conditions associated with CARD14. Carcinoembryonic Antigen-related Cell Adhesion Molecule 7 (CEACAM7, Accession NM_006890) is another VGAM850 host target gene. CEACAM7 BINDING SITE is HOST TARGET binding site found in the 3' untranslated region of mRNA encoded by CEACAM7, corresponding to a HOST TARGET binding site such as BINDING SITE I, BINDING SITE II or BINDING SITE III. Table 2 illustrates the complementarity of the nucleotide sequences of CEACAM7 BINDING SITE, designated SEQ ID:13757, to the nucleotide sequence of VGAM850 RNA, herein designated VGAM RNA, also designated SEQ ID:3561.

Another function of VGAM850 is therefore inhibition of Carcinoembryonic Antigen-related Cell Adhesion Molecule 7 (CEACAM7, Accession NM_006890). Accordingly, utilities of VGAM850 include diagnosis, prevention and treatment of diseases and clinical conditions associated with CEACAM7. Centaurin, Gamma 2 (CENTG2, Accession NM_014914) is another VGAM850 host target gene. CENTG2 BINDING SITE is HOST TARGET binding site found in the 3' untranslated region of mRNA encoded by CENTG2, corresponding to a HOST TARGET binding site such as BINDING SITE I, BINDING SITE II or BINDING SITE III. Table 2 illustrates the complementarity of the nucleotide sequences of CENTG2 BINDING SITE, designated SEQ ID:17159, to the nucleotide sequence of VGAM850 RNA, herein designated VGAM RNA, also designated SEQ ID:3561.

Another function of VGAM850 is therefore inhibition of Centaurin, Gamma 2 (CENTG2, Accession NM_014914). Accordingly, utilities of VGAM850 include diagnosis, prevention and treatment of diseases and clinical conditions associated with CENTG2. CUG Triplet Repeat, RNA Binding Protein 2 (CUGBP2, Accession NM_006561) is another VGAM850 host target gene. CUGBP2 BINDING SITE is HOST TARGET binding site found in the 3' untranslated region of mRNA encoded by CUGBP2, corresponding to a HOST TARGET binding site such as BINDING SITE I, BINDING SITE II or BINDING SITE III. Table 2 illustrates the complementarity of the nucleotide sequences of CUGBP2 BINDING SITE, designated SEQ ID:13331, to the nucleotide sequence of VGAM850 RNA, herein designated VGAM RNA, also designated SEQ ID:3561.

Another function of VGAM850 is therefore inhibition of CUG Triplet Repeat, RNA Binding Protein 2 (CUGBP2, Accession NM_006561). Accordingly, utilities of VGAM850 include diagnosis, prevention and treatment of diseases and clinical conditions associated with CUGBP2. CXYorf1 (Accession XM_088704) is another VGAM850 host target gene. CXYorf1 BINDING SITE is HOST TARGET binding site found in the 5' untranslated region of mRNA encoded by CXYorf1, corresponding to a HOST TARGET binding site such as BINDING SITE I, BINDING SITE II or BINDING SITE III. Table 2 illustrates the complementarity of the nucleotide sequences of CXYorf1 BINDING SITE, designated SEQ ID:39909, to the nucleotide sequence of VGAM850 RNA, herein designated VGAM RNA, also designated SEQ ID:3561.

Another function of VGAM850 is therefore inhibition of CXYorf1 (Accession XM_088704). Accordingly, utilities of VGAM850 include diagnosis, prevention and treatment of diseases and clinical conditions associated with CXYorf1. FLJ10716 (Accession NM_018191) is another VGAM850 host target gene. FLJ10716 BINDING SITE is HOST TARGET binding site found in the 3' untranslated region of mRNA encoded by FLJ10716, corresponding to a HOST TARGET binding site such as BINDING SITE I, BINDING SITE II or BINDING SITE III. Table 2 illustrates the complementarity of the nucleotide sequences of FLJ10716 BINDING SITE, designated SEQ ID:20047, to the nucleotide sequence of VGAM850 RNA, herein designated VGAM RNA, also designated SEQ ID:3561.

Another function of VGAM850 is therefore inhibition of FLJ10716 (Accession NM_018191). Accordingly, utilities of VGAM850 include diagnosis, prevention and treatment of diseases and clinical conditions associated with FLJ10716.

FLJ10719 (Accession XM_031328) is another VGAM850 host target gene. FLJ10719 BINDING SITE is HOST TARGET binding site found in the 3' untranslated region of mRNA encoded by FLJ10719, corresponding to a HOST TARGET binding site such as BINDING SITE I, BINDING SITE II or BINDING SITE III. Table 2 illustrates the complementarity of the nucleotide sequences of FLJ10719 BINDING SITE, designated SEQ ID:31340, to the nucleotide sequence of VGAM850 RNA, herein designated VGAM RNA, also designated SEQ ID:3561.

Another function of VGAM850 is therefore inhibition of FLJ10719 (Accession XM_031328). Accordingly, utilities of VGAM850 include diagnosis, prevention and treatment of diseases and clinical conditions associated with FLJ10719. FLJ20296 (Accession NM_017750) is another VGAM850 host target gene. FLJ20296 BINDING SITE is HOST TARGET binding site found in the 3' untranslated region of mRNA encoded by FLJ20296, corresponding to a HOST TARGET binding site such as BINDING SITE I, BINDING SITE II or BINDING SITE III. Table 2 illustrates the complementarity of the nucleotide sequences of FLJ20296 BINDING SITE, designated SEQ ID:19355, to the nucleotide sequence of VGAM850 RNA, herein designated VGAM RNA, also designated SEQ ID:3561.

Another function of VGAM850 is therefore inhibition of FLJ20296 (Accession NM_017750). Accordingly, utilities of VGAM850 include diagnosis, prevention and treatment of diseases and clinical conditions associated with FLJ20296. FLJ20772 (Accession NM_017956) is another VGAM850 host target gene. FLJ20772 BINDING SITE is HOST TARGET binding site found in the 3' untranslated region of mRNA encoded by FLJ20772, corresponding to a HOST TARGET binding site such as BINDING SITE I, BINDING SITE II or BINDING SITE III. Table 2 illustrates the complementarity of the nucleotide sequences of FLJ20772 BINDING SITE, designated SEQ ID:19666, to the nucleotide sequence of VGAM850 RNA, herein designated VGAM RNA, also designated SEQ ID:3561.

Another function of VGAM850 is therefore inhibition of FLJ20772 (Accession NM_017956). Accordingly, utilities of VGAM850 include diagnosis, prevention and treatment of diseases and clinical conditions associated with FLJ20772. FLJ22215 (Accession XM_173021) is another VGAM850 host target gene. FLJ22215 BINDING SITE is HOST TARGET binding site found in the 3' untranslated region of mRNA encoded by FLJ22215, corresponding to a HOST TARGET binding site such as BINDING SITE I, BINDING SITE II or BINDING SITE III. Table 2 illustrates the complementarity of the nucleotide sequences of FLJ22215 BINDING SITE, designated SEQ ID:46282, to the nucleotide sequence of VGAM850 RNA, herein designated VGAM RNA, also designated SEQ ID:3561.

Another function of VGAM850 is therefore inhibition of FLJ22215 (Accession XM_173021). Accordingly, utilities of VGAM850 include diagnosis, prevention and treatment of diseases and clinical conditions associated with FLJ22215. FLJ32752 (Accession NM_144666) is another VGAM850 host target gene. FLJ32752 BINDING SITE is HOST TARGET binding site found in the 5' untranslated region of mRNA encoded by FLJ32752, corresponding to a HOST TARGET binding site such as BINDING SITE I, BINDING SITE II or BINDING SITE III. Table 2 illustrates the complementarity of the nucleotide sequences of FLJ32752 BINDING SITE, designated SEQ ID:29482, to the nucleotide sequence of VGAM850 RNA, herein designated VGAM RNA, also designated SEQ ID:3561.

Another function of VGAM850 is therefore inhibition of FLJ32752 (Accession NM_144666). Accordingly, utilities of VGAM850 include diagnosis, prevention and treatment of diseases and clinical conditions associated with FLJ32752. GRB2-associated Binding Protein 3 (GAB3, Accession NM_080612) is another VGAM850 host target gene. GAB3 BINDING SITE is HOST TARGET binding site found in the 3' untranslated region of mRNA encoded by GAB3, corresponding to a HOST TARGET binding site such as BINDING SITE I, BINDING SITE II or BINDING SITE III. Table 2 illustrates the complementarity of the nucleotide sequences of GAB3 BINDING SITE, designated SEQ ID:27928, to the nucleotide sequence of VGAM850 RNA, herein designated VGAM RNA, also designated SEQ ID:3561.

Another function of VGAM850 is therefore inhibition of GRB2-associated Binding Protein 3 (GAB3, Accession NM_080612). Accordingly, utilities of VGAM850 include diagnosis, prevention and treatment of diseases and clinical conditions associated with GAB3. GR6 (Accession NM_007354) is another VGAM850 host target gene. GR6 BINDING SITE is HOST TARGET binding site found in the 3' untranslated region of mRNA encoded by GR6, corresponding to a HOST TARGET binding site such as BINDING SITE I, BINDING SITE II or BINDING SITE III. Table 2 illustrates the complementarity of the nucleotide sequences of GR6 BINDING SITE, designated SEQ ID:14284, to the nucleotide sequence of VGAM850 RNA, herein designated VGAM RNA, also designated SEQ ID:3561.

Another function of VGAM850 is therefore inhibition of GR6 (Accession NM_007354). Accordingly, utilities of VGAM850 include diagnosis, prevention and treatment of diseases and clinical conditions associated with GR6. HSPC213 (Accession NM_016475) is another VGAM850 host target gene. HSPC213 BINDING SITE is HOST TARGET binding site found in the 3' untranslated region of mRNA encoded by HSPC213, corresponding to a HOST TARGET binding site such as BINDING SITE I, BINDING SITE II or BINDING SITE III. Table 2 illustrates the complementarity of the nucleotide sequences of HSPC213 BINDING SITE, designated SEQ ID:18576, to the nucleotide sequence of VGAM850 RNA, herein designated VGAM RNA, also designated SEQ ID:3561.

Another function of VGAM850 is therefore inhibition of HSPC213 (Accession NM_016475). Accordingly, utilities of VGAM850 include diagnosis, prevention and treatment of diseases and clinical conditions associated with HSPC213. Interleukin 17D (IL17D, Accession NM_138284) is another VGAM850 host target gene. IL17D BINDING SITE is HOST TARGET binding site found in the 3' untranslated region of mRNA encoded by IL17D, corresponding to a HOST TARGET binding site such as BINDING SITE I, BINDING SITE II or BINDING SITE III. Table 2 illustrates the complementarity of the nucleotide sequences of IL17D BINDING SITE, designated SEQ ID:28700, to the nucleotide sequence of VGAM850 RNA, herein designated VGAM RNA, also designated SEQ ID:3561.

Another function of VGAM850 is therefore inhibition of Interleukin 17D (IL17D, Accession NM_138284). Accordingly, utilities of VGAM850 include diagnosis, prevention and treatment of diseases and clinical conditions associated with IL17D. KH Domain Containing, RNA Binding, Signal Transduction Associated 1 (KHDRBS1, Accession NM_006559) is another VGAM850 host target gene. KHDRBS1 BINDING SITE is HOST TARGET binding site found in the 3' untranslated region of mRNA encoded by KHDRBS1, corresponding to a HOST TARGET binding site such as BINDING SITE I, BINDING SITE II or BINDING SITE III. Table 2 illustrates the complementarity of the nucleotide sequences of KHDRBS1 BINDING SITE, designated SEQ ID:13328, to the nucleotide sequence of VGAM850 RNA, herein designated VGAM RNA, also designated SEQ ID:3561.

Another function of VGAM850 is therefore inhibition of KH Domain Containing, RNA Binding, Signal Transduction Associated 1 (KHDRBS1, Accession NM_006559). Accordingly, utilities of VGAM850 include diagnosis, prevention and treatment of diseases and clinical conditions associated with KHDRBS1. KIAA0298 (Accession XM_084529) is another VGAM850 host target gene. KIAA0298 BINDING SITE is HOST TARGET binding site found in the 3' untranslated region of mRNA encoded by KIAA0298, corresponding to a HOST TARGET binding site such as BINDING SITE I, BINDING SITE II or BINDING SITE III. Table 2 illustrates the complementarity of the nucleotide sequences of KIAA0298 BINDING SITE, designated SEQ ID:37627, to the nucleotide sequence of VGAM850 RNA, herein designated VGAM RNA, also designated SEQ ID:3561.

Another function of VGAM850 is therefore inhibition of KIAA0298 (Accession XM_084529). Accordingly, utilities of VGAM850 include diagnosis, prevention and treatment of diseases and clinical conditions associated with KIAA0298. KIAA0461 (Accession XM_047883) is another VGAM850 host target gene. KIAA0461 BINDING SITE is HOST TARGET binding site found in the 3' untranslated region of mRNA encoded by KIAA0461, corresponding to a HOST TARGET binding site such as BINDING SITE I, BINDING SITE II or BINDING SITE III. Table 2 illustrates the complementarity of the nucleotide sequences of KIAA0461 BINDING SITE, designated SEQ ID:35075, to the nucleotide sequence of VGAM850 RNA, herein designated VGAM RNA, also designated SEQ ID:3561.

Another function of VGAM850 is therefore inhibition of KIAA0461 (Accession XM_047883). Accordingly, utilities of VGAM850 include diagnosis, prevention and treatment of diseases and clinical conditions associated with KIAA0461. KIAA0493 (Accession XM_034717) is another VGAM850 host target gene. KIAA0493 BINDING SITE is HOST TARGET binding site found in the 3' untranslated region of mRNA encoded by KIAA0493, corresponding to a HOST TARGET binding site such as BINDING SITE I, BINDING SITE II or BINDING SITE III. Table 2 illustrates the complementarity of the nucleotide sequences of KIAA0493 BINDING SITE, designated SEQ ID:32142, to the nucleotide sequence of VGAM850 RNA, herein designated VGAM RNA, also designated SEQ ID:3561.

Another function of VGAM850 is therefore inhibition of KIAA0493 (Accession XM_034717). Accordingly, utilities of VGAM850 include diagnosis, prevention and treatment of diseases and clinical conditions associated with KIAA0493. KIAA0766 (Accession NM_014805) is another VGAM850 host target gene. KIAA0766 BINDING SITE is HOST TARGET binding site found in the 3' untranslated region of mRNA encoded by KIAA0766, corresponding to a HOST TARGET binding site such as BINDING SITE I, BINDING SITE II or BINDING SITE III. Table 2 illustrates the complementarity of the nucleotide sequences of KIAA0766 BINDING SITE, designated SEQ ID:16743, to the nucleotide sequence of VGAM850 RNA, herein designated VGAM RNA, also designated SEQ ID:3561.

Another function of VGAM850 is therefore inhibition of KIAA0766 (Accession NM_014805). Accordingly, utilities of VGAM850 include diagnosis, prevention and treatment of diseases and clinical conditions associated with KIAA0766. KIAA0853 (Accession NM_015070) is another VGAM850 host target gene. KIAA0853 BINDING SITE is HOST TARGET binding site found in the 3' untranslated region of mRNA encoded by KIAA0853, corresponding to a HOST TARGET binding site such as BINDING SITE I, BINDING SITE II or BINDING SITE III. Table 2 illustrates the complementarity of the nucleotide sequences of KIAA0853 BINDING SITE, designated SEQ ID:17437, to the nucleotide sequence of VGAM850 RNA, herein designated VGAM RNA, also designated SEQ ID:3561.

Another function of VGAM850 is therefore inhibition of KIAA0853 (Accession NM_015070). Accordingly, utilities of VGAM850 include diagnosis, prevention and treatment of diseases and clinical conditions associated with KIAA0853. KIAA0978 (Accession XM_047013) is another VGAM850 host target gene. KIAA0978 BINDING SITE is HOST TARGET binding site found in the 3' untranslated region of mRNA encoded by KIAA0978, corresponding to a HOST TARGET binding site such as BINDING SITE I, BINDING SITE II or BINDING SITE III. Table 2 illustrates the complementarity of the nucleotide sequences of KIAA0978 BINDING SITE, designated SEQ ID:34887, to the nucleotide sequence of VGAM850 RNA, herein designated VGAM RNA, also designated SEQ ID:3561.

Another function of VGAM850 is therefore inhibition of KIAA0978 (Accession XM_047013). Accordingly, utilities of VGAM850 include diagnosis, prevention and treatment of diseases and clinical conditions associated with KIAA0978. KIAA1530 (Accession XM_042661) is another VGAM850 host target gene. KIAA1530 BINDING SITE is HOST TARGET binding site found in the 3' untranslated region of mRNA encoded by KIAA1530, corresponding to a HOST TARGET binding site such as BINDING SITE I, BINDING SITE II or BINDING SITE III. Table 2 illustrates the complementarity of the nucleotide sequences of KIAA1530 BINDING SITE, designated SEQ ID:33735, to the nucleotide sequence of VGAM850 RNA, herein designated VGAM RNA, also designated SEQ ID:3561.

Another function of VGAM850 is therefore inhibition of KIAA1530 (Accession XM_042661). Accordingly, utilities of VGAM850 include diagnosis, prevention and treatment of diseases and clinical conditions associated with KIAA1530. KIAA1559 (Accession XM_054472) is another VGAM850 host target gene. KIAA1559 BINDING SITE is HOST TARGET binding site found in the 3' untranslated region of mRNA encoded by KIAA1559, corresponding to a HOST TARGET binding site such as BINDING SITE I, BINDING SITE II or BINDING SITE III. Table 2 illustrates the complementarity of the nucleotide sequences of KIAA1559 BINDING SITE, designated SEQ ID:36164, to the nucleotide sequence of VGAM850 RNA, herein designated VGAM RNA, also designated SEQ ID:3561.

Another function of VGAM850 is therefore inhibition of KIAA1559 (Accession XM_054472). Accordingly, utilities of VGAM850 include diagnosis, prevention and treatment of diseases and clinical conditions associated with KIAA1559. MGC2835 (Accession NM_024072) is another VGAM850 host target gene. MGC2835 BINDING SITE is HOST TARGET binding site found in the 3' untranslated region of mRNA encoded by MGC2835, corresponding to a HOST TARGET binding site such as BINDING SITE I, BINDING SITE II or BINDING SITE III. Table 2 illustrates the complementarity of the nucleotide sequences of MGC2835 BINDING SITE, designated SEQ ID:23506, to the nucleotide sequence of VGAM850 RNA, herein designated VGAM RNA, also designated SEQ ID:3561.

Another function of VGAM850 is therefore inhibition of MGC2835 (Accession NM_024072). Accordingly, utilities of VGAM850 include diagnosis, prevention and treatment of diseases and clinical conditions associated with MGC2835. MGC2865 (Accession NM_032375) is another VGAM850 host target gene. MGC2865 BINDING SITE is HOST TARGET binding site found in the 5' untranslated region of mRNA encoded by MGC2865, corresponding to a HOST TARGET binding site such as BINDING SITE I, BINDING SITE II or BINDING SITE III. Table 2 illustrates the complementarity of the nucleotide sequences of MGC2865 BINDING SITE, designated SEQ ID:26168, to the nucleotide sequence of VGAM850 RNA, herein designated VGAM RNA, also designated SEQ ID:3561.

Another function of VGAM850 is therefore inhibition of MGC2865 (Accession NM_032375). Accordingly, utilities of VGAM850 include diagnosis, prevention and treatment of diseases and clinical conditions associated with MGC2865. MGC3130 (Accession NM_024032) is another VGAM850 host target gene. MGC3130 BINDING SITE is HOST TARGET binding site found in the 3' untranslated region of mRNA encoded by MGC3130, corresponding to a HOST TARGET binding site such as BINDING SITE I, BINDING SITE II or BINDING SITE III. Table 2 illustrates the complementarity of the nucleotide sequences of MGC3130 BINDING SITE, designated SEQ ID:23461, to the nucleotide sequence of VGAM850 RNA, herein designated VGAM RNA, also designated SEQ ID:3561.

Another function of VGAM850 is therefore inhibition of MGC3130 (Accession NM_024032). Accordingly, utilities of VGAM850 include diagnosis, prevention and treatment of diseases and clinical conditions associated with MGC3130. moblak (Accession NM_130807) is another VGAM850 host target gene. moblak BINDING SITE is HOST TARGET binding site found in the 3" untranslated region of mRNA encoded by moblak, corresponding to a HOST TARGET binding site such as BINDING SITE I, BINDING SITE II or BINDING SITE III. Table 2 illustrates the complementarity of the nucleotide sequences of moblak BINDING SITE, designated SEQ ID:28309, to the nucleotide sequence of VGAM850 RNA, herein designated VGAM RNA, also designated SEQ ID:3561.

Another function of VGAM850 is therefore inhibition of moblak (Accession NM_130807). Accordingly, utilities of VGAM850 include diagnosis, prevention and treatment of diseases and clinical conditions associated with moblak. Myozenin 2 (MYOZ2, Accession NM_016599) is another VGAM850 host target gene. MYOZ2 BINDING SITE is HOST TARGET binding site found in the 3' untranslated region of mRNA encoded by MYOZ2, corresponding to a HOST TARGET binding site such as BINDING SITE I, BINDING SITE II or BINDING SITE III. Table 2 illustrates the complementarity of the nucleotide sequences of MYOZ2 BINDING SITE, designated SEQ ID:18692, to the nucleotide sequence of VGAM850 RNA, herein designated VGAM RNA, also designated SEQ ID:3561.

Another function of VGAM850 is therefore inhibition of Myozenin 2 (MYOZ2, Accession NM_016599). Accordingly, utilities of VGAM850 include diagnosis, prevention and treatment of diseases and clinical conditions associated with MYOZ2. NDP52 (Accession NM_005831) is another VGAM850 host target gene. NDP52 BINDING SITE is HOST TARGET binding site found in the 3' untranslated region of mRNA encoded by NDP52, corresponding to a HOST TARGET binding site such as BINDING SITE I, BINDING SITE II or BINDING SITE III. Table 2 illustrates the complementarity of the nucleotide sequences of NDP52 BINDING SITE, designated SEQ ID:12444, to the nucleotide sequence of VGAM850 RNA, herein designated VGAM RNA, also designated SEQ ID:3561.

Another function of VGAM850 is therefore inhibition of NDP52 (Accession NM_005831). Accordingly, utilities of VGAM850 include diagnosis, prevention and treatment of diseases and clinical conditions associated with NDP52. Nei Like 2 (*E. coli*) (NEIL2, Accession NM_145043) is another VGAM850 host target gene. NEIL2 BINDING SITE is HOST TARGET binding site found in the 3' untranslated region of mRNA encoded by NEIL2, corresponding to a HOST TARGET binding site such as BINDING SITE I, BINDING SITE II or BINDING SITE III. Table 2 illustrates the complementarity of the nucleotide sequences of NEIL2 BINDING SITE, designated SEQ ID:29675, to the nucleotide sequence of VGAM850 RNA, herein designated VGAM RNA, also designated SEQ ID:3561.

Another function of VGAM850 is therefore inhibition of Nei Like 2 (*E. coli*) (NEIL2, Accession NM_145043). Accordingly, utilities of VGAM850 include diagnosis, prevention and treatment of diseases and clinical conditions associated with NEIL2. NRF (Accession NM_017544) is another VGAM850 host target gene. NRF BINDING SITE is HOST TARGET binding site found in the 5' untranslated region of mRNA encoded by NRF, corresponding to a HOST TARGET binding site such as BINDING SITE I, BINDING SITE II or BINDING SITE III. Table 2 illustrates the complementarity of the nucleotide sequences of NRF BINDING SITE, designated SEQ ID:18988, to the nucleotide sequence of VGAM850 RNA, herein designated VGAM RNA, also designated SEQ ID:3561.

Another function of VGAM850 is therefore inhibition of NRF (Accession NM_017544). Accordingly, utilities of VGAM850 include diagnosis, prevention and treatment of diseases and clinical conditions associated with NRF. Nudix (nucleoside diphosphate linked moiety X)-type Motif 11 (NUDT11, Accession XM_010230) is another VGAM850 host target gene. NUDT11 BINDING SITE is HOST TARGET binding site found in the 3' untranslated region of mRNA encoded by NUDT11, corresponding to a HOST TARGET binding site such as BINDING SITE I, BINDING SITE II or BINDING SITE III. Table 2 illustrates the complementarity of the nucleotide sequences of NUDT11 BINDING SITE, designated SEQ ID:30144, to the nucleotide sequence of VGAM850 RNA, herein designated VGAM RNA, also designated SEQ ID:3561.

Another function of VGAM850 is therefore inhibition of Nudix (nucleoside diphosphate linked moiety X)-type Motif 11 (NUDT11, Accession XM_010230). Accordingly, utilities of VGAM850 include diagnosis, prevention and treatment of diseases and clinical conditions associated with NUDT11. Protein Kinase C and Casein Kinase Substrate In Neurons 2 (PACSIN2, Accession NM_007229) is another VGAM850 host target gene. PACSIN2 BINDING SITE is HOST TARGET binding site found in the 3' untranslated region of mRNA encoded by PACSIN2, corresponding to a HOST TARGET binding site such as BINDING SITE I, BINDING SITE II or BINDING SITE III. Table 2 illustrates the complementarity of the nucleotide sequences of PACSIN2 BINDING SITE, designated SEQ ID:14097, to the nucleotide sequence of VGAM850 RNA, herein designated VGAM RNA, also designated SEQ ID:3561.

Another function of VGAM850 is therefore inhibition of Protein Kinase C and Casein Kinase Substrate In Neurons 2 (PACSIN2, Accession NM_007229). Accordingly, utilities of VGAM850 include diagnosis, prevention and treatment of diseases and clinical conditions associated with PACSIN2. Protein Phosphatase 1, Regulatory Subunit 10 (PPP1R10, Accession NM_002714) is another VGAM850 host target gene. PPP1R10 BINDING SITE is HOST TARGET binding site found in the 3' untranslated region of mRNA encoded by PPP1R10, corresponding to a HOST TARGET binding site such as BINDING SITE I, BINDING SITE II or BINDING SITE III. Table 2 illustrates the complementarity of the nucleotide sequences of PPP1R10 BINDING SITE, designated SEQ ID:8577, to the nucleotide sequence of VGAM850 RNA, herein designated VGAM RNA, also designated SEQ ID:3561.

Another function of VGAM850 is therefore inhibition of Protein Phosphatase 1, Regulatory Subunit 10 (PPP1R10, Accession NM_002714). Accordingly, utilities of VGAM850 include diagnosis, prevention and treatment of diseases and clinical conditions associated with PPP1R10. RBT1 (Accession NM_013368) is another VGAM850 host target gene. RBT1 BINDING SITE is HOST TARGET binding site found in the 3' untranslated region of mRNA encoded by RBT1, corresponding to a HOST TARGET binding site such as BINDING SITE I, BINDING SITE II or BINDING SITE III. Table 2 illustrates the complementarity of the nucleotide sequences of RBT1 BINDING SITE, designated SEQ ID:15011, to the nucleotide sequence of VGAM850 RNA, herein designated VGAM RNA, also designated SEQ ID:3561.

Another function of VGAM850 is therefore inhibition of RBT1 (Accession NM_013368). Accordingly, utilities of VGAM850 include diagnosis, prevention and treatment of diseases and clinical conditions associated with RBT1. Solute Carrier Family 39 (zinc transporter), Member 3 (SLC39A3, Accession NM_144564) is another VGAM850 host target gene. SLC39A3 BINDING SITE is HOST TARGET binding site found in the 3' untranslated region of mRNA encoded by SLC39A3, corresponding to a HOST TARGET binding site such as BINDING SITE I, BINDING SITE II or BINDING SITE III. Table 2 illustrates the complementarity of the nucleotide sequences of SLC39A3 BINDING SITE, designated SEQ ID:29359, to the nucleotide sequence of VGAM850 RNA, herein designated VGAM RNA, also designated SEQ ID:3561.

Another function of VGAM850 is therefore inhibition of Solute Carrier Family 39 (zinc transporter), Member 3 (SLC39A3, Accession NM_144564). Accordingly, utilities of VGAM850 include diagnosis, prevention and treatment of diseases and clinical conditions associated with SLC39A3. SV2 (Accession NM_014849) is another VGAM850 host target gene. SV2 BINDING SITE is HOST TARGET binding site found in the 3' untranslated region of mRNA encoded by SV2, corresponding to a HOST TARGET binding site such as BINDING SITE I, BINDING SITE II or BINDING SITE III. Table 2 illustrates the complementarity of the nucleotide sequences of SV2 BINDING SITE, designated SEQ ID:16885, to the nucleotide sequence of VGAM850 RNA, herein designated VGAM RNA, also designated SEQ ID:3561.

Another function of VGAM850 is therefore inhibition of SV2 (Accession NM_014849). Accordingly, utilities of VGAM850 include diagnosis, prevention and treatment of diseases and clinical conditions associated with SV2. TAF9-like RNA Polymerase II, TATA Box Binding Protein (TBP)-associated Factor, 31 kDa (TAF9L, Accession NM_015975) is another VGAM850 host target gene. TAF9L BINDING SITE is HOST TARGET binding site found in the 3' untranslated region of mRNA encoded by TAF9L, corresponding to a HOST TARGET binding site such as BINDING SITE I, BINDING SITE II or BINDING SITE III. Table 2 illustrates the complementarity of the nucleotide sequences of TAF9L BINDING SITE, designated SEQ ID:18075, to the nucleotide sequence of VGAM850 RNA, herein designated VGAM RNA, also designated SEQ ID:3561.

Another function of VGAM850 is therefore inhibition of TAF9-like RNA Polymerase II, TATA Box Binding Protein (TBP)-associated Factor, 31 kDa (TAF9L, Accession NM_015975). Accordingly, utilities of VGAM850 include diagnosis, prevention and treatment of diseases and clinical conditions associated with TAF9L. TUBB5 (Accession NM_006087) is another VGAM850 host target gene. TUBB5 BINDING SITE is HOST TARGET binding site found in the 3' untranslated region of mRNA encoded by TUBB5, corresponding to a HOST TARGET binding site such as BINDING SITE I, BINDING SITE II or BINDING SITE III. Table 2 illustrates the complementarity of the nucleotide sequences of TUBB5 BINDING SITE, designated SEQ ID:12730, to the nucleotide sequence of VGAM850 RNA, herein designated VGAM RNA, also designated SEQ ID:3561.

Another function of VGAM850 is therefore inhibition of TUBB5 (Accession NM_006087). Accordingly, utilities of VGAM850 include diagnosis, prevention and treatment of diseases and clinical conditions associated with TUBB5. Upstream Binding Protein 1 (LBP-1a) (UBP1, Accession NM_014517) is another VGAM850 host target gene. UBP1 BINDING SITE is HOST TARGET binding site found in the 3' untranslated region of mRNA encoded by UBP1, corresponding to a HOST TARGET binding site such as BINDING SITE I, BINDING SITE II or BINDING SITE III. Table 2 illustrates the complementarity of the nucleotide sequences of UBP1 BINDING SITE, designated SEQ ID:15847, to the nucleotide sequence of VGAM850 RNA, herein designated VGAM RNA, also designated SEQ ID:3561.

Another function of VGAM850 is therefore inhibition of Upstream Binding Protein 1 (LBP-1a) (UBP1, Accession NM_014517). Accordingly, utilities of VGAM850 include diagnosis, prevention and treatment of diseases and clinical conditions associated with UBP1. LOC125456 (Accession XM_064620) is another VGAM850 host target gene. LOC125456 BINDING SITE is HOST TARGET binding site found in the 5' untranslated region of mRNA encoded by LOC125456, corresponding to a HOST TARGET binding site such as BINDING SITE I, BINDING SITE II or BINDING SITE III. Table 2 illustrates the complementarity of the nucleotide sequences of LOC125456 BINDING SITE, designated SEQ ID:37266, to the nucleotide sequence of VGAM850 RNA, herein designated VGAM RNA, also designated SEQ ID:3561.

Another function of VGAM850 is therefore inhibition of LOC125456 (Accession XM_064620). Accordingly, utilities of VGAM850 include diagnosis, prevention and treatment of diseases and clinical conditions associated with LOC125456. LOC125929 (Accession XM_064872) is another VGAM850 host target gene. LOC125929 BINDING SITE is HOST TARGET binding site found in the 3' untranslated region of mRNA encoded by LOC125929, corresponding to a HOST TARGET binding site such as BINDING SITE I, BINDING SITE II or BINDING SITE III. Table 2 illustrates the complementarity of the nucleotide sequences of LOC125929 BINDING SITE, designated SEQ ID:37269, to the nucleotide sequence of VGAM850 RNA, herein designated VGAM RNA, also designated SEQ ID:3561.

Another function of VGAM850 is therefore inhibition of LOC125929 (Accession XM_064872). Accordingly, utilities of VGAM850 include diagnosis, prevention and treatment of diseases and clinical conditions associated with LOC125929. LOC144438 (Accession XM_084860) is another VGAM850 host target gene. LOC144438 BINDING SITE is HOST TARGET binding site found in the 3' untranslated region of mRNA encoded by LOC144438, corresponding to a HOST TARGET binding site such as BINDING SITE I, BINDING SITE II or BINDING SITE III. Table 2 illustrates the complementarity of the nucleotide sequences of LOC144438 BINDING SITE, designated SEQ ID:37738, to the nucleotide sequence of VGAM850 RNA, herein designated VGAM RNA, also designated SEQ ID:3561.

Another function of VGAM850 is therefore inhibition of LOC144438 (Accession XM_084860). Accordingly, utilities of VGAM850 include diagnosis, prevention and treatment of diseases and clinical conditions associated with LOC144438. LOC146733 (Accession XM_097076) is another VGAM850 host target gene. LOC146733 BINDING SITE is HOST TARGET binding site found in the 3' untranslated region of mRNA encoded by LOC146733, corresponding to a HOST TARGET binding site such as BINDING SITE I, BINDING SITE II or BINDING SITE III. Table 2 illustrates the complementarity of the nucleotide sequences of LOC146733 BINDING SITE, designated SEQ ID:40730, to the nucleotide sequence of VGAM850 RNA, herein designated VGAM RNA, also designated SEQ ID:3561.

Another function of VGAM850 is therefore inhibition of LOC146733 (Accession XM_097076). Accordingly, utilities of VGAM850 include diagnosis, prevention and treatment of diseases and clinical conditions associated with LOC146733. LOC149668 (Accession XM_097692) is another VGAM850 host target gene. LOC149668 BINDING SITE is HOST TARGET binding site found in the 3' untranslated region of mRNA encoded by LOC149668, corresponding to a HOST TARGET binding site such as BINDING SITE I, BINDING SITE II or BINDING SITE III. Table 2 illustrates the complementarity of the nucleotide sequences of LOC149668 BINDING SITE, designated SEQ ID:41030, to the nucleotide sequence of VGAM850 RNA, herein designated VGAM RNA, also designated SEQ ID:3561.

Another function of VGAM850 is therefore inhibition of LOC149668 (Accession XM_097692). Accordingly, utilities of VGAM850 include diagnosis, prevention and treatment of diseases and clinical conditions associated with LOC149668. LOC149911 (Accession XM_097735) is another VGAM850 host target gene. LOC149911 BINDING SITE is HOST TARGET binding site found in the 5' untranslated region of mRNA encoded by LOC149911, corresponding to a HOST TARGET binding site such as BINDING SITE I, BINDING SITE II or BINDING SITE III. Table 2 illustrates the complementarity of the nucleotide sequences of LOC149911 BINDING SITE, designated SEQ ID:41083, to the nucleotide sequence of VGAM850 RNA, herein designated VGAM RNA, also designated SEQ ID:3561.

Another function of VGAM850 is therefore inhibition of LOC149911 (Accession XM_097735). Accordingly, utilities of VGAM850 include diagnosis, prevention and treatment of diseases and clinical conditions associated with LOC149911. LOC150271 (Accession XM_097859) is another VGAM850 host target gene. LOC150271 BINDING SITE is HOST TARGET binding site found in the 5' untranslated region of mRNA encoded by LOC150271, corresponding to a HOST TARGET binding site such as BINDING SITE I, BINDING SITE II or BINDING SITE III. Table 2 illustrates the complementarity of the nucleotide sequences of LOC150271 BINDING SITE, designated SEQ ID:41172, to the nucleotide sequence of VGAM850 RNA, herein designated VGAM RNA, also designated SEQ ID:3561.

Another function of VGAM850 is therefore inhibition of LOC150271 (Accession XM_097859). Accordingly, utilities of VGAM850 include diagnosis, prevention and treatment of diseases and clinical conditions associated with LOC150271. LOC151647 (Accession XM_087261) is another VGAM850 host target gene. LOC151647 BINDING SITE is HOST TARGET binding site found in the 3' untranslated region of mRNA encoded by LOC151647, corresponding to a HOST TARGET binding site such as BINDING SITE I, BINDING SITE II or BINDING SITE III. Table 2 illustrates the complementarity of the nucleotide sequences of LOC151647 BINDING SITE, designated SEQ ID:39155, to the nucleotide sequence of VGAM850 RNA, herein designated VGAM RNA, also designated SEQ ID:3561.

Another function of VGAM850 is therefore inhibition of LOC151647 (Accession XM_087261). Accordingly, utilities of VGAM850 include diagnosis, prevention and treatment of diseases and clinical conditions associated with LOC151647. LOC152220 (Accession XM_098176) is another VGAM850 host target gene. LOC152220 BINDING SITE is HOST TARGET binding site found in the 3' untranslated region of mRNA encoded by LOC152220, corresponding to a HOST TARGET binding site such as BINDING SITE I, BINDING SITE II or BINDING SITE III. Table 2 illustrates the complementarity of the nucleotide sequences of LOC152220 BINDING SITE, designated SEQ ID:41444, to the nucleotide sequence of VGAM850 RNA, herein designated VGAM RNA, also designated SEQ ID:3561.

Another function of VGAM850 is therefore inhibition of LOC152220 (Accession XM_098176). Accordingly, utilities of VGAM850 include diagnosis, prevention and treatment of diseases and clinical conditions associated with LOC152220. LOC155054 (Accession XM_088140) is another VGAM850 host target gene. LOC155054 BINDING SITE is HOST TARGET binding site found in the 3' untranslated region of mRNA encoded by LOC155054, corresponding to a HOST TARGET binding site such as BINDING SITE I, BINDING SITE II or BINDING SITE III. Table 2 illustrates the complementarity of the nucleotide sequences of LOC155054 BINDING SITE, designated SEQ ID:39540, to the nucleotide sequence of VGAM850 RNA, herein designated VGAM RNA, also designated SEQ ID:3561.

Another function of VGAM850 is therefore inhibition of LOC155054 (Accession XM_088140). Accordingly, utilities of VGAM850 include diagnosis, prevention and treatment of diseases and clinical conditions associated with LOC155054. LOC158055 (Accession XM_088453) is another VGAM850 host target gene. LOC158055 BINDING SITE is HOST TARGET binding site found in the 3' untranslated region of mRNA encoded by LOC158055, corresponding to a HOST TARGET binding site such as BINDING SITE I, BINDING SITE II or BINDING SITE III. Table 2 illustrates the complementarity of the nucleotide sequences of LOC158055 BINDING SITE, designated SEQ ID:39706, to the nucleotide sequence of VGAM850 RNA, herein designated VGAM RNA, also designated SEQ ID:3561.

Another function of VGAM850 is therefore inhibition of LOC158055 (Accession XM_088453). Accordingly, utilities of VGAM850 include diagnosis, prevention and treatment of diseases and clinical conditions associated with LOC158055. LOC200093 (Accession XM_032184) is another VGAM850 host target gene. LOC200093 BINDING SITE is HOST TARGET binding site found in the 5' untranslated region of mRNA encoded by LOC200093, corresponding to a HOST TARGET binding site such as BINDING SITE I, BINDING SITE II or BINDING SITE III. Table 2 illustrates the complementarity of the nucleotide sequences of LOC200093 BINDING SITE, designated SEQ ID:31601, to the nucleotide sequence of VGAM850 RNA, herein designated VGAM RNA, also designated SEQ ID:3561.

Another function of VGAM850 is therefore inhibition of LOC200093 (Accession XM_032184). Accordingly, utilities of VGAM850 include diagnosis, prevention and treatment of diseases and clinical conditions associated with LOC200093. LOC200310 (Accession XM_037840) is another VGAM850 host target gene. LOC200310 BINDING SITE is HOST TARGET binding site found in the 3' untranslated region of mRNA encoded by LOC200310, corresponding to a HOST TARGET binding site such as BINDING SITE I, BINDING SITE II or BINDING SITE III. Table 2 illustrates the complementarity of the nucleotide sequences of LOC200310 BINDING SITE, designated SEQ ID:32709, to the nucleotide sequence of VGAM850 RNA, herein designated VGAM RNA, also designated SEQ ID:3561.

Another function of VGAM850 is therefore inhibition of LOC200310 (Accession XM_037840). Accordingly, utilities of VGAM850 include diagnosis, prevention and treatment of diseases and clinical conditions associated with LOC200310. LOC202024 (Accession XM_114422) is another VGAM850 host target gene. LOC202024 BINDING SITE is HOST TARGET binding site found in the 5' untranslated region of mRNA encoded by LOC202024, corresponding to a HOST TARGET binding site such as BINDING SITE I, BINDING SITE II or BINDING SITE III. Table 2 illustrates the complementarity of the nucleotide sequences of LOC202024 BINDING SITE, designated SEQ ID:42959, to the nucleotide sequence of VGAM850 RNA, herein designated VGAM RNA, also designated SEQ ID:3561.

Another function of VGAM850 is therefore inhibition of LOC202024 (Accession XM_114422). Accordingly, utilities of VGAM850 include diagnosis, prevention and treatment of diseases and clinical conditions associated with LOC202024. LOC202347 (Accession XM_117390) is another VGAM850 host target gene. LOC202347 BINDING SITE is HOST TARGET binding site found in the 5' untranslated region of mRNA encoded by LOC202347, corresponding to a HOST TARGET binding site such as BINDING SITE I, BINDING SITE II or BINDING SITE III. Table 2 illustrates the complementarity of the nucleotide sequences of LOC202347 BINDING SITE, designated SEQ ID:43431, to the nucleotide sequence of VGAM850 RNA, herein designated VGAM RNA, also designated SEQ ID:3561.

Another function of VGAM850 is therefore inhibition of LOC202347 (Accession XM_117390). Accordingly, utilities of VGAM850 include diagnosis, prevention and treatment of diseases and clinical conditions associated with LOC202347. LOC202934 (Accession XM_117486) is another VGAM850 host target gene. LOC202934 BINDING SITE is HOST TARGET binding site found in the 5' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43461, to the nucleotide sequence of VGAM850 RNA, herein designated VGAM RNA, also designated SEQ ID:3561.

Another function of VGAM850 is therefore inhibition of LOC202934 (Accession XM_117486). Accordingly, utilities of VGAM850 include diagnosis, prevention and treatment of diseases and clinical conditions associated with LOC202934. LOC220514 (Accession XM_017498) is another VGAM850 host target gene. LOC220514 BINDING SITE is HOST TARGET binding site found in the 3' untranslated region of mRNA encoded by LOC220514, corresponding to a HOST TARGET binding site such as BINDING SITE I, BINDING SITE II or BINDING SITE III. Table 2 illustrates the complementarity of the nucleotide sequences of LOC220514 BINDING SITE, designated SEQ ID:30321, to the nucleotide sequence of VGAM850 RNA, herein designated VGAM RNA, also designated SEQ ID:3561.

Another function of VGAM850 is therefore inhibition of LOC220514 (Accession XM_017498). Accordingly, utilities of VGAM850 include diagnosis, prevention and treatment of diseases and clinical conditions associated with LOC220514. LOC220776 (Accession XM_043388) is another VGAM850 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33935, to the nucleotide sequence of VGAM850 RNA, herein designated VGAM RNA, also designated SEQ ID:3561.

Another function of VGAM850 is therefore inhibition of LOC220776 (Accession XM_043388). Accordingly, utilities of VGAM850 include diagnosis, prevention and treatment of diseases and clinical conditions associated with LOC220776. LOC221931 (Accession XM_168348) is another VGAM850 host target gene. LOC221931 BINDING SITE is HOST TARGET binding site found in the 3' untranslated region of mRNA encoded by LOC221931, corresponding to a HOST TARGET binding site such as BINDING SITE I, BINDING SITE II or BINDING SITE III. Table 2 illustrates the complementarity of the nucleotide sequences of LOC221931 BINDING SITE, designated SEQ ID:45119, to the nucleotide sequence of VGAM850 RNA, herein designated VGAM RNA, also designated SEQ ID:3561.

Another function of VGAM850 is therefore inhibition of LOC221931 (Accession XM_168348). Accordingly, utilities of VGAM850 include diagnosis, prevention and treatment of diseases and clinical conditions associated with LOC221931. LOC253675 (Accession XM_172990) is another VGAM850 host target gene. LOC253675 BINDING SITE is HOST TARGET binding site found in the 3' untranslated region of mRNA encoded by LOC253675, corresponding to a HOST TARGET binding site such as BINDING SITE I, BINDING SITE II or BINDING SITE III. Table 2 illustrates the complementarity of the nucleotide sequences of LOC253675 BINDING SITE, designated SEQ ID:46265, to the nucleotide sequence of VGAM850 RNA, herein designated VGAM RNA, also designated SEQ ID:3561.

Another function of VGAM850 is therefore inhibition of LOC253675 (Accession XM_172990). Accordingly, utilities of VGAM850 include diagnosis, prevention and treatment of diseases and clinical conditions associated with LOC253675. LOC253782 (Accession XM_171023) is another VGAM850 host target gene. LOC253782 BINDING SITE is HOST TARGET binding site found in the 3' untranslated region of mRNA encoded by LOC253782, corresponding to a HOST TARGET binding site such as BINDING SITE I, BINDING SITE II or BINDING SITE III. Table 2 illustrates the complementarity of the nucleotide sequences of LOC253782 BINDING SITE, designated SEQ ID:45798, to the nucleotide sequence of VGAM850 RNA, herein designated VGAM RNA, also designated SEQ ID:3561.

Another function of VGAM850 is therefore inhibition of LOC253782 (Accession XM_171023). Accordingly, utilities of VGAM850 include diagnosis, prevention and treatment of diseases and clinical conditions associated with LOC253782. LOC254428 (Accession XM_170932) is another VGAM850 host target gene. LOC254428 BINDING SITE is HOST TARGET binding site found in the 3' untranslated region of mRNA encoded by LOC254428, corresponding to a HOST TARGET binding site such as BINDING SITE I, BINDING SITE II or BINDING SITE III. Table 2 illustrates the complementarity of the nucleotide sequences of LOC254428 BINDING SITE, designated SEQ ID:45718, to the nucleotide sequence of VGAM850 RNA, herein designated VGAM RNA, also designated SEQ ID:3561.

Another function of VGAM850 is therefore inhibition of LOC254428 (Accession XM_170932). Accordingly, utilities of VGAM850 include diagnosis, prevention and treatment of diseases and clinical conditions associated with LOC254428. LOC254848 (Accession XM_173133) is another VGAM850 host target gene. LOC254848 BINDING SITE is HOST TARGET binding site found in the 5' untranslated region of mRNA encoded by LOC254848, corresponding to a HOST TARGET binding site such as BINDING SITE I, BINDING SITE II or BINDING SITE III. Table 2 illustrates the complementarity of the nucleotide sequences of LOC254848 BINDING SITE, designated SEQ ID:46381, to the nucleotide sequence of VGAM850 RNA, herein designated VGAM RNA, also designated SEQ ID:3561.

Another function of VGAM850 is therefore inhibition of LOC254848 (Accession XM_173133). Accordingly, utilities of VGAM850 include diagnosis, prevention and treatment of diseases and clinical conditions associated with LOC254848. LOC56267 (Accession NM_019610) is another VGAM850 host target gene. LOC56267 BINDING SITE is HOST TARGET binding site found in the 3' untranslated region of mRNA encoded by LOC56267, corresponding to a HOST TARGET binding site such as BINDING SITE I, BINDING SITE II or BINDING SITE III. Table 2 illustrates the complementarity of the nucleotide sequences of LOC56267 BINDING SITE, designated SEQ ID:21228, to the nucleotide sequence of VGAM850 RNA, herein designated VGAM RNA, also designated SEQ ID:3561.

Another function of VGAM850 is therefore inhibition of LOC56267 (Accession NM_019610). Accordingly, utilities of VGAM850 include diagnosis, prevention and treatment of diseases and clinical conditions associated with LOC56267. LOC57105 (Accession NM_020377) is another VGAM850 host target gene. LOC57105 BINDING SITE is HOST TARGET binding site found in the 3' untranslated region of mRNA encoded by LOC57105, corresponding to a HOST TARGET binding site such as BINDING SITE I, BINDING SITE II or BINDING SITE III. Table 2 illustrates the complementarity of the nucleotide sequences of LOC57105 BINDING SITE, designated SEQ ID:21641, to the nucleotide sequence of VGAM850 RNA, herein designated VGAM RNA, also designated SEQ ID:3561.

Another function of VGAM850 is therefore inhibition of LOC57105 (Accession NM_020377). Accordingly, utilities of VGAM850 include diagnosis, prevention and treatment of diseases and clinical conditions associated with LOC57105. LOC83693 (Accession NM_031463) is another VGAM850 host target gene. LOC83693 BINDING SITE is HOST TARGET binding site found in the 3' untranslated region of mRNA encoded by LOC83693, corresponding to a HOST TARGET binding site such as BINDING SITE I, BINDING SITE II or BINDING SITE III. Table 2 illustrates the complementarity of the nucleotide sequences of LOC83693 BINDING SITE, designated SEQ ID:25496, to the nucleotide sequence of VGAM850 RNA, herein designated VGAM RNA, also designated SEQ ID:3561.

Another function of VGAM850 is therefore inhibition of LOC83693 (Accession NM_031463). Accordingly, utilities of VGAM850 include diagnosis, prevention and treatment of diseases and clinical conditions associated with LOC83693. LOC90670 (Accession XM_033352) is another VGAM850 host target gene. LOC90670 BINDING SITE is HOST TARGET binding site found in the 3' untranslated region of mRNA encoded by LOC90670, corresponding to a HOST TARGET binding site such as BINDING SITE I, BINDING SITE II or BINDING SITE III. Table 2 illustrates the complementarity of the nucleotide sequences of LOC90670 BINDING SITE, designated SEQ ID:31882, to the nucleotide sequence of VGAM850 RNA, herein designated VGAM RNA, also designated SEQ ID:3561.

Another function of VGAM850 is therefore inhibition of LOC90670 (Accession XM_033352). Accordingly, utilities of VGAM850 include diagnosis, prevention and treatment of diseases and clinical conditions associated with LOC90670. LOC91040 (Accession XM_035641) is another VGAM850 host target gene. LOC91040 BINDING SITE is HOST TARGET binding site found in the 5' untranslated region of mRNA encoded by LOC91040, corresponding to a HOST TARGET binding site such as BINDING SITE I, BINDING SITE II or BINDING SITE III. Table 2 illustrates the complementarity of the nucleotide sequences of LOC91040 BINDING SITE, designated SEQ ID:32318, to the nucleotide sequence of VGAM850 RNA, herein designated VGAM RNA, also designated SEQ ID:3561.

Another function of VGAM850 is therefore inhibition of LOC91040 (Accession XM_035641). Accordingly, utilities of VGAM850 include diagnosis, prevention and treatment of diseases and clinical conditions associated with LOC91040. LOC96597 (Accession XM_039922) is another VGAM850 host target gene. LOC96597 BINDING SITE is HOST TARGET binding site found in the 3' untranslated region of mRNA encoded by LOC96597, corresponding to a HOST TARGET binding site such as BINDING SITE I, BINDING SITE II or BINDING SITE III. Table 2 illustrates the complementarity of the nucleotide sequences of LOC96597 BINDING SITE, designated SEQ ID:33232, to the nucleotide sequence of VGAM850 RNA, herein designated VGAM RNA, also designated SEQ ID:3561.

Another function of VGAM850 is therefore inhibition of LOC96597 (Accession XM_039922). Accordingly, utilities of VGAM850 include diagnosis, prevention and treatment of diseases and clinical conditions associated with LOC96597. FIG. 1 further provides a conceptual description of a novel bioinformatically detected viral gene of the present invention, referred to here as Viral Genomic Address Messenger 851 (VGAM851) viral gene, which modulates expression of respective host target genes thereof, the function and utility of which host target genes is known in the art.

VGAM851 is a novel bioinformatically detected regulatory, non protein coding, viral micro RNA (miRNA) gene. The method by which VGAM851 was detected is described hereinabove with reference to FIGS. 1-8.

VGAM851 gene, herein designated VGAM GENE, is a viral gene contained in the genome of Lymphocystis Disease Virus 1. VGAM851 host target gene, herein designated VGAM HOST TARGET GENE, is a human gene contained in the human genome.

VGAM851 gene encodes a VGAM851 precursor RNA, herein designated VGAM PRECURSOR RNA. Similar to other miRNA genes, and unlike most ordinary genes, VGAM851 precursor RNA does not encode a protein. A nucleotide sequence identical or highly similar to the nucleotide sequence of VGAM851 precursor RNA is designated SEQ ID:837, and is provided hereinbelow with reference to the sequence listing part. Nucleotide sequence SEQ ID:837 is located at position 13906 relative to the genome of Lymphocystis Disease Virus 1.

VGAM851 precursor RNA folds onto itself, forming VGAM851 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM851 folded precursor RNA into VGAM851 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM851 RNA is designated SEQ ID:3562, and is provided hereinbelow with reference to the sequence listing part.

VGAM851 host target gene, herein designated VGAM HOST TARGET GENE, encodes a corresponding messenger RNA, VGAM851 host target RNA, herein designated VGAM HOST TARGET RNA. VGAM851 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM851 RNA, herein designated VGAM RNA, binds complementarily to one or more host target binding sites located in untranslated regions of VGAM851 host target RNA, herein designated VGAM HOST TARGET RNA. This complementary binding is due to the fact that the nucleotide sequence of VGAM851 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM851 RNA, herein designated VGAM RNA, may have a different number of host target binding sites in untranslated regions of a VGAM851 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM851 RNA, herein designated VGAM RNA, to host target binding sites on VGAM851 host target RNA, herein designated VGAM HOST TARGET RNA, such as BINDING SITE I, BINDING SITE II and BINDING SITE III, inhibits translation of VGAM851 host target RNA into VGAM851 host target protein, herein designated VGAM HOST TARGET PROTEIN. VGAM host target protein is therefore outlined by a broken line.

It is appreciated that VGAM851 host target gene, herein designated VGAM HOST TARGET GENE, in fact represents a plurality of VGAM851 host target genes. The mRNA of each one of this plurality of VGAM851 host target genes comprises one or more host target binding sites, each having a nucleotide sequence which is at least partly complementary to VGAM851 RNA, herein designated VGAM RNA, and which when bound by VGAM851 RNA causes inhibition of translation of respective one or more VGAM851 host target proteins.

It is further appreciated by one skilled in the art that the mode of translational inhibition illustrated by FIG. 1 with specific reference to translational inhibition exerted by VGAM851 gene, herein designated VGAM GENE, on one or more VGAM851 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM851 is inhibition of expression of host target genes, as part of a novel viral mechanism of attacking a host. Accordingly, utilities of VGAM851 include diagnosis, prevention and treatment of viral infection by Lymphocystis Disease Virus 1. Specific functions, and accordingly utilities, of VGAM851 correlate with, and may be deduced from, the identity of the host target genes which VGAM851 binds and inhibits, and the function of these host target genes, as elaborated hereinbelow.

Nucleotide sequences of the VGAM851 precursor RNA, herein designated VGAM PRECURSOR RNA, and of the 'diced' VGAM851 RNA, herein designated VGAM RNA, and a schematic representation of the secondary folding of VGAM851 folded precursor RNA, herein designated VGAM FOLDED PRECURSOR RNA, of VGAM851 are further described hereinbelow with reference to Table 1.

Nucleotide sequences of host target binding sites, such as BINDING SITE-I, BINDING SITE-II and BINDING SITE-III of FIG. 1, found on VGAM851 host target RNA, and schematic representation of the complementarity of each of these host target binding sites to VGAM851 RNA, herein designated VGAM RNA, are described hereinbelow with reference to Table 2.

As mentioned hereinabove with reference to FIG. 1, a function of VGAM851 gene, herein designated VGAM is inhibition of expression of VGAM851 target genes. It is appreciated that specific functions, and accordingly utilities, of VGAM851 correlate with, and may be deduced from, the identity of the target genes which VGAM851 binds and inhibits, and the function of these target genes, as elaborated hereinbelow.

Chloride Channel, Calcium Activated, Family Member 2 (CLCA2, Accession NM_006536) is a VGAM851 host target gene. CLCA2 BINDING SITE is HOST TARGET binding site found in the 3' untranslated region of mRNA encoded by CLCA2, corresponding to a HOST TARGET binding site such as BINDING SITE I, BINDING SITE II or BINDING SITE III. Table 2 illustrates the complementarity of the nucleotide sequences of CLCA2 BINDING SITE, designated SEQ ID:13290, to the nucleotide sequence of VGAM851 RNA, herein designated VGAM RNA, also designated SEQ ID:3562.

A function of VGAM851 is therefore inhibition of Chloride Channel, Calcium Activated, Family Member 2 (CLCA2, Accession NM_006536), a gene which Calcium-sensitive chloride channel, is suggested to play a role in the complex pathogenesis of cystic fibrosis. Accordingly, utilities of VGAM851 include diagnosis, prevention and treatment of diseases and clinical conditions associated with CLCA2. The function of CLCA2 has been established by previous studies. Members of the CLCA family of calcium-activated chloride channels, such as human CLCA1 (OMIM Ref. No. 603906) and bovine lung-endothelial cell adhesion molecule-1 (Lu-ECAM-1), appear to have a conserved structure and function but significantly different tissue expression patterns. By screening a human lung cDNA library with a Lu-ECAM-1 cDNA, Gruber et al. (1999) isolated cDNAs encoding CLCA2. The 943-amino acid protein deduced from the CLCA2 cDNAs is 76% and 51% identical to Lu-ECAM-1 and human CLCA1, respectively. Glycosylation site scanning and protease protection assays predicted that CLCA2 has 5 transmembrane domains and a large N-terminal extracellular domain. CLCA2 also contains a signal sequence, conserved cysteine residues within its N-terminal extracellular domain, a conserved consensus site for monobasic proteolytic cleavage, several potential glycosylation sites, and a number of potential phosphorylation sites for protein kinase C (see OMIM Ref. No. 176982). Northern blot analysis detected a 3.6-kb CLCA2 transcript in trachea and mammary gland; in addition to these tissues, RT-PCR showed expression in lung. Recombinant CLCA2 was expressed in mammalian cells as a 120-kD primary translation product that was cleaved into an 86-kD N-terminal polypeptide and a 34-kD C-terminal polypeptide, both of which were associated with the outer cell surface. Expression of recombinant CLCA2 in HEK 293 cells resulted in a slightly outwardly rectifying anion conductance that was increased in the presence of the calcium ionophore ionomycin and inhibited by DIDS, dithiothreitol, niflumic acid, and tamoxifen. By radiation hybrid analysis, Gruber and Pauli (1999) determined that the CLCA2 and CLCA3 genes map to 1p31-p22, where the CLCA1 gene had been assigned. Thus, all human CLCA family members known to that time were shown to be clustered on the short arm of chromosome 1 despite their moderately low levels of sequence homology and their heterogeneous expression patterns.

Full details of the abovementioned studies are described in the following publications, the disclosure of which are hereby incorporated by reference:

Gruber, A. D.; Pauli, B. U.: Clustering of the human CLCA gene family on the short arm of chromosome 1 (1p22-31). Genome 42:1030-1032, 1999; and Gruber, A. D.; Schreur, K. D.; Ji, H.-L.; Fuller, C. M.; Pauli, B. U.: Molecular cloning and transmembrane structure of hCLCA2 from human lung, trachea, and mammary gland. Am. J. Phys.

Further studies establishing the function and utilities of CLCA2 are found in John Hopkins OMIM database record ID 604003, and in sited publications numbered 739 and 8199 listed in the bibliography section hereinbelow, which are also hereby incorporated by reference. Pituitary Tumor-transforming 1 Interacting Protein (PTTG1IP, Accession NM_004339) is another VGAM851 host target gene. PTTG1IP BINDING SITE is HOST TARGET binding site found in the 3' untranslated region of mRNA encoded by PTTG1IP, corresponding to a HOST TARGET binding site such as BINDING SITE I, BINDING SITE II or BINDING SITE III. Table 2 illustrates the complementarity of the nucleotide sequences of PTTG1IP BINDING SITE, designated SEQ ID:10540, to the nucleotide sequence of VGAM851 RNA, herein designated VGAM RNA, also designated SEQ ID:3562.

Another function of VGAM851 is therefore inhibition of Pituitary Tumor-transforming 1 Interacting Protein (PTTG1IP, Accession NM_004339), a gene which facilitates the translocation of PTTG to the nucleus. Accordingly, utilities of VGAM851 include diagnosis, prevention and treatment of diseases and clinical conditions associated with PTTG1IP. The function of PTTG1IP and its association with various diseases and clinical conditions, has been established by previous studies, as described hereinabove with reference to VGAM131. Kell Blood Group Precursor (McLeod phenotype) (XK, Accession NM_021083) is another VGAM851 host target gene. XK BINDING SITE is HOST TARGET binding site found in the 3' untranslated region of mRNA encoded by XK, corresponding to a HOST TARGET binding site such as BINDING SITE I, BINDING SITE II or BINDING SITE III. Table 2 illustrates the complementarity of the nucleotide sequences of XK BINDING SITE, designated SEQ ID:22063, to the nucleotide sequence of VGAM851 RNA, herein designated VGAM RNA, also designated SEQ ID:3562.

Another function of VGAM851 is therefore inhibition of Kell Blood Group Precursor (McLeod phenotype) (XK, Accession NM_021083). Accordingly, utilities of VGAM851 include diagnosis, prevention and treatment of diseases and clinical conditions associated with XK. DKFZp564K142 (Accession NM_032121) is another VGAM851 host target gene. DKFZp564K142 BINDING SITE is HOST TARGET binding site found in the 3' untranslated region of mRNA encoded by DKFZp564K142, corresponding to a HOST TARGET binding site such as BINDING SITE I, BINDING SITE II or BINDING SITE III. Table 2 illustrates the complementarity of the nucleotide sequences of DKFZp564K142 BINDING SITE, designated SEQ ID:25807, to the nucleotide sequence of VGAM851 RNA, herein designated VGAM RNA, also designated SEQ ID:3562.

Another function of VGAM851 is therefore inhibition of DKFZp564K142 (Accession NM_032121). Accordingly, utilities of VGAM851 include diagnosis, prevention and treatment of diseases and clinical conditions associated with DKFZp564K142. FLJ13197 (Accession NM_024614) is another VGAM851 host target gene. FLJ13197 BINDING SITE is HOST TARGET binding site found in the 3' untranslated region of mRNA encoded by FLJ13197, corresponding to a HOST TARGET binding site such as BINDING SITE I, BINDING SITE II or BINDING SITE III. Table 2 illustrates the complementarity of the nucleotide sequences of FLJ13197 BINDING SITE, designated SEQ ID:23876, to the nucleotide sequence of VGAM851 RNA, herein designated VGAM RNA, also designated SEQ ID:3562.

Another function of VGAM851 is therefore inhibition of FLJ13197 (Accession NM_024614). Accordingly, utilities of VGAM851 include diagnosis, prevention and treatment of diseases and clinical conditions associated with FLJ13197. KIAA0186 (Accession NM_021067) is another VGAM851 host target gene. KIAA0186 BINDING SITE is HOST TARGET binding site found in the 3' untranslated region of mRNA encoded by KIAA0186, corresponding to a HOST TARGET binding site such as BINDING SITE I, BINDING SITE II or BINDING SITE III. Table 2 illustrates the complementarity of the nucleotide sequences of KIAA0186 BINDING SITE, designated SEQ ID:22040, to the nucleotide sequence of VGAM851 RNA, herein designated VGAM RNA, also designated SEQ ID:3562.

Another function of VGAM851 is therefore inhibition of KIAA0186 (Accession NM_021067). Accordingly, utilities of VGAM851 include diagnosis, prevention and treatment of diseases and clinical conditions associated with KIAA0186. MGC4562 (Accession NM_133375) is another VGAM851 host target gene. MGC4562 BINDING SITE is HOST TARGET binding site found in the 3' untranslated region of mRNA encoded by MGC4562, corresponding to a HOST TARGET binding site such as BINDING SITE I, BINDING SITE II or BINDING SITE III. Table 2 illustrates the complementarity of the nucleotide sequences of MGC4562 BINDING SITE, designated SEQ ID:28497, to the nucleotide sequence of VGAM851 RNA, herein designated VGAM RNA, also designated SEQ ID:3562.

Another function of VGAM851 is therefore inhibition of MGC4562 (Accession NM_133375). Accordingly, utilities of VGAM851 include diagnosis, prevention and treatment of diseases and clinical conditions associated with MGC4562. LOC151258 (Accession XM_087146) is another VGAM851 host target gene. LOC151258 BINDING SITE is HOST TARGET binding site found in the 5' untranslated region of mRNA encoded by LOC151258, corresponding to a HOST TARGET binding site such as BINDING SITE I, BINDING SITE II or BINDING SITE III. Table 2 illustrates the complementarity of the nucleotide sequences of LOC151258 BINDING SITE, designated SEQ ID:39091, to the nucleotide sequence of VGAM851 RNA, herein designated VGAM RNA, also designated SEQ ID:3562.

Another function of VGAM851 is therefore inhibition of LOC151258 (Accession XM_087146). Accordingly, utilities of VGAM851 include diagnosis, prevention and treatment of diseases and clinical conditions associated with LOC151258. LOC157798 (Accession XM_098827) is another VGAM851 host target gene. LOC157798 BINDING SITE is HOST TARGET binding site found in the 5' untranslated region of mRNA encoded by LOC157798, corresponding to a HOST TARGET binding site such as BINDING SITE I, BINDING SITE II or BINDING SITE III. Table 2 illustrates the complementarity of the nucleotide sequences of LOC157798 BINDING SITE, designated SEQ ID:41845, to the nucleotide sequence of VGAM851 RNA, herein designated VGAM RNA, also designated SEQ ID:3562.

Another function of VGAM851 is therefore inhibition of LOC157798 (Accession XM_098827). Accordingly, utilities of VGAM851 include diagnosis, prevention and treatment of diseases and clinical conditions associated with LOC157798. LOC200803 (Accession XM_114299) is another VGAM851 host target gene. LOC200803 BINDING SITE is HOST TARGET binding site found in the 3' untranslated region of mRNA encoded by LOC200803, corresponding to a HOST TARGET binding site such as BINDING SITE I, BINDING SITE II or BINDING SITE III. Table 2 illustrates the complementarity of the nucleotide sequences of LOC200803 BINDING SITE, designated SEQ ID:42855, to the nucleotide sequence of VGAM851 RNA, herein designated VGAM RNA, also designated SEQ ID:3562.

Another function of VGAM851 is therefore inhibition of LOC200803 (Accession XM_114299). Accordingly, utilities of VGAM851 include diagnosis, prevention and treatment of diseases and clinical conditions associated with LOC200803. LOC256642 (Accession XM_172797) is another VGAM851 host target gene. LOC256642 BINDING SITE is HOST TARGET binding site found in the 3' untranslated region of mRNA encoded by LOC256642, corresponding to a HOST TARGET binding site such as BINDING SITE I, BINDING SITE II or BINDING SITE III. Table 2 illustrates the complementarity of the nucleotide sequences of LOC256642 BINDING SITE, designated SEQ ID:46080, to the nucleotide sequence of VGAM851 RNA, herein designated VGAM RNA, also designated SEQ ID:3562.

Another function of VGAM851 is therefore inhibition of LOC256642 (Accession XM_172797). Accordingly, utilities of VGAM851 include diagnosis, prevention and treatment of diseases and clinical conditions associated with LOC256642. LOC89932 (Accession XM_027341) is another VGAM851 host target gene. LOC89932 BINDING SITE is HOST TARGET binding site found in the 3' untranslated region of mRNA encoded by LOC89932, corresponding to a HOST TARGET binding site such as BINDING SITE I, BINDING SITE II or BINDING SITE III. Table 2 illustrates the complementarity of the nucleotide sequences of LOC89932 BINDING SITE, designated SEQ ID:30493, to the nucleotide sequence of VGAM851 RNA, herein designated VGAM RNA, also designated SEQ ID:3562.

Another function of VGAM851 is therefore inhibition of LOC89932 (Accession XM_027341). Accordingly, utilities of VGAM851 include diagnosis, prevention and treatment of diseases and clinical conditions associated with LOC89932. FIG. 1 further provides a conceptual description of a novel bioinformatically detected viral gene of the present invention, referred to here as Viral Genomic Address Messenger 852 (VGAM852) viral gene, which modulates expression of respective host target genes thereof, the function and utility of which host target genes is known in the art.

VGAM852 is a novel bioinformatically detected regulatory, non protein coding, viral micro RNA (miRNA) gene. The method by which VGAM852 was detected is described hereinabove with reference to FIGS. 1-8.

VGAM852 gene, herein designated VGAM GENE, is a viral gene contained in the genome of Molluscum Contagiosum Virus. VGAM852 host target gene, herein designated VGAM HOST TARGET GENE, is a human gene contained in the human genome.

VGAM852 gene encodes a VGAM852 precursor RNA, herein designated VGAM PRECURSOR RNA. Similar to other miRNA genes, and unlike most ordinary genes, VGAM852 precursor RNA does not encode a protein. A nucleotide sequence identical or highly similar to the nucleotide sequence of VGAM852 precursor RNA is designated SEQ ID:838, and is provided hereinbelow with reference to the sequence listing part. Nucleotide sequence SEQ ID:838 is located at position 135041 relative to the genome of Molluscum Contagiosum Virus.

VGAM852 precursor RNA folds onto itself, forming VGAM852 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM852 folded precursor RNA into VGAM852 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM852 RNA is designated SEQ ID:3563, and is provided hereinbelow with reference to the sequence listing part.

VGAM852 host target gene, herein designated VGAM HOST TARGET GENE, encodes a corresponding messenger RNA, VGAM852 host target RNA, herein designated VGAM HOST TARGET RNA. VGAM852 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM852 RNA, herein designated VGAM RNA, binds complementarily to one or more host target binding sites located in untranslated regions of VGAM852 host target RNA, herein designated VGAM HOST TARGET RNA. This complementary binding is due to the fact that the nucleotide sequence of VGAM852 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM852 RNA, herein designated VGAM RNA, may have a different number of host target binding sites in untranslated regions of a VGAM852 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM852 RNA, herein designated VGAM RNA, to host target binding sites on VGAM852 host target RNA, herein designated VGAM HOST TARGET RNA, such as BINDING SITE I, BINDING SITE II and BINDING SITE III, inhibits translation of VGAM852 host target RNA into VGAM852 host target protein, herein designated VGAM HOST TARGET PROTEIN. VGAM host target protein is therefore outlined by a broken line.

It is appreciated that VGAM852 host target gene, herein designated VGAM HOST TARGET GENE, in fact represents a plurality of VGAM852 host target genes. The mRNA of each one of this plurality of VGAM852 host target genes comprises one or more host target binding sites, each having a nucleotide sequence which is at least partly complementary to VGAM852 RNA, herein designated VGAM RNA, and which when bound by VGAM852 RNA causes inhibition of translation of respective one or more VGAM852 host target proteins.

It is further appreciated by one skilled in the art that the mode of translational inhibition illustrated by FIG. 1 with specific reference to translational inhibition exerted by VGAM852 gene, herein designated VGAM GENE, on one or more VGAM852 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM852 is inhibition of expression of host target genes, as part of a novel viral mechanism of attacking a host. Accordingly, utilities of VGAM852 include diagnosis, prevention and treatment of viral infection by Molluscum Contagiosum Virus. Specific functions, and accordingly utilities, of VGAM852 correlate with, and may be deduced from, the identity of the host target genes which VGAM852 binds and inhibits, and the function of these host target genes, as elaborated hereinbelow.

Nucleotide sequences of the VGAM852 precursor RNA, herein designated VGAM PRECURSOR RNA, and of the 'diced' VGAM852 RNA, herein designated VGAM RNA, and a schematic representation of the secondary folding of VGAM852 folded precursor RNA, herein designated VGAM FOLDED PRECURSOR RNA, of VGAM852 are further described hereinbelow with reference to Table 1.

Nucleotide sequences of host target binding sites, such as BINDING SITE-I, BINDING SITE-II and BINDING SITE-III of FIG. 1, found on VGAM852 host target RNA, and schematic representation of the complementarity of each of these host target binding sites to VGAM852 RNA, herein designated VGAM RNA, are described hereinbelow with reference to Table 2.

As mentioned hereinabove with reference to FIG. 1, a function of VGAM852 gene, herein designated VGAM is inhibition of expression of VGAM852 target genes. It is appreciated that specific functions, and accordingly utilities, of VGAM852 correlate with, and may be deduced from, the identity of the target genes which VGAM852 binds and inhibits, and the function of these target genes, as elaborated hereinbelow.

Potassium Voltage-gated Channel, Shaker-related Subfamily, Beta Member 2 (KCNAB2, Accession NM_003636) is a VGAM852 host target gene. KCNAB2 BINDING SITE is HOST TARGET binding site found in the 3' untranslated region of mRNA encoded by KCNAB2, corresponding to a HOST TARGET binding site such as BINDING SITE I, BINDING SITE II or BINDING SITE III. Table 2 illustrates the complementarity of the nucleotide sequences of KCNAB2 BINDING SITE, designated SEQ ID:9705, to the nucleotide sequence of VGAM852 RNA, herein designated VGAM RNA, also designated SEQ ID:3563.

A function of VGAM852 is therefore inhibition of Potassium Voltage-gated Channel, Shaker-related Subfamily, Beta Member 2 (KCNAB2, Accession NM_003636), a gene which is the beta subunit of shaker voltage-gated potassium channels. Accordingly, utilities of VGAM852 include diagnosis, prevention and treatment of diseases and clinical conditions associated with KCNAB2. The function of KCNAB2 and its association with various diseases and clinical conditions, has been established by previous studies, as described hereinabove with reference to VGAM659. Lactotransferrin (LTF, Accession NM_002343) is another VGAM852 host target gene. LTF BINDING SITE is HOST TARGET binding site found in the 5' untranslated region of mRNA encoded by LTF, corresponding to a HOST TARGET binding site such as BINDING SITE I, BINDING SITE II or BINDING SITE III. Table 2 illustrates the complementarity of the nucleotide sequences of LTF BINDING SITE, designated SEQ ID:8142, to the nucleotide sequence of VGAM852 RNA, herein designated VGAM RNA, also designated SEQ ID:3563.

Another function of VGAM852 is therefore inhibition of Lactotransferrin (LTF, Accession NM_002343), a gene which is an iron binding transport protein. Accordingly, utilities of VGAM852 include diagnosis, prevention and treatment of diseases and clinical conditions associated with LTF. The function of LTF has been established by previous studies. Haemophilus influenzae is a major cause of otitis media and other respiratory tract disease in children. The pathogenesis of the disease begins with colonization of the upper respiratory mucosa, a process that involves evasion of local immune mechanisms and adherence to epithelial cells. Several studies demonstrated that human milk is protective against H. influenzae colonization and disease. Qiu et al. (1998) examined the effect of human milk on 2 autotransported proteins of H. influenzae that are presumed to facilitate colonization: IgA1 protease and Hap adhesin. They found that human milk lactoferrin efficiently extracted the IgA1 protease preprotein from the bacterial outer membrane. In addition, lactoferrin specifically degraded the Hap adhesin and abolished Hap-mediated adherence. The results suggested that human milk lactoferrin attenuates the pathogenic potential of H. influenzae by selectively inactivating IgA1 protease and Hap, thereby interfering with colonization. They suggested that future studies should examine the therapeutic potential of lactoferrin, perhaps as a supplement in infant formulas. Human T-cell leukemia virus-1 (OMIM Ref. No. HTLV-1) causes T-cell leukemia and lymphoma and is clustered in certain geographic areas. Like HIV-1 infection, HTLV-1 infection can be transmitted vertically through breast milk. Refraining from breast feeding was found to efficiently block mother-to-infant transmission in southwestern Japan. Moriuchi and Moriuchi (2001) observed a dose-dependent enhancement of HTLV-1 replication by transactivating the viral long terminal repeat in cells stimulated with human or bovine lactoferrin. Lactoferrin also accelerated transmission to uninfected cord blood mononuclear cells. Moriuchi and Moriuchi (2001) confirmed that lactoferrin inhibits HIV-1 replication and showed that it does so by nonspecifically blocking viral fusion to cells Full details of the abovementioned studies are described in the following publications, the disclosure of which are hereby incorporated by reference:

Qiu, J.; Hendrixson, D. R.; Baker, E. N.; Murphy, T. F.; St. Geme, J. W., III; Plaut, A. G.: Human milk lactoferrin inactivates two putative colonization factors expressed by Haemophilus influenzae. Proc. Nat. Acad. Sci. 95:12641-12646, 1998; and Moriuchi, M.; Moriuchi, H.: A milk protein lactoferrin enhances human T cell leukemia virus type I and suppresses HIV-1 infection. J. Immun. 166: 4231-4236, 2001.

Further studies establishing the function and utilities of LTF are found in John Hopkins OMIM database record ID 150210, and in sited publications numbered 11339-11348 listed in the bibliography section hereinbelow, which are also hereby incorporated by reference. FLJ20294 (Accession NM_017749) is another VGAM852 host target gene. FLJ20294 BINDING SITE is HOST TARGET binding site found in the 3' untranslated region of mRNA encoded by FLJ20294, corresponding to a HOST TARGET binding site such as BINDING SITE I, BINDING SITE II or BINDING SITE III. Table 2 illustrates the complementarity of the nucleotide sequences of FLJ20294 BINDING SITE, designated SEQ ID:19344, to the nucleotide sequence of VGAM852 RNA, herein designated VGAM RNA, also designated SEQ ID:3563.

Another function of VGAM852 is therefore inhibition of FLJ20294 (Accession NM_017749). Accordingly, utilities of VGAM852 include diagnosis, prevention and treatment of diseases and clinical conditions associated with FLJ20294. FIG. 1 further provides a conceptual description of a novel bioinformatically detected viral gene of the present invention, referred to here as Viral Genomic Address Messenger 853 (VGAM853) viral gene, which modulates expression of respective host target genes thereof, the function and utility of which host target genes is known in the art.

VGAM853 is a novel bioinformatically detected regulatory, non protein coding, viral micro RNA (miRNA) gene. The method by which VGAM853 was detected is described hereinabove with reference to FIGS. 1-8.

VGAM853 gene, herein designated VGAM GENE, is a viral gene contained in the genome of Ectromelia Virus. VGAM853 host target gene, herein designated VGAM HOST TARGET GENE, is a human gene contained in the human genome.

VGAM853 gene encodes a VGAM853 precursor RNA, herein designated VGAM PRECURSOR RNA. Similar to other miRNA genes, and unlike most ordinary genes, VGAM853 precursor RNA does not encode a protein. A nucleotide sequence identical or highly similar to the nucleotide sequence of VGAM853 precursor RNA is designated SEQ ID:839, and is provided hereinbelow with reference to the sequence listing part. Nucleotide sequence SEQ ID:839 is located at position 202536 relative to the genome of Ectromelia Virus.

VGAM853 precursor RNA folds onto itself, forming VGAM853 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM853 folded precursor RNA into VGAM853 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM853 RNA is designated SEQ ID:3564, and is provided hereinbelow with reference to the sequence listing part.

VGAM853 host target gene, herein designated VGAM HOST TARGET GENE, encodes a corresponding messenger RNA, VGAM853 host target RNA, herein designated VGAM HOST TARGET RNA. VGAM853 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM853 RNA, herein designated VGAM RNA, binds complementarily to one or more host target binding sites located in untranslated regions of VGAM853 host target RNA, herein designated VGAM HOST TARGET RNA. This complementary binding is due to the fact that the nucleotide sequence of VGAM853 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM853 RNA, herein designated VGAM RNA, may have a different number of host target binding sites in untranslated regions of a VGAM853 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM853 RNA, herein designated VGAM RNA, to host target binding sites on VGAM853 host target RNA, herein designated VGAM HOST TARGET RNA, such as BINDING SITE I, BINDING SITE II and BINDING SITE III, inhibits translation of VGAM853 host target RNA into VGAM853 host target protein, herein designated VGAM HOST TARGET PROTEIN. VGAM host target protein is therefore outlined by a broken line.

It is appreciated that VGAM853 host target gene, herein designated VGAM HOST TARGET GENE, in fact represents a plurality of VGAM853 host target genes. The mRNA of each one of this plurality of VGAM853 host target genes comprises one or more host target binding sites, each having a nucleotide sequence which is at least partly complementary to VGAM853 RNA, herein designated VGAM RNA, and which when bound by VGAM853 RNA causes inhibition of translation of respective one or more VGAM853 host target proteins.

It is further appreciated by one skilled in the art that the mode of translational inhibition illustrated by FIG. 1 with specific reference to translational inhibition exerted by VGAM853 gene, herein designated VGAM GENE, on one or more VGAM853 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM853 is inhibition of expression of host target genes, as part of a novel viral mechanism of attacking a host. Accordingly, utilities of VGAM853 include diagnosis, prevention and treatment of viral infection by Ectromelia Virus. Specific functions, and accordingly utilities, of VGAM853 correlate with, and may be deduced from, the identity of the host target genes which VGAM853 binds and inhibits, and the function of these host target genes, as elaborated hereinbelow.

Nucleotide sequences of the VGAM853 precursor RNA, herein designated VGAM PRECURSOR RNA, and of the 'diced' VGAM853 RNA, herein designated VGAM RNA, and a schematic representation of the secondary folding of VGAM853 folded precursor RNA, herein designated VGAM FOLDED PRECURSOR RNA, of VGAM853 are further described hereinbelow with reference to Table 1.

Nucleotide sequences of host target binding sites, such as BINDING SITE-I, BINDING SITE-II and BINDING SITE-III of FIG. 1, found on VGAM853 host target RNA, and schematic representation of the complementarity of each of these host target binding sites to VGAM853 RNA, herein designated VGAM RNA, are described hereinbelow with reference to Table 2.

As mentioned hereinabove with reference to FIG. 1, a function of VGAM853 gene, herein designated VGAM is inhibition of expression of VGAM853 target genes. It is appreciated that specific functions, and accordingly utilities, of VGAM853 correlate with, and may be deduced from, the identity of the target genes which VGAM853 binds and inhibits, and the function of these target genes, as elaborated hereinbelow.

LOC168512 (Accession XM_095148) is a VGAM853 host target gene. LOC168512 BINDING SITE is HOST TARGET binding site found in the 5' untranslated region of mRNA encoded by LOC168512, corresponding to a HOST TARGET binding site such as BINDING SITE I, BINDING SITE II or BINDING SITE III. Table 2 illustrates the complementarity of the nucleotide sequences of LOC168512 BINDING SITE, designated SEQ ID:40251, to the nucleotide sequence of VGAM853 RNA, herein designated VGAM RNA, also designated SEQ ID:3564.

A function of VGAM853 is therefore inhibition of LOC168512 (Accession XM_095148). Accordingly, utilities of VGAM853 include diagnosis, prevention and treatment of diseases and clinical conditions associated with LOC168512.

LOC200059 (Accession XM_114104) is another VGAM853 host target gene. LOC200059 BINDING SITE is HOST TARGET binding site found in the 3' untranslated region of mRNA encoded by LOC200059, corresponding to a HOST TARGET binding site such as BINDING SITE I, BINDING SITE II or BINDING SITE III. Table 2 illustrates the complementarity of the nucleotide sequences of LOC200059 BINDING SITE, designated SEQ ID:42699, to the nucleotide sequence of VGAM853 RNA, herein designated VGAM RNA, also designated SEQ ID:3564.

Another function of VGAM853 is therefore inhibition of LOC200059 (Accession XM_114104). Accordingly, utilities of VGAM853 include diagnosis, prevention and treatment of diseases and clinical conditions associated with LOC200059.

LOC81537 (Accession NM_030791) is another VGAM853 host target gene. LOC81537 BINDING SITE is HOST TARGET binding site found in the 3' untranslated region of mRNA encoded by LOC81537, corresponding to a HOST TARGET binding site such as BINDING SITE I, BINDING SITE II or BINDING SITE III. Table 2 illustrates the complementarity of the nucleotide sequences of LOC81537 BINDING SITE, designated SEQ ID:25087, to the nucleotide sequence of VGAM853 RNA, herein designated VGAM RNA, also designated SEQ ID:3564.

Another function of VGAM853 is therefore inhibition of LOC81537 (Accession NM_030791). Accordingly, utilities of VGAM853 include diagnosis, prevention and treatment of diseases and clinical conditions associated with LOC81537.

FIG. 1 further provides a conceptual description of a novel bioinformatically detected viral gene of the present invention, referred to here as Viral Genomic Address Messenger 854 (VGAM854) viral gene, which modulates expression of respective host target genes thereof, the function and utility of which host target genes is known in the art.

VGAM854 is a novel bioinformatically detected regulatory, non protein coding, viral micro RNA (miRNA) gene. The method by which VGAM854 was detected is described hereinabove with reference to FIGS. 1-8.

VGAM854 gene, herein designated VGAM GENE, is a viral gene contained in the genome of Amsacta Moorei Entomopoxvirus. VGAM854 host target gene, herein designated VGAM HOST TARGET GENE, is a human gene contained in the human genome.

VGAM854 gene encodes a VGAM854 precursor RNA, herein designated VGAM PRECURSOR RNA. Similar to other miRNA genes, and unlike most ordinary genes, VGAM854 precursor RNA does not encode a protein. A nucleotide sequence identical or highly similar to the nucleotide sequence of VGAM854 precursor RNA is designated SEQ ID:840, and is provided hereinbelow with reference to the sequence listing part. Nucleotide sequence SEQ ID:840 is located at position 79626 relative to the genome of Amsacta Moorei Entomopoxvirus.

VGAM854 precursor RNA folds onto itself, forming VGAM854 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM854 folded precursor RNA into VGAM854 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM854 RNA is designated SEQ ID:3565, and is provided hereinbelow with reference to the sequence listing part.

VGAM854 host target gene, herein designated VGAM HOST TARGET GENE, encodes a corresponding messenger RNA, VGAM854 host target RNA, herein designated VGAM HOST TARGET RNA. VGAM854 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM854 RNA, herein designated VGAM RNA, binds complementarily to one or more host target binding sites located in untranslated regions of VGAM854 host target RNA, herein designated VGAM HOST TARGET RNA. This complementary binding is due to the fact that the nucleotide sequence of VGAM854 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM854 RNA, herein designated VGAM RNA, may have a different number of host target binding sites in untranslated regions of a VGAM854 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM854 RNA, herein designated VGAM RNA, to host target binding sites on VGAM854 host target RNA, herein designated VGAM HOST TARGET RNA, such as BINDING SITE I, BINDING SITE II and BINDING SITE III, inhibits translation of VGAM854 host target RNA into VGAM854 host target protein, herein designated VGAM HOST TARGET PROTEIN. VGAM host target protein is therefore outlined by a broken line.

It is appreciated that VGAM854 host target gene, herein designated VGAM HOST TARGET GENE, in fact represents a plurality of VGAM854 host target genes. The mRNA of each one of this plurality of VGAM854 host target genes comprises one or more host target binding sites, each having a nucleotide sequence which is at least partly complementary to VGAM854 RNA, herein designated VGAM RNA, and which when bound by VGAM854 RNA causes inhibition of translation of respective one or more VGAM854 host target proteins.

It is further appreciated by one skilled in the art that the mode of translational inhibition illustrated by FIG. 1 with specific reference to translational inhibition exerted by VGAM854 gene, herein designated VGAM GENE, on one or more VGAM854 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM854 is inhibition of expression of host target genes, as part of a novel viral mechanism of attacking a host. Accordingly, utilities of VGAM854 include diagnosis, prevention and treatment of viral infection by Amsacta Moorei Entomopoxvirus. Specific functions, and accordingly utilities, of VGAM854 correlate with, and may be deduced from, the identity of the host target genes which VGAM854 binds and inhibits, and the function of these host target genes, as elaborated hereinbelow.

Nucleotide sequences of the VGAM854 precursor RNA, herein designated VGAM PRECURSOR RNA, and of the 'diced' VGAM854 RNA, herein designated VGAM RNA, and a schematic representation of the secondary folding of VGAM854 folded precursor RNA, herein designated VGAM FOLDED PRECURSOR RNA, of VGAM854 are further described hereinbelow with reference to Table 1.

Nucleotide sequences of host target binding sites, such as BINDING SITE-I, BINDING SITE-II and BINDING SITE-III of FIG. 1, found on VGAM854 host target RNA, and schematic representation of the complementarity of each of these host target binding sites to VGAM854 RNA, herein designated VGAM RNA, are described hereinbelow with reference to Table 2.

As mentioned hereinabove with reference to FIG. 1, a function of VGAM854 gene, herein designated VGAM is inhibition of expression of VGAM854 target genes. It is appreciated that specific functions, and accordingly utilities, of VGAM854 correlate with, and may be deduced from, the identity of the target genes which VGAM854 binds and inhibits, and the function of these target genes, as elaborated hereinbelow.

Egl Nine Homolog 1 (C. elegans) (EGLN1, Accession NM_022051) is a VGAM854 host target gene. EGLN1 BINDING SITE is HOST TARGET binding site found in the 5' untranslated region of mRNA encoded by EGLN1, corresponding to a HOST TARGET binding site such as BINDING SITE I, BINDING SITE II or BINDING SITE III. Table 2 illustrates the complementarity of the nucleotide sequences of EGLN1 BINDING SITE, designated SEQ ID:22581, to the nucleotide sequence of VGAM854 RNA, herein designated VGAM RNA, also designated SEQ ID:3565.

A function of VGAM854 is therefore inhibition of Egl Nine Homolog 1 (C. elegans) (EGLN1, Accession NM_022051), a gene which is expressed in the cytoplasm of arterial smooth muscle cells. Accordingly, utilities of VGAM854 include diagnosis, prevention and treatment of diseases and clinical conditions associated with EGLN1. The function of EGLN1 and its association with various diseases and clinical conditions, has been established by previous studies, as described hereinabove with reference to VGAM216. KIP2 (Accession NM_006383) is another VGAM854 host target gene. KIP2 BINDING SITE is HOST TARGET binding site found in the 3' untranslated region of mRNA encoded by KIP2, corresponding to a HOST TARGET binding site such as BINDING SITE I, BINDING SITE II or BINDING SITE III. Table 2 illustrates the complementarity of the nucleotide sequences of KIP2 BINDING SITE, designated SEQ ID:13087, to the nucleotide sequence of VGAM854 RNA, herein designated VGAM RNA, also designated SEQ ID:3565.

Another function of VGAM854 is therefore inhibition of KIP2 (Accession NM_006383). Accordingly, utilities of VGAM854 include diagnosis, prevention and treatment of diseases and clinical conditions associated with KIP2. Myotubularin Related Protein 8 (MTMR8, Accession NM_015458) is another VGAM854 host target gene. MTMR8 BINDING SITE is HOST TARGET binding site found in the 3' untranslated region of mRNA encoded by MTMR8, corresponding to a HOST TARGET binding site such as BINDING SITE I, BINDING SITE II or BINDING SITE III. Table 2 illustrates the complementarity of the nucleotide sequences of MTMR8 BINDING SITE, designated SEQ ID:17743, to the nucleotide sequence of VGAM854 RNA, herein designated VGAM RNA, also designated SEQ ID:3565.

Another function of VGAM854 is therefore inhibition of Myotubularin Related Protein 8 (MTMR8, Accession NM_015458), a gene which could be a tyrosine-phosphatase. Accordingly, utilities of VGAM854 include diagnosis, prevention and treatment of diseases and clinical conditions associated with MTMR8. The function of MTMR8 and its association with various diseases and clinical conditions, has been established by previous studies, as described hereinabove with reference to VGAM379. Ubiquitin-conjugating Enzyme E2A (RAD6 homolog) (UBE2A, Accession NM_003336) is another VGAM854 host target gene. UBE2A BINDING SITE is HOST TARGET binding site found in the 3" untranslated region of mRNA encoded by UBE2A, corresponding to a HOST TARGET binding site such as BINDING SITE I, BINDING SITE II or BINDING SITE III. Table 2 illustrates the complementarity of the nucleotide sequences of UBE2A BINDING SITE, designated SEQ ID:9340, to the nucleotide sequence of VGAM854 RNA, herein designated VGAM RNA, also designated SEQ ID:3565.

Another function of VGAM854 is therefore inhibition of Ubiquitin-conjugating Enzyme E2A (RAD6 homolog) (UBE2A, Accession NM_003336), a gene which catalyzes the covalent attachment of ubiquitin to other proteins and is required for postreplication repair of uv-damaged dna. Accordingly, utilities of VGAM854 include diagnosis, prevention and treatment of diseases and clinical conditions associated with UBE2A. The function of UBE2A and its association with various diseases and clinical conditions, has been established by previous studies, as described hereinabove with reference to VGAM294. Basic Leucine Zipper Nuclear Factor 1 (JEM-1) (BLZF1, Accession NM_003666) is another VGAM854 host target gene. BLZF1 BINDING SITE is HOST TARGET binding site found in the 5' untranslated region of mRNA encoded by BLZF1, corresponding to a HOST TARGET binding site such as BINDING SITE I, BINDING SITE II or BINDING SITE III. Table 2 illustrates the complementarity of the nucleotide sequences of BLZF1 BINDING SITE, designated SEQ ID:9749, to the nucleotide sequence of VGAM854 RNA, herein designated VGAM RNA, also designated SEQ ID:3565.

Another function of VGAM854 is therefore inhibition of Basic Leucine Zipper Nuclear Factor 1 (JEM-1) (BLZF1, Accession NM_003666). Accordingly, utilities of VGAM854 include diagnosis, prevention and treatment of diseases and clinical conditions associated with BLZF1. FLJ20069 (Accession NM_017651) is another VGAM854 host target gene. FLJ20069 BINDING SITE is HOST TARGET binding site found in the 3' untranslated region of mRNA encoded by FLJ20069, corresponding to a HOST TARGET binding site such as BINDING SITE I, BINDING SITE II or BINDING SITE III. Table 2 illustrates the complementarity of the nucleotide sequences of FLJ20069 BINDING SITE, designated SEQ ID:19160, to the nucleotide sequence of VGAM854 RNA, herein designated VGAM RNA, also designated SEQ ID:3565.

Another function of VGAM854 is therefore inhibition of FLJ20069 (Accession NM_017651). Accordingly, utilities of VGAM854 include diagnosis, prevention and treatment of diseases and clinical conditions associated with FLJ20069. LCE (Accession NM_024090) is another VGAM854 host target gene. LCE BINDING SITE is HOST TARGET binding site found in the 3" untranslated region of mRNA encoded by LCE, corresponding to a HOST TARGET binding site such as BINDING SITE I, BINDING SITE II or BINDING SITE III. Table 2 illustrates the complementarity of the nucleotide sequences of LCE BINDING SITE, designated SEQ ID:23533, to the nucleotide sequence of VGAM854 RNA, herein designated VGAM RNA, also designated SEQ ID:3565.

Another function of VGAM854 is therefore inhibition of LCE (Accession NM_024090). Accordingly, utilities of VGAM854 include diagnosis, prevention and treatment of diseases and clinical conditions associated with LCE. LOC147219 (Accession XM_097214) is another VGAM854 host target gene. LOC147219 BINDING SITE is HOST TARGET binding site found in the 5' untranslated region of mRNA encoded by LOC147219, corresponding to a HOST TARGET binding site such as BINDING SITE I, BINDING SITE II or BINDING SITE III. Table 2 illustrates the complementarity of the nucleotide sequences of LOC147219 BINDING SITE, designated SEQ ID:40821, to the nucleotide sequence of VGAM854 RNA, herein designated VGAM RNA, also designated SEQ ID:3565.

Another function of VGAM854 is therefore inhibition of LOC147219 (Accession XM_097214). Accordingly, utilities of VGAM854 include diagnosis, prevention and treatment of diseases and clinical conditions associated with LOC147219. FIG. 1 further provides a conceptual description of a novel bioinformatically detected viral gene of the present invention, referred to here as Viral Genomic Address Messenger 855 (VGAM855) viral gene, which modulates expression of respective host target genes thereof, the function and utility of which host target genes is known in the art.

VGAM855 is a novel bioinformatically detected regulatory, non protein coding, viral micro RNA (miRNA) gene. The method by which VGAM855 was detected is described hereinabove with reference to FIGS. 1-8.

VGAM855 gene, herein designated VGAM GENE, is a viral gene contained in the genome of African Swine Fever Virus. VGAM855 host target gene, herein designated VGAM HOST TARGET GENE, is a human gene contained in the human genome.

VGAM855 gene encodes a VGAM855 precursor RNA, herein designated VGAM PRECURSOR RNA. Similar to other miRNA genes, and unlike most ordinary genes, VGAM855 precursor RNA does not encode a protein. A nucleotide sequence identical or highly similar to the nucleotide sequence of VGAM855 precursor RNA is designated SEQ ID:841, and is provided hereinbelow with reference to the sequence listing part. Nucleotide sequence SEQ ID:841 is located at position 45064 relative to the genome of African Swine Fever Virus.

VGAM855 precursor RNA folds onto itself, forming VGAM855 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM855 folded precursor RNA into VGAM855 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM855 RNA is designated SEQ ID:3566, and is provided hereinbelow with reference to the sequence listing part.

VGAM855 host target gene, herein designated VGAM HOST TARGET GENE, encodes a corresponding messenger RNA, VGAM855 host target RNA, herein designated VGAM HOST TARGET RNA. VGAM855 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM855 RNA, herein designated VGAM RNA, binds complementarily to one or more host target binding sites located in untranslated regions of VGAM855 host target RNA, herein designated VGAM HOST TARGET RNA. This complementary binding is due to the fact that the nucleotide sequence of VGAM855 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM855 RNA, herein designated VGAM RNA, may have a different number of host target binding sites in untranslated regions of a VGAM855 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM855 RNA, herein designated VGAM RNA, to host target binding sites on VGAM855 host target RNA, herein designated VGAM HOST TARGET RNA, such as BINDING SITE I, BINDING SITE II and BINDING SITE III, inhibits translation of VGAM855 host target RNA into VGAM855 host target protein, herein designated VGAM HOST TARGET PROTEIN. VGAM host target protein is therefore outlined by a broken line.

It is appreciated that VGAM855 host target gene, herein designated VGAM HOST TARGET GENE, in fact represents a plurality of VGAM855 host target genes. The mRNA of each one of this plurality of VGAM855 host target genes comprises one or more host target binding sites, each having a nucleotide sequence which is at least partly complementary to VGAM855 RNA, herein designated VGAM RNA, and which when bound by VGAM855 RNA causes inhibition of translation of respective one or more VGAM855 host target proteins.

It is further appreciated by one skilled in the art that the mode of translational inhibition illustrated by FIG. 1 with specific reference to translational inhibition exerted by VGAM855 gene, herein designated VGAM GENE, on one or more VGAM855 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM855 is inhibition of expression of host target genes, as part of a novel viral mechanism of attacking a host. Accordingly, utilities of VGAM855 include diagnosis, prevention and treatment of viral infection by African Swine Fever Virus. Specific functions, and accordingly utilities, of VGAM855 correlate with, and may be deduced from, the identity of the host target genes which VGAM855 binds and inhibits, and the function of these host target genes, as elaborated hereinbelow.

Nucleotide sequences of the VGAM855 precursor RNA, herein designated VGAM PRECURSOR RNA, and of the 'diced' VGAM855 RNA, herein designated VGAM RNA, and a schematic representation of the secondary folding of VGAM855 folded precursor RNA, herein designated VGAM FOLDED PRECURSOR RNA, of VGAM855 are further described hereinbelow with reference to Table 1.

Nucleotide sequences of host target binding sites, such as BINDING SITE-I, BINDING SITE-II and BINDING SITE-III of FIG. 1, found on VGAM855 host target RNA, and schematic representation of the complementarity of each of these host target binding sites to VGAM855 RNA, herein designated VGAM RNA, are described hereinbelow with reference to Table 2.

As mentioned hereinabove with reference to FIG. 1, a function of VGAM855 gene, herein designated VGAM is inhibition of expression of VGAM855 target genes. It is appreciated that specific functions, and accordingly utilities, of VGAM855 correlate with, and may be deduced from, the identity of the target genes which VGAM855 binds and inhibits, and the function of these target genes, as elaborated hereinbelow.

Ets Homologous Factor (EHF, Accession NM_012153) is a VGAM855 host target gene. EHF BINDING SITE is HOST TARGET binding site found in the 3" untranslated region of mRNA encoded by EHF, corresponding to a HOST TARGET binding site such as BINDING SITE I, BINDING SITE II or BINDING SITE III. Table 2 illustrates the complementarity of the nucleotide sequences of EHF BINDING SITE, designated SEQ ID:14451, to the nucleotide sequence of VGAM855 RNA, herein designated VGAM RNA, also designated SEQ ID:3566.

A function of VGAM855 is therefore inhibition of Ets Homologous Factor (EHF, Accession NM_012153), a gene which is Member of the ESE subfamily of Ets transcription factors. Accordingly, utilities of VGAM855 include diagnosis, prevention and treatment of diseases and clinical conditions associated with EHF. The function of EHF has been established by previous studies. By searching an EST database, Kas et al. (2000) identified an EST with sequence similarity to the ETS domain of human ESE1 (ELF3; 602191). They obtained a full-length cDNA encoding EHF, which they called ESE3, by using 5-prime RACE on human prostate cDNA. RT-PCR analysis identified 2 alternatively spliced forms of ESE3, ESE3a and ESE3b. Sequence analysis predicted that ESE3a encodes a 277-amino acid protein with a molecular mass of 32.3 kD, while ESE3b encodes a 300-amino acid protein with a molecular mass of 34.9 kD. The C-terminal ETS domain of ESE3 is 84% and 65% identical to the ETS domains of ESE1 and ESE2 (ELF5; 605169), respectively. Northern blot analysis detected a 5.9-kb ESE3 transcript in pancreas and prostate, with lower levels detected in kidney and colon. Dot blot analysis detected high levels of ESE3 expression in salivary gland, prostate, and trachea, with lower levels detected in colon, mammary gland, pancreas, lung, stomach, appendix, fetal kidney, and fetal lung. Using RT-PCR on primary and tumor-derived cell lines, the authors detected expression of ESE3 in tumor cells of epithelial origin. Gel-shift experiments showed binding of ESE3 to 3 high-affinity binding sites in the MET (OMIM Ref. No. 164860) promoter. Cotransfection of ESE3 expression vectors with a MET promoter-luciferase reporter construct demonstrated that both ESE3a and ESE3b act as transcriptional activators on this promoter. Kleinbaum et al. (1999) mapped the EHF gene to 11p12 by somatic cell hybrid analysis and FISH.

Full details of the abovementioned studies are described in the following publications, the disclosure of which are hereby incorporated by reference:

Kas, K.; Finger, E.; Grall, F.; Gu, X.; Akbarali, Y.; Boltax, J.; Weiss, A.; Oettgen, P.; Kapeller, R.; Libermann, T. A.: ESE-3, a novel member of an epithelium-specific Ets transcription factor subfamily, demonstrates different target gene specificity from ESE-1. J. Biol. Chem. 275:2986-2998, 2000; and Kleinbaum, L. A.; Duggan, C.; Ferreira, E.; Coffey, G. P.; Buttice, G.; Burton, F. H.: Human chromosomal localization, tissue/tumor expression, and regulatory function of the ets fami.

Further studies establishing the function and utilities of EHF are found in John Hopkins OMIM database record ID 605439, and in sited publications numbered 4792-4793 listed in the bibliography section hereinbelow, which are also hereby incorporated by reference. Estrogen Receptor 1 (ESR1, Accession NM_000125) is another VGAM855 host target gene. ESR1 BINDING SITE is HOST TARGET binding site found in the 3' untranslated region of mRNA encoded by ESR1, corresponding to a HOST TARGET binding site such as BINDING SITE I, BINDING SITE II or BINDING SITE III. Table 2 illustrates the complementarity of the nucleotide sequences of ESR1 BINDING SITE, designated SEQ ID:5598, to the nucleotide sequence of VGAM855 RNA, herein designated VGAM RNA, also designated SEQ ID:3566.

Another function of VGAM855 is therefore inhibition of Estrogen Receptor 1 (ESR1, Accession NM_000125), a gene which involved in hormone-mediated inhibition of gene expression. Accordingly, utilities of VGAM855 include diagnosis, prevention and treatment of diseases and clinical conditions associated with ESR1. The function of ESR1 and its association with various diseases and clinical conditions, has been established by previous studies, as described hereinabove with reference to VGAM695. FLJ11053 (Accession XM_114194) is another VGAM855 host target gene. FLJ11053 BINDING SITE is HOST TARGET binding site found in the 3' untranslated region of mRNA encoded by FLJ11053, corresponding to a HOST TARGET binding site such as BINDING SITE I, BINDING SITE II or BINDING SITE III. Table 2 illustrates the complementarity of the nucleotide sequences of FLJ11053 BINDING SITE, designated SEQ ID:42776, to the nucleotide sequence of VGAM855 RNA, herein designated VGAM RNA, also designated SEQ ID:3566.

Another function of VGAM855 is therefore inhibition of FLJ11053 (Accession XM_114194). Accordingly, utilities of VGAM855 include diagnosis, prevention and treatment of diseases and clinical conditions associated with FLJ11053. FLJ11827 (Accession NM_025093) is another VGAM855 host target gene. FLJ11827 BINDING SITE is HOST TARGET binding site found in the 3' untranslated region of mRNA encoded by FLJ11827, corresponding to a HOST TARGET binding site such as BINDING SITE I, BINDING SITE II or BINDING SITE III. Table 2 illustrates the complementarity of the nucleotide sequences of FLJ11827 BINDING SITE, designated SEQ ID:24720, to the nucleotide sequence of VGAM855 RNA, herein designated VGAM RNA, also designated SEQ ID:3566.

Another function of VGAM855 is therefore inhibition of FLJ11827 (Accession NM_025093). Accordingly, utilities of VGAM855 include diagnosis, prevention and treatment of diseases and clinical conditions associated with FLJ11827. LOC253664 (Accession XM_170673) is another VGAM855 host target gene. LOC253664 BINDING SITE is HOST TARGET binding site found in the 3' untranslated region of mRNA encoded by LOC253664, corresponding to a HOST TARGET binding site such as BINDING SITE I, BINDING SITE II or BINDING SITE III. Table 2 illustrates the complementarity of the nucleotide sequences of LOC253664 BINDING SITE, designated SEQ ID:45447, to the nucleotide sequence of VGAM855 RNA, herein designated VGAM RNA, also designated SEQ ID:3566.

Another function of VGAM855 is therefore inhibition of LOC253664 (Accession XM_170673). Accordingly, utilities of VGAM855 include diagnosis, prevention and treatment of diseases and clinical conditions associated with LOC253664. FIG. 1 further provides a conceptual description of a novel bioinformatically detected viral gene of the present invention, referred to here as Viral Genomic Address Messenger 856 (VGAM856) viral gene, which modulates expression of respective host target genes thereof, the function and utility of which host target genes is known in the art.

VGAM856 is a novel bioinformatically detected regulatory, non protein coding, viral micro RNA (miRNA) gene. The method by which VGAM856 was detected is described hereinabove with reference to FIGS. 1-8.

VGAM856 gene, herein designated VGAM GENE, is a viral gene contained in the genome of African Swine Fever Virus. VGAM856 host target gene, herein designated VGAM HOST TARGET GENE, is a human gene contained in the human genome.

VGAM856 gene encodes a VGAM856 precursor RNA, herein designated VGAM PRECURSOR RNA. Similar to other miRNA genes, and unlike most ordinary genes, VGAM856 precursor RNA does not encode a protein. A nucleotide sequence identical or highly similar to the nucleotide sequence of VGAM856 precursor RNA is designated SEQ ID:842, and is provided hereinbelow with reference to the sequence listing part. Nucleotide sequence SEQ ID:842 is located at position 43493 relative to the genome of African Swine Fever Virus.

VGAM856 precursor RNA folds onto itself, forming VGAM856 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM856 folded precursor RNA into VGAM856 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM856 RNA is designated SEQ ID:3567, and is provided hereinbelow with reference to the sequence listing part.

VGAM856 host target gene, herein designated VGAM HOST TARGET GENE, encodes a corresponding messenger RNA, VGAM856 host target RNA, herein designated VGAM HOST TARGET RNA. VGAM856 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM856 RNA, herein designated VGAM RNA, binds complementarily to one or more host target binding sites located in untranslated regions of VGAM856 host target RNA, herein designated VGAM HOST TARGET RNA. This complementary binding is due to the fact that the nucleotide sequence of VGAM856 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM856 RNA, herein designated VGAM RNA, may have a different number of host target binding sites in untranslated regions of a VGAM856 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM856 RNA, herein designated VGAM RNA, to host target binding sites on VGAM856 host target RNA, herein designated VGAM HOST TARGET RNA, such as BINDING SITE I, BINDING SITE II and BINDING SITE III, inhibits translation of VGAM856 host target RNA into VGAM856 host target protein, herein designated VGAM HOST TARGET PROTEIN. VGAM host target protein is therefore outlined by a broken line.

It is appreciated that VGAM856 host target gene, herein designated VGAM HOST TARGET GENE, in fact represents a plurality of VGAM856 host target genes. The mRNA of each one of this plurality of VGAM856 host target genes comprises one or more host target binding sites, each having a nucleotide sequence which is at least partly complementary to VGAM856 RNA, herein designated VGAM RNA, and which when bound by VGAM856 RNA causes inhibition of translation of respective one or more VGAM856 host target proteins.

It is further appreciated by one skilled in the art that the mode of translational inhibition illustrated by FIG. 1 with specific reference to translational inhibition exerted by VGAM856 gene, herein designated VGAM GENE, on one or more VGAM856 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM856 is inhibition of expression of host target genes, as part of a novel viral mechanism of attacking a host. Accordingly, utilities of VGAM856 include diagnosis, prevention and treatment of viral infection by African Swine Fever Virus. Specific functions, and accordingly utilities, of VGAM856 correlate with, and may be deduced from, the identity of the host target genes which VGAM856 binds and inhibits, and the function of these host target genes, as elaborated hereinbelow.

Nucleotide sequences of the VGAM856 precursor RNA, herein designated VGAM PRECURSOR RNA, and of the 'diced' VGAM856 RNA, herein designated VGAM RNA, and a schematic representation of the secondary folding of VGAM856 folded precursor RNA, herein designated VGAM FOLDED PRECURSOR RNA, of VGAM856 are further described hereinbelow with reference to Table 1.

Nucleotide sequences of host target binding sites, such as BINDING SITE-I, BINDING SITE-II and BINDING SITE-III of FIG. 1, found on VGAM856 host target RNA, and schematic representation of the complementarity of each of these host target binding sites to VGAM856 RNA, herein designated VGAM RNA, are described hereinbelow with reference to Table 2.

As mentioned hereinabove with reference to FIG. 1, a function of VGAM856 gene, herein designated VGAM is inhibition of expression of VGAM856 target genes. It is appreciated that specific functions, and accordingly utilities, of VGAM856 correlate with, and may be deduced from, the identity of the target genes which VGAM856 binds and inhibits, and the function of these target genes, as elaborated hereinbelow.

Sparc/osteonectin, Cwcv and Kazal-like Domains Proteoglycan (testican) (SPOCK, Accession XM_031696) is a VGAM856 host target gene. SPOCK BINDING SITE is HOST TARGET binding site found in the 5' untranslated region of mRNA encoded by SPOCK, corresponding to a HOST TARGET binding site such as BINDING SITE I, BINDING SITE II or BINDING SITE III. Table 2 illustrates the complementarity of the nucleotide sequences of SPOCK BINDING SITE, designated SEQ ID:31455, to the nucleotide sequence of VGAM856 RNA, herein designated VGAM RNA, also designated SEQ ID:3567.

A function of VGAM856 is therefore inhibition of Sparc/osteonectin, Cwcv and Kazal-like Domains Proteoglycan (testican) (SPOCK, Accession XM_031696). Accordingly, utilities of VGAM856 include diagnosis, prevention and treatment of diseases and clinical conditions associated with SPOCK. BOP (Accession XM_097915) is another VGAM856 host target gene. BOP BINDING SITE is HOST TARGET binding site found in the 5' untranslated region of mRNA encoded by BOP, corresponding to a HOST TARGET binding site such as BINDING SITE I, BINDING SITE II or BINDING SITE III. Table 2 illustrates the complementarity of the nucleotide sequences of BOP BINDING SITE, designated SEQ ID:41207, to the nucleotide sequence of VGAM856 RNA, herein designated VGAM RNA, also designated SEQ ID:3567.

Another function of VGAM856 is therefore inhibition of BOP (Accession XM_097915). Accordingly, utilities of VGAM856 include diagnosis, prevention and treatment of diseases and clinical conditions associated with BOP. CHRNA7 (cholinergic receptor, nicotinic, alpha polypeptide 7, exons 5-10) and FAM7A (family with sequence similarity 7A, exons A-E) Fusion (CHRFAM7A, Accession XM_170784) is another VGAM856 host target gene. CHRFAM7A BINDING SITE is HOST TARGET binding site found in the 3' untranslated region of mRNA encoded by CHRFAM7A, corresponding to a HOST TARGET binding site such as BINDING SITE I, BINDING SITE II or BINDING SITE III. Table 2 illustrates the complementarity of the nucleotide sequences of CHRFAM7A BINDING SITE, designated SEQ ID:45552, to the nucleotide sequence of VGAM856 RNA, herein designated VGAM RNA, also designated SEQ ID:3567.

Another function of VGAM856 is therefore inhibition of CHRNA7 (cholinergic receptor, nicotinic, alpha polypeptide 7, exons 5-10) and FAM7A (family with sequence similarity 7A, exons A-E) Fusion (CHRFAM7A, Accession XM_170784). Accordingly, utilities of VGAM856 include diagnosis, prevention and treatment of diseases and clinical conditions associated with CHRFAM7A. KIAA1416 (Accession XM_098762) is another VGAM856 host target gene. KIAA1416 BINDING SITE is HOST TARGET binding site found in the 3' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41799, to the nucleotide sequence of VGAM856 RNA, herein designated VGAM RNA, also designated SEQ ID:3567.

Another function of VGAM856 is therefore inhibition of KIAA1416 (Accession XM_098762). Accordingly, utilities of VGAM856 include diagnosis, prevention and treatment of diseases and clinical conditions associated with KIAA1416. LBP-9 (Accession NM_014553) is another VGAM856 host target gene. LBP-9 BINDING SITE is HOST TARGET binding site found in the 3' untranslated region of mRNA encoded by LBP-9, corresponding to a HOST TARGET binding site such as BINDING SITE I, BINDING SITE II or BINDING SITE III. Table 2 illustrates the complementarity of the nucleotide sequences of LBP-9 BINDING SITE, designated SEQ ID:15878, to the nucleotide sequence of VGAM856 RNA, herein designated VGAM RNA, also designated SEQ ID:3567.

Another function of VGAM856 is therefore inhibition of LBP-9 (Accession NM_014553). Accordingly, utilities of VGAM856 include diagnosis, prevention and treatment of diseases and clinical conditions associated with LBP-9. LOC132625 (Accession XM_067946) is another VGAM856 host target gene. LOC132625 BINDING SITE is HOST TARGET binding site found in the 3' untranslated region of mRNA encoded by LOC132625, corresponding to a HOST TARGET binding site such as BINDING SITE I, BINDING SITE II or BINDING SITE III. Table 2 illustrates the complementarity of the nucleotide sequences of LOC132625 BINDING SITE, designated SEQ ID:37371, to the nucleotide sequence of VGAM856 RNA, herein designated VGAM RNA, also designated SEQ ID:3567.

Another function of VGAM856 is therefore inhibition of LOC132625 (Accession XM_067946). Accordingly, utilities of VGAM856 include diagnosis, prevention and treatment of diseases and clinical conditions associated with LOC132625. LOC148811 (Accession XM_086326) is another VGAM856 host target gene. LOC148811 BINDING SITE is HOST TARGET binding site found in the 3' untranslated region of mRNA encoded by LOC148811, corresponding to a HOST TARGET binding site such as BINDING SITE I, BINDING SITE II or BINDING SITE III. Table 2 illustrates the complementarity of the nucleotide sequences of LOC148811 BINDING SITE, designated SEQ ID:38597, to the nucleotide sequence of VGAM856 RNA, herein designated VGAM RNA, also designated SEQ ID:3567.

Another function of VGAM856 is therefore inhibition of LOC148811 (Accession XM_086326). Accordingly, utilities of VGAM856 include diagnosis, prevention and treatment of diseases and clinical conditions associated with LOC148811. LOC256733 (Accession XM_173116) is another VGAM856 host target gene. LOC256733 BINDING SITE is HOST TARGET binding site found in the 5' untranslated region of mRNA encoded by LOC256733, corresponding to a HOST TARGET binding site such as BINDING SITE I, BINDING SITE II or BINDING SITE III. Table 2 illustrates the complementarity of the nucleotide sequences of LOC256733 BINDING SITE, designated SEQ ID:46367, to the nucleotide sequence of VGAM856 RNA, herein designated VGAM RNA, also designated SEQ ID:3567.

Another function of VGAM856 is therefore inhibition of LOC256733 (Accession XM_173116). Accordingly, utilities of VGAM856 include diagnosis, prevention and treatment of diseases and clinical conditions associated with LOC256733. LOC90936 (Accession XM_034953) is another VGAM856 host target gene. LOC90936 BINDING SITE is HOST TARGET binding site found in the 5' untranslated region of mRNA encoded by LOC90936, corresponding to a HOST TARGET binding site such as BINDING SITE I, BINDING SITE II or BINDING SITE III. Table 2 illustrates the complementarity of the nucleotide sequences of LOC90936 BINDING SITE, designated SEQ ID:32188, to the nucleotide sequence of VGAM856 RNA, herein designated VGAM RNA, also designated SEQ ID:3567.

Another function of VGAM856 is therefore inhibition of LOC90936 (Accession XM_034953). Accordingly, utilities of VGAM856 include diagnosis, prevention and treatment of diseases and clinical conditions associated with LOC90936. FIG. 1 further provides a conceptual description of a novel bioinformatically detected viral gene of the present invention, referred to here as Viral Genomic Address Messenger 857 (VGAM857) viral gene, which modulates expression of respective host target genes thereof, the function and utility of which host target genes is known in the art.

VGAM857 is a novel bioinformatically detected regulatory, non protein coding, viral micro RNA (miRNA) gene. The method by which VGAM857 was detected is described hereinabove with reference to FIGS. 1-8.

VGAM857 gene, herein designated VGAM GENE, is a viral gene contained in the genome of Ectromelia Virus. VGAM857 host target gene, herein designated VGAM HOST TARGET GENE, is a human gene contained in the human genome.

VGAM857 gene encodes a VGAM857 precursor RNA, herein designated VGAM PRECURSOR RNA. Similar to other miRNA genes, and unlike most ordinary genes, VGAM857 precursor RNA does not encode a protein. A nucleotide sequence identical or highly similar to the nucleotide sequence of VGAM857 precursor RNA is designated SEQ ID:843, and is provided hereinbelow with reference to the sequence listing part. Nucleotide sequence SEQ ID:843 is located at position 134388 relative to the genome of Ectromelia Virus.

VGAM857 precursor RNA folds onto itself, forming VGAM857 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM857 folded precursor RNA into VGAM857 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM857 RNA is designated SEQ ID:3568, and is provided hereinbelow with reference to the sequence listing part.

VGAM857 host target gene, herein designated VGAM HOST TARGET GENE, encodes a corresponding messenger RNA, VGAM857 host target RNA, herein designated VGAM HOST TARGET RNA. VGAM857 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM857 RNA, herein designated VGAM RNA, binds complementarily to one or more host target binding sites located in untranslated regions of VGAM857 host target RNA, herein designated VGAM HOST TARGET RNA. This complementary binding is due to the fact that the nucleotide sequence of VGAM857 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM857 RNA, herein designated VGAM RNA, may have a different number of host target binding sites in untranslated regions of a VGAM857 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM857 RNA, herein designated VGAM RNA, to host target binding sites on VGAM857 host target RNA, herein designated VGAM HOST TARGET RNA, such as BINDING SITE I, BINDING SITE II and BINDING SITE III, inhibits translation of VGAM857 host target RNA into VGAM857 host target protein, herein designated VGAM HOST TARGET PROTEIN. VGAM host target protein is therefore outlined by a broken line.

It is appreciated that VGAM857 host target gene, herein designated VGAM HOST TARGET GENE, in fact represents a plurality of VGAM857 host target genes. The mRNA of each one of this plurality of VGAM857 host target genes comprises one or more host target binding sites, each having a nucleotide sequence which is at least partly complementary to VGAM857 RNA, herein designated VGAM RNA, and which when bound by VGAM857 RNA causes inhibition of translation of respective one or more VGAM857 host target proteins.

It is further appreciated by one skilled in the art that the mode of translational inhibition illustrated by FIG. 1 with specific reference to translational inhibition exerted by VGAM857 gene, herein designated VGAM GENE, on one or more VGAM857 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM857 is inhibition of expression of host target genes, as part of a novel viral mechanism of attacking a host. Accordingly, utilities of VGAM857 include diagnosis, prevention and treatment of viral infection by Ectromelia Virus. Specific functions, and accordingly utilities, of VGAM857 correlate with, and may be deduced from, the identity of the host target genes which VGAM857 binds and inhibits, and the function of these host target genes, as elaborated hereinbelow.

Nucleotide sequences of the VGAM857 precursor RNA, herein designated VGAM PRECURSOR RNA, and of the 'diced' VGAM857 RNA, herein designated VGAM RNA, and a schematic representation of the secondary folding of VGAM857 folded precursor RNA, herein designated VGAM FOLDED PRECURSOR RNA, of VGAM857 are further described hereinbelow with reference to Table 1.

Nucleotide sequences of host target binding sites, such as BINDING SITE-I, BINDING SITE-II and BINDING SITE-III of FIG. 1, found on VGAM857 host target RNA, and schematic representation of the complementarity of each of these host target binding sites to VGAM857 RNA, herein designated VGAM RNA, are described hereinbelow with reference to Table 2.

As mentioned hereinabove with reference to FIG. 1, a function of VGAM857 gene, herein designated VGAM is inhibition of expression of VGAM857 target genes. It is appreciated that specific functions, and accordingly utilities, of VGAM857 correlate with, and may be deduced from, the identity of the target genes which VGAM857 binds and inhibits, and the function of these target genes, as elaborated hereinbelow.

Endothelin 3 (EDN3, Accession NM_000114) is a VGAM857 host target gene. EDN3 BINDING SITE is HOST TARGET binding site found in the 3' untranslated region of mRNA encoded by EDN3, corresponding to a HOST TARGET binding site such as BINDING SITE I, BINDING SITE II or BINDING SITE III. Table 2 illustrates the complementarity of the nucleotide sequences of EDN3 BINDING SITE, designated SEQ ID:5583, to the nucleotide sequence of VGAM857 RNA, herein designated VGAM RNA, also designated SEQ ID:3568.

A function of VGAM857 is therefore inhibition of Endothelin 3 (EDN3, Accession NM_000114). Accordingly, utilities of VGAM857 include diagnosis, prevention and treatment of diseases and clinical conditions associated with EDN3. DKFZP564F013 (Accession XM_168479) is another VGAM857 host target gene. DKFZP564F013 BINDING SITE is HOST TARGET binding site found in the 3' untranslated region of mRNA encoded by DKFZP564F013, corresponding to a HOST TARGET binding site such as BINDING SITE I, BINDING SITE II or BINDING SITE III. Table 2 illustrates the complementarity of the nucleotide sequences of DKFZP564F013 BINDING SITE, designated SEQ ID:45203, to the nucleotide sequence of VGAM857 RNA, herein designated VGAM RNA, also designated SEQ ID:3568.

Another function of VGAM857 is therefore inhibition of DKFZP564F013 (Accession XM_168479). Accordingly, utilities of VGAM857 include diagnosis, prevention and treatment of diseases and clinical conditions associated with DKFZP564F013. Epsin 2 (EPN2, Accession NM_014964) is another VGAM857 host target gene. EPN2 BINDING SITE is HOST TARGET binding site found in the 3' untranslated region of mRNA encoded by EPN2, corresponding to a HOST TARGET binding site such as BINDING SITE I, BINDING SITE II or BINDING SITE III. Table 2 illustrates the complementarity of the nucleotide sequences of EPN2 BINDING SITE, designated SEQ ID:17350, to the nucleotide sequence of VGAM857 RNA, herein designated VGAM RNA, also designated SEQ ID:3568.

Another function of VGAM857 is therefore inhibition of Epsin 2 (EPN2, Accession NM_014964). Accordingly, utilities of VGAM857 include diagnosis, prevention and treatment of diseases and clinical conditions associated with EPN2. KIAA1486 (Accession XM_041126) is another VGAM857 host target gene. KIAA1486 BINDING SITE is HOST TARGET binding site found in the 3' untranslated region of mRNA encoded by KIAA1486, corresponding to a HOST TARGET binding site such as BINDING SITE I, BINDING SITE II or BINDING SITE III. Table 2 illustrates the complementarity of the nucleotide sequences of KIAA1486 BINDING SITE, designated SEQ ID:33463, to the nucleotide sequence of VGAM857 RNA, herein designated VGAM RNA, also designated SEQ ID:3568.

Another function of VGAM857 is therefore inhibition of KIAA1486 (Accession XM_041126). Accordingly, utilities of VGAM857 include diagnosis, prevention and treatment of diseases and clinical conditions associated with KIAA1486. Ubiquitin Specific Protease 15 (USP15, Accession NM_006313) is another VGAM857 host target gene. USP15 BINDING SITE is HOST TARGET binding site found in the 3' untranslated region of mRNA encoded by USP15, corresponding to a HOST TARGET binding site such as BINDING SITE I, BINDING SITE II or BINDING SITE III. Table 2 illustrates the complementarity of the nucleotide sequences of USP15 BINDING SITE, designated SEQ ID:13005, to the nucleotide sequence of VGAM857 RNA, herein designated VGAM RNA, also designated SEQ ID:3568.

Another function of VGAM857 is therefore inhibition of Ubiquitin Specific Protease 15 (USP15, Accession NM_006313). Accordingly, utilities of VGAM857 include diagnosis, prevention and treatment of diseases and clinical conditions associated with USP15. LOC152317 (Accession XM_098189) is another VGAM857 host target gene. LOC152317 BINDING SITE is HOST TARGET binding site found in the 5' untranslated region of mRNA encoded by LOC152317, corresponding to a HOST TARGET binding site such as BINDING SITE I, BINDING SITE II or BINDING SITE III. Table 2 illustrates the complementarity of the nucleotide sequences of LOC152317 BINDING SITE, designated SEQ ID:41468, to the nucleotide sequence of VGAM857 RNA, herein designated VGAM RNA, also designated SEQ ID:3568.

Another function of VGAM857 is therefore inhibition of LOC152317 (Accession XM_098189). Accordingly, utilities of VGAM857 include diagnosis, prevention and treatment of diseases and clinical conditions associated with LOC152317. FIG. 1 further provides a conceptual description of a novel bioinformatically detected viral gene of the present invention, referred to here as Viral Genomic Address Messenger 858 (VGAM858) viral gene, which modulates expression of respective host target genes thereof, the function and utility of which host target genes is known in the art.

VGAM858 is a novel bioinformatically detected regulatory, non protein coding, viral micro RNA (miRNA) gene. The method by which VGAM858 was detected is described hereinabove with reference to FIGS. 1-8.

VGAM858 gene, herein designated VGAM GENE, is a viral gene contained in the genome of Ectromelia Virus. VGAM858 host target gene, herein designated VGAM HOST TARGET GENE, is a human gene contained in the human genome.

VGAM858 gene encodes a VGAM858 precursor RNA, herein designated VGAM PRECURSOR RNA. Similar to other miRNA genes, and unlike most ordinary genes, VGAM858 precursor RNA does not encode a protein. A nucleotide sequence identical or highly similar to the nucleotide sequence of VGAM858 precursor RNA is designated SEQ ID:844, and is provided hereinbelow with reference to the sequence listing part. Nucleotide sequence SEQ ID:844 is located at position 132888 relative to the genome of Ectromelia Virus.

VGAM858 precursor RNA folds onto itself, forming VGAM858 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM858 folded precursor RNA into VGAM858 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM858 RNA is designated SEQ ID:3569, and is provided hereinbelow with reference to the sequence listing part.

VGAM858 host target gene, herein designated VGAM HOST TARGET GENE, encodes a corresponding messenger RNA, VGAM858 host target RNA, herein designated VGAM HOST TARGET RNA. VGAM858 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM858 RNA, herein designated VGAM RNA, binds complementarily to one or more host target binding sites located in untranslated regions of VGAM858 host target RNA, herein designated VGAM HOST TARGET RNA. This complementary binding is due to the fact that the nucleotide sequence of VGAM858 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM858 RNA, herein designated VGAM RNA, may have a different number of host target binding sites in untranslated regions of a VGAM858 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM858 RNA, herein designated VGAM RNA, to host target binding sites on VGAM858 host target RNA, herein designated VGAM HOST TARGET RNA, such as BINDING SITE I, BINDING SITE II and BINDING SITE III, inhibits translation of VGAM858 host target RNA into VGAM858 host target protein, herein designated VGAM HOST TARGET PROTEIN. VGAM host target protein is therefore outlined by a broken line.

It is appreciated that VGAM858 host target gene, herein designated VGAM HOST TARGET GENE, in fact represents a plurality of VGAM858 host target genes. The mRNA of each one of this plurality of VGAM858 host target genes comprises one or more host target binding sites, each having a nucleotide sequence which is at least partly complementary to VGAM858 RNA, herein designated VGAM RNA, and which when bound by VGAM858 RNA causes inhibition of translation of respective one or more VGAM858 host target proteins.

It is further appreciated by one skilled in the art that the mode of translational inhibition illustrated by FIG. 1 with specific reference to translational inhibition exerted by VGAM858 gene, herein designated VGAM GENE, on one or more VGAM858 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM858 is inhibition of expression of host target genes, as part of a novel viral mechanism of attacking a host. Accordingly, utilities of VGAM858 include diagnosis, prevention and treatment of viral infection by Ectromelia Virus. Specific functions, and accordingly utilities, of VGAM858 correlate with, and may be deduced from, the identity of the host target genes which VGAM858 binds and inhibits, and the function of these host target genes, as elaborated hereinbelow.

Nucleotide sequences of the VGAM858 precursor RNA, herein designated VGAM PRECURSOR RNA, and of the 'diced' VGAM858 RNA, herein designated VGAM RNA, and a schematic representation of the secondary folding of VGAM858 folded precursor RNA, herein designated VGAM FOLDED PRECURSOR RNA, of VGAM858 are further described hereinbelow with reference to Table 1.

Nucleotide sequences of host target binding sites, such as BINDING SITE-I, BINDING SITE-II and BINDING SITE-III of FIG. 1, found on VGAM858 host target RNA, and schematic representation of the complementarity of each of these host target binding sites to VGAM858 RNA, herein designated VGAM RNA, are described hereinbelow with reference to Table 2.

As mentioned hereinabove with reference to FIG. 1, a function of VGAM858 gene, herein designated VGAM is inhibition of expression of VGAM858 target genes. It is appreciated that specific functions, and accordingly utilities, of VGAM858 correlate with, and may be deduced from, the identity of the target genes which VGAM858 binds and inhibits, and the function of these target genes, as elaborated hereinbelow.

KIAA0143 (Accession XM_035825) is a VGAM858 host target gene. KIAA0143 BINDING SITE is HOST TARGET binding site found in the 3' untranslated region of mRNA encoded by KIAA0143, corresponding to a HOST TARGET binding site such as BINDING SITE I, BINDING SITE II or BINDING SITE III. Table 2 illustrates the complementarity of the nucleotide sequences of KIAA0143 BINDING SITE, designated SEQ ID:32351, to the nucleotide sequence of VGAM858 RNA, herein designated VGAM RNA, also designated SEQ ID:3569.

A function of VGAM858 is therefore inhibition of KIAA0143 (Accession XM_035825). Accordingly, utilities of VGAM858 include diagnosis, prevention and treatment of diseases and clinical conditions associated with KIAA0143. Solute Carrier Family 26, Member 7 (SLC26A7, Accession NM_052832) is another VGAM858 host target gene. SLC26A7 BINDING SITE is HOST TARGET binding site found in the 3' untranslated region of mRNA encoded by SLC26A7, corresponding to a HOST TARGET binding site such as BINDING SITE I, BINDING SITE II or BINDING SITE III. Table 2 illustrates the complementarity of the nucleotide sequences of SLC26A7 BINDING SITE, designated SEQ ID:27417, to the nucleotide sequence of VGAM858 RNA, herein designated VGAM RNA, also designated SEQ ID:3569.

Another function of VGAM858 is therefore inhibition of Solute Carrier Family 26, Member 7 (SLC26A7, Accession NM_052832). Accordingly, utilities of VGAM858 include diagnosis, prevention and treatment of diseases and clinical conditions associated with SLC26A7. LOC158292 (Accession XM_098914) is another VGAM858 host target gene. LOC158292 BINDING SITE1 and LOC158292 BINDING SITE2 are HOST TARGET binding sites found in untranslated regions of mRNA encoded by LOC158292, corresponding to HOST TARGET binding sites such as BINDING SITE I, BINDING SITE II or BINDING SITE III. Table 2 illustrates the complementarity of the nucleotide sequences of LOC158292 BINDING SITE1 and LOC158292 BINDING SITE2, designated SEQ ID:41934 and SEQ ID:41935 respectively, to the nucleotide sequence of VGAM858 RNA, herein designated VGAM RNA, also designated SEQ ID:3569.

Another function of VGAM858 is therefore inhibition of LOC158292 (Accession XM_098914). Accordingly, utilities of VGAM858 include diagnosis, prevention and treatment of diseases and clinical conditions associated with LOC158292. FIG. 1 further provides a conceptual description of a novel bioinformatically detected viral gene of the present invention, referred to here as Viral Genomic Address Messenger 859 (VGAM859) viral gene, which modulates expression of respective host target genes thereof, the function and utility of which host target genes is known in the art.

VGAM859 is a novel bioinformatically detected regulatory, non protein coding, viral micro RNA (miRNA) gene. The method by which VGAM859 was detected is described hereinabove with reference to FIGS. 1-8.

VGAM859 gene, herein designated VGAM GENE, is a viral gene contained in the genome of Camelpox Virus. VGAM859 host target gene, herein designated VGAM HOST TARGET GENE, is a human gene contained in the human genome.

VGAM859 gene encodes a VGAM859 precursor RNA, herein designated VGAM PRECURSOR RNA. Similar to other miRNA genes, and unlike most ordinary genes, VGAM859 precursor RNA does not encode a protein. A nucleotide sequence identical or highly similar to the nucleotide sequence of VGAM859 precursor RNA is designated SEQ ID:845, and is provided hereinbelow with reference to the sequence listing part. Nucleotide sequence SEQ ID:845 is located at position 126158 relative to the genome of Camelpox Virus.

VGAM859 precursor RNA folds onto itself, forming VGAM859 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM859 folded precursor RNA into VGAM859 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM859 RNA is designated SEQ ID:3570, and is provided hereinbelow with reference to the sequence listing part.

VGAM859 host target gene, herein designated VGAM HOST TARGET GENE, encodes a corresponding messenger RNA, VGAM859 host target RNA, herein designated VGAM HOST TARGET RNA. VGAM859 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM859 RNA, herein designated VGAM RNA, binds complementarily to one or more host target binding sites located in untranslated regions of VGAM859 host target RNA, herein designated VGAM HOST TARGET RNA. This complementary binding is due to the fact that the nucleotide sequence of VGAM859 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM859 RNA, herein designated VGAM RNA, may have a different number of host target binding sites in untranslated regions of a VGAM859 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM859 RNA, herein designated VGAM RNA, to host target binding sites on VGAM859 host target RNA, herein designated VGAM HOST TARGET RNA, such as BINDING SITE I, BINDING SITE II and BINDING SITE III, inhibits translation of VGAM859 host target RNA into VGAM859 host target protein, herein designated VGAM HOST TARGET PROTEIN. VGAM host target protein is therefore outlined by a broken line.

It is appreciated that VGAM859 host target gene, herein designated VGAM HOST TARGET GENE, in fact represents a plurality of VGAM859 host target genes. The mRNA of each one of this plurality of VGAM859 host target genes comprises one or more host target binding sites, each having a nucleotide sequence which is at least partly complementary to VGAM859 RNA, herein designated VGAM RNA, and which when bound by VGAM859 RNA causes inhibition of translation of respective one or more VGAM859 host target proteins.

It is further appreciated by one skilled in the art that the mode of translational inhibition illustrated by FIG. 1 with specific reference to translational inhibition exerted by VGAM859 gene, herein designated VGAM GENE, on one or more VGAM859 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM859 is inhibition of expression of host target genes, as part of a novel viral mechanism of attacking a host. Accordingly, utilities of VGAM859 include diagnosis, prevention and treatment of viral infection by Camelpox Virus. Specific functions, and accordingly utilities, of VGAM859 correlate with, and may be deduced from, the identity of the host target genes which VGAM859 binds and inhibits, and the function of these host target genes, as elaborated hereinbelow.

Nucleotide sequences of the VGAM859 precursor RNA, herein designated VGAM PRECURSOR RNA, and of the 'diced' VGAM859 RNA, herein designated VGAM RNA, and a schematic representation of the secondary folding of VGAM859 folded precursor RNA, herein designated VGAM FOLDED PRECURSOR RNA, of VGAM859 are further described hereinbelow with reference to Table 1.

Nucleotide sequences of host target binding sites, such as BINDING SITE-I, BINDING SITE-II and BINDING SITE-III of FIG. 1, found on VGAM859 host target RNA, and schematic representation of the complementarity of each of these host target binding sites to VGAM859 RNA, herein designated VGAM RNA, are described hereinbelow with reference to Table 2.

As mentioned hereinabove with reference to FIG. 1, a function of VGAM859 gene, herein designated VGAM is inhibition of expression of VGAM859 target genes. It is appreciated that specific functions, and accordingly utilities, of VGAM859 correlate with, and may be deduced from, the identity of the target genes which VGAM859 binds and inhibits, and the function of these target genes, as elaborated hereinbelow.

A Disintegrin and Metalloproteinase Domain 22 (ADAM22, Accession NM_021722) is a VGAM859 host target gene. ADAM22 BINDING SITE1 and ADAM22 BINDING SITE2 are HOST TARGET binding sites found in untranslated regions of mRNA encoded by ADAM22, corresponding to HOST TARGET binding sites such as BINDING SITE I, BINDING SITE II or BINDING SITE III. Table 2 illustrates the complementarity of the nucleotide sequences of ADAM22 BINDING SITE1 and ADAM22 BINDING SITE2, designated SEQ ID:22323 and SEQ ID:22325 respectively, to the nucleotide sequence of VGAM859 RNA, herein designated VGAM RNA, also designated SEQ ID:3570.

A function of VGAM859 is therefore inhibition of A Disintegrin and Metalloproteinase Domain 22 (ADAM22, Accession NM_021722), a gene which Member of ADAM family of zinc metalloproteases. Accordingly, utilities of VGAM859 include diagnosis, prevention and treatment of diseases and clinical conditions associated with ADAM22. The function of ADAM22 and its association with various diseases and clinical conditions, has been established by previous studies, as described hereinabove with reference to VGAM81. Karyopherin Alpha 1 (importin alpha 5) (KPNA1, Accession XM_087256) is another VGAM859 host target gene. KPNA1 BINDING SITE is HOST TARGET binding site found in the 3' untranslated region of mRNA encoded by KPNA1, corresponding to a HOST TARGET binding site such as BINDING SITE I, BINDING SITE II or BINDING SITE III. Table 2 illustrates the complementarity of the nucleotide sequences of KPNA1 BINDING SITE, designated SEQ ID:39150, to the nucleotide sequence of VGAM859 RNA, herein designated VGAM RNA, also designated SEQ ID:3570.

Another function of VGAM859 is therefore inhibition of Karyopherin Alpha 1 (importin alpha 5) (KPNA1, Accession XM_087256), a gene which promotes docking of import substrates to the nuclear pore complex. Accordingly, utilities of VGAM859 include diagnosis, prevention and treatment of diseases and clinical conditions associated with KPNA1. The function of KPNA1 has been established by previous studies. Cortes et al. (1994) used the 2-hybrid protein interaction systems to isolate a protein that specifically interacts with RAG1 (OMIM Ref. No. 179615). The genes RAG1 and RAG2 (OMIM Ref. No. 179616) are able to activate V(D)J recombination when transfected into fibroblasts. Further, knockout mice for these 2 loci lack B and T cells. Several other ubiquitously expressed proteins are thought to be recruited in the recombination process. Among these are the genes affected in severe combined immune deficiency (e.g., OMIM Ref. No. also 600899) and genes involved in ds-DNA break repair. The human cDNA identified by Cortes et al. (1994) encodes a 489-amino acid polypeptide that shows striking similarity to the yeast SRP1 protein, a mutant allele which can suppress a mutation of RNA polymerase I. The authors obtained human and mouse cDNA sequences which are 98% identical as proteins. When RAG1 and human SRP1 were cotransfected into 293T cells a stable complex of the 2 was observed. The authors speculated that because SRP1 appears to be bound to the nuclear envelope, the interaction with RAG1 may serve to localize that protein to the envelope as well. Conti et al. (1998) reported the crystal structure of a 50-kD fragment of the 60-kD yeast karyopherin alpha, in the absence and presence of a monopartite nuclear localization signal (NLS) peptide at 2.2-angstrom and 2.8-angstrom resolution, respectively. The structure showed a tandem array of 10 armadillo repeats, organized in a right-handed superhelix of helices. Binding of the NLS peptide occurred at 2 sites within a helical surface groove. The structure reveals the determinants of NLS specificity and suggested a model for the recognition of bipartite NLSs. By fluorescence in situ hybridization, Ayala-Madrigal et al. (2000) mapped the human KPNA1 gene to chromosome 3q21.

Full details of the abovementioned studies are described in the following publications, the disclosure of which are hereby incorporated by reference:

Ayala-Madrigal, M. L.; Doerr, S.; Ramirez-Duenas, M. L.; Hansmann, I.: Assignment of karyopherin alpha 1 (KPNA1) to human chromosome band 3q21 by in situ hybridization. Cytogenet. Cell Genet. 90:58-59, 2000; and Conti, E.; Uy, M.; Leighton, L.; Blobel, G.; Kuriyan, J.: Crystallographic analysis of the recognition of a nuclear localization signal by the nuclear import factor karyopherin alpha.

Further studies establishing the function and utilities of KPNA1 are found in John Hopkins OMIM database record ID 600686, and in sited publications numbered 9973-9975 listed in the bibliography section hereinbelow, which are also hereby incorporated by reference. Procollagen-proline, 2-oxoglutarate 4-dioxygenase (proline 4-hydroxylase), Alpha Polypeptide I (P4HA1, Accession NM_000917) is another VGAM859 host target gene. P4HA1 BINDING SITE is HOST TARGET binding site found in the 3' untranslated region of mRNA encoded by P4HA1, corresponding to a HOST TARGET binding site such as BINDING SITE I, BINDING SITE II or BINDING SITE III. Table 2 illustrates the complementarity of the nucleotide sequences of P4HA1 BINDING SITE, designated SEQ ID:6624, to the nucleotide sequence of VGAM859 RNA, herein designated VGAM RNA, also designated SEQ ID:3570.

Another function of VGAM859 is therefore inhibition of Procollagen-proline, 2-oxoglutarate 4-dioxygenase (proline 4-hydroxylase), Alpha Polypeptide I (P4HA1, Accession NM_000917), a gene which catalyzes the formation of 4-hydroxyproline in collagen. Accordingly, utilities of VGAM859 include diagnosis, prevention and treatment of diseases and clinical conditions associated with P4HA1. The function of P4HA1 and its association with various diseases and clinical conditions, has been established by previous studies, as described hereinabove with reference to VGAM260. Solute Carrier Family 1 (glutamate/neutral amino acid transporter), Member 4 (SLC1A4, Accession NM_003038) is another VGAM859 host target gene. SLC1A4 BINDING SITE is HOST TARGET binding site found in the 3' untranslated region of mRNA encoded by SLC1A4, corresponding to a HOST TARGET binding site such as BINDING SITE I, BINDING SITE II or BINDING SITE III. Table 2 illustrates the complementarity of the nucleotide sequences of SLC1A4 BINDING SITE, designated SEQ ID:8999, to the nucleotide sequence of VGAM859 RNA, herein designated VGAM RNA, also designated SEQ ID:3570.

Another function of VGAM859 is therefore inhibition of Solute Carrier Family 1 (glutamate/neutral amino acid transporter), Member 4 (SLC1A4, Accession NM_003038), a gene which transports alanine, serine, cysteine, and threonine. exhibits sodium dependence. Accordingly, utilities of VGAM859 include diagnosis, prevention and treatment of diseases and clinical conditions associated with SLC1A4. The function of SLC1A4 has been established by previous studies. In a screening for cDNAs encoding proteins similar to the sodium-coupled glutamate transporter GLAST1, Hofmann et al. (1994) isolated a cDNA clone encoding a protein that turned out to be identical to the neutral amino acid transporter ASCT1 (Arriza et al., 1993; Shafqat et al., 1993). The new member of the GLAST-related transporter family did not transport glutamate or aspartate but alanine, serine, cysteine, and threonine instead. The open reading frame of 1,572 basepairs encodes 524 amino acid residues distributed over 8 exons spanning at least 40 kb of genomic DNA. The gene for ASCT1, designated SLC1A4, was assigned to 2p15-p13 by fluorescence in situ hybridization. The gene structure was not related to any previously characterized transporter gene. Zerangue and Kavanaugh (1996) found that the ASCT1 transporter functions primarily as an amino acid exchanger. Transport is associated with a chloride channel activity that is thermodynamically uncoupled from amino acid transport.

Full details of the abovementioned studies are described in the following publications, the disclosure of which are hereby incorporated by reference:

Arriza, J. L.; Kavanaugh, M. P.; Fairman, W. A.; Wu, Y.-N.; Murdoch, G. H.; North, R. A.; Amara, S. G.: Cloning and expression of a human neutral amino acid transporter with structural similarity to the glutamate transporter gene family. J. Biol. Chem. 268:15329-15332, 1993; and Zerangue, N.; Kavanaugh, M. P.: ASCT-1 is a neutral amino acid exchanger with chloride channel activity. J. Biol. Chem. 271:27991-27994, 1996.

Further studies establishing the function and utilities of SLC1A4 are found in John Hopkins OMIM database record ID 600229, and in sited publications numbered 7556-7559 listed in the bibliography section hereinbelow, which are also hereby incorporated by reference. Chromosome 20 Open Reading Frame 13 (C20orf13, Accession NM_017714) is another VGAM859 host target gene. C20orf13 BINDING SITE is HOST TARGET binding site found in the 3' untranslated region of mRNA encoded by C20orf13, corresponding to a HOST TARGET binding site such as BINDING SITE I, BINDING SITE II or BINDING SITE III. Table 2 illustrates the complementarity of the nucleotide sequences of C20orf13 BINDING SITE, designated SEQ ID:19298, to the nucleotide sequence of VGAM859 RNA, herein designated VGAM RNA, also designated SEQ ID:3570.

Another function of VGAM859 is therefore inhibition of Chromosome 20 Open Reading Frame 13 (C20orf13, Accession NM_017714). Accordingly, utilities of VGAM859 include diagnosis, prevention and treatment of diseases and clinical conditions associated with C20orf13. DIS3 (Accession NM_014953) is another VGAM859 host target gene. DIS3 BINDING SITE is HOST TARGET binding site found in the 3' untranslated region of mRNA encoded by DIS3, corresponding to a HOST TARGET binding site such as BINDING SITE I, BINDING SITE II or BINDING SITE III. Table 2 illustrates the complementarity of the nucleotide sequences of DIS3 BINDING SITE, designated SEQ ID:17305, to the nucleotide sequence of VGAM859 RNA, herein designated VGAM RNA, also designated SEQ ID:3570.

Another function of VGAM859 is therefore inhibition of DIS3 (Accession NM_014953). Accordingly, utilities of VGAM859 include diagnosis, prevention and treatment of diseases and clinical conditions associated with DIS3. DKFZp547A023 (Accession XM_052065) is another VGAM859 host target gene. DKFZp547A023 BINDING SITE is HOST TARGET binding site found in the 3' untranslated region of mRNA encoded by DKFZp547A023, corresponding to a HOST TARGET binding site such as BINDING SITE I, BINDING SITE II or BINDING SITE III. Table 2 illustrates the complementarity of the nucleotide sequences of DKFZp547A023 BINDING SITE, designated SEQ ID:35945, to the nucleotide sequence of VGAM859 RNA, herein designated VGAM RNA, also designated SEQ ID:3570.

Another function of VGAM859 is therefore inhibition of DKFZp547A023 (Accession XM_052065). Accordingly, utilities of VGAM859 include diagnosis, prevention and treatment of diseases and clinical conditions associated with DKFZp547A023. FLJ13072 (Accession XM_117117) is another VGAM859 host target gene. FLJ13072 BINDING SITE is HOST TARGET binding site found in the 5' untranslated region of mRNA encoded by FLJ13072, corresponding to a HOST TARGET binding site such as BINDING SITE I, BINDING SITE II or BINDING SITE III. Table 2 illustrates the complementarity of the nucleotide sequences of FLJ13072 BINDING SITE, designated SEQ ID:43237, to the nucleotide sequence of VGAM859 RNA, herein designated VGAM RNA, also designated SEQ ID:3570.

Another function of VGAM859 is therefore inhibition of FLJ13072 (Accession XM_117117). Accordingly, utilities of VGAM859 include diagnosis, prevention and treatment of diseases and clinical conditions associated with FLJ13072. FLJ22794 (Accession XM_166220) is another VGAM859 host target gene. FLJ22794 BINDING SITE is HOST TARGET binding site found in the 5' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44038, to the nucleotide sequence of VGAM859 RNA, herein designated VGAM RNA, also designated SEQ ID:3570.

Another function of VGAM859 is therefore inhibition of FLJ22794 (Accession XM_166220). Accordingly, utilities of VGAM859 include diagnosis, prevention and treatment of diseases and clinical conditions associated with FLJ22794. Zinc Finger Protein 197 (ZNF197, Accession NM_006991) is another VGAM859 host target gene. ZNF197 BINDING SITE is HOST TARGET binding site found in the 3' untranslated region of mRNA encoded by ZNF197, corresponding to a HOST TARGET binding site such as BINDING SITE I, BINDING SITE II or BINDING SITE III. Table 2 illustrates the complementarity of the nucleotide sequences of ZNF197 BINDING SITE, designated SEQ ID:13855, to the nucleotide sequence of VGAM859 RNA, herein designated VGAM RNA, also designated SEQ ID:3570.

Another function of VGAM859 is therefore inhibition of Zinc Finger Protein 197 (ZNF197, Accession NM_006991). Accordingly, utilities of VGAM859 include diagnosis, prevention and treatment of diseases and clinical conditions associated with ZNF197. LOC115297 (Accession XM_053313) is another VGAM859 host target gene. LOC115297 BINDING SITE is HOST TARGET binding site found in the 3' untranslated region of mRNA encoded by LOC115297, corresponding to a HOST TARGET binding site such as BINDING SITE I, BINDING SITE II or BINDING SITE III. Table 2 illustrates the complementarity of the nucleotide sequences of LOC115297 BINDING SITE, designated SEQ ID:36073, to the nucleotide sequence of VGAM859 RNA, herein designated VGAM RNA, also designated SEQ ID:3570.

Another function of VGAM859 is therefore inhibition of LOC115297 (Accession XM_053313). Accordingly, utilities of VGAM859 include diagnosis, prevention and treatment of diseases and clinical conditions associated with LOC115297. LOC145790 (Accession XM_085234) is another VGAM859 host target gene. LOC145790 BINDING SITE is HOST TARGET binding site found in the 3' untranslated region of mRNA encoded by LOC145790, corresponding to a HOST TARGET binding site such as BINDING SITE I, BINDING SITE II or BINDING SITE III. Table 2 illustrates the complementarity of the nucleotide sequences of LOC145790 BINDING SITE, designated SEQ ID:37980, to the nucleotide sequence of VGAM859 RNA, herein designated VGAM RNA, also designated SEQ ID:3570.

Another function of VGAM859 is therefore inhibition of LOC145790 (Accession XM_085234). Accordingly, utilities of VGAM859 include diagnosis, prevention and treatment of diseases and clinical conditions associated with LOC145790. LOC145951 (Accession XM_085283) is another VGAM859 host target gene. LOC145951 BINDING SITE is HOST TARGET binding site found in the 5' untranslated region of mRNA encoded by LOC145951, corresponding to a HOST TARGET binding site such as BINDING SITE I, BINDING SITE II or BINDING SITE III. Table 2 illustrates the complementarity of the nucleotide sequences of LOC145951 BINDING SITE, designated SEQ ID:38017, to the nucleotide sequence of VGAM859 RNA, herein designated VGAM RNA, also designated SEQ ID:3570.

Another function of VGAM859 is therefore inhibition of LOC145951 (Accession XM_085283). Accordingly, utilities of VGAM859 include diagnosis, prevention and treatment of diseases and clinical conditions associated with LOC145951.

LOC152220 (Accession XM_098176) is another VGAM859 host target gene. LOC152220 BINDING SITE is HOST TARGET binding site found in the 3' untranslated region of mRNA encoded by LOC152220, corresponding to a HOST TARGET binding site such as BINDING SITE I, BINDING SITE II or BINDING SITE III. Table 2 illustrates the complementarity of the nucleotide sequences of LOC152220 BINDING SITE, designated SEQ ID:41446, to the nucleotide sequence of VGAM859 RNA, herein designated VGAM RNA, also designated SEQ ID:3570.

Another function of VGAM859 is therefore inhibition of LOC152220 (Accession XM_098176). Accordingly, utilities of VGAM859 include diagnosis, prevention and treatment of diseases and clinical conditions associated with LOC152220. LOC199678 (Accession XM_117111) is another VGAM859 host target gene. LOC199678 BINDING SITE is HOST TARGET binding site found in the 3' untranslated region of mRNA encoded by LOC199678, corresponding to a HOST TARGET binding site such as BINDING SITE I, BINDING SITE II or BINDING SITE III. Table 2 illustrates the complementarity of the nucleotide sequences of LOC199678 BINDING SITE, designated SEQ ID:43228, to the nucleotide sequence of VGAM859 RNA, herein designated VGAM RNA, also designated SEQ ID:3570.

Another function of VGAM859 is therefore inhibition of LOC199678 (Accession XM_117111). Accordingly, utilities of VGAM859 include diagnosis, prevention and treatment of diseases and clinical conditions associated with LOC199678. LOC254896 (Accession XM_171201) is another VGAM859 host target gene. LOC254896 BINDING SITE is HOST TARGET binding site found in the 5' untranslated region of mRNA encoded by LOC254896, corresponding to a HOST TARGET binding site such as BINDING SITE I, BINDING SITE II or BINDING SITE III. Table 2 illustrates the complementarity of the nucleotide sequences of LOC254896 BINDING SITE, designated SEQ ID:45989, to the nucleotide sequence of VGAM859 RNA, herein designated VGAM RNA, also designated SEQ ID:3570.

Another function of VGAM859 is therefore inhibition of LOC254896 (Accession XM_171201). Accordingly, utilities of VGAM859 include diagnosis, prevention and treatment of diseases and clinical conditions associated with LOC254896. LOC257478 (Accession XM_054745) is another VGAM859 host target gene. LOC257478 BINDING SITE is HOST TARGET binding site found in the 5' untranslated region of mRNA encoded by LOC257478, corresponding to a HOST TARGET binding site such as BINDING SITE I, BINDING SITE II or BINDING SITE III. Table 2 illustrates the complementarity of the nucleotide sequences of LOC257478 BINDING SITE, designated SEQ ID:36184, to the nucleotide sequence of VGAM859 RNA, herein designated VGAM RNA, also designated SEQ ID:3570.

Another function of VGAM859 is therefore inhibition of LOC257478 (Accession XM_054745). Accordingly, utilities of VGAM859 include diagnosis, prevention and treatment of diseases and clinical conditions associated with LOC257478. LOC57147 (Accession NM_020423) is another VGAM859 host target gene. LOC57147 BINDING SITE is HOST TARGET binding site found in the 3' untranslated region of mRNA encoded by LOC57147, corresponding to a HOST TARGET binding site such as BINDING SITE I, BINDING SITE II or BINDING SITE III. Table 2 illustrates the complementarity of the nucleotide sequences of LOC57147 BINDING SITE, designated SEQ ID:21681, to the nucleotide sequence of VGAM859 RNA, herein designated VGAM RNA, also designated SEQ ID:3570.

Another function of VGAM859 is therefore inhibition of LOC57147 (Accession NM_020423). Accordingly, utilities of VGAM859 include diagnosis, prevention and treatment of diseases and clinical conditions associated with LOC57147. FIG. 1 further provides a conceptual description of a novel bioinformatically detected viral gene of the present invention, referred to here as Viral Genomic Address Messenger 860 (VGAM860) viral gene, which modulates expression of respective host target genes thereof, the function and utility of which host target genes is known in the art.

VGAM860 is a novel bioinformatically detected regulatory, non protein coding, viral micro RNA (miRNA) gene. The method by which VGAM860 was detected is described hereinabove with reference to FIGS. 1-8.

VGAM860 gene, herein designated VGAM GENE, is a viral gene contained in the genome of Camelpox Virus. VGAM860 host target gene, herein designated VGAM HOST TARGET GENE, is a human gene contained in the human genome.

VGAM860 gene encodes a VGAM860 precursor RNA, herein designated VGAM PRECURSOR RNA. Similar to other miRNA genes, and unlike most ordinary genes, VGAM860 precursor RNA does not encode a protein. A nucleotide sequence identical or highly similar to the nucleotide sequence of VGAM860 precursor RNA is designated SEQ ID:846, and is provided hereinbelow with reference to the sequence listing part. Nucleotide sequence SEQ ID:846 is located at position 127064 relative to the genome of Camelpox Virus.

VGAM860 precursor RNA folds onto itself, forming VGAM860 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM860 folded precursor RNA into VGAM860 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM860 RNA is designated SEQ ID:3571, and is provided hereinbelow with reference to the sequence listing part.

VGAM860 host target gene, herein designated VGAM HOST TARGET GENE, encodes a corresponding messenger RNA, VGAM860 host target RNA, herein designated VGAM HOST TARGET RNA. VGAM860 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM860 RNA, herein designated VGAM RNA, binds complementarily to one or more host target binding sites located in untranslated regions of VGAM860 host target RNA, herein designated VGAM HOST TARGET RNA. This complementary binding is due to the fact that the nucleotide sequence of VGAM860 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM860 RNA, herein designated VGAM RNA, may have a different number of host target binding sites in untranslated regions of a VGAM860 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM860 RNA, herein designated VGAM RNA, to host target binding sites on VGAM860 host target RNA, herein designated VGAM HOST TARGET RNA, such as BINDING SITE I, BINDING SITE II and BINDING SITE III, inhibits translation of VGAM860 host target RNA into VGAM860 host target protein, herein designated VGAM HOST TARGET PROTEIN. VGAM host target protein is therefore outlined by a broken line.

It is appreciated that VGAM860 host target gene, herein designated VGAM HOST TARGET GENE, in fact represents a plurality of VGAM860 host target genes. The mRNA of each one of this plurality of VGAM860 host target genes comprises one or more host target binding sites, each having a nucleotide sequence which is at least partly complementary to VGAM860 RNA, herein designated VGAM RNA, and which when bound by VGAM860 RNA causes inhibition of translation of respective one or more VGAM860 host target proteins.

It is further appreciated by one skilled in the art that the mode of translational inhibition illustrated by FIG. 1 with specific reference to translational inhibition exerted by VGAM860 gene, herein designated VGAM GENE, on one or more VGAM860 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM860 is inhibition of expression of host target genes, as part of a novel viral mechanism of attacking a host. Accordingly, utilities of VGAM860 include diagnosis, prevention and treatment of viral infection by Camelpox Virus. Specific functions, and accordingly utilities, of VGAM860 correlate with, and may be deduced from, the identity of the host target genes which VGAM860 binds and inhibits, and the function of these host target genes, as elaborated hereinbelow.

Nucleotide sequences of the VGAM860 precursor RNA, herein designated VGAM PRECURSOR RNA, and of the 'diced' VGAM860 RNA, herein designated VGAM RNA, and a schematic representation of the secondary folding of VGAM860 folded precursor RNA, herein designated VGAM FOLDED PRECURSOR RNA, of VGAM860 are further described hereinbelow with reference to Table 1.

Nucleotide sequences of host target binding sites, such as BINDING SITE-I, BINDING SITE-II and BINDING SITE-III of FIG. 1, found on VGAM860 host target RNA, and schematic representation of the complementarity of each of these host target binding sites to VGAM860 RNA, herein designated VGAM RNA, are described hereinbelow with reference to Table 2.

As mentioned hereinabove with reference to FIG. 1, a function of VGAM860 gene, herein designated VGAM is inhibition of expression of VGAM860 target genes. It is appreciated that specific functions, and accordingly utilities, of VGAM860 correlate with, and may be deduced from, the identity of the target genes which VGAM860 binds and inhibits, and the function of these target genes, as elaborated hereinbelow.

KIAA0143 (Accession XM_035825) is a VGAM860 host target gene. KIAA0143 BINDING SITE is HOST TARGET binding site found in the 3' untranslated region of mRNA encoded by KIAA0143, corresponding to a HOST TARGET binding site such as BINDING SITE I, BINDING SITE II or BINDING SITE III. Table 2 illustrates the complementarity of the nucleotide sequences of KIAA0143 BINDING SITE, designated SEQ ID:32351, to the nucleotide sequence of VGAM860 RNA, herein designated VGAM RNA, also designated SEQ ID:3571.

A function of VGAM860 is therefore inhibition of KIAA0143 (Accession XM_035825). Accordingly, utilities of VGAM860 include diagnosis, prevention and treatment of diseases and clinical conditions associated with KIAA0143. Solute Carrier Family 26, Member 7 (SLC26A7, Accession NM_052832) is another VGAM860 host target gene. SLC26A7 BINDING SITE is HOST TARGET binding site found in the 3' untranslated region of mRNA encoded by SLC26A7, corresponding to a HOST TARGET binding site such as BINDING SITE I, BINDING SITE II or BINDING SITE III. Table 2 illustrates the complementarity of the nucleotide sequences of SLC26A7 BINDING SITE, designated SEQ ID:27417, to the nucleotide sequence of VGAM860 RNA, herein designated VGAM RNA, also designated SEQ ID:3571.

Another function of VGAM860 is therefore inhibition of Solute Carrier Family 26, Member 7 (SLC26A7, Accession NM_052832). Accordingly, utilities of VGAM860 include diagnosis, prevention and treatment of diseases and clinical conditions associated with SLC26A7. LOC158292 (Accession XM_098914) is another VGAM860 host target gene. LOC158292 BINDING SITE1 and LOC158292 BINDING SITE2 are HOST TARGET binding sites found in untranslated regions of mRNA encoded by LOC158292, corresponding to HOST TARGET binding sites such as BINDING SITE I, BINDING SITE II or BINDING SITE III. Table 2 illustrates the complementarity of the nucleotide sequences of LOC158292 BINDING SITE1 and LOC158292 BINDING SITE2, designated SEQ ID:41934 and SEQ ID:41935 respectively, to the nucleotide sequence of VGAM860 RNA, herein designated VGAM RNA, also designated SEQ ID:3571.

Another function of VGAM860 is therefore inhibition of LOC158292 (Accession XM_098914). Accordingly, utilities of VGAM860 include diagnosis, prevention and treatment of diseases and clinical conditions associated with LOC158292. FIG. 1 further provides a conceptual description of a novel bioinformatically detected viral gene of the present invention, referred to here as Viral Genomic Address Messenger 861 (VGAM861) viral gene, which modulates expression of respective host target genes thereof, the function and utility of which host target genes is known in the art.

VGAM861 is a novel bioinformatically detected regulatory, non protein coding, viral micro RNA (miRNA) gene. The method by which VGAM861 was detected is described hereinabove with reference to FIGS. 1-8.

VGAM861 gene, herein designated VGAM GENE, is a viral gene contained in the genome of Ictalurid Herpesvirus 1.

VGAM861 host target gene, herein designated VGAM HOST TARGET GENE, is a human gene contained in the human genome.

VGAM861 gene encodes a VGAM861 precursor RNA, herein designated VGAM PRECURSOR RNA. Similar to other miRNA genes, and unlike most ordinary genes, VGAM861 precursor RNA does not encode a protein. A nucleotide sequence identical or highly similar to the nucleotide sequence of VGAM861 precursor RNA is designated SEQ ID:847, and is provided hereinbelow with reference to the sequence listing part. Nucleotide sequence SEQ ID:847 is located at position 97141 relative to the genome of Ictalurid Herpesvirus 1.

VGAM861 precursor RNA folds onto itself, forming VGAM861 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM861 folded precursor RNA into VGAM861 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM861 RNA is designated SEQ ID:3572, and is provided hereinbelow with reference to the sequence listing part.

VGAM861 host target gene, herein designated VGAM HOST TARGET GENE, encodes a corresponding messenger RNA, VGAM861 host target RNA, herein designated VGAM HOST TARGET RNA. VGAM861 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM861 RNA, herein designated VGAM RNA, binds complementarily to one or more host target binding sites located in untranslated regions of VGAM861 host target RNA, herein designated VGAM HOST TARGET RNA. This complementary binding is due to the fact that the nucleotide sequence of VGAM861 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM861 RNA, herein designated VGAM RNA, may have a different number of host target binding sites in untranslated regions of a VGAM861 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM861 RNA, herein designated VGAM RNA, to host target binding sites on VGAM861 host target RNA, herein designated VGAM HOST TARGET RNA, such as BINDING SITE I, BINDING SITE II and BINDING SITE III, inhibits translation of VGAM861 host target RNA into VGAM861 host target protein, herein designated VGAM HOST TARGET PROTEIN. VGAM host target protein is therefore outlined by a broken line.

It is appreciated that VGAM861 host target gene, herein designated VGAM HOST TARGET GENE, in fact represents a plurality of VGAM861 host target genes. The mRNA of each one of this plurality of VGAM861 host target genes comprises one or more host target binding sites, each having a nucleotide sequence which is at least partly complementary to VGAM861 RNA, herein designated VGAM RNA, and which when bound by VGAM861 RNA causes inhibition of translation of respective one or more VGAM861 host target proteins.

It is further appreciated by one skilled in the art that the mode of translational inhibition illustrated by FIG. 1 with specific reference to translational inhibition exerted by VGAM861 gene, herein designated VGAM GENE, on one or more VGAM861 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM861 is inhibition of expression of host target genes, as part of a novel viral mechanism of attacking a host. Accordingly, utilities of VGAM861 include diagnosis, prevention and treatment of viral infection by Ictalurid Herpesvirus 1. Specific functions, and accordingly utilities, of VGAM861 correlate with, and may be deduced from, the identity of the host target genes which VGAM861 binds and inhibits, and the function of these host target genes, as elaborated hereinbelow.

Nucleotide sequences of the VGAM861 precursor RNA, herein designated VGAM PRECURSOR RNA, and of the 'diced' VGAM861 RNA, herein designated VGAM RNA, and a schematic representation of the secondary folding of VGAM861 folded precursor RNA, herein designated VGAM FOLDED PRECURSOR RNA, of VGAM861 are further described hereinbelow with reference to Table 1.

Nucleotide sequences of host target binding sites, such as BINDING SITE-I, BINDING SITE-II and BINDING SITE-III of FIG. 1, found on VGAM861 host target RNA, and schematic representation of the complementarity of each of these host target binding sites to VGAM861 RNA, herein designated VGAM RNA, are described hereinbelow with reference to Table 2.

As mentioned hereinabove with reference to FIG. 1, a function of VGAM861 gene, herein designated VGAM is inhibition of expression of VGAM861 target genes. It is appreciated that specific functions, and accordingly utilities, of VGAM861 correlate with, and may be deduced from, the identity of the target genes which VGAM861 binds and inhibits, and the function of these target genes, as elaborated hereinbelow.

Estrogen-related Receptor Gamma (ESRRG, Accession XM_039053) is a VGAM861 host target gene. ESRRG BINDING SITE is HOST TARGET binding site found in the 3' untranslated region of mRNA encoded by ESRRG, corresponding to a HOST TARGET binding site such as BINDING SITE I, BINDING SITE II or BINDING SITE III. Table 2 illustrates the complementarity of the nucleotide sequences of ESRRG BINDING SITE, designated SEQ ID:33001, to the nucleotide sequence of VGAM861 RNA, herein designated VGAM RNA, also designated SEQ ID:3572.

A function of VGAM861 is therefore inhibition of Estrogen-related Receptor Gamma (ESRRG, Accession XM_039053), a gene which Estrogen-related receptor gamma. Accordingly, utilities of VGAM861 include diagnosis, prevention and treatment of diseases and clinical conditions associated with ESRRG. The function of ESRRG and its association with various diseases and clinical conditions, has been established by previous studies, as described hereinabove with reference to VGAM359. Glypican 4 (GPC4, Accession NM_001448) is another VGAM861 host target gene. GPC4 BINDING SITE is HOST TARGET binding site found in the 3' untranslated region of mRNA encoded by GPC4, corresponding to a HOST TARGET binding site such as BINDING SITE I, BINDING SITE II or BINDING SITE III. Table 2 illustrates the complementarity of the nucleotide sequences of GPC4 BINDING SITE, designated SEQ ID:7179, to the nucleotide sequence of VGAM861 RNA, herein designated VGAM RNA, also designated SEQ ID:3572.

Another function of VGAM861 is therefore inhibition of Glypican 4 (GPC4, Accession NM_001448), a gene which may play a role in growth control and cell division. Accordingly, utilities of VGAM861 include diagnosis, prevention and treatment of diseases and clinical conditions associated with GPC4. The function of GPC4 and its association with various diseases and clinical conditions, has been established by previous studies, as described hereinabove with reference to VGAM538. Kinase Insert Domain Receptor (a type III receptor tyrosine kinase) (KDR, Accession NM_002253) is another VGAM861 host target gene. KDR BINDING SITE is HOST TARGET binding site found in the 5" untranslated region of mRNA encoded by KDR, corresponding to a HOST TARGET binding site such as BINDING SITE I, BINDING SITE II or BINDING SITE III. Table 2 illustrates the complementarity of the nucleotide sequences of KDR BINDING SITE, designated SEQ ID:8055, to the nucleotide sequence of VGAM861 RNA, herein designated VGAM RNA, also designated SEQ ID:3572.

Another function of VGAM861 is therefore inhibition of Kinase Insert Domain Receptor (a type III receptor tyrosine kinase) (KDR, Accession NM_002253). Accordingly, utilities of VGAM861 include diagnosis, prevention and treatment of diseases and clinical conditions associated with KDR. Male-specific Lethal 3-like 1 (Drosophila) (MSL3L1, Accession NM_006800) is another VGAM861 host target gene. MSL3L1 BINDING SITE1 through MSL3L1 BINDING SITE3 are HOST TARGET binding sites found in untranslated regions of mRNA encoded by MSL3L1, corresponding to HOST TARGET binding sites such as BINDING SITE I, BINDING SITE II or BINDING SITE III. Table 2 illustrates the complementarity of the nucleotide sequences of MSL3L1 BINDING SITE1 through MSL3L1 BINDING SITE3, designated SEQ ID:13673, SEQ ID:27813 and SEQ ID:27816 respectively, to the nucleotide sequence of VGAM861 RNA, herein designated VGAM RNA, also designated SEQ ID:3572.

Another function of VGAM861 is therefore inhibition of Male-specific Lethal 3-like 1 (Drosophila) (MSL3L1, Accession NM_006800). Accordingly, utilities of VGAM861 include diagnosis, prevention and treatment of diseases and clinical conditions associated with MSL3L1. Sp3 Transcription Factor (SP3, Accession XM_092672) is another VGAM861 host target gene. SP3 BINDING SITE is HOST TARGET binding site found in the 3' untranslated region of mRNA encoded by SP3, corresponding to a HOST TARGET binding site such as BINDING SITE I, BINDING SITE II or BINDING SITE III. Table 2 illustrates the complementarity of the nucleotide sequences of SP3 BINDING SITE, designated SEQ ID:40136, to the nucleotide sequence of VGAM861 RNA, herein designated VGAM RNA, also designated SEQ ID:3572.

Another function of VGAM861 is therefore inhibition of Sp3 Transcription Factor (SP3, Accession XM_092672), a gene which binds to gt and gc boxes promoters elements. Accordingly, utilities of VGAM861 include diagnosis, prevention and treatment of diseases and clinical conditions associated with SP3. The function of SP3 has been established by previous studies. Kingsley and Winoto (1992) noted that in T cells, a consensus GT box similar to the GC box is bound by Sp1. Gel shift analysis showed that other regulatory proteins also bind the GT box. They then cloned 2 novel cDNAs using the Sp1 zinc finger domain as a probe. These new transcription factors, termed Sp2 (OMIM Ref. No. 601801) and Sp3 by them, encode proteins with several transactivation domains and a zinc finger DNA-binding domain with homology to Sp1. The Sp3 cDNA encodes an open reading frame of 713 amino acids. They found that the amino acid sequence of Sp3 is 90% homologous to that of Sp1 within the zinc finger region, and that there is significant homology throughout the protein. Kingsley and Winoto (1992) found that, when expressed in vitro, both Sp1 and Sp3 bind strongly to GC- and GT-box regulatory elements. Hagen et al. (1992) independently performed recognition site screening for factors which bind to the GT motif of the uteroglobin promoter. They isolated Sp3 and Sp4 (OMIM Ref. No. 600540), referring to them as SPR2 and SPR1 (for Sp-related factors 2 and 1) respectively. Northern blot analysis showed that Sp3 is expressed as a 5.0-kb message in all cell lines and tissues tested. Hagen et al. (1994) found that Sp3 represses Sp1-mediated transcriptional activation, suggesting that Sp3 is an inhibitory member of the Sp gene family.

Full details of the abovementioned studies are described in the following publications, the disclosure of which are hereby incorporated by reference:

Kalff-Suske, M.; Kunz, J.; Grzeschik, K.-H.; Suske, G.: Human Sp3 transcriptional regulator gene (SP3) maps to chromosome 2q31. Genomics 37:410-412, 1996; and Hagen, G.; Muller, S.; Beato, M.; Suske, G.: Cloning by recognition site screening of two novel GT box binding proteins: a family of Sp1 related genes. Nucleic Acids Res. 20:5519-5525, 19.

Further studies establishing the function and utilities of SP3 are found in John Hopkins OMIM database record ID 601804, and in sited publications numbered 7689-916 listed in the bibliography section hereinbelow, which are also hereby incorporated by reference. Chromosome 21 Open Reading Frame 25 (C21orf25, Accession XM_032945) is another VGAM861 host target gene. C21orf25 BINDING SITE is HOST TARGET binding site found in the 3' untranslated region of mRNA encoded by C21orf25, corresponding to a HOST TARGET binding site such as BINDING SITE I, BINDING SITE II or BINDING SITE III. Table 2 illustrates the complementarity of the nucleotide sequences of C21orf25 BINDING SITE, designated SEQ ID:31802, to the nucleotide sequence of VGAM861 RNA, herein designated VGAM RNA, also designated SEQ ID:3572.

Another function of VGAM861 is therefore inhibition of Chromosome 21 Open Reading Frame 25 (C21orf25, Accession XM_032945). Accordingly, utilities of VGAM861 include diagnosis, prevention and treatment of diseases and clinical conditions associated with C21orf25. FLJ21106 (Accession NM_025097) is another VGAM861 host target gene. FLJ21106 BINDING SITE is HOST TARGET binding site found in the 3' untranslated region of mRNA encoded by FLJ21106, corresponding to a HOST TARGET binding site such as BINDING SITE I, BINDING SITE II or BINDING SITE III. Table 2 illustrates the complementarity of the nucleotide sequences of FLJ21106 BINDING SITE, designated SEQ ID:24736, to the nucleotide sequence of VGAM861 RNA, herein designated VGAM RNA, also designated SEQ ID:3572.

Another function of VGAM861 is therefore inhibition of FLJ21106 (Accession NM_025097). Accordingly, utilities of VGAM861 include diagnosis, prevention and treatment of diseases and clinical conditions associated with FLJ21106. KIAA0427 (Accession NM_014772) is another VGAM861 host target gene. KIAA0427 BINDING SITE is HOST TARGET binding site found in the 3' untranslated region of mRNA encoded by KIAA0427, corresponding to a HOST TARGET binding site such as BINDING SITE I, BINDING SITE II or BINDING SITE III. Table 2 illustrates the complementarity of the nucleotide sequences of KIAA0427 BINDING SITE, designated SEQ ID:16582, to the nucleotide sequence of VGAM861 RNA, herein designated VGAM RNA, also designated SEQ ID:3572.

Another function of VGAM861 is therefore inhibition of KIAA0427 (Accession NM_014772). Accordingly, utilities of VGAM861 include diagnosis, prevention and treatment of diseases and clinical conditions associated with KIAA0427. Phosphatidylinositol-4-phosphate 5-kinase, Type I, Gamma (PIP5K1C, Accession XM_047620) is another VGAM861 host target gene. PIP5K1C BINDING SITE is HOST TARGET binding site found in the 3' untranslated region of mRNA encoded by PIP5K1C, corresponding to a HOST TARGET binding site such as BINDING SITE I, BINDING SITE II or BINDING SITE III. Table 2 illustrates the complementarity of the nucleotide sequences of PIP5K1C BINDING SITE, designated SEQ ID:35019, to the nucleotide sequence of VGAM861 RNA, herein designated VGAM RNA, also designated SEQ ID:3572.

Another function of VGAM861 is therefore inhibition of Phosphatidylinositol-4-phosphate 5-kinase, Type I, Gamma (PIP5K1C, Accession XM_047620). Accordingly, utilities of VGAM861 include diagnosis, prevention and treatment of diseases and clinical conditions associated with PIP5K1C. Target of Myb1 (chicken) (TOM1, Accession NM_005488) is another VGAM861 host target gene. TOM1 BINDING SITE is HOST TARGET binding site found in the 3' untranslated region of mRNA encoded by TOM1, corresponding to a HOST TARGET binding site such as BINDING SITE I, BINDING SITE II or BINDING SITE III. Table 2 illustrates the complementarity of the nucleotide sequences of TOM1 BINDING SITE, designated SEQ ID:11988, to the nucleotide sequence of VGAM861 RNA, herein designated VGAM RNA, also designated SEQ ID:3572.

Another function of VGAM861 is therefore inhibition of Target of Myb1 (chicken) (TOM1, Accession NM_005488). Accordingly, utilities of VGAM861 include diagnosis, prevention and treatment of diseases and clinical conditions associated with TOM1. LOC116028 (Accession XM_057225) is another VGAM861 host target gene. LOC116028 BINDING SITE is HOST TARGET binding site found in the 3' untranslated region of mRNA encoded by LOC116028, corresponding to a HOST TARGET binding site such as BINDING SITE I, BINDING SITE II or BINDING SITE III. Table 2 illustrates the complementarity of the nucleotide sequences of LOC116028 BINDING SITE, designated SEQ ID:36494, to the nucleotide sequence of VGAM861 RNA, herein designated VGAM RNA, also designated SEQ ID:3572.

Another function of VGAM861 is therefore inhibition of LOC116028 (Accession XM_057225). Accordingly, utilities of VGAM861 include diagnosis, prevention and treatment of diseases and clinical conditions associated with LOC116028. LOC150848 (Accession XM_097959) is another VGAM861 host target gene. LOC150848 BINDING SITE is HOST TARGET binding site found in the 3' untranslated region of mRNA encoded by LOC150848, corresponding to a HOST TARGET binding site such as BINDING SITE I, BINDING SITE II or BINDING SITE III. Table 2 illustrates the complementarity of the nucleotide sequences of LOC150848 BINDING SITE, designated SEQ ID:41260, to the nucleotide sequence of VGAM861 RNA, herein designated VGAM RNA, also designated SEQ ID:3572.

Another function of VGAM861 is therefore inhibition of LOC150848 (Accession XM_097959). Accordingly, utilities of VGAM861 include diagnosis, prevention and treatment of diseases and clinical conditions associated with LOC150848. LOC257471 (Accession XM_171020) is another VGAM861 host target gene. LOC257471 BINDING SITE is HOST TARGET binding site found in the 3' untranslated region of mRNA encoded by LOC257471, corresponding to a HOST TARGET binding site such as BINDING SITE I, BINDING SITE II or BINDING SITE III. Table 2 illustrates the complementarity of the nucleotide sequences of LOC257471 BINDING SITE, designated SEQ ID:45788, to the nucleotide sequence of VGAM861 RNA, herein designated VGAM RNA, also designated SEQ ID:3572.

Another function of VGAM861 is therefore inhibition of LOC257471 (Accession XM_171020). Accordingly, utilities of VGAM861 include diagnosis, prevention and treatment of diseases and clinical conditions associated with LOC257471. LOC51696 (Accession NM_016217) is another VGAM861 host target gene. LOC51696 BINDING SITE is HOST TARGET binding site found in the 5' untranslated region of mRNA encoded by LOC51696, corresponding to a HOST TARGET binding site such as BINDING SITE I, BINDING SITE II or BINDING SITE III. Table 2 illustrates the complementarity of the nucleotide sequences of LOC51696 BINDING SITE, designated SEQ ID:18318, to the nucleotide sequence of VGAM861 RNA, herein designated VGAM RNA, also designated SEQ ID:3572.

Another function of VGAM861 is therefore inhibition of LOC51696 (Accession NM_016217). Accordingly, utilities of VGAM861 include diagnosis, prevention and treatment of diseases and clinical conditions associated with LOC51696. FIG. 1 further provides a conceptual description of a novel bioinformatically detected viral gene of the present invention, referred to here as Viral Genomic Address Messenger 862 (VGAM862) viral gene, which modulates expression of respective host target genes thereof, the function and utility of which host target genes is known in the art.

VGAM862 is a novel bioinformatically detected regulatory, non protein coding, viral micro RNA (miRNA) gene. The method by which VGAM862 was detected is described hereinabove with reference to FIGS. 1-8.

VGAM862 gene, herein designated VGAM GENE, is a viral gene contained in the genome of Ictalurid Herpesvirus 1. VGAM862 host target gene, herein designated VGAM HOST TARGET GENE, is a human gene contained in the human genome.

VGAM862 gene encodes a VGAM862 precursor RNA, herein designated VGAM PRECURSOR RNA. Similar to other miRNA genes, and unlike most ordinary genes, VGAM862 precursor RNA does not encode a protein. A nucleotide sequence identical or highly similar to the nucleotide sequence of VGAM862 precursor RNA is designated SEQ ID:848, and is provided hereinbelow with reference to the sequence listing part. Nucleotide sequence SEQ ID:848 is located at position 97256 relative to the genome of Ictalurid Herpesvirus 1.

VGAM862 precursor RNA folds onto itself, forming VGAM862 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM862 folded precursor RNA into VGAM862 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM862 RNA is designated SEQ ID:3573, and is provided hereinbelow with reference to the sequence listing part.

VGAM862 host target gene, herein designated VGAM HOST TARGET GENE, encodes a corresponding messenger RNA, VGAM862 host target RNA, herein designated VGAM HOST TARGET RNA. VGAM862 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM862 RNA, herein designated VGAM RNA, binds complementarily to one or more host target binding sites located in untranslated regions of VGAM862 host target RNA, herein designated VGAM HOST TARGET RNA. This complementary binding is due to the fact that the nucleotide sequence of VGAM862 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM862 RNA, herein designated VGAM RNA, may have a different number of host target binding sites in untranslated regions of a VGAM862 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM862 RNA, herein designated VGAM RNA, to host target binding sites on VGAM862 host target RNA, herein designated VGAM HOST TARGET RNA, such as BINDING SITE I, BINDING SITE II and BINDING SITE III, inhibits translation of VGAM862 host target RNA into VGAM862 host target protein, herein designated VGAM HOST TARGET PROTEIN. VGAM host target protein is therefore outlined by a broken line.

It is appreciated that VGAM862 host target gene, herein designated VGAM HOST TARGET GENE, in fact represents a plurality of VGAM862 host target genes. The mRNA of each one of this plurality of VGAM862 host target genes comprises one or more host target binding sites, each having a nucleotide sequence which is at least partly complementary to VGAM862 RNA, herein designated VGAM RNA, and which when bound by VGAM862 RNA causes inhibition of translation of respective one or more VGAM862 host target proteins.

It is further appreciated by one skilled in the art that the mode of translational inhibition illustrated by FIG. 1 with specific reference to translational inhibition exerted by VGAM862 gene, herein designated VGAM GENE, on one or more VGAM862 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM862 is inhibition of expression of host target genes, as part of a novel viral mechanism of attacking a host. Accordingly, utilities of VGAM862 include diagnosis, prevention and treatment of viral infection by Ictalurid Herpesvirus 1. Specific functions, and accordingly utilities, of VGAM862 correlate with, and may be deduced from, the identity of the host target genes which VGAM862 binds and inhibits, and the function of these host target genes, as elaborated hereinbelow.

Nucleotide sequences of the VGAM862 precursor RNA, herein designated VGAM PRECURSOR RNA, and of the 'diced' VGAM862 RNA, herein designated VGAM RNA, and a schematic representation of the secondary folding of VGAM862 folded precursor RNA, herein designated VGAM FOLDED PRECURSOR RNA, of VGAM862 are further described hereinbelow with reference to Table 1.

Nucleotide sequences of host target binding sites, such as BINDING SITE-I, BINDING SITE-II and BINDING SITE-III of FIG. 1, found on VGAM862 host target RNA, and schematic representation of the complementarity of each of these host target binding sites to VGAM862 RNA, herein designated VGAM RNA, are described hereinbelow with reference to Table 2.

As mentioned hereinabove with reference to FIG. 1, a function of VGAM862 gene, herein designated VGAM is inhibition of expression of VGAM862 target genes. It is appreciated that specific functions, and accordingly utilities, of VGAM862 correlate with, and may be deduced from, the identity of the target genes which VGAM862 binds and inhibits, and the function of these target genes, as elaborated hereinbelow.

BLTR2 (Accession NM_019839) is a VGAM862 host target gene. BLTR2 BINDING SITE is HOST TARGET binding site found in the 5' untranslated region of mRNA encoded by BLTR2, corresponding to a HOST TARGET binding site such as BINDING SITE I, BINDING SITE II or BINDING SITE III. Table 2 illustrates the complementarity of the nucleotide sequences of BLTR2 BINDING SITE, designated SEQ ID:21242, to the nucleotide sequence of VGAM862 RNA, herein designated VGAM RNA, also designated SEQ ID:3573.

A function of VGAM862 is therefore inhibition of BLTR2 (Accession NM_019839). Accordingly, utilities of VGAM862 include diagnosis, prevention and treatment of diseases and clinical conditions associated with BLTR2.

Dishevelled, Dsh Homolog 3 (Drosophila) (DVL3, Accession NM_004423) is another VGAM862 host target gene. DVL3 BINDING SITE is HOST TARGET binding site found in the 3' untranslated region of mRNA encoded by DVL3, corresponding to a HOST TARGET binding site such as BINDING SITE I, BINDING SITE II or BINDING SITE III. Table 2 illustrates the complementarity of the nucleotide sequences of DVL3 BINDING SITE, designated SEQ ID:10691, to the nucleotide sequence of VGAM862 RNA, herein designated VGAM RNA, also designated SEQ ID:3573.

Another function of VGAM862 is therefore inhibition of Dishevelled, Dsh Homolog 3 (Drosophila) (DVL3, Accession NM_004423), a gene which regulates cell proliferation. Accordingly, utilities of VGAM862 include diagnosis, prevention and treatment of diseases and clinical conditions associated with DVL3. The function of DVL3 and its association with various diseases and clinical conditions, has been established by previous studies, as described hereinabove with reference to VGAM57. Fibroblast Growth Factor 5 (FGF5, Accession NM_004464) is another VGAM862 host target gene. FGF5 BINDING SITE1 and FGF5 BINDING SITE2 are HOST TARGET binding sites found in untranslated regions of mRNA encoded by FGF5, corresponding to HOST TARGET binding sites such as BINDING SITE I, BINDING SITE II or BINDING SITE III. Table 2 illustrates the complementarity of the nucleotide sequences of FGF5 BINDING SITE1 and FGF5 BINDING SITE2, designated SEQ ID:10772 and SEQ ID:26999 respectively, to the nucleotide sequence of VGAM862 RNA, herein designated VGAM RNA, also designated SEQ ID:3573.

Another function of VGAM862 is therefore inhibition of Fibroblast Growth Factor 5 (FGF5, Accession NM_004464), a gene which induces transformation and may regulate neuronal differentiation. Accordingly, utilities of VGAM862 include diagnosis, prevention and treatment of diseases and clinical conditions associated with FGF5. The function of FGF5 and its association with various diseases and clinical conditions, has been established by previous studies, as described hereinabove with reference to VGAM276. Solute Carrier Family 8 (sodium-calcium exchanger), Member 2 (SLC8A2, Accession XM_038970) is another VGAM862 host target gene. SLC8A2 BINDING SITE is HOST TARGET binding site found in the 3' untranslated region of mRNA encoded by SLC8A2, corresponding to a HOST TARGET binding site such as BINDING SITE I, BINDING SITE II or BINDING SITE III. Table 2 illustrates the complementarity of the nucleotide sequences of SLC8A2 BINDING SITE, designated SEQ ID:32966, to the nucleotide sequence of VGAM862 RNA, herein designated VGAM RNA, also designated SEQ ID:3573.

Another function of VGAM862 is therefore inhibition of Solute Carrier Family 8 (sodium-calcium exchanger), Member 2 (SLC8A2, Accession XM_038970). Accordingly, utilities of VGAM862 include diagnosis, prevention and treatment of diseases and clinical conditions associated with SLC8A2. Small Optic Lobes Homolog (Drosophila) (SOLH, Accession NM_005632) is another VGAM862 host target gene. SOLH BINDING SITE is HOST TARGET binding site found in the 5' untranslated region of mRNA encoded by SOLH, corresponding to a HOST TARGET binding site such as BINDING SITE I, BINDING SITE II or BINDING SITE III. Table 2 illustrates the complementarity of the nucleotide sequences of SOLH BINDING SITE, designated SEQ ID:12163, to the nucleotide sequence of VGAM862 RNA, herein designated VGAM RNA, also designated SEQ ID:3573.

Another function of VGAM862 is therefore inhibition of Small Optic Lobes Homolog (Drosophila) (SOLH, Accession NM_005632), a gene which has several domains (calpain-like domain, zinc fingers) and homologic to the Drosophila sol. Accordingly, utilities of VGAM862 include diagnosis, prevention and treatment of diseases and clinical conditions associated with SOLH. The function of SOLH has been established by previous studies. The Drosophila small optic lobes (sol) gene encodes a protein with zinc finger-like repeats, a calpain (see OMIM Ref. No. 114240)-like protease domain, and a C-terminal region of unknown function. Mutations in sol cause a severe reduction in the cell numbers of the neuropiles of the medulla and lobula complexes of the adult optic lobes. Banfi et al. (1996) identified a human EST encoding a protein with homology to the sol gene product. By screening human brain cDNA libraries with this EST, Kamei et al. (1998) isolated cDNAs corresponding to the complete coding sequence of SOLH. The predicted 1,086-amino acid protein shares 44% sequence identity with sol. The calpain-like domain and C-terminal region are highly conserved between SOLH and sol, and similar zinc fingers are present in the N-terminal regions of these proteins. The SOLH gene contains at least 14 exons distributed over more than 45 kb. Southern blot analysis indicated that SOLH is a single-copy gene. Using Northern blots, the authors demonstrated that SOLH is expressed as an approximately 5-kb mRNA in various human tissues; additional smaller transcripts were observed in some tissues. Kamei et al. (1998) identified cDNAs and genomic clones encoding mouse, C. elegans, and Fugu rubripes (Japanese pufferfish) homologs of sol.

Full details of the abovementioned studies are described in the following publications, the disclosure of which are hereby incorporated by reference:

Banfi, S.; Borsani, G.; Rossi, E.; Bernard, L.; Guffanti, A.; Rubboli, F.; Marchitiello, A.; Giglio, S.; Coluccia, E.; Zollo, M.; Zuffardi, O.; Ballabio, A.: Identification and mapping of human cDNAs homologous to Drosophila mutant genes through EST database searching. Nature Genet. 13:167-174, 1996; and Kamei, M.; Webb, G. C.; Young, I. G.; Campbell, H. D.: SOLH, a human homologue of the Drosophila melanogaster small optic lobes gene is a member of the calpain and zinc-finger gene famili.

Further studies establishing the function and utilities of SOLH are found in John Hopkins OMIM database record ID 603267, and in sited publications numbered 602 and 6331 listed in the bibliography section hereinbelow, which are also hereby incorporated by reference. FLJ12816 (Accession NM_022060) is another VGAM862 host target gene. FLJ12816 BINDING SITE is HOST TARGET binding site found in the 3' untranslated region of mRNA encoded by FLJ12816, corresponding to a HOST TARGET binding site such as BINDING SITE I, BINDING SITE II or BINDING SITE III. Table 2 illustrates the complementarity of the nucleotide sequences of FLJ12816 BINDING SITE, designated SEQ ID:22602, to the nucleotide sequence of VGAM862 RNA, herein designated VGAM RNA, also designated SEQ ID:3573.

Another function of VGAM862 is therefore inhibition of FLJ12816 (Accession NM_022060). Accordingly, utilities of VGAM862 include diagnosis, prevention and treatment of diseases and clinical conditions associated with FLJ12816. FLJ22471 (Accession NM_025140) is another VGAM862 host target gene. FLJ22471 BINDING SITE is HOST TARGET binding site found in the 3' untranslated region of mRNA encoded by FLJ22471, corresponding to a HOST TARGET binding site such as BINDING SITE I, BINDING SITE II or BINDING SITE III. Table 2 illustrates the complementarity of the nucleotide sequences of FLJ22471 BINDING SITE, designated SEQ ID:24777, to the nucleotide sequence of VGAM862 RNA, herein designated VGAM RNA, also designated SEQ ID:3573.

Another function of VGAM862 is therefore inhibition of FLJ22471 (Accession NM_025140). Accordingly, utilities of VGAM862 include diagnosis, prevention and treatment of diseases and clinical conditions associated with FLJ22471. KIAA1322 (Accession XM_052626) is another VGAM862 host target gene. KIAA1322 BINDING SITE is HOST TARGET binding site found in the 3' untranslated region of mRNA encoded by KIAA1322, corresponding to a HOST TARGET binding site such as BINDING SITE I, BINDING SITE II or BINDING SITE III. Table 2 illustrates the complementarity of the nucleotide sequences of KIAA1322 BINDING SITE, designated SEQ ID:36020, to the nucleotide sequence of VGAM862 RNA, herein designated VGAM RNA, also designated SEQ ID:3573.

Another function of VGAM862 is therefore inhibition of KIAA1322 (Accession XM_052626). Accordingly, utilities of VGAM862 include diagnosis, prevention and treatment of diseases and clinical conditions associated with KIAA1322. PRO0097 (Accession NM_014114) is another VGAM862 host target gene. PRO0097 BINDING SITE is HOST TARGET binding site found in the 5' untranslated region of mRNA encoded by PRO0097, corresponding to a HOST TARGET binding site such as BINDING SITE I, BINDING SITE II or BINDING SITE III. Table 2 illustrates the complementarity of the nucleotide sequences of PRO0097 BINDING SITE, designated SEQ ID:15364, to the nucleotide sequence of VGAM862 RNA, herein designated VGAM RNA, also designated SEQ ID:3573.

Another function of VGAM862 is therefore inhibition of PRO0097 (Accession NM_014114). Accordingly, utilities of VGAM862 include diagnosis, prevention and treatment of diseases and clinical conditions associated with PRO0097. ZFP106 (Accession NM_022473) is another VGAM862 host target gene. ZFP106 BINDING SITE is HOST TARGET binding site found in the 5' untranslated region of mRNA encoded by ZFP106, corresponding to a HOST TARGET binding site such as BINDING SITE I, BINDING SITE II or BINDING SITE III. Table 2 illustrates the complementarity of the nucleotide sequences of ZFP106 BINDING SITE, designated SEQ ID:22829, to the nucleotide sequence of VGAM862 RNA, herein designated VGAM RNA, also designated SEQ ID:3573.

Another function of VGAM862 is therefore inhibition of ZFP106 (Accession NM_022473). Accordingly, utilities of VGAM862 include diagnosis, prevention and treatment of diseases and clinical conditions associated with ZFP106. LOC150397 (Accession XM_086907) is another VGAM862 host target gene. LOC150397 BINDING SITE is HOST TARGET binding site found in the 3' untranslated region of mRNA encoded by LOC150397, corresponding to a HOST TARGET binding site such as BINDING SITE I, BINDING SITE II or BINDING SITE III. Table 2 illustrates the complementarity of the nucleotide sequences of LOC150397 BINDING SITE, designated SEQ ID:38959, to the nucleotide sequence of VGAM862 RNA, herein designated VGAM RNA, also designated SEQ ID:3573.

Another function of VGAM862 is therefore inhibition of LOC150397 (Accession XM_086907). Accordingly, utilities of VGAM862 include diagnosis, prevention and treatment of diseases and clinical conditions associated with LOC150397. LOC163682 (Accession XM_099402) is another VGAM862 host target gene. LOC163682 BINDING SITE is HOST TARGET binding site found in the 5' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42086, to the nucleotide sequence of VGAM862 RNA, herein designated VGAM RNA, also designated SEQ ID:3573.

Another function of VGAM862 is therefore inhibition of LOC163682 (Accession XM_099402). Accordingly, utilities of VGAM862 include diagnosis, prevention and treatment of diseases and clinical conditions associated with LOC163682. LOC222171 (Accession XM_166586) is another VGAM862 host target gene. LOC222171 BINDING SITE is HOST TARGET binding site found in the 5' untranslated region of mRNA encoded by LOC222171, corresponding to a HOST TARGET binding site such as BINDING SITE I, BINDING SITE II or BINDING SITE III. Table 2 illustrates the complementarity of the nucleotide sequences of LOC222171 BINDING SITE, designated SEQ ID:44558, to the nucleotide sequence of VGAM862 RNA, herein designated VGAM RNA, also designated SEQ ID:3573.

Another function of VGAM862 is therefore inhibition of LOC222171 (Accession XM_166586). Accordingly, utilities of VGAM862 include diagnosis, prevention and treatment of diseases and clinical conditions associated with LOC222171. FIG. 1 further provides a conceptual description of a novel bioinformatically detected viral gene of the present invention, referred to here as Viral Genomic Address Messenger 863 (VGAM863) viral gene, which modulates expression of respective host target genes thereof, the function and utility of which host target genes is known in the art.

VGAM863 is a novel bioinformatically detected regulatory, non protein coding, viral micro RNA (miRNA) gene. The method by which VGAM863 was detected is described hereinabove with reference to FIGS. 1-8.

VGAM863 gene, herein designated VGAM GENE, is a viral gene contained in the genome of Ictalurid Herpesvirus 1. VGAM863 host target gene, herein designated VGAM HOST TARGET GENE, is a human gene contained in the human genome.

VGAM863 gene encodes a VGAM863 precursor RNA, herein designated VGAM PRECURSOR RNA. Similar to other miRNA genes, and unlike most ordinary genes, VGAM863 precursor RNA does not encode a protein. A nucleotide sequence identical or highly similar to the nucleotide sequence of VGAM863 precursor RNA is designated SEQ ID:849, and is provided hereinbelow with reference to the sequence listing part. Nucleotide sequence SEQ ID:849 is located at position 99448 relative to the genome of Ictalurid Herpesvirus 1.

VGAM863 precursor RNA folds onto itself, forming VGAM863 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM863 folded precursor RNA into VGAM863 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM863 RNA is designated SEQ ID:3574, and is provided hereinbelow with reference to the sequence listing part.

VGAM863 host target gene, herein designated VGAM HOST TARGET GENE, encodes a corresponding messenger RNA, VGAM863 host target RNA, herein designated VGAM HOST TARGET RNA. VGAM863 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM863 RNA, herein designated VGAM RNA, binds complementarily to one or more host target binding sites located in untranslated regions of VGAM863 host target RNA, herein designated VGAM HOST TARGET RNA. This complementary binding is due to the fact that the nucleotide sequence of VGAM863 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM863 RNA, herein designated VGAM RNA, may have a different number of host target binding sites in untranslated regions of a VGAM863 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM863 RNA, herein designated VGAM RNA, to host target binding sites on VGAM863 host target RNA, herein designated VGAM HOST TARGET RNA, such as BINDING SITE I, BINDING SITE II and BINDING SITE III, inhibits translation of VGAM863 host target RNA into VGAM863 host target protein, herein designated VGAM HOST TARGET PROTEIN. VGAM host target protein is therefore outlined by a broken line.

It is appreciated that VGAM863 host target gene, herein designated VGAM HOST TARGET GENE, in fact represents a plurality of VGAM863 host target genes. The mRNA of each one of this plurality of VGAM863 host target genes comprises one or more host target binding sites, each having a nucleotide sequence which is at least partly complementary to VGAM863 RNA, herein designated VGAM RNA, and which when bound by VGAM863 RNA causes inhibition of translation of respective one or more VGAM863 host target proteins.

It is further appreciated by one skilled in the art that the mode of translational inhibition illustrated by FIG. 1 with specific reference to translational inhibition exerted by VGAM863 gene, herein designated VGAM GENE, on one or more VGAM863 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM863 is inhibition of expression of host target genes, as part of a novel viral mechanism of attacking a host. Accordingly, utilities of VGAM863 include diagnosis, prevention and treatment of viral infection by Ictalurid Herpesvirus 1. Specific functions, and accordingly utilities, of VGAM863 correlate with, and may be deduced from, the identity of the host target genes which VGAM863 binds and inhibits, and the function of these host target genes, as elaborated hereinbelow.

Nucleotide sequences of the VGAM863 precursor RNA, herein designated VGAM PRECURSOR RNA, and of the 'diced' VGAM863 RNA, herein designated VGAM RNA, and a schematic representation of the secondary folding of VGAM863 folded precursor RNA, herein designated VGAM FOLDED PRECURSOR RNA, of VGAM863 are further described hereinbelow with reference to Table 1.

Nucleotide sequences of host target binding sites, such as BINDING SITE-I, BINDING SITE-II and BINDING SITE-III of FIG. 1, found on VGAM863 host target RNA, and schematic representation of the complementarity of each of these host target binding sites to VGAM863 RNA, herein designated VGAM RNA, are described hereinbelow with reference to Table 2.

As mentioned hereinabove with reference to FIG. 1, a function of VGAM863 gene, herein designated VGAM is inhibition of expression of VGAM863 target genes. It is appreciated that specific functions, and accordingly utilities, of VGAM863 correlate with, and may be deduced from, the identity of the target genes which VGAM863 binds and inhibits, and the function of these target genes, as elaborated hereinbelow.

Axin 1 (AXIN1, Accession XM_027520) is a VGAM863 host target gene. AXIN1 BINDING SITE is HOST TARGET binding site found in the 3' untranslated region of mRNA encoded by AXIN1, corresponding to a HOST TARGET binding site such as BINDING SITE I, BINDING SITE II or BINDING SITE III. Table 2 illustrates the complementarity of the nucleotide sequences of AXIN1 BINDING SITE, designated SEQ ID:30513, to the nucleotide sequence of VGAM863 RNA, herein designated VGAM RNA, also designated SEQ ID:3574.

A function of VGAM863 is therefore inhibition of Axin 1 (AXIN1, Accession XM_027520). Accordingly, utilities of VGAM863 include diagnosis, prevention and treatment of diseases and clinical conditions associated with AXIN1. Lysosomal-associated Membrane Protein 2 (LAMP2, Accession NM_013995) is another VGAM863 host target gene. LAMP2 BINDING SITE is HOST TARGET binding site found in the 3' untranslated region of mRNA encoded by LAMP2, corresponding to a HOST TARGET binding site such as BINDING SITE I, BINDING SITE II or BINDING SITE III. Table 2 illustrates the complementarity of the nucleotide sequences of LAMP2 BINDING SITE, designated SEQ ID:15182, to the nucleotide sequence of VGAM863 RNA, herein designated VGAM RNA, also designated SEQ ID:3574.

Another function of VGAM863 is therefore inhibition of Lysosomal-associated Membrane Protein 2 (LAMP2, Accession NM_013995). Accordingly, utilities of VGAM863 include diagnosis, prevention and treatment of diseases and clinical conditions associated with LAMP2. Lymphotoxin Alpha (TNF superfamily, member 1) (LTA, Accession NM_000595) is another VGAM863 host target gene. LTA BINDING SITE is HOST TARGET binding site found in the 3' untranslated region of mRNA encoded by LTA, corresponding to a HOST TARGET binding site such as BINDING SITE I, BINDING SITE II or BINDING SITE III. Table 2 illustrates the complementarity of the nucleotide sequences of LTA BINDING SITE, designated SEQ ID:6193, to the nucleotide sequence of VGAM863 RNA, herein designated VGAM RNA, also designated SEQ ID:3574.

Another function of VGAM863 is therefore inhibition of Lymphotoxin Alpha (TNF superfamily, member 1) (LTA, Accession NM_000595), a gene which is a cytokine that in its homotrimeric form binds to tnfrsf1a/tnfr1, tnfrsf1b/tnfbr and tnfrsf14/hvem. Accordingly, utilities of VGAM863 include diagnosis, prevention and treatment of diseases and clinical conditions associated with LTA. The function of LTA and its association with various diseases and clinical conditions, has been established by previous studies, as described hereinabove with reference to VGAM662. ATP-binding Cassette, Sub-family A (ABC1), Member 9 (ABCA9, Accession NM_080283) is another VGAM863 host target gene. ABCA9 BINDING SITE is HOST TARGET binding site found in the 3' untranslated region of mRNA encoded by ABCA9, corresponding to a HOST TARGET binding site such as BINDING SITE I, BINDING SITE II or BINDING SITE III. Table 2 illustrates the complementarity of the nucleotide sequences of ABCA9 BINDING SITE, designated SEQ ID:27826, to the nucleotide sequence of VGAM863 RNA, herein designated VGAM RNA, also designated SEQ ID:3574.

Another function of VGAM863 is therefore inhibition of ATP-binding Cassette, Sub-family A (ABC1), Member 9 (ABCA9, Accession NM_080283). Accordingly, utilities of VGAM863 include diagnosis, prevention and treatment of diseases and clinical conditions associated with ABCA9. FASTK (Accession NM_025096) is another VGAM863 host target gene. FASTK BINDING SITE is HOST TARGET binding site found in the 3' untranslated region of mRNA encoded by FASTK, corresponding to a HOST TARGET binding site such as BINDING SITE I, BINDING SITE II or BINDING SITE III. Table 2 illustrates the complementarity of the nucleotide sequences of FASTK BINDING SITE, designated SEQ ID:24726, to the nucleotide sequence of VGAM863 RNA, herein designated VGAM RNA, also designated SEQ ID:3574.

Another function of VGAM863 is therefore inhibition of FASTK (Accession NM_025096). Accordingly, utilities of VGAM863 include diagnosis, prevention and treatment of diseases and clinical conditions associated with FASTK. FLJ14437 (Accession NM_032578) is another VGAM863 host target gene. FLJ14437 BINDING SITE is HOST TARGET binding site found in the 3" untranslated region of mRNA encoded by FLJ14437, corresponding to a HOST TARGET binding site such as BINDING SITE I, BINDING SITE II or BINDING SITE III. Table 2 illustrates the complementarity of the nucleotide sequences of FLJ14437 BINDING SITE, designated SEQ ID:26306, to the nucleotide sequence of VGAM863 RNA, herein designated VGAM RNA, also designated SEQ ID:3574.

Another function of VGAM863 is therefore inhibition of FLJ14437 (Accession NM_032578). Accordingly, utilities of VGAM863 include diagnosis, prevention and treatment of diseases and clinical conditions associated with FLJ14437. KIAA0125 (Accession XM_018203) is another VGAM863 host target gene. KIAA0125 BINDING SITE is HOST TARGET binding site found in the 3' untranslated region of mRNA encoded by KIAA0125, corresponding to a HOST TARGET binding site such as BINDING SITE I, BINDING SITE II or BINDING SITE III. Table 2 illustrates the complementarity of the nucleotide sequences of KIAA0125 BINDING SITE, designated SEQ ID:30344, to the nucleotide sequence of VGAM863 RNA, herein designated VGAM RNA, also designated SEQ ID:3574.

Another function of VGAM863 is therefore inhibition of KIAA0125 (Accession XM_018203). Accordingly, utilities of VGAM863 include diagnosis, prevention and treatment of diseases and clinical conditions associated with KIAA0125. KIAA1505 (Accession XM_168469) is another VGAM863 host target gene. KIAA1505 BINDING SITE is HOST TARGET binding site found in the 5' untranslated region of mRNA encoded by KIAA1505, corresponding to a HOST TARGET binding site such as BINDING SITE I, BINDING SITE II or BINDING SITE III. Table 2 illustrates the complementarity of the nucleotide sequences of KIAA1505 BINDING SITE, designated SEQ ID:45191, to the nucleotide sequence of VGAM863 RNA, herein designated VGAM RNA, also designated SEQ ID:3574.

Another function of VGAM863 is therefore inhibition of KIAA1505 (Accession XM_168469). Accordingly, utilities of VGAM863 include diagnosis, prevention and treatment of diseases and clinical conditions associated with KIAA1505. MGC39436 (Accession NM_144673) is another VGAM863 host target gene. MGC39436 BINDING SITE is HOST TARGET binding site found in the 5' untranslated region of mRNA encoded by MGC39436, corresponding to a HOST TARGET binding site such as BINDING SITE I, BINDING SITE II or BINDING SITE III. Table 2 illustrates the complementarity of the nucleotide sequences of MGC39436 BINDING SITE, designated SEQ ID:29495, to the nucleotide sequence of VGAM863 RNA, herein designated VGAM RNA, also designated SEQ ID:3574.

Another function of VGAM863 is therefore inhibition of MGC39436 (Accession NM_144673). Accordingly, utilities of VGAM863 include diagnosis, prevention and treatment of diseases and clinical conditions associated with MGC39436. NYD-SP27 (Accession NM_033123) is another VGAM863 host target gene. NYD-SP27 BINDING SITE is HOST TARGET binding site found in the 5' untranslated region of mRNA encoded by NYD-SP27, corresponding to a HOST TARGET binding site such as BINDING SITE I, BINDING SITE II or BINDING SITE III. Table 2 illustrates the complementarity of the nucleotide sequences of NYD-SP27 BINDING SITE, designated SEQ ID:26967, to the nucleotide sequence of VGAM863 RNA, herein designated VGAM RNA, also designated SEQ ID:3574.

Another function of VGAM863 is therefore inhibition of NYD-SP27 (Accession NM_033123). Accordingly, utilities of VGAM863 include diagnosis, prevention and treatment of diseases and clinical conditions associated with NYD-SP27. Suppression of Tumorigenicity 7 Like (ST7L, Accession NM_139195) is another VGAM863 host target gene. ST7L BINDING SITE is HOST TARGET binding site found in the 3' untranslated region of mRNA encoded by ST7L, corresponding to a HOST TARGET binding site such as BINDING SITE I, BINDING SITE II or BINDING SITE III. Table 2 illustrates the complementarity of the nucleotide sequences of ST7L BINDING SITE, designated SEQ ID:29203, to the nucleotide sequence of VGAM863 RNA, herein designated VGAM RNA, also designated SEQ ID:3574.

Another function of VGAM863 is therefore inhibition of Suppression of Tumorigenicity 7 Like (ST7L, Accession NM_139195). Accordingly, utilities of VGAM863 include diagnosis, prevention and treatment of diseases and clinical conditions associated with ST7L. LOC158434 (Accession XM_098939) is another VGAM863 host target gene. LOC158434 BINDING SITE is HOST TARGET binding site found in the 3' untranslated region of mRNA encoded by LOC158434, corresponding to a HOST TARGET binding site such as BINDING SITE I, BINDING SITE II or BINDING SITE III. Table 2 illustrates the complementarity of the nucleotide sequences of LOC158434 BINDING SITE, designated SEQ ID:41981, to the nucleotide sequence of VGAM863 RNA, herein designated VGAM RNA, also designated SEQ ID:3574.

Another function of VGAM863 is therefore inhibition of LOC158434 (Accession XM_098939). Accordingly, utilities of VGAM863 include diagnosis, prevention and treatment of diseases and clinical conditions associated with LOC158434. FIG. 1 further provides a conceptual description of a novel bioinformatically detected viral gene of the present invention, referred to here as Viral Genomic Address Messenger 864 (VGAM864) viral gene, which modulates expression of respective host target genes thereof, the function and utility of which host target genes is known in the art.

VGAM864 is a novel bioinformatically detected regulatory, non protein coding, viral micro RNA (miRNA) gene. The method by which VGAM864 was detected is described hereinabove with reference to FIGS. 1-8.

VGAM864 gene, herein designated VGAM GENE, is a viral gene contained in the genome of Ictalurid Herpesvirus 1. VGAM864 host target gene, herein designated VGAM HOST TARGET GENE, is a human gene contained in the human genome.

VGAM864 gene encodes a VGAM864 precursor RNA, herein designated VGAM PRECURSOR RNA. Similar to other miRNA genes, and unlike most ordinary genes, VGAM864 precursor RNA does not encode a protein. A nucleotide sequence identical or highly similar to the nucleotide sequence of VGAM864 precursor RNA is designated SEQ ID:850, and is provided hereinbelow with reference to the sequence listing part. Nucleotide sequence SEQ ID:850 is located at position 96883 relative to the genome of Ictalurid Herpesvirus 1.

VGAM864 precursor RNA folds onto itself, forming VGAM864 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM864 folded precursor RNA into VGAM864 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM864 RNA is designated SEQ ID:3575, and is provided hereinbelow with reference to the sequence listing part.

VGAM864 host target gene, herein designated VGAM HOST TARGET GENE, encodes a corresponding messenger RNA, VGAM864 host target RNA, herein designated VGAM HOST TARGET RNA. VGAM864 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM864 RNA, herein designated VGAM RNA, binds complementarily to one or more host target binding sites located in untranslated regions of VGAM864 host target RNA, herein designated VGAM HOST TARGET RNA. This complementary binding is due to the fact that the nucleotide sequence of VGAM864 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM864 RNA, herein designated VGAM RNA, may have a different number of host target binding sites in untranslated regions of a VGAM864 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM864 RNA, herein designated VGAM RNA, to host target binding sites on VGAM864 host target RNA, herein designated VGAM HOST TARGET RNA, such as BINDING SITE I, BINDING SITE II and BINDING SITE III, inhibits translation of VGAM864 host target RNA into VGAM864 host target protein, herein designated VGAM HOST TARGET PROTEIN. VGAM host target protein is therefore outlined by a broken line.

It is appreciated that VGAM864 host target gene, herein designated VGAM HOST TARGET GENE, in fact represents a plurality of VGAM864 host target genes. The mRNA of each one of this plurality of VGAM864 host target genes comprises one or more host target binding sites, each having a nucleotide sequence which is at least partly complementary to VGAM864 RNA, herein designated VGAM RNA, and which when bound by VGAM864 RNA causes inhibition of translation of respective one or more VGAM864 host target proteins.

It is further appreciated by one skilled in the art that the mode of translational inhibition illustrated by FIG. 1 with specific reference to translational inhibition exerted by VGAM864 gene, herein designated VGAM GENE, on one or more VGAM864 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM864 is inhibition of expression of host target genes, as part of a novel viral mechanism of attacking a host. Accordingly, utilities of VGAM864 include diagnosis, prevention and treatment of viral infection by Ictalurid Herpesvirus 1. Specific functions, and accordingly utilities, of VGAM864 correlate with, and may be deduced from, the identity of the host target genes which VGAM864 binds and inhibits, and the function of these host target genes, as elaborated hereinbelow.

Nucleotide sequences of the VGAM864 precursor RNA, herein designated VGAM PRECURSOR RNA, and of the 'diced' VGAM864 RNA, herein designated VGAM RNA, and a schematic representation of the secondary folding of VGAM864 folded precursor RNA, herein designated VGAM FOLDED PRECURSOR RNA, of VGAM864 are further described hereinbelow with reference to Table 1.

Nucleotide sequences of host target binding sites, such as BINDING SITE-I, BINDING SITE-II and BINDING SITE- III of FIG. 1, found on VGAM864 host target RNA, and schematic representation of the complementarity of each of these host target binding sites to VGAM864 RNA, herein designated VGAM RNA, are described hereinbelow with reference to Table 2.

As mentioned hereinabove with reference to FIG. 1, a function of VGAM864 gene, herein designated VGAM is inhibition of expression of VGAM864 target genes. It is appreciated that specific functions, and accordingly utilities, of VGAM864 correlate with, and may be deduced from, the identity of the target genes which VGAM864 binds and inhibits, and the function of these target genes, as elaborated hereinbelow.

Fibroblast Growth Factor 9 (glia-activating factor) (FGF9, Accession NM_002010) is a VGAM864 host target gene. FGF9 BINDING SITE is HOST TARGET binding site found in the 3' untranslated region of mRNA encoded by FGF9, corresponding to a HOST TARGET binding site such as BINDING SITE I, BINDING SITE II or BINDING SITE III. Table 2 illustrates the complementarity of the nucleotide sequences of FGF9 BINDING SITE, designated SEQ ID:7751, to the nucleotide sequence of VGAM864 RNA, herein designated VGAM RNA, also designated SEQ ID:3575.

A function of VGAM864 is therefore inhibition of Fibroblast Growth Factor 9 (glia-activating factor) (FGF9, Accession NM_002010), a gene which Fibroblast growth factor 9 (glia-activating factor); secreted mitogen. Accordingly, utilities of VGAM864 include diagnosis, prevention and treatment of diseases and clinical conditions associated with FGF9. The function of FGF9 has been established by previous studies. Members of the fibroblast growth factor (FGF) gene family (e.g., FGF1; 131220) are peptide regulatory factors acting through 4 distinct tyrosine kinase receptors and involved in various biologic processes during embryogenesis and adult life, including implantation, morphogenesis, angiogenesis, and possibly tumorigenesis. Miyamoto et al. (1993) cloned the ninth member of the FGF family. By radioactive chromosomal in situ hybridization, Mattei et al. (1995) mapped the gene to 13q11-q12. Using the Cre/loxP system, Sun et al. (2000) found that maintenance of Fgf9 and Fgf17 (OMIM Ref. No. 603725) expression is dependent on Shh (OMIM Ref. No. 600725), whereas Fgf8 (OMIM Ref. No. 600483) expression is not. Sun et al. (2000) developed a model in which no individual Fgf expressed in the apical ectodermal ridge is solely necessary to maintain Shh expression, but instead the combined activity of 2 or more apical ectodermal ridge Fgfs function in a positive feedback loop with Shh to control limb development. Colvin et al. (2001) reported male-to-female sex reversal in mice lacking Fgf9, demonstrating a novel role for FGF signaling in testicular embryogenesis. Fgf9 -/- mice also exhibited lung hypoplasia and died at birth. Reproductive system phenotypes ranged from testicular hypoplasia to complete sex reversal, with most Fgf9 -/- XY reproductive systems appearing grossly female at birth. Fgf9 appeared to act downstream of Sry (OMIM Ref. No. 480000) to stimulate mesenchymal proliferation, mesonephric cell migration, and Sertoli cell differentiation in the embryonic testis. While Sry is found only in some mammals, Fgfs are highly conserved. Thus, Fgfs may function in sex determination and reproductive system development in many species.

Full details of the abovementioned studies are described in the following publications, the disclosure of which are hereby incorporated by reference:

Colvin, J. S.; Green, R. P.; Schmahl, J.; Capel, B.; Ornitz, D. M.: Male-to-female sex reversal in mice lacking fibroblast growth factor 9. Cell 104:875-889, 2001; and Sun, X.; Lewandoski, M.; Meyers, E. N.; Liu, Y.-H.; Maxson, R. E., Jr.; Martin, G. R.: Conditional inactivation of Fgf4 reveals complexity of signalling during limb bud development. Na.

Further studies establishing the function and utilities of FGF9 are found in John Hopkins OMIM database record ID 600921, and in sited publications numbered 9955-995 and 3289 listed in the bibliography section hereinbelow, which are also hereby incorporated by reference. Guanylate Binding Protein 1, Interferon-inducible, 67 kDa (GBP1, Accession NM_002053) is another VGAM864 host target gene. GBP1 BINDING SITE is HOST TARGET binding site found in the 3' untranslated region of mRNA encoded by GBP1, corresponding to a HOST TARGET binding site such as BINDING SITE I, BINDING SITE II or BINDING SITE III. Table 2 illustrates the complementarity of the nucleotide sequences of GBP1 BINDING SITE, designated SEQ ID:7809, to the nucleotide sequence of VGAM864 RNA, herein designated VGAM RNA, also designated SEQ ID:3575.

Another function of VGAM864 is therefore inhibition of Guanylate Binding Protein 1, Interferon-inducible, 67 kDa (GBP1, Accession NM_002053), a gene which specifically binds guanylate nucleotides (GMP, GDP and GTP). Accordingly, utilities of VGAM864 include diagnosis, prevention and treatment of diseases and clinical conditions associated with GBP1. The function of GBP1 and its association with various diseases and clinical conditions, has been established by previous studies, as described hereinabove with reference to VGAM46. GEMIN5 (Accession XM_114471) is another VGAM864 host target gene. GEMIN5 BINDING SITE is HOST TARGET binding site found in the 5' untranslated region of mRNA encoded by GEMIN5, corresponding to a HOST TARGET binding site such as BINDING SITE I, BINDING SITE II or BINDING SITE III. Table 2 illustrates the complementarity of the nucleotide sequences of GEMIN5 BINDING SITE, designated SEQ ID:42974, to the nucleotide sequence of VGAM864 RNA, herein designated VGAM RNA, also designated SEQ ID:3575.

Another function of VGAM864 is therefore inhibition of GEMIN5 (Accession XM_114471). Accordingly, utilities of VGAM864 include diagnosis, prevention and treatment of diseases and clinical conditions associated with GEMIN5. DKFZp434D177 (Accession NM_032264) is another VGAM864 host target gene. DKFZp434D177 BINDING SITE is HOST TARGET binding site found in the 3' untranslated region of mRNA encoded by DKFZp434D177, corresponding to a HOST TARGET binding site such as BINDING SITE I, BINDING SITE II or BINDING SITE III. Table 2 illustrates the complementarity of the nucleotide sequences of DKFZp434D177 BINDING SITE, designated SEQ ID:26009, to the nucleotide sequence of VGAM864 RNA, herein designated VGAM RNA, also designated SEQ ID:3575.

Another function of VGAM864 is therefore inhibition of DKFZp434D177 (Accession NM_032264). Accordingly, utilities of VGAM864 include diagnosis, prevention and treatment of diseases and clinical conditions associated with DKFZp434D177. LOC123745 (Accession XM_063826) is another VGAM864 host target gene. LOC123745 BINDING SITE is HOST TARGET binding site found in the 5' untranslated region of mRNA encoded by LOC123745, corresponding to a HOST TARGET binding site such as BINDING SITE I, BINDING SITE II or BINDING SITE III. Table 2 illustrates the complementarity of the nucleotide sequences of LOC123745 BINDING SITE, designated SEQ ID:37255, to the nucleotide sequence of VGAM864 RNA, herein designated VGAM RNA, also designated SEQ ID:3575.

Another function of VGAM864 is therefore inhibition of LOC123745 (Accession XM_063826). Accordingly, utilities of VGAM864 include diagnosis, prevention and treatment of diseases and clinical conditions associated with LOC123745. LOC149010 (Accession XM_086397) is another VGAM864 host target gene. LOC149010 BINDING SITE is HOST TARGET binding site found in the 3' untranslated region of mRNA encoded by LOC149010, corresponding to a HOST TARGET binding site such as BINDING SITE I, BINDING SITE II or BINDING SITE III. Table 2 illustrates the complementarity of the nucleotide sequences of LOC149010 BINDING SITE, designated SEQ ID:38629, to the nucleotide sequence of VGAM864 RNA, herein designated VGAM RNA, also designated SEQ ID:3575.

Another function of VGAM864 is therefore inhibition of LOC149010 (Accession XM_086397). Accordingly, utilities of VGAM864 include diagnosis, prevention and treatment of diseases and clinical conditions associated with LOC149010. LOC162333 (Accession XM_102591) is another VGAM864 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42143, to the nucleotide sequence of VGAM864 RNA, herein designated VGAM RNA, also designated SEQ ID:3575.

Another function of VGAM864 is therefore inhibition of LOC162333 (Accession XM_102591). Accordingly, utilities of VGAM864 include diagnosis, prevention and treatment of diseases and clinical conditions associated with LOC162333. FIG. 1 further provides a conceptual description of a novel bioinformatically detected viral gene of the present invention, referred to here as Viral Genomic Address Messenger 865 (VGAM865) viral gene, which modulates expression of respective host target genes thereof, the function and utility of which host target genes is known in the art.

VGAM865 is a novel bioinformatically detected regulatory, non protein coding, viral micro RNA (miRNA) gene. The method by which VGAM865 was detected is described hereinabove with reference to FIGS. 1-8.

VGAM865 gene, herein designated VGAM GENE, is a viral gene contained in the genome of Swinepox Virus. VGAM865 host target gene, herein designated VGAM HOST TARGET GENE, is a human gene contained in the human genome.

VGAM865 gene encodes a VGAM865 precursor RNA, herein designated VGAM PRECURSOR RNA. Similar to other miRNA genes, and unlike most ordinary genes, VGAM865 precursor RNA does not encode a protein. A nucleotide sequence identical or highly similar to the nucleotide sequence of VGAM865 precursor RNA is designated SEQ ID:851, and is provided hereinbelow with reference to the sequence listing part. Nucleotide sequence SEQ ID:851 is located at position 38140 relative to the genome of Swinepox Virus.

VGAM865 precursor RNA folds onto itself, forming VGAM865 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM865 folded precursor RNA into VGAM865 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 46%) nucleotide sequence of VGAM865 RNA is designated SEQ ID:3576, and is provided hereinbelow with reference to the sequence listing part.

VGAM865 host target gene, herein designated VGAM HOST TARGET GENE, encodes a corresponding messenger RNA, VGAM865 host target RNA, herein designated VGAM HOST TARGET RNA. VGAM865 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM865 RNA, herein designated VGAM RNA, binds complementarily to one or more host target binding sites located in untranslated regions of VGAM865 host target RNA, herein designated VGAM HOST TARGET RNA. This complementary binding is due to the fact that the nucleotide sequence of VGAM865 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM865 RNA, herein designated VGAM RNA, may have a different number of host target binding sites in untranslated regions of a VGAM865 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM865 RNA, herein designated VGAM RNA, to host target binding sites on VGAM865 host target RNA, herein designated VGAM HOST TARGET RNA, such as BINDING SITE I, BINDING SITE II and BINDING SITE III, inhibits translation of VGAM865 host target RNA into VGAM865 host target protein, herein designated VGAM HOST TARGET PROTEIN. VGAM host target protein is therefore outlined by a broken line.

It is appreciated that VGAM865 host target gene, herein designated VGAM HOST TARGET GENE, in fact represents a plurality of VGAM865 host target genes. The mRNA of each one of this plurality of VGAM865 host target genes comprises one or more host target binding sites, each having a nucleotide sequence which is at least partly complementary to VGAM865 RNA, herein designated VGAM RNA, and which when bound by VGAM865 RNA causes inhibition of translation of respective one or more VGAM865 host target proteins.

It is further appreciated by one skilled in the art that the mode of translational inhibition illustrated by FIG. 1 with specific reference to translational inhibition exerted by VGAM865 gene, herein designated VGAM GENE, on one or more VGAM865 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM865 is inhibition of expression of host target genes, as part of a novel viral mechanism of attacking a host. Accordingly, utilities of VGAM865 include diagnosis, prevention and treatment of viral infection by Swinepox Virus. Specific functions, and accordingly utilities, of VGAM865 correlate with, and may be deduced from, the identity of the host target genes which VGAM865 binds and inhibits, and the function of these host target genes, as elaborated hereinbelow.

Nucleotide sequences of the VGAM865 precursor RNA, herein designated VGAM PRECURSOR RNA, and of the 'diced' VGAM865 RNA, herein designated VGAM RNA, and a schematic representation of the secondary folding of VGAM865 folded precursor RNA, herein designated VGAM FOLDED PRECURSOR RNA, of VGAM865 are further described hereinbelow with reference to Table 1.

Nucleotide sequences of host target binding sites, such as BINDING SITE-I, BINDING SITE-II and BINDING SITE-III of FIG. 1, found on VGAM865 host target RNA, and schematic representation of the complementarity of each of these host target binding sites to VGAM865 RNA, herein designated VGAM RNA, are described hereinbelow with reference to Table 2.

As mentioned hereinabove with reference to FIG. 1, a function of VGAM865 gene, herein designated VGAM is inhibition of expression of VGAM865 target genes. It is appreciated that specific functions, and accordingly utilities, of VGAM865 correlate with, and may be deduced from, the identity of the target genes which VGAM865 binds and inhibits, and the function of these target genes, as elaborated hereinbelow.

LNK (Accession NM_005475) is a VGAM865 host target gene. LNK BINDING SITE is HOST TARGET binding site found in the 3' untranslated region of mRNA encoded by LNK, corresponding to a HOST TARGET binding site such as BINDING SITE I, BINDING SITE II or BINDING SITE III. Table 2 illustrates the complementarity of the nucleotide sequences of LNK BINDING SITE, designated SEQ ID:11968, to the nucleotide sequence of VGAM865 RNA, herein designated VGAM RNA, also designated SEQ ID:3576.

A function of VGAM865 is therefore inhibition of LNK (Accession NM_005475), a gene which links T-cell receptor activation signal to phospholipase c-gamma-1, grb-2 and phosphatidylinositol 3-kinase (by similarity). Accordingly, utilities of VGAM865 include diagnosis, prevention and treatment of diseases and clinical conditions associated with LNK. The function of LNK and its association with various diseases and clinical conditions, has been established by previous studies, as described hereinabove with reference to VGAM115. Reticulocalbin 1, EF-hand Calcium Binding Domain (RCN1, Accession NM_002901) is another VGAM865 host target gene. RCN1 BINDING SITE is HOST TARGET binding site found in the 3' untranslated region of mRNA encoded by RCN1, corresponding to a HOST TARGET binding site such as BINDING SITE I, BINDING SITE II or BINDING SITE III. Table 2 illustrates the complementarity of the nucleotide sequences of RCN1 BINDING SITE, designated SEQ ID:8803, to the nucleotide sequence of VGAM865 RNA, herein designated VGAM RNA, also designated SEQ ID:3576.

Another function of VGAM865 is therefore inhibition of Reticulocalbin 1, EF-hand Calcium Binding Domain (RCN1, Accession NM_002901), a gene which may regulate calcium-dependent activities in the ER lumen or post-ER compartment. Accordingly, utilities of VGAM865 include diagnosis, prevention and treatment of diseases and clinical conditions associated with RCN1. The function of RCN1 has been established by previous studies. The endoplasmic reticulum (ER) is the major storage compartment for calcium in most eukaryotic cells. Ozawa and Muramatsu (1993) identified cDNAs encoding mouse reticulocalbin (Rcn), a calcium-binding protein located in the lumen of the ER. By PCR using oligonucleotides based on the nucleotide sequence of mouse Rcn, Ozawa (1995) isolated cDNAs encoding RCN1 from human transitional carcinoma cell line cDNAs. The predicted 331-amino acid human RCN1 protein is 95% identical to the mouse Rcn protein. RCN1 contains a leader peptide, 6 EF-hand calcium-binding motifs, and a C-terminal HDEL sequence, which serves as an ER retention signal. By Western blot analysis of human mammalian cell extracts, antibodies against Rcn recognized 44- and 46-kD proteins. Northern blot analysis revealed that RCN1 was expressed as a 2.4-kb transcript in all tissues tested. Kent et al. (1997) identified the human RCN1 gene within a cosmid contig of 11p13 and localized it between the WT1 (OMIM Ref. No. 607102) and PAX6 (OMIM Ref. No. 607108) genes. By interspecific backcross analysis, Kent et al. (1997) mapped the mouse Rcn gene to chromosome 2, in a region showing homology of synteny with human 11p14-p13.

Full details of the abovementioned studies are described in the following publications, the disclosure of which are hereby incorporated by reference:

Ozawa, M.: Cloning of a human homologue of mouse reticulocalbin reveals conservation of structural domains in the novel endoplasmic reticulum resident Ca2+-binding protein with multiple EF-hand motifs. J. Biochem. 117:1113-1119, 1995; and Kent, J.; Lee, M.; Schedl, A.; Boyle, S.; Fantes, J.; Powell, M.; Rushmere, N.; Abbott, C.; van Heyningen, V.; Bickmore, W. A.: The reticulocalbin gene maps to the WAGR region in human.

Further studies establishing the function and utilities of RCN1 are found in John Hopkins OMIM database record ID 602735, and in sited publications numbered 8765-8767 listed in the bibliography section hereinbelow, which are also hereby incorporated by reference. FLJ22795 (Accession NM_025084) is another VGAM865 host target gene. FLJ22795 BINDING SITE is HOST TARGET binding site found in the 3' untranslated region of mRNA encoded by FLJ22795, corresponding to a HOST TARGET binding site such as BINDING SITE I, BINDING SITE II or BINDING SITE III. Table 2 illustrates the complementarity of the nucleotide sequences of FLJ22795 BINDING SITE, designated SEQ ID:24688, to the nucleotide sequence of VGAM865 RNA, herein designated VGAM RNA, also designated SEQ ID:3576.

Another function of VGAM865 is therefore inhibition of FLJ22795 (Accession NM_025084). Accordingly, utilities of VGAM865 include diagnosis, prevention and treatment of diseases and clinical conditions associated with FLJ22795. TNF Receptor-associated Factor 6 (TRAF6, Accession NM_004620) is another VGAM865 host target gene. TRAF6 BINDING SITE is HOST TARGET binding site found in the 5' untranslated region of mRNA encoded by TRAF6, corresponding to a HOST TARGET binding site such as BINDING SITE I, BINDING SITE II or BINDING SITE III. Table 2 illustrates the complementarity of the nucleotide sequences of TRAF6 BINDING SITE, designated SEQ ID:10969, to the nucleotide sequence of VGAM865 RNA, herein designated VGAM RNA, also designated SEQ ID:3576.

Another function of VGAM865 is therefore inhibition of TNF Receptor-associated Factor 6 (TRAF6, Accession NM_004620). Accordingly, utilities of VGAM865 include diagnosis, prevention and treatment of diseases and clinical conditions associated with TRAF6. LOC121599 (Accession XM_058576) is another VGAM865 host target gene. LOC121599 BINDING SITE is HOST TARGET binding site found in the 5' untranslated region of mRNA encoded by LOC121599, corresponding to a HOST TARGET binding site such as BINDING SITE I, BINDING SITE II or BINDING SITE III. Table 2 illustrates the complementarity of the nucleotide sequences of LOC121599 BINDING SITE, designated SEQ ID:36672, to the nucleotide sequence of VGAM865 RNA, herein designated VGAM RNA, also designated SEQ ID:3576.

Another function of VGAM865 is therefore inhibition of LOC121599 (Accession XM_058576). Accordingly, utilities of VGAM865 include diagnosis, prevention and treatment of diseases and clinical conditions associated with LOC121599. LOC145717 (Accession XM_039771) is another VGAM865 host target gene. LOC145717 BINDING SITE is HOST TARGET binding site found in the 3' untranslated region of mRNA encoded by LOC145717, corresponding to a HOST TARGET binding site such as BINDING SITE I, BINDING SITE II or BINDING SITE III. Table 2 illustrates the complementarity of the nucleotide sequences of LOC145717 BINDING SITE, designated SEQ ID:33189, to the nucleotide sequence of VGAM865 RNA, herein designated VGAM RNA, also designated SEQ ID:3576.

Another function of VGAM865 is therefore inhibition of LOC145717 (Accession XM_039771). Accordingly, utilities of VGAM865 include diagnosis, prevention and treatment of diseases and clinical conditions associated with LOC145717. LOC220537 (Accession XM_165406) is another VGAM865 host target gene. LOC220537 BINDING SITE is HOST TARGET binding site found in the 3' untranslated region of mRNA encoded by LOC220537, corresponding to a HOST TARGET binding site such as BINDING SITE I, BINDING SITE II or BINDING SITE III. Table 2 illustrates the complementarity of the nucleotide sequences of LOC220537 BINDING SITE, designated SEQ ID:43621, to the nucleotide sequence of VGAM865 RNA, herein designated VGAM RNA, also designated SEQ ID:3576.

Another function of VGAM865 is therefore inhibition of LOC220537 (Accession XM_165406). Accordingly, utilities of VGAM865 include diagnosis, prevention and treatment of diseases and clinical conditions associated with LOC220537. LOC51580 (Accession NM_015874) is another VGAM865 host target gene. LOC51580 BINDING SITE is HOST TARGET binding site found in the 3' untranslated region of mRNA encoded by LOC51580, corresponding to a HOST TARGET binding site such as BINDING SITE I, BINDING SITE II or BINDING SITE III. Table 2 illustrates the complementarity of the nucleotide sequences of LOC51580 BINDING SITE, designated SEQ ID:18010, to the nucleotide sequence of VGAM865 RNA, herein designated VGAM RNA, also designated SEQ ID:3576.

Another function of VGAM865 is therefore inhibition of LOC51580 (Accession NM_015874). Accordingly, utilities of VGAM865 include diagnosis, prevention and treatment of diseases and clinical conditions associated with LOC51580.

LOC54103 (Accession XM_168508) is another VGAM865 host target gene. LOC54103 BINDING SITE is HOST TARGET binding site found in the 3' untranslated region of mRNA encoded by LOC54103, corresponding to a HOST TARGET binding site such as BINDING SITE I, BINDING SITE II or BINDING SITE III. Table 2 illustrates the complementarity of the nucleotide sequences of LOC54103 BINDING SITE, designated SEQ ID:45209, to the nucleotide sequence of VGAM865 RNA, herein designated VGAM RNA, also designated SEQ ID:3576.

Another function of VGAM865 is therefore inhibition of LOC54103 (Accession XM_168508). Accordingly, utilities of VGAM865 include diagnosis, prevention and treatment of diseases and clinical conditions associated with LOC54103. FIG. 1 further provides a conceptual description of a novel bioinformatically detected viral gene of the present invention, referred to here as Viral Genomic Address Messenger 866 (VGAM866) viral gene, which modulates expression of respective host target genes thereof, the function and utility of which host target genes is known in the art.

VGAM866 is a novel bioinformatically detected regulatory, non protein coding, viral micro RNA (miRNA) gene. The method by which VGAM866 was detected is described hereinabove with reference to FIGS. 1-8.

VGAM866 gene, herein designated VGAM GENE, is a viral gene contained in the genome of Swinepox Virus. VGAM866 host target gene, herein designated VGAM HOST TARGET GENE, is a human gene contained in the human genome.

VGAM866 gene encodes a VGAM866 precursor RNA, herein designated VGAM PRECURSOR RNA. Similar to other miRNA genes, and unlike most ordinary genes, VGAM866 precursor RNA does not encode a protein. A nucleotide sequence identical or highly similar to the nucleotide sequence of VGAM866 precursor RNA is designated SEQ ID:852, and is provided hereinbelow with reference to the sequence listing part. Nucleotide sequence SEQ ID:852 is located at position 37456 relative to the genome of Swinepox Virus.

VGAM866 precursor RNA folds onto itself, forming VGAM866 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM866 folded precursor RNA into VGAM866 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM866 RNA is designated SEQ ID:3577, and is provided hereinbelow with reference to the sequence listing part.

VGAM866 host target gene, herein designated VGAM HOST TARGET GENE, encodes a corresponding messenger RNA, VGAM866 host target RNA, herein designated VGAM HOST TARGET RNA. VGAM866 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM866 RNA, herein designated VGAM RNA, binds complementarily to one or more host target binding sites located in untranslated regions of VGAM866 host target RNA, herein designated VGAM HOST TARGET RNA. This complementary binding is due to the fact that the nucleotide sequence of VGAM866 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM866 RNA, herein designated VGAM RNA, may have a different number of host target binding sites in untranslated regions of a VGAM866 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM866 RNA, herein designated VGAM RNA, to host target binding sites on VGAM866 host target RNA, herein designated VGAM HOST TARGET RNA, such as BINDING SITE I, BINDING SITE II and BINDING SITE III, inhibits translation of VGAM866 host target RNA into VGAM866 host target protein, herein designated VGAM HOST TARGET PROTEIN. VGAM host target protein is therefore outlined by a broken line.

It is appreciated that VGAM866 host target gene, herein designated VGAM HOST TARGET GENE, in fact represents a plurality of VGAM866 host target genes. The mRNA of each one of this plurality of VGAM866 host target genes comprises one or more host target binding sites, each having a nucleotide sequence which is at least partly complementary to VGAM866 RNA, herein designated VGAM RNA, and which when bound by VGAM866 RNA causes inhibition of translation of respective one or more VGAM866 host target proteins.

It is further appreciated by one skilled in the art that the mode of translational inhibition illustrated by FIG. 1 with specific reference to translational inhibition exerted by VGAM866 gene, herein designated VGAM GENE, on one or more VGAM866 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM866 is inhibition of expression of host target genes, as part of a novel viral mechanism of attacking a host. Accordingly, utilities of VGAM866 include diagnosis, prevention and treatment of viral infection by Swinepox Virus. Specific functions, and accordingly utilities, of VGAM866 correlate with, and may be deduced from, the identity of the host target genes which VGAM866 binds and inhibits, and the function of these host target genes, as elaborated hereinbelow.

Nucleotide sequences of the VGAM866 precursor RNA, herein designated VGAM PRECURSOR RNA, and of the 'diced' VGAM866 RNA, herein designated VGAM RNA, and a schematic representation of the secondary folding of VGAM866 folded precursor RNA, herein designated VGAM FOLDED PRECURSOR RNA, of VGAM866 are further described hereinbelow with reference to Table 1.

Nucleotide sequences of host target binding sites, such as BINDING SITE-I, BINDING SITE-II and BINDING SITE-III of FIG. 1, found on VGAM866 host target RNA, and schematic representation of the complementarity of each of these host target binding sites to VGAM866 RNA, herein designated VGAM RNA, are described hereinbelow with reference to Table 2.

As mentioned hereinabove with reference to FIG. 1, a function of VGAM866 gene, herein designated VGAM is inhibition of expression of VGAM866 target genes. It is appreciated that specific functions, and accordingly utilities, of VGAM866 correlate with, and may be deduced from, the identity of the target genes which VGAM866 binds and inhibits, and the function of these target genes, as elaborated hereinbelow.

Kinesin Family Member 5C (KIF5C, Accession NM_004522) is a VGAM866 host target gene. KIF5C BINDING SITE is HOST TARGET binding site found in the 3' untranslated region of mRNA encoded by KIF5C, corresponding to a HOST TARGET binding site such as BINDING SITE I, BINDING SITE II or BINDING SITE III. Table 2 illustrates the complementarity of the nucleotide sequences of KIF5C BINDING SITE, designated SEQ ID:10856, to the nucleotide sequence of VGAM866 RNA, herein designated VGAM RNA, also designated SEQ ID:3577.

A function of VGAM866 is therefore inhibition of Kinesin Family Member 5C (KIF5C, Accession NM_004522). Accordingly, utilities of VGAM866 include diagnosis, prevention and treatment of diseases and clinical conditions associated with KIF5C. FIG. 1 further provides a conceptual description of a novel bioinformatically detected viral gene of the present invention, referred to here as Viral Genomic Address Messenger 867 (VGAM867) viral gene, which modulates expression of respective host target genes thereof, the function and utility of which host target genes is known in the art.

VGAM867 is a novel bioinformatically detected regulatory, non protein coding, viral micro RNA (miRNA) gene. The method by which VGAM867 was detected is described hereinabove with reference to FIGS. 1-8.

VGAM867 gene, herein designated VGAM GENE, is a viral gene contained in the genome of Turkey Adenovirus 3. VGAM867 host target gene, herein designated VGAM HOST TARGET GENE, is a human gene contained in the human genome.

VGAM867 gene encodes a VGAM867 precursor RNA, herein designated VGAM PRECURSOR RNA. Similar to other miRNA genes, and unlike most ordinary genes, VGAM867 precursor RNA does not encode a protein. A nucleotide sequence identical or highly similar to the nucleotide sequence of VGAM867 precursor RNA is designated SEQ ID:853, and is provided hereinbelow with reference to the sequence listing part. Nucleotide sequence SEQ ID:853 is located at position 5962 relative to the genome of Turkey Adenovirus 3.

VGAM867 precursor RNA folds onto itself, forming VGAM867 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM867 folded precursor RNA into VGAM867 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM867 RNA is designated SEQ ID:3578, and is provided hereinbelow with reference to the sequence listing part.

VGAM867 host target gene, herein designated VGAM HOST TARGET GENE, encodes a corresponding messenger RNA, VGAM867 host target RNA, herein designated VGAM HOST TARGET RNA. VGAM867 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM867 RNA, herein designated VGAM RNA, binds complementarily to one or more host target binding sites located in untranslated regions of VGAM867 host target RNA, herein designated VGAM HOST TARGET RNA. This complementary binding is due to the fact that the nucleotide sequence of VGAM867 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM867 RNA, herein designated VGAM RNA, may have a different number of host target binding sites in untranslated regions of a VGAM867 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM867 RNA, herein designated VGAM RNA, to host target binding sites on VGAM867 host target RNA, herein designated VGAM HOST TARGET RNA, such as BINDING SITE I, BINDING SITE II and BINDING SITE III, inhibits translation of VGAM867 host target RNA into VGAM867 host target protein, herein designated VGAM HOST TARGET PROTEIN. VGAM host target protein is therefore outlined by a broken line.

It is appreciated that VGAM867 host target gene, herein designated VGAM HOST TARGET GENE, in fact represents a plurality of VGAM867 host target genes. The mRNA of each one of this plurality of VGAM867 host target genes comprises one or more host target binding sites, each having a nucleotide sequence which is at least partly complementary to VGAM867 RNA, herein designated VGAM RNA, and which when bound by VGAM867 RNA causes inhibition of translation of respective one or more VGAM867 host target proteins.

It is further appreciated by one skilled in the art that the mode of translational inhibition illustrated by FIG. 1 with specific reference to translational inhibition exerted by VGAM867 gene, herein designated VGAM GENE, on one or more VGAM867 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM867 is inhibition of expression of host target genes, as part of a novel viral mechanism of attacking a host. Accordingly, utilities of VGAM867 include diagnosis, prevention and treatment of viral infection by Turkey Adenovirus 3. Specific functions, and accordingly utilities, of VGAM867 correlate with, and may be deduced from, the identity of the host target genes which VGAM867 binds and inhibits, and the function of these host target genes, as elaborated hereinbelow.

Nucleotide sequences of the VGAM867 precursor RNA, herein designated VGAM PRECURSOR RNA, and of the 'diced' VGAM867 RNA, herein designated VGAM RNA, and a schematic representation of the secondary folding of VGAM867 folded precursor RNA, herein designated VGAM FOLDED PRECURSOR RNA, of VGAM867 are further described hereinbelow with reference to Table 1.

Nucleotide sequences of host target binding sites, such as BINDING SITE-I, BINDING SITE-II and BINDING SITE-III of FIG. 1, found on VGAM867 host target RNA, and schematic representation of the complementarity of each of these host target binding sites to VGAM867 RNA, herein designated VGAM RNA, are described hereinbelow with reference to Table 2.

As mentioned hereinabove with reference to FIG. 1, a function of VGAM867 gene, herein designated VGAM is inhibition of expression of VGAM867 target genes. It is appreciated that specific functions, and accordingly utilities, of VGAM867 correlate with, and may be deduced from, the identity of the target genes which VGAM867 binds and inhibits, and the function of these target genes, as elaborated hereinbelow.

CAP350 (Accession NM_014810) is a VGAM867 host target gene. CAP350 BINDING SITE is HOST TARGET binding site found in the 3' untranslated region of mRNA encoded by CAP350, corresponding to a HOST TARGET binding site such as BINDING SITE I, BINDING SITE II or BINDING SITE III. Table 2 illustrates the complementarity of the nucleotide sequences of CAP350 BINDING SITE, designated SEQ ID:16768, to the nucleotide sequence of VGAM867 RNA, herein designated VGAM RNA, also designated SEQ ID:3578.

A function of VGAM867 is therefore inhibition of CAP350 (Accession NM_014810). Accordingly, utilities of VGAM867 include diagnosis, prevention and treatment of diseases and clinical conditions associated with CAP350. LOC219942 (Accession XM_167790) is another VGAM867 host target gene. LOC219942 BINDING SITE is HOST TARGET binding site found in the 3' untranslated region of mRNA encoded by LOC219942, corresponding to a HOST TARGET binding site such as BINDING SITE I, BINDING SITE II or BINDING SITE III. Table 2 illustrates the complementarity of the nucleotide sequences of LOC219942 BINDING SITE, designated SEQ ID:44827, to the nucleotide sequence of VGAM867 RNA, herein designated VGAM RNA, also designated SEQ ID:3578.

Another function of VGAM867 is therefore inhibition of LOC219942 (Accession XM_167790). Accordingly, utilities of VGAM867 include diagnosis, prevention and treatment of diseases and clinical conditions associated with LOC219942. FIG. 1 further provides a conceptual description of a novel bioinformatically detected viral gene of the present invention, referred to here as Viral Genomic Address Messenger 868 (VGAM868) viral gene, which modulates expression of respective host target genes thereof, the function and utility of which host target genes is known in the art.

VGAM868 is a novel bioinformatically detected regulatory, non protein coding, viral micro RNA (miRNA) gene. The method by which VGAM868 was detected is described hereinabove with reference to FIGS. 1-8.

VGAM868 gene, herein designated VGAM GENE, is a viral gene contained in the genome of Turkey Adenovirus 3. VGAM868 host target gene, herein designated VGAM HOST TARGET GENE, is a human gene contained in the human genome.

VGAM868 gene encodes a VGAM868 precursor RNA, herein designated VGAM PRECURSOR RNA. Similar to other miRNA genes, and unlike most ordinary genes, VGAM868 precursor RNA does not encode a protein. A nucleotide sequence identical or highly similar to the nucleotide sequence of VGAM868 precursor RNA is designated SEQ ID:854, and is provided hereinbelow with reference to the sequence listing part. Nucleotide sequence SEQ ID:854 is located at position 5577 relative to the genome of Turkey Adenovirus 3.

VGAM868 precursor RNA folds onto itself, forming VGAM868 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM868 folded precursor RNA into VGAM868 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM868 RNA is designated SEQ ID:3579, and is provided hereinbelow with reference to the sequence listing part.

VGAM868 host target gene, herein designated VGAM HOST TARGET GENE, encodes a corresponding messenger RNA, VGAM868 host target RNA, herein designated VGAM HOST TARGET RNA. VGAM868 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM868 RNA, herein designated VGAM RNA, binds complementarily to one or more host target binding sites located in untranslated regions of VGAM868 host target RNA, herein designated VGAM HOST TARGET RNA. This complementary binding is due to the fact that the nucleotide sequence of VGAM868 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM868 RNA, herein designated VGAM RNA, may have a different number of host target binding sites in untranslated regions of a VGAM868 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM868 RNA, herein designated VGAM RNA, to host target binding sites on VGAM868 host target RNA, herein designated VGAM HOST TARGET RNA, such as BINDING SITE I, BINDING SITE II and BINDING SITE III, inhibits translation of VGAM868 host target RNA into VGAM868 host target protein, herein designated VGAM HOST TARGET PROTEIN. VGAM host target protein is therefore outlined by a broken line.

It is appreciated that VGAM868 host target gene, herein designated VGAM HOST TARGET GENE, in fact represents a plurality of VGAM868 host target genes. The mRNA of each one of this plurality of VGAM868 host target genes comprises one or more host target binding sites, each having a nucleotide sequence which is at least partly complementary to VGAM868 RNA, herein designated VGAM RNA, and which when bound by VGAM868 RNA causes inhibition of translation of respective one or more VGAM868 host target proteins.

It is further appreciated by one skilled in the art that the mode of translational inhibition illustrated by FIG. 1 with specific reference to translational inhibition exerted by VGAM868 gene, herein designated VGAM GENE, on one or more VGAM868 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM868 is inhibition of expression of host target genes, as part of a novel viral mechanism of attacking a host. Accordingly, utilities of VGAM868 include diagnosis, prevention and treatment of viral infection by Turkey Adenovirus 3. Specific functions, and accordingly utilities, of VGAM868 correlate with, and may be deduced from, the identity of the host target genes which VGAM868 binds and inhibits, and the function of these host target genes, as elaborated hereinbelow.

Nucleotide sequences of the VGAM868 precursor RNA, herein designated VGAM PRECURSOR RNA, and of the 'diced' VGAM868 RNA, herein designated VGAM RNA, and a schematic representation of the secondary folding of VGAM868 folded precursor RNA, herein designated VGAM FOLDED PRECURSOR RNA, of VGAM868 are further described hereinbelow with reference to Table 1.

Nucleotide sequences of host target binding sites, such as BINDING SITE-I, BINDING SITE-II and BINDING SITE-III of FIG. 1, found on VGAM868 host target RNA, and schematic representation of the complementarity of each of these host target binding sites to VGAM868 RNA, herein designated VGAM RNA, are described hereinbelow with reference to Table 2.

As mentioned hereinabove with reference to FIG. 1, a function of VGAM868 gene, herein designated VGAM is inhibition of expression of VGAM868 target genes. It is appreciated that specific functions, and accordingly utilities, of VGAM868 correlate with, and may be deduced from, the identity of the target genes which VGAM868 binds and inhibits, and the function of these target genes, as elaborated hereinbelow.

Matrilin 3 (MATN3, Accession NM_002381) is a VGAM868 host target gene. MATN3 BINDING SITE is HOST TARGET binding site found in the 3' untranslated region of mRNA encoded by MATN3, corresponding to a HOST TARGET binding site such as BINDING SITE I, BINDING SITE II or BINDING SITE III. Table 2 illustrates the complementarity of the nucleotide sequences of MATN3 BINDING SITE, designated SEQ ID:8197, to the nucleotide sequence of VGAM868 RNA, herein designated VGAM RNA, also designated SEQ ID:3579.

A function of VGAM868 is therefore inhibition of Matrilin 3 (MATN3, Accession NM_002381). Accordingly, utilities of VGAM868 include diagnosis, prevention and treatment of diseases and clinical conditions associated with MATN3. AAK1 (Accession NM_014911) is another VGAM868 host target gene. AAK1 BINDING SITE is HOST TARGET binding site found in the 3' untranslated region of mRNA encoded by AAK1, corresponding to a HOST TARGET binding site such as BINDING SITE I, BINDING SITE II or BINDING SITE III. Table 2 illustrates the complementarity of the nucleotide sequences of AAK1 BINDING SITE, designated SEQ ID:17144, to the nucleotide sequence of VGAM868 RNA, herein designated VGAM RNA, also designated SEQ ID:3579.

Another function of VGAM868 is therefore inhibition of AAK1 (Accession NM_014911). Accordingly, utilities of VGAM868 include diagnosis, prevention and treatment of diseases and clinical conditions associated with AAK1. DKFZP434A043 (Accession NM_015396) is another VGAM868 host target gene. DKFZP434A043 BINDING SITE is HOST TARGET binding site found in the 3' untranslated region of mRNA encoded by DKFZP434A043, corresponding to a HOST TARGET binding site such as BINDING SITE I, BINDING SITE II or BINDING SITE III. Table 2 illustrates the complementarity of the nucleotide sequences of DKFZP434A043 BINDING SITE, designated SEQ ID:17703, to the nucleotide sequence of VGAM868 RNA, herein designated VGAM RNA, also designated SEQ ID:3579.

Another function of VGAM868 is therefore inhibition of DKFZP434A043 (Accession NM_015396). Accordingly, utilities of VGAM868 include diagnosis, prevention and treatment of diseases and clinical conditions associated with DKFZP434A043. LOC221074 (Accession XM_167663) is another VGAM868 host target gene. LOC221074 BINDING SITE is HOST TARGET binding site found in the 5' untranslated region of mRNA encoded by LOC221074, corresponding to a HOST TARGET binding site such as BINDING SITE I, BINDING SITE II or BINDING SITE III. Table 2 illustrates the complementarity of the nucleotide sequences of LOC221074 BINDING SITE, designated SEQ ID:44748, to the nucleotide sequence of VGAM868 RNA, herein designated VGAM RNA, also designated SEQ ID:3579.

Another function of VGAM868 is therefore inhibition of LOC221074 (Accession XM_167663). Accordingly, utilities of VGAM868 include diagnosis, prevention and treatment of diseases and clinical conditions associated with LOC221074. FIG. 1 further provides a conceptual description of a novel bioinformatically detected viral gene of the present invention, referred to here as Viral Genomic Address Messenger 869 (VGAM869) viral gene, which modulates expression of respective host target genes thereof, the function and utility of which host target genes is known in the art.

VGAM869 is a novel bioinformatically detected regulatory, non protein coding, viral micro RNA (miRNA) gene. The method by which VGAM869 was detected is described hereinabove with reference to FIGS. 1-8.

VGAM869 gene, herein designated VGAM GENE, is a viral gene contained in the genome of Fowlpox Virus. VGAM869 host target gene, herein designated VGAM HOST TARGET GENE, is a human gene contained in the human genome.

VGAM869 gene encodes a VGAM869 precursor RNA, herein designated VGAM PRECURSOR RNA. Similar to other miRNA genes, and unlike most ordinary genes, VGAM869 precursor RNA does not encode a protein. A nucleotide sequence identical or highly similar to the nucleotide sequence of VGAM869 precursor RNA is designated SEQ ID:855, and is provided hereinbelow with reference to the sequence listing part. Nucleotide sequence SEQ ID:855 is located at position 174898 relative to the genome of Fowlpox Virus.

VGAM869 precursor RNA folds onto itself, forming VGAM869 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM869 folded precursor RNA into VGAM869 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM869 RNA is designated SEQ ID:3580, and is provided hereinbelow with reference to the sequence listing part.

VGAM869 host target gene, herein designated VGAM HOST TARGET GENE, encodes a corresponding messenger RNA, VGAM869 host target RNA, herein designated VGAM HOST TARGET RNA. VGAM869 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM869 RNA, herein designated VGAM RNA, binds complementarily to one or more host target binding sites located in untranslated regions of VGAM869 host target RNA, herein designated VGAM HOST TARGET RNA. This complementary binding is due to the fact that the nucleotide sequence of VGAM869 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM869 RNA, herein designated VGAM RNA, may have a different number of host target binding sites in untranslated regions of a VGAM869 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM869 RNA, herein designated VGAM RNA, to host target binding sites on VGAM869 host target RNA, herein designated VGAM HOST TARGET RNA, such as BINDING SITE I, BINDING SITE II and BINDING SITE III, inhibits translation of VGAM869 host target RNA into VGAM869 host target protein, herein designated VGAM HOST TARGET PROTEIN. VGAM host target protein is therefore outlined by a broken line.

It is appreciated that VGAM869 host target gene, herein designated VGAM HOST TARGET GENE, in fact represents a plurality of VGAM869 host target genes. The mRNA of each one of this plurality of VGAM869 host target genes comprises one or more host target binding sites, each having a nucleotide sequence which is at least partly complementary to VGAM869 RNA, herein designated VGAM RNA, and which when bound by VGAM869 RNA causes inhibition of translation of respective one or more VGAM869 host target proteins.

It is further appreciated by one skilled in the art that the mode of translational inhibition illustrated by FIG. 1 with specific reference to translational inhibition exerted by VGAM869 gene, herein designated VGAM GENE, on one or more VGAM869 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM869 is inhibition of expression of host target genes, as part of a novel viral mechanism of attacking a host. Accordingly, utilities of VGAM869 include diagnosis, prevention and treatment of viral infection by Fowlpox Virus. Specific functions, and accordingly utilities, of VGAM869 correlate with, and may be deduced from, the identity of the host target genes which VGAM869 binds and inhibits, and the function of these host target genes, as elaborated hereinbelow.

Nucleotide sequences of the VGAM869 precursor RNA, herein designated VGAM PRECURSOR RNA, and of the 'diced' VGAM869 RNA, herein designated VGAM RNA, and a schematic representation of the secondary folding of VGAM869 folded precursor RNA, herein designated VGAM FOLDED PRECURSOR RNA, of VGAM869 are further described hereinbelow with reference to Table 1.

Nucleotide sequences of host target binding sites, such as BINDING SITE-I, BINDING SITE-II and BINDING SITE-III of FIG. 1, found on VGAM869 host target RNA, and schematic representation of the complementarity of each of these host target binding sites to VGAM869 RNA, herein designated VGAM RNA, are described hereinbelow with reference to Table 2.

As mentioned hereinabove with reference to FIG. 1, a function of VGAM869 gene, herein designated VGAM is inhibition of expression of VGAM869 target genes. It is appreciated that specific functions, and accordingly utilities, of VGAM869 correlate with, and may be deduced from, the identity of the target genes which VGAM869 binds and inhibits, and the function of these target genes, as elaborated hereinbelow.

MLL Sep.in-like Fusion (MSF, Accession XM_113892) is a VGAM869 host target gene. MSF BINDING SITE is HOST TARGET binding site found in the 3" untranslated region of mRNA encoded by MSF, corresponding to a HOST TARGET binding site such as BINDING SITE I, BINDING SITE II or BINDING SITE III. Table 2 illustrates the complementarity of the nucleotide sequences of MSF BINDING SITE, designated SEQ ID:42518, to the nucleotide sequence of VGAM869 RNA, herein designated VGAM RNA, also designated SEQ ID:3580.

A function of VGAM869 is therefore inhibition of MLL Sep.in-like Fusion (MSF, Accession XM_113892), a gene which plays a role in the cell cycle. Accordingly, utilities of VGAM869 include diagnosis, prevention and treatment of diseases and clinical conditions associated with MSF. The function of MSF and its association with various diseases and clinical conditions, has been established by previous studies, as described hereinabove with reference to VGAM514. Single-minded Homolog 2 (Drosophila) (SIM2, Accession NM_005069) is another VGAM869 host target gene. SIM2 BINDING SITE is HOST TARGET binding site found in the 3' untranslated region of mRNA encoded by SIM2, corresponding to a HOST TARGET binding site such as BINDING SITE I, BINDING SITE II or BINDING SITE III. Table 2 illustrates the complementarity of the nucleotide sequences of SIM2 BINDING SITE, designated SEQ ID:11515, to the nucleotide sequence of VGAM869 RNA, herein designated VGAM RNA, also designated SEQ ID:3580.

Another function of VGAM869 is therefore inhibition of Single-minded Homolog 2 (Drosophila) (SIM2, Accession NM_005069), a gene which may be a master gene of cns development. Accordingly, utilities of VGAM869 include diagnosis, prevention and treatment of diseases and clinical conditions associated with SIM2. The function of SIM2 and its association with various diseases and clinical conditions, has been established by previous studies, as described hereinabove with reference to VGAM369. FIG. 1 further provides a conceptual description of a novel bioinformatically detected viral gene of the present invention, referred to here as Viral Genomic Address Messenger 870 (VGAM870) viral gene, which modulates expression of respective host target genes thereof, the function and utility of which host target genes is known in the art.

VGAM870 is a novel bioinformatically detected regulatory, non protein coding, viral micro RNA (miRNA) gene. The method by which VGAM870 was detected is described hereinabove with reference to FIGS. 1-8.

VGAM870 gene, herein designated VGAM GENE, is a viral gene contained in the genome of Fowlpox Virus. VGAM870 host target gene, herein designated VGAM HOST TARGET GENE, is a human gene contained in the human genome.

VGAM870 gene encodes a VGAM870 precursor RNA, herein designated VGAM PRECURSOR RNA. Similar to other miRNA genes, and unlike most ordinary genes, VGAM870 precursor RNA does not encode a protein. A nucleotide sequence identical or highly similar to the nucleotide sequence of VGAM870 precursor RNA is designated SEQ ID:856, and is provided hereinbelow with reference to the sequence listing part. Nucleotide sequence SEQ ID:856 is located at position 175174 relative to the genome of Fowlpox Virus.

VGAM870 precursor RNA folds onto itself, forming VGAM870 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM870 folded precursor RNA into VGAM870 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM870 RNA is designated SEQ ID:3581, and is provided hereinbelow with reference to the sequence listing part.

VGAM870 host target gene, herein designated VGAM HOST TARGET GENE, encodes a corresponding messenger RNA, VGAM870 host target RNA, herein designated VGAM HOST TARGET RNA. VGAM870 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM870 RNA, herein designated VGAM RNA, binds complementarily to one or more host target binding sites located in untranslated regions of VGAM870 host target RNA, herein designated VGAM HOST TARGET RNA. This complementary binding is due to the fact that the nucleotide sequence of VGAM870 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM870 RNA, herein designated VGAM RNA, may have a different number of host target binding sites in untranslated regions of a VGAM870 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM870 RNA, herein designated VGAM RNA, to host target binding sites on VGAM870 host target RNA, herein designated VGAM HOST TARGET RNA, such as BINDING SITE I, BINDING SITE II and BINDING SITE III, inhibits translation of VGAM870 host target RNA into VGAM870 host target protein, herein designated VGAM HOST TARGET PROTEIN. VGAM host target protein is therefore outlined by a broken line.

It is appreciated that VGAM870 host target gene, herein designated VGAM HOST TARGET GENE, in fact represents a plurality of VGAM870 host target genes. The mRNA of each one of this plurality of VGAM870 host target genes comprises one or more host target binding sites, each having a nucleotide sequence which is at least partly complementary to VGAM870 RNA, herein designated VGAM RNA, and which when bound by VGAM870 RNA causes inhibition of translation of respective one or more VGAM870 host target proteins.

It is further appreciated by one skilled in the art that the mode of translational inhibition illustrated by FIG. 1 with specific reference to translational inhibition exerted by VGAM870 gene, herein designated VGAM GENE, on one or more VGAM870 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM870 is inhibition of expression of host target genes, as part of a novel viral mechanism of attacking a host. Accordingly, utilities of VGAM870 include diagnosis, prevention and treatment of viral infection by Fowlpox Virus. Specific functions, and accordingly utilities, of VGAM870 correlate with, and may be deduced from, the identity of the host target genes which VGAM870 binds and inhibits, and the function of these host target genes, as elaborated hereinbelow.

Nucleotide sequences of the VGAM870 precursor RNA, herein designated VGAM PRECURSOR RNA, and of the 'diced' VGAM870 RNA, herein designated VGAM RNA, and a schematic representation of the secondary folding of VGAM870 folded precursor RNA, herein designated VGAM FOLDED PRECURSOR RNA, of VGAM870 are further described hereinbelow with reference to Table 1.

Nucleotide sequences of host target binding sites, such as BINDING SITE-I, BINDING SITE-II and BINDING SITE-III of FIG. 1, found on VGAM870 host target RNA, and schematic representation of the complementarity of each of these host target binding sites to VGAM870 RNA, herein designated VGAM RNA, are described hereinbelow with reference to Table 2.

As mentioned hereinabove with reference to FIG. 1, a function of VGAM870 gene, herein designated VGAM is inhibition of expression of VGAM870 target genes. It is appreciated that specific functions, and accordingly utilities, of VGAM870 correlate with, and may be deduced from, the identity of the target genes which VGAM870 binds and inhibits, and the function of these target genes, as elaborated hereinbelow.

Contactin Associated Protein-like 2 (CNTNAP2, Accession NM_014141) is a VGAM870 host target gene. CNTNAP2 BINDING SITE is HOST TARGET binding site found in the 3' untranslated region of mRNA encoded by CNTNAP2, corresponding to a HOST TARGET binding site such as BINDING SITE I, BINDING SITE II or BINDING SITE III. Table 2 illustrates the complementarity of the nucleotide sequences of CNTNAP2 BINDING SITE, designated SEQ ID:15421, to the nucleotide sequence of VGAM870 RNA, herein designated VGAM RNA, also designated SEQ ID:3581.

A function of VGAM870 is therefore inhibition of Contactin Associated Protein-like 2 (CNTNAP2, Accession NM_014141). Accordingly, utilities of VGAM870 include diagnosis, prevention and treatment of diseases and clinical conditions associated with CNTNAP2. Fibroblast Growth Factor 5 (FGF5, Accession NM_004464) is another VGAM870 host target gene. FGF5 BINDING SITE1 and FGF5 BINDING SITE2 are HOST TARGET binding sites found in untranslated regions of mRNA encoded by FGF5, corresponding to HOST TARGET binding sites such as BINDING SITE I, BINDING SITE II or BINDING SITE III. Table 2 illustrates the complementarity of the nucleotide sequences of FGF5 BINDING SITE1 and FGF5 BINDING SITE2, designated SEQ ID:10777 and SEQ ID:27004 respectively, to the nucleotide sequence of VGAM870 RNA, herein designated VGAM RNA, also designated SEQ ID:3581.

Another function of VGAM870 is therefore inhibition of Fibroblast Growth Factor 5 (FGF5, Accession NM_004464), a gene which induces transformation and may regulate neuronal differentiation. Accordingly, utilities of VGAM870 include diagnosis, prevention and treatment of diseases and clinical conditions associated with FGF5. The function of FGF5 and its association with various diseases and clinical conditions, has been established by previous studies, as described hereinabove with reference to VGAM276. V-myb Myeloblastosis Viral Oncogene Homolog (avian)-like 1 (MYBL1, Accession XM_034274) is another VGAM870 host target gene. MYBL1 BINDING SITE is HOST TARGET binding site found in the 3' untranslated region of mRNA encoded by MYBL1, corresponding to a HOST TARGET binding site such as BINDING SITE I, BINDING SITE II or BINDING SITE III. Table 2 illustrates the complementarity of the nucleotide sequences of MYBL1 BINDING SITE, designated SEQ ID:32042, to the nucleotide sequence of VGAM870 RNA, herein designated VGAM RNA, also designated SEQ ID:3581.

Another function of VGAM870 is therefore inhibition of V-myb Myeloblastosis Viral Oncogene Homolog (avian)-like 1 (MYBL1, Accession XM_034274), a gene which could have a role in the proliferation and/or differentiation of neurogenic, spermatogenic and b-lymphoid cells. Accordingly, utilities of VGAM870 include diagnosis, prevention and treatment of diseases and clinical conditions associated with MYBL1. The function of MYBL1 and its association with various diseases and clinical conditions, has been established by previous studies, as described hereinabove with reference to VGAM184. Crn, Crooked Neck-like 1 (Drosophila) (CRNKL1, Accession NM_016652) is another VGAM870 host target gene. CRNKL1 BINDING SITE is HOST TARGET binding site found in the 3' untranslated region of mRNA encoded by CRNKL1, corresponding to a HOST TARGET binding site such as BINDING SITE I, BINDING SITE II or BINDING SITE III. Table 2 illustrates the complementarity of the nucleotide sequences of CRNKL1 BINDING SITE, designated SEQ ID:18772, to the nucleotide sequence of VGAM870 RNA, herein designated VGAM RNA, also designated SEQ ID:3581.

Another function of VGAM870 is therefore inhibition of Crn, Crooked Neck-like 1 (Drosophila) (CRNKL1, Accession NM_016652). Accordingly, utilities of VGAM870 include diagnosis, prevention and treatment of diseases and clinical conditions associated with CRNKL1. FLJ11142 (Accession NM_018338) is another VGAM870 host target gene. FLJ11142 BINDING SITE is HOST TARGET binding site found in the 3' untranslated region of mRNA encoded by FLJ11142, corresponding to a HOST TARGET binding site such as BINDING SITE I, BINDING SITE II or BINDING SITE III. Table 2 illustrates the complementarity of the nucleotide sequences of FLJ11142 BINDING SITE, designated SEQ ID:20344, to the nucleotide sequence of VGAM870 RNA, herein designated VGAM RNA, also designated SEQ ID:3581.

Another function of VGAM870 is therefore inhibition of FLJ11142 (Accession NM_018338). Accordingly, utilities of VGAM870 include diagnosis, prevention and treatment of diseases and clinical conditions associated with FLJ11142. FLJ12770 (Accession NM_032174) is another VGAM870 host target gene. FLJ12770 BINDING SITE is HOST TARGET binding site found in the 3' untranslated region of mRNA encoded by FLJ12770, corresponding to a HOST TARGET binding site such as BINDING SITE I, BINDING SITE II or BINDING SITE III. Table 2 illustrates the complementarity of the nucleotide sequences of FLJ12770 BINDING SITE, designated SEQ ID:25883, to the nucleotide sequence of VGAM870 RNA, herein designated VGAM RNA, also designated SEQ ID:3581.

Another function of VGAM870 is therefore inhibition of FLJ12770 (Accession NM_032174). Accordingly, utilities of VGAM870 include diagnosis, prevention and treatment of diseases and clinical conditions associated with FLJ12770. KIAA0275 (Accession NM_014767) is another VGAM870 host target gene. KIAA0275 BINDING SITE is HOST TARGET binding site found in the 3' untranslated region of mRNA encoded by KIAA0275, corresponding to a HOST TARGET binding site such as BINDING SITE I, BINDING SITE II or BINDING SITE III. Table 2 illustrates the complementarity of the nucleotide sequences of KIAA0275 BINDING SITE, designated SEQ ID:16552, to the nucleotide sequence of VGAM870 RNA, herein designated VGAM RNA, also designated SEQ ID:3581.

Another function of VGAM870 is therefore inhibition of KIAA0275 (Accession NM_014767). Accordingly, utilities of VGAM870 include diagnosis, prevention and treatment of diseases and clinical conditions associated with KIAA0275. NIR3 (Accession XM_038799) is another VGAM870 host target gene. NIR3 BINDING SITE is HOST TARGET binding site found in the 3' untranslated region of mRNA encoded by NIR3, corresponding to a HOST TARGET binding site such as BINDING SITE I, BINDING SITE II or BINDING SITE III. Table 2 illustrates the complementarity of the nucleotide sequences of NIR3 BINDING SITE, designated SEQ ID:32924, to the nucleotide sequence of VGAM870 RNA, herein designated VGAM RNA, also designated SEQ ID:3581.

Another function of VGAM870 is therefore inhibition of NIR3 (Accession XM_038799). Accordingly, utilities of VGAM870 include diagnosis, prevention and treatment of diseases and clinical conditions associated with NIR3. PRMT6 (Accession NM_018137) is another VGAM870 host target gene. PRMT6 BINDING SITE is HOST TARGET binding site found in the 3' untranslated region of mRNA encoded by PRMT6, corresponding to a HOST TARGET binding site such as BINDING SITE I, BINDING SITE II or BINDING SITE III. Table 2 illustrates the complementarity of the nucleotide sequences of PRMT6 BINDING SITE, designated SEQ ID:19933, to the nucleotide sequence of VGAM870 RNA, herein designated VGAM RNA, also designated SEQ ID:3581.

Another function of VGAM870 is therefore inhibition of PRMT6 (Accession NM_018137). Accordingly, utilities of VGAM870 include diagnosis, prevention and treatment of diseases and clinical conditions associated with PRMT6. Syntaxin 6 (STX6, Accession NM_005819) is another VGAM870 host target gene. STX6 BINDING SITE is HOST TARGET binding site found in the 3' untranslated region of mRNA encoded by STX6, corresponding to a HOST TARGET binding site such as BINDING SITE I, BINDING SITE II or BINDING SITE III. Table 2 illustrates the complementarity of the nucleotide sequences of STX6 BINDING SITE, designated SEQ ID:12420, to the nucleotide sequence of VGAM870 RNA, herein designated VGAM RNA, also designated SEQ ID:3581.

Another function of VGAM870 is therefore inhibition of Syntaxin 6 (STX6, Accession NM_005819). Accordingly, utilities of VGAM870 include diagnosis, prevention and treatment of diseases and clinical conditions associated with STX6. LOC146059 (Accession XM_085300) is another VGAM870 host target gene. LOC146059 BINDING SITE is HOST TARGET binding site found in the 3' untranslated region of mRNA encoded by LOC146059, corresponding to a HOST TARGET binding site such as BINDING SITE I, BINDING SITE II or BINDING SITE III. Table 2 illustrates the complementarity of the nucleotide sequences of LOC146059 BINDING SITE, designated SEQ ID:38052, to the nucleotide sequence of VGAM870 RNA, herein designated VGAM RNA, also designated SEQ ID:3581.

Another function of VGAM870 is therefore inhibition of LOC146059 (Accession XM_085300). Accordingly, utilities of VGAM870 include diagnosis, prevention and treatment of diseases and clinical conditions associated with LOC146059. LOC51107 (Accession NM_016022) is another VGAM870 host target gene. LOC51107 BINDING SITE is HOST TARGET binding site found in the 3' untranslated region of mRNA encoded by LOC51107, corresponding to a HOST TARGET binding site such as BINDING SITE I, BINDING SITE II or BINDING SITE III. Table 2 illustrates the complementarity of the nucleotide sequences of LOC51107 BINDING SITE, designated SEQ ID:18097, to the nucleotide sequence of VGAM870 RNA, herein designated VGAM RNA, also designated SEQ ID:3581.

Another function of VGAM870 is therefore inhibition of LOC51107 (Accession NM_016022). Accordingly, utilities of VGAM870 include diagnosis, prevention and treatment of diseases and clinical conditions associated with LOC51107. LOC91408 (Accession XM_038290) is another VGAM870 host target gene. LOC91408 BINDING SITE is HOST TARGET binding site found in the 3' untranslated region of mRNA encoded by LOC91408, corresponding to a HOST TARGET binding site such as BINDING SITE I, BINDING SITE II or BINDING SITE III. Table 2 illustrates the complementarity of the nucleotide sequences of LOC91408 BINDING SITE, designated SEQ ID:32789, to the nucleotide sequence of VGAM870 RNA, herein designated VGAM RNA, also designated SEQ ID:3581.

Another function of VGAM870 is therefore inhibition of LOC91408 (Accession XM_038290). Accordingly, utilities of VGAM870 include diagnosis, prevention and treatment of diseases and clinical conditions associated with LOC91408. FIG. 1 further provides a conceptual description of a novel bioinformatically detected viral gene of the present invention, referred to here as Viral Genomic Address Messenger 871 (VGAM871) viral gene, which modulates expression of respective host target genes thereof, the function and utility of which host target genes is known in the art.

VGAM871 is a novel bioinformatically detected regulatory, non protein coding, viral micro RNA (miRNA) gene. The method by which VGAM871 was detected is described hereinabove with reference to FIGS. 1-8.

VGAM871 gene, herein designated VGAM GENE, is a viral gene contained in the genome of Fowlpox Virus. VGAM871 host target gene, herein designated VGAM HOST TARGET GENE, is a human gene contained in the human genome.

VGAM871 gene encodes a VGAM871 precursor RNA, herein designated VGAM PRECURSOR RNA. Similar to other miRNA genes, and unlike most ordinary genes, VGAM871 precursor RNA does not encode a protein. A nucleotide sequence identical or highly similar to the nucleotide sequence of VGAM871 precursor RNA is designated SEQ ID:857, and is provided hereinbelow with reference to the sequence listing part. Nucleotide sequence SEQ ID:857 is located at position 172281 relative to the genome of Fowlpox Virus.

VGAM871 precursor RNA folds onto itself, forming VGAM871 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM871 folded precursor RNA into VGAM871 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM871 RNA is designated SEQ ID:3582, and is provided hereinbelow with reference to the sequence listing part.

VGAM871 host target gene, herein designated VGAM HOST TARGET GENE, encodes a corresponding messenger RNA, VGAM871 host target RNA, herein designated VGAM HOST TARGET RNA. VGAM871 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM871 RNA, herein designated VGAM RNA, binds complementarily to one or more host target binding sites located in untranslated regions of VGAM871 host target RNA, herein designated VGAM HOST TARGET RNA. This complementary binding is due to the fact that the nucleotide sequence of VGAM871 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM871 RNA, herein designated VGAM RNA, may have a different number of host target binding sites in untranslated regions of a VGAM871 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM871 RNA, herein designated VGAM RNA, to host target binding sites on VGAM871 host target RNA, herein designated VGAM HOST TARGET RNA, such as BINDING SITE I, BINDING SITE II and BINDING SITE III, inhibits translation of VGAM871 host target RNA into VGAM871 host target protein, herein designated VGAM HOST TARGET PROTEIN. VGAM host target protein is therefore outlined by a broken line.

It is appreciated that VGAM871 host target gene, herein designated VGAM HOST TARGET GENE, in fact represents a plurality of VGAM871 host target genes. The mRNA of each one of this plurality of VGAM871 host target genes comprises one or more host target binding sites, each having a nucleotide sequence which is at least partly complementary to VGAM871 RNA, herein designated VGAM RNA, and which when bound by VGAM871 RNA causes inhibition of translation of respective one or more VGAM871 host target proteins.

It is further appreciated by one skilled in the art that the mode of translational inhibition illustrated by FIG. 1 with specific reference to translational inhibition exerted by VGAM871 gene, herein designated VGAM GENE, on one or more VGAM871 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM871 is inhibition of expression of host target genes, as part of a novel viral mechanism of attacking a host. Accordingly, utilities of VGAM871 include diagnosis, prevention and treatment of viral infection by Fowlpox Virus. Specific functions, and accordingly utilities, of VGAM871 correlate with, and may be deduced from, the identity of the host target genes which VGAM871 binds and inhibits, and the function of these host target genes, as elaborated hereinbelow.

Nucleotide sequences of the VGAM871 precursor RNA, herein designated VGAM PRECURSOR RNA, and of the 'diced' VGAM871 RNA, herein designated VGAM RNA, and a schematic representation of the secondary folding of VGAM871 folded precursor RNA, herein designated VGAM FOLDED PRECURSOR RNA, of VGAM871 are further described hereinbelow with reference to Table 1.

Nucleotide sequences of host target binding sites, such as BINDING SITE-I, BINDING SITE-II and BINDING SITE-III of FIG. 1, found on VGAM871 host target RNA, and schematic representation of the complementarity of each of these host target binding sites to VGAM871 RNA, herein designated VGAM RNA, are described hereinbelow with reference to Table 2.

As mentioned hereinabove with reference to FIG. 1, a function of VGAM871 gene, herein designated VGAM is inhibition of expression of VGAM871 target genes. It is appreciated that specific functions, and accordingly utilities, of VGAM871 correlate with, and may be deduced from, the identity of the target genes which VGAM871 binds and inhibits, and the function of these target genes, as elaborated hereinbelow.

KIAA0677 (Accession NM_014663) is a VGAM871 host target gene. KIAA0677 BINDING SITE is HOST TARGET binding site found in the 3' untranslated region of mRNA encoded by KIAA0677, corresponding to a HOST TARGET binding site such as BINDING SITE I, BINDING SITE II or BINDING SITE III. Table 2 illustrates the complementarity of the nucleotide sequences of KIAA0677 BINDING SITE, designated SEQ ID:16111, to the nucleotide sequence of VGAM871 RNA, herein designated VGAM RNA, also designated SEQ ID:3582.

A function of VGAM871 is therefore inhibition of KIAA0677 (Accession NM_014663). Accordingly, utilities of VGAM871 include diagnosis, prevention and treatment of diseases and clinical conditions associated with KIAA0677. LOC90777 (Accession XM_034052) is another VGAM871 host target gene. LOC90777 BINDING SITE is HOST TARGET binding site found in the 3' untranslated region of mRNA encoded by LOC90777, corresponding to a HOST TARGET binding site such as BINDING SITE I, BINDING SITE II or BINDING SITE III. Table 2 illustrates the complementarity of the nucleotide sequences of LOC90777 BINDING SITE, designated SEQ ID:31994, to the nucleotide sequence of VGAM871 RNA, herein designated VGAM RNA, also designated SEQ ID:3582.

Another function of VGAM871 is therefore inhibition of LOC90777 (Accession XM_034052). Accordingly, utilities of VGAM871 include diagnosis, prevention and treatment of diseases and clinical conditions associated with LOC90777. FIG. 1 further provides a conceptual description of a novel bioinformatically detected viral gene of the present invention, referred to here as Viral Genomic Address Messenger 872 (VGAM872) viral gene, which modulates expression of respective host target genes thereof, the function and utility of which host target genes is known in the art.

VGAM872 is a novel bioinformatically detected regulatory, non protein coding, viral micro RNA (miRNA) gene. The method by which VGAM872 was detected is described hereinabove with reference to FIGS. 1-8.

VGAM872 gene, herein designated VGAM GENE, is a viral gene contained in the genome of Fowlpox Virus. VGAM872 host target gene, herein designated VGAM HOST TARGET GENE, is a human gene contained in the human genome.

VGAM872 gene encodes a VGAM872 precursor RNA, herein designated VGAM PRECURSOR RNA. Similar to other miRNA genes, and unlike most ordinary genes, VGAM872 precursor RNA does not encode a protein. A nucleotide sequence identical or highly similar to the nucleotide sequence of VGAM872 precursor RNA is designated SEQ ID:858, and is provided hereinbelow with reference to the sequence listing part. Nucleotide sequence SEQ ID:858 is located at position 172697 relative to the genome of Fowlpox Virus.

VGAM872 precursor RNA folds onto itself, forming VGAM872 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM872 folded precursor RNA into VGAM872 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM872 RNA is designated SEQ ID:3583, and is provided hereinbelow with reference to the sequence listing part.

VGAM872 host target gene, herein designated VGAM HOST TARGET GENE, encodes a corresponding messenger RNA, VGAM872 host target RNA, herein designated VGAM HOST TARGET RNA. VGAM872 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM872 RNA, herein designated VGAM RNA, binds complementarily to one or more host target binding sites located in untranslated regions of VGAM872 host target RNA, herein designated VGAM HOST TARGET RNA. This complementary binding is due to the fact that the nucleotide sequence of VGAM872 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM872 RNA, herein designated VGAM RNA, may have a different number of host target binding sites in untranslated regions of a VGAM872 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM872 RNA, herein designated VGAM RNA, to host target binding sites on VGAM872 host target RNA, herein designated VGAM HOST TARGET RNA, such as BINDING SITE I, BINDING SITE II and BINDING SITE III, inhibits translation of VGAM872 host target RNA into VGAM872 host target protein, herein designated VGAM HOST TARGET PROTEIN. VGAM host target protein is therefore outlined by a broken line.

It is appreciated that VGAM872 host target gene, herein designated VGAM HOST TARGET GENE, in fact represents a plurality of VGAM872 host target genes. The mRNA of each one of this plurality of VGAM872 host target genes comprises one or more host target binding sites, each having a nucleotide sequence which is at least partly complementary to VGAM872 RNA, herein designated VGAM RNA, and which when bound by VGAM872 RNA causes inhibition of translation of respective one or more VGAM872 host target proteins.

It is further appreciated by one skilled in the art that the mode of translational inhibition illustrated by FIG. 1 with specific reference to translational inhibition exerted by VGAM872 gene, herein designated VGAM GENE, on one or more VGAM872 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM872 is inhibition of expression of host target genes, as part of a novel viral mechanism of attacking a host. Accordingly, utilities of VGAM872 include diagnosis, prevention and treatment of viral infection by Fowlpox Virus. Specific functions, and accordingly utilities, of VGAM872 correlate with, and may be deduced from, the identity of the host target genes which VGAM872 binds and inhibits, and the function of these host target genes, as elaborated hereinbelow.

Nucleotide sequences of the VGAM872 precursor RNA, herein designated VGAM PRECURSOR RNA, and of the 'diced' VGAM872 RNA, herein designated VGAM RNA, and a schematic representation of the secondary folding of VGAM872 folded precursor RNA, herein designated VGAM FOLDED PRECURSOR RNA, of VGAM872 are further described hereinbelow with reference to Table 1.

Nucleotide sequences of host target binding sites, such as BINDING SITE-I, BINDING SITE-II and BINDING SITE-III of FIG. 1, found on VGAM872 host target RNA, and schematic representation of the complementarity of each of these host target binding sites to VGAM872 RNA, herein designated VGAM RNA, are described hereinbelow with reference to Table 2.

As mentioned hereinabove with reference to FIG. 1, a function of VGAM872 gene, herein designated VGAM is inhibition of expression of VGAM872 target genes. It is appreciated that specific functions, and accordingly utilities, of VGAM872 correlate with, and may be deduced from, the identity of the target genes which VGAM872 binds and inhibits, and the function of these target genes, as elaborated hereinbelow.

Integral Membrane Protein 2B (ITM2B, Accession NM_021999) is a VGAM872 host target gene. ITM2B BINDING SITE is HOST TARGET binding site found in the 3' untranslated region of mRNA encoded by ITM2B, corresponding to a HOST TARGET binding site such as BINDING SITE I, BINDING SITE II or BINDING SITE III. Table 2 illustrates the complementarity of the nucleotide sequences of ITM2B BINDING SITE, designated SEQ ID:22537, to the nucleotide sequence of VGAM872 RNA, herein designated VGAM RNA, also designated SEQ ID:3583.

A function of VGAM872 is therefore inhibition of Integral Membrane Protein 2B (ITM2B, Accession NM_021999), a gene which is a member of the type II integral membrane protein family. Accordingly, utilities of VGAM872 include diagnosis, prevention and treatment of diseases and clinical conditions associated with ITM2B. The function of ITM2B and its association with various diseases and clinical conditions, has been established by previous studies, as described hereinabove with reference to VGAM458. DKFZP434G1411 (Accession XM_166383) is another VGAM872 host target gene. DKFZP434G1411 BINDING SITE is HOST TARGET binding site found in the 3' untranslated region of mRNA encoded by DKFZP434G1411, corresponding to a HOST TARGET binding site such as BINDING SITE I, BINDING SITE II or BINDING SITE III. Table 2 illustrates the complementarity of the nucleotide sequences of DKFZP434G1411 BINDING SITE, designated SEQ ID:44228, to the nucleotide sequence of VGAM872 RNA, herein designated VGAM RNA, also designated SEQ ID:3583.

Another function of VGAM872 is therefore inhibition of DKFZP434G1411 (Accession XM_166383). Accordingly, utilities of VGAM872 include diagnosis, prevention and treatment of diseases and clinical conditions associated with DKFZP434G1411. LOC151103 (Accession XM_098004) is another VGAM872 host target gene. LOC151103 BINDING SITE is HOST TARGET binding site found in the 3' untranslated region of mRNA encoded by LOC151103, corresponding to a HOST TARGET binding site such as BINDING SITE I, BINDING SITE II or BINDING SITE III. Table 2 illustrates the complementarity of the nucleotide sequences of LOC151103 BINDING SITE, designated SEQ ID:41298, to the nucleotide sequence of VGAM872 RNA, herein designated VGAM RNA, also designated SEQ ID:3583.

Another function of VGAM872 is therefore inhibition of LOC151103 (Accession XM_098004). Accordingly, utilities of VGAM872 include diagnosis, prevention and treatment of diseases and clinical conditions associated with LOC151103. FIG. 1 further provides a conceptual description of a novel bioinformatically detected viral gene of the present invention, referred to here as Viral Genomic Address Messenger 873 (VGAM873) viral gene, which modulates expression of respective host target genes thereof, the function and utility of which host target genes is known in the art.

VGAM873 is a novel bioinformatically detected regulatory, non protein coding, viral micro RNA (miRNA) gene. The method by which VGAM873 was detected is described hereinabove with reference to FIGS. 1-8.

VGAM873 gene, herein designated VGAM GENE, is a viral gene contained in the genome of Fowlpox Virus. VGAM873 host target gene, herein designated VGAM HOST TARGET GENE, is a human gene contained in the human genome.

VGAM873 gene encodes a VGAM873 precursor RNA, herein designated VGAM PRECURSOR RNA. Similar to other miRNA genes, and unlike most ordinary genes, VGAM873 precursor RNA does not encode a protein. A nucleotide sequence identical or highly similar to the nucleotide sequence of VGAM873 precursor RNA is designated SEQ ID:859, and is provided hereinbelow with reference to the sequence listing part. Nucleotide sequence SEQ ID:859 is located at position 174514 relative to the genome of Fowlpox Virus.

VGAM873 precursor RNA folds onto itself, forming VGAM873 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM873 folded precursor RNA into VGAM873 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 85%) nucleotide sequence of VGAM873 RNA is designated SEQ ID:3584, and is provided hereinbelow with reference to the sequence listing part.

VGAM873 host target gene, herein designated VGAM HOST TARGET GENE, encodes a corresponding messenger RNA, VGAM873 host target RNA, herein designated VGAM HOST TARGET RNA. VGAM873 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM873 RNA, herein designated VGAM RNA, binds complementarily to one or more host target binding sites located in untranslated regions of VGAM873 host target RNA, herein designated VGAM HOST TARGET RNA. This complementary binding is due to the fact that the nucleotide sequence of VGAM873 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM873 RNA, herein designated VGAM RNA, may have a different number of host target binding sites in untranslated regions of a VGAM873 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM873 RNA, herein designated VGAM RNA, to host target binding sites on VGAM873 host target RNA, herein designated VGAM HOST TARGET RNA, such as BINDING SITE I, BINDING SITE II and BINDING SITE III, inhibits translation of VGAM873 host target RNA into VGAM873 host target protein, herein designated VGAM HOST TARGET PROTEIN. VGAM host target protein is therefore outlined by a broken line.

It is appreciated that VGAM873 host target gene, herein designated VGAM HOST TARGET GENE, in fact represents a plurality of VGAM873 host target genes. The mRNA of each one of this plurality of VGAM873 host target genes comprises one or more host target binding sites, each having a nucleotide sequence which is at least partly complementary to VGAM873 RNA, herein designated VGAM RNA, and which when bound by VGAM873 RNA causes inhibition of translation of respective one or more VGAM873 host target proteins.

It is further appreciated by one skilled in the art that the mode of translational inhibition illustrated by FIG. 1 with specific reference to translational inhibition exerted by VGAM873 gene, herein designated VGAM GENE, on one or more VGAM873 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM873 is inhibition of expression of host target genes, as part of a novel viral mechanism of attacking a host. Accordingly, utilities of VGAM873 include diagnosis, prevention and treatment of viral infection by Fowlpox Virus. Specific functions, and accordingly utilities, of VGAM873 correlate with, and may be deduced from, the identity of the host target genes which VGAM873 binds and inhibits, and the function of these host target genes, as elaborated hereinbelow.

Nucleotide sequences of the VGAM873 precursor RNA, herein designated VGAM PRECURSOR RNA, and of the 'diced' VGAM873 RNA, herein designated VGAM RNA, and a schematic representation of the secondary folding of VGAM873 folded precursor RNA, herein designated VGAM FOLDED PRECURSOR RNA, of VGAM873 are further described hereinbelow with reference to Table 1.

Nucleotide sequences of host target binding sites, such as BINDING SITE-I, BINDING SITE-II and BINDING SITE-III of FIG. 1, found on VGAM873 host target RNA, and schematic representation of the complementarity of each of these host target binding sites to VGAM873 RNA, herein designated VGAM RNA, are described hereinbelow with reference to Table 2.

As mentioned hereinabove with reference to FIG. 1, a function of VGAM873 gene, herein designated VGAM is inhibition of expression of VGAM873 target genes. It is appreciated that specific functions, and accordingly utilities, of VGAM873 correlate with, and may be deduced from, the identity of the target genes which VGAM873 binds and inhibits, and the function of these target genes, as elaborated hereinbelow.

Amyloid Beta Precursor Protein (cytoplasmic tail) Binding Protein 2 (APPBP2, Accession NM_006380) is a VGAM873 host target gene. APPBP2 BINDING SITE is HOST TARGET binding site found in the 3' untranslated region of mRNA encoded by APPBP2, corresponding to a HOST TARGET binding site such as BINDING SITE I, BINDING SITE II or BINDING SITE III. Table 2 illustrates the complementarity of the nucleotide sequences of APPBP2 BINDING SITE, designated SEQ ID:13081, to the nucleotide sequence of VGAM873 RNA, herein designated VGAM RNA, also designated SEQ ID:3584.

A function of VGAM873 is therefore inhibition of Amyloid Beta Precursor Protein (cytoplasmic tail) Binding Protein 2 (APPBP2, Accession NM_006380), a gene which interacts with the basolateral sorting signal of amyloid precursor protein. Accordingly, utilities of VGAM873 include diagnosis, prevention and treatment of diseases and clinical conditions associated with APPBP2. The function of APPBP2 and its association with various diseases and clinical conditions, has been established by previous studies, as described hereinabove with reference to VGAM525. Cannabinoid Receptor 1 (brain) (CNR1, Accession NM_016083) is another VGAM873 host target gene. CNR1 BINDING SITE is HOST TARGET binding site found in the 3' untranslated region of mRNA encoded by CNR1, corresponding to a HOST TARGET binding site such as BINDING SITE I, BINDING SITE II or BINDING SITE III. Table 2 illustrates the complementarity of the nucleotide sequences of CNR1 BINDING SITE, designated SEQ ID:18166, to the nucleotide sequence of VGAM873 RNA, herein designated VGAM RNA, also designated SEQ ID:3584.

Another function of VGAM873 is therefore inhibition of Cannabinoid Receptor 1 (brain) (CNR1, Accession NM_016083), a gene which is involved in the cannabinoid-induced CNS effects. Accordingly, utilities of VGAM873 include diagnosis, prevention and treatment of diseases and clinical conditions associated with CNR1. The function of CNR1 and its association with various diseases and clinical conditions, has been established by previous studies, as described hereinabove with reference to VGAM533. Chromosome X Open Reading Frame 6 (CXorf6, Accession NM_005491) is another VGAM873 host target gene. CXorf6 BINDING SITE is HOST TARGET binding site found in the 3' untranslated region of mRNA encoded by CXorf6, corresponding to a HOST TARGET binding site such as BINDING SITE I, BINDING SITE II or BINDING SITE III. Table 2 illustrates the complementarity of the nucleotide sequences of CXorf6 BINDING SITE, designated SEQ ID:11990, to the nucleotide sequence of VGAM873 RNA, herein designated VGAM RNA, also designated SEQ ID:3584.

Another function of VGAM873 is therefore inhibition of Chromosome X Open Reading Frame 6 (CXorf6, Accession NM_005491). Accordingly, utilities of VGAM873 include diagnosis, prevention and treatment of diseases and clinical conditions associated with CXorf6. Isovaleryl Coenzyme A Dehydrogenase (IVD, Accession NM_002225) is another VGAM873 host target gene. IVD BINDING SITE is HOST TARGET binding site found in the 3" untranslated region of mRNA encoded by IVD, corresponding to a HOST TARGET binding site such as BINDING SITE I, BINDING SITE II or BINDING SITE III. Table 2 illustrates the complementarity of the nucleotide sequences of IVD BINDING SITE, designated SEQ ID:8002, to the nucleotide sequence of VGAM873 RNA, herein designated VGAM RNA, also designated SEQ ID:3584.

Another function of VGAM873 is therefore inhibition of Isovaleryl Coenzyme A Dehydrogenase (IVD, Accession NM_002225). Accordingly, utilities of VGAM873 include diagnosis, prevention and treatment of diseases and clinical conditions associated with IVD. Membrane-spanning 4-domains, Subfamily A, Member 3 (hematopoietic cell-specific) (MS4A3, Accession NM_006138) is another VGAM873 host target gene. MS4A3 BINDING SITE is HOST TARGET binding site found in the 3' untranslated region of mRNA encoded by MS4A3, corresponding to a HOST TARGET binding site such as BINDING SITE I, BINDING SITE II or BINDING SITE III. Table 2 illustrates the complementarity of the nucleotide sequences of MS4A3 BINDING SITE, designated SEQ ID:12778, to the nucleotide sequence of VGAM873 RNA, herein designated VGAM RNA, also designated SEQ ID:3584.

Another function of VGAM873 is therefore inhibition of Membrane-spanning 4-domains, Subfamily A, Member 3 (hematopoietic cell-specific) (MS4A3, Accession NM_006138). Accordingly, utilities of VGAM873 include diagnosis, prevention and treatment of diseases and clinical conditions associated with MS4A3. Myeloma Overexpressed Gene (in a subset of t (11;14) Positive Multiple Myelomas) (MYEOV, Accession NM_138768) is another VGAM873 host target gene. MYEOV BINDING SITE is HOST TARGET binding site found in the 5' untranslated region of mRNA encoded by MYEOV, corresponding to a HOST TARGET binding site such as BINDING SITE I, BINDING SITE II or BINDING SITE III. Table 2 illustrates the complementarity of the nucleotide sequences of MYEOV BINDING SITE, designated SEQ ID:29000, to the nucleotide sequence of VGAM873 RNA, herein designated VGAM RNA, also designated SEQ ID:3584.

Another function of VGAM873 is therefore inhibition of Myeloma Overexpressed Gene (in a subset of t (11;14) Positive Multiple Myelomas) (MYEOV, Accession NM_138768), a gene which is encoded by MYELOMA OVEREXPRESSED GENE. Accordingly, utilities of VGAM873 include diagnosis, prevention and treatment of diseases and clinical conditions associated with MYEOV. The function of MYEOV and its association with various diseases and clinical conditions, has been established by previous studies, as described hereinabove with reference to VGAM471. Protein Phosphatase 1, Catalytic Subunit, Beta Isoform (PPP1CB, Accession NM_002709) is another VGAM873 host target gene. PPP1CB BINDING SITE is HOST TARGET binding site found in the 3' untranslated region of mRNA encoded by PPP1CB, corresponding to a HOST TARGET binding site such as BINDING SITE I, BINDING SITE II or BINDING SITE III. Table 2 illustrates the complementarity of the nucleotide sequences of PPP1CB BINDING SITE, designated SEQ ID:8554, to the nucleotide sequence of VGAM873 RNA, herein designated VGAM RNA, also designated SEQ ID:3584.

Another function of VGAM873 is therefore inhibition of Protein Phosphatase 1, Catalytic Subunit, Beta Isoform (PPP1CB, Accession NM_002709), a gene which is the catalytic subunit of protein phosphatase 1. Accordingly, utilities of VGAM873 include diagnosis, prevention and treatment of diseases and clinical conditions associated with PPP1CB. The function of PPP1CB and its association with various diseases and clinical conditions, has been established by previous studies, as described hereinabove with reference to VGAM46. TEA Domain Family Member 3 (TEAD3, Accession NM_003214) is another VGAM873 host target gene. TEAD3 BINDING SITE is HOST TARGET binding site found in the 3' untranslated region of mRNA encoded by TEAD3, corresponding to a HOST TARGET binding site such as BINDING SITE I, BINDING SITE II or BINDING SITE III. Table 2 illustrates the complementarity of the nucleotide sequences of TEAD3 BINDING SITE, designated SEQ ID:9212, to the nucleotide sequence of VGAM873 RNA, herein designated VGAM RNA, also designated SEQ ID:3584.

Another function of VGAM873 is therefore inhibition of TEA Domain Family Member 3 (TEAD3, Accession NM_003214), a gene which binds to multiple functional elements of the human chorionic somatomammotropin-b gene enhancer. Accordingly, utilities of VGAM873 include diagnosis, prevention and treatment of diseases and clinical conditions associated with TEAD3. The function of TEAD3 and its association with various diseases and clinical conditions, has been established by previous studies, as described hereinabove with reference to VGAM299. Ubiquitin Specific Protease 6 (Tre-2 oncogene) (USP6, Accession XM_165948) is another VGAM873 host target gene. USP6 BINDING SITE is HOST TARGET binding site found in the 3' untranslated region of mRNA encoded by USP6, corresponding to a HOST TARGET binding site such as BINDING SITE I, BINDING SITE II or BINDING SITE III. Table 2 illustrates the complementarity of the nucleotide sequences of USP6 BINDING SITE, designated SEQ ID:43812, to the nucleotide sequence of VGAM873 RNA, herein designated VGAM RNA, also designated SEQ ID:3584.

Another function of VGAM873 is therefore inhibition of Ubiquitin Specific Protease 6 (Tre-2 oncogene) (USP6, Accession XM_165948), a gene which has an atp-independent isopeptidase activity, cleaving at the carboxyl terminus of the ubiquitin moiety. Accordingly, utilities of VGAM873 include diagnosis, prevention and treatment of diseases and clinical conditions associated with USP6. The function of USP6 and its association with various diseases and clinical conditions, has been established by previous studies, as described hereinabove with reference to VGAM296. Vang-like 2 (van gogh, Drosophila) (VANGL2, Accession XM_049695) is another VGAM873 host target gene. VANGL2 BINDING SITE is HOST TARGET binding site found in the 3' untranslated region of mRNA encoded by VANGL2, corresponding to a HOST TARGET binding site such as BINDING SITE I, BINDING SITE II or BINDING SITE III. Table 2 illustrates the complementarity of the nucleotide sequences of VANGL2 BINDING SITE, designated SEQ ID:35479, to the nucleotide sequence of VGAM873 RNA, herein designated VGAM RNA, also designated SEQ ID:3584.

Another function of VGAM873 is therefore inhibition of Vang-like 2 (van gogh, Drosophila) (VANGL2, Accession XM_049695), a gene which may take part in defining the lateral boundary of floorplate differentiation. Accordingly, utilities of VGAM873 include diagnosis, prevention and treatment of diseases and clinical conditions associated with VANGL2. The function of VANGL2 and its association with various diseases and clinical conditions, has been established by previous studies, as described hereinabove with reference to VGAM111. A Kinase (PRKA) Anchor Protein 11 (AKAP11, Accession NM_016248) is another VGAM873 host target gene. AKAP11 BINDING SITE is HOST TARGET binding site found in the 3' untranslated region of mRNA encoded by AKAP11, corresponding to a HOST TARGET binding site such as BINDING SITE I, BINDING SITE II or BINDING SITE III. Table 2 illustrates the complementarity of the nucleotide sequences of AKAP11 BINDING SITE, designated SEQ ID:18374, to the nucleotide sequence of VGAM873 RNA, herein designated VGAM RNA, also designated SEQ ID:3584.

Another function of VGAM873 is therefore inhibition of A Kinase (PRKA) Anchor Protein 11 (AKAP11, Accession NM_016248). Accordingly, utilities of VGAM873 include diagnosis, prevention and treatment of diseases and clinical conditions associated with AKAP11. DJ667H12.2 (Accession NM_019605) is another VGAM873 host target gene. DJ667H12.2 BINDING SITE is HOST TARGET binding site found in the 3" untranslated region of mRNA encoded by DJ667H12.2, corresponding to a HOST TARGET binding site such as BINDING SITE I, BINDING SITE II or BINDING SITE III. Table 2 illustrates the complementarity of the nucleotide sequences of DJ667H12.2 BINDING SITE, designated SEQ ID:21216, to the nucleotide sequence of VGAM873 RNA, herein designated VGAM RNA, also designated SEQ ID:3584.

Another function of VGAM873 is therefore inhibition of DJ667H12.2 (Accession NM_019605). Accordingly, utilities of VGAM873 include diagnosis, prevention and treatment of diseases and clinical conditions associated with DJ667H12.2. FLJ00001 (Accession XM_088525) is another VGAM873 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39778, to the nucleotide sequence of VGAM873 RNA, herein designated VGAM RNA, also designated SEQ ID:3584.

Another function of VGAM873 is therefore inhibition of FLJ00001 (Accession XM_088525). Accordingly, utilities of VGAM873 include diagnosis, prevention and treatment of diseases and clinical conditions associated with FLJ00001. FLJ14007 (Accession NM_024699) is another VGAM873 host target gene. FLJ14007 BINDING SITE is HOST TARGET binding site found in the 3' untranslated region of mRNA encoded by FLJ14007, corresponding to a HOST TARGET binding site such as BINDING SITE I, BINDING SITE II or BINDING SITE III. Table 2 illustrates the complementarity of the nucleotide sequences of FLJ14007 BINDING SITE, designated SEQ ID:24009, to the nucleotide sequence of VGAM873 RNA, herein designated VGAM RNA, also designated SEQ ID:3584.

Another function of VGAM873 is therefore inhibition of FLJ14007 (Accession NM_024699). Accordingly, utilities of VGAM873 include diagnosis, prevention and treatment of diseases and clinical conditions associated with FLJ14007. FLJ23017 (Accession NM_022840) is another VGAM873 host target gene. FLJ23017 BINDING SITE is HOST TARGET binding site found in the 3' untranslated region of mRNA encoded by FLJ23017, corresponding to a HOST TARGET binding site such as BINDING SITE I, BINDING SITE II or BINDING SITE III. Table 2 illustrates the complementarity of the nucleotide sequences of FLJ23017 BINDING SITE, designated SEQ ID:23132, to the nucleotide sequence of VGAM873 RNA, herein designated VGAM RNA, also designated SEQ ID:3584.

Another function of VGAM873 is therefore inhibition of FLJ23017 (Accession NM_022840). Accordingly, utilities of VGAM873 include diagnosis, prevention and treatment of diseases and clinical conditions associated with FLJ23017. KIAA0229 (Accession XM_166478) is another VGAM873 host target gene. KIAA0229 BINDING SITE is HOST TARGET binding site found in the 3' untranslated region of mRNA encoded by KIAA0229, corresponding to a HOST TARGET binding site such as BINDING SITE I, BINDING SITE II or BINDING SITE III. Table 2 illustrates the complementarity of the nucleotide sequences of KIAA0229 BINDING SITE, designated SEQ ID:44404, to the nucleotide sequence of VGAM873 RNA, herein designated VGAM RNA, also designated SEQ ID:3584.

Another function of VGAM873 is therefore inhibition of KIAA0229 (Accession XM_166478). Accordingly, utilities of VGAM873 include diagnosis, prevention and treatment of diseases and clinical conditions associated with KIAA0229. KIAA0285 (Accession NM_014807) is another VGAM873 host target gene. KIAA0285 BINDING SITE is HOST TARGET binding site found in the 3' untranslated region of mRNA encoded by KIAA0285, corresponding to a HOST TARGET binding site such as BINDING SITE I, BINDING SITE II or BINDING SITE III. Table 2 illustrates the complementarity of the nucleotide sequences of KIAA0285 BINDING SITE, designated SEQ ID:16754, to the nucleotide sequence of VGAM873 RNA, herein designated VGAM RNA, also designated SEQ ID:3584.

Another function of VGAM873 is therefore inhibition of KIAA0285 (Accession NM_014807). Accordingly, utilities of VGAM873 include diagnosis, prevention and treatment of diseases and clinical conditions associated with KIAA0285. KIAA0513 (Accession NM_014732) is another VGAM873 host target gene. KIAA0513 BINDING SITE is HOST TARGET binding site found in the 3' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16362, to the nucleotide sequence of VGAM873 RNA, herein designated VGAM RNA, also designated SEQ ID:3584.

Another function of VGAM873 is therefore inhibition of KIAA0513 (Accession NM_014732). Accordingly, utilities of VGAM873 include diagnosis, prevention and treatment of diseases and clinical conditions associated with KIAA0513. KIAA1041 (Accession NM_014947) is another VGAM873 host target gene. KIAA1041 BINDING SITE is HOST TARGET binding site found in the 3' untranslated region of mRNA encoded by KIAA1041, corresponding to a HOST TARGET binding site such as BINDING SITE I, BINDING SITE II or BINDING SITE III. Table 2 illustrates the complementarity of the nucleotide sequences of KIAA1041 BINDING SITE, designated SEQ ID:17263, to the nucleotide sequence of VGAM873 RNA, herein designated VGAM RNA, also designated SEQ ID:3584.

Another function of VGAM873 is therefore inhibition of KIAA1041 (Accession NM_014947). Accordingly, utilities of VGAM873 include diagnosis, prevention and treatment of diseases and clinical conditions associated with KIAA1041. KIAA1171 (Accession XM_113868) is another VGAM873 host target gene. KIAA1171 BINDING SITE is HOST TARGET binding site found in the 3' untranslated region of mRNA encoded by KIAA1171, corresponding to a HOST TARGET binding site such as BINDING SITE I, BINDING SITE II or BINDING SITE III. Table 2 illustrates the complementarity of the nucleotide sequences of KIAA1171 BINDING SITE, designated SEQ ID:42481, to the nucleotide sequence of VGAM873 RNA, herein designated VGAM RNA, also designated SEQ ID:3584.

Another function of VGAM873 is therefore inhibition of KIAA1171 (Accession XM_113868). Accordingly, utilities of VGAM873 include diagnosis, prevention and treatment of diseases and clinical conditions associated with KIAA1171. KIAA1348 (Accession XM_043826) is another VGAM873 host target gene. KIAA1348 BINDING SITE is HOST TARGET binding site found in the 3' untranslated region of mRNA encoded by KIAA1348, corresponding to a HOST TARGET binding site such as BINDING SITE I, BINDING SITE II or BINDING SITE III. Table 2 illustrates the complementarity of the nucleotide sequences of KIAA1348 BINDING SITE, designated SEQ ID:34027, to the nucleotide sequence of VGAM873 RNA, herein designated VGAM RNA, also designated SEQ ID:3584.

Another function of VGAM873 is therefore inhibition of KIAA1348 (Accession XM_043826). Accordingly, utilities of VGAM873 include diagnosis, prevention and treatment of diseases and clinical conditions associated with KIAA1348. PLU-1 (Accession NM_006618) is another VGAM873 host target gene. PLU-1 BINDING SITE is HOST TARGET binding site found in the 5' untranslated region of mRNA encoded by PLU-1, corresponding to a HOST TARGET binding site such as BINDING SITE I, BINDING SITE II or BINDING SITE III. Table 2 illustrates the complementarity of the nucleotide sequences of PLU-1 BINDING SITE, designated SEQ ID:13403, to the nucleotide sequence of VGAM873 RNA, herein designated VGAM RNA, also designated SEQ ID:3584.

Another function of VGAM873 is therefore inhibition of PLU-1 (Accession NM_006618). Accordingly, utilities of VGAM873 include diagnosis, prevention and treatment of diseases and clinical conditions associated with PLU-1. SET Binding Protein 1 (SETBP1, Accession NM_015559) is another VGAM873 host target gene. SETBP1 BINDING SITE is HOST TARGET binding site found in the 3' untranslated region of mRNA encoded by SETBP1, corresponding to a HOST TARGET binding site such as BINDING SITE I, BINDING SITE II or BINDING SITE III. Table 2 illustrates the complementarity of the nucleotide sequences of SETBP1 BINDING SITE, designated SEQ ID:17828, to the nucleotide sequence of VGAM873 RNA, herein designated VGAM RNA, also designated SEQ ID:3584.

Another function of VGAM873 is therefore inhibition of SET Binding Protein 1 (SETBP1, Accession NM_015559). Accordingly, utilities of VGAM873 include diagnosis, prevention and treatment of diseases and clinical conditions associated with SETBP1. Transcription Factor 6-like 1 (mitochondrial transcription factor 1-like) (TCF6L1, Accession NM_003201) is another VGAM873 host target gene. TCF6L1 BINDING SITE is HOST TARGET binding site found in the 3' untranslated region of mRNA encoded by TCF6L1, corresponding to a HOST TARGET binding site such as BINDING SITE I, BINDING SITE II or BINDING SITE III. Table 2 illustrates the complementarity of the nucleotide sequences of TCF6L1 BINDING SITE, designated SEQ ID:9188, to the nucleotide sequence of VGAM873 RNA, herein designated VGAM RNA, also designated SEQ ID:3584.

Another function of VGAM873 is therefore inhibition of Transcription Factor 6-like 1 (mitochondrial transcription factor 1-like) (TCF6L1, Accession NM_003201). Accordingly, utilities of VGAM873 include diagnosis, prevention and treatment of diseases and clinical conditions associated with TCF6L1. Ubiquitin-conjugating Enzyme E2D 3 (UBC4/5 homolog, yeast) (UBE2D3, Accession NM_003340) is another VGAM873 host target gene. UBE2D3 BINDING SITE is HOST TARGET binding site found in the 3' untranslated region of mRNA encoded by UBE2D3, corresponding to a HOST TARGET binding site such as BINDING SITE I, BINDING SITE II or BINDING SITE III. Table 2 illustrates the complementarity of the nucleotide sequences of UBE2D3 BINDING SITE, designated SEQ ID:9346, to the nucleotide sequence of VGAM873

RNA, herein designated VGAM RNA, also designated SEQ ID:3584.

Another function of VGAM873 is therefore inhibition of Ubiquitin-conjugating Enzyme E2D 3 (UBC4/5 homolog, yeast) (UBE2D3, Accession NM_003340). Accordingly, utilities of VGAM873 include diagnosis, prevention and treatment of diseases and clinical conditions associated with UBE2D3. LOC153778 (Accession XM_087762) is another VGAM873 host target gene. LOC153778 BINDING SITE is HOST TARGET binding site found in the 5' untranslated region of mRNA encoded by LOC153778, corresponding to a HOST TARGET binding site such as BINDING SITE I, BINDING SITE II or BINDING SITE III. Table 2 illustrates the complementarity of the nucleotide sequences of LOC153778 BINDING SITE, designated SEQ ID:39408, to the nucleotide sequence of VGAM873 RNA, herein designated VGAM RNA, also designated SEQ ID:3584.

Another function of VGAM873 is therefore inhibition of LOC153778 (Accession XM_087762). Accordingly, utilities of VGAM873 include diagnosis, prevention and treatment of diseases and clinical conditions associated with LOC153778. LOC196955 (Accession XM_085210) is another VGAM873 host target gene. LOC196955 BINDING SITE is HOST TARGET binding site found in the 5' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37934, to the nucleotide sequence of VGAM873 RNA, herein designated VGAM RNA, also designated SEQ ID:3584.

Another function of VGAM873 is therefore inhibition of LOC196955 (Accession XM_085210). Accordingly, utilities of VGAM873 include diagnosis, prevention and treatment of diseases and clinical conditions associated with LOC196955. LOC199858 (Accession XM_114040) is another VGAM873 host target gene. LOC199858 BINDING SITE is HOST TARGET binding site found in the 3' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42637, to the nucleotide sequence of VGAM873 RNA, herein designated VGAM RNA, also designated SEQ ID:3584.

Another function of VGAM873 is therefore inhibition of LOC199858 (Accession XM_114040). Accordingly, utilities of VGAM873 include diagnosis, prevention and treatment of diseases and clinical conditions associated with LOC199858. LOC199870 (Accession XM_114043) is another VGAM873 host target gene. LOC199870 BINDING SITE is HOST TARGET binding site found in the 3' untranslated region of mRNA encoded by LOC199870, corresponding to a HOST TARGET binding site such as BINDING SITE I, BINDING SITE II or BINDING SITE III. Table 2 illustrates the complementarity of the nucleotide sequences of LOC199870 BINDING SITE, designated SEQ ID:42647, to the nucleotide sequence of VGAM873 RNA, herein designated VGAM RNA, also designated SEQ ID:3584.

Another function of VGAM873 is therefore inhibition of LOC199870 (Accession XM_114043). Accordingly, utilities of VGAM873 include diagnosis, prevention and treatment of diseases and clinical conditions associated with LOC199870. LOC200488 (Accession XM_117240) is another VGAM873 host target gene. LOC200488 BINDING SITE is HOST TARGET binding site found in the 5' untranslated region of mRNA encoded by LOC200488, corresponding to a HOST TARGET binding site such as BINDING SITE I, BINDING SITE II or BINDING SITE III. Table 2 illustrates the complementarity of the nucleotide sequences of LOC200488 BINDING SITE, designated SEQ ID:43315, to the nucleotide sequence of VGAM873 RNA, herein designated VGAM RNA, also designated SEQ ID:3584.

Another function of VGAM873 is therefore inhibition of LOC200488 (Accession XM_117240). Accordingly, utilities of VGAM873 include diagnosis, prevention and treatment of diseases and clinical conditions associated with LOC200488. LOC200942 (Accession XM_114323) is another VGAM873 host target gene. LOC200942 BINDING SITE is HOST TARGET binding site found in the 3' untranslated region of mRNA encoded by LOC200942, corresponding to a HOST TARGET binding site such as BINDING SITE I, BINDING SITE II or BINDING SITE III. Table 2 illustrates the complementarity of the nucleotide sequences of LOC200942 BINDING SITE, designated SEQ ID:42872, to the nucleotide sequence of VGAM873 RNA, herein designated VGAM RNA, also designated SEQ ID:3584.

Another function of VGAM873 is therefore inhibition of LOC200942 (Accession XM_114323). Accordingly, utilities of VGAM873 include diagnosis, prevention and treatment of diseases and clinical conditions associated with LOC200942. LOC202181 (Accession XM_114456) is another VGAM873 host target gene. LOC202181 BINDING SITE is HOST TARGET binding site found in the 5' untranslated region of mRNA encoded by LOC202181, corresponding to a HOST TARGET binding site such as BINDING SITE I, BINDING SITE II or BINDING SITE III. Table 2 illustrates the complementarity of the nucleotide sequences of LOC202181 BINDING SITE, designated SEQ ID:42968, to the nucleotide sequence of VGAM873 RNA, herein designated VGAM RNA, also designated SEQ ID:3584.

Another function of VGAM873 is therefore inhibition of LOC202181 (Accession XM_114456). Accordingly, utilities of VGAM873 include diagnosis, prevention and treatment of diseases and clinical conditions associated with LOC202181. LOC93259 (Accession XM_050105) is another VGAM873 host target gene. LOC93259 BINDING SITE is HOST TARGET binding site found in the 5' untranslated region of mRNA encoded by LOC93259, corresponding to a HOST TARGET binding site such as BINDING SITE I, BINDING SITE II or BINDING SITE III. Table 2 illustrates the complementarity of the nucleotide sequences of LOC93259 BINDING SITE, designated SEQ ID:35563, to the nucleotide sequence of VGAM873 RNA, herein designated VGAM RNA, also designated SEQ ID:3584.

Another function of VGAM873 is therefore inhibition of LOC93259 (Accession XM_050105). Accordingly, utilities of VGAM873 include diagnosis, prevention and treatment of diseases and clinical conditions associated with LOC93259. FIG. 1 further provides a conceptual description of a novel bioinformatically detected viral gene of the present invention, referred to here as Viral Genomic Address Messenger 874 (VGAM874) viral gene, which modulates expression of respective host target genes thereof, the function and utility of which host target genes is known in the art.

VGAM874 is a novel bioinformatically detected regulatory, non protein coding, viral micro RNA (miRNA) gene. The method by which VGAM874 was detected is described hereinabove with reference to FIGS. 1-8.

VGAM874 gene, herein designated VGAM GENE, is a viral gene contained in the genome of Swinepox Virus. VGAM874 host target gene, herein designated VGAM HOST TARGET GENE, is a human gene contained in the human genome.

VGAM874 gene encodes a VGAM874 precursor RNA, herein designated VGAM PRECURSOR RNA. Similar to other miRNA genes, and unlike most ordinary genes, VGAM874 precursor RNA does not encode a protein. A nucleotide sequence identical or highly similar to the nucleotide sequence of VGAM874 precursor RNA is designated SEQ ID:860, and is provided hereinbelow with reference to the sequence listing part. Nucleotide sequence SEQ ID:860 is located at position 91946 relative to the genome of Swinepox Virus.

VGAM874 precursor RNA folds onto itself, forming VGAM874 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM874 folded precursor RNA into VGAM874 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM874 RNA is designated SEQ ID:3585, and is provided hereinbelow with reference to the sequence listing part.

VGAM874 host target gene, herein designated VGAM HOST TARGET GENE, encodes a corresponding messenger RNA, VGAM874 host target RNA, herein designated VGAM HOST TARGET RNA. VGAM874 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM874 RNA, herein designated VGAM RNA, binds complementarily to one or more host target binding sites located in untranslated regions of VGAM874 host target RNA, herein designated VGAM HOST TARGET RNA. This complementary binding is due to the fact that the nucleotide sequence of VGAM874 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM874 RNA, herein designated VGAM RNA, may have a different number of host target binding sites in untranslated regions of a VGAM874 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM874 RNA, herein designated VGAM RNA, to host target binding sites on VGAM874 host target RNA, herein designated VGAM HOST TARGET RNA, such as BINDING SITE I, BINDING SITE II and BINDING SITE III, inhibits translation of VGAM874 host target RNA into VGAM874 host target protein, herein designated VGAM HOST TARGET PROTEIN. VGAM host target protein is therefore outlined by a broken line.

It is appreciated that VGAM874 host target gene, herein designated VGAM HOST TARGET GENE, in fact represents a plurality of VGAM874 host target genes. The mRNA of each one of this plurality of VGAM874 host target genes comprises one or more host target binding sites, each having a nucleotide sequence which is at least partly complementary to VGAM874 RNA, herein designated VGAM RNA, and which when bound by VGAM874 RNA causes inhibition of translation of respective one or more VGAM874 host target proteins.

It is further appreciated by one skilled in the art that the mode of translational inhibition illustrated by FIG. 1 with specific reference to translational inhibition exerted by VGAM874 gene, herein designated VGAM GENE, on one or more VGAM874 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM874 is inhibition of expression of host target genes, as part of a novel viral mechanism of attacking a host. Accordingly, utilities of VGAM874 include diagnosis, prevention and treatment of viral infection by Swinepox Virus. Specific functions, and accordingly utilities, of VGAM874 correlate with, and may be deduced from, the identity of the host target genes which VGAM874 binds and inhibits, and the function of these host target genes, as elaborated hereinbelow.

Nucleotide sequences of the VGAM874 precursor RNA, herein designated VGAM PRECURSOR RNA, and of the 'diced' VGAM874 RNA, herein designated VGAM RNA, and a schematic representation of the secondary folding of VGAM874 folded precursor RNA, herein designated VGAM FOLDED PRECURSOR RNA, of VGAM874 are further described hereinbelow with reference to Table 1.

Nucleotide sequences of host target binding sites, such as BINDING SITE-I, BINDING SITE-II and BINDING SITE-III of FIG. 1, found on VGAM874 host target RNA, and schematic representation of the complementarity of each of these host target binding sites to VGAM874 RNA, herein designated VGAM RNA, are described hereinbelow with reference to Table 2.

As mentioned hereinabove with reference to FIG. 1, a function of VGAM874 gene, herein designated VGAM is inhibition of expression of VGAM874 target genes. It is appreciated that specific functions, and accordingly utilities, of VGAM874 correlate with, and may be deduced from, the identity of the target genes which VGAM874 binds and inhibits, and the function of these target genes, as elaborated hereinbelow.

Gamma-aminobutyric Acid (GABA) A Receptor, Alpha 5 (GABRA5, Accession XM_012441) is a VGAM874 host target gene. GABRA5 BINDING SITE is HOST TARGET binding site found in the 3' untranslated region of mRNA encoded by GABRA5, corresponding to a HOST TARGET binding site such as BINDING SITE I, BINDING SITE II or BINDING SITE III. Table 2 illustrates the complementarity of the nucleotide sequences of GABRA5 BINDING SITE, designated SEQ ID:30213, to the nucleotide sequence of VGAM874 RNA, herein designated VGAM RNA, also designated SEQ ID:3585.

A function of VGAM874 is therefore inhibition of Gamma-aminobutyric Acid (GABA) A Receptor, Alpha 5 (GABRA5, Accession XM_012441), a gene which mediates neuronal inhibition by binding to the gaba/benzodiazepine receptor and opening an integral chloride channel. Accordingly, utilities of VGAM874 include diagnosis, prevention and treatment of diseases and clinical conditions associated with GABRA5. The function of GABRA5 has been established by previous studies. Papadimitriou et al. (1998) found an association between a 282-bp CA repeat in the gene encoding GABRA5 and bipolar affective disorder in 48 unrelated southern Greek patients but not in 50 healthy individuals drawn from the same population. No association was seen in another sample of 40 unipolar patients in the same specimen. Even though the authors applied the Bonferroni correction for the total numbers of genes tested, they cautioned that the level of significance in association studies is still a matter of debate. They believed that the 282-bp allele is unlikely to have functional significance but does not represent stratification in their sample. Rather, they considered that the allele may be in linkage disequilibrium with a functional mutation elsewhere in the GABRA5 gene or another gene in close proximity. Ritchie et al. (1998) reported a partial duplication of GABRA5 within the imprinted 15q11-q13 region. The duplicated locus mapped to the pericentromeric region of 15q, proximal to the large deletions associated Angelman and Prader-Willi syndromes. They also observed variation in the number of copies of this locus in different individuals, indicating that the duplication is part of the variable repeat. Investigation of the duplication in individuals with a normal karyotype revealed between 1 and 4 copies of the repeat on each chromosome 15, whereas from 8 to 20 copies were found in individuals possessing a cytogenetically detectable elongation of the 15q region. The variable region is roughly 1 Mb long and contains 2 other nonprocessed duplications, the immunoglobulin heavy chain (IgH) D segment gene (IGHD; 147170) on 14q and the neurofibromatosis type 1 gene (NF1; 162200) on chromosome 17. One unit of the pericentromeric repeat is thus composed of duplications of genes from different chromosomal regions. Ritchie et al. (1998) also found replication asynchrony across the GABRA5 duplication, suggesting for the first time that the imprinted part of chromosome 15q extends proximal of the region commonly deleted in Angelman and Prader-Willi syndromes.

Full details of the abovementioned studies are described in the following publications, the disclosure of which are hereby incorporated by reference:

Ritchie, R. J.; Mattei, M.-G.; Lalande, M.: A large polymorphic repeat in the pericentromeric region of human chromosome 15q contains three partial gene duplications. Hum. Molec. Genet. 7:1253-1260, 1998; and Papadimitriou, G. N.; Dikeos, D. G.; Karadima, G.; Avramopoulos, D.; Daskalopoulou, E. G.; Vassilopoulos, D.; Stefanis, C. N.: Association between the GABA-A receptor alpha-5 subunit ge.

Further studies establishing the function and utilities of GABRA5 are found in John Hopkins OMIM database record ID 137142, and in sited publications numbered 628-634 listed in the bibliography section hereinbelow, which are also hereby incorporated by reference. Hyaluronan Synthase 2 (HAS2, Accession NM_005328) is another VGAM874 host target gene. HAS2 BINDING SITE is HOST TARGET binding site found in the 3' untranslated region of mRNA encoded by HAS2, corresponding to a HOST TARGET binding site such as BINDING SITE I, BINDING SITE II or BINDING SITE III. Table 2 illustrates the complementarity of the nucleotide sequences of HAS2 BINDING SITE, designated SEQ ID:11800, to the nucleotide sequence of VGAM874 RNA, herein designated VGAM RNA, also designated SEQ ID:3585.

Another function of VGAM874 is therefore inhibition of Hyaluronan Synthase 2 (HAS2, Accession NM_005328), a gene which plays a role in hyaluronan/hyaluronic acid (ha) synthesis and transport. Accordingly, utilities of VGAM874 include diagnosis, prevention and treatment of diseases and clinical conditions associated with HAS2. The function of HAS2 has been established by previous studies. Hyaluronan, or hyaluronic acid (HA), is a high molecular weight unbranched polysaccharide of the extracellular matrix. Watanabe and Yamaguchi (1996) described the cloning of a human cDNA from a fibroblast library using degenerate PCR with primers based on regions of conservation between the previously published Xenopus DG42 and Streptococcus HasA proteins. When expressed in cell culture, the cDNA increased hyaluronan production. The sequence of the predicted 552-amino acid protein differs from HAS1 (OMIM Ref. No. 601463) and so was designated HAS2. The HAS2 amino acid sequence is 55% similar to the Xenopus DG42 sequence and 55% identical to mouse Has1. Northern blots showed high levels of HAS2 mRNA in a proliferating human fibroblast cell line but not in growth-arrested cells. Watanabe and Yamaguchi (1996) speculated that if HAS2 is not a true hyaluronan synthase, it is at least a major inducer of HA synthase activity. Spicer et al. (1996) isolated the apparent mouse homolog of human HAS2 from a mouse embryo cDNA library using degenerate PCR. The predicted mouse protein is also 552 amino acids long. The Has2 protein is predicted to contain multiple transmembrane domains similar to bacterial HasA and mammalian HAS1. Northern blots demonstrated 4.8- and 3.2-kb transcripts expressed highly in the mouse embryo and at lower levels in adult heart, brain, spleen, lung, and skeletal muscle. When expressed in COS cells, the cDNA was shown to induce the formation of large HA coats around the cells. Based on analogy with what is known about HA production in Streptococcus, Spicer et al. (1996) suggested that HAS2 may play a key role in HA transport rather than act as a synthase per se.

Full details of the abovementioned studies are described in the following publications, the disclosure of which are hereby incorporated by reference:

Watanabe, K.; Yamaguchi, Y.: Molecular identification of a putative human hyaluronan synthase. J. Biol. Chem. 271: 22945-22948, 1996; and Spicer, A. P.; Augustine, M. L.; McDonald, J. A.: Molecular cloning and characterization of a putative mouse hyaluronan synthase. J. Biol. Chem. 271: 23400-23406, 1996.

Further studies establishing the function and utilities of HAS2 are found in John Hopkins OMIM database record ID 601636, and in sited publications numbered 6682-2755 listed in the bibliography section hereinbelow, which are also hereby incorporated by reference. RalA Binding Protein 1 (RALBP1, Accession NM_006788) is another VGAM874 host target gene. RALBP1 BINDING SITE is HOST TARGET binding site found in the 3' untranslated region of mRNA encoded by RALBP1, corresponding to a HOST TARGET binding site such as BINDING SITE I, BINDING SITE II or BINDING SITE III. Table 2 illustrates the complementarity of the nucleotide sequences of RALBP1 BINDING SITE, designated SEQ ID:13656, to the nucleotide sequence of VGAM874 RNA, herein designated VGAM RNA, also designated SEQ ID:3585.

Another function of VGAM874 is therefore inhibition of RalA Binding Protein 1 (RALBP1, Accession NM_006788), a gene which plays a role in signal transduction and catalyzes the transport of glutathione conjugates and xenobiotics. Accordingly, utilities of VGAM874 include diagnosis, prevention and treatment of diseases and clinical conditions associated with RALBP1. The function of RALBP1 and its association with various diseases and clinical conditions, has been established by previous studies, as described hereinabove with reference to VGAM345. WTAP (Accession NM_004906) is another VGAM874 host target gene. WTAP BINDING SITE is HOST TARGET binding site found in the 3' untranslated region of mRNA encoded by WTAP, corresponding to a HOST TARGET binding site such as BINDING SITE I, BINDING SITE II or BINDING SITE III. Table 2 illustrates the complementarity of the nucleotide sequences of WTAP BINDING SITE, designated SEQ ID:11344, to the nucleotide sequence of VGAM874 RNA, herein designated VGAM RNA, also designated SEQ ID:3585.

Another function of VGAM874 is therefore inhibition of WTAP (Accession NM_004906), a gene which plays a role in both transcriptional and posttranscriptional regulation of certain cellular genes. Accordingly, utilities of VGAM874 include diagnosis, prevention and treatment of diseases and clinical conditions associated with WTAP. The function of WTAP has been established by previous studies. The Wilms tumor suppressor gene WT1 (OMIM Ref. No. 607102) appears to play a role in both transcriptional and posttranscriptional regulation of certain cellular genes. Little et al. (2000) used the yeast 2-hybrid system to identify a novel human WT1-associating protein, which they called WTAP, containing 388 amino acids. They also identified the mouse homolog and found that the 2 proteins share 96% sequence identity. Both in vitro and in vivo assays demonstrated a specific interaction between WTAP and WT1, which occurred endogenously in cells. The authors found that WTAP is a ubiquitously expressed nuclear protein which, like WT1, localized throughout the nucleoplasm as well as in speckles and partially colocalized with splicing factors. Using a panel of human-rodent hybrid cell lines, Nagase et al. (1995) mapped the WTAP gene, which they designated KIAA0105, to chromosome 6. By fluorescence in situ hybridization, Little et al. (2000) assigned the human WTAP gene to chromosome 6q25-q27 and the mouse homolog to a region of syntenic homology on chromosome 17

Full details of the abovementioned studies are described in the following publications, the disclosure of which are hereby incorporated by reference:

Little, N. A.; Hastie, N. D.; Davies, R. C.: Identification of WTAP, a novel Wilms' tumour 1-associating protein. Hum. Molec. Genet. 9:2231-2239, 2000; and Nagase, T.; Miyajima, N.; Tanaka, A.; Sazuka, T.; Seki, N.; Sato, S.; Tabata, S.; Ishikawa, K.; Kawarabayasi, Y.; Kotani, H.; Nomura, N.: Prediction of the coding sequences of unidenti.

Further studies establishing the function and utilities of WTAP are found in John Hopkins OMIM database record ID 605442, and in sited publications numbered 5025 listed in the bibliography section hereinbelow, which are also hereby incorporated by reference. Cysteine and Tyrosine-rich 1 (CYYR1, Accession NM_052954) is another VGAM874 host target gene. CYYR1 BINDING SITE is HOST TARGET binding site found in the 3' untranslated region of mRNA encoded by CYYR1, corresponding to a HOST TARGET binding site such as BINDING SITE I, BINDING SITE II or BINDING SITE III. Table 2 illustrates the complementarity of the nucleotide sequences of CYYR1 BINDING SITE, designated SEQ ID:27515, to the nucleotide sequence of VGAM874 RNA, herein designated VGAM RNA, also designated SEQ ID:3585.

Another function of VGAM874 is therefore inhibition of Cysteine and Tyrosine-rich 1 (CYYR1, Accession NM_052954). Accordingly, utilities of VGAM874 include diagnosis, prevention and treatment of diseases and clinical conditions associated with CYYR1. FLJ21945 (Accession NM_025203) is another VGAM874 host target gene. FLJ21945 BINDING SITE is HOST TARGET binding site found in the 3' untranslated region of mRNA encoded by FLJ21945, corresponding to a HOST TARGET binding site such as BINDING SITE I, BINDING SITE II or BINDING SITE III. Table 2 illustrates the complementarity of the nucleotide sequences of FLJ21945 BINDING SITE, designated SEQ ID:24867, to the nucleotide sequence of VGAM874 RNA, herein designated VGAM RNA, also designated SEQ ID:3585.

Another function of VGAM874 is therefore inhibition of FLJ21945 (Accession NM_025203). Accordingly, utilities of VGAM874 include diagnosis, prevention and treatment of diseases and clinical conditions associated with FLJ21945. HTEX4 (Accession XM_166378) is another VGAM874 host target gene. HTEX4 BINDING SITE1 through HTEX4 BINDING SITE3 are HOST TARGET binding sites found in untranslated regions of mRNA encoded by HTEX4, corresponding to HOST TARGET binding sites such as BINDING SITE I, BINDING SITE II or BINDING SITE III. Table 2 illustrates the complementarity of the nucleotide sequences of HTEX4 BINDING SITE1 through HTEX4 BINDING SITE3, designated SEQ ID:44214, SEQ ID:46650 and SEQ ID:46719 respectively, to the nucleotide sequence of VGAM874 RNA, herein designated VGAM RNA, also designated SEQ ID:3585.

Another function of VGAM874 is therefore inhibition of HTEX4 (Accession XM_166378). Accordingly, utilities of VGAM874 include diagnosis, prevention and treatment of diseases and clinical conditions associated with HTEX4. LOC147353 (Accession XM_097227) is another VGAM874 host target gene. LOC147353 BINDING SITE is HOST TARGET binding site found in the 3' untranslated region of mRNA encoded by LOC147353, corresponding to a HOST TARGET binding site such as BINDING SITE I, BINDING SITE II or BINDING SITE III. Table 2 illustrates the complementarity of the nucleotide sequences of LOC147353 BINDING SITE, designated SEQ ID:40837, to the nucleotide sequence of VGAM874 RNA, herein designated VGAM RNA, also designated SEQ ID:3585.

Another function of VGAM874 is therefore inhibition of LOC147353 (Accession XM_097227). Accordingly, utilities of VGAM874 include diagnosis, prevention and treatment of diseases and clinical conditions associated with LOC147353. LOC148530 (Accession XM_097480) is another VGAM874 host target gene. LOC148530 BINDING SITE is HOST TARGET binding site found in the 5' untranslated region of mRNA encoded by LOC148530, corresponding to a HOST TARGET binding site such as BINDING SITE I, BINDING SITE II or BINDING SITE III. Table 2 illustrates the complementarity of the nucleotide sequences of LOC148530 BINDING SITE, designated SEQ ID:40887, to the nucleotide sequence of VGAM874 RNA, herein designated VGAM RNA, also designated SEQ ID:3585.

Another function of VGAM874 is therefore inhibition of LOC148530 (Accession XM_097480). Accordingly, utilities of VGAM874 include diagnosis, prevention and treatment of diseases and clinical conditions associated with LOC148530. LOC149827 (Accession XM_097762) is another VGAM874 host target gene. LOC149827 BINDING SITE is HOST TARGET binding site found in the 5' untranslated region of mRNA encoded by LOC149827, corresponding to a HOST TARGET binding site such as BINDING SITE I, BINDING SITE II or BINDING SITE III. Table 2 illustrates the complementarity of the nucleotide sequences of LOC149827 BINDING SITE, designated SEQ ID:41111, to the nucleotide sequence of VGAM874 RNA, herein designated VGAM RNA, also designated SEQ ID:3585.

Another function of VGAM874 is therefore inhibition of LOC149827 (Accession XM_097762). Accordingly, utilities of VGAM874 include diagnosis, prevention and treatment of diseases and clinical conditions associated with LOC149827. LOC158490 (Accession XM_088585) is another VGAM874 host target gene. LOC158490 BINDING SITE is HOST TARGET binding site found in the 3' untranslated region of mRNA encoded by LOC158490, corresponding to a HOST TARGET binding site such as BINDING SITE I, BINDING SITE II or BINDING SITE III. Table 2 illustrates the complementarity of the nucleotide sequences of LOC158490 BINDING SITE, designated SEQ ID:39847, to the nucleotide sequence of VGAM874 RNA, herein designated VGAM RNA, also designated SEQ ID:3585.

Another function of VGAM874 is therefore inhibition of LOC158490 (Accession XM_088585). Accordingly, utilities of VGAM874 include diagnosis, prevention and treatment of diseases and clinical conditions associated with LOC158490. LOC196484 (Accession XM_031807) is another VGAM874 host target gene. LOC196484 BINDING SITE is HOST TARGET binding site found in the 5' untranslated region of mRNA encoded by LOC196484, corresponding to a HOST TARGET binding site such as BINDING SITE I, BINDING SITE II or BINDING SITE III. Table 2 illustrates the complementarity of the nucleotide sequences of LOC196484 BINDING SITE, designated SEQ ID:31484, to the nucleotide sequence of VGAM874 RNA, herein designated VGAM RNA, also designated SEQ ID:3585.

Another function of VGAM874 is therefore inhibition of LOC196484 (Accession XM_031807). Accordingly, utilities of VGAM874 include diagnosis, prevention and treatment of diseases and clinical conditions associated with LOC196484. LOC220073 (Accession XM_167847) is another VGAM874 host target gene. LOC220073 BINDING SITE is HOST TARGET binding site found in the 5' untranslated region of mRNA encoded by LOC220073, corresponding to a HOST TARGET binding site such as BINDING SITE I, BINDING SITE II or BINDING SITE III. Table 2 illustrates the complementarity of the nucleotide sequences of LOC220073 BINDING SITE, designated SEQ ID:44872, to the nucleotide sequence of VGAM874 RNA, herein designated VGAM RNA, also designated SEQ ID:3585.

Another function of VGAM874 is therefore inhibition of LOC220073 (Accession XM_167847). Accordingly, utilities of VGAM874 include diagnosis, prevention and treatment of diseases and clinical conditions associated with LOC220073. LOC222160 (Accession XM_168431) is another VGAM874 host target gene. LOC222160 BINDING SITE is HOST TARGET binding site found in the 5' untranslated region of mRNA encoded by LOC222160, corresponding to a HOST TARGET binding site such as BINDING SITE I, BINDING SITE II or BINDING SITE III. Table 2 illustrates the complementarity of the nucleotide sequences of LOC222160 BINDING SITE, designated SEQ ID:45164, to the nucleotide sequence of VGAM874 RNA, herein designated VGAM RNA, also designated SEQ ID:3585.

Another function of VGAM874 is therefore inhibition of LOC222160 (Accession XM_168431). Accordingly, utilities of VGAM874 include diagnosis, prevention and treatment of diseases and clinical conditions associated with LOC222160. LOC91069 (Accession XM_035824) is another VGAM874 host target gene. LOC91069 BINDING SITE is HOST TARGET binding site found in the 3' untranslated region of mRNA encoded by LOC91069, corresponding to a HOST TARGET binding site such as BINDING SITE I, BINDING SITE II or BINDING SITE III. Table 2 illustrates the complementarity of the nucleotide sequences of LOC91069 BINDING SITE, designated SEQ ID:32344, to the nucleotide sequence of VGAM874 RNA, herein designated VGAM RNA, also designated SEQ ID:3585.

Another function of VGAM874 is therefore inhibition of LOC91069 (Accession XM_035824). Accordingly, utilities of VGAM874 include diagnosis, prevention and treatment of diseases and clinical conditions associated with LOC91069.

FIG. 1 further provides a conceptual description of a novel bioinformatically detected viral gene of the present invention, referred to here as Viral Genomic Address Messenger 875 (VGAM875) viral gene, which modulates expression of respective host target genes thereof, the function and utility of which host target genes is known in the art.

VGAM875 is a novel bioinformatically detected regulatory, non protein coding, viral micro RNA (miRNA) gene. The method by which VGAM875 was detected is described hereinabove with reference to FIGS. 1-8.

VGAM875 gene, herein designated VGAM GENE, is a viral gene contained in the genome of Human Herpesvirus 5. VGAM875 host target gene, herein designated VGAM HOST TARGET GENE, is a human gene contained in the human genome.

VGAM875 gene encodes a VGAM875 precursor RNA, herein designated VGAM PRECURSOR RNA. Similar to other miRNA genes, and unlike most ordinary genes, VGAM875 precursor RNA does not encode a protein. A nucleotide sequence identical or highly similar to the nucleotide sequence of VGAM875 precursor RNA is designated SEQ ID:861, and is provided hereinbelow with reference to the sequence listing part. Nucleotide sequence SEQ ID:861 is located at position 28481 relative to the genome of Human Herpesvirus 5.

VGAM875 precursor RNA folds onto itself, forming VGAM875 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM875 folded precursor RNA into VGAM875 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM875 RNA is designated SEQ ID:3586, and is provided hereinbelow with reference to the sequence listing part.

VGAM875 host target gene, herein designated VGAM HOST TARGET GENE, encodes a corresponding messenger RNA, VGAM875 host target RNA, herein designated VGAM HOST TARGET RNA. VGAM875 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM875 RNA, herein designated VGAM RNA, binds complementarily to one or more host target binding sites located in untranslated regions of VGAM875 host target RNA, herein designated VGAM HOST TARGET RNA. This complementary binding is due to the fact that the nucleotide sequence of VGAM875 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM875 RNA, herein designated VGAM RNA, may have a different number of host target binding sites in untranslated regions of a VGAM875 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM875 RNA, herein designated VGAM RNA, to host target binding sites on VGAM875 host target RNA, herein designated VGAM HOST TARGET RNA, such as BINDING SITE I, BINDING SITE II and BINDING SITE III, inhibits translation of VGAM875 host target RNA into VGAM875 host target protein, herein designated VGAM HOST TARGET PROTEIN. VGAM host target protein is therefore outlined by a broken line.

It is appreciated that VGAM875 host target gene, herein designated VGAM HOST TARGET GENE, in fact represents a plurality of VGAM875 host target genes. The mRNA of each one of this plurality of VGAM875 host target genes comprises one or more host target binding sites, each having a nucleotide sequence which is at least partly complementary to VGAM875 RNA, herein designated VGAM RNA, and which when bound by VGAM875 RNA causes inhibition of translation of respective one or more VGAM875 host target proteins.

It is further appreciated by one skilled in the art that the mode of translational inhibition illustrated by FIG. 1 with specific reference to translational inhibition exerted by VGAM875 gene, herein designated VGAM GENE, on one or more VGAM875 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM875 is inhibition of expression of host target genes, as part of a novel viral mechanism of attacking a host. Accordingly, utilities of VGAM875 include diagnosis, prevention and treatment of viral infection by Human Herpesvirus 5. Specific functions, and accordingly utilities, of VGAM875 correlate with, and may be deduced from, the identity of the host target genes which VGAM875 binds and inhibits, and the function of these host target genes, as elaborated hereinbelow.

Nucleotide sequences of the VGAM875 precursor RNA, herein designated VGAM PRECURSOR RNA, and of the 'diced' VGAM875 RNA, herein designated VGAM RNA, and a schematic representation of the secondary folding of VGAM875 folded precursor RNA, herein designated VGAM FOLDED PRECURSOR RNA, of VGAM875 are further described hereinbelow with reference to Table 1.

Nucleotide sequences of host target binding sites, such as BINDING SITE-I, BINDING SITE-II and BINDING SITE-III of FIG. 1, found on VGAM875 host target RNA, and schematic representation of the complementarity of each of these host target binding sites to VGAM875 RNA, herein designated VGAM RNA, are described hereinbelow with reference to Table 2.

As mentioned hereinabove with reference to FIG. 1, a function of VGAM875 gene, herein designated VGAM is inhibition of expression of VGAM875 target genes. It is appreciated that specific functions, and accordingly utilities, of VGAM875 correlate with, and may be deduced from, the identity of the target genes which VGAM875 binds and inhibits, and the function of these target genes, as elaborated hereinbelow.

MGC10818 (Accession NM_030568) is a VGAM875 host target gene. MGC10818 BINDING SITE is HOST TARGET binding site found in the 3' untranslated region of mRNA encoded by MGC10818, corresponding to a HOST TARGET binding site such as BINDING SITE I, BINDING SITE II or BINDING SITE III. Table 2 illustrates the complementarity of the nucleotide sequences of MGC10818 BINDING SITE, designated SEQ ID:24942, to the nucleotide sequence of VGAM875 RNA, herein designated VGAM RNA, also designated SEQ ID:3586.

A function of VGAM875 is therefore inhibition of MGC10818 (Accession NM_030568). Accordingly, utilities of VGAM875 include diagnosis, prevention and treatment of diseases and clinical conditions associated with MGC10818. SV2B (Accession NM_014848) is another VGAM875 host target gene. SV2B BINDING SITE is HOST TARGET binding site found in the 3' untranslated region of mRNA encoded by SV2B, corresponding to a HOST TARGET binding site such as BINDING SITE I, BINDING SITE II or BINDING SITE III. Table 2 illustrates the complementarity of the nucleotide sequences of SV2B BINDING SITE, designated SEQ ID:16881, to the nucleotide sequence of VGAM875 RNA, herein designated VGAM RNA, also designated SEQ ID:3586.

Another function of VGAM875 is therefore inhibition of SV2B (Accession NM_014848). Accordingly, utilities of VGAM875 include diagnosis, prevention and treatment of diseases and clinical conditions associated with SV2B. FIG. 1 further provides a conceptual description of a novel bioinformatically detected viral gene of the present invention, referred to here as Viral Genomic Address Messenger 876 (VGAM876) viral gene, which modulates expression of respective host target genes thereof, the function and utility of which host target genes is known in the art.

VGAM876 is a novel bioinformatically detected regulatory, non protein coding, viral micro RNA (miRNA) gene. The method by which VGAM876 was detected is described hereinabove with reference to FIGS. 1-8.

VGAM876 gene, herein designated VGAM GENE, is a viral gene contained in the genome of Human Herpesvirus 5. VGAM876 host target gene, herein designated VGAM HOST TARGET GENE, is a human gene contained in the human genome.

VGAM876 gene encodes a VGAM876 precursor RNA, herein designated VGAM PRECURSOR RNA. Similar to other miRNA genes, and unlike most ordinary genes, VGAM876 precursor RNA does not encode a protein. A nucleotide sequence identical or highly similar to the nucleotide sequence of VGAM876 precursor RNA is designated SEQ ID:862, and is provided hereinbelow with reference to the sequence listing part. Nucleotide sequence SEQ ID:862 is located at position 29679 relative to the genome of Human Herpesvirus 5.

VGAM876 precursor RNA folds onto itself, forming VGAM876 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM876 folded precursor RNA into VGAM876 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM876 RNA is designated SEQ ID:3587, and is provided hereinbelow with reference to the sequence listing part.

VGAM876 host target gene, herein designated VGAM HOST TARGET GENE, encodes a corresponding messenger RNA, VGAM876 host target RNA, herein designated VGAM HOST TARGET RNA. VGAM876 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM876 RNA, herein designated VGAM RNA, binds complementarily to one or more host target binding sites located in untranslated regions of VGAM876 host target RNA, herein designated VGAM HOST TARGET RNA. This complementary binding is due to the fact that the nucleotide sequence of VGAM876 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM876 RNA, herein designated VGAM RNA, may have a different number of host target binding sites in untranslated regions of a VGAM876 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM876 RNA, herein designated VGAM RNA, to host target binding sites on VGAM876 host target RNA, herein designated VGAM HOST TARGET RNA, such as BINDING SITE I, BINDING SITE II and BINDING SITE III, inhibits translation of VGAM876 host target RNA into VGAM876 host target protein, herein designated VGAM HOST TARGET PROTEIN. VGAM host target protein is therefore outlined by a broken line.

It is appreciated that VGAM876 host target gene, herein designated VGAM HOST TARGET GENE, in fact represents a plurality of VGAM876 host target genes. The mRNA of each one of this plurality of VGAM876 host target genes comprises one or more host target binding sites, each having a nucleotide sequence which is at least partly complementary to VGAM876 RNA, herein designated VGAM RNA, and which when bound by VGAM876 RNA causes inhibition of translation of respective one or more VGAM876 host target proteins.

It is further appreciated by one skilled in the art that the mode of translational inhibition illustrated by FIG. 1 with specific reference to translational inhibition exerted by VGAM876 gene, herein designated VGAM GENE, on one or more VGAM876 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM876 is inhibition of expression of host target genes, as part of a novel viral mechanism of attacking a host. Accordingly, utilities of VGAM876 include diagnosis, prevention and treatment of viral infection by Human Herpesvirus 5. Specific functions, and accordingly utilities, of VGAM876 correlate with, and may be deduced from, the identity of the host target genes which VGAM876 binds and inhibits, and the function of these host target genes, as elaborated hereinbelow.

Nucleotide sequences of the VGAM876 precursor RNA, herein designated VGAM PRECURSOR RNA, and of the 'diced' VGAM876 RNA, herein designated VGAM RNA, and a schematic representation of the secondary folding of VGAM876 folded precursor RNA, herein designated VGAM FOLDED PRECURSOR RNA, of VGAM876 are further described hereinbelow with reference to Table 1.

Nucleotide sequences of host target binding sites, such as BINDING SITE-I, BINDING SITE-II and BINDING SITE-III of FIG. 1, found on VGAM876 host target RNA, and schematic representation of the complementarity of each of these host target binding sites to VGAM876 RNA, herein designated VGAM RNA, are described hereinbelow with reference to Table 2.

As mentioned hereinabove with reference to FIG. 1, a function of VGAM876 gene, herein designated VGAM is inhibition of expression of VGAM876 target genes. It is appreciated that specific functions, and accordingly utilities, of VGAM876 correlate with, and may be deduced from, the identity of the target genes which VGAM876 binds and inhibits, and the function of these target genes, as elaborated hereinbelow.

EH-domain Containing 2 (EHD2, Accession NM_014601) is a VGAM876 host target gene. EHD2 BINDING SITE is HOST TARGET binding site found in the 3' untranslated region of mRNA encoded by EHD2, corresponding to a HOST TARGET binding site such as BINDING SITE I, BINDING SITE II or BINDING SITE III. Table 2 illustrates the complementarity of the nucleotide sequences of EHD2 BINDING SITE, designated SEQ ID:15960, to the nucleotide sequence of VGAM876 RNA, herein designated VGAM RNA, also designated SEQ ID:3587.

A function of VGAM876 is therefore inhibition of EH-domain Containing 2 (EHD2, Accession NM_014601).

Accordingly, utilities of VGAM876 include diagnosis, prevention and treatment of diseases and clinical conditions associated with EHD2. LOC51289 (Accession NM_016568) is another VGAM876 host target gene. LOC51289 BINDING SITE is HOST TARGET binding site found in the 5' untranslated region of mRNA encoded by LOC51289, corresponding to a HOST TARGET binding site such as BINDING SITE I, BINDING SITE II or BINDING SITE III. Table 2 illustrates the complementarity of the nucleotide sequences of LOC51289 BINDING SITE, designated SEQ ID:18639, to the nucleotide sequence of VGAM876 RNA, herein designated VGAM RNA, also designated SEQ ID:3587.

Another function of VGAM876 is therefore inhibition of LOC51289 (Accession NM_016568). Accordingly, utilities of VGAM876 include diagnosis, prevention and treatment of diseases and clinical conditions associated with LOC51289. FIG. 1 further provides a conceptual description of a novel bioinformatically detected viral gene of the present invention, referred to here as Viral Genomic Address Messenger 877 (VGAM877) viral gene, which modulates expression of respective host target genes thereof, the function and utility of which host target genes is known in the art.

VGAM877 is a novel bioinformatically detected regulatory, non protein coding, viral micro RNA (miRNA) gene. The method by which VGAM877 was detected is described hereinabove with reference to FIGS. 1-8.

VGAM877 gene, herein designated VGAM GENE, is a viral gene contained in the genome of Human Herpesvirus 5. VGAM877 host target gene, herein designated VGAM HOST TARGET GENE, is a human gene contained in the human genome.

VGAM877 gene encodes a VGAM877 precursor RNA, herein designated VGAM PRECURSOR RNA. Similar to other miRNA genes, and unlike most ordinary genes, VGAM877 precursor RNA does not encode a protein. A nucleotide sequence identical or highly similar to the nucleotide sequence of VGAM877 precursor RNA is designated SEQ ID:863, and is provided hereinbelow with reference to the sequence listing part. Nucleotide sequence SEQ ID:863 is located at position 27633 relative to the genome of Human Herpesvirus 5.

VGAM877 precursor RNA folds onto itself, forming VGAM877 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM877 folded precursor RNA into VGAM877 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 79%) nucleotide sequence of VGAM877 RNA is designated SEQ ID:3588, and is provided hereinbelow with reference to the sequence listing part.

VGAM877 host target gene, herein designated VGAM HOST TARGET GENE, encodes a corresponding messenger RNA, VGAM877 host target RNA, herein designated VGAM HOST TARGET RNA. VGAM877 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM877 RNA, herein designated VGAM RNA, binds complementarily to one or more host target binding sites located in untranslated regions of VGAM877 host target RNA, herein designated VGAM HOST TARGET RNA. This complementary binding is due to the fact that the nucleotide sequence of VGAM877 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM877 RNA, herein designated VGAM RNA, may have a different number of host target binding sites in untranslated regions of a VGAM877 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM877 RNA, herein designated VGAM RNA, to host target binding sites on VGAM877 host target RNA, herein designated VGAM HOST TARGET RNA, such as BINDING SITE I, BINDING SITE II and BINDING SITE III, inhibits translation of VGAM877 host target RNA into VGAM877 host target protein, herein designated VGAM HOST TARGET PROTEIN. VGAM host target protein is therefore outlined by a broken line.

It is appreciated that VGAM877 host target gene, herein designated VGAM HOST TARGET GENE, in fact represents a plurality of VGAM877 host target genes. The mRNA of each one of this plurality of VGAM877 host target genes comprises one or more host target binding sites, each having a nucleotide sequence which is at least partly complementary to VGAM877 RNA, herein designated VGAM RNA, and which when bound by VGAM877 RNA causes inhibition of translation of respective one or more VGAM877 host target proteins.

It is further appreciated by one skilled in the art that the mode of translational inhibition illustrated by FIG. 1 with specific reference to translational inhibition exerted by VGAM877 gene, herein designated VGAM GENE, on one or more VGAM877 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM877 is inhibition of expression of host target genes, as part of a novel viral mechanism of attacking a host. Accordingly, utilities of VGAM877 include diagnosis, prevention and treatment of viral infection by Human Herpesvirus 5. Specific functions, and accordingly utilities, of VGAM877 correlate with, and may be deduced from, the identity of the host target genes which VGAM877 binds and inhibits, and the function of these host target genes, as elaborated hereinbelow.

Nucleotide sequences of the VGAM877 precursor RNA, herein designated VGAM PRECURSOR RNA, and of the 'diced' VGAM877 RNA, herein designated VGAM RNA, and a schematic representation of the secondary folding of VGAM877 folded precursor RNA, herein designated VGAM FOLDED PRECURSOR RNA, of VGAM877 are further described hereinbelow with reference to Table 1.

Nucleotide sequences of host target binding sites, such as BINDING SITE-I, BINDING SITE-II and BINDING SITE-III of FIG. 1, found on VGAM877 host target RNA, and schematic representation of the complementarity of each of these host target binding sites to VGAM877 RNA, herein designated VGAM RNA, are described hereinbelow with reference to Table 2.

As mentioned hereinabove with reference to FIG. 1, a function of VGAM877 gene, herein designated VGAM is inhibition of expression of VGAM877 target genes. It is appreciated that specific functions, and accordingly utilities, of VGAM877 correlate with, and may be deduced from, the identity of the target genes which VGAM877 binds and inhibits, and the function of these target genes, as elaborated hereinbelow.

Catenin (cadherin-associated protein), Alpha 2 (CTNNA2, Accession NM_004389) is a VGAM877 host target gene. CTNNA2 BINDING SITE is HOST TARGET binding site found in the 3' untranslated region of mRNA encoded by CTNNA2, corresponding to a HOST TARGET binding site such as BINDING SITE I, BINDING SITE II or BINDING SITE III. Table 2 illustrates the complementarity of the nucleotide sequences of CTNNA2 BINDING SITE, designated SEQ ID:10618, to the nucleotide sequence of VGAM877 RNA, herein designated VGAM RNA, also designated SEQ ID:3588.

A function of VGAM877 is therefore inhibition of Catenin (cadherin-associated protein), Alpha 2 (CTNNA2, Accession NM_004389), a gene which is involved in the cytoplasmic anchorage of cell-cell and cell-substrate adhesion molecules. Accordingly, utilities of VGAM877 include diagnosis, prevention and treatment of diseases and clinical conditions associated with CTNNA2. The function of CTNNA2 has been established by previous studies. Cell-cell and cell-matrix adhesions involve transmembrane glycoproteins such as cell adhesion molecules and integrins, which are thought to function via interactions of their cytoplasmic domains with proteins associated with the cytoskeleton. Vinculin (OMIM Ref. No. 193065) and talin (OMIM Ref. No. 186745) are examples. The activity of cadherins (e.g., 114020), which mediate homophilic cell-cell Ca (2+)-dependent association, depends on their anchorage to cytoskeleton via proteins termed catenins (Herrenknecht et al., 1991). Animal model experiments lend further support to the function of CTNNA2. Mice homozygous for the 'cerebellar-deficient folia' (cdf) mutation are ataxic and have cerebellar hypoplasia and abnormal lobulation of the cerebellum (Cook et al., 1997). In the cerebella of cdf/cdf homozygous mice, approximately 40% of Purkinje cells are located ectopically in the white matter and inner granule-cell layer. Many hippocampal pyramidal cells are scattered in the plexiform layers, and those that are correctly positioned are less densely packed than are cells in wildtype mice. Park et al. (2002) showed that fear conditioning and prepulse inhibition of the startle response are also disrupted in cdf/cdf mice. They identified a deletion on mouse chromosome 6 that removed approximately 150 kb of the cdf region. The deletion included part of Catna2, encoding alpha-N-catenin, a protein that links the classic cadherins to the neuronal cytoskeleton. Expression of a Catna2 transgene in cdf/cdf mice restored normal cerebellar and hippocampal morphology, prepulse inhibition, and fear conditioning. The findings suggested that catenin-cadherin cell-adhesion complexes are important in cerebellar and hippocampal lamination and in the control of startle modulation.

It is appreciated that the abovementioned animal model for CTNNA2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Claverie, J.-M.; Hardelin, J.-P.; Legouis, R.; Levilliers, J.; Bougueleret, L.; Mattei, M.-G.; Petit, C.: Characterization and chromosomal assignment of a human cDNA encoding a protein related to the murine 102-kDa cadherin-associated protein (alpha-catenin). Genomics 15:13-20, 1993; and Park, C.; Falls, W.; Finger, J. H.; Longo-Guess, C. M.; Ackerman, S. L.: Deletion in Catna2, encoding alpha-N-catenin, causes cerebellar and hippocampal lamination defects and impaired.

Further studies establishing the function and utilities of CTNNA2 are found in John Hopkins OMIM database record ID 114025, and in sited publications numbered 11654-11655, 982 and 11656-11657 listed in the bibliography section hereinbelow, which are also hereby incorporated by reference. Kallmann Syndrome 1 Sequence (KAL1, Accession NM_000216) is another VGAM877 host target gene. KAL1 BINDING SITE is HOST TARGET binding site found in the 3' untranslated region of mRNA encoded by KAL1, corresponding to a HOST TARGET binding site such as BINDING SITE I, BINDING SITE II or BINDING SITE III. Table 2 illustrates the complementarity of the nucleotide sequences of KAL1 BINDING SITE, designated SEQ ID:5716, to the nucleotide sequence of VGAM877 RNA, herein designated VGAM RNA, also designated SEQ ID:3588.

Another function of VGAM877 is therefore inhibition of Kallmann Syndrome 1 Sequence (KAL1, Accession NM_000216). Accordingly, utilities of VGAM877 include diagnosis, prevention and treatment of diseases and clinical conditions associated with KAL1. Nijmegen Breakage Syndrome 1 (nibrin) (NBS1, Accession XM_045343) is another VGAM877 host target gene. NBS1 BINDING SITE is HOST TARGET binding site found in the 3' untranslated region of mRNA encoded by NBS1, corresponding to a HOST TARGET binding site such as BINDING SITE I, BINDING SITE II or BINDING SITE III. Table 2 illustrates the complementarity of the nucleotide sequences of NBS1 BINDING SITE, designated SEQ ID:34436, to the nucleotide sequence of VGAM877 RNA, herein designated VGAM RNA, also designated SEQ ID:3588.

Another function of VGAM877 is therefore inhibition of Nijmegen Breakage Syndrome 1 (nibrin) (NBS1, Accession XM_045343), a gene which may be involved in repair of DNA double-strand breaks. Accordingly, utilities of VGAM877 include diagnosis, prevention and treatment of diseases and clinical conditions associated with NBS1. The function of NBS1 and its association with various diseases and clinical conditions, has been established by previous studies, as described hereinabove with reference to VGAM450. Oligophrenin 1 (OPHN1, Accession NM_002547) is another VGAM877 host target gene. OPHN1 BINDING SITE is HOST TARGET binding site found in the 3' untranslated region of mRNA encoded by OPHN1, corresponding to a HOST TARGET binding site such as BINDING SITE I, BINDING SITE II or BINDING SITE III. Table 2 illustrates the complementarity of the nucleotide sequences of OPHN1 BINDING SITE, designated SEQ ID:8403, to the nucleotide sequence of VGAM877 RNA, herein designated VGAM RNA, also designated SEQ ID:3588.

Another function of VGAM877 is therefore inhibition of Oligophrenin 1 (OPHN1, Accession NM_002547). Accordingly, utilities of VGAM877 include diagnosis, prevention and treatment of diseases and clinical conditions associated with OPHN1. A Kinase (PRKA) Anchor Protein 7 (AKAP7, Accession NM_004842) is another VGAM877 host target gene. AKAP7 BINDING SITE1 through AKAP7 BINDING SITE3 are HOST TARGET binding sites found in untranslated regions of mRNA encoded by AKAP7, corresponding to HOST TARGET binding sites such as BINDING SITE I, BINDING SITE II or BINDING SITE III. Table 2 illustrates the complementarity of the nucleotide sequences of AKAP7 BINDING SITE1 through AKAP7 BINDING SITE3, designated SEQ ID:11253, SEQ ID:18516 and SEQ ID:28906 respectively, to the nucleotide sequence of VGAM877 RNA, herein designated VGAM RNA, also designated SEQ ID:3588.

Another function of VGAM877 is therefore inhibition of A Kinase (PRKA) Anchor Protein 7 (AKAP7, Accession NM_004842). Accordingly, utilities of VGAM877 include diagnosis, prevention and treatment of diseases and clinical conditions associated with AKAP7. Histidyl-tRNA Synthetase-like (HARSL, Accession NM_012208) is another VGAM877 host target gene. HARSL BINDING SITE is HOST TARGET binding site found in the 3' untranslated region of mRNA encoded by HARSL, corresponding to a HOST TARGET binding site such as BINDING SITE I, BINDING SITE II or BINDING SITE III. Table 2 illustrates the complementarity of the nucleotide sequences of HARSL BINDING SITE, designated SEQ ID:14509, to the nucleotide sequence of VGAM877 RNA, herein designated VGAM RNA, also designated SEQ ID:3588.

Another function of VGAM877 is therefore inhibition of Histidyl-tRNA Synthetase-like (HARSL, Accession NM_012208). Accordingly, utilities of VGAM877 include diagnosis, prevention and treatment of diseases and clinical conditions associated with HARSL. KIAA1939 (Accession NM_024837) is another VGAM877 host target gene. KIAA1939 BINDING SITE is HOST TARGET binding site found in the 5' untranslated region of mRNA encoded by KIAA1939, corresponding to a HOST TARGET binding site such as BINDING SITE I, BINDING SITE II or BINDING SITE III. Table 2 illustrates the complementarity of the nucleotide sequences of KIAA1939 BINDING SITE, designated SEQ ID:24243, to the nucleotide sequence of VGAM877 RNA, herein designated VGAM RNA, also designated SEQ ID:3588.

Another function of VGAM877 is therefore inhibition of KIAA1939 (Accession NM_024837). Accordingly, utilities of VGAM877 include diagnosis, prevention and treatment of diseases and clinical conditions associated with KIAA1939. LOC144699 (Accession XM_084940) is another VGAM877 host target gene. LOC144699 BINDING SITE is HOST TARGET binding site found in the 3' untranslated region of mRNA encoded by LOC144699, corresponding to a HOST TARGET binding site such as BINDING SITE I, BINDING SITE II or BINDING SITE III. Table 2 illustrates the complementarity of the nucleotide sequences of LOC144699 BINDING SITE, designated SEQ ID:37769, to the nucleotide sequence of VGAM877 RNA, herein designated VGAM RNA, also designated SEQ ID:3588.

Another function of VGAM877 is therefore inhibition of LOC144699 (Accession XM_084940). Accordingly, utilities of VGAM877 include diagnosis, prevention and treatment of diseases and clinical conditions associated with LOC144699.

FIG. 1 further provides a conceptual description of a novel bioinformatically detected viral gene of the present invention, referred to here as Viral Genomic Address Messenger 878 (VGAM878) viral gene, which modulates expression of respective host target genes thereof, the function and utility of which host target genes is known in the art.

VGAM878 is a novel bioinformatically detected regulatory, non protein coding, viral micro RNA (miRNA) gene. The method by which VGAM878 was detected is described hereinabove with reference to FIGS. 1-8.

VGAM878 gene, herein designated VGAM GENE, is a viral gene contained in the genome of Swinepox Virus. VGAM878 host target gene, herein designated VGAM HOST TARGET GENE, is a human gene contained in the human genome.

VGAM878 gene encodes a VGAM878 precursor RNA, herein designated VGAM PRECURSOR RNA. Similar to other miRNA genes, and unlike most ordinary genes, VGAM878 precursor RNA does not encode a protein. A nucleotide sequence identical or highly similar to the nucleotide sequence of VGAM878 precursor RNA is designated SEQ ID:864, and is provided hereinbelow with reference to the sequence listing part. Nucleotide sequence SEQ ID:864 is located at position 106591 relative to the genome of Swinepox Virus.

VGAM878 precursor RNA folds onto itself, forming VGAM878 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM878 folded precursor RNA into VGAM878 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM878 RNA is designated SEQ ID:3589, and is provided hereinbelow with reference to the sequence listing part.

VGAM878 host target gene, herein designated VGAM HOST TARGET GENE, encodes a corresponding messenger RNA, VGAM878 host target RNA, herein designated VGAM HOST TARGET RNA. VGAM878 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM878 RNA, herein designated VGAM RNA, binds complementarily to one or more host target binding sites located in untranslated regions of VGAM878 host target RNA, herein designated VGAM HOST TARGET RNA. This complementary binding is due to the fact that the nucleotide sequence of VGAM878 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM878 RNA, herein designated VGAM RNA, may have a different number of host target binding sites in untranslated regions of a VGAM878 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM878 RNA, herein designated VGAM RNA, to host target binding sites on VGAM878 host target RNA, herein designated VGAM HOST TARGET RNA, such as BINDING SITE I, BINDING SITE II and BINDING SITE III, inhibits translation of VGAM878 host target RNA into VGAM878 host target protein, herein designated VGAM HOST TARGET PROTEIN. VGAM host target protein is therefore outlined by a broken line.

It is appreciated that VGAM878 host target gene, herein designated VGAM HOST TARGET GENE, in fact represents a plurality of VGAM878 host target genes. The mRNA of each one of this plurality of VGAM878 host target genes comprises one or more host target binding sites, each having a nucleotide sequence which is at least partly complementary to VGAM878 RNA, herein designated VGAM RNA, and which when bound by VGAM878 RNA causes inhibition of translation of respective one or more VGAM878 host target proteins.

It is further appreciated by one skilled in the art that the mode of translational inhibition illustrated by FIG. 1 with specific reference to translational inhibition exerted by VGAM878 gene, herein designated VGAM GENE, on one or more VGAM878 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM878 is inhibition of expression of host target genes, as part of a novel viral mechanism of attacking a host. Accordingly, utilities of VGAM878 include diagnosis, prevention and treatment of viral infection by Swinepox Virus. Specific functions, and accordingly utilities, of VGAM878 correlate with, and may be deduced from, the identity of the host target genes which VGAM878 binds and inhibits, and the function of these host target genes, as elaborated hereinbelow.

Nucleotide sequences of the VGAM878 precursor RNA, herein designated VGAM PRECURSOR RNA, and of the 'diced' VGAM878 RNA, herein designated VGAM RNA, and a schematic representation of the secondary folding of VGAM878 folded precursor RNA, herein designated VGAM FOLDED PRECURSOR RNA, of VGAM878 are further described hereinbelow with reference to Table 1.

Nucleotide sequences of host target binding sites, such as BINDING SITE-I, BINDING SITE-II and BINDING SITE-III of FIG. 1, found on VGAM878 host target RNA, and schematic representation of the complementarity of each of these host target binding sites to VGAM878 RNA, herein designated VGAM RNA, are described hereinbelow with reference to Table 2.

As mentioned hereinabove with reference to FIG. 1, a function of VGAM878 gene, herein designated VGAM is inhibition of expression of VGAM878 target genes. It is appreciated that specific functions, and accordingly utilities, of VGAM878 correlate with, and may be deduced from, the identity of the target genes which VGAM878 binds and inhibits, and the function of these target genes, as elaborated hereinbelow.

Protocadherin Beta 8 (PCDHB8, Accession NM_019120) is a VGAM878 host target gene. PCDHB8 BINDING SITE is HOST TARGET binding site found in the 5' untranslated region of mRNA encoded by PCDHB8, corresponding to a HOST TARGET binding site such as BINDING SITE I, BINDING SITE II or BINDING SITE III. Table 2 illustrates the complementarity of the nucleotide sequences of PCDHB8 BINDING SITE, designated SEQ ID:21207, to the nucleotide sequence of VGAM878 RNA, herein designated VGAM RNA, also designated SEQ ID:3589.

A function of VGAM878 is therefore inhibition of Protocadherin Beta 8 (PCDHB8, Accession NM_019120). Accordingly, utilities of VGAM878 include diagnosis, prevention and treatment of diseases and clinical conditions associated with PCDHB8. LOC145871 (Accession XM_096897) is another VGAM878 host target gene. LOC145871 BINDING SITE is HOST TARGET binding site found in the 5' untranslated region of mRNA encoded by LOC145871, corresponding to a HOST TARGET binding site such as BINDING SITE I, BINDING SITE II or BINDING SITE III. Table 2 illustrates the complementarity of the nucleotide sequences of LOC145871 BINDING SITE, designated SEQ ID:40622, to the nucleotide sequence of VGAM878 RNA, herein designated VGAM RNA, also designated SEQ ID:3589.

Another function of VGAM878 is therefore inhibition of LOC145871 (Accession XM_096897). Accordingly, utilities of VGAM878 include diagnosis, prevention and treatment of diseases and clinical conditions associated with LOC145871. FIG. 1 further provides a conceptual description of a novel bioinformatically detected viral gene of the present invention, referred to here as Viral Genomic Address Messenger 879 (VGAM879) viral gene, which modulates expression of respective host target genes thereof, the function and utility of which host target genes is known in the art.

VGAM879 is a novel bioinformatically detected regulatory, non protein coding, viral micro RNA (miRNA) gene. The method by which VGAM879 was detected is described hereinabove with reference to FIGS. 1-8.

VGAM879 gene, herein designated VGAM GENE, is a viral gene contained in the genome of Amsacta Moorei Entomopoxvirus. VGAM879 host target gene, herein designated VGAM HOST TARGET GENE, is a human gene contained in the human genome.

VGAM879 gene encodes a VGAM879 precursor RNA, herein designated VGAM PRECURSOR RNA. Similar to other miRNA genes, and unlike most ordinary genes, VGAM879 precursor RNA does not encode a protein. A nucleotide sequence identical or highly similar to the nucleotide sequence of VGAM879 precursor RNA is designated SEQ ID:865, and is provided hereinbelow with reference to the sequence listing part. Nucleotide sequence SEQ ID:865 is located at position 137324 relative to the genome of Amsacta Moorei Entomopoxvirus.

VGAM879 precursor RNA folds onto itself, forming VGAM879 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM879 folded precursor RNA into VGAM879 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM879 RNA is designated SEQ ID:3590, and is provided hereinbelow with reference to the sequence listing part.

VGAM879 host target gene, herein designated VGAM HOST TARGET GENE, encodes a corresponding messenger RNA, VGAM879 host target RNA, herein designated VGAM HOST TARGET RNA. VGAM879 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM879 RNA, herein designated VGAM RNA, binds complementarily to one or more host target binding sites located in untranslated regions of VGAM879 host target RNA, herein designated VGAM HOST TARGET RNA. This complementary binding is due to the fact that the nucleotide sequence of VGAM879 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM879 RNA, herein designated VGAM RNA, may have a different number of host target binding sites in untranslated regions of a VGAM879 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM879 RNA, herein designated VGAM RNA, to host target binding sites on VGAM879 host target RNA, herein designated VGAM HOST TARGET RNA, such as BINDING SITE I, BINDING SITE II and BINDING SITE III, inhibits translation of VGAM879 host target RNA into VGAM879 host target protein, herein designated VGAM HOST TARGET PROTEIN. VGAM host target protein is therefore outlined by a broken line.

It is appreciated that VGAM879 host target gene, herein designated VGAM HOST TARGET GENE, in fact represents a plurality of VGAM879 host target genes. The mRNA of each one of this plurality of VGAM879 host target genes comprises one or more host target binding sites, each having a nucleotide sequence which is at least partly complementary to VGAM879 RNA, herein designated VGAM RNA, and which when bound by VGAM879 RNA causes inhibition of translation of respective one or more VGAM879 host target proteins.

It is further appreciated by one skilled in the art that the mode of translational inhibition illustrated by FIG. 1 with specific reference to translational inhibition exerted by VGAM879 gene, herein designated VGAM GENE, on one or more VGAM879 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM879 is inhibition of expression of host target genes, as part of a novel viral mechanism of attacking a host. Accordingly, utilities of VGAM879 include diagnosis, prevention and treatment of viral infection by Amsacta Moorei Entomopoxvirus. Specific functions, and accordingly utilities, of VGAM879 correlate with, and may be deduced from, the identity of the host target genes which VGAM879 binds and inhibits, and the function of these host target genes, as elaborated hereinbelow.

Nucleotide sequences of the VGAM879 precursor RNA, herein designated VGAM PRECURSOR RNA, and of the 'diced' VGAM879 RNA, herein designated VGAM RNA, and a schematic representation of the secondary folding of VGAM879 folded precursor RNA, herein designated VGAM FOLDED PRECURSOR RNA, of VGAM879 are further described hereinbelow with reference to Table 1.

Nucleotide sequences of host target binding sites, such as BINDING SITE-I, BINDING SITE-II and BINDING SITE-III of FIG. 1, found on VGAM879 host target RNA, and schematic representation of the complementarity of each of these host target binding sites to VGAM879 RNA, herein designated VGAM RNA, are described hereinbelow with reference to Table 2.

As mentioned hereinabove with reference to FIG. 1, a function of VGAM879 gene, herein designated VGAM is inhibition of expression of VGAM879 target genes. It is appreciated that specific functions, and accordingly utilities, of VGAM879 correlate with, and may be deduced from, the identity of the target genes which VGAM879 binds and inhibits, and the function of these target genes, as elaborated hereinbelow.

KIAA0256 (Accession XM_034905) is a VGAM879 host target gene. KIAA0256 BINDING SITE is HOST TARGET binding site found in the 3' untranslated region of mRNA encoded by KIAA0256, corresponding to a HOST TARGET binding site such as BINDING SITE I, BINDING SITE II or BINDING SITE III. Table 2 illustrates the complementarity of the nucleotide sequences of KIAA0256 BINDING SITE, designated SEQ ID:32184, to the nucleotide sequence of VGAM879 RNA, herein designated VGAM RNA, also designated SEQ ID:3590.

A function of VGAM879 is therefore inhibition of KIAA0256 (Accession XM_034905). Accordingly, utilities of VGAM879 include diagnosis, prevention and treatment of diseases and clinical conditions associated with KIAA0256. TOLLIP (Accession NM_019009) is another VGAM879 host target gene. TOLLIP BINDING SITE is HOST TARGET binding site found in the 3' untranslated region of mRNA encoded by TOLLIP, corresponding to a HOST TARGET binding site such as BINDING SITE I, BINDING SITE II or BINDING SITE III. Table 2 illustrates the complementarity of the nucleotide sequences of TOLLIP BINDING SITE, designated SEQ ID:21094, to the nucleotide sequence of VGAM879 RNA, herein designated VGAM RNA, also designated SEQ ID:3590.

Another function of VGAM879 is therefore inhibition of TOLLIP (Accession NM_019009). Accordingly, utilities of VGAM879 include diagnosis, prevention and treatment of diseases and clinical conditions associated with TOLLIP. LOC133744 (Accession XM_059669) is another VGAM879 host target gene. LOC133744 BINDING SITE is HOST TARGET binding site found in the 5' untranslated region of mRNA encoded by LOC133744, corresponding to a HOST TARGET binding site such as BINDING SITE I, BINDING SITE II or BINDING SITE III. Table 2 illustrates the complementarity of the nucleotide sequences of LOC133744 BINDING SITE, designated SEQ ID:37059, to the nucleotide sequence of VGAM879 RNA, herein designated VGAM RNA, also designated SEQ ID:3590.

Another function of VGAM879 is therefore inhibition of LOC133744 (Accession XM_059669). Accordingly, utilities of VGAM879 include diagnosis, prevention and treatment of diseases and clinical conditions associated with LOC133744. LOC203369 (Accession XM_114689) is another VGAM879 host target gene. LOC203369 BINDING SITE is HOST TARGET binding site found in the 3' untranslated region of mRNA encoded by LOC203369, corresponding to a HOST TARGET binding site such as BINDING SITE I, BINDING SITE II or BINDING SITE III. Table 2 illustrates the complementarity of the nucleotide sequences of LOC203369 BINDING SITE, designated SEQ ID:43031, to the nucleotide sequence of VGAM879 RNA, herein designated VGAM RNA, also designated SEQ ID:3590.

Another function of VGAM879 is therefore inhibition of LOC203369 (Accession XM_114689). Accordingly, utilities of VGAM879 include diagnosis, prevention and treatment of diseases and clinical conditions associated with LOC203369. FIG. 1 further provides a conceptual description of a novel bioinformatically detected viral gene of the present invention, referred to here as Viral Genomic Address Messenger 880 (VGAM880) viral gene, which modulates expression of respective host target genes thereof, the function and utility of which host target genes is known in the art.

VGAM880 is a novel bioinformatically detected regulatory, non protein coding, viral micro RNA (miRNA) gene. The method by which VGAM880 was detected is described hereinabove with reference to FIGS. 1-8.

VGAM880 gene, herein designated VGAM GENE, is a viral gene contained in the genome of Gallid Herpesvirus 3. VGAM880 host target gene, herein designated VGAM HOST TARGET GENE, is a human gene contained in the human genome.

VGAM880 gene encodes a VGAM880 precursor RNA, herein designated VGAM PRECURSOR RNA. Similar to other miRNA genes, and unlike most ordinary genes, VGAM880 precursor RNA does not encode a protein. A nucleotide sequence identical or highly similar to the nucleotide sequence of VGAM880 precursor RNA is designated SEQ ID:866, and is provided hereinbelow with reference to the sequence listing part. Nucleotide sequence SEQ ID:866 is located at position 52351 relative to the genome of Gallid Herpesvirus 3.

VGAM880 precursor RNA folds onto itself, forming VGAM880 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM880 folded precursor RNA into VGAM880 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM880 RNA is designated SEQ ID:3591, and is provided hereinbelow with reference to the sequence listing part.

VGAM880 host target gene, herein designated VGAM HOST TARGET GENE, encodes a corresponding messenger RNA, VGAM880 host target RNA, herein designated VGAM HOST TARGET RNA. VGAM880 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM880 RNA, herein designated VGAM RNA, binds complementarily to one or more host target binding sites located in untranslated regions of VGAM880 host target RNA, herein designated VGAM HOST TARGET RNA. This complementary binding is due to the fact that the nucleotide sequence of VGAM880 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM880 RNA, herein designated VGAM RNA, may have a different number of host target binding sites in untranslated regions of a VGAM880 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM880 RNA, herein designated VGAM RNA, to host target binding sites on VGAM880 host target RNA, herein designated VGAM HOST TARGET RNA, such as BINDING SITE I, BINDING SITE II and BINDING SITE III, inhibits translation of VGAM880 host target RNA into VGAM880 host target protein, herein designated VGAM HOST TARGET PROTEIN. VGAM host target protein is therefore outlined by a broken line.

It is appreciated that VGAM880 host target gene, herein designated VGAM HOST TARGET GENE, in fact represents a plurality of VGAM880 host target genes. The mRNA of each one of this plurality of VGAM880 host target genes comprises one or more host target binding sites, each having a nucleotide sequence which is at least partly complementary to VGAM880 RNA, herein designated VGAM RNA, and which when bound by VGAM880 RNA causes inhibition of translation of respective one or more VGAM880 host target proteins.

It is further appreciated by one skilled in the art that the mode of translational inhibition illustrated by FIG. 1 with specific reference to translational inhibition exerted by VGAM880 gene, herein designated VGAM GENE, on one or more VGAM880 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM880 is inhibition of expression of host target genes, as part of a novel viral mechanism of attacking a host. Accordingly, utilities of VGAM880 include diagnosis, prevention and treatment of viral infection by Gallid Herpesvirus 3. Specific functions, and accordingly utilities, of VGAM880 correlate with, and may be deduced from, the identity of the host target genes which VGAM880 binds and inhibits, and the function of these host target genes, as elaborated hereinbelow.

Nucleotide sequences of the VGAM880 precursor RNA, herein designated VGAM PRECURSOR RNA, and of the 'diced' VGAM880 RNA, herein designated VGAM RNA, and a schematic representation of the secondary folding of VGAM880 folded precursor RNA, herein designated VGAM FOLDED PRECURSOR RNA, of VGAM880 are further described hereinbelow with reference to Table 1.

Nucleotide sequences of host target binding sites, such as BINDING SITE-I, BINDING SITE-II and BINDING SITE-III of FIG. 1, found on VGAM880 host target RNA, and schematic representation of the complementarity of each of these host target binding sites to VGAM880 RNA, herein designated VGAM RNA, are described hereinbelow with reference to Table 2.

As mentioned hereinabove with reference to FIG. 1, a function of VGAM880 gene, herein designated VGAM is inhibition of expression of VGAM880 target genes. It is appreciated that specific functions, and accordingly utilities, of VGAM880 correlate with, and may be deduced from, the identity of the target genes which VGAM880 binds and inhibits, and the function of these target genes, as elaborated hereinbelow.

Chloride Channel, Calcium Activated, Family Member 3 (CLCA3, Accession NM_004921) is a VGAM880 host target gene. CLCA3 BINDING SITE is HOST TARGET binding site found in the 3' untranslated region of mRNA encoded by CLCA3, corresponding to a HOST TARGET binding site such as BINDING SITE I, BINDING SITE II or BINDING SITE III. Table 2 illustrates the complementarity of the nucleotide sequences of CLCA3 BINDING SITE, designated SEQ ID:11355, to the nucleotide sequence of VGAM880 RNA, herein designated VGAM RNA, also designated SEQ ID:3591.

A function of VGAM880 is therefore inhibition of Chloride Channel, Calcium Activated, Family Member 3 (CLCA3, Accession NM_004921), a gene which is similar to calcium-activated chloride channel family. Accordingly, utilities of VGAM880 include diagnosis, prevention and treatment of diseases and clinical conditions associated with CLCA3. The function of CLCA3 and its association with various diseases and clinical conditions, has been established by previous studies, as described hereinabove with reference to VGAM595. Engulfment and Cell Motility 2 (ced-12 homolog, C. elegans) (ELMO2, Accession NM_133171) is another VGAM880 host target gene. ELMO2 BINDING SITE is HOST TARGET binding site found in the 3' untranslated region of mRNA encoded by ELMO2, corresponding to a HOST TARGET binding site such as BINDING SITE I, BINDING SITE II or BINDING SITE III. Table 2 illustrates the complementarity of the nucleotide sequences of ELMO2 BINDING SITE, designated SEQ ID:28394, to the nucleotide sequence of VGAM880 RNA, herein designated VGAM RNA, also designated SEQ ID:3591.

Another function of VGAM880 is therefore inhibition of Engulfment and Cell Motility 2 (ced-12 homolog, C. elegans) (ELMO2, Accession NM_133171). Accordingly, utilities of VGAM880 include diagnosis, prevention and treatment of diseases and clinical conditions associated with ELMO2. LFG (Accession XM_084780) is another VGAM880 host target gene. LFG BINDING SITE is HOST TARGET binding site found in the 3' untranslated region of mRNA encoded by LFG, corresponding to a HOST TARGET binding site such as BINDING SITE I, BINDING SITE II or BINDING SITE III. Table 2 illustrates the complementarity of the nucleotide sequences of LFG BINDING SITE, designated SEQ ID:37690, to the nucleotide sequence of VGAM880 RNA, herein designated VGAM RNA, also designated SEQ ID:3591.

Another function of VGAM880 is therefore inhibition of LFG (Accession XM_084780). Accordingly, utilities of VGAM880 include diagnosis, prevention and treatment of diseases and clinical conditions associated with LFG. Steroid-5-alpha-reductase, Alpha Polypeptide 1 (3-oxo-5 alpha-steroid delta 4-dehydrogenase alpha 1) (SRD5A1, Accession NM_001047) is another VGAM880 host target gene. SRD5A1 BINDING SITE is HOST TARGET binding site found in the 3' untranslated region of mRNA encoded by SRD5A1, corresponding to a HOST TARGET binding site such as BINDING SITE I, BINDING SITE II or BINDING SITE III. Table 2 illustrates the complementarity of the nucleotide sequences of SRD5A1 BINDING SITE, designated SEQ ID:6717, to the nucleotide sequence of VGAM880 RNA, herein designated VGAM RNA, also designated SEQ ID:3591.

Another function of VGAM880 is therefore inhibition of Steroid-5-alpha-reductase, Alpha Polypeptide 1 (3-oxo-5 alpha-steroid delta 4-dehydrogenase alpha 1) (SRD5A1, Accession NM_001047), a gene which catalyzes the conversion of testosterone into 5-alpha-dihydrotestosterone and progesterone. Accordingly, utilities of VGAM880 include diagnosis, prevention and treatment of diseases and clinical conditions associated with SRD5A1. The function of SRD5A1 and its association with various diseases and clinical conditions, has been established by previous studies, as described hereinabove with reference to VGAM749. Di-Ras2 (Accession NM_017594) is another VGAM880 host target gene. Di-Ras2 BINDING SITE is HOST TARGET binding site found in the 3' untranslated region of mRNA encoded by Di-Ras2, corresponding to a HOST TARGET binding site such as BINDING SITE I, BINDING SITE II or BINDING SITE III. Table 2 illustrates the complementarity of the nucleotide sequences of Di-Ras2 BINDING SITE, designated SEQ ID:19047, to the nucleotide sequence of VGAM880 RNA, herein designated VGAM RNA, also designated SEQ ID:3591.

Another function of VGAM880 is therefore inhibition of Di-Ras2 (Accession NM_017594). Accordingly, utilities of VGAM880 include diagnosis, prevention and treatment of diseases and clinical conditions associated with Di-Ras2. FLJ12700 (Accession NM_024910) is another VGAM880 host target gene. FLJ12700 BINDING SITE is HOST TARGET binding site found in the 3' untranslated region of mRNA encoded by FLJ12700, corresponding to a HOST TARGET binding site such as BINDING SITE I, BINDING SITE II or BINDING SITE III. Table 2 illustrates the complementarity of the nucleotide sequences of FLJ12700 BINDING SITE, designated SEQ ID:24417, to the nucleotide sequence of VGAM880 RNA, herein designated VGAM RNA, also designated SEQ ID:3591.

Another function of VGAM880 is therefore inhibition of FLJ12700 (Accession NM_024910). Accordingly, utilities of VGAM880 include diagnosis, prevention and treatment of diseases and clinical conditions associated with FLJ12700. KIAA0427 (Accession NM_014772) is another VGAM880 host target gene. KIAA0427 BINDING SITE is HOST TARGET binding site found in the 3' untranslated region of mRNA encoded by KIAA0427, corresponding to a HOST TARGET binding site such as BINDING SITE I, BINDING SITE II or BINDING SITE III. Table 2 illustrates the complementarity of the nucleotide sequences of KIAA0427 BINDING SITE, designated SEQ ID:16581, to the nucleotide sequence of VGAM880 RNA, herein designated VGAM RNA, also designated SEQ ID:3591.

Another function of VGAM880 is therefore inhibition of KIAA0427 (Accession NM_014772). Accordingly, utilities of VGAM880 include diagnosis, prevention and treatment of diseases and clinical conditions associated with KIAA0427. KIAA1223 (Accession XM_048747) is another VGAM880 host target gene. KIAA1223 BINDING SITE is HOST TARGET binding site found in the 3' untranslated region of mRNA encoded by KIAA1223, corresponding to a HOST TARGET binding site such as BINDING SITE I, BINDING SITE II or BINDING SITE III. Table 2 illustrates the complementarity of the nucleotide sequences of KIAA1223 BINDING SITE, designated SEQ ID:35250, to the nucleotide sequence of VGAM880 RNA, herein designated VGAM RNA, also designated SEQ ID:3591.

Another function of VGAM880 is therefore inhibition of KIAA1223 (Accession XM_048747). Accordingly, utilities of VGAM880 include diagnosis, prevention and treatment of diseases and clinical conditions associated with KIAA1223. KIAA1383 (Accession XM_045859) is another VGAM880 host target gene. KIAA1383 BINDING SITE is HOST TARGET binding site found in the 3' untranslated region of mRNA encoded by KIAA1383, corresponding to a HOST TARGET binding site such as BINDING SITE I, BINDING SITE II or BINDING SITE III. Table 2 illustrates the complementarity of the nucleotide sequences of KIAA1383 BINDING SITE, designated SEQ ID:34586, to the nucleotide sequence of VGAM880 RNA, herein designated VGAM RNA, also designated SEQ ID:3591.

Another function of VGAM880 is therefore inhibition of KIAA1383 (Accession XM_045859). Accordingly, utilities of VGAM880 include diagnosis, prevention and treatment of diseases and clinical conditions associated with KIAA1383. KIAA1872 (Accession XM_031917) is another VGAM880 host target gene. KIAA1872 BINDING SITE is HOST TARGET binding site found in the 3' untranslated region of mRNA encoded by KIAA1872, corresponding to a HOST TARGET binding site such as BINDING SITE I, BINDING SITE II or BINDING SITE III. Table 2 illustrates the complementarity of the nucleotide sequences of KIAA1872 BINDING SITE, designated SEQ ID:31524, to the nucleotide sequence of VGAM880 RNA, herein designated VGAM RNA, also designated SEQ ID:3591.

Another function of VGAM880 is therefore inhibition of KIAA1872 (Accession XM_031917). Accordingly, utilities of VGAM880 include diagnosis, prevention and treatment of diseases and clinical conditions associated with KIAA1872. TAF2 RNA Polymerase II, TATA Box Binding Protein (TBP)-associated Factor, 150 kDa (TAF2, Accession NM_003184) is another VGAM880 host target gene. TAF2 BINDING SITE is HOST TARGET binding site found in the 3' untranslated region of mRNA encoded by TAF2, corresponding to a HOST TARGET binding site such as BINDING SITE I, BINDING SITE II or BINDING SITE III. Table 2 illustrates the complementarity of the nucleotide sequences of TAF2 BINDING SITE, designated SEQ ID:9159, to the nucleotide sequence of VGAM880 RNA, herein designated VGAM RNA, also designated SEQ ID:3591.

Another function of VGAM880 is therefore inhibition of TAF2 RNA Polymerase II, TATA Box Binding Protein (TBP)-associated Factor, 150 kDa (TAF2, Accession NM_003184). Accordingly, utilities of VGAM880 include diagnosis, prevention and treatment of diseases and clinical conditions associated with TAF2. LOC144262 (Accession XM_084793) is another VGAM880 host target gene. LOC144262 BINDING SITE is HOST TARGET binding site found in the 5' untranslated region of mRNA encoded by LOC144262, corresponding to a HOST TARGET binding site such as BINDING SITE I, BINDING SITE II or BINDING SITE III. Table 2 illustrates the complementarity of the nucleotide sequences of LOC144262 BINDING SITE, designated SEQ ID:37706, to the nucleotide sequence of VGAM880 RNA, herein designated VGAM RNA, also designated SEQ ID:3591.

Another function of VGAM880 is therefore inhibition of LOC144262 (Accession XM_084793). Accordingly, utilities of VGAM880 include diagnosis, prevention and treatment of diseases and clinical conditions associated with LOC144262. LOC149103 (Accession XM_086434) is another VGAM880 host target gene. LOC149103 BINDING SITE is HOST TARGET binding site found in the 3' untranslated region of mRNA encoded by LOC149103, corresponding to a HOST TARGET binding site such as BINDING SITE I, BINDING SITE II or BINDING SITE III. Table 2 illustrates the complementarity of the nucleotide sequences of LOC149103 BINDING SITE, designated SEQ ID:38650, to the nucleotide sequence of VGAM880 RNA, herein designated VGAM RNA, also designated SEQ ID:3591.

Another function of VGAM880 is therefore inhibition of LOC149103 (Accession XM_086434). Accordingly, utilities of VGAM880 include diagnosis, prevention and treatment of diseases and clinical conditions associated with LOC149103. LOC199733 (Accession XM_117123) is another VGAM880 host target gene. LOC199733 BINDING SITE is HOST TARGET binding site found in the 3' untranslated region of mRNA encoded by LOC199733, corresponding to a HOST TARGET binding site such as BINDING SITE I, BINDING SITE II or BINDING SITE III. Table 2 illustrates the complementarity of the nucleotide sequences of LOC199733 BINDING SITE, designated SEQ ID:43247, to the nucleotide sequence of VGAM880 RNA, herein designated VGAM RNA, also designated SEQ ID:3591.

Another function of VGAM880 is therefore inhibition of LOC199733 (Accession XM_117123). Accordingly, utilities of VGAM880 include diagnosis, prevention and treatment of diseases and clinical conditions associated with LOC199733. LOC253805 (Accession XM_172854) is another VGAM880 host target gene. LOC253805 BINDING SITE is HOST TARGET binding site found in the 3' untranslated region of mRNA encoded by LOC253805, corresponding to a HOST TARGET binding site such as BINDING SITE I, BINDING SITE II or BINDING SITE III. Table 2 illustrates the complementarity of the nucleotide sequences of LOC253805 BINDING SITE, designated SEQ ID:46132, to the nucleotide sequence of VGAM880 RNA, herein designated VGAM RNA, also designated SEQ ID:3591.

Another function of VGAM880 is therefore inhibition of LOC253805 (Accession XM_172854). Accordingly, utilities of VGAM880 include diagnosis, prevention and treatment of diseases and clinical conditions associated with LOC253805. LOC90321 (Accession XM_030896) is another VGAM880 host target gene. LOC90321 BINDING SITE is HOST TARGET binding site found in the 3' untranslated region of mRNA encoded by LOC90321, corresponding to a HOST TARGET binding site such as BINDING SITE I, BINDING SITE II or BINDING SITE III. Table 2 illustrates the complementarity of the nucleotide sequences of LOC90321 BINDING SITE, designated SEQ ID:31211, to the nucleotide sequence of VGAM880 RNA, herein designated VGAM RNA, also designated SEQ ID:3591.

Another function of VGAM880 is therefore inhibition of LOC90321 (Accession XM_030896). Accordingly, utilities of VGAM880 include diagnosis, prevention and treatment of diseases and clinical conditions associated with LOC90321. LOC92249 (Accession XM_043814) is another VGAM880 host target gene. LOC92249 BINDING SITE is HOST TARGET binding site found in the 5' untranslated region of mRNA encoded by LOC92249, corresponding to a HOST TARGET binding site such as BINDING SITE I, BINDING SITE II or BINDING SITE III. Table 2 illustrates the complementarity of the nucleotide sequences of LOC92249 BINDING SITE, designated SEQ ID:34021, to the nucleotide sequence of VGAM880 RNA, herein designated VGAM RNA, also designated SEQ ID:3591.

Another function of VGAM880 is therefore inhibition of LOC92249 (Accession XM_043814). Accordingly, utilities of VGAM880 include diagnosis, prevention and treatment of diseases and clinical conditions associated with LOC92249. FIG. 1 further provides a conceptual description of a novel bioinformatically detected viral gene of the present invention, referred to here as Viral Genomic Address Messenger 881 (VGAM881) viral gene, which modulates expression of respective host target genes thereof, the function and utility of which host target genes is known in the art.

VGAM881 is a novel bioinformatically detected regulatory, non protein coding, viral micro RNA (miRNA) gene. The method by which VGAM881 was detected is described hereinabove with reference to FIGS. 1-8.

VGAM881 gene, herein designated VGAM GENE, is a viral gene contained in the genome of Gallid Herpesvirus 3. VGAM881 host target gene, herein designated VGAM HOST TARGET GENE, is a human gene contained in the human genome.

VGAM881 gene encodes a VGAM881 precursor RNA, herein designated VGAM PRECURSOR RNA. Similar to other miRNA genes, and unlike most ordinary genes, VGAM881 precursor RNA does not encode a protein. A nucleotide sequence identical or highly similar to the nucleotide sequence of VGAM881 precursor RNA is designated SEQ ID:867, and is provided hereinbelow with reference to the sequence listing part. Nucleotide sequence SEQ ID:867 is located at position 51459 relative to the genome of Gallid Herpesvirus 3.

VGAM881 precursor RNA folds onto itself, forming VGAM881 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM881 folded precursor RNA into VGAM881 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM881 RNA is designated SEQ ID:3592, and is provided hereinbelow with reference to the sequence listing part.

VGAM881 host target gene, herein designated VGAM HOST TARGET GENE, encodes a corresponding messenger RNA, VGAM881 host target RNA, herein designated VGAM HOST TARGET RNA. VGAM881 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM881 RNA, herein designated VGAM RNA, binds complementarily to one or more host target binding sites located in untranslated regions of VGAM881 host target RNA, herein designated VGAM HOST TARGET RNA. This complementary binding is due to the fact that the nucleotide sequence of VGAM881 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM881 RNA, herein designated VGAM RNA, may have a different number of host target binding sites in untranslated regions of a VGAM881 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM881 RNA, herein designated VGAM RNA, to host target binding sites on VGAM881 host target RNA, herein designated VGAM HOST TARGET RNA, such as BINDING SITE I, BINDING SITE II and BINDING SITE III, inhibits translation of VGAM881 host target RNA into VGAM881 host target protein, herein designated VGAM HOST TARGET PROTEIN. VGAM host target protein is therefore outlined by a broken line.

It is appreciated that VGAM881 host target gene, herein designated VGAM HOST TARGET GENE, in fact represents a plurality of VGAM881 host target genes. The mRNA of each one of this plurality of VGAM881 host target genes comprises one or more host target binding sites, each having a nucleotide sequence which is at least partly complementary to VGAM881 RNA, herein designated VGAM RNA, and which when bound by VGAM881 RNA causes inhibition of translation of respective one or more VGAM881 host target proteins.

It is further appreciated by one skilled in the art that the mode of translational inhibition illustrated by FIG. 1 with specific reference to translational inhibition exerted by VGAM881 gene, herein designated VGAM GENE, on one or more VGAM881 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM881 is inhibition of expression of host target genes, as part of a novel viral mechanism of attacking a host. Accordingly, utilities of VGAM881 include diagnosis, prevention and treatment of viral infection by Gallid Herpesvirus 3. Specific functions, and accordingly utilities, of VGAM881 correlate with, and may be deduced from, the identity of the host target genes which VGAM881 binds and inhibits, and the function of these host target genes, as elaborated hereinbelow.

Nucleotide sequences of the VGAM881 precursor RNA, herein designated VGAM PRECURSOR RNA, and of the 'diced' VGAM881 RNA, herein designated VGAM RNA, and a schematic representation of the secondary folding of VGAM881 folded precursor RNA, herein designated VGAM FOLDED PRECURSOR RNA, of VGAM881 are further described hereinbelow with reference to Table 1.

Nucleotide sequences of host target binding sites, such as BINDING SITE-I, BINDING SITE-II and BINDING SITE-III of FIG. 1, found on VGAM881 host target RNA, and schematic representation of the complementarity of each of these host target binding sites to VGAM881 RNA, herein designated VGAM RNA, are described hereinbelow with reference to Table 2.

As mentioned hereinabove with reference to FIG. 1, a function of VGAM881 gene, herein designated VGAM is inhibition of expression of VGAM881 target genes. It is appreciated that specific functions, and accordingly utilities, of VGAM881 correlate with, and may be deduced from, the identity of the target genes which VGAM881 binds and inhibits, and the function of these target genes, as elaborated hereinbelow.

Carnitine O-octanoyltransferase (CROT, Accession NM_021151) is a VGAM881 host target gene. CROT BINDING SITE is HOST TARGET binding site found in the 3' untranslated region of mRNA encoded by CROT, corresponding to a HOST TARGET binding site such as BINDING SITE I, BINDING SITE II or BINDING SITE III. Table 2 illustrates the complementarity of the nucleotide sequences of CROT BINDING SITE, designated SEQ ID:22121, to the nucleotide sequence of VGAM881 RNA, herein designated VGAM RNA, also designated SEQ ID:3592.

A function of VGAM881 is therefore inhibition of Carnitine O-octanoyltransferase (CROT, Accession NM_021151), a gene which CROT plays a crucial role in the beta-oxidation of branched-chain fatty acids including pristanic acid. Accordingly, utilities of VGAM881 include diagnosis, prevention and treatment of diseases and clinical conditions associated with CROT. The function of CROT and its association with various diseases and clinical conditions, has been established by previous studies, as described hereinabove with reference to VGAM70. Dual Specificity Phosphatase 1 (DUSP1, Accession NM_004417) is another VGAM881 host target gene. DUSP1 BINDING SITE is HOST TARGET binding site found in the 3' untranslated region of mRNA encoded by DUSP1, corresponding to a HOST TARGET binding site such as BINDING SITE I, BINDING SITE II or BINDING SITE III. Table 2 illustrates the complementarity of the nucleotide sequences of DUSP1 BINDING SITE, designated SEQ ID:10680, to the nucleotide sequence of VGAM881 RNA, herein designated VGAM RNA, also designated SEQ ID:3592.

Another function of VGAM881 is therefore inhibition of Dual Specificity Phosphatase 1 (DUSP1, Accession NM_004417), a gene which is a dual specificity phosphatase. Accordingly, utilities of VGAM881 include diagnosis, prevention and treatment of diseases and clinical conditions associated with DUSP1. The function of DUSP1 has been established by previous studies. Keyse and Emslie (1992) isolated and characterized a cDNA, which they designated CL100, corresponding to an mRNA that is highly inducible by oxidative stress and heat shock in human skin cells. The cDNA was obtained by differential screening of a library made from normal human skin fibroblasts stressed for 2 hours in a solution of hydrogen peroxide. The cDNA contains an open reading frame specifying a 367-residue protein of 39.3 kD predicted molecular mass with the structural features of a nonreceptor type protein-tyrosine phosphatase. It has significant amino acid sequence similarity to a tyr/ser-protein phosphatase encoded by the late gene H1 of vaccinia virus. The purified protein encoded by the open reading frame expressed in bacteria has intrinsic phosphatase activity. Given the relationship between the levels of protein-tyrosine phosphorylation, receptor activity, cellular proliferation, and cell cycle control, Keyse and Emslie (1992) concluded that induction of this gene may play an important regulatory role in the human cellular response to environmental stress. Brondello et al. (1999) determined that DUSP1, which they called MKP1, is a labile protein with a half-life of approximately 45 minutes in CCL39 hamster fibroblasts. Its degradation was attenuated by inhibitors of the ubiquitin-directed proteasome complex. MKP1 was a target in vivo and in vitro for p42MAPK (OMIM Ref. No. 176948) or p44MAPK (OMIM Ref. No. 601795), which phosphorylates MKP1 on 2 C-terminal serine residues, ser359 and ser364. This phosphorylation did not modify MKP1's intrinsic ability to dephosphorylate p44MAPK, but led to stabilization of the protein. Brondello et al. (1999) concluded that these results illustrated the importance of regulated protein degradation in the control of mitogenic signaling.

Full details of the abovementioned studies are described in the following publications, the disclosure of which are hereby incorporated by reference:

Brondello, J.-M.; Pouyssegur, J.; McKenzie, F. R.: Reduced MAP kinase phosphatase-1 degradation after p42/p44(MAPK)-dependent phosphorylation. Science 286:2514-2517, 1999; and Keyse, S. M.; Emslie, E. A.: Oxidative stress and heat shock induce a human gene encoding a protein-tyrosine phosphatase. Nature 359:644-647, 1992.

Further studies establishing the function and utilities of DUSP1 are found in John Hopkins OMIM database record ID 600714, and in sited publications numbered 1005 and 10052-10055 listed in the bibliography section hereinbelow, which are also hereby incorporated by reference. HUS1 Checkpoint Homolog (S. pombe) (HUS1, Accession XM_165873) is another VGAM881 host target gene. HUS1 BINDING SITE is HOST TARGET binding site found in the 3' untranslated region of mRNA encoded by HUS1, corresponding to a HOST TARGET binding site such as BINDING SITE I, BINDING SITE II or BINDING SITE III. Table 2 illustrates the complementarity of the nucleotide sequences of HUS1 BINDING SITE, designated SEQ ID:43788, to the nucleotide sequence of VGAM881 RNA, herein designated VGAM RNA, also designated SEQ ID:3592.

Another function of VGAM881 is therefore inhibition of HUS1 Checkpoint Homolog (S. pombe) (HUS1, Accession XM_165873), a gene which May form DNA damage-responsive protein complex. Accordingly, utilities of VGAM881 include diagnosis, prevention and treatment of diseases and clinical conditions associated with HUS1. The function of HUS1 and its association with various diseases and clinical conditions, has been established by previous studies, as described hereinabove with reference to VGAM228. Muscleblind-like (Drosophila) (MBNL, Accession NM_021038)

is another VGAM881 host target gene. MBNL BINDING SITE is HOST TARGET binding site found in the 3' untranslated region of mRNA encoded by MBNL, corresponding to a HOST TARGET binding site such as BINDING SITE I, BINDING SITE II or BINDING SITE III. Table 2 illustrates the complementarity of the nucleotide sequences of MBNL BINDING SITE, designated SEQ ID:22024, to the nucleotide sequence of VGAM881 RNA, herein designated VGAM RNA, also designated SEQ ID:3592.

Another function of VGAM881 is therefore inhibition of Muscleblind-like (Drosophila) (MBNL, Accession NM_021038), a gene which binds to cug triplet repeat expansion dsrna (by similarity). Accordingly, utilities of VGAM881 include diagnosis, prevention and treatment of diseases and clinical conditions associated with MBNL. The function of MBNL and its association with various diseases and clinical conditions, has been established by previous studies, as described hereinabove with reference to VGAM95. FIBL-6 (Accession XM_053531) is another VGAM881 host target gene. FIBL-6 BINDING SITE is HOST TARGET binding site found in the 3' untranslated region of mRNA encoded by FIBL-6, corresponding to a HOST TARGET binding site such as BINDING SITE I, BINDING SITE II or BINDING SITE III. Table 2 illustrates the complementarity of the nucleotide sequences of FIBL-6 BINDING SITE, designated SEQ ID:36099, to the nucleotide sequence of VGAM881 RNA, herein designated VGAM RNA, also designated SEQ ID:3592.

Another function of VGAM881 is therefore inhibition of FIBL-6 (Accession XM_053531). Accordingly, utilities of VGAM881 include diagnosis, prevention and treatment of diseases and clinical conditions associated with FIBL-6. FLJ30046 (Accession NM_144595) is another VGAM881 host target gene. FLJ30046 BINDING SITE is HOST TARGET binding site found in the 3' untranslated region of mRNA encoded by FLJ30046, corresponding to a HOST TARGET binding site such as BINDING SITE I, BINDING SITE II or BINDING SITE III. Table 2 illustrates the complementarity of the nucleotide sequences of FLJ30046 BINDING SITE, designated SEQ ID:29410, to the nucleotide sequence of VGAM881 RNA, herein designated VGAM RNA, also designated SEQ ID:3592.

Another function of VGAM881 is therefore inhibition of FLJ30046 (Accession NM_144595). Accordingly, utilities of VGAM881 include diagnosis, prevention and treatment of diseases and clinical conditions associated with FLJ30046. G Protein-coupled Receptor 105 (GPR105, Accession NM_014879) is another VGAM881 host target gene. GPR105 BINDING SITE is HOST TARGET binding site found in the 3' untranslated region of mRNA encoded by GPR105, corresponding to a HOST TARGET binding site such as BINDING SITE I, BINDING SITE II or BINDING SITE III. Table 2 illustrates the complementarity of the nucleotide sequences of GPR105 BINDING SITE, designated SEQ ID:17022, to the nucleotide sequence of VGAM881 RNA, herein designated VGAM RNA, also designated SEQ ID:3592.

Another function of VGAM881 is therefore inhibition of G Protein-coupled Receptor 105 (GPR105, Accession NM_014879). Accordingly, utilities of VGAM881 include diagnosis, prevention and treatment of diseases and clinical conditions associated with GPR105. KIAA0261 (Accession XM_042946) is another VGAM881 host target gene. KIAA0261 BINDING SITE is HOST TARGET binding site found in the 3' untranslated region of mRNA encoded by KIAA0261, corresponding to a HOST TARGET binding site such as BINDING SITE I, BINDING SITE II or BINDING SITE III. Table 2 illustrates the complementarity of the nucleotide sequences of KIAA0261 BINDING SITE, designated SEQ ID:33829, to the nucleotide sequence of VGAM881 RNA, herein designated VGAM RNA, also designated SEQ ID:3592.

Another function of VGAM881 is therefore inhibition of KIAA0261 (Accession XM_042946). Accordingly, utilities of VGAM881 include diagnosis, prevention and treatment of diseases and clinical conditions associated with KIAA0261. KIAA1143 (Accession XM_044014) is another VGAM881 host target gene. KIAA1143 BINDING SITE is HOST TARGET binding site found in the 3' untranslated region of mRNA encoded by KIAA1143, corresponding to a HOST TARGET binding site such as BINDING SITE I, BINDING SITE II or BINDING SITE III. Table 2 illustrates the complementarity of the nucleotide sequences of KIAA1143 BINDING SITE, designated SEQ ID:34069, to the nucleotide sequence of VGAM881 RNA, herein designated VGAM RNA, also designated SEQ ID:3592.

Another function of VGAM881 is therefore inhibition of KIAA1143 (Accession XM_044014). Accordingly, utilities of VGAM881 include diagnosis, prevention and treatment of diseases and clinical conditions associated with KIAA1143. Tumor Protein P53 Inducible Nuclear Protein 1 (TP53INP1, Accession NM_033285) is another VGAM881 host target gene. TP53INP1 BINDING SITE1 and TP53INP1 BINDING SITE2 are HOST TARGET binding sites found in untranslated regions of mRNA encoded by TP53INP1, corresponding to HOST TARGET binding sites such as BINDING SITE I, BINDING SITE II or BINDING SITE III. Table 2 illustrates the complementarity of the nucleotide sequences of TP53INP1 BINDING SITE1 and TP53INP1 BINDING SITE2, designated SEQ ID:27109 and SEQ ID:36118 respectively, to the nucleotide sequence of VGAM881 RNA, herein designated VGAM RNA, also designated SEQ ID:3592.

Another function of VGAM881 is therefore inhibition of Tumor Protein P53 Inducible Nuclear Protein 1 (TP53INP1, Accession NM_033285). Accordingly, utilities of VGAM881 include diagnosis, prevention and treatment of diseases and clinical conditions associated with TP53INP1. LOC203305 (Accession XM_117529) is another VGAM881 host target gene. LOC203305 BINDING SITE is HOST TARGET binding site found in the 3' untranslated region of mRNA encoded by LOC203305, corresponding to a HOST TARGET binding site such as BINDING SITE I, BINDING SITE II or BINDING SITE III. Table 2 illustrates the complementarity of the nucleotide sequences of LOC203305 BINDING SITE, designated SEQ ID:43509, to the nucleotide sequence of VGAM881 RNA, herein designated VGAM RNA, also designated SEQ ID:3592.

Another function of VGAM881 is therefore inhibition of LOC203305 (Accession XM_117529). Accordingly, utilities of VGAM881 include diagnosis, prevention and treatment of diseases and clinical conditions associated with LOC203305. LOC254243 (Accession XM_173233) is another VGAM881 host target gene. LOC254243 BINDING SITE is HOST TARGET binding site found in the 3' untranslated region of mRNA encoded by LOC254243, corresponding to a HOST TARGET binding site such as BINDING SITE I, BINDING SITE II or BINDING SITE III. Table 2 illustrates the complementarity of the nucleotide sequences of LOC254243 BINDING SITE, designated SEQ ID:46511, to the nucleotide sequence of VGAM881 RNA, herein designated VGAM RNA, also designated SEQ ID:3592.

Another function of VGAM881 is therefore inhibition of LOC254243 (Accession XM_173233). Accordingly, utilities of VGAM881 include diagnosis, prevention and treatment of diseases and clinical conditions associated with LOC254243. LOC90038 (Accession XM_028305) is another VGAM881 host target gene. LOC90038 BINDING SITE is HOST TARGET binding site found in the 3' untranslated region of mRNA encoded by LOC90038, corresponding to a HOST TARGET binding site such as BINDING SITE I, BINDING SITE II or BINDING SITE III. Table 2 illustrates the complementarity of the nucleotide sequences of LOC90038 BINDING SITE, designated SEQ ID:30648, to the nucleotide sequence of VGAM881 RNA, herein designated VGAM RNA, also designated SEQ ID:3592.

Another function of VGAM881 is therefore inhibition of LOC90038 (Accession XM_028305). Accordingly, utilities of VGAM881 include diagnosis, prevention and treatment of diseases and clinical conditions associated with LOC90038. FIG. 1 further provides a conceptual description of a novel bioinformatically detected viral gene of the present invention, referred to here as Viral Genomic Address Messenger 882 (VGAM882) viral gene, which modulates expression of respective host target genes thereof, the function and utility of which host target genes is known in the art.

VGAM882 is a novel bioinformatically detected regulatory, non protein coding, viral micro RNA (miRNA) gene. The method by which VGAM882 was detected is described hereinabove with reference to FIGS. 1-8.

VGAM882 gene, herein designated VGAM GENE, is a viral gene contained in the genome of Meleagrid Herpesvirus 1. VGAM882 host target gene, herein designated VGAM HOST TARGET GENE, is a human gene contained in the human genome.

VGAM882 gene encodes a VGAM882 precursor RNA, herein designated VGAM PRECURSOR RNA. Similar to other miRNA genes, and unlike most ordinary genes, VGAM882 precursor RNA does not encode a protein. A nucleotide sequence identical or highly similar to the nucleotide sequence of VGAM882 precursor RNA is designated SEQ ID:868, and is provided hereinbelow with reference to the sequence listing part. Nucleotide sequence SEQ ID:868 is located at position 13598 relative to the genome of Meleagrid Herpesvirus 1.

VGAM882 precursor RNA folds onto itself, forming VGAM882 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM882 folded precursor RNA into VGAM882 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM882 RNA is designated SEQ ID:3593, and is provided hereinbelow with reference to the sequence listing part.

VGAM882 host target gene, herein designated VGAM HOST TARGET GENE, encodes a corresponding messenger RNA, VGAM882 host target RNA, herein designated VGAM HOST TARGET RNA. VGAM882 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM882 RNA, herein designated VGAM RNA, binds complementarily to one or more host target binding sites located in untranslated regions of VGAM882 host target RNA, herein designated VGAM HOST TARGET RNA. This complementary binding is due to the fact that the nucleotide sequence of VGAM882 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM882 RNA, herein designated VGAM RNA, may have a different number of host target binding sites in untranslated regions of a VGAM882 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM882 RNA, herein designated VGAM RNA, to host target binding sites on VGAM882 host target RNA, herein designated VGAM HOST TARGET RNA, such as BINDING SITE I, BINDING SITE II and BINDING SITE III, inhibits translation of VGAM882 host target RNA into VGAM882 host target protein, herein designated VGAM HOST TARGET PROTEIN. VGAM host target protein is therefore outlined by a broken line.

It is appreciated that VGAM882 host target gene, herein designated VGAM HOST TARGET GENE, in fact represents a plurality of VGAM882 host target genes. The mRNA of each one of this plurality of VGAM882 host target genes comprises one or more host target binding sites, each having a nucleotide sequence which is at least partly complementary to VGAM882 RNA, herein designated VGAM RNA, and which when bound by VGAM882 RNA causes inhibition of translation of respective one or more VGAM882 host target proteins.

It is further appreciated by one skilled in the art that the mode of translational inhibition illustrated by FIG. 1 with specific reference to translational inhibition exerted by VGAM882 gene, herein designated VGAM GENE, on one or more VGAM882 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM882 is inhibition of expression of host target genes, as part of a novel viral mechanism of attacking a host. Accordingly, utilities of VGAM882 include diagnosis, prevention and treatment of viral infection by Meleagrid Herpesvirus 1. Specific functions, and accordingly utilities, of VGAM882 correlate with, and may be deduced from, the identity of the host target genes which VGAM882 binds and inhibits, and the function of these host target genes, as elaborated hereinbelow.

Nucleotide sequences of the VGAM882 precursor RNA, herein designated VGAM PRECURSOR RNA, and of the 'diced' VGAM882 RNA, herein designated VGAM RNA, and a schematic representation of the secondary folding of VGAM882 folded precursor RNA, herein designated VGAM FOLDED PRECURSOR RNA, of VGAM882 are further described hereinbelow with reference to Table 1.

Nucleotide sequences of host target binding sites, such as BINDING SITE-I, BINDING SITE-II and BINDING SITE-III of FIG. 1, found on VGAM882 host target RNA, and schematic representation of the complementarity of each of these host target binding sites to VGAM882 RNA, herein designated VGAM RNA, are described hereinbelow with reference to Table 2.

As mentioned hereinabove with reference to FIG. 1, a function of VGAM882 gene, herein designated VGAM is inhibition of expression of VGAM882 target genes. It is appreciated that specific functions, and accordingly utilities, of VGAM882 correlate with, and may be deduced from, the identity of the target genes which VGAM882 binds and inhibits, and the function of these target genes, as elaborated hereinbelow.

Arginine Vasopressin Receptor 1A (AVPR1A, Accession NM_000706) is a VGAM882 host target gene. AVPR1A BINDING SITE is HOST TARGET binding site found in the 3' untranslated region of mRNA encoded by AVPR1A, corresponding to a HOST TARGET binding site such as BINDING SITE I, BINDING SITE II or BINDING SITE III. Table 2 illustrates the complementarity of the nucleotide sequences of AVPR1A BINDING SITE, designated SEQ ID:6373, to the nucleotide sequence of VGAM882 RNA, herein designated VGAM RNA, also designated SEQ ID:3593.

A function of VGAM882 is therefore inhibition of Arginine Vasopressin Receptor 1A (AVPR1A, Accession NM_000706), a gene which mediates cell contraction and proliferation, platelet aggregation, release of coagulation factor, and glycogenolysis. Accordingly, utilities of VGAM882 include diagnosis, prevention and treatment of diseases and clinical conditions associated with AVPR1A. The function of AVPR1A and its association with various diseases and clinical conditions, has been established by previous studies, as described hereinabove with reference to VGAM549. EGF-like-domain, Multiple 5 (EGFL5, Accession XM_098838) is another VGAM882 host target gene. EGFL5 BINDING SITE is HOST TARGET binding site found in the 3' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41885, to the nucleotide sequence of VGAM882 RNA, herein designated VGAM RNA, also designated SEQ ID:3593.

Another function of VGAM882 is therefore inhibition of EGF-like-domain, Multiple 5 (EGFL5, Accession XM_098838). Accordingly, utilities of VGAM882 include diagnosis, prevention and treatment of diseases and clinical conditions associated with EGFL5. Eukaryotic Translation Initiation Factor 3, Subunit 10 Theta, 150/170 kDa (EIF3S10, Accession XM_049795) is another VGAM882 host target gene. EIF3S10 BINDING SITE is HOST TARGET binding site found in the 3' untranslated region of mRNA encoded by EIF3S10, corresponding to a HOST TARGET binding site such as BINDING SITE I, BINDING SITE II or BINDING SITE III. Table 2 illustrates the complementarity of the nucleotide sequences of EIF3S10 BINDING SITE, designated SEQ ID:35501, to the nucleotide sequence of VGAM882 RNA, herein designated VGAM RNA, also designated SEQ ID:3593.

Another function of VGAM882 is therefore inhibition of Eukaryotic Translation Initiation Factor 3, Subunit 10 Theta, 150/170 kDa (EIF3S10, Accession XM_049795), a gene which binds to the 40s ribosome and promotes the binding of methionyl-trnai and mrna. Accordingly, utilities of VGAM882 include diagnosis, prevention and treatment of diseases and clinical conditions associated with EIF3S10. The function of EIF3S10 has been established by previous studies. Eukaryotic translation initiation factors (EIFs) initiate protein synthesis from mRNAs. EIF3, at 650 kD, is the largest of the EIFs. According to Johnson et al. (1997), EIF3 has been implicated in several roles, including binding to the 40S ribosomal subunit and to other EIFs, possibly to align the factors for initial binding to the 40S subunit and the subsequent identification of the AUG initiation codon. The EIF3 protein synthesis initiation factor is composed of at least 8 subunits, the largest of which is p180. Nagase et al. (1995) identified an open reading frame with significant homology to mouse centrosomin B. Nagase et al. (1995) noted that this clone, which they termed KIAA0139, was ubiquitously expressed and contained 21 units of an unusual 10-amino acid repeat. The full-length cDNA was later cloned and characterized independently by Johnson et al. (1997) and Scholler and Kanner (1997). Johnson et al. (1997) used expression screening of a human liver cDNA library to isolate a clone, which they termed p180. The cDNA predicted a protein of 1,382 amino acids, which Johnson et al. (1997) identified as the human homolog of centrosomin, the large subunit of mouse eif3. Johnson et al. (1997) also showed that p180 has homologs in yeast, nematodes, and plants. Scholler and Kanner (1997) used expression screening of a human T-cell cDNA library to isolate a clone, termed p167 by them, that was nearly identical to that isolated by Johnson et al. (1997). Scholler and Kanner (1997) showed that p167 was a cytoplasmic protein that is not phosphorylated and is part of a multi-subunit complex.

Full details of the abovementioned studies are described in the following publications, the disclosure of which are hereby incorporated by reference:

Johnson, K. R.; Merrick, W. C.; Zoll, W. L.; Zhu, Y.: Identification of cDNA clones for the large subunit of eukaryotic translation initiation factor 3: comparison of homologues from human, Nicotiana tabacum, Caenorhabditis elegans, and Saccharomyces cerevisiae. J. Biol. Chem. 272:7106-7113, 1997; and Scholler, J. K.; Kanner, S. B.: The human p167 gene encodes a unique structural protein that contains centrosomin A homology and associates with a multicomponent complex. DNA Cell Biol.

Further studies establishing the function and utilities of EIF3S10 are found in John Hopkins OMIM database record ID 602039, and in sited publications numbered 953-95 and 10969 listed in the bibliography section hereinbelow, which are also hereby incorporated by reference. Nuclear Receptor Coactivator 6 (NCOA6, Accession NM_014071) is another VGAM882 host target gene. NCOA6 BINDING SITE is HOST TARGET binding site found in the 5' untranslated region of mRNA encoded by NCOA6, corresponding to a HOST TARGET binding site such as BINDING SITE I, BINDING SITE II or BINDING SITE III. Table 2 illustrates the complementarity of the nucleotide sequences of NCOA6 BINDING SITE, designated SEQ ID:15287, to the nucleotide sequence of VGAM882 RNA, herein designated VGAM RNA, also designated SEQ ID:3593.

Another function of VGAM882 is therefore inhibition of Nuclear Receptor Coactivator 6 (NCOA6, Accession NM_014071), a gene which activates gene transcription through ligand-dependent association with coactivators. Accordingly, utilities of VGAM882 include diagnosis, prevention and treatment of diseases and clinical conditions associated with NCOA6. The function of NCOA6 and its association with various diseases and clinical conditions, has been established by previous studies, as described hereinabove with reference to VGAM25. Phenylalanine Hydroxylase (PAH, Accession NM_000277) is another VGAM882 host target gene. PAH BINDING SITE is HOST TARGET binding site found in the 3' untranslated region of mRNA encoded by PAH, corresponding to a HOST TARGET binding site such as BINDING SITE I, BINDING SITE II or BINDING SITE III. Table 2 illustrates the complementarity of the nucleotide sequences of PAH BINDING SITE, designated SEQ ID:5822, to the nucleotide sequence of VGAM882 RNA, herein designated VGAM RNA, also designated SEQ ID:3593.

Another function of VGAM882 is therefore inhibition of Phenylalanine Hydroxylase (PAH, Accession NM_000277). Accordingly, utilities of VGAM882 include diagnosis, prevention and treatment of diseases and clinical conditions associated with PAH. Tropomodulin (TMOD, Accession NM_003275) is another VGAM882 host target gene. TMOD BINDING SITE is HOST TARGET binding site found in the 3' untranslated region of mRNA encoded by TMOD, corresponding to a HOST TARGET binding site such as BINDING SITE I, BINDING SITE II or BINDING SITE III. Table 2 illustrates the complementarity of the nucleotide sequences of TMOD BINDING SITE, designated SEQ ID:9292, to the nucleotide sequence of VGAM882 RNA, herein designated VGAM RNA, also designated SEQ ID:3593.

Another function of VGAM882 is therefore inhibition of Tropomodulin (TMOD, Accession NM_003275), a gene which blocks the elongation and depolymerization of the actin filaments at the pointed end. Accordingly, utilities of VGAM882 include diagnosis, prevention and treatment of diseases and clinical conditions associated with TMOD. The function of TMOD and its association with various diseases and clinical conditions, has been established by previous studies, as described hereinabove with reference to VGAM716. Protocadherin 20 (PCDH20, Accession NM_022843) is another VGAM882 host target gene. PCDH20 BINDING SITE is HOST TARGET binding site found in the 3' untranslated region of mRNA encoded by PCDH20, corresponding to a HOST TARGET binding site such as BINDING SITE I, BINDING SITE II or BINDING SITE III. Table 2 illustrates the complementarity of the nucleotide sequences of PCDH20 BINDING SITE, designated SEQ ID:23134, to the nucleotide sequence of VGAM882 RNA, herein designated VGAM RNA, also designated SEQ ID:3593.

Another function of VGAM882 is therefore inhibition of Protocadherin 20 (PCDH20, Accession NM_022843). Accordingly, utilities of VGAM882 include diagnosis, prevention and treatment of diseases and clinical conditions associated with PCDH20. Protein Phosphatase 1, Regulatory (inhibitor) Subunit 3B (PPP1R3B, Accession NM_024607) is another VGAM882 host target gene. PPP1R3B BINDING SITE is HOST TARGET binding site found in the 3' untranslated region of mRNA encoded by PPP1R3B, corresponding to a HOST TARGET binding site such as BINDING SITE I, BINDING SITE II or BINDING SITE III. Table 2 illustrates the complementarity of the nucleotide sequences of PPP1R3B BINDING SITE, designated SEQ ID:23856, to the nucleotide sequence of VGAM882 RNA, herein designated VGAM RNA, also designated SEQ ID:3593.

Another function of VGAM882 is therefore inhibition of Protein Phosphatase 1, Regulatory (inhibitor) Subunit 3B (PPP1R3B, Accession NM_024607). Accordingly, utilities of VGAM882 include diagnosis, prevention and treatment of diseases and clinical conditions associated with PPP1R3B. LOC151446 (Accession XM_098061) is another VGAM882 host target gene. LOC151446 BINDING SITE is HOST TARGET binding site found in the 3' untranslated region of mRNA encoded by LOC151446, corresponding to a HOST TARGET binding site such as BINDING SITE I, BINDING SITE II or BINDING SITE III. Table 2 illustrates the complementarity of the nucleotide sequences of LOC151446 BINDING SITE, designated SEQ ID:41351, to the nucleotide sequence of VGAM882 RNA, herein designated VGAM RNA, also designated SEQ ID:3593.

Another function of VGAM882 is therefore inhibition of LOC151446 (Accession XM_098061). Accordingly, utilities of VGAM882 include diagnosis, prevention and treatment of diseases and clinical conditions associated with LOC151446. LOC161823 (Accession XM_091156) is another VGAM882 host target gene. LOC161823 BINDING SITE is HOST TARGET binding site found in the 3' untranslated region of mRNA encoded by LOC161823, corresponding to a HOST TARGET binding site such as BINDING SITE I, BINDING SITE II or BINDING SITE III. Table 2 illustrates the complementarity of the nucleotide sequences of LOC161823 BINDING SITE, designated SEQ ID:40031, to the nucleotide sequence of VGAM882 RNA, herein designated VGAM RNA, also designated SEQ ID:3593.

Another function of VGAM882 is therefore inhibition of LOC161823 (Accession XM_091156). Accordingly, utilities of VGAM882 include diagnosis, prevention and treatment of diseases and clinical conditions associated with LOC161823. LOC221490 (Accession XM_168084) is another VGAM882 host target gene. LOC221490 BINDING SITE is HOST TARGET binding site found in the 5' untranslated region of mRNA encoded by LOC221490, corresponding to a HOST TARGET binding site such as BINDING SITE I, BINDING SITE II or BINDING SITE III. Table 2 illustrates the complementarity of the nucleotide sequences of LOC221490 BINDING SITE, designated SEQ ID:44988, to the nucleotide sequence of VGAM882 RNA, herein designated VGAM RNA, also designated SEQ ID:3593.

Another function of VGAM882 is therefore inhibition of LOC221490 (Accession XM_168084). Accordingly, utilities of VGAM882 include diagnosis, prevention and treatment of diseases and clinical conditions associated with LOC221490. FIG. 1 further provides a conceptual description of a novel bioinformatically detected viral gene of the present invention, referred to here as Viral Genomic Address Messenger 883 (VGAM883) viral gene, which modulates expression of respective host target genes thereof, the function and utility of which host target genes is known in the art.

VGAM883 is a novel bioinformatically detected regulatory, non protein coding, viral micro RNA (miRNA) gene. The method by which VGAM883 was detected is described hereinabove with reference to FIGS. 1-8.

VGAM883 gene, herein designated VGAM GENE, is a viral gene contained in the genome of Gallid Herpesvirus 3. VGAM883 host target gene, herein designated VGAM HOST TARGET GENE, is a human gene contained in the human genome.

VGAM883 gene encodes a VGAM883 precursor RNA, herein designated VGAM PRECURSOR RNA. Similar to other miRNA genes, and unlike most ordinary genes, VGAM883 precursor RNA does not encode a protein. A nucleotide sequence identical or highly similar to the nucleotide sequence of VGAM883 precursor RNA is designated SEQ ID:869, and is provided hereinbelow with reference to the sequence listing part. Nucleotide sequence SEQ ID:869 is located at position 33063 relative to the genome of Gallid Herpesvirus 3.

VGAM883 precursor RNA folds onto itself, forming VGAM883 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM883 folded precursor RNA into VGAM883 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 88%) nucleotide sequence of VGAM883 RNA is designated SEQ ID:3594, and is provided hereinbelow with reference to the sequence listing part.

VGAM883 host target gene, herein designated VGAM HOST TARGET GENE, encodes a corresponding messenger RNA, VGAM883 host target RNA, herein designated VGAM HOST TARGET RNA. VGAM883 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM883 RNA, herein designated VGAM RNA, binds complementarily to one or more host target binding sites located in untranslated regions of VGAM883 host target RNA, herein designated VGAM HOST TARGET RNA. This complementary binding is due to the fact that the nucleotide sequence of VGAM883 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM883 RNA, herein designated VGAM RNA, may have a different number of host target binding sites in untranslated regions of a VGAM883 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM883 RNA, herein designated VGAM RNA, to host target binding sites on VGAM883 host target RNA, herein designated VGAM HOST TARGET RNA, such as BINDING SITE I, BINDING SITE II and BINDING SITE III, inhibits translation of VGAM883 host target RNA into VGAM883 host target protein, herein designated VGAM HOST TARGET PROTEIN. VGAM host target protein is therefore outlined by a broken line.

It is appreciated that VGAM883 host target gene, herein designated VGAM HOST TARGET GENE, in fact represents a plurality of VGAM883 host target genes. The mRNA of each one of this plurality of VGAM883 host target genes comprises one or more host target binding sites, each having a nucleotide sequence which is at least partly complementary to VGAM883 RNA, herein designated VGAM RNA, and which when bound by VGAM883 RNA causes inhibition of translation of respective one or more VGAM883 host target proteins.

It is further appreciated by one skilled in the art that the mode of translational inhibition illustrated by FIG. 1 with specific reference to translational inhibition exerted by VGAM883 gene, herein designated VGAM GENE, on one or more VGAM883 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM883 is inhibition of expression of host target genes, as part of a novel viral mechanism of attacking a host. Accordingly, utilities of VGAM883 include diagnosis, prevention and treatment of viral infection by Gallid Herpesvirus 3. Specific functions, and accordingly utilities, of VGAM883 correlate with, and may be deduced from, the identity of the host target genes which VGAM883 binds and inhibits, and the function of these host target genes, as elaborated hereinbelow.

Nucleotide sequences of the VGAM883 precursor RNA, herein designated VGAM PRECURSOR RNA, and of the 'diced' VGAM883 RNA, herein designated VGAM RNA, and a schematic representation of the secondary folding of VGAM883 folded precursor RNA, herein designated VGAM FOLDED PRECURSOR RNA, of VGAM883 are further described hereinbelow with reference to Table 1.

Nucleotide sequences of host target binding sites, such as BINDING SITE-I, BINDING SITE-II and BINDING SITE-III of FIG. 1, found on VGAM883 host target RNA, and schematic representation of the complementarity of each of these host target binding sites to VGAM883 RNA, herein designated VGAM RNA, are described hereinbelow with reference to Table 2.

As mentioned hereinabove with reference to FIG. 1, a function of VGAM883 gene, herein designated VGAM is inhibition of expression of VGAM883 target genes. It is appreciated that specific functions, and accordingly utilities, of VGAM883 correlate with, and may be deduced from, the identity of the target genes which VGAM883 binds and inhibits, and the function of these target genes, as elaborated hereinbelow.

Adenylate Cyclase 9 (ADCY9, Accession NM_001116) is a VGAM883 host target gene. ADCY9 BINDING SITE is HOST TARGET binding site found in the 3' untranslated region of mRNA encoded by ADCY9, corresponding to a HOST TARGET binding site such as BINDING SITE I, BINDING SITE II or BINDING SITE III. Table 2 illustrates the complementarity of the nucleotide sequences of ADCY9 BINDING SITE, designated SEQ ID:6792, to the nucleotide sequence of VGAM883 RNA, herein designated VGAM RNA, also designated SEQ ID:3594.

A function of VGAM883 is therefore inhibition of Adenylate Cyclase 9 (ADCY9, Accession NM_001116), a gene which. may be a physiologically relevant docking site for calcineurin (by similarity). Accordingly, utilities of VGAM883 include diagnosis, prevention and treatment of diseases and clinical conditions associated with ADCY9. The function of ADCY9 and its association with various diseases and clinical conditions, has been established by previous studies, as described hereinabove with reference to VGAM477. Discs, Large (Drosophila) Homolog 4 (DLG4, Accession NM_001365) is another VGAM883 host target gene. DLG4 BINDING SITE is HOST TARGET binding site found in the 3' untranslated region of mRNA encoded by DLG4, corresponding to a HOST TARGET binding site such as BINDING SITE I, BINDING SITE II or BINDING SITE III. Table 2 illustrates the complementarity of the nucleotide sequences of DLG4 BINDING SITE, designated SEQ ID:7046, to the nucleotide sequence of VGAM883 RNA, herein designated VGAM RNA, also designated SEQ ID:3594.

Another function of VGAM883 is therefore inhibition of Discs, Large (Drosophila) Homolog 4 (DLG4, Accession NM_001365), a gene which is a membrane-associated guanylate kinase and may intervene in synaptogenesis. Accordingly, utilities of VGAM883 include diagnosis, prevention and treatment of diseases and clinical conditions associated with DLG4. The function of DLG4 and its association with various diseases and clinical conditions, has been established by previous studies, as described hereinabove with reference to VGAM206. ELAV (embryonic lethal, abnormal vision, Drosophila)-like 3 (Hu antigen C) (ELAVL3, Accession NM_001420) is another VGAM883 host target gene. ELAVL3 BINDING SITE is HOST TARGET binding site found in the 3' untranslated region of mRNA encoded by ELAVL3, corresponding to a HOST TARGET binding site such as BINDING SITE I, BINDING SITE II or BINDING SITE III. Table 2 illustrates the complementarity of the nucleotide sequences of ELAVL3 BINDING SITE, designated SEQ ID:7120, to the nucleotide sequence of VGAM883 RNA, herein designated VGAM RNA, also designated SEQ ID:3594.

Another function of VGAM883 is therefore inhibition of ELAV (embryonic lethal, abnormal vision, Drosophila)-like 3 (Hu antigen C) (ELAVL3, Accession NM_001420), a gene which arises when an immune response to systemic tumors expressing neuronal proteins develops into an autoimmune neuronal degeneration. Accordingly, utilities of VGAM883 include diagnosis, prevention and treatment of diseases and clinical conditions associated with ELAVL3. The function of ELAVL3 has been established by previous studies. Paraneoplastic neurologic disorders (PNDs) are a group of neurologic syndromes that arise when an immune response to systemic tumors expressing neuronal proteins develops into an autoimmune neuronal degeneration. Sakai et al. (1994) determined that the serum of a patient with paraneoplastic limbic encephalitis (PLE) contained autoantibodies that recognized a 38-kD nuclear antigen in neural cells. By screening a hippocampus expression library with this serum, they isolated cDNAs encoding a protein that they called PLE21. The predicted 350-amino acid protein contains 3 RNA recognition motifs (RRMs). PLE21 shares 82% and 54% protein sequence identity with the human neural autoantigen HuD (OMIM Ref. No. 168360) and Drosophila ELAV protein, respectively. Northern blot analysis revealed that PLE21 is expressed as an approximately 2-kb mRNA exclusively in brain. Liu et al. (1995) stated that PLE21, or HuC, is one of several Hu antigens, neuronal-specific RNA-binding proteins recognized by the anti-Hu serum antibody present in sera from patients with paraneoplastic encephalomyelitis and sensory neuronopathy (PEM/PSN). The Hu antigens HuD, HuC, and Hel-N1 (OMIM Ref. No. 601673) each contain 2 tandemly arranged RRMs connected to a third RRM by a highly basic segment. Abe et al. (1996) cloned cDNAs encoding mouse HuC. The predicted mouse and human proteins are 96% identical. These authors found that alternative splicing generates 2 mouse HuC isoforms, both of which can bind to AU-rich elements (AREs) within the 3-prime untranslated regions of mRNAs. Functional domain mapping using mouse HuC deletion mutants showed that the first RRM binds to ARE, that the second RRM has no binding activity by itself but facilitates ARE binding by the first RRM, and that the third RRM has specific binding activity for the poly (A) sequence. By fluorescence in situ hybridization (FISH), Van Tine et al. (1998) mapped the ELAVL3 gene to 19p13.2. Using FISH and radiation hybrid analysis, they demonstrated that ELAVL3 is centromeric to the ELAVL1 (HuR; 603466) gene located in the same chromosomal region. By analysis of an interspecific backcross, Fletcher et al. (1997) mapped the mouse HuC gene to chromosome 9, in a region showing homology of synteny to human chromosome 19p13.2.

Full details of the abovementioned studies are described in the following publications, the disclosure of which are hereby incorporated by reference:

Sakai, K.; Gofuku, M.; Kitagawa, Y.; Ogasawara, T.; Hirose, G.; Yamazaki, M.; Koh, C.-S.; Yanagisawa, N.; Steinman, L.: A hippocampal protein associated with paraneoplastic neurologic syndrome and small cell lung carcinoma. Biochem. Biophys. Res. Commun. 199:1200-1208, 1994; and Van Tine, B. A.; Knops, J. F.; Butler, A.; Deloukas, P.; Shaw, G. M.; King, P. H. : Localization of HuC (ELAVL3) to chromosome 19p13.2 by fluorescence in situ hybridization utilizing a n.

Further studies establishing the function and utilities of ELAVL3 are found in John Hopkins OMIM database record ID 603458, and in sited publications numbered 598 and 5833-5835 listed in the bibliography section hereinbelow, which are also hereby incorporated by reference. Interleukin 1 Receptor, Type I (IL1R1, Accession NM_000877) is another VGAM883 host target gene. IL1R1 BINDING SITE is HOST TARGET binding site found in the 3' untranslated region of mRNA encoded by IL1R1, corresponding to a HOST TARGET binding site such as BINDING SITE I, BINDING SITE II or BINDING SITE III. Table 2 illustrates the complementarity of the nucleotide sequences of IL1R1 BINDING SITE, designated SEQ ID:6566, to the nucleotide sequence of VGAM883 RNA, herein designated VGAM RNA, also designated SEQ ID:3594.

Another function of VGAM883 is therefore inhibition of Interleukin 1 Receptor, Type I (IL1R1, Accession NM_000877), a gene which is a receptor for interleukin-1 alpha (il-1a), beta (il-1b), and interleukin-1 receptor antagonist protein (il-1ra). Accordingly, utilities of VGAM883 include diagnosis, prevention and treatment of diseases and clinical conditions associated with IL1R1. The function of IL1R1 and its association with various diseases and clinical conditions, has been established by previous studies, as described hereinabove with reference to VGAM704. LIM Homeobox Protein 5 (LHX5, Accession NM_022363) is another VGAM883 host target gene. LHX5 BINDING SITE is HOST TARGET binding site found in the 5' untranslated region of mRNA encoded by LHX5, corresponding to a HOST TARGET binding site such as BINDING SITE I, BINDING SITE II or BINDING SITE III. Table 2 illustrates the complementarity of the nucleotide sequences of LHX5 BINDING SITE, designated SEQ ID:22750, to the nucleotide sequence of VGAM883 RNA, herein designated VGAM RNA, also designated SEQ ID:3594.

Another function of VGAM883 is therefore inhibition of LIM Homeobox Protein 5 (LHX5, Accession NM_022363).

Accordingly, utilities of VGAM883 include diagnosis, prevention and treatment of diseases and clinical conditions associated with LHX5. Microtubule-associated Protein, RP/EB Family, Member 3 (MAPRE3, Accession NM_012326) is another VGAM883 host target gene. MAPRE3 BINDING SITE is HOST TARGET binding site found in the 3' untranslated region of mRNA encoded by MAPRE3, corresponding to a HOST TARGET binding site such as BINDING SITE I, BINDING SITE II or BINDING SITE III. Table 2 illustrates the complementarity of the nucleotide sequences of MAPRE3 BINDING SITE, designated SEQ ID:14712, to the nucleotide sequence of VGAM883 RNA, herein designated VGAM RNA, also designated SEQ ID:3594.

Another function of VGAM883 is therefore inhibition of Microtubule-associated Protein, RP/EB Family, Member 3 (MAPRE3, Accession NM_012326), a gene which interact with cytoplasmic microtubules, and with the adenomatous polyposis coli. Accordingly, utilities of VGAM883 include diagnosis, prevention and treatment of diseases and clinical conditions associated with MAPRE3. The function of MAPRE3 and its association with various diseases and clinical conditions, has been established by previous studies, as described hereinabove with reference to VGAM340. V-rel Reticuloendotheliosis Viral Oncogene Homolog A, Nuclear Factor of Kappa Light Polypeptide Gene Enhancer In B-cells 3, P65 (avian) (RELA, Accession NM_021975) is another VGAM883 host target gene. RELA BINDING SITE is HOST TARGET binding site found in the 3' untranslated region of mRNA encoded by RELA, corresponding to a HOST TARGET binding site such as BINDING SITE I, BINDING SITE II or BINDING SITE III. Table 2 illustrates the complementarity of the nucleotide sequences of RELA BINDING SITE, designated SEQ ID:22500, to the nucleotide sequence of VGAM883 RNA, herein designated VGAM RNA, also designated SEQ ID:3594.

Another function of VGAM883 is therefore inhibition of V-rel Reticuloendotheliosis Viral Oncogene Homolog A, Nuclear Factor of Kappa Light Polypeptide Gene Enhancer In B-cells 3, P65 (avian) (RELA, Accession NM_021975), a gene which has a DNA-binding domain and regulates transcription as a heterodimer with NFKB1. Accordingly, utilities of VGAM883 include diagnosis, prevention and treatment of diseases and clinical conditions associated with RELA. The function of RELA has been established by previous studies. Jacobs and Harrison (1998) and Huxford et al. (1998) determined the structure of the NFKBIA ankyrin repeat domain, bound to a partially truncated NFKB heterodimer (p50/p65), by x-ray crystallography at 2.7- and 2.3-angstrom resolution, respectively. It shows a stack of 6 NFKBIA ankyrin repeats facing the C-terminal domains of the NFKB rel homology regions. Contacts occur in discontinuous patches, suggesting a combinatorial quality for ankyrin repeat specificity. The first 2 repeats cover an alpha helically ordered segment containing the p65 nuclear localization signal. The position of the sixth ankyrin repeat shows that full-length NFKBIA will occlude the NFKB DNA-binding cleft. The orientation of NFKBIA in the complex places its N- and C-terminal regions in appropriate locations for their known regulatory functions. Baeuerle (1998) discussed the model of interactions between NFKBIA and NFKB. Animal model experiments lend further support to the function of RELA. Neurath et al. (1996) reported direct evidence for the involvement of p65 in chronic intestinal inflammation induced in mice and suggested a potential molecular therapeutic approach to the treatment of patients with Crohn disease (OMIM Ref. No. 266600) using p65 antisense oligonucleotides.

It is appreciated that the abovementioned animal model for RELA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Baeuerle, P. A.: I-kappa-B--NF-kappa-B structures: at the interface of inflammation control. Cell 95:729-731, 1998; and Neurath, M. F.; Pettersson, S.; Myer zum Buschenfelde, K.-H.; Strober, W.: Local administration of antisense phosphorothioate oligonucleotides to the p65 subunit of NF-kappa-B abrogate.

Further studies establishing the function and utilities of RELA are found in John Hopkins OMIM database record ID 164014, and in sited publications numbered 2244-1714, 3984-1716, 2245, 1273 and 12741 listed in the bibliography section hereinbelow, which are also hereby incorporated by reference. Solute Carrier Family 5 (sodium iodide symporter), Member 5 (SLC5A5, Accession NM_000453) is another VGAM883 host target gene. SLC5A5 BINDING SITE is HOST TARGET binding site found in the 5' untranslated region of mRNA encoded by SLC5A5, corresponding to a HOST TARGET binding site such as BINDING SITE I, BINDING SITE II or BINDING SITE III. Table 2 illustrates the complementarity of the nucleotide sequences of SLC5A5 BINDING SITE, designated SEQ ID:6068, to the nucleotide sequence of VGAM883 RNA, herein designated VGAM RNA, also designated SEQ ID:3594.

Another function of VGAM883 is therefore inhibition of Solute Carrier Family 5 (sodium iodide symporter), Member 5 (SLC5A5, Accession NM_000453). Accordingly, utilities of VGAM883 include diagnosis, prevention and treatment of diseases and clinical conditions associated with SLC5A5. Solute Carrier Family 6 (neurotransmitter transporter, creatine), Member 8 (SLC6A8, Accession NM_005629) is another VGAM883 host target gene. SLC6A8 BINDING SITE is HOST TARGET binding site found in the 3' untranslated region of mRNA encoded by SLC6A8, corresponding to a HOST TARGET binding site such as BINDING SITE I, BINDING SITE II or BINDING SITE III. Table 2 illustrates the complementarity of the nucleotide sequences of SLC6A8 BINDING SITE, designated SEQ ID:12148, to the nucleotide sequence of VGAM883 RNA, herein designated VGAM RNA, also designated SEQ ID:3594.

Another function of VGAM883 is therefore inhibition of Solute Carrier Family 6 (neurotransmitter transporter, creatine), Member 8 (SLC6A8, Accession NM_005629). Accordingly, utilities of VGAM883 include diagnosis, prevention and treatment of diseases and clinical conditions associated with SLC6A8. Cyclin M3 (CNNM3, Accession NM_017623) is another VGAM883 host target gene. CNNM3 BINDING SITE is HOST TARGET binding site found in the 3' untranslated region of mRNA encoded by CNNM3, corresponding to a HOST TARGET binding site such as BINDING SITE I, BINDING SITE II or BINDING SITE III. Table 2 illustrates the complementarity of the nucleotide sequences of CNNM3 BINDING SITE, designated SEQ ID:19123, to the nucleotide sequence of VGAM883 RNA, herein designated VGAM RNA, also designated SEQ ID:3594.

Another function of VGAM883 is therefore inhibition of Cyclin M3 (CNNM3, Accession NM_017623). Accordingly, utilities of VGAM883 include diagnosis, prevention and treatment of diseases and clinical conditions associated with CNNM3. DKFZp761F2014 (Accession NM_020215) is another VGAM883 host target gene. DKFZp761F2014 BINDING SITE is HOST TARGET binding site found in the 3' untranslated region of mRNA encoded by DKFZp761F2014, corresponding to a HOST TARGET binding site such as BINDING SITE I, BINDING SITE II or BINDING SITE III. Table 2 illustrates the complementarity of the nucleotide sequences of DKFZp761F2014 BINDING SITE, designated SEQ ID:21459, to the nucleotide sequence of VGAM883 RNA, herein designated VGAM RNA, also designated SEQ ID:3594.

Another function of VGAM883 is therefore inhibition of DKFZp761F2014 (Accession NM_020215). Accordingly, utilities of VGAM883 include diagnosis, prevention and treatment of diseases and clinical conditions associated with DKFZp761F2014. ELL2 (Accession NM_012081) is another VGAM883 host target gene. ELL2 BINDING SITE is HOST TARGET binding site found in the 3' untranslated region of mRNA encoded by ELL2, corresponding to a HOST TARGET binding site such as BINDING SITE I, BINDING SITE II or BINDING SITE III. Table 2 illustrates the complementarity of the nucleotide sequences of ELL2 BINDING SITE, designated SEQ ID:14367, to the nucleotide sequence of VGAM883 RNA, herein designated VGAM RNA, also designated SEQ ID:3594.

Another function of VGAM883 is therefore inhibition of ELL2 (Accession NM_012081). Accordingly, utilities of VGAM883 include diagnosis, prevention and treatment of diseases and clinical conditions associated with ELL2. FLJ10315 (Accession NM_018056) is another VGAM883 host target gene. FLJ10315 BINDING SITE is HOST TARGET binding site found in the 5' untranslated region of mRNA encoded by FLJ10315, corresponding to a HOST TARGET binding site such as BINDING SITE I, BINDING SITE II or BINDING SITE III. Table 2 illustrates the complementarity of the nucleotide sequences of FLJ10315 BINDING SITE, designated SEQ ID:19818, to the nucleotide sequence of VGAM883 RNA, herein designated VGAM RNA, also designated SEQ ID:3594.

Another function of VGAM883 is therefore inhibition of FLJ10315 (Accession NM_018056). Accordingly, utilities of VGAM883 include diagnosis, prevention and treatment of diseases and clinical conditions associated with FLJ10315. FLJ32865 (Accession NM_144613) is another VGAM883 host target gene. FLJ32865 BINDING SITE is HOST TARGET binding site found in the 3' untranslated region of mRNA encoded by FLJ32865, corresponding to a HOST TARGET binding site such as BINDING SITE I, BINDING SITE II or BINDING SITE III. Table 2 illustrates the complementarity of the nucleotide sequences of FLJ32865 BINDING SITE, designated SEQ ID:29427, to the nucleotide sequence of VGAM883 RNA, herein designated VGAM RNA, also designated SEQ ID:3594.

Another function of VGAM883 is therefore inhibition of FLJ32865 (Accession NM_144613). Accordingly, utilities of VGAM883 include diagnosis, prevention and treatment of diseases and clinical conditions associated with FLJ32865. Integrin, Alpha 10 (ITGA10, Accession XM_002097) is another VGAM883 host target gene. ITGA10 BINDING SITE is HOST TARGET binding site found in the 3' untranslated region of mRNA encoded by ITGA10, corresponding to a HOST TARGET binding site such as BINDING SITE I, BINDING SITE II or BINDING SITE III. Table 2 illustrates the complementarity of the nucleotide sequences of ITGA10 BINDING SITE, designated SEQ ID:29860, to the nucleotide sequence of VGAM883 RNA, herein designated VGAM RNA, also designated SEQ ID:3594.

Another function of VGAM883 is therefore inhibition of Integrin, Alpha 10 (ITGA10, Accession XM_002097). Accordingly, utilities of VGAM883 include diagnosis, prevention and treatment of diseases and clinical conditions associated with ITGA10. KIAA0211 (Accession NM_014630) is another VGAM883 host target gene. KIAA0211 BINDING SITE is HOST TARGET binding site found in the 5' untranslated region of mRNA encoded by KIAA0211, corresponding to a HOST TARGET binding site such as BINDING SITE I, BINDING SITE II or BINDING SITE III. Table 2 illustrates the complementarity of the nucleotide sequences of KIAA0211 BINDING SITE, designated SEQ ID:15992, to the nucleotide sequence of VGAM883 RNA, herein designated VGAM RNA, also designated SEQ ID:3594.

Another function of VGAM883 is therefore inhibition of KIAA0211 (Accession NM_014630). Accordingly, utilities of VGAM883 include diagnosis, prevention and treatment of diseases and clinical conditions associated with KIAA0211. KIAA0552 (Accession NM_014731) is another VGAM883 host target gene. KIAA0552 BINDING SITE is HOST TARGET binding site found in the 3' untranslated region of mRNA encoded by KIAA0552, corresponding to a HOST TARGET binding site such as BINDING SITE I, BINDING SITE II or BINDING SITE III. Table 2 illustrates the complementarity of the nucleotide sequences of KIAA0552 BINDING SITE, designated SEQ ID:16344, to the nucleotide sequence of VGAM883 RNA, herein designated VGAM RNA, also designated SEQ ID:3594.

Another function of VGAM883 is therefore inhibition of KIAA0552 (Accession NM_014731). Accordingly, utilities of VGAM883 include diagnosis, prevention and treatment of diseases and clinical conditions associated with KIAA0552. KIAA1111 (Accession XM_171233) is another VGAM883 host target gene. KIAA1111 BINDING SITE is HOST TARGET binding site found in the 3' untranslated region of mRNA encoded by KIAA1111, corresponding to a HOST TARGET binding site such as BINDING SITE I, BINDING SITE II or BINDING SITE III. Table 2 illustrates the complementarity of the nucleotide sequences of KIAA1111 BINDING SITE, designated SEQ ID:46020, to the nucleotide sequence of VGAM883 RNA, herein designated VGAM RNA, also designated SEQ ID:3594.

Another function of VGAM883 is therefore inhibition of KIAA1111 (Accession XM_171233). Accordingly, utilities of VGAM883 include diagnosis, prevention and treatment of diseases and clinical conditions associated with KIAA1111. KIAA1196 (Accession XM_028968) is another VGAM883 host target gene. KIAA1196 BINDING SITE is HOST TARGET binding site found in the 3' untranslated region of mRNA encoded by KIAA1196, corresponding to a HOST TARGET binding site such as BINDING SITE I, BINDING SITE II or BINDING SITE III. Table 2 illustrates the complementarity of the nucleotide sequences of KIAA1196 BINDING SITE, designated SEQ ID:30817, to the nucleotide sequence of VGAM883 RNA, herein designated VGAM RNA, also designated SEQ ID:3594.

Another function of VGAM883 is therefore inhibition of KIAA1196 (Accession XM_028968). Accordingly, utilities of VGAM883 include diagnosis, prevention and treatment of diseases and clinical conditions associated with KIAA1196. KIAA1750 (Accession XM_043067) is another VGAM883 host target gene. KIAA1750 BINDING SITE is HOST TARGET binding site found in the 3' untranslated region of mRNA encoded by KIAA1750, corresponding to a HOST TARGET binding site such as BINDING SITE I, BINDING SITE II or BINDING SITE III. Table 2 illustrates the complementarity of the nucleotide sequences of KIAA1750 BINDING SITE, designated SEQ ID:33874, to the nucleotide sequence of VGAM883 RNA, herein designated VGAM RNA, also designated SEQ ID:3594.

Another function of VGAM883 is therefore inhibition of KIAA1750 (Accession XM_043067). Accordingly, utilities of VGAM883 include diagnosis, prevention and treatment of diseases and clinical conditions associated with KIAA1750. KIAA1755 (Accession XM_028810) is another VGAM883 host target gene. KIAA1755 BINDING SITE is HOST TARGET binding site found in the 3' untranslated region of mRNA encoded by KIAA1755, corresponding to a HOST TARGET binding site such as BINDING SITE I, BINDING SITE II or BINDING SITE III. Table 2 illustrates the complementarity of the nucleotide sequences of KIAA1755 BINDING SITE, designated SEQ ID:30750, to the nucleotide sequence of VGAM883 RNA, herein designated VGAM RNA, also designated SEQ ID:3594.

Another function of VGAM883 is therefore inhibition of KIAA1755 (Accession XM_028810). Accordingly, utilities of VGAM883 include diagnosis, prevention and treatment of diseases and clinical conditions associated with KIAA1755. KIAA1910 (Accession XM_055514) is another VGAM883 host target gene. KIAA1910 BINDING SITE is HOST TARGET binding site found in the 3' untranslated region of mRNA encoded by KIAA1910, corresponding to a HOST TARGET binding site such as BINDING SITE I, BINDING SITE II or BINDING SITE III. Table 2 illustrates the complementarity of the nucleotide sequences of KIAA1910 BINDING SITE, designated SEQ ID:36287, to the nucleotide sequence of VGAM883 RNA, herein designated VGAM RNA, also designated SEQ ID:3594.

Another function of VGAM883 is therefore inhibition of KIAA1910 (Accession XM_055514). Accordingly, utilities of VGAM883 include diagnosis, prevention and treatment of diseases and clinical conditions associated with KIAA1910. Leucine Rich Repeat (in FLII) Interacting Protein 1 (LRRFIP1, Accession NM_004735) is another VGAM883 host target gene. LRRFIP1 BINDING SITE is HOST TARGET binding site found in the 3' untranslated region of mRNA encoded by LRRFIP1, corresponding to a HOST TARGET binding site such as BINDING SITE I, BINDING SITE II or BINDING SITE III. Table 2 illustrates the complementarity of the nucleotide sequences of LRRFIP1 BINDING SITE, designated SEQ ID:11119, to the nucleotide sequence of VGAM883 RNA, herein designated VGAM RNA, also designated SEQ ID:3594.

Another function of VGAM883 is therefore inhibition of Leucine Rich Repeat (in FLII) Interacting Protein 1 (LRRFIP1, Accession NM_004735). Accordingly, utilities of VGAM883 include diagnosis, prevention and treatment of diseases and clinical conditions associated with LRRFIP1. MFN2 (Accession NM_014874) is another VGAM883 host target gene. MFN2 BINDING SITE is HOST TARGET binding site found in the 3' untranslated region of mRNA encoded by MFN2, corresponding to a HOST TARGET binding site such as BINDING SITE I, BINDING SITE II or BINDING SITE III. Table 2 illustrates the complementarity of the nucleotide sequences of MFN2 BINDING SITE, designated SEQ ID:17010, to the nucleotide sequence of VGAM883 RNA, herein designated VGAM RNA, also designated SEQ ID:3594.

Another function of VGAM883 is therefore inhibition of MFN2 (Accession NM_014874). Accordingly, utilities of VGAM883 include diagnosis, prevention and treatment of diseases and clinical conditions associated with MFN2. MGC20255 (Accession NM_052848) is another VGAM883 host target gene. MGC20255 BINDING SITE is HOST TARGET binding site found in the 3' untranslated region of mRNA encoded by MGC20255, corresponding to a HOST TARGET binding site such as BINDING SITE I, BINDING SITE II or BINDING SITE III. Table 2 illustrates the complementarity of the nucleotide sequences of MGC20255 BINDING SITE, designated SEQ ID:27428, to the nucleotide sequence of VGAM883 RNA, herein designated VGAM RNA, also designated SEQ ID:3594.

Another function of VGAM883 is therefore inhibition of MGC20255 (Accession NM_052848). Accordingly, utilities of VGAM883 include diagnosis, prevention and treatment of diseases and clinical conditions associated with MGC20255. Neuritin 1 (NRN1, Accession NM_016588) is another VGAM883 host target gene. NRN1 BINDING SITE is HOST TARGET binding site found in the 3' untranslated region of mRNA encoded by NRN1, corresponding to a HOST TARGET binding site such as BINDING SITE I, BINDING SITE II or BINDING SITE III. Table 2 illustrates the complementarity of the nucleotide sequences of NRN1 BINDING SITE, designated SEQ ID:18663, to the nucleotide sequence of VGAM883 RNA, herein designated VGAM RNA, also designated SEQ ID:3594.

Another function of VGAM883 is therefore inhibition of Neuritin 1 (NRN1, Accession NM_016588). Accordingly, utilities of VGAM883 include diagnosis, prevention and treatment of diseases and clinical conditions associated with NRN1. Protein Phosphatase 1, Regulatory (inhibitor) Subunit 1A (PPP1R1A, Accession NM_006741) is another VGAM883 host target gene. PPP1R1A BINDING SITE is HOST TARGET binding site found in the 3' untranslated region of mRNA encoded by PPP1R1A, corresponding to a HOST TARGET binding site such as BINDING SITE I, BINDING SITE II or BINDING SITE III. Table 2 illustrates the complementarity of the nucleotide sequences of PPP1R1A BINDING SITE, designated SEQ ID:13591, to the nucleotide sequence of VGAM883 RNA, herein designated VGAM RNA, also designated SEQ ID:3594.

Another function of VGAM883 is therefore inhibition of Protein Phosphatase 1, Regulatory (inhibitor) Subunit 1A (PPP1R1A, Accession NM_006741). Accordingly, utilities of VGAM883 include diagnosis, prevention and treatment of diseases and clinical conditions associated with PPP1R1A. RAB10, Member RAS Oncogene Family (RAB10, Accession XM_097979) is another VGAM883 host target gene. RAB10 BINDING SITE is HOST TARGET binding site found in the 3' untranslated region of mRNA encoded by RAB10, corresponding to a HOST TARGET binding site such as BINDING SITE I, BINDING SITE II or BINDING SITE III. Table 2 illustrates the complementarity of the nucleotide sequences of RAB10 BINDING SITE, designated SEQ ID:41279, to the nucleotide sequence of VGAM883 RNA, herein designated VGAM RNA, also designated SEQ ID:3594.

Another function of VGAM883 is therefore inhibition of RAB10, Member RAS Oncogene Family (RAB10, Accession XM_097979). Accordingly, utilities of VGAM883 include diagnosis, prevention and treatment of diseases and clinical conditions associated with RAB10. LOC116113 (Accession XM_166413) is another VGAM883 host target gene. LOC116113 BINDING SITE is HOST TARGET binding site found in the 3' untranslated region of mRNA encoded by LOC116113, corresponding to a HOST TARGET binding site such as BINDING SITE I, BINDING SITE II or BINDING SITE III. Table 2 illustrates the complementarity of the nucleotide sequences of LOC116113 BINDING SITE, designated SEQ ID:44285, to the nucleotide sequence of VGAM883 RNA, herein designated VGAM RNA, also designated SEQ ID:3594.

Another function of VGAM883 is therefore inhibition of LOC116113 (Accession XM_166413). Accordingly, utilities of VGAM883 include diagnosis, prevention and treatment of diseases and clinical conditions associated with LOC116113. LOC146488 (Accession XM_047748) is another VGAM883 host target gene. LOC146488 BINDING SITE is HOST TARGET binding site found in the 3' untranslated region of mRNA encoded by LOC146488, corresponding to a HOST TARGET binding site such as BINDING SITE I, BINDING SITE II or BINDING SITE III. Table 2 illustrates the complementarity of the nucleotide sequences of LOC146488 BINDING SITE, designated SEQ ID:35044, to the nucleotide sequence of VGAM883 RNA, herein designated VGAM RNA, also designated SEQ ID:3594.

Another function of VGAM883 is therefore inhibition of LOC146488 (Accession XM_047748). Accordingly, utilities of VGAM883 include diagnosis, prevention and treatment of diseases and clinical conditions associated with LOC146488. LOC149577 (Accession XM_097675) is another VGAM883 host target gene. LOC149577 BINDING SITE is HOST TARGET binding site found in the 3' untranslated region of mRNA encoded by LOC149577, corresponding to a HOST TARGET binding site such as BINDING SITE I, BINDING SITE II or BINDING SITE III. Table 2 illustrates the complementarity of the nucleotide sequences of LOC149577 BINDING SITE, designated SEQ ID:41022, to the nucleotide sequence of VGAM883 RNA, herein designated VGAM RNA, also designated SEQ ID:3594.

Another function of VGAM883 is therefore inhibition of LOC149577 (Accession XM_097675). Accordingly, utilities of VGAM883 include diagnosis, prevention and treatment of diseases and clinical conditions associated with LOC149577. LOC158310 (Accession XM_098919) is another VGAM883 host target gene. LOC158310 BINDING SITE is HOST TARGET binding site found in the 5' untranslated region of mRNA encoded by LOC158310, corresponding to a HOST TARGET binding site such as BINDING SITE I, BINDING SITE II or BINDING SITE III. Table 2 illustrates the complementarity of the nucleotide sequences of LOC158310 BINDING SITE, designated SEQ ID:41949, to the nucleotide sequence of VGAM883 RNA, herein designated VGAM RNA, also designated SEQ ID:3594.

Another function of VGAM883 is therefore inhibition of LOC158310 (Accession XM_098919). Accordingly, utilities of VGAM883 include diagnosis, prevention and treatment of diseases and clinical conditions associated with LOC158310. LOC196500 (Accession XM_113734) is another VGAM883 host target gene. LOC196500 BINDING SITE is HOST TARGET binding site found in the 5' untranslated region of mRNA encoded by LOC196500, corresponding to a HOST TARGET binding site such as BINDING SITE I, BINDING SITE II or BINDING SITE III. Table 2 illustrates the complementarity of the nucleotide sequences of LOC196500 BINDING SITE, designated SEQ ID:42389, to the nucleotide sequence of VGAM883 RNA, herein designated VGAM RNA, also designated SEQ ID:3594.

Another function of VGAM883 is therefore inhibition of LOC196500 (Accession XM_113734). Accordingly, utilities of VGAM883 include diagnosis, prevention and treatment of diseases and clinical conditions associated with LOC196500. LOC201475 (Accession XM_113967) is another VGAM883 host target gene. LOC201475 BINDING SITE is HOST TARGET binding site found in the 5' untranslated region of mRNA encoded by LOC201475, corresponding to a HOST TARGET binding site such as BINDING SITE I, BINDING SITE II or BINDING SITE III. Table 2 illustrates the complementarity of the nucleotide sequences of LOC201475 BINDING SITE, designated SEQ ID:42578, to the nucleotide sequence of VGAM883 RNA, herein designated VGAM RNA, also designated SEQ ID:3594.

Another function of VGAM883 is therefore inhibition of LOC201475 (Accession XM_113967). Accordingly, utilities of VGAM883 include diagnosis, prevention and treatment of diseases and clinical conditions associated with LOC201475. LOC253216 (Accession XM_170765) is another VGAM883 host target gene. LOC253216 BINDING SITE is HOST TARGET binding site found in the 3' untranslated region of mRNA encoded by LOC253216, corresponding to a HOST TARGET binding site such as BINDING SITE I, BINDING SITE II or BINDING SITE III. Table 2 illustrates the complementarity of the nucleotide sequences of LOC253216 BINDING SITE, designated SEQ ID:45519, to the nucleotide sequence of VGAM883 RNA, herein designated VGAM RNA, also designated SEQ ID:3594.

Another function of VGAM883 is therefore inhibition of LOC253216 (Accession XM_170765). Accordingly, utilities of VGAM883 include diagnosis, prevention and treatment of diseases and clinical conditions associated with LOC253216. LOC253868 (Accession XM_170975) is another VGAM883 host target gene. LOC253868 BINDING SITE is HOST TARGET binding site found in the 3' untranslated region of mRNA encoded by LOC253868, corresponding to a HOST TARGET binding site such as BINDING SITE I, BINDING SITE II or BINDING SITE III. Table 2 illustrates the complementarity of the nucleotide sequences of LOC253868 BINDING SITE, designated SEQ ID:45747, to the nucleotide sequence of VGAM883 RNA, herein designated VGAM RNA, also designated SEQ ID:3594.

Another function of VGAM883 is therefore inhibition of LOC253868 (Accession XM_170975). Accordingly, utilities of VGAM883 include diagnosis, prevention and treatment of diseases and clinical conditions associated with LOC253868. LOC90019 (Accession NM_138567) is another VGAM883 host target gene. LOC90019 BINDING SITE is HOST TARGET binding site found in the 3' untranslated region of mRNA encoded by LOC90019, corresponding to a HOST TARGET binding site such as BINDING SITE I, BINDING SITE II or BINDING SITE III. Table 2 illustrates the complementarity of the nucleotide sequences of LOC90019 BINDING SITE, designated SEQ ID:28871, to the nucleotide sequence of VGAM883 RNA, herein designated VGAM RNA, also designated SEQ ID:3594.

Another function of VGAM883 is therefore inhibition of LOC90019 (Accession NM_138567). Accordingly, utilities of VGAM883 include diagnosis, prevention and treatment of diseases and clinical conditions associated with LOC90019. LOC91397 (Accession XM_038219) is another VGAM883 host target gene. LOC91397 BINDING SITE is HOST TARGET binding site found in the 5' untranslated region of mRNA encoded by LOC91397, corresponding to a HOST TARGET binding site such as BINDING SITE I, BINDING SITE II or BINDING SITE III. Table 2 illustrates the complementarity of the nucleotide sequences of LOC91397 BINDING SITE, designated SEQ ID:32782, to the nucleotide sequence of VGAM883 RNA, herein designated VGAM RNA, also designated SEQ ID:3594.

Another function of VGAM883 is therefore inhibition of LOC91397 (Accession XM_038219). Accordingly, utilities of VGAM883 include diagnosis, prevention and treatment of diseases and clinical conditions associated with LOC91397. LOC95702 (Accession XM_031446) is another VGAM883 host target gene. LOC95702 BINDING SITE is HOST TAR- GET binding site found in the 5' untranslated region of mRNA encoded by LOC95702, corresponding to a HOST TARGET binding site such as BINDING SITE I, BINDING SITE II or BINDING SITE III. Table 2 illustrates the complementarity of the nucleotide sequences of LOC95702 BINDING SITE, designated SEQ ID:31382, to the nucleotide sequence of VGAM883 RNA, herein designated VGAM RNA, also designated SEQ ID:3594.

Another function of VGAM883 is therefore inhibition of LOC95702 (Accession XM_031446). Accordingly, utilities of VGAM883 include diagnosis, prevention and treatment of diseases and clinical conditions associated with LOC95702. FIG. 1 further provides a conceptual description of a novel bioinformatically detected viral gene of the present invention, referred to here as Viral Genomic Address Messenger 884 (VGAM884) viral gene, which modulates expression of respective host target genes thereof, the function and utility of which host target genes is known in the art.

VGAM884 is a novel bioinformatically detected regulatory, non protein coding, viral micro RNA (miRNA) gene. The method by which VGAM884 was detected is described hereinabove with reference to FIGS. 1-8.

VGAM884 gene, herein designated VGAM GENE, is a viral gene contained in the genome of Rat Cytomegalovirus. VGAM884 host target gene, herein designated VGAM HOST TARGET GENE, is a human gene contained in the human genome.

VGAM884 gene encodes a VGAM884 precursor RNA, herein designated VGAM PRECURSOR RNA. Similar to other miRNA genes, and unlike most ordinary genes, VGAM884 precursor RNA does not encode a protein. A nucleotide sequence identical or highly similar to the nucleotide sequence of VGAM884 precursor RNA is designated SEQ ID:870, and is provided hereinbelow with reference to the sequence listing part. Nucleotide sequence SEQ ID:870 is located at position 93181 relative to the genome of Rat Cytomegalovirus.

VGAM884 precursor RNA folds onto itself, forming VGAM884 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM884 folded precursor RNA into VGAM884 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM884 RNA is designated SEQ ID:3595, and is provided hereinbelow with reference to the sequence listing part.

VGAM884 host target gene, herein designated VGAM HOST TARGET GENE, encodes a corresponding messenger RNA, VGAM884 host target RNA, herein designated VGAM HOST TARGET RNA. VGAM884 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM884 RNA, herein designated VGAM RNA, binds complementarily to one or more host target binding sites located in untranslated regions of VGAM884 host target RNA, herein designated VGAM HOST TARGET RNA. This complementary binding is due to the fact that the nucleotide sequence of VGAM884 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM884 RNA, herein designated VGAM RNA, may have a different number of host target binding sites in untranslated regions of a VGAM884 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM884 RNA, herein designated VGAM RNA, to host target binding sites on VGAM884 host target RNA, herein designated VGAM HOST TARGET RNA, such as BINDING SITE I, BINDING SITE II and BINDING SITE III, inhibits translation of VGAM884 host target RNA into VGAM884 host target protein, herein designated VGAM HOST TARGET PROTEIN. VGAM host target protein is therefore outlined by a broken line.

It is appreciated that VGAM884 host target gene, herein designated VGAM HOST TARGET GENE, in fact represents a plurality of VGAM884 host target genes. The mRNA of each one of this plurality of VGAM884 host target genes comprises one or more host target binding sites, each having a nucleotide sequence which is at least partly complementary to VGAM884 RNA, herein designated VGAM RNA, and which when bound by VGAM884 RNA causes inhibition of translation of respective one or more VGAM884 host target proteins.

It is further appreciated by one skilled in the art that the mode of translational inhibition illustrated by FIG. 1 with specific reference to translational inhibition exerted by VGAM884 gene, herein designated VGAM GENE, on one or more VGAM884 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM884 is inhibition of expression of host target genes, as part of a novel viral mechanism of attacking a host. Accordingly, utilities of VGAM884 include diagnosis, prevention and treatment of viral infection by Rat Cytomegalovirus. Specific functions, and accordingly utilities, of VGAM884 correlate with, and may be deduced from, the identity of the host target genes which VGAM884 binds and inhibits, and the function of these host target genes, as elaborated hereinbelow.

Nucleotide sequences of the VGAM884 precursor RNA, herein designated VGAM PRECURSOR RNA, and of the 'diced' VGAM884 RNA, herein designated VGAM RNA, and a schematic representation of the secondary folding of VGAM884 folded precursor RNA, herein designated VGAM FOLDED PRECURSOR RNA, of VGAM884 are further described hereinbelow with reference to Table 1.

Nucleotide sequences of host target binding sites, such as BINDING SITE-I, BINDING SITE-II and BINDING SITE-III of FIG. 1, found on VGAM884 host target RNA, and schematic representation of the complementarity of each of these host target binding sites to VGAM884 RNA, herein designated VGAM RNA, are described hereinbelow with reference to Table 2.

As mentioned hereinabove with reference to FIG. 1, a function of VGAM884 gene, herein designated VGAM is inhibition of expression of VGAM884 target genes. It is appreciated that specific functions, and accordingly utilities, of VGAM884 correlate with, and may be deduced from, the identity of the target genes which VGAM884 binds and inhibits, and the function of these target genes, as elaborated hereinbelow.

Mitogen-activated Protein Kinase 1 (MAPK1, Accession NM_002745) is a VGAM884 host target gene. MAPK1 BINDING SITE is HOST TARGET binding site found in the 3' untranslated region of mRNA encoded by MAPK1, corresponding to a HOST TARGET binding site such as BINDING SITE I, BINDING SITE II or BINDING SITE III. Table 2 illustrates the complementarity of the nucleotide sequences of MAPK1 BINDING SITE, designated SEQ ID:8617, to the nucleotide sequence of VGAM884 RNA, herein designated VGAM RNA, also designated SEQ ID:3595.

A function of VGAM884 is therefore inhibition of Mitogen-activated Protein Kinase 1 (MAPK1, Accession NM_002745), a gene which phosphorylates microtubule-associated protein-2 (map2). myelin basic protein (mbp), and elk-1; may promote entry in the cell cycle. Accordingly, utilities of VGAM884 include diagnosis, prevention and treatment of diseases and clinical conditions associated with MAPK1. The function of MAPK1 and its association with various diseases and clinical conditions, has been established by previous studies, as described hereinabove with reference to VGAM217. LOC126302 (Accession XM_059020) is another VGAM884 host target gene. LOC126302 BINDING SITE is HOST TARGET binding site found in the 3' untranslated region of mRNA encoded by LOC126302, corresponding to a HOST TARGET binding site such as BINDING SITE I, BINDING SITE II or BINDING SITE III. Table 2 illustrates the complementarity of the nucleotide sequences of LOC126302 BINDING SITE, designated SEQ ID:36825, to the nucleotide sequence of VGAM884 RNA, herein designated VGAM RNA, also designated SEQ ID:3595.

Another function of VGAM884 is therefore inhibition of LOC126302 (Accession XM_059020). Accordingly, utilities of VGAM884 include diagnosis, prevention and treatment of diseases and clinical conditions associated with LOC126302. LOC51277 (Accession XM_087054) is another VGAM884 host target gene. LOC51277 BINDING SITE is HOST TARGET binding site found in the 3' untranslated region of mRNA encoded by LOC51277, corresponding to a HOST TARGET binding site such as BINDING SITE I, BINDING SITE II or BINDING SITE III. Table 2 illustrates the complementarity of the nucleotide sequences of LOC51277 BINDING SITE, designated SEQ ID:39023, to the nucleotide sequence of VGAM884 RNA, herein designated VGAM RNA, also designated SEQ ID:3595.

Another function of VGAM884 is therefore inhibition of LOC51277 (Accession XM_087054). Accordingly, utilities of VGAM884 include diagnosis, prevention and treatment of diseases and clinical conditions associated with LOC51277. LOC56965 (Accession NM_020213) is another VGAM884 host target gene. LOC56965 BINDING SITE is HOST TARGET binding site found in the 3' untranslated region of mRNA encoded by LOC56965, corresponding to a HOST TARGET binding site such as BINDING SITE I, BINDING SITE II or BINDING SITE III. Table 2 illustrates the complementarity of the nucleotide sequences of LOC56965 BINDING SITE, designated SEQ ID:21450, to the nucleotide sequence of VGAM884 RNA, herein designated VGAM RNA, also designated SEQ ID:3595.

Another function of VGAM884 is therefore inhibition of LOC56965 (Accession NM_020213). Accordingly, utilities of VGAM884 include diagnosis, prevention and treatment of diseases and clinical conditions associated with LOC56965. FIG. 1 further provides a conceptual description of a novel bioinformatically detected viral gene of the present invention, referred to here as Viral Genomic Address Messenger 885 (VGAM885) viral gene, which modulates expression of respective host target genes thereof, the function and utility of which host target genes is known in the art.

VGAM885 is a novel bioinformatically detected regulatory, non protein coding, viral micro RNA (miRNA) gene. The method by which VGAM885 was detected is described hereinabove with reference to FIGS. 1-8.

VGAM885 gene, herein designated VGAM GENE, is a viral gene contained in the genome of Human Adenovirus E. VGAM885 host target gene, herein designated VGAM HOST TARGET GENE, is a human gene contained in the human genome.

VGAM885 gene encodes a VGAM885 precursor RNA, herein designated VGAM PRECURSOR RNA. Similar to other miRNA genes, and unlike most ordinary genes, VGAM885 precursor RNA does not encode a protein. A nucleotide sequence identical or highly similar to the nucleotide sequence of VGAM885 precursor RNA is designated SEQ ID:871, and is provided hereinbelow with reference to the sequence listing part. Nucleotide sequence SEQ ID:871 is located at position 7211 relative to the genome of Human Adenovirus E.

VGAM885 precursor RNA folds onto itself, forming VGAM885 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM885 folded precursor RNA into VGAM885 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM885 RNA is designated SEQ ID:3596, and is provided hereinbelow with reference to the sequence listing part.

VGAM885 host target gene, herein designated VGAM HOST TARGET GENE, encodes a corresponding messenger RNA, VGAM885 host target RNA, herein designated VGAM HOST TARGET RNA. VGAM885 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM885 RNA, herein designated VGAM RNA, binds complementarily to one or more host target binding sites located in untranslated regions of VGAM885 host target RNA, herein designated VGAM HOST TARGET RNA. This complementary binding is due to the fact that the nucleotide sequence of VGAM885 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM885 RNA, herein designated VGAM RNA, may have a different number of host target binding sites in untranslated regions of a VGAM885 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM885 RNA, herein designated VGAM RNA, to host target binding sites on VGAM885 host target RNA, herein designated VGAM HOST TARGET RNA, such as BINDING SITE I, BINDING SITE II and BINDING SITE III, inhibits translation of VGAM885 host target RNA into VGAM885 host target protein, herein designated VGAM HOST TARGET PROTEIN. VGAM host target protein is therefore outlined by a broken line.

It is appreciated that VGAM885 host target gene, herein designated VGAM HOST TARGET GENE, in fact represents a plurality of VGAM885 host target genes. The mRNA of each one of this plurality of VGAM885 host target genes comprises one or more host target binding sites, each having a nucleotide sequence which is at least partly complementary to VGAM885 RNA, herein designated VGAM RNA, and which when bound by VGAM885 RNA causes inhibition of translation of respective one or more VGAM885 host target proteins.

It is further appreciated by one skilled in the art that the mode of translational inhibition illustrated by FIG. 1 with specific reference to translational inhibition exerted by VGAM885 gene, herein designated VGAM GENE, on one or more VGAM885 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM885 is inhibition of expression of host target genes, as part of a novel viral mechanism of attacking a host. Accordingly, utilities of VGAM885 include diagnosis, prevention and treatment of viral infection by Human Adenovirus E. Specific functions, and accordingly utilities, of VGAM885 correlate with, and may be deduced from, the identity of the host target genes which VGAM885 binds and inhibits, and the function of these host target genes, as elaborated hereinbelow.

Nucleotide sequences of the VGAM885 precursor RNA, herein designated VGAM PRECURSOR RNA, and of the 'diced' VGAM885 RNA, herein designated VGAM RNA, and a schematic representation of the secondary folding of VGAM885 folded precursor RNA, herein designated VGAM FOLDED PRECURSOR RNA, of VGAM885 are further described hereinbelow with reference to Table 1.

Nucleotide sequences of host target binding sites, such as BINDING SITE-I, BINDING SITE-II and BINDING SITE-III of FIG. 1, found on VGAM885 host target RNA, and schematic representation of the complementarity of each of these host target binding sites to VGAM885 RNA, herein designated VGAM RNA, are described hereinbelow with reference to Table 2.

As mentioned hereinabove with reference to FIG. 1, a function of VGAM885 gene, herein designated VGAM is inhibition of expression of VGAM885 target genes. It is appreciated that specific functions, and accordingly utilities, of VGAM885 correlate with, and may be deduced from, the identity of the target genes which VGAM885 binds and inhibits, and the function of these target genes, as elaborated hereinbelow.

Alkaline Phosphatase, Intestinal (ALPI, Accession NM_001631) is a VGAM885 host target gene. ALPI BINDING SITE is HOST TARGET binding site found in the 3' untranslated region of mRNA encoded by ALPI, corresponding to a HOST TARGET binding site such as BINDING SITE I, BINDING SITE II or BINDING SITE III. Table 2 illustrates the complementarity of the nucleotide sequences of ALPI BINDING SITE, designated SEQ ID:7344, to the nucleotide sequence of VGAM885 RNA, herein designated VGAM RNA, also designated SEQ ID:3596.

A function of VGAM885 is therefore inhibition of Alkaline Phosphatase, Intestinal (ALPI, Accession NM_001631), a gene which is a glycoprotein phosphatase. Accordingly, utilities of VGAM885 include diagnosis, prevention and treatment of diseases and clinical conditions associated with ALPI. The function of ALPI has been established by previous studies. Harris et al. (1974) found no genetic variants by electrophoretic means. Lehmann (1980) provided biochemical corroboration of the genetic distinctness of 3 alkaline phosphatases: intestinal, placental, and liver/bone/kidney. The existence of at least 1 gene coding for the intestinal forms (adult and fetal), independent of the other forms listed here, is inescapable (Goldstein et al., 1980). Gogolin et al. (1982) found a monoclonal antibody raised against purified human placental alkaline phosphatase that crossreacted with the adult and fetal forms of intestinal alkaline phosphatase, despite the fact that the placental and intestinal enzymes are nonallelic. Berger et al. (1987) used alkaline phosphatase cDNA as a probe to clone intestinal alkaline phosphatase cDNA, since partial protein sequence data indicated a high degree of homology between intestinal alkaline phosphatase and the reported sequence of the placental isoenzyme. Intestinal alkaline phosphatase cDNA, which is 3.1 kb, is somewhat larger than the cDNA for the placental isoenzyme, which is 2.8 kb. Differences and similarities were pointed out. Henthorn et al. (1987) isolated and sequenced a cDNA that encodes the alkaline phosphatase expressed in adult human intestine and compared the sequence with those previously determined for the placental (OMIM Ref. No. 171800) and liver/bone/kidney (OMIM Ref. No. 171760) cDNAs. The deduced polypeptide showed 86.5% amino acid identity to placental ALP and 56.6% amino acid identity to liver/bone/kidney ALP. Thus, the immunologic cross-reactivity of ALPI and ALPP is perhaps explained. Henthorn et al. (1988) isolated and sequenced the ALPI gene in its entirety. The gene is composed of 11 exons interrupted by 10 introns. Introns in intestinal, placental, and liver/bone/kidney ALP genes occur at analogous positions, confirming that these genes arose from a single ancestral gene. Henthorn et al. (1987) stated that the placental and intestinal ALP genes map to the same region of chromosome 2. Griffin et al. (1987) mapped both the placental and the intestinal alkaline phosphatase genes to 2q34-q37 by chromosomal in situ hybridization and hybridization to the DNA of somatic cell hybrids. By fluorescence in situ hybridization, Wu et al. (1993) mapped ALPI to 2q36.3-q37.1. Pasteris et al. (1993) concluded from a molecular analysis of a chromosome 2 deletion mapping panel that the ALPI gene is on the telomeric side of both PAX3 (OMIM Ref. No. 606597) and COL4A3 (OMIM Ref. No. 120070) and close to CHRND (OMIM Ref. No. 100720).

Full details of the abovementioned studies are described in the following publications, the disclosure of which are hereby incorporated by reference:

Henthorn, P. S.; Raducha, M.; Edwards, Y. H.; Weiss, M. J.; Slaughter, C.; Lafferty, M. A.; Harris, H.: Nucleotide and amino acid sequences of human intestinal alkaline phosphatase: close homology to placental alkaline phosphatase. Proc. Nat. Acad. Sci. 84:1234-1238, 1987; and Langman, M. J. S.; Leuthold, E.; Robson, E. B.; Harris, J.; Luffman, J. E.; Harris, H.: Influence of diet on the 'intestinal' component of serum alkaline phosphatase in people of differ.

Further studies establishing the function and utilities of ALPI are found in John Hopkins OMIM database record ID 171740, and in sited publications numbered 10, 2495-2498, 1886, 2499-250 and 4112 listed in the bibliography section hereinbelow, which are also hereby incorporated by reference. Ras Homolog Gene Family, Member C (ARHC, Accession NM_005167) is another VGAM885 host target gene. ARHC BINDING SITE is HOST TARGET binding site found in the 5' untranslated region of mRNA encoded by ARHC, corresponding to a HOST TARGET binding site such as BINDING SITE I, BINDING SITE II or BINDING SITE III. Table 2 illustrates the complementarity of the nucleotide sequences of ARHC BINDING SITE, designated SEQ ID:11664, to the nucleotide sequence of VGAM885 RNA, herein designated VGAM RNA, also designated SEQ ID:3596.

Another function of VGAM885 is therefore inhibition of Ras Homolog Gene Family, Member C (ARHC, Accession NM_005167), a gene which remodels of the actin cytoskeleton during cell morphogenesis and motility. Accordingly, utilities of VGAM885 include diagnosis, prevention and treatment of diseases and clinical conditions associated with ARHC. The function of ARHC has been established by previous studies. The small guanosine triphosphatase Rho regulates remodeling of the actin cytoskeleton during cell morphogenesis and motility. In their FIG. 3C, Maekawa et al. (1999) diagrammed proposed signaling pathways for Rho-induced remodeling of the actin cytoskeleton. They demonstrated that active Rho signals to its downstream effector ROCK (OMIM Ref. No. 601702), which phosphorylates and activates LIM kinase (see OMIM Ref. No. 601329). LIM kinase, in turn, phosphorylates cofilin (OMIM Ref. No. 601442), inhibiting its actin-depolymerizing activity. Clark et al. (2000) used an in vivo selection scheme to select highly metastatic melanoma cells. By analyzing these cells on DNA arrays, they defined a pattern of gene expression that correlates with progression to a metastatic phenotype. In particular, Clark et al. (2000) showed enhanced expression of several genes involved in extracellular matrix assembly and of a second set of genes that regulate, either directly or indirectly, the actin-based cytoskeleton. Clark et al. (2000) found that RhoC enhances metastasis when overexpressed, whereas a dominant-negative Rho inhibits metastasis. Analysis of the phenotype of cells expressing dominant-negative Rho or RhoC indicates that RhoC is important in tumor cell invasion. The genomic approach allowed Clark et al. (2000) to identify families of genes involved in a process, not just single genes, and could indicate which molecular and cellular events might be important in complex biologic processes such as metastasis.

Full details of the abovementioned studies are described in the following publications, the disclosure of which are hereby incorporated by reference:

Clark, E. A.; Golub, T. R.; Lander, E. S.; Hynes, R. O.: Genomic analysis of metastasis reveals an essential role for RhoC. Nature 406:532-535, 2000; and Maekawa, M.; Ishizaki, T.; Boku, S.; Watanabe, N.; Fujita, A.; Iwamatsu, A.; Obinata, T.; Ohashi, K.; Mizuno, K.; Narumiya, S.: Signaling from Rho to the actin cytoskeleton through pro.

Further studies establishing the function and utilities of ARHC are found in John Hopkins OMIM database record ID 165380, and in sited publications numbered 10904-10905, 2155, 10909-1090 and 10910 listed in the bibliography section hereinbelow, which are also hereby incorporated by reference. BLTR2 (Accession NM_019839) is another VGAM885 host target gene. BLTR2 BINDING SITE is HOST TARGET binding site found in the 5' untranslated region of mRNA encoded by BLTR2, corresponding to a HOST TARGET binding site such as BINDING SITE I, BINDING SITE II or BINDING SITE III. Table 2 illustrates the complementarity of the nucleotide sequences of BLTR2 BINDING SITE, designated SEQ ID:21244, to the nucleotide sequence of VGAM885 RNA, herein designated VGAM RNA, also designated SEQ ID:3596.

Another function of VGAM885 is therefore inhibition of BLTR2 (Accession NM_019839). Accordingly, utilities of VGAM885 include diagnosis, prevention and treatment of diseases and clinical conditions associated with BLTR2. Calpain 10 (CAPN10, Accession NM_023084) is another VGAM885 host target gene. CAPN10 BINDING SITE1 through CAPN10 BINDING SITE4 are HOST TARGET binding sites found in untranslated regions of mRNA encoded by CAPN10, corresponding to HOST TARGET binding sites such as BINDING SITE I, BINDING SITE II or BINDING SITE III. Table 2 illustrates the complementarity of the nucleotide sequences of CAPN10 BINDING SITE1 through CAPN10 BINDING SITE4, designated SEQ ID:23347, SEQ ID:23349, SEQ ID:23351 and SEQ ID:23353 respectively, to the nucleotide sequence of VGAM885 RNA, herein designated VGAM RNA, also designated SEQ ID:3596.

Another function of VGAM885 is therefore inhibition of Calpain 10 (CAPN10, Accession NM_023084), a gene which catalyzes limited proteolysis of substrates involved in cytoskeletal remodelling and signal tranduction. Accordingly, utilities of VGAM885 include diagnosis, prevention and treatment of diseases and clinical conditions associated with CAPN10. The function of CAPN10 and its association with various diseases and clinical conditions, has been established by previous studies, as described hereinabove with reference to VGAM247. Cell Division Cycle 2-like 2 (CDC2L2, Accession NM_033532) is another VGAM885 host target gene. CDC2L2 BINDING SITE is HOST TARGET binding site found in the 5' untranslated region of mRNA encoded by CDC2L2, corresponding to a HOST TARGET binding site such as BINDING SITE I, BINDING SITE II or BINDING SITE III. Table 2 illustrates the complementarity of the nucleotide sequences of CDC2L2 BINDING SITE, designated SEQ ID:27301, to the nucleotide sequence of VGAM885 RNA, herein designated VGAM RNA, also designated SEQ ID:3596.

Another function of VGAM885 is therefore inhibition of Cell Division Cycle 2-like 2 (CDC2L2, Accession NM_033532). Accordingly, utilities of VGAM885 include diagnosis, prevention and treatment of diseases and clinical conditions associated with CDC2L2. Deoxyribonuclease I-like 1 (DNASE1L1, Accession NM_006730) is another VGAM885 host target gene. DNASE1L1 BINDING SITE is HOST TARGET binding site found in the 3' untranslated region of mRNA encoded by DNASE1L1, corresponding to a HOST TARGET binding site such as BINDING SITE I, BINDING SITE II or BINDING SITE III. Table 2 illustrates the complementarity of the nucleotide sequences of DNASE1L1 BINDING SITE, designated SEQ ID:13567, to the nucleotide sequence of VGAM885 RNA, herein designated VGAM RNA, also designated SEQ ID:3596.

Another function of VGAM885 is therefore inhibition of Deoxyribonuclease I-like 1 (DNASE1L1, Accession NM_006730), a gene which seems to be involved in cell death. Accordingly, utilities of VGAM885 include diagnosis, prevention and treatment of diseases and clinical conditions associated with DNASE1L1. The function of DNASE1L1 has been established by previous studies. Parrish et al. (1995) isolated a novel cDNA from the region of Xq28 between QM (OMIM Ref. No. 312173) and DXS1010E. Sequence similarity to DNase I (OMIM Ref. No. 125505) was high at the DNA and peptide sequence levels. The transcript was present at highest levels in skeletal and cardiac muscle, with lower expression in other tissues. Mutation analysis was performed using DNA samples from 2 unrelated patients with Barth syndrome (OMIM Ref. No. 302060) and from 11 unrelated patients with Emery-Dreifuss muscular dystrophy (OMIM Ref. No. 310300), 2 genetic disorders involving muscle and with joint linkage to Xq28. No disease-associated mutations were detected in the coding region of the gene; however, Parrish et al. (1995) found a novel 190-bp insertion/deletion polymorphism in the 3-prime untranslated region. Translation of the long open reading frame found in the cDNA yielded a putative 302-amino acid protein with 37.6% identity to human DNase I. The protein was predicted to contain a signal sequence at the amino terminus, a transmembrane domain near the carboxyl terminus, and a helix-loop-helix domain. Pergolizzi et al. (1996) screened cDNA libraries with a cosmid that had been mapped to Xq28 in the region between RCP/GCP (303900; 303800) and G6PD (OMIM Ref. No. 305900). They obtained a 2.1-kb cDNA and showed that it encodes a putative 302-amino acid protein with 44% sequence identity to pig DNase I and 39% identity to human DNase I. Northern blots showed a single 2.0-kb transcript in adult heart and skeletal muscle and an additional transcript of 2.5 kb in some fetal tissues. (The sequence of Pergolizzi et al. (1996) was identical to that reported by Parrish et al. (1995)).

Full details of the abovementioned studies are described in the following publications, the disclosure of which are hereby incorporated by reference:

Parrish, J. E.; Ciccodicola, A.; Wehnert, M.; Cox, G. F.; Chen, E.; Nelson, D. L.: A muscle-specific DNase I-like gene in human Xq28. Hum. Molec. Genet. 4:1557-1564, 1995; and Pergolizzi, R.; Appierto, V.; Bosetti, A.; DeBellis, G. L.; Rovida, E.; Biunno, I.: Cloning of a gene encoding a DNase I-like endonuclease in the human Xq28 region. Gene 168: 267-270.

Further studies establishing the function and utilities of DNASE1L1 are found in John Hopkins OMIM database record ID 300081, and in sited publications numbered 10970-10971 listed in the bibliography section hereinbelow, which are also hereby incorporated by reference. Deoxyribonuclease II, Lysosomal (DNASE2, Accession NM_001375) is another VGAM885 host target gene. DNASE2 BINDING SITE is HOST TARGET binding site found in the 3' untranslated region of mRNA encoded by DNASE2, corresponding to a HOST TARGET binding site such as BINDING SITE I, BINDING SITE II or BINDING SITE III. Table 2 illustrates the complementarity of the nucleotide sequences of DNASE2 BINDING SITE, designated SEQ ID:7049, to the nucleotide sequence of VGAM885 RNA, herein designated VGAM RNA, also designated SEQ ID:3596.

Another function of VGAM885 is therefore inhibition of Deoxyribonuclease II, Lysosomal (DNASE2, Accession NM_001375), a gene which has a possible role in apoptosis. Accordingly, utilities of VGAM885 include diagnosis, prevention and treatment of diseases and clinical conditions associated with DNASE2. The function of DNASE2 has been established by previous studies. Yasuda et al. (1992) described a specific and highly sensitive assay for urinary and leukocytic DNASE2. In both urine and leukocytes, the enzyme showed clear-cut bimodality, and the Japanese study population could be classified into 2 distinct types, namely low-activity (DNASE2 L) and high-activity (DNASE2 H), which indicated the existence of a genetic polymorphism. Close correlations between the leukocytic and urinary enzyme activity levels from the same individuals were observed, and the types in the leukocyte samples agreed with the types found in the corresponding urine samples. In a group of 528 unrelated Japanese individuals, the gene frequencies of the low-activity allele (DNASE2*L) and the high-activity allele (DNASE2*H) were calculated to be 0.632 and 0.368, respectively. Sex and age did not affect the distribution of the DNASE2 activity levels. Family studies indicated that the low-activity type is autosomal recessive. Using RACE with primers based on the sequence of purified DNase II protein to amplify thyroid RNA, Yasuda et al. (1998) cloned the DNase II gene. The predicted 360-amino acid protein has 3 parts: a 16-amino acid signal peptide, a 91-amino acid propeptide, and a 253-amino acid mature protein region. Yasuda et al. (1998) suggested that, like other lysosomal enzymes, DNase II is processed by release of a signal peptide followed by proteolytic processing that generates a 2-chain enzyme. Purified DNase II migrates as 2 bands (32 and 12 kD) on SDS-PAGE. Using RT-PCR, Yasuda et al. (1998) found that DNase II is expressed ubiquitously. Animal model experiments lend further support to the function of DNASE2. Mature erythrocytes in mammals have no nuclei, although they differentiate from nucleated precursor cells. Kawane et al. (2001) demonstrated that DNase II is indispensable for definitive erythropoiesis in mouse fetal liver. No live DNase II-null mice were born, owing to severe anemia. When mutant fetal liver cells were transferred into lethally irradiated wild-type mice, mature red blood cells were generated from the mutant cells, suggesting that DNase II functions in a non-cell-autonomous manner. Histochemical analyses indicated that the critical cellular sources of DNase II are macrophages present at the site of definitive erythropoiesis in the fetal liver. Thus, Kawane et al. (2001) concluded that DNase II in macrophages appears to be responsible for destroying the nuclear DNA expelled from erythroid precursor cells.

It is appreciated that the abovementioned animal model for DNASE2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Yasuda, T.; Nadano, D.; Sawazaki, K.; Kishi, K.: Genetic polymorphism of human deoxyribonuclease II (DNase II): low activity levels in urine and leukocytes are due to an autosomal recessive allele. Ann. Hum. Genet. 56:1-10, 1992; and Yasuda, T.; Takeshita, H.; Iida, R.; Nakajima, T.; Hosomi, O.; Nakashima, Y.; Kishi, K.: Molecular cloning of the cDNA encoding human deoxyribonuclease II. J. Biol. Chem. 273: 2610-261.

Further studies establishing the function and utilities of DNASE2 are found in John Hopkins OMIM database record ID 126350, and in sited publications numbered 3436-3441 listed in the bibliography section hereinbelow, which are also hereby incorporated by reference. Hedgehog Interacting Protein (HHIP, Accession NM_022475) is another VGAM885 host target gene. HHIP BINDING SITE is HOST TARGET binding site found in the 5' untranslated region of mRNA encoded by HHIP, corresponding to a HOST TARGET binding site such as BINDING SITE I, BINDING SITE II or BINDING SITE III. Table 2 illustrates the complementarity of the nucleotide sequences of HHIP BINDING SITE, designated SEQ ID:22842, to the nucleotide sequence of VGAM885 RNA, herein designated VGAM RNA, also designated SEQ ID:3596.

Another function of VGAM885 is therefore inhibition of Hedgehog Interacting Protein (HHIP, Accession NM_022475), a gene which is involved in many fundamental processes in embryonic development, including anteroposterior patterns of limbs and regulation of left-right asymmetry. Accordingly, utilities of VGAM885 include diagnosis, prevention and treatment of diseases and clinical conditions associated with HHIP. The function of HHIP and its association with various diseases and clinical conditions, has been established by previous studies, as described hereinabove with reference to VGAM329. Hermansky-Pudlak Syndrome 1 (HPS1, Accession NM_000195) is another VGAM885 host target gene. HPS1 BINDING SITE is HOST TARGET binding site found in the 3' untranslated region of mRNA encoded by HPS1, corresponding to a HOST TARGET binding site such as BINDING SITE I, BINDING SITE II or BINDING SITE III. Table 2 illustrates the complementarity of the nucleotide sequences of HPS1 BINDING SITE, designated SEQ ID:5694, to the nucleotide sequence of VGAM885 RNA, herein designated VGAM RNA, also designated SEQ ID:3596.

Another function of VGAM885 is therefore inhibition of Hermansky-Pudlak Syndrome 1 (HPS1, Accession NM_000195). Accordingly, utilities of VGAM885 include diagnosis, prevention and treatment of diseases and clinical conditions associated with HPS1. Interferon Gamma Receptor 2 (interferon gamma transducer 1) (IFNGR2, Accession NM_005534) is another VGAM885 host target gene. IFNGR2 BINDING SITE is HOST TARGET binding site found in the 5' untranslated region of mRNA encoded by IFNGR2, corresponding to a HOST TARGET binding site such as BINDING SITE I, BINDING SITE II or BINDING SITE III. Table 2 illustrates the complementarity of the nucleotide sequences of IFNGR2 BINDING SITE, designated SEQ ID:12054, to the nucleotide sequence of VGAM885 RNA, herein designated VGAM RNA, also designated SEQ ID:3596.

Another function of VGAM885 is therefore inhibition of Interferon Gamma Receptor 2 (interferon gamma transducer 1) (IFNGR2, Accession NM_005534), a gene which is required for signal transduction. this accessory factor is an integral part of the ifn-gamma signal transduction pathway and is likely to interact with gaf, jak1, and/or jak2. Accordingly, utilities of VGAM885 include diagnosis, prevention and treatment of diseases and clinical conditions associated with IFNGR2. The function of IFNGR2 has been established by previous studies. For the cellular response of somatic cell hybrids (from fibroblasts) to gamma-interferon (OMIM Ref. No. 147570), the gamma-interferon receptor on 6q and a factor on chromosome 21q are necessary (Jung et al., 1987). Langer et al. (1990) demonstrated that the factor encoded by chromosome 21 is separate from the alpha and beta interferon receptors (see OMIM Ref. No. 107450) but maps to the same region. In hamster-human somatic cell hybrids, the presence of the IFN-gamma receptor-related factor mediating cellular responsiveness was determined by HLA induction in hybrid cells containing the IFN-gamma receptor on 6q, a transfected copy of the human HLA-B7 gene, and various portions of chromosome 21. In all hybrids, the IFNGT1 gene cosegregated with the IFNAR gene. (Presumably OMIM Ref. No. 107470.) Bono et al. (1991) likewise mapped this gene to chromosome 21 by study of somatic cell hybrids. Soh et al. (1993) identified a small region of chromosome 21 that is responsible for encoding accessory factor (s) by study of hamster-human somatic cell hybrids carrying an irradiation-reduced fragment of human chromosome 21. To localize the genes further, 10 different YAC clones from 6 different loci in the region were fused to a human-hamster hybrid cell line that contained 6q (supplying the interferon-gamma receptor) and the human HLA-B7 gene. These transformed cells were assayed for induction of class I HLA antigens upon treatment with gamma-interferon. Soh et al. (1993) described a 540-kb YAC that could substitute for chromosome 21 in functioning as the accessory factor. The factor encoded by the YAC did not confer antiviral protection against the encephalomyocarditis virus, however, demonstrating that an additional factor encoded on human chromosome 21 is required for the antiviral activity. Mariano et al. (1996) mapped the Ifgr2 gene to the distal end of mouse chromosome 16 by the study of interspecies backcrosses. Rhee et al. (1996) found that the IFNGR2 gene spans over 33 kb of DNA and contains 7 exons. A signal peptide is encoded by exons 1 and 2, the extracellular domain by exons 2, 3, 4, 5, and part of 6. Exon 6 also encodes the entire transmembrane domain and part of the intracellular domain. Exon 7 encodes the remainder of the intracellular domain and contains the 3-prime untranslated region. No TATA or CAAT boxes were found in the promoter region. Consistent with the lack of a TATA box, analysis of mRNAs by primer extension showed multiple transcription start sites. Mutations in the IFN-gamma receptor ligand-binding chain (IFNGR1; 107470) have been shown to confer susceptibility to severe infection with nontuberculous mycobacteria. Dorman and Holland (1998) described a mutation in the IFN-gamma receptor signal-transducing chain (OMIM Ref. No. IFNGR2) in a child with disseminated Mycobacterium fortuitum and M. avium complex infections, associated with absent IFN-gamma signaling due to a mutation in the extracellular domain of IFNGR2. The patient was a male who had 2 episodes of otitis media and 1 episode of thrush, all of which responded promptly to standard treatment. He received prescribed childhood immunizations but did not receive BCG vaccine. At 20 months of age, he developed a cough with pulmonary infiltrates that did not resolve with antibiotics. At 2 years of age, he developed lymphadenopathy, hepatosplenomegaly, and fevers. Biopsy of an axillary lymph node showed capsular fibrosis and histiocytic infiltration without abscesses or granulomata. Acid-fast bacilli were present on staining, and cultures grew the 2 forms of mycobacterium mentioned. Intensive therapy failed to eliminate the infection. The mother was of English descent and the father of English and Portuguese descent; they were not known to be related. A maternal aunt had been diagnosed with tuberculosis at age 3 years and subsequently developed cervical lymphadenopathy; she died at the age of 26 years of chronic aggressive hepatitis. In vitro cytokine production by the patient's peripheral blood mononuclear cells showed 75% less PHA-induced interferon-gamma production than in normal cells, while the patient's PHA-induced TNF-alpha production was normal.

Full details of the abovementioned studies are described in the following publications, the disclosure of which are hereby incorporated by reference:

Rhee, S.; Ebensperger, C.; Dembic, Z.; Pestka, S.: The structure of the gene for the second chain of the human interferon-gamma receptor. J. Biol. Chem. 271: 28947-28952, 1996; and Dorman, S. E.; Holland, S. M.: Mutation in the signal-transducing chain of the interferon-gamma receptor and susceptibility to mycobacterial infection. J. Clin. Invest. 101: 2364-2369.

Further studies establishing the function and utilities of IFNGR2 are found in John Hopkins OMIM database record ID 147569, and in sited publications numbered 2733-2740 listed in the bibliography section hereinbelow, which are also hereby incorporated by reference. Low Density Lipoprotein-related Protein 1 (alpha-2-macroglobulin receptor) (LRP1, Accession NM_002332) is another VGAM885 host target gene. LRP1 BINDING SITE is HOST TARGET binding site found in the 5' untranslated region of mRNA encoded by LRP1, corresponding to a HOST TARGET binding site such as BINDING SITE I, BINDING SITE II or BINDING SITE III. Table 2 illustrates the complementarity of the nucleotide sequences of LRP1 BINDING SITE, designated SEQ ID:8137, to the nucleotide sequence of VGAM885 RNA, herein designated VGAM RNA, also designated SEQ ID:3596.

Another function of VGAM885 is therefore inhibition of Low Density Lipoprotein-related Protein 1 (alpha-2-macroglobulin receptor) (LRP1, Accession NM_002332), a gene which is a recycling lipoprotein receptor with possible growth-modulating effects. Accordingly, utilities of VGAM885 include diagnosis, prevention and treatment of diseases and clinical conditions associated with LRP1. The function of LRP1 has been established by previous studies. Herz et al. (1988) cloned a cDNA for the low density lipoprotein receptor-related protein (LRP) by virtue of its close homology to the LDL receptor (OMIM Ref. No. 606945). Kristensen et al. (1990) and Strickland et al. (1990) demonstrated that LRP is identical to the alpha-2-macroglobulin (A2M; 103950) receptor (A2MR). Like the mannose-6-phosphate receptor (OMIM Ref. No. 147280), the A2MR/LRP molecule is probably bifunctional The heat-shock protein gp96 (TRA1; 191175) is an intracellular protein capable of chaperoning exogenous antigens from tumors or virus-infected cells to antigen-presenting cells for presentation through major histocompatibility complex (MHC) class I rather than class II molecules, thereby eliciting CD8 (OMIM Ref. No. 186910)-positive T-cell responses. Using a mouse system, Binder et al. (2000) determined that the receptor for gp96 is CD91 (A2MR) and that A2M, a protein found in blood, inhibits gp96 binding to CD91. They proposed that CD91 acts as a sensor for necrotic cell death in tissues, leading to proinflammatory immune responses Full details of the abovementioned studies are described in the following publications, the disclosure of which are hereby incorporated by reference:

Strickland, D. K.; Ashcom, J. D.; Williams, S.; Burgess, W. H.; Migliorini, M.; Argraves, W. S.: Sequence identity between the alpha-2-macroglobulin receptor and low density lipoprotein receptor-related protein suggests that this molecule is a multifunctional receptor. J. Biol. Chem. 265:17401-17404, 1990; and Binder, R. J.; Han, D. K.; Srivastava, P. K.: CD91: a receptor for heat shock protein gp96. Nature Immun. 1:151-155, 2000.

Further studies establishing the function and utilities of LRP1 are found in John Hopkins OMIM database record ID 107770, and in sited publications numbered 12057-12061, 831, 12062-1206 and 12070-12068 listed in the bibliography section hereinbelow, which are also hereby incorporated by reference. Nuclear Transcription Factor Y, Gamma (NFYC, Accession NM_014223) is another VGAM885 host target gene. NFYC BINDING SITE is HOST TARGET binding site found in the 3' untranslated region of mRNA encoded by NFYC, corresponding to a HOST TARGET binding site such as BINDING SITE I, BINDING SITE II or BINDING SITE III. Table 2 illustrates the complementarity of the nucleotide sequences of NFYC BINDING SITE, designated SEQ ID:15494, to the nucleotide sequence of VGAM885 RNA, herein designated VGAM RNA, also designated SEQ ID:3596.

Another function of VGAM885 is therefore inhibition of Nuclear Transcription Factor Y, Gamma (NFYC, Accession NM_014223). Accordingly, utilities of VGAM885 include diagnosis, prevention and treatment of diseases and clinical conditions associated with NFYC. PACE (Accession NM_002569) is another VGAM885 host target gene. PACE BINDING SITE is HOST TARGET binding site found in the 3' untranslated region of mRNA encoded by PACE, corresponding to a HOST TARGET binding site such as BINDING SITE I, BINDING SITE II or BINDING SITE III. Table 2 illustrates the complementarity of the nucleotide sequences of PACE BINDING SITE, designated SEQ ID:8427, to the nucleotide sequence of VGAM885 RNA, herein designated VGAM RNA, also designated SEQ ID:3596.

Another function of VGAM885 is therefore inhibition of PACE (Accession NM_002569), a gene which processes pro-parathyroid hormone, pro-transforming growth factor beta. Accordingly, utilities of VGAM885 include diagnosis, prevention and treatment of diseases and clinical conditions associated with PACE. The function of PACE and its association with various diseases and clinical conditions, has been established by previous studies, as described hereinabove with reference to VGAM151. Protein Kinase C and Casein Kinase Substrate In Neurons 1 (PACSIN1, Accession XM_166424) is another VGAM885 host target gene. PACSIN1 BINDING SITE is HOST TARGET binding site found in the 3' untranslated region of mRNA encoded by PACSIN1, corresponding to a HOST TARGET binding site such as BINDING SITE I, BINDING SITE II or BINDING SITE III. Table 2 illustrates the complementarity of the nucleotide sequences of PACSIN1 BINDING SITE, designated SEQ ID:44316, to the nucleotide sequence of VGAM885 RNA, herein designated VGAM RNA, also designated SEQ ID:3596.

Another function of VGAM885 is therefore inhibition of Protein Kinase C and Casein Kinase Substrate In Neurons 1 (PACSIN1, Accession XM_166424). Accordingly, utilities of VGAM885 include diagnosis, prevention and treatment of diseases and clinical conditions associated with PACSIN1. Paired Box Gene 8 (PAX8, Accession NM_013953) is another VGAM885 host target gene. PAX8 BINDING SITE1 through PAX8 BINDING SITE3 are HOST TARGET binding sites found in untranslated regions of mRNA encoded by PAX8, corresponding to HOST TARGET binding sites such as BINDING SITE I, BINDING SITE II or BINDING SITE III. Table 2 illustrates the complementarity of the nucleotide sequences of PAX8 BINDING SITE1 through PAX8 BINDING SITE3, designated SEQ ID:15136, SEQ ID:15177 and SEQ ID:15135 respectively, to the nucleotide sequence of VGAM885 RNA, herein designated VGAM RNA, also designated SEQ ID:3596.

Another function of VGAM885 is therefore inhibition of Paired Box Gene 8 (PAX8, Accession NM_013953), a gene which maintaines the functional differentiation of thyroid cell type. Accordingly, utilities of VGAM885 include diagnosis, prevention and treatment of diseases and clinical conditions associated with PAX8. The function of PAX8 has been established by previous studies. Pasca di Magliano et al. (2000) demonstrated that PAX8 is sufficient to activate expression of endogenous genes encoding thyroglobulin (TG; 188450), thyroperoxidase (TPO; 274500), and sodium/iodide symporter (SLC5A5; 601843), all thyroid-specific genes. The cell system they used provided direct evidence for the ability of PAX8 to activate transcription of thyroid-specific genes at their chromosomal locus and strongly suggested a fundamental role of this transcription factor in the maintenance of functional differentiation in thyroid cells. Moreover, they showed that PAX8 and thyroid transcription factor-1 (OMIM Ref. No. 600635) cooperate in the activation of the thyroglobulin promoter. Animal model experiments lend further support to the function of PAX8. The thyroid gland develops from 2 distinct embryonic lineages: follicular cells, which produce thyroxine and are of endodermal origin, and parafollicular C-cells, which produce calcitonin and are of neural crest origin. Mice lacking thyroid transcription factor-1 (OMIM Ref. No. 600635) lack both cell types and thus are unable to develop a thyroid gland. By analysis of Pax8 knockout mice (Pax8 -/-), Mansouri et al. (1998) demonstrated that Pax8 is required for the formation of the follicular cells in the thyroid. They presented evidence that Pax8 is necessary for providing cues for the differentiation of component endoderm primordia into thyroxine-producing follicular cells.

It is appreciated that the abovementioned animal model for PAX8 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pasca di Magliano, M.; Di Lauro, R.; Zannini, M.: Pax8 has a key role in thyroid cell differentiation. Proc. Nat. Acad. Sci. 97:13144-13149, 2000; and Mansouri, A.; Chowdhury, K.; Gruss, P.: Follicular cells of the thyroid gland require Pax8 gene function. Nature Genet. 19:87-90, 1998.

Further studies establishing the function and utilities of PAX8 are found in John Hopkins OMIM database record ID 167415, and in sited publications numbered 10774-10777, 10760, 10778, 10779, 10780, 1094 and 10947-10948 listed in the bibliography section hereinbelow, which are also hereby incorporated by reference. RAD52 Homolog (S. cerevisiae) (RAD52, Accession NM_134422) is another VGAM885 host target gene. RAD52 BINDING SITE1 through RAD52 BINDING SITE3 are HOST TARGET binding sites found in untranslated regions of mRNA encoded by RAD52, corresponding to HOST TARGET binding sites such as BINDING SITE I, BINDING SITE II or BINDING SITE III. Table 2 illustrates the complementarity of the nucleotide sequences of RAD52 BINDING SITE1 through RAD52 BINDING SITE3, designated SEQ ID:28644, SEQ ID:28653 and SEQ ID:28662 respectively, to the nucleotide sequence of VGAM885 RNA, herein designated VGAM RNA, also designated SEQ ID:3596.

Another function of VGAM885 is therefore inhibition of RAD52 Homolog (S. cerevisiae) (RAD52, Accession NM_134422). Accordingly, utilities of VGAM885 include diagnosis, prevention and treatment of diseases and clinical conditions associated with RAD52. Baculoviral IAP Repeat-containing 8 (BIRC8, Accession NM_033341) is another VGAM885 host target gene. BIRC8 BINDING SITE is HOST TARGET binding site found in the 5' untranslated region of mRNA encoded by BIRC8, corresponding to a HOST TARGET binding site such as BINDING SITE I, BINDING SITE II or BINDING SITE III. Table 2 illustrates the complementarity of the nucleotide sequences of BIRC8 BINDING SITE, designated SEQ ID:27196, to the nucleotide sequence of VGAM885 RNA, herein designated VGAM RNA, also designated SEQ ID:3596.

Another function of VGAM885 is therefore inhibition of Baculoviral IAP Repeat-containing 8 (BIRC8, Accession NM_033341). Accordingly, utilities of VGAM885 include diagnosis, prevention and treatment of diseases and clinical conditions associated with BIRC8. Chromosome 5 Open Reading Frame 6 (C5orf6, Accession NM_016605) is another VGAM885 host target gene. C5orf6 BINDING SITE is HOST TARGET binding site found in the 5' untranslated region of mRNA encoded by C5orf6, corresponding to a HOST TARGET binding site such as BINDING SITE I, BINDING SITE II or BINDING SITE III. Table 2 illustrates the complementarity of the nucleotide sequences of C5orf6 BINDING SITE, designated SEQ ID:18705, to the nucleotide sequence of VGAM885 RNA, herein designated VGAM RNA, also designated SEQ ID:3596.

Another function of VGAM885 is therefore inhibition of Chromosome 5 Open Reading Frame 6 (C5orf6, Accession NM_016605). Accordingly, utilities of VGAM885 include diagnosis, prevention and treatment of diseases and clinical conditions associated with C5orf6. Cullin 2 (CUL2, Accession NM_003591) is another VGAM885 host target gene. CUL2 BINDING SITE is HOST TARGET binding site found in the 5' untranslated region of mRNA encoded by CUL2, corresponding to a HOST TARGET binding site such as BINDING SITE I, BINDING SITE II or BINDING SITE III. Table 2 illustrates the complementarity of the nucleotide sequences of CUL2 BINDING SITE, designated SEQ ID:9647, to the nucleotide sequence of VGAM885 RNA, herein designated VGAM RNA, also designated SEQ ID:3596.

Another function of VGAM885 is therefore inhibition of Cullin 2 (CUL2, Accession NM_003591). Accordingly, utilities of VGAM885 include diagnosis, prevention and treatment of diseases and clinical conditions associated with CUL2. DKFZP434J037 (Accession NM_030952) is another VGAM885 host target gene. DKFZP434J037 BINDING SITE is HOST TARGET binding site found in the 3' untranslated region of mRNA encoded by DKFZP434J037, corresponding to a HOST TARGET binding site such as BINDING SITE I, BINDING SITE II or BINDING SITE III. Table 2 illustrates the complementarity of the nucleotide sequences of DKFZP434J037 BINDING SITE, designated SEQ ID:25219, to the nucleotide sequence of VGAM885 RNA, herein designated VGAM RNA, also designated SEQ ID:3596.

Another function of VGAM885 is therefore inhibition of DKFZP434J037 (Accession NM_030952). Accordingly, utilities of VGAM885 include diagnosis, prevention and treatment of diseases and clinical conditions associated with DKFZP434J037. DKFZP564C1940 (Accession NM_014045) is another VGAM885 host target gene. DKFZP564C1940 BINDING SITE is HOST TARGET binding site found in the 5' untranslated region of mRNA encoded by DKFZP564C1940, corresponding to a HOST TARGET binding site such as BINDING SITE I, BINDING SITE II or BINDING SITE III. Table 2 illustrates the complementarity of the nucleotide sequences of DKFZP564C1940 BINDING SITE, designated SEQ ID:15273, to the nucleotide sequence of VGAM885 RNA, herein designated VGAM RNA, also designated SEQ ID:3596.

Another function of VGAM885 is therefore inhibition of DKFZP564C1940 (Accession NM_014045). Accordingly, utilities of VGAM885 include diagnosis, prevention and treatment of diseases and clinical conditions associated with DKFZP564C1940. DKFZp762A227 (Accession NM_017611) is another VGAM885 host target gene. DKFZp762A227 BINDING SITE is HOST TARGET binding site found in the 5' untranslated region of mRNA encoded by DKFZp762A227, corresponding to a HOST TARGET binding site such as BINDING SITE I, BINDING SITE II or BINDING SITE III. Table 2 illustrates the complementarity of the nucleotide sequences of DKFZp762A227 BINDING SITE, designated SEQ ID:19107, to the nucleotide sequence of VGAM885 RNA, herein designated VGAM RNA, also designated SEQ ID:3596.

Another function of VGAM885 is therefore inhibition of DKFZp762A227 (Accession NM_017611). Accordingly, utilities of VGAM885 include diagnosis, prevention and treatment of diseases and clinical conditions associated with DKFZp762A227. EFS2 (Accession NM_005864) is another VGAM885 host target gene. EFS2 BINDING SITE is HOST TARGET binding site found in the 3' untranslated region of mRNA encoded by EFS2, corresponding to a HOST TARGET binding site such as BINDING SITE I, BINDING SITE II or BINDING SITE III. Table 2 illustrates the complementarity of the nucleotide sequences of EFS2 BINDING SITE, designated SEQ ID:12478, to the nucleotide sequence of VGAM885 RNA, herein designated VGAM RNA, also designated SEQ ID:3596.

Another function of VGAM885 is therefore inhibition of EFS2 (Accession NM_005864). Accordingly, utilities of VGAM885 include diagnosis, prevention and treatment of diseases and clinical conditions associated with EFS2. Four Jointed Box 1 (Drosophila) (FJX1, Accession NM_014344) is another VGAM885 host target gene. FJX1 BINDING SITE is HOST TARGET binding site found in the 3' untranslated region of mRNA encoded by FJX1, corresponding to a HOST TARGET binding site such as BINDING SITE I, BINDING SITE II or BINDING SITE III. Table 2 illustrates the complementarity of the nucleotide sequences of FJX1 BINDING SITE, designated SEQ ID:15663, to the nucleotide sequence of VGAM885 RNA, herein designated VGAM RNA, also designated SEQ ID:3596.

Another function of VGAM885 is therefore inhibition of Four Jointed Box 1 (Drosophila) (FJX1, Accession NM_014344). Accordingly, utilities of VGAM885 include diagnosis, prevention and treatment of diseases and clinical conditions associated with FJX1. FLJ10898 (Accession XM_002486) is another VGAM885 host target gene. FLJ10898 BINDING SITE is HOST TARGET binding site found in the 5' untranslated region of mRNA encoded by FLJ10898, corresponding to a HOST TARGET binding site such as BINDING SITE I, BINDING SITE II or BINDING SITE III. Table 2 illustrates the complementarity of the nucleotide sequences of FLJ10898 BINDING SITE, designated SEQ ID:29891, to the nucleotide sequence of VGAM885 RNA, herein designated VGAM RNA, also designated SEQ ID:3596.

Another function of VGAM885 is therefore inhibition of FLJ10898 (Accession XM_002486). Accordingly, utilities of VGAM885 include diagnosis, prevention and treatment of diseases and clinical conditions associated with FLJ10898. FLJ21709 (Accession XM_085480) is another VGAM885 host target gene. FLJ21709 BINDING SITE is HOST TARGET binding site found in the 3' untranslated region of mRNA encoded by FLJ21709, corresponding to a HOST TARGET binding site such as BINDING SITE I, BINDING SITE II or BINDING SITE III. Table 2 illustrates the complementarity of the nucleotide sequences of FLJ21709 BINDING SITE, designated SEQ ID:38170, to the nucleotide sequence of VGAM885 RNA, herein designated VGAM RNA, also designated SEQ ID:3596.

Another function of VGAM885 is therefore inhibition of FLJ21709 (Accession XM_085480). Accordingly, utilities of VGAM885 include diagnosis, prevention and treatment of diseases and clinical conditions associated with FLJ21709. FLJ23476 (Accession NM_024640) is another VGAM885 host target gene. FLJ23476 BINDING SITE is HOST TARGET binding site found in the 3' untranslated region of mRNA encoded by FLJ23476, corresponding to a HOST TARGET binding site such as BINDING SITE I, BINDING SITE II or BINDING SITE III. Table 2 illustrates the complementarity of the nucleotide sequences of FLJ23476 BINDING SITE, designated SEQ ID:23921, to the nucleotide sequence of VGAM885 RNA, herein designated VGAM RNA, also designated SEQ ID:3596.

Another function of VGAM885 is therefore inhibition of FLJ23476 (Accession NM_024640). Accordingly, utilities of VGAM885 include diagnosis, prevention and treatment of diseases and clinical conditions associated with FLJ23476. Insulin-like Growth Factor 2, Antisense (IGF2AS, Accession NM_016412) is another VGAM885 host target gene. IGF2AS BINDING SITE is HOST TARGET binding site found in the 3' untranslated region of mRNA encoded by IGF2AS, corresponding to a HOST TARGET binding site such as BINDING SITE I, BINDING SITE II or BINDING SITE III. Table 2 illustrates the complementarity of the nucleotide sequences of IGF2AS BINDING SITE, designated SEQ ID:18540, to the nucleotide sequence of VGAM885 RNA, herein designated VGAM RNA, also designated SEQ ID:3596.

Another function of VGAM885 is therefore inhibition of Insulin-like Growth Factor 2, Antisense (IGF2AS, Accession NM_016412). Accordingly, utilities of VGAM885 include diagnosis, prevention and treatment of diseases and clinical conditions associated with IGF2AS. Integrin, Beta 8 (ITGB8, Accession NM_002214) is another VGAM885 host target gene. ITGB8 BINDING SITE is HOST TARGET binding site found in the 5' untranslated region of mRNA encoded by ITGB8, corresponding to a HOST TARGET binding site such as BINDING SITE I, BINDING SITE II or BINDING SITE III. Table 2 illustrates the complementarity of the nucleotide sequences of ITGB8 BINDING SITE, designated SEQ ID:7978, to the nucleotide sequence of VGAM885 RNA, herein designated VGAM RNA, also designated SEQ ID:3596.

Another function of VGAM885 is therefore inhibition of Integrin, Beta 8 (ITGB8, Accession NM_002214). Accordingly, utilities of VGAM885 include diagnosis, prevention and treatment of diseases and clinical conditions associated with ITGB8. KIAA0255 (Accession NM_014742) is another VGAM885 host target gene. KIAA0255 BINDING SITE is HOST TARGET binding site found in the 5' untranslated region of mRNA encoded by KIAA0255, corresponding to a HOST TARGET binding site such as BINDING SITE I, BINDING SITE II or BINDING SITE III. Table 2 illustrates the complementarity of the nucleotide sequences of KIAA0255 BINDING SITE, designated SEQ ID:16416, to the nucleotide sequence of VGAM885 RNA, herein designated VGAM RNA, also designated SEQ ID:3596.

Another function of VGAM885 is therefore inhibition of KIAA0255 (Accession NM_014742). Accordingly, utilities of VGAM885 include diagnosis, prevention and treatment of diseases and clinical conditions associated with KIAA0255. KIAA0275 (Accession NM_014767) is another VGAM885 host target gene. KIAA0275 BINDING SITE is HOST TARGET binding site found in the 3' untranslated region of mRNA encoded by KIAA0275, corresponding to a HOST TARGET binding site such as BINDING SITE I, BINDING SITE II or BINDING SITE III. Table 2 illustrates the complementarity of the nucleotide sequences of KIAA0275 BINDING SITE, designated SEQ ID:16553, to the nucleotide sequence of VGAM885 RNA, herein designated VGAM RNA, also designated SEQ ID:3596.

Another function of VGAM885 is therefore inhibition of KIAA0275 (Accession NM_014767). Accordingly, utilities of VGAM885 include diagnosis, prevention and treatment of diseases and clinical conditions associated with KIAA0275. KIAA0514 (Accession NM_014696) is another VGAM885 host target gene. KIAA0514 BINDING SITE is HOST TARGET binding site found in the 3' untranslated region of mRNA encoded by KIAA0514, corresponding to a HOST TARGET binding site such as BINDING SITE I, BINDING SITE II or BINDING SITE III. Table 2 illustrates the complementarity of the nucleotide sequences of KIAA0514 BINDING SITE, designated SEQ ID:16209, to the nucleotide sequence of VGAM885 RNA, herein designated VGAM RNA, also designated SEQ ID:3596.

Another function of VGAM885 is therefore inhibition of KIAA0514 (Accession NM_014696). Accordingly, utilities of VGAM885 include diagnosis, prevention and treatment of diseases and clinical conditions associated with KIAA0514. KIAA0601 (Accession XM_031267) is another VGAM885 host target gene. KIAA0601 BINDING SITE is HOST TARGET binding site found in the 3' untranslated region of mRNA encoded by KIAA0601, corresponding to a HOST TARGET binding site such as BINDING SITE I, BINDING SITE II or BINDING SITE III. Table 2 illustrates the complementarity of the nucleotide sequences of KIAA0601 BINDING SITE, designated SEQ ID:31327, to the nucleotide sequence of VGAM885 RNA, herein designated VGAM RNA, also designated SEQ ID:3596.

Another function of VGAM885 is therefore inhibition of KIAA0601 (Accession XM_031267). Accordingly, utilities of VGAM885 include diagnosis, prevention and treatment of diseases and clinical conditions associated with KIAA0601. KIAA0769 (Accession NM_014824) is another VGAM885 host target gene. KIAA0769 BINDING SITE is HOST TARGET binding site found in the 3' untranslated region of mRNA encoded by KIAA0769, corresponding to a HOST TARGET binding site such as BINDING SITE I, BINDING SITE II or BINDING SITE III. Table 2 illustrates the complementarity of the nucleotide sequences of KIAA0769 BINDING SITE, designated SEQ ID:16802, to the nucleotide sequence of VGAM885 RNA, herein designated VGAM RNA, also designated SEQ ID:3596.

Another function of VGAM885 is therefore inhibition of KIAA0769 (Accession NM_014824). Accordingly, utilities of VGAM885 include diagnosis, prevention and treatment of diseases and clinical conditions associated with KIAA0769. KIAA0945 (Accession NM_014952) is another VGAM885 host target gene. KIAA0945 BINDING SITE is HOST TARGET binding site found in the 3' untranslated region of mRNA encoded by KIAA0945, corresponding to a HOST TARGET binding site such as BINDING SITE I, BINDING SITE II or BINDING SITE III. Table 2 illustrates the complementarity of the nucleotide sequences of KIAA0945 BINDING SITE, designated SEQ ID:17296, to the nucleotide sequence of VGAM885 RNA, herein designated VGAM RNA, also designated SEQ ID:3596.

Another function of VGAM885 is therefore inhibition of KIAA0945 (Accession NM_014952). Accordingly, utilities of VGAM885 include diagnosis, prevention and treatment of diseases and clinical conditions associated with KIAA0945. KIAA1161 (Accession XM_088501) is another VGAM885 host target gene. KIAA1161 BINDING SITE is HOST TARGET binding site found in the 5' untranslated region of mRNA encoded by KIAA1161, corresponding to a HOST TARGET binding site such as BINDING SITE I, BINDING SITE II or BINDING SITE III. Table 2 illustrates the complementarity of the nucleotide sequences of KIAA1161 BINDING SITE, designated SEQ ID:39752, to the nucleotide sequence of VGAM885 RNA, herein designated VGAM RNA, also designated SEQ ID:3596.

Another function of VGAM885 is therefore inhibition of KIAA1161 (Accession XM_088501). Accordingly, utilities of VGAM885 include diagnosis, prevention and treatment of diseases and clinical conditions associated with KIAA1161. KIAA1908 (Accession XM_055834) is another VGAM885 host target gene. KIAA1908 BINDING SITE is HOST TARGET binding site found in the 5' untranslated region of mRNA encoded by KIAA1908, corresponding to a HOST TARGET binding site such as BINDING SITE I, BINDING SITE II or BINDING SITE III. Table 2 illustrates the complementarity of the nucleotide sequences of KIAA1908 BINDING SITE, designated SEQ ID:36335, to the nucleotide sequence of VGAM885 RNA, herein designated VGAM RNA, also designated SEQ ID:3596.

Another function of VGAM885 is therefore inhibition of KIAA1908 (Accession XM_055834). Accordingly, utilities of VGAM885 include diagnosis, prevention and treatment of diseases and clinical conditions associated with KIAA1908. Mitogen-activated Protein Kinase 8 Interacting Protein 3 (MAPK8IP3, Accession NM_033392) is another VGAM885 host target gene. MAPK8IP3 BINDING SITE is HOST TARGET binding site found in the 3' untranslated region of mRNA encoded by MAPK8IP3, corresponding to a HOST TARGET binding site such as BINDING SITE I, BINDING SITE II or BINDING SITE III. Table 2 illustrates the complementarity of the nucleotide sequences of MAPK8IP3 BINDING SITE, designated SEQ ID:27220, to the nucleotide sequence of VGAM885 RNA, herein designated VGAM RNA, also designated SEQ ID:3596.

Another function of VGAM885 is therefore inhibition of Mitogen-activated Protein Kinase 8 Interacting Protein 3 (MAPK8IP3, Accession NM_033392). Accordingly, utilities of VGAM885 include diagnosis, prevention and treatment of diseases and clinical conditions associated with MAPK8IP3. MGC4172 (Accession NM_024308) is another VGAM885 host target gene. MGC4172 BINDING SITE is HOST TARGET binding site found in the 5' untranslated region of mRNA encoded by MGC4172, corresponding to a HOST TARGET binding site such as BINDING SITE I, BINDING SITE II or BINDING SITE III. Table 2 illustrates the complementarity of the nucleotide sequences of MGC4172 BINDING SITE, designated SEQ ID:23599, to the nucleotide sequence of VGAM885 RNA, herein designated VGAM RNA, also designated SEQ ID:3596.

Another function of VGAM885 is therefore inhibition of MGC4172 (Accession NM_024308). Accordingly, utilities of VGAM885 include diagnosis, prevention and treatment of diseases and clinical conditions associated with MGC4172. Purinergic Receptor P2X, Ligand-gated Ion Channel, 1 (P2RX1, Accession XM_040635) is another VGAM885 host target gene. P2RX1 BINDING SITE is HOST TARGET binding site found in the 5' untranslated region of mRNA encoded by P2RX1, corresponding to a HOST TARGET binding site such as BINDING SITE I, BINDING SITE II or BINDING SITE III. Table 2 illustrates the complementarity of the nucleotide sequences of P2RX1 BINDING SITE, designated SEQ ID:33355, to the nucleotide sequence of VGAM885 RNA, herein designated VGAM RNA, also designated SEQ ID:3596.

Another function of VGAM885 is therefore inhibition of Purinergic Receptor P2X, Ligand-gated Ion Channel, 1 (P2RX1, Accession XM_040635). Accordingly, utilities of VGAM885 include diagnosis, prevention and treatment of diseases and clinical conditions associated with P2RX1. Sema Domain, Immunoglobulin Domain (Ig), Transmembrane Domain (TM) and Short Cytoplasmic Domain, (semaphorin) 4B (SEMA4B, Accession XM_044533) is another VGAM885 host target gene. SEMA4B BINDING SITE is HOST TARGET binding site found in the 3' untranslated region of mRNA encoded by SEMA4B, corresponding to a HOST TARGET binding site such as BINDING SITE I, BINDING SITE II or BINDING SITE III. Table 2 illustrates the complementarity of the nucleotide sequences of SEMA4B BINDING SITE, designated SEQ ID:34225, to the nucleotide sequence of VGAM885 RNA, herein designated VGAM RNA, also designated SEQ ID:3596.

Another function of VGAM885 is therefore inhibition of Sema Domain, Immunoglobulin Domain (Ig), Transmembrane Domain (TM) and Short Cytoplasmic Domain, (semaphorin) 4B (SEMA4B, Accession XM_044533). Accordingly, utilities of VGAM885 include diagnosis, prevention and treatment of diseases and clinical conditions associated with SEMA4B. Sulfotransferase Family 4A, Member 1 (SULT4A1, Accession XM_043609) is another VGAM885 host target gene. SULT4A1 BINDING SITE is HOST TARGET binding site found in the 3' untranslated region of mRNA encoded by SULT4A1, corresponding to a HOST TARGET binding site such as BINDING SITE I, BINDING SITE II or BINDING SITE III. Table 2 illustrates the complementarity of the nucleotide sequences of SULT4A1 BINDING SITE, designated SEQ ID:33975, to the nucleotide sequence of VGAM885 RNA, herein designated VGAM RNA, also designated SEQ ID:3596.

Another function of VGAM885 is therefore inhibition of Sulfotransferase Family 4A, Member 1 (SULT4A1, Accession XM_043609). Accordingly, utilities of VGAM885 include diagnosis, prevention and treatment of diseases and clinical conditions associated with SULT4A1. U5-116KD (Accession NM_004247) is another VGAM885 host target gene. U5-116KD BINDING SITE is HOST TARGET binding site found in the 3' untranslated region of mRNA encoded by U5-116KD, corresponding to a HOST TARGET binding site such as BINDING SITE I, BINDING SITE II or BINDING SITE III. Table 2 illustrates the complementarity of the nucleotide sequences of U5-116KD BINDING SITE, designated SEQ ID:10440, to the nucleotide sequence of VGAM885 RNA, herein designated VGAM RNA, also designated SEQ ID:3596.

Another function of VGAM885 is therefore inhibition of U5-116KD (Accession NM_004247). Accordingly, utilities of VGAM885 include diagnosis, prevention and treatment of diseases and clinical conditions associated with U5-116KD. LOC115708 (Accession XM_056552) is another VGAM885 host target gene. LOC115708 BINDING SITE is HOST TARGET binding site found in the 3' untranslated region of mRNA encoded by LOC115708, corresponding to a HOST TARGET binding site such as BINDING SITE I, BINDING SITE II or BINDING SITE III. Table 2 illustrates the complementarity of the nucleotide sequences of LOC115708 BINDING SITE, designated SEQ ID:36406, to the nucleotide sequence of VGAM885 RNA, herein designated VGAM RNA, also designated SEQ ID:3596.

Another function of VGAM885 is therefore inhibition of LOC115708 (Accession XM_056552). Accordingly, utilities of VGAM885 include diagnosis, prevention and treatment of diseases and clinical conditions associated with LOC115708. LOC126432 (Accession XM_059046) is another VGAM885 host target gene. LOC126432 BINDING SITE is HOST TARGET binding site found in the 5' untranslated region of mRNA encoded by LOC126432, corresponding to a HOST TARGET binding site such as BINDING SITE I, BINDING SITE II or BINDING SITE III. Table 2 illustrates the complementarity of the nucleotide sequences of LOC126432 BINDING SITE, designated SEQ ID:36840, to the nucleotide sequence of VGAM885 RNA, herein designated VGAM RNA, also designated SEQ ID:3596.

Another function of VGAM885 is therefore inhibition of LOC126432 (Accession XM_059046). Accordingly, utilities of VGAM885 include diagnosis, prevention and treatment of diseases and clinical conditions associated with LOC126432. LOC129011 (Accession XM_059326) is another VGAM885 host target gene. LOC129011 BINDING SITE is HOST TARGET binding site found in the 3' untranslated region of mRNA encoded by LOC129011, corresponding to a HOST TARGET binding site such as BINDING SITE I, BINDING SITE II or BINDING SITE III. Table 2 illustrates the complementarity of the nucleotide sequences of LOC129011 BINDING SITE, designated SEQ ID:36965, to the nucleotide sequence of VGAM885 RNA, herein designated VGAM RNA, also designated SEQ ID:3596.

Another function of VGAM885 is therefore inhibition of LOC129011 (Accession XM_059326). Accordingly, utilities of VGAM885 include diagnosis, prevention and treatment of diseases and clinical conditions associated with LOC129011. LOC145468 (Accession XM_057874) is another VGAM885 host target gene. LOC145468 BINDING SITE is HOST TARGET binding site found in the 3' untranslated region of mRNA encoded by LOC145468, corresponding to a HOST TARGET binding site such as BINDING SITE I, BINDING SITE II or BINDING SITE III. Table 2 illustrates the complementarity of the nucleotide sequences of LOC145468 BINDING SITE, designated SEQ ID:36549, to the nucleotide sequence of VGAM885 RNA, herein designated VGAM RNA, also designated SEQ ID:3596.

Another function of VGAM885 is therefore inhibition of LOC145468 (Accession XM_057874). Accordingly, utilities of VGAM885 include diagnosis, prevention and treatment of diseases and clinical conditions associated with LOC145468. LOC147072 (Accession XM_017121) is another VGAM885 host target gene. LOC147072 BINDING SITE is HOST TARGET binding site found in the 5' untranslated region of mRNA encoded by LOC147072, corresponding to a HOST TARGET binding site such as BINDING SITE I, BINDING SITE II or BINDING SITE III. Table 2 illustrates the complementarity of the nucleotide sequences of LOC147072 BINDING SITE, designated SEQ ID:30298, to the nucleotide sequence of VGAM885 RNA, herein designated VGAM RNA, also designated SEQ ID:3596.

Another function of VGAM885 is therefore inhibition of LOC147072 (Accession XM_017121). Accordingly, utilities of VGAM885 include diagnosis, prevention and treatment of diseases and clinical conditions associated with LOC147072.

LOC148304 (Accession XM_086141) is another VGAM885 host target gene. LOC148304 BINDING SITE is HOST TARGET binding site found in the 5' untranslated region of mRNA encoded by LOC148304, corresponding to a HOST TARGET binding site such as BINDING SITE I, BINDING SITE II or BINDING SITE III. Table 2 illustrates the complementarity of the nucleotide sequences of LOC148304 BINDING SITE, designated SEQ ID:38520, to the nucleotide sequence of VGAM885 RNA, herein designated VGAM RNA, also designated SEQ ID:3596.

Another function of VGAM885 is therefore inhibition of LOC148304 (Accession XM_086141). Accordingly, utilities of VGAM885 include diagnosis, prevention and treatment of diseases and clinical conditions associated with LOC148304.

LOC148479 (Accession XM_086204) is another VGAM885 host target gene. LOC148479 BINDING SITE is HOST TARGET binding site found in the 3' untranslated region of mRNA encoded by LOC148479, corresponding to a HOST TARGET binding site such as BINDING SITE I, BINDING SITE II or BINDING SITE III. Table 2 illustrates the complementarity of the nucleotide sequences of LOC148479 BINDING SITE, designated SEQ ID:38540, to the nucleotide sequence of VGAM885 RNA, herein designated VGAM RNA, also designated SEQ ID:3596.

Another function of VGAM885 is therefore inhibition of LOC148479 (Accession XM_086204). Accordingly, utilities of VGAM885 include diagnosis, prevention and treatment of diseases and clinical conditions associated with LOC148479.

LOC150155 (Accession XM_047977) is another VGAM885 host target gene. LOC150155 BINDING SITE is HOST TARGET binding site found in the 3' untranslated region of mRNA encoded by LOC150155, corresponding to a HOST TARGET binding site such as BINDING SITE I, BINDING SITE II or BINDING SITE III. Table 2 illustrates the complementarity of the nucleotide sequences of LOC150155 BINDING SITE, designated SEQ ID:35091, to the nucleotide sequence of VGAM885 RNA, herein designated VGAM RNA, also designated SEQ ID:3596.

Another function of VGAM885 is therefore inhibition of LOC150155 (Accession XM_047977). Accordingly, utilities of VGAM885 include diagnosis, prevention and treatment of diseases and clinical conditions associated with LOC150155.

LOC151429 (Accession XM_098059) is another VGAM885 host target gene. LOC151429 BINDING SITE is HOST TARGET binding site found in the 5' untranslated region of mRNA encoded by LOC151429, corresponding to a HOST TARGET binding site such as BINDING SITE I, BINDING SITE II or BINDING SITE III. Table 2 illustrates the complementarity of the nucleotide sequences of LOC151429 BINDING SITE, designated SEQ ID:41342, to the nucleotide sequence of VGAM885 RNA, herein designated VGAM RNA, also designated SEQ ID:3596.

Another function of VGAM885 is therefore inhibition of LOC151429 (Accession XM_098059). Accordingly, utilities of VGAM885 include diagnosis, prevention and treatment of diseases and clinical conditions associated with LOC151429.

LOC152274 (Accession XM_087418) is another VGAM885 host target gene. LOC152274 BINDING SITE is HOST TARGET binding site found in the 5' untranslated region of mRNA encoded by LOC152274, corresponding to a HOST TARGET binding site such as BINDING SITE I, BINDING SITE II or BINDING SITE III. Table 2 illustrates the complementarity of the nucleotide sequences of LOC152274 BINDING SITE, designated SEQ ID:39231, to the nucleotide sequence of VGAM885 RNA, herein designated VGAM RNA, also designated SEQ ID:3596.

Another function of VGAM885 is therefore inhibition of LOC152274 (Accession XM_087418). Accordingly, utilities of VGAM885 include diagnosis, prevention and treatment of diseases and clinical conditions associated with LOC152274.

LOC152283 (Accession XM_098196) is another VGAM885 host target gene. LOC152283 BINDING SITE is HOST TARGET binding site found in the 3' untranslated region of mRNA encoded by LOC152283, corresponding to a HOST TARGET binding site such as BINDING SITE I, BINDING SITE II or BINDING SITE III. Table 2 illustrates the complementarity of the nucleotide sequences of LOC152283 BINDING SITE, designated SEQ ID:41485, to the nucleotide sequence of VGAM885 RNA, herein designated VGAM RNA, also designated SEQ ID:3596.

Another function of VGAM885 is therefore inhibition of LOC152283 (Accession XM_098196). Accordingly, utilities of VGAM885 include diagnosis, prevention and treatment of diseases and clinical conditions associated with LOC152283.

LOC158056 (Accession XM_088463) is another VGAM885 host target gene. LOC158056 BINDING SITE is HOST TARGET binding site found in the 5' untranslated region of mRNA encoded by LOC158056, corresponding to a HOST TARGET binding site such as BINDING SITE I, BINDING SITE II or BINDING SITE III. Table 2 illustrates the complementarity of the nucleotide sequences of LOC158056 BINDING SITE, designated SEQ ID:39717, to the nucleotide sequence of VGAM885 RNA, herein designated VGAM RNA, also designated SEQ ID:3596.

Another function of VGAM885 is therefore inhibition of LOC158056 (Accession XM_088463). Accordingly, utilities of VGAM885 include diagnosis, prevention and treatment of diseases and clinical conditions associated with LOC158056.

LOC161190 (Accession XM_090747) is another VGAM885 host target gene. LOC161190 BINDING SITE is HOST TARGET binding site found in the 5' untranslated region of mRNA encoded by LOC161190, corresponding to a HOST TARGET binding site such as BINDING SITE I, BINDING SITE II or BINDING SITE III. Table 2 illustrates the complementarity of the nucleotide sequences of LOC161190 BINDING SITE, designated SEQ ID:40014, to the nucleotide sequence of VGAM885 RNA, herein designated VGAM RNA, also designated SEQ ID:3596.

Another function of VGAM885 is therefore inhibition of LOC161190 (Accession XM_090747). Accordingly, utilities of VGAM885 include diagnosis, prevention and treatment of diseases and clinical conditions associated with LOC161190.

LOC200853 (Accession XM_114308) is another VGAM885 host target gene. LOC200853 BINDING SITE is HOST TARGET binding site found in the 3' untranslated region of mRNA encoded by LOC200853, corresponding to a HOST TARGET binding site such as BINDING SITE I, BINDING SITE II or BINDING SITE III. Table 2 illustrates the complementarity of the nucleotide sequences of LOC200853 BINDING SITE, designated SEQ ID:42868, to the nucleotide sequence of VGAM885 RNA, herein designated VGAM RNA, also designated SEQ ID:3596.

Another function of VGAM885 is therefore inhibition of LOC200853 (Accession XM_114308). Accordingly, utilities of VGAM885 include diagnosis, prevention and treatment of diseases and clinical conditions associated with LOC200853.

LOC204965 (Accession XM_117691) is another VGAM885 host target gene. LOC204965 BINDING SITE is HOST TARGET binding site found in the 5' untranslated region of mRNA encoded by LOC204965, corresponding to a HOST TARGET binding site such as BINDING SITE I, BINDING SITE II or BINDING SITE III. Table 2 illustrates the complementarity of the nucleotide sequences of LOC204965 BINDING SITE, designated SEQ ID:43575, to the nucleotide sequence of VGAM885 RNA, herein designated VGAM RNA, also designated SEQ ID:3596.

Another function of VGAM885 is therefore inhibition of LOC204965 (Accession XM_117691). Accordingly, utilities of VGAM885 include diagnosis, prevention and treatment of diseases and clinical conditions associated with LOC204965. LOC219397 (Accession XM_167889) is another VGAM885 host target gene. LOC219397 BINDING SITE is HOST TARGET binding site found in the 3' untranslated region of mRNA encoded by LOC219397, corresponding to a HOST TARGET binding site such as BINDING SITE I, BINDING SITE II or BINDING SITE III. Table 2 illustrates the complementarity of the nucleotide sequences of LOC219397 BINDING SITE, designated SEQ ID:44900, to the nucleotide sequence of VGAM885 RNA, herein designated VGAM RNA, also designated SEQ ID:3596.

Another function of VGAM885 is therefore inhibition of LOC219397 (Accession XM_167889). Accordingly, utilities of VGAM885 include diagnosis, prevention and treatment of diseases and clinical conditions associated with LOC219397. LOC219654 (Accession XM_166095) is another VGAM885 host target gene. LOC219654 BINDING SITE is HOST TARGET binding site found in the 5' untranslated region of mRNA encoded by LOC219654, corresponding to a HOST TARGET binding site such as BINDING SITE I, BINDING SITE II or BINDING SITE III. Table 2 illustrates the complementarity of the nucleotide sequences of LOC219654 BINDING SITE, designated SEQ ID:43874, to the nucleotide sequence of VGAM885 RNA, herein designated VGAM RNA, also designated SEQ ID:3596.

Another function of VGAM885 is therefore inhibition of LOC219654 (Accession XM_166095). Accordingly, utilities of VGAM885 include diagnosis, prevention and treatment of diseases and clinical conditions associated with LOC219654. LOC219920 (Accession XM_167787) is another VGAM885 host target gene. LOC219920 BINDING SITE is HOST TARGET binding site found in the 5' untranslated region of mRNA encoded by LOC219920, corresponding to a HOST TARGET binding site such as BINDING SITE I, BINDING SITE II or BINDING SITE III. Table 2 illustrates the complementarity of the nucleotide sequences of LOC219920 BINDING SITE, designated SEQ ID:44808, to the nucleotide sequence of VGAM885 RNA, herein designated VGAM RNA, also designated SEQ ID:3596.

Another function of VGAM885 is therefore inhibition of LOC219920 (Accession XM_167787). Accordingly, utilities of VGAM885 include diagnosis, prevention and treatment of diseases and clinical conditions associated with LOC219920. LOC256239 (Accession XM_170510) is another VGAM885 host target gene. LOC256239 BINDING SITE is HOST TARGET binding site found in the 5' untranslated region of mRNA encoded by LOC256239, corresponding to a HOST TARGET binding site such as BINDING SITE I, BINDING SITE II or BINDING SITE III. Table 2 illustrates the complementarity of the nucleotide sequences of LOC256239 BINDING SITE, designated SEQ ID:45344, to the nucleotide sequence of VGAM885 RNA, herein designated VGAM RNA, also designated SEQ ID:3596.

Another function of VGAM885 is therefore inhibition of LOC256239 (Accession XM_170510). Accordingly, utilities of VGAM885 include diagnosis, prevention and treatment of diseases and clinical conditions associated with LOC256239. LOC91960 (Accession XM_041872) is another VGAM885 host target gene. LOC91960 BINDING SITE is HOST TARGET binding site found in the 3' untranslated region of mRNA encoded by LOC91960, corresponding to a HOST TARGET binding site such as BINDING SITE I, BINDING SITE II or BINDING SITE III. Table 2 illustrates the complementarity of the nucleotide sequences of LOC91960 BINDING SITE, designated SEQ ID:33614, to the nucleotide sequence of VGAM885 RNA, herein designated VGAM RNA, also designated SEQ ID:3596.

Another function of VGAM885 is therefore inhibition of LOC91960 (Accession XM_041872). Accordingly, utilities of VGAM885 include diagnosis, prevention and treatment of diseases and clinical conditions associated with LOC91960.

FIG. 1 further provides a conceptual description of a novel bioinformatically detected viral gene of the present invention, referred to here as Viral Genomic Address Messenger 886 (VGAM886) viral gene, which modulates expression of respective host target genes thereof, the function and utility of which host target genes is known in the art.

VGAM886 is a novel bioinformatically detected regulatory, non protein coding, viral micro RNA (miRNA) gene. The method by which VGAM886 was detected is described hereinabove with reference to FIGS. 1-8.

VGAM886 gene, herein designated VGAM GENE, is a viral gene contained in the genome of Vaccinia Virus. VGAM886 host target gene, herein designated VGAM HOST TARGET GENE, is a human gene contained in the human genome.

VGAM886 gene encodes a VGAM886 precursor RNA, herein designated VGAM PRECURSOR RNA. Similar to other miRNA genes, and unlike most ordinary genes, VGAM886 precursor RNA does not encode a protein. A nucleotide sequence identical or highly similar to the nucleotide sequence of VGAM886 precursor RNA is designated SEQ ID:872, and is provided hereinbelow with reference to the sequence listing part. Nucleotide sequence SEQ ID:872 is located at position 68429 relative to the genome of Vaccinia Virus.

VGAM886 precursor RNA folds onto itself, forming VGAM886 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM886 folded precursor RNA into VGAM886 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM886 RNA is designated SEQ ID:3597, and is provided hereinbelow with reference to the sequence listing part.

VGAM886 host target gene, herein designated VGAM HOST TARGET GENE, encodes a corresponding messenger RNA, VGAM886 host target RNA, herein designated VGAM HOST TARGET RNA. VGAM886 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM886 RNA, herein designated VGAM RNA, binds complementarily to one or more host target binding sites located in untranslated regions of VGAM886 host target RNA, herein designated VGAM HOST TARGET RNA. This complementary binding is due to the fact that the nucleotide sequence of VGAM886 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM886 RNA, herein designated VGAM RNA, may have a different number of host target binding sites in untranslated regions of a VGAM886 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM886 RNA, herein designated VGAM RNA, to host target binding sites on VGAM886 host target RNA, herein designated VGAM HOST TARGET RNA, such as BINDING SITE I, BINDING SITE II and BINDING SITE III, inhibits translation of VGAM886 host target RNA into VGAM886 host target protein, herein designated VGAM HOST TARGET PROTEIN. VGAM host target protein is therefore outlined by a broken line.

It is appreciated that VGAM886 host target gene, herein designated VGAM HOST TARGET GENE, in fact represents a plurality of VGAM886 host target genes. The mRNA of each one of this plurality of VGAM886 host target genes comprises one or more host target binding sites, each having a nucleotide sequence which is at least partly complementary to VGAM886 RNA, herein designated VGAM RNA, and which when bound by VGAM886 RNA causes inhibition of translation of respective one or more VGAM886 host target proteins.

It is further appreciated by one skilled in the art that the mode of translational inhibition illustrated by FIG. 1 with specific reference to translational inhibition exerted by VGAM886 gene, herein designated VGAM GENE, on one or more VGAM886 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM886 is inhibition of expression of host target genes, as part of a novel viral mechanism of attacking a host. Accordingly, utilities of VGAM886 include diagnosis, prevention and treatment of viral infection by Vaccinia Virus. Specific functions, and accordingly utilities, of VGAM886 correlate with, and may be deduced from, the identity of the host target genes which VGAM886 binds and inhibits, and the function of these host target genes, as elaborated hereinbelow.

Nucleotide sequences of the VGAM886 precursor RNA, herein designated VGAM PRECURSOR RNA, and of the 'diced' VGAM886 RNA, herein designated VGAM RNA, and a schematic representation of the secondary folding of VGAM886 folded precursor RNA, herein designated VGAM FOLDED PRECURSOR RNA, of VGAM886 are further described hereinbelow with reference to Table 1.

Nucleotide sequences of host target binding sites, such as BINDING SITE-I, BINDING SITE-II and BINDING SITE-III of FIG. 1, found on VGAM886 host target RNA, and schematic representation of the complementarity of each of these host target binding sites to VGAM886 RNA, herein designated VGAM RNA, are described hereinbelow with reference to Table 2.

As mentioned hereinabove with reference to FIG. 1, a function of VGAM886 gene, herein designated VGAM is inhibition of expression of VGAM886 target genes. It is appreciated that specific functions, and accordingly utilities, of VGAM886 correlate with, and may be deduced from, the identity of the target genes which VGAM886 binds and inhibits, and the function of these target genes, as elaborated hereinbelow.

SRY (sex determining region Y)-box 9 (campomelic dysplasia, autosomal sex-reversal) (SOX9, Accession NM_000346) is a VGAM886 host target gene. SOX9 BINDING SITE is HOST TARGET binding site found in the 3' untranslated region of mRNA encoded by SOX9, corresponding to a HOST TARGET binding site such as BINDING SITE I, BINDING SITE II or BINDING SITE III. Table 2 illustrates the complementarity of the nucleotide sequences of SOX9 BINDING SITE, designated SEQ ID:5899, to the nucleotide sequence of VGAM886 RNA, herein designated VGAM RNA, also designated SEQ ID:3597.

A function of VGAM886 is therefore inhibition of SRY (sex determining region Y)-box 9 (campomelic dysplasia, autosomal sex-reversal) (SOX9, Accession NM_000346), a gene which regulates the expression of other genes involved in chondrogenesis. Accordingly, utilities of VGAM886 include diagnosis, prevention and treatment of diseases and clinical conditions associated with SOX9. The function of SOX9 and its association with various diseases and clinical conditions, has been established by previous studies, as described hereinabove with reference to VGAM329.

KIAA0982 (Accession NM_014023) is another VGAM886 host target gene. KIAA0982 BINDING SITE is HOST TARGET binding site found in the 3' untranslated region of mRNA encoded by KIAA0982, corresponding to a HOST TARGET binding site such as BINDING SITE I, BINDING SITE II or BINDING SITE III. Table 2 illustrates the complementarity of the nucleotide sequences of KIAA0982 BINDING SITE, designated SEQ ID:15247, to the nucleotide sequence of VGAM886 RNA, herein designated VGAM RNA, also designated SEQ ID:3597.

Another function of VGAM886 is therefore inhibition of KIAA0982 (Accession NM_014023). Accordingly, utilities of VGAM886 include diagnosis, prevention and treatment of diseases and clinical conditions associated with KIAA0982.

KIAA1028 (Accession XM_166324) is another VGAM886 host target gene. KIAA1028 BINDING SITE is HOST TARGET binding site found in the 3' untranslated region of mRNA encoded by KIAA1028, corresponding to a HOST TARGET binding site such as BINDING SITE I, BINDING SITE II or BINDING SITE III. Table 2 illustrates the complementarity of the nucleotide sequences of KIAA1028 BINDING SITE, designated SEQ ID:44155, to the nucleotide sequence of VGAM886 RNA, herein designated VGAM RNA, also designated SEQ ID:3597.

Another function of VGAM886 is therefore inhibition of KIAA1028 (Accession XM_166324). Accordingly, utilities of VGAM886 include diagnosis, prevention and treatment of diseases and clinical conditions associated with KIAA1028.

PC2 (positive cofactor 2, multiprotein complex) Glutamine/ Q-rich-associated Protein (PCQAP, Accession NM_015889) is another VGAM886 host target gene. PCQAP BINDING SITE is HOST TARGET binding site found in the 3' untranslated region of mRNA encoded by PCQAP, corresponding to a HOST TARGET binding site such as BINDING SITE I, BINDING SITE II or BINDING SITE III. Table 2 illustrates the complementarity of the nucleotide sequences of PCQAP BINDING SITE, designated SEQ ID:18032, to the nucleotide sequence of VGAM886 RNA, herein designated VGAM RNA, also designated SEQ ID:3597.

Another function of VGAM886 is therefore inhibition of PC2 (positive cofactor 2, multiprotein complex) Glutamine/ Q-rich-associated Protein (PCQAP, Accession NM_015889). Accordingly, utilities of VGAM886 include diagnosis, prevention and treatment of diseases and clinical conditions associated with PCQAP. Protein Kinase, Lysine Deficient 2 (PRKWNK2, Accession XM_117531) is another VGAM886 host target gene. PRKWNK2 BINDING SITE is HOST TARGET binding site found in the 3' untranslated region of mRNA encoded by PRKWNK2, corresponding to a HOST TARGET binding site such as BINDING SITE I, BINDING SITE II or BINDING SITE III. Table 2 illustrates the complementarity of the nucleotide sequences of PRKWNK2 BINDING SITE, designated SEQ ID:43523, to the nucleotide sequence of VGAM886 RNA, herein designated VGAM RNA, also designated SEQ ID:3597.

Another function of VGAM886 is therefore inhibition of Protein Kinase, Lysine Deficient 2 (PRKWNK2, Accession XM_117531). Accordingly, utilities of VGAM886 include diagnosis, prevention and treatment of diseases and clinical conditions associated with PRKWNK2. RCD-8 (Accession NM_014329) is another VGAM886 host target gene. RCD-8 BINDING SITE is HOST TARGET binding site found in the 3' untranslated region of mRNA encoded by RCD-8, corresponding to a HOST TARGET binding site such as BINDING SITE I, BINDING SITE II or BINDING SITE III. Table 2 illustrates the complementarity of the nucleotide sequences of RCD-8 BINDING SITE, designated SEQ ID:15641, to the nucleotide sequence of VGAM886 RNA, herein designated VGAM RNA, also designated SEQ ID:3597.

Another function of VGAM886 is therefore inhibition of RCD-8 (Accession NM_014329). Accordingly, utilities of VGAM886 include diagnosis, prevention and treatment of diseases and clinical conditions associated with RCD-8. SMOC2 (Accession XM_051452) is another VGAM886 host target gene. SMOC2 BINDING SITE is HOST TARGET binding site found in the 3' untranslated region of mRNA encoded by SMOC2, corresponding to a HOST TARGET binding site such as BINDING SITE I, BINDING SITE II or BINDING SITE III. Table 2 illustrates the complementarity of the nucleotide sequences of SMOC2 BINDING SITE, designated SEQ ID:35832, to the nucleotide sequence of VGAM886 RNA, herein designated VGAM RNA, also designated SEQ ID:3597.

Another function of VGAM886 is therefore inhibition of SMOC2 (Accession XM_051452). Accordingly, utilities of VGAM886 include diagnosis, prevention and treatment of diseases and clinical conditions associated with SMOC2. Synaptojanin 2 (SYNJ2, Accession XM_029746) is another VGAM886 host target gene. SYNJ2 BINDING SITE is HOST TARGET binding site found in the 3' untranslated region of mRNA encoded by SYNJ2, corresponding to a HOST TARGET binding site such as BINDING SITE I, BINDING SITE II or BINDING SITE III. Table 2 illustrates the complementarity of the nucleotide sequences of SYNJ2 BINDING SITE, designated SEQ ID:30942, to the nucleotide sequence of VGAM886 RNA, herein designated VGAM RNA, also designated SEQ ID:3597.

Another function of VGAM886 is therefore inhibition of Synaptojanin 2 (SYNJ2, Accession XM_029746). Accordingly, utilities of VGAM886 include diagnosis, prevention and treatment of diseases and clinical conditions associated with SYNJ2. Testis Specific, 14 (TSGA14, Accession NM_018718) is another VGAM886 host target gene. TSGA14 BINDING SITE is HOST TARGET binding site found in the 3' untranslated region of mRNA encoded by TSGA14, corresponding to a HOST TARGET binding site such as BINDING SITE I, BINDING SITE II or BINDING SITE III. Table 2 illustrates the complementarity of the nucleotide sequences of TSGA14 BINDING SITE, designated SEQ ID:20793, to the nucleotide sequence of VGAM886 RNA, herein designated VGAM RNA, also designated SEQ ID:3597.

Another function of VGAM886 is therefore inhibition of Testis Specific, 14 (TSGA14, Accession NM_018718). Accordingly, utilities of VGAM886 include diagnosis, prevention and treatment of diseases and clinical conditions associated with TSGA14. LOC197201 (Accession XM_113839) is another VGAM886 host target gene. LOC197201 BINDING SITE is HOST TARGET binding site found in the 3' untranslated region of mRNA encoded by LOC197201, corresponding to a HOST TARGET binding site such as BINDING SITE I, BINDING SITE II or BINDING SITE III. Table 2 illustrates the complementarity of the nucleotide sequences of LOC197201 BINDING SITE, designated SEQ ID:42465, to the nucleotide sequence of VGAM886 RNA, herein designated VGAM RNA, also designated SEQ ID:3597.

Another function of VGAM886 is therefore inhibition of LOC197201 (Accession XM_113839). Accordingly, utilities of VGAM886 include diagnosis, prevention and treatment of diseases and clinical conditions associated with LOC197201. LOC219401 (Accession XM_166706) is another VGAM886 host target gene. LOC219401 BINDING SITE is HOST TARGET binding site found in the 3' untranslated region of mRNA encoded by LOC219401, corresponding to a HOST TARGET binding site such as BINDING SITE I, BINDING SITE II or BINDING SITE III. Table 2 illustrates the complementarity of the nucleotide sequences of LOC219401 BINDING SITE, designated SEQ ID:44587, to the nucleotide sequence of VGAM886 RNA, herein designated VGAM RNA, also designated SEQ ID:3597.

Another function of VGAM886 is therefore inhibition of LOC219401 (Accession XM_166706). Accordingly, utilities of VGAM886 include diagnosis, prevention and treatment of diseases and clinical conditions associated with LOC219401. FIG. 1 further provides a conceptual description of a novel bioinformatically detected viral gene of the present invention, referred to here as Viral Genomic Address Messenger 887 (VGAM887) viral gene, which modulates expression of respective host target genes thereof, the function and utility of which host target genes is known in the art.

VGAM887 is a novel bioinformatically detected regulatory, non protein coding, viral micro RNA (miRNA) gene. The method by which VGAM887 was detected is described hereinabove with reference to FIGS. 1-8.

VGAM887 gene, herein designated VGAM GENE, is a viral gene contained in the genome of Vaccinia Virus. VGAM887 host target gene, herein designated VGAM HOST TARGET GENE, is a human gene contained in the human genome.

VGAM887 gene encodes a VGAM887 precursor RNA, herein designated VGAM PRECURSOR RNA. Similar to other miRNA genes, and unlike most ordinary genes, VGAM887 precursor RNA does not encode a protein. A nucleotide sequence identical or highly similar to the nucleotide sequence of VGAM887 precursor RNA is designated SEQ ID:873, and is provided hereinbelow with reference to the sequence listing part. Nucleotide sequence SEQ ID:873 is located at position 67126 relative to the genome of Vaccinia Virus.

VGAM887 precursor RNA folds onto itself, forming VGAM887 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM887 folded precursor RNA into VGAM887 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM887 RNA is designated SEQ ID:3598, and is provided hereinbelow with reference to the sequence listing part.

VGAM887 host target gene, herein designated VGAM HOST TARGET GENE, encodes a corresponding messenger RNA, VGAM887 host target RNA, herein designated VGAM HOST TARGET RNA. VGAM887 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM887 RNA, herein designated VGAM RNA, binds complementarily to one or more host target binding sites located in untranslated regions of VGAM887 host target RNA, herein designated VGAM HOST TARGET RNA. This complementary binding is due to the fact that the nucleotide sequence of VGAM887 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM887 RNA, herein designated VGAM RNA, may have a different number of host target binding sites in untranslated regions of a VGAM887 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM887 RNA, herein designated VGAM RNA, to host target binding sites on VGAM887 host target RNA, herein designated VGAM HOST TARGET RNA, such as BINDING SITE I, BINDING SITE II and BINDING SITE III, inhibits translation of VGAM887 host target RNA into VGAM887 host target protein, herein designated VGAM HOST TARGET PROTEIN. VGAM host target protein is therefore outlined by a broken line.

It is appreciated that VGAM887 host target gene, herein designated VGAM HOST TARGET GENE, in fact represents a plurality of VGAM887 host target genes. The mRNA of each one of this plurality of VGAM887 host target genes comprises one or more host target binding sites, each having a nucleotide sequence which is at least partly complementary to VGAM887 RNA, herein designated VGAM RNA, and which when bound by VGAM887 RNA causes inhibition of translation of respective one or more VGAM887 host target proteins.

It is further appreciated by one skilled in the art that the mode of translational inhibition illustrated by FIG. 1 with specific reference to translational inhibition exerted by VGAM887 gene, herein designated VGAM GENE, on one or more VGAM887 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM887 is inhibition of expression of host target genes, as part of a novel viral mechanism of attacking a host. Accordingly, utilities of VGAM887 include diagnosis, prevention and treatment of viral infection by Vaccinia Virus. Specific functions, and accordingly utilities, of VGAM887 correlate with, and may be deduced from, the identity of the host target genes which VGAM887 binds and inhibits, and the function of these host target genes, as elaborated hereinbelow.

Nucleotide sequences of the VGAM887 precursor RNA, herein designated VGAM PRECURSOR RNA, and of the 'diced' VGAM887 RNA, herein designated VGAM RNA, and a schematic representation of the secondary folding of VGAM887 folded precursor RNA, herein designated VGAM FOLDED PRECURSOR RNA, of VGAM887 are further described hereinbelow with reference to Table 1.

Nucleotide sequences of host target binding sites, such as BINDING SITE-I, BINDING SITE-II and BINDING SITE-III of FIG. 1, found on VGAM887 host target RNA, and schematic representation of the complementarity of each of these host target binding sites to VGAM887 RNA, herein designated VGAM RNA, are described hereinbelow with reference to Table 2.

As mentioned hereinabove with reference to FIG. 1, a function of VGAM887 gene, herein designated VGAM is inhibition of expression of VGAM887 target genes. It is appreciated that specific functions, and accordingly utilities, of VGAM887 correlate with, and may be deduced from, the identity of the target genes which VGAM887 binds and inhibits, and the function of these target genes, as elaborated hereinbelow.

Membrane Component, Chromosome 11, Surface Marker 1 (M11S1, Accession NM_005898) is a VGAM887 host target gene. M11S1 BINDING SITE is HOST TARGET binding site found in the 3' untranslated region of mRNA encoded by M11S1, corresponding to a HOST TARGET binding site such as BINDING SITE I, BINDING SITE II or BINDING SITE III. Table 2 illustrates the complementarity of the nucleotide sequences of M11S1 BINDING SITE, designated SEQ ID:12516, to the nucleotide sequence of VGAM887 RNA, herein designated VGAM RNA, also designated SEQ ID:3598.

A function of VGAM887 is therefore inhibition of Membrane Component, Chromosome 11, Surface Marker 1 (M11S1, Accession NM_005898), a gene which may play a role in transporting nutrients from the gut lumen across the gutlining epithelial cell layer. Accordingly, utilities of VGAM887 include diagnosis, prevention and treatment of diseases and clinical conditions associated with M11S1. The function of M11S1 and its association with various diseases and clinical conditions, has been established by previous studies, as described hereinabove with reference to VGAM131. Placenta-specific 1 (PLAC1, Accession NM_021796) is another VGAM887 host target gene. PLAC1 BINDING SITE is HOST TARGET binding site found in the 5' untranslated region of mRNA encoded by PLAC1, corresponding to a HOST TARGET binding site such as BINDING SITE I, BINDING SITE II or BINDING SITE III. Table 2 illustrates the complementarity of the nucleotide sequences of PLAC1 BINDING SITE, designated SEQ ID:22352, to the nucleotide sequence of VGAM887 RNA, herein designated VGAM RNA, also designated SEQ ID:3598.

Another function of VGAM887 is therefore inhibition of Placenta-specific 1 (PLAC1, Accession NM_021796). Accordingly, utilities of VGAM887 include diagnosis, prevention and treatment of diseases and clinical conditions associated with PLAC1. Ubiquitin Protein Ligase E3A (human papilloma virus E6-associated protein, Angelman syndrome) (UBE3A, Accession NM_130838) is another VGAM887 host target gene. UBE3A BINDING SITE1 through UBE3A BINDING SITE3 are HOST TARGET binding sites found in untranslated regions of mRNA encoded by UBE3A, corresponding to HOST TARGET binding sites such as BINDING SITE I, BINDING SITE II or BINDING SITE III. Table 2 illustrates the complementarity of the nucleotide sequences of UBE3A BINDING SITE1 through UBE3A BINDING SITE3, designated SEQ ID:28360, SEQ ID:28364 and SEQ ID:6079 respectively, to the nucleotide sequence of VGAM887 RNA, herein designated VGAM RNA, also designated SEQ ID:3598.

Another function of VGAM887 is therefore inhibition of Ubiquitin Protein Ligase E3A (human papilloma virus E6-associated protein, Angelman syndrome) (UBE3A, Accession NM_130838). Accordingly, utilities of VGAM887 include diagnosis, prevention and treatment of diseases and clinical conditions associated with UBE3A. LOC91250 (Accession XM_037135) is another VGAM887 host target gene. LOC91250 BINDING SITE is HOST TARGET binding site found in the 5' untranslated region of mRNA encoded by LOC91250, corresponding to a HOST TARGET binding site such as BINDING SITE I, BINDING SITE II or BINDING SITE III. Table 2 illustrates the complementarity of the nucleotide sequences of LOC91250 BINDING SITE, designated SEQ ID:32548, to the nucleotide sequence of VGAM887 RNA, herein designated VGAM RNA, also designated SEQ ID:3598.

Another function of VGAM887 is therefore inhibition of LOC91250 (Accession XM_037135). Accordingly, utilities of VGAM887 include diagnosis, prevention and treatment of diseases and clinical conditions associated with LOC91250. FIG. 1 further provides a conceptual description of a novel bioinformatically detected viral gene of the present invention, referred to here as Viral Genomic Address Messenger 888 (VGAM888) viral gene, which modulates expression of respective host target genes thereof, the function and utility of which host target genes is known in the art.

VGAM888 is a novel bioinformatically detected regulatory, non protein coding, viral micro RNA (miRNA) gene. The method by which VGAM888 was detected is described hereinabove with reference to FIGS. 1-8.

VGAM888 gene, herein designated VGAM GENE, is a viral gene contained in the genome of Human Herpesvirus 4. VGAM888 host target gene, herein designated VGAM HOST TARGET GENE, is a human gene contained in the human genome.

VGAM888 gene encodes a VGAM888 precursor RNA, herein designated VGAM PRECURSOR RNA. Similar to other miRNA genes, and unlike most ordinary genes, VGAM888 precursor RNA does not encode a protein. A nucleotide sequence identical or highly similar to the nucleotide sequence of VGAM888 precursor RNA is designated SEQ ID:874, and is provided hereinbelow with reference to the sequence listing part. Nucleotide sequence SEQ ID:874 is located at position 7588 relative to the genome of Human Herpesvirus 4.

VGAM888 precursor RNA folds onto itself, forming VGAM888 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM888 folded precursor RNA into VGAM888 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 91%) nucleotide sequence of VGAM888 RNA is designated SEQ ID:3599, and is provided hereinbelow with reference to the sequence listing part.

VGAM888 host target gene, herein designated VGAM HOST TARGET GENE, encodes a corresponding messenger RNA, VGAM888 host target RNA, herein designated VGAM HOST TARGET RNA. VGAM888 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM888 RNA, herein designated VGAM RNA, binds complementarily to one or more host target binding sites located in untranslated regions of VGAM888 host target RNA, herein designated VGAM HOST TARGET RNA. This complementary binding is due to the fact that the nucleotide sequence of VGAM888 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM888 RNA, herein designated VGAM RNA, may have a different number of host target binding sites in untranslated regions of a VGAM888 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM888 RNA, herein designated VGAM RNA, to host target binding sites on VGAM888 host target RNA, herein designated VGAM HOST TARGET RNA, such as BINDING SITE I, BINDING SITE II and BINDING SITE III, inhibits translation of VGAM888 host target RNA into VGAM888 host target protein, herein designated VGAM HOST TARGET PROTEIN. VGAM host target protein is therefore outlined by a broken line.

It is appreciated that VGAM888 host target gene, herein designated VGAM HOST TARGET GENE, in fact represents a plurality of VGAM888 host target genes. The mRNA of each one of this plurality of VGAM888 host target genes comprises one or more host target binding sites, each having a nucleotide sequence which is at least partly complementary to VGAM888 RNA, herein designated VGAM RNA, and which when bound by VGAM888 RNA causes inhibition of translation of respective one or more VGAM888 host target proteins.

It is further appreciated by one skilled in the art that the mode of translational inhibition illustrated by FIG. 1 with specific reference to translational inhibition exerted by VGAM888 gene, herein designated VGAM GENE, on one or more VGAM888 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM888 is inhibition of expression of host target genes, as part of a novel viral mechanism of attacking a host. Accordingly, utilities of VGAM888 include diagnosis, prevention and treatment of viral infection by Human Herpesvirus 4. Specific functions, and accordingly utilities, of VGAM888 correlate with, and may be deduced from, the identity of the host target genes which VGAM888 binds and inhibits, and the function of these host target genes, as elaborated hereinbelow.

Nucleotide sequences of the VGAM888 precursor RNA, herein designated VGAM PRECURSOR RNA, and of the 'diced' VGAM888 RNA, herein designated VGAM RNA, and a schematic representation of the secondary folding of VGAM888 folded precursor RNA, herein designated VGAM FOLDED PRECURSOR RNA, of VGAM888 are further described hereinbelow with reference to Table 1.

Nucleotide sequences of host target binding sites, such as BINDING SITE-I, BINDING SITE-II and BINDING SITE-III of FIG. 1, found on VGAM888 host target RNA, and schematic representation of the complementarity of each of these host target binding sites to VGAM888 RNA, herein designated VGAM RNA, are described hereinbelow with reference to Table 2.

As mentioned hereinabove with reference to FIG. 1, a function of VGAM888 gene, herein designated VGAM is inhibition of expression of VGAM888 target genes. It is appreciated that specific functions, and accordingly utilities, of VGAM888 correlate with, and may be deduced from, the identity of the target genes which VGAM888 binds and inhibits, and the function of these target genes, as elaborated hereinbelow.

Tumor Necrosis Factor (ligand) Superfamily, Member 4 (tax-transcriptionally activated glycoprotein 1, 34 kDa) (TNFSF4, Accession NM_003326) is a VGAM888 host target gene. TNFSF4 BINDING SITE is HOST TARGET binding site found in the 3' untranslated region of mRNA encoded by TNFSF4, corresponding to a HOST TARGET binding site such as BINDING SITE I, BINDING SITE II or BINDING SITE III. Table 2 illustrates the complementarity of the nucleotide sequences of TNFSF4 BINDING SITE, designated SEQ ID:9331, to the nucleotide sequence of VGAM888 RNA, herein designated VGAM RNA, also designated SEQ ID:3599.

A function of VGAM888 is therefore inhibition of Tumor Necrosis Factor (ligand) Superfamily, Member 4 (tax-transcriptionally activated glycoprotein 1, 34 kDa) (TNFSF4, Accession NM_003326), a gene which co-stimulates t cell proliferation and cytokine production. Accordingly, utilities of VGAM888 include diagnosis, prevention and treatment of diseases and clinical conditions associated with TNFSF4. The function of TNFSF4 and its association with various diseases and clinical conditions, has been established by previous studies, as described hereinabove with reference to VGAM463. FLJ20038 (Accession NM_017634) is another VGAM888 host target gene. FLJ20038 BINDING SITE is HOST TARGET binding site found in the 3' untranslated region of mRNA encoded by FLJ20038, corresponding to a HOST TARGET binding site such as BINDING SITE I, BINDING SITE II or BINDING SITE III. Table 2 illustrates the complementarity of the nucleotide sequences of FLJ20038 BINDING SITE, designated SEQ ID:19141, to the nucleotide sequence of VGAM888 RNA, herein designated VGAM RNA, also designated SEQ ID:3599.

Another function of VGAM888 is therefore inhibition of FLJ20038 (Accession NM_017634). Accordingly, utilities of VGAM888 include diagnosis, prevention and treatment of diseases and clinical conditions associated with FLJ20038. KIAA1805 (Accession XM_086976) is another VGAM888 host target gene. KIAA1805 BINDING SITE is HOST TARGET binding site found in the 3' untranslated region of mRNA encoded by KIAA1805, corresponding to a HOST TARGET binding site such as BINDING SITE I, BINDING SITE II or BINDING SITE III. Table 2 illustrates the complementarity of the nucleotide sequences of KIAA1805 BINDING SITE, designated SEQ ID:39000, to the nucleotide sequence of VGAM888 RNA, herein designated VGAM RNA, also designated SEQ ID:3599.

Another function of VGAM888 is therefore inhibition of KIAA1805 (Accession XM_086976). Accordingly, utilities of VGAM888 include diagnosis, prevention and treatment of diseases and clinical conditions associated with KIAA1805. MSTP032 (Accession NM_025226) is another VGAM888 host target gene. MSTP032 BINDING SITE is HOST TARGET binding site found in the 3' untranslated region of mRNA encoded by MSTP032, corresponding to a HOST TARGET binding site such as BINDING SITE I, BINDING SITE II or BINDING SITE III. Table 2 illustrates the complementarity of the nucleotide sequences of MSTP032 BINDING SITE, designated SEQ ID:24908, to the nucleotide sequence of VGAM888 RNA, herein designated VGAM RNA, also designated SEQ ID:3599.

Another function of VGAM888 is therefore inhibition of MSTP032 (Accession NM_025226). Accordingly, utilities of VGAM888 include diagnosis, prevention and treatment of diseases and clinical conditions associated with MSTP032. NCK Adaptor Protein 1 (NCK1, Accession NM_006153) is another VGAM888 host target gene. NCK1 BINDING SITE is HOST TARGET binding site found in the 3' untranslated region of mRNA encoded by NCK1, corresponding to a HOST TARGET binding site such as BINDING SITE I, BINDING SITE II or BINDING SITE III. Table 2 illustrates the complementarity of the nucleotide sequences of NCK1 BINDING SITE, designated SEQ ID:12810, to the nucleotide sequence of VGAM888 RNA, herein designated VGAM RNA, also designated SEQ ID:3599.

Another function of VGAM888 is therefore inhibition of NCK Adaptor Protein 1 (NCK1, Accession NM_006153). Accordingly, utilities of VGAM888 include diagnosis, prevention and treatment of diseases and clinical conditions associated with NCK1. LOC120114 (Accession XM_061871) is another VGAM888 host target gene. LOC120114 BINDING SITE is HOST TARGET binding site found in the 3' untranslated region of mRNA encoded by LOC120114, corresponding to a HOST TARGET binding site such as BINDING SITE I, BINDING SITE II or BINDING SITE III. Table 2 illustrates the complementarity of the nucleotide sequences of LOC120114 BINDING SITE, designated SEQ ID:37214, to the nucleotide sequence of VGAM888 RNA, herein designated VGAM RNA, also designated SEQ ID:3599.

Another function of VGAM888 is therefore inhibition of LOC120114 (Accession XM_061871). Accordingly, utilities of VGAM888 include diagnosis, prevention and treatment of diseases and clinical conditions associated with LOC120114. LOC146669 (Accession XM_085534) is another VGAM888 host target gene. LOC146669 BINDING SITE is HOST TARGET binding site found in the 5' untranslated region of mRNA encoded by LOC146669, corresponding to a HOST TARGET binding site such as BINDING SITE I, BINDING SITE II or BINDING SITE III. Table 2 illustrates the complementarity of the nucleotide sequences of LOC146669 BINDING SITE, designated SEQ ID:38223, to the nucleotide sequence of VGAM888 RNA, herein designated VGAM RNA, also designated SEQ ID:3599.

Another function of VGAM888 is therefore inhibition of LOC146669 (Accession XM_085534). Accordingly, utilities of VGAM888 include diagnosis, prevention and treatment of diseases and clinical conditions associated with LOC146669. FIG. 1 further provides a conceptual description of a novel bioinformatically detected viral gene of the present invention, referred to here as Viral Genomic Address Messenger 889 (VGAM889) viral gene, which modulates expression of respective host target genes thereof, the function and utility of which host target genes is known in the art.

VGAM889 is a novel bioinformatically detected regulatory, non protein coding, viral micro RNA (miRNA) gene. The method by which VGAM889 was detected is described hereinabove with reference to FIGS. 1-8.

VGAM889 gene, herein designated VGAM GENE, is a viral gene contained in the genome of Human Herpesvirus 4. VGAM889 host target gene, herein designated VGAM HOST TARGET GENE, is a human gene contained in the human genome.

VGAM889 gene encodes a VGAM889 precursor RNA, herein designated VGAM PRECURSOR RNA. Similar to other miRNA genes, and unlike most ordinary genes, VGAM889 precursor RNA does not encode a protein. A nucleotide sequence identical or highly similar to the nucleotide sequence of VGAM889 precursor RNA is designated SEQ ID:875, and is provided hereinbelow with reference to the sequence listing part. Nucleotide sequence SEQ ID:875 is located at position 9562 relative to the genome of Human Herpesvirus 4.

VGAM889 precursor RNA folds onto itself, forming VGAM889 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM889 folded precursor RNA into VGAM889 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM889 RNA is designated SEQ ID:3600, and is provided hereinbelow with reference to the sequence listing part.

VGAM889 host target gene, herein designated VGAM HOST TARGET GENE, encodes a corresponding messenger RNA, VGAM889 host target RNA, herein designated VGAM HOST TARGET RNA. VGAM889 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM889 RNA, herein designated VGAM RNA, binds complementarily to one or more host target binding sites located in untranslated regions of VGAM889 host target RNA, herein designated VGAM HOST TARGET RNA. This complementary binding is due to the fact that the nucleotide sequence of VGAM889 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM889 RNA, herein designated VGAM RNA, may have a different number of host target binding sites in untranslated regions of a VGAM889 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM889 RNA, herein designated VGAM RNA, to host target binding sites on VGAM889 host target RNA, herein designated VGAM HOST TARGET RNA, such as BINDING SITE I, BINDING SITE II and BINDING SITE III, inhibits translation of VGAM889 host target RNA into VGAM889 host target protein, herein designated VGAM HOST TARGET PROTEIN. VGAM host target protein is therefore outlined by a broken line.

It is appreciated that VGAM889 host target gene, herein designated VGAM HOST TARGET GENE, in fact represents a plurality of VGAM889 host target genes. The mRNA of each one of this plurality of VGAM889 host target genes comprises one or more host target binding sites, each having a nucleotide sequence which is at least partly complementary to VGAM889 RNA, herein designated VGAM RNA, and which when bound by VGAM889 RNA causes inhibition of translation of respective one or more VGAM889 host target proteins.

It is further appreciated by one skilled in the art that the mode of translational inhibition illustrated by FIG. 1 with specific reference to translational inhibition exerted by VGAM889 gene, herein designated VGAM GENE, on one or more VGAM889 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM889 is inhibition of expression of host target genes, as part of a novel viral mechanism of attacking a host. Accordingly, utilities of VGAM889 include diagnosis, prevention and treatment of viral infection by Human Herpesvirus 4. Specific functions, and accordingly utilities, of VGAM889 correlate with, and may be deduced from, the identity of the host target genes which VGAM889 binds and inhibits, and the function of these host target genes, as elaborated hereinbelow.

Nucleotide sequences of the VGAM889 precursor RNA, herein designated VGAM PRECURSOR RNA, and of the 'diced' VGAM889 RNA, herein designated VGAM RNA, and a schematic representation of the secondary folding of VGAM889 folded precursor RNA, herein designated VGAM FOLDED PRECURSOR RNA, of VGAM889 are further described hereinbelow with reference to Table 1.

Nucleotide sequences of host target binding sites, such as BINDING SITE-I, BINDING SITE-II and BINDING SITE-III of FIG. 1, found on VGAM889 host target RNA, and schematic representation of the complementarity of each of these host target binding sites to VGAM889 RNA, herein designated VGAM RNA, are described hereinbelow with reference to Table 2.

As mentioned hereinabove with reference to FIG. 1, a function of VGAM889 gene, herein designated VGAM is inhibition of expression of VGAM889 target genes. It is appreciated that specific functions, and accordingly utilities, of VGAM889 correlate with, and may be deduced from, the identity of the target genes which VGAM889 binds and inhibits, and the function of these target genes, as elaborated hereinbelow.

Microfibrillar-associated Protein 4 (MFAP4, Accession XM_045044) is a VGAM889 host target gene. MFAP4 BINDING SITE is HOST TARGET binding site found in the 3' untranslated region of mRNA encoded by MFAP4, corresponding to a HOST TARGET binding site such as BINDING SITE I, BINDING SITE II or BINDING SITE III. Table 2 illustrates the complementarity of the nucleotide sequences of MFAP4 BINDING SITE, designated SEQ ID:34328, to the nucleotide sequence of VGAM889 RNA, herein designated VGAM RNA, also designated SEQ ID:3600.

A function of VGAM889 is therefore inhibition of Microfibrillar-associated Protein 4 (MFAP4, Accession XM_045044). Accordingly, utilities of VGAM889 include diagnosis, prevention and treatment of diseases and clinical conditions associated with MFAP4. Transient Receptor Potential Cation Channel, Subfamily M, Member 6 (TRPM6, Accession NM_017662) is another VGAM889 host target gene. TRPM6 BINDING SITE is HOST TARGET binding site found in the 3' untranslated region of mRNA encoded by TRPM6, corresponding to a HOST TARGET binding site such as BINDING SITE I, BINDING SITE II or BINDING SITE III. Table 2 illustrates the complementarity of the nucleotide sequences of TRPM6 BINDING SITE, designated SEQ ID:19197, to the nucleotide sequence of VGAM889 RNA, herein designated VGAM RNA, also designated SEQ ID:3600.

Another function of VGAM889 is therefore inhibition of Transient Receptor Potential Cation Channel, Subfamily M, Member 6 (TRPM6, Accession NM_017662), a gene which contains a predicted ion channel domain and a protein kinase domain. Accordingly, utilities of VGAM889 include diagnosis, prevention and treatment of diseases and clinical conditions associated with TRPM6. The function of TRPM6 and its association with various diseases and clinical conditions, has been established by previous studies, as described hereinabove with reference to VGAM173. Chromosome 20 Open Reading Frame 30 (C20orf30, Accession NM_014145) is another VGAM889 host target gene. C20orf30 BINDING SITE is HOST TARGET binding site found in the 3' untranslated region of mRNA encoded by C20orf30, corresponding to a HOST TARGET binding site such as BINDING SITE I, BINDING SITE II or BINDING SITE III. Table 2 illustrates the complementarity of the nucleotide sequences of C20orf30 BINDING SITE, designated SEQ ID:15431, to the nucleotide sequence of VGAM889 RNA, herein designated VGAM RNA, also designated SEQ ID:3600.

Another function of VGAM889 is therefore inhibition of Chromosome 20 Open Reading Frame 30 (C20orf30, Accession NM_014145). Accordingly, utilities of VGAM889 include diagnosis, prevention and treatment of diseases and clinical conditions associated with C20orf30. DKFZP434P211 (Accession NM_014549) is another VGAM889 host target gene. DKFZP434P211 BINDING SITE is HOST TARGET binding site found in the 5' untranslated region of mRNA encoded by DKFZP434P211, corresponding to a HOST TARGET binding site such as BINDING SITE I, BINDING SITE II or BINDING SITE III. Table 2 illustrates the complementarity of the nucleotide sequences of DKFZP434P211 BINDING SITE, designated SEQ ID:15866, to the nucleotide sequence of VGAM889 RNA, herein designated VGAM RNA, also designated SEQ ID:3600.

Another function of VGAM889 is therefore inhibition of DKFZP434P211 (Accession NM_014549). Accordingly, utilities of VGAM889 include diagnosis, prevention and treatment of diseases and clinical conditions associated with DKFZP434P211. Glutamate Receptor, Ionotropic, N-methyl-D-aspartate 3A (GRIN3A, Accession NM_133445) is another VGAM889 host target gene. GRIN3A BINDING SITE is HOST TARGET binding site found in the 3' untranslated region of mRNA encoded by GRIN3A, corresponding to a HOST TARGET binding site such as BINDING SITE I, BINDING SITE II or BINDING SITE III. Table 2 illustrates the complementarity of the nucleotide sequences of GRIN3A BINDING SITE, designated SEQ ID:28531, to the nucleotide sequence of VGAM889 RNA, herein designated VGAM RNA, also designated SEQ ID:3600.

Another function of VGAM889 is therefore inhibition of Glutamate Receptor, Ionotropic, N-methyl-D-aspartate 3A (GRIN3A, Accession NM_133445). Accordingly, utilities of VGAM889 include diagnosis, prevention and treatment of diseases and clinical conditions associated with GRIN3A. IMP-2 (Accession NM_006548) is another VGAM889 host target gene. IMP-2 BINDING SITE is HOST TARGET binding site found in the 3' untranslated region of mRNA encoded by IMP-2, corresponding to a HOST TARGET binding site such as BINDING SITE I, BINDING SITE II or BINDING SITE III. Table 2 illustrates the complementarity of the nucleotide sequences of IMP-2 BINDING SITE, designated SEQ ID:13303, to the nucleotide sequence of VGAM889 RNA, herein designated VGAM RNA, also designated SEQ ID:3600.

Another function of VGAM889 is therefore inhibition of IMP-2 (Accession NM_006548). Accordingly, utilities of VGAM889 include diagnosis, prevention and treatment of diseases and clinical conditions associated with IMP-2. KIAA0164 (Accession NM_014739) is another VGAM889 host target gene. KIAA0164 BINDING SITE is HOST TARGET binding site found in the 5' untranslated region of mRNA encoded by KIAA0164, corresponding to a HOST TARGET binding site such as BINDING SITE I, BINDING SITE II or BINDING SITE III. Table 2 illustrates the complementarity of the nucleotide sequences of KIAA0164 BINDING SITE, designated SEQ ID:16405, to the nucleotide sequence of VGAM889 RNA, herein designated VGAM RNA, also designated SEQ ID:3600.

Another function of VGAM889 is therefore inhibition of KIAA0164 (Accession NM_014739). Accordingly, utilities of VGAM889 include diagnosis, prevention and treatment of diseases and clinical conditions associated with KIAA0164. KIAA1389 (Accession XM_045839) is another VGAM889 host target gene. KIAA1389 BINDING SITE is HOST TARGET binding site found in the 3' untranslated region of mRNA encoded by KIAA1389, corresponding to a HOST TARGET binding site such as BINDING SITE I, BINDING SITE II or BINDING SITE III. Table 2 illustrates the complementarity of the nucleotide sequences of KIAA1389 BINDING SITE, designated SEQ ID:34569, to the nucleotide sequence of VGAM889 RNA, herein designated VGAM RNA, also designated SEQ ID:3600.

Another function of VGAM889 is therefore inhibition of KIAA1389 (Accession XM_045839). Accordingly, utilities of VGAM889 include diagnosis, prevention and treatment of diseases and clinical conditions associated with KIAA1389. KIAA1416 (Accession XM_098762) is another VGAM889 host target gene. KIAA1416 BINDING SITE is HOST TARGET binding site found in the 5' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41801, to the nucleotide sequence of VGAM889 RNA, herein designated VGAM RNA, also designated SEQ ID:3600.

Another function of VGAM889 is therefore inhibition of KIAA1416 (Accession XM_098762). Accordingly, utilities of VGAM889 include diagnosis, prevention and treatment of diseases and clinical conditions associated with KIAA1416. T-cell Leukemia/lymphoma 6 (TCL6, Accession NM_020552) is another VGAM889 host target gene. TCL6 BINDING SITE1 and TCL6 BINDING SITE2 are HOST TARGET binding sites found in untranslated regions of mRNA encoded by TCL6, corresponding to HOST TARGET binding sites such as BINDING SITE I, BINDING SITE II or BINDING SITE III. Table 2 illustrates the complementarity of the nucleotide sequences of TCL6 BINDING SITE1 and TCL6 BINDING SITE2, designated SEQ ID:21769 and SEQ ID:21775 respectively, to the nucleotide sequence of VGAM889 RNA, herein designated VGAM RNA, also designated SEQ ID:3600.

Another function of VGAM889 is therefore inhibition of T-cell Leukemia/lymphoma 6 (TCL6, Accession NM_020552). Accordingly, utilities of VGAM889 include diagnosis, prevention and treatment of diseases and clinical conditions associated with TCL6. LOC199858 (Accession XM_114040) is another VGAM889 host target gene. LOC199858 BINDING SITE is HOST TARGET binding site found in the 5' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42633, to the nucleotide sequence of VGAM889 RNA, herein designated VGAM RNA, also designated SEQ ID:3600.

Another function of VGAM889 is therefore inhibition of LOC199858 (Accession XM_114040). Accordingly, utilities of VGAM889 include diagnosis, prevention and treatment of diseases and clinical conditions associated with LOC199858. LOC256176 (Accession XM_172889) is another VGAM889 host target gene. LOC256176 BINDING SITE is HOST TARGET binding site found in the 5' untranslated region of mRNA encoded by LOC256176, corresponding to a HOST TARGET binding site such as BINDING SITE I, BINDING SITE II or BINDING SITE III. Table 2 illustrates the complementarity of the nucleotide sequences of LOC256176 BINDING SITE, designated SEQ ID:46170, to the nucleotide sequence of VGAM889 RNA, herein designated VGAM RNA, also designated SEQ ID:3600.

Another function of VGAM889 is therefore inhibition of LOC256176 (Accession XM_172889). Accordingly, utilities of VGAM889 include diagnosis, prevention and treatment of diseases and clinical conditions associated with LOC256176. LOC57105 (Accession NM_020377) is another VGAM889 host target gene. LOC57105 BINDING SITE is HOST TARGET binding site found in the 3' untranslated region of mRNA encoded by LOC57105, corresponding to a HOST TARGET binding site such as BINDING SITE I, BINDING SITE II or BINDING SITE III. Table 2 illustrates the complementarity of the nucleotide sequences of LOC57105 BINDING SITE, designated SEQ ID:21637, to the nucleotide sequence of VGAM889 RNA, herein designated VGAM RNA, also designated SEQ ID:3600.

Another function of VGAM889 is therefore inhibition of LOC57105 (Accession NM_020377). Accordingly, utilities of VGAM889 include diagnosis, prevention and treatment of diseases and clinical conditions associated with LOC57105. LOC81558 (Accession NM_030802) is another VGAM889 host target gene. LOC81558 BINDING SITE is HOST TARGET binding site found in the 3' untranslated region of mRNA encoded by LOC81558, corresponding to a HOST TARGET binding site such as BINDING SITE I, BINDING SITE II or BINDING SITE III. Table 2 illustrates the complementarity of the nucleotide sequences of LOC81558 BINDING SITE, designated SEQ ID:25109, to the nucleotide sequence of VGAM889 RNA, herein designated VGAM RNA, also designated SEQ ID:3600.

Another function of VGAM889 is therefore inhibition of LOC81558 (Accession NM_030802). Accordingly, utilities of VGAM889 include diagnosis, prevention and treatment of diseases and clinical conditions associated with LOC81558. FIG. 1 further provides a conceptual description of a novel bioinformatically detected viral gene of the present invention, referred to here as Viral Genomic Address Messenger 890 (VGAM890) viral gene, which modulates expression of respective host target genes thereof, the function and utility of which host target genes is known in the art.

VGAM890 is a novel bioinformatically detected regulatory, non protein coding, viral micro RNA (miRNA) gene. The method by which VGAM890 was detected is described hereinabove with reference to FIGS. 1-8.

VGAM890 gene, herein designated VGAM GENE, is a viral gene contained in the genome of Human Herpesvirus 4. VGAM890 host target gene, herein designated VGAM HOST TARGET GENE, is a human gene contained in the human genome.

VGAM890 gene encodes a VGAM890 precursor RNA, herein designated VGAM PRECURSOR RNA. Similar to other miRNA genes, and unlike most ordinary genes, VGAM890 precursor RNA does not encode a protein. A nucleotide sequence identical or highly similar to the nucleotide sequence of VGAM890 precursor RNA is designated SEQ ID:876, and is provided hereinbelow with reference to the sequence listing part. Nucleotide sequence SEQ ID:876 is located at position 8059 relative to the genome of Human Herpesvirus 4.

VGAM890 precursor RNA folds onto itself, forming VGAM890 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM890 folded precursor RNA into VGAM890 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM890 RNA is designated SEQ ID:3601, and is provided hereinbelow with reference to the sequence listing part.

VGAM890 host target gene, herein designated VGAM HOST TARGET GENE, encodes a corresponding messenger RNA, VGAM890 host target RNA, herein designated VGAM HOST TARGET RNA. VGAM890 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM890 RNA, herein designated VGAM RNA, binds complementarily to one or more host target binding sites located in untranslated regions of VGAM890 host target RNA, herein designated VGAM HOST TARGET RNA. This complementary binding is due to the fact that the nucleotide sequence of VGAM890 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM890 RNA, herein designated VGAM RNA, may have a different number of host target binding sites in untranslated regions of a VGAM890 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM890 RNA, herein designated VGAM RNA, to host target binding sites on VGAM890 host target RNA, herein designated VGAM HOST TARGET RNA, such as BINDING SITE I, BINDING SITE II and BINDING SITE III, inhibits translation of VGAM890 host target RNA into VGAM890 host target protein, herein designated VGAM HOST TARGET PROTEIN. VGAM host target protein is therefore outlined by a broken line.

It is appreciated that VGAM890 host target gene, herein designated VGAM HOST TARGET GENE, in fact represents a plurality of VGAM890 host target genes. The mRNA of each one of this plurality of VGAM890 host target genes comprises one or more host target binding sites, each having a nucleotide sequence which is at least partly complementary to VGAM890 RNA, herein designated VGAM RNA, and which when bound by VGAM890 RNA causes inhibition of translation of respective one or more VGAM890 host target proteins.

It is further appreciated by one skilled in the art that the mode of translational inhibition illustrated by FIG. 1 with specific reference to translational inhibition exerted by VGAM890 gene, herein designated VGAM GENE, on one or more VGAM890 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM890 is inhibition of expression of host target genes, as part of a novel viral mechanism of attacking a host. Accordingly, utilities of VGAM890 include diagnosis, prevention and treatment of viral infection by Human Herpesvirus 4. Specific functions, and accordingly utilities, of VGAM890 correlate with, and may be deduced from, the identity of the host target genes which VGAM890 binds and inhibits, and the function of these host target genes, as elaborated hereinbelow.

Nucleotide sequences of the VGAM890 precursor RNA, herein designated VGAM PRECURSOR RNA, and of the 'diced' VGAM890 RNA, herein designated VGAM RNA, and a schematic representation of the secondary folding of VGAM890 folded precursor RNA, herein designated VGAM FOLDED PRECURSOR RNA, of VGAM890 are further described hereinbelow with reference to Table 1.

Nucleotide sequences of host target binding sites, such as BINDING SITE-I, BINDING SITE-II and BINDING SITE-III of FIG. 1, found on VGAM890 host target RNA, and schematic representation of the complementarity of each of these host target binding sites to VGAM890 RNA, herein designated VGAM RNA, are described hereinbelow with reference to Table 2.

As mentioned hereinabove with reference to FIG. 1, a function of VGAM890 gene, herein designated VGAM is inhibition of expression of VGAM890 target genes. It is appreciated that specific functions, and accordingly utilities, of VGAM890 correlate with, and may be deduced from, the identity of the target genes which VGAM890 binds and inhibits, and the function of these target genes, as elaborated hereinbelow.

GAC1 (Accession NM_006338) is a VGAM890 host target gene. GAC1 BINDING SITE is HOST TARGET binding site found in the 5' untranslated region of mRNA encoded by GAC1, corresponding to a HOST TARGET binding site such as BINDING SITE I, BINDING SITE II or BINDING SITE III. Table 2 illustrates the complementarity of the nucleotide sequences of GAC1 BINDING SITE, designated SEQ ID:13036, to the nucleotide sequence of VGAM890 RNA, herein designated VGAM RNA, also designated SEQ ID:3601.

A function of VGAM890 is therefore inhibition of GAC1 (Accession NM_006338). Accordingly, utilities of VGAM890 include diagnosis, prevention and treatment of diseases and clinical conditions associated with GAC1. Leucine Zipper, Putative Tumor Suppressor 1 (LZTS1, Accession NM_021020) is another VGAM890 host target gene. LZTS1 BINDING SITE is HOST TARGET binding site found in the 3' untranslated region of mRNA encoded by LZTS1, corresponding to a HOST TARGET binding site such as BINDING SITE I, BINDING SITE II or BINDING SITE III. Table 2 illustrates the complementarity of the nucleotide sequences of LZTS1 BINDING SITE, designated SEQ ID:22004, to the nucleotide sequence of VGAM890 RNA, herein designated VGAM RNA, also designated SEQ ID:3601.

Another function of VGAM890 is therefore inhibition of Leucine Zipper, Putative Tumor Suppressor 1 (LZTS1, Accession NM_021020), a gene which Zygin 1; may have a role in axonal outgrowth; has similarity to C. elegans UNC-76. Accordingly, utilities of VGAM890 include diagnosis, prevention and treatment of diseases and clinical conditions associated with LZTS1. The function of LZTS1 has been established by previous studies. Ishii et al. (1999) positionally cloned and characterized the FEZ1/LZTS1 (leucine zipper, putative tumor suppressor-1) gene at 8p22, a region that is lost in many tumors, including prostate, breast, head and neck, esophageal, and urinary bladder carcinomas. The predicted FEZ1 protein contained a leucine-zipper region with similarity to the DNA-binding domain of the cAMP-responsive activating transcription factor-5 (OMIM Ref. No. 606398). Northern blot analysis revealed that FEZ2 is expressed almost ubiquitously in normal tissues, although expression is most abundant in testes. FEZ1 expression was undetectable in more than 60% of epithelial tumors, but FEZ1 mutations were found in primary esophageal cancers and in a prostate cancer cell line. Transcript analysis from several FEZ1-expressing tumors revealed truncated mRNAs, including a frameshift. Alteration and inactivation of the FEZ1 gene may play a role in various human tumors. Ishii et al. (2001) showed that introduction of FEZ1/LZTS1 into FEZ1/LZTS1-negative cancer cells resulted in suppression of tumorigenicity and reduced cell growth with accumulation of cells at late S-G2/M stage of the cell cycle. Their data showed that FEZ1/LZTS1 inhibits cancer cell growth through regulation of mitosis, and that its alterations result in abnormal cell growth. Ishii et al. (1999) analyzed the nucleotide sequence of the FEZ1 gene open reading frame in 194 cancers, including 72 primary esophageal cancers. They found a point mutation in 2 primary esophageal cancers and in a prostate cancer cell line.

Full details of the abovementioned studies are described in the following publications, the disclosure of which are hereby incorporated by reference:

Ishii, H.; Baffa, R.; Numata, S.-I.; Murakumo, Y.; Rattan, S.; Inoue, H.; Mori, M.; Fidanza, V.; Alder, H.; Croce, C. M.: The FEZ1 gene at chromosome 8p22 encodes a leucine-zipper protein, and its expression is altered in multiple human tumors. Proc. Nat. Acad. Sci. 96:3928-3933, 1999; and Ishii, H.; Vecchione, A.; Murakumo, Y.; Baldassarre, G.; Numata, S.; Trapasso, F.; Alder, H.; Baffa, R.; Croce, C. M.: FEZ1/LZTS1 gene at 8p22 suppresses cancer cell growth and regula.

Further studies establishing the function and utilities of LZTS1 are found in John Hopkins OMIM database record ID 606551, and in sited publications numbered 4650 listed in the bibliography section hereinbelow, which are also hereby incorporated by reference. Sulfite Oxidase (SUOX, Accession NM_000456) is another VGAM890 host target gene. SUOX BINDING SITE is HOST TARGET binding site found in the 5' untranslated region of mRNA encoded by SUOX, corresponding to a HOST TARGET binding site such as BINDING SITE I, BINDING SITE II or BINDING SITE III. Table 2 illustrates the complementarity of the nucleotide sequences of SUOX BINDING SITE, designated SEQ ID:6071, to the nucleotide sequence of VGAM890 RNA, herein designated VGAM RNA, also designated SEQ ID:3601.

Another function of VGAM890 is therefore inhibition of Sulfite Oxidase (SUOX, Accession NM_000456), a gene which sulfite oxidase deficiency. Accordingly, utilities of VGAM890 include diagnosis, prevention and treatment of diseases and clinical conditions associated with SUOX. The function of SUOX has been established by previous studies. Garrett et al. (1995) isolated a 2.4-kb cDNA clone of human sulfite oxidase from a human liver cDNA library. The deduced 488-amino acid protein has a molecular mass of approximately 52 kD and shows 88% homology to the rat protein and 67% homology to the chicken protein. Comparison of 3 sulfite oxidase sequences to several plant and fungal nitrate reductase sequences revealed a single conserved cysteine with highly conserved flanking sequences. Garrett et al. (1995) postulated that the conserved cysteine is a ligand of molybdenum in sulfite oxidase and nitrate reductase. Kisker et al. (1997) determined the crystal structure of chicken liver sulfite oxidase, which is homologous to the human protein, at 1.9-angstrom resolution. They found that each monomer of the dimeric enzyme consists of 3 domains. At the active site, the Mo is penta-coordinated by 3 sulfur ligands, 1 oxo group, and 1 water/hydroxo. A sulfate molecule adjacent to the Mo identifies the substrate binding pocket.

Full details of the abovementioned studies are described in the following publications, the disclosure of which are hereby incorporated by reference:

Garrett, R. M.; Bellissimo, D. B.; Rajagopalan, K. V.: Molecular cloning of human liver sulfite oxidase. Biochim. Biophys. Acta 1262:147-149, 1995; and Kisker, C.; Schindelin, H.; Pacheco, A.; Wehbi, W. A.; Garrett, R. M.; Rajagopalan, K. V.; Enemark, J. H.; Rees, D. C.: Molecular basis of sulfite oxidase deficiency from the structur.

Further studies establishing the function and utilities of SUOX are found in John Hopkins OMIM database record ID 606887, and in sited publications numbered 5393, 870 and 8706 listed in the bibliography section hereinbelow, which are also hereby incorporated by reference. FLJ20297 (Accession NM_017751) is another VGAM890 host target gene. FLJ20297 BINDING SITE1 and FLJ20297 BINDING SITE2 are HOST TARGET binding sites found in untranslated regions of mRNA encoded by FLJ20297, corresponding to HOST TARGET binding sites such as BINDING SITE I, BINDING SITE II or BINDING SITE III. Table 2 illustrates the complementarity of the nucleotide sequences of FLJ20297 BINDING SITE1 and FLJ20297 BINDING SITE2, designated SEQ ID:19357 and SEQ ID:19646 respectively, to the nucleotide sequence of VGAM890 RNA, herein designated VGAM RNA, also designated SEQ ID:3601.

Another function of VGAM890 is therefore inhibition of FLJ20297 (Accession NM_017751). Accordingly, utilities of VGAM890 include diagnosis, prevention and treatment of diseases and clinical conditions associated with FLJ20297. KIAA1867 (Accession XM_170675) is another VGAM890 host target gene. KIAA1867 BINDING SITE is HOST TARGET binding site found in the 3' untranslated region of mRNA encoded by KIAA1867, corresponding to a HOST TARGET binding site such as BINDING SITE I, BINDING SITE II or BINDING SITE III. Table 2 illustrates the complementarity of the nucleotide sequences of KIAA1867 BINDING SITE, designated SEQ ID:45453, to the nucleotide sequence of VGAM890 RNA, herein designated VGAM RNA, also designated SEQ ID:3601.

Another function of VGAM890 is therefore inhibition of KIAA1867 (Accession XM_170675). Accordingly, utilities of VGAM890 include diagnosis, prevention and treatment of diseases and clinical conditions associated with KIAA1867. KIAA1940 (Accession XM_086981) is another VGAM890 host target gene. KIAA1940 BINDING SITE is HOST TARGET binding site found in the 5' untranslated region of mRNA encoded by KIAA1940, corresponding to a HOST TARGET binding site such as BINDING SITE I, BINDING SITE II or BINDING SITE III. Table 2 illustrates the complementarity of the nucleotide sequences of KIAA1940 BINDING SITE, designated SEQ ID:39009, to the nucleotide sequence of VGAM890 RNA, herein designated VGAM RNA, also designated SEQ ID:3601.

Another function of VGAM890 is therefore inhibition of KIAA1940 (Accession XM_086981). Accordingly, utilities of VGAM890 include diagnosis, prevention and treatment of diseases and clinical conditions associated with KIAA1940. Peptidylprolyl Isomerase (cyclophilin)-like 2 (PPIL2, Accession NM_014337) is another VGAM890 host target gene. PPIL2 BINDING SITE is HOST TARGET binding site found in the 3' untranslated region of mRNA encoded by PPIL2, corresponding to a HOST TARGET binding site such as BINDING SITE I, BINDING SITE II or BINDING SITE III. Table 2 illustrates the complementarity of the nucleotide sequences of PPIL2 BINDING SITE, designated SEQ ID:15649, to the nucleotide sequence of VGAM890 RNA, herein designated VGAM RNA, also designated SEQ ID:3601.

Another function of VGAM890 is therefore inhibition of Peptidylprolyl Isomerase (cyclophilin)-like 2 (PPIL2, Accession NM_014337). Accordingly, utilities of VGAM890 include diagnosis, prevention and treatment of diseases and clinical conditions associated with PPIL2. PR Domain Containing 10 (PRDM10, Accession NM_020228) is another VGAM890 host target gene. PRDM10 BINDING SITE is HOST TARGET binding site found in the 3' untranslated region of mRNA encoded by PRDM10, corresponding to a HOST TARGET binding site such as BINDING SITE I, BINDING SITE II or BINDING SITE III. Table 2 illustrates the complementarity of the nucleotide sequences of PRDM10 BINDING SITE, designated SEQ ID:21496, to the nucleotide sequence of VGAM890 RNA, herein designated VGAM RNA, also designated SEQ ID:3601.

Another function of VGAM890 is therefore inhibition of PR Domain Containing 10 (PRDM10, Accession NM_020228). Accordingly, utilities of VGAM890 include diagnosis, prevention and treatment of diseases and clinical conditions associated with PRDM10. TOPBP1 (Accession NM_007027) is another VGAM890 host target gene. TOPBP1 BINDING SITE is HOST TARGET binding site found in the 5' untranslated region of mRNA encoded by TOPBP1, corresponding to a HOST TARGET binding site such as BINDING SITE I, BINDING SITE II or BINDING SITE III. Table 2 illustrates the complementarity of the nucleotide sequences of TOPBP1 BINDING SITE, designated SEQ ID:13886, to the nucleotide sequence of VGAM890 RNA, herein designated VGAM RNA, also designated SEQ ID:3601.

Another function of VGAM890 is therefore inhibition of TOPBP1 (Accession NM_007027). Accordingly, utilities of VGAM890 include diagnosis, prevention and treatment of diseases and clinical conditions associated with TOPBP1. LOC150776 (Accession XM_032542) is another VGAM890 host target gene. LOC150776 BINDING SITE is HOST TARGET binding site found in the 3' untranslated region of mRNA encoded by LOC150776, corresponding to a HOST TARGET binding site such as BINDING SITE I, BINDING SITE II or BINDING SITE III. Table 2 illustrates the complementarity of the nucleotide sequences of LOC150776 BINDING SITE, designated SEQ ID:31673, to the nucleotide sequence of VGAM890 RNA, herein designated VGAM RNA, also designated SEQ ID:3601.

Another function of VGAM890 is therefore inhibition of LOC150776 (Accession XM_032542). Accordingly, utilities of VGAM890 include diagnosis, prevention and treatment of diseases and clinical conditions associated with LOC150776. LOC152274 (Accession XM_087418) is another VGAM890 host target gene. LOC152274 BINDING SITE is HOST TARGET binding site found in the 3' untranslated region of mRNA encoded by LOC152274, corresponding to a HOST TARGET binding site such as BINDING SITE I, BINDING SITE II or BINDING SITE III. Table 2 illustrates the complementarity of the nucleotide sequences of LOC152274 BINDING SITE, designated SEQ ID:39230, to the nucleotide sequence of VGAM890 RNA, herein designated VGAM RNA, also designated SEQ ID:3601.

Another function of VGAM890 is therefore inhibition of LOC152274 (Accession XM_087418). Accordingly, utilities of VGAM890 include diagnosis, prevention and treatment of diseases and clinical conditions associated with LOC152274. LOC199837 (Accession XM_114034) is another VGAM890 host target gene. LOC199837 BINDING SITE is HOST TARGET binding site found in the 5' untranslated region of mRNA encoded by LOC199837, corresponding to a HOST TARGET binding site such as BINDING SITE I, BINDING SITE II or BINDING SITE III. Table 2 illustrates the complementarity of the nucleotide sequences of LOC199837 BINDING SITE, designated SEQ ID:42626, to the nucleotide sequence of VGAM890 RNA, herein designated VGAM RNA, also designated SEQ ID:3601.

Another function of VGAM890 is therefore inhibition of LOC199837 (Accession XM_114034). Accordingly, utilities of VGAM890 include diagnosis, prevention and treatment of diseases and clinical conditions associated with LOC199837. LOC255104 (Accession XM_170911) is another VGAM890 host target gene. LOC255104 BINDING SITE is HOST TARGET binding site found in the 3' untranslated region of mRNA encoded by LOC255104, corresponding to a HOST TARGET binding site such as BINDING SITE I, BINDING SITE II or BINDING SITE III. Table 2 illustrates the complementarity of the nucleotide sequences of LOC255104 BINDING SITE, designated SEQ ID:45682, to the nucleotide sequence of VGAM890 RNA, herein designated VGAM RNA, also designated SEQ ID:3601.

Another function of VGAM890 is therefore inhibition of LOC255104 (Accession XM_170911). Accordingly, utilities of VGAM890 include diagnosis, prevention and treatment of diseases and clinical conditions associated with LOC255104. FIG. 1 further provides a conceptual description of a novel bioinformatically detected viral gene of the present invention, referred to here as Viral Genomic Address Messenger 891 (VGAM891) viral gene, which modulates expression of respective host target genes thereof, the function and utility of which host target genes is known in the art.

VGAM891 is a novel bioinformatically detected regulatory, non protein coding, viral micro RNA (miRNA) gene. The method by which VGAM891 was detected is described hereinabove with reference to FIGS. 1-8.

VGAM891 gene, herein designated VGAM GENE, is a viral gene contained in the genome of Human Herpesvirus 4. VGAM891 host target gene, herein designated VGAM HOST TARGET GENE, is a human gene contained in the human genome.

VGAM891 gene encodes a VGAM891 precursor RNA, herein designated VGAM PRECURSOR RNA. Similar to other miRNA genes, and unlike most ordinary genes, VGAM891 precursor RNA does not encode a protein. A nucleotide sequence identical or highly similar to the nucleotide sequence of VGAM891 precursor RNA is designated SEQ ID:877, and is provided hereinbelow with reference to the sequence listing part. Nucleotide sequence SEQ ID:877 is located at position 7900 relative to the genome of Human Herpesvirus 4.

VGAM891 precursor RNA folds onto itself, forming VGAM891 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM891 folded precursor RNA into VGAM891 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 91%) nucleotide sequence of VGAM891 RNA is designated SEQ ID:3602, and is provided hereinbelow with reference to the sequence listing part.

VGAM891 host target gene, herein designated VGAM HOST TARGET GENE, encodes a corresponding messenger RNA, VGAM891 host target RNA, herein designated VGAM HOST TARGET RNA. VGAM891 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM891 RNA, herein designated VGAM RNA, binds complementarily to one or more host target binding sites located in untranslated regions of VGAM891 host target RNA, herein designated VGAM HOST TARGET RNA. This complementary binding is due to the fact that the nucleotide sequence of VGAM891 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM891 RNA, herein designated VGAM RNA, may have a different number of host target binding sites in untranslated regions of a VGAM891 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM891 RNA, herein designated VGAM RNA, to host target binding sites on VGAM891 host target RNA, herein designated VGAM HOST TARGET RNA, such as BINDING SITE I, BINDING SITE II and BINDING SITE III, inhibits translation of VGAM891 host target RNA into VGAM891 host target protein, herein designated VGAM HOST TARGET PROTEIN. VGAM host target protein is therefore outlined by a broken line.

It is appreciated that VGAM891 host target gene, herein designated VGAM HOST TARGET GENE, in fact represents a plurality of VGAM891 host target genes. The mRNA of each one of this plurality of VGAM891 host target genes comprises one or more host target binding sites, each having a nucleotide sequence which is at least partly complementary to VGAM891 RNA, herein designated VGAM RNA, and which when bound by VGAM891 RNA causes inhibition of translation of respective one or more VGAM891 host target proteins.

It is further appreciated by one skilled in the art that the mode of translational inhibition illustrated by FIG. 1 with specific reference to translational inhibition exerted by VGAM891 gene, herein designated VGAM GENE, on one or more VGAM891 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM891 is inhibition of expression of host target genes, as part of a novel viral mechanism of attacking a host. Accordingly, utilities of VGAM891 include diagnosis, prevention and treatment of viral infection by Human Herpesvirus 4. Specific functions, and accordingly utilities, of VGAM891 correlate with, and may be deduced from, the identity of the host target genes which VGAM891 binds and inhibits, and the function of these host target genes, as elaborated hereinbelow.

Nucleotide sequences of the VGAM891 precursor RNA, herein designated VGAM PRECURSOR RNA, and of the 'diced' VGAM891 RNA, herein designated VGAM RNA, and a schematic representation of the secondary folding of VGAM891 folded precursor RNA, herein designated VGAM FOLDED PRECURSOR RNA, of VGAM891 are further described hereinbelow with reference to Table 1.

Nucleotide sequences of host target binding sites, such as BINDING SITE-I, BINDING SITE-II and BINDING SITE-III of FIG. 1, found on VGAM891 host target RNA, and schematic representation of the complementarity of each of these host target binding sites to VGAM891 RNA, herein designated VGAM RNA, are described hereinbelow with reference to Table 2.

As mentioned hereinabove with reference to FIG. 1, a function of VGAM891 gene, herein designated VGAM is inhibition of expression of VGAM891 target genes. It is appreciated that specific functions, and accordingly utilities, of VGAM891 correlate with, and may be deduced from, the identity of the target genes which VGAM891 binds and inhibits, and the function of these target genes, as elaborated hereinbelow.

Tumor Necrosis Factor (ligand) Superfamily, Member 4 (tax-transcriptionally activated glycoprotein 1, 34 kDa) (TNFSF4, Accession NM_003326) is a VGAM891 host target gene. TNFSF4 BINDING SITE is HOST TARGET binding site found in the 3' untranslated region of mRNA encoded by TNFSF4, corresponding to a HOST TARGET binding site such as BINDING SITE I, BINDING SITE II or BINDING SITE III. Table 2 illustrates the complementarity of the nucleotide sequences of TNFSF4 BINDING SITE, designated SEQ ID:9331, to the nucleotide sequence of VGAM891 RNA, herein designated VGAM RNA, also designated SEQ ID:3602.

A function of VGAM891 is therefore inhibition of Tumor Necrosis Factor (ligand) Superfamily, Member 4 (tax-transcriptionally activated glycoprotein 1, 34 kDa) (TNFSF4, Accession NM_003326), a gene which co-stimulates t cell proliferation and cytokine production. Accordingly, utilities of VGAM891 include diagnosis, prevention and treatment of diseases and clinical conditions associated with TNFSF4. The function of TNFSF4 and its association with various diseases and clinical conditions, has been established by previous studies, as described hereinabove with reference to VGAM463. FLJ20038 (Accession NM_017634) is another VGAM891 host target gene. FLJ20038 BINDING SITE is HOST TARGET binding site found in the 3' untranslated region of mRNA encoded by FLJ20038, corresponding to a HOST TARGET binding site such as BINDING SITE I, BINDING SITE II or BINDING SITE III. Table 2 illustrates the complementarity of the nucleotide sequences of FLJ20038 BINDING SITE, designated SEQ ID:19141, to the nucleotide sequence of VGAM891 RNA, herein designated VGAM RNA, also designated SEQ ID:3602.

Another function of VGAM891 is therefore inhibition of FLJ20038 (Accession NM_017634). Accordingly, utilities of VGAM891 include diagnosis, prevention and treatment of diseases and clinical conditions associated with FLJ20038. KIAA1805 (Accession XM_086976) is another VGAM891 host target gene. KIAA1805 BINDING SITE is HOST TARGET binding site found in the 3' untranslated region of mRNA encoded by KIAA1805, corresponding to a HOST TARGET binding site such as BINDING SITE I, BINDING SITE II or BINDING SITE III. Table 2 illustrates the complementarity of the nucleotide sequences of KIAA1805 BINDING SITE, designated SEQ ID:39000, to the nucleotide sequence of VGAM891 RNA, herein designated VGAM RNA, also designated SEQ ID:3602.

Another function of VGAM891 is therefore inhibition of KIAA1805 (Accession XM_086976). Accordingly, utilities of VGAM891 include diagnosis, prevention and treatment of diseases and clinical conditions associated with KIAA1805. MSTP032 (Accession NM_025226) is another VGAM891 host target gene. MSTP032 BINDING SITE is HOST TARGET binding site found in the 3' untranslated region of mRNA encoded by MSTP032, corresponding to a HOST TARGET binding site such as BINDING SITE I, BINDING SITE II or BINDING SITE III. Table 2 illustrates the complementarity of the nucleotide sequences of MSTP032 BINDING SITE, designated SEQ ID:24908, to the nucleotide sequence of VGAM891 RNA, herein designated VGAM RNA, also designated SEQ ID:3602.

Another function of VGAM891 is therefore inhibition of MSTP032 (Accession NM_025226). Accordingly, utilities of VGAM891 include diagnosis, prevention and treatment of diseases and clinical conditions associated with MSTP032. NCK Adaptor Protein 1 (NCK1, Accession NM_006153) is another VGAM891 host target gene. NCK1 BINDING SITE is HOST TARGET binding site found in the 3' untranslated region of mRNA encoded by NCK1, corresponding to a HOST TARGET binding site such as BINDING SITE I, BINDING SITE II or BINDING SITE III. Table 2 illustrates the complementarity of the nucleotide sequences of NCK1 BINDING SITE, designated SEQ ID:12810, to the nucleotide sequence of VGAM891 RNA, herein designated VGAM RNA, also designated SEQ ID:3602.

Another function of VGAM891 is therefore inhibition of NCK Adaptor Protein 1 (NCK1, Accession NM_006153). Accordingly, utilities of VGAM891 include diagnosis, prevention and treatment of diseases and clinical conditions associated with NCK1. LOC120114 (Accession XM_061871) is another VGAM891 host target gene. LOC120114 BINDING SITE is HOST TARGET binding site found in the 3' untranslated region of mRNA encoded by LOC120114, corresponding to a HOST TARGET binding site such as BINDING SITE I, BINDING SITE II or BINDING SITE III. Table 2 illustrates the complementarity of the nucleotide sequences of LOC120114 BINDING SITE, designated SEQ ID:37214, to the nucleotide sequence of VGAM891 RNA, herein designated VGAM RNA, also designated SEQ ID:3602.

Another function of VGAM891 is therefore inhibition of LOC120114 (Accession XM_061871). Accordingly, utilities of VGAM891 include diagnosis, prevention and treatment of diseases and clinical conditions associated with LOC120114. LOC146669 (Accession XM_085534) is another VGAM891 host target gene. LOC146669 BINDING SITE is HOST TARGET binding site found in the 5' untranslated region of mRNA encoded by LOC146669, corresponding to a HOST TARGET binding site such as BINDING SITE I, BINDING SITE II or BINDING SITE III. Table 2 illustrates the complementarity of the nucleotide sequences of LOC146669 BINDING SITE, designated SEQ ID:38223, to the nucleotide sequence of VGAM891 RNA, herein designated VGAM RNA, also designated SEQ ID:3602.

Another function of VGAM891 is therefore inhibition of LOC146669 (Accession XM_085534). Accordingly, utilities of VGAM891 include diagnosis, prevention and treatment of diseases and clinical conditions associated with LOC146669.

FIG. 1 further provides a conceptual description of a novel bioinformatically detected viral gene of the present invention, referred to here as Viral Genomic Address Messenger 892 (VGAM892) viral gene, which modulates expression of respective host target genes thereof, the function and utility of which host target genes is known in the art.

VGAM892 is a novel bioinformatically detected regulatory, non protein coding, viral micro RNA (miRNA) gene. The method by which VGAM892 was detected is described hereinabove with reference to FIGS. 1-8.

VGAM892 gene, herein designated VGAM GENE, is a viral gene contained in the genome of Periplaneta Fuliginosa Densovirus. VGAM892 host target gene, herein designated VGAM HOST TARGET GENE, is a human gene contained in the human genome.

VGAM892 gene encodes a VGAM892 precursor RNA, herein designated VGAM PRECURSOR RNA. Similar to other miRNA genes, and unlike most ordinary genes, VGAM892 precursor RNA does not encode a protein. A nucleotide sequence identical or highly similar to the nucleotide sequence of VGAM892 precursor RNA is designated SEQ ID:878, and is provided hereinbelow with reference to the sequence listing part. Nucleotide sequence SEQ ID:878 is located at position 4066 relative to the genome of Periplaneta Fuliginosa Densovirus.

VGAM892 precursor RNA folds onto itself, forming VGAM892 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM892 folded precursor RNA into VGAM892 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM892 RNA is designated SEQ ID:3603, and is provided hereinbelow with reference to the sequence listing part.

VGAM892 host target gene, herein designated VGAM HOST TARGET GENE, encodes a corresponding messenger RNA, VGAM892 host target RNA, herein designated VGAM HOST TARGET RNA. VGAM892 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM892 RNA, herein designated VGAM RNA, binds complementarily to one or more host target binding sites located in untranslated regions of VGAM892 host target RNA, herein designated VGAM HOST TARGET RNA. This complementary binding is due to the fact that the nucleotide sequence of VGAM892 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM892 RNA, herein designated VGAM RNA, may have a different number of host target binding sites in untranslated regions of a VGAM892 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM892 RNA, herein designated VGAM RNA, to host target binding sites on VGAM892 host target RNA, herein designated VGAM HOST TARGET RNA, such as BINDING SITE I, BINDING SITE II and BINDING SITE III, inhibits translation of VGAM892 host target RNA into VGAM892 host target protein, herein designated VGAM HOST TARGET PROTEIN. VGAM host target protein is therefore outlined by a broken line.

It is appreciated that VGAM892 host target gene, herein designated VGAM HOST TARGET GENE, in fact represents a plurality of VGAM892 host target genes. The mRNA of each one of this plurality of VGAM892 host target genes comprises one or more host target binding sites, each having a nucleotide sequence which is at least partly complementary to VGAM892 RNA, herein designated VGAM RNA, and which when bound by VGAM892 RNA causes inhibition of translation of respective one or more VGAM892 host target proteins.

It is further appreciated by one skilled in the art that the mode of translational inhibition illustrated by FIG. 1 with specific reference to translational inhibition exerted by VGAM892 gene, herein designated VGAM GENE, on one or more VGAM892 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM892 is inhibition of expression of host target genes, as part of a novel viral mechanism of attacking a host. Accordingly, utilities of VGAM892 include diagnosis, prevention and treatment of viral infection by Periplaneta Fuliginosa Densovirus. Specific functions, and accordingly utilities, of VGAM892 correlate with, and may be deduced from, the identity of the host target genes which VGAM892 binds and inhibits, and the function of these host target genes, as elaborated hereinbelow.

Nucleotide sequences of the VGAM892 precursor RNA, herein designated VGAM PRECURSOR RNA, and of the 'diced' VGAM892 RNA, herein designated VGAM RNA, and a schematic representation of the secondary folding of VGAM892 folded precursor RNA, herein designated VGAM FOLDED PRECURSOR RNA, of VGAM892 are further described hereinbelow with reference to Table 1.

Nucleotide sequences of host target binding sites, such as BINDING SITE-I, BINDING SITE-II and BINDING SITE-III of FIG. 1, found on VGAM892 host target RNA, and schematic representation of the complementarity of each of these host target binding sites to VGAM892 RNA, herein designated VGAM RNA, are described hereinbelow with reference to Table 2.

As mentioned hereinabove with reference to FIG. 1, a function of VGAM892 gene, herein designated VGAM is inhibition of expression of VGAM892 target genes. It is appreciated that specific functions, and accordingly utilities, of VGAM892 correlate with, and may be deduced from, the identity of the target genes which VGAM892 binds and inhibits, and the function of these target genes, as elaborated hereinbelow.

Tumor Necrosis Factor Receptor Superfamily, Member 10b (TNFRSF10B, Accession NM_003842) is a VGAM892 host target gene. TNFRSF10B BINDING SITE is HOST TARGET binding site found in the 3' untranslated region of mRNA encoded by TNFRSF10B, corresponding to a HOST TARGET binding site such as BINDING SITE I, BINDING SITE II or BINDING SITE III. Table 2 illustrates the complementarity of the nucleotide sequences of TNFRSF10B BINDING SITE, designated SEQ ID:9939, to the nucleotide sequence of VGAM892 RNA, herein designated VGAM RNA, also designated SEQ ID:3603.

A function of VGAM892 is therefore inhibition of Tumor Necrosis Factor Receptor Superfamily, Member 10b (TNFRSF10B, Accession NM_003842), a gene which forms complex that induces apoptosis. Accordingly, utilities of VGAM892 include diagnosis, prevention and treatment of diseases and clinical conditions associated with TNFRSF10B. The function of TNFRSF10B and its association with various diseases and clinical conditions, has been established by previous studies, as described hereinabove with reference to VGAM400. LOC146880 (Accession XM_085627) is another VGAM892 host target gene.

LOC146880 BINDING SITE is HOST TARGET binding site found in the 5' untranslated region of mRNA encoded by LOC146880, corresponding to a HOST TARGET binding site such as BINDING SITE I, BINDING SITE II or BINDING SITE III. Table 2 illustrates the complementarity of the nucleotide sequences of LOC146880 BINDING SITE, designated SEQ ID:38258, to the nucleotide sequence of VGAM892 RNA, herein designated VGAM RNA, also designated SEQ ID:3603.

Another function of VGAM892 is therefore inhibition of LOC146880 (Accession XM_085627). Accordingly, utilities of VGAM892 include diagnosis, prevention and treatment of diseases and clinical conditions associated with LOC146880. FIG. 1 further provides a conceptual description of a novel bioinformatically detected viral gene of the present invention, referred to here as Viral Genomic Address Messenger 893 (VGAM893) viral gene, which modulates expression of respective host target genes thereof, the function and utility of which host target genes is known in the art.

VGAM893 is a novel bioinformatically detected regulatory, non protein coding, viral micro RNA (miRNA) gene. The method by which VGAM893 was detected is described hereinabove with reference to FIGS. 1-8.

VGAM893 gene, herein designated VGAM GENE, is a viral gene contained in the genome of Periplaneta Fuliginosa Densovirus. VGAM893 host target gene, herein designated VGAM HOST TARGET GENE, is a human gene contained in the human genome.

VGAM893 gene encodes a VGAM893 precursor RNA, herein designated VGAM PRECURSOR RNA. Similar to other miRNA genes, and unlike most ordinary genes, VGAM893 precursor RNA does not encode a protein. A nucleotide sequence identical or highly similar to the nucleotide sequence of VGAM893 precursor RNA is designated SEQ ID:879, and is provided hereinbelow with reference to the sequence listing part. Nucleotide sequence SEQ ID:879 is located at position 2 relative to the genome of Periplaneta Fuliginosa Densovirus.

VGAM893 precursor RNA folds onto itself, forming VGAM893 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM893 folded precursor RNA into VGAM893 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM893 RNA is designated SEQ ID:3604, and is provided hereinbelow with reference to the sequence listing part.

VGAM893 host target gene, herein designated VGAM HOST TARGET GENE, encodes a corresponding messenger RNA, VGAM893 host target RNA, herein designated VGAM HOST TARGET RNA. VGAM893 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM893 RNA, herein designated VGAM RNA, binds complementarily to one or more host target binding sites located in untranslated regions of VGAM893 host target RNA, herein designated VGAM HOST TARGET RNA. This complementary binding is due to the fact that the nucleotide sequence of VGAM893 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM893 RNA, herein designated VGAM RNA, may have a different number of host target binding sites in untranslated regions of a VGAM893 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM893 RNA, herein designated VGAM RNA, to host target binding sites on VGAM893 host target RNA, herein designated VGAM HOST TARGET RNA, such as BINDING SITE I, BINDING SITE II and BINDING SITE III, inhibits translation of VGAM893 host target RNA into VGAM893 host target protein, herein designated VGAM HOST TARGET PROTEIN. VGAM host target protein is therefore outlined by a broken line.

It is appreciated that VGAM893 host target gene, herein designated VGAM HOST TARGET GENE, in fact represents a plurality of VGAM893 host target genes. The mRNA of each one of this plurality of VGAM893 host target genes comprises one or more host target binding sites, each having a nucleotide sequence which is at least partly complementary to VGAM893 RNA, herein designated VGAM RNA, and which when bound by VGAM893 RNA causes inhibition of translation of respective one or more VGAM893 host target proteins.

It is further appreciated by one skilled in the art that the mode of translational inhibition illustrated by FIG. 1 with specific reference to translational inhibition exerted by VGAM893 gene, herein designated VGAM GENE, on one or more VGAM893 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM893 is inhibition of expression of host target genes, as part of a novel viral mechanism of attacking a host. Accordingly, utilities of VGAM893 include diagnosis, prevention and treatment of viral infection by Periplaneta Fuliginosa Densovirus. Specific functions, and accordingly utilities, of VGAM893 correlate with, and may be deduced from, the identity of the host target genes which VGAM893 binds and inhibits, and the function of these host target genes, as elaborated hereinbelow.

Nucleotide sequences of the VGAM893 precursor RNA, herein designated VGAM PRECURSOR RNA, and of the 'diced' VGAM893 RNA, herein designated VGAM RNA, and a schematic representation of the secondary folding of VGAM893 folded precursor RNA, herein designated VGAM FOLDED PRECURSOR RNA, of VGAM893 are further described hereinbelow with reference to Table 1.

Nucleotide sequences of host target binding sites, such as BINDING SITE-I, BINDING SITE-II and BINDING SITE-III of FIG. 1, found on VGAM893 host target RNA, and schematic representation of the complementarity of each of these host target binding sites to VGAM893 RNA, herein designated VGAM RNA, are described hereinbelow with reference to Table 2.

As mentioned hereinabove with reference to FIG. 1, a function of VGAM893 gene, herein designated VGAM is inhibition of expression of VGAM893 target genes. It is appreciated that specific functions, and accordingly utilities, of VGAM893 correlate with, and may be deduced from, the identity of the target genes which VGAM893 binds and inhibits, and the function of these target genes, as elaborated hereinbelow.

Cadherin, EGF LAG Seven-pass G-type Receptor 3 (flamingo homolog, Drosophila) (CELSR3, Accession NM_001407) is a VGAM893 host target gene. CELSR3 BINDING SITE is HOST TARGET binding site found in the 5' untranslated region of mRNA encoded by CELSR3, corresponding to a HOST TARGET binding site such as BINDING SITE I, BINDING SITE II or BINDING SITE III. Table 2 illustrates the complementarity of the nucleotide sequences of CELSR3 BINDING SITE, designated SEQ ID:7104, to the nucleotide sequence of VGAM893 RNA, herein designated VGAM RNA, also designated SEQ ID:3604.

A function of VGAM893 is therefore inhibition of Cadherin, EGF LAG Seven-pass G-type Receptor 3 (flamingo homolog, Drosophila) (CELSR3, Accession NM_001407), a gene which interacts in a homophilic manner in connecting cells. Accordingly, utilities of VGAM893 include diagnosis, prevention and treatment of diseases and clinical conditions associated with CELSR3. The function of CELSR3 has been established by previous studies. The domain that characterizes epidermal growth factor (EGF; 131530) consists of approximately 50 amino acids with 3 disulfide bonds. EGF-like domains are believed to play a critical role in a number of extracellular events, including cell adhesion and receptor-ligand interactions. Proteins with EGF-like domains often consist of more than 1,000 amino acids, have multiple copies of the EGF-like domain, and contain additional domains known to be involved in specific protein-protein interactions. To identify proteins containing EGF-like domains, Nakayama et al. (1998) searched a database of long cDNA sequences randomly selected from a human brain cDNA library for those that encode an EGF-like motif. They identified several partial cDNAs encoding novel proteins with EGF-like domains, such as EGFL1, which they named MEGF2. Nakayama et al. (1998) isolated a rat cDNA containing the complete Megf2 coding sequence. The predicted Megf2 protein has a signal sequence, 8 cadherin motifs (see OMIM Ref. No. 603006), 6 EGF-like domains, 2 laminin G domains (see OMIM Ref. No. 601033), 7 transmembrane domains, and a cytoplasmic proline-rich sequence. Megf2 appears to have a domain structure identical to that of human MEGF3 (OMIM Ref. No. 604265), whose partial cDNA was also isolated by the authors. Northern blot analysis detected Megf2 expression in several regions of rat brain.

Full details of the abovementioned studies are described in the following publications, the disclosure of which are hereby incorporated by reference:

Nakayama, M.; Nakajima, D.; Nagase, T.; Nomura, N.; Seki, N.; Ohara, O.: Identification of high-molecular-weight proteins with multiple EGF-like motifs by motif-trap screening. Genomics 51:27-34, 1998; and Wu, Q.; Maniatis, T.: Large exons encoding multiple ectodomains are a characteristic feature of protocadherin genes. Proc. Nat. Acad. Sci. 97:3124-3129, 2000.

Further studies establishing the function and utilities of CELSR3 are found in John Hopkins OMIM database record ID 604264, and in sited publications numbered 7437-7438 listed in the bibliography section hereinbelow, which are also hereby incorporated by reference. DXS1283E (Accession XM_047871) is another VGAM893 host target gene. DXS1283E BINDING SITE is HOST TARGET binding site found in the 3' untranslated region of mRNA encoded by DXS1283E, corresponding to a HOST TARGET binding site such as BINDING SITE I, BINDING SITE II or BINDING SITE III. Table 2 illustrates the complementarity of the nucleotide sequences of DXS1283E BINDING SITE, designated SEQ ID:35069, to the nucleotide sequence of VGAM893 RNA, herein designated VGAM RNA, also designated SEQ ID:3604.

Another function of VGAM893 is therefore inhibition of DXS1283E (Accession XM_047871). Accordingly, utilities of VGAM893 include diagnosis, prevention and treatment of diseases and clinical conditions associated with DXS1283E. Potassium Voltage-gated Channel, Shaker-related Subfamily, Member 6 (KCNA6, Accession NM_002235) is another VGAM893 host target gene. KCNA6 BINDING SITE is HOST TARGET binding site found in the 5' untranslated region of mRNA encoded by KCNA6, corresponding to a HOST TARGET binding site such as BINDING SITE I, BINDING SITE II or BINDING SITE III. Table 2 illustrates the complementarity of the nucleotide sequences of KCNA6 BINDING SITE, designated SEQ ID:8018, to the nucleotide sequence of VGAM893 RNA, herein designated VGAM RNA, also designated SEQ ID:3604.

Another function of VGAM893 is therefore inhibition of Potassium Voltage-gated Channel, Shaker-related Subfamily, Member 6 (KCNA6, Accession NM_002235), a gene which mediates the voltage-dependent potassium ion permeability of excitable membranes. Accordingly, utilities of VGAM893 include diagnosis, prevention and treatment of diseases and clinical conditions associated with KCNA6. The function of KCNA6 has been established by previous studies. By screening a human fetal cDNA library with a rat RCK3 potassium channel cDNA, Grupe et al. (1990) isolated cDNAs encoding a protein that they designated HBK2 (human brain potassium channel-2). The authors also cloned cDNAs corresponding to the rat homolog, RCK2. The predicted 529-amino acid HBK2 protein shares 94% identity with RCK2. HBK2 and RCK2 have the characteristic structure of voltage-gated ionic channels, with 6 potential membrane-spanning segments. When expressed in Xenopus oocytes, the HBK2/RCK2 channels exhibited the functional characteristics of a delayed-rectifier channel that acts especially in the more positive membrane voltage range. The functional and pharmacologic properties of HBK2/RCK2 potassium channels were distinct from those of previously characterized channels. Grupe et al. (1990) determined that the HBK2 gene did not contain introns. Using interspecific backcrosses between Mus musculus and Mus spretus, Klocke et al. (1993) mapped the mouse gene encoding the Kv1.6 potassium voltage-gated channel, Kcna6, to chromosome 6 in a cluster with Kcna1, Kcna5 (OMIM Ref. No. 176267), and the homolog of human TPI1 (OMIM Ref. No. 190450). Since human TPI1 is located on band 12p13, Klocke et al. (1993) predicted that the human KCNA6 gene is located on 12p near other genes of the Shaker-related subfamily, KCNA1 and KCNA5. Albrecht et al. (1995) determined that a 300-kb cluster on chromosome 12p13 contains the human KCNA6, KCNA1, and KCNA5 genes arranged in tandem Full details of the abovementioned studies are described in the following publications, the disclosure of which are hereby incorporated by reference:

Albrecht, B.; Weber, K.; Pongs, O.: Characterization of a voltage-activated K-channel gene cluster on human chromosome 12p13. Receptors Channels 3:213-220, 1995; and Grupe, A.; Schroter, K. H.; Ruppersberg, J. P.; Stocker, M.; Drewes, T.; Beckh, S.; Pongs, O.: Cloning and expression of a human voltage-gated potassium channel: a novel member of the R.

Further studies establishing the function and utilities of KCNA6 are found in John Hopkins OMIM database record ID 176257, and in sited publications numbered 10288-10290 listed in the bibliography section hereinbelow, which are also hereby incorporated by reference. Spinocerebellar Ataxia 1 (olivopontocerebellar ataxia 1, autosomal dominant, ataxin 1) (SCA1, Accession NM_000332) is another VGAM893 host target gene. SCA1 BINDING SITE is HOST TARGET binding site found in the 5' untranslated region of mRNA encoded by SCA1, corresponding to a HOST TARGET binding site such as BINDING SITE I, BINDING SITE II or BINDING SITE III. Table 2 illustrates the complementarity of the nucleotide sequences of SCA1 BINDING SITE, designated SEQ ID:5881, to the nucleotide sequence of VGAM893 RNA, herein designated VGAM RNA, also designated SEQ ID:3604.

Another function of VGAM893 is therefore inhibition of Spinocerebellar Ataxia 1 (olivopontocerebellar ataxia 1, autosomal dominant, ataxin 1) (SCA1, Accession NM_000332). Accordingly, utilities of VGAM893 include diagnosis, prevention and treatment of diseases and clinical conditions associated with SCA1. Ganglioside Induced Differentiation Associated Protein 2 (GDAP2, Accession NM_017686) is another VGAM893 host target gene. GDAP2 BINDING SITE is HOST TARGET binding site found in the 3' untranslated region of mRNA encoded by GDAP2, corresponding to a HOST TARGET binding site such as BINDING SITE I, BINDING SITE II or BINDING SITE III. Table 2 illustrates the complementarity of the nucleotide sequences of GDAP2 BINDING SITE, designated SEQ ID:19240, to the nucleotide sequence of VGAM893 RNA, herein designated VGAM RNA, also designated SEQ ID:3604.

Another function of VGAM893 is therefore inhibition of Ganglioside Induced Differentiation Associated Protein 2 (GDAP2, Accession NM_017686). Accordingly, utilities of VGAM893 include diagnosis, prevention and treatment of diseases and clinical conditions associated with GDAP2. KIAA1708 (Accession XM_040211) is another VGAM893 host target gene. KIAA1708 BINDING SITE is HOST TARGET binding site found in the 3" untranslated region of mRNA encoded by KIAA1708, corresponding to a HOST TARGET binding site such as BINDING SITE I, BINDING SITE II or BINDING SITE III. Table 2 illustrates the complementarity of the nucleotide sequences of KIAA1708 BINDING SITE, designated SEQ ID:33273, to the nucleotide sequence of VGAM893 RNA, herein designated VGAM RNA, also designated SEQ ID:3604.

Another function of VGAM893 is therefore inhibition of KIAA1708 (Accession XM_040211). Accordingly, utilities of VGAM893 include diagnosis, prevention and treatment of diseases and clinical conditions associated with KIAA1708. MRF2 (Accession XM_084482) is another VGAM893 host target gene. MRF2 BINDING SITE is HOST TARGET binding site found in the 3' untranslated region of mRNA encoded by MRF2, corresponding to a HOST TARGET binding site such as BINDING SITE I, BINDING SITE II or BINDING SITE III. Table 2 illustrates the complementarity of the nucleotide sequences of MRF2 BINDING SITE, designated SEQ ID:37602, to the nucleotide sequence of VGAM893 RNA, herein designated VGAM RNA, also designated SEQ ID:3604.

Another function of VGAM893 is therefore inhibition of MRF2 (Accession XM_084482). Accordingly, utilities of VGAM893 include diagnosis, prevention and treatment of diseases and clinical conditions associated with MRF2. PHD Finger Protein 5A (PHF5A, Accession NM_032758) is another VGAM893 host target gene. PHF5A BINDING SITE is HOST TARGET binding site found in the 3' untranslated region of mRNA encoded by PHF5A, corresponding to a HOST TARGET binding site such as BINDING SITE I, BINDING SITE II or BINDING SITE III. Table 2 illustrates the complementarity of the nucleotide sequences of PHF5A BINDING SITE, designated SEQ ID:26502, to the nucleotide sequence of VGAM893 RNA, herein designated VGAM RNA, also designated SEQ ID:3604.

Another function of VGAM893 is therefore inhibition of PHD Finger Protein 5A (PHF5A, Accession NM_032758). Accordingly, utilities of VGAM893 include diagnosis, prevention and treatment of diseases and clinical conditions associated with PHF5A. SERP1 (Accession NM_014445) is another VGAM893 host target gene. SERP1 BINDING SITE is HOST TARGET binding site found in the 3' untranslated region of mRNA encoded by SERP1, corresponding to a HOST TARGET binding site such as BINDING SITE I, BINDING SITE II or BINDING SITE III. Table 2 illustrates the complementarity of the nucleotide sequences of SERP1 BINDING SITE, designated SEQ ID:15796, to the nucleotide sequence of VGAM893 RNA, herein designated VGAM RNA, also designated SEQ ID:3604.

Another function of VGAM893 is therefore inhibition of SERP1 (Accession NM_014445). Accordingly, utilities of VGAM893 include diagnosis, prevention and treatment of diseases and clinical conditions associated with SERP1. LOC153196 (Accession XM_098323) is another VGAM893 host target gene. LOC153196 BINDING SITE is HOST TARGET binding site found in the 5' untranslated region of mRNA encoded by LOC153196, corresponding to a HOST TARGET binding site such as BINDING SITE I, BINDING SITE II or BINDING SITE III. Table 2 illustrates the complementarity of the nucleotide sequences of LOC153196 BINDING SITE, designated SEQ ID:41595, to the nucleotide sequence of VGAM893 RNA, herein designated VGAM RNA, also designated SEQ ID:3604.

Another function of VGAM893 is therefore inhibition of LOC153196 (Accession XM_098323). Accordingly, utilities of VGAM893 include diagnosis, prevention and treatment of diseases and clinical conditions associated with LOC153196. FIG. 1 further provides a conceptual description of a novel bioinformatically detected viral gene of the present invention, referred to here as Viral Genomic Address Messenger 894 (VGAM894) viral gene, which modulates expression of respective host target genes thereof, the function and utility of which host target genes is known in the art.

VGAM894 is a novel bioinformatically detected regulatory, non protein coding, viral micro RNA (miRNA) gene. The method by which VGAM894 was detected is described hereinabove with reference to FIGS. 1-8.

VGAM894 gene, herein designated VGAM GENE, is a viral gene contained in the genome of Periplaneta Fuliginosa Densovirus. VGAM894 host target gene, herein designated VGAM HOST TARGET GENE, is a human gene contained in the human genome.

VGAM894 gene encodes a VGAM894 precursor RNA, herein designated VGAM PRECURSOR RNA. Similar to other miRNA genes, and unlike most ordinary genes, VGAM894 precursor RNA does not encode a protein. A nucleotide sequence identical or highly similar to the nucleotide sequence of VGAM894 precursor RNA is designated SEQ ID:880, and is provided hereinbelow with reference to the sequence listing part. Nucleotide sequence SEQ ID:880 is located at position 2107 relative to the genome of Periplaneta Fuliginosa Densovirus.

VGAM894 precursor RNA folds onto itself, forming VGAM894 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM894 folded precursor RNA into VGAM894 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM894 RNA is designated SEQ ID:3605, and is provided hereinbelow with reference to the sequence listing part.

VGAM894 host target gene, herein designated VGAM HOST TARGET GENE, encodes a corresponding messenger RNA, VGAM894 host target RNA, herein designated VGAM HOST TARGET RNA. VGAM894 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM894 RNA, herein designated VGAM RNA, binds complementarily to one or more host target binding sites located in untranslated regions of VGAM894 host target RNA, herein designated VGAM HOST TARGET RNA. This complementary binding is due to the fact that the nucleotide sequence of VGAM894 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM894 RNA, herein designated VGAM RNA, may have a different number of host target binding sites in untranslated regions of a VGAM894 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM894 RNA, herein designated VGAM RNA, to host target binding sites on VGAM894 host target RNA, herein designated VGAM HOST TARGET RNA, such as BINDING SITE I, BINDING SITE II and BINDING SITE III, inhibits translation of VGAM894 host target RNA into VGAM894 host target protein, herein designated VGAM HOST TARGET PROTEIN. VGAM host target protein is therefore outlined by a broken line.

It is appreciated that VGAM894 host target gene, herein designated VGAM HOST TARGET GENE, in fact represents a plurality of VGAM894 host target genes. The mRNA of each one of this plurality of VGAM894 host target genes comprises one or more host target binding sites, each having a nucleotide sequence which is at least partly complementary to VGAM894 RNA, herein designated VGAM RNA, and which when bound by VGAM894 RNA causes inhibition of translation of respective one or more VGAM894 host target proteins.

It is further appreciated by one skilled in the art that the mode of translational inhibition illustrated by FIG. 1 with specific reference to translational inhibition exerted by VGAM894 gene, herein designated VGAM GENE, on one or more VGAM894 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM894 is inhibition of expression of host target genes, as part of a novel viral mechanism of attacking a host. Accordingly, utilities of VGAM894 include diagnosis, prevention and treatment of viral infection by Periplaneta Fuliginosa Densovirus. Specific functions, and accordingly utilities, of VGAM894 correlate with, and may be deduced from, the identity of the host target genes which VGAM894 binds and inhibits, and the function of these host target genes, as elaborated hereinbelow.

Nucleotide sequences of the VGAM894 precursor RNA, herein designated VGAM PRECURSOR RNA, and of the 'diced' VGAM894 RNA, herein designated VGAM RNA, and a schematic representation of the secondary folding of VGAM894 folded precursor RNA, herein designated VGAM FOLDED PRECURSOR RNA, of VGAM894 are further described hereinbelow with reference to Table 1.

Nucleotide sequences of host target binding sites, such as BINDING SITE-I, BINDING SITE-II and BINDING SITE-III of FIG. 1, found on VGAM894 host target RNA, and schematic representation of the complementarity of each of these host target binding sites to VGAM894 RNA, herein designated VGAM RNA, are described hereinbelow with reference to Table 2.

As mentioned hereinabove with reference to FIG. 1, a function of VGAM894 gene, herein designated VGAM is inhibition of expression of VGAM894 target genes. It is appreciated that specific functions, and accordingly utilities, of VGAM894 correlate with, and may be deduced from, the identity of the target genes which VGAM894 binds and inhibits, and the function of these target genes, as elaborated hereinbelow.

A Disintegrin-like and Metalloprotease (reprolysin type) with Thrombospondin Type 1 Motif, 3 (ADAMTS3, Accession NM_014243) is a VGAM894 host target gene. ADAMTS3 BINDING SITE is HOST TARGET binding site found in the 3' untranslated region of mRNA encoded by ADAMTS3, corresponding to a HOST TARGET binding site such as BINDING SITE I, BINDING SITE II or BINDING SITE III. Table 2 illustrates the complementarity of the nucleotide sequences of ADAMTS3 BINDING SITE, designated SEQ ID:15510, to the nucleotide sequence of VGAM894 RNA, herein designated VGAM RNA, also designated SEQ ID:3605.

A function of VGAM894 is therefore inhibition of A Disintegrin-like and Metalloprotease (reprolysin type) with Thrombospondin Type 1 Motif, 3 (ADAMTS3, Accession NM_014243), a gene which cleaves the propeptides of type ii collagen prior to fibril assembly. Accordingly, utilities of VGAM894 include diagnosis, prevention and treatment of diseases and clinical conditions associated with ADAMTS3. The function of ADAMTS3 and its association with various diseases and clinical conditions, has been established by previous studies, as described hereinabove with reference to VGAM211. Chromosome 8 Open Reading Frame 1 (C8orf1, Accession NM_004337) is another VGAM894 host target gene. C8orf1 BINDING SITE is HOST TARGET binding site found in the 3' untranslated region of mRNA encoded by C8orf1, corresponding to a HOST TARGET binding site such as BINDING SITE I, BINDING SITE II or BINDING SITE III. Table 2 illustrates the complementarity of the nucleotide sequences of C8orf1 BINDING SITE, designated SEQ ID:10533, to the nucleotide sequence of VGAM894 RNA, herein designated VGAM RNA, also designated SEQ ID:3605.

Another function of VGAM894 is therefore inhibition of Chromosome 8 Open Reading Frame 1 (C8orf1, Accession NM_004337). Accordingly, utilities of VGAM894 include diagnosis, prevention and treatment of diseases and clinical conditions associated with C8orf1. Cyclin-dependent Kinase Inhibitor 2A (melanoma, p16, inhibits CDK4) (CDKN2A, Accession NM_058197) is another VGAM894 host target gene. CDKN2A BINDING SITE is HOST TARGET binding site found in the 3' untranslated region of mRNA encoded by CDKN2A, corresponding to a HOST TARGET binding site such as BINDING SITE I, BINDING SITE II or BINDING SITE III. Table 2 illustrates the complementarity of the nucleotide sequences of CDKN2A BINDING SITE, designated SEQ ID:27760, to the nucleotide sequence of VGAM894 RNA, herein designated VGAM RNA, also designated SEQ ID:3605.

Another function of VGAM894 is therefore inhibition of Cyclin-dependent Kinase Inhibitor 2A (melanoma, p16, inhibits CDK4) (CDKN2A, Accession NM_058197). Accordingly, utilities of VGAM894 include diagnosis, prevention and treatment of diseases and clinical conditions associated with CDKN2A. Crystallin, Zeta (quinone reductase) (CRYZ, Accession NM_001889) is another VGAM894 host target gene. CRYZ BINDING SITE is HOST TARGET binding site found in the 3' untranslated region of mRNA encoded by CRYZ, corresponding to a HOST TARGET binding site such as BINDING SITE I, BINDING SITE II or BINDING SITE III. Table 2 illustrates the complementarity of the nucleotide sequences of CRYZ BINDING SITE, designated SEQ ID:7617, to the nucleotide sequence of VGAM894 RNA, herein designated VGAM RNA, also designated SEQ ID:3605.

Another function of VGAM894 is therefore inhibition of Crystallin, Zeta (quinone reductase) (CRYZ, Accession NM_001889), a gene which may act in the detoxification of xenobiotics. Accordingly, utilities of VGAM894 include diagnosis, prevention and treatment of diseases and clinical conditions associated with CRYZ. The function of CRYZ and its association with various diseases and clinical conditions, has been established by previous studies, as described hereinabove with reference to VGAM323. Cytochrome P450, Subfamily I (dioxin-inducible), Polypeptide 1 (glaucoma 3, primary infantile) (CYP1B1, Accession NM_000104) is another VGAM894 host target gene. CYP1B1 BINDING SITE is HOST TARGET binding site found in the 3' untranslated region of mRNA encoded by CYP1B1, corresponding to a HOST TARGET binding site such as BINDING SITE I, BINDING SITE II or BINDING SITE III. Table 2 illustrates the complementarity of the nucleotide sequences of CYP1B1 BINDING SITE, designated SEQ ID:5568, to the nucleotide sequence of VGAM894 RNA, herein designated VGAM RNA, also designated SEQ ID:3605.

Another function of VGAM894 is therefore inhibition of Cytochrome P450, Subfamily I (dioxin-inducible), Polypeptide 1 (glaucoma 3, primary infantile) (CYP1B1, Accession NM_000104), a gene which participates in the metabolism of a molecule that is a participant in eye development. Accordingly, utilities of VGAM894 include diagnosis, prevention and treatment of diseases and clinical conditions associated with CYP1B1. The function of CYP1B1 has been established by previous studies. In the study of candidate genes identified in the critical region of 2p21 where a major gene for primary congenital glaucoma, GLC3A (OMIM Ref. No. 231300), had been mapped by linkage studies, Stoilov et al. (1997) found the CYP1B1 gene, which had previously been identified by Sutter et al. (1994). From a determination of the intron/exon junctions of this gene, Stoilov et al. (1997) concluded that the gene contains 3 exons and 2 introns. The entire coding sequence of the genes is contained in exons 2 and 3. This genomic structure agreed with that reported by Tang et al. (1996). Screening for the presence of coding sequence changes in the CYP1B1 gene, Stoilov et al. (1997) identified 3 different truncating mutations: a 13-bp deletion found in 1 consanguineous and 1 nonconsanguineous family (601771.0001); a single cytosine insertion observed in another 2 consanguineous families (601771.0002); and a large deletion found in an additional consanguineous family. In addition, a G-to-C transversion at nucleotide 1640 of the CYP1B1 coding sequence was found that caused a val432-to-leu amino acid substitution. This change created an EcoR57 restriction site, thus providing a rapid screening method. Heterozygosity for the val432-to-leu change was found in 51.4% of 70 normal individuals. This amino acid change was not in that part of CYP1B1 that represented conserved sequences, and both valine and leucine are neutral and hydrophobic. Their very similar aliphatic side groups differ by a single -CH2 group. Therefore, this change appeared to represent a common amino acid polymorphism that is not related to the primary congenital glaucoma phenotype. Identification of CYP1B1 as the gene affected in primary congenital glaucoma was said by Stoilov et al. (1997) to be the first example in which mutations in a member of the cytochrome P450 superfamily results in a primary developmental defect. The finding was not unexpected, however, as a link between members of this superfamily and the processes of growth and differentiation had been postulated previously. They speculated that CYP1B1 participates in the metabolism of an as-yet-unknown biologically active molecule that is a participant in eye development. Stoilov et al. (1997) demonstrated that a stable protein product is produced in the affected subjects of these families, and that the 3 mutations they described would be expected to result in a product lacking between 189 and 254 amino acids from the C terminus. This segment harbors the invariant cysteine of all known cytochrome P450 amino sequences; in CYP1B1 it is cys470. Schwartzman et al. (1987) implicated a cytochrome-P450-dependent arachidonate metabolite that inhibits Na+, K+-ATPase in the cornea in regulating corneal transparency and aqueous humor secretion. This finding is consistent with the clouding of the cornea and increased intraocular pressure, the 2 major diagnostic criteria for primary congenital glaucoma.

Full details of the abovementioned studies are described in the following publications, the disclosure of which are hereby incorporated by reference:

Bejjani, B. A.; Lewis, R. A.; Tomey, K. F.; Anderson, K. L.; Dueker, D. K.; Jabak, M.; Astle, W. F.; Otterud, B.; Leppert, M.; Lupski, J. R.: Mutations in CYP1B1, the gene for cytochrome P4501B1, are the predominant cause of primary congenital glaucoma in Saudi Arabia. Am. J. Hum. Genet. 62:325-333, 1998; and Stoilov, I.; Akarsu, A. N.; Alozie, I.; Child, A.; Barsoum-Homsy, M.; Turacli, M. E.; Or, M.; Lewis, R. A.; Ozdemir, N.; Brice, G.; Aktan, S. G.; Chevrette, L.; Coca-Prados, M.; Sarfara.

Further studies establishing the function and utilities of CYP1B1 are found in John Hopkins OMIM database record ID 601771, and in sited publications numbered 8866-8867, 911 and 9123-9129 listed in the bibliography section hereinbelow, which are also hereby incorporated by reference. Forkhead Box P2 (FOXP2, Accession NM_014491) is another VGAM894 host target gene. FOXP2 BINDING SITE is HOST TARGET binding site found in the 5' untranslated region of mRNA encoded by FOXP2, corresponding to a HOST TARGET binding site such as BINDING SITE I, BINDING SITE II or BINDING SITE III. Table 2 illustrates the complementarity of the nucleotide sequences of FOXP2 BINDING SITE, designated SEQ ID:15835, to the nucleotide sequence of VGAM894 RNA, herein designated VGAM RNA, also designated SEQ ID:3605.

Another function of VGAM894 is therefore inhibition of Forkhead Box P2 (FOXP2, Accession NM_014491), a gene which may have a role in regulating neurodevelopment or neuroplasticity. Accordingly, utilities of VGAM894 include diagnosis, prevention and treatment of diseases and clinical conditions associated with FOXP2. The function of FOXP2 has been established by previous studies. In a search for the gene responsible for the severe speech and language disorder (OMIM Ref. No. 602081) in the KE pedigree, Lai et al. (2001) isolated the FOXP2 gene. FOXP2 has an open reading frame (ORF) of 2.1 kb. The carboxy-terminal portion of the predicted protein sequence encoded by the FOXP2 gene contains a segment of 84 amino acids (encoded by exons 12-14) that shows high similarity to the characteristic DNA-binding domains of the forkhead-winged helix (FOX) family of transcription factors. By Northern blot analysis of several human adult tissues, Lai et al. (2001) demonstrated broad expression of a roughly 6.5-kb FOXP2 transcript. This transcript was also observed in fetal tissues, with strong expression in brain. A murine homolog of FOXP2 is expressed in adult and fetal mouse brain. The FOXP2 gene is mutated in a severe monogenic form of speech and language impairment, segregating within a single large pedigree, and is also disrupted by a translocation in an isolated case. Several studies of autistic disorder have demonstrated linkage to a similar region of 7q (AUTS1; 209850), leading to the proposal that a single genetic factor on 7q31 contributes to both autism and language disorders. Newbury et al. (2002) used association and mutation screening analyses to evaluate directly the impact of the FOXP2 gene with regard to both complex language impairments and autism. They concluded that the coding region variants in FOXP2 do not underlie the AUTS1 linkage and that the gene is unlikely to play a role in autism or more common forms of language impairment.

Full details of the abovementioned studies are described in the following publications, the disclosure of which are hereby incorporated by reference:

Lai, C. S. L.; Fisher, S. E.; Hurst, J. A.; Levy, E. R.; Hodgson, S.; Fox, M.; Jeremiah, S.; Povey, S.; Jamison, D. C.; Green, E. D.; Vargha-Khadem, F.; Monaco, A. P.: The SPCH1 region on human 7q31: genomic characterization of the critical interval and localization of translocations associated with speech and language disorder. Am. J. Hum. Genet. 67:357-368, 2000; and Newbury, D. F.; Bonora, E.; Lamb, J. A.; Fisher, S. E.; Lai, C. S. L.; Baird, G.; Jannoun, L.; Slonims, V.; Stott, C. M.; Merricks, M. J.; Bolton, P. F.; Bailey, A. J.; Monaco, A. P.

Further studies establishing the function and utilities of FOXP2 are found in John Hopkins OMIM database record ID 605317, and in sited publications numbered 4483-4484, 5967-596 and 8561 listed in the bibliography section hereinbelow, which are also hereby incorporated by reference. Interleukin 18 Receptor 1 (IL18R1, Accession NM_003855) is another VGAM894 host target gene. IL18R1 BINDING SITE is HOST TARGET binding site found in the 3' untranslated region of mRNA encoded by IL18R1, corresponding to a HOST TARGET binding site such as BINDING SITE I, BINDING SITE II or BINDING SITE III. Table 2 illustrates the complementarity of the nucleotide sequences of IL18R1 BINDING SITE, designated SEQ ID:9952, to the nucleotide sequence of VGAM894 RNA, herein designated VGAM RNA, also designated SEQ ID:3605.

Another function of VGAM894 is therefore inhibition of Interleukin 18 Receptor 1 (IL18R1, Accession NM_003855), a gene which is required for dorsal-ventral embryonic polarity and promotes heterophilic cellular adhesion. Accordingly, utilities of VGAM894 include diagnosis, prevention and treatment of diseases and clinical conditions associated with IL18R1. The function of IL18R1 and its association with various diseases and clinical conditions, has been established by previous studies, as described hereinabove with reference to VGAM37. Meis1, Myeloid Ecotropic Viral Integration Site 1 Homolog (mouse) (MEIS1, Accession NM_002398) is another VGAM894 host target gene. MEIS1 BINDING SITE is HOST TARGET binding site found in the 3' untranslated region of mRNA encoded by MEIS1, corresponding to a HOST TARGET binding site such as BINDING SITE I, BINDING SITE II or BINDING SITE III. Table 2 illustrates the complementarity of the nucleotide sequences of MEIS1 BINDING SITE, designated SEQ ID:8219, to the nucleotide sequence of VGAM894 RNA, herein designated VGAM RNA, also designated SEQ ID:3605.

Another function of VGAM894 is therefore inhibition of Meis1, Myeloid Ecotropic Viral Integration Site 1 Homolog (mouse) (MEIS1, Accession NM_002398), a gene which may regulate gene expression and control cell differentiation. Accordingly, utilities of VGAM894 include diagnosis, prevention and treatment of diseases and clinical conditions associated with MEIS1. The function of MEIS1 has been established by previous studies. Homeo box genes, of which the most well-characterized category is represented by the HOX genes, play a crucial role in normal development. In addition, several homeoproteins are involved in neoplasia: PPX1 (OMIM Ref. No. 176310), HOXA10 (OMIM Ref. No. 142957), and HOXB8 (OMIM Ref. No. 142963) play important roles in leukemia. The Meis1 locus was isolated by Moskow et al. (1995) as a common site of viral integration involved in myeloid leukemia in BXH-2 mice. MEIS1 encodes a novel homeo box protein belonging to the TALE (three amino acid loop extension) family of homeodomain-containing proteins. The homeodomain of MEIS1 is the only conserved motif within the entire 390-amino acid protein. Steelman et al. (1997) described additional members of a related gene family, which they called Meis1-related genes (MRGs; OMIM Ref. No. 601740). Mercader et al. (1999) described the role of homeo box genes Meis1, Meis2, and Pbx1 in the development of mouse, chicken, and Drosophila limbs. Mercader et al. (1999) found that Meis1 and Meis2 expression is restricted to the proximal domain, coincident with the previously reported domain in which Pbx1 is localized to the nucleus. Meis1 regulates Pbx1 activity by promoting nuclear import of the Pbx1 protein. Mercader et al. (1999) also demonstrated that ectopic expression of Meis1 in chicken disrupts distal limb development and induces distal-to-proximal transformations. Mercader et al. (1999) concluded that the restriction of Meis1 to proximal regions of the vertebrate limb is essential to specify cell fates and differentiation patterns along the proximodistal axis of the limb. Thorsteinsdottir et al. (2001) identified MEIS as a common collaborator with 2 divergent HOX genes, HOXA9 (OMIM Ref. No. 142956) and HOXB3 (OMIM Ref. No. 142966), in leukemic transformation. Using overexpression studies in bone marrow cells, they also demonstrated that each HOX gene studied predisposes to leukemias that are phenotypically distinct and that MEIS1 acts primarily to accelerate the occurrence of these leukemias without altering their phenotype. By fluorescence in situ hybridization, Moskow et al. (1995) mapped the human MEIS1 gene to 2p14-p13 near 3 translocation breakpoints involved in human leukemia. They mapped the murine homolog to mouse 11.

Full details of the abovementioned studies are described in the following publications, the disclosure of which are hereby incorporated by reference:

Moskow, J. J.; Bullrich, F.; Huebner, K.; Daar, I. O.; Buchberg, A. M.: Meis1, a PBX1-related homeobox gene involved in myeloid leukemia in BXH-2 mice. Molec. Cell. Biol. 15:5434-5443, 1995; and Steelman, S.; Moskow, J. J.; Muzynski, K.; North, C.; Druck, T.; Montgomery, J. C.; Huebner, K.; Daar, I. O.; Buchberg, A. M.: Identification of a conserved family of Meis1-related home.

Further studies establishing the function and utilities of MEIS1 are found in John Hopkins OMIM database record ID 601739, and in sited publications numbered 10366-9328 listed in the bibliography section hereinbelow, which are also hereby incorporated by reference. N-acetylgalactosaminidase, Alpha- (NAGA, Accession NM_000262) is another VGAM894 host target gene. NAGA BINDING SITE is HOST TARGET binding site found in the 5' untranslated region of mRNA encoded by NAGA, corresponding to a HOST TARGET binding site such as BINDING SITE I, BINDING SITE II or BINDING SITE III. Table 2 illustrates the complementarity of the nucleotide sequences of NAGA BINDING SITE, designated SEQ ID:5803, to the nucleotide sequence of VGAM894 RNA, herein designated VGAM RNA, also designated SEQ ID:3605.

Another function of VGAM894 is therefore inhibition of N-acetylgalactosaminidase, Alpha- (NAGA, Accession NM_000262). Accordingly, utilities of VGAM894 include diagnosis, prevention and treatment of diseases and clinical conditions associated with NAGA. Phosphoribosylaminoimidazole Carboxylase, Phosphoribosylaminoimidazole Succinocarboxamide Synthetase (PAICS, Accession NM_006452) is another VGAM894 host target gene. PAICS BINDING SITE is HOST TARGET binding site found in the 3' untranslated region of mRNA encoded by PAICS, corresponding to a HOST TARGET binding site such as BINDING SITE I, BINDING SITE II or BINDING SITE III. Table 2 illustrates the complementarity of the nucleotide sequences of PAICS BINDING SITE, designated SEQ ID:13166, to the nucleotide sequence of VGAM894 RNA, herein designated VGAM RNA, also designated SEQ ID:3605.

Another function of VGAM894 is therefore inhibition of Phosphoribosylaminoimidazole Carboxylase, Phosphoribosylaminoimidazole Succinocarboxamide Synthetase (PAICS, Accession NM_006452), a gene which is required for purine biosynthesis. Accordingly, utilities of VGAM894 include diagnosis, prevention and treatment of diseases and clinical conditions associated with PAICS. The function of PAICS has been established by previous studies. Schild et al. (1990) used the functional complementation of mutations in Saccharomyces cerevisiae to isolate a human cDNA clone complementing the ade-2 (phosphoribosylaminoimidazole carboxylase; EC 4.1.1.21) yeast mutation. The same cDNA also complemented ade-1 (phosphoribosylaminoimidazole succinocarboxamide synthetase; EC 6.3.2.6); thus, this is a bifunctional enzyme. Although these enzymes are encoded by genes on different chromosomes in yeast, their enzymatic activities copurify from chicken livers, and the complementation of both activities by this single cDNA clone suggests that the enzyme is bifunctional in human S. Barton et al. (1991) mapped the gene to chromosome 4 by fusing Chinese hamster ovary (CHO) cells carrying the Ade (-)D mutation with human lymphocytes using inactivated Sendai virus. Two of the isolated subclones contained only the long arm of human chromosome 4 translocated onto a CHO chromosome, thus providing evidence that the gene in question is on 4q. By subjecting 2 of the subclones containing chromosome 4 to BrdU visible light segregation, Barton et al. (1991) demonstrated that all of the isolated purine auxotrophic cell lines showed a loss of 4q. It is noteworthy that this bifunctional enzyme maps to the same general region as the monofunctional enzyme PPAT (OMIM Ref. No. 172450), which catalyzes the first step in the biosynthetic pathway for the production of AMP from phosphoribosylpyrophosphate (PRPP) and maps to 4pter-q21. AIR carboxylase (EC 4.1.1.21)/SAICAR synthetase (EC 6.3.2.6) is a bifunctional enzyme, the activities of which are required for steps 6 and 7, respectively, of purine biosynthesis. Brayton et al. (1994) demonstrated that in the human, as in the chicken, the GPAT gene (OMIM Ref. No. 172450), which catalyzes the first and presumably rate-limiting reaction in purine biosynthesis, is closely linked and divergently transcribed. The intergenic region is approximately 625 bp in the human and 229 bp in the chicken. Although there are several examples for bidirectional transcription in higher eukaryotes, GPAT-AIRC was the first example for bidirectional transcription of tightly coupled genes that are not structurally related but are involved in the same pathway. This may be a eukaryotic equivalent of a prokaryotic operon.

Full details of the abovementioned studies are described in the following publications, the disclosure of which are hereby incorporated by reference:

Schild, D.; Brake, A. J.; Kiefer, M. C.; Young, D.; Barr, P. J.: Cloning of three human multifunctional de novo purine biosynthetic genes by functional complementation of yeast mutations. Proc. Nat. Acad. Sci. 87:2916-2920, 1990; and Brayton, K. A.; Chen, Z.; Zhou, G.; Nagy, P. L.; Gavalas, A.; Trent, J. M.; Deaven, L. L.; Dixon, J. E.; Zalkin, H.: Two genes for de novo purine nucleotide synthesis on human chromosom.

Further studies establishing the function and utilities of PAICS are found in John Hopkins OMIM database record ID 172439, and in sited publications numbered 10941-1094 and 4809 listed in the bibliography section hereinbelow, which are also hereby incorporated by reference. Protein Phosphatase 2, Regulatory Subunit B (B56), Delta Isoform (PPP2R5D, Accession NM_006245) is another VGAM894 host target gene. PPP2R5D BINDING SITE is HOST TARGET binding site found in the 3' untranslated region of mRNA encoded by PPP2R5D, corresponding to a HOST TARGET binding site such as BINDING SITE I, BINDING SITE II or BINDING SITE III. Table 2 illustrates the complementarity of the nucleotide sequences of PPP2R5D BINDING SITE, designated SEQ ID:12919, to the nucleotide sequence of VGAM894 RNA, herein designated VGAM RNA, also designated SEQ ID:3605.

Another function of VGAM894 is therefore inhibition of Protein Phosphatase 2, Regulatory Subunit B (B56), Delta Isoform (PPP2R5D, Accession NM_006245), a gene which is a regulatory subunit of protein phosphatase 2A. Accordingly, utilities of VGAM894 include diagnosis, prevention and treatment of diseases and clinical conditions associated with PPP2R5D. The function of PPP2R5D and its association with various diseases and clinical conditions, has been established by previous studies, as described hereinabove with reference to VGAM96. SH2 Domain Protein 1A, Duncan's Disease (lymphoproliferative syndrome) (SH2D1A, Accession NM_002351) is another VGAM894 host target gene. SH2D1A BINDING SITE is HOST TARGET binding site found in the 3' untranslated region of mRNA encoded by SH2D1A, corresponding to a HOST TARGET binding site such as BINDING SITE I, BINDING SITE II or BINDING SITE III. Table 2 illustrates the complementarity of the nucleotide sequences of SH2D1A BINDING SITE, designated SEQ ID:8156, to the nucleotide sequence of VGAM894 RNA, herein designated VGAM RNA, also designated SEQ ID:3605.

Another function of VGAM894 is therefore inhibition of SH2 Domain Protein 1A, Duncan's Disease (lymphoproliferative syndrome) (SH2D1A, Accession NM_002351), a gene which is involved in t cell signaling. inhibits slam self-association. Accordingly, utilities of VGAM894 include diagnosis, prevention and treatment of diseases and clinical conditions associated with SH2D1A. The function of SH2D1A has been established by previous studies. Sumegi et al. (2000) reported that analysis of 35 families from the XLP Registry revealed 28 different mutations in 34 families:3 large genomic deletions, 10 small intragenic deletions, 3 splice site, 3 nonsense, and 9 missense mutations. No mutations were found in 25 males, so-called sporadic XLP (males with an XLP phenotype after EBV infection but no family history of XLP), or in 9 patients with chronic active EBV syndrome. The authors found that although EBV infection often resulted in fulminant infectious mononucleosis, it was not necessary for the expression of other manifestations of XLP and correlated poorly with outcome. They interpreted the results as suggesting that unidentified factors, either environmental or genetic (e.g., modifier genes), contribute to the pathogenesis of XLP. Animal model experiments lend further support to the function of SH2D1A. Wu et al. (2001) generated Sap-deficient mice, which were fertile and had no defects in lymphocyte surface markers or overall morphology. Sap-deficient mice had increased lymphocytic choriomeningitis virus (LCMV)-specific splenic and hepatic T cells and increased gamma-interferon (IFNG; 147570) production compared with their wildtype littermates. All Sap-deficient mice died as a result of hepatotropic LCMV infection, while only 30% of wildtype mice died. In contrast to the increased Ifng production, interleukin-4 (IL4; 147780) production was markedly lower in Sap-deficient mice. Mice with a BALB/c background are normally highly susceptible to infection with the Leishmania major parasite due to poor Ifng production. However, Sap-deficient mice with a BALB/c background produced little Il4 and high levels of Ifng and had lower parasite burdens than wildtype BALB/c mice. This suggested that in the absence of SAP, IL4 gene activation is defective. Lower Il4 expression in Sap-deficient mice correlated with greatly reduced IgE production and reduced basal IgE expression. Wu et al. (2001) proposed that the Sap-deficient mouse model would be a useful tool for dissecting the complex XLP phenotypes.

It is appreciated that the abovementioned animal model for SH2D1A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sumegi, J.; Huang, D.; Lanyi, A.; Davis, J. D.; Seemayer, T. A.; Maeda, A.; Klein, G.; Seri, M.; Wakiguchi, H.; Purtilo, D. T.; Gross, T. G.: Correlation of mutations of the SH2D1A gene and Epstein-Barr virus infection with clinical phenotype and outcome in X-linked lymphoproliferative disease. Blood 96:3118-3125, 2000; and Wu, C.; Nguyen, K. B.; Pien, G. C.; Wang, N.; Gullo, C.; Duncan, H.; Sosa, M. R.; Edwards, M. J.; Borrow, P.; Satoskar, A. R.; Sharpe, A. H.; Biron, C. A.; Terhorst, C. : SAP controls T c.

Further studies establishing the function and utilities of SH2D1A are found in John Hopkins OMIM database record ID 308240, and in sited publications numbered 8594-8597, 8599, 8600-8612, 4213, 8056-8071, 9435-8079, 8770-123 and 8771-8781 listed in the bibliography section hereinbelow, which are also hereby incorporated by reference. Solute Carrier Family 21 (organic anion transporter), Member 9 (SLC21A9, Accession NM_007256) is another VGAM894 host target gene. SLC21A9 BINDING SITE is HOST TARGET binding site found in the 3' untranslated region of mRNA encoded by SLC21A9, corresponding to a HOST TARGET binding site such as BINDING SITE I, BINDING SITE II or BINDING SITE III. Table 2 illustrates the complementarity of the nucleotide sequences of SLC21A9 BINDING SITE, designated SEQ ID:14127, to the nucleotide sequence of VGAM894 RNA, herein designated VGAM RNA, also designated SEQ ID:3605.

Another function of VGAM894 is therefore inhibition of Solute Carrier Family 21 (organic anion transporter), Member 9 (SLC21A9, Accession NM_007256), a gene which is Moderately similar to SLC21A2 prostaglandin transporter. Accordingly, utilities of VGAM894 include diagnosis, prevention and treatment of diseases and clinical conditions associated with SLC21A9. The function of SLC21A9 has been established by previous studies. By screening human brain cDNAs for the potential to encode proteins that are at least 50 kD, Nagase et al. (1998) isolated an SLC21A9 cDNA, which they called KIAA0880, that contains a complete coding sequence. The predicted 709-amino acid SLC21A9 protein contains 8 membrane-spanning regions. SLC21A9 shares 42.8% amino acid sequence identity with a rat prostaglandin transporter across 678 residues. RT-PCR followed by ELISA detected SLC21A9 expression in all human tissues examined, with the highest expression in liver, lower expression in lung, ovary, brain, heart, kidney, pancreas, spleen, and testis, and lowest expression in skeletal muscle Organic anion-transporting polypeptides (OATPs) are a family of multispecific carriers that mediate the sodium-independent transport of steroid hormone and conjugates, drugs, and numerous anionic endogenous substrates. St-Pierre et al. (2002) investigated whether members of the OATP gene family could mediate fetal-maternal transfer of anionic steroid conjugates in the human placenta. They isolated OATPB (SLC21A9) from a placenta cDNA library. An antiserum to OATPB detected an 85-kD protein in basal but not apical syncytiotrophoblast membranes. Immunohistochemistry of first-, second-, and third-trimester placenta showed staining in the cytotrophoblast membranes and at the basal surface of the syncytiotrophoblast. Trophoblasts that reacted with an antibody to Ki-67, a proliferation-associated antigen, expressed lower levels of OATPB. OATPB mRNA levels were measured in isolated trophoblasts under culture conditions that promoted syncytia formation. Real-time quantitative PCR estimated an 8-fold increase in OATPB expression on differentiation to syncytia. Pregnenolone sulfate partially inhibited OATPB-mediated transport of estrone-3-sulfate in an oocyte expression system. The authors concluded that these findings suggested a physiologic role for OATPB in the placental uptake of fetal-derived sulfated steroids Full details of the abovementioned studies are described in the following publications, the disclosure of which are hereby incorporated by reference:

Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human genes. XII. The complete sequences of 100 new cDNA clones from brain which code for large proteins in vitro. DNA Res. 5:355-364, 1998; and St-Pierre, M. V.; Hagenbuch, B.; Ugele, B.; Meier, P. J.; Stallmach, T.: Characterization of an organic anion-transporting polypeptide (OATP-B) in human placenta. J. Clin. Endocr. Metab.

Further studies establishing the function and utilities of SLC21A9 are found in John Hopkins OMIM database record ID 604988, and in sited publications numbered 493 and 7097 listed in the bibliography section hereinbelow, which are also hereby incorporated by reference. Transcriptional Adaptor 2 (ADA2 homolog, yeast)-like (TADA2L, Accession NM_001488) is another VGAM894 host target gene. TADA2L BINDING SITE1 and TADA2L BINDING SITE2 are HOST TARGET binding sites found in untranslated regions of mRNA encoded by TADA2L, corresponding to HOST TARGET binding sites such as BINDING SITE I, BINDING SITE II or BINDING SITE III. Table 2 illustrates the complementarity of the nucleotide sequences of TADA2L BINDING SITE1 and TADA2L BINDING SITE2, designated SEQ ID:7229 and SEQ ID:28520 respectively, to the nucleotide sequence of VGAM894 RNA, herein designated VGAM RNA, also designated SEQ ID:3605.

Another function of VGAM894 is therefore inhibition of Transcriptional Adaptor 2 (ADA2 homolog, yeast)-like (TADA2L, Accession NM_001488), a gene which is one PCAF histone acetylase complex subunit, and a probable transcriptional adaptor protein. Accordingly, utilities of VGAM894 include diagnosis, prevention and treatment of diseases and clinical conditions associated with TADA2L. The function of TADA2L has been established by previous studies. The ability of DNA-bound transcriptional activator proteins to enhance the initiation rate of RNA polymerase II-mediated gene transcription hinges on their potential to interact functionally with the general transcription machinery bound at the basal promoter. Candau et al. (1996) identified expressed sequence tags of possible human homologs of the yeast transcriptional activator proteins ADA2 and GCN5. Full-length cDNAs, designated TADA2L and GCN5L2 (OMIM Ref. No. 602301), were isolated from testis. The predicted 443-amino acid TADA2L protein is 31% identical to the yeast ADA2 protein. TADA2L was shown to function experimentally as an adaptor in a human cell line. Carter et al. (1997) found that TADA2L is transcribed to varying degrees in all tissue types, but most abundantly in testis. By fluorescence in situ hybridization, they mapped the TADA2L gene to 17q12-q21, proximal to GCN5L2. Ogryzko et al. (1998) found that TADA2L is associated with the P/CAF (OMIM Ref. No. 602303) protein in the PCAF complex. Struhl and Moqtaderi (1998) reviewed the potential roles of the PCAF complex in transcription.

Full details of the abovementioned studies are described in the following publications, the disclosure of which are hereby incorporated by reference:

Carter, K. C.; Wang, L.; Shell, B. K.; Zamir, I.; Berger, S. L.; Moore, P. A.: The human transcriptional adaptor genes TADA2L and GCN5L2 colocalize to chromosome 17q12-q21 and display a similar tissue expression pattern. Genomics 40:497-500, 1997; and Ogryzko, V. V.; Kotani, T.; Zhang, X.; Schiltz, R. L.; Howard, T.; Yang, X.-J.; Howard, B. H.; Qin, J.; Nakatani, Y.: Histone-like TAFs within the PCAF histone acetylase complex. Cell.

Further studies establishing the function and utilities of TADA2L are found in John Hopkins OMIM database record ID 602276, and in sited publications numbered 2799-2802 listed in the bibliography section hereinbelow, which are also hereby incorporated by reference. TRIP15 (Accession NM_004236) is another VGAM894 host target gene. TRIP15 BINDING SITE is HOST TARGET binding site found in the 3' untranslated region of mRNA encoded by TRIP15, corresponding to a HOST TARGET binding site such as BINDING SITE I, BINDING SITE II or BINDING SITE III. Table 2 illustrates the complementarity of the nucleotide sequences of TRIP15 BINDING SITE, designated SEQ ID:10432, to the nucleotide sequence of VGAM894 RNA, herein designated VGAM RNA, also designated SEQ ID:3605.

Another function of VGAM894 is therefore inhibition of TRIP15 (Accession NM_004236), a gene which is a subunit of the COP9 signalosome complex. Accordingly, utilities of VGAM894 include diagnosis, prevention and treatment of diseases and clinical conditions associated with TRIP15. The function of TRIP15 and its association with various diseases and clinical conditions, has been established by previous studies, as described hereinabove with reference to VGAM452. Ubiquitin Specific Protease 9, Y Chromosome (fat facets-like Drosophila) (USP9Y, Accession XM_034147) is another VGAM894 host target gene. USP9Y BINDING SITE is HOST TARGET binding site found in the 5' untranslated region of mRNA encoded by USP9Y, corresponding to a HOST TARGET binding site such as BINDING SITE I, BINDING SITE II or BINDING SITE III. Table 2 illustrates the complementarity of the nucleotide sequences of USP9Y BINDING SITE, designated SEQ ID:32019, to the nucleotide sequence of VGAM894 RNA, herein designated VGAM RNA, also designated SEQ ID:3605.

Another function of VGAM894 is therefore inhibition of Ubiquitin Specific Protease 9, Y Chromosome (fat facets-like Drosophila) (USP9Y, Accession XM_034147), a gene which removes ubiquitin from ubiquitin-conjugated proteins and has a role in spermatogenesis. Accordingly, utilities of VGAM894 include diagnosis, prevention and treatment of diseases and clinical conditions associated with USP9Y. The function of USP9Y has been established by previous studies. Sun et al. (1999) were the first to trace spermatogenic failure to a point mutation in a Y-linked gene or to a deletion of a single Y-linked gene. They sequenced the AZFa (see OMIM Ref. No. 415000) region of the Y chromosome and identified 2 functional genes previously described: USP9Y and DBY (OMIM Ref. No. 400010). Screening of the 2 genes in 576 infertile and 96 fertile men revealed several sequence variants, most of which appeared to be heritable and of little functional consequence. They found 1 de novo mutation in USP9Y: a 4-bp deletion in the splice donor site, causing an exon to be skipped and protein truncation. This mutation was present in a man with nonobstructive azoospermia, but was absent in his fertile brother, suggesting that the USP9Y mutation caused spermatogenic failure. Sun et al. (1999) also identified a single gene deletion associated with spermatogenic failure, again involving USP9Y, by reanalyzing a published study. The coding regions of the DFFRY and DFFRX genes show 89% identity at the nucleotide level. In common with DFFRX, the potential amino acid sequence of DFFRY contains the conserved cys and his domains characteristic of ubiquitin C-terminal hydrolases. The human DFFRY mRNA is expressed in a wide range of adult and embryonic tissues, including testis, whereas the homologous mouse Dffry gene is expressed specifically in the testis. Brown et al. (1998) found that 3 azoospermic male patients had deletion of DFFRY from the Y chromosome. Two patients had a testicular phenotype that resembled Sertoli cell-only syndrome (see OMIM Ref. No. 305700), and the third had diminished spermatogenesis. In all 3 patients, the deletions extended from close to the 3-prime end into the gene, removing the entire coding sequence of DFFRY. Brown et al. (1998) showed that the mouse Dffry gene maps to the Sxr-b deletion interval on the shorter arm of the mouse Y chromosome and that its expression in mouse testis can first be detected between 7.5 and 10.5 days after birth when type A and B spermatogonia and preleptotene and leptotene spermatocytes are present.

Full details of the abovementioned studies are described in the following publications, the disclosure of which are hereby incorporated by reference:

Sun, C.; Skaletsky, H.; Birren, B.; Devon, K.; Tang, Z.; Silber, S.; Oates, R.; Page, D. C.: An azoospermic man with a de novo point mutation in the Y-chromosomal gene USP9Y. Nature Genet. 23:429-432, 1999; and Brown, G. M.; Furlong, R. A.; Sargent, C. A.; Erickson, R. P.; Longepied, G.; Mitchell, M.; Jones, M. H.; Hargreave, T. B.; Cooke, H. J.; Affara, N. A.: Characterisation of the coding.

Further studies establishing the function and utilities of USP9Y are found in John Hopkins OMIM database record ID 400005, and in sited publications numbered 8827-882 and 9087-8833 listed in the bibliography section hereinbelow, which are also hereby incorporated by reference. Zinc-fingers and Homeoboxes 1 (ZHX1, Accession NM_007222) is another VGAM894 host target gene. ZHX1 BINDING SITE is HOST TARGET binding site found in the 3' untranslated region of mRNA encoded by ZHX1, corresponding to a HOST TARGET binding site such as BINDING SITE I, BINDING SITE II or BINDING SITE III. Table 2 illustrates the complementarity of the nucleotide sequences of ZHX1 BINDING SITE, designated SEQ ID:14092, to the nucleotide sequence of VGAM894 RNA, herein designated VGAM RNA, also designated SEQ ID:3605.

Another function of VGAM894 is therefore inhibition of Zinc-fingers and Homeoboxes 1 (ZHX1, Accession NM_007222). Accordingly, utilities of VGAM894 include diagnosis, prevention and treatment of diseases and clinical conditions associated with ZHX1. Adaptor-related Protein Complex 3, Mu 2 Subunit (AP3M2, Accession NM_006803) is another VGAM894 host target gene. AP3M2 BINDING SITE is HOST TARGET binding site found in the 3' untranslated region of mRNA encoded by AP3M2, corresponding to a HOST TARGET binding site such as BINDING SITE I, BINDING SITE II or BINDING SITE III. Table 2 illustrates the complementarity of the nucleotide sequences of AP3M2 BINDING SITE, designated SEQ ID:13678, to the nucleotide sequence of VGAM894 RNA, herein designated VGAM RNA, also designated SEQ ID:3605.

Another function of VGAM894 is therefore inhibition of Adaptor-related Protein Complex 3, Mu 2 Subunit (AP3M2, Accession NM_006803). Accordingly, utilities of VGAM894 include diagnosis, prevention and treatment of diseases and clinical conditions associated with AP3M2. Chromosome 8 Open Reading Frame 17 (C8orf17, Accession NM_020237) is another VGAM894 host target gene. C8orf17 BINDING SITE is HOST TARGET binding site found in the 3' untranslated region of mRNA encoded by C8orf17, corresponding to a HOST TARGET binding site such as BINDING SITE I, BINDING SITE II or BINDING SITE III. Table 2 illustrates the complementarity of the nucleotide sequences of C8orf17 BINDING SITE, designated SEQ ID:21506, to the nucleotide sequence of VGAM894 RNA, herein designated VGAM RNA, also designated SEQ ID:3605.

Another function of VGAM894 is therefore inhibition of Chromosome 8 Open Reading Frame 17 (C8orf17, Accession NM_020237). Accordingly, utilities of VGAM894 include diagnosis, prevention and treatment of diseases and clinical conditions associated with C8orf17. DKFZP434J1813 (Accession XM_029798) is another VGAM894 host target gene. DKFZP434J1813 BINDING SITE is HOST TARGET binding site found in the 3' untranslated region of mRNA encoded by DKFZP434J1813, corresponding to a HOST TARGET binding site such as BINDING SITE I, BINDING SITE II or BINDING SITE III. Table 2 illustrates the complementarity of the nucleotide sequences of DKFZP434J1813 BINDING SITE, designated SEQ ID:30950, to the nucleotide sequence of VGAM894 RNA, herein designated VGAM RNA, also designated SEQ ID:3605.

Another function of VGAM894 is therefore inhibition of DKFZP434J1813 (Accession XM_029798). Accordingly, utilities of VGAM894 include diagnosis, prevention and treatment of diseases and clinical conditions associated with DKFZP434J1813. FLJ10520 (Accession NM_018124) is another VGAM894 host target gene. FLJ10520 BINDING SITE is HOST TARGET binding site found in the 3' untranslated region of mRNA encoded by FLJ10520, corresponding to a HOST TARGET binding site such as BINDING SITE I, BINDING SITE II or BINDING SITE III. Table 2 illustrates the complementarity of the nucleotide sequences of FLJ10520 BINDING SITE, designated SEQ ID:19908, to the nucleotide sequence of VGAM894 RNA, herein designated VGAM RNA, also designated SEQ ID:3605.

Another function of VGAM894 is therefore inhibition of FLJ10520 (Accession NM_018124). Accordingly, utilities of VGAM894 include diagnosis, prevention and treatment of diseases and clinical conditions associated with FLJ10520. FLJ13449 (Accession NM_024546) is another VGAM894 host target gene. FLJ13449 BINDING SITE is HOST TARGET binding site found in the 5' untranslated region of mRNA encoded by FLJ13449, corresponding to a HOST TARGET binding site such as BINDING SITE I, BINDING SITE II or BINDING SITE III. Table 2 illustrates the complementarity of the nucleotide sequences of FLJ13449 BINDING SITE, designated SEQ ID:23760, to the nucleotide sequence of VGAM894 RNA, herein designated VGAM RNA, also designated SEQ ID:3605.

Another function of VGAM894 is therefore inhibition of FLJ13449 (Accession NM_024546). Accordingly, utilities of VGAM894 include diagnosis, prevention and treatment of diseases and clinical conditions associated with FLJ13449.

FLJ13842 (Accession NM_024645) is another VGAM894 host target gene. FLJ13842 BINDING SITE is HOST TARGET binding site found in the 3' untranslated region of mRNA encoded by FLJ13842, corresponding to a HOST TARGET binding site such as BINDING SITE I, BINDING SITE II or BINDING SITE III. Table 2 illustrates the complementarity of the nucleotide sequences of FLJ13842 BINDING SITE, designated SEQ ID:23930, to the nucleotide sequence of VGAM894 RNA, herein designated VGAM RNA, also designated SEQ ID:3605.

Another function of VGAM894 is therefore inhibition of FLJ13842 (Accession NM_024645). Accordingly, utilities of VGAM894 include diagnosis, prevention and treatment of diseases and clinical conditions associated with FLJ13842. Glia Maturation Factor, Beta (GMFB, Accession NM_004124) is another VGAM894 host target gene. GMFB BINDING SITE is HOST TARGET binding site found in the 3' untranslated region of mRNA encoded by GMFB, corresponding to a HOST TARGET binding site such as BINDING SITE I, BINDING SITE II or BINDING SITE III. Table 2 illustrates the complementarity of the nucleotide sequences of GMFB BINDING SITE, designated SEQ ID:10331, to the nucleotide sequence of VGAM894 RNA, herein designated VGAM RNA, also designated SEQ ID:3605.

Another function of VGAM894 is therefore inhibition of Glia Maturation Factor, Beta (GMFB, Accession NM_004124). Accordingly, utilities of VGAM894 include diagnosis, prevention and treatment of diseases and clinical conditions associated with GMFB. HCA127 (Accession NM_018684) is another VGAM894 host target gene. HCA127 BINDING SITE is HOST TARGET binding site found in the 3' untranslated region of mRNA encoded by HCA127, corresponding to a HOST TARGET binding site such as BINDING SITE I, BINDING SITE II or BINDING SITE III. Table 2 illustrates the complementarity of the nucleotide sequences of HCA127 BINDING SITE, designated SEQ ID:20761, to the nucleotide sequence of VGAM894 RNA, herein designated VGAM RNA, also designated SEQ ID:3605.

Another function of VGAM894 is therefore inhibition of HCA127 (Accession NM_018684). Accordingly, utilities of VGAM894 include diagnosis, prevention and treatment of diseases and clinical conditions associated with HCA127. HMP19 (Accession XM_113455) is another VGAM894 host target gene. HMP19 BINDING SITE is HOST TARGET binding site found in the 3' untranslated region of mRNA encoded by HMP19, corresponding to a HOST TARGET binding site such as BINDING SITE I, BINDING SITE II or BINDING SITE III. Table 2 illustrates the complementarity of the nucleotide sequences of HMP19 BINDING SITE, designated SEQ ID:42274, to the nucleotide sequence of VGAM894 RNA, herein designated VGAM RNA, also designated SEQ ID:3605.

Another function of VGAM894 is therefore inhibition of HMP19 (Accession XM_113455). Accordingly, utilities of VGAM894 include diagnosis, prevention and treatment of diseases and clinical conditions associated with HMP19. ICK (Accession NM_014920) is another VGAM894 host target gene. ICK BINDING SITE is HOST TARGET binding site found in the 3' untranslated region of mRNA encoded by ICK, corresponding to a HOST TARGET binding site such as BINDING SITE I, BINDING SITE II or BINDING SITE III. Table 2 illustrates the complementarity of the nucleotide sequences of ICK BINDING SITE, designated SEQ ID:17198, to the nucleotide sequence of VGAM894 RNA, herein designated VGAM RNA, also designated SEQ ID:3605.

Another function of VGAM894 is therefore inhibition of ICK (Accession NM_014920). Accordingly, utilities of VGAM894 include diagnosis, prevention and treatment of diseases and clinical conditions associated with ICK. KIAA0057 (Accession NM_012288) is another VGAM894 host target gene. KIAA0057 BINDING SITE is HOST TARGET binding site found in the 3" untranslated region of mRNA encoded by KIAA0057, corresponding to a HOST TARGET binding site such as BINDING SITE I, BINDING SITE II or BINDING SITE III. Table 2 illustrates the complementarity of the nucleotide sequences of KIAA0057 BINDING SITE, designated SEQ ID:14623, to the nucleotide sequence of VGAM894 RNA, herein designated VGAM RNA, also designated SEQ ID:3605.

Another function of VGAM894 is therefore inhibition of KIAA0057 (Accession NM_012288). Accordingly, utilities of VGAM894 include diagnosis, prevention and treatment of diseases and clinical conditions associated with KIAA0057. KIAA0319 (Accession NM_014809) is another VGAM894 host target gene. KIAA0319 BINDING SITE is HOST TARGET binding site found in the 3' untranslated region of mRNA encoded by KIAA0319, corresponding to a HOST TARGET binding site such as BINDING SITE I, BINDING SITE II or BINDING SITE III. Table 2 illustrates the complementarity of the nucleotide sequences of KIAA0319 BINDING SITE, designated SEQ ID:16765, to the nucleotide sequence of VGAM894 RNA, herein designated VGAM RNA, also designated SEQ ID:3605.

Another function of VGAM894 is therefore inhibition of KIAA0319 (Accession NM_014809). Accordingly, utilities of VGAM894 include diagnosis, prevention and treatment of diseases and clinical conditions associated with KIAA0319. KIAA0354 (Accession NM_014872) is another VGAM894 host target gene. KIAA0354 BINDING SITE is HOST TARGET binding site found in the 3' untranslated region of mRNA encoded by KIAA0354, corresponding to a HOST TARGET binding site such as BINDING SITE I, BINDING SITE II or BINDING SITE III. Table 2 illustrates the complementarity of the nucleotide sequences of KIAA0354 BINDING SITE, designated SEQ ID:17000, to the nucleotide sequence of VGAM894 RNA, herein designated VGAM RNA, also designated SEQ ID:3605.

Another function of VGAM894 is therefore inhibition of KIAA0354 (Accession NM_014872). Accordingly, utilities of VGAM894 include diagnosis, prevention and treatment of diseases and clinical conditions associated with KIAA0354. KIAA0703 (Accession NM_014861) is another VGAM894 host target gene. KIAA0703 BINDING SITE is HOST TARGET binding site found in the 5' untranslated region of mRNA encoded by KIAA0703, corresponding to a HOST TARGET binding site such as BINDING SITE I, BINDING SITE II or BINDING SITE III. Table 2 illustrates the complementarity of the nucleotide sequences of KIAA0703 BINDING SITE, designated SEQ ID:16930, to the nucleotide sequence of VGAM894 RNA, herein designated VGAM RNA, also designated SEQ ID:3605.

Another function of VGAM894 is therefore inhibition of KIAA0703 (Accession NM_014861). Accordingly, utilities of VGAM894 include diagnosis, prevention and treatment of diseases and clinical conditions associated with KIAA0703. KIAA0961 (Accession NM_014898) is another VGAM894 host target gene. KIAA0961 BINDING SITE is HOST TARGET binding site found in the 3' untranslated region of mRNA encoded by KIAA0961, corresponding to a HOST TARGET binding site such as BINDING SITE I, BINDING SITE II or BINDING SITE III. Table 2 illustrates the complementarity of the nucleotide sequences of KIAA0961 BIND- ING SITE, designated SEQ ID:17074, to the nucleotide sequence of VGAM894 RNA, herein designated VGAM RNA, also designated SEQ ID:3605.

Another function of VGAM894 is therefore inhibition of KIAA0961 (Accession NM_014898). Accordingly, utilities of VGAM894 include diagnosis, prevention and treatment of diseases and clinical conditions associated with KIAA0961. KIAA1257 (Accession XM_031577) is another VGAM894 host target gene. KIAA1257 BINDING SITE is HOST TARGET binding site found in the 3' untranslated region of mRNA encoded by KIAA1257, corresponding to a HOST TARGET binding site such as BINDING SITE I, BINDING SITE II or BINDING SITE III. Table 2 illustrates the complementarity of the nucleotide sequences of KIAA1257 BINDING SITE, designated SEQ ID:31442, to the nucleotide sequence of VGAM894 RNA, herein designated VGAM RNA, also designated SEQ ID:3605.

Another function of VGAM894 is therefore inhibition of KIAA1257 (Accession XM_031577). Accordingly, utilities of VGAM894 include diagnosis, prevention and treatment of diseases and clinical conditions associated with KIAA1257. KIAA1500 (Accession XM_034353) is another VGAM894 host target gene. KIAA1500 BINDING SITE is HOST TARGET binding site found in the 3' untranslated region of mRNA encoded by KIAA1500, corresponding to a HOST TARGET binding site such as BINDING SITE I, BINDING SITE II or BINDING SITE III. Table 2 illustrates the complementarity of the nucleotide sequences of KIAA1500 BINDING SITE, designated SEQ ID:32072, to the nucleotide sequence of VGAM894 RNA, herein designated VGAM RNA, also designated SEQ ID:3605.

Another function of VGAM894 is therefore inhibition of KIAA1500 (Accession XM_034353). Accordingly, utilities of VGAM894 include diagnosis, prevention and treatment of diseases and clinical conditions associated with KIAA1500. MIC2 Like 1 (MIC2L1, Accession NM_031462) is another VGAM894 host target gene. MIC2L1 BINDING SITE is HOST TARGET binding site found in the 3' untranslated region of mRNA encoded by MIC2L1, corresponding to a HOST TARGET binding site such as BINDING SITE I, BINDING SITE II or BINDING SITE III. Table 2 illustrates the complementarity of the nucleotide sequences of MIC2L1 BINDING SITE, designated SEQ ID:25493, to the nucleotide sequence of VGAM894 RNA, herein designated VGAM RNA, also designated SEQ ID:3605.

Another function of VGAM894 is therefore inhibition of MIC2 Like 1 (MIC2L1, Accession NM_031462). Accordingly, utilities of VGAM894 include diagnosis, prevention and treatment of diseases and clinical conditions associated with MIC2L1. MR (Accession NM_031212) is another VGAM894 host target gene. MR BINDING SITE is HOST TARGET binding site found in the 5' untranslated region of mRNA encoded by MR, corresponding to a HOST TARGET binding site such as BINDING SITE I, BINDING SITE II or BINDING SITE III. Table 2 illustrates the complementarity of the nucleotide sequences of MR BINDING SITE, designated SEQ ID:25257, to the nucleotide sequence of VGAM894 RNA, herein designated VGAM RNA, also designated SEQ ID:3605.

Another function of VGAM894 is therefore inhibition of MR (Accession NM_031212). Accordingly, utilities of VGAM894 include diagnosis, prevention and treatment of diseases and clinical conditions associated with MR. Nudix (nucleoside diphosphate linked moiety X)-type Motif 11 (NUDT11, Accession XM_010230) is another VGAM894 host target gene. NUDT11 BINDING SITE is HOST TARGET binding site found in the 3' untranslated region of mRNA encoded by NUDT11, corresponding to a HOST TARGET binding site such as BINDING SITE I, BINDING SITE II or BINDING SITE III. Table 2 illustrates the complementarity of the nucleotide sequences of NUDT11 BINDING SITE, designated SEQ ID:30146, to the nucleotide sequence of VGAM894 RNA, herein designated VGAM RNA, also designated SEQ ID:3605.

Another function of VGAM894 is therefore inhibition of Nudix (nucleoside diphosphate linked moiety X)-type Motif 11 (NUDT11, Accession XM_010230). Accordingly, utilities of VGAM894 include diagnosis, prevention and treatment of diseases and clinical conditions associated with NUDT11. Protein Phosphatase 2 (formerly 2A), Regulatory Subunit B", Alpha (PPP2R3A, Accession NM_002718) is another VGAM894 host target gene. PPP2R3A BINDING SITE is HOST TARGET binding site found in the 3' untranslated region of mRNA encoded by PPP2R3A, corresponding to a HOST TARGET binding site such as BINDING SITE I, BINDING SITE II or BINDING SITE III. Table 2 illustrates the complementarity of the nucleotide sequences of PPP2R3A BINDING SITE, designated SEQ ID:8587, to the nucleotide sequence of VGAM894 RNA, herein designated VGAM RNA, also designated SEQ ID:3605.

Another function of VGAM894 is therefore inhibition of Protein Phosphatase 2 (formerly 2A), Regulatory Subunit B", Alpha (PPP2R3A, Accession NM_002718). Accordingly, utilities of VGAM894 include diagnosis, prevention and treatment of diseases and clinical conditions associated with PPP2R3A. SENP7 (Accession NM_020654) is another VGAM894 host target gene. SENP7 BINDING SITE is HOST TARGET binding site found in the 3' untranslated region of mRNA encoded by SENP7, corresponding to a HOST TARGET binding site such as BINDING SITE I, BINDING SITE II or BINDING SITE III. Table 2 illustrates the complementarity of the nucleotide sequences of SENP7 BINDING SITE, designated SEQ ID:21823, to the nucleotide sequence of VGAM894 RNA, herein designated VGAM RNA, also designated SEQ ID:3605.

Another function of VGAM894 is therefore inhibition of SENP7 (Accession NM_020654). Accordingly, utilities of VGAM894 include diagnosis, prevention and treatment of diseases and clinical conditions associated with SENP7. Splicing Factor, Arginine/serine-rich 11 (SFRS11, Accession NM_004768) is another VGAM894 host target gene. SFRS11 BINDING SITE is HOST TARGET binding site found in the 3' untranslated region of mRNA encoded by SFRS11, corresponding to a HOST TARGET binding site such as BINDING SITE I, BINDING SITE II or BINDING SITE III. Table 2 illustrates the complementarity of the nucleotide sequences of SFRS11 BINDING SITE, designated SEQ ID:11160, to the nucleotide sequence of VGAM894 RNA, herein designated VGAM RNA, also designated SEQ ID:3605.

Another function of VGAM894 is therefore inhibition of Splicing Factor, Arginine/serine-rich 11 (SFRS11, Accession NM_004768). Accordingly, utilities of VGAM894 include diagnosis, prevention and treatment of diseases and clinical conditions associated with SFRS11. TAF2 RNA Polymerase II, TATA Box Binding Protein (TBP)-associated Factor, 150 kDa (TAF2, Accession NM_003184) is another VGAM894 host target gene. TAF2 BINDING SITE is HOST TARGET binding site found in the 3' untranslated region of mRNA encoded by TAF2, corresponding to a HOST TARGET binding site such as BINDING SITE I, BINDING SITE II or BINDING SITE III. Table 2 illustrates the complementarity of the nucleotide sequences of TAF2 BINDING SITE, designated SEQ ID:9160, to the nucleotide sequence of VGAM894 RNA, herein designated VGAM RNA, also designated SEQ ID:3605.

Another function of VGAM894 is therefore inhibition of TAF2 RNA Polymerase II, TATA Box Binding Protein (TBP)-associated Factor, 150 kDa (TAF2, Accession NM_003184). Accordingly, utilities of VGAM894 include diagnosis, prevention and treatment of diseases and clinical conditions associated with TAF2. Zinc Metalloproteinase (STE24 homolog, yeast) (ZMPSTE24, Accession NM_005857) is another VGAM894 host target gene. ZMPSTE24 BINDING SITE is HOST TARGET binding site found in the 3' untranslated region of mRNA encoded by ZMPSTE24, corresponding to a HOST TARGET binding site such as BINDING SITE I, BINDING SITE II or BINDING SITE III. Table 2 illustrates the complementarity of the nucleotide sequences of ZMPSTE24 BINDING SITE, designated SEQ ID:12463, to the nucleotide sequence of VGAM894 RNA, herein designated VGAM RNA, also designated SEQ ID:3605.

Another function of VGAM894 is therefore inhibition of Zinc Metalloproteinase (STE24 homolog, yeast) (ZMPSTE24, Accession NM_005857). Accordingly, utilities of VGAM894 include diagnosis, prevention and treatment of diseases and clinical conditions associated with ZMPSTE24. Zinc Finger Protein 262 (ZNF262, Accession NM_005095) is another VGAM894 host target gene. ZNF262 BINDING SITE is HOST TARGET binding site found in the 3' untranslated region of mRNA encoded by ZNF262, corresponding to a HOST TARGET binding site such as BINDING SITE I, BINDING SITE II or BINDING SITE III. Table 2 illustrates the complementarity of the nucleotide sequences of ZNF262 BINDING SITE, designated SEQ ID:11558, to the nucleotide sequence of VGAM894 RNA, herein designated VGAM RNA, also designated SEQ ID:3605.

Another function of VGAM894 is therefore inhibition of Zinc Finger Protein 262 (ZNF262, Accession NM_005095). Accordingly, utilities of VGAM894 include diagnosis, prevention and treatment of diseases and clinical conditions associated with ZNF262. LOC147991 (Accession XM_085993) is another VGAM894 host target gene. LOC147991 BINDING SITE is HOST TARGET binding site found in the 5' untranslated region of mRNA encoded by LOC147991, corresponding to a HOST TARGET binding site such as BINDING SITE I, BINDING SITE II or BINDING SITE III. Table 2 illustrates the complementarity of the nucleotide sequences of LOC147991 BINDING SITE, designated SEQ ID:38438, to the nucleotide sequence of VGAM894 RNA, herein designated VGAM RNA, also designated SEQ ID:3605.

Another function of VGAM894 is therefore inhibition of LOC147991 (Accession XM_085993). Accordingly, utilities of VGAM894 include diagnosis, prevention and treatment of diseases and clinical conditions associated with LOC147991. LOC149271 (Accession XM_086475) is another VGAM894 host target gene. LOC149271 BINDING SITE is HOST TARGET binding site found in the 5' untranslated region of mRNA encoded by LOC149271, corresponding to a HOST TARGET binding site such as BINDING SITE I, BINDING SITE II or BINDING SITE III. Table 2 illustrates the complementarity of the nucleotide sequences of LOC149271 BINDING SITE, designated SEQ ID:38682, to the nucleotide sequence of VGAM894 RNA, herein designated VGAM RNA, also designated SEQ ID:3605.

Another function of VGAM894 is therefore inhibition of LOC149271 (Accession XM_086475). Accordingly, utilities of VGAM894 include diagnosis, prevention and treatment of diseases and clinical conditions associated with LOC149271.

LOC150170 (Accession XM_086799) is another VGAM894 host target gene. LOC150170 BINDING SITE is HOST TARGET binding site found in the 5' untranslated region of mRNA encoded by LOC150170, corresponding to a HOST TARGET binding site such as BINDING SITE I, BINDING SITE II or BINDING SITE III. Table 2 illustrates the complementarity of the nucleotide sequences of LOC150170 BINDING SITE, designated SEQ ID:38864, to the nucleotide sequence of VGAM894 RNA, herein designated VGAM RNA, also designated SEQ ID:3605.

Another function of VGAM894 is therefore inhibition of LOC150170 (Accession XM_086799). Accordingly, utilities of VGAM894 include diagnosis, prevention and treatment of diseases and clinical conditions associated with LOC150170. LOC150175 (Accession XM_086806) is another VGAM894 host target gene. LOC150175 BINDING SITE is HOST TARGET binding site found in the 5' untranslated region of mRNA encoded by LOC150175, corresponding to a HOST TARGET binding site such as BINDING SITE I, BINDING SITE II or BINDING SITE III. Table 2 illustrates the complementarity of the nucleotide sequences of LOC150175 BINDING SITE, designated SEQ ID:38886, to the nucleotide sequence of VGAM894 RNA, herein designated VGAM RNA, also designated SEQ ID:3605.

Another function of VGAM894 is therefore inhibition of LOC150175 (Accession XM_086806). Accordingly, utilities of VGAM894 include diagnosis, prevention and treatment of diseases and clinical conditions associated with LOC150175. LOC150215 (Accession XM_086813) is another VGAM894 host target gene. LOC150215 BINDING SITE is HOST TARGET binding site found in the 5' untranslated region of mRNA encoded by LOC150215, corresponding to a HOST TARGET binding site such as BINDING SITE I, BINDING SITE II or BINDING SITE III. Table 2 illustrates the complementarity of the nucleotide sequences of LOC150215 BINDING SITE, designated SEQ ID:38890, to the nucleotide sequence of VGAM894 RNA, herein designated VGAM RNA, also designated SEQ ID:3605.

Another function of VGAM894 is therefore inhibition of LOC150215 (Accession XM_086813). Accordingly, utilities of VGAM894 include diagnosis, prevention and treatment of diseases and clinical conditions associated with LOC150215. LOC150218 (Accession XM_086850) is another VGAM894 host target gene. LOC150218 BINDING SITE is HOST TARGET binding site found in the 5' untranslated region of mRNA encoded by LOC150218, corresponding to a HOST TARGET binding site such as BINDING SITE I, BINDING SITE II or BINDING SITE III. Table 2 illustrates the complementarity of the nucleotide sequences of LOC150218 BINDING SITE, designated SEQ ID:38917, to the nucleotide sequence of VGAM894 RNA, herein designated VGAM RNA, also designated SEQ ID:3605.

Another function of VGAM894 is therefore inhibition of LOC150218 (Accession XM_086850). Accordingly, utilities of VGAM894 include diagnosis, prevention and treatment of diseases and clinical conditions associated with LOC150218. LOC151201 (Accession XM_098021) is another VGAM894 host target gene. LOC151201 BINDING SITE is HOST TARGET binding site found in the 3' untranslated region of mRNA encoded by LOC151201, corresponding to a HOST TARGET binding site such as BINDING SITE I, BINDING SITE II or BINDING SITE III. Table 2 illustrates the complementarity of the nucleotide sequences of LOC151201 BINDING SITE, designated SEQ ID:41325, to the nucleotide sequence of VGAM894 RNA, herein designated VGAM RNA, also designated SEQ ID:3605.

Another function of VGAM894 is therefore inhibition of LOC151201 (Accession XM_098021). Accordingly, utilities of VGAM894 include diagnosis, prevention and treatment of diseases and clinical conditions associated with LOC151201.

LOC206338 (Accession XM_116456) is another VGAM894 host target gene. LOC206338 BINDING SITE is HOST TARGET binding site found in the 5' untranslated region of mRNA encoded by LOC206338, corresponding to a HOST TARGET binding site such as BINDING SITE I, BINDING SITE II or BINDING SITE III. Table 2 illustrates the complementarity of the nucleotide sequences of LOC206338 BINDING SITE, designated SEQ ID:43112, to the nucleotide sequence of VGAM894 RNA, herein designated VGAM RNA, also designated SEQ ID:3605.

Another function of VGAM894 is therefore inhibition of LOC206338 (Accession XM_116456). Accordingly, utilities of VGAM894 include diagnosis, prevention and treatment of diseases and clinical conditions associated with LOC206338.

LOC221576 (Accession XM_168088) is another VGAM894 host target gene. LOC221576 BINDING SITE is HOST TARGET binding site found in the 3' untranslated region of mRNA encoded by LOC221576, corresponding to a HOST TARGET binding site such as BINDING SITE I, BINDING SITE II or BINDING SITE III. Table 2 illustrates the complementarity of the nucleotide sequences of LOC221576 BINDING SITE, designated SEQ ID:45001, to the nucleotide sequence of VGAM894 RNA, herein designated VGAM RNA, also designated SEQ ID:3605.

Another function of VGAM894 is therefore inhibition of LOC221576 (Accession XM_168088). Accordingly, utilities of VGAM894 include diagnosis, prevention and treatment of diseases and clinical conditions associated with LOC221576. LOC257282 (Accession XM_172844) is another VGAM894 host target gene. LOC257282 BINDING SITE is HOST TARGET binding site found in the 5' untranslated region of mRNA encoded by LOC257282, corresponding to a HOST TARGET binding site such as BINDING SITE I, BINDING SITE II or BINDING SITE III. Table 2 illustrates the complementarity of the nucleotide sequences of LOC257282 BINDING SITE, designated SEQ ID:46123, to the nucleotide sequence of VGAM894 RNA, herein designated VGAM RNA, also designated SEQ ID:3605.

Another function of VGAM894 is therefore inhibition of LOC257282 (Accession XM_172844). Accordingly, utilities of VGAM894 include diagnosis, prevention and treatment of diseases and clinical conditions associated with LOC257282. LOC257515 (Accession XM_175211) is another VGAM894 host target gene. LOC257515 BINDING SITE is HOST TARGET binding site found in the 3' untranslated region of mRNA encoded by LOC257515, corresponding to a HOST TARGET binding site such as BINDING SITE I, BINDING SITE II or BINDING SITE III. Table 2 illustrates the complementarity of the nucleotide sequences of LOC257515 BINDING SITE, designated SEQ ID:46685, to the nucleotide sequence of VGAM894 RNA, herein designated VGAM RNA, also designated SEQ ID:3605.

Another function of VGAM894 is therefore inhibition of LOC257515 (Accession XM_175211). Accordingly, utilities of VGAM894 include diagnosis, prevention and treatment of diseases and clinical conditions associated with LOC257515. LOC257572 (Accession XM_175294) is another VGAM894 host target gene. LOC257572 BINDING SITE is HOST TARGET binding site found in the 3' untranslated region of mRNA encoded by LOC257572, corresponding to a HOST TARGET binding site such as BINDING SITE I, BINDING SITE II or BINDING SITE III. Table 2 illustrates the complementarity of the nucleotide sequences of LOC257572 BINDING SITE, designated SEQ ID:46746, to the nucleotide sequence of VGAM894 RNA, herein designated VGAM RNA, also designated SEQ ID:3605.

Another function of VGAM894 is therefore inhibition of LOC257572 (Accession XM_175294). Accordingly, utilities of VGAM894 include diagnosis, prevention and treatment of diseases and clinical conditions associated with LOC257572. LOC91445 (Accession XM_018516) is another VGAM894 host target gene. LOC91445 BINDING SITE is HOST TARGET binding site found in the 3' untranslated region of mRNA encoded by LOC91445, corresponding to a HOST TARGET binding site such as BINDING SITE I, BINDING SITE II or BINDING SITE III. Table 2 illustrates the complementarity of the nucleotide sequences of LOC91445 BINDING SITE, designated SEQ ID:30369, to the nucleotide sequence of VGAM894 RNA, herein designated VGAM RNA, also designated SEQ ID:3605.

Another function of VGAM894 is therefore inhibition of LOC91445 (Accession XM_018516). Accordingly, utilities of VGAM894 include diagnosis, prevention and treatment of diseases and clinical conditions associated with LOC91445. FIG. 1 further provides a conceptual description of a novel bioinformatically detected viral gene of the present invention, referred to here as Viral Genomic Address Messenger 895 (VGAM895) viral gene, which modulates expression of respective host target genes thereof, the function and utility of which host target genes is known in the art.

VGAM895 is a novel bioinformatically detected regulatory, non protein coding, viral micro RNA (miRNA) gene. The method by which VGAM895 was detected is described hereinabove with reference to FIGS. 1-8.

VGAM895 gene, herein designated VGAM GENE, is a viral gene contained in the genome of Gallid Herpesvirus 2. VGAM895 host target gene, herein designated VGAM HOST TARGET GENE, is a human gene contained in the human genome.

VGAM895 gene encodes a VGAM895 precursor RNA, herein designated VGAM PRECURSOR RNA. Similar to other miRNA genes, and unlike most ordinary genes, VGAM895 precursor RNA does not encode a protein. A nucleotide sequence identical or highly similar to the nucleotide sequence of VGAM895 precursor RNA is designated SEQ ID:881, and is provided hereinbelow with reference to the sequence listing part. Nucleotide sequence SEQ ID:881 is located at position 20248 relative to the genome of Gallid Herpesvirus 2.

VGAM895 precursor RNA folds onto itself, forming VGAM895 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM895 folded precursor RNA into VGAM895 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM895 RNA is designated SEQ ID:3606, and is provided hereinbelow with reference to the sequence listing part.

VGAM895 host target gene, herein designated VGAM HOST TARGET GENE, encodes a corresponding messenger RNA, VGAM895 host target RNA, herein designated VGAM HOST TARGET RNA. VGAM895 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM895 RNA, herein designated VGAM RNA, binds complementarily to one or more host target binding sites located in untranslated regions of VGAM895 host target RNA, herein designated VGAM HOST TARGET RNA. This complementary binding is due to the fact that the nucleotide sequence of VGAM895 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM895 RNA, herein designated VGAM RNA, may have a different number of host target binding sites in untranslated regions of a VGAM895 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM895 RNA, herein designated VGAM RNA, to host target binding sites on VGAM895 host target RNA, herein designated VGAM HOST TARGET RNA, such as BINDING SITE I, BINDING SITE II and BINDING SITE III, inhibits translation of VGAM895 host target RNA into VGAM895 host target protein, herein designated VGAM HOST TARGET PROTEIN. VGAM host target protein is therefore outlined by a broken line.

It is appreciated that VGAM895 host target gene, herein designated VGAM HOST TARGET GENE, in fact represents a plurality of VGAM895 host target genes. The mRNA of each one of this plurality of VGAM895 host target genes comprises one or more host target binding sites, each having a nucleotide sequence which is at least partly complementary to VGAM895 RNA, herein designated VGAM RNA, and which when bound by VGAM895 RNA causes inhibition of translation of respective one or more VGAM895 host target proteins.

It is further appreciated by one skilled in the art that the mode of translational inhibition illustrated by FIG. 1 with specific reference to translational inhibition exerted by VGAM895 gene, herein designated VGAM GENE, on one or more VGAM895 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM895 is inhibition of expression of host target genes, as part of a novel viral mechanism of attacking a host. Accordingly, utilities of VGAM895 include diagnosis, prevention and treatment of viral infection by Gallid Herpesvirus 2. Specific functions, and accordingly utilities, of VGAM895 correlate with, and may be deduced from, the identity of the host target genes which VGAM895 binds and inhibits, and the function of these host target genes, as elaborated hereinbelow.

Nucleotide sequences of the VGAM895 precursor RNA, herein designated VGAM PRECURSOR RNA, and of the 'diced' VGAM895 RNA, herein designated VGAM RNA, and a schematic representation of the secondary folding of VGAM895 folded precursor RNA, herein designated VGAM FOLDED PRECURSOR RNA, of VGAM895 are further described hereinbelow with reference to Table 1.

Nucleotide sequences of host target binding sites, such as BINDING SITE-I, BINDING SITE-II and BINDING SITE-III of FIG. 1, found on VGAM895 host target RNA, and schematic representation of the complementarity of each of these host target binding sites to VGAM895 RNA, herein designated VGAM RNA, are described hereinbelow with reference to Table 2.

As mentioned hereinabove with reference to FIG. 1, a function of VGAM895 gene, herein designated VGAM is inhibition of expression of VGAM895 target genes. It is appreciated that specific functions, and accordingly utilities, of VGAM895 correlate with, and may be deduced from, the identity of the target genes which VGAM895 binds and inhibits, and the function of these target genes, as elaborated hereinbelow.

KOC1 (Accession XM_165847) is a VGAM895 host target gene. KOC1 BINDING SITE is HOST TARGET binding site found in the 5' untranslated region of mRNA encoded by KOC1, corresponding to a HOST TARGET binding site such as BINDING SITE I, BINDING SITE II or BINDING SITE III. Table 2 illustrates the complementarity of the nucleotide sequences of KOC1 BINDING SITE, designated SEQ ID:43781, to the nucleotide sequence of VGAM895 RNA, herein designated VGAM RNA, also designated SEQ ID:3606.

A function of VGAM895 is therefore inhibition of KOC1 (Accession XM_165847). Accordingly, utilities of VGAM895 include diagnosis, prevention and treatment of diseases and clinical conditions associated with KOC1. SE57-1 (Accession NM_025214) is another VGAM895 host target gene. SE57-1 BINDING SITE is HOST TARGET binding site found in the 3' untranslated region of mRNA encoded by SE57-1, corresponding to a HOST TARGET binding site such as BINDING SITE I, BINDING SITE II or BINDING SITE III. Table 2 illustrates the complementarity of the nucleotide sequences of SE57-1 BINDING SITE, designated SEQ ID:24890, to the nucleotide sequence of VGAM895 RNA, herein designated VGAM RNA, also designated SEQ ID:3606.

Another function of VGAM895 is therefore inhibition of SE57-1 (Accession NM_025214). Accordingly, utilities of VGAM895 include diagnosis, prevention and treatment of diseases and clinical conditions associated with SE57-1. FIG. 1 further provides a conceptual description of a novel bioinformatically detected viral gene of the present invention, referred to here as Viral Genomic Address Messenger 896 (VGAM896) viral gene, which modulates expression of respective host target genes thereof, the function and utility of which host target genes is known in the art.

VGAM896 is a novel bioinformatically detected regulatory, non protein coding, viral micro RNA (miRNA) gene. The method by which VGAM896 was detected is described hereinabove with reference to FIGS. 1-8.

VGAM896 gene, herein designated VGAM GENE, is a viral gene contained in the genome of Gallid Herpesvirus 2. VGAM896 host target gene, herein designated VGAM HOST TARGET GENE, is a human gene contained in the human genome.

VGAM896 gene encodes a VGAM896 precursor RNA, herein designated VGAM PRECURSOR RNA. Similar to other miRNA genes, and unlike most ordinary genes, VGAM896 precursor RNA does not encode a protein. A nucleotide sequence identical or highly similar to the nucleotide sequence of VGAM896 precursor RNA is designated SEQ ID:882, and is provided hereinbelow with reference to the sequence listing part. Nucleotide sequence SEQ ID:882 is located at position 21611 relative to the genome of Gallid Herpesvirus 2.

VGAM896 precursor RNA folds onto itself, forming VGAM896 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM896 folded precursor RNA into VGAM896 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM896 RNA is designated SEQ ID:3607, and is provided hereinbelow with reference to the sequence listing part.

VGAM896 host target gene, herein designated VGAM HOST TARGET GENE, encodes a corresponding messenger RNA, VGAM896 host target RNA, herein designated VGAM HOST TARGET RNA. VGAM896 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM896 RNA, herein designated VGAM RNA, binds complementarily to one or more host target binding sites located in untranslated regions of VGAM896 host target RNA, herein designated VGAM HOST TARGET RNA. This complementary binding is due to the fact that the nucleotide sequence of VGAM896 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM896 RNA, herein designated VGAM RNA, may have a different number of host target binding sites in untranslated regions of a VGAM896 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM896 RNA, herein designated VGAM RNA, to host target binding sites on VGAM896 host target RNA, herein designated VGAM HOST TARGET RNA, such as BINDING SITE I, BINDING SITE II and BINDING SITE III, inhibits translation of VGAM896 host target RNA into VGAM896 host target protein, herein designated VGAM HOST TARGET PROTEIN. VGAM host target protein is therefore outlined by a broken line.

It is appreciated that VGAM896 host target gene, herein designated VGAM HOST TARGET GENE, in fact represents a plurality of VGAM896 host target genes. The mRNA of each one of this plurality of VGAM896 host target genes comprises one or more host target binding sites, each having a nucleotide sequence which is at least partly complementary to VGAM896 RNA, herein designated VGAM RNA, and which when bound by VGAM896 RNA causes inhibition of translation of respective one or more VGAM896 host target proteins.

It is further appreciated by one skilled in the art that the mode of translational inhibition illustrated by FIG. 1 with specific reference to translational inhibition exerted by VGAM896 gene, herein designated VGAM GENE, on one or more VGAM896 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM896 is inhibition of expression of host target genes, as part of a novel viral mechanism of attacking a host. Accordingly, utilities of VGAM896 include diagnosis, prevention and treatment of viral infection by Gallid Herpesvirus 2. Specific functions, and accordingly utilities, of VGAM896 correlate with, and may be deduced from, the identity of the host target genes which VGAM896 binds and inhibits, and the function of these host target genes, as elaborated hereinbelow.

Nucleotide sequences of the VGAM896 precursor RNA, herein designated VGAM PRECURSOR RNA, and of the 'diced' VGAM896 RNA, herein designated VGAM RNA, and a schematic representation of the secondary folding of VGAM896 folded precursor RNA, herein designated VGAM FOLDED PRECURSOR RNA, of VGAM896 are further described hereinbelow with reference to Table 1.

Nucleotide sequences of host target binding sites, such as BINDING SITE-I, BINDING SITE-II and BINDING SITE-III of FIG. 1, found on VGAM896 host target RNA, and schematic representation of the complementarity of each of these host target binding sites to VGAM896 RNA, herein designated VGAM RNA, are described hereinbelow with reference to Table 2.

As mentioned hereinabove with reference to FIG. 1, a function of VGAM896 gene, herein designated VGAM is inhibition of expression of VGAM896 target genes. It is appreciated that specific functions, and accordingly utilities, of VGAM896 correlate with, and may be deduced from, the identity of the target genes which VGAM896 binds and inhibits, and the function of these target genes, as elaborated hereinbelow.

B-cell CLL/lymphoma 9 (BCL9, Accession NM_004326) is a VGAM896 host target gene. BCL9 BINDING SITE is HOST TARGET binding site found in the 3' untranslated region of mRNA encoded by BCL9, corresponding to a HOST TARGET binding site such as BINDING SITE I, BINDING SITE II or BINDING SITE III. Table 2 illustrates the complementarity of the nucleotide sequences of BCL9 BINDING SITE, designated SEQ ID:10521, to the nucleotide sequence of VGAM896 RNA, herein designated VGAM RNA, also designated SEQ ID:3607.

A function of VGAM896 is therefore inhibition of B-cell CLL/lymphoma 9 (BCL9, Accession NM_004326), a gene which recruits of PYGO to the nuclear beta-catenin-TCF complex in Wnt/Wingless signaling. Accordingly, utilities of VGAM896 include diagnosis, prevention and treatment of diseases and clinical conditions associated with BCL9. The function of BCL9 and its association with various diseases and clinical conditions, has been established by previous studies, as described hereinabove with reference to VGAM74. Filamin B, Beta (actin binding protein 278) (FLNB, Accession XM_030806) is another VGAM896 host target gene. FLNB BINDING SITE is HOST TARGET binding site found in the 3' untranslated region of mRNA encoded by FLNB, corresponding to a HOST TARGET binding site such as BINDING SITE I, BINDING SITE II or BINDING SITE III. Table 2 illustrates the complementarity of the nucleotide sequences of FLNB BINDING SITE, designated SEQ ID:31137, to the nucleotide sequence of VGAM896 RNA, herein designated VGAM RNA, also designated SEQ ID:3607.

Another function of VGAM896 is therefore inhibition of Filamin B, Beta (actin binding protein 278) (FLNB, Accession XM_030806), a gene which Filamin B, beta; binds actin, interacts with cytoplasmic domain of Ibalpha. Accordingly, utilities of VGAM896 include diagnosis, prevention and treatment of diseases and clinical conditions associated with FLNB. The function of FLNB and its association with various diseases and clinical conditions, has been established by previous studies, as described hereinabove with reference to VGAM416. Chromosome 20 Open Reading Frame 103 (C20orf103, Accession NM_012261) is another VGAM896 host target gene. C20orf103 BINDING SITE is HOST TARGET binding site found in the 3' untranslated region of mRNA encoded by C20orf103, corresponding to a HOST TARGET binding site such as BINDING SITE I, BINDING SITE II or BINDING SITE III. Table 2 illustrates the complementarity of the nucleotide sequences of C20orf103 BINDING SITE, designated SEQ ID:14567, to the nucleotide sequence of VGAM896 RNA, herein designated VGAM RNA, also designated SEQ ID:3607.

Another function of VGAM896 is therefore inhibition of Chromosome 20 Open Reading Frame 103 (C20orf103, Accession NM_012261). Accordingly, utilities of VGAM896 include diagnosis, prevention and treatment of diseases and clinical conditions associated with C20orf103. Solute Carrier Family 5 (choline transporter), Member 7 (SLC5A7, Accession NM_021815) is another VGAM896 host target gene. SLC5A7 BINDING SITE is HOST TARGET binding site found in the 3' untranslated region of mRNA encoded by SLC5A7, corresponding to a HOST TARGET binding site such as BINDING SITE I, BINDING SITE II or BINDING SITE III. Table 2 illustrates the complementarity of the nucleotide sequences of SLC5A7 BINDING SITE, designated SEQ ID:22392, to the nucleotide sequence of VGAM896 RNA, herein designated VGAM RNA, also designated SEQ ID:3607.

Another function of VGAM896 is therefore inhibition of Solute Carrier Family 5 (choline transporter), Member 7 (SLC5A7, Accession NM_021815). Accordingly, utilities of VGAM896 include diagnosis, prevention and treatment of diseases and clinical conditions associated with SLC5A7. LOC197201 (Accession XM_113839) is another VGAM896 host target gene. LOC197201 BINDING SITE is HOST TARGET binding site found in the 3' untranslated region of mRNA encoded by LOC197201, corresponding to a HOST TARGET binding site such as BINDING SITE I, BINDING SITE II or BINDING SITE III. Table 2 illustrates the complementarity of the nucleotide sequences of LOC197201 BINDING SITE, designated SEQ ID:42462, to the nucleotide sequence of VGAM896 RNA, herein designated VGAM RNA, also designated SEQ ID:3607.

Another function of VGAM896 is therefore inhibition of LOC197201 (Accession XM_113839). Accordingly, utilities of VGAM896 include diagnosis, prevention and treatment of diseases and clinical conditions associated with LOC197201. LOC254122 (Accession XM_170660) is another VGAM896 host target gene. LOC254122 BINDING SITE is HOST TARGET binding site found in the 3' untranslated region of mRNA encoded by LOC254122, corresponding to a HOST TARGET binding site such as BINDING SITE I, BINDING SITE II or BINDING SITE III. Table 2 illustrates the complementarity of the nucleotide sequences of LOC254122 BINDING SITE, designated SEQ ID:45434, to the nucleotide sequence of VGAM896 RNA, herein designated VGAM RNA, also designated SEQ ID:3607.

Another function of VGAM896 is therefore inhibition of LOC254122 (Accession XM_170660). Accordingly, utilities of VGAM896 include diagnosis, prevention and treatment of diseases and clinical conditions associated with LOC254122. FIG. 1 further provides a conceptual description of a novel bioinformatically detected viral gene of the present invention, referred to here as Viral Genomic Address Messenger 897 (VGAM897) viral gene, which modulates expression of respective host target genes thereof, the function and utility of which host target genes is known in the art.

VGAM897 is a novel bioinformatically detected regulatory, non protein coding, viral micro RNA (miRNA) gene. The method by which VGAM897 was detected is described hereinabove with reference to FIGS. 1-8.

VGAM897 gene, herein designated VGAM GENE, is a viral gene contained in the genome of Gallid Herpesvirus 2. VGAM897 host target gene, herein designated VGAM HOST TARGET GENE, is a human gene contained in the human genome.

VGAM897 gene encodes a VGAM897 precursor RNA, herein designated VGAM PRECURSOR RNA. Similar to other miRNA genes, and unlike most ordinary genes, VGAM897 precursor RNA does not encode a protein. A nucleotide sequence identical or highly similar to the nucleotide sequence of VGAM897 precursor RNA is designated SEQ ID:883, and is provided hereinbelow with reference to the sequence listing part. Nucleotide sequence SEQ ID:883 is located at position 20974 relative to the genome of Gallid Herpesvirus 2.

VGAM897 precursor RNA folds onto itself, forming VGAM897 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM897 folded precursor RNA into VGAM897 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM897 RNA is designated SEQ ID:3608, and is provided hereinbelow with reference to the sequence listing part.

VGAM897 host target gene, herein designated VGAM HOST TARGET GENE, encodes a corresponding messenger RNA, VGAM897 host target RNA, herein designated VGAM HOST TARGET RNA. VGAM897 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM897 RNA, herein designated VGAM RNA, binds complementarily to one or more host target binding sites located in untranslated regions of VGAM897 host target RNA, herein designated VGAM HOST TARGET RNA. This complementary binding is due to the fact that the nucleotide sequence of VGAM897 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM897 RNA, herein designated VGAM RNA, may have a different number of host target binding sites in untranslated regions of a VGAM897 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM897 RNA, herein designated VGAM RNA, to host target binding sites on VGAM897 host target RNA, herein designated VGAM HOST TARGET RNA, such as BINDING SITE I, BINDING SITE II and BINDING SITE III, inhibits translation of VGAM897 host target RNA into VGAM897 host target protein, herein designated VGAM HOST TARGET PROTEIN. VGAM host target protein is therefore outlined by a broken line.

It is appreciated that VGAM897 host target gene, herein designated VGAM HOST TARGET GENE, in fact represents a plurality of VGAM897 host target genes. The mRNA of each one of this plurality of VGAM897 host target genes comprises one or more host target binding sites, each having a nucleotide sequence which is at least partly complementary to VGAM897 RNA, herein designated VGAM RNA, and which when bound by VGAM897 RNA causes inhibition of translation of respective one or more VGAM897 host target proteins.

It is further appreciated by one skilled in the art that the mode of translational inhibition illustrated by FIG. 1 with specific reference to translational inhibition exerted by VGAM897 gene, herein designated VGAM GENE, on one or more VGAM897 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM897 is inhibition of expression of host target genes, as part of a novel viral mechanism of attacking a host. Accordingly, utilities of VGAM897 include diagnosis, prevention and treatment of viral infection by Gallid Herpesvirus 2. Specific functions, and accordingly utilities, of VGAM897 correlate with, and may be deduced from, the identity of the host target genes which VGAM897 binds and inhibits, and the function of these host target genes, as elaborated hereinbelow.

Nucleotide sequences of the VGAM897 precursor RNA, herein designated VGAM PRECURSOR RNA, and of the 'diced' VGAM897 RNA, herein designated VGAM RNA, and a schematic representation of the secondary folding of VGAM897 folded precursor RNA, herein designated VGAM FOLDED PRECURSOR RNA, of VGAM897 are further described hereinbelow with reference to Table 1.

Nucleotide sequences of host target binding sites, such as BINDING SITE-I, BINDING SITE-II and BINDING SITE-III of FIG. 1, found on VGAM897 host target RNA, and schematic representation of the complementarity of each of these host target binding sites to VGAM897 RNA, herein designated VGAM RNA, are described hereinbelow with reference to Table 2.

As mentioned hereinabove with reference to FIG. 1, a function of VGAM897 gene, herein designated VGAM is inhibition of expression of VGAM897 target genes. It is appreciated that specific functions, and accordingly utilities, of VGAM897 correlate with, and may be deduced from, the identity of the target genes which VGAM897 binds and inhibits, and the function of these target genes, as elaborated hereinbelow.

Cytoplasmic Linker Associated Protein 2 (CLASP2, Accession XM_035453) is a VGAM897 host target gene. CLASP2 BINDING SITE is HOST TARGET binding site found in the 3' untranslated region of mRNA encoded by CLASP2, corresponding to a HOST TARGET binding site such as BINDING SITE I, BINDING SITE II or BINDING SITE III. Table 2 illustrates the complementarity of the nucleotide sequences of CLASP2 BINDING SITE, designated SEQ ID:32269, to the nucleotide sequence of VGAM897 RNA, herein designated VGAM RNA, also designated SEQ ID:3608.

A function of VGAM897 is therefore inhibition of Cytoplasmic Linker Associated Protein 2 (CLASP2, Accession XM_035453), a gene which is involved in the regional regulation of microtubule dynamics in motile fibroblasts. Accordingly, utilities of VGAM897 include diagnosis, prevention and treatment of diseases and clinical conditions associated with CLASP2. The function of CLASP2 has been established by previous studies. CLIP170 (OMIM Ref. No. 179838) and CLIP115 (OMIM Ref. No. 603432) are cytoplasmic linker proteins that associate specifically with the ends of growing microtubules and may act as anticatastrophe factors. Using a yeast 2-hybrid screen with an N-terminal region of CLIP115 as bait, followed by cDNA library screening, RACE analysis, and EST database searching, Akhmanova et al. (2001) identified mouse and human cDNAs encoding 2 CLIP-associated proteins, CLASP1 (OMIM Ref. No. 605852) and CLASP2. The CLASPs are homologous to a Drosophila microtubule-associated protein termed Orbit or Mast. CLASP1 is identical to the protein encoded by a partial cDNA, KIAA0622, identified by Ishikawa et al. (1998), although the KIAA0622 protein lacks the N-terminal 249 amino acids of the 1,538-amino acid CLASP1 protein reported by Akhmanova et al. (2001). CLASP2 shares approximately 75% identity with the KIAA0627 protein, which is encoded by a partial cDNA also identified by Ishikawa et al. (1998). There are several CLASP isoforms due to alternative splicing. Northern blot analysis of mouse tissues detected highest expression of Clasp1 in brain, heart, and testis, while Clasp2 mRNAs were enriched in the brain. The Clasp2-beta transcript appeared to be brain specific. By RT-PCR analysis, Ishikawa et al. (1998) detected variable but ubiquitous expression of CLASP2, or KIAA0627, except in spleen. Akhmanova et al. (2001) showed that CLASPs bind CLIPs and microtubules, colocalize with the CLIPs at microtubule distal ends, and have microtubule-stabilizing effects in transfected cells. After serum induction, CLASPs relocalize to distal segments of microtubules at the leading edge of motile fibroblasts. Akhmanova et al. (2001) provided evidence that this asymmetric CLASP distribution is mediated by phosphatidylinositol 3-kinase (see OMIM Ref. No. 171834) and glycogen synthase kinase 3-beta (OMIM Ref. No. 605004). Antibody injections suggested that CLASP2 is required for the orientation of stabilized microtubules toward the leading edge. The authors proposed that CLASPs are involved in the local regulation of microtubule dynamics in response to positional cues.

Full details of the abovementioned studies are described in the following publications, the disclosure of which are hereby incorporated by reference:

Akhmanova, A.; Hoogenraad, C. C.; Drabek, K.; Stepanova, T.; Dortland, B.; Verkerk, T.; Vermeulen, W.; Burgering, B. M.; De Zeeuw, C. I.; Grosveld, F.; Galjart, N.: CLASPs are CLIP-115 and -170 associating proteins involved in the regional regulation of microtubule dynamics in motile fibroblasts. Cell 104:923-935, 2001; and Ishikawa, K.; Nagase, T.; Suyama, M.; Miyajima, N.; Tanaka, A.; Kotani, H.; Nomura, N.; Ohara, O.: Prediction of the coding sequences of unidentified human genes. X. The complete sequ.

Further studies establishing the function and utilities of CLASP2 are found in John Hopkins OMIM database record ID 605853, and in sited publications numbered 662 and 9440 listed in the bibliography section hereinbelow, which are also hereby incorporated by reference. Fucosyltransferase 1 (galactoside 2-alpha-L-fucosyltransferase, Bombay phenotype included) (FUT1, Accession NM_000148) is another VGAM897 host target gene. FUT1 BINDING SITE is HOST TARGET binding site found in the 3' untranslated region of mRNA encoded by FUT1, corresponding to a HOST TARGET binding site such as BINDING SITE I, BINDING SITE II or BINDING SITE III. Table 2 illustrates the complementarity of the nucleotide sequences of FUT1 BINDING SITE, designated SEQ ID:5645, to the nucleotide sequence of VGAM897 RNA, herein designated VGAM RNA, also designated SEQ ID:3608.

Another function of VGAM897 is therefore inhibition of Fucosyltransferase 1 (galactoside 2-alpha-L-fucosyltransferase, Bombay phenotype included) (FUT1, Accession NM_000148). Accordingly, utilities of VGAM897 include diagnosis, prevention and treatment of diseases and clinical conditions associated with FUT1. Nuclear Receptor Subfamily 4, Group A, Member 1 (NR4A1, Accession NM_002135) is another VGAM897 host target gene. NR4A1 BINDING SITE is HOST TARGET binding site found in the 5' untranslated region of mRNA encoded by NR4A1, corresponding to a HOST TARGET binding site such as BINDING SITE I, BINDING SITE II or BINDING SITE III. Table 2 illustrates the complementarity of the nucleotide sequences of NR4A1 BINDING SITE, designated SEQ ID:7911, to the nucleotide sequence of VGAM897 RNA, herein designated VGAM RNA, also designated SEQ ID:3608.

Another function of VGAM897 is therefore inhibition of Nuclear Receptor Subfamily 4, Group A, Member 1 (NR4A1, Accession NM_002135), a gene which is a member of steroid receptor family and binds DNA. Accordingly, utilities of VGAM897 include diagnosis, prevention and treatment of diseases and clinical conditions associated with NR4A1. The function of NR4A1 has been established by previous studies. Ryseck et al. (1989) characterized a growth factor-inducible gene, N10, encoding a nuclear protein of 601 amino acids with similarities to members of the steroid and thyroid hormone receptor families. The gene is rapidly but transiently induced by several mitogens. The N10 transcription unit is 8 kb long and split into 7 exons. The exon-intron distribution is similar to that of other members of the nuclear receptor superfamily. The gene was assigned to mouse chromosome 15 and human chromosome 12 (12q13) by in situ hybridization. These localizations are close to that of the gene encoding gamma retinoic acid receptor (OMIM Ref. No. 180190). Chang et al. (1989) isolated a member of the steroid receptor superfamily, which they called TR3, from a human prostate cDNA library by use of an oligonucleotide probe to the DNA-binding domain common to members of the steroid receptor superfamily. Sequence analysis of the TR3 cDNA revealed that it encodes a 598-amino acid protein with domains homologous to the DNA-binding and hormone-binding domains of other members of the steroid receptor superfamily. Chang et al. (1989) found that the TR3 receptor shares about 20% amino acid homology with the estrogen receptor and less than 15% homology with other known receptors. The authors noted that the TR3 gene may be the human homolog of the mouse nur77 gene, with which it shares 91% amino acid identity. Expression of the TR3 cDNA in rabbit reticulocyte lysate produced a 64-kD DNA-binding protein.

Full details of the abovementioned studies are described in the following publications, the disclosure of which are hereby incorporated by reference:

Chang, C.; Kokontis, J.; Liao, S. S.; Chang, Y.: Isolation and characterization of human TR3 receptor: a member of steroid receptor superfamily. J. Steroid Biochem. 34:391-395, 1989; and Ryseck, R.-P.; Macdonald-Bravo, H.; Mattei, M. G.; Siegfried, R. L.; Bravo, R.: Structure, mapping and expression of a growth factor inducible gene encoding a putative nuclear hormonal.

Further studies establishing the function and utilities of NR4A1 are found in John Hopkins OMIM database record ID 139139, and in sited publications numbered 4728-4737 listed in the bibliography section hereinbelow, which are also hereby incorporated by reference. Tumor Necrosis Factor Receptor Superfamily, Member 17 (TNFRSF17, Accession NM_001192) is another VGAM897 host target gene. TNFRSF17 BINDING SITE is HOST TARGET binding site found in the 5' untranslated region of mRNA encoded by TNFRSF17, corresponding to a HOST TARGET binding site such as BINDING SITE I, BINDING SITE II or BINDING SITE III. Table 2 illustrates the complementarity of the nucleotide sequences of TNFRSF17 BINDING SITE, designated SEQ ID:6862, to the nucleotide sequence of VGAM897 RNA, herein designated VGAM RNA, also designated SEQ ID:3608.

Another function of VGAM897 is therefore inhibition of Tumor Necrosis Factor Receptor Superfamily, Member 17 (TNFRSF17, Accession NM_001192), a gene which associates with B lymphocyte maturation. Accordingly, utilities of VGAM897 include diagnosis, prevention and treatment of diseases and clinical conditions associated with TNFRSF17. The function of TNFRSF17 has been established by previous studies. Laabi et al. (1992) found that a t (4;16)(q26; p13.1) translocation, found in tumor cells of a patient with intestinal T-cell lymphoma, resulted in a rearrangement of the interleukin-2 gene (IL2; 147680), normally located on 4q26, with sequences from 16p13.1. Use of an IL2-specific probe to screen a cDNA library of tumor cells, Laabi et al. (1992) isolated clones that consisted, from 5-prime to 3-prime, of the 3 first exons of the IL2 gene, followed by a 16p13 in-frame sequence encoding 181 amino acids. A probe derived from this sequence detected a 1.2-kb transcript in various cell lines exhibiting mature B lymphoid cell features, but this sequence was not detected in other cell lines representative of other hematopoietic lineages, or in other organs. For this reason, the novel gene was termed BCM for B-cell maturation. The open reading frame of normal BCM cDNA predicted a 184-amino acid protein with a single transmembrane domain that had no homology with any protein sequences stored in data banks. Data indicated that the expression of BCM coincides with B-cell terminal maturation. Gras et al. (1995) found that in a myeloma cell line, BCMA is primarily expressed in a perinuclear Golgi-like structure. By transfection of kidney and B-cell lines and flow cytometry and immunofluorescence analysis, Hatzoglou et al. (2000) demonstrated that in addition to the intracytoplasmic localization, BCMA is present on the cell surface. Western blot analysis showed that overexpressed BCMA, like other TNFRs, induces activation of NFKB (OMIM Ref. No. 164011) as well as the MAPK substrate ELK1 (OMIM Ref. No. 311040) and the MAPKs JNK (MAPK8; 601158) and p38 (MAPK14; 600289), but not ERK (OMIM Ref. No. 600997), via its cytoplasmic tail (residues 119 to 143). Cotransfection, immunoprecipitation, and immunoblot analysis indicated that BCMA, again through its cytoplasmic tail, associates with TRAF1 601711, TRAF2 601895, and TRAF3 601896, but not with TRAF5 602356, suggesting that these adaptor proteins further propagate signals elicited by TNFRs such as BCMA.

Full details of the abovementioned studies are described in the following publications, the disclosure of which are hereby incorporated by reference:

Laabi, Y.; Gras, M. P.; Carbonnel, F.; Brouet, J. C.; Berger, R.; Larsen, C. J.; Tsapis, A.: A new gene, BCM, on chromosome 16 is fused to the interleukin 2 gene by a t (4;16)(q26; p13) translocation in a malignant T cell lymphoma. EMBO J. 11:3897-3904, 1992; and Hatzoglou, A.; Roussel, J.; Bourgeade, M.-F.; Rogier, E.; Madry, C.; Inoue, J.; Devergne, O.; Tsapis, A.: TNF receptor family member BCMA (B cell maturation) associates with TNF recepto.

Further studies establishing the function and utilities of TNFRSF17 are found in John Hopkins OMIM database record ID 109545, and in sited publications numbered 50 and 3161 listed in the bibliography section hereinbelow, which are also hereby incorporated by reference. Chemokine (C-C motif) Receptor 6 (CCR6, Accession NM_031409) is another VGAM897 host target gene. CCR6 BINDING SITE is HOST TARGET binding site found in the 5' untranslated region of mRNA encoded by CCR6, corresponding to a HOST TARGET binding site such as BINDING SITE I, BINDING SITE II or BINDING SITE III. Table 2 illustrates the complementarity of the nucleotide sequences of CCR6 BINDING SITE, designated SEQ ID:25371, to the nucleotide sequence of VGAM897 RNA, herein designated VGAM RNA, also designated SEQ ID:3608.

Another function of VGAM897 is therefore inhibition of Chemokine (C-C motif) Receptor 6 (CCR6, Accession NM_031409). Accordingly, utilities of VGAM897 include diagnosis, prevention and treatment of diseases and clinical conditions associated with CCR6. Down Syndrome Critical Region Gene 1-like 1 (DSCR1L1, Accession NM_005822) is another VGAM897 host target gene. DSCR1L1 BINDING SITE is HOST TARGET binding site found in the 3' untranslated region of mRNA encoded by DSCR1L1, corresponding to a HOST TARGET binding site such as BINDING SITE I, BINDING SITE II or BINDING SITE III. Table 2 illustrates the complementarity of the nucleotide sequences of DSCR1L1 BINDING SITE, designated SEQ ID:12430, to the nucleotide sequence of VGAM897 RNA, herein designated VGAM RNA, also designated SEQ ID:3608.

Another function of VGAM897 is therefore inhibition of Down Syndrome Critical Region Gene 1-like 1 (DSCR1L1, Accession NM_005822). Accordingly, utilities of VGAM897 include diagnosis, prevention and treatment of diseases and clinical conditions associated with DSCR1L1. FLJ10826 (Accession NM_018233) is another VGAM897 host target gene. FLJ10826 BINDING SITE is HOST TARGET binding site found in the 3' untranslated region of mRNA encoded by FLJ10826, corresponding to a HOST TARGET binding site such as BINDING SITE I, BINDING SITE II or BINDING SITE III. Table 2 illustrates the complementarity of the nucleotide sequences of FLJ10826 BINDING SITE, designated SEQ ID:20174, to the nucleotide sequence of VGAM897 RNA, herein designated VGAM RNA, also designated SEQ ID:3608.

Another function of VGAM897 is therefore inhibition of FLJ10826 (Accession NM_018233). Accordingly, utilities of VGAM897 include diagnosis, prevention and treatment of diseases and clinical conditions associated with FLJ10826. FLJ12888 (Accession NM_024945) is another VGAM897 host target gene. FLJ12888 BINDING SITE is HOST TARGET binding site found in the 3' untranslated region of mRNA encoded by FLJ12888, corresponding to a HOST TARGET binding site such as BINDING SITE I, BINDING SITE II or BINDING SITE III. Table 2 illustrates the complementarity of the nucleotide sequences of FLJ12888 BINDING SITE, designated SEQ ID:24497, to the nucleotide sequence of VGAM897 RNA, herein designated VGAM RNA, also designated SEQ ID:3608.

Another function of VGAM897 is therefore inhibition of FLJ12888 (Accession NM_024945). Accordingly, utilities of VGAM897 include diagnosis, prevention and treatment of diseases and clinical conditions associated with FLJ12888. Golgi Phosphoprotein 2 (GOLPH2, Accession NM_016548) is another VGAM897 host target gene. GOLPH2 BINDING SITE is HOST TARGET binding site found in the 3' untranslated region of mRNA encoded by GOLPH2, corresponding to a HOST TARGET binding site such as BINDING SITE I, BINDING SITE II or BINDING SITE III. Table 2 illustrates the complementarity of the nucleotide sequences of GOLPH2 BINDING SITE, designated SEQ ID:18623, to the nucleotide sequence of VGAM897 RNA, herein designated VGAM RNA, also designated SEQ ID:3608.

Another function of VGAM897 is therefore inhibition of Golgi Phosphoprotein 2 (GOLPH2, Accession NM_016548). Accordingly, utilities of VGAM897 include diagnosis, prevention and treatment of diseases and clinical conditions associated with GOLPH2. LOC168667 (Accession XM_166592) is another VGAM897 host target gene. LOC168667 BINDING SITE is HOST TARGET binding site found in the 3' untranslated region of mRNA encoded by LOC168667, corresponding to a HOST TARGET binding site such as BINDING SITE I, BINDING SITE II or BINDING SITE III. Table 2 illustrates the complementarity of the nucleotide sequences of LOC168667 BINDING SITE, designated SEQ ID:44568, to the nucleotide sequence of VGAM897 RNA, herein designated VGAM RNA, also designated SEQ ID:3608.

Another function of VGAM897 is therefore inhibition of LOC168667 (Accession XM_166592). Accordingly, utilities of VGAM897 include diagnosis, prevention and treatment of diseases and clinical conditions associated with LOC168667. LOC204010 (Accession XM_115138) is another VGAM897 host target gene. LOC204010 BINDING SITE is HOST TARGET binding site found in the 5' untranslated region of mRNA encoded by LOC204010, corresponding to a HOST TARGET binding site such as BINDING SITE I, BINDING SITE II or BINDING SITE III. Table 2 illustrates the complementarity of the nucleotide sequences of LOC204010 BINDING SITE, designated SEQ ID:43082, to the nucleotide sequence of VGAM897 RNA, herein designated VGAM RNA, also designated SEQ ID:3608.

Another function of VGAM897 is therefore inhibition of LOC204010 (Accession XM_115138). Accordingly, utilities of VGAM897 include diagnosis, prevention and treatment of diseases and clinical conditions associated with LOC204010. FIG. 1 further provides a conceptual description of a novel bioinformatically detected viral gene of the present invention, referred to here as Viral Genomic Address Messenger 898 (VGAM898) viral gene, which modulates expression of respective host target genes thereof, the function and utility of which host target genes is known in the art.

VGAM898 is a novel bioinformatically detected regulatory, non protein coding, viral micro RNA (miRNA) gene. The method by which VGAM898 was detected is described hereinabove with reference to FIGS. 1-8.

VGAM898 gene, herein designated VGAM GENE, is a viral gene contained in the genome of Cowpea Mottle Virus. VGAM898 host target gene, herein designated VGAM HOST TARGET GENE, is a human gene contained in the human genome.

VGAM898 gene encodes a VGAM898 precursor RNA, herein designated VGAM PRECURSOR RNA. Similar to other miRNA genes, and unlike most ordinary genes, VGAM898 precursor RNA does not encode a protein. A nucleotide sequence identical or highly similar to the nucleotide sequence of VGAM898 precursor RNA is designated SEQ ID:884, and is provided hereinbelow with reference to the sequence listing part. Nucleotide sequence SEQ ID:884 is located at position 3264 relative to the genome of Cowpea Mottle Virus.

VGAM898 precursor RNA folds onto itself, forming VGAM898 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM898 folded precursor RNA into VGAM898 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM898 RNA is designated SEQ ID:3609, and is provided hereinbelow with reference to the sequence listing part.

VGAM898 host target gene, herein designated VGAM HOST TARGET GENE, encodes a corresponding messenger RNA, VGAM898 host target RNA, herein designated VGAM HOST TARGET RNA. VGAM898 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM898 RNA, herein designated VGAM RNA, binds complementarily to one or more host target binding sites located in untranslated regions of VGAM898 host target RNA, herein designated VGAM HOST TARGET RNA. This complementary binding is due to the fact that the nucleotide sequence of VGAM898 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM898 RNA, herein designated VGAM RNA, may have a different number of host target binding sites in untranslated regions of a VGAM898 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM898 RNA, herein designated VGAM RNA, to host target binding sites on VGAM898 host target RNA, herein designated VGAM HOST TARGET RNA, such as BINDING SITE I, BINDING SITE II and BINDING SITE III, inhibits translation of VGAM898 host target RNA into VGAM898 host target protein, herein designated VGAM HOST TARGET PROTEIN. VGAM host target protein is therefore outlined by a broken line.

It is appreciated that VGAM898 host target gene, herein designated VGAM HOST TARGET GENE, in fact represents a plurality of VGAM898 host target genes. The mRNA of each one of this plurality of VGAM898 host target genes comprises one or more host target binding sites, each having a nucleotide sequence which is at least partly complementary to VGAM898 RNA, herein designated VGAM RNA, and which when bound by VGAM898 RNA causes inhibition of translation of respective one or more VGAM898 host target proteins.

It is further appreciated by one skilled in the art that the mode of translational inhibition illustrated by FIG. 1 with specific reference to translational inhibition exerted by VGAM898 gene, herein designated VGAM GENE, on one or more VGAM898 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM898 is inhibition of expression of host target genes, as part of a novel viral mechanism of attacking a host. Accordingly, utilities of VGAM898 include diagnosis, prevention and treatment of viral infection by Cowpea Mottle Virus. Specific functions, and accordingly utilities, of VGAM898 correlate with, and may be deduced from, the identity of the host target genes which VGAM898 binds and inhibits, and the function of these host target genes, as elaborated hereinbelow.

Nucleotide sequences of the VGAM898 precursor RNA, herein designated VGAM PRECURSOR RNA, and of the 'diced' VGAM898 RNA, herein designated VGAM RNA, and a schematic representation of the secondary folding of VGAM898 folded precursor RNA, herein designated VGAM FOLDED PRECURSOR RNA, of VGAM898 are further described hereinbelow with reference to Table 1.

Nucleotide sequences of host target binding sites, such as BINDING SITE-I, BINDING SITE-II and BINDING SITE-III of FIG. 1, found on VGAM898 host target RNA, and schematic representation of the complementarity of each of these host target binding sites to VGAM898 RNA, herein designated VGAM RNA, are described hereinbelow with reference to Table 2.

As mentioned hereinabove with reference to FIG. 1, a function of VGAM898 gene, herein designated VGAM is inhibition of expression of VGAM898 target genes. It is appreciated that specific functions, and accordingly utilities, of VGAM898 correlate with, and may be deduced from, the identity of the target genes which VGAM898 binds and inhibits, and the function of these target genes, as elaborated hereinbelow.

DKFZP564O0423 (Accession XM_166254) is a VGAM898 host target gene. DKFZP564O0423 BINDING SITE is HOST TARGET binding site found in the 3' untranslated region of mRNA encoded by DKFZP564O0423, corresponding to a HOST TARGET binding site such as BINDING SITE I, BINDING SITE II or BINDING SITE III. Table 2 illustrates the complementarity of the nucleotide sequences of DKFZP564O0423 BINDING SITE, designated SEQ ID:44069, to the nucleotide sequence of VGAM898 RNA, herein designated VGAM RNA, also designated SEQ ID:3609.

A function of VGAM898 is therefore inhibition of DKFZP564O0423 (Accession XM_166254). Accordingly, utilities of VGAM898 include diagnosis, prevention and treatment of diseases and clinical conditions associated with DKFZP564O0423. FLJ14251 (Accession NM_024881) is another VGAM898 host target gene. FLJ14251 BINDING SITE is HOST TARGET binding site found in the 3' untranslated region of mRNA encoded by FLJ14251, corresponding to a HOST TARGET binding site such as BINDING SITE I, BINDING SITE II or BINDING SITE III. Table 2 illustrates the complementarity of the nucleotide sequences of FLJ14251 BINDING SITE, designated SEQ ID:24322, to the nucleotide sequence of VGAM898 RNA, herein designated VGAM RNA, also designated SEQ ID:3609.

Another function of VGAM898 is therefore inhibition of FLJ14251 (Accession NM_024881). Accordingly, utilities of VGAM898 include diagnosis, prevention and treatment of diseases and clinical conditions associated with FLJ14251. FLJ32743 (Accession NM_145020) is another VGAM898 host target gene. FLJ32743 BINDING SITE is HOST TARGET binding site found in the 5' untranslated region of mRNA encoded by FLJ32743, corresponding to a HOST TARGET binding site such as BINDING SITE I, BINDING SITE II or BINDING SITE III. Table 2 illustrates the complementarity of the nucleotide sequences of FLJ32743 BINDING SITE, designated SEQ ID:29628, to the nucleotide sequence of VGAM898 RNA, herein designated VGAM RNA, also designated SEQ ID:3609.

Another function of VGAM898 is therefore inhibition of FLJ32743 (Accession NM_145020). Accordingly, utilities of VGAM898 include diagnosis, prevention and treatment of diseases and clinical conditions associated with FLJ32743.

MGC20486 (Accession NM_052844) is another VGAM898 host target gene. MGC20486 BINDING SITE is HOST TARGET binding site found in the 5' untranslated region of mRNA encoded by MGC20486, corresponding to a HOST TARGET binding site such as BINDING SITE I, BINDING SITE II or BINDING SITE III. Table 2 illustrates the complementarity of the nucleotide sequences of MGC20486 BINDING SITE, designated SEQ ID:27423, to the nucleotide sequence of VGAM898 RNA, herein designated VGAM RNA, also designated SEQ ID:3609.

Another function of VGAM898 is therefore inhibition of MGC20486 (Accession NM_052844). Accordingly, utilities of VGAM898 include diagnosis, prevention and treatment of diseases and clinical conditions associated with MGC20486. Zinc Finger Protein 226 (ZNF226, Accession NM_016444) is another VGAM898 host target gene. ZNF226 BINDING SITE is HOST TARGET binding site found in the 5' untranslated region of mRNA encoded by ZNF226, corresponding to a HOST TARGET binding site such as BINDING SITE I, BINDING SITE II or BINDING SITE III. Table 2 illustrates the complementarity of the nucleotide sequences of ZNF226 BINDING SITE, designated SEQ ID:18564, to the nucleotide sequence of VGAM898 RNA, herein designated VGAM RNA, also designated SEQ ID:3609.

Another function of VGAM898 is therefore inhibition of Zinc Finger Protein 226 (ZNF226, Accession NM_016444). Accordingly, utilities of VGAM898 include diagnosis, prevention and treatment of diseases and clinical conditions associated with ZNF226. LOC151614 (Accession XM_087252) is another VGAM898 host target gene. LOC151614 BINDING SITE is HOST TARGET binding site found in the 3' untranslated region of mRNA encoded by LOC151614, corresponding to a HOST TARGET binding site such as BINDING SITE I, BINDING SITE II or BINDING SITE III. Table 2 illustrates the complementarity of the nucleotide sequences of LOC151614 BINDING SITE, designated SEQ ID:39141, to the nucleotide sequence of VGAM898 RNA, herein designated VGAM RNA, also designated SEQ ID:3609.

Another function of VGAM898 is therefore inhibition of LOC151614 (Accession XM_087252). Accordingly, utilities of VGAM898 include diagnosis, prevention and treatment of diseases and clinical conditions associated with LOC151614. FIG. 1 further provides a conceptual description of a novel bioinformatically detected viral gene of the present invention, referred to here as Viral Genomic Address Messenger 899 (VGAM899) viral gene, which modulates expression of respective host target genes thereof, the function and utility of which host target genes is known in the art.

VGAM899 is a novel bioinformatically detected regulatory, non protein coding, viral micro RNA (miRNA) gene. The method by which VGAM899 was detected is described hereinabove with reference to FIGS. 1-8.

VGAM899 gene, herein designated VGAM GENE, is a viral gene contained in the genome of Human Herpesvirus 2. VGAM899 host target gene, herein designated VGAM HOST TARGET GENE, is a human gene contained in the human genome.

VGAM899 gene encodes a VGAM899 precursor RNA, herein designated VGAM PRECURSOR RNA. Similar to other miRNA genes, and unlike most ordinary genes, VGAM899 precursor RNA does not encode a protein. A nucleotide sequence identical or highly similar to the nucleotide sequence of VGAM899 precursor RNA is designated SEQ ID:885, and is provided hereinbelow with reference to the sequence listing part. Nucleotide sequence SEQ ID:885 is located at position 46153 relative to the genome of Human Herpesvirus 2.

VGAM899 precursor RNA folds onto itself, forming VGAM899 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM899 folded precursor RNA into VGAM899 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM899 RNA is designated SEQ ID:3610, and is provided hereinbelow with reference to the sequence listing part.

VGAM899 host target gene, herein designated VGAM HOST TARGET GENE, encodes a corresponding messenger RNA, VGAM899 host target RNA, herein designated VGAM HOST TARGET RNA. VGAM899 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM899 RNA, herein designated VGAM RNA, binds complementarily to one or more host target binding sites located in untranslated regions of VGAM899 host target RNA, herein designated VGAM HOST TARGET RNA. This complementary binding is due to the fact that the nucleotide sequence of VGAM899 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM899 RNA, herein designated VGAM RNA, may have a different number of host target binding sites in untranslated regions of a VGAM899 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM899 RNA, herein designated VGAM RNA, to host target binding sites on VGAM899 host target RNA, herein designated VGAM HOST TARGET RNA, such as BINDING SITE I, BINDING SITE II and BINDING SITE III, inhibits translation of VGAM899 host target RNA into VGAM899 host target protein, herein designated VGAM HOST TARGET PROTEIN. VGAM host target protein is therefore outlined by a broken line.

It is appreciated that VGAM899 host target gene, herein designated VGAM HOST TARGET GENE, in fact represents a plurality of VGAM899 host target genes. The mRNA of each one of this plurality of VGAM899 host target genes comprises one or more host target binding sites, each having a nucleotide sequence which is at least partly complementary to VGAM899 RNA, herein designated VGAM RNA, and which when bound by VGAM899 RNA causes inhibition of translation of respective one or more VGAM899 host target proteins.

It is further appreciated by one skilled in the art that the mode of translational inhibition illustrated by FIG. 1 with specific reference to translational inhibition exerted by VGAM899 gene, herein designated VGAM GENE, on one or more VGAM899 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM899 is inhibition of expression of host target genes, as part of a novel viral mechanism of attacking a host. Accordingly, utilities of VGAM899 include diagnosis, prevention and treatment of viral infection by Human Herpesvirus 2. Specific functions, and accordingly utilities, of VGAM899 correlate with, and may be deduced from, the identity of the host target genes which VGAM899 binds and inhibits, and the function of these host target genes, as elaborated hereinbelow.

Nucleotide sequences of the VGAM899 precursor RNA, herein designated VGAM PRECURSOR RNA, and of the 'diced' VGAM899 RNA, herein designated VGAM RNA, and a schematic representation of the secondary folding of VGAM899 folded precursor RNA, herein designated VGAM FOLDED PRECURSOR RNA, of VGAM899 are further described hereinbelow with reference to Table 1.

Nucleotide sequences of host target binding sites, such as BINDING SITE-I, BINDING SITE-II and BINDING SITE-III of FIG. 1, found on VGAM899 host target RNA, and schematic representation of the complementarity of each of these host target binding sites to VGAM899 RNA, herein designated VGAM RNA, are described hereinbelow with reference to Table 2.

As mentioned hereinabove with reference to FIG. 1, a function of VGAM899 gene, herein designated VGAM is inhibition of expression of VGAM899 target genes. It is appreciated that specific functions, and accordingly utilities, of VGAM899 correlate with, and may be deduced from, the identity of the target genes which VGAM899 binds and inhibits, and the function of these target genes, as elaborated hereinbelow.

Aquaporin 6, Kidney Specific (AQP6, Accession NM_001652) is a VGAM899 host target gene. AQP6 BINDING SITE1 and AQP6 BINDING SITE2 are HOST TARGET binding sites found in untranslated regions of mRNA encoded by AQP6, corresponding to HOST TARGET binding sites such as BINDING SITE I, BINDING SITE II or BINDING SITE III. Table 2 illustrates the complementarity of the nucleotide sequences of AQP6 BINDING SITE1 and AQP6 BINDING SITE2, designated SEQ ID:7358 and SEQ ID:27612 respectively, to the nucleotide sequence of VGAM899 RNA, herein designated VGAM RNA, also designated SEQ ID:3610.

A function of VGAM899 is therefore inhibition of Aquaporin 6, Kidney Specific (AQP6, Accession NM_001652), a gene which participates in distinct physiologic function such as glomerular filtration, tubular endocytosis, and acid-base metabolism. Accordingly, utilities of VGAM899 include diagnosis, prevention and treatment of diseases and clinical conditions associated with AQP6. The function of AQP6 and its association with various diseases and clinical conditions, has been established by previous studies, as described hereinabove with reference to VGAM340. Calcium Channel, Voltage-dependent, P/Q Type, Alpha 1A Subunit (CACNA1A, Accession NM_000068) is another VGAM899 host target gene. CACNA1A BINDING SITE1 and CACNA1A BINDING SITE2 are HOST TARGET binding sites found in untranslated regions of mRNA encoded by CACNA1A, corresponding to HOST TARGET binding sites such as BINDING SITE I, BINDING SITE II or BINDING SITE III. Table 2 illustrates the complementarity of the nucleotide sequences of CACNA1A BINDING SITE1 and CACNA1A BINDING SITE2, designated SEQ ID:5515 and SEQ ID:35106 respectively, to the nucleotide sequence of VGAM899 RNA, herein designated VGAM RNA, also designated SEQ ID:3610.

Another function of VGAM899 is therefore inhibition of Calcium Channel, Voltage-dependent, P/Q Type, Alpha 1A Subunit (CACNA1A, Accession NM_000068). Accordingly, utilities of VGAM899 include diagnosis, prevention and treatment of diseases and clinical conditions associated with CACNA1A. G Protein-coupled Receptor 62 (GPR62, Accession XM_116151) is another VGAM899 host target gene. GPR62 BINDING SITE is HOST TARGET binding site found in the 5' untranslated region of mRNA encoded by GPR62, corresponding to a HOST TARGET binding site such as BINDING SITE I, BINDING SITE II or BINDING SITE III. Table 2 illustrates the complementarity of the nucleotide sequences of GPR62 BINDING SITE, designated SEQ ID:43109, to the nucleotide sequence of VGAM899 RNA, herein designated VGAM RNA, also designated SEQ ID:3610.

Another function of VGAM899 is therefore inhibition of G Protein-coupled Receptor 62 (GPR62, Accession XM_116151). Accordingly, utilities of VGAM899 include diagnosis, prevention and treatment of diseases and clinical conditions associated with GPR62. Solute Carrier Family 17 (anion/sugar transporter), Member 5 (SLC17A5, Accession NM_012434) is another VGAM899 host target gene. SLC17A5 BINDING SITE is HOST TARGET binding site found in the 3' untranslated region of mRNA encoded by SLC17A5, corresponding to a HOST TARGET binding site such as BINDING SITE I, BINDING SITE II or BINDING SITE III. Table 2 illustrates the complementarity of the nucleotide sequences of SLC17A5 BINDING SITE, designated SEQ ID:14812, to the nucleotide sequence of VGAM899 RNA, herein designated VGAM RNA, also designated SEQ ID:3610.

Another function of VGAM899 is therefore inhibition of Solute Carrier Family 17 (anion/sugar transporter), Member 5 (SLC17A5, Accession NM_012434), a gene which is a member of a family of anion/cation symporters. Accordingly, utilities of VGAM899 include diagnosis, prevention and treatment of diseases and clinical conditions associated with SLC17A5. The function of SLC17A5 and its association with various diseases and clinical conditions, has been established by previous studies, as described hereinabove with reference to VGAM766. Transglutaminase 2 (C polypeptide, protein-glutamine-gamma-glutamyltransferase) (TGM2, Accession NM_004613) is another VGAM899 host target gene. TGM2 BINDING SITE is HOST TARGET binding site found in the 3' untranslated region of mRNA encoded by TGM2, corresponding to a HOST TARGET binding site such as BINDING SITE I, BINDING SITE II or BINDING SITE III. Table 2 illustrates the complementarity of the nucleotide sequences of TGM2 BINDING SITE, designated SEQ ID:10953, to the nucleotide sequence of VGAM899 RNA, herein designated VGAM RNA, also designated SEQ ID:3610.

Another function of VGAM899 is therefore inhibition of Transglutaminase 2 (C polypeptide, protein-glutamine-gamma-glutamyltransferase) (TGM2, Accession NM_004613), a gene which catalyzes the cross-linking of proteins and the conjugation of polyamines to proteins. Accordingly, utilities of VGAM899 include diagnosis, prevention and treatment of diseases and clinical conditions associated with TGM2. The function of TGM2 has been established by previous studies. Transglutaminases (EC 2.3.2.13) are a family of enzymes that catalyze the crosslinking of proteins by epsilon-gamma glutamyl lysine isopeptide bonds. The transglutaminases include factor XIII (plasma transglutaminase; 134570), keratinocyte transglutaminase (TGM1; 190195), hair follicle transglutaminase, prostate transglutaminase (TGM4; 600585), and tissue transglutaminase (TGM2). Although the overall primary structures of these enzymes appear to be quite different, they all share a common amino acid sequence at the active site (Y-G-Q-C-W) and a strict calcium dependence for their activity. The differences in the primary structures of these different transglutaminases are probably responsible for the diverse biologic functions that they play in physiologic processes such as blood coagulation, epidermal differentiation, seminal fluid coagulation and fertilization, cell differentiation, and apoptosis. Dieterich et al. (1997) demonstrated that tissue transglutaminase is the autoantigen involved in celiac disease (OMIM Ref. No. 212750). Gentile et al. (1991) isolated mouse and human cDNAs encoding tissue transglutaminase. The predicted 687-amino acid human protein is 84% and 81% identical to mouse and guinea pig tissue transglutaminase, respectively. In vitro translated human tissue transglutaminase has an apparent molecular mass of 85 kD by SDS-PAGE. The translated product exhibited calcium-dependent catalytic activity. Northern blot analysis revealed that tissue transglutaminase is expressed as a 3.6-kb mRNA in human endothelial cells. Lu et al. (1995) cloned the promoter region of TGM2, ligated it to a reporter construct, and demonstrated its activity in transient transfection experiments.

Full details of the abovementioned studies are described in the following publications, the disclosure of which are hereby incorporated by reference:

Dieterich, W.; Ehnis, T.; Bauer, M.; Donner, P.; Volta, U.; Riecken, E. O.; Schuppan, D.: Identification of tissue transglutaminase as the autoantigen of celiac disease. Nature Med. 3:797-801, 1997; and Gentile, V.; Saydak, M.; Chiocca, E. A.; Akande, O.; Birckbichler, P. J.; Lee, K. N.; Stein, J. P.; Davies, P. J. A.: Isolation and characterization of cDNA clones to mouse macrophage a.

Further studies establishing the function and utilities of TGM2 are found in John Hopkins OMIM database record ID 190196, and in sited publications numbered 5736-5740 listed in the bibliography section hereinbelow, which are also hereby incorporated by reference. Zinc Finger Protein 36, C3H Type-like 1 (ZFP36L1, Accession NM_004926) is another VGAM899 host target gene. ZFP36L1 BINDING SITE is HOST TARGET binding site found in the 3' untranslated region of mRNA encoded by ZFP36L1, corresponding to a HOST TARGET binding site such as BINDING SITE I, BINDING SITE II or BINDING SITE III. Table 2 illustrates the complementarity of the nucleotide sequences of ZFP36L1 BINDING SITE, designated SEQ ID:11363, to the nucleotide sequence of VGAM899 RNA, herein designated VGAM RNA, also designated SEQ ID:3610.

Another function of VGAM899 is therefore inhibition of Zinc Finger Protein 36, C3H Type-like 1 (ZFP36L1, Accession NM_004926), a gene which is a regulatory protein involved in regulating the response to growth factors. Accordingly, utilities of VGAM899 include diagnosis, prevention and treatment of diseases and clinical conditions associated with ZFP36L1. The function of ZFP36L1 and its association with various diseases and clinical conditions, has been established by previous studies, as described hereinabove with reference to VGAM74. ARP1 Actin-related Protein 1 Homolog A, Centractin Alpha (yeast) (ACTR1A, Accession XM_031949) is another VGAM899 host target gene. ACTR1A BINDING SITE is HOST TARGET binding site found in the 3' untranslated region of mRNA encoded by ACTR1A, corresponding to a HOST TARGET binding site such as BINDING SITE I, BINDING SITE II or BINDING SITE III. Table 2 illustrates the complementarity of the nucleotide sequences of ACTR1A BINDING SITE, designated SEQ ID:31532, to the nucleotide sequence of VGAM899 RNA, herein designated VGAM RNA, also designated SEQ ID:3610.

Another function of VGAM899 is therefore inhibition of ARP1 Actin-related Protein 1 Homolog A, Centractin Alpha (yeast) (ACTR1A, Accession XM_031949). Accordingly, utilities of VGAM899 include diagnosis, prevention and treatment of diseases and clinical conditions associated with ACTR1A. Chromosome 20 Open Reading Frame 28 (C20orf28, Accession NM_015417) is another VGAM899 host target gene. C20orf28 BINDING SITE is HOST TARGET binding site found in the 3" untranslated region of mRNA encoded by C20orf28, corresponding to a HOST TARGET binding site such as BINDING SITE I, BINDING SITE II or BINDING SITE III. Table 2 illustrates the complementarity of the nucleotide sequences of C20orf28 BINDING SITE, designated SEQ ID:17719, to the nucleotide sequence of VGAM899 RNA, herein designated VGAM RNA, also designated SEQ ID:3610.

Another function of VGAM899 is therefore inhibition of Chromosome 20 Open Reading Frame 28 (C20orf28, Accession NM_015417). Accordingly, utilities of VGAM899 include diagnosis, prevention and treatment of diseases and clinical conditions associated with C20orf28. KIAA1322 (Accession XM_052626) is another VGAM899 host target gene. KIAA1322 BINDING SITE is HOST TARGET binding site found in the 3' untranslated region of mRNA encoded by KIAA1322, corresponding to a HOST TARGET binding site such as BINDING SITE I, BINDING SITE II or BINDING SITE III. Table 2 illustrates the complementarity of the nucleotide sequences of KIAA1322 BINDING SITE, designated SEQ ID:36022, to the nucleotide sequence of VGAM899 RNA, herein designated VGAM RNA, also designated SEQ ID:3610.

Another function of VGAM899 is therefore inhibition of KIAA1322 (Accession XM_052626). Accordingly, utilities of VGAM899 include diagnosis, prevention and treatment of diseases and clinical conditions associated with KIAA1322. KIAA1372 (Accession XM_166244) is another VGAM899 host target gene. KIAA1372 BINDING SITE is HOST TARGET binding site found in the 5' untranslated region of mRNA encoded by KIAA1372, corresponding to a HOST TARGET binding site such as BINDING SITE I, BINDING SITE II or BINDING SITE III. Table 2 illustrates the complementarity of the nucleotide sequences of KIAA1372 BINDING SITE, designated SEQ ID:44057, to the nucleotide sequence of VGAM899 RNA, herein designated VGAM RNA, also designated SEQ ID:3610.

Another function of VGAM899 is therefore inhibition of KIAA1372 (Accession XM_166244). Accordingly, utilities of VGAM899 include diagnosis, prevention and treatment of diseases and clinical conditions associated with KIAA1372. KIAA1453 (Accession NM_025090) is another VGAM899 host target gene. KIAA1453 BINDING SITE is HOST TARGET binding site found in the 5' untranslated region of mRNA encoded by KIAA1453, corresponding to a HOST TARGET binding site such as BINDING SITE I, BINDING SITE II or BINDING SITE III. Table 2 illustrates the complementarity of the nucleotide sequences of KIAA1453 BINDING SITE, designated SEQ ID:24712, to the nucleotide sequence of VGAM899 RNA, herein designated VGAM RNA, also designated SEQ ID:3610.

Another function of VGAM899 is therefore inhibition of KIAA1453 (Accession NM_025090). Accordingly, utilities of VGAM899 include diagnosis, prevention and treatment of diseases and clinical conditions associated with KIAA1453. MGC4342 (Accession NM_024329) is another VGAM899 host target gene. MGC4342 BINDING SITE is HOST TARGET binding site found in the 3' untranslated region of mRNA encoded by MGC4342, corresponding to a HOST TARGET binding site such as BINDING SITE I, BINDING SITE II or BINDING SITE III. Table 2 illustrates the complementarity of the nucleotide sequences of MGC4342 BINDING SITE, designated SEQ ID:23622, to the nucleotide sequence of VGAM899 RNA, herein designated VGAM RNA, also designated SEQ ID:3610.

Another function of VGAM899 is therefore inhibition of MGC4342 (Accession NM_024329). Accordingly, utilities of VGAM899 include diagnosis, prevention and treatment of diseases and clinical conditions associated with MGC4342. MICAL (Accession NM_022765) is another VGAM899 host target gene. MICAL BINDING SITE is HOST TARGET binding site found in the 5" untranslated region of mRNA encoded by MICAL, corresponding to a HOST TARGET binding site such as BINDING SITE I, BINDING SITE II or BINDING SITE III. Table 2 illustrates the complementarity of the nucleotide sequences of MICAL BINDING SITE, designated SEQ ID:23010, to the nucleotide sequence of VGAM899 RNA, herein designated VGAM RNA, also designated SEQ ID:3610.

Another function of VGAM899 is therefore inhibition of MICAL (Accession NM_022765). Accordingly, utilities of VGAM899 include diagnosis, prevention and treatment of diseases and clinical conditions associated with MICAL. MSTP032 (Accession NM_025226) is another VGAM899 host target gene. MSTP032 BINDING SITE is HOST TARGET binding site found in the 3' untranslated region of mRNA encoded by MSTP032, corresponding to a HOST TARGET binding site such as BINDING SITE I, BINDING SITE II or BINDING SITE III. Table 2 illustrates the complementarity of the nucleotide sequences of MSTP032 BINDING SITE, designated SEQ ID:24907, to the nucleotide sequence of VGAM899 RNA, herein designated VGAM RNA, also designated SEQ ID:3610.

Another function of VGAM899 is therefore inhibition of MSTP032 (Accession NM_025226). Accordingly, utilities of VGAM899 include diagnosis, prevention and treatment of diseases and clinical conditions associated with MSTP032. Phosphatidylinositol-4-phosphate 5-kinase, Type I, Gamma (PIP5K1C, Accession XM_047620) is another VGAM899 host target gene. PIP5K1C BINDING SITE is HOST TARGET binding site found in the 3' untranslated region of mRNA encoded by PIP5K1C, corresponding to a HOST TARGET binding site such as BINDING SITE I, BINDING SITE II or BINDING SITE III. Table 2 illustrates the complementarity of the nucleotide sequences of PIP5K1C BINDING SITE, designated SEQ ID:35017, to the nucleotide sequence of VGAM899 RNA, herein designated VGAM RNA, also designated SEQ ID:3610.

Another function of VGAM899 is therefore inhibition of Phosphatidylinositol-4-phosphate 5-kinase, Type I, Gamma (PIP5K1C, Accession XM_047620). Accordingly, utilities of VGAM899 include diagnosis, prevention and treatment of diseases and clinical conditions associated with PIP5K1C. Syndecan 3 (N-syndecan) (SDC3, Accession NM_014654) is another VGAM899 host target gene. SDC3 BINDING SITE is HOST TARGET binding site found in the 3' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16082, to the nucleotide sequence of VGAM899 RNA, herein designated VGAM RNA, also designated SEQ ID:3610.

Another function of VGAM899 is therefore inhibition of Syndecan 3 (N-syndecan) (SDC3, Accession NM_014654). Accordingly, utilities of VGAM899 include diagnosis, prevention and treatment of diseases and clinical conditions associated with SDC3. Torsin Family 2, Member A (TOR2A, Accession NM_130459) is another VGAM899 host target gene. TOR2A BINDING SITE is HOST TARGET binding site found in the 3' untranslated region of mRNA encoded by TOR2A, corresponding to a HOST TARGET binding site such as BINDING SITE I, BINDING SITE II or BINDING SITE III. Table 2 illustrates the complementarity of the nucleotide sequences of TOR2A BINDING SITE, designated SEQ ID:28219, to the nucleotide sequence of VGAM899 RNA, herein designated VGAM RNA, also designated SEQ ID:3610.

Another function of VGAM899 is therefore inhibition of Torsin Family 2, Member A (TOR2A, Accession NM_130459). Accordingly, utilities of VGAM899 include diagnosis, prevention and treatment of diseases and clinical conditions associated with TOR2A. LOC125268 (Accession XM_071960) is another VGAM899 host target gene. LOC125268 BINDING SITE is HOST TARGET binding site found in the 3' untranslated region of mRNA encoded by LOC125268, corresponding to a HOST TARGET binding site such as BINDING SITE I, BINDING SITE II or BINDING SITE III. Table 2 illustrates the complementarity of the nucleotide sequences of LOC125268 BINDING SITE, designated SEQ ID:37450, to the nucleotide sequence of VGAM899 RNA, herein designated VGAM RNA, also designated SEQ ID:3610.

Another function of VGAM899 is therefore inhibition of LOC125268 (Accession XM_071960). Accordingly, utilities of VGAM899 include diagnosis, prevention and treatment of diseases and clinical conditions associated with LOC125268. LOC145757 (Accession XM_085227) is another VGAM899 host target gene. LOC145757 BINDING SITE is HOST TARGET binding site found in the 5' untranslated region of mRNA encoded by LOC145757, corresponding to a HOST TARGET binding site such as BINDING SITE I, BINDING SITE II or BINDING SITE III. Table 2 illustrates the complementarity of the nucleotide sequences of LOC145757 BINDING SITE, designated SEQ ID:37972, to the nucleotide sequence of VGAM899 RNA, herein designated VGAM RNA, also designated SEQ ID:3610.

Another function of VGAM899 is therefore inhibition of LOC145757 (Accession XM_085227). Accordingly, utilities of VGAM899 include diagnosis, prevention and treatment of diseases and clinical conditions associated with LOC145757. LOC148397 (Accession XM_086171) is another VGAM899 host target gene. LOC148397 BINDING SITE is HOST TARGET binding site found in the 5' untranslated region of mRNA encoded by LOC148397, corresponding to a HOST TARGET binding site such as BINDING SITE I, BINDING SITE II or BINDING SITE III. Table 2 illustrates the complementarity of the nucleotide sequences of LOC148397 BINDING SITE, designated SEQ ID:38527, to the nucleotide sequence of VGAM899 RNA, herein designated VGAM RNA, also designated SEQ ID:3610.

Another function of VGAM899 is therefore inhibition of LOC148397 (Accession XM_086171). Accordingly, utilities of VGAM899 include diagnosis, prevention and treatment of diseases and clinical conditions associated with LOC148397. LOC148479 (Accession XM_086204) is another VGAM899 host target gene. LOC148479 BINDING SITE is HOST TARGET binding site found in the 5' untranslated region of mRNA encoded by LOC148479, corresponding to a HOST TARGET binding site such as BINDING SITE I, BINDING SITE II or BINDING SITE III. Table 2 illustrates the complementarity of the nucleotide sequences of LOC148479 BINDING SITE, designated SEQ ID:38539, to the nucleotide sequence of VGAM899 RNA, herein designated VGAM RNA, also designated SEQ ID:3610.

Another function of VGAM899 is therefore inhibition of LOC148479 (Accession XM_086204). Accordingly, utilities of VGAM899 include diagnosis, prevention and treatment of diseases and clinical conditions associated with LOC148479. LOC151568 (Accession NM_138483) is another VGAM899 host target gene. LOC151568 BINDING SITE is HOST TARGET binding site found in the 5' untranslated region of mRNA encoded by LOC151568, corresponding to a HOST TARGET binding site such as BINDING SITE I, BINDING SITE II or BINDING SITE III. Table 2 illustrates the complementarity of the nucleotide sequences of LOC151568 BINDING SITE, designated SEQ ID:28835, to the nucleotide sequence of VGAM899 RNA, herein designated VGAM RNA, also designated SEQ ID:3610.

Another function of VGAM899 is therefore inhibition of LOC151568 (Accession NM_138483). Accordingly, utilities of VGAM899 include diagnosis, prevention and treatment of diseases and clinical conditions associated with LOC151568. LOC152633 (Accession XM_098248) is another VGAM899 host target gene. LOC152633 BINDING SITE is HOST TARGET binding site found in the 5' untranslated region of mRNA encoded by LOC152633, corresponding to a HOST TARGET binding site such as BINDING SITE I, BINDING SITE II or BINDING SITE III. Table 2 illustrates the complementarity of the nucleotide sequences of LOC152633 BINDING SITE, designated SEQ ID:41532, to the nucleotide sequence of VGAM899 RNA, herein designated VGAM RNA, also designated SEQ ID:3610.

Another function of VGAM899 is therefore inhibition of LOC152633 (Accession XM_098248). Accordingly, utilities of VGAM899 include diagnosis, prevention and treatment of diseases and clinical conditions associated with LOC152633. LOC222057 (Accession XM_166594) is another VGAM899 host target gene. LOC222057 BINDING SITE is HOST TARGET binding site found in the 3' untranslated region of mRNA encoded by LOC222057, corresponding to a HOST TARGET binding site such as BINDING SITE I, BINDING SITE II or BINDING SITE III. Table 2 illustrates the complementarity of the nucleotide sequences of LOC222057 BINDING SITE, designated SEQ ID:44572, to the nucleotide sequence of VGAM899 RNA, herein designated VGAM RNA, also designated SEQ ID:3610.

Another function of VGAM899 is therefore inhibition of LOC222057 (Accession XM_166594). Accordingly, utilities of VGAM899 include diagnosis, prevention and treatment of diseases and clinical conditions associated with LOC222057. LOC51112 (Accession NM_016030) is another VGAM899 host target gene. LOC51112 BINDING SITE is HOST TARGET binding site found in the 5' untranslated region of mRNA encoded by LOC51112, corresponding to a HOST TARGET binding site such as BINDING SITE I, BINDING SITE II or BINDING SITE III. Table 2 illustrates the complementarity of the nucleotide sequences of LOC51112 BINDING SITE, designated SEQ ID:18112, to the nucleotide sequence of VGAM899 RNA, herein designated VGAM RNA, also designated SEQ ID:3610.

Another function of VGAM899 is therefore inhibition of LOC51112 (Accession NM_016030). Accordingly, utilities of VGAM899 include diagnosis, prevention and treatment of diseases and clinical conditions associated with LOC51112.

FIG. 1 further provides a conceptual description of a novel bioinformatically detected viral gene of the present invention, referred to here as Viral Genomic Address Messenger 900 (VGAM900) viral gene, which modulates expression of respective host target genes thereof, the function and utility of which host target genes is known in the art.

VGAM900 is a novel bioinformatically detected regulatory, non protein coding, viral micro RNA (miRNA) gene. The method by which VGAM900 was detected is described hereinabove with reference to FIGS. 1-8.

VGAM900 gene, herein designated VGAM GENE, is a viral gene contained in the genome of Human Herpesvirus 5. VGAM900 host target gene, herein designated VGAM HOST TARGET GENE, is a human gene contained in the human genome.

VGAM900 gene encodes a VGAM900 precursor RNA, herein designated VGAM PRECURSOR RNA. Similar to other miRNA genes, and unlike most ordinary genes, VGAM900 precursor RNA does not encode a protein. A nucleotide sequence identical or highly similar to the nucleotide sequence of VGAM900 precursor RNA is designated SEQ ID:886, and is provided hereinbelow with reference to the sequence listing part. Nucleotide sequence SEQ ID:886 is located at position 111776 relative to the genome of Human Herpesvirus 5.

VGAM900 precursor RNA folds onto itself, forming VGAM900 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM900 folded precursor RNA into VGAM900 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM900 RNA is designated SEQ ID:3611, and is provided hereinbelow with reference to the sequence listing part.

VGAM900 host target gene, herein designated VGAM HOST TARGET GENE, encodes a corresponding messenger RNA, VGAM900 host target RNA, herein designated VGAM HOST TARGET RNA. VGAM900 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM900 RNA, herein designated VGAM RNA, binds complementarily to one or more host target binding sites located in untranslated regions of VGAM900 host target RNA, herein designated VGAM HOST TARGET RNA. This complementary binding is due to the fact that the nucleotide sequence of VGAM900 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM900 RNA, herein designated VGAM RNA, may have a different number of host target binding sites in untranslated regions of a VGAM900 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM900 RNA, herein designated VGAM RNA, to host target binding sites on VGAM900 host target RNA, herein designated VGAM HOST TARGET RNA, such as BINDING SITE I, BINDING SITE II and BINDING SITE III, inhibits translation of VGAM900 host target RNA into VGAM900 host target protein, herein designated VGAM HOST TARGET PROTEIN. VGAM host target protein is therefore outlined by a broken line.

It is appreciated that VGAM900 host target gene, herein designated VGAM HOST TARGET GENE, in fact represents a plurality of VGAM900 host target genes. The mRNA of each one of this plurality of VGAM900 host target genes comprises one or more host target binding sites, each having a nucleotide sequence which is at least partly complementary to VGAM900 RNA, herein designated VGAM RNA, and which when bound by VGAM900 RNA causes inhibition of translation of respective one or more VGAM900 host target proteins.

It is further appreciated by one skilled in the art that the mode of translational inhibition illustrated by FIG. 1 with specific reference to translational inhibition exerted by VGAM900 gene, herein designated VGAM GENE, on one or more VGAM900 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM900 is inhibition of expression of host target genes, as part of a novel viral mechanism of attacking a host. Accordingly, utilities of VGAM900 include diagnosis, prevention and treatment of viral infection by Human Herpesvirus 5. Specific functions, and accordingly utilities, of VGAM900 correlate with, and may be deduced from, the identity of the host target genes which VGAM900 binds and inhibits, and the function of these host target genes, as elaborated hereinbelow.

Nucleotide sequences of the VGAM900 precursor RNA, herein designated VGAM PRECURSOR RNA, and of the 'diced' VGAM900 RNA, herein designated VGAM RNA, and a schematic representation of the secondary folding of VGAM900 folded precursor RNA, herein designated VGAM FOLDED PRECURSOR RNA, of VGAM900 are further described hereinbelow with reference to Table 1.

Nucleotide sequences of host target binding sites, such as BINDING SITE-I, BINDING SITE-II and BINDING SITE-III of FIG. 1, found on VGAM900 host target RNA, and schematic representation of the complementarity of each of these host target binding sites to VGAM900 RNA, herein designated VGAM RNA, are described hereinbelow with reference to Table 2.

As mentioned hereinabove with reference to FIG. 1, a function of VGAM900 gene, herein designated VGAM is inhibition of expression of VGAM900 target genes. It is appreciated that specific functions, and accordingly utilities, of VGAM900 correlate with, and may be deduced from, the identity of the target genes which VGAM900 binds and inhibits, and the function of these target genes, as elaborated hereinbelow.

Axin 1 (AXIN1, Accession XM_027520) is a VGAM900 host target gene. AXIN1 BINDING SITE is HOST TARGET binding site found in the 3' untranslated region of mRNA encoded by AXIN1, corresponding to a HOST TARGET binding site such as BINDING SITE I, BINDING SITE II or BINDING SITE III. Table 2 illustrates the complementarity of the nucleotide sequences of AXIN1 BINDING SITE, designated SEQ ID:30511, to the nucleotide sequence of VGAM900 RNA, herein designated VGAM RNA, also designated SEQ ID:3611.

A function of VGAM900 is therefore inhibition of Axin 1 (AXIN1, Accession XM_027520). Accordingly, utilities of VGAM900 include diagnosis, prevention and treatment of diseases and clinical conditions associated with AXIN1. CDP-diacylglycerol Synthase (phosphatidate cytidylyltransferase) 2 (CDS2, Accession NM_003818) is another VGAM900 host target gene. CDS2 BINDING SITE is HOST TARGET binding site found in the 5' untranslated region of mRNA encoded by CDS2, corresponding to a HOST TARGET binding site such as BINDING SITE I, BINDING SITE II or BINDING SITE III. Table 2 illustrates the complementarity of the nucleotide sequences of CDS2 BINDING SITE, designated SEQ ID:9909, to the nucleotide sequence of VGAM900 RNA, herein designated VGAM RNA, also designated SEQ ID:3611.

Another function of VGAM900 is therefore inhibition of CDP-diacylglycerol Synthase (phosphatidate cytidylyltransferase) 2 (CDS2, Accession NM_003818), a gene which is a key regulator of the amount of PIP2 available for signaling. Accordingly, utilities of VGAM900 include diagnosis, prevention and treatment of diseases and clinical conditions associated with CDS2. The function of CDS2 has been established by previous studies. 4,5-bisphosphate (PIP2) plays a central role in Drosophila phototransduction. A photoreceptor-specific form of the enzyme CDP-diacylglycerol synthase (CDS; EC 2.7.7.41), which catalyzes the formation of CDP-diacylglycerol from phosphatidic acid, is a key regulator of the amount of PIP2 available for signaling. By screening EST databases, Halford et al. (1998) identified a partial human cDNA with sequence similarity to CDS1 (OMIM Ref. No. 603548). The deduced partial polypeptide, which they designated CDS2, is 69% identical to CDS1. Volta et al. (1999) isolated additional cDNAs encoding mouse and human CDS2. The predicted human CDS2 protein contains 445 amino acids with 9 transmembrane domains. The sequences of human CDS2 and Drosophila CDS proteins are 65% identical. Northern blot analysis revealed that CDS2 was expressed as greater than 9.5-, 4.4-, and approximately 3-kb mRNAs in all tissues tested. In situ hybridization to adult and embryonic mouse tissue sections showed that Cds2 is highly expressed in the differentiating neuroblasts of the neural retina and in the central nervous system during embryonic development, although not in the adult retina.

Full details of the abovementioned studies are described in the following publications, the disclosure of which are hereby incorporated by reference:

Halford, S.; Dulai, K. S.; Daw, S. C.; Fitzgibbon, J.; Hunt, D. M.: Isolation and chromosomal localization of two human CDP-diacylglycerol synthase (CDS) genes. Genomics 54:140-144, 1998; and Volta, M.; Bulfone, A.; Gattuso, C.; Rossi, E.; Mariani, M.; Consalez, G. G.; Zuffardi, O.; Ballabio, A.; Banfi, S.; Franco, B.: Identification and characterization of CDS2, a mammalia.

Further studies establishing the function and utilities of CDS2 are found in John Hopkins OMIM database record ID 603549, and in sited publications numbered 4946-4947 listed in the bibliography section hereinbelow, which are also hereby incorporated by reference. Kinesin Family Member 3C (KIF3C, Accession NM_002254) is another VGAM900 host target gene. KIF3C BINDING SITE is HOST TARGET binding site found in the 3' untranslated region of mRNA encoded by KIF3C, corresponding to a HOST TARGET binding site such as BINDING SITE I, BINDING SITE II or BINDING SITE III. Table 2 illustrates the complementarity of the nucleotide sequences of KIF3C BINDING SITE, designated SEQ ID:8057, to the nucleotide sequence of VGAM900 RNA, herein designated VGAM RNA, also designated SEQ ID:3611.

Another function of VGAM900 is therefore inhibition of Kinesin Family Member 3C (KIF3C, Accession NM_002254). Accordingly, utilities of VGAM900 include diagnosis, prevention and treatment of diseases and clinical conditions associated with KIF3C. Lymphoblastic Leukemia Derived Sequence 1 (LYL1, Accession NM_005583) is another VGAM900 host target gene. LYL1 BINDING SITE is HOST TARGET binding site found in the 5' untranslated region of mRNA encoded by LYL1, corresponding to a HOST TARGET binding site such as BINDING SITE I, BINDING SITE II or BINDING SITE III. Table 2 illustrates the complementarity of the nucleotide sequences of LYL1 BINDING SITE, designated SEQ ID:12109, to the nucleotide sequence of VGAM900 RNA, herein designated VGAM RNA, also designated SEQ ID:3611.

Another function of VGAM900 is therefore inhibition of Lymphoblastic Leukemia Derived Sequence 1 (LYL1, Accession NM_005583), a gene which has a Putative helix-loop-helix DNA binding factor;. Accordingly, utilities of VGAM900 include diagnosis, prevention and treatment of diseases and clinical conditions associated with LYL1. The function of LYL1 has been established by previous studies. suggested that LYAAT1 is a lysosomal transporter that actively exports neutral amino acids from lysosomes by chemiosmotic coupling to the H(+)-ATPase of these organelles.

Full details of the abovementioned studies are described in the following publications, the disclosure of which are hereby incorporated by reference:

Kuo, S. S.; Mellentin, J. D.; Copeland, N. G.; Gilbert, D. J.; Jenkins, N. A.; Cleary, M. L.: Structure, chromosome mapping, and expression of the mouse Lyl-1 gene. Oncogene 6:961-968, 1991; and Trask, B.; Fertitta, A.; Christensen, M.; Youngblom, J.; Bergmann, A.; Copeland, A.; de Jong, P.; Mohrenweiser, H.; Olsen, A.; Carrano, A.; Tynan, K.: Fluorescence in situ hybridization.

Further studies establishing the function and utilities of LYL1 are found in John Hopkins OMIM database record ID 151440, and in sited publications numbered 3559-356 and 4710 listed in the bibliography section hereinbelow, which are also hereby incorporated by reference. Retinitis Pigmentosa 2 (X-linked recessive) (RP2, Accession NM_006915) is another VGAM900 host target gene. RP2 BINDING SITE is HOST TARGET binding site found in the 3' untranslated region of mRNA encoded by RP2, corresponding to a HOST TARGET binding site such as BINDING SITE I, BINDING SITE II or BINDING SITE III. Table 2 illustrates the complementarity of the nucleotide sequences of RP2 BINDING SITE, designated SEQ ID:13793, to the nucleotide sequence of VGAM900 RNA, herein designated VGAM RNA, also designated SEQ ID:3611.

Another function of VGAM900 is therefore inhibition of Retinitis Pigmentosa 2 (X-linked recessive) (RP2, Accession NM_006915). Accordingly, utilities of VGAM900 include diagnosis, prevention and treatment of diseases and clinical conditions associated with RP2. ATP6V1EL2 (Accession NM_080653) is another VGAM900 host target gene. ATP6V1EL2 BINDING SITE is HOST TARGET binding site found in the 5' untranslated region of mRNA encoded by ATP6V1EL2, corresponding to a HOST TARGET binding site such as BINDING SITE I, BINDING SITE II or BINDING SITE III. Table 2 illustrates the complementarity of the nucleotide sequences of ATP6V1EL2 BINDING SITE, designated SEQ ID:27940, to the nucleotide sequence of VGAM900 RNA, herein designated VGAM RNA, also designated SEQ ID:3611.

Another function of VGAM900 is therefore inhibition of ATP6V1EL2 (Accession NM_080653). Accordingly, utilities of VGAM900 include diagnosis, prevention and treatment of diseases and clinical conditions associated with ATP6V1EL2. Chromosome 20 Open Reading Frame 162 (C20orf162, Accession NM_080603) is another VGAM900 host target gene. C20orf162 BINDING SITE is HOST TARGET binding site found in the 5' untranslated region of mRNA encoded by C20orf162, corresponding to a HOST TARGET binding site such as BINDING SITE I, BINDING SITE II or BINDING SITE III. Table 2 illustrates the complementarity of the nucleotide sequences of C20orf162 BINDING SITE, designated SEQ ID:27916, to the nucleotide sequence of VGAM900 RNA, herein designated VGAM RNA, also designated SEQ ID:3611.

Another function of VGAM900 is therefore inhibition of Chromosome 20 Open Reading Frame 162 (C20orf162, Accession NM_080603). Accordingly, utilities of VGAM900 include diagnosis, prevention and treatment of diseases and clinical conditions associated with C20orf162. GAPCENA (Accession NM_012197) is another VGAM900 host target gene. GAPCENA BINDING SITE is HOST TARGET binding site found in the 3' untranslated region of mRNA encoded by GAPCENA, corresponding to a HOST TARGET binding site such as BINDING SITE I, BINDING SITE II or BINDING SITE III. Table 2 illustrates the complementarity of the nucleotide sequences of GAPCENA BINDING SITE, designated SEQ ID:14494, to the nucleotide sequence of VGAM900 RNA, herein designated VGAM RNA, also designated SEQ ID:3611.

Another function of VGAM900 is therefore inhibition of GAPCENA (Accession NM_012197). Accordingly, utilities of VGAM900 include diagnosis, prevention and treatment of diseases and clinical conditions associated with GAPCENA. KIAA1126 (Accession XM_050325) is another VGAM900 host target gene. KIAA1126 BINDING SITE is HOST TARGET binding site found in the 3' untranslated region of mRNA encoded by KIAA1126, corresponding to a HOST TARGET binding site such as BINDING SITE I, BINDING SITE II or BINDING SITE III. Table 2 illustrates the complementarity of the nucleotide sequences of KIAA1126 BINDING SITE, designated SEQ ID:35609, to the nucleotide sequence of VGAM900 RNA, herein designated VGAM RNA, also designated SEQ ID:3611.

Another function of VGAM900 is therefore inhibition of KIAA1126 (Accession XM_050325). Accordingly, utilities of VGAM900 include diagnosis, prevention and treatment of diseases and clinical conditions associated with KIAA1126. MGC2574 (Accession NM_024098) is another VGAM900 host target gene. MGC2574 BINDING SITE is HOST TARGET binding site found in the 3' untranslated region of mRNA encoded by MGC2574, corresponding to a HOST TARGET binding site such as BINDING SITE I, BINDING SITE II or BINDING SITE III. Table 2 illustrates the complementarity of the nucleotide sequences of MGC2574 BINDING SITE, designated SEQ ID:23538, to the nucleotide sequence of VGAM900 RNA, herein designated VGAM RNA, also designated SEQ ID:3611.

Another function of VGAM900 is therefore inhibition of MGC2574 (Accession NM_024098). Accordingly, utilities of VGAM900 include diagnosis, prevention and treatment of diseases and clinical conditions associated with MGC2574. Ring Finger Protein 24 (RNF24, Accession NM_007219) is another VGAM900 host target gene. RNF24 BINDING SITE is HOST TARGET binding site found in the 5' untranslated region of mRNA encoded by RNF24, corresponding to a HOST TARGET binding site such as BINDING SITE I, BINDING SITE II or BINDING SITE III. Table 2 illustrates the complementarity of the nucleotide sequences of RNF24 BINDING SITE, designated SEQ ID:14086, to the nucleotide sequence of VGAM900 RNA, herein designated VGAM RNA, also designated SEQ ID:3611.

Another function of VGAM900 is therefore inhibition of Ring Finger Protein 24 (RNF24, Accession NM_007219). Accordingly, utilities of VGAM900 include diagnosis, prevention and treatment of diseases and clinical conditions associated with RNF24. Rpo1-2 (Accession NM_032212) is another VGAM900 host target gene. Rpo1-2 BINDING SITE1 and Rpo1-2 BINDING SITE2 are HOST TARGET binding sites found in untranslated regions of mRNA encoded by Rpo1-2, corresponding to HOST TARGET binding sites such as BINDING SITE I, BINDING SITE II or BINDING SITE III. Table 2 illustrates the complementarity of the nucleotide sequences of Rpo1-2 BINDING SITE1 and Rpo1-2 BINDING SITE2, designated SEQ ID:25931 and SEQ ID:21096 respectively, to the nucleotide sequence of VGAM900 RNA, herein designated VGAM RNA, also designated SEQ ID:3611.

Another function of VGAM900 is therefore inhibition of Rpo1-2 (Accession NM_032212). Accordingly, utilities of VGAM900 include diagnosis, prevention and treatment of diseases and clinical conditions associated with Rpo1-2. LOC221416 (Accession XM_168094) is another VGAM900 host target gene. LOC221416 BINDING SITE is HOST TARGET binding site found in the 3' untranslated region of mRNA encoded by LOC221416, corresponding to a HOST TARGET binding site such as BINDING SITE I, BINDING SITE II or BINDING SITE III. Table 2 illustrates the complementarity of the nucleotide sequences of LOC221416 BINDING SITE, designated SEQ ID:45025, to the nucleotide sequence of VGAM900 RNA, herein designated VGAM RNA, also designated SEQ ID:3611.

Another function of VGAM900 is therefore inhibition of LOC221416 (Accession XM_168094). Accordingly, utilities of VGAM900 include diagnosis, prevention and treatment of diseases and clinical conditions associated with LOC221416. LOC253502 (Accession XM_170561) is another VGAM900 host target gene. LOC253502 BINDING SITE is HOST TARGET binding site found in the 3' untranslated region of mRNA encoded by LOC253502, corresponding to a HOST TARGET binding site such as BINDING SITE I, BINDING SITE II or BINDING SITE III. Table 2 illustrates the complementarity of the nucleotide sequences of LOC253502 BINDING SITE, designated SEQ ID:45382, to the nucleotide sequence of VGAM900 RNA, herein designated VGAM RNA, also designated SEQ ID:3611.

Another function of VGAM900 is therefore inhibition of LOC253502 (Accession XM_170561). Accordingly, utilities of VGAM900 include diagnosis, prevention and treatment of diseases and clinical conditions associated with LOC253502. FIG. 1 further provides a conceptual description of a novel bioinformatically detected viral gene of the present invention, referred to here as Viral Genomic Address Messenger 901 (VGAM901) viral gene, which modulates expression of respective host target genes thereof, the function and utility of which host target genes is known in the art.

VGAM901 is a novel bioinformatically detected regulatory, non protein coding, viral micro RNA (miRNA) gene. The method by which VGAM901 was detected is described hereinabove with reference to FIGS. 1-8.

VGAM901 gene, herein designated VGAM GENE, is a viral gene contained in the genome of Sulfolobus Virus SIRV-1. VGAM901 host target gene, herein designated VGAM HOST TARGET GENE, is a human gene contained in the human genome.

VGAM901 gene encodes a VGAM901 precursor RNA, herein designated VGAM PRECURSOR RNA. Similar to other miRNA genes, and unlike most ordinary genes, VGAM901 precursor RNA does not encode a protein. A nucleotide sequence identical or highly similar to the nucleotide sequence of VGAM901 precursor RNA is designated SEQ ID:887, and is provided hereinbelow with reference to the sequence listing part. Nucleotide sequence SEQ ID:887 is located at position 8223 relative to the genome of Sulfolobus Virus SIRV-1.

VGAM901 precursor RNA folds onto itself, forming VGAM901 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM901 folded precursor RNA into VGAM901 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM901 RNA is designated SEQ ID:3612, and is provided hereinbelow with reference to the sequence listing part.

VGAM901 host target gene, herein designated VGAM HOST TARGET GENE, encodes a corresponding messenger RNA, VGAM901 host target RNA, herein designated VGAM HOST TARGET RNA. VGAM901 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM901 RNA, herein designated VGAM RNA, binds complementarily to one or more host target binding sites located in untranslated regions of VGAM901 host target RNA, herein designated VGAM HOST TARGET RNA. This complementary binding is due to the fact that the nucleotide sequence of VGAM901 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM901 RNA, herein designated VGAM RNA, may have a different number of host target binding sites in untranslated regions of a VGAM901 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM901 RNA, herein designated VGAM RNA, to host target binding sites on VGAM901 host target RNA, herein designated VGAM HOST TARGET RNA, such as BINDING SITE I, BINDING SITE II and BINDING SITE III, inhibits translation of VGAM901 host target RNA into VGAM901 host target protein, herein designated VGAM HOST TARGET PROTEIN. VGAM host target protein is therefore outlined by a broken line.

It is appreciated that VGAM901 host target gene, herein designated VGAM HOST TARGET GENE, in fact represents a plurality of VGAM901 host target genes. The mRNA of each one of this plurality of VGAM901 host target genes comprises one or more host target binding sites, each having a nucleotide sequence which is at least partly complementary to VGAM901 RNA, herein designated VGAM RNA, and which when bound by VGAM901 RNA causes inhibition of translation of respective one or more VGAM901 host target proteins.

It is further appreciated by one skilled in the art that the mode of translational inhibition illustrated by FIG. 1 with specific reference to translational inhibition exerted by VGAM901 gene, herein designated VGAM GENE, on one or more VGAM901 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM901 is inhibition of expression of host target genes, as part of a novel viral mechanism of attacking a host. Accordingly, utilities of VGAM901 include diagnosis, prevention and treatment of viral infection by Sulfolobus Virus SIRV-1. Specific functions, and accordingly utilities, of VGAM901 correlate with, and may be deduced from, the identity of the host target genes which VGAM901 binds and inhibits, and the function of these host target genes, as elaborated hereinbelow.

Nucleotide sequences of the VGAM901 precursor RNA, herein designated VGAM PRECURSOR RNA, and of the 'diced' VGAM901 RNA, herein designated VGAM RNA, and a schematic representation of the secondary folding of VGAM901 folded precursor RNA, herein designated VGAM FOLDED PRECURSOR RNA, of VGAM901 are further described hereinbelow with reference to Table 1.

Nucleotide sequences of host target binding sites, such as BINDING SITE-I, BINDING SITE-II and BINDING SITE-III of FIG. 1, found on VGAM901 host target RNA, and schematic representation of the complementarity of each of these host target binding sites to VGAM901 RNA, herein designated VGAM RNA, are described hereinbelow with reference to Table 2.

As mentioned hereinabove with reference to FIG. 1, a function of VGAM901 gene, herein designated VGAM is inhibition of expression of VGAM901 target genes. It is appreciated that specific functions, and accordingly utilities, of VGAM901 correlate with, and may be deduced from, the identity of the target genes which VGAM901 binds and inhibits, and the function of these target genes, as elaborated hereinbelow.

Centaurin, Delta 1 (CENTD1, Accession NM_139182) is a VGAM901 host target gene. CENTD1 BINDING SITE1 and CENTD1 BINDING SITE2 are HOST TARGET binding sites found in untranslated regions of mRNA encoded by CENTD1, corresponding to HOST TARGET binding sites such as BINDING SITE I, BINDING SITE II or BINDING SITE III. Table 2 illustrates the complementarity of the nucleotide sequences of CENTD1 BINDING SITE1 and CENTD1 BINDING SITE2, designated SEQ ID:29200 and SEQ ID:17562 respectively, to the nucleotide sequence of VGAM901 RNA, herein designated VGAM RNA, also designated SEQ ID:3612.

A function of VGAM901 is therefore inhibition of Centaurin, Delta 1 (CENTD1, Accession NM_139182), a gene which is nvolved in cell signaling/communication. Accordingly, utilities of VGAM901 include diagnosis, prevention and treatment of diseases and clinical conditions associated with CENTD1. The function of CENTD1 and its association with various diseases and clinical conditions, has been established by previous studies, as described hereinabove with reference to VGAM445. TEM5 (Accession NM_032777) is another VGAM901 host target gene. TEM5 BINDING SITE is HOST TARGET binding site found in the 3' untranslated region of mRNA encoded by TEM5, corresponding to a HOST TARGET binding site such as BINDING SITE I, BINDING SITE II or BINDING SITE III. Table 2 illustrates the complementarity of the nucleotide sequences of TEM5 BINDING SITE, designated SEQ ID:26521, to the nucleotide sequence of VGAM901 RNA, herein designated VGAM RNA, also designated SEQ ID:3612.

Another function of VGAM901 is therefore inhibition of TEM5 (Accession NM_032777), a gene which involves in development of midline glia and commissural axon pathways. Accordingly, utilities of VGAM901 include diagnosis, prevention and treatment of diseases and clinical conditions associated with TEM5. The function of TEM5 and its association with various diseases and clinical conditions, has been established by previous studies, as described hereinabove with reference to VGAM406. EFA6R (Accession NM_015310) is another VGAM901 host target gene. EFA6R BINDING SITE is HOST TARGET binding site found in the 3' untranslated region of mRNA encoded by EFA6R, corresponding to a HOST TARGET binding site such as BINDING SITE I, BINDING SITE II or BINDING SITE III. Table 2 illustrates the complementarity of the nucleotide sequences of EFA6R BINDING SITE, designated SEQ ID:17627, to the nucleotide sequence of VGAM901 RNA, herein designated VGAM RNA, also designated SEQ ID:3612.

Another function of VGAM901 is therefore inhibition of EFA6R (Accession NM_015310). Accordingly, utilities of VGAM901 include diagnosis, prevention and treatment of diseases and clinical conditions associated with EFA6R. FLJ13910 (Accession NM_022780) is another VGAM901 host target gene. FLJ13910 BINDING SITE is HOST TARGET binding site found in the 3' untranslated region of mRNA encoded by FLJ13910, corresponding to a HOST TARGET binding site such as BINDING SITE I, BINDING SITE II or BINDING SITE III. Table 2 illustrates the complementarity of the nucleotide sequences of FLJ13910 BINDING SITE, designated SEQ ID:23059, to the nucleotide sequence of VGAM901 RNA, herein designated VGAM RNA, also designated SEQ ID:3612.

Another function of VGAM901 is therefore inhibition of FLJ13910 (Accession NM_022780). Accordingly, utilities of VGAM901 include diagnosis, prevention and treatment of diseases and clinical conditions associated with FLJ13910. KIAA1077 (Accession XM_053496) is another VGAM901 host target gene. KIAA1077 BINDING SITE is HOST TARGET binding site found in the 5' untranslated region of mRNA encoded by KIAA1077, corresponding to a HOST TARGET binding site such as BINDING SITE I, BINDING SITE II or BINDING SITE III. Table 2 illustrates the complementarity of the nucleotide sequences of KIAA1077 BINDING SITE, designated SEQ ID:36094, to the nucleotide sequence of VGAM901 RNA, herein designated VGAM RNA, also designated SEQ ID:3612.

Another function of VGAM901 is therefore inhibition of KIAA1077 (Accession XM_053496). Accordingly, utilities of VGAM901 include diagnosis, prevention and treatment of diseases and clinical conditions associated with KIAA1077. FIG. 1 further provides a conceptual description of a novel bioinformatically detected viral gene of the present invention, referred to here as Viral Genomic Address Messenger 902 (VGAM902) viral gene, which modulates expression of respective host target genes thereof, the function and utility of which host target genes is known in the art.

VGAM902 is a novel bioinformatically detected regulatory, non protein coding, viral micro RNA (miRNA) gene. The method by which VGAM902 was detected is described hereinabove with reference to FIGS. 1-8.

VGAM902 gene, herein designated VGAM GENE, is a viral gene contained in the genome of Sulfolobus Virus SIRV-1. VGAM902 host target gene, herein designated VGAM HOST TARGET GENE, is a human gene contained in the human genome.

VGAM902 gene encodes a VGAM902 precursor RNA, herein designated VGAM PRECURSOR RNA. Similar to other miRNA genes, and unlike most ordinary genes, VGAM902 precursor RNA does not encode a protein. A nucleotide sequence identical or highly similar to the nucleotide sequence of VGAM902 precursor RNA is designated SEQ ID:888, and is provided hereinbelow with reference to the sequence listing part. Nucleotide sequence SEQ ID:888 is located at position 8730 relative to the genome of Sulfolobus Virus SIRV-1.

VGAM902 precursor RNA folds onto itself, forming VGAM902 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM902 folded precursor RNA into VGAM902 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM902 RNA is designated SEQ ID:3613, and is provided hereinbelow with reference to the sequence listing part.

VGAM902 host target gene, herein designated VGAM HOST TARGET GENE, encodes a corresponding messenger RNA, VGAM902 host target RNA, herein designated VGAM HOST TARGET RNA. VGAM902 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM902 RNA, herein designated VGAM RNA, binds complementarily to one or more host target binding sites located in untranslated regions of VGAM902 host target RNA, herein designated VGAM HOST TARGET RNA. This complementary binding is due to the fact that the nucleotide sequence of VGAM902 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM902 RNA, herein designated VGAM RNA, may have a different number of host target binding sites in untranslated regions of a VGAM902 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM902 RNA, herein designated VGAM RNA, to host target binding sites on VGAM902 host target RNA, herein designated VGAM HOST TARGET RNA, such as BINDING SITE I, BINDING SITE II and BINDING SITE III, inhibits translation of VGAM902 host target RNA into VGAM902 host target protein, herein designated VGAM HOST TARGET PROTEIN. VGAM host target protein is therefore outlined by a broken line.

It is appreciated that VGAM902 host target gene, herein designated VGAM HOST TARGET GENE, in fact represents a plurality of VGAM902 host target genes. The mRNA of each one of this plurality of VGAM902 host target genes comprises one or more host target binding sites, each having a nucleotide sequence which is at least partly complementary to VGAM902 RNA, herein designated VGAM RNA, and which when bound by VGAM902 RNA causes inhibition of translation of respective one or more VGAM902 host target proteins.

It is further appreciated by one skilled in the art that the mode of translational inhibition illustrated by FIG. 1 with specific reference to translational inhibition exerted by VGAM902 gene, herein designated VGAM GENE, on one or more VGAM902 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM902 is inhibition of expression of host target genes, as part of a novel viral mechanism of attacking a host. Accordingly, utilities of VGAM902 include diagnosis, prevention and treatment of viral infection by Sulfolobus Virus SIRV-1. Specific functions, and accordingly utilities, of VGAM902 correlate with, and may be deduced from, the identity of the host target genes which VGAM902 binds and inhibits, and the function of these host target genes, as elaborated hereinbelow.

Nucleotide sequences of the VGAM902 precursor RNA, herein designated VGAM PRECURSOR RNA, and of the 'diced' VGAM902 RNA, herein designated VGAM RNA, and a schematic representation of the secondary folding of VGAM902 folded precursor RNA, herein designated VGAM FOLDED PRECURSOR RNA, of VGAM902 are further described hereinbelow with reference to Table 1.

Nucleotide sequences of host target binding sites, such as BINDING SITE-I, BINDING SITE-II and BINDING SITE-III of FIG. 1, found on VGAM902 host target RNA, and schematic representation of the complementarity of each of these host target binding sites to VGAM902 RNA, herein designated VGAM RNA, are described hereinbelow with reference to Table 2.

As mentioned hereinabove with reference to FIG. 1, a function of VGAM902 gene, herein designated VGAM is inhibition of expression of VGAM902 target genes. It is appreciated that specific functions, and accordingly utilities, of VGAM902 correlate with, and may be deduced from, the identity of the target genes which VGAM902 binds and inhibits, and the function of these target genes, as elaborated hereinbelow.

Histone Deacetylase 4 (HDAC4, Accession NM_006037) is a VGAM902 host target gene. HDAC4 BINDING SITE is HOST TARGET binding site found in the 3' untranslated region of mRNA encoded by HDAC4, corresponding to a HOST TARGET binding site such as BINDING SITE I, BINDING SITE II or BINDING SITE III. Table 2 illustrates the complementarity of the nucleotide sequences of HDAC4 BINDING SITE, designated SEQ ID:12659, to the nucleotide sequence of VGAM902 RNA, herein designated VGAM RNA, also designated SEQ ID:3613.

A function of VGAM902 is therefore inhibition of Histone Deacetylase 4 (HDAC4, Accession NM_006037), a gene which is responsible for the deacetylation of lysine residues on the n-terminal part of the core histones and may mediate transcriptional regulation. Accordingly, utilities of VGAM902 include diagnosis, prevention and treatment of diseases and clinical conditions associated with HDAC4. The function of HDAC4 and its association with various diseases and clinical conditions, has been established by previous studies, as described hereinabove with reference to VGAM264. Ubiquitin-conjugating Enzyme E2A (RAD6 homolog) (UBE2A, Accession NM_003336) is another VGAM902 host target gene. UBE2A BINDING SITE is HOST TARGET binding site found in the 3' untranslated region of mRNA encoded by UBE2A, corresponding to a HOST TARGET binding site such as BINDING SITE I, BINDING SITE II or BINDING SITE III. Table 2 illustrates the complementarity of the nucleotide sequences of UBE2A BINDING SITE, designated SEQ ID:9339, to the nucleotide sequence of VGAM902 RNA, herein designated VGAM RNA, also designated SEQ ID:3613.

Another function of VGAM902 is therefore inhibition of Ubiquitin-conjugating Enzyme E2A (RAD6 homolog) (UBE2A, Accession NM_003336), a gene which catalyzes the covalent attachment of ubiquitin to other proteins and is required for postreplication repair of uv-damaged dna. Accordingly, utilities of VGAM902 include diagnosis, prevention and treatment of diseases and clinical conditions associated with UBE2A. The function of UBE2A and its association with various diseases and clinical conditions, has been established by previous studies, as described hereinabove with reference to VGAM294. Chromosome 20 Open Reading Frame 54 (C20orf54, Accession NM_033409) is another VGAM902 host target gene. C20orf54 BINDING SITE is HOST TARGET binding site found in the 5' untranslated region of mRNA encoded by C20orf54, corresponding to a HOST TARGET binding site such as BINDING SITE I, BINDING SITE II or BINDING SITE III. Table 2 illustrates the complementarity of the nucleotide sequences of C20orf54 BINDING SITE, designated SEQ ID:27226, to the nucleotide sequence of VGAM902 RNA, herein designated VGAM RNA, also designated SEQ ID:3613.

Another function of VGAM902 is therefore inhibition of Chromosome 20 Open Reading Frame 54 (C20orf54, Accession NM_033409). Accordingly, utilities of VGAM902 include diagnosis, prevention and treatment of diseases and clinical conditions associated with C20orf54. CAP350 (Accession NM_014810) is another VGAM902 host target gene. CAP350 BINDING SITE is HOST TARGET binding site found in the 3' untranslated region of mRNA encoded by CAP350, corresponding to a HOST TARGET binding site such as BINDING SITE I, BINDING SITE II or BINDING SITE III. Table 2 illustrates the complementarity of the nucleotide sequences of CAP350 BINDING SITE, designated SEQ ID:16770, to the nucleotide sequence of VGAM902 RNA, herein designated VGAM RNA, also designated SEQ ID:3613.

Another function of VGAM902 is therefore inhibition of CAP350 (Accession NM_014810). Accordingly, utilities of VGAM902 include diagnosis, prevention and treatment of diseases and clinical conditions associated with CAP350. Phytoceramidase, Alkaline (PHCA, Accession NM_018367) is another VGAM902 host target gene. PHCA BINDING SITE is HOST TARGET binding site found in the 3' untranslated region of mRNA encoded by PHCA, corresponding to a HOST TARGET binding site such as BINDING SITE I, BINDING SITE II or BINDING SITE III. Table 2 illustrates the complementarity of the nucleotide sequences of PHCA BINDING SITE, designated SEQ ID:20374, to the nucleotide sequence of VGAM902 RNA, herein designated VGAM RNA, also designated SEQ ID:3613.

Another function of VGAM902 is therefore inhibition of Phytoceramidase, Alkaline (PHCA, Accession NM_018367). Accordingly, utilities of VGAM902 include diagnosis, prevention and treatment of diseases and clinical conditions associated with PHCA. FIG. 1 further provides a conceptual description of a novel bioinformatically detected viral gene of the present invention, referred to here as Viral Genomic Address Messenger 903 (VGAM903) viral gene, which modulates expression of respective host target genes thereof, the function and utility of which host target genes is known in the art.

VGAM903 is a novel bioinformatically detected regulatory, non protein coding, viral micro RNA (miRNA) gene. The method by which VGAM903 was detected is described hereinabove with reference to FIGS. 1-8.

VGAM903 gene, herein designated VGAM GENE, is a viral gene contained in the genome of Melanoplus Sanguinipes Entomopoxvirus. VGAM903 host target gene, herein designated VGAM HOST TARGET GENE, is a human gene contained in the human genome.

VGAM903 gene encodes a VGAM903 precursor RNA, herein designated VGAM PRECURSOR RNA. Similar to other miRNA genes, and unlike most ordinary genes, VGAM903 precursor RNA does not encode a protein. A nucleotide sequence identical or highly similar to the nucleotide sequence of VGAM903 precursor RNA is designated SEQ ID:889, and is provided hereinbelow with reference to the sequence listing part. Nucleotide sequence SEQ ID:889 is located at position 178832 relative to the genome of Melanoplus Sanguinipes Entomopoxvirus.

VGAM903 precursor RNA folds onto itself, forming VGAM903 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM903 folded precursor RNA into VGAM903 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM903 RNA is designated SEQ ID:3614, and is provided hereinbelow with reference to the sequence listing part.

VGAM903 host target gene, herein designated VGAM HOST TARGET GENE, encodes a corresponding messenger RNA, VGAM903 host target RNA, herein designated VGAM HOST TARGET RNA. VGAM903 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM903 RNA, herein designated VGAM RNA, binds complementarily to one or more host target binding sites located in untranslated regions of VGAM903 host target RNA, herein designated VGAM HOST TARGET RNA. This complementary binding is due to the fact that the nucleotide sequence of VGAM903 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM903 RNA, herein designated VGAM RNA, may have a different number of host target binding sites in untranslated regions of a VGAM903 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM903 RNA, herein designated VGAM RNA, to host target binding sites on VGAM903 host target RNA, herein designated VGAM HOST TARGET RNA, such as BINDING SITE I, BINDING SITE II and BINDING SITE III, inhibits translation of VGAM903 host target RNA into VGAM903 host target protein, herein designated VGAM HOST TARGET PROTEIN. VGAM host target protein is therefore outlined by a broken line.

It is appreciated that VGAM903 host target gene, herein designated VGAM HOST TARGET GENE, in fact represents a plurality of VGAM903 host target genes. The mRNA of each one of this plurality of VGAM903 host target genes comprises one or more host target binding sites, each having a nucleotide sequence which is at least partly complementary to VGAM903 RNA, herein designated VGAM RNA, and which when bound by VGAM903 RNA causes inhibition of translation of respective one or more VGAM903 host target proteins.

It is further appreciated by one skilled in the art that the mode of translational inhibition illustrated by FIG. 1 with specific reference to translational inhibition exerted by VGAM903 gene, herein designated VGAM GENE, on one or more VGAM903 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM903 is inhibition of expression of host target genes, as part of a novel viral mechanism of attacking a host. Accordingly, utilities of VGAM903 include diagnosis, prevention and treatment of viral infection by Melanoplus Sanguinipes Entomopoxvirus. Specific functions, and accordingly utilities, of VGAM903 correlate with, and may be deduced from, the identity of the host target genes which VGAM903 binds and inhibits, and the function of these host target genes, as elaborated hereinbelow.

Nucleotide sequences of the VGAM903 precursor RNA, herein designated VGAM PRECURSOR RNA, and of the 'diced' VGAM903 RNA, herein designated VGAM RNA, and a schematic representation of the secondary folding of VGAM903 folded precursor RNA, herein designated VGAM FOLDED PRECURSOR RNA, of VGAM903 are further described hereinbelow with reference to Table 1.

Nucleotide sequences of host target binding sites, such as BINDING SITE-I, BINDING SITE-II and BINDING SITE-III of FIG. 1, found on VGAM903 host target RNA, and schematic representation of the complementarity of each of these host target binding sites to VGAM903 RNA, herein designated VGAM RNA, are described hereinbelow with reference to Table 2.

As mentioned hereinabove with reference to FIG. 1, a function of VGAM903 gene, herein designated VGAM is inhibition of expression of VGAM903 target genes. It is appreciated that specific functions, and accordingly utilities, of VGAM903 correlate with, and may be deduced from, the identity of the target genes which VGAM903 binds and inhibits, and the function of these target genes, as elaborated hereinbelow.

FLJ20707 (Accession NM_017936) is a VGAM903 host target gene. FLJ20707 BINDING SITE is HOST TARGET binding site found in the 3' untranslated region of mRNA encoded by FLJ20707, corresponding to a HOST TARGET binding site such as BINDING SITE I, BINDING SITE II or BINDING SITE III. Table 2 illustrates the complementarity of the nucleotide sequences of FLJ20707 BINDING SITE, designated SEQ ID:19628, to the nucleotide sequence of VGAM903 RNA, herein designated VGAM RNA, also designated SEQ ID:3614.

A function of VGAM903 is therefore inhibition of FLJ20707 (Accession NM_017936). Accordingly, utilities of VGAM903 include diagnosis, prevention and treatment of diseases and clinical conditions associated with FLJ20707. FLJ21934 (Accession NM_024743) is another VGAM903 host target gene. FLJ21934 BINDING SITE is HOST TARGET binding site found in the 3' untranslated region of mRNA encoded by FLJ21934, corresponding to a HOST TARGET binding site such as BINDING SITE I, BINDING SITE II or BINDING SITE III. Table 2 illustrates the complementarity of the nucleotide sequences of FLJ21934 BINDING SITE, designated SEQ ID:24080, to the nucleotide sequence of VGAM903 RNA, herein designated VGAM RNA, also designated SEQ ID:3614.

Another function of VGAM903 is therefore inhibition of FLJ21934 (Accession NM_024743). Accordingly, utilities of VGAM903 include diagnosis, prevention and treatment of diseases and clinical conditions associated with FLJ21934. FIG. 1 further provides a conceptual description of a novel bioinformatically detected viral gene of the present invention, referred to here as Viral Genomic Address Messenger 904 (VGAM904) viral gene, which modulates expression of respective host target genes thereof, the function and utility of which host target genes is known in the art.

VGAM904 is a novel bioinformatically detected regulatory, non protein coding, viral micro RNA (miRNA) gene. The method by which VGAM904 was detected is described hereinabove with reference to FIGS. 1-8.

VGAM904 gene, herein designated VGAM GENE, is a viral gene contained in the genome of Melanoplus Sanguinipes Entomopoxvirus. VGAM904 host target gene, herein designated VGAM HOST TARGET GENE, is a human gene contained in the human genome.

VGAM904 gene encodes a VGAM904 precursor RNA, herein designated VGAM PRECURSOR RNA. Similar to other miRNA genes, and unlike most ordinary genes, VGAM904 precursor RNA does not encode a protein. A nucleotide sequence identical or highly similar to the nucleotide sequence of VGAM904 precursor RNA is designated SEQ ID:890, and is provided hereinbelow with reference to the sequence listing part. Nucleotide sequence SEQ ID:890 is located at position 179537 relative to the genome of Melanoplus Sanguinipes Entomopoxvirus.

VGAM904 precursor RNA folds onto itself, forming VGAM904 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM904 folded precursor RNA into VGAM904 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM904 RNA is designated SEQ ID:3615, and is provided hereinbelow with reference to the sequence listing part.

VGAM904 host target gene, herein designated VGAM HOST TARGET GENE, encodes a corresponding messenger RNA, VGAM904 host target RNA, herein designated VGAM HOST TARGET RNA. VGAM904 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM904 RNA, herein designated VGAM RNA, binds complementarily to one or more host target binding sites located in untranslated regions of VGAM904 host target RNA, herein designated VGAM HOST TARGET RNA. This complementary binding is due to the fact that the nucleotide sequence of VGAM904 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM904 RNA, herein designated VGAM RNA, may have a different number of host target binding sites in untranslated regions of a VGAM904 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM904 RNA, herein designated VGAM RNA, to host target binding sites on VGAM904 host target RNA, herein designated VGAM HOST TARGET RNA, such as BINDING SITE I, BINDING SITE II and BINDING SITE III, inhibits translation of VGAM904 host target RNA into VGAM904 host target protein, herein designated VGAM HOST TARGET PROTEIN. VGAM host target protein is therefore outlined by a broken line.

It is appreciated that VGAM904 host target gene, herein designated VGAM HOST TARGET GENE, in fact represents a plurality of VGAM904 host target genes. The mRNA of each one of this plurality of VGAM904 host target genes comprises one or more host target binding sites, each having a nucleotide sequence which is at least partly complementary to VGAM904 RNA, herein designated VGAM RNA, and which when bound by VGAM904 RNA causes inhibition of translation of respective one or more VGAM904 host target proteins.

It is further appreciated by one skilled in the art that the mode of translational inhibition illustrated by FIG. 1 with specific reference to translational inhibition exerted by VGAM904 gene, herein designated VGAM GENE, on one or more VGAM904 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM904 is inhibition of expression of host target genes, as part of a novel viral mechanism of attacking a host. Accordingly, utilities of VGAM904 include diagnosis, prevention and treatment of viral infection by Melanoplus Sanguinipes Entomopoxvirus. Specific functions, and accordingly utilities, of VGAM904 correlate with, and may be deduced from, the identity of the host target genes which VGAM904 binds and inhibits, and the function of these host target genes, as elaborated hereinbelow.

Nucleotide sequences of the VGAM904 precursor RNA, herein designated VGAM PRECURSOR RNA, and of the 'diced' VGAM904 RNA, herein designated VGAM RNA, and a schematic representation of the secondary folding of VGAM904 folded precursor RNA, herein designated VGAM FOLDED PRECURSOR RNA, of VGAM904 are further described hereinbelow with reference to Table 1.

Nucleotide sequences of host target binding sites, such as BINDING SITE-I, BINDING SITE-II and BINDING SITE-III of FIG. 1, found on VGAM904 host target RNA, and schematic representation of the complementarity of each of these host target binding sites to VGAM904 RNA, herein designated VGAM RNA, are described hereinbelow with reference to Table 2.

As mentioned hereinabove with reference to FIG. 1, a function of VGAM904 gene, herein designated VGAM is inhibition of expression of VGAM904 target genes. It is appreciated that specific functions, and accordingly utilities, of VGAM904 correlate with, and may be deduced from, the identity of the target genes which VGAM904 binds and inhibits, and the function of these target genes, as elaborated hereinbelow.

CARPX (Accession NM_020178) is a VGAM904 host target gene. CARPX BINDING SITE is HOST TARGET binding site found in the 3' untranslated region of mRNA encoded by CARPX, corresponding to a HOST TARGET binding site such as BINDING SITE I, BINDING SITE II or BINDING SITE III. Table 2 illustrates the complementarity of the nucleotide sequences of CARPX BINDING SITE, designated SEQ ID:21394, to the nucleotide sequence of VGAM904 RNA, herein designated VGAM RNA, also designated SEQ ID:3615.

A function of VGAM904 is therefore inhibition of CARPX (Accession NM_020178), a gene which is alpha-carbonic anhydrases-related protein. Accordingly, utilities of VGAM904 include diagnosis, prevention and treatment of diseases and clinical conditions associated with CARPX. The function of CARPX has been established by previous studies. Hewett-Emmett and Tashian (1996) described an alignment of 6 human brain ESTs that encode part of an alpha-carbonic anhydrase, which they named CA X. They noted that gln92, his94, and his119, which are invariant in all alpha-CA isozymes with catalytic activity, were replaced by glu, arg, and gln, respectively. They therefore suggested that CA X might represent a new CA-related protein (CA-RP). In reporting the sequence of partial CA XI (OMIM Ref. No. 604644) cDNAs from human and mouse, Lovejoy et al. (1998) stated that these sequences were most homologous to the human CA X sequence. They reported an extended but incomplete human CA X protein sequence of 169 amino acids that was based on exons in a BAC clone containing human genomic DNA from chromosome 17 (GenBank AC002090) and 5 additional human ESTs.

Full details of the abovementioned studies are described in the following publications, the disclosure of which are hereby incorporated by reference:

Hewett-Emmett, D.; Tashian, R. E.: Functional diversity, conservation, and convergence in the evolution of the alpha-, beta-, and gamma-carbonic anhydrase gene families. Molec. Phylogenet. Evol. 5:50-77, 1996; and Lovejoy, D. A.; Hewett-Emmett, D.; Porter, C. A.; Cepoi, D.; Sheffield, A.; Vale, W. W.; Tashian, R. E.: Evolutionarily conserved, 'acatalytic' carbonic anhydrase-related protein XI con.

Further studies establishing the function and utilities of CARPX are found in John Hopkins OMIM database record ID 604642, and in sited publications numbered 6935-6938 listed in the bibliography section hereinbelow, which are also hereby incorporated by reference. Interferon (alpha, beta and omega) Receptor 1 (IFNAR1, Accession NM_000629) is another VGAM904 host target gene. IFNAR1 BINDING SITE is HOST TARGET binding site found in the 3' untranslated region of mRNA encoded by IFNAR1, corresponding to a HOST TARGET binding site such as BINDING SITE I, BINDING SITE II or BINDING SITE III. Table 2 illustrates the complementarity of the nucleotide sequences of IFNAR1 BINDING SITE, designated SEQ ID:6245, to the nucleotide sequence of VGAM904 RNA, herein designated VGAM RNA, also designated SEQ ID:3615.

Another function of VGAM904 is therefore inhibition of Interferon (alpha, beta and omega) Receptor 1 (IFNAR1, Accession NM_000629), a gene which is a receptor for interferons alpha and beta. Accordingly, utilities of VGAM904 include diagnosis, prevention and treatment of diseases and clinical conditions associated with IFNAR1. The function of IFNAR1 has been established by previous studies. Alpha-type antiviral protein is a factor, presumably protein in nature, that mediates specific interferon inhibition of virus replication. According to studies of mouse-man hybrid clones, the locus determining this protein is carried on chromosome 21 (Tan et al., 1973). Tan et al. (1974) made observations of dosage effect in monosomy-21 and trisomy-21 cells which supported assignment of the locus to chromosome 21. This character was also called interferon sensitivity (IS). Chany et al. (1975) showed that trisomy-21 cells have increased interferon sensitivity. Trisomy-16 cells have reduced sensitivity. This might suggest the presence on chromosome 16 of a regulator of mouse antiviral protein. Revel et al. (1976) showed that antibody to a cell surface component coded by human chromosome 21 inhibited the action of interferon. This suggested that antiviral protein is an interferon receptor. See 147570, 147640, 147660 for a discussion of the gamma, beta, and alpha interferons, respectively. De Clercq et al. (1976) concluded that it is not a cell membrane receptor for interferon that is encoded by chromosome 21. Cellular responses to cytokines involve cross-communication through their respective receptors. The IFNs alpha, beta, and gamma mediate innate immune responses to viral infection through IFNAR1/IFNAR2 (OMIM Ref. No. 602376) for IFNA and IFNB, and IFNGR1 (OMIM Ref. No. 107470)/IFNGR2 (OMIM Ref. No. 147569) for IFNG. Stimulation of these receptors activates Janus protein kinases (e.g., JAK1, 147795 and JAK2, 147796), which leads to the tyrosine phosphorylation of STAT1 (OMIM Ref. No. 600555) and STAT2 (OMIM Ref. No. 600556). Although the IFN receptors are expressed at low levels in cells, they may be clustered in the cell membrane to permit efficient signal transduction. Using mouse embryonic fibroblasts (MEFs) from IFNAR1- and IFNGR1-deficient mice, Takaoka et al. (2000) observed that the STAT1-mediated DNA-binding activity and the antiviral response to IFNG in IFNAR-null MEFs but not to IFNA in IFNGR-null MEFs are impaired. Restoration of the IFNG response requires constitutive subthreshold IFNA/IFNB signaling and an intact IFNAR1 capable of interacting with STAT1 after tyrosine phosphorylation. Immunoblot analysis showed that IFNAR1 coimmunoprecipitated with the nonligand-binding component, IFNGR2, of the IFNGR complex in wildtype MEFs but less well in IFNB-null MEFs. Immunoblot analysis also demonstrated that the IFN receptor components are exclusively localized in the caveolar membrane fractions (see OMIM Ref. No. CAV1; 601047) where there is a concentration of cytoplasmically oriented signaling molecules Full details of the abovementioned studies are described in the following publications, the disclosure of which are hereby incorporated by reference:

Takaoka, A.; Mitani, Y.; Suemori, H.; Sato, M.; Yokochi, T.; Noguchi, S.; Tanaka, N.; Taniguchi, T.: Cross talk between interferon-gamma and -alpha/beta signaling components in caveolar membrane domains. Science 288:2357-2360, 2000; and Revel, M.; Bash, D.; Ruddle, F. H.: Antibodies to a cell-surface component coded by human chromosome 21 inhibit action of interferon. Nature 260:139-141, 1976.

Further studies establishing the function and utilities of IFNAR1 are found in John Hopkins OMIM database record ID 107450, and in sited publications numbered 12523-11826, 2737, 3910, 11827-1183 and 3643-3651 listed in the bibliography section hereinbelow, which are also hereby incorporated by reference. KIAA0318 (Accession XM_044334) is another VGAM904 host target gene. KIAA0318 BINDING SITE is HOST TARGET binding site found in the 3' untranslated region of mRNA encoded by KIAA0318, corresponding to a HOST TARGET binding site such as BINDING SITE I, BINDING SITE II or BINDING SITE III. Table 2 illustrates the complementarity of the nucleotide sequences of KIAA0318 BINDING SITE, designated SEQ ID:34183, to the nucleotide sequence of VGAM904 RNA, herein designated VGAM RNA, also designated SEQ ID:3615.

Another function of VGAM904 is therefore inhibition of KIAA0318 (Accession XM_044334). Accordingly, utilities of VGAM904 include diagnosis, prevention and treatment of diseases and clinical conditions associated with KIAA0318. LOC160414 (Accession XM_100898) is another VGAM904 host target gene. LOC160414 BINDING SITE is HOST TARGET binding site found in the 5' untranslated region of mRNA encoded by LOC160414, corresponding to a HOST TARGET binding site such as BINDING SITE I, BINDING SITE II or BINDING SITE III. Table 2 illustrates the complementarity of the nucleotide sequences of LOC160414 BINDING SITE, designated SEQ ID:42102, to the nucleotide sequence of VGAM904 RNA, herein designated VGAM RNA, also designated SEQ ID:3615.

Another function of VGAM904 is therefore inhibition of LOC160414 (Accession XM_100898). Accordingly, utilities of VGAM904 include diagnosis, prevention and treatment of diseases and clinical conditions associated with LOC160414. LOC57086 (Accession NM_020351) is another VGAM904 host target gene. LOC57086 BINDING SITE is HOST TARGET binding site found in the 3' untranslated region of mRNA encoded by LOC57086, corresponding to a HOST TARGET binding site such as BINDING SITE I, BINDING SITE II or BINDING SITE III. Table 2 illustrates the complementarity of the nucleotide sequences of LOC57086 BINDING SITE, designated SEQ ID:21615, to the nucleotide sequence of VGAM904 RNA, herein designated VGAM RNA, also designated SEQ ID:3615.

Another function of VGAM904 is therefore inhibition of LOC57086 (Accession NM_020351). Accordingly, utilities of VGAM904 include diagnosis, prevention and treatment of diseases and clinical conditions associated with LOC57086. FIG. 1 further provides a conceptual description of a novel bioinformatically detected viral gene of the present invention, referred to here as Viral Genomic Address Messenger 905 (VGAM905) viral gene, which modulates expression of respective host target genes thereof, the function and utility of which host target genes is known in the art.

VGAM905 is a novel bioinformatically detected regulatory, non protein coding, viral micro RNA (miRNA) gene. The method by which VGAM905 was detected is described hereinabove with reference to FIGS. 1-8.

VGAM905 gene, herein designated VGAM GENE, is a viral gene contained in the genome of Saimiriine Herpesvirus 2. VGAM905 host target gene, herein designated VGAM HOST TARGET GENE, is a human gene contained in the human genome.

VGAM905 gene encodes a VGAM905 precursor RNA, herein designated VGAM PRECURSOR RNA. Similar to other miRNA genes, and unlike most ordinary genes, VGAM905 precursor RNA does not encode a protein. A nucleotide sequence identical or highly similar to the nucleotide sequence of VGAM905 precursor RNA is designated SEQ ID:891, and is provided hereinbelow with reference to the sequence listing part. Nucleotide sequence SEQ ID:891 is located at position 79238 relative to the genome of Saimiriine Herpesvirus 2.

VGAM905 precursor RNA folds onto itself, forming VGAM905 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM905 folded precursor RNA into VGAM905 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM905 RNA is designated SEQ ID:3616, and is provided hereinbelow with reference to the sequence listing part.

VGAM905 host target gene, herein designated VGAM HOST TARGET GENE, encodes a corresponding messenger RNA, VGAM905 host target RNA, herein designated VGAM HOST TARGET RNA. VGAM905 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM905 RNA, herein designated VGAM RNA, binds complementarily to one or more host target binding sites located in untranslated regions of VGAM905 host target RNA, herein designated VGAM HOST TARGET RNA. This complementary binding is due to the fact that the nucleotide sequence of VGAM905 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM905 RNA, herein designated VGAM RNA, may have a different number of host target binding sites in untranslated regions of a VGAM905 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM905 RNA, herein designated VGAM RNA, to host target binding sites on VGAM905 host target RNA, herein designated VGAM HOST TARGET RNA, such as BINDING SITE I, BINDING SITE II and BINDING SITE III, inhibits translation of VGAM905 host target RNA into VGAM905 host target protein, herein designated VGAM HOST TARGET PROTEIN. VGAM host target protein is therefore outlined by a broken line.

It is appreciated that VGAM905 host target gene, herein designated VGAM HOST TARGET GENE, in fact represents a plurality of VGAM905 host target genes. The mRNA of each one of this plurality of VGAM905 host target genes comprises one or more host target binding sites, each having a nucleotide sequence which is at least partly complementary to VGAM905 RNA, herein designated VGAM RNA, and which when bound by VGAM905 RNA causes inhibition of translation of respective one or more VGAM905 host target proteins.

It is further appreciated by one skilled in the art that the mode of translational inhibition illustrated by FIG. 1 with specific reference to translational inhibition exerted by VGAM905 gene, herein designated VGAM GENE, on one or more VGAM905 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM905 is inhibition of expression of host target genes, as part of a novel viral mechanism of attacking a host. Accordingly, utilities of VGAM905 include diagnosis, prevention and treatment of viral infection by Saimiriine Herpesvirus 2. Specific functions, and accordingly utilities, of VGAM905 correlate with, and may be deduced from, the identity of the host target genes which VGAM905 binds and inhibits, and the function of these host target genes, as elaborated hereinbelow.

Nucleotide sequences of the VGAM905 precursor RNA, herein designated VGAM PRECURSOR RNA, and of the 'diced' VGAM905 RNA, herein designated VGAM RNA, and a schematic representation of the secondary folding of VGAM905 folded precursor RNA, herein designated VGAM FOLDED PRECURSOR RNA, of VGAM905 are further described hereinbelow with reference to Table 1.

Nucleotide sequences of host target binding sites, such as BINDING SITE-I, BINDING SITE-II and BINDING SITE-III of FIG. 1, found on VGAM905 host target RNA, and schematic representation of the complementarity of each of these host target binding sites to VGAM905 RNA, herein designated VGAM RNA, are described hereinbelow with reference to Table 2.

As mentioned hereinabove with reference to FIG. 1, a function of VGAM905 gene, herein designated VGAM is inhibition of expression of VGAM905 target genes. It is appreciated that specific functions, and accordingly utilities, of VGAM905 correlate with, and may be deduced from, the identity of the target genes which VGAM905 binds and inhibits, and the function of these target genes, as elaborated hereinbelow.

ABH (Accession XM_007409) is a VGAM905 host target gene. ABH BINDING SITE is HOST TARGET binding site found in the 3' untranslated region of mRNA encoded by ABH, corresponding to a HOST TARGET binding site such as BINDING SITE I, BINDING SITE II or BINDING SITE III. Table 2 illustrates the complementarity of the nucleotide sequences of ABH BINDING SITE, designated SEQ ID:30056, to the nucleotide sequence of VGAM905 RNA, herein designated VGAM RNA, also designated SEQ ID:3616.

A function of VGAM905 is therefore inhibition of ABH (Accession XM_007409). Accordingly, utilities of VGAM905 include diagnosis, prevention and treatment of diseases and clinical conditions associated with ABH. Brain and Acute Leukemia, Cytoplasmic (BAALC, Accession NM_024812) is another VGAM905 host target gene. BAALC BINDING SITE is HOST TARGET binding site found in the 3' untranslated region of mRNA encoded by BAALC, corresponding to a HOST TARGET binding site such as BINDING SITE I, BINDING SITE II or BINDING SITE III. Table 2 illustrates the complementarity of the nucleotide sequences of BAALC BINDING SITE, designated SEQ ID:24195, to the nucleotide sequence of VGAM905 RNA, herein designated VGAM RNA, also designated SEQ ID:3616.

Another function of VGAM905 is therefore inhibition of Brain and Acute Leukemia, Cytoplasmic (BAALC, Accession NM_024812). Accordingly, utilities of VGAM905 include diagnosis, prevention and treatment of diseases and clinical conditions associated with BAALC. CD34 Antigen (CD34, Accession NM_001773) is another VGAM905 host target gene. CD34 BINDING SITE is HOST TARGET binding site found in the 3' untranslated region of mRNA encoded by CD34, corresponding to a HOST TARGET binding site such as BINDING SITE I, BINDING SITE II or BINDING SITE III. Table 2 illustrates the complementarity of the nucleotide sequences of CD34 BINDING SITE, designated SEQ ID:7537, to the nucleotide sequence of VGAM905 RNA, herein designated VGAM RNA, also designated SEQ ID:3616.

Another function of VGAM905 is therefore inhibition of CD34 Antigen (CD34, Accession NM_001773), a gene which is a monomeric cell surface antigen that is selectively expressed on human hematopoietic progenitor cells. Accordingly, utilities of VGAM905 include diagnosis, prevention and treatment of diseases and clinical conditions associated with CD34. The function of CD34 and its association with various diseases and clinical conditions, has been established by previous studies, as described hereinabove with reference to VGAM55. Deoxycytidine Kinase (DCK, Accession NM_000788) is another VGAM905 host target gene. DCK BINDING SITE is HOST TARGET binding site found in the 3" untranslated region of mRNA encoded by DCK, corresponding to a HOST TARGET binding site such as BINDING SITE I, BINDING SITE II or BINDING SITE III. Table 2 illustrates the complementarity of the nucleotide sequences of DCK BINDING SITE, designated SEQ ID:6443, to the nucleotide sequence of VGAM905 RNA, herein designated VGAM RNA, also designated SEQ ID:3616.

Another function of VGAM905 is therefore inhibition of Deoxycytidine Kinase (DCK, Accession NM_000788), a gene which mediates the phosphorylation of several deoxyribonucleosides and their analogs. Accordingly, utilities of VGAM905 include diagnosis, prevention and treatment of diseases and clinical conditions associated with DCK. The function of DCK and its association with various diseases and clinical conditions, has been established by previous studies, as described hereinabove with reference to VGAM538. Fatty-acid-Coenzyme A Ligase, Long-chain 4 (FACL4, Accession NM_022977) is another VGAM905 host target gene. FACL4 BINDING SITE is HOST TARGET binding site found in the 5' untranslated region of mRNA encoded by FACL4, corresponding to a HOST TARGET binding site such as BINDING SITE I, BINDING SITE II or BINDING SITE III. Table 2 illustrates the complementarity of the nucleotide sequences of FACL4 BINDING SITE, designated SEQ ID:23255, to the nucleotide sequence of VGAM905 RNA, herein designated VGAM RNA, also designated SEQ ID:3616.

Another function of VGAM905 is therefore inhibition of Fatty-acid-Coenzyme A Ligase, Long-chain 4 (FACL4, Accession NM_022977). Accordingly, utilities of VGAM905 include diagnosis, prevention and treatment of diseases and clinical conditions associated with FACL4. FREB (Accession NM_032738) is another VGAM905 host target gene. FREB BINDING SITE is HOST TARGET binding site found in the 3' untranslated region of mRNA encoded by FREB, corresponding to a HOST TARGET binding site such as BINDING SITE I, BINDING SITE II or BINDING SITE III. Table 2 illustrates the complementarity of the nucleotide sequences of FREB BINDING SITE, designated SEQ ID:26466, to the nucleotide sequence of VGAM905 RNA, herein designated VGAM RNA, also designated SEQ ID:3616.

Another function of VGAM905 is therefore inhibition of FREB (Accession NM_032738). Accordingly, utilities of VGAM905 include diagnosis, prevention and treatment of diseases and clinical conditions associated with FREB. Interleukin 1 Receptor, Type I (IL1R1, Accession NM_000877) is another VGAM905 host target gene. IL1R1 BINDING SITE is HOST TARGET binding site found in the 3' untranslated region of mRNA encoded by IL1R1, corresponding to a HOST TARGET binding site such as BINDING SITE I, BINDING SITE II or BINDING SITE III. Table 2 illustrates the complementarity of the nucleotide sequences of IL1R1 BINDING SITE, designated SEQ ID:6563, to the nucleotide sequence of VGAM905 RNA, herein designated VGAM RNA, also designated SEQ ID:3616.

Another function of VGAM905 is therefore inhibition of Interleukin 1 Receptor, Type I (IL1R1, Accession NM_000877), a gene which is a receptor for interleukin-1 alpha (il-1a), beta (il-1b), and interleukin-1 receptor antagonist protein (il-1ra). Accordingly, utilities of VGAM905 include diagnosis, prevention and treatment of diseases and clinical conditions associated with IL1R1. The function of IL1R1 and its association with various diseases and clinical conditions, has been established by previous studies, as described hereinabove with reference to VGAM704. Junctional Adhesion Molecule 3 (JAM3, Accession NM_032801) is another VGAM905 host target gene. JAM3 BINDING SITE is HOST TARGET binding site found in the 3' untranslated region of mRNA encoded by JAM3, corresponding to a HOST TARGET binding site such as BINDING SITE I, BINDING SITE II or BINDING SITE III. Table 2 illustrates the complementarity of the nucleotide sequences of JAM3 BINDING SITE, designated SEQ ID:26555, to the nucleotide sequence of VGAM905 RNA, herein designated VGAM RNA, also designated SEQ ID:3616.

Another function of VGAM905 is therefore inhibition of Junctional Adhesion Molecule 3 (JAM3, Accession NM_032801), a gene which is a member of the junctional adhesion molecule protein family. Accordingly, utilities of VGAM905 include diagnosis, prevention and treatment of diseases and clinical conditions associated with JAM3. The function of JAM3 and its association with various diseases and clinical conditions, has been established by previous studies, as described hereinabove with reference to VGAM200. Nuclear Receptor Coactivator 3 (NCOA3, Accession NM_006534) is another VGAM905 host target gene. NCOA3 BINDING SITE is HOST TARGET binding site found in the 3' untranslated region of mRNA encoded by NCOA3, corresponding to a HOST TARGET binding site such as BINDING SITE I, BINDING SITE II or BINDING SITE III. Table 2 illustrates the complementarity of the nucleotide sequences of NCOA3 BINDING SITE, designated SEQ ID:13283, to the nucleotide sequence of VGAM905 RNA, herein designated VGAM RNA, also designated SEQ ID:3616.

Another function of VGAM905 is therefore inhibition of Nuclear Receptor Coactivator 3 (NCOA3, Accession NM_006534), a gene which directly binds nuclear receptors and stimulates the transcriptional activities in hormone-dependent fashion. Accordingly, utilities of VGAM905 include diagnosis, prevention and treatment of diseases and clinical conditions associated with NCOA3. The function of NCOA3 and its association with various diseases and clinical conditions, has been established by previous studies, as described hereinabove with reference to VGAM215. Nuclear Receptor Interacting Protein 1 (NRIP1, Accession XM_009699) is another VGAM905 host target gene. NRIP1 BINDING SITE is HOST TARGET binding site found in the 5' untranslated region of mRNA encoded by NRIP1, corresponding to a HOST TARGET binding site such as BINDING SITE I, BINDING SITE II or BINDING SITE III. Table 2 illustrates the complementarity of the nucleotide sequences of NRIP1 BINDING SITE, designated SEQ ID:30122, to the nucleotide sequence of VGAM905 RNA, herein designated VGAM RNA, also designated SEQ ID:3616.

Another function of VGAM905 is therefore inhibition of Nuclear Receptor Interacting Protein 1 (NRIP1, Accession XM_009699), a gene which modulates transcriptional activation by the estrogen receptor. Accordingly, utilities of VGAM905 include diagnosis, prevention and treatment of diseases and clinical conditions associated with NRIP1. The function of NRIP1 and its association with various diseases and clinical conditions, has been established by previous studies, as described hereinabove with reference to VGAM276. Prominin-like 1 (mouse) (PROML1, Accession NM_006017) is another VGAM905 host target gene. PROML1 BINDING SITE is HOST TARGET binding site found in the 3' untranslated region of mRNA encoded by PROML1, corresponding to a HOST TARGET binding site such as BINDING SITE I, BINDING SITE II or BINDING SITE III. Table 2 illustrates the complementarity of the nucleotide sequences of PROML1 BINDING SITE, designated SEQ ID:12634, to the nucleotide sequence of VGAM905 RNA, herein designated VGAM RNA, also designated SEQ ID:3616.

Another function of VGAM905 is therefore inhibition of Prominin-like 1 (mouse) (PROML1, Accession NM_006017), a gene which is a Transmembrane protein. Accordingly, utilities of VGAM905 include diagnosis, prevention and treatment of diseases and clinical conditions associated with PROML1. The function of PROML1 has been established by previous studies. the prominin 5-transmembrane domain glycoprotein was originally identified as a protein that selectively localized at the apical surface of murine neuroepithelial cells, whereas PROML1 was identified as an antigenic marker (AC133 antigen) in hematopoietic stem cells (Miraglia et al., 1997; Yin et al., 1997) and found to be expressed in retinoblastoma cell lines and adult retina. Most of the PROML1 gene is contained in 23 exons distributed over more than 50 kb of genomic sequence. The gene is predicted to encode an 865-amino acid glycoprotein. Prominin is conserved throughout the animal kingdom. Photoreceptors are the cells in the retina that are responsible for generation of the neuronal signal in response to light. The outer segments of vertebrate photoreceptors house a stack of photoreceptive membranes called disks. These membranes have a high rate of turnover. Disks of vertebrate photoreceptors are produced at the base of the outer segments initially by evagination of the plasma membrane with subsequent rim formation and membrane fusion resulting in release of the individual disks into the cytoplasm. The disks are ultimately shed from the terminal end of the outer segment and phagocytosed by the retinal pigment epithelium. A similar, although not identical process appears to occur in cone photoreceptor disks. Because of their origin from the plasma membranes, genes that encode retinal proteins targeted to plasma membrane protrusions represent candidates for inherited retinal degenerations. One such candidate is the gene encoding human PROML1. Murine prominin (prom) shows a strong preference for plasma membrane protrusions in a variety of epithelial cells, whereas PROML1 is expressed in retinoblastoma cell lines and adult retina. Maw et al. (2000) performed molecular genetic analyses on an Indian pedigree segregating for autosomal recessive retinal degeneration and found that affected individuals were homozygous for deletion of nucleotide 1878 (a G) in PROML1 (604365.0001). This alteration was predicted to result in a frameshift at codon 614 with premature termination of translation. Expression of a similar prom deletion mutant in CHO cells indicated that the truncated protein does not reach the cell surface. Immunocytochemistry indicated that prom is concentrated in the plasma membrane evaginations at the base of the outer segments of rod photoreceptors. These findings suggested that loss of prominin causes retinal degeneration, possibly because of impaired generation of the evaginations and/or impaired conversion of the evaginations to disks. In the family in which Maw et al. (2000) found the deletion mutation in PROML1, 4 of 8 children were affected, the offspring of an uncle-niece marriage. Linkage studies localized the mutant gene to 4p. Two-point linkage analysis using the deletion mutation gave a peak lod score of 3.17 at theta=0.00. Markers distal to D4S1602 formed a haplotype that cosegregated with the disorder. Crossovers indicated that the critical region was proximal to D4S2960 and distal to D4S1567. This region was found to be distinct from the distal PDEB (OMIM Ref. No. 180072) region at 4p16.3 and the proximal CNGA1 (OMIM Ref. No. 123825) region at 4p12-cen; both of these genes had previously been implicated in autosomal recessive retinal degeneration.

Full details of the abovementioned studies are described in the following publications, the disclosure of which are hereby incorporated by reference:

Maw, M. A.; Corbeil, D.; Koch, J.; Hellwig, A.; Wilson-Wheeler, J. C.; Bridges, R. J.; Kumaramanickavel, G.; John, S.; Nancarrow, D.; Roper, K.; Weigmann, A.; Huttner, W. B.; Denton, M. J.: A frameshift mutation in prominin (mouse)-like 1 causes human retinal degeneration. Hum. Molec. Genet. 9:27-34, 2000; and Miraglia, S.; Godfrey, W.; Yin, A. H.; Atkins, K.; Warnke, R.; Holden, J. T.; Bray, R. A.; Waller, E. K.; Buck, D. W.: A novel five-transmembrane hematopoietic stem cell antigen: isola.

Further studies establishing the function and utilities of PROML1 are found in John Hopkins OMIM database record ID 604365, and in sited publications numbered 5316-5318 listed in the bibliography section hereinbelow, which are also hereby incorporated by reference. RGL (Accession NM_015149) is another VGAM905 host target gene. RGL BINDING SITE is HOST TARGET binding site found in the 3' untranslated region of mRNA encoded by RGL, corresponding to a HOST TARGET binding site such as BINDING SITE I, BINDING SITE II or BINDING SITE III. Table 2 illustrates the complementarity of the nucleotide sequences of RGL BINDING SITE, designated SEQ ID:17505, to the nucleotide sequence of VGAM905 RNA, herein designated VGAM RNA, also designated SEQ ID:3616.

Another function of VGAM905 is therefore inhibition of RGL (Accession NM_015149), a gene which is involved in nucleotide exchange factor. Accordingly, utilities of VGAM905 include diagnosis, prevention and treatment of diseases and clinical conditions associated with RGL. The function of RGL and its association with various diseases and clinical conditions, has been established by previous studies, as described hereinabove with reference to VGAM861. Angiomotin (AMOT, Accession NM_133265) is another VGAM905 host target gene. AMOT BINDING SITE is HOST TARGET binding site found in the 3' untranslated region of mRNA encoded by AMOT, corresponding to a HOST TARGET binding site such as BINDING SITE I, BINDING SITE II or BINDING SITE III. Table 2 illustrates the complementarity of the nucleotide sequences of AMOT BINDING SITE, designated SEQ ID:28420, to the nucleotide sequence of VGAM905 RNA, herein designated VGAM RNA, also designated SEQ ID:3616.

Another function of VGAM905 is therefore inhibition of Angiomotin (AMOT, Accession NM_133265). Accordingly, utilities of VGAM905 include diagnosis, prevention and treatment of diseases and clinical conditions associated with AMOT. ARSDR1 (Accession NM_016026) is another VGAM905 host target gene. ARSDR1 BINDING SITE is HOST TARGET binding site found in the 3' untranslated region of mRNA encoded by ARSDR1, corresponding to a HOST TARGET binding site such as BINDING SITE I, BINDING SITE II or BINDING SITE III. Table 2 illustrates the complementarity of the nucleotide sequences of ARSDR1 BINDING SITE, designated SEQ ID:18111, to the nucleotide sequence of VGAM905 RNA, herein designated VGAM RNA, also designated SEQ ID:3616.

Another function of VGAM905 is therefore inhibition of ARSDR1 (Accession NM_016026). Accordingly, utilities of VGAM905 include diagnosis, prevention and treatment of diseases and clinical conditions associated with ARSDR1. FLJ12171 (Accession NM_024619) is another VGAM905 host target gene. FLJ12171 BINDING SITE is HOST TARGET binding site found in the 3' untranslated region of mRNA encoded by FLJ12171, corresponding to a HOST TARGET binding site such as BINDING SITE I, BINDING SITE II or BINDING SITE III. Table 2 illustrates the complementarity of the nucleotide sequences of FLJ12171 BINDING SITE, designated SEQ ID:23880, to the nucleotide sequence of VGAM905 RNA, herein designated VGAM RNA, also designated SEQ ID:3616.

Another function of VGAM905 is therefore inhibition of FLJ12171 (Accession NM_024619). Accordingly, utilities of VGAM905 include diagnosis, prevention and treatment of diseases and clinical conditions associated with FLJ12171. Glutamate Receptor, Ionotropic, Delta 1 (GRID1, Accession XM_043613) is another VGAM905 host target gene. GRID1 BINDING SITE is HOST TARGET binding site found in the 3' untranslated region of mRNA encoded by GRID1, corresponding to a HOST TARGET binding site such as BINDING SITE I, BINDING SITE II or BINDING SITE III. Table 2 illustrates the complementarity of the nucleotide sequences of GRID1 BINDING SITE, designated SEQ ID:33977, to the nucleotide sequence of VGAM905 RNA, herein designated VGAM RNA, also designated SEQ ID:3616.

Another function of VGAM905 is therefore inhibition of Glutamate Receptor, Ionotropic, Delta 1 (GRID1, Accession XM_043613). Accordingly, utilities of VGAM905 include diagnosis, prevention and treatment of diseases and clinical conditions associated with GRID1. KIAA0332 (Accession XM_031553) is another VGAM905 host target gene. KIAA0332 BINDING SITE is HOST TARGET binding site found in the 3' untranslated region of mRNA encoded by KIAA0332, corresponding to a HOST TARGET binding site such as BINDING SITE I, BINDING SITE II or BINDING SITE III. Table 2 illustrates the complementarity of the nucleotide sequences of KIAA0332 BINDING SITE, designated SEQ ID:31417, to the nucleotide sequence of VGAM905 RNA, herein designated VGAM RNA, also designated SEQ ID:3616.

Another function of VGAM905 is therefore inhibition of KIAA0332 (Accession XM_031553). Accordingly, utilities of VGAM905 include diagnosis, prevention and treatment of diseases and clinical conditions associated with KIAA0332. KIAA0556 (Accession XM_044632) is another VGAM905 host target gene. KIAA0556 BINDING SITE is HOST TARGET binding site found in the 3' untranslated region of mRNA encoded by KIAA0556, corresponding to a HOST TARGET binding site such as BINDING SITE I, BINDING SITE II or BINDING SITE III. Table 2 illustrates the complementarity of the nucleotide sequences of KIAA0556 BINDING SITE, designated SEQ ID:34248, to the nucleotide sequence of VGAM905 RNA, herein designated VGAM RNA, also designated SEQ ID:3616.

Another function of VGAM905 is therefore inhibition of KIAA0556 (Accession XM_044632). Accordingly, utilities of VGAM905 include diagnosis, prevention and treatment of diseases and clinical conditions associated with KIAA0556. KIAA0826 (Accession XM_093839) is another VGAM905 host target gene. KIAA0826 BINDING SITE is HOST TARGET binding site found in the 3' untranslated region of mRNA encoded by KIAA0826, corresponding to a HOST TARGET binding site such as BINDING SITE I, BINDING SITE II or BINDING SITE III. Table 2 illustrates the complementarity of the nucleotide sequences of KIAA0826 BINDING SITE, designated SEQ ID:40214, to the nucleotide sequence of VGAM905 RNA, herein designated VGAM RNA, also designated SEQ ID:3616.

Another function of VGAM905 is therefore inhibition of KIAA0826 (Accession XM_093839). Accordingly, utilities of VGAM905 include diagnosis, prevention and treatment of diseases and clinical conditions associated with KIAA0826. KIAA0977 (Accession NM_014900) is another VGAM905 host target gene. KIAA0977 BINDING SITE is HOST TARGET binding site found in the 3' untranslated region of mRNA encoded by KIAA0977, corresponding to a HOST TARGET binding site such as BINDING SITE I, BINDING SITE II or BINDING SITE III. Table 2 illustrates the complementarity of the nucleotide sequences of KIAA0977 BINDING SITE, designated SEQ ID:17080, to the nucleotide sequence of VGAM905 RNA, herein designated VGAM RNA, also designated SEQ ID:3616.

Another function of VGAM905 is therefore inhibition of KIAA0977 (Accession NM_014900). Accordingly, utilities of VGAM905 include diagnosis, prevention and treatment of diseases and clinical conditions associated with KIAA0977. KIAA1041 (Accession NM_014947) is another VGAM905 host target gene. KIAA1041 BINDING SITE is HOST TARGET binding site found in the 3' untranslated region of mRNA encoded by KIAA1041, corresponding to a HOST TARGET binding site such as BINDING SITE I, BINDING SITE II or BINDING SITE III. Table 2 illustrates the complementarity of the nucleotide sequences of KIAA1041 BINDING SITE, designated SEQ ID:17265, to the nucleotide sequence of VGAM905 RNA, herein designated VGAM RNA, also designated SEQ ID:3616.

Another function of VGAM905 is therefore inhibition of KIAA1041 (Accession NM_014947). Accordingly, utilities of VGAM905 include diagnosis, prevention and treatment of diseases and clinical conditions associated with KIAA1041. KIAA1238 (Accession XM_048675) is another VGAM905 host target gene. KIAA1238 BINDING SITE is HOST TARGET binding site found in the 3' untranslated region of mRNA encoded by KIAA1238, corresponding to a HOST TARGET binding site such as BINDING SITE I, BINDING SITE II or BINDING SITE III. Table 2 illustrates the complementarity of the nucleotide sequences of KIAA1238 BINDING SITE, designated SEQ ID:35215, to the nucleotide sequence of VGAM905 RNA, herein designated VGAM RNA, also designated SEQ ID:3616.

Another function of VGAM905 is therefore inhibition of KIAA1238 (Accession XM_048675). Accordingly, utilities of VGAM905 include diagnosis, prevention and treatment of diseases and clinical conditions associated with KIAA1238. Methionyl Aminopeptidase 1 (METAP1, Accession XM_052334) is another VGAM905 host target gene. METAP1 BINDING SITE is HOST TARGET binding site found in the 3' untranslated region of mRNA encoded by METAP1, corresponding to a HOST TARGET binding site such as BINDING SITE I, BINDING SITE II or BINDING SITE III. Table 2 illustrates the complementarity of the nucleotide sequences of METAP1 BINDING SITE, designated SEQ ID:35958, to the nucleotide sequence of VGAM905 RNA, herein designated VGAM RNA, also designated SEQ ID:3616.

Another function of VGAM905 is therefore inhibition of Methionyl Aminopeptidase 1 (METAP1, Accession XM_052334). Accordingly, utilities of VGAM905 include diagnosis, prevention and treatment of diseases and clinical conditions associated with METAP1. NIN283 (Accession NM_032268) is another VGAM905 host target gene. NIN283 BINDING SITE is HOST TARGET binding site found in the 3' untranslated region of mRNA encoded by NIN283, corresponding to a HOST TARGET binding site such as BINDING SITE I, BINDING SITE II or BINDING SITE III. Table 2 illustrates the complementarity of the nucleotide sequences of NIN283 BINDING SITE, designated SEQ ID:26015, to the nucleotide sequence of VGAM905 RNA, herein designated VGAM RNA, also designated SEQ ID:3616.

Another function of VGAM905 is therefore inhibition of NIN283 (Accession NM_032268). Accordingly, utilities of VGAM905 include diagnosis, prevention and treatment of diseases and clinical conditions associated with NIN283. PRO1331 (Accession NM_030778) is another VGAM905 host target gene. PRO1331 BINDING SITE is HOST TARGET binding site found in the 5' untranslated region of mRNA encoded by PRO1331, corresponding to a HOST TARGET binding site such as BINDING SITE I, BINDING SITE II or BINDING SITE III. Table 2 illustrates the complementarity of the nucleotide sequences of PRO1331 BINDING SITE, designated SEQ ID:25067, to the nucleotide sequence of VGAM905 RNA, herein designated VGAM RNA, also designated SEQ ID:3616.

Another function of VGAM905 is therefore inhibition of PRO1331 (Accession NM_030778). Accordingly, utilities of VGAM905 include diagnosis, prevention and treatment of diseases and clinical conditions associated with PRO1331. Serine Threonine Kinase 39 (STE20/SPS1 homolog, yeast) (STK39, Accession NM_013233) is another VGAM905 host target gene. STK39 BINDING SITE is HOST TARGET binding site found in the 3' untranslated region of mRNA encoded by STK39, corresponding to a HOST TARGET binding site such as BINDING SITE I, BINDING SITE II or BINDING SITE III. Table 2 illustrates the complementarity of the nucleotide sequences of STK39 BINDING SITE, designated SEQ ID:14891, to the nucleotide sequence of VGAM905 RNA, herein designated VGAM RNA, also designated SEQ ID:3616.

Another function of VGAM905 is therefore inhibition of Serine Threonine Kinase 39 (STE20/SPS1 homolog, yeast) (STK39, Accession NM_013233). Accordingly, utilities of VGAM905 include diagnosis, prevention and treatment of diseases and clinical conditions associated with STK39. TRIP-Br2 (Accession NM_014755) is another VGAM905 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16493, to the nucleotide sequence of VGAM905 RNA, herein designated VGAM RNA, also designated SEQ ID:3616.

Another function of VGAM905 is therefore inhibition of TRIP-Br2 (Accession NM_014755). Accordingly, utilities of VGAM905 include diagnosis, prevention and treatment of diseases and clinical conditions associated with TRIP-Br2. LOC120856 (Accession XM_058509) is another VGAM905 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36633, to the nucleotide sequence of VGAM905 RNA, herein designated VGAM RNA, also designated SEQ ID:3616.

Another function of VGAM905 is therefore inhibition of LOC120856 (Accession XM_058509). Accordingly, utilities of VGAM905 include diagnosis, prevention and treatment of diseases and clinical conditions associated with LOC120856. LOC120939 (Accession XM_073688) is another VGAM905 host target gene. LOC120939 BINDING SITE is HOST TARGET binding site found in the 3' untranslated region of mRNA encoded by LOC120939, corresponding to a HOST TARGET binding site such as BINDING SITE I, BINDING SITE II or BINDING SITE III. Table 2 illustrates the complementarity of the nucleotide sequences of LOC120939 BINDING SITE, designated SEQ ID:37510, to the nucleotide sequence of VGAM905 RNA, herein designated VGAM RNA, also designated SEQ ID:3616.

Another function of VGAM905 is therefore inhibition of LOC120939 (Accession XM_073688). Accordingly, utilities of VGAM905 include diagnosis, prevention and treatment of diseases and clinical conditions associated with LOC120939. LOC130612 (Accession XM_059461) is another VGAM905 host target gene. LOC130612 BINDING SITE is HOST TARGET binding site found in the 3' untranslated region of mRNA encoded by LOC130612, corresponding to a HOST TARGET binding site such as BINDING SITE I, BINDING SITE II or BINDING SITE III. Table 2 illustrates the complementarity of the nucleotide sequences of LOC130612 BINDING SITE, designated SEQ ID:36997, to the nucleotide sequence of VGAM905 RNA, herein designated VGAM RNA, also designated SEQ ID:3616.

Another function of VGAM905 is therefore inhibition of LOC130612 (Accession XM_059461). Accordingly, utilities of VGAM905 include diagnosis, prevention and treatment of diseases and clinical conditions associated with LOC130612. LOC148936 (Accession XM_097556) is another VGAM905 host target gene. LOC148936 BINDING SITE is HOST TARGET binding site found in the 5' untranslated region of mRNA encoded by LOC148936, corresponding to a HOST TARGET binding site such as BINDING SITE I, BINDING SITE II or BINDING SITE III. Table 2 illustrates the complementarity of the nucleotide sequences of LOC148936 BINDING SITE, designated SEQ ID:40931, to the nucleotide sequence of VGAM905 RNA, herein designated VGAM RNA, also designated SEQ ID:3616.

Another function of VGAM905 is therefore inhibition of LOC148936 (Accession XM_097556). Accordingly, utilities of VGAM905 include diagnosis, prevention and treatment of diseases and clinical conditions associated with LOC148936. LOC148938 (Accession XM_097555) is another VGAM905 host target gene. LOC148938 BINDING SITE is HOST TARGET binding site found in the 5' untranslated region of mRNA encoded by LOC148938, corresponding to a HOST TARGET binding site such as BINDING SITE I, BINDING SITE II or BINDING SITE III. Table 2 illustrates the complementarity of the nucleotide sequences of LOC148938 BINDING SITE, designated SEQ ID:40924, to the nucleotide sequence of VGAM905 RNA, herein designated VGAM RNA, also designated SEQ ID:3616.

Another function of VGAM905 is therefore inhibition of LOC148938 (Accession XM_097555). Accordingly, utilities of VGAM905 include diagnosis, prevention and treatment of diseases and clinical conditions associated with LOC148938. LOC221504 (Accession XM_166476) is another VGAM905 host target gene. LOC221504 BINDING SITE is HOST TARGET binding site found in the 3' untranslated region of mRNA encoded by LOC221504, corresponding to a HOST TARGET binding site such as BINDING SITE I, BINDING SITE II or BINDING SITE III. Table 2 illustrates the complementarity of the nucleotide sequences of LOC221504 BINDING SITE, designated SEQ ID:44396, to the nucleotide sequence of VGAM905 RNA, herein designated VGAM RNA, also designated SEQ ID:3616.

Another function of VGAM905 is therefore inhibition of LOC221504 (Accession XM_166476). Accordingly, utilities of VGAM905 include diagnosis, prevention and treatment of diseases and clinical conditions associated with LOC221504. LOC91151 (Accession NM_033208) is another VGAM905 host target gene. LOC91151 BINDING SITE is HOST TARGET binding site found in the 5' untranslated region of mRNA encoded by LOC91151, corresponding to a HOST TARGET binding site such as BINDING SITE I, BINDING SITE II or BINDING SITE III. Table 2 illustrates the complementarity of the nucleotide sequences of LOC91151 BINDING SITE, designated SEQ ID:27056, to the nucleotide sequence of VGAM905 RNA, herein designated VGAM RNA, also designated SEQ ID:3616.

Another function of VGAM905 is therefore inhibition of LOC91151 (Accession NM_033208). Accordingly, utilities of VGAM905 include diagnosis, prevention and treatment of diseases and clinical conditions associated with LOC91151. LOC92391 (Accession XM_044793) is another VGAM905 host target gene. LOC92391 BINDING SITE is HOST TARGET binding site found in the 3' untranslated region of mRNA encoded by LOC92391, corresponding to a HOST TARGET binding site such as BINDING SITE I, BINDING SITE II or BINDING SITE III. Table 2 illustrates the complementarity of the nucleotide sequences of LOC92391 BINDING SITE, designated SEQ ID:34273, to the nucleotide sequence of VGAM905 RNA, herein designated VGAM RNA, also designated SEQ ID:3616.

Another function of VGAM905 is therefore inhibition of LOC92391 (Accession XM_044793). Accordingly, utilities of VGAM905 include diagnosis, prevention and treatment of diseases and clinical conditions associated with LOC92391. FIG. 1 further provides a conceptual description of a novel bioinformatically detected viral gene of the present invention, referred to here as Viral Genomic Address Messenger 906 (VGAM906) viral gene, which modulates expression of respective host target genes thereof, the function and utility of which host target genes is known in the art.

VGAM906 is a novel bioinformatically detected regulatory, non protein coding, viral micro RNA (miRNA) gene. The method by which VGAM906 was detected is described hereinabove with reference to FIGS. 1-8.

VGAM906 gene, herein designated VGAM GENE, is a viral gene contained in the genome of Saimiriine Herpesvirus 2. VGAM906 host target gene, herein designated VGAM HOST TARGET GENE, is a human gene contained in the human genome.

VGAM906 gene encodes a VGAM906 precursor RNA, herein designated VGAM PRECURSOR RNA. Similar to other miRNA genes, and unlike most ordinary genes, VGAM906 precursor RNA does not encode a protein. A nucleotide sequence identical or highly similar to the nucleotide sequence of VGAM906 precursor RNA is designated SEQ ID:892, and is provided hereinbelow with reference to the sequence listing part. Nucleotide sequence SEQ ID:892 is located at position 77662 relative to the genome of Saimiriine Herpesvirus 2.

VGAM906 precursor RNA folds onto itself, forming VGAM906 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM906 folded precursor RNA into VGAM906 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM906 RNA is designated SEQ ID:3617, and is provided hereinbelow with reference to the sequence listing part.

VGAM906 host target gene, herein designated VGAM HOST TARGET GENE, encodes a corresponding messenger RNA, VGAM906 host target RNA, herein designated VGAM HOST TARGET RNA. VGAM906 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM906 RNA, herein designated VGAM RNA, binds complementarily to one or more host target binding sites located in untranslated regions of VGAM906 host target RNA, herein designated VGAM HOST TARGET RNA. This complementary binding is due to the fact that the nucleotide sequence of VGAM906 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM906 RNA, herein designated VGAM RNA, may have a different number of host target binding sites in untranslated regions of a VGAM906 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM906 RNA, herein designated VGAM RNA, to host target binding sites on VGAM906 host target RNA, herein designated VGAM HOST TARGET RNA, such as BINDING SITE I, BINDING SITE II and BINDING SITE III, inhibits translation of VGAM906 host target RNA into VGAM906 host target protein, herein designated VGAM HOST TARGET PROTEIN. VGAM host target protein is therefore outlined by a broken line.

It is appreciated that VGAM906 host target gene, herein designated VGAM HOST TARGET GENE, in fact represents a plurality of VGAM906 host target genes. The mRNA of each one of this plurality of VGAM906 host target genes comprises one or more host target binding sites, each having a nucleotide sequence which is at least partly complementary to VGAM906 RNA, herein designated VGAM RNA, and which when bound by VGAM906 RNA causes inhibition of translation of respective one or more VGAM906 host target proteins.

It is further appreciated by one skilled in the art that the mode of translational inhibition illustrated by FIG. 1 with specific reference to translational inhibition exerted by VGAM906 gene, herein designated VGAM GENE, on one or more VGAM906 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM906 is inhibition of expression of host target genes, as part of a novel viral mechanism of attacking a host. Accordingly, utilities of VGAM906 include diagnosis, prevention and treatment of viral infection by Saimiriine Herpesvirus 2. Specific functions, and accordingly utilities, of VGAM906 correlate with, and may be deduced from, the identity of the host target genes which VGAM906 binds and inhibits, and the function of these host target genes, as elaborated hereinbelow.

Nucleotide sequences of the VGAM906 precursor RNA, herein designated VGAM PRECURSOR RNA, and of the 'diced' VGAM906 RNA, herein designated VGAM RNA, and a schematic representation of the secondary folding of VGAM906 folded precursor RNA, herein designated VGAM FOLDED PRECURSOR RNA, of VGAM906 are further described hereinbelow with reference to Table 1.

Nucleotide sequences of host target binding sites, such as BINDING SITE-I, BINDING SITE-II and BINDING SITE-III of FIG. 1, found on VGAM906 host target RNA, and schematic representation of the complementarity of each of these host target binding sites to VGAM906 RNA, herein designated VGAM RNA, are described hereinbelow with reference to Table 2.

As mentioned hereinabove with reference to FIG. 1, a function of VGAM906 gene, herein designated VGAM is inhibition of expression of VGAM906 target genes. It is appreciated that specific functions, and accordingly utilities, of VGAM906 correlate with, and may be deduced from, the identity of the target genes which VGAM906 binds and inhibits, and the function of these target genes, as elaborated hereinbelow.

UDP-glucose Dehydrogenase (UGDH, Accession NM_003359) is a VGAM906 host target gene. UGDH BINDING SITE is HOST TARGET binding site found in the 3' untranslated region of mRNA encoded by UGDH, corresponding to a HOST TARGET binding site such as BINDING SITE I, BINDING SITE II or BINDING SITE III. Table 2 illustrates the complementarity of the nucleotide sequences of UGDH BINDING SITE, designated SEQ ID:9387, to the nucleotide sequence of VGAM906 RNA, herein designated VGAM RNA, also designated SEQ ID:3617.

A function of VGAM906 is therefore inhibition of UDP-glucose Dehydrogenase (UGDH, Accession NM_003359), a gene which is an UDP-glucose dehydrogenase. Accordingly, utilities of VGAM906 include diagnosis, prevention and treatment of diseases and clinical conditions associated with UGDH. The function of UGDH and its association with various diseases and clinical conditions, has been established by previous studies, as described hereinabove with reference to VGAM74. Xenotropic and Polytropic Retrovirus Receptor (XPR1, Accession NM_004736) is another VGAM906 host target gene. XPR1 BINDING SITE is HOST TARGET binding site found in the 3' untranslated region of mRNA encoded by XPR1, corresponding to a HOST TARGET binding site such as BINDING SITE I, BINDING SITE II or BINDING SITE III. Table 2 illustrates the complementarity of the nucleotide sequences of XPR1 BINDING SITE, designated SEQ ID:11122, to the nucleotide sequence of VGAM906 RNA, herein designated VGAM RNA, also designated SEQ ID:3617.

Another function of VGAM906 is therefore inhibition of Xenotropic and Polytropic Retrovirus Receptor (XPR1, Accession NM_004736), a gene which is a putative G protein-coupled receptor and a target for xenotropic and polytropic murine leukemia retroviruses. Accordingly, utilities of VGAM906 include diagnosis, prevention and treatment of diseases and clinical conditions associated with XPR1. The function of XPR1 and its association with various diseases and clinical conditions, has been established by previous studies, as described hereinabove with reference to VGAM430. AP1 Gamma Subunit Binding Protein 1 (AP1GBP1, Accession NM_007247) is another VGAM906 host target gene. AP1GBP1 BINDING SITE1 through AP1GBP1 BINDING SITE3 are HOST TARGET binding sites found in untranslated regions of mRNA encoded by AP1GBP1, corresponding to HOST TARGET binding sites such as BINDING SITE I, BINDING SITE II or BINDING SITE III. Table 2 illustrates the complementarity of the nucleotide sequences of AP1GBP1 BINDING SITE1 through AP1GBP1 BINDING SITE3, designated SEQ ID:14115, SEQ ID:27877 and SEQ ID:27870 respectively, to the nucleotide sequence of VGAM906 RNA, herein designated VGAM RNA, also designated SEQ ID:3617.

Another function of VGAM906 is therefore inhibition of AP1 Gamma Subunit Binding Protein 1 (AP1GBP1, Accession NM_007247). Accordingly, utilities of VGAM906 include diagnosis, prevention and treatment of diseases and clinical conditions associated with AP1GBP1. FLJ12598 (Accession NM_024754) is another VGAM906 host target gene. FLJ12598 BINDING SITE is HOST TARGET binding site found in the 5' untranslated region of mRNA encoded by FLJ12598, corresponding to a HOST TARGET binding site such as BINDING SITE I, BINDING SITE II or BINDING SITE III. Table 2 illustrates the complementarity of the nucleotide sequences of FLJ12598 BINDING SITE, designated SEQ ID:24097, to the nucleotide sequence of VGAM906 RNA, herein designated VGAM RNA, also designated SEQ ID:3617.

Another function of VGAM906 is therefore inhibition of FLJ12598 (Accession NM_024754). Accordingly, utilities of VGAM906 include diagnosis, prevention and treatment of diseases and clinical conditions associated with FLJ12598. FLJ21140 (Accession NM_024776) is another VGAM906 host target gene. FLJ21140 BINDING SITE is HOST TARGET binding site found in the 3' untranslated region of mRNA encoded by FLJ21140, corresponding to a HOST TARGET binding site such as BINDING SITE I, BINDING SITE II or BINDING SITE III. Table 2 illustrates the complementarity of the nucleotide sequences of FLJ21140 BINDING SITE, designated SEQ ID:24141, to the nucleotide sequence of VGAM906 RNA, herein designated VGAM RNA, also designated SEQ ID:3617.

Another function of VGAM906 is therefore inhibition of FLJ21140 (Accession NM_024776). Accordingly, utilities of VGAM906 include diagnosis, prevention and treatment of diseases and clinical conditions associated with FLJ21140. High-mobility Group (nonhistone chromosomal) Protein 17-like 1 (HMG17L1, Accession NM_021024) is another VGAM906 host target gene. HMG17L1 BINDING SITE is HOST TARGET binding site found in the 3' untranslated region of mRNA encoded by HMG17L1, corresponding to a HOST TARGET binding site such as BINDING SITE I, BINDING SITE II or BINDING SITE III. Table 2 illustrates the complementarity of the nucleotide sequences of HMG17L1 BINDING SITE, designated SEQ ID:22014, to the nucleotide sequence of VGAM906 RNA, herein designated VGAM RNA, also designated SEQ ID:3617.

Another function of VGAM906 is therefore inhibition of High-mobility Group (nonhistone chromosomal) Protein 17-like 1 (HMG17L1, Accession NM_021024). Accordingly, utilities of VGAM906 include diagnosis, prevention and treatment of diseases and clinical conditions associated with HMG17L1. Myoneurin (MYNN, Accession NM_018657) is another VGAM906 host target gene. MYNN BINDING SITE is HOST TARGET binding site found in the 3' untranslated region of mRNA encoded by MYNN, corresponding to a HOST TARGET binding site such as BINDING SITE I, BINDING SITE II or BINDING SITE III. Table 2 illustrates the complementarity of the nucleotide sequences of MYNN BINDING SITE, designated SEQ ID:20725, to the nucleotide sequence of VGAM906 RNA, herein designated VGAM RNA, also designated SEQ ID:3617.

Another function of VGAM906 is therefore inhibition of Myoneurin (MYNN, Accession NM_018657). Accordingly, utilities of VGAM906 include diagnosis, prevention and treatment of diseases and clinical conditions associated with MYNN. Nucleosome Assembly Protein 1-like 1 (NAP1L1, Accession NM_139207) is another VGAM906 host target gene. NAP1L1 BINDING SITE is HOST TARGET binding site found in the 3' untranslated region of mRNA encoded by NAP1L1, corresponding to a HOST TARGET binding site such as BINDING SITE I, BINDING SITE II or BINDING SITE III. Table 2 illustrates the complementarity of the nucleotide sequences of NAP1L1 BINDING SITE, designated SEQ ID:29224, to the nucleotide sequence of VGAM906 RNA, herein designated VGAM RNA, also designated SEQ ID:3617.

Another function of VGAM906 is therefore inhibition of Nucleosome Assembly Protein 1-like 1 (NAP1L1, Accession NM_139207). Accordingly, utilities of VGAM906 include diagnosis, prevention and treatment of diseases and clinical conditions associated with NAP1L1. LOC146050 (Accession XM_085301) is another VGAM906 host target gene. LOC146050 BINDING SITE is HOST TARGET binding site found in the 3' untranslated region of mRNA encoded by LOC146050, corresponding to a HOST TARGET binding site such as BINDING SITE I, BINDING SITE II or BINDING SITE III. Table 2 illustrates the complementarity of the nucleotide sequences of LOC146050 BINDING SITE, designated SEQ ID:38055, to the nucleotide sequence of VGAM906 RNA, herein designated VGAM RNA, also designated SEQ ID:3617.

Another function of VGAM906 is therefore inhibition of LOC146050 (Accession XM_085301). Accordingly, utilities of VGAM906 include diagnosis, prevention and treatment of diseases and clinical conditions associated with LOC146050. LOC158549 (Accession XM_098963) is another VGAM906 host target gene. LOC158549 BINDING SITE is HOST TARGET binding site found in the 5' untranslated region of mRNA encoded by LOC158549, corresponding to a HOST TARGET binding site such as BINDING SITE I, BINDING SITE II or BINDING SITE III. Table 2 illustrates the complementarity of the nucleotide sequences of LOC158549 BINDING SITE, designated SEQ ID:42009, to the nucleotide sequence of VGAM906 RNA, herein designated VGAM RNA, also designated SEQ ID:3617.

Another function of VGAM906 is therefore inhibition of LOC158549 (Accession XM_098963). Accordingly, utilities of VGAM906 include diagnosis, prevention and treatment of diseases and clinical conditions associated with LOC158549. LOC169166 (Accession XM_095541) is another VGAM906 host target gene. LOC169166 BINDING SITE is HOST TARGET binding site found in the 3' untranslated region of mRNA encoded by LOC169166, corresponding to a HOST TARGET binding site such as BINDING SITE I, BINDING SITE II or BINDING SITE III. Table 2 illustrates the complementarity of the nucleotide sequences of LOC169166 BINDING SITE, designated SEQ ID:40271, to the nucleotide sequence of VGAM906 RNA, herein designated VGAM RNA, also designated SEQ ID:3617.

Another function of VGAM906 is therefore inhibition of LOC169166 (Accession XM_095541). Accordingly, utilities of VGAM906 include diagnosis, prevention and treatment of diseases and clinical conditions associated with LOC169166. LOC199957 (Accession XM_114068) is another VGAM906 host target gene. LOC199957 BINDING SITE is HOST TARGET binding site found in the 3' untranslated region of mRNA encoded by LOC199957, corresponding to a HOST TARGET binding site such as BINDING SITE I, BINDING SITE II or BINDING SITE III. Table 2 illustrates the complementarity of the nucleotide sequences of LOC199957 BINDING SITE, designated SEQ ID:42671, to the nucleotide sequence of VGAM906 RNA, herein designated VGAM RNA, also designated SEQ ID:3617.

Another function of VGAM906 is therefore inhibition of LOC199957 (Accession XM_114068). Accordingly, utilities of VGAM906 include diagnosis, prevention and treatment of diseases and clinical conditions associated with LOC199957. FIG. 1 further provides a conceptual description of a novel bioinformatically detected viral gene of the present invention, referred to here as Viral Genomic Address Messenger 907 (VGAM907) viral gene, which modulates expression of respective host target genes thereof, the function and utility of which host target genes is known in the art.

VGAM907 is a novel bioinformatically detected regulatory, non protein coding, viral micro RNA (miRNA) gene. The method by which VGAM907 was detected is described hereinabove with reference to FIGS. 1-8.

VGAM907 gene, herein designated VGAM GENE, is a viral gene contained in the genome of Saimiriine Herpesvirus 2. VGAM907 host target gene, herein designated VGAM HOST TARGET GENE, is a human gene contained in the human genome.

VGAM907 gene encodes a VGAM907 precursor RNA, herein designated VGAM PRECURSOR RNA. Similar to other miRNA genes, and unlike most ordinary genes, VGAM907 precursor RNA does not encode a protein. A nucleotide sequence identical or highly similar to the nucleotide sequence of VGAM907 precursor RNA is designated SEQ ID:893, and is provided hereinbelow with reference to the sequence listing part. Nucleotide sequence SEQ ID:893 is located at position 79366 relative to the genome of Saimiriine Herpesvirus 2.

VGAM907 precursor RNA folds onto itself, forming VGAM907 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM907 folded precursor RNA into VGAM907 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM907 RNA is designated SEQ ID:3618, and is provided hereinbelow with reference to the sequence listing part.

VGAM907 host target gene, herein designated VGAM HOST TARGET GENE, encodes a corresponding messenger RNA, VGAM907 host target RNA, herein designated VGAM HOST TARGET RNA. VGAM907 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM907 RNA, herein designated VGAM RNA, binds complementarily to one or more host target binding sites located in untranslated regions of VGAM907 host target RNA, herein designated VGAM HOST TARGET RNA. This complementary binding is due to the fact that the nucleotide sequence of VGAM907 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM907 RNA, herein designated VGAM RNA, may have a different number of host target binding sites in untranslated regions of a VGAM907 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM907 RNA, herein designated VGAM RNA, to host target binding sites on VGAM907 host target RNA, herein designated VGAM HOST TARGET RNA, such as BINDING SITE I, BINDING SITE II and BINDING SITE III, inhibits translation of VGAM907 host target RNA into VGAM907 host target protein, herein designated VGAM HOST TARGET PROTEIN. VGAM host target protein is therefore outlined by a broken line.

It is appreciated that VGAM907 host target gene, herein designated VGAM HOST TARGET GENE, in fact represents a plurality of VGAM907 host target genes. The mRNA of each one of this plurality of VGAM907 host target genes comprises one or more host target binding sites, each having a nucleotide sequence which is at least partly complementary to VGAM907 RNA, herein designated VGAM RNA, and which when bound by VGAM907 RNA causes inhibition of translation of respective one or more VGAM907 host target proteins.

It is further appreciated by one skilled in the art that the mode of translational inhibition illustrated by FIG. 1 with specific reference to translational inhibition exerted by VGAM907 gene, herein designated VGAM GENE, on one or more VGAM907 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM907 is inhibition of expression of host target genes, as part of a novel viral mechanism of attacking a host. Accordingly, utilities of VGAM907 include diagnosis, prevention and treatment of viral infection by Saimiriine Herpesvirus 2. Specific functions, and accordingly utilities, of VGAM907 correlate with, and may be deduced from, the identity of the host target genes which VGAM907 binds and inhibits, and the function of these host target genes, as elaborated hereinbelow.

Nucleotide sequences of the VGAM907 precursor RNA, herein designated VGAM PRECURSOR RNA, and of the 'diced' VGAM907 RNA, herein designated VGAM RNA, and a schematic representation of the secondary folding of VGAM907 folded precursor RNA, herein designated VGAM FOLDED PRECURSOR RNA, of VGAM907 are further described hereinbelow with reference to Table 1.

Nucleotide sequences of host target binding sites, such as BINDING SITE-I, BINDING SITE-II and BINDING SITE-III of FIG. 1, found on VGAM907 host target RNA, and schematic representation of the complementarity of each of these host target binding sites to VGAM907 RNA, herein designated VGAM RNA, are described hereinbelow with reference to Table 2.

As mentioned hereinabove with reference to FIG. 1, a function of VGAM907 gene, herein designated VGAM is inhibition of expression of VGAM907 target genes. It is appreciated that specific functions, and accordingly utilities, of VGAM907 correlate with, and may be deduced from, the identity of the target genes which VGAM907 binds and inhibits, and the function of these target genes, as elaborated hereinbelow.

HCA4 (Accession XM_085287) is a VGAM907 host target gene. HCA4 BINDING SITE is HOST TARGET binding site found in the 3' untranslated region of mRNA encoded by HCA4, corresponding to a HOST TARGET binding site such as BINDING SITE I, BINDING SITE II or BINDING SITE III. Table 2 illustrates the complementarity of the nucleotide sequences of HCA4 BINDING SITE, designated SEQ ID:38022, to the nucleotide sequence of VGAM907 RNA, herein designated VGAM RNA, also designated SEQ ID:3618.

A function of VGAM907 is therefore inhibition of HCA4 (Accession XM_085287). Accordingly, utilities of VGAM907 include diagnosis, prevention and treatment of diseases and clinical conditions associated with HCA4. KIAA1600 (Accession XM_049351) is another VGAM907 host target gene. KIAA1600 BINDING SITE is HOST TARGET binding site found in the 3' untranslated region of mRNA encoded by KIAA1600, corresponding to a HOST TARGET binding site such as BINDING SITE I, BINDING SITE II or BINDING SITE III. Table 2 illustrates the complementarity of the nucleotide sequences of KIAA1600 BINDING SITE, designated SEQ ID:35391, to the nucleotide sequence of VGAM907 RNA, herein designated VGAM RNA, also designated SEQ ID:3618.

Another function of VGAM907 is therefore inhibition of KIAA1600 (Accession XM_049351). Accordingly, utilities of VGAM907 include diagnosis, prevention and treatment of diseases and clinical conditions associated with KIAA1600. Purinergic Receptor P2X-like 1, Orphan Receptor (P2RXL1, Accession NM_005446) is another VGAM907 host target gene. P2RXL1 BINDING SITE is HOST TARGET binding site found in the 3' untranslated region of mRNA encoded by P2RXL1, corresponding to a HOST TARGET binding site such as BINDING SITE I, BINDING SITE II or BINDING SITE III. Table 2 illustrates the complementarity of the nucleotide sequences of P2RXL1 BINDING SITE, designated SEQ ID:11933, to the nucleotide sequence of VGAM907 RNA, herein designated VGAM RNA, also designated SEQ ID:3618.

Another function of VGAM907 is therefore inhibition of Purinergic Receptor P2X-like 1, Orphan Receptor (P2RXL1, Accession NM_005446). Accordingly, utilities of VGAM907 include diagnosis, prevention and treatment of diseases and clinical conditions associated with P2RXL1. LOC133418 (Accession XM_059649) is another VGAM907 host target gene. LOC133418 BINDING SITE is HOST TARGET binding site found in the 3' untranslated region of mRNA encoded by LOC133418, corresponding to a HOST TARGET binding site such as BINDING SITE I, BINDING SITE II or BINDING SITE III. Table 2 illustrates the complementarity of the nucleotide sequences of LOC133418 BINDING SITE, designated SEQ ID:37038, to the nucleotide sequence of VGAM907 RNA, herein designated VGAM RNA, also designated SEQ ID:3618.

Another function of VGAM907 is therefore inhibition of LOC133418 (Accession XM_059649). Accordingly, utilities of VGAM907 include diagnosis, prevention and treatment of diseases and clinical conditions associated with LOC133418. LOC153222 (Accession XM_087631) is another VGAM907 host target gene. LOC153222 BINDING SITE is HOST TARGET binding site found in the 3' untranslated region of mRNA encoded by LOC153222, corresponding to a HOST TARGET binding site such as BINDING SITE I, BINDING SITE II or BINDING SITE III. Table 2 illustrates the complementarity of the nucleotide sequences of LOC153222 BINDING SITE, designated SEQ ID:39369, to the nucleotide sequence of VGAM907 RNA, herein designated VGAM RNA, also designated SEQ ID:3618.

Another function of VGAM907 is therefore inhibition of LOC153222 (Accession XM_087631). Accordingly, utilities of VGAM907 include diagnosis, prevention and treatment of diseases and clinical conditions associated with LOC153222. LOC255098 (Accession XM_170912) is another VGAM907 host target gene. LOC255098 BINDING SITE is HOST TARGET binding site found in the 3' untranslated region of mRNA encoded by LOC255098, corresponding to a HOST TARGET binding site such as BINDING SITE I, BINDING SITE II or BINDING SITE III. Table 2 illustrates the complementarity of the nucleotide sequences of LOC255098 BINDING SITE, designated SEQ ID:45687, to the nucleotide sequence of VGAM907 RNA, herein designated VGAM RNA, also designated SEQ ID:3618.

Another function of VGAM907 is therefore inhibition of LOC255098 (Accession XM_170912). Accordingly, utilities of VGAM907 include diagnosis, prevention and treatment of diseases and clinical conditions associated with LOC255098. FIG. 1 further provides a conceptual description of a novel bioinformatically detected viral gene of the present invention, referred to here as Viral Genomic Address Messenger 908 (VGAM908) viral gene, which modulates expression of respective host target genes thereof, the function and utility of which host target genes is known in the art.

VGAM908 is a novel bioinformatically detected regulatory, non protein coding, viral micro RNA (miRNA) gene. The method by which VGAM908 was detected is described hereinabove with reference to FIGS. 1-8.

VGAM908 gene, herein designated VGAM GENE, is a viral gene contained in the genome of Saimiriine Herpesvirus 2. VGAM908 host target gene, herein designated VGAM HOST TARGET GENE, is a human gene contained in the human genome.

VGAM908 gene encodes a VGAM908 precursor RNA, herein designated VGAM PRECURSOR RNA. Similar to other miRNA genes, and unlike most ordinary genes, VGAM908 precursor RNA does not encode a protein. A nucleotide sequence identical or highly similar to the nucleotide sequence of VGAM908 precursor RNA is designated SEQ ID:894, and is provided hereinbelow with reference to the sequence listing part. Nucleotide sequence SEQ ID:894 is located at position 78640 relative to the genome of Saimiriine Herpesvirus 2.

VGAM908 precursor RNA folds onto itself, forming VGAM908 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM908 folded precursor RNA into VGAM908 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM908 RNA is designated SEQ ID:3619, and is provided hereinbelow with reference to the sequence listing part.

VGAM908 host target gene, herein designated VGAM HOST TARGET GENE, encodes a corresponding messenger RNA, VGAM908 host target RNA, herein designated VGAM HOST TARGET RNA. VGAM908 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM908 RNA, herein designated VGAM RNA, binds complementarily to one or more host target binding sites located in untranslated regions of VGAM908 host target RNA, herein designated VGAM HOST TARGET RNA. This complementary binding is due to the fact that the nucleotide sequence of VGAM908 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM908 RNA, herein designated VGAM RNA, may have a different number of host target binding sites in untranslated regions of a VGAM908 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM908 RNA, herein designated VGAM RNA, to host target binding sites on VGAM908 host target RNA, herein designated VGAM HOST TARGET RNA, such as BINDING SITE I, BINDING SITE II and BINDING SITE III, inhibits translation of VGAM908 host target RNA into VGAM908 host target protein, herein designated VGAM HOST TARGET PROTEIN. VGAM host target protein is therefore outlined by a broken line.

It is appreciated that VGAM908 host target gene, herein designated VGAM HOST TARGET GENE, in fact represents a plurality of VGAM908 host target genes. The mRNA of each one of this plurality of VGAM908 host target genes comprises one or more host target binding sites, each having a nucleotide sequence which is at least partly complementary to VGAM908 RNA, herein designated VGAM RNA, and which when bound by VGAM908 RNA causes inhibition of translation of respective one or more VGAM908 host target proteins.

It is further appreciated by one skilled in the art that the mode of translational inhibition illustrated by FIG. 1 with specific reference to translational inhibition exerted by VGAM908 gene, herein designated VGAM GENE, on one or more VGAM908 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM908 is inhibition of expression of host target genes, as part of a novel viral mechanism of attacking a host. Accordingly, utilities of VGAM908 include diagnosis, prevention and treatment of viral infection by Saimiriine Herpesvirus 2. Specific functions, and accordingly utilities, of VGAM908 correlate with, and may be deduced from, the identity of the host target genes which VGAM908 binds and inhibits, and the function of these host target genes, as elaborated hereinbelow.

Nucleotide sequences of the VGAM908 precursor RNA, herein designated VGAM PRECURSOR RNA, and of the 'diced' VGAM908 RNA, herein designated VGAM RNA, and a schematic representation of the secondary folding of VGAM908 folded precursor RNA, herein designated VGAM FOLDED PRECURSOR RNA, of VGAM908 are further described hereinbelow with reference to Table 1.

Nucleotide sequences of host target binding sites, such as BINDING SITE-I, BINDING SITE-II and BINDING SITE-III of FIG. 1, found on VGAM908 host target RNA, and schematic representation of the complementarity of each of these host target binding sites to VGAM908 RNA, herein designated VGAM RNA, are described hereinbelow with reference to Table 2.

As mentioned hereinabove with reference to FIG. 1, a function of VGAM908 gene, herein designated VGAM is inhibition of expression of VGAM908 target genes. It is appreciated that specific functions, and accordingly utilities, of VGAM908 correlate with, and may be deduced from, the identity of the target genes which VGAM908 binds and inhibits, and the function of these target genes, as elaborated hereinbelow.

Eyes Absent Homolog 1 (Drosophila) (EYA1, Accession NM_000503) is a VGAM908 host target gene. EYA1 BINDING SITE is HOST TARGET binding site found in the 5' untranslated region of mRNA encoded by EYA1, corresponding to a HOST TARGET binding site such as BINDING SITE I, BINDING SITE II or BINDING SITE III. Table 2 illustrates the complementarity of the nucleotide sequences of EYA1 BINDING SITE, designated SEQ ID:6115, to the nucleotide sequence of VGAM908 RNA, herein designated VGAM RNA, also designated SEQ ID:3619.

A function of VGAM908 is therefore inhibition of Eyes Absent Homolog 1 (Drosophila) (EYA1, Accession NM_000503). Accordingly, utilities of VGAM908 include diagnosis, prevention and treatment of diseases and clinical conditions associated with EYA1. Gamma-glutamyltransferase 1 (GGT1, Accession NM_013421) is another VGAM908 host target gene. GGT1 BINDING SITE is HOST TARGET binding site found in the 5' untranslated region of mRNA encoded by GGT1, corresponding to a HOST TARGET binding site such as BINDING SITE I, BINDING SITE II or BINDING SITE III. Table 2 illustrates the complementarity of the nucleotide sequences of GGT1 BINDING SITE, designated SEQ ID:15081, to the nucleotide sequence of VGAM908 RNA, herein designated VGAM RNA, also designated SEQ ID:3619.

Another function of VGAM908 is therefore inhibition of Gamma-glutamyltransferase 1 (GGT1, Accession NM_013421), a gene which catalyzes the transfer of the glutamyl moiety of glutathione to a variety of amino acids and dipeptide acceptors. Accordingly, utilities of VGAM908 include diagnosis, prevention and treatment of diseases and clinical conditions associated with GGT1. The function of GGT1 has been established by previous studies. Gamma-glutamyltranspeptidase (EC 2.3.2.2) acts as a glutathionase and catalyzes the transfer of the glutamyl moiety of glutathione to a variety of amino acids and dipeptide acceptors. This enzyme is located on the outer surface of the cell membrane. It is widely distributed in mammalian tissues involved in absorption and secretion. In human S, hepatic GGT activity is elevated in some liver diseases. GGT is released into the bloodstream after liver damage, and an elevated level of the enzyme may be a useful early sign of hepatocellular carcinoma. Schulman et al. (1975) described a mildly retarded adult male with glutathionemia and marked glutathionuria, whose cultured skin fibroblasts showed very low activity of the transpeptidase. Since several studies have suggested that the transpeptidase may play a role in cellular amino acid transport, the lack of aminoaciduria and aminoacidemia was noteworthy. O'Daley (1968) may have described the same condition. Hammond et al. (1995) reported sisters with GGT deficiency. The elder of the 2 sibs was detected during the course of a population screening on infants at 6 weeks of age using ascending paper chromatography of urine, which revealed a migration spot similar to that of cystine. Her growth and development were normal. During the second year, easy bruising was noted. Asthma was diagnosed at 2.5 years but was never a major problem. At 10 years of age, she began having attacks of absence and an EEG showed typical 3-Hz spike and wave activity. Seizures were controlled by valproate medication. At age 21 years, she had no significant health problems, had a good secretarial position, and was pursuing a course at technical college. The younger sister was somewhat hypotonic and inactive at birth and had a dislocated hip and mild bilateral equinovarus. Tube feeding was required for the first 4 months. Problems noted later included strabismus, easy bruising, poor coordination, and some dysmorphic features. A diagnosis of Prader-Willi syndrome (PWS; 176270) was confirmed by demonstration of an interstitial deletion of 15q11-q13. Both sisters had normal red cell glutathione and no Heinz bodies. Clearly there were no specific clinical indicators for GGT deficiency, which in the younger sister was unrelated to PWS. Laperche et al. (1986) cloned the structural gene for GGT from a rat kidney cDNA library. Taking advantage of its cross-hybridization with the human genome, Bulle et al. (1987) mapped the GGT gene by in situ hybridization to 22q11.1-q11.2. A minor peak was found in 22q13.1. Rouleau et al. (1988) demonstrated a PvuII polymorphism at the GGT locus and added family linkage analysis to the methods by which GGT has been assigned to chromosome 22. From studies involving restriction analysis, Heisterkamp and Groffen (1988) presented evidence that the transcribed GGT gene lies 3-prime and just distal to the BCR locus (OMIM Ref. No. 151410). Rajpert-De Meyts et al. (1988) isolated cDNAs for GGT. Sakamuro et al. (1988) reported the primary structure of human GGT based on studies of a cDNA. The enzyme consists of 2 peptide chains, heavy and light, composed of 351 and 189 amino acids, respectively. Both are coded by a single gene; the 2 subunits of the mature enzyme are the products of processing of the single precursor peptide. The active site of GGT is located in the light subunit of the mature enzyme. A family of at least 4 GGT genes exists on chromosome 22 (Pawlak et al., 1988; Rajpert-De Meyts et al., 1988). At least 2 of these genes appear to be transcribed, since a human kidney cDNA has been isolated that differs from the placental and liver cDNAs (Pawlak et al., 1989).

Full details of the abovementioned studies are described in the following publications, the disclosure of which are hereby incorporated by reference:

Hammond, J. W.; Potter, M.; Wilcken, B.; Truscott, R.: Siblings with gamma-glutamyltransferase deficiency. J. Inherit. Metab. Dis. 18:82-83, 1995; and Rajpert-De Meyts, E.; Heisterkamp, N.; Groffen, J.: Cloning and nucleotide sequence of human gamma-glutamyl transpeptidase. Proc. Nat. Acad. Sci. 85:8840-8844, 1988.

Further studies establishing the function and utilities of GGT1 are found in John Hopkins OMIM database record ID 231950, and in sited publications numbered 5775, 6382-6386, 3354-335 and 6387-6389 listed in the bibliography section hereinbelow, which are also hereby incorporated by reference. Gamma-glutamyltransferase 2 (GGT2, Accession XM_057166) is another VGAM908 host target gene. GGT2 BINDING SITE is HOST TARGET binding site found in the 5' untranslated region of mRNA encoded by GGT2, corresponding to a HOST TARGET binding site such as BINDING SITE I, BINDING SITE II or BINDING SITE III. Table 2 illustrates the complementarity of the nucleotide sequences of GGT2 BINDING SITE, designated SEQ ID:36487, to the nucleotide sequence of VGAM908 RNA, herein designated VGAM RNA, also designated SEQ ID:3619.

Another function of VGAM908 is therefore inhibition of Gamma-glutamyltransferase 2 (GGT2, Accession XM_057166). Accordingly, utilities of VGAM908 include diagnosis, prevention and treatment of diseases and clinical conditions associated with GGT2. MHC Class II Transactivator (MHC2TA, Accession NM_000246) is another VGAM908 host target gene. MHC2TA BINDING SITE is HOST TARGET binding site found in the 3' untranslated region of mRNA encoded by MHC2TA, corresponding to a HOST TARGET binding site such as BINDING SITE I, BINDING SITE II or BINDING SITE III. Table 2 illustrates the complementarity of the nucleotide sequences of MHC2TA BINDING SITE, designated SEQ ID:5777, to the nucleotide sequence of VGAM908 RNA, herein designated VGAM RNA, also designated SEQ ID:3619.

Another function of VGAM908 is therefore inhibition of MHC Class II Transactivator (MHC2TA, Accession NM_000246). Accordingly, utilities of VGAM908 include diagnosis, prevention and treatment of diseases and clinical conditions associated with MHC2TA. Sialidase 3 (membrane sialidase) (NEU3, Accession NM_006656) is another VGAM908 host target gene. NEU3 BINDING SITE is HOST TARGET binding site found in the 3' untranslated region of mRNA encoded by NEU3, corresponding to a HOST TARGET binding site such as BINDING SITE I, BINDING SITE II or BINDING SITE III. Table 2 illustrates the complementarity of the nucleotide sequences of NEU3 BINDING SITE, designated SEQ ID:13454, to the nucleotide sequence of VGAM908 RNA, herein designated VGAM RNA, also designated SEQ ID:3619.

Another function of VGAM908 is therefore inhibition of Sialidase 3 (membrane sialidase) (NEU3, Accession NM_006656). Accordingly, utilities of VGAM908 include diagnosis, prevention and treatment of diseases and clinical conditions associated with NEU3. Asporin (LRR class 1) (ASPN, Accession NM_017680) is another VGAM908 host target gene. ASPN BINDING SITE is HOST TARGET binding site found in the 3' untranslated region of mRNA encoded by ASPN, corresponding to a HOST TARGET binding site such as BINDING SITE I, BINDING SITE II or BINDING SITE III. Table 2 illustrates the complementarity of the nucleotide sequences of ASPN BINDING SITE, designated SEQ ID:19223, to the nucleotide sequence of VGAM908 RNA, herein designated VGAM RNA, also designated SEQ ID:3619.

Another function of VGAM908 is therefore inhibition of Asporin (LRR class 1) (ASPN, Accession NM_017680). Accordingly, utilities of VGAM908 include diagnosis, prevention and treatment of diseases and clinical conditions associated with ASPN. Chromosome 20 Open Reading Frame 110 (C20orf110, Accession XM_086728) is another VGAM908 host target gene. C20orf110 BINDING SITE is HOST TARGET binding site found in the 3' untranslated region of mRNA encoded by C20orf110, corresponding to a HOST TARGET binding site such as BINDING SITE I, BINDING SITE II or BINDING SITE III. Table 2 illustrates the complementarity of the nucleotide sequences of C20orf110 BINDING SITE, designated SEQ ID:38834, to the nucleotide sequence of VGAM908 RNA, herein designated VGAM RNA, also designated SEQ ID:3619.

Another function of VGAM908 is therefore inhibition of Chromosome 20 Open Reading Frame 110 (C20orf110, Accession XM_086728). Accordingly, utilities of VGAM908 include diagnosis, prevention and treatment of diseases and clinical conditions associated with C20orf110. DKFZP566K023 (Accession NM_015485) is another VGAM908 host target gene. DKFZP566K023 BINDING SITE is HOST TARGET binding site found in the 3' untranslated region of mRNA encoded by DKFZP566K023, corresponding to a HOST TARGET binding site such as BINDING SITE I, BINDING SITE II or BINDING SITE III. Table 2 illustrates the complementarity of the nucleotide sequences of DKFZP566K023 BINDING SITE, designated SEQ ID:17756, to the nucleotide sequence of VGAM908 RNA, herein designated VGAM RNA, also designated SEQ ID:3619.

Another function of VGAM908 is therefore inhibition of DKFZP566K023 (Accession NM_015485). Accordingly, utilities of VGAM908 include diagnosis, prevention and treatment of diseases and clinical conditions associated with DKFZP566K023. F-box Only Protein 24 (FBXO24, Accession NM_012172) is another VGAM908 host target gene. FBXO24 BINDING SITE is HOST TARGET binding site found in the 3' untranslated region of mRNA encoded by FBXO24, corresponding to a HOST TARGET binding site such as BINDING SITE I, BINDING SITE II or BINDING SITE III. Table 2 illustrates the complementarity of the nucleotide sequences of FBXO24 BINDING SITE, designated SEQ ID:14463, to the nucleotide sequence of VGAM908 RNA, herein designated VGAM RNA, also designated SEQ ID:3619.

Another function of VGAM908 is therefore inhibition of F-box Only Protein 24 (FBXO24, Accession NM_012172). Accordingly, utilities of VGAM908 include diagnosis, prevention and treatment of diseases and clinical conditions associated with FBXO24. FLJ10956 (Accession NM_018283) is another VGAM908 host target gene. FLJ10956 BINDING SITE is HOST TARGET binding site found in the 3' untranslated region of mRNA encoded by FLJ10956, corresponding to a HOST TARGET binding site such as BINDING SITE I, BINDING SITE II or BINDING SITE III. Table 2 illustrates the complementarity of the nucleotide sequences of FLJ10956 BINDING SITE, designated SEQ ID:20275, to the nucleotide sequence of VGAM908 RNA, herein designated VGAM RNA, also designated SEQ ID:3619.

Another function of VGAM908 is therefore inhibition of FLJ10956 (Accession NM_018283). Accordingly, utilities of VGAM908 include diagnosis, prevention and treatment of diseases and clinical conditions associated with FLJ10956. FLJ20281 (Accession XM_165663) is another VGAM908 host target gene. FLJ20281 BINDING SITE is HOST TARGET binding site found in the 5' untranslated region of mRNA encoded by FLJ20281, corresponding to a HOST TARGET binding site such as BINDING SITE I, BINDING SITE II or BINDING SITE III. Table 2 illustrates the complementarity of the nucleotide sequences of FLJ20281 BINDING SITE, designated SEQ ID:43724, to the nucleotide sequence of VGAM908 RNA, herein designated VGAM RNA, also designated SEQ ID:3619.

Another function of VGAM908 is therefore inhibition of FLJ20281 (Accession XM_165663). Accordingly, utilities of VGAM908 include diagnosis, prevention and treatment of diseases and clinical conditions associated with FLJ20281. Integrin, Alpha 10 (ITGA10, Accession XM_002097) is another VGAM908 host target gene. ITGA10 BINDING SITE is HOST TARGET binding site found in the 3' untranslated region of mRNA encoded by ITGA10, corresponding to a HOST TARGET binding site such as BINDING SITE I, BINDING SITE II or BINDING SITE III. Table 2 illustrates the complementarity of the nucleotide sequences of ITGA10 BINDING SITE, designated SEQ ID:29859, to the nucleotide sequence of VGAM908 RNA, herein designated VGAM RNA, also designated SEQ ID:3619.

Another function of VGAM908 is therefore inhibition of Integrin, Alpha 10 (ITGA10, Accession XM_002097). Accordingly, utilities of VGAM908 include diagnosis, prevention and treatment of diseases and clinical conditions associated with ITGA10. KIAA0601 (Accession XM_031267) is another VGAM908 host target gene. KIAA0601 BINDING SITE is HOST TARGET binding site found in the 3' untranslated region of mRNA encoded by KIAA0601, corresponding to a HOST TARGET binding site such as BINDING SITE I, BINDING SITE II or BINDING SITE III. Table 2 illustrates the complementarity of the nucleotide sequences of KIAA0601 BINDING SITE, designated SEQ ID:31328, to the nucleotide sequence of VGAM908 RNA, herein designated VGAM RNA, also designated SEQ ID:3619.

Another function of VGAM908 is therefore inhibition of KIAA0601 (Accession XM_031267). Accordingly, utilities of VGAM908 include diagnosis, prevention and treatment of diseases and clinical conditions associated with KIAA0601. KIAA0700 (Accession XM_050561) is another VGAM908 host target gene. KIAA0700 BINDING SITE is HOST TARGET binding site found in the 5' untranslated region of mRNA encoded by KIAA0700, corresponding to a HOST TARGET binding site such as BINDING SITE I, BINDING SITE II or BINDING SITE III. Table 2 illustrates the complementarity of the nucleotide sequences of KIAA0700 BINDING SITE, designated SEQ ID:35657, to the nucleotide sequence of VGAM908 RNA, herein designated VGAM RNA, also designated SEQ ID:3619.

Another function of VGAM908 is therefore inhibition of KIAA0700 (Accession XM_050561). Accordingly, utilities of VGAM908 include diagnosis, prevention and treatment of diseases and clinical conditions associated with KIAA0700. KIAA1373 (Accession XM_048195) is another VGAM908 host target gene. KIAA1373 BINDING SITE is HOST TARGET binding site found in the 5' untranslated region of mRNA encoded by KIAA1373, corresponding to a HOST TARGET binding site such as BINDING SITE I, BINDING SITE II or BINDING SITE III. Table 2 illustrates the complementarity of the nucleotide sequences of KIAA1373 BINDING SITE, designated SEQ ID:35124, to the nucleotide sequence of VGAM908 RNA, herein designated VGAM RNA, also designated SEQ ID:3619.

Another function of VGAM908 is therefore inhibition of KIAA1373 (Accession XM_048195). Accordingly, utilities of VGAM908 include diagnosis, prevention and treatment of diseases and clinical conditions associated with KIAA1373. KIAA1981 (Accession XM_114000) is another VGAM908 host target gene. KIAA1981 BINDING SITE is HOST TARGET binding site found in the 3' untranslated region of mRNA encoded by KIAA1981, corresponding to a HOST TARGET binding site such as BINDING SITE I, BINDING SITE II or BINDING SITE III. Table 2 illustrates the complementarity of the nucleotide sequences of KIAA1981 BINDING SITE, designated SEQ ID:42607, to the nucleotide sequence of VGAM908 RNA, herein designated VGAM RNA, also designated SEQ ID:3619.

Another function of VGAM908 is therefore inhibition of KIAA1981 (Accession XM_114000). Accordingly, utilities of VGAM908 include diagnosis, prevention and treatment of diseases and clinical conditions associated with KIAA1981. RNAC (Accession NM_005772) is another VGAM908 host target gene. RNAC BINDING SITE is HOST TARGET binding site found in the 3" untranslated region of mRNA encoded by RNAC, corresponding to a HOST TARGET binding site such as BINDING SITE I, BINDING SITE II or BINDING SITE III. Table 2 illustrates the complementarity of the nucleotide sequences of RNAC BINDING SITE, designated SEQ ID:12344, to the nucleotide sequence of VGAM908 RNA, herein designated VGAM RNA, also designated SEQ ID:3619.

Another function of VGAM908 is therefore inhibition of RNAC (Accession NM_005772). Accordingly, utilities of VGAM908 include diagnosis, prevention and treatment of diseases and clinical conditions associated with RNAC. LOC129676 (Accession XM_065341) is another VGAM908 host target gene. LOC129676 BINDING SITE is HOST TARGET binding site found in the 5' untranslated region of mRNA encoded by LOC129676, corresponding to a HOST TARGET binding site such as BINDING SITE I, BINDING SITE II or BINDING SITE III. Table 2 illustrates the complementarity of the nucleotide sequences of LOC129676 BINDING SITE, designated SEQ ID:37281, to the nucleotide sequence of VGAM908 RNA, herein designated VGAM RNA, also designated SEQ ID:3619.

Another function of VGAM908 is therefore inhibition of LOC129676 (Accession XM_065341). Accordingly, utilities of VGAM908 include diagnosis, prevention and treatment of diseases and clinical conditions associated with LOC129676. LOC145678 (Accession XM_096832) is another VGAM908 host target gene. LOC145678 BINDING SITE is HOST TARGET binding site found in the 3' untranslated region of mRNA encoded by LOC145678, corresponding to a HOST TARGET binding site such as BINDING SITE I, BINDING SITE II or BINDING SITE III. Table 2 illustrates the complementarity of the nucleotide sequences of LOC145678 BINDING SITE, designated SEQ ID:40554, to the nucleotide sequence of VGAM908 RNA, herein designated VGAM RNA, also designated SEQ ID:3619.

Another function of VGAM908 is therefore inhibition of LOC145678 (Accession XM_096832). Accordingly, utilities of VGAM908 include diagnosis, prevention and treatment of diseases and clinical conditions associated with LOC145678. LOC152762 (Accession XM_087518) is another VGAM908 host target gene. LOC152762 BINDING SITE is HOST TARGET binding site found in the 3' untranslated region of mRNA encoded by LOC152762, corresponding to a HOST TARGET binding site such as BINDING SITE I, BINDING SITE II or BINDING SITE III. Table 2 illustrates the complementarity of the nucleotide sequences of LOC152762 BINDING SITE, designated SEQ ID:39304, to the nucleotide sequence of VGAM908 RNA, herein designated VGAM RNA, also designated SEQ ID:3619.

Another function of VGAM908 is therefore inhibition of LOC152762 (Accession XM_087518). Accordingly, utilities of VGAM908 include diagnosis, prevention and treatment of diseases and clinical conditions associated with LOC152762. LOC199957 (Accession XM_114068) is another VGAM908 host target gene. LOC199957 BINDING SITE is HOST TARGET binding site found in the 3' untranslated region of mRNA encoded by LOC199957, corresponding to a HOST TARGET binding site such as BINDING SITE I, BINDING SITE II or BINDING SITE III. Table 2 illustrates the complementarity of the nucleotide sequences of LOC199957 BINDING SITE, designated SEQ ID:42673, to the nucleotide sequence of VGAM908 RNA, herein designated VGAM RNA, also designated SEQ ID:3619.

Another function of VGAM908 is therefore inhibition of LOC199957 (Accession XM_114068). Accordingly, utilities of VGAM908 include diagnosis, prevention and treatment of diseases and clinical conditions associated with LOC199957. LOC253024 (Accession XM_174858) is another VGAM908 host target gene. LOC253024 BINDING SITE is HOST TARGET binding site found in the 5' untranslated region of mRNA encoded by LOC253024, corresponding to a HOST TARGET binding site such as BINDING SITE I, BINDING SITE II or BINDING SITE III. Table 2 illustrates the complementarity of the nucleotide sequences of LOC253024 BINDING SITE, designated SEQ ID:46604, to the nucleotide sequence of VGAM908 RNA, herein designated VGAM RNA, also designated SEQ ID:3619.

Another function of VGAM908 is therefore inhibition of LOC253024 (Accession XM_174858). Accordingly, utilities of VGAM908 include diagnosis, prevention and treatment of diseases and clinical conditions associated with LOC253024. FIG. 1 further provides a conceptual description of a novel bioinformatically detected viral gene of the present invention, referred to here as Viral Genomic Address Messenger 909 (VGAM909) viral gene, which modulates expression of respective host target genes thereof, the function and utility of which host target genes is known in the art.

VGAM909 is a novel bioinformatically detected regulatory, non protein coding, viral micro RNA (miRNA) gene. The method by which VGAM909 was detected is described hereinabove with reference to FIGS. 1-8.

VGAM909 gene, herein designated VGAM GENE, is a viral gene contained in the genome of Alcelaphine Herpesvirus 1. VGAM909 host target gene, herein designated VGAM HOST TARGET GENE, is a human gene contained in the human genome.

VGAM909 gene encodes a VGAM909 precursor RNA, herein designated VGAM PRECURSOR RNA. Similar to other miRNA genes, and unlike most ordinary genes, VGAM909 precursor RNA does not encode a protein. A nucleotide sequence identical or highly similar to the nucleotide sequence of VGAM909 precursor RNA is designated SEQ ID:895, and is provided hereinbelow with reference to the sequence listing part. Nucleotide sequence SEQ ID:895 is located at position 60240 relative to the genome of Alcelaphine Herpesvirus 1.

VGAM909 precursor RNA folds onto itself, forming VGAM909 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM909 folded precursor RNA into VGAM909 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM909 RNA is designated SEQ ID:3620, and is provided hereinbelow with reference to the sequence listing part.

VGAM909 host target gene, herein designated VGAM HOST TARGET GENE, encodes a corresponding messenger RNA, VGAM909 host target RNA, herein designated VGAM HOST TARGET RNA. VGAM909 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM909 RNA, herein designated VGAM RNA, binds complementarily to one or more host target binding sites located in untranslated regions of VGAM909 host target RNA, herein designated VGAM HOST TARGET RNA. This complementary binding is due to the fact that the nucleotide sequence of VGAM909 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM909 RNA, herein designated VGAM RNA, may have a different number of host target binding sites in untranslated regions of a VGAM909 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM909 RNA, herein designated VGAM RNA, to host target binding sites on VGAM909 host target RNA, herein designated VGAM HOST TARGET RNA, such as BINDING SITE I, BINDING SITE II and BINDING SITE III, inhibits translation of VGAM909 host target RNA into VGAM909 host target protein, herein designated VGAM HOST TARGET PROTEIN. VGAM host target protein is therefore outlined by a broken line.

It is appreciated that VGAM909 host target gene, herein designated VGAM HOST TARGET GENE, in fact represents a plurality of VGAM909 host target genes. The mRNA of each one of this plurality of VGAM909 host target genes comprises one or more host target binding sites, each having a nucleotide sequence which is at least partly complementary to VGAM909 RNA, herein designated VGAM RNA, and which when bound by VGAM909 RNA causes inhibition of translation of respective one or more VGAM909 host target proteins.

It is further appreciated by one skilled in the art that the mode of translational inhibition illustrated by FIG. 1 with specific reference to translational inhibition exerted by VGAM909 gene, herein designated VGAM GENE, on one or more VGAM909 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM909 is inhibition of expression of host target genes, as part of a novel viral mechanism of attacking a host. Accordingly, utilities of VGAM909 include diagnosis, prevention and treatment of viral infection by Alcelaphine Herpesvirus 1. Specific functions, and accordingly utilities, of VGAM909 correlate with, and may be deduced from, the identity of the host target genes which VGAM909 binds and inhibits, and the function of these host target genes, as elaborated hereinbelow.

Nucleotide sequences of the VGAM909 precursor RNA, herein designated VGAM PRECURSOR RNA, and of the 'diced' VGAM909 RNA, herein designated VGAM RNA, and a schematic representation of the secondary folding of VGAM909 folded precursor RNA, herein designated VGAM FOLDED PRECURSOR RNA, of VGAM909 are further described hereinbelow with reference to Table 1.

Nucleotide sequences of host target binding sites, such as BINDING SITE-I, BINDING SITE-II and BINDING SITE-III of FIG. 1, found on VGAM909 host target RNA, and schematic representation of the complementarity of each of these host target binding sites to VGAM909 RNA, herein designated VGAM RNA, are described hereinbelow with reference to Table 2.

As mentioned hereinabove with reference to FIG. 1, a function of VGAM909 gene, herein designated VGAM is inhibition of expression of VGAM909 target genes. It is appreciated that specific functions, and accordingly utilities, of VGAM909 correlate with, and may be deduced from, the identity of the target genes which VGAM909 binds and inhibits, and the function of these target genes, as elaborated hereinbelow.

DNA Fragmentation Factor, 40 kDa, Beta Polypeptide (caspase-activated DNase) (DFFB, Accession XM_113366) is a VGAM909 host target gene. DFFB BINDING SITE is HOST TARGET binding site found in the 3' untranslated region of mRNA encoded by DFFB, corresponding to a HOST TARGET binding site such as BINDING SITE I, BINDING SITE II or BINDING SITE III. Table 2 illustrates the complementarity of the nucleotide sequences of DFFB BINDING SITE, designated SEQ ID:42245, to the nucleotide sequence of VGAM909 RNA, herein designated VGAM RNA, also designated SEQ ID:3620.

A function of VGAM909 is therefore inhibition of DNA Fragmentation Factor, 40 kDa, Beta Polypeptide (caspase-activated DNase) (DFFB, Accession XM_113366), a gene which induces DNA fragmentation and chromatin condensation during apoptosis. Accordingly, utilities of VGAM909 include diagnosis, prevention and treatment of diseases and clinical conditions associated with DFFB. The function of DFFB and its association with various diseases and clinical conditions, has been established by previous studies, as described hereinabove with reference to VGAM74. Desmocollin 2 (DSC2, Accession NM_004949) is another VGAM909 host target gene. DSC2 BINDING SITE is HOST TARGET binding site found in the 3' untranslated region of mRNA encoded by DSC2, corresponding to a HOST TARGET binding site such as BINDING SITE I, BINDING SITE II or BINDING SITE III. Table 2 illustrates the complementarity of the nucleotide sequences of DSC2 BINDING SITE, designated SEQ ID:11392, to the nucleotide sequence of VGAM909 RNA, herein designated VGAM RNA, also designated SEQ ID:3620.

Another function of VGAM909 is therefore inhibition of Desmocollin 2 (DSC2, Accession NM_004949), a gene which is a component of intercellular desmosome junctions. Accordingly, utilities of VGAM909 include diagnosis, prevention and treatment of diseases and clinical conditions associated with DSC2. The function of DSC2 has been established by previous studies. Arnemann et al. (1991) assigned the single gene responsible for DG II/III to the short arm of chromosome 9 by the study of somatic cell hybrids; however, King et al. (1993) cited unpublished data indicating that DSC3 is in fact not on 9p but rather on chromosome 18 where type 1 desmocollin (DSC1; 125643) is located. Tight linkage between the mouse homologs of NCAD (OMIM Ref. No. 114020), DSG1 (OMIM Ref. No. 125670), TTR (OMIM Ref. No. 176300), and DSC3, all of which are located in a region of mouse chromosome 18 with homology to human 18q, suggested that DSC3 was probably located on 18q12.1. Buxton et al. (1994) found that the human DSC3 gene maps to chromosome 18 by PCR amplification of DNA from a panel of rodent/human somatic cell hybrids. Greenwood et al. (1997) found that the human DSC2 gene, which codes for the most widely distributed form of desmocollins, contains 17 exons ranging in size from 46 to 258 bp and spans more than 32 kb of DNA. Exon 16 is alternatively spliced, giving rise to the a and b forms of the protein. A remarkable degree of conservation of intron position with other cadherins was observed.

Full details of the abovementioned studies are described in the following publications, the disclosure of which are hereby incorporated by reference:

Arnemann, J.; Spurr, N. K.; Wheeler, G. N.; Parker, A. E.; Buxton, R. S.: Chromosomal assignment of the human genes coding for the major proteins of the desmosome junction, desmoglein DGI (DSG), desmocollins DGII/III (DSC), desmoplakins DPI/II (DSP), and plakoglobin DPIII (JUP). Genomics 10:640-645, 1991; and Greenwood, M. D.; Marsden, M. D.; Cowley, C. M. E.; Sahota, V. K.; Buxton, R. S.: Exon-intron organization of the human type 2 desmocollin gene (DSC2): desmocollin gene structure is cl.

Further studies establishing the function and utilities of DSC2 are found in John Hopkins OMIM database record ID 125645, and in sited publications numbered 361-36 and 359 listed in the bibliography section hereinbelow, which are also hereby incorporated by reference. EphB2 (EPHB2, Accession NM_004442) is another VGAM909 host target gene. EPHB2 BINDING SITE1 and EPHB2 BINDING SITE2 are HOST TARGET binding sites found in untranslated regions of mRNA encoded by EPHB2, corresponding to HOST TARGET binding sites such as BINDING SITE I, BINDING SITE II or BINDING SITE III. Table 2 illustrates the complementarity of the nucleotide sequences of EPHB2 BINDING SITE1 and EPHB2 BINDING SITE2, designated SEQ ID:10735 and SEQ ID:18910 respectively, to the nucleotide sequence of VGAM909 RNA, herein designated VGAM RNA, also designated SEQ ID:3620.

Another function of VGAM909 is therefore inhibition of EphB2 (EPHB2, Accession NM_004442), a gene which Eph-related receptor tyrosine kinase B2; may have a role in neurogenesis. Accordingly, utilities of VGAM909 include diagnosis, prevention and treatment of diseases and clinical conditions associated with EPHB2. The function of EPHB2 and its association with various diseases and clinical conditions, has been established by previous studies, as described hereinabove with reference to VGAM533. JJAZ1 (Accession NM_015355) is another VGAM909 host target gene. JJAZ1 BINDING SITE is HOST TARGET binding site found in the 3' untranslated region of mRNA encoded by JJAZ1, corresponding to a HOST TARGET binding site such as BINDING SITE I, BINDING SITE II or BINDING SITE III. Table 2 illustrates the complementarity of the nucleotide sequences of JJAZ1 BINDING SITE, designated SEQ ID:17657, to the nucleotide sequence of VGAM909 RNA, herein designated VGAM RNA, also designated SEQ ID:3620.

Another function of VGAM909 is therefore inhibition of JJAZ1 (Accession NM_015355), a gene which is a zinc finger protein. Accordingly, utilities of VGAM909 include diagnosis, prevention and treatment of diseases and clinical conditions associated with JJAZ1. The function of JJAZ1 and its association with various diseases and clinical conditions, has been established by previous studies, as described hereinabove with reference to VGAM231. Mitogen-activated Protein Kinase Kinase 1 (MAP2K1, Accession NM_002755) is another VGAM909 host target gene. MAP2K1 BINDING SITE is HOST TARGET binding site found in the 3' untranslated region of mRNA encoded by MAP2K1, corresponding to a HOST TARGET binding site such as BINDING SITE I, BINDING SITE II or BINDING SITE III. Table 2 illustrates the complementarity of the nucleotide sequences of MAP2K1 BINDING SITE, designated SEQ ID:8634, to the nucleotide sequence of VGAM909 RNA, herein designated VGAM RNA, also designated SEQ ID:3620.

Another function of VGAM909 is therefore inhibition of Mitogen-activated Protein Kinase Kinase 1 (MAP2K1, Accession NM_002755), a gene which is a signaling intermediate, may take part in cell transformation. Accordingly, utilities of VGAM909 include diagnosis, prevention and treatment of diseases and clinical conditions associated with MAP2K1. The function of MAP2K1 and its association with various diseases and clinical conditions, has been established by previous studies, as described hereinabove with reference to VGAM528. N-ethylmaleimide-sensitive Factor Attachment Protein, Beta (NAPB, Accession XM_046652) is another VGAM909 host target gene. NAPB BINDING SITE is HOST TARGET binding site found in the 3' untranslated region of mRNA encoded by NAPB, corresponding to a HOST TARGET binding site such as BINDING SITE I, BINDING SITE II or BINDING SITE III. Table 2 illustrates the complementarity of the nucleotide sequences of NAPB BINDING SITE, designated SEQ ID:34767, to the nucleotide sequence of VGAM909 RNA, herein designated VGAM RNA, also designated SEQ ID:3620.

Another function of VGAM909 is therefore inhibition of N-ethylmaleimide-sensitive Factor Attachment Protein, Beta (NAPB, Accession XM_046652). Accordingly, utilities of VGAM909 include diagnosis, prevention and treatment of diseases and clinical conditions associated with NAPB. Retinoblastoma Binding Protein 9 (RBBP9, Accession XM_046553) is another VGAM909 host target gene. RBBP9 BINDING SITE is HOST TARGET binding site found in the 3' untranslated region of mRNA encoded by RBBP9, corresponding to a HOST TARGET binding site such as BINDING SITE I, BINDING SITE II or BINDING SITE III. Table 2 illustrates the complementarity of the nucleotide sequences of RBBP9 BINDING SITE, designated SEQ ID:34742, to the nucleotide sequence of VGAM909 RNA, herein designated VGAM RNA, also designated SEQ ID:3620.

Another function of VGAM909 is therefore inhibition of Retinoblastoma Binding Protein 9 (RBBP9, Accession XM_046553). Accordingly, utilities of VGAM909 include diagnosis, prevention and treatment of diseases and clinical conditions associated with RBBP9. Signal Transducer and Activator of Transcription 1, 91 kDa (STAT1, Accession NM_007315) is another VGAM909 host target gene. STAT1 BINDING SITE is HOST TARGET binding site found in the 3' untranslated region of mRNA encoded by STAT1, corresponding to a HOST TARGET binding site such as BINDING SITE I, BINDING SITE II or BINDING SITE III. Table 2 illustrates the complementarity of the nucleotide sequences of STAT1 BINDING SITE, designated SEQ ID:14231, to the nucleotide sequence of VGAM909 RNA, herein designated VGAM RNA, also designated SEQ ID:3620.

Another function of VGAM909 is therefore inhibition of Signal Transducer and Activator of Transcription 1, 91 kDa (STAT1, Accession NM_007315), a gene which is involved in transcriptional regulation. Accordingly, utilities of VGAM909 include diagnosis, prevention and treatment of diseases and clinical conditions associated with STAT1. The function of STAT1 has been established by previous studies. STAT proteins have the dual function of signal transduction and activation of transcription (Darnell et al., 1994). These proteins are activated by phosphorylation on tyrosine in response to different ligands after which they form homodimers or heterodimers that translocate to the cell nucleus where they either directly bind to DNA or act together with other DNA-binding proteins in multiprotein transcription complexes to direct transcription. The first of these proteins to be described, which they termed STAT1 (for signal transduction and activator of transcription-1), is activated by a number of different ligands, including interferon-alpha (IFNA; 147660), interferon-gamma (IFNG; 147570), EGF (OMIM Ref. No. 131530), PDGF (see OMIM Ref. No. 173430), and IL6 (OMIM Ref. No. 147620). The same tyrosine residue is activated at least by IFN-alpha, IFN-gamma, and EGF. STAT2 (OMIM Ref. No. 600556), in contrast, is activated by IFN-alpha but not by IFN-gamma or any of the other ligands mentioned above. STAT3 is known to be activated by IGF, IL6, LIF, and perhaps other ligands but is not activated by IFN-gamma. STAT4 (OMIM Ref. No. 600558) is present in high concentration in the testis but has not been found in a phosphorylated form in cells. The STAT proteins differ in the DNA sites to which they bind. STAT1 homodimer binds to a site termed GAS, first defined as required for IFN-gamma induction. Variations on this site are also used in response to IL6, PDGF, and other ligands. Animal model experiments lend further support to the function of STAT1. Meraz et al. (1996) reported the generation and characterization of mice deficient in Stat1. Stat1-deficient mice showed no overt development abnormalities but displayed a complete lack of responsiveness to either interferon-alpha or interferon-gamma and were highly sensitive to infection by microbial pathogens and viruses. In contrast, these mice responded normally to several other cytokines that activate Stat1 in vitro. These observations documented that STAT1 plays an obligate and dedicated role in mediating IFN-dependent biologic responses and revealed an unexpected level of physiologic specificity for STAT1 action.

It is appreciated that the abovementioned animal model for STAT1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Darnell, J. E., Jr.; Kerr, I. M.; Stark, G. M.: Jak-STAT pathways and transcriptional activation in response to IFNs and other extracellular signaling proteins. Science 264:1415-1421, 1994; and Meraz, M. A.; White, J. M.; Sheehan, K. C. F.; Bach, E. A.; Rodig, S. J.; Dighe, A. S.; Kaplan, D. H.; Riley, J. K.; Greenlund, A. C. Campbell, D.; Carver-Moore, K.; DuBois, R. N.; Clar.

Further studies establishing the function and utilities of STAT1 are found in John Hopkins OMIM database record ID 600555, and in sited publications numbered 8095-8097, 6079, 8098-8100, 11676, 12053-8103, 168 and 12330 listed in the bibliography section hereinbelow, which are also hereby incorporated by reference. TIM3 (Accession NM_032782) is another VGAM909 host target gene. TIM3 BINDING SITE is HOST TARGET binding site found in the 3' untranslated region of mRNA encoded by TIM3, corresponding to a HOST TARGET binding site such as BINDING SITE I, BINDING SITE II or BINDING SITE III. Table 2 illustrates the complementarity of the nucleotide sequences of TIM3 BINDING SITE, designated SEQ ID:26524, to the nucleotide sequence of VGAM909 RNA, herein designated VGAM RNA, also designated SEQ ID:3620.

Another function of VGAM909 is therefore inhibition of TIM3 (Accession NM_032782), a gene which regulates macrophage activation and enhances the severity of experimental autoimmune encephalomyelitis in mice. Accordingly, utilities of VGAM909 include diagnosis, prevention and treatment of diseases and clinical conditions associated with TIM3. The function of TIM3 has been established by previous studies. By immunoscreening Th1 and Th2 cells with monoclonal antibodies derived from mouse Th1 cell-immunized rats, followed by gene-expression cloning, Monney et al. (2002) obtained a cDNA encoding mouse Tim3. By genomic database searching and RT-PCR, the authors isolated a cDNA encoding human TIM3. The deduced 301-amino acid type I membrane protein, 63% identical overall and 77% identical in the cytoplasmic domain, has an Ig variable-like domain, a mucin-like domain consisting of 31% serine and threonine residues, and a cytoplasmic domain with a tyrosine phosphorylation motif. Monney et al. (2002) noted that TIM3 is related to the hepatitis A virus cellular receptor (HAVCR1; 606518), also known as the kidney injury molecule (Kim1). Using flow cytometric and RT-PCR analysis, Monney et al. (2002) detected Tim3 only on activated Th1 cells and CD11b+ (ITGAM; 120980) macrophages. Cells expressing Tim3 predominate in the central nervous system of mice at the onset of experimental autoimmune encephalomyelitis (EAE), a Th1-mediated autoimmune disease. Anti-Tim3 treatment enhanced the clinical and pathologic severity of EAE and increased the number and activation level of macrophages. Monney et al. (2002) proposed that anti-Tim3 may trigger the production of proinflammatory cytokines in vivo and induce macrophage activation possibly by enhancing the migration of Th1 cells into the brain or by blocking an interaction between Tim3 and an inhibitory ligand.

Full details of the abovementioned studies are described in the following publications, the disclosure of which are hereby incorporated by reference:

Monney, L.; Sabatos, C.; Gaglia, J. L.; Ryu, A.; Waldner, H.; Chernova, T.; Manning, S.; Greenfield, E. A.; Coyle, A. J.; Sobel, R. A.; Freeman, G. J.; Kuchroo, V. K.: Th1-specific cell surface protein regulates macrophage activation and severity of an autoimmune disease. Nature 415:536-541, 2002; and McIntire, J. J.; Umetsu, S. E.; Akbari, O.; Potter, M.; Kuchroo, V. K.; Barsh, G. S.; Freeman, G. J.; Umetsu, D. T.; DeKruyff, R. H.: Identification of Tapr (an airway hyperreactivity.

Further studies establishing the function and utilities of TIM3 are found in John Hopkins OMIM database record ID 606652, and in sited publications numbered 6839 listed in the bibliography section hereinbelow, which are also hereby incorporated by reference. Bifunctional Apoptosis Regulator (BFAR, Accession XM_027311) is another VGAM909 host target gene. BFAR BINDING SITE is HOST TARGET binding site found in the 5' untranslated region of mRNA encoded by BFAR, corresponding to a HOST TARGET binding site such as BINDING SITE I, BINDING SITE II or BINDING SITE III. Table 2 illustrates the complementarity of the nucleotide sequences of BFAR BINDING SITE, designated SEQ ID:30478, to the nucleotide sequence of VGAM909 RNA, herein designated VGAM RNA, also designated SEQ ID:3620.

Another function of VGAM909 is therefore inhibition of Bifunctional Apoptosis Regulator (BFAR, Accession XM_027311). Accordingly, utilities of VGAM909 include diagnosis, prevention and treatment of diseases and clinical conditions associated with BFAR. CMRF-35H (Accession XM_046925) is another VGAM909 host target gene. CMRF-35H BINDING SITE is HOST TARGET binding site found in the 3' untranslated region of mRNA encoded by CMRF-35H, corresponding to a HOST TARGET binding site such as BINDING SITE I, BINDING SITE II or BINDING SITE III. Table 2 illustrates the complementarity of the nucleotide sequences of CMRF-35H BINDING SITE, designated SEQ ID:34862, to the nucleotide sequence of VGAM909 RNA, herein designated VGAM RNA, also designated SEQ ID:3620.

Another function of VGAM909 is therefore inhibition of CMRF-35H (Accession XM_046925). Accordingly, utilities of VGAM909 include diagnosis, prevention and treatment of diseases and clinical conditions associated with CMRF-35H. Cleavage and Polyadenylation Specific Factor 2, 100 kDa (CPSF2, Accession XM_029311) is another VGAM909 host target gene. CPSF2 BINDING SITE is HOST TARGET binding site found in the 5' untranslated region of mRNA encoded by CPSF2, corresponding to a HOST TARGET binding site such as BINDING SITE I, BINDING SITE II or BINDING SITE III. Table 2 illustrates the complementarity of the nucleotide sequences of CPSF2 BINDING SITE, designated SEQ ID:30863, to the nucleotide sequence of VGAM909 RNA, herein designated VGAM RNA, also designated SEQ ID:3620.

Another function of VGAM909 is therefore inhibition of Cleavage and Polyadenylation Specific Factor 2, 100 kDa (CPSF2, Accession XM_029311). Accordingly, utilities of VGAM909 include diagnosis, prevention and treatment of diseases and clinical conditions associated with CPSF2. DKFZP564D0764 (Accession XM_113964) is another VGAM909 host target gene. DKFZP564D0764 BINDING SITE is HOST TARGET binding site found in the 3' untranslated region of mRNA encoded by DKFZP564D0764, corresponding to a HOST TARGET binding site such as BINDING SITE I, BINDING SITE II or BINDING SITE III. Table 2 illustrates the complementarity of the nucleotide sequences of DKFZP564D0764 BINDING SITE, designated SEQ ID:42574, to the nucleotide sequence of VGAM909 RNA, herein designated VGAM RNA, also designated SEQ ID:3620.

Another function of VGAM909 is therefore inhibition of DKFZP564D0764 (Accession XM_113964). Accordingly, utilities of VGAM909 include diagnosis, prevention and treatment of diseases and clinical conditions associated with DKFZP564D0764. FLJ10697 (Accession NM_018181) is another VGAM909 host target gene. FLJ10697 BINDING SITE is HOST TARGET binding site found in the 3' untranslated region of mRNA encoded by FLJ10697, corresponding to a HOST TARGET binding site such as BINDING SITE I, BINDING SITE II or BINDING SITE III. Table 2 illustrates the complementarity of the nucleotide sequences of FLJ10697 BINDING SITE, designated SEQ ID:20016, to the nucleotide sequence of VGAM909 RNA, herein designated VGAM RNA, also designated SEQ ID:3620.

Another function of VGAM909 is therefore inhibition of FLJ10697 (Accession NM_018181). Accordingly, utilities of VGAM909 include diagnosis, prevention and treatment of diseases and clinical conditions associated with FLJ10697. FLJ10704 (Accession NM_018185) is another VGAM909 host target gene. FLJ10704 BINDING SITE is HOST TARGET binding site found in the 3' untranslated region of mRNA encoded by FLJ10704, corresponding to a HOST TARGET binding site such as BINDING SITE I, BINDING SITE II or BINDING SITE III. Table 2 illustrates the complementarity of the nucleotide sequences of FLJ10704 BINDING SITE, designated SEQ ID:20030, to the nucleotide sequence of VGAM909 RNA, herein designated VGAM RNA, also designated SEQ ID:3620.

Another function of VGAM909 is therefore inhibition of FLJ10704 (Accession NM_018185). Accordingly, utilities of VGAM909 include diagnosis, prevention and treatment of diseases and clinical conditions associated with FLJ10704. FLJ11722 (Accession NM_024970) is another VGAM909 host target gene. FLJ11722 BINDING SITE is HOST TARGET binding site found in the 3' untranslated region of mRNA encoded by FLJ11722, corresponding to a HOST TARGET binding site such as BINDING SITE I, BINDING SITE II or BINDING SITE III. Table 2 illustrates the complementarity of the nucleotide sequences of FLJ11722 BINDING SITE, designated SEQ ID:24521, to the nucleotide sequence of VGAM909 RNA, herein designated VGAM RNA, also designated SEQ ID:3620.

Another function of VGAM909 is therefore inhibition of FLJ11722 (Accession NM_024970). Accordingly, utilities of VGAM909 include diagnosis, prevention and treatment of diseases and clinical conditions associated with FLJ11722. KIAA0335 (Accession NM_014803) is another VGAM909 host target gene. KIAA0335 BINDING SITE is HOST TARGET binding site found in the 3' untranslated region of mRNA encoded by KIAA0335, corresponding to a HOST TARGET binding site such as BINDING SITE I, BINDING SITE II or BINDING SITE III. Table 2 illustrates the complementarity of the nucleotide sequences of KIAA0335 BINDING SITE, designated SEQ ID:16734, to the nucleotide sequence of VGAM909 RNA, herein designated VGAM RNA, also designated SEQ ID:3620.

Another function of VGAM909 is therefore inhibition of KIAA0335 (Accession NM_014803). Accordingly, utilities of VGAM909 include diagnosis, prevention and treatment of diseases and clinical conditions associated with KIAA0335. KIAA0976 (Accession NM_014917) is another VGAM909 host target gene. KIAA0976 BINDING SITE is HOST TARGET binding site found in the 3' untranslated region of mRNA encoded by KIAA0976, corresponding to a HOST TARGET binding site such as BINDING SITE I, BINDING SITE II or BINDING SITE III. Table 2 illustrates the complementarity of the nucleotide sequences of KIAA0976 BINDING SITE, designated SEQ ID:17162, to the nucleotide sequence of VGAM909 RNA, herein designated VGAM RNA, also designated SEQ ID:3620.

Another function of VGAM909 is therefore inhibition of KIAA0976 (Accession NM_014917). Accordingly, utilities of VGAM909 include diagnosis, prevention and treatment of diseases and clinical conditions associated with KIAA0976. KIAA1727 (Accession XM_034262) is another VGAM909 host target gene. KIAA1727 BINDING SITE is HOST TARGET binding site found in the 3' untranslated region of mRNA encoded by KIAA1727, corresponding to a HOST TARGET binding site such as BINDING SITE I, BINDING SITE II or BINDING SITE III. Table 2 illustrates the complementarity of the nucleotide sequences of KIAA1727 BINDING SITE, designated SEQ ID:32031, to the nucleotide sequence of VGAM909 RNA, herein designated VGAM RNA, also designated SEQ ID:3620.

Another function of VGAM909 is therefore inhibition of KIAA1727 (Accession XM_034262). Accordingly, utilities of VGAM909 include diagnosis, prevention and treatment of diseases and clinical conditions associated with KIAA1727. KIAA1938 (Accession XM_166407) is another VGAM909 host target gene. KIAA1938 BINDING SITE is HOST TARGET binding site found in the 3' untranslated region of mRNA encoded by KIAA1938, corresponding to a HOST TARGET binding site such as BINDING SITE I, BINDING SITE II or BINDING SITE III. Table 2 illustrates the complementarity of the nucleotide sequences of KIAA1938 BINDING SITE, designated SEQ ID:44279, to the nucleotide sequence of VGAM909 RNA, herein designated VGAM RNA, also designated SEQ ID:3620.

Another function of VGAM909 is therefore inhibition of KIAA1938 (Accession XM_166407). Accordingly, utilities of VGAM909 include diagnosis, prevention and treatment of diseases and clinical conditions associated with KIAA1938. SEC15L (Accession XM_051147) is another VGAM909 host target gene. SEC15L BINDING SITE is HOST TARGET binding site found in the 3' untranslated region of mRNA encoded by SEC15L, corresponding to a HOST TARGET binding site such as BINDING SITE I, BINDING SITE II or BINDING SITE III. Table 2 illustrates the complementarity of the nucleotide sequences of SEC15L BINDING SITE, designated SEQ ID:35765, to the nucleotide sequence of VGAM909 RNA, herein designated VGAM RNA, also designated SEQ ID:3620.

Another function of VGAM909 is therefore inhibition of SEC15L (Accession XM_051147). Accordingly, utilities of VGAM909 include diagnosis, prevention and treatment of diseases and clinical conditions associated with SEC15L. TSPAN-2 (Accession NM_005725) is another VGAM909 host target gene. TSPAN-2 BINDING SITE is HOST TARGET binding site found in the 3' untranslated region of mRNA encoded by TSPAN-2, corresponding to a HOST TARGET binding site such as BINDING SITE I, BINDING SITE II or BINDING SITE III. Table 2 illustrates the complementarity of the nucleotide sequences of TSPAN-2 BINDING SITE, designated SEQ ID:12278, to the nucleotide sequence of VGAM909 RNA, herein designated VGAM RNA, also designated SEQ ID:3620.

Another function of VGAM909 is therefore inhibition of TSPAN-2 (Accession NM_005725). Accordingly, utilities of VGAM909 include diagnosis, prevention and treatment of diseases and clinical conditions associated with TSPAN-2. Zinc Finger Protein 297B (ZNF297B, Accession NM_014007) is another VGAM909 host target gene. ZNF297B BINDING SITE is HOST TARGET binding site found in the 3' untranslated region of mRNA encoded by ZNF297B, corresponding to a HOST TARGET binding site such as BINDING SITE I, BINDING SITE II or BINDING SITE III. Table 2 illustrates the complementarity of the nucleotide sequences of ZNF297B BINDING SITE, designated SEQ ID:15220, to the nucleotide sequence of VGAM909 RNA, herein designated VGAM RNA, also designated SEQ ID:3620.

Another function of VGAM909 is therefore inhibition of Zinc Finger Protein 297B (ZNF297B, Accession NM_014007). Accordingly, utilities of VGAM909 include diagnosis, prevention and treatment of diseases and clinical conditions associated with ZNF297B. LOC143879 (Accession XM_084666) is another VGAM909 host target gene. LOC143879 BINDING SITE is HOST TARGET binding site found in the 3' untranslated region of mRNA encoded by LOC143879, corresponding to a HOST TARGET binding site such as BINDING SITE I, BINDING SITE II or BINDING SITE III. Table 2 illustrates the complementarity of the nucleotide sequences of LOC143879 BINDING SITE, designated SEQ ID:37659, to the nucleotide sequence of VGAM909 RNA, herein designated VGAM RNA, also designated SEQ ID:3620.

Another function of VGAM909 is therefore inhibition of LOC143879 (Accession XM_084666). Accordingly, utilities of VGAM909 include diagnosis, prevention and treatment of diseases and clinical conditions associated with LOC143879. LOC151057 (Accession XM_097998) is another VGAM909 host target gene. LOC151057 BINDING SITE is HOST TARGET binding site found in the 3' untranslated region of mRNA encoded by LOC151057, corresponding to a HOST TARGET binding site such as BINDING SITE I, BINDING SITE II or BINDING SITE III. Table 2 illustrates the complementarity of the nucleotide sequences of LOC151057 BINDING SITE, designated SEQ ID:41294, to the nucleotide sequence of VGAM909 RNA, herein designated VGAM RNA, also designated SEQ ID:3620.

Another function of VGAM909 is therefore inhibition of LOC151057 (Accession XM_097998). Accordingly, utilities of VGAM909 include diagnosis, prevention and treatment of diseases and clinical conditions associated with LOC151057. LOC199957 (Accession XM_114068) is another VGAM909 host target gene. LOC199957 BINDING SITE is HOST TARGET binding site found in the 3' untranslated region of mRNA encoded by LOC199957, corresponding to a HOST TARGET binding site such as BINDING SITE I, BINDING SITE II or BINDING SITE III. Table 2 illustrates the complementarity of the nucleotide sequences of LOC199957 BINDING SITE, designated SEQ ID:42674, to the nucleotide sequence of VGAM909 RNA, herein designated VGAM RNA, also designated SEQ ID:3620.

Another function of VGAM909 is therefore inhibition of LOC199957 (Accession XM_114068). Accordingly, utilities of VGAM909 include diagnosis, prevention and treatment of diseases and clinical conditions associated with LOC199957. LOC202934 (Accession XM_117486) is another VGAM909 host target gene. LOC202934 BINDING SITE is HOST TARGET binding site found in the 3' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43460, to the nucleotide sequence of VGAM909 RNA, herein designated VGAM RNA, also designated SEQ ID:3620.

Another function of VGAM909 is therefore inhibition of LOC202934 (Accession XM_117486). Accordingly, utilities of VGAM909 include diagnosis, prevention and treatment of diseases and clinical conditions associated with LOC202934.

LOC253612 (Accession XM_172985) is another VGAM909 host target gene. LOC253612 BINDING SITE is HOST TARGET binding site found in the 3' untranslated region of mRNA encoded by LOC253612, corresponding to a HOST TARGET binding site such as BINDING SITE I, BINDING SITE II or BINDING SITE III. Table 2 illustrates the complementarity of the nucleotide sequences of LOC253612 BINDING SITE, designated SEQ ID:46255, to the nucleotide sequence of VGAM909 RNA, herein designated VGAM RNA, also designated SEQ ID:3620.

Another function of VGAM909 is therefore inhibition of LOC253612 (Accession XM_172985). Accordingly, utilities of VGAM909 include diagnosis, prevention and treatment of diseases and clinical conditions associated with LOC253612. LOC257017 (Accession XM_173227) is another VGAM909 host target gene. LOC257017 BINDING SITE is HOST TARGET binding site found in the 5' untranslated region of mRNA encoded by LOC257017, corresponding to a HOST TARGET binding site such as BINDING SITE I, BINDING SITE II or BINDING SITE III. Table 2 illustrates the complementarity of the nucleotide sequences of LOC257017 BINDING SITE, designated SEQ ID:46491, to the nucleotide sequence of VGAM909 RNA, herein designated VGAM RNA, also designated SEQ ID:3620.

Another function of VGAM909 is therefore inhibition of LOC257017 (Accession XM_173227). Accordingly, utilities of VGAM909 include diagnosis, prevention and treatment of diseases and clinical conditions associated with LOC257017. LOC92573 (Accession XM_045884) is another VGAM909 host target gene. LOC92573 BINDING SITE is HOST TARGET binding site found in the 5' untranslated region of mRNA encoded by LOC92573, corresponding to a HOST TARGET binding site such as BINDING SITE I, BINDING SITE II or BINDING SITE III. Table 2 illustrates the complementarity of the nucleotide sequences of LOC92573 BINDING SITE, designated SEQ ID:34599, to the nucleotide sequence of VGAM909 RNA, herein designated VGAM RNA, also designated SEQ ID:3620.

Another function of VGAM909 is therefore inhibition of LOC92573 (Accession XM_045884). Accordingly, utilities of VGAM909 include diagnosis, prevention and treatment of diseases and clinical conditions associated with LOC92573. FIG. 1 further provides a conceptual description of a novel bioinformatically detected viral gene of the present invention, referred to here as Viral Genomic Address Messenger 910 (VGAM910) viral gene, which modulates expression of respective host target genes thereof, the function and utility of which host target genes is known in the art.

VGAM910 is a novel bioinformatically detected regulatory, non protein coding, viral micro RNA (miRNA) gene. The method by which VGAM910 was detected is described hereinabove with reference to FIGS. 1-8.

VGAM910 gene, herein designated VGAM GENE, is a viral gene contained in the genome of Alcelaphine Herpesvirus 1. VGAM910 host target gene, herein designated VGAM HOST TARGET GENE, is a human gene contained in the human genome.

VGAM910 gene encodes a VGAM910 precursor RNA, herein designated VGAM PRECURSOR RNA. Similar to other miRNA genes, and unlike most ordinary genes, VGAM910 precursor RNA does not encode a protein. A nucleotide sequence identical or highly similar to the nucleotide sequence of VGAM910 precursor RNA is designated SEQ ID:896, and is provided hereinbelow with reference to the sequence listing part. Nucleotide sequence SEQ ID:896 is located at position 61092 relative to the genome of Alcelaphine Herpesvirus 1.

VGAM910 precursor RNA folds onto itself, forming VGAM910 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM910 folded precursor RNA into VGAM910 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM910 RNA is designated SEQ ID:3621, and is provided hereinbelow with reference to the sequence listing part.

VGAM910 host target gene, herein designated VGAM HOST TARGET GENE, encodes a corresponding messenger RNA, VGAM910 host target RNA, herein designated VGAM HOST TARGET RNA. VGAM910 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM910 RNA, herein designated VGAM RNA, binds complementarily to one or more host target binding sites located in untranslated regions of VGAM910 host target RNA, herein designated VGAM HOST TARGET RNA. This complementary binding is due to the fact that the nucleotide sequence of VGAM910 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM910 RNA, herein designated VGAM RNA, may have a different number of host target binding sites in untranslated regions of a VGAM910 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM910 RNA, herein designated VGAM RNA, to host target binding sites on VGAM910 host target RNA, herein designated VGAM HOST TARGET RNA, such as BINDING SITE I, BINDING SITE II and BINDING SITE III, inhibits translation of VGAM910 host target RNA into VGAM910 host target protein, herein designated VGAM HOST TARGET PROTEIN. VGAM host target protein is therefore outlined by a broken line.

It is appreciated that VGAM910 host target gene, herein designated VGAM HOST TARGET GENE, in fact represents a plurality of VGAM910 host target genes. The mRNA of each one of this plurality of VGAM910 host target genes comprises one or more host target binding sites, each having a nucleotide sequence which is at least partly complementary to VGAM910 RNA, herein designated VGAM RNA, and which when bound by VGAM910 RNA causes inhibition of translation of respective one or more VGAM910 host target proteins.

It is further appreciated by one skilled in the art that the mode of translational inhibition illustrated by FIG. 1 with specific reference to translational inhibition exerted by VGAM910 gene, herein designated VGAM GENE, on one or more VGAM910 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM910 is inhibition of expression of host target genes, as part of a novel viral mechanism of attacking a host. Accordingly, utilities of VGAM910 include diagnosis, prevention and treatment of viral infection by Alcelaphine Herpesvirus 1. Specific functions, and accordingly utilities, of VGAM910 correlate with, and may be deduced from, the identity of the host target genes which VGAM910 binds and inhibits, and the function of these host target genes, as elaborated hereinbelow.

Nucleotide sequences of the VGAM910 precursor RNA, herein designated VGAM PRECURSOR RNA, and of the 'diced' VGAM910 RNA, herein designated VGAM RNA, and a schematic representation of the secondary folding of VGAM910 folded precursor RNA, herein designated VGAM FOLDED PRECURSOR RNA, of VGAM910 are further described hereinbelow with reference to Table 1.

Nucleotide sequences of host target binding sites, such as BINDING SITE-I, BINDING SITE-II and BINDING SITE-III of FIG. 1, found on VGAM910 host target RNA, and schematic representation of the complementarity of each of these host target binding sites to VGAM910 RNA, herein designated VGAM RNA, are described hereinbelow with reference to Table 2.

As mentioned hereinabove with reference to FIG. 1, a function of VGAM910 gene, herein designated VGAM is inhibition of expression of VGAM910 target genes. It is appreciated that specific functions, and accordingly utilities, of VGAM910 correlate with, and may be deduced from, the identity of the target genes which VGAM910 binds and inhibits, and the function of these target genes, as elaborated hereinbelow.

Bone Morphogenetic Protein 4 (BMP4, Accession NM_001202) is a VGAM910 host target gene. BMP4 BINDING SITE1 through BMP4 BINDING SITE3 are HOST TARGET binding sites found in untranslated regions of mRNA encoded by BMP4, corresponding to HOST TARGET binding sites such as BINDING SITE I, BINDING SITE II or BINDING SITE III. Table 2 illustrates the complementarity of the nucleotide sequences of BMP4 BINDING SITE1 through BMP4 BINDING SITE3, designated SEQ ID:6867, SEQ ID:28388 and SEQ ID:28389 respectively, to the nucleotide sequence of VGAM910 RNA, herein designated VGAM RNA, also designated SEQ ID:3621.

A function of VGAM910 is therefore inhibition of Bone Morphogenetic Protein 4 (BMP4, Accession NM_001202), a gene which acts in mesoderm induction, tooth development, limb formation and fracture repair. Accordingly, utilities of VGAM910 include diagnosis, prevention and treatment of diseases and clinical conditions associated with BMP4. The function of BMP4 has been established by previous studies. Shafritz et al. (1996) found overexpression of BMP4 in lymphoblastoid cell lines from 26 of 32 patients with fibrodysplasia ossificans progressiva (FOP; 135100), but from only 1 of 12 normal subjects (P less than 0.001). Furthermore, BMP4 and its mRNA were detected in the lymphoblastoid cell lines from a man with FOP and his 3 affected children, but not from the children's unaffected mother. Cosegregation of DNA markers for the BMP4 locus on chromosome 14 in the rare families in which FOP is inherited would strengthen the candidacy of BMP4, and the demonstration of mutations in the BMP4 gene, especially in the promoter sequences, would be confirmatory. Animal model experiments lend further support to the function of BMP4. Connor (1996) speculated that transgenic mice with selective overexpression of BMP4 may serve as animal models of FOP and may make it possible to evaluate potential therapies directed at influencing the expression of BMP4 or its 2 types of cell-surface receptors. Not only may this knowledge provide a rational basis for therapy for FOP, but possibly also measures for the control of local ectopic bone development which occurs in 10 to 20% of patients who have undergone surgical hip replacement. According to Connor (1996), there appears to be an individual propensity to the phenomenon of secondary ectopic ossification of soft tissue. In the 10 to 20% of patients who develop local ectopic bone formation after hip replacement, if surgical removal of that bone is attempted or the opposite hip is replaced, ectopic bone almost invariably recurs or occurs.

It is appreciated that the abovementioned animal model for BMP4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shafritz, A. B.; Shore, E. M.; Gannon, F. H.; Zasloff, M. A.; Taub, R.; Muenke, M.; Kaplan, F. S.: Overexpression of an osteogenic morphogen in fibrodysplasia ossificans progressiva. New Eng. J. Med. 335:555-561, 1996; and Connor, J. M.: Fibrodysplasia ossificans progressiva: lessons from rare maladies. (Editorial) New Eng. J. Med. 335: 591-593, 1996.

Further studies establishing the function and utilities of BMP4 are found in John Hopkins OMIM database record ID 112262, and in sited publications numbered 1163 and 11632-11639 listed in the bibliography section hereinbelow, which are also hereby incorporated by reference. Coagulation Factor VIII, Procoagulant Component (hemophilia A) (F8, Accession NM_000132) is another VGAM910 host target gene. F8 BINDING SITE is HOST TARGET binding site found in the 3' untranslated region of mRNA encoded by F8, corresponding to a HOST TARGET binding site such as BINDING SITE I, BINDING SITE II or BINDING SITE III. Table 2 illustrates the complementarity of the nucleotide sequences of F8 BINDING SITE, designated SEQ ID:5616, to the nucleotide sequence of VGAM910 RNA, herein designated VGAM RNA, also designated SEQ ID:3621.

Another function of VGAM910 is therefore inhibition of Coagulation Factor VIII, Procoagulant Component (hemophilia A) (F8, Accession NM_000132). Accordingly, utilities of VGAM910 include diagnosis, prevention and treatment of diseases and clinical conditions associated with F8. Interleukin 2 Receptor, Beta (IL2RB, Accession NM_000878) is another VGAM910 host target gene. IL2RB BINDING SITE is HOST TARGET binding site found in the 3' untranslated region of mRNA encoded by IL2RB, corresponding to a HOST TARGET binding site such as BINDING SITE I, BINDING SITE II or BINDING SITE III. Table 2 illustrates the complementarity of the nucleotide sequences of IL2RB BINDING SITE, designated SEQ ID:6573, to the nucleotide sequence of VGAM910 RNA, herein designated VGAM RNA, also designated SEQ ID:3621.

Another function of VGAM910 is therefore inhibition of Interleukin 2 Receptor, Beta (IL2RB, Accession NM_000878), a gene which is involved in receptor mediated endocytosis and transduces the mitogenic signals of il-2. Accordingly, utilities of VGAM910 include diagnosis, prevention and treatment of diseases and clinical conditions associated with IL2RB. The function of IL2RB and its association with various diseases and clinical conditions, has been established by previous studies, as described hereinabove with reference to VGAM450. Keratin, Hair, Acidic, 8 (KRTHA8, Accession NM_006771) is another VGAM910 host target gene. KRTHA8 BINDING SITE is HOST TARGET binding site found in the 3' untranslated region of mRNA encoded by KRTHA8, corresponding to a HOST TARGET binding site such as BINDING SITE I, BINDING SITE II or BINDING SITE III. Table 2 illustrates the complementarity of the nucleotide sequences of KRTHA8 BINDING SITE, designated SEQ ID:13644, to the nucleotide sequence of VGAM910 RNA, herein designated VGAM RNA, also designated SEQ ID:3621.

Another function of VGAM910 is therefore inhibition of Keratin, Hair, Acidic, 8 (KRTHA8, Accession NM_006771), a gene which a type I keratin that may form intermediate filaments. Accordingly, utilities of VGAM910 include diagnosis, prevention and treatment of diseases and clinical conditions associated with KRTHA8. The function of KRTHA8 has been established by previous studies. Rogers et al. (1998) isolated and characterized 2 overlapping human PAC clones that cover 190 kb on 17q12-q21. These clones contain 9 type I hair keratin genes, including the novel genes KRTHA7 (OMIM Ref. No. 604541) and KRTHA8; 1 transcribed hair keratin pseudogene; and 1 orphan exon. The order of the genes is 5-prime--KRTHA6 (OMIM Ref. No. 604540)--KRTHA5 (OMIM Ref. No. 602764)--KRTHA2 (OMIM Ref. No. 602760)--orphan exon--KRTHA8--KRTHA7--pseudogene--KRTHA1--KRTHA4 (OMIM Ref. No. 602763)--KRTHA3B (OMIM Ref. No. 602762)--KRTHA3A (OMIM Ref. No. 602761)--3-prime. The hair keratin genes range in size from 4.2 to 7.5 kb, and the genes are separated from each other by 5.5 to 18.4 kb; all are located within about 140 kb. Each gene is transcribed from the 5-prime to 3-prime direction. Based on sequence homologies, the genes can be grouped into 3 subclusters of tandemly arranged genes. One subcluster, group A, consists of KRTHA1, KRTHA3A, KRTHA3B, and KRTHA4, which share 89% overall amino acid identity. A second subcluster, group B, contains KRTHA7 and KRTHA8, as well as the hair keratin pseudogene, which the authors called HAA. The functional hair keratins and hypothetical HAA hair keratin share approximately 81% overall amino acid identity. Due to an almost completely identical head domain, KRTHA7 and KRTHA8 are 92.6% identical. The third subcluster, group C, consists of the structurally less related hair keratins KRTHA2, KRTHA5, and KRTHA6, which share about 70% amino acid identity. Rogers et al. (1998) found that the deduced KRTHA8 protein, which they called HA8, has 415 amino acids. The KRTHA8 gene contains 7 exons. By RT-PCR, Rogers et al. (1998) showed that KRTHA8 is expressed in the human hair follicle. See Langbein et al. (1999) for further details on the expression pattern of the KRTHA8 gene in the hair follicle.

Full details of the abovementioned studies are described in the following publications, the disclosure of which are hereby incorporated by reference:

Langbein, L.; Rogers, M. A.; Winter, H.; Silke, P.; Beckhaus, U.; Rackwitz, H.-R.; Schweizer, J.: The catalog of human hair keratins. I. Expression of the nine type I members in the hair follicle. J. Biol. Chem. 274:19874-19884, 1999; and Rogers, M. A.; Winter, H.; Wolf, C.; Heck, M.; Schweizer, J.: Characterization of a 190-kilobase pair domain of human type I hair keratin genes. J. Biol. Chem. 273:26683-26691, 1998.

Further studies establishing the function and utilities of KRTHA8 are found in John Hopkins OMIM database record ID 604542, and in sited publications numbered 1257-1258 listed in the bibliography section hereinbelow, which are also hereby incorporated by reference. Mesenchyme Homeo Box 2 (growth arrest-specific homeo box) (MEOX2, Accession NM_005924) is another VGAM910 host target gene. MEOX2 BINDING SITE is HOST TARGET binding site found in the 3' untranslated region of mRNA encoded by MEOX2, corresponding to a HOST TARGET binding site such as BINDING SITE I, BINDING SITE II or BINDING SITE III. Table 2 illustrates the complementarity of the nucleotide sequences of MEOX2 BINDING SITE, designated SEQ ID:12548, to the nucleotide sequence of VGAM910 RNA, herein designated VGAM RNA, also designated SEQ ID:3621.

Another function of VGAM910 is therefore inhibition of Mesenchyme Homeo Box 2 (growth arrest-specific homeo box) (MEOX2, Accession NM_005924), a gene which roles in mesoderm induction and, somitogenesis, and myogenic and sclerotomal differentiation. Accordingly, utilities of VGAM910 include diagnosis, prevention and treatment of diseases and clinical conditions associated with MEOX2. The function of MEOX2 and its association with various diseases and clinical conditions, has been established by previous studies, as described hereinabove with reference to VGAM827. Nitric Oxide Synthase 1 (neuronal) (NOS1, Accession NM_000620) is another VGAM910 host target gene. NOS1 BINDING SITE is HOST TARGET binding site found in the 5' untranslated region of mRNA encoded by NOS1, corresponding to a HOST TARGET binding site such as BINDING SITE I, BINDING SITE II or BINDING SITE III. Table 2 illustrates the complementarity of the nucleotide sequences of NOS1 BINDING SITE, designated SEQ ID:6228, to the nucleotide sequence of VGAM910 RNA, herein designated VGAM RNA, also designated SEQ ID:3621.

Another function of VGAM910 is therefore inhibition of Nitric Oxide Synthase 1 (neuronal) (NOS1, Accession NM_000620), a gene which produces nitric oxide (no) which is a messenger molecule with diverse functions throughout the body. Accordingly, utilities of VGAM910 include diagnosis, prevention and treatment of diseases and clinical conditions associated with NOS1. The function of NOS1 and its association with various diseases and clinical conditions, has been established by previous studies, as described hereinabove with reference to VGAM323. Protein Kinase C and Casein Kinase Substrate In Neurons 1 (PACSIN1, Accession XM_166424) is another VGAM910 host target gene. PACSIN1 BINDING SITE is HOST TARGET binding site found in the 3' untranslated region of mRNA encoded by PACSIN1, corresponding to a HOST TARGET binding site such as BINDING SITE I, BINDING SITE II or BINDING SITE III. Table 2 illustrates the complementarity of the nucleotide sequences of PACSIN1 BINDING SITE, designated SEQ ID:44318, to the nucleotide sequence of VGAM910 RNA, herein designated VGAM RNA, also designated SEQ ID:3621.

Another function of VGAM910 is therefore inhibition of Protein Kinase C and Casein Kinase Substrate In Neurons 1 (PACSIN1, Accession XM_166424). Accordingly, utilities of VGAM910 include diagnosis, prevention and treatment of diseases and clinical conditions associated with PACSIN1. Sclerosteosis (SOST, Accession NM_025237) is another VGAM910 host target gene. SOST BINDING SITE is HOST TARGET binding site found in the 3" untranslated region of mRNA encoded by SOST, corresponding to a HOST TARGET binding site such as BINDING SITE I, BINDING SITE II or BINDING SITE III. Table 2 illustrates the complementarity of the nucleotide sequences of SOST BINDING SITE, designated SEQ ID:24918, to the nucleotide sequence of VGAM910 RNA, herein designated VGAM RNA, also designated SEQ ID:3621.

Another function of VGAM910 is therefore inhibition of Sclerosteosis (SOST, Accession NM_025237). Accordingly, utilities of VGAM910 include diagnosis, prevention and treatment of diseases and clinical conditions associated with SOST. Angiomotin (AMOT, Accession NM_133265) is another VGAM910 host target gene. AMOT BINDING SITE is HOST TARGET binding site found in the 3' untranslated region of mRNA encoded by AMOT, corresponding to a HOST TARGET binding site such as BINDING SITE I, BINDING SITE II or BINDING SITE III. Table 2 illustrates the complementarity of the nucleotide sequences of AMOT BINDING SITE, designated SEQ ID:28414, to the nucleotide sequence of VGAM910 RNA, herein designated VGAM RNA, also designated SEQ ID:3621.

Another function of VGAM910 is therefore inhibition of Angiomotin (AMOT, Accession NM_133265). Accordingly, utilities of VGAM910 include diagnosis, prevention and treatment of diseases and clinical conditions associated with AMOT. Adaptor-related Protein Complex 4, Sigma 1 Subunit (AP4S1, Accession NM_007077) is another VGAM910 host target gene. AP4S1 BINDING SITE is HOST TARGET binding site found in the 3' untranslated region of mRNA encoded by AP4S1, corresponding to a HOST TARGET binding site such as BINDING SITE I, BINDING SITE II or BINDING SITE III. Table 2 illustrates the complementarity of the nucleotide sequences of AP4S1 BINDING SITE, designated SEQ ID:13942, to the nucleotide sequence of VGAM910 RNA, herein designated VGAM RNA, also designated SEQ ID:3621.

Another function of VGAM910 is therefore inhibition of Adaptor-related Protein Complex 4, Sigma 1 Subunit (AP4S1, Accession NM_007077). Accordingly, utilities of VGAM910 include diagnosis, prevention and treatment of diseases and clinical conditions associated with AP4S1. DKFZP434N161 (Accession XM_085920) is another VGAM910 host target gene. DKFZP434N161 BINDING SITE is HOST TARGET binding site found in the 3' untranslated region of mRNA encoded by DKFZP434N161, corresponding to a HOST TARGET binding site such as BINDING SITE I, BINDING SITE II or BINDING SITE III. Table 2 illustrates the complementarity of the nucleotide sequences of DKFZP434N161 BINDING SITE, designated SEQ ID:38396, to the nucleotide sequence of VGAM910 RNA, herein designated VGAM RNA, also designated SEQ ID:3621.

Another function of VGAM910 is therefore inhibition of DKFZP434N161 (Accession XM_085920). Accordingly, utilities of VGAM910 include diagnosis, prevention and treatment of diseases and clinical conditions associated with DKFZP434N161. FLJ11004 (Accession NM_018296) is another VGAM910 host target gene. FLJ11004 BINDING SITE is HOST TARGET binding site found in the 5' untranslated region of mRNA encoded by FLJ11004, corresponding to a HOST TARGET binding site such as BINDING SITE I, BINDING SITE II or BINDING SITE III. Table 2 illustrates the complementarity of the nucleotide sequences of FLJ11004 BINDING SITE, designated SEQ ID:20285, to the nucleotide sequence of VGAM910 RNA, herein designated VGAM RNA, also designated SEQ ID:3621.

Another function of VGAM910 is therefore inhibition of FLJ11004 (Accession NM_018296). Accordingly, utilities of VGAM910 include diagnosis, prevention and treatment of diseases and clinical conditions associated with FLJ11004. FLJ11560 (Accession NM_025182) is another VGAM910 host target gene. FLJ11560 BINDING SITE is HOST TARGET binding site found in the 5' untranslated region of mRNA encoded by FLJ11560, corresponding to a HOST TARGET binding site such as BINDING SITE I, BINDING SITE II or BINDING SITE III. Table 2 illustrates the complementarity of the nucleotide sequences of FLJ11560 BINDING SITE, designated SEQ ID:24819, to the nucleotide sequence of VGAM910 RNA, herein designated VGAM RNA, also designated SEQ ID:3621.

Another function of VGAM910 is therefore inhibition of FLJ11560 (Accession NM_025182). Accordingly, utilities of VGAM910 include diagnosis, prevention and treatment of diseases and clinical conditions associated with FLJ11560. FLJ13263 (Accession NM_025125) is another VGAM910 host target gene. FLJ13263 BINDING SITE is HOST TARGET binding site found in the 3' untranslated region of mRNA encoded by FLJ13263, corresponding to a HOST TARGET binding site such as BINDING SITE I, BINDING SITE II or BINDING SITE III. Table 2 illustrates the complementarity of the nucleotide sequences of FLJ13263 BINDING SITE, designated SEQ ID:24768, to the nucleotide sequence of VGAM910 RNA, herein designated VGAM RNA, also designated SEQ ID:3621.

Another function of VGAM910 is therefore inhibition of FLJ13263 (Accession NM_025125). Accordingly, utilities of VGAM910 include diagnosis, prevention and treatment of diseases and clinical conditions associated with FLJ13263. IMPACT (Accession NM_018439) is another VGAM910 host target gene. IMPACT BINDING SITE is HOST TARGET binding site found in the 3' untranslated region of mRNA encoded by IMPACT, corresponding to a HOST TARGET binding site such as BINDING SITE I, BINDING SITE II or BINDING SITE III. Table 2 illustrates the complementarity of the nucleotide sequences of IMPACT BINDING SITE, designated SEQ ID:20503, to the nucleotide sequence of VGAM910 RNA, herein designated VGAM RNA, also designated SEQ ID:3621.

Another function of VGAM910 is therefore inhibition of IMPACT (Accession NM_018439). Accordingly, utilities of VGAM910 include diagnosis, prevention and treatment of diseases and clinical conditions associated with IMPACT. KIAA1157 (Accession XM_051093) is another VGAM910 host target gene. KIAA1157 BINDING SITE is HOST TARGET binding site found in the 3' untranslated region of mRNA encoded by KIAA1157, corresponding to a HOST TARGET binding site such as BINDING SITE I, BINDING SITE II or BINDING SITE III. Table 2 illustrates the complementarity of the nucleotide sequences of KIAA1157 BINDING SITE, designated SEQ ID:35750, to the nucleotide sequence of VGAM910 RNA, herein designated VGAM RNA, also designated SEQ ID:3621.

Another function of VGAM910 is therefore inhibition of KIAA1157 (Accession XM_051093). Accordingly, utilities of VGAM910 include diagnosis, prevention and treatment of diseases and cl KIAA1170 (Accession XM_045907) is another VGAM910 host target gene. KIAA1170 BINDING SITE is HOST TARGET binding site found in the 3' untranslated region of mRNA encoded by KIAA1170, corresponding to a HOST TARGET binding site such as BINDING SITE I, BINDING SITE II or BINDING SITE III. Table 2 illustrates the complementarity of the nucleotide sequences of KIAA1170 BINDING SITE, designated SEQ ID:34610, to the nucleotide sequence of VGAM910 RNA, herein designated VGAM RNA, also designated SEQ ID:3621.

Another function of VGAM910 is therefore inhibition of KIAA1170 (Accession XM_045907). Accordingly, utilities of VGAM910 include diagnosis, prevention and treatment of diseases and clinical conditions associated with KIAA1170. KIAA1276 (Accession XM_039169) is another VGAM910 host target gene. KIAA1276 BINDING SITE is HOST TARGET binding site found in the 5' untranslated region of mRNA encoded by KIAA1276, corresponding to a HOST TARGET binding site such as BINDING SITE I, BINDING SITE II or BINDING SITE III. Table 2 illustrates the complementarity of the nucleotide sequences of KIAA1276 BINDING SITE, designated SEQ ID:33018, to the nucleotide sequence of VGAM910 RNA, herein designated VGAM RNA, also designated SEQ ID:3621.

Another function of VGAM910 is therefore inhibition of KIAA1276 (Accession XM_039169). Accordingly, utilities of VGAM910 include diagnosis, prevention and treatment of diseases and clinical conditions associated with KIAA1276. KIAA1937 (Accession XM_057107) is another VGAM910 host target gene. KIAA1937 BINDING SITE is HOST TARGET binding site found in the 3' untranslated region of mRNA encoded by KIAA1937, corresponding to a HOST TARGET binding site such as BINDING SITE I, BINDING SITE II or BINDING SITE III. Table 2 illustrates the complementarity of the nucleotide sequences of KIAA1937 BINDING SITE, designated SEQ ID:36484, to the nucleotide sequence of VGAM910 RNA, herein designated VGAM RNA, also designated SEQ ID:3621.

Another function of VGAM910 is therefore inhibition of KIAA1937 (Accession XM_057107). Accordingly, utilities of VGAM910 include diagnosis, prevention and treatment of diseases and clinical conditions associated with KIAA1937. LCE (Accession NM_024090) is another VGAM910 host target gene. LCE BINDING SITE is HOST TARGET binding site found in the 3" untranslated region of mRNA encoded by LCE, corresponding to a HOST TARGET binding site such as BINDING SITE I, BINDING SITE II or BINDING SITE III. Table 2 illustrates the complementarity of the nucleotide sequences of LCE BINDING SITE, designated SEQ ID:23534, to the nucleotide sequence of VGAM910 RNA, herein designated VGAM RNA, also designated SEQ ID:3621.

Another function of VGAM910 is therefore inhibition of LCE (Accession NM_024090). Accordingly, utilities of VGAM910 include diagnosis, prevention and treatment of diseases and clinical conditions associated with LCE. MAD4 (Accession NM_006454) is another VGAM910 host target gene. MAD4 BINDING SITE is HOST TARGET binding site found in the 3' untranslated region of mRNA encoded by MAD4, corresponding to a HOST TARGET binding site such as BINDING SITE I, BINDING SITE II or BINDING SITE III. Table 2 illustrates the complementarity of the nucleotide sequences of MAD4 BINDING SITE, designated SEQ ID:13168, to the nucleotide sequence of VGAM910 RNA, herein designated VGAM RNA, also designated SEQ ID:3621.

Another function of VGAM910 is therefore inhibition of MAD4 (Accession NM_006454). Accordingly, utilities of VGAM910 include diagnosis, prevention and treatment of diseases and clinical conditions associated with MAD4. RAS Guanyl Releasing Protein 4 (RASGRP4, Accession NM_052949) is another VGAM910 host target gene. RASGRP4 BINDING SITE is HOST TARGET binding site found in the 3' untranslated region of mRNA encoded by RASGRP4, corresponding to a HOST TARGET binding site such as BINDING SITE I, BINDING SITE II or BINDING SITE III. Table 2 illustrates the complementarity of the nucleotide sequences of RASGRP4 BINDING SITE, designated SEQ ID:27503, to the nucleotide sequence of VGAM910 RNA, herein designated VGAM RNA, also designated SEQ ID:3621.

Another function of VGAM910 is therefore inhibition of RAS Guanyl Releasing Protein 4 (RASGRP4, Accession NM_052949). Accordingly, utilities of VGAM910 include diagnosis, prevention and treatment of diseases and clinical conditions associated with RASGRP4. LOC127262 (Accession XM_072073) is another VGAM910 host target gene. LOC127262 BINDING SITE is HOST TARGET binding site found in the 3' untranslated region of mRNA encoded by LOC127262, corresponding to a HOST TARGET binding site such as BINDING SITE I, BINDING SITE II or BINDING SITE III. Table 2 illustrates the complementarity of the nucleotide sequences of LOC127262 BINDING SITE, designated SEQ ID:37458, to the nucleotide sequence of VGAM910 RNA, herein designated VGAM RNA, also designated SEQ ID:3621.

Another function of VGAM910 is therefore inhibition of LOC127262 (Accession XM_072073). Accordingly, utilities of VGAM910 include diagnosis, prevention and treatment of diseases and clinical conditions associated with LOC127262. LOC137075 (Accession XM_059895) is another VGAM910 host target gene. LOC137075 BINDING SITE is HOST TARGET binding site found in the 3' untranslated region of mRNA encoded by LOC137075, corresponding to a HOST TARGET binding site such as BINDING SITE I, BINDING SITE II or BINDING SITE III. Table 2 illustrates the complementarity of the nucleotide sequences of LOC137075 BINDING SITE, designated SEQ ID:37103, to the nucleotide sequence of VGAM910 RNA, herein designated VGAM RNA, also designated SEQ ID:3621.

Another function of VGAM910 is therefore inhibition of LOC137075 (Accession XM_059895). Accordingly, utilities of VGAM910 include diagnosis, prevention and treatment of diseases and clinical conditions associated with LOC137075. LOC153688 (Accession XM_098416) is another VGAM910 host target gene. LOC153688 BINDING SITE is HOST TARGET binding site found in the 3' untranslated region of mRNA encoded by LOC153688, corresponding to a HOST TARGET binding site such as BINDING SITE I, BINDING SITE II or BINDING SITE III. Table 2 illustrates the complementarity of the nucleotide sequences of LOC153688 BINDING SITE, designated SEQ ID:41655, to the nucleotide sequence of VGAM910 RNA, herein designated VGAM RNA, also designated SEQ ID:3621.

Another function of VGAM910 is therefore inhibition of LOC153688 (Accession XM_098416). Accordingly, utilities of VGAM910 include diagnosis, prevention and treatment of diseases and clinical conditions associated with LOC153688. LOC158972 (Accession XM_099009) is another VGAM910 host target gene. LOC158972 BINDING SITE is HOST TARGET binding site found in the 3' untranslated region of mRNA encoded by LOC158972, corresponding to a HOST TARGET binding site such as BINDING SITE I, BINDING SITE II or BINDING SITE III. Table 2 illustrates the complementarity of the nucleotide sequences of LOC158972 BINDING SITE, designated SEQ ID:42042, to the nucleotide sequence of VGAM910 RNA, herein designated VGAM RNA, also designated SEQ ID:3621.

Another function of VGAM910 is therefore inhibition of LOC158972 (Accession XM_099009). Accordingly, utilities of VGAM910 include diagnosis, prevention and treatment of diseases and clinical conditions associated with LOC158972. LOC196540 (Accession XM_116933) is another VGAM910 host target gene. LOC196540 BINDING SITE is HOST TARGET binding site found in the 3' untranslated region of mRNA encoded by LOC196540, corresponding to a HOST TARGET binding site such as BINDING SITE I, BINDING SITE II or BINDING SITE III. Table 2 illustrates the complementarity of the nucleotide sequences of LOC196540 BINDING SITE, designated SEQ ID:43151, to the nucleotide sequence of VGAM910 RNA, herein designated VGAM RNA, also designated SEQ ID:3621.

Another function of VGAM910 is therefore inhibition of LOC196540 (Accession XM_116933). Accordingly, utilities of VGAM910 include diagnosis, prevention and treatment of diseases and clinical conditions associated with LOC196540. LOC221832 (Accession XM_166496) is another VGAM910 host target gene. LOC221832 BINDING SITE is HOST TARGET binding site found in the 5' untranslated region of mRNA encoded by LOC221832, corresponding to a HOST TARGET binding site such as BINDING SITE I, BINDING SITE II or BINDING SITE III. Table 2 illustrates the complementarity of the nucleotide sequences of LOC221832 BINDING SITE, designated SEQ ID:44426, to the nucleotide sequence of VGAM910 RNA, herein designated VGAM RNA, also designated SEQ ID:3621.

Another function of VGAM910 is therefore inhibition of LOC221832 (Accession XM_166496). Accordingly, utilities of VGAM910 include diagnosis, prevention and treatment of diseases and clinical conditions associated with LOC221832. LOC255465 (Accession XM_173206) is another VGAM910 host target gene. LOC255465 BINDING SITE is HOST TARGET binding site found in the 5' untranslated region of mRNA encoded by LOC255465, corresponding to a HOST TARGET binding site such as BINDING SITE I, BINDING SITE II or BINDING SITE III. Table 2 illustrates the complementarity of the nucleotide sequences of LOC255465 BINDING SITE, designated SEQ ID:46453, to the nucleotide sequence of VGAM910 RNA, herein designated VGAM RNA, also designated SEQ ID:3621.

Another function of VGAM910 is therefore inhibition of LOC255465 (Accession XM_173206). Accordingly, utilities of VGAM910 include diagnosis, prevention and treatment of diseases and clinical conditions associated with LOC255465. LOC57109 (Accession NM_020385) is another VGAM910 host target gene. LOC57109 BINDING SITE is HOST TARGET binding site found in the 3' untranslated region of mRNA encoded by LOC57109, corresponding to a HOST TARGET binding site such as BINDING SITE I, BINDING SITE II or BINDING SITE III. Table 2 illustrates the complementarity of the nucleotide sequences of LOC57109 BINDING SITE, designated SEQ ID:21655, to the nucleotide sequence of VGAM910 RNA, herein designated VGAM RNA, also designated SEQ ID:3621.

Another function of VGAM910 is therefore inhibition of LOC57109 (Accession NM_020385). Accordingly, utilities of VGAM910 include diagnosis, prevention and treatment of diseases and clinical conditions associated with LOC57109. LOC90538 (Accession XM_032401) is another VGAM910 host target gene. LOC90538 BINDING SITE is HOST TARGET binding site found in the 3' untranslated region of mRNA encoded by LOC90538, corresponding to a HOST TARGET binding site such as BINDING SITE I, BINDING SITE II or BINDING SITE III. Table 2 illustrates the complementarity of the nucleotide sequences of LOC90538 BINDING SITE, designated SEQ ID:31656, to the nucleotide sequence of VGAM910 RNA, herein designated VGAM RNA, also designated SEQ ID:3621.

Another function of VGAM910 is therefore inhibition of LOC90538 (Accession XM_032401). Accordingly, utilities of VGAM910 include diagnosis, prevention and treatment of diseases and clinical conditions associated with LOC90538. FIG. 1 further provides a conceptual description of a novel bioinformatically detected viral gene of the present invention, referred to here as Viral Genomic Address Messenger 911 (VGAM911) viral gene, which modulates expression of respective host target genes thereof, the function and utility of which host target genes is known in the art.

VGAM911 is a novel bioinformatically detected regulatory, non protein coding, viral micro RNA (miRNA) gene. The method by which VGAM911 was detected is described hereinabove with reference to FIGS. 1-8.

VGAM911 gene, herein designated VGAM GENE, is a viral gene contained in the genome of Human Herpesvirus 8. VGAM911 host target gene, herein designated VGAM HOST TARGET GENE, is a human gene contained in the human genome.

VGAM911 gene encodes a VGAM911 precursor RNA, herein designated VGAM PRECURSOR RNA. Similar to other miRNA genes, and unlike most ordinary genes, VGAM911 precursor RNA does not encode a protein. A nucleotide sequence identical or highly similar to the nucleotide sequence of VGAM911 precursor RNA is designated SEQ ID:897, and is provided hereinbelow with reference to the sequence listing part. Nucleotide sequence SEQ ID:897 is located at position 56711 relative to the genome of Human Herpesvirus 8.

VGAM911 precursor RNA folds onto itself, forming VGAM911 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM911 folded precursor RNA into VGAM911 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM911 RNA is designated SEQ ID:3622, and is provided hereinbelow with reference to the sequence listing part.

VGAM911 host target gene, herein designated VGAM HOST TARGET GENE, encodes a corresponding messenger RNA, VGAM911 host target RNA, herein designated VGAM HOST TARGET RNA. VGAM911 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM911 RNA, herein designated VGAM RNA, binds complementarily to one or more host target binding sites located in untranslated regions of VGAM911 host target RNA, herein designated VGAM HOST TARGET RNA. This complementary binding is due to the fact that the nucleotide sequence of VGAM911 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM911 RNA, herein designated VGAM RNA, may have a different number of host target binding sites in untranslated regions of a VGAM911 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM911 RNA, herein designated VGAM RNA, to host target binding sites on VGAM911 host target RNA, herein designated VGAM HOST TARGET RNA, such as BINDING SITE I, BINDING SITE II and BINDING SITE III, inhibits translation of VGAM911 host target RNA into VGAM911 host target protein, herein designated VGAM HOST TARGET PROTEIN. VGAM host target protein is therefore outlined by a broken line.

It is appreciated that VGAM911 host target gene, herein designated VGAM HOST TARGET GENE, in fact represents a plurality of VGAM911 host target genes. The mRNA of each one of this plurality of VGAM911 host target genes comprises one or more host target binding sites, each having a nucleotide sequence which is at least partly complementary to VGAM911 RNA, herein designated VGAM RNA, and which when bound by VGAM911 RNA causes inhibition of translation of respective one or more VGAM911 host target proteins.

It is further appreciated by one skilled in the art that the mode of translational inhibition illustrated by FIG. 1 with specific reference to translational inhibition exerted by VGAM911 gene, herein designated VGAM GENE, on one or more VGAM911 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM911 is inhibition of expression of host target genes, as part of a novel viral mechanism of attacking a host. Accordingly, utilities of VGAM911 include diagnosis, prevention and treatment of viral infection by Human Herpesvirus 8. Specific functions, and accordingly utilities, of VGAM911 correlate with, and may be deduced from, the identity of the host target genes which VGAM911 binds and inhibits, and the function of these host target genes, as elaborated hereinbelow.

Nucleotide sequences of the VGAM911 precursor RNA, herein designated VGAM PRECURSOR RNA, and of the 'diced' VGAM911 RNA, herein designated VGAM RNA, and a schematic representation of the secondary folding of VGAM911 folded precursor RNA, herein designated VGAM FOLDED PRECURSOR RNA, of VGAM911 are further described hereinbelow with reference to Table 1.

Nucleotide sequences of host target binding sites, such as BINDING SITE-I, BINDING SITE-II and BINDING SITE-III of FIG. 1, found on VGAM911 host target RNA, and schematic representation of the complementarity of each of these host target binding sites to VGAM911 RNA, herein designated VGAM RNA, are described hereinbelow with reference to Table 2.

As mentioned hereinabove with reference to FIG. 1, a function of VGAM911 gene, herein designated VGAM is inhibition of expression of VGAM911 target genes. It is appreciated that specific functions, and accordingly utilities, of VGAM911 correlate with, and may be deduced from, the identity of the target genes which VGAM911 binds and inhibits, and the function of these target genes, as elaborated hereinbelow.

Cadherin 1, Type 1, E-cadherin (epithelial) (CDH1, Accession NM_004360) is a VGAM911 host target gene. CDH1 BINDING SITE is HOST TARGET binding site found in the 3' untranslated region of mRNA encoded by CDH1, corresponding to a HOST TARGET binding site such as BINDING SITE I, BINDING SITE II or BINDING SITE III. Table 2 illustrates the complementarity of the nucleotide sequences of CDH1 BINDING SITE, designated SEQ ID:10562, to the nucleotide sequence of VGAM911 RNA, herein designated VGAM RNA, also designated SEQ ID:3622.

A function of VGAM911 is therefore inhibition of Cadherin 1, Type 1, E-cadherin (epithelial) (CDH1, Accession NM_004360). Accordingly, utilities of VGAM911 include diagnosis, prevention and treatment of diseases and clinical conditions associated with CDH1. N-myc Downstream Regulated Gene 1 (NDRG1, Accession XM_005243) is another VGAM911 host target gene. NDRG1 BINDING SITE is HOST TARGET binding site found in the 3' untranslated region of mRNA encoded by NDRG1, corresponding to a HOST TARGET binding site such as BINDING SITE I, BINDING SITE II or BINDING SITE III. Table 2 illustrates the complementarity of the nucleotide sequences of NDRG1 BINDING SITE, designated SEQ ID:29967, to the nucleotide sequence of VGAM911 RNA, herein designated VGAM RNA, also designated SEQ ID:3622.

Another function of VGAM911 is therefore inhibition of N-myc Downstream Regulated Gene 1 (NDRG1, Accession XM_005243), a gene which may have a growth inhibitory role. Accordingly, utilities of VGAM911 include diagnosis, prevention and treatment of diseases and clinical conditions associated with NDRG1. The function of NDRG1 and its association with various diseases and clinical conditions, has been established by previous studies, as described hereinabove with reference to VGAM144. Syntrophin, Beta 1 (dystrophin-associated protein A1, 59 kDa, basic component 1) (SNTB1, Accession NM_021021) is another VGAM911 host target gene. SNTB1 BINDING SITE is HOST TARGET binding site found in the 5' untranslated region of mRNA encoded by SNTB1, corresponding to a HOST TARGET binding site such as BINDING SITE I, BINDING SITE II or BINDING SITE III. Table 2 illustrates the complementarity of the nucleotide sequences of SNTB1 BINDING SITE, designated SEQ ID:22012, to the nucleotide sequence of VGAM911 RNA, herein designated VGAM RNA, also designated SEQ ID:3622.

Another function of VGAM911 is therefore inhibition of Syntrophin, Beta 1 (dystrophin-associated protein A1, 59 kDa, basic component 1) (SNTB1, Accession NM_021021). Accordingly, utilities of VGAM911 include diagnosis, prevention and treatment of diseases and clinical conditions associated with SNTB1. Zinc Finger Protein 138 (clone pHZ-32) (ZNF138, Accession XM_088081) is another VGAM911 host target gene. ZNF138 BINDING SITE is HOST TARGET binding site found in the 5' untranslated region of mRNA encoded by ZNF138, corresponding to a HOST TARGET binding site such as BINDING SITE I, BINDING SITE II or BINDING SITE III. Table 2 illustrates the complementarity of the nucleotide sequences of ZNF138 BINDING SITE, designated SEQ ID:39508, to the nucleotide sequence of VGAM911 RNA, herein designated VGAM RNA, also designated SEQ ID:3622.

Another function of VGAM911 is therefore inhibition of Zinc Finger Protein 138 (clone pHZ-32) (ZNF138, Accession XM_088081). Accordingly, utilities of VGAM911 include diagnosis, prevention and treatment of diseases and clinical conditions associated with ZNF138. AOP2 (Accession NM_004905) is another VGAM911 host target gene. AOP2 BINDING SITE is HOST TARGET binding site found in the 3' untranslated region of mRNA encoded by AOP2, corresponding to a HOST TARGET binding site such as BINDING SITE I, BINDING SITE II or BINDING SITE III. Table 2 illustrates the complementarity of the nucleotide sequences of AOP2 BINDING SITE, designated SEQ ID:11341, to the nucleotide sequence of VGAM911 RNA, herein designated VGAM RNA, also designated SEQ ID:3622.

Another function of VGAM911 is therefore inhibition of AOP2 (Accession NM_004905). Accordingly, utilities of VGAM911 include diagnosis, prevention and treatment of diseases and clinical conditions associated with AOP2. BCL2-like 12 (proline rich) (BCL2L12, Accession NM_138639) is another VGAM911 host target gene. BCL2L12 BINDING SITE is HOST TARGET binding site found in the 5' untranslated region of mRNA encoded by BCL2L12, corresponding to a HOST TARGET binding site such as BINDING SITE I, BINDING SITE II or BINDING SITE III. Table 2 illustrates the complementarity of the nucleotide sequences of BCL2L12 BINDING SITE, designated SEQ ID:28915, to the nucleotide sequence of VGAM911 RNA, herein designated VGAM RNA, also designated SEQ ID:3622.

Another function of VGAM911 is therefore inhibition of BCL2-like 12 (proline rich) (BCL2L12, Accession NM_138639). Accordingly, utilities of VGAM911 include diagnosis, prevention and treatment of diseases and clinical conditions associated with BCL2L12. FLJ14129 (Accession NM_030895) is another VGAM911 host target gene. FLJ14129 BINDING SITE is HOST TARGET binding site found in the 3' untranslated region of mRNA encoded by FLJ14129, corresponding to a HOST TARGET binding site such as BINDING SITE I, BINDING SITE II or BINDING SITE III. Table 2 illustrates the complementarity of the nucleotide sequences of FLJ14129 BINDING SITE, designated SEQ ID:25164, to the nucleotide sequence of VGAM911 RNA, herein designated VGAM RNA, also designated SEQ ID:3622.

Another function of VGAM911 is therefore inhibition of FLJ14129 (Accession NM_030895). Accordingly, utilities of VGAM911 include diagnosis, prevention and treatment of diseases and clinical conditions associated with FLJ14129. HSPC043 (Accession XM_041943) is another VGAM911 host target gene. HSPC043 BINDING SITE is HOST TARGET binding site found in the 3' untranslated region of mRNA encoded by HSPC043, corresponding to a HOST TARGET binding site such as BINDING SITE I, BINDING SITE II or BINDING SITE III. Table 2 illustrates the complementarity of the nucleotide sequences of HSPC043 BINDING SITE, designated SEQ ID:33637, to the nucleotide sequence of VGAM911 RNA, herein designated VGAM RNA, also designated SEQ ID:3622.

Another function of VGAM911 is therefore inhibition of HSPC043 (Accession XM_041943). Accordingly, utilities of VGAM911 include diagnosis, prevention and treatment of diseases and clinical conditions associated with HSPC043. LOC199796 (Accession XM_058994) is another VGAM911 host target gene. LOC199796 BINDING SITE is HOST TARGET binding site found in the 5' untranslated region of mRNA encoded by LOC199796, corresponding to a HOST TARGET binding site such as BINDING SITE I, BINDING SITE II or BINDING SITE III. Table 2 illustrates the complementarity of the nucleotide sequences of LOC199796 BINDING SITE, designated SEQ ID:36810, to the nucleotide sequence of VGAM911 RNA, herein designated VGAM RNA, also designated SEQ ID:3622.

Another function of VGAM911 is therefore inhibition of LOC199796 (Accession XM_058994). Accordingly, utilities of VGAM911 include diagnosis, prevention and treatment of diseases and clinical conditions associated with LOC199796. FIG. 1 further provides a conceptual description of a novel bioinformatically detected viral gene of the present invention, referred to here as Viral Genomic Address Messenger 912 (VGAM912) viral gene, which modulates expression of respective host target genes thereof, the function and utility of which host target genes is known in the art.

VGAM912 is a novel bioinformatically detected regulatory, non protein coding, viral micro RNA (miRNA) gene. The method by which VGAM912 was detected is described hereinabove with reference to FIGS. 1-8.

VGAM912 gene, herein designated VGAM GENE, is a viral gene contained in the genome of Human Herpesvirus 8. VGAM912 host target gene, herein designated VGAM HOST TARGET GENE, is a human gene contained in the human genome.

VGAM912 gene encodes a VGAM912 precursor RNA, herein designated VGAM PRECURSOR RNA. Similar to other miRNA genes, and unlike most ordinary genes, VGAM912 precursor RNA does not encode a protein. A nucleotide sequence identical or highly similar to the nucleotide sequence of VGAM912 precursor RNA is designated SEQ ID:898, and is provided hereinbelow with reference to the sequence listing part. Nucleotide sequence SEQ ID:898 is located at position 58652 relative to the genome of Human Herpesvirus 8.

VGAM912 precursor RNA folds onto itself, forming VGAM912 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM912 folded precursor RNA into VGAM912 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM912 RNA is designated SEQ ID:3623, and is provided hereinbelow with reference to the sequence listing part.

VGAM912 host target gene, herein designated VGAM HOST TARGET GENE, encodes a corresponding messenger RNA, VGAM912 host target RNA, herein designated VGAM HOST TARGET RNA. VGAM912 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM912 RNA, herein designated VGAM RNA, binds complementarily to one or more host target binding sites located in untranslated regions of VGAM912 host target RNA, herein designated VGAM HOST TARGET RNA. This complementary binding is due to the fact that the nucleotide sequence of VGAM912 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM912 RNA, herein designated VGAM RNA, may have a different number of host target binding sites in untranslated regions of a VGAM912 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM912 RNA, herein designated VGAM RNA, to host target binding sites on VGAM912 host target RNA, herein designated VGAM HOST TARGET RNA, such as BINDING SITE I, BINDING SITE II and BINDING SITE III, inhibits translation of VGAM912 host target RNA into VGAM912 host target protein, herein designated VGAM HOST TARGET PROTEIN. VGAM host target protein is therefore outlined by a broken line.

It is appreciated that VGAM912 host target gene, herein designated VGAM HOST TARGET GENE, in fact represents a plurality of VGAM912 host target genes. The mRNA of each one of this plurality of VGAM912 host target genes comprises one or more host target binding sites, each having a nucleotide sequence which is at least partly complementary to VGAM912 RNA, herein designated VGAM RNA, and which when bound by VGAM912 RNA causes inhibition of translation of respective one or more VGAM912 host target proteins.

It is further appreciated by one skilled in the art that the mode of translational inhibition illustrated by FIG. 1 with specific reference to translational inhibition exerted by VGAM912 gene, herein designated VGAM GENE, on one or more VGAM912 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM912 is inhibition of expression of host target genes, as part of a novel viral mechanism of attacking a host. Accordingly, utilities of VGAM912 include diagnosis, prevention and treatment of viral infection by Human Herpesvirus 8. Specific functions, and accordingly utilities, of VGAM912 correlate with, and may be deduced from, the identity of the host target genes which VGAM912 binds and inhibits, and the function of these host target genes, as elaborated hereinbelow.

Nucleotide sequences of the VGAM912 precursor RNA, herein designated VGAM PRECURSOR RNA, and of the 'diced' VGAM912 RNA, herein designated VGAM RNA, and a schematic representation of the secondary folding of VGAM912 folded precursor RNA, herein designated VGAM FOLDED PRECURSOR RNA, of VGAM912 are further described hereinbelow with reference to Table 1.

Nucleotide sequences of host target binding sites, such as BINDING SITE-I, BINDING SITE-II and BINDING SITE-III of FIG. 1, found on VGAM912 host target RNA, and schematic representation of the complementarity of each of these host target binding sites to VGAM912 RNA, herein designated VGAM RNA, are described hereinbelow with reference to Table 2.

As mentioned hereinabove with reference to FIG. 1, a function of VGAM912 gene, herein designated VGAM is inhibition of expression of VGAM912 target genes. It is appreciated that specific functions, and accordingly utilities, of VGAM912 correlate with, and may be deduced from, the identity of the target genes which VGAM912 binds and inhibits, and the function of these target genes, as elaborated hereinbelow.

Matrix Metalloproteinase 8 (neutrophil collagenase) (MMP8, Accession NM_002424) is a VGAM912 host target gene. MMP8 BINDING SITE is HOST TARGET binding site found in the 3' untranslated region of mRNA encoded by MMP8, corresponding to a HOST TARGET binding site such as BINDING SITE I, BINDING SITE II or BINDING SITE III. Table 2 illustrates the complementarity of the nucleotide sequences of MMP8 BINDING SITE, designated SEQ ID:8258, to the nucleotide sequence of VGAM912 RNA, herein designated VGAM RNA, also designated SEQ ID:3623.

A function of VGAM912 is therefore inhibition of Matrix Metalloproteinase 8 (neutrophil collagenase) (MMP8, Accession NM_002424). Accordingly, utilities of VGAM912 include diagnosis, prevention and treatment of diseases and clinical conditions associated with MMP8. KIAA1024 (Accession XM_044580) is another VGAM912 host target gene. KIAA1024 BINDING SITE is HOST TARGET binding site found in the 3' untranslated region of mRNA encoded by KIAA1024, corresponding to a HOST TARGET binding site such as BINDING SITE I, BINDING SITE II or BINDING SITE III. Table 2 illustrates the complementarity of the nucleotide sequences of KIAA1024 BINDING SITE, designated SEQ ID:34235, to the nucleotide sequence of VGAM912 RNA, herein designated VGAM RNA, also designated SEQ ID:3623.

Another function of VGAM912 is therefore inhibition of KIAA1024 (Accession XM_044580). Accordingly, utilities of VGAM912 include diagnosis, prevention and treatment of diseases and clinical conditions associated with KIAA1024. LOC145820 (Accession XM_085246) is another VGAM912 host target gene. LOC145820 BINDING SITE is HOST TARGET binding site found in the 3' untranslated region of mRNA encoded by LOC145820, corresponding to a HOST TARGET binding site such as BINDING SITE I, BINDING SITE II or BINDING SITE III. Table 2 illustrates the complementarity of the nucleotide sequences of LOC145820 BINDING SITE, designated SEQ ID:37992, to the nucleotide sequence of VGAM912 RNA, herein designated VGAM RNA, also designated SEQ ID:3623.

Another function of VGAM912 is therefore inhibition of LOC145820 (Accession XM_085246). Accordingly, utilities of VGAM912 include diagnosis, prevention and treatment of diseases and clinical conditions associated with LOC145820.

LOC151248 (Accession XM_087143) is another VGAM912 host target gene. LOC151248 BINDING SITE is HOST TARGET binding site found in the 5' untranslated region of mRNA encoded by LOC151248, corresponding to a HOST TARGET binding site such as BINDING SITE I, BINDING SITE II or BINDING SITE III. Table 2 illustrates the complementarity of the nucleotide sequences of LOC151248 BINDING SITE, designated SEQ ID:39087, to the nucleotide sequence of VGAM912 RNA, herein designated VGAM RNA, also designated SEQ ID:3623.

Another function of VGAM912 is therefore inhibition of LOC151248 (Accession XM_087143). Accordingly, utilities of VGAM912 include diagnosis, prevention and treatment of diseases and clinical conditions associated with LOC151248. LOC54550 (Accession XM_085348) is another VGAM912 host target gene. LOC54550 BINDING SITE is HOST TARGET binding site found in the 5' untranslated region of mRNA encoded by LOC54550, corresponding to a HOST TARGET binding site such as BINDING SITE I, BINDING SITE II or BINDING SITE III. Table 2 illustrates the complementarity of the nucleotide sequences of LOC54550 BINDING SITE, designated SEQ ID:38076, to the nucleotide sequence of VGAM912 RNA, herein designated VGAM RNA, also designated SEQ ID:3623.

Another function of VGAM912 is therefore inhibition of LOC54550 (Accession XM_085348). Accordingly, utilities of VGAM912 include diagnosis, prevention and treatment of diseases and clinical conditions associated with LOC54550. LOC92539 (Accession XM_045632) is another VGAM912 host target gene. LOC92539 BINDING SITE is HOST TARGET binding site found in the 5' untranslated region of mRNA encoded by LOC92539, corresponding to a HOST TARGET binding site such as BINDING SITE I, BINDING SITE II or BINDING SITE III. Table 2 illustrates the complementarity of the nucleotide sequences of LOC92539 BINDING SITE, designated SEQ ID:34502, to the nucleotide sequence of VGAM912 RNA, herein designated VGAM RNA, also designated SEQ ID:3623.

Another function of VGAM912 is therefore inhibition of LOC92539 (Accession XM_045632). Accordingly, utilities of VGAM912 include diagnosis, prevention and treatment of diseases and clinical conditions associated with LOC92539. FIG. 1 further provides a conceptual description of a novel bioinformatically detected viral gene of the present invention, referred to here as Viral Genomic Address Messenger 913 (VGAM913) viral gene, which modulates expression of respective host target genes thereof, the function and utility of which host target genes is known in the art.

VGAM913 is a novel bioinformatically detected regulatory, non protein coding, viral micro RNA (miRNA) gene. The method by which VGAM913 was detected is described hereinabove with reference to FIGS. 1-8.

VGAM913 gene, herein designated VGAM GENE, is a viral gene contained in the genome of Pothos Latent Virus. VGAM913 host target gene, herein designated VGAM HOST TARGET GENE, is a human gene contained in the human genome.

VGAM913 gene encodes a VGAM913 precursor RNA, herein designated VGAM PRECURSOR RNA. Similar to other miRNA genes, and unlike most ordinary genes, VGAM913 precursor RNA does not encode a protein. A nucleotide sequence identical or highly similar to the nucleotide sequence of VGAM913 precursor RNA is designated SEQ ID:899, and is provided hereinbelow with reference to the sequence listing part. Nucleotide sequence SEQ ID:899 is located at position 2180 relative to the genome of Pothos Latent Virus.

VGAM913 precursor RNA folds onto itself, forming VGAM913 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM913 folded precursor RNA into VGAM913 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM913 RNA is designated SEQ ID:3624, and is provided hereinbelow with reference to the sequence listing part.

VGAM913 host target gene, herein designated VGAM HOST TARGET GENE, encodes a corresponding messenger RNA, VGAM913 host target RNA, herein designated VGAM HOST TARGET RNA. VGAM913 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM913 RNA, herein designated VGAM RNA, binds complementarily to one or more host target binding sites located in untranslated regions of VGAM913 host target RNA, herein designated VGAM HOST TARGET RNA. This complementary binding is due to the fact that the nucleotide sequence of VGAM913 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM913 RNA, herein designated VGAM RNA, may have a different number of host target binding sites in untranslated regions of a VGAM913 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM913 RNA, herein designated VGAM RNA, to host target binding sites on VGAM913 host target RNA, herein designated VGAM HOST TARGET RNA, such as BINDING SITE I, BINDING SITE II and BINDING SITE III, inhibits translation of VGAM913 host target RNA into VGAM913 host target protein, herein designated VGAM HOST TARGET PROTEIN. VGAM host target protein is therefore outlined by a broken line.

It is appreciated that VGAM913 host target gene, herein designated VGAM HOST TARGET GENE, in fact represents a plurality of VGAM913 host target genes. The mRNA of each one of this plurality of VGAM913 host target genes comprises one or more host target binding sites, each having a nucleotide sequence which is at least partly complementary to VGAM913 RNA, herein designated VGAM RNA, and which when bound by VGAM913 RNA causes inhibition of translation of respective one or more VGAM913 host target proteins.

It is further appreciated by one skilled in the art that the mode of translational inhibition illustrated by FIG. 1 with specific reference to translational inhibition exerted by VGAM913 gene, herein designated VGAM GENE, on one or more VGAM913 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM913 is inhibition of expression of host target genes, as part of a novel viral mechanism of attacking a host. Accordingly, utilities of VGAM913 include diagnosis, prevention and treatment of viral infection by Pothos Latent Virus. Specific functions, and accordingly utilities, of VGAM913 correlate with, and may be deduced from, the identity of the host target genes which VGAM913 binds and inhibits, and the function of these host target genes, as elaborated hereinbelow.

Nucleotide sequences of the VGAM913 precursor RNA, herein designated VGAM PRECURSOR RNA, and of the 'diced' VGAM913 RNA, herein designated VGAM RNA, and a schematic representation of the secondary folding of VGAM913 folded precursor RNA, herein designated VGAM FOLDED PRECURSOR RNA, of VGAM913 are further described hereinbelow with reference to Table 1.

Nucleotide sequences of host target binding sites, such as BINDING SITE-I, BINDING SITE-II and BINDING SITE-III of FIG. 1, found on VGAM913 host target RNA, and schematic representation of the complementarity of each of these host target binding sites to VGAM913 RNA, herein designated VGAM RNA, are described hereinbelow with reference to Table 2.

As mentioned hereinabove with reference to FIG. 1, a function of VGAM913 gene, herein designated VGAM is inhibition of expression of VGAM913 target genes. It is appreciated that specific functions, and accordingly utilities, of VGAM913 correlate with, and may be deduced from, the identity of the target genes which VGAM913 binds and inhibits, and the function of these target genes, as elaborated hereinbelow.

Catenin, Beta Interacting Protein 1 (CTNNBIP1, Accession NM_020248) is a VGAM913 host target gene. CTNNBIP1 BINDING SITE is HOST TARGET binding site found in the 3' untranslated region of mRNA encoded by CTNNBIP1, corresponding to a HOST TARGET binding site such as BINDING SITE I, BINDING SITE II or BINDING SITE III. Table 2 illustrates the complementarity of the nucleotide sequences of CTNNBIP1 BINDING SITE, designated SEQ ID:21547, to the nucleotide sequence of VGAM913 RNA, herein designated VGAM RNA, also designated SEQ ID:3624.

A function of VGAM913 is therefore inhibition of Catenin, Beta Interacting Protein 1 (CTNNBIP1, Accession NM_020248). Accordingly, utilities of VGAM913 include diagnosis, prevention and treatment of diseases and clinical conditions associated with CTNNBIP1. Histidyl-tRNA Synthetase 2 (HARS2, Accession NM_080820) is another VGAM913 host target gene. HARS2 BINDING SITE is HOST TARGET binding site found in the 3' untranslated region of mRNA encoded by HARS2, corresponding to a HOST TARGET binding site such as BINDING SITE I, BINDING SITE II or BINDING SITE III. Table 2 illustrates the complementarity of the nucleotide sequences of HARS2 BINDING SITE, designated SEQ ID:28078, to the nucleotide sequence of VGAM913 RNA, herein designated VGAM RNA, also designated SEQ ID:3624.

Another function of VGAM913 is therefore inhibition of Histidyl-tRNA Synthetase 2 (HARS2, Accession NM_080820). Accordingly, utilities of VGAM913 include diagnosis, prevention and treatment of diseases and clinical conditions associated with HARS2. LOC118738 (Accession XM_061125) is another VGAM913 host target gene. LOC118738 BINDING SITE is HOST TARGET binding site found in the 3' untranslated region of mRNA encoded by LOC118738, corresponding to a HOST TARGET binding site such as BINDING SITE I, BINDING SITE II or BINDING SITE III. Table 2 illustrates the complementarity of the nucleotide sequences of LOC118738 BINDING SITE, designated SEQ ID:37196, to the nucleotide sequence of VGAM913 RNA, herein designated VGAM RNA, also designated SEQ ID:3624.

Another function of VGAM913 is therefore inhibition of LOC118738 (Accession XM_061125). Accordingly, utilities of VGAM913 include diagnosis, prevention and treatment of diseases and clinical conditions associated with LOC118738. LOC164684 (Accession XM_092926) is another VGAM913 host target gene. LOC164684 BINDING SITE is HOST TARGET binding site found in the 3' untranslated region of mRNA encoded by LOC164684, corresponding to a HOST TARGET binding site such as BINDING SITE I, BINDING SITE II or BINDING SITE III. Table 2 illustrates the complementarity of the nucleotide sequences of LOC164684 BINDING SITE, designated SEQ ID:40159, to the nucleotide sequence of VGAM913 RNA, herein designated VGAM RNA, also designated SEQ ID:3624.

Another function of VGAM913 is therefore inhibition of LOC164684 (Accession XM_092926). Accordingly, utilities of VGAM913 include diagnosis, prevention and treatment of diseases and clinical conditions associated with LOC164684. LOC170425 (Accession XM_084330) is another VGAM913 host target gene. LOC170425 BINDING SITE is HOST TARGET binding site found in the 3' untranslated region of mRNA encoded by LOC170425, corresponding to a HOST TARGET binding site such as BINDING SITE I, BINDING SITE II or BINDING SITE III. Table 2 illustrates the complementarity of the nucleotide sequences of LOC170425 BINDING SITE, designated SEQ ID:37552, to the nucleotide sequence of VGAM913 RNA, herein designated VGAM RNA, also designated SEQ ID:3624.

Another function of VGAM913 is therefore inhibition of LOC170425 (Accession XM_084330). Accordingly, utilities of VGAM913 include diagnosis, prevention and treatment of diseases and clinical conditions associated with LOC170425. FIG. 1 further provides a conceptual description of a novel bioinformatically detected viral gene of the present invention, referred to here as Viral Genomic Address Messenger 914 (VGAM914) viral gene, which modulates expression of respective host target genes thereof, the function and utility of which host target genes is known in the art.

VGAM914 is a novel bioinformatically detected regulatory, non protein coding, viral micro RNA (miRNA) gene. The method by which VGAM914 was detected is described hereinabove with reference to FIGS. 1-8.

VGAM914 gene, herein designated VGAM GENE, is a viral gene contained in the genome of Pothos Latent Virus.

VGAM914 host target gene, herein designated VGAM HOST TARGET GENE, is a human gene contained in the human genome.

VGAM914 gene encodes a VGAM914 precursor RNA, herein designated VGAM PRECURSOR RNA. Similar to other miRNA genes, and unlike most ordinary genes, VGAM914 precursor RNA does not encode a protein. A nucleotide sequence identical or highly similar to the nucleotide sequence of VGAM914 precursor RNA is designated SEQ ID:900, and is provided hereinbelow with reference to the sequence listing part. Nucleotide sequence SEQ ID:900 is located at position 2846 relative to the genome of Pothos Latent Virus.

VGAM914 precursor RNA folds onto itself, forming VGAM914 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM914 folded precursor RNA into VGAM914 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM914 RNA is designated SEQ ID:3625, and is provided hereinbelow with reference to the sequence listing part.

VGAM914 host target gene, herein designated VGAM HOST TARGET GENE, encodes a corresponding messenger RNA, VGAM914 host target RNA, herein designated VGAM HOST TARGET RNA. VGAM914 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM914 RNA, herein designated VGAM RNA, binds complementarily to one or more host target binding sites located in untranslated regions of VGAM914 host target RNA, herein designated VGAM HOST TARGET RNA. This complementary binding is due to the fact that the nucleotide sequence of VGAM914 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM914 RNA, herein designated VGAM RNA, may have a different number of host target binding sites in untranslated regions of a VGAM914 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM914 RNA, herein designated VGAM RNA, to host target binding sites on VGAM914 host target RNA, herein designated VGAM HOST TARGET RNA, such as BINDING SITE I, BINDING SITE II and BINDING SITE III, inhibits translation of VGAM914 host target RNA into VGAM914 host target protein, herein designated VGAM HOST TARGET PROTEIN. VGAM host target protein is therefore outlined by a broken line.

It is appreciated that VGAM914 host target gene, herein designated VGAM HOST TARGET GENE, in fact represents a plurality of VGAM914 host target genes. The mRNA of each one of this plurality of VGAM914 host target genes comprises one or more host target binding sites, each having a nucleotide sequence which is at least partly complementary to VGAM914 RNA, herein designated VGAM RNA, and which when bound by VGAM914 RNA causes inhibition of translation of respective one or more VGAM914 host target proteins.

It is further appreciated by one skilled in the art that the mode of translational inhibition illustrated by FIG. 1 with specific reference to translational inhibition exerted by VGAM914 gene, herein designated VGAM GENE, on one or more VGAM914 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM914 is inhibition of expression of host target genes, as part of a novel viral mechanism of attacking a host. Accordingly, utilities of VGAM914 include diagnosis, prevention and treatment of viral infection by Pothos Latent Virus. Specific functions, and accordingly utilities, of VGAM914 correlate with, and may be deduced from, the identity of the host target genes which VGAM914 binds and inhibits, and the function of these host target genes, as elaborated hereinbelow.

Nucleotide sequences of the VGAM914 precursor RNA, herein designated VGAM PRECURSOR RNA, and of the 'diced' VGAM914 RNA, herein designated VGAM RNA, and a schematic representation of the secondary folding of VGAM914 folded precursor RNA, herein designated VGAM FOLDED PRECURSOR RNA, of VGAM914 are further described hereinbelow with reference to Table 1.

Nucleotide sequences of host target binding sites, such as BINDING SITE-I, BINDING SITE-II and BINDING SITE-III of FIG. 1, found on VGAM914 host target RNA, and schematic representation of the complementarity of each of these host target binding sites to VGAM914 RNA, herein designated VGAM RNA, are described hereinbelow with reference to Table 2.

As mentioned hereinabove with reference to FIG. 1, a function of VGAM914 gene, herein designated VGAM is inhibition of expression of VGAM914 target genes. It is appreciated that specific functions, and accordingly utilities, of VGAM914 correlate with, and may be deduced from, the identity of the target genes which VGAM914 binds and inhibits, and the function of these target genes, as elaborated hereinbelow.

Phosphoribosyl Pyrophosphate Synthetase-associated Protein 1 (PRPSAP1, Accession NM_002766) is a VGAM914 host target gene. PRPSAP1 BINDING SITE is HOST TARGET binding site found in the 3' untranslated region of mRNA encoded by PRPSAP1, corresponding to a HOST TARGET binding site such as BINDING SITE I, BINDING SITE II or BINDING SITE III. Table 2 illustrates the complementarity of the nucleotide sequences of PRPSAP1 BINDING SITE, designated SEQ ID:8660, to the nucleotide sequence of VGAM914 RNA, herein designated VGAM RNA, also designated SEQ ID:3625.

A function of VGAM914 is therefore inhibition of Phosphoribosyl Pyrophosphate Synthetase-associated Protein 1 (PRPSAP1, Accession NM_002766), a gene which catalyzes the formation of PRPP from ATP and ribose 5-phosphate. Accordingly, utilities of VGAM914 include diagnosis, prevention and treatment of diseases and clinical conditions associated with PRPSAP1. The function of PRPSAP1 has been established by previous studies. Phosphoribosylpyrophosphate (PRPP) synthetase catalyzes the formation of PRPP from ATP and ribose 5-phosphate. Ishizuka et al. (1996) noted that the rat liver enzyme exists as complex aggregates of 34-, 39-, and 41-kD components, with the 34-kD species being the catalytic subunit. The 34-kD subunit from rat liver is a mixture of 2 highly homologous isoforms, PRS I and PRS II. The PRS I and PRS II mRNAs are encoded by 2 distinct genes, designated Prps1 and Prps2. The human PRPS1 (OMIM Ref. No. 311850) and PRPS2 (OMIM Ref. No. 311860) genes are located in different regions of the X chromosome, Xq22-q24 and Xp22.3-p22.2, respectively. The 39- and 41-kD components of these enzymes are termed PRPP synthetase-associated proteins (PAPs). The human 41-kD component, PAP41, is encoded by the PRPSAP2 gene (OMIM Ref. No. 603762). Since Kita et al. (1994) showed that removal of the Paps from the rat liver enzyme complex led to an increase in enzyme activity of the remaining catalytic subunits, they proposed that Paps have a negative regulatory role in PRPP synthesis. Kita et al. (1994) cloned the cDNA for the 39-kD component (Pap39) from rat liver. The deduced amino acid sequence was remarkably similar to those of the 34-kD subunits. Using a PCR strategy with primers based on the sequence of the rat Pap39 protein, Ishizuka et al. (1996) cloned cDNAs encoding human PAP39. The deduced 356-amino acid human protein shares 98% identity with rat Pap39 and 44% identity with human PRS I and PRS II. Northern blot analysis revealed that PAP39 was expressed as a 2.2-kb mRNA in all human tissues tested. Ishizuka et al. (1996) mapped the human PRPSAP1 gene to 17q24-q25 by PCR analysis of somatic cell hybrids and by fluorescence in situ hybridization.

Full details of the abovementioned studies are described in the following publications, the disclosure of which are hereby incorporated by reference:

Ishizuka, T.; Ahmad, I.; Kita, K.; Sonoda, T.; Ishijima, S.; Sawa, K.; Suzuki, N.; Tatibana, M.: The human phosphoribosylpyrophosphate synthetase-associated protein 39 gene (PRPSAP1) is located in the chromosome region 17q24-q25. Genomics 33:332-334, 1996; and Ishizuka, T.; Kita, K.; Sonoda, T.; Ishijima, S.; Sawa, K.; Suzuki, N.; Tatibana, M.: Cloning and sequencing of human complementary DNA for the phosphoribosylpyrophosphate synthetase-as.

Further studies establishing the function and utilities of PRPSAP1 are found in John Hopkins OMIM database record ID 601249, and in sited publications numbered 9380-9382 listed in the bibliography section hereinbelow, which are also hereby incorporated by reference. RAP1B, Member of RAS Oncogene Family (RAP1B, Accession NM_015646) is another VGAM914 host target gene. RAP1B BINDING SITE is HOST TARGET binding site found in the 3' untranslated region of mRNA encoded by RAP1B, corresponding to a HOST TARGET binding site such as BINDING SITE I, BINDING SITE II or BINDING SITE III. Table 2 illustrates the complementarity of the nucleotide sequences of RAP1B BINDING SITE, designated SEQ ID:17897, to the nucleotide sequence of VGAM914 RNA, herein designated VGAM RNA, also designated SEQ ID:3625.

Another function of VGAM914 is therefore inhibition of RAP1B, Member of RAS Oncogene Family (RAP1B, Accession NM_015646), a gene which induces morphological reversion of a cell line transformed by a ras oncogene. Accordingly, utilities of VGAM914 include diagnosis, prevention and treatment of diseases and clinical conditions associated with RAP1B. The function of RAP1B has been established by previous studies. Three human cDNAs encoding 'new' RAS-related proteins, designated RAP1A, RAP1B, and RAP2, were isolated by Pizon et al. (1988). These proteins share approximately 50% amino acid identity with the classical RAS proteins and have numerous structural features in common. The most striking difference between the RAP and RAS proteins resides in their 61st amino acid: glutamine in RAS is replaced by threonine in RAP proteins. Animal model experiments lend further support to the function of RAP1B. Using mice transgenic for constitutive expression of Rap1a within the T cell lineage, Sebzda et al. (2002) found that instead of anergy, these T cells showed enhanced T cell receptor-mediated responses, both in thymocytes and in mature T cells. In addition, Rap1a activation induces strong activation of beta-1 (OMIM Ref. No. 135630) and beta-2 (OMIM Ref. No. 600065) integrins. The authors concluded that Rap1a positively influences T cells by augmenting their responses and directing integrin activation.

It is appreciated that the abovementioned animal model for RAP1B is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pizon, V.; Chardin, P.; Lerosey, I.; Olofsson, B.; Tavitian, A.: Human cDNAs RAP1 and RAP2 homologous to the Drosophila gene Dras3 encode proteins closely related to ras in the 'effector' region. Oncogene 3: 201-204, 1988; and Kitayama, H.; Sugimoto, Y.; Matsuzaki, T.; Ikawa, Y.; Noda, M.: A ras-related gene with transformation suppressor activity. Cell 56:77-84, 1989. PubMed ID:2642744 9. Sebzda, E.; Brac.

Further studies establishing the function and utilities of RAP1B are found in John Hopkins OMIM database record ID 179530, and in sited publications numbered listed in the bibliography section hereinbelow, which are also hereby incorporated by reference. KIAA0316 (Accession XM_045712) is another VGAM914 host target gene. KIAA0316 BINDING SITE is HOST TARGET binding site found in the 3' untranslated region of mRNA encoded by KIAA0316, corresponding to a HOST TARGET binding site such as BINDING SITE I, BINDING SITE II or BINDING SITE III. Table 2 illustrates the complementarity of the nucleotide sequences of KIAA0316 BINDING SITE, designated SEQ ID:34529, to the nucleotide sequence of VGAM914 RNA, herein designated VGAM RNA, also designated SEQ ID:3625.

Another function of VGAM914 is therefore inhibition of KIAA0316 (Accession XM_045712). Accordingly, utilities of VGAM914 include diagnosis, prevention and treatment of diseases and clinical conditions associated with KIAA0316. LOC149271 (Accession XM_086475) is another VGAM914 host target gene. LOC149271 BINDING SITE is HOST TARGET binding site found in the 3' untranslated region of mRNA encoded by LOC149271, corresponding to a HOST TARGET binding site such as BINDING SITE I, BINDING SITE II or BINDING SITE III. Table 2 illustrates the complementarity of the nucleotide sequences of LOC149271 BINDING SITE, designated SEQ ID:38681, to the nucleotide sequence of VGAM914 RNA, herein designated VGAM RNA, also designated SEQ ID:3625.

Another function of VGAM914 is therefore inhibition of LOC149271 (Accession XM_086475). Accordingly, utilities of VGAM914 include diagnosis, prevention and treatment of diseases and clinical conditions associated with LOC149271. LOC149372 (Accession XM_086509) is another VGAM914 host target gene. LOC149372 BINDING SITE is HOST TARGET binding site found in the 3' untranslated region of mRNA encoded by LOC149372, corresponding to a HOST TARGET binding site such as BINDING SITE I, BINDING SITE II or BINDING SITE III. Table 2 illustrates the complementarity of the nucleotide sequences of LOC149372 BINDING SITE, designated SEQ ID:38730, to the nucleotide sequence of VGAM914 RNA, herein designated VGAM RNA, also designated SEQ ID:3625.

Another function of VGAM914 is therefore inhibition of LOC149372 (Accession XM_086509). Accordingly, utilities of VGAM914 include diagnosis, prevention and treatment of diseases and clinical conditions associated with LOC149372. LOC150245 (Accession XM_097843) is another VGAM914 host target gene. LOC150245 BINDING SITE is HOST TARGET binding site found in the 5' untranslated region of mRNA encoded by LOC150245, corresponding to a HOST TARGET binding site such as BINDING SITE I, BINDING SITE II or BINDING SITE III. Table 2 illustrates the complementarity of the nucleotide sequences of LOC150245 BINDING SITE, designated SEQ ID:41160, to the nucleotide sequence of VGAM914 RNA, herein designated VGAM RNA, also designated SEQ ID:3625.

Another function of VGAM914 is therefore inhibition of LOC150245 (Accession XM_097843). Accordingly, utilities of VGAM914 include diagnosis, prevention and treatment of diseases and clinical conditions associated with LOC150245. LOC153416 (Accession XM_018473) is another VGAM914 host target gene. LOC153416 BINDING SITE is HOST TARGET binding site found in the 3' untranslated region of mRNA encoded by LOC153416, corresponding to a HOST TARGET binding site such as BINDING SITE I, BINDING SITE II or BINDING SITE III. Table 2 illustrates the complementarity of the nucleotide sequences of LOC153416 BINDING SITE, designated SEQ ID:30362, to the nucleotide sequence of VGAM914 RNA, herein designated VGAM RNA, also designated SEQ ID:3625.

Another function of VGAM914 is therefore inhibition of LOC153416 (Accession XM_018473). Accordingly, utilities of VGAM914 include diagnosis, prevention and treatment of diseases and clinical conditions associated with LOC153416. LOC196500 (Accession XM_113734) is another VGAM914 host target gene. LOC196500 BINDING SITE is HOST TARGET binding site found in the 3' untranslated region of mRNA encoded by LOC196500, corresponding to a HOST TARGET binding site such as BINDING SITE I, BINDING SITE II or BINDING SITE III. Table 2 illustrates the complementarity of the nucleotide sequences of LOC196500 BINDING SITE, designated SEQ ID:42385, to the nucleotide sequence of VGAM914 RNA, herein designated VGAM RNA, also designated SEQ ID:3625.

Another function of VGAM914 is therefore inhibition of LOC196500 (Accession XM_113734). Accordingly, utilities of VGAM914 include diagnosis, prevention and treatment of diseases and clinical conditions associated with LOC196500. LOC200317 (Accession XM_114208) is another VGAM914 host target gene. LOC200317 BINDING SITE is HOST TARGET binding site found in the 3' untranslated region of mRNA encoded by LOC200317, corresponding to a HOST TARGET binding site such as BINDING SITE I, BINDING SITE II or BINDING SITE III. Table 2 illustrates the complementarity of the nucleotide sequences of LOC200317 BINDING SITE, designated SEQ ID:42804, to the nucleotide sequence of VGAM914 RNA, herein designated VGAM RNA, also designated SEQ ID:3625.

Another function of VGAM914 is therefore inhibition of LOC200317 (Accession XM_114208). Accordingly, utilities of VGAM914 include diagnosis, prevention and treatment of diseases and clinical conditions associated with LOC200317.

FIG. 1 further provides a conceptual description of a novel bioinformatically detected viral gene of the present invention, referred to here as Viral Genomic Address Messenger 915 (VGAM915) viral gene, which modulates expression of respective host target genes thereof, the function and utility of which host target genes is known in the art.

VGAM915 is a novel bioinformatically detected regulatory, non protein coding, viral micro RNA (miRNA) gene. The method by which VGAM915 was detected is described hereinabove with reference to FIGS. 1-8.

VGAM915 gene, herein designated VGAM GENE, is a viral gene contained in the genome of Trichoplusia Ni Cytoplasmic Polyhedrosis Virus 15. VGAM915 host target gene, herein designated VGAM HOST TARGET GENE, is a human gene contained in the human genome.

VGAM915 gene encodes a VGAM915 precursor RNA, herein designated VGAM PRECURSOR RNA. Similar to other miRNA genes, and unlike most ordinary genes, VGAM915 precursor RNA does not encode a protein. A nucleotide sequence identical or highly similar to the nucleotide sequence of VGAM915 precursor RNA is designated SEQ ID:901, and is provided hereinbelow with reference to the sequence listing part. Nucleotide sequence SEQ ID:901 is located at position 1864 relative to the genome of Trichoplusia Ni Cytoplasmic Polyhedrosis Virus 15.

VGAM915 precursor RNA folds onto itself, forming VGAM915 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM915 folded precursor RNA into VGAM915 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM915 RNA is designated SEQ ID:3626, and is provided hereinbelow with reference to the sequence listing part.

VGAM915 host target gene, herein designated VGAM HOST TARGET GENE, encodes a corresponding messenger RNA, VGAM915 host target RNA, herein designated VGAM HOST TARGET RNA. VGAM915 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM915 RNA, herein designated VGAM RNA, binds complementarily to one or more host target binding sites located in untranslated regions of VGAM915 host target RNA, herein designated VGAM HOST TARGET RNA. This complementary binding is due to the fact that the nucleotide sequence of VGAM915 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM915 RNA, herein designated VGAM RNA, may have a different number of host target binding sites in untranslated regions of a VGAM915 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM915 RNA, herein designated VGAM RNA, to host target binding sites on VGAM915 host target RNA, herein designated VGAM HOST TARGET RNA, such as BINDING SITE I, BINDING SITE II and BINDING SITE III, inhibits translation of VGAM915 host target RNA into VGAM915 host target protein, herein designated VGAM HOST TARGET PROTEIN. VGAM host target protein is therefore outlined by a broken line.

It is appreciated that VGAM915 host target gene, herein designated VGAM HOST TARGET GENE, in fact represents a plurality of VGAM915 host target genes. The mRNA of each one of this plurality of VGAM915 host target genes comprises one or more host target binding sites, each having a nucleotide sequence which is at least partly complementary to VGAM915 RNA, herein designated VGAM RNA, and which when bound by VGAM915 RNA causes inhibition of translation of respective one or more VGAM915 host target proteins.

It is further appreciated by one skilled in the art that the mode of translational inhibition illustrated by FIG. 1 with specific reference to translational inhibition exerted by VGAM915 gene, herein designated VGAM GENE, on one or more VGAM915 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM915 is inhibition of expression of host target genes, as part of a novel viral mechanism of attacking a host. Accordingly, utilities of VGAM915 include diagnosis, prevention and treatment of viral infection by Trichoplusia Ni Cytoplasmic Polyhedrosis Virus 15. Specific functions, and accordingly utilities, of VGAM915 correlate with, and may be deduced from, the identity of the host target genes which VGAM915 binds and inhibits, and the function of these target genes, as elaborated hereinbelow.

Nucleotide sequences of the VGAM915 precursor RNA, herein designated VGAM PRECURSOR RNA, and of the 'diced' VGAM915 RNA, herein designated VGAM RNA, and a schematic representation of the secondary folding of VGAM915 folded precursor RNA, herein designated VGAM FOLDED PRECURSOR RNA, of VGAM915 are further described hereinbelow with reference to Table 1.

Nucleotide sequences of host target binding sites, such as BINDING SITE-I, BINDING SITE-II and BINDING SITE-III of FIG. 1, found on VGAM915 host target RNA, and schematic representation of the complementarity of each of these host target binding sites to VGAM915 RNA, herein designated VGAM RNA, are described hereinbelow with reference to Table 2.

As mentioned hereinabove with reference to FIG. 1, a function of VGAM915 gene, herein designated VGAM is inhibition of expression of VGAM915 target genes. It is appreciated that specific functions, and accordingly utilities, of VGAM915 correlate with, and may be deduced from, the identity of the target genes which VGAM915 binds and inhibits, and the function of these target genes, as elaborated hereinbelow.

Caspase Recruitment Domain Family, Member 15 (CARD15, Accession NM_022162) is a VGAM915 host target gene. CARD15 BINDING SITE is HOST TARGET binding site found in the 3' untranslated region of mRNA encoded by CARD15, corresponding to a HOST TARGET binding site such as BINDING SITE I, BINDING SITE II or BINDING SITE III. Table 2 illustrates the complementarity of the nucleotide sequences of CARD15 BINDING SITE, designated SEQ ID:22714, to the nucleotide sequence of VGAM915 RNA, herein designated VGAM RNA, also designated SEQ ID:3626.

A function of VGAM915 is therefore inhibition of Caspase Recruitment Domain Family, Member 15 (CARD15, Accession NM_022162), a gene which serves as an intracellular receptor for bacterial products in monocytes and transduces signals leading to NFKB activation. Accordingly, utilities of VGAM915 include diagnosis, prevention and treatment of diseases and clinical conditions associated with CARD15. The function of CARD15 and its association with various diseases and clinical conditions, has been established by previous studies, as described hereinabove with reference to VGAM126. CD2-associated Protein (CD2AP, Accession NM_012120) is another VGAM915 host target gene. CD2AP BINDING SITE is HOST TARGET binding site found in the 3' untranslated region of mRNA encoded by CD2AP, corresponding to a HOST TARGET binding site such as BINDING SITE I, BINDING SITE II or BINDING SITE III. Table 2 illustrates the complementarity of the nucleotide sequences of CD2AP BINDING SITE, designated SEQ ID:14432, to the nucleotide sequence of VGAM915 RNA, herein designated VGAM RNA, also designated SEQ ID:3626.

Another function of VGAM915 is therefore inhibition of CD2-associated Protein (CD2AP, Accession NM_012120), a gene which binds CAS ligand and may therefor involves in its growth regulatory pathway. Accordingly, utilities of VGAM915 include diagnosis, prevention and treatment of diseases and clinical conditions associated with CD2AP. The function of CD2AP and its association with various diseases and clinical conditions, has been established by previous studies, as described hereinabove with reference to VGAM95. Galactosylceramidase (Krabbe disease) (GALC, Accession NM_000153) is another VGAM915 host target gene. GALC BINDING SITE is HOST TARGET binding site found in the 3' untranslated region of mRNA encoded by GALC, corresponding to a HOST TARGET binding site such as BINDING SITE I, BINDING SITE II or BINDING SITE III. Table 2 illustrates the complementarity of the nucleotide sequences of GALC BINDING SITE, designated SEQ ID:5663, to the nucleotide sequence of VGAM915 RNA, herein designated VGAM RNA, also designated SEQ ID:3626.

Another function of VGAM915 is therefore inhibition of Galactosylceramidase (Krabbe disease) (GALC, Accession NM_000153), a gene which hydrolyses the galactose ester bonds of galactosylceramide, galactosylsphingosine, lactosylceramide, and monogalactosyldiglyceride. Accordingly, utilities of VGAM915 include diagnosis, prevention and treatment of diseases and clinical conditions associated with GALC. The function of GALC and its association with various diseases and clinical conditions, has been established by previous studies, as described hereinabove with reference to VGAM624. Chromosome 17 Open Reading Frame 31 (C17orf31, Accession NM_017575) is another VGAM915 host target gene. C17orf31 BINDING SITE is HOST TARGET binding site found in the 5' untranslated region of mRNA encoded by C17orf31, corresponding to a HOST TARGET binding site such as BINDING SITE I, BINDING SITE II or BINDING SITE III. Table 2 illustrates the complementarity of the nucleotide sequences of C17orf31 BINDING SITE, designated SEQ ID:19008, to the nucleotide sequence of VGAM915 RNA, herein designated VGAM RNA, also designated SEQ ID:3626.

Another function of VGAM915 is therefore inhibition of Chromosome 17 Open Reading Frame 31 (C17orf31, Accession NM_017575). Accordingly, utilities of VGAM915 include diagnosis, prevention and treatment of diseases and clinical conditions associated with C17orf31. FLJ11362 (Accession NM_021946) is another VGAM915 host target gene. FLJ11362 BINDING SITE is HOST TARGET binding site found in the 5' untranslated region of mRNA encoded by FLJ11362, corresponding to a HOST TARGET binding site such as BINDING SITE I, BINDING SITE II or BINDING SITE III. Table 2 illustrates the complementarity of the nucleotide sequences of FLJ11362 BINDING SITE, designated SEQ ID:22469, to the nucleotide sequence of VGAM915 RNA, herein designated VGAM RNA, also designated SEQ ID:3626.

Another function of VGAM915 is therefore inhibition of FLJ11362 (Accession NM_021946). Accordingly, utilities of VGAM915 include diagnosis, prevention and treatment of diseases and clinical conditions associated with FLJ11362. KIAA0449 (Accession NM_017596) is another VGAM915 host target gene. KIAA0449 BINDING SITE is HOST TARGET binding site found in the 3' untranslated region of mRNA encoded by KIAA0449, corresponding to a HOST TARGET binding site such as BINDING SITE I, BINDING SITE II or BINDING SITE III. Table 2 illustrates the complementarity of the nucleotide sequences of KIAA0449 BINDING SITE, designated SEQ ID:19055, to the nucleotide sequence of VGAM915 RNA, herein designated VGAM RNA, also designated SEQ ID:3626.

Another function of VGAM915 is therefore inhibition of KIAA0449 (Accession NM_017596). Accordingly, utilities of VGAM915 include diagnosis, prevention and treatment of diseases and clinical conditions associated with KIAA0449. SET Binding Protein 1 (SETBP1, Accession NM_015559) is another VGAM915 host target gene. SETBP1 BINDING SITE is HOST TARGET binding site found in the 3' untranslated region of mRNA encoded by SETBP1, corresponding to a HOST TARGET binding site such as BINDING SITE I, BINDING SITE II or BINDING SITE III. Table 2 illustrates the complementarity of the nucleotide sequences of SETBP1 BINDING SITE, designated SEQ ID:17827, to the nucleotide sequence of VGAM915 RNA, herein designated VGAM RNA, also designated SEQ ID:3626.

Another function of VGAM915 is therefore inhibition of SET Binding Protein 1 (SETBP1, Accession NM_015559). Accordingly, utilities of VGAM915 include diagnosis, prevention and treatment of diseases and clinical conditions associated with SETBP1. LOC149302 (Accession XM_086489) is another VGAM915 host target gene. LOC149302 BINDING SITE is HOST TARGET binding site found in the 5' untranslated region of mRNA encoded by LOC149302, corresponding to a HOST TARGET binding site such as BINDING SITE I, BINDING SITE II or BINDING SITE III. Table 2 illustrates the complementarity of the nucleotide sequences of LOC149302 BINDING SITE, designated SEQ ID:38703, to the nucleotide sequence of VGAM915 RNA, herein designated VGAM RNA, also designated SEQ ID:3626.

Another function of VGAM915 is therefore inhibition of LOC149302 (Accession XM_086489). Accordingly, utilities of VGAM915 include diagnosis, prevention and treatment of diseases and clinical conditions associated with LOC149302. LOC203378 (Accession XM_117541) is another VGAM915 host target gene. LOC203378 BINDING SITE is HOST TARGET binding site found in the 3' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43546, to the nucleotide sequence of VGAM915 RNA, herein designated VGAM RNA, also designated SEQ ID:3626.

Another function of VGAM915 is therefore inhibition of LOC203378 (Accession XM_117541). Accordingly, utilities of VGAM915 include diagnosis, prevention and treatment of diseases and clinical conditions associated with LOC203378. LOC256267 (Accession XM_173007) is another VGAM915 host target gene. LOC256267 BINDING SITE is HOST TARGET binding site found in the 5' untranslated region of mRNA encoded by LOC256267, corresponding to a HOST TARGET binding site such as BINDING SITE I, BINDING SITE II or BINDING SITE III. Table 2 illustrates the complementarity of the nucleotide sequences of LOC256267 BINDING SITE, designated SEQ ID:46277, to the nucleotide sequence of VGAM915 RNA, herein designated VGAM RNA, also designated SEQ ID:3626.

Another function of VGAM915 is therefore inhibition of LOC256267 (Accession XM_173007). Accordingly, utilities of VGAM915 include diagnosis, prevention and treatment of diseases and clinical conditions associated with LOC256267. LOC92466 (Accession XM_045251) is another VGAM915 host target gene. LOC92466 BINDING SITE is HOST TARGET binding site found in the 5' untranslated region of mRNA encoded by LOC92466, corresponding to a HOST TARGET binding site such as BINDING SITE I, BINDING SITE II or BINDING SITE III. Table 2 illustrates the complementarity of the nucleotide sequences of LOC92466 BINDING SITE, designated SEQ ID:34396, to the nucleotide sequence of VGAM915 RNA, herein designated VGAM RNA, also designated SEQ ID:3626.

Another function of VGAM915 is therefore inhibition of LOC92466 (Accession XM_045251). Accordingly, utilities of VGAM915 include diagnosis, prevention and treatment of diseases and clinical conditions associated with LOC92466. FIG. 1 further provides a conceptual description of a novel bioinformatically detected viral gene of the present invention, referred to here as Viral Genomic Address Messenger 916 (VGAM916) viral gene, which modulates expression of respective host target genes thereof, the function and utility of which host target genes is known in the art.

VGAM916 is a novel bioinformatically detected regulatory, non protein coding, viral micro RNA (miRNA) gene. The method by which VGAM916 was detected is described hereinabove with reference to FIGS. 1-8.

VGAM916 gene, herein designated VGAM GENE, is a viral gene contained in the genome of Trichoplusia Ni Cytoplasmic Polyhedrosis Virus 15. VGAM916 host target gene, herein designated VGAM HOST TARGET GENE, is a human gene contained in the human genome.

VGAM916 gene encodes a VGAM916 precursor RNA, herein designated VGAM PRECURSOR RNA. Similar to other miRNA genes, and unlike most ordinary genes, VGAM916 precursor RNA does not encode a protein. A nucleotide sequence identical or highly similar to the nucleotide sequence of VGAM916 precursor RNA is designated SEQ ID:902, and is provided hereinbelow with reference to the sequence listing part. Nucleotide sequence SEQ ID:902 is located at position 762 relative to the genome of Trichoplusia Ni Cytoplasmic Polyhedrosis Virus 15.

VGAM916 precursor RNA folds onto itself, forming VGAM916 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM916 folded precursor RNA into VGAM916 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 62%) nucleotide sequence of VGAM916 RNA is designated SEQ ID:3627, and is provided hereinbelow with reference to the sequence listing part.

VGAM916 host target gene, herein designated VGAM HOST TARGET GENE, encodes a corresponding messenger RNA, VGAM916 host target RNA, herein designated VGAM HOST TARGET RNA. VGAM916 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM916 RNA, herein designated VGAM RNA, binds complementarily to one or more host target binding sites located in untranslated regions of VGAM916 host target RNA, herein designated VGAM HOST TARGET RNA. This complementary binding is due to the fact that the nucleotide sequence of VGAM916 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM916 RNA, herein designated VGAM RNA, may have a different number of host target binding sites in untranslated regions of a VGAM916 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM916 RNA, herein designated VGAM RNA, to host target binding sites on VGAM916 host target RNA, herein designated VGAM HOST TARGET RNA, such as BINDING SITE I, BINDING SITE II and BINDING SITE III, inhibits translation of VGAM916 host target RNA into VGAM916 host target protein, herein designated VGAM HOST TARGET PROTEIN. VGAM host target protein is therefore outlined by a broken line.

It is appreciated that VGAM916 host target gene, herein designated VGAM HOST TARGET GENE, in fact represents a plurality of VGAM916 host target genes. The mRNA of each one of this plurality of VGAM916 host target genes comprises one or more host target binding sites, each having a nucleotide sequence which is at least partly complementary to VGAM916 RNA, herein designated VGAM RNA, and which when bound by VGAM916 RNA causes inhibition of translation of respective one or more VGAM916 host target proteins.

It is further appreciated by one skilled in the art that the mode of translational inhibition illustrated by FIG. 1 with specific reference to translational inhibition exerted by VGAM916 gene, herein designated VGAM GENE, on one or more VGAM916 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM916 is inhibition of expression of host target genes, as part of a novel viral mechanism of attacking a host. Accordingly, utilities of VGAM916 include diagnosis, prevention and treatment of viral infection by Trichoplusia Ni Cytoplasmic Polyhedrosis Virus 15. Specific functions, and accordingly utilities, of VGAM916 correlate with, and may be deduced from, the identity of the host target genes which VGAM916 binds and inhibits, and the function of these host target genes, as elaborated hereinbelow.

Nucleotide sequences of the VGAM916 precursor RNA, herein designated VGAM PRECURSOR RNA, and of the 'diced' VGAM916 RNA, herein designated VGAM RNA, and a schematic representation of the secondary folding of VGAM916 folded precursor RNA, herein designated VGAM FOLDED PRECURSOR RNA, of VGAM916 are further described hereinbelow with reference to Table 1.

Nucleotide sequences of host target binding sites, such as BINDING SITE-I, BINDING SITE-II and BINDING SITE-III of FIG. 1, found on VGAM916 host target RNA, and schematic representation of the complementarity of each of these host target binding sites to VGAM916 RNA, herein designated VGAM RNA, are described hereinbelow with reference to Table 2.

As mentioned hereinabove with reference to FIG. 1, a function of VGAM916 gene, herein designated VGAM is inhibition of expression of VGAM916 target genes. It is appreciated that specific functions, and accordingly utilities, of VGAM916 correlate with, and may be deduced from, the identity of the target genes which VGAM916 binds and inhibits, and the function of these target genes, as elaborated hereinbelow.

Staufen, RNA Binding Protein (Drosophila) (STAU, Accession NM_004602) is a VGAM916 host target gene. STAU BINDING SITE1 through STAU BINDING SITE4 are HOST TARGET binding sites found in untranslated regions of mRNA encoded by STAU, corresponding to HOST TARGET binding sites such as BINDING SITE I, BINDING SITE II or BINDING SITE III. Table 2 illustrates the complementarity of the nucleotide sequences of STAU BINDING SITE1 through STAU BINDING SITE4, designated SEQ ID:10938, SEQ ID:18911, SEQ ID:18917 and SEQ ID:18923 respectively, to the nucleotide sequence of VGAM916 RNA, herein designated VGAM RNA, also designated SEQ ID:3627.

A function of VGAM916 is therefore inhibition of Staufen, RNA Binding Protein (Drosophila) (STAU, Accession NM_004602), a gene which may play a role in specific positioning of mrnas at given sites in the cell and in stimulating their translation at the site. Accordingly, utilities of VGAM916 include diagnosis, prevention and treatment of diseases and clinical conditions associated with STAU. The function of STAU has been established by previous studies. In Drosophila, genetic studies have identified a number of potential genes that are necessary for localization of mRNAs in oocytes, one of which is the staufen gene. The staufen gene product is a double-stranded RNA (dsRNA)-binding protein that contains several copies of a consensus dsRNA-binding domain (RBD). By searching an EST database for staufen-related sequences, Wickham et al. (1999) identified a partial cDNA encoding STAU, a human staufen homolog. Using RACE and library screening, they recovered additional cDNAs corresponding to the entire STAU coding region. Northern blot analysis indicated that the STAU gene was expressed as an unresolved band of approximately 3.6 kb in all tissues tested. Characterization of STAU cDNAs revealed that there are 4 different STAU transcripts encoding predicted 496- and 577-amino acid isoforms differing in their N-terminal extremities. Wickham et al. (1999) also cloned a mouse Stau cDNA. Mouse and human STAU are 90% identical on the amino acid level. The RBDs are well conserved between Drosophila and mammalian staufen proteins in terms of overall structure and relative positions, and share 47 to 66% identity. However, the mammalian proteins lack the first RBD found in Drosophila staufen and contain a putative microtubule-binding domain not found in the Drosophila protein. In vitro, STAU bound dsRNA and tubulin, suggesting that it crosslinks cytoskeletal and RNA components. In mammalian cells expressing epitope-tagged STAU, immunofluorescence experiments revealed that STAU is localized to the rough endoplasmic reticulum. Wickham et al. (1999) proposed that STAU plays a role in the targeting of RNA to its site of translation. The influenza virus nonstructural protein NS1 is an RNA-binding protein that may be involved in regulatory processes during viral infection, including pre-mRNA splicing, retention of poly (A)-containing RNA in the nucleus, and the stimulation of viral mRNA translation. Using a yeast 2-hybrid screen, Marion et al. (1999) identified staufen-like as a protein that bound NS1. By immunofluorescence, they localized endogenous staufen-like to the rough endoplasmic reticulum in HeLa cells. Sedimentation analyses indicated that staufen-like associates with polysomes in these cells. Marion et al. (1999) suggested that staufen-like might therefore play a dual role: positioning specific mRNAs at given sites in the cell, and stimulating their translation at the site.

Full details of the abovementioned studies are described in the following publications, the disclosure of which are hereby incorporated by reference:

Marion, R. M.; Fortes, P.; Beloso, A.; Dotti, C.; Ortin, J.: A human sequence homologue of staufen is an RNA-binding protein that is associated with polysomes and localizes to the rough endoplasmic reticulum. Molec. Cell. Biol. 19:2212-2219, 1999; and Wickham, L.; Duchaine, T.; Luo, M.; Nabi, I. R.; Des-Groseillers, L.: Mammalian staufen is a double-stranded-RNA- and tubulin-binding protein which localizes to the rough endoplasmic r.

Further studies establishing the function and utilities of STAU are found in John Hopkins OMIM database record ID 601716, and in sited publications numbered 9115-9117 listed in the bibliography section hereinbelow, which are also hereby incorporated by reference. FLJ13187 (Accession NM_024613) is another VGAM916 host target gene. FLJ13187 BINDING SITE is HOST TARGET binding site found in the 3' untranslated region of mRNA encoded by FLJ13187, corresponding to a HOST TARGET binding site such as BINDING SITE I, BINDING SITE II or BINDING SITE III. Table 2 illustrates the complementarity of the nucleotide sequences of FLJ13187 BINDING SITE, designated SEQ ID:23868, to the nucleotide sequence of VGAM916 RNA, herein designated VGAM RNA, also designated SEQ ID:3627.

Another function of VGAM916 is therefore inhibition of FLJ13187 (Accession NM_024613). Accordingly, utilities of VGAM916 include diagnosis, prevention and treatment of diseases and clinical conditions associated with FLJ13187. Splicing Factor, Arginine/serine-rich 12 (SFRS12, Accession NM_139168) is another VGAM916 host target gene. SFRS12 BINDING SITE is HOST TARGET binding site found in the 3' untranslated region of mRNA encoded by SFRS12, corresponding to a HOST TARGET binding site such as BINDING SITE I, BINDING SITE II or BINDING SITE III. Table 2 illustrates the complementarity of the nucleotide sequences of SFRS12 BINDING SITE, designated SEQ ID:29173, to the nucleotide sequence of VGAM916 RNA, herein designated VGAM RNA, also designated SEQ ID:3627.

Another function of VGAM916 is therefore inhibition of Splicing Factor, Arginine/serine-rich 12 (SFRS12, Accession NM_139168). Accordingly, utilities of VGAM916 include diagnosis, prevention and treatment of diseases and clinical conditions associated with SFRS12. FIG. 1 further provides a conceptual description of a novel bioinformatically detected viral gene of the present invention, referred to here as Viral Genomic Address Messenger 917 (VGAM917) viral gene, which modulates expression of respective host target genes thereof, the function and utility of which host target genes is known in the art.

VGAM917 is a novel bioinformatically detected regulatory, non protein coding, viral micro RNA (miRNA) gene. The method by which VGAM917 was detected is described hereinabove with reference to FIGS. 1-8.

VGAM917 gene, herein designated VGAM GENE, is a viral gene contained in the genome of Vaccinia Virus. VGAM917 host target gene, herein designated VGAM HOST TARGET GENE, is a human gene contained in the human genome.

VGAM917 gene encodes a VGAM917 precursor RNA, herein designated VGAM PRECURSOR RNA. Similar to other miRNA genes, and unlike most ordinary genes, VGAM917 precursor RNA does not encode a protein. A nucleotide sequence identical or highly similar to the nucleotide sequence of VGAM917 precursor RNA is designated SEQ ID:903, and is provided hereinbelow with reference to the sequence listing part. Nucleotide sequence SEQ ID:903 is located at position 134932 relative to the genome of Vaccinia Virus.

VGAM917 precursor RNA folds onto itself, forming VGAM917 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM917 folded precursor RNA into VGAM917 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM917 RNA is designated SEQ ID:3628, and is provided hereinbelow with reference to the sequence listing part.

VGAM917 host target gene, herein designated VGAM HOST TARGET GENE, encodes a corresponding messenger RNA, VGAM917 host target RNA, herein designated VGAM HOST TARGET RNA. VGAM917 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM917 RNA, herein designated VGAM RNA, binds complementarily to one or more host target binding sites located in untranslated regions of VGAM917 host target RNA, herein designated VGAM HOST TARGET RNA. This complementary binding is due to the fact that the nucleotide sequence of VGAM917 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM917 RNA, herein designated VGAM RNA, may have a different number of host target binding sites in untranslated regions of a VGAM917 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM917 RNA, herein designated VGAM RNA, to host target binding sites on VGAM917 host target RNA, herein designated VGAM HOST TARGET RNA, such as BINDING SITE I, BINDING SITE II and BINDING SITE III, inhibits translation of VGAM917 host target RNA into VGAM917 host target protein, herein designated VGAM HOST TARGET PROTEIN. VGAM host target protein is therefore outlined by a broken line.

It is appreciated that VGAM917 host target gene, herein designated VGAM HOST TARGET GENE, in fact represents a plurality of VGAM917 host target genes. The mRNA of each one of this plurality of VGAM917 host target genes comprises one or more host target binding sites, each having a nucleotide sequence which is at least partly complementary to VGAM917 RNA, herein designated VGAM RNA, and which when bound by VGAM917 RNA causes inhibition of translation of respective one or more VGAM917 host target proteins.

It is further appreciated by one skilled in the art that the mode of translational inhibition illustrated by FIG. 1 with specific reference to translational inhibition exerted by VGAM917 gene, herein designated VGAM GENE, on one or more VGAM917 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM917 is inhibition of expression of host target genes, as part of a novel viral mechanism of attacking a host. Accordingly, utilities of VGAM917 include diagnosis, prevention and treatment of viral infection by Vaccinia Virus. Specific functions, and accordingly utilities, of VGAM917 correlate with, and may be deduced from, the identity of the host target genes which VGAM917 binds and inhibits, and the function of these host target genes, as elaborated hereinbelow.

Nucleotide sequences of the VGAM917 precursor RNA, herein designated VGAM PRECURSOR RNA, and of the 'diced' VGAM917 RNA, herein designated VGAM RNA, and a schematic representation of the secondary folding of VGAM917 folded precursor RNA, herein designated VGAM FOLDED PRECURSOR RNA, of VGAM917 are further described hereinbelow with reference to Table 1.

Nucleotide sequences of host target binding sites, such as BINDING SITE-I, BINDING SITE-II and BINDING SITE-III of FIG. 1, found on VGAM917 host target RNA, and schematic representation of the complementarity of each of these host target binding sites to VGAM917 RNA, herein designated VGAM RNA, are described hereinbelow with reference to Table 2.

As mentioned hereinabove with reference to FIG. 1, a function of VGAM917 gene, herein designated VGAM is inhibition of expression of VGAM917 target genes. It is appreciated that specific functions, and accordingly utilities, of VGAM917 correlate with, and may be deduced from, the identity of the target genes which VGAM917 binds and inhibits, and the function of these target genes, as elaborated hereinbelow.

ATPase, Class V, Type 10B (ATP10B, Accession XM_032721) is a VGAM917 host target gene. ATP10B BINDING SITE is HOST TARGET binding site found in the 3' untranslated region of mRNA encoded by ATP10B, corresponding to a HOST TARGET binding site such as BINDING SITE I, BINDING SITE II or BINDING SITE III. Table 2 illustrates the complementarity of the nucleotide sequences of ATP10B BINDING SITE, designated SEQ ID:31735, to the nucleotide sequence of VGAM917 RNA, herein designated VGAM RNA, also designated SEQ ID:3628.

A function of VGAM917 is therefore inhibition of ATPase, Class V, Type 10B (ATP10B, Accession XM_032721). Accordingly, utilities of VGAM917 include diagnosis, prevention and treatment of diseases and clinical conditions associated with ATP10B. BDG-29 (Accession XM_051343) is another VGAM917 host target gene. BDG-29 BINDING SITE is HOST TARGET binding site found in the 3' untranslated region of mRNA encoded by BDG-29, corresponding to a HOST TARGET binding site such as BINDING SITE I, BINDING SITE II or BINDING SITE III. Table 2 illustrates the complementarity of the nucleotide sequences of BDG-29 BINDING SITE, designated SEQ ID:35815, to the nucleotide sequence of VGAM917 RNA, herein designated VGAM RNA, also designated SEQ ID:3628.

Another function of VGAM917 is therefore inhibition of BDG-29 (Accession XM_051343). Accordingly, utilities of VGAM917 include diagnosis, prevention and treatment of diseases and clinical conditions associated with BDG-29. GW112 (Accession NM_006418) is another VGAM917 host target gene. GW112 BINDING SITE is HOST TARGET binding site found in the 3' untranslated region of mRNA encoded by GW112, corresponding to a HOST TARGET binding site such as BINDING SITE I, BINDING SITE II or BINDING SITE III. Table 2 illustrates the complementarity of the nucleotide sequences of GW112 BINDING SITE, designated SEQ ID:13131, to the nucleotide sequence of VGAM917 RNA, herein designated VGAM RNA, also designated SEQ ID:3628.

Another function of VGAM917 is therefore inhibition of GW112 (Accession NM_006418). Accordingly, utilities of VGAM917 include diagnosis, prevention and treatment of diseases and clinical conditions associated with GW112. Heat Shock 27 kDa Protein Family, Member 7 (cardiovascular) (HSPB7, Accession NM_014424) is another VGAM917 host target gene. HSPB7 BINDING SITE is HOST TARGET binding site found in the 3' untranslated region of mRNA encoded by HSPB7, corresponding to a HOST TARGET binding site such as BINDING SITE I, BINDING SITE II or BINDING SITE III. Table 2 illustrates the complementarity of the nucleotide sequences of HSPB7 BINDING SITE, designated SEQ ID:15780, to the nucleotide sequence of VGAM917 RNA, herein designated VGAM RNA, also designated SEQ ID:3628.

Another function of VGAM917 is therefore inhibition of Heat Shock 27kDa Protein Family, Member 7 (cardiovascular) (HSPB7, Accession NM_014424). Accordingly, utilities of VGAM917 include diagnosis, prevention and treatment of diseases and clinical conditions associated with HSPB7. KIAA1464 (Accession XM_043069) is another VGAM917 host target gene. KIAA1464 BINDING SITE is HOST TARGET binding site found in the 3' untranslated region of mRNA encoded by KIAA1464, corresponding to a HOST TARGET binding site such as BINDING SITE I, BINDING SITE II or BINDING SITE III. Table 2 illustrates the complementarity of the nucleotide sequences of KIAA1464 BINDING SITE, designated SEQ ID:33882, to the nucleotide sequence of VGAM917 RNA, herein designated VGAM RNA, also designated SEQ ID:3628.

Another function of VGAM917 is therefore inhibition of KIAA1464 (Accession XM_043069). Accordingly, utilities of VGAM917 include diagnosis, prevention and treatment of diseases and clinical conditions associated with KIAA1464. KIAA1634 (Accession XM_032749) is another VGAM917 host target gene. KIAA1634 BINDING SITE is HOST TARGET binding site found in the 3' untranslated region of mRNA encoded by KIAA1634, corresponding to a HOST TARGET binding site such as BINDING SITE I, BINDING SITE II or BINDING SITE III. Table 2 illustrates the complementarity of the nucleotide sequences of KIAA1634 BINDING SITE, designated SEQ ID:31752, to the nucleotide sequence of VGAM917 RNA, herein designated VGAM RNA, also designated SEQ ID:3628.

Another function of VGAM917 is therefore inhibition of KIAA1634 (Accession XM_032749). Accordingly, utilities of VGAM917 include diagnosis, prevention and treatment of diseases and clinical conditions associated with KIAA1634. Neuropilin (NRP) and Tolloid (TLL)-like 1 (NETO1, Accession NM_138999) is another VGAM917 host target gene. NETO1 BINDING SITE is HOST TARGET binding site found in the 3' untranslated region of mRNA encoded by NETO1, corresponding to a HOST TARGET binding site such as BINDING SITE I, BINDING SITE II or BINDING SITE III. Table 2 illustrates the complementarity of the nucleotide sequences of NETO1 BINDING SITE, designated SEQ ID:29097, to the nucleotide sequence of VGAM917 RNA, herein designated VGAM RNA, also designated SEQ ID:3628.

Another function of VGAM917 is therefore inhibition of Neuropilin (NRP) and Tolloid (TLL)-like 1 (NETO1, Accession NM_138999). Accordingly, utilities of VGAM917 include diagnosis, prevention and treatment of diseases and clinical conditions associated with NETO1. PRO2533 (Accession NM_018629) is another VGAM917 host target gene. PRO2533 BINDING SITE is HOST TARGET binding site found in the 3' untranslated region of mRNA encoded by PRO2533, corresponding to a HOST TARGET binding site such as BINDING SITE I, BINDING SITE II or BINDING SITE III. Table 2 illustrates the complementarity of the nucleotide sequences of PRO2533 BINDING SITE, designated SEQ ID:20703, to the nucleotide sequence of VGAM917 RNA, herein designated VGAM RNA, also designated SEQ ID:3628.

Another function of VGAM917 is therefore inhibition of PRO2533 (Accession NM_018629). Accordingly, utilities of VGAM917 include diagnosis, prevention and treatment of diseases and clinical conditions associated with PRO2533. LOC151201 (Accession XM_098021) is another VGAM917 host target gene. LOC151201 BINDING SITE is HOST TARGET binding site found in the 3' untranslated region of mRNA encoded by LOC151201, corresponding to a HOST TARGET binding site such as BINDING SITE I, BINDING SITE II or BINDING SITE III. Table 2 illustrates the complementarity of the nucleotide sequences of LOC151201 BINDING SITE, designated SEQ ID:41324, to the nucleotide sequence of VGAM917 RNA, herein designated VGAM RNA, also designated SEQ ID:3628.

Another function of VGAM917 is therefore inhibition of LOC151201 (Accession XM_098021). Accordingly, utilities of VGAM917 include diagnosis, prevention and treatment of diseases and clinical conditions associated with LOC151201. FIG. 1 further provides a conceptual description of a novel bioinformatically detected viral gene of the present invention, referred to here as Viral Genomic Address Messenger 918 (VGAM918) viral gene, which modulates expression of respective host target genes thereof, the function and utility of which host target genes is known in the art.

VGAM918 is a novel bioinformatically detected regulatory, non protein coding, viral micro RNA (miRNA) gene. The method by which VGAM918 was detected is described hereinabove with reference to FIGS. 1-8.

VGAM918 gene, herein designated VGAM GENE, is a viral gene contained in the genome of Vaccinia Virus. VGAM918 host target gene, herein designated VGAM HOST TARGET GENE, is a human gene contained in the human genome.

VGAM918 gene encodes a VGAM918 precursor RNA, herein designated VGAM PRECURSOR RNA. Similar to other miRNA genes, and unlike most ordinary genes, VGAM918 precursor RNA does not encode a protein. A nucleotide sequence identical or highly similar to the nucleotide sequence of VGAM918 precursor RNA is designated SEQ ID:904, and is provided hereinbelow with reference to the sequence listing part. Nucleotide sequence SEQ ID:904 is located at position 642 relative to the genome of Vaccinia Virus.

VGAM918 precursor RNA folds onto itself, forming VGAM918 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM918 folded precursor RNA into VGAM918 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM918 RNA is designated SEQ ID:3629, and is provided hereinbelow with reference to the sequence listing part.

VGAM918 host target gene, herein designated VGAM HOST TARGET GENE, encodes a corresponding messenger RNA, VGAM918 host target RNA, herein designated VGAM HOST TARGET RNA. VGAM918 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM918 RNA, herein designated VGAM RNA, binds complementarily to one or more host target binding sites located in untranslated regions of VGAM918 host target RNA, herein designated VGAM HOST TARGET RNA. This complementary binding is due to the fact that the nucleotide sequence of VGAM918 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM918 RNA, herein designated VGAM RNA, may have a different number of host target binding sites in untranslated regions of a VGAM918 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM918 RNA, herein designated VGAM RNA, to host target binding sites on VGAM918 host target RNA, herein designated VGAM HOST TARGET RNA, such as BINDING SITE I, BINDING SITE II and BINDING SITE III, inhibits translation of VGAM918 host target RNA into VGAM918 host target protein, herein designated VGAM HOST TARGET PROTEIN. VGAM host target protein is therefore outlined by a broken line.

It is appreciated that VGAM918 host target gene, herein designated VGAM HOST TARGET GENE, in fact represents a plurality of VGAM918 host target genes. The mRNA of each one of this plurality of VGAM918 host target genes comprises one or more host target binding sites, each having a nucleotide sequence which is at least partly complementary to VGAM918 RNA, herein designated VGAM RNA, and which when bound by VGAM918 RNA causes inhibition of translation of respective one or more VGAM918 host target proteins.

It is further appreciated by one skilled in the art that the mode of translational inhibition illustrated by FIG. 1 with specific reference to translational inhibition exerted by VGAM918 gene, herein designated VGAM GENE, on one or more VGAM918 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM918 is inhibition of expression of host target genes, as part of a novel viral mechanism of attacking a host. Accordingly, utilities of VGAM918 include diagnosis, prevention and treatment of viral infection by Vaccinia Virus. Specific functions, and accordingly utilities, of VGAM918 correlate with, and may be deduced from, the identity of the host target genes which VGAM918 binds and inhibits, and the function of these host target genes, as elaborated hereinbelow.

Nucleotide sequences of the VGAM918 precursor RNA, herein designated VGAM PRECURSOR RNA, and of the 'diced' VGAM918 RNA, herein designated VGAM RNA, and a schematic representation of the secondary folding of VGAM918 folded precursor RNA, herein designated VGAM FOLDED PRECURSOR RNA, of VGAM918 are further described hereinbelow with reference to Table 1.

Nucleotide sequences of host target binding sites, such as BINDING SITE-I, BINDING SITE-II and BINDING SITE-III of FIG. 1, found on VGAM918 host target RNA, and schematic representation of the complementarity of each of these host target binding sites to VGAM918 RNA, herein designated VGAM RNA, are described hereinbelow with reference to Table 2.

As mentioned hereinabove with reference to FIG. 1, a function of VGAM918 gene, herein designated VGAM is inhibition of expression of VGAM918 target genes. It is appreciated that specific functions, and accordingly utilities, of VGAM918 correlate with, and may be deduced from, the identity of the target genes which VGAM918 binds and inhibits, and the function of these target genes, as elaborated hereinbelow.

Myosin IE (MYO1E, Accession NM_004998) is a VGAM918 host target gene. MYO1E BINDING SITE is HOST TARGET binding site found in the 5' untranslated region of mRNA encoded by MYO1E, corresponding to a HOST TARGET binding site such as BINDING SITE I, BINDING SITE II or BINDING SITE III. Table 2 illustrates the complementarity of the nucleotide sequences of MYO1E BINDING SITE, designated SEQ ID:11441, to the nucleotide sequence of VGAM918 RNA, herein designated VGAM RNA, also designated SEQ ID:3629.

A function of VGAM918 is therefore inhibition of Myosin IE (MYO1E, Accession NM_004998), a gene which is an unconventional myosin. Accordingly, utilities of VGAM918 include diagnosis, prevention and treatment of diseases and clinical conditions associated with MYO1E. The function of MYO1E and its association with various diseases and clinical conditions, has been established by previous studies, as described hereinabove with reference to VGAM200. Rho-associated, Coiled-coil Containing Protein Kinase 2 (ROCK2, Accession XM_038377) is another VGAM918 host target gene. ROCK2 BINDING SITE is HOST TARGET binding site found in the 3' untranslated region of mRNA encoded by ROCK2, corresponding to a HOST TARGET binding site such as BINDING SITE I, BINDING SITE II or BINDING SITE III. Table 2 illustrates the complementarity of the nucleotide sequences of ROCK2 BINDING SITE, designated SEQ ID:32836, to the nucleotide sequence of VGAM918 RNA, herein designated VGAM RNA, also designated SEQ ID:3629.

Another function of VGAM918 is therefore inhibition of Rho-associated, Coiled-coil Containing Protein Kinase 2 (ROCK2, Accession XM_038377), a gene which regulates cytokinesis, smooth muscle contraction, the formation of actin stress fibers and focal adhesions. Accordingly, utilities of VGAM918 include diagnosis, prevention and treatment of diseases and clinical conditions associated with ROCK2. The function of ROCK2 and its association with various diseases and clinical conditions, has been established by previous studies, as described hereinabove with reference to VGAM273. MGC15937 (Accession NM_080661) is another VGAM918 host target gene. MGC15937 BINDING SITE is HOST TARGET binding site found in the 5' untranslated region of mRNA encoded by MGC15937, corresponding to a HOST TARGET binding site such as BINDING SITE I, BINDING SITE II or BINDING SITE III. Table 2 illustrates the complementarity of the nucleotide sequences of MGC15937 BINDING SITE, designated SEQ ID:27949, to the nucleotide sequence of VGAM918 RNA, herein designated VGAM RNA, also designated SEQ ID:3629.

Another function of VGAM918 is therefore inhibition of MGC15937 (Accession NM_080661). Accordingly, utilities of VGAM918 include diagnosis, prevention and treatment of diseases and clinical conditions associated with MGC15937. LOC148029 (Accession XM_086014) is another VGAM918 host target gene. LOC148029 BINDING SITE is HOST TARGET binding site found in the 5' untranslated region of mRNA encoded by LOC148029, corresponding to a HOST TARGET binding site such as BINDING SITE I, BINDING SITE II or BINDING SITE III. Table 2 illustrates the complementarity of the nucleotide sequences of LOC148029 BINDING SITE, designated SEQ ID:38447, to the nucleotide sequence of VGAM918 RNA, herein designated VGAM RNA, also designated SEQ ID:3629.

Another function of VGAM918 is therefore inhibition of LOC148029 (Accession XM_086014). Accordingly, utilities of VGAM918 include diagnosis, prevention and treatment of diseases and clinical conditions associated with LOC148029. LOC169436 (Accession XM_095696) is another VGAM918 host target gene. LOC169436 BINDING SITE is HOST TARGET binding site found in the 5' untranslated region of mRNA encoded by LOC169436, corresponding to a HOST TARGET binding site such as BINDING SITE I, BINDING SITE II or BINDING SITE III. Table 2 illustrates the complementarity of the nucleotide sequences of LOC169436 BINDING SITE, designated SEQ ID:40279, to the nucleotide sequence of VGAM918 RNA, herein designated VGAM RNA, also designated SEQ ID:3629.

Another function of VGAM918 is therefore inhibition of LOC169436 (Accession XM_095696). Accordingly, utilities of VGAM918 include diagnosis, prevention and treatment of diseases and clinical conditions associated with LOC169436. LOC256267 (Accession XM_173007) is another VGAM918 host target gene. LOC256267 BINDING SITE is HOST TARGET binding site found in the 3' untranslated region of mRNA encoded by LOC256267, corresponding to a HOST TARGET binding site such as BINDING SITE I, BINDING SITE II or BINDING SITE III. Table 2 illustrates the complementarity of the nucleotide sequences of LOC256267 BINDING SITE, designated SEQ ID:46276, to the nucleotide sequence of VGAM918 RNA, herein designated VGAM RNA, also designated SEQ ID:3629.

Another function of VGAM918 is therefore inhibition of LOC256267 (Accession XM_173007). Accordingly, utilities of VGAM918 include diagnosis, prevention and treatment of diseases and clinical conditions associated with LOC256267. LOC257426 (Accession XM_039451) is another VGAM918 host target gene. LOC257426 BINDING SITE is HOST TARGET binding site found in the 3' untranslated region of mRNA encoded by LOC257426, corresponding to a HOST TARGET binding site such as BINDING SITE I, BINDING SITE II or BINDING SITE III. Table 2 illustrates the complementarity of the nucleotide sequences of LOC257426 BINDING SITE, designated SEQ ID:33098, to the nucleotide sequence of VGAM918 RNA, herein designated VGAM RNA, also designated SEQ ID:3629.

Another function of VGAM918 is therefore inhibition of LOC257426 (Accession XM_039451). Accordingly, utilities of VGAM918 include diagnosis, prevention and treatment of diseases and clinical conditions associated with LOC257426. LOC92466 (Accession XM_045251) is another VGAM918 host target gene. LOC92466 BINDING SITE is HOST TARGET binding site found in the 3' untranslated region of mRNA encoded by LOC92466, corresponding to a HOST TARGET binding site such as BINDING SITE I, BINDING SITE II or BINDING SITE III. Table 2 illustrates the complementarity of the nucleotide sequences of LOC92466 BINDING SITE, designated SEQ ID:34395, to the nucleotide sequence of VGAM918 RNA, herein designated VGAM RNA, also designated SEQ ID:3629.

Another function of VGAM918 is therefore inhibition of LOC92466 (Accession XM_045251). Accordingly, utilities of VGAM918 include diagnosis, prevention and treatment of diseases and clinical conditions associated with LOC92466. FIG. 1 further provides a conceptual description of a novel bioinformatically detected viral gene of the present invention, referred to here as Viral Genomic Address Messenger 919 (VGAM919) viral gene, which modulates expression of respective host target genes thereof, the function and utility of which host target genes is known in the art.

VGAM919 is a novel bioinformatically detected regulatory, non protein coding, viral micro RNA (miRNA) gene. The method by which VGAM919 was detected is described hereinabove with reference to FIGS. 1-8.

VGAM919 gene, herein designated VGAM GENE, is a viral gene contained in the genome of Vaccinia Virus. VGAM919 host target gene, herein designated VGAM HOST TARGET GENE, is a human gene contained in the human genome.

VGAM919 gene encodes a VGAM919 precursor RNA, herein designated VGAM PRECURSOR RNA. Similar to other miRNA genes, and unlike most ordinary genes, VGAM919 precursor RNA does not encode a protein. A nucleotide sequence identical or highly similar to the nucleotide sequence of VGAM919 precursor RNA is designated SEQ ID:905, and is provided hereinbelow with reference to the sequence listing part. Nucleotide sequence SEQ ID:905 is located at position 963 relative to the genome of Vaccinia Virus.

VGAM919 precursor RNA folds onto itself, forming VGAM919 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM919 folded precursor RNA into VGAM919 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM919 RNA is designated SEQ ID:3630, and is provided hereinbelow with reference to the sequence listing part.

VGAM919 host target gene, herein designated VGAM HOST TARGET GENE, encodes a corresponding messenger RNA, VGAM919 host target RNA, herein designated VGAM HOST TARGET RNA. VGAM919 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM919 RNA, herein designated VGAM RNA, binds complementarily to one or more host target binding sites located in untranslated regions of VGAM919 host target RNA, herein designated VGAM HOST TARGET RNA. This complementary binding is due to the fact that the nucleotide sequence of VGAM919 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM919 RNA, herein designated VGAM RNA, may have a different number of host target binding sites in untranslated regions of a VGAM919 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM919 RNA, herein designated VGAM RNA, to host target binding sites on VGAM919 host target RNA, herein designated VGAM HOST TARGET RNA, such as BINDING SITE I, BINDING SITE II and BINDING SITE III, inhibits translation of VGAM919 host target RNA into VGAM919 host target protein, herein designated VGAM HOST TARGET PROTEIN. VGAM host target protein is therefore outlined by a broken line.

It is appreciated that VGAM919 host target gene, herein designated VGAM HOST TARGET GENE, in fact represents a plurality of VGAM919 host target genes. The mRNA of each one of this plurality of VGAM919 host target genes comprises one or more host target binding sites, each having a nucleotide sequence which is at least partly complementary to VGAM919 RNA, herein designated VGAM RNA, and which when bound by VGAM919 RNA causes inhibition of translation of respective one or more VGAM919 host target proteins.

It is further appreciated by one skilled in the art that the mode of translational inhibition illustrated by FIG. 1 with specific reference to translational inhibition exerted by VGAM919 gene, herein designated VGAM GENE, on one or more VGAM919 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM919 is inhibition of expression of host target genes, as part of a novel viral mechanism of attacking a host. Accordingly, utilities of VGAM919 include diagnosis, prevention and treatment of viral infection by Vaccinia Virus. Specific functions, and accordingly utilities, of VGAM919 correlate with, and may be deduced from, the identity of the host target genes which VGAM919 binds and inhibits, and the function of these host target genes, as elaborated hereinbelow.

Nucleotide sequences of the VGAM919 precursor RNA, herein designated VGAM PRECURSOR RNA, and of the 'diced' VGAM919 RNA, herein designated VGAM RNA, and a schematic representation of the secondary folding of VGAM919 folded precursor RNA, herein designated VGAM FOLDED PRECURSOR RNA, of VGAM919 are further described hereinbelow with reference to Table 1.

Nucleotide sequences of host target binding sites, such as BINDING SITE-I, BINDING SITE-II and BINDING SITE-III of FIG. 1, found on VGAM919 host target RNA, and schematic representation of the complementarity of each of these host target binding sites to VGAM919 RNA, herein designated VGAM RNA, are described hereinbelow with reference to Table 2.

As mentioned hereinabove with reference to FIG. 1, a function of VGAM919 gene, herein designated VGAM is inhibition of expression of VGAM919 target genes. It is appreciated that specific functions, and accordingly utilities, of VGAM919 correlate with, and may be deduced from, the identity of the target genes which VGAM919 binds and inhibits, and the function of these target genes, as elaborated hereinbelow.

LOC152078 (Accession XM_087376) is a VGAM919 host target gene. LOC152078 BINDING SITE is HOST TARGET binding site found in the 3' untranslated region of mRNA encoded by LOC152078, corresponding to a HOST TARGET binding site such as BINDING SITE I, BINDING SITE II or BINDING SITE III. Table 2 illustrates the complementarity of the nucleotide sequences of LOC152078 BINDING SITE, designated SEQ ID:39213, to the nucleotide sequence of VGAM919 RNA, herein designated VGAM RNA, also designated SEQ ID:3630.

A function of VGAM919 is therefore inhibition of LOC152078 (Accession XM_087376). Accordingly, utilities of VGAM919 include diagnosis, prevention and treatment of diseases and clinical conditions associated with LOC152078. FIG. 1 further provides a conceptual description of a novel bioinformatically detected viral gene of the present invention, referred to here as Viral Genomic Address Messenger 920 (VGAM920) viral gene, which modulates expression of respective host target genes thereof, the function and utility of which host target genes is known in the art.

VGAM920 is a novel bioinformatically detected regulatory, non protein coding, viral micro RNA (miRNA) gene.

The method by which VGAM920 was detected is described hereinabove with reference to FIGS. 1-8.

VGAM920 gene, herein designated VGAM GENE, is a viral gene contained in the genome of Vaccinia Virus. VGAM920 host target gene, herein designated VGAM HOST TARGET GENE, is a human gene contained in the human genome.

VGAM920 gene encodes a VGAM920 precursor RNA, herein designated VGAM PRECURSOR RNA. Similar to other miRNA genes, and unlike most ordinary genes, VGAM920 precursor RNA does not encode a protein. A nucleotide sequence identical or highly similar to the nucleotide sequence of VGAM920 precursor RNA is designated SEQ ID:906, and is provided hereinbelow with reference to the sequence listing part. Nucleotide sequence SEQ ID:906 is located at position 1243 relative to the genome of Vaccinia Virus.

VGAM920 precursor RNA folds onto itself, forming VGAM920 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM920 folded precursor RNA into VGAM920 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM920 RNA is designated SEQ ID:3631, and is provided hereinbelow with reference to the sequence listing part.

VGAM920 host target gene, herein designated VGAM HOST TARGET GENE, encodes a corresponding messenger RNA, VGAM920 host target RNA, herein designated VGAM HOST TARGET RNA. VGAM920 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM920 RNA, herein designated VGAM RNA, binds complementarily to one or more host target binding sites located in untranslated regions of VGAM920 host target RNA, herein designated VGAM HOST TARGET RNA. This complementary binding is due to the fact that the nucleotide sequence of VGAM920 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM920 RNA, herein designated VGAM RNA, may have a different number of host target binding sites in untranslated regions of a VGAM920 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM920 RNA, herein designated VGAM RNA, to host target binding sites on VGAM920 host target RNA, herein designated VGAM HOST TARGET RNA, such as BINDING SITE I, BINDING SITE II and BINDING SITE III, inhibits translation of VGAM920 host target RNA into VGAM920 host target protein, herein designated VGAM HOST TARGET PROTEIN. VGAM host target protein is therefore outlined by a broken line.

It is appreciated that VGAM920 host target gene, herein designated VGAM HOST TARGET GENE, in fact represents a plurality of VGAM920 host target genes. The mRNA of each one of this plurality of VGAM920 host target genes comprises one or more host target binding sites, each having a nucleotide sequence which is at least partly complementary to VGAM920 RNA, herein designated VGAM RNA, and which when bound by VGAM920 RNA causes inhibition of translation of respective one or more VGAM920 host target proteins.

It is further appreciated by one skilled in the art that the mode of translational inhibition illustrated by FIG. 1 with specific reference to translational inhibition exerted by VGAM920 gene, herein designated VGAM GENE, on one or more VGAM920 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM920 is inhibition of expression of host target genes, as part of a novel viral mechanism of attacking a host. Accordingly, utilities of VGAM920 include diagnosis, prevention and treatment of viral infection by Vaccinia Virus. Specific functions, and accordingly utilities, of VGAM920 correlate with, and may be deduced from, the identity of the host target genes which VGAM920 binds and inhibits, and the function of these host target genes, as elaborated hereinbelow.

Nucleotide sequences of the VGAM920 precursor RNA, herein designated VGAM PRECURSOR RNA, and of the 'diced' VGAM920 RNA, herein designated VGAM RNA, and a schematic representation of the secondary folding of VGAM920 folded precursor RNA, herein designated VGAM FOLDED PRECURSOR RNA, of VGAM920 are further described hereinbelow with reference to Table 1.

Nucleotide sequences of host target binding sites, such as BINDING SITE-I, BINDING SITE-II and BINDING SITE-III of FIG. 1, found on VGAM920 host target RNA, and schematic representation of the complementarity of each of these host target binding sites to VGAM920 RNA, herein designated VGAM RNA, are described hereinbelow with reference to Table 2.

As mentioned hereinabove with reference to FIG. 1, a function of VGAM920 gene, herein designated VGAM is inhibition of expression of VGAM920 target genes. It is appreciated that specific functions, and accordingly utilities, of VGAM920 correlate with, and may be deduced from, the identity of the target genes which VGAM920 binds and inhibits, and the function of these target genes, as elaborated hereinbelow.

LOC152078 (Accession XM_087376) is a VGAM920 host target gene. LOC152078 BINDING SITE is HOST TARGET binding site found in the 3' untranslated region of mRNA encoded by LOC152078, corresponding to a HOST TARGET binding site such as BINDING SITE I, BINDING SITE II or BINDING SITE III. Table 2 illustrates the complementarity of the nucleotide sequences of LOC152078 BINDING SITE, designated SEQ ID:39213, to the nucleotide sequence of VGAM920 RNA, herein designated VGAM RNA, also designated SEQ ID:3631.

A function of VGAM920 is therefore inhibition of LOC152078 (Accession XM_087376). Accordingly, utilities of VGAM920 include diagnosis, prevention and treatment of diseases and clinical conditions associated with LOC152078. FIG. 1 further provides a conceptual description of a novel bioinformatically detected viral gene of the present invention, referred to here as Viral Genomic Address Messenger 921 (VGAM921) viral gene, which modulates expression of respective host target genes thereof, the function and utility of which host target genes is known in the art.

VGAM921 is a novel bioinformatically detected regulatory, non protein coding, viral micro RNA (miRNA) gene. The method by which VGAM921 was detected is described hereinabove with reference to FIGS. 1-8.

VGAM921 gene, herein designated VGAM GENE, is a viral gene contained in the genome of Peanut Clump Virus. VGAM921 host target gene, herein designated VGAM HOST TARGET GENE, is a human gene contained in the human genome.

VGAM921 gene encodes a VGAM921 precursor RNA, herein designated VGAM PRECURSOR RNA. Similar to other miRNA genes, and unlike most ordinary genes, VGAM921 precursor RNA does not encode a protein. A nucleotide sequence identical or highly similar to the nucleotide sequence of VGAM921 precursor RNA is designated SEQ ID:907, and is provided hereinbelow with reference to the sequence listing part. Nucleotide sequence SEQ ID:907 is located at position 3787 relative to the genome of Peanut Clump Virus.

VGAM921 precursor RNA folds onto itself, forming VGAM921 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM921 folded precursor RNA into VGAM921 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM921 RNA is designated SEQ ID:3632, and is provided hereinbelow with reference to the sequence listing part.

VGAM921 host target gene, herein designated VGAM HOST TARGET GENE, encodes a corresponding messenger RNA, VGAM921 host target RNA, herein designated VGAM HOST TARGET RNA. VGAM921 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM921 RNA, herein designated VGAM RNA, binds complementarily to one or more host target binding sites located in untranslated regions of VGAM921 host target RNA, herein designated VGAM HOST TARGET RNA. This complementary binding is due to the fact that the nucleotide sequence of VGAM921 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM921 RNA, herein designated VGAM RNA, may have a different number of host target binding sites in untranslated regions of a VGAM921 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM921 RNA, herein designated VGAM RNA, to host target binding sites on VGAM921 host target RNA, herein designated VGAM HOST TARGET RNA, such as BINDING SITE I, BINDING SITE II and BINDING SITE III, inhibits translation of VGAM921 host target RNA into VGAM921 host target protein, herein designated VGAM HOST TARGET PROTEIN. VGAM host target protein is therefore outlined by a broken line.

It is appreciated that VGAM921 host target gene, herein designated VGAM HOST TARGET GENE, in fact represents a plurality of VGAM921 host target genes. The mRNA of each one of this plurality of VGAM921 host target genes comprises one or more host target binding sites, each having a nucleotide sequence which is at least partly complementary to VGAM921 RNA, herein designated VGAM RNA, and which when bound by VGAM921 RNA causes inhibition of translation of respective one or more VGAM921 host target proteins.

It is further appreciated by one skilled in the art that the mode of translational inhibition illustrated by FIG. 1 with specific reference to translational inhibition exerted by VGAM921 gene, herein designated VGAM GENE, on one or more VGAM921 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM921 is inhibition of expression of host target genes, as part of a novel viral mechanism of attacking a host. Accordingly, utilities of VGAM921 include diagnosis, prevention and treatment of viral infection by Peanut Clump Virus. Specific functions, and accordingly utilities, of VGAM921 correlate with, and may be deduced from, the identity of the host target genes which VGAM921 binds and inhibits, and the function of these host target genes, as elaborated hereinbelow.

Nucleotide sequences of the VGAM921 precursor RNA, herein designated VGAM PRECURSOR RNA, and of the 'diced' VGAM921 RNA, herein designated VGAM RNA, and a schematic representation of the secondary folding of VGAM921 folded precursor RNA, herein designated VGAM FOLDED PRECURSOR RNA, of VGAM921 are further described hereinbelow with reference to Table 1.

Nucleotide sequences of host target binding sites, such as BINDING SITE-I, BINDING SITE-II and BINDING SITE-III of FIG. 1, found on VGAM921 host target RNA, and schematic representation of the complementarity of each of these host target binding sites to VGAM921 RNA, herein designated VGAM RNA, are described hereinbelow with reference to Table 2.

As mentioned hereinabove with reference to FIG. 1, a function of VGAM921 gene, herein designated VGAM is inhibition of expression of VGAM921 target genes. It is appreciated that specific functions, and accordingly utilities, of VGAM921 correlate with, and may be deduced from, the identity of the target genes which VGAM921 binds and inhibits, and the function of these target genes, as elaborated hereinbelow.

Adenylosuccinate Synthase (ADSS, Accession XM_049992) is a VGAM921 host target gene. ADSS BINDING SITE is HOST TARGET binding site found in the 3' untranslated region of mRNA encoded by ADSS, corresponding to a HOST TARGET binding site such as BINDING SITE I, BINDING SITE II or BINDING SITE III. Table 2 illustrates the complementarity of the nucleotide sequences of ADSS BINDING SITE, designated SEQ ID:35541, to the nucleotide sequence of VGAM921 RNA, herein designated VGAM RNA, also designated SEQ ID:3632.

A function of VGAM921 is therefore inhibition of Adenylosuccinate Synthase (ADSS, Accession XM_049992), a gene which plays an important role in the de novo pathway of purine nucleotide biosynthesis. Accordingly, utilities of VGAM921 include diagnosis, prevention and treatment of diseases and clinical conditions associated with ADSS. The function of ADSS has been established by previous studies. Somatic cell hybrids between human cells and Chinese hamster ovary cells deficient in specific steps in the purine biosynthetic pathway permitted mapping of human genes correcting the defects. The ade (-)H mutant is missing the enzyme adenylosuccinate synthetase (IMP:L-aspartate ligase; EC 6.3.4.4.), which carries out the first of a 2-step sequence in the biosynthesis of AMP from IMP. Thus, ade (-)H cells require exogenous adenine for growth. Lai et al. (1989) found that in somatic cell hybrids human chromosome 1 corrected the defect so that the hybrid cell containing chromosome 1 grew without adenine. Lai et al. (1991) reported that analysis of a human/CHO translocation chromosome that arose in 1 of the hybrids suggested that the gene correcting the defect lies in the region 1cen-q12. (See their FIG. 1 for a useful diagram of the purine biosynthesis pathway and the purine nucleotide cycle pathway, together with the location of the genes for the enzymes when known.) AMP deaminase, which converts AMP back to IMP, is coded by a gene, perhaps 2 genes, in region 1p21-p13; see 102770. From a human liver library, Powell et al. (1992) isolated a cDNA that encoded a protein of 455 amino acids. Alignment with the sequence of the ADSS gene in mouse, Dictyostelium discoideum, and E. coli pointed to invariant residues that are likely to be important for structure and/or catalysis. The human ADSS sequence also showed some similarity to argininosuccinate synthetase, which catalyzes a chemically similar reaction.

Full details of the abovementioned studies are described in the following publications, the disclosure of which are hereby incorporated by reference:

Lai, L.-W.; Hart, I. M.; Patterson, D.: A gene correcting the defect in the CHO mutant Ade (-)H, deficient in a branch point enzyme (adenylosuccinate synthetase) of de novo purine biosynthesis, is located on the long arm of chromosome 1. Genomics 9:322-328, 1991; and Powell, S. M.; Zalkin, H.; Dixon, J. E.: Cloning and characterization of the cDNA encoding human adenylosuccinate synthetase. FEBS Lett. 303:4-10, 1992.

Further studies establishing the function and utilities of ADSS are found in John Hopkins OMIM database record ID 103060, and in sited publications numbered 489-491 listed in the bibliography section hereinbelow, which are also hereby incorporated by reference. LIM Domain Only 7 (LMO7, Accession NM_015843) is another VGAM921 host target gene. LMO7 BINDING SITE1 and LMO7 BINDING SITE2 are HOST TARGET binding sites found in untranslated regions of mRNA encoded by LMO7, corresponding to HOST TARGET binding sites such as BINDING SITE I, BINDING SITE II or BINDING SITE III. Table 2 illustrates the complementarity of the nucleotide sequences of LMO7 BINDING SITE1 and LMO7 BINDING SITE2, designated SEQ ID:17971 and SEQ ID:11828 respectively, to the nucleotide sequence of VGAM921 RNA, herein designated VGAM RNA, also designated SEQ ID:3632.

Another function of VGAM921 is therefore inhibition of LIM Domain Only 7 (LMO7, Accession NM_015843). Accordingly, utilities of VGAM921 include diagnosis, prevention and treatment of diseases and clinical conditions associated with LMO7. RNA Guanylyltransferase and 5'-phosphatase (RNGTT, Accession NM_003800) is another VGAM921 host target gene. RNGTT BINDING SITE is HOST TARGET binding site found in the 3' untranslated region of mRNA encoded by RNGTT, corresponding to a HOST TARGET binding site such as BINDING SITE I, BINDING SITE II or BINDING SITE III. Table 2 illustrates the complementarity of the nucleotide sequences of RNGTT BINDING SITE, designated SEQ ID:9895, to the nucleotide sequence of VGAM921 RNA, herein designated VGAM RNA, also designated SEQ ID:3632.

Another function of VGAM921 is therefore inhibition of RNA Guanylyltransferase and 5'-phosphatase (RNGTT, Accession NM_003800), a gene which is an MRNA capping enzyme; bifunctional enzyme containing both 5'-triphosphatase and mRNA guanylyltransferase activity. Accordingly, utilities of VGAM921 include diagnosis, prevention and treatment of diseases and clinical conditions associated with RNGTT. The function of RNGTT and its association with various diseases and clinical conditions, has been established by previous studies, as described hereinabove with reference to VGAM292. FLJ14906 (Accession NM_032859) is another VGAM921 host target gene. FLJ14906 BINDING SITE is HOST TARGET binding site found in the 3' untranslated region of mRNA encoded by FLJ14906, corresponding to a HOST TARGET binding site such as BINDING SITE I, BINDING SITE II or BINDING SITE III. Table 2 illustrates the complementarity of the nucleotide sequences of FLJ14906 BINDING SITE, designated SEQ ID:26662, to the nucleotide sequence of VGAM921 RNA, herein designated VGAM RNA, also designated SEQ ID:3632.

Another function of VGAM921 is therefore inhibition of FLJ14906 (Accession NM_032859). Accordingly, utilities of VGAM921 include diagnosis, prevention and treatment of diseases and clinical conditions associated with FLJ14906. KIAA1727 (Accession XM_034262) is another VGAM921 host target gene. KIAA1727 BINDING SITE is HOST TARGET binding site found in the 3' untranslated region of mRNA encoded by KIAA1727, corresponding to a HOST TARGET binding site such as BINDING SITE I, BINDING SITE II or BINDING SITE III. Table 2 illustrates the complementarity of the nucleotide sequences of KIAA1727 BIND- ING SITE, designated SEQ ID:32036, to the nucleotide sequence of VGAM921 RNA, herein designated VGAM RNA, also designated SEQ ID:3632.

Another function of VGAM921 is therefore inhibition of KIAA1727 (Accession XM_034262). Accordingly, utilities of VGAM921 include diagnosis, prevention and treatment of diseases and clinical conditions associated with KIAA1727. KIAA1854 (Accession XM_049884) is another VGAM921 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35524, to the nucleotide sequence of VGAM921 RNA, herein designated VGAM RNA, also designated SEQ ID:3632.

Another function of VGAM921 is therefore inhibition of KIAA1854 (Accession XM_049884). Accordingly, utilities of VGAM921 include diagnosis, prevention and treatment of diseases and clinical conditions associated with KIAA1854. LOC153114 (Accession XM_098313) is another VGAM921 host target gene. LOC153114 BINDING SITE is HOST TARGET binding site found in the 5' untranslated region of mRNA encoded by LOC153114, corresponding to a HOST TARGET binding site such as BINDING SITE I, BINDING SITE II or BINDING SITE III. Table 2 illustrates the complementarity of the nucleotide sequences of LOC153114 BINDING SITE, designated SEQ ID:41573, to the nucleotide sequence of VGAM921 RNA, herein designated VGAM RNA, also designated SEQ ID:3632.

Another function of VGAM921 is therefore inhibition of LOC153114 (Accession XM_098313). Accordingly, utilities of VGAM921 include diagnosis, prevention and treatment of diseases and clinical conditions associated with LOC153114. FIG. 1 further provides a conceptual description of a novel bioinformatically detected viral gene of the present invention, referred to here as Viral Genomic Address Messenger 922 (VGAM922) viral gene, which modulates expression of respective host target genes thereof, the function and utility of which host target genes is known in the art.

VGAM922 is a novel bioinformatically detected regulatory, non protein coding, viral micro RNA (miRNA) gene. The method by which VGAM922 was detected is described hereinabove with reference to FIGS. 1-8.

VGAM922 gene, herein designated VGAM GENE, is a viral gene contained in the genome of Peanut Clump Virus. VGAM922 host target gene, herein designated VGAM HOST TARGET GENE, is a human gene contained in the human genome.

VGAM922 gene encodes a VGAM922 precursor RNA, herein designated VGAM PRECURSOR RNA. Similar to other miRNA genes, and unlike most ordinary genes, VGAM922 precursor RNA does not encode a protein. A nucleotide sequence identical or highly similar to the nucleotide sequence of VGAM922 precursor RNA is designated SEQ ID:908, and is provided hereinbelow with reference to the sequence listing part. Nucleotide sequence SEQ ID:908 is located at position 1130 relative to the genome of Peanut Clump Virus.

VGAM922 precursor RNA folds onto itself, forming VGAM922 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM922 folded precursor RNA into VGAM922 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM922 RNA is designated SEQ ID:3633, and is provided hereinbelow with reference to the sequence listing part.

VGAM922 host target gene, herein designated VGAM HOST TARGET GENE, encodes a corresponding messenger RNA, VGAM922 host target RNA, herein designated VGAM HOST TARGET RNA. VGAM922 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM922 RNA, herein designated VGAM RNA, binds complementarily to one or more host target binding sites located in untranslated regions of VGAM922 host target RNA, herein designated VGAM HOST TARGET RNA. This complementary binding is due to the fact that the nucleotide sequence of VGAM922 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM922 RNA, herein designated VGAM RNA, may have a different number of host target binding sites in untranslated regions of a VGAM922 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM922 RNA, herein designated VGAM RNA, to host target binding sites on VGAM922 host target RNA, herein designated VGAM HOST TARGET RNA, such as BINDING SITE I, BINDING SITE II and BINDING SITE III, inhibits translation of VGAM922 host target RNA into VGAM922 host target protein, herein designated VGAM HOST TARGET PROTEIN. VGAM host target protein is therefore outlined by a broken line.

It is appreciated that VGAM922 host target gene, herein designated VGAM HOST TARGET GENE, in fact represents a plurality of VGAM922 host target genes. The mRNA of each one of this plurality of VGAM922 host target genes comprises one or more host target binding sites, each having a nucleotide sequence which is at least partly complementary to VGAM922 RNA, herein designated VGAM RNA, and which when bound by VGAM922 RNA causes inhibition of translation of respective one or more VGAM922 host target proteins.

It is further appreciated by one skilled in the art that the mode of translational inhibition illustrated by FIG. 1 with specific reference to translational inhibition exerted by VGAM922 gene, herein designated VGAM GENE, on one or more VGAM922 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM922 is inhibition of expression of host target genes, as part of a novel viral mechanism of attacking a host. Accordingly, utilities of VGAM922 include diagnosis, prevention and treatment of viral infection by Peanut Clump Virus. Specific functions, and accordingly utilities, of VGAM922 correlate with, and may be deduced from, the identity of the host target genes which VGAM922 binds and inhibits, and the function of these host target genes, as elaborated hereinbelow.

Nucleotide sequences of the VGAM922 precursor RNA, herein designated VGAM PRECURSOR RNA, and of the 'diced' VGAM922 RNA, herein designated VGAM RNA, and a schematic representation of the secondary folding of VGAM922 folded precursor RNA, herein designated VGAM FOLDED PRECURSOR RNA, of VGAM922 are further described hereinbelow with reference to Table 1.

Nucleotide sequences of host target binding sites, such as BINDING SITE-I, BINDING SITE-II and BINDING SITE-III of FIG. 1, found on VGAM922 host target RNA, and schematic representation of the complementarity of each of these host target binding sites to VGAM922 RNA, herein designated VGAM RNA, are described hereinbelow with reference to Table 2.

As mentioned hereinabove with reference to FIG. 1, a function of VGAM922 gene, herein designated VGAM is inhibition of expression of VGAM922 target genes. It is appreciated that specific functions, and accordingly utilities, of VGAM922 correlate with, and may be deduced from, the identity of the target genes which VGAM922 binds and inhibits, and the function of these target genes, as elaborated hereinbelow.

Notch Homolog 2 (Drosophila) (NOTCH2, Accession NM_024408) is a VGAM922 host target gene. NOTCH2 BINDING SITE is HOST TARGET binding site found in the 3' untranslated region of mRNA encoded by NOTCH2, corresponding to a HOST TARGET binding site such as BINDING SITE I, BINDING SITE II or BINDING SITE III. Table 2 illustrates the complementarity of the nucleotide sequences of NOTCH2 BINDING SITE, designated SEQ ID:23651, to the nucleotide sequence of VGAM922 RNA, herein designated VGAM RNA, also designated SEQ ID:3633.

A function of VGAM922 is therefore inhibition of Notch Homolog 2 (Drosophila) (NOTCH2, Accession NM_024408), a gene which is moderately similar to a region of murine Notch1 and contains an ankyrin repeat. Accordingly, utilities of VGAM922 include diagnosis, prevention and treatment of diseases and clinical conditions associated with NOTCH2. The function of NOTCH2 and its association with various diseases and clinical conditions, has been established by previous studies, as described hereinabove with reference to VGAM93. Polymerase (DNA directed), Theta (POLQ, Accession NM_006596) is another VGAM922 host target gene. POLQ BINDING SITE is HOST TARGET binding site found in the 3' untranslated region of mRNA encoded by POLQ, corresponding to a HOST TARGET binding site such as BINDING SITE I, BINDING SITE II or BINDING SITE III. Table 2 illustrates the complementarity of the nucleotide sequences of POLQ BINDING SITE, designated SEQ ID:13368, to the nucleotide sequence of VGAM922 RNA, herein designated VGAM RNA, also designated SEQ ID:3633.

Another function of VGAM922 is therefore inhibition of Polymerase (DNA directed), Theta (POLQ, Accession NM_006596), a gene which enhances untargeted mutagenesis. Accordingly, utilities of VGAM922 include diagnosis, prevention and treatment of diseases and clinical conditions associated with POLQ. The function of POLQ has been established by previous studies. By EST database searching for homologs of yeast Rad30 and screening of a fetal brain cDNA library, Johnson et al. (2000) also cloned POLK, which they termed POL-theta (POLQ) because it encodes the eighth known eukaryotic polymerase. Functional analysis showed that purified POLK can incorporate all 4 nucleotides almost to the end of the template. In contrast to POLH, POLK, which lacks a proofreading exonuclease function, is unable to bypass DNA lesions, namely cis-syn T-T dimers, T-T photoproducts, or an abasic site. Assays of fidelity of replication indicated that POLK misincorporated deoxynucleotides with a frequency of 1/1000 to 1/10,000, a rate 10-fold lower than that of POLH. Ohashi et al. (2000) also found that POLK is unable to bypass T-T dimers. Unlike Johnson et al. (2000), however, they did observe bypassing of abasic sites, the most common lesions in DNA within cells which are generated by spontaneous hydrolysis of the N glycoside bond during the course of repairing base-damage generated by carcinogenic agents and ionizing radiation. Ohashi et al. (2000) noted that their finding was heavily dependent on sequence context and enzyme concentration.

Full details of the abovementioned studies are described in the following publications, the disclosure of which are hereby incorporated by reference:

Johnson, R. E.; Prakash, S.; Prakash, L.: The human DINB1 gene encodes the DNA polymerase Pol-theta. Proc. Nat. Acad. Sci. 97:3838-3843, 2000; and Ohashi, E.; Ogi, T.; Kusumoto, R.; Iwai, S.; Masutani, C.; Hanaoka, F.; Ohmori, H. : Error-prone bypass of certain DNA lesions by the human DNA polymerase kappa. Genes Dev. 14:1589-1594.

Further studies establishing the function and utilities of POLQ are found in John Hopkins OMIM database record ID 605650, and in sited publications numbered 411-414 listed in the bibliography section hereinbelow, which are also hereby incorporated by reference. RAD1 Homolog (S. pombe) (RAD1, Accession NM_133282) is another VGAM922 host target gene. RAD1 BINDING SITE is HOST TARGET binding site found in the 5' untranslated region of mRNA encoded by RAD1, corresponding to a HOST TARGET binding site such as BINDING SITE I, BINDING SITE II or BINDING SITE III. Table 2 illustrates the complementarity of the nucleotide sequences of RAD1 BINDING SITE, designated SEQ ID:28436, to the nucleotide sequence of VGAM922 RNA, herein designated VGAM RNA, also designated SEQ ID:3633.

Another function of VGAM922 is therefore inhibition of RAD1 Homolog (S. pombe) (RAD1, Accession NM_133282), a gene which has important roles in DNA damage-activated mitotic and meiotic cell cycle checkpoints. Accordingly, utilities of VGAM922 include diagnosis, prevention and treatment of diseases and clinical conditions associated with RAD1. The function of RAD1 has been established by previous studies. In the fission yeast S. pombe, the rad1+ gene product is required for DNA repair and replication. Parker et al. (1998) cloned 2 alternatively spliced human cDNAs encoding proteins with significant homology to yeast rad1+. The longer cDNA, called Hrad1A, encodes a 282-amino acid polypeptide, while Hrad1B encodes a 163-amino acid polypeptide. Northern blot analysis revealed that human RAD1 is expressed as mRNAs of 5, 3, and 1.3 kb in a variety of human tissues, with higher levels present in some cancer cell lines. Northern blot analysis of cells subjected to ultraviolet radiation demonstrated that human RAD1 expression is not induced in response to DNA damage. Purified RAD1 exhibited terminal exonuclease activity on double-stranded DNA, with a preference for 3-prime ends. Independently, Udell et al. (1998) isolated RAD1 cDNAs from a spontaneously transformed human keratinocyte cDNA library. The cDNAs encode the 282-amino acid RAD1 isoform, which is 90% and 27% identical to mouse Rad1 and S. pombe rad1+, respectively. Udell et al. (1998) found that expression of human RAD1 in yeast rad1 mutants partially restores radiation resistance and G2 checkpoint proficiency.

Full details of the abovementioned studies are described in the following publications, the disclosure of which are hereby incorporated by reference:

Parker, A. E.; Van de Weyer, I.; Laus, M. C.; Oostveen, I.; Yon, J.; Verhasselt, P.; Luyten, W. H. M. L.: A human homologue of Schizosaccharomyces pombe rad1+ checkpoint gene encodes an exonuclease. J. Biol. Chem. 273:18332-18339, 1998; and Udell, C. M.; Lee, S. K.; Davey, S.: HRAD1 and MRAD1 encode mammalian homologues of the fission yeast rad1+ cell cycle checkpoint control gene. Nucleic Acids Res. 26:3971-3976, 1998.

Further studies establishing the function and utilities of RAD1 are found in John Hopkins OMIM database record ID 603153, and in sited publications numbered 690, 543 and 2422 listed in the bibliography section hereinbelow, which are also hereby incorporated by reference. RNA (guanine-7-) Methyltransferase (RNMT, Accession NM_003799) is another VGAM922 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9890, to the nucleotide sequence of VGAM922 RNA, herein designated VGAM RNA, also designated SEQ ID:3633.

Another function of VGAM922 is therefore inhibition of RNA (guanine-7-) Methyltransferase (RNMT, Accession NM_003799), a gene which catalyzes the methylation of GpppN- at the guanine N7 position. Accordingly, utilities of VGAM922 include diagnosis, prevention and treatment of diseases and clinical conditions associated with RNMT. The function of RNMT and its association with various diseases and clinical conditions, has been established by previous studies, as described hereinabove with reference to VGAM178. SIP (Accession NM_014412) is another VGAM922 host target gene. SIP BINDING SITE is HOST TARGET binding site found in the 3' untranslated region of mRNA encoded by SIP, corresponding to a HOST TARGET binding site such as BINDING SITE I, BINDING SITE II or BINDING SITE III. Table 2 illustrates the complementarity of the nucleotide sequences of SIP BINDING SITE, designated SEQ ID:15759, to the nucleotide sequence of VGAM922 RNA, herein designated VGAM RNA, also designated SEQ ID:3633.

Another function of VGAM922 is therefore inhibition of SIP (Accession NM_014412). Accordingly, utilities of VGAM922 include diagnosis, prevention and treatment of diseases and clinical conditions associated with SIP. Solute Carrier Family 38, Member 3 (SLC38A3, Accession NM_006841) is another VGAM922 host target gene. SLC38A3 BINDING SITE is HOST TARGET binding site found in the 3' untranslated region of mRNA encoded by SLC38A3, corresponding to a HOST TARGET binding site such as BINDING SITE I, BINDING SITE II or BINDING SITE III. Table 2 illustrates the complementarity of the nucleotide sequences of SLC38A3 BINDING SITE, designated SEQ ID:13714, to the nucleotide sequence of VGAM922 RNA, herein designated VGAM RNA, also designated SEQ ID:3633.

Another function of VGAM922 is therefore inhibition of Solute Carrier Family 38, Member 3 (SLC38A3, Accession NM_006841), a gene which involves H+ exchange and Na+ cotransport, mediates glutamine efflux and uptake. Accordingly, utilities of VGAM922 include diagnosis, prevention and treatment of diseases and clinical conditions associated with SLC38A3. The function of SLC38A3 has been established by previous studies. The amino acid glutamine has a central role in nitrogen metabolism. Although the molecular mechanisms responsible for its transport across cell membranes are poorly understood, classical amino acid transport system N appears particularly important. Using intracellular pH measurements, Chaudhry et al. (1999) identified an orphan protein, which they called SN1, related to the vesicular GABA transporter (VGAT) as system N Functional analysis by Chaudhry et al. (1999) showed that this protein involves H+ exchange as well as Na+ cotransport and, under physiologic conditions, mediates glutamine efflux as well as uptake. Together with the pattern of SN1 expression, these unusual properties suggested novel physiologic roles for system N in nitrogen metabolism and synaptic transmission Full details of the abovementioned studies are described in the following publications, the disclosure of which are hereby incorporated by reference:

Chaudhry, F. A.; Reimer, R. J.; Krizaj, D.; Barber, D.; Storm-Mathisen, J.; Copenhagen, D. R.; Edwards, R. H.: Molecular analysis of system N suggests novel physiological roles in nitrogen metabolism and synaptic transmission. Cell 99: 769-780, 1999; and Lerman, M. I.; Minna, J. D.: The 630-kb lung cancer homozygous deletion region on human chromosome 3p21.3: identification and evaluation of the resident candidate tumor suppressor genes.

Further studies establishing the function and utilities of SLC38A3 are found in John Hopkins OMIM database record ID 604437, and in sited publications numbered 7939 listed in the bibliography section hereinbelow, which are also hereby incorporated by reference. Cdc42 Guanine Nucleotide Exchange Factor (GEF) 9 (ARHGEF9, Accession NM_015185) is another VGAM922 host target gene. ARHGEF9 BINDING SITE is HOST TARGET binding site found in the 3' untranslated region of mRNA encoded by ARHGEF9, corresponding to a HOST TARGET binding site such as BINDING SITE I, BINDING SITE II or BINDING SITE III. Table 2 illustrates the complementarity of the nucleotide sequences of ARHGEF9 BINDING SITE, designated SEQ ID:17544, to the nucleotide sequence of VGAM922 RNA, herein designated VGAM RNA, also designated SEQ ID:3633.

Another function of VGAM922 is therefore inhibition of Cdc42 Guanine Nucleotide Exchange Factor (GEF) 9 (ARHGEF9, Accession NM_015185). Accordingly, utilities of VGAM922 include diagnosis, prevention and treatment of diseases and clinical conditions associated with ARHGEF9. CG018 (Accession NM_052818) is another VGAM922 host target gene. CG018 BINDING SITE is HOST TARGET binding site found in the 5' untranslated region of mRNA encoded by CG018, corresponding to a HOST TARGET binding site such as BINDING SITE I, BINDING SITE II or BINDING SITE III. Table 2 illustrates the complementarity of the nucleotide sequences of CG018 BINDING SITE, designated SEQ ID:27401, to the nucleotide sequence of VGAM922 RNA, herein designated VGAM RNA, also designated SEQ ID:3633.

Another function of VGAM922 is therefore inhibition of CG018 (Accession NM_052818). Accordingly, utilities of VGAM922 include diagnosis, prevention and treatment of diseases and clinical conditions associated with CG018. DKFZP434J214 (Accession XM_027639) is another VGAM922 host target gene. DKFZP434J214 BINDING SITE is HOST TARGET binding site found in the 3' untranslated region of mRNA encoded by DKFZP434J214, corresponding to a HOST TARGET binding site such as BINDING SITE I, BINDING SITE II or BINDING SITE III. Table 2 illustrates the complementarity of the nucleotide sequences of DKFZP434J214 BINDING SITE, designated SEQ ID:30550, to the nucleotide sequence of VGAM922 RNA, herein designated VGAM RNA, also designated SEQ ID:3633.

Another function of VGAM922 is therefore inhibition of DKFZP434J214 (Accession XM_027639). Accordingly, utilities of VGAM922 include diagnosis, prevention and treatment of diseases and clinical conditions associated with DKFZP434J214. HCA127 (Accession NM_018684) is another VGAM922 host target gene. HCA127 BINDING SITE is HOST TARGET binding site found in the 3' untranslated region of mRNA encoded by HCA127, corresponding to a HOST TARGET binding site such as BINDING SITE I, BINDING SITE II or BINDING SITE III. Table 2 illustrates the complementarity of the nucleotide sequences of HCA127 BINDING SITE, designated SEQ ID:20760, to the nucleotide sequence of VGAM922 RNA, herein designated VGAM RNA, also designated SEQ ID:3633.

Another function of VGAM922 is therefore inhibition of HCA127 (Accession NM_018684). Accordingly, utilities of VGAM922 include diagnosis, prevention and treatment of diseases and clinical conditions associated with HCA127. KIAA0931 (Accession XM_041191) is another VGAM922 host target gene. KIAA0931 BINDING SITE is HOST TARGET binding site found in the 3' untranslated region of mRNA encoded by KIAA0931, corresponding to a HOST TARGET binding site such as BINDING SITE I, BINDING SITE II or BINDING SITE III. Table 2 illustrates the complementarity of the nucleotide sequences of KIAA0931 BINDING SITE, designated SEQ ID:33488, to the nucleotide sequence of VGAM922 RNA, herein designated VGAM RNA, also designated SEQ ID:3633.

Another function of VGAM922 is therefore inhibition of KIAA0931 (Accession XM_041191). Accordingly, utilities of VGAM922 include diagnosis, prevention and treatment of diseases and clinical conditions associated with KIAA0931. KIAA1795 (Accession XM_050988) is another VGAM922 host target gene. KIAA1795 BINDING SITE is HOST TARGET binding site found in the 3' untranslated region of mRNA encoded by KIAA1795, corresponding to a HOST TARGET binding site such as BINDING SITE I, BINDING SITE II or BINDING SITE III. Table 2 illustrates the complementarity of the nucleotide sequences of KIAA1795 BINDING SITE, designated SEQ ID:35702, to the nucleotide sequence of VGAM922 RNA, herein designated VGAM RNA, also designated SEQ ID:3633.

Another function of VGAM922 is therefore inhibition of KIAA1795 (Accession XM_050988). Accordingly, utilities of VGAM922 include diagnosis, prevention and treatment of diseases and clinical conditions associated with KIAA1795. MGC5457 (Accession NM_032633) is another VGAM922 host target gene. MGC5457 BINDING SITE is HOST TARGET binding site found in the 3' untranslated region of mRNA encoded by MGC5457, corresponding to a HOST TARGET binding site such as BINDING SITE I, BINDING SITE II or BINDING SITE III. Table 2 illustrates the complementarity of the nucleotide sequences of MGC5457 BINDING SITE, designated SEQ ID:26348, to the nucleotide sequence of VGAM922 RNA, herein designated VGAM RNA, also designated SEQ ID:3633.

Another function of VGAM922 is therefore inhibition of MGC5457 (Accession NM_032633). Accordingly, utilities of VGAM922 include diagnosis, prevention and treatment of diseases and clinical conditions associated with MGC5457. NYD-SP27 (Accession NM_033123) is another VGAM922 host target gene. NYD-SP27 BINDING SITE is HOST TARGET binding site found in the 5' untranslated region of mRNA encoded by NYD-SP27, corresponding to a HOST TARGET binding site such as BINDING SITE I, BINDING SITE II or BINDING SITE III. Table 2 illustrates the complementarity of the nucleotide sequences of NYD-SP27 BINDING SITE, designated SEQ ID:26969, to the nucleotide sequence of VGAM922 RNA, herein designated VGAM RNA, also designated SEQ ID:3633.

Another function of VGAM922 is therefore inhibition of NYD-SP27 (Accession NM_033123). Accordingly, utilities of VGAM922 include diagnosis, prevention and treatment of diseases and clinical conditions associated with NYD-SP27. PRO0132 (Accession NM_014116) is another VGAM922 host target gene. PRO0132 BINDING SITE is HOST TARGET binding site found in the 5' untranslated region of mRNA encoded by PRO0132, corresponding to a HOST TARGET binding site such as BINDING SITE I, BINDING SITE II or BINDING SITE III. Table 2 illustrates the complementarity of the nucleotide sequences of PRO0132 BINDING SITE, designated SEQ ID:15369, to the nucleotide sequence of VGAM922 RNA, herein designated VGAM RNA, also designated SEQ ID:3633.

Another function of VGAM922 is therefore inhibition of PRO0132 (Accession NM_014116). Accordingly, utilities of VGAM922 include diagnosis, prevention and treatment of diseases and clinical conditions associated with PRO0132. SHAPY (Accession NM_138793) is another VGAM922 host target gene. SHAPY BINDING SITE is HOST TARGET binding site found in the 3" untranslated region of mRNA encoded by SHAPY, corresponding to a HOST TARGET binding site such as BINDING SITE I, BINDING SITE II or BINDING SITE III. Table 2 illustrates the complementarity of the nucleotide sequences of SHAPY BINDING SITE, designated SEQ ID:29016, to the nucleotide sequence of VGAM922 RNA, herein designated VGAM RNA, also designated SEQ ID:3633.

Another function of VGAM922 is therefore inhibition of SHAPY (Accession NM_138793). Accordingly, utilities of VGAM922 include diagnosis, prevention and treatment of diseases and clinical conditions associated with SHAPY. UCK1 (Accession NM_031432) is another VGAM922 host target gene. UCK1 BINDING SITE is HOST TARGET binding site found in the 3' untranslated region of mRNA encoded by UCK1, corresponding to a HOST TARGET binding site such as BINDING SITE I, BINDING SITE II or BINDING SITE III. Table 2 illustrates the complementarity of the nucleotide sequences of UCK1 BINDING SITE, designated SEQ ID:25428, to the nucleotide sequence of VGAM922 RNA, herein designated VGAM RNA, also designated SEQ ID:3633.

Another function of VGAM922 is therefore inhibition of UCK1 (Accession NM_031432). Accordingly, utilities of VGAM922 include diagnosis, prevention and treatment of diseases and clinical conditions associated with UCK1. WD Repeat Domain 9 (WDR9, Accession NM_018963) is another VGAM922 host target gene. WDR9 BINDING SITE is HOST TARGET binding site found in the 3' untranslated region of mRNA encoded by WDR9, corresponding to a HOST TARGET binding site such as BINDING SITE I, BINDING SITE II or BINDING SITE III. Table 2 illustrates the complementarity of the nucleotide sequences of WDR9 BINDING SITE, designated SEQ ID:21034, to the nucleotide sequence of VGAM922 RNA, herein designated VGAM RNA, also designated SEQ ID:3633.

Another function of VGAM922 is therefore inhibition of WD Repeat Domain 9 (WDR9, Accession NM_018963). Accordingly, utilities of VGAM922 include diagnosis, prevention and treatment of diseases and clinical conditions associated with WDR9. LOC143465 (Accession XM_096430) is another VGAM922 host target gene. LOC143465 BINDING SITE is HOST TARGET binding site found in the 5' untranslated region of mRNA encoded by LOC143465, corresponding to a HOST TARGET binding site such as BINDING SITE I, BINDING SITE II or BINDING SITE III. Table 2 illustrates the complementarity of the nucleotide sequences of LOC143465 BINDING SITE, designated SEQ ID:40367, to the nucleotide sequence of VGAM922 RNA, herein designated VGAM RNA, also designated SEQ ID:3633.

Another function of VGAM922 is therefore inhibition of LOC143465 (Accession XM_096430). Accordingly, utilities of VGAM922 include diagnosis, prevention and treatment of diseases and clinical conditions associated with LOC143465. LOC159963 (Accession XM_089960) is another VGAM922 host target gene. LOC159963 BINDING SITE is HOST TARGET binding site found in the 5' untranslated region of mRNA encoded by LOC159963, corresponding to a HOST TARGET binding site such as BINDING SITE I, BINDING SITE II or BINDING SITE III. Table 2 illustrates the complementarity of the nucleotide sequences of LOC159963 BINDING SITE, designated SEQ ID:39988, to the nucleotide sequence of VGAM922 RNA, herein designated VGAM RNA, also designated SEQ ID:3633.

Another function of VGAM922 is therefore inhibition of LOC159963 (Accession XM_089960). Accordingly, utilities of VGAM922 include diagnosis, prevention and treatment of diseases and clinical conditions associated with LOC159963. LOC200609 (Accession XM_117256) is another VGAM922 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43340, to the nucleotide sequence of VGAM922 RNA, herein designated VGAM RNA, also designated SEQ ID:3633.

Another function of VGAM922 is therefore inhibition of LOC200609 (Accession XM_117256). Accordingly, utilities of VGAM922 include diagnosis, prevention and treatment of diseases and clinical conditions associated with LOC200609. LOC222237 (Accession XM_168592) is another VGAM922 host target gene. LOC222237 BINDING SITE is HOST TARGET binding site found in the 3' untranslated region of mRNA encoded by LOC222237, corresponding to a HOST TARGET binding site such as BINDING SITE I, BINDING SITE II or BINDING SITE III. Table 2 illustrates the complementarity of the nucleotide sequences of LOC222237 BINDING SITE, designated SEQ ID:45270, to the nucleotide sequence of VGAM922 RNA, herein designated VGAM RNA, also designated SEQ ID:3633.

Another function of VGAM922 is therefore inhibition of LOC222237 (Accession XM_168592). Accordingly, utilities of VGAM922 include diagnosis, prevention and treatment of diseases and clinical conditions associated with LOC222237. FIG. 1 further provides a conceptual description of a novel bioinformatically detected viral gene of the present invention, referred to here as Viral Genomic Address Messenger 923 (VGAM923) viral gene, which modulates expression of respective host target genes thereof, the function and utility of which host target genes is known in the art.

VGAM923 is a novel bioinformatically detected regulatory, non protein coding, viral micro RNA (miRNA) gene. The method by which VGAM923 was detected is described hereinabove with reference to FIGS. 1-8.

VGAM923 gene, herein designated VGAM GENE, is a viral gene contained in the genome of Peanut Clump Virus. VGAM923 host target gene, herein designated VGAM HOST TARGET GENE, is a human gene contained in the human genome.

VGAM923 gene encodes a VGAM923 precursor RNA, herein designated VGAM PRECURSOR RNA. Similar to other miRNA genes, and unlike most ordinary genes, VGAM923 precursor RNA does not encode a protein. A nucleotide sequence identical or highly similar to the nucleotide sequence of VGAM923 precursor RNA is designated SEQ ID:909, and is provided hereinbelow with reference to the sequence listing part. Nucleotide sequence SEQ ID:909 is located at position 1684 relative to the genome of Peanut Clump Virus.

VGAM923 precursor RNA folds onto itself, forming VGAM923 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM923 folded precursor RNA into VGAM923 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 77%) nucleotide sequence of VGAM923 RNA is designated SEQ ID:3634, and is provided hereinbelow with reference to the sequence listing part.

VGAM923 host target gene, herein designated VGAM HOST TARGET GENE, encodes a corresponding messenger RNA, VGAM923 host target RNA, herein designated VGAM HOST TARGET RNA. VGAM923 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM923 RNA, herein designated VGAM RNA, binds complementarily to one or more host target binding sites located in untranslated regions of VGAM923 host target RNA, herein designated VGAM HOST TARGET RNA. This complementary binding is due to the fact that the nucleotide sequence of VGAM923 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM923 RNA, herein designated VGAM RNA, may have a different number of host target binding sites in untranslated regions of a VGAM923 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM923 RNA, herein designated VGAM RNA, to host target binding sites on VGAM923 host target RNA, herein designated VGAM HOST TARGET RNA, such as BINDING SITE I, BINDING SITE II and BINDING SITE III, inhibits translation of VGAM923 host target RNA into VGAM923 host target protein, herein designated VGAM HOST TARGET PROTEIN. VGAM host target protein is therefore outlined by a broken line.

It is appreciated that VGAM923 host target gene, herein designated VGAM HOST TARGET GENE, in fact represents a plurality of VGAM923 host target genes. The mRNA of each one of this plurality of VGAM923 host target genes comprises one or more host target binding sites, each having a nucleotide sequence which is at least partly complementary to VGAM923 RNA, herein designated VGAM RNA, and which when bound by VGAM923 RNA causes inhibition of translation of respective one or more VGAM923 host target proteins.

It is further appreciated by one skilled in the art that the mode of translational inhibition illustrated by FIG. 1 with specific reference to translational inhibition exerted by VGAM923 gene, herein designated VGAM GENE, on one or more VGAM923 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM923 is inhibition of expression of host target genes, as part of a novel viral mechanism of attacking a host. Accordingly, utilities of VGAM923 include diagnosis, prevention and treatment of viral infection by Peanut Clump Virus. Specific functions, and accordingly utilities, of VGAM923 correlate with, and may be deduced from, the identity of the host target genes which VGAM923 binds and inhibits, and the function of these host target genes, as elaborated hereinbelow.

Nucleotide sequences of the VGAM923 precursor RNA, herein designated VGAM PRECURSOR RNA, and of the 'diced' VGAM923 RNA, herein designated VGAM RNA, and a schematic representation of the secondary folding of VGAM923 folded precursor RNA, herein designated VGAM FOLDED PRECURSOR RNA, of VGAM923 are further described hereinbelow with reference to Table 1.

Nucleotide sequences of host target binding sites, such as BINDING SITE-I, BINDING SITE-II and BINDING SITE-III of FIG. 1, found on VGAM923 host target RNA, and schematic representation of the complementarity of each of these host target binding sites to VGAM923 RNA, herein designated VGAM RNA, are described hereinbelow with reference to Table 2.

As mentioned hereinabove with reference to FIG. 1, a function of VGAM923 gene, herein designated VGAM is inhibition of expression of VGAM923 target genes. It is appreciated that specific functions, and accordingly utilities, of VGAM923 correlate with, and may be deduced from, the identity of the target genes which VGAM923 binds and inhibits, and the function of these target genes, as elaborated hereinbelow.

A Disintegrin-like and Metalloprotease (reprolysin type) with Thrombospondin Type 1 Motif, 4 (ADAMTS4, Accession NM_005099) is a VGAM923 host target gene. ADAMTS4 BINDING SITE is HOST TARGET binding site found in the 3' untranslated region of mRNA encoded by ADAMTS4, corresponding to a HOST TARGET binding site such as BINDING SITE I, BINDING SITE II or BINDING SITE III. Table 2 illustrates the complementarity of the nucleotide sequences of ADAMTS4 BINDING SITE, designated SEQ ID:11565, to the nucleotide sequence of VGAM923 RNA, herein designated VGAM RNA, also designated SEQ ID:3634.

A function of VGAM923 is therefore inhibition of A Disintegrin-like and Metalloprotease (reprolysin type) with Thrombospondin Type 1 Motif, 4 (ADAMTS4, Accession NM_005099), a gene which cleaves aggrecan, a cartilage proteoglycan, and may be involved in its turnover. Accordingly, utilities of VGAM923 include diagnosis, prevention and treatment of diseases and clinical conditions associated with ADAMTS4. The function of ADAMTS4 and its association with various diseases and clinical conditions, has been established by previous studies, as described hereinabove with reference to VGAM809. Adenylate Cyclase 6 (ADCY6, Accession NM_015270) is another VGAM923 host target gene. ADCY6 BINDING SITE is HOST TARGET binding site found in the 5' untranslated region of mRNA encoded by ADCY6, corresponding to a HOST TARGET binding site such as BINDING SITE I, BINDING SITE II or BINDING SITE III. Table 2 illustrates the complementarity of the nucleotide sequences of ADCY6 BINDING SITE, designated SEQ ID:17584, to the nucleotide sequence of VGAM923 RNA, herein designated VGAM RNA, also designated SEQ ID:3634.

Another function of VGAM923 is therefore inhibition of Adenylate Cyclase 6 (ADCY6, Accession NM_015270), a gene which this a membrane-bound, ca (2+)-inhibitable adenylyl cyclase (by similarity). Accordingly, utilities of VGAM923 include diagnosis, prevention and treatment of diseases and clinical conditions associated with ADCY6. The function of ADCY6 and its association with various diseases and clinical conditions, has been established by previous studies, as described hereinabove with reference to VGAM22. Apoptotic Protease Activating Factor (APAF1, Accession NM_013229) is another VGAM923 host target gene. APAF1 BINDING SITE1 and APAF1 BINDING SITE2 are HOST TARGET binding sites found in untranslated regions of mRNA encoded by APAF1, corresponding to HOST TARGET binding sites such as BINDING SITE I, BINDING SITE II or BINDING SITE III. Table 2 illustrates the complementarity of the nucleotide sequences of APAF1 BINDING SITE1 and APAF1 BINDING SITE2, designated SEQ ID:14866 and SEQ ID:6827 respectively, to the nucleotide sequence of VGAM923 RNA, herein designated VGAM RNA, also designated SEQ ID:3634.

Another function of VGAM923 is therefore inhibition of Apoptotic Protease Activating Factor (APAF1, Accession NM_013229), a gene which functions in the mitochondrial apoptotic pathway that leads to caspase 9 dependent activation of caspase 3. Accordingly, utilities of VGAM923 include diagnosis, prevention and treatment of diseases and clinical conditions associated with APAF1. The function of APAF1 and its association with various diseases and clinical conditions, has been established by previous studies, as described hereinabove with reference to VGAM552. Coronin, Actin Binding Protein, 2B (CORO2B, Accession XM_035403) is another VGAM923 host target gene. CORO2B BINDING SITE is HOST TARGET binding site found in the 5' untranslated region of mRNA encoded by CORO2B, corresponding to a HOST TARGET binding site such as BINDING SITE I, BINDING SITE II or BINDING SITE III. Table 2 illustrates the complementarity of the nucleotide sequences of CORO2B BINDING SITE, designated SEQ ID:32252, to the nucleotide sequence of VGAM923 RNA, herein designated VGAM RNA, also designated SEQ ID:3634.

Another function of VGAM923 is therefore inhibition of Coronin, Actin Binding Protein, 2B (CORO2B, Accession XM_035403), a gene which may play a role in the reorganization of neuronal actin structure. Accordingly, utilities of VGAM923 include diagnosis, prevention and treatment of diseases and clinical conditions associated with CORO2B. The function of CORO2B has been established by previous studies. The Dictyostelium actin-binding protein coronin accumulates at the leading edges of motile cells and in crown-shaped extensions on the dorsal cell surface. Coronin is involved in cell motility, cytokinesis, and phagocytosis, all of which depend on cytoskeletal rearrangement; see CORO1A (OMIM Ref. No. 605000). By screening a frontal cortex cDNA library with a brain-enriched clone showing similarity to Dictyostelium coronin, Nakamura et al. (1999) isolated a full-length cDNA encoding CORO2B, which they called CLIPINC. The predicted 475-amino acid CORO2B protein has an N-terminal domain containing 5 WD repeats and a succeeding domain with a tendency to form alpha helices. Northern blot analysis detected abundant expression of an approximately 4.0-kb CORO2B transcript in brain, with moderate expression in heart and ovary, and little or no expression in other tissues tested. In contrast, CORO1A is primarily expressed in immune system tissues, and CORO2A (OMIM Ref. No. 602159) is predominantly expressed in colon, prostate, and testis. Immunohistochemical analysis revealed Coro2a expression in mouse cerebral cortex, hippocampus, thalamus, olfactory bulb, and cerebellum, as well as in the inner nuclear layer of embryonic retina and embryonic olfactory bulb. Cosedimentation analysis demonstrated that CORO2B associates with F-actin. Immunofluorescence analysis indicated that CORO2B accumulates at neurite tips, at focal adhesions in association with VCL (OMIM Ref. No. 193065), and along stress fibers.

Full details of the abovementioned studies are described in the following publications, the disclosure of which are hereby incorporated by reference:

Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human genes. XIII. The complete sequences of 100 new cDNA clones from brain which code for large proteins in vitro. DNA Res. 6:63-70, 1999; and Nakamura, T.; Takeuchi, K.; Muraoka, S.; Takezoe, H.; Takahashi, N.; Mori, N.: A neurally enriched coronin-like protein, ClipnC, is a novel candidate for an actin cytoskeleton-cortical.

Further studies establishing the function and utilities of CORO2B are found in John Hopkins OMIM database record ID 605002, and in sited publications numbered 8593 listed in the bibliography section hereinbelow, which are also hereby incorporated by reference. Cytochrome P450, Subfamily VIIIB (sterol 12-alpha-hydroxylase), Polypeptide 1 (CYP8B1, Accession NM_004391) is another VGAM923 host target gene. CYP8B1 BINDING SITE is HOST TARGET binding site found in the 3' untranslated region of mRNA encoded by CYP8B1, corresponding to a HOST TARGET binding site such as BINDING SITE I, BINDING SITE II or BINDING SITE III. Table 2 illustrates the complementarity of the nucleotide sequences of CYP8B1 BINDING SITE, designated SEQ ID:10619, to the nucleotide sequence of VGAM923 RNA, herein designated VGAM RNA, also designated SEQ ID:3634.

Another function of VGAM923 is therefore inhibition of Cytochrome P450, Subfamily VIIIB (sterol 12-alpha-hydroxylase), Polypeptide 1 (CYP8B1, Accession NM_004391), a gene which functions in bile acid biosynthesis. Accordingly, utilities of VGAM923 include diagnosis, prevention and treatment of diseases and clinical conditions associated with CYP8B1. The function of CYP8B1 has been established by previous studies. Zhang and Chiang (2001) showed that hepatocyte nuclear factor-4-alpha (HNF4A; 600281) strongly activates CYP8B1 promoter activity, whereas CYP7A promoter-binding factor (CPF, or NR5A2; 604453) has much less effect. The promoter activities were strongly repressed by bile acid. EMSA and site-directed mutagenesis analysis indicated that HNF4A, CPF, and the bile acid response element have overlapping binding sites in CYP8B1. Mammalian 2-hybrid analysis demonstrated interaction of HNF4A with the small heterodimer partner (SHP; 604630). Functional analysis determined that SHP represses HNF4A-induced CYP8B1 transcription. Zhang and Chiang (2001) concluded that bile acids repress human CYP8B1 transcription by reducing the transactivation activity of HNF4A through the interaction of HNF4A with SHP and a reduction of HNF4A expression in liver. Gafvels et al. (1999) obtained cDNAs encoding human and mouse CYP8B1. The deduced 501-amino acid human CYP8B1 protein is approximately 75% identical to the mouse and rabbit proteins. It contains a hydrophobic, membrane-spanning N terminus and conserved oxygen-binding, steroidogenic, and heme-binding segments. Northern blot analysis revealed expression of a 3.9-kb CYP8B1 transcript in liver. In mouse, expression was restricted to liver.

Full details of the abovementioned studies are described in the following publications, the disclosure of which are hereby incorporated by reference:

Gafvels, M.; Olin, M.; Chowdhary, B. P.; Raudsepp, T.; Andersson, U.; Persson, B.; Jansson, M.; Bjorkhem, I.; Eggertsen, G.: Structure and chromosomal assignment of the sterol 12-alpha-hydroxylase gene (CYP8B1) in human and mouse: eukaryotic cytochrome P-450 gene devoid of introns. Genomics 56:184-196, 1999; and Zhang, M.; Chiang, J. Y. L.: Transcriptional regulation of the human sterol 12-alpha-hydroxylase gene (CYP8B1): roles of hepatocyte nuclear factor 4-alpha in mediating bile acid repre.

Further studies establishing the function and utilities of CYP8B1 are found in John Hopkins OMIM database record ID 602172, and in sited publications numbered 5994-5996 listed in the bibliography section hereinbelow, which are also hereby incorporated by reference. Fc Fragment of IgA, Receptor For (FCAR, Accession NM_133279) is another VGAM923 host target gene. FCAR BINDING SITE is HOST TARGET binding site found in the 3' untranslated region of mRNA encoded by FCAR, corresponding to a HOST TARGET binding site such as BINDING SITE I, BINDING SITE II or BINDING SITE III. Table 2 illustrates the complementarity of the nucleotide sequences of FCAR BINDING SITE, designated SEQ ID:28432, to the nucleotide sequence of VGAM923 RNA, herein designated VGAM RNA, also designated SEQ ID:3634.

Another function of VGAM923 is therefore inhibition of Fc Fragment of IgA, Receptor For (FCAR, Accession NM_133279), a gene which binds to the fc region of immunoglobulins alpha and mediates several functions including cytokine production. Accordingly, utilities of VGAM923 include diagnosis, prevention and treatment of diseases and clinical conditions associated with FCAR. The function of FCAR has been established by previous studies. Human Fc-alpha receptor (FCAR) is present on a number of cell types, including neutrophils, monocytes, macrophages, and eosinophils. FCAR interacts with aggregated IgAs, such as IgA coated on the surface of an invading microorganism, and mediates several immunologic defense processes such as phagocytosis, antibody-dependent cell-mediated cytotoxicity, and stimulation of the release of inflammatory mediators. FCAR is a glycoprotein of 50 to 100 kD, with diversity on different cell types. Narita et al. (2001) examined polymorphisms in the promoter and 5-prime untranslated region of the FCAR gene in 151 patients with IgA nephropathy and 163 patients with other glomerular diseases shown to have no mesangial IgA deposition by renal biopsy. Haplotype analysis showed tight linkage disequilibrium among the polymorphisms. No significant association for the genotype, allele, and haplotype frequencies of the polymorphisms were shown between the patients with histologically proven IgA nephropathy and those with other glomerular diseases. Thus, the analyzed polymorphisms did not appear to be primarily involved in susceptibility to IgA nephropathy.

Full details of the abovementioned studies are described in the following publications, the disclosure of which are hereby incorporated by reference:

Narita, I.; Goto, S.; Saito, N.; Sakatsume, M.; Jin, S.; Omori, K.; Gejyo, F.: Genetic polymorphisms in the promoter and 5-prime UTR region of the Fc alpha receptor (CD89) are not associated with a risk of IgA nephropathy. J. Hum. Genet. 46:694-698, 2001; and Maliszewski, C. R.; March, C. J.; Schoenborn, M. A.; Gimpel, S.; Shen, L.: Expression cloning of a human Fc receptor for IgA. J. Exp. Med. 172:1665-1672, 1990.

Further studies establishing the function and utilities of FCAR are found in John Hopkins OMIM database record ID 147045, and in sited publications numbered 3162-3164, 3158-316 and 3165-3166 listed in the bibliography section hereinbelow, which are also hereby incorporated by reference. GM2 Ganglioside Activator Protein (GM2A, Accession XM_041978) is another VGAM923 host target gene. GM2A BINDING SITE is HOST TARGET binding site found in the 3' untranslated region of mRNA encoded by GM2A, corresponding to a HOST TARGET binding site such as BINDING SITE I, BINDING SITE II or BINDING SITE III. Table 2 illustrates the complementarity of the nucleotide sequences of GM2A BINDING SITE, designated SEQ ID:33656, to the nucleotide sequence of VGAM923 RNA, herein designated VGAM RNA, also designated SEQ ID:3634.

Another function of VGAM923 is therefore inhibition of GM2 Ganglioside Activator Protein (GM2A, Accession XM_041978). Accordingly, utilities of VGAM923 include diagnosis, prevention and treatment of diseases and clinical conditions associated with GM2A. G Protein-coupled Receptor 81 (GPR81, Accession NM_032554) is another VGAM923 host target gene. GPR81 BINDING SITE is HOST TARGET binding site found in the 3' untranslated region of mRNA encoded by GPR81, corresponding to a HOST TARGET binding site such as BINDING SITE I, BINDING SITE II or BINDING SITE III. Table 2 illustrates the complementarity of the nucleotide sequences of GPR81 BINDING SITE, designated SEQ ID:26278, to the nucleotide sequence of VGAM923 RNA, herein designated VGAM RNA, also designated SEQ ID:3634.

Another function of VGAM923 is therefore inhibition of G Protein-coupled Receptor 81 (GPR81, Accession NM_032554). Accordingly, utilities of VGAM923 include diagnosis, prevention and treatment of diseases and clinical conditions associated with GPR81. HCS (Accession NM_018947) is another VGAM923 host target gene. HCS BINDING SITE is HOST TARGET binding site found in the 3' untranslated region of mRNA encoded by HCS, corresponding to a HOST TARGET binding site such as BINDING SITE I, BINDING SITE II or BINDING SITE III. Table 2 illustrates the complementarity of the nucleotide sequences of HCS BINDING SITE, designated SEQ ID:21013, to the nucleotide sequence of VGAM923 RNA, herein designated VGAM RNA, also designated SEQ ID:3634.

Another function of VGAM923 is therefore inhibition of HCS (Accession NM_018947). Accordingly, utilities of VGAM923 include diagnosis, prevention and treatment of diseases and clinical conditions associated with HCS. Interleukin 11 (IL11, Accession NM_000641) is another VGAM923 host target gene. IL11 BINDING SITE is HOST TARGET binding site found in the 3' untranslated region of mRNA encoded by IL11, corresponding to a HOST TARGET binding site such as BINDING SITE I, BINDING SITE II or BINDING SITE III. Table 2 illustrates the complementarity of the nucleotide sequences of IL11 BINDING SITE, designated SEQ ID:6277, to the nucleotide sequence of VGAM923 RNA, herein designated VGAM RNA, also designated SEQ ID:3634.

Another function of VGAM923 is therefore inhibition of Interleukin 11 (IL11, Accession NM_000641), a gene which stimulates the proliferation of hematopoietic stem cells and megakaryocyte progenitor cells and induces megakaryocyte maturation. Accordingly, utilities of VGAM923 include diagnosis, prevention and treatment of diseases and clinical conditions associated with IL11. The function of IL11 and its association with various diseases and clinical conditions, has been established by previous studies, as described hereinabove with reference to VGAM178. NAD(P)H Dehydrogenase, Quinone 1 (NQO1, Accession NM_000903) is another VGAM923 host target gene. NQO1 BINDING SITE is HOST TARGET binding site found in the 3' untranslated region of mRNA encoded by NQO1, corresponding to a HOST TARGET binding site such as BINDING SITE I, BINDING SITE II or BINDING SITE III. Table 2 illustrates the complementarity of the nucleotide sequences of NQO1 BINDING SITE, designated SEQ ID:6605, to the nucleotide sequence of VGAM923 RNA, herein designated VGAM RNA, also designated SEQ ID:3634.

Another function of VGAM923 is therefore inhibition of NAD(P)H Dehydrogenase, Quinone 1 (NQO1, Accession NM_000903), a gene which is cytochrome b5 reductase which reduces redox dyes and quinones. Accordingly, utilities of VGAM923 include diagnosis, prevention and treatment of diseases and clinical conditions associated with NQO1. The function of NQO1 has been established by previous studies. By study of man-mouse somatic cell hybrids, Grzeschik (1980) and Povey et al. (1980) identified a fourth diaphorase locus (DIA4) which segregates with chromosome 16. The regional assignment was 16q12-q22 (smallest region of overlap, SRO). Edwards et al. (1983) showed that the quantitative polymorphism of DIA4 can be attributed to the segregation of a 'low activity' allele. In 4 to 6% of persons there is a DIA4-absent phenotype. In a series of human/hamster hybrids, made using a human parental cell heterozygous for both phosphoglycolate phosphatase (PGP; 172280) and DIA4, the low activity allele and the PGP(2) allele cosegregated except in 2 of 16 discordant hybrids. DIA4 is presumably the same as NAD(P)H:menadione oxidoreductase (NMOR1). Jaiswal et al. (1988) showed that tetrachlorodibenzo-p-dioxin (TCDD) treatment of a human hepatoblastoma cell produced a 5-fold induction of NMOR1 activity. They isolated several overlapping human NMOR1 cDNAs. Southern blot analysis of human genomic DNA suggested the presence of a single NMOR1 gene approximately 10 kb long. They identified 4 potential polyadenylation sites and found 3 mRNAs in human cells. The 3 mRNA species appeared to be differentially regulated following TCDD treatment. By means of Southern blot analysis of genomic DNA from human/rodent somatic cell hybrids, Jaiswal et al. (1988) demonstrated that the gene is located on chromosome 16, consistent with the assignment of DIA4 to that chromosome. By means of mouse/human somatic cell hybrids containing rearranged chromosome 16 together with multiple probes, Chen et al. (1991) assigned the NMOR1 locus to 16q22.1. Animal model experiments lend further support to the function of NQO1. Radjendirane et al. (1998) generated Nqo1-null mice by targeted disruption. Mice lacking NQO1 gene expression were indistinguishable from wildtype mice. However, Nqo1-null mice exhibited increased toxicity when administered menadione compared with wildtype mice. These results established a role for NQO1 in protection against quinone toxicity.

It is appreciated that the abovementioned animal model for NQO1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Jaiswal, A. K.; McBride, O. W.; Adesnik, M.; Nebert, D. W.: Human dioxin-inducible cytosolic NAD(P)H:menadione oxidoreductase: cDNA sequence and localization of gene to chromosome 16. J. Biol. Chem. 263:13572-13578, 1988; and Radjendirane, V.; Joseph, P.; Lee, Y.-H.; Kimura, S.; Klein-Szanto, A. J. P.; Gonzalez, F. J.; Jaiswal, A. K.: Disruption of the DT diaphorase (NQO1) gene in mice leads to increased me.

Further studies establishing the function and utilities of NQO1 are found in John Hopkins OMIM database record ID 125860, and in sited publications numbered 11858-11867, 1187 and 11868-11872 listed in the bibliography section hereinbelow, which are also hereby incorporated by reference. Phosphoribosylaminoimidazole Carboxylase, Phosphoribosylaminoimidazole Succinocarboxamide Synthetase (PAICS, Accession NM_006452) is another VGAM923 host target gene. PAICS BINDING SITE is HOST TARGET binding site found in the 3' untranslated region of mRNA encoded by PAICS, corresponding to a HOST TARGET binding site such as BINDING SITE I, BINDING SITE II or BINDING SITE III. Table 2 illustrates the complementarity of the nucleotide sequences of PAICS BINDING SITE, designated SEQ ID:13161, to the nucleotide sequence of VGAM923 RNA, herein designated VGAM RNA, also designated SEQ ID:3634.

Another function of VGAM923 is therefore inhibition of Phosphoribosylaminoimidazole Carboxylase, Phosphoribosylaminoimidazole Succinocarboxamide Synthetase (PAICS, Accession NM_006452), a gene which is required for purine biosynthesis. Accordingly, utilities of VGAM923 include diagnosis, prevention and treatment of diseases and clinical conditions associated with PAICS. The function of PAICS and its association with various diseases and clinical conditions, has been established by previous studies, as described hereinabove with reference to VGAM894. Protocadherin Alpha 9 (PCDHA9, Accession NM_014005) is another VGAM923 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:15206, to the nucleotide sequence of VGAM923 RNA, herein designated VGAM RNA, also designated SEQ ID:3634.

Another function of VGAM923 is therefore inhibition of Protocadherin Alpha 9 (PCDHA9, Accession NM_014005), a gene which is a calcium-dependent cell-adhesion protein. Accordingly, utilities of VGAM923 include diagnosis, prevention and treatment of diseases and clinical conditions associated with PCDHA9. The function of PCDHA9 and its association with various diseases and clinical conditions, has been established by previous studies, as described hereinabove with reference to VGAM71. Phosphoinositide-3-kinase, Class 2, Beta Polypeptide (PIK3C2B, Accession NM_002646) is another VGAM923 host target gene. PIK3C2B BINDING SITE is HOST TARGET binding site found in the 3' untranslated region of mRNA encoded by PIK3C2B, corresponding to a HOST TARGET binding site such as BINDING SITE I, BINDING SITE II or BINDING SITE III. Table 2 illustrates the complementarity of the nucleotide sequences of PIK3C2B BINDING SITE, designated SEQ ID:8503, to the nucleotide sequence of VGAM923 RNA, herein designated VGAM RNA, also designated SEQ ID:3634.

Another function of VGAM923 is therefore inhibition of Phosphoinositide-3-kinase, Class 2, Beta Polypeptide (PIK3C2B, Accession NM_002646). Accordingly, utilities of VGAM923 include diagnosis, prevention and treatment of diseases and clinical conditions associated with PIK3C2B. Rhesus Blood Group, D Antigen (RHD, Accession NM_016124) is another VGAM923 host target gene. RHD BINDING SITE1 and RHD BINDING SITE2 are HOST TARGET binding sites found in untranslated regions of mRNA encoded by RHD, corresponding to HOST TARGET binding sites such as BINDING SITE I, BINDING SITE II or BINDING SITE III. Table 2 illustrates the complementarity of the nucleotide sequences of RHD BINDING SITE1 and RHD BINDING SITE2, designated SEQ ID:18213 and SEQ ID:18333 respectively, to the nucleotide sequence of VGAM923 RNA, herein designated VGAM RNA, also designated SEQ ID:3634.

Another function of VGAM923 is therefore inhibition of Rhesus Blood Group, D Antigen (RHD, Accession NM_016124), a gene which Major antigen of the RH system. Accordingly, utilities of VGAM923 include diagnosis, prevention and treatment of diseases and clinical conditions associated with RHD. The function of RHD and its association with various diseases and clinical conditions, has been established by previous studies, as described hereinabove with reference to VGAM74. Sex Comb On Midleg-like 2 (Drosophila) (SCML2, Accession NM_006089) is another VGAM923 host target gene. SCML2 BINDING SITE is HOST TARGET binding site found in the 3' untranslated region of mRNA encoded by SCML2, corresponding to a HOST TARGET binding site such as BINDING SITE I, BINDING SITE II or BINDING SITE III. Table 2 illustrates the complementarity of the nucleotide sequences of SCML2 BINDING SITE, designated SEQ ID:12734, to the nucleotide sequence of VGAM923 RNA, herein designated VGAM RNA, also designated SEQ ID:3634.

Another function of VGAM923 is therefore inhibition of Sex Comb On Midleg-like 2 (Drosophila) (SCML2, Accession NM_006089). Accordingly, utilities of VGAM923 include diagnosis, prevention and treatment of diseases and clinical conditions associated with SCML2. Spondyloepiphyseal Dysplasia, Late (SEDL, Accession NM_014563) is another VGAM923 host target gene. SEDL BINDING SITE1 through SEDL BINDING SITE3 are HOST TARGET binding sites found in untranslated regions of mRNA encoded by SEDL, corresponding to HOST TARGET binding sites such as BINDING SITE I, BINDING SITE II or BINDING SITE III. Table 2 illustrates the complementarity of the nucleotide sequences of SEDL BINDING SITE1 through SEDL BINDING SITE3, designated SEQ ID:15900, SEQ ID:15901 and SEQ ID:15899 respectively, to the nucleotide sequence of VGAM923 RNA, herein designated VGAM RNA, also designated SEQ ID:3634.

Another function of VGAM923 is therefore inhibition of Spondyloepiphyseal Dysplasia, Late (SEDL, Accession NM_014563), a gene which may play role in vesicular transport from endoplasmic reticulum to golgi. Accordingly, utilities of VGAM923 include diagnosis, prevention and treatment of diseases and clinical conditions associated with SEDL. The function of SEDL and its association with various diseases and clinical conditions, has been established by previous studies, as described hereinabove with reference to VGAM74. Serine (or cysteine) Proteinase Inhibitor, Clade B (ovalbumin), Member 9 (SERPINB9, Accession NM_004155) is another VGAM923 host target gene. SERPINB9 BINDING SITE is HOST TARGET binding site found in the 3' untranslated region of mRNA encoded by SERPINB9, corresponding to a HOST TARGET binding site such as BINDING SITE I, BINDING SITE II or BINDING SITE III. Table 2 illustrates the complementarity of the nucleotide sequences of SERPINB9 BINDING SITE, designated SEQ ID:10357, to the nucleotide sequence of VGAM923 RNA, herein designated VGAM RNA, also designated SEQ ID:3634.

Another function of VGAM923 is therefore inhibition of Serine (or cysteine) Proteinase Inhibitor, Clade B (ovalbumin), Member 9 (SERPINB9, Accession NM_004155), a gene which may be a serpin serine protease inhibitor that interacts with granzyme B (GZMB). Accordingly, utilities of VGAM923 include diagnosis, prevention and treatment of diseases and clinical conditions associated with SERPINB9. The function of SERPINB9 and its association with various diseases and clinical conditions, has been established by previous studies, as described hereinabove with reference to VGAM60. Solute Carrier Family 24 (sodium/potassium/calcium exchanger), Member 1 (SLC24A1, Accession NM_004727) is another VGAM923 host target gene. SLC24A1 BINDING SITE is HOST TARGET binding site found in the 3' untranslated region of mRNA encoded by SLC24A1, corresponding to a HOST TARGET binding site such as BINDING SITE I, BINDING SITE II or BINDING SITE III. Table 2 illustrates the complementarity of the nucleotide sequences of SLC24A1 BINDING SITE, designated SEQ ID:11099, to the nucleotide sequence of VGAM923 RNA, herein designated VGAM RNA, also designated SEQ ID:3634.

Another function of VGAM923 is therefore inhibition of Solute Carrier Family 24 (sodium/potassium/calcium exchanger), Member 1 (SLC24A1, Accession NM_004727), a gene which is a critical component of the visual transduction cascade, controlling the calcium concentration of outer segments during light and darkness. Accordingly, utilities of VGAM923 include diagnosis, prevention and treatment of diseases and clinical conditions associated with SLC24A1. The function of SLC24A1 and its association with various diseases and clinical conditions, has been established by previous studies, as described hereinabove with reference to VGAM142. Tumor Necrosis Factor Receptor Superfamily, Member 10b (TNFRSF10B, Accession NM_003842) is another VGAM923 host target gene. TNFRSF10B BINDING SITE is HOST TARGET binding site found in the 3' untranslated region of mRNA encoded by TNFRSF10B, corresponding to a HOST TARGET binding site such as BINDING SITE I, BINDING SITE II or BINDING SITE III. Table 2 illustrates the complementarity of the nucleotide sequences of TNFRSF10B BINDING SITE, designated SEQ ID:9933, to the nucleotide sequence of VGAM923 RNA, herein designated VGAM RNA, also designated SEQ ID:3634.

Another function of VGAM923 is therefore inhibition of Tumor Necrosis Factor Receptor Superfamily, Member 10b (TNFRSF10B, Accession NM_003842), a gene which forms complex that induces apoptosis. Accordingly, utilities of VGAM923 include diagnosis, prevention and treatment of diseases and clinical conditions associated with TNFRSF10B. The function of TNFRSF10B and its association with various diseases and clinical conditions, has been established by previous studies, as described hereinabove with reference to VGAM400. AAK1 (Accession NM_014911) is another VGAM923 host target gene. AAK1 BINDING SITE is HOST TARGET binding site found in the 3' untranslated region of mRNA encoded by AAK1, corresponding to a HOST TARGET binding site such as BINDING SITE I, BINDING SITE II or BINDING SITE III. Table 2 illustrates the complementarity of the nucleotide sequences of AAK1 BINDING SITE, designated SEQ ID:17143, to the nucleotide sequence of VGAM923 RNA, herein designated VGAM RNA, also designated SEQ ID:3634.

Another function of VGAM923 is therefore inhibition of AAK1 (Accession NM_014911). Accordingly, utilities of VGAM923 include diagnosis, prevention and treatment of diseases and clinical conditions associated with AAK1. ADMP (Accession NM_145035) is another VGAM923 host target gene. ADMP BINDING SITE is HOST TARGET binding site found in the 3' untranslated region of mRNA encoded by ADMP, corresponding to a HOST TARGET binding site such as BINDING SITE I, BINDING SITE II or BINDING SITE III. Table 2 illustrates the complementarity of the nucleotide sequences of ADMP BINDING SITE, designated SEQ ID:29658, to the nucleotide sequence of VGAM923 RNA, herein designated VGAM RNA, also designated SEQ ID:3634.

Another function of VGAM923 is therefore inhibition of ADMP (Accession NM_145035). Accordingly, utilities of VGAM923 include diagnosis, prevention and treatment of diseases and clinical conditions associated with ADMP. Ankyrin Repeat and SOCS Box-containing 16 (ASB16, Accession XM_046024) is another VGAM923 host target gene. ASB16 BINDING SITE is HOST TARGET binding site found in the 5' untranslated region of mRNA encoded by ASB16, corresponding to a HOST TARGET binding site such as BINDING SITE I, BINDING SITE II or BINDING SITE III. Table 2 illustrates the complementarity of the nucleotide sequences of ASB16 BINDING SITE, designated SEQ ID:34652, to the nucleotide sequence of VGAM923 RNA, herein designated VGAM RNA, also designated SEQ ID:3634.

Another function of VGAM923 is therefore inhibition of Ankyrin Repeat and SOCS Box-containing 16 (ASB16, Accession XM_046024). Accordingly, utilities of VGAM923 include diagnosis, prevention and treatment of diseases and clinical conditions associated with ASB16. Chromosome 1 Open Reading Frame 34 (C1orf34, Accession XM_027172) is another VGAM923 host target gene. C1orf34 BINDING SITE is HOST TARGET binding site found in the 3' untranslated region of mRNA encoded by C1orf34, corresponding to a HOST TARGET binding site such as BINDING SITE I, BINDING SITE II or BINDING SITE III. Table 2 illustrates the complementarity of the nucleotide sequences of C1orf34 BINDING SITE, designated SEQ ID:30433, to the nucleotide sequence of VGAM923 RNA, herein designated VGAM RNA, also designated SEQ ID:3634.

Another function of VGAM923 is therefore inhibition of Chromosome 1 Open Reading Frame 34 (C1orf34, Accession XM_027172). Accordingly, utilities of VGAM923 include diagnosis, prevention and treatment of diseases and clinical conditions associated with C1orf34. CIP29 (Accession NM_032364) is another VGAM923 host target gene. CIP29 BINDING SITE is HOST TARGET binding site found in the 3' untranslated region of mRNA encoded by CIP29, corresponding to a HOST TARGET binding site such as BINDING SITE I, BINDING SITE II or BINDING SITE III. Table 2 illustrates the complementarity of the nucleotide sequences of CIP29 BINDING SITE, designated SEQ ID:26147, to the nucleotide sequence of VGAM923 RNA, herein designated VGAM RNA, also designated SEQ ID:3634.

Another function of VGAM923 is therefore inhibition of CIP29 (Accession NM_032364). Accordingly, utilities of VGAM923 include diagnosis, prevention and treatment of diseases and clinical conditions associated with CIP29. DKFZp434C0923 (Accession NM_017598) is another VGAM923 host target gene. DKFZp434C0923 BINDING SITE is HOST TARGET binding site found in the 3' untranslated region of mRNA encoded by DKFZp434C0923, corresponding to a HOST TARGET binding site such as BINDING SITE I, BINDING SITE II or BINDING SITE III. Table 2 illustrates the complementarity of the nucleotide sequences of DKFZp434C0923 BINDING SITE, designated SEQ ID:19061, to the nucleotide sequence of VGAM923 RNA, herein designated VGAM RNA, also designated SEQ ID:3634.

Another function of VGAM923 is therefore inhibition of DKFZp434C0923 (Accession NM_017598). Accordingly, utilities of VGAM923 include diagnosis, prevention and treatment of diseases and clinical conditions associated with DKFZp434C0923. DKFZP566I1024 (Accession XM_046506) is another VGAM923 host target gene. DKFZP566I1024 BINDING SITE is HOST TARGET binding site found in the 3' untranslated region of mRNA encoded by DKFZP566I1024, corresponding to a HOST TARGET binding site such as BINDING SITE I, BINDING SITE II or BINDING SITE III. Table 2 illustrates the complementarity of the nucleotide sequences of DKFZP566I1024 BINDING SITE, designated SEQ ID:34733, to the nucleotide sequence of VGAM923 RNA, herein designated VGAM RNA, also designated SEQ ID:3634.

Another function of VGAM923 is therefore inhibition of DKFZP566I1024 (Accession XM_046506). Accordingly, utilities of VGAM923 include diagnosis, prevention and treatment of diseases and clinical conditions associated with DKFZP566I1024. FLJ10535 (Accession NM_018129) is another VGAM923 host target gene. FLJ10535 BINDING SITE is HOST TARGET binding site found in the 3' untranslated region of mRNA encoded by FLJ10535, corresponding to a HOST TARGET binding site such as BINDING SITE I, BINDING SITE II or BINDING SITE III. Table 2 illustrates the complementarity of the nucleotide sequences of FLJ10535 BINDING SITE, designated SEQ ID:19915, to the nucleotide sequence of VGAM923 RNA, herein designated VGAM RNA, also designated SEQ ID:3634.

Another function of VGAM923 is therefore inhibition of FLJ10535 (Accession NM_018129). Accordingly, utilities of VGAM923 include diagnosis, prevention and treatment of diseases and clinical conditions associated with FLJ10535. FLJ10956 (Accession NM_018283) is another VGAM923 host target gene. FLJ10956 BINDING SITE is HOST TARGET binding site found in the 3' untranslated region of mRNA encoded by FLJ10956, corresponding to a HOST TARGET binding site such as BINDING SITE I, BINDING SITE II or BINDING SITE III. Table 2 illustrates the complementarity of the nucleotide sequences of FLJ10956 BINDING SITE, designated SEQ ID:20274, to the nucleotide sequence of VGAM923 RNA, herein designated VGAM RNA, also designated SEQ ID:3634.

Another function of VGAM923 is therefore inhibition of FLJ10956 (Accession NM_018283). Accordingly, utilities of VGAM923 include diagnosis, prevention and treatment of diseases and clinical conditions associated with FLJ10956. FLJ13072 (Accession XM_117117) is another VGAM923 host target gene. FLJ13072 BINDING SITE is HOST TARGET binding site found in the 5' untranslated region of mRNA encoded by FLJ13072, corresponding to a HOST TARGET binding site such as BINDING SITE I, BINDING SITE II or BINDING SITE III. Table 2 illustrates the complementarity of the nucleotide sequences of FLJ13072 BINDING SITE, designated SEQ ID:43231, to the nucleotide sequence of VGAM923 RNA, herein designated VGAM RNA, also designated SEQ ID:3634.

Another function of VGAM923 is therefore inhibition of FLJ13072 (Accession XM_117117). Accordingly, utilities of VGAM923 include diagnosis, prevention and treatment of diseases and clinical conditions associated with FLJ13072. FLJ13952 (Accession NM_024798) is another VGAM923 host target gene. FLJ13952 BINDING SITE is HOST TARGET binding site found in the 3' untranslated region of mRNA encoded by FLJ13952, corresponding to a HOST TARGET binding site such as BINDING SITE I, BINDING SITE II or BINDING SITE III. Table 2 illustrates the complementarity of the nucleotide sequences of FLJ13952 BINDING SITE, designated SEQ ID:24175, to the nucleotide sequence of VGAM923 RNA, herein designated VGAM RNA, also designated SEQ ID:3634.

Another function of VGAM923 is therefore inhibition of FLJ13952 (Accession NM_024798). Accordingly, utilities of VGAM923 include diagnosis, prevention and treatment of diseases and clinical conditions associated with FLJ13952. FLJ14803 (Accession NM_032842) is another VGAM923 host target gene. FLJ14803 BINDING SITE is HOST TARGET binding site found in the 3' untranslated region of mRNA encoded by FLJ14803, corresponding to a HOST TARGET binding site such as BINDING SITE I, BINDING SITE II or BINDING SITE III. Table 2 illustrates the complementarity of the nucleotide sequences of FLJ14803 BINDING SITE, designated SEQ ID:26624, to the nucleotide sequence of VGAM923 RNA, herein designated VGAM RNA, also designated SEQ ID:3634.

Another function of VGAM923 is therefore inhibition of FLJ14803 (Accession NM_032842). Accordingly, utilities of VGAM923 include diagnosis, prevention and treatment of diseases and clinical conditions associated with FLJ14803.

FLJ20045 (Accession NM_017638) is another VGAM923 host target gene. FLJ20045 BINDING SITE is HOST TARGET binding site found in the 3' untranslated region of mRNA encoded by FLJ20045, corresponding to a HOST TARGET binding site such as BINDING SITE I, BINDING SITE II or BINDING SITE III. Table 2 illustrates the complementarity of the nucleotide sequences of FLJ20045 BINDING SITE, designated SEQ ID:19143, to the nucleotide sequence of VGAM923 RNA, herein designated VGAM RNA, also designated SEQ ID:3634.

Another function of VGAM923 is therefore inhibition of FLJ20045 (Accession NM_017638). Accordingly, utilities of VGAM923 include diagnosis, prevention and treatment of diseases and clinical conditions associated with FLJ20045.

FLJ20671 (Accession NM_017924) is another VGAM923 host target gene. FLJ20671 BINDING SITE is HOST TARGET binding site found in the 3' untranslated region of mRNA encoded by FLJ20671, corresponding to a HOST TARGET binding site such as BINDING SITE I, BINDING SITE II or BINDING SITE III. Table 2 illustrates the complementarity of the nucleotide sequences of FLJ20671 BINDING SITE, designated SEQ ID:19590, to the nucleotide sequence of VGAM923 RNA, herein designated VGAM RNA, also designated SEQ ID:3634.

Another function of VGAM923 is therefore inhibition of FLJ20671 (Accession NM_017924). Accordingly, utilities of VGAM923 include diagnosis, prevention and treatment of diseases and clinical conditions associated with FLJ20671.

FLJ22969 (Accession XM_044006) is another VGAM923 host target gene. FLJ22969 BINDING SITE is HOST TARGET binding site found in the 3' untranslated region of mRNA encoded by FLJ22969, corresponding to a HOST TARGET binding site such as BINDING SITE I, BINDING SITE II or BINDING SITE III. Table 2 illustrates the complementarity of the nucleotide sequences of FLJ22969 BINDING SITE, designated SEQ ID:34063, to the nucleotide sequence of VGAM923 RNA, herein designated VGAM RNA, also designated SEQ ID:3634.

Another function of VGAM923 is therefore inhibition of FLJ22969 (Accession XM_044006). Accordingly, utilities of VGAM923 include diagnosis, prevention and treatment of diseases and clinical conditions associated with FLJ22969.

FLJ23356 (Accession NM_032237) is another VGAM923 host target gene. FLJ23356 BINDING SITE is HOST TARGET binding site found in the 3' untranslated region of mRNA encoded by FLJ23356, corresponding to a HOST TARGET binding site such as BINDING SITE I, BINDING SITE II or BINDING SITE III. Table 2 illustrates the complementarity of the nucleotide sequences of FLJ23356 BINDING SITE, designated SEQ ID:25956, to the nucleotide sequence of VGAM923 RNA, herein designated VGAM RNA, also designated SEQ ID:3634.

Another function of VGAM923 is therefore inhibition of FLJ23356 (Accession NM_032237). Accordingly, utilities of VGAM923 include diagnosis, prevention and treatment of diseases and clinical conditions associated with FLJ23356.

GR6 (Accession NM_007354) is another VGAM923 host target gene. GR6 BINDING SITE is HOST TARGET binding site found in the 5' untranslated region of mRNA encoded by GR6, corresponding to a HOST TARGET binding site such as BINDING SITE I, BINDING SITE II or BINDING SITE III. Table 2 illustrates the complementarity of the nucleotide sequences of GR6 BINDING SITE, designated SEQ ID:14279, to the nucleotide sequence of VGAM923 RNA, herein designated VGAM RNA, also designated SEQ ID:3634.

Another function of VGAM923 is therefore inhibition of GR6 (Accession NM_007354). Accordingly, utilities of VGAM923 include diagnosis, prevention and treatment of diseases and clinical conditions associated with GR6.

HSPC065 (Accession NM_014157) is another VGAM923 host target gene. HSPC065 BINDING SITE1 and HSPC065 BINDING SITE2 are HOST TARGET binding sites found in untranslated regions of mRNA encoded by HSPC065, corresponding to HOST TARGET binding sites such as BINDING SITE I, BINDING SITE II or BINDING SITE III. Table 2 illustrates the complementarity of the nucleotide sequences of HSPC065 BINDING SITE1 and HSPC065 BINDING SITE2, designated SEQ ID:15447 and SEQ ID:15448 respectively, to the nucleotide sequence of VGAM923 RNA, herein designated VGAM RNA, also designated SEQ ID:3634.

Another function of VGAM923 is therefore inhibition of HSPC065 (Accession NM_014157). Accordingly, utilities of VGAM923 include diagnosis, prevention and treatment of diseases and clinical conditions associated with HSPC065.

KIAA0513 (Accession NM_014732) is another VGAM923 host target gene. KIAA0513 BINDING SITE is HOST TARGET binding site found in the 3' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16350, to the nucleotide sequence of VGAM923 RNA, herein designated VGAM RNA, also designated SEQ ID:3634.

Another function of VGAM923 is therefore inhibition of KIAA0513 (Accession NM_014732). Accordingly, utilities of VGAM923 include diagnosis, prevention and treatment of diseases and clinical conditions associated with KIAA0513.

KIAA0527 (Accession XM_171054) is another VGAM923 host target gene. KIAA0527 BINDING SITE is HOST TARGET binding site found in the 3' untranslated region of mRNA encoded by KIAA0527, corresponding to a HOST TARGET binding site such as BINDING SITE I, BINDING SITE II or BINDING SITE III. Table 2 illustrates the complementarity of the nucleotide sequences of KIAA0527 BINDING SITE, designated SEQ ID:45839, to the nucleotide sequence of VGAM923 RNA, herein designated VGAM RNA, also designated SEQ ID:3634.

Another function of VGAM923 is therefore inhibition of KIAA0527 (Accession XM_171054). Accordingly, utilities of VGAM923 include diagnosis, prevention and treatment of diseases and clinical conditions associated with KIAA0527.

KIAA1041 (Accession NM_014947) is another VGAM923 host target gene. KIAA1041 BINDING SITE is HOST TARGET binding site found in the 3' untranslated region of mRNA encoded by KIAA1041, corresponding to a HOST TARGET binding site such as BINDING SITE I, BINDING SITE II or BINDING SITE III. Table 2 illustrates the complementarity of the nucleotide sequences of KIAA1041 BINDING SITE, designated SEQ ID:17262, to the nucleotide sequence of VGAM923 RNA, herein designated VGAM RNA, also designated SEQ ID:3634.

Another function of VGAM923 is therefore inhibition of KIAA1041 (Accession NM_014947). Accordingly, utilities of VGAM923 include diagnosis, prevention and treatment of diseases and clinical conditions associated with KIAA1041.

KIAA1198 (Accession XM_032674) is another VGAM923 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31700, to the nucleotide sequence of VGAM923 RNA, herein designated VGAM RNA, also designated SEQ ID:3634.

Another function of VGAM923 is therefore inhibition of KIAA1198 (Accession XM_032674). Accordingly, utilities of VGAM923 include diagnosis, prevention and treatment of diseases and clinical conditions associated with KIAA1198. KIAA1200 (Accession XM_031054) is another VGAM923 host target gene. KIAA1200 BINDING SITE is HOST TARGET binding site found in the 3' untranslated region of mRNA encoded by KIAA1200, corresponding to a HOST TARGET binding site such as BINDING SITE I, BINDING SITE II or BINDING SITE III. Table 2 illustrates the complementarity of the nucleotide sequences of KIAA1200 BINDING SITE, designated SEQ ID:31261, to the nucleotide sequence of VGAM923 RNA, herein designated VGAM RNA, also designated SEQ ID:3634.

Another function of VGAM923 is therefore inhibition of KIAA1200 (Accession XM_031054). Accordingly, utilities of VGAM923 include diagnosis, prevention and treatment of diseases and clinical conditions associated with KIAA1200. KIAA1257 (Accession XM_031577) is another VGAM923 host target gene. KIAA1257 BINDING SITE is HOST TARGET binding site found in the 3' untranslated region of mRNA encoded by KIAA1257, corresponding to a HOST TARGET binding site such as BINDING SITE I, BINDING SITE II or BINDING SITE III. Table 2 illustrates the complementarity of the nucleotide sequences of KIAA1257 BINDING SITE, designated SEQ ID:31427, to the nucleotide sequence of VGAM923 RNA, herein designated VGAM RNA, also designated SEQ ID:3634.

Another function of VGAM923 is therefore inhibition of KIAA1257 (Accession XM_031577). Accordingly, utilities of VGAM923 include diagnosis, prevention and treatment of diseases and clinical conditions associated with KIAA1257. KIAA1655 (Accession XM_039442) is another VGAM923 host target gene. KIAA1655 BINDING SITE1 and KIAA1655 BINDING SITE2 are HOST TARGET binding sites found in untranslated regions of mRNA encoded by KIAA1655, corresponding to HOST TARGET binding sites such as BINDING SITE I, BINDING SITE II or BINDING SITE III. Table 2 illustrates the complementarity of the nucleotide sequences of KIAA1655 BINDING SITE1 and KIAA1655 BINDING SITE2, designated SEQ ID:33079 and SEQ ID:33080 respectively, to the nucleotide sequence of VGAM923 RNA, herein designated VGAM RNA, also designated SEQ ID:3634.

Another function of VGAM923 is therefore inhibition of KIAA1655 (Accession XM_039442). Accordingly, utilities of VGAM923 include diagnosis, prevention and treatment of diseases and clinical conditions associated with KIAA1655. KIAA1878 (Accession XM_166256) is another VGAM923 host target gene. KIAA1878 BINDING SITE is HOST TARGET binding site found in the 3' untranslated region of mRNA encoded by KIAA1878, corresponding to a HOST TARGET binding site such as BINDING SITE I, BINDING SITE II or BINDING SITE III. Table 2 illustrates the complementarity of the nucleotide sequences of KIAA1878 BINDING SITE, designated SEQ ID:44073, to the nucleotide sequence of VGAM923 RNA, herein designated VGAM RNA, also designated SEQ ID:3634.

Another function of VGAM923 is therefore inhibition of KIAA1878 (Accession XM_166256). Accordingly, utilities of VGAM923 include diagnosis, prevention and treatment of diseases and clinical conditions associated with KIAA1878. MGC13138 (Accession NM_033410) is another VGAM923 host target gene. MGC13138 BINDING SITE is HOST TARGET binding site found in the 3' untranslated region of mRNA encoded by MGC13138, corresponding to a HOST TARGET binding site such as BINDING SITE I, BINDING SITE II or BINDING SITE III. Table 2 illustrates the complementarity of the nucleotide sequences of MGC13138 BINDING SITE, designated SEQ ID:27231, to the nucleotide sequence of VGAM923 RNA, herein designated VGAM RNA, also designated SEQ ID:3634.

Another function of VGAM923 is therefore inhibition of MGC13138 (Accession NM_033410). Accordingly, utilities of VGAM923 include diagnosis, prevention and treatment of diseases and clinical conditions associated with MGC13138. MGC15606 (Accession NM_145037) is another VGAM923 host target gene. MGC15606 BINDING SITE is HOST TARGET binding site found in the 5' untranslated region of mRNA encoded by MGC15606, corresponding to a HOST TARGET binding site such as BINDING SITE I, BINDING SITE II or BINDING SITE III. Table 2 illustrates the complementarity of the nucleotide sequences of MGC15606 BINDING SITE, designated SEQ ID:29660, to the nucleotide sequence of VGAM923 RNA, herein designated VGAM RNA, also designated SEQ ID:3634.

Another function of VGAM923 is therefore inhibition of MGC15606 (Accession NM_145037). Accordingly, utilities of VGAM923 include diagnosis, prevention and treatment of diseases and clinical conditions associated with MGC15606. NADH Dehydrogenase (ubiquinone) 1, Subcomplex Unknown, 2, 14.5 kDa (NDUFC2, Accession NM_004549) is another VGAM923 host target gene. NDUFC2 BINDING SITE is HOST TARGET binding site found in the 3' untranslated region of mRNA encoded by NDUFC2, corresponding to a HOST TARGET binding site such as BINDING SITE I, BINDING SITE II or BINDING SITE III. Table 2 illustrates the complementarity of the nucleotide sequences of NDUFC2 BINDING SITE, designated SEQ ID:10893, to the nucleotide sequence of VGAM923 RNA, herein designated VGAM RNA, also designated SEQ ID:3634.

Another function of VGAM923 is therefore inhibition of NADH Dehydrogenase (ubiquinone) 1, Subcomplex Unknown, 2, 14.5 kDa (NDUFC2, Accession NM_004549). Accordingly, utilities of VGAM923 include diagnosis, prevention and treatment of diseases and clinical conditions associated with NDUFC2. PP1201 (Accession NM_022152) is another VGAM923 host target gene. PP1201 BINDING SITE is HOST TARGET binding site found in the 3' untranslated region of mRNA encoded by PP1201, corresponding to a HOST TARGET binding site such as BINDING SITE I, BINDING SITE II or BINDING SITE III. Table 2 illustrates the complementarity of the nucleotide sequences of PP1201 BINDING SITE, designated SEQ ID:22710, to the nucleotide sequence of VGAM923 RNA, herein designated VGAM RNA, also designated SEQ ID:3634.

Another function of VGAM923 is therefore inhibition of PP1201 (Accession NM_022152). Accordingly, utilities of VGAM923 include diagnosis, prevention and treatment of diseases and clinical conditions associated with PP1201. Solute Carrier Family 11 (proton-coupled divalent metal ion transporters), Member 2 (SLC11A2, Accession NM_000617) is another VGAM923 host target gene. SLC11A2 BINDING SITE is HOST TARGET binding site found in the 3' untranslated region of mRNA encoded by SLC11A2, corresponding to a HOST TARGET binding site such as BINDING SITE I, BINDING SITE II or BINDING SITE III. Table 2 illustrates the complementarity of the nucleotide sequences of SLC11A2 BINDING SITE, designated SEQ ID:6220, to the nucleotide sequence of VGAM923 RNA, herein designated VGAM RNA, also designated SEQ ID:3634.

Another function of VGAM923 is therefore inhibition of Solute Carrier Family 11 (proton-coupled divalent metal ion transporters), Member 2 (SLC11A2, Accession NM_000617). Accordingly, utilities of VGAM923 include diagnosis, prevention and treatment of diseases and clinical conditions associated with SLC11A2. Solute Carrier Family 12 (potassium/chloride transporters), Member 8 (SLC12A8, Accession NM_024628) is another VGAM923 host target gene. SLC12A8 BINDING SITE is HOST TARGET binding site found in the 3' untranslated region of mRNA encoded by SLC12A8, corresponding to a HOST TARGET binding site such as BINDING SITE I, BINDING SITE II or BINDING SITE III. Table 2 illustrates the complementarity of the nucleotide sequences of SLC12A8 BINDING SITE, designated SEQ ID:23892, to the nucleotide sequence of VGAM923 RNA, herein designated VGAM RNA, also designated SEQ ID:3634.

Another function of VGAM923 is therefore inhibition of Solute Carrier Family 12 (potassium/chloride transporters), Member 8 (SLC12A8, Accession NM_024628). Accordingly, utilities of VGAM923 include diagnosis, prevention and treatment of diseases and clinical conditions associated with SLC12A8. Tripartite Motif-containing 16 (TRIM16, Accession NM_006470) is another VGAM923 host target gene. TRIM16 BINDING SITE is HOST TARGET binding site found in the 3' untranslated region of mRNA encoded by TRIM16, corresponding to a HOST TARGET binding site such as BINDING SITE I, BINDING SITE II or BINDING SITE III. Table 2 illustrates the complementarity of the nucleotide sequences of TRIM16 BINDING SITE, designated SEQ ID:13194, to the nucleotide sequence of VGAM923 RNA, herein designated VGAM RNA, also designated SEQ ID:3634.

Another function of VGAM923 is therefore inhibition of Tripartite Motif-containing 16 (TRIM16, Accession NM_006470). Accordingly, utilities of VGAM923 include diagnosis, prevention and treatment of diseases and clinical conditions associated with TRIM16. Tripartite Motif-containing 5 (TRIM5, Accession NM_033034) is another VGAM923 host target gene. TRIM5 BINDING SITE is HOST TARGET binding site found in the 3' untranslated region of mRNA encoded by TRIM5, corresponding to a HOST TARGET binding site such as BINDING SITE I, BINDING SITE II or BINDING SITE III. Table 2 illustrates the complementarity of the nucleotide sequences of TRIM5 BINDING SITE, designated SEQ ID:26926, to the nucleotide sequence of VGAM923 RNA, herein designated VGAM RNA, also designated SEQ ID:3634.

Another function of VGAM923 is therefore inhibition of Tripartite Motif-containing 5 (TRIM5, Accession NM_033034). Accordingly, utilities of VGAM923 include diagnosis, prevention and treatment of diseases and clinical conditions associated with TRIM5. Vacuolar Protein Sorting 33A (yeast) (VPS33A, Accession NM_022916) is another VGAM923 host target gene. VPS33A BINDING SITE is HOST TARGET binding site found in the 3' untranslated region of mRNA encoded by VPS33A, corresponding to a HOST TARGET binding site such as BINDING SITE I, BINDING SITE II or BINDING SITE III. Table 2 illustrates the complementarity of the nucleotide sequences of VPS33A BINDING SITE, designated SEQ ID:23230, to the nucleotide sequence of VGAM923 RNA, herein designated VGAM RNA, also designated SEQ ID:3634.

Another function of VGAM923 is therefore inhibition of Vacuolar Protein Sorting 33A (yeast) (VPS33A, Accession NM_022916). Accordingly, utilities of VGAM923 include diagnosis, prevention and treatment of diseases and clinical conditions associated with VPS33A. LOC119392 (Accession NM_145247) is another VGAM923 host target gene. LOC119392 BINDING SITE is HOST TARGET binding site found in the 3' untranslated region of mRNA encoded by LOC119392, corresponding to a HOST TARGET binding site such as BINDING SITE I, BINDING SITE II or BINDING SITE III. Table 2 illustrates the complementarity of the nucleotide sequences of LOC119392 BINDING SITE, designated SEQ ID:29758, to the nucleotide sequence of VGAM923 RNA, herein designated VGAM RNA, also designated SEQ ID:3634.

Another function of VGAM923 is therefore inhibition of LOC119392 (Accession NM_145247). Accordingly, utilities of VGAM923 include diagnosis, prevention and treatment of diseases and clinical conditions associated with LOC119392. LOC128989 (Accession XM_059310) is another VGAM923 host target gene. LOC128989 BINDING SITE is HOST TARGET binding site found in the 3' untranslated region of mRNA encoded by LOC128989, corresponding to a HOST TARGET binding site such as BINDING SITE I, BINDING SITE II or BINDING SITE III. Table 2 illustrates the complementarity of the nucleotide sequences of LOC128989 BINDING SITE, designated SEQ ID:36938, to the nucleotide sequence of VGAM923 RNA, herein designated VGAM RNA, also designated SEQ ID:3634.

Another function of VGAM923 is therefore inhibition of LOC128989 (Accession XM_059310). Accordingly, utilities of VGAM923 include diagnosis, prevention and treatment of diseases and clinical conditions associated with LOC128989. LOC135154 (Accession XM_059752) is another VGAM923 host target gene. LOC135154 BINDING SITE is HOST TARGET binding site found in the 3' untranslated region of mRNA encoded by LOC135154, corresponding to a HOST TARGET binding site such as BINDING SITE I, BINDING SITE II or BINDING SITE III. Table 2 illustrates the complementarity of the nucleotide sequences of LOC135154 BINDING SITE, designated SEQ ID:37090, to the nucleotide sequence of VGAM923 RNA, herein designated VGAM RNA, also designated SEQ ID:3634.

Another function of VGAM923 is therefore inhibition of LOC135154 (Accession XM_059752). Accordingly, utilities of VGAM923 include diagnosis, prevention and treatment of diseases and clinical conditions associated with LOC135154. LOC147166 (Accession XM_085722) is another VGAM923 host target gene. LOC147166 BINDING SITE is HOST TARGET binding site found in the 3' untranslated region of mRNA encoded by LOC147166, corresponding to a HOST TARGET binding site such as BINDING SITE I, BINDING SITE II or BINDING SITE III. Table 2 illustrates the complementarity of the nucleotide sequences of LOC147166 BINDING SITE, designated SEQ ID:38312, to the nucleotide sequence of VGAM923 RNA, herein designated VGAM RNA, also designated SEQ ID:3634.

Another function of VGAM923 is therefore inhibition of LOC147166 (Accession XM_085722). Accordingly, utilities of VGAM923 include diagnosis, prevention and treatment of diseases and clinical conditions associated with LOC147166. LOC148195 (Accession XM_097419) is another VGAM923 host target gene. LOC148195 BINDING SITE is HOST TARGET binding site found in the 3' untranslated region of mRNA encoded by LOC148195, corresponding to a HOST TARGET binding site such as BINDING SITE I, BINDING SITE II or BINDING SITE III. Table 2 illustrates the complementarity of the nucleotide sequences of LOC148195 BINDING SITE, designated SEQ ID:40870, to the nucleotide sequence of VGAM923 RNA, herein designated VGAM RNA, also designated SEQ ID:3634.

Another function of VGAM923 is therefore inhibition of LOC148195 (Accession XM_097419). Accordingly, utilities of VGAM923 include diagnosis, prevention and treatment of diseases and clinical conditions associated with LOC148195. LOC149577 (Accession XM_097675) is another VGAM923 host target gene. LOC149577 BINDING SITE is HOST TARGET binding site found in the 3' untranslated region of mRNA encoded by LOC149577, corresponding to a HOST TARGET binding site such as BINDING SITE I, BINDING SITE II or BINDING SITE III. Table 2 illustrates the complementarity of the nucleotide sequences of LOC149577 BINDING SITE, designated SEQ ID:41020, to the nucleotide sequence of VGAM923 RNA, herein designated VGAM RNA, also designated SEQ ID:3634.

Another function of VGAM923 is therefore inhibition of LOC149577 (Accession XM_097675). Accordingly, utilities of VGAM923 include diagnosis, prevention and treatment of diseases and clinical conditions associated with LOC149577. LOC152343 (Accession XM_087441) is another VGAM923 host target gene. LOC152343 BINDING SITE is HOST TARGET binding site found in the 3' untranslated region of mRNA encoded by LOC152343, corresponding to a HOST TARGET binding site such as BINDING SITE I, BINDING SITE II or BINDING SITE III. Table 2 illustrates the complementarity of the nucleotide sequences of LOC152343 BINDING SITE, designated SEQ ID:39259, to the nucleotide sequence of VGAM923 RNA, herein designated VGAM RNA, also designated SEQ ID:3634.

Another function of VGAM923 is therefore inhibition of LOC152343 (Accession XM_087441). Accordingly, utilities of VGAM923 include diagnosis, prevention and treatment of diseases and clinical conditions associated with LOC152343. LOC152620 (Accession XM_011108) is another VGAM923 host target gene. LOC152620 BINDING SITE is HOST TARGET binding site found in the 3' untranslated region of mRNA encoded by LOC152620, corresponding to a HOST TARGET binding site such as BINDING SITE I, BINDING SITE II or BINDING SITE III. Table 2 illustrates the complementarity of the nucleotide sequences of LOC152620 BINDING SITE, designated SEQ ID:30170, to the nucleotide sequence of VGAM923 RNA, herein designated VGAM RNA, also designated SEQ ID:3634.

Another function of VGAM923 is therefore inhibition of LOC152620 (Accession XM_011108). Accordingly, utilities of VGAM923 include diagnosis, prevention and treatment of diseases and clinical conditions associated with LOC152620. LOC152719 (Accession XM_098257) is another VGAM923 host target gene. LOC152719 BINDING SITE is HOST TARGET binding site found in the 5' untranslated region of mRNA encoded by LOC152719, corresponding to a HOST TARGET binding site such as BINDING SITE I, BINDING SITE II or BINDING SITE III. Table 2 illustrates the complementarity of the nucleotide sequences of LOC152719 BINDING SITE, designated SEQ ID:41542, to the nucleotide sequence of VGAM923 RNA, herein designated VGAM RNA, also designated SEQ ID:3634.

Another function of VGAM923 is therefore inhibition of LOC152719 (Accession XM_098257). Accordingly, utilities of VGAM923 include diagnosis, prevention and treatment of diseases and clinical conditions associated with LOC152719. LOC158476 (Accession XM_098955) is another VGAM923 host target gene. LOC158476 BINDING SITE is HOST TARGET binding site found in the 3' untranslated region of mRNA encoded by LOC158476, corresponding to a HOST TARGET binding site such as BINDING SITE I, BINDING SITE II or BINDING SITE III. Table 2 illustrates the complementarity of the nucleotide sequences of LOC158476 BINDING SITE, designated SEQ ID:41993, to the nucleotide sequence of VGAM923 RNA, herein designated VGAM RNA, also designated SEQ ID:3634.

Another function of VGAM923 is therefore inhibition of LOC158476 (Accession XM_098955). Accordingly, utilities of VGAM923 include diagnosis, prevention and treatment of diseases and clinical conditions associated with LOC158476. LOC158549 (Accession XM_098963) is another VGAM923 host target gene. LOC158549 BINDING SITE is HOST TARGET binding site found in the 5' untranslated region of mRNA encoded by LOC158549, corresponding to a HOST TARGET binding site such as BINDING SITE I, BINDING SITE II or BINDING SITE III. Table 2 illustrates the complementarity of the nucleotide sequences of LOC158549 BINDING SITE, designated SEQ ID:42003, to the nucleotide sequence of VGAM923 RNA, herein designated VGAM RNA, also designated SEQ ID:3634.

Another function of VGAM923 is therefore inhibition of LOC158549 (Accession XM_098963). Accordingly, utilities of VGAM923 include diagnosis, prevention and treatment of diseases and clinical conditions associated with LOC158549. LOC161829 (Accession XM_091161) is another VGAM923 host target gene. LOC161829 BINDING SITE is HOST TARGET binding site found in the 3' untranslated region of mRNA encoded by LOC161829, corresponding to a HOST TARGET binding site such as BINDING SITE I, BINDING SITE II or BINDING SITE III. Table 2 illustrates the complementarity of the nucleotide sequences of LOC161829 BINDING SITE, designated SEQ ID:40035, to the nucleotide sequence of VGAM923 RNA, herein designated VGAM RNA, also designated SEQ ID:3634.

Another function of VGAM923 is therefore inhibition of LOC161829 (Accession XM_091161). Accordingly, utilities of VGAM923 include diagnosis, prevention and treatment of diseases and clinical conditions associated with LOC161829. LOC163590 (Accession NM_145034) is another VGAM923 host target gene. LOC163590 BINDING SITE is HOST TARGET binding site found in the 5' untranslated region of mRNA encoded by LOC163590, corresponding to a HOST TARGET binding site such as BINDING SITE I, BINDING SITE II or BINDING SITE III. Table 2 illustrates the complementarity of the nucleotide sequences of LOC163590 BINDING SITE, designated SEQ ID:29651, to the nucleotide sequence of VGAM923 RNA, herein designated VGAM RNA, also designated SEQ ID:3634.

Another function of VGAM923 is therefore inhibition of LOC163590 (Accession NM_145034). Accordingly, utilities of VGAM923 include diagnosis, prevention and treatment of diseases and clinical conditions associated with LOC163590. LOC202025 (Accession XM_117353) is another VGAM923 host target gene. LOC202025 BINDING SITE is HOST TARGET binding site found in the 3' untranslated region of mRNA encoded by LOC202025, corresponding to a HOST TARGET binding site such as BINDING SITE I, BINDING SITE II or BINDING SITE III. Table 2 illustrates the complementarity of the nucleotide sequences of LOC202025 BINDING SITE, designated SEQ ID:43398, to the nucleotide sequence of VGAM923 RNA, herein designated VGAM RNA, also designated SEQ ID:3634.

Another function of VGAM923 is therefore inhibition of LOC202025 (Accession XM_117353). Accordingly, utilities of VGAM923 include diagnosis, prevention and treatment of diseases and clinical conditions associated with LOC202025. LOC202908 (Accession XM_114602) is another VGAM923 host target gene. LOC202908 BINDING SITE is HOST TARGET binding site found in the 5' untranslated region of mRNA encoded by LOC202908, corresponding to a HOST TARGET binding site such as BINDING SITE I, BINDING SITE II or BINDING SITE III. Table 2 illustrates the complementarity of the nucleotide sequences of LOC202908 BINDING SITE, designated SEQ ID:42993, to the nucleotide sequence of VGAM923 RNA, herein designated VGAM RNA, also designated SEQ ID:3634.

Another function of VGAM923 is therefore inhibition of LOC202908 (Accession XM_114602). Accordingly, utilities of VGAM923 include diagnosis, prevention and treatment of diseases and clinical conditions associated with LOC202908. LOC202934 (Accession XM_117486) is another VGAM923 host target gene. LOC202934 BINDING SITE is HOST TARGET binding site found in the 3' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43451, to the nucleotide sequence of VGAM923 RNA, herein designated VGAM RNA, also designated SEQ ID:3634.

Another function of VGAM923 is therefore inhibition of LOC202934 (Accession XM_117486). Accordingly, utilities of VGAM923 include diagnosis, prevention and treatment of diseases and clinical conditions associated with LOC202934. LOC220662 (Accession XM_165978) is another VGAM923 host target gene. LOC220662 BINDING SITE is HOST TARGET binding site found in the 3' untranslated region of mRNA encoded by LOC220662, corresponding to a HOST TARGET binding site such as BINDING SITE I, BINDING SITE II or BINDING SITE III. Table 2 illustrates the complementarity of the nucleotide sequences of LOC220662 BINDING SITE, designated SEQ ID:43820, to the nucleotide sequence of VGAM923 RNA, herein designated VGAM RNA, also designated SEQ ID:3634.

Another function of VGAM923 is therefore inhibition of LOC220662 (Accession XM_165978). Accordingly, utilities of VGAM923 include diagnosis, prevention and treatment of diseases and clinical conditions associated with LOC220662. LOC222070 (Accession XM_168433) is another VGAM923 host target gene. LOC222070 BINDING SITE is HOST TARGET binding site found in the 5' untranslated region of mRNA encoded by LOC222070, corresponding to a HOST TARGET binding site such as BINDING SITE I, BINDING SITE II or BINDING SITE III. Table 2 illustrates the complementarity of the nucleotide sequences of LOC222070 BINDING SITE, designated SEQ ID:45175, to the nucleotide sequence of VGAM923 RNA, herein designated VGAM RNA, also designated SEQ ID:3634.

Another function of VGAM923 is therefore inhibition of LOC222070 (Accession XM_168433). Accordingly, utilities of VGAM923 include diagnosis, prevention and treatment of diseases and clinical conditions associated with LOC222070. LOC256306 (Accession XM_172976) is another VGAM923 host target gene. LOC256306 BINDING SITE is HOST TARGET binding site found in the 3' untranslated region of mRNA encoded by LOC256306, corresponding to a HOST TARGET binding site such as BINDING SITE I, BINDING SITE II or BINDING SITE III. Table 2 illustrates the complementarity of the nucleotide sequences of LOC256306 BINDING SITE, designated SEQ ID:46233, to the nucleotide sequence of VGAM923 RNA, herein designated VGAM RNA, also designated SEQ ID:3634.

Another function of VGAM923 is therefore inhibition of LOC256306 (Accession XM_172976). Accordingly, utilities of VGAM923 include diagnosis, prevention and treatment of diseases and clinical conditions associated with LOC256306. LOC51200 (Accession NM_016352) is another VGAM923 host target gene. LOC51200 BINDING SITE is HOST TARGET binding site found in the 3' untranslated region of mRNA encoded by LOC51200, corresponding to a HOST TARGET binding site such as BINDING SITE I, BINDING SITE II or BINDING SITE III. Table 2 illustrates the complementarity of the nucleotide sequences of LOC51200 BINDING SITE, designated SEQ ID:18478, to the nucleotide sequence of VGAM923 RNA, herein designated VGAM RNA, also designated SEQ ID:3634.

Another function of VGAM923 is therefore inhibition of LOC51200 (Accession NM_016352). Accordingly, utilities of VGAM923 include diagnosis, prevention and treatment of diseases and clinical conditions associated with LOC51200. LOC51219 (Accession NM_016418) is another VGAM923 host target gene. LOC51219 BINDING SITE is HOST TARGET binding site found in the 5' untranslated region of mRNA encoded by LOC51219, corresponding to a HOST TARGET binding site such as BINDING SITE I, BINDING SITE II or BINDING SITE III. Table 2 illustrates the complementarity of the nucleotide sequences of LOC51219 BINDING SITE, designated SEQ ID:18543, to the nucleotide sequence of VGAM923 RNA, herein designated VGAM RNA, also designated SEQ ID:3634.

Another function of VGAM923 is therefore inhibition of LOC51219 (Accession NM_016418). Accordingly, utilities of VGAM923 include diagnosis, prevention and treatment of diseases and clinical conditions associated with LOC51219. LOC90333 (Accession XM_030958) is another VGAM923 host target gene. LOC90333 BINDING SITE1 and LOC90333 BINDING SITE2 are HOST TARGET binding sites found in untranslated regions of mRNA encoded by LOC90333, corresponding to HOST TARGET binding sites such as BINDING SITE I, BINDING SITE II or BINDING SITE III. Table 2 illustrates the complementarity of the nucleotide sequences of LOC90333 BINDING SITE1 and LOC90333 BINDING SITE2, designated SEQ ID:31215 and SEQ ID:31216 respectively, to the nucleotide sequence of VGAM923 RNA, herein designated VGAM RNA, also designated SEQ ID:3634.

Another function of VGAM923 is therefore inhibition of LOC90333 (Accession XM_030958). Accordingly, utilities of VGAM923 include diagnosis, prevention and treatment of diseases and clinical conditions associated with LOC90333. LOC93408 (Accession NM_138403) is another VGAM923 host target gene. LOC93408 BINDING SITE is HOST TARGET binding site found in the 5' untranslated region of mRNA encoded by LOC93408, corresponding to a HOST TARGET binding site such as BINDING SITE I, BINDING SITE II or BINDING SITE III. Table 2 illustrates the complementarity of the nucleotide sequences of LOC93408 BINDING SITE, designated SEQ ID:28772, to the nucleotide sequence of VGAM923 RNA, herein designated VGAM RNA, also designated SEQ ID:3634.

Another function of VGAM923 is therefore inhibition of LOC93408 (Accession NM_138403). Accordingly, utilities of VGAM923 include diagnosis, prevention and treatment of diseases and clinical conditions associated with LOC93408. FIG. 1 further provides a conceptual description of a novel bioinformatically detected viral gene of the present invention, referred to here as Viral Genomic Address Messenger 924 (VGAM924) viral gene, which modulates expression of respective host target genes thereof, the function and utility of which host target genes is known in the art.

VGAM924 is a novel bioinformatically detected regulatory, non protein coding, viral micro RNA (miRNA) gene. The method by which VGAM924 was detected is described hereinabove with reference to FIGS. 1-8.

VGAM924 gene, herein designated VGAM GENE, is a viral gene contained in the genome of Infectious Spleen and Kidney Necrosis Virus. VGAM924 host target gene, herein designated VGAM HOST TARGET GENE, is a human gene contained in the human genome.

VGAM924 gene encodes a VGAM924 precursor RNA, herein designated VGAM PRECURSOR RNA. Similar to other miRNA genes, and unlike most ordinary genes, VGAM924 precursor RNA does not encode a protein. A nucleotide sequence identical or highly similar to the nucleotide sequence of VGAM924 precursor RNA is designated SEQ ID:910, and is provided hereinbelow with reference to the sequence listing part. Nucleotide sequence SEQ ID:910 is located at position 67724 relative to the genome of Infectious Spleen and Kidney Necrosis Virus.

VGAM924 precursor RNA folds onto itself, forming VGAM924 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM924 folded precursor RNA into VGAM924 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM924 RNA is designated SEQ ID:3635, and is provided hereinbelow with reference to the sequence listing part.

VGAM924 host target gene, herein designated VGAM HOST TARGET GENE, encodes a corresponding messenger RNA, VGAM924 host target RNA, herein designated VGAM HOST TARGET RNA. VGAM924 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM924 RNA, herein designated VGAM RNA, binds complementarily to one or more host target binding sites located in untranslated regions of VGAM924 host target RNA, herein designated VGAM HOST TARGET RNA. This complementary binding is due to the fact that the nucleotide sequence of VGAM924 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM924 RNA, herein designated VGAM RNA, may have a different number of host target binding sites in untranslated regions of a VGAM924 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM924 RNA, herein designated VGAM RNA, to host target binding sites on VGAM924 host target RNA, herein designated VGAM HOST TARGET RNA, such as BINDING SITE I, BINDING SITE II and BINDING SITE III, inhibits translation of VGAM924 host target RNA into VGAM924 host target protein, herein designated VGAM HOST TARGET PROTEIN. VGAM host target protein is therefore outlined by a broken line.

It is appreciated that VGAM924 host target gene, herein designated VGAM HOST TARGET GENE, in fact represents a plurality of VGAM924 host target genes. The mRNA of each one of this plurality of VGAM924 host target genes comprises one or more host target binding sites, each having a nucleotide sequence which is at least partly complementary to VGAM924 RNA, herein designated VGAM RNA, and which when bound by VGAM924 RNA causes inhibition of translation of respective one or more VGAM924 host target proteins.

It is further appreciated by one skilled in the art that the mode of translational inhibition illustrated by FIG. 1 with specific reference to translational inhibition exerted by VGAM924 gene, herein designated VGAM GENE, on one or more VGAM924 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM924 is inhibition of expression of host target genes, as part of a novel viral mechanism of attacking a host. Accordingly, utilities of VGAM924 include diagnosis, prevention and treatment of viral infection by Infectious Spleen and Kidney Necrosis Virus. Specific functions, and accordingly utilities, of VGAM924 correlate with, and may be deduced from, the identity of the host target genes which VGAM924 binds and inhibits, and the function of these host target genes, as elaborated hereinbelow.

Nucleotide sequences of the VGAM924 precursor RNA, herein designated VGAM PRECURSOR RNA, and of the 'diced' VGAM924 RNA, herein designated VGAM RNA, and a schematic representation of the secondary folding of VGAM924 folded precursor RNA, herein designated VGAM FOLDED PRECURSOR RNA, of VGAM924 are further described hereinbelow with reference to Table 1.

Nucleotide sequences of host target binding sites, such as BINDING SITE-I, BINDING SITE-II and BINDING SITE-III of FIG. 1, found on VGAM924 host target RNA, and schematic representation of the complementarity of each of these host target binding sites to VGAM924 RNA, herein designated VGAM RNA, are described hereinbelow with reference to Table 2.

As mentioned hereinabove with reference to FIG. 1, a function of VGAM924 gene, herein designated VGAM is inhibition of expression of VGAM924 target genes. It is appreciated that specific functions, and accordingly utilities, of VGAM924 correlate with, and may be deduced from, the identity of the target genes which VGAM924 binds and inhibits, and the function of these target genes, as elaborated hereinbelow.

Splicing Factor, Arginine/serine-rich 11 (SFRS11, Accession NM_004768) is a VGAM924 host target gene. SFRS11 BINDING SITE is HOST TARGET binding site found in the 3' untranslated region of mRNA encoded by SFRS11, corresponding to a HOST TARGET binding site such as BINDING SITE I, BINDING SITE II or BINDING SITE III. Table 2 illustrates the complementarity of the nucleotide sequences of SFRS11 BINDING SITE, designated SEQ ID:11159, to the nucleotide sequence of VGAM924 RNA, herein designated VGAM RNA, also designated SEQ ID:3635.

A function of VGAM924 is therefore inhibition of Splicing Factor, Arginine/serine-rich 11 (SFRS11, Accession NM_004768). Accordingly, utilities of VGAM924 include diagnosis, prevention and treatment of diseases and clinical conditions associated with SFRS11. LOC205251 (Accession XM_119554) is another VGAM924 host target gene. LOC205251 BINDING SITE is HOST TARGET binding site found in the 5' untranslated region of mRNA encoded by LOC205251, corresponding to a HOST TARGET binding site such as BINDING SITE I, BINDING SITE II or BINDING SITE III. Table 2 illustrates the complementarity of the nucleotide sequences of LOC205251 BINDING SITE, designated SEQ ID:43592, to the nucleotide sequence of VGAM924 RNA, herein designated VGAM RNA, also designated SEQ ID:3635.

Another function of VGAM924 is therefore inhibition of LOC205251 (Accession XM_119554). Accordingly, utilities of VGAM924 include diagnosis, prevention and treatment of diseases and clinical conditions associated with LOC205251. FIG. 1 further provides a conceptual description of a novel bioinformatically detected viral gene of the present invention, referred to here as Viral Genomic Address Messenger 925 (VGAM925) viral gene, which modulates expression of respective host target genes thereof, the function and utility of which host target genes is known in the art.

VGAM925 is a novel bioinformatically detected regulatory, non protein coding, viral micro RNA (miRNA) gene. The method by which VGAM925 was detected is described hereinabove with reference to FIGS. 1-8.

VGAM925 gene, herein designated VGAM GENE, is a viral gene contained in the genome of Infectious Spleen and Kidney Necrosis Virus. VGAM925 host target gene, herein designated VGAM HOST TARGET GENE, is a human gene contained in the human genome.

VGAM925 gene encodes a VGAM925 precursor RNA, herein designated VGAM PRECURSOR RNA. Similar to other miRNA genes, and unlike most ordinary genes, VGAM925 precursor RNA does not encode a protein. A nucleotide sequence identical or highly similar to the nucleotide sequence of VGAM925 precursor RNA is designated SEQ ID:911, and is provided hereinbelow with reference to the sequence listing part. Nucleotide sequence SEQ ID:911 is located at position 67920 relative to the genome of Infectious Spleen and Kidney Necrosis Virus.

VGAM925 precursor RNA folds onto itself, forming VGAM925 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM925 folded precursor RNA into VGAM925 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM925 RNA is designated SEQ ID:3636, and is provided hereinbelow with reference to the sequence listing part.

VGAM925 host target gene, herein designated VGAM HOST TARGET GENE, encodes a corresponding messenger RNA, VGAM925 host target RNA, herein designated VGAM HOST TARGET RNA. VGAM925 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM925 RNA, herein designated VGAM RNA, binds complementarily to one or more host target binding sites located in untranslated regions of VGAM925 host target RNA, herein designated VGAM HOST TARGET RNA. This complementary binding is due to the fact that the nucleotide sequence of VGAM925 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM925 RNA, herein designated VGAM RNA, may have a different number of host target binding sites in untranslated regions of a VGAM925 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM925 RNA, herein designated VGAM RNA, to host target binding sites on VGAM925 host target RNA, herein designated VGAM HOST TARGET RNA, such as BINDING SITE I, BINDING SITE II and BINDING SITE III, inhibits translation of VGAM925 host target RNA into VGAM925 host target protein, herein designated VGAM HOST TARGET PROTEIN. VGAM host target protein is therefore outlined by a broken line.

It is appreciated that VGAM925 host target gene, herein designated VGAM HOST TARGET GENE, in fact represents a plurality of VGAM925 host target genes. The mRNA of each one of this plurality of VGAM925 host target genes comprises one or more host target binding sites, each having a nucleotide sequence which is at least partly complementary to VGAM925 RNA, herein designated VGAM RNA, and which when bound by VGAM925 RNA causes inhibition of translation of respective one or more VGAM925 host target proteins.

It is further appreciated by one skilled in the art that the mode of translational inhibition illustrated by FIG. 1 with specific reference to translational inhibition exerted by VGAM925 gene, herein designated VGAM GENE, on one or more VGAM925 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM925 is inhibition of expression of host target genes, as part of a novel viral mechanism of attacking a host. Accordingly, utilities of VGAM925 include diagnosis, prevention and treatment of viral infection by Infectious Spleen and Kidney Necrosis Virus. Specific functions, and accordingly utilities, of VGAM925 correlate with, and may be deduced from, the identity of the host target genes which VGAM925 binds and inhibits, and the function of these host target genes, as elaborated hereinbelow.

Nucleotide sequences of the VGAM925 precursor RNA, herein designated VGAM PRECURSOR RNA, and of the 'diced' VGAM925 RNA, herein designated VGAM RNA, and a schematic representation of the secondary folding of VGAM925 folded precursor RNA, herein designated VGAM FOLDED PRECURSOR RNA, of VGAM925 are further described hereinbelow with reference to Table 1.

Nucleotide sequences of host target binding sites, such as BINDING SITE-I, BINDING SITE-II and BINDING SITE-III of FIG. 1, found on VGAM925 host target RNA, and schematic representation of the complementarity of each of these host target binding sites to VGAM925 RNA, herein designated VGAM RNA, are described hereinbelow with reference to Table 2.

As mentioned hereinabove with reference to FIG. 1, a function of VGAM925 gene, herein designated VGAM is inhibition of expression of VGAM925 target genes. It is appreciated that specific functions, and accordingly utilities, of VGAM925 correlate with, and may be deduced from, the identity of the target genes which VGAM925 binds and inhibits, and the function of these target genes, as elaborated hereinbelow.

Amyloid Beta (A4) Precursor Protein-binding, Family A, Member 2 (X11-like) (APBA2, Accession NM_005503) is a VGAM925 host target gene. APBA2 BINDING SITE is HOST TARGET binding site found in the 3' untranslated region of mRNA encoded by APBA2, corresponding to a HOST TARGET binding site such as BINDING SITE I, BINDING SITE II or BINDING SITE III. Table 2 illustrates the complementarity of the nucleotide sequences of APBA2 BINDING SITE, designated SEQ ID:12016, to the nucleotide sequence of VGAM925 RNA, herein designated VGAM RNA, also designated SEQ ID:3636.

A function of VGAM925 is therefore inhibition of Amyloid Beta (A4) Precursor Protein-binding, Family A, Member 2 (X11-like) (APBA2, Accession NM_005503), a gene which interacts with and stabilisesthe Alzheimer's disease amyloid precursor protein (APP) and inhibits production of proteolytic APP fragments. Accordingly, utilities of VGAM925 include diagnosis, prevention and treatment of diseases and clinical conditions associated with APBA2. The function of APBA2 has been established by previous studies. The cytoplasmic domain of the Alzheimer disease locus amyloid protein precursor (APP; 104760) binds to 4 human phosphotyrosine-binding (PTB) proteins; see APBA1 (OMIM Ref. No. 602414). By use of a yeast 2-hybrid screening of a human brain cDNA library, McLoughlin and Miller (1996) identified 3 of these proteins: the human homolog of rat Fe65 (APBB1; 602709), an Fe65-like sequence (APBB2; 602710), and an X11-like sequence (APBA2). The human X11-like sequence is 83% identical to that encoded by the X11 gene (APBA1; 602414). McLoughlin and Miller (1996) detected a phosphotyrosine-binding domain in the protein encoded by the X11-like clone. Using a radiation hybrid panel, Blanco et al. (1998) mapped the APBA2 gene to human chromosome 15, between markers WI-5590 (10.31 cR) and D15S144 (21.7 cR). In an interspecific backcross, using an SSCP-demonstrated polymorphism, they assigned the Apba2 gene to mouse chromosome 7. The location of the flanking markers suggested that Apba2 is a further addition to a gene segment conserved between mouse chromosome 7 and human 15q.

Full details of the abovementioned studies are described in the following publications, the disclosure of which are hereby incorporated by reference:

Blanco, G.; Irving, N. G.; Brown, S. D. M.; Miller, C. C. J.; McLoughlin, D. M.: Mapping of the human and murine X11-like genes (APBA2 and Apba2), the murine Fe65 gene (Apbb1), and the human Fe65-like gene (APBB2): genes encoding phosphotyrosine-binding domain proteins that interact with the Alzheimer's disease amyloid precursor protein. Mammalian Genome 9:473-475, 1998; and McLoughlin, D. M.; Miller, C. C. J.: The intracellular cytoplasmic domain of the Alzheimer's disease amyloid precursor protein interacts with phosphotyrosine-binding domain proteins in.

Further studies establishing the function and utilities of APBA2 are found in John Hopkins OMIM database record ID 602712, and in sited publications numbered 101 and 1118 listed in the bibliography section hereinbelow, which are also hereby incorporated by reference. DNA (cytosine-5-)-methyltransferase 3 Alpha (DNMT3A, Accession NM_022552) is another VGAM925 host target gene. DNMT3A BINDING SITE is HOST TARGET binding site found in the 5' untranslated region of mRNA encoded by DNMT3A, corresponding to a HOST TARGET binding site such as BINDING SITE I, BINDING SITE II or BINDING SITE III. Table 2 illustrates the complementarity of the nucleotide sequences of DNMT3A BINDING SITE, designated SEQ ID:22881, to the nucleotide sequence of VGAM925 RNA, herein designated VGAM RNA, also designated SEQ ID:3636.

Another function of VGAM925 is therefore inhibition of DNA (cytosine-5-)-methyltransferase 3 Alpha (DNMT3A, Accession NM_022552), a gene which intervenes in de novo methylation of DNA. Accordingly, utilities of VGAM925 include diagnosis, prevention and treatment of diseases and clinical conditions associated with DNMT3A. The function of DNMT3A has been established by previous studies. De novo methylation of genomic DNA is a developmentally regulated process that appears to play a pivotal role in regulation of genomic imprinting and X-chromosome inactivation in mammals. Aberrant de novo methylation of growth regulatory genes is associated with tumorigenesis in human S (Baylin et al., 1998). However, Lei et al. (1996) showed that de novo methylation persists in embryonic stem (ES) cells lacking Dnmt1 (OMIM Ref. No. 126375), which encodes the constitutive DNA methyltransferase 1, indicating the existence of independently encoded de novo methyltransferases. By a TBLASTN search of the dbEST database using full-length bacterial type II cytosine-5 methyltransferase sequences as queries, followed by isolation and sequencing of overlapping cDNA clones, Okano et al. (1998) identified 2 homologous genes in both human and mouse that contain the highly conserved cytosine-5 methyltransferase motifs. The mouse genes, termed Dnmt3a and Dnmt3b (OMIM Ref. No. 602900), show little sequence similarity to mouse Dnmt1 and Dnmt2 (OMIM Ref. No. 602478), and masc1 from Ascobolus. The Dnmt3a cDNA is 4,192 bp in length, encoding a protein of 908 amino acids. The human DNMT3A and DNMT3B cDNA are highly homologous to the mouse genes. Dnmt3a and Dnmt3b transcripts are abundantly expressed in undifferentiated embryonic stem cells. Okano et al. (1998) performed other experiments suggesting that Dnmt3a and Dnmt3b encode the long-sought de novo DNA methyltransferases. By FISH, Xie et al. (1999) mapped the DNMT3A gene to 2p23. Robertson et al. (1999) also mapped the DNMT3A gene to 2p23 using FISH Animal model experiments lend further support to the function of DNMT3A. Okano et al. (1999) generated mice with targeted disruption of the Dnmt3a and Dnmt3b genes. Inactivation of both genes blocked de novo methylation in embryonic stem cells and early embryos but had no effect on maintenance of imprinted methylation patterns. Dnmt3a -/- mice developed to term and appeared to be normal at birth. However, most homozygous mutant mice became runted and died at about 4 weeks of age. In contrast, no viable Dnmt3b -/- mice were recovered at birth. Dissection of embryos at different stages of development revealed that Dnmt3b -/- embryos had multiple developmental defects, including growth impairment and rostral neural tube defects with variable severity at later stages of development, though most of them appeared to develop normally before E9.5. Dnmt3a and Dnmt3b also exhibited non-overlapping functions in development, with Dnmt3b specifically required for methylation of centromeric minor satellite repeats. These results indicated that both Dnmt3a and Dnmt3b are required for genomewide de novo methylation and are essential for mammalian development.

It is appreciated that the abovementioned animal model for DNMT3A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Okano, M.; Xie, S.; Li, E.: Cloning and characterization of a family of novel mammalian DNA (cytosine-5) methyltransferases. (Letter) Nature Genet. 19:219-220, 1998; and Robertson, K. D.; Uzvolgyi, E.; Liang, G.; Talmadge, C.; Sumegi, J.; Gonzales, F. A.; Jones, P. A.: The human DNA methyltransferases (DNMTs) 1, 3a and 3b: coordinate mRNA expression in.

Further studies establishing the function and utilities of DNMT3A are found in John Hopkins OMIM database record ID 602769, and in sited publications numbered 6213-6214, 344 and 11685-6217 listed in the bibliography section hereinbelow, which are also hereby incorporated by reference. DNA (cytosine-5-)-methyltransferase 3-like (DNMT3L, Accession NM_013369) is another VGAM925 host target gene. DNMT3L BINDING SITE is HOST TARGET binding site found in the 5' untranslated region of mRNA encoded by DNMT3L, corresponding to a HOST TARGET binding site such as BINDING SITE I, BINDING SITE II or BINDING SITE III. Table 2 illustrates the complementarity of the nucleotide sequences of DNMT3L BINDING SITE, designated SEQ ID:15016, to the nucleotide sequence of VGAM925 RNA, herein designated VGAM RNA, also designated SEQ ID:3636.

Another function of VGAM925 is therefore inhibition of DNA (cytosine-5-)-methyltransferase 3-like (DNMT3L, Accession NM_013369), a gene which plays a role in de novo methylation of CpG islands. Accordingly, utilities of VGAM925 include diagnosis, prevention and treatment of diseases and clinical conditions associated with DNMT3L. The function of DNMT3L and its association with various diseases and clinical conditions, has been established by previous studies, as described hereinabove with reference to VGAM447. Fibroblast Growth Factor 18 (FGF18, Accession NM_033649) is another VGAM925 host target gene. FGF18 BINDING SITE1 and FGF18 BINDING SITE2 are HOST TARGET binding sites found in untranslated regions of mRNA encoded by FGF18, corresponding to HOST TARGET binding sites such as BINDING SITE I, BINDING SITE II or BINDING SITE III. Table 2 illustrates the complementarity of the nucleotide sequences of FGF18 BINDING SITE1 and FGF18 BINDING SITE2, designated SEQ ID:27382 and SEQ ID:9954 respectively, to the nucleotide sequence of VGAM925 RNA, herein designated VGAM RNA, also designated SEQ ID:3636.

Another function of VGAM925 is therefore inhibition of Fibroblast Growth Factor 18 (FGF18, Accession NM_033649), a gene which stimulates hepatic and intestinal proliferation. Accordingly, utilities of VGAM925 include diagnosis, prevention and treatment of diseases and clinical conditions associated with FGF18. The function of FGF18 has been established by previous studies. The fibroblast growth factors (FGFs; e.g., FGF2; 134920) are a family of growth factors and oncogenes that contain a conserved, approximately 120-amino acid core. Individual FGFs play important roles in embryonic development, cell growth, morphogenesis, tissue repair, inflammation, angiogenesis, and tumor growth and invasion. Ohbayashi et al. (1998) isolated human, mouse, and rat cDNAs encoding a novel member of the FGF family, FGF18. The deduced 207-amino acid human and rat FGF18 proteins are 99% identical. FGF18 contains a typical hydrophobic signal sequence at its N terminus, and the authors demonstrated that recombinant rat Fgf18 can be efficiently secreted by High Five insect cells. Recombinant rat Fgf18 induced neurite outgrowth in PC12 cells. Northern blot analysis of rat adult tissues showed abundant expression of Fgf18 in lung but did not detect Fgf18 expression in other tissues. In rat 14.5- and 19.5-day embryos, in situ hybridization showed Fgf18 expression in several discrete regions. Independently, Hu et al. (1998) isolated human and mouse FGF18 cDNAs. Among known FGF family members, the FGF18 protein is most similar to FGF8 (OMIM Ref. No. 600483) and FGF17 (OMIM Ref. No. 603725), with human FGF18 showing 60% and 58% identity with human FGF8 and FGF17, respectively. The authors demonstrated that recombinant mouse Fgf18 is glycosylated and can stimulate proliferation of NIH 3T3 cells in vitro in a heparan sulfate-dependent manner. Northern blot analysis of mouse adult tissues showed highest Fgf18 expression in the lung and kidney, and in situ hybridization of mouse 15.5-day embryos detected Fgf18 transcripts primarily in the lung. However, injection of recombinant mouse Fgf18 into normal mice induced proliferation in a wide variety of tissues, with the liver and small intestine appearing to be the primary targets. Hu et al. (1998) showed that transgenic mice overexpressing Fgf18 in the liver exhibited an increase in liver weight and hepatocellular proliferation. By radiation hybrid analysis and FISH, Whitmore et al. (2000) mapped the FGF18 gene to chromosome 5q34.

Full details of the abovementioned studies are described in the following publications, the disclosure of which are hereby incorporated by reference:

Ohbayashi, N.; Hoshikawa, M.; Kimura, S.; Yamasaki, M.; Fukui, S.; Itoh, N.: Structure and expression of the mRNA encoding a novel fibroblast growth factor, FGF-18. J. Biol. Chem. 273:18161-18164, 1998; and Whitmore, T. E.; Maurer, M. F.; Sexson, S.; Raymond, F.; Conklin, D.; Deisher, T. A.: Assignment of fibroblast growth factor 18 (FGF18) to human chromosome 5q34 by use of radiation hyb.

Further studies establishing the function and utilities of FGF18 are found in John Hopkins OMIM database record ID 603726, and in sited publications numbered 536 and 5836 listed in the bibliography section hereinbelow, which are also hereby incorporated by reference. Lunatic Fringe Homolog (Drosophila) (LFNG, Accession XM_166539) is another VGAM925 host target gene. LFNG BINDING SITE is HOST TARGET binding site found in the 3' untranslated region of mRNA encoded by LFNG, corresponding to a HOST TARGET binding site such as BINDING SITE I, BINDING SITE II or BINDING SITE III. Table 2 illustrates the complementarity of the nucleotide sequences of LFNG BINDING SITE, designated SEQ ID:44508, to the nucleotide sequence of VGAM925 RNA, herein designated VGAM RNA, also designated SEQ ID:3636.

Another function of VGAM925 is therefore inhibition of Lunatic Fringe Homolog (Drosophila) (LFNG, Accession XM_166539). Accordingly, utilities of VGAM925 include diagnosis, prevention and treatment of diseases and clinical conditions associated with LFNG. Leukocyte Immunoglobulin-like Receptor, Subfamily A (with TM domain), Member 1 (LILRA1, Accession NM_006863) is another VGAM925 host target gene. LILRA1 BINDING SITE is HOST TARGET binding site found in the 5' untranslated region of mRNA encoded by LILRA1, corresponding to a HOST TARGET binding site such as BINDING SITE I, BINDING SITE II or BINDING SITE III. Table 2 illustrates the complementarity of the nucleotide sequences of LILRA1 BINDING SITE, designated SEQ ID:13736, to the nucleotide sequence of VGAM925 RNA, herein designated VGAM RNA, also designated SEQ ID:3636.

Another function of VGAM925 is therefore inhibition of Leukocyte Immunoglobulin-like Receptor, Subfamily A (with TM domain), Member 1 (LILRA1, Accession NM_006863). Accordingly, utilities of VGAM925 include diagnosis, prevention and treatment of diseases and clinical conditions associated with LILRA1. Leukocyte Immunoglobulin-like Receptor, Subfamily B (with TM and ITIM domains), Member 2 (LILRB2, Accession NM_005874) is another VGAM925 host target gene. LILRB2 BINDING SITE is HOST TARGET binding site found in the 5' untranslated region of mRNA encoded by LILRB2, corresponding to a HOST TARGET binding site such as BINDING SITE I, BINDING SITE II or BINDING SITE III. Table 2 illustrates the complementarity of the nucleotide sequences of LILRB2 BINDING SITE, designated SEQ ID:12492, to the nucleotide sequence of VGAM925 RNA, herein designated VGAM RNA, also designated SEQ ID:3636.

Another function of VGAM925 is therefore inhibition of Leukocyte Immunoglobulin-like Receptor, Subfamily B (with TM and ITIM domains), Member 2 (LILRB2, Accession NM_005874). Accordingly, utilities of VGAM925 include diagnosis, prevention and treatment of diseases and clinical conditions associated with LILRB2. Synapsin III (SYN3, Accession NM_133632) is another VGAM925 host target gene. SYN3 BINDING SITE is HOST TARGET binding site found in the 3' untranslated region of mRNA encoded by SYN3, corresponding to a HOST TARGET binding site such as BINDING SITE I, BINDING SITE II or BINDING SITE III. Table 2 illustrates the complementarity of the nucleotide sequences of SYN3 BINDING SITE, designated SEQ ID:28591, to the nucleotide sequence of VGAM925 RNA, herein designated VGAM RNA, also designated SEQ ID:3636.

Another function of VGAM925 is therefore inhibition of Synapsin III (SYN3, Accession NM_133632), a gene which may be involved in the regulation of neurotransmitter release and synaptogenesis. Accordingly, utilities of VGAM925 include diagnosis, prevention and treatment of diseases and clinical conditions associated with SYN3. The function of SYN3 has been established by previous studies. Synapsins are a family of neuron-specific synaptic vesicle-associated phosphoproteins that have been implicated in synaptogenesis and in the modulation of neurotransmitter release. In mammals, distinct genes for synapsins I (SYN1; 313440) and II (SYN2; 600755) have been identified, each of which encodes 2 alternatively spliced isoforms. Kao et al. (1998) cloned and characterized a third member of the synapsin gene family, synapsin III, from human DNA. Synapsin III gives rise to at least 1 protein isoform, designated synapsin IIIa, in several mammalian species. Synapsin IIIa is associated with synaptic vesicles, and its expression appears to be neuron-specific. The primary structure of synapsin IIIa conforms to the domain model previously described for the synapsin family, with domains A, C, and E exhibiting the highest degree of conservation. Synapsin IIIa contains a novel domain, termed domain J, located between domains C and E. The similarities among synapsins I, II, and III in domain organization, neuron-specific expression, and subcellular localization suggested a possible role for synapsin III in the regulation of neurotransmitter release and synaptogenesis. Hosaka and Sudhof (1998) identified the human SYN3 gene. Among the rat tissues tested, they found that Syn3 was expressed only in brain. As in other synapsins, the C domain of Syn3 bound ATP with high affinity and ADP with a lower affinity, consistent with a cycle of ATP binding and hydrolysis. However, unlike with Syn1 and Syn2, calcium inhibited ATP binding to Syn3. The authors concluded that calcium has distinct regulatory effects on Syn1, Syn2, and Syn3.

Full details of the abovementioned studies are described in the following publications, the disclosure of which are hereby incorporated by reference:

Hosaka, M.; Sudhof, T. C.: Synapsin III, a novel synapsin with an unusual regulation by Ca (2)+. J. Biol. Chem. 273: 13371-13374, 1998; and Kao, H.-T.; Porton, B.; Czernik, A. J.; Feng, J.; Yiu, G.; Haring, M.; Benfenati, F.; Greengard, P.: A third member of the synapsin gene family. Proc. Nat. Acad. Sci. 95:4667-4672, 19.

Further studies establishing the function and utilities of SYN3 are found in John Hopkins OMIM database record ID 602705, and in sited publications numbered 1048-1051 listed in the bibliography section hereinbelow, which are also hereby incorporated by reference. CLIPR-59 (Accession NM_015526) is another VGAM925 host target gene. CLIPR-59 BINDING SITE is HOST TARGET binding site found in the 3' untranslated region of mRNA encoded by CLIPR-59, corresponding to a HOST TARGET binding site such as BINDING SITE I, BINDING SITE II or BINDING SITE III. Table 2 illustrates the complementarity of the nucleotide sequences of CLIPR-59 BINDING SITE, designated SEQ ID:17785, to the nucleotide sequence of VGAM925 RNA, herein designated VGAM RNA, also designated SEQ ID:3636.

Another function of VGAM925 is therefore inhibition of CLIPR-59 (Accession NM_015526). Accordingly, utilities of VGAM925 include diagnosis, prevention and treatment of diseases and clinical conditions associated with CLIPR-59. FLJ22160 (Accession NM_024585) is another VGAM925 host target gene. FLJ22160 BINDING SITE is HOST TARGET binding site found in the 3' untranslated region of mRNA encoded by FLJ22160, corresponding to a HOST TARGET binding site such as BINDING SITE I, BINDING SITE II or BINDING SITE III. Table 2 illustrates the complementarity of the nucleotide sequences of FLJ22160 BINDING SITE, designated SEQ ID:23819, to the nucleotide sequence of VGAM925 RNA, herein designated VGAM RNA, also designated SEQ ID:3636.

Another function of VGAM925 is therefore inhibition of FLJ22160 (Accession NM_024585). Accordingly, utilities of VGAM925 include diagnosis, prevention and treatment of diseases and clinical conditions associated with FLJ22160. HGC6.1.1 (Accession NM_014354) is another VGAM925 host target gene. HGC6.1.1 BINDING SITE is HOST TARGET binding site found in the 5' untranslated region of mRNA encoded by HGC6.1.1, corresponding to a HOST TARGET binding site such as BINDING SITE I, BINDING SITE II or BINDING SITE III. Table 2 illustrates the complementarity of the nucleotide sequences of HGC6.1.1 BINDING SITE, designated SEQ ID:15686, to the nucleotide sequence of VGAM925 RNA, herein designated VGAM RNA, also designated SEQ ID:3636.

Another function of VGAM925 is therefore inhibition of HGC6.1.1 (Accession NM_014354). Accordingly, utilities of VGAM925 include diagnosis, prevention and treatment of diseases and clinical conditions associated with HGC6.1.1. KIAA0514 (Accession NM_014696) is another VGAM925 host target gene. KIAA0514 BINDING SITE is HOST TARGET binding site found in the 3' untranslated region of mRNA encoded by KIAA0514, corresponding to a HOST TARGET binding site such as BINDING SITE I, BINDING SITE II or BINDING SITE III. Table 2 illustrates the complementarity of the nucleotide sequences of KIAA0514 BINDING SITE, designated SEQ ID:16211, to the nucleotide sequence of VGAM925 RNA, herein designated VGAM RNA, also designated SEQ ID:3636.

Another function of VGAM925 is therefore inhibition of KIAA0514 (Accession NM_014696). Accordingly, utilities of VGAM925 include diagnosis, prevention and treatment of diseases and clinical conditions associated with KIAA0514. KIAA1089 (Accession XM_044148) is another VGAM925 host target gene. KIAA1089 BINDING SITE is HOST TARGET binding site found in the 3' untranslated region of mRNA encoded by KIAA1089, corresponding to a HOST TARGET binding site such as BINDING SITE I, BINDING SITE II or BINDING SITE III. Table 2 illustrates the complementarity of the nucleotide sequences of KIAA1089 BINDING SITE, designated SEQ ID:34141, to the nucleotide sequence of VGAM925 RNA, herein designated VGAM RNA, also designated SEQ ID:3636.

Another function of VGAM925 is therefore inhibition of KIAA1089 (Accession XM_044148). Accordingly, utilities of VGAM925 include diagnosis, prevention and treatment of diseases and clinical conditions associated with KIAA1089. KIAA1110 (Accession XM_029973) is another VGAM925 host target gene. KIAA1110 BINDING SITE is HOST TARGET binding site found in the 3' untranslated region of mRNA encoded by KIAA1110, corresponding to a HOST TARGET binding site such as BINDING SITE I, BINDING SITE II or BINDING SITE III. Table 2 illustrates the complementarity of the nucleotide sequences of KIAA1110 BINDING SITE, designated SEQ ID:30983, to the nucleotide sequence of VGAM925 RNA, herein designated VGAM RNA, also designated SEQ ID:3636.

Another function of VGAM925 is therefore inhibition of KIAA1110 (Accession XM_029973). Accordingly, utilities of VGAM925 include diagnosis, prevention and treatment of diseases and clinical conditions associated with KIAA1110. KIAA1274 (Accession XM_166125) is another VGAM925 host target gene. KIAA1274 BINDING SITE is HOST TARGET binding site found in the 3' untranslated region of mRNA encoded by KIAA1274, corresponding to a HOST TARGET binding site such as BINDING SITE I, BINDING SITE II or BINDING SITE III. Table 2 illustrates the complementarity of the nucleotide sequences of KIAA1274 BINDING SITE, designated SEQ ID:43908, to the nucleotide sequence of VGAM925 RNA, herein designated VGAM RNA, also designated SEQ ID:3636.

Another function of VGAM925 is therefore inhibition of KIAA1274 (Accession XM_166125). Accordingly, utilities of VGAM925 include diagnosis, prevention and treatment of diseases and clinical conditions associated with KIAA1274. KIAA1388 (Accession XM_168030) is another VGAM925 host target gene. KIAA1388 BINDING SITE is HOST TARGET binding site found in the 3' untranslated region of mRNA encoded by KIAA1388, corresponding to a HOST TARGET binding site such as BINDING SITE I, BINDING SITE II or BINDING SITE III. Table 2 illustrates the complementarity of the nucleotide sequences of KIAA1388 BINDING SITE, designated SEQ ID:44949, to the nucleotide sequence of VGAM925 RNA, herein designated VGAM RNA, also designated SEQ ID:3636.

Another function of VGAM925 is therefore inhibition of KIAA1388 (Accession XM_168030). Accordingly, utilities of VGAM925 include diagnosis, prevention and treatment of diseases and clinical conditions associated with KIAA1388. KIAA1533 (Accession XM_057385) is another VGAM925 host target gene. KIAA1533 BINDING SITE is HOST TARGET binding site found in the 5' untranslated region of mRNA encoded by KIAA1533, corresponding to a HOST TARGET binding site such as BINDING SITE I, BINDING SITE II or BINDING SITE III. Table 2 illustrates the complementarity of the nucleotide sequences of KIAA1533 BINDING SITE, designated SEQ ID:36510, to the nucleotide sequence of VGAM925 RNA, herein designated VGAM RNA, also designated SEQ ID:3636.

Another function of VGAM925 is therefore inhibition of KIAA1533 (Accession XM_057385). Accordingly, utilities of VGAM925 include diagnosis, prevention and treatment of diseases and clinical conditions associated with KIAA1533. PTK6 Protein Tyrosine Kinase 6 (PTK6, Accession NM_005975) is another VGAM925 host target gene. PTK6 BINDING SITE is HOST TARGET binding site found in the 5' untranslated region of mRNA encoded by PTK6, corresponding to a HOST TARGET binding site such as BINDING SITE I, BINDING SITE II or BINDING SITE III. Table 2 illustrates the complementarity of the nucleotide sequences of PTK6 BINDING SITE, designated SEQ ID:12598, to the nucleotide sequence of VGAM925 RNA, herein designated VGAM RNA, also designated SEQ ID:3636.

Another function of VGAM925 is therefore inhibition of PTK6 Protein Tyrosine Kinase 6 (PTK6, Accession NM_005975). Accordingly, utilities of VGAM925 include diagnosis, prevention and treatment of diseases and clinical conditions associated with PTK6. Syndecan 3 (N-syndecan) (SDC3, Accession NM_014654) is another VGAM925 host target gene. SDC3 BINDING SITE is HOST TARGET binding site found in the 3' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16081, to the nucleotide sequence of VGAM925 RNA, herein designated VGAM RNA, also designated SEQ ID:3636.

Another function of VGAM925 is therefore inhibition of Syndecan 3 (N-syndecan) (SDC3, Accession NM_014654). Accordingly, utilities of VGAM925 include diagnosis, prevention and treatment of diseases and clinical conditions associated with SDC3. Spindlin (SPIN, Accession XM_005421) is another VGAM925 host target gene. SPIN BINDING SITE is HOST TARGET binding site found in the 5' untranslated region of mRNA encoded by SPIN, corresponding to a HOST TARGET binding site such as BINDING SITE I, BINDING SITE II or BINDING SITE III. Table 2 illustrates the complementarity of the nucleotide sequences of SPIN BINDING SITE, designated SEQ ID:29979, to the nucleotide sequence of VGAM925 RNA, herein designated VGAM RNA, also designated SEQ ID:3636.

Another function of VGAM925 is therefore inhibition of Spindlin (SPIN, Accession XM_005421). Accordingly, utilities of VGAM925 include diagnosis, prevention and treatment of diseases and clinical conditions associated with SPIN. Serine Protease Inhibitor, Kunitz Type 1 (SPINT1, Accession XM_031510) is another VGAM925 host target gene. SPINT1 BINDING SITE is HOST TARGET binding site found in the 5' untranslated region of mRNA encoded by SPINT1, corresponding to a HOST TARGET binding site such as BINDING SITE I, BINDING SITE II or BINDING SITE III. Table 2 illustrates the complementarity of the nucleotide sequences of SPINT1 BINDING SITE, designated SEQ ID:31391, to the nucleotide sequence of VGAM925 RNA, herein designated VGAM RNA, also designated SEQ ID:3636.

Another function of VGAM925 is therefore inhibition of Serine Protease Inhibitor, Kunitz Type 1 (SPINT1, Accession XM_031510). Accordingly, utilities of VGAM925 include diagnosis, prevention and treatment of diseases and clinical conditions associated with SPINT1. Upstream Binding Protein 1 (LBP-1a) (UBP1, Accession NM_014517) is another VGAM925 host target gene. UBP1 BINDING SITE is HOST TARGET binding site found in the 5' untranslated region of mRNA encoded by UBP1, corresponding to a HOST TARGET binding site such as BINDING SITE I, BINDING SITE II or BINDING SITE III. Table 2 illustrates the complementarity of the nucleotide sequences of UBP1 BINDING SITE, designated SEQ ID:15845, to the nucleotide sequence of VGAM925 RNA, herein designated VGAM RNA, also designated SEQ ID:3636.

Another function of VGAM925 is therefore inhibition of Upstream Binding Protein 1 (LBP-1a) (UBP1, Accession NM_014517). Accordingly, utilities of VGAM925 include diagnosis, prevention and treatment of diseases and clinical conditions associated with UBP1. ZFP106 (Accession NM_022473) is another VGAM925 host target gene. ZFP106 BINDING SITE is HOST TARGET binding site found in the 3' untranslated region of mRNA encoded by ZFP106, corresponding to a HOST TARGET binding site such as BINDING SITE I, BINDING SITE II or BINDING SITE III. Table 2 illustrates the complementarity of the nucleotide sequences of ZFP106 BINDING SITE, designated SEQ ID:22834, to the nucleotide sequence of VGAM925 RNA, herein designated VGAM RNA, also designated SEQ ID:3636.

Another function of VGAM925 is therefore inhibition of ZFP106 (Accession NM_022473). Accordingly, utilities of VGAM925 include diagnosis, prevention and treatment of diseases and clinical conditions associated with ZFP106. LOC147180 (Accession XM_097207) is another VGAM925 host target gene. LOC147180 BINDING SITE is HOST TARGET binding site found in the 5' untranslated region of mRNA encoded by LOC147180, corresponding to a HOST TARGET binding site such as BINDING SITE I, BINDING SITE II or BINDING SITE III. Table 2 illustrates the complementarity of the nucleotide sequences of LOC147180 BINDING SITE, designated SEQ ID:40817, to the nucleotide sequence of VGAM925 RNA, herein designated VGAM RNA, also designated SEQ ID:3636.

Another function of VGAM925 is therefore inhibition of LOC147180 (Accession XM_097207). Accordingly, utilities of VGAM925 include diagnosis, prevention and treatment of diseases and clinical conditions associated with LOC147180. LOC167040 (Accession XM_106497) is another VGAM925 host target gene. LOC167040 BINDING SITE is HOST TARGET binding site found in the 5' untranslated region of mRNA encoded by LOC167040, corresponding to a HOST TARGET binding site such as BINDING SITE I, BINDING SITE II or BINDING SITE III. Table 2 illustrates the complementarity of the nucleotide sequences of LOC167040 BINDING SITE, designated SEQ ID:42200, to the nucleotide sequence of VGAM925 RNA, herein designated VGAM RNA, also designated SEQ ID:3636.

Another function of VGAM925 is therefore inhibition of LOC167040 (Accession XM_106497). Accordingly, utilities of VGAM925 include diagnosis, prevention and treatment of diseases and clinical conditions associated with LOC167040. LOC200213 (Accession XM_114156) is another VGAM925 host target gene. LOC200213 BINDING SITE is HOST TARGET binding site found in the 5' untranslated region of mRNA encoded by LOC200213, corresponding to a HOST TARGET binding site such as BINDING SITE I, BINDING SITE II or BINDING SITE III. Table 2 illustrates the complementarity of the nucleotide sequences of LOC200213 BINDING SITE, designated SEQ ID:42739, to the nucleotide sequence of VGAM925 RNA, herein designated VGAM RNA, also designated SEQ ID:3636.

Another function of VGAM925 is therefore inhibition of LOC200213 (Accession XM_114156). Accordingly, utilities of VGAM925 include diagnosis, prevention and treatment of diseases and clinical conditions associated with LOC200213. LOC90170 (Accession XM_029589) is another VGAM925 host target gene. LOC90170 BINDING SITE is HOST TARGET binding site found in the 5' untranslated region of mRNA encoded by LOC90170, corresponding to a HOST TARGET binding site such as BINDING SITE I, BINDING SITE II or BINDING SITE III. Table 2 illustrates the complementarity of the nucleotide sequences of LOC90170 BINDING SITE, designated SEQ ID:30907, to the nucleotide sequence of VGAM925 RNA, herein designated VGAM RNA, also designated SEQ ID:3636.

Another function of VGAM925 is therefore inhibition of LOC90170 (Accession XM_029589). Accordingly, utilities of VGAM925 include diagnosis, prevention and treatment of diseases and clinical conditions associated with LOC90170. LOC93624 (Accession XM_052624) is another VGAM925 host target gene. LOC93624 BINDING SITE is HOST TARGET binding site found in the 5' untranslated region of mRNA encoded by LOC93624, corresponding to a HOST TARGET binding site such as BINDING SITE I, BINDING SITE II or BINDING SITE III. Table 2 illustrates the complementarity of the nucleotide sequences of LOC93624 BINDING SITE, designated SEQ ID:36014, to the nucleotide sequence of VGAM925 RNA, herein designated VGAM RNA, also designated SEQ ID:3636.

Another function of VGAM925 is therefore inhibition of LOC93624 (Accession XM_052624). Accordingly, utilities of VGAM925 include diagnosis, prevention and treatment of diseases and clinical conditions associated with LOC93624. FIG. 1 further provides a conceptual description of a novel bioinformatically detected viral gene of the present invention, referred to here as Viral Genomic Address Messenger 926 (VGAM926) viral gene, which modulates expression of respective host target genes thereof, the function and utility of which host target genes is known in the art.

VGAM926 is a novel bioinformatically detected regulatory, non protein coding, viral micro RNA (miRNA) gene. The method by which VGAM926 was detected is described hereinabove with reference to FIGS. 1-8.

VGAM926 gene, herein designated VGAM GENE, is a viral gene contained in the genome of Infectious Spleen and Kidney Necrosis Virus. VGAM926 host target gene, herein designated VGAM HOST TARGET GENE, is a human gene contained in the human genome.

VGAM926 gene encodes a VGAM926 precursor RNA, herein designated VGAM PRECURSOR RNA. Similar to other miRNA genes, and unlike most ordinary genes, VGAM926 precursor RNA does not encode a protein. A nucleotide sequence identical or highly similar to the nucleotide sequence of VGAM926 precursor RNA is designated SEQ ID:912, and is provided hereinbelow with reference to the sequence listing part. Nucleotide sequence SEQ ID:912 is located at position 67259 relative to the genome of Infectious Spleen and Kidney Necrosis Virus.

VGAM926 precursor RNA folds onto itself, forming VGAM926 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM926 folded precursor RNA into VGAM926 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM926 RNA is designated SEQ ID:3637, and is provided hereinbelow with reference to the sequence listing part.

VGAM926 host target gene, herein designated VGAM HOST TARGET GENE, encodes a corresponding messenger RNA, VGAM926 host target RNA, herein designated VGAM HOST TARGET RNA. VGAM926 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM926 RNA, herein designated VGAM RNA, binds complementarily to one or more host target binding sites located in untranslated regions of VGAM926 host target RNA, herein designated VGAM HOST TARGET RNA. This complementary binding is due to the fact that the nucleotide sequence of VGAM926 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM926 RNA, herein designated VGAM RNA, may have a different number of host target binding sites in untranslated regions of a VGAM926 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM926 RNA, herein designated VGAM RNA, to host target binding sites on VGAM926 host target RNA, herein designated VGAM HOST TARGET RNA, such as BINDING SITE I, BINDING SITE II and BINDING SITE III, inhibits translation of VGAM926 host target RNA into VGAM926 host target protein, herein designated VGAM HOST TARGET PROTEIN. VGAM host target protein is therefore outlined by a broken line.

It is appreciated that VGAM926 host target gene, herein designated VGAM HOST TARGET GENE, in fact represents a plurality of VGAM926 host target genes. The mRNA of each one of this plurality of VGAM926 host target genes comprises one or more host target binding sites, each having a nucleotide sequence which is at least partly complementary to VGAM926 RNA, herein designated VGAM RNA, and which when bound by VGAM926 RNA causes inhibition of translation of respective one or more VGAM926 host target proteins.

It is further appreciated by one skilled in the art that the mode of translational inhibition illustrated by FIG. 1 with specific reference to translational inhibition exerted by VGAM926 gene, herein designated VGAM GENE, on one or more VGAM926 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM926 is inhibition of expression of host target genes, as part of a novel viral mechanism of attacking a host. Accordingly, utilities of VGAM926 include diagnosis, prevention and treatment of viral infection by Infectious Spleen and Kidney Necrosis Virus. Specific functions, and accordingly utilities, of VGAM926 correlate with, and may be deduced from, the identity of the host target genes which VGAM926 binds and inhibits, and the function of these host target genes, as elaborated hereinbelow.

Nucleotide sequences of the VGAM926 precursor RNA, herein designated VGAM PRECURSOR RNA, and of the 'diced' VGAM926 RNA, herein designated VGAM RNA, and a schematic representation of the secondary folding of VGAM926 folded precursor RNA, herein designated VGAM FOLDED PRECURSOR RNA, of VGAM926 are further described hereinbelow with reference to Table 1.

Nucleotide sequences of host target binding sites, such as BINDING SITE-I, BINDING SITE-II and BINDING SITE-III of FIG. 1, found on VGAM926 host target RNA, and schematic representation of the complementarity of each of these host target binding sites to VGAM926 RNA, herein designated VGAM RNA, are described hereinbelow with reference to Table 2.

As mentioned hereinabove with reference to FIG. 1, a function of VGAM926 gene, herein designated VGAM is inhibition of expression of VGAM926 target genes. It is appreciated that specific functions, and accordingly utilities, of VGAM926 correlate with, and may be deduced from, the identity of the target genes which VGAM926 binds and inhibits, and the function of these target genes, as elaborated hereinbelow.

Keratocan (KERA, Accession NM_007035) is a VGAM926 host target gene. KERA BINDING SITE is HOST TARGET binding site found in the 5' untranslated region of mRNA encoded by KERA, corresponding to a HOST TARGET binding site such as BINDING SITE I, BINDING SITE II or BINDING SITE III. Table 2 illustrates the complementarity of the nucleotide sequences of KERA BINDING SITE, designated SEQ ID:13907, to the nucleotide sequence of VGAM926 RNA, herein designated VGAM RNA, also designated SEQ ID:3637.

A function of VGAM926 is therefore inhibition of Keratocan (KERA, Accession NM_007035), a gene which may be important in developing and maintaining corneal transparency and for the structure of the stromal matrix. Accordingly, utilities of VGAM926 include diagnosis, prevention and treatment of diseases and clinical conditions associated with KERA. The function of KERA and its association with various diseases and clinical conditions, has been established by previous studies, as described hereinabove with reference to VGAM723. HT008 (Accession XM_008246) is another VGAM926 host target gene. HT008 BINDING SITE is HOST TARGET binding site found in the 3' untranslated region of mRNA encoded by HT008, corresponding to a HOST TARGET binding site such as BINDING SITE I, BINDING SITE II or BINDING SITE III. Table 2 illustrates the complementarity of the nucleotide sequences of HT008 BINDING SITE, designated SEQ ID:30073, to the nucleotide sequence of VGAM926 RNA, herein designated VGAM RNA, also designated SEQ ID:3637.

Another function of VGAM926 is therefore inhibition of HT008 (Accession XM_008246). Accordingly, utilities of VGAM926 include diagnosis, prevention and treatment of diseases and clinical conditions associated with HT008. LOC151827 (Accession XM_087317) is another VGAM926 host target gene. LOC151827 BINDING SITE is HOST TARGET binding site found in the 5' untranslated region of mRNA encoded by LOC151827, corresponding to a HOST TARGET binding site such as BINDING SITE I, BINDING SITE II or BINDING SITE III. Table 2 illustrates the complementarity of the nucleotide sequences of LOC151827 BINDING SITE, designated SEQ ID:39168, to the nucleotide sequence of VGAM926 RNA, herein designated VGAM RNA, also designated SEQ ID:3637.

Another function of VGAM926 is therefore inhibition of LOC151827 (Accession XM_087317). Accordingly, utilities of VGAM926 include diagnosis, prevention and treatment of diseases and clinical conditions associated with LOC151827. FIG. 1 further provides a conceptual description of a novel bioinformatically detected viral gene of the present invention, referred to here as Viral Genomic Address Messenger 927 (VGAM927) viral gene, which modulates expression of respective host target genes thereof, the function and utility of which host target genes is known in the art.

VGAM927 is a novel bioinformatically detected regulatory, non protein coding, viral micro RNA (miRNA) gene. The method by which VGAM927 was detected is described hereinabove with reference to FIGS. 1-8.

VGAM927 gene, herein designated VGAM GENE, is a viral gene contained in the genome of Infectious Spleen and Kidney Necrosis Virus. VGAM927 host target gene, herein designated VGAM HOST TARGET GENE, is a human gene contained in the human genome.

VGAM927 gene encodes a VGAM927 precursor RNA, herein designated VGAM PRECURSOR RNA. Similar to other miRNA genes, and unlike most ordinary genes, VGAM927 precursor RNA does not encode a protein. A nucleotide sequence identical or highly similar to the nucleotide sequence of VGAM927 precursor RNA is designated SEQ ID:913, and is provided hereinbelow with reference to the sequence listing part. Nucleotide sequence SEQ ID:913 is located at position 65593 relative to the genome of Infectious Spleen and Kidney Necrosis Virus.

VGAM927 precursor RNA folds onto itself, forming VGAM927 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM927 folded precursor RNA into VGAM927 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM927 RNA is designated SEQ ID:3638, and is provided hereinbelow with reference to the sequence listing part.

VGAM927 host target gene, herein designated VGAM HOST TARGET GENE, encodes a corresponding messenger RNA, VGAM927 host target RNA, herein designated VGAM HOST TARGET RNA. VGAM927 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM927 RNA, herein designated VGAM RNA, binds complementarily to one or more host target binding sites located in untranslated regions of VGAM927 host target RNA, herein designated VGAM HOST TARGET RNA. This complementary binding is due to the fact that the nucleotide sequence of VGAM927 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM927 RNA, herein designated VGAM RNA, may have a different number of host target binding sites in untranslated regions of a VGAM927 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM927 RNA, herein designated VGAM RNA, to host target binding sites on VGAM927 host target RNA, herein designated VGAM HOST TARGET RNA, such as BINDING SITE I, BINDING SITE II and BINDING SITE III, inhibits translation of VGAM927 host target RNA into VGAM927 host target protein, herein designated VGAM HOST TARGET PROTEIN. VGAM host target protein is therefore outlined by a broken line.

It is appreciated that VGAM927 host target gene, herein designated VGAM HOST TARGET GENE, in fact represents a plurality of VGAM927 host target genes. The mRNA of each one of this plurality of VGAM927 host target genes comprises one or more host target binding sites, each having a nucleotide sequence which is at least partly complementary to VGAM927 RNA, herein designated VGAM RNA, and which when bound by VGAM927 RNA causes inhibition of translation of respective one or more VGAM927 host target proteins.

It is further appreciated by one skilled in the art that the mode of translational inhibition illustrated by FIG. 1 with specific reference to translational inhibition exerted by VGAM927 gene, herein designated VGAM GENE, on one or more VGAM927 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM927 is inhibition of expression of host target genes, as part of a novel viral mechanism of attacking a host. Accordingly, utilities of VGAM927 include diagnosis, prevention and treatment of viral infection by Infectious Spleen and Kidney Necrosis Virus. Specific functions, and accordingly utilities, of VGAM927 correlate with, and may be deduced from, the identity of the host target genes which VGAM927 binds and inhibits, and the function of these host target genes, as elaborated hereinbelow.

Nucleotide sequences of the VGAM927 precursor RNA, herein designated VGAM PRECURSOR RNA, and of the 'diced' VGAM927 RNA, herein designated VGAM RNA, and a schematic representation of the secondary folding of VGAM927 folded precursor RNA, herein designated VGAM FOLDED PRECURSOR RNA, of VGAM927 are further described hereinbelow with reference to Table 1.

Nucleotide sequences of host target binding sites, such as BINDING SITE-I, BINDING SITE-II and BINDING SITE-III of FIG. 1, found on VGAM927 host target RNA, and schematic representation of the complementarity of each of these host target binding sites to VGAM927 RNA, herein designated VGAM RNA, are described hereinbelow with reference to Table 2.

As mentioned hereinabove with reference to FIG. 1, a function of VGAM927 gene, herein designated VGAM is inhibition of expression of VGAM927 target genes. It is appreciated that specific functions, and accordingly utilities, of VGAM927 correlate with, and may be deduced from, the identity of the target genes which VGAM927 binds and inhibits, and the function of these target genes, as elaborated hereinbelow.

Adrenergic, Beta-3-, Receptor (ADRB3, Accession NM_000025) is a VGAM927 host target gene. ADRB3 BINDING SITE is HOST TARGET binding site found in the 3' untranslated region of mRNA encoded by ADRB3, corresponding to a HOST TARGET binding site such as BINDING SITE I, BINDING SITE II or BINDING SITE III. Table 2 illustrates the complementarity of the nucleotide sequences of ADRB3 BINDING SITE, designated SEQ ID:5461, to the nucleotide sequence of VGAM927 RNA, herein designated VGAM RNA, also designated SEQ ID:3638.

A function of VGAM927 is therefore inhibition of Adrenergic, Beta-3-, Receptor (ADRB3, Accession NM_000025), a gene which stimulates adenylyl cyclase activity and regulates lipolysis. Accordingly, utilities of VGAM927 include diagnosis, prevention and treatment of diseases and clinical conditions associated with ADRB3. The function of ADRB3 and its association with various diseases and clinical conditions, has been established by previous studies, as described hereinabove with reference to VGAM179. Ankyrin-like with Transmembrane Domains 1 (ANKTM1, Accession NM_007332) is another VGAM927 host target gene. ANKTM1 BINDING SITE is HOST TARGET binding site found in the 3' untranslated region of mRNA encoded by ANKTM1, corresponding to a HOST TARGET binding site such as BINDING SITE I, BINDING SITE II or BINDING SITE III. Table 2 illustrates the complementarity of the nucleotide sequences of ANKTM1 BINDING SITE, designated SEQ ID:14259, to the nucleotide sequence of VGAM927 RNA, herein designated VGAM RNA, also designated SEQ ID:3638.

Another function of VGAM927 is therefore inhibition of Ankyrin-like with Transmembrane Domains 1 (ANKTM1, Accession NM_007332), a gene which attaches integral membrane proteins to cytoskeletal elements. Accordingly, utilities of VGAM927 include diagnosis, prevention and treatment of diseases and clinical conditions associated with ANKTM1. The function of ANKTM1 and its association with various diseases and clinical conditions, has been established by previous studies, as described hereinabove with reference to VGAM644. Rho GTPase Activating Protein 6 (ARHGAP6, Accession NM_001174) is another VGAM927 host target gene. ARHGAP6 BINDING SITE is HOST TARGET binding site found in the 3' untranslated region of mRNA encoded by ARHGAP6, corresponding to a HOST TARGET binding site such as BINDING SITE I, BINDING SITE II or BINDING SITE III. Table 2 illustrates the complementarity of the nucleotide sequences of ARHGAP6 BINDING SITE, designated SEQ ID:6840, to the nucleotide sequence of VGAM927 RNA, herein designated VGAM RNA, also designated SEQ ID:3638.

Another function of VGAM927 is therefore inhibition of Rho GTPase Activating Protein 6 (ARHGAP6, Accession NM_001174), a gene which activates the rho-type GTPases by converting them to an inactive GTP-bound state. Accordingly, utilities of VGAM927 include diagnosis, prevention and treatment of diseases and clinical conditions associated with ARHGAP6. The function of ARHGAP6 and its association with various diseases and clinical conditions, has been established by previous studies, as described hereinabove with reference to VGAM55. Attractin (ATRN, Accession NM_139321) is another VGAM927 host target gene. ATRN BINDING SITE is HOST TARGET binding site found in the 3" untranslated region of mRNA encoded by ATRN, corresponding to a HOST TARGET binding site such as BINDING SITE I, BINDING SITE II or BINDING SITE III. Table 2 illustrates the complementarity of the nucleotide sequences of ATRN BINDING SITE, designated SEQ ID:29296, to the nucleotide sequence of VGAM927 RNA, herein designated VGAM RNA, also designated SEQ ID:3638.

Another function of VGAM927 is therefore inhibition of Attractin (ATRN, Accession NM_139321), a gene which is involved in the initial immune cell clustering during inflammatory response. Accordingly, utilities of VGAM927 include diagnosis, prevention and treatment of diseases and clinical conditions associated with ATRN. The function of ATRN and its association with various diseases and clinical conditions, has been established by previous studies, as described hereinabove with reference to VGAM53. B-cell CLL/lymphoma 11B (zinc finger protein) (BCL11B, Accession NM_022898)

is another VGAM927 host target gene. BCL11B BINDING SITE is HOST TARGET binding site found in the 3' untranslated region of mRNA encoded by BCL11B, corresponding to a HOST TARGET binding site such as BINDING SITE I, BINDING SITE II or BINDING SITE III. Table 2 illustrates the complementarity of the nucleotide sequences of BCL11B BINDING SITE, designated SEQ ID:23158, to the nucleotide sequence of VGAM927 RNA, herein designated VGAM RNA, also designated SEQ ID:3638.

Another function of VGAM927 is therefore inhibition of B-cell CLL/lymphoma 11B (zinc finger protein) (BCL11B, Accession NM_022898). Accordingly, utilities of VGAM927 include diagnosis, prevention and treatment of diseases and clinical conditions associated with BCL11B. Fibroblast Activation Protein, Alpha (FAP, Accession NM_004460) is another VGAM927 host target gene. FAP BINDING SITE is HOST TARGET binding site found in the 5" untranslated region of mRNA encoded by FAP, corresponding to a HOST TARGET binding site such as BINDING SITE I, BINDING SITE II or BINDING SITE III. Table 2 illustrates the complementarity of the nucleotide sequences of FAP BINDING SITE, designated SEQ ID:10766, to the nucleotide sequence of VGAM927 RNA, herein designated VGAM RNA, also designated SEQ ID:3638.

Another function of VGAM927 is therefore inhibition of Fibroblast Activation Protein, Alpha (FAP, Accession NM_004460), a gene which may have a role in tissue remodeling during development and wound healing. Accordingly, utilities of VGAM927 include diagnosis, prevention and treatment of diseases and clinical conditions associated with FAP. The function of FAP has been established by previous studies. Fibroblast activation protein-alpha (FAP-alpha) is an inducible cell surface glycoprotein that was originally identified in cultured fibroblasts using monoclonal antibody F19. Immunohistochemical studies have shown that FAP-alpha is transiently expressed in certain normal fetal mesenchymal tissues but that normal adult tissues as well as malignant epithelial, neural, and hematopoietic cells are generally FAP-alpha-negative. However, most of the common types of epithelial cancers contain abundant FAP-alpha-reactive stromal fibroblasts. Scanlan et al. (1994) cloned an FAP-alpha cDNA from a WI-38 human fibroblast cDNA expression library by immunoselection using antibody F19. The predicted 760-amino acid FAP-alpha protein (GenBank 1888316) is a type II integral membrane protein with a large C-terminal extracellular domain, which contains 6 potential N-glycosylation sites, 13 cysteine residues, and 3 segments that correspond to highly conserved catalytic domains of serine proteases; a hydrophobic transmembrane segment; and a short cytoplasmic tail. FAP-alpha shows 48% amino acid identity with dipeptidyl peptidase IV (DPP4; 102720) and 30% identity with DPP4-related protein (DPPX; 126141). Northern blot analysis detected a 2.8-kb FAP-alpha mRNA in fibroblasts. Seprase is a 170-kD integral membrane gelatinase whose expression correlates with the invasiveness of human melanoma and carcinoma cells. Goldstein et al. (1997) cloned and characterized a seprase cDNA. They suggested that seprase and FAP-alpha are the same protein and products of the same gene. Pineiro-Sanchez et al. (1997) isolated seprase protein from the cell membranes and shed vesicles of human melanoma LOX cells. Serine protease inhibitors blocked the gelatinase activity of seprase, suggesting that seprase contains a catalytically active serine residue (s). The authors found that seprase is composed of monomeric, N-glycosylated 97-kD subunits that are proteolytically inactive. They concluded that seprase is similar to DPP4 in that their proteolytic activities are dependent upon subunit association.

Full details of the abovementioned studies are described in the following publications, the disclosure of which are hereby incorporated by reference:

Pineiro-Sanchez, M. L.; Goldstein, L. A.; Dodt, J.; Howard, L.; Yeh, Y.; Tran, H.; Argraves, W. S.; Chen, W.-T.: Identification of the 170-kDa melanoma membrane-bound gelatinase (seprase) as a serine integral membrane protease. J. Biol. Chem. 272:7595-7601, 1997; and Scanlan, M. J.; Raj, B. K. M.; Calvo, B.; Garin-Chesa, P.; Sanz-Moncasi, M. P.; Healey, J. H.; Old, L. J.; Rettig, W. J.: Molecular cloning of fibroblast activation protein alpha, a me.

Further studies establishing the function and utilities of FAP are found in John Hopkins OMIM database record ID 600403, and in sited publications numbered 7113-7116 listed in the bibliography section hereinbelow, which are also hereby incorporated by reference. Leukemia Inhibitory Factor (cholinergic differentiation factor) (LIF, Accession NM_002309) is another VGAM927 host target gene. LIF BINDING SITE is HOST TARGET binding site found in the 3' untranslated region of mRNA encoded by LIF, corresponding to a HOST TARGET binding site such as BINDING SITE I, BINDING SITE II or BINDING SITE III. Table 2 illustrates the complementarity of the nucleotide sequences of LIF BINDING SITE, designated SEQ ID:8097, to the nucleotide sequence of VGAM927 RNA, herein designated VGAM RNA, also designated SEQ ID:3638.

Another function of VGAM927 is therefore inhibition of Leukemia Inhibitory Factor (cholinergic differentiation factor) (LIF, Accession NM_002309). Accordingly, utilities of VGAM927 include diagnosis, prevention and treatment of diseases and clinical conditions associated with LIF. Phosphoribosyl Pyrophosphate Synthetase 2 (PRPS2, Accession NM_002765) is another VGAM927 host target gene. PRPS2 BINDING SITE is HOST TARGET binding site found in the 3' untranslated region of mRNA encoded by PRPS2, corresponding to a HOST TARGET binding site such as BINDING SITE I, BINDING SITE II or BINDING SITE III. Table 2 illustrates the complementarity of the nucleotide sequences of PRPS2 BINDING SITE, designated SEQ ID:8655, to the nucleotide sequence of VGAM927 RNA, herein designated VGAM RNA, also designated SEQ ID:3638.

Another function of VGAM927 is therefore inhibition of Phosphoribosyl Pyrophosphate Synthetase 2 (PRPS2, Accession NM_002765), a gene which generates the PRPP needed for initiation of purine biosynthesis. Accordingly, utilities of VGAM927 include diagnosis, prevention and treatment of diseases and clinical conditions associated with PRPS2. The function of PRPS2 and its association with various diseases and clinical conditions, has been established by previous studies, as described hereinabove with reference to VGAM828. Solute Carrier Family 10 (sodium/bile acid cotransporter family), Member 2 (SLC10A2, Accession NM_000452) is another VGAM927 host target gene. SLC10A2 BINDING SITE is HOST TARGET binding site found in the 3' untranslated region of mRNA encoded by SLC10A2, corresponding to a HOST TARGET binding site such as BINDING SITE I, BINDING SITE II or BINDING SITE III. Table 2 illustrates the complementarity of the nucleotide sequences of SLC10A2 BINDING SITE, designated SEQ ID:6064, to the nucleotide sequence of VGAM927 RNA, herein designated VGAM RNA, also designated SEQ ID:3638.

Another function of VGAM927 is therefore inhibition of Solute Carrier Family 10 (sodium/bile acid cotransporter family), Member 2 (SLC10A2, Accession NM_000452). Accordingly, utilities of VGAM927 include diagnosis, prevention and treatment of diseases and clinical conditions associated with SLC10A2. Signal Transducing Adaptor Molecule (SH3 domain and ITAM motif) 1 (STAM, Accession NM_003473) is another VGAM927 host target gene. STAM BINDING SITE is HOST TARGET binding site found in the 3' untranslated region of mRNA encoded by STAM, corresponding to a HOST TARGET binding site such as BINDING SITE I, BINDING SITE II or BINDING SITE III. Table 2 illustrates the complementarity of the nucleotide sequences of STAM BINDING SITE, designated SEQ ID:9539, to the nucleotide sequence of VGAM927 RNA, herein designated VGAM RNA, also designated SEQ ID:3638.

Another function of VGAM927 is therefore inhibition of Signal Transducing Adaptor Molecule (SH3 domain and ITAM motif) 1 (STAM, Accession NM_003473), a gene which is as an adaptor molecule involved in the downstream signaling of cytokine receptors. Accordingly, utilities of VGAM927 include diagnosis, prevention and treatment of diseases and clinical conditions associated with STAM. The function of STAM has been established by previous studies. Stimulation of cells with cytokines results in a signal transduction cascade involving cytokine receptors, Janus kinases (JAKs) and signal transducers and activators of transcription (STATs). In order to investigate signal transduction downstream of JAK3 (OMIM Ref. No. 600173), Takeshita et al. (1996) screened for molecules induced after stimulation of cells with the cytokine IL2 (OMIM Ref. No. 147680). Their screen identified a novel molecule, which they named STAM for 'signal-transducing adaptor molecule.' They cloned the human STAM cDNA from a T-cell cDNA library and found that it encodes a 540-amino acid polypeptide. The approximately 70-kD protein product was precipitated by anti-phosphotyrosine. Northern blot analysis indicated that STAM was expressed as a 2.9-kb message in all tissue and cell types examined. The STAM sequence contains a Src-homology 3 (SH3) domain and an immunoreceptor tyrosine-based activation motif (ITAM). Takeshita et al. (1996) suggested that STAM acts as an adaptor molecule in signal transduction pathways from cytokine receptors. Asao et al. (1997) showed that HGS (OMIM Ref. No. 604375) binds to STAM via coiled-coil sequences and appears to regulate proliferation in response to cytokines.

Full details of the abovementioned studies are described in the following publications, the disclosure of which are hereby incorporated by reference:

Asao, H.; Sasaki, Y.; Arita, T.; Tanaka, N.; Endo, K.; Kasai, H.; Takeshita, T; Endo, Y.; Fujita, T.; Sugamura, K.: Hrs is associated with STAM, a signal-transducing adaptor molecule: its suppressive effect on cytokine-induced cell growth. J. Biol. Chem. 272:32785-32791, 1997; and Takeshita, T.; Arita, T.; Asao, H.; Tanaka, N.; Higuchi, M.; Kuroda, H.; Kaneko, K.; Munakata, H.; Endo, Y.; Fujita, T.; Sugamura, K.: Cloning of a novel signal-transducing adaptor mol.

Further studies establishing the function and utilities of STAM are found in John Hopkins OMIM database record ID 601899, and in sited publications numbered 8742-8743 listed in the bibliography section hereinbelow, which are also hereby incorporated by reference. Transcobalamin II; Macrocytic Anemia (TCN2, Accession NM_000355) is another VGAM927 host target gene. TCN2 BINDING SITE is HOST TARGET binding site found in the 5' untranslated region of mRNA encoded by TCN2, corresponding to a HOST TARGET binding site such as BINDING SITE I, BINDING SITE II or BINDING SITE III. Table 2 illustrates the complementarity of the nucleotide sequences of TCN2 BINDING SITE, designated SEQ ID:5916, to the nucleotide sequence of VGAM927 RNA, herein designated VGAM RNA, also designated SEQ ID:3638.

Another function of VGAM927 is therefore inhibition of Transcobalamin II; Macrocytic Anemia (TCN2, Accession NM_000355). Accordingly, utilities of VGAM927 include diagnosis, prevention and treatment of diseases and clinical conditions associated with TCN2. Tec Protein Tyrosine Kinase (TEC, Accession NM_003215) is another VGAM927 host target gene. TEC BINDING SITE is HOST TARGET binding site found in the 3' untranslated region of mRNA encoded by TEC, corresponding to a HOST TARGET binding site such as BINDING SITE I, BINDING SITE II or BINDING SITE III. Table 2 illustrates the complementarity of the nucleotide sequences of TEC BINDING SITE, designated SEQ ID:9216, to the nucleotide sequence of VGAM927 RNA, herein designated VGAM RNA, also designated SEQ ID:3638.

Another function of VGAM927 is therefore inhibition of Tec Protein Tyrosine Kinase (TEC, Accession NM_003215). Accordingly, utilities of VGAM927 include diagnosis, prevention and treatment of diseases and clinical conditions associated with TEC. AIG-1 (Accession NM_016108) is another VGAM927 host target gene. AIG-1 BINDING SITE is HOST TARGET binding site found in the 3' untranslated region of mRNA encoded by AIG-1, corresponding to a HOST TARGET binding site such as BINDING SITE I, BINDING SITE II or BINDING SITE III. Table 2 illustrates the complementarity of the nucleotide sequences of AIG-1 BINDING SITE, designated SEQ ID:18190, to the nucleotide sequence of VGAM927 RNA, herein designated VGAM RNA, also designated SEQ ID:3638.

Another function of VGAM927 is therefore inhibition of AIG-1 (Accession NM_016108). Accordingly, utilities of VGAM927 include diagnosis, prevention and treatment of diseases and clinical conditions associated with AIG-1. Butyrophilin, Subfamily 2, Member A1 (BTN2A1, Accession NM_078476) is another VGAM927 host target gene. BTN2A1 BINDING SITE is HOST TARGET binding site found in the 3' untranslated region of mRNA encoded by BTN2A1, corresponding to a HOST TARGET binding site such as BINDING SITE I, BINDING SITE II or BINDING SITE III. Table 2 illustrates the complementarity of the nucleotide sequences of BTN2A1 BINDING SITE, designated SEQ ID:27804, to the nucleotide sequence of VGAM927 RNA, herein designated VGAM RNA, also designated SEQ ID:3638.

Another function of VGAM927 is therefore inhibition of Butyrophilin, Subfamily 2, Member A1 (BTN2A1, Accession NM_078476). Accordingly, utilities of VGAM927 include diagnosis, prevention and treatment of diseases and clinical conditions associated with BTN2A1. FLJ10120 (Accession NM_018001) is another VGAM927 host target gene. FLJ10120 BINDING SITE is HOST TARGET binding site found in the 3' untranslated region of mRNA encoded by FLJ10120, corresponding to a HOST TARGET binding site such as BINDING SITE I, BINDING SITE II or BINDING SITE III. Table 2 illustrates the complementarity of the nucleotide sequences of FLJ10120 BINDING SITE, designated SEQ ID:19728, to the nucleotide sequence of VGAM927 RNA, herein designated VGAM RNA, also designated SEQ ID:3638.

Another function of VGAM927 is therefore inhibition of FLJ10120 (Accession NM_018001). Accordingly, utilities of VGAM927 include diagnosis, prevention and treatment of diseases and clinical conditions associated with FLJ10120. FLJ10540 (Accession NM_018131) is another VGAM927 host target gene. FLJ10540 BINDING SITE is HOST TAR- GET binding site found in the 5' untranslated region of mRNA encoded by FLJ10540, corresponding to a HOST TARGET binding site such as BINDING SITE I, BINDING SITE II or BINDING SITE III. Table 2 illustrates the complementarity of the nucleotide sequences of FLJ10540 BINDING SITE, designated SEQ ID:19929, to the nucleotide sequence of VGAM927 RNA, herein designated VGAM RNA, also designated SEQ ID:3638.

Another function of VGAM927 is therefore inhibition of FLJ10540 (Accession NM_018131). Accordingly, utilities of VGAM927 include diagnosis, prevention and treatment of diseases and clinical conditions associated with FLJ10540. FLJ23045 (Accession NM_024704) is another VGAM927 host target gene. FLJ23045 BINDING SITE is HOST TARGET binding site found in the 3' untranslated region of mRNA encoded by FLJ23045, corresponding to a HOST TARGET binding site such as BINDING SITE I, BINDING SITE II or BINDING SITE III. Table 2 illustrates the complementarity of the nucleotide sequences of FLJ23045 BINDING SITE, designated SEQ ID:24020, to the nucleotide sequence of VGAM927 RNA, herein designated VGAM RNA, also designated SEQ ID:3638.

Another function of VGAM927 is therefore inhibition of FLJ23045 (Accession NM_024704). Accordingly, utilities of VGAM927 include diagnosis, prevention and treatment of diseases and clinical conditions associated with FLJ23045. KIAA1361 (Accession XM_030845) is another VGAM927 host target gene. KIAA1361 BINDING SITE is HOST TARGET binding site found in the 3' untranslated region of mRNA encoded by KIAA1361, corresponding to a HOST TARGET binding site such as BINDING SITE I, BINDING SITE II or BINDING SITE III. Table 2 illustrates the complementarity of the nucleotide sequences of KIAA1361 BINDING SITE, designated SEQ ID:31169, to the nucleotide sequence of VGAM927 RNA, herein designated VGAM RNA, also designated SEQ ID:3638.

Another function of VGAM927 is therefore inhibition of KIAA1361 (Accession XM_030845). Accordingly, utilities of VGAM927 include diagnosis, prevention and treatment of diseases and clinical conditions associated with KIAA1361. KIAA1750 (Accession XM_043067) is another VGAM927 host target gene. KIAA1750 BINDING SITE is HOST TARGET binding site found in the 3' untranslated region of mRNA encoded by KIAA1750, corresponding to a HOST TARGET binding site such as BINDING SITE I, BINDING SITE II or BINDING SITE III. Table 2 illustrates the complementarity of the nucleotide sequences of KIAA1750 BINDING SITE, designated SEQ ID:33870, to the nucleotide sequence of VGAM927 RNA, herein designated VGAM RNA, also designated SEQ ID:3638.

Another function of VGAM927 is therefore inhibition of KIAA1750 (Accession XM_043067). Accordingly, utilities of VGAM927 include diagnosis, prevention and treatment of diseases and clinical conditions associated with KIAA1750. Protein Tyrosine Phosphatase, Receptor Type, U (PTPRU, Accession NM_133177) is another VGAM927 host target gene. PTPRU BINDING SITE1 through PTPRU BINDING SITE3 are HOST TARGET binding sites found in untranslated regions of mRNA encoded by PTPRU, corresponding to HOST TARGET binding sites such as BINDING SITE I, BINDING SITE II or BINDING SITE III. Table 2 illustrates the complementarity of the nucleotide sequences of PTPRU BINDING SITE1 through PTPRU BINDING SITE3, designated SEQ ID:28402, SEQ ID:28407 and SEQ ID:12257 respectively, to the nucleotide sequence of VGAM927 RNA, herein designated VGAM RNA, also designated SEQ ID:3638.

Another function of VGAM927 is therefore inhibition of Protein Tyrosine Phosphatase, Receptor Type, U (PTPRU, Accession NM_133177). Accordingly, utilities of VGAM927 include diagnosis, prevention and treatment of diseases and clinical conditions associated with PTPRU. LOC144962 (Accession XM_084990) is another VGAM927 host target gene. LOC144962 BINDING SITE is HOST TARGET binding site found in the 5' untranslated region of mRNA encoded by LOC144962, corresponding to a HOST TARGET binding site such as BINDING SITE I, BINDING SITE II or BINDING SITE III. Table 2 illustrates the complementarity of the nucleotide sequences of LOC144962 BINDING SITE, designated SEQ ID:37792, to the nucleotide sequence of VGAM927 RNA, herein designated VGAM RNA, also designated SEQ ID:3638.

Another function of VGAM927 is therefore inhibition of LOC144962 (Accession XM_084990). Accordingly, utilities of VGAM927 include diagnosis, prevention and treatment of diseases and clinical conditions associated with LOC144962. LOC151248 (Accession XM_087143) is another VGAM927 host target gene. LOC151248 BINDING SITE is HOST TARGET binding site found in the 5' untranslated region of mRNA encoded by LOC151248, corresponding to a HOST TARGET binding site such as BINDING SITE I, BINDING SITE II or BINDING SITE III. Table 2 illustrates the complementarity of the nucleotide sequences of LOC151248 BINDING SITE, designated SEQ ID:39090, to the nucleotide sequence of VGAM927 RNA, herein designated VGAM RNA, also designated SEQ ID:3638.

Another function of VGAM927 is therefore inhibition of LOC151248 (Accession XM_087143). Accordingly, utilities of VGAM927 include diagnosis, prevention and treatment of diseases and clinical conditions associated with LOC151248. LOC157421 (Accession XM_098756) is another VGAM927 host target gene. LOC157421 BINDING SITE is HOST TARGET binding site found in the 5' untranslated region of mRNA encoded by LOC157421, corresponding to a HOST TARGET binding site such as BINDING SITE I, BINDING SITE II or BINDING SITE III. Table 2 illustrates the complementarity of the nucleotide sequences of LOC157421 BINDING SITE, designated SEQ ID:41795, to the nucleotide sequence of VGAM927 RNA, herein designated VGAM RNA, also designated SEQ ID:3638.

Another function of VGAM927 is therefore inhibition of LOC157421 (Accession XM_098756). Accordingly, utilities of VGAM927 include diagnosis, prevention and treatment of diseases and clinical conditions associated with LOC157421. LOC158014 (Accession XM_088442) is another VGAM927 host target gene. LOC158014 BINDING SITE is HOST TARGET binding site found in the 5' untranslated region of mRNA encoded by LOC158014, corresponding to a HOST TARGET binding site such as BINDING SITE I, BINDING SITE II or BINDING SITE III. Table 2 illustrates the complementarity of the nucleotide sequences of LOC158014 BINDING SITE, designated SEQ ID:39693, to the nucleotide sequence of VGAM927 RNA, herein designated VGAM RNA, also designated SEQ ID:3638.

Another function of VGAM927 is therefore inhibition of LOC158014 (Accession XM_088442). Accordingly, utilities of VGAM927 include diagnosis, prevention and treatment of diseases and clinical conditions associated with LOC158014. LOC220846 (Accession XM_165515) is another VGAM927 host target gene. LOC220846 BINDING SITE is HOST TARGET binding site found in the 3' untranslated region of mRNA encoded by LOC220846, corresponding to a HOST TARGET binding site such as BINDING SITE I, BINDING SITE II or BINDING SITE III. Table 2 illustrates the complementarity of the nucleotide sequences of LOC220846 BINDING SITE, designated SEQ ID:43663, to the nucleotide sequence of VGAM927 RNA, herein designated VGAM RNA, also designated SEQ ID:3638.

Another function of VGAM927 is therefore inhibition of LOC220846 (Accession XM_165515). Accordingly, utilities of VGAM927 include diagnosis, prevention and treatment of diseases and clinical conditions associated with LOC220846. LOC220930 (Accession XM_167624) is another VGAM927 host target gene. LOC220930 BINDING SITE is HOST TARGET binding site found in the 3' untranslated region of mRNA encoded by LOC220930, corresponding to a HOST TARGET binding site such as BINDING SITE I, BINDING SITE II or BINDING SITE III. Table 2 illustrates the complementarity of the nucleotide sequences of LOC220930 BINDING SITE, designated SEQ ID:44731, to the nucleotide sequence of VGAM927 RNA, herein designated VGAM RNA, also designated SEQ ID:3638.

Another function of VGAM927 is therefore inhibition of LOC220930 (Accession XM_167624). Accordingly, utilities of VGAM927 include diagnosis, prevention and treatment of diseases and clinical conditions associated with LOC220930. LOC51320 (Accession NM_016626) is another VGAM927 host target gene. LOC51320 BINDING SITE is HOST TARGET binding site found in the 3' untranslated region of mRNA encoded by LOC51320, corresponding to a HOST TARGET binding site such as BINDING SITE I, BINDING SITE II or BINDING SITE III. Table 2 illustrates the complementarity of the nucleotide sequences of LOC51320 BINDING SITE, designated SEQ ID:18741, to the nucleotide sequence of VGAM927 RNA, herein designated VGAM RNA, also designated SEQ ID:3638.

Another function of VGAM927 is therefore inhibition of LOC51320 (Accession NM_016626). Accordingly, utilities of VGAM927 include diagnosis, prevention and treatment of diseases and clinical conditions associated with LOC51320. LOC84549 (Accession NM_032509) is another VGAM927 host target gene. LOC84549 BINDING SITE is HOST TARGET binding site found in the 3' untranslated region of mRNA encoded by LOC84549, corresponding to a HOST TARGET binding site such as BINDING SITE I, BINDING SITE II or BINDING SITE III. Table 2 illustrates the complementarity of the nucleotide sequences of LOC84549 BINDING SITE, designated SEQ ID:26261, to the nucleotide sequence of VGAM927 RNA, herein designated VGAM RNA, also designated SEQ ID:3638.

Another function of VGAM927 is therefore inhibition of LOC84549 (Accession NM_032509). Accordingly, utilities of VGAM927 include diagnosis, prevention and treatment of diseases and clinical conditions associated with LOC84549. FIG. 1 further provides a conceptual description of a novel bioinformatically detected viral gene of the present invention, referred to here as Viral Genomic Address Messenger 928 (VGAM928) viral gene, which modulates expression of respective host target genes thereof, the function and utility of which host target genes is known in the art.

VGAM928 is a novel bioinformatically detected regulatory, non protein coding, viral micro RNA (miRNA) gene. The method by which VGAM928 was detected is described hereinabove with reference to FIGS. 1-8.

VGAM928 gene, herein designated VGAM GENE, is a viral gene contained in the genome of Infectious Spleen and Kidney Necrosis Virus. VGAM928 host target gene, herein designated VGAM HOST TARGET GENE, is a human gene contained in the human genome.

VGAM928 gene encodes a VGAM928 precursor RNA, herein designated VGAM PRECURSOR RNA. Similar to other miRNA genes, and unlike most ordinary genes, VGAM928 precursor RNA does not encode a protein. A nucleotide sequence identical or highly similar to the nucleotide sequence of VGAM928 precursor RNA is designated SEQ ID:914, and is provided hereinbelow with reference to the sequence listing part. Nucleotide sequence SEQ ID:914 is located at position 67062 relative to the genome of Infectious Spleen and Kidney Necrosis Virus.

VGAM928 precursor RNA folds onto itself, forming VGAM928 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM928 folded precursor RNA into VGAM928 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM928 RNA is designated SEQ ID:3639, and is provided hereinbelow with reference to the sequence listing part.

VGAM928 host target gene, herein designated VGAM HOST TARGET GENE, encodes a corresponding messenger RNA, VGAM928 host target RNA, herein designated VGAM HOST TARGET RNA. VGAM928 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM928 RNA, herein designated VGAM RNA, binds complementarily to one or more host target binding sites located in untranslated regions of VGAM928 host target RNA, herein designated VGAM HOST TARGET RNA. This complementary binding is due to the fact that the nucleotide sequence of VGAM928 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM928 RNA, herein designated VGAM RNA, may have a different number of host target binding sites in untranslated regions of a VGAM928 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM928 RNA, herein designated VGAM RNA, to host target binding sites on VGAM928 host target RNA, herein designated VGAM HOST TARGET RNA, such as BINDING SITE I, BINDING SITE II and BINDING SITE III, inhibits translation of VGAM928 host target RNA into VGAM928 host target protein, herein designated VGAM HOST TARGET PROTEIN. VGAM host target protein is therefore outlined by a broken line.

It is appreciated that VGAM928 host target gene, herein designated VGAM HOST TARGET GENE, in fact represents a plurality of VGAM928 host target genes. The mRNA of each one of this plurality of VGAM928 host target genes comprises one or more host target binding sites, each having a nucleotide sequence which is at least partly complementary to VGAM928 RNA, herein designated VGAM RNA, and which when bound by VGAM928 RNA causes inhibition of translation of respective one or more VGAM928 host target proteins.

It is further appreciated by one skilled in the art that the mode of translational inhibition illustrated by FIG. 1 with specific reference to translational inhibition exerted by VGAM928 gene, herein designated VGAM GENE, on one or more VGAM928 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM928 is inhibition of expression of host target genes, as part of a novel viral mechanism of attacking a host. Accordingly, utilities of VGAM928 include diagnosis, prevention and treatment of viral infection by Infectious Spleen and Kidney Necrosis Virus. Specific functions, and accordingly utilities, of VGAM928 correlate with, and may be deduced from, the identity of the host target genes which VGAM928 binds and inhibits, and the function of these host target genes, as elaborated hereinbelow.

Nucleotide sequences of the VGAM928 precursor RNA, herein designated VGAM PRECURSOR RNA, and of the 'diced' VGAM928 RNA, herein designated VGAM RNA, and a schematic representation of the secondary folding of VGAM928 folded precursor RNA, herein designated VGAM FOLDED PRECURSOR RNA, of VGAM928 are further described hereinbelow with reference to Table 1.

Nucleotide sequences of host target binding sites, such as BINDING SITE-I, BINDING SITE-II and BINDING SITE-III of FIG. 1, found on VGAM928 host target RNA, and schematic representation of the complementarity of each of these host target binding sites to VGAM928 RNA, herein designated VGAM RNA, are described hereinbelow with reference to Table 2.

As mentioned hereinabove with reference to FIG. 1, a function of VGAM928 gene, herein designated VGAM is inhibition of expression of VGAM928 target genes. It is appreciated that specific functions, and accordingly utilities, of VGAM928 correlate with, and may be deduced from, the identity of the target genes which VGAM928 binds and inhibits, and the function of these target genes, as elaborated hereinbelow.

Secreted Frizzled-related Protein 4 (SFRP4, Accession NM_003014) is a VGAM928 host target gene. SFRP4 BINDING SITE is HOST TARGET binding site found in the 3' untranslated region of mRNA encoded by SFRP4, corresponding to a HOST TARGET binding site such as BINDING SITE I, BINDING SITE II or BINDING SITE III. Table 2 illustrates the complementarity of the nucleotide sequences of SFRP4 BINDING SITE, designated SEQ ID:8938, to the nucleotide sequence of VGAM928 RNA, herein designated VGAM RNA, also designated SEQ ID:3639.

A function of VGAM928 is therefore inhibition of Secreted Frizzled-related Protein 4 (SFRP4, Accession NM_003014). Accordingly, utilities of VGAM928 include diagnosis, prevention and treatment of diseases and clinical conditions associated with SFRP4. ATP Synthase Mitochondrial F1 Complex Assembly Factor 2 (ATPAF2, Accession XM_058905) is another VGAM928 host target gene. ATPAF2 BINDING SITE is HOST TARGET binding site found in the 5' untranslated region of mRNA encoded by ATPAF2, corresponding to a HOST TARGET binding site such as BINDING SITE I, BINDING SITE II or BINDING SITE III. Table 2 illustrates the complementarity of the nucleotide sequences of ATPAF2 BINDING SITE, designated SEQ ID:36790, to the nucleotide sequence of VGAM928 RNA, herein designated VGAM RNA, also designated SEQ ID:3639.

Another function of VGAM928 is therefore inhibition of ATP Synthase Mitochondrial F1 Complex Assembly Factor 2 (ATPAF2, Accession XM_058905). Accordingly, utilities of VGAM928 include diagnosis, prevention and treatment of diseases and clinical conditions associated with ATPAF2. FIG. 1 further provides a conceptual description of a novel bioinformatically detected viral gene of the present invention, referred to here as Viral Genomic Address Messenger 929 (VGAM929) viral gene, which modulates expression of respective host target genes thereof, the function and utility of which host target genes is known in the art.

VGAM929 is a novel bioinformatically detected regulatory, non protein coding, viral micro RNA (miRNA) gene. The method by which VGAM929 was detected is described hereinabove with reference to FIGS. 1-8.

VGAM929 gene, herein designated VGAM GENE, is a viral gene contained in the genome of Infectious Spleen and Kidney Necrosis Virus. VGAM929 host target gene, herein designated VGAM HOST TARGET GENE, is a human gene contained in the human genome.

VGAM929 gene encodes a VGAM929 precursor RNA, herein designated VGAM PRECURSOR RNA. Similar to other miRNA genes, and unlike most ordinary genes, VGAM929 precursor RNA does not encode a protein. A nucleotide sequence identical or highly similar to the nucleotide sequence of VGAM929 precursor RNA is designated SEQ ID:915, and is provided hereinbelow with reference to the sequence listing part. Nucleotide sequence SEQ ID:915 is located at position 64221 relative to the genome of Infectious Spleen and Kidney Necrosis Virus.

VGAM929 precursor RNA folds onto itself, forming VGAM929 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM929 folded precursor RNA into VGAM929 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM929 RNA is designated SEQ ID:3640, and is provided hereinbelow with reference to the sequence listing part.

VGAM929 host target gene, herein designated VGAM HOST TARGET GENE, encodes a corresponding messenger RNA, VGAM929 host target RNA, herein designated VGAM HOST TARGET RNA. VGAM929 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM929 RNA, herein designated VGAM RNA, binds complementarily to one or more host target binding sites located in untranslated regions of VGAM929 host target RNA, herein designated VGAM HOST TARGET RNA. This complementary binding is due to the fact that the nucleotide sequence of VGAM929 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM929 RNA, herein designated VGAM RNA, may have a different number of host target binding sites in untranslated regions of a VGAM929 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM929 RNA, herein designated VGAM RNA, to host target binding sites on VGAM929 host target RNA, herein designated VGAM HOST TARGET RNA, such as BINDING SITE I, BINDING SITE II and BINDING SITE III, inhibits translation of VGAM929 host target RNA into VGAM929 host target protein, herein designated VGAM HOST TARGET PROTEIN. VGAM host target protein is therefore outlined by a broken line.

It is appreciated that VGAM929 host target gene, herein designated VGAM HOST TARGET GENE, in fact represents a plurality of VGAM929 host target genes. The mRNA of each one of this plurality of VGAM929 host target genes comprises one or more host target binding sites, each having a nucleotide sequence which is at least partly complementary to VGAM929 RNA, herein designated VGAM RNA, and which when bound by VGAM929 RNA causes inhibition of translation of respective one or more VGAM929 host target proteins.

It is further appreciated by one skilled in the art that the mode of translational inhibition illustrated by FIG. 1 with specific reference to translational inhibition exerted by VGAM929 gene, herein designated VGAM GENE, on one or more VGAM929 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM929 is inhibition of expression of host target genes, as part of a novel viral mechanism of attacking a host. Accordingly, utilities of VGAM929 include diagnosis, prevention and treatment of viral infection by Infectious Spleen and Kidney Necrosis Virus. Specific functions, and accordingly utilities, of VGAM929 correlate with, and may be deduced from, the identity of the host target genes which VGAM929 binds and inhibits, and the function of these host target genes, as elaborated hereinbelow.

Nucleotide sequences of the VGAM929 precursor RNA, herein designated VGAM PRECURSOR RNA, and of the 'diced' VGAM929 RNA, herein designated VGAM RNA, and a schematic representation of the secondary folding of VGAM929 folded precursor RNA, herein designated VGAM FOLDED PRECURSOR RNA, of VGAM929 are further described hereinbelow with reference to Table 1.

Nucleotide sequences of host target binding sites, such as BINDING SITE-I, BINDING SITE-II and BINDING SITE-III of FIG. 1, found on VGAM929 host target RNA, and schematic representation of the complementarity of each of these host target binding sites to VGAM929 RNA, herein designated VGAM RNA, are described hereinbelow with reference to Table 2.

As mentioned hereinabove with reference to FIG. 1, a function of VGAM929 gene, herein designated VGAM is inhibition of expression of VGAM929 target genes. It is appreciated that specific functions, and accordingly utilities, of VGAM929 correlate with, and may be deduced from, the identity of the target genes which VGAM929 binds and inhibits, and the function of these target genes, as elaborated hereinbelow.

Diphtheria Toxin Receptor (heparin-binding epidermal growth factor-like growth factor) (DTR, Accession NM_001945) is a VGAM929 host target gene. DTR BINDING SITE is HOST TARGET binding site found in the 3' untranslated region of mRNA encoded by DTR, corresponding to a HOST TARGET binding site such as BINDING SITE I, BINDING SITE II or BINDING SITE III. Table 2 illustrates the complementarity of the nucleotide sequences of DTR BINDING SITE, designated SEQ ID:7661, to the nucleotide sequence of VGAM929 RNA, herein designated VGAM RNA, also designated SEQ ID:3640.

A function of VGAM929 is therefore inhibition of Diphtheria Toxin Receptor (heparin-binding epidermal growth factor-like growth factor) (DTR, Accession NM_001945), a gene which may be involved in macrophage-mediated cellular proliferation. Accordingly, utilities of VGAM929 include diagnosis, prevention and treatment of diseases and clinical conditions associated with DTR. The function of DTR and its association with various diseases and clinical conditions, has been established by previous studies, as described hereinabove with reference to VGAM242. Lysozyme (renal amyloidosis) (LYZ, Accession NM_000239) is another VGAM929 host target gene. LYZ BINDING SITE is HOST TARGET binding site found in the 3' untranslated region of mRNA encoded by LYZ, corresponding to a HOST TARGET binding site such as BINDING SITE I, BINDING SITE II or BINDING SITE III. Table 2 illustrates the complementarity of the nucleotide sequences of LYZ BINDING SITE, designated SEQ ID:5756, to the nucleotide sequence of VGAM929 RNA, herein designated VGAM RNA, also designated SEQ ID:3640.

Another function of VGAM929 is therefore inhibition of Lysozyme (renal amyloidosis) (LYZ, Accession NM_000239), a gene which a bacteriolytic enzyme. Accordingly, utilities of VGAM929 include diagnosis, prevention and treatment of diseases and clinical conditions associated with LYZ. The function of LYZ has been established by previous studies. Lysozyme (EC 3.2.1.17) catalyzes the hydrolysis of certain mucopolysaccharides of bacterial cell walls. Specifically, it catalyzes the hydrolysis of the bacterial cell wall beta (1-4) glycosidic linkages between N-acetylmuramic acid and N-acetylglucosamine. It is found in spleen, lung, kidney, white blood cells, plasma, saliva, milk and tears. Alexander Fleming (1881-1955), of penicillin fame, discovered and named lysozyme. In a communication to the Royal Society, Fleming (1922) wrote: '. I wish to draw attention to a substance present in the tissues and secretions of the body, which is capable of rapidly dissolving certain bacteria. As this substance has properties akin to those of ferments I have called it a Lysozyme.' Fleming and Allison (1922) demonstrated an unusually high concentration in cartilage, indeed the highest of any tissue. Its role in cartilage is unknown. It resembles lactalbumin (OMIM Ref. No. 149750) in structure. Human lysozyme has a molecular mass of 14,602 Da. Neufeld (1972) suggested that a genetic defect of lysozyme might underlie a skeletal dysplasia. Spitznagel et al. (1972) observed a patient with selective deficiency of a particular type of neutrophil granule which resulted in about 50% reduction in lysozyme levels. The patient showed increased susceptibility to infectionPrieur et al. (1974) described inherited lysozyme deficiency in rabbits. No abnormality of cartilage or bone was noted (Greenwald et al., 1975). Older mutant rabbits showed increased susceptibility to infections, especially subcutaneous abscesses (Prieur, 1975). Camara et al. (1990) identified 2 isozymes of rabbit lysozyme and showed that their distribution was tissue specific. Leukocytic and gastrointestinal isozymes were clearly distinguished, and a possible lymphoepithelial isozyme that resembled the gastrointestinal isozyme electrophoretically and chromatographically but not kinetically was demonstrated. Mutant, lysozyme-deficient rabbits completely lacked a detectable leukocytic isozyme but had gastrointestinal and lymphoepithelial isozymes indistinguishable from those of normal rabbits. By electrophoretic methods, the mutant rabbits were shown to lack a protein band corresponding to that of the leukocytic isozyme in normal rabbits Canet et al. (1999) studied the unfolding and refolding properties of human lysozyme and 2 of its amyloidogenic variants, ile56 to thr and asp67 to his, by stopped-flow fluorescence and hydrogen exchange pulse labeling coupled with mass spectrometry. Their results suggested that the amyloidogenic nature of the lysozyme variants arises from a decrease in the stability of the native fold relative to partially folded intermediates. The origin of this instability was different in the 2 variants, being caused in one case primarily by a reduction in the folding rate and in the other by an increase in the unfolding rate. In both cases, this resulted in a low population of soluble partially folded species that can aggregate in a slow and controlled manner to form amyloid fibrils Full details of the abovementioned studies are described in the following publications, the disclosure of which are hereby incorporated by reference:

Canet, D.; Sunde, M.; Last, A. M.; Miranker, A.; Spencer, A.; Robinson, C. V.; Dobson, C. M.: Mechanistic studies of the folding of human lysozyme and the origin of amyloidogenic behavior in its disease-related variants. Biochemistry 38:6419-6427, 1999; and Camara, V. M.; Harding, J. W.; Prieur, D. J.: Inherited lysozyme deficiency in rabbits: the absence of a primary isozyme of lysozyme as the cause of the condition. Lab. Invest. 63:544-55.

Further studies establishing the function and utilities of LYZ are found in John Hopkins OMIM database record ID 153450, and in sited publications numbered 668-67 and 5245 listed in the bibliography section hereinbelow, which are also hereby incorporated by reference. RNA (guanine-7-) Methyltransferase (RNMT, Accession NM_003799) is another VGAM929 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9886, to the nucleotide sequence of VGAM929 RNA, herein designated VGAM RNA, also designated SEQ ID:3640.

Another function of VGAM929 is therefore inhibition of RNA (guanine-7-) Methyltransferase (RNMT, Accession NM_003799), a gene which catalyzes the methylation of GpppN- at the guanine N7 position. Accordingly, utilities of VGAM929 include diagnosis, prevention and treatment of diseases and clinical conditions associated with RNMT. The function of RNMT and its association with various diseases and clinical conditions, has been established by previous studies, as described hereinabove with reference to VGAM178. FLJ14166 (Accession NM_024565) is another VGAM929 host target gene. FLJ14166 BINDING SITE is HOST TARGET binding site found in the 3' untranslated region of mRNA encoded by FLJ14166, corresponding to a HOST TARGET binding site such as BINDING SITE I, BINDING SITE II or BINDING SITE III. Table 2 illustrates the complementarity of the nucleotide sequences of FLJ14166 BINDING SITE, designated SEQ ID:23790, to the nucleotide sequence of VGAM929 RNA, herein designated VGAM RNA, also designated SEQ ID:3640.

Another function of VGAM929 is therefore inhibition of FLJ14166 (Accession NM_024565). Accordingly, utilities of VGAM929 include diagnosis, prevention and treatment of diseases and clinical conditions associated with FLJ14166. GRB2-associated Binding Protein 3 (GAB3, Accession NM_080612) is another VGAM929 host target gene. GAB3 BINDING SITE is HOST TARGET binding site found in the 3' untranslated region of mRNA encoded by GAB3, corresponding to a HOST TARGET binding site such as BINDING SITE I, BINDING SITE II or BINDING SITE III. Table 2 illustrates the complementarity of the nucleotide sequences of GAB3 BINDING SITE, designated SEQ ID:27927, to the nucleotide sequence of VGAM929 RNA, herein designated VGAM RNA, also designated SEQ ID:3640.

Another function of VGAM929 is therefore inhibition of GRB2-associated Binding Protein 3 (GAB3, Accession NM_080612). Accordingly, utilities of VGAM929 include diagnosis, prevention and treatment of diseases and clinical conditions associated with GAB3. KIAA1223 (Accession XM_048747) is another VGAM929 host target gene. KIAA1223 BINDING SITE is HOST TARGET binding site found in the 3' untranslated region of mRNA encoded by KIAA1223, corresponding to a HOST TARGET binding site such as BINDING SITE I, BINDING SITE II or BINDING SITE III. Table 2 illustrates the complementarity of the nucleotide sequences of KIAA1223 BINDING SITE, designated SEQ ID:35246, to the nucleotide sequence of VGAM929 RNA, herein designated VGAM RNA, also designated SEQ ID:3640.

Another function of VGAM929 is therefore inhibition of KIAA1223 (Accession XM_048747). Accordingly, utilities of VGAM929 include diagnosis, prevention and treatment of diseases and clinical conditions associated with KIAA1223. Leiomodin 1 (smooth muscle) (LMOD1, Accession NM_012134) is another VGAM929 host target gene. LMOD1 BINDING SITE is HOST TARGET binding site found in the 5' untranslated region of mRNA encoded by LMOD1, corresponding to a HOST TARGET binding site such as BINDING SITE I, BINDING SITE II or BINDING SITE III. Table 2 illustrates the complementarity of the nucleotide sequences of LMOD1 BINDING SITE, designated SEQ ID:14444, to the nucleotide sequence of VGAM929 RNA, herein designated VGAM RNA, also designated SEQ ID:3640.

Another function of VGAM929 is therefore inhibition of Leiomodin 1 (smooth muscle) (LMOD1, Accession NM_012134). Accordingly, utilities of VGAM929 include diagnosis, prevention and treatment of diseases and clinical conditions associated with LMOD1. Stromal Antigen 2 (STAG2, Accession XM_047285) is another VGAM929 host target gene. STAG2 BINDING SITE is HOST TARGET binding site found in the 3' untranslated region of mRNA encoded by STAG2, corresponding to a HOST TARGET binding site such as BINDING SITE I, BINDING SITE II or BINDING SITE III. Table 2 illustrates the complementarity of the nucleotide sequences of STAG2 BINDING SITE, designated SEQ ID:34929, to the nucleotide sequence of VGAM929 RNA, herein designated VGAM RNA, also designated SEQ ID:3640.

Another function of VGAM929 is therefore inhibition of Stromal Antigen 2 (STAG2, Accession XM_047285). Accordingly, utilities of VGAM929 include diagnosis, prevention and treatment of diseases and clinical conditions associated with STAG2. LOC115129 (Accession XM_055292) is another VGAM929 host target gene. LOC115129 BINDING SITE is HOST TARGET binding site found in the 5' untranslated region of mRNA encoded by LOC115129, corresponding to a HOST TARGET binding site such as BINDING SITE I, BINDING SITE II or BINDING SITE III. Table 2 illustrates the complementarity of the nucleotide sequences of LOC115129 BINDING SITE, designated SEQ ID:36250, to the nucleotide sequence of VGAM929 RNA, herein designated VGAM RNA, also designated SEQ ID:3640.

Another function of VGAM929 is therefore inhibition of LOC115129 (Accession XM_055292). Accordingly, utilities of VGAM929 include diagnosis, prevention and treatment of diseases and clinical conditions associated with LOC115129. FIG. 1 further provides a conceptual description of a novel bioinformatically detected viral gene of the present invention, referred to here as Viral Genomic Address Messenger 930 (VGAM930) viral gene, which modulates expression of respective host target genes thereof, the function and utility of which host target genes is known in the art.

VGAM930 is a novel bioinformatically detected regulatory, non protein coding, viral micro RNA (miRNA) gene. The method by which VGAM930 was detected is described hereinabove with reference to FIGS. 1-8.

VGAM930 gene, herein designated VGAM GENE, is a viral gene contained in the genome of Amsacta Moorei Entomopoxvirus. VGAM930 host target gene, herein designated VGAM HOST TARGET GENE, is a human gene contained in the human genome.

VGAM930 gene encodes a VGAM930 precursor RNA, herein designated VGAM PRECURSOR RNA. Similar to other miRNA genes, and unlike most ordinary genes, VGAM930 precursor RNA does not encode a protein. A nucleotide sequence identical or highly similar to the nucleotide sequence of VGAM930 precursor RNA is designated SEQ ID:916, and is provided hereinbelow with reference to the sequence listing part. Nucleotide sequence SEQ ID:916 is located at position 48640 relative to the genome of Amsacta Moorei Entomopoxvirus.

VGAM930 precursor RNA folds onto itself, forming VGAM930 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM930 folded precursor RNA into VGAM930 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM930 RNA is designated SEQ ID:3641, and is provided hereinbelow with reference to the sequence listing part.

VGAM930 host target gene, herein designated VGAM HOST TARGET GENE, encodes a corresponding messenger RNA, VGAM930 host target RNA, herein designated VGAM HOST TARGET RNA. VGAM930 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM930 RNA, herein designated VGAM RNA, binds complementarily to one or more host target binding sites located in untranslated regions of VGAM930 host target RNA, herein designated VGAM HOST TARGET RNA. This complementary binding is due to the fact that the nucleotide sequence of VGAM930 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM930 RNA, herein designated VGAM RNA, may have a different number of host target binding sites in untranslated regions of a VGAM930 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM930 RNA, herein designated VGAM RNA, to host target binding sites on VGAM930 host target RNA, herein designated VGAM HOST TARGET RNA, such as BINDING SITE I, BINDING SITE II and BINDING SITE III, inhibits translation of VGAM930 host target RNA into VGAM930 host target protein, herein designated VGAM HOST TARGET PROTEIN. VGAM host target protein is therefore outlined by a broken line.

It is appreciated that VGAM930 host target gene, herein designated VGAM HOST TARGET GENE, in fact represents a plurality of VGAM930 host target genes. The mRNA of each one of this plurality of VGAM930 host target genes comprises one or more host target binding sites, each having a nucleotide sequence which is at least partly complementary to VGAM930 RNA, herein designated VGAM RNA, and which when bound by VGAM930 RNA causes inhibition of translation of respective one or more VGAM930 host target proteins.

It is further appreciated by one skilled in the art that the mode of translational inhibition illustrated by FIG. 1 with specific reference to translational inhibition exerted by VGAM930 gene, herein designated VGAM GENE, on one or more VGAM930 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM930 is inhibition of expression of host target genes, as part of a novel viral mechanism of attacking a host. Accordingly, utilities of VGAM930 include diagnosis, prevention and treatment of viral infection by Amsacta Moorei Entomopoxvirus. Specific functions, and accordingly utilities, of VGAM930 correlate with, and may be deduced from, the identity of the host target genes which VGAM930 binds and inhibits, and the function of these host target genes, as elaborated hereinbelow.

Nucleotide sequences of the VGAM930 precursor RNA, herein designated VGAM PRECURSOR RNA, and of the 'diced' VGAM930 RNA, herein designated VGAM RNA, and a schematic representation of the secondary folding of VGAM930 folded precursor RNA, herein designated VGAM FOLDED PRECURSOR RNA, of VGAM930 are further described hereinbelow with reference to Table 1.

Nucleotide sequences of host target binding sites, such as BINDING SITE-I, BINDING SITE-II and BINDING SITE-III of FIG. 1, found on VGAM930 host target RNA, and schematic representation of the complementarity of each of these host target binding sites to VGAM930 RNA, herein designated VGAM RNA, are described hereinbelow with reference to Table 2.

As mentioned hereinabove with reference to FIG. 1, a function of VGAM930 gene, herein designated VGAM is inhibition of expression of VGAM930 target genes. It is appreciated that specific functions, and accordingly utilities, of VGAM930 correlate with, and may be deduced from, the identity of the target genes which VGAM930 binds and inhibits, and the function of these target genes, as elaborated hereinbelow.

FLJ13391 (Accession NM_032181) is a VGAM930 host target gene. FLJ13391 BINDING SITE is HOST TARGET binding site found in the 3' untranslated region of mRNA encoded by FLJ13391, corresponding to a HOST TARGET binding site such as BINDING SITE I, BINDING SITE II or BINDING SITE III. Table 2 illustrates the complementarity of the nucleotide sequences of FLJ13391 BINDING SITE, designated SEQ ID:25895, to the nucleotide sequence of VGAM930 RNA, herein designated VGAM RNA, also designated SEQ ID:3641.

A function of VGAM930 is therefore inhibition of FLJ13391 (Accession NM_032181). Accordingly, utilities of VGAM930 include diagnosis, prevention and treatment of diseases and clinical conditions associated with FLJ13391. KIAA0783 (Accession NM_014660) is another VGAM930 host target gene. KIAA0783 BINDING SITE is HOST TARGET binding site found in the 3' untranslated region of mRNA encoded by KIAA0783, corresponding to a HOST TARGET binding site such as BINDING SITE I, BINDING SITE II or BINDING SITE III. Table 2 illustrates the complementarity of the nucleotide sequences of KIAA0783 BINDING SITE, designated SEQ ID:16104, to the nucleotide sequence of VGAM930 RNA, herein designated VGAM RNA, also designated SEQ ID:3641.

Another function of VGAM930 is therefore inhibition of KIAA0783 (Accession NM_014660). Accordingly, utilities of VGAM930 include diagnosis, prevention and treatment of diseases and clinical conditions associated with KIAA0783. KIAA1209 (Accession XM_027307) is another VGAM930 host target gene. KIAA1209 BINDING SITE is HOST TARGET binding site found in the 3' untranslated region of mRNA encoded by KIAA1209, corresponding to a HOST TARGET binding site such as BINDING SITE I, BINDING SITE II or BINDING SITE III. Table 2 illustrates the complementarity of the nucleotide sequences of KIAA1209 BINDING SITE, designated SEQ ID:30470, to the nucleotide sequence of VGAM930 RNA, herein designated VGAM RNA, also designated SEQ ID:3641.

Another function of VGAM930 is therefore inhibition of KIAA1209 (Accession XM_027307). Accordingly, utilities of VGAM930 include diagnosis, prevention and treatment of diseases and clinical conditions associated with KIAA1209. NX-17 (Accession NM_020665) is another VGAM930 host target gene. NX-17 BINDING SITE is HOST TARGET binding site found in the 3' untranslated region of mRNA encoded by NX-17, corresponding to a HOST TARGET binding site such as BINDING SITE I, BINDING SITE II or BINDING SITE III. Table 2 illustrates the complementarity of the nucleotide sequences of NX-17 BINDING SITE, designated SEQ ID:21834, to the nucleotide sequence of VGAM930 RNA, herein designated VGAM RNA, also designated SEQ ID:3641.

Another function of VGAM930 is therefore inhibition of NX-17 (Accession NM_020665). Accordingly, utilities of VGAM930 include diagnosis, prevention and treatment of diseases and clinical conditions associated with NX-17. PV1 (Accession NM_031310) is another VGAM930 host target gene. PV1 BINDING SITE is HOST TARGET binding site found in the 3' untranslated region of mRNA encoded by PV1, corresponding to a HOST TARGET binding site such as BINDING SITE I, BINDING SITE II or BINDING SITE III. Table 2 illustrates the complementarity of the nucleotide sequences of PV1 BINDING SITE, designated SEQ ID:25347, to the nucleotide sequence of VGAM930 RNA, herein designated VGAM RNA, also designated SEQ ID:3641.

Another function of VGAM930 is therefore inhibition of PV1 (Accession NM_031310). Accordingly, utilities of VGAM930 include diagnosis, prevention and treatment of diseases and clinical conditions associated with PV1. LOC153277 (Accession XM_098346) is another VGAM930 host target gene. LOC153277 BINDING SITE is HOST TARGET binding site found in the 3' untranslated region of mRNA encoded by LOC153277, corresponding to a HOST TARGET binding site such as BINDING SITE I, BINDING SITE II or BINDING SITE III. Table 2 illustrates the complementarity of the nucleotide sequences of LOC153277 BINDING SITE, designated SEQ ID:41603, to the nucleotide sequence of VGAM930 RNA, herein designated VGAM RNA, also designated SEQ ID:3641.

Another function of VGAM930 is therefore inhibition of LOC153277 (Accession XM_098346). Accordingly, utilities of VGAM930 include diagnosis, prevention and treatment of diseases and clinical conditions associated with LOC153277. FIG. 1 further provides a conceptual description of a novel bioinformatically detected viral gene of the present invention, referred to here as Viral Genomic Address Messenger 931 (VGAM931) viral gene, which modulates expression of respective host target genes thereof, the function and utility of which host target genes is known in the art.

VGAM931 is a novel bioinformatically detected regulatory, non protein coding, viral micro RNA (miRNA) gene. The method by which VGAM931 was detected is described hereinabove with reference to FIGS. 1-8.

VGAM931 gene, herein designated VGAM GENE, is a viral gene contained in the genome of African Swine Fever Virus. VGAM931 host target gene, herein designated VGAM HOST TARGET GENE, is a human gene contained in the human genome.

VGAM931 gene encodes a VGAM931 precursor RNA, herein designated VGAM PRECURSOR RNA. Similar to other miRNA genes, and unlike most ordinary genes, VGAM931 precursor RNA does not encode a protein. A nucleotide sequence identical or highly similar to the nucleotide sequence of VGAM931 precursor RNA is designated SEQ ID:917, and is provided hereinbelow with reference to the sequence listing part. Nucleotide sequence SEQ ID:917 is located at position 133625 relative to the genome of African Swine Fever Virus.

VGAM931 precursor RNA folds onto itself, forming VGAM931 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM931 folded precursor RNA into VGAM931 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM931 RNA is designated SEQ ID:3642, and is provided hereinbelow with reference to the sequence listing part.

VGAM931 host target gene, herein designated VGAM HOST TARGET GENE, encodes a corresponding messenger RNA, VGAM931 host target RNA, herein designated VGAM HOST TARGET RNA. VGAM931 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM931 RNA, herein designated VGAM RNA, binds complementarily to one or more host target binding sites located in untranslated regions of VGAM931 host target RNA, herein designated VGAM HOST TARGET RNA. This complementary binding is due to the fact that the nucleotide sequence of VGAM931 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM931 RNA, herein designated VGAM RNA, may have a different number of host target binding sites in untranslated regions of a VGAM931 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM931 RNA, herein designated VGAM RNA, to host target binding sites on VGAM931 host target RNA, herein designated VGAM HOST TARGET RNA, such as BINDING SITE I, BINDING SITE II and BINDING SITE III, inhibits translation of VGAM931 host target RNA into VGAM931 host target protein, herein designated VGAM HOST TARGET PROTEIN. VGAM host target protein is therefore outlined by a broken line.

It is appreciated that VGAM931 host target gene, herein designated VGAM HOST TARGET GENE, in fact represents a plurality of VGAM931 host target genes. The mRNA of each one of this plurality of VGAM931 host target genes comprises one or more host target binding sites, each having a nucleotide sequence which is at least partly complementary to VGAM931 RNA, herein designated VGAM RNA, and which when bound by VGAM931 RNA causes inhibition of translation of respective one or more VGAM931 host target proteins.

It is further appreciated by one skilled in the art that the mode of translational inhibition illustrated by FIG. 1 with specific reference to translational inhibition exerted by VGAM931 gene, herein designated VGAM GENE, on one or more VGAM931 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM931 is inhibition of expression of host target genes, as part of a novel viral mechanism of attacking a host. Accordingly, utilities of VGAM931 include diagnosis, prevention and treatment of viral infection by African Swine Fever Virus. Specific functions, and accordingly utilities, of VGAM931 correlate with, and may be deduced from, the identity of the host target genes which VGAM931 binds and inhibits, and the function of these host target genes, as elaborated hereinbelow.

Nucleotide sequences of the VGAM931 precursor RNA, herein designated VGAM PRECURSOR RNA, and of the 'diced' VGAM931 RNA, herein designated VGAM RNA, and a schematic representation of the secondary folding of VGAM931 folded precursor RNA, herein designated VGAM FOLDED PRECURSOR RNA, of VGAM931 are further described hereinbelow with reference to Table 1.

Nucleotide sequences of host target binding sites, such as BINDING SITE-I, BINDING SITE-II and BINDING SITE-III of FIG. 1, found on VGAM931 host target RNA, and schematic representation of the complementarity of each of these host target binding sites to VGAM931 RNA, herein designated VGAM RNA, are described hereinbelow with reference to Table 2.

As mentioned hereinabove with reference to FIG. 1, a function of VGAM931 gene, herein designated VGAM is inhibition of expression of VGAM931 target genes. It is appreciated that specific functions, and accordingly utilities, of VGAM931 correlate with, and may be deduced from, the identity of the target genes which VGAM931 binds and inhibits, and the function of these target genes, as elaborated hereinbelow.

FCRH1 (Accession NM_052938) is a VGAM931 host target gene. FCRH1 BINDING SITE is HOST TARGET binding site found in the 3' untranslated region of mRNA encoded by FCRH1, corresponding to a HOST TARGET binding site such as BINDING SITE I, BINDING SITE II or BINDING SITE III. Table 2 illustrates the complementarity of the nucleotide sequences of FCRH1 BINDING SITE, designated SEQ ID:27497, to the nucleotide sequence of VGAM931 RNA, herein designated VGAM RNA, also designated SEQ ID:3642.

A function of VGAM931 is therefore inhibition of FCRH1 (Accession NM_052938). Accordingly, utilities of VGAM931 include diagnosis, prevention and treatment of diseases and clinical conditions associated with FCRH1. Inhibitor of DNA Binding 4, Dominant Negative Helix-loop-helix Protein (ID4, Accession NM_001546) is another VGAM931 host target gene. ID4 BINDING SITE is HOST TARGET binding site found in the 3' untranslated region of mRNA encoded by ID4, corresponding to a HOST TARGET binding site such as BINDING SITE I, BINDING SITE II or BINDING SITE III. Table 2 illustrates the complementarity of the nucleotide sequences of ID4 BINDING SITE, designated SEQ ID:7271, to the nucleotide sequence of VGAM931 RNA, herein designated VGAM RNA, also designated SEQ ID:3642.

Another function of VGAM931 is therefore inhibition of Inhibitor of DNA Binding 4, Dominant Negative Helix-loop-helix Protein (ID4, Accession NM_001546), a gene which negatively regulates cell differentiation. Accordingly, utilities of VGAM931 include diagnosis, prevention and treatment of diseases and clinical conditions associated with ID4. The function of ID4 has been established by previous studies. Transcription factors containing a basic helix-loop-helix (bHLH) motif regulate the expression of tissue-specific genes in a number of mammalian and insect systems (Pagliuca et al., 1995). DNA-binding activity of the bHLH proteins is dependent on formation of homo- and/or heterodimers. Dominant-negative HLH proteins (encoded by Id-related genes) also contain the HLH-dimerization domain but lack the DNA-binding basic domain. Consequently, Id proteins inhibit binding to DNA and transcriptional transactivation by heterodimerization with bHLH proteins. Pagliuca et al. (1995) reported the cDNA sequence of a novel human HLH gene, to which the symbol ID4 was assigned, which lacks the basic domain. ID4 is differentially expressed in adult organs as 4 mRNA molecules that are presumably the result of differential splicing and/or alternative polyadenylation sites. Transfection experiments indicated that enforced expression of the ID4 protein inhibits the transactivation of the muscle creatine kinase (CKM; 123310) E-box enhancer by MyoD (MYOD1; 159970). By fluorescence in situ hybridization (FISH), Pagliuca et al. (1995) mapped the ID4 gene to 6p22-p21.3. By the same method, Rigolet et al. (1998) mapped the gene to 6p23-p22.3. For other dominant-negative inhibitors of DNA binding, see ID1 (OMIM Ref. No. 600349), ID2 (OMIM Ref. No. 600386), and ID3 (600277

Full details of the abovementioned studies are described in the following publications, the disclosure of which are hereby incorporated by reference:

Pagliuca, A.; Bartoli, P. C.; Saccone, S.; Valle, G. D.; Lania, L.: Molecular cloning of ID4, a novel dominant negative helix-loop-helix human gene on chromosome 6p21.3-p22. Genomics 27:200-203, 1995; and Rigolet, M.; Rich, T.; Gross-Morand, M.-S.; Molina-Gomes, D.; Viegas-Pequignot, E.; Junien, C.: cDNA cloning, tissue distribution and chromosomal localization of the human ID4 gene. DNA.

Further studies establishing the function and utilities of ID4 are found in John Hopkins OMIM database record ID 600581, and in sited publications numbered 10185-10186 listed in the bibliography section hereinbelow, which are also hereby incorporated by reference. Protocadherin Alpha 1 (PCDHA1, Accession NM_018900) is another VGAM931 host target gene. PCDHA1 BINDING SITE1 and PCDHA1 BINDING SITE2 are HOST TARGET binding sites found in untranslated regions of mRNA encoded by PCDHA1, corresponding to HOST TARGET binding sites such as BINDING SITE I, BINDING SITE II or BINDING SITE III. Table 2 illustrates the complementarity of the nucleotide sequences of PCDHA1 BINDING SITE1 and PCDHA1 BINDING SITE2, designated SEQ ID:20863 and SEQ ID:25382 respectively, to the nucleotide sequence of VGAM931 RNA, herein designated VGAM RNA, also designated SEQ ID:3642.

Another function of VGAM931 is therefore inhibition of Protocadherin Alpha 1 (PCDHA1, Accession NM_018900). Accordingly, utilities of VGAM931 include diagnosis, prevention and treatment of diseases and clinical conditions associated with PCDHA1. Protocadherin Alpha 10 (PCDHA10, Accession NM_031860) is another VGAM931 host target gene. PCDHA10 BINDING SITE1 and PCDHA10 BINDING SITE2 are HOST TARGET binding sites found in untranslated regions of mRNA encoded by PCDHA10, corresponding to HOST TARGET binding sites such as BINDING SITE I, BINDING SITE II or BINDING SITE III. Table 2 illustrates the complementarity of the nucleotide sequences of PCDHA10 BINDING SITE1 and PCDHA10 BINDING SITE2, designated SEQ ID:25614 and SEQ ID:20883 respectively, to the nucleotide sequence of VGAM931 RNA, herein designated VGAM RNA, also designated SEQ ID:3642.

Another function of VGAM931 is therefore inhibition of Protocadherin Alpha 10 (PCDHA10, Accession NM_031860). Accordingly, utilities of VGAM931 include diagnosis, prevention and treatment of diseases and clinical conditions associated with PCDHA10. Protocadherin Alpha 13 (PCDHA13, Accession NM_018904) is another VGAM931 host target gene. PCDHA13 BINDING SITE is HOST TARGET binding site found in the 3' untranslated region of mRNA encoded by PCDHA13, corresponding to a HOST TARGET binding site such as BINDING SITE I, BINDING SITE II or BINDING SITE III. Table 2 illustrates the complementarity of the nucleotide sequences of PCDHA13 BINDING SITE, designated SEQ ID:20904, to the nucleotide sequence of VGAM931 RNA, herein designated VGAM RNA, also designated SEQ ID:3642.

Another function of VGAM931 is therefore inhibition of Protocadherin Alpha 13 (PCDHA13, Accession NM_018904). Accordingly, utilities of VGAM931 include diagnosis, prevention and treatment of diseases and clinical conditions associated with PCDHA13. Protocadherin Alpha 2 (PCDHA2, Accession NM_018905) is another VGAM931 host target gene. PCDHA2 BINDING SITE is HOST TARGET binding site found in the 3' untranslated region of mRNA encoded by PCDHA2, corresponding to a HOST TARGET binding site such as BINDING SITE I, BINDING SITE II or BINDING SITE III. Table 2 illustrates the complementarity of the nucleotide sequences of PCDHA2 BINDING SITE, designated SEQ ID:20914, to the nucleotide sequence of VGAM931 RNA, herein designated VGAM RNA, also designated SEQ ID:3642.

Another function of VGAM931 is therefore inhibition of Protocadherin Alpha 2 (PCDHA2, Accession NM_018905).

Accordingly, utilities of VGAM931 include diagnosis, prevention and treatment of diseases and clinical conditions associated with PCDHA2. Protocadherin Alpha 3 (PCDHA3, Accession NM_018906) is another VGAM931 host target gene. PCDHA3 BINDING SITE is HOST TARGET binding site found in the 3' untranslated region of mRNA encoded by PCDHA3, corresponding to a HOST TARGET binding site such as BINDING SITE I, BINDING SITE II or BINDING SITE III. Table 2 illustrates the complementarity of the nucleotide sequences of PCDHA3 BINDING SITE, designated SEQ ID:20924, to the nucleotide sequence of VGAM931 RNA, herein designated VGAM RNA, also designated SEQ ID:3642.

Another function of VGAM931 is therefore inhibition of Protocadherin Alpha 3 (PCDHA3, Accession NM_018906). Accordingly, utilities of VGAM931 include diagnosis, prevention and treatment of diseases and clinical conditions associated with PCDHA3. Protocadherin Alpha 4 (PCDHA4, Accession NM_018907) is another VGAM931 host target gene. PCDHA4 BINDING SITE is HOST TARGET binding site found in the 3' untranslated region of mRNA encoded by PCDHA4, corresponding to a HOST TARGET binding site such as BINDING SITE I, BINDING SITE II or BINDING SITE III. Table 2 illustrates the complementarity of the nucleotide sequences of PCDHA4 BINDING SITE, designated SEQ ID:20934, to the nucleotide sequence of VGAM931 RNA, herein designated VGAM RNA, also designated SEQ ID:3642.

Another function of VGAM931 is therefore inhibition of Protocadherin Alpha 4 (PCDHA4, Accession NM_018907). Accordingly, utilities of VGAM931 include diagnosis, prevention and treatment of diseases and clinical conditions associated with PCDHA4. Protocadherin Alpha 5 (PCDHA5, Accession NM_018908) is another VGAM931 host target gene. PCDHA5 BINDING SITE is HOST TARGET binding site found in the 3' untranslated region of mRNA encoded by PCDHA5, corresponding to a HOST TARGET binding site such as BINDING SITE I, BINDING SITE II or BINDING SITE III. Table 2 illustrates the complementarity of the nucleotide sequences of PCDHA5 BINDING SITE, designated SEQ ID:20944, to the nucleotide sequence of VGAM931 RNA, herein designated VGAM RNA, also designated SEQ ID:3642.

Another function of VGAM931 is therefore inhibition of Protocadherin Alpha 5 (PCDHA5, Accession NM_018908). Accordingly, utilities of VGAM931 include diagnosis, prevention and treatment of diseases and clinical conditions associated with PCDHA5. Protocadherin Alpha 6 (PCDHA6, Accession NM_031849) is another VGAM931 host target gene. PCDHA6 BINDING SITE1 and PCDHA6 BINDING SITE2 are HOST TARGET binding sites found in untranslated regions of mRNA encoded by PCDHA6, corresponding to HOST TARGET binding sites such as BINDING SITE I, BINDING SITE II or BINDING SITE III. Table 2 illustrates the complementarity of the nucleotide sequences of PCDHA6 BINDING SITE1 and PCDHA6 BINDING SITE2, designated SEQ ID:25586 and SEQ ID:20954 respectively, to the nucleotide sequence of VGAM931 RNA, herein designated VGAM RNA, also designated SEQ ID:3642.

Another function of VGAM931 is therefore inhibition of Protocadherin Alpha 6 (PCDHA6, Accession NM_031849). Accordingly, utilities of VGAM931 include diagnosis, prevention and treatment of diseases and clinical conditions associated with PCDHA6. Protocadherin Alpha 8 (PCDHA8, Accession NM_018911) is another VGAM931 host target gene. PCDHA8 BINDING SITE is HOST TARGET binding site found in the 3' untranslated region of mRNA encoded by PCDHA8, corresponding to a HOST TARGET binding site such as BINDING SITE I, BINDING SITE II or BINDING SITE III. Table 2 illustrates the complementarity of the nucleotide sequences of PCDHA8 BINDING SITE, designated SEQ ID:20974, to the nucleotide sequence of VGAM931 RNA, herein designated VGAM RNA, also designated SEQ ID:3642.

Another function of VGAM931 is therefore inhibition of Protocadherin Alpha 8 (PCDHA8, Accession NM_018911). Accordingly, utilities of VGAM931 include diagnosis, prevention and treatment of diseases and clinical conditions associated with PCDHA8. Protocadherin Alpha 9 (PCDHA9, Accession NM_031857) is another VGAM931 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:25599, to the nucleotide sequence of VGAM931 RNA, herein designated VGAM RNA, also designated SEQ ID:3642.

Another function of VGAM931 is therefore inhibition of Protocadherin Alpha 9 (PCDHA9, Accession NM_031857), a gene which is a calcium-dependent cell-adhesion protein. Accordingly, utilities of VGAM931 include diagnosis, prevention and treatment of diseases and clinical conditions associated with PCDHA9. The function of PCDHA9 and its association with various diseases and clinical conditions, has been established by previous studies, as described hereinabove with reference to VGAM71. Protocadherin Alpha Subfamily C, 1 (PCDHAC1, Accession NM_018898) is another VGAM931 host target gene. PCDHAC1 BINDING SITE is HOST TARGET binding site found in the 3' untranslated region of mRNA encoded by PCDHAC1, corresponding to a HOST TARGET binding site such as BINDING SITE I, BINDING SITE II or BINDING SITE III. Table 2 illustrates the complementarity of the nucleotide sequences of PCDHAC1 BINDING SITE, designated SEQ ID:20843, to the nucleotide sequence of VGAM931 RNA, herein designated VGAM RNA, also designated SEQ ID:3642.

Another function of VGAM931 is therefore inhibition of Protocadherin Alpha Subfamily C, 1 (PCDHAC1, Accession NM_018898). Accordingly, utilities of VGAM931 include diagnosis, prevention and treatment of diseases and clinical conditions associated with PCDHAC1. Protocadherin Alpha Subfamily C, 2 (PCDHAC2, Accession NM_018899) is another VGAM931 host target gene. PCDHAC2 BINDING SITE is HOST TARGET binding site found in the 3' untranslated region of mRNA encoded by PCDHAC2, corresponding to a HOST TARGET binding site such as BINDING SITE I, BINDING SITE II or BINDING SITE III. Table 2 illustrates the complementarity of the nucleotide sequences of PCDHAC2 BINDING SITE, designated SEQ ID:20853, to the nucleotide sequence of VGAM931 RNA, herein designated VGAM RNA, also designated SEQ ID:3642.

Another function of VGAM931 is therefore inhibition of Protocadherin Alpha Subfamily C, 2 (PCDHAC2, Accession NM_018899). Accordingly, utilities of VGAM931 include diagnosis, prevention and treatment of diseases and clinical conditions associated with PCDHAC2. Protocadherin Beta 16 (PCDHB16, Accession NM_020957) is another VGAM931 host target gene. PCDHB16 BINDING SITE is HOST TARGET binding site found in the 3' untranslated region of mRNA encoded by PCDHB16, corresponding to a HOST TARGET binding site such as BINDING SITE I, BINDING SITE II or BINDING SITE III. Table 2 illustrates the complementarity of the nucleotide sequences of PCDHB16 BINDING SITE, designated SEQ ID:21944, to the nucleotide sequence of VGAM931 RNA, herein designated VGAM RNA, also designated SEQ ID:3642.

Another function of VGAM931 is therefore inhibition of Protocadherin Beta 16 (PCDHB16, Accession NM_020957), a gene which is a potential calcium-dependent cell-adhesion protein. Accordingly, utilities of VGAM931 include diagnosis, prevention and treatment of diseases and clinical conditions associated with PCDHB16. The function of PCDHB16 has been established by previous studies. Cadherins are calcium-dependent cell-cell adhesion molecules that mediate neural cell-cell interactions. Protocadherins constitute a subfamily of nonclassic cadherins. PCDHB16 is a member of the beta cluster of protocadherin genes on 5q31. For specific information on the PCDHB genes, see 604967. Using PCR with degenerate primers to screen melanoma cell lines, Matsuyoshi et al. (1997) obtained a cDNA fragment encoding part of PCDHB16, which they termed ME1. RT-PCR analysis detected expression of ME1 in melanoma cell lines and normal fibroblast cell lines, but not in a squamous carcinoma cell lines or normal melanocytes, suggesting that ME1 may play a role in the strong cell-cell adhesiveness of melanoma cells.

Full details of the abovementioned studies are described in the following publications, the disclosure of which are hereby incorporated by reference:

Matsuyoshi, N.; Tanaka, T.; Toda, K.; Imamura, S.: Identification of novel cadherins expressed in human melanoma cells. J. Invest. Derm. 108:908-913, 1997; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse and.

Further studies establishing the function and utilities of PCDHB16 are found in John Hopkins OMIM database record ID 606345, and in sited publications numbered 4514, 673 and 9535 listed in the bibliography section hereinbelow, which are also hereby incorporated by reference. Zinc Finger Protein 268 (ZNF268, Accession XM_031851) is another VGAM931 host target gene. ZNF268 BINDING SITE is HOST TARGET binding site found in the 3' untranslated region of mRNA encoded by ZNF268, corresponding to a HOST TARGET binding site such as BINDING SITE I, BINDING SITE II or BINDING SITE III. Table 2 illustrates the complementarity of the nucleotide sequences of ZNF268 BINDING SITE, designated SEQ ID:31499, to the nucleotide sequence of VGAM931 RNA, herein designated VGAM RNA, also designated SEQ ID:3642.

Another function of VGAM931 is therefore inhibition of Zinc Finger Protein 268 (ZNF268, Accession XM_031851). Accordingly, utilities of VGAM931 include diagnosis, prevention and treatment of diseases and clinical conditions associated with ZNF268. Chromosome 2 Open Reading Frame 6 (C2orf6, Accession NM_018221) is another VGAM931 host target gene. C2orf6 BINDING SITE is HOST TARGET binding site found in the 3' untranslated region of mRNA encoded by C2orf6, corresponding to a HOST TARGET binding site such as BINDING SITE I, BINDING SITE II or BINDING SITE III. Table 2 illustrates the complementarity of the nucleotide sequences of C2orf6 BINDING SITE, designated SEQ ID:20141, to the nucleotide sequence of VGAM931 RNA, herein designated VGAM RNA, also designated SEQ ID:3642.

Another function of VGAM931 is therefore inhibition of Chromosome 2 Open Reading Frame 6 (C2orf6, Accession NM_018221). Accordingly, utilities of VGAM931 include diagnosis, prevention and treatment of diseases and clinical conditions associated with C2orf6. FLJ20086 (Accession NM_017661) is another VGAM931 host target gene. FLJ20086 BINDING SITE is HOST TARGET binding site found in the 3' untranslated region of mRNA encoded by FLJ20086, corresponding to a HOST TARGET binding site such as BINDING SITE I, BINDING SITE II or BINDING SITE III. Table 2 illustrates the complementarity of the nucleotide sequences of FLJ20086 BINDING SITE, designated SEQ ID:19191, to the nucleotide sequence of VGAM931 RNA, herein designated VGAM RNA, also designated SEQ ID:3642.

Another function of VGAM931 is therefore inhibition of FLJ20086 (Accession NM_017661). Accordingly, utilities of VGAM931 include diagnosis, prevention and treatment of diseases and clinical conditions associated with FLJ20086. FLJ20220 (Accession NM_017718) is another VGAM931 host target gene. FLJ20220 BINDING SITE is HOST TARGET binding site found in the 3' untranslated region of mRNA encoded by FLJ20220, corresponding to a HOST TARGET binding site such as BINDING SITE I, BINDING SITE II or BINDING SITE III. Table 2 illustrates the complementarity of the nucleotide sequences of FLJ20220 BINDING SITE, designated SEQ ID:19302, to the nucleotide sequence of VGAM931 RNA, herein designated VGAM RNA, also designated SEQ ID:3642.

Another function of VGAM931 is therefore inhibition of FLJ20220 (Accession NM_017718). Accordingly, utilities of VGAM931 include diagnosis, prevention and treatment of diseases and clinical conditions associated with FLJ20220. FLJ20436 (Accession NM_017822) is another VGAM931 host target gene. FLJ20436 BINDING SITE is HOST TARGET binding site found in the 3' untranslated region of mRNA encoded by FLJ20436, corresponding to a HOST TARGET binding site such as BINDING SITE I, BINDING SITE II or BINDING SITE III. Table 2 illustrates the complementarity of the nucleotide sequences of FLJ20436 BINDING SITE, designated SEQ ID:19473, to the nucleotide sequence of VGAM931 RNA, herein designated VGAM RNA, also designated SEQ ID:3642.

Another function of VGAM931 is therefore inhibition of FLJ20436 (Accession NM_017822). Accordingly, utilities of VGAM931 include diagnosis, prevention and treatment of diseases and clinical conditions associated with FLJ20436. Interleukin 18 Binding Protein (IL18BP, Accession NM_005699) is another VGAM931 host target gene. IL18BP BINDING SITE is HOST TARGET binding site found in the 3' untranslated region of mRNA encoded by IL18BP, corresponding to a HOST TARGET binding site such as BINDING SITE I, BINDING SITE II or BINDING SITE III. Table 2 illustrates the complementarity of the nucleotide sequences of IL18BP BINDING SITE, designated SEQ ID:12250, to the nucleotide sequence of VGAM931 RNA, herein designated VGAM RNA, also designated SEQ ID:3642.

Another function of VGAM931 is therefore inhibition of Interleukin 18 Binding Protein (IL18BP, Accession NM_005699). Accordingly, utilities of VGAM931 include diagnosis, prevention and treatment of diseases and clinical conditions associated with IL18BP. KIAA1219 (Accession XM_028835) is another VGAM931 host target gene. KIAA1219 BINDING SITE is HOST TARGET binding site found in the 3' untranslated region of mRNA encoded by KIAA1219, corresponding to a HOST TARGET binding site such as BINDING SITE I, BINDING SITE II or BINDING SITE III. Table 2 illustrates the complementarity of the nucleotide sequences of KIAA1219 BINDING SITE, designated SEQ ID:30757, to the nucleotide sequence of VGAM931

RNA, herein designated VGAM RNA, also designated SEQ ID:3642.

Another function of VGAM931 is therefore inhibition of KIAA1219 (Accession XM_028835). Accordingly, utilities of VGAM931 include diagnosis, prevention and treatment of diseases and clinical conditions associated with KIAA1219. KIAA1884 (Accession XM_055539) is another VGAM931 host target gene. KIAA1884 BINDING SITE is HOST TARGET binding site found in the 3' untranslated region of mRNA encoded by KIAA1884, corresponding to a HOST TARGET binding site such as BINDING SITE I, BINDING SITE II or BINDING SITE III. Table 2 illustrates the complementarity of the nucleotide sequences of KIAA1884 BINDING SITE, designated SEQ ID:36293, to the nucleotide sequence of VGAM931 RNA, herein designated VGAM RNA, also designated SEQ ID:3642.

Another function of VGAM931 is therefore inhibition of KIAA1884 (Accession XM_055539). Accordingly, utilities of VGAM931 include diagnosis, prevention and treatment of diseases and clinical conditions associated with KIAA1884. PDP (Accession NM_018444) is another VGAM931 host target gene. PDP BINDING SITE is HOST TARGET binding site found in the 3" untranslated region of mRNA encoded by PDP, corresponding to a HOST TARGET binding site such as BINDING SITE I, BINDING SITE II or BINDING SITE III. Table 2 illustrates the complementarity of the nucleotide sequences of PDP BINDING SITE, designated SEQ ID:20514, to the nucleotide sequence of VGAM931 RNA, herein designated VGAM RNA, also designated SEQ ID:3642.

Another function of VGAM931 is therefore inhibition of PDP (Accession NM_018444). Accordingly, utilities of VGAM931 include diagnosis, prevention and treatment of diseases and clinical conditions associated with PDP. SET Binding Protein 1 (SETBP1, Accession NM_015559) is another VGAM931 host target gene. SETBP1 BINDING SITE is HOST TARGET binding site found in the 3' untranslated region of mRNA encoded by SETBP1, corresponding to a HOST TARGET binding site such as BINDING SITE I, BINDING SITE II or BINDING SITE III. Table 2 illustrates the complementarity of the nucleotide sequences of SETBP1 BINDING SITE, designated SEQ ID:17824, to the nucleotide sequence of VGAM931 RNA, herein designated VGAM RNA, also designated SEQ ID:3642.

Another function of VGAM931 is therefore inhibition of SET Binding Protein 1 (SETBP1, Accession NM_015559). Accordingly, utilities of VGAM931 include diagnosis, prevention and treatment of diseases and clinical conditions associated with SETBP1. LOC150358 (Accession XM_097842) is another VGAM931 host target gene. LOC150358 BINDING SITE is HOST TARGET binding site found in the 3' untranslated region of mRNA encoded by LOC150358, corresponding to a HOST TARGET binding site such as BINDING SITE I, BINDING SITE II or BINDING SITE III. Table 2 illustrates the complementarity of the nucleotide sequences of LOC150358 BINDING SITE, designated SEQ ID:41158, to the nucleotide sequence of VGAM931 RNA, herein designated VGAM RNA, also designated SEQ ID:3642.

Another function of VGAM931 is therefore inhibition of LOC150358 (Accession XM_097842). Accordingly, utilities of VGAM931 include diagnosis, prevention and treatment of diseases and clinical conditions associated with LOC150358. LOC155081 (Accession XM_088145) is another VGAM931 host target gene. LOC155081 BINDING SITE is HOST TARGET binding site found in the 3' untranslated region of mRNA encoded by LOC155081, corresponding to a HOST TARGET binding site such as BINDING SITE I, BINDING SITE II or BINDING SITE III. Table 2 illustrates the complementarity of the nucleotide sequences of LOC155081 BINDING SITE, designated SEQ ID:39543, to the nucleotide sequence of VGAM931 RNA, herein designated VGAM RNA, also designated SEQ ID:3642.

Another function of VGAM931 is therefore inhibition of LOC155081 (Accession XM_088145). Accordingly, utilities of VGAM931 include diagnosis, prevention and treatment of diseases and clinical conditions associated with LOC155081. LOC157280 (Accession XM_058301) is another VGAM931 host target gene. LOC157280 BINDING SITE is HOST TARGET binding site found in the 3' untranslated region of mRNA encoded by LOC157280, corresponding to a HOST TARGET binding site such as BINDING SITE I, BINDING SITE II or BINDING SITE III. Table 2 illustrates the complementarity of the nucleotide sequences of LOC157280 BINDING SITE, designated SEQ ID:36594, to the nucleotide sequence of VGAM931 RNA, herein designated VGAM RNA, also designated SEQ ID:3642.

Another function of VGAM931 is therefore inhibition of LOC157280 (Accession XM_058301). Accordingly, utilities of VGAM931 include diagnosis, prevention and treatment of diseases and clinical conditions associated with LOC157280. LOC202802 (Accession XM_114560) is another VGAM931 host target gene. LOC202802 BINDING SITE is HOST TARGET binding site found in the 3' untranslated region of mRNA encoded by LOC202802, corresponding to a HOST TARGET binding site such as BINDING SITE I, BINDING SITE II or BINDING SITE III. Table 2 illustrates the complementarity of the nucleotide sequences of LOC202802 BINDING SITE, designated SEQ ID:42988, to the nucleotide sequence of VGAM931 RNA, herein designated VGAM RNA, also designated SEQ ID:3642.

Another function of VGAM931 is therefore inhibition of LOC202802 (Accession XM_114560). Accordingly, utilities of VGAM931 include diagnosis, prevention and treatment of diseases and clinical conditions associated with LOC202802. LOC219401 (Accession XM_166706) is another VGAM931 host target gene. LOC219401 BINDING SITE is HOST TARGET binding site found in the 3' untranslated region of mRNA encoded by LOC219401, corresponding to a HOST TARGET binding site such as BINDING SITE I, BINDING SITE II or BINDING SITE III. Table 2 illustrates the complementarity of the nucleotide sequences of LOC219401 BINDING SITE, designated SEQ ID:44589, to the nucleotide sequence of VGAM931 RNA, herein designated VGAM RNA, also designated SEQ ID:3642.

Another function of VGAM931 is therefore inhibition of LOC219401 (Accession XM_166706). Accordingly, utilities of VGAM931 include diagnosis, prevention and treatment of diseases and clinical conditions associated with LOC219401. LOC221543 (Accession XM_168091) is another VGAM931 host target gene. LOC221543 BINDING SITE is HOST TARGET binding site found in the 3' untranslated region of mRNA encoded by LOC221543, corresponding to a HOST TARGET binding site such as BINDING SITE I, BINDING SITE II or BINDING SITE III. Table 2 illustrates the complementarity of the nucleotide sequences of LOC221543 BINDING SITE, designated SEQ ID:45011, to the nucleotide sequence of VGAM931 RNA, herein designated VGAM RNA, also designated SEQ ID:3642.

Another function of VGAM931 is therefore inhibition of LOC221543 (Accession XM_168091). Accordingly, utilities of VGAM931 include diagnosis, prevention and treatment of diseases and clinical conditions associated with LOC221543. LOC222228 (Accession XM_168627) is another VGAM931 host target gene. LOC222228 BINDING SITE is HOST TARGET binding site found in the 3' untranslated region of mRNA encoded by LOC222228, corresponding to a HOST TARGET binding site such as BINDING SITE I, BINDING SITE II or BINDING SITE III. Table 2 illustrates the complementarity of the nucleotide sequences of LOC222228 BINDING SITE, designated SEQ ID:45274, to the nucleotide sequence of VGAM931 RNA, herein designated VGAM RNA, also designated SEQ ID:3642.

Another function of VGAM931 is therefore inhibition of LOC222228 (Accession XM_168627). Accordingly, utilities of VGAM931 include diagnosis, prevention and treatment of diseases and clinical conditions associated with LOC222228. LOC222233 (Accession XM_168560) is another VGAM931 host target gene. LOC222233 BINDING SITE is HOST TARGET binding site found in the 3' untranslated region of mRNA encoded by LOC222233, corresponding to a HOST TARGET binding site such as BINDING SITE I, BINDING SITE II or BINDING SITE III. Table 2 illustrates the complementarity of the nucleotide sequences of LOC222233 BINDING SITE, designated SEQ ID:45243, to the nucleotide sequence of VGAM931 RNA, herein designated VGAM RNA, also designated SEQ ID:3642.

Another function of VGAM931 is therefore inhibition of LOC222233 (Accession XM_168560). Accordingly, utilities of VGAM931 include diagnosis, prevention and treatment of diseases and clinical conditions associated with LOC222233. LOC254018 (Accession XM_173066) is another VGAM931 host target gene. LOC254018 BINDING SITE is HOST TARGET binding site found in the 3' untranslated region of mRNA encoded by LOC254018, corresponding to a HOST TARGET binding site such as BINDING SITE I, BINDING SITE II or BINDING SITE III. Table 2 illustrates the complementarity of the nucleotide sequences of LOC254018 BINDING SITE, designated SEQ ID:46318, to the nucleotide sequence of VGAM931 RNA, herein designated VGAM RNA, also designated SEQ ID:3642.

Another function of VGAM931 is therefore inhibition of LOC254018 (Accession XM_173066). Accordingly, utilities of VGAM931 include diagnosis, prevention and treatment of diseases and clinical conditions associated with LOC254018. LOC255448 (Accession XM_170623) is another VGAM931 host target gene. LOC255448 BINDING SITE is HOST TARGET binding site found in the 3' untranslated region of mRNA encoded by LOC255448, corresponding to a HOST TARGET binding site such as BINDING SITE I, BINDING SITE II or BINDING SITE III. Table 2 illustrates the complementarity of the nucleotide sequences of LOC255448 BINDING SITE, designated SEQ ID:45404, to the nucleotide sequence of VGAM931 RNA, herein designated VGAM RNA, also designated SEQ ID:3642.

Another function of VGAM931 is therefore inhibition of LOC255448 (Accession XM_170623). Accordingly, utilities of VGAM931 include diagnosis, prevention and treatment of diseases and clinical conditions associated with LOC255448. LOC257596 (Accession XM_175296) is another VGAM931 host target gene. LOC257596 BINDING SITE is HOST TARGET binding site found in the 3' untranslated region of mRNA encoded by LOC257596, corresponding to a HOST TARGET binding site such as BINDING SITE I, BINDING SITE II or BINDING SITE III. Table 2 illustrates the complementarity of the nucleotide sequences of LOC257596 BINDING SITE, designated SEQ ID:46752, to the nucleotide sequence of VGAM931 RNA, herein designated VGAM RNA, also designated SEQ ID:3642.

Another function of VGAM931 is therefore inhibition of LOC257596 (Accession XM_175296). Accordingly, utilities of VGAM931 include diagnosis, prevention and treatment of diseases and clinical conditions associated with LOC257596. LOC91308 (Accession XM_037600) is another VGAM931 host target gene. LOC91308 BINDING SITE is HOST TARGET binding site found in the 3' untranslated region of mRNA encoded by LOC91308, corresponding to a HOST TARGET binding site such as BINDING SITE I, BINDING SITE II or BINDING SITE III. Table 2 illustrates the complementarity of the nucleotide sequences of LOC91308 BINDING SITE, designated SEQ ID:32655, to the nucleotide sequence of VGAM931 RNA, herein designated VGAM RNA, also designated SEQ ID:3642.

Another function of VGAM931 is therefore inhibition of LOC91308 (Accession XM_037600). Accordingly, utilities of VGAM931 include diagnosis, prevention and treatment of diseases and clinical conditions associated with LOC91308. FIG. 1 further provides a conceptual description of a novel bioinformatically detected viral gene of the present invention, referred to here as Viral Genomic Address Messenger 932 (VGAM932) viral gene, which modulates expression of respective host target genes thereof, the function and utility of which host target genes is known in the art.

VGAM932 is a novel bioinformatically detected regulatory, non protein coding, viral micro RNA (miRNA) gene. The method by which VGAM932 was detected is described hereinabove with reference to FIGS. 1-8.

VGAM932 gene, herein designated VGAM GENE, is a viral gene contained in the genome of Human Herpesvirus 4. VGAM932 host target gene, herein designated VGAM HOST TARGET GENE, is a human gene contained in the human genome.

VGAM932 gene encodes a VGAM932 precursor RNA, herein designated VGAM PRECURSOR RNA. Similar to other miRNA genes, and unlike most ordinary genes, VGAM932 precursor RNA does not encode a protein. A nucleotide sequence identical or highly similar to the nucleotide sequence of VGAM932 precursor RNA is designated SEQ ID:918, and is provided hereinbelow with reference to the sequence listing part. Nucleotide sequence SEQ ID:918 is located at position 122063 relative to the genome of Human Herpesvirus 4.

VGAM932 precursor RNA folds onto itself, forming VGAM932 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM932 folded precursor RNA into VGAM932 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM932 RNA is designated SEQ ID:3643, and is provided hereinbelow with reference to the sequence listing part.

VGAM932 host target gene, herein designated VGAM HOST TARGET GENE, encodes a corresponding messenger RNA, VGAM932 host target RNA, herein designated VGAM HOST TARGET RNA. VGAM932 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM932 RNA, herein designated VGAM RNA, binds complementarily to one or more host target binding sites located in untranslated regions of VGAM932 host target RNA, herein designated VGAM HOST TARGET RNA. This complementary binding is due to the fact that the nucleotide sequence of VGAM932 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM932 RNA, herein designated VGAM RNA, may have a different number of host target binding sites in untranslated regions of a VGAM932 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM932 RNA, herein designated VGAM RNA, to host target binding sites on VGAM932 host target RNA, herein designated VGAM HOST TARGET RNA, such as BINDING SITE I, BINDING SITE II and BINDING SITE III, inhibits translation of VGAM932 host target RNA into VGAM932 host target protein, herein designated VGAM HOST TARGET PROTEIN. VGAM host target protein is therefore outlined by a broken line.

It is appreciated that VGAM932 host target gene, herein designated VGAM HOST TARGET GENE, in fact represents a plurality of VGAM932 host target genes. The mRNA of each one of this plurality of VGAM932 host target genes comprises one or more host target binding sites, each having a nucleotide sequence which is at least partly complementary to VGAM932 RNA, herein designated VGAM RNA, and which when bound by VGAM932 RNA causes inhibition of translation of respective one or more VGAM932 host target proteins.

It is further appreciated by one skilled in the art that the mode of translational inhibition illustrated by FIG. 1 with specific reference to translational inhibition exerted by VGAM932 gene, herein designated VGAM GENE, on one or more VGAM932 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM932 is inhibition of expression of host target genes, as part of a novel viral mechanism of attacking a host. Accordingly, utilities of VGAM932 include diagnosis, prevention and treatment of viral infection by Human Herpesvirus 4. Specific functions, and accordingly utilities, of VGAM932 correlate with, and may be deduced from, the identity of the host target genes which VGAM932 binds and inhibits, and the function of these host target genes, as elaborated hereinbelow.

Nucleotide sequences of the VGAM932 precursor RNA, herein designated VGAM PRECURSOR RNA, and of the 'diced' VGAM932 RNA, herein designated VGAM RNA, and a schematic representation of the secondary folding of VGAM932 folded precursor RNA, herein designated VGAM FOLDED PRECURSOR RNA, of VGAM932 are further described hereinbelow with reference to Table 1.

Nucleotide sequences of host target binding sites, such as BINDING SITE-I, BINDING SITE-II and BINDING SITE-III of FIG. 1, found on VGAM932 host target RNA, and schematic representation of the complementarity of each of these host target binding sites to VGAM932 RNA, herein designated VGAM RNA, are described hereinbelow with reference to Table 2.

As mentioned hereinabove with reference to FIG. 1, a function of VGAM932 gene, herein designated VGAM is inhibition of expression of VGAM932 target genes. It is appreciated that specific functions, and accordingly utilities, of VGAM932 correlate with, and may be deduced from, the identity of the target genes which VGAM932 binds and inhibits, and the function of these target genes, as elaborated hereinbelow.

PIF1 (Accession XM_027898) is a VGAM932 host target gene. PIF1 BINDING SITE is HOST TARGET binding site found in the 3' untranslated region of mRNA encoded by PIF1, corresponding to a HOST TARGET binding site such as BINDING SITE I, BINDING SITE II or BINDING SITE III. Table 2 illustrates the complementarity of the nucleotide sequences of PIF1 BINDING SITE, designated SEQ ID:30585, to the nucleotide sequence of VGAM932 RNA, herein designated VGAM RNA, also designated SEQ ID:3643.

A function of VGAM932 is therefore inhibition of PIF1 (Accession XM_027898). Accordingly, utilities of VGAM932 include diagnosis, prevention and treatment of diseases and clinical conditions associated with PIF1. SE57-1 (Accession NM_025214) is another VGAM932 host target gene. SE57-1 BINDING SITE is HOST TARGET binding site found in the 3' untranslated region of mRNA encoded by SE57-1, corresponding to a HOST TARGET binding site such as BINDING SITE I, BINDING SITE II or BINDING SITE III. Table 2 illustrates the complementarity of the nucleotide sequences of SE57-1 BINDING SITE, designated SEQ ID:24888, to the nucleotide sequence of VGAM932 RNA, herein designated VGAM RNA, also designated SEQ ID:3643.

Another function of VGAM932 is therefore inhibition of SE57-1 (Accession NM_025214). Accordingly, utilities of VGAM932 include diagnosis, prevention and treatment of diseases and clinical conditions associated with SE57-1. FIG. 1 further provides a conceptual description of a novel bioinformatically detected viral gene of the present invention, referred to here as Viral Genomic Address Messenger 933 (VGAM933) viral gene, which modulates expression of respective host target genes thereof, the function and utility of which host target genes is known in the art.

VGAM933 is a novel bioinformatically detected regulatory, non protein coding, viral micro RNA (miRNA) gene. The method by which VGAM933 was detected is described hereinabove with reference to FIGS. 1-8.

VGAM933 gene, herein designated VGAM GENE, is a viral gene contained in the genome of Human Herpesvirus 4. VGAM933 host target gene, herein designated VGAM HOST TARGET GENE, is a human gene contained in the human genome.

VGAM933 gene encodes a VGAM933 precursor RNA, herein designated VGAM PRECURSOR RNA. Similar to other miRNA genes, and unlike most ordinary genes, VGAM933 precursor RNA does not encode a protein. A nucleotide sequence identical or highly similar to the nucleotide sequence of VGAM933 precursor RNA is designated SEQ ID:919, and is provided hereinbelow with reference to the sequence listing part. Nucleotide sequence SEQ ID:919 is located at position 123567 relative to the genome of Human Herpesvirus 4.

VGAM933 precursor RNA folds onto itself, forming VGAM933 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM933 folded precursor RNA into VGAM933 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM933 RNA is designated SEQ ID:3644, and is provided hereinbelow with reference to the sequence listing part.

VGAM933 host target gene, herein designated VGAM HOST TARGET GENE, encodes a corresponding messenger RNA, VGAM933 host target RNA, herein designated VGAM HOST TARGET RNA. VGAM933 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM933 RNA, herein designated VGAM RNA, binds complementarily to one or more host target binding sites located in untranslated regions of VGAM933 host target RNA, herein designated VGAM HOST TARGET RNA. This complementary binding is due to the fact that the nucleotide sequence of VGAM933 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM933 RNA, herein designated VGAM RNA, may have a different number of host target binding sites in untranslated regions of a VGAM933 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM933 RNA, herein designated VGAM RNA, to host target binding sites on VGAM933 host target RNA, herein designated VGAM HOST TARGET RNA, such as BINDING SITE I, BINDING SITE II and BINDING SITE III, inhibits translation of VGAM933 host target RNA into VGAM933 host target protein, herein designated VGAM HOST TARGET PROTEIN. VGAM host target protein is therefore outlined by a broken line.

It is appreciated that VGAM933 host target gene, herein designated VGAM HOST TARGET GENE, in fact represents a plurality of VGAM933 host target genes. The mRNA of each one of this plurality of VGAM933 host target genes comprises one or more host target binding sites, each having a nucleotide sequence which is at least partly complementary to VGAM933 RNA, herein designated VGAM RNA, and which when bound by VGAM933 RNA causes inhibition of translation of respective one or more VGAM933 host target proteins.

It is further appreciated by one skilled in the art that the mode of translational inhibition illustrated by FIG. 1 with specific reference to translational inhibition exerted by VGAM933 gene, herein designated VGAM GENE, on one or more VGAM933 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM933 is inhibition of expression of host target genes, as part of a novel viral mechanism of attacking a host. Accordingly, utilities of VGAM933 include diagnosis, prevention and treatment of viral infection by Human Herpesvirus 4. Specific functions, and accordingly utilities, of VGAM933 correlate with, and may be deduced from, the identity of the host target genes which VGAM933 binds and inhibits, and the function of these host target genes, as elaborated hereinbelow.

Nucleotide sequences of the VGAM933 precursor RNA, herein designated VGAM PRECURSOR RNA, and of the 'diced' VGAM933 RNA, herein designated VGAM RNA, and a schematic representation of the secondary folding of VGAM933 folded precursor RNA, herein designated VGAM FOLDED PRECURSOR RNA, of VGAM933 are further described hereinbelow with reference to Table 1.

Nucleotide sequences of host target binding sites, such as BINDING SITE-I, BINDING SITE-II and BINDING SITE-III of FIG. 1, found on VGAM933 host target RNA, and schematic representation of the complementarity of each of these host target binding sites to VGAM933 RNA, herein designated VGAM RNA, are described hereinbelow with reference to Table 2.

As mentioned hereinabove with reference to FIG. 1, a function of VGAM933 gene, herein designated VGAM is inhibition of expression of VGAM933 target genes. It is appreciated that specific functions, and accordingly utilities, of VGAM933 correlate with, and may be deduced from, the identity of the target genes which VGAM933 binds and inhibits, and the function of these target genes, as elaborated hereinbelow.

Ectonucleoside Triphosphate Diphosphohydrolase 6 (putative function) (ENTPD6, Accession NM_001247) is a VGAM933 host target gene. ENTPD6 BINDING SITE is HOST TARGET binding site found in the 3' untranslated region of mRNA encoded by ENTPD6, corresponding to a HOST TARGET binding site such as BINDING SITE I, BINDING SITE II or BINDING SITE III. Table 2 illustrates the complementarity of the nucleotide sequences of ENTPD6 BINDING SITE, designated SEQ ID:6917, to the nucleotide sequence of VGAM933 RNA, herein designated VGAM RNA, also designated SEQ ID:3644.

A function of VGAM933 is therefore inhibition of Ectonucleoside Triphosphate Diphosphohydrolase 6 (putative function) (ENTPD6, Accession NM_001247), a gene which might support glycosylation reactions in the golgi apparatus and, when released from cells, might catalyze the hydrolysis of extracellular nucleotides. Accordingly, utilities of VGAM933 include diagnosis, prevention and treatment of diseases and clinical conditions associated with ENTPD6. The function of ENTPD6 and its association with various diseases and clinical conditions, has been established by previous studies, as described hereinabove with reference to VGAM827. Chromosome 17 Open Reading Frame 26 (C17orf26, Accession NM_139177) is another VGAM933 host target gene. C17orf26 BINDING SITE is HOST TARGET binding site found in the 3' untranslated region of mRNA encoded by C17orf26, corresponding to a HOST TARGET binding site such as BINDING SITE I, BINDING SITE II or BINDING SITE III. Table 2 illustrates the complementarity of the nucleotide sequences of C17orf26 BINDING SITE, designated SEQ ID:29185, to the nucleotide sequence of VGAM933 RNA, herein designated VGAM RNA, also designated SEQ ID:3644.

Another function of VGAM933 is therefore inhibition of Chromosome 17 Open Reading Frame 26 (C17orf26, Accession NM_139177). Accordingly, utilities of VGAM933 include diagnosis, prevention and treatment of diseases and clinical conditions associated with C17orf26. FLJ13265 (Accession NM_024877) is another VGAM933 host target gene. FLJ13265 BINDING SITE is HOST TARGET binding site found in the 3' untranslated region of mRNA encoded by FLJ13265, corresponding to a HOST TARGET binding site such as BINDING SITE I, BINDING SITE II or BINDING SITE III. Table 2 illustrates the complementarity of the nucleotide sequences of FLJ13265 BINDING SITE, designated SEQ ID:24311, to the nucleotide sequence of VGAM933 RNA, herein designated VGAM RNA, also designated SEQ ID:3644.

Another function of VGAM933 is therefore inhibition of FLJ13265 (Accession NM_024877). Accordingly, utilities of VGAM933 include diagnosis, prevention and treatment of diseases and clinical conditions associated with FLJ13265. Potassium Channel, Subfamily T, Member 1 (KCNT1, Accession XM_029962) is another VGAM933 host target gene. KCNT1 BINDING SITE is HOST TARGET binding site found in the 3' untranslated region of mRNA encoded by KCNT1, corresponding to a HOST TARGET binding site such as BINDING SITE I, BINDING SITE II or BINDING SITE III. Table 2 illustrates the complementarity of the nucleotide sequences of KCNT1 BINDING SITE, designated SEQ ID:30973, to the nucleotide sequence of VGAM933 RNA, herein designated VGAM RNA, also designated SEQ ID:3644.

Another function of VGAM933 is therefore inhibition of Potassium Channel, Subfamily T, Member 1 (KCNT1, Accession XM_029962). Accordingly, utilities of VGAM933 include diagnosis, prevention and treatment of diseases and clinical conditions associated with KCNT1. KIAA1493 (Accession XM_034415) is another VGAM933 host target gene. KIAA1493 BINDING SITE is HOST TARGET binding site found in the 3' untranslated region of mRNA encoded by KIAA1493, corresponding to a HOST TARGET binding site such as BINDING SITE I, BINDING SITE II or BINDING SITE III. Table 2 illustrates the complementarity of the nucleotide sequences of KIAA1493 BINDING SITE, designated SEQ ID:32092, to the nucleotide sequence of VGAM933 RNA, herein designated VGAM RNA, also designated SEQ ID:3644.

Another function of VGAM933 is therefore inhibition of KIAA1493 (Accession XM_034415). Accordingly, utilities of VGAM933 include diagnosis, prevention and treatment of diseases and clinical conditions associated with KIAA1493. LOC113230 (Accession XM_053966) is another VGAM933 host target gene. LOC113230 BINDING SITE is HOST TARGET binding site found in the 5' untranslated region of mRNA encoded by LOC113230, corresponding to a HOST TARGET binding site such as BINDING SITE I, BINDING SITE II or BINDING SITE III. Table 2 illustrates the complementarity of the nucleotide sequences of LOC113230 BINDING SITE, designated SEQ ID:36131, to the nucleotide sequence of VGAM933 RNA, herein designated VGAM RNA, also designated SEQ ID:3644.

Another function of VGAM933 is therefore inhibition of LOC113230 (Accession XM_053966). Accordingly, utilities of VGAM933 include diagnosis, prevention and treatment of diseases and clinical conditions associated with LOC113230. LOC115399 (Accession XM_055874) is another VGAM933 host target gene. LOC115399 BINDING SITE is HOST TARGET binding site found in the 3' untranslated region of mRNA encoded by LOC115399, corresponding to a HOST TARGET binding site such as BINDING SITE I, BINDING SITE II or BINDING SITE III. Table 2 illustrates the complementarity of the nucleotide sequences of LOC115399 BINDING SITE, designated SEQ ID:36347, to the nucleotide sequence of VGAM933 RNA, herein designated VGAM RNA, also designated SEQ ID:3644.

Another function of VGAM933 is therefore inhibition of LOC115399 (Accession XM_055874). Accordingly, utilities of VGAM933 include diagnosis, prevention and treatment of diseases and clinical conditions associated with LOC115399. LOC147817 (Accession XM_085903) is another VGAM933 host target gene. LOC147817 BINDING SITE is HOST TARGET binding site found in the 5' untranslated region of mRNA encoded by LOC147817, corresponding to a HOST TARGET binding site such as BINDING SITE I, BINDING SITE II or BINDING SITE III. Table 2 illustrates the complementarity of the nucleotide sequences of LOC147817 BINDING SITE, designated SEQ ID:38387, to the nucleotide sequence of VGAM933 RNA, herein designated VGAM RNA, also designated SEQ ID:3644.

Another function of VGAM933 is therefore inhibition of LOC147817 (Accession XM_085903). Accordingly, utilities of VGAM933 include diagnosis, prevention and treatment of diseases and clinical conditions associated with LOC147817. LOC148147 (Accession XM_086071) is another VGAM933 host target gene. LOC148147 BINDING SITE is HOST TARGET binding site found in the 3' untranslated region of mRNA encoded by LOC148147, corresponding to a HOST TARGET binding site such as BINDING SITE I, BINDING SITE II or BINDING SITE III. Table 2 illustrates the complementarity of the nucleotide sequences of LOC148147 BINDING SITE, designated SEQ ID:38474, to the nucleotide sequence of VGAM933 RNA, herein designated VGAM RNA, also designated SEQ ID:3644.

Another function of VGAM933 is therefore inhibition of LOC148147 (Accession XM_086071). Accordingly, utilities of VGAM933 include diagnosis, prevention and treatment of diseases and clinical conditions associated with LOC148147. LOC163412 (Accession XM_088868) is another VGAM933 host target gene. LOC163412 BINDING SITE is HOST TARGET binding site found in the 5' untranslated region of mRNA encoded by LOC163412, corresponding to a HOST TARGET binding site such as BINDING SITE I, BINDING SITE II or BINDING SITE III. Table 2 illustrates the complementarity of the nucleotide sequences of LOC163412 BIND- ING SITE, designated SEQ ID:39953, to the nucleotide sequence of VGAM933 RNA, herein designated VGAM RNA, also designated SEQ ID:3644.

Another function of VGAM933 is therefore inhibition of LOC163412 (Accession XM_088868). Accordingly, utilities of VGAM933 include diagnosis, prevention and treatment of diseases and clinical conditions associated with LOC163412. LOC58525 (Accession XM_086045) is another VGAM933 host target gene. LOC58525 BINDING SITE is HOST TARGET binding site found in the 5' untranslated region of mRNA encoded by LOC58525, corresponding to a HOST TARGET binding site such as BINDING SITE I, BINDING SITE II or BINDING SITE III. Table 2 illustrates the complementarity of the nucleotide sequences of LOC58525 BINDING SITE, designated SEQ ID:38457, to the nucleotide sequence of VGAM933 RNA, herein designated VGAM RNA, also designated SEQ ID:3644.

Another function of VGAM933 is therefore inhibition of LOC58525 (Accession XM_086045). Accordingly, utilities of VGAM933 include diagnosis, prevention and treatment of diseases and clinical conditions associated with LOC58525. FIG. 1 further provides a conceptual description of a novel bioinformatically detected viral gene of the present invention, referred to here as Viral Genomic Address Messenger 934 (VGAM934) viral gene, which modulates expression of respective host target genes thereof, the function and utility of which host target genes is known in the art.

VGAM934 is a novel bioinformatically detected regulatory, non protein coding, viral micro RNA (miRNA) gene. The method by which VGAM934 was detected is described hereinabove with reference to FIGS. 1-8.

VGAM934 gene, herein designated VGAM GENE, is a viral gene contained in the genome of Human Herpesvirus 4. VGAM934 host target gene, herein designated VGAM HOST TARGET GENE, is a human gene contained in the human genome.

VGAM934 gene encodes a VGAM934 precursor RNA, herein designated VGAM PRECURSOR RNA. Similar to other miRNA genes, and unlike most ordinary genes, VGAM934 precursor RNA does not encode a protein. A nucleotide sequence identical or highly similar to the nucleotide sequence of VGAM934 precursor RNA is designated SEQ ID:920, and is provided hereinbelow with reference to the sequence listing part. Nucleotide sequence SEQ ID:920 is located at position 123384 relative to the genome of Human Herpesvirus 4.

VGAM934 precursor RNA folds onto itself, forming VGAM934 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM934 folded precursor RNA into VGAM934 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM934 RNA is designated SEQ ID:3645, and is provided hereinbelow with reference to the sequence listing part.

VGAM934 host target gene, herein designated VGAM HOST TARGET GENE, encodes a corresponding messenger RNA, VGAM934 host target RNA, herein designated VGAM HOST TARGET RNA. VGAM934 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM934 RNA, herein designated VGAM RNA, binds complementarily to one or more host target binding sites located in untranslated regions of VGAM934 host target RNA, herein designated VGAM HOST TARGET RNA. This complementary binding is due to the fact that the nucleotide sequence of VGAM934 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM934 RNA, herein designated VGAM RNA, may have a different number of host target binding sites in untranslated regions of a VGAM934 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM934 RNA, herein designated VGAM RNA, to host target binding sites on VGAM934 host target RNA, herein designated VGAM HOST TARGET RNA, such as BINDING SITE I, BINDING SITE II and BINDING SITE III, inhibits translation of VGAM934 host target RNA into VGAM934 host target protein, herein designated VGAM HOST TARGET PROTEIN. VGAM host target protein is therefore outlined by a broken line.

It is appreciated that VGAM934 host target gene, herein designated VGAM HOST TARGET GENE, in fact represents a plurality of VGAM934 host target genes. The mRNA of each one of this plurality of VGAM934 host target genes comprises one or more host target binding sites, each having a nucleotide sequence which is at least partly complementary to VGAM934 RNA, herein designated VGAM RNA, and which when bound by VGAM934 RNA causes inhibition of translation of respective one or more VGAM934 host target proteins.

It is further appreciated by one skilled in the art that the mode of translational inhibition illustrated by FIG. 1 with specific reference to translational inhibition exerted by VGAM934 gene, herein designated VGAM GENE, on one or more VGAM934 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM934 is inhibition of expression of host target genes, as part of a novel viral mechanism of attacking a host. Accordingly, utilities of VGAM934 include diagnosis, prevention and treatment of viral infection by Human Herpesvirus 4. Specific functions, and accordingly utilities, of VGAM934 correlate with, and may be deduced from, the identity of the host target genes which VGAM934 binds and inhibits, and the function of these host target genes, as elaborated hereinbelow.

Nucleotide sequences of the VGAM934 precursor RNA, herein designated VGAM PRECURSOR RNA, and of the 'diced' VGAM934 RNA, herein designated VGAM RNA, and a schematic representation of the secondary folding of VGAM934 folded precursor RNA, herein designated VGAM FOLDED PRECURSOR RNA, of VGAM934 are further described hereinbelow with reference to Table 1.

Nucleotide sequences of host target binding sites, such as BINDING SITE-I, BINDING SITE-II and BINDING SITE-III of FIG. 1, found on VGAM934 host target RNA, and schematic representation of the complementarity of each of these host target binding sites to VGAM934 RNA, herein designated VGAM RNA, are described hereinbelow with reference to Table 2.

As mentioned hereinabove with reference to FIG. 1, a function of VGAM934 gene, herein designated VGAM is inhibition of expression of VGAM934 target genes. It is appreciated that specific functions, and accordingly utilities, of VGAM934 correlate with, and may be deduced from, the identity of the target genes which VGAM934 binds and inhibits, and the function of these target genes, as elaborated hereinbelow.

Splicing Factor 1 (SF1, Accession NM_004630) is a VGAM934 host target gene. SF1 BINDING SITE is HOST TARGET binding site found in the 5' untranslated region of mRNA encoded by SF1, corresponding to a HOST TARGET binding site such as BINDING SITE I, BINDING SITE II or BINDING SITE III. Table 2 illustrates the complementarity of the nucleotide sequences of SF1 BINDING SITE, designated SEQ ID:11003, to the nucleotide sequence of VGAM934 RNA, herein designated VGAM RNA, also designated SEQ ID:3645.

A function of VGAM934 is therefore inhibition of Splicing Factor 1 (SF1, Accession NM_004630), a gene which is a transcriptional repressor and splicing factor. Accordingly, utilities of VGAM934 include diagnosis, prevention and treatment of diseases and clinical conditions associated with SF1. The function of SF1 has been established by previous studies. Toda et al. (1994) isolated a gene, designated ZFM1 by them, from cosmids from the MEN1 (OMIM Ref. No. 131100) region of 11q13 using exon amplification. They then obtained cDNAs from cerebral, cerebellar, and fetal liver libraries. The predicted 623-amino acid protein contains a nuclear transport domain, a metal-binding or zinc finger motif, and glutamine- and proline-rich regions. It shows some sequence similarity to WT1 (OMIM Ref. No. 607102) and EGR2 (OMIM Ref. No. 129010). RT-PCR was used to show expression in the thyroid gland, pancreas, adrenal gland, and ovary. By differential screening of a cDNA library obtained from GMCSF (OMIM Ref. No. 138960)-stimulated human myeloid leukemia cells, Caslini et al. (1997) cloned 2 additional isoforms of the ZNF162 gene, designated B3 and B4, that encode 571- and 639-amino acid proteins, respectively. All of the ZNF162 isoforms contain a KH domain, a sequence motif present in proteins playing a major role in regulating cellular RNA metabolism.

Full details of the abovementioned studies are described in the following publications, the disclosure of which are hereby incorporated by reference:

Toda, T.; Iida, A.; Miwa, T.; Nakamura, Y.; Imai, T.: Isolation and characterization of a novel gene encoding nuclear protein at a locus (D11S636) tightly linked to multiple endocrine neoplasia type 1 (MEN1). Hum. Molec. Genet. 3:465-470, 1994; and Caslini, C.; Spinelli, O.; Cazzaniga, G.; Golay, J.; De Gioia, L.; Pedretti, A.; Breviario, F.; Amaru, R.; Barbui, T.; Biondi, A.; Introna, M.; Rambaldi, A.: Identification of two novel is.

Further studies establishing the function and utilities of SF1 are found in John Hopkins OMIM database record ID 601516, and in sited publications numbered 2776, 398 and 6654 listed in the bibliography section hereinbelow, which are also hereby incorporated by reference. FLJ22002 (Accession NM_024838) is another VGAM934 host target gene. FLJ22002 BINDING SITE is HOST TARGET binding site found in the 3' untranslated region of mRNA encoded by FLJ22002, corresponding to a HOST TARGET binding site such as BINDING SITE I, BINDING SITE II or BINDING SITE III. Table 2 illustrates the complementarity of the nucleotide sequences of FLJ22002 BINDING SITE, designated SEQ ID:24244, to the nucleotide sequence of VGAM934 RNA, herein designated VGAM RNA, also designated SEQ ID:3645.

Another function of VGAM934 is therefore inhibition of FLJ22002 (Accession NM_024838). Accordingly, utilities of VGAM934 include diagnosis, prevention and treatment of diseases and clinical conditions associated with FLJ22002. Purinergic Receptor P2X, Ligand-gated Ion Channel, 1 (P2RX1, Accession XM_040635) is another VGAM934 host target gene. P2RX1 BINDING SITE is HOST TARGET binding site found in the 3' untranslated region of mRNA encoded by P2RX1, corresponding to a HOST TARGET binding site such as BINDING SITE I, BINDING SITE II or BINDING SITE III. Table 2 illustrates the complementarity of the nucleotide sequences of P2RX1 BINDING SITE, designated SEQ ID:33349, to the nucleotide sequence of VGAM934 RNA, herein designated VGAM RNA, also designated SEQ ID:3645.

Another function of VGAM934 is therefore inhibition of Purinergic Receptor P2X, Ligand-gated Ion Channel, 1 (P2RX1, Accession XM_040635). Accordingly, utilities of VGAM934 include diagnosis, prevention and treatment of diseases and clinical conditions associated with P2RX1. LOC255598 (Accession XM_173715) is another VGAM934 host target gene. LOC255598 BINDING SITE is HOST TARGET binding site found in the 5' untranslated region of mRNA encoded by LOC255598, corresponding to a HOST TARGET binding site such as BINDING SITE I, BINDING SITE II or BINDING SITE III. Table 2 illustrates the complementarity of the nucleotide sequences of LOC255598 BINDING SITE, designated SEQ ID:46558, to the nucleotide sequence of VGAM934 RNA, herein designated VGAM RNA, also designated SEQ ID:3645.

Another function of VGAM934 is therefore inhibition of LOC255598 (Accession XM_173715). Accordingly, utilities of VGAM934 include diagnosis, prevention and treatment of diseases and clinical conditions associated with LOC255598. LOC257103 (Accession XM_170982) is another VGAM934 host target gene. LOC257103 BINDING SITE is HOST TARGET binding site found in the 5' untranslated region of mRNA encoded by LOC257103, corresponding to a HOST TARGET binding site such as BINDING SITE I, BINDING SITE II or BINDING SITE III. Table 2 illustrates the complementarity of the nucleotide sequences of LOC257103 BINDING SITE, designated SEQ ID:45753, to the nucleotide sequence of VGAM934 RNA, herein designated VGAM RNA, also designated SEQ ID:3645.

Another function of VGAM934 is therefore inhibition of LOC257103 (Accession XM_170982). Accordingly, utilities of VGAM934 include diagnosis, prevention and treatment of diseases and clinical conditions associated with LOC257103.

FIG. 1 further provides a conceptual description of a novel bioinformatically detected viral gene of the present invention, referred to here as Viral Genomic Address Messenger 935 (VGAM935) viral gene, which modulates expression of respective host target genes thereof, the function and utility of which host target genes is known in the art.

VGAM935 is a novel bioinformatically detected regulatory, non protein coding, viral micro RNA (miRNA) gene. The method by which VGAM935 was detected is described hereinabove with reference to FIGS. 1-8.

VGAM935 gene, herein designated VGAM GENE, is a viral gene contained in the genome of Melanoplus Sanguinipes Entomopoxvirus. VGAM935 host target gene, herein designated VGAM HOST TARGET GENE, is a human gene contained in the human genome.

VGAM935 gene encodes a VGAM935 precursor RNA, herein designated VGAM PRECURSOR RNA. Similar to other miRNA genes, and unlike most ordinary genes, VGAM935 precursor RNA does not encode a protein. A nucleotide sequence identical or highly similar to the nucleotide sequence of VGAM935 precursor RNA is designated SEQ ID:921, and is provided hereinbelow with reference to the sequence listing part. Nucleotide sequence SEQ ID:921 is located at position 137342 relative to the genome of Melanoplus Sanguinipes Entomopoxvirus.

VGAM935 precursor RNA folds onto itself, forming VGAM935 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM935 folded precursor RNA into VGAM935 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM935 RNA is designated SEQ ID:3646, and is provided hereinbelow with reference to the sequence listing part.

VGAM935 host target gene, herein designated VGAM HOST TARGET GENE, encodes a corresponding messenger RNA, VGAM935 host target RNA, herein designated VGAM HOST TARGET RNA. VGAM935 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM935 RNA, herein designated VGAM RNA, binds complementarily to one or more host target binding sites located in untranslated regions of VGAM935 host target RNA, herein designated VGAM HOST TARGET RNA. This complementary binding is due to the fact that the nucleotide sequence of VGAM935 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM935 RNA, herein designated VGAM RNA, may have a different number of host target binding sites in untranslated regions of a VGAM935 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM935 RNA, herein designated VGAM RNA, to host target binding sites on VGAM935 host target RNA, herein designated VGAM HOST TARGET RNA, such as BINDING SITE I, BINDING SITE II and BINDING SITE III, inhibits translation of VGAM935 host target RNA into VGAM935 host target protein, herein designated VGAM HOST TARGET PROTEIN. VGAM host target protein is therefore outlined by a broken line.

It is appreciated that VGAM935 host target gene, herein designated VGAM HOST TARGET GENE, in fact represents a plurality of VGAM935 host target genes. The mRNA of each one of this plurality of VGAM935 host target genes comprises one or more host target binding sites, each having a nucleotide sequence which is at least partly complementary to VGAM935 RNA, herein designated VGAM RNA, and which when bound by VGAM935 RNA causes inhibition of translation of respective one or more VGAM935 host target proteins.

It is further appreciated by one skilled in the art that the mode of translational inhibition illustrated by FIG. 1 with specific reference to translational inhibition exerted by VGAM935 gene, herein designated VGAM GENE, on one or more VGAM935 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM935 is inhibition of expression of host target genes, as part of a novel viral mechanism of attacking a host. Accordingly, utilities of VGAM935 include diagnosis, prevention and treatment of viral infection by Melanoplus Sanguinipes Entomopoxvirus. Specific functions, and accordingly utilities, of VGAM935 correlate with, and may be deduced from, the identity of the host target genes which VGAM935 binds and inhibits, and the function of these host target genes, as elaborated hereinbelow.

Nucleotide sequences of the VGAM935 precursor RNA, herein designated VGAM PRECURSOR RNA, and of the 'diced' VGAM935 RNA, herein designated VGAM RNA, and a schematic representation of the secondary folding of VGAM935 folded precursor RNA, herein designated VGAM FOLDED PRECURSOR RNA, of VGAM935 are further described hereinbelow with reference to Table 1.

Nucleotide sequences of host target binding sites, such as BINDING SITE-I, BINDING SITE-II and BINDING SITE-III of FIG. 1, found on VGAM935 host target RNA, and schematic representation of the complementarity of each of these host target binding sites to VGAM935 RNA, herein designated VGAM RNA, are described hereinbelow with reference to Table 2.

As mentioned hereinabove with reference to FIG. 1, a function of VGAM935 gene, herein designated VGAM is inhibition of expression of VGAM935 target genes. It is appreciated that specific functions, and accordingly utilities, of VGAM935 correlate with, and may be deduced from, the identity of the target genes which VGAM935 binds and inhibits, and the function of these target genes, as elaborated hereinbelow.

Translocase of Inner Mitochondrial Membrane 8 Homolog A (yeast) (TIMM8A, Accession NM_004085) is a VGAM935 host target gene. TIMM8A BINDING SITE is HOST TARGET binding site found in the 3' untranslated region of mRNA encoded by TIMM8A, corresponding to a HOST TARGET binding site such as BINDING SITE I, BINDING SITE II or BINDING SITE III. Table 2 illustrates the complementarity of the nucleotide sequences of TIMM8A BINDING SITE, designated SEQ ID:10289, to the nucleotide sequence of VGAM935 RNA, herein designated VGAM RNA, also designated SEQ ID:3646.

A function of VGAM935 is therefore inhibition of Translocase of Inner Mitochondrial Membrane 8 Homolog A (yeast) (TIMM8A, Accession NM_004085). Accordingly, utilities of VGAM935 include diagnosis, prevention and treatment of diseases and clinical conditions associated with TIMM8A. BDG-29 (Accession XM_051343) is another VGAM935 host target gene. BDG-29 BINDING SITE is HOST TARGET binding site found in the 3' untranslated region of mRNA encoded by BDG-29, corresponding to a HOST TARGET binding site such as BINDING SITE I, BINDING SITE II or BINDING SITE III. Table 2 illustrates the complementarity of the nucleotide sequences of BDG-29 BINDING SITE, designated SEQ ID:35813, to the nucleotide sequence of VGAM935 RNA, herein designated VGAM RNA, also designated SEQ ID:3646.

Another function of VGAM935 is therefore inhibition of BDG-29 (Accession XM_051343). Accordingly, utilities of VGAM935 include diagnosis, prevention and treatment of diseases and clinical conditions associated with BDG-29. Chromosome 1 Open Reading Frame 26 (C1orf26, Accession NM_017673) is another VGAM935 host target gene. C1orf26 BINDING SITE is HOST TARGET binding site found in the 3" untranslated region of mRNA encoded by C1orf26, corresponding to a HOST TARGET binding site such as BINDING SITE I, BINDING SITE II or BINDING SITE III. Table 2 illustrates the complementarity of the nucleotide sequences of C1orf26 BINDING SITE, designated SEQ ID:19217, to the nucleotide sequence of VGAM935 RNA, herein designated VGAM RNA, also designated SEQ ID:3646.

Another function of VGAM935 is therefore inhibition of Chromosome 1 Open Reading Frame 26 (C1orf26, Accession NM_017673). Accordingly, utilities of VGAM935 include diagnosis, prevention and treatment of diseases and clinical conditions associated with C1orf26. FIG. 1 further provides a conceptual description of a novel bioinformatically detected viral gene of the present invention, referred to here as Viral Genomic Address Messenger 936 (VGAM936) viral gene, which modulates expression of respective host target genes thereof, the function and utility of which host target genes is known in the art.

VGAM936 is a novel bioinformatically detected regulatory, non protein coding, viral micro RNA (miRNA) gene. The method by which VGAM936 was detected is described hereinabove with reference to FIGS. 1-8.

VGAM936 gene, herein designated VGAM GENE, is a viral gene contained in the genome of Melanoplus Sanguinipes Entomopoxvirus. VGAM936 host target gene, herein designated VGAM HOST TARGET GENE, is a human gene contained in the human genome.

VGAM936 gene encodes a VGAM936 precursor RNA, herein designated VGAM PRECURSOR RNA. Similar to other miRNA genes, and unlike most ordinary genes, VGAM936 precursor RNA does not encode a protein. A nucleotide sequence identical or highly similar to the nucleotide sequence of VGAM936 precursor RNA is designated SEQ ID:922, and is provided hereinbelow with reference to the sequence listing part. Nucleotide sequence SEQ ID:922 is located at position 139973 relative to the genome of Melanoplus Sanguinipes Entomopoxvirus.

VGAM936 precursor RNA folds onto itself, forming VGAM936 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM936 folded precursor RNA into VGAM936 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM936 RNA is designated SEQ ID:3647, and is provided hereinbelow with reference to the sequence listing part.

VGAM936 host target gene, herein designated VGAM HOST TARGET GENE, encodes a corresponding messenger RNA, VGAM936 host target RNA, herein designated VGAM HOST TARGET RNA. VGAM936 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM936 RNA, herein designated VGAM RNA, binds complementarily to one or more host target binding sites located in untranslated regions of VGAM936 host target RNA, herein designated VGAM HOST TARGET RNA. This complementary binding is due to the fact that the nucleotide sequence of VGAM936 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM936 RNA, herein designated VGAM RNA, may have a different number of host target binding sites in untranslated regions of a VGAM936 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM936 RNA, herein designated VGAM RNA, to host target binding sites on VGAM936 host target RNA, herein designated VGAM HOST TARGET RNA, such as BINDING SITE I, BINDING SITE II and BINDING SITE III, inhibits translation of VGAM936 host target RNA into VGAM936 host target protein, herein designated VGAM HOST TARGET PROTEIN.

VGAM host target protein is therefore outlined by a broken line.

It is appreciated that VGAM936 host target gene, herein designated VGAM HOST TARGET GENE, in fact represents a plurality of VGAM936 host target genes. The mRNA of each one of this plurality of VGAM936 host target genes comprises one or more host target binding sites, each having a nucleotide sequence which is at least partly complementary to VGAM936 RNA, herein designated VGAM RNA, and which when bound by VGAM936 RNA causes inhibition of translation of respective one or more VGAM936 host target proteins.

It is further appreciated by one skilled in the art that the mode of translational inhibition illustrated by FIG. 1 with specific reference to translational inhibition exerted by VGAM936 gene, herein designated VGAM GENE, on one or more VGAM936 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM936 is inhibition of expression of host target genes, as part of a novel viral mechanism of attacking a host. Accordingly, utilities of VGAM936 include diagnosis, prevention and treatment of viral infection by Melanoplus Sanguinipes Entomopoxvirus. Specific functions, and accordingly utilities, of VGAM936 correlate with, and may be deduced from, the identity of the host target genes which VGAM936 binds and inhibits, and the function of these host target genes, as elaborated hereinbelow.

Nucleotide sequences of the VGAM936 precursor RNA, herein designated VGAM PRECURSOR RNA, and of the 'diced' VGAM936 RNA, herein designated VGAM RNA, and a schematic representation of the secondary folding of VGAM936 folded precursor RNA, herein designated VGAM FOLDED PRECURSOR RNA, of VGAM936 are further described hereinbelow with reference to Table 1.

Nucleotide sequences of host target binding sites, such as BINDING SITE-I, BINDING SITE-II and BINDING SITE-III of FIG. 1, found on VGAM936 host target RNA, and schematic representation of the complementarity of each of these host target binding sites to VGAM936 RNA, herein designated VGAM RNA, are described hereinbelow with reference to Table 2.

As mentioned hereinabove with reference to FIG. 1, a function of VGAM936 gene, herein designated VGAM is inhibition of expression of VGAM936 target genes. It is appreciated that specific functions, and accordingly utilities, of VGAM936 correlate with, and may be deduced from, the identity of the target genes which VGAM936 binds and inhibits, and the function of these target genes, as elaborated hereinbelow.

DKFZp547A023 (Accession XM_052065) is a VGAM936 host target gene. DKFZp547A023 BINDING SITE is HOST TARGET binding site found in the 3' untranslated region of mRNA encoded by DKFZp547A023, corresponding to a HOST TARGET binding site such as BINDING SITE I, BINDING SITE II or BINDING SITE III. Table 2 illustrates the complementarity of the nucleotide sequences of DKFZp547A023 BINDING SITE, designated SEQ ID:35943, to the nucleotide sequence of VGAM936 RNA, herein designated VGAM RNA, also designated SEQ ID:3647.

A function of VGAM936 is therefore inhibition of DKFZp547A023 (Accession XM_052065). Accordingly, utilities of VGAM936 include diagnosis, prevention and treatment of diseases and clinical conditions associated with DKFZp547A023. DKFZP564O123 (Accession XM_002810) is another VGAM936 host target gene. DKFZP564O123 BINDING SITE is HOST TARGET binding site found in the 3' untranslated region of mRNA encoded by DKFZP564O123, corresponding to a HOST TARGET binding site such as BINDING SITE I, BINDING SITE II or BINDING SITE III. Table 2 illustrates the complementarity of the nucleotide sequences of DKFZP564O123 BINDING SITE, designated SEQ ID:29906, to the nucleotide sequence of VGAM936 RNA, herein designated VGAM RNA, also designated SEQ ID:3647.

Another function of VGAM936 is therefore inhibition of DKFZP564O123 (Accession XM_002810). Accordingly, utilities of VGAM936 include diagnosis, prevention and treatment of diseases and clinical conditions associated with DKFZP564O123. Zinc Finger, DHHC Domain Containing 2 (ZDHHC2, Accession NM_016353) is another VGAM936 host target gene. ZDHHC2 BINDING SITE is HOST TARGET binding site found in the 3' untranslated region of mRNA encoded by ZDHHC2, corresponding to a HOST TARGET binding site such as BINDING SITE I, BINDING SITE II or BINDING SITE III. Table 2 illustrates the complementarity of the nucleotide sequences of ZDHHC2 BINDING SITE, designated SEQ ID:18490, to the nucleotide sequence of VGAM936 RNA, herein designated VGAM RNA, also designated SEQ ID:3647.

Another function of VGAM936 is therefore inhibition of Zinc Finger, DHHC Domain Containing 2 (ZDHHC2, Accession NM_016353). Accordingly, utilities of VGAM936 include diagnosis, prevention and treatment of diseases and clinical conditions associated with ZDHHC2. LOC129446 (Accession XM_072203) is another VGAM936 host target gene. LOC129446 BINDING SITE is HOST TARGET binding site found in the 3' untranslated region of mRNA encoded by LOC129446, corresponding to a HOST TARGET binding site such as BINDING SITE I, BINDING SITE II or BINDING SITE III. Table 2 illustrates the complementarity of the nucleotide sequences of LOC129446 BINDING SITE, designated SEQ ID:37468, to the nucleotide sequence of VGAM936 RNA, herein designated VGAM RNA, also designated SEQ ID:3647.

Another function of VGAM936 is therefore inhibition of LOC129446 (Accession XM_072203). Accordingly, utilities of VGAM936 include diagnosis, prevention and treatment of diseases and clinical conditions associated with LOC129446. LOC149722 (Accession XM_097709) is another VGAM936 host target gene. LOC149722 BINDING SITE is HOST TARGET binding site found in the 5' untranslated region of mRNA encoded by LOC149722, corresponding to a HOST TARGET binding site such as BINDING SITE I, BINDING SITE II or BINDING SITE III. Table 2 illustrates the complementarity of the nucleotide sequences of LOC149722 BINDING SITE, designated SEQ ID:41044, to the nucleotide sequence of VGAM936 RNA, herein designated VGAM RNA, also designated SEQ ID:3647.

Another function of VGAM936 is therefore inhibition of LOC149722 (Accession XM_097709). Accordingly, utilities of VGAM936 include diagnosis, prevention and treatment of diseases and clinical conditions associated with LOC149722.

LOC151414 (Accession XM_087197) is another VGAM936 host target gene. LOC151414 BINDING SITE is HOST TARGET binding site found in the 3' untranslated region of mRNA encoded by LOC151414, corresponding to a HOST TARGET binding site such as BINDING SITE I, BINDING SITE II or BINDING SITE III. Table 2 illustrates the complementarity of the nucleotide sequences of LOC151414 BINDING SITE, designated SEQ ID:39113, to the nucleotide sequence of VGAM936 RNA, herein designated VGAM RNA, also designated SEQ ID:3647.

Another function of VGAM936 is therefore inhibition of LOC151414 (Accession XM_087197). Accordingly, utilities of VGAM936 include diagnosis, prevention and treatment of diseases and clinical conditions associated with LOC151414. FIG. 1 further provides a conceptual description of a novel bioinformatically detected viral gene of the present invention, referred to here as Viral Genomic Address Messenger 937 (VGAM937) viral gene, which modulates expression of respective host target genes thereof, the function and utility of which host target genes is known in the art.

VGAM937 is a novel bioinformatically detected regulatory, non protein coding, viral micro RNA (miRNA) gene. The method by which VGAM937 was detected is described hereinabove with reference to FIGS. 1-8.

VGAM937 gene, herein designated VGAM GENE, is a viral gene contained in the genome of Melanoplus Sanguinipes Entomopoxvirus. VGAM937 host target gene, herein designated VGAM HOST TARGET GENE, is a human gene contained in the human genome.

VGAM937 gene encodes a VGAM937 precursor RNA, herein designated VGAM PRECURSOR RNA. Similar to other miRNA genes, and unlike most ordinary genes, VGAM937 precursor RNA does not encode a protein. A nucleotide sequence identical or highly similar to the nucleotide sequence of VGAM937 precursor RNA is designated SEQ ID:923, and is provided hereinbelow with reference to the sequence listing part. Nucleotide sequence SEQ ID:923 is located at position 139184 relative to the genome of Melanoplus Sanguinipes Entomopoxvirus.

VGAM937 precursor RNA folds onto itself, forming VGAM937 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM937 folded precursor RNA into VGAM937 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM937 RNA is designated SEQ ID:3648, and is provided hereinbelow with reference to the sequence listing part.

VGAM937 host target gene, herein designated VGAM HOST TARGET GENE, encodes a corresponding messenger RNA, VGAM937 host target RNA, herein designated VGAM HOST TARGET RNA. VGAM937 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM937 RNA, herein designated VGAM RNA, binds complementarily to one or more host target binding sites located in untranslated regions of VGAM937 host target RNA, herein designated VGAM HOST TARGET RNA. This complementary binding is due to the fact that the nucleotide sequence of VGAM937 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM937 RNA, herein designated VGAM RNA, may have a different number of host target binding sites in untranslated regions of a VGAM937 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM937 RNA, herein designated VGAM RNA, to host target binding sites on VGAM937 host target RNA, herein designated VGAM HOST TARGET RNA, such as BINDING SITE I, BINDING SITE II and BINDING SITE III, inhibits translation of VGAM937 host target RNA into VGAM937 host target protein, herein designated VGAM HOST TARGET PROTEIN. VGAM host target protein is therefore outlined by a broken line.

It is appreciated that VGAM937 host target gene, herein designated VGAM HOST TARGET GENE, in fact represents a plurality of VGAM937 host target genes. The mRNA of each one of this plurality of VGAM937 host target genes comprises one or more host target binding sites, each having a nucleotide sequence which is at least partly complementary to VGAM937 RNA, herein designated VGAM RNA, and which when bound by VGAM937 RNA causes inhibition of translation of respective one or more VGAM937 host target proteins.

It is further appreciated by one skilled in the art that the mode of translational inhibition illustrated by FIG. 1 with specific reference to translational inhibition exerted by VGAM937 gene, herein designated VGAM GENE, on one or more VGAM937 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM937 is inhibition of expression of host target genes, as part of a novel viral mechanism of attacking a host. Accordingly, utilities of VGAM937 include diagnosis, prevention and treatment of viral infection by Melanoplus Sanguinipes Entomopoxvirus. Specific functions, and accordingly utilities, of VGAM937 correlate with, and may be deduced from, the identity of the host target genes which VGAM937 binds and inhibits, and the function of these host target genes, as elaborated hereinbelow.

Nucleotide sequences of the VGAM937 precursor RNA, herein designated VGAM PRECURSOR RNA, and of the 'diced' VGAM937 RNA, herein designated VGAM RNA, and a schematic representation of the secondary folding of VGAM937 folded precursor RNA, herein designated VGAM FOLDED PRECURSOR RNA, of VGAM937 are further described hereinbelow with reference to Table 1.

Nucleotide sequences of host target binding sites, such as BINDING SITE-I, BINDING SITE-II and BINDING SITE-III of FIG. 1, found on VGAM937 host target RNA, and schematic representation of the complementarity of each of these host target binding sites to VGAM937 RNA, herein designated VGAM RNA, are described hereinbelow with reference to Table 2.

As mentioned hereinabove with reference to FIG. 1, a function of VGAM937 gene, herein designated VGAM is inhibition of expression of VGAM937 target genes. It is appreciated that specific functions, and accordingly utilities, of VGAM937 correlate with, and may be deduced from, the identity of the target genes which VGAM937 binds and inhibits, and the function of these target genes, as elaborated hereinbelow.

Butyrophilin, Subfamily 3, Member A3 (BTN3A3, Accession NM_006994) is a VGAM937 host target gene. BTN3A3 BINDING SITE is HOST TARGET binding site found in the 3' untranslated region of mRNA encoded by BTN3A3, corresponding to a HOST TARGET binding site such as BINDING SITE I, BINDING SITE II or BINDING SITE III. Table 2 illustrates the complementarity of the nucleotide sequences of BTN3A3 BINDING SITE, designated SEQ ID:13856, to the nucleotide sequence of VGAM937 RNA, herein designated VGAM RNA, also designated SEQ ID:3648.

A function of VGAM937 is therefore inhibition of Butyrophilin, Subfamily 3, Member A3 (BTN3A3, Accession NM_006994). Accordingly, utilities of VGAM937 include diagnosis, prevention and treatment of diseases and clinical conditions associated with BTN3A3. FENS-1 (Accession NM_020830) is another VGAM937 host target gene. FENS-1 BINDING SITE is HOST TARGET binding site found in the 3' untranslated region of mRNA encoded by FENS-1, corresponding to a HOST TARGET binding site such as BINDING SITE I, BINDING SITE II or BINDING SITE III. Table 2 illustrates the complementarity of the nucleotide sequences of FENS-1 BINDING SITE, designated SEQ ID:21893, to the nucleotide sequence of VGAM937 RNA, herein designated VGAM RNA, also designated SEQ ID:3648.

Another function of VGAM937 is therefore inhibition of FENS-1 (Accession NM_020830). Accordingly, utilities of VGAM937 include diagnosis, prevention and treatment of diseases and clinical conditions associated with FENS-1. KIAA1164 (Accession XM_045358) is another VGAM937 host target gene. KIAA1164 BINDING SITE is HOST TARGET binding site found in the 3' untranslated region of mRNA encoded by KIAA1164, corresponding to a HOST TARGET binding site such as BINDING SITE I, BINDING SITE II or BINDING SITE III. Table 2 illustrates the complementarity of the nucleotide sequences of KIAA1164 BINDING SITE, designated SEQ ID:34440, to the nucleotide sequence of VGAM937 RNA, herein designated VGAM RNA, also designated SEQ ID:3648.

Another function of VGAM937 is therefore inhibition of KIAA1164 (Accession XM_045358). Accordingly, utilities of VGAM937 include diagnosis, prevention and treatment of diseases and clinical conditions associated with KIAA1164. FIG. 1 further provides a conceptual description of a novel bioinformatically detected viral gene of the present invention, referred to here as Viral Genomic Address Messenger 938 (VGAM938) viral gene, which modulates expression of respective host target genes thereof, the function and utility of which host target genes is known in the art.

VGAM938 is a novel bioinformatically detected regulatory, non protein coding, viral micro RNA (miRNA) gene. The method by which VGAM938 was detected is described hereinabove with reference to FIGS. 1-8.

VGAM938 gene, herein designated VGAM GENE, is a viral gene contained in the genome of Beet Soil-borne Mosaic Virus. VGAM938 host target gene, herein designated VGAM HOST TARGET GENE, is a human gene contained in the human genome.

VGAM938 gene encodes a VGAM938 precursor RNA, herein designated VGAM PRECURSOR RNA. Similar to other miRNA genes, and unlike most ordinary genes, VGAM938 precursor RNA does not encode a protein. A nucleotide sequence identical or highly similar to the nucleotide sequence of VGAM938 precursor RNA is designated SEQ ID:924, and is provided hereinbelow with reference to the sequence listing part. Nucleotide sequence SEQ ID:924 is located at position 709 relative to the genome of Beet Soil-borne Mosaic Virus.

VGAM938 precursor RNA folds onto itself, forming VGAM938 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM938 folded precursor RNA into VGAM938 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM938 RNA is designated SEQ ID:3649, and is provided hereinbelow with reference to the sequence listing part.

VGAM938 host target gene, herein designated VGAM HOST TARGET GENE, encodes a corresponding messenger RNA, VGAM938 host target RNA, herein designated VGAM HOST TARGET RNA. VGAM938 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM938 RNA, herein designated VGAM RNA, binds complementarily to one or more host target binding sites located in untranslated regions of VGAM938 host target RNA, herein designated VGAM HOST TARGET RNA. This complementary binding is due to the fact that the nucleotide sequence of VGAM938 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM938 RNA, herein designated VGAM RNA, may have a different number of host target binding sites in untranslated regions of a VGAM938 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM938 RNA, herein designated VGAM RNA, to host target binding sites on VGAM938 host target RNA, herein designated VGAM HOST TARGET RNA, such as BINDING SITE I, BINDING SITE II and BINDING SITE III, inhibits translation of VGAM938 host target RNA into VGAM938 host target protein, herein designated VGAM HOST TARGET PROTEIN. VGAM host target protein is therefore outlined by a broken line.

It is appreciated that VGAM938 host target gene, herein designated VGAM HOST TARGET GENE, in fact represents a plurality of VGAM938 host target genes. The mRNA of each one of this plurality of VGAM938 host target genes comprises one or more host target binding sites, each having a nucleotide sequence which is at least partly complementary to VGAM938 RNA, herein designated VGAM RNA, and which when bound by VGAM938 RNA causes inhibition of translation of respective one or more VGAM938 host target proteins.

It is further appreciated by one skilled in the art that the mode of translational inhibition illustrated by FIG. 1 with specific reference to translational inhibition exerted by VGAM938 gene, herein designated VGAM GENE, on one or more VGAM938 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM938 is inhibition of expression of host target genes, as part of a novel viral mechanism of attacking a host. Accordingly, utilities of VGAM938 include diagnosis, prevention and treatment of viral infection by Beet Soil-borne Mosaic Virus. Specific functions, and accordingly utilities, of VGAM938 correlate with, and may be deduced from, the identity of the host target genes which VGAM938 binds and inhibits, and the function of these host target genes, as elaborated hereinbelow.

Nucleotide sequences of the VGAM938 precursor RNA, herein designated VGAM PRECURSOR RNA, and of the 'diced' VGAM938 RNA, herein designated VGAM RNA, and a schematic representation of the secondary folding of VGAM938 folded precursor RNA, herein designated VGAM FOLDED PRECURSOR RNA, of VGAM938 are further described hereinbelow with reference to Table 1.

Nucleotide sequences of host target binding sites, such as BINDING SITE-I, BINDING SITE-II and BINDING SITE-III of FIG. 1, found on VGAM938 host target RNA, and schematic representation of the complementarity of each of these host target binding sites to VGAM938 RNA, herein designated VGAM RNA, are described hereinbelow with reference to Table 2.

As mentioned hereinabove with reference to FIG. 1, a function of VGAM938 gene, herein designated VGAM is inhibition of expression of VGAM938 target genes. It is appreciated that specific functions, and accordingly utilities, of VGAM938 correlate with, and may be deduced from, the identity of the target genes which VGAM938 binds and inhibits, and the function of these target genes, as elaborated hereinbelow.

Protein Kinase, CAMP-dependent, Regulatory, Type II, Beta (PRKAR2B, Accession NM_002736) is a VGAM938 host target gene. PRKAR2B BINDING SITE is HOST TARGET binding site found in the 3' untranslated region of mRNA encoded by PRKAR2B, corresponding to a HOST TARGET binding site such as BINDING SITE I, BINDING SITE II or BINDING SITE III. Table 2 illustrates the complementarity of the nucleotide sequences of PRKAR2B BINDING SITE, designated SEQ ID:8612, to the nucleotide sequence of VGAM938 RNA, herein designated VGAM RNA, also designated SEQ ID:3649.

A function of VGAM938 is therefore inhibition of Protein Kinase, CAMP-dependent, Regulatory, Type II, Beta (PRKAR2B, Accession NM_002736), a gene which type ii regulatory chains mediate membrane association by binding to anchoring proteins, including the map2 kinase. Accordingly, utilities of VGAM938 include diagnosis, prevention and treatment of diseases and clinical conditions associated with PRKAR2B. The function of PRKAR2B and its association with various diseases and clinical conditions, has been established by previous studies, as described hereinabove with reference to VGAM120. LOC154789 (Accession XM_088043) is another VGAM938 host target gene. LOC154789 BINDING SITE is HOST TARGET binding site found in the 3' untranslated region of mRNA encoded by LOC154789, corresponding to a HOST TARGET binding site such as BINDING SITE I, BINDING SITE II or BINDING SITE III. Table 2 illustrates the complementarity of the nucleotide sequences of LOC154789 BINDING SITE, designated SEQ ID:39486, to the nucleotide sequence of VGAM938 RNA, herein designated VGAM RNA, also designated SEQ ID:3649.

Another function of VGAM938 is therefore inhibition of LOC154789 (Accession XM_088043). Accordingly, utilities of VGAM938 include diagnosis, prevention and treatment of diseases and clinical conditions associated with LOC154789. FIG. 1 further provides a conceptual description of a novel bioinformatically detected viral gene of the present invention, referred to here as Viral Genomic Address Messenger 939 (VGAM939) viral gene, which modulates expression of respective host target genes thereof, the function and utility of which host target genes is known in the art.

VGAM939 is a novel bioinformatically detected regulatory, non protein coding, viral micro RNA (miRNA) gene. The method by which VGAM939 was detected is described hereinabove with reference to FIGS. 1-8.

VGAM939 gene, herein designated VGAM GENE, is a viral gene contained in the genome of Beet Soil-borne Mosaic Virus. VGAM939 host target gene, herein designated VGAM HOST TARGET GENE, is a human gene contained in the human genome.

VGAM939 gene encodes a VGAM939 precursor RNA, herein designated VGAM PRECURSOR RNA. Similar to other miRNA genes, and unlike most ordinary genes, VGAM939 precursor RNA does not encode a protein. A nucleotide sequence identical or highly similar to the nucleotide sequence of VGAM939 precursor RNA is designated SEQ ID:925, and is provided hereinbelow with reference to the sequence listing part. Nucleotide sequence SEQ ID:925 is located at position 1784 relative to the genome of Beet Soil-borne Mosaic Virus.

VGAM939 precursor RNA folds onto itself, forming VGAM939 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM939 folded precursor RNA into VGAM939 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM939 RNA is designated SEQ ID:3650, and is provided hereinbelow with reference to the sequence listing part.

VGAM939 host target gene, herein designated VGAM HOST TARGET GENE, encodes a corresponding messenger RNA, VGAM939 host target RNA, herein designated VGAM HOST TARGET RNA. VGAM939 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM939 RNA, herein designated VGAM RNA, binds complementarily to one or more host target binding sites located in untranslated regions of VGAM939 host target RNA, herein designated VGAM HOST TARGET RNA. This complementary binding is due to the fact that the nucleotide sequence of VGAM939 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM939 RNA, herein designated VGAM RNA, may have a different number of host target binding sites in untranslated regions of a VGAM939 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM939 RNA, herein designated VGAM RNA, to host target binding sites on VGAM939 host target RNA, herein designated VGAM HOST TARGET RNA, such as BINDING SITE I, BINDING SITE II and BINDING SITE III, inhibits translation of VGAM939 host target RNA into VGAM939 host target protein, herein designated VGAM HOST TARGET PROTEIN. VGAM host target protein is therefore outlined by a broken line.

It is appreciated that VGAM939 host target gene, herein designated VGAM HOST TARGET GENE, in fact represents a plurality of VGAM939 host target genes. The mRNA of each one of this plurality of VGAM939 host target genes comprises one or more host target binding sites, each having a nucleotide sequence which is at least partly complementary to VGAM939 RNA, herein designated VGAM RNA, and which when bound by VGAM939 RNA causes inhibition of translation of respective one or more VGAM939 host target proteins.

It is further appreciated by one skilled in the art that the mode of translational inhibition illustrated by FIG. 1 with specific reference to translational inhibition exerted by VGAM939 gene, herein designated VGAM GENE, on one or more VGAM939 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM939 is inhibition of expression of host target genes, as part of a novel viral mechanism of attacking a host. Accordingly, utilities of VGAM939 include diagnosis, prevention and treatment of viral infection by Beet Soil-borne Mosaic Virus. Specific functions, and accordingly utilities, of VGAM939 correlate with, and may be deduced from, the identity of the host target genes which VGAM939 binds and inhibits, and the function of these host target genes, as elaborated hereinbelow.

Nucleotide sequences of the VGAM939 precursor RNA, herein designated VGAM PRECURSOR RNA, and of the 'diced' VGAM939 RNA, herein designated VGAM RNA, and a schematic representation of the secondary folding of VGAM939 folded precursor RNA, herein designated VGAM FOLDED PRECURSOR RNA, of VGAM939 are further described hereinbelow with reference to Table 1.

Nucleotide sequences of host target binding sites, such as BINDING SITE-I, BINDING SITE-II and BINDING SITE-III of FIG. 1, found on VGAM939 host target RNA, and schematic representation of the complementarity of each of these host target binding sites to VGAM939 RNA, herein designated VGAM RNA, are described hereinbelow with reference to Table 2.

As mentioned hereinabove with reference to FIG. 1, a function of VGAM939 gene, herein designated VGAM is inhibition of expression of VGAM939 target genes. It is appreciated that specific functions, and accordingly utilities, of VGAM939 correlate with, and may be deduced from, the identity of the target genes which VGAM939 binds and inhibits, and the function of these target genes, as elaborated hereinbelow.

A Disintegrin and Metalloproteinase Domain 28 (ADAM28, Accession NM_014265) is a VGAM939 host target gene. ADAM28 BINDING SITE is HOST TARGET binding site found in the 3' untranslated region of mRNA encoded by ADAM28, corresponding to a HOST TARGET binding site such as BINDING SITE I, BINDING SITE II or BINDING SITE III. Table 2 illustrates the complementarity of the nucleotide sequences of ADAM28 BINDING SITE, designated SEQ ID:15540, to the nucleotide sequence of VGAM939 RNA, herein designated VGAM RNA, also designated SEQ ID:3650.

A function of VGAM939 is therefore inhibition of A Disintegrin and Metalloproteinase Domain 28 (ADAM28, Accession NM_014265), a gene which Member of the MDC family of metalloproteinases. Accordingly, utilities of VGAM939 include diagnosis, prevention and treatment of diseases and clinical conditions associated with ADAM28. The function of ADAM28 and its association with various diseases and clinical conditions, has been established by previous studies, as described hereinabove with reference to VGAM608. Inducible T-cell Co-stimulator (ICOS, Accession NM_012092) is another VGAM939 host target gene. ICOS BINDING SITE is HOST TARGET binding site found in the 3' untranslated region of mRNA encoded by ICOS, corresponding to a HOST TARGET binding site such as BINDING SITE I, BINDING SITE II or BINDING SITE III. Table 2 illustrates the complementarity of the nucleotide sequences of ICOS BINDING SITE, designated SEQ ID:14390, to the nucleotide sequence of VGAM939 RNA, herein designated VGAM RNA, also designated SEQ ID:3650.

Another function of VGAM939 is therefore inhibition of Inducible T-cell Co-stimulator (ICOS, Accession NM_012092), a gene which forms homodimers and functions as an inducible T-cell co-stimulator. Accordingly, utilities of VGAM939 include diagnosis, prevention and treatment of diseases and clinical conditions associated with ICOS. The function of ICOS and its association with various diseases and clinical conditions, has been established by previous studies, as described hereinabove with reference to VGAM18. Tumor Necrosis Factor Receptor Superfamily, Member 1B (TNFRSF1B, Accession NM_001066) is another VGAM939 host target gene. TNFRSF1B BINDING SITE is HOST TARGET binding site found in the 3' untranslated region of mRNA encoded by TNFRSF1B, corresponding to a HOST TARGET binding site such as BINDING SITE I, BINDING SITE II or BINDING SITE III. Table 2 illustrates the complementarity of the nucleotide sequences of TNFRSF1B BINDING SITE, designated SEQ ID:6734, to the nucleotide sequence of VGAM939 RNA, herein designated VGAM RNA, also designated SEQ ID:3650.

Another function of VGAM939 is therefore inhibition of Tumor Necrosis Factor Receptor Superfamily, Member 1B (TNFRSF1B, Accession NM_001066), a gene which mediates proinflammatory cellular responses. Accordingly, utilities of VGAM939 include diagnosis, prevention and treatment of diseases and clinical conditions associated with TNFRSF1B. The function of TNFRSF1B has been established by previous studies. Preassembly or self-association of cytokine receptor dimers (e.g., OMIM Ref. No. 147810; IL2R, 147730; and EPOR, 133171) occurs via the same amino acid contacts that are critical for ligand binding. Chan et al. (2000) found that, in contrast, the p60 (TNFRSF1A; 191190) and p80 (TNFRSF1B) TNFA receptors self-assemble through a distinct functional domain in the TNFR extracellular domain, termed the pre-ligand assembly domain (PLAD), in the absence of ligand. Deletion of the PLAD results in monomeric presentation of p60 or p80. Flow cytometric analysis showed that efficient TNFA binding depends on receptor self-assembly. They also found that other members of the TNF receptor superfamily, including the extracellular domains of TRAIL (TNFRSF10A; 603611), CD40 (TNFRSF5; 109535), and FAS (TNFRSF6; 134637), all self-associate but do not interact with heterologous receptors. Using Jurkat T cells, which express TNFR1 but little TNFR2, and Jurkat cells stably transfected with TNFR2, Li et al. (2002) confirmed that TNF stimulation, or stimulation with a TNFR2, but not TNFR1, agonist, causes a loss of TRAF2 (OMIM Ref. No. 601895) in the TNFR2-expressing cells, but not the parental cell line, through a ubiquitination- and proteasome-dependent process. Binding analysis indicated that TRAF2 interacts with CIAP1 (OMIM Ref. No. 601712) and CIAP2 (OMIM Ref. No. 601721), which possess E3 ubiquitin ligase (e.g. UBE3A, 601623) activity. Ubiquitination assays and SDS-PAGE analysis showed that in the presence of an E2-conjugating enzyme (e.g., UBCH7, 603721), CIAP1, but not CIAP2, induces TRAF2 ubiquitination outside of its RING domain. Both CIAPs bind but neither ubiquitinates TRAF1 (OMIM Ref. No. 601711). CIAP1 expression fails to protect TNFR2-expressing cells from TNF-induced apoptosis, whereas an E3-inactive CIAP1 mutant and wildtype CIAP2 do protect cells from TRAF2 down regulation and cause a delay in cell death. Li et al. (2002) concluded that TNFR2 stimulation causes the ubiquitination of TRAF2 by CIAP1, which can play a proapoptotic role in TNF signaling. Animal model experiments lend further support to the function of TNFRSF1B. Bruce et al. (1996) used targeted gene disruption to generate mice lacking either the p55 (TNFR1) or the p75 (TNFR2) TNF receptor; mice lacking both p55 and p75 were generated from crosses of the singly deficient mice. The TNFR-deficient (TNFR-KO) mice exhibited no overt phenotype under unchallenged conditions. Bruce et al. (1996) reported that damage to neurons caused by focal cerebral ischemia and epileptic seizures was exacerbated in the TNFR-KO mice, indicating that TNF serves a neuroprotective function. Their studies indicated that TNF protects neurons by stimulating antioxidative pathways. Injury-induced microglial activation was suppressed in TNFR-KO mice. They concluded that drugs which target TNF signaling pathways may prove beneficial in treating stroke or traumatic brain injury.

It is appreciated that the abovementioned animal model for TNFRSF1B is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chan, F. K.-M.; Chun, H. J.; Zheng, L.; Siegel, R. M.; Bui, K. L.; Lenardo, M. J.: A domain in TNF receptors that mediates ligand-independent receptor assembly and signaling. Science 288:2351-2354, 2000; and Li, X.; Yang, Y.; Ashwell, J. D.: TNF-RII and c-IAP1 mediate ubiquitination and degradation of TRAF2. Nature 416: 345-349, 2002.

Further studies establishing the function and utilities of TNFRSF1B are found in John Hopkins OMIM database record ID 191191, and in sited publications numbered 2048, 9573, 11502-1182, 1176, 1183, 1054 and 10543 listed in the bibliography section hereinbelow, which are also hereby incorporated by reference. Alpha 1,4-galactosyltransferase (A4GALT, Accession NM_017436) is another VGAM939 host target gene. A4GALT BINDING SITE is HOST TARGET binding site found in the 3' untranslated region of mRNA encoded by A4GALT, corresponding to a HOST TARGET binding site such as BINDING SITE I, BINDING SITE II or BINDING SITE III. Table 2 illustrates the complementarity of the nucleotide sequences of A4GALT BINDING SITE, designated SEQ ID:18894, to the nucleotide sequence of VGAM939 RNA, herein designated VGAM RNA, also designated SEQ ID:3650.

Another function of VGAM939 is therefore inhibition of Alpha 1,4-galactosyltransferase (A4GALT, Accession NM_017436). Accordingly, utilities of VGAM939 include diagnosis, prevention and treatment of diseases and clinical conditions associated with A4GALT. Apg4B (Accession NM_013325) is another VGAM939 host target gene. Apg4B BINDING SITE is HOST TARGET binding site found in the 3' untranslated region of mRNA encoded by Apg4B, corresponding to a HOST TARGET binding site such as BINDING SITE I, BINDING SITE II or BINDING SITE III. Table 2 illustrates the complementarity of the nucleotide sequences of Apg4B BINDING SITE, designated SEQ ID:14974, to the nucleotide sequence of VGAM939 RNA, herein designated VGAM RNA, also designated SEQ ID:3650.

Another function of VGAM939 is therefore inhibition of Apg4B (Accession NM_013325). Accordingly, utilities of VGAM939 include diagnosis, prevention and treatment of diseases and clinical conditions associated with Apg4B. FLJ22405 (Accession NM_022485) is another VGAM939 host target gene. FLJ22405 BINDING SITE is HOST TARGET binding site found in the 5' untranslated region of mRNA encoded by FLJ22405, corresponding to a HOST TARGET binding site such as BINDING SITE I, BINDING SITE II or BINDING SITE III. Table 2 illustrates the complementarity of the nucleotide sequences of FLJ22405 BINDING SITE, designated SEQ ID:22863, to the nucleotide sequence of VGAM939 RNA, herein designated VGAM RNA, also designated SEQ ID:3650.

Another function of VGAM939 is therefore inhibition of FLJ22405 (Accession NM_022485). Accordingly, utilities of VGAM939 include diagnosis, prevention and treatment of diseases and clinical conditions associated with FLJ22405. HGC6.2 (Accession NM_014356) is another VGAM939 host target gene. HGC6.2 BINDING SITE is HOST TARGET binding site found in the 3' untranslated region of mRNA encoded by HGC6.2, corresponding to a HOST TARGET binding site such as BINDING SITE I, BINDING SITE II or BINDING SITE III. Table 2 illustrates the complementarity of the nucleotide sequences of HGC6.2 BINDING SITE, designated SEQ ID:15687, to the nucleotide sequence of VGAM939 RNA, herein designated VGAM RNA, also designated SEQ ID:3650.

Another function of VGAM939 is therefore inhibition of HGC6.2 (Accession NM_014356). Accordingly, utilities of VGAM939 include diagnosis, prevention and treatment of diseases and clinical conditions associated with HGC6.2. HRD1 (Accession XM_045498) is another VGAM939 host target gene. HRD1 BINDING SITE is HOST TARGET binding site found in the 3' untranslated region of mRNA encoded by HRD1, corresponding to a HOST TARGET binding site such as BINDING SITE I, BINDING SITE II or BINDING SITE III. Table 2 illustrates the complementarity of the nucleotide sequences of HRD1 BINDING SITE, designated SEQ ID:34472, to the nucleotide sequence of VGAM939 RNA, herein designated VGAM RNA, also designated SEQ ID:3650.

Another function of VGAM939 is therefore inhibition of HRD1 (Accession XM_045498). Accordingly, utilities of VGAM939 include diagnosis, prevention and treatment of diseases and clinical conditions associated with HRD1. OS4 (Accession NM_005730) is another VGAM939 host target gene. OS4 BINDING SITE is HOST TARGET binding site found in the 3' untranslated region of mRNA encoded by OS4, corresponding to a HOST TARGET binding site such as BINDING SITE I, BINDING SITE II or BINDING SITE III. Table 2 illustrates the complementarity of the nucleotide sequences of OS4 BINDING SITE, designated SEQ ID:12289, to the nucleotide sequence of VGAM939 RNA, herein designated VGAM RNA, also designated SEQ ID:3650.

Another function of VGAM939 is therefore inhibition of OS4 (Accession NM_005730). Accordingly, utilities of VGAM939 include diagnosis, prevention and treatment of diseases and clinical conditions associated with OS4. LOC115557 (Accession NM_133483) is another VGAM939 host target gene. LOC115557 BINDING SITE is HOST TARGET binding site found in the 5' untranslated region of mRNA encoded by LOC115557, corresponding to a HOST TARGET binding site such as BINDING SITE I, BINDING SITE II or BINDING SITE III. Table 2 illustrates the complementarity of the nucleotide sequences of LOC115557 BINDING SITE, designated SEQ ID:28556, to the nucleotide sequence of VGAM939 RNA, herein designated VGAM RNA, also designated SEQ ID:3650.

Another function of VGAM939 is therefore inhibition of LOC115557 (Accession NM_133483). Accordingly, utilities of VGAM939 include diagnosis, prevention and treatment of diseases and clinical conditions associated with LOC115557. LOC124976 (Accession XM_058879) is another VGAM939 host target gene. LOC124976 BINDING SITE is HOST TARGET binding site found in the 3' untranslated region of mRNA encoded by LOC124976, corresponding to a HOST TARGET binding site such as BINDING SITE I, BINDING SITE II or BINDING SITE III. Table 2 illustrates the complementarity of the nucleotide sequences of LOC124976 BINDING SITE, designated SEQ ID:36781, to the nucleotide sequence of VGAM939 RNA, herein designated VGAM RNA, also designated SEQ ID:3650.

Another function of VGAM939 is therefore inhibition of LOC124976 (Accession XM_058879). Accordingly, utilities of VGAM939 include diagnosis, prevention and treatment of diseases and clinical conditions associated with LOC124976. LOC148343 (Accession XM_086150) is another VGAM939 host target gene. LOC148343 BINDING SITE is HOST TARGET binding site found in the 5' untranslated region of mRNA encoded by LOC148343, corresponding to a HOST TARGET binding site such as BINDING SITE I, BINDING SITE II or BINDING SITE III. Table 2 illustrates the complementarity of the nucleotide sequences of LOC148343 BINDING SITE, designated SEQ ID:38521, to the nucleotide sequence of VGAM939 RNA, herein designated VGAM RNA, also designated SEQ ID:3650.

Another function of VGAM939 is therefore inhibition of LOC148343 (Accession XM_086150). Accordingly, utilities of VGAM939 include diagnosis, prevention and treatment of diseases and clinical conditions associated with LOC148343. LOC150175 (Accession XM_086806) is another VGAM939 host target gene. LOC150175 BINDING SITE is HOST TARGET binding site found in the 5' untranslated region of mRNA encoded by LOC150175, corresponding to a HOST TARGET binding site such as BINDING SITE I, BINDING SITE II or BINDING SITE III. Table 2 illustrates the complementarity of the nucleotide sequences of LOC150175 BINDING SITE, designated SEQ ID:38883, to the nucleotide sequence of VGAM939 RNA, herein designated VGAM RNA, also designated SEQ ID:3650.

Another function of VGAM939 is therefore inhibition of LOC150175 (Accession XM_086806). Accordingly, utilities of VGAM939 include diagnosis, prevention and treatment of diseases and clinical conditions associated with LOC150175. LOC150215 (Accession XM_086813) is another VGAM939 host target gene. LOC150215 BINDING SITE is HOST TARGET binding site found in the 5' untranslated region of mRNA encoded by LOC150215, corresponding to a HOST TARGET binding site such as BINDING SITE I, BINDING SITE II or BINDING SITE III. Table 2 illustrates the complementarity of the nucleotide sequences of LOC150215 BINDING SITE, designated SEQ ID:38887, to the nucleotide sequence of VGAM939 RNA, herein designated VGAM RNA, also designated SEQ ID:3650.

Another function of VGAM939 is therefore inhibition of LOC150215 (Accession XM_086813). Accordingly, utilities of VGAM939 include diagnosis, prevention and treatment of diseases and clinical conditions associated with LOC150215. LOC150218 (Accession XM_086850) is another VGAM939 host target gene. LOC150218 BINDING SITE is HOST TARGET binding site found in the 5' untranslated region of mRNA encoded by LOC150218, corresponding to a HOST TARGET binding site such as BINDING SITE I, BINDING SITE II or BINDING SITE III. Table 2 illustrates the complementarity of the nucleotide sequences of LOC150218 BIND- ING SITE, designated SEQ ID:38914, to the nucleotide sequence of VGAM939 RNA, herein designated VGAM RNA, also designated SEQ ID:3650.

Another function of VGAM939 is therefore inhibition of LOC150218 (Accession XM_086850). Accordingly, utilities of VGAM939 include diagnosis, prevention and treatment of diseases and clinical conditions associated with LOC150218. LOC152002 (Accession XM_087360) is another VGAM939 host target gene. LOC152002 BINDING SITE is HOST TARGET binding site found in the 3' untranslated region of mRNA encoded by LOC152002, corresponding to a HOST TARGET binding site such as BINDING SITE I, BINDING SITE II or BINDING SITE III. Table 2 illustrates the complementarity of the nucleotide sequences of LOC152002 BINDING SITE, designated SEQ ID:39195, to the nucleotide sequence of VGAM939 RNA, herein designated VGAM RNA, also designated SEQ ID:3650.

Another function of VGAM939 is therefore inhibition of LOC152002 (Accession XM_087360). Accordingly, utilities of VGAM939 include diagnosis, prevention and treatment of diseases and clinical conditions associated with LOC152002. LOC152765 (Accession XM_087519) is another VGAM939 host target gene. LOC152765 BINDING SITE is HOST TARGET binding site found in the 3' untranslated region of mRNA encoded by LOC152765, corresponding to a HOST TARGET binding site such as BINDING SITE I, BINDING SITE II or BINDING SITE III. Table 2 illustrates the complementarity of the nucleotide sequences of LOC152765 BINDING SITE, designated SEQ ID:39312, to the nucleotide sequence of VGAM939 RNA, herein designated VGAM RNA, also designated SEQ ID:3650.

Another function of VGAM939 is therefore inhibition of LOC152765 (Accession XM_087519). Accordingly, utilities of VGAM939 include diagnosis, prevention and treatment of diseases and clinical conditions associated with LOC152765. LOC166979 (Accession XM_094210) is another VGAM939 host target gene. LOC166979 BINDING SITE is HOST TARGET binding site found in the 5' untranslated region of mRNA encoded by LOC166979, corresponding to a HOST TARGET binding site such as BINDING SITE I, BINDING SITE II or BINDING SITE III. Table 2 illustrates the complementarity of the nucleotide sequences of LOC166979 BINDING SITE, designated SEQ ID:40225, to the nucleotide sequence of VGAM939 RNA, herein designated VGAM RNA, also designated SEQ ID:3650.

Another function of VGAM939 is therefore inhibition of LOC166979 (Accession XM_094210). Accordingly, utilities of VGAM939 include diagnosis, prevention and treatment of diseases and clinical conditions associated with LOC166979. LOC196746 (Accession XM_113595) is another VGAM939 host target gene. LOC196746 BINDING SITE is HOST TARGET binding site found in the 3' untranslated region of mRNA encoded by LOC196746, corresponding to a HOST TARGET binding site such as BINDING SITE I, BINDING SITE II or BINDING SITE III. Table 2 illustrates the complementarity of the nucleotide sequences of LOC196746 BINDING SITE, designated SEQ ID:42289, to the nucleotide sequence of VGAM939 RNA, herein designated VGAM RNA, also designated SEQ ID:3650.

Another function of VGAM939 is therefore inhibition of LOC196746 (Accession XM_113595). Accordingly, utilities of VGAM939 include diagnosis, prevention and treatment of diseases and clinical conditions associated with LOC196746. LOC253962 (Accession XM_172968) is another VGAM939 host target gene. LOC253962 BINDING SITE is HOST TARGET binding site found in the 5' untranslated region of mRNA encoded by LOC253962, corresponding to a HOST TARGET binding site such as BINDING SITE I, BINDING SITE II or BINDING SITE III. Table 2 illustrates the complementarity of the nucleotide sequences of LOC253962 BINDING SITE, designated SEQ ID:46224, to the nucleotide sequence of VGAM939 RNA, herein designated VGAM RNA, also designated SEQ ID:3650.

Another function of VGAM939 is therefore inhibition of LOC253962 (Accession XM_172968). Accordingly, utilities of VGAM939 include diagnosis, prevention and treatment of diseases and clinical conditions associated with LOC253962. FIG. 1 further provides a conceptual description of a novel bioinformatically detected viral gene of the present invention, referred to here as Viral Genomic Address Messenger 940 (VGAM940) viral gene, which modulates expression of respective host target genes thereof, the function and utility of which host target genes is known in the art.

VGAM940 is a novel bioinformatically detected regulatory, non protein coding, viral micro RNA (miRNA) gene. The method by which VGAM940 was detected is described hereinabove with reference to FIGS. 1-8.

VGAM940 gene, herein designated VGAM GENE, is a viral gene contained in the genome of Beet Soil-borne Mosaic Virus. VGAM940 host target gene, herein designated VGAM HOST TARGET GENE, is a human gene contained in the human genome.

VGAM940 gene encodes a VGAM940 precursor RNA, herein designated VGAM PRECURSOR RNA. Similar to other miRNA genes, and unlike most ordinary genes, VGAM940 precursor RNA does not encode a protein. A nucleotide sequence identical or highly similar to the nucleotide sequence of VGAM940 precursor RNA is designated SEQ ID:926, and is provided hereinbelow with reference to the sequence listing part. Nucleotide sequence SEQ ID:926 is located at position 2221 relative to the genome of Beet Soil-borne Mosaic Virus.

VGAM940 precursor RNA folds onto itself, forming VGAM940 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM940 folded precursor RNA into VGAM940 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM940 RNA is designated SEQ ID:3651, and is provided hereinbelow with reference to the sequence listing part.

VGAM940 host target gene, herein designated VGAM HOST TARGET GENE, encodes a corresponding messenger RNA, VGAM940 host target RNA, herein designated VGAM HOST TARGET RNA. VGAM940 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM940 RNA, herein designated VGAM RNA, binds complementarily to one or more host target binding sites located in untranslated regions of VGAM940 host target RNA, herein designated VGAM HOST TARGET RNA. This complementary binding is due to the fact that the nucleotide sequence of VGAM940 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM940 RNA, herein designated VGAM RNA, may have a different number of host target binding sites in untranslated regions of a VGAM940 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM940 RNA, herein designated VGAM RNA, to host target binding sites on VGAM940 host target RNA, herein designated VGAM HOST TARGET RNA, such as BINDING SITE I, BINDING SITE II and BINDING SITE III, inhibits translation of VGAM940 host target RNA into VGAM940 host target protein, herein designated VGAM HOST TARGET PROTEIN. VGAM host target protein is therefore outlined by a broken line.

It is appreciated that VGAM940 host target gene, herein designated VGAM HOST TARGET GENE, in fact represents a plurality of VGAM940 host target genes. The mRNA of each one of this plurality of VGAM940 host target genes comprises one or more host target binding sites, each having a nucleotide sequence which is at least partly complementary to VGAM940 RNA, herein designated VGAM RNA, and which when bound by VGAM940 RNA causes inhibition of translation of respective one or more VGAM940 host target proteins.

It is further appreciated by one skilled in the art that the mode of translational inhibition illustrated by FIG. 1 with specific reference to translational inhibition exerted by VGAM940 gene, herein designated VGAM GENE, on one or more VGAM940 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM940 is inhibition of expression of host target genes, as part of a novel viral mechanism of attacking a host. Accordingly, utilities of VGAM940 include diagnosis, prevention and treatment of viral infection by Beet Soil-borne Mosaic Virus. Specific functions, and accordingly utilities, of VGAM940 correlate with, and may be deduced from, the identity of the host target genes which VGAM940 binds and inhibits, and the function of these target genes, as elaborated hereinbelow.

Nucleotide sequences of the VGAM940 precursor RNA, herein designated VGAM PRECURSOR RNA, and of the 'diced' VGAM940 RNA, herein designated VGAM RNA, and a schematic representation of the secondary folding of VGAM940 folded precursor RNA, herein designated VGAM FOLDED PRECURSOR RNA, of VGAM940 are further described hereinbelow with reference to Table 1.

Nucleotide sequences of host target binding sites, such as BINDING SITE-I, BINDING SITE-II and BINDING SITE-III of FIG. 1, found on VGAM940 host target RNA, and schematic representation of the complementarity of each of these host target binding sites to VGAM940 RNA, herein designated VGAM RNA, are described hereinbelow with reference to Table 2.

As mentioned hereinabove with reference to FIG. 1, a function of VGAM940 gene, herein designated VGAM is inhibition of expression of VGAM940 target genes. It is appreciated that specific functions, and accordingly utilities, of VGAM940 correlate with, and may be deduced from, the identity of the target genes which VGAM940 binds and inhibits, and the function of these target genes, as elaborated hereinbelow.

B-cell CLL/lymphoma 2 (BCL2, Accession NM_000633) is a VGAM940 host target gene. BCL2 BINDING SITE is HOST TARGET binding site found in the 3' untranslated region of mRNA encoded by BCL2, corresponding to a HOST TARGET binding site such as BINDING SITE I, BINDING SITE II or BINDING SITE III. Table 2 illustrates the complementarity of the nucleotide sequences of BCL2 BINDING SITE, designated SEQ ID:6257, to the nucleotide sequence of VGAM940 RNA, herein designated VGAM RNA, also designated SEQ ID:3651.

A function of VGAM940 is therefore inhibition of B-cell CLL/lymphoma 2 (BCL2, Accession NM_000633). Accordingly, utilities of VGAM940 include diagnosis, prevention and treatment of diseases and clinical conditions associated with BCL2. CAMP Responsive Element Binding Protein-like 2 (CREBL2, Accession NM_001310) is another VGAM940 host target gene. CREBL2 BINDING SITE is HOST TARGET binding site found in the 3' untranslated region of mRNA encoded by CREBL2, corresponding to a HOST TARGET binding site such as BINDING SITE I, BINDING SITE II or BINDING SITE III. Table 2 illustrates the complementarity of the nucleotide sequences of CREBL2 BINDING SITE, designated SEQ ID:6992, to the nucleotide sequence of VGAM940 RNA, herein designated VGAM RNA, also designated SEQ ID:3651.

Another function of VGAM940 is therefore inhibition of CAMP Responsive Element Binding Protein-like 2 (CREBL2, Accession NM_001310). Accordingly, utilities of VGAM940 include diagnosis, prevention and treatment of diseases and clinical conditions associated with CREBL2. Dystrophin (muscular dystrophy, Duchenne and Becker types) (DMD, Accession NM_004007) is another VGAM940 host target gene. DMD BINDING SITE1 and DMD BINDING SITE2 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 and DMD BINDING SITE2, designated SEQ ID:10162 and SEQ ID:10176 respectively, to the nucleotide sequence of VGAM940 RNA, herein designated VGAM RNA, also designated SEQ ID:3651.

Another function of VGAM940 is therefore inhibition of Dystrophin (muscular dystrophy, Duchenne and Becker types) (DMD, Accession NM_004007), a gene which muscular dystrophy. Accordingly, utilities of VGAM940 include diagnosis, prevention and treatment of diseases and clinical conditions associated with DMD. The function of DMD and its association with various diseases and clinical conditions, has been established by previous studies, as described hereinabove with reference to VGAM218. Myotubularin Related Protein 8 (MTMR8, Accession NM_015458) is another VGAM940 host target gene. MTMR8 BINDING SITE is HOST TARGET binding site found in the 3' untranslated region of mRNA encoded by MTMR8, corresponding to a HOST TARGET binding site such as BINDING SITE I, BINDING SITE II or BINDING SITE III. Table 2 illustrates the complementarity of the nucleotide sequences of MTMR8 BINDING SITE, designated SEQ ID:17740, to the nucleotide sequence of VGAM940 RNA, herein designated VGAM RNA, also designated SEQ ID:3651.

Another function of VGAM940 is therefore inhibition of Myotubularin Related Protein 8 (MTMR8, Accession NM_015458), a gene which could be a tyrosine-phosphatase. Accordingly, utilities of VGAM940 include diagnosis, prevention and treatment of diseases and clinical conditions associated with MTMR8. The function of MTMR8 and its association with various diseases and clinical conditions, has been established by previous studies, as described hereinabove with reference to VGAM379. Tec Protein Tyrosine Kinase (TEC, Accession NM_003215) is another VGAM940 host target gene. TEC BINDING SITE is HOST TARGET binding site found in the 3' untranslated region of mRNA encoded by TEC, corresponding to a HOST TARGET binding site such as BINDING SITE I, BINDING SITE II or BINDING SITE III. Table 2 illustrates the complementarity of the nucleotide sequences of TEC BINDING SITE, designated SEQ ID:9215, to the nucleotide sequence of VGAM940 RNA, herein designated VGAM RNA, also designated SEQ ID:3651.

Another function of VGAM940 is therefore inhibition of Tec Protein Tyrosine Kinase (TEC, Accession NM_003215). Accordingly, utilities of VGAM940 include diagnosis, prevention and treatment of diseases and clinical conditions associated with TEC. Tumor Necrosis Factor Receptor Superfamily, Member 8 (TNFRSF8, Accession NM_001243) is another VGAM940 host target gene. TNFRSF8 BINDING SITE is HOST TARGET binding site found in the 3' untranslated region of mRNA encoded by TNFRSF8, corresponding to a HOST TARGET binding site such as BINDING SITE I, BINDING SITE II or BINDING SITE III. Table 2 illustrates the complementarity of the nucleotide sequences of TNFRSF8 BINDING SITE, designated SEQ ID:6907, to the nucleotide sequence of VGAM940 RNA, herein designated VGAM RNA, also designated SEQ ID:3651.

Another function of VGAM940 is therefore inhibition of Tumor Necrosis Factor Receptor Superfamily, Member 8 (TNFRSF8, Accession NM_001243), a gene which regulates gene expression through activation of nf-kappab. Accordingly, utilities of VGAM940 include diagnosis, prevention and treatment of diseases and clinical conditions associated with TNFRSF8. The function of TNFRSF8 and its association with various diseases and clinical conditions, has been established by previous studies, as described hereinabove with reference to VGAM154. Zinc Finger Protein (C2H2 type) 277 (ZNF277, Accession NM_021994) is another VGAM940 host target gene. ZNF277 BINDING SITE is HOST TARGET binding site found in the 5' untranslated region of mRNA encoded by ZNF277, corresponding to a HOST TARGET binding site such as BINDING SITE I, BINDING SITE II or BINDING SITE III. Table 2 illustrates the complementarity of the nucleotide sequences of ZNF277 BINDING SITE, designated SEQ ID:22534, to the nucleotide sequence of VGAM940 RNA, herein designated VGAM RNA, also designated SEQ ID:3651.

Another function of VGAM940 is therefore inhibition of Zinc Finger Protein (C2H2 type) 277 (ZNF277, Accession NM_021994). Accordingly, utilities of VGAM940 include diagnosis, prevention and treatment of diseases and clinical conditions associated with ZNF277. FHX (Accession NM_018416) is another VGAM940 host target gene. FHX BINDING SITE is HOST TARGET binding site found in the 3' untranslated region of mRNA encoded by FHX, corresponding to a HOST TARGET binding site such as BINDING SITE I, BINDING SITE II or BINDING SITE III. Table 2 illustrates the complementarity of the nucleotide sequences of FHX BINDING SITE, designated SEQ ID:20456, to the nucleotide sequence of VGAM940 RNA, herein designated VGAM RNA, also designated SEQ ID:3651.

Another function of VGAM940 is therefore inhibition of FHX (Accession NM_018416). Accordingly, utilities of VGAM940 include diagnosis, prevention and treatment of diseases and clinical conditions associated with FHX. FLJ10035 (Accession NM_017974) is another VGAM940 host target gene. FLJ10035 BINDING SITE is HOST TARGET binding site found in the 3" untranslated region of mRNA encoded by FLJ10035, corresponding to a HOST TARGET binding site such as BINDING SITE I, BINDING SITE II or BINDING SITE III. Table 2 illustrates the complementarity of the nucleotide sequences of FLJ10035 BINDING SITE, designated SEQ ID:19705, to the nucleotide sequence of VGAM940 RNA, herein designated VGAM RNA, also designated SEQ ID:3651.

Another function of VGAM940 is therefore inhibition of FLJ10035 (Accession NM_017974). Accordingly, utilities of VGAM940 include diagnosis, prevention and treatment of diseases and clinical conditions associated with FLJ10035. FLJ10283 (Accession NM_018046) is another VGAM940 host target gene. FLJ10283 BINDING SITE is HOST TARGET binding site found in the 3' untranslated region of mRNA encoded by FLJ10283, corresponding to a HOST TARGET binding site such as BINDING SITE I, BINDING SITE II or BINDING SITE III. Table 2 illustrates the complementarity of the nucleotide sequences of FLJ10283 BINDING SITE, designated SEQ ID:19794, to the nucleotide sequence of VGAM940 RNA, herein designated VGAM RNA, also designated SEQ ID:3651.

Another function of VGAM940 is therefore inhibition of FLJ10283 (Accession NM_018046). Accordingly, utilities of VGAM940 include diagnosis, prevention and treatment of diseases and clinical conditions associated with FLJ10283. FLJ20127 (Accession NM_017678) is another VGAM940 host target gene. FLJ20127 BINDING SITE is HOST TARGET binding site found in the 3' untranslated region of mRNA encoded by FLJ20127, corresponding to a HOST TARGET binding site such as BINDING SITE I, BINDING SITE II or BINDING SITE III. Table 2 illustrates the complementarity of the nucleotide sequences of FLJ20127 BINDING SITE, designated SEQ ID:19219, to the nucleotide sequence of VGAM940 RNA, herein designated VGAM RNA, also designated SEQ ID:3651.

Another function of VGAM940 is therefore inhibition of FLJ20127 (Accession NM_017678). Accordingly, utilities of VGAM940 include diagnosis, prevention and treatment of diseases and clinical conditions associated with FLJ20127. KIAA0828 (Accession XM_088105) is another VGAM940 host target gene. KIAA0828 BINDING SITE is HOST TARGET binding site found in the 3' untranslated region of mRNA encoded by KIAA0828, corresponding to a HOST TARGET binding site such as BINDING SITE I, BINDING SITE II or BINDING SITE III. Table 2 illustrates the complementarity of the nucleotide sequences of KIAA0828 BINDING SITE, designated SEQ ID:39514, to the nucleotide sequence of VGAM940 RNA, herein designated VGAM RNA, also designated SEQ ID:3651.

Another function of VGAM940 is therefore inhibition of KIAA0828 (Accession XM_088105). Accordingly, utilities of VGAM940 include diagnosis, prevention and treatment of diseases and clinical conditions associated with KIAA0828. KIAA1163 (Accession XM_086231) is another VGAM940 host target gene. KIAA1163 BINDING SITE is HOST TARGET binding site found in the 3' untranslated region of mRNA encoded by KIAA1163, corresponding to a HOST TARGET binding site such as BINDING SITE I, BINDING SITE II or BINDING SITE III. Table 2 illustrates the complementarity of the nucleotide sequences of KIAA1163 BINDING SITE, designated SEQ ID:38560, to the nucleotide sequence of VGAM940 RNA, herein designated VGAM RNA, also designated SEQ ID:3651.

Another function of VGAM940 is therefore inhibition of KIAA1163 (Accession XM_086231). Accordingly, utilities of VGAM940 include diagnosis, prevention and treatment of diseases and clinical conditions associated with KIAA1163. KIAA1434 (Accession XM_045585) is another VGAM940 host target gene. KIAA1434 BINDING SITE is HOST TARGET binding site found in the 3' untranslated region of mRNA encoded by KIAA1434, corresponding to a HOST TARGET binding site such as BINDING SITE I, BINDING SITE II or BINDING SITE III. Table 2 illustrates the complementarity of the nucleotide sequences of KIAA1434 BINDING SITE, designated SEQ ID:34487, to the nucleotide sequence of VGAM940 RNA, herein designated VGAM RNA, also designated SEQ ID:3651.

Another function of VGAM940 is therefore inhibition of KIAA1434 (Accession XM_045585). Accordingly, utilities of VGAM940 include diagnosis, prevention and treatment of diseases and clinical conditions associated with KIAA1434. KIAA1821 (Accession XM_050101) is another VGAM940 host target gene. KIAA1821 BINDING SITE is HOST TARGET binding site found in the 3' untranslated region of mRNA encoded by KIAA1821, corresponding to a HOST TARGET binding site such as BINDING SITE I, BINDING SITE II or BINDING SITE III. Table 2 illustrates the complementarity of the nucleotide sequences of KIAA1821 BINDING SITE, designated SEQ ID:35553, to the nucleotide sequence of VGAM940 RNA, herein designated VGAM RNA, also designated SEQ ID:3651.

Another function of VGAM940 is therefore inhibition of KIAA1821 (Accession XM_050101). Accordingly, utilities of VGAM940 include diagnosis, prevention and treatment of diseases and clinical conditions associated with KIAA1821. Macrophage Erythroblast Attacher (MAEA, Accession NM_005882) is another VGAM940 host target gene. MAEA BINDING SITE is HOST TARGET binding site found in the 3' untranslated region of mRNA encoded by MAEA, corresponding to a HOST TARGET binding site such as BINDING SITE I, BINDING SITE II or BINDING SITE III. Table 2 illustrates the complementarity of the nucleotide sequences of MAEA BINDING SITE, designated SEQ ID:12494, to the nucleotide sequence of VGAM940 RNA, herein designated VGAM RNA, also designated SEQ ID:3651.

Another function of VGAM940 is therefore inhibition of Macrophage Erythroblast Attacher (MAEA, Accession NM_005882). Accordingly, utilities of VGAM940 include diagnosis, prevention and treatment of diseases and clinical conditions associated with MAEA. Zinc Finger Protein 31 (KOX 29) (ZNF31, Accession XM_036305) is another VGAM940 host target gene. ZNF31 BINDING SITE is HOST TARGET binding site found in the 5' untranslated region of mRNA encoded by ZNF31, corresponding to a HOST TARGET binding site such as BINDING SITE I, BINDING SITE II or BINDING SITE III. Table 2 illustrates the complementarity of the nucleotide sequences of ZNF31 BINDING SITE, designated SEQ ID:32422, to the nucleotide sequence of VGAM940 RNA, herein designated VGAM RNA, also designated SEQ ID:3651.

Another function of VGAM940 is therefore inhibition of Zinc Finger Protein 31 (KOX 29) (ZNF31, Accession XM_036305). Accordingly, utilities of VGAM940 include diagnosis, prevention and treatment of diseases and clinical conditions associated with ZNF31. LOC118709 (Accession XM_058338) is another VGAM940 host target gene. LOC118709 BINDING SITE is HOST TARGET binding site found in the 5' untranslated region of mRNA encoded by LOC118709, corresponding to a HOST TARGET binding site such as BINDING SITE I, BINDING SITE II or BINDING SITE III. Table 2 illustrates the complementarity of the nucleotide sequences of LOC118709 BINDING SITE, designated SEQ ID:36599, to the nucleotide sequence of VGAM940 RNA, herein designated VGAM RNA, also designated SEQ ID:3651.

Another function of VGAM940 is therefore inhibition of LOC118709 (Accession XM_058338). Accordingly, utilities of VGAM940 include diagnosis, prevention and treatment of diseases and clinical conditions associated with LOC118709. LOC158310 (Accession XM_098919) is another VGAM940 host target gene. LOC158310 BINDING SITE is HOST TARGET binding site found in the 5' untranslated region of mRNA encoded by LOC158310, corresponding to a HOST TARGET binding site such as BINDING SITE I, BINDING SITE II or BINDING SITE III. Table 2 illustrates the complementarity of the nucleotide sequences of LOC158310 BINDING SITE, designated SEQ ID:41946, to the nucleotide sequence of VGAM940 RNA, herein designated VGAM RNA, also designated SEQ ID:3651.

Another function of VGAM940 is therefore inhibition of LOC158310 (Accession XM_098919). Accordingly, utilities of VGAM940 include diagnosis, prevention and treatment of diseases and clinical conditions associated with LOC158310. LOC256519 (Accession XM_171056) is another VGAM940 host target gene. LOC256519 BINDING SITE is HOST TARGET binding site found in the 5' untranslated region of mRNA encoded by LOC256519, corresponding to a HOST TARGET binding site such as BINDING SITE I, BINDING SITE II or BINDING SITE III. Table 2 illustrates the complementarity of the nucleotide sequences of LOC256519 BINDING SITE, designated SEQ ID:45852, to the nucleotide sequence of VGAM940 RNA, herein designated VGAM RNA, also designated SEQ ID:3651.

Another function of VGAM940 is therefore inhibition of LOC256519 (Accession XM_171056). Accordingly, utilities of VGAM940 include diagnosis, prevention and treatment of diseases and clinical conditions associated with LOC256519. FIG. 1 further provides a conceptual description of a novel bioinformatically detected viral gene of the present invention, referred to here as Viral Genomic Address Messenger 941 (VGAM941) viral gene, which modulates expression of respective host target genes thereof, the function and utility of which host target genes is known in the art.

VGAM941 is a novel bioinformatically detected regulatory, non protein coding, viral micro RNA (miRNA) gene. The method by which VGAM941 was detected is described hereinabove with reference to FIGS. 1-8.

VGAM941 gene, herein designated VGAM GENE, is a viral gene contained in the genome of Infectious Spleen and Kidney Necrosis Virus. VGAM941 host target gene, herein designated VGAM HOST TARGET GENE, is a human gene contained in the human genome.

VGAM941 gene encodes a VGAM941 precursor RNA, herein designated VGAM PRECURSOR RNA. Similar to other miRNA genes, and unlike most ordinary genes, VGAM941 precursor RNA does not encode a protein. A nucleotide sequence identical or highly similar to the nucleotide sequence of VGAM941 precursor RNA is designated SEQ ID:927, and is provided hereinbelow with reference to the sequence listing part. Nucleotide sequence SEQ ID:927 is located at position 5149 relative to the genome of Infectious Spleen and Kidney Necrosis Virus.

VGAM941 precursor RNA folds onto itself, forming VGAM941 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM941 folded precursor RNA into VGAM941 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 87%) nucleotide sequence of VGAM941 RNA is designated SEQ ID:3652, and is provided hereinbelow with reference to the sequence listing part.

VGAM941 host target gene, herein designated VGAM HOST TARGET GENE, encodes a corresponding messenger RNA, VGAM941 host target RNA, herein designated VGAM HOST TARGET RNA. VGAM941 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM941 RNA, herein designated VGAM RNA, binds complementarily to one or more host target binding sites located in untranslated regions of VGAM941 host target RNA, herein designated VGAM HOST TARGET RNA. This complementary binding is due to the fact that the nucleotide sequence of VGAM941 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM941 RNA, herein designated VGAM RNA, may have a different number of host target binding sites in untranslated regions of a VGAM941 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM941 RNA, herein designated VGAM RNA, to host target binding sites on VGAM941 host target RNA, herein designated VGAM HOST TARGET RNA, such as BINDING SITE I, BINDING SITE II and BINDING SITE III, inhibits translation of VGAM941 host target RNA into VGAM941 host target protein, herein designated VGAM HOST TARGET PROTEIN. VGAM host target protein is therefore outlined by a broken line.

It is appreciated that VGAM941 host target gene, herein designated VGAM HOST TARGET GENE, in fact represents a plurality of VGAM941 host target genes. The mRNA of each one of this plurality of VGAM941 host target genes comprises one or more host target binding sites, each having a nucleotide sequence which is at least partly complementary to VGAM941 RNA, herein designated VGAM RNA, and which when bound by VGAM941 RNA causes inhibition of translation of respective one or more VGAM941 host target proteins.

It is further appreciated by one skilled in the art that the mode of translational inhibition illustrated by FIG. 1 with specific reference to translational inhibition exerted by VGAM941 gene, herein designated VGAM GENE, on one or more VGAM941 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM941 is inhibition of expression of host target genes, as part of a novel viral mechanism of attacking a host. Accordingly, utilities of VGAM941 include diagnosis, prevention and treatment of viral infection by Infectious Spleen and Kidney Necrosis Virus. Specific functions, and accordingly utilities, of VGAM941 correlate with, and may be deduced from, the identity of the host target genes which VGAM941 binds and inhibits, and the function of these host target genes, as elaborated hereinbelow.

Nucleotide sequences of the VGAM941 precursor RNA, herein designated VGAM PRECURSOR RNA, and of the 'diced' VGAM941 RNA, herein designated VGAM RNA, and a schematic representation of the secondary folding of VGAM941 folded precursor RNA, herein designated VGAM FOLDED PRECURSOR RNA, of VGAM941 are further described hereinbelow with reference to Table 1.

Nucleotide sequences of host target binding sites, such as BINDING SITE-I, BINDING SITE-II and BINDING SITE-III of FIG. 1, found on VGAM941 host target RNA, and schematic representation of the complementarity of each of these host target binding sites to VGAM941 RNA, herein designated VGAM RNA, are described hereinbelow with reference to Table 2.

As mentioned hereinabove with reference to FIG. 1, a function of VGAM941 gene, herein designated VGAM is inhibition of expression of VGAM941 target genes. It is appreciated that specific functions, and accordingly utilities, of VGAM941 correlate with, and may be deduced from, the identity of the target genes which VGAM941 binds and inhibits, and the function of these target genes, as elaborated hereinbelow.

Ataxia Telangiectasia Mutated (includes complementation groups A, C and D) (ATM, Accession NM_138292) is a VGAM941 host target gene. ATM BINDING SITE1 and ATM BINDING SITE2 are HOST TARGET binding sites found in untranslated regions of mRNA encoded by ATM, corresponding to HOST TARGET binding sites such as BINDING SITE I, BINDING SITE II or BINDING SITE III. Table 2 illustrates the complementarity of the nucleotide sequences of ATM BINDING SITE1 and ATM BINDING SITE2, designated SEQ ID:28704 and SEQ ID:28706 respectively, to the nucleotide sequence of VGAM941 RNA, herein designated VGAM RNA, also designated SEQ ID:3652.

A function of VGAM941 is therefore inhibition of Ataxia Telangiectasia Mutated (includes complementation groups A, C and D) (ATM, Accession NM_138292). Accordingly, utilities of VGAM941 include diagnosis, prevention and treatment of diseases and clinical conditions associated with ATM. Fc Fragment of IgG, Low Affinity IIa, Receptor For (CD32) (FCGR2A, Accession XM_086483) is another VGAM941 host target gene. FCGR2A BINDING SITE is HOST TARGET binding site found in the 3' untranslated region of mRNA encoded by FCGR2A, corresponding to a HOST TARGET binding site such as BINDING SITE I, BINDING SITE II or BINDING SITE III. Table 2 illustrates the complementarity of the nucleotide sequences of FCGR2A BINDING SITE, designated SEQ ID:38698, to the nucleotide sequence of VGAM941 RNA, herein designated VGAM RNA, also designated SEQ ID:3652.

Another function of VGAM941 is therefore inhibition of Fc Fragment of IgG, Low Affinity IIa, Receptor For (CD32) (FCGR2A, Accession XM_086483), a gene which binds IgG immune complexes; member of the immunoglobulin superfamily. Accordingly, utilities of VGAM941 include diagnosis, prevention and treatment of diseases and clinical conditions associated with FCGR2A. The function of FCGR2A and its association with various diseases and clinical conditions, has been established by previous studies, as described hereinabove with reference to VGAM444. Laminin, Gamma 1 (formerly LAMB2) (LAMC1, Accession NM_002293) is another VGAM941 host target gene. LAMC1 BINDING SITE is HOST TARGET binding site found in the 3' untranslated region of mRNA encoded by LAMC1, corresponding to a HOST TARGET binding site such as BINDING SITE I, BINDING SITE II or BINDING SITE III. Table 2 illustrates the complementarity of the nucleotide sequences of LAMC1 BINDING SITE, designated SEQ ID:8074, to the nucleotide sequence of VGAM941 RNA, herein designated VGAM RNA, also designated SEQ ID:3652.

Another function of VGAM941 is therefore inhibition of Laminin, Gamma 1 (formerly LAMB2) (LAMC1, Accession NM_002293), a gene which may mediate the attachment, migration, and organization of cells into tissues. Accordingly, utilities of VGAM941 include diagnosis, prevention and treatment of diseases and clinical conditions associated with LAMC1. The function of LAMC1 and its association with various diseases and clinical conditions, has been established by previous studies, as described hereinabove with reference to VGAM812. Myosin X (MYO10, Accession NM_012334) is another VGAM941 host target gene. MYO10 BINDING SITE is HOST TARGET binding site found in the 3' untranslated region of mRNA encoded by MYO10, corresponding to a HOST TARGET binding site such as BINDING SITE I, BINDING SITE II or BINDING SITE III. Table 2 illustrates the complementarity of the nucleotide sequences of MYO10 BINDING SITE, designated SEQ ID:14731, to the nucleotide sequence of VGAM941 RNA, herein designated VGAM RNA, also designated SEQ ID:3652.

Another function of VGAM941 is therefore inhibition of Myosin X (MYO10, Accession NM_012334), a gene which is an unconventional myosin. Accordingly, utilities of VGAM941 include diagnosis, prevention and treatment of diseases and clinical conditions associated with MYO10. The function of MYO10 and its association with various diseases and clinical conditions, has been established by previous studies, as described hereinabove with reference to VGAM28. NADH Dehydrogenase (ubiquinone) Flavoprotein 3, 10 kDa (NDUFV3, Accession NM_021075) is another VGAM941 host target gene. NDUFV3 BINDING SITE is HOST TARGET binding site found in the 5' untranslated region of mRNA encoded by NDUFV3, corresponding to a HOST TARGET binding site such as BINDING SITE I, BINDING SITE II or BINDING SITE III. Table 2 illustrates the complementarity of the nucleotide sequences of NDUFV3 BINDING SITE, designated SEQ ID:22043, to the nucleotide sequence of VGAM941 RNA, herein designated VGAM RNA, also designated SEQ ID:3652.

Another function of VGAM941 is therefore inhibition of NADH Dehydrogenase (ubiquinone) Flavoprotein 3, 10 kDa (NDUFV3, Accession NM_021075), a gene which transports electrons from NADH to ubiquinone. Accordingly, utilities of VGAM941 include diagnosis, prevention and treatment of diseases and clinical conditions associated with NDUFV3. The function of NDUFV3 and its association with various diseases and clinical conditions, has been established by previous studies, as described hereinabove with reference to VGAM626. Platelet-derived Growth Factor Receptor, Alpha Polypeptide (PDGFRA, Accession NM_006206) is another VGAM941 host target gene. PDGFRA BINDING SITE is HOST TARGET binding site found in the 3' untranslated region of mRNA encoded by PDGFRA, corresponding to a HOST TARGET binding site such as BINDING SITE I, BINDING SITE II or BINDING SITE III. Table 2 illustrates the complementarity of the nucleotide sequences of PDGFRA BINDING SITE, designated SEQ ID:12881, to the nucleotide sequence of VGAM941 RNA, herein designated VGAM RNA, also designated SEQ ID:3652.

Another function of VGAM941 is therefore inhibition of Platelet-derived Growth Factor Receptor, Alpha Polypeptide (PDGFRA, Accession NM_006206), a gene which this receptor binds platelet-derived growth factor and has a tyrosine-protein kinase activity. Accordingly, utilities of VGAM941 include diagnosis, prevention and treatment of diseases and clinical conditions associated with PDGFRA. The function of PDGFRA and its association with various diseases and clinical conditions, has been established by previous studies, as described hereinabove with reference to VGAM117. Solute Carrier Family 20 (phosphate transporter), Member 2 (SLC20A2, Accession NM_006749) is another VGAM941 host target gene. SLC20A2 BINDING SITE is HOST TARGET binding site found in the 5' untranslated region of mRNA encoded by SLC20A2, corresponding to a HOST TARGET binding site such as BINDING SITE I, BINDING SITE II or BINDING SITE III. Table 2 illustrates the complementarity of the nucleotide sequences of SLC20A2 BINDING SITE, designated SEQ ID:13599, to the nucleotide sequence of VGAM941 RNA, herein designated VGAM RNA, also designated SEQ ID:3652.

Another function of VGAM941 is therefore inhibition of Solute Carrier Family 20 (phosphate transporter), Member 2 (SLC20A2, Accession NM_006749), a gene which is a sodium-phosphate symporter. Accordingly, utilities of VGAM941 include diagnosis, prevention and treatment of diseases and clinical conditions associated with SLC20A2. The function of SLC20A2 and its association with various diseases and clinical conditions, has been established by previous studies, as described hereinabove with reference to VGAM232. Transcription Factor 2, Hepatic; LF-B3; Variant Hepatic Nuclear Factor (TCF2, Accession NM_000458) is another VGAM941 host target gene. TCF2 BINDING SITE is HOST TARGET binding site found in the 3' untranslated region of mRNA encoded by TCF2, corresponding to a HOST TARGET binding site such as BINDING SITE I, BINDING SITE II or BINDING SITE III. Table 2 illustrates the complementarity of the nucleotide sequences of TCF2 BINDING SITE, designated SEQ ID:6074, to the nucleotide sequence of VGAM941 RNA, herein designated VGAM RNA, also designated SEQ ID:3652.

Another function of VGAM941 is therefore inhibition of Transcription Factor 2, Hepatic; LF-B3; Variant Hepatic Nuclear Factor (TCF2, Accession NM_000458), a gene which probably binds to the inverted palindrome 5'-gttaatnat-taac-3'. Accordingly, utilities of VGAM941 include diagnosis, prevention and treatment of diseases and clinical conditions associated with TCF2. The function of TCF2 and its association with various diseases and clinical conditions, has been established by previous studies, as described hereinabove with reference to VGAM118. Basic Leucine Zipper Nuclear Factor 1 (JEM-1) (BLZF1, Accession NM_003666) is another VGAM941 host target gene. BLZF1 BINDING SITE is HOST TARGET binding site found in the 3' untranslated region of mRNA encoded by BLZF1, corresponding to a HOST TARGET binding site such as BINDING SITE I, BINDING SITE II or BINDING SITE III. Table 2 illustrates the complementarity of the nucleotide sequences of BLZF1 BINDING SITE, designated SEQ ID:9747, to the nucleotide sequence of VGAM941 RNA, herein designated VGAM RNA, also designated SEQ ID:3652.

Another function of VGAM941 is therefore inhibition of Basic Leucine Zipper Nuclear Factor 1 (JEM-1) (BLZF1, Accession NM_003666). Accordingly, utilities of VGAM941 include diagnosis, prevention and treatment of diseases and clinical conditions associated with BLZF1. Diacylglycerol Kinase, Delta 130 kDa (DGKD, Accession XM_002384) is another VGAM941 host target gene. DGKD BINDING SITE is HOST TARGET binding site found in the 3' untranslated region of mRNA encoded by DGKD, corresponding to a HOST TARGET binding site such as BINDING SITE I, BINDING SITE II or BINDING SITE III. Table 2 illustrates the complementarity of the nucleotide sequences of DGKD BINDING SITE, designated SEQ ID:29877, to the nucleotide sequence of VGAM941 RNA, herein designated VGAM RNA, also designated SEQ ID:3652.

Another function of VGAM941 is therefore inhibition of Diacylglycerol Kinase, Delta 130 kDa (DGKD, Accession XM_002384). Accordingly, utilities of VGAM941 include diagnosis, prevention and treatment of diseases and clinical conditions associated with DGKD. FLJ21195 (Accession NM_022469) is another VGAM941 host target gene. FLJ21195 BINDING SITE is HOST TARGET binding site found in the 3' untranslated region of mRNA encoded by FLJ21195, corresponding to a HOST TARGET binding site such as BINDING SITE I, BINDING SITE II or BINDING SITE III. Table 2 illustrates the complementarity of the nucleotide sequences of FLJ21195 BINDING SITE, designated SEQ ID:22824, to the nucleotide sequence of VGAM941 RNA, herein designated VGAM RNA, also designated SEQ ID:3652.

Another function of VGAM941 is therefore inhibition of FLJ21195 (Accession NM_022469). Accordingly, utilities of VGAM941 include diagnosis, prevention and treatment of diseases and clinical conditions associated with FLJ21195. KIAA0164 (Accession NM_014739) is another VGAM941 host target gene. KIAA0164 BINDING SITE is HOST TARGET binding site found in the 3' untranslated region of mRNA encoded by KIAA0164, corresponding to a HOST TARGET binding site such as BINDING SITE I, BINDING SITE II or BINDING SITE III. Table 2 illustrates the complementarity of the nucleotide sequences of KIAA0164 BINDING SITE, designated SEQ ID:16404, to the nucleotide sequence of VGAM941 RNA, herein designated VGAM RNA, also designated SEQ ID:3652.

Another function of VGAM941 is therefore inhibition of KIAA0164 (Accession NM_014739). Accordingly, utilities of VGAM941 include diagnosis, prevention and treatment of diseases and clinical conditions associated with KIAA0164. KIAA0350 (Accession XM_028332) is another VGAM941 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30661, to the nucleotide sequence of VGAM941 RNA, herein designated VGAM RNA, also designated SEQ ID:3652.

Another function of VGAM941 is therefore inhibition of KIAA0350 (Accession XM_028332). Accordingly, utilities of VGAM941 include diagnosis, prevention and treatment of diseases and clinical conditions associated with KIAA0350. KIAA1396 (Accession XM_032054) is another VGAM941 host target gene. KIAA1396 BINDING SITE is HOST TARGET binding site found in the 3' untranslated region of mRNA encoded by KIAA1396, corresponding to a HOST TARGET binding site such as BINDING SITE I, BINDING SITE II or BINDING SITE III. Table 2 illustrates the complementarity of the nucleotide sequences of KIAA1396 BINDING SITE, designated SEQ ID:31546, to the nucleotide sequence of VGAM941 RNA, herein designated VGAM RNA, also designated SEQ ID:3652.

Another function of VGAM941 is therefore inhibition of KIAA1396 (Accession XM_032054). Accordingly, utilities of VGAM941 include diagnosis, prevention and treatment of diseases and clinical conditions associated with KIAA1396. KIAA1853 (Accession XM_045184) is another VGAM941 host target gene. KIAA1853 BINDING SITE is HOST TARGET binding site found in the 3' untranslated region of mRNA encoded by KIAA1853, corresponding to a HOST TARGET binding site such as BINDING SITE I, BINDING SITE II or BINDING SITE III. Table 2 illustrates the complementarity of the nucleotide sequences of KIAA1853 BINDING SITE, designated SEQ ID:34382, to the nucleotide sequence of VGAM941 RNA, herein designated VGAM RNA, also designated SEQ ID:3652.

Another function of VGAM941 is therefore inhibition of KIAA1853 (Accession XM_045184). Accordingly, utilities of VGAM941 include diagnosis, prevention and treatment of diseases and clinical conditions associated with KIAA1853. KIAA1884 (Accession XM_055539) is another VGAM941 host target gene. KIAA1884 BINDING SITE is HOST TARGET binding site found in the 3' untranslated region of mRNA encoded by KIAA1884, corresponding to a HOST TARGET binding site such as BINDING SITE I, BINDING SITE II or BINDING SITE III. Table 2 illustrates the complementarity of the nucleotide sequences of KIAA1884 BINDING SITE, designated SEQ ID:36291, to the nucleotide sequence of VGAM941 RNA, herein designated VGAM RNA, also designated SEQ ID:3652.

Another function of VGAM941 is therefore inhibition of KIAA1884 (Accession XM_055539). Accordingly, utilities of VGAM941 include diagnosis, prevention and treatment of diseases and clinical conditions associated with KIAA1884. SH3 Domain Binding Glutamic Acid-rich Protein Like 2 (SH3BGRL2, Accession NM_031469) is another VGAM941 host target gene. SH3BGRL2 BINDING SITE is HOST TARGET binding site found in the 3' untranslated region of mRNA encoded by SH3BGRL2, corresponding to a HOST TARGET binding site such as BINDING SITE I, BINDING SITE II or BINDING SITE III. Table 2 illustrates the complementarity of the nucleotide sequences of SH3BGRL2 BINDING SITE, designated SEQ ID:25526, to the nucleotide sequence of VGAM941 RNA, herein designated VGAM RNA, also designated SEQ ID:3652.

Another function of VGAM941 is therefore inhibition of SH3 Domain Binding Glutamic Acid-rich Protein Like 2 (SH3BGRL2, Accession NM_031469). Accordingly, utilities of VGAM941 include diagnosis, prevention and treatment of diseases and clinical conditions associated with SH3BGRL2. LOC127255 (Accession NM_145258) is another VGAM941 host target gene. LOC127255 BINDING SITE is HOST TARGET binding site found in the 3' untranslated region of mRNA encoded by LOC127255, corresponding to a HOST TARGET binding site such as BINDING SITE I, BINDING SITE II or BINDING SITE III. Table 2 illustrates the complementarity of the nucleotide sequences of LOC127255 BINDING SITE, designated SEQ ID:29773, to the nucleotide sequence of VGAM941 RNA, herein designated VGAM RNA, also designated SEQ ID:3652.

Another function of VGAM941 is therefore inhibition of LOC127255 (Accession NM_145258). Accordingly, utilities of VGAM941 include diagnosis, prevention and treatment of diseases and clinical conditions associated with LOC127255. LOC158563 (Accession XM_088606) is another VGAM941 host target gene. LOC158563 BINDING SITE is HOST TARGET binding site found in the 3' untranslated region of mRNA encoded by LOC158563, corresponding to a HOST TARGET binding site such as BINDING SITE I, BINDING SITE II or BINDING SITE III. Table 2 illustrates the complementarity of the nucleotide sequences of LOC158563 BINDING SITE, designated SEQ ID:39868, to the nucleotide sequence of VGAM941 RNA, herein designated VGAM RNA, also designated SEQ ID:3652.

Another function of VGAM941 is therefore inhibition of LOC158563 (Accession XM_088606). Accordingly, utilities of VGAM941 include diagnosis, prevention and treatment of diseases and clinical conditions associated with LOC158563. LOC163081 (Accession XM_091987) is another VGAM941 host target gene. LOC163081 BINDING SITE is HOST TARGET binding site found in the 5' untranslated region of mRNA encoded by LOC163081, corresponding to a HOST TARGET binding site such as BINDING SITE I, BINDING SITE II or BINDING SITE III. Table 2 illustrates the complementarity of the nucleotide sequences of LOC163081 BINDING SITE, designated SEQ ID:40085, to the nucleotide sequence of VGAM941 RNA, herein designated VGAM RNA, also designated SEQ ID:3652.

Another function of VGAM941 is therefore inhibition of LOC163081 (Accession XM_091987). Accordingly, utilities of VGAM941 include diagnosis, prevention and treatment of diseases and clinical conditions associated with LOC163081. LOC51279 (Accession NM_016546) is another VGAM941 host target gene. LOC51279 BINDING SITE is HOST TARGET binding site found in the 3' untranslated region of mRNA encoded by LOC51279, corresponding to a HOST TARGET binding site such as BINDING SITE I, BINDING SITE II or BINDING SITE III. Table 2 illustrates the complementarity of the nucleotide sequences of LOC51279 BINDING SITE, designated SEQ ID:18616, to the nucleotide sequence of VGAM941 RNA, herein designated VGAM RNA, also designated SEQ ID:3652.

Another function of VGAM941 is therefore inhibition of LOC51279 (Accession NM_016546). Accordingly, utilities of VGAM941 include diagnosis, prevention and treatment of diseases and clinical conditions associated with LOC51279.

FIG. 1 further provides a conceptual description of a novel bioinformatically detected viral gene of the present invention, referred to here as Viral Genomic Address Messenger 942 (VGAM942) viral gene, which modulates expression of respective host target genes thereof, the function and utility of which host target genes is known in the art.

VGAM942 is a novel bioinformatically detected regulatory, non protein coding, viral micro RNA (miRNA) gene. The method by which VGAM942 was detected is described hereinabove with reference to FIGS. 1-8.

VGAM942 gene, herein designated VGAM GENE, is a viral gene contained in the genome of Infectious Spleen and Kidney Necrosis Virus. VGAM942 host target gene, herein designated VGAM HOST TARGET GENE, is a human gene contained in the human genome.

VGAM942 gene encodes a VGAM942 precursor RNA, herein designated VGAM PRECURSOR RNA. Similar to other miRNA genes, and unlike most ordinary genes, VGAM942 precursor RNA does not encode a protein. A nucleotide sequence identical or highly similar to the nucleotide sequence of VGAM942 precursor RNA is designated SEQ ID:928, and is provided hereinbelow with reference to the sequence listing part. Nucleotide sequence SEQ ID:928 is located at position 3787 relative to the genome of Infectious Spleen and Kidney Necrosis Virus.

VGAM942 precursor RNA folds onto itself, forming VGAM942 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM942 folded precursor RNA into VGAM942 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM942 RNA is designated SEQ ID:3653, and is provided hereinbelow with reference to the sequence listing part.

VGAM942 host target gene, herein designated VGAM HOST TARGET GENE, encodes a corresponding messenger RNA, VGAM942 host target RNA, herein designated VGAM HOST TARGET RNA. VGAM942 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM942 RNA, herein designated VGAM RNA, binds complementarily to one or more host target binding sites located in untranslated regions of VGAM942 host target RNA, herein designated VGAM HOST TARGET RNA. This complementary binding is due to the fact that the nucleotide sequence of VGAM942 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM942 RNA, herein designated VGAM RNA, may have a different number of host target binding sites in untranslated regions of a VGAM942 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM942 RNA, herein designated VGAM RNA, to host target binding sites on VGAM942 host target RNA, herein designated VGAM HOST TARGET RNA, such as BINDING SITE I, BINDING SITE II and BINDING SITE III, inhibits translation of VGAM942 host target RNA into VGAM942 host target protein, herein designated VGAM HOST TARGET PROTEIN. VGAM host target protein is therefore outlined by a broken line.

It is appreciated that VGAM942 host target gene, herein designated VGAM HOST TARGET GENE, in fact represents a plurality of VGAM942 host target genes. The mRNA of each one of this plurality of VGAM942 host target genes comprises one or more host target binding sites, each having a nucleotide sequence which is at least partly complementary to VGAM942 RNA, herein designated VGAM RNA, and which when bound by VGAM942 RNA causes inhibition of translation of respective one or more VGAM942 host target proteins.

It is further appreciated by one skilled in the art that the mode of translational inhibition illustrated by FIG. 1 with specific reference to translational inhibition exerted by VGAM942 gene, herein designated VGAM GENE, on one or more VGAM942 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM942 is inhibition of expression of host target genes, as part of a novel viral mechanism of attacking a host. Accordingly, utilities of VGAM942 include diagnosis, prevention and treatment of viral infection by Infectious Spleen and Kidney Necrosis Virus. Specific functions, and accordingly utilities, of VGAM942 correlate with, and may be deduced from, the identity of the host target genes which VGAM942 binds and inhibits, and the function of these host target genes, as elaborated hereinbelow.

Nucleotide sequences of the VGAM942 precursor RNA, herein designated VGAM PRECURSOR RNA, and of the 'diced' VGAM942 RNA, herein designated VGAM RNA, and a schematic representation of the secondary folding of VGAM942 folded precursor RNA, herein designated VGAM FOLDED PRECURSOR RNA, of VGAM942 are further described hereinbelow with reference to Table 1.

Nucleotide sequences of host target binding sites, such as BINDING SITE-I, BINDING SITE-II and BINDING SITE-III of FIG. 1, found on VGAM942 host target RNA, and schematic representation of the complementarity of each of these host target binding sites to VGAM942 RNA, herein designated VGAM RNA, are described hereinbelow with reference to Table 2.

As mentioned hereinabove with reference to FIG. 1, a function of VGAM942 gene, herein designated VGAM is inhibition of expression of VGAM942 target genes. It is appreciated that specific functions, and accordingly utilities, of VGAM942 correlate with, and may be deduced from, the identity of the target genes which VGAM942 binds and inhibits, and the function of these target genes, as elaborated hereinbelow.

EphB2 (EPHB2, Accession NM_004442) is a VGAM942 host target gene. EPHB2 BINDING SITE is HOST TARGET binding site found in the 3' untranslated region of mRNA encoded by EPHB2, corresponding to a HOST TARGET binding site such as BINDING SITE I, BINDING SITE II or BINDING SITE III. Table 2 illustrates the complementarity of the nucleotide sequences of EPHB2 BINDING SITE, designated SEQ ID:10732, to the nucleotide sequence of VGAM942 RNA, herein designated VGAM RNA, also designated SEQ ID:3653.

A function of VGAM942 is therefore inhibition of EphB2 (EPHB2, Accession NM_004442), a gene which Eph-related receptor tyrosine kinase B2; may have a role in neurogenesis. Accordingly, utilities of VGAM942 include diagnosis, prevention and treatment of diseases and clinical conditions associated with EPHB2. The function of EPHB2 and its association with various diseases and clinical conditions, has been established by previous studies, as described hereinabove with reference to VGAM533. GATA Binding Protein 2 (GATA2, Accession NM_002050) is another VGAM942 host target gene. GATA2 BINDING SITE is HOST TARGET binding site found in the 5' untranslated region of mRNA encoded by GATA2, corresponding to a HOST TARGET binding site such as BINDING SITE I, BINDING SITE II or BINDING SITE III. Table 2 illustrates the complementarity of the nucleotide sequences of GATA2 BINDING SITE, designated SEQ ID:7804, to the nucleotide sequence of VGAM942 RNA, herein designated VGAM RNA, also designated SEQ ID:3653.

Another function of VGAM942 is therefore inhibition of GATA Binding Protein 2 (GATA2, Accession NM_002050). Accordingly, utilities of VGAM942 include diagnosis, prevention and treatment of diseases and clinical conditions associated with GATA2. GRAF (Accession NM_015071) is another VGAM942 host target gene. GRAF BINDING SITE is HOST TARGET binding site found in the 3' untranslated region of mRNA encoded by GRAF, corresponding to a HOST TARGET binding site such as BINDING SITE I, BINDING SITE II or BINDING SITE III. Table 2 illustrates the complementarity of the nucleotide sequences of GRAF BINDING SITE, designated SEQ ID:17441, to the nucleotide sequence of VGAM942 RNA, herein designated VGAM RNA, also designated SEQ ID:3653.

Another function of VGAM942 is therefore inhibition of GRAF (Accession NM_015071), a gene which ia a GTPase activating protein for p21-rac. Accordingly, utilities of VGAM942 include diagnosis, prevention and treatment of diseases and clinical conditions associated with GRAF. The function of GRAF and its association with various diseases and clinical conditions, has been established by previous studies, as described hereinabove with reference to VGAM430. Interleukin-1 Receptor-associated Kinase 1 (IRAK1, Accession NM_001569) is another VGAM942 host target gene. IRAK1 BINDING SITE is HOST TARGET binding site found in the 3' untranslated region of mRNA encoded by IRAK1, corresponding to a HOST TARGET binding site such as BINDING SITE I, BINDING SITE II or BINDING SITE III. Table 2 illustrates the complementarity of the nucleotide sequences of IRAK1 BINDING SITE, designated SEQ ID:7298, to the nucleotide sequence of VGAM942 RNA, herein designated VGAM RNA, also designated SEQ ID:3653.

Another function of VGAM942 is therefore inhibition of Interleukin-1 Receptor-associated Kinase 1 (IRAK1, Accession NM_001569). Accordingly, utilities of VGAM942 include diagnosis, prevention and treatment of diseases and clinical conditions associated with IRAK1. KIAA0450 (Accession NM_014638) is another VGAM942 host target gene. KIAA0450 BINDING SITE is HOST TARGET binding site found in the 3" untranslated region of mRNA encoded by KIAA0450, corresponding to a HOST TARGET binding site such as BINDING SITE I, BINDING SITE II or BINDING SITE III. Table 2 illustrates the complementarity of the nucleotide sequences of KIAA0450 BINDING SITE, designated SEQ ID:16027, to the nucleotide sequence of VGAM942 RNA, herein designated VGAM RNA, also designated SEQ ID:3653.

Another function of VGAM942 is therefore inhibition of KIAA0450 (Accession NM_014638). Accordingly, utilities of VGAM942 include diagnosis, prevention and treatment of diseases and clinical conditions associated with KIAA0450. KIAA0789 (Accession XM_033113) is another VGAM942 host target gene. KIAA0789 BINDING SITE is HOST TARGET binding site found in the 5' untranslated region of mRNA encoded by KIAA0789, corresponding to a HOST TARGET binding site such as BINDING SITE I, BINDING SITE II or BINDING SITE III. Table 2 illustrates the complementarity of the nucleotide sequences of KIAA0789 BINDING SITE, designated SEQ ID:31845, to the nucleotide sequence of VGAM942 RNA, herein designated VGAM RNA, also designated SEQ ID:3653.

Another function of VGAM942 is therefore inhibition of KIAA0789 (Accession XM_033113). Accordingly, utilities of VGAM942 include diagnosis, prevention and treatment of diseases and clinical conditions associated with KIAA0789. LIG-1 (Accession XM_033712) is another VGAM942 host target gene. LIG-1 BINDING SITE is HOST TARGET binding site found in the 3' untranslated region of mRNA encoded by LIG-1, corresponding to a HOST TARGET binding site such as BINDING SITE I, BINDING SITE II or BINDING SITE III. Table 2 illustrates the complementarity of the nucleotide sequences of LIG-1 BINDING SITE, designated SEQ ID:31950, to the nucleotide sequence of VGAM942 RNA, herein designated VGAM RNA, also designated SEQ ID:3653.

Another function of VGAM942 is therefore inhibition of LIG-1 (Accession XM_033712). Accordingly, utilities of VGAM942 include diagnosis, prevention and treatment of diseases and clinical conditions associated with LIG-1. Protein Phosphatase 1, Regulatory (inhibitor) Subunit 3B (PPP1R3B, Accession NM_024607) is another VGAM942 host target gene. PPP1R3B BINDING SITE is HOST TARGET binding site found in the 3' untranslated region of mRNA encoded by PPP1R3B, corresponding to a HOST TARGET binding site such as BINDING SITE I, BINDING SITE II or BINDING SITE III. Table 2 illustrates the complementarity of the nucleotide sequences of PPP1R3B BINDING SITE, designated SEQ ID:23855, to the nucleotide sequence of VGAM942 RNA, herein designated VGAM RNA, also designated SEQ ID:3653.

Another function of VGAM942 is therefore inhibition of Protein Phosphatase 1, Regulatory (inhibitor) Subunit 3B (PPP1R3B, Accession NM_024607). Accordingly, utilities of VGAM942 include diagnosis, prevention and treatment of diseases and clinical conditions associated with PPP1R3B. STI2 (Accession XM_114335) is another VGAM942 host target gene. STI2 BINDING SITE is HOST TARGET binding site found in the 3' untranslated region of mRNA encoded by STI2, corresponding to a HOST TARGET binding site such as BINDING SITE I, BINDING SITE II or BINDING SITE III. Table 2 illustrates the complementarity of the nucleotide sequences of STI2 BINDING SITE, designated SEQ ID:42876, to the nucleotide sequence of VGAM942 RNA, herein designated VGAM RNA, also designated SEQ ID:3653.

Another function of VGAM942 is therefore inhibition of STI2 (Accession XM_114335). Accordingly, utilities of VGAM942 include diagnosis, prevention and treatment of diseases and clinical conditions associated with STI2. LOC51285 (Accession NM_016563) is another VGAM942 host target gene. LOC51285 BINDING SITE is HOST TARGET binding site found in the 3' untranslated region of mRNA encoded by LOC51285, corresponding to a HOST TARGET binding site such as BINDING SITE I, BINDING SITE II or BINDING SITE III. Table 2 illustrates the complementarity of the nucleotide sequences of LOC51285 BINDING SITE, designated SEQ ID:18637, to the nucleotide sequence of VGAM942 RNA, herein designated VGAM RNA, also designated SEQ ID:3653.

Another function of VGAM942 is therefore inhibition of LOC51285 (Accession NM_016563). Accordingly, utilities of VGAM942 include diagnosis, prevention and treatment of diseases and clinical conditions associated with LOC51285. FIG. 1 further provides a conceptual description of a novel bioinformatically detected viral gene of the present invention, referred to here as Viral Genomic Address Messenger 943 (VGAM943) viral gene, which modulates expression of respective host target genes thereof, the function and utility of which host target genes is known in the art.

VGAM943 is a novel bioinformatically detected regulatory, non protein coding, viral micro RNA (miRNA) gene. The method by which VGAM943 was detected is described hereinabove with reference to FIGS. 1-8.

VGAM943 gene, herein designated VGAM GENE, is a viral gene contained in the genome of Infectious Spleen and Kidney Necrosis Virus. VGAM943 host target gene, herein designated VGAM HOST TARGET GENE, is a human gene contained in the human genome.

VGAM943 gene encodes a VGAM943 precursor RNA, herein designated VGAM PRECURSOR RNA. Similar to other miRNA genes, and unlike most ordinary genes, VGAM943 precursor RNA does not encode a protein. A nucleotide sequence identical or highly similar to the nucleotide sequence of VGAM943 precursor RNA is designated SEQ ID:929, and is provided hereinbelow with reference to the sequence listing part. Nucleotide sequence SEQ ID:929 is located at position 6007 relative to the genome of Infectious Spleen and Kidney Necrosis Virus.

VGAM943 precursor RNA folds onto itself, forming VGAM943 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM943 folded precursor RNA into VGAM943 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM943 RNA is designated SEQ ID:3654, and is provided hereinbelow with reference to the sequence listing part.

VGAM943 host target gene, herein designated VGAM HOST TARGET GENE, encodes a corresponding messenger RNA, VGAM943 host target RNA, herein designated VGAM HOST TARGET RNA. VGAM943 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM943 RNA, herein designated VGAM RNA, binds complementarily to one or more host target binding sites located in untranslated regions of VGAM943 host target RNA, herein designated VGAM HOST TARGET RNA. This complementary binding is due to the fact that the nucleotide sequence of VGAM943 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM943 RNA, herein designated VGAM RNA, may have a different number of host target binding sites in untranslated regions of a VGAM943 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM943 RNA, herein designated VGAM RNA, to host target binding sites on VGAM943 host target RNA, herein designated VGAM HOST TARGET RNA, such as BINDING SITE I, BINDING SITE II and BINDING SITE III, inhibits translation of VGAM943 host target RNA into VGAM943 host target protein, herein designated VGAM HOST TARGET PROTEIN. VGAM host target protein is therefore outlined by a broken line.

It is appreciated that VGAM943 host target gene, herein designated VGAM HOST TARGET GENE, in fact represents a plurality of VGAM943 host target genes. The mRNA of each one of this plurality of VGAM943 host target genes comprises one or more host target binding sites, each having a nucleotide sequence which is at least partly complementary to VGAM943 RNA, herein designated VGAM RNA, and which when bound by VGAM943 RNA causes inhibition of translation of respective one or more VGAM943 host target proteins.

It is further appreciated by one skilled in the art that the mode of translational inhibition illustrated by FIG. 1 with specific reference to translational inhibition exerted by VGAM943 gene, herein designated VGAM GENE, on one or more VGAM943 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM943 is inhibition of expression of host target genes, as part of a novel viral mechanism of attacking a host. Accordingly, utilities of VGAM943 include diagnosis, prevention and treatment of viral infection by Infectious Spleen and Kidney Necrosis Virus. Specific functions, and accordingly utilities, of VGAM943 correlate with, and may be deduced from, the identity of the host target genes which VGAM943 binds and inhibits, and the function of these host target genes, as elaborated hereinbelow.

Nucleotide sequences of the VGAM943 precursor RNA, herein designated VGAM PRECURSOR RNA, and of the 'diced' VGAM943 RNA, herein designated VGAM RNA, and a schematic representation of the secondary folding of VGAM943 folded precursor RNA, herein designated VGAM FOLDED PRECURSOR RNA, of VGAM943 are further described hereinbelow with reference to Table 1.

Nucleotide sequences of host target binding sites, such as BINDING SITE-I, BINDING SITE-II and BINDING SITE-III of FIG. 1, found on VGAM943 host target RNA, and schematic representation of the complementarity of each of these host target binding sites to VGAM943 RNA, herein designated VGAM RNA, are described hereinbelow with reference to Table 2.

As mentioned hereinabove with reference to FIG. 1, a function of VGAM943 gene, herein designated VGAM is inhibition of expression of VGAM943 target genes. It is appreciated that specific functions, and accordingly utilities, of VGAM943 correlate with, and may be deduced from, the identity of the target genes which VGAM943 binds and inhibits, and the function of these target genes, as elaborated hereinbelow.

Adenomatosis Polyposis Coli (APC, Accession NM_000038) is a VGAM943 host target gene. APC BINDING SITE is HOST TARGET binding site found in the 3' untranslated region of mRNA encoded by APC, corresponding to a HOST TARGET binding site such as BINDING SITE I, BINDING SITE II or BINDING SITE III. Table 2 illustrates the complementarity of the nucleotide sequences of APC BINDING SITE, designated SEQ ID:5482, to the nucleotide sequence of VGAM943 RNA, herein designated VGAM RNA, also designated SEQ ID:3654.

A function of VGAM943 is therefore inhibition of Adenomatosis Polyposis Coli (APC, Accession NM_000038). Accordingly, utilities of VGAM943 include diagnosis, prevention and treatment of diseases and clinical conditions associated with APC. Cadherin 17, LI Cadherin (liver-intestine) (CDH17, Accession NM_004063) is another VGAM943 host target gene. CDH17 BINDING SITE is HOST TARGET binding site found in the 3' untranslated region of mRNA encoded by CDH17, corresponding to a HOST TARGET binding site such as BINDING SITE I, BINDING SITE II or BINDING SITE III. Table 2 illustrates the complementarity of the nucleotide sequences of CDH17 BINDING SITE, designated SEQ ID:10268, to the nucleotide sequence of VGAM943 RNA, herein designated VGAM RNA, also designated SEQ ID:3654.

Another function of VGAM943 is therefore inhibition of Cadherin 17, LI Cadherin (liver-intestine) (CDH17, Accession NM_004063), a gene which may have a role in the morphological organization of liver and intestine and involved in intestinal peptide transport. Accordingly, utilities of VGAM943 include diagnosis, prevention and treatment of diseases and clinical conditions associated with CDH17. The function of CDH17 and its association with various diseases and clinical conditions, has been established by previous studies, as described hereinabove with reference to VGAM795. Diaphanous Homolog 2 (Drosophila) (DIAPH2, Accession NM_006729) is another VGAM943 host target gene. DIAPH2 BINDING SITE is HOST TARGET binding site found in the 3' untranslated region of mRNA encoded by DIAPH2, corresponding to a HOST TARGET binding site such as BINDING SITE I, BINDING SITE II or BINDING SITE III. Table 2 illustrates the complementarity of the nucleotide sequences of DIAPH2 BINDING SITE, designated SEQ ID:13558, to the nucleotide sequence of VGAM943 RNA, herein designated VGAM RNA, also designated SEQ ID:3654.

Another function of VGAM943 is therefore inhibition of Diaphanous Homolog 2 (Drosophila) (DIAPH2, Accession NM_006729), a gene which may affect in oogenesis. Accordingly, utilities of VGAM943 include diagnosis, prevention and treatment of diseases and clinical conditions associated with DIAPH2. The function of DIAPH2 and its association with various diseases and clinical conditions, has been established by previous studies, as described hereinabove with reference to VGAM129. Glucosaminyl (N-acetyl) Transferase 2, I-branching Enzyme (GCNT2, Accession NM_001491) is another VGAM943 host target gene. GCNT2 BINDING SITE is HOST TARGET binding site found in the 5' untranslated region of mRNA encoded by GCNT2, corresponding to a HOST TARGET binding site such as BINDING SITE I, BINDING SITE II or BINDING SITE III. Table 2 illustrates the complementarity of the nucleotide sequences of GCNT2 BINDING SITE, designated SEQ ID:7240, to the nucleotide sequence of VGAM943 RNA, herein designated VGAM RNA, also designated SEQ ID:3654.

Another function of VGAM943 is therefore inhibition of Glucosaminyl (N-acetyl) Transferase 2, I-branching Enzyme (GCNT2, Accession NM_001491), a gene which converts linear into branched poly-n-acetyllactosaminoglycans. Accordingly, utilities of VGAM943 include diagnosis, prevention and treatment of diseases and clinical conditions associated with GCNT2. The function of GCNT2 has been established by previous studies. The blood group i/I antigens were the first identified alloantigens that display a dramatic change during human development (OMIM Ref. No. 110800). The i and I antigens are determined by linear and branched poly-N-acetyllactosaminoglycans, respectively. In human erythrocytes during embryonic development, the fetal (i) antigen is replaced by the adult (I) antigen as the result of the appearance of a beta-1,6-N-acetylglucosaminyltransferase, the I-branching enzyme (GCNT2). Bierhuizen et al. (1993) cloned the cDNA for the branching enzyme that converts the linear form into the branched form and studied its expression with development of I antigen in transfected cells. The cDNA sequence predicted a protein of type II membrane topology as has been found for all other mammalian glycosyltransferases. Comparison of the amino acid sequence with those of other glycosyltransferases revealed that this I-branching enzyme and another beta-1,6, N-acetylglucosaminyltransferase that forms a branch in O-glycans (GCNT1; 600391) are strongly homologous in the center of their putative catalytic domains.

Full details of the abovementioned studies are described in the following publications, the disclosure of which are hereby incorporated by reference:

Bierhuizen, M. F. A.; Mattei, M.-G.; Fukuda, M.: Expression of the developmental I antigen by a cloned human cDNA encoding a member of a beta-1,6-N-acetylglucosaminyltransferase gene family. Genes Dev. 7:468-478, 1993; and Lin-Chu, M.; Broadberry, R. E.; Okubo, Y.; Tanaka, M.: The i phenotype and congenital cataracts among Chinese in Taiwan (Letter) Transfusion 31:676-677, 1991.

Further studies establishing the function and utilities of GCNT2 are found in John Hopkins OMIM database record ID 600429, and in sited publications numbered 12154-12156, 4585, 758 and 12157-12158 listed in the bibliography section hereinbelow, which are also hereby incorporated by reference. Histidine Ammonia-lyase (HAL, Accession NM_002108) is another VGAM943 host target gene. HAL BINDING SITE is HOST TARGET binding site found in the 5' untranslated region of mRNA encoded by HAL, corresponding to a HOST TARGET binding site such as BINDING SITE I, BINDING SITE II or BINDING SITE III. Table 2 illustrates the complementarity of the nucleotide sequences of HAL BINDING SITE, designated SEQ ID:7887, to the nucleotide sequence of VGAM943 RNA, herein designated VGAM RNA, also designated SEQ ID:3654.

Another function of VGAM943 is therefore inhibition of Histidine Ammonia-lyase (HAL, Accession NM_002108). Accordingly, utilities of VGAM943 include diagnosis, prevention and treatment of diseases and clinical conditions associated with HAL. Sterol Carrier Protein 2 (SCP2, Accession NM_002979) is another VGAM943 host target gene. SCP2 BINDING SITE is HOST TARGET binding site found in the 3' untranslated region of mRNA encoded by SCP2, corresponding to a HOST TARGET binding site such as BINDING SITE I, BINDING SITE II or BINDING SITE III. Table 2 illustrates the complementarity of the nucleotide sequences of SCP2 BINDING SITE, designated SEQ ID:8881, to the nucleotide sequence of VGAM943 RNA, herein designated VGAM RNA, also designated SEQ ID:3654.

Another function of VGAM943 is therefore inhibition of Sterol Carrier Protein 2 (SCP2, Accession NM_002979), a gene which may regulate steroidogenesis. Accordingly, utilities of VGAM943 include diagnosis, prevention and treatment of diseases and clinical conditions associated with SCP2. The function of SCP2 has been established by previous studies. During meiotic prophase, chromosomes are arranged along proteinaceous axes called axial elements. In rat, the major protein components of axial elements are proteins of 30, 33, and 190 kD. The 30- and 33-kD proteins are closely related and appear to be products of a single gene, Scp3 (synaptonemal complex protein-3; 604759). Offenberg et al. (1998) isolated rat testis cDNAs encoding the 190-kD protein, which they designated Scp2. Sequence analysis revealed that Scp2 is a basic protein, with a pI of 8. Scp2 contains 2 clusters of S/T-P motifs, which are common in DNA-binding proteins, and a C-terminal coiled-coil region. In Southwestern blot experiments, recombinant Scp2 bound DNA. Using immunocytology, Offenberg et al. (1998) determined that Scp2 localizes specifically to the synaptonemal complex in the nuclei of rat testis meiotic prophase nuclei. Northern blot analysis indicated that Scp2 is expressed exclusively in testis. The authors noted that Scp2 shows some similarity at the amino acid sequence and secondary structural level to the S. cerevisiae Red1 protein, which is involved in meiotic recombination and the assembly of axial elements of synaptonemal complexes. They speculated that Scp2 is a DNA-binding protein involved in the structural organization of meiotic prophase chromosomes. By screening a human testis library with a partial rat Scp2 cDNA, Schalk et al. (1999) isolated cDNAs encoding human SCP2. The predicted 1,530-amino acid human protein shares 63% amino acid identity with rat Scp2. Like rat Scp2, human SCP2 contains S/T-P motifs, 2 nuclear targeting signals, and a C-terminal coiled-coil region.

Full details of the abovementioned studies are described in the following publications, the disclosure of which are hereby incorporated by reference:

Offenberg, H. H.; Schalk, J. A. C.; Meuwissen, R. L. J.; van Aalderen, M.; Kester, H. A.; Dietrich, A. J. J.; Heyting, C.: SCP2: a major protein component of the axial elements of synaptonemal complexes of the rat. Nucleic Acids Res. 26: 2572-2579, 1998; and Schalk, J. A. C.; Offenberg, H. H.; Peters, E.; Groot, N. P. B.; Hoovers, J. M. N.; Heyting, C.: Isolation and characterization of the human SCP2 cDNA and chromosomal localization of t.

Further studies establishing the function and utilities of SCP2 are found in John Hopkins OMIM database record ID 604105, and in sited publications numbered 7057-7058 listed in the bibliography section hereinbelow, which are also hereby incorporated by reference. FLJ10759 (Accession NM_018207) is another VGAM943 host target gene. FLJ10759 BINDING SITE is HOST TARGET binding site found in the 3' untranslated region of mRNA encoded by FLJ10759, corresponding to a HOST TARGET binding site such as BINDING SITE I, BINDING SITE II or BINDING SITE III. Table 2 illustrates the complementarity of the nucleotide sequences of FLJ10759 BINDING SITE, designated SEQ ID:20103, to the nucleotide sequence of VGAM943 RNA, herein designated VGAM RNA, also designated SEQ ID:3654.

Another function of VGAM943 is therefore inhibition of FLJ10759 (Accession NM_018207). Accordingly, utilities of VGAM943 include diagnosis, prevention and treatment of diseases and clinical conditions associated with FLJ10759. FLJ20151 (Accession NM_017689) is another VGAM943 host target gene. FLJ20151 BINDING SITE is HOST TARGET binding site found in the 3' untranslated region of mRNA encoded by FLJ20151, corresponding to a HOST TARGET binding site such as BINDING SITE I, BINDING SITE II or BINDING SITE III. Table 2 illustrates the complementarity of the nucleotide sequences of FLJ20151 BINDING SITE, designated SEQ ID:19246, to the nucleotide sequence of VGAM943 RNA, herein designated VGAM RNA, also designated SEQ ID:3654.

Another function of VGAM943 is therefore inhibition of FLJ20151 (Accession NM_017689). Accordingly, utilities of VGAM943 include diagnosis, prevention and treatment of diseases and clinical conditions associated with FLJ20151. FLJ21617 (Accession NM_030897) is another VGAM943 host target gene. FLJ21617 BINDING SITE is HOST TARGET binding site found in the 5' untranslated region of mRNA encoded by FLJ21617, corresponding to a HOST TARGET binding site such as BINDING SITE I, BINDING SITE II or BINDING SITE III. Table 2 illustrates the complementarity of the nucleotide sequences of FLJ21617 BINDING SITE, designated SEQ ID:25166, to the nucleotide sequence of VGAM943 RNA, herein designated VGAM RNA, also designated SEQ ID:3654.

Another function of VGAM943 is therefore inhibition of FLJ21617 (Accession NM_030897). Accordingly, utilities of VGAM943 include diagnosis, prevention and treatment of diseases and clinical conditions associated with FLJ21617. KIAA0673 (Accession XM_030915) is another VGAM943 host target gene. KIAA0673 BINDING SITE is HOST TARGET binding site found in the 5' untranslated region of mRNA encoded by KIAA0673, corresponding to a HOST TARGET binding site such as BINDING SITE I, BINDING SITE II or BINDING SITE III. Table 2 illustrates the complementarity of the nucleotide sequences of KIAA0673 BINDING SITE, designated SEQ ID:31214, to the nucleotide sequence of VGAM943 RNA, herein designated VGAM RNA, also designated SEQ ID:3654.

Another function of VGAM943 is therefore inhibition of KIAA0673 (Accession XM_030915). Accordingly, utilities of VGAM943 include diagnosis, prevention and treatment of diseases and clinical conditions associated with KIAA0673. KLK15 (Accession NM_138563) is another VGAM943 host target gene. KLK15 BINDING SITE1 and KLK15 BINDING SITE2 are HOST TARGET binding sites found in untranslated regions of mRNA encoded by KLK15, corresponding to HOST TARGET binding sites such as BINDING SITE I, BINDING SITE II or BINDING SITE III. Table 2 illustrates the complementarity of the nucleotide sequences of KLK15 BINDING SITE1 and KLK15 BINDING SITE2, designated SEQ ID:28861 and SEQ ID:23263 respectively, to the nucleotide sequence of VGAM943 RNA, herein designated VGAM RNA, also designated SEQ ID:3654.

Another function of VGAM943 is therefore inhibition of KLK15 (Accession NM_138563). Accordingly, utilities of VGAM943 include diagnosis, prevention and treatment of diseases and clinical conditions associated with KLK15. Syndecan 3 (N-syndecan) (SDC3, Accession NM_014654) is another VGAM943 host target gene. SDC3 BINDING SITE is HOST TARGET binding site found in the 5' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16084, to the nucleotide sequence of VGAM943 RNA, herein designated VGAM RNA, also designated SEQ ID:3654.

Another function of VGAM943 is therefore inhibition of Syndecan 3 (N-syndecan) (SDC3, Accession NM_014654). Accordingly, utilities of VGAM943 include diagnosis, prevention and treatment of diseases and clinical conditions associated with SDC3. Trans-golgi Network Protein 2 (TGOLN2, Accession XM_034215) is another VGAM943 host target gene. TGOLN2 BINDING SITE is HOST TARGET binding site found in the 3' untranslated region of mRNA encoded by TGOLN2, corresponding to a HOST TARGET binding site such as BINDING SITE I, BINDING SITE II or BINDING SITE III. Table 2 illustrates the complementarity of the nucleotide sequences of TGOLN2 BINDING SITE, designated SEQ ID:32021, to the nucleotide sequence of VGAM943 RNA, herein designated VGAM RNA, also designated SEQ ID:3654.

Another function of VGAM943 is therefore inhibition of Trans-golgi Network Protein 2 (TGOLN2, Accession XM_034215). Accordingly, utilities of VGAM943 include diagnosis, prevention and treatment of diseases and clinical conditions associated with TGOLN2. LOC125268 (Accession XM_071960) is another VGAM943 host target gene. LOC125268 BINDING SITE is HOST TARGET binding site found in the 3' untranslated region of mRNA encoded by LOC125268, corresponding to a HOST TARGET binding site such as BINDING SITE I, BINDING SITE II or BINDING SITE III. Table 2 illustrates the complementarity of the nucleotide sequences of LOC125268 BINDING SITE, designated SEQ ID:37453, to the nucleotide sequence of VGAM943 RNA, herein designated VGAM RNA, also designated SEQ ID:3654.

Another function of VGAM943 is therefore inhibition of LOC125268 (Accession XM_071960). Accordingly, utilities of VGAM943 include diagnosis, prevention and treatment of diseases and clinical conditions associated with LOC125268. LOC144017 (Accession XM_096520) is another VGAM943 host target gene. LOC144017 BINDING SITE is HOST TARGET binding site found in the 5' untranslated region of mRNA encoded by LOC144017, corresponding to a HOST TARGET binding site such as BINDING SITE I, BINDING SITE II or BINDING SITE III. Table 2 illustrates the complementarity of the nucleotide sequences of LOC144017 BINDING SITE, designated SEQ ID:40388, to the nucleotide sequence of VGAM943 RNA, herein designated VGAM RNA, also designated SEQ ID:3654.

Another function of VGAM943 is therefore inhibition of LOC144017 (Accession XM_096520). Accordingly, utilities of VGAM943 include diagnosis, prevention and treatment of diseases and clinical conditions associated with LOC144017. LOC148137 (Accession NM_144692) is another VGAM943 host target gene. LOC148137 BINDING SITE is HOST TARGET binding site found in the 3' untranslated region of mRNA encoded by LOC148137, corresponding to a HOST TARGET binding site such as BINDING SITE I, BINDING SITE II or BINDING SITE III. Table 2 illustrates the complementarity of the nucleotide sequences of LOC148137 BINDING SITE, designated SEQ ID:29513, to the nucleotide sequence of VGAM943 RNA, herein designated VGAM RNA, also designated SEQ ID:3654.

Another function of VGAM943 is therefore inhibition of LOC148137 (Accession NM_144692). Accordingly, utilities of VGAM943 include diagnosis, prevention and treatment of diseases and clinical conditions associated with LOC148137. LOC204970 (Accession XM_114795) is another VGAM943 host target gene. LOC204970 BINDING SITE is HOST TARGET binding site found in the 3' untranslated region of mRNA encoded by LOC204970, corresponding to a HOST TARGET binding site such as BINDING SITE I, BINDING SITE II or BINDING SITE III. Table 2 illustrates the complementarity of the nucleotide sequences of LOC204970 BINDING SITE, designated SEQ ID:43073, to the nucleotide sequence of VGAM943 RNA, herein designated VGAM RNA, also designated SEQ ID:3654.

Another function of VGAM943 is therefore inhibition of LOC204970 (Accession XM_114795). Accordingly, utilities of VGAM943 include diagnosis, prevention and treatment of diseases and clinical conditions associated with LOC204970. LOC219654 (Accession XM_166095) is another VGAM943 host target gene. LOC219654 BINDING SITE is HOST TARGET binding site found in the 3' untranslated region of mRNA encoded by LOC219654, corresponding to a HOST TARGET binding site such as BINDING SITE I, BINDING SITE II or BINDING SITE III. Table 2 illustrates the complementarity of the nucleotide sequences of LOC219654 BINDING SITE, designated SEQ ID:43878, to the nucleotide sequence of VGAM943 RNA, herein designated VGAM RNA, also designated SEQ ID:3654.

Another function of VGAM943 is therefore inhibition of LOC219654 (Accession XM_166095). Accordingly, utilities of VGAM943 include diagnosis, prevention and treatment of diseases and clinical conditions associated with LOC219654. LOC253539 (Accession XM_171134) is another VGAM943 host target gene. LOC253539 BINDING SITE is HOST TARGET binding site found in the 5' untranslated region of mRNA encoded by LOC253539, corresponding to a HOST TARGET binding site such as BINDING SITE I, BINDING SITE II or BINDING SITE III. Table 2 illustrates the complementarity of the nucleotide sequences of LOC253539 BINDING SITE, designated SEQ ID:45938, to the nucleotide sequence of VGAM943 RNA, herein designated VGAM RNA, also designated SEQ ID:3654.

Another function of VGAM943 is therefore inhibition of LOC253539 (Accession XM_171134). Accordingly, utilities of VGAM943 include diagnosis, prevention and treatment of diseases and clinical conditions associated with LOC253539. LOC254559 (Accession XM_172931) is another VGAM943 host target gene. LOC254559 BINDING SITE is HOST TARGET binding site found in the 5' untranslated region of mRNA encoded by LOC254559, corresponding to a HOST TARGET binding site such as BINDING SITE I, BINDING SITE II or BINDING SITE III. Table 2 illustrates the complementarity of the nucleotide sequences of LOC254559 BINDING SITE, designated SEQ ID:46197, to the nucleotide sequence of VGAM943 RNA, herein designated VGAM RNA, also designated SEQ ID:3654.

Another function of VGAM943 is therefore inhibition of LOC254559 (Accession XM_172931). Accordingly, utilities of VGAM943 include diagnosis, prevention and treatment of diseases and clinical conditions associated with LOC254559.

FIG. 1 further provides a conceptual description of a novel bioinformatically detected viral gene of the present invention, referred to here as Viral Genomic Address Messenger 944 (VGAM944) viral gene, which modulates expression of respective host target genes thereof, the function and utility of which host target genes is known in the art.

VGAM944 is a novel bioinformatically detected regulatory, non protein coding, viral micro RNA (miRNA) gene. The method by which VGAM944 was detected is described hereinabove with reference to FIGS. 1-8.

VGAM944 gene, herein designated VGAM GENE, is a viral gene contained in the genome of Human Herpesvirus 7. VGAM944 host target gene, herein designated VGAM HOST TARGET GENE, is a human gene contained in the human genome.

VGAM944 gene encodes a VGAM944 precursor RNA, herein designated VGAM PRECURSOR RNA. Similar to other miRNA genes, and unlike most ordinary genes, VGAM944 precursor RNA does not encode a protein. A nucleotide sequence identical or highly similar to the nucleotide sequence of VGAM944 precursor RNA is designated SEQ ID:930, and is provided hereinbelow with reference to the sequence listing part. Nucleotide sequence SEQ ID:930 is located at position 97457 relative to the genome of Human Herpesvirus 7.

VGAM944 precursor RNA folds onto itself, forming VGAM944 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM944 folded precursor RNA into VGAM944 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM944 RNA is designated SEQ ID:3655, and is provided hereinbelow with reference to the sequence listing part.

VGAM944 host target gene, herein designated VGAM HOST TARGET GENE, encodes a corresponding messenger RNA, VGAM944 host target RNA, herein designated VGAM HOST TARGET RNA. VGAM944 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM944 RNA, herein designated VGAM RNA, binds complementarily to one or more host target binding sites located in untranslated regions of VGAM944 host target RNA, herein designated VGAM HOST TARGET RNA. This complementary binding is due to the fact that the nucleotide sequence of VGAM944 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM944 RNA, herein designated VGAM RNA, may have a different number of host target binding sites in untranslated regions of a VGAM944 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM944 RNA, herein designated VGAM RNA, to host target binding sites on VGAM944 host target RNA, herein designated VGAM HOST TARGET RNA, such as BINDING SITE I, BINDING SITE II and BINDING SITE III, inhibits translation of VGAM944 host target RNA into VGAM944 host target protein, herein designated VGAM HOST TARGET PROTEIN. VGAM host target protein is therefore outlined by a broken line.

It is appreciated that VGAM944 host target gene, herein designated VGAM HOST TARGET GENE, in fact represents a plurality of VGAM944 host target genes. The mRNA of each one of this plurality of VGAM944 host target genes comprises one or more host target binding sites, each having a nucleotide sequence which is at least partly complementary to VGAM944 RNA, herein designated VGAM RNA, and which when bound by VGAM944 RNA causes inhibition of translation of respective one or more VGAM944 host target proteins.

It is further appreciated by one skilled in the art that the mode of translational inhibition illustrated by FIG. 1 with specific reference to translational inhibition exerted by VGAM944 gene, herein designated VGAM GENE, on one or more VGAM944 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM944 is inhibition of expression of host target genes, as part of a novel viral mechanism of attacking a host. Accordingly, utilities of VGAM944 include diagnosis, prevention and treatment of viral infection by Human Herpesvirus 7. Specific functions, and accordingly utilities, of VGAM944 correlate with, and may be deduced from, the identity of the host target genes which VGAM944 binds and inhibits, and the function of these host target genes, as elaborated hereinbelow.

Nucleotide sequences of the VGAM944 precursor RNA, herein designated VGAM PRECURSOR RNA, and of the 'diced' VGAM944 RNA, herein designated VGAM RNA, and a schematic representation of the secondary folding of VGAM944 folded precursor RNA, herein designated VGAM FOLDED PRECURSOR RNA, of VGAM944 are further described hereinbelow with reference to Table 1.

Nucleotide sequences of host target binding sites, such as BINDING SITE-I, BINDING SITE-II and BINDING SITE-III of FIG. 1, found on VGAM944 host target RNA, and schematic representation of the complementarity of each of these host target binding sites to VGAM944 RNA, herein designated VGAM RNA, are described hereinbelow with reference to Table 2.

As mentioned hereinabove with reference to FIG. 1, a function of VGAM944 gene, herein designated VGAM is inhibition of expression of VGAM944 target genes. It is appreciated that specific functions, and accordingly utilities, of VGAM944 correlate with, and may be deduced from, the identity of the target genes which VGAM944 binds and inhibits, and the function of these target genes, as elaborated hereinbelow.

PRO1386 (Accession NM_031269) is a VGAM944 host target gene. PRO1386 BINDING SITE is HOST TARGET binding site found in the 3' untranslated region of mRNA encoded by PRO1386, corresponding to a HOST TARGET binding site such as BINDING SITE I, BINDING SITE II or BINDING SITE III. Table 2 illustrates the complementarity of the nucleotide sequences of PRO1386 BINDING SITE, designated SEQ ID:25289, to the nucleotide sequence of VGAM944 RNA, herein designated VGAM RNA, also designated SEQ ID:3655.

A function of VGAM944 is therefore inhibition of PRO1386 (Accession NM_031269). Accordingly, utilities of VGAM944 include diagnosis, prevention and treatment of diseases and clinical conditions associated with PRO1386. FIG. 1 further provides a conceptual description of a novel bioinformatically detected viral gene of the present invention, referred to here as Viral Genomic Address Messenger 945 (VGAM945) viral gene, which modulates expression of respective host target genes thereof, the function and utility of which host target genes is known in the art.

VGAM945 is a novel bioinformatically detected regulatory, non protein coding, viral micro RNA (miRNA) gene. The method by which VGAM945 was detected is described hereinabove with reference to FIGS. 1-8.

VGAM945 gene, herein designated VGAM GENE, is a viral gene contained in the genome of Human Herpesvirus 7. VGAM945 host target gene, herein designated VGAM HOST TARGET GENE, is a human gene contained in the human genome.

VGAM945 gene encodes a VGAM945 precursor RNA, herein designated VGAM PRECURSOR RNA. Similar to other miRNA genes, and unlike most ordinary genes, VGAM945 precursor RNA does not encode a protein. A nucleotide sequence identical or highly similar to the nucleotide sequence of VGAM945 precursor RNA is designated SEQ ID:931, and is provided hereinbelow with reference to the sequence listing part. Nucleotide sequence SEQ ID:931 is located at position 98645 relative to the genome of Human Herpesvirus 7.

VGAM945 precursor RNA folds onto itself, forming VGAM945 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM945 folded precursor RNA into VGAM945 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM945 RNA is designated SEQ ID:3656, and is provided hereinbelow with reference to the sequence listing part.

VGAM945 host target gene, herein designated VGAM HOST TARGET GENE, encodes a corresponding messenger RNA, VGAM945 host target RNA, herein designated VGAM HOST TARGET RNA. VGAM945 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM945 RNA, herein designated VGAM RNA, binds complementarily to one or more host target binding sites located in untranslated regions of VGAM945 host target RNA, herein designated VGAM HOST TARGET RNA. This complementary binding is due to the fact that the nucleotide sequence of VGAM945 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM945 RNA, herein designated VGAM RNA, may have a different number of host target binding sites in untranslated regions of a VGAM945 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM945 RNA, herein designated VGAM RNA, to host target binding sites on VGAM945 host target RNA, herein designated VGAM HOST TARGET RNA, such as BINDING SITE I, BINDING SITE II and BINDING SITE III, inhibits translation of VGAM945 host target RNA into VGAM945 host target protein, herein designated VGAM HOST TARGET PROTEIN. VGAM host target protein is therefore outlined by a broken line.

It is appreciated that VGAM945 host target gene, herein designated VGAM HOST TARGET GENE, in fact represents a plurality of VGAM945 host target genes. The mRNA of each one of this plurality of VGAM945 host target genes comprises one or more host target binding sites, each having a nucleotide sequence which is at least partly complementary to VGAM945 RNA, herein designated VGAM RNA, and which when bound by VGAM945 RNA causes inhibition of translation of respective one or more VGAM945 host target proteins.

It is further appreciated by one skilled in the art that the mode of translational inhibition illustrated by FIG. 1 with specific reference to translational inhibition exerted by VGAM945 gene, herein designated VGAM GENE, on one or more VGAM945 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM945 is inhibition of expression of host target genes, as part of a novel viral mechanism of attacking a host. Accordingly, utilities of VGAM945 include diagnosis, prevention and treatment of viral infection by Human Herpesvirus 7. Specific functions, and accordingly utilities, of VGAM945 correlate with, and may be deduced from, the identity of the host target genes which VGAM945 binds and inhibits, and the function of these host target genes, as elaborated hereinbelow.

Nucleotide sequences of the VGAM945 precursor RNA, herein designated VGAM PRECURSOR RNA, and of the 'diced' VGAM945 RNA, herein designated VGAM RNA, and a schematic representation of the secondary folding of VGAM945 folded precursor RNA, herein designated VGAM FOLDED PRECURSOR RNA, of VGAM945 are further described hereinbelow with reference to Table 1.

Nucleotide sequences of host target binding sites, such as BINDING SITE-I, BINDING SITE-II and BINDING SITE-III of FIG. 1, found on VGAM945 host target RNA, and schematic representation of the complementarity of each of these host target binding sites to VGAM945 RNA, herein designated VGAM RNA, are described hereinbelow with reference to Table 2.

As mentioned hereinabove with reference to FIG. 1, a function of VGAM945 gene, herein designated VGAM is inhibition of expression of VGAM945 target genes. It is appreciated that specific functions, and accordingly utilities, of VGAM945 correlate with, and may be deduced from, the identity of the target genes which VGAM945 binds and inhibits, and the function of these target genes, as elaborated hereinbelow.

Potassium Inwardly-rectifying Channel, Subfamily J, Member 1 (KCNJ1, Accession NM_000220) is a VGAM945 host target gene. KCNJ1 BINDING SITE is HOST TARGET binding site found in the 5' untranslated region of mRNA encoded by KCNJ1, corresponding to a HOST TARGET binding site such as BINDING SITE I, BINDING SITE II or BINDING SITE III. Table 2 illustrates the complementarity of the nucleotide sequences of KCNJ1 BINDING SITE, designated SEQ ID:5727, to the nucleotide sequence of VGAM945 RNA, herein designated VGAM RNA, also designated SEQ ID:3656.

A function of VGAM945 is therefore inhibition of Potassium Inwardly-rectifying Channel, Subfamily J, Member 1 (KCNJ1, Accession NM_000220). Accordingly, utilities of VGAM945 include diagnosis, prevention and treatment of diseases and clinical conditions associated with KCNJ1. Transcription Factor Dp-1 (TFDP1, Accession NM_007111) is another VGAM945 host target gene. TFDP1 BINDING SITE is HOST TARGET binding site found in the 3' untranslated region of mRNA encoded by TFDP1, corresponding to a HOST TARGET binding site such as BINDING SITE I, BINDING SITE II or BINDING SITE III. Table 2 illustrates the complementarity of the nucleotide sequences of TFDP1 BINDING SITE, designated SEQ ID:13977, to the nucleotide sequence of VGAM945 RNA, herein designated VGAM RNA, also designated SEQ ID:3656.

Another function of VGAM945 is therefore inhibition of Transcription Factor Dp-1 (TFDP1, Accession NM_007111). Accordingly, utilities of VGAM945 include diagnosis, prevention and treatment of diseases and clinical conditions associated with TFDP1. Von Hippel-Lindau Binding Protein 1 (VBP1, Accession NM_003372) is another VGAM945 host target gene. VBP1 BINDING SITE is HOST TARGET binding site found in the 3' untranslated region of mRNA encoded by VBP1, corresponding to a HOST TARGET binding site such as BINDING SITE I, BINDING SITE II or BINDING SITE III. Table 2 illustrates the complementarity of the nucleotide sequences of VBP1 BINDING SITE, designated SEQ ID:9400, to the nucleotide sequence of VGAM945 RNA, herein designated VGAM RNA, also designated SEQ ID:3656.

Another function of VGAM945 is therefore inhibition of Von Hippel-Lindau Binding Protein 1 (VBP1, Accession NM_003372), a gene which binds specifically to cytosolic chaperonin (c-cpn) and transfers target proteins to it. Accordingly, utilities of VGAM945 include diagnosis, prevention and treatment of diseases and clinical conditions associated with VBP1. The function of VBP1 has been established by previous studies. Brinke et al. (1996) reported the presence of a novel inversion in the factor VIII (OMIM Ref. No. 306700) gene in hemophilic monozygotic twins. Brinke et al. (1996) noted that this novel inversion creates 2 hybrid transcription units. One of these is formed by the promoter and first exon of factor VIII and novel sequences. Brinke et al. (1997) determined that these novel sequences were part of the VBP1 gene. The VBP1 gene contains 6 exons and spans at least 30 kb. Northern blot analysis revealed that VBP1 is ubiquitously expressed as a 1.7-kb mRNA and a much weaker 5.0-kb mRNA. By primer extension analysis, Brinke et al. (1997) found that there are 2 major and 1 minor transcription start sites. Brinke et al. (1997) cloned cDNAs of the mouse VBP1 homolog. The 160-amino acid mouse and human VBP1 protein sequences were identical. Clifford et al. (1999) could demonstrate no mutation in VBP1 in 89 sporadic cases of renal cell carcinoma. Hemberger et al. (1999) used the murine Vbp1 cDNA to investigate the expression of the Vbp1 mRNA in the mouse by in situ hybridization and Northern blot analysis. In fetal stages between days 9 and 18 of gestation, Vbp1 was expressed mainly in the central nervous system, retina, and liver. In addition, at day 12, high expression was observed in the labyrinthine region of the placenta. In later stage placentas, Vbp1 expression was, however, considerably reduced. Northern blot analysis of adult mouse tissues showed that Vbp1 was ubiquitously expressed. In situ analysis of several adult tissues showed that in most tissues the transcripts were evenly distributed. In brain, eye, kidney, and intestine, however, Vbp1 was expressed in specific cell types. In cerebellum and various tumors of VHL patients, no consistent differences in VBP1 expression levels could be detected between tumors characteristic of von Hippel-Lindau disease and normal tissue. Mapping of the murine Vbp1 gene revealed conserved chromosomal localization between mouse and human in a region homologous to human Xq28.

Full details of the abovementioned studies are described in the following publications, the disclosure of which are hereby incorporated by reference:

Brinke, A.; Tagliavacca, L.; Naylor, J.; Green, P.; Giangrande, P.; Giannelli, F.: Two chimaeric transcription units result from an inversion breaking intron 1 of the factor VIII gene and a region reportedly affected by reciprocal translocations in T-cell leukaemia. Hum. Molec. Genet. 5:1945-1951, 1996; and Hemberger, M.; Himmelbauer, H.; Neumann, H. P. H.; Plate, K. H.; Schwarzkopf, G.; Fundele, R.: Expression of the von Hippel-Lindau-binding protein-1 (Vbp1) in fetal and adult mouse tissue.

Further studies establishing the function and utilities of VBP1 are found in John Hopkins OMIM database record ID 300133, and in sited publications numbered 8945-8949 listed in the bibliography section hereinbelow, which are also hereby incorporated by reference. F-box Protein 30 (FBXO30, Accession NM_032145) is another VGAM945 host target gene. FBXO30 BINDING SITE is HOST TARGET binding site found in the 3' untranslated region of mRNA encoded by FBXO30, corresponding to a HOST TARGET binding site such as BINDING SITE I, BINDING SITE II or BINDING SITE III. Table 2 illustrates the complementarity of the nucleotide sequences of FBXO30 BINDING SITE, designated SEQ ID:25839, to the nucleotide sequence of VGAM945 RNA, herein designated VGAM RNA, also designated SEQ ID:3656.

Another function of VGAM945 is therefore inhibition of F-box Protein 30 (FBXO30, Accession NM_032145). Accordingly, utilities of VGAM945 include diagnosis, prevention and treatment of diseases and clinical conditions associated with FBXO30. FLJ23112 (Accession NM_024929) is another VGAM945 host target gene. FLJ23112 BINDING SITE is HOST TARGET binding site found in the 5' untranslated region of mRNA encoded by FLJ23112, corresponding to a HOST TARGET binding site such as BINDING SITE I, BINDING SITE II or BINDING SITE III. Table 2 illustrates the complementarity of the nucleotide sequences of FLJ23112 BINDING SITE, designated SEQ ID:24467, to the nucleotide sequence of VGAM945 RNA, herein designated VGAM RNA, also designated SEQ ID:3656.

Another function of VGAM945 is therefore inhibition of FLJ23112 (Accession NM_024929). Accordingly, utilities of VGAM945 include diagnosis, prevention and treatment of diseases and clinical conditions associated with FLJ23112. MGC13114 (Accession NM_032366) is another VGAM945 host target gene. MGC13114 BINDING SITE is HOST TARGET binding site found in the 3' untranslated region of mRNA encoded by MGC13114, corresponding to a HOST TARGET binding site such as BINDING SITE I, BINDING SITE II or BINDING SITE III. Table 2 illustrates the complementarity of the nucleotide sequences of MGC13114 BINDING SITE, designated SEQ ID:26154, to the nucleotide sequence of VGAM945 RNA, herein designated VGAM RNA, also designated SEQ ID:3656.

Another function of VGAM945 is therefore inhibition of MGC13114 (Accession NM_032366). Accordingly, utilities of VGAM945 include diagnosis, prevention and treatment of diseases and clinical conditions associated with MGC13114. Sprouty Homolog 2 (Drosophila) (SPRY2, Accession NM_005842) is another VGAM945 host target gene. SPRY2 BINDING SITE is HOST TARGET binding site found in the 3' untranslated region of mRNA encoded by SPRY2, corresponding to a HOST TARGET binding site such as BINDING SITE I, BINDING SITE II or BINDING SITE III. Table 2 illustrates the complementarity of the nucleotide sequences of SPRY2 BINDING SITE, designated SEQ ID:12456, to the nucleotide sequence of VGAM945 RNA, herein designated VGAM RNA, also designated SEQ ID:3656.

Another function of VGAM945 is therefore inhibition of Sprouty Homolog 2 (Drosophila) (SPRY2, Accession NM_005842). Accordingly, utilities of VGAM945 include diagnosis, prevention and treatment of diseases and clinical conditions associated with SPRY2. LOC144871 (Accession XM_096698) is another VGAM945 host target gene. LOC144871 BINDING SITE is HOST TARGET binding site found in the 3' untranslated region of mRNA encoded by LOC144871, corresponding to a HOST TARGET binding site such as BINDING SITE I, BINDING SITE II or BINDING SITE III. Table 2 illustrates the complementarity of the nucleotide sequences of LOC144871 BINDING SITE, designated SEQ ID:40470, to the nucleotide sequence of VGAM945 RNA, herein designated VGAM RNA, also designated SEQ ID:3656.

Another function of VGAM945 is therefore inhibition of LOC144871 (Accession XM_096698). Accordingly, utilities of VGAM945 include diagnosis, prevention and treatment of diseases and clinical conditions associated with LOC144871. LOC145988 (Accession XM_085290) is another VGAM945 host target gene. LOC145988 BINDING SITE is HOST TARGET binding site found in the 5' untranslated region of mRNA encoded by LOC145988, corresponding to a HOST TARGET binding site such as BINDING SITE I, BINDING SITE II or BINDING SITE III. Table 2 illustrates the complementarity of the nucleotide sequences of LOC145988 BINDING SITE, designated SEQ ID:38040, to the nucleotide sequence of VGAM945 RNA, herein designated VGAM RNA, also designated SEQ ID:3656.

Another function of VGAM945 is therefore inhibition of LOC145988 (Accession XM_085290). Accordingly, utilities of VGAM945 include diagnosis, prevention and treatment of diseases and clinical conditions associated with LOC145988. LOC219940 (Accession XM_167791) is another VGAM945 host target gene. LOC219940 BINDING SITE is HOST TARGET binding site found in the 3' untranslated region of mRNA encoded by LOC219940, corresponding to a HOST TARGET binding site such as BINDING SITE I, BINDING SITE II or BINDING SITE III. Table 2 illustrates the complementarity of the nucleotide sequences of LOC219940 BINDING SITE, designated SEQ ID:44834, to the nucleotide sequence of VGAM945 RNA, herein designated VGAM RNA, also designated SEQ ID:3656.

Another function of VGAM945 is therefore inhibition of LOC219940 (Accession XM_167791). Accordingly, utilities of VGAM945 include diagnosis, prevention and treatment of diseases and clinical conditions associated with LOC219940. FIG. 1 further provides a conceptual description of a novel bioinformatically detected viral gene of the present invention, referred to here as Viral Genomic Address Messenger 946 (VGAM946) viral gene, which modulates expression of respective host target genes thereof, the function and utility of which host target genes is known in the art.

VGAM946 is a novel bioinformatically detected regulatory, non protein coding, viral micro RNA (miRNA) gene. The method by which VGAM946 was detected is described hereinabove with reference to FIGS. 1-8.

VGAM946 gene, herein designated VGAM GENE, is a viral gene contained in the genome of Human Herpesvirus 6. VGAM946 host target gene, herein designated VGAM HOST TARGET GENE, is a human gene contained in the human genome.

VGAM946 gene encodes a VGAM946 precursor RNA, herein designated VGAM PRECURSOR RNA. Similar to other miRNA genes, and unlike most ordinary genes, VGAM946 precursor RNA does not encode a protein. A nucleotide sequence identical or highly similar to the nucleotide sequence of VGAM946 precursor RNA is designated SEQ ID:932, and is provided hereinbelow with reference to the sequence listing part. Nucleotide sequence SEQ ID:932 is located at position 80004 relative to the genome of Human Herpesvirus 6.

VGAM946 precursor RNA folds onto itself, forming VGAM946 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM946 folded precursor RNA into VGAM946 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM946 RNA is designated SEQ ID:3657, and is provided hereinbelow with reference to the sequence listing part.

VGAM946 host target gene, herein designated VGAM HOST TARGET GENE, encodes a corresponding messenger RNA, VGAM946 host target RNA, herein designated VGAM HOST TARGET RNA. VGAM946 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM946 RNA, herein designated VGAM RNA, binds complementarily to one or more host target binding sites located in untranslated regions of VGAM946 host target RNA, herein designated VGAM HOST TARGET RNA. This complementary binding is due to the fact that the nucleotide sequence of VGAM946 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM946 RNA, herein designated VGAM RNA, may have a different number of host target binding sites in untranslated regions of a VGAM946 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM946 RNA, herein designated VGAM RNA, to host target binding sites on VGAM946 host target RNA, herein designated VGAM HOST TARGET RNA, such as BINDING SITE I, BINDING SITE II and BINDING SITE III, inhibits translation of VGAM946 host target RNA into VGAM946 host target protein, herein designated VGAM HOST TARGET PROTEIN. VGAM host target protein is therefore outlined by a broken line.

It is appreciated that VGAM946 host target gene, herein designated VGAM HOST TARGET GENE, in fact represents a plurality of VGAM946 host target genes. The mRNA of each one of this plurality of VGAM946 host target genes comprises one or more host target binding sites, each having a nucleotide sequence which is at least partly complementary to VGAM946 RNA, herein designated VGAM RNA, and which when bound by VGAM946 RNA causes inhibition of translation of respective one or more VGAM946 host target proteins.

It is further appreciated by one skilled in the art that the mode of translational inhibition illustrated by FIG. 1 with specific reference to translational inhibition exerted by VGAM946 gene, herein designated VGAM GENE, on one or more VGAM946 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM946 is inhibition of expression of host target genes, as part of a novel viral mechanism of attacking a host. Accordingly, utilities of VGAM946 include diagnosis, prevention and treatment of viral infection by Human Herpesvirus 6. Specific functions, and accordingly utilities, of VGAM946 correlate with, and may be deduced from, the identity of the host target genes which VGAM946 binds and inhibits, and the function of these host target genes, as elaborated hereinbelow.

Nucleotide sequences of the VGAM946 precursor RNA, herein designated VGAM PRECURSOR RNA, and of the 'diced' VGAM946 RNA, herein designated VGAM RNA, and a schematic representation of the secondary folding of VGAM946 folded precursor RNA, herein designated VGAM FOLDED PRECURSOR RNA, of VGAM946 are further described hereinbelow with reference to Table 1.

Nucleotide sequences of host target binding sites, such as BINDING SITE-I, BINDING SITE-II and BINDING SITE-III of FIG. 1, found on VGAM946 host target RNA, and schematic representation of the complementarity of each of these host target binding sites to VGAM946 RNA, herein designated VGAM RNA, are described hereinbelow with reference to Table 2.

As mentioned hereinabove with reference to FIG. 1, a function of VGAM946 gene, herein designated VGAM is inhibition of expression of VGAM946 target genes. It is appreciated that specific functions, and accordingly utilities, of VGAM946 correlate with, and may be deduced from, the identity of the target genes which VGAM946 binds and inhibits, and the function of these target genes, as elaborated hereinbelow.

Cytoskeleton Associated Protein 2 (CKAP2, Accession NM_018204) is a VGAM946 host target gene. CKAP2 BINDING SITE is HOST TARGET binding site found in the 3' untranslated region of mRNA encoded by CKAP2, corresponding to a HOST TARGET binding site such as BINDING SITE I, BINDING SITE II or BINDING SITE III. Table 2 illustrates the complementarity of the nucleotide sequences of CKAP2 BINDING SITE, designated SEQ ID:20088, to the nucleotide sequence of VGAM946 RNA, herein designated VGAM RNA, also designated SEQ ID:3657.

A function of VGAM946 is therefore inhibition of Cytoskeleton Associated Protein 2 (CKAP2, Accession NM_018204). Accordingly, utilities of VGAM946 include diagnosis, prevention and treatment of diseases and clinical conditions associated with CKAP2. KIAA0427 (Accession NM_014772) is another VGAM946 host target gene. KIAA0427 BINDING SITE is HOST TARGET binding site found in the 5' untranslated region of mRNA encoded by KIAA0427, corresponding to a HOST TARGET binding site such as BINDING SITE I, BINDING SITE II or BINDING SITE III. Table 2 illustrates the complementarity of the nucleotide sequences of KIAA0427 BINDING SITE, designated SEQ ID:16574, to the nucleotide sequence of VGAM946 RNA, herein designated VGAM RNA, also designated SEQ ID:3657.

Another function of VGAM946 is therefore inhibition of KIAA0427 (Accession NM_014772). Accordingly, utilities of VGAM946 include diagnosis, prevention and treatment of diseases and clinical conditions associated with KIAA0427. MGC15705 (Accession NM_032757) is another VGAM946 host target gene. MGC15705 BINDING SITE is HOST TARGET binding site found in the 3' untranslated region of mRNA encoded by MGC15705, corresponding to a HOST TARGET binding site such as BINDING SITE I, BINDING SITE II or BINDING SITE III. Table 2 illustrates the complementarity of the nucleotide sequences of MGC15705 BINDING SITE, designated SEQ ID:26498, to the nucleotide sequence of VGAM946 RNA, herein designated VGAM RNA, also designated SEQ ID:3657.

Another function of VGAM946 is therefore inhibition of MGC15705 (Accession NM_032757). Accordingly, utilities of VGAM946 include diagnosis, prevention and treatment of diseases and clinical conditions associated with MGC15705. Mitochondrial Ribosomal Protein L10 (MRPL10, Accession NM_145255) is another VGAM946 host target gene. MRPL10 BINDING SITE is HOST TARGET binding site found in the 3' untranslated region of mRNA encoded by MRPL10, corresponding to a HOST TARGET binding site such as BINDING SITE I, BINDING SITE II or BINDING SITE III. Table 2 illustrates the complementarity of the nucleotide sequences of MRPL10 BINDING SITE, designated SEQ ID:29769, to the nucleotide sequence of VGAM946 RNA, herein designated VGAM RNA, also designated SEQ ID:3657.

Another function of VGAM946 is therefore inhibition of Mitochondrial Ribosomal Protein L10 (MRPL10, Accession NM_145255). Accordingly, utilities of VGAM946 include diagnosis, prevention and treatment of diseases and clinical conditions associated with MRPL10. LOC220021 (Accession XM_167814) is another VGAM946 host target gene. LOC220021 BINDING SITE is HOST TARGET binding site found in the 5' untranslated region of mRNA encoded by LOC220021, corresponding to a HOST TARGET binding site such as BINDING SITE I, BINDING SITE II or BINDING SITE III. Table 2 illustrates the complementarity of the nucleotide sequences of LOC220021 BINDING SITE, designated SEQ ID:44851, to the nucleotide sequence of VGAM946 RNA, herein designated VGAM RNA, also designated SEQ ID:3657.

Another function of VGAM946 is therefore inhibition of LOC220021 (Accession XM_167814). Accordingly, utilities of VGAM946 include diagnosis, prevention and treatment of diseases and clinical conditions associated with LOC220021. LOC91012 (Accession XM_035503) is another VGAM946 host target gene. LOC91012 BINDING SITE is HOST TARGET binding site found in the 5' untranslated region of mRNA encoded by LOC91012, corresponding to a HOST TARGET binding site such as BINDING SITE I, BINDING SITE II or BINDING SITE III. Table 2 illustrates the complementarity of the nucleotide sequences of LOC91012 BINDING SITE, designated SEQ ID:32278, to the nucleotide sequence of VGAM946 RNA, herein designated VGAM RNA, also designated SEQ ID:3657.

Another function of VGAM946 is therefore inhibition of LOC91012 (Accession XM_035503). Accordingly, utilities of VGAM946 include diagnosis, prevention and treatment of diseases and clinical conditions associated with LOC91012. FIG. 1 further provides a conceptual description of a novel bioinformatically detected viral gene of the present invention, referred to here as Viral Genomic Address Messenger 947

(VGAM947) viral gene, which modulates expression of respective host target genes thereof, the function and utility of which host target genes is known in the art.

VGAM947 is a novel bioinformatically detected regulatory, non protein coding, viral micro RNA (miRNA) gene. The method by which VGAM947 was detected is described hereinabove with reference to FIGS. 1-8.

VGAM947 gene, herein designated VGAM GENE, is a viral gene contained in the genome of Human Herpesvirus 6. VGAM947 host target gene, herein designated VGAM HOST TARGET GENE, is a human gene contained in the human genome.

VGAM947 gene encodes a VGAM947 precursor RNA, herein designated VGAM PRECURSOR RNA. Similar to other miRNA genes, and unlike most ordinary genes, VGAM947 precursor RNA does not encode a protein. A nucleotide sequence identical or highly similar to the nucleotide sequence of VGAM947 precursor RNA is designated SEQ ID:933, and is provided hereinbelow with reference to the sequence listing part. Nucleotide sequence SEQ ID:933 is located at position 76244 relative to the genome of Human Herpesvirus 6.

VGAM947 precursor RNA folds onto itself, forming VGAM947 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM947 folded precursor RNA into VGAM947 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM947 RNA is designated SEQ ID:3658, and is provided hereinbelow with reference to the sequence listing part.

VGAM947 host target gene, herein designated VGAM HOST TARGET GENE, encodes a corresponding messenger RNA, VGAM947 host target RNA, herein designated VGAM HOST TARGET RNA. VGAM947 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM947 RNA, herein designated VGAM RNA, binds complementarily to one or more host target binding sites located in untranslated regions of VGAM947 host target RNA, herein designated VGAM HOST TARGET RNA. This complementary binding is due to the fact that the nucleotide sequence of VGAM947 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM947 RNA, herein designated VGAM RNA, may have a different number of host target binding sites in untranslated regions of a VGAM947 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM947 RNA, herein designated VGAM RNA, to host target binding sites on VGAM947 host target RNA, herein designated VGAM HOST TARGET RNA, such as BINDING SITE I, BINDING SITE II and BINDING SITE III, inhibits translation of VGAM947 host target RNA into VGAM947 host target protein, herein designated VGAM HOST TARGET PROTEIN. VGAM host target protein is therefore outlined by a broken line.

It is appreciated that VGAM947 host target gene, herein designated VGAM HOST TARGET GENE, in fact represents a plurality of VGAM947 host target genes. The mRNA of each one of this plurality of VGAM947 host target genes comprises one or more host target binding sites, each having a nucleotide sequence which is at least partly complementary to VGAM947 RNA, herein designated VGAM RNA, and which when bound by VGAM947 RNA causes inhibition of translation of respective one or more VGAM947 host target proteins.

It is further appreciated by one skilled in the art that the mode of translational inhibition illustrated by FIG. 1 with specific reference to translational inhibition exerted by VGAM947 gene, herein designated VGAM GENE, on one or more VGAM947 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM947 is inhibition of expression of host target genes, as part of a novel viral mechanism of attacking a host. Accordingly, utilities of VGAM947 include diagnosis, prevention and treatment of viral infection by Human Herpesvirus 6. Specific functions, and accordingly utilities, of VGAM947 correlate with, and may be deduced from, the identity of the host target genes which VGAM947 binds and inhibits, and the function of these host target genes, as elaborated hereinbelow.

Nucleotide sequences of the VGAM947 precursor RNA, herein designated VGAM PRECURSOR RNA, and of the 'diced' VGAM947 RNA, herein designated VGAM RNA, and a schematic representation of the secondary folding of VGAM947 folded precursor RNA, herein designated VGAM FOLDED PRECURSOR RNA, of VGAM947 are further described hereinbelow with reference to Table 1.

Nucleotide sequences of host target binding sites, such as BINDING SITE-I, BINDING SITE-II and BINDING SITE-III of FIG. 1, found on VGAM947 host target RNA, and schematic representation of the complementarity of each of these host target binding sites to VGAM947 RNA, herein designated VGAM RNA, are described hereinbelow with reference to Table 2.

As mentioned hereinabove with reference to FIG. 1, a function of VGAM947 gene, herein designated VGAM is inhibition of expression of VGAM947 target genes. It is appreciated that specific functions, and accordingly utilities, of VGAM947 correlate with, and may be deduced from, the identity of the target genes which VGAM947 binds and inhibits, and the function of these target genes, as elaborated hereinbelow.

Procollagen (type III) N-endopeptidase (PCOLN3, Accession NM_002768) is a VGAM947 host target gene. PCOLN3 BINDING SITE is HOST TARGET binding site found in the 3' untranslated region of mRNA encoded by PCOLN3, corresponding to a HOST TARGET binding site such as BINDING SITE I, BINDING SITE II or BINDING SITE III. Table 2 illustrates the complementarity of the nucleotide sequences of PCOLN3 BINDING SITE, designated SEQ ID:8661, to the nucleotide sequence of VGAM947 RNA, herein designated VGAM RNA, also designated SEQ ID:3658.

A function of VGAM947 is therefore inhibition of Procollagen (type III) N-endopeptidase (PCOLN3, Accession NM_002768), a gene which is a member of the zincin superfamily of zinc-dependent metalloproteases. Accordingly, utilities of VGAM947 include diagnosis, prevention and treatment of diseases and clinical conditions associated with PCOLN3. The function of PCOLN3 has been established by previous studies. Metallopeptidases are a functionally diverse group of enzymes that are involved in critical stages of many biologic processes including bacterial pathogenesis, growth factor activation, and cancer metastasis. They are essential for the synthesis of the collagen that forms the fibrous scaffold of the extracellular matrix of tissues. Most metallopeptidases contain a zinc cation necessary for both structure coordination of the active site and catalysis. The zincin superfamily comprises metallopeptidases that contain the HEXXH zinc-binding consensus sequence. The 2 histidine residues serve as zinc ligands, and the glutamic acid residue polarizes a water molecule involved in the nucleophilic attack of peptide bonds. Subclassification is based on the identity of other amino acids that act as zinc ligands. Gluzincins, for example, have glutamic acid as a third zinc ligand. Halila et al. (1989) isolated a possible cDNA for type III procollagen N-proteinase (OMIM Ref. No. PCOLN3) from a human placenta cDNA library. By screening a human placenta cDNA library with polyclonal antibodies raised against human PCOLN3 and the use of 5-prime RACE and primer extension strategies on the isolated cDNAs, Scott et al. (1996) identified a gene, which they symbolized PRSM1, that is a member of the gluzincin subfamily of metallopeptidases. The full-length composite sequence of the PRSM1 gene encodes a deduced 318-amino acid protein with an HELGH pentapeptide fitting the consensus sequence characteristic of zincins, and a glutamic acid 25 residues C-terminal of the first histidine, fitting the pattern of gluzincins for a third zinc-binding ligand. PRSM1 contains 3 clusters of cysteine residues: 1 cluster of 4 residues and 1 cluster of 6 residues at the N terminus and a cluster of 6 residues at the C terminus. However, the predicted sequence lacks potential glycosylation sites. Immunoblot analysis of placental tissue revealed an approximately 30-kD protein. Northern blot analysis of human fibroblast culture mRNA detected a transcript of approximately 2.5 kb. By Northern blot analysis, Nomura et al. (1994) found that PRSM1, which they designated KIAA0047, is expressed ubiquitously, with highest levels in lung and kidney as well as in HeLa and KG-1 cell lines.

Full details of the abovementioned studies are described in the following publications, the disclosure of which are hereby incorporated by reference:

Scott, I. C.; Halila, R.; Jenkins, J. M.; Mehan, S.; Apostolou, S.; Winqvist, R.; Callen, D. F.; Prockop, D. J.; Peltonen, L.; Kadler, K. E.: Molecular cloning, expression and chromosomal localization of a human gene encoding a 33 kDa putative metallopeptidase (PRSM1). Gene 174:135-143, 1996; and Nomura, N.; Nagase, T.; Miyajima, N.; Sazuka, T.; Tanaka, A.; Sato, S.; Seki, N.; Kawarabayasi, Y.; Ishikawa, K.; Tabata, S.: Prediction of the coding sequences of unidentified human ge.

Further studies establishing the function and utilities of PCOLN3 are found in John Hopkins OMIM database record ID 164010, and in sited publications numbered 2253-225 and 12737 listed in the bibliography section hereinbelow, which are also hereby incorporated by reference. FIG. 1 further provides a conceptual description of a novel bioinformatically detected viral gene of the present invention, referred to here as Viral Genomic Address Messenger 948 (VGAM948) viral gene, which modulates expression of respective host target genes thereof, the function and utility of which host target genes is known in the art.

VGAM948 is a novel bioinformatically detected regulatory, non protein coding, viral micro RNA (miRNA) gene. The method by which VGAM948 was detected is described hereinabove with reference to FIGS. 1-8.

VGAM948 gene, herein designated VGAM GENE, is a viral gene contained in the genome of Carnation Italian Ringspot Virus. VGAM948 host target gene, herein designated VGAM HOST TARGET GENE, is a human gene contained in the human genome.

VGAM948 gene encodes a VGAM948 precursor RNA, herein designated VGAM PRECURSOR RNA. Similar to other miRNA genes, and unlike most ordinary genes, VGAM948 precursor RNA does not encode a protein. A nucleotide sequence identical or highly similar to the nucleotide sequence of VGAM948 precursor RNA is designated SEQ ID:934, and is provided hereinbelow with reference to the sequence listing part. Nucleotide sequence SEQ ID:934 is located at position 1710 relative to the genome of Carnation Italian Ringspot Virus.

VGAM948 precursor RNA folds onto itself, forming VGAM948 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM948 folded precursor RNA into VGAM948 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 75%) nucleotide sequence of VGAM948 RNA is designated SEQ ID:3659, and is provided hereinbelow with reference to the sequence listing part.

VGAM948 host target gene, herein designated VGAM HOST TARGET GENE, encodes a corresponding messenger RNA, VGAM948 host target RNA, herein designated VGAM HOST TARGET RNA. VGAM948 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM948 RNA, herein designated VGAM RNA, binds complementarily to one or more host target binding sites located in untranslated regions of VGAM948 host target RNA, herein designated VGAM HOST TARGET RNA. This complementary binding is due to the fact that the nucleotide sequence of VGAM948 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM948 RNA, herein designated VGAM RNA, may have a different number of host target binding sites in untranslated regions of a VGAM948 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM948 RNA, herein designated VGAM RNA, to host target binding sites on VGAM948 host target RNA, herein designated VGAM HOST TARGET RNA, such as BINDING SITE I, BINDING SITE II and BINDING SITE III, inhibits translation of VGAM948 host target RNA into VGAM948 host target protein, herein designated VGAM HOST TARGET PROTEIN. VGAM host target protein is therefore outlined by a broken line.

It is appreciated that VGAM948 host target gene, herein designated VGAM HOST TARGET GENE, in fact represents a plurality of VGAM948 host target genes. The mRNA of each one of this plurality of VGAM948 host target genes comprises one or more host target binding sites, each having a nucleotide sequence which is at least partly complementary to VGAM948 RNA, herein designated VGAM RNA, and which when bound by VGAM948 RNA causes inhibition of translation of respective one or more VGAM948 host target proteins.

It is further appreciated by one skilled in the art that the mode of translational inhibition illustrated by FIG. 1 with specific reference to translational inhibition exerted by VGAM948 gene, herein designated VGAM GENE, on one or more VGAM948 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM948 is inhibition of expression of host target genes, as part of a novel viral mechanism of attacking a host. Accordingly, utilities of VGAM948 include diagnosis, prevention and treatment of viral infection by Carnation Italian Ringspot Virus. Specific functions, and accordingly utilities, of VGAM948 correlate with, and may be deduced from, the identity of the host target genes which VGAM948 binds and inhibits, and the function of these host target genes, as elaborated hereinbelow.

Nucleotide sequences of the VGAM948 precursor RNA, herein designated VGAM PRECURSOR RNA, and of the 'diced' VGAM948 RNA, herein designated VGAM RNA, and a schematic representation of the secondary folding of VGAM948 folded precursor RNA, herein designated VGAM FOLDED PRECURSOR RNA, of VGAM948 are further described hereinbelow with reference to Table 1.

Nucleotide sequences of host target binding sites, such as BINDING SITE-I, BINDING SITE-II and BINDING SITE-III of FIG. 1, found on VGAM948 host target RNA, and schematic representation of the complementarity of each of these host target binding sites to VGAM948 RNA, herein designated VGAM RNA, are described hereinbelow with reference to Table 2.

As mentioned hereinabove with reference to FIG. 1, a function of VGAM948 gene, herein designated VGAM is inhibition of expression of VGAM948 target genes. It is appreciated that specific functions, and accordingly utilities, of VGAM948 correlate with, and may be deduced from, the identity of the target genes which VGAM948 binds and inhibits, and the function of these target genes, as elaborated hereinbelow.

CD1A Antigen, A Polypeptide (CD1A, Accession XM_048792) is a VGAM948 host target gene. CD1A BINDING SITE is HOST TARGET binding site found in the 5' untranslated region of mRNA encoded by CD1A, corresponding to a HOST TARGET binding site such as BINDING SITE I, BINDING SITE II or BINDING SITE III. Table 2 illustrates the complementarity of the nucleotide sequences of CD1A BINDING SITE, designated SEQ ID:35271, to the nucleotide sequence of VGAM948 RNA, herein designated VGAM RNA, also designated SEQ ID:3659.

A function of VGAM948 is therefore inhibition of CD1A Antigen, A Polypeptide (CD1A, Accession XM_048792), a gene which is involved in antigen presentation. Accordingly, utilities of VGAM948 include diagnosis, prevention and treatment of diseases and clinical conditions associated with CD1A. The function of CD1A has been established by previous studies. Thymocyte antigens CD1 were thought to be human counterparts of mouse thymus leukemia (TL) antigens (OMIM Ref. No. 188850). Serological and biochemical analyses indicated the existence of at least 3 subsets, the first of which was initially identified by a monoclonal antibody. Like TL antigens, CD1 antigens are expressed on cortical thymocytes, as well as on some lymphoid neoplasias, and resemble in structure the major histocompatibility complex class I antigens. (CD in the nomenclature of these cell surface antigens is derived from 'cluster of differentiation.') The expression of surface markers correlates with the stage of differentiation of lymphocytes, hence they were referred to as differentiation markers and proved to be powerful tools for identification, characterization, and analysis. The concept of differentiation markers, although derived from studies on lymphocytes, has greater applicability. For example, the developing embryo has stage-specific markers, and many other developing systems can be studied by utilizing unique markers at certain stages of differentiation. Monoclonal antibodies facilitated greatly the identification of lymphocyte differentiation antigens; it also brought about a Tower of Babel in nomenclature as discoverers of new markers gave them new names without regard to possible identity to previously described antigens. In 1982, the First International Workshop in Human Leukocyte Differentiation Antigens was held in Paris. At that meeting, 139 monoclonal antibodies were tested by immunofluorescence, and the antibodies were grouped into 'clusters' on the basis of the results. At the Fifth International Congress of Immunology, held in Kyoto, Japan, in 1983, the nomenclature subcommittee officially adopted this scheme of nomenclature. The idea of the 'cluster of differentiation' was to group all known antibodies that reacted with the same marker. When new antigens are discovered, they are sometimes said to be 'clustered' when their relationship to other CDs has been determined. CD4 (OMIM Ref. No. 186940) and CD8 (OMIM Ref. No. 186910) are at the heart of many immunologic mechanisms. Park and Bendelac (2000) noted that the crystal structure of murine CD1D (see OMIM Ref. No. Zeng et al., 1997), showing a deep ligand-binding groove made of 2 large electrostatically neutral pockets lined with clustered hydrophobic residues, appears to suggest a way in which CD1 molecules, which complex with B2M (OMIM Ref. No. 109700), bind lipids. Park and Bendelac (2000) also observed that the stable lipid binding might occur in the secretory pathway, at the cell surface, or only after internalization in an acidified compartment. The intracellular locations include different compartments of the endocytic pathway: CD1A is concentrated in the early or recycling endosome, CD1B and CD1D in the late endosome or lysosome, and CD1C in the late endosome. Access to the endocytic pathway is regulated by a tyrosine-based motif in the cytoplasmic tail of CD1 that differs among CD1B, CD1C, and CD1D.

Full details of the abovementioned studies are described in the following publications, the disclosure of which are hereby incorporated by reference:

Park, S.-H.; Bendelac, A.: CD1-restricted T-cell responses and microbial infection. Nature 406:788-792, 2000; and Martin, L. H.; Calabi, F.; Milstein, C.: Isolation of CD1 genes: a family of major histocompatibility complex-related differentiation antigens. Proc. Nat. Acad. Sci. 83:9154-9158, 198.

Further studies establishing the function and utilities of CD1A are found in John Hopkins OMIM database record ID 188370, and in sited publications numbered 10280-10282, 10428-10430, 393 and 10279-5696 listed in the bibliography section hereinbelow, which are also hereby incorporated by reference. Deleted In Lymphocytic Leukemia, 2 (DLEU2, Accession NM_006021) is another VGAM948 host target gene. DLEU2 BINDING SITE is HOST TARGET binding site found in the 5' untranslated region of mRNA encoded by DLEU2, corresponding to a HOST TARGET binding site such as BINDING SITE I, BINDING SITE II or BINDING SITE III. Table 2 illustrates the complementarity of the nucleotide sequences of DLEU2 BINDING SITE, designated SEQ ID:12638, to the nucleotide sequence of VGAM948 RNA, herein designated VGAM RNA, also designated SEQ ID:3659.

Another function of VGAM948 is therefore inhibition of Deleted In Lymphocytic Leukemia, 2 (DLEU2, Accession NM_006021). Accordingly, utilities of VGAM948 include diagnosis, prevention and treatment of diseases and clinical conditions associated with DLEU2. Eukaryotic Translation Elongation Factor 1 Beta 2 (EEF1B2, Accession NM_001959) is another VGAM948 host target gene. EEF1B2 BINDING SITE is HOST TARGET binding site found in the 5' untranslated region of mRNA encoded by EEF1B2, corresponding to a HOST TARGET binding site such as BINDING SITE I, BINDING SITE II or BINDING SITE III. Table 2 illustrates the complementarity of the nucleotide sequences of EEF1B2 BINDING SITE, designated SEQ ID:7682, to the nucleotide sequence of VGAM948 RNA, herein designated VGAM RNA, also designated SEQ ID:3659.

Another function of VGAM948 is therefore inhibition of Eukaryotic Translation Elongation Factor 1 Beta 2 (EEF1B2, Accession NM_001959), a gene which stimulates the exchange of gdp bound to ef-1-alpha to gtp (by similarity). Accordingly, utilities of VGAM948 include diagnosis, prevention and treatment of diseases and clinical conditions associated with EEF1B2. The function of EEF1B2 has been established by previous studies. Sanders et al. (1991) identified a human cDNA by hybridization with a pig EF-1 beta probe. The gene was subsequently mapped by Pizzuti et al. (1993) to chromosome 2 by PCR analysis of a somatic cell hybrid DNA panel. The gene is referred to here as 'isoform 2a' of EEF1-beta because of its chromosome 2 location.

Full details of the abovementioned studies are described in the following publications, the disclosure of which are hereby incorporated by reference:

Pizzuti, A.; Gennarelli, M.; Novelli, G.; Colosimo, A.; Cicero, S. L.; Caskey, C. T.; Dallapiccola, B.: Human elongation factor EF-1-beta: cloning and characterization of the EF1-beta-5a gene and assignment of EF-1-beta isoforms to chromosomes 2, 5, 15 and X. Biochem. Biophys. Res. Commun. 197:154-162, 1993; and Sanders, J.; Maassen, J. A.; Amons, R.; Moller, W.: Nucleotide sequence of human elongation factor-1-beta cDNA. Nucleic Acids Res. 19:4551, 1991.

Further studies establishing the function and utilities of EEF1B2 are found in John Hopkins OMIM database record ID 600655, and in sited publications numbered 87 and 7930 listed in the bibliography section hereinbelow, which are also hereby incorporated by reference. Glutamate-ammonia Ligase (glutamine synthase) (GLUL, Accession NM_002065) is another VGAM948 host target gene. GLUL BINDING SITE is HOST TARGET binding site found in the 3' untranslated region of mRNA encoded by GLUL, corresponding to a HOST TARGET binding site such as BINDING SITE I, BINDING SITE II or BINDING SITE III. Table 2 illustrates the complementarity of the nucleotide sequences of GLUL BINDING SITE, designated SEQ ID:7834, to the nucleotide sequence of VGAM948 RNA, herein designated VGAM RNA, also designated SEQ ID:3659.

Another function of VGAM948 is therefore inhibition of Glutamate-ammonia Ligase (glutamine synthase) (GLUL, Accession NM_002065), a gene which catalyzes the condensation of glutamate and ammonia to form glutamine. Accordingly, utilities of VGAM948 include diagnosis, prevention and treatment of diseases and clinical conditions associated with GLUL. The function of GLUL has been established by previous studies. Glutamine synthetase (EC 6.3.1.2), also called glutamate-ammonia ligase (GLUL), is expressed throughout the body and plays an important role in controlling body pH and in removing ammonia from the circulation. The enzyme clears L-glutamate, the major neurotransmitter in the central nervous system, from neuronal synapses (see OMIM Ref. No. references in Clancy et al., 1996). Gibbs et al. (1987) reported the complete 1,119-bp coding sequence of glutamine synthetase, which they determined from a liver-derived cDNA. Pesole et al. (1991) suggested that glutamine synthetase is a good molecular clock for determining times of divergence even as great as that which occurred between eukaryotes and prokaryotes. One conclusion reached by Pesole et al. (1991) was that organelle-specific enzymes, such as those of the mitochondria, may have originated from a duplication of nuclear genes. The endosymbiotic hypothesis suggests that a transfer of prokaryotic genes to nuclei occurred during the evolution of the primitive eukaryotic cell. In some cases, it is likely that the old prokaryotic gene could not be active in the new nuclear genome environment and was totally lost because its function in the organelle could be dispensed with. Subsequently, a new organelle-specific enzyme could have originated to serve specialized metabolic functions. The presence of glutamine synthetase in mitochondria is linked to the nitrogen metabolism of the species, and in particular to the need for glutamine as a source of ammonia and for particular biochemical pathways for ammonia detoxification.

Full details of the abovementioned studies are described in the following publications, the disclosure of which are hereby incorporated by reference:

Gibbs, C. S.; Campbell, K. E.; Wilson, R. H.: Sequence of a human glutamine synthetase cDNA. Nucleic Acids Res. 15:6293 only, 1987; and Pesole, G.; Bozzetti, M. P.; Lanave, C.; Preparata, G.; Saccone, C.: Glutamine synthetase gene evolution: a good molecular clock. Proc. Nat. Acad. Sci. 88:522-526, 1991.

Further studies establishing the function and utilities of GLUL are found in John Hopkins OMIM database record ID 138290, and in sited publications numbered 2012-2017 listed in the bibliography section hereinbelow, which are also hereby incorporated by reference. LOC220753 (Accession XM_167549) is another VGAM948 host target gene. LOC220753 BINDING SITE is HOST TARGET binding site found in the 5' untranslated region of mRNA encoded by LOC220753, corresponding to a HOST TARGET binding site such as BINDING SITE I, BINDING SITE II or BINDING SITE III. Table 2 illustrates the complementarity of the nucleotide sequences of LOC220753 BINDING SITE, designated SEQ ID:44660, to the nucleotide sequence of VGAM948 RNA, herein designated VGAM RNA, also designated SEQ ID:3659.

Another function of VGAM948 is therefore inhibition of LOC220753 (Accession XM_167549). Accordingly, utilities of VGAM948 include diagnosis, prevention and treatment of diseases and clinical conditions associated with LOC220753. FIG. 1 further provides a conceptual description of a novel bioinformatically detected viral gene of the present invention, referred to here as Viral Genomic Address Messenger 949 (VGAM949) viral gene, which modulates expression of respective host target genes thereof, the function and utility of which host target genes is known in the art.

VGAM949 is a novel bioinformatically detected regulatory, non protein coding, viral micro RNA (miRNA) gene. The method by which VGAM949 was detected is described hereinabove with reference to FIGS. 1-8.

VGAM949 gene, herein designated VGAM GENE, is a viral gene contained in the genome of Carnation Italian Ringspot Virus. VGAM949 host target gene, herein designated VGAM HOST TARGET GENE, is a human gene contained in the human genome.

VGAM949 gene encodes a VGAM949 precursor RNA, herein designated VGAM PRECURSOR RNA. Similar to other miRNA genes, and unlike most ordinary genes, VGAM949 precursor RNA does not encode a protein. A nucleotide sequence identical or highly similar to the nucleotide sequence of VGAM949 precursor RNA is designated SEQ ID:935, and is provided hereinbelow with reference to the sequence listing part. Nucleotide sequence SEQ ID:935 is located at position 2039 relative to the genome of Carnation Italian Ringspot Virus.

VGAM949 precursor RNA folds onto itself, forming VGAM949 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM949 folded precursor RNA into VGAM949 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM949 RNA is designated SEQ ID:3660, and is provided hereinbelow with reference to the sequence listing part.

VGAM949 host target gene, herein designated VGAM HOST TARGET GENE, encodes a corresponding messenger RNA, VGAM949 host target RNA, herein designated VGAM HOST TARGET RNA. VGAM949 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM949 RNA, herein designated VGAM RNA, binds complementarily to one or more host target binding sites located in untranslated regions of VGAM949 host target RNA, herein designated VGAM HOST TARGET RNA. This complementary binding is due to the fact that the nucleotide sequence of VGAM949 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM949 RNA, herein designated VGAM RNA, may have a different number of host target binding sites in untranslated regions of a VGAM949 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM949 RNA, herein designated VGAM RNA, to host target binding sites on VGAM949 host target RNA, herein designated VGAM HOST TARGET RNA, such as BINDING SITE I, BINDING SITE II and BINDING SITE III, inhibits translation of VGAM949 host target RNA into VGAM949 host target protein, herein designated VGAM HOST TARGET PROTEIN. VGAM host target protein is therefore outlined by a broken line.

It is appreciated that VGAM949 host target gene, herein designated VGAM HOST TARGET GENE, in fact represents a plurality of VGAM949 host target genes. The mRNA of each one of this plurality of VGAM949 host target genes comprises one or more host target binding sites, each having a nucleotide sequence which is at least partly complementary to VGAM949 RNA, herein designated VGAM RNA, and which when bound by VGAM949 RNA causes inhibition of translation of respective one or more VGAM949 host target proteins.

It is further appreciated by one skilled in the art that the mode of translational inhibition illustrated by FIG. 1 with specific reference to translational inhibition exerted by VGAM949 gene, herein designated VGAM GENE, on one or more VGAM949 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM949 is inhibition of expression of host target genes, as part of a novel viral mechanism of attacking a host. Accordingly, utilities of VGAM949 include diagnosis, prevention and treatment of viral infection by Carnation Italian Ringspot Virus. Specific functions, and accordingly utilities, of VGAM949 correlate with, and may be deduced from, the identity of the host target genes which VGAM949 binds and inhibits, and the function of these host target genes, as elaborated hereinbelow.

Nucleotide sequences of the VGAM949 precursor RNA, herein designated VGAM PRECURSOR RNA, and of the 'diced' VGAM949 RNA, herein designated VGAM RNA, and a schematic representation of the secondary folding of VGAM949 folded precursor RNA, herein designated VGAM FOLDED PRECURSOR RNA, of VGAM949 are further described hereinbelow with reference to Table 1.

Nucleotide sequences of host target binding sites, such as BINDING SITE-I, BINDING SITE-II and BINDING SITE-III of FIG. 1, found on VGAM949 host target RNA, and schematic representation of the complementarity of each of these host target binding sites to VGAM949 RNA, herein designated VGAM RNA, are described hereinbelow with reference to Table 2.

As mentioned hereinabove with reference to FIG. 1, a function of VGAM949 gene, herein designated VGAM is inhibition of expression of VGAM949 target genes. It is appreciated that specific functions, and accordingly utilities, of VGAM949 correlate with, and may be deduced from, the identity of the target genes which VGAM949 binds and inhibits, and the function of these target genes, as elaborated hereinbelow.

APM1 (Accession NM_004797) is a VGAM949 host target gene. APM1 BINDING SITE1 and APM1 BINDING SITE2 are HOST TARGET binding sites found in untranslated regions of mRNA encoded by APM1, corresponding to HOST TARGET binding sites such as BINDING SITE I, BINDING SITE II or BINDING SITE III. Table 2 illustrates the complementarity of the nucleotide sequences of APM1 BINDING SITE1 and APM1 BINDING SITE2, designated SEQ ID:11206 and SEQ ID:11212 respectively, to the nucleotide sequence of VGAM949 RNA, herein designated VGAM RNA, also designated SEQ ID:3660.

A function of VGAM949 is therefore inhibition of APM1 (Accession NM_004797). Accordingly, utilities of VGAM949 include diagnosis, prevention and treatment of diseases and clinical conditions associated with APM1. Caspase 8, Apoptosis-related Cysteine Protease (CASP8, Accession NM_033357) is another VGAM949 host target gene. CASP8 BINDING SITE is HOST TARGET binding site found in the 3' untranslated region of mRNA encoded by CASP8, corresponding to a HOST TARGET binding site such as BINDING SITE I, BINDING SITE II or BINDING SITE III. Table 2 illustrates the complementarity of the nucleotide sequences of CASP8 BINDING SITE, designated SEQ ID:27205, to the nucleotide sequence of VGAM949 RNA, herein designated VGAM RNA, also designated SEQ ID:3660.

Another function of VGAM949 is therefore inhibition of Caspase 8, Apoptosis-related Cysteine Protease (CASP8, Accession NM_033357), a gene which is an apoptosis-related caspase and an upstream component of Fas receptor and tumor necrosis factor (TNF) receptor-induced apoptosis. Accordingly, utilities of VGAM949 include diagnosis, prevention and treatment of diseases and clinical conditions associated with CASP8. The function of CASP8 and its association with various diseases and clinical conditions, has been established by previous studies, as described hereinabove with reference to VGAM145. Coronin, Actin Binding Protein, 1C (CORO1C, Accession NM_014325) is another VGAM949 host target gene. CORO1C BINDING SITE is HOST TARGET binding site found in the 3' untranslated region of mRNA encoded by CORO1C, corresponding to a HOST TARGET binding site such as BINDING SITE I, BINDING SITE II or BINDING SITE III. Table 2 illustrates the complementarity of the nucleotide sequences of CORO1C BINDING SITE, designated SEQ ID:15628, to the nucleotide sequence of VGAM949 RNA, herein designated VGAM RNA, also designated SEQ ID:3660.

Another function of VGAM949 is therefore inhibition of Coronin, Actin Binding Protein, 1C (CORO1C, Accession NM_014325). Accordingly, utilities of VGAM949 include diagnosis, prevention and treatment of diseases and clinical conditions associated with CORO1C. DNA (cytosine-5-)-methyltransferase 3 Beta (DNMT3B, Accession NM_006892) is another VGAM949 host target gene. DNMT3B BINDING SITE is HOST TARGET binding site found in the 3' untranslated region of mRNA encoded by DNMT3B, corresponding to a HOST TARGET binding site such as BINDING SITE I, BINDING SITE II or BINDING SITE III. Table 2 illustrates the complementarity of the nucleotide sequences of DNMT3B BINDING SITE, designated SEQ ID:13759, to the nucleotide sequence of VGAM949 RNA, herein designated VGAM RNA, also designated SEQ ID:3660.

Another function of VGAM949 is therefore inhibition of DNA (cytosine-5-)-methyltransferase 3 Beta (DNMT3B, Accession NM_006892), a gene which is required for genome wide de novo methylation. Accordingly, utilities of VGAM949 include diagnosis, prevention and treatment of diseases and clinical conditions associated with DNMT3B. The function of DNMT3B and its association with various diseases and clinical conditions, has been established by previous studies, as described hereinabove with reference to VGAM280. Eukaryotic Translation Initiation Factor 3, Subunit 10 Theta, 150/170 kDa (EIF3S10, Accession XM_049795) is another VGAM949 host target gene. EIF3S10 BINDING SITE is HOST TARGET binding site found in the 3" untranslated region of mRNA encoded by EIF3S10, corresponding to a HOST TARGET binding site such as BINDING SITE I, BINDING SITE II or BINDING SITE III. Table 2 illustrates the complementarity of the nucleotide sequences of EIF3S10 BINDING SITE, designated SEQ ID:35502, to the nucleotide sequence of VGAM949 RNA, herein designated VGAM RNA, also designated SEQ ID:3660.

Another function of VGAM949 is therefore inhibition of Eukaryotic Translation Initiation Factor 3, Subunit 10 Theta, 150/170 kDa (EIF3S10, Accession XM_049795), a gene which binds to the 40s ribosome and promotes the binding of methionyl-trnai and mrna. Accordingly, utilities of VGAM949 include diagnosis, prevention and treatment of diseases and clinical conditions associated with EIF3S10. The function of EIF3S10 and its association with various diseases and clinical conditions, has been established by previous studies, as described hereinabove with reference to VGAM882. FAT Tumor Suppressor Homolog 2 (Drosophila) (FAT2, Accession NM_001447) is another VGAM949 host target gene. FAT2 BINDING SITE is HOST TARGET binding site found in the 3' untranslated region of mRNA encoded by FAT2, corresponding to a HOST TARGET binding site such as BINDING SITE I, BINDING SITE II or BINDING SITE III. Table 2 illustrates the complementarity of the nucleotide sequences of FAT2 BINDING SITE, designated SEQ ID:7174, to the nucleotide sequence of VGAM949 RNA, herein designated VGAM RNA, also designated SEQ ID:3660.

Another function of VGAM949 is therefore inhibition of FAT Tumor Suppressor Homolog 2 (Drosophila) (FAT2, Accession NM_001447), a gene which could function as a cell-adhesion protein. Accordingly, utilities of VGAM949 include diagnosis, prevention and treatment of diseases and clinical conditions associated with FAT2. The function of FAT2 has been established by previous studies. The domain that characterizes epidermal growth factor (EGF; 131530) consists of approximately 50 amino acids with 3 disulfide bonds. EGF-like domains are believed to play a critical role in a number of extracellular events, including cell adhesion and receptor-ligand interactions. Proteins with EGF-like domains often consist of more than 1,000 amino acids, have multiple copies of the EGF-like domain, and contain additional domains known to be involved in specific protein-protein interactions. To identify proteins containing EGF-like domains, Nakayama et al. (1998) searched a database of long cDNA sequences randomly selected from a human brain cDNA library for those that encode an EGF-like motif. They identified several partial cDNAs encoding novel proteins with EGF-like domains, such as FAT2, which they named MEGF1. Nakayama et al. (1998) isolated a rat cDNA containing the complete Megf1 coding sequence. The predicted Megf1 protein has a signal sequence, 34 cadherin motifs (see OMIM Ref. No. 603006), a laminin G domain (see OMIM Ref. No. 601033), 2 EGF-like domains, a transmembrane domain, a cytoplasmic proline-rich sequence, and a cytoplasmic RGD (arginine-glycine-aspartic acid) motif, which is found in proteins modulating cell adhesion. The predicted structure of Megf1 is similar overall to the structures of the Drosophila 'fat' gene product and human FAT (OMIM Ref. No. 600976), although the number of EGF-like domains varies among these proteins. The Drosophila fat gene is a tumor suppressor gene whose product controls cell proliferation and morphogenesis in the imaginal discs in a contact-dependent manner. Northern blot analysis of various regions of rat brain detected Megf1 expression only in the cerebellum.

Full details of the abovementioned studies are described in the following publications, the disclosure of which are hereby incorporated by reference:

Nakayama, M.; Nakajima, D.; Nagase, T.; Nomura, N.; Seki, N.; Ohara, O.: Identification of high-molecular-weight proteins with multiple EGF-like motifs by motif-trap screening. Genomics 51:27-34, 1998; and Wu, Q.; Maniatis, T.: Large exons encoding multiple ectodomains are a characteristic feature of protocadherin genes. Proc. Nat. Acad. Sci. 97:3124-3129, 2000.

Further studies establishing the function and utilities of FAT2 are found in John Hopkins OMIM database record ID 604269, and in sited publications numbered 7437-7438 listed in the bibliography section hereinbelow, which are also hereby incorporated by reference. Nucleosome Assembly Protein 1-like 4 (NAP1L4, Accession NM_005969) is another VGAM949 host target gene. NAP1L4 BINDING SITE is HOST TARGET binding site found in the 3' untranslated region of mRNA encoded by NAP1L4, corresponding to a HOST TARGET binding site such as BINDING SITE I, BINDING SITE II or BINDING SITE III. Table 2 illustrates the complementarity of the nucleotide sequences of NAP1L4 BINDING SITE, designated SEQ ID:12589, to the nucleotide sequence of VGAM949 RNA, herein designated VGAM RNA, also designated SEQ ID:3660.

Another function of VGAM949 is therefore inhibition of Nucleosome Assembly Protein 1-like 4 (NAP1L4, Accession NM_005969), a gene which may have a role as a histone chaperone. Accordingly, utilities of VGAM949 include diagnosis, prevention and treatment of diseases and clinical conditions associated with NAP1L4. The function of NAP1L4 has been established by previous studies. Hu et al. (1996) used a positional cloning approach to isolate a gene which is located 100 kb centromeric to the proximal Beckwith-Wiedemann breakpoint cluster region (BWS; 130650) on chromosome 11p15. This gene is homologous to the yeast nucleosome assembly protein NAP1 (OMIM Ref. No. 164060). The authors designated the new gene NAP2. They demonstrated that this gene shows biallelic expression in all tissues tested and that it therefore diverges in its expression from IGF2 (OMIM Ref. No. 147470), H19 (OMIM Ref. No. 103280), and p57(KIP2) (OMIM Ref. No. 600856), which also map to 11p15.5 in the vicinity of the BWS gene. The NAP2 gene encodes a highly acidic protein of 375 amino acids. A 1,200-bp 3-prime untranslated region was present. Rodriguez et al. (1997) reported that the NAP1L4 gene consists of 14 exons and spans approximately 30.5 kb. Histones are thought to play a key role in regulating gene expression at the level of DNA packaging. The deduced amino acid sequence of NAP2 indicates that it is a protein with a potential nuclear localization motif and 2 clusters of highly acidic residues. By functional analysis of recombinant NAP2 protein purified from Escherichia coli, Rodriguez et al. (1997) found that this protein can interact with both core and linker histones (see OMIM Ref. No. 142709). They demonstrated that recombinant NAP2 can transfer histones onto naked DNA templates. Subcellular localization studies of NAP2 indicated that it can shuttle between the cytoplasm and nucleus, suggesting a role as a histone chaperone. NAP1L4 maps to a region implicated in Wilms tumor etiology (see OMIM Ref. No. 194071). Rodriguez et al. (1997) analyzed the gene encoding NAP2 for mutations and found no evidence of nonsense, frameshift, or deletion mutations. Their findings, coupled with tumor suppression assays in Wilms tumor cells, did not support a role for NAP2 in the etiology of that neoplasm.

Full details of the abovementioned studies are described in the following publications, the disclosure of which are hereby incorporated by reference:

Hu, R.-J.; Lee, M. P.; Johnson, L. A.; Feinberg, A. P.: A novel human homologue of yeast nucleosome assembly protein, 65 kb centromeric to the p57(KIP2) gene, is biallelically expressed in fetal and adult tissues. Hum. Molec. Genet. 5:1743-1748, 1996; and Rodriguez, P.; Munroe, D.; Prawitt, D.; Chu, L. L.; Bric, E.; Kim, J.; Reid, L. H.; Davies, C.; Nakagama, H.; Loebbert, R.; Winterpacht, A.; Petruzzi, M.-J.; Higgins, M. J.; Nowak, N.

Further studies establishing the function and utilities of NAP1L4 are found in John Hopkins OMIM database record ID 601651, and in sited publications numbered 6557-6558 listed in the bibliography section hereinbelow, which are also hereby incorporated by reference. Phosphoprotein Enriched In Astrocytes 15 (PEA15, Accession NM_003768) is another VGAM949 host target gene. PEA15 BINDING SITE is HOST TARGET binding site found in the 3' untranslated region of mRNA encoded by PEA15, corresponding to a HOST TARGET binding site such as BINDING SITE I, BINDING SITE II or BINDING SITE III. Table 2 illustrates the complementarity of the nucleotide sequences of PEA15 BINDING SITE, designated SEQ ID:9845, to the nucleotide sequence of VGAM949 RNA, herein designated VGAM RNA, also designated SEQ ID:3660.

Another function of VGAM949 is therefore inhibition of Phosphoprotein Enriched In Astrocytes 15 (PEA15, Accession NM_003768), a gene which is a phosphoprotein and involved in glucose uptake. Accordingly, utilities of VGAM949 include diagnosis, prevention and treatment of diseases and clinical conditions associated with PEA15. The function of PEA15 has been established by previous studies. Astrocytes are involved in a variety of functions, including storage of glycogen and support for the migration and differentiation of neurons. They express membrane receptors which allow them to respond to extracellular signals. Activation of the receptors induces a cascade of events, such as the stimulation of protein kinases and the subsequent phosphorylation of target proteins. Araujo et al. (1993) identified a unique 15-kD protein in astrocytes that exists as a nonphosphorylated form and as 2 increasingly phosphorylated varieties. This protein, which they called PEA15, contains a consensus site for protein kinase C (PKC; e.g., 176960) and is an endogenous substrate for PKC. Using differential display to identify genes whose expressions are altered in tissues derived from type II diabetes mellitus (OMIM Ref. No. 125853) patients compared with nondiabetic individuals, Condorelli et al. (1998) cloned cDNAs encoding PEA15, which they named PED for 'phosphoprotein enriched in diabetes'. The ubiquitously expressed 2.8-kb PED mRNA was overexpressed in fibroblasts, skeletal muscle, and adipose tissue from type II diabetics. Levels of the 15-kD PED phosphoprotein were also elevated in type II diabetic tissues. The authors demonstrated that transfection of a PED cDNA into differentiating L6 skeletal muscle cells increases the content of glucose transporter-1 (GLUT1; 138140) on the plasma membrane and inhibits insulin-stimulated glucose transport and cell surface recruitment of glucose transporter-4 (GLUT4; 138190). These effects were reversed by blocking PKC activity.

Full details of the abovementioned studies are described in the following publications, the disclosure of which are hereby incorporated by reference:

Araujo, H.; Danziger, N.; Cordier, J.; Glowinski, J.; Chneiweiss, H.: Characterization of PEA-15, a major substrate for protein kinase C in astrocytes. J. Biol. Chem. 268:5911-5920, 1993; and Condorelli, G.; Vigliotta, G.; Iavarone, C.; Caruso, M.; Tocchetti, C. G.; Andreozzi, F.; Cafieri, A.; Tecce, M. F.; Formisano, P.; Beguinot, L.; Beguinot, F.: PED/PEA-15 gene controls.

Further studies establishing the function and utilities of PEA15 are found in John Hopkins OMIM database record ID 603434, and in sited publications numbered 5348-5354 listed in the bibliography section hereinbelow, which are also hereby incorporated by reference. Peanut-like 2 (Drosophila) (PNUTL2, Accession NM_080417) is another VGAM949 host target gene. PNUTL2 BINDING SITE is HOST TARGET binding site found in the 3' untranslated region of mRNA encoded by PNUTL2, corresponding to a HOST TARGET binding site such as BINDING SITE I, BINDING SITE II or BINDING SITE III. Table 2 illustrates the complementarity of the nucleotide sequences of PNUTL2 BINDING SITE, designated SEQ ID:27836, to the nucleotide sequence of VGAM949 RNA, herein designated VGAM RNA, also designated SEQ ID:3660.

Another function of VGAM949 is therefore inhibition of Peanut-like 2 (Drosophila) (PNUTL2, Accession NM_080417), a gene which is involved in cytokinesis. Accordingly, utilities of VGAM949 include diagnosis, prevention and treatment of diseases and clinical conditions associated with PNUTL2. The function of PNUTL2 and its association with various diseases and clinical conditions, has been established by previous studies, as described hereinabove with reference to VGAM95. Sodium Channel, Voltage-gated, Type I, Alpha Polypeptide (SCN1A, Accession XM_114281) is another VGAM949 host target gene. SCN1A BINDING SITE is HOST TARGET binding site found in the 3" untranslated region of mRNA encoded by SCN1A, corresponding to a HOST TARGET binding site such as BINDING SITE I, BINDING SITE II or BINDING SITE III. Table 2 illustrates the complementarity of the nucleotide sequences of SCN1A BINDING SITE, designated SEQ ID:42832, to the nucleotide sequence of VGAM949 RNA, herein designated VGAM RNA, also designated SEQ ID:3660.

Another function of VGAM949 is therefore inhibition of Sodium Channel, Voltage-gated, Type I, Alpha Polypeptide (SCN1A, Accession XM_114281). Accordingly, utilities of VGAM949 include diagnosis, prevention and treatment of diseases and clinical conditions associated with SCN1A. Sialyltransferase 4C (beta-galactoside alpha-2,3-sialytransferase) (SIAT4C, Accession NM_006278) is another VGAM949 host target gene. SIAT4C BINDING SITE is HOST TARGET binding site found in the 5' untranslated region of mRNA encoded by SIAT4C, corresponding to a HOST TARGET binding site such as BINDING SITE I, BINDING SITE II or BINDING SITE III. Table 2 illustrates the complementarity of the nucleotide sequences of SIAT4C BINDING SITE, designated SEQ ID:12957, to the nucleotide sequence of VGAM949 RNA, herein designated VGAM RNA, also designated SEQ ID:3660.

Another function of VGAM949 is therefore inhibition of Sialyltransferase 4C (beta-galactoside alpha-2,3-sialytransferase) (SIAT4C, Accession NM_006278), a gene which may be involved in the biosynthesis of the sialyl lewis x determinant. Accordingly, utilities of VGAM949 include diagnosis, prevention and treatment of diseases and clinical conditions associated with SIAT4C. The function of SIAT4C has been established by previous studies. The synthesis of alpha-2,3-linked sialic acid to Gal (beta-1,3)GalNAc is mediated by at least 3 beta-galactoside alpha-2,3-sialyl transferases (EC 2.4.99.4), SiaT-4, that are encoded by 3 distinct genes. In contrast, only a single gene encodes the beta-galactoside alpha-2,6-sialyl transferase (EC 2.4.99.1), SiaT-1. Chang et al. (1995) assessed the relationship and nature of the SiaT-4 genes. Analysis of human-mouse somatic cell hybrids demonstrated that the sialyl transferase genes are dispersed in the human genome. One gene, SiaT-4a, resides in chromosome 8; that for SiaT-4b resides in 1p34-p21; and that for SiaT-4c, in 11q23.3-qter. The gene symbols for these genes were designated SIAT4A (OMIM Ref. No. 607187), SIAT4B (OMIM Ref. No. 607188), and SIAT4C, respectively. Kitagawa et al. (1996) described the chromosomal mapping and genomic organization of the human alpha-2,3-sialyl transferase gene. They mapped the gene to 11q23-q24 by isotopic in situ hybridization to metaphase chromosomes. They showed that it spans more than 25 kb of human genomic DNA and is distributed over 14 exons that range in size from 61 to 679 bp. Previous characterization of cDNAs encoding this enzyme revealed that the gene produces at least 3 transcripts in human placenta, which code for identical protein sequences except at the 5-prime ends. Further screening for clones that contained the 5-prime end of the cDNA identified 2 additional distinct mRNAs that are expressed in human placenta. Comparison of the genomic DNA sequence with that of the 5 different mRNAs indicated that these transcripts are produced by a combination of alternative splicing and alternative promoter utilization. Northern analysis indicated that one of them is specifically expressed in placenta, testis, and ovary, indicating that its expression is independently regulated from the others.

Full details of the abovementioned studies are described in the following publications, the disclosure of which are hereby incorporated by reference:

Chang, M.-L.; Eddy, R. L.; Shows, T. B.; Lau, J. T. Y.: Three genes that encode human beta-galactoside alpha-2,3-sialyl transferases. Structural analysis and chromosomal mapping studies. Glycobiology 5:319-325, 1995; and Kitagawa, H.; Mattei, M.-G.; Paulson, J. C.: Genomic organization and chromosomal mapping of the Gal-beta-1, 3GalNAc/Gal-beta-1,4GlcNAc alpha-2,3-sialyl transferase. J. Biol. Chem. 271:931.

Further studies establishing the function and utilities of SIAT4C are found in John Hopkins OMIM database record ID 104240, and in sited publications numbered 475-47 and 474 listed in the bibliography section hereinbelow, which are also hereby incorporated by reference. Solute Carrier Family 26, Member 4 (SLC26A4, Accession NM_000441) is another VGAM949 host target gene. SLC26A4 BINDING SITE is HOST TARGET binding site found in the 3' untranslated region of mRNA encoded by SLC26A4, corresponding to a HOST TARGET binding site such as BINDING SITE I, BINDING SITE II or BINDING SITE III. Table 2 illustrates the complementarity of the nucleotide sequences of SLC26A4 BINDING SITE, designated SEQ ID:6028, to the nucleotide sequence of VGAM949 RNA, herein designated VGAM RNA, also designated SEQ ID:3660.

Another function of VGAM949 is therefore inhibition of Solute Carrier Family 26, Member 4 (SLC26A4, Accession NM_000441). Accordingly, utilities of VGAM949 include diagnosis, prevention and treatment of diseases and clinical conditions associated with SLC26A4. CDK5 Regulatory Subunit Associated Protein 3 (CDK5RAP3, Accession NM_025197) is another VGAM949 host target gene. CDK5RAP3 BINDING SITE is HOST TARGET binding site found in the 5' untranslated region of mRNA encoded by CDK5RAP3, corresponding to a HOST TARGET binding site such as BINDING SITE I, BINDING SITE II or BINDING SITE III. Table 2 illustrates the complementarity of the nucleotide sequences of CDK5RAP3 BINDING SITE, designated SEQ ID:24852, to the nucleotide sequence of VGAM949 RNA, herein designated VGAM RNA, also designated SEQ ID:3660.

Another function of VGAM949 is therefore inhibition of CDK5 Regulatory Subunit Associated Protein 3 (CDK5RAP3, Accession NM_025197). Accordingly, utilities of VGAM949 include diagnosis, prevention and treatment of diseases and clinical conditions associated with CDK5RAP3. DIS3 (Accession NM_014953) is another VGAM949 host target gene. DIS3 BINDING SITE is HOST TARGET binding site found in the 3' untranslated region of mRNA encoded by DIS3, corresponding to a HOST TARGET binding site such as BINDING SITE I, BINDING SITE II or BINDING SITE III. Table 2 illustrates the complementarity of the nucleotide sequences of DIS3 BINDING SITE, designated SEQ ID:17298, to the nucleotide sequence of VGAM949 RNA, herein designated VGAM RNA, also designated SEQ ID:3660.

Another function of VGAM949 is therefore inhibition of DIS3 (Accession NM_014953). Accordingly, utilities of VGAM949 include diagnosis, prevention and treatment of diseases and clinical conditions associated with DIS3. FLJ11113 (Accession XM_002359) is another VGAM949 host target gene. FLJ11113 BINDING SITE is HOST TARGET binding site found in the 5' untranslated region of mRNA encoded by FLJ11113, corresponding to a HOST TARGET binding site such as BINDING SITE I, BINDING SITE II or BINDING SITE III. Table 2 illustrates the complementarity of the nucleotide sequences of FLJ11113 BINDING SITE, designated SEQ ID:29875, to the nucleotide sequence of VGAM949 RNA, herein designated VGAM RNA, also designated SEQ ID:3660.

Another function of VGAM949 is therefore inhibition of FLJ11113 (Accession XM_002359). Accordingly, utilities of VGAM949 include diagnosis, prevention and treatment of diseases and clinical conditions associated with FLJ11113. FLJ21324 (Accession XM_165988) is another VGAM949 host target gene. FLJ21324 BINDING SITE is HOST TARGET binding site found in the 5' untranslated region of mRNA encoded by FLJ21324, corresponding to a HOST TARGET binding site such as BINDING SITE I, BINDING SITE II or BINDING SITE III. Table 2 illustrates the complementarity of the nucleotide sequences of FLJ21324 BINDING SITE, designated SEQ ID:43828, to the nucleotide sequence of VGAM949 RNA, herein designated VGAM RNA, also designated SEQ ID:3660.

Another function of VGAM949 is therefore inhibition of FLJ21324 (Accession XM_165988). Accordingly, utilities of VGAM949 include diagnosis, prevention and treatment of diseases and clinical conditions associated with FLJ21324. FLJ21918 (Accession NM_024939) is another VGAM949 host target gene. FLJ21918 BINDING SITE is HOST TARGET binding site found in the 3' untranslated region of mRNA encoded by FLJ21918, corresponding to a HOST TARGET binding site such as BINDING SITE I, BINDING SITE II or BINDING SITE III. Table 2 illustrates the complementarity of the nucleotide sequences of FLJ21918 BINDING SITE, designated SEQ ID:24482, to the nucleotide sequence of VGAM949 RNA, herein designated VGAM RNA, also designated SEQ ID:3660.

Another function of VGAM949 is therefore inhibition of FLJ21918 (Accession NM_024939). Accordingly, utilities of VGAM949 include diagnosis, prevention and treatment of diseases and clinical conditions associated with FLJ21918. KIAA0254 (Accession NM_014758) is another VGAM949 host target gene. KIAA0254 BINDING SITE is HOST TARGET binding site found in the 3' untranslated region of mRNA encoded by KIAA0254, corresponding to a HOST TARGET binding site such as BINDING SITE I, BINDING SITE II or BINDING SITE III. Table 2 illustrates the complementarity of the nucleotide sequences of KIAA0254 BINDING SITE, designated SEQ ID:16504, to the nucleotide sequence of VGAM949 RNA, herein designated VGAM RNA, also designated SEQ ID:3660.

Another function of VGAM949 is therefore inhibition of KIAA0254 (Accession NM_014758). Accordingly, utilities of VGAM949 include diagnosis, prevention and treatment of diseases and clinical conditions associated with KIAA0254. KIAA0258 (Accession NM_014785) is another VGAM949 host target gene. KIAA0258 BINDING SITE is HOST TARGET binding site found in the 3' untranslated region of mRNA encoded by KIAA0258, corresponding to a HOST TARGET binding site such as BINDING SITE I, BINDING SITE II or BINDING SITE III. Table 2 illustrates the complementarity of the nucleotide sequences of KIAA0258 BINDING SITE, designated SEQ ID:16641, to the nucleotide sequence of VGAM949 RNA, herein designated VGAM RNA, also designated SEQ ID:3660.

Another function of VGAM949 is therefore inhibition of KIAA0258 (Accession NM_014785). Accordingly, utilities of VGAM949 include diagnosis, prevention and treatment of diseases and clinical conditions associated with KIAA0258. KIAA0828 (Accession XM_088105) is another VGAM949 host target gene. KIAA0828 BINDING SITE is HOST TARGET binding site found in the 3' untranslated region of mRNA encoded by KIAA0828, corresponding to a HOST TARGET binding site such as BINDING SITE I, BINDING SITE II or BINDING SITE III. Table 2 illustrates the complementarity of the nucleotide sequences of KIAA0828 BINDING SITE, designated SEQ ID:39513, to the nucleotide sequence of VGAM949 RNA, herein designated VGAM RNA, also designated SEQ ID:3660.

Another function of VGAM949 is therefore inhibition of KIAA0828 (Accession XM_088105). Accordingly, utilities of VGAM949 include diagnosis, prevention and treatment of diseases and clinical conditions associated with KIAA0828. Mitogen-activated Protein Kinase Kinase 4 (MAP2K4, Accession NM_003010) is another VGAM949 host target gene. MAP2K4 BINDING SITE is HOST TARGET binding site found in the 3' untranslated region of mRNA encoded by MAP2K4, corresponding to a HOST TARGET binding site such as BINDING SITE I, BINDING SITE II or BINDING SITE III. Table 2 illustrates the complementarity of the nucleotide sequences of MAP2K4 BINDING SITE, designated SEQ ID:8916, to the nucleotide sequence of VGAM949 RNA, herein designated VGAM RNA, also designated SEQ ID:3660.

Another function of VGAM949 is therefore inhibition of Mitogen-activated Protein Kinase Kinase 4 (MAP2K4, Accession NM_003010). Accordingly, utilities of VGAM949 include diagnosis, prevention and treatment of diseases and clinical conditions associated with MAP2K4. Trinucleotide Repeat Containing 6 (TNRC6, Accession XM_047123) is another VGAM949 host target gene. TNRC6 BINDING SITE is HOST TARGET binding site found in the 5' untranslated region of mRNA encoded by TNRC6, corresponding to a HOST TARGET binding site such as BINDING SITE I, BINDING SITE II or BINDING SITE III. Table 2 illustrates the complementarity of the nucleotide sequences of TNRC6 BINDING SITE, designated SEQ ID:34899, to the nucleotide sequence of VGAM949 RNA, herein designated VGAM RNA, also designated SEQ ID:3660.

Another function of VGAM949 is therefore inhibition of Trinucleotide Repeat Containing 6 (TNRC6, Accession XM_047123). Accordingly, utilities of VGAM949 include diagnosis, prevention and treatment of diseases and clinical conditions associated with TNRC6. TU12B1-TY (Accession NM_016575) is another VGAM949 host target gene. TU12B1-TY BINDING SITE is HOST TARGET binding site found in the 3' untranslated region of mRNA encoded by TU12B1-TY, corresponding to a HOST TARGET binding site such as BINDING SITE I, BINDING SITE II or BINDING SITE III. Table 2 illustrates the complementarity of the nucleotide sequences of TU12B1-TY BINDING SITE, designated SEQ ID:18642, to the nucleotide sequence of VGAM949 RNA, herein designated VGAM RNA, also designated SEQ ID:3660.

Another function of VGAM949 is therefore inhibition of TU12B1-TY (Accession NM_016575). Accordingly, utilities of VGAM949 include diagnosis, prevention and treatment of diseases and clinical conditions associated with TU12B1-TY. LOC115297 (Accession XM_053313) is another VGAM949 host target gene. LOC115297 BINDING SITE is HOST TARGET binding site found in the 3' untranslated region of mRNA encoded by LOC115297, corresponding to a HOST TARGET binding site such as BINDING SITE I, BINDING SITE II or BINDING SITE III. Table 2 illustrates the complementarity of the nucleotide sequences of LOC115297 BINDING SITE, designated SEQ ID:36068, to the nucleotide sequence of VGAM949 RNA, herein designated VGAM RNA, also designated SEQ ID:3660.

Another function of VGAM949 is therefore inhibition of LOC115297 (Accession XM_053313). Accordingly, utilities of VGAM949 include diagnosis, prevention and treatment of diseases and clinical conditions associated with LOC115297. LOC147165 (Accession XM_097205) is another VGAM949 host target gene. LOC147165 BINDING SITE is HOST TARGET binding site found in the 3' untranslated region of mRNA encoded by LOC147165, corresponding to a HOST TARGET binding site such as BINDING SITE I, BINDING SITE II or BINDING SITE III. Table 2 illustrates the complementarity of the nucleotide sequences of LOC147165 BINDING SITE, designated SEQ ID:40812, to the nucleotide sequence of VGAM949 RNA, herein designated VGAM RNA, also designated SEQ ID:3660.

Another function of VGAM949 is therefore inhibition of LOC147165 (Accession XM_097205). Accordingly, utilities of VGAM949 include diagnosis, prevention and treatment of diseases and clinical conditions associated with LOC147165. LOC150605 (Accession XM_097927) is another VGAM949 host target gene. LOC150605 BINDING SITE is HOST TARGET binding site found in the 5' untranslated region of mRNA encoded by LOC150605, corresponding to a HOST TARGET binding site such as BINDING SITE I, BINDING SITE II or BINDING SITE III. Table 2 illustrates the complementarity of the nucleotide sequences of LOC150605 BINDING SITE, designated SEQ ID:41230, to the nucleotide sequence of VGAM949 RNA, herein designated VGAM RNA, also designated SEQ ID:3660.

Another function of VGAM949 is therefore inhibition of LOC150605 (Accession XM_097927). Accordingly, utilities of VGAM949 include diagnosis, prevention and treatment of diseases and clinical conditions associated with LOC150605. LOC169436 (Accession XM_095696) is another VGAM949 host target gene. LOC169436 BINDING SITE is HOST TARGET binding site found in the 5' untranslated region of mRNA encoded by LOC169436, corresponding to a HOST TARGET binding site such as BINDING SITE I, BINDING SITE II or BINDING SITE III. Table 2 illustrates the complementarity of the nucleotide sequences of LOC169436 BINDING SITE, designated SEQ ID:40278, to the nucleotide sequence of VGAM949 RNA, herein designated VGAM RNA, also designated SEQ ID:3660.

Another function of VGAM949 is therefore inhibition of LOC169436 (Accession XM_095696). Accordingly, utilities of VGAM949 include diagnosis, prevention and treatment of diseases and clinical conditions associated with LOC169436. LOC170425 (Accession XM_084330) is another VGAM949 host target gene. LOC170425 BINDING SITE is HOST TARGET binding site found in the 3' untranslated region of mRNA encoded by LOC170425, corresponding to a HOST TARGET binding site such as BINDING SITE I, BINDING SITE II or BINDING SITE III. Table 2 illustrates the complementarity of the nucleotide sequences of LOC170425 BINDING SITE, designated SEQ ID:37550, to the nucleotide sequence of VGAM949 RNA, herein designated VGAM RNA, also designated SEQ ID:3660.

Another function of VGAM949 is therefore inhibition of LOC170425 (Accession XM_084330). Accordingly, utilities of VGAM949 include diagnosis, prevention and treatment of diseases and clinical conditions associated with LOC170425. LOC220729 (Accession XM_049575) is another VGAM949 host target gene. LOC220729 BINDING SITE is HOST TARGET binding site found in the 3' untranslated region of mRNA encoded by LOC220729, corresponding to a HOST TARGET binding site such as BINDING SITE I, BINDING SITE II or BINDING SITE III. Table 2 illustrates the complementarity of the nucleotide sequences of LOC220729 BINDING SITE, designated SEQ ID:35449, to the nucleotide sequence of VGAM949 RNA, herein designated VGAM RNA, also designated SEQ ID:3660.

Another function of VGAM949 is therefore inhibition of LOC220729 (Accession XM_049575). Accordingly, utilities of VGAM949 include diagnosis, prevention and treatment of diseases and clinical conditions associated with LOC220729. LOC255031 (Accession XM_173187) is another VGAM949 host target gene. LOC255031 BINDING SITE is HOST TARGET binding site found in the 5' untranslated region of mRNA encoded by LOC255031, corresponding to a HOST TARGET binding site such as BINDING SITE I, BINDING SITE II or BINDING SITE III. Table 2 illustrates the complementarity of the nucleotide sequences of LOC255031 BINDING SITE, designated SEQ ID:46431, to the nucleotide sequence of VGAM949 RNA, herein designated VGAM RNA, also designated SEQ ID:3660.

Another function of VGAM949 is therefore inhibition of LOC255031 (Accession XM_173187). Accordingly, utilities of VGAM949 include diagnosis, prevention and treatment of diseases and clinical conditions associated with LOC255031. LOC257422 (Accession XM_172923) is another VGAM949 host target gene. LOC257422 BINDING SITE is HOST TARGET binding site found in the 5' untranslated region of mRNA encoded by LOC257422, corresponding to a HOST TARGET binding site such as BINDING SITE I, BINDING SITE II or BINDING SITE III. Table 2 illustrates the complementarity of the nucleotide sequences of LOC257422 BINDING SITE, designated SEQ ID:46191, to the nucleotide sequence of VGAM949 RNA, herein designated VGAM RNA, also designated SEQ ID:3660.

Another function of VGAM949 is therefore inhibition of LOC257422 (Accession XM_172923). Accordingly, utilities of VGAM949 include diagnosis, prevention and treatment of diseases and clinical conditions associated with LOC257422. LOC91272 (Accession XM_037317) is another VGAM949 host target gene. LOC91272 BINDING SITE is HOST TARGET binding site found in the 3' untranslated region of mRNA encoded by LOC91272, corresponding to a HOST TARGET binding site such as BINDING SITE I, BINDING SITE II or BINDING SITE III. Table 2 illustrates the complementarity of the nucleotide sequences of LOC91272 BINDING SITE, designated SEQ ID:32613, to the nucleotide sequence of VGAM949 RNA, herein designated VGAM RNA, also designated SEQ ID:3660.

Another function of VGAM949 is therefore inhibition of LOC91272 (Accession XM_037317). Accordingly, utilities of VGAM949 include diagnosis, prevention and treatment of diseases and clinical conditions associated with LOC91272. LOC93512 (Accession XM_051758) is another VGAM949 host target gene. LOC93512 BINDING SITE is HOST TARGET binding site found in the 3' untranslated region of mRNA encoded by LOC93512, corresponding to a HOST TARGET binding site such as BINDING SITE I, BINDING SITE II or BINDING SITE III. Table 2 illustrates the complementarity of the nucleotide sequences of LOC93512 BINDING SITE, designated SEQ ID:35876, to the nucleotide sequence of VGAM949 RNA, herein designated VGAM RNA, also designated SEQ ID:3660.

Another function of VGAM949 is therefore inhibition of LOC93512 (Accession XM_051758). Accordingly, utilities of VGAM949 include diagnosis, prevention and treatment of diseases and clinical conditions associated with LOC93512. FIG. 1 further provides a conceptual description of a novel bioinformatically detected viral gene of the present invention, referred to here as Viral Genomic Address Messenger 950 (VGAM950) viral gene, which modulates expression of respective host target genes thereof, the function and utility of which host target genes is known in the art.

VGAM950 is a novel bioinformatically detected regulatory, non protein coding, viral micro RNA (miRNA) gene. The method by which VGAM950 was detected is described hereinabove with reference to FIGS. 1-8.

VGAM950 gene, herein designated VGAM GENE, is a viral gene contained in the genome of Tomato Bushy Stunt Virus. VGAM950 host target gene, herein designated VGAM HOST TARGET GENE, is a human gene contained in the human genome.

VGAM950 gene encodes a VGAM950 precursor RNA, herein designated VGAM PRECURSOR RNA. Similar to other miRNA genes, and unlike most ordinary genes, VGAM950 precursor RNA does not encode a protein. A nucleotide sequence identical or highly similar to the nucleotide sequence of VGAM950 precursor RNA is designated SEQ ID:936, and is provided hereinbelow with reference to the sequence listing part. Nucleotide sequence SEQ ID:936 is located at position 3278 relative to the genome of Tomato Bushy Stunt Virus.

VGAM950 precursor RNA folds onto itself, forming VGAM950 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM950 folded precursor RNA into VGAM950 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM950 RNA is designated SEQ ID:3661, and is provided hereinbelow with reference to the sequence listing part.

VGAM950 host target gene, herein designated VGAM HOST TARGET GENE, encodes a corresponding messenger RNA, VGAM950 host target RNA, herein designated VGAM HOST TARGET RNA. VGAM950 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM950 RNA, herein designated VGAM RNA, binds complementarily to one or more host target binding sites located in untranslated regions of VGAM950 host target RNA, herein designated VGAM HOST TARGET RNA. This complementary binding is due to the fact that the nucleotide sequence of VGAM950 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM950 RNA, herein designated VGAM RNA, may have a different number of host target binding sites in untranslated regions of a VGAM950 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM950 RNA, herein designated VGAM RNA, to host target binding sites on VGAM950 host target RNA, herein designated VGAM HOST TARGET RNA, such as BINDING SITE I, BINDING SITE II and BINDING SITE III, inhibits translation of VGAM950 host target RNA into VGAM950 host target protein, herein designated VGAM HOST TARGET PROTEIN. VGAM host target protein is therefore outlined by a broken line.

It is appreciated that VGAM950 host target gene, herein designated VGAM HOST TARGET GENE, in fact represents a plurality of VGAM950 host target genes. The mRNA of each one of this plurality of VGAM950 host target genes comprises one or more host target binding sites, each having a nucleotide sequence which is at least partly complementary to VGAM950 RNA, herein designated VGAM RNA, and which when bound by VGAM950 RNA causes inhibition of translation of respective one or more VGAM950 host target proteins.

It is further appreciated by one skilled in the art that the mode of translational inhibition illustrated by FIG. 1 with specific reference to translational inhibition exerted by VGAM950 gene, herein designated VGAM GENE, on one or more VGAM950 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM950 is inhibition of expression of host target genes, as part of a novel viral mechanism of attacking a host. Accordingly, utilities of VGAM950 include diagnosis, prevention and treatment of viral infection by Tomato Bushy Stunt Virus. Specific functions, and accordingly utilities, of VGAM950 correlate with, and may be deduced from, the identity of the host target genes which VGAM950 binds and inhibits, and the function of these host target genes, as elaborated hereinbelow.

Nucleotide sequences of the VGAM950 precursor RNA, herein designated VGAM PRECURSOR RNA, and of the 'diced' VGAM950 RNA, herein designated VGAM RNA, and a schematic representation of the secondary folding of VGAM950 folded precursor RNA, herein designated VGAM FOLDED PRECURSOR RNA, of VGAM950 are further described hereinbelow with reference to Table 1.

Nucleotide sequences of host target binding sites, such as BINDING SITE-I, BINDING SITE-II and BINDING SITE-III of FIG. 1, found on VGAM950 host target RNA, and schematic representation of the complementarity of each of these host target binding sites to VGAM950 RNA, herein designated VGAM RNA, are described hereinbelow with reference to Table 2.

As mentioned hereinabove with reference to FIG. 1, a function of VGAM950 gene, herein designated VGAM is inhibition of expression of VGAM950 target genes. It is appreciated that specific functions, and accordingly utilities, of VGAM950 correlate with, and may be deduced from, the identity of the target genes which VGAM950 binds and inhibits, and the function of these target genes, as elaborated hereinbelow.

RIG (Accession NM_006394) is a VGAM950 host target gene. RIG BINDING SITE is HOST TARGET binding site found in the 3' untranslated region of mRNA encoded by RIG, corresponding to a HOST TARGET binding site such as BINDING SITE I, BINDING SITE II or BINDING SITE III. Table 2 illustrates the complementarity of the nucleotide sequences of RIG BINDING SITE, designated SEQ ID:13106, to the nucleotide sequence of VGAM950 RNA, herein designated VGAM RNA, also designated SEQ ID:3661.

A function of VGAM950 is therefore inhibition of RIG (Accession NM_006394), a gene which is ribosomal protein S15. Accordingly, utilities of VGAM950 include diagnosis, prevention and treatment of diseases and clinical conditions associated with RIG. The function of RIG and its association with various diseases and clinical conditions, has been established by previous studies, as described hereinabove with reference to VGAM206. Golgi Phosphoprotein 3 (coat-protein) (GOLPH3, Accession NM_022130) is another VGAM950 host target gene. GOLPH3 BINDING SITE is HOST TARGET binding site found in the 3' untranslated region of mRNA encoded by GOLPH3, corresponding to a HOST TARGET binding site such as BINDING SITE I, BINDING SITE II or BINDING SITE III. Table 2 illustrates the complementarity of the nucleotide sequences of GOLPH3 BINDING SITE, designated SEQ ID:22684, to the nucleotide sequence of VGAM950 RNA, herein designated VGAM RNA, also designated SEQ ID:3661.

Another function of VGAM950 is therefore inhibition of Golgi Phosphoprotein 3 (coat-protein) (GOLPH3, Accession NM_022130). Accordingly, utilities of VGAM950 include diagnosis, prevention and treatment of diseases and clinical conditions associated with GOLPH3. FIG. 1 further provides a conceptual description of a novel bioinformatically detected viral gene of the present invention, referred to here as Viral Genomic Address Messenger 951 (VGAM951) viral gene, which modulates expression of respective host target genes thereof, the function and utility of which host target genes is known in the art.

VGAM951 is a novel bioinformatically detected regulatory, non protein coding, viral micro RNA (miRNA) gene. The method by which VGAM951 was detected is described hereinabove with reference to FIGS. 1-8.

VGAM951 gene, herein designated VGAM GENE, is a viral gene contained in the genome of Tomato Bushy Stunt Virus. VGAM951 host target gene, herein designated VGAM HOST TARGET GENE, is a human gene contained in the human genome.

VGAM951 gene encodes a VGAM951 precursor RNA, herein designated VGAM PRECURSOR RNA. Similar to other miRNA genes, and unlike most ordinary genes, VGAM951 precursor RNA does not encode a protein. A nucleotide sequence identical or highly similar to the nucleotide sequence of VGAM951 precursor RNA is designated SEQ ID:937, and is provided hereinbelow with reference to the sequence listing part. Nucleotide sequence SEQ ID:937 is located at position 1675 relative to the genome of Tomato Bushy Stunt Virus.

VGAM951 precursor RNA folds onto itself, forming VGAM951 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM951 folded precursor RNA into VGAM951 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM951 RNA is designated SEQ ID:3662, and is provided hereinbelow with reference to the sequence listing part.

VGAM951 host target gene, herein designated VGAM HOST TARGET GENE, encodes a corresponding messenger RNA, VGAM951 host target RNA, herein designated VGAM HOST TARGET RNA. VGAM951 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM951 RNA, herein designated VGAM RNA, binds complementarily to one or more host target binding sites located in untranslated regions of VGAM951 host target RNA, herein designated VGAM HOST TARGET RNA. This complementary binding is due to the fact that the nucleotide sequence of VGAM951 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM951 RNA, herein designated VGAM RNA, may have a different number of host target binding sites in untranslated regions of a VGAM951 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM951 RNA, herein designated VGAM RNA, to host target binding sites on VGAM951 host target RNA, herein designated VGAM HOST TARGET RNA, such as BINDING SITE I, BINDING SITE II and BINDING SITE III, inhibits translation of VGAM951 host target RNA into VGAM951 host target protein, herein designated VGAM HOST TARGET PROTEIN. VGAM host target protein is therefore outlined by a broken line.

It is appreciated that VGAM951 host target gene, herein designated VGAM HOST TARGET GENE, in fact represents a plurality of VGAM951 host target genes. The mRNA of each one of this plurality of VGAM951 host target genes comprises one or more host target binding sites, each having a nucleotide sequence which is at least partly complementary to VGAM951 RNA, herein designated VGAM RNA, and which when bound by VGAM951 RNA causes inhibition of translation of respective one or more VGAM951 host target proteins.

It is further appreciated by one skilled in the art that the mode of translational inhibition illustrated by FIG. 1 with specific reference to translational inhibition exerted by VGAM951 gene, herein designated VGAM GENE, on one or more VGAM951 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM951 is inhibition of expression of host target genes, as part of a novel viral mechanism of attacking a host. Accordingly, utilities of VGAM951 include diagnosis, prevention and treatment of viral infection by Tomato Bushy Stunt Virus. Specific functions, and accordingly utilities, of VGAM951 correlate with, and may be deduced from, the identity of the host target genes which VGAM951 binds and inhibits, and the function of these host target genes, as elaborated hereinbelow.

Nucleotide sequences of the VGAM951 precursor RNA, herein designated VGAM PRECURSOR RNA, and of the 'diced' VGAM951 RNA, herein designated VGAM RNA, and a schematic representation of the secondary folding of VGAM951 folded precursor RNA, herein designated VGAM FOLDED PRECURSOR RNA, of VGAM951 are further described hereinbelow with reference to Table 1.

Nucleotide sequences of host target binding sites, such as BINDING SITE-I, BINDING SITE-II and BINDING SITE-III of FIG. 1, found on VGAM951 host target RNA, and schematic representation of the complementarity of each of these host target binding sites to VGAM951 RNA, herein designated VGAM RNA, are described hereinbelow with reference to Table 2.

As mentioned hereinabove with reference to FIG. 1, a function of VGAM951 gene, herein designated VGAM is inhibition of expression of VGAM951 target genes. It is appreciated that specific functions, and accordingly utilities, of VGAM951 correlate with, and may be deduced from, the identity of the target genes which VGAM951 binds and inhibits, and the function of these target genes, as elaborated hereinbelow.

Fatty Acid Binding Protein 2, Intestinal (FABP2, Accession NM_000134) is a VGAM951 host target gene. FABP2 BINDING SITE is HOST TARGET binding site found in the 3' untranslated region of mRNA encoded by FABP2, corresponding to a HOST TARGET binding site such as BINDING SITE I, BINDING SITE II or BINDING SITE III. Table 2 illustrates the complementarity of the nucleotide sequences of FABP2 BINDING SITE, designated SEQ ID:5623, to the nucleotide sequence of VGAM951 RNA, herein designated VGAM RNA, also designated SEQ ID:3662.

A function of VGAM951 is therefore inhibition of Fatty Acid Binding Protein 2, Intestinal (FABP2, Accession NM_000134), a gene which may have a role in dietary fat uptake or processing. Accordingly, utilities of VGAM951 include diagnosis, prevention and treatment of diseases and clinical conditions associated with FABP2. The function of FABP2 has been established by previous studies. To test the hypothesis that the A54T FABP2 polymorphism is associated with impaired lipid metabolism and cardiovascular disease, Carlsson et al. (2000) compared clinical characteristics and a parental history of cardiovascular disease between 213 sib pairs discordant for the polymorphism. Sibs with an excess of the thr54 allele had higher triglyceride and cholesterol concentrations than sibs with the ala54 allele. Parents of offspring with the thr/thr and thr/ala genotypes reported an increased prevalence of stroke compared to parents of offspring with the ala/ala genotype. The authors confirmed the association of the FABP2 thr54 allele with increased concentrations of cholesterol and triglycerides in genotype-discordant sib pairs. They also presented novel evidence that genetic variation in the FABP2 gene may increase susceptibility to stroke. To assess whether increased intestinal triglyceride input leads to elevated fasting and postprandial triglycerides in type 2 diabetes (NIDDM), Georgopoulos et al. (2000) studied the ala54-to-thr polymorphism of FABP2, which is associated with increased intestinal input of triglyceride. Of the 287 diabetic patients screened, 108 (37.6%) were heterozygous and 31 (10.8%) were homozygous for the thr54 allele. Mean fasting plasma triglyceride levels in patients with the wild-type (OMIM Ref. No. n=80), those heterozygous for the thr54 allele (OMIM Ref. No. n=57), and those homozygous for it (OMIM Ref. No. n=18) were 2.0 +/-0.09, 2.7 +/-0.20, and 3.8 +/-0.43 mmol/L, respectively. A linear relationship of mean fasting plasma triglyceride levels between the 3 groups was found. After fat ingestion, the postprandial area under the curve of plasma triglyceride and chylomicrons was higher in the thr54/thr54 (n=6) than in the wild-type (n=9). The authors concluded that their results support the hypothesis that, in type 2 diabetes, increased intestinal input of triglyceride can lead to elevated fasting and postprandial plasma triglycerides. triglyceride.

Full details of the abovementioned studies are described in the following publications, the disclosure of which are hereby incorporated by reference:

Carlsson, M.; Orho-Melander, M.; Hedenbro, J.; Almgren, P.; Groop, L. C.: The T54 allele of the intestinal fatty acid-binding protein 2 is associated with a parental history of stroke. J. Clin. Endocr. Metab. 85:2801-2804, 2000; and Georgopoulos, A.; Aras, O.; Tsai, M. Y.: Codon-54 polymorphism of the fatty acid-binding protein 2 gene is associated with elevation of fasting and postprandial triglyceride in type 2.

Further studies establishing the function and utilities of FABP2 are found in John Hopkins OMIM database record ID 134640, and in sited publications numbered 617-627 listed in the bibliography section hereinbelow, which are also hereby incorporated by reference. LOC114971 (Accession XM_054936) is another VGAM951 host target gene. LOC114971 BINDING SITE is HOST TARGET binding site found in the 3' untranslated region of mRNA encoded by LOC114971, corresponding to a HOST TARGET binding site such as BINDING SITE I, BINDING SITE II or BINDING SITE III. Table 2 illustrates the complementarity of the nucleotide sequences of LOC114971 BINDING SITE, designated SEQ ID:36208, to the nucleotide sequence of VGAM951 RNA, herein designated VGAM RNA, also designated SEQ ID:3662.

Another function of VGAM951 is therefore inhibition of LOC114971 (Accession XM_054936). Accordingly, utilities of VGAM951 include diagnosis, prevention and treatment of diseases and clinical conditions associated with LOC114971. FIG. 1 further provides a conceptual description of a novel bioinformatically detected viral gene of the present invention, referred to here as Viral Genomic Address Messenger 952 (VGAM952) viral gene, which modulates expression of respective host target genes thereof, the function and utility of which host target genes is known in the art.

VGAM952 is a novel bioinformatically detected regulatory, non protein coding, viral micro RNA (miRNA) gene. The method by which VGAM952 was detected is described hereinabove with reference to FIGS. 1-8.

VGAM952 gene, herein designated VGAM GENE, is a viral gene contained in the genome of Tomato Bushy Stunt Virus. VGAM952 host target gene, herein designated VGAM HOST TARGET GENE, is a human gene contained in the human genome.

VGAM952 gene encodes a VGAM952 precursor RNA, herein designated VGAM PRECURSOR RNA. Similar to other miRNA genes, and unlike most ordinary genes, VGAM952 precursor RNA does not encode a protein. A nucleotide sequence identical or highly similar to the nucleotide sequence of VGAM952 precursor RNA is designated SEQ ID:938, and is provided hereinbelow with reference to the sequence listing part. Nucleotide sequence SEQ ID:938 is located at position 3036 relative to the genome of Tomato Bushy Stunt Virus.

VGAM952 precursor RNA folds onto itself, forming VGAM952 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM952 folded precursor RNA into VGAM952 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 89%) nucleotide sequence of VGAM952 RNA is designated SEQ ID:3663, and is provided hereinbelow with reference to the sequence listing part.

VGAM952 host target gene, herein designated VGAM HOST TARGET GENE, encodes a corresponding messenger RNA, VGAM952 host target RNA, herein designated VGAM HOST TARGET RNA. VGAM952 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM952 RNA, herein designated VGAM RNA, binds complementarily to one or more host target binding sites located in untranslated regions of VGAM952 host target RNA, herein designated VGAM HOST TARGET RNA. This complementary binding is due to the fact that the nucleotide sequence of VGAM952 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM952 RNA, herein designated VGAM RNA, may have a different number of host target binding sites in untranslated regions of a VGAM952 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM952 RNA, herein designated VGAM RNA, to host target binding sites on VGAM952 host target RNA, herein designated VGAM HOST TARGET RNA, such as BINDING SITE I, BINDING SITE II and BINDING SITE III, inhibits translation of VGAM952 host target RNA into VGAM952 host target protein, herein designated VGAM HOST TARGET PROTEIN. VGAM host target protein is therefore outlined by a broken line.

It is appreciated that VGAM952 host target gene, herein designated VGAM HOST TARGET GENE, in fact represents a plurality of VGAM952 host target genes. The mRNA of each one of this plurality of VGAM952 host target genes comprises one or more host target binding sites, each having a nucleotide sequence which is at least partly complementary to VGAM952 RNA, herein designated VGAM RNA, and which when bound by VGAM952 RNA causes inhibition of translation of respective one or more VGAM952 host target proteins.

It is further appreciated by one skilled in the art that the mode of translational inhibition illustrated by FIG. 1 with specific reference to translational inhibition exerted by VGAM952 gene, herein designated VGAM GENE, on one or more VGAM952 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM952 is inhibition of expression of host target genes, as part of a novel viral mechanism of attacking a host. Accordingly, utilities of VGAM952 include diagnosis, prevention and treatment of viral infection by Tomato Bushy Stunt Virus. Specific functions, and accordingly utilities, of VGAM952 correlate with, and may be deduced from, the identity of the host target genes which VGAM952 binds and inhibits, and the function of these host target genes, as elaborated hereinbelow.

Nucleotide sequences of the VGAM952 precursor RNA, herein designated VGAM PRECURSOR RNA, and of the 'diced' VGAM952 RNA, herein designated VGAM RNA, and a schematic representation of the secondary folding of VGAM952 folded precursor RNA, herein designated VGAM FOLDED PRECURSOR RNA, of VGAM952 are further described hereinbelow with reference to Table 1.

Nucleotide sequences of host target binding sites, such as BINDING SITE-I, BINDING SITE-II and BINDING SITE-III of FIG. 1, found on VGAM952 host target RNA, and schematic representation of the complementarity of each of these host target binding sites to VGAM952 RNA, herein designated VGAM RNA, are described hereinbelow with reference to Table 2.

As mentioned hereinabove with reference to FIG. 1, a function of VGAM952 gene, herein designated VGAM is inhibition of expression of VGAM952 target genes. It is appreciated that specific functions, and accordingly utilities, of VGAM952 correlate with, and may be deduced from, the identity of the target genes which VGAM952 binds and inhibits, and the function of these target genes, as elaborated hereinbelow.

UDP-Gal:betaGlcNAc Beta 1,4-Galactosyltransferase, Polypeptide 4 (B4GALT4, Accession NM_003778) is a VGAM952 host target gene. B4GALT4 BINDING SITE is HOST TARGET binding site found in the 3' untranslated region of mRNA encoded by B4GALT4, corresponding to a HOST TARGET binding site such as BINDING SITE I, BINDING SITE II or BINDING SITE III. Table 2 illustrates the complementarity of the nucleotide sequences of B4GALT4 BINDING SITE, designated SEQ ID:9862, to the nucleotide sequence of VGAM952 RNA, herein designated VGAM RNA, also designated SEQ ID:3663.

A function of VGAM952 is therefore inhibition of UDP-Gal:betaGlcNAc Beta 1,4-Galactosyltransferase, Polypeptide 4 (B4GALT4, Accession NM_003778). Accordingly, utilities of VGAM952 include diagnosis, prevention and treatment of diseases and clinical conditions associated with B4GALT4. Cyclin T2 (CCNT2, Accession NM_058241) is another VGAM952 host target gene. CCNT2 BINDING SITE is HOST TARGET binding site found in the 3' untranslated region of mRNA encoded by CCNT2, corresponding to a HOST TARGET binding site such as BINDING SITE I, BINDING SITE II or BINDING SITE III. Table 2 illustrates the complementarity of the nucleotide sequences of CCNT2 BINDING SITE, designated SEQ ID:27771, to the nucleotide sequence of VGAM952 RNA, herein designated VGAM RNA, also designated SEQ ID:3663.

Another function of VGAM952 is therefore inhibition of Cyclin T2 (CCNT2, Accession NM_058241), a gene which is a regulatory subunit of the cyclin-dependent kinase pair (cdk9/cyclin t) complex. Accordingly, utilities of VGAM952 include diagnosis, prevention and treatment of diseases and clinical conditions associated with CCNT2. The function of CCNT2 and its association with various diseases and clinical conditions, has been established by previous studies, as described hereinabove with reference to VGAM159. Fibronectin Leucine Rich Transmembrane Protein 2 (FLRT2, Accession NM_013231) is another VGAM952 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14890, to the nucleotide sequence of VGAM952 RNA, herein designated VGAM RNA, also designated SEQ ID:3663.

Another function of VGAM952 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM952 include diagnosis, prevention and treatment of diseases and clinical conditions associated with FLRT2. The function of FLRT2 and its association with various diseases and clinical conditions, has been established by previous studies, as described hereinabove with reference to VGAM247. Neogenin Homolog 1 (chicken) (NEO1, Accession NM_002499) is another VGAM952 host target gene. NEO1 BINDING SITE is HOST TARGET binding site found in the 3' untranslated region of mRNA encoded by NEO1, corresponding to a HOST TARGET binding site such as BINDING SITE I, BINDING SITE II or BINDING SITE III. Table 2 illustrates the complementarity of the nucleotide sequences of NEO1 BINDING SITE, designated SEQ ID:8321, to the nucleotide sequence of VGAM952 RNA, herein designated VGAM RNA, also designated SEQ ID:3663.

Another function of VGAM952 is therefore inhibition of Neogenin Homolog 1 (chicken) (NEO1, Accession NM_002499), a gene which regulates the transition of undifferentiated proliferating cells to their differentiated state. Accordingly, utilities of VGAM952 include diagnosis, prevention and treatment of diseases and clinical conditions associated with NEO1. The function of NEO1 and its association with various diseases and clinical conditions, has been established by previous studies, as described hereinabove with reference to VGAM329. Peroxisome Proliferative Activated Receptor, Gamma, Coactivator 1 (PPARGC1, Accession NM_013261) is another VGAM952 host target gene. PPARGC1 BINDING SITE is HOST TARGET binding site found in the 3' untranslated region of mRNA encoded by PPARGC1, corresponding to a HOST TARGET binding site such as BINDING SITE I, BINDING SITE II or BINDING SITE III. Table 2 illustrates the complementarity of the nucleotide sequences of PPARGC1 BINDING SITE, designated SEQ ID:14934, to the nucleotide sequence of VGAM952 RNA, herein designated VGAM RNA, also designated SEQ ID:3663.

Another function of VGAM952 is therefore inhibition of Peroxisome Proliferative Activated Receptor, Gamma, Coactivator 1 (PPARGC1, Accession NM_013261), a gene which may play a role in insulin sensitivity and thermogenesis. Accordingly, utilities of VGAM952 include diagnosis, prevention and treatment of diseases and clinical conditions associated with PPARGC1. The function of PPARGC1 has been established by previous studies. Adaptive thermogenesis is an important component of energy homeostasis and a metabolic defense against obesity, which is characterized by a chronic imbalance between energy intake and expenditure. Part of energy expenditure results from a leaking of protons across the mitochondrial inner membrane which leads to energy dissipation because of uncoupling of oxygen consumption to ATP synthesis. Three mitochondrial uncoupling proteins, UCP1 (OMIM Ref. No. 113730), UCP2 (OMIM Ref. No. 601693), and UCP3 (OMIM Ref. No. 602044), are candidates to explain the proton leak. The most compelling evidence for a direct role of uncoupling proteins in the proton leak comes from data on brown fat-specific UCP1. During cold exposure, energy dissipation is increased through brown adipose tissue (BAT) hypertrophy, biogenesis of mitochondria, and increased expression and activation of UCP1. Data pointed to peroxisome proliferator-activated receptor-gamma (PPARG; 601487) as a transcriptional regulator of uncoupling protein expression. PPAR-gamma is a nuclear receptor activated by fatty acids and eicosanoids which plays a major role in adipocyte differentiation. In brown fat cells, PPARG activates an enhancer of the UCP1 gene promoter. Puigserver et al. (1998) cloned a novel transcription coactivator of nuclear receptors, termed Pgc1, from a mouse brown fat cDNA library. Pgc1 mRNA expression was dramatically elevated upon cold exposure of mice in both brown fat and skeletal muscle, key thermogenic tissues. Pgc1 greatly increased the transcriptional activity of Ppar-gamma (OMIM Ref. No. 601487) and thyroid hormone receptor (see OMIM Ref. No. 190120) on the uncoupling protein Ucp1 (OMIM Ref. No. 113730) promoter. Ectopic expression of Pgc1 in white adipose cells activated expression of Ucp1 and key mitochondrial enzymes of the respiratory chain, and increased the cellular content of mitochondrial DNA. Puigserver et al. (1998) suggested that PGC1 plays a key role in linking nuclear receptors to the transcriptional program of adaptive thermogenesis. Animal model experiments lend further support to the function of PPARGC1. Herzig et al. (2001) demonstrated that mice carrying a targeted disruption of the cAMP response element-binding (CREB) protein gene (OMIM Ref. No. 123810), or overexpressing a dominant-negative CREB inhibitor, exhibit fasting hyperglycemia and reduced expression of gluconeogenic enzymes. CREB was found to induce expression of the gluconeogenic program through the nuclear receptor coactivator PGC1, which was demonstrated to be a direct target for CREB regulation in vivo. Overexpression of PGC1 in CREB-deficient mice restored glucose homeostasis and rescued the expression of gluconeogenic genes. In transient assays, PGC1 potentiated glucocorticoid induction of the gene for PEPCK, the rate-limiting enzyme in gluconeogenesis. PGC1 promotes cooperativity between cAMP and glucocorticoid signaling pathways during hepatic gluconeogenesis. Fasting hyperglycemia is strongly correlated with type II diabetes (OMIM Ref. No. 125853), so Herzig et al. (2001) concluded that the activation of PGC1 by CREB in liver contributes importantly to the pathogenesis of this disease.

It is appreciated that the abovementioned animal model for PPARGC1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Puigserver, P.; Wu, Z.; Park, C. W.; Graves, R.; Wright, M.; Spiegelman, B. M.: A cold-inducible coactivator of nuclear receptors linked to adaptive thermogenesis. Cell 92:829-839, 1998; and Herzig, S.; Long, F.; Jhala, U. S.; Hedrick, S.; Quinn, R.; Bauer, A.; Rudolph, D.; Schutz, G.; Yoon, C.; Puigserver, P.; Spiegelman, B.; Montminy, M.: CREB regulates hepatic gluconeoge.

Further studies establishing the function and utilities of PPARGC1 are found in John Hopkins OMIM database record ID 604517, and in sited publications numbered 4789, 490 and 11857-6932 listed in the bibliography section hereinbelow, which are also hereby incorporated by reference. Chromosome 21 Open Reading Frame 100 (C21orf100, Accession NM_145033) is another VGAM952 host target gene. C21orf100 BINDING SITE is HOST TARGET binding site found in the 3' untranslated region of mRNA encoded by C21orf100, corresponding to a HOST TARGET binding site such as BINDING SITE I, BINDING SITE II or BINDING SITE III. Table 2 illustrates the complementarity of the nucleotide sequences of C21orf100 BINDING SITE, designated SEQ ID:29650, to the nucleotide sequence of VGAM952 RNA, herein designated VGAM RNA, also designated SEQ ID:3663.

Another function of VGAM952 is therefore inhibition of Chromosome 21 Open Reading Frame 100 (C21orf100, Accession NM_145033). Accordingly, utilities of VGAM952 include diagnosis, prevention and treatment of diseases and clinical conditions associated with C21orf100. DKFZP434N178 (Accession XM_050278) is another VGAM952 host target gene. DKFZP434N178 BINDING SITE is HOST TARGET binding site found in the 3' untranslated region of mRNA encoded by DKFZP434N178, corresponding to a HOST TARGET binding site such as BINDING SITE I, BINDING SITE II or BINDING SITE III. Table 2 illustrates the complementarity of the nucleotide sequences of DKFZP434N178 BINDING SITE, designated SEQ ID:35600, to the nucleotide sequence of VGAM952 RNA, herein designated VGAM RNA, also designated SEQ ID:3663.

Another function of VGAM952 is therefore inhibition of DKFZP434N178 (Accession XM_050278). Accordingly, utilities of VGAM952 include diagnosis, prevention and treatment of diseases and clinical conditions associated with DKFZP434N178. Down Syndrome Critical Region Gene 6 (DSCR6, Accession NM_018962) is another VGAM952 host target gene. DSCR6 BINDING SITE is HOST TARGET binding site found in the 3' untranslated region of mRNA encoded by DSCR6, corresponding to a HOST TARGET binding site such as BINDING SITE I, BINDING SITE II or BINDING SITE III. Table 2 illustrates the complementarity of the nucleotide sequences of DSCR6 BINDING SITE, designated SEQ ID:21031, to the nucleotide sequence of VGAM952 RNA, herein designated VGAM RNA, also designated SEQ ID:3663.

Another function of VGAM952 is therefore inhibition of Down Syndrome Critical Region Gene 6 (DSCR6, Accession NM_018962). Accordingly, utilities of VGAM952 include diagnosis, prevention and treatment of diseases and clinical conditions associated with DSCR6. FACTP140 (Accession NM_007192) is another VGAM952 host target gene. FACTP140 BINDING SITE is HOST TARGET binding site found in the 3' untranslated region of mRNA encoded by FACTP140, corresponding to a HOST TARGET binding site such as BINDING SITE I, BINDING SITE II or BINDING SITE III. Table 2 illustrates the complementarity of the nucleotide sequences of FACTP140 BINDING SITE, designated SEQ ID:14046, to the nucleotide sequence of VGAM952 RNA, herein designated VGAM RNA, also designated SEQ ID:3663.

Another function of VGAM952 is therefore inhibition of FACTP140 (Accession NM_007192). Accordingly, utilities of VGAM952 include diagnosis, prevention and treatment of diseases and clinical conditions associated with FACTP140. FLJ23360 (Accession NM_023076) is another VGAM952 host target gene. FLJ23360 BINDING SITE is HOST TARGET binding site found in the 3' untranslated region of mRNA encoded by FLJ23360, corresponding to a HOST TARGET binding site such as BINDING SITE I, BINDING SITE II or BINDING SITE III. Table 2 illustrates the complementarity of the nucleotide sequences of FLJ23360 BINDING SITE, designated SEQ ID:23338, to the nucleotide sequence of VGAM952 RNA, herein designated VGAM RNA, also designated SEQ ID:3663.

Another function of VGAM952 is therefore inhibition of FLJ23360 (Accession NM_023076). Accordingly, utilities of VGAM952 include diagnosis, prevention and treatment of diseases and clinical conditions associated with FLJ23360. HSA250839 (Accession NM_018401) is another VGAM952 host target gene. HSA250839 BINDING SITE is HOST TARGET binding site found in the 3' untranslated region of mRNA encoded by HSA250839, corresponding to a HOST TARGET binding site such as BINDING SITE I, BINDING SITE II or BINDING SITE III. Table 2 illustrates the complementarity of the nucleotide sequences of HSA250839 BINDING SITE, designated SEQ ID:20440, to the nucleotide sequence of VGAM952 RNA, herein designated VGAM RNA, also designated SEQ ID:3663.

Another function of VGAM952 is therefore inhibition of HSA250839 (Accession NM_018401). Accordingly, utilities of VGAM952 include diagnosis, prevention and treatment of diseases and clinical conditions associated with HSA250839. LOC143943 (Accession XM_096504) is another VGAM952 host target gene. LOC143943 BINDING SITE is HOST TARGET binding site found in the 5' untranslated region of mRNA encoded by LOC143943, corresponding to a HOST TARGET binding site such as BINDING SITE I, BINDING SITE II or BINDING SITE III. Table 2 illustrates the complementarity of the nucleotide sequences of LOC143943 BINDING SITE, designated SEQ ID:40385, to the nucleotide sequence of VGAM952 RNA, herein designated VGAM RNA, also designated SEQ ID:3663.

Another function of VGAM952 is therefore inhibition of LOC143943 (Accession XM_096504). Accordingly, utilities of VGAM952 include diagnosis, prevention and treatment of diseases and clinical conditions associated with LOC143943. LOC151610 (Accession XM_087245) is another VGAM952 host target gene. LOC151610 BINDING SITE is HOST TARGET binding site found in the 3' untranslated region of mRNA encoded by LOC151610, corresponding to a HOST TARGET binding site such as BINDING SITE I, BINDING SITE II or BINDING SITE III. Table 2 illustrates the complementarity of the nucleotide sequences of LOC151610 BINDING SITE, designated SEQ ID:39139, to the nucleotide sequence of VGAM952 RNA, herein designated VGAM RNA, also designated SEQ ID:3663.

Another function of VGAM952 is therefore inhibition of LOC151610 (Accession XM_087245). Accordingly, utilities of VGAM952 include diagnosis, prevention and treatment of diseases and clinical conditions associated with LOC151610. LOC200609 (Accession XM_117256) is another VGAM952 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43339, to the nucleotide sequence of VGAM952 RNA, herein designated VGAM RNA, also designated SEQ ID:3663.

Another function of VGAM952 is therefore inhibition of LOC200609 (Accession XM_117256). Accordingly, utilities of VGAM952 include diagnosis, prevention and treatment of diseases and clinical conditions associated with LOC200609. FIG. 1 further provides a conceptual description of a novel bioinformatically detected viral gene of the present invention, referred to here as Viral Genomic Address Messenger 953 (VGAM953) viral gene, which modulates expression of respective host target genes thereof, the function and utility of which host target genes is known in the art.

VGAM953 is a novel bioinformatically detected regulatory, non protein coding, viral micro RNA (miRNA) gene. The method by which VGAM953 was detected is described hereinabove with reference to FIGS. 1-8.

VGAM953 gene, herein designated VGAM GENE, is a viral gene contained in the genome of Tomato Spotted Wilt Virus. VGAM953 host target gene, herein designated VGAM HOST TARGET GENE, is a human gene contained in the human genome.

VGAM953 gene encodes a VGAM953 precursor RNA, herein designated VGAM PRECURSOR RNA. Similar to other miRNA genes, and unlike most ordinary genes, VGAM953 precursor RNA does not encode a protein. A nucleotide sequence identical or highly similar to the nucleotide sequence of VGAM953 precursor RNA is designated SEQ ID:939, and is provided hereinbelow with reference to the sequence listing part. Nucleotide sequence SEQ ID:939 is located at position 3700 relative to the genome of Tomato Spotted Wilt Virus.

VGAM953 precursor RNA folds onto itself, forming VGAM953 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM953 folded precursor RNA into VGAM953 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM953 RNA is designated SEQ ID:3664, and is provided hereinbelow with reference to the sequence listing part.

VGAM953 host target gene, herein designated VGAM HOST TARGET GENE, encodes a corresponding messenger RNA, VGAM953 host target RNA, herein designated VGAM HOST TARGET RNA. VGAM953 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM953 RNA, herein designated VGAM RNA, binds complementarily to one or more host target binding sites located in untranslated regions of VGAM953 host target RNA, herein designated VGAM HOST TARGET RNA. This complementary binding is due to the fact that the nucleotide sequence of VGAM953 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM953 RNA, herein designated VGAM RNA, may have a different number of host target binding sites in untranslated regions of a VGAM953 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM953 RNA, herein designated VGAM RNA, to host target binding sites on VGAM953 host target RNA, herein designated VGAM HOST TARGET RNA, such as BINDING SITE I, BINDING SITE II and BINDING SITE III, inhibits translation of VGAM953 host target RNA into VGAM953 host target protein, herein designated VGAM HOST TARGET PROTEIN. VGAM host target protein is therefore outlined by a broken line.

It is appreciated that VGAM953 host target gene, herein designated VGAM HOST TARGET GENE, in fact represents a plurality of VGAM953 host target genes. The mRNA of each one of this plurality of VGAM953 host target genes comprises one or more host target binding sites, each having a nucleotide sequence which is at least partly complementary to VGAM953 RNA, herein designated VGAM RNA, and which when bound by VGAM953 RNA causes inhibition of translation of respective one or more VGAM953 host target proteins.

It is further appreciated by one skilled in the art that the mode of translational inhibition illustrated by FIG. 1 with specific reference to translational inhibition exerted by VGAM953 gene, herein designated VGAM GENE, on one or more VGAM953 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM953 is inhibition of expression of host target genes, as part of a novel viral mechanism of attacking a host. Accordingly, utilities of VGAM953 include diagnosis, prevention and treatment of viral infection by Tomato Spotted Wilt Virus. Specific functions, and accordingly utilities, of VGAM953 correlate with, and may be deduced from, the identity of the host target genes which VGAM953 binds and inhibits, and the function of these host target genes, as elaborated hereinbelow.

Nucleotide sequences of the VGAM953 precursor RNA, herein designated VGAM PRECURSOR RNA, and of the 'diced' VGAM953 RNA, herein designated VGAM RNA, and a schematic representation of the secondary folding of VGAM953 folded precursor RNA, herein designated VGAM FOLDED PRECURSOR RNA, of VGAM953 are further described hereinbelow with reference to Table 1.

Nucleotide sequences of host target binding sites, such as BINDING SITE-I, BINDING SITE-II and BINDING SITE-III of FIG. 1, found on VGAM953 host target RNA, and schematic representation of the complementarity of each of these host target binding sites to VGAM953 RNA, herein designated VGAM RNA, are described hereinbelow with reference to Table 2.

As mentioned hereinabove with reference to FIG. 1, a function of VGAM953 gene, herein designated VGAM is inhibition of expression of VGAM953 target genes. It is appreciated that specific functions, and accordingly utilities, of VGAM953 correlate with, and may be deduced from, the identity of the target genes which VGAM953 binds and inhibits, and the function of these target genes, as elaborated hereinbelow.

EH-domain Containing 4 (EHD4, Accession NM_139265) is a VGAM953 host target gene. EHD4 BINDING SITE is HOST TARGET binding site found in the 3' untranslated region of mRNA encoded by EHD4, corresponding to a HOST TARGET binding site such as BINDING SITE I, BINDING SITE II or BINDING SITE III. Table 2 illustrates the complementarity of the nucleotide sequences of EHD4 BINDING SITE, designated SEQ ID:29256, to the nucleotide sequence of VGAM953 RNA, herein designated VGAM RNA, also designated SEQ ID:3664.

A function of VGAM953 is therefore inhibition of EH-domain Containing 4 (EHD4, Accession NM_139265). Accordingly, utilities of VGAM953 include diagnosis, prevention and treatment of diseases and clinical conditions associated with EHD4. Exostoses (multiple)-like 2 (EXTL2, Accession NM_001439) is another VGAM953 host target gene. EXTL2 BINDING SITE is HOST TARGET binding site found in the 5' untranslated region of mRNA encoded by EXTL2, corresponding to a HOST TARGET binding site such as BINDING SITE I, BINDING SITE II or BINDING SITE III. Table 2 illustrates the complementarity of the nucleotide sequences of EXTL2 BINDING SITE, designated SEQ ID:7160, to the nucleotide sequence of VGAM953 RNA, herein designated VGAM RNA, also designated SEQ ID:3664.

Another function of VGAM953 is therefore inhibition of Exostoses (multiple)-like 2 (EXTL2, Accession NM_001439), a gene which is homologous to the EXT and EXTL genes. Accordingly, utilities of VGAM953 include diagnosis, prevention and treatment of diseases and clinical conditions associated with EXTL2. The function of EXTL2 and its association with various diseases and clinical conditions, has been established by previous studies, as described hereinabove with reference to VGAM743. Interleukin 1 Family, Member 5 (delta) (IL1F5, Accession NM_012275) is another VGAM953 host target gene. IL1F5 BINDING SITE is HOST TARGET binding site found in the 3' untranslated region of mRNA encoded by IL1F5, corresponding to a HOST TARGET binding site such as BINDING SITE I, BINDING SITE II or BINDING SITE III. Table 2 illustrates the complementarity of the nucleotide sequences of IL1F5 BINDING SITE, designated SEQ ID:14603, to the nucleotide sequence of VGAM953 RNA, herein designated VGAM RNA, also designated SEQ ID:3664.

Another function of VGAM953 is therefore inhibition of Interleukin 1 Family, Member 5 (delta) (IL1F5, Accession NM_012275), a gene which is a novel interleukin-1 receptor antagonist gene. Accordingly, utilities of VGAM953 include diagnosis, prevention and treatment of diseases and clinical conditions associated with IL1F5. The function of IL1F5 and its association with various diseases and clinical conditions, has been established by previous studies, as described hereinabove with reference to VGAM263. S100 Calcium Binding Protein A5 (S100A5, Accession NM_002962) is another VGAM953 host target gene. S100A5 BINDING SITE is HOST TARGET binding site found in the 5' untranslated region of mRNA encoded by S100A5, corresponding to a HOST TARGET binding site such as BINDING SITE I, BINDING SITE II or BINDING SITE III. Table 2 illustrates the complementarity of the nucleotide sequences of S100A5 BINDING SITE, designated SEQ ID:8876, to the nucleotide sequence of VGAM953 RNA, herein designated VGAM RNA, also designated SEQ ID:3664.

Another function of VGAM953 is therefore inhibition of S100 Calcium Binding Protein A5 (S100A5, Accession NM_002962), a gene which interacts with target proteins to link extracellular stimuli and cellular responses; member of the S100 family of tissue-specific calcium-binding proteins. Accordingly, utilities of VGAM953 include diagnosis, prevention and treatment of diseases and clinical conditions associated with S100A5. The function of S100A5 has been established by previous studies. The S100 proteins are small calcium-binding proteins which display different expression patterns in human tissues. Some S100 proteins are associated with tumor development and the metastatic behavior of tumors. Engelkamp et al. (1993) established the physical linkage of 6 S100 genes by pulsed field gel electrophoresis and DNA sequencing of 15 kb containing the full coding region of 4 different S100 genes: S100E (S100A3; 176992), CAPL (S100A4; 114210), S100D (OMIM Ref. No. S100A5), and calcyclin (S100A6; 114110). Engelkamp et al. (1993) stated that 'this is the tightest mammalian gene cluster discovered so far.' The cluster was assigned to 1q21 by in situ hybridization. Two other S100 genes were located within 450 kb: S100L (S100A2; 176993) and S100A (S100A1; 176940). Schafer et al. (1995) isolated a YAC from 1q21 on which 9 different genes coding for S100 calcium-binding proteins could be localized. The clustered organization of S100 genes allowed introduction of a new logical nomenclature based on their physical arrangement on the chromosome, with S100A1 being closest to the telomere and S100A9 (OMIM Ref. No. 123886) being closest to the centromere. In this nomenclature, S100D became S100A5.

Full details of the abovementioned studies are described in the following publications, the disclosure of which are hereby incorporated by reference:

Engelkamp, D.; Schafer, B. W.; Mattei, M. G.; Erne, P.; Heizmann, C. W.: Six S100 genes are clustered on human chromosome 1q21: identification of two genes coding for the two previously unreported calcium-binding proteins S100D and S100E. Proc. Nat. Acad. Sci. 90:6547-6551, 1993. ; and Schafer, B. W.; Wicki, R.; Engelkamp, D.; Mattei, M.-G.; Heizmann, C. W.: Isolation of a YAC clone covering a cluster of nine S100 genes on human chromosome 1q21: rationale for a new no.

Further studies establishing the function and utilities of S100A5 are found in John Hopkins OMIM database record ID 176991, and in sited publications numbered 12359 listed in the bibliography section hereinbelow, which are also hereby incorporated by reference. Chromosome 12 Open Reading Frame 2 (C12orf2, Accession XM_096040) is another VGAM953 host target gene. C12orf2 BINDING SITE is HOST TARGET binding site found in the 3' untranslated region of mRNA encoded by C12orf2, corresponding to a HOST TARGET binding site such as BINDING SITE I, BINDING SITE II or BINDING SITE III. Table 2 illustrates the complementarity of the nucleotide sequences of C12orf2 BINDING SITE, designated SEQ ID:40290, to the nucleotide sequence of VGAM953 RNA, herein designated VGAM RNA, also designated SEQ ID:3664.

Another function of VGAM953 is therefore inhibition of Chromosome 12 Open Reading Frame 2 (C12orf2, Accession XM_096040). Accordingly, utilities of VGAM953 include diagnosis, prevention and treatment of diseases and clinical conditions associated with C12orf2. Chromosome 20 Open Reading Frame 38 (C20orf38, Accession NM_018327) is another VGAM953 host target gene. C20orf38 BINDING SITE is HOST TARGET binding site found in the 3' untranslated region of mRNA encoded by C20orf38, corresponding to a HOST TARGET binding site such as BINDING SITE I, BINDING SITE II or BINDING SITE III. Table 2 illustrates the complementarity of the nucleotide sequences of C20orf38 BINDING SITE, designated SEQ ID:20323, to the nucleotide sequence of VGAM953 RNA, herein designated VGAM RNA, also designated SEQ ID:3664.

Another function of VGAM953 is therefore inhibition of Chromosome 20 Open Reading Frame 38 (C20orf38, Accession NM_018327). Accordingly, utilities of VGAM953 include diagnosis, prevention and treatment of diseases and clinical conditions associated with C20orf38. C6orf5 (Accession NM_015524) is another VGAM953 host target gene. C6orf5 BINDING SITE is HOST TARGET binding site found in the 3' untranslated region of mRNA encoded by C6orf5, corresponding to a HOST TARGET binding site such as BINDING SITE I, BINDING SITE II or BINDING SITE III. Table 2 illustrates the complementarity of the nucleotide sequences of C6orf5 BINDING SITE, designated SEQ ID:17779, to the nucleotide sequence of VGAM953 RNA, herein designated VGAM RNA, also designated SEQ ID:3664.

Another function of VGAM953 is therefore inhibition of C6orf5 (Accession NM_015524). Accordingly, utilities of VGAM953 include diagnosis, prevention and treatment of diseases and clinical conditions associated with C6orf5. Cartilage Acidic Protein 1 (CRTAC1, Accession NM_018058) is another VGAM953 host target gene. CRTAC1 BINDING SITE is HOST TARGET binding site found in the 3' untranslated region of mRNA encoded by CRTAC1, corresponding to a HOST TARGET binding site such as BINDING SITE I, BINDING SITE II or BINDING SITE III. Table 2 illustrates the complementarity of the nucleotide sequences of CRTAC1 BINDING SITE, designated SEQ ID:19827, to the nucleotide sequence of VGAM953 RNA, herein designated VGAM RNA, also designated SEQ ID:3664.

Another function of VGAM953 is therefore inhibition of Cartilage Acidic Protein 1 (CRTAC1, Accession NM_018058). Accordingly, utilities of VGAM953 include diagnosis, prevention and treatment of diseases and clinical conditions associated with CRTAC1. DKFZp547A023 (Accession XM_052065) is another VGAM953 host target gene. DKFZp547A023 BINDING SITE is HOST TARGET binding site found in the 3' untranslated region of mRNA encoded by DKFZp547A023, corresponding to a HOST TARGET binding site such as BINDING SITE I, BINDING SITE II or BINDING SITE III. Table 2 illustrates the complementarity of the nucleotide sequences of DKFZp547A023 BINDING SITE, designated SEQ ID:35940, to the nucleotide sequence of VGAM953 RNA, herein designated VGAM RNA, also designated SEQ ID:3664.

Another function of VGAM953 is therefore inhibition of DKFZp547A023 (Accession XM_052065). Accordingly, utilities of VGAM953 include diagnosis, prevention and treatment of diseases and clinical conditions associated with DKFZp547A023. FLJ10314 (Accession NM_018055) is another VGAM953 host target gene. FLJ10314 BINDING SITE is HOST TARGET binding site found in the 5' untranslated region of mRNA encoded by FLJ10314, corresponding to a HOST TARGET binding site such as BINDING SITE I, BINDING SITE II or BINDING SITE III. Table 2 illustrates the complementarity of the nucleotide sequences of FLJ10314 BINDING SITE, designated SEQ ID:19815, to the nucleotide sequence of VGAM953 RNA, herein designated VGAM RNA, also designated SEQ ID:3664.

Another function of VGAM953 is therefore inhibition of FLJ10314 (Accession NM_018055). Accordingly, utilities of VGAM953 include diagnosis, prevention and treatment of diseases and clinical conditions associated with FLJ10314. G Protein-coupled Receptor Kinase-interactor 2 (GIT2, Accession NM_014776) is another VGAM953 host target gene. GIT2 BINDING SITE1 through GIT2 BINDING SITE3 are HOST TARGET binding sites found in untranslated regions of mRNA encoded by GIT2, corresponding to HOST TARGET binding sites such as BINDING SITE I, BINDING SITE II or BINDING SITE III. Table 2 illustrates the complementarity of the nucleotide sequences of GIT2 BINDING SITE1 through GIT2 BINDING SITE3, designated SEQ ID:16604, SEQ ID:27686 and SEQ ID:27699 respectively, to the nucleotide sequence of VGAM953 RNA, herein designated VGAM RNA, also designated SEQ ID:3664.

Another function of VGAM953 is therefore inhibition of G Protein-coupled Receptor Kinase-interactor 2 (GIT2, Accession NM_014776). Accordingly, utilities of VGAM953 include diagnosis, prevention and treatment of diseases and clinical conditions associated with GIT2. LIM and SH3 Protein 1 (LASP1, Accession NM_006148) is another VGAM953 host target gene. LASP1 BINDING SITE is HOST TARGET binding site found in the 3' untranslated region of mRNA encoded by LASP1, corresponding to a HOST TARGET binding site such as BINDING SITE I, BINDING SITE II or BINDING SITE III. Table 2 illustrates the complementarity of the nucleotide sequences of LASP1 BINDING SITE, designated SEQ ID:12801, to the nucleotide sequence of VGAM953 RNA, herein designated VGAM RNA, also designated SEQ ID:3664.

Another function of VGAM953 is therefore inhibition of LIM and SH3 Protein 1 (LASP1, Accession NM_006148). Accordingly, utilities of VGAM953 include diagnosis, prevention and treatment of diseases and clinical conditions associated with LASP1. MGC30052 (Accession NM_144721) is another VGAM953 host target gene. MGC30052 BINDING SITE is HOST TARGET binding site found in the 3' untranslated region of mRNA encoded by MGC30052, corresponding to a HOST TARGET binding site such as BINDING SITE I, BINDING SITE II or BINDING SITE III. Table 2 illustrates the complementarity of the nucleotide sequences of MGC30052 BINDING SITE, designated SEQ ID:29543, to the nucleotide sequence of VGAM953 RNA, herein designated VGAM RNA, also designated SEQ ID:3664.

Another function of VGAM953 is therefore inhibition of MGC30052 (Accession NM_144721). Accordingly, utilities of VGAM953 include diagnosis, prevention and treatment of diseases and clinical conditions associated with MGC30052. LOC149386 (Accession XM_097631) is another VGAM953 host target gene. LOC149386 BINDING SITE is HOST TARGET binding site found in the 3' untranslated region of mRNA encoded by LOC149386, corresponding to a HOST TARGET binding site such as BINDING SITE I, BINDING SITE II or BINDING SITE III. Table 2 illustrates the complementarity of the nucleotide sequences of LOC149386 BINDING SITE, designated SEQ ID:40985, to the nucleotide sequence of VGAM953 RNA, herein designated VGAM RNA, also designated SEQ ID:3664.

Another function of VGAM953 is therefore inhibition of LOC149386 (Accession XM_097631). Accordingly, utilities of VGAM953 include diagnosis, prevention and treatment of diseases and clinical conditions associated with LOC149386. LOC154789 (Accession XM_088043) is another VGAM953 host target gene. LOC154789 BINDING SITE is HOST TARGET binding site found in the 5' untranslated region of mRNA encoded by LOC154789, corresponding to a HOST TARGET binding site such as BINDING SITE I, BINDING SITE II or BINDING SITE III. Table 2 illustrates the complementarity of the nucleotide sequences of LOC154789 BINDING SITE, designated SEQ ID:39487, to the nucleotide sequence of VGAM953 RNA, herein designated VGAM RNA, also designated SEQ ID:3664.

Another function of VGAM953 is therefore inhibition of LOC154789 (Accession XM_088043). Accordingly, utilities of VGAM953 include diagnosis, prevention and treatment of diseases and clinical conditions associated with LOC154789. LOC158563 (Accession XM_088606) is another VGAM953 host target gene. LOC158563 BINDING SITE is HOST TARGET binding site found in the 3' untranslated region of mRNA encoded by LOC158563, corresponding to a HOST TARGET binding site such as BINDING SITE I, BINDING SITE II or BINDING SITE III. Table 2 illustrates the complementarity of the nucleotide sequences of LOC158563 BINDING SITE, designated SEQ ID:39866, to the nucleotide sequence of VGAM953 RNA, herein designated VGAM RNA, also designated SEQ ID:3664.

Another function of VGAM953 is therefore inhibition of LOC158563 (Accession XM_088606). Accordingly, utilities of VGAM953 include diagnosis, prevention and treatment of diseases and clinical conditions associated with LOC158563. LOC255270 (Accession XM_170578) is another VGAM953 host target gene. LOC255270 BINDING SITE is HOST TARGET binding site found in the 5' untranslated region of mRNA encoded by LOC255270, corresponding to a HOST TARGET binding site such as BINDING SITE I, BINDING SITE II or BINDING SITE III. Table 2 illustrates the complementarity of the nucleotide sequences of LOC255270 BINDING SITE, designated SEQ ID:45389, to the nucleotide sequence of VGAM953 RNA, herein designated VGAM RNA, also designated SEQ ID:3664.

Another function of VGAM953 is therefore inhibition of LOC255270 (Accession XM_170578). Accordingly, utilities of VGAM953 include diagnosis, prevention and treatment of diseases and clinical conditions associated with LOC255270. LOC51026 (Accession NM_016072) is another VGAM953 host target gene. LOC51026 BINDING SITE is HOST TARGET binding site found in the 3' untranslated region of mRNA encoded by LOC51026, corresponding to a HOST TARGET binding site such as BINDING SITE I, BINDING SITE II or BINDING SITE III. Table 2 illustrates the complementarity of the nucleotide sequences of LOC51026 BINDING SITE, designated SEQ ID:18142, to the nucleotide sequence of VGAM953 RNA, herein designated VGAM RNA, also designated SEQ ID:3664.

Another function of VGAM953 is therefore inhibition of LOC51026 (Accession NM_016072). Accordingly, utilities of VGAM953 include diagnosis, prevention and treatment of diseases and clinical conditions associated with LOC51026. FIG. 1 further provides a conceptual description of a novel bioinformatically detected viral gene of the present invention, referred to here as Viral Genomic Address Messenger 954 (VGAM954) viral gene, which modulates expression of respective host target genes thereof, the function and utility of which host target genes is known in the art.

VGAM954 is a novel bioinformatically detected regulatory, non protein coding, viral micro RNA (miRNA) gene. The method by which VGAM954 was detected is described hereinabove with reference to FIGS. 1-8.

VGAM954 gene, herein designated VGAM GENE, is a viral gene contained in the genome of Tomato Spotted Wilt Virus. VGAM954 host target gene, herein designated VGAM HOST TARGET GENE, is a human gene contained in the human genome.

VGAM954 gene encodes a VGAM954 precursor RNA, herein designated VGAM PRECURSOR RNA. Similar to other miRNA genes, and unlike most ordinary genes, VGAM954 precursor RNA does not encode a protein. A nucleotide sequence identical or highly similar to the nucleotide sequence of VGAM954 precursor RNA is designated SEQ ID:940, and is provided hereinbelow with reference to the sequence listing part. Nucleotide sequence SEQ ID:940 is located at position 4634 relative to the genome of Tomato Spotted Wilt Virus.

VGAM954 precursor RNA folds onto itself, forming VGAM954 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM954 folded precursor RNA into VGAM954 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM954 RNA is designated SEQ ID:3665, and is provided hereinbelow with reference to the sequence listing part.

VGAM954 host target gene, herein designated VGAM HOST TARGET GENE, encodes a corresponding messenger RNA, VGAM954 host target RNA, herein designated VGAM HOST TARGET RNA. VGAM954 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM954 RNA, herein designated VGAM RNA, binds complementarily to one or more host target binding sites located in untranslated regions of VGAM954 host target RNA, herein designated VGAM HOST TARGET RNA. This complementary binding is due to the fact that the nucleotide sequence of VGAM954 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM954 RNA, herein designated VGAM RNA, may have a different number of host target binding sites in untranslated regions of a VGAM954 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM954 RNA, herein designated VGAM RNA, to host target binding sites on VGAM954 host target RNA, herein designated VGAM HOST TARGET RNA, such as BINDING SITE I, BINDING SITE II and BINDING SITE III, inhibits translation of VGAM954 host target RNA into VGAM954 host target protein, herein designated VGAM HOST TARGET PROTEIN. VGAM host target protein is therefore outlined by a broken line.

It is appreciated that VGAM954 host target gene, herein designated VGAM HOST TARGET GENE, in fact represents a plurality of VGAM954 host target genes. The mRNA of each one of this plurality of VGAM954 host target genes comprises one or more host target binding sites, each having a nucleotide sequence which is at least partly complementary to VGAM954 RNA, herein designated VGAM RNA, and which when bound by VGAM954 RNA causes inhibition of translation of respective one or more VGAM954 host target proteins.

It is further appreciated by one skilled in the art that the mode of translational inhibition illustrated by FIG. 1 with specific reference to translational inhibition exerted by VGAM954 gene, herein designated VGAM GENE, on one or more VGAM954 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM954 is inhibition of expression of host target genes, as part of a novel viral mechanism of attacking a host. Accordingly, utilities of VGAM954 include diagnosis, prevention and treatment of viral infection by Tomato Spotted Wilt Virus. Specific functions, and accordingly utilities, of VGAM954 correlate with, and may be deduced from, the identity of the host target genes which VGAM954 binds and inhibits, and the function of these host target genes, as elaborated hereinbelow.

Nucleotide sequences of the VGAM954 precursor RNA, herein designated VGAM PRECURSOR RNA, and of the 'diced' VGAM954 RNA, herein designated VGAM RNA, and a schematic representation of the secondary folding of VGAM954 folded precursor RNA, herein designated VGAM FOLDED PRECURSOR RNA, of VGAM954 are further described hereinbelow with reference to Table 1.

Nucleotide sequences of host target binding sites, such as BINDING SITE-I, BINDING SITE-II and BINDING SITE-III of FIG. 1, found on VGAM954 host target RNA, and schematic representation of the complementarity of each of these host target binding sites to VGAM954 RNA, herein designated VGAM RNA, are described hereinbelow with reference to Table 2.

As mentioned hereinabove with reference to FIG. 1, a function of VGAM954 gene, herein designated VGAM is inhibition of expression of VGAM954 target genes. It is appreciated that specific functions, and accordingly utilities, of VGAM954 correlate with, and may be deduced from, the identity of the target genes which VGAM954 binds and inhibits, and the function of these target genes, as elaborated hereinbelow.

Glycine Amidinotransferase (L-arginine:glycine amidinotransferase) (GATM, Accession NM_001482) is a VGAM954 host target gene. GATM BINDING SITE is HOST TARGET binding site found in the 3' untranslated region of mRNA encoded by GATM, corresponding to a HOST TARGET binding site such as BINDING SITE I, BINDING SITE II or BINDING SITE III. Table 2 illustrates the complementarity of the nucleotide sequences of GATM BINDING SITE, designated SEQ ID:7225, to the nucleotide sequence of VGAM954 RNA, herein designated VGAM RNA, also designated SEQ ID:3665.

A function of VGAM954 is therefore inhibition of Glycine Amidinotransferase (L-arginine:glycine amidinotransferase) (GATM, Accession NM_001482), a gene which glycine amidinotransferase; component of the creatine biosynthetic pathway. Accordingly, utilities of VGAM954 include diagnosis, prevention and treatment of diseases and clinical conditions associated with GATM. The function of GATM and its association with various diseases and clinical conditions, has been established by previous studies, as described hereinabove with reference to VGAM24. Hypoxia-inducible Factor 1, Alpha Subunit (basic helix-loop-helix transcription factor) (HIF1A, Accession NM_001530) is another VGAM954 host target gene. HIF1A BINDING SITE is HOST TARGET binding site found in the 3' untranslated region of mRNA encoded by HIF1A, corresponding to a HOST TARGET binding site such as BINDING SITE I, BINDING SITE II or BINDING SITE III. Table 2 illustrates the complementarity of the nucleotide sequences of HIF1A BINDING SITE, designated SEQ ID:7264, to the nucleotide sequence of VGAM954 RNA, herein designated VGAM RNA, also designated SEQ ID:3665.

Another function of VGAM954 is therefore inhibition of Hypoxia-inducible Factor 1, Alpha Subunit (basic helix-loop-helix transcription factor) (HIF1A, Accession NM_001530), a gene which is a basic helix-loop-helix transcription factor and mediates transcriptional responses to hypoxia and dioxin-signaling. Accordingly, utilities of VGAM954 include diagnosis, prevention and treatment of diseases and clinical conditions associated with HIF1A. The function of HIF1A and its association with various diseases and clinical conditions, has been established by previous studies, as described hereinabove with reference to VGAM229. AUT-like 1, Cysteine Endopeptidase (S. cerevisiae) (AUTL1, Accession NM_032852) is another VGAM954 host target gene. AUTL1 BINDING SITE is HOST TARGET binding site found in the 3' untranslated region of mRNA encoded by AUTL1, corresponding to a HOST TARGET binding site such as BINDING SITE I, BINDING SITE II or BINDING SITE III. Table 2 illustrates the complementarity of the nucleotide sequences of AUTL1 BINDING SITE, designated SEQ ID:26650, to the nucleotide sequence of VGAM954 RNA, herein designated VGAM RNA, also designated SEQ ID:3665.

Another function of VGAM954 is therefore inhibition of AUT-like 1, Cysteine Endopeptidase (S. cerevisiae) (AUTL1, Accession NM_032852). Accordingly, utilities of VGAM954 include diagnosis, prevention and treatment of diseases and clinical conditions associated with AUTL1. Phorbol-12-myristate-13-acetate-induced Protein 1 (PMAIP1, Accession NM_021127) is another VGAM954 host target gene. PMAIP1 BINDING SITE is HOST TARGET binding site found in the 3' untranslated region of mRNA encoded by PMAIP1, corresponding to a HOST TARGET binding site such as BINDING SITE I, BINDING SITE II or BINDING SITE III. Table 2 illustrates the complementarity of the nucleotide sequences of PMAIP1 BINDING SITE, designated SEQ ID:22099, to the nucleotide sequence of VGAM954 RNA, herein designated VGAM RNA, also designated SEQ ID:3665.

Another function of VGAM954 is therefore inhibition of Phorbol-12-myristate-13-acetate-induced Protein 1 (PMAIP1, Accession NM_021127). Accordingly, utilities of VGAM954 include diagnosis, prevention and treatment of diseases and clinical conditions associated with PMAIP1. PRO2037 (Accession NM_018616) is another VGAM954 host target gene. PRO2037 BINDING SITE is HOST TARGET binding site found in the 3' untranslated region of mRNA encoded by PRO2037, corresponding to a HOST TARGET binding site such as BINDING SITE I, BINDING SITE II or BINDING SITE III. Table 2 illustrates the complementarity of the nucleotide sequences of PRO2037 BINDING SITE, designated SEQ ID:20688, to the nucleotide sequence of VGAM954 RNA, herein designated VGAM RNA, also designated SEQ ID:3665.

Another function of VGAM954 is therefore inhibition of PRO2037 (Accession NM_018616). Accordingly, utilities of VGAM954 include diagnosis, prevention and treatment of diseases and clinical conditions associated with PRO2037. LOC149711 (Accession XM_097720) is another VGAM954 host target gene. LOC149711 BINDING SITE is HOST TARGET binding site found in the 3' untranslated region of mRNA encoded by LOC149711, corresponding to a HOST TARGET binding site such as BINDING SITE I, BINDING SITE II or BINDING SITE III. Table 2 illustrates the complementarity of the nucleotide sequences of LOC149711 BINDING SITE, designated SEQ ID:41069, to the nucleotide sequence of VGAM954 RNA, herein designated VGAM RNA, also designated SEQ ID:3665.

Another function of VGAM954 is therefore inhibition of LOC149711 (Accession XM_097720). Accordingly, utilities of VGAM954 include diagnosis, prevention and treatment of diseases and clinical conditions associated with LOC149711. LOC158156 (Accession XM_088496) is another VGAM954 host target gene. LOC158156 BINDING SITE is HOST TARGET binding site found in the 3' untranslated region of mRNA encoded by LOC158156, corresponding to a HOST TARGET binding site such as BINDING SITE I, BINDING SITE II or BINDING SITE III. Table 2 illustrates the complementarity of the nucleotide sequences of LOC158156 BINDING SITE, designated SEQ ID:39737, to the nucleotide sequence of VGAM954 RNA, herein designated VGAM RNA, also designated SEQ ID:3665.

Another function of VGAM954 is therefore inhibition of LOC158156 (Accession XM_088496). Accordingly, utilities of VGAM954 include diagnosis, prevention and treatment of diseases and clinical conditions associated with LOC158156. LOC162137 (Accession XM_102426) is another VGAM954 host target gene. LOC162137 BINDING SITE is HOST TARGET binding site found in the 3' untranslated region of mRNA encoded by LOC162137, corresponding to a HOST TARGET binding site such as BINDING SITE I, BINDING SITE II or BINDING SITE III. Table 2 illustrates the complementarity of the nucleotide sequences of LOC162137 BINDING SITE, designated SEQ ID:42116, to the nucleotide sequence of VGAM954 RNA, herein designated VGAM RNA, also designated SEQ ID:3665.

Another function of VGAM954 is therefore inhibition of LOC162137 (Accession XM_102426). Accordingly, utilities of VGAM954 include diagnosis, prevention and treatment of diseases and clinical conditions associated with LOC162137. FIG. 1 further provides a conceptual description of a novel bioinformatically detected viral gene of the present invention, referred to here as Viral Genomic Address Messenger 955 (VGAM955) viral gene, which modulates expression of respective host target genes thereof, the function and utility of which host target genes is known in the art.

VGAM955 is a novel bioinformatically detected regulatory, non protein coding, viral micro RNA (miRNA) gene. The method by which VGAM955 was detected is described hereinabove with reference to FIGS. 1-8.

VGAM955 gene, herein designated VGAM GENE, is a viral gene contained in the genome of Tomato Spotted Wilt Virus. VGAM955 host target gene, herein designated VGAM HOST TARGET GENE, is a human gene contained in the human genome.

VGAM955 gene encodes a VGAM955 precursor RNA, herein designated VGAM PRECURSOR RNA. Similar to other miRNA genes, and unlike most ordinary genes, VGAM955 precursor RNA does not encode a protein. A nucleotide sequence identical or highly similar to the nucleotide sequence of VGAM955 precursor RNA is designated SEQ ID:941, and is provided hereinbelow with reference to the sequence listing part. Nucleotide sequence SEQ ID:941 is located at position 4126 relative to the genome of Tomato Spotted Wilt Virus.

VGAM955 precursor RNA folds onto itself, forming VGAM955 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or a partial inversed-reversed sequence of the nucleotide sequence of the second half thereof.

An enzyme complex designated DICER COMPLEX, 'dices' the VGAM955 folded precursor RNA into VGAM955 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM955 RNA is designated SEQ ID:3666, and is provided hereinbelow with reference to the sequence listing part.

VGAM955 host target gene, herein designated VGAM HOST TARGET GENE, encodes a corresponding messenger RNA, VGAM955 host target RNA, herein designated VGAM HOST TARGET RNA. VGAM955 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM955 RNA, herein designated VGAM RNA, binds complementarily to one or more host target binding sites located in untranslated regions of VGAM955 host target RNA, herein designated VGAM HOST TARGET RNA. This complementary binding is due to the fact that the nucleotide sequence of VGAM955 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM955 RNA, herein designated VGAM RNA, may have a different number of host target binding sites in untranslated regions of a VGAM955 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM955 RNA, herein designated VGAM RNA, to host target binding sites on VGAM955 host target RNA, herein designated VGAM HOST TARGET RNA, such as BINDING SITE I, BINDING SITE II and BINDING SITE III, inhibits translation of VGAM955 host target RNA into VGAM955 host target protein, herein designated VGAM HOST TARGET PROTEIN. VGAM host target protein is therefore outlined by a broken line.

It is appreciated that VGAM955 host target gene, herein designated VGAM HOST TARGET GENE, in fact represents a plurality of VGAM955 host target genes. The mRNA of each one of this plurality of VGAM955 host target genes comprises one or more host target binding sites, each having a nucleotide sequence which is at least partly complementary to VGAM955 RNA, herein designated VGAM RNA, and which when bound by VGAM955 RNA causes inhibition of translation of respective one or more VGAM955 host target proteins.

It is further appreciated by one skilled in the art that the mode of translational inhibition illustrated by FIG. 1 with specific reference to translational inhibition exerted by VGAM955 gene, herein designated VGAM GENE, on one or more VGAM955 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM955 is inhibition of expression of host target genes, as part of a novel viral mechanism of attacking a host. Accordingly, utilities of VGAM955 include diagnosis, prevention and treatment of viral infection by Tomato Spotted Wilt Virus. Specific functions, and accordingly utilities, of VGAM955 correlate with, and may be deduced from, the identity of the host target genes which VGAM955 binds and inhibits, and the function of these host target genes, as elaborated hereinbelow.

Nucleotide sequences of the VGAM955 precursor RNA, herein designated VGAM PRECURSOR RNA, and of the 'diced' VGAM955 RNA, herein designated VGAM RNA, and a schematic representation of the secondary folding of VGAM955 folded precursor RNA, herein designated VGAM FOLDED PRECURSOR RNA, of VGAM955 are further described hereinbelow with reference to Table 1.

Nucleotide sequences of host target binding sites, such as BINDING SITE-I, BINDING SITE-II and BINDING SITE-III of FIG. 1, found on VGAM955 host target RNA, and schematic representation of the complementarity of each of these host target binding sites to VGAM955 RNA, herein designated VGAM RNA, are described hereinbelow with reference to Table 2.

As mentioned hereinabove with reference to FIG. 1, a function of VGAM955 gene, herein designated VGAM is inhibition of expression of VGAM955 target genes. It is appreciated that specific functions, and accordingly utilities, of VGAM955 correlate with, and may be deduced from, the identity of the target genes which VGAM955 binds and inhibits, and the function of these target genes, as elaborated hereinbelow.

ATPase, Class VI, Type 11A (ATP11A, Accession XM_085028) is a VGAM955 host target gene. ATP11A BINDING SITE is HOST TARGET binding site found in the 3' untranslated region of mRNA encoded by ATP11A, corresponding to a HOST TARGET binding site such as BINDING SITE I, BINDING SITE II or BINDING SITE III. Table 2 illustrates the complementarity of the nucleotide sequences of ATP11A BINDING SITE, designated SEQ ID:37806, to the nucleotide sequence of VGAM955 RNA, herein designated VGAM RNA, also designated SEQ ID:3666.

A function of VGAM955 is therefore inhibition of ATPase, Class VI, Type 11A (ATP11A, Accession XM_085028). Accordingly, utilities of VGAM955 include diagnosis, prevention and treatment of diseases and clinical conditions associated with ATP11A. Brain and Acute Leukemia, Cytoplasmic (BAALC, Accession NM_024812) is another VGAM955 host target gene. BAALC BINDING SITE is HOST TARGET binding site found in the 3' untranslated region of mRNA encoded by BAALC, corresponding to a HOST TARGET binding site such as BINDING SITE I, BINDING SITE II or BINDING SITE III. Table 2 illustrates the complementarity of the nucleotide sequences of BAALC BINDING SITE, designated SEQ ID:24199, to the nucleotide sequence of VGAM955 RNA, herein designated VGAM RNA, also designated SEQ ID:3666.

Another function of VGAM955 is therefore inhibition of Brain and Acute Leukemia, Cytoplasmic (BAALC, Accession NM_024812). Accordingly, utilities of VGAM955 include diagnosis, prevention and treatment of diseases and clinical conditions associated with BAALC. Cytochrome P450, Subfamily IIIA (niphedipine oxidase), Polypeptide 4 (CYP3A4, Accession NM_017460) is another VGAM955 host target gene. CYP3A4 BINDING SITE is HOST TARGET binding site found in the 3' untranslated region of mRNA encoded by CYP3A4, corresponding to a HOST TARGET binding site such as BINDING SITE I, BINDING SITE II or BINDING SITE III. Table 2 illustrates the complementarity of the nucleotide sequences of CYP3A4 BINDING SITE, designated SEQ ID:18932, to the nucleotide sequence of VGAM955 RNA, herein designated VGAM RNA, also designated SEQ ID:3666.

Another function of VGAM955 is therefore inhibition of Cytochrome P450, Subfamily IIIA (niphedipine oxidase), Polypeptide 4 (CYP3A4, Accession NM_017460), a gene which may be involved in an nadph-dependent electron transport pathway. Accordingly, utilities of VGAM955 include diagnosis, prevention and treatment of diseases and clinical conditions associated with CYP3A4. The function of CYP3A4 has been established by previous studies. Watkins et al. (1985) identified a glucocorticoid-inducible cytochrome P450 in human liver. Molowa et al. (1986) reported the complete cDNA sequence of this P450. Wrighton and Vandenbranden (1989) isolated a CYP3-type cytochrome P450 from human fetal liver. By somatic cell hybridization and in situ hybridization, Riddell et al. (1987) assigned to chromosome 7 the gene for a cytochrome P450 that encodes the enzyme nifedipine oxidase (CYP3). The assignment to chromosome 7 was corroborated by Gonzalez et al. (1988) by use of somatic cell hybrids. These authors also provided additional evidence supporting the identity of P450PCN1 and nifedipine oxidase. By multipoint linkage analysis using DNA markers known to be located on chromosome 7, Brooks et al. (1988) concluded that the most likely location of CYP3 is 7q21-q22.1. No recombination with a COL1A2 (OMIM Ref. No. 120160) marker was found. Spurr et al. (1989) assigned CYP3 to 7q22-qter by study of a panel of human-rodent somatic cell hybrids. Inoue et al. (1992) mapped CYP3A4 to 7q22.1 by fluorescence in situ hybridization. The induction of CYP3A enzymes is species-specific and believed to involve 1 or more cellular factors, or receptor-like xenosensors. Xie et al. (2000) identified PXR/SXR as one such factor. They showed that targeted disruption of the mouse Pxr gene abolished induction of CYP3A by prototypic inducers such as dexamethasone or pregnenolone-16-alpha-carbonitrile. In Pxr-null mice carrying a transgene for an activated form of human SXR, there was constitutive upregulation of CYP3A gene expression and enhanced protection against toxic xenobiotic compounds. Xie et al. (2000) demonstrated that species origin of the receptor, rather than the promoter structure of the CYP3A genes, dictates the species-specific pattern of CYP3A inducibility. Thus, they could generate 'human Ized' transgenic mice that were responsive to human-specific inducers such as the antibiotic rifampicin. Xie et al. (2000) concluded that the SXR/PXR genes encode the primary species-specific xenosensors that mediate the adaptive hepatic response, and may represent the critical biochemical mechanism of human xenoprotection.

Full details of the abovementioned studies are described in the following publications, the disclosure of which are hereby incorporated by reference:

Inoue, K.; Inazawa, J.; Nakagawa, H.; Shimada, T.; Yamazaki, H.; Guengerich, F. P.; Abe, T.: Assignment of the human cytochrome P-450 nifedipine oxidase gene (CYP3A4) to chromosome 7 at band q22.1 by fluorescence in situ hybridization. Jpn. J. Hum. Genet. 37:133-138, 1992; and Xie, W.; Barwick, J. L.; Downes, M.; Blumberg, B.; Simon, C. M.; Nelson, M. C.; Neuschwander-Tetri, B. A.; Brunt, E. M.; Guzelian, P. S.; Evans, R. M.: human Ized xenobiotic response.

Further studies establishing the function and utilities of CYP3A4 are found in John Hopkins OMIM database record ID 124010, and in sited publications numbered 3412-3425, 12760-12761, 3426-3428, 366 and 3672-3681 listed in the bibliography section hereinbelow, which are also hereby incorporated by reference. Dual-specificity tyrosine-(Y)-phosphorylation Regulated Kinase 2 (DYRK2, Accession NM_003583) is another VGAM955 host target gene. DYRK2 BINDING SITE1 and DYRK2 BINDING SITE2 are HOST TARGET binding sites found in untranslated regions of mRNA encoded by DYRK2, corresponding to HOST TARGET binding sites such as BINDING SITE I, BINDING SITE II or BINDING SITE III. Table 2 illustrates the complementarity of the nucleotide sequences of DYRK2 BINDING SITE1 and DYRK2 BINDING SITE2, designated SEQ ID:9631 and SEQ ID:13207 respectively, to the nucleotide sequence of VGAM955 RNA, herein designated VGAM RNA, also designated SEQ ID:3666.

Another function of VGAM955 is therefore inhibition of Dual-specificity tyrosine-(Y)-phosphorylation Regulated Kinase 2 (DYRK2, Accession NM_003583). Accordingly, utilities of VGAM955 include diagnosis, prevention and treatment of diseases and clinical conditions associated with DYRK2. Chromosome 5 Open Reading Frame 4 (C5orf4, Accession NM_016348) is another VGAM955 host target gene. C5orf4 BINDING SITE1 and C5orf4 BINDING SITE2 are HOST TARGET binding sites found in untranslated regions of mRNA encoded by C5orf4, corresponding to HOST TARGET binding sites such as BINDING SITE I, BINDING SITE II or BINDING SITE III. Table 2 illustrates the complementarity of the nucleotide sequences of C5orf4 BINDING SITE1 and C5orf4 BINDING SITE2, designated SEQ ID:18477 and SEQ ID:26186 respectively, to the nucleotide sequence of VGAM955 RNA, herein designated VGAM RNA, also designated SEQ ID:3666.

Another function of VGAM955 is therefore inhibition of Chromosome 5 Open Reading Frame 4 (C5orf4, Accession NM_016348). Accordingly, utilities of VGAM955 include diagnosis, prevention and treatment of diseases and clinical conditions associated with C5orf4. DKFZp434F142 (Accession NM_032254) is another VGAM955 host target gene. DKFZp434F142 BINDING SITE is HOST TARGET binding site found in the 3' untranslated region of mRNA encoded by DKFZp434F142, corresponding to a HOST TARGET binding site such as BINDING SITE I, BINDING SITE II or BINDING SITE III. Table 2 illustrates the complementarity of the nucleotide sequences of DKFZp434F142 BINDING SITE, designated SEQ ID:25996, to the nucleotide sequence of VGAM955 RNA, herein designated VGAM RNA, also designated SEQ ID:3666.

Another function of VGAM955 is therefore inhibition of DKFZp434F142 (Accession NM_032254). Accordingly, utilities of VGAM955 include diagnosis, prevention and treatment of diseases and clinical conditions associated with DKFZp434F142. DKFZP434K1772 (Accession XM_041936) is another VGAM955 host target gene. DKFZP434K1772 BINDING SITE is HOST TARGET binding site found in the 3' untranslated region of mRNA encoded by DKFZP434K1772, corresponding to a HOST TARGET binding site such as BINDING SITE I, BINDING SITE II or BINDING SITE III. Table 2 illustrates the complementarity of the nucleotide sequences of DKFZP434K1772 BINDING SITE, designated SEQ ID:33632, to the nucleotide sequence of VGAM955 RNA, herein designated VGAM RNA, also designated SEQ ID:3666.

Another function of VGAM955 is therefore inhibition of DKFZP434K1772 (Accession XM_041936). Accordingly, utilities of VGAM955 include diagnosis, prevention and treatment of diseases and clinical conditions associated with DKFZP434K1772. Formin Homology 2 Domain Containing 2 (FHOD2, Accession XM_057927) is another VGAM955 host target gene. FHOD2 BINDING SITE is HOST TARGET binding site found in the 5' untranslated region of mRNA encoded by FHOD2, corresponding to a HOST TARGET binding site such as BINDING SITE I, BINDING SITE II or BINDING SITE III. Table 2 illustrates the complementarity of the nucleotide sequences of FHOD2 BINDING SITE, designated SEQ ID:36551, to the nucleotide sequence of VGAM955 RNA, herein designated VGAM RNA, also designated SEQ ID:3666.

Another function of VGAM955 is therefore inhibition of Formin Homology 2 Domain Containing 2 (FHOD2, Accession XM_057927). Accordingly, utilities of VGAM955 include diagnosis, prevention and treatment of diseases and clinical conditions associated with FHOD2. FLJ14437 (Accession NM_032578) is another VGAM955 host target gene. FLJ14437 BINDING SITE is HOST TARGET binding site found in the 5' untranslated region of mRNA encoded by FLJ14437, corresponding to a HOST TARGET binding site such as BINDING SITE I, BINDING SITE II or BINDING SITE III. Table 2 illustrates the complementarity of the nucleotide sequences of FLJ14437 BINDING SITE, designated SEQ ID:26309, to the nucleotide sequence of VGAM955 RNA, herein designated VGAM RNA, also designated SEQ ID:3666.

Another function of VGAM955 is therefore inhibition of FLJ14437 (Accession NM_032578). Accordingly, utilities of VGAM955 include diagnosis, prevention and treatment of diseases and clinical conditions associated with FLJ14437. KIAA0084 (Accession XM_042841) is another VGAM955 host target gene. KIAA0084 BINDING SITE is HOST TARGET binding site found in the 5' untranslated region of mRNA encoded by KIAA0084, corresponding to a HOST TARGET binding site such as BINDING SITE I, BINDING SITE II or BINDING SITE III. Table 2 illustrates the complementarity of the nucleotide sequences of KIAA0084 BINDING SITE, designated SEQ ID:33807, to the nucleotide sequence of VGAM955 RNA, herein designated VGAM RNA, also designated SEQ ID:3666.

Another function of VGAM955 is therefore inhibition of KIAA0084 (Accession XM_042841). Accordingly, utilities of VGAM955 include diagnosis, prevention and treatment of diseases and clinical conditions associated with KIAA0084. MGC3130 (Accession NM_024032) is another VGAM955 host target gene. MGC3130 BINDING SITE is HOST TARGET binding site found in the 3' untranslated region of mRNA encoded by MGC3130, corresponding to a HOST TARGET binding site such as BINDING SITE I, BINDING SITE II or BINDING SITE III. Table 2 illustrates the complementarity of the nucleotide sequences of MGC3130 BINDING SITE, designated SEQ ID:23462, to the nucleotide sequence of VGAM955 RNA, herein designated VGAM RNA, also designated SEQ ID:3666.

Another function of VGAM955 is therefore inhibition of MGC3130 (Accession NM_024032). Accordingly, utilities of VGAM955 include diagnosis, prevention and treatment of diseases and clinical conditions associated with MGC3130. PBX/knotted 1 Homeobox 2 (PKNOX2, Accession XM_165574) is another VGAM955 host target gene. PKNOX2 BINDING SITE is HOST TARGET binding site found in the 3' untranslated region of mRNA encoded by PKNOX2, corresponding to a HOST TARGET binding site such as BINDING SITE I, BINDING SITE II or BINDING SITE III. Table 2 illustrates the complementarity of the nucleotide sequences of PKNOX2 BINDING SITE, designated SEQ ID:43694, to the nucleotide sequence of VGAM955 RNA, herein designated VGAM RNA, also designated SEQ ID:3666.

Another function of VGAM955 is therefore inhibition of PBX/knotted 1 Homeobox 2 (PKNOX2, Accession XM_165574). Accordingly, utilities of VGAM955 include diagnosis, prevention and treatment of diseases and clinical conditions associated with PKNOX2. SBB103 (Accession NM_005785) is another VGAM955 host target gene. SBB103 BINDING SITE is HOST TARGET binding site found in the 3' untranslated region of mRNA encoded by SBB103, corresponding to a HOST TARGET binding site such as BINDING SITE I, BINDING SITE II or BINDING SITE III. Table 2 illustrates the complementarity of the nucleotide sequences of SBB103 BINDING SITE, designated SEQ ID:12368, to the nucleotide sequence of VGAM955 RNA, herein designated VGAM RNA, also designated SEQ ID:3666.

Another function of VGAM955 is therefore inhibition of SBB103 (Accession NM_005785). Accordingly, utilities of VGAM955 include diagnosis, prevention and treatment of diseases and clinical conditions associated with SBB103. SCOP (Accession XM_166290) is another VGAM955 host target gene. SCOP BINDING SITE is HOST TARGET binding site found in the 3" untranslated region of mRNA encoded by SCOP, corresponding to a HOST TARGET binding site such as BINDING SITE I, BINDING SITE II or BINDING SITE III. Table 2 illustrates the complementarity of the nucleotide sequences of SCOP BINDING SITE, designated SEQ ID:44103, to the nucleotide sequence of VGAM955 RNA, herein designated VGAM RNA, also designated SEQ ID:3666.

Another function of VGAM955 is therefore inhibition of SCOP (Accession XM_166290). Accordingly, utilities of VGAM955 include diagnosis, prevention and treatment of diseases and clinical conditions associated with SCOP. TIP120A (Accession NM_018448) is another VGAM955 host target gene. TIP120A BINDING SITE is HOST TARGET binding site found in the 3' untranslated region of mRNA encoded by TIP120A, corresponding to a HOST TARGET binding site such as BINDING SITE I, BINDING SITE II or BINDING SITE III. Table 2 illustrates the complementarity of the nucleotide sequences of TIP120A BINDING SITE, designated SEQ ID:20517, to the nucleotide sequence of VGAM955 RNA, herein designated VGAM RNA, also designated SEQ ID:3666.

Another function of VGAM955 is therefore inhibition of TIP120A (Accession NM_018448). Accordingly, utilities of VGAM955 include diagnosis, prevention and treatment of diseases and clinical conditions associated with TIP120A. TRIAD3 (Accession XM_170517) is another VGAM955 host target gene. TRIAD3 BINDING SITE is HOST TARGET binding site found in the 3' untranslated region of mRNA encoded by TRIAD3, corresponding to a HOST TARGET binding site such as BINDING SITE I, BINDING SITE II or BINDING SITE III. Table 2 illustrates the complementarity of the nucleotide sequences of TRIAD3 BINDING SITE, designated SEQ ID:45349, to the nucleotide sequence of VGAM955 RNA, herein designated VGAM RNA, also designated SEQ ID:3666.

Another function of VGAM955 is therefore inhibition of TRIAD3 (Accession XM_170517). Accordingly, utilities of VGAM955 include diagnosis, prevention and treatment of diseases and clinical conditions associated with TRIAD3. Vav 3 Oncogene (VAV3, Accession NM_006113) is another VGAM955 host target gene. VAV3 BINDING SITE is HOST TARGET binding site found in the 3' untranslated region of mRNA encoded by VAV3, corresponding to a HOST TARGET binding site such as BINDING SITE I, BINDING SITE II or BINDING SITE III. Table 2 illustrates the complementarity of the nucleotide sequences of VAV3 BINDING SITE, designated SEQ ID:12759, to the nucleotide sequence of VGAM955 RNA, herein designated VGAM RNA, also designated SEQ ID:3666.

Another function of VGAM955 is therefore inhibition of Vav 3 Oncogene (VAV3, Accession NM_006113). Accordingly, utilities of VGAM955 include diagnosis, prevention and treatment of diseases and clinical conditions associated with VAV3. ZNF361 (Accession NM_018555) is another VGAM955 host target gene. ZNF361 BINDING SITE is HOST TARGET binding site found in the 5' untranslated region of mRNA encoded by ZNF361, corresponding to a HOST TARGET binding site such as BINDING SITE I, BINDING SITE II or BINDING SITE III. Table 2 illustrates the complementarity of the nucleotide sequences of ZNF361 BINDING SITE, designated SEQ ID:20635, to the nucleotide sequence of VGAM955 RNA, herein designated VGAM RNA, also designated SEQ ID:3666.

Another function of VGAM955 is therefore inhibition of ZNF361 (Accession NM_018555). Accordingly, utilities of VGAM955 include diagnosis, prevention and treatment of diseases and clinical conditions associated with ZNF361. LOC144161 (Accession XM_096548) is another VGAM955 host target gene. LOC144161 BINDING SITE is HOST TARGET binding site found in the 3' untranslated region of mRNA encoded by LOC144161, corresponding to a HOST TARGET binding site such as BINDING SITE I, BINDING SITE II or BINDING SITE III. Table 2 illustrates the complementarity of the nucleotide sequences of LOC144161 BINDING SITE, designated SEQ ID:40389, to the nucleotide sequence of VGAM955 RNA, herein designated VGAM RNA, also designated SEQ ID:3666.

Another function of VGAM955 is therefore inhibition of LOC144161 (Accession XM_096548). Accordingly, utilities of VGAM955 include diagnosis, prevention and treatment of diseases and clinical conditions associated with LOC144161. LOC150035 (Accession XM_097793) is another VGAM955 host target gene. LOC150035 BINDING SITE is HOST TARGET binding site found in the 5' untranslated region of mRNA encoded by LOC150035, corresponding to a HOST TARGET binding site such as BINDING SITE I, BINDING SITE II or BINDING SITE III. Table 2 illustrates the complementarity of the nucleotide sequences of LOC150035 BINDING SITE, designated SEQ ID:41121, to the nucleotide sequence of VGAM955 RNA, herein designated VGAM RNA, also designated SEQ ID:3666.

Another function of VGAM955 is therefore inhibition of LOC150035 (Accession XM_097793). Accordingly, utilities of VGAM955 include diagnosis, prevention and treatment of diseases and clinical conditions associated with LOC150035. LOC151098 (Accession XM_087096) is another VGAM955 host target gene. LOC151098 BINDING SITE is HOST TARGET binding site found in the 5' untranslated region of mRNA encoded by LOC151098, corresponding to a HOST TARGET binding site such as BINDING SITE I, BINDING SITE II or BINDING SITE III. Table 2 illustrates the complementarity of the nucleotide sequences of LOC151098 BINDING SITE, designated SEQ ID:39049, to the nucleotide sequence of VGAM955 RNA, herein designated VGAM RNA, also designated SEQ ID:3666.

Another function of VGAM955 is therefore inhibition of LOC151098 (Accession XM_087096). Accordingly, utilities of VGAM955 include diagnosis, prevention and treatment of diseases and clinical conditions associated with LOC151098. LOC219540 (Accession XM_168047) is another VGAM955 host target gene. LOC219540 BINDING SITE is HOST TARGET binding site found in the 5' untranslated region of mRNA encoded by LOC219540, corresponding to a HOST TARGET binding site such as BINDING SITE I, BINDING SITE II or BINDING SITE III. Table 2 illustrates the complementarity of the nucleotide sequences of LOC219540 BINDING SITE, designated SEQ ID:44957, to the nucleotide sequence of VGAM955 RNA, herein designated VGAM RNA, also designated SEQ ID:3666.

Another function of VGAM955 is therefore inhibition of LOC219540 (Accession XM_168047). Accordingly, utilities of VGAM955 include diagnosis, prevention and treatment of diseases and clinical conditions associated with LOC219540. LOC257475 (Accession XM_051670) is another VGAM955 host target gene. LOC257475 BINDING SITE is HOST TARGET binding site found in the 5' untranslated region of mRNA encoded by LOC257475, corresponding to a HOST TARGET binding site such as BINDING SITE I, BINDING SITE II or BINDING SITE III. Table 2 illustrates the complementarity of the nucleotide sequences of LOC257475 BINDING SITE, designated SEQ ID:35860, to the nucleotide sequence of VGAM955 RNA, herein designated VGAM RNA, also designated SEQ ID:3666.

Another function of VGAM955 is therefore inhibition of LOC257475 (Accession XM_051670). Accordingly, utilities of VGAM955 include diagnosis, prevention and treatment of diseases and clinical conditions associated with LOC257475. FIG. 1 further provides a conceptual description of a novel bioinformatically detected viral gene of the present invention, referred to here as Viral Genomic Address Messenger 956 (VGAM956) viral gene, which modulates expression of respective host target genes thereof, the function and utility of which host target genes is known in the art.

VGAM956 is a novel bioinformatically detected regulatory, non protein coding, viral micro RNA (miRNA) gene. The method by which VGAM956 was detected is described hereinabove with reference to FIGS. 1-8.

VGAM956 gene, herein designated VGAM GENE, is a viral gene contained in the genome of Tomato Spotted Wilt Virus. VGAM956 host target gene, herein designated VGAM HOST TARGET GENE, is a human gene contained in the human genome.

VGAM956 gene encodes a VGAM956 precursor RNA, herein designated VGAM PRECURSOR RNA. Similar to other miRNA genes, and unlike most ordinary genes, VGAM956 precursor RNA does not encode a protein. A nucleotide sequence identical or highly similar to the nucleotide sequence of VGAM956 precursor RNA is designated SEQ ID:942, and is provided hereinbelow with reference to the sequence listing part. Nucleotide sequence SEQ ID:942 is located at position 3426 relative to the genome of Tomato Spotted Wilt Virus.

VGAM956 precursor RNA folds onto itself, forming VGAM956 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or a partial inversed-reversed sequence of the nucleotide sequence of the second half thereof.

An enzyme complex designated DICER COMPLEX, 'dices' the VGAM956 folded precursor RNA into VGAM956 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM956 RNA is designated SEQ ID:3667, and is provided hereinbelow with reference to the sequence listing part.

VGAM956 host target gene, herein designated VGAM HOST TARGET GENE, encodes a corresponding messenger RNA, VGAM956 host target RNA, herein designated VGAM HOST TARGET RNA. VGAM956 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM956 RNA, herein designated VGAM RNA, binds complementarily to one or more host target binding sites located in untranslated regions of VGAM956 host target RNA, herein designated VGAM HOST TARGET RNA. This complementary binding is due to the fact that the nucleotide sequence of VGAM956 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM956 RNA, herein designated VGAM RNA, may have a different number of host target binding sites in untranslated regions of a VGAM956 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM956 RNA, herein designated VGAM RNA, to host target binding sites on VGAM956 host target RNA, herein designated VGAM HOST TARGET RNA, such as BINDING SITE I, BINDING SITE II and BINDING SITE III, inhibits translation of VGAM956 host target RNA into VGAM956 host target protein, herein designated VGAM HOST TARGET PROTEIN. VGAM host target protein is therefore outlined by a broken line.

It is appreciated that VGAM956 host target gene, herein designated VGAM HOST TARGET GENE, in fact represents a plurality of VGAM956 host target genes. The mRNA of each one of this plurality of VGAM956 host target genes comprises one or more host target binding sites, each having a nucleotide sequence which is at least partly complementary to VGAM956 RNA, herein designated VGAM RNA, and which when bound by VGAM956 RNA causes inhibition of translation of respective one or more VGAM956 host target proteins.

It is further appreciated by one skilled in the art that the mode of translational inhibition illustrated by FIG. 1 with specific reference to translational inhibition exerted by VGAM956 gene, herein designated VGAM GENE, on one or more VGAM956 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM956 is inhibition of expression of host target genes, as part of a novel viral mechanism of attacking a host. Accordingly, utilities of VGAM956 include diagnosis, prevention and treatment of viral infection by Tomato Spotted Wilt Virus. Specific functions, and accordingly utilities, of VGAM956 correlate with, and may be deduced from, the identity of the host target genes which VGAM956 binds and inhibits, and the function of these host target genes, as elaborated hereinbelow.

Nucleotide sequences of the VGAM956 precursor RNA, herein designated VGAM PRECURSOR RNA, and of the 'diced' VGAM956 RNA, herein designated VGAM RNA, and a schematic representation of the secondary folding of VGAM956 folded precursor RNA, herein designated VGAM FOLDED PRECURSOR RNA, of VGAM956 are further described hereinbelow with reference to Table 1.

Nucleotide sequences of host target binding sites, such as BINDING SITE-I, BINDING SITE-II and BINDING SITE-III of FIG. 1, found on VGAM956 host target RNA, and schematic representation of the complementarity of each of these host target binding sites to VGAM956 RNA, herein designated VGAM RNA, are described hereinbelow with reference to Table 2.

As mentioned hereinabove with reference to FIG. 1, a function of VGAM956 gene, herein designated VGAM is inhibition of expression of VGAM956 target genes. It is appreciated that specific functions, and accordingly utilities, of VGAM956 correlate with, and may be deduced from, the identity of the target genes which VGAM956 binds and inhibits, and the function of these target genes, as elaborated hereinbelow.

JJAZ1 (Accession NM_015355) is a VGAM956 host target gene. JJAZ1 BINDING SITE is HOST TARGET binding site found in the 3' untranslated region of mRNA encoded by JJAZ1, corresponding to a HOST TARGET binding site such as BINDING SITE I, BINDING SITE II or BINDING SITE III. Table 2 illustrates the complementarity of the nucleotide sequences of JJAZ1 BINDING SITE, designated SEQ ID:17656, to the nucleotide sequence of VGAM956 RNA, herein designated VGAM RNA, also designated SEQ ID:3667.

A function of VGAM956 is therefore inhibition of JJAZ1 (Accession NM_015355), a gene which is a zinc finger protein. Accordingly, utilities of VGAM956 include diagnosis, prevention and treatment of diseases and clinical conditions associated with JJAZ1. The function of JJAZ1 and its association with various diseases and clinical conditions, has been established by previous studies, as described hereinabove with reference to VGAM231. NEBL (Accession NM_006393) is another VGAM956 host target gene. NEBL BINDING SITE is HOST TARGET binding site found in the 3' untranslated region of mRNA encoded by NEBL, corresponding to a HOST TARGET binding site such as BINDING SITE I, BINDING SITE II or BINDING SITE III. Table 2 illustrates the complementarity of the nucleotide sequences of NEBL BINDING SITE, designated SEQ ID:13099, to the nucleotide sequence of VGAM956 RNA, herein designated VGAM RNA, also designated SEQ ID:3667.

Another function of VGAM956 is therefore inhibition of NEBL (Accession NM_006393). Accordingly, utilities of VGAM956 include diagnosis, prevention and treatment of diseases and clinical conditions associated with NEBL. TEM7 (Accession NM_020405) is another VGAM956 host target gene. TEM7 BINDING SITE is HOST TARGET binding site found in the 3' untranslated region of mRNA encoded by TEM7, corresponding to a HOST TARGET binding site such as BINDING SITE I, BINDING SITE II or BINDING SITE III. Table 2 illustrates the complementarity of the nucleotide sequences of TEM7 BINDING SITE, designated SEQ ID:21671, to the nucleotide sequence of VGAM956 RNA, herein designated VGAM RNA, also designated SEQ ID:3667.

Another function of VGAM956 is therefore inhibition of TEM7 (Accession NM_020405), a gene which involves in angiogenesis. Accordingly, utilities of VGAM956 include diagnosis, prevention and treatment of diseases and clinical conditions associated with TEM7. The function of TEM7 and its association with various diseases and clinical conditions, has been established by previous studies, as described hereinabove with reference to VGAM23. FLJ11274 (Accession NM_018375) is another VGAM956 host target gene. FLJ11274 BINDING SITE is HOST TARGET binding site found in the 5' untranslated region of mRNA encoded by FLJ11274, corresponding to a HOST TARGET binding site such as BINDING SITE I, BINDING SITE II or BINDING SITE III. Table 2 illustrates the complementarity of the nucleotide sequences of FLJ11274 BINDING SITE, designated SEQ ID:20397, to the nucleotide sequence of VGAM956 RNA, herein designated VGAM RNA, also designated SEQ ID:3667.

Another function of VGAM956 is therefore inhibition of FLJ11274 (Accession NM_018375). Accordingly, utilities of VGAM956 include diagnosis, prevention and treatment of diseases and clinical conditions associated with FLJ11274. MGC12981 (Accession NM_032357) is another VGAM956 host target gene. MGC12981 BINDING SITE is HOST TARGET binding site found in the 3' untranslated region of mRNA encoded by MGC12981, corresponding to a HOST TARGET binding site such as BINDING SITE I, BINDING SITE II or BINDING SITE III. Table 2 illustrates the complementarity of the nucleotide sequences of MGC12981 BINDING SITE, designated SEQ ID:26142, to the nucleotide sequence of VGAM956 RNA, herein designated VGAM RNA, also designated SEQ ID:3667.

Another function of VGAM956 is therefore inhibition of MGC12981 (Accession NM_032357). Accordingly, utilities of VGAM956 include diagnosis, prevention and treatment of diseases and clinical conditions associated with MGC12981. LOC143310 (Accession XM_084485) is another VGAM956 host target gene. LOC143310 BINDING SITE is HOST TARGET binding site found in the 5' untranslated region of mRNA encoded by LOC143310, corresponding to a HOST TARGET binding site such as BINDING SITE I, BINDING SITE II or BINDING SITE III. Table 2 illustrates the complementarity of the nucleotide sequences of LOC143310 BINDING SITE, designated SEQ ID:37610, to the nucleotide sequence of VGAM956 RNA, herein designated VGAM RNA, also designated SEQ ID:3667.

Another function of VGAM956 is therefore inhibition of LOC143310 (Accession XM_084485). Accordingly, utilities of VGAM956 include diagnosis, prevention and treatment of diseases and clinical conditions associated with LOC143310. FIG. 1 further provides a conceptual description of a novel bioinformatically detected viral gene of the present invention, referred to here as Viral Genomic Address Messenger 957 (VGAM957) viral gene, which modulates expression of respective host target genes thereof, the function and utility of which host target genes is known in the art.

VGAM957 is a novel bioinformatically detected regulatory, non protein coding, viral micro RNA (miRNA) gene. The method by which VGAM957 was detected is described hereinabove with reference to FIGS. 1-8.

VGAM957 gene, herein designated VGAM GENE, is a viral gene contained in the genome of Tomato Spotted Wilt Virus. VGAM957 host target gene, herein designated VGAM HOST TARGET GENE, is a human gene contained in the human genome.

VGAM957 gene encodes a VGAM957 precursor RNA, herein designated VGAM PRECURSOR RNA. Similar to other miRNA genes, and unlike most ordinary genes, VGAM957 precursor RNA does not encode a protein. A nucleotide sequence identical or highly similar to the nucleotide sequence of VGAM957 precursor RNA is designated SEQ ID:943, and is provided hereinbelow with reference to the sequence listing part. Nucleotide sequence SEQ ID:943 is located at position 704 relative to the genome of Tomato Spotted Wilt Virus.

VGAM957 precursor RNA folds onto itself, forming VGAM957 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM957 folded precursor RNA into VGAM957 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM957 RNA is designated SEQ ID:3668, and is provided hereinbelow with reference to the sequence listing part.

VGAM957 host target gene, herein designated VGAM HOST TARGET GENE, encodes a corresponding messenger RNA, VGAM957 host target RNA, herein designated VGAM HOST TARGET RNA. VGAM957 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM957 RNA, herein designated VGAM RNA, binds complementarily to one or more host target binding sites located in untranslated regions of VGAM957 host target RNA, herein designated VGAM HOST TARGET RNA. This complementary binding is due to the fact that the nucleotide sequence of VGAM957 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM957 RNA, herein designated VGAM RNA, may have a different number of host target binding sites in untranslated regions of a VGAM957 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM957 RNA, herein designated VGAM RNA, to host target binding sites on VGAM957 host target RNA, herein designated VGAM HOST TARGET RNA, such as BINDING SITE I, BINDING SITE II and BINDING SITE III, inhibits translation of VGAM957 host target RNA into VGAM957 host target protein, herein designated VGAM HOST TARGET PROTEIN. VGAM host target protein is therefore outlined by a broken line.

It is appreciated that VGAM957 host target gene, herein designated VGAM HOST TARGET GENE, in fact represents a plurality of VGAM957 host target genes. The mRNA of each one of this plurality of VGAM957 host target genes comprises one or more host target binding sites, each having a nucleotide sequence which is at least partly complementary to VGAM957 RNA, herein designated VGAM RNA, and which when bound by VGAM957 RNA causes inhibition of translation of respective one or more VGAM957 host target proteins.

It is further appreciated by one skilled in the art that the mode of translational inhibition illustrated by FIG. 1 with specific reference to translational inhibition exerted by VGAM957 gene, herein designated VGAM GENE, on one or more VGAM957 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM957 is inhibition of expression of host target genes, as part of a novel viral mechanism of attacking a host. Accordingly, utilities of VGAM957 include diagnosis, prevention and treatment of viral infection by Tomato Spotted Wilt Virus. Specific functions, and accordingly utilities, of VGAM957 correlate with, and may be deduced from, the identity of the host target genes which VGAM957 binds and inhibits, and the function of these host target genes, as elaborated hereinbelow.

Nucleotide sequences of the VGAM957 precursor RNA, herein designated VGAM PRECURSOR RNA, and of the 'diced' VGAM957 RNA, herein designated VGAM RNA, and a schematic representation of the secondary folding of VGAM957 folded precursor RNA, herein designated VGAM FOLDED PRECURSOR RNA, of VGAM957 are further described hereinbelow with reference to Table 1.

Nucleotide sequences of host target binding sites, such as BINDING SITE-I, BINDING SITE-II and BINDING SITE-III of FIG. 1, found on VGAM957 host target RNA, and schematic representation of the complementarity of each of these host target binding sites to VGAM957 RNA, herein designated VGAM RNA, are described hereinbelow with reference to Table 2.

As mentioned hereinabove with reference to FIG. 1, a function of VGAM957 gene, herein designated VGAM is inhibition of expression of VGAM957 target genes. It is appreciated that specific functions, and accordingly utilities, of VGAM957 correlate with, and may be deduced from, the identity of the target genes which VGAM957 binds and inhibits, and the function of these target genes, as elaborated hereinbelow.

Golgi Autoantigen, Golgin Subfamily A, 4 (GOLGA4, Accession XM_011069) is a VGAM957 host target gene. GOLGA4 BINDING SITE is HOST TARGET binding site found in the 3' untranslated region of mRNA encoded by GOLGA4, corresponding to a HOST TARGET binding site such as BINDING SITE I, BINDING SITE II or BINDING SITE III. Table 2 illustrates the complementarity of the nucleotide sequences of GOLGA4 BINDING SITE, designated SEQ ID:30165, to the nucleotide sequence of VGAM957 RNA, herein designated VGAM RNA, also designated SEQ ID:3668.

A function of VGAM957 is therefore inhibition of Golgi Autoantigen, Golgin Subfamily A, 4 (GOLGA4, Accession XM_011069), a gene which may play a role in vesicular transport from the trans-golgi. Accordingly, utilities of VGAM957 include diagnosis, prevention and treatment of diseases and clinical conditions associated with GOLGA4. The function of GOLGA4 and its association with various diseases and clinical conditions, has been established by previous studies, as described hereinabove with reference to VGAM841. Outer Dense Fiber of Sperm Tails 2 (ODF2, Accession NM_002540) is another VGAM957 host target gene. ODF2 BINDING SITE is HOST TARGET binding site found in the 3' untranslated region of mRNA encoded by ODF2, corresponding to a HOST TARGET binding site such as BINDING SITE I, BINDING SITE II or BINDING SITE III. Table 2 illustrates the complementarity of the nucleotide sequences of ODF2 BINDING SITE, designated SEQ ID:8389, to the nucleotide sequence of VGAM957 RNA, herein designated VGAM RNA, also designated SEQ ID:3668.

Another function of VGAM957 is therefore inhibition of Outer Dense Fiber of Sperm Tails 2 (ODF2, Accession NM_002540), a gene which is very strongly similar to rat Odf2. Accordingly, utilities of VGAM957 include diagnosis, prevention and treatment of diseases and clinical conditions associated with ODF2. The function of ODF2 and its association with various diseases and clinical conditions, has been established by previous studies, as described hereinabove with reference to VGAM363. Platelet-activating Factor Acetylhydrolase, Isoform Ib, Alpha Subunit 45 kDa (PAFAH1B1, Accession NM_000430) is another VGAM957 host target gene. PAFAH1B1 BINDING SITE is HOST TARGET binding site found in the 3' untranslated region of mRNA encoded by PAFAH1B1, corresponding to a HOST TARGET binding site such as BINDING SITE I, BINDING SITE II or BINDING SITE III. Table 2 illustrates the complementarity of the nucleotide sequences of PAFAH1B1 BINDING SITE, designated SEQ ID:6015, to the nucleotide sequence of VGAM957 RNA, herein designated VGAM RNA, also designated SEQ ID:3668.

Another function of VGAM957 is therefore inhibition of Platelet-activating Factor Acetylhydrolase, Isoform Ib, Alpha Subunit 45 kDa (PAFAH1B1, Accession NM_000430). Accordingly, utilities of VGAM957 include diagnosis, prevention and treatment of diseases and clinical conditions associated with PAFAH1B1. Steroid-5-alpha-reductase, Alpha Polypeptide 2 (3-oxo-5 alpha-steroid delta 4-dehydrogenase alpha 2) (SRD5A2, Accession XM_002471) is another VGAM957 host target gene. SRD5A2 BINDING SITE is HOST TARGET binding site found in the 5' untranslated region of mRNA encoded by SRD5A2, corresponding to a HOST TARGET binding site such as BINDING SITE I, BINDING SITE II or BINDING SITE III. Table 2 illustrates the complementarity of the nucleotide sequences of SRD5A2 BINDING SITE, designated SEQ ID:29888, to the nucleotide sequence of VGAM957 RNA, herein designated VGAM RNA, also designated SEQ ID:3668.

Another function of VGAM957 is therefore inhibition of Steroid-5-alpha-reductase, Alpha Polypeptide 2 (3-oxo-5 alpha-steroid delta 4-dehydrogenase alpha 2) (SRD5A2, Accession XM_002471). Accordingly, utilities of VGAM957 include diagnosis, prevention and treatment of diseases and clinical conditions associated with SRD5A2. Trichorhinophalangeal Syndrome I (TRPS1, Accession NM_014112) is another VGAM957 host target gene. TRPS1 BINDING SITE is HOST TARGET binding site found in the 5' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15358, to the nucleotide sequence of VGAM957 RNA, herein designated VGAM RNA, also designated SEQ ID:3668.

Another function of VGAM957 is therefore inhibition of Trichorhinophalangeal Syndrome I (TRPS1, Accession NM_014112), a gene which may function as a transcriptional activator protein. Accordingly, utilities of VGAM957 include diagnosis, prevention and treatment of diseases and clinical conditions associated with TRPS1. The function of TRPS1 and its association with various diseases and clinical conditions, has been established by previous studies, as described hereinabove with reference to VGAM172. Chromosome 20 Open Reading Frame 21 (C20orf21, Accession NM_017798) is another VGAM957 host target gene. C20orf21 BINDING SITE is HOST TARGET binding site found in the 3' untranslated region of mRNA encoded by C20orf21, corresponding to a HOST TARGET binding site such as BINDING SITE I, BINDING SITE II or BINDING SITE III. Table 2 illustrates the complementarity of the nucleotide sequences of C20orf21 BINDING SITE, designated SEQ ID:19443, to the nucleotide sequence of VGAM957 RNA, herein designated VGAM RNA, also designated SEQ ID:3668.

Another function of VGAM957 is therefore inhibition of Chromosome 20 Open Reading Frame 21 (C20orf21, Accession NM_017798). Accordingly, utilities of VGAM957 include diagnosis, prevention and treatment of diseases and clinical conditions associated with C20orf21. DKFZP564O0423 (Accession XM_166254) is another VGAM957 host target gene. DKFZP564O0423 BINDING SITE is HOST TARGET binding site found in the 3' untranslated region of mRNA encoded by DKFZP564O0423, corresponding to a HOST TARGET binding site such as BINDING SITE I, BINDING SITE II or BINDING SITE III. Table 2 illustrates the complementarity of the nucleotide sequences of DKFZP564O0423 BINDING SITE, designated SEQ ID:44071, to the nucleotide sequence of VGAM957 RNA, herein designated VGAM RNA, also designated SEQ ID:3668.

Another function of VGAM957 is therefore inhibition of DKFZP564O0423 (Accession XM_166254). Accordingly, utilities of VGAM957 include diagnosis, prevention and treatment of diseases and clinical conditions associated with DKFZP564O0423. FLJ13072 (Accession XM_117117) is another VGAM957 host target gene. FLJ13072 BINDING SITE is HOST TARGET binding site found in the 5' untranslated region of mRNA encoded by FLJ13072, corresponding to a HOST TARGET binding site such as BINDING SITE I, BINDING SITE II or BINDING SITE III. Table 2 illustrates the complementarity of the nucleotide sequences of FLJ13072 BINDING SITE, designated SEQ ID:43238, to the nucleotide sequence of VGAM957 RNA, herein designated VGAM RNA, also designated SEQ ID:3668.

Another function of VGAM957 is therefore inhibition of FLJ13072 (Accession XM_117117). Accordingly, utilities of VGAM957 include diagnosis, prevention and treatment of diseases and clinical conditions associated with FLJ13072. FLJ20055 (Accession NM_017643) is another VGAM957 host target gene. FLJ20055 BINDING SITE is HOST TARGET binding site found in the 3' untranslated region of mRNA encoded by FLJ20055, corresponding to a HOST TARGET binding site such as BINDING SITE I, BINDING SITE II or BINDING SITE III. Table 2 illustrates the complementarity of the nucleotide sequences of FLJ20055 BINDING SITE, designated SEQ ID:19147, to the nucleotide sequence of VGAM957 RNA, herein designated VGAM RNA, also designated SEQ ID:3668.

Another function of VGAM957 is therefore inhibition of FLJ20055 (Accession NM_017643). Accordingly, utilities of VGAM957 include diagnosis, prevention and treatment of diseases and clinical conditions associated with FLJ20055. MGC14798 (Accession NM_080650) is another VGAM957 host target gene. MGC14798 BINDING SITE is HOST TARGET binding site found in the 3' untranslated region of mRNA encoded by MGC14798, corresponding to a HOST TARGET binding site such as BINDING SITE I, BINDING SITE II or BINDING SITE III. Table 2 illustrates the complementarity of the nucleotide sequences of MGC14798 BINDING SITE, designated SEQ ID:27939, to the nucleotide sequence of VGAM957 RNA, herein designated VGAM RNA, also designated SEQ ID:3668.

Another function of VGAM957 is therefore inhibition of MGC14798 (Accession NM_080650). Accordingly, utilities of VGAM957 include diagnosis, prevention and treatment of diseases and clinical conditions associated with MGC14798. Protein Tyrosine Phosphatase, Receptor Type, F Polypeptide (PTPRF), Interacting Protein (liprin), Alpha 4 (PPFIA4, Accession XM_046751) is another VGAM957 host target gene. PPFIA4 BINDING SITE is HOST TARGET binding site found in the 3' untranslated region of mRNA encoded by PPFIA4, corresponding to a HOST TARGET binding site such as BINDING SITE I, BINDING SITE II or BINDING SITE III. Table 2 illustrates the complementarity of the nucleotide sequences of PPFIA4 BINDING SITE, designated SEQ ID:34823, to the nucleotide sequence of VGAM957 RNA, herein designated VGAM RNA, also designated SEQ ID:3668.

Another function of VGAM957 is therefore inhibition of Protein Tyrosine Phosphatase, Receptor Type, F Polypeptide (PTPRF), Interacting Protein (liprin), Alpha 4 (PPFIA4, Accession XM_046751). Accordingly, utilities of VGAM957 include diagnosis, prevention and treatment of diseases and clinical conditions associated with PPFIA4. PR Domain Containing 8 (PRDM8, Accession NM_020226) is another VGAM957 host target gene. PRDM8 BINDING SITE is HOST TARGET binding site found in the 5' untranslated region of mRNA encoded by PRDM8, corresponding to a HOST TARGET binding site such as BINDING SITE I, BINDING SITE II or BINDING SITE III. Table 2 illustrates the complementarity of the nucleotide sequences of PRDM8 BINDING SITE, designated SEQ ID:21492, to the nucleotide sequence of VGAM957 RNA, herein designated VGAM RNA, also designated SEQ ID:3668.

Another function of VGAM957 is therefore inhibition of PR Domain Containing 8 (PRDM8, Accession NM_020226). Accordingly, utilities of VGAM957 include diagnosis, prevention and treatment of diseases and clinical conditions associated with PRDM8. LOC129607 (Accession XM_059368) is another VGAM957 host target gene. LOC129607 BINDING SITE is HOST TARGET binding site found in the 3' untranslated region of mRNA encoded by LOC129607, corresponding to a HOST TARGET binding site such as BINDING SITE I, BINDING SITE II or BINDING SITE III. Table 2 illustrates the complementarity of the nucleotide sequences of LOC129607 BINDING SITE, designated SEQ ID:36977, to the nucleotide sequence of VGAM957 RNA, herein designated VGAM RNA, also designated SEQ ID:3668.

Another function of VGAM957 is therefore inhibition of LOC129607 (Accession XM_059368). Accordingly, utilities of VGAM957 include diagnosis, prevention and treatment of diseases and clinical conditions associated with LOC129607. LOC196424 (Accession XM_113718) is another VGAM957 host target gene. LOC196424 BINDING SITE is HOST TARGET binding site found in the 3' untranslated region of mRNA encoded by LOC196424, corresponding to a HOST TARGET binding site such as BINDING SITE I, BINDING SITE II or BINDING SITE III. Table 2 illustrates the complementarity of the nucleotide sequences of LOC196424 BINDING SITE, designated SEQ ID:42370, to the nucleotide sequence of VGAM957 RNA, herein designated VGAM RNA, also designated SEQ ID:3668.

Another function of VGAM957 is therefore inhibition of LOC196424 (Accession XM_113718). Accordingly, utilities of VGAM957 include diagnosis, prevention and treatment of diseases and clinical conditions associated with LOC196424. LOC199692 (Accession NM_145295) is another VGAM957 host target gene. LOC199692 BINDING SITE is HOST TARGET binding site found in the 3' untranslated region of mRNA encoded by LOC199692, corresponding to a HOST TARGET binding site such as BINDING SITE I, BINDING SITE II or BINDING SITE III. Table 2 illustrates the complementarity of the nucleotide sequences of LOC199692 BINDING SITE, designated SEQ ID:29812, to the nucleotide sequence of VGAM957 RNA, herein designated VGAM RNA, also designated SEQ ID:3668.

Another function of VGAM957 is therefore inhibition of LOC199692 (Accession NM_145295). Accordingly, utilities of VGAM957 include diagnosis, prevention and treatment of diseases and clinical conditions associated with LOC199692. LOC199848 (Accession XM_117144) is another VGAM957 host target gene. LOC199848 BINDING SITE is HOST TARGET binding site found in the 5' untranslated region of mRNA encoded by LOC199848, corresponding to a HOST TARGET binding site such as BINDING SITE I, BINDING SITE II or BINDING SITE III. Table 2 illustrates the complementarity of the nucleotide sequences of LOC199848 BINDING SITE, designated SEQ ID:43250, to the nucleotide sequence of VGAM957 RNA, herein designated VGAM RNA, also designated SEQ ID:3668.

Another function of VGAM957 is therefore inhibition of LOC199848 (Accession XM_117144). Accordingly, utilities of VGAM957 include diagnosis, prevention and treatment of diseases and clinical conditions associated with LOC199848. LOC90841 (Accession XM_034427) is another VGAM957 host target gene. LOC90841 BINDING SITE is HOST TARGET binding site found in the 3' untranslated region of mRNA encoded by LOC90841, corresponding to a HOST TARGET binding site such as BINDING SITE I, BINDING SITE II or BINDING SITE III. Table 2 illustrates the complementarity of the nucleotide sequences of LOC90841 BINDING SITE, designated SEQ ID:32113, to the nucleotide sequence of VGAM957 RNA, herein designated VGAM RNA, also designated SEQ ID:3668.

Another function of VGAM957 is therefore inhibition of LOC90841 (Accession XM_034427). Accordingly, utilities of VGAM957 include diagnosis, prevention and treatment of diseases and clinical conditions associated with LOC90841. FIG. 1 further provides a conceptual description of a novel bioinformatically detected viral gene of the present invention, referred to here as Viral Genomic Address Messenger 958 (VGAM958) viral gene, which modulates expression of respective host target genes thereof, the function and utility of which host target genes is known in the art.

VGAM958 is a novel bioinformatically detected regulatory, non protein coding, viral micro RNA (miRNA) gene. The method by which VGAM958 was detected is described hereinabove with reference to FIGS. 1-8.

VGAM958 gene, herein designated VGAM GENE, is a viral gene contained in the genome of Tomato Spotted Wilt Virus. VGAM958 host target gene, herein designated VGAM HOST TARGET GENE, is a human gene contained in the human genome.

VGAM958 gene encodes a VGAM958 precursor RNA, herein designated VGAM PRECURSOR RNA. Similar to other miRNA genes, and unlike most ordinary genes, VGAM958 precursor RNA does not encode a protein. A nucleotide sequence identical or highly similar to the nucleotide sequence of VGAM958 precursor RNA is designated SEQ ID:944, and is provided hereinbelow with reference to the sequence listing part. Nucleotide sequence SEQ ID:944 is located at position 2556 relative to the genome of Tomato Spotted Wilt Virus.

VGAM958 precursor RNA folds onto itself, forming VGAM958 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM958 folded precursor RNA into VGAM958 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM958 RNA is designated SEQ ID:3669, and is provided hereinbelow with reference to the sequence listing part.

VGAM958 host target gene, herein designated VGAM HOST TARGET GENE, encodes a corresponding messenger RNA, VGAM958 host target RNA, herein designated VGAM HOST TARGET RNA. VGAM958 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM958 RNA, herein designated VGAM RNA, binds complementarily to one or more host target binding sites located in untranslated regions of VGAM958 host target RNA, herein designated VGAM HOST TARGET RNA. This complementary binding is due to the fact that the nucleotide sequence of VGAM958 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM958 RNA, herein designated VGAM RNA, may have a different number of host target binding sites in untranslated regions of a VGAM958 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM958 RNA, herein designated VGAM RNA, to host target binding sites on VGAM958 host target RNA, herein designated VGAM HOST TARGET RNA, such as BINDING SITE I, BINDING SITE II and BINDING SITE III, inhibits translation of VGAM958 host target RNA into VGAM958 host target protein, herein designated VGAM HOST TARGET PROTEIN. VGAM host target protein is therefore outlined by a broken line.

It is appreciated that VGAM958 host target gene, herein designated VGAM HOST TARGET GENE, in fact represents a plurality of VGAM958 host target genes. The mRNA of each one of this plurality of VGAM958 host target genes comprises one or more host target binding sites, each having a nucleotide sequence which is at least partly complementary to VGAM958 RNA, herein designated VGAM RNA, and which when bound by VGAM958 RNA causes inhibition of translation of respective one or more VGAM958 host target proteins.

It is further appreciated by one skilled in the art that the mode of translational inhibition illustrated by FIG. 1 with specific reference to translational inhibition exerted by VGAM958 gene, herein designated VGAM GENE, on one or more VGAM958 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM958 is inhibition of expression of host target genes, as part of a novel viral mechanism of attacking a host. Accordingly, utilities of VGAM958 include diagnosis, prevention and treatment of viral infection by Tomato Spotted Wilt Virus. Specific functions, and accordingly utilities, of VGAM958 correlate with, and may be deduced from, the identity of the host target genes which VGAM958 binds and inhibits, and the function of these host target genes, as elaborated hereinbelow.

Nucleotide sequences of the VGAM958 precursor RNA, herein designated VGAM PRECURSOR RNA, and of the 'diced' VGAM958 RNA, herein designated VGAM RNA, and a schematic representation of the secondary folding of VGAM958 folded precursor RNA, herein designated VGAM FOLDED PRECURSOR RNA, of VGAM958 are further described hereinbelow with reference to Table 1.

Nucleotide sequences of host target binding sites, such as BINDING SITE-I, BINDING SITE-II and BINDING SITE-III of FIG. 1, found on VGAM958 host target RNA, and schematic representation of the complementarity of each of these host target binding sites to VGAM958 RNA, herein designated VGAM RNA, are described hereinbelow with reference to Table 2.

As mentioned hereinabove with reference to FIG. 1, a function of VGAM958 gene, herein designated VGAM is inhibition of expression of VGAM958 target genes. It is appreciated that specific functions, and accordingly utilities, of VGAM958 correlate with, and may be deduced from, the identity of the target genes which VGAM958 binds and inhibits, and the function of these target genes, as elaborated hereinbelow.

UDP-Gal:betaGlcNAc Beta 1,4-Galactosyltransferase, Polypeptide 5 (B4GALT5, Accession NM_004776) is a VGAM958 host target gene. B4GALT5 BINDING SITE is HOST TARGET binding site found in the 3' untranslated region of mRNA encoded by B4GALT5, corresponding to a HOST TARGET binding site such as BINDING SITE I, BINDING SITE II or BINDING SITE III. Table 2 illustrates the complementarity of the nucleotide sequences of B4GALT5 BINDING SITE, designated SEQ ID:11172, to the nucleotide sequence of VGAM958 RNA, herein designated VGAM RNA, also designated SEQ ID:3669.

A function of VGAM958 is therefore inhibition of UDP-Gal:betaGlcNAc Beta 1,4-Galactosyltransferase, Polypeptide 5 (B4GALT5, Accession NM_004776). Accordingly, utilities of VGAM958 include diagnosis, prevention and treatment of diseases and clinical conditions associated with B4GALT5. Basigin (OK blood group) (BSG, Accession NM_001728) is another VGAM958 host target gene. BSG BINDING SITE1 and BSG BINDING SITE2 are HOST TARGET binding sites found in untranslated regions of mRNA encoded by BSG, corresponding to HOST TARGET binding sites such as BINDING SITE I, BINDING SITE II or BINDING SITE III. Table 2 illustrates the complementarity of the nucleotide sequences of BSG BINDING SITE1 and BSG BINDING SITE2, designated SEQ ID:7458 and SEQ ID:33669 respectively, to the nucleotide sequence of VGAM958 RNA, herein designated VGAM RNA, also designated SEQ ID:3669.

Another function of VGAM958 is therefore inhibition of Basigin (OK blood group) (BSG, Accession NM_001728), a gene which is a LEUKOCYTE ACTIVATION ANTIGEN and a member of the immunoglobulin superfamily. Accordingly, utilities of VGAM958 include diagnosis, prevention and treatment of diseases and clinical conditions associated with BSG. The function of BSG has been established by previous studies. Basigin is a member of the immunoglobulin superfamily, with a structure related to the putative primordial form of the family. It was cloned as a carrier of an oncodevelopmental carbohydrate marker expressed in teratocarcinoma stem cells. It is expressed broadly in both embryos and adults (4,5:Miyauchi et al., 1990, 1991; Kanekura et al., 1991). As members of the immunoglobulin superfamily play fundamental roles in intercellular recognition involved in various immunologic phenomena, differentiation, and development, basigin is thought also to play a role in intercellular recognition. Animal model experiments lend further support to the function of BSG. Naruhashi et al. (1997) generated mice deficient in basigin by targeted disruption. Bsg -/- mice showed worse performance than their wildtype and heterozygous littermates in the Y-maze task, which assesses short-term memory, and in the water-finding task, which examines latent learning, without any motor dysfunction. Moreover, the mutant mice showed less acclimation in the habituation task compared with the wildtype mice. The mutant mice were also more sensitive to electric foot shock. Naruhashi et al. (1997) found these findings consistent with the expression profile of basigin in the central nervous system and suggested that basigin may play an important role in learning and memory as well as in sensory functions It is appreciated that the abovementioned animal model for BSG is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kanekura, T.; Miyauchi, T.; Tashiro, M.; Muramatsu, T.: Basigin, a new member of the immunoglobulin superfamily: genes in different mammalian species, glycosylation changes in the molecule from adult organs and possible variation in the N-terminal sequences. Cell Struct. Funct. 16:23-30, 1991; and Naruhashi, K.; Kadomatsu, K.; Igakura, T.; Fan, Q.-W.; Kuno, N.; Muramatsu, H.; Miyauchi, T.; Hasegawa, T.; Itoh, A.; Muramatsu, T.; Nabeshima, T.: Abnormalities of sensory and memor.

Further studies establishing the function and utilities of BSG are found in John Hopkins OMIM database record ID 109480, and in sited publications numbered 21-2 and 1711 listed in the bibliography section hereinbelow, which are also hereby incorporated by reference. Dystrophia Myotonica-protein Kinase (DMPK, Accession NM_004409) is another VGAM958 host target gene. DMPK BINDING SITE is HOST TARGET binding site found in the 3' untranslated region of mRNA encoded by DMPK, corresponding to a HOST TARGET binding site such as BINDING SITE I, BINDING SITE II or BINDING SITE III. Table 2 illustrates the complementarity of the nucleotide sequences of DMPK BINDING SITE, designated SEQ ID:10665, to the nucleotide sequence of VGAM958 RNA, herein designated VGAM RNA, also designated SEQ ID:3669.

Another function of VGAM958 is therefore inhibition of Dystrophia Myotonica-protein Kinase (DMPK, Accession NM_004409). Accordingly, utilities of VGAM958 include diagnosis, prevention and treatment of diseases and clinical conditions associated with DMPK. DXYS155E (Accession NM_005088) is another VGAM958 host target gene. DXYS155E BINDING SITE is HOST TARGET binding site found in the 3' untranslated region of mRNA encoded by DXYS155E, corresponding to a HOST TARGET binding site such as BINDING SITE I, BINDING SITE II or BINDING SITE III. Table 2 illustrates the complementarity of the nucleotide sequences of DXYS155E BINDING SITE, designated SEQ ID:11544, to the nucleotide sequence of VGAM958 RNA, herein designated VGAM RNA, also designated SEQ ID:3669.

Another function of VGAM958 is therefore inhibition of DXYS155E (Accession NM_005088), a gene which may be involved in b-cell activation. may also be involved in signal transduction and gene regulation. Accordingly, utilities of VGAM958 include diagnosis, prevention and treatment of diseases and clinical conditions associated with DXYS155E. The function of DXYS155E and its association with various diseases and clinical conditions, has been established by previous studies, as described hereinabove with reference to VGAM766. Erythropoietin (EPO, Accession NM_000799) is another VGAM958 host target gene. EPO BINDING SITE is HOST TARGET binding site found in the 5' untranslated region of mRNA encoded by EPO, corresponding to a HOST TARGET binding site such as BINDING SITE I, BINDING SITE II or BINDING SITE III. Table 2 illustrates the complementarity of the nucleotide sequences of EPO BINDING SITE, designated SEQ ID:6468, to the nucleotide sequence of VGAM958 RNA, herein designated VGAM RNA, also designated SEQ ID:3669.

Another function of VGAM958 is therefore inhibition of Erythropoietin (EPO, Accession NM_000799). Accordingly, utilities of VGAM958 include diagnosis, prevention and treatment of diseases and clinical conditions associated with EPO. GA Binding Protein Transcription Factor, Beta Subunit 1, 53 kDa (GABPB1, Accession NM_005254) is another VGAM958 host target gene. GABPB1 BINDING SITE is HOST TARGET binding site found in the 3' untranslated region of mRNA encoded by GABPB1, corresponding to a HOST TARGET binding site such as BINDING SITE I, BINDING SITE II or BINDING SITE III. Table 2 illustrates the complementarity of the nucleotide sequences of GABPB1 BINDING SITE, designated SEQ ID:11761, to the nucleotide sequence of VGAM958 RNA, herein designated VGAM RNA, also designated SEQ ID:3669.

Another function of VGAM958 is therefore inhibition of GA Binding Protein Transcription Factor, Beta Subunit 1, 53 kDa (GABPB1, Accession NM_005254), a gene which activates adenovirus E4 gene transcription. Accordingly, utilities of VGAM958 include diagnosis, prevention and treatment of diseases and clinical conditions associated with GABPB1. The function of GABPB1 and its association with various diseases and clinical conditions, has been established by previous studies, as described hereinabove with reference to VGAM191. Heterogeneous Nuclear Ribonucleoprotein D-like (HNRPDL, Accession NM_005463) is another VGAM958 host target gene. HNRPDL BINDING SITE is HOST TARGET binding site found in the 3' untranslated region of mRNA encoded by HNRPDL, corresponding to a HOST TARGET binding site such as BINDING SITE I, BINDING SITE II or BINDING SITE III. Table 2 illustrates the complementarity of the nucleotide sequences of HNRPDL BINDING SITE, designated SEQ ID:11949, to the nucleotide sequence of VGAM958 RNA, herein designated VGAM RNA, also designated SEQ ID:3669.

Another function of VGAM958 is therefore inhibition of Heterogeneous Nuclear Ribonucleoprotein D-like (HNRPDL, Accession NM_005463), a gene which binds to rna molecules that contain au-rich elements. Accordingly, utilities of VGAM958 include diagnosis, prevention and treatment of diseases and clinical conditions associated with HNRPDL. The function of HNRPDL and its association with various diseases and clinical conditions, has been established by previous studies, as described hereinabove with reference to VGAM144. Lactate Dehydrogenase B (LDHB, Accession NM_002300) is another VGAM958 host target gene. LDHB BINDING SITE is HOST TARGET binding site found in the 5' untranslated region of mRNA encoded by LDHB, corresponding to a HOST TARGET binding site such as BINDING SITE I, BINDING SITE II or BINDING SITE III. Table 2 illustrates the complementarity of the nucleotide sequences of LDHB BINDING SITE, designated SEQ ID:8090, to the nucleotide sequence of VGAM958 RNA, herein designated VGAM RNA, also designated SEQ ID:3669.

Another function of VGAM958 is therefore inhibition of Lactate Dehydrogenase B (LDHB, Accession NM_002300), a gene which causes dehydrogenation of lactate. Accordingly, utilities of VGAM958 include diagnosis, prevention and treatment of diseases and clinical conditions associated with LDHB. The function of LDHB and its association with various diseases and clinical conditions, has been established by previous studies, as described hereinabove with reference to VGAM273. Mannosidase, Alpha, Class 2C, Member 1 (MAN2C1, Accession XM_053585) is another VGAM958 host target gene. MAN2C1 BINDING SITE is HOST TARGET binding site found in the 5' untranslated region of mRNA encoded by MAN2C1, corresponding to a HOST TARGET binding site such as BINDING SITE I, BINDING SITE II or BINDING SITE III. Table 2 illustrates the complementarity of the nucleotide sequences of MAN2C1 BINDING SITE, designated SEQ ID:36103, to the nucleotide sequence of VGAM958 RNA, herein designated VGAM RNA, also designated SEQ ID:3669.

Another function of VGAM958 is therefore inhibition of Mannosidase, Alpha, Class 2C, Member 1 (MAN2C1, Accession XM_053585), a gene which is Strongly similar to a region of rat ER alpha-mannosidase. Accordingly, utilities of VGAM958 include diagnosis, prevention and treatment of diseases and clinical conditions associated with MAN2C1. The function of MAN2C1 has been established by previous studies. Cytoplasmic alpha-mannosidase (MANA) was assigned to 15q11-qter by study of an X;15 translocation in man-mouse hybrids (Champion et al., 1978). Lysosomal alpha-mannosidase (MANB) has been assigned to chromosome 19 by somatic cell hybridization (see OMIM Ref. No. 248500). Neri et al. (1983) described a boy with a ring chromosome 15 derived from a t (15q;15q) chromosome of the mother. The ring chromosome was duplicated for a portion of the long arms near the centromere, probably cen-q13. Dosage effects suggested that the alpha-mannosidase gene is located in this segment. Since a shortest region of overlap (SRO) of 15q11-qter had been estimated by Ferguson-Smith and Westerveld (1979), the new information places the MAN2C1 gene in the 15q11-q13 segment.

Full details of the abovementioned studies are described in the following publications, the disclosure of which are hereby incorporated by reference:

Ferguson-Smith, M. A.; Westerveld, A.: Report of the committee on the genetic constitution of chromosomes 13, 14, 15, 16, 17, 18, 19, 20, 21, and 22 (HGM5). Cytogenet. Cell Genet. 25:59-73, 1979; and Neri, G.; Ricci, R.; Pelino, A.; Bova, R.; Tedeschi, B.; Serra, A.: A boy with ring chromosome 15 derived from a t (15q;15q) Robertsonian translocation in the mother: cytogenetic and bio.

Further studies establishing the function and utilities of MAN2C1 are found in John Hopkins OMIM database record ID 154580, and in sited publications numbered 11523-11525 listed in the bibliography section hereinbelow, which are also hereby incorporated by reference. Methionine Adenosyltransferase I, Alpha (MAT1A, Accession XM_165540) is another VGAM958 host target gene. MAT1A BINDING SITE is HOST TARGET binding site found in the 3" untranslated region of mRNA encoded by MAT1A, corresponding to a HOST TARGET binding site such as BINDING SITE I, BINDING SITE II or BINDING SITE III. Table 2 illustrates the complementarity of the nucleotide sequences of MAT1A BINDING SITE, designated SEQ ID:43670, to the nucleotide sequence of VGAM958 RNA, herein designated VGAM RNA, also designated SEQ ID:3669.

Another function of VGAM958 is therefore inhibition of Methionine Adenosyltransferase I, Alpha (MAT1A, Accession XM_165540). Accordingly, utilities of VGAM958 include diagnosis, prevention and treatment of diseases and clinical conditions associated with MAT1A. Metallothionein-like 5, Testis-specific (tesmin) (MTL5, Accession NM_004923) is another VGAM958 host target gene. MTL5 BINDING SITE is HOST TARGET binding site found in the 3' untranslated region of mRNA encoded by MTL5, corresponding to a HOST TARGET binding site such as BINDING SITE I, BINDING SITE II or BINDING SITE III. Table 2 illustrates the complementarity of the nucleotide sequences of MTL5 BINDING SITE, designated SEQ ID:11360, to the nucleotide sequence of VGAM958 RNA, herein designated VGAM RNA, also designated SEQ ID:3669.

Another function of VGAM958 is therefore inhibition of Metallothionein-like 5, Testis-specific (tesmin) (MTL5, Accession NM_004923), a gene which functions in metal homeostasis and protects against heavy-metal toxicity. Accordingly, utilities of VGAM958 include diagnosis, prevention and treatment of diseases and clinical conditions associated with MTL5. The function of MTL5 has been established by previous studies. By randomized RT-PCR on mRNA from mouse tissues, Sugihara et al. (1999) isolated a testis-specific transcript, which they called TF1. By screening a human testis cDNA library with TF1 as a probe, they cloned a novel cDNA, which they called testis-specific metallothionein-like protein, or tesmin. Tesmin encodes a predicted cysteine-rich, 295-amino acid protein that is 76.3% homologous to mouse tesmin. Sequence analysis revealed the presence of 2 metallothionein (MT)-like motifs. MT expression has been observed to be higher in testes than in liver tissue (Salehi-Ashtiani et al., 1993) and to be actively expressed in a developmentally regulated fashion in mouse male germ cells (De et al., 1991). Tesmin shows no homology to other testis-specific genes. In situ hybridization of adult mouse testicular sections showed that expression of tesmin is restricted to spermatocytes. RT-PCR analysis on testicular transcripts from mice showed that expression of tesmin occurs as early as day 8 and coincides with the entry of germ cells in meiosis.

Full details of the abovementioned studies are described in the following publications, the disclosure of which are hereby incorporated by reference:

De, S. K.; Enders, G. C.; Andrews, G. K.: High levels of metallothionein messenger RNAs in male germ cells of the adult mouse. Molec. Endocr. 5:628-636, 1991; and Salehi-Ashtiani, K.; Widrow, R. J.; Markert, C. L.; Goldberg, E.: Testis-specific expression of a metallothionein I-driven transgene correlates with undermethylation of the locus in te.

Further studies establishing the function and utilities of MTL5 are found in John Hopkins OMIM database record ID 604374, and in sited publications numbered 6921-6923 listed in the bibliography section hereinbelow, which are also hereby incorporated by reference. Myosin, Heavy Polypeptide 11, Smooth Muscle (MYH11, Accession NM_002474) is another VGAM958 host target gene. MYH11 BINDING SITE1 and MYH11 BINDING SITE2 are HOST TARGET binding sites found in untranslated regions of mRNA encoded by MYH11, corresponding to HOST TARGET binding sites such as BINDING SITE I, BINDING SITE II or BINDING SITE III. Table 2 illustrates the complementarity of the nucleotide sequences of MYH11 BINDING SITE1 and MYH11 BINDING SITE2, designated SEQ ID:8302 and SEQ ID:23144 respectively, to the nucleotide sequence of VGAM958 RNA, herein designated VGAM RNA, also designated SEQ ID:3669.

Another function of VGAM958 is therefore inhibition of Myosin, Heavy Polypeptide 11, Smooth Muscle (MYH11, Accession NM_002474), a gene which is involved in muscle contraction. Accordingly, utilities of VGAM958 include diagnosis, prevention and treatment of diseases and clinical conditions associated with MYH11. The function of MYH11 and its association with various diseases and clinical conditions, has been established by previous studies, as described hereinabove with reference to VGAM178. Peptidylprolyl Isomerase F (cyclophilin F) (PPIF, Accession NM_005729) is another VGAM958 host target gene. PPIF BINDING SITE is HOST TARGET binding site found in the 3" untranslated region of mRNA encoded by PPIF, corresponding to a HOST TARGET binding site such as BINDING SITE I, BINDING SITE II or BINDING SITE III. Table 2 illustrates the complementarity of the nucleotide sequences of PPIF BINDING SITE, designated SEQ ID:12283, to the nucleotide sequence of VGAM958 RNA, herein designated VGAM RNA, also designated SEQ ID:3669.

Another function of VGAM958 is therefore inhibition of Peptidylprolyl Isomerase F (cyclophilin F) (PPIF, Accession NM_005729), a gene which catalyzes the cis to trans isomerization of certain proline imidic peptide bonds in oligopeptides. Accordingly, utilities of VGAM958 include diagnosis, prevention and treatment of diseases and clinical conditions associated with PPIF. The function of PPIF and its association with various diseases and clinical conditions, has been established by previous studies, as described hereinabove with reference to VGAM251. Protein S (alpha) (PROS1, Accession XM_113400) is another VGAM958 host target gene. PROS1 BINDING SITE is HOST TARGET binding site found in the 3' untranslated region of mRNA encoded by PROS1, corresponding to a HOST TARGET binding site such as BINDING SITE I, BINDING SITE II or BINDING SITE III. Table 2 illustrates the complementarity of the nucleotide sequences of PROS1 BINDING SITE, designated SEQ ID:42257, to the nucleotide sequence of VGAM958 RNA, herein designated VGAM RNA, also designated SEQ ID:3669.

Another function of VGAM958 is therefore inhibition of Protein S (alpha) (PROS1, Accession XM_113400). Accordingly, utilities of VGAM958 include diagnosis, prevention and treatment of diseases and clinical conditions associated with PROS1. Reticulon 3 (RTN3, Accession XM_058207) is another VGAM958 host target gene. RTN3 BINDING SITE is HOST TARGET binding site found in the 3' untranslated region of mRNA encoded by RTN3, corresponding to a HOST TARGET binding site such as BINDING SITE I, BINDING SITE II or BINDING SITE III. Table 2 illustrates the complementarity of the nucleotide sequences of RTN3 BINDING SITE, designated SEQ ID:36587, to the nucleotide sequence of VGAM958 RNA, herein designated VGAM RNA, also designated SEQ ID:3669.

Another function of VGAM958 is therefore inhibition of Reticulon 3 (RTN3, Accession XM_058207), a gene which is a member of the reticulon (neuroendocrine-specific, NSP) family. Accordingly, utilities of VGAM958 include diagnosis, prevention and treatment of diseases and clinical conditions associated with RTN3. The function of RTN3 and its association with various diseases and clinical conditions, has been established by previous studies, as described hereinabove with reference to VGAM596. Secreted and Transmembrane 1 (SECTM1, Accession NM_003004) is another VGAM958 host target gene. SECTM1 BINDING SITE is HOST TARGET binding site found in the 3' untranslated region of mRNA encoded by SECTM1, corresponding to a HOST TARGET binding site such as BINDING SITE I, BINDING SITE II or BINDING SITE III. Table 2 illustrates the complementarity of the nucleotide sequences of SECTM1 BINDING SITE, designated SEQ ID:8911, to the nucleotide sequence of VGAM958 RNA, herein designated VGAM RNA, also designated SEQ ID:3669.

Another function of VGAM958 is therefore inhibition of Secreted and Transmembrane 1 (SECTM1, Accession NM_003004). Accordingly, utilities of VGAM958 include diagnosis, prevention and treatment of diseases and clinical conditions associated with SECTM1. Spectrin, Beta, Non-erythrocytic 4 (SPTBN4, Accession NM_025213) is another VGAM958 host target gene. SPTBN4 BINDING SITE is HOST TARGET binding site found in the 3' untranslated region of mRNA encoded by SPTBN4, corresponding to a HOST TARGET binding site such as BINDING SITE I, BINDING SITE II or BINDING SITE III. Table 2 illustrates the complementarity of the nucleotide sequences of SPTBN4 BINDING SITE, designated SEQ ID:24885, to the nucleotide sequence of VGAM958 RNA, herein designated VGAM RNA, also designated SEQ ID:3669.

Another function of VGAM958 is therefore inhibition of Spectrin, Beta, Non-erythrocytic 4 (SPTBN4, Accession NM_025213), a gene which is critical for the maintenance of plasma membrane shape and lipid asymmetry. Accordingly, utilities of VGAM958 include diagnosis, prevention and treatment of diseases and clinical conditions associated with SPTBN4. The function of SPTBN4 has been established by previous studies. Tse et al. (2001) cloned SPTBN4, which they termed SPTBN3, as well as a splice variant, sigma-5, encoding a 678-amino acid protein. Whole-mount in situ hybridization analysis revealed Sptbn4 expression that was restricted to forebrain, hindbrain, and developing eye in postcoital day-9.5 mice. Western blot analysis with polyclonal antibodies detected expression of a predominant 72-kD protein, close to the expected size of the sigma-5 variant. Immunofluorescence microscopy demonstrated colocalization of SPTBN4 with PML (OMIM Ref. No. 102578) and with SUMO1 (UBL1; 601912) in the cytoplasm and nucleus. The authors showed that both the N- and C-terminal helical coils of sigma-5 are needed to form nuclear dots and are associated with the nuclear matrix. Tse et al. (2001) proposed that a spectrin-based skeleton may be important for the structure of the nucleus. Spectrins (e.g., SPTA1; 182860) are rod-shaped proteins that are part of the lattice-like cytoskeleton under the erythrocyte membrane. This meshwork is critical for the maintenance of plasma membrane shape and lipid asymmetry, as revealed by mutant spectrins in diseases such as elliptocytosis (see OMIM Ref. No. 182860) and spherocytosis (see OMIM Ref. No. 182870). Although originally identified in erythrocytes, spectrins have also been found in the membranes of intracellular organelles, such as the Golgi, lysosomes, and secretory vesicles. The spectrin molecule is a tetramer consisting of 2 alpha and 2 beta subunits, in which the N terminus of an alpha subunit is tightly connected with the C terminus of a beta subunit to form a heterodimer. Spectrin repeats contain approximately 106 amino acids. Alpha subunits have 20 spectrin repeats, while beta subunits have 17. Animal model experiments lend further support to the function of SPTBN4. The autosomal recessive mouse mutation 'quivering' (qv), described by Yoon and Les (1957), produces progressive ataxia with hindlimb paralysis, deafness, and tremor. Ear twitch responses (Preyer reflex) to sound are absent in homozygous qv/qv mice, although cochlear morphology seems normal and cochlear potentials recorded at the round window are no different from those of control mice. However, responses from brain stem auditory nuclei show abnormal transmission of auditory inflammation, indicating that in contrast to the many mutations causing deafness originating in the cochlea, deafness in qv is central in origin (Deol et al., 1983; Bock et al., 1983). Parkinson et al. (2001) reported that qv mice carry loss-of-function mutations in the Spnb4 gene that cause alterations in ion channel localization in myelinated nerves. They concluded that this finding provides a rationale for the auditory and motor neuropathies of these mice.

It is appreciated that the abovementioned animal model for SPTBN4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Parkinson, N. J.; Olsson, C. L.; Hallows, J. L.; McKee-Johnson, J.; Keogh, B. P.; Noben-Trauth, K.; Kujawa, S. G.; Tempel, B. L.: Mutant beta-spectrin 4 causes auditory and motor neuropathies in quivering mice. Nature Genet. 29:61-65, 2001; and Tse, W. T.; Tang, J.; Jin, O.; Korsgren, C.; John, K. M.; Kung, A. L.; Gwynn, B.; Peters, L. L.; Lux, S. E.: A new spectrin, beta-IV, has a major truncated isoform that associates with pr.

Further studies establishing the function and utilities of SPTBN4 are found in John Hopkins OMIM database record ID 606214, and in sited publications numbered 6166-616 and 6730-6171 listed in the bibliography section hereinbelow, which are also hereby incorporated by reference. TRIP15 (Accession NM_004236) is another VGAM958 host target gene. TRIP15 BINDING SITE is HOST TARGET binding site found in the 3' untranslated region of mRNA encoded by TRIP15, corresponding to a HOST TARGET binding site such as BINDING SITE I, BINDING SITE II or BINDING SITE III. Table 2 illustrates the complementarity of the nucleotide sequences of TRIP15 BINDING SITE, designated SEQ ID:10433, to the nucleotide sequence of VGAM958 RNA, herein designated VGAM RNA, also designated SEQ ID:3669.

Another function of VGAM958 is therefore inhibition of TRIP15 (Accession NM_004236), a gene which is a subunit of the COP9 signalosome complex. Accordingly, utilities of VGAM958 include diagnosis, prevention and treatment of diseases and clinical conditions associated with TRIP15. The function of TRIP15 and its association with various diseases and clinical conditions, has been established by previous studies, as described hereinabove with reference to VGAM452. Zinc Finger Protein 36, C3H Type-like 1 (ZFP36L1, Accession NM_004926) is another VGAM958 host target gene. ZFP36L1 BINDING SITE is HOST TARGET binding site found in the 3' untranslated region of mRNA encoded by ZFP36L1, corresponding to a HOST TARGET binding site such as BINDING SITE I, BINDING SITE II or BINDING SITE III. Table 2 illustrates the complementarity of the nucleotide sequences of ZFP36L1 BINDING SITE, designated SEQ ID:11366, to the nucleotide sequence of VGAM958 RNA, herein designated VGAM RNA, also designated SEQ ID:3669.

Another function of VGAM958 is therefore inhibition of Zinc Finger Protein 36, C3H Type-like 1 (ZFP36L1, Accession NM_004926), a gene which is a regulatory protein involved in regulating the response to growth factors. Accordingly, utilities of VGAM958 include diagnosis, prevention and treatment of diseases and clinical conditions associated with ZFP36L1. The function of ZFP36L1 and its association with various diseases and clinical conditions, has been established by previous studies, as described hereinabove with reference to VGAM74. ADAR3 (Accession NM_018702) is another VGAM958 host target gene. ADAR3 BINDING SITE is HOST TARGET binding site found in the 5' untranslated region of mRNA encoded by ADAR3, corresponding to a HOST TARGET binding site such as BINDING SITE I, BINDING SITE II or BINDING SITE III. Table 2 illustrates the complementarity of the nucleotide sequences of ADAR3 BINDING SITE, designated SEQ ID:20787, to the nucleotide sequence of VGAM958 RNA, herein designated VGAM RNA, also designated SEQ ID:3669.

Another function of VGAM958 is therefore inhibition of ADAR3 (Accession NM_018702). Accordingly, utilities of VGAM958 include diagnosis, prevention and treatment of diseases and clinical conditions associated with ADAR3. Apolipoprotein L, 3 (APOL3, Accession NM_014349) is another VGAM958 host target gene. APOL3 BINDING SITE is HOST TARGET binding site found in the 5' untranslated region of mRNA encoded by APOL3, corresponding to a HOST TARGET binding site such as BINDING SITE I, BINDING SITE II or BINDING SITE III. Table 2 illustrates the complementarity of the nucleotide sequences of APOL3 BINDING SITE, designated SEQ ID:15676, to the nucleotide sequence of VGAM958 RNA, herein designated VGAM RNA, also designated SEQ ID:3669.

Another function of VGAM958 is therefore inhibition of Apolipoprotein L, 3 (APOL3, Accession NM_014349). Accordingly, utilities of VGAM958 include diagnosis, prevention and treatment of diseases and clinical conditions associated with APOL3. Chromosome 17 Open Reading Frame 26 (C17orf26, Accession NM_139177) is another VGAM958 host target gene. C17orf26 BINDING SITE is HOST TARGET binding site found in the 3' untranslated region of mRNA encoded by C17orf26, corresponding to a HOST TARGET binding site such as BINDING SITE I, BINDING SITE II or BINDING SITE III. Table 2 illustrates the complementarity of the nucleotide sequences of C17orf26 BINDING SITE, designated SEQ ID:29189, to the nucleotide sequence of VGAM958 RNA, herein designated VGAM RNA, also designated SEQ ID:3669.

Another function of VGAM958 is therefore inhibition of Chromosome 17 Open Reading Frame 26 (C17orf26, Accession NM_139177). Accordingly, utilities of VGAM958 include diagnosis, prevention and treatment of diseases and clinical conditions associated with C17orf26. Chromosome 19 Open Reading Frame 7 (C19orf7, Accession XM_028253) is another VGAM958 host target gene. C19orf7 BINDING SITE is HOST TARGET binding site found in the 3' untranslated region of mRNA encoded by C19orf7, corresponding to a HOST TARGET binding site such as BINDING SITE I, BINDING SITE II or BINDING SITE III. Table 2 illustrates the complementarity of the nucleotide sequences of C19orf7 BINDING SITE, designated SEQ ID:30637, to the nucleotide sequence of VGAM958 RNA, herein designated VGAM RNA, also designated SEQ ID:3669.

Another function of VGAM958 is therefore inhibition of Chromosome 19 Open Reading Frame 7 (C19orf7, Accession XM_028253). Accordingly, utilities of VGAM958 include diagnosis, prevention and treatment of diseases and clinical conditions associated with C19orf7. Chromosome 1 Open Reading Frame 34 (C1orf34, Accession XM_027172) is another VGAM958 host target gene. C1orf34 BINDING SITE is HOST TARGET binding site found in the 3' untranslated region of mRNA encoded by C1orf34, corresponding to a HOST TARGET binding site such as BINDING SITE I, BINDING SITE II or BINDING SITE III. Table 2 illustrates the complementarity of the nucleotide sequences of C1orf34 BINDING SITE, designated SEQ ID:30441, to the nucleotide sequence of VGAM958 RNA, herein designated VGAM RNA, also designated SEQ ID:3669.

Another function of VGAM958 is therefore inhibition of Chromosome 1 Open Reading Frame 34 (C1orf34, Accession XM_027172). Accordingly, utilities of VGAM958 include diagnosis, prevention and treatment of diseases and clinical conditions associated with C1orf34. Chromosome 20 Open Reading Frame 150 (C20orf150, Accession XM_037265) is another VGAM958 host target gene. C20orf150 BINDING SITE is HOST TARGET binding site found in the 3' untranslated region of mRNA encoded by C20orf150, corresponding to a HOST TARGET binding site such as BINDING SITE I, BINDING SITE II or BINDING SITE III. Table 2 illustrates the complementarity of the nucleotide sequences of C20orf150 BINDING SITE, designated SEQ ID:32598, to the nucleotide sequence of VGAM958 RNA, herein designated VGAM RNA, also designated SEQ ID:3669.

Another function of VGAM958 is therefore inhibition of Chromosome 20 Open Reading Frame 150 (C20orf150, Accession XM_037265). Accordingly, utilities of VGAM958 include diagnosis, prevention and treatment of diseases and clinical conditions associated with C20orf150. Chromosome 22 Open Reading Frame 5 (C22orf5, Accession NM_012264) is another VGAM958 host target gene. C22orf5 BINDING SITE is HOST TARGET binding site found in the 3' untranslated region of mRNA encoded by C22orf5, corresponding to a HOST TARGET binding site such as BINDING SITE I, BINDING SITE II or BINDING SITE III. Table 2 illustrates the complementarity of the nucleotide sequences of C22orf5 BINDING SITE, designated SEQ ID:14583, to the nucleotide sequence of VGAM958 RNA, herein designated VGAM RNA, also designated SEQ ID:3669.

Another function of VGAM958 is therefore inhibition of Chromosome 22 Open Reading Frame 5 (C22orf5, Accession NM_012264). Accordingly, utilities of VGAM958 include diagnosis, prevention and treatment of diseases and clinical conditions associated with C22orf5. Calsyntenin 2 (CLSTN2, Accession NM_022131) is another VGAM958 host target gene. CLSTN2 BINDING SITE is HOST TARGET binding site found in the 3' untranslated region of mRNA encoded by CLSTN2, corresponding to a HOST TARGET binding site such as BINDING SITE I, BINDING SITE II or BINDING SITE III. Table 2 illustrates the complementarity of the nucleotide sequences of CLSTN2 BINDING SITE, designated SEQ ID:22694, to the nucleotide sequence of VGAM958 RNA, herein designated VGAM RNA, also designated SEQ ID:3669.

Another function of VGAM958 is therefore inhibition of Calsyntenin 2 (CLSTN2, Accession NM_022131). Accordingly, utilities of VGAM958 include diagnosis, prevention and treatment of diseases and clinical conditions associated with CLSTN2. Cyclin M4 (CNNM4, Accession NM_020184) is another VGAM958 host target gene. CNNM4 BINDING SITE is HOST TARGET binding site found in the 3' untranslated region of mRNA encoded by CNNM4, corresponding to a HOST TARGET binding site such as BINDING SITE I, BINDING SITE II or BINDING SITE III. Table 2 illustrates the complementarity of the nucleotide sequences of CNNM4 BINDING SITE, designated SEQ ID:21428, to the nucleotide sequence of VGAM958 RNA, herein designated VGAM RNA, also designated SEQ ID:3669.

Another function of VGAM958 is therefore inhibition of Cyclin M4 (CNNM4, Accession NM_020184). Accordingly, utilities of VGAM958 include diagnosis, prevention and treatment of diseases and clinical conditions associated with CNNM4. Erythrocyte Membrane Protein Band 4.1-like 1 (EPB41L1, Accession XM_047295) is another VGAM958 host target gene. EPB41L1 BINDING SITE is HOST TARGET binding site found in the 3' untranslated region of mRNA encoded by EPB41L1, corresponding to a HOST TARGET binding site such as BINDING SITE I, BINDING SITE II or BINDING SITE III. Table 2 illustrates the complementarity of the nucleotide sequences of EPB41L1 BINDING SITE, designated SEQ ID:34945, to the nucleotide sequence of VGAM958 RNA, herein designated VGAM RNA, also designated SEQ ID:3669.

Another function of VGAM958 is therefore inhibition of Erythrocyte Membrane Protein Band 4.1-like 1 (EPB41L1, Accession XM_047295). Accordingly, utilities of VGAM958 include diagnosis, prevention and treatment of diseases and clinical conditions associated with EPB41L1. Ecotropic Viral Integration Site 5 (EVI5, Accession NM_005665) is another VGAM958 host target gene. EVI5 BINDING SITE is HOST TARGET binding site found in the 3' untranslated region of mRNA encoded by EVI5, corresponding to a HOST TARGET binding site such as BINDING SITE I, BINDING SITE II or BINDING SITE III. Table 2 illustrates the complementarity of the nucleotide sequences of EVI5 BINDING SITE, designated SEQ ID:12217, to the nucleotide sequence of VGAM958 RNA, herein designated VGAM RNA, also designated SEQ ID:3669.

Another function of VGAM958 is therefore inhibition of Ecotropic Viral Integration Site 5 (EVI5, Accession NM_005665). Accordingly, utilities of VGAM958 include diagnosis, prevention and treatment of diseases and clinical conditions associated with EVI5. FLJ10619 (Accession NM_018156) is another VGAM958 host target gene. FLJ10619 BINDING SITE is HOST TARGET binding site found in the 3' untranslated region of mRNA encoded by FLJ10619, corresponding to a HOST TARGET binding site such as BINDING SITE I, BINDING SITE II or BINDING SITE III. Table 2 illustrates the complementarity of the nucleotide sequences of FLJ10619 BINDING SITE, designated SEQ ID:19969, to the nucleotide sequence of VGAM958 RNA, herein designated VGAM RNA, also designated SEQ ID:3669.

Another function of VGAM958 is therefore inhibition of FLJ10619 (Accession NM_018156). Accordingly, utilities of VGAM958 include diagnosis, prevention and treatment of diseases and clinical conditions associated with FLJ10619. FLJ10751 (Accession NM_018205) is another VGAM958 host target gene. FLJ10751 BINDING SITE1 and FLJ10751 BINDING SITE2 are HOST TARGET binding sites found in untranslated regions of mRNA encoded by FLJ10751, corresponding to HOST TARGET binding sites such as BINDING SITE I, BINDING SITE II or BINDING SITE III. Table 2 illustrates the complementarity of the nucleotide sequences of FLJ10751 BINDING SITE1 and FLJ10751 BINDING SITE2, designated SEQ ID:20096 and SEQ ID:20195 respectively, to the nucleotide sequence of VGAM958 RNA, herein designated VGAM RNA, also designated SEQ ID:3669.

Another function of VGAM958 is therefore inhibition of FLJ10751 (Accession NM_018205). Accordingly, utilities of VGAM958 include diagnosis, prevention and treatment of diseases and clinical conditions associated with FLJ10751. FLJ14642 (Accession NM_032818) is another VGAM958 host target gene. FLJ14642 BINDING SITE is HOST TARGET binding site found in the 3' untranslated region of mRNA encoded by FLJ14642, corresponding to a HOST TARGET binding site such as BINDING SITE I, BINDING SITE II or BINDING SITE III. Table 2 illustrates the complementarity of the nucleotide sequences of FLJ14642 BINDING SITE, designated SEQ ID:26596, to the nucleotide sequence of VGAM958 RNA, herein designated VGAM RNA, also designated SEQ ID:3669.

Another function of VGAM958 is therefore inhibition of FLJ14642 (Accession NM_032818). Accordingly, utilities of VGAM958 include diagnosis, prevention and treatment of diseases and clinical conditions associated with FLJ14642. FLJ20054 (Accession NM_019049) is another VGAM958 host target gene. FLJ20054 BINDING SITE is HOST TARGET binding site found in the 3' untranslated region of mRNA encoded by FLJ20054, corresponding to a HOST TARGET binding site such as BINDING SITE I, BINDING SITE II or BINDING SITE III. Table 2 illustrates the complementarity of the nucleotide sequences of FLJ20054 BINDING SITE, designated SEQ ID:21131, to the nucleotide sequence of VGAM958 RNA, herein designated VGAM RNA, also designated SEQ ID:3669.

Another function of VGAM958 is therefore inhibition of FLJ20054 (Accession NM_019049). Accordingly, utilities of VGAM958 include diagnosis, prevention and treatment of diseases and clinical conditions associated with FLJ20054. FLJ20772 (Accession NM_017956) is another VGAM958 host target gene. FLJ20772 BINDING SITE is HOST TARGET binding site found in the 3' untranslated region of mRNA encoded by FLJ20772, corresponding to a HOST TARGET binding site such as BINDING SITE I, BINDING SITE II or BINDING SITE III. Table 2 illustrates the complementarity of the nucleotide sequences of FLJ20772 BINDING SITE, designated SEQ ID:19667, to the nucleotide sequence of VGAM958 RNA, herein designated VGAM RNA, also designated SEQ ID:3669.

Another function of VGAM958 is therefore inhibition of FLJ20772 (Accession NM_017956). Accordingly, utilities of VGAM958 include diagnosis, prevention and treatment of diseases and clinical conditions associated with FLJ20772. FLJ21657 (Accession NM_022483) is another VGAM958 host target gene. FLJ21657 BINDING SITE1 and FLJ21657 BINDING SITE2 are HOST TARGET binding sites found in untranslated regions of mRNA encoded by FLJ21657, corresponding to HOST TARGET binding sites such as BINDING SITE I, BINDING SITE II or BINDING SITE III. Table 2 illustrates the complementarity of the nucleotide sequences of FLJ21657 BINDING SITE1 and FLJ21657 BINDING SITE2, designated SEQ ID:22858 and SEQ ID:22859 respectively, to the nucleotide sequence of VGAM958 RNA, herein designated VGAM RNA, also designated SEQ ID:3669.

Another function of VGAM958 is therefore inhibition of FLJ21657 (Accession NM_022483). Accordingly, utilities of VGAM958 include diagnosis, prevention and treatment of diseases and clinical conditions associated with FLJ21657. H11 (Accession NM_014365) is another VGAM958 host target gene. H11 BINDING SITE is HOST TARGET binding site found in the 5' untranslated region of mRNA encoded by H11, corresponding to a HOST TARGET binding site such as BINDING SITE I, BINDING SITE II or BINDING SITE III. Table 2 illustrates the complementarity of the nucleotide sequences of H11 BINDING SITE, designated SEQ ID:15695, to the nucleotide sequence of VGAM958 RNA, herein designated VGAM RNA, also designated SEQ ID:3669.

Another function of VGAM958 is therefore inhibition of H11 (Accession NM_014365). Accordingly, utilities of VGAM958 include diagnosis, prevention and treatment of diseases and clinical conditions associated with H11. Hyaluronan Binding Protein 2 (HABP2, Accession NM_004132) is another VGAM958 host target gene. HABP2 BINDING SITE is HOST TARGET binding site found in the 3' untranslated region of mRNA encoded by HABP2, corresponding to a HOST TARGET binding site such as BINDING SITE I, BINDING SITE II or BINDING SITE III. Table 2 illustrates the complementarity of the nucleotide sequences of HABP2 BINDING SITE, designated SEQ ID:10345, to the nucleotide sequence of VGAM958 RNA, herein designated VGAM RNA, also designated SEQ ID:3669.

Another function of VGAM958 is therefore inhibition of Hyaluronan Binding Protein 2 (HABP2, Accession NM_004132). Accordingly, utilities of VGAM958 include diagnosis, prevention and treatment of diseases and clinical conditions associated with HABP2. Integrin, Beta 5 (ITGB5, Accession XM_003029) is another VGAM958 host target gene. ITGB5 BINDING SITE is HOST TARGET binding site found in the 3' untranslated region of mRNA encoded by ITGB5, corresponding to a HOST TARGET binding site such as BINDING SITE I, BINDING SITE II or BINDING SITE III. Table 2 illustrates the complementarity of the nucleotide sequences of ITGB5 BINDING SITE, designated SEQ ID:29924, to the nucleotide sequence of VGAM958 RNA, herein designated VGAM RNA, also designated SEQ ID:3669.

Another function of VGAM958 is therefore inhibition of Integrin, Beta 5 (ITGB5, Accession XM_003029). Accordingly, utilities of VGAM958 include diagnosis, prevention and treatment of diseases and clinical conditions associated with ITGB5. KIAA0040 (Accession NM_014656) is another VGAM958 host target gene. KIAA0040 BINDING SITE is HOST TARGET binding site found in the 5' untranslated region of mRNA encoded by KIAA0040, corresponding to a HOST TARGET binding site such as BINDING SITE I, BINDING SITE II or BINDING SITE III. Table 2 illustrates the complementarity of the nucleotide sequences of KIAA0040 BINDING SITE, designated SEQ ID:16100, to the nucleotide sequence of VGAM958 RNA, herein designated VGAM RNA, also designated SEQ ID:3669.

Another function of VGAM958 is therefore inhibition of KIAA0040 (Accession NM_014656). Accordingly, utilities of VGAM958 include diagnosis, prevention and treatment of diseases and clinical conditions associated with KIAA0040.

KIAA0205 (Accession NM_014873) is another VGAM958 host target gene. KIAA0205 BINDING SITE is HOST TARGET binding site found in the 3' untranslated region of mRNA encoded by KIAA0205, corresponding to a HOST TARGET binding site such as BINDING SITE I, BINDING SITE II or BINDING SITE III. Table 2 illustrates the complementarity of the nucleotide sequences of KIAA0205 BINDING SITE, designated SEQ ID:17009, to the nucleotide sequence of VGAM958 RNA, herein designated VGAM RNA, also designated SEQ ID:3669.

Another function of VGAM958 is therefore inhibition of KIAA0205 (Accession NM_014873). Accordingly, utilities of VGAM958 include diagnosis, prevention and treatment of diseases and clinical conditions associated with KIAA0205.

KIAA0319 (Accession NM_014809) is another VGAM958 host target gene. KIAA0319 BINDING SITE is HOST TARGET binding site found in the 3' untranslated region of mRNA encoded by KIAA0319, corresponding to a HOST TARGET binding site such as BINDING SITE I, BINDING SITE II or BINDING SITE III. Table 2 illustrates the complementarity of the nucleotide sequences of KIAA0319 BINDING SITE, designated SEQ ID:16767, to the nucleotide sequence of VGAM958 RNA, herein designated VGAM RNA, also designated SEQ ID:3669.

Another function of VGAM958 is therefore inhibition of KIAA0319 (Accession NM_014809). Accordingly, utilities of VGAM958 include diagnosis, prevention and treatment of diseases and clinical conditions associated with KIAA0319.

KIAA0481 (Accession XM_050144) is another VGAM958 host target gene. KIAA0481 BINDING SITE is HOST TARGET binding site found in the 5' untranslated region of mRNA encoded by KIAA0481, corresponding to a HOST TARGET binding site such as BINDING SITE I, BINDING SITE II or BINDING SITE III. Table 2 illustrates the complementarity of the nucleotide sequences of KIAA0481 BINDING SITE, designated SEQ ID:35572, to the nucleotide sequence of VGAM958 RNA, herein designated VGAM RNA, also designated SEQ ID:3669.

Another function of VGAM958 is therefore inhibition of KIAA0481 (Accession XM_050144). Accordingly, utilities of VGAM958 include diagnosis, prevention and treatment of diseases and clinical conditions associated with KIAA0481.

KIAA1084 (Accession NM_014910) is another VGAM958 host target gene. KIAA1084 BINDING SITE is HOST TARGET binding site found in the 3' untranslated region of mRNA encoded by KIAA1084, corresponding to a HOST TARGET binding site such as BINDING SITE I, BINDING SITE II or BINDING SITE III. Table 2 illustrates the complementarity of the nucleotide sequences of KIAA1084 BINDING SITE, designated SEQ ID:17140, to the nucleotide sequence of VGAM958 RNA, herein designated VGAM RNA, also designated SEQ ID:3669.

Another function of VGAM958 is therefore inhibition of KIAA1084 (Accession NM_014910). Accordingly, utilities of VGAM958 include diagnosis, prevention and treatment of diseases and clinical conditions associated with KIAA1084.

KIAA1253 (Accession XM_166310) is another VGAM958 host target gene. KIAA1253 BINDING SITE is HOST TARGET binding site found in the 3' untranslated region of mRNA encoded by KIAA1253, corresponding to a HOST TARGET binding site such as BINDING SITE I, BINDING SITE II or BINDING SITE III. Table 2 illustrates the complementarity of the nucleotide sequences of KIAA1253 BINDING SITE, designated SEQ ID:44133, to the nucleotide sequence of VGAM958 RNA, herein designated VGAM RNA, also designated SEQ ID:3669.

Another function of VGAM958 is therefore inhibition of KIAA1253 (Accession XM_166310). Accordingly, utilities of VGAM958 include diagnosis, prevention and treatment of diseases and clinical conditions associated with KIAA1253.

KIAA1500 (Accession XM_034353) is another VGAM958 host target gene. KIAA1500 BINDING SITE is HOST TARGET binding site found in the 3' untranslated region of mRNA encoded by KIAA1500, corresponding to a HOST TARGET binding site such as BINDING SITE I, BINDING SITE II or BINDING SITE III. Table 2 illustrates the complementarity of the nucleotide sequences of KIAA1500 BINDING SITE, designated SEQ ID:32071, to the nucleotide sequence of VGAM958 RNA, herein designated VGAM RNA, also designated SEQ ID:3669.

Another function of VGAM958 is therefore inhibition of KIAA1500 (Accession XM_034353). Accordingly, utilities of VGAM958 include diagnosis, prevention and treatment of diseases and clinical conditions associated with KIAA1500.

KIAA1673 (Accession XM_047672) is another VGAM958 host target gene. KIAA1673 BINDING SITE is HOST TARGET binding site found in the 3' untranslated region of mRNA encoded by KIAA1673, corresponding to a HOST TARGET binding site such as BINDING SITE I, BINDING SITE II or BINDING SITE III. Table 2 illustrates the complementarity of the nucleotide sequences of KIAA1673 BINDING SITE, designated SEQ ID:35027, to the nucleotide sequence of VGAM958 RNA, herein designated VGAM RNA, also designated SEQ ID:3669.

Another function of VGAM958 is therefore inhibition of KIAA1673 (Accession XM_047672). Accordingly, utilities of VGAM958 include diagnosis, prevention and treatment of diseases and clinical conditions associated with KIAA1673.

KIAA1719 (Accession XM_042936) is another VGAM958 host target gene. KIAA1719 BINDING SITE is HOST TARGET binding site found in the 5' untranslated region of mRNA encoded by KIAA1719, corresponding to a HOST TARGET binding site such as BINDING SITE I, BINDING SITE II or BINDING SITE III. Table 2 illustrates the complementarity of the nucleotide sequences of KIAA1719 BINDING SITE, designated SEQ ID:33827, to the nucleotide sequence of VGAM958 RNA, herein designated VGAM RNA, also designated SEQ ID:3669.

Another function of VGAM958 is therefore inhibition of KIAA1719 (Accession XM_042936). Accordingly, utilities of VGAM958 include diagnosis, prevention and treatment of diseases and clinical conditions associated with KIAA1719.

KIAA1817 (Accession XM_042978) is another VGAM958 host target gene. KIAA1817 BINDING SITE is HOST TARGET binding site found in the 3' untranslated region of mRNA encoded by KIAA1817, corresponding to a HOST TARGET binding site such as BINDING SITE I, BINDING SITE II or BINDING SITE III. Table 2 illustrates the complementarity of the nucleotide sequences of KIAA1817 BINDING SITE, designated SEQ ID:33864, to the nucleotide sequence of VGAM958 RNA, herein designated VGAM RNA, also designated SEQ ID:3669.

Another function of VGAM958 is therefore inhibition of KIAA1817 (Accession XM_042978). Accordingly, utilities of VGAM958 include diagnosis, prevention and treatment of diseases and clinical conditions associated with KIAA1817.

MGC3265 (Accession NM_024028) is another VGAM958 host target gene. MGC3265 BINDING SITE is HOST TARGET binding site found in the 3' untranslated region of mRNA encoded by MGC3265, corresponding to a HOST TARGET binding site such as BINDING SITE I, BINDING SITE II or BINDING SITE III. Table 2 illustrates the complementarity of the nucleotide sequences of MGC3265 BINDING SITE, designated SEQ ID:23458, to the nucleotide sequence of VGAM958 RNA, herein designated VGAM RNA, also designated SEQ ID:3669.

Another function of VGAM958 is therefore inhibition of MGC3265 (Accession NM_024028). Accordingly, utilities of VGAM958 include diagnosis, prevention and treatment of diseases and clinical conditions associated with MGC3265. MAP Kinase-interacting Serine/threonine Kinase 1 (MKNK1, Accession NM_003684) is another VGAM958 host target gene. MKNK1 BINDING SITE is HOST TARGET binding site found in the 5' untranslated region of mRNA encoded by MKNK1, corresponding to a HOST TARGET binding site such as BINDING SITE I, BINDING SITE II or BINDING SITE III. Table 2 illustrates the complementarity of the nucleotide sequences of MKNK1 BINDING SITE, designated SEQ ID:9795, to the nucleotide sequence of VGAM958 RNA, herein designated VGAM RNA, also designated SEQ ID:3669.

Another function of VGAM958 is therefore inhibition of MAP Kinase-interacting Serine/threonine Kinase 1 (MKNK1, Accession NM_003684). Accordingly, utilities of VGAM958 include diagnosis, prevention and treatment of diseases and clinical conditions associated with MKNK1. PRO2955 (Accession NM_018545) is another VGAM958 host target gene. PRO2955 BINDING SITE is HOST TARGET binding site found in the 3' untranslated region of mRNA encoded by PRO2955, corresponding to a HOST TARGET binding site such as BINDING SITE I, BINDING SITE II or BINDING SITE III. Table 2 illustrates the complementarity of the nucleotide sequences of PRO2955 BINDING SITE, designated SEQ ID:20623, to the nucleotide sequence of VGAM958 RNA, herein designated VGAM RNA, also designated SEQ ID:3669.

Another function of VGAM958 is therefore inhibition of PRO2955 (Accession NM_018545). Accordingly, utilities of VGAM958 include diagnosis, prevention and treatment of diseases and clinical conditions associated with PRO2955. Proline-serine-threonine Phosphatase Interacting Protein 2 (PSTPIP2, Accession NM_024430) is another VGAM958 host target gene. PSTPIP2 BINDING SITE is HOST TARGET binding site found in the 3' untranslated region of mRNA encoded by PSTPIP2, corresponding to a HOST TARGET binding site such as BINDING SITE I, BINDING SITE II or BINDING SITE III. Table 2 illustrates the complementarity of the nucleotide sequences of PSTPIP2 BINDING SITE, designated SEQ ID:23684, to the nucleotide sequence of VGAM958 RNA, herein designated VGAM RNA, also designated SEQ ID:3669.

Another function of VGAM958 is therefore inhibition of Proline-serine-threonine Phosphatase Interacting Protein 2 (PSTPIP2, Accession NM_024430). Accordingly, utilities of VGAM958 include diagnosis, prevention and treatment of diseases and clinical conditions associated with PSTPIP2. SIMRP7 (Accession XM_166462) is another VGAM958 host target gene. SIMRP7 BINDING SITE is HOST TARGET binding site found in the 3' untranslated region of mRNA encoded by SIMRP7, corresponding to a HOST TARGET binding site such as BINDING SITE I, BINDING SITE II or BINDING SITE III. Table 2 illustrates the complementarity of the nucleotide sequences of SIMRP7 BINDING SITE, designated SEQ ID:44375, to the nucleotide sequence of VGAM958 RNA, herein designated VGAM RNA, also designated SEQ ID:3669.

Another function of VGAM958 is therefore inhibition of SIMRP7 (Accession XM_166462). Accordingly, utilities of VGAM958 include diagnosis, prevention and treatment of diseases and clinical conditions associated with SIMRP7. SS-56 (Accession XM_006063) is another VGAM958 host target gene. SS-56 BINDING SITE is HOST TARGET binding site found in the 5' untranslated region of mRNA encoded by SS-56, corresponding to a HOST TARGET binding site such as BINDING SITE I, BINDING SITE II or BINDING SITE III. Table 2 illustrates the complementarity of the nucleotide sequences of SS-56 BINDING SITE, designated SEQ ID:29991, to the nucleotide sequence of VGAM958 RNA, herein designated VGAM RNA, also designated SEQ ID:3669.

Another function of VGAM958 is therefore inhibition of SS-56 (Accession XM_006063). Accordingly, utilities of VGAM958 include diagnosis, prevention and treatment of diseases and clinical conditions associated with SS-56. WAC (Accession NM_100264) is another VGAM958 host target gene. WAC BINDING SITE1 through WAC BINDING SITE3 are HOST TARGET binding sites found in untranslated regions of mRNA encoded by WAC, corresponding to HOST TARGET binding sites such as BINDING SITE I, BINDING SITE II or BINDING SITE III. Table 2 illustrates the complementarity of the nucleotide sequences of WAC BINDING SITE1 through WAC BINDING SITE3, designated SEQ ID:28157, SEQ ID:28158 and SEQ ID:18743 respectively, to the nucleotide sequence of VGAM958 RNA, herein designated VGAM RNA, also designated SEQ ID:3669.

Another function of VGAM958 is therefore inhibition of WAC (Accession NM_100264). Accordingly, utilities of VGAM958 include diagnosis, prevention and treatment of diseases and clinical conditions associated with WAC. LOC115073 (Accession XM_055193) is another VGAM958 host target gene. LOC115073 BINDING SITE is HOST TARGET binding site found in the 5' untranslated region of mRNA encoded by LOC115073, corresponding to a HOST TARGET binding site such as BINDING SITE I, BINDING SITE II or BINDING SITE III. Table 2 illustrates the complementarity of the nucleotide sequences of LOC115073 BINDING SITE, designated SEQ ID:36240, to the nucleotide sequence of VGAM958 RNA, herein designated VGAM RNA, also designated SEQ ID:3669.

Another function of VGAM958 is therefore inhibition of LOC115073 (Accession XM_055193). Accordingly, utilities of VGAM958 include diagnosis, prevention and treatment of diseases and clinical conditions associated with LOC115073. LOC124460 (Accession XM_071892) is another VGAM958 host target gene. LOC124460 BINDING SITE is HOST TARGET binding site found in the 3' untranslated region of mRNA encoded by LOC124460, corresponding to a HOST TARGET binding site such as BINDING SITE I, BINDING SITE II or BINDING SITE III. Table 2 illustrates the complementarity of the nucleotide sequences of LOC124460 BINDING SITE, designated SEQ ID:37447, to the nucleotide sequence of VGAM958 RNA, herein designated VGAM RNA, also designated SEQ ID:3669.

Another function of VGAM958 is therefore inhibition of LOC124460 (Accession XM_071892). Accordingly, utilities of VGAM958 include diagnosis, prevention and treatment of diseases and clinical conditions associated with LOC124460. LOC125929 (Accession XM_064872) is another VGAM958 host target gene. LOC125929 BINDING SITE is HOST TARGET binding site found in the 3' untranslated region of mRNA encoded by LOC125929, corresponding to a HOST TARGET binding site such as BINDING SITE I, BINDING SITE II or BINDING SITE III. Table 2 illustrates the complementarity of the nucleotide sequences of LOC125929 BINDING SITE, designated SEQ ID:37268, to the nucleotide sequence of VGAM958 RNA, herein designated VGAM RNA, also designated SEQ ID:3669.

Another function of VGAM958 is therefore inhibition of LOC125929 (Accession XM_064872). Accordingly, utilities of VGAM958 include diagnosis, prevention and treatment of diseases and clinical conditions associated with LOC125929. LOC129011 (Accession XM_059326) is another VGAM958 host target gene. LOC129011 BINDING SITE is HOST TARGET binding site found in the 3' untranslated region of mRNA encoded by LOC129011, corresponding to a HOST TARGET binding site such as BINDING SITE I, BINDING SITE II or BINDING SITE III. Table 2 illustrates the complementarity of the nucleotide sequences of LOC129011 BINDING SITE, designated SEQ ID:36967, to the nucleotide sequence of VGAM958 RNA, herein designated VGAM RNA, also designated SEQ ID:3669.

Another function of VGAM958 is therefore inhibition of LOC129011 (Accession XM_059326). Accordingly, utilities of VGAM958 include diagnosis, prevention and treatment of diseases and clinical conditions associated with LOC129011. LOC129138 (Accession NM_138797) is another VGAM958 host target gene. LOC129138 BINDING SITE is HOST TARGET binding site found in the 3' untranslated region of mRNA encoded by LOC129138, corresponding to a HOST TARGET binding site such as BINDING SITE I, BINDING SITE II or BINDING SITE III. Table 2 illustrates the complementarity of the nucleotide sequences of LOC129138 BINDING SITE, designated SEQ ID:29019, to the nucleotide sequence of VGAM958 RNA, herein designated VGAM RNA, also designated SEQ ID:3669.

Another function of VGAM958 is therefore inhibition of LOC129138 (Accession NM_138797). Accordingly, utilities of VGAM958 include diagnosis, prevention and treatment of diseases and clinical conditions associated with LOC129138. LOC144308 (Accession XM_096575) is another VGAM958 host target gene. LOC144308 BINDING SITE is HOST TARGET binding site found in the 3' untranslated region of mRNA encoded by LOC144308, corresponding to a HOST TARGET binding site such as BINDING SITE I, BINDING SITE II or BINDING SITE III. Table 2 illustrates the complementarity of the nucleotide sequences of LOC144308 BINDING SITE, designated SEQ ID:40408, to the nucleotide sequence of VGAM958 RNA, herein designated VGAM RNA, also designated SEQ ID:3669.

Another function of VGAM958 is therefore inhibition of LOC144308 (Accession XM_096575). Accordingly, utilities of VGAM958 include diagnosis, prevention and treatment of diseases and clinical conditions associated with LOC144308. LOC144699 (Accession XM_084940) is another VGAM958 host target gene. LOC144699 BINDING SITE is HOST TARGET binding site found in the 3' untranslated region of mRNA encoded by LOC144699, corresponding to a HOST TARGET binding site such as BINDING SITE I, BINDING SITE II or BINDING SITE III. Table 2 illustrates the complementarity of the nucleotide sequences of LOC144699 BINDING SITE, designated SEQ ID:37771, to the nucleotide sequence of VGAM958 RNA, herein designated VGAM RNA, also designated SEQ ID:3669.

Another function of VGAM958 is therefore inhibition of LOC144699 (Accession XM_084940). Accordingly, utilities of VGAM958 include diagnosis, prevention and treatment of diseases and clinical conditions associated with LOC144699. LOC145508 (Accession XM_085158) is another VGAM958 host target gene. LOC145508 BINDING SITE is HOST TARGET binding site found in the 3' untranslated region of mRNA encoded by LOC145508, corresponding to a HOST TARGET binding site such as BINDING SITE I, BINDING SITE II or BINDING SITE III. Table 2 illustrates the complementarity of the nucleotide sequences of LOC145508 BINDING SITE, designated SEQ ID:37887, to the nucleotide sequence of VGAM958 RNA, herein designated VGAM RNA, also designated SEQ ID:3669.

Another function of VGAM958 is therefore inhibition of LOC145508 (Accession XM_085158). Accordingly, utilities of VGAM958 include diagnosis, prevention and treatment of diseases and clinical conditions associated with LOC145508. LOC146243 (Accession XM_096956) is another VGAM958 host target gene. LOC146243 BINDING SITE1 and LOC146243 BINDING SITE2 are HOST TARGET binding sites found in untranslated regions of mRNA encoded by LOC146243, corresponding to HOST TARGET binding sites such as BINDING SITE I, BINDING SITE II or BINDING SITE III. Table 2 illustrates the complementarity of the nucleotide sequences of LOC146243 BINDING SITE1 and LOC146243 BINDING SITE2, designated SEQ ID:40680 and SEQ ID:40681 respectively, to the nucleotide sequence of VGAM958 RNA, herein designated VGAM RNA, also designated SEQ ID:3669.

Another function of VGAM958 is therefore inhibition of LOC146243 (Accession XM_096956). Accordingly, utilities of VGAM958 include diagnosis, prevention and treatment of diseases and clinical conditions associated with LOC146243. LOC147077 (Accession XM_085699) is another VGAM958 host target gene. LOC147077 BINDING SITE is HOST TARGET binding site found in the 3' untranslated region of mRNA encoded by LOC147077, corresponding to a HOST TARGET binding site such as BINDING SITE I, BINDING SITE II or BINDING SITE III. Table 2 illustrates the complementarity of the nucleotide sequences of LOC147077 BINDING SITE, designated SEQ ID:38296, to the nucleotide sequence of VGAM958 RNA, herein designated VGAM RNA, also designated SEQ ID:3669.

Another function of VGAM958 is therefore inhibition of LOC147077 (Accession XM_085699). Accordingly, utilities of VGAM958 include diagnosis, prevention and treatment of diseases and clinical conditions associated with LOC147077. LOC149127 (Accession XM_097584) is another VGAM958 host target gene. LOC149127 BINDING SITE is HOST TARGET binding site found in the 3' untranslated region of mRNA encoded by LOC149127, corresponding to a HOST TARGET binding site such as BINDING SITE I, BINDING SITE II or BINDING SITE III. Table 2 illustrates the complementarity of the nucleotide sequences of LOC149127 BINDING SITE, designated SEQ ID:40952, to the nucleotide sequence of VGAM958 RNA, herein designated VGAM RNA, also designated SEQ ID:3669.

Another function of VGAM958 is therefore inhibition of LOC149127 (Accession XM_097584). Accordingly, utilities of VGAM958 include diagnosis, prevention and treatment of diseases and clinical conditions associated with LOC149127. LOC149271 (Accession XM_086475) is another VGAM958 host target gene. LOC149271 BINDING SITE is HOST TARGET binding site found in the 5' untranslated region of mRNA encoded by LOC149271, corresponding to a HOST TARGET binding site such as BINDING SITE I, BINDING SITE II or BINDING SITE III. Table 2 illustrates the complementarity of the nucleotide sequences of LOC149271 BINDING SITE, designated SEQ ID:38685, to the nucleotide sequence of VGAM958 RNA, herein designated VGAM RNA, also designated SEQ ID:3669.

Another function of VGAM958 is therefore inhibition of LOC149271 (Accession XM_086475). Accordingly, utilities of VGAM958 include diagnosis, prevention and treatment of diseases and clinical conditions associated with LOC149271.

LOC152343 (Accession XM_087441) is another VGAM958 host target gene. LOC152343 BINDING SITE is HOST TARGET binding site found in the 3' untranslated region of mRNA encoded by LOC152343, corresponding to a HOST TARGET binding site such as BINDING SITE I, BINDING SITE II or BINDING SITE III. Table 2 illustrates the complementarity of the nucleotide sequences of LOC152343 BINDING SITE, designated SEQ ID:39262, to the nucleotide sequence of VGAM958 RNA, herein designated VGAM RNA, also designated SEQ ID:3669.

Another function of VGAM958 is therefore inhibition of LOC152343 (Accession XM_087441). Accordingly, utilities of VGAM958 include diagnosis, prevention and treatment of diseases and clinical conditions associated with LOC152343.

LOC152905 (Accession XM_017966) is another VGAM958 host target gene. LOC152905 BINDING SITE is HOST TARGET binding site found in the 3' untranslated region of mRNA encoded by LOC152905, corresponding to a HOST TARGET binding site such as BINDING SITE I, BINDING SITE II or BINDING SITE III. Table 2 illustrates the complementarity of the nucleotide sequences of LOC152905 BINDING SITE, designated SEQ ID:30332, to the nucleotide sequence of VGAM958 RNA, herein designated VGAM RNA, also designated SEQ ID:3669.

Another function of VGAM958 is therefore inhibition of LOC152905 (Accession XM_017966). Accordingly, utilities of VGAM958 include diagnosis, prevention and treatment of diseases and clinical conditions associated with LOC152905.

LOC153232 (Accession XM_098331) is another VGAM958 host target gene. LOC153232 BINDING SITE is HOST TARGET binding site found in the 5' untranslated region of mRNA encoded by LOC153232, corresponding to a HOST TARGET binding site such as BINDING SITE I, BINDING SITE II or BINDING SITE III. Table 2 illustrates the complementarity of the nucleotide sequences of LOC153232 BINDING SITE, designated SEQ ID:41599, to the nucleotide sequence of VGAM958 RNA, herein designated VGAM RNA, also designated SEQ ID:3669.

Another function of VGAM958 is therefore inhibition of LOC153232 (Accession XM_098331). Accordingly, utilities of VGAM958 include diagnosis, prevention and treatment of diseases and clinical conditions associated with LOC153232.

LOC157657 (Accession XM_088352) is another VGAM958 host target gene. LOC157657 BINDING SITE is HOST TARGET binding site found in the 3' untranslated region of mRNA encoded by LOC157657, corresponding to a HOST TARGET binding site such as BINDING SITE I, BINDING SITE II or BINDING SITE III. Table 2 illustrates the complementarity of the nucleotide sequences of LOC157657 BINDING SITE, designated SEQ ID:39628, to the nucleotide sequence of VGAM958 RNA, herein designated VGAM RNA, also designated SEQ ID:3669.

Another function of VGAM958 is therefore inhibition of LOC157657 (Accession XM_088352). Accordingly, utilities of VGAM958 include diagnosis, prevention and treatment of diseases and clinical conditions associated with LOC157657.

LOC157737 (Accession XM_098819) is another VGAM958 host target gene. LOC157737 BINDING SITE is HOST TARGET binding site found in the 5' untranslated region of mRNA encoded by LOC157737, corresponding to a HOST TARGET binding site such as BINDING SITE I, BINDING SITE II or BINDING SITE III. Table 2 illustrates the complementarity of the nucleotide sequences of LOC157737 BINDING SITE, designated SEQ ID:41844, to the nucleotide sequence of VGAM958 RNA, herein designated VGAM RNA, also designated SEQ ID:3669.

Another function of VGAM958 is therefore inhibition of LOC157737 (Accession XM_098819). Accordingly, utilities of VGAM958 include diagnosis, prevention and treatment of diseases and clinical conditions associated with LOC157737.

LOC158230 (Accession XM_088517) is another VGAM958 host target gene. LOC158230 BINDING SITE is HOST TARGET binding site found in the 3' untranslated region of mRNA encoded by LOC158230, corresponding to a HOST TARGET binding site such as BINDING SITE I, BINDING SITE II or BINDING SITE III. Table 2 illustrates the complementarity of the nucleotide sequences of LOC158230 BINDING SITE, designated SEQ ID:39768, to the nucleotide sequence of VGAM958 RNA, herein designated VGAM RNA, also designated SEQ ID:3669.

Another function of VGAM958 is therefore inhibition of LOC158230 (Accession XM_088517). Accordingly, utilities of VGAM958 include diagnosis, prevention and treatment of diseases and clinical conditions associated with LOC158230.

LOC165693 (Accession XM_093373) is another VGAM958 host target gene. LOC165693 BINDING SITE is HOST TARGET binding site found in the 5' untranslated region of mRNA encoded by LOC165693, corresponding to a HOST TARGET binding site such as BINDING SITE I, BINDING SITE II or BINDING SITE III. Table 2 illustrates the complementarity of the nucleotide sequences of LOC165693 BINDING SITE, designated SEQ ID:40189, to the nucleotide sequence of VGAM958 RNA, herein designated VGAM RNA, also designated SEQ ID:3669.

Another function of VGAM958 is therefore inhibition of LOC165693 (Accession XM_093373). Accordingly, utilities of VGAM958 include diagnosis, prevention and treatment of diseases and clinical conditions associated with LOC165693.

LOC169026 (Accession XM_095471) is another VGAM958 host target gene. LOC169026 BINDING SITE is HOST TARGET binding site found in the 3' untranslated region of mRNA encoded by LOC169026, corresponding to a HOST TARGET binding site such as BINDING SITE I, BINDING SITE II or BINDING SITE III. Table 2 illustrates the complementarity of the nucleotide sequences of LOC169026 BINDING SITE, designated SEQ ID:40270, to the nucleotide sequence of VGAM958 RNA, herein designated VGAM RNA, also designated SEQ ID:3669.

Another function of VGAM958 is therefore inhibition of LOC169026 (Accession XM_095471). Accordingly, utilities of VGAM958 include diagnosis, prevention and treatment of diseases and clinical conditions associated with LOC169026.

LOC196074 (Accession XM_113647) is another VGAM958 host target gene. LOC196074 BINDING SITE is HOST TARGET binding site found in the 5' untranslated region of mRNA encoded by LOC196074, corresponding to a HOST TARGET binding site such as BINDING SITE I, BINDING SITE II or BINDING SITE III. Table 2 illustrates the complementarity of the nucleotide sequences of LOC196074 BINDING SITE, designated SEQ ID:42323, to the nucleotide sequence of VGAM958 RNA, herein designated VGAM RNA, also designated SEQ ID:3669.

Another function of VGAM958 is therefore inhibition of LOC196074 (Accession XM_113647). Accordingly, utilities of VGAM958 include diagnosis, prevention and treatment of diseases and clinical conditions associated with LOC196074.

LOC200058 (Accession XM_114109) is another VGAM958 host target gene. LOC200058 BINDING SITE is HOST TARGET binding site found in the 3' untranslated region of mRNA encoded by LOC200058, corresponding to a HOST TARGET binding site such as BINDING SITE I, BINDING SITE II or BINDING SITE III. Table 2 illustrates the complementarity of the nucleotide sequences of LOC200058 BINDING SITE, designated SEQ ID:42703, to the nucleotide sequence of VGAM958 RNA, herein designated VGAM RNA, also designated SEQ ID:3669.

Another function of VGAM958 is therefore inhibition of LOC200058 (Accession XM_114109). Accordingly, utilities of VGAM958 include diagnosis, prevention and treatment of diseases and clinical conditions associated with LOC200058. LOC202152 (Accession XM_114446) is another VGAM958 host target gene. LOC202152 BINDING SITE is HOST TARGET binding site found in the 5' untranslated region of mRNA encoded by LOC202152, corresponding to a HOST TARGET binding site such as BINDING SITE I, BINDING SITE II or BINDING SITE III. Table 2 illustrates the complementarity of the nucleotide sequences of LOC202152 BINDING SITE, designated SEQ ID:42966, to the nucleotide sequence of VGAM958 RNA, herein designated VGAM RNA, also designated SEQ ID:3669.

Another function of VGAM958 is therefore inhibition of LOC202152 (Accession XM_114446). Accordingly, utilities of VGAM958 include diagnosis, prevention and treatment of diseases and clinical conditions associated with LOC202152. LOC220522 (Accession XM_018306) is another VGAM958 host target gene. LOC220522 BINDING SITE is HOST TARGET binding site found in the 3' untranslated region of mRNA encoded by LOC220522, corresponding to a HOST TARGET binding site such as BINDING SITE I, BINDING SITE II or BINDING SITE III. Table 2 illustrates the complementarity of the nucleotide sequences of LOC220522 BINDING SITE, designated SEQ ID:30355, to the nucleotide sequence of VGAM958 RNA, herein designated VGAM RNA, also designated SEQ ID:3669.

Another function of VGAM958 is therefore inhibition of LOC220522 (Accession XM_018306). Accordingly, utilities of VGAM958 include diagnosis, prevention and treatment of diseases and clinical conditions associated with LOC220522. LOC220753 (Accession XM_167549) is another VGAM958 host target gene. LOC220753 BINDING SITE is HOST TARGET binding site found in the 3' untranslated region of mRNA encoded by LOC220753, corresponding to a HOST TARGET binding site such as BINDING SITE I, BINDING SITE II or BINDING SITE III. Table 2 illustrates the complementarity of the nucleotide sequences of LOC220753 BINDING SITE, designated SEQ ID:44664, to the nucleotide sequence of VGAM958 RNA, herein designated VGAM RNA, also designated SEQ ID:3669.

Another function of VGAM958 is therefore inhibition of LOC220753 (Accession XM_167549). Accordingly, utilities of VGAM958 include diagnosis, prevention and treatment of diseases and clinical conditions associated with LOC220753. LOC253258 (Accession XM_172870) is another VGAM958 host target gene. LOC253258 BINDING SITE is HOST TARGET binding site found in the 3' untranslated region of mRNA encoded by LOC253258, corresponding to a HOST TARGET binding site such as BINDING SITE I, BINDING SITE II or BINDING SITE III. Table 2 illustrates the complementarity of the nucleotide sequences of LOC253258 BINDING SITE, designated SEQ ID:46149, to the nucleotide sequence of VGAM958 RNA, herein designated VGAM RNA, also designated SEQ ID:3669.

Another function of VGAM958 is therefore inhibition of LOC253258 (Accession XM_172870). Accordingly, utilities of VGAM958 include diagnosis, prevention and treatment of diseases and clinical conditions associated with LOC253258. LOC253612 (Accession XM_172985) is another VGAM958 host target gene. LOC253612 BINDING SITE is HOST TARGET binding site found in the 5' untranslated region of mRNA encoded by LOC253612, corresponding to a HOST TARGET binding site such as BINDING SITE I, BINDING SITE II or BINDING SITE III. Table 2 illustrates the complementarity of the nucleotide sequences of LOC253612 BINDING SITE, designated SEQ ID:46258, to the nucleotide sequence of VGAM958 RNA, herein designated VGAM RNA, also designated SEQ ID:3669.

Another function of VGAM958 is therefore inhibition of LOC253612 (Accession XM_172985). Accordingly, utilities of VGAM958 include diagnosis, prevention and treatment of diseases and clinical conditions associated with LOC253612. LOC255057 (Accession XM_170903) is another VGAM958 host target gene. LOC255057 BINDING SITE is HOST TARGET binding site found in the 3' untranslated region of mRNA encoded by LOC255057, corresponding to a HOST TARGET binding site such as BINDING SITE I, BINDING SITE II or BINDING SITE III. Table 2 illustrates the complementarity of the nucleotide sequences of LOC255057 BINDING SITE, designated SEQ ID:45663, to the nucleotide sequence of VGAM958 RNA, herein designated VGAM RNA, also designated SEQ ID:3669.

Another function of VGAM958 is therefore inhibition of LOC255057 (Accession XM_170903). Accordingly, utilities of VGAM958 include diagnosis, prevention and treatment of diseases and clinical conditions associated with LOC255057. LOC257482 (Accession XM_168544) is another VGAM958 host target gene. LOC257482 BINDING SITE is HOST TARGET binding site found in the 3' untranslated region of mRNA encoded by LOC257482, corresponding to a HOST TARGET binding site such as BINDING SITE I, BINDING SITE II or BINDING SITE III. Table 2 illustrates the complementarity of the nucleotide sequences of LOC257482 BINDING SITE, designated SEQ ID:45237, to the nucleotide sequence of VGAM958 RNA, herein designated VGAM RNA, also designated SEQ ID:3669.

Another function of VGAM958 is therefore inhibition of LOC257482 (Accession XM_168544). Accordingly, utilities of VGAM958 include diagnosis, prevention and treatment of diseases and clinical conditions associated with LOC257482. LOC90494 (Accession XM_032161) is another VGAM958 host target gene. LOC90494 BINDING SITE is HOST TARGET binding site found in the 5' untranslated region of mRNA encoded by LOC90494, corresponding to a HOST TARGET binding site such as BINDING SITE I, BINDING SITE II or BINDING SITE III. Table 2 illustrates the complementarity of the nucleotide sequences of LOC90494 BINDING SITE, designated SEQ ID:31578, to the nucleotide sequence of VGAM958 RNA, herein designated VGAM RNA, also designated SEQ ID:3669.

Another function of VGAM958 is therefore inhibition of LOC90494 (Accession XM_032161). Accordingly, utilities of VGAM958 include diagnosis, prevention and treatment of diseases and clinical conditions associated with LOC90494. LOC92405 (Accession XM_044914) is another VGAM958 host target gene. LOC92405 BINDING SITE is HOST TARGET binding site found in the 3' untranslated region of mRNA encoded by LOC92405, corresponding to a HOST TARGET binding site such as BINDING SITE I, BINDING SITE II or BINDING SITE III. Table 2 illustrates the complementarity of the nucleotide sequences of LOC92405 BINDING SITE, designated SEQ ID:34305, to the nucleotide sequence of VGAM958 RNA, herein designated VGAM RNA, also designated SEQ ID:3669.

Another function of VGAM958 is therefore inhibition of LOC92405 (Accession XM_044914). Accordingly, utilities of VGAM958 include diagnosis, prevention and treatment of diseases and clinical conditions associated with LOC92405. LOC92578 (Accession XM_045900) is another VGAM958 host target gene. LOC92578 BINDING SITE is HOST TARGET binding site found in the 5' untranslated region of mRNA encoded by LOC92578, corresponding to a HOST TARGET binding site such as BINDING SITE I, BINDING SITE II or BINDING SITE III. Table 2 illustrates the complementarity of the nucleotide sequences of LOC92578 BINDING SITE, designated SEQ ID:34608, to the nucleotide sequence of VGAM958 RNA, herein designated VGAM RNA, also designated SEQ ID:3669.

Another function of VGAM958 is therefore inhibition of LOC92578 (Accession XM_045900). Accordingly, utilities of VGAM958 include diagnosis, prevention and treatment of diseases and clinical conditions associated with LOC92578.

FIG. 1 further provides a conceptual description of a novel bioinformatically detected viral gene of the present invention, referred to here as Viral Genomic Address Messenger 959 (VGAM959) viral gene, which modulates expression of respective host target genes thereof, the function and utility of which host target genes is known in the art.

VGAM959 is a novel bioinformatically detected regulatory, non protein coding, viral micro RNA (miRNA) gene. The method by which VGAM959 was detected is described hereinabove with reference to FIGS. 1-8.

VGAM959 gene, herein designated VGAM GENE, is a viral gene contained in the genome of Lumpy Skin Disease Virus. VGAM959 host target gene, herein designated VGAM HOST TARGET GENE, is a human gene contained in the human genome.

VGAM959 gene encodes a VGAM959 precursor RNA, herein designated VGAM PRECURSOR RNA. Similar to other miRNA genes, and unlike most ordinary genes, VGAM959 precursor RNA does not encode a protein. A nucleotide sequence identical or highly similar to the nucleotide sequence of VGAM959 precursor RNA is designated SEQ ID:945, and is provided hereinbelow with reference to the sequence listing part. Nucleotide sequence SEQ ID:945 is located at position 24838 relative to the genome of Lumpy Skin Disease Virus.

VGAM959 precursor RNA folds onto itself, forming VGAM959 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM959 folded precursor RNA into VGAM959 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM959 RNA is designated SEQ ID:3670, and is provided hereinbelow with reference to the sequence listing part.

VGAM959 host target gene, herein designated VGAM HOST TARGET GENE, encodes a corresponding messenger RNA, VGAM959 host target RNA, herein designated VGAM HOST TARGET RNA. VGAM959 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM959 RNA, herein designated VGAM RNA, binds complementarily to one or more host target binding sites located in untranslated regions of VGAM959 host target RNA, herein designated VGAM HOST TARGET RNA. This complementary binding is due to the fact that the nucleotide sequence of VGAM959 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM959 RNA, herein designated VGAM RNA, may have a different number of host target binding sites in untranslated regions of a VGAM959 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM959 RNA, herein designated VGAM RNA, to host target binding sites on VGAM959 host target RNA, herein designated VGAM HOST TARGET RNA, such as BINDING SITE I, BINDING SITE II and BINDING SITE III, inhibits translation of VGAM959 host target RNA into VGAM959 host target protein, herein designated VGAM HOST TARGET PROTEIN. VGAM host target protein is therefore outlined by a broken line.

It is appreciated that VGAM959 host target gene, herein designated VGAM HOST TARGET GENE, in fact represents a plurality of VGAM959 host target genes. The mRNA of each one of this plurality of VGAM959 host target genes comprises one or more host target binding sites, each having a nucleotide sequence which is at least partly complementary to VGAM959 RNA, herein designated VGAM RNA, and which when bound by VGAM959 RNA causes inhibition of translation of respective one or more VGAM959 host target proteins.

It is further appreciated by one skilled in the art that the mode of translational inhibition illustrated by FIG. 1 with specific reference to translational inhibition exerted by VGAM959 gene, herein designated VGAM GENE, on one or more VGAM959 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM959 is inhibition of expression of host target genes, as part of a novel viral mechanism of attacking a host. Accordingly, utilities of VGAM959 include diagnosis, prevention and treatment of viral infection by Lumpy Skin Disease Virus. Specific functions, and accordingly utilities, of VGAM959 correlate with, and may be deduced from, the identity of the host target genes which VGAM959 binds and inhibits, and the function of these host target genes, as elaborated hereinbelow.

Nucleotide sequences of the VGAM959 precursor RNA, herein designated VGAM PRECURSOR RNA, and of the 'diced' VGAM959 RNA, herein designated VGAM RNA, and a schematic representation of the secondary folding of VGAM959 folded precursor RNA, herein designated VGAM FOLDED PRECURSOR RNA, of VGAM959 are further described hereinbelow with reference to Table 1.

Nucleotide sequences of host target binding sites, such as BINDING SITE-I, BINDING SITE-II and BINDING SITE-III of FIG. 1, found on VGAM959 host target RNA, and schematic representation of the complementarity of each of these host target binding sites to VGAM959 RNA, herein designated VGAM RNA, are described hereinbelow with reference to Table 2.

As mentioned hereinabove with reference to FIG. 1, a function of VGAM959 gene, herein designated VGAM is inhibition of expression of VGAM959 target genes. It is appreciated that specific functions, and accordingly utilities, of VGAM959 correlate with, and may be deduced from, the identity of the target genes which VGAM959 binds and inhibits, and the function of these target genes, as elaborated hereinbelow.

High-mobility Group Nucleosome Binding Domain 1 (HMGN1, Accession NM_004965) is a VGAM959 host target gene. HMGN1 BINDING SITE is HOST TARGET binding site found in the 3' untranslated region of mRNA encoded by HMGN1, corresponding to a HOST TARGET binding site such as BINDING SITE I, BINDING SITE II or BINDING SITE III. Table 2 illustrates the complementarity of the nucleotide sequences of HMGN1 BINDING SITE, designated SEQ ID:11411, to the nucleotide sequence of VGAM959 RNA, herein designated VGAM RNA, also designated SEQ ID:3670.

A function of VGAM959 is therefore inhibition of High-mobility Group Nucleosome Binding Domain 1 (HMGN1, Accession NM_004965), a gene which binds to the inner side of the nucleosomal DNA and involves in transcriptional regulation. Accordingly, utilities of VGAM959 include diagnosis, prevention and treatment of diseases and clinical conditions associated with HMGN1. The function of HMGN1 and its association with various diseases and clinical conditions, has been established by previous studies, as described hereinabove with reference to VGAM381. PIG8 (Accession NM_004879) is another VGAM959 host target gene. PIG8 BINDING SITE is HOST TARGET binding site found in the 3' untranslated region of mRNA encoded by PIG8, corresponding to a HOST TARGET binding site such as BINDING SITE I, BINDING SITE II or BINDING SITE III. Table 2 illustrates the complementarity of the nucleotide sequences of PIG8 BINDING SITE, designated SEQ ID:11314, to the nucleotide sequence of VGAM959 RNA, herein designated VGAM RNA, also designated SEQ ID:3670.

Another function of VGAM959 is therefore inhibition of PIG8 (Accession NM_004879), a gene which is induced by p53 and may be involved in apoptosis. Accordingly, utilities of VGAM959 include diagnosis, prevention and treatment of diseases and clinical conditions associated with PIG8. The function of PIG8 and its association with various diseases and clinical conditions, has been established by previous studies, as described hereinabove with reference to VGAM737. KIAA1095 (Accession XM_041363) is another VGAM959 host target gene. KIAA1095 BINDING SITE is HOST TARGET binding site found in the 3' untranslated region of mRNA encoded by KIAA1095, corresponding to a HOST TARGET binding site such as BINDING SITE I, BINDING SITE II or BINDING SITE III. Table 2 illustrates the complementarity of the nucleotide sequences of KIAA1095 BINDING SITE, designated SEQ ID:33504, to the nucleotide sequence of VGAM959 RNA, herein designated VGAM RNA, also designated SEQ ID:3670.

Another function of VGAM959 is therefore inhibition of KIAA1095 (Accession XM_041363). Accordingly, utilities of VGAM959 include diagnosis, prevention and treatment of diseases and clinical conditions associated with KIAA1095. LOC145854 (Accession XM_085259) is another VGAM959 host target gene. LOC145854 BINDING SITE is HOST TARGET binding site found in the 3' untranslated region of mRNA encoded by LOC145854, corresponding to a HOST TARGET binding site such as BINDING SITE I, BINDING SITE II or BINDING SITE III. Table 2 illustrates the complementarity of the nucleotide sequences of LOC145854 BINDING SITE, designated SEQ ID:38004, to the nucleotide sequence of VGAM959 RNA, herein designated VGAM RNA, also designated SEQ ID:3670.

Another function of VGAM959 is therefore inhibition of LOC145854 (Accession XM_085259). Accordingly, utilities of VGAM959 include diagnosis, prevention and treatment of diseases and clinical conditions associated with LOC145854. LOC158956 (Accession XM_039450) is another VGAM959 host target gene. LOC158956 BINDING SITE is HOST TARGET binding site found in the 3' untranslated region of mRNA encoded by LOC158956, corresponding to a HOST TARGET binding site such as BINDING SITE I, BINDING SITE II or BINDING SITE III. Table 2 illustrates the complementarity of the nucleotide sequences of LOC158956 BINDING SITE, designated SEQ ID:33095, to the nucleotide sequence of VGAM959 RNA, herein designated VGAM RNA, also designated SEQ ID:3670.

Another function of VGAM959 is therefore inhibition of LOC158956 (Accession XM_039450). Accordingly, utilities of VGAM959 include diagnosis, prevention and treatment of diseases and clinical conditions associated with LOC158956. FIG. 1 further provides a conceptual description of a novel bioinformatically detected viral gene of the present invention, referred to here as Viral Genomic Address Messenger 960 (VGAM960) viral gene, which modulates expression of respective host target genes thereof, the function and utility of which host target genes is known in the art.

VGAM960 is a novel bioinformatically detected regulatory, non protein coding, viral micro RNA (miRNA) gene. The method by which VGAM960 was detected is described hereinabove with reference to FIGS. 1-8.

VGAM960 gene, herein designated VGAM GENE, is a viral gene contained in the genome of Lumpy Skin Disease Virus. VGAM960 host target gene, herein designated VGAM HOST TARGET GENE, is a human gene contained in the human genome.

VGAM960 gene encodes a VGAM960 precursor RNA, herein designated VGAM PRECURSOR RNA. Similar to other miRNA genes, and unlike most ordinary genes, VGAM960 precursor RNA does not encode a protein. A nucleotide sequence identical or highly similar to the nucleotide sequence of VGAM960 precursor RNA is designated SEQ ID:946, and is provided hereinbelow with reference to the sequence listing part. Nucleotide sequence SEQ ID:946 is located at position 28243 relative to the genome of Lumpy Skin Disease Virus.

VGAM960 precursor RNA folds onto itself, forming VGAM960 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM960 folded precursor RNA into VGAM960 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM960 RNA is designated SEQ ID:3671, and is provided hereinbelow with reference to the sequence listing part.

VGAM960 host target gene, herein designated VGAM HOST TARGET GENE, encodes a corresponding messenger RNA, VGAM960 host target RNA, herein designated VGAM HOST TARGET RNA. VGAM960 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM960 RNA, herein designated VGAM RNA, binds complementarily to one or more host target binding sites located in untranslated regions of VGAM960 host target RNA, herein designated VGAM HOST TARGET RNA. This complementary binding is due to the fact that the nucleotide sequence of VGAM960 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM960 RNA, herein designated VGAM RNA, may have a different number of host target binding sites in untranslated regions of a VGAM960 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM960 RNA, herein designated VGAM RNA, to host target binding sites on VGAM960 host target RNA, herein designated VGAM HOST TARGET RNA, such as BINDING SITE I, BINDING SITE II and BINDING SITE III, inhibits translation of VGAM960 host target RNA into VGAM960 host target protein, herein designated VGAM HOST TARGET PROTEIN. VGAM host target protein is therefore outlined by a broken line.

It is appreciated that VGAM960 host target gene, herein designated VGAM HOST TARGET GENE, in fact represents a plurality of VGAM960 host target genes. The mRNA of each one of this plurality of VGAM960 host target genes comprises one or more host target binding sites, each having a nucleotide sequence which is at least partly complementary to VGAM960 RNA, herein designated VGAM RNA, and which when bound by VGAM960 RNA causes inhibition of translation of respective one or more VGAM960 host target proteins.

It is further appreciated by one skilled in the art that the mode of translational inhibition illustrated by FIG. 1 with specific reference to translational inhibition exerted by VGAM960 gene, herein designated VGAM GENE, on one or more VGAM960 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM960 is inhibition of expression of host target genes, as part of a novel viral mechanism of attacking a host. Accordingly, utilities of VGAM960 include diagnosis, prevention and treatment of viral infection by Lumpy Skin Disease Virus. Specific functions, and accordingly utilities, of VGAM960 correlate with, and may be deduced from, the identity of the host target genes which VGAM960 binds and inhibits, and the function of these host target genes, as elaborated hereinbelow.

Nucleotide sequences of the VGAM960 precursor RNA, herein designated VGAM PRECURSOR RNA, and of the 'diced' VGAM960 RNA, herein designated VGAM RNA, and a schematic representation of the secondary folding of VGAM960 folded precursor RNA, herein designated VGAM FOLDED PRECURSOR RNA, of VGAM960 are further described hereinbelow with reference to Table 1.

Nucleotide sequences of host target binding sites, such as BINDING SITE-I, BINDING SITE-II and BINDING SITE-III of FIG. 1, found on VGAM960 host target RNA, and schematic representation of the complementarity of each of these host target binding sites to VGAM960 RNA, herein designated VGAM RNA, are described hereinbelow with reference to Table 2.

As mentioned hereinabove with reference to FIG. 1, a function of VGAM960 gene, herein designated VGAM is inhibition of expression of VGAM960 target genes. It is appreciated that specific functions, and accordingly utilities, of VGAM960 correlate with, and may be deduced from, the identity of the target genes which VGAM960 binds and inhibits, and the function of these target genes, as elaborated hereinbelow.

Asparaginyl-tRNA Synthetase (NARS, Accession NM_004539) is a VGAM960 host target gene. NARS BINDING SITE is HOST TARGET binding site found in the 3' untranslated region of mRNA encoded by NARS, corresponding to a HOST TARGET binding site such as BINDING SITE I, BINDING SITE II or BINDING SITE III. Table 2 illustrates the complementarity of the nucleotide sequences of NARS BINDING SITE, designated SEQ ID:10890, to the nucleotide sequence of VGAM960 RNA, herein designated VGAM RNA, also designated SEQ ID:3671.

A function of VGAM960 is therefore inhibition of Asparaginyl-tRNA Synthetase (NARS, Accession NM_004539), a gene which is ASPARAGINYL-tRNA SYNTHETASE. Accordingly, utilities of VGAM960 include diagnosis, prevention and treatment of diseases and clinical conditions associated with NARS. The function of NARS and its association with various diseases and clinical conditions, has been established by previous studies, as described hereinabove with reference to VGAM601. Solute Carrier Family 16 (monocarboxylic acid transporters), Member 2 (putative transporter) (SLC16A2, Accession NM_006517) is another VGAM960 host target gene. SLC16A2 BINDING SITE is HOST TARGET binding site found in the 3' untranslated region of mRNA encoded by SLC16A2, corresponding to a HOST TARGET binding site such as BINDING SITE I, BINDING SITE II or BINDING SITE III. Table 2 illustrates the complementarity of the nucleotide sequences of SLC16A2 BINDING SITE, designated SEQ ID:13272, to the nucleotide sequence of VGAM960 RNA, herein designated VGAM RNA, also designated SEQ ID:3671.

Another function of VGAM960 is therefore inhibition of Solute Carrier Family 16 (monocarboxylic acid transporters), Member 2 (putative transporter) (SLC16A2, Accession NM_006517). Accordingly, utilities of VGAM960 include diagnosis, prevention and treatment of diseases and clinical conditions associated with SLC16A2. KIAA0391 (Accession NM_014672) is another VGAM960 host target gene. KIAA0391 BINDING SITE is HOST TARGET binding site found in the 3' untranslated region of mRNA encoded by KIAA0391, corresponding to a HOST TARGET binding site such as BINDING SITE I, BINDING SITE II or BINDING SITE III. Table 2 illustrates the complementarity of the nucleotide sequences of KIAA0391 BINDING SITE, designated SEQ ID:16137, to the nucleotide sequence of VGAM960 RNA, herein designated VGAM RNA, also designated SEQ ID:3671.

Another function of VGAM960 is therefore inhibition of KIAA0391 (Accession NM_014672). Accordingly, utilities of VGAM960 include diagnosis, prevention and treatment of diseases and clinical conditions associated with KIAA0391.

FIG. 1 further provides a conceptual description of a novel bioinformatically detected viral gene of the present invention, referred to here as Viral Genomic Address Messenger 961 (VGAM961) viral gene, which modulates expression of respective host target genes thereof, the function and utility of which host target genes is known in the art.

VGAM961 is a novel bioinformatically detected regulatory, non protein coding, viral micro RNA (miRNA) gene. The method by which VGAM961 was detected is described hereinabove with reference to FIGS. 1-8.

VGAM961 gene, herein designated VGAM GENE, is a viral gene contained in the genome of Goatpox Virus. VGAM961 host target gene, herein designated VGAM HOST TARGET GENE, is a human gene contained in the human genome.

VGAM961 gene encodes a VGAM961 precursor RNA, herein designated VGAM PRECURSOR RNA. Similar to other miRNA genes, and unlike most ordinary genes, VGAM961 precursor RNA does not encode a protein. A nucleotide sequence identical or highly similar to the nucleotide sequence of VGAM961 precursor RNA is designated SEQ ID:947, and is provided hereinbelow with reference to the sequence listing part. Nucleotide sequence SEQ ID:947 is located at position 23299 relative to the genome of Goatpox Virus.

VGAM961 precursor RNA folds onto itself, forming VGAM961 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM961 folded precursor RNA into VGAM961 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 83%) nucleotide sequence of VGAM961 RNA is designated SEQ ID:3672, and is provided hereinbelow with reference to the sequence listing part.

VGAM961 host target gene, herein designated VGAM HOST TARGET GENE, encodes a corresponding messenger RNA, VGAM961 host target RNA, herein designated VGAM HOST TARGET RNA. VGAM961 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM961 RNA, herein designated VGAM RNA, binds complementarily to one or more host target binding sites located in untranslated regions of VGAM961 host target RNA, herein designated VGAM HOST TARGET RNA. This complementary binding is due to the fact that the nucleotide sequence of VGAM961 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM961 RNA, herein designated VGAM RNA, may have a different number of host target binding sites in untranslated regions of a VGAM961 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM961 RNA, herein designated VGAM RNA, to host target binding sites on VGAM961 host target RNA, herein designated VGAM HOST TARGET RNA, such as BINDING SITE I, BINDING SITE II and BINDING SITE III, inhibits translation of VGAM961 host target RNA into VGAM961 host target protein, herein designated VGAM HOST TARGET PROTEIN. VGAM host target protein is therefore outlined by a broken line.

It is appreciated that VGAM961 host target gene, herein designated VGAM HOST TARGET GENE, in fact represents a plurality of VGAM961 host target genes. The mRNA of each one of this plurality of VGAM961 host target genes comprises one or more host target binding sites, each having a nucleotide sequence which is at least partly complementary to VGAM961 RNA, herein designated VGAM RNA, and which when bound by VGAM961 RNA causes inhibition of translation of respective one or more VGAM961 host target proteins.

It is further appreciated by one skilled in the art that the mode of translational inhibition illustrated by FIG. 1 with specific reference to translational inhibition exerted by VGAM961 gene, herein designated VGAM GENE, on one or more VGAM961 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM961 is inhibition of expression of host target genes, as part of a novel viral mechanism of attacking a host. Accordingly, utilities of VGAM961 include diagnosis, prevention and treatment of viral infection by Goatpox Virus. Specific functions, and accordingly utilities, of VGAM961 correlate with, and may be deduced from, the identity of the host target genes which VGAM961 binds and inhibits, and the function of these host target genes, as elaborated hereinbelow.

Nucleotide sequences of the VGAM961 precursor RNA, herein designated VGAM PRECURSOR RNA, and of the 'diced' VGAM961 RNA, herein designated VGAM RNA, and a schematic representation of the secondary folding of VGAM961 folded precursor RNA, herein designated VGAM FOLDED PRECURSOR RNA, of VGAM961 are further described hereinbelow with reference to Table 1.

Nucleotide sequences of host target binding sites, such as BINDING SITE-I, BINDING SITE-II and BINDING SITE-III of FIG. 1, found on VGAM961 host target RNA, and schematic representation of the complementarity of each of these host target binding sites to VGAM961 RNA, herein designated VGAM RNA, are described hereinbelow with reference to Table 2.

As mentioned hereinabove with reference to FIG. 1, a function of VGAM961 gene, herein designated VGAM is inhibition of expression of VGAM961 target genes. It is appreciated that specific functions, and accordingly utilities, of VGAM961 correlate with, and may be deduced from, the identity of the target genes which VGAM961 binds and inhibits, and the function of these target genes, as elaborated hereinbelow.

Collagen, Type XIX, Alpha 1 (COL19A1, Accession NM_001858) is a VGAM961 host target gene. COL19A1 BINDING SITE is HOST TARGET binding site found in the 3' untranslated region of mRNA encoded by COL19A1, corresponding to a HOST TARGET binding site such as BINDING SITE I, BINDING SITE II or BINDING SITE III. Table 2 illustrates the complementarity of the nucleotide sequences of COL19A1 BINDING SITE, designated SEQ ID:7596, to the nucleotide sequence of VGAM961 RNA, herein designated VGAM RNA, also designated SEQ ID:3672.

A function of VGAM961 is therefore inhibition of Collagen, Type XIX, Alpha 1 (COL19A1, Accession NM_001858), a gene which may act as a cross-bridge between fibrils and other extracellular matrix molecules. Accordingly, utilities of VGAM961 include diagnosis, prevention and treatment of diseases and clinical conditions associated with COL19A1. The function of COL19A1 and its association with various diseases and clinical conditions, has been established by previous studies, as described hereinabove with reference to VGAM19. FIG. 1 further provides a conceptual description of a novel bioinformatically detected viral gene of the present invention, referred to here as Viral Genomic Address Messenger 962 (VGAM962) viral gene, which modulates expression of respective host target genes thereof, the function and utility of which host target genes is known in the art.

VGAM962 is a novel bioinformatically detected regulatory, non protein coding, viral micro RNA (miRNA) gene. The method by which VGAM962 was detected is described hereinabove with reference to FIGS. 1-8.

VGAM962 gene, herein designated VGAM GENE, is a viral gene contained in the genome of Meleagrid Herpesvirus 1. VGAM962 host target gene, herein designated VGAM HOST TARGET GENE, is a human gene contained in the human genome.

VGAM962 gene encodes a VGAM962 precursor RNA, herein designated VGAM PRECURSOR RNA. Similar to other miRNA genes, and unlike most ordinary genes, VGAM962 precursor RNA does not encode a protein. A nucleotide sequence identical or highly similar to the nucleotide sequence of VGAM962 precursor RNA is designated SEQ ID:948, and is provided hereinbelow with reference to the sequence listing part. Nucleotide sequence SEQ ID:948 is located at position 22678 relative to the genome of Meleagrid Herpesvirus 1.

VGAM962 precursor RNA folds onto itself, forming VGAM962 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM962 folded precursor RNA into VGAM962 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM962 RNA is designated SEQ ID:3673, and is provided hereinbelow with reference to the sequence listing part.

VGAM962 host target gene, herein designated VGAM HOST TARGET GENE, encodes a corresponding messenger RNA, VGAM962 host target RNA, herein designated VGAM HOST TARGET RNA. VGAM962 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM962 RNA, herein designated VGAM RNA, binds complementarily to one or more host target binding sites located in untranslated regions of VGAM962 host target RNA, herein designated VGAM HOST TARGET RNA. This complementary binding is due to the fact that the nucleotide sequence of VGAM962 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM962 RNA, herein designated VGAM RNA, may have a different number of host target binding sites in untranslated regions of a VGAM962 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM962 RNA, herein designated VGAM RNA, to host target binding sites on VGAM962 host target RNA, herein designated VGAM HOST TARGET RNA, such as BINDING SITE I, BINDING SITE II and BINDING SITE III, inhibits translation of VGAM962 host target RNA into VGAM962 host target protein, herein designated VGAM HOST TARGET PROTEIN. VGAM host target protein is therefore outlined by a broken line.

It is appreciated that VGAM962 host target gene, herein designated VGAM HOST TARGET GENE, in fact represents a plurality of VGAM962 host target genes. The mRNA of each one of this plurality of VGAM962 host target genes comprises one or more host target binding sites, each having a nucleotide sequence which is at least partly complementary to VGAM962 RNA, herein designated VGAM RNA, and which when bound by VGAM962 RNA causes inhibition of translation of respective one or more VGAM962 host target proteins.

It is further appreciated by one skilled in the art that the mode of translational inhibition illustrated by FIG. 1 with specific reference to translational inhibition exerted by VGAM962 gene, herein designated VGAM GENE, on one or more VGAM962 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM962 is inhibition of expression of host target genes, as part of a novel viral mechanism of attacking a host. Accordingly, utilities of VGAM962 include diagnosis, prevention and treatment of viral infection by Meleagrid Herpesvirus 1. Specific functions, and accordingly utilities, of VGAM962 correlate with, and may be deduced from, the identity of the host target genes which VGAM962 binds and inhibits, and the function of these host target genes, as elaborated hereinbelow.

Nucleotide sequences of the VGAM962 precursor RNA, herein designated VGAM PRECURSOR RNA, and of the 'diced' VGAM962 RNA, herein designated VGAM RNA, and a schematic representation of the secondary folding of VGAM962 folded precursor RNA, herein designated VGAM FOLDED PRECURSOR RNA, of VGAM962 are further described hereinbelow with reference to Table 1.

Nucleotide sequences of host target binding sites, such as BINDING SITE-I, BINDING SITE-II and BINDING SITE-III of FIG. 1, found on VGAM962 host target RNA, and schematic representation of the complementarity of each of these host target binding sites to VGAM962 RNA, herein designated VGAM RNA, are described hereinbelow with reference to Table 2.

As mentioned hereinabove with reference to FIG. 1, a function of VGAM962 gene, herein designated VGAM is inhibition of expression of VGAM962 target genes. It is appreciated that specific functions, and accordingly utilities, of VGAM962 correlate with, and may be deduced from, the identity of the target genes which VGAM962 binds and inhibits, and the function of these target genes, as elaborated hereinbelow.

Adenylate Cyclase 7 (ADCY7, Accession NM_001114) is a VGAM962 host target gene. ADCY7 BINDING SITE is HOST TARGET binding site found in the 3' untranslated region of mRNA encoded by ADCY7, corresponding to a HOST TARGET binding site such as BINDING SITE I, BINDING SITE II or BINDING SITE III. Table 2 illustrates the complementarity of the nucleotide sequences of ADCY7 BINDING SITE, designated SEQ ID:6778, to the nucleotide sequence of VGAM962 RNA, herein designated VGAM RNA, also designated SEQ ID:3673.

A function of VGAM962 is therefore inhibition of Adenylate Cyclase 7 (ADCY7, Accession NM_001114), a gene which this a membrane-bound, ca (2+)-inhibitable adenylyl cyclase. Accordingly, utilities of VGAM962 include diagnosis, prevention and treatment of diseases and clinical conditions associated with ADCY7. The function of ADCY7 and its association with various diseases and clinical conditions, has been established by previous studies, as described hereinabove with reference to VGAM108. Chromatin Accessibility Complex 1 (CHRAC1, Accession NM_017444) is another VGAM962 host target gene. CHRAC1 BINDING SITE is HOST TARGET binding site found in the 3' untranslated region of mRNA encoded by CHRAC1, corresponding to a HOST TARGET binding site such as BINDING SITE I, BINDING SITE II or BINDING SITE III. Table 2 illustrates the complementarity of the nucleotide sequences of CHRAC1 BINDING SITE, designated SEQ ID:18901, to the nucleotide sequence of VGAM962 RNA, herein designated VGAM RNA, also designated SEQ ID:3673.

Another function of VGAM962 is therefore inhibition of Chromatin Accessibility Complex 1 (CHRAC1, Accession NM_017444). Accordingly, utilities of VGAM962 include diagnosis, prevention and treatment of diseases and clinical conditions associated with CHRAC1. KIAA1538 (Accession XM_049474) is another VGAM962 host target gene. KIAA1538 BINDING SITE is HOST TARGET binding site found in the 5' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35421, to the nucleotide sequence of VGAM962 RNA, herein designated VGAM RNA, also designated SEQ ID:3673.

Another function of VGAM962 is therefore inhibition of KIAA1538 (Accession XM_049474). Accordingly, utilities of VGAM962 include diagnosis, prevention and treatment of diseases and clinical conditions associated with KIAA1538. MGC2752 (Accession XM_085842) is another VGAM962 host target gene. MGC2752 BINDING SITE is HOST TARGET binding site found in the 5' untranslated region of mRNA encoded by MGC2752, corresponding to a HOST TARGET binding site such as BINDING SITE I, BINDING SITE II or BINDING SITE III. Table 2 illustrates the complementarity of the nucleotide sequences of MGC2752 BINDING SITE, designated SEQ ID:38366, to the nucleotide sequence of VGAM962 RNA, herein designated VGAM RNA, also designated SEQ ID:3673.

Another function of VGAM962 is therefore inhibition of MGC2752 (Accession XM_085842). Accordingly, utilities of VGAM962 include diagnosis, prevention and treatment of diseases and clinical conditions associated with MGC2752. LOC146445 (Accession XM_096999) is another VGAM962 host target gene. LOC146445 BINDING SITE is HOST TARGET binding site found in the 3' untranslated region of mRNA encoded by LOC146445, corresponding to a HOST TARGET binding site such as BINDING SITE I, BINDING SITE II or BINDING SITE III. Table 2 illustrates the complementarity of the nucleotide sequences of LOC146445 BINDING SITE, designated SEQ ID:40697, to the nucleotide sequence of VGAM962 RNA, herein designated VGAM RNA, also designated SEQ ID:3673.

Another function of VGAM962 is therefore inhibition of LOC146445 (Accession XM_096999). Accordingly, utilities of VGAM962 include diagnosis, prevention and treatment of diseases and clinical conditions associated with LOC146445. FIG. 1 further provides a conceptual description of a novel bioinformatically detected viral gene of the present invention, referred to here as Viral Genomic Address Messenger 963 (VGAM963) viral gene, which modulates expression of respective host target genes thereof, the function and utility of which host target genes is known in the art.

VGAM963 is a novel bioinformatically detected regulatory, non protein coding, viral micro RNA (miRNA) gene. The method by which VGAM963 was detected is described hereinabove with reference to FIGS. 1-8.

VGAM963 gene, herein designated VGAM GENE, is a viral gene contained in the genome of Meleagrid Herpesvirus 1. VGAM963 host target gene, herein designated VGAM HOST TARGET GENE, is a human gene contained in the human genome.

VGAM963 gene encodes a VGAM963 precursor RNA, herein designated VGAM PRECURSOR RNA. Similar to other miRNA genes, and unlike most ordinary genes, VGAM963 precursor RNA does not encode a protein. A nucleotide sequence identical or highly similar to the nucleotide sequence of VGAM963 precursor RNA is designated SEQ ID:949, and is provided hereinbelow with reference to the sequence listing part. Nucleotide sequence SEQ ID:949 is located at position 20617 relative to the genome of Meleagrid Herpesvirus 1.

VGAM963 precursor RNA folds onto itself, forming VGAM963 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM963 folded precursor RNA into VGAM963 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM963 RNA is designated SEQ ID:3674, and is provided hereinbelow with reference to the sequence listing part.

VGAM963 host target gene, herein designated VGAM HOST TARGET GENE, encodes a corresponding messenger RNA, VGAM963 host target RNA, herein designated VGAM HOST TARGET RNA. VGAM963 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM963 RNA, herein designated VGAM RNA, binds complementarily to one or more host target binding sites located in untranslated regions of VGAM963 host target RNA, herein designated VGAM HOST TARGET RNA. This complementary binding is due to the fact that the nucleotide sequence of VGAM963 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM963 RNA, herein designated VGAM RNA, may have a different number of host target binding sites in untranslated regions of a VGAM963 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM963 RNA, herein designated VGAM RNA, to host target binding sites on VGAM963 host target RNA, herein designated VGAM HOST TARGET RNA, such as BINDING SITE I, BINDING SITE II and BINDING SITE III, inhibits translation of VGAM963 host target RNA into VGAM963 host target protein, herein designated VGAM HOST TARGET PROTEIN. VGAM host target protein is therefore outlined by a broken line.

It is appreciated that VGAM963 host target gene, herein designated VGAM HOST TARGET GENE, in fact represents a plurality of VGAM963 host target genes. The mRNA of each one of this plurality of VGAM963 host target genes comprises one or more host target binding sites, each having a nucleotide sequence which is at least partly complementary to VGAM963 RNA, herein designated VGAM RNA, and which when bound by VGAM963 RNA causes inhibition of translation of respective one or more VGAM963 host target proteins.

It is further appreciated by one skilled in the art that the mode of translational inhibition illustrated by FIG. 1 with specific reference to translational inhibition exerted by VGAM963 gene, herein designated VGAM GENE, on one or more VGAM963 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM963 is inhibition of expression of host target genes, as part of a novel viral mechanism of attacking a host. Accordingly, utilities of VGAM963 include diagnosis, prevention and treatment of viral infection by Meleagrid Herpesvirus 1. Specific functions, and accordingly utilities, of VGAM963 correlate with, and may be deduced from, the identity of the host target genes which VGAM963 binds and inhibits, and the function of these host target genes, as elaborated hereinbelow.

Nucleotide sequences of the VGAM963 precursor RNA, herein designated VGAM PRECURSOR RNA, and of the 'diced' VGAM963 RNA, herein designated VGAM RNA, and a schematic representation of the secondary folding of VGAM963 folded precursor RNA, herein designated VGAM FOLDED PRECURSOR RNA, of VGAM963 are further described hereinbelow with reference to Table 1.

Nucleotide sequences of host target binding sites, such as BINDING SITE-I, BINDING SITE-II and BINDING SITE-III of FIG. 1, found on VGAM963 host target RNA, and schematic representation of the complementarity of each of these host target binding sites to VGAM963 RNA, herein designated VGAM RNA, are described hereinbelow with reference to Table 2.

As mentioned hereinabove with reference to FIG. 1, a function of VGAM963 gene, herein designated VGAM is inhibition of expression of VGAM963 target genes. It is appreciated that specific functions, and accordingly utilities, of VGAM963 correlate with, and may be deduced from, the identity of the target genes which VGAM963 binds and inhibits, and the function of these target genes, as elaborated hereinbelow.

EZFIT (Accession NM_021216) is a VGAM963 host target gene. EZFIT BINDING SITE is HOST TARGET binding site found in the 3' untranslated region of mRNA encoded by EZFIT, corresponding to a HOST TARGET binding site such as BINDING SITE I, BINDING SITE II or BINDING SITE III. Table 2 illustrates the complementarity of the nucleotide sequences of EZFIT BINDING SITE, designated SEQ ID:22197, to the nucleotide sequence of VGAM963 RNA, herein designated VGAM RNA, also designated SEQ ID:3674.

A function of VGAM963 is therefore inhibition of EZFIT (Accession NM_021216). Accordingly, utilities of VGAM963 include diagnosis, prevention and treatment of diseases and clinical conditions associated with EZFIT. KIAA0009 (Accession NM_014637) is another VGAM963 host target gene. KIAA0009 BINDING SITE is HOST TARGET binding site found in the 3' untranslated region of mRNA encoded by KIAA0009, corresponding to a HOST TARGET binding site such as BINDING SITE I, BINDING SITE II or BINDING SITE III. Table 2 illustrates the complementarity of the nucleotide sequences of KIAA0009 BINDING SITE, designated SEQ ID:16024, to the nucleotide sequence of VGAM963 RNA, herein designated VGAM RNA, also designated SEQ ID:3674.

Another function of VGAM963 is therefore inhibition of KIAA0009 (Accession NM_014637). Accordingly, utilities of VGAM963 include diagnosis, prevention and treatment of diseases and clinical conditions associated with KIAA0009. Ubinuclein 1 (UBN1, Accession NM_016936) is another VGAM963 host target gene. UBN1 BINDING SITE is HOST TARGET binding site found in the 3' untranslated region of mRNA encoded by UBN1, corresponding to a HOST TARGET binding site such as BINDING SITE I, BINDING SITE II or BINDING SITE III. Table 2 illustrates the complementarity of the nucleotide sequences of UBN1 BINDING SITE, designated SEQ ID:18853, to the nucleotide sequence of VGAM963 RNA, herein designated VGAM RNA, also designated SEQ ID:3674.

Another function of VGAM963 is therefore inhibition of Ubinuclein 1 (UBN1, Accession NM_016936). Accordingly, utilities of VGAM963 include diagnosis, prevention and treatment of diseases and clinical conditions associated with UBN1. FIG. 1 further provides a conceptual description of a novel bioinformatically detected viral gene of the present invention, referred to here as Viral Genomic Address Messenger 964 (VGAM964) viral gene, which modulates expression of respective host target genes thereof, the function and utility of which host target genes is known in the art.

VGAM964 is a novel bioinformatically detected regulatory, non protein coding, viral micro RNA (miRNA) gene. The method by which VGAM964 was detected is described hereinabove with reference to FIGS. 1-8.

VGAM964 gene, herein designated VGAM GENE, is a viral gene contained in the genome of Meleagrid Herpesvirus 1. VGAM964 host target gene, herein designated VGAM HOST TARGET GENE, is a human gene contained in the human genome.

VGAM964 gene encodes a VGAM964 precursor RNA, herein designated VGAM PRECURSOR RNA. Similar to other miRNA genes, and unlike most ordinary genes, VGAM964 precursor RNA does not encode a protein. A nucleotide sequence identical or highly similar to the nucleotide sequence of VGAM964 precursor RNA is designated SEQ ID:950, and is provided hereinbelow with reference to the sequence listing part. Nucleotide sequence SEQ ID:950 is located at position 22865 relative to the genome of Meleagrid Herpesvirus 1.

VGAM964 precursor RNA folds onto itself, forming VGAM964 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM964 folded precursor RNA into VGAM964 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 43%) nucleotide sequence of VGAM964 RNA is designated SEQ ID:3675, and is provided hereinbelow with reference to the sequence listing part.

VGAM964 host target gene, herein designated VGAM HOST TARGET GENE, encodes a corresponding messenger RNA, VGAM964 host target RNA, herein designated VGAM HOST TARGET RNA. VGAM964 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM964 RNA, herein designated VGAM RNA, binds complementarily to one or more host target binding sites located in untranslated regions of VGAM964 host target RNA, herein designated VGAM HOST TARGET RNA. This complementary binding is due to the fact that the nucleotide sequence of VGAM964 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM964 RNA, herein designated VGAM RNA, may have a different number of host target binding sites in untranslated regions of a VGAM964 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM964 RNA, herein designated VGAM RNA, to host target binding sites on VGAM964 host target RNA, herein designated VGAM HOST TARGET RNA, such as BINDING SITE I, BINDING SITE II and BINDING SITE III, inhibits translation of VGAM964 host target RNA into VGAM964 host target protein, herein designated VGAM HOST TARGET PROTEIN. VGAM host target protein is therefore outlined by a broken line.

It is appreciated that VGAM964 host target gene, herein designated VGAM HOST TARGET GENE, in fact represents a plurality of VGAM964 host target genes. The mRNA of each one of this plurality of VGAM964 host target genes comprises one or more host target binding sites, each having a nucleotide sequence which is at least partly complementary to VGAM964 RNA, herein designated VGAM RNA, and which when bound by VGAM964 RNA causes inhibition of translation of respective one or more VGAM964 host target proteins.

It is further appreciated by one skilled in the art that the mode of translational inhibition illustrated by FIG. 1 with specific reference to translational inhibition exerted by VGAM964 gene, herein designated VGAM GENE, on one or more VGAM964 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM964 is inhibition of expression of host target genes, as part of a novel viral mechanism of attacking a host. Accordingly, utilities of VGAM964 include diagnosis, prevention and treatment of viral infection by Meleagrid Herpesvirus 1. Specific functions, and accordingly utilities, of VGAM964 correlate with, and may be deduced from, the identity of the host target genes which VGAM964 binds and inhibits, and the function of these host target genes, as elaborated hereinbelow.

Nucleotide sequences of the VGAM964 precursor RNA, herein designated VGAM PRECURSOR RNA, and of the 'diced' VGAM964 RNA, herein designated VGAM RNA, and a schematic representation of the secondary folding of VGAM964 folded precursor RNA, herein designated VGAM FOLDED PRECURSOR RNA, of VGAM964 are further described hereinbelow with reference to Table 1.

Nucleotide sequences of host target binding sites, such as BINDING SITE-I, BINDING SITE-II and BINDING SITE-III of FIG. 1, found on VGAM964 host target RNA, and schematic representation of the complementarity of each of these host target binding sites to VGAM964 RNA, herein designated VGAM RNA, are described hereinbelow with reference to Table 2.

As mentioned hereinabove with reference to FIG. 1, a function of VGAM964 gene, herein designated VGAM is inhibition of expression of VGAM964 target genes. It is appreciated that specific functions, and accordingly utilities, of VGAM964 correlate with, and may be deduced from, the identity of the target genes which VGAM964 binds and inhibits, and the function of these target genes, as elaborated hereinbelow.

Ankyrin-like with Transmembrane Domains 1 (ANKTM1, Accession NM_007332) is a VGAM964 host target gene. ANKTM1 BINDING SITE is HOST TARGET binding site found in the 3' untranslated region of mRNA encoded by ANKTM1, corresponding to a HOST TARGET binding site such as BINDING SITE I, BINDING SITE II or BINDING SITE III. Table 2 illustrates the complementarity of the nucleotide sequences of ANKTM1 BINDING SITE, designated SEQ ID:14257, to the nucleotide sequence of VGAM964 RNA, herein designated VGAM RNA, also designated SEQ ID:3675.

A function of VGAM964 is therefore inhibition of Ankyrin-like with Transmembrane Domains 1 (ANKTM1, Accession NM_007332), a gene which attaches integral membrane proteins to cytoskeletal elements. Accordingly, utilities of VGAM964 include diagnosis, prevention and treatment of diseases and clinical conditions associated with ANKTM1. The function of ANKTM1 and its association with various diseases and clinical conditions, has been established by previous studies, as described hereinabove with reference to VGAM644. Checkpoint Suppressor 1 (CHES1, Accession NM_005197) is another VGAM964 host target gene. CHES1 BINDING SITE is HOST TARGET binding site found in the 3' untranslated region of mRNA encoded by CHES1, corresponding to a HOST TARGET binding site such as BINDING SITE I, BINDING SITE II or BINDING SITE III. Table 2 illustrates the complementarity of the nucleotide sequences of CHES1 BINDING SITE, designated SEQ ID:11696, to the nucleotide sequence of VGAM964 RNA, herein designated VGAM RNA, also designated SEQ ID:3675.

Another function of VGAM964 is therefore inhibition of Checkpoint Suppressor 1 (CHES1, Accession NM_005197). Accordingly, utilities of VGAM964 include diagnosis, prevention and treatment of diseases and clinical conditions associated with CHES1. Deoxyguanosine Kinase (DGUOK, Accession NM_080915) is another VGAM964 host target gene. DGUOK BINDING SITE1 and DGUOK BINDING SITE2 are HOST TARGET binding sites found in untranslated regions of mRNA encoded by DGUOK, corresponding to HOST TARGET binding sites such as BINDING SITE I, BINDING SITE II or BINDING SITE III. Table 2 illustrates the complementarity of the nucleotide sequences of DGUOK BINDING SITE1 and DGUOK BINDING SITE2, designated SEQ ID:28136 and SEQ ID:28139 respectively, to the nucleotide sequence of VGAM964 RNA, herein designated VGAM RNA, also designated SEQ ID:3675.

Another function of VGAM964 is therefore inhibition of Deoxyguanosine Kinase (DGUOK, Accession NM_080915), a gene which is deoxyguanosine kinase and mediates phosphorylation of several deoxyribonucleosides. Accordingly, utilities of VGAM964 include diagnosis, prevention and treatment of diseases and clinical conditions associated with DGUOK. The function of DGUOK and its association with various diseases and clinical conditions, has been established by previous studies, as described hereinabove with reference to VGAM121. Zinc Finger Protein 202 (ZNF202, Accession NM_003455) is another VGAM964 host target gene. ZNF202 BINDING SITE is HOST TARGET binding site found in the 3' untranslated region of mRNA encoded by ZNF202, corresponding to a HOST TARGET binding site such as BINDING SITE I, BINDING SITE II or BINDING SITE III. Table 2 illustrates the complementarity of the nucleotide sequences of ZNF202 BINDING SITE, designated SEQ ID:9508, to the nucleotide sequence of VGAM964 RNA, herein designated VGAM RNA, also designated SEQ ID:3675.

Another function of VGAM964 is therefore inhibition of Zinc Finger Protein 202 (ZNF202, Accession NM_003455). Accordingly, utilities of VGAM964 include diagnosis, prevention and treatment of diseases and clinical conditions associated with ZNF202. Chromosome 20 Open Reading Frame 121 (C20orf121, Accession NM_024331) is another VGAM964 host target gene. C20orf121 BINDING SITE is HOST TARGET binding site found in the 3' untranslated region of mRNA encoded by C20orf121, corresponding to a HOST TARGET binding site such as BINDING SITE I, BINDING SITE II or BINDING SITE III. Table 2 illustrates the complementarity of the nucleotide sequences of C20orf121 BINDING SITE, designated SEQ ID:23632, to the nucleotide sequence of VGAM964 RNA, herein designated VGAM RNA, also designated SEQ ID:3675.

Another function of VGAM964 is therefore inhibition of Chromosome 20 Open Reading Frame 121 (C20orf121, Accession NM_024331). Accordingly, utilities of VGAM964 include diagnosis, prevention and treatment of diseases and clinical conditions associated with C20orf121. FLJ14213 (Accession NM_024841) is another VGAM964 host target gene. FLJ14213 BINDING SITE is HOST TARGET binding site found in the 3' untranslated region of mRNA encoded by FLJ14213, corresponding to a HOST TARGET binding site such as BINDING SITE I, BINDING SITE II or BINDING SITE III. Table 2 illustrates the complementarity of the nucleotide sequences of FLJ14213 BINDING SITE, designated SEQ ID:24254, to the nucleotide sequence of VGAM964 RNA, herein designated VGAM RNA, also designated SEQ ID:3675.

Another function of VGAM964 is therefore inhibition of FLJ14213 (Accession NM_024841). Accordingly, utilities of VGAM964 include diagnosis, prevention and treatment of diseases and clinical conditions associated with FLJ14213. FLJ22794 (Accession XM_166220) is another VGAM964 host target gene. FLJ22794 BINDING SITE is HOST TARGET binding site found in the 5' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44030, to the nucleotide sequence of VGAM964 RNA, herein designated VGAM RNA, also designated SEQ ID:3675.

Another function of VGAM964 is therefore inhibition of FLJ22794 (Accession XM_166220). Accordingly, utilities of VGAM964 include diagnosis, prevention and treatment of diseases and clinical conditions associated with FLJ22794. FUS Interacting Protein (serine-arginine rich) 1 (FUSIP1, Accession NM_006625) is another VGAM964 host target gene. FUSIP1 BINDING SITE is HOST TARGET binding site found in the 3' untranslated region of mRNA encoded by FUSIP1, corresponding to a HOST TARGET binding site such as BINDING SITE I, BINDING SITE II or BINDING SITE III. Table 2 illustrates the complementarity of the nucleotide sequences of FUSIP1 BINDING SITE, designated SEQ ID:13409, to the nucleotide sequence of VGAM964 RNA, herein designated VGAM RNA, also designated SEQ ID:3675.

Another function of VGAM964 is therefore inhibition of FUS Interacting Protein (serine-arginine rich) 1 (FUSIP1, Accession NM_006625). Accordingly, utilities of VGAM964 include diagnosis, prevention and treatment of diseases and clinical conditions associated with FUSIP1. HCA4 (Accession XM_085287) is another VGAM964 host target gene. HCA4 BINDING SITE is HOST TARGET binding site found in the 3' untranslated region of mRNA encoded by HCA4, corresponding to a HOST TARGET binding site such as BINDING SITE I, BINDING SITE II or BINDING SITE III. Table 2 illustrates the complementarity of the nucleotide sequences of HCA4 BINDING SITE, designated SEQ ID:38018, to the nucleotide sequence of VGAM964 RNA, herein designated VGAM RNA, also designated SEQ ID:3675.

Another function of VGAM964 is therefore inhibition of HCA4 (Accession XM_085287). Accordingly, utilities of VGAM964 include diagnosis, prevention and treatment of diseases and clinical conditions associated with HCA4. KIAA0157 (Accession NM_032182) is another VGAM964 host target gene. KIAA0157 BINDING SITE is HOST TARGET binding site found in the 3' untranslated region of mRNA encoded by KIAA0157, corresponding to a HOST TARGET binding site such as BINDING SITE I, BINDING SITE II or BINDING SITE III. Table 2 illustrates the complementarity of the nucleotide sequences of KIAA0157 BINDING SITE, designated SEQ ID:25899, to the nucleotide sequence of VGAM964 RNA, herein designated VGAM RNA, also designated SEQ ID:3675.

Another function of VGAM964 is therefore inhibition of KIAA0157 (Accession NM_032182). Accordingly, utilities of VGAM964 include diagnosis, prevention and treatment of diseases and clinical conditions associated with KIAA0157. KIAA0310 (Accession XM_088459) is another VGAM964 host target gene. KIAA0310 BINDING SITE is HOST TARGET binding site found in the 3' untranslated region of mRNA encoded by KIAA0310, corresponding to a HOST TARGET binding site such as BINDING SITE I, BINDING SITE II or BINDING SITE III. Table 2 illustrates the complementarity of the nucleotide sequences of KIAA0310 BINDING SITE, designated SEQ ID:39710, to the nucleotide sequence of VGAM964 RNA, herein designated VGAM RNA, also designated SEQ ID:3675.

Another function of VGAM964 is therefore inhibition of KIAA0310 (Accession XM_088459). Accordingly, utilities of VGAM964 include diagnosis, prevention and treatment of diseases and clinical conditions associated with KIAA0310. KIAA0884 (Accession XM_046660) is another VGAM964 host target gene. KIAA0884 BINDING SITE is HOST TARGET binding site found in the 3' untranslated region of mRNA encoded by KIAA0884, corresponding to a HOST TARGET binding site such as BINDING SITE I, BINDING SITE II or BINDING SITE III. Table 2 illustrates the complementarity of the nucleotide sequences of KIAA0884 BINDING SITE, designated SEQ ID:34772, to the nucleotide sequence of VGAM964 RNA, herein designated VGAM RNA, also designated SEQ ID:3675.

Another function of VGAM964 is therefore inhibition of KIAA0884 (Accession XM_046660). Accordingly, utilities of VGAM964 include diagnosis, prevention and treatment of diseases and clinical conditions associated with KIAA0884. KIAA1077 (Accession XM_053496) is another VGAM964 host target gene. KIAA1077 BINDING SITE is HOST TARGET binding site found in the 5' untranslated region of mRNA encoded by KIAA1077, corresponding to a HOST TARGET binding site such as BINDING SITE I, BINDING SITE II or BINDING SITE III. Table 2 illustrates the complementarity of the nucleotide sequences of KIAA1077 BINDING SITE, designated SEQ ID:36095, to the nucleotide sequence of VGAM964 RNA, herein designated VGAM RNA, also designated SEQ ID:3675.

Another function of VGAM964 is therefore inhibition of KIAA1077 (Accession XM_053496). Accordingly, utilities of VGAM964 include diagnosis, prevention and treatment of diseases and clinical conditions associated with KIAA1077. KIAA1948 (Accession XM_091984) is another VGAM964 host target gene. KIAA1948 BINDING SITE is HOST TARGET binding site found in the 5' untranslated region of mRNA encoded by KIAA1948, corresponding to a HOST TARGET binding site such as BINDING SITE I, BINDING SITE II or BINDING SITE III. Table 2 illustrates the complementarity of the nucleotide sequences of KIAA1948 BINDING SITE, designated SEQ ID:40076, to the nucleotide sequence of VGAM964 RNA, herein designated VGAM RNA, also designated SEQ ID:3675.

Another function of VGAM964 is therefore inhibition of KIAA1948 (Accession XM_091984). Accordingly, utilities of VGAM964 include diagnosis, prevention and treatment of diseases and clinical conditions associated with KIAA1948. LOC151556 (Accession XM_087239) is another VGAM964 host target gene. LOC151556 BINDING SITE is HOST TARGET binding site found in the 5' untranslated region of mRNA encoded by LOC151556, corresponding to a HOST TARGET binding site such as BINDING SITE I, BINDING SITE II or BINDING SITE III. Table 2 illustrates the complementarity of the nucleotide sequences of LOC151556 BINDING SITE, designated SEQ ID:39133, to the nucleotide sequence of VGAM964 RNA, herein designated VGAM RNA, also designated SEQ ID:3675.

Another function of VGAM964 is therefore inhibition of LOC151556 (Accession XM_087239). Accordingly, utilities of VGAM964 include diagnosis, prevention and treatment of diseases and clinical conditions associated with LOC151556. LOC256946 (Accession XM_170543) is another VGAM964 host target gene. LOC256946 BINDING SITE is HOST TARGET binding site found in the 3' untranslated region of mRNA encoded by LOC256946, corresponding to a HOST TARGET binding site such as BINDING SITE I, BINDING SITE II or BINDING SITE III. Table 2 illustrates the complementarity of the nucleotide sequences of LOC256946 BINDING SITE, designated SEQ ID:45359, to the nucleotide sequence of VGAM964 RNA, herein designated VGAM RNA, also designated SEQ ID:3675.

Another function of VGAM964 is therefore inhibition of LOC256946 (Accession XM_170543). Accordingly, utilities of VGAM964 include diagnosis, prevention and treatment of diseases and clinical conditions associated with LOC256946. FIG. 1 further provides a conceptual description of a novel bioinformatically detected viral gene of the present invention, referred to here as Viral Genomic Address Messenger 965 (VGAM965) viral gene, which modulates expression of respective host target genes thereof, the function and utility of which host target genes is known in the art.

VGAM965 is a novel bioinformatically detected regulatory, non protein coding, viral micro RNA (miRNA) gene. The method by which VGAM965 was detected is described hereinabove with reference to FIGS. 1-8.

VGAM965 gene, herein designated VGAM GENE, is a viral gene contained in the genome of Meleagrid Herpesvirus 1. VGAM965 host target gene, herein designated VGAM HOST TARGET GENE, is a human gene contained in the human genome.

VGAM965 gene encodes a VGAM965 precursor RNA, herein designated VGAM PRECURSOR RNA. Similar to other miRNA genes, and unlike most ordinary genes, VGAM965 precursor RNA does not encode a protein. A nucleotide sequence identical or highly similar to the nucleotide sequence of VGAM965 precursor RNA is designated SEQ ID:951, and is provided hereinbelow with reference to the sequence listing part. Nucleotide sequence SEQ ID:951 is located at position 23173 relative to the genome of Meleagrid Herpesvirus 1.

VGAM965 precursor RNA folds onto itself, forming VGAM965 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM965 folded precursor RNA into VGAM965 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM965 RNA is designated SEQ ID:3676, and is provided hereinbelow with reference to the sequence listing part.

VGAM965 host target gene, herein designated VGAM HOST TARGET GENE, encodes a corresponding messenger RNA, VGAM965 host target RNA, herein designated VGAM HOST TARGET RNA. VGAM965 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM965 RNA, herein designated VGAM RNA, binds complementarily to one or more host target binding sites located in untranslated regions of VGAM965 host target RNA, herein designated VGAM HOST TARGET RNA. This complementary binding is due to the fact that the nucleotide sequence of VGAM965 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM965 RNA, herein designated VGAM RNA, may have a different number of host target binding sites in untranslated regions of a VGAM965 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM965 RNA, herein designated VGAM RNA, to host target binding sites on VGAM965 host target RNA, herein designated VGAM HOST TARGET RNA, such as BINDING SITE I, BINDING SITE II and BINDING SITE III, inhibits translation of VGAM965 host target RNA into VGAM965 host target protein, herein designated VGAM HOST TARGET PROTEIN. VGAM host target protein is therefore outlined by a broken line.

It is appreciated that VGAM965 host target gene, herein designated VGAM HOST TARGET GENE, in fact represents a plurality of VGAM965 host target genes. The mRNA of each one of this plurality of VGAM965 host target genes comprises one or more host target binding sites, each having a nucleotide sequence which is at least partly complementary to VGAM965 RNA, herein designated VGAM RNA, and which when bound by VGAM965 RNA causes inhibition of translation of respective one or more VGAM965 host target proteins.

It is further appreciated by one skilled in the art that the mode of translational inhibition illustrated by FIG. 1 with specific reference to translational inhibition exerted by VGAM965 gene, herein designated VGAM GENE, on one or more VGAM965 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM965 is inhibition of expression of host target genes, as part of a novel viral mechanism of attacking a host. Accordingly, utilities of VGAM965 include diagnosis, prevention and treatment of viral infection by Meleagrid Herpesvirus 1. Specific functions, and accordingly utilities, of VGAM965 correlate with, and may be deduced from, the identity of the host target genes which VGAM965 binds and inhibits, and the function of these host target genes, as elaborated hereinbelow.

Nucleotide sequences of the VGAM965 precursor RNA, herein designated VGAM PRECURSOR RNA, and of the 'diced' VGAM965 RNA, herein designated VGAM RNA, and a schematic representation of the secondary folding of VGAM965 folded precursor RNA, herein designated VGAM FOLDED PRECURSOR RNA, of VGAM965 are further described hereinbelow with reference to Table 1.

Nucleotide sequences of host target binding sites, such as BINDING SITE-I, BINDING SITE-II and BINDING SITE-III of FIG. 1, found on VGAM965 host target RNA, and schematic representation of the complementarity of each of these host target binding sites to VGAM965 RNA, herein designated VGAM RNA, are described hereinbelow with reference to Table 2.

As mentioned hereinabove with reference to FIG. 1, a function of VGAM965 gene, herein designated VGAM is inhibition of expression of VGAM965 target genes. It is appreciated that specific functions, and accordingly utilities, of VGAM965 correlate with, and may be deduced from, the identity of the target genes which VGAM965 binds and inhibits, and the function of these target genes, as elaborated hereinbelow.

Holocarboxylase Synthetase (biotin-[proprionyl-Coenzyme A-carboxylase (ATP-hydrolysing)] Ligase) (HLCS, Accession NM_000411) is a VGAM965 host target gene. HLCS BINDING SITE is HOST TARGET binding site found in the 3' untranslated region of mRNA encoded by HLCS, corresponding to a HOST TARGET binding site such as BINDING SITE I, BINDING SITE II or BINDING SITE III. Table 2 illustrates the complementarity of the nucleotide sequences of HLCS BINDING SITE, designated SEQ ID:5990, to the nucleotide sequence of VGAM965 RNA, herein designated VGAM RNA, also designated SEQ ID:3676.

A function of VGAM965 is therefore inhibition of Holocarboxylase Synthetase (biotin-[proprionyl-Coenzyme A-carboxylase (ATP-hydrolysing)] Ligase) (HLCS, Accession NM_000411). Accordingly, utilities of VGAM965 include diagnosis, prevention and treatment of diseases and clinical conditions associated with HLCS. Chromosome 13 Open Reading Frame 1 (C13orf1, Accession NM_020456) is another VGAM965 host target gene. C13orf1 BINDING SITE is HOST TARGET binding site found in the 3' untranslated region of mRNA encoded by C13orf1, corresponding to a HOST TARGET binding site such as BINDING SITE I, BINDING SITE II or BINDING SITE III. Table 2 illustrates the complementarity of the nucleotide sequences of C13orf1 BINDING SITE, designated SEQ ID:21688, to the nucleotide sequence of VGAM965 RNA, herein designated VGAM RNA, also designated SEQ ID:3676.

Another function of VGAM965 is therefore inhibition of Chromosome 13 Open Reading Frame 1 (C13orf1, Accession NM_020456). Accordingly, utilities of VGAM965 include diagnosis, prevention and treatment of diseases and clinical conditions associated with C13orf1. DKFZp761B1514 (Accession NM_032288) is another VGAM965 host target gene. DKFZp761B1514 BINDING SITE is HOST TARGET binding site found in the 3' untranslated region of mRNA encoded by DKFZp761B1514, corresponding to a HOST TARGET binding site such as BINDING SITE I, BINDING SITE II or BINDING SITE III. Table 2 illustrates the complementarity of the nucleotide sequences of DKFZp761B1514 BINDING SITE, designated SEQ ID:26045, to the nucleotide sequence of VGAM965 RNA, herein designated VGAM RNA, also designated SEQ ID:3676.

Another function of VGAM965 is therefore inhibition of DKFZp761B1514 (Accession NM_032288). Accordingly, utilities of VGAM965 include diagnosis, prevention and treatment of diseases and clinical conditions associated with DKFZp761B1514. FIG. 1 further provides a conceptual description of a novel bioinformatically detected viral gene of the present invention, referred to here as Viral Genomic Address Messenger 966 (VGAM966) viral gene, which modulates expression of respective host target genes thereof, the function and utility of which host target genes is known in the art.

VGAM966 is a novel bioinformatically detected regulatory, non protein coding, viral micro RNA (miRNA) gene. The method by which VGAM966 was detected is described hereinabove with reference to FIGS. 1-8.

VGAM966 gene, herein designated VGAM GENE, is a viral gene contained in the genome of Meleagrid Herpesvirus 1. VGAM966 host target gene, herein designated VGAM HOST TARGET GENE, is a human gene contained in the human genome.

VGAM966 gene encodes a VGAM966 precursor RNA, herein designated VGAM PRECURSOR RNA. Similar to other miRNA genes, and unlike most ordinary genes, VGAM966 precursor RNA does not encode a protein. A nucleotide sequence identical or highly similar to the nucleotide sequence of VGAM966 precursor RNA is designated SEQ ID:952, and is provided hereinbelow with reference to the sequence listing part. Nucleotide sequence SEQ ID:952 is located at position 21558 relative to the genome of Meleagrid Herpesvirus 1.

VGAM966 precursor RNA folds onto itself, forming VGAM966 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM966 folded precursor RNA into VGAM966 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM966 RNA is designated SEQ ID:3677, and is provided hereinbelow with reference to the sequence listing part.

VGAM966 host target gene, herein designated VGAM HOST TARGET GENE, encodes a corresponding messenger RNA, VGAM966 host target RNA, herein designated VGAM HOST TARGET RNA. VGAM966 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM966 RNA, herein designated VGAM RNA, binds complementarily to one or more host target binding sites located in untranslated regions of VGAM966 host target RNA, herein designated VGAM HOST TARGET RNA. This complementary binding is due to the fact that the nucleotide sequence of VGAM966 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM966 RNA, herein designated VGAM RNA, may have a different number of host target binding sites in untranslated regions of a VGAM966 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM966 RNA, herein designated VGAM RNA, to host target binding sites on VGAM966 host target RNA, herein designated VGAM HOST TARGET RNA, such as BINDING SITE I, BINDING SITE II and BINDING SITE III, inhibits translation of VGAM966 host target RNA into VGAM966 host target protein, herein designated VGAM HOST TARGET PROTEIN. VGAM host target protein is therefore outlined by a broken line.

It is appreciated that VGAM966 host target gene, herein designated VGAM HOST TARGET GENE, in fact represents a plurality of VGAM966 host target genes. The mRNA of each one of this plurality of VGAM966 host target genes comprises one or more host target binding sites, each having a nucleotide sequence which is at least partly complementary to VGAM966 RNA, herein designated VGAM RNA, and which when bound by VGAM966 RNA causes inhibition of translation of respective one or more VGAM966 host target proteins.

It is further appreciated by one skilled in the art that the mode of translational inhibition illustrated by FIG. 1 with specific reference to translational inhibition exerted by VGAM966 gene, herein designated VGAM GENE, on one or more VGAM966 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM966 is inhibition of expression of host target genes, as part of a novel viral mechanism of attacking a host. Accordingly, utilities of VGAM966 include diagnosis, prevention and treatment of viral infection by Meleagrid Herpesvirus 1. Specific functions, and accordingly utilities, of VGAM966 correlate with, and may be deduced from, the identity of the host target genes which VGAM966 binds and inhibits, and the function of these host target genes, as elaborated hereinbelow.

Nucleotide sequences of the VGAM966 precursor RNA, herein designated VGAM PRECURSOR RNA, and of the 'diced' VGAM966 RNA, herein designated VGAM RNA, and a schematic representation of the secondary folding of VGAM966 folded precursor RNA, herein designated VGAM FOLDED PRECURSOR RNA, of VGAM966 are further described hereinbelow with reference to Table 1.

Nucleotide sequences of host target binding sites, such as BINDING SITE-I, BINDING SITE-II and BINDING SITE-III of FIG. 1, found on VGAM966 host target RNA, and schematic representation of the complementarity of each of these host target binding sites to VGAM966 RNA, herein designated VGAM RNA, are described hereinbelow with reference to Table 2.

As mentioned hereinabove with reference to FIG. 1, a function of VGAM966 gene, herein designated VGAM is inhibition of expression of VGAM966 target genes. It is appreciated that specific functions, and accordingly utilities, of VGAM966 correlate with, and may be deduced from, the identity of the target genes which VGAM966 binds and inhibits, and the function of these target genes, as elaborated hereinbelow.

Erythrocyte Membrane Protein Band 4.1-like 2 (EPB41L2, Accession NM_001431) is a VGAM966 host target gene. EPB41L2 BINDING SITE is HOST TARGET binding site found in the 3' untranslated region of mRNA encoded by EPB41L2, corresponding to a HOST TARGET binding site such as BINDING SITE I, BINDING SITE II or BINDING SITE III. Table 2 illustrates the complementarity of the nucleotide sequences of EPB41L2 BINDING SITE, designated SEQ ID:7154, to the nucleotide sequence of VGAM966 RNA, herein designated VGAM RNA, also designated SEQ ID:3677.

A function of VGAM966 is therefore inhibition of Erythrocyte Membrane Protein Band 4.1-like 2 (EPB41L2, Accession NM_001431). Accordingly, utilities of VGAM966 include diagnosis, prevention and treatment of diseases and clinical conditions associated with EPB41L2. Retinal Degeneration, Slow (retinitis pigmentosa 7) (RDS, Accession NM_000322) is another VGAM966 host target gene. RDS BINDING SITE is HOST TARGET binding site found in the 3' untranslated region of mRNA encoded by RDS, corresponding to a HOST TARGET binding site such as BINDING SITE I, BINDING SITE II or BINDING SITE III. Table 2 illustrates the complementarity of the nucleotide sequences of RDS BINDING SITE, designated SEQ ID:5863, to the nucleotide sequence of VGAM966 RNA, herein designated VGAM RNA, also designated SEQ ID:3677.

Another function of VGAM966 is therefore inhibition of Retinal Degeneration, Slow (retinitis pigmentosa 7) (RDS, Accession NM_000322), a gene which may function as an adhesion molecule involved in stabilization and compaction of outer segment disks or in the maintenance of the curvature of the rim. Accordingly, utilities of VGAM966 include diagnosis, prevention and treatment of diseases and clinical conditions associated with RDS. The function of RDS and its association with various diseases and clinical conditions, has been established by previous studies, as described hereinabove with reference to VGAM341. KIAA1946 (Accession XM_092459) is another VGAM966 host target gene. KIAA1946 BINDING SITE is HOST TARGET binding site found in the 3' untranslated region of mRNA encoded by KIAA1946, corresponding to a HOST TARGET binding site such as BINDING SITE I, BINDING SITE II or BINDING SITE III. Table 2 illustrates the complementarity of the nucleotide sequences of KIAA1946 BINDING SITE, designated SEQ ID:40118, to the nucleotide sequence of VGAM966 RNA, herein designated VGAM RNA, also designated SEQ ID:3677.

Another function of VGAM966 is therefore inhibition of KIAA1946 (Accession XM_092459). Accordingly, utilities of VGAM966 include diagnosis, prevention and treatment of diseases and clinical conditions associated with KIAA1946. MGC3130 (Accession NM_024032) is another VGAM966 host target gene. MGC3130 BINDING SITE is HOST TARGET binding site found in the 3' untranslated region of mRNA encoded by MGC3130, corresponding to a HOST TARGET binding site such as BINDING SITE I, BINDING SITE II or BINDING SITE III. Table 2 illustrates the complementarity of the nucleotide sequences of MGC3130 BINDING SITE, designated SEQ ID:23460, to the nucleotide sequence of VGAM966 RNA, herein designated VGAM RNA, also designated SEQ ID:3677.

Another function of VGAM966 is therefore inhibition of MGC3130 (Accession NM_024032). Accordingly, utilities of VGAM966 include diagnosis, prevention and treatment of diseases and clinical conditions associated with MGC3130. MGC4415 (Accession NM_031484) is another VGAM966 host target gene. MGC4415 BINDING SITE is HOST TARGET binding site found in the 3' untranslated region of mRNA encoded by MGC4415, corresponding to a HOST TARGET binding site such as BINDING SITE I, BINDING SITE II or BINDING SITE III. Table 2 illustrates the complementarity of the nucleotide sequences of MGC4415 BINDING SITE, designated SEQ ID:25566, to the nucleotide sequence of VGAM966 RNA, herein designated VGAM RNA, also designated SEQ ID:3677.

Another function of VGAM966 is therefore inhibition of MGC4415 (Accession NM_031484). Accordingly, utilities of VGAM966 include diagnosis, prevention and treatment of diseases and clinical conditions associated with MGC4415. PRO0611 (Accession NM_014076) is another VGAM966 host target gene. PRO0611 BINDING SITE is HOST TARGET binding site found in the 3' untranslated region of mRNA encoded by PRO0611, corresponding to a HOST TARGET binding site such as BINDING SITE I, BINDING SITE II or BINDING SITE III. Table 2 illustrates the complementarity of the nucleotide sequences of PRO0611 BINDING SITE, designated SEQ ID:15304, to the nucleotide sequence of VGAM966 RNA, herein designated VGAM RNA, also designated SEQ ID:3677.

Another function of VGAM966 is therefore inhibition of PRO0611 (Accession NM_014076). Accordingly, utilities of VGAM966 include diagnosis, prevention and treatment of diseases and clinical conditions associated with PRO0611. LOC63929 (Accession NM_022098) is another VGAM966 host target gene. LOC63929 BINDING SITE is HOST TARGET binding site found in the 3' untranslated region of mRNA encoded by LOC63929, corresponding to a HOST TARGET binding site such as BINDING SITE I, BINDING SITE II or BINDING SITE III. Table 2 illustrates the complementarity of the nucleotide sequences of LOC63929 BINDING SITE, designated SEQ ID:22639, to the nucleotide sequence of VGAM966 RNA, herein designated VGAM RNA, also designated SEQ ID:3677.

Another function of VGAM966 is therefore inhibition of LOC63929 (Accession NM_022098). Accordingly, utilities of VGAM966 include diagnosis, prevention and treatment of diseases and clinical conditions associated with LOC63929. FIG. 1 further provides a conceptual description of a novel bioinformatically detected viral gene of the present invention, referred to here as Viral Genomic Address Messenger 967 (VGAM967) viral gene, which modulates expression of respective host target genes thereof, the function and utility of which host target genes is known in the art.

VGAM967 is a novel bioinformatically detected regulatory, non protein coding, viral micro RNA (miRNA) gene. The method by which VGAM967 was detected is described hereinabove with reference to FIGS. 1-8.

VGAM967 gene, herein designated VGAM GENE, is a viral gene contained in the genome of Sheeppox Virus. VGAM967 host target gene, herein designated VGAM HOST TARGET GENE, is a human gene contained in the human genome.

VGAM967 gene encodes a VGAM967 precursor RNA, herein designated VGAM PRECURSOR RNA. Similar to other miRNA genes, and unlike most ordinary genes, VGAM967 precursor RNA does not encode a protein. A nucleotide sequence identical or highly similar to the nucleotide sequence of VGAM967 precursor RNA is designated SEQ ID:953, and is provided hereinbelow with reference to the sequence listing part. Nucleotide sequence SEQ ID:953 is located at position 26912 relative to the genome of Sheeppox Virus.

VGAM967 precursor RNA folds onto itself, forming VGAM967 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM967 folded precursor RNA into VGAM967 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM967 RNA is designated SEQ ID:3678, and is provided hereinbelow with reference to the sequence listing part.

VGAM967 host target gene, herein designated VGAM HOST TARGET GENE, encodes a corresponding messenger RNA, VGAM967 host target RNA, herein designated VGAM HOST TARGET RNA. VGAM967 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM967 RNA, herein designated VGAM RNA, binds complementarily to one or more host target binding sites located in untranslated regions of VGAM967 host target RNA, herein designated VGAM HOST TARGET RNA. This complementary binding is due to the fact that the nucleotide sequence of VGAM967 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM967 RNA, herein designated VGAM RNA, may have a different number of host target binding sites in untranslated regions of a VGAM967 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM967 RNA, herein designated VGAM RNA, to host target binding sites on VGAM967 host target RNA, herein designated VGAM HOST TARGET RNA, such as BINDING SITE I, BINDING SITE II and BINDING SITE III, inhibits translation of VGAM967 host target RNA into VGAM967 host target protein, herein designated VGAM HOST TARGET PROTEIN. VGAM host target protein is therefore outlined by a broken line.

It is appreciated that VGAM967 host target gene, herein designated VGAM HOST TARGET GENE, in fact represents a plurality of VGAM967 host target genes. The mRNA of each one of this plurality of VGAM967 host target genes comprises one or more host target binding sites, each having a nucleotide sequence which is at least partly complementary to VGAM967 RNA, herein designated VGAM RNA, and which when bound by VGAM967 RNA causes inhibition of translation of respective one or more VGAM967 host target proteins.

It is further appreciated by one skilled in the art that the mode of translational inhibition illustrated by FIG. 1 with specific reference to translational inhibition exerted by VGAM967 gene, herein designated VGAM GENE, on one or more VGAM967 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM967 is inhibition of expression of host target genes, as part of a novel viral mechanism of attacking a host. Accordingly, utilities of VGAM967 include diagnosis, prevention and treatment of viral infection by Sheeppox Virus. Specific functions, and accordingly utilities, of VGAM967 correlate with, and may be deduced from, the identity of the host target genes which VGAM967 binds and inhibits, and the function of these host target genes, as elaborated hereinbelow.

Nucleotide sequences of the VGAM967 precursor RNA, herein designated VGAM PRECURSOR RNA, and of the 'diced' VGAM967 RNA, herein designated VGAM RNA, and a schematic representation of the secondary folding of VGAM967 folded precursor RNA, herein designated VGAM FOLDED PRECURSOR RNA, of VGAM967 are further described hereinbelow with reference to Table 1.

Nucleotide sequences of host target binding sites, such as BINDING SITE-I, BINDING SITE-II and BINDING SITE-III of FIG. 1, found on VGAM967 host target RNA, and schematic representation of the complementarity of each of these host target binding sites to VGAM967 RNA, herein designated VGAM RNA, are described hereinbelow with reference to Table 2.

As mentioned hereinabove with reference to FIG. 1, a function of VGAM967 gene, herein designated VGAM is inhibition of expression of VGAM967 target genes. It is appreciated that specific functions, and accordingly utilities, of VGAM967 correlate with, and may be deduced from, the identity of the target genes which VGAM967 binds and inhibits, and the function of these target genes, as elaborated hereinbelow.

LOC161589 (Accession XM_090991) is a VGAM967 host target gene. LOC161589 BINDING SITE is HOST TARGET binding site found in the 5' untranslated region of mRNA encoded by LOC161589, corresponding to a HOST TARGET binding site such as BINDING SITE I, BINDING SITE II or BINDING SITE III. Table 2 illustrates the complementarity of the nucleotide sequences of LOC161589 BINDING SITE, designated SEQ ID:40023, to the nucleotide sequence of VGAM967 RNA, herein designated VGAM RNA, also designated SEQ ID:3678.

A function of VGAM967 is therefore inhibition of LOC161589 (Accession XM_090991). Accordingly, utilities of VGAM967 include diagnosis, prevention and treatment of diseases and clinical conditions associated with LOC161589. LOC202108 (Accession XM_114442) is another VGAM967 host target gene. LOC202108 BINDING SITE is HOST TARGET binding site found in the 5' untranslated region of mRNA encoded by LOC202108, corresponding to a HOST TARGET binding site such as BINDING SITE I, BINDING SITE II or BINDING SITE III. Table 2 illustrates the complementarity of the nucleotide sequences of LOC202108 BINDING SITE, designated SEQ ID:42965, to the nucleotide sequence of VGAM967 RNA, herein designated VGAM RNA, also designated SEQ ID:3678.

Another function of VGAM967 is therefore inhibition of LOC202108 (Accession XM_114442). Accordingly, utilities of VGAM967 include diagnosis, prevention and treatment of diseases and clinical conditions associated with LOC202108. LOC202333 (Accession XM_114467) is another VGAM967 host target gene. LOC202333 BINDING SITE is HOST TARGET binding site found in the 3' untranslated region of mRNA encoded by LOC202333, corresponding to a HOST TARGET binding site such as BINDING SITE I, BINDING SITE II or BINDING SITE III. Table 2 illustrates the complementarity of the nucleotide sequences of LOC202333 BINDING SITE, designated SEQ ID:42970, to the nucleotide sequence of VGAM967 RNA, herein designated VGAM RNA, also designated SEQ ID:3678.

Another function of VGAM967 is therefore inhibition of LOC202333 (Accession XM_114467). Accordingly, utilities of VGAM967 include diagnosis, prevention and treatment of diseases and clinical conditions associated with LOC202333. LOC221838 (Accession XM_166521) is another VGAM967 host target gene. LOC221838 BINDING SITE is HOST TARGET binding site found in the 5' untranslated region of mRNA encoded by LOC221838, corresponding to a HOST TARGET binding site such as BINDING SITE I, BINDING SITE II or BINDING SITE III. Table 2 illustrates the complementarity of the nucleotide sequences of LOC221838 BINDING SITE, designated SEQ ID:44459, to the nucleotide sequence of VGAM967 RNA, herein designated VGAM RNA, also designated SEQ ID:3678.

Another function of VGAM967 is therefore inhibition of LOC221838 (Accession XM_166521). Accordingly, utilities of VGAM967 include diagnosis, prevention and treatment of diseases and clinical conditions associated with LOC221838. LOC221839 (Accession XM_166506) is another VGAM967 host target gene. LOC221839 BINDING SITE is HOST TARGET binding site found in the 5' untranslated region of mRNA encoded by LOC221839, corresponding to a HOST TARGET binding site such as BINDING SITE I, BINDING SITE II or BINDING SITE III. Table 2 illustrates the complementarity of the nucleotide sequences of LOC221839 BINDING SITE, designated SEQ ID:44430, to the nucleotide sequence of VGAM967 RNA, herein designated VGAM RNA, also designated SEQ ID:3678.

Another function of VGAM967 is therefore inhibition of LOC221839 (Accession XM_166506). Accordingly, utilities of VGAM967 include diagnosis, prevention and treatment of diseases and clinical conditions associated with LOC221839. FIG. 1 further provides a conceptual description of a novel bioinformatically detected viral gene of the present invention, referred to here as Viral Genomic Address Messenger 968 (VGAM968) viral gene, which modulates expression of respective host target genes thereof, the function and utility of which host target genes is known in the art.

VGAM968 is a novel bioinformatically detected regulatory, non protein coding, viral micro RNA (miRNA) gene. The method by which VGAM968 was detected is described hereinabove with reference to FIGS. 1-8.

VGAM968 gene, herein designated VGAM GENE, is a viral gene contained in the genome of Sheeppox Virus. VGAM968 host target gene, herein designated VGAM HOST TARGET GENE, is a human gene contained in the human genome.

VGAM968 gene encodes a VGAM968 precursor RNA, herein designated VGAM PRECURSOR RNA. Similar to other miRNA genes, and unlike most ordinary genes, VGAM968 precursor RNA does not encode a protein. A nucleotide sequence identical or highly similar to the nucleotide sequence of VGAM968 precursor RNA is designated SEQ ID:954, and is provided hereinbelow with reference to the sequence listing part. Nucleotide sequence SEQ ID:954 is located at position 24977 relative to the genome of Sheeppox Virus.

VGAM968 precursor RNA folds onto itself, forming VGAM968 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM968 folded precursor RNA into VGAM968 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM968 RNA is designated SEQ ID:3679, and is provided hereinbelow with reference to the sequence listing part.

VGAM968 host target gene, herein designated VGAM HOST TARGET GENE, encodes a corresponding messenger RNA, VGAM968 host target RNA, herein designated VGAM HOST TARGET RNA. VGAM968 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM968 RNA, herein designated VGAM RNA, binds complementarily to one or more host target binding sites located in untranslated regions of VGAM968 host target RNA, herein designated VGAM HOST TARGET RNA. This complementary binding is due to the fact that the nucleotide sequence of VGAM968 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM968 RNA, herein designated VGAM RNA, may have a different number of host target binding sites in untranslated regions of a VGAM968 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM968 RNA, herein designated VGAM RNA, to host target binding sites on VGAM968 host target RNA, herein designated VGAM HOST TARGET RNA, such as BINDING SITE I, BINDING SITE II and BINDING SITE III, inhibits translation of VGAM968 host target RNA into VGAM968 host target protein, herein designated VGAM HOST TARGET PROTEIN. VGAM host target protein is therefore outlined by a broken line.

It is appreciated that VGAM968 host target gene, herein designated VGAM HOST TARGET GENE, in fact represents a plurality of VGAM968 host target genes. The mRNA of each one of this plurality of VGAM968 host target genes comprises one or more host target binding sites, each having a nucleotide sequence which is at least partly complementary to VGAM968 RNA, herein designated VGAM RNA, and which when bound by VGAM968 RNA causes inhibition of translation of respective one or more VGAM968 host target proteins.

It is further appreciated by one skilled in the art that the mode of translational inhibition illustrated by FIG. 1 with specific reference to translational inhibition exerted by VGAM968 gene, herein designated VGAM GENE, on one or more VGAM968 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM968 is inhibition of expression of host target genes, as part of a novel viral mechanism of attacking a host. Accordingly, utilities of VGAM968 include diagnosis, prevention and treatment of viral infection by Sheeppox Virus. Specific functions, and accordingly utilities, of VGAM968 correlate with, and may be deduced from, the identity of the host target genes which VGAM968 binds and inhibits, and the function of these host target genes, as elaborated hereinbelow.

Nucleotide sequences of the VGAM968 precursor RNA, herein designated VGAM PRECURSOR RNA, and of the 'diced' VGAM968 RNA, herein designated VGAM RNA, and a schematic representation of the secondary folding of VGAM968 folded precursor RNA, herein designated VGAM FOLDED PRECURSOR RNA, of VGAM968 are further described hereinbelow with reference to Table 1.

Nucleotide sequences of host target binding sites, such as BINDING SITE-I, BINDING SITE-II and BINDING SITE-III of FIG. 1, found on VGAM968 host target RNA, and schematic representation of the complementarity of each of these host target binding sites to VGAM968 RNA, herein designated VGAM RNA, are described hereinbelow with reference to Table 2.

As mentioned hereinabove with reference to FIG. 1, a function of VGAM968 gene, herein designated VGAM is inhibition of expression of VGAM968 target genes. It is appreciated that specific functions, and accordingly utilities, of VGAM968 correlate with, and may be deduced from, the identity of the target genes which VGAM968 binds and inhibits, and the function of these target genes, as elaborated hereinbelow.

Mastermind-like 1 (Drosophila) (MAML1, Accession NM_014757) is a VGAM968 host target gene. MAML1 BINDING SITE is HOST TARGET binding site found in the 3' untranslated region of mRNA encoded by MAML1, corresponding to a HOST TARGET binding site such as BINDING SITE I, BINDING SITE II or BINDING SITE III. Table 2 illustrates the complementarity of the nucleotide sequences of MAML1 BINDING SITE, designated SEQ ID:16496, to the nucleotide sequence of VGAM968 RNA, herein designated VGAM RNA, also designated SEQ ID:3679.

A function of VGAM968 is therefore inhibition of Mastermind-like 1 (Drosophila) (MAML1, Accession NM_014757), a gene which MAML1 functions as a transcriptional coactivator for Notch signaling. Accordingly, utilities of VGAM968 include diagnosis, prevention and treatment of diseases and clinical conditions associated with MAML1. The function of MAML1 and its association with various diseases and clinical conditions, has been established by previous studies, as described hereinabove with reference to VGAM556. KIAA0628 (Accession NM_014789) is another VGAM968 host target gene. KIAA0628 BINDING SITE is HOST TARGET binding site found in the 3' untranslated region of mRNA encoded by KIAA0628, corresponding to a HOST TARGET binding site such as BINDING SITE I, BINDING SITE II or BINDING SITE III. Table 2 illustrates the complementarity of the nucleotide sequences of KIAA0628 BINDING SITE, designated SEQ ID:16673, to the nucleotide sequence of VGAM968 RNA, herein designated VGAM RNA, also designated SEQ ID:3679.

Another function of VGAM968 is therefore inhibition of KIAA0628 (Accession NM_014789). Accordingly, utilities of VGAM968 include diagnosis, prevention and treatment of diseases and clinical conditions associated with KIAA0628. KIAA1281 (Accession XM_114432) is another VGAM968 host target gene. KIAA1281 BINDING SITE is HOST TARGET binding site found in the 3' untranslated region of mRNA encoded by KIAA1281, corresponding to a HOST TARGET binding site such as BINDING SITE I, BINDING SITE II or BINDING SITE III. Table 2 illustrates the complementarity of the nucleotide sequences of KIAA1281 BINDING SITE, designated SEQ ID:42963, to the nucleotide sequence of VGAM968 RNA, herein designated VGAM RNA, also designated SEQ ID:3679.

Another function of VGAM968 is therefore inhibition of KIAA1281 (Accession XM_114432). Accordingly, utilities of VGAM968 include diagnosis, prevention and treatment of diseases and clinical conditions associated with KIAA1281. MIG (Accession NM_002416) is another VGAM968 host target gene. MIG BINDING SITE is HOST TARGET binding site found in the 3" untranslated region of mRNA encoded by MIG, corresponding to a HOST TARGET binding site such as BINDING SITE I, BINDING SITE II or BINDING SITE III. Table 2 illustrates the complementarity of the nucleotide sequences of MIG BINDING SITE, designated SEQ ID:8245, to the nucleotide sequence of VGAM968 RNA, herein designated VGAM RNA, also designated SEQ ID:3679.

Another function of VGAM968 is therefore inhibition of MIG (Accession NM_002416). Accordingly, utilities of VGAM968 include diagnosis, prevention and treatment of diseases and clinical conditions associated with MIG. LOC222865 (Accession XM_167242) is another VGAM968 host target gene. LOC222865 BINDING SITE is HOST TARGET binding site found in the 3' untranslated region of mRNA encoded by LOC222865, corresponding to a HOST TARGET binding site such as BINDING SITE I, BINDING SITE II or BINDING SITE III. Table 2 illustrates the complementarity of the nucleotide sequences of LOC222865 BINDING SITE, designated SEQ ID:44623, to the nucleotide sequence of VGAM968 RNA, herein designated VGAM RNA, also designated SEQ ID:3679.

Another function of VGAM968 is therefore inhibition of LOC222865 (Accession XM_167242). Accordingly, utilities of VGAM968 include diagnosis, prevention and treatment of diseases and clinical conditions associated with LOC222865. LOC92303 (Accession XM_044108) is another VGAM968 host target gene. LOC92303 BINDING SITE is HOST TARGET binding site found in the 3' untranslated region of mRNA encoded by LOC92303, corresponding to a HOST TARGET binding site such as BINDING SITE I, BINDING SITE II or BINDING SITE III. Table 2 illustrates the complementarity of the nucleotide sequences of LOC92303 BINDING SITE, designated SEQ ID:34134, to the nucleotide sequence of VGAM968 RNA, herein designated VGAM RNA, also designated SEQ ID:3679.

Another function of VGAM968 is therefore inhibition of LOC92303 (Accession XM_044108). Accordingly, utilities of VGAM968 include diagnosis, prevention and treatment of diseases and clinical conditions associated with LOC92303. FIG. 1 further provides a conceptual description of a novel bioinformatically detected viral gene of the present invention, referred to here as Viral Genomic Address Messenger 969 (VGAM969) viral gene, which modulates expression of respective host target genes thereof, the function and utility of which host target genes is known in the art.

VGAM969 is a novel bioinformatically detected regulatory, non protein coding, viral micro RNA (miRNA) gene. The method by which VGAM969 was detected is described hereinabove with reference to FIGS. 1-8.

VGAM969 gene, herein designated VGAM GENE, is a viral gene contained in the genome of Goatpox Virus. VGAM969 host target gene, herein designated VGAM HOST TARGET GENE, is a human gene contained in the human genome.

VGAM969 gene encodes a VGAM969 precursor RNA, herein designated VGAM PRECURSOR RNA. Similar to other miRNA genes, and unlike most ordinary genes, VGAM969 precursor RNA does not encode a protein. A nucleotide sequence identical or highly similar to the nucleotide sequence of VGAM969 precursor RNA is designated SEQ ID:955, and is provided hereinbelow with reference to the sequence listing part. Nucleotide sequence SEQ ID:955 is located at position 25550 relative to the genome of Goatpox Virus.

VGAM969 precursor RNA folds onto itself, forming VGAM969 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM969 folded precursor RNA into VGAM969 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM969 RNA is designated SEQ ID:3680, and is provided hereinbelow with reference to the sequence listing part.

VGAM969 host target gene, herein designated VGAM HOST TARGET GENE, encodes a corresponding messenger RNA, VGAM969 host target RNA, herein designated VGAM HOST TARGET RNA. VGAM969 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM969 RNA, herein designated VGAM RNA, binds complementarily to one or more host target binding sites located in untranslated regions of VGAM969 host target RNA, herein designated VGAM HOST TARGET RNA. This complementary binding is due to the fact that the nucleotide sequence of VGAM969 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM969 RNA, herein designated VGAM RNA, may have a different number of host target binding sites in untranslated regions of a VGAM969 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM969 RNA, herein designated VGAM RNA, to host target binding sites on VGAM969 host target RNA, herein designated VGAM HOST TARGET RNA, such as BINDING SITE I, BINDING SITE II and BINDING SITE III, inhibits translation of VGAM969 host target RNA into VGAM969 host target protein, herein designated VGAM HOST TARGET PROTEIN. VGAM host target protein is therefore outlined by a broken line.

It is appreciated that VGAM969 host target gene, herein designated VGAM HOST TARGET GENE, in fact represents a plurality of VGAM969 host target genes. The mRNA of each one of this plurality of VGAM969 host target genes comprises one or more host target binding sites, each having a nucleotide sequence which is at least partly complementary to VGAM969 RNA, herein designated VGAM RNA, and which when bound by VGAM969 RNA causes inhibition of translation of respective one or more VGAM969 host target proteins.

It is further appreciated by one skilled in the art that the mode of translational inhibition illustrated by FIG. 1 with specific reference to translational inhibition exerted by VGAM969 gene, herein designated VGAM GENE, on one or more VGAM969 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM969 is inhibition of expression of host target genes, as part of a novel viral mechanism of attacking a host. Accordingly, utilities of VGAM969 include diagnosis, prevention and treatment of viral infection by Goatpox Virus. Specific functions, and accordingly utilities, of VGAM969 correlate with, and may be deduced from, the identity of the host target genes which VGAM969 binds and inhibits, and the function of these host target genes, as elaborated hereinbelow.

Nucleotide sequences of the VGAM969 precursor RNA, herein designated VGAM PRECURSOR RNA, and of the 'diced' VGAM969 RNA, herein designated VGAM RNA, and a schematic representation of the secondary folding of VGAM969 folded precursor RNA, herein designated VGAM FOLDED PRECURSOR RNA, of VGAM969 are further described hereinbelow with reference to Table 1.

Nucleotide sequences of host target binding sites, such as BINDING SITE-I, BINDING SITE-II and BINDING SITE-III of FIG. 1, found on VGAM969 host target RNA, and schematic representation of the complementarity of each of these host target binding sites to VGAM969 RNA, herein designated VGAM RNA, are described hereinbelow with reference to Table 2.

As mentioned hereinabove with reference to FIG. 1, a function of VGAM969 gene, herein designated VGAM is inhibition of expression of VGAM969 target genes. It is appreciated that specific functions, and accordingly utilities, of VGAM969 correlate with, and may be deduced from, the identity of the target genes which VGAM969 binds and inhibits, and the function of these target genes, as elaborated hereinbelow.

KIAA0534 (Accession XM_049349) is a VGAM969 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35375, to the nucleotide sequence of VGAM969 RNA, herein designated VGAM RNA, also designated SEQ ID:3680.

A function of VGAM969 is therefore inhibition of KIAA0534 (Accession XM_049349). Accordingly, utilities of VGAM969 include diagnosis, prevention and treatment of diseases and clinical conditions associated with KIAA0534.

KIAA1708 (Accession XM_040211) is another VGAM969 host target gene. KIAA1708 BINDING SITE is HOST TARGET binding site found in the 3' untranslated region of mRNA encoded by KIAA1708, corresponding to a HOST TARGET binding site such as BINDING SITE I, BINDING SITE II or BINDING SITE III. Table 2 illustrates the complementarity of the nucleotide sequences of KIAA1708 BINDING SITE, designated SEQ ID:33271, to the nucleotide sequence of VGAM969 RNA, herein designated VGAM RNA, also designated SEQ ID:3680.

Another function of VGAM969 is therefore inhibition of KIAA1708 (Accession XM_040211). Accordingly, utilities of VGAM969 include diagnosis, prevention and treatment of diseases and clinical conditions associated with KIAA1708.

LOC157464 (Accession XM_098758) is another VGAM969 host target gene. LOC157464 BINDING SITE is HOST TARGET binding site found in the 5' untranslated region of mRNA encoded by LOC157464, corresponding to a HOST TARGET binding site such as BINDING SITE I, BINDING SITE II or BINDING SITE III. Table 2 illustrates the complementarity of the nucleotide sequences of LOC157464 BINDING SITE, designated SEQ ID:41796, to the nucleotide sequence of VGAM969 RNA, herein designated VGAM RNA, also designated SEQ ID:3680.

Another function of VGAM969 is therefore inhibition of LOC157464 (Accession XM_098758). Accordingly, utilities of VGAM969 include diagnosis, prevention and treatment of diseases and clinical conditions associated with LOC157464. FIG. 1 further provides a conceptual description of a novel bioinformatically detected viral gene of the present invention, referred to here as Viral Genomic Address Messenger 970 (VGAM970) viral gene, which modulates expression of respective host target genes thereof, the function and utility of which host target genes is known in the art.

VGAM970 is a novel bioinformatically detected regulatory, non protein coding, viral micro RNA (miRNA) gene. The method by which VGAM970 was detected is described hereinabove with reference to FIGS. 1-8.

VGAM970 gene, herein designated VGAM GENE, is a viral gene contained in the genome of Sheeppox Virus. VGAM970 host target gene, herein designated VGAM HOST TARGET GENE, is a human gene contained in the human genome.

VGAM970 gene encodes a VGAM970 precursor RNA, herein designated VGAM PRECURSOR RNA. Similar to other miRNA genes, and unlike most ordinary genes, VGAM970 precursor RNA does not encode a protein. A nucleotide sequence identical or highly similar to the nucleotide sequence of VGAM970 precursor RNA is designated SEQ ID:956, and is provided hereinbelow with reference to the sequence listing part. Nucleotide sequence SEQ ID:956 is located at position 23426 relative to the genome of Sheeppox Virus.

VGAM970 precursor RNA folds onto itself, forming VGAM970 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM970 folded precursor RNA into VGAM970 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM970 RNA is designated SEQ ID:3681, and is provided hereinbelow with reference to the sequence listing part.

VGAM970 host target gene, herein designated VGAM HOST TARGET GENE, encodes a corresponding messenger RNA, VGAM970 host target RNA, herein designated VGAM HOST TARGET RNA. VGAM970 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM970 RNA, herein designated VGAM RNA, binds complementarily to one or more host target binding sites located in untranslated regions of VGAM970 host target RNA, herein designated VGAM HOST TARGET RNA. This complementary binding is due to the fact that the nucleotide sequence of VGAM970 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM970 RNA, herein designated VGAM RNA, may have a different number of host target binding sites in untranslated regions of a VGAM970 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM970 RNA, herein designated VGAM RNA, to host target binding sites on VGAM970 host target RNA, herein designated VGAM HOST TARGET RNA, such as BINDING SITE I, BINDING SITE II and BINDING SITE III, inhibits translation of VGAM970 host target RNA into VGAM970 host target protein, herein designated VGAM HOST TARGET PROTEIN. VGAM host target protein is therefore outlined by a broken line.

It is appreciated that VGAM970 host target gene, herein designated VGAM HOST TARGET GENE, in fact represents a plurality of VGAM970 host target genes. The mRNA of each one of this plurality of VGAM970 host target genes comprises one or more host target binding sites, each having a nucleotide sequence which is at least partly complementary to VGAM970 RNA, herein designated VGAM RNA, and which when bound by VGAM970 RNA causes inhibition of translation of respective one or more VGAM970 host target proteins.

It is further appreciated by one skilled in the art that the mode of translational inhibition illustrated by FIG. 1 with specific reference to translational inhibition exerted by VGAM970 gene, herein designated VGAM GENE, on one or more VGAM970 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM970 is inhibition of expression of host target genes, as part of a novel viral mechanism of attacking a host. Accordingly, utilities of VGAM970 include diagnosis, prevention and treatment of viral infection by Sheeppox Virus. Specific functions, and accordingly utilities, of VGAM970 correlate with, and may be deduced from, the identity of the host target genes which VGAM970 binds and inhibits, and the function of these host target genes, as elaborated hereinbelow.

Nucleotide sequences of the VGAM970 precursor RNA, herein designated VGAM PRECURSOR RNA, and of the 'diced' VGAM970 RNA, herein designated VGAM RNA, and a schematic representation of the secondary folding of VGAM970 folded precursor RNA, herein designated VGAM FOLDED PRECURSOR RNA, of VGAM970 are further described hereinbelow with reference to Table 1.

Nucleotide sequences of host target binding sites, such as BINDING SITE-I, BINDING SITE-II and BINDING SITE-III of FIG. 1, found on VGAM970 host target RNA, and schematic representation of the complementarity of each of these host target binding sites to VGAM970 RNA, herein designated VGAM RNA, are described hereinbelow with reference to Table 2.

As mentioned hereinabove with reference to FIG. 1, a function of VGAM970 gene, herein designated VGAM is inhibition of expression of VGAM970 target genes. It is appreciated that specific functions, and accordingly utilities, of VGAM970 correlate with, and may be deduced from, the identity of the target genes which VGAM970 binds and inhibits, and the function of these target genes, as elaborated hereinbelow.

B29 (Accession NM_031939) is a VGAM970 host target gene. B29 BINDING SITE is HOST TARGET binding site found in the 3' untranslated region of mRNA encoded by B29, corresponding to a HOST TARGET binding site such as BINDING SITE I, BINDING SITE II or BINDING SITE III. Table 2 illustrates the complementarity of the nucleotide sequences of B29 BINDING SITE, designated SEQ ID:25684, to the nucleotide sequence of VGAM970 RNA, herein designated VGAM RNA, also designated SEQ ID:3681.

A function of VGAM970 is therefore inhibition of B29 (Accession NM_031939). Accordingly, utilities of VGAM970 include diagnosis, prevention and treatment of diseases and clinical conditions associated with B29. CD2-associated Protein (CD2AP, Accession NM_012120) is another VGAM970 host target gene. CD2AP BINDING SITE is HOST TARGET binding site found in the 3' untranslated region of mRNA encoded by CD2AP, corresponding to a HOST TARGET binding site such as BINDING SITE I, BINDING SITE II or BINDING SITE III. Table 2 illustrates the complementarity of the nucleotide sequences of CD2AP BINDING SITE, designated SEQ ID:14431, to the nucleotide sequence of VGAM970 RNA, herein designated VGAM RNA, also designated SEQ ID:3681.

Another function of VGAM970 is therefore inhibition of CD2-associated Protein (CD2AP, Accession NM_012120), a gene which binds CAS ligand and may therefor involves in its growth regulatory pathway. Accordingly, utilities of VGAM970 include diagnosis, prevention and treatment of diseases and clinical conditions associated with CD2AP. The function of CD2AP and its association with various diseases and clinical conditions, has been established by previous studies, as described hereinabove with reference to VGAM95. Mdm4, Transformed 3T3 Cell Double Minute 4, P53 Binding Protein (mouse) (MDM4, Accession NM_002393) is another VGAM970 host target gene. MDM4 BINDING SITE is HOST TARGET binding site found in the 3' untranslated region of mRNA encoded by MDM4, corresponding to a HOST TARGET binding site such as BINDING SITE I, BINDING SITE II or BINDING SITE III. Table 2 illustrates the complementarity of the nucleotide sequences of MDM4 BINDING SITE, designated SEQ ID:8208, to the nucleotide sequence of VGAM970 RNA, herein designated VGAM RNA, also designated SEQ ID:3681.

Another function of VGAM970 is therefore inhibition of Mdm4, Transformed 3T3 Cell Double Minute 4, P53 Binding Protein (mouse) (MDM4, Accession NM_002393), a gene which Strongly similar to murine Mdm4; may interact with p53. Accordingly, utilities of VGAM970 include diagnosis, prevention and treatment of diseases and clinical conditions associated with MDM4. The function of MDM4 and its association with various diseases and clinical conditions, has been established by previous studies, as described hereinabove with reference to VGAM739. SERP1 (Accession NM_014445) is another VGAM970 host target gene. SERP1 BINDING SITE is HOST TARGET binding site found in the 3' untranslated region of mRNA encoded by SERP1, corresponding to a HOST TARGET binding site such as BINDING SITE I, BINDING SITE II or BINDING SITE III. Table 2 illustrates the complementarity of the nucleotide sequences of SERP1 BINDING SITE, designated SEQ ID:15795, to the nucleotide sequence of VGAM970 RNA, herein designated VGAM RNA, also designated SEQ ID:3681.

Another function of VGAM970 is therefore inhibition of SERP1 (Accession NM_014445). Accordingly, utilities of VGAM970 include diagnosis, prevention and treatment of diseases and clinical conditions associated with SERP1. SKI-like (SKIL, Accession NM_005414) is another VGAM970 host target gene. SKIL BINDING SITE is HOST TARGET binding site found in the 5' untranslated region of mRNA encoded by SKIL, corresponding to a HOST TARGET binding site such as BINDING SITE I, BINDING SITE II or BINDING SITE III. Table 2 illustrates the complementarity of the nucleotide sequences of SKIL BINDING SITE, designated SEQ ID:11885, to the nucleotide sequence of VGAM970 RNA, herein designated VGAM RNA, also designated SEQ ID:3681.

Another function of VGAM970 is therefore inhibition of SKI-like (SKIL, Accession NM_005414). Accordingly, utilities of VGAM970 include diagnosis, prevention and treatment of diseases and clinical conditions associated with SKIL. LOC149271 (Accession XM_086475) is another VGAM970 host target gene. LOC149271 BINDING SITE is HOST TARGET binding site found in the 3' untranslated region of mRNA encoded by LOC149271, corresponding to a HOST TARGET binding site such as BINDING SITE I, BINDING SITE II or BINDING SITE III. Table 2 illustrates the complementarity of the nucleotide sequences of LOC149271 BINDING SITE, designated SEQ ID:38676, to the nucleotide sequence of VGAM970 RNA, herein designated VGAM RNA, also designated SEQ ID:3681.

Another function of VGAM970 is therefore inhibition of LOC149271 (Accession XM_086475). Accordingly, utilities of VGAM970 include diagnosis, prevention and treatment of diseases and clinical conditions associated with LOC149271. FIG. 1 further provides a conceptual description of a novel bioinformatically detected viral gene of the present invention, referred to here as Viral Genomic Address Messenger 971 (VGAM971) viral gene, which modulates expression of respective host target genes thereof, the function and utility of which host target genes is known in the art.

VGAM971 is a novel bioinformatically detected regulatory, non protein coding, viral micro RNA (miRNA) gene. The method by which VGAM971 was detected is described hereinabove with reference to FIGS. 1-8.

VGAM971 gene, herein designated VGAM GENE, is a viral gene contained in the genome of Melanoplus Sanguinipes Entomopoxvirus. VGAM971 host target gene, herein designated VGAM HOST TARGET GENE, is a human gene contained in the human genome.

VGAM971 gene encodes a VGAM971 precursor RNA, herein designated VGAM PRECURSOR RNA. Similar to other miRNA genes, and unlike most ordinary genes, VGAM971 precursor RNA does not encode a protein. A nucleotide sequence identical or highly similar to the nucleotide sequence of VGAM971 precursor RNA is designated SEQ ID:957, and is provided hereinbelow with reference to the sequence listing part. Nucleotide sequence SEQ ID:957 is located at position 53540 relative to the genome of Melanoplus Sanguinipes Entomopoxvirus.

VGAM971 precursor RNA folds onto itself, forming VGAM971 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM971 folded precursor RNA into VGAM971 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM971 RNA is designated SEQ ID:3682, and is provided hereinbelow with reference to the sequence listing part.

VGAM971 host target gene, herein designated VGAM HOST TARGET GENE, encodes a corresponding messenger RNA, VGAM971 host target RNA, herein designated VGAM HOST TARGET RNA. VGAM971 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM971 RNA, herein designated VGAM RNA, binds complementarily to one or more host target binding sites located in untranslated regions of VGAM971 host target RNA, herein designated VGAM HOST TARGET RNA. This complementary binding is due to the fact that the nucleotide sequence of VGAM971 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM971 RNA, herein designated VGAM RNA, may have a different number of host target binding sites in untranslated regions of a VGAM971 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM971 RNA, herein designated VGAM RNA, to host target binding sites on VGAM971 host target RNA, herein designated VGAM HOST TARGET RNA, such as BINDING SITE I, BINDING SITE II and BINDING SITE III, inhibits translation of VGAM971 host target RNA into VGAM971 host target protein, herein designated VGAM HOST TARGET PROTEIN. VGAM host target protein is therefore outlined by a broken line.

It is appreciated that VGAM971 host target gene, herein designated VGAM HOST TARGET GENE, in fact represents a plurality of VGAM971 host target genes. The mRNA of each one of this plurality of VGAM971 host target genes comprises one or more host target binding sites, each having a nucleotide sequence which is at least partly complementary to VGAM971 RNA, herein designated VGAM RNA, and which when bound by VGAM971 RNA causes inhibition of translation of respective one or more VGAM971 host target proteins.

It is further appreciated by one skilled in the art that the mode of translational inhibition illustrated by FIG. 1 with specific reference to translational inhibition exerted by VGAM971 gene, herein designated VGAM GENE, on one or more VGAM971 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM971 is inhibition of expression of host target genes, as part of a novel viral mechanism of attacking a host. Accordingly, utilities of VGAM971 include diagnosis, prevention and treatment of viral infection by Melanoplus Sanguinipes Entomopoxvirus. Specific functions, and accordingly utilities, of VGAM971 correlate with, and may be deduced from, the identity of the host target genes which VGAM971 binds and inhibits, and the function of these host target genes, as elaborated hereinbelow.

Nucleotide sequences of the VGAM971 precursor RNA, herein designated VGAM PRECURSOR RNA, and of the 'diced' VGAM971 RNA, herein designated VGAM RNA, and a schematic representation of the secondary folding of VGAM971 folded precursor RNA, herein designated VGAM FOLDED PRECURSOR RNA, of VGAM971 are further described hereinbelow with reference to Table 1.

Nucleotide sequences of host target binding sites, such as BINDING SITE-I, BINDING SITE-II and BINDING SITE-III of FIG. 1, found on VGAM971 host target RNA, and schematic representation of the complementarity of each of these host target binding sites to VGAM971 RNA, herein designated VGAM RNA, are described hereinbelow with reference to Table 2.

As mentioned hereinabove with reference to FIG. 1, a function of VGAM971 gene, herein designated VGAM is inhibition of expression of VGAM971 target genes. It is appreciated that specific functions, and accordingly utilities, of VGAM971 correlate with, and may be deduced from, the identity of the target genes which VGAM971 binds and inhibits, and the function of these target genes, as elaborated hereinbelow.

Protein Tyrosine Phosphatase, Receptor Type, C (PTPRC, Accession NM_080923) is a VGAM971 host target gene. PTPRC BINDING SITE is HOST TARGET binding site found in the 3' untranslated region of mRNA encoded by PTPRC, corresponding to a HOST TARGET binding site such as BINDING SITE I, BINDING SITE II or BINDING SITE III. Table 2 illustrates the complementarity of the nucleotide sequences of PTPRC BINDING SITE, designated SEQ ID:28149, to the nucleotide sequence of VGAM971 RNA, herein designated VGAM RNA, also designated SEQ ID:3682.

A function of VGAM971 is therefore inhibition of Protein Tyrosine Phosphatase, Receptor Type, C (PTPRC, Accession NM_080923). Accordingly, utilities of VGAM971 include diagnosis, prevention and treatment of diseases and clinical conditions associated with PTPRC. Serine (or cysteine) Proteinase Inhibitor, Clade B (ovalbumin), Member 9 (SERPINB9, Accession NM_004155) is another VGAM971 host target gene. SERPINB9 BINDING SITE is HOST TARGET binding site found in the 3' untranslated region of mRNA encoded by SERPINB9, corresponding to a HOST TARGET binding site such as BINDING SITE I, BINDING SITE II or BINDING SITE III. Table 2 illustrates the complementarity of the nucleotide sequences of SERPINB9 BINDING SITE, designated SEQ ID:10366, to the nucleotide sequence of VGAM971 RNA, herein designated VGAM RNA, also designated SEQ ID:3682.

Another function of VGAM971 is therefore inhibition of Serine (or cysteine) Proteinase Inhibitor, Clade B (ovalbumin), Member 9 (SERPINB9, Accession NM_004155), a gene which may be a serpin serine protease inhibitor that interacts with granzyme B (GZMB). Accordingly, utilities of VGAM971 include diagnosis, prevention and treatment of diseases and clinical conditions associated with SERPINB9. The function of SERPINB9 and its association with various diseases and clinical conditions, has been established by previous studies, as described hereinabove with reference to VGAM60. Transcription Factor 3 (E2A immunoglobulin enhancer binding factors E12/E47) (TCF3, Accession XM_047600) is another VGAM971 host target gene. TCF3 BINDING SITE is HOST TARGET binding site found in the 3' untranslated region of mRNA encoded by TCF3, corresponding to a HOST TARGET binding site such as BINDING SITE I, BINDING SITE II or BINDING SITE III. Table 2 illustrates the complementarity of the nucleotide sequences of TCF3 BINDING SITE, designated SEQ ID:35006, to the nucleotide sequence of VGAM971 RNA, herein designated VGAM RNA, also designated SEQ ID:3682.

Another function of VGAM971 is therefore inhibition of Transcription Factor 3 (E2A immunoglobulin enhancer binding factors E12/E47) (TCF3, Accession XM_047600), a gene which plays major roles in determining tissue-specific cell fate during embryogenesis. Accordingly, utilities of VGAM971 include diagnosis, prevention and treatment of diseases and clinical conditions associated with TCF3. The function of TCF3 and its association with various diseases and clinical conditions, has been established by previous studies, as described hereinabove with reference to VGAM144. VAMP (vesicle-associated membrane protein)-associated Protein B and C (VAPB, Accession NM_004738) is another VGAM971 host target gene. VAPB BINDING SITE is HOST TARGET binding site found in the 3' untranslated region of mRNA encoded by VAPB, corresponding to a HOST TARGET binding site such as BINDING SITE I, BINDING SITE II or BINDING SITE III. Table 2 illustrates the complementarity of the nucleotide sequences of VAPB BINDING SITE, designated SEQ ID:11132, to the nucleotide sequence of VGAM971 RNA, herein designated VGAM RNA, also designated SEQ ID:3682.

Another function of VGAM971 is therefore inhibition of VAMP (vesicle-associated membrane protein)-associated Protein B and C (VAPB, Accession NM_004738). Accordingly, utilities of VGAM971 include diagnosis, prevention and treatment of diseases and clinical conditions associated with VAPB. DEPP (Accession NM_007021) is another VGAM971 host target gene. DEPP BINDING SITE is HOST TARGET binding site found in the 3' untranslated region of mRNA encoded by DEPP, corresponding to a HOST TARGET binding site such as BINDING SITE I, BINDING SITE II or BINDING SITE III. Table 2 illustrates the complementarity of the nucleotide sequences of DEPP BINDING SITE, designated SEQ ID:13877, to the nucleotide sequence of VGAM971 RNA, herein designated VGAM RNA, also designated SEQ ID:3682.

Another function of VGAM971 is therefore inhibition of DEPP (Accession NM_007021). Accordingly, utilities of VGAM971 include diagnosis, prevention and treatment of diseases and clinical conditions associated with DEPP. DORFIN (Accession NM_015435) is another VGAM971 host target gene. DORFIN BINDING SITE is HOST TARGET binding site found in the 3' untranslated region of mRNA encoded by DORFIN, corresponding to a HOST TARGET binding site such as BINDING SITE I, BINDING SITE II or BINDING SITE III. Table 2 illustrates the complementarity of the nucleotide sequences of DORFIN BINDING SITE, designated SEQ ID:17729, to the nucleotide sequence of VGAM971 RNA, herein designated VGAM RNA, also designated SEQ ID:3682.

Another function of VGAM971 is therefore inhibition of DORFIN (Accession NM_015435). Accordingly, utilities of VGAM971 include diagnosis, prevention and treatment of diseases and clinical conditions associated with DORFIN. KIAA1423 (Accession XM_029703) is another VGAM971 host target gene. KIAA1423 BINDING SITE is HOST TARGET binding site found in the 3' untranslated region of mRNA encoded by KIAA1423, corresponding to a HOST TARGET binding site such as BINDING SITE I, BINDING SITE II or BINDING SITE III. Table 2 illustrates the complementarity of the nucleotide sequences of KIAA1423 BINDING SITE, designated SEQ ID:30923, to the nucleotide sequence of VGAM971 RNA, herein designated VGAM RNA, also designated SEQ ID:3682.

Another function of VGAM971 is therefore inhibition of KIAA1423 (Accession XM_029703). Accordingly, utilities of VGAM971 include diagnosis, prevention and treatment of diseases and clinical conditions associated with KIAA1423. Phospholipase C-like 2 (PLCL2, Accession XM_042836) is another VGAM971 host target gene. PLCL2 BINDING SITE is HOST TARGET binding site found in the 3' untranslated region of mRNA encoded by PLCL2, corresponding to a HOST TARGET binding site such as BINDING SITE I, BINDING SITE II or BINDING SITE III. Table 2 illustrates the complementarity of the nucleotide sequences of PLCL2 BINDING SITE, designated SEQ ID:33795, to the nucleotide sequence of VGAM971 RNA, herein designated VGAM RNA, also designated SEQ ID:3682.

Another function of VGAM971 is therefore inhibition of Phospholipase C-like 2 (PLCL2, Accession XM_042836). Accordingly, utilities of VGAM971 include diagnosis, prevention and treatment of diseases and clinical conditions associated with PLCL2. Splicing Factor, Arginine/serine-rich 11 (SFRS11, Accession NM_004768) is another VGAM971 host target gene. SFRS11 BINDING SITE is HOST TARGET binding site found in the 3' untranslated region of mRNA encoded by SFRS11, corresponding to a HOST TARGET binding site such as BINDING SITE I, BINDING SITE II or BINDING SITE III. Table 2 illustrates the complementarity of the nucleotide sequences of SFRS11 BINDING SITE, designated SEQ ID:11158, to the nucleotide sequence of VGAM971 RNA, herein designated VGAM RNA, also designated SEQ ID:3682.

Another function of VGAM971 is therefore inhibition of Splicing Factor, Arginine/serine-rich 11 (SFRS11, Accession NM_004768). Accordingly, utilities of VGAM971 include diagnosis, prevention and treatment of diseases and clinical conditions associated with SFRS11. UBE3B (Accession XM_084941) is another VGAM971 host target gene. UBE3B BINDING SITE is HOST TARGET binding site found in the 3' untranslated region of mRNA encoded by UBE3B, corresponding to a HOST TARGET binding site such as BINDING SITE I, BINDING SITE II or BINDING SITE III. Table 2 illustrates the complementarity of the nucleotide sequences of UBE3B BINDING SITE, designated SEQ ID:37775, to the nucleotide sequence of VGAM971 RNA, herein designated VGAM RNA, also designated SEQ ID:3682.

Another function of VGAM971 is therefore inhibition of UBE3B (Accession XM_084941). Accordingly, utilities of VGAM971 include diagnosis, prevention and treatment of diseases and clinical conditions associated with UBE3B. LOC155054 (Accession XM_088140) is another VGAM971 host target gene. LOC155054 BINDING SITE is HOST TARGET binding site found in the 3' untranslated region of mRNA encoded by LOC155054, corresponding to a HOST TARGET binding site such as BINDING SITE I, BINDING SITE II or BINDING SITE III. Table 2 illustrates the complementarity of the nucleotide sequences of LOC155054 BINDING SITE, designated SEQ ID:39539, to the nucleotide sequence of VGAM971 RNA, herein designated VGAM RNA, also designated SEQ ID:3682.

Another function of VGAM971 is therefore inhibition of LOC155054 (Accession XM_088140). Accordingly, utilities of VGAM971 include diagnosis, prevention and treatment of diseases and clinical conditions associated with LOC155054. FIG. 1 further provides a conceptual description of a novel bioinformatically detected viral gene of the present invention, referred to here as Viral Genomic Address Messenger 972 (VGAM972) viral gene, which modulates expression of respective host target genes thereof, the function and utility of which host target genes is known in the art.

VGAM972 is a novel bioinformatically detected regulatory, non protein coding, viral micro RNA (miRNA) gene. The method by which VGAM972 was detected is described hereinabove with reference to FIGS. 1-8.

VGAM972 gene, herein designated VGAM GENE, is a viral gene contained in the genome of Melanoplus Sanguinipes Entomopoxvirus. VGAM972 host target gene, herein designated VGAM HOST TARGET GENE, is a human gene contained in the human genome.

VGAM972 gene encodes a VGAM972 precursor RNA, herein designated VGAM PRECURSOR RNA. Similar to other miRNA genes, and unlike most ordinary genes, VGAM972 precursor RNA does not encode a protein. A nucleotide sequence identical or highly similar to the nucleotide sequence of VGAM972 precursor RNA is designated SEQ ID:958, and is provided hereinbelow with reference to the sequence listing part. Nucleotide sequence SEQ ID:958 is located at position 53651 relative to the genome of Melanoplus Sanguinipes Entomopoxvirus.

VGAM972 precursor RNA folds onto itself, forming VGAM972 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM972 folded precursor RNA into VGAM972 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM972 RNA is designated SEQ ID:3683, and is provided hereinbelow with reference to the sequence listing part.

VGAM972 host target gene, herein designated VGAM HOST TARGET GENE, encodes a corresponding messenger RNA, VGAM972 host target RNA, herein designated VGAM HOST TARGET RNA. VGAM972 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM972 RNA, herein designated VGAM RNA, binds complementarily to one or more host target binding sites located in untranslated regions of VGAM972 host target RNA, herein designated VGAM HOST TARGET RNA. This complementary binding is due to the fact that the nucleotide sequence of VGAM972 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM972 RNA, herein designated VGAM RNA, may have a different number of host target binding sites in untranslated regions of a VGAM972 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM972 RNA, herein designated VGAM RNA, to host target binding sites on VGAM972 host target RNA, herein designated VGAM HOST TARGET RNA, such as BINDING SITE I, BINDING SITE II and BINDING SITE III, inhibits translation of VGAM972 host target RNA into VGAM972 host target protein, herein designated VGAM HOST TARGET PROTEIN. VGAM host target protein is therefore outlined by a broken line.

It is appreciated that VGAM972 host target gene, herein designated VGAM HOST TARGET GENE, in fact represents a plurality of VGAM972 host target genes. The mRNA of each one of this plurality of VGAM972 host target genes comprises one or more host target binding sites, each having a nucleotide sequence which is at least partly complementary to VGAM972 RNA, herein designated VGAM RNA, and which when bound by VGAM972 RNA causes inhibition of translation of respective one or more VGAM972 host target proteins.

It is further appreciated by one skilled in the art that the mode of translational inhibition illustrated by FIG. 1 with specific reference to translational inhibition exerted by VGAM972 gene, herein designated VGAM GENE, on one or more VGAM972 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM972 is inhibition of expression of host target genes, as part of a novel viral mechanism of attacking a host. Accordingly, utilities of VGAM972 include diagnosis, prevention and treatment of viral infection by Melanoplus Sanguinipes Entomopoxvirus. Specific functions, and accordingly utilities, of VGAM972 correlate with, and may be deduced from, the identity of the host target genes which VGAM972 binds and inhibits, and the function of these host target genes, as elaborated hereinbelow.

Nucleotide sequences of the VGAM972 precursor RNA, herein designated VGAM PRECURSOR RNA, and of the 'diced' VGAM972 RNA, herein designated VGAM RNA, and a schematic representation of the secondary folding of VGAM972 folded precursor RNA, herein designated VGAM FOLDED PRECURSOR RNA, of VGAM972 are further described hereinbelow with reference to Table 1.

Nucleotide sequences of host target binding sites, such as BINDING SITE-I, BINDING SITE-II and BINDING SITE-III of FIG. 1, found on VGAM972 host target RNA, and schematic representation of the complementarity of each of these host target binding sites to VGAM972 RNA, herein designated VGAM RNA, are described hereinbelow with reference to Table 2.

As mentioned hereinabove with reference to FIG. 1, a function of VGAM972 gene, herein designated VGAM is inhibition of expression of VGAM972 target genes. It is appreciated that specific functions, and accordingly utilities, of VGAM972 correlate with, and may be deduced from, the identity of the target genes which VGAM972 binds and inhibits, and the function of these target genes, as elaborated hereinbelow.

Epilepsy, Progressive Myoclonus Type 2, Lafora Disease (laforin) (EPM2A, Accession NM_005670) is a VGAM972 host target gene. EPM2A BINDING SITE is HOST TARGET binding site found in the 3' untranslated region of mRNA encoded by EPM2A, corresponding to a HOST TARGET binding site such as BINDING SITE I, BINDING SITE II or BINDING SITE III. Table 2 illustrates the complementarity of the nucleotide sequences of EPM2A BINDING SITE, designated SEQ ID:12225, to the nucleotide sequence of VGAM972 RNA, herein designated VGAM RNA, also designated SEQ ID:3683.

A function of VGAM972 is therefore inhibition of Epilepsy, Progressive Myoclonus Type 2, Lafora Disease (laforin) (EPM2A, Accession NM_005670), a gene which Laforin; protein tyrosine phosphatase that may have role in glycogen metabolism. Accordingly, utilities of VGAM972 include diagnosis, prevention and treatment of diseases and clinical conditions associated with EPM2A. The function of EPM2A and its association with various diseases and clinical conditions, has been established by previous studies, as described hereinabove with reference to VGAM470. Kinesin-like 1 (KNSL1, Accession NM_004523) is another VGAM972 host target gene. KNSL1 BINDING SITE is HOST TARGET binding site found in the 3' untranslated region of mRNA encoded by KNSL1, corresponding to a HOST TARGET binding site such as BINDING SITE I, BINDING SITE II or BINDING SITE III. Table 2 illustrates the complementarity of the nucleotide sequences of KNSL1 BINDING SITE, designated SEQ ID:10863, to the nucleotide sequence of VGAM972 RNA, herein designated VGAM RNA, also designated SEQ ID:3683.

Another function of VGAM972 is therefore inhibition of Kinesin-like 1 (KNSL1, Accession NM_004523), a gene which is a motor protein required for establishing a bipolar spindle. Accordingly, utilities of VGAM972 include diagnosis, prevention and treatment of diseases and clinical conditions associated with KNSL1. The function of KNSL1 and its association with various diseases and clinical conditions, has been established by previous studies, as described hereinabove with reference to VGAM252. BANP (Accession XM_038696) is another VGAM972 host target gene. BANP BINDING SITE is HOST TARGET binding site found in the 5' untranslated region of mRNA encoded by BANP, corresponding to a HOST TARGET binding site such as BINDING SITE I, BINDING SITE II or BINDING SITE III. Table 2 illustrates the complementarity of the nucleotide sequences of BANP BINDING SITE, designated SEQ ID:32910, to the nucleotide sequence of VGAM972 RNA, herein designated VGAM RNA, also designated SEQ ID:3683.

Another function of VGAM972 is therefore inhibition of BANP (Accession XM_038696). Accordingly, utilities of VGAM972 include diagnosis, prevention and treatment of diseases and clinical conditions associated with BANP. GFR (Accession NM_012294) is another VGAM972 host target gene. GFR BINDING SITE is HOST TARGET binding site found in the 3' untranslated region of mRNA encoded by GFR, corresponding to a HOST TARGET binding site such as BINDING SITE I, BINDING SITE II or BINDING SITE III. Table 2 illustrates the complementarity of the nucleotide sequences of GFR BINDING SITE, designated SEQ ID:14645, to the nucleotide sequence of VGAM972 RNA, herein designated VGAM RNA, also designated SEQ ID:3683.

Another function of VGAM972 is therefore inhibition of GFR (Accession NM_012294). Accordingly, utilities of VGAM972 include diagnosis, prevention and treatment of diseases and clinical conditions associated with GFR. Phytoceramidase, Alkaline (PHCA, Accession NM_018367) is another VGAM972 host target gene. PHCA BINDING SITE is HOST TARGET binding site found in the 3' untranslated region of mRNA encoded by PHCA, corresponding to a HOST TARGET binding site such as BINDING SITE I, BINDING SITE II or BINDING SITE III. Table 2 illustrates the complementarity of the nucleotide sequences of PHCA BINDING SITE, designated SEQ ID:20373, to the nucleotide sequence of VGAM972 RNA, herein designated VGAM RNA, also designated SEQ ID:3683.

Another function of VGAM972 is therefore inhibition of Phytoceramidase, Alkaline (PHCA, Accession NM_018367). Accordingly, utilities of VGAM972 include diagnosis, prevention and treatment of diseases and clinical conditions associated with PHCA. Proteasome (prosome, macropain) 26S Subunit, Non-ATPase, 10 (PSMD10, Accession NM_002814) is another VGAM972 host target gene. PSMD10 BINDING SITE is HOST TARGET binding site found in the 3' untranslated region of mRNA encoded by PSMD10, corresponding to a HOST TARGET binding site such as BINDING SITE I, BINDING SITE II or BINDING SITE III. Table 2 illustrates the complementarity of the nucleotide sequences of PSMD10 BINDING SITE, designated SEQ ID:8678, to the nucleotide sequence of VGAM972 RNA, herein designated VGAM RNA, also designated SEQ ID:3683.

Another function of VGAM972 is therefore inhibition of Proteasome (prosome, macropain) 26S Subunit, Non-ATPase, 10 (PSMD10, Accession NM_002814). Accordingly, utilities of VGAM972 include diagnosis, prevention and treatment of diseases and clinical conditions associated with PSMD10. FIG. 1 further provides a conceptual description of a novel bioinformatically detected viral gene of the present invention, referred to here as Viral Genomic Address Messenger 973 (VGAM973) viral gene, which modulates expression of respective host target genes thereof, the function and utility of which host target genes is known in the art.

VGAM973 is a novel bioinformatically detected regulatory, non protein coding, viral micro RNA (miRNA) gene. The method by which VGAM973 was detected is described hereinabove with reference to FIGS. 1-8.

VGAM973 gene, herein designated VGAM GENE, is a viral gene contained in the genome of Equine Herpesvirus 1.

VGAM973 host target gene, herein designated VGAM HOST TARGET GENE, is a human gene contained in the human genome.

VGAM973 gene encodes a VGAM973 precursor RNA, herein designated VGAM PRECURSOR RNA. Similar to other miRNA genes, and unlike most ordinary genes, VGAM973 precursor RNA does not encode a protein. A nucleotide sequence identical or highly similar to the nucleotide sequence of VGAM973 precursor RNA is designated SEQ ID:959, and is provided hereinbelow with reference to the sequence listing part. Nucleotide sequence SEQ ID:959 is located at position 96169 relative to the genome of Equine Herpesvirus 1.

VGAM973 precursor RNA folds onto itself, forming VGAM973 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM973 folded precursor RNA into VGAM973 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM973 RNA is designated SEQ ID:3684, and is provided hereinbelow with reference to the sequence listing part.

VGAM973 host target gene, herein designated VGAM HOST TARGET GENE, encodes a corresponding messenger RNA, VGAM973 host target RNA, herein designated VGAM HOST TARGET RNA. VGAM973 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM973 RNA, herein designated VGAM RNA, binds complementarily to one or more host target binding sites located in untranslated regions of VGAM973 host target RNA, herein designated VGAM HOST TARGET RNA. This complementary binding is due to the fact that the nucleotide sequence of VGAM973 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM973 RNA, herein designated VGAM RNA, may have a different number of host target binding sites in untranslated regions of a VGAM973 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM973 RNA, herein designated VGAM RNA, to host target binding sites on VGAM973 host target RNA, herein designated VGAM HOST TARGET RNA, such as BINDING SITE I, BINDING SITE II and BINDING SITE III, inhibits translation of VGAM973 host target RNA into VGAM973 host target protein, herein designated VGAM HOST TARGET PROTEIN. VGAM host target protein is therefore outlined by a broken line.

It is appreciated that VGAM973 host target gene, herein designated VGAM HOST TARGET GENE, in fact represents a plurality of VGAM973 host target genes. The mRNA of each one of this plurality of VGAM973 host target genes comprises one or more host target binding sites, each having a nucleotide sequence which is at least partly complementary to VGAM973 RNA, herein designated VGAM RNA, and which when bound by VGAM973 RNA causes inhibition of translation of respective one or more VGAM973 host target proteins.

It is further appreciated by one skilled in the art that the mode of translational inhibition illustrated by FIG. 1 with specific reference to translational inhibition exerted by VGAM973 gene, herein designated VGAM GENE, on one or more VGAM973 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM973 is inhibition of expression of host target genes, as part of a novel viral mechanism of attacking a host. Accordingly, utilities of VGAM973 include diagnosis, prevention and treatment of viral infection by Equine Herpesvirus 1. Specific functions, and accordingly utilities, of VGAM973 correlate with, and may be deduced from, the identity of the host target genes which VGAM973 binds and inhibits, and the function of these host target genes, as elaborated hereinbelow.

Nucleotide sequences of the VGAM973 precursor RNA, herein designated VGAM PRECURSOR RNA, and of the 'diced' VGAM973 RNA, herein designated VGAM RNA, and a schematic representation of the secondary folding of VGAM973 folded precursor RNA, herein designated VGAM FOLDED PRECURSOR RNA, of VGAM973 are further described hereinbelow with reference to Table 1.

Nucleotide sequences of host target binding sites, such as BINDING SITE-I, BINDING SITE-II and BINDING SITE-III of FIG. 1, found on VGAM973 host target RNA, and schematic representation of the complementarity of each of these host target binding sites to VGAM973 RNA, herein designated VGAM RNA, are described hereinbelow with reference to Table 2.

As mentioned hereinabove with reference to FIG. 1, a function of VGAM973 gene, herein designated VGAM is inhibition of expression of VGAM973 target genes. It is appreciated that specific functions, and accordingly utilities, of VGAM973 correlate with, and may be deduced from, the identity of the target genes which VGAM973 binds and inhibits, and the function of these target genes, as elaborated hereinbelow.

Myxovirus (influenza virus) Resistance 1, Interferon-inducible Protein P78 (mouse) (MX1, Accession NM_002462) is a VGAM973 host target gene. MX1 BINDING SITE is HOST TARGET binding site found in the 5" untranslated region of mRNA encoded by MX1, corresponding to a HOST TARGET binding site such as BINDING SITE I, BINDING SITE II or BINDING SITE III. Table 2 illustrates the complementarity of the nucleotide sequences of MX1 BINDING SITE, designated SEQ ID:8291, to the nucleotide sequence of VGAM973 RNA, herein designated VGAM RNA, also designated SEQ ID:3684.

A function of VGAM973 is therefore inhibition of Myxovirus (influenza virus) Resistance 1, Interferon-inducible Protein P78 (mouse) (MX1, Accession NM_002462), a gene which is responsible for a specific antiviral state against influenza virus infection. Accordingly, utilities of VGAM973 include diagnosis, prevention and treatment of diseases and clinical conditions associated with MX1. The function of MX1 has been established by previous studies. Horisberger et al. (1988) purified to homogeneity and characterized an interferon-induced human protein (p78 protein) that is the equivalent of the murine Mx1 protein as shown by antigenic relatedness, induction conditions, physicochemical properties, and amino acid analysis. The murine gene is located on chromosome 16. Horisberger et al. (1988) constructed a cDNA library using mRNAs from interferon-induced human diploid fibroblasts. They identified cDNA clones coding for the human p78 protein and used them to determine the chromosomal location of the corresponding gene, termed IFI-78K, by hybridization to DNA from a panel of human-rodent somatic cell hybrids. The newly identified gene was located on human chromosome 21. Observation of a gene dosage effect with trisomic cells confirmed this location. The gene symbol MX, which corresponds to the mouse symbol Mx, is derived from myxovirus (influenza) resistance. Because Mx is the official title of this locus in the mouse, the same is used as the preferred symbol in man. There is a second MX gene on chromosome 21; thus, these are designated MX1 and MX2 (OMIM Ref. No. 147890). By somatic cell hybrid studies, Huber et al. (1988) likewise demonstrated that the 2 MX genes are located on distal mouse chromosome 16 and on human chromosome 21. By means of genetic linkage studies using RFLPs, Petersen et al. (1991) mapped the MX1 gene to 21q22.3 and determined its location relative to 15 other genes and DNA markers. Fanconi anemia (FA) consists of a group of at least 5 autosomal recessive disorders that share both clinical (e.g., birth defects and hematopoietic failure) and cellular (e.g., sensitivity to crosslinking agents and predisposition to apoptosis) features with each other. To identify genetic pathways that are altered in FA and to characterize shared molecular defects that might represent pathogenetic links among these groups, Li and Youssoufian (1997) used mRNA differential display to isolate the genes that have altered expression patterns in FA cells. They reported that the expression of an interferon-inducible gene, which they referred to as MxA, is highly upregulated in cells of FA complementation groups A, B, C, and D, but that it is suppressed in FA group C cells (OMIM Ref. No. 227645) complemented with wildtype FAC cDNA, as well as in non-FA cells. A posttranslational mechanism rather than transcriptional induction appeared to account for MxA overexpression. Forced expression of MxA in Hep3B cells enhanced their sensitivity to mitomycin C and induced apoptosis, similar to the FA phenotype. Thus, MxA is a downstream target of FAC and is the first genetic marker to be identified among multiple FA complementation groups. FA subtypes may converge onto a final common pathway, which is intimately related to the interferon signaling mechanism. Constitutive activity of this pathway may explain a number of the phenotypic features of FA, particularly the pathogenesis of bone marrow failure.

Full details of the abovementioned studies are described in the following publications, the disclosure of which are hereby incorporated by reference:

Horisberger, M. A.; Wathelet, M.; Szpirer, J.; Szpirer, C.; Islam, Q.; Levan, G.; Huez, G.; Content, J.: cDNA cloning and assignment to chromosome 21 of IFI-78K gene, the human equivalent of murine Mx gene. Somat. Cell Molec. Genet. 14:123-131, 1988; and Li, Y.; Youssoufian, H.: MxA overexpression reveals a common genetic link in four Fanconi anemia complementation groups. J. Clin. Invest. 100:2873-2880, 1997.

Further studies establishing the function and utilities of MX1 are found in John Hopkins OMIM database record ID 147150, and in sited publications numbered 2019-2021, 496 and 12304 listed in the bibliography section hereinbelow, which are also hereby incorporated by reference. Diacylglycerol Kinase, Delta 130 kDa (DGKD, Accession XM_002384) is another VGAM973 host target gene. DGKD BINDING SITE is HOST TARGET binding site found in the 3" untranslated region of mRNA encoded by DGKD, corresponding to a HOST TARGET binding site such as BINDING SITE I, BINDING SITE II or BINDING SITE III. Table 2 illustrates the complementarity of the nucleotide sequences of DGKD BINDING SITE, designated SEQ ID:29878, to the nucleotide sequence of VGAM973 RNA, herein designated VGAM RNA, also designated SEQ ID:3684.

Another function of VGAM973 is therefore inhibition of Diacylglycerol Kinase, Delta 130 kDa (DGKD, Accession XM_002384). Accordingly, utilities of VGAM973 include diagnosis, prevention and treatment of diseases and clinical conditions associated with DGKD. LOC201696 (Accession XM_032269) is another VGAM973 host target gene. LOC201696 BINDING SITE is HOST TARGET binding site found in the 3' untranslated region of mRNA encoded by LOC201696, corresponding to a HOST TARGET binding site such as BINDING SITE I, BINDING SITE II or BINDING SITE III. Table 2 illustrates the complementarity of the nucleotide sequences of LOC201696 BINDING SITE, designated SEQ ID:31623, to the nucleotide sequence of VGAM973 RNA, herein designated VGAM RNA, also designated SEQ ID:3684.

Another function of VGAM973 is therefore inhibition of LOC201696 (Accession XM_032269). Accordingly, utilities of VGAM973 include diagnosis, prevention and treatment of diseases and clinical conditions associated with LOC201696. FIG. 1 further provides a conceptual description of a novel bioinformatically detected viral gene of the present invention, referred to here as Viral Genomic Address Messenger 974 (VGAM974) viral gene, which modulates expression of respective host target genes thereof, the function and utility of which host target genes is known in the art.

VGAM974 is a novel bioinformatically detected regulatory, non protein coding, viral micro RNA (miRNA) gene. The method by which VGAM974 was detected is described hereinabove with reference to FIGS. 1-8.

VGAM974 gene, herein designated VGAM GENE, is a viral gene contained in the genome of Melanoplus Sanguinipes Entomopoxvirus. VGAM974 host target gene, herein designated VGAM HOST TARGET GENE, is a human gene contained in the human genome.

VGAM974 gene encodes a VGAM974 precursor RNA, herein designated VGAM PRECURSOR RNA. Similar to other miRNA genes, and unlike most ordinary genes, VGAM974 precursor RNA does not encode a protein. A nucleotide sequence identical or highly similar to the nucleotide sequence of VGAM974 precursor RNA is designated SEQ ID:960, and is provided hereinbelow with reference to the sequence listing part. Nucleotide sequence SEQ ID:960 is located at position 142776 relative to the genome of Melanoplus Sanguinipes Entomopoxvirus.

VGAM974 precursor RNA folds onto itself, forming VGAM974 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM974 folded precursor RNA into VGAM974 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 78%) nucleotide sequence of VGAM974 RNA is designated SEQ ID:3685, and is provided hereinbelow with reference to the sequence listing part.

VGAM974 host target gene, herein designated VGAM HOST TARGET GENE, encodes a corresponding messenger RNA, VGAM974 host target RNA, herein designated VGAM HOST TARGET RNA. VGAM974 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM974 RNA, herein designated VGAM RNA, binds complementarily to one or more host target binding sites located in untranslated regions of VGAM974 host target RNA, herein designated VGAM HOST TARGET RNA. This complementary binding is due to the fact that the nucleotide sequence of VGAM974 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM974 RNA, herein designated VGAM RNA, may have a different number of host target binding sites in untranslated regions of a VGAM974 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM974 RNA, herein designated VGAM RNA, to host target binding sites on VGAM974 host target RNA, herein designated VGAM HOST TARGET RNA, such as BINDING SITE I, BINDING SITE II and BINDING SITE III, inhibits translation of VGAM974 host target RNA into VGAM974 host target protein, herein designated VGAM HOST TARGET PROTEIN. VGAM host target protein is therefore outlined by a broken line.

It is appreciated that VGAM974 host target gene, herein designated VGAM HOST TARGET GENE, in fact represents a plurality of VGAM974 host target genes. The mRNA of each one of this plurality of VGAM974 host target genes comprises one or more host target binding sites, each having a nucleotide sequence which is at least partly complementary to VGAM974 RNA, herein designated VGAM RNA, and which when bound by VGAM974 RNA causes inhibition of translation of respective one or more VGAM974 host target proteins.

It is further appreciated by one skilled in the art that the mode of translational inhibition illustrated by FIG. 1 with specific reference to translational inhibition exerted by VGAM974 gene, herein designated VGAM GENE, on one or more VGAM974 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM974 is inhibition of expression of host target genes, as part of a novel viral mechanism of attacking a host. Accordingly, utilities of VGAM974 include diagnosis, prevention and treatment of viral infection by Melanoplus Sanguinipes Entomopoxvirus. Specific functions, and accordingly utilities, of VGAM974 correlate with, and may be deduced from, the identity of the host target genes which VGAM974 binds and inhibits, and the function of these host target genes, as elaborated hereinbelow.

Nucleotide sequences of the VGAM974 precursor RNA, herein designated VGAM PRECURSOR RNA, and of the 'diced' VGAM974 RNA, herein designated VGAM RNA, and a schematic representation of the secondary folding of VGAM974 folded precursor RNA, herein designated VGAM FOLDED PRECURSOR RNA, of VGAM974 are further described hereinbelow with reference to Table 1.

Nucleotide sequences of host target binding sites, such as BINDING SITE-I, BINDING SITE-II and BINDING SITE-III of FIG. 1, found on VGAM974 host target RNA, and schematic representation of the complementarity of each of these host target binding sites to VGAM974 RNA, herein designated VGAM RNA, are described hereinbelow with reference to Table 2.

As mentioned hereinabove with reference to FIG. 1, a function of VGAM974 gene, herein designated VGAM is inhibition of expression of VGAM974 target genes. It is appreciated that specific functions, and accordingly utilities, of VGAM974 correlate with, and may be deduced from, the identity of the target genes which VGAM974 binds and inhibits, and the function of these target genes, as elaborated hereinbelow.

Aryl-hydrocarbon Receptor Nuclear Translocator 2 (ARNT2, Accession NM_014862) is a VGAM974 host target gene. ARNT2 BINDING SITE is HOST TARGET binding site found in the 3' untranslated region of mRNA encoded by ARNT2, corresponding to a HOST TARGET binding site such as BINDING SITE I, BINDING SITE II or BINDING SITE III. Table 2 illustrates the complementarity of the nucleotide sequences of ARNT2 BINDING SITE, designated SEQ ID:16932, to the nucleotide sequence of VGAM974 RNA, herein designated VGAM RNA, also designated SEQ ID:3685.

A function of VGAM974 is therefore inhibition of Aryl-hydrocarbon Receptor Nuclear Translocator 2 (ARNT2, Accession NM_014862), a gene which specifically recognizes the xenobiotic response element (xre). Accordingly, utilities of VGAM974 include diagnosis, prevention and treatment of diseases and clinical conditions associated with ARNT2. The function of ARNT2 and its association with various diseases and clinical conditions, has been established by previous studies, as described hereinabove with reference to VGAM345. Interleukin 1 Family, Member 5 (delta) (IL1F5, Accession NM_012275) is another VGAM974 host target gene. IL1F5 BINDING SITE is HOST TARGET binding site found in the 3' untranslated region of mRNA encoded by IL1F5, corresponding to a HOST TARGET binding site such as BINDING SITE I, BINDING SITE II or BINDING SITE III. Table 2 illustrates the complementarity of the nucleotide sequences of IL1F5 BINDING SITE, designated SEQ ID:14594, to the nucleotide sequence of VGAM974 RNA, herein designated VGAM RNA, also designated SEQ ID:3685.

Another function of VGAM974 is therefore inhibition of Interleukin 1 Family, Member 5 (delta) (IL1F5, Accession NM_012275), a gene which is a novel interleukin-1 receptor antagonist gene. Accordingly, utilities of VGAM974 include diagnosis, prevention and treatment of diseases and clinical conditions associated with IL1F5. The function of IL1F5 and its association with various diseases and clinical conditions, has been established by previous studies, as described hereinabove with reference to VGAM263. Protein Tyrosine Phosphatase, Non-receptor Type 1 (PTPN1, Accession NM_002827) is another VGAM974 host target gene. PTPN1 BINDING SITE is HOST TARGET binding site found in the 3' untranslated region of mRNA encoded by PTPN1, corresponding to a HOST TARGET binding site such as BINDING SITE I, BINDING SITE II or BINDING SITE III. Table 2 illustrates the complementarity of the nucleotide sequences of PTPN1 BINDING SITE, designated SEQ ID:8702, to the nucleotide sequence of VGAM974 RNA, herein designated VGAM RNA, also designated SEQ ID:3685.

Another function of VGAM974 is therefore inhibition of Protein Tyrosine Phosphatase, Non-receptor Type 1 (PTPN1, Accession NM_002827), a gene which is a non-receptor type 1 protein tyrosine phosphatase and inhibits insulin signaling. Accordingly, utilities of VGAM974 include diagnosis, prevention and treatment of diseases and clinical conditions associated with PTPN1. The function of PTPN1 and its association with various diseases and clinical conditions, has been established by previous studies, as described hereinabove with reference to VGAM327. Transcription Factor 19 (SC1) (TCF19, Accession XM_175167) is another VGAM974 host target gene. TCF19 BINDING SITE1 and TCF19 BINDING SITE2 are HOST TARGET binding sites found in untranslated regions of mRNA encoded by TCF19, corresponding to HOST TARGET binding sites such as BINDING SITE I, BINDING SITE II or BINDING SITE III. Table 2 illustrates the complementarity of the nucleotide sequences of TCF19 BINDING SITE1 and TCF19 BINDING SITE2, designated SEQ ID:46656 and SEQ ID:46705 respectively, to the nucleotide sequence of VGAM974 RNA, herein designated VGAM RNA, also designated SEQ ID:3685.

Another function of VGAM974 is therefore inhibition of Transcription Factor 19 (SC1) (TCF19, Accession XM_175167), a gene which plays an important role in the transcription of genes required for the later stages of cell cycle progression. Accordingly, utilities of VGAM974 include diagnosis, prevention and treatment of diseases and clinical conditions associated with TCF19. The function of TCF19 and its association with various diseases and clinical conditions, has been established by previous studies, as described hereinabove with reference to VGAM299. KIAA0461 (Accession XM_047883) is another VGAM974 host target gene. KIAA0461 BINDING SITE is HOST TARGET binding site found in the 3' untranslated region of mRNA encoded by KIAA0461, corresponding to a HOST TARGET binding site such as BINDING SITE I, BINDING SITE II or BINDING SITE III. Table 2 illustrates the complementarity of the nucleotide sequences of KIAA0461 BINDING SITE, designated SEQ ID:35071, to the nucleotide sequence of VGAM974 RNA, herein designated VGAM RNA, also designated SEQ ID:3685.

Another function of VGAM974 is therefore inhibition of KIAA0461 (Accession XM_047883). Accordingly, utilities of VGAM974 include diagnosis, prevention and treatment of diseases and clinical conditions associated with KIAA0461. LOC200597 (Accession XM_114266) is another VGAM974 host target gene. LOC200597 BINDING SITE is HOST TARGET binding site found in the 3' untranslated region of mRNA encoded by LOC200597, corresponding to a HOST TARGET binding site such as BINDING SITE I, BINDING SITE II or BINDING SITE III. Table 2 illustrates the complementarity of the nucleotide sequences of LOC200597 BINDING SITE, designated SEQ ID:42823, to the nucleotide sequence of VGAM974 RNA, herein designated VGAM RNA, also designated SEQ ID:3685.

Another function of VGAM974 is therefore inhibition of LOC200597 (Accession XM_114266). Accordingly, utilities of VGAM974 include diagnosis, prevention and treatment of diseases and clinical conditions associated with LOC200597. LOC220522 (Accession XM_018306) is another VGAM974 host target gene. LOC220522 BINDING SITE is HOST TARGET binding site found in the 3' untranslated region of mRNA encoded by LOC220522, corresponding to a HOST TARGET binding site such as BINDING SITE I, BINDING SITE II or BINDING SITE III. Table 2 illustrates the complementarity of the nucleotide sequences of LOC220522 BINDING SITE, designated SEQ ID:30354, to the nucleotide sequence of VGAM974 RNA, herein designated VGAM RNA, also designated SEQ ID:3685.

Another function of VGAM974 is therefore inhibition of LOC220522 (Accession XM_018306). Accordingly, utilities of VGAM974 include diagnosis, prevention and treatment of diseases and clinical conditions associated with LOC220522. LOC257319 (Accession XM_171049) is another VGAM974 host target gene. LOC257319 BINDING SITE is HOST TARGET binding site found in the 3' untranslated region of mRNA encoded by LOC257319, corresponding to a HOST TARGET binding site such as BINDING SITE I, BINDING SITE II or BINDING SITE III. Table 2 illustrates the complementarity of the nucleotide sequences of LOC257319 BINDING SITE, designated SEQ ID:45829, to the nucleotide sequence of VGAM974 RNA, herein designated VGAM RNA, also designated SEQ ID:3685.

Another function of VGAM974 is therefore inhibition of LOC257319 (Accession XM_171049). Accordingly, utilities of VGAM974 include diagnosis, prevention and treatment of diseases and clinical conditions associated with LOC257319. FIG. 1 further provides a conceptual description of a novel bioinformatically detected viral gene of the present invention, referred to here as Viral Genomic Address Messenger 975 (VGAM975) viral gene, which modulates expression of respective host target genes thereof, the function and utility of which host target genes is known in the art.

VGAM975 is a novel bioinformatically detected regulatory, non protein coding, viral micro RNA (miRNA) gene. The method by which VGAM975 was detected is described hereinabove with reference to FIGS. 1-8.

VGAM975 gene, herein designated VGAM GENE, is a viral gene contained in the genome of Variola Virus. VGAM975 host target gene, herein designated VGAM HOST TARGET GENE, is a human gene contained in the human genome.

VGAM975 gene encodes a VGAM975 precursor RNA, herein designated VGAM PRECURSOR RNA. Similar to other miRNA genes, and unlike most ordinary genes, VGAM975 precursor RNA does not encode a protein. A nucleotide sequence identical or highly similar to the nucleotide sequence of VGAM975 precursor RNA is designated SEQ ID:961, and is provided hereinbelow with reference to the sequence listing part. Nucleotide sequence SEQ ID:961 is located at position 34911 relative to the genome of Variola Virus.

VGAM975 precursor RNA folds onto itself, forming VGAM975 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM975 folded precursor RNA into VGAM975 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM975 RNA is designated SEQ ID:3686, and is provided hereinbelow with reference to the sequence listing part.

VGAM975 host target gene, herein designated VGAM HOST TARGET GENE, encodes a corresponding messenger RNA, VGAM975 host target RNA, herein designated VGAM HOST TARGET RNA. VGAM975 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM975 RNA, herein designated VGAM RNA, binds complementarily to one or more host target binding sites located in untranslated regions of VGAM975 host target RNA, herein designated VGAM HOST TARGET RNA. This complementary binding is due to the fact that the nucleotide sequence of VGAM975 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM975 RNA, herein designated VGAM RNA, may have a different number of host target binding sites in untranslated regions of a VGAM975 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM975 RNA, herein designated VGAM RNA, to host target binding sites on VGAM975 host target RNA, herein designated VGAM HOST TARGET RNA, such as BINDING SITE I, BINDING SITE II and BINDING SITE III, inhibits translation of VGAM975 host target RNA into VGAM975 host target protein, herein designated VGAM HOST TARGET PROTEIN. VGAM host target protein is therefore outlined by a broken line.

It is appreciated that VGAM975 host target gene, herein designated VGAM HOST TARGET GENE, in fact represents a plurality of VGAM975 host target genes. The mRNA of each one of this plurality of VGAM975 host target genes comprises one or more host target binding sites, each having a nucleotide sequence which is at least partly complementary to VGAM975 RNA, herein designated VGAM RNA, and which when bound by VGAM975 RNA causes inhibition of translation of respective one or more VGAM975 host target proteins.

It is further appreciated by one skilled in the art that the mode of translational inhibition illustrated by FIG. 1 with specific reference to translational inhibition exerted by VGAM975 gene, herein designated VGAM GENE, on one or more VGAM975 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM975 is inhibition of expression of host target genes, as part of a novel viral mechanism of attacking a host. Accordingly, utilities of VGAM975 include diagnosis, prevention and treatment of viral infection by Variola Virus. Specific functions, and accordingly utilities, of VGAM975 correlate with, and may be deduced from, the identity of the host target genes which VGAM975 binds and inhibits, and the function of these host target genes, as elaborated hereinbelow.

Nucleotide sequences of the VGAM975 precursor RNA, herein designated VGAM PRECURSOR RNA, and of the 'diced' VGAM975 RNA, herein designated VGAM RNA, and a schematic representation of the secondary folding of VGAM975 folded precursor RNA, herein designated VGAM FOLDED PRECURSOR RNA, of VGAM975 are further described hereinbelow with reference to Table 1.

Nucleotide sequences of host target binding sites, such as BINDING SITE-I, BINDING SITE-II and BINDING SITE-III of FIG. 1, found on VGAM975 host target RNA, and schematic representation of the complementarity of each of these host target binding sites to VGAM975 RNA, herein designated VGAM RNA, are described hereinbelow with reference to Table 2.

As mentioned hereinabove with reference to FIG. 1, a function of VGAM975 gene, herein designated VGAM is inhibition of expression of VGAM975 target genes. It is appreciated that specific functions, and accordingly utilities, of VGAM975 correlate with, and may be deduced from, the identity of the target genes which VGAM975 binds and inhibits, and the function of these target genes, as elaborated hereinbelow.

Inositol Hexaphosphate Kinase 3 (IHPK3, Accession NM_054111) is a VGAM975 host target gene. IHPK3 BINDING SITE is HOST TARGET binding site found in the 3' untranslated region of mRNA encoded by IHPK3, corresponding to a HOST TARGET binding site such as BINDING SITE I, BINDING SITE II or BINDING SITE III. Table 2 illustrates the complementarity of the nucleotide sequences of IHPK3 BINDING SITE, designated SEQ ID:27654, to the nucleotide sequence of VGAM975 RNA, herein designated VGAM RNA, also designated SEQ ID:3686.

A function of VGAM975 is therefore inhibition of Inositol Hexaphosphate Kinase 3 (IHPK3, Accession NM_054111). Accordingly, utilities of VGAM975 include diagnosis, prevention and treatment of diseases and clinical conditions associated with IHPK3. DKFZP434D193 (Accession XM_114297) is another VGAM975 host target gene. DKFZP434D193 BINDING SITE is HOST TARGET binding site found in the 3' untranslated region of mRNA encoded by DKFZP434D193, corresponding to a HOST TARGET binding site such as BINDING SITE I, BINDING SITE II or BINDING SITE III. Table 2 illustrates the complementarity of the nucleotide sequences of DKFZP434D193 BINDING SITE, designated SEQ ID:42852, to the nucleotide sequence of VGAM975 RNA, herein designated VGAM RNA, also designated SEQ ID:3686.

Another function of VGAM975 is therefore inhibition of DKFZP434D193 (Accession XM_114297). Accordingly, utilities of VGAM975 include diagnosis, prevention and treatment of diseases and clinical conditions associated with DKFZP434D193. Fucose-1-phosphate Guanylyltransferase (FPGT, Accession NM_003838) is another VGAM975 host target gene. FPGT BINDING SITE is HOST TARGET binding site found in the 3' untranslated region of mRNA encoded by FPGT, corresponding to a HOST TARGET binding site such as BINDING SITE I, BINDING SITE II or BINDING SITE III. Table 2 illustrates the complementarity of the nucleotide sequences of FPGT BINDING SITE, designated SEQ ID:9929, to the nucleotide sequence of VGAM975 RNA, herein designated VGAM RNA, also designated SEQ ID:3686.

Another function of VGAM975 is therefore inhibition of Fucose-1-phosphate Guanylyltransferase (FPGT, Accession NM_003838). Accordingly, utilities of VGAM975 include diagnosis, prevention and treatment of diseases and clinical conditions associated with FPGT. KIAA0252 (Accession XM_031646) is another VGAM975 host target gene. KIAA0252 BINDING SITE is HOST TARGET binding site found in the 3' untranslated region of mRNA encoded by KIAA0252, corresponding to a HOST TARGET binding site such as BINDING SITE I, BINDING SITE II or BINDING SITE III. Table 2 illustrates the complementarity of the nucleotide sequences of KIAA0252 BINDING SITE, designated SEQ ID:31449, to the nucleotide sequence of VGAM975 RNA, herein designated VGAM RNA, also designated SEQ ID:3686.

Another function of VGAM975 is therefore inhibition of KIAA0252 (Accession XM_031646). Accordingly, utilities of VGAM975 include diagnosis, prevention and treatment of diseases and clinical conditions associated with KIAA0252. Mal, T-cell Differentiation Protein 2 (MAL2, Accession NM_052886) is another VGAM975 host target gene. MAL2 BINDING SITE is HOST TARGET binding site found in the 3' untranslated region of mRNA encoded by MAL2, corresponding to a HOST TARGET binding site such as BINDING SITE I, BINDING SITE II or BINDING SITE III. Table 2 illustrates the complementarity of the nucleotide sequences of MAL2 BINDING SITE, designated SEQ ID:27467, to the nucleotide sequence of VGAM975 RNA, herein designated VGAM RNA, also designated SEQ ID:3686.

Another function of VGAM975 is therefore inhibition of Mal, T-cell Differentiation Protein 2 (MAL2, Accession NM_052886). Accordingly, utilities of VGAM975 include diagnosis, prevention and treatment of diseases and clinical conditions associated with MAL2. LOC122553 (Accession XM_058630) is another VGAM975 host target gene. LOC122553 BINDING SITE is HOST TARGET binding site found in the 3' untranslated region of mRNA encoded by LOC122553, corresponding to a HOST TARGET binding site such as BINDING SITE I, BINDING SITE II or BINDING SITE III. Table 2 illustrates the complementarity of the nucleotide sequences of LOC122553 BINDING SITE, designated SEQ ID:36687, to the nucleotide sequence of VGAM975 RNA, herein designated VGAM RNA, also designated SEQ ID:3686.

Another function of VGAM975 is therefore inhibition of LOC122553 (Accession XM_058630). Accordingly, utilities of VGAM975 include diagnosis, prevention and treatment of diseases and clinical conditions associated with LOC122553. LOC170425 (Accession XM_084330) is another VGAM975 host target gene. LOC170425 BINDING SITE is HOST TARGET binding site found in the 5' untranslated region of mRNA encoded by LOC170425, corresponding to a HOST TARGET binding site such as BINDING SITE I, BINDING SITE II or BINDING SITE III. Table 2 illustrates the complementarity of the nucleotide sequences of LOC170425 BINDING SITE, designated SEQ ID:37548, to the nucleotide sequence of VGAM975 RNA, herein designated VGAM RNA, also designated SEQ ID:3686.

Another function of VGAM975 is therefore inhibition of LOC170425 (Accession XM_084330). Accordingly, utilities of VGAM975 include diagnosis, prevention and treatment of diseases and clinical conditions associated with LOC170425. FIG. 1 further provides a conceptual description of a novel bioinformatically detected viral gene of the present invention, referred to here as Viral Genomic Address Messenger 976 (VGAM976) viral gene, which modulates expression of respective host target genes thereof, the function and utility of which host target genes is known in the art.

VGAM976 is a novel bioinformatically detected regulatory, non protein coding, viral micro RNA (miRNA) gene. The method by which VGAM976 was detected is described hereinabove with reference to FIGS. 1-8.

VGAM976 gene, herein designated VGAM GENE, is a viral gene contained in the genome of Camelpox Virus. VGAM976 host target gene, herein designated VGAM HOST TARGET GENE, is a human gene contained in the human genome.

VGAM976 gene encodes a VGAM976 precursor RNA, herein designated VGAM PRECURSOR RNA. Similar to other miRNA genes, and unlike most ordinary genes, VGAM976 precursor RNA does not encode a protein. A nucleotide sequence identical or highly similar to the nucleotide sequence of VGAM976 precursor RNA is designated SEQ ID:962, and is provided hereinbelow with reference to the sequence listing part. Nucleotide sequence SEQ ID:962 is located at position 48892 relative to the genome of Camelpox Virus.

VGAM976 precursor RNA folds onto itself, forming VGAM976 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM976 folded precursor RNA into VGAM976 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 69%) nucleotide sequence of VGAM976 RNA is designated SEQ ID:3687, and is provided hereinbelow with reference to the sequence listing part.

VGAM976 host target gene, herein designated VGAM HOST TARGET GENE, encodes a corresponding messenger RNA, VGAM976 host target RNA, herein designated VGAM HOST TARGET RNA. VGAM976 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM976 RNA, herein designated VGAM RNA, binds complementarily to one or more host target binding sites located in untranslated regions of VGAM976 host target RNA, herein designated VGAM HOST TARGET RNA. This complementary binding is due to the fact that the nucleotide sequence of VGAM976 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM976 RNA, herein designated VGAM RNA, may have a different number of host target binding sites in untranslated regions of a VGAM976 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM976 RNA, herein designated VGAM RNA, to host target binding sites on VGAM976 host target RNA, herein designated VGAM HOST TARGET RNA, such as BINDING SITE I, BINDING SITE II and BINDING SITE III, inhibits translation of VGAM976 host target RNA into VGAM976 host target protein, herein designated VGAM HOST TARGET PROTEIN. VGAM host target protein is therefore outlined by a broken line.

It is appreciated that VGAM976 host target gene, herein designated VGAM HOST TARGET GENE, in fact represents a plurality of VGAM976 host target genes. The mRNA of each one of this plurality of VGAM976 host target genes comprises one or more host target binding sites, each having a nucleotide sequence which is at least partly complementary to VGAM976 RNA, herein designated VGAM RNA, and which when bound by VGAM976 RNA causes inhibition of translation of respective one or more VGAM976 host target proteins.

It is further appreciated by one skilled in the art that the mode of translational inhibition illustrated by FIG. 1 with specific reference to translational inhibition exerted by VGAM976 gene, herein designated VGAM GENE, on one or more VGAM976 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM976 is inhibition of expression of host target genes, as part of a novel viral mechanism of attacking a host. Accordingly, utilities of VGAM976 include diagnosis, prevention and treatment of viral infection by Camelpox Virus. Specific functions, and accordingly utilities, of VGAM976 correlate with, and may be deduced from, the identity of the host target genes which VGAM976 binds and inhibits, and the function of these host target genes, as elaborated hereinbelow.

Nucleotide sequences of the VGAM976 precursor RNA, herein designated VGAM PRECURSOR RNA, and of the 'diced' VGAM976 RNA, herein designated VGAM RNA, and a schematic representation of the secondary folding of VGAM976 folded precursor RNA, herein designated VGAM FOLDED PRECURSOR RNA, of VGAM976 are further described hereinbelow with reference to Table 1.

Nucleotide sequences of host target binding sites, such as BINDING SITE-I, BINDING SITE-II and BINDING SITE-III of FIG. 1, found on VGAM976 host target RNA, and schematic representation of the complementarity of each of these host target binding sites to VGAM976 RNA, herein designated VGAM RNA, are described hereinbelow with reference to Table 2.

As mentioned hereinabove with reference to FIG. 1, a function of VGAM976 gene, herein designated VGAM is inhibition of expression of VGAM976 target genes. It is appreciated that specific functions, and accordingly utilities, of VGAM976 correlate with, and may be deduced from, the identity of the target genes which VGAM976 binds and inhibits, and the function of these target genes, as elaborated hereinbelow.

Fibronectin Leucine Rich Transmembrane Protein 2 (FLRT2, Accession NM_013231) is a VGAM976 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14877, to the nucleotide sequence of VGAM976 RNA, herein designated VGAM RNA, also designated SEQ ID:3687.

A function of VGAM976 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM976 include diagnosis, prevention and treatment of diseases and clinical conditions associated with FLRT2. The function of FLRT2 and its association with various diseases and clinical conditions, has been established by previous studies, as described hereinabove with reference to VGAM247. KIAA1468 (Accession XM_166289) is another VGAM976 host target gene. KIAA1468 BINDING SITE is HOST TARGET binding site found in the 3' untranslated region of mRNA encoded by KIAA1468, corresponding to a HOST TARGET binding site such as BINDING SITE I, BINDING SITE II or BINDING SITE III. Table 2 illustrates the complementarity of the nucleotide sequences of KIAA1468 BINDING SITE, designated SEQ ID:44097, to the nucleotide sequence of VGAM976 RNA, herein designated VGAM RNA, also designated SEQ ID:3687.

Another function of VGAM976 is therefore inhibition of KIAA1468 (Accession XM_166289). Accordingly, utilities of VGAM976 include diagnosis, prevention and treatment of diseases and clinical conditions associated with KIAA1468. KIAA1979 (Accession XM_113984) is another VGAM976 host target gene. KIAA1979 BINDING SITE is HOST TAR- GET binding site found in the 3' untranslated region of mRNA encoded by KIAA1979, corresponding to a HOST TARGET binding site such as BINDING SITE I, BINDING SITE II or BINDING SITE III. Table 2 illustrates the complementarity of the nucleotide sequences of KIAA1979 BINDING SITE, designated SEQ ID:42588, to the nucleotide sequence of VGAM976 RNA, herein designated VGAM RNA, also designated SEQ ID:3687.

Another function of VGAM976 is therefore inhibition of KIAA1979 (Accession XM_113984). Accordingly, utilities of VGAM976 include diagnosis, prevention and treatment of diseases and clinical conditions associated with KIAA1979. FIG. 1 further provides a conceptual description of a novel bioinformatically detected viral gene of the present invention, referred to here as Viral Genomic Address Messenger 977 (VGAM977) viral gene, which modulates expression of respective host target genes thereof, the function and utility of which host target genes is known in the art.

VGAM977 is a novel bioinformatically detected regulatory, non protein coding, viral micro RNA (miRNA) gene. The method by which VGAM977 was detected is described hereinabove with reference to FIGS. 1-8.

VGAM977 gene, herein designated VGAM GENE, is a viral gene contained in the genome of Variola Virus. VGAM977 host target gene, herein designated VGAM HOST TARGET GENE, is a human gene contained in the human genome.

VGAM977 gene encodes a VGAM977 precursor RNA, herein designated VGAM PRECURSOR RNA. Similar to other miRNA genes, and unlike most ordinary genes, VGAM977 precursor RNA does not encode a protein. A nucleotide sequence identical or highly similar to the nucleotide sequence of VGAM977 precursor RNA is designated SEQ ID:963, and is provided hereinbelow with reference to the sequence listing part. Nucleotide sequence SEQ ID:963 is located at position 38963 relative to the genome of Variola Virus.

VGAM977 precursor RNA folds onto itself, forming VGAM977 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM977 folded precursor RNA into VGAM977 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM977 RNA is designated SEQ ID:3688, and is provided hereinbelow with reference to the sequence listing part.

VGAM977 host target gene, herein designated VGAM HOST TARGET GENE, encodes a corresponding messenger RNA, VGAM977 host target RNA, herein designated VGAM HOST TARGET RNA. VGAM977 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM977 RNA, herein designated VGAM RNA, binds complementarily to one or more host target binding sites located in untranslated regions of VGAM977 host target RNA, herein designated VGAM HOST TARGET RNA. This complementary binding is due to the fact that the nucleotide sequence of VGAM977 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM977 RNA, herein designated VGAM RNA, may have a different number of host target binding sites in untranslated regions of a VGAM977 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM977 RNA, herein designated VGAM RNA, to host target binding sites on VGAM977 host target RNA, herein designated VGAM HOST TARGET RNA, such as BINDING SITE I, BINDING SITE II and BINDING SITE III, inhibits translation of VGAM977 host target RNA into VGAM977 host target protein, herein designated VGAM HOST TARGET PROTEIN. VGAM host target protein is therefore outlined by a broken line.

It is appreciated that VGAM977 host target gene, herein designated VGAM HOST TARGET GENE, in fact represents a plurality of VGAM977 host target genes. The mRNA of each one of this plurality of VGAM977 host target genes comprises one or more host target binding sites, each having a nucleotide sequence which is at least partly complementary to VGAM977 RNA, herein designated VGAM RNA, and which when bound by VGAM977 RNA causes inhibition of translation of respective one or more VGAM977 host target proteins.

It is further appreciated by one skilled in the art that the mode of translational inhibition illustrated by FIG. 1 with specific reference to translational inhibition exerted by VGAM977 gene, herein designated VGAM GENE, on one or more VGAM977 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM977 is inhibition of expression of host target genes, as part of a novel viral mechanism of attacking a host. Accordingly, utilities of VGAM977 include diagnosis, prevention and treatment of viral infection by Variola Virus. Specific functions, and accordingly utilities, of VGAM977 correlate with, and may be deduced from, the identity of the host target genes which VGAM977 binds and inhibits, and the function of these host target genes, as elaborated hereinbelow.

Nucleotide sequences of the VGAM977 precursor RNA, herein designated VGAM PRECURSOR RNA, and of the 'diced' VGAM977 RNA, herein designated VGAM RNA, and a schematic representation of the secondary folding of VGAM977 folded precursor RNA, herein designated VGAM FOLDED PRECURSOR RNA, of VGAM977 are further described hereinbelow with reference to Table 1.

Nucleotide sequences of host target binding sites, such as BINDING SITE-I, BINDING SITE-II and BINDING SITE-III of FIG. 1, found on VGAM977 host target RNA, and schematic representation of the complementarity of each of these host target binding sites to VGAM977 RNA, herein designated VGAM RNA, are described hereinbelow with reference to Table 2.

As mentioned hereinabove with reference to FIG. 1, a function of VGAM977 gene, herein designated VGAM is inhibition of expression of VGAM977 target genes. It is appreciated that specific functions, and accordingly utilities, of VGAM977 correlate with, and may be deduced from, the identity of the target genes which VGAM977 binds and inhibits, and the function of these target genes, as elaborated hereinbelow.

HIS1 (Accession NM_006460) is a VGAM977 host target gene. HIS1 BINDING SITE is HOST TARGET binding site found in the 3' untranslated region of mRNA encoded by HIS1, corresponding to a HOST TARGET binding site such as BINDING SITE I, BINDING SITE II or BINDING SITE III. Table 2 illustrates the complementarity of the nucleotide sequences of HIS1 BINDING SITE, designated SEQ ID:13179, to the nucleotide sequence of VGAM977 RNA, herein designated VGAM RNA, also designated SEQ ID:3688.

A function of VGAM977 is therefore inhibition of HIS1 (Accession NM_006460). Accordingly, utilities of VGAM977 include diagnosis, prevention and treatment of diseases and clinical conditions associated with HIS1. Inositol 1,4,5-triphosphate Receptor, Type 2 (ITPR2, Accession NM_002223) is another VGAM977 host target gene. ITPR2 BINDING SITE is HOST TARGET binding site found in the 3' untranslated region of mRNA encoded by ITPR2, corresponding to a HOST TARGET binding site such as BINDING SITE I, BINDING SITE II or BINDING SITE III. Table 2 illustrates the complementarity of the nucleotide sequences of ITPR2 BINDING SITE, designated SEQ ID:7992, to the nucleotide sequence of VGAM977 RNA, herein designated VGAM RNA, also designated SEQ ID:3688.

Another function of VGAM977 is therefore inhibition of Inositol 1,4,5-triphosphate Receptor, Type 2 (ITPR2, Accession NM_002223). Accordingly, utilities of VGAM977 include diagnosis, prevention and treatment of diseases and clinical conditions associated with ITPR2. KIAA0342 (Accession XM_047357) is another VGAM977 host target gene. KIAA0342 BINDING SITE is HOST TARGET binding site found in the 3' untranslated region of mRNA encoded by KIAA0342, corresponding to a HOST TARGET binding site such as BINDING SITE I, BINDING SITE II or BINDING SITE III. Table 2 illustrates the complementarity of the nucleotide sequences of KIAA0342 BINDING SITE, designated SEQ ID:34960, to the nucleotide sequence of VGAM977 RNA, herein designated VGAM RNA, also designated SEQ ID:3688.

Another function of VGAM977 is therefore inhibition of KIAA0342 (Accession XM_047357). Accordingly, utilities of VGAM977 include diagnosis, prevention and treatment of diseases and clinical conditions associated with KIAA0342. KIAA1948 (Accession XM_091984) is another VGAM977 host target gene. KIAA1948 BINDING SITE is HOST TARGET binding site found in the 5' untranslated region of mRNA encoded by KIAA1948, corresponding to a HOST TARGET binding site such as BINDING SITE I, BINDING SITE II or BINDING SITE III. Table 2 illustrates the complementarity of the nucleotide sequences of KIAA1948 BINDING SITE, designated SEQ ID:40083, to the nucleotide sequence of VGAM977 RNA, herein designated VGAM RNA, also designated SEQ ID:3688.

Another function of VGAM977 is therefore inhibition of KIAA1948 (Accession XM_091984). Accordingly, utilities of VGAM977 include diagnosis, prevention and treatment of diseases and clinical conditions associated with KIAA1948. MAC30 (Accession XM_031536) is another VGAM977 host target gene. MAC30 BINDING SITE is HOST TARGET binding site found in the 5' untranslated region of mRNA encoded by MAC30, corresponding to a HOST TARGET binding site such as BINDING SITE I, BINDING SITE II or BINDING SITE III. Table 2 illustrates the complementarity of the nucleotide sequences of MAC30 BINDING SITE, designated SEQ ID:31404, to the nucleotide sequence of VGAM977 RNA, herein designated VGAM RNA, also designated SEQ ID:3688.

Another function of VGAM977 is therefore inhibition of MAC30 (Accession XM_031536). Accordingly, utilities of VGAM977 include diagnosis, prevention and treatment of diseases and clinical conditions associated with MAC30. MY014 (Accession NM_030918) is another VGAM977 host target gene. MY014 BINDING SITE is HOST TARGET binding site found in the 5' untranslated region of mRNA encoded by MY014, corresponding to a HOST TARGET binding site such as BINDING SITE I, BINDING SITE II or BINDING SITE III. Table 2 illustrates the complementarity of the nucleotide sequences of MY014 BINDING SITE, designated SEQ ID:25189, to the nucleotide sequence of VGAM977 RNA, herein designated VGAM RNA, also designated SEQ ID:3688.

Another function of VGAM977 is therefore inhibition of MY014 (Accession NM_030918). Accordingly, utilities of VGAM977 include diagnosis, prevention and treatment of diseases and clinical conditions associated with MY014. LOC158056 (Accession XM_088463) is another VGAM977 host target gene. LOC158056 BINDING SITE is HOST TARGET binding site found in the 5' untranslated region of mRNA encoded by LOC158056, corresponding to a HOST TARGET binding site such as BINDING SITE I, BINDING SITE II or BINDING SITE III. Table 2 illustrates the complementarity of the nucleotide sequences of LOC158056 BINDING SITE, designated SEQ ID:39713, to the nucleotide sequence of VGAM977 RNA, herein designated VGAM RNA, also designated SEQ ID:3688.

Another function of VGAM977 is therefore inhibition of LOC158056 (Accession XM_088463). Accordingly, utilities of VGAM977 include diagnosis, prevention and treatment of diseases and clinical conditions associated with LOC158056. FIG. 1 further provides a conceptual description of a novel bioinformatically detected viral gene of the present invention, referred to here as Viral Genomic Address Messenger 978 (VGAM978) viral gene, which modulates expression of respective host target genes thereof, the function and utility of which host target genes is known in the art.

VGAM978 is a novel bioinformatically detected regulatory, non protein coding, viral micro RNA (miRNA) gene. The method by which VGAM978 was detected is described hereinabove with reference to FIGS. 1-8.

VGAM978 gene, herein designated VGAM GENE, is a viral gene contained in the genome of Ectromelia Virus. VGAM978 host target gene, herein designated VGAM HOST TARGET GENE, is a human gene contained in the human genome.

VGAM978 gene encodes a VGAM978 precursor RNA, herein designated VGAM PRECURSOR RNA. Similar to other miRNA genes, and unlike most ordinary genes, VGAM978 precursor RNA does not encode a protein. A nucleotide sequence identical or highly similar to the nucleotide sequence of VGAM978 precursor RNA is designated SEQ ID:964, and is provided hereinbelow with reference to the sequence listing part. Nucleotide sequence SEQ ID:964 is located at position 55420 relative to the genome of Ectromelia Virus.

VGAM978 precursor RNA folds onto itself, forming VGAM978 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM978 folded precursor RNA into VGAM978 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM978 RNA is designated SEQ ID:3689, and is provided hereinbelow with reference to the sequence listing part.

VGAM978 host target gene, herein designated VGAM HOST TARGET GENE, encodes a corresponding messenger RNA, VGAM978 host target RNA, herein designated VGAM HOST TARGET RNA. VGAM978 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM978 RNA, herein designated VGAM RNA, binds complementarily to one or more host target binding sites located in untranslated regions of VGAM978 host target RNA, herein designated VGAM HOST TARGET RNA. This complementary binding is due to the fact that the nucleotide sequence of VGAM978 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM978 RNA, herein designated VGAM RNA, may have a different number of host target binding sites in untranslated regions of a VGAM978 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM978 RNA, herein designated VGAM RNA, to host target binding sites on VGAM978 host target RNA, herein designated VGAM HOST TARGET RNA, such as BINDING SITE I, BINDING SITE II and BINDING SITE III, inhibits translation of VGAM978 host target RNA into VGAM978 host target protein, herein designated VGAM HOST TARGET PROTEIN. VGAM host target protein is therefore outlined by a broken line.

It is appreciated that VGAM978 host target gene, herein designated VGAM HOST TARGET GENE, in fact represents a plurality of VGAM978 host target genes. The mRNA of each one of this plurality of VGAM978 host target genes comprises one or more host target binding sites, each having a nucleotide sequence which is at least partly complementary to VGAM978 RNA, herein designated VGAM RNA, and which when bound by VGAM978 RNA causes inhibition of translation of respective one or more VGAM978 host target proteins.

It is further appreciated by one skilled in the art that the mode of translational inhibition illustrated by FIG. 1 with specific reference to translational inhibition exerted by VGAM978 gene, herein designated VGAM GENE, on one or more VGAM978 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM978 is inhibition of expression of host target genes, as part of a novel viral mechanism of attacking a host. Accordingly, utilities of VGAM978 include diagnosis, prevention and treatment of viral infection by Ectromelia Virus. Specific functions, and accordingly utilities, of VGAM978 correlate with, and may be deduced from, the identity of the host target genes which VGAM978 binds and inhibits, and the function of these host target genes, as elaborated hereinbelow.

Nucleotide sequences of the VGAM978 precursor RNA, herein designated VGAM PRECURSOR RNA, and of the 'diced' VGAM978 RNA, herein designated VGAM RNA, and a schematic representation of the secondary folding of VGAM978 folded precursor RNA, herein designated VGAM FOLDED PRECURSOR RNA, of VGAM978 are further described hereinbelow with reference to Table 1.

Nucleotide sequences of host target binding sites, such as BINDING SITE-I, BINDING SITE-II and BINDING SITE-III of FIG. 1, found on VGAM978 host target RNA, and schematic representation of the complementarity of each of these host target binding sites to VGAM978 RNA, herein designated VGAM RNA, are described hereinbelow with reference to Table 2.

As mentioned hereinabove with reference to FIG. 1, a function of VGAM978 gene, herein designated VGAM is inhibition of expression of VGAM978 target genes. It is appreciated that specific functions, and accordingly utilities, of VGAM978 correlate with, and may be deduced from, the identity of the target genes which VGAM978 binds and inhibits, and the function of these target genes, as elaborated hereinbelow.

FLJ12806 (Accession NM_022831) is a VGAM978 host target gene. FLJ12806 BINDING SITE is HOST TARGET binding site found in the 3' untranslated region of mRNA encoded by FLJ12806, corresponding to a HOST TARGET binding site such as BINDING SITE I, BINDING SITE II or BINDING SITE III. Table 2 illustrates the complementarity of the nucleotide sequences of FLJ12806 BINDING SITE, designated SEQ ID:23110, to the nucleotide sequence of VGAM978 RNA, herein designated VGAM RNA, also designated SEQ ID:3689.

A function of VGAM978 is therefore inhibition of FLJ12806 (Accession NM_022831). Accordingly, utilities of VGAM978 include diagnosis, prevention and treatment of diseases and clinical conditions associated with FLJ12806. LOC157621 (Accession XM_098800) is another VGAM978 host target gene. LOC157621 BINDING SITE is HOST TARGET binding site found in the 3' untranslated region of mRNA encoded by LOC157621, corresponding to a HOST TARGET binding site such as BINDING SITE I, BINDING SITE II or BINDING SITE III. Table 2 illustrates the complementarity of the nucleotide sequences of LOC157621 BINDING SITE, designated SEQ ID:41824, to the nucleotide sequence of VGAM978 RNA, herein designated VGAM RNA, also designated SEQ ID:3689.

Another function of VGAM978 is therefore inhibition of LOC157621 (Accession XM_098800). Accordingly, utilities of VGAM978 include diagnosis, prevention and treatment of diseases and clinical conditions associated with LOC157621. FIG. 1 further provides a conceptual description of a novel bioinformatically detected viral gene of the present invention, referred to here as Viral Genomic Address Messenger 979 (VGAM979) viral gene, which modulates expression of respective host target genes thereof, the function and utility of which host target genes is known in the art.

VGAM979 is a novel bioinformatically detected regulatory, non protein coding, viral micro RNA (miRNA) gene. The method by which VGAM979 was detected is described hereinabove with reference to FIGS. 1-8.

VGAM979 gene, herein designated VGAM GENE, is a viral gene contained in the genome of Camelpox Virus. VGAM979 host target gene, herein designated VGAM HOST TARGET GENE, is a human gene contained in the human genome.

VGAM979 gene encodes a VGAM979 precursor RNA, herein designated VGAM PRECURSOR RNA. Similar to other miRNA genes, and unlike most ordinary genes, VGAM979 precursor RNA does not encode a protein. A nucleotide sequence identical or highly similar to the nucleotide sequence of VGAM979 precursor RNA is designated SEQ ID:965, and is provided hereinbelow with reference to the sequence listing part. Nucleotide sequence SEQ ID:965 is located at position 50081 relative to the genome of Camelpox Virus.

VGAM979 precursor RNA folds onto itself, forming VGAM979 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM979 folded precursor RNA into VGAM979 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM979 RNA is designated SEQ ID:3690, and is provided hereinbelow with reference to the sequence listing part.

VGAM979 host target gene, herein designated VGAM HOST TARGET GENE, encodes a corresponding messenger RNA, VGAM979 host target RNA, herein designated VGAM HOST TARGET RNA. VGAM979 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM979 RNA, herein designated VGAM RNA, binds complementarily to one or more host target binding sites located in untranslated regions of VGAM979 host target RNA, herein designated VGAM HOST TARGET RNA. This complementary binding is due to the fact that the nucleotide sequence of VGAM979 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM979 RNA, herein designated VGAM RNA, may have a different number of host target binding sites in untranslated regions of a VGAM979 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM979 RNA, herein designated VGAM RNA, to host target binding sites on VGAM979 host target RNA, herein designated VGAM HOST TARGET RNA, such as BINDING SITE I, BINDING SITE II and BINDING SITE III, inhibits translation of VGAM979 host target RNA into VGAM979 host target protein, herein designated VGAM HOST TARGET PROTEIN. VGAM host target protein is therefore outlined by a broken line.

It is appreciated that VGAM979 host target gene, herein designated VGAM HOST TARGET GENE, in fact represents a plurality of VGAM979 host target genes. The mRNA of each one of this plurality of VGAM979 host target genes comprises one or more host target binding sites, each having a nucleotide sequence which is at least partly complementary to VGAM979 RNA, herein designated VGAM RNA, and which when bound by VGAM979 RNA causes inhibition of translation of respective one or more VGAM979 host target proteins.

It is further appreciated by one skilled in the art that the mode of translational inhibition illustrated by FIG. 1 with specific reference to translational inhibition exerted by VGAM979 gene, herein designated VGAM GENE, on one or more VGAM979 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM979 is inhibition of expression of host target genes, as part of a novel viral mechanism of attacking a host. Accordingly, utilities of VGAM979 include diagnosis, prevention and treatment of viral infection by Camelpox Virus. Specific functions, and accordingly utilities, of VGAM979 correlate with, and may be deduced from, the identity of the host target genes which VGAM979 binds and inhibits, and the function of these host target genes, as elaborated hereinbelow.

Nucleotide sequences of the VGAM979 precursor RNA, herein designated VGAM PRECURSOR RNA, and of the 'diced' VGAM979 RNA, herein designated VGAM RNA, and a schematic representation of the secondary folding of VGAM979 folded precursor RNA, herein designated VGAM FOLDED PRECURSOR RNA, of VGAM979 are further described hereinbelow with reference to Table 1.

Nucleotide sequences of host target binding sites, such as BINDING SITE-I, BINDING SITE-II and BINDING SITE-III of FIG. 1, found on VGAM979 host target RNA, and schematic representation of the complementarity of each of these host target binding sites to VGAM979 RNA, herein designated VGAM RNA, are described hereinbelow with reference to Table 2.

As mentioned hereinabove with reference to FIG. 1, a function of VGAM979 gene, herein designated VGAM is inhibition of expression of VGAM979 target genes. It is appreciated that specific functions, and accordingly utilities, of VGAM979 correlate with, and may be deduced from, the identity of the target genes which VGAM979 binds and inhibits, and the function of these target genes, as elaborated hereinbelow.

ACF (Accession NM_014576) is a VGAM979 host target gene. ACF BINDING SITE1 and ACF BINDING SITE2 are HOST TARGET binding sites found in untranslated regions of mRNA encoded by ACF, corresponding to HOST TARGET binding sites such as BINDING SITE I, BINDING SITE II or BINDING SITE III. Table 2 illustrates the complementarity of the nucleotide sequences of ACF BINDING SITE1 and ACF BINDING SITE2, designated SEQ ID:15937 and SEQ ID:29058 respectively, to the nucleotide sequence of VGAM979 RNA, herein designated VGAM RNA, also designated SEQ ID:3690.

A function of VGAM979 is therefore inhibition of ACF (Accession NM_014576). Accordingly, utilities of VGAM979 include diagnosis, prevention and treatment of diseases and clinical conditions associated with ACF. p21 (CDKN1A)-activated Kinase 7 (PAK7, Accession XM_045653) is another VGAM979 host target gene. PAK7 BINDING SITE is HOST TARGET binding site found in the 3' untranslated region of mRNA encoded by PAK7, corresponding to a HOST TARGET binding site such as BINDING SITE I, BINDING SITE II or BINDING SITE III. Table 2 illustrates the complementarity of the nucleotide sequences of PAK7 BINDING SITE, designated SEQ ID:34507, to the nucleotide sequence of VGAM979 RNA, herein designated VGAM RNA, also designated SEQ ID:3690.

Another function of VGAM979 is therefore inhibition of p21(CDKN1A)-activated Kinase 7 (PAK7, Accession XM_045653). Accordingly, utilities of VGAM979 include diagnosis, prevention and treatment of diseases and clinical conditions associated with PAK7. FIG. 1 further provides a conceptual description of a novel bioinformatically detected viral gene of the present invention, referred to here as Viral Genomic Address Messenger 980 (VGAM980) viral gene, which modulates expression of respective host target genes thereof, the function and utility of which host target genes is known in the art.

VGAM980 is a novel bioinformatically detected regulatory, non protein coding, viral micro RNA (miRNA) gene. The method by which VGAM980 was detected is described hereinabove with reference to FIGS. 1-8.

VGAM980 gene, herein designated VGAM GENE, is a viral gene contained in the genome of Ectromelia Virus. VGAM980 host target gene, herein designated VGAM HOST TARGET GENE, is a human gene contained in the human genome.

VGAM980 gene encodes a VGAM980 precursor RNA, herein designated VGAM PRECURSOR RNA. Similar to other miRNA genes, and unlike most ordinary genes, VGAM980 precursor RNA does not encode a protein. A nucleotide sequence identical or highly similar to the nucleotide sequence of VGAM980 precursor RNA is designated SEQ ID:966, and is provided hereinbelow with reference to the sequence listing part. Nucleotide sequence SEQ ID:966 is located at position 54779 relative to the genome of Ectromelia Virus.

VGAM980 precursor RNA folds onto itself, forming VGAM980 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM980 folded precursor RNA into VGAM980 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 69%) nucleotide sequence of VGAM980 RNA is designated SEQ ID:3691, and is provided hereinbelow with reference to the sequence listing part.

VGAM980 host target gene, herein designated VGAM HOST TARGET GENE, encodes a corresponding messenger RNA, VGAM980 host target RNA, herein designated VGAM HOST TARGET RNA. VGAM980 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM980 RNA, herein designated VGAM RNA, binds complementarily to one or more host target binding sites located in untranslated regions of VGAM980 host target RNA, herein designated VGAM HOST TARGET RNA. This complementary binding is due to the fact that the nucleotide sequence of VGAM980 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM980 RNA, herein designated VGAM RNA, may have a different number of host target binding sites in untranslated regions of a VGAM980 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM980 RNA, herein designated VGAM RNA, to host target binding sites on VGAM980 host target RNA, herein designated VGAM HOST TARGET RNA, such as BINDING SITE I, BINDING SITE II and BINDING SITE III, inhibits translation of VGAM980 host target RNA into VGAM980 host target protein, herein designated VGAM HOST TARGET PROTEIN. VGAM host target protein is therefore outlined by a broken line.

It is appreciated that VGAM980 host target gene, herein designated VGAM HOST TARGET GENE, in fact represents a plurality of VGAM980 host target genes. The mRNA of each one of this plurality of VGAM980 host target genes comprises one or more host target binding sites, each having a nucleotide sequence which is at least partly complementary to VGAM980 RNA, herein designated VGAM RNA, and which when bound by VGAM980 RNA causes inhibition of translation of respective one or more VGAM980 host target proteins.

It is further appreciated by one skilled in the art that the mode of translational inhibition illustrated by FIG. 1 with specific reference to translational inhibition exerted by VGAM980 gene, herein designated VGAM GENE, on one or more VGAM980 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM980 is inhibition of expression of host target genes, as part of a novel viral mechanism of attacking a host. Accordingly, utilities of VGAM980 include diagnosis, prevention and treatment of viral infection by Ectromelia Virus. Specific functions, and accordingly utilities, of VGAM980 correlate with, and may be deduced from, the identity of the host target genes which VGAM980 binds and inhibits, and the function of these host target genes, as elaborated hereinbelow.

Nucleotide sequences of the VGAM980 precursor RNA, herein designated VGAM PRECURSOR RNA, and of the 'diced' VGAM980 RNA, herein designated VGAM RNA, and a schematic representation of the secondary folding of VGAM980 folded precursor RNA, herein designated VGAM FOLDED PRECURSOR RNA, of VGAM980 are further described hereinbelow with reference to Table 1.

Nucleotide sequences of host target binding sites, such as BINDING SITE-I, BINDING SITE-II and BINDING SITE-III of FIG. 1, found on VGAM980 host target RNA, and schematic representation of the complementarity of each of these host target binding sites to VGAM980 RNA, herein designated VGAM RNA, are described hereinbelow with reference to Table 2.

As mentioned hereinabove with reference to FIG. 1, a function of VGAM980 gene, herein designated VGAM is inhibition of expression of VGAM980 target genes. It is appreciated that specific functions, and accordingly utilities, of VGAM980 correlate with, and may be deduced from, the identity of the target genes which VGAM980 binds and inhibits, and the function of these target genes, as elaborated hereinbelow.

Fibronectin Leucine Rich Transmembrane Protein 2 (FLRT2, Accession NM_013231) is a VGAM980 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14877, to the nucleotide sequence of VGAM980 RNA, herein designated VGAM RNA, also designated SEQ ID:3691.

A function of VGAM980 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM980 include diagnosis, prevention and treatment of diseases and clinical conditions associated with FLRT2. The function of FLRT2 and its association with various diseases and clinical conditions, has been established by previous studies, as described hereinabove with reference to VGAM247. KIAA1468 (Accession XM_166289) is another VGAM980 host target gene. KIAA1468 BINDING SITE is HOST TARGET binding site found in the 3' untranslated region of mRNA encoded by KIAA1468, corresponding to a HOST TARGET binding site such as BINDING SITE I, BINDING SITE II or BINDING SITE III. Table 2 illustrates the complementarity of the nucleotide sequences of KIAA1468 BINDING SITE, designated SEQ ID:44097, to the nucleotide sequence of VGAM980 RNA, herein designated VGAM RNA, also designated SEQ ID:3691.

Another function of VGAM980 is therefore inhibition of KIAA1468 (Accession XM_166289). Accordingly, utilities of VGAM980 include diagnosis, prevention and treatment of diseases and clinical conditions associated with KIAA1468. KIAA1979 (Accession XM_113984) is another VGAM980 host target gene. KIAA1979 BINDING SITE is HOST TARGET binding site found in the 3' untranslated region of mRNA encoded by KIAA1979, corresponding to a HOST TARGET binding site such as BINDING SITE I, BINDING SITE II or BINDING SITE III. Table 2 illustrates the complementarity of the nucleotide sequences of KIAA1979 BINDING SITE, designated SEQ ID:42588, to the nucleotide sequence of VGAM980 RNA, herein designated VGAM RNA, also designated SEQ ID:3691.

Another function of VGAM980 is therefore inhibition of KIAA1979 (Accession XM_113984). Accordingly, utilities of VGAM980 include diagnosis, prevention and treatment of diseases and clinical conditions associated with KIAA1979. FIG. 1 further provides a conceptual description of a novel bioinformatically detected viral gene of the present invention, referred to here as Viral Genomic Address Messenger 981 (VGAM981) viral gene, which modulates expression of respective host target genes thereof, the function and utility of which host target genes is known in the art.

VGAM981 is a novel bioinformatically detected regulatory, non protein coding, viral micro RNA (miRNA) gene. The method by which VGAM981 was detected is described hereinabove with reference to FIGS. 1-8.

VGAM981 gene, herein designated VGAM GENE, is a viral gene contained in the genome of Cowpox Virus. VGAM981 host target gene, herein designated VGAM HOST TARGET GENE, is a human gene contained in the human genome.

VGAM981 gene encodes a VGAM981 precursor RNA, herein designated VGAM PRECURSOR RNA. Similar to other miRNA genes, and unlike most ordinary genes, VGAM981 precursor RNA does not encode a protein. A nucleotide sequence identical or highly similar to the nucleotide sequence of VGAM981 precursor RNA is designated SEQ ID:967, and is provided hereinbelow with reference to the sequence listing part. Nucleotide sequence SEQ ID:967 is located at position 62393 relative to the genome of Cowpox Virus.

VGAM981 precursor RNA folds onto itself, forming VGAM981 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM981 folded precursor RNA into VGAM981 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM981 RNA is designated SEQ ID:3692, and is provided hereinbelow with reference to the sequence listing part.

VGAM981 host target gene, herein designated VGAM HOST TARGET GENE, encodes a corresponding messenger RNA, VGAM981 host target RNA, herein designated VGAM HOST TARGET RNA. VGAM981 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM981 RNA, herein designated VGAM RNA, binds complementarily to one or more host target binding sites located in untranslated regions of VGAM981 host target RNA, herein designated VGAM HOST TARGET RNA. This complementary binding is due to the fact that the nucleotide sequence of VGAM981 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM981 RNA, herein designated VGAM RNA, may have a different number of host target binding sites in untranslated regions of a VGAM981 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM981 RNA, herein designated VGAM RNA, to host target binding sites on VGAM981 host target RNA, herein designated VGAM HOST TARGET RNA, such as BINDING SITE I, BINDING SITE II and BINDING SITE III, inhibits translation of VGAM981 host target RNA into VGAM981 host target protein, herein designated VGAM HOST TARGET PROTEIN. VGAM host target protein is therefore outlined by a broken line.

It is appreciated that VGAM981 host target gene, herein designated VGAM HOST TARGET GENE, in fact represents a plurality of VGAM981 host target genes. The mRNA of each one of this plurality of VGAM981 host target genes comprises one or more host target binding sites, each having a nucleotide sequence which is at least partly complementary to VGAM981 RNA, herein designated VGAM RNA, and which when bound by VGAM981 RNA causes inhibition of translation of respective one or more VGAM981 host target proteins.

It is further appreciated by one skilled in the art that the mode of translational inhibition illustrated by FIG. 1 with specific reference to translational inhibition exerted by VGAM981 gene, herein designated VGAM GENE, on one or more VGAM981 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM981 is inhibition of expression of host target genes, as part of a novel viral mechanism of attacking a host. Accordingly, utilities of VGAM981 include diagnosis, prevention and treatment of viral infection by Cowpox Virus. Specific functions, and accordingly utilities, of VGAM981 correlate with, and may be deduced from, the identity of the host target genes which VGAM981 binds and inhibits, and the function of these host target genes, as elaborated hereinbelow.

Nucleotide sequences of the VGAM981 precursor RNA, herein designated VGAM PRECURSOR RNA, and of the 'diced' VGAM981 RNA, herein designated VGAM RNA, and a schematic representation of the secondary folding of VGAM981 folded precursor RNA, herein designated VGAM FOLDED PRECURSOR RNA, of VGAM981 are further described hereinbelow with reference to Table 1.

Nucleotide sequences of host target binding sites, such as BINDING SITE-I, BINDING SITE-II and BINDING SITE-III of FIG. 1, found on VGAM981 host target RNA, and schematic representation of the complementarity of each of these host target binding sites to VGAM981 RNA, herein designated VGAM RNA, are described hereinbelow with reference to Table 2.

As mentioned hereinabove with reference to FIG. 1, a function of VGAM981 gene, herein designated VGAM is inhibition of expression of VGAM981 target genes. It is appreciated that specific functions, and accordingly utilities, of VGAM981 correlate with, and may be deduced from, the identity of the target genes which VGAM981 binds and inhibits, and the function of these target genes, as elaborated hereinbelow.

DKFZp761O0113 (Accession NM_018409) is a VGAM981 host target gene. DKFZp761O0113 BINDING SITE is HOST TARGET binding site found in the 5' untranslated region of mRNA encoded by DKFZp761O0113, corresponding to a HOST TARGET binding site such as BINDING SITE I, BINDING SITE II or BINDING SITE III. Table 2 illustrates the complementarity of the nucleotide sequences of DKFZp761O0113 BINDING SITE, designated SEQ ID:20446, to the nucleotide sequence of VGAM981 RNA, herein designated VGAM RNA, also designated SEQ ID:3692.

A function of VGAM981 is therefore inhibition of DKFZp761O0113 (Accession NM_018409). Accordingly, utilities of VGAM981 include diagnosis, prevention and treatment of diseases and clinical conditions associated with DKFZp761O0113. KIAA1084 (Accession NM_014910) is another VGAM981 host target gene. KIAA1084 BINDING SITE is HOST TARGET binding site found in the 3' untranslated region of mRNA encoded by KIAA1084, corresponding to a HOST TARGET binding site such as BINDING SITE I, BINDING SITE II or BINDING SITE III. Table 2 illustrates the complementarity of the nucleotide sequences of KIAA1084 BINDING SITE, designated SEQ ID:17136, to the nucleotide sequence of VGAM981 RNA, herein designated VGAM RNA, also designated SEQ ID:3692.

Another function of VGAM981 is therefore inhibition of KIAA1084 (Accession NM_014910). Accordingly, utilities of VGAM981 include diagnosis, prevention and treatment of diseases and clinical conditions associated with KIAA1084. LOC158629 (Accession XM_098972) is another VGAM981 host target gene. LOC158629 BINDING SITE is HOST TARGET binding site found in the 5' untranslated region of mRNA encoded by LOC158629, corresponding to a HOST TARGET binding site such as BINDING SITE I, BINDING SITE II or BINDING SITE III. Table 2 illustrates the complementarity of the nucleotide sequences of LOC158629 BINDING SITE, designated SEQ ID:42021, to the nucleotide sequence of VGAM981 RNA, herein designated VGAM RNA, also designated SEQ ID:3692.

Another function of VGAM981 is therefore inhibition of LOC158629 (Accession XM_098972). Accordingly, utilities of VGAM981 include diagnosis, prevention and treatment of diseases and clinical conditions associated with LOC158629. FIG. 1 further provides a conceptual description of a novel bioinformatically detected viral gene of the present invention, referred to here as Viral Genomic Address Messenger 982 (VGAM982) viral gene, which modulates expression of respective host target genes thereof, the function and utility of which host target genes is known in the art.

VGAM982 is a novel bioinformatically detected regulatory, non protein coding, viral micro RNA (miRNA) gene. The method by which VGAM982 was detected is described hereinabove with reference to FIGS. 1-8.

VGAM982 gene, herein designated VGAM GENE, is a viral gene contained in the genome of Ectromelia Virus. VGAM982 host target gene, herein designated VGAM HOST TARGET GENE, is a human gene contained in the human genome.

VGAM982 gene encodes a VGAM982 precursor RNA, herein designated VGAM PRECURSOR RNA. Similar to other miRNA genes, and unlike most ordinary genes, VGAM982 precursor RNA does not encode a protein. A nucleotide sequence identical or highly similar to the nucleotide sequence of VGAM982 precursor RNA is designated SEQ ID:968, and is provided hereinbelow with reference to the sequence listing part. Nucleotide sequence SEQ ID:968 is located at position 54629 relative to the genome of Ectromelia Virus.

VGAM982 precursor RNA folds onto itself, forming VGAM982 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM982 folded precursor RNA into VGAM982 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM982 RNA is designated SEQ ID:3693, and is provided hereinbelow with reference to the sequence listing part.

VGAM982 host target gene, herein designated VGAM HOST TARGET GENE, encodes a corresponding messenger RNA, VGAM982 host target RNA, herein designated VGAM HOST TARGET RNA. VGAM982 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM982 RNA, herein designated VGAM RNA, binds complementarily to one or more host target binding sites located in untranslated regions of VGAM982 host target RNA, herein designated VGAM HOST TARGET RNA. This complementary binding is due to the fact that the nucleotide sequence of VGAM982 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM982 RNA, herein designated VGAM RNA, may have a different number of host target binding sites in untranslated regions of a VGAM982 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM982 RNA, herein designated VGAM RNA, to host target binding sites on VGAM982 host target RNA, herein designated VGAM HOST TARGET RNA, such as BINDING SITE I, BINDING SITE II and BINDING SITE III, inhibits translation of VGAM982 host target RNA into VGAM982 host target protein, herein designated VGAM HOST TARGET PROTEIN. VGAM host target protein is therefore outlined by a broken line.

It is appreciated that VGAM982 host target gene, herein designated VGAM HOST TARGET GENE, in fact represents a plurality of VGAM982 host target genes. The mRNA of each one of this plurality of VGAM982 host target genes comprises one or more host target binding sites, each having a nucleotide sequence which is at least partly complementary to VGAM982 RNA, herein designated VGAM RNA, and which when bound by VGAM982 RNA causes inhibition of translation of respective one or more VGAM982 host target proteins.

It is further appreciated by one skilled in the art that the mode of translational inhibition illustrated by FIG. 1 with specific reference to translational inhibition exerted by VGAM982 gene, herein designated VGAM GENE, on one or more VGAM982 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM982 is inhibition of expression of host target genes, as part of a novel viral mechanism of attacking a host. Accordingly, utilities of VGAM982 include diagnosis, prevention and treatment of viral infection by Ectromelia Virus. Specific functions, and accordingly utilities, of VGAM982 correlate with, and may be deduced from, the identity of the host target genes which VGAM982 binds and inhibits, and the function of these host target genes, as elaborated hereinbelow.

Nucleotide sequences of the VGAM982 precursor RNA, herein designated VGAM PRECURSOR RNA, and of the 'diced' VGAM982 RNA, herein designated VGAM RNA, and a schematic representation of the secondary folding of VGAM982 folded precursor RNA, herein designated VGAM FOLDED PRECURSOR RNA, of VGAM982 are further described hereinbelow with reference to Table 1.

Nucleotide sequences of host target binding sites, such as BINDING SITE-I, BINDING SITE-II and BINDING SITE-III of FIG. 1, found on VGAM982 host target RNA, and schematic representation of the complementarity of each of these host target binding sites to VGAM982 RNA, herein designated VGAM RNA, are described hereinbelow with reference to Table 2.

As mentioned hereinabove with reference to FIG. 1, a function of VGAM982 gene, herein designated VGAM is inhibition of expression of VGAM982 target genes. It is appreciated that specific functions, and accordingly utilities, of VGAM982 correlate with, and may be deduced from, the identity of the target genes which VGAM982 binds and inhibits, and the function of these target genes, as elaborated hereinbelow.

Leucine Zipper-EF-hand Containing Transmembrane Protein 1 (LETM1, Accession NM_012318) is a VGAM982 host target gene. LETM1 BINDING SITE is HOST TARGET binding site found in the 3' untranslated region of mRNA encoded by LETM1, corresponding to a HOST TARGET binding site such as BINDING SITE I, BINDING SITE II or BINDING SITE III. Table 2 illustrates the complementarity of the nucleotide sequences of LETM1 BINDING SITE, designated SEQ ID:14696, to the nucleotide sequence of VGAM982 RNA, herein designated VGAM RNA, also designated SEQ ID:3693.

A function of VGAM982 is therefore inhibition of Leucine Zipper-EF-hand Containing Transmembrane Protein 1 (LETM1, Accession NM_012318). Accordingly, utilities of VGAM982 include diagnosis, prevention and treatment of diseases and clinical conditions associated with LETM1. Protein Tyrosine Phosphatase, Receptor Type, O (PTPRO, Accession NM_002848) is another VGAM982 host target gene. PTPRO BINDING SITE1 through PTPRO BINDING SITE5 are HOST TARGET binding sites found in untranslated regions of mRNA encoded by PTPRO, corresponding to HOST TARGET binding sites such as BINDING SITE I, BINDING SITE II or BINDING SITE III. Table 2 illustrates the complementarity of the nucleotide sequences of PTPRO BINDING SITE1 through PTPRO BINDING SITE5, designated SEQ ID:8737, SEQ ID:25002, SEQ ID:25008, SEQ ID:25017 and SEQ ID:25026 respectively, to the nucleotide sequence of VGAM982 RNA, herein designated VGAM RNA, also designated SEQ ID:3693.

Another function of VGAM982 is therefore inhibition of Protein Tyrosine Phosphatase, Receptor Type, O (PTPRO, Accession NM_002848), a gene which may function as a cell contact receptor that mediates and controls cell-cell signals. Accordingly, utilities of VGAM982 include diagnosis, prevention and treatment of diseases and clinical conditions associated with PTPRO. The function of PTPRO and its association with various diseases and clinical conditions, has been established by previous studies, as described hereinabove with reference to VGAM140. Trichorhinophalangeal Syndrome I (TRPS1, Accession NM_014112) is another VGAM982 host target gene. TRPS1 BINDING SITE is HOST TARGET binding site found in the 3' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15355, to the nucleotide sequence of VGAM982 RNA, herein designated VGAM RNA, also designated SEQ ID:3693.

Another function of VGAM982 is therefore inhibition of Trichorhinophalangeal Syndrome I (TRPS1, Accession NM_014112), a gene which may function as a transcriptional activator protein. Accordingly, utilities of VGAM982 include diagnosis, prevention and treatment of diseases and clinical conditions associated with TRPS1. The function of TRPS1 and its association with various diseases and clinical conditions, has been established by previous studies, as described hereinabove with reference to VGAM172. ATP-binding Cassette, Sub-family C (CFTR/MRP), Member 13 (ABCC13, Accession NM_138726) is another VGAM982 host target gene. ABCC13 BINDING SITE is HOST TARGET binding site found in the 3' untranslated region of mRNA encoded by ABCC13, corresponding to a HOST TARGET binding site such as BINDING SITE I, BINDING SITE II or BINDING SITE III. Table 2 illustrates the complementarity of the nucleotide sequences of ABCC13 BINDING SITE, designated SEQ ID:28973, to the nucleotide sequence of VGAM982 RNA, herein designated VGAM RNA, also designated SEQ ID:3693.

Another function of VGAM982 is therefore inhibition of ATP-binding Cassette, Sub-family C (CFTR/MRP), Member 13 (ABCC13, Accession NM_138726). Accordingly, utilities of VGAM982 include diagnosis, prevention and treatment of diseases and clinical conditions associated with ABCC13. Chromosome 22 Open Reading Frame 20 (C22orf20, Accession NM_025225) is another VGAM982 host target gene. C22orf20 BINDING SITE is HOST TARGET binding site found in the 3' untranslated region of mRNA encoded by C22orf20, corresponding to a HOST TARGET binding site such as BINDING SITE I, BINDING SITE II or BINDING SITE III. Table 2 illustrates the complementarity of the nucleotide sequences of C22orf20 BINDING SITE, designated SEQ ID:24901, to the nucleotide sequence of VGAM982 RNA, herein designated VGAM RNA, also designated SEQ ID:3693.

Another function of VGAM982 is therefore inhibition of Chromosome 22 Open Reading Frame 20 (C22orf20, Accession NM_025225). Accordingly, utilities of VGAM982 include diagnosis, prevention and treatment of diseases and clinical conditions associated with C22orf20. FLJ12056 (Accession NM_024933) is another VGAM982 host target gene. FLJ12056 BINDING SITE is HOST TARGET binding site found in the 3' untranslated region of mRNA encoded by FLJ12056, corresponding to a HOST TARGET binding site such as BINDING SITE I, BINDING SITE II or BINDING SITE III. Table 2 illustrates the complementarity of the nucleotide sequences of FLJ12056 BINDING SITE, designated SEQ ID:24469, to the nucleotide sequence of VGAM982 RNA, herein designated VGAM RNA, also designated SEQ ID:3693.

Another function of VGAM982 is therefore inhibition of FLJ12056 (Accession NM_024933). Accordingly, utilities of VGAM982 include diagnosis, prevention and treatment of diseases and clinical conditions associated with FLJ12056. FLJ30681 (Accession XM_166291) is another VGAM982 host target gene. FLJ30681 BINDING SITE is HOST TARGET binding site found in the 3' untranslated region of mRNA encoded by FLJ30681, corresponding to a HOST TARGET binding site such as BINDING SITE I, BINDING SITE II or BINDING SITE III. Table 2 illustrates the complementarity of the nucleotide sequences of FLJ30681 BINDING SITE, designated SEQ ID:44105, to the nucleotide sequence of VGAM982 RNA, herein designated VGAM RNA, also designated SEQ ID:3693.

Another function of VGAM982 is therefore inhibition of FLJ30681 (Accession XM_166291). Accordingly, utilities of VGAM982 include diagnosis, prevention and treatment of diseases and clinical conditions associated with FLJ30681. HSA249128 (Accession NM_017583) is another VGAM982 host target gene. HSA249128 BINDING SITE is HOST TARGET binding site found in the 3' untranslated region of mRNA encoded by HSA249128, corresponding to a HOST TARGET binding site such as BINDING SITE I, BINDING SITE II or BINDING SITE III. Table 2 illustrates the complementarity of the nucleotide sequences of HSA249128 BINDING SITE, designated SEQ ID:19028, to the nucleotide sequence of VGAM982 RNA, herein designated VGAM RNA, also designated SEQ ID:3693.

Another function of VGAM982 is therefore inhibition of HSA249128 (Accession NM_017583). Accordingly, utilities of VGAM982 include diagnosis, prevention and treatment of diseases and clinical conditions associated with HSA249128. KIAA0774 (Accession XM_166270) is another VGAM982 host target gene. KIAA0774 BINDING SITE is HOST TARGET binding site found in the 5' untranslated region of mRNA encoded by KIAA0774, corresponding to a HOST TARGET binding site such as BINDING SITE I, BINDING SITE II or BINDING SITE III. Table 2 illustrates the complementarity of the nucleotide sequences of KIAA0774 BINDING SITE, designated SEQ ID:44087, to the nucleotide sequence of VGAM982 RNA, herein designated VGAM RNA, also designated SEQ ID:3693.

Another function of VGAM982 is therefore inhibition of KIAA0774 (Accession XM_166270). Accordingly, utilities of VGAM982 include diagnosis, prevention and treatment of diseases and clinical conditions associated with KIAA0774. KIAA1867 (Accession XM_170675) is another VGAM982 host target gene. KIAA1867 BINDING SITE is HOST TARGET binding site found in the 5' untranslated region of mRNA encoded by KIAA1867, corresponding to a HOST TARGET binding site such as BINDING SITE I, BINDING SITE II or BINDING SITE III. Table 2 illustrates the complementarity of the nucleotide sequences of KIAA1867 BINDING SITE, designated SEQ ID:45456, to the nucleotide sequence of VGAM982 RNA, herein designated VGAM RNA, also designated SEQ ID:3693.

Another function of VGAM982 is therefore inhibition of KIAA1867 (Accession XM_170675). Accordingly, utilities of VGAM982 include diagnosis, prevention and treatment of diseases and clinical conditions associated with KIAA1867. LAP1B (Accession XM_035429) is another VGAM982 host target gene. LAP1B BINDING SITE is HOST TARGET binding site found in the 3' untranslated region of mRNA encoded by LAP1B, corresponding to a HOST TARGET binding site such as BINDING SITE I, BINDING SITE II or BINDING SITE III. Table 2 illustrates the complementarity of the nucleotide sequences of LAP1B BINDING SITE, designated SEQ ID:32264, to the nucleotide sequence of VGAM982 RNA, herein designated VGAM RNA, also designated SEQ ID:3693.

Another function of VGAM982 is therefore inhibition of LAP1B (Accession XM_035429). Accordingly, utilities of VGAM982 include diagnosis, prevention and treatment of diseases and clinical conditions associated with LAP1B. MGC4796 (Accession XM_029031) is another VGAM982 host target gene. MGC4796 BINDING SITE is HOST TARGET binding site found in the 3' untranslated region of mRNA encoded by MGC4796, corresponding to a HOST TARGET binding site such as BINDING SITE I, BINDING SITE II or BINDING SITE III. Table 2 illustrates the complementarity of the nucleotide sequences of MGC4796 BINDING SITE, designated SEQ ID:30827, to the nucleotide sequence of VGAM982 RNA, herein designated VGAM RNA, also designated SEQ ID:3693.

Another function of VGAM982 is therefore inhibition of MGC4796 (Accession XM_029031). Accordingly, utilities of VGAM982 include diagnosis, prevention and treatment of diseases and clinical conditions associated with MGC4796. FIG. 1 further provides a conceptual description of a novel bioinformatically detected viral gene of the present invention, referred to here as Viral Genomic Address Messenger 983 (VGAM983) viral gene, which modulates expression of respective host target genes thereof, the function and utility of which host target genes is known in the art.

VGAM983 is a novel bioinformatically detected regulatory, non protein coding, viral micro RNA (miRNA) gene. The method by which VGAM983 was detected is described hereinabove with reference to FIGS. 1-8.

VGAM983 gene, herein designated VGAM GENE, is a viral gene contained in the genome of Ectromelia Virus. VGAM983 host target gene, herein designated VGAM HOST TARGET GENE, is a human gene contained in the human genome.

VGAM983 gene encodes a VGAM983 precursor RNA, herein designated VGAM PRECURSOR RNA. Similar to other miRNA genes, and unlike most ordinary genes, VGAM983 precursor RNA does not encode a protein. A nucleotide sequence identical or highly similar to the nucleotide sequence of VGAM983 precursor RNA is designated SEQ ID:969, and is provided hereinbelow with reference to the sequence listing part. Nucleotide sequence SEQ ID:969 is located at position 54050 relative to the genome of Ectromelia Virus.

VGAM983 precursor RNA folds onto itself, forming VGAM983 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM983 folded precursor RNA into VGAM983 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM983 RNA is designated SEQ ID:3694, and is provided hereinbelow with reference to the sequence listing part.

VGAM983 host target gene, herein designated VGAM HOST TARGET GENE, encodes a corresponding messenger RNA, VGAM983 host target RNA, herein designated VGAM HOST TARGET RNA. VGAM983 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM983 RNA, herein designated VGAM RNA, binds complementarily to one or more host target binding sites located in untranslated regions of VGAM983 host target RNA, herein designated VGAM HOST TARGET RNA. This complementary binding is due to the fact that the nucleotide sequence of VGAM983 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM983 RNA, herein designated VGAM RNA, may have a different number of host target binding sites in untranslated regions of a VGAM983 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM983 RNA, herein designated VGAM RNA, to host target binding sites on VGAM983 host target RNA, herein designated VGAM HOST TARGET RNA, such as BINDING SITE I, BINDING SITE II and BINDING SITE III, inhibits translation of VGAM983 host target RNA into VGAM983 host target protein, herein designated VGAM HOST TARGET PROTEIN. VGAM host target protein is therefore outlined by a broken line.

It is appreciated that VGAM983 host target gene, herein designated VGAM HOST TARGET GENE, in fact represents a plurality of VGAM983 host target genes. The mRNA of each one of this plurality of VGAM983 host target genes comprises one or more host target binding sites, each having a nucleotide sequence which is at least partly complementary to VGAM983 RNA, herein designated VGAM RNA, and which when bound by VGAM983 RNA causes inhibition of translation of respective one or more VGAM983 host target proteins.

It is further appreciated by one skilled in the art that the mode of translational inhibition illustrated by FIG. 1 with specific reference to translational inhibition exerted by VGAM983 gene, herein designated VGAM GENE, on one or more VGAM983 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM983 is inhibition of expression of host target genes, as part of a novel viral mechanism of attacking a host. Accordingly, utilities of VGAM983 include diagnosis, prevention and treatment of viral infection by Ectromelia Virus. Specific functions, and accordingly utilities, of VGAM983 correlate with, and may be deduced from, the identity of the host target genes which VGAM983 binds and inhibits, and the function of these host target genes, as elaborated hereinbelow.

Nucleotide sequences of the VGAM983 precursor RNA, herein designated VGAM PRECURSOR RNA, and of the 'diced' VGAM983 RNA, herein designated VGAM RNA, and a schematic representation of the secondary folding of VGAM983 folded precursor RNA, herein designated VGAM FOLDED PRECURSOR RNA, of VGAM983 are further described hereinbelow with reference to Table 1.

Nucleotide sequences of host target binding sites, such as BINDING SITE-I, BINDING SITE-II and BINDING SITE-III of FIG. 1, found on VGAM983 host target RNA, and schematic representation of the complementarity of each of these host target binding sites to VGAM983 RNA, herein designated VGAM RNA, are described hereinbelow with reference to Table 2.

As mentioned hereinabove with reference to FIG. 1, a function of VGAM983 gene, herein designated VGAM is inhibition of expression of VGAM983 target genes. It is appreciated that specific functions, and accordingly utilities, of VGAM983 correlate with, and may be deduced from, the identity of the target genes which VGAM983 binds and inhibits, and the function of these target genes, as elaborated hereinbelow.

Sulfotransferase Family, Cytosolic, 1C, Member 1 (SULT1C1, Accession NM_001056) is a VGAM983 host target gene. SULT1C1 BINDING SITE is HOST TARGET binding site found in the 3' untranslated region of mRNA encoded by SULT1C1, corresponding to a HOST TARGET binding site such as BINDING SITE I, BINDING SITE II or BINDING SITE III. Table 2 illustrates the complementarity of the nucleotide sequences of SULT1C1 BINDING SITE, designated SEQ ID:6718, to the nucleotide sequence of VGAM983 RNA, herein designated VGAM RNA, also designated SEQ ID:3694.

A function of VGAM983 is therefore inhibition of Sulfotransferase Family, Cytosolic, 1C, Member 1 (SULT1C1, Accession NM_001056). Accordingly, utilities of VGAM983 include diagnosis, prevention and treatment of diseases and clinical conditions associated with SULT1C1. Chromosome X Open Reading Frame 1 (CXorf1, Accession NM_004709) is another VGAM983 host target gene. CXorf1 BINDING SITE is HOST TARGET binding site found in the 3' untranslated region of mRNA encoded by CXorf1, corresponding to a HOST TARGET binding site such as BINDING SITE I, BINDING SITE II or BINDING SITE III. Table 2 illustrates the complementarity of the nucleotide sequences of CXorf1 BINDING SITE, designated SEQ ID:11052, to the nucleotide sequence of VGAM983 RNA, herein designated VGAM RNA, also designated SEQ ID:3694.

Another function of VGAM983 is therefore inhibition of Chromosome X Open Reading Frame 1 (CXorf1, Accession NM_004709). Accordingly, utilities of VGAM983 include diagnosis, prevention and treatment of diseases and clinical conditions associated with CXorf1. KIAA1211 (Accession XM_044178) is another VGAM983 host target gene. KIAA1211 BINDING SITE is HOST TARGET binding site found in the 3' untranslated region of mRNA encoded by KIAA1211, corresponding to a HOST TARGET binding site such as BINDING SITE I, BINDING SITE II or BINDING SITE III. Table 2 illustrates the complementarity of the nucleotide sequences of KIAA1211 BINDING SITE, designated SEQ ID:34164, to the nucleotide sequence of VGAM983 RNA, herein designated VGAM RNA, also designated SEQ ID:3694.

Another function of VGAM983 is therefore inhibition of KIAA1211 (Accession XM_044178). Accordingly, utilities of VGAM983 include diagnosis, prevention and treatment of diseases and clinical conditions associated with KIAA1211. SH3 Domain Binding Glutamic Acid-rich Protein Like (SH3BGRL, Accession XM_030373) is another VGAM983 host target gene. SH3BGRL BINDING SITE is HOST TARGET binding site found in the 3' untranslated region of mRNA encoded by SH3BGRL, corresponding to a HOST TARGET binding site such as BINDING SITE I, BINDING SITE II or BINDING SITE III. Table 2 illustrates the complementarity of the nucleotide sequences of SH3BGRL BINDING SITE, designated SEQ ID:31022, to the nucleotide sequence of VGAM983 RNA, herein designated VGAM RNA, also designated SEQ ID:3694.

Another function of VGAM983 is therefore inhibition of SH3 Domain Binding Glutamic Acid-rich Protein Like (SH3BGRL, Accession XM_030373). Accordingly, utilities of VGAM983 include diagnosis, prevention and treatment of diseases and clinical conditions associated with SH3BGRL. LOC221143 (Accession XM_167986) is another VGAM983 host target gene. LOC221143 BINDING SITE is HOST TARGET binding site found in the 3' untranslated region of mRNA encoded by LOC221143, corresponding to a HOST TARGET binding site such as BINDING SITE I, BINDING SITE II or BINDING SITE III. Table 2 illustrates the complementarity of the nucleotide sequences of LOC221143 BINDING SITE, designated SEQ ID:44940, to the nucleotide sequence of VGAM983 RNA, herein designated VGAM RNA, also designated SEQ ID:3694.

Another function of VGAM983 is therefore inhibition of LOC221143 (Accession XM_167986). Accordingly, utilities of VGAM983 include diagnosis, prevention and treatment of diseases and clinical conditions associated with LOC221143. FIG. 1 further provides a conceptual description of a novel bioinformatically detected viral gene of the present invention, referred to here as Viral Genomic Address Messenger 984 (VGAM984) viral gene, which modulates expression of respective host target genes thereof, the function and utility of which host target genes is known in the art.

VGAM984 is a novel bioinformatically detected regulatory, non protein coding, viral micro RNA (miRNA) gene. The method by which VGAM984 was detected is described hereinabove with reference to FIGS. 1-8.

VGAM984 gene, herein designated VGAM GENE, is a viral gene contained in the genome of Cowpox Virus. VGAM984 host target gene, herein designated VGAM HOST TARGET GENE, is a human gene contained in the human genome.

VGAM984 gene encodes a VGAM984 precursor RNA, herein designated VGAM PRECURSOR RNA. Similar to other miRNA genes, and unlike most ordinary genes, VGAM984 precursor RNA does not encode a protein. A nucleotide sequence identical or highly similar to the nucleotide sequence of VGAM984 precursor RNA is designated SEQ ID:970, and is provided hereinbelow with reference to the sequence listing part. Nucleotide sequence SEQ ID:970 is located at position 64055 relative to the genome of Cowpox Virus.

VGAM984 precursor RNA folds onto itself, forming VGAM984 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM984 folded precursor RNA into VGAM984 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM984 RNA is designated SEQ ID:3695, and is provided hereinbelow with reference to the sequence listing part.

VGAM984 host target gene, herein designated VGAM HOST TARGET GENE, encodes a corresponding messenger RNA, VGAM984 host target RNA, herein designated VGAM HOST TARGET RNA. VGAM984 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM984 RNA, herein designated VGAM RNA, binds complementarily to one or more host target binding sites located in untranslated regions of VGAM984 host target RNA, herein designated VGAM HOST TARGET RNA. This complementary binding is due to the fact that the nucleotide sequence of VGAM984 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM984 RNA, herein designated VGAM RNA, may have a different number of host target binding sites in untranslated regions of a VGAM984 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM984 RNA, herein designated VGAM RNA, to host target binding sites on VGAM984 host target RNA, herein designated VGAM HOST TARGET RNA, such as BINDING SITE I, BINDING SITE II and BINDING SITE III, inhibits translation of VGAM984 host target RNA into VGAM984 host target protein, herein designated VGAM HOST TARGET PROTEIN. VGAM host target protein is therefore outlined by a broken line.

It is appreciated that VGAM984 host target gene, herein designated VGAM HOST TARGET GENE, in fact represents a plurality of VGAM984 host target genes. The mRNA of each one of this plurality of VGAM984 host target genes comprises one or more host target binding sites, each having a nucleotide sequence which is at least partly complementary to VGAM984 RNA, herein designated VGAM RNA, and which when bound by VGAM984 RNA causes inhibition of translation of respective one or more VGAM984 host target proteins.

It is further appreciated by one skilled in the art that the mode of translational inhibition illustrated by FIG. 1 with specific reference to translational inhibition exerted by VGAM984 gene, herein designated VGAM GENE, on one or more VGAM984 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM984 is inhibition of expression of host target genes, as part of a novel viral mechanism of attacking a host. Accordingly, utilities of VGAM984 include diagnosis, prevention and treatment of viral infection by Cowpox Virus. Specific functions, and accordingly utilities, of VGAM984 correlate with, and may be deduced from, the identity of the host target genes which VGAM984 binds and inhibits, and the function of these host target genes, as elaborated hereinbelow.

Nucleotide sequences of the VGAM984 precursor RNA, herein designated VGAM PRECURSOR RNA, and of the 'diced' VGAM984 RNA, herein designated VGAM RNA, and a schematic representation of the secondary folding of VGAM984 folded precursor RNA, herein designated VGAM FOLDED PRECURSOR RNA, of VGAM984 are further described hereinbelow with reference to Table 1.

Nucleotide sequences of host target binding sites, such as BINDING SITE-I, BINDING SITE-II and BINDING SITE-III of FIG. 1, found on VGAM984 host target RNA, and schematic representation of the complementarity of each of these host target binding sites to VGAM984 RNA, herein designated VGAM RNA, are described hereinbelow with reference to Table 2.

As mentioned hereinabove with reference to FIG. 1, a function of VGAM984 gene, herein designated VGAM is inhibition of expression of VGAM984 target genes. It is appreciated that specific functions, and accordingly utilities, of VGAM984 correlate with, and may be deduced from, the identity of the target genes which VGAM984 binds and inhibits, and the function of these target genes, as elaborated hereinbelow.

KIAA0442 (Accession NM_015570) is a VGAM984 host target gene. KIAA0442 BINDING SITE is HOST TARGET binding site found in the 3' untranslated region of mRNA encoded by KIAA0442, corresponding to a HOST TARGET binding site such as BINDING SITE I, BINDING SITE II or BINDING SITE III. Table 2 illustrates the complementarity of the nucleotide sequences of KIAA0442 BINDING SITE, designated SEQ ID:17842, to the nucleotide sequence of VGAM984 RNA, herein designated VGAM RNA, also designated SEQ ID:3695.

A function of VGAM984 is therefore inhibition of KIAA0442 (Accession NM_015570). Accordingly, utilities of VGAM984 include diagnosis, prevention and treatment of diseases and clinical conditions associated with KIAA0442. KIAA0711 (Accession NM_014867) is another VGAM984 host target gene. KIAA0711 BINDING SITE is HOST TARGET binding site found in the 3' untranslated region of mRNA encoded by KIAA0711, corresponding to a HOST TARGET binding site such as BINDING SITE I, BINDING SITE II or BINDING SITE III. Table 2 illustrates the complementarity of the nucleotide sequences of KIAA0711 BINDING SITE, designated SEQ ID:16953, to the nucleotide sequence of VGAM984 RNA, herein designated VGAM RNA, also designated SEQ ID:3695.

Another function of VGAM984 is therefore inhibition of KIAA0711 (Accession NM_014867). Accordingly, utilities of VGAM984 include diagnosis, prevention and treatment of diseases and clinical conditions associated with KIAA0711. KIAA1240 (Accession XM_039676) is another VGAM984 host target gene. KIAA1240 BINDING SITE is HOST TARGET binding site found in the 3' untranslated region of mRNA encoded by KIAA1240, corresponding to a HOST TARGET binding site such as BINDING SITE I, BINDING SITE II or BINDING SITE III. Table 2 illustrates the complementarity of the nucleotide sequences of KIAA1240 BINDING SITE, designated SEQ ID:33143, to the nucleotide sequence of VGAM984 RNA, herein designated VGAM RNA, also designated SEQ ID:3695.

Another function of VGAM984 is therefore inhibition of KIAA1240 (Accession XM_039676). Accordingly, utilities of VGAM984 include diagnosis, prevention and treatment of diseases and clinical conditions associated with KIAA1240. PRO0245 (Accession NM_014122) is another VGAM984 host target gene. PRO0245 BINDING SITE is HOST TARGET binding site found in the 5' untranslated region of mRNA encoded by PRO0245, corresponding to a HOST TARGET binding site such as BINDING SITE I, BINDING SITE II or BINDING SITE III. Table 2 illustrates the complementarity of the nucleotide sequences of PRO0245 BINDING SITE, designated SEQ ID:15376, to the nucleotide sequence of VGAM984 RNA, herein designated VGAM RNA, also designated SEQ ID:3695.

Another function of VGAM984 is therefore inhibition of PRO0245 (Accession NM_014122). Accordingly, utilities of VGAM984 include diagnosis, prevention and treatment of diseases and clinical conditions associated with PRO0245. ZFD25 (Accession NM_016220) is another VGAM984 host target gene. ZFD25 BINDING SITE is HOST TARGET binding site found in the 3' untranslated region of mRNA encoded by ZFD25, corresponding to a HOST TARGET binding site such as BINDING SITE I, BINDING SITE II or BINDING SITE III. Table 2 illustrates the complementarity of the nucleotide sequences of ZFD25 BINDING SITE, designated SEQ ID:18319, to the nucleotide sequence of VGAM984 RNA, herein designated VGAM RNA, also designated SEQ ID:3695.

Another function of VGAM984 is therefore inhibition of ZFD25 (Accession NM_016220). Accordingly, utilities of VGAM984 include diagnosis, prevention and treatment of diseases and clinical conditions associated with ZFD25. LOC157381 (Accession XM_098754) is another VGAM984 host target gene. LOC157381 BINDING SITE is HOST TARGET binding site found in the 3' untranslated region of mRNA encoded by LOC157381, corresponding to a HOST TARGET binding site such as BINDING SITE I, BINDING SITE II or BINDING SITE III. Table 2 illustrates the complementarity of the nucleotide sequences of LOC157381 BINDING SITE, designated SEQ ID:41792, to the nucleotide sequence of VGAM984 RNA, herein designated VGAM RNA, also designated SEQ ID:3695.

Another function of VGAM984 is therefore inhibition of LOC157381 (Accession XM_098754). Accordingly, utilities of VGAM984 include diagnosis, prevention and treatment of diseases and clinical conditions associated with LOC157381. FIG. 1 further provides a conceptual description of a novel bioinformatically detected viral gene of the present invention, referred to here as Viral Genomic Address Messenger 985 (VGAM985) viral gene, which modulates expression of respective host target genes thereof, the function and utility of which host target genes is known in the art.

VGAM985 is a novel bioinformatically detected regulatory, non protein coding, viral micro RNA (miRNA) gene. The method by which VGAM985 was detected is described hereinabove with reference to FIGS. 1-8.

VGAM985 gene, herein designated VGAM GENE, is a viral gene contained in the genome of Human Herpesvirus 3. VGAM985 host target gene, herein designated VGAM HOST TARGET GENE, is a human gene contained in the human genome.

VGAM985 gene encodes a VGAM985 precursor RNA, herein designated VGAM PRECURSOR RNA. Similar to other miRNA genes, and unlike most ordinary genes, VGAM985 precursor RNA does not encode a protein. A nucleotide sequence identical or highly similar to the nucleotide sequence of VGAM985 precursor RNA is designated SEQ ID:971, and is provided hereinbelow with reference to the sequence listing part. Nucleotide sequence SEQ ID:971 is located at position 26086 relative to the genome of Human Herpesvirus 3.

VGAM985 precursor RNA folds onto itself, forming VGAM985 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM985 folded precursor RNA into VGAM985 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM985 RNA is designated SEQ ID:3696, and is provided hereinbelow with reference to the sequence listing part.

VGAM985 host target gene, herein designated VGAM HOST TARGET GENE, encodes a corresponding messenger RNA, VGAM985 host target RNA, herein designated VGAM HOST TARGET RNA. VGAM985 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM985 RNA, herein designated VGAM RNA, binds complementarily to one or more host target binding sites located in untranslated regions of VGAM985 host target RNA, herein designated VGAM HOST TARGET RNA. This complementary binding is due to the fact that the nucleotide sequence of VGAM985 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM985 RNA, herein designated VGAM RNA, may have a different number of host target binding sites in untranslated regions of a VGAM985 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM985 RNA, herein designated VGAM RNA, to host target binding sites on VGAM985 host target RNA, herein designated VGAM HOST TARGET RNA, such as BINDING SITE I, BINDING SITE II and BINDING SITE III, inhibits translation of VGAM985 host target RNA into VGAM985 host target protein, herein designated VGAM HOST TARGET PROTEIN. VGAM host target protein is therefore outlined by a broken line.

It is appreciated that VGAM985 host target gene, herein designated VGAM HOST TARGET GENE, in fact represents a plurality of VGAM985 host target genes. The mRNA of each one of this plurality of VGAM985 host target genes comprises one or more host target binding sites, each having a nucleotide sequence which is at least partly complementary to VGAM985 RNA, herein designated VGAM RNA, and which when bound by VGAM985 RNA causes inhibition of translation of respective one or more VGAM985 host target proteins.

It is further appreciated by one skilled in the art that the mode of translational inhibition illustrated by FIG. 1 with specific reference to translational inhibition exerted by VGAM985 gene, herein designated VGAM GENE, on one or more VGAM985 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM985 is inhibition of expression of host target genes, as part of a novel viral mechanism of attacking a host. Accordingly, utilities of VGAM985 include diagnosis, prevention and treatment of viral infection by Human Herpesvirus 3. Specific functions, and accordingly utilities, of VGAM985 correlate with, and may be deduced from, the identity of the host target genes which VGAM985 binds and inhibits, and the function of these host target genes, as elaborated hereinbelow.

Nucleotide sequences of the VGAM985 precursor RNA, herein designated VGAM PRECURSOR RNA, and of the 'diced' VGAM985 RNA, herein designated VGAM RNA, and a schematic representation of the secondary folding of VGAM985 folded precursor RNA, herein designated VGAM FOLDED PRECURSOR RNA, of VGAM985 are further described hereinbelow with reference to Table 1.

Nucleotide sequences of host target binding sites, such as BINDING SITE-I, BINDING SITE-II and BINDING SITE-III of FIG. 1, found on VGAM985 host target RNA, and schematic representation of the complementarity of each of these host target binding sites to VGAM985 RNA, herein designated VGAM RNA, are described hereinbelow with reference to Table 2.

As mentioned hereinabove with reference to FIG. 1, a function of VGAM985 gene, herein designated VGAM is inhibition of expression of VGAM985 target genes. It is appreciated that specific functions, and accordingly utilities, of VGAM985 correlate with, and may be deduced from, the identity of the target genes which VGAM985 binds and inhibits, and the function of these target genes, as elaborated hereinbelow.

Myosin XVA (MYO15A, Accession NM_016239) is a VGAM985 host target gene. MYO15A BINDING SITE is HOST TARGET binding site found in the 5' untranslated region of mRNA encoded by MYO15A, corresponding to a HOST TARGET binding site such as BINDING SITE I, BINDING SITE II or BINDING SITE III. Table 2 illustrates the complementarity of the nucleotide sequences of MYO15A BINDING SITE, designated SEQ ID:18353, to the nucleotide sequence of VGAM985 RNA, herein designated VGAM RNA, also designated SEQ ID:3696.

A function of VGAM985 is therefore inhibition of Myosin XVA (MYO15A, Accession NM_016239), a gene which acts as actin-based motors. Accordingly, utilities of VGAM985 include diagnosis, prevention and treatment of diseases and clinical conditions associated with MYO15A. The function of MYO15A has been established by previous studies. Shaker-2 (sh2) is a recessive mouse mutation on chromosome 11 that arose in the progeny of an x-ray irradiated mouse and has been proposed as the mouse model of DFNB3 (OMIM Ref. No. 600316), an autosomal recessive form of human deafness that maps to 17p11.2. Affected mice lack normal startle response to sound and show no auditory brain stem responses to sound pressure levels up to high levels, indicating profound deafness. Associated vestibular defects cause head-tossing and circling behavior. Fine genetic mapping of the sh2 gene identified 4 genes in a region of chromosome 11 that have homologs mapping to 17p11.2 in the human. Complete 1-Mb yeast artificial chromosome (YAC) and bacterial artificial chromosome (BAC) contigs that spanned the shaker-2 critical region were generated. Because there were no compelling candidate genes in the nonrecombinant region, Probst et al. (1998) adopted an in vivo complementation approach to narrow the sh2 critical region. A BAC transgene from the shaker-2 critical region corrected the vestibular defects, deafness, and inner ear morphology of shaker-2 mice. An unconventional myosin gene, Myo15, was discovered by DNA sequencing of this BAC. Shaker-2 mice were found to have an amino acid substitution at a highly conserved position within the motor domain of this myosin. Auditory hair cells of shaker-2 mice have very short stereocilia and a long actin-containing protrusion extending from the basal end. This histopathology suggests that Myo15 is necessary for actin organization in the hair cells of the cochlea. In 3 consanguineous families from Pakistan and India, Liburd et al. (2001) found novel homozygous mutations in the MYO15A gene associated with profound congenital hearing loss, including Q1229X (602666.0004), IVS4+1G-T (602666.0005), and Q2716H (602666.0006). In addition, a hemizygous missense mutation, T2205I (602666.0007), was found in a patient with Smith-Magenis syndrome (OMIM Ref. No. 182290) due to a deletion in 17p11.2. The patient had moderately severe hearing loss. The mother was heterozygous for the T2205I mutation.

Full details of the abovementioned studies are described in the following publications, the disclosure of which are hereby incorporated by reference:

Liburd, N.; Ghosh, M.; Riazuddin, S.; Naz, S.; Khan, S.; Ahmed, Z.; Riazuddin, S.; Liang, Y.; Menon, P. S. N.; Smith, T.; Smith, A. C. M.; Chen, K.-S.; Lupski, J. R.; Wilcox, E. R.; Potocki, L.; Friedman, T. B.: Novel mutations of MYO15A associated with profound deafness in consanguineous families and moderately severe hearing loss in a patient with Smith-Magenis syndrome. Hum. Genet. 109:535-541, 2001; and Probst, F. J.; Fridell, R. A.; Raphael, Y.; Saunders, T. L.; Wang, A.; Liang, Y.; Morell, R. J.; Touchman, J. W.; Lyons, R. H.; Noben-Trauth, K.; Friedman, T. B.; Camper, S. A.: Corre.

Further studies establishing the function and utilities of MYO15A are found in John Hopkins OMIM database record ID 602666, and in sited publications numbered 722 and 7223-7224 listed in the bibliography section hereinbelow, which are also hereby incorporated by reference. KIAA0514 (Accession NM_014696) is another VGAM985 host target gene. KIAA0514 BINDING SITE is HOST TARGET binding site found in the 3' untranslated region of mRNA encoded by KIAA0514, corresponding to a HOST TARGET binding site such as BINDING SITE I, BINDING SITE II or BINDING SITE III. Table 2 illustrates the complementarity of the nucleotide sequences of KIAA0514 BINDING SITE, designated SEQ ID:16202, to the nucleotide sequence of VGAM985 RNA, herein designated VGAM RNA, also designated SEQ ID:3696.

Another function of VGAM985 is therefore inhibition of KIAA0514 (Accession NM_014696). Accordingly, utilities of VGAM985 include diagnosis, prevention and treatment of diseases and clinical conditions associated with KIAA0514. Mitogen-activated Protein Kinase Kinase 3 (MAP2K3, Accession NM_145109) is another VGAM985 host target gene. MAP2K3 BINDING SITE1 and MAP2K3 BINDING SITE2 are HOST TARGET binding sites found in untranslated regions of mRNA encoded by MAP2K3, corresponding to HOST TARGET binding sites such as BINDING SITE I, BINDING SITE II or BINDING SITE III. Table 2 illustrates the complementarity of the nucleotide sequences of MAP2K3 BINDING SITE1 and MAP2K3 BINDING SITE2, designated SEQ ID:29713 and SEQ ID:8636 respectively, to the nucleotide sequence of VGAM985 RNA, herein designated VGAM RNA, also designated SEQ ID:3696.

Another function of VGAM985 is therefore inhibition of Mitogen-activated Protein Kinase Kinase 3 (MAP2K3, Accession NM_145109). Accordingly, utilities of VGAM985 include diagnosis, prevention and treatment of diseases and clinical conditions associated with MAP2K3. LOC148824 (Accession XM_097527) is another VGAM985 host target gene. LOC148824 BINDING SITE is HOST TARGET binding site found in the 3' untranslated region of mRNA encoded by LOC148824, corresponding to a HOST TARGET binding site such as BINDING SITE I, BINDING SITE II or BINDING SITE III. Table 2 illustrates the complementarity of the nucleotide sequences of LOC148824 BINDING SITE, designated SEQ ID:40906, to the nucleotide sequence of VGAM985 RNA, herein designated VGAM RNA, also designated SEQ ID:3696.

Another function of VGAM985 is therefore inhibition of LOC148824 (Accession XM_097527). Accordingly, utilities of VGAM985 include diagnosis, prevention and treatment of diseases and clinical conditions associated with LOC148824. LOC219690 (Accession XM_167572) is another VGAM985 host target gene. LOC219690 BINDING SITE is HOST TARGET binding site found in the 5' untranslated region of mRNA encoded by LOC219690, corresponding to a HOST TARGET binding site such as BINDING SITE I, BINDING SITE II or BINDING SITE III. Table 2 illustrates the complementarity of the nucleotide sequences of LOC219690 BINDING SITE, designated SEQ ID:44705, to the nucleotide sequence of VGAM985 RNA, herein designated VGAM RNA, also designated SEQ ID:3696.

Another function of VGAM985 is therefore inhibition of LOC219690 (Accession XM_167572). Accordingly, utilities of VGAM985 include diagnosis, prevention and treatment of diseases and clinical conditions associated with LOC219690. LOC221431 (Accession XM_166380) is another VGAM985 host target gene. LOC221431 BINDING SITE is HOST TARGET binding site found in the 3' untranslated region of mRNA encoded by LOC221431, corresponding to a HOST TARGET binding site such as BINDING SITE I, BINDING SITE II or BINDING SITE III. Table 2 illustrates the complementarity of the nucleotide sequences of LOC221431 BINDING SITE, designated SEQ ID:44221, to the nucleotide sequence of VGAM985 RNA, herein designated VGAM RNA, also designated SEQ ID:3696.

Another function of VGAM985 is therefore inhibition of LOC221431 (Accession XM_166380). Accordingly, utilities of VGAM985 include diagnosis, prevention and treatment of diseases and clinical conditions associated with LOC221431. LOC255533 (Accession XM_173073) is another VGAM985 host target gene. LOC255533 BINDING SITE is HOST TARGET binding site found in the 5' untranslated region of mRNA encoded by LOC255533, corresponding to a HOST TARGET binding site such as BINDING SITE I, BINDING SITE II or BINDING SITE III. Table 2 illustrates the complementarity of the nucleotide sequences of LOC255533 BINDING SITE, designated SEQ ID:46329, to the nucleotide sequence of VGAM985 RNA, herein designated VGAM RNA, also designated SEQ ID:3696.

Another function of VGAM985 is therefore inhibition of LOC255533 (Accession XM_173073). Accordingly, utilities of VGAM985 include diagnosis, prevention and treatment of diseases and clinical conditions associated with LOC255533. FIG. 1 further provides a conceptual description of a novel bioinformatically detected viral gene of the present invention, referred to here as Viral Genomic Address Messenger 986 (VGAM986) viral gene, which modulates expression of respective host target genes thereof, the function and utility of which host target genes is known in the art.

VGAM986 is a novel bioinformatically detected regulatory, non protein coding, viral micro RNA (miRNA) gene. The method by which VGAM986 was detected is described hereinabove with reference to FIGS. 1-8.

VGAM986 gene, herein designated VGAM GENE, is a viral gene contained in the genome of Leishmania RNA Virus 1-4. VGAM986 host target gene, herein designated VGAM HOST TARGET GENE, is a human gene contained in the human genome.

VGAM986 gene encodes a VGAM986 precursor RNA, herein designated VGAM PRECURSOR RNA. Similar to other miRNA genes, and unlike most ordinary genes, VGAM986 precursor RNA does not encode a protein. A nucleotide sequence identical or highly similar to the nucleotide sequence of VGAM986 precursor RNA is designated SEQ ID:972, and is provided hereinbelow with reference to the sequence listing part. Nucleotide sequence SEQ ID:972 is located at position 377 relative to the genome of Leishmania RNA Virus 1-4.

VGAM986 precursor RNA folds onto itself, forming VGAM986 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM986 folded precursor RNA into VGAM986 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM986 RNA is designated SEQ ID:3697, and is provided hereinbelow with reference to the sequence listing part.

VGAM986 host target gene, herein designated VGAM HOST TARGET GENE, encodes a corresponding messenger RNA, VGAM986 host target RNA, herein designated VGAM HOST TARGET RNA. VGAM986 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM986 RNA, herein designated VGAM RNA, binds complementarily to one or more host target binding sites located in untranslated regions of VGAM986 host target RNA, herein designated VGAM HOST TARGET RNA. This complementary binding is due to the fact that the nucleotide sequence of VGAM986 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM986 RNA, herein designated VGAM RNA, may have a different number of host target binding sites in untranslated regions of a VGAM986 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM986 RNA, herein designated VGAM RNA, to host target binding sites on VGAM986 host target RNA, herein designated VGAM HOST TARGET RNA, such as BINDING SITE I, BINDING SITE II and BINDING SITE III, inhibits translation of VGAM986 host target RNA into VGAM986 host target protein, herein designated VGAM HOST TARGET PROTEIN. VGAM host target protein is therefore outlined by a broken line.

It is appreciated that VGAM986 host target gene, herein designated VGAM HOST TARGET GENE, in fact represents a plurality of VGAM986 host target genes. The mRNA of each one of this plurality of VGAM986 host target genes comprises one or more host target binding sites, each having a nucleotide sequence which is at least partly complementary to VGAM986 RNA, herein designated VGAM RNA, and which when bound by VGAM986 RNA causes inhibition of translation of respective one or more VGAM986 host target proteins.

It is further appreciated by one skilled in the art that the mode of translational inhibition illustrated by FIG. 1 with specific reference to translational inhibition exerted by VGAM986 gene, herein designated VGAM GENE, on one or more VGAM986 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM986 is inhibition of expression of host target genes, as part of a novel viral mechanism of attacking a host. Accordingly, utilities of VGAM986 include diagnosis, prevention and treatment of viral infection by Leishmania RNA Virus 1-4. Specific functions, and accordingly utilities, of VGAM986 correlate with, and may be deduced from, the identity of the host target genes which VGAM986 binds and inhibits, and the function of these host target genes, as elaborated hereinbelow.

Nucleotide sequences of the VGAM986 precursor RNA, herein designated VGAM PRECURSOR RNA, and of the 'diced' VGAM986 RNA, herein designated VGAM RNA, and a schematic representation of the secondary folding of VGAM986 folded precursor RNA, herein designated VGAM FOLDED PRECURSOR RNA, of VGAM986 are further described hereinbelow with reference to Table 1.

Nucleotide sequences of host target binding sites, such as BINDING SITE-I, BINDING SITE-II and BINDING SITE-III of FIG. 1, found on VGAM986 host target RNA, and schematic representation of the complementarity of each of these host target binding sites to VGAM986 RNA, herein designated VGAM RNA, are described hereinbelow with reference to Table 2.

As mentioned hereinabove with reference to FIG. 1, a function of VGAM986 gene, herein designated VGAM is inhibition of expression of VGAM986 target genes. It is appreciated that specific functions, and accordingly utilities, of VGAM986 correlate with, and may be deduced from, the identity of the target genes which VGAM986 binds and inhibits, and the function of these target genes, as elaborated hereinbelow.

SudD Suppressor of BimD6 Homolog (A. nidulans) (SUDD, Accession NM_003831) is a VGAM986 host target gene. SUDD BINDING SITE is HOST TARGET binding site found in the 3' untranslated region of mRNA encoded by SUDD, corresponding to a HOST TARGET binding site such as BINDING SITE I, BINDING SITE II or BINDING SITE III. Table 2 illustrates the complementarity of the nucleotide sequences of SUDD BINDING SITE, designated SEQ ID:9922, to the nucleotide sequence of VGAM986 RNA, herein designated VGAM RNA, also designated SEQ ID:3697.

A function of VGAM986 is therefore inhibition of SudD Suppressor of BimD6 Homolog (A. nidulans) (SUDD, Accession NM_003831). Accordingly, utilities of VGAM986 include diagnosis, prevention and treatment of diseases and clinical conditions associated with SUDD. Von Hippel-Lindau Binding Protein 1 (VBP1, Accession NM_003372) is another VGAM986 host target gene. VBP1 BINDING SITE is HOST TARGET binding site found in the 3' untranslated region of mRNA encoded by VBP1, corresponding to a HOST TARGET binding site such as BINDING SITE I, BINDING SITE II or BINDING SITE III. Table 2 illustrates the complementarity of the nucleotide sequences of VBP1 BINDING SITE, designated SEQ ID:9399, to the nucleotide sequence of VGAM986 RNA, herein designated VGAM RNA, also designated SEQ ID:3697.

Another function of VGAM986 is therefore inhibition of Von Hippel-Lindau Binding Protein 1 (VBP1, Accession NM_003372), a gene which binds specifically to cytosolic chaperonin (c-cpn) and transfers target proteins to it. Accordingly, utilities of VGAM986 include diagnosis, prevention and treatment of diseases and clinical conditions associated with VBP1. The function of VBP1 and its association with various diseases and clinical conditions, has been established by previous studies, as described hereinabove with reference to VGAM945. Vasoactive Intestinal Peptide (VIP, Accession NM_003381) is another VGAM986 host target gene. VIP BINDING SITE is HOST TARGET binding site found in the 3' untranslated region of mRNA encoded by VIP, corresponding to a HOST TARGET binding site such as BINDING SITE I, BINDING SITE II or BINDING SITE III. Table 2 illustrates the complementarity of the nucleotide sequences of VIP BINDING SITE, designated SEQ ID:9411, to the nucleotide sequence of VGAM986 RNA, herein designated VGAM RNA, also designated SEQ ID:3697.

Another function of VGAM986 is therefore inhibition of Vasoactive Intestinal Peptide (VIP, Accession NM_003381), a gene which causes vasodilation, lowers arterial blood pressure, stimulates myocardial contractility, increases glycogenolysis and relaxes the smooth muscle. Accordingly, utilities of VGAM986 include diagnosis, prevention and treatment of diseases and clinical conditions associated with VIP. The function of VIP has been established by previous studies. Vasoactive intestinal peptide is a neuropeptide present in the lymphoid microenvironment that elicits a broad spectrum of biologic functions, including the modulation of innate and adaptive immunity, and shows a predominant antiinflammatory action. VIP promotes TH2 differentiation and inhibits TH1 responses by regulating macrophage costimulatory signals and probably IL12/IFN-gamma production. In collagen-induced arthritis, a murine model for rheumatoid arthritis, Delgado et al. (2001) administered VIP daily or on alternate days for 2 weeks. Treatment with VIP significantly reduced incidence and severity of arthritis in this model, completely abrogating joint swelling and destruction of cartilage and bone. The therapeutic effect of VIP was associated with down regulation of both inflammatory and autoimmune components of the disease. Delgado et al. (2001) concluded that VIP is a viable candidate for the development of treatments for rheumatoid arthritis. Vasoactive intestinal peptide is a neuropeptide present in the lymphoid microenvironment that elicits a broad spectrum of biologic functions, including the modulation of innate and adaptive immunity, and shows a predominant antiinflammatory action. VIP promotes TH2 differentiation and inhibits TH1 responses by regulating macrophage costimulatory signals and probably IL12/IFN-gamma production. In collagen-induced arthritis, a murine model for rheumatoid arthritis, Delgado et al. (2001) administered VIP daily or on alternate days for 2 weeks. Treatment with VIP significantly reduced incidence and severity of arthritis in this model, completely abrogating joint swelling and destruction of cartilage and bone. The therapeutic effect of VIP was associated with down regulation of both inflammatory and autoimmune components of the disease. Delgado et al. (2001) concluded that VIP is a viable candidate for the development of treatments for rheumatoid arthritis.

Full details of the abovementioned studies are described in the following publications, the disclosure of which are hereby incorporated by reference:

Linder, S.; Barkhem, T.; Norberg, A.; Persson, H.; Schalling, M.; Hokfelt, T.; Magnusson, G.: Structure and expression of the gene encoding the vasoactive intestinal peptide precursor. Proc. Nat. Acad. Sci. 84:605-609, 1987; and Delgado, M.; Abad, C.; Martinez, C.; Leceta, J.; Gomariz, R. P.: Vasoactive intestinal peptide prevents experimental arthritis by downregulating both autoimmune and inflammatory component.

Further studies establishing the function and utilities of VIP are found in John Hopkins OMIM database record ID 192320, and in sited publications numbered 9663-967 and 11146 listed in the bibliography section hereinbelow, which are also hereby incorporated by reference. LOC144467 (Accession NM_138473) is another VGAM986 host target gene. LOC144467 BINDING SITE is HOST TARGET binding site found in the 5' untranslated region of mRNA encoded by LOC144467, corresponding to a HOST TARGET binding site such as BINDING SITE I, BINDING SITE II or BINDING SITE III. Table 2 illustrates the complementarity of the nucleotide sequences of LOC144467 BINDING SITE, designated SEQ ID:28820, to the nucleotide sequence of VGAM986 RNA, herein designated VGAM RNA, also designated SEQ ID:3697.

Another function of VGAM986 is therefore inhibition of LOC144467 (Accession NM_138473). Accordingly, utilities of VGAM986 include diagnosis, prevention and treatment of diseases and clinical conditions associated with LOC144467. LOC50999 (Accession NM_016040) is another VGAM986 host target gene. LOC50999 BINDING SITE is HOST TARGET binding site found in the 3' untranslated region of mRNA encoded by LOC50999, corresponding to a HOST TARGET binding site such as BINDING SITE I, BINDING SITE II or BINDING SITE III. Table 2 illustrates the complementarity of the nucleotide sequences of LOC50999 BINDING SITE, designated SEQ ID:18115, to the nucleotide sequence of VGAM986 RNA, herein designated VGAM RNA, also designated SEQ ID:3697.

Another function of VGAM986 is therefore inhibition of LOC50999 (Accession NM_016040). Accordingly, utilities of VGAM986 include diagnosis, prevention and treatment of diseases and clinical conditions associated with LOC50999. FIG. 1 further provides a conceptual description of a novel bioinformatically detected viral gene of the present invention, referred to here as Viral Genomic Address Messenger 987 (VGAM987) viral gene, which modulates expression of respective host target genes thereof, the function and utility of which host target genes is known in the art.

VGAM987 is a novel bioinformatically detected regulatory, non protein coding, viral micro RNA (miRNA) gene. The method by which VGAM987 was detected is described hereinabove with reference to FIGS. 1-8.

VGAM987 gene, herein designated VGAM GENE, is a viral gene contained in the genome of Leishmania RNA Virus 1-4. VGAM987 host target gene, herein designated VGAM HOST TARGET GENE, is a human gene contained in the human genome.

VGAM987 gene encodes a VGAM987 precursor RNA, herein designated VGAM PRECURSOR RNA. Similar to other miRNA genes, and unlike most ordinary genes, VGAM987 precursor RNA does not encode a protein. A nucleotide sequence identical or highly similar to the nucleotide sequence of VGAM987 precursor RNA is designated SEQ ID:973, and is provided hereinbelow with reference to the sequence listing part. Nucleotide sequence SEQ ID:973 is located at position 1955 relative to the genome of Leishmania RNA Virus 1-4.

VGAM987 precursor RNA folds onto itself, forming VGAM987 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or a partial inversed-reversed sequence of the nucleotide sequence of the second half thereof.

An enzyme complex designated DICER COMPLEX, 'dices' the VGAM987 folded precursor RNA into VGAM987 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM987 RNA is designated SEQ ID:3698, and is provided hereinbelow with reference to the sequence listing part.

VGAM987 host target gene, herein designated VGAM HOST TARGET GENE, encodes a corresponding messenger RNA, VGAM987 host target RNA, herein designated VGAM HOST TARGET RNA. VGAM987 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM987 RNA, herein designated VGAM RNA, binds complementarily to one or more host target binding sites located in untranslated regions of VGAM987 host target RNA, herein designated VGAM HOST TARGET RNA. This complementary binding is due to the fact that the nucleotide sequence of VGAM987 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM987 RNA, herein designated VGAM RNA, may have a different number of host target binding sites in untranslated regions of a VGAM987 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM987 RNA, herein designated VGAM RNA, to host target binding sites on VGAM987 host target RNA, herein designated VGAM HOST TARGET RNA, such as BINDING SITE I, BINDING SITE II and BINDING SITE III, inhibits translation of VGAM987 host target RNA into VGAM987 host target protein, herein designated VGAM HOST TARGET PROTEIN. VGAM host target protein is therefore outlined by a broken line.

It is appreciated that VGAM987 host target gene, herein designated VGAM HOST TARGET GENE, in fact represents a plurality of VGAM987 host target genes. The mRNA of each one of this plurality of VGAM987 host target genes comprises one or more host target binding sites, each having a nucleotide sequence which is at least partly complementary to VGAM987 RNA, herein designated VGAM RNA, and which when bound by VGAM987 RNA causes inhibition of translation of respective one or more VGAM987 host target proteins.

It is further appreciated by one skilled in the art that the mode of translational inhibition illustrated by FIG. 1 with specific reference to translational inhibition exerted by VGAM987 gene, herein designated VGAM GENE, on one or more VGAM987 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM987 is inhibition of expression of host target genes, as part of a novel viral mechanism of attacking a host. Accordingly, utilities of VGAM987 include diagnosis, prevention and treatment of viral infection by Leishmania RNA Virus 1-4. Specific functions, and accordingly utilities, of VGAM987 correlate with, and may be deduced from, the identity of the host target genes which VGAM987 binds and inhibits, and the function of these host target genes, as elaborated hereinbelow.

Nucleotide sequences of the VGAM987 precursor RNA, herein designated VGAM PRECURSOR RNA, and of the 'diced' VGAM987 RNA, herein designated VGAM RNA, and a schematic representation of the secondary folding of VGAM987 folded precursor RNA, herein designated VGAM FOLDED PRECURSOR RNA, of VGAM987 are further described hereinbelow with reference to Table 1.

Nucleotide sequences of host target binding sites, such as BINDING SITE-I, BINDING SITE-II and BINDING SITE-III of FIG. 1, found on VGAM987 host target RNA, and schematic representation of the complementarity of each of these host target binding sites to VGAM987 RNA, herein designated VGAM RNA, are described hereinbelow with reference to Table 2.

As mentioned hereinabove with reference to FIG. 1, a function of VGAM987 gene, herein designated VGAM is inhibition of expression of VGAM987 target genes. It is appreciated that specific functions, and accordingly utilities, of VGAM987 correlate with, and may be deduced from, the identity of the target genes which VGAM987 binds and inhibits, and the function of these target genes, as elaborated hereinbelow.

MGC2835 (Accession NM_024072) is a VGAM987 host target gene. MGC2835 BINDING SITE is HOST TARGET binding site found in the 3' untranslated region of mRNA encoded by MGC2835, corresponding to a HOST TARGET binding site such as BINDING SITE I, BINDING SITE II or BINDING SITE III. Table 2 illustrates the complementarity of the nucleotide sequences of MGC2835 BINDING SITE, designated SEQ ID:23503, to the nucleotide sequence of VGAM987 RNA, herein designated VGAM RNA, also designated SEQ ID:3698.

A function of VGAM987 is therefore inhibition of MGC2835 (Accession NM_024072). Accordingly, utilities of VGAM987 include diagnosis, prevention and treatment of diseases and clinical conditions associated with MGC2835. LOC143888 (Accession XM_084669) is another VGAM987 host target gene. LOC143888 BINDING SITE is HOST TARGET binding site found in the 3' untranslated region of mRNA encoded by LOC143888, corresponding to a HOST TARGET binding site such as BINDING SITE I, BINDING SITE II or BINDING SITE III. Table 2 illustrates the complementarity of the nucleotide sequences of LOC143888 BINDING SITE, designated SEQ ID:37667, to the nucleotide sequence of VGAM987 RNA, herein designated VGAM RNA, also designated SEQ ID:3698.

Another function of VGAM987 is therefore inhibition of LOC143888 (Accession XM_084669). Accordingly, utilities of VGAM987 include diagnosis, prevention and treatment of diseases and clinical conditions associated with LOC143888. LOC148709 (Accession XM_086281) is another VGAM987 host target gene. LOC148709 BINDING SITE is HOST TARGET binding site found in the 5' untranslated region of mRNA encoded by LOC148709, corresponding to a HOST TARGET binding site such as BINDING SITE I, BINDING SITE II or BINDING SITE III. Table 2 illustrates the complementarity of the nucleotide sequences of LOC148709 BINDING SITE, designated SEQ ID:38582, to the nucleotide sequence of VGAM987 RNA, herein designated VGAM RNA, also designated SEQ ID:3698.

Another function of VGAM987 is therefore inhibition of LOC148709 (Accession XM_086281). Accordingly, utilities of VGAM987 include diagnosis, prevention and treatment of diseases and clinical conditions associated with LOC148709. LOC257017 (Accession XM_173227) is another VGAM987 host target gene. LOC257017 BINDING SITE is HOST TARGET binding site found in the 5' untranslated region of mRNA encoded by LOC257017, corresponding to a HOST TARGET binding site such as BINDING SITE I, BINDING SITE II or BINDING SITE III. Table 2 illustrates the complementarity of the nucleotide sequences of LOC257017 BINDING SITE, designated SEQ ID:46492, to the nucleotide sequence of VGAM987 RNA, herein designated VGAM RNA, also designated SEQ ID:3698.

Another function of VGAM987 is therefore inhibition of LOC257017 (Accession XM_173227). Accordingly, utilities of VGAM987 include diagnosis, prevention and treatment of diseases and clinical conditions associated with LOC257017. FIG. 1 further provides a conceptual description of a novel bioinformatically detected viral gene of the present invention, referred to here as Viral Genomic Address Messenger 988 (VGAM988) viral gene, which modulates expression of respective host target genes thereof, the function and utility of which host target genes is known in the art.

VGAM988 is a novel bioinformatically detected regulatory, non protein coding, viral micro RNA (miRNA) gene. The method by which VGAM988 was detected is described hereinabove with reference to FIGS. 1-8.

VGAM988 gene, herein designated VGAM GENE, is a viral gene contained in the genome of Leishmania RNA Virus 1-4. VGAM988 host target gene, herein designated VGAM HOST TARGET GENE, is a human gene contained in the human genome.

VGAM988 gene encodes a VGAM988 precursor RNA, herein designated VGAM PRECURSOR RNA. Similar to other miRNA genes, and unlike most ordinary genes, VGAM988 precursor RNA does not encode a protein. A nucleotide sequence identical or highly similar to the nucleotide sequence of VGAM988 precursor RNA is designated SEQ ID:974, and is provided hereinbelow with reference to the sequence listing part. Nucleotide sequence SEQ ID:974 is located at position 2513 relative to the genome of Leishmania RNA Virus 1-4.

VGAM988 precursor RNA folds onto itself, forming VGAM988 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM988 folded precursor RNA into VGAM988 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM988 RNA is designated SEQ ID:3699, and is provided hereinbelow with reference to the sequence listing part.

VGAM988 host target gene, herein designated VGAM HOST TARGET GENE, encodes a corresponding messenger RNA, VGAM988 host target RNA, herein designated VGAM HOST TARGET RNA. VGAM988 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM988 RNA, herein designated VGAM RNA, binds complementarily to one or more host target binding sites located in untranslated regions of VGAM988 host target RNA, herein designated VGAM HOST TARGET RNA. This complementary binding is due to the fact that the nucleotide sequence of VGAM988 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM988 RNA, herein designated VGAM RNA, may have a different number of host target binding sites in untranslated regions of a VGAM988 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM988 RNA, herein designated VGAM RNA, to host target binding sites on VGAM988 host target RNA, herein designated VGAM HOST TARGET RNA, such as BINDING SITE I, BINDING SITE II and BINDING SITE III, inhibits translation of VGAM988 host target RNA into VGAM988 host target protein, herein designated VGAM HOST TARGET PROTEIN. VGAM host target protein is therefore outlined by a broken line.

It is appreciated that VGAM988 host target gene, herein designated VGAM HOST TARGET GENE, in fact represents a plurality of VGAM988 host target genes. The mRNA of each one of this plurality of VGAM988 host target genes comprises one or more host target binding sites, each having a nucleotide sequence which is at least partly complementary to VGAM988 RNA, herein designated VGAM RNA, and which when bound by VGAM988 RNA causes inhibition of translation of respective one or more VGAM988 host target proteins.

It is further appreciated by one skilled in the art that the mode of translational inhibition illustrated by FIG. 1 with specific reference to translational inhibition exerted by VGAM988 gene, herein designated VGAM GENE, on one or more VGAM988 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM988 is inhibition of expression of host target genes, as part of a novel viral mechanism of attacking a host. Accordingly, utilities of VGAM988 include diagnosis, prevention and treatment of viral infection by Leishmania RNA Virus 1-4. Specific functions, and accordingly utilities, of VGAM988 correlate with, and may be deduced from, the identity of the host target genes which VGAM988 binds and inhibits, and the function of these host target genes, as elaborated hereinbelow.

Nucleotide sequences of the VGAM988 precursor RNA, herein designated VGAM PRECURSOR RNA, and of the 'diced' VGAM988 RNA, herein designated VGAM RNA, and a schematic representation of the secondary folding of VGAM988 folded precursor RNA, herein designated VGAM FOLDED PRECURSOR RNA, of VGAM988 are further described hereinbelow with reference to Table 1.

Nucleotide sequences of host target binding sites, such as BINDING SITE-I, BINDING SITE-II and BINDING SITE-III of FIG. 1, found on VGAM988 host target RNA, and schematic representation of the complementarity of each of these host target binding sites to VGAM988 RNA, herein designated VGAM RNA, are described hereinbelow with reference to Table 2.

As mentioned hereinabove with reference to FIG. 1, a function of VGAM988 gene, herein designated VGAM is inhibition of expression of VGAM988 target genes. It is appreciated that specific functions, and accordingly utilities, of VGAM988 correlate with, and may be deduced from, the identity of the target genes which VGAM988 binds and inhibits, and the function of these target genes, as elaborated hereinbelow.

BRF1 Homolog, Subunit of RNA Polymerase III Transcription Initiation Factor IIIB (S. cerevisiae) (BRF1, Accession NM_001519) is a VGAM988 host target gene. BRF1 BINDING SITE is HOST TARGET binding site found in the 3' untranslated region of mRNA encoded by BRF1, corresponding to a HOST TARGET binding site such as BINDING SITE I, BINDING SITE II or BINDING SITE III. Table 2 illustrates the complementarity of the nucleotide sequences of BRF1 BINDING SITE, designated SEQ ID:7259, to the nucleotide sequence of VGAM988 RNA, herein designated VGAM RNA, also designated SEQ ID:3699.

A function of VGAM988 is therefore inhibition of BRF1 Homolog, Subunit of RNA Polymerase III Transcription Initiation Factor IIIB (S. cerevisiae) (BRF1, Accession NM_001519), a gene which is a general activator of RNA polymerase III. Accordingly, utilities of VGAM988 include diagnosis, prevention and treatment of diseases and clinical conditions associated with BRF1. The function of BRF1 and its association with various diseases and clinical conditions, has been established by previous studies, as described hereinabove with reference to VGAM232. Ladinin 1 (LAD1, Accession NM_005558) is another VGAM988 host target gene. LAD1 BINDING SITE1 and LAD1 BINDING SITE2 are HOST TARGET binding sites found in untranslated regions of mRNA encoded by LAD1, corresponding to HOST TARGET binding sites such as BINDING SITE I, BINDING SITE II or BINDING SITE III. Table 2 illustrates the complementarity of the nucleotide sequences of LAD1 BINDING SITE1 and LAD1 BINDING SITE2, designated SEQ ID:12088 and SEQ ID:12087 respectively, to the nucleotide sequence of VGAM988 RNA, herein designated VGAM RNA, also designated SEQ ID:3699.

Another function of VGAM988 is therefore inhibition of Ladinin 1 (LAD1, Accession NM_005558). Accordingly, utilities of VGAM988 include diagnosis, prevention and treatment of diseases and clinical conditions associated with LAD1. RAB7, Member RAS Oncogene Family (RAB7, Accession NM_004637) is another VGAM988 host target gene. RAB7 BINDING SITE is HOST TARGET binding site found in the 5' untranslated region of mRNA encoded by RAB7, corresponding to a HOST TARGET binding site such as BINDING SITE I, BINDING SITE II or BINDING SITE III. Table 2 illustrates the complementarity of the nucleotide sequences of RAB7 BINDING SITE, designated SEQ ID:11012, to the nucleotide sequence of VGAM988 RNA, herein designated VGAM RNA, also designated SEQ ID:3699.

Another function of VGAM988 is therefore inhibition of RAB7, Member RAS Oncogene Family (RAB7, Accession NM_004637), a gene which is an important regulator of vesicular transport in the late endocytic pathway. Accordingly, utilities of VGAM988 include diagnosis, prevention and treatment of diseases and clinical conditions associated with RAB7. The function of RAB7 and its association with various diseases and clinical conditions, has been established by previous studies, as described hereinabove with reference to VGAM35. Ribosomal Protein S6 Kinase, 90 kDa, Polypeptide 2 (RPS6KA2, Accession NM_021135) is another VGAM988 host target gene. RPS6KA2 BINDING SITE is HOST TARGET binding site found in the 5' untranslated region of mRNA encoded by RPS6KA2, corresponding to a HOST TARGET binding site such as BINDING SITE I, BINDING SITE II or BINDING SITE III. Table 2 illustrates the complementarity of the nucleotide sequences of RPS6KA2 BINDING SITE, designated SEQ ID:22107, to the nucleotide sequence of VGAM988 RNA, herein designated VGAM RNA, also designated SEQ ID:3699.

Another function of VGAM988 is therefore inhibition of Ribosomal Protein S6 Kinase, 90 kDa, Polypeptide 2 (RPS6KA2, Accession NM_021135), a gene which phosphorylates a wide range of substrates including ribosomal protein s6. Accordingly, utilities of VGAM988 include diagnosis, prevention and treatment of diseases and clinical conditions associated with RPS6KA2. The function of RPS6KA2 and its association with various diseases and clinical conditions, has been established by previous studies, as described hereinabove with reference to VGAM216. Secreted Frizzled-related Protein 1 (SFRP1, Accession NM_003012) is another VGAM988 host target gene. SFRP1 BINDING SITE is HOST TARGET binding site found in the 5' untranslated region of mRNA encoded by SFRP1, corresponding to a HOST TARGET binding site such as BINDING SITE I, BINDING SITE II or BINDING SITE III. Table 2 illustrates the complementarity of the nucleotide sequences of SFRP1 BINDING SITE, designated SEQ ID:8930, to the nucleotide sequence of VGAM988 RNA, herein designated VGAM RNA, also designated SEQ ID:3699.

Another function of VGAM988 is therefore inhibition of Secreted Frizzled-related Protein 1 (SFRP1, Accession NM_003012), a gene which is a receptor for wnt proteins that may have an anti-apoptotic function. Accordingly, utilities of VGAM988 include diagnosis, prevention and treatment of diseases and clinical conditions associated with SFRP1. The function of SFRP1 and its association with various diseases and clinical conditions, has been established by previous studies, as described hereinabove with reference to VGAM250. VENT-like Homeobox 2 (VENTX2, Accession NM_014468) is another VGAM988 host target gene. VENTX2 BINDING SITE is HOST TARGET binding site found in the 3' untranslated region of mRNA encoded by VENTX2, corresponding to a HOST TARGET binding site such as BINDING SITE I, BINDING SITE II or BINDING SITE III. Table 2 illustrates the complementarity of the nucleotide sequences of VENTX2 BINDING SITE, designated SEQ ID:15818, to the nucleotide sequence of VGAM988 RNA, herein designated VGAM RNA, also designated SEQ ID:3699.

Another function of VGAM988 is therefore inhibition of VENT-like Homeobox 2 (VENTX2, Accession NM_014468). Accordingly, utilities of VGAM988 include diagnosis, prevention and treatment of diseases and clinical conditions associated with VENTX2. DKFZP564O0423 (Accession XM_166254) is another VGAM988 host target gene. DKFZP564O0423 BINDING SITE is HOST TARGET binding site found in the 5' untranslated region of mRNA encoded by DKFZP564O0423, corresponding to a HOST TARGET binding site such as BINDING SITE I, BINDING SITE II or BINDING SITE III. Table 2 illustrates the complementarity of the nucleotide sequences of DKFZP564O0423 BINDING SITE, designated SEQ ID:44072, to the nucleotide sequence of VGAM988 RNA, herein designated VGAM RNA, also designated SEQ ID:3699.

Another function of VGAM988 is therefore inhibition of DKFZP564O0423 (Accession XM_166254). Accordingly, utilities of VGAM988 include diagnosis, prevention and treatment of diseases and clinical conditions associated with DKFZP564O0423. FK506 Binding Protein 4, 59 kDa (FKBP4, Accession NM_002014) is another VGAM988 host target gene. FKBP4 BINDING SITE is HOST TARGET binding site found in the 3' untranslated region of mRNA encoded by FKBP4, corresponding to a HOST TARGET binding site such as BINDING SITE I, BINDING SITE II or BINDING SITE III. Table 2 illustrates the complementarity of the nucleotide sequences of FKBP4 BINDING SITE, designated SEQ ID:7755, to the nucleotide sequence of VGAM988 RNA, herein designated VGAM RNA, also designated SEQ ID:3699.

Another function of VGAM988 is therefore inhibition of FK506 Binding Protein 4, 59 kDa (FKBP4, Accession NM_002014). Accordingly, utilities of VGAM988 include diagnosis, prevention and treatment of diseases and clinical conditions associated with FKBP4. FLJ10932 (Accession NM_018277) is another VGAM988 host target gene. FLJ10932 BINDING SITE is HOST TARGET binding site found in the 3' untranslated region of mRNA encoded by FLJ10932, corresponding to a HOST TARGET binding site such as BINDING SITE I, BINDING SITE II or BINDING SITE III. Table 2 illustrates the complementarity of the nucleotide sequences of FLJ10932 BINDING SITE, designated SEQ ID:20266, to the nucleotide sequence of VGAM988 RNA, herein designated VGAM RNA, also designated SEQ ID:3699.

Another function of VGAM988 is therefore inhibition of FLJ10932 (Accession NM_018277). Accordingly, utilities of VGAM988 include diagnosis, prevention and treatment of diseases and clinical conditions associated with FLJ10932. FLJ13397 (Accession NM_024948) is another VGAM988 host target gene. FLJ13397 BINDING SITE is HOST TARGET binding site found in the 5' untranslated region of mRNA encoded by FLJ13397, corresponding to a HOST TARGET binding site such as BINDING SITE I, BINDING SITE II or BINDING SITE III. Table 2 illustrates the complementarity of the nucleotide sequences of FLJ13397 BINDING SITE, designated SEQ ID:24501, to the nucleotide sequence of VGAM988 RNA, herein designated VGAM RNA, also designated SEQ ID:3699.

Another function of VGAM988 is therefore inhibition of FLJ13397 (Accession NM_024948). Accordingly, utilities of VGAM988 include diagnosis, prevention and treatment of diseases and clinical conditions associated with FLJ13397. FLJ22393 (Accession NM_025106) is another VGAM988 host target gene. FLJ22393 BINDING SITE is HOST TARGET binding site found in the 5' untranslated region of mRNA encoded by FLJ22393, corresponding to a HOST TARGET binding site such as BINDING SITE I, BINDING SITE II or BINDING SITE III. Table 2 illustrates the complementarity of the nucleotide sequences of FLJ22393 BINDING SITE, designated SEQ ID:24757, to the nucleotide sequence of VGAM988 RNA, herein designated VGAM RNA, also designated SEQ ID:3699.

Another function of VGAM988 is therefore inhibition of FLJ22393 (Accession NM_025106). Accordingly, utilities of VGAM988 include diagnosis, prevention and treatment of diseases and clinical conditions associated with FLJ22393. Golgi Phosphoprotein 3 (coat-protein) (GOLPH3, Accession NM_022130) is another VGAM988 host target gene. GOLPH3 BINDING SITE is HOST TARGET binding site found in the 5' untranslated region of mRNA encoded by GOLPH3, corresponding to a HOST TARGET binding site such as BINDING SITE I, BINDING SITE II or BINDING SITE III. Table 2 illustrates the complementarity of the nucleotide sequences of GOLPH3 BINDING SITE, designated SEQ ID:22687, to the nucleotide sequence of VGAM988 RNA, herein designated VGAM RNA, also designated SEQ ID:3699.

Another function of VGAM988 is therefore inhibition of Golgi Phosphoprotein 3 (coat-protein) (GOLPH3, Accession NM_022130). Accordingly, utilities of VGAM988 include diagnosis, prevention and treatment of diseases and clinical conditions associated with GOLPH3. MGC15482 (Accession NM_032875) is another VGAM988 host target gene. MGC15482 BINDING SITE is HOST TARGET binding site found in the 5' untranslated region of mRNA encoded by MGC15482, corresponding to a HOST TARGET binding site such as BINDING SITE I, BINDING SITE II or BINDING SITE III. Table 2 illustrates the complementarity of the nucleotide sequences of MGC15482 BINDING SITE, designated SEQ ID:26697, to the nucleotide sequence of VGAM988 RNA, herein designated VGAM RNA, also designated SEQ ID:3699.

Another function of VGAM988 is therefore inhibition of MGC15482 (Accession NM_032875). Accordingly, utilities of VGAM988 include diagnosis, prevention and treatment of diseases and clinical conditions associated with MGC15482. Ornithine Decarboxylase Antizyme Inhibitor (OAZIN, Accession NM_015878) is another VGAM988 host target gene. OAZIN BINDING SITE is HOST TARGET binding site found in the 5' untranslated region of mRNA encoded by OAZIN, corresponding to a HOST TARGET binding site such as BINDING SITE I, BINDING SITE II or BINDING SITE III. Table 2 illustrates the complementarity of the nucleotide sequences of OAZIN BINDING SITE, designated SEQ ID:18021, to the nucleotide sequence of VGAM988 RNA, herein designated VGAM RNA, also designated SEQ ID:3699.

Another function of VGAM988 is therefore inhibition of Ornithine Decarboxylase Antizyme Inhibitor (OAZIN, Accession NM_015878). Accordingly, utilities of VGAM988 include diagnosis, prevention and treatment of diseases and clinical conditions associated with OAZIN. Protein Phosphatase 1A (formerly 2C), Magnesium-dependent, Alpha Isoform (PPM1A, Accession NM_021003) is another VGAM988 host target gene. PPM1A BINDING SITE is HOST TARGET binding site found in the 5' untranslated region of mRNA encoded by PPM1A, corresponding to a HOST TARGET binding site such as BINDING SITE I, BINDING SITE II or BINDING SITE III. Table 2 illustrates the complementarity of the nucleotide sequences of PPM1A BINDING SITE, designated SEQ ID:21999, to the nucleotide sequence of VGAM988 RNA, herein designated VGAM RNA, also designated SEQ ID:3699.

Another function of VGAM988 is therefore inhibition of Protein Phosphatase 1A (formerly 2C), Magnesium-dependent, Alpha Isoform (PPM1A, Accession NM_021003). Accordingly, utilities of VGAM988 include diagnosis, prevention and treatment of diseases and clinical conditions associated with PPM1A. Rab11-FIP2 (Accession NM_014904) is another VGAM988 host target gene. Rab11-FIP2 BINDING SITE is HOST TARGET binding site found in the 5' untranslated region of mRNA encoded by Rab11-FIP2, corresponding to a HOST TARGET binding site such as BINDING SITE I, BINDING SITE II or BINDING SITE III. Table 2 illustrates the complementarity of the nucleotide sequences of Rab11-FIP2 BINDING SITE, designated SEQ ID:17099, to the nucleotide sequence of VGAM988 RNA, herein designated VGAM RNA, also designated SEQ ID:3699.

Another function of VGAM988 is therefore inhibition of Rab11-FIP2 (Accession NM_014904). Accordingly, utilities of VGAM988 include diagnosis, prevention and treatment of diseases and clinical conditions associated with Rab11-FIP2. RCD-8 (Accession NM_014329) is another VGAM988 host target gene. RCD-8 BINDING SITE is HOST TARGET binding site found in the 3' untranslated region of mRNA encoded by RCD-8, corresponding to a HOST TARGET binding site such as BINDING SITE I, BINDING SITE II or BINDING SITE III. Table 2 illustrates the complementarity of the nucleotide sequences of RCD-8 BINDING SITE, designated SEQ ID:15643, to the nucleotide sequence of VGAM988 RNA, herein designated VGAM RNA, also designated SEQ ID:3699.

Another function of VGAM988 is therefore inhibition of RCD-8 (Accession NM_014329). Accordingly, utilities of VGAM988 include diagnosis, prevention and treatment of diseases and clinical conditions associated with RCD-8. REC8 (Accession NM_005132) is another VGAM988 host target gene. REC8 BINDING SITE is HOST TARGET binding site found in the 5' untranslated region of mRNA encoded by REC8, corresponding to a HOST TARGET binding site such as BINDING SITE I, BINDING SITE II or BINDING SITE III. Table 2 illustrates the complementarity of the nucleotide sequences of REC8 BINDING SITE, designated SEQ ID:11609, to the nucleotide sequence of VGAM988 RNA, herein designated VGAM RNA, also designated SEQ ID:3699.

Another function of VGAM988 is therefore inhibition of REC8 (Accession NM_005132). Accordingly, utilities of VGAM988 include diagnosis, prevention and treatment of diseases and clinical conditions associated with REC8. TGFB-induced Factor 2 (TALE family homeobox) (TGIF2, Accession NM_021809) is another VGAM988 host target gene. TGIF2 BINDING SITE is HOST TARGET binding site found in the 3' untranslated region of mRNA encoded by TGIF2, corresponding to a HOST TARGET binding site such as BINDING SITE I, BINDING SITE II or BINDING SITE III. Table 2 illustrates the complementarity of the nucleotide sequences of TGIF2 BINDING SITE, designated SEQ ID:22367, to the nucleotide sequence of VGAM988 RNA, herein designated VGAM RNA, also designated SEQ ID:3699.

Another function of VGAM988 is therefore inhibition of TGFB-induced Factor 2 (TALE family homeobox) (TGIF2, Accession NM_021809). Accordingly, utilities of VGAM988 include diagnosis, prevention and treatment of diseases and clinical conditions associated with TGIF2. Tumor Protein P53 Inducible Nuclear Protein 1 (TP53INP1, Accession NM_033285) is another VGAM988 host target gene. TP53INP1 BINDING SITE is HOST TARGET binding site found in the 5' untranslated region of mRNA encoded by TP53INP1, corresponding to a HOST TARGET binding site such as BINDING SITE I, BINDING SITE II or BINDING SITE III. Table 2 illustrates the complementarity of the nucleotide sequences of TP53INP1 BINDING SITE, designated SEQ ID:27108, to the nucleotide sequence of VGAM988 RNA, herein designated VGAM RNA, also designated SEQ ID:3699.

Another function of VGAM988 is therefore inhibition of Tumor Protein P53 Inducible Nuclear Protein 1 (TP53INP1, Accession NM_033285). Accordingly, utilities of VGAM988 include diagnosis, prevention and treatment of diseases and clinical conditions associated with TP53INP1. LOC139411 (Accession XM_066680) is another VGAM988 host target gene. LOC139411 BINDING SITE is HOST TARGET binding site found in the 5' untranslated region of mRNA encoded by LOC139411, corresponding to a HOST TARGET binding site such as BINDING SITE I, BINDING SITE II or BINDING SITE III. Table 2 illustrates the complementarity of the nucleotide sequences of LOC139411 BINDING SITE, designated SEQ ID:37342, to the nucleotide sequence of VGAM988 RNA, herein designated VGAM RNA, also designated SEQ ID:3699.

Another function of VGAM988 is therefore inhibition of LOC139411 (Accession XM_066680). Accordingly, utilities of VGAM988 include diagnosis, prevention and treatment of diseases and clinical conditions associated with LOC139411. LOC146433 (Accession XM_085458) is another VGAM988 host target gene. LOC146433 BINDING SITE is HOST TARGET binding site found in the 5' untranslated region of mRNA encoded by LOC146433, corresponding to a HOST TARGET binding site such as BINDING SITE I, BINDING SITE II or BINDING SITE III. Table 2 illustrates the complementarity of the nucleotide sequences of LOC146433 BINDING SITE, designated SEQ ID:38147, to the nucleotide sequence of VGAM988 RNA, herein designated VGAM RNA, also designated SEQ ID:3699.

Another function of VGAM988 is therefore inhibition of LOC146433 (Accession XM_085458). Accordingly, utilities of VGAM988 include diagnosis, prevention and treatment of diseases and clinical conditions associated with LOC146433. LOC51104 (Accession NM_016014) is another VGAM988 host target gene. LOC51104 BINDING SITE is HOST TARGET binding site found in the 5' untranslated region of mRNA encoded by LOC51104, corresponding to a HOST TARGET binding site such as BINDING SITE I, BINDING SITE II or BINDING SITE III. Table 2 illustrates the complementarity of the nucleotide sequences of LOC51104 BINDING SITE, designated SEQ ID:18091, to the nucleotide sequence of VGAM988 RNA, herein designated VGAM RNA, also designated SEQ ID:3699.

Another function of VGAM988 is therefore inhibition of LOC51104 (Accession NM_016014). Accordingly, utilities of VGAM988 include diagnosis, prevention and treatment of diseases and clinical conditions associated with LOC51104. FIG. 1 further provides a conceptual description of a novel bioinformatically detected viral gene of the present invention, referred to here as Viral Genomic Address Messenger 989 (VGAM989) viral gene, which modulates expression of respective host target genes thereof, the function and utility of which host target genes is known in the art.

VGAM989 is a novel bioinformatically detected regulatory, non protein coding, viral micro RNA (miRNA) gene. The method by which VGAM989 was detected is described hereinabove with reference to FIGS. 1-8.

VGAM989 gene, herein designated VGAM GENE, is a viral gene contained in the genome of Leishmania RNA Virus 1-4. VGAM989 host target gene, herein designated VGAM HOST TARGET GENE, is a human gene contained in the human genome.

VGAM989 gene encodes a VGAM989 precursor RNA, herein designated VGAM PRECURSOR RNA. Similar to other miRNA genes, and unlike most ordinary genes, VGAM989 precursor RNA does not encode a protein. A nucleotide sequence identical or highly similar to the nucleotide sequence of VGAM989 precursor RNA is designated SEQ ID:975, and is provided hereinbelow with reference to the sequence listing part. Nucleotide sequence SEQ ID:975 is located at position 1535 relative to the genome of Leishmania RNA Virus 1-4.

VGAM989 precursor RNA folds onto itself, forming VGAM989 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM989 folded precursor RNA into VGAM989 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM989 RNA is designated SEQ ID:3700, and is provided hereinbelow with reference to the sequence listing part.

VGAM989 host target gene, herein designated VGAM HOST TARGET GENE, encodes a corresponding messenger RNA, VGAM989 host target RNA, herein designated VGAM HOST TARGET RNA. VGAM989 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM989 RNA, herein designated VGAM RNA, binds complementarily to one or more host target binding sites located in untranslated regions of VGAM989 host target RNA, herein designated VGAM HOST TARGET RNA. This complementary binding is due to the fact that the nucleotide sequence of VGAM989 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM989 RNA, herein designated VGAM RNA, may have a different number of host target binding sites in untranslated regions of a VGAM989 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM989 RNA, herein designated VGAM RNA, to host target binding sites on VGAM989 host target RNA, herein designated VGAM HOST TARGET RNA, such as BINDING SITE I, BINDING SITE II and BINDING SITE III, inhibits translation of VGAM989 host target RNA into VGAM989 host target protein, herein designated VGAM HOST TARGET PROTEIN. VGAM host target protein is therefore outlined by a broken line.

It is appreciated that VGAM989 host target gene, herein designated VGAM HOST TARGET GENE, in fact represents a plurality of VGAM989 host target genes. The mRNA of each one of this plurality of VGAM989 host target genes comprises one or more host target binding sites, each having a nucleotide sequence which is at least partly complementary to VGAM989 RNA, herein designated VGAM RNA, and which when bound by VGAM989 RNA causes inhibition of translation of respective one or more VGAM989 host target proteins.

It is further appreciated by one skilled in the art that the mode of translational inhibition illustrated by FIG. 1 with specific reference to translational inhibition exerted by VGAM989 gene, herein designated VGAM GENE, on one or more VGAM989 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM989 is inhibition of expression of host target genes, as part of a novel viral mechanism of attacking a host. Accordingly, utilities of VGAM989 include diagnosis, prevention and treatment of viral infection by Leishmania RNA Virus 1-4. Specific functions, and accordingly utilities, of VGAM989 correlate with, and may be deduced from, the identity of the host target genes which VGAM989 binds and inhibits, and the function of these host target genes, as elaborated hereinbelow.

Nucleotide sequences of the VGAM989 precursor RNA, herein designated VGAM PRECURSOR RNA, and of the 'diced' VGAM989 RNA, herein designated VGAM RNA, and a schematic representation of the secondary folding of VGAM989 folded precursor RNA, herein designated VGAM FOLDED PRECURSOR RNA, of VGAM989 are further described hereinbelow with reference to Table 1.

Nucleotide sequences of host target binding sites, such as BINDING SITE-I, BINDING SITE-II and BINDING SITE-III of FIG. 1, found on VGAM989 host target RNA, and schematic representation of the complementarity of each of these host target binding sites to VGAM989 RNA, herein designated VGAM RNA, are described hereinbelow with reference to Table 2.

As mentioned hereinabove with reference to FIG. 1, a function of VGAM989 gene, herein designated VGAM is inhibition of expression of VGAM989 target genes. It is appreciated that specific functions, and accordingly utilities, of VGAM989 correlate with, and may be deduced from, the identity of the target genes which VGAM989 binds and inhibits, and the function of these target genes, as elaborated hereinbelow.

Chromosome 7 Open Reading Frame 2 (C7orf2, Accession NM_022458) is a VGAM989 host target gene. C7orf2 BINDING SITE is HOST TARGET binding site found in the 3' untranslated region of mRNA encoded by C7orf2, corresponding to a HOST TARGET binding site such as BINDING SITE I, BINDING SITE II or BINDING SITE III. Table 2 illustrates the complementarity of the nucleotide sequences of C7orf2 BINDING SITE, designated SEQ ID:22795, to the nucleotide sequence of VGAM989 RNA, herein designated VGAM RNA, also designated SEQ ID:3700.

A function of VGAM989 is therefore inhibition of Chromosome 7 Open Reading Frame 2 (C7orf2, Accession NM_022458). Accordingly, utilities of VGAM989 include diagnosis, prevention and treatment of diseases and clinical conditions associated with C7orf2. FLJ14054 (Accession NM_024563) is another VGAM989 host target gene. FLJ14054 BINDING SITE is HOST TARGET binding site found in the 3' untranslated region of mRNA encoded by FLJ14054, corresponding to a HOST TARGET binding site such as BINDING SITE I, BINDING SITE II or BINDING SITE III. Table 2 illustrates the complementarity of the nucleotide sequences of FLJ14054 BINDING SITE, designated SEQ ID:23783, to the nucleotide sequence of VGAM989 RNA, herein designated VGAM RNA, also designated SEQ ID:3700.

Another function of VGAM989 is therefore inhibition of FLJ14054 (Accession NM_024563). Accordingly, utilities of VGAM989 include diagnosis, prevention and treatment of diseases and clinical conditions associated with FLJ14054. FLJ20297 (Accession NM_017751) is another VGAM989 host target gene. FLJ20297 BINDING SITE1 and FLJ20297 BINDING SITE2 are HOST TARGET binding sites found in untranslated regions of mRNA encoded by FLJ20297, corresponding to HOST TARGET binding sites such as BINDING SITE I, BINDING SITE II or BINDING SITE III. Table 2 illustrates the complementarity of the nucleotide sequences of FLJ20297 BINDING SITE1 and FLJ20297 BINDING SITE2, designated SEQ ID:19358 and SEQ ID:19648 respectively, to the nucleotide sequence of VGAM989 RNA, herein designated VGAM RNA, also designated SEQ ID:3700.

Another function of VGAM989 is therefore inhibition of FLJ20297 (Accession NM_017751). Accordingly, utilities of VGAM989 include diagnosis, prevention and treatment of diseases and clinical conditions associated with FLJ20297. LOC150776 (Accession XM_032542) is another VGAM989 host target gene. LOC150776 BINDING SITE is HOST TARGET binding site found in the 3' untranslated region of mRNA encoded by LOC150776, corresponding to a HOST TARGET binding site such as BINDING SITE I, BINDING SITE II or BINDING SITE III. Table 2 illustrates the complementarity of the nucleotide sequences of LOC150776 BINDING SITE, designated SEQ ID:31675, to the nucleotide sequence of VGAM989 RNA, herein designated VGAM RNA, also designated SEQ ID:3700.

Another function of VGAM989 is therefore inhibition of LOC150776 (Accession XM_032542). Accordingly, utilities of VGAM989 include diagnosis, prevention and treatment of diseases and clinical conditions associated with LOC150776. FIG. 1 further provides a conceptual description of a novel bioinformatically detected viral gene of the present invention, referred to here as Viral Genomic Address Messenger 990 (VGAM990) viral gene, which modulates expression of respective host target genes thereof, the function and utility of which host target genes is known in the art.

VGAM990 is a novel bioinformatically detected regulatory, non protein coding, viral micro RNA (miRNA) gene. The method by which VGAM990 was detected is described hereinabove with reference to FIGS. 1-8.

VGAM990 gene, herein designated VGAM GENE, is a viral gene contained in the genome of Leishmania RNA Virus 1-4. VGAM990 host target gene, herein designated VGAM HOST TARGET GENE, is a human gene contained in the human genome.

VGAM990 gene encodes a VGAM990 precursor RNA, herein designated VGAM PRECURSOR RNA. Similar to other miRNA genes, and unlike most ordinary genes, VGAM990 precursor RNA does not encode a protein. A nucleotide sequence identical or highly similar to the nucleotide sequence of VGAM990 precursor RNA is designated SEQ ID:976, and is provided hereinbelow with reference to the sequence listing part. Nucleotide sequence SEQ ID:976 is located at position 5193 relative to the genome of Leishmania RNA Virus 1-4.

VGAM990 precursor RNA folds onto itself, forming VGAM990 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM990 folded precursor RNA into VGAM990 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM990 RNA is designated SEQ ID:3701, and is provided hereinbelow with reference to the sequence listing part.

VGAM990 host target gene, herein designated VGAM HOST TARGET GENE, encodes a corresponding messenger RNA, VGAM990 host target RNA, herein designated VGAM HOST TARGET RNA. VGAM990 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM990 RNA, herein designated VGAM RNA, binds complementarily to one or more host target binding sites located in untranslated regions of VGAM990 host target RNA, herein designated VGAM HOST TARGET RNA. This complementary binding is due to the fact that the nucleotide sequence of VGAM990 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM990 RNA, herein designated VGAM RNA, may have a different number of host target binding sites in untranslated regions of a VGAM990 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM990 RNA, herein designated VGAM RNA, to host target binding sites on VGAM990 host target RNA, herein designated VGAM HOST TARGET RNA, such as BINDING SITE I, BINDING SITE II and BINDING SITE III, inhibits translation of VGAM990 host target RNA into VGAM990 host target protein, herein designated VGAM HOST TARGET PROTEIN. VGAM host target protein is therefore outlined by a broken line.

It is appreciated that VGAM990 host target gene, herein designated VGAM HOST TARGET GENE, in fact represents a plurality of VGAM990 host target genes. The mRNA of each one of this plurality of VGAM990 host target genes comprises one or more host target binding sites, each having a nucleotide sequence which is at least partly complementary to VGAM990 RNA, herein designated VGAM RNA, and which when bound by VGAM990 RNA causes inhibition of translation of respective one or more VGAM990 host target proteins.

It is further appreciated by one skilled in the art that the mode of translational inhibition illustrated by FIG. 1 with specific reference to translational inhibition exerted by VGAM990 gene, herein designated VGAM GENE, on one or more VGAM990 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM990 is inhibition of expression of host target genes, as part of a novel viral mechanism of attacking a host. Accordingly, utilities of VGAM990 include diagnosis, prevention and treatment of viral infection by Leishmania RNA Virus 1-4. Specific functions, and accordingly utilities, of VGAM990 correlate with, and may be deduced from, the identity of the host target genes which VGAM990 binds and inhibits, and the function of these host target genes, as elaborated hereinbelow.

Nucleotide sequences of the VGAM990 precursor RNA, herein designated VGAM PRECURSOR RNA, and of the 'diced' VGAM990 RNA, herein designated VGAM RNA, and a schematic representation of the secondary folding of VGAM990 folded precursor RNA, herein designated VGAM FOLDED PRECURSOR RNA, of VGAM990 are further described hereinbelow with reference to Table 1.

Nucleotide sequences of host target binding sites, such as BINDING SITE-I, BINDING SITE-II and BINDING SITE-III of FIG. 1, found on VGAM990 host target RNA, and schematic representation of the complementarity of each of these host target binding sites to VGAM990 RNA, herein designated VGAM RNA, are described hereinbelow with reference to Table 2.

As mentioned hereinabove with reference to FIG. 1, a function of VGAM990 gene, herein designated VGAM is inhibition of expression of VGAM990 target genes. It is appreciated that specific functions, and accordingly utilities, of VGAM990 correlate with, and may be deduced from, the identity of the target genes which VGAM990 binds and inhibits, and the function of these target genes, as elaborated hereinbelow.

Down Syndrome Critical Region Gene 1 (DSCR1, Accession NM_004414) is a VGAM990 host target gene. DSCR1 BINDING SITE is HOST TARGET binding site found in the 3' untranslated region of mRNA encoded by DSCR1, corresponding to a HOST TARGET binding site such as BINDING SITE I, BINDING SITE II or BINDING SITE III. Table 2 illustrates the complementarity of the nucleotide sequences of DSCR1 BINDING SITE, designated SEQ ID:10676, to the nucleotide sequence of VGAM990 RNA, herein designated VGAM RNA, also designated SEQ ID:3701.

A function of VGAM990 is therefore inhibition of Down Syndrome Critical Region Gene 1 (DSCR1, Accession NM_004414), a gene which inhibits calcineurin-dependent transcriptional responses. Accordingly, utilities of VGAM990 include diagnosis, prevention and treatment of diseases and clinical conditions associated with DSCR1. The function of DSCR1 and its association with various diseases and clinical conditions, has been established by previous studies, as described hereinabove with reference to VGAM589. Epithelial Membrane Protein 1 (EMP1, Accession NM_001423) is another VGAM990 host target gene. EMP1 BINDING SITE is HOST TARGET binding site found in the 3' untranslated region of mRNA encoded by EMP1, corresponding to a HOST TARGET binding site such as BINDING SITE I, BINDING SITE II or BINDING SITE III. Table 2 illustrates the complementarity of the nucleotide sequences of EMP1 BINDING SITE, designated SEQ ID:7136, to the nucleotide sequence of VGAM990 RNA, herein designated VGAM RNA, also designated SEQ ID:3701.

Another function of VGAM990 is therefore inhibition of Epithelial Membrane Protein 1 (EMP1, Accession NM_001423), a gene which plays a role in squamous cell differentiation; member of the PMP22/EMP/MP20 family of membrane glycoproteins. Accordingly, utilities of VGAM990 include diagnosis, prevention and treatment of diseases and clinical conditions associated with EMP1. The function of EMP1 and its association with various diseases and clinical conditions, has been established by previous studies, as described hereinabove with reference to VGAM107. Spondyloepiphyseal Dysplasia, Late (SEDL, Accession NM_014563) is another VGAM990 host target gene. SEDL BINDING SITE is HOST TARGET binding site found in the 3' untranslated region of mRNA encoded by SEDL, corresponding to a HOST TARGET binding site such as BINDING SITE I, BINDING SITE II or BINDING SITE III. Table 2 illustrates the complementarity of the nucleotide sequences of SEDL BINDING SITE, designated SEQ ID:15914, to the nucleotide sequence of VGAM990 RNA, herein designated VGAM RNA, also designated SEQ ID:3701.

Another function of VGAM990 is therefore inhibition of Spondyloepiphyseal Dysplasia, Late (SEDL, Accession NM_014563), a gene which may play role in vesicular transport from endoplasmic reticulum to golgi. Accordingly, utilities of VGAM990 include diagnosis, prevention and treatment of diseases and clinical conditions associated with SEDL. The function of SEDL and its association with various diseases and clinical conditions, has been established by previous studies, as described hereinabove with reference to VGAM74. Zinc Finger Protein 22 (KOX 15) (ZNF22, Accession XM_166153) is another VGAM990 host target gene. ZNF22 BINDING SITE is HOST TARGET binding site found in the 3' untranslated region of mRNA encoded by ZNF22, corresponding to a HOST TARGET binding site such as BINDING SITE I, BINDING SITE II or BINDING SITE III. Table 2 illustrates the complementarity of the nucleotide sequences of ZNF22 BINDING SITE, designated SEQ ID:43970, to the nucleotide sequence of VGAM990 RNA, herein designated VGAM RNA, also designated SEQ ID:3701.

Another function of VGAM990 is therefore inhibition of Zinc Finger Protein 22 (KOX 15) (ZNF22, Accession XM_166153). Accordingly, utilities of VGAM990 include diagnosis, prevention and treatment of diseases and clinical conditions associated with ZNF22. ATP-binding Cassette, Sub-family C (CFTR/MRP), Member 13 (ABCC13, Accession NM_138726) is another VGAM990 host target gene. ABCC13 BINDING SITE is HOST TARGET binding site found in the 3' untranslated region of mRNA encoded by ABCC13, corresponding to a HOST TARGET binding site such as BINDING SITE I, BINDING SITE II or BINDING SITE III. Table 2 illustrates the complementarity of the nucleotide sequences of ABCC13 BINDING SITE, designated SEQ ID:28972, to the nucleotide sequence of VGAM990 RNA, herein designated VGAM RNA, also designated SEQ ID:3701.

Another function of VGAM990 is therefore inhibition of ATP-binding Cassette, Sub-family C (CFTR/MRP), Member 13 (ABCC13, Accession NM_138726). Accordingly, utilities of VGAM990 include diagnosis, prevention and treatment of diseases and clinical conditions associated with ABCC13. FLJ20308 (Accession XM_039852) is another VGAM990 host target gene. FLJ20308 BINDING SITE is HOST TARGET binding site found in the 3" untranslated region of mRNA encoded by FLJ20308, corresponding to a HOST TARGET binding site such as BINDING SITE I, BINDING SITE II or BINDING SITE III. Table 2 illustrates the complementarity of the nucleotide sequences of FLJ20308 BINDING SITE, designated SEQ ID:33199, to the nucleotide sequence of VGAM990 RNA, herein designated VGAM RNA, also designated SEQ ID:3701.

Another function of VGAM990 is therefore inhibition of FLJ20308 (Accession XM_039852). Accordingly, utilities of VGAM990 include diagnosis, prevention and treatment of diseases and clinical conditions associated with FLJ20308. KIAA1511 (Accession XM_046581) is another VGAM990 host target gene. KIAA1511 BINDING SITE is HOST TARGET binding site found in the 3' untranslated region of mRNA encoded by KIAA1511, corresponding to a HOST TARGET binding site such as BINDING SITE I, BINDING SITE II or BINDING SITE III. Table 2 illustrates the complementarity of the nucleotide sequences of KIAA1511 BINDING SITE, designated SEQ ID:34756, to the nucleotide sequence of VGAM990 RNA, herein designated VGAM RNA, also designated SEQ ID:3701.

Another function of VGAM990 is therefore inhibition of KIAA1511 (Accession XM_046581). Accordingly, utilities of VGAM990 include diagnosis, prevention and treatment of diseases and clinical conditions associated with KIAA1511. MGC23980 (Accession NM_145005) is another VGAM990 host target gene. MGC23980 BINDING SITE is HOST TARGET binding site found in the 3' untranslated region of mRNA encoded by MGC23980, corresponding to a HOST TARGET binding site such as BINDING SITE I, BINDING SITE II or BINDING SITE III. Table 2 illustrates the complementarity of the nucleotide sequences of MGC23980 BINDING SITE, designated SEQ ID:29606, to the nucleotide sequence of VGAM990 RNA, herein designated VGAM RNA, also designated SEQ ID:3701.

Another function of VGAM990 is therefore inhibition of MGC23980 (Accession NM_145005). Accordingly, utilities of VGAM990 include diagnosis, prevention and treatment of diseases and clinical conditions associated with MGC23980. WSB1 (Accession NM_134264) is another VGAM990 host target gene. WSB1 BINDING SITE1 and WSB1 BINDING SITE2 are HOST TARGET binding sites found in untranslated regions of mRNA encoded by WSB1, corresponding to HOST TARGET binding sites such as BINDING SITE I, BINDING SITE II or BINDING SITE III. Table 2 illustrates the complementarity of the nucleotide sequences of WSB1 BINDING SITE1 and WSB1 BINDING SITE2, designated SEQ ID:28616 and SEQ ID:28622 respectively, to the nucleotide sequence of VGAM990 RNA, herein designated VGAM RNA, also designated SEQ ID:3701.

Another function of VGAM990 is therefore inhibition of WSB1 (Accession NM_134264). Accordingly, utilities of VGAM990 include diagnosis, prevention and treatment of diseases and clinical conditions associated with WSB1. LOC154043 (Accession XM_087831) is another VGAM990 host target gene. LOC154043 BINDING SITE is HOST TARGET binding site found in the 3' untranslated region of mRNA encoded by LOC154043, corresponding to a HOST TARGET binding site such as BINDING SITE I, BINDING SITE II or BINDING SITE III. Table 2 illustrates the complementarity of the nucleotide sequences of LOC154043 BINDING SITE, designated SEQ ID:39460, to the nucleotide sequence of VGAM990 RNA, herein designated VGAM RNA, also designated SEQ ID:3701.

Another function of VGAM990 is therefore inhibition of LOC154043 (Accession XM_087831). Accordingly, utilities of VGAM990 include diagnosis, prevention and treatment of diseases and clinical conditions associated with LOC154043. FIG. 1 further provides a conceptual description of a novel bioinformatically detected viral gene of the present invention, referred to here as Viral Genomic Address Messenger 991 (VGAM991) viral gene, which modulates expression of respective host target genes thereof, the function and utility of which host target genes is known in the art.

VGAM991 is a novel bioinformatically detected regulatory, non protein coding, viral micro RNA (miRNA) gene. The method by which VGAM991 was detected is described hereinabove with reference to FIGS. 1-8.

VGAM991 gene, herein designated VGAM GENE, is a viral gene contained in the genome of Leishmania RNA Virus 1-1. VGAM991 host target gene, herein designated VGAM HOST TARGET GENE, is a human gene contained in the human genome.

VGAM991 gene encodes a VGAM991 precursor RNA, herein designated VGAM PRECURSOR RNA. Similar to other miRNA genes, and unlike most ordinary genes, VGAM991 precursor RNA does not encode a protein. A nucleotide sequence identical or highly similar to the nucleotide sequence of VGAM991 precursor RNA is designated SEQ ID:977, and is provided hereinbelow with reference to the sequence listing part. Nucleotide sequence SEQ ID:977 is located at position 390 relative to the genome of Leishmania RNA Virus 1-1.

VGAM991 precursor RNA folds onto itself, forming VGAM991 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM991 folded precursor RNA into VGAM991 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM991 RNA is designated SEQ ID:3702, and is provided hereinbelow with reference to the sequence listing part.

VGAM991 host target gene, herein designated VGAM HOST TARGET GENE, encodes a corresponding messenger RNA, VGAM991 host target RNA, herein designated VGAM HOST TARGET RNA. VGAM991 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM991 RNA, herein designated VGAM RNA, binds complementarily to one or more host target binding sites located in untranslated regions of VGAM991 host target RNA, herein designated VGAM HOST TARGET RNA. This complementary binding is due to the fact that the nucleotide sequence of VGAM991 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM991 RNA, herein designated VGAM RNA, may have a different number of host target binding sites in untranslated regions of a VGAM991 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM991 RNA, herein designated VGAM RNA, to host target binding sites on VGAM991 host target RNA, herein designated VGAM HOST TARGET RNA, such as BINDING SITE I, BINDING SITE II and BINDING SITE III, inhibits translation of VGAM991 host target RNA into VGAM991 host target protein, herein designated VGAM HOST TARGET PROTEIN. VGAM host target protein is therefore outlined by a broken line.

It is appreciated that VGAM991 host target gene, herein designated VGAM HOST TARGET GENE, in fact represents a plurality of VGAM991 host target genes. The mRNA of each one of this plurality of VGAM991 host target genes comprises one or more host target binding sites, each having a nucleotide sequence which is at least partly complementary to VGAM991 RNA, herein designated VGAM RNA, and which when bound by VGAM991 RNA causes inhibition of translation of respective one or more VGAM991 host target proteins.

It is further appreciated by one skilled in the art that the mode of translational inhibition illustrated by FIG. 1 with specific reference to translational inhibition exerted by VGAM991 gene, herein designated VGAM GENE, on one or more VGAM991 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM991 is inhibition of expression of host target genes, as part of a novel viral mechanism of attacking a host. Accordingly, utilities of VGAM991 include diagnosis, prevention and treatment of viral infection by Leishmania RNA Virus 1-1. Specific functions, and accordingly utilities, of VGAM991 correlate with, and may be deduced from, the identity of the host target genes which VGAM991 binds and inhibits, and the function of these host target genes, as elaborated hereinbelow.

Nucleotide sequences of the VGAM991 precursor RNA, herein designated VGAM PRECURSOR RNA, and of the 'diced' VGAM991 RNA, herein designated VGAM RNA, and a schematic representation of the secondary folding of VGAM991 folded precursor RNA, herein designated VGAM FOLDED PRECURSOR RNA, of VGAM991 are further described hereinbelow with reference to Table 1.

Nucleotide sequences of host target binding sites, such as BINDING SITE-I, BINDING SITE-II and BINDING SITE-III of FIG. 1, found on VGAM991 host target RNA, and schematic representation of the complementarity of each of these host target binding sites to VGAM991 RNA, herein designated VGAM RNA, are described hereinbelow with reference to Table 2.

As mentioned hereinabove with reference to FIG. 1, a function of VGAM991 gene, herein designated VGAM is inhibition of expression of VGAM991 target genes. It is appreciated that specific functions, and accordingly utilities, of VGAM991 correlate with, and may be deduced from, the identity of the target genes which VGAM991 binds and inhibits, and the function of these target genes, as elaborated hereinbelow.

Anterior Gradient 2 Homolog (Xenepus laevis) (AGR2, Accession NM_006408) is a VGAM991 host target gene. AGR2 BINDING SITE is HOST TARGET binding site found in the 3' untranslated region of mRNA encoded by AGR2, corresponding to a HOST TARGET binding site such as BINDING SITE I, BINDING SITE II or BINDING SITE III. Table 2 illustrates the complementarity of the nucleotide sequences of AGR2 BINDING SITE, designated SEQ ID:13113, to the nucleotide sequence of VGAM991 RNA, herein designated VGAM RNA, also designated SEQ ID:3702.

A function of VGAM991 is therefore inhibition of Anterior Gradient 2 Homolog (Xenepus laevis) (AGR2, Accession NM_006408), a gene which Expressed in estrogen receptor-positive breast cancer cell lines. Accordingly, utilities of VGAM991 include diagnosis, prevention and treatment of diseases and clinical conditions associated with AGR2. The function of AGR2 has been established by previous studies. Estrogen receptor (ER; 133430)-negative breast cancers are less well-differentiated and more aggressive than ER-positive tumors. Using suppression subtractive hybridization, Kuang et al. (1998) identified 29 gene fragments expressed in ER-positive breast carcinomas that might contribute to its less aggressive phenotype compared to ER-negative tumors. The expression of one of these fragments, DEME2, correlated with ER expression in 8 breast carcinoma cell lines. By screening an ER-positive breast cancer cDNA library with the DEKE2 fragment, followed by EST database searching, Thompson and Weigel (1998) obtained a cDNA encoding AGR2, a homolog of the frog secreted cement gland anterior gradient protein, which they termed AG2. The deduced 175-amino acid soluble AGR2 protein, which is 91% identical to the mouse protein and 47% identical to the frog protein, contains a signal peptide. Northern blot analysis revealed strongest expression of 0.9- and 1.6-kb AGR2 transcripts in lung and in all ER-positive breast carcinoma lines tested; weaker expression was detected in pancreas. RNA dot blot analysis detected strong expression in trachea, lung, stomach, colon, prostate, and small intestine, with lower expression in other tissues. By radiation hybrid analysis and FISH, Petek et al. (2000) mapped the AGR2 gene to 7p21.3.

Full details of the abovementioned studies are described in the following publications, the disclosure of which are hereby incorporated by reference:

Petek, E.; Windpassinger, C.; Egger, H.; Kroisel, P. M.; Wagner, K.: Localization of the human anterior gradient-2 gene (AGR2) to chromosome band 7p21.3 by radiation hybrid mapping and fluorescence in situ hybridisation. Cytogenet. Cell Genet. 89:141-142, 2000; and Thompson, D. A.; Weigel, R. J.: hAG-2, the human homologue of the Xenopus laevis cement gland gene XAG-2, is coexpressed with estrogen receptor in breast cancer cell lines. Biochem. B.

Further studies establishing the function and utilities of AGR2 are found in John Hopkins OMIM database record ID 606358, and in sited publications numbered 6420-6173 listed in the bibliography section hereinbelow, which are also hereby incorporated by reference. Solute Carrier Family 12 (potassium/chloride transporters), Member 7 (SLC12A7, Accession NM_006598) is another VGAM991 host target gene. SLC12A7 BINDING SITE is HOST TARGET binding site found in the 3' untranslated region of mRNA encoded by SLC12A7, corresponding to a HOST TARGET binding site such as BINDING SITE I, BINDING SITE II or BINDING SITE III. Table 2 illustrates the complementarity of the nucleotide sequences of SLC12A7 BINDING SITE, designated SEQ ID:13374, to the nucleotide sequence of VGAM991 RNA, herein designated VGAM RNA, also designated SEQ ID:3702.

Another function of VGAM991 is therefore inhibition of Solute Carrier Family 12 (potassium/chloride transporters), Member 7 (SLC12A7, Accession NM_006598), a gene which is a potassium/chloride-cotransporter. Accordingly, utilities of VGAM991 include diagnosis, prevention and treatment of diseases and clinical conditions associated with SLC12A7. The function of SLC12A7 and its association with various diseases and clinical conditions, has been established by previous studies, as described hereinabove with reference to VGAM200. CLIPR-59 (Accession NM_015526) is another VGAM991 host target gene. CLIPR-59 BINDING SITE is HOST TARGET binding site found in the 3' untranslated region of mRNA encoded by CLIPR-59, corresponding to a HOST TARGET binding site such as BINDING SITE I, BINDING SITE II or BINDING SITE III. Table 2 illustrates the complementarity of the nucleotide sequences of CLIPR-59 BINDING SITE, designated SEQ ID:17784, to the nucleotide sequence of VGAM991 RNA, herein designated VGAM RNA, also designated SEQ ID:3702.

Another function of VGAM991 is therefore inhibition of CLIPR-59 (Accession NM_015526). Accordingly, utilities of VGAM991 include diagnosis, prevention and treatment of diseases and clinical conditions associated with CLIPR-59. DCNP1 (Accession NM_130848) is another VGAM991 host target gene. DCNP1 BINDING SITE is HOST TARGET binding site found in the 3' untranslated region of mRNA encoded by DCNP1, corresponding to a HOST TARGET binding site such as BINDING SITE I, BINDING SITE II or BINDING SITE III. Table 2 illustrates the complementarity of the nucleotide sequences of DCNP1 BINDING SITE, designated SEQ ID:28386, to the nucleotide sequence of VGAM991 RNA, herein designated VGAM RNA, also designated SEQ ID:3702.

Another function of VGAM991 is therefore inhibition of DCNP1 (Accession NM_130848). Accordingly, utilities of VGAM991 include diagnosis, prevention and treatment of diseases and clinical conditions associated with DCNP1. FLJ12875 (Accession NM_024544) is another VGAM991 host target gene. FLJ12875 BINDING SITE is HOST TARGET binding site found in the 3' untranslated region of mRNA encoded by FLJ12875, corresponding to a HOST TARGET binding site such as BINDING SITE I, BINDING SITE II or BINDING SITE III. Table 2 illustrates the complementarity of the nucleotide sequences of FLJ12875 BINDING SITE, designated SEQ ID:23753, to the nucleotide sequence of VGAM991 RNA, herein designated VGAM RNA, also designated SEQ ID:3702.

Another function of VGAM991 is therefore inhibition of FLJ12875 (Accession NM_024544). Accordingly, utilities of VGAM991 include diagnosis, prevention and treatment of diseases and clinical conditions associated with FLJ12875. KIAA0323 (Accession XM_032634) is another VGAM991 host target gene. KIAA0323 BINDING SITE is HOST TARGET binding site found in the 3' untranslated region of mRNA encoded by KIAA0323, corresponding to a HOST TARGET binding site such as BINDING SITE I, BINDING SITE II or BINDING SITE III. Table 2 illustrates the complementarity of the nucleotide sequences of KIAA0323 BINDING SITE, designated SEQ ID:31686, to the nucleotide sequence of VGAM991 RNA, herein designated VGAM RNA, also designated SEQ ID:3702.

Another function of VGAM991 is therefore inhibition of KIAA0323 (Accession XM_032634). Accordingly, utilities of VGAM991 include diagnosis, prevention and treatment of diseases and clinical conditions associated with KIAA0323. LOC144308 (Accession XM_096575) is another VGAM991 host target gene. LOC144308 BINDING SITE is HOST TARGET binding site found in the 3' untranslated region of mRNA encoded by LOC144308, corresponding to a HOST TARGET binding site such as BINDING SITE I, BINDING SITE II or BINDING SITE III. Table 2 illustrates the complementarity of the nucleotide sequences of LOC144308 BINDING SITE, designated SEQ ID:40404, to the nucleotide sequence of VGAM991 RNA, herein designated VGAM RNA, also designated SEQ ID:3702.

Another function of VGAM991 is therefore inhibition of LOC144308 (Accession XM_096575). Accordingly, utilities of VGAM991 include diagnosis, prevention and treatment of diseases and clinical conditions associated with LOC144308. LOC153480 (Accession XM_053483) is another VGAM991 host target gene. LOC153480 BINDING SITE is HOST TARGET binding site found in the 5' untranslated region of mRNA encoded by LOC153480, corresponding to a HOST TARGET binding site such as BINDING SITE I, BINDING SITE II or BINDING SITE III. Table 2 illustrates the complementarity of the nucleotide sequences of LOC153480 BINDING SITE, designated SEQ ID:36088, to the nucleotide sequence of VGAM991 RNA, herein designated VGAM RNA, also designated SEQ ID:3702.

Another function of VGAM991 is therefore inhibition of LOC153480 (Accession XM_053483). Accordingly, utilities of VGAM991 include diagnosis, prevention and treatment of diseases and clinical conditions associated with LOC153480. LOC154739 (Accession XM_098602) is another VGAM991 host target gene. LOC154739 BINDING SITE is HOST TARGET binding site found in the 5' untranslated region of mRNA encoded by LOC154739, corresponding to a HOST TARGET binding site such as BINDING SITE I, BINDING SITE II or BINDING SITE III. Table 2 illustrates the complementarity of the nucleotide sequences of LOC154739 BINDING SITE, designated SEQ ID:41722, to the nucleotide sequence of VGAM991 RNA, herein designated VGAM RNA, also designated SEQ ID:3702.

Another function of VGAM991 is therefore inhibition of LOC154739 (Accession XM_098602). Accordingly, utilities of VGAM991 include diagnosis, prevention and treatment of diseases and clinical conditions associated with LOC154739. FIG. 1 further provides a conceptual description of a novel bioinformatically detected viral gene of the present invention, referred to here as Viral Genomic Address Messenger 992 (VGAM992) viral gene, which modulates expression of respective host target genes thereof, the function and utility of which host target genes is known in the art.

VGAM992 is a novel bioinformatically detected regulatory, non protein coding, viral micro RNA (miRNA) gene. The method by which VGAM992 was detected is described hereinabove with reference to FIGS. 1-8.

VGAM992 gene, herein designated VGAM GENE, is a viral gene contained in the genome of Leishmania RNA Virus 1-1. VGAM992 host target gene, herein designated VGAM HOST TARGET GENE, is a human gene contained in the human genome.

VGAM992 gene encodes a VGAM992 precursor RNA, herein designated VGAM PRECURSOR RNA. Similar to other miRNA genes, and unlike most ordinary genes, VGAM992 precursor RNA does not encode a protein. A nucleotide sequence identical or highly similar to the nucleotide sequence of VGAM992 precursor RNA is designated SEQ ID:978, and is provided hereinbelow with reference to the sequence listing part. Nucleotide sequence SEQ ID:978 is located at position 3813 relative to the genome of Leishmania RNA Virus 1-1.

VGAM992 precursor RNA folds onto itself, forming VGAM992 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM992 folded precursor RNA into VGAM992 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM992 RNA is designated SEQ ID:3703, and is provided hereinbelow with reference to the sequence listing part.

VGAM992 host target gene, herein designated VGAM HOST TARGET GENE, encodes a corresponding messenger RNA, VGAM992 host target RNA, herein designated VGAM HOST TARGET RNA. VGAM992 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM992 RNA, herein designated VGAM RNA, binds complementarily to one or more host target binding sites located in untranslated regions of VGAM992 host target RNA, herein designated VGAM HOST TARGET RNA. This complementary binding is due to the fact that the nucleotide sequence of VGAM992 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM992 RNA, herein designated VGAM RNA, may have a different number of host target binding sites in untranslated regions of a VGAM992 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM992 RNA, herein designated VGAM RNA, to host target binding sites on VGAM992 host target RNA, herein designated VGAM HOST TARGET RNA, such as BINDING SITE I, BINDING SITE II and BINDING SITE III, inhibits translation of VGAM992 host target RNA into VGAM992 host target protein, herein designated VGAM HOST TARGET PROTEIN.

VGAM host target protein is therefore outlined by a broken line.

It is appreciated that VGAM992 host target gene, herein designated VGAM HOST TARGET GENE, in fact represents a plurality of VGAM992 host target genes. The mRNA of each one of this plurality of VGAM992 host target genes comprises one or more host target binding sites, each having a nucleotide sequence which is at least partly complementary to VGAM992 RNA, herein designated VGAM RNA, and which when bound by VGAM992 RNA causes inhibition of translation of respective one or more VGAM992 host target proteins.

It is further appreciated by one skilled in the art that the mode of translational inhibition illustrated by FIG. 1 with specific reference to translational inhibition exerted by VGAM992 gene, herein designated VGAM GENE, on one or more VGAM992 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM992 is inhibition of expression of host target genes, as part of a novel viral mechanism of attacking a host. Accordingly, utilities of VGAM992 include diagnosis, prevention and treatment of viral infection by Leishmania RNA Virus 1-1. Specific functions, and accordingly utilities, of VGAM992 correlate with, and may be deduced from, the identity of the host target genes which VGAM992 binds and inhibits, and the function of these host target genes, as elaborated hereinbelow.

Nucleotide sequences of the VGAM992 precursor RNA, herein designated VGAM PRECURSOR RNA, and of the 'diced' VGAM992 RNA, herein designated VGAM RNA, and a schematic representation of the secondary folding of VGAM992 folded precursor RNA, herein designated VGAM FOLDED PRECURSOR RNA, of VGAM992 are further described hereinbelow with reference to Table 1.

Nucleotide sequences of host target binding sites, such as BINDING SITE-I, BINDING SITE-II and BINDING SITE-III of FIG. 1, found on VGAM992 host target RNA, and schematic representation of the complementarity of each of these host target binding sites to VGAM992 RNA, herein designated VGAM RNA, are described hereinbelow with reference to Table 2.

As mentioned hereinabove with reference to FIG. 1, a function of VGAM992 gene, herein designated VGAM is inhibition of expression of VGAM992 target genes. It is appreciated that specific functions, and accordingly utilities, of VGAM992 correlate with, and may be deduced from, the identity of the target genes which VGAM992 binds and inhibits, and the function of these target genes, as elaborated hereinbelow.

EGF-like-domain, Multiple 5 (EGFL5, Accession XM_098838) is a VGAM992 host target gene. EGFL5 BINDING SITE is HOST TARGET binding site found in the 3' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41879, to the nucleotide sequence of VGAM992 RNA, herein designated VGAM RNA, also designated SEQ ID:3703.

A function of VGAM992 is therefore inhibition of EGF-like-domain, Multiple 5 (EGFL5, Accession XM_098838). Accordingly, utilities of VGAM992 include diagnosis, prevention and treatment of diseases and clinical conditions associated with EGFL5. Leucine-rich Repeat-containing 2 (LRRC2, Accession NM_024512) is another VGAM992 host target gene. LRRC2 BINDING SITE is HOST TARGET binding site found in the 3' untranslated region of mRNA encoded by LRRC2, corresponding to a HOST TARGET binding site such as BINDING SITE I, BINDING SITE II or BINDING SITE III. Table 2 illustrates the complementarity of the nucleotide sequences of LRRC2 BINDING SITE, designated SEQ ID:23703, to the nucleotide sequence of VGAM992 RNA, herein designated VGAM RNA, also designated SEQ ID:3703.

Another function of VGAM992 is therefore inhibition of Leucine-rich Repeat-containing 2 (LRRC2, Accession NM_024512). Accordingly, utilities of VGAM992 include diagnosis, prevention and treatment of diseases and clinical conditions associated with LRRC2. Zinc Finger Protein, Subfamily 2A (FYVE domain containing), 1 (ZNFN2A1, Accession XM_027302) is another VGAM992 host target gene. ZNFN2A1 BINDING SITE is HOST TARGET binding site found in the 3' untranslated region of mRNA encoded by ZNFN2A1, corresponding to a HOST TARGET binding site such as BINDING SITE I, BINDING SITE II or BINDING SITE III. Table 2 illustrates the complementarity of the nucleotide sequences of ZNFN2A1 BINDING SITE, designated SEQ ID:30468, to the nucleotide sequence of VGAM992 RNA, herein designated VGAM RNA, also designated SEQ ID:3703.

Another function of VGAM992 is therefore inhibition of Zinc Finger Protein, Subfamily 2A (FYVE domain containing), 1 (ZNFN2A1, Accession XM_027302). Accordingly, utilities of VGAM992 include diagnosis, prevention and treatment of diseases and clinical conditions associated with ZNFN2A1. Calsenilin, Presenilin Binding Protein, EF Hand Transcription Factor (CSEN, Accession NM_013434) is another VGAM992 host target gene. CSEN BINDING SITE is HOST TARGET binding site found in the 3' untranslated region of mRNA encoded by CSEN, corresponding to a HOST TARGET binding site such as BINDING SITE I, BINDING SITE II or BINDING SITE III. Table 2 illustrates the complementarity of the nucleotide sequences of CSEN BINDING SITE, designated SEQ ID:15091, to the nucleotide sequence of VGAM992 RNA, herein designated VGAM RNA, also designated SEQ ID:3703.

Another function of VGAM992 is therefore inhibition of Calsenilin, Presenilin Binding Protein, EF Hand Transcription Factor (CSEN, Accession NM_013434). Accordingly, utilities of VGAM992 include diagnosis, prevention and treatment of diseases and clinical conditions associated with CSEN. Docking Protein 4 (DOK4, Accession NM_018110) is another VGAM992 host target gene. DOK4 BINDING SITE is HOST TARGET binding site found in the 3' untranslated region of mRNA encoded by DOK4, corresponding to a HOST TARGET binding site such as BINDING SITE I, BINDING SITE II or BINDING SITE III. Table 2 illustrates the complementarity of the nucleotide sequences of DOK4 BINDING SITE, designated SEQ ID:19879, to the nucleotide sequence of VGAM992 RNA, herein designated VGAM RNA, also designated SEQ ID:3703.

Another function of VGAM992 is therefore inhibition of Docking Protein 4 (DOK4, Accession NM_018110). Accordingly, utilities of VGAM992 include diagnosis, prevention and treatment of diseases and clinical conditions associated with DOK4. FLJ11800 (Accession NM_024974) is another VGAM992 host target gene. FLJ11800 BINDING SITE is HOST TARGET binding site found in the 3' untranslated region of mRNA encoded by FLJ11800, corresponding to a HOST TARGET binding site such as BINDING SITE I, BINDING SITE II or BINDING SITE III. Table 2 illustrates the complementarity of the nucleotide sequences of FLJ11800 BINDING SITE, designated SEQ ID:24531, to the nucleotide sequence of VGAM992 RNA, herein designated VGAM RNA, also designated SEQ ID:3703.

Another function of VGAM992 is therefore inhibition of FLJ11800 (Accession NM_024974). Accordingly, utilities of VGAM992 include diagnosis, prevention and treatment of diseases and clinical conditions associated with FLJ11800. FLJ22341 (Accession NM_024599) is another VGAM992 host target gene. FLJ22341 BINDING SITE is HOST TARGET binding site found in the 3' untranslated region of mRNA encoded by FLJ22341, corresponding to a HOST TARGET binding site such as BINDING SITE I, BINDING SITE II or BINDING SITE III. Table 2 illustrates the complementarity of the nucleotide sequences of FLJ22341 BINDING SITE, designated SEQ ID:23847, to the nucleotide sequence of VGAM992 RNA, herein designated VGAM RNA, also designated SEQ ID:3703.

Another function of VGAM992 is therefore inhibition of FLJ22341 (Accession NM_024599). Accordingly, utilities of VGAM992 include diagnosis, prevention and treatment of diseases and clinical conditions associated with FLJ22341. KIAA1950 (Accession XM_166532) is another VGAM992 host target gene. KIAA1950 BINDING SITE is HOST TARGET binding site found in the 3' untranslated region of mRNA encoded by KIAA1950, corresponding to a HOST TARGET binding site such as BINDING SITE I, BINDING SITE II or BINDING SITE III. Table 2 illustrates the complementarity of the nucleotide sequences of KIAA1950 BINDING SITE, designated SEQ ID:44487, to the nucleotide sequence of VGAM992 RNA, herein designated VGAM RNA, also designated SEQ ID:3703.

Another function of VGAM992 is therefore inhibition of KIAA1950 (Accession XM_166532). Accordingly, utilities of VGAM992 include diagnosis, prevention and treatment of diseases and clinical conditions associated with KIAA1950. MGC15631 (Accession NM_032753) is another VGAM992 host target gene. MGC15631 BINDING SITE is HOST TARGET binding site found in the 3' untranslated region of mRNA encoded by MGC15631, corresponding to a HOST TARGET binding site such as BINDING SITE I, BINDING SITE II or BINDING SITE III. Table 2 illustrates the complementarity of the nucleotide sequences of MGC15631 BINDING SITE, designated SEQ ID:26494, to the nucleotide sequence of VGAM992 RNA, herein designated VGAM RNA, also designated SEQ ID:3703.

Another function of VGAM992 is therefore inhibition of MGC15631 (Accession NM_032753). Accordingly, utilities of VGAM992 include diagnosis, prevention and treatment of diseases and clinical conditions associated with MGC15631. PRO2133 (Accession NM_018619) is another VGAM992 host target gene. PRO2133 BINDING SITE is HOST TARGET binding site found in the 3' untranslated region of mRNA encoded by PRO2133, corresponding to a HOST TARGET binding site such as BINDING SITE I, BINDING SITE II or BINDING SITE III. Table 2 illustrates the complementarity of the nucleotide sequences of PRO2133 BINDING SITE, designated SEQ ID:20693, to the nucleotide sequence of VGAM992 RNA, herein designated VGAM RNA, also designated SEQ ID:3703.

Another function of VGAM992 is therefore inhibition of PRO2133 (Accession NM_018619). Accordingly, utilities of VGAM992 include diagnosis, prevention and treatment of diseases and clinical conditions associated with PRO2133. Sialyltransferase 4A (beta-galactoside alpha-2,3-sialyltransferase) (SIAT4A, Accession NM_003033) is another VGAM992 host target gene. SIAT4A BINDING SITE is HOST TARGET binding site found in the 3' untranslated region of mRNA encoded by SIAT4A, corresponding to a HOST TARGET binding site such as BINDING SITE I, BINDING SITE II or BINDING SITE III. Table 2 illustrates the complementarity of the nucleotide sequences of SIAT4A BINDING SITE, designated SEQ ID:8979, to the nucleotide sequence of VGAM992 RNA, herein designated VGAM RNA, also designated SEQ ID:3703.

Another function of VGAM992 is therefore inhibition of Sialyltransferase 4A (beta-galactoside alpha-2,3-sialyltransferase) (SIAT4A, Accession NM_003033). Accordingly, utilities of VGAM992 include diagnosis, prevention and treatment of diseases and clinical conditions associated with SIAT4A. Stromal Antigen 3 (STAG3, Accession NM_012447) is another VGAM992 host target gene. STAG3 BINDING SITE is HOST TARGET binding site found in the 5' untranslated region of mRNA encoded by STAG3, corresponding to a HOST TARGET binding site such as BINDING SITE I, BINDING SITE II or BINDING SITE III. Table 2 illustrates the complementarity of the nucleotide sequences of STAG3 BINDING SITE, designated SEQ ID:14819, to the nucleotide sequence of VGAM992 RNA, herein designated VGAM RNA, also designated SEQ ID:3703.

Another function of VGAM992 is therefore inhibition of Stromal Antigen 3 (STAG3, Accession NM_012447). Accordingly, utilities of VGAM992 include diagnosis, prevention and treatment of diseases and clinical conditions associated with STAG3. Translocase of Outer Mitochondrial Membrane 70 Homolog A (yeast) (TOMM70A, Accession NM_014820) is another VGAM992 host target gene. TOMM70A BINDING SITE is HOST TARGET binding site found in the 3' untranslated region of mRNA encoded by TOMM70A, corresponding to a HOST TARGET binding site such as BINDING SITE I, BINDING SITE II or BINDING SITE III. Table 2 illustrates the complementarity of the nucleotide sequences of TOMM70A BINDING SITE, designated SEQ ID:16789, to the nucleotide sequence of VGAM992 RNA, herein designated VGAM RNA, also designated SEQ ID:3703.

Another function of VGAM992 is therefore inhibition of Translocase of Outer Mitochondrial Membrane 70 Homolog A (yeast) (TOMM70A, Accession NM_014820). Accordingly, utilities of VGAM992 include diagnosis, prevention and treatment of diseases and clinical conditions associated with TOMM70A. LOC138241 (Accession XM_059957) is another VGAM992 host target gene. LOC138241 BINDING SITE is HOST TARGET binding site found in the 5' untranslated region of mRNA encoded by LOC138241, corresponding to a HOST TARGET binding site such as BINDING SITE I, BINDING SITE II or BINDING SITE III. Table 2 illustrates the complementarity of the nucleotide sequences of LOC138241 BINDING SITE, designated SEQ ID:37120, to the nucleotide sequence of VGAM992 RNA, herein designated VGAM RNA, also designated SEQ ID:3703.

Another function of VGAM992 is therefore inhibition of LOC138241 (Accession XM_059957). Accordingly, utilities of VGAM992 include diagnosis, prevention and treatment of diseases and clinical conditions associated with LOC138241. LOC144848 (Accession XM_056770) is another VGAM992 host target gene. LOC144848 BINDING SITE is HOST TARGET binding site found in the 3' untranslated region of mRNA encoded by LOC144848, corresponding to a HOST TARGET binding site such as BINDING SITE I, BINDING SITE II or BINDING SITE III. Table 2 illustrates the complementarity of the nucleotide sequences of LOC144848 BINDING SITE, designated SEQ ID:36420, to the nucleotide sequence of VGAM992 RNA, herein designated VGAM RNA, also designated SEQ ID:3703.

Another function of VGAM992 is therefore inhibition of LOC144848 (Accession XM_056770). Accordingly, utilities of VGAM992 include diagnosis, prevention and treatment of diseases and clinical conditions associated with LOC144848. LOC170395 (Accession XM_084325) is another VGAM992 host target gene. LOC170395 BINDING SITE is HOST TARGET binding site found in the 3' untranslated region of mRNA encoded by LOC170395, corresponding to a HOST TARGET binding site such as BINDING SITE I, BINDING SITE II or BINDING SITE III. Table 2 illustrates the complementarity of the nucleotide sequences of LOC170395 BINDING SITE, designated SEQ ID:37544, to the nucleotide sequence of VGAM992 RNA, herein designated VGAM RNA, also designated SEQ ID:3703.

Another function of VGAM992 is therefore inhibition of LOC170395 (Accession XM_084325). Accordingly, utilities of VGAM992 include diagnosis, prevention and treatment of diseases and clinical conditions associated with LOC170395. LOC220575 (Accession XM_083991) is another VGAM992 host target gene. LOC220575 BINDING SITE is HOST TARGET binding site found in the 3' untranslated region of mRNA encoded by LOC220575, corresponding to a HOST TARGET binding site such as BINDING SITE I, BINDING SITE II or BINDING SITE III. Table 2 illustrates the complementarity of the nucleotide sequences of LOC220575 BINDING SITE, designated SEQ ID:37529, to the nucleotide sequence of VGAM992 RNA, herein designated VGAM RNA, also designated SEQ ID:3703.

Another function of VGAM992 is therefore inhibition of LOC220575 (Accession XM_083991). Accordingly, utilities of VGAM992 include diagnosis, prevention and treatment of diseases and clinical conditions associated with LOC220575. LOC254181 (Accession XM_174526) is another VGAM992 host target gene. LOC254181 BINDING SITE is HOST TARGET binding site found in the 5' untranslated region of mRNA encoded by LOC254181, corresponding to a HOST TARGET binding site such as BINDING SITE I, BINDING SITE II or BINDING SITE III. Table 2 illustrates the complementarity of the nucleotide sequences of LOC254181 BINDING SITE, designated SEQ ID:46597, to the nucleotide sequence of VGAM992 RNA, herein designated VGAM RNA, also designated SEQ ID:3703.

Another function of VGAM992 is therefore inhibition of LOC254181 (Accession XM_174526). Accordingly, utilities of VGAM992 include diagnosis, prevention and treatment of diseases and clinical conditions associated with LOC254181. FIG. 1 further provides a conceptual description of a novel bioinformatically detected viral gene of the present invention, referred to here as Viral Genomic Address Messenger 993 (VGAM993) viral gene, which modulates expression of respective host target genes thereof, the function and utility of which host target genes is known in the art.

VGAM993 is a novel bioinformatically detected regulatory, non protein coding, viral micro RNA (miRNA) gene. The method by which VGAM993 was detected is described hereinabove with reference to FIGS. 1-8.

VGAM993 gene, herein designated VGAM GENE, is a viral gene contained in the genome of Leishmania RNA Virus 1-1. VGAM993 host target gene, herein designated VGAM HOST TARGET GENE, is a human gene contained in the human genome.

VGAM993 gene encodes a VGAM993 precursor RNA, herein designated VGAM PRECURSOR RNA. Similar to other miRNA genes, and unlike most ordinary genes, VGAM993 precursor RNA does not encode a protein. A nucleotide sequence identical or highly similar to the nucleotide sequence of VGAM993 precursor RNA is designated SEQ ID:979, and is provided hereinbelow with reference to the sequence listing part. Nucleotide sequence SEQ ID:979 is located at position 4662 relative to the genome of Leishmania RNA Virus 1-1.

VGAM993 precursor RNA folds onto itself, forming VGAM993 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM993 folded precursor RNA into VGAM993 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM993 RNA is designated SEQ ID:3704, and is provided hereinbelow with reference to the sequence listing part.

VGAM993 host target gene, herein designated VGAM HOST TARGET GENE, encodes a corresponding messenger RNA, VGAM993 host target RNA, herein designated VGAM HOST TARGET RNA. VGAM993 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM993 RNA, herein designated VGAM RNA, binds complementarily to one or more host target binding sites located in untranslated regions of VGAM993 host target RNA, herein designated VGAM HOST TARGET RNA. This complementary binding is due to the fact that the nucleotide sequence of VGAM993 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM993 RNA, herein designated VGAM RNA, may have a different number of host target binding sites in untranslated regions of a VGAM993 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM993 RNA, herein designated VGAM RNA, to host target binding sites on VGAM993 host target RNA, herein designated VGAM HOST TARGET RNA, such as BINDING SITE I, BINDING SITE II and BINDING SITE III, inhibits translation of VGAM993 host target RNA into VGAM993 host target protein, herein designated VGAM HOST TARGET PROTEIN.

VGAM host target protein is therefore outlined by a broken line.

It is appreciated that VGAM993 host target gene, herein designated VGAM HOST TARGET GENE, in fact represents a plurality of VGAM993 host target genes. The mRNA of each one of this plurality of VGAM993 host target genes comprises one or more host target binding sites, each having a nucleotide sequence which is at least partly complementary to VGAM993 RNA, herein designated VGAM RNA, and which when bound by VGAM993 RNA causes inhibition of translation of respective one or more VGAM993 host target proteins.

It is further appreciated by one skilled in the art that the mode of translational inhibition illustrated by FIG. 1 with specific reference to translational inhibition exerted by VGAM993 gene, herein designated VGAM GENE, on one or more VGAM993 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM993 is inhibition of expression of host target genes, as part of a novel viral mechanism of attacking a host. Accordingly, utilities of VGAM993 include diagnosis, prevention and treatment of viral infection by Leishmania RNA Virus 1-1. Specific functions, and accordingly utilities, of VGAM993 correlate with, and may be deduced from, the identity of the host target genes which VGAM993 binds and inhibits, and the function of these host target genes, as elaborated hereinbelow.

Nucleotide sequences of the VGAM993 precursor RNA, herein designated VGAM PRECURSOR RNA, and of the 'diced' VGAM993 RNA, herein designated VGAM RNA, and a schematic representation of the secondary folding of VGAM993 folded precursor RNA, herein designated VGAM FOLDED PRECURSOR RNA, of VGAM993 are further described hereinbelow with reference to Table 1.

Nucleotide sequences of host target binding sites, such as BINDING SITE-I, BINDING SITE-II and BINDING SITE-III of FIG. 1, found on VGAM993 host target RNA, and schematic representation of the complementarity of each of these host target binding sites to VGAM993 RNA, herein designated VGAM RNA, are described hereinbelow with reference to Table 2.

As mentioned hereinabove with reference to FIG. 1, a function of VGAM993 gene, herein designated VGAM is inhibition of expression of VGAM993 target genes. It is appreciated that specific functions, and accordingly utilities, of VGAM993 correlate with, and may be deduced from, the identity of the target genes which VGAM993 binds and inhibits, and the function of these target genes, as elaborated hereinbelow.

Exostoses (multiple)-like 1 (EXTL1, Accession NM_004455) is a VGAM993 host target gene. EXTL1 BINDING SITE is HOST TARGET binding site found in the 3' untranslated region of mRNA encoded by EXTL1, corresponding to a HOST TARGET binding site such as BINDING SITE I, BINDING SITE II or BINDING SITE III. Table 2 illustrates the complementarity of the nucleotide sequences of EXTL1 BINDING SITE, designated SEQ ID:10751, to the nucleotide sequence of VGAM993 RNA, herein designated VGAM RNA, also designated SEQ ID:3704.

A function of VGAM993 is therefore inhibition of Exostoses (multiple)-like 1 (EXTL1, Accession NM_004455), a gene which probably contribute to the synthesis of heparan sulfate and heparin. Accordingly, utilities of VGAM993 include diagnosis, prevention and treatment of diseases and clinical conditions associated with EXTL1. The function of EXTL1 and its association with various diseases and clinical conditions, has been established by previous studies, as described hereinabove with reference to VGAM806. Protein Kinase (cAMP-dependent, catalytic) Inhibitor Alpha (PKIA, Accession NM_006823) is another VGAM993 host target gene. PKIA BINDING SITE is HOST TARGET binding site found in the 5' untranslated region of mRNA encoded by PKIA, corresponding to a HOST TARGET binding site such as BINDING SITE I, BINDING SITE II or BINDING SITE III. Table 2 illustrates the complementarity of the nucleotide sequences of PKIA BINDING SITE, designated SEQ ID:13699, to the nucleotide sequence of VGAM993 RNA, herein designated VGAM RNA, also designated SEQ ID:3704.

Another function of VGAM993 is therefore inhibition of Protein Kinase (cAMP-dependent, catalytic) Inhibitor Alpha (PKIA, Accession NM_006823). Accordingly, utilities of VGAM993 include diagnosis, prevention and treatment of diseases and clinical conditions associated with PKIA. PR Domain Containing 2, with ZNF Domain (PRDM2, Accession NM_015866) is another VGAM993 host target gene. PRDM2 BINDING SITE is HOST TARGET binding site found in the 3' untranslated region of mRNA encoded by PRDM2, corresponding to a HOST TARGET binding site such as BINDING SITE I, BINDING SITE II or BINDING SITE III. Table 2 illustrates the complementarity of the nucleotide sequences of PRDM2 BINDING SITE, designated SEQ ID:18005, to the nucleotide sequence of VGAM993 RNA, herein designated VGAM RNA, also designated SEQ ID:3704.

Another function of VGAM993 is therefore inhibition of PR Domain Containing 2, with ZNF Domain (PRDM2, Accession NM_015866), a gene which plays a role in transcriptional regulation during neuronal differentiation and pathogenesis of retinoblastoma. Accordingly, utilities of VGAM993 include diagnosis, prevention and treatment of diseases and clinical conditions associated with PRDM2. The function of PRDM2 and its association with various diseases and clinical conditions, has been established by previous studies, as described hereinabove with reference to VGAM120. RAP1A, Member of RAS Oncogene Family (RAP1A, Accession NM_002884) is another VGAM993 host target gene. RAP1A BINDING SITE is HOST TARGET binding site found in the 3" untranslated region of mRNA encoded by RAP1A, corresponding to a HOST TARGET binding site such as BINDING SITE I, BINDING SITE II or BINDING SITE III. Table 2 illustrates the complementarity of the nucleotide sequences of RAP1A BINDING SITE, designated SEQ ID:8794, to the nucleotide sequence of VGAM993 RNA, herein designated VGAM RNA, also designated SEQ ID:3704.

Another function of VGAM993 is therefore inhibition of RAP1A, Member of RAS Oncogene Family (RAP1A, Accession NM_002884), a gene which induces morphological reversion of a cell line transformed by a ras oncogene. Accordingly, utilities of VGAM993 include diagnosis, prevention and treatment of diseases and clinical conditions associated with RAP1A. The function of RAP1A has been established by previous studies. Three human cDNAs encoding 'new' RAS-related proteins, designated RAP1A, RAP1B, and RAP2, were isolated by Pizon et al. (1988). These proteins share approximately 50% amino acid identity with the classical RAS proteins and have numerous structural features in common. The most striking difference between the RAP and RAS proteins resides in their 61st amino acid: glutamine in RAS is replaced by threonine in RAP proteins. Animal model experiments lend further support to the function of RAP1A. Using mice transgenic for constitutive expression of Rap1a within the T cell lineage, Sebzda et al. (2002) found that instead of anergy, these T cells showed enhanced T cell receptor-mediated responses, both in thymocytes and in mature T cells. In addition, Rap1a activation induces strong activation of beta-1 (OMIM Ref. No. 135630) and beta-2 (OMIM Ref. No. 600065) integrins. The authors concluded that Rap1a positively influences T cells by augmenting their responses and directing integrin activation.

It is appreciated that the abovementioned animal model for RAP1A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pizon, V.; Chardin, P.; Lerosey, I.; Olofsson, B.; Tavitian, A.: Human cDNAs RAP1 and RAP2 homologous to the Drosophila gene Dras3 encode proteins closely related to ras in the 'effector' region. Oncogene 3:201-204, 1988; and Kitayama, H.; Sugimoto, Y.; Matsuzaki, T.; Ikawa, Y.; Noda, M.: A ras-related gene with transformation suppressor activity. Cell 56:77-84, 1989. PubMed ID:2642744 9. Sebzda, E.; Brac.

Further studies establishing the function and utilities of RAP1A are found in John Hopkins OMIM database record ID 179520, and in sited publications numbered 2547-2550, 1184, 488 and 12377-12381 listed in the bibliography section hereinbelow, which are also hereby incorporated by reference. DEAD/H (Asp-Glu-Ala-Asp/His) Box Polypeptide 28 (DDX28, Accession NM_018380) is another VGAM993 host target gene. DDX28 BINDING SITE is HOST TARGET binding site found in the 5' untranslated region of mRNA encoded by DDX28, corresponding to a HOST TARGET binding site such as BINDING SITE I, BINDING SITE II or BINDING SITE III. Table 2 illustrates the complementarity of the nucleotide sequences of DDX28 BINDING SITE, designated SEQ ID:20408, to the nucleotide sequence of VGAM993 RNA, herein designated VGAM RNA, also designated SEQ ID:3704.

Another function of VGAM993 is therefore inhibition of DEAD/H (Asp-Glu-Ala-Asp/His) Box Polypeptide 28 (DDX28, Accession NM_018380). Accordingly, utilities of VGAM993 include diagnosis, prevention and treatment of diseases and clinical conditions associated with DDX28. Potassium Voltage-gated Channel, Shal-related Subfamily, Member 1 (KCND1, Accession NM_004979) is another VGAM993 host target gene. KCND1 BINDING SITE is HOST TARGET binding site found in the 3' untranslated region of mRNA encoded by KCND1, corresponding to a HOST TARGET binding site such as BINDING SITE I, BINDING SITE II or BINDING SITE III. Table 2 illustrates the complementarity of the nucleotide sequences of KCND1 BINDING SITE, designated SEQ ID:11424, to the nucleotide sequence of VGAM993 RNA, herein designated VGAM RNA, also designated SEQ ID:3704.

Another function of VGAM993 is therefore inhibition of Potassium Voltage-gated Channel, Shal-related Subfamily, Member 1 (KCND1, Accession NM_004979). Accordingly, utilities of VGAM993 include diagnosis, prevention and treatment of diseases and clinical conditions associated with KCND1. MGC13251 (Accession NM_032714) is another VGAM993 host target gene. MGC13251 BINDING SITE is HOST TARGET binding site found in the 3' untranslated region of mRNA encoded by MGC13251, corresponding to a HOST TARGET binding site such as BINDING SITE I, BINDING SITE II or BINDING SITE III. Table 2 illustrates the complementarity of the nucleotide sequences of MGC13251 BINDING SITE, designated SEQ ID:26436, to the nucleotide sequence of VGAM993 RNA, herein designated VGAM RNA, also designated SEQ ID:3704.

Another function of VGAM993 is therefore inhibition of MGC13251 (Accession NM_032714). Accordingly, utilities of VGAM993 include diagnosis, prevention and treatment of diseases and clinical conditions associated with MGC13251. Synovial Sarcoma Translocation Gene On Chromosome 18-like 1 (SS18L1, Accession XM_037202) is another VGAM993 host target gene. SS18L1 BINDING SITE is HOST TARGET binding site found in the 3' untranslated region of mRNA encoded by SS18L1, corresponding to a HOST TARGET binding site such as BINDING SITE I, BINDING SITE II or BINDING SITE III. Table 2 illustrates the complementarity of the nucleotide sequences of SS18L1 BINDING SITE, designated SEQ ID:32558, to the nucleotide sequence of VGAM993 RNA, herein designated VGAM RNA, also designated SEQ ID:3704.

Another function of VGAM993 is therefore inhibition of Synovial Sarcoma Translocation Gene On Chromosome 18-like 1 (SS18L1, Accession XM_037202). Accordingly, utilities of VGAM993 include diagnosis, prevention and treatment of diseases and clinical conditions associated with SS18L1. LOC124460 (Accession XM_071892) is another VGAM993 host target gene. LOC124460 BINDING SITE is HOST TARGET binding site found in the 3' untranslated region of mRNA encoded by LOC124460, corresponding to a HOST TARGET binding site such as BINDING SITE I, BINDING SITE II or BINDING SITE III. Table 2 illustrates the complementarity of the nucleotide sequences of LOC124460 BINDING SITE, designated SEQ ID:37445, to the nucleotide sequence of VGAM993 RNA, herein designated VGAM RNA, also designated SEQ ID:3704.

Another function of VGAM993 is therefore inhibition of LOC124460 (Accession XM_071892). Accordingly, utilities of VGAM993 include diagnosis, prevention and treatment of diseases and clinical conditions associated with LOC124460. LOC138130 (Accession XM_070771) is another VGAM993 host target gene. LOC138130 BINDING SITE is HOST TARGET binding site found in the 5' untranslated region of mRNA encoded by LOC138130, corresponding to a HOST TARGET binding site such as BINDING SITE I, BINDING SITE II or BINDING SITE III. Table 2 illustrates the complementarity of the nucleotide sequences of LOC138130 BINDING SITE, designated SEQ ID:37394, to the nucleotide sequence of VGAM993 RNA, herein designated VGAM RNA, also designated SEQ ID:3704.

Another function of VGAM993 is therefore inhibition of LOC138130 (Accession XM_070771). Accordingly, utilities of VGAM993 include diagnosis, prevention and treatment of diseases and clinical conditions associated with LOC138130. LOC152620 (Accession XM_011108) is another VGAM993 host target gene. LOC152620 BINDING SITE is HOST TARGET binding site found in the 3' untranslated region of mRNA encoded by LOC152620, corresponding to a HOST TARGET binding site such as BINDING SITE I, BINDING SITE II or BINDING SITE III. Table 2 illustrates the complementarity of the nucleotide sequences of LOC152620 BIND- ING SITE, designated SEQ ID:30173, to the nucleotide sequence of VGAM993 RNA, herein designated VGAM RNA, also designated SEQ ID:3704.

Another function of VGAM993 is therefore inhibition of LOC152620 (Accession XM_011108). Accordingly, utilities of VGAM993 include diagnosis, prevention and treatment of diseases and clinical conditions associated with LOC152620. LOC158668 (Accession XM_045161) is another VGAM993 host target gene. LOC158668 BINDING SITE is HOST TARGET binding site found in the 3' untranslated region of mRNA encoded by LOC158668, corresponding to a HOST TARGET binding site such as BINDING SITE I, BINDING SITE II or BINDING SITE III. Table 2 illustrates the complementarity of the nucleotide sequences of LOC158668 BINDING SITE, designated SEQ ID:34377, to the nucleotide sequence of VGAM993 RNA, herein designated VGAM RNA, also designated SEQ ID:3704.

Another function of VGAM993 is therefore inhibition of LOC158668 (Accession XM_045161). Accordingly, utilities of VGAM993 include diagnosis, prevention and treatment of diseases and clinical conditions associated with LOC158668. LOC254312 (Accession XM_172839) is another VGAM993 host target gene. LOC254312 BINDING SITE is HOST TARGET binding site found in the 5' untranslated region of mRNA encoded by LOC254312, corresponding to a HOST TARGET binding site such as BINDING SITE I, BINDING SITE II or BINDING SITE III. Table 2 illustrates the complementarity of the nucleotide sequences of LOC254312 BINDING SITE, designated SEQ ID:46113, to the nucleotide sequence of VGAM993 RNA, herein designated VGAM RNA, also designated SEQ ID:3704.

Another function of VGAM993 is therefore inhibition of LOC254312 (Accession XM_172839). Accordingly, utilities of VGAM993 include diagnosis, prevention and treatment of diseases and clinical conditions associated with LOC254312. FIG. 1 further provides a conceptual description of a novel bioinformatically detected viral gene of the present invention, referred to here as Viral Genomic Address Messenger 994 (VGAM994) viral gene, which modulates expression of respective host target genes thereof, the function and utility of which host target genes is known in the art.

VGAM994 is a novel bioinformatically detected regulatory, non protein coding, viral micro RNA (miRNA) gene. The method by which VGAM994 was detected is described hereinabove with reference to FIGS. 1-8.

VGAM994 gene, herein designated VGAM GENE, is a viral gene contained in the genome of Leishmania RNA Virus 1-1. VGAM994 host target gene, herein designated VGAM HOST TARGET GENE, is a human gene contained in the human genome.

VGAM994 gene encodes a VGAM994 precursor RNA, herein designated VGAM PRECURSOR RNA. Similar to other miRNA genes, and unlike most ordinary genes, VGAM994 precursor RNA does not encode a protein. A nucleotide sequence identical or highly similar to the nucleotide sequence of VGAM994 precursor RNA is designated SEQ ID:980, and is provided hereinbelow with reference to the sequence listing part. Nucleotide sequence SEQ ID:980 is located at position 4299 relative to the genome of Leishmania RNA Virus 1-1.

VGAM994 precursor RNA folds onto itself, forming VGAM994 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM994 folded precursor RNA into VGAM994 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM994 RNA is designated SEQ ID:3705, and is provided hereinbelow with reference to the sequence listing part.

VGAM994 host target gene, herein designated VGAM HOST TARGET GENE, encodes a corresponding messenger RNA, VGAM994 host target RNA, herein designated VGAM HOST TARGET RNA. VGAM994 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM994 RNA, herein designated VGAM RNA, binds complementarily to one or more host target binding sites located in untranslated regions of VGAM994 host target RNA, herein designated VGAM HOST TARGET RNA. This complementary binding is due to the fact that the nucleotide sequence of VGAM994 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM994 RNA, herein designated VGAM RNA, may have a different number of host target binding sites in untranslated regions of a VGAM994 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM994 RNA, herein designated VGAM RNA, to host target binding sites on VGAM994 host target RNA, herein designated VGAM HOST TARGET RNA, such as BINDING SITE I, BINDING SITE II and BINDING SITE III, inhibits translation of VGAM994 host target RNA into VGAM994 host target protein, herein designated VGAM HOST TARGET PROTEIN. VGAM host target protein is therefore outlined by a broken line.

It is appreciated that VGAM994 host target gene, herein designated VGAM HOST TARGET GENE, in fact represents a plurality of VGAM994 host target genes. The mRNA of each one of this plurality of VGAM994 host target genes comprises one or more host target binding sites, each having a nucleotide sequence which is at least partly complementary to VGAM994 RNA, herein designated VGAM RNA, and which when bound by VGAM994 RNA causes inhibition of translation of respective one or more VGAM994 host target proteins.

It is further appreciated by one skilled in the art that the mode of translational inhibition illustrated by FIG. 1 with specific reference to translational inhibition exerted by VGAM994 gene, herein designated VGAM GENE, on one or more VGAM994 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM994 is inhibition of expression of host target genes, as part of a novel viral mechanism of attacking a host. Accordingly, utilities of VGAM994 include diagnosis, prevention and treatment of viral infection by Leishmania RNA Virus 1-1. Specific functions, and accordingly utilities, of VGAM994 correlate with, and may be deduced from, the identity of the host target genes which VGAM994 binds and inhibits, and the function of these host target genes, as elaborated hereinbelow.

Nucleotide sequences of the VGAM994 precursor RNA, herein designated VGAM PRECURSOR RNA, and of the 'diced' VGAM994 RNA, herein designated VGAM RNA, and a schematic representation of the secondary folding of VGAM994 folded precursor RNA, herein designated VGAM FOLDED PRECURSOR RNA, of VGAM994 are further described hereinbelow with reference to Table 1.

Nucleotide sequences of host target binding sites, such as BINDING SITE-I, BINDING SITE-II and BINDING SITE-III of FIG. 1, found on VGAM994 host target RNA, and schematic representation of the complementarity of each of these host target binding sites to VGAM994 RNA, herein designated VGAM RNA, are described hereinbelow with reference to Table 2.

As mentioned hereinabove with reference to FIG. 1, a function of VGAM994 gene, herein designated VGAM is inhibition of expression of VGAM994 target genes. It is appreciated that specific functions, and accordingly utilities, of VGAM994 correlate with, and may be deduced from, the identity of the target genes which VGAM994 binds and inhibits, and the function of these target genes, as elaborated hereinbelow.

Frizzled Homolog 4 (Drosophila) (FZD4, Accession NM_012193) is a VGAM994 host target gene. FZD4 BINDING SITE is HOST TARGET binding site found in the 3' untranslated region of mRNA encoded by FZD4, corresponding to a HOST TARGET binding site such as BINDING SITE I, BINDING SITE II or BINDING SITE III. Table 2 illustrates the complementarity of the nucleotide sequences of FZD4 BINDING SITE, designated SEQ ID:14489, to the nucleotide sequence of VGAM994 RNA, herein designated VGAM RNA, also designated SEQ ID:3705.

A function of VGAM994 is therefore inhibition of Frizzled Homolog 4 (Drosophila) (FZD4, Accession NM_012193), a gene which may function in cell polarity, cell fate specification and cancer; similar to frizzled receptor family, has seven transmembrane domains. Accordingly, utilities of VGAM994 include diagnosis, prevention and treatment of diseases and clinical conditions associated with FZD4. The function of FZD4 and its association with various diseases and clinical conditions, has been established by previous studies, as described hereinabove with reference to VGAM309. Solute Carrier Family 7 (cationic amino acid transporter, y+ system), Member 6 (SLC7A6, Accession NM_003983) is another VGAM994 host target gene. SLC7A6 BINDING SITE is HOST TARGET binding site found in the 3' untranslated region of mRNA encoded by SLC7A6, corresponding to a HOST TARGET binding site such as BINDING SITE I, BINDING SITE II or BINDING SITE III. Table 2 illustrates the complementarity of the nucleotide sequences of SLC7A6 BINDING SITE, designated SEQ ID:10131, to the nucleotide sequence of VGAM994 RNA, herein designated VGAM RNA, also designated SEQ ID:3705.

Another function of VGAM994 is therefore inhibition of Solute Carrier Family 7 (cationic amino acid transporter, y+ system), Member 6 (SLC7A6, Accession NM_003983), a gene which is involved in mediating amino acid transport. Accordingly, utilities of VGAM994 include diagnosis, prevention and treatment of diseases and clinical conditions associated with SLC7A6. The function of SLC7A6 and its association with various diseases and clinical conditions, has been established by previous studies, as described hereinabove with reference to VGAM87. FLJ10932 (Accession NM_018277) is another VGAM994 host target gene. FLJ10932 BINDING SITE is HOST TARGET binding site found in the 3' untranslated region of mRNA encoded by FLJ10932, corresponding to a HOST TARGET binding site such as BINDING SITE I, BINDING SITE II or BINDING SITE III. Table 2 illustrates the complementarity of the nucleotide sequences of FLJ10932 BINDING SITE, designated SEQ ID:20264, to the nucleotide sequence of VGAM994 RNA, herein designated VGAM RNA, also designated SEQ ID:3705.

Another function of VGAM994 is therefore inhibition of FLJ10932 (Accession NM_018277). Accordingly, utilities of VGAM994 include diagnosis, prevention and treatment of diseases and clinical conditions associated with FLJ10932. KIAA1906 (Accession XM_055095) is another VGAM994 host target gene. KIAA1906 BINDING SITE is HOST TARGET binding site found in the 3' untranslated region of mRNA encoded by KIAA1906, corresponding to a HOST TARGET binding site such as BINDING SITE I, BINDING SITE II or BINDING SITE III. Table 2 illustrates the complementarity of the nucleotide sequences of KIAA1906 BINDING SITE, designated SEQ ID:36230, to the nucleotide sequence of VGAM994 RNA, herein designated VGAM RNA, also designated SEQ ID:3705.

Another function of VGAM994 is therefore inhibition of KIAA1906 (Accession XM_055095). Accordingly, utilities of VGAM994 include diagnosis, prevention and treatment of diseases and clinical conditions associated with KIAA1906. LOC126917 (Accession XM_059091) is another VGAM994 host target gene. LOC126917 BINDING SITE is HOST TARGET binding site found in the 3' untranslated region of mRNA encoded by LOC126917, corresponding to a HOST TARGET binding site such as BINDING SITE I, BINDING SITE II or BINDING SITE III. Table 2 illustrates the complementarity of the nucleotide sequences of LOC126917 BINDING SITE, designated SEQ ID:36870, to the nucleotide sequence of VGAM994 RNA, herein designated VGAM RNA, also designated SEQ ID:3705.

Another function of VGAM994 is therefore inhibition of LOC126917 (Accession XM_059091). Accordingly, utilities of VGAM994 include diagnosis, prevention and treatment of diseases and clinical conditions associated with LOC126917. FIG. 1 further provides a conceptual description of a novel bioinformatically detected viral gene of the present invention, referred to here as Viral Genomic Address Messenger 995 (VGAM995) viral gene, which modulates expression of respective host target genes thereof, the function and utility of which host target genes is known in the art.

VGAM995 is a novel bioinformatically detected regulatory, non protein coding, viral micro RNA (miRNA) gene. The method by which VGAM995 was detected is described hereinabove with reference to FIGS. 1-8.

VGAM995 gene, herein designated VGAM GENE, is a viral gene contained in the genome of Leishmania RNA Virus 1-1. VGAM995 host target gene, herein designated VGAM HOST TARGET GENE, is a human gene contained in the human genome.

VGAM995 gene encodes a VGAM995 precursor RNA, herein designated VGAM PRECURSOR RNA. Similar to other miRNA genes, and unlike most ordinary genes, VGAM995 precursor RNA does not encode a protein. A nucleotide sequence identical or highly similar to the nucleotide sequence of VGAM995 precursor RNA is designated SEQ ID:981, and is provided hereinbelow with reference to the sequence listing part. Nucleotide sequence SEQ ID:981 is located at position 4489 relative to the genome of Leishmania RNA Virus 1-1.

VGAM995 precursor RNA folds onto itself, forming VGAM995 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM995 folded precursor RNA into VGAM995 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM995 RNA is designated SEQ ID:3706, and is provided hereinbelow with reference to the sequence listing part.

VGAM995 host target gene, herein designated VGAM HOST TARGET GENE, encodes a corresponding messenger RNA, VGAM995 host target RNA, herein designated VGAM HOST TARGET RNA. VGAM995 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM995 RNA, herein designated VGAM RNA, binds complementarily to one or more host target binding sites located in untranslated regions of VGAM995 host target RNA, herein designated VGAM HOST TARGET RNA. This complementary binding is due to the fact that the nucleotide sequence of VGAM995 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM995 RNA, herein designated VGAM RNA, may have a different number of host target binding sites in untranslated regions of a VGAM995 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM995 RNA, herein designated VGAM RNA, to host target binding sites on VGAM995 host target RNA, herein designated VGAM HOST TARGET RNA, such as BINDING SITE I, BINDING SITE II and BINDING SITE III, inhibits translation of VGAM995 host target RNA into VGAM995 host target protein, herein designated VGAM HOST TARGET PROTEIN. VGAM host target protein is therefore outlined by a broken line.

It is appreciated that VGAM995 host target gene, herein designated VGAM HOST TARGET GENE, in fact represents a plurality of VGAM995 host target genes. The mRNA of each one of this plurality of VGAM995 host target genes comprises one or more host target binding sites, each having a nucleotide sequence which is at least partly complementary to VGAM995 RNA, herein designated VGAM RNA, and which when bound by VGAM995 RNA causes inhibition of translation of respective one or more VGAM995 host target proteins.

It is further appreciated by one skilled in the art that the mode of translational inhibition illustrated by FIG. 1 with specific reference to translational inhibition exerted by VGAM995 gene, herein designated VGAM GENE, on one or more VGAM995 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM995 is inhibition of expression of host target genes, as part of a novel viral mechanism of attacking a host. Accordingly, utilities of VGAM995 include diagnosis, prevention and treatment of viral infection by Leishmania RNA Virus 1-1. Specific functions, and accordingly utilities, of VGAM995 correlate with, and may be deduced from, the identity of the host target genes which VGAM995 binds and inhibits, and the function of these host target genes, as elaborated hereinbelow.

Nucleotide sequences of the VGAM995 precursor RNA, herein designated VGAM PRECURSOR RNA, and of the 'diced' VGAM995 RNA, herein designated VGAM RNA, and a schematic representation of the secondary folding of VGAM995 folded precursor RNA, herein designated VGAM FOLDED PRECURSOR RNA, of VGAM995 are further described hereinbelow with reference to Table 1.

Nucleotide sequences of host target binding sites, such as BINDING SITE-I, BINDING SITE-II and BINDING SITE-III of FIG. 1, found on VGAM995 host target RNA, and schematic representation of the complementarity of each of these host target binding sites to VGAM995 RNA, herein designated VGAM RNA, are described hereinbelow with reference to Table 2.

As mentioned hereinabove with reference to FIG. 1, a function of VGAM995 gene, herein designated VGAM is inhibition of expression of VGAM995 target genes. It is appreciated that specific functions, and accordingly utilities, of VGAM995 correlate with, and may be deduced from, the identity of the target genes which VGAM995 binds and inhibits, and the function of these target genes, as elaborated hereinbelow.

Aryl Hydrocarbon Receptor (AHR, Accession NM_001621) is a VGAM995 host target gene. AHR BINDING SITE is HOST TARGET binding site found in the 3" untranslated region of mRNA encoded by AHR, corresponding to a HOST TARGET binding site such as BINDING SITE I, BINDING SITE II or BINDING SITE III. Table 2 illustrates the complementarity of the nucleotide sequences of AHR BINDING SITE, designated SEQ ID:7335, to the nucleotide sequence of VGAM995 RNA, herein designated VGAM RNA, also designated SEQ ID:3706.

A function of VGAM995 is therefore inhibition of Aryl Hydrocarbon Receptor (AHR, Accession NM_001621), a gene which plays a role in modulating carcinogenesis through the induction of xenobiotic-metabolizing enzymes. Accordingly, utilities of VGAM995 include diagnosis, prevention and treatment of diseases and clinical conditions associated with AHR. The function of AHR and its association with various diseases and clinical conditions, has been established by previous studies, as described hereinabove with reference to VGAM368. ATPase, Class I, Type 8B, Member 2 (ATP8B2, Accession XM_036933) is another VGAM995 host target gene. ATP8B2 BINDING SITE is HOST TARGET binding site found in the 5' untranslated region of mRNA encoded by ATP8B2, corresponding to a HOST TARGET binding site such as BINDING SITE I, BINDING SITE II or BINDING SITE III. Table 2 illustrates the complementarity of the nucleotide sequences of ATP8B2 BINDING SITE, designated SEQ ID:32509, to the nucleotide sequence of VGAM995 RNA, herein designated VGAM RNA, also designated SEQ ID:3706.

Another function of VGAM995 is therefore inhibition of ATPase, Class I, Type 8B, Member 2 (ATP8B2, Accession XM_036933). Accordingly, utilities of VGAM995 include diagnosis, prevention and treatment of diseases and clinical conditions associated with ATP8B2. B-cell CLL/lymphoma 2 (BCL2, Accession NM_000633) is another VGAM995 host target gene. BCL2 BINDING SITE is HOST TARGET binding site found in the 3' untranslated region of mRNA encoded by BCL2, corresponding to a HOST TARGET binding site such as BINDING SITE I, BINDING SITE II or BINDING SITE III. Table 2 illustrates the complementarity of the nucleotide sequences of BCL2 BINDING SITE, designated SEQ ID:6262, to the nucleotide sequence of VGAM995 RNA, herein designated VGAM RNA, also designated SEQ ID:3706.

Another function of VGAM995 is therefore inhibition of B-cell CLL/lymphoma 2 (BCL2, Accession NM_000633). Accordingly, utilities of VGAM995 include diagnosis, prevention and treatment of diseases and clinical conditions associated with BCL2. Calcitonin Receptor-like (CALCRL, Accession NM_005795) is another VGAM995 host target gene. CALCRL BINDING SITE is HOST TARGET binding site found in the 3' untranslated region of mRNA encoded by CALCRL, corresponding to a HOST TARGET binding site such as BINDING SITE I, BINDING SITE II or BINDING SITE III. Table 2 illustrates the complementarity of the nucleotide sequences of CALCRL BINDING SITE, designated SEQ ID:12376, to the nucleotide sequence of VGAM995 RNA, herein designated VGAM RNA, also designated SEQ ID:3706.

Another function of VGAM995 is therefore inhibition of Calcitonin Receptor-like (CALCRL, Accession NM_005795), a gene which is a receptor for calcitonin gene-related peptide type 1. Accordingly, utilities of VGAM995 include diagnosis, prevention and treatment of diseases and clinical conditions associated with CALCRL. The function of CALCRL has been established by previous studies. McLatchie et al. (1998) demonstrated that a complex consisting of RAMP2 and CALCRL can function as an ADM receptor. To investigate whether ADM has implications as a pathophysiologic substance in pregnancy-induced hypertension, Makino et al. (2001) measured the changes of expression of RAMP2 and CALCRL in fetomaternal tissues in normotensive pregnant women and pregnancy-induced hypertensive women by Northern blot analysis. RAMP2 and CALCRL mRNA was significantly decreased in the umbilical artery and uterus of the patients with pregnancy-induced hypertension. On the other hand, RAMP2 mRNA was significantly increased in the fetal membrane of the patients with pregnancy-induced hypertension. In addition, there was a significant negative correlation between the RAMP2 mRNA levels in the umbilical artery and uterine muscle and blood pressure. However, there was no correlation between the mRNA level and blood pressure in fetal membrane and placenta, suggesting that there is no close relationship to the pathogenesis in pregnancy-induced hypertension. These findings suggested that the reduced expression of RAMP2 and CALCRL functioning as components of an adrenomedullin receptor in umbilical artery and uterus may have some role in pregnancy-induced hypertension. In a mammalian cell line without an endogenous receptor, McLatchie et al. (1998) observed increased intracellular cAMP levels in response to CGRP when CGRPR and receptor activity-modifying protein-1 (RAMP1; 605153) were expressed together, but not when they were expressed alone. Flow cytometric analysis showed that expression of CGRPR at the cell surface increases substantially when CGRPR is expressed with RAMP1. Likewise, surface expression of RAMP1 was shown to increase in cells also expressing CGRPR. SDS-PAGE analysis showed that binding of CGRP requires expression of both the 14-kD RAMP1 and the 58-kD CGRPR glycoprotein. The authors demonstrated that in the presence of RAMP1, CGRPR becomes a 66-kD terminally glycosylated protein. McLatchie et al. (1998) found that unlike RAMP1, RAMP2 (OMIM Ref. No. 605154) and RAMP3 (OMIM Ref. No. 605155) do not potentiate responses to CGRP but do transport the glycosylated 58-kD but not the 66-kD form of CGRPR to the cell surface. In frog oocytes and mammalian cells, coexpression of RAMP2 and CGRPR resulted in increased intracellular cAMP concentrations in response to ADM but not to CGRP, CT, or IAPP. SDS-PAGE analysis demonstrated that ADM binds to coexpressed RAMP2 and CGRPR. McLatchie et al. (1998) demonstrated that a complex consisting of RAMP2 and CALCRL can function as an ADM receptor. To investigate whether ADM has implications as a pathophysiologic substance in pregnancy-induced hypertension, Makino et al. (2001) measured the changes of expression of RAMP2 and CALCRL in fetomaternal tissues in normotensive pregnant women and pregnancy-induced hypertensive women by Northern blot analysis. RAMP2 and CALCRL mRNA was significantly decreased in the umbilical artery and uterus of the patients with pregnancy-induced hypertension. On the other hand, RAMP2 mRNA was significantly increased in the fetal membrane of the patients with pregnancy-induced hypertension. In addition, there was a significant negative correlation between the RAMP2 mRNA levels in the umbilical artery and uterine muscle and blood pressure. However, there was no correlation between the mRNA level and blood pressure in fetal membrane and placenta, suggesting that there is no close relationship to the pathogenesis in pregnancy-induced hypertension. These findings suggested that the reduced expression of RAMP2 and CALCRL functioning as components of an adrenomedullin receptor in umbilical artery and uterus may have some role in pregnancy-induced hypertension.

Full details of the abovementioned studies are described in the following publications, the disclosure of which are hereby incorporated by reference:

McLatchie, L. M.; Fraser, N. J.; Main, M. J.; Wise, A.; Brown, J.; Thompson, N.; Solari, R.; Lee, M. G.; Foord, S. M.: RAMPs regulate the transport and ligand specificity of the calcitonin-receptor-like receptor. Nature 393:333-339, 1998; and Makino, Y.; Shibata, K.; Makino, I.; Kangawa, K.; Kawarabayashi, T.: Alteration of the adrenomedullin receptor components gene expression associated with the blood pressure in pregnancy.

Further studies establishing the function and utilities of CALCRL are found in John Hopkins OMIM database record ID 114190, and in sited publications numbered 4693-4697, 4301-430 and 4698 listed in the bibliography section hereinbelow, which are also hereby incorporated by reference. Calpain 10 (CAPN10, Accession NM_023088) is another VGAM995 host target gene. CAPN10 BINDING SITE is HOST TARGET binding site found in the 3' untranslated region of mRNA encoded by CAPN10, corresponding to a HOST TARGET binding site such as BINDING SITE I, BINDING SITE II or BINDING SITE III. Table 2 illustrates the complementarity of the nucleotide sequences of CAPN10 BINDING SITE, designated SEQ ID:23355, to the nucleotide sequence of VGAM995 RNA, herein designated VGAM RNA, also designated SEQ ID:3706.

Another function of VGAM995 is therefore inhibition of Calpain 10 (CAPN10, Accession NM_023088), a gene which catalyzes limited proteolysis of substrates involved in cytoskeletal remodelling and signal tranduction. Accordingly, utilities of VGAM995 include diagnosis, prevention and treatment of diseases and clinical conditions associated with CAPN10. The function of CAPN10 and its association with various diseases and clinical conditions, has been established by previous studies, as described hereinabove with reference to VGAM247. CRACC (Accession NM_021181) is another VGAM995 host target gene. CRACC BINDING SITE is HOST TARGET binding site found in the 3' untranslated region of mRNA encoded by CRACC, corresponding to a HOST TARGET binding site such as BINDING SITE I, BINDING SITE II or BINDING SITE III. Table 2 illustrates the complementarity of the nucleotide sequences of CRACC BINDING SITE, designated SEQ ID:22156, to the nucleotide sequence of VGAM995 RNA, herein designated VGAM RNA, also designated SEQ ID:3706.

Another function of VGAM995 is therefore inhibition of CRACC (Accession NM_021181), a gene which may participate in adhesion reactions between t lymphocytes and accessory cells. Accordingly, utilities of VGAM995 include diagnosis, prevention and treatment of diseases and clinical conditions associated with CRACC. The function of CRACC and its association with various diseases and clinical conditions, has been established by previous studies, as described hereinabove with reference to VGAM26. Fas (TNFRSF6)-associated Via Death Domain (FADD, Accession NM_003824) is another VGAM995 host target gene. FADD BINDING SITE is HOST TARGET binding site found in the 3' untranslated region of mRNA encoded by FADD, corresponding to a HOST TARGET binding site such as BINDING SITE I, BINDING SITE II or BINDING SITE III. Table 2 illustrates the complementarity of the nucleotide sequences of FADD BINDING SITE, designated SEQ ID:9918, to the nucleotide sequence of VGAM995 RNA, herein designated VGAM RNA, also designated SEQ ID:3706.

Another function of VGAM995 is therefore inhibition of Fas (TNFRSF6)-associated Via Death Domain (FADD, Accession NM_003824), a gene which may play an important role in the proximal signal transduction of FAS. Accordingly, utilities of VGAM995 include diagnosis, prevention and treatment of diseases and clinical conditions associated with FADD. The function of FADD has been established by previous studies. FADD is a universal adapter protein in apoptosis that mediates signaling of all known death domain-containing members of the TNF receptor superfamily (Kabra et al., 2001). Animal model experiments lend further support to the function of FADD. Yeh et al. (1998) found that FAS (CD95), TNFR1, and death receptor 3 (OMIM Ref. No. 603366) did not induce apoptosis in FADD-deficient embryonic fibroblasts, whereas DR4, oncogenes E1A and c-myc (OMIM Ref. No. 190080), and chemotherapeutic agent adriamycin did. Mice with a deletion in the FADD gene did not survive beyond day 11.5 of embryogenesis; these mice showed signs of cardiac failure and abdominal hemorrhage. Chimeric embryos showing a high contribution of FADD-null mutant cells to the heart reproduced the phenotype of FADD-deficient mutants. Thus, not only death receptors but also receptors that couple to developmental programs may use FADD for signaling. Since FAS is necessary for homeostasis in the immune system, Zhang et al. (1998) investigated the effect of FADD deletion in lymphoid organs. Since FADD-null mice die in utero, they used FADD-null, RAG1 (OMIM Ref. No. 179615)-null chimeras in which all mature lymphocytes were derived from the FADD-null cells, as RAG1-null mice are not capable of producing B or T cells. FAS-induced apoptosis was completely blocked in thymocytes from the FADD-null mice, indicating that there are no redundant FAS apoptotic pathways. Although thymocyte subpopulations were apparently normal in newborn chimeras, the thymocytes decreased to undetectable levels as these mice age. Peripheral T cells were present in all older FADD-null chimeras, but activation-induced proliferation was impaired despite production of IL2 (OMIM Ref. No. 147680). These results and the similarities between FADD-null mice and mice lacking the beta-subunits of the IL2 receptor (IL2RB; 146710), suggested to Zhang et al. (1998) that there is an unexpected connection between cell proliferation and apoptosis.

It is appreciated that the abovementioned animal model for FADD is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chinnaiyan, A. M.; O'Rourke, K.; Tewari, M.; Dixit, V. M.: FADD, a novel death domain-containing protein, interacts with the death domain of Fas and initiates apoptosis. Cell 81:505-512, 1995; and Zhang, J.; Cado, D.; Chen, A.; Kabra, N. H.; Winoto, A.: Fas-mediated apoptosis and activation-induced T-cell proliferation are defective in mice lacking FADD/Mort1. Nature 392:296-300.

Further studies establishing the function and utilities of FADD are found in John Hopkins OMIM database record ID 602457, and in sited publications numbered 6325-6326, 596 and 6184-6185 listed in the bibliography section hereinbelow, which are also hereby incorporated by reference. Insulin-like Growth Factor 2 Receptor (IGF2R, Accession NM_000876) is another VGAM995 host target gene. IGF2R BINDING SITE is HOST TARGET binding site found in the 3' untranslated region of mRNA encoded by IGF2R, corresponding to a HOST TARGET binding site such as BINDING SITE I, BINDING SITE II or BINDING SITE III. Table 2 illustrates the complementarity of the nucleotide sequences of IGF2R BINDING SITE, designated SEQ ID:6558, to the nucleotide sequence of VGAM995 RNA, herein designated VGAM RNA, also designated SEQ ID:3706.

Another function of VGAM995 is therefore inhibition of Insulin-like Growth Factor 2 Receptor (IGF2R, Accession NM_000876), a gene which transport of phosphorylated lysosomal enzymes from the golgi complex and the cell surface to lysosomes. lysosomal enzymes bearing phosphomannosyl residues bind specifically to mannose-6-phosphate receptors in the golgi apparatus and the resulting receptor-ligand complex is transported to an acidic prelysosomal compartment where the low ph mediates the dissociation of the complex. this receptor also binds insulin growth factor ii. Accordingly, utilities of VGAM995 include diagnosis, prevention and treatment of diseases and clinical conditions associated with IGF2R. The function of IGF2R and its association with various diseases and clinical conditions, has been established by previous studies, as described hereinabove with reference to VGAM209. Loss of Heterozygosity, 11, Chromosomal Region 2, Gene A (LOH11CR2A, Accession NM_014622) is another VGAM995 host target gene. LOH11CR2A BINDING SITE is HOST TARGET binding site found in the 5' untranslated region of mRNA encoded by LOH11CR2A, corresponding to a HOST TARGET binding site such as BINDING SITE I, BINDING SITE II or BINDING SITE III. Table 2 illustrates the complementarity of the nucleotide sequences of LOH11CR2A BINDING SITE, designated SEQ ID:15986, to the nucleotide sequence of VGAM995 RNA, herein designated VGAM RNA, also designated SEQ ID:3706.

Another function of VGAM995 is therefore inhibition of Loss of Heterozygosity, 11, Chromosomal Region 2, Gene A (LOH11CR2A, Accession NM_014622). Accordingly, utilities of VGAM995 include diagnosis, prevention and treatment of diseases and clinical conditions associated with LOH11CR2A. Snail Homolog 1 (Drosophila) (SNAI1, Accession NM_005985) is another VGAM995 host target gene. SNAI1 BINDING SITE is HOST TARGET binding site found in the 3' untranslated region of mRNA encoded by SNAI1, corresponding to a HOST TARGET binding site such as BINDING SITE I, BINDING SITE II or BINDING SITE III. Table 2 illustrates the complementarity of the nucleotide sequences of SNAI1 BINDING SITE, designated SEQ ID:12606, to the nucleotide sequence of VGAM995 RNA, herein designated VGAM RNA, also designated SEQ ID:3706.

Another function of VGAM995 is therefore inhibition of Snail Homolog 1 (Drosophila) (SNAI1, Accession NM_005985). Accordingly, utilities of VGAM995 include diagnosis, prevention and treatment of diseases and clinical conditions associated with SNAI1. Sulfotransferase Family, Cytosolic, 1A, Phenol-preferring, Member 2 (SULT1A2, Accession XM_051068) is another VGAM995 host target gene. SULT1A2 BINDING SITE is HOST TARGET binding site found in the 5' untranslated region of mRNA encoded by SULT1A2, corresponding to a HOST TARGET binding site such as BINDING SITE I, BINDING SITE II or BINDING SITE III. Table 2 illustrates the complementarity of the nucleotide sequences of SULT1A2 BINDING SITE, designated SEQ ID:35734, to the nucleotide sequence of VGAM995 RNA, herein designated VGAM RNA, also designated SEQ ID:3706.

Another function of VGAM995 is therefore inhibition of Sulfotransferase Family, Cytosolic, 1A, Phenol-preferring, Member 2 (SULT1A2, Accession XM_051068), a gene which catalyzes the sulfate conjugation of target proyeins and mediates the metabolic activation of carcinogenic n-hydroxyarylamines. Accordingly, utilities of VGAM995 include diagnosis, prevention and treatment of diseases and clinical conditions associated with SULT1A2. The function of SULT1A2 has been established by previous studies. Sulfonation is an important pathway in the biotransformation of many drugs, xenobiotics, neurotransmitters, and steroid hormones. The thermostable form of phenol sulfotransferase preferentially catalyzes the sulfonation of 'simple' planar phenols. The phenol sulfotransferase STP1 (OMIM Ref. No. 171150) maps to chromosome 16. Her et al. (1996) determined the structure and chromosomal localization of the gene encoding a second phenol sulfotransferase, STP2. The gene spans approximately 5.1 kb and contains 9 exons that range in length from 74 to 347 bp. The locations of most STP2 exon/intron splice junctions are identical to those of a gene for the thermolabile form of PST in human S, STM (OMIM Ref. No. 600641), which maps to 16p close to the location of the thermostable STP1. Her et al. (1996) mapped STP2 to human chromosome 16 by PCR with DNA from human/rodent somatic cell hybrids. Dooley and Huang (1996) determined the genomic organization of the human STP1, STP2, and STM (OMIM Ref. No. 600641) genes. These 3 genes each have 8 exons with the initiator methionine on exon 2. All 3 colocalize on a single cosmid from chromosome 16p12.1-p11.2 and have a high degree of sequence homology, suggesting that these 3 genes arose by gene duplication. Dooley and Huang (1996) stated that the previously identified PST gene sequences HAST4, HAST4v, and ST1A2 are isolates of the STP2 gene.

Full details of the abovementioned studies are described in the following publications, the disclosure of which are hereby incorporated by reference:

Dooley, T. P.; Huang, Z.: Genomic organization and DNA sequences of two human phenol sulfotransferase genes (STP1 and STP2) on the short arm of chromosome 16. Biochem. Biophys. Res. Commun. 228:134-140, 1996; and Her, C.; Raftogianis, R.; Weinshilboum, R. M.: Human phenol sulfotransferase STP2 gene: molecular cloning, structural characterization, and chromosomal localization. Genomics 33:409-4.

Further studies establishing the function and utilities of SULT1A2 are found in John Hopkins OMIM database record ID 601292, and in sited publications numbered 5264-5265 listed in the bibliography section hereinbelow, which are also hereby incorporated by reference. Ankyrin Repeat and SOCS Box-containing 13 (ASB13, Accession NM_024701) is another VGAM995 host target gene. ASB13 BINDING SITE is HOST TARGET binding site found in the 3' untranslated region of mRNA encoded by ASB13, corresponding to a HOST TARGET binding site such as BINDING SITE I, BINDING SITE II or BINDING SITE III. Table 2 illustrates the complementarity of the nucleotide sequences of ASB13 BINDING SITE, designated SEQ ID:24012, to the nucleotide sequence of VGAM995 RNA, herein designated VGAM RNA, also designated SEQ ID:3706.

Another function of VGAM995 is therefore inhibition of Ankyrin Repeat and SOCS Box-containing 13 (ASB13, Accession NM_024701). Accordingly, utilities of VGAM995 include diagnosis, prevention and treatment of diseases and clinical conditions associated with ASB13. DKFZP434C1715 (Accession XM_098421) is another VGAM995 host target gene. DKFZP434C1715 BINDING SITE is HOST TARGET binding site found in the 5' untranslated region of mRNA encoded by DKFZP434C1715, corresponding to a HOST TARGET binding site such as BINDING SITE I, BINDING SITE II or BINDING SITE III. Table 2 illustrates the complementarity of the nucleotide sequences of DKFZP434C1715 BINDING SITE, designated SEQ ID:41676, to the nucleotide sequence of VGAM995 RNA, herein designated VGAM RNA, also designated SEQ ID:3706.

Another function of VGAM995 is therefore inhibition of DKFZP434C1715 (Accession XM_098421). Accordingly, utilities of VGAM995 include diagnosis, prevention and treatment of diseases and clinical conditions associated with DKFZP434C1715. FLJ10604 (Accession NM_018154) is another VGAM995 host target gene. FLJ10604 BINDING SITE is HOST TARGET binding site found in the 3' untranslated region of mRNA encoded by FLJ10604, corresponding to a HOST TARGET binding site such as BINDING SITE I, BINDING SITE II or BINDING SITE III. Table 2 illustrates the complementarity of the nucleotide sequences of FLJ10604 BINDING SITE, designated SEQ ID:19964, to the nucleotide sequence of VGAM995 RNA, herein designated VGAM RNA, also designated SEQ ID:3706.

Another function of VGAM995 is therefore inhibition of FLJ10604 (Accession NM_018154). Accordingly, utilities of VGAM995 include diagnosis, prevention and treatment of diseases and clinical conditions associated with FLJ10604. FLJ10898 (Accession XM_002486) is another VGAM995 host target gene. FLJ10898 BINDING SITE is HOST TARGET binding site found in the 3' untranslated region of mRNA encoded by FLJ10898, corresponding to a HOST TARGET binding site such as BINDING SITE I, BINDING SITE II or BINDING SITE III. Table 2 illustrates the complementarity of the nucleotide sequences of FLJ10898 BINDING SITE, designated SEQ ID:29889, to the nucleotide sequence of VGAM995 RNA, herein designated VGAM RNA, also designated SEQ ID:3706.

Another function of VGAM995 is therefore inhibition of FLJ10898 (Accession XM_002486). Accordingly, utilities of VGAM995 include diagnosis, prevention and treatment of diseases and clinical conditions associated with FLJ10898. KIAA0721 (Accession XM_171125) is another VGAM995 host target gene. KIAA0721 BINDING SITE1 and KIAA0721 BINDING SITE2 are HOST TARGET binding sites found in untranslated regions of mRNA encoded by KIAA0721, corresponding to HOST TARGET binding sites such as BINDING SITE I, BINDING SITE II or BINDING SITE III. Table 2 illustrates the complementarity of the nucleotide sequences of KIAA0721 BINDING SITE1 and KIAA0721 BINDING SITE2, designated SEQ ID:45925 and SEQ ID:22318 respectively, to the nucleotide sequence of VGAM995 RNA, herein designated VGAM RNA, also designated SEQ ID:3706.

Another function of VGAM995 is therefore inhibition of KIAA0721 (Accession XM_171125). Accordingly, utilities of VGAM995 include diagnosis, prevention and treatment of diseases and clinical conditions associated with KIAA0721. KIAA1091 (Accession XM_045750) is another VGAM995 host target gene. KIAA1091 BINDING SITE is HOST TARGET binding site found in the 3' untranslated region of mRNA encoded by KIAA1091, corresponding to a HOST TARGET binding site such as BINDING SITE I, BINDING SITE II or BINDING SITE III. Table 2 illustrates the complementarity of the nucleotide sequences of KIAA1091 BINDING SITE, designated SEQ ID:34539, to the nucleotide sequence of VGAM995 RNA, herein designated VGAM RNA, also designated SEQ ID:3706.

Another function of VGAM995 is therefore inhibition of KIAA1091 (Accession XM_045750). Accordingly, utilities of VGAM995 include diagnosis, prevention and treatment of diseases and clinical conditions associated with KIAA1091. MGC4266 (Accession NM_032680) is another VGAM995 host target gene. MGC4266 BINDING SITE is HOST TARGET binding site found in the 5' untranslated region of mRNA encoded by MGC4266, corresponding to a HOST TARGET binding site such as BINDING SITE I, BINDING SITE II or BINDING SITE III. Table 2 illustrates the complementarity of the nucleotide sequences of MGC4266 BINDING SITE, designated SEQ ID:26401, to the nucleotide sequence of VGAM995 RNA, herein designated VGAM RNA, also designated SEQ ID:3706.

Another function of VGAM995 is therefore inhibition of MGC4266 (Accession NM_032680). Accordingly, utilities of VGAM995 include diagnosis, prevention and treatment of diseases and clinical conditions associated with MGC4266. Proteasome (prosome, macropain) 26S Subunit, Non-ATPase, 12 (PSMD12, Accession NM_002816) is another VGAM995 host target gene. PSMD12 BINDING SITE is HOST TARGET binding site found in the 3' untranslated region of mRNA encoded by PSMD12, corresponding to a HOST TARGET binding site such as BINDING SITE I, BINDING SITE II or BINDING SITE III. Table 2 illustrates the complementarity of the nucleotide sequences of PSMD12 BINDING SITE, designated SEQ ID:8681, to the nucleotide sequence of VGAM995 RNA, herein designated VGAM RNA, also designated SEQ ID:3706.

Another function of VGAM995 is therefore inhibition of Proteasome (prosome, macropain) 26S Subunit, Non-ATPase, 12 (PSMD12, Accession NM_002816). Accordingly, utilities of VGAM995 include diagnosis, prevention and treatment of diseases and clinical conditions associated with PSMD12. Regulatory Factor X, 4 (influences HLA class II expression) (RFX4, Accession NM_032491) is another VGAM995 host target gene. RFX4 BINDING SITE is HOST TARGET binding site found in the 3' untranslated region of mRNA encoded by RFX4, corresponding to a HOST TARGET binding site such as BINDING SITE I, BINDING SITE II or BINDING SITE III. Table 2 illustrates the complementarity of the nucleotide sequences of RFX4 BINDING SITE, designated SEQ ID:26242, to the nucleotide sequence of VGAM995 RNA, herein designated VGAM RNA, also designated SEQ ID:3706.

Another function of VGAM995 is therefore inhibition of Regulatory Factor X, 4 (influences HLA class II expression) (RFX4, Accession NM_032491). Accordingly, utilities of VGAM995 include diagnosis, prevention and treatment of diseases and clinical conditions associated with RFX4. LOC118709 (Accession XM_058338) is another VGAM995 host target gene. LOC118709 BINDING SITE is HOST TARGET binding site found in the 5' untranslated region of mRNA encoded by LOC118709, corresponding to a HOST TARGET binding site such as BINDING SITE I, BINDING SITE II or BINDING SITE III. Table 2 illustrates the complementarity of the nucleotide sequences of LOC118709 BINDING SITE, designated SEQ ID:36598, to the nucleotide sequence of VGAM995 RNA, herein designated VGAM RNA, also designated SEQ ID:3706.

Another function of VGAM995 is therefore inhibition of LOC118709 (Accession XM_058338). Accordingly, utilities of VGAM995 include diagnosis, prevention and treatment of diseases and clinical conditions associated with LOC118709. LOC126669 (Accession XM_060121) is another VGAM995 host target gene. LOC126669 BINDING SITE is HOST TARGET binding site found in the 3' untranslated region of mRNA encoded by LOC126669, corresponding to a HOST TARGET binding site such as BINDING SITE I, BINDING SITE II or BINDING SITE III. Table 2 illustrates the complementarity of the nucleotide sequences of LOC126669 BINDING SITE, designated SEQ ID:37159, to the nucleotide sequence of VGAM995 RNA, herein designated VGAM RNA, also designated SEQ ID:3706.

Another function of VGAM995 is therefore inhibition of LOC126669 (Accession XM_060121). Accordingly, utilities of VGAM995 include diagnosis, prevention and treatment of diseases and clinical conditions associated with LOC126669. LOC138241 (Accession XM_059957) is another VGAM995 host target gene. LOC138241 BINDING SITE is HOST TARGET binding site found in the 5' untranslated region of mRNA encoded by LOC138241, corresponding to a HOST TARGET binding site such as BINDING SITE I, BINDING SITE II or BINDING SITE III. Table 2 illustrates the complementarity of the nucleotide sequences of LOC138241 BINDING SITE, designated SEQ ID:37121, to the nucleotide sequence of VGAM995 RNA, herein designated VGAM RNA, also designated SEQ ID:3706.

Another function of VGAM995 is therefore inhibition of LOC138241 (Accession XM_059957). Accordingly, utilities of VGAM995 include diagnosis, prevention and treatment of diseases and clinical conditions associated with LOC138241. LOC145900 (Accession XM_085276) is another VGAM995 host target gene. LOC145900 BINDING SITE is HOST TARGET binding site found in the 5' untranslated region of mRNA encoded by LOC145900, corresponding to a HOST TARGET binding site such as BINDING SITE I, BINDING SITE II or BINDING SITE III. Table 2 illustrates the complementarity of the nucleotide sequences of LOC145900 BINDING SITE, designated SEQ ID:38012, to the nucleotide sequence of VGAM995 RNA, herein designated VGAM RNA, also designated SEQ ID:3706.

Another function of VGAM995 is therefore inhibition of LOC145900 (Accession XM_085276). Accordingly, utilities of VGAM995 include diagnosis, prevention and treatment of diseases and clinical conditions associated with LOC145900. LOC149844 (Accession XM_086675) is another VGAM995 host target gene. LOC149844 BINDING SITE is HOST TARGET binding site found in the 3' untranslated region of mRNA encoded by LOC149844, corresponding to a HOST TARGET binding site such as BINDING SITE I, BINDING SITE II or BINDING SITE III. Table 2 illustrates the complementarity of the nucleotide sequences of LOC149844 BINDING SITE, designated SEQ ID:38823, to the nucleotide sequence of VGAM995 RNA, herein designated VGAM RNA, also designated SEQ ID:3706.

Another function of VGAM995 is therefore inhibition of LOC149844 (Accession XM_086675). Accordingly, utilities of VGAM995 include diagnosis, prevention and treatment of diseases and clinical conditions associated with LOC149844. LOC151438 (Accession XM_098060) is another VGAM995 host target gene. LOC151438 BINDING SITE1 and LOC151438 BINDING SITE2 are HOST TARGET binding sites found in untranslated regions of mRNA encoded by LOC151438, corresponding to HOST TARGET binding sites such as BINDING SITE I, BINDING SITE II or BINDING SITE III. Table 2 illustrates the complementarity of the nucleotide sequences of LOC151438 BINDING SITE1 and LOC151438 BINDING SITE2, designated SEQ ID:41346 and SEQ ID:41350 respectively, to the nucleotide sequence of VGAM995 RNA, herein designated VGAM RNA, also designated SEQ ID:3706.

Another function of VGAM995 is therefore inhibition of LOC151438 (Accession XM_098060). Accordingly, utilities of VGAM995 include diagnosis, prevention and treatment of diseases and clinical conditions associated with LOC151438. LOC157376 (Accession XM_088301) is another VGAM995 host target gene. LOC157376 BINDING SITE is HOST TARGET binding site found in the 3' untranslated region of mRNA encoded by LOC157376, corresponding to a HOST TARGET binding site such as BINDING SITE I, BINDING SITE II or BINDING SITE III. Table 2 illustrates the complementarity of the nucleotide sequences of LOC157376 BINDING SITE, designated SEQ ID:39601, to the nucleotide sequence of VGAM995 RNA, herein designated VGAM RNA, also designated SEQ ID:3706.

Another function of VGAM995 is therefore inhibition of LOC157376 (Accession XM_088301). Accordingly, utilities of VGAM995 include diagnosis, prevention and treatment of diseases and clinical conditions associated with LOC157376. LOC197342 (Accession XM_113869) is another VGAM995 host target gene. LOC197342 BINDING SITE is HOST TARGET binding site found in the 3' untranslated region of mRNA encoded by LOC197342, corresponding to a HOST TARGET binding site such as BINDING SITE I, BINDING SITE II or BINDING SITE III. Table 2 illustrates the complementarity of the nucleotide sequences of LOC197342 BINDING SITE, designated SEQ ID:42489, to the nucleotide sequence of VGAM995 RNA, herein designated VGAM RNA, also designated SEQ ID:3706.

Another function of VGAM995 is therefore inhibition of LOC197342 (Accession XM_113869). Accordingly, utilities of VGAM995 include diagnosis, prevention and treatment of diseases and clinical conditions associated with LOC197342. LOC203286 (Accession XM_117526) is another VGAM995 host target gene. LOC203286 BINDING SITE is HOST TARGET binding site found in the 3' untranslated region of mRNA encoded by LOC203286, corresponding to a HOST TARGET binding site such as BINDING SITE I, BINDING SITE II or BINDING SITE III. Table 2 illustrates the complementarity of the nucleotide sequences of LOC203286 BINDING SITE, designated SEQ ID:43497, to the nucleotide sequence of VGAM995 RNA, herein designated VGAM RNA, also designated SEQ ID:3706.

Another function of VGAM995 is therefore inhibition of LOC203286 (Accession XM_117526). Accordingly, utilities of VGAM995 include diagnosis, prevention and treatment of diseases and clinical conditions associated with LOC203286. LOC222614 (Accession XM_169970) is another VGAM995 host target gene. LOC222614 BINDING SITE is HOST TARGET binding site found in the 5' untranslated region of mRNA encoded by LOC222614, corresponding to a HOST TARGET binding site such as BINDING SITE I, BINDING SITE II or BINDING SITE III. Table 2 illustrates the complementarity of the nucleotide sequences of LOC222614 BINDING SITE, designated SEQ ID:45306, to the nucleotide sequence of VGAM995 RNA, herein designated VGAM RNA, also designated SEQ ID:3706.

Another function of VGAM995 is therefore inhibition of LOC222614 (Accession XM_169970). Accordingly, utilities of VGAM995 include diagnosis, prevention and treatment of diseases and clinical conditions associated with LOC222614. LOC253613 (Accession XM_171225) is another VGAM995 host target gene. LOC253613 BINDING SITE is HOST TARGET binding site found in the 3' untranslated region of mRNA encoded by LOC253613, corresponding to a HOST TARGET binding site such as BINDING SITE I, BINDING SITE II or BINDING SITE III. Table 2 illustrates the complementarity of the nucleotide sequences of LOC253613 BINDING SITE, designated SEQ ID:46013, to the nucleotide sequence of VGAM995 RNA, herein designated VGAM RNA, also designated SEQ ID:3706.

Another function of VGAM995 is therefore inhibition of LOC253613 (Accession XM_171225). Accordingly, utilities of VGAM995 include diagnosis, prevention and treatment of diseases and clinical conditions associated with LOC253613.

LOC254936 (Accession XM_170770) is another VGAM995 host target gene. LOC254936 BINDING SITE is HOST TARGET binding site found in the 5' untranslated region of mRNA encoded by LOC254936, corresponding to a HOST TARGET binding site such as BINDING SITE I, BINDING SITE II or BINDING SITE III. Table 2 illustrates the complementarity of the nucleotide sequences of LOC254936 BINDING SITE, designated SEQ ID:45527, to the nucleotide sequence of VGAM995 RNA, herein designated VGAM RNA, also designated SEQ ID:3706.

Another function of VGAM995 is therefore inhibition of LOC254936 (Accession XM_170770). Accordingly, utilities of VGAM995 include diagnosis, prevention and treatment of diseases and clinical conditions associated with LOC254936.

LOC255870 (Accession XM_170628) is another VGAM995 host target gene. LOC255870 BINDING SITE is HOST TARGET binding site found in the 3' untranslated region of mRNA encoded by LOC255870, corresponding to a HOST TARGET binding site such as BINDING SITE I, BINDING SITE II or BINDING SITE III. Table 2 illustrates the complementarity of the nucleotide sequences of LOC255870 BINDING SITE, designated SEQ ID:45406, to the nucleotide sequence of VGAM995 RNA, herein designated VGAM RNA, also designated SEQ ID:3706.

Another function of VGAM995 is therefore inhibition of LOC255870 (Accession XM_170628). Accordingly, utilities of VGAM995 include diagnosis, prevention and treatment of diseases and clinical conditions associated with LOC255870.

LOC51336 (Accession NM_016646) is another VGAM995 host target gene. LOC51336 BINDING SITE is HOST TARGET binding site found in the 3' untranslated region of mRNA encoded by LOC51336, corresponding to a HOST TARGET binding site such as BINDING SITE I, BINDING SITE II or BINDING SITE III. Table 2 illustrates the complementarity of the nucleotide sequences of LOC51336 BINDING SITE, designated SEQ ID:18753, to the nucleotide sequence of VGAM995 RNA, herein designated VGAM RNA, also designated SEQ ID:3706.

Another function of VGAM995 is therefore inhibition of LOC51336 (Accession NM_016646). Accordingly, utilities of VGAM995 include diagnosis, prevention and treatment of diseases and clinical conditions associated with LOC51336.

LOC58486 (Accession NM_021211) is another VGAM995 host target gene. LOC58486 BINDING SITE is HOST TARGET binding site found in the 5' untranslated region of mRNA encoded by LOC58486, corresponding to a HOST TARGET binding site such as BINDING SITE I, BINDING SITE II or BINDING SITE III. Table 2 illustrates the complementarity of the nucleotide sequences of LOC58486 BINDING SITE, designated SEQ ID:22187, to the nucleotide sequence of VGAM995 RNA, herein designated VGAM RNA, also designated SEQ ID:3706.

Another function of VGAM995 is therefore inhibition of LOC58486 (Accession NM_021211). Accordingly, utilities of VGAM995 include diagnosis, prevention and treatment of diseases and clinical conditions associated with LOC58486.

LOC89135 (Accession XM_016232) is another VGAM995 host target gene. LOC89135 BINDING SITE is HOST TARGET binding site found in the 3' untranslated region of mRNA encoded by LOC89135, corresponding to a HOST TARGET binding site such as BINDING SITE I, BINDING SITE II or BINDING SITE III. Table 2 illustrates the complementarity of the nucleotide sequences of LOC89135 BINDING SITE, designated SEQ ID:30250, to the nucleotide sequence of VGAM995 RNA, herein designated VGAM RNA, also designated SEQ ID:3706.

Another function of VGAM995 is therefore inhibition of LOC89135 (Accession XM_016232). Accordingly, utilities of VGAM995 include diagnosis, prevention and treatment of diseases and clinical conditions associated with LOC89135.

LOC90538 (Accession XM_032401) is another VGAM995 host target gene. LOC90538 BINDING SITE is HOST TARGET binding site found in the 3' untranslated region of mRNA encoded by LOC90538, corresponding to a HOST TARGET binding site such as BINDING SITE I, BINDING SITE II or BINDING SITE III. Table 2 illustrates the complementarity of the nucleotide sequences of LOC90538 BINDING SITE, designated SEQ ID:31658, to the nucleotide sequence of VGAM995 RNA, herein designated VGAM RNA, also designated SEQ ID:3706.

Another function of VGAM995 is therefore inhibition of LOC90538 (Accession XM_032401). Accordingly, utilities of VGAM995 include diagnosis, prevention and treatment of diseases and clinical conditions associated with LOC90538.

LOC91974 (Accession XM_041974) is another VGAM995 host target gene. LOC91974 BINDING SITE is HOST TARGET binding site found in the 5' untranslated region of mRNA encoded by LOC91974, corresponding to a HOST TARGET binding site such as BINDING SITE I, BINDING SITE II or BINDING SITE III. Table 2 illustrates the complementarity of the nucleotide sequences of LOC91974 BINDING SITE, designated SEQ ID:33651, to the nucleotide sequence of VGAM995 RNA, herein designated VGAM RNA, also designated SEQ ID:3706.

Another function of VGAM995 is therefore inhibition of LOC91974 (Accession XM_041974). Accordingly, utilities of VGAM995 include diagnosis, prevention and treatment of diseases and clinical conditions associated with LOC91974.

FIG. 1 further provides a conceptual description of a novel bioinformatically detected viral gene of the present invention, referred to here as Viral Genomic Address Messenger 996 (VGAM996) viral gene, which modulates expression of respective host target genes thereof, the function and utility of which host target genes is known in the art.

VGAM996 is a novel bioinformatically detected regulatory, non protein coding, viral micro RNA (miRNA) gene. The method by which VGAM996 was detected is described hereinabove with reference to FIGS. 1-8.

VGAM996 gene, herein designated VGAM GENE, is a viral gene contained in the genome of Leishmania RNA Virus 1-1. VGAM996 host target gene, herein designated VGAM HOST TARGET GENE, is a human gene contained in the human genome.

VGAM996 gene encodes a VGAM996 precursor RNA, herein designated VGAM PRECURSOR RNA. Similar to other miRNA genes, and unlike most ordinary genes, VGAM996 precursor RNA does not encode a protein. A nucleotide sequence identical or highly similar to the nucleotide sequence of VGAM996 precursor RNA is designated SEQ ID:982, and is provided hereinbelow with reference to the sequence listing part. Nucleotide sequence SEQ ID:982 is located at position 3625 relative to the genome of Leishmania RNA Virus 1-1.

VGAM996 precursor RNA folds onto itself, forming VGAM996 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM996 folded precursor RNA into VGAM996 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM996 RNA is designated SEQ ID:3707, and is provided hereinbelow with reference to the sequence listing part.

VGAM996 host target gene, herein designated VGAM HOST TARGET GENE, encodes a corresponding messenger RNA, VGAM996 host target RNA, herein designated VGAM HOST TARGET RNA. VGAM996 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM996 RNA, herein designated VGAM RNA, binds complementarily to one or more host target binding sites located in untranslated regions of VGAM996 host target RNA, herein designated VGAM HOST TARGET RNA. This complementary binding is due to the fact that the nucleotide sequence of VGAM996 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM996 RNA, herein designated VGAM RNA, may have a different number of host target binding sites in untranslated regions of a VGAM996 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM996 RNA, herein designated VGAM RNA, to host target binding sites on VGAM996 host target RNA, herein designated VGAM HOST TARGET RNA, such as BINDING SITE I, BINDING SITE II and BINDING SITE III, inhibits translation of VGAM996 host target RNA into VGAM996 host target protein, herein designated VGAM HOST TARGET PROTEIN. VGAM host target protein is therefore outlined by a broken line.

It is appreciated that VGAM996 host target gene, herein designated VGAM HOST TARGET GENE, in fact represents a plurality of VGAM996 host target genes. The mRNA of each one of this plurality of VGAM996 host target genes comprises one or more host target binding sites, each having a nucleotide sequence which is at least partly complementary to VGAM996 RNA, herein designated VGAM RNA, and which when bound by VGAM996 RNA causes inhibition of translation of respective one or more VGAM996 host target proteins.

It is further appreciated by one skilled in the art that the mode of translational inhibition illustrated by FIG. 1 with specific reference to translational inhibition exerted by VGAM996 gene, herein designated VGAM GENE, on one or more VGAM996 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM996 is inhibition of expression of host target genes, as part of a novel viral mechanism of attacking a host. Accordingly, utilities of VGAM996 include diagnosis, prevention and treatment of viral infection by Leishmania RNA Virus 1-1. Specific functions, and accordingly utilities, of VGAM996 correlate with, and may be deduced from, the identity of the host target genes which VGAM996 binds and inhibits, and the function of these host target genes, as elaborated hereinbelow.

Nucleotide sequences of the VGAM996 precursor RNA, herein designated VGAM PRECURSOR RNA, and of the 'diced' VGAM996 RNA, herein designated VGAM RNA, and a schematic representation of the secondary folding of VGAM996 folded precursor RNA, herein designated VGAM FOLDED PRECURSOR RNA, of VGAM996 are further described hereinbelow with reference to Table 1.

Nucleotide sequences of host target binding sites, such as BINDING SITE-I, BINDING SITE-II and BINDING SITE-III of FIG. 1, found on VGAM996 host target RNA, and schematic representation of the complementarity of each of these host target binding sites to VGAM996 RNA, herein designated VGAM RNA, are described hereinbelow with reference to Table 2.

As mentioned hereinabove with reference to FIG. 1, a function of VGAM996 gene, herein designated VGAM is inhibition of expression of VGAM996 target genes. It is appreciated that specific functions, and accordingly utilities, of VGAM996 correlate with, and may be deduced from, the identity of the target genes which VGAM996 binds and inhibits, and the function of these target genes, as elaborated hereinbelow.

V-raf Murine Sarcoma 3611 Viral Oncogene Homolog 1 (ARAF1, Accession XM_033884) is a VGAM996 host target gene. ARAF1 BINDING SITE is HOST TARGET binding site found in the 5' untranslated region of mRNA encoded by ARAF1, corresponding to a HOST TARGET binding site such as BINDING SITE I, BINDING SITE II or BINDING SITE III. Table 2 illustrates the complementarity of the nucleotide sequences of ARAF1 BINDING SITE, designated SEQ ID:31980, to the nucleotide sequence of VGAM996 RNA, herein designated VGAM RNA, also designated SEQ ID:3707.

A function of VGAM996 is therefore inhibition of V-raf Murine Sarcoma 3611 Viral Oncogene Homolog 1 (ARAF1, Accession XM_033884), a gene which may play a critical role in cell growth and development. Accordingly, utilities of VGAM996 include diagnosis, prevention and treatment of diseases and clinical conditions associated with ARAF1. The function of ARAF1 has been established by previous studies. By screening a mouse cDNA library with a v-raf oncogene probe, Huebner et al. (1986) also isolated a transforming raf-related cDNA, A-raf, that represented a gene distinct from RAF1. As an initial step in the analysis of this RAF1-related cDNA, they isolated a human ARAF cDNA and used it to map the genes in mouse and man. The mouse gene cosegregated with the X chromosome in Chinese hamster-mouse hybrid cells. In human S, 2 independently segregating loci, designated ARAF1 and ARAF2, were mapped to chromosomes X and 7, respectively. (Huebner et al. (1986) had not conclusively shown that the ARAF2 locus on chromosome 7 is transcribed, and indeed the ARAF2 locus, now designated ARAF2P, has been shown to be a pseudogene (Lee et al., 1994).) The single X-linked ARAF locus of the mouse and the ARAF1 locus of man are actively transcribed in several mouse and human cell lines. Because of an 80% homology to RAF1 in its kinase domain, the authors speculated that the ARAF1 gene product may have serine/threonine-specific kinase activity. By in situ hybridization, ARAF1 was mapped to Xp21-q11, probably Xp13-p11. Popescu and Mark (1989) regionalized the gene to Xp11.4-p11.2 by in situ hybridization. Beck et al. (1987) deduced the complete 606-amino acid sequence of the human ARAF1 oncogene from the 2,453-nucleotide sequence of the cDNA. Avner et al. (1987) found that in the mouse the A-raf oncogene is on the X chromosome, 10 to 17 cM proximal to the Hprt gene. The localization was considered compatible with the presence of the ARAF oncogene on the short arm of the X chromosome between the centromere and Xp21 in man. The RAF proto-oncogenes encode cytoplasmic protein serine/threonine kinases that play a critical role in cell growth and development. Araf1 in the mouse is expressed predominantly in urogenital tissues. Lee et al. (1994) demonstrated that the ARAF1 gene in the human comprises 16 exons encoded by a minimum of 10,776 nucleotides.

Full details of the abovementioned studies are described in the following publications, the disclosure of which are hereby incorporated by reference:

Beck, T. W.; Huleihel, M.; Gunnell, M.; Bonner, T. I.; Rapp, U. R.: The complete coding sequence of the human A-raf-1 oncogene and transforming activity of a human A-raf carrying retrovirus. Nucleic Acids Res. 15:595-609, 1987; and Lee, J.-E.; Beck, T. W.; Brennscheidt, U.; DeGennaro, L. J.; Rapp, U. R.: The complete sequence and promoter activity of the human A-raf-1 gene (ARAF1). Genomics 20:43-55, 1994.

Further studies establishing the function and utilities of ARAF1 are found in John Hopkins OMIM database record ID 311010, and in sited publications numbered 8382-8387 listed in the bibliography section hereinbelow, which are also hereby incorporated by reference. CARPX (Accession NM_020178) is another VGAM996 host target gene. CARPX BINDING SITE is HOST TARGET binding site found in the 3' untranslated region of mRNA encoded by CARPX, corresponding to a HOST TARGET binding site such as BINDING SITE I, BINDING SITE II or BINDING SITE III. Table 2 illustrates the complementarity of the nucleotide sequences of CARPX BINDING SITE, designated SEQ ID:21393, to the nucleotide sequence of VGAM996 RNA, herein designated VGAM RNA, also designated SEQ ID:3707.

Another function of VGAM996 is therefore inhibition of CARPX (Accession NM_020178), a gene which is alpha-carbonic anhydrases-related protein. Accordingly, utilities of VGAM996 include diagnosis, prevention and treatment of diseases and clinical conditions associated with CARPX. The function of CARPX and its association with various diseases and clinical conditions, has been established by previous studies, as described hereinabove with reference to VGAM904. RP42 (Accession NM_020640) is another VGAM996 host target gene. RP42 BINDING SITE is HOST TARGET binding site found in the 3' untranslated region of mRNA encoded by RP42, corresponding to a HOST TARGET binding site such as BINDING SITE I, BINDING SITE II or BINDING SITE III. Table 2 illustrates the complementarity of the nucleotide sequences of RP42 BINDING SITE, designated SEQ ID:21799, to the nucleotide sequence of VGAM996 RNA, herein designated VGAM RNA, also designated SEQ ID:3707.

Another function of VGAM996 is therefore inhibition of RP42 (Accession NM_020640), a gene which not clear yet. Accordingly, utilities of VGAM996 include diagnosis, prevention and treatment of diseases and clinical conditions associated with RP42. The function of RP42 and its association with various diseases and clinical conditions, has been established by previous studies, as described hereinabove with reference to VGAM47. Sarcospan (Kras oncogene-associated gene) (SSPN, Accession NM_005086) is another VGAM996 host target gene. SSPN BINDING SITE is HOST TARGET binding site found in the 3' untranslated region of mRNA encoded by SSPN, corresponding to a HOST TARGET binding site such as BINDING SITE I, BINDING SITE II or BINDING SITE III. Table 2 illustrates the complementarity of the nucleotide sequences of SSPN BINDING SITE, designated SEQ ID:11535, to the nucleotide sequence of VGAM996 RNA, herein designated VGAM RNA, also designated SEQ ID:3707.

Another function of VGAM996 is therefore inhibition of Sarcospan (Kras oncogene-associated gene) (SSPN, Accession NM_005086), a gene which spans the muscle plasma membrane and forms a link between the f-actin cytoskeleton and the extracellular matrix. Accordingly, utilities of VGAM996 include diagnosis, prevention and treatment of diseases and clinical conditions associated with SSPN. The function of SSPN has been established by previous studies. Scott et al. (1994) reported the sequence of a gene in mice that is coamplified with Ki-ras (OMIM Ref. No. 190070) in the Y1 murine adrenal carcinoma cell line. The gene, designated Krag (Kirsten ras-associated gene) by them, consists of 3 exons and spans about 20 kb of genomic DNA. The Krag gene has a CG-rich promoter and first exon. The predicted 216-amino acid polypeptide encodes a protein with 4 potential hydrophobic domains, and its hydropathy plot resembles certain of the transmembrane-4 superfamily members such as CO-029 (OMIM Ref. No. 600769) and ME491 (OMIM Ref. No. 155740). An apparently homologous EST was mapped to chromosome 12. Heighway et al. (1996) isolated the human KRAG gene and showed that the predicted amino acid sequence is 91% identical to the mouse sequence. The human gene also contains 3 exons. Northern blots showed that KRAG is expressed in a variety of tissues with highest levels in muscle, where alternative splice variants were also observed. A YAC clone containing KRAG was mapped by fluorescence in situ hybridization to 12p11.2. One end of the YAC contained a sequence that was identical to that reported for inositol 1,4,5-triphosphate receptor type 2 (ITPR2; 600144), which had previously been mapped to 12p11. Heighway et al. (1996) showed that in certain tumors KRAS2, KRAG, and ITPR2 were all coamplified.

Full details of the abovementioned studies are described in the following publications, the disclosure of which are hereby incorporated by reference:

Heighway, J.; Betticher, D. C.; Hoban, P. R.; Altermatt, H. J.; Cowen, R.: Coamplification in tumors of KRAS2, type 2 inositol 1,4,5 triphosphate receptor gene, and a novel human gene, KRAG. Genomics 35:207-214, 1996; and Scott, A. F.; Elizaga, A.; Morrell, J.; Bergen, A.; Penno, M. B.: Characterization of a gene coamplified with Ki-ras in Y1 murine adrenal carcinoma cells that codes for a putative memb.

Further studies establishing the function and utilities of SSPN are found in John Hopkins OMIM database record ID 601599, and in sited publications numbered 642 and 9335-9336 listed in the bibliography section hereinbelow, which are also hereby incorporated by reference. Wingless-type MMTV Integration Site Family, Member 5A (WNT5A, Accession NM_003392) is another VGAM996 host target gene. WNT5A BINDING SITE is HOST TARGET binding site found in the 3' untranslated region of mRNA encoded by WNT5A, corresponding to a HOST TARGET binding site such as BINDING SITE I, BINDING SITE II or BINDING SITE III. Table 2 illustrates the complementarity of the nucleotide sequences of WNT5A BINDING SITE, designated SEQ ID:9428, to the nucleotide sequence of VGAM996 RNA, herein designated VGAM RNA, also designated SEQ ID:3707.

Another function of VGAM996 is therefore inhibition of Wingless-type MMTV Integration Site Family, Member 5A (WNT5A, Accession NM_003392), a gene which is a ligand for members of the frizzled family of seven transmembrane receptors and is probablely a developmental protein. Accordingly, utilities of VGAM996 include diagnosis, prevention and treatment of diseases and clinical conditions associated with WNT5A. The function of WNT5A has been established by previous studies. The Wnt genes belong to a family of proto-oncogenes with at least 13 known members that are expressed in species ranging from Drosophila to man. The name Wnt denotes the relationship of this family to the Drosophila segment polarity gene 'wingless' and to its vertebrate ortholog, Int1, a mouse proto-oncogene (see OMIM Ref. No. 164820). Transcription of Wnt family genes appears to be developmentally regulated in a precise temporal and spatial manner. The Wnt family is considered to be 1 of the 3 major families of signaling molecules in the mouse, the others being the fibroblast growth factor-related family (see OMIM Ref. No. 164980) and the transforming growth factor-beta-related family (TGFB; 190180). Using degenerate PCR and cDNA library screening to search for mouse genes related to Wnt1, Gavin et al. (1990) identified 6 new members of the Wnt gene family, including Wnt5a. The Wnt genes encode 38- to 43-kD cysteine-rich putative glycoproteins, which have features typical of secreted growth factors: a hydrophobic signal sequence and 21 conserved cysteine residues whose relative spacing is maintained. Northern blot analysis detected expression of Wnt5a in brain, lung, and heart. At least 5 distinct Wnt5a transcripts were observed, which Gavin et al. (1990) hypothesized were due to transcript variability 5-prime to the initiation methionine. In situ hybridization detected a complex spatial and temporal pattern of Wnt5a in the mouse, including expression in the developing central nervous system, limbs, facial processes, and the posterior region of the fetus. Clark et al. (1993) cloned and sequenced several overlapping cDNAs encoding approximately 4.1 kb of the human homolog of Wnt5A. Expression of the human gene, symbolized WNT5A, was detected only in neonatal heart and lung. He et al. (1997) showed that human frizzled-5 (OMIM Ref. No. 601723) is the receptor for the Wnt5A ligand.

Full details of the abovementioned studies are described in the following publications, the disclosure of which are hereby incorporated by reference:

Gavin, B. J.; McMahon, J. A.; McMahon, A. P.: Expression of multiple novel Wnt-1/int-1-related genes during fetal and adult mouse development. Genes Dev. 4:2319-2332, 1990; and He, X.; Saint-Jeannet, J.-P.; Wang, Y.; Nathans, J.; Dawid, I.; Varmus, H.: A member of the frizzled protein family mediating axis induction by Wnt-5A. Science 275:1652-1654, 1997.

Further studies establishing the function and utilities of WNT5A are found in John Hopkins OMIM database record ID 164975, and in sited publications numbered 328 and 12747 listed in the bibliography section hereinbelow, which are also hereby incorporated by reference. CDT6 (Accession NM_021146) is another VGAM996 host target gene. CDT6 BINDING SITE is HOST TARGET binding site found in the 5' untranslated region of mRNA encoded by CDT6, corresponding to a HOST TARGET binding site such as BINDING SITE I, BINDING SITE II or BINDING SITE III. Table 2 illustrates the complementarity of the nucleotide sequences of CDT6 BINDING SITE, designated SEQ ID:22118, to the nucleotide sequence of VGAM996 RNA, herein designated VGAM RNA, also designated SEQ ID:3707.

Another function of VGAM996 is therefore inhibition of CDT6 (Accession NM_021146). Accordingly, utilities of VGAM996 include diagnosis, prevention and treatment of diseases and clinical conditions associated with CDT6. FLJ23251 (Accession NM_024818) is another VGAM996 host target gene. FLJ23251 BINDING SITE is HOST TARGET binding site found in the 3' untranslated region of mRNA encoded by FLJ23251, corresponding to a HOST TARGET binding site such as BINDING SITE I, BINDING SITE II or BINDING SITE III. Table 2 illustrates the complementarity of the nucleotide sequences of FLJ23251 BINDING SITE, designated SEQ ID:24209, to the nucleotide sequence of VGAM996 RNA, herein designated VGAM RNA, also designated SEQ ID:3707.

Another function of VGAM996 is therefore inhibition of FLJ23251 (Accession NM_024818). Accordingly, utilities of VGAM996 include diagnosis, prevention and treatment of diseases and clinical conditions associated with FLJ23251. KIAA0461 (Accession XM_047883) is another VGAM996 host target gene. KIAA0461 BINDING SITE is HOST TARGET binding site found in the 3' untranslated region of mRNA encoded by KIAA0461, corresponding to a HOST TARGET binding site such as BINDING SITE I, BINDING SITE II or BINDING SITE III. Table 2 illustrates the complementarity of the nucleotide sequences of KIAA0461 BINDING SITE, designated SEQ ID:35073, to the nucleotide sequence of VGAM996 RNA, herein designated VGAM RNA, also designated SEQ ID:3707.

Another function of VGAM996 is therefore inhibition of KIAA0461 (Accession XM_047883). Accordingly, utilities of VGAM996 include diagnosis, prevention and treatment of diseases and clinical conditions associated with KIAA0461. KIAA1819 (Accession XM_045716) is another VGAM996 host target gene. KIAA1819 BINDING SITE is HOST TARGET binding site found in the 5' untranslated region of mRNA encoded by KIAA1819, corresponding to a HOST TARGET binding site such as BINDING SITE I, BINDING SITE II or BINDING SITE III. Table 2 illustrates the complementarity of the nucleotide sequences of KIAA1819 BINDING SITE, designated SEQ ID:34532, to the nucleotide sequence of VGAM996 RNA, herein designated VGAM RNA, also designated SEQ ID:3707.

Another function of VGAM996 is therefore inhibition of KIAA1819 (Accession XM_045716). Accordingly, utilities of VGAM996 include diagnosis, prevention and treatment of diseases and clinical conditions associated with KIAA1819. MAC30 (Accession XM_031536) is another VGAM996 host target gene. MAC30 BINDING SITE is HOST TARGET binding site found in the 3' untranslated region of mRNA encoded by MAC30, corresponding to a HOST TARGET binding site such as BINDING SITE I, BINDING SITE II or BINDING SITE III. Table 2 illustrates the complementarity of the nucleotide sequences of MAC30 BINDING SITE, designated SEQ ID:31402, to the nucleotide sequence of VGAM996 RNA, herein designated VGAM RNA, also designated SEQ ID:3707.

Another function of VGAM996 is therefore inhibition of MAC30 (Accession XM_031536). Accordingly, utilities of VGAM996 include diagnosis, prevention and treatment of diseases and clinical conditions associated with MAC30. Sema Domain, Transmembrane Domain (TM), and Cytoplasmic Domain, (semaphorin) 6A (SEMA6A, Accession NM_020796) is another VGAM996 host target gene. SEMA6A BINDING SITE is HOST TARGET binding site found in the 5' untranslated region of mRNA encoded by SEMA6A, corresponding to a HOST TARGET binding site such as BINDING SITE I, BINDING SITE II or BINDING SITE III. Table 2 illustrates the complementarity of the nucleotide sequences of SEMA6A BINDING SITE, designated SEQ ID:21879, to the nucleotide sequence of VGAM996 RNA, herein designated VGAM RNA, also designated SEQ ID:3707.

Another function of VGAM996 is therefore inhibition of Sema Domain, Transmembrane Domain (TM), and Cytoplasmic Domain, (semaphorin) 6A (SEMA6A, Accession NM_020796). Accordingly, utilities of VGAM996 include diagnosis, prevention and treatment of diseases and clinical conditions associated with SEMA6A. Tumor Protein D52 (TPD52, Accession NM_005079) is another VGAM996 host target gene. TPD52 BINDING SITE is HOST TARGET binding site found in the 3' untranslated region of mRNA encoded by TPD52, corresponding to a HOST TARGET binding site such as BINDING SITE I, BINDING SITE II or BINDING SITE III. Table 2 illustrates the complementarity of the nucleotide sequences of TPD52 BINDING SITE, designated SEQ ID:11530, to the nucleotide sequence of VGAM996 RNA, herein designated VGAM RNA, also designated SEQ ID:3707.

Another function of VGAM996 is therefore inhibition of Tumor Protein D52 (TPD52, Accession NM_005079). Accordingly, utilities of VGAM996 include diagnosis, prevention and treatment of diseases and clinical conditions associated with TPD52. LOC124460 (Accession XM_071892) is another VGAM996 host target gene. LOC124460 BINDING SITE is HOST TARGET binding site found in the 3' untranslated region of mRNA encoded by LOC124460, corresponding to a HOST TARGET binding site such as BINDING SITE I, BINDING SITE II or BINDING SITE III. Table 2 illustrates the complementarity of the nucleotide sequences of LOC124460 BINDING SITE, designated SEQ ID:37441, to the nucleotide sequence of VGAM996 RNA, herein designated VGAM RNA, also designated SEQ ID:3707.

Another function of VGAM996 is therefore inhibition of LOC124460 (Accession XM_071892). Accordingly, utilities of VGAM996 include diagnosis, prevention and treatment of diseases and clinical conditions associated with LOC124460. LOC130814 (Accession XM_059471) is another VGAM996 host target gene. LOC130814 BINDING SITE is HOST TARGET binding site found in the 3' untranslated region of mRNA encoded by LOC130814, corresponding to a HOST TARGET binding site such as BINDING SITE I, BINDING SITE II or BINDING SITE III. Table 2 illustrates the complementarity of the nucleotide sequences of LOC130814 BINDING SITE, designated SEQ ID:37007, to the nucleotide sequence of VGAM996 RNA, herein designated VGAM RNA, also designated SEQ ID:3707.

Another function of VGAM996 is therefore inhibition of LOC130814 (Accession XM_059471). Accordingly, utilities of VGAM996 include diagnosis, prevention and treatment of diseases and clinical conditions associated with LOC130814. LOC131827 (Accession XM_059536) is another VGAM996 host target gene. LOC131827 BINDING SITE is HOST TARGET binding site found in the 3' untranslated region of mRNA encoded by LOC131827, corresponding to a HOST TARGET binding site such as BINDING SITE I, BINDING SITE II or BINDING SITE III. Table 2 illustrates the complementarity of the nucleotide sequences of LOC131827 BINDING SITE, designated SEQ ID:37013, to the nucleotide sequence of VGAM996 RNA, herein designated VGAM RNA, also designated SEQ ID:3707.

Another function of VGAM996 is therefore inhibition of LOC131827 (Accession XM_059536). Accordingly, utilities of VGAM996 include diagnosis, prevention and treatment of diseases and clinical conditions associated with LOC131827. LOC136319 (Accession XM_059839) is another VGAM996 host target gene. LOC136319 BINDING SITE is HOST TARGET binding site found in the 3' untranslated region of mRNA encoded by LOC136319, corresponding to a HOST TARGET binding site such as BINDING SITE I, BINDING SITE II or BINDING SITE III. Table 2 illustrates the complementarity of the nucleotide sequences of LOC136319 BINDING SITE, designated SEQ ID:37101, to the nucleotide sequence of VGAM996 RNA, herein designated VGAM RNA, also designated SEQ ID:3707.

Another function of VGAM996 is therefore inhibition of LOC136319 (Accession XM_059839). Accordingly, utilities of VGAM996 include diagnosis, prevention and treatment of diseases and clinical conditions associated with LOC136319. LOC148267 (Accession XM_086129) is another VGAM996 host target gene. LOC148267 BINDING SITE is HOST TARGET binding site found in the 5' untranslated region of mRNA encoded by LOC148267, corresponding to a HOST TARGET binding site such as BINDING SITE I, BINDING SITE II or BINDING SITE III. Table 2 illustrates the complementarity of the nucleotide sequences of LOC148267 BINDING SITE, designated SEQ ID:38516, to the nucleotide sequence of VGAM996 RNA, herein designated VGAM RNA, also designated SEQ ID:3707.

Another function of VGAM996 is therefore inhibition of LOC148267 (Accession XM_086129). Accordingly, utilities of VGAM996 include diagnosis, prevention and treatment of diseases and clinical conditions associated with LOC148267. LOC221806 (Accession XM_166518) is another VGAM996 host target gene. LOC221806 BINDING SITE is HOST TARGET binding site found in the 5' untranslated region of mRNA encoded by LOC221806, corresponding to a HOST TARGET binding site such as BINDING SITE I, BINDING SITE II or BINDING SITE III. Table 2 illustrates the complementarity of the nucleotide sequences of LOC221806 BINDING SITE, designated SEQ ID:44453, to the nucleotide sequence of VGAM996 RNA, herein designated VGAM RNA, also designated SEQ ID:3707.

Another function of VGAM996 is therefore inhibition of LOC221806 (Accession XM_166518). Accordingly, utilities of VGAM996 include diagnosis, prevention and treatment of diseases and clinical conditions associated with LOC221806. LOC91445 (Accession XM_018516) is another VGAM996 host target gene. LOC91445 BINDING SITE is HOST TARGET binding site found in the 3' untranslated region of mRNA encoded by LOC91445, corresponding to a HOST TARGET binding site such as BINDING SITE I, BINDING SITE II or BINDING SITE III. Table 2 illustrates the complementarity of the nucleotide sequences of LOC91445 BINDING SITE, designated SEQ ID:30366, to the nucleotide sequence of VGAM996 RNA, herein designated VGAM RNA, also designated SEQ ID:3707.

Another function of VGAM996 is therefore inhibition of LOC91445 (Accession XM_018516). Accordingly, utilities of VGAM996 include diagnosis, prevention and treatment of diseases and clinical conditions associated with LOC91445.

FIG. 1 further provides a conceptual description of a novel bioinformatically detected viral gene of the present invention, referred to here as Viral Genomic Address Messenger 997 (VGAM997) viral gene, which modulates expression of respective host target genes thereof, the function and utility of which host target genes is known in the art.

VGAM997 is a novel bioinformatically detected regulatory, non protein coding, viral micro RNA (miRNA) gene. The method by which VGAM997 was detected is described hereinabove with reference to FIGS. 1-8.

VGAM997 gene, herein designated VGAM GENE, is a viral gene contained in the genome of Cowpox Virus. VGAM997 host target gene, herein designated VGAM HOST TARGET GENE, is a human gene contained in the human genome.

VGAM997 gene encodes a VGAM997 precursor RNA, herein designated VGAM PRECURSOR RNA. Similar to other miRNA genes, and unlike most ordinary genes, VGAM997 precursor RNA does not encode a protein. A nucleotide sequence identical or highly similar to the nucleotide sequence of VGAM997 precursor RNA is designated SEQ ID:983, and is provided hereinbelow with reference to the sequence listing part. Nucleotide sequence SEQ ID:983 is located at position 65867 relative to the genome of Cowpox Virus.

VGAM997 precursor RNA folds onto itself, forming VGAM997 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM997 folded precursor RNA into VGAM997 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM997 RNA is designated SEQ ID:3708, and is provided hereinbelow with reference to the sequence listing part.

VGAM997 host target gene, herein designated VGAM HOST TARGET GENE, encodes a corresponding messenger RNA, VGAM997 host target RNA, herein designated VGAM HOST TARGET RNA. VGAM997 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM997 RNA, herein designated VGAM RNA, binds complementarily to one or more host target binding sites located in untranslated regions of VGAM997 host target RNA, herein designated VGAM HOST TARGET RNA. This complementary binding is due to the fact that the nucleotide sequence of VGAM997 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM997 RNA, herein designated VGAM RNA, may have a different number of host target binding sites in untranslated regions of a VGAM997 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM997 RNA, herein designated VGAM RNA, to host target binding sites on VGAM997 host target RNA, herein designated VGAM HOST TARGET RNA, such as BINDING SITE I, BINDING SITE II and BINDING SITE III, inhibits translation of VGAM997 host target RNA into VGAM997 host target protein, herein designated VGAM HOST TARGET PROTEIN. VGAM host target protein is therefore outlined by a broken line.

It is appreciated that VGAM997 host target gene, herein designated VGAM HOST TARGET GENE, in fact represents a plurality of VGAM997 host target genes. The mRNA of each one of this plurality of VGAM997 host target genes comprises one or more host target binding sites, each having a nucleotide sequence which is at least partly complementary to VGAM997 RNA, herein designated VGAM RNA, and which when bound by VGAM997 RNA causes inhibition of translation of respective one or more VGAM997 host target proteins.

It is further appreciated by one skilled in the art that the mode of translational inhibition illustrated by FIG. 1 with specific reference to translational inhibition exerted by VGAM997 gene, herein designated VGAM GENE, on one or more VGAM997 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM997 is inhibition of expression of host target genes, as part of a novel viral mechanism of attacking a host. Accordingly, utilities of VGAM997 include diagnosis, prevention and treatment of viral infection by Cowpox Virus. Specific functions, and accordingly utilities, of VGAM997 correlate with, and may be deduced from, the identity of the host target genes which VGAM997 binds and inhibits, and the function of these host target genes, as elaborated hereinbelow.

Nucleotide sequences of the VGAM997 precursor RNA, herein designated VGAM PRECURSOR RNA, and of the 'diced' VGAM997 RNA, herein designated VGAM RNA, and a schematic representation of the secondary folding of VGAM997 folded precursor RNA, herein designated VGAM FOLDED PRECURSOR RNA, of VGAM997 are further described hereinbelow with reference to Table 1.

Nucleotide sequences of host target binding sites, such as BINDING SITE-I, BINDING SITE-II and BINDING SITE-III of FIG. 1, found on VGAM997 host target RNA, and schematic representation of the complementarity of each of these host target binding sites to VGAM997 RNA, herein designated VGAM RNA, are described hereinbelow with reference to Table 2.

As mentioned hereinabove with reference to FIG. 1, a function of VGAM997 gene, herein designated VGAM is inhibition of expression of VGAM997 target genes. It is appreciated that specific functions, and accordingly utilities, of VGAM997 correlate with, and may be deduced from, the identity of the target genes which VGAM997 binds and inhibits, and the function of these target genes, as elaborated hereinbelow.

Glutamate Receptor, Metabotropic 1 (GRM1, Accession NM_000838) is a VGAM997 host target gene. GRM1 BINDING SITE is HOST TARGET binding site found in the 3' untranslated region of mRNA encoded by GRM1, corresponding to a HOST TARGET binding site such as BINDING SITE I, BINDING SITE II or BINDING SITE III. Table 2 illustrates the complementarity of the nucleotide sequences of GRM1 BINDING SITE, designated SEQ ID:6494, to the nucleotide sequence of VGAM997 RNA, herein designated VGAM RNA, also designated SEQ ID:3708.

A function of VGAM997 is therefore inhibition of Glutamate Receptor, Metabotropic 1 (GRM1, Accession NM_000838), a gene which promotes phosphoinositide hydrolysis. Accordingly, utilities of VGAM997 include diagnosis, prevention and treatment of diseases and clinical conditions associated with GRM1. The function of GRM1 and its association with various diseases and clinical conditions, has been established by previous studies, as described hereinabove with reference to VGAM786. Solute Carrier Family 13 (sodium/sulfate symporters), Member 1 (SLC13A1, Accession NM_022444) is another VGAM997 host target gene. SLC13A1 BINDING SITE is HOST TARGET binding site found in the 3' untranslated region of mRNA encoded by SLC13A1, corresponding to a HOST TARGET binding site such as BINDING SITE I, BINDING SITE II or BINDING SITE III. Table 2 illustrates the complementarity of the nucleotide sequences of SLC13A1 BINDING SITE, designated SEQ ID:22774, to the nucleotide sequence of VGAM997 RNA, herein designated VGAM RNA, also designated SEQ ID:3708.

Another function of VGAM997 is therefore inhibition of Solute Carrier Family 13 (sodium/sulfate symporters), Member 1 (SLC13A1, Accession NM_022444). Accordingly, utilities of VGAM997 include diagnosis, prevention and treatment of diseases and clinical conditions associated with SLC13A1. GFR (Accession NM_012294) is another VGAM997 host target gene. GFR BINDING SITE is HOST TARGET binding site found in the 3" untranslated region of mRNA encoded by GFR, corresponding to a HOST TARGET binding site such as BINDING SITE I, BINDING SITE II or BINDING SITE III. Table 2 illustrates the complementarity of the nucleotide sequences of GFR BINDING SITE, designated SEQ ID:14636, to the nucleotide sequence of VGAM997 RNA, herein designated VGAM RNA, also designated SEQ ID:3708.

Another function of VGAM997 is therefore inhibition of GFR (Accession NM_012294). Accordingly, utilities of VGAM997 include diagnosis, prevention and treatment of diseases and clinical conditions associated with GFR. KIAA1878 (Accession XM_166256) is another VGAM997 host target gene. KIAA1878 BINDING SITE is HOST TARGET binding site found in the 3" untranslated region of mRNA encoded by KIAA1878, corresponding to a HOST TARGET binding site such as BINDING SITE I, BINDING SITE II or BINDING SITE III. Table 2 illustrates the complementarity of the nucleotide sequences of KIAA1878 BINDING SITE, designated SEQ ID:44074, to the nucleotide sequence of VGAM997 RNA, herein designated VGAM RNA, also designated SEQ ID:3708.

Another function of VGAM997 is therefore inhibition of KIAA1878 (Accession XM_166256). Accordingly, utilities of VGAM997 include diagnosis, prevention and treatment of diseases and clinical conditions associated with KIAA1878. LOC222681 (Accession XM_167116) is another VGAM997 host target gene. LOC222681 BINDING SITE is HOST TARGET binding site found in the 3' untranslated region of mRNA encoded by LOC222681, corresponding to a HOST TARGET binding site such as BINDING SITE I, BINDING SITE II or BINDING SITE III. Table 2 illustrates the complementarity of the nucleotide sequences of LOC222681 BINDING SITE, designated SEQ ID:44614, to the nucleotide sequence of VGAM997 RNA, herein designated VGAM RNA, also designated SEQ ID:3708.

Another function of VGAM997 is therefore inhibition of LOC222681 (Accession XM_167116). Accordingly, utilities of VGAM997 include diagnosis, prevention and treatment of diseases and clinical conditions associated with LOC222681. LOC257507 (Accession XM_175204) is another VGAM997 host target gene. LOC257507 BINDING SITE is HOST TARGET binding site found in the 3' untranslated region of mRNA encoded by LOC257507, corresponding to a HOST TARGET binding site such as BINDING SITE I, BINDING SITE II or BINDING SITE III. Table 2 illustrates the complementarity of the nucleotide sequences of LOC257507 BINDING SITE, designated SEQ ID:46680, to the nucleotide sequence of VGAM997 RNA, herein designated VGAM RNA, also designated SEQ ID:3708.

Another function of VGAM997 is therefore inhibition of LOC257507 (Accession XM_175204). Accordingly, utilities of VGAM997 include diagnosis, prevention and treatment of diseases and clinical conditions associated with LOC257507. LOC257625 (Accession XM_175267) is another VGAM997 host target gene. LOC257625 BINDING SITE is HOST TARGET binding site found in the 3' untranslated region of mRNA encoded by LOC257625, corresponding to a HOST TARGET binding site such as BINDING SITE I, BINDING SITE II or BINDING SITE III. Table 2 illustrates the complementarity of the nucleotide sequences of LOC257625 BINDING SITE, designated SEQ ID:46736, to the nucleotide sequence of VGAM997 RNA, herein designated VGAM RNA, also designated SEQ ID:3708.

Another function of VGAM997 is therefore inhibition of LOC257625 (Accession XM_175267). Accordingly, utilities of VGAM997 include diagnosis, prevention and treatment of diseases and clinical conditions associated with LOC257625. LOC93297 (Accession XM_050370) is another VGAM997 host target gene. LOC93297 BINDING SITE is HOST TARGET binding site found in the 3' untranslated region of mRNA encoded by LOC93297, corresponding to a HOST TARGET binding site such as BINDING SITE I, BINDING SITE II or BINDING SITE III. Table 2 illustrates the complementarity of the nucleotide sequences of LOC93297 BINDING SITE, designated SEQ ID:35615, to the nucleotide sequence of VGAM997 RNA, herein designated VGAM RNA, also designated SEQ ID:3708.

Another function of VGAM997 is therefore inhibition of LOC93297 (Accession XM_050370). Accordingly, utilities of VGAM997 include diagnosis, prevention and treatment of diseases and clinical conditions associated with LOC93297. FIG. 1 further provides a conceptual description of a novel bioinformatically detected viral gene of the present invention, referred to here as Viral Genomic Address Messenger 998 (VGAM998) viral gene, which modulates expression of respective host target genes thereof, the function and utility of which host target genes is known in the art.

VGAM998 is a novel bioinformatically detected regulatory, non protein coding, viral micro RNA (miRNA) gene. The method by which VGAM998 was detected is described hereinabove with reference to FIGS. 1-8.

VGAM998 gene, herein designated VGAM GENE, is a viral gene contained in the genome of Cowpox Virus. VGAM998 host target gene, herein designated VGAM HOST TARGET GENE, is a human gene contained in the human genome.

VGAM998 gene encodes a VGAM998 precursor RNA, herein designated VGAM PRECURSOR RNA. Similar to other miRNA genes, and unlike most ordinary genes, VGAM998 precursor RNA does not encode a protein. A nucleotide sequence identical or highly similar to the nucleotide sequence of VGAM998 precursor RNA is designated SEQ ID:984, and is provided hereinbelow with reference to the sequence listing part. Nucleotide sequence SEQ ID:984 is located at position 64470 relative to the genome of Cowpox Virus.

VGAM998 precursor RNA folds onto itself, forming VGAM998 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM998 folded precursor RNA into VGAM998 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM998 RNA is designated SEQ ID:3709, and is provided hereinbelow with reference to the sequence listing part.

VGAM998 host target gene, herein designated VGAM HOST TARGET GENE, encodes a corresponding messenger RNA, VGAM998 host target RNA, herein designated VGAM HOST TARGET RNA. VGAM998 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM998 RNA, herein designated VGAM RNA, binds complementarily to one or more host target binding sites located in untranslated regions of VGAM998 host target RNA, herein designated VGAM HOST TARGET RNA. This complementary binding is due to the fact that the nucleotide sequence of VGAM998 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM998 RNA, herein designated VGAM RNA, may have a different number of host target binding sites in untranslated regions of a VGAM998 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM998 RNA, herein designated VGAM RNA, to host target binding sites on VGAM998 host target RNA, herein designated VGAM HOST TARGET RNA, such as BINDING SITE I, BINDING SITE II and BINDING SITE III, inhibits translation of VGAM998 host target RNA into VGAM998 host target protein, herein designated VGAM HOST TARGET PROTEIN. VGAM host target protein is therefore outlined by a broken line.

It is appreciated that VGAM998 host target gene, herein designated VGAM HOST TARGET GENE, in fact represents a plurality of VGAM998 host target genes. The mRNA of each one of this plurality of VGAM998 host target genes comprises one or more host target binding sites, each having a nucleotide sequence which is at least partly complementary to VGAM998 RNA, herein designated VGAM RNA, and which when bound by VGAM998 RNA causes inhibition of translation of respective one or more VGAM998 host target proteins.

It is further appreciated by one skilled in the art that the mode of translational inhibition illustrated by FIG. 1 with specific reference to translational inhibition exerted by VGAM998 gene, herein designated VGAM GENE, on one or more VGAM998 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM998 is inhibition of expression of host target genes, as part of a novel viral mechanism of attacking a host. Accordingly, utilities of VGAM998 include diagnosis, prevention and treatment of viral infection by Cowpox Virus. Specific functions, and accordingly utilities, of VGAM998 correlate with, and may be deduced from, the identity of the host target genes which VGAM998 binds and inhibits, and the function of these host target genes, as elaborated hereinbelow.

Nucleotide sequences of the VGAM998 precursor RNA, herein designated VGAM PRECURSOR RNA, and of the ‘diced’ VGAM998 RNA, herein designated VGAM RNA, and a schematic representation of the secondary folding of VGAM998 folded precursor RNA, herein designated VGAM FOLDED PRECURSOR RNA, of VGAM998 are further described hereinbelow with reference to Table 1.

Nucleotide sequences of host target binding sites, such as BINDING SITE-I, BINDING SITE-II and BINDING SITE-III of FIG. 1, found on VGAM998 host target RNA, and schematic representation of the complementarity of each of these host target binding sites to VGAM998 RNA, herein designated VGAM RNA, are described hereinbelow with reference to Table 2.

As mentioned hereinabove with reference to FIG. 1, a function of VGAM998 gene, herein designated VGAM is inhibition of expression of VGAM998 target genes. It is appreciated that specific functions, and accordingly utilities, of VGAM998 correlate with, and may be deduced from, the identity of the target genes which VGAM998 binds and inhibits, and the function of these target genes, as elaborated hereinbelow.

Cleavage and Polyadenylation Specific Factor 4, 30 kDa (CPSF4, Accession NM_006693) is a VGAM998 host target gene. CPSF4 BINDING SITE is HOST TARGET binding site found in the 3' untranslated region of mRNA encoded by CPSF4, corresponding to a HOST TARGET binding site such as BINDING SITE I, BINDING SITE II or BINDING SITE III. Table 2 illustrates the complementarity of the nucleotide sequences of CPSF4 BINDING SITE, designated SEQ ID:13511, to the nucleotide sequence of VGAM998 RNA, herein designated VGAM RNA, also designated SEQ ID:3709.

A function of VGAM998 is therefore inhibition of Cleavage and Polyadenylation Specific Factor 4, 30 kDa (CPSF4, Accession NM_006693), a gene which may bind DNA. Accordingly, utilities of VGAM998 include diagnosis, prevention and treatment of diseases and clinical conditions associated with CPSF4. The function of CPSF4 has been established by previous studies. Nemeroff et al. (1998) used the yeast 2-hybrid interaction trap to screen a human HeLa cDNA library for proteins that interact with the effector domain of the influenza A virus NS1 protein. They identified 1 such protein, termed NEB1 (NS1 effector domain-binding protein-1), which was almost identical to the bovine cleavage-polyadenylation specificity factor (CPSF) 30-kD subunit (Barabino et al., 1997). The human CPSF30 protein contains 236 amino acids. CPSF30 is an essential component of the 3-prime end processing machinery of cellular pre-mRNAs. In influenza virus-infected cells, the NS1 protein is physically associated with CPSF30. Binding of the NS1 protein to the CPSF30 protein in vitro prevents CPSF binding to the RNA substrate and inhibits 3-prime end cleavage and polyadenylation of host pre-mRNAs. The NS1 protein also inhibits 3-prime end processing in vivo, and the uncleaved pre-mRNA remains in the nucleus. Via this regulation of pre-mRNA 3-prime end processing, the NS1 protein selectively inhibits the nuclear export of cellular, and not viral, mRNAs.

Full details of the abovementioned studies are described in the following publications, the disclosure of which are hereby incorporated by reference:

Nemeroff, M. E.; Barabino, S. M. L.; Li, Y.; Keller, W.; Krug, R. M.: Influenza virus NS1 protein interacts with the cellular 30 kDa subunit of CPSF and inhibits 3-prime end formation of cellular pre-mRNAs. Molec. Cell 1: 991-1000, 1998; and Barabino, S. M. L.; Hubner, W.; Jenny, A.; Minvielle-Sebastia, L.; Keller, W.: The 30 kDa subunit of mammalian cleavage and polyadenylation specificity factor and its yeast homolog are.

Further studies establishing the function and utilities of CPSF4 are found in John Hopkins OMIM database record ID 603052, and in sited publications numbered 8015-8016 listed in the bibliography section hereinbelow, which are also hereby incorporated by reference. Von Hippel-Lindau Syndrome (VHL, Accession NM_000551) is another VGAM998 host target gene. VHL BINDING SITE is HOST TARGET binding site found in the 3' untranslated region of mRNA encoded by VHL, corresponding to a HOST TARGET binding site such as BINDING SITE I, BINDING SITE II or BINDING SITE III. Table 2 illustrates the complementarity of the nucleotide sequences of VHL BINDING SITE, designated SEQ ID:6163, to the nucleotide sequence of VGAM998 RNA, herein designated VGAM RNA, also designated SEQ ID:3709.

Another function of VGAM998 is therefore inhibition of Von Hippel-Lindau Syndrome (VHL, Accession NM_000551), a gene which may control rna stability through the selective degradation of rna-bound proteins. Accordingly, utilities of VGAM998 include diagnosis, prevention and treatment of diseases and clinical conditions associated with VHL. The function of VHL and its association with various diseases and clinical conditions, has been established by previous studies, as described hereinabove with reference to VGAM197. IMPACT (Accession NM_018439) is another VGAM998 host target gene. IMPACT BINDING SITE is HOST TARGET binding site found in the 3' untranslated region of mRNA encoded by IMPACT, corresponding to a HOST TARGET binding site such as BINDING SITE I, BINDING SITE II or BINDING SITE III. Table 2 illustrates the complementarity of the nucleotide sequences of IMPACT BINDING SITE, designated SEQ ID:20505, to the nucleotide sequence of VGAM998 RNA, herein designated VGAM RNA, also designated SEQ ID:3709.

Another function of VGAM998 is therefore inhibition of IMPACT (Accession NM_018439). Accordingly, utilities of VGAM998 include diagnosis, prevention and treatment of diseases and clinical conditions associated with IMPACT. MGC20496 (Accession NM_052845) is another VGAM998 host target gene. MGC20496 BINDING SITE is HOST TARGET binding site found in the 3' untranslated region of mRNA encoded by MGC20496, corresponding to a HOST TARGET binding site such as BINDING SITE I, BINDING SITE II or BINDING SITE III. Table 2 illustrates the complementarity of the nucleotide sequences of MGC20496 BINDING SITE, designated SEQ ID:27425, to the nucleotide sequence of VGAM998 RNA, herein designated VGAM RNA, also designated SEQ ID:3709.

Another function of VGAM998 is therefore inhibition of MGC20496 (Accession NM_052845). Accordingly, utilities of VGAM998 include diagnosis, prevention and treatment of diseases and clinical conditions associated with MGC20496. Triple Homeobox 1 (TIX1, Accession XM_029734) is another VGAM998 host target gene. TIX1 BINDING SITE is HOST TARGET binding site found in the 3' untranslated region of mRNA encoded by TIX1, corresponding to a HOST TARGET binding site such as BINDING SITE I, BINDING SITE II or BINDING SITE III. Table 2 illustrates the complementarity of the nucleotide sequences of TIX1 BINDING SITE, designated SEQ ID:30930, to the nucleotide sequence of VGAM998 RNA, herein designated VGAM RNA, also designated SEQ ID:3709.

Another function of VGAM998 is therefore inhibition of Triple Homeobox 1 (TIX1, Accession XM_029734). Accordingly, utilities of VGAM998 include diagnosis, prevention and treatment of diseases and clinical conditions associated with TIX1. FIG. 1 further provides a conceptual description of a novel bioinformatically detected viral gene of the present invention, referred to here as Viral Genomic Address Messenger 999 (VGAM999) viral gene, which modulates expression of respective host target genes thereof, the function and utility of which host target genes is known in the art.

VGAM999 is a novel bioinformatically detected regulatory, non protein coding, viral micro RNA (miRNA) gene. The method by which VGAM999 was detected is described hereinabove with reference to FIGS. 1-8.

VGAM999 gene, herein designated VGAM GENE, is a viral gene contained in the genome of Cowpox Virus. VGAM999 host target gene, herein designated VGAM HOST TARGET GENE, is a human gene contained in the human genome.

VGAM999 gene encodes a VGAM999 precursor RNA, herein designated VGAM PRECURSOR RNA. Similar to other miRNA genes, and unlike most ordinary genes, VGAM999 precursor RNA does not encode a protein. A nucleotide sequence identical or highly similar to the nucleotide sequence of VGAM999 precursor RNA is designated SEQ ID:985, and is provided hereinbelow with reference to the sequence listing part. Nucleotide sequence SEQ ID:985 is located at position 62693 relative to the genome of Cowpox Virus.

VGAM999 precursor RNA folds onto itself, forming VGAM999 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM999 folded precursor RNA into VGAM999 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 69%) nucleotide sequence of VGAM999 RNA is designated SEQ ID:3710, and is provided hereinbelow with reference to the sequence listing part.

VGAM999 host target gene, herein designated VGAM HOST TARGET GENE, encodes a corresponding messenger RNA, VGAM999 host target RNA, herein designated VGAM HOST TARGET RNA. VGAM999 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM999 RNA, herein designated VGAM RNA, binds complementarily to one or more host target binding sites located in untranslated regions of VGAM999 host target RNA, herein designated VGAM HOST TARGET RNA. This complementary binding is due to the fact that the nucleotide sequence of VGAM999 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM999 RNA, herein designated VGAM RNA, may have a different number of host target binding sites in untranslated regions of a VGAM999 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM999 RNA, herein designated VGAM RNA, to host target binding sites on VGAM999 host target RNA, herein designated VGAM HOST TARGET RNA, such as BINDING SITE I, BINDING SITE II and BINDING SITE III, inhibits translation of VGAM999 host target RNA into VGAM999 host target protein, herein designated VGAM HOST TARGET PROTEIN. VGAM host target protein is therefore outlined by a broken line.

It is appreciated that VGAM999 host target gene, herein designated VGAM HOST TARGET GENE, in fact represents a plurality of VGAM999 host target genes. The mRNA of each one of this plurality of VGAM999 host target genes comprises one or more host target binding sites, each having a nucleotide sequence which is at least partly complementary to VGAM999 RNA, herein designated VGAM RNA, and which when bound by VGAM999 RNA causes inhibition of translation of respective one or more VGAM999 host target proteins.

It is further appreciated by one skilled in the art that the mode of translational inhibition illustrated by FIG. 1 with specific reference to translational inhibition exerted by VGAM999 gene, herein designated VGAM GENE, on one or more VGAM999 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM999 is inhibition of expression of host target genes, as part of a novel viral mechanism of attacking a host. Accordingly, utilities of VGAM999 include diagnosis, prevention and treatment of viral infection by Cowpox Virus. Specific functions, and accordingly utilities, of VGAM999 correlate with, and may be deduced from, the identity of the host target genes which VGAM999 binds and inhibits, and the function of these host target genes, as elaborated hereinbelow.

Nucleotide sequences of the VGAM999 precursor RNA, herein designated VGAM PRECURSOR RNA, and of the 'diced' VGAM999 RNA, herein designated VGAM RNA, and a schematic representation of the secondary folding of VGAM999 folded precursor RNA, herein designated VGAM FOLDED PRECURSOR RNA, of VGAM999 are further described hereinbelow with reference to Table 1.

Nucleotide sequences of host target binding sites, such as BINDING SITE-I, BINDING SITE-II and BINDING SITE-III of FIG. 1, found on VGAM999 host target RNA, and schematic representation of the complementarity of each of these host target binding sites to VGAM999 RNA, herein designated VGAM RNA, are described hereinbelow with reference to Table 2.

As mentioned hereinabove with reference to FIG. 1, a function of VGAM999 gene, herein designated VGAM is inhibition of expression of VGAM999 target genes. It is appreciated that specific functions, and accordingly utilities, of VGAM999 correlate with, and may be deduced from, the identity of the target genes which VGAM999 binds and inhibits, and the function of these target genes, as elaborated hereinbelow.

Fibronectin Leucine Rich Transmembrane Protein 2 (FLRT2, Accession NM_013231) is a VGAM999 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14877, to the nucleotide sequence of VGAM999 RNA, herein designated VGAM RNA, also designated SEQ ID:3710.

A function of VGAM999 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM999 include diagnosis, prevention and treatment of diseases and clinical conditions associated with FLRT2. The function of FLRT2 and its association with various diseases and clinical conditions, has been established by previous studies, as described hereinabove with reference to VGAM247. KIAA1468 (Accession XM_166289) is another VGAM999 host target gene. KIAA1468 BINDING SITE is HOST TARGET binding site found in the 3' untranslated region of mRNA encoded by KIAA1468, corresponding to a HOST TARGET binding site such as BINDING SITE I, BINDING SITE II or BINDING SITE III. Table 2 illustrates the complementarity of the nucleotide sequences of KIAA1468 BINDING SITE, designated SEQ ID:44097, to the nucleotide sequence of VGAM999 RNA, herein designated VGAM RNA, also designated SEQ ID:3710.

Another function of VGAM999 is therefore inhibition of KIAA1468 (Accession XM_166289). Accordingly, utilities of VGAM999 include diagnosis, prevention and treatment of diseases and clinical conditions associated with KIAA1468. KIAA1979 (Accession XM_113984) is another VGAM999 host target gene. KIAA1979 BINDING SITE is HOST TARGET binding site found in the 3' untranslated region of mRNA encoded by KIAA1979, corresponding to a HOST TARGET binding site such as BINDING SITE I, BINDING SITE II or BINDING SITE III. Table 2 illustrates the complementarity of the nucleotide sequences of KIAA1979 BINDING SITE, designated SEQ ID:42588, to the nucleotide sequence of VGAM999 RNA, herein designated VGAM RNA, also designated SEQ ID:3710.

Another function of VGAM999 is therefore inhibition of KIAA1979 (Accession XM_113984). Accordingly, utilities of VGAM999 include diagnosis, prevention and treatment of diseases and clinical conditions associated with KIAA1979. FIG. 1 further provides a conceptual description of a novel bioinformatically detected viral gene of the present invention, referred to here as Viral Genomic Address Messenger 1000 (VGAM1000) viral gene, which modulates expression of respective host target genes thereof, the function and utility of which host target genes is known in the art.

VGAM1000 is a novel bioinformatically detected regulatory, non protein coding, viral micro RNA (miRNA) gene. The method by which VGAM1000 was detected is described hereinabove with reference to FIGS. 1-8.

VGAM1000 gene, herein designated VGAM GENE, is a viral gene contained in the genome of Cowpox Virus. VGAM1000 host target gene, herein designated VGAM HOST TARGET GENE, is a human gene contained in the human genome.

VGAM1000 gene encodes a VGAM1000 precursor RNA, herein designated VGAM PRECURSOR RNA. Similar to other miRNA genes, and unlike most ordinary genes, VGAM1000 precursor RNA does not encode a protein. A nucleotide sequence identical or highly similar to the nucleotide sequence of VGAM1000 precursor RNA is designated SEQ ID:986, and is provided hereinbelow with reference to the sequence listing part. Nucleotide sequence SEQ ID:986 is located at position 63271 relative to the genome of Cowpox Virus.

VGAM1000 precursor RNA folds onto itself, forming VGAM1000 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1000 folded precursor RNA into VGAM1000 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1000 RNA is designated SEQ ID:3711, and is provided hereinbelow with reference to the sequence listing part.

VGAM1000 host target gene, herein designated VGAM HOST TARGET GENE, encodes a corresponding messenger RNA, VGAM1000 host target RNA, herein designated VGAM HOST TARGET RNA. VGAM1000 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1000 RNA, herein designated VGAM RNA, binds complementarily to one or more host target binding sites located in untranslated regions of VGAM1000 host target RNA, herein designated VGAM HOST TARGET RNA. This complementary binding is due to the fact that the nucleotide sequence of VGAM1000 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1000 RNA, herein designated VGAM RNA, may have a different number of host target binding sites in untranslated regions of a VGAM1000 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1000 RNA, herein designated VGAM RNA, to host target binding sites on VGAM1000 host target RNA, herein designated VGAM HOST TARGET RNA, such as BINDING SITE I, BINDING SITE II and BINDING SITE III, inhibits translation of VGAM1000 host target RNA into VGAM1000 host target protein, herein designated VGAM HOST TARGET PROTEIN. VGAM host target protein is therefore outlined by a broken line.

It is appreciated that VGAM1000 host target gene, herein designated VGAM HOST TARGET GENE, in fact represents a plurality of VGAM1000 host target genes. The mRNA of each one of this plurality of VGAM1000 host target genes comprises one or more host target binding sites, each having a nucleotide sequence which is at least partly complementary to VGAM1000 RNA, herein designated VGAM RNA, and which when bound by VGAM1000 RNA causes inhibition of translation of respective one or more VGAM1000 host target proteins.

It is further appreciated by one skilled in the art that the mode of translational inhibition illustrated by FIG. 1 with specific reference to translational inhibition exerted by VGAM1000 gene, herein designated VGAM GENE, on one or more VGAM1000 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1000 is inhibition of expression of host target genes, as part of a novel viral mechanism of attacking a host. Accordingly, utilities of VGAM1000 include diagnosis, prevention and treatment of viral infection by Cowpox Virus. Specific functions, and accordingly utilities, of VGAM1000 correlate with, and may be deduced from, the identity of the host target genes which VGAM1000 binds and inhibits, and the function of these host target genes, as elaborated hereinbelow.

Nucleotide sequences of the VGAM1000 precursor RNA, herein designated VGAM PRECURSOR RNA, and of the 'diced' VGAM1000 RNA, herein designated VGAM RNA, and a schematic representation of the secondary folding of VGAM1000 folded precursor RNA, herein designated VGAM FOLDED PRECURSOR RNA, of VGAM1000 are further described hereinbelow with reference to Table 1.

Nucleotide sequences of host target binding sites, such as BINDING SITE-I, BINDING SITE-II and BINDING SITE-III of FIG. 1, found on VGAM1000 host target RNA, and schematic representation of the complementarity of each of these host target binding sites to VGAM1000 RNA, herein designated VGAM RNA, are described hereinbelow with reference to Table 2.

As mentioned hereinabove with reference to FIG. 1, a function of VGAM1000 gene, herein designated VGAM is inhibition of expression of VGAM1000 target genes. It is appreciated that specific functions, and accordingly utilities, of VGAM1000 correlate with, and may be deduced from, the identity of the target genes which VGAM1000 binds and inhibits, and the function of these target genes, as elaborated hereinbelow.

EphB1 (EPHB1, Accession NM_004441) is a VGAM1000 host target gene. EPHB1 BINDING SITE1 and EPHB1 BINDING SITE2 are HOST TARGET binding sites found in untranslated regions of mRNA encoded by EPHB1, corresponding to HOST TARGET binding sites such as BINDING SITE I, BINDING SITE II or BINDING SITE III. Table 2 illustrates the complementarity of the nucleotide sequences of EPHB1 BINDING SITE1 and EPHB1 BINDING SITE2, designated SEQ ID:10727 and SEQ ID:10726 respectively, to the nucleotide sequence of VGAM1000 RNA, herein designated VGAM RNA, also designated SEQ ID:3711.

A function of VGAM1000 is therefore inhibition of EphB1 (EPHB1, Accession NM_004441), a gene which receptor for members of the ephrin-b family. binds to ephrin-b1, -b2 and -b3. Accordingly, utilities of VGAM1000 include diagnosis, prevention and treatment of diseases and clinical conditions associated with EPHB1. The function of EPHB1 has been established by previous studies. See 179610 for background on Eph receptors and their ligands, the ephrins. Tang et al. (1995) cloned and characterized a member of the EPH-related receptor protein tyrosine kinases and designated it NET (neuronally expressed EPH-related tyrosine kinase). The cDNA was isolated from a fetal brain expression library using a monoclonal antibody. The 3.9-kb RNA encodes a predicted protein of 984 amino acids with 2 hydrophobic regions corresponding to possible signal peptide and transmembrane domains. The NET protein shares 99% amino acid identity with Elk, the rat homolog. Northern blots showed maximal NET expression in the nervous system and in some tumor cell lines derived from neuroectoderm. Using immunohistochemical analysis of the developing mouse hindbrain, Cowan et al. (2000) detected Ephb1 expression in the floor plate and in hindbrain regions where facial and inner ear efferent neurons are located. Contractor et al. (2002) reported that mossy fiber long-term potentiation was reduced by perfusion of postsynaptic neurons with peptides and antibodies that interfere with binding of EphB receptor tyrosine kinases to the PDZ protein GRIP (GRIP1; 604597). Mossy fiber long-term potentiation was also reduced by extracellular application of soluble forms of beta-ephrins, which are normally membrane-anchored presynaptic ligands for the EphB receptors. The application of soluble ligands for presynaptic ephrins increased basal excitatory transmission and occluded both tetanus and forskolin-induced synaptic potentiation. Contractor et al. (2002) concluded that the PDZ interactions in postsynaptic neuron and transsynaptic interactions between postsynaptic EphB receptors and presynaptic beta-ephrins are necessary for the induction of mossy fiber long-term potentiation. Tang et al. (1995) mapped the EPHB1 gene to 3q21-q23 by fluorescence in situ hybridization.

Full details of the abovementioned studies are described in the following publications, the disclosure of which are hereby incorporated by reference:

Tang, X. X.; Biegel, J. A.; Nycum, L. M.; Yoshioka, A.; Brodeur, G. M.; Pleasure, D. E.; Ikegaki, N.: cDNA cloning, molecular characterization, and chromosomal localization of NET (EPHT2), a human EPH-related receptor protein-tyrosine kinase gene preferentially expressed in braiN.:Genomics 29:426-437, 1995; and Contractor, A.; Rogers, C.; Maron, C.; Henkemeyer, M.; Swanson, G. T.; Heinemann, S. F.: Trans-synaptic Eph receptor-ephrin signaling in hippocampal mossy fiber LTP. Science 296:1864-1.

Further studies establishing the function and utilities of EPHB1 are found in John Hopkins OMIM database record ID 600600, and in sited publications numbered 1038 and 12328 listed in the bibliography section hereinbelow, which are also hereby incorporated by reference. V-myc Myelocytomatosis Viral Oncogene Homolog 2 (avian) (MYCL2, Accession NM_005377) is another VGAM1000 host target gene. MYCL2 BINDING SITE is HOST TARGET binding site found in the 3' untranslated region of mRNA encoded by MYCL2, corresponding to a HOST TARGET binding site such as BINDING SITE I, BINDING SITE II or BINDING SITE III. Table 2 illustrates the complementarity of the nucleotide sequences of MYCL2 BINDING SITE, designated SEQ ID:11854, to the nucleotide sequence of VGAM1000 RNA, herein designated VGAM RNA, also designated SEQ ID:3711.

Another function of VGAM1000 is therefore inhibition of V-myc Myelocytomatosis Viral Oncogene Homolog 2 (avian) (MYCL2, Accession NM_005377). Accordingly, utilities of VGAM1000 include diagnosis, prevention and treatment of diseases and clinical conditions associated with MYCL2. Prokineticin 1 (PROK1, Accession NM_032414) is another VGAM1000 host target gene. PROK1 BINDING SITE is HOST TARGET binding site found in the 3' untranslated region of mRNA encoded by PROK1, corresponding to a HOST TARGET binding site such as BINDING SITE I, BINDING SITE II or BINDING SITE III. Table 2 illustrates the complementarity of the nucleotide sequences of PROK1 BINDING SITE, designated SEQ ID:26195, to the nucleotide sequence of VGAM1000 RNA, herein designated VGAM RNA, also designated SEQ ID:3711.

Another function of VGAM1000 is therefore inhibition of Prokineticin 1 (PROK1, Accession NM_032414), a gene which induces proliferation, migration and fenestration in capillary endothelial cells derived from endocrine glands. Accordingly, utilities of VGAM1000 include diagnosis, prevention and treatment of diseases and clinical conditions associated with PROK1. The function of PROK1 has been established by previous studies. Endocrine gland-derived vascular endothelial growth factor (EG-VEGF) induces proliferation, migration, and fenestration in capillary endothelial cells derived from endocrine glands. Its expression is induced by hypoxia and is restricted to the steroidogenic glands (ovary, testis, adrenal, and placenta). Its expression is often complementary to the expression of VEGF (OMIM Ref. No. 192240), suggesting that these molecules function in a coordinated manner. LeCouter et al. (2001) screened a library of purified human secreted proteins for the ability to induce proliferation in primary bovine adrenal cortex-derived capillary endothelial cells. EG-VEGF was capable of inducing a strong and reproducible mitogenic response. Mature EG-VEGF is a protein with a relative molecular mass of 8,600 encoded by a cDNA cloned from human ovary library. The 1.4-kb cDNA encodes a protein of 105 amino acids with a well defined signal sequence. The mature protein is predicted to have 86 amino acids, including 10 cysteines, and an expected isoelectric point of 8.46. These cysteines potentially form 5 disulfide bridges. EG-VEGF displays a high degree of homology to a nontoxic protein purified from the venom of the black mamba snake, venom protein A (VPRA). The structure of native VPRA was solved, and the disulfide bridge partners were revealed. The number and spacing of cysteines are completely conserved between VPRA and EG-VEGF. BV8, a human molecule closely related to a peptide isolated from the yellow-bellied toad, is 58% identical to the EG-VEGF mature protein. There is also significant homology to the carboxy-terminal sequence of Xenopus dickkopf (see OMIM Ref. No. 605189) and to colipase (OMIM Ref. No. 120105). Li et al. (2001) identified EG-VEGF as prokineticin-1. EG-VEGF is mitogenic and chemoattractive and able to induce fenestration. EG-VEGF expression is induced by hypoxia, and there is an HIF1 (OMIM Ref. No. 603348) binding site present on EG-VEGF. EG-VEGF is able to induce angiogenesis and ovarian cyst formation. Northern blot analysis demonstrated expression in testis, ovary, adrenal gland, and placenta. A signal was detectable in prostate after prolonged exposure Full details of the abovementioned studies are described in the following publications, the disclosure of which are hereby incorporated by reference:

LeCouter, J.; Kowalski, J.; Foster, J.; Hass, P.; Zhang, Z.; Dillard-Telm, L.; Frantz, G.; Rangell, L.; DeGuzman, L.; Keller, G.-A.; Peale, F.; Gurney, P.; Hillan, K. J.; Ferrara, N.: Identification of an angiogenic mitogen selective for endocrine gland endothelium. Nature 412:877-884, 2001; and Li, M.; Bullock, C. M.; Knauer, D. J.; Ehlert, F. J.; Zhou, Q. Y.: Identification of two prokineticin cDNAs: recombinant proteins potently contract gastrointestinal smooth muscle. Mol.

Further studies establishing the function and utilities of PROK1 are found in John Hopkins OMIM database record ID 606233, and in sited publications numbered 6644-6645 listed in the bibliography section hereinbelow, which are also hereby incorporated by reference. Titin Immunoglobulin Domain Protein (myotilin) (TTID, Accession NM_006790) is another VGAM1000 host target gene. TTID BINDING SITE is HOST TARGET binding site found in the 5' untranslated region of mRNA encoded by TTID, corresponding to a HOST TARGET binding site such as BINDING SITE I, BINDING SITE II or BINDING SITE III. Table 2 illustrates the complementarity of the nucleotide sequences of TTID BINDING SITE, designated SEQ ID:13668, to the nucleotide sequence of VGAM1000 RNA, herein designated VGAM RNA, also designated SEQ ID:3711.

Another function of VGAM1000 is therefore inhibition of Titin Immunoglobulin Domain Protein (myotilin) (TTID, Accession NM_006790), a gene which is a sarcomeric structural protein. Accordingly, utilities of VGAM1000 include diagnosis, prevention and treatment of diseases and clinical conditions associated with TTID. The function of TTID has been established by previous studies. By radiation hybrid mapping, Salmikangas et al. (1999) located the myotilin gene on 5q31 between markers AFM350yB1 and D5S500. The locus of a dominantly inherited limb-girdle muscular dystrophy, LGMD1A (OMIM Ref. No. 159000), resides in an overlapping narrow segment, and a form of distal myopathy with vocal cord and pharyngeal weakness (OMIM Ref. No. 158580) maps to the same region. Muscle specificity and apparent role as a sarcomeric structural protein raise the possibility that defects in the myotilin gene may cause muscular dystrophy. Hauser et al. (2000) identified a mutation in the myotilin gene (thr57 to ile; 604103.0001) in a large North American family of German descent segregating LGMD1A. The mutant allele was transcribed, and normal levels of correctly localized myotilin protein were seen in LGMD1A muscle. The mutation did not disrupt binding to alpha-actinin.

Full details of the abovementioned studies are described in the following publications, the disclosure of which are hereby incorporated by reference:

Salmikangas, P.; Mykkanen, O.-M.; Gronholm, M.; Heiska, L.; Kere, J.; Carpen, O.: Myotilin, a novel sarcomeric protein with two Ig-like domains, is encoded by a candidate gene for limb-girdle muscular dystrophy. Hum. Molec. Genet. 8:1329-1336, 1999; and Hauser, M. A.; Horrigan, S. K.; Salmikangas, P.; Torian, U. M.; Viles, K. D.; Dancel, R.; Tim, R. W.; Taivainen, A.; Bartoloni, L.; Gilchrist, J. M.; Stajich, J. M.; Gaskell, P. C.; Gilber.

Further studies establishing the function and utilities of TTID are found in John Hopkins OMIM database record ID 604103, and in sited publications numbered 5084 listed in the bibliography section hereinbelow, which are also hereby incorporated by reference. Calcium/calmodulin-dependent Protein Kinase Kinase 1, Alpha (CAMKK1, Accession NM_032294) is another VGAM1000 host target gene. CAMKK1 BINDING SITE is HOST TARGET binding site found in the 3' untranslated region of mRNA encoded by CAMKK1, corresponding to a HOST TARGET binding site such as BINDING SITE I, BINDING SITE II or BINDING SITE III. Table 2 illustrates the complementarity of the nucleotide sequences of CAMKK1 BINDING SITE, designated SEQ ID:26062, to the nucleotide sequence of VGAM1000 RNA, herein designated VGAM RNA, also designated SEQ ID:3711.

Another function of VGAM1000 is therefore inhibition of Calcium/calmodulin-dependent Protein Kinase Kinase 1, Alpha (CAMKK1, Accession NM_032294). Accordingly, utilities of VGAM1000 include diagnosis, prevention and treatment of diseases and clinical conditions associated with CAMKK1. DKFZp547I094 (Accession NM_032155) is another VGAM1000 host target gene. DKFZp547I094 BINDING SITE is HOST TARGET binding site found in the 5' untranslated region of mRNA encoded by DKFZp547I094, corresponding to a HOST TARGET binding site such as BINDING SITE I, BINDING SITE II or BINDING SITE III. Table 2 illustrates the complementarity of the nucleotide sequences of DKFZp547I094 BINDING SITE, designated SEQ ID:25854, to the nucleotide sequence of VGAM1000 RNA, herein designated VGAM RNA, also designated SEQ ID:3711.

Another function of VGAM1000 is therefore inhibition of DKFZp547I094 (Accession NM_032155). Accordingly, utilities of VGAM1000 include diagnosis, prevention and treatment of diseases and clinical conditions associated with DKFZp547I094. DKFZp761O17121 (Accession NM_032287) is another VGAM1000 host target gene. DKFZp761O17121 BINDING SITE is HOST TARGET binding site found in the 3' untranslated region of mRNA encoded by DKFZp761O17121, corresponding to a HOST TARGET binding site such as BINDING SITE I, BINDING SITE II or BINDING SITE III. Table 2 illustrates the complementarity of the nucleotide sequences of DKFZp761O17121 BINDING SITE, designated SEQ ID:26043, to the nucleotide sequence of VGAM1000 RNA, herein designated VGAM RNA, also designated SEQ ID:3711.

Another function of VGAM1000 is therefore inhibition of DKFZp761O17121 (Accession NM_032287). Accordingly, utilities of VGAM1000 include diagnosis, prevention and treatment of diseases and clinical conditions associated with DKFZp761O17121. FLJ21438 (Accession XM_029084) is another VGAM1000 host target gene. FLJ21438 BINDING SITE is HOST TARGET binding site found in the 5' untranslated region of mRNA encoded by FLJ21438, corresponding to a HOST TARGET binding site such as BINDING SITE I, BINDING SITE II or BINDING SITE III. Table 2 illustrates the complementarity of the nucleotide sequences of FLJ21438 BINDING SITE, designated SEQ ID:30842, to the nucleotide sequence of VGAM1000 RNA, herein designated VGAM RNA, also designated SEQ ID:3711.

Another function of VGAM1000 is therefore inhibition of FLJ21438 (Accession XM_029084). Accordingly, utilities of VGAM1000 include diagnosis, prevention and treatment of diseases and clinical conditions associated with FLJ21438. Mab-21-like 2 (C. elegans) (MAB21L2, Accession NM_006439) is another VGAM1000 host target gene. MAB21L2 BINDING SITE is HOST TARGET binding site found in the 5' untranslated region of mRNA encoded by MAB21L2, corresponding to a HOST TARGET binding site such as BINDING SITE I, BINDING SITE II or BINDING SITE III. Table 2 illustrates the complementarity of the nucleotide sequences of MAB21L2 BINDING SITE, designated SEQ ID:13147, to the nucleotide sequence of VGAM1000 RNA, herein designated VGAM RNA, also designated SEQ ID:3711.

Another function of VGAM1000 is therefore inhibition of Mab-21-like 2 (C. elegans) (MAB21L2, Accession NM_006439). Accordingly, utilities of VGAM1000 include diagnosis, prevention and treatment of diseases and clinical conditions associated with MAB21L2. MDN1, Midasin Homolog (yeast) (MDN1, Accession XM_031539) is another VGAM1000 host target gene. MDN1 BINDING SITE is HOST TARGET binding site found in the 5' untranslated region of mRNA encoded by MDN1, corresponding to a HOST TARGET binding site such as BINDING SITE I, BINDING SITE II or BINDING SITE III. Table 2 illustrates the complementarity of the nucleotide sequences of MDN1 BINDING SITE, designated SEQ ID:31408, to the nucleotide sequence of VGAM1000 RNA, herein designated VGAM RNA, also designated SEQ ID:3711.

Another function of VGAM1000 is therefore inhibition of MDN1, Midasin Homolog (yeast) (MDN1, Accession XM_031539). Accordingly, utilities of VGAM1000 include diagnosis, prevention and treatment of diseases and clinical conditions associated with MDN1. LOC220766 (Accession XM_165471) is another VGAM1000 host target gene. LOC220766 BINDING SITE is HOST TARGET binding site found in the 5' untranslated region of mRNA encoded by LOC220766, corresponding to a HOST TARGET binding site such as BINDING SITE I, BINDING SITE II or BINDING SITE III. Table 2 illustrates the complementarity of the nucleotide sequences of LOC220766 BINDING SITE, designated SEQ ID:43645, to the nucleotide sequence of VGAM1000 RNA, herein designated VGAM RNA, also designated SEQ ID:3711.

Another function of VGAM1000 is therefore inhibition of LOC220766 (Accession XM_165471). Accordingly, utilities of VGAM1000 include diagnosis, prevention and treatment of diseases and clinical conditions associated with LOC220766. LOC255565 (Accession XM_170811) is another VGAM1000 host target gene. LOC255565 BINDING SITE is HOST TARGET binding site found in the 3' untranslated region of mRNA encoded by LOC255565, corresponding to a HOST TARGET binding site such as BINDING SITE I, BINDING SITE II or BINDING SITE III. Table 2 illustrates the complementarity of the nucleotide sequences of LOC255565 BINDING SITE, designated SEQ ID:45586, to the nucleotide sequence of VGAM1000 RNA, herein designated VGAM RNA, also designated SEQ ID:3711.

Another function of VGAM1000 is therefore inhibition of LOC255565 (Accession XM_170811). Accordingly, utilities of VGAM1000 include diagnosis, prevention and treatment of diseases and clinical conditions associated with LOC255565. LOC92230 (Accession XM_043733) is another VGAM1000 host target gene. LOC92230 BINDING SITE is HOST TARGET binding site found in the 5' untranslated region of mRNA encoded by LOC92230, corresponding to a HOST TARGET binding site such as BINDING SITE I, BINDING SITE II or BINDING SITE III. Table 2 illustrates the complementarity of the nucleotide sequences of LOC92230 BINDING SITE, designated SEQ ID:34005, to the nucleotide sequence of VGAM1000 RNA, herein designated VGAM RNA, also designated SEQ ID:3711.

Another function of VGAM1000 is therefore inhibition of LOC92230 (Accession XM_043733). Accordingly, utilities of VGAM1000 include diagnosis, prevention and treatment of diseases and clinical conditions associated with LOC92230. FIG. 1 further provides a conceptual description of a novel bioinformatically detected viral gene of the present invention, referred to here as Viral Genomic Address Messenger 1001 (VGAM1001) viral gene, which modulates expression of respective host target genes thereof, the function and utility of which host target genes is known in the art.

VGAM1001 is a novel bioinformatically detected regulatory, non protein coding, viral micro RNA (miRNA) gene. The method by which VGAM1001 was detected is described hereinabove with reference to FIGS. 1-8.

VGAM1001 gene, herein designated VGAM GENE, is a viral gene contained in the genome of Cowpox Virus. VGAM1001 host target gene, herein designated VGAM HOST TARGET GENE, is a human gene contained in the human genome.

VGAM1001 gene encodes a VGAM1001 precursor RNA, herein designated VGAM PRECURSOR RNA. Similar to other miRNA genes, and unlike most ordinary genes, VGAM1001 precursor RNA does not encode a protein. A nucleotide sequence identical or highly similar to the nucleotide sequence of VGAM1001 precursor RNA is designated SEQ ID:987, and is provided hereinbelow with reference to the sequence listing part. Nucleotide sequence SEQ ID:987 is located at position 62554 relative to the genome of Cowpox Virus.

VGAM1001 precursor RNA folds onto itself, forming VGAM1001 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1001 folded precursor RNA into VGAM1001 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1001 RNA is designated SEQ ID:3712, and is provided hereinbelow with reference to the sequence listing part.

VGAM1001 host target gene, herein designated VGAM HOST TARGET GENE, encodes a corresponding messenger RNA, VGAM1001 host target RNA, herein designated VGAM HOST TARGET RNA. VGAM1001 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1001 RNA, herein designated VGAM RNA, binds complementarily to one or more host target binding sites located in untranslated regions of VGAM1001 host target RNA, herein designated VGAM HOST TARGET RNA. This complementary binding is due to the fact that the nucleotide sequence of VGAM1001 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1001 RNA, herein designated VGAM RNA, may have a different number of host target binding sites in untranslated regions of a VGAM1001 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1001 RNA, herein designated VGAM RNA, to host target binding sites on VGAM1001 host target RNA, herein designated VGAM HOST TARGET RNA, such as BINDING SITE I, BINDING SITE II and BINDING SITE III, inhibits translation of VGAM1001 host target RNA into VGAM1001 host target protein, herein designated VGAM HOST TARGET PROTEIN. VGAM host target protein is therefore outlined by a broken line.

It is appreciated that VGAM1001 host target gene, herein designated VGAM HOST TARGET GENE, in fact represents a plurality of VGAM1001 host target genes. The mRNA of each one of this plurality of VGAM1001 host target genes comprises one or more host target binding sites, each having a nucleotide sequence which is at least partly complementary to VGAM1001 RNA, herein designated VGAM RNA, and which when bound by VGAM1001 RNA causes inhibition of translation of respective one or more VGAM1001 host target proteins.

It is further appreciated by one skilled in the art that the mode of translational inhibition illustrated by FIG. 1 with specific reference to translational inhibition exerted by VGAM1001 gene, herein designated VGAM GENE, on one or more VGAM1001 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1001 is inhibition of expression of host target genes, as part of a novel viral mechanism of attacking a host. Accordingly, utilities of VGAM1001 include diagnosis, prevention and treatment of viral infection by Cowpox Virus. Specific functions, and accordingly utilities, of VGAM1001 correlate with, and may be deduced from, the identity of the host target genes which VGAM1001 binds and inhibits, and the function of these host target genes, as elaborated hereinbelow.

Nucleotide sequences of the VGAM1001 precursor RNA, herein designated VGAM PRECURSOR RNA, and of the 'diced' VGAM1001 RNA, herein designated VGAM RNA, and a schematic representation of the secondary folding of VGAM1001 folded precursor RNA, herein designated VGAM FOLDED PRECURSOR RNA, of VGAM1001 are further described hereinbelow with reference to Table 1.

Nucleotide sequences of host target binding sites, such as BINDING SITE-I, BINDING SITE-II and BINDING SITE-III of FIG. 1, found on VGAM1001 host target RNA, and schematic representation of the complementarity of each of these host target binding sites to VGAM1001 RNA, herein designated VGAM RNA, are described hereinbelow with reference to Table 2.

As mentioned hereinabove with reference to FIG. 1, a function of VGAM1001 gene, herein designated VGAM is inhibition of expression of VGAM1001 target genes. It is appreciated that specific functions, and accordingly utilities, of VGAM1001 correlate with, and may be deduced from, the identity of the target genes which VGAM1001 binds and inhibits, and the function of these target genes, as elaborated hereinbelow.

Leucine Zipper-EF-hand Containing Transmembrane Protein 1 (LETM1, Accession NM_012318) is a VGAM1001 host target gene. LETM1 BINDING SITE is HOST TARGET binding site found in the 3' untranslated region of mRNA encoded by LETM1, corresponding to a HOST TARGET binding site such as BINDING SITE I, BINDING SITE II or BINDING SITE III. Table 2 illustrates the complementarity of the nucleotide sequences of LETM1 BINDING SITE, designated SEQ ID:14696, to the nucleotide sequence of VGAM1001 RNA, herein designated VGAM RNA, also designated SEQ ID:3712.

A function of VGAM1001 is therefore inhibition of Leucine Zipper-EF-hand Containing Transmembrane Protein 1 (LETM1, Accession NM_012318). Accordingly, utilities of VGAM1001 include diagnosis, prevention and treatment of diseases and clinical conditions associated with LETM1. Protein Tyrosine Phosphatase, Receptor Type, O (PTPRO, Accession NM_030667) is another VGAM1001 host target gene. PTPRO BINDING SITE1 through PTPRO BINDING SITE5 are HOST TARGET binding sites found in untranslated regions of mRNA encoded by PTPRO, corresponding to HOST TARGET binding sites such as BINDING SITE I, BINDING SITE II or BINDING SITE III. Table 2 illustrates the complementarity of the nucleotide sequences of PTPRO BINDING SITE1 through PTPRO BINDING SITE5, designated SEQ ID:25002, SEQ ID:25008, SEQ ID:25017, SEQ ID:25026 and SEQ ID:8737 respectively, to the nucleotide sequence of VGAM1001 RNA, herein designated VGAM RNA, also designated SEQ ID:3712.

Another function of VGAM1001 is therefore inhibition of Protein Tyrosine Phosphatase, Receptor Type, O (PTPRO, Accession NM_030667), a gene which may function as a cell contact receptor that mediates and controls cell-cell signals. Accordingly, utilities of VGAM1001 include diagnosis, prevention and treatment of diseases and clinical conditions associated with PTPRO. The function of PTPRO and its association with various diseases and clinical conditions, has been established by previous studies, as described hereinabove with reference to VGAM140. Trichorhinophalangeal Syndrome I (TRPS1, Accession NM_014112) is another VGAM1001 host target gene. TRPS1 BINDING SITE is HOST TARGET binding site found in the 3' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15355, to the nucleotide sequence of VGAM1001 RNA, herein designated VGAM RNA, also designated SEQ ID:3712.

Another function of VGAM1001 is therefore inhibition of Trichorhinophalangeal Syndrome I (TRPS1, Accession NM_014112), a gene which may function as a transcriptional activator protein. Accordingly, utilities of VGAM1001 include diagnosis, prevention and treatment of diseases and clinical conditions associated with TRPS1. The function of TRPS1 and its association with various diseases and clinical conditions, has been established by previous studies, as described hereinabove with reference to VGAM172. ATP-binding Cassette, Sub-family C (CFTR/MRP), Member 13 (ABCC13, Accession NM_138726) is another VGAM1001 host target gene. ABCC13 BINDING SITE is HOST TARGET binding site found in the 3' untranslated region of mRNA encoded by ABCC13, corresponding to a HOST TARGET binding site such as BINDING SITE I, BINDING SITE II or BINDING SITE III. Table 2 illustrates the complementarity of the nucleotide sequences of ABCC13 BINDING SITE, designated SEQ ID:28973, to the nucleotide sequence of VGAM1001 RNA, herein designated VGAM RNA, also designated SEQ ID:3712.

Another function of VGAM1001 is therefore inhibition of ATP-binding Cassette, Sub-family C (CFTR/MRP), Member 13 (ABCC13, Accession NM_138726). Accordingly, utilities of VGAM1001 include diagnosis, prevention and treatment of diseases and clinical conditions associated with ABCC13. Chromosome 22 Open Reading Frame 20 (C22orf20, Accession NM_025225) is another VGAM1001 host target gene. C22orf20 BINDING SITE is HOST TARGET binding site found in the 3' untranslated region of mRNA encoded by C22orf20, corresponding to a HOST TARGET binding site such as BINDING SITE I, BINDING SITE II or BINDING SITE III. Table 2 illustrates the complementarity of the nucleotide sequences of C22orf20 BINDING SITE, designated SEQ ID:24901, to the nucleotide sequence of VGAM1001 RNA, herein designated VGAM RNA, also designated SEQ ID:3712.

Another function of VGAM1001 is therefore inhibition of Chromosome 22 Open Reading Frame 20 (C22orf20, Accession NM_025225). Accordingly, utilities of VGAM1001 include diagnosis, prevention and treatment of diseases and clinical conditions associated with C22orf20. FLJ12056 (Accession NM_024933) is another VGAM1001 host target gene. FLJ12056 BINDING SITE is HOST TARGET binding site found in the 3' untranslated region of mRNA encoded by FLJ12056, corresponding to a HOST TARGET binding site such as BINDING SITE I, BINDING SITE II or BINDING SITE III. Table 2 illustrates the complementarity of the nucleotide sequences of FLJ12056 BINDING SITE, designated SEQ ID:24469, to the nucleotide sequence of VGAM1001 RNA, herein designated VGAM RNA, also designated SEQ ID:3712.

Another function of VGAM1001 is therefore inhibition of FLJ12056 (Accession NM_024933). Accordingly, utilities of VGAM1001 include diagnosis, prevention and treatment of diseases and clinical conditions associated with FLJ12056. FLJ20232 (Accession NM_019008) is another VGAM1001 host target gene. FLJ20232 BINDING SITE is HOST TARGET binding site found in the 3' untranslated region of mRNA encoded by FLJ20232, corresponding to a HOST TARGET binding site such as BINDING SITE I, BINDING SITE II or BINDING SITE III. Table 2 illustrates the complementarity of the nucleotide sequences of FLJ20232 BINDING SITE, designated SEQ ID:21085, to the nucleotide sequence of VGAM1001 RNA, herein designated VGAM RNA, also designated SEQ ID:3712.

Another function of VGAM1001 is therefore inhibition of FLJ20232 (Accession NM_019008). Accordingly, utilities of VGAM1001 include diagnosis, prevention and treatment of diseases and clinical conditions associated with FLJ20232. FLJ30681 (Accession XM_166291) is another VGAM1001 host target gene. FLJ30681 BINDING SITE is HOST TARGET binding site found in the 3' untranslated region of mRNA encoded by FLJ30681, corresponding to a HOST TARGET binding site such as BINDING SITE I, BINDING SITE II or BINDING SITE III. Table 2 illustrates the complementarity of the nucleotide sequences of FLJ30681 BINDING SITE, designated SEQ ID:44105, to the nucleotide sequence of VGAM1001 RNA, herein designated VGAM RNA, also designated SEQ ID:3712.

Another function of VGAM1001 is therefore inhibition of FLJ30681 (Accession XM_166291). Accordingly, utilities of VGAM1001 include diagnosis, prevention and treatment of diseases and clinical conditions associated with FLJ30681. HSA249128 (Accession NM_017583) is another VGAM1001 host target gene. HSA249128 BINDING SITE is HOST TARGET binding site found in the 3' untranslated region of mRNA encoded by HSA249128, corresponding to a HOST TARGET binding site such as BINDING SITE I, BINDING SITE II or BINDING SITE III. Table 2 illustrates the complementarity of the nucleotide sequences of HSA249128 BINDING SITE, designated SEQ ID:19028, to the nucleotide sequence of VGAM1001 RNA, herein designated VGAM RNA, also designated SEQ ID:3712.

Another function of VGAM1001 is therefore inhibition of HSA249128 (Accession NM_017583). Accordingly, utilities of VGAM1001 include diagnosis, prevention and treatment of diseases and clinical conditions associated with HSA249128. KIAA0774 (Accession XM_166270) is another VGAM1001 host target gene. KIAA0774 BINDING SITE is HOST TARGET binding site found in the 5' untranslated region of mRNA encoded by KIAA0774, corresponding to a HOST TARGET binding site such as BINDING SITE I, BINDING SITE II or BINDING SITE III. Table 2 illustrates the complementarity of the nucleotide sequences of KIAA0774 BINDING SITE, designated SEQ ID:44087, to the nucleotide sequence of VGAM1001 RNA, herein designated VGAM RNA, also designated SEQ ID:3712.

Another function of VGAM1001 is therefore inhibition of KIAA0774 (Accession XM_166270). Accordingly, utilities of VGAM1001 include diagnosis, prevention and treatment of diseases and clinical conditions associated with KIAA0774. KIAA1164 (Accession XM_045358) is another VGAM1001 host target gene. KIAA1164 BINDING SITE is HOST TARGET binding site found in the 5' untranslated region of mRNA encoded by KIAA1164, corresponding to a HOST TARGET binding site such as BINDING SITE I, BINDING SITE II or BINDING SITE III. Table 2 illustrates the complementarity of the nucleotide sequences of KIAA1164 BINDING SITE, designated SEQ ID:34441, to the nucleotide sequence of VGAM1001 RNA, herein designated VGAM RNA, also designated SEQ ID:3712.

Another function of VGAM1001 is therefore inhibition of KIAA1164 (Accession XM_045358). Accordingly, utilities of VGAM1001 include diagnosis, prevention and treatment of diseases and clinical conditions associated with KIAA1164. KIAA1867 (Accession XM_170675) is another VGAM1001 host target gene. KIAA1867 BINDING SITE is HOST TARGET binding site found in the 5' untranslated region of mRNA encoded by KIAA1867, corresponding to a HOST TARGET binding site such as BINDING SITE I, BINDING SITE II or BINDING SITE III. Table 2 illustrates the complementarity of the nucleotide sequences of KIAA1867 BINDING SITE, designated SEQ ID:45456, to the nucleotide sequence of VGAM1001 RNA, herein designated VGAM RNA, also designated SEQ ID:3712.

Another function of VGAM1001 is therefore inhibition of KIAA1867 (Accession XM_170675). Accordingly, utilities of VGAM1001 include diagnosis, prevention and treatment of diseases and clinical conditions associated with KIAA1867. LAP1B (Accession XM_035429) is another VGAM1001 host target gene. LAP1B BINDING SITE is HOST TARGET binding site found in the 3' untranslated region of mRNA encoded by LAP1B, corresponding to a HOST TARGET binding site such as BINDING SITE I, BINDING SITE II or BINDING SITE III. Table 2 illustrates the complementarity of the nucleotide sequences of LAP1B BINDING SITE, designated SEQ ID:32264, to the nucleotide sequence of VGAM1001 RNA, herein designated VGAM RNA, also designated SEQ ID:3712.

Another function of VGAM1001 is therefore inhibition of LAP1B (Accession XM_035429). Accordingly, utilities of VGAM1001 include diagnosis, prevention and treatment of diseases and clinical conditions associated with LAP1B. MGC4796 (Accession XM_029031) is another VGAM1001 host target gene. MGC4796 BINDING SITE is HOST TARGET binding site found in the 3' untranslated region of mRNA encoded by MGC4796, corresponding to a HOST TARGET binding site such as BINDING SITE I, BINDING SITE II or BINDING SITE III. Table 2 illustrates the complementarity of the nucleotide sequences of MGC4796 BINDING SITE, designated SEQ ID:30827, to the nucleotide sequence of VGAM1001 RNA, herein designated VGAM RNA, also designated SEQ ID:3712.

Another function of VGAM1001 is therefore inhibition of MGC4796 (Accession XM_029031). Accordingly, utilities of VGAM1001 include diagnosis, prevention and treatment of diseases and clinical conditions associated with MGC4796. LOC134285 (Accession XM_072365) is another VGAM1001 host target gene. LOC134285 BINDING SITE is HOST TARGET binding site found in the 5' untranslated region of mRNA encoded by LOC134285, corresponding to a HOST TARGET binding site such as BINDING SITE I, BINDING SITE II or BINDING SITE III. Table 2 illustrates the complementarity of the nucleotide sequences of LOC134285 BINDING SITE, designated SEQ ID:37490, to the nucleotide sequence of VGAM1001 RNA, herein designated VGAM RNA, also designated SEQ ID:3712.

Another function of VGAM1001 is therefore inhibition of LOC134285 (Accession XM_072365). Accordingly, utilities of VGAM1001 include diagnosis, prevention and treatment of diseases and clinical conditions associated with LOC134285. FIG. 1 further provides a conceptual description of a novel bioinformatically detected viral gene of the present invention, referred to here as Viral Genomic Address Messenger 1002 (VGAM1002) viral gene, which modulates expression of respective host target genes thereof, the function and utility of which host target genes is known in the art.

VGAM1002 is a novel bioinformatically detected regulatory, non protein coding, viral micro RNA (miRNA) gene. The method by which VGAM1002 was detected is described hereinabove with reference to FIGS. 1-8.

VGAM1002 gene, herein designated VGAM GENE, is a viral gene contained in the genome of Chimpanzee Cytomegalovirus. VGAM1002 host target gene, herein designated VGAM HOST TARGET GENE, is a human gene contained in the human genome.

VGAM1002 gene encodes a VGAM1002 precursor RNA, herein designated VGAM PRECURSOR RNA. Similar to other miRNA genes, and unlike most ordinary genes, VGAM1002 precursor RNA does not encode a protein. A nucleotide sequence identical or highly similar to the nucleotide sequence of VGAM1002 precursor RNA is designated SEQ ID:988, and is provided hereinbelow with reference to the sequence listing part. Nucleotide sequence SEQ ID:988 is located at position 198161 relative to the genome of Chimpanzee Cytomegalovirus.

VGAM1002 precursor RNA folds onto itself, forming VGAM1002 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1002 folded precursor RNA into VGAM1002 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1002 RNA is designated SEQ ID:3713, and is provided hereinbelow with reference to the sequence listing part.

VGAM1002 host target gene, herein designated VGAM HOST TARGET GENE, encodes a corresponding messenger RNA, VGAM1002 host target RNA, herein designated VGAM HOST TARGET RNA. VGAM1002 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1002 RNA, herein designated VGAM RNA, binds complementarily to one or more host target binding sites located in untranslated regions of VGAM1002 host target RNA, herein designated VGAM HOST TARGET RNA. This complementary binding is due to the fact that the nucleotide sequence of VGAM1002 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1002 RNA, herein designated VGAM RNA, may have a different number of host target binding sites in untranslated regions of a VGAM1002 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1002 RNA, herein designated VGAM RNA, to host target binding sites on VGAM1002 host target RNA, herein designated VGAM HOST TARGET RNA, such as BINDING SITE I, BINDING SITE II and BINDING SITE III, inhibits translation of VGAM1002 host target RNA into VGAM1002 host target protein, herein designated VGAM HOST TARGET PROTEIN. VGAM host target protein is therefore outlined by a broken line.

It is appreciated that VGAM1002 host target gene, herein designated VGAM HOST TARGET GENE, in fact represents a plurality of VGAM1002 host target genes. The mRNA of each one of this plurality of VGAM1002 host target genes comprises one or more host target binding sites, each having a nucleotide sequence which is at least partly complementary to VGAM1002 RNA, herein designated VGAM RNA, and which when bound by VGAM1002 RNA causes inhibition of translation of respective one or more VGAM1002 host target proteins.

It is further appreciated by one skilled in the art that the mode of translational inhibition illustrated by FIG. 1 with specific reference to translational inhibition exerted by VGAM1002 gene, herein designated VGAM GENE, on one or more VGAM1002 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1002 is inhibition of expression of host target genes, as part of a novel viral mechanism of attacking a host. Accordingly, utilities of VGAM1002 include diagnosis, prevention and treatment of viral infection by Chimpanzee Cytomegalovirus. Specific functions, and accordingly utilities, of VGAM1002 correlate with, and may be deduced from, the identity of the host target genes which VGAM1002 binds and inhibits, and the function of these host target genes, as elaborated hereinbelow.

Nucleotide sequences of the VGAM1002 precursor RNA, herein designated VGAM PRECURSOR RNA, and of the 'diced' VGAM1002 RNA, herein designated VGAM RNA, and a schematic representation of the secondary folding of VGAM1002 folded precursor RNA, herein designated VGAM FOLDED PRECURSOR RNA, of VGAM1002 are further described hereinbelow with reference to Table 1.

Nucleotide sequences of host target binding sites, such as BINDING SITE-I, BINDING SITE-II and BINDING SITE-III of FIG. 1, found on VGAM1002 host target RNA, and schematic representation of the complementarity of each of these host target binding sites to VGAM1002 RNA, herein designated VGAM RNA, are described hereinbelow with reference to Table 2.

As mentioned hereinabove with reference to FIG. 1, a function of VGAM1002 gene, herein designated VGAM is inhibition of expression of VGAM1002 target genes. It is appreciated that specific functions, and accordingly utilities, of VGAM1002 correlate with, and may be deduced from, the identity of the target genes which VGAM1002 binds and inhibits, and the function of these target genes, as elaborated hereinbelow.

EGF-like-domain, Multiple 4 (EGFL4, Accession XM_029883) is a VGAM1002 host target gene. EGFL4 BINDING SITE is HOST TARGET binding site found in the 5' untranslated region of mRNA encoded by EGFL4, corresponding to a HOST TARGET binding site such as BINDING SITE I, BINDING SITE II or BINDING SITE III. Table 2 illustrates the complementarity of the nucleotide sequences of EGFL4 BINDING SITE, designated SEQ ID:30967, to the nucleotide sequence of VGAM1002 RNA, herein designated VGAM RNA, also designated SEQ ID:3713.

A function of VGAM1002 is therefore inhibition of EGF-like-domain, Multiple 4 (EGFL4, Accession XM_029883). Accordingly, utilities of VGAM1002 include diagnosis, prevention and treatment of diseases and clinical conditions associated with EGFL4. FIG. 1 further provides a conceptual description of a novel bioinformatically detected viral gene of the present invention, referred to here as Viral Genomic Address Messenger 1003 (VGAM1003) viral gene, which modulates expression of respective host target genes thereof, the function and utility of which host target genes is known in the art.

VGAM1003 is a novel bioinformatically detected regulatory, non protein coding, viral micro RNA (miRNA) gene. The method by which VGAM1003 was detected is described hereinabove with reference to FIGS. 1-8.

VGAM1003 gene, herein designated VGAM GENE, is a viral gene contained in the genome of Chimpanzee Cytomegalovirus. VGAM1003 host target gene, herein designated VGAM HOST TARGET GENE, is a human gene contained in the human genome.

VGAM1003 gene encodes a VGAM1003 precursor RNA, herein designated VGAM PRECURSOR RNA. Similar to other miRNA genes, and unlike most ordinary genes, VGAM1003 precursor RNA does not encode a protein. A nucleotide sequence identical or highly similar to the nucleotide sequence of VGAM1003 precursor RNA is designated SEQ ID:989, and is provided hereinbelow with reference to the sequence listing part. Nucleotide sequence SEQ ID:989 is located at position 199498 relative to the genome of Chimpanzee Cytomegalovirus.

VGAM1003 precursor RNA folds onto itself, forming VGAM1003 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1003 folded precursor RNA into VGAM1003 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1003 RNA is designated SEQ ID:3714, and is provided hereinbelow with reference to the sequence listing part.

VGAM1003 host target gene, herein designated VGAM HOST TARGET GENE, encodes a corresponding messenger RNA, VGAM1003 host target RNA, herein designated VGAM HOST TARGET RNA. VGAM1003 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1003 RNA, herein designated VGAM RNA, binds complementarily to one or more host target binding sites located in untranslated regions of VGAM1003 host target RNA, herein designated VGAM HOST TARGET RNA. This complementary binding is due to the fact that the nucleotide sequence of VGAM1003 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1003 RNA, herein designated VGAM RNA, may have a different number of host target binding sites in untranslated regions of a VGAM1003 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1003 RNA, herein designated VGAM RNA, to host target binding sites on VGAM1003 host target RNA, herein designated VGAM HOST TARGET RNA, such as BINDING SITE I, BINDING SITE II and BINDING SITE III, inhibits translation of VGAM1003 host target RNA into VGAM1003 host target protein, herein designated VGAM HOST TARGET PROTEIN. VGAM host target protein is therefore outlined by a broken line.

It is appreciated that VGAM1003 host target gene, herein designated VGAM HOST TARGET GENE, in fact represents a plurality of VGAM1003 host target genes. The mRNA of each one of this plurality of VGAM1003 host target genes comprises one or more host target binding sites, each having a nucleotide sequence which is at least partly complementary to VGAM1003 RNA, herein designated VGAM RNA, and which when bound by VGAM1003 RNA causes inhibition of translation of respective one or more VGAM1003 host target proteins.

It is further appreciated by one skilled in the art that the mode of translational inhibition illustrated by FIG. 1 with specific reference to translational inhibition exerted by VGAM1003 gene, herein designated VGAM GENE, on one or more VGAM1003 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1003 is inhibition of expression of host target genes, as part of a novel viral mechanism of attacking a host. Accordingly, utilities of VGAM1003 include diagnosis, prevention and treatment of viral infection by Chimpanzee Cytomegalovirus. Specific functions, and accordingly utilities, of VGAM1003 correlate with, and may be deduced from, the identity of the host target genes which VGAM1003 binds and inhibits, and the function of these host target genes, as elaborated hereinbelow.

Nucleotide sequences of the VGAM1003 precursor RNA, herein designated VGAM PRECURSOR RNA, and of the 'diced' VGAM1003 RNA, herein designated VGAM RNA, and a schematic representation of the secondary folding of VGAM1003 folded precursor RNA, herein designated VGAM FOLDED PRECURSOR RNA, of VGAM1003 are further described hereinbelow with reference to Table 1.

Nucleotide sequences of host target binding sites, such as BINDING SITE-I, BINDING SITE-II and BINDING SITE-III of FIG. 1, found on VGAM1003 host target RNA, and schematic representation of the complementarity of each of these host target binding sites to VGAM1003 RNA, herein designated VGAM RNA, are described hereinbelow with reference to Table 2.

As mentioned hereinabove with reference to FIG. 1, a function of VGAM1003 gene, herein designated VGAM is inhibition of expression of VGAM1003 target genes. It is appreciated that specific functions, and accordingly utilities, of VGAM1003 correlate with, and may be deduced from, the identity of the target genes which VGAM1003 binds and inhibits, and the function of these target genes, as elaborated hereinbelow.

DEAD/H (Asp-Glu-Ala-Asp/His) Box Polypeptide 3 (DDX3, Accession NM_001356) is a VGAM1003 host target gene. DDX3 BINDING SITE is HOST TARGET binding site found in the 3' untranslated region of mRNA encoded by DDX3, corresponding to a HOST TARGET binding site such as BINDING SITE I, BINDING SITE II or BINDING SITE III. Table 2 illustrates the complementarity of the nucleotide sequences of DDX3 BINDING SITE, designated SEQ ID:7033, to the nucleotide sequence of VGAM1003 RNA, herein designated VGAM RNA, also designated SEQ ID:3714.

A function of VGAM1003 is therefore inhibition of DEAD/H (Asp-Glu-Ala-Asp/His) Box Polypeptide 3 (DDX3, Accession NM_001356), a gene which interacts with hepatitis c virus core protein resulting a change in intracellular location. Accordingly, utilities of VGAM1003 include diagnosis, prevention and treatment of diseases and clinical conditions associated with DDX3. The function of DDX3 and its association with various diseases and clinical conditions, has been established by previous studies, as described hereinabove with reference to VGAM232. Glutamate Receptor, Metabotropic 1 (GRM1, Accession NM_000838) is another VGAM1003 host target gene. GRM1 BINDING SITE is HOST TARGET binding site found in the 3' untranslated region of mRNA encoded by GRM1, corresponding to a HOST TARGET binding site such as BINDING SITE I, BINDING SITE II or BINDING SITE III. Table 2 illustrates the complementarity of the nucleotide sequences of GRM1 BINDING SITE, designated SEQ ID:6495, to the nucleotide sequence of VGAM1003 RNA, herein designated VGAM RNA, also designated SEQ ID:3714.

Another function of VGAM1003 is therefore inhibition of Glutamate Receptor, Metabotropic 1 (GRM1, Accession NM_000838), a gene which promotes phosphoinositide hydrolysis. Accordingly, utilities of VGAM1003 include diagnosis, prevention and treatment of diseases and clinical conditions associated with GRM1. The function of GRM1 and its association with various diseases and clinical conditions, has been established by previous studies, as described hereinabove with reference to VGAM786. Transient Receptor Potential Cation Channel, Subfamily V, Member 3 (TRPV3, Accession XM_170821) is another VGAM1003 host target gene. TRPV3 BINDING SITE is HOST TARGET binding site found in the 3' untranslated region of mRNA encoded by TRPV3, corresponding to a HOST TARGET binding site such as BINDING SITE I, BINDING SITE II or BINDING SITE III. Table 2 illustrates the complementarity of the nucleotide sequences of TRPV3 BINDING SITE, designated SEQ ID:45597, to the nucleotide sequence of VGAM1003 RNA, herein designated VGAM RNA, also designated SEQ ID:3714.

Another function of VGAM1003 is therefore inhibition of Transient Receptor Potential Cation Channel, Subfamily V, Member 3 (TRPV3, Accession XM_170821). Accordingly, utilities of VGAM1003 include diagnosis, prevention and treatment of diseases and clinical conditions associated with TRPV3. FLJ10936 (Accession NM_018279) is another VGAM1003 host target gene. FLJ10936 BINDING SITE is HOST TARGET binding site found in the 3' untranslated region of mRNA encoded by FLJ10936, corresponding to a HOST TARGET binding site such as BINDING SITE I, BINDING SITE II or BINDING SITE III. Table 2 illustrates the complementarity of the nucleotide sequences of FLJ10936 BINDING SITE, designated SEQ ID:20268, to the nucleotide sequence of VGAM1003 RNA, herein designated VGAM RNA, also designated SEQ ID:3714.

Another function of VGAM1003 is therefore inhibition of FLJ10936 (Accession NM_018279). Accordingly, utilities of VGAM1003 include diagnosis, prevention and treatment of diseases and clinical conditions associated with FLJ10936. phorbolin-1 (Accession XM_114206) is another VGAM1003 host target gene. phorbolin-1 BINDING SITE is HOST TARGET binding site found in the 3' untranslated region of mRNA encoded by phorbolin-1, corresponding to a HOST TARGET binding site such as BINDING SITE I, BINDING SITE II or BINDING SITE III. Table 2 illustrates the complementarity of the nucleotide sequences of phorbolin-1 BINDING SITE, designated SEQ ID:42798, to the nucleotide sequence of VGAM1003 RNA, herein designated VGAM RNA, also designated SEQ ID:3714.

Another function of VGAM1003 is therefore inhibition of phorbolin-1 (Accession XM_114206). Accordingly, utilities of VGAM1003 include diagnosis, prevention and treatment of diseases and clinical conditions associated with phorbolin-1. LOC151568 (Accession NM_138483) is another VGAM1003 host target gene. LOC151568 BINDING SITE is HOST TARGET binding site found in the 5' untranslated region of mRNA encoded by LOC151568, corresponding to a HOST TARGET binding site such as BINDING SITE I, BINDING SITE II or BINDING SITE III. Table 2 illustrates the complementarity of the nucleotide sequences of LOC151568 BINDING SITE, designated SEQ ID:28836, to the nucleotide sequence of VGAM1003 RNA, herein designated VGAM RNA, also designated SEQ ID:3714.

Another function of VGAM1003 is therefore inhibition of LOC151568 (Accession NM_138483). Accordingly, utilities of VGAM1003 include diagnosis, prevention and treatment of diseases and clinical conditions associated with LOC151568. LOC151996 (Accession XM_098151) is another VGAM1003 host target gene. LOC151996 BINDING SITE is HOST TARGET binding site found in the 5' untranslated region of mRNA encoded by LOC151996, corresponding to a HOST TARGET binding site such as BINDING SITE I, BINDING SITE II or BINDING SITE III. Table 2 illustrates the complementarity of the nucleotide sequences of LOC151996 BINDING SITE, designated SEQ ID:41413, to the nucleotide sequence of VGAM1003 RNA, herein designated VGAM RNA, also designated SEQ ID:3714.

Another function of VGAM1003 is therefore inhibition of LOC151996 (Accession XM_098151). Accordingly, utilities of VGAM1003 include diagnosis, prevention and treatment of diseases and clinical conditions associated with LOC151996. LOC196759 (Accession XM_113601) is another VGAM1003 host target gene. LOC196759 BINDING SITE is HOST TARGET binding site found in the 3' untranslated region of mRNA encoded by LOC196759, corresponding to a HOST TARGET binding site such as BINDING SITE I, BINDING SITE II or BINDING SITE III. Table 2 illustrates the complementarity of the nucleotide sequences of LOC196759 BINDING SITE, designated SEQ ID:42294, to the nucleotide sequence of VGAM1003 RNA, herein designated VGAM RNA, also designated SEQ ID:3714.

Another function of VGAM1003 is therefore inhibition of LOC196759 (Accession XM_113601). Accordingly, utilities of VGAM1003 include diagnosis, prevention and treatment of diseases and clinical conditions associated with LOC196759. LOC201617 (Accession XM_117315) is another VGAM1003 host target gene. LOC201617 BINDING SITE is HOST TARGET binding site found in the 5' untranslated region of mRNA encoded by LOC201617, corresponding to a HOST TARGET binding site such as BINDING SITE I, BINDING SITE II or BINDING SITE III. Table 2 illustrates the complementarity of the nucleotide sequences of LOC201617 BINDING SITE, designated SEQ ID:43382, to the nucleotide sequence of VGAM1003 RNA, herein designated VGAM RNA, also designated SEQ ID:3714.

Another function of VGAM1003 is therefore inhibition of LOC201617 (Accession XM_117315). Accordingly, utilities of VGAM1003 include diagnosis, prevention and treatment of diseases and clinical conditions associated with LOC201617. LOC220045 (Accession XM_167820) is another VGAM1003 host target gene. LOC220045 BINDING SITE is HOST TARGET binding site found in the 3' untranslated region of mRNA encoded by LOC220045, corresponding to a HOST TARGET binding site such as BINDING SITE I, BINDING SITE II or BINDING SITE III. Table 2 illustrates the complementarity of the nucleotide sequences of LOC220045 BINDING SITE, designated SEQ ID:44859, to the nucleotide sequence of VGAM1003 RNA, herein designated VGAM RNA, also designated SEQ ID:3714.

Another function of VGAM1003 is therefore inhibition of LOC220045 (Accession XM_167820). Accordingly, utilities of VGAM1003 include diagnosis, prevention and treatment of diseases and clinical conditions associated with LOC220045. LOC93070 (Accession XM_049046) is another VGAM1003 host target gene. LOC93070 BINDING SITE is HOST TARGET binding site found in the 3' untranslated region of mRNA encoded by LOC93070, corresponding to a HOST TARGET binding site such as BINDING SITE I, BINDING SITE II or BINDING SITE III. Table 2 illustrates the complementarity of the nucleotide sequences of LOC93070 BINDING SITE, designated SEQ ID:35323, to the nucleotide sequence of VGAM1003 RNA, herein designated VGAM RNA, also designated SEQ ID:3714.

Another function of VGAM1003 is therefore inhibition of LOC93070 (Accession XM_049046). Accordingly, utilities of VGAM1003 include diagnosis, prevention and treatment of diseases and clinical conditions associated with LOC93070. FIG. 1 further provides a conceptual description of a novel bioinformatically detected viral gene of the present invention, referred to here as Viral Genomic Address Messenger 1004 (VGAM1004) viral gene, which modulates expression of respective host target genes thereof, the function and utility of which host target genes is known in the art.

VGAM1004 is a novel bioinformatically detected regulatory, non protein coding, viral micro RNA (miRNA) gene. The method by which VGAM1004 was detected is described hereinabove with reference to FIGS. 1-8.

VGAM1004 gene, herein designated VGAM GENE, is a viral gene contained in the genome of Chimpanzee Cytomegalovirus. VGAM1004 host target gene, herein designated VGAM HOST TARGET GENE, is a human gene contained in the human genome.

VGAM1004 gene encodes a VGAM1004 precursor RNA, herein designated VGAM PRECURSOR RNA. Similar to other miRNA genes, and unlike most ordinary genes, VGAM1004 precursor RNA does not encode a protein. A nucleotide sequence identical or highly similar to the nucleotide sequence of VGAM1004 precursor RNA is designated SEQ ID:990, and is provided hereinbelow with reference to the sequence listing part. Nucleotide sequence SEQ ID:990 is located at position 199410 relative to the genome of Chimpanzee Cytomegalovirus.

VGAM1004 precursor RNA folds onto itself, forming VGAM1004 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1004 folded precursor RNA into VGAM1004 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1004 RNA is designated SEQ ID:3715, and is provided hereinbelow with reference to the sequence listing part.

VGAM1004 host target gene, herein designated VGAM HOST TARGET GENE, encodes a corresponding messenger RNA, VGAM1004 host target RNA, herein designated VGAM HOST TARGET RNA. VGAM1004 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1004 RNA, herein designated VGAM RNA, binds complementarily to one or more host target binding sites located in untranslated regions of VGAM1004 host target RNA, herein designated VGAM HOST TARGET RNA. This complementary binding is due to the fact that the nucleotide sequence of VGAM1004 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1004 RNA, herein designated VGAM RNA, may have a different number of host target binding sites in untranslated regions of a VGAM1004 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1004 RNA, herein designated VGAM RNA, to host target binding sites on VGAM1004 host target RNA, herein designated VGAM HOST TARGET RNA, such as BINDING SITE I, BINDING SITE II and BINDING SITE III, inhibits translation of VGAM1004 host target RNA into VGAM1004 host target protein, herein designated VGAM HOST TARGET PROTEIN. VGAM host target protein is therefore outlined by a broken line.

It is appreciated that VGAM1004 host target gene, herein designated VGAM HOST TARGET GENE, in fact represents a plurality of VGAM1004 host target genes. The mRNA of each one of this plurality of VGAM1004 host target genes comprises one or more host target binding sites, each having a nucleotide sequence which is at least partly complementary to VGAM1004 RNA, herein designated VGAM RNA, and which when bound by VGAM1004 RNA causes inhibition of translation of respective one or more VGAM1004 host target proteins.

It is further appreciated by one skilled in the art that the mode of translational inhibition illustrated by FIG. 1 with specific reference to translational inhibition exerted by VGAM1004 gene, herein designated VGAM GENE, on one or more VGAM1004 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1004 is inhibition of expression of host target genes, as part of a novel viral mechanism of attacking a host. Accordingly, utilities of VGAM1004 include diagnosis, prevention and treatment of viral infection by Chimpanzee Cytomegalovirus. Specific functions, and accordingly utilities, of VGAM1004 correlate with, and may be deduced from, the identity of the host target genes which VGAM1004 binds and inhibits, and the function of these host target genes, as elaborated hereinbelow.

Nucleotide sequences of the VGAM1004 precursor RNA, herein designated VGAM PRECURSOR RNA, and of the 'diced' VGAM1004 RNA, herein designated VGAM RNA, and a schematic representation of the secondary folding of VGAM1004 folded precursor RNA, herein designated VGAM FOLDED PRECURSOR RNA, of VGAM1004 are further described hereinbelow with reference to Table 1.

Nucleotide sequences of host target binding sites, such as BINDING SITE-I, BINDING SITE-II and BINDING SITE-III of FIG. 1, found on VGAM1004 host target RNA, and schematic representation of the complementarity of each of these host target binding sites to VGAM1004 RNA, herein designated VGAM RNA, are described hereinbelow with reference to Table 2.

As mentioned hereinabove with reference to FIG. 1, a function of VGAM1004 gene, herein designated VGAM is inhibition of expression of VGAM1004 target genes. It is appreciated that specific functions, and accordingly utilities, of VGAM1004 correlate with, and may be deduced from, the identity of the target genes which VGAM1004 binds and inhibits, and the function of these target genes, as elaborated hereinbelow.

FLJ20330 (Accession NM_018988) is a VGAM1004 host target gene. FLJ20330 BINDING SITE is HOST TARGET binding site found in the 3' untranslated region of mRNA encoded by FLJ20330, corresponding to a HOST TARGET binding site such as BINDING SITE I, BINDING SITE II or BINDING SITE III. Table 2 illustrates the complementarity of the nucleotide sequences of FLJ20330 BINDING SITE, designated SEQ ID:21059, to the nucleotide sequence of VGAM1004 RNA, herein designated VGAM RNA, also designated SEQ ID:3715.

A function of VGAM1004 is therefore inhibition of FLJ20330 (Accession NM_018988). Accordingly, utilities of VGAM1004 include diagnosis, prevention and treatment of diseases and clinical conditions associated with FLJ20330. PRO0529 (Accession NM_014074) is another VGAM1004 host target gene. PRO0529 BINDING SITE is HOST TARGET binding site found in the 3' untranslated region of mRNA encoded by PRO0529, corresponding to a HOST TARGET binding site such as BINDING SITE I, BINDING SITE II or BINDING SITE III. Table 2 illustrates the complementarity of the nucleotide sequences of PRO0529 BINDING SITE, designated SEQ ID:15298, to the nucleotide sequence of VGAM1004 RNA, herein designated VGAM RNA, also designated SEQ ID:3715.

Another function of VGAM1004 is therefore inhibition of PRO0529 (Accession NM_014074). Accordingly, utilities of VGAM1004 include diagnosis, prevention and treatment of diseases and clinical conditions associated with PRO0529. LOC93206 (Accession XM_049838) is another VGAM1004 host target gene. LOC93206 BINDING SITE is HOST TARGET binding site found in the 3' untranslated region of mRNA encoded by LOC93206, corresponding to a HOST TARGET binding site such as BINDING SITE I, BINDING SITE II or BINDING SITE III. Table 2 illustrates the complementarity of the nucleotide sequences of LOC93206 BINDING SITE, designated SEQ ID:35517, to the nucleotide sequence of VGAM1004 RNA, herein designated VGAM RNA, also designated SEQ ID:3715.

Another function of VGAM1004 is therefore inhibition of LOC93206 (Accession XM_049838). Accordingly, utilities of VGAM1004 include diagnosis, prevention and treatment of diseases and clinical conditions associated with LOC93206. FIG. 1 further provides a conceptual description of a novel bioinformatically detected viral gene of the present invention, referred to here as Viral Genomic Address Messenger 1005 (VGAM1005) viral gene, which modulates expression of respective host target genes thereof, the function and utility of which host target genes is known in the art.

VGAM1005 is a novel bioinformatically detected regulatory, non protein coding, viral micro RNA (miRNA) gene. The method by which VGAM1005 was detected is described hereinabove with reference to FIGS. 1-8.

VGAM1005 gene, herein designated VGAM GENE, is a viral gene contained in the genome of Chimpanzee Cytomegalovirus. VGAM1005 host target gene, herein designated VGAM HOST TARGET GENE, is a human gene contained in the human genome.

VGAM1005 gene encodes a VGAM1005 precursor RNA, herein designated VGAM PRECURSOR RNA. Similar to other miRNA genes, and unlike most ordinary genes, VGAM1005 precursor RNA does not encode a protein. A nucleotide sequence identical or highly similar to the nucleotide sequence of VGAM1005 precursor RNA is designated SEQ ID:991, and is provided hereinbelow with reference to the sequence listing part. Nucleotide sequence SEQ ID:991 is located at position 196285 relative to the genome of Chimpanzee Cytomegalovirus.

VGAM1005 precursor RNA folds onto itself, forming VGAM1005 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1005 folded precursor RNA into VGAM1005 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1005 RNA is designated SEQ ID:3716, and is provided hereinbelow with reference to the sequence listing part.

VGAM1005 host target gene, herein designated VGAM HOST TARGET GENE, encodes a corresponding messenger RNA, VGAM1005 host target RNA, herein designated VGAM HOST TARGET RNA. VGAM1005 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1005 RNA, herein designated VGAM RNA, binds complementarily to one or more host target binding sites located in untranslated regions of VGAM1005 host target RNA, herein designated VGAM HOST TARGET RNA. This complementary binding is due to the fact that the nucleotide sequence of VGAM1005 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1005 RNA, herein designated VGAM RNA, may have a different number of host target binding sites in untranslated regions of a VGAM1005 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1005 RNA, herein designated VGAM RNA, to host target binding sites on VGAM1005 host target RNA, herein designated VGAM HOST TARGET RNA, such as BINDING SITE I, BINDING SITE II and BINDING SITE III, inhibits translation of VGAM1005 host target RNA into VGAM1005 host target protein, herein designated VGAM HOST TARGET PROTEIN. VGAM host target protein is therefore outlined by a broken line.

It is appreciated that VGAM1005 host target gene, herein designated VGAM HOST TARGET GENE, in fact represents a plurality of VGAM1005 host target genes. The mRNA of each one of this plurality of VGAM1005 host target genes comprises one or more host target binding sites, each having a nucleotide sequence which is at least partly complementary to VGAM1005 RNA, herein designated VGAM RNA, and which when bound by VGAM1005 RNA causes inhibition of translation of respective one or more VGAM1005 host target proteins.

It is further appreciated by one skilled in the art that the mode of translational inhibition illustrated by FIG. 1 with specific reference to translational inhibition exerted by VGAM1005 gene, herein designated VGAM GENE, on one or more VGAM1005 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1005 is inhibition of expression of host target genes, as part of a novel viral mechanism of attacking a host. Accordingly, utilities of VGAM1005 include diagnosis, prevention and treatment of viral infection by Chimpanzee Cytomegalovirus. Specific functions, and accordingly utilities, of VGAM1005 correlate with, and may be deduced from, the identity of the host target genes which VGAM1005 binds and inhibits, and the function of these target genes, as elaborated hereinbelow.

Nucleotide sequences of the VGAM1005 precursor RNA, herein designated VGAM PRECURSOR RNA, and of the 'diced' VGAM1005 RNA, herein designated VGAM RNA, and a schematic representation of the secondary folding of VGAM1005 folded precursor RNA, herein designated VGAM FOLDED PRECURSOR RNA, of VGAM1005 are further described hereinbelow with reference to Table 1.

Nucleotide sequences of host target binding sites, such as BINDING SITE-I, BINDING SITE-II and BINDING SITE-III of FIG. 1, found on VGAM1005 host target RNA, and schematic representation of the complementarity of each of these host target binding sites to VGAM1005 RNA, herein designated VGAM RNA, are described hereinbelow with reference to Table 2.

As mentioned hereinabove with reference to FIG. 1, a function of VGAM1005 gene, herein designated VGAM is inhibition of expression of VGAM1005 target genes. It is appreciated that specific functions, and accordingly utilities, of VGAM1005 correlate with, and may be deduced from, the identity of the target genes which VGAM1005 binds and inhibits, and the function of these target genes, as elaborated hereinbelow.

HLA-B Associated Transcript 4 (BAT4, Accession NM_033177) is a VGAM1005 host target gene. BAT4 BINDING SITE is HOST TARGET binding site found in the 5' untranslated region of mRNA encoded by BAT4, corresponding to a HOST TARGET binding site such as BINDING SITE I, BINDING SITE II or BINDING SITE III. Table 2 illustrates the complementarity of the nucleotide sequences of BAT4 BINDING SITE, designated SEQ ID:27040, to the nucleotide sequence of VGAM1005 RNA, herein designated VGAM RNA, also designated SEQ ID:3716.

A function of VGAM1005 is therefore inhibition of HLA-B Associated Transcript 4 (BAT4, Accession NM_033177). Accordingly, utilities of VGAM1005 include diagnosis, prevention and treatment of diseases and clinical conditions associated with BAT4. Cyclin D2 (CCND2, Accession NM_001759) is another VGAM1005 host target gene. CCND2 BINDING SITE is HOST TARGET binding site found in the 3' untranslated region of mRNA encoded by CCND2, corresponding to a HOST TARGET binding site such as BINDING SITE I, BINDING SITE II or BINDING SITE III. Table 2 illustrates the complementarity of the nucleotide sequences of CCND2 BINDING SITE, designated SEQ ID:7514, to the nucleotide sequence of VGAM1005 RNA, herein designated VGAM RNA, also designated SEQ ID:3716.

Another function of VGAM1005 is therefore inhibition of Cyclin D2 (CCND2, Accession NM_001759), a gene which is essential for the control of the cell cycle at the g1/s (start) transition. Accordingly, utilities of VGAM1005 include diagnosis, prevention and treatment of diseases and clinical conditions associated with CCND2. The function of CCND2 and its association with various diseases and clinical conditions, has been established by previous studies, as described hereinabove with reference to VGAM128. Cell Division Cycle 34 (CDC34, Accession NM_004359) is another VGAM1005 host target gene. CDC34 BINDING SITE is HOST TARGET binding site found in the 5' untranslated region of mRNA encoded by CDC34, corresponding to a HOST TARGET binding site such as BINDING SITE I, BINDING SITE II or BINDING SITE III. Table 2 illustrates the complementarity of the nucleotide sequences of CDC34 BINDING SITE, designated SEQ ID:10561, to the nucleotide sequence of VGAM1005 RNA, herein designated VGAM RNA, also designated SEQ ID:3716.

Another function of VGAM1005 is therefore inhibition of Cell Division Cycle 34 (CDC34, Accession NM_004359). Accordingly, utilities of VGAM1005 include diagnosis, prevention and treatment of diseases and clinical conditions associated with CDC34. Dishevelled, Dsh Homolog 3 (Drosophila) (DVL3, Accession NM_004423) is another VGAM1005 host target gene. DVL3 BINDING SITE is HOST TARGET binding site found in the 5' untranslated region of mRNA encoded by DVL3, corresponding to a HOST TARGET binding site such as BINDING SITE I, BINDING SITE II or BINDING SITE III. Table 2 illustrates the complementarity of the nucleotide sequences of DVL3 BINDING SITE, designated SEQ ID:10698, to the nucleotide sequence of VGAM1005 RNA, herein designated VGAM RNA, also designated SEQ ID:3716.

Another function of VGAM1005 is therefore inhibition of Dishevelled, Dsh Homolog 3 (Drosophila) (DVL3, Accession NM_004423), a gene which regulates cell proliferation. Accordingly, utilities of VGAM1005 include diagnosis, prevention and treatment of diseases and clinical conditions associated with DVL3. The function of DVL3 and its association with various diseases and clinical conditions, has been established by previous studies, as described hereinabove with reference to VGAM57. Fibroblast Growth Factor Receptor 1 (fms-related tyrosine kinase 2, Pfeiffer syndrome) (FGFR1, Accession NM_015850) is another VGAM1005 host target gene. FGFR1 BINDING SITE1 through FGFR1 BINDING SITE5 are HOST TARGET binding sites found in untranslated regions of mRNA encoded by FGFR1, corresponding to HOST TARGET binding sites such as BINDING SITE I, BINDING SITE II or BINDING SITE III. Table 2 illustrates the complementarity of the nucleotide sequences of FGFR1 BINDING SITE1 through FGFR1 BINDING SITE5, designated SEQ ID:17977, SEQ ID:23361, SEQ ID:23371, SEQ ID:23376 and SEQ ID:6206 respectively, to the nucleotide sequence of VGAM1005 RNA, herein designated VGAM RNA, also designated SEQ ID:3716.

Another function of VGAM1005 is therefore inhibition of Fibroblast Growth Factor Receptor 1 (fms-related tyrosine kinase 2, Pfeiffer syndrome) (FGFR1, Accession NM_015850). Accordingly, utilities of VGAM1005 include diagnosis, prevention and treatment of diseases and clinical conditions associated with FGFR1. Fucosyltransferase 8 (alpha (1,6) Fucosyltransferase) (FUT8, Accession NM_004480) is another VGAM1005 host target gene. FUT8 BINDING SITE is HOST TARGET binding site found in the 5' untranslated region of mRNA encoded by FUT8, corresponding to a HOST TARGET binding site such as BINDING SITE I, BINDING SITE II or BINDING SITE III. Table 2 illustrates the complementarity of the nucleotide sequences of FUT8 BINDING SITE, designated SEQ ID:10795, to the nucleotide sequence of VGAM1005 RNA, herein designated VGAM RNA, also designated SEQ ID:3716.

Another function of VGAM1005 is therefore inhibition of Fucosyltransferase 8 (alpha (1,6) Fucosyltransferase) (FUT8, Accession NM_004480), a gene which transfers fucose to N-linked type complex glycopeptides from GDP-Fuc; functions in asparagine-linked glycoprotein oligosaccharide synthesis. Accordingly, utilities of VGAM1005 include diagnosis, prevention and treatment of diseases and clinical conditions associated with FUT8. The function of FUT8 and its association with various diseases and clinical conditions, has been established by previous studies, as described hereinabove with reference to VGAM64. Glycyl-tRNA Synthetase (GARS, Accession NM_002047) is another VGAM1005 host target gene. GARS BINDING SITE is HOST TARGET binding site found in the 5' untranslated region of mRNA encoded by GARS, corresponding to a HOST TARGET binding site such as BINDING SITE I, BINDING SITE II or BINDING SITE III. Table 2 illustrates the complementarity of the nucleotide sequences of GARS BINDING SITE, designated SEQ ID:7796, to the nucleotide sequence of VGAM1005 RNA, herein designated VGAM RNA, also designated SEQ ID:3716.

Another function of VGAM1005 is therefore inhibition of Glycyl-tRNA Synthetase (GARS, Accession NM_002047), a gene which functions in protein biosynthesis. Accordingly, utilities of VGAM1005 include diagnosis, prevention and treatment of diseases and clinical conditions associated with GARS. The function of GARS and its association with various diseases and clinical conditions, has been established by previous studies, as described hereinabove with reference to VGAM113. Guanine Nucleotide Binding Protein-like 1 (GNL1, Accession XM_166361) is another VGAM1005 host target gene. GNL1 BINDING SITE1 and GNL1 BINDING SITE2 are HOST TARGET binding sites found in untranslated regions of mRNA encoded by GNL1, corresponding to HOST TARGET binding sites such as BINDING SITE I, BINDING SITE II or BINDING SITE III. Table 2 illustrates the complementarity of the nucleotide sequences of GNL1 BINDING SITE1 and GNL1 BINDING SITE2, designated SEQ ID:44187 and SEQ ID:46716 respectively, to the nucleotide sequence of VGAM1005 RNA, herein designated VGAM RNA, also designated SEQ ID:3716.

Another function of VGAM1005 is therefore inhibition of Guanine Nucleotide Binding Protein-like 1 (GNL1, Accession XM_166361). Accordingly, utilities of VGAM1005 include diagnosis, prevention and treatment of diseases and clinical conditions associated with GNL1. Hippocalcin-like 1 (HPCAL1, Accession NM_002149) is another VGAM1005 host target gene. HPCAL1 BINDING SITE is HOST TARGET binding site found in the 5' untranslated region of mRNA encoded by HPCAL1, corresponding to a HOST TARGET binding site such as BINDING SITE I, BINDING SITE II or BINDING SITE III. Table 2 illustrates the complementarity of the nucleotide sequences of HPCAL1 BINDING SITE, designated SEQ ID:7928, to the nucleotide sequence of VGAM1005 RNA, herein designated VGAM RNA, also designated SEQ ID:3716.

Another function of VGAM1005 is therefore inhibition of Hippocalcin-like 1 (HPCAL1, Accession NM_002149). Accordingly, utilities of VGAM1005 include diagnosis, prevention and treatment of diseases and clinical conditions associated with HPCAL1. Iduronate 2-sulfatase (Hunter syndrome) (IDS, Accession NM_000202) is another VGAM1005 host target gene. IDS BINDING SITE is HOST TARGET binding site found in the 5' untranslated region of mRNA encoded by IDS, corresponding to a HOST TARGET binding site such as BINDING SITE I, BINDING SITE II or BINDING SITE III. Table 2 illustrates the complementarity of the nucleotide sequences of IDS BINDING SITE, designated SEQ ID:5697, to the nucleotide sequence of VGAM1005 RNA, herein designated VGAM RNA, also designated SEQ ID:3716.

Another function of VGAM1005 is therefore inhibition of Iduronate 2-sulfatase (Hunter syndrome) (IDS, Accession NM_000202). Accordingly, utilities of VGAM1005 include diagnosis, prevention and treatment of diseases and clinical conditions associated with IDS. Jagged 2 (JAG2, Accession NM_002226) is another VGAM1005 host target gene. JAG2 BINDING SITE is HOST TARGET binding site found in the 5' untranslated region of mRNA encoded by JAG2, corresponding to a HOST TARGET binding site such as BINDING SITE I, BINDING SITE II or BINDING SITE III. Table 2 illustrates the complementarity of the nucleotide sequences of JAG2 BINDING SITE, designated SEQ ID:8005, to the nucleotide sequence of VGAM1005 RNA, herein designated VGAM RNA, also designated SEQ ID:3716.

Another function of VGAM1005 is therefore inhibition of Jagged 2 (JAG2, Accession NM_002226), a gene which is a putative notch ligand involved in the mediation of notch signaling. Accordingly, utilities of VGAM1005 include diagnosis, prevention and treatment of diseases and clinical conditions associated with JAG2. The function of JAG2 and its association with various diseases and clinical conditions, has been established by previous studies, as described hereinabove with reference to VGAM136. Met Proto-oncogene (hepatocyte growth factor receptor) (MET, Accession XM_048918) is another VGAM1005 host target gene. MET BINDING SITE is HOST TARGET binding site found in the 5' untranslated region of mRNA encoded by MET, corresponding to a HOST TARGET binding site such as BINDING SITE I, BINDING SITE II or BINDING SITE III. Table 2 illustrates the complementarity of the nucleotide sequences of MET BINDING SITE, designated SEQ ID:35304, to the nucleotide sequence of VGAM1005 RNA, herein designated VGAM RNA, also designated SEQ ID:3716.

Another function of VGAM1005 is therefore inhibition of Met Proto-oncogene (hepatocyte growth factor receptor) (MET, Accession XM_048918), a gene which catalyzes the methylation of GpppN- at the guanine N7 position. Accordingly, utilities of VGAM1005 include diagnosis, prevention and treatment of diseases and clinical conditions associated with MET. The function of MET has been established by previous studies. In mammals, 5-prime-terminal caps are formed on nascent pre-mRNAs by the sequential action of 2 enzymes, the bifunctional capping enzyme RNGTT (OMIM Ref. No. 603512) and RNA (guanine-7) methyltransferase. RNGTT catalyzes the removal of the gamma-phosphate of the initiating nucleotide and transfers GMP from GTP to the resulting diphosphate end. RNA (guanine-7) methyltransferase catalyzes the subsequent N7 methylation of the newly formed termini. The terminal 7-methylguanosine is recognized by cap-binding proteins that facilitate key events in gene expression. By searching an EST database for sequences homologous to that of S. cerevisiae RNA (guanine-7) methyltransferase, Pillutla et al. (1998) identified a human Met cDNA. The predicted 476-amino acid MET protein contains several conserved motifs known to be required for methyltransferase activity. Recombinant Met exhibited RNA (guanine-7) methyltransferase activity in vitro, and formed ternary complexes with RNGTT and the elongating form of RNA polymerase II. By screening human brain cDNAs for those encoding large proteins, Ishikawa et al. (1997) identified KIAA0398, an RNMT cDNA. Tsukamoto et al. (1998) isolated 3 human cDNAs encoding mRNA RNMT, which they termed HCMT1a, HCMT1b, and HCMT1c, which appear to be produced by alternative splicing. HCMT1a and HCMT1b encode deduced proteins of 476 and 504 amino acids, respectively, and differ only in the region encoding the C-terminal portion of the enzyme after residue 465. HCMT1c appears to encode the same polypeptide as HCMT1a; however, the 3-prime noncoding region of HCMT1c contains sequences corresponding to portions of both HCMT1a and HCMT1b. RT-PCR detected expression of the 3 mRNAs in all tissues tested. Recombinant HCMT1a expressed in E. coli exhibited mRNA RNMT activity, whereas recombinant HCMT1b did not. By analysis of a radiation hybrid panel, Pillutla et al. (1998) and Ishikawa et al. (1997) mapped the RNMT gene to chromosome 18. Pillutla et al. (1998) refined the location to 18p11.23-p11.22 using fluorescence in situ hybridization.

Full details of the abovementioned studies are described in the following publications, the disclosure of which are hereby incorporated by reference:

Pillutla, R. C.; Yue, Z.; Maldonado, E.; Shatkin, A. J.: Recombinant human mRNA cap methyltransferase binds capping enzyme/RNA polymerase IIo complexes. J. Biol. Chem. 273:21443-21446, 1998; and Tsukamoto, T.; Shibagaki, Y.; Niikura, Y.; Mizumoto, K.: Cloning and characterization of three human cDNAs encoding mRNA (guanine-7)-methyltransferase, an mRNA cap methylase. Biochem. B.

Further studies establishing the function and utilities of MET are found in John Hopkins OMIM database record ID 603514, and in sited publications numbered 110 and 1110-1111 listed in the bibliography section hereinbelow, which are also hereby incorporated by reference. Neurexin 1 (NRXN1, Accession NM_138735) is another VGAM1005 host target gene. NRXN1 BINDING SITE is HOST TARGET binding site found in the 5' untranslated region of mRNA encoded by NRXN1, corresponding to a HOST TARGET binding site such as BINDING SITE I, BINDING SITE II or BINDING SITE III. Table 2 illustrates the complementarity of the nucleotide sequences of NRXN1 BINDING SITE, designated SEQ ID:28995, to the nucleotide sequence of VGAM1005 RNA, herein designated VGAM RNA, also designated SEQ ID:3716.

Another function of VGAM1005 is therefore inhibition of Neurexin 1 (NRXN1, Accession NM_138735), a gene which may be involved in cell recognition, cell adhesion, and mediate intracellular signaling. Accordingly, utilities of VGAM1005 include diagnosis, prevention and treatment of diseases and clinical conditions associated with NRXN1. The function of NRXN1 and its association with various diseases and clinical conditions, has been established by previous studies, as described hereinabove with reference to VGAM191. Sodium Channel, Voltage-gated, Type I, Alpha Polypeptide (SCN1A, Accession XM_114281) is another VGAM1005 host target gene. SCN1A BINDING SITE is HOST TARGET binding site found in the 3' untranslated region of mRNA encoded by SCN1A, corresponding to a HOST TARGET binding site such as BINDING SITE I, BINDING SITE II or BINDING SITE III. Table 2 illustrates the complementarity of the nucleotide sequences of SCN1A BINDING SITE, designated SEQ ID:42837, to the nucleotide sequence of VGAM1005 RNA, herein designated VGAM RNA, also designated SEQ ID:3716.

Another function of VGAM1005 is therefore inhibition of Sodium Channel, Voltage-gated, Type I, Alpha Polypeptide (SCN1A, Accession XM_114281). Accordingly, utilities of VGAM1005 include diagnosis, prevention and treatment of diseases and clinical conditions associated with SCN1A. Solute Carrier Family 30 (zinc transporter), Member 3 (SLC30A3, Accession NM_003459) is another VGAM1005 host target gene. SLC30A3 BINDING SITE is HOST TARGET binding site found in the 5' untranslated region of mRNA encoded by SLC30A3, corresponding to a HOST TARGET binding site such as BINDING SITE I, BINDING SITE II or BINDING SITE III. Table 2 illustrates the complementarity of the nucleotide sequences of SLC30A3 BINDING SITE, designated SEQ ID:9524, to the nucleotide sequence of VGAM1005 RNA, herein designated VGAM RNA, also designated SEQ ID:3716.

Another function of VGAM1005 is therefore inhibition of Solute Carrier Family 30 (zinc transporter), Member 3 (SLC30A3, Accession NM_003459). Accordingly, utilities of VGAM1005 include diagnosis, prevention and treatment of diseases and clinical conditions associated with SLC30A3. Adaptor-related Protein Complex 1, Sigma 2 Subunit (AP1S2, Accession NM_003916) is another VGAM1005 host target gene. AP1S2 BINDING SITE is HOST TARGET binding site found in the 5' untranslated region of mRNA encoded by AP1S2, corresponding to a HOST TARGET binding site such as BINDING SITE I, BINDING SITE II or BINDING SITE III. Table 2 illustrates the complementarity of the nucleotide sequences of AP1S2 BINDING SITE, designated SEQ ID:10002, to the nucleotide sequence of VGAM1005 RNA, herein designated VGAM RNA, also designated SEQ ID:3716.

Another function of VGAM1005 is therefore inhibition of Adaptor-related Protein Complex 1, Sigma 2 Subunit (AP1S2, Accession NM_003916). Accordingly, utilities of VGAM1005 include diagnosis, prevention and treatment of diseases and clinical conditions associated with AP1S2. Chromosome 22 Open Reading Frame 4 (C22orf4, Accession XM_027143) is another VGAM1005 host target gene.

C22orf4 BINDING SITE is HOST TARGET binding site found in the 3' untranslated region of mRNA encoded by C22orf4, corresponding to a HOST TARGET binding site such as BINDING SITE I, BINDING SITE II or BINDING SITE III. Table 2 illustrates the complementarity of the nucleotide sequences of C22orf4 BINDING SITE, designated SEQ ID:30424, to the nucleotide sequence of VGAM1005 RNA, herein designated VGAM RNA, also designated SEQ ID:3716.

Another function of VGAM1005 is therefore inhibition of Chromosome 22 Open Reading Frame 4 (C22orf4, Accession XM_027143). Accordingly, utilities of VGAM1005 include diagnosis, prevention and treatment of diseases and clinical conditions associated with C22orf4. CHFR (Accession NM_018223) is another VGAM1005 host target gene. CHFR BINDING SITE is HOST TARGET binding site found in the 3' untranslated region of mRNA encoded by CHFR, corresponding to a HOST TARGET binding site such as BINDING SITE I, BINDING SITE II or BINDING SITE III. Table 2 illustrates the complementarity of the nucleotide sequences of CHFR BINDING SITE, designated SEQ ID:20148, to the nucleotide sequence of VGAM1005 RNA, herein designated VGAM RNA, also designated SEQ ID:3716.

Another function of VGAM1005 is therefore inhibition of CHFR (Accession NM_018223). Accordingly, utilities of VGAM1005 include diagnosis, prevention and treatment of diseases and clinical conditions associated with CHFR. DKFZp547C176 (Accession XM_040799) is another VGAM1005 host target gene. DKFZp547C176 BINDING SITE is HOST TARGET binding site found in the 5' untranslated region of mRNA encoded by DKFZp547C176, corresponding to a HOST TARGET binding site such as BINDING SITE I, BINDING SITE II or BINDING SITE III. Table 2 illustrates the complementarity of the nucleotide sequences of DKFZp547C176 BINDING SITE, designated SEQ ID:33380, to the nucleotide sequence of VGAM1005 RNA, herein designated VGAM RNA, also designated SEQ ID:3716.

Another function of VGAM1005 is therefore inhibition of DKFZp547C176 (Accession XM_040799). Accordingly, utilities of VGAM1005 include diagnosis, prevention and treatment of diseases and clinical conditions associated with DKFZp547C176. DKFZP564I1171 (Accession XM_049568) is another VGAM1005 host target gene. DKFZP564I1171 BINDING SITE is HOST TARGET binding site found in the 5' untranslated region of mRNA encoded by DKFZP564I1171, corresponding to a HOST TARGET binding site such as BINDING SITE I, BINDING SITE II or BINDING SITE III. Table 2 illustrates the complementarity of the nucleotide sequences of DKFZP564I1171 BINDING SITE, designated SEQ ID:35443, to the nucleotide sequence of VGAM1005 RNA, herein designated VGAM RNA, also designated SEQ ID:3716.

Another function of VGAM1005 is therefore inhibition of DKFZP564I1171 (Accession XM_049568). Accordingly, utilities of VGAM1005 include diagnosis, prevention and treatment of diseases and clinical conditions associated with DKFZP564I1171. DKFZp761A052 (Accession XM_054098) is another VGAM1005 host target gene. DKFZp761A052 BINDING SITE is HOST TARGET binding site found in the 5' untranslated region of mRNA encoded by DKFZp761A052, corresponding to a HOST TARGET binding site such as BINDING SITE I, BINDING SITE II or BINDING SITE III. Table 2 illustrates the complementarity of the nucleotide sequences of DKFZp761A052 BINDING SITE, designated SEQ ID:36141, to the nucleotide sequence of VGAM1005 RNA, herein designated VGAM RNA, also designated SEQ ID:3716.

Another function of VGAM1005 is therefore inhibition of DKFZp761A052 (Accession XM_054098). Accordingly, utilities of VGAM1005 include diagnosis, prevention and treatment of diseases and clinical conditions associated with DKFZp761A052. FLJ13262 (Accession NM_024914) is another VGAM1005 host target gene. FLJ13262 BINDING SITE is HOST TARGET binding site found in the 3' untranslated region of mRNA encoded by FLJ13262, corresponding to a HOST TARGET binding site such as BINDING SITE I, BINDING SITE II or BINDING SITE III. Table 2 illustrates the complementarity of the nucleotide sequences of FLJ13262 BINDING SITE, designated SEQ ID:24433, to the nucleotide sequence of VGAM1005 RNA, herein designated VGAM RNA, also designated SEQ ID:3716.

Another function of VGAM1005 is therefore inhibition of FLJ13262 (Accession NM_024914). Accordingly, utilities of VGAM1005 include diagnosis, prevention and treatment of diseases and clinical conditions associated with FLJ13262. FLJ20979 (Accession NM_024121) is another VGAM1005 host target gene. FLJ20979 BINDING SITE is HOST TARGET binding site found in the 5' untranslated region of mRNA encoded by FLJ20979, corresponding to a HOST TARGET binding site such as BINDING SITE I, BINDING SITE II or BINDING SITE III. Table 2 illustrates the complementarity of the nucleotide sequences of FLJ20979 BINDING SITE, designated SEQ ID:23574, to the nucleotide sequence of VGAM1005 RNA, herein designated VGAM RNA, also designated SEQ ID:3716.

Another function of VGAM1005 is therefore inhibition of FLJ20979 (Accession NM_024121). Accordingly, utilities of VGAM1005 include diagnosis, prevention and treatment of diseases and clinical conditions associated with FLJ20979. GABA(A) Receptors Associated Protein Like 3 (GABARAPL3, Accession NM_032568) is another VGAM1005 host target gene. GABARAPL3 BINDING SITE is HOST TARGET binding site found in the 3' untranslated region of mRNA encoded by GABARAPL3, corresponding to a HOST TARGET binding site such as BINDING SITE I, BINDING SITE II or BINDING SITE III. Table 2 illustrates the complementarity of the nucleotide sequences of GABARAPL3 BINDING SITE, designated SEQ ID:26298, to the nucleotide sequence of VGAM1005 RNA, herein designated VGAM RNA, also designated SEQ ID:3716.

Another function of VGAM1005 is therefore inhibition of GABA(A) Receptors Associated Protein Like 3 (GABARAPL3, Accession NM_032568). Accordingly, utilities of VGAM1005 include diagnosis, prevention and treatment of diseases and clinical conditions associated with GABARAPL3. KIAA0668 (Accession XM_039332) is another VGAM1005 host target gene. KIAA0668 BINDING SITE is HOST TARGET binding site found in the 5" untranslated region of mRNA encoded by KIAA0668, corresponding to a HOST TARGET binding site such as BINDING SITE I, BINDING SITE II or BINDING SITE III. Table 2 illustrates the complementarity of the nucleotide sequences of KIAA0668 BINDING SITE, designated SEQ ID:33048, to the nucleotide sequence of VGAM1005 RNA, herein designated VGAM RNA, also designated SEQ ID:3716.

Another function of VGAM1005 is therefore inhibition of KIAA0668 (Accession XM_039332). Accordingly, utilities of VGAM1005 include diagnosis, prevention and treatment of diseases and clinical conditions associated with KIAA0668. KIAA0997 (Accession NM_014950) is another VGAM1005 host target gene. KIAA0997 BINDING SITE is HOST TARGET binding site found in the 5' untranslated region of mRNA encoded by KIAA0997, corresponding to a HOST TARGET binding site such as BINDING SITE I, BINDING SITE II or BINDING SITE III. Table 2 illustrates the complementarity of the nucleotide sequences of KIAA0997 BINDING SITE, designated SEQ ID:17281, to the nucleotide sequence of VGAM1005 RNA, herein designated VGAM RNA, also designated SEQ ID:3716.

Another function of VGAM1005 is therefore inhibition of KIAA0997 (Accession NM_014950). Accordingly, utilities of VGAM1005 include diagnosis, prevention and treatment of diseases and clinical conditions associated with KIAA0997. KIAA1228 (Accession XM_036408) is another VGAM1005 host target gene. KIAA1228 BINDING SITE1 and KIAA1228 BINDING SITE2 are HOST TARGET binding sites found in untranslated regions of mRNA encoded by KIAA1228, corresponding to HOST TARGET binding sites such as BINDING SITE I, BINDING SITE II or BINDING SITE III. Table 2 illustrates the complementarity of the nucleotide sequences of KIAA1228 BINDING SITE1 and KIAA1228 BINDING SITE2, designated SEQ ID:32440 and SEQ ID:32441 respectively, to the nucleotide sequence of VGAM1005 RNA, herein designated VGAM RNA, also designated SEQ ID:3716.

Another function of VGAM1005 is therefore inhibition of KIAA1228 (Accession XM_036408). Accordingly, utilities of VGAM1005 include diagnosis, prevention and treatment of diseases and clinical conditions associated with KIAA1228. PC4 and SFRS1 Interacting Protein 2 (PSIP2, Accession NM_033222) is another VGAM1005 host target gene. PSIP2 BINDING SITE is HOST TARGET binding site found in the 5' untranslated region of mRNA encoded by PSIP2, corresponding to a HOST TARGET binding site such as BINDING SITE I, BINDING SITE II or BINDING SITE III. Table 2 illustrates the complementarity of the nucleotide sequences of PSIP2 BINDING SITE, designated SEQ ID:27067, to the nucleotide sequence of VGAM1005 RNA, herein designated VGAM RNA, also designated SEQ ID:3716.

Another function of VGAM1005 is therefore inhibition of PC4 and SFRS1 Interacting Protein 2 (PSIP2, Accession NM_033222). Accordingly, utilities of VGAM1005 include diagnosis, prevention and treatment of diseases and clinical conditions associated with PSIP2. Prostaglandin E Synthase 2 (PTGES2, Accession NM_025072) is another VGAM1005 host target gene. PTGES2 BINDING SITE is HOST TARGET binding site found in the 5' untranslated region of mRNA encoded by PTGES2, corresponding to a HOST TARGET binding site such as BINDING SITE I, BINDING SITE II or BINDING SITE III. Table 2 illustrates the complementarity of the nucleotide sequences of PTGES2 BINDING SITE, designated SEQ ID:24669, to the nucleotide sequence of VGAM1005 RNA, herein designated VGAM RNA, also designated SEQ ID:3716.

Another function of VGAM1005 is therefore inhibition of Prostaglandin E Synthase 2 (PTGES2, Accession NM_025072). Accordingly, utilities of VGAM1005 include diagnosis, prevention and treatment of diseases and clinical conditions associated with PTGES2. Rab11-FIP3 (Accession NM_014700) is another VGAM1005 host target gene. Rab11-FIP3 BINDING SITE is HOST TARGET binding site found in the 5" untranslated region of mRNA encoded by Rab11-FIP3, corresponding to a HOST TARGET binding site such as BINDING SITE I, BINDING SITE II or BINDING SITE III. Table 2 illustrates the complementarity of the nucleotide sequences of Rab11-FIP3 BINDING SITE, designated SEQ ID:16227, to the nucleotide sequence of VGAM1005 RNA, herein designated VGAM RNA, also designated SEQ ID:3716.

Another function of VGAM1005 is therefore inhibition of Rab11-FIP3 (Accession NM_014700). Accordingly, utilities of VGAM1005 include diagnosis, prevention and treatment of diseases and clinical conditions associated with Rab11-FIP3. RAP2B, Member of RAS Oncogene Family (RAP2B, Accession XM_171061) is another VGAM1005 host target gene. RAP2B BINDING SITE is HOST TARGET binding site found in the 3' untranslated region of mRNA encoded by RAP2B, corresponding to a HOST TARGET binding site such as BINDING SITE I, BINDING SITE II or BINDING SITE III. Table 2 illustrates the complementarity of the nucleotide sequences of RAP2B BINDING SITE, designated SEQ ID:45861, to the nucleotide sequence of VGAM1005 RNA, herein designated VGAM RNA, also designated SEQ ID:3716.

Another function of VGAM1005 is therefore inhibition of RAP2B, Member of RAS Oncogene Family (RAP2B, Accession XM_171061). Accordingly, utilities of VGAM1005 include diagnosis, prevention and treatment of diseases and clinical conditions associated with RAP2B. Rho-related BTB Domain Containing 1 (RHOBTB1, Accession XM_166144) is another VGAM1005 host target gene. RHOBTB1 BINDING SITE is HOST TARGET binding site found in the 5' untranslated region of mRNA encoded by RHOBTB1, corresponding to a HOST TARGET binding site such as BINDING SITE I, BINDING SITE II or BINDING SITE III. Table 2 illustrates the complementarity of the nucleotide sequences of RHOBTB1 BINDING SITE, designated SEQ ID:43951, to the nucleotide sequence of VGAM1005 RNA, herein designated VGAM RNA, also designated SEQ ID:3716.

Another function of VGAM1005 is therefore inhibition of Rho-related BTB Domain Containing 1 (RHOBTB1, Accession XM_166144). Accordingly, utilities of VGAM1005 include diagnosis, prevention and treatment of diseases and clinical conditions associated with RHOBTB1. RNA-binding Region (RNP1, RRM) Containing 1 (RNPC1, Accession NM_017495) is another VGAM1005 host target gene. RNPC1 BINDING SITE is HOST TARGET binding site found in the 5' untranslated region of mRNA encoded by RNPC1, corresponding to a HOST TARGET binding site such as BINDING SITE I, BINDING SITE II or BINDING SITE III. Table 2 illustrates the complementarity of the nucleotide sequences of RNPC1 BINDING SITE, designated SEQ ID:18957, to the nucleotide sequence of VGAM1005 RNA, herein designated VGAM RNA, also designated SEQ ID:3716.

Another function of VGAM1005 is therefore inhibition of RNA-binding Region (RNP1, RRM) Containing 1 (RNPC1, Accession NM_017495). Accordingly, utilities of VGAM1005 include diagnosis, prevention and treatment of diseases and clinical conditions associated with RNPC1. Sema Domain, Immunoglobulin Domain (Ig), Short Basic Domain, Secreted, (semaphorin) 3C (SEMA3C, Accession NM_006379) is another VGAM1005 host target gene. SEMA3C BINDING SITE is HOST TARGET binding site found in the 5' untranslated region of mRNA encoded by SEMA3C, corresponding to a HOST TARGET binding site such as BINDING SITE I, BINDING SITE II or BINDING SITE III. Table 2 illustrates the complementarity of the nucleotide sequences of SEMA3C BINDING SITE, designated SEQ ID:13073, to the nucleotide sequence of VGAM1005 RNA, herein designated VGAM RNA, also designated SEQ ID:3716.

Another function of VGAM1005 is therefore inhibition of Sema Domain, Immunoglobulin Domain (Ig), Short Basic Domain, Secreted, (semaphorin) 3C (SEMA3C, Accession NM_006379). Accordingly, utilities of VGAM1005 include diagnosis, prevention and treatment of diseases and clinical conditions associated with SEMA3C. Williams-Beuren Syndrome Chromosome Region 23 (WBSCR23, Accession NM_025042) is another VGAM1005 host target gene. WBSCR23 BINDING SITE is HOST TARGET binding site found in the 3' untranslated region of mRNA encoded by WBSCR23, corresponding to a HOST TARGET binding site such as BINDING SITE I, BINDING SITE II or BINDING SITE III. Table 2 illustrates the complementarity of the nucleotide sequences of WBSCR23 BINDING SITE, designated SEQ ID:24638, to the nucleotide sequence of VGAM1005 RNA, herein designated VGAM RNA, also designated SEQ ID:3716.

Another function of VGAM1005 is therefore inhibition of Williams-Beuren Syndrome Chromosome Region 23 (WBSCR23, Accession NM_025042). Accordingly, utilities of VGAM1005 include diagnosis, prevention and treatment of diseases and clinical conditions associated with WBSCR23. LOC133308 (Accession XM_059638) is another VGAM1005 host target gene. LOC133308 BINDING SITE is HOST TARGET binding site found in the 5' untranslated region of mRNA encoded by LOC133308, corresponding to a HOST TARGET binding site such as BINDING SITE I, BINDING SITE II or BINDING SITE III. Table 2 illustrates the complementarity of the nucleotide sequences of LOC133308 BINDING SITE, designated SEQ ID:37035, to the nucleotide sequence of VGAM1005 RNA, herein designated VGAM RNA, also designated SEQ ID:3716.

Another function of VGAM1005 is therefore inhibition of LOC133308 (Accession XM_059638). Accordingly, utilities of VGAM1005 include diagnosis, prevention and treatment of diseases and clinical conditions associated with LOC133308. LOC134145 (Accession XM_059691) is another VGAM1005 host target gene. LOC134145 BINDING SITE is HOST TARGET binding site found in the 5' untranslated region of mRNA encoded by LOC134145, corresponding to a HOST TARGET binding site such as BINDING SITE I, BINDING SITE II or BINDING SITE III. Table 2 illustrates the complementarity of the nucleotide sequences of LOC134145 BINDING SITE, designated SEQ ID:37062, to the nucleotide sequence of VGAM1005 RNA, herein designated VGAM RNA, also designated SEQ ID:3716.

Another function of VGAM1005 is therefore inhibition of LOC134145 (Accession XM_059691). Accordingly, utilities of VGAM1005 include diagnosis, prevention and treatment of diseases and clinical conditions associated with LOC134145. LOC143915 (Accession XM_096502) is another VGAM1005 host target gene. LOC143915 BINDING SITE is HOST TARGET binding site found in the 3' untranslated region of mRNA encoded by LOC143915, corresponding to a HOST TARGET binding site such as BINDING SITE I, BINDING SITE II or BINDING SITE III. Table 2 illustrates the complementarity of the nucleotide sequences of LOC143915 BINDING SITE, designated SEQ ID:40377, to the nucleotide sequence of VGAM1005 RNA, herein designated VGAM RNA, also designated SEQ ID:3716.

Another function of VGAM1005 is therefore inhibition of LOC143915 (Accession XM_096502). Accordingly, utilities of VGAM1005 include diagnosis, prevention and treatment of diseases and clinical conditions associated with LOC143915. LOC145481 (Accession XM_085163) is another VGAM1005 host target gene. LOC145481 BINDING SITE is HOST TARGET binding site found in the 5' untranslated region of mRNA encoded by LOC145481, corresponding to a HOST TARGET binding site such as BINDING SITE I, BINDING SITE II or BINDING SITE III. Table 2 illustrates the complementarity of the nucleotide sequences of LOC145481 BINDING SITE, designated SEQ ID:37890, to the nucleotide sequence of VGAM1005 RNA, herein designated VGAM RNA, also designated SEQ ID:3716.

Another function of VGAM1005 is therefore inhibition of LOC145481 (Accession XM_085163). Accordingly, utilities of VGAM1005 include diagnosis, prevention and treatment of diseases and clinical conditions associated with LOC145481. LOC146894 (Accession NM_145273) is another VGAM1005 host target gene. LOC146894 BINDING SITE is HOST TARGET binding site found in the 3' untranslated region of mRNA encoded by LOC146894, corresponding to a HOST TARGET binding site such as BINDING SITE I, BINDING SITE II or BINDING SITE III. Table 2 illustrates the complementarity of the nucleotide sequences of LOC146894 BINDING SITE, designated SEQ ID:29781, to the nucleotide sequence of VGAM1005 RNA, herein designated VGAM RNA, also designated SEQ ID:3716.

Another function of VGAM1005 is therefore inhibition of LOC146894 (Accession NM_145273). Accordingly, utilities of VGAM1005 include diagnosis, prevention and treatment of diseases and clinical conditions associated with LOC146894. LOC148709 (Accession XM_086281) is another VGAM1005 host target gene. LOC148709 BINDING SITE is HOST TARGET binding site found in the 5' untranslated region of mRNA encoded by LOC148709, corresponding to a HOST TARGET binding site such as BINDING SITE I, BINDING SITE II or BINDING SITE III. Table 2 illustrates the complementarity of the nucleotide sequences of LOC148709 BINDING SITE, designated SEQ ID:38583, to the nucleotide sequence of VGAM1005 RNA, herein designated VGAM RNA, also designated SEQ ID:3716.

Another function of VGAM1005 is therefore inhibition of LOC148709 (Accession XM_086281). Accordingly, utilities of VGAM1005 include diagnosis, prevention and treatment of diseases and clinical conditions associated with LOC148709. LOC149297 (Accession XM_097622) is another VGAM1005 host target gene. LOC149297 BINDING SITE is HOST TARGET binding site found in the 5' untranslated region of mRNA encoded by LOC149297, corresponding to a HOST TARGET binding site such as BINDING SITE I, BINDING SITE II or BINDING SITE III. Table 2 illustrates the complementarity of the nucleotide sequences of LOC149297 BINDING SITE, designated SEQ ID:40979, to the nucleotide sequence of VGAM1005 RNA, herein designated VGAM RNA, also designated SEQ ID:3716.

Another function of VGAM1005 is therefore inhibition of LOC149297 (Accession XM_097622). Accordingly, utilities of VGAM1005 include diagnosis, prevention and treatment of diseases and clinical conditions associated with LOC149297. LOC151127 (Accession XM_087104) is another VGAM1005 host target gene. LOC151127 BINDING SITE is HOST TARGET binding site found in the 5' untranslated region of mRNA encoded by LOC151127, corresponding to a HOST TARGET binding site such as BINDING SITE I, BINDING SITE II or BINDING SITE III. Table 2 illustrates the complementarity of the nucleotide sequences of LOC151127 BINDING SITE, designated SEQ ID:39061, to the nucleotide sequence of VGAM1005 RNA, herein designated VGAM RNA, also designated SEQ ID:3716.

Another function of VGAM1005 is therefore inhibition of LOC151127 (Accession XM_087104). Accordingly, utilities of VGAM1005 include diagnosis, prevention and treatment of diseases and clinical conditions associated with LOC151127. LOC153474 (Accession XM_087684) is another VGAM1005 host target gene. LOC153474 BIND- ING SITE is HOST TARGET binding site found in the 5' untranslated region of mRNA encoded by LOC153474, corresponding to a HOST TARGET binding site such as BINDING SITE I, BINDING SITE II or BINDING SITE III. Table 2 illustrates the complementarity of the nucleotide sequences of LOC153474 BINDING SITE, designated SEQ ID:39379, to the nucleotide sequence of VGAM1005 RNA, herein designated VGAM RNA, also designated SEQ ID:3716.

Another function of VGAM1005 is therefore inhibition of LOC153474 (Accession XM_087684). Accordingly, utilities of VGAM1005 include diagnosis, prevention and treatment of diseases and clinical conditions associated with LOC153474. LOC153505 (Accession XM_087693) is another VGAM1005 host target gene. LOC153505 BINDING SITE is HOST TARGET binding site found in the 3' untranslated region of mRNA encoded by LOC153505, corresponding to a HOST TARGET binding site such as BINDING SITE I, BINDING SITE II or BINDING SITE III. Table 2 illustrates the complementarity of the nucleotide sequences of LOC153505 BINDING SITE, designated SEQ ID:39382, to the nucleotide sequence of VGAM1005 RNA, herein designated VGAM RNA, also designated SEQ ID:3716.

Another function of VGAM1005 is therefore inhibition of LOC153505 (Accession XM_087693). Accordingly, utilities of VGAM1005 include diagnosis, prevention and treatment of diseases and clinical conditions associated with LOC153505. LOC164537 (Accession XM_104534) is another VGAM1005 host target gene. LOC164537 BINDING SITE is HOST TARGET binding site found in the 5' untranslated region of mRNA encoded by LOC164537, corresponding to a HOST TARGET binding site such as BINDING SITE I, BINDING SITE II or BINDING SITE III. Table 2 illustrates the complementarity of the nucleotide sequences of LOC164537 BINDING SITE, designated SEQ ID:42172, to the nucleotide sequence of VGAM1005 RNA, herein designated VGAM RNA, also designated SEQ ID:3716.

Another function of VGAM1005 is therefore inhibition of LOC164537 (Accession XM_104534). Accordingly, utilities of VGAM1005 include diagnosis, prevention and treatment of diseases and clinical conditions associated with LOC164537. LOC219513 (Accession XM_169166) is another VGAM1005 host target gene. LOC219513 BINDING SITE is HOST TARGET binding site found in the 3' untranslated region of mRNA encoded by LOC219513, corresponding to a HOST TARGET binding site such as BINDING SITE I, BINDING SITE II or BINDING SITE III. Table 2 illustrates the complementarity of the nucleotide sequences of LOC219513 BINDING SITE, designated SEQ ID:45294, to the nucleotide sequence of VGAM1005 RNA, herein designated VGAM RNA, also designated SEQ ID:3716.

Another function of VGAM1005 is therefore inhibition of LOC219513 (Accession XM_169166). Accordingly, utilities of VGAM1005 include diagnosis, prevention and treatment of diseases and clinical conditions associated with LOC219513. LOC221938 (Accession XM_166542) is another VGAM1005 host target gene. LOC221938 BINDING SITE is HOST TARGET binding site found in the 5' untranslated region of mRNA encoded by LOC221938, corresponding to a HOST TARGET binding site such as BINDING SITE I, BINDING SITE II or BINDING SITE III. Table 2 illustrates the complementarity of the nucleotide sequences of LOC221938 BINDING SITE, designated SEQ ID:44513, to the nucleotide sequence of VGAM1005 RNA, herein designated VGAM RNA, also designated SEQ ID:3716.

Another function of VGAM1005 is therefore inhibition of LOC221938 (Accession XM_166542). Accordingly, utilities of VGAM1005 include diagnosis, prevention and treatment of diseases and clinical conditions associated with LOC221938. LOC255104 (Accession XM_170911) is another VGAM1005 host target gene. LOC255104 BINDING SITE is HOST TARGET binding site found in the 5' untranslated region of mRNA encoded by LOC255104, corresponding to a HOST TARGET binding site such as BINDING SITE I, BINDING SITE II or BINDING SITE III. Table 2 illustrates the complementarity of the nucleotide sequences of LOC255104 BINDING SITE, designated SEQ ID:45684, to the nucleotide sequence of VGAM1005 RNA, herein designated VGAM RNA, also designated SEQ ID:3716.

Another function of VGAM1005 is therefore inhibition of LOC255104 (Accession XM_170911). Accordingly, utilities of VGAM1005 include diagnosis, prevention and treatment of diseases and clinical conditions associated with LOC255104. LOC257541 (Accession XM_175175) is another VGAM1005 host target gene. LOC257541 BINDING SITE is HOST TARGET binding site found in the 5' untranslated region of mRNA encoded by LOC257541, corresponding to a HOST TARGET binding site such as BINDING SITE I, BINDING SITE II or BINDING SITE III. Table 2 illustrates the complementarity of the nucleotide sequences of LOC257541 BINDING SITE, designated SEQ ID:46671, to the nucleotide sequence of VGAM1005 RNA, herein designated VGAM RNA, also designated SEQ ID:3716.

Another function of VGAM1005 is therefore inhibition of LOC257541 (Accession XM_175175). Accordingly, utilities of VGAM1005 include diagnosis, prevention and treatment of diseases and clinical conditions associated with LOC257541. FIG. 1 further provides a conceptual description of a novel bioinformatically detected viral gene of the present invention, referred to here as Viral Genomic Address Messenger 1006 (VGAM1006) viral gene, which modulates expression of respective host target genes thereof, the function and utility of which host target genes is known in the art.

VGAM1006 is a novel bioinformatically detected regulatory, non protein coding, viral micro RNA (miRNA) gene. The method by which VGAM1006 was detected is described hereinabove with reference to FIGS. 1-8.

VGAM1006 gene, herein designated VGAM GENE, is a viral gene contained in the genome of Chimpanzee Cytomegalovirus. VGAM1006 host target gene, herein designated VGAM HOST TARGET GENE, is a human gene contained in the human genome.

VGAM1006 gene encodes a VGAM1006 precursor RNA, herein designated VGAM PRECURSOR RNA. Similar to other miRNA genes, and unlike most ordinary genes, VGAM1006 precursor RNA does not encode a protein. A nucleotide sequence identical or highly similar to the nucleotide sequence of VGAM1006 precursor RNA is designated SEQ ID:992, and is provided hereinbelow with reference to the sequence listing part. Nucleotide sequence SEQ ID:992 is located at position 197086 relative to the genome of Chimpanzee Cytomegalovirus.

VGAM1006 precursor RNA folds onto itself, forming VGAM1006 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1006 folded precursor RNA into VGAM1006 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1006 RNA is designated SEQ ID:3717, and is provided hereinbelow with reference to the sequence listing part.

VGAM1006 host target gene, herein designated VGAM HOST TARGET GENE, encodes a corresponding messenger RNA, VGAM1006 host target RNA, herein designated VGAM HOST TARGET RNA. VGAM1006 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1006 RNA, herein designated VGAM RNA, binds complementarily to one or more host target binding sites located in untranslated regions of VGAM1006 host target RNA, herein designated VGAM HOST TARGET RNA. This complementary binding is due to the fact that the nucleotide sequence of VGAM1006 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1006 RNA, herein designated VGAM RNA, may have a different number of host target binding sites in untranslated regions of a VGAM1006 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1006 RNA, herein designated VGAM RNA, to host target binding sites on VGAM1006 host target RNA, herein designated VGAM HOST TARGET RNA, such as BINDING SITE I, BINDING SITE II and BINDING SITE III, inhibits translation of VGAM1006 host target RNA into VGAM1006 host target protein, herein designated VGAM HOST TARGET PROTEIN. VGAM host target protein is therefore outlined by a broken line.

It is appreciated that VGAM1006 host target gene, herein designated VGAM HOST TARGET GENE, in fact represents a plurality of VGAM1006 host target genes. The mRNA of each one of this plurality of VGAM1006 host target genes comprises one or more host target binding sites, each having a nucleotide sequence which is at least partly complementary to VGAM1006 RNA, herein designated VGAM RNA, and which when bound by VGAM1006 RNA causes inhibition of translation of respective one or more VGAM1006 host target proteins.

It is further appreciated by one skilled in the art that the mode of translational inhibition illustrated by FIG. 1 with specific reference to translational inhibition exerted by VGAM1006 gene, herein designated VGAM GENE, on one or more VGAM1006 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1006 is inhibition of expression of host target genes, as part of a novel viral mechanism of attacking a host. Accordingly, utilities of VGAM1006 include diagnosis, prevention and treatment of viral infection by Chimpanzee Cytomegalovirus. Specific functions, and accordingly utilities, of VGAM1006 correlate with, and may be deduced from, the identity of the host target genes which VGAM1006 binds and inhibits, and the function of these host target genes, as elaborated hereinbelow.

Nucleotide sequences of the VGAM1006 precursor RNA, herein designated VGAM PRECURSOR RNA, and of the 'diced' VGAM1006 RNA, herein designated VGAM RNA, and a schematic representation of the secondary folding of VGAM1006 folded precursor RNA, herein designated VGAM FOLDED PRECURSOR RNA, of VGAM1006 are further described hereinbelow with reference to Table 1.

Nucleotide sequences of host target binding sites, such as BINDING SITE-I, BINDING SITE-II and BINDING SITE-III of FIG. 1, found on VGAM1006 host target RNA, and schematic representation of the complementarity of each of these host target binding sites to VGAM1006 RNA, herein designated VGAM RNA, are described hereinbelow with reference to Table 2.

As mentioned hereinabove with reference to FIG. 1, a function of VGAM1006 gene, herein designated VGAM is inhibition of expression of VGAM1006 target genes. It is appreciated that specific functions, and accordingly utilities, of VGAM1006 correlate with, and may be deduced from, the identity of the target genes which VGAM1006 binds and inhibits, and the function of these target genes, as elaborated hereinbelow.

Acyl-Coenzyme A Dehydrogenase, C-4 to C-12 Straight Chain (ACADM, Accession NM_000016) is a VGAM1006 host target gene. ACADM BINDING SITE is HOST TARGET binding site found in the 5' untranslated region of mRNA encoded by ACADM, corresponding to a HOST TARGET binding site such as BINDING SITE I, BINDING SITE II or BINDING SITE III. Table 2 illustrates the complementarity of the nucleotide sequences of ACADM BINDING SITE, designated SEQ ID:5451, to the nucleotide sequence of VGAM1006 RNA, herein designated VGAM RNA, also designated SEQ ID:3717.

A function of VGAM1006 is therefore inhibition of Acyl-Coenzyme A Dehydrogenase, C-4 to C-12 Straight Chain (ACADM, Accession NM_000016). Accordingly, utilities of VGAM1006 include diagnosis, prevention and treatment of diseases and clinical conditions associated with ACADM. AF5Q31 (Accession NM_014423) is another VGAM1006 host target gene. AF5Q31 BINDING SITE is HOST TARGET binding site found in the 5' untranslated region of mRNA encoded by AF5Q31, corresponding to a HOST TARGET binding site such as BINDING SITE I, BINDING SITE II or BINDING SITE III. Table 2 illustrates the complementarity of the nucleotide sequences of AF5Q31 BINDING SITE, designated SEQ ID:15777, to the nucleotide sequence of VGAM1006 RNA, herein designated VGAM RNA, also designated SEQ ID:3717.

Another function of VGAM1006 is therefore inhibition of AF5Q31 (Accession NM_014423). Accordingly, utilities of VGAM1006 include diagnosis, prevention and treatment of diseases and clinical conditions associated with AF5Q31. Asialoglycoprotein Receptor 2 (ASGR2, Accession NM_080912) is another VGAM1006 host target gene. ASGR2 BINDING SITE is HOST TARGET binding site found in the 5' untranslated region of mRNA encoded by ASGR2, corresponding to a HOST TARGET binding site such as BINDING SITE I, BINDING SITE II or BINDING SITE III. Table 2 illustrates the complementarity of the nucleotide sequences of ASGR2 BINDING SITE, designated SEQ ID:28130, to the nucleotide sequence of VGAM1006 RNA, herein designated VGAM RNA, also designated SEQ ID:3717.

Another function of VGAM1006 is therefore inhibition of Asialoglycoprotein Receptor 2 (ASGR2, Accession NM_080912). Accordingly, utilities of VGAM1006 include diagnosis, prevention and treatment of diseases and clinical conditions associated with ASGR2. BarH-like 1 (Drosophila) (BARHL1, Accession NM_020064) is another VGAM1006 host target gene. BARHL1 BINDING SITE is HOST TARGET binding site found in the 3' untranslated region of mRNA encoded by BARHL1, corresponding to a HOST TARGET binding site such as BINDING SITE I, BINDING SITE II or BINDING SITE III. Table 2 illustrates the complementarity of the nucleotide sequences of BARHL1 BINDING SITE, designated SEQ ID:21300, to the nucleotide sequence of VGAM1006 RNA, herein designated VGAM RNA, also designated SEQ ID:3717.

Another function of VGAM1006 is therefore inhibition of BarH-like 1 (Drosophila) (BARHL1, Accession NM_020064), a gene which controls the expression of neural adhesion molecules. Accordingly, utilities of VGAM1006 include diagnosis, prevention and treatment of diseases and clinical conditions associated with BARHL1. The function of BARHL1 has been established by previous studies. The BarH1 and BarH2 (Bar) Drosophila genes are homeobox-containing genes, which are required for the fate determination of external sensory organs in the fly. Using a bioinformatic approach, Bulfone et al. (2000) identified murine and human homeobox genes highly related to the Bar Drosophila genes, which they designated Barhl1 and Barhl2 (OMIM Ref. No. 605212). Bulfone et al. (2000) screened a human lambda genomic library and identified a clone containing the last 2 exons of the BARHL1 gene. By joining these 2 exons together, they obtained a partial BARHL1 sequence (GenBank AJ237816) containing the homeobox and stop codon. This partial BARHL1 sequence and the corresponding mouse sequence share 99% amino acid identity. The mouse Barhl1 gene is more highly homologous to Drosophila BARH1 than is the murine Barx1 gene (OMIM Ref. No. 603260). In situ hybridization to mouse tissues at several developmental stages revealed that Barhl1 is exclusively expressed in restricted domains of the developing central nervous system, in particular the diencephalon and rhombencephalon, where it is expressed in migrating cells giving rise to the cerebellar external granular layer and to specific populations of dorsal sensory interneurons of the spinal cord. The authors hypothesized that Barhl1 function may be required for the generation of these specific subtypes of neuronal progenitors. Bulfone et al. (2000) stated that the mapping assignment and the expression pattern make BARHL1 a positional candidate gene for a form of Joubert syndrome (OMIM Ref. No. 213300), a rare developmental anomaly of the cerebellum in human S. Blair et al. (2002) appeared to have excluded BARHL1 as the site of the mutation in the form of Joubert syndrome that is linked to 9q34.

Full details of the abovementioned studies are described in the following publications, the disclosure of which are hereby incorporated by reference:

Bulfone, A.; Menguzzato, E.; Broccoli, V.; Marchitiello, A.; Gattuso, C.; Mariani, M.; Consalez, G. G.; Martinez, S.; Ballabio, A.; Banfi, S.: Barhl1, a gene belonging to a new subfamily of mammalian homeobox genes, is expressed in migrating neurons of the CNS. Hum. Molec. Genet. 9:1443-1452, 2000; and Blair, I. P.; Gibson, R. R.; Bennett, C. L.; Chance, P. F.: Search for genes involved in Joubert syndrome: evidence that one or more major loci are yet to be identified and exclusion o.

Further studies establishing the function and utilities of BARHL1 are found in John Hopkins OMIM database record ID 605211, and in sited publications numbered 9538 listed in the bibliography section hereinbelow, which are also hereby incorporated by reference. CGTHBA (Accession NM_012075) is another VGAM1006 host target gene. CGTHBA BINDING SITE is HOST TARGET binding site found in the 5' untranslated region of mRNA encoded by CGTHBA, corresponding to a HOST TARGET binding site such as BINDING SITE I, BINDING SITE II or BINDING SITE III. Table 2 illustrates the complementarity of the nucleotide sequences of CGTHBA BINDING SITE, designated SEQ ID:14362, to the nucleotide sequence of VGAM1006 RNA, herein designated VGAM RNA, also designated SEQ ID:3717.

Another function of VGAM1006 is therefore inhibition of CGTHBA (Accession NM_012075). Accordingly, utilities of VGAM1006 include diagnosis, prevention and treatment of diseases and clinical conditions associated with CGTHBA. Cysteine Knot Superfamily 1, BMP Antagonist 1 (CKTSF1B1, Accession NM_013372) is another VGAM1006 host target gene. CKTSF1B1 BINDING SITE is HOST TARGET binding site found in the 3" untranslated region of mRNA encoded by CKTSF1B1, corresponding to a HOST TARGET binding site such as BINDING SITE I, BINDING SITE II or BINDING SITE III. Table 2 illustrates the complementarity of the nucleotide sequences of CKTSF1B1 BINDING SITE, designated SEQ ID:15021, to the nucleotide sequence of VGAM1006 RNA, herein designated VGAM RNA, also designated SEQ ID:3717.

Another function of VGAM1006 is therefore inhibition of Cysteine Knot Superfamily 1, BMP Antagonist 1 (CKTSF1B1, Accession NM_013372), a gene which blocks signaling of bone morphogenetic protein (BMP) . Accordingly, utilities of VGAM1006 include diagnosis, prevention and treatment of diseases and clinical conditions associated with CKTSF1B1. The function of CKTSF1B1 and its association with various diseases and clinical conditions, has been established by previous studies, as described hereinabove with reference to VGAM28. Espin (ESPN, Accession NM_031475) is another VGAM1006 host target gene. ESPN BINDING SITE is HOST TARGET binding site found in the 3' untranslated region of mRNA encoded by ESPN, corresponding to a HOST TARGET binding site such as BINDING SITE I, BINDING SITE II or BINDING SITE III. Table 2 illustrates the complementarity of the nucleotide sequences of ESPN BINDING SITE, designated SEQ ID:25549, to the nucleotide sequence of VGAM1006 RNA, herein designated VGAM RNA, also designated SEQ ID:3717.

Another function of VGAM1006 is therefore inhibition of Espin (ESPN, Accession NM_031475), a gene which a membrane-cytoskeletal assemblages . Accordingly, utilities of VGAM1006 include diagnosis, prevention and treatment of diseases and clinical conditions associated with ESPN. The function of ESPN has been established by previous studies. Ectoplasmic specializations are membrane-cytoskeletal assemblages found in Sertoli cells at sites of attachment to elongate spermatids or neighboring Sertoli cells. Bartles et al. (1996) identified the rat actin-bundling protein espin, which is localized to ectoplasmic specializations. The 836-amino acid espin protein had a molecular mass of approximately 110 kD in SDS gels. Northern blot analysis detected a 2.9-kb espin transcript only in rat testis; a minor 1.7-kb transcript was detected in small intestine and kidney. Bartles et al. (1998) identified a 30-kD, 253-amino acid isoform of rat espin that localized to brush border microvilli in the intestine and kidney. Espin and small espin share a 167-amino acid C-terminal peptide that includes a 116-amino acid C-terminal actin-bundling module that is necessary and sufficient for actin bundle formation in vitro; however, they contain different N termini. Bartles et al. (1998) and Chen et al. (1999) determined that unlike many actin-bundling proteins, the rat espins bind actin filaments with high affinity, and their actin-bundling activities are not inhibited by calcium. Zheng et al. (2000) determined that espins are present in hair cell stereocilia and uncovered a connection between the espin gene and jerker mouse, a recessive mutation that causes hair cell degeneration, deafness, and vestibular dysfunction. The tissues of jerker mice did not accumulate espin proteins but contained normal levels of espin mRNAs. The authors identified a frameshift mutation in the espin gene of jerker mice that affected the espin C-terminal actin-bundling module. These data suggested that jerker mice are espin null and that the jerker phenotype results from a mutation in the espin gene. Animal model experiments lend further support to the function of ESPN. Zheng et al. (2000) determined that espins are present in hair cell stereocilia and uncovered a connection between the espin gene and jerker mouse, a recessive mutation that causes hair cell degeneration, deafness, and vestibular dysfunction. The tissues of jerker mice did not accumulate espin proteins but contained normal levels of espin mRNAs. The authors identified a frameshift mutation in the espin gene of jerker mice that affected the espin C-terminal actin-bundling module. These data suggested that jerker mice are espin null and that the jerker phenotype results from a mutation in the espin gene.

It is appreciated that the abovementioned animal model for ESPN is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chen, B.; Li, A.; Wang, D.; Wang, M.; Zheng, L.; Bartles, J. R.: Espin contains an additional actin-binding site in its N terminus and is a major actin-bundling protein of the Sertoli cell-spermatid ectoplasmic specialization junctional plaque. Molec. Biol. Cell 10:4327-4339, 1999; and Zheng, L.; Sekerkova, G.; Vranich, K.; Tilney, L. G.; Mugnaini, E.; Bartles, J. R.: The deaf jerker mouse has a mutation in the gene encoding the espin actin-bundling proteins of hair.

Further studies establishing the function and utilities of ESPN are found in John Hopkins OMIM database record ID 606351, and in sited publications numbered 6421-6424 listed in the bibliography section hereinbelow, which are also hereby incorporated by reference. Glypican 1 (GPC1, Accession NM_002081) is another VGAM1006 host target gene. GPC1 BINDING SITE is HOST TARGET binding site found in the 3' untranslated region of mRNA encoded by GPC1, corresponding to a HOST TARGET binding site such as BINDING SITE I, BINDING SITE II or BINDING SITE III. Table 2 illustrates the complementarity of the nucleotide sequences of GPC1 BINDING SITE, designated SEQ ID:7872, to the nucleotide sequence of VGAM1006 RNA, herein designated VGAM RNA, also designated SEQ ID:3717.

Another function of VGAM1006 is therefore inhibition of Glypican 1 (GPC1, Accession NM_002081), a gene which may play a role in growth control and differentation. Accordingly, utilities of VGAM1006 include diagnosis, prevention and treatment of diseases and clinical conditions associated with GPC1. The function of GPC1 and its association with various diseases and clinical conditions, has been established by previous studies, as described hereinabove with reference to VGAM125. HTRA3 (Accession XM_114416) is another VGAM1006 host target gene. HTRA3 BINDING SITE is HOST TARGET binding site found in the 5' untranslated region of mRNA encoded by HTRA3, corresponding to a HOST TARGET binding site such as BINDING SITE I, BINDING SITE II or BINDING SITE III. Table 2 illustrates the complementarity of the nucleotide sequences of HTRA3 BINDING SITE, designated SEQ ID:42941, to the nucleotide sequence of VGAM1006 RNA, herein designated VGAM RNA, also designated SEQ ID:3717.

Another function of VGAM1006 is therefore inhibition of HTRA3 (Accession XM_114416). Accordingly, utilities of VGAM1006 include diagnosis, prevention and treatment of diseases and clinical conditions associated with HTRA3. Insulin-like Growth Factor 2 (somatomedin A) (IGF2, Accession NM_000612) is another VGAM1006 host target gene. IGF2 BINDING SITE is HOST TARGET binding site found in the 5' untranslated region of mRNA encoded by IGF2, corresponding to a HOST TARGET binding site such as BINDING SITE I, BINDING SITE II or BINDING SITE III. Table 2 illustrates the complementarity of the nucleotide sequences of IGF2 BINDING SITE, designated SEQ ID:6215, to the nucleotide sequence of VGAM1006 RNA, herein designated VGAM RNA, also designated SEQ ID:3717.

Another function of VGAM1006 is therefore inhibition of Insulin-like Growth Factor 2 (somatomedin A) (IGF2, Accession NM_000612). Accordingly, utilities of VGAM1006 include diagnosis, prevention and treatment of diseases and clinical conditions associated with IGF2. Kinesin Family Member C3 (KIFC3, Accession NM_005550) is another VGAM1006 host target gene. KIFC3 BINDING SITE is HOST TARGET binding site found in the 5' untranslated region of mRNA encoded by KIFC3, corresponding to a HOST TARGET binding site such as BINDING SITE I, BINDING SITE II or BINDING SITE III. Table 2 illustrates the complementarity of the nucleotide sequences of KIFC3 BINDING SITE, designated SEQ ID:12082, to the nucleotide sequence of VGAM1006 RNA, herein designated VGAM RNA, also designated SEQ ID:3717.

Another function of VGAM1006 is therefore inhibition of Kinesin Family Member C3 (KIFC3, Accession NM_005550), a gene which may function in intracellular transport and mitosis. Accordingly, utilities of VGAM1006 include diagnosis, prevention and treatment of diseases and clinical conditions associated with KIFC3. The function of KIFC3 has been established by previous studies. Kinesins comprise a large superfamily of molecular motors that use the energy of ATP hydrolysis to translocate cargoes along microtubules. Members share extensive homology within a globular domain containing the microtubule- and ATP-binding sites and have a coiled-coil stalk domain that mediates oligomerization. Different kinesin family members participate in specific and diverse motile processes, such as cell division, organelle transport, and nuclear movement. Motile processes are essential to the function, morphogenesis, and maintenance of photoreceptors and the retinal pigment epithelium (RPE). By PCR of human retina cDNA using degenerate oligonucleotides based on highly conserved sequences in the kinesin motor domain, Hoang et al. (1998) isolated cDNAs encoding 4 different kinesin family members, including KIFC3. KIFC3 is highly homologous to mouse Kifc3 and Morone saxatilus (striped bass) FKIF2, which was the most abundant kinesin identified in both the retina and RPE (Bost-Usinger et al., 1997). The predicted 687-amino acid KIFC3 protein contains the highly conserved ATP/GTP-binding site, or P-loop, and kinesin motor domain. In contrast to conventional kinesin and kinesin families that have N-terminal motor domains, the motor domains of human KIFC3, mouse Kifc3, and FKIF2 are predicted to reside at the C-terminal end; such kinesins are termed C-kinesins. An antibody raised against FKIF2 recognized an approximately 80-kD protein in human retina, RPE, kidney, and lung Full details of the abovementioned studies are described in the following publications, the disclosure of which are hereby incorporated by reference:

Bost-Usinger, L.; Chen, R. J.; Hillman, D.; Park, P.; Burnside, B.: Multiple kinesin family members expressed in teleost retina and RPE include a novel C-terminal kinesin. Exp. Eye Res. 64:781-794, 1997; and Hoang, E. H.; Whitehead, J. L.; Dose, A. C.; Burnside, B.: Cloning of a novel C-terminal kinesin (KIFC3) that maps to human chromosome 16q13-q21 and thus is a candidate gene for Bardet.

Further studies establishing the function and utilities of KIFC3 are found in John Hopkins OMIM database record ID 604535, and in sited publications numbered 7462-7463 listed in the bibliography section hereinbelow, which are also hereby incorporated by reference. Notch Homolog 3 (Drosophila) (NOTCH3, Accession NM_000435) is another VGAM1006 host target gene. NOTCH3 BINDING SITE is HOST TARGET binding site found in the 3' untranslated region of mRNA encoded by NOTCH3, corresponding to a HOST TARGET binding site such as BINDING SITE I, BINDING SITE II or BINDING SITE III. Table 2 illustrates the complementarity of the nucleotide sequences of NOTCH3 BINDING SITE, designated SEQ ID:6016, to the nucleotide sequence of VGAM1006 RNA, herein designated VGAM RNA, also designated SEQ ID:3717.

Another function of VGAM1006 is therefore inhibition of Notch Homolog 3 (Drosophila) (NOTCH3, Accession NM_000435), a gene which may function in cell fate specification during development. Accordingly, utilities of VGAM1006 include diagnosis, prevention and treatment of diseases and clinical conditions associated with NOTCH3. The function of NOTCH3 and its association with various diseases and clinical conditions, has been established by previous studies, as described hereinabove with reference to VGAM128. PACE (Accession NM_002569) is another VGAM1006 host target gene. PACE BINDING SITE is HOST TARGET binding site found in the 3' untranslated region of mRNA encoded by PACE, corresponding to a HOST TARGET binding site such as BINDING SITE I, BINDING SITE II or BINDING SITE III. Table 2 illustrates the complementarity of the nucleotide sequences of PACE BINDING SITE, designated SEQ ID:8426, to the nucleotide sequence of VGAM1006 RNA, herein designated VGAM RNA, also designated SEQ ID:3717.

Another function of VGAM1006 is therefore inhibition of PACE (Accession NM_002569), a gene which processes pro-parathyroid hormone, pro-transforming growth factor beta. Accordingly, utilities of VGAM1006 include diagnosis, prevention and treatment of diseases and clinical conditions associated with PACE. The function of PACE and its association with various diseases and clinical conditions, has been established by previous studies, as described hereinabove with reference to VGAM151. Protein Kinase C and Casein Kinase Substrate In Neurons 1 (PACSIN1, Accession XM_166424) is another VGAM1006 host target gene. PACSIN1 BINDING SITE is HOST TARGET binding site found in the 3' untranslated region of mRNA encoded by PACSIN1, corresponding to a HOST TARGET binding site such as BINDING SITE I, BINDING SITE II or BINDING SITE III. Table 2 illustrates the complementarity of the nucleotide sequences of PACSIN1 BINDING SITE, designated SEQ ID:44310, to the nucleotide sequence of VGAM1006 RNA, herein designated VGAM RNA, also designated SEQ ID:3717.

Another function of VGAM1006 is therefore inhibition of Protein Kinase C and Casein Kinase Substrate In Neurons 1 (PACSIN1, Accession XM_166424). Accordingly, utilities of VGAM1006 include diagnosis, prevention and treatment of diseases and clinical conditions associated with PACSIN1. Retinoic Acid Receptor, Alpha (RARA, Accession NM_000964) is another VGAM1006 host target gene. RARA BINDING SITE is HOST TARGET binding site found in the 3' untranslated region of mRNA encoded by RARA, corresponding to a HOST TARGET binding site such as BINDING SITE I, BINDING SITE II or BINDING SITE III. Table 2 illustrates the complementarity of the nucleotide sequences of RARA BINDING SITE, designated SEQ ID:6688, to the nucleotide sequence of VGAM1006 RNA, herein designated VGAM RNA, also designated SEQ ID:3717.

Another function of VGAM1006 is therefore inhibition of Retinoic Acid Receptor, Alpha (RARA, Accession NM_000964). Accordingly, utilities of VGAM1006 include diagnosis, prevention and treatment of diseases and clinical conditions associated with RARA. RNA (guanine-7-) Methyltransferase (RNMT, Accession NM_003799) is another VGAM1006 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9885, to the nucleotide sequence of VGAM1006 RNA, herein designated VGAM RNA, also designated SEQ ID:3717.

Another function of VGAM1006 is therefore inhibition of RNA (guanine-7-) Methyltransferase (RNMT, Accession NM_003799), a gene which catalyzes the methylation of GpppN- at the guanine N7 position. Accordingly, utilities of VGAM1006 include diagnosis, prevention and treatment of diseases and clinical conditions associated with RNMT. The function of RNMT and its association with various diseases and clinical conditions, has been established by previous studies, as described hereinabove with reference to VGAM178. Receptor Tyrosine Kinase-like Orphan Receptor 2 (ROR2, Accession NM_004560) is another VGAM1006 host target gene. ROR2 BINDING SITE is HOST TARGET binding site found in the 5' untranslated region of mRNA encoded by ROR2, corresponding to a HOST TARGET binding site such as BINDING SITE I, BINDING SITE II or BINDING SITE III. Table 2 illustrates the complementarity of the nucleotide sequences of ROR2 BINDING SITE, designated SEQ ID:10898, to the nucleotide sequence of VGAM1006 RNA, herein designated VGAM RNA, also designated SEQ ID:3717.

Another function of VGAM1006 is therefore inhibition of Receptor Tyrosine Kinase-like Orphan Receptor 2 (ROR2, Accession NM_004560), a gene which may be involved in the early formayion of the chonrocytes. Accordingly, utilities of VGAM1006 include diagnosis, prevention and treatment of diseases and clinical conditions associated with ROR2. The function of ROR2 and its association with various diseases and clinical conditions, has been established by previous studies, as described hereinabove with reference to VGAM232. Cat Eye Syndrome Chromosome Region, Candidate 2 (CECR2, Accession NM_031413) is another VGAM1006 host target gene. CECR2 BINDING SITE is HOST TARGET binding site found in the 5' untranslated region of mRNA encoded by CECR2, corresponding to a HOST TARGET binding site such as BINDING SITE I, BINDING SITE II or BINDING SITE III. Table 2 illustrates the complementarity of the nucleotide sequences of CECR2 BINDING SITE, designated SEQ ID:25393, to the nucleotide sequence of VGAM1006 RNA, herein designated VGAM RNA, also designated SEQ ID:3717.

Another function of VGAM1006 is therefore inhibition of Cat Eye Syndrome Chromosome Region, Candidate 2 (CECR2, Accession NM_031413). Accordingly, utilities of VGAM1006 include diagnosis, prevention and treatment of diseases and clinical conditions associated with CECR2. CEP3 (Accession NM_006449) is another VGAM1006 host target gene. CEP3 BINDING SITE is HOST TARGET binding site found in the 5' untranslated region of mRNA encoded by CEP3, corresponding to a HOST TARGET binding site such as BINDING SITE I, BINDING SITE II or BINDING SITE III. Table 2 illustrates the complementarity of the nucleotide sequences of CEP3 BINDING SITE, designated SEQ ID:13158, to the nucleotide sequence of VGAM1006 RNA, herein designated VGAM RNA, also designated SEQ ID:3717.

Another function of VGAM1006 is therefore inhibition of CEP3 (Accession NM_006449). Accordingly, utilities of VGAM1006 include diagnosis, prevention and treatment of diseases and clinical conditions associated with CEP3. DKFZP434H132 (Accession XM_057020) is another VGAM1006 host target gene. DKFZP434H132 BINDING SITE is HOST TARGET binding site found in the 5' untranslated region of mRNA encoded by DKFZP434H132, corresponding to a HOST TARGET binding site such as BINDING SITE I, BINDING SITE II or BINDING SITE III. Table 2 illustrates the complementarity of the nucleotide sequences of DKFZP434H132 BINDING SITE, designated SEQ ID:36449, to the nucleotide sequence of VGAM1006 RNA, herein designated VGAM RNA, also designated SEQ ID:3717.

Another function of VGAM1006 is therefore inhibition of DKFZP434H132 (Accession XM_057020). Accordingly, utilities of VGAM1006 include diagnosis, prevention and treatment of diseases and clinical conditions associated with DKFZP434H132. DKFZp547M072 (Accession XM_028067) is another VGAM1006 host target gene. DKFZp547M072 BINDING SITE is HOST TARGET binding site found in the 3' untranslated region of mRNA encoded by DKFZp547M072, corresponding to a HOST TARGET binding site such as BINDING SITE I, BINDING SITE II or BINDING SITE III. Table 2 illustrates the complementarity of the nucleotide sequences of DKFZp547M072 BINDING SITE, designated SEQ ID:30616, to the nucleotide sequence of VGAM1006 RNA, herein designated VGAM RNA, also designated SEQ ID:3717.

Another function of VGAM1006 is therefore inhibition of DKFZp547M072 (Accession XM_028067). Accordingly, utilities of VGAM1006 include diagnosis, prevention and treatment of diseases and clinical conditions associated with DKFZp547M072. DKFZp586I021 (Accession NM_032271) is another VGAM1006 host target gene. DKFZp586I021 BINDING SITE is HOST TARGET binding site found in the 5' untranslated region of mRNA encoded by DKFZp586I021, corresponding to a HOST TARGET binding site such as BINDING SITE I, BINDING SITE II or BINDING SITE III. Table 2 illustrates the complementarity of the nucleotide sequences of DKFZp586I021 BINDING SITE, designated SEQ ID:26026, to the nucleotide sequence of VGAM1006 RNA, herein designated VGAM RNA, also designated SEQ ID:3717.

Another function of VGAM1006 is therefore inhibition of DKFZp586I021 (Accession NM_032271). Accordingly, utilities of VGAM1006 include diagnosis, prevention and treatment of diseases and clinical conditions associated with DKFZp586I021. FLJ10743 (Accession NM_018201) is another VGAM1006 host target gene. FLJ10743 BINDING SITE is HOST TARGET binding site found in the 3' untranslated region of mRNA encoded by FLJ10743, corresponding to a HOST TARGET binding site such as BINDING SITE I, BINDING SITE II or BINDING SITE III. Table 2 illustrates the complementarity of the nucleotide sequences of FLJ10743 BINDING SITE, designated SEQ ID:20079, to the nucleotide sequence of VGAM1006 RNA, herein designated VGAM RNA, also designated SEQ ID:3717.

Another function of VGAM1006 is therefore inhibition of FLJ10743 (Accession NM_018201). Accordingly, utilities of VGAM1006 include diagnosis, prevention and treatment of diseases and clinical conditions associated with FLJ10743. FLJ14810 (Accession NM_032843) is another VGAM1006 host target gene. FLJ14810 BINDING SITE is HOST TARGET binding site found in the 5' untranslated region of mRNA encoded by FLJ14810, corresponding to a HOST TARGET binding site such as BINDING SITE I, BINDING SITE II or BINDING SITE III. Table 2 illustrates the complementarity of the nucleotide sequences of FLJ14810 BINDING SITE, designated SEQ ID:26635, to the nucleotide sequence of VGAM1006 RNA, herein designated VGAM RNA, also designated SEQ ID:3717.

Another function of VGAM1006 is therefore inhibition of FLJ14810 (Accession NM_032843). Accordingly, utilities of VGAM1006 include diagnosis, prevention and treatment of diseases and clinical conditions associated with FLJ14810. FLJ21438 (Accession XM_029084) is another VGAM1006 host target gene. FLJ21438 BINDING SITE is HOST TARGET binding site found in the 5' untranslated region of mRNA encoded by FLJ21438, corresponding to a HOST TARGET binding site such as BINDING SITE I, BINDING SITE II or BINDING SITE III. Table 2 illustrates the complementarity of the nucleotide sequences of FLJ21438 BINDING SITE, designated SEQ ID:30848, to the nucleotide sequence of VGAM1006 RNA, herein designated VGAM RNA, also designated SEQ ID:3717.

Another function of VGAM1006 is therefore inhibition of FLJ21438 (Accession XM_029084). Accordingly, utilities of VGAM1006 include diagnosis, prevention and treatment of diseases and clinical conditions associated with FLJ21438. FLJ22215 (Accession NM_022834) is another VGAM1006 host target gene. FLJ22215 BINDING SITE is HOST TARGET binding site found in the 3' untranslated region of mRNA encoded by FLJ22215, corresponding to a HOST TARGET binding site such as BINDING SITE I, BINDING SITE II or BINDING SITE III. Table 2 illustrates the complementarity of the nucleotide sequences of FLJ22215 BINDING SITE, designated SEQ ID:23117, to the nucleotide sequence of VGAM1006 RNA, herein designated VGAM RNA, also designated SEQ ID:3717.

Another function of VGAM1006 is therefore inhibition of FLJ22215 (Accession NM_022834). Accordingly, utilities of VGAM1006 include diagnosis, prevention and treatment of diseases and clinical conditions associated with FLJ22215. KIAA0258 (Accession NM_014785) is another VGAM1006 host target gene. KIAA0258 BINDING SITE is HOST TARGET binding site found in the 3' untranslated region of mRNA encoded by KIAA0258, corresponding to a HOST TARGET binding site such as BINDING SITE I, BINDING SITE II or BINDING SITE III. Table 2 illustrates the complementarity of the nucleotide sequences of KIAA0258 BINDING SITE, designated SEQ ID:16647, to the nucleotide sequence of VGAM1006 RNA, herein designated VGAM RNA, also designated SEQ ID:3717.

Another function of VGAM1006 is therefore inhibition of KIAA0258 (Accession NM_014785). Accordingly, utilities of VGAM1006 include diagnosis, prevention and treatment of diseases and clinical conditions associated with KIAA0258. KIAA0552 (Accession NM_014731) is another VGAM1006 host target gene. KIAA0552 BINDING SITE is HOST TARGET binding site found in the 5' untranslated region of mRNA encoded by KIAA0552, corresponding to a HOST TARGET binding site such as BINDING SITE I, BINDING SITE II or BINDING SITE III. Table 2 illustrates the complementarity of the nucleotide sequences of KIAA0552 BINDING SITE, designated SEQ ID:16348, to the nucleotide sequence of VGAM1006 RNA, herein designated VGAM RNA, also designated SEQ ID:3717.

Another function of VGAM1006 is therefore inhibition of KIAA0552 (Accession NM_014731). Accordingly, utilities of VGAM1006 include diagnosis, prevention and treatment of diseases and clinical conditions associated with KIAA0552. KIAA0618 (Accession NM_014833) is another VGAM1006 host target gene. KIAA0618 BINDING SITE is HOST TARGET binding site found in the 5' untranslated region of mRNA encoded by KIAA0618, corresponding to a HOST TARGET binding site such as BINDING SITE I, BINDING SITE II or BINDING SITE III. Table 2 illustrates the complementarity of the nucleotide sequences of KIAA0618 BINDING SITE, designated SEQ ID:16834, to the nucleotide sequence of VGAM1006 RNA, herein designated VGAM RNA, also designated SEQ ID:3717.

Another function of VGAM1006 is therefore inhibition of KIAA0618 (Accession NM_014833). Accordingly, utilities of VGAM1006 include diagnosis, prevention and treatment of diseases and clinical conditions associated with KIAA0618. KIAA1530 (Accession XM_042661) is another VGAM1006 host target gene. KIAA1530 BINDING SITE is HOST TARGET binding site found in the 5' untranslated region of mRNA encoded by KIAA1530, corresponding to a HOST TARGET binding site such as BINDING SITE I, BINDING SITE II or BINDING SITE III. Table 2 illustrates the complementarity of the nucleotide sequences of KIAA1530 BINDING SITE, designated SEQ ID:33734, to the nucleotide sequence of VGAM1006 RNA, herein designated VGAM RNA, also designated SEQ ID:3717.

Another function of VGAM1006 is therefore inhibition of KIAA1530 (Accession XM_042661). Accordingly, utilities of VGAM1006 include diagnosis, prevention and treatment of diseases and clinical conditions associated with KIAA1530. MCLC (Accession NM_015127) is another VGAM1006 host target gene. MCLC BINDING SITE is HOST TARGET binding site found in the 3' untranslated region of mRNA encoded by MCLC, corresponding to a HOST TARGET binding site such as BINDING SITE I, BINDING SITE II or BINDING SITE III. Table 2 illustrates the complementarity of the nucleotide sequences of MCLC BINDING SITE, designated SEQ ID:17492, to the nucleotide sequence of VGAM1006 RNA, herein designated VGAM RNA, also designated SEQ ID:3717.

Another function of VGAM1006 is therefore inhibition of MCLC (Accession NM_015127). Accordingly, utilities of VGAM1006 include diagnosis, prevention and treatment of diseases and clinical conditions associated with MCLC. QKI (Accession XM_037438) is another VGAM1006 host target gene. QKI BINDING SITE is HOST TARGET binding site found in the 5' untranslated region of mRNA encoded by QKI, corresponding to a HOST TARGET binding site such as BINDING SITE I, BINDING SITE II or BINDING SITE III. Table 2 illustrates the complementarity of the nucleotide sequences of QKI BINDING SITE, designated SEQ ID:32617, to the nucleotide sequence of VGAM1006 RNA, herein designated VGAM RNA, also designated SEQ ID:3717.

Another function of VGAM1006 is therefore inhibition of QKI (Accession XM_037438). Accordingly, utilities of VGAM1006 include diagnosis, prevention and treatment of diseases and clinical conditions associated with QKI. RBAK (Accession NM_021163) is another VGAM1006 host target gene. RBAK BINDING SITE is HOST TARGET binding site found in the 5' untranslated region of mRNA encoded by RBAK, corresponding to a HOST TARGET binding site such as BINDING SITE I, BINDING SITE II or BINDING SITE III. Table 2 illustrates the complementarity of the nucleotide sequences of RBAK BINDING SITE, designated SEQ ID:22141, to the nucleotide sequence of VGAM1006 RNA, herein designated VGAM RNA, also designated SEQ ID:3717.

Another function of VGAM1006 is therefore inhibition of RBAK (Accession NM_021163). Accordingly, utilities of VGAM1006 include diagnosis, prevention and treatment of diseases and clinical conditions associated with RBAK. LOC116113 (Accession XM_166413) is another VGAM1006 host target gene. LOC116113 BINDING SITE is HOST TARGET binding site found in the 3' untranslated region of mRNA encoded by LOC116113, corresponding to a HOST TARGET binding site such as BINDING SITE I, BINDING SITE II or BINDING SITE III. Table 2 illustrates the complementarity of the nucleotide sequences of LOC116113 BINDING SITE, designated SEQ ID:44287, to the nucleotide sequence of VGAM1006 RNA, herein designated VGAM RNA, also designated SEQ ID:3717.

Another function of VGAM1006 is therefore inhibition of LOC116113 (Accession XM_166413). Accordingly, utilities of VGAM1006 include diagnosis, prevention and treatment of diseases and clinical conditions associated with LOC116113. LOC145547 (Accession XM_085167) is another VGAM1006 host target gene. LOC145547 BINDING SITE is HOST TARGET binding site found in the 3' untranslated region of mRNA encoded by LOC145547, corresponding to a HOST TARGET binding site such as BINDING SITE I, BINDING SITE II or BINDING SITE III. Table 2 illustrates the complementarity of the nucleotide sequences of LOC145547 BINDING SITE, designated SEQ ID:37893, to the nucleotide sequence of VGAM1006 RNA, herein designated VGAM RNA, also designated SEQ ID:3717.

Another function of VGAM1006 is therefore inhibition of LOC145547 (Accession XM_085167). Accordingly, utilities of VGAM1006 include diagnosis, prevention and treatment of diseases and clinical conditions associated with LOC145547. LOC221424 (Accession XM_168060) is another VGAM1006 host target gene. LOC221424 BINDING SITE is HOST TARGET binding site found in the 5' untranslated region of mRNA encoded by LOC221424, corresponding to a HOST TARGET binding site such as BINDING SITE I, BINDING SITE II or BINDING SITE III. Table 2 illustrates the complementarity of the nucleotide sequences of LOC221424 BINDING SITE, designated SEQ ID:44979, to the nucleotide sequence of VGAM1006 RNA, herein designated VGAM RNA, also designated SEQ ID:3717.

Another function of VGAM1006 is therefore inhibition of LOC221424 (Accession XM_168060). Accordingly, utilities of VGAM1006 include diagnosis, prevention and treatment of diseases and clinical conditions associated with LOC221424. LOC221486 (Accession XM_165760) is another VGAM1006 host target gene. LOC221486 BINDING SITE is HOST TARGET binding site found in the 3' untranslated region of mRNA encoded by LOC221486, corresponding to a HOST TARGET binding site such as BINDING SITE I, BINDING SITE II or BINDING SITE III. Table 2 illustrates the complementarity of the nucleotide sequences of LOC221486 BINDING SITE, designated SEQ ID:43743, to the nucleotide sequence of VGAM1006 RNA, herein designated VGAM RNA, also designated SEQ ID:3717.

Another function of VGAM1006 is therefore inhibition of LOC221486 (Accession XM_165760). Accordingly, utilities of VGAM1006 include diagnosis, prevention and treatment of diseases and clinical conditions associated with LOC221486. FIG. 1 further provides a conceptual description of a novel bioinformatically detected viral gene of the present invention, referred to here as Viral Genomic Address Messenger 1007 (VGAM1007) viral gene, which modulates expression of respective host target genes thereof, the function and utility of which host target genes is known in the art.

VGAM1007 is a novel bioinformatically detected regulatory, non protein coding, viral micro RNA (miRNA) gene. The method by which VGAM1007 was detected is described hereinabove with reference to FIGS. 1-8.

VGAM1007 gene, herein designated VGAM GENE, is a viral gene contained in the genome of Chimpanzee Cytomegalovirus. VGAM1007 host target gene, herein designated VGAM HOST TARGET GENE, is a human gene contained in the human genome.

VGAM1007 gene encodes a VGAM1007 precursor RNA, herein designated VGAM PRECURSOR RNA. Similar to other miRNA genes, and unlike most ordinary genes, VGAM1007 precursor RNA does not encode a protein. A nucleotide sequence identical or highly similar to the nucleotide sequence of VGAM1007 precursor RNA is designated SEQ ID:993, and is provided hereinbelow with reference to the sequence listing part. Nucleotide sequence SEQ ID:993 is located at position 200001 relative to the genome of Chimpanzee Cytomegalovirus.

VGAM1007 precursor RNA folds onto itself, forming VGAM1007 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1007 folded precursor RNA into VGAM1007 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1007 RNA is designated SEQ ID:3718, and is provided hereinbelow with reference to the sequence listing part.

VGAM1007 host target gene, herein designated VGAM HOST TARGET GENE, encodes a corresponding messenger RNA, VGAM1007 host target RNA, herein designated VGAM HOST TARGET RNA. VGAM1007 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1007 RNA, herein designated VGAM RNA, binds complementarily to one or more host target binding sites located in untranslated regions of VGAM1007 host target RNA, herein designated VGAM HOST TARGET RNA. This complementary binding is due to the fact that the nucleotide sequence of VGAM1007 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1007 RNA, herein designated VGAM RNA, may have a different number of host target binding sites in untranslated regions of a VGAM1007 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1007 RNA, herein designated VGAM RNA, to host target binding sites on VGAM1007 host target RNA, herein designated VGAM HOST TARGET RNA, such as BINDING SITE I, BINDING SITE II and BINDING SITE III, inhibits translation of VGAM1007 host target RNA into VGAM1007 host target protein, herein designated VGAM HOST TARGET PROTEIN. VGAM host target protein is therefore outlined by a broken line.

It is appreciated that VGAM1007 host target gene, herein designated VGAM HOST TARGET GENE, in fact represents a plurality of VGAM1007 host target genes. The mRNA of each one of this plurality of VGAM1007 host target genes comprises one or more host target binding sites, each having a nucleotide sequence which is at least partly complementary to VGAM1007 RNA, herein designated VGAM RNA, and which when bound by VGAM1007 RNA causes inhibition of translation of respective one or more VGAM1007 host target proteins.

It is further appreciated by one skilled in the art that the mode of translational inhibition illustrated by FIG. 1 with specific reference to translational inhibition exerted by VGAM1007 gene, herein designated VGAM GENE, on one or more VGAM1007 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1007 is inhibition of expression of host target genes, as part of a novel viral mechanism of attacking a host. Accordingly, utilities of VGAM1007 include diagnosis, prevention and treatment of viral infection by Chimpanzee Cytomegalovirus. Specific functions, and accordingly utilities, of VGAM1007 correlate with, and may be deduced from, the identity of the host target genes which VGAM1007 binds and inhibits, and the function of these host target genes, as elaborated hereinbelow.

Nucleotide sequences of the VGAM1007 precursor RNA, herein designated VGAM PRECURSOR RNA, and of the 'diced' VGAM1007 RNA, herein designated VGAM RNA, and a schematic representation of the secondary folding of VGAM1007 folded precursor RNA, herein designated VGAM FOLDED PRECURSOR RNA, of VGAM1007 are further described hereinbelow with reference to Table 1.

Nucleotide sequences of host target binding sites, such as BINDING SITE-I, BINDING SITE-II and BINDING SITE-III of FIG. 1, found on VGAM1007 host target RNA, and schematic representation of the complementarity of each of these host target binding sites to VGAM1007 RNA, herein designated VGAM RNA, are described hereinbelow with reference to Table 2.

As mentioned hereinabove with reference to FIG. 1, a function of VGAM1007 gene, herein designated VGAM is inhibition of expression of VGAM1007 target genes. It is appreciated that specific functions, and accordingly utilities, of VGAM1007 correlate with, and may be deduced from, the identity of the target genes which VGAM1007 binds and inhibits, and the function of these target genes, as elaborated hereinbelow.

E1A Binding Protein P300 (EP300, Accession NM_001429) is a VGAM1007 host target gene. EP300 BINDING SITE is HOST TARGET binding site found in the 5' untranslated region of mRNA encoded by EP300, corresponding to a HOST TARGET binding site such as BINDING SITE I, BINDING SITE II or BINDING SITE III. Table 2 illustrates the complementarity of the nucleotide sequences of EP300 BINDING SITE, designated SEQ ID:7150, to the nucleotide sequence of VGAM1007 RNA, herein designated VGAM RNA, also designated SEQ ID:3718.

A function of VGAM1007 is therefore inhibition of E1A Binding Protein P300 (EP300, Accession NM_001429), a gene which may have a function in cell cycle regulation. Accordingly, utilities of VGAM1007 include diagnosis, prevention and treatment of diseases and clinical conditions associated with EP300. The function of EP300 and its association with various diseases and clinical conditions, has been established by previous studies, as described hereinabove with reference to VGAM191. GRB2-associated Binding Protein 2 (GAB2, Accession NM_012296) is another VGAM1007 host target gene. GAB2 BINDING SITE1 and GAB2 BINDING SITE2 are HOST TARGET binding sites found in untranslated regions of mRNA encoded by GAB2, corresponding to HOST TARGET binding sites such as BINDING SITE I, BINDING SITE II or BINDING SITE III. Table 2 illustrates the complementarity of the nucleotide sequences of GAB2 BINDING SITE1 and GAB2 BINDING SITE2, designated SEQ ID:14653 and SEQ ID:27848 respectively, to the nucleotide sequence of VGAM1007 RNA, herein designated VGAM RNA, also designated SEQ ID:3718.

Another function of VGAM1007 is therefore inhibition of GRB2-associated Binding Protein 2 (GAB2, Accession NM_012296), a gene which act as adapters for transmitting various signals. Accordingly, utilities of VGAM1007 include diagnosis, prevention and treatment of diseases and clinical conditions associated with GAB2. The function of GAB2 and its association with various diseases and clinical conditions, has been established by previous studies, as described hereinabove with reference to VGAM53. Transducin (beta)-like 2 (TBL2, Accession NM_032988) is another VGAM1007 host target gene. TBL2 BINDING SITE is HOST TARGET binding site found in the 3' untranslated region of mRNA encoded by TBL2, corresponding to a HOST TARGET binding site such as BINDING SITE I, BINDING SITE II or BINDING SITE III. Table 2 illustrates the complementarity of the nucleotide sequences of TBL2 BINDING SITE, designated SEQ ID:26869, to the nucleotide sequence of VGAM1007 RNA, herein designated VGAM RNA, also designated SEQ ID:3718.

Another function of VGAM1007 is therefore inhibition of Transducin (beta)-like 2 (TBL2, Accession NM_032988), a gene which is of unknown function. Accordingly, utilities of VGAM1007 include diagnosis, prevention and treatment of diseases and clinical conditions associated with TBL2. The function of TBL2 and its association with various diseases and clinical conditions, has been established by previous studies, as described hereinabove with reference to VGAM229. Calneuron 1 (CALN1, Accession NM_031468) is another VGAM1007 host target gene. CALN1 BINDING SITE is HOST TARGET binding site found in the 3' untranslated region of mRNA encoded by CALN1, corresponding to a HOST TARGET binding site such as BINDING SITE I, BINDING SITE II or BINDING SITE III. Table 2 illustrates the complementarity of the nucleotide sequences of CALN1 BINDING SITE, designated SEQ ID:25516, to the nucleotide sequence of VGAM1007 RNA, herein designated VGAM RNA, also designated SEQ ID:3718.

Another function of VGAM1007 is therefore inhibition of Calneuron 1 (CALN1, Accession NM_031468). Accordingly, utilities of VGAM1007 include diagnosis, prevention and treatment of diseases and clinical conditions associated with CALN1. CDC14 Cell Division Cycle 14 Homolog B (S. cerevisiae) (CDC14B, Accession NM_033332) is another VGAM1007 host target gene. CDC14B BINDING SITE is HOST TARGET binding site found in the 3' untranslated region of mRNA encoded by CDC14B, corresponding to a HOST TARGET binding site such as BINDING SITE I, BINDING SITE II or BINDING SITE III. Table 2 illustrates the complementarity of the nucleotide sequences of CDC14B BINDING SITE, designated SEQ ID:27168, to the nucleotide sequence of VGAM1007 RNA, herein designated VGAM RNA, also designated SEQ ID:3718.

Another function of VGAM1007 is therefore inhibition of CDC14 Cell Division Cycle 14 Homolog B (S. cerevisiae) (CDC14B, Accession NM_033332). Accordingly, utilities of VGAM1007 include diagnosis, prevention and treatment of diseases and clinical conditions associated with CDC14B. DGS-A (Accession XM_097827) is another VGAM1007 host target gene. DGS-A BINDING SITE is HOST TARGET binding site found in the 3' untranslated region of mRNA encoded by DGS-A, corresponding to a HOST TARGET binding site such as BINDING SITE I, BINDING SITE II or BINDING SITE III. Table 2 illustrates the complementarity of the nucleotide sequences of DGS-A BINDING SITE, designated SEQ ID:41149, to the nucleotide sequence of VGAM1007 RNA, herein designated VGAM RNA, also designated SEQ ID:3718.

Another function of VGAM1007 is therefore inhibition of DGS-A (Accession XM_097827). Accordingly, utilities of VGAM1007 include diagnosis, prevention and treatment of diseases and clinical conditions associated with DGS-A.

DKFZP761E2110 (Accession NM_030953) is another VGAM1007 host target gene. DKFZP761E2110 BINDING SITE is HOST TARGET binding site found in the 5' untranslated region of mRNA encoded by DKFZP761E2110, corresponding to a HOST TARGET binding site such as BINDING SITE I, BINDING SITE II or BINDING SITE III. Table 2 illustrates the complementarity of the nucleotide sequences of DKFZP761E2110 BINDING SITE, designated SEQ ID:25226, to the nucleotide sequence of VGAM1007 RNA, herein designated VGAM RNA, also designated SEQ ID:3718.

Another function of VGAM1007 is therefore inhibition of DKFZP761E2110 (Accession NM_030953). Accordingly, utilities of VGAM1007 include diagnosis, prevention and treatment of diseases and clinical conditions associated with DKFZP761E2110. HCCA2 (Accession XM_039894) is another VGAM1007 host target gene. HCCA2 BINDING SITE is HOST TARGET binding site found in the 5' untranslated region of mRNA encoded by HCCA2, corresponding to a HOST TARGET binding site such as BINDING SITE I, BINDING SITE II or BINDING SITE III. Table 2 illustrates the complementarity of the nucleotide sequences of HCCA2 BINDING SITE, designated SEQ ID:33205, to the nucleotide sequence of VGAM1007 RNA, herein designated VGAM RNA, also designated SEQ ID:3718.

Another function of VGAM1007 is therefore inhibition of HCCA2 (Accession XM_039894). Accordingly, utilities of VGAM1007 include diagnosis, prevention and treatment of diseases and clinical conditions associated with HCCA2. KIAA0449 (Accession NM_017596) is another VGAM1007 host target gene. KIAA0449 BINDING SITE is HOST TARGET binding site found in the 5' untranslated region of mRNA encoded by KIAA0449, corresponding to a HOST TARGET binding site such as BINDING SITE I, BINDING SITE II or BINDING SITE III. Table 2 illustrates the complementarity of the nucleotide sequences of KIAA0449 BINDING SITE, designated SEQ ID:19053, to the nucleotide sequence of VGAM1007 RNA, herein designated VGAM RNA, also designated SEQ ID:3718.

Another function of VGAM1007 is therefore inhibition of KIAA0449 (Accession NM_017596). Accordingly, utilities of VGAM1007 include diagnosis, prevention and treatment of diseases and clinical conditions associated with KIAA0449. KIAA0596 (Accession XM_031706) is another VGAM1007 host target gene. KIAA0596 BINDING SITE is HOST TARGET binding site found in the 3' untranslated region of mRNA encoded by KIAA0596, corresponding to a HOST TARGET binding site such as BINDING SITE I, BINDING SITE II or BINDING SITE III. Table 2 illustrates the complementarity of the nucleotide sequences of KIAA0596 BINDING SITE, designated SEQ ID:31462, to the nucleotide sequence of VGAM1007 RNA, herein designated VGAM RNA, also designated SEQ ID:3718.

Another function of VGAM1007 is therefore inhibition of KIAA0596 (Accession XM_031706). Accordingly, utilities of VGAM1007 include diagnosis, prevention and treatment of diseases and clinical conditions associated with KIAA0596. KIAA0599 (Accession XM_085127) is another VGAM1007 host target gene. KIAA0599 BINDING SITE is HOST TARGET binding site found in the 3' untranslated region of mRNA encoded by KIAA0599, corresponding to a HOST TARGET binding site such as BINDING SITE I, BINDING SITE II or BINDING SITE III. Table 2 illustrates the complementarity of the nucleotide sequences of KIAA0599 BINDING SITE, designated SEQ ID:37858, to the nucleotide sequence of VGAM1007 RNA, herein designated VGAM RNA, also designated SEQ ID:3718.

Another function of VGAM1007 is therefore inhibition of KIAA0599 (Accession XM_085127). Accordingly, utilities of VGAM1007 include diagnosis, prevention and treatment of diseases and clinical conditions associated with KIAA0599. KIAA1283 (Accession XM_050563) is another VGAM1007 host target gene. KIAA1283 BINDING SITE is HOST TARGET binding site found in the 5' untranslated region of mRNA encoded by KIAA1283, corresponding to a HOST TARGET binding site such as BINDING SITE I, BINDING SITE II or BINDING SITE III. Table 2 illustrates the complementarity of the nucleotide sequences of KIAA1283 BINDING SITE, designated SEQ ID:35663, to the nucleotide sequence of VGAM1007 RNA, herein designated VGAM RNA, also designated SEQ ID:3718.

Another function of VGAM1007 is therefore inhibition of KIAA1283 (Accession XM_050563). Accordingly, utilities of VGAM1007 include diagnosis, prevention and treatment of diseases and clinical conditions associated with KIAA1283. MGC2217 (Accession NM_024300) is another VGAM1007 host target gene. MGC2217 BINDING SITE is HOST TARGET binding site found in the 5' untranslated region of mRNA encoded by MGC2217, corresponding to a HOST TARGET binding site such as BINDING SITE I, BINDING SITE II or BINDING SITE III. Table 2 illustrates the complementarity of the nucleotide sequences of MGC2217 BINDING SITE, designated SEQ ID:23589, to the nucleotide sequence of VGAM1007 RNA, herein designated VGAM RNA, also designated SEQ ID:3718.

Another function of VGAM1007 is therefore inhibition of MGC2217 (Accession NM_024300). Accordingly, utilities of VGAM1007 include diagnosis, prevention and treatment of diseases and clinical conditions associated with MGC2217. LOC114932 (Accession XM_052614) is another VGAM1007 host target gene. LOC114932 BINDING SITE is HOST TARGET binding site found in the 3' untranslated region of mRNA encoded by LOC114932, corresponding to a HOST TARGET binding site such as BINDING SITE I, BINDING SITE II or BINDING SITE III. Table 2 illustrates the complementarity of the nucleotide sequences of LOC114932 BINDING SITE, designated SEQ ID:36006, to the nucleotide sequence of VGAM1007 RNA, herein designated VGAM RNA, also designated SEQ ID:3718.

Another function of VGAM1007 is therefore inhibition of LOC114932 (Accession XM_052614). Accordingly, utilities of VGAM1007 include diagnosis, prevention and treatment of diseases and clinical conditions associated with LOC114932. LOC159036 (Accession XM_099018) is another VGAM1007 host target gene. LOC159036 BINDING SITE is HOST TARGET binding site found in the 3' untranslated region of mRNA encoded by LOC159036, corresponding to a HOST TARGET binding site such as BINDING SITE I, BINDING SITE II or BINDING SITE III. Table 2 illustrates the complementarity of the nucleotide sequences of LOC159036 BINDING SITE, designated SEQ ID:42053, to the nucleotide sequence of VGAM1007 RNA, herein designated VGAM RNA, also designated SEQ ID:3718.

Another function of VGAM1007 is therefore inhibition of LOC159036 (Accession XM_099018). Accordingly, utilities of VGAM1007 include diagnosis, prevention and treatment of diseases and clinical conditions associated with LOC159036. LOC201595 (Accession XM_114346) is another VGAM1007 host target gene. LOC201595 BINDING SITE is HOST TARGET binding site found in the 5' untranslated region of mRNA encoded by LOC201595, corresponding to a HOST TARGET binding site such as BINDING SITE I, BINDING SITE II or BINDING SITE III. Table 2 illustrates the complementarity of the nucleotide sequences of LOC201595 BINDING SITE, designated SEQ ID:42886, to the nucleotide sequence of VGAM1007 RNA, herein designated VGAM RNA, also designated SEQ ID:3718.

Another function of VGAM1007 is therefore inhibition of LOC201595 (Accession XM_114346). Accordingly, utilities of VGAM1007 include diagnosis, prevention and treatment of diseases and clinical conditions associated with LOC201595. LOC222662 (Accession XM_167086) is another VGAM1007 host target gene. LOC222662 BINDING SITE is HOST TARGET binding site found in the 5' untranslated region of mRNA encoded by LOC222662, corresponding to a HOST TARGET binding site such as BINDING SITE I, BINDING SITE II or BINDING SITE III. Table 2 illustrates the complementarity of the nucleotide sequences of LOC222662 BINDING SITE, designated SEQ ID:44603, to the nucleotide sequence of VGAM1007 RNA, herein designated VGAM RNA, also designated SEQ ID:3718.

Another function of VGAM1007 is therefore inhibition of LOC222662 (Accession XM_167086). Accordingly, utilities of VGAM1007 include diagnosis, prevention and treatment of diseases and clinical conditions associated with LOC222662. LOC256586 (Accession XM_170759) is another VGAM1007 host target gene. LOC256586 BINDING SITE is HOST TARGET binding site found in the 5' untranslated region of mRNA encoded by LOC256586, corresponding to a HOST TARGET binding site such as BINDING SITE I, BINDING SITE II or BINDING SITE III. Table 2 illustrates the complementarity of the nucleotide sequences of LOC256586 BINDING SITE, designated SEQ ID:45515, to the nucleotide sequence of VGAM1007 RNA, herein designated VGAM RNA, also designated SEQ ID:3718.

Another function of VGAM1007 is therefore inhibition of LOC256586 (Accession XM_170759). Accordingly, utilities of VGAM1007 include diagnosis, prevention and treatment of diseases and clinical conditions associated with LOC256586. FIG. 1 further provides a conceptual description of a novel bioinformatically detected viral gene of the present invention, referred to here as Viral Genomic Address Messenger 1008 (VGAM1008) viral gene, which modulates expression of respective host target genes thereof, the function and utility of which host target genes is known in the art.

VGAM1008 is a novel bioinformatically detected regulatory, non protein coding, viral micro RNA (miRNA) gene. The method by which VGAM1008 was detected is described hereinabove with reference to FIGS. 1-8.

VGAM1008 gene, herein designated VGAM GENE, is a viral gene contained in the genome of Chimpanzee Cytomegalovirus. VGAM1008 host target gene, herein designated VGAM HOST TARGET GENE, is a human gene contained in the human genome.

VGAM1008 gene encodes a VGAM1008 precursor RNA, herein designated VGAM PRECURSOR RNA. Similar to other miRNA genes, and unlike most ordinary genes, VGAM1008 precursor RNA does not encode a protein. A nucleotide sequence identical or highly similar to the nucleotide sequence of VGAM1008 precursor RNA is designated SEQ ID:994, and is provided hereinbelow with reference to the sequence listing part. Nucleotide sequence SEQ ID:994 is located at position 199188 relative to the genome of Chimpanzee Cytomegalovirus.

VGAM1008 precursor RNA folds onto itself, forming VGAM1008 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1008 folded precursor RNA into VGAM1008 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1008 RNA is designated SEQ ID:3719, and is provided hereinbelow with reference to the sequence listing part.

VGAM1008 host target gene, herein designated VGAM HOST TARGET GENE, encodes a corresponding messenger RNA, VGAM1008 host target RNA, herein designated VGAM HOST TARGET RNA. VGAM1008 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1008 RNA, herein designated VGAM RNA, binds complementarily to one or more host target binding sites located in untranslated regions of VGAM1008 host target RNA, herein designated VGAM HOST TARGET RNA. This complementary binding is due to the fact that the nucleotide sequence of VGAM1008 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1008 RNA, herein designated VGAM RNA, may have a different number of host target binding sites in untranslated regions of a VGAM1008 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1008 RNA, herein designated VGAM RNA, to host target binding sites on VGAM1008 host target RNA, herein designated VGAM HOST TARGET RNA, such as BINDING SITE I, BINDING SITE II and BINDING SITE III, inhibits translation of VGAM1008 host target RNA into VGAM1008 host target protein, herein designated VGAM HOST TARGET PROTEIN. VGAM host target protein is therefore outlined by a broken line.

It is appreciated that VGAM1008 host target gene, herein designated VGAM HOST TARGET GENE, in fact represents a plurality of VGAM1008 host target genes. The mRNA of each one of this plurality of VGAM1008 host target genes comprises one or more host target binding sites, each having a nucleotide sequence which is at least partly complementary to VGAM1008 RNA, herein designated VGAM RNA, and which when bound by VGAM1008 RNA causes inhibition of translation of respective one or more VGAM1008 host target proteins.

It is further appreciated by one skilled in the art that the mode of translational inhibition illustrated by FIG. 1 with specific reference to translational inhibition exerted by VGAM1008 gene, herein designated VGAM GENE, on one or more VGAM1008 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1008 is inhibition of expression of host target genes, as part of a novel viral mechanism of attacking a host. Accordingly, utilities of VGAM1008 include diagnosis, prevention and treatment of viral infection by Chimpanzee Cytomegalovirus. Specific functions, and accordingly utilities, of VGAM1008 correlate with, and may be deduced from, the identity of the host target genes which VGAM1008 binds and inhibits, and the function of these host target genes, as elaborated hereinbelow.

Nucleotide sequences of the VGAM1008 precursor RNA, herein designated VGAM PRECURSOR RNA, and of the 'diced' VGAM1008 RNA, herein designated VGAM RNA, and a schematic representation of the secondary folding of VGAM1008 folded precursor RNA, herein designated VGAM FOLDED PRECURSOR RNA, of VGAM1008 are further described hereinbelow with reference to Table 1.

Nucleotide sequences of host target binding sites, such as BINDING SITE-I, BINDING SITE-II and BINDING SITE-III of FIG. 1, found on VGAM1008 host target RNA, and a schematic representation of the complementarity of each of these host target binding sites to VGAM1008 RNA, herein designated VGAM RNA, are described hereinbelow with reference to Table 2.

As mentioned hereinabove with reference to FIG. 1, a function of VGAM1008 gene, herein designated VGAM is inhibition of expression of VGAM1008 target genes. It is appreciated that specific functions, and accordingly utilities, of VGAM1008 correlate with, and may be deduced from, the identity of the target genes which VGAM1008 binds and inhibits, and the function of these target genes, as elaborated hereinbelow.

Nerve Growth Factor Receptor (TNFR superfamily, member 16) (NGFR, Accession NM_002507) is a VGAM1008 host target gene. NGFR BINDING SITE is HOST TARGET binding site found in the 3' untranslated region of mRNA encoded by NGFR, corresponding to a HOST TARGET binding site such as BINDING SITE I, BINDING SITE II or BINDING SITE III. Table 2 illustrates the complementarity of the nucleotide sequences of NGFR BINDING SITE, designated SEQ ID:8336, to the nucleotide sequence of VGAM1008 RNA, herein designated VGAM RNA, also designated SEQ ID:3719.

A function of VGAM1008 is therefore inhibition of Nerve Growth Factor Receptor (TNFR superfamily, member 16) (NGFR, Accession NM_002507), a gene which can mediate cell survival as well as cell death of neural cells. Accordingly, utilities of VGAM1008 include diagnosis, prevention and treatment of diseases and clinical conditions associated with NGFR. The function of NGFR and its association with various diseases and clinical conditions, has been established by previous studies, as described hereinabove with reference to VGAM212. Optic Atrophy 3 (autosomal recessive, with chorea and spastic paraplegia) (OPA3, Accession NM_025136) is another VGAM1008 host target gene. OPA3 BINDING SITE is HOST TARGET binding site found in the 3' untranslated region of mRNA encoded by OPA3, corresponding to a HOST TARGET binding site such as BINDING SITE I, BINDING SITE II or BINDING SITE III. Table 2 illustrates the complementarity of the nucleotide sequences of OPA3 BINDING SITE, designated SEQ ID:24775, to the nucleotide sequence of VGAM1008 RNA, herein designated VGAM RNA, also designated SEQ ID:3719.

Another function of VGAM1008 is therefore inhibition of Optic Atrophy 3 (autosomal recessive, with chorea and spastic paraplegia) (OPA3, Accession NM_025136). Accordingly, utilities of VGAM1008 include diagnosis, prevention and treatment of diseases and clinical conditions associated with OPA3. KIAA0447 (Accession XM_049733) is another VGAM1008 host target gene. KIAA0447 BINDING SITE is HOST TARGET binding site found in the 3' untranslated region of mRNA encoded by KIAA0447, corresponding to a HOST TARGET binding site such as BINDING SITE I, BINDING SITE II or BINDING SITE III. Table 2 illustrates the complementarity of the nucleotide sequences of KIAA0447 BINDING SITE, designated SEQ ID:35492, to the nucleotide sequence of VGAM1008 RNA, herein designated VGAM RNA, also designated SEQ ID:3719.

Another function of VGAM1008 is therefore inhibition of KIAA0447 (Accession XM_049733). Accordingly, utilities of VGAM1008 include diagnosis, prevention and treatment of diseases and clinical conditions associated with KIAA0447. Purinergic Receptor P2X, Ligand-gated Ion Channel, 1 (P2RX1, Accession XM_040635) is another VGAM1008 host target gene. P2RX1 BINDING SITE is HOST TARGET binding site found in the 3' untranslated region of mRNA encoded by P2RX1, corresponding to a HOST TARGET binding site such as BINDING SITE I, BINDING SITE II or BINDING SITE III. Table 2 illustrates the complementarity of the nucleotide sequences of P2RX1 BINDING SITE, designated SEQ ID:33353, to the nucleotide sequence of VGAM1008 RNA, herein designated VGAM RNA, also designated SEQ ID:3719.

Another function of VGAM1008 is therefore inhibition of Purinergic Receptor P2X, Ligand-gated Ion Channel, 1 (P2RX1, Accession XM_040635). Accordingly, utilities of VGAM1008 include diagnosis, prevention and treatment of diseases and clinical conditions associated with P2RX1. Ubiquitin Specific Protease 22 (USP22, Accession XM_042698) is another VGAM1008 host target gene. USP22 BINDING SITE is HOST TARGET binding site found in the 3' untranslated region of mRNA encoded by USP22, corresponding to a HOST TARGET binding site such as BINDING SITE I, BINDING SITE II or BINDING SITE III. Table 2 illustrates the complementarity of the nucleotide sequences of USP22 BINDING SITE, designated SEQ ID:33752, to the nucleotide sequence of VGAM1008 RNA, herein designated VGAM RNA, also designated SEQ ID:3719.

Another function of VGAM1008 is therefore inhibition of Ubiquitin Specific Protease 22 (USP22, Accession XM_042698). Accordingly, utilities of VGAM1008 include diagnosis, prevention and treatment of diseases and clinical conditions associated with USP22. LOC146229 (Accession XM_085387) is another VGAM1008 host target gene. LOC146229 BINDING SITE is HOST TARGET binding site found in the 3' untranslated region of mRNA encoded by LOC146229, corresponding to a HOST TARGET binding site such as BINDING SITE I, BINDING SITE II or BINDING SITE III. Table 2 illustrates the complementarity of the nucleotide sequences of LOC146229 BINDING SITE, designated SEQ ID:38118, to the nucleotide sequence of VGAM1008 RNA, herein designated VGAM RNA, also designated SEQ ID:3719.

Another function of VGAM1008 is therefore inhibition of LOC146229 (Accession XM_085387). Accordingly, utilities of VGAM1008 include diagnosis, prevention and treatment of diseases and clinical conditions associated with LOC146229. FIG. 1 further provides a conceptual description of a novel bioinformatically detected viral gene of the present invention, referred to here as Viral Genomic Address Messenger 1009 (VGAM1009) viral gene, which modulates expression of respective host target genes thereof, the function and utility of which host target genes is known in the art.

VGAM1009 is a novel bioinformatically detected regulatory, non protein coding, viral micro RNA (miRNA) gene. The method by which VGAM1009 was detected is described hereinabove with reference to FIGS. 1-8.

VGAM1009 gene, herein designated VGAM GENE, is a viral gene contained in the genome of Equine Herpesvirus 4. VGAM1009 host target gene, herein designated VGAM HOST TARGET GENE, is a human gene contained in the human genome.

VGAM1009 gene encodes a VGAM1009 precursor RNA, herein designated VGAM PRECURSOR RNA. Similar to other miRNA genes, and unlike most ordinary genes, VGAM1009 precursor RNA does not encode a protein. A nucleotide sequence identical or highly similar to the nucleotide sequence of VGAM1009 precursor RNA is designated SEQ ID:995, and is provided hereinbelow with reference to the sequence listing part. Nucleotide sequence SEQ ID:995 is located at position 31121 relative to the genome of Equine Herpesvirus 4.

VGAM1009 precursor RNA folds onto itself, forming VGAM1009 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1009 folded precursor RNA into VGAM1009 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1009 RNA is designated SEQ ID:3720, and is provided hereinbelow with reference to the sequence listing part.

VGAM1009 host target gene, herein designated VGAM HOST TARGET GENE, encodes a corresponding messenger RNA, VGAM1009 host target RNA, herein designated VGAM HOST TARGET RNA. VGAM1009 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1009 RNA, herein designated VGAM RNA, binds complementarily to one or more host target binding sites located in untranslated regions of VGAM1009 host target RNA, herein designated VGAM HOST TARGET RNA. This complementary binding is due to the fact that the nucleotide sequence of VGAM1009 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1009 RNA, herein designated VGAM RNA, may have a different number of host target binding sites in untranslated regions of a VGAM1009 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1009 RNA, herein designated VGAM RNA, to host target binding sites on VGAM1009 host target RNA, herein designated VGAM HOST TARGET RNA, such as BINDING SITE I, BINDING SITE II and BINDING SITE III, inhibits translation of VGAM1009 host target RNA into VGAM1009 host target protein, herein designated VGAM HOST TARGET PROTEIN. VGAM host target protein is therefore outlined by a broken line.

It is appreciated that VGAM1009 host target gene, herein designated VGAM HOST TARGET GENE, in fact represents a plurality of VGAM1009 host target genes. The mRNA of each one of this plurality of VGAM1009 host target genes comprises one or more host target binding sites, each having a nucleotide sequence which is at least partly complementary to VGAM1009 RNA, herein designated VGAM RNA, and which when bound by VGAM1009 RNA causes inhibition of translation of respective one or more VGAM1009 host target proteins.

It is further appreciated by one skilled in the art that the mode of translational inhibition illustrated by FIG. 1 with specific reference to translational inhibition exerted by VGAM1009 gene, herein designated VGAM GENE, on one or more VGAM1009 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1009 is inhibition of expression of host target genes, as part of a novel viral mechanism of attacking a host. Accordingly, utilities of VGAM1009 include diagnosis, prevention and treatment of viral infection by Equine Herpesvirus 4. Specific functions, and accordingly utilities, of VGAM1009 correlate with, and may be deduced from, the identity of the host target genes which VGAM1009 binds and inhibits, and the function of these host target genes, as elaborated hereinbelow.

Nucleotide sequences of the VGAM1009 precursor RNA, herein designated VGAM PRECURSOR RNA, and of the 'diced' VGAM1009 RNA, herein designated VGAM RNA, and a schematic representation of the secondary folding of VGAM1009 folded precursor RNA, herein designated VGAM FOLDED PRECURSOR RNA, of VGAM1009 are further described hereinbelow with reference to Table 1.

Nucleotide sequences of host target binding sites, such as BINDING SITE-I, BINDING SITE-II and BINDING SITE-III of FIG. 1, found on VGAM1009 host target RNA, and schematic representation of the complementarity of each of these host target binding sites to VGAM1009 RNA, herein designated VGAM RNA, are described hereinbelow with reference to Table 2.

As mentioned hereinabove with reference to FIG. 1, a function of VGAM1009 gene, herein designated VGAM is inhibition of expression of VGAM1009 target genes. It is appreciated that specific functions, and accordingly utilities, of VGAM1009 correlate with, and may be deduced from, the identity of the target genes which VGAM1009 binds and inhibits, and the function of these target genes, as elaborated hereinbelow.

Interleukin 1 Family, Member 5 (delta) (IL1F5, Accession NM_012275) is a VGAM1009 host target gene. IL1F5 BINDING SITE is HOST TARGET binding site found in the 3' untranslated region of mRNA encoded by IL1F5, corresponding to a HOST TARGET binding site such as BINDING SITE I, BINDING SITE II or BINDING SITE III. Table 2 illustrates the complementarity of the nucleotide sequences of IL1F5 BINDING SITE, designated SEQ ID:14599, to the nucleotide sequence of VGAM1009 RNA, herein designated VGAM RNA, also designated SEQ ID:3720.

A function of VGAM1009 is therefore inhibition of Interleukin 1 Family, Member 5 (delta) (IL1F5, Accession NM_012275), a gene which is a novel interleukin-1 receptor antagonist gene. Accordingly, utilities of VGAM1009 include diagnosis, prevention and treatment of diseases and clinical conditions associated with IL1F5. The function of IL1F5 and its association with various diseases and clinical conditions, has been established by previous studies, as described hereinabove with reference to VGAM263. NBR2 (Accession NM_005821) is another VGAM1009 host target gene. NBR2 BINDING SITE is HOST TARGET binding site found in the 3' untranslated region of mRNA encoded by NBR2, corresponding to a HOST TARGET binding site such as BINDING SITE I, BINDING SITE II or BINDING SITE III. Table 2 illustrates the complementarity of the nucleotide sequences of NBR2 BINDING SITE, designated SEQ ID:12424, to the nucleotide sequence of VGAM1009 RNA, herein designated VGAM RNA, also designated SEQ ID:3720.

Another function of VGAM1009 is therefore inhibition of NBR2 (Accession NM_005821). Accordingly, utilities of VGAM1009 include diagnosis, prevention and treatment of diseases and clinical conditions associated with NBR2. LOC149134 (Accession XM_097594) is another VGAM1009 host target gene. LOC149134 BINDING SITE is HOST TARGET binding site found in the 5' untranslated region of mRNA encoded by LOC149134, corresponding to a HOST TARGET binding site such as BINDING SITE I, BINDING SITE II or BINDING SITE III. Table 2 illustrates the complementarity of the nucleotide sequences of LOC149134 BINDING SITE, designated SEQ ID:40957, to the nucleotide sequence of VGAM1009 RNA, herein designated VGAM RNA, also designated SEQ ID:3720.

Another function of VGAM1009 is therefore inhibition of LOC149134 (Accession XM_097594). Accordingly, utilities of VGAM1009 include diagnosis, prevention and treatment of diseases and clinical conditions associated with LOC149134. LOC168283 (Accession XM_094966) is another VGAM1009 host target gene. LOC168283 BINDING SITE is HOST TARGET binding site found in the 5' untranslated region of mRNA encoded by LOC168283, corresponding to a HOST TARGET binding site such as BINDING SITE I, BINDING SITE II or BINDING SITE III. Table 2 illustrates the complementarity of the nucleotide sequences of LOC168283 BINDING SITE, designated SEQ ID:40239, to the nucleotide sequence of VGAM1009 RNA, herein designated VGAM RNA, also designated SEQ ID:3720.

Another function of VGAM1009 is therefore inhibition of LOC168283 (Accession XM_094966). Accordingly, utilities of VGAM1009 include diagnosis, prevention and treatment of diseases and clinical conditions associated with LOC168283. FIG. 1 further provides a conceptual description of a novel bioinformatically detected viral gene of the present invention, referred to here as Viral Genomic Address Messenger 1010 (VGAM1010) viral gene, which modulates expression of respective host target genes thereof, the function and utility of which host target genes is known in the art.

VGAM1010 is a novel bioinformatically detected regulatory, non protein coding, viral micro RNA (miRNA) gene. The method by which VGAM1010 was detected is described hereinabove with reference to FIGS. 1-8.

VGAM1010 gene, herein designated VGAM GENE, is a viral gene contained in the genome of Equine Herpesvirus 4. VGAM1010 host target gene, herein designated VGAM HOST TARGET GENE, is a human gene contained in the human genome.

VGAM1010 gene encodes a VGAM1010 precursor RNA, herein designated VGAM PRECURSOR RNA. Similar to other miRNA genes, and unlike most ordinary genes, VGAM1010 precursor RNA does not encode a protein. A nucleotide sequence identical or highly similar to the nucleotide sequence of VGAM1010 precursor RNA is designated SEQ ID:996, and is provided hereinbelow with reference to the sequence listing part. Nucleotide sequence SEQ ID:996 is located at position 29765 relative to the genome of Equine Herpesvirus 4.

VGAM1010 precursor RNA folds onto itself, forming VGAM1010 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1010 folded precursor RNA into VGAM1010 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1010 RNA is designated SEQ ID:3721, and is provided hereinbelow with reference to the sequence listing part.

VGAM1010 host target gene, herein designated VGAM HOST TARGET GENE, encodes a corresponding messenger RNA, VGAM1010 host target RNA, herein designated VGAM HOST TARGET RNA. VGAM1010 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1010 RNA, herein designated VGAM RNA, binds complementarily to one or more host target binding sites located in untranslated regions of VGAM1010 host target RNA, herein designated VGAM HOST TARGET RNA. This complementary binding is due to the fact that the nucleotide sequence of VGAM1010 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1010 RNA, herein designated VGAM RNA, may have a different number of host target binding sites in untranslated regions of a VGAM1010 host target RNA, herein designated VGAM HOST TARGET RNA. It is further appreciated that while FIG. 1 depicts host target binding sites in the 3'UTR region, this is meant as an example only - these host target binding sites may be located in the 3"UTR region, the 5"UTR region, or in both 3'UTR and 5"UTR regions.

The complementary binding of VGAM1010 RNA, herein designated VGAM RNA, to host target binding sites on VGAM1010 host target RNA, herein designated VGAM HOST TARGET RNA, such as BINDING SITE I, BINDING SITE II and BINDING SITE III, inhibits translation of VGAM1010 host target RNA into VGAM1010 host target protein, herein designated VGAM HOST TARGET PROTEIN. VGAM host target protein is therefore outlined by a broken line.

It is appreciated that VGAM1010 host target gene, herein designated VGAM HOST TARGET GENE, in fact represents a plurality of VGAM1010 host target genes. The mRNA of each one of this plurality of VGAM1010 host target genes comprises one or more host target binding sites, each having a nucleotide sequence which is at least partly complementary to VGAM1010 RNA, herein designated VGAM RNA, and which when bound by VGAM1010 RNA causes inhibition of translation of respective one or more VGAM1010 host target proteins.

It is further appreciated by one skilled in the art that the mode of translational inhibition illustrated by FIG. 1 with specific reference to translational inhibition exerted by VGAM1010 gene, herein designated VGAM GENE, on one or more VGAM1010 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1010 is inhibition of expression of host target genes, as part of a novel viral mechanism of attacking a host. Accordingly, utilities of VGAM1010 include diagnosis, prevention and treatment of viral infection by Equine Herpesvirus 4. Specific functions, and accordingly utilities, of VGAM1010 correlate with, and may be deduced from, the identity of the host target genes which VGAM1010 binds and inhibits, and the function of these host target genes, as elaborated hereinbelow.

Nucleotide sequences of the VGAM1010 precursor RNA, herein designated VGAM PRECURSOR RNA, and of the 'diced' VGAM1010 RNA, herein designated VGAM RNA, and a schematic representation of the secondary folding of VGAM1010 folded precursor RNA, herein designated VGAM FOLDED PRECURSOR RNA, of VGAM1010 are further described hereinbelow with reference to Table 1.

Nucleotide sequences of host target binding sites, such as BINDING SITE-I, BINDING SITE-II and BINDING SITE-III of FIG. 1, found on VGAM1010 host target RNA, and schematic representation of the complementarity of each of these host target binding sites to VGAM1010 RNA, herein designated VGAM RNA, are described hereinbelow with reference to Table 2.

As mentioned hereinabove with reference to FIG. 1, a function of VGAM1010 gene, herein designated VGAM is inhibition of expression of VGAM1010 target genes. It is appreciated that specific functions, and accordingly utilities, of VGAM1010 correlate with, and may be deduced from, the identity of the target genes which VGAM1010 binds and inhibits, and the function of these target genes, as elaborated hereinbelow.

Cytokine Inducible SH2-containing Protein (CISH, Accession NM_013324) is a VGAM1010 host target gene. CISH BINDING SITE is HOST TARGET binding site found in the 5' untranslated region of mRNA encoded by CISH, corresponding to a HOST TARGET binding site such as BINDING SITE I, BINDING SITE II or BINDING SITE III. Table 2 illustrates the complementarity of the nucleotide sequences of CISH BINDING SITE, designated SEQ ID:14971, to the nucleotide sequence of VGAM1010 RNA, herein designated VGAM RNA, also designated SEQ ID:3721.

A function of VGAM1010 is therefore inhibition of Cytokine Inducible SH2-containing Protein (CISH, Accession NM_013324), a gene which intervenes in the negative regulation of cytokines. Accordingly, utilities of VGAM1010 include diagnosis, prevention and treatment of diseases and clinical conditions associated with CISH. The function of CISH and its association with various diseases and clinical conditions, has been established by previous studies, as described hereinabove with reference to VGAM488. Microtubule-associated Protein, RP/EB Family, Member 3 (MAPRE3, Accession NM_012326) is another VGAM1010 host target gene. MAPRE3 BINDING SITE is HOST TARGET binding site found in the 3' untranslated region of mRNA encoded by MAPRE3, corresponding to a HOST TARGET binding site such as BINDING SITE I, BINDING SITE II or BINDING SITE III. Table 2 illustrates the complementarity of the nucleotide sequences of MAPRE3 BINDING SITE, designated SEQ ID:14713, to the nucleotide sequence of VGAM1010 RNA, herein designated VGAM RNA, also designated SEQ ID:3721.

Another function of VGAM1010 is therefore inhibition of Microtubule-associated Protein, RP/EB Family, Member 3 (MAPRE3, Accession NM_012326), a gene which interact with cytoplasmic microtubules, and with the adenomatous polyposis coli. Accordingly, utilities of VGAM1010 include diagnosis, prevention and treatment of diseases and clinical conditions associated with MAPRE3. The function of MAPRE3 and its association with various diseases and clinical conditions, has been established by previous studies, as described hereinabove with reference to VGAM340. DKFZp434O0320 (Accession XM_097012) is another VGAM1010 host target gene. DKFZp434O0320 BINDING SITE is HOST TARGET binding site found in the 3' untranslated region of mRNA encoded by DKFZp434O0320, corresponding to a HOST TARGET binding site such as BINDING SITE I, BINDING SITE II or BINDING SITE III. Table 2 illustrates the complementarity of the nucleotide sequences of DKFZp434O0320 BINDING SITE, designated SEQ ID:40704, to the nucleotide sequence of VGAM1010 RNA, herein designated VGAM RNA, also designated SEQ ID:3721.

Another function of VGAM1010 is therefore inhibition of DKFZp434O0320 (Accession XM_097012). Accordingly, utilities of VGAM1010 include diagnosis, prevention and treatment of diseases and clinical conditions associated with DKFZp434O0320. EPSIN (Accession NM_013333) is another VGAM1010 host target gene. EPSIN BINDING SITE is HOST TARGET binding site found in the 5' untranslated region of mRNA encoded by EPSIN, corresponding to a HOST TARGET binding site such as BINDING SITE I, BINDING SITE II or BINDING SITE III. Table 2 illustrates the complementarity of the nucleotide sequences of EPSIN BINDING SITE, designated SEQ ID:14980, to the nucleotide sequence of VGAM1010 RNA, herein designated VGAM RNA, also designated SEQ ID:3721.

Another function of VGAM1010 is therefore inhibition of EPSIN (Accession NM_013333). Accordingly, utilities of VGAM1010 include diagnosis, prevention and treatment of diseases and clinical conditions associated with EPSIN. FASTK (Accession NM_025096) is another VGAM1010 host target gene. FASTK BINDING SITE is HOST TARGET binding site found in the 5' untranslated region of mRNA encoded by FASTK, corresponding to a HOST TARGET binding site such as BINDING SITE I, BINDING SITE II or BINDING SITE III. Table 2 illustrates the complementarity of the nucleotide sequences of FASTK BINDING SITE, designated SEQ ID:24728, to the nucleotide sequence of VGAM1010 RNA, herein designated VGAM RNA, also designated SEQ ID:3721.

Another function of VGAM1010 is therefore inhibition of FASTK (Accession NM_025096). Accordingly, utilities of VGAM1010 include diagnosis, prevention and treatment of diseases and clinical conditions associated with FASTK. HSPC065 (Accession NM_014157) is another VGAM1010 host target gene. HSPC065 BINDING SITE is HOST TARGET binding site found in the 3' untranslated region of mRNA encoded by HSPC065, corresponding to a HOST TARGET binding site such as BINDING SITE I, BINDING SITE II or BINDING SITE III. Table 2 illustrates the complementarity of the nucleotide sequences of HSPC065 BINDING SITE, designated SEQ ID:15451, to the nucleotide sequence of VGAM1010 RNA, herein designated VGAM RNA, also designated SEQ ID:3721.

Another function of VGAM1010 is therefore inhibition of HSPC065 (Accession NM_014157). Accordingly, utilities of VGAM1010 include diagnosis, prevention and treatment of diseases and clinical conditions associated with HSPC065. MGC16025 (Accession NM_032923) is another VGAM1010 host target gene. MGC16025 BINDING SITE is HOST TARGET binding site found in the 3' untranslated region of mRNA encoded by MGC16025, corresponding to a HOST TARGET binding site such as BINDING SITE I, BINDING SITE II or BINDING SITE III. Table 2 illustrates the complementarity of the nucleotide sequences of MGC16025 BINDING SITE, designated SEQ ID:26748, to the nucleotide sequence of VGAM1010 RNA, herein designated VGAM RNA, also designated SEQ ID:3721.

Another function of VGAM1010 is therefore inhibition of MGC16025 (Accession NM_032923). Accordingly, utilities of VGAM1010 include diagnosis, prevention and treatment of diseases and clinical conditions associated with MGC16025. SEC8 (Accession NM_021807) is another VGAM1010 host target gene. SEC8 BINDING SITE is HOST TARGET binding site found in the 3' untranslated region of mRNA encoded by SEC8, corresponding to a HOST TARGET binding site such as BINDING SITE I, BINDING SITE II or BINDING SITE III. Table 2 illustrates the complementarity of the nucleotide sequences of SEC8 BINDING SITE, designated SEQ ID:22360, to the nucleotide sequence of VGAM1010 RNA, herein designated VGAM RNA, also designated SEQ ID:3721.

Another function of VGAM1010 is therefore inhibition of SEC8 (Accession NM_021807). Accordingly, utilities of VGAM1010 include diagnosis, prevention and treatment of diseases and clinical conditions associated with SEC8. SYNE-2 (Accession NM_015180) is another VGAM1010 host target gene. SYNE-2 BINDING SITE is HOST TARGET binding site found in the 3' untranslated region of mRNA encoded by SYNE-2, corresponding to a HOST TARGET binding site such as BINDING SITE I, BINDING SITE II or BINDING SITE III. Table 2 illustrates the complementarity of the nucleotide sequences of SYNE-2 BINDING SITE, designated SEQ ID:17532, to the nucleotide sequence of VGAM1010 RNA, herein designated VGAM RNA, also designated SEQ ID:3721.

Another function of VGAM1010 is therefore inhibition of SYNE-2 (Accession NM_015180). Accordingly, utilities of VGAM1010 include diagnosis, prevention and treatment of diseases and clinical conditions associated with SYNE-2. Transducer of ERBB2, 2 (TOB2, Accession XM_170995) is another VGAM1010 host target gene. TOB2 BINDING SITE is HOST TARGET binding site found in the 3' untranslated region of mRNA encoded by TOB2, corresponding to a HOST TARGET binding site such as BINDING SITE I, BINDING SITE II or BINDING SITE III. Table 2 illustrates the complementarity of the nucleotide sequences of TOB2 BINDING SITE, designated SEQ ID:45767, to the nucleotide sequence of VGAM1010 RNA, herein designated VGAM RNA, also designated SEQ ID:3721.

Another function of VGAM1010 is therefore inhibition of Transducer of ERBB2, 2 (TOB2, Accession XM_170995). Accordingly, utilities of VGAM1010 include diagnosis, prevention and treatment of diseases and clinical conditions associated with TOB2. LOC127435 (Accession XM_072088) is another VGAM1010 host target gene. LOC127435 BINDING SITE is HOST TARGET binding site found in the 3' untranslated region of mRNA encoded by LOC127435, corresponding to a HOST TARGET binding site such as BINDING SITE I, BINDING SITE II or BINDING SITE III. Table 2 illustrates the complementarity of the nucleotide sequences of LOC127435 BINDING SITE, designated SEQ ID:37461, to the nucleotide sequence of VGAM1010 RNA, herein designated VGAM RNA, also designated SEQ ID:3721.

Another function of VGAM1010 is therefore inhibition of LOC127435 (Accession XM_072088). Accordingly, utilities of VGAM1010 include diagnosis, prevention and treatment of diseases and clinical conditions associated with LOC127435. LOC157556 (Accession XM_098783) is another VGAM1010 host target gene. LOC157556 BINDING SITE is HOST TARGET binding site found in the 5' untranslated region of mRNA encoded by LOC157556, corresponding to a HOST TARGET binding site such as BINDING SITE I, BINDING SITE II or BINDING SITE III. Table 2 illustrates the complementarity of the nucleotide sequences of LOC157556 BINDING SITE, designated SEQ ID:41822, to the nucleotide sequence of VGAM1010 RNA, herein designated VGAM RNA, also designated SEQ ID:3721.

Another function of VGAM1010 is therefore inhibition of LOC157556 (Accession XM_098783). Accordingly, utilities of VGAM1010 include diagnosis, prevention and treatment of diseases and clinical conditions associated with LOC157556. LOC220143 (Accession XM_168046) is another VGAM1010 host target gene. LOC220143 BINDING SITE is HOST TARGET binding site found in the 5' untranslated region of mRNA encoded by LOC220143, corresponding to a HOST TARGET binding site such as BINDING SITE I, BINDING SITE II or BINDING SITE III. Table 2 illustrates the complementarity of the nucleotide sequences of LOC220143 BINDING SITE, designated SEQ ID:44952, to the nucleotide sequence of VGAM1010 RNA, herein designated VGAM RNA, also designated SEQ ID:3721.

Another function of VGAM1010 is therefore inhibition of LOC220143 (Accession XM_168046). Accordingly, utilities of VGAM1010 include diagnosis, prevention and treatment of diseases and clinical conditions associated with LOC220143. FIG. 1 further provides a conceptual description of a novel bioinformatically detected viral gene of the present invention, referred to here as Viral Genomic Address Messenger 1011 (VGAM1011) viral gene, which modulates expression of respective host target genes thereof, the function and utility of which host target genes is known in the art.

VGAM1011 is a novel bioinformatically detected regulatory, non protein coding, viral micro RNA (miRNA) gene. The method by which VGAM1011 was detected is described hereinabove with reference to FIGS. 1-8.

VGAM1011 gene, herein designated VGAM GENE, is a viral gene contained in the genome of Equine Herpesvirus 4. VGAM1011 host target gene, herein designated VGAM HOST TARGET GENE, is a human gene contained in the human genome.

VGAM1011 gene encodes a VGAM1011 precursor RNA, herein designated VGAM PRECURSOR RNA. Similar to other miRNA genes, and unlike most ordinary genes, VGAM1011 precursor RNA does not encode a protein. A nucleotide sequence identical or highly similar to the nucleotide sequence of VGAM1011 precursor RNA is designated SEQ ID:997, and is provided hereinbelow with reference to the sequence listing part. Nucleotide sequence SEQ ID:997 is located at position 29460 relative to the genome of Equine Herpesvirus 4.

VGAM1011 precursor RNA folds onto itself, forming VGAM1011 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1011 folded precursor RNA into VGAM1011 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1011 RNA is designated SEQ ID:3722, and is provided hereinbelow with reference to the sequence listing part.

VGAM1011 host target gene, herein designated VGAM HOST TARGET GENE, encodes a corresponding messenger RNA, VGAM1011 host target RNA, herein designated VGAM HOST TARGET RNA. VGAM1011 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1011 RNA, herein designated VGAM RNA, binds complementarily to one or more host target binding sites located in untranslated regions of VGAM1011 host target RNA, herein designated VGAM HOST TARGET RNA. This complementary binding is due to the fact that the nucleotide sequence of VGAM1011 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1011 RNA, herein designated VGAM RNA, may have a different number of host target binding sites in untranslated regions of a VGAM1011 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1011 RNA, herein designated VGAM RNA, to host target binding sites on VGAM1011 host target RNA, herein designated VGAM HOST TARGET RNA, such as BINDING SITE I, BINDING SITE II and BINDING SITE III, inhibits translation of VGAM1011 host target RNA into VGAM1011 host target protein, herein designated VGAM HOST TARGET PROTEIN. VGAM host target protein is therefore outlined by a broken line.

It is appreciated that VGAM1011 host target gene, herein designated VGAM HOST TARGET GENE, in fact represents a plurality of VGAM1011 host target genes. The mRNA of each one of this plurality of VGAM1011 host target genes comprises one or more host target binding sites, each having a nucleotide sequence which is at least partly complementary to VGAM1011 RNA, herein designated VGAM RNA, and which when bound by VGAM1011 RNA causes inhibition of translation of respective one or more VGAM1011 host target proteins.

It is further appreciated by one skilled in the art that the mode of translational inhibition illustrated by FIG. 1 with specific reference to translational inhibition exerted by VGAM1011 gene, herein designated VGAM GENE, on one or more VGAM1011 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1011 is inhibition of expression of host target genes, as part of a novel viral mechanism of attacking a host. Accordingly, utilities of VGAM1011 include diagnosis, prevention and treatment of viral infection by Equine Herpesvirus 4. Specific functions, and accordingly utilities, of VGAM1011 correlate with, and may be deduced from, the identity of the host target genes which VGAM1011 binds and inhibits, and the function of these host target genes, as elaborated hereinbelow.

Nucleotide sequences of the VGAM1011 precursor RNA, herein designated VGAM PRECURSOR RNA, and of the 'diced' VGAM1011 RNA, herein designated VGAM RNA, and a schematic representation of the secondary folding of VGAM1011 folded precursor RNA, herein designated VGAM FOLDED PRECURSOR RNA, of VGAM1011 are further described hereinbelow with reference to Table 1.

Nucleotide sequences of host target binding sites, such as BINDING SITE-I, BINDING SITE-II and BINDING SITE-III of FIG. 1, found on VGAM1011 host target RNA, and schematic representation of the complementarity of each of these host target binding sites to VGAM1011 RNA, herein designated VGAM RNA, are described hereinbelow with reference to Table 2.

As mentioned hereinabove with reference to FIG. 1, a function of VGAM1011 gene, herein designated VGAM is inhibition of expression of VGAM1011 target genes. It is appreciated that specific functions, and accordingly utilities, of VGAM1011 correlate with, and may be deduced from, the identity of the target genes which VGAM1011 binds and inhibits, and the function of these target genes, as elaborated hereinbelow.

Midline 1 (Opitz/BBB syndrome) (MID1, Accession NM_000381) is a VGAM1011 host target gene. MID1 BINDING SITE is HOST TARGET binding site found in the 3' untranslated region of mRNA encoded by MID1, corresponding to a HOST TARGET binding site such as BINDING SITE I, BINDING SITE II or BINDING SITE III. Table 2 illustrates the complementarity of the nucleotide sequences of MID1 BINDING SITE, designated SEQ ID:5954, to the nucleotide sequence of VGAM1011 RNA, herein designated VGAM RNA, also designated SEQ ID:3722.

A function of VGAM1011 is therefore inhibition of Midline 1 (Opitz/BBB syndrome) (MID1, Accession NM_000381). Accordingly, utilities of VGAM1011 include diagnosis, prevention and treatment of diseases and clinical conditions associated with MID1. Mucin 3B (MUC3B, Accession XM_168578) is another VGAM1011 host target gene. MUC3B BINDING SITE is HOST TARGET binding site found in the 5' untranslated region of mRNA encoded by MUC3B, corresponding to a HOST TARGET binding site such as BINDING SITE I, BINDING SITE II or BINDING SITE III. Table 2 illustrates the complementarity of the nucleotide sequences of MUC3B BINDING SITE, designated SEQ ID:45253, to the nucleotide sequence of VGAM1011 RNA, herein designated VGAM RNA, also designated SEQ ID:3722.

Another function of VGAM1011 is therefore inhibition of Mucin 3B (MUC3B, Accession XM_168578), a gene which provides a protective, lubricating barrier against particles and infectious agents at mucosal surfaces. Accordingly, utilities of VGAM1011 include diagnosis, prevention and treatment of diseases and clinical conditions associated with MUC3B. The function of MUC3B and its association with various diseases and clinical conditions, has been established by previous studies, as described hereinabove with reference to VGAM55. V-myc Myelocytomatosis Viral Oncogene Homolog 1, Lung Carcinoma Derived (avian) (MYCL1, Accession NM_005376) is another VGAM1011 host target gene. MYCL1 BINDING SITE is HOST TARGET binding site found in the 3' untranslated region of mRNA encoded by MYCL1, corresponding to a HOST TARGET binding site such as BINDING SITE I, BINDING SITE II or BINDING SITE III. Table 2 illustrates the complementarity of the nucleotide sequences of MYCL1 BINDING SITE, designated SEQ ID:11852, to the nucleotide sequence of VGAM1011 RNA, herein designated VGAM RNA, also designated SEQ ID:3722.

Another function of VGAM1011 is therefore inhibition of V-myc Myelocytomatosis Viral Oncogene Homolog 1, Lung Carcinoma Derived (avian) (MYCL1, Accession NM_005376), a gene which is a Myc-like transcription factor. Accordingly, utilities of VGAM1011 include diagnosis, prevention and treatment of diseases and clinical conditions associated with MYCL1. The function of MYCL1 and its association with various diseases and clinical conditions, has been established by previous studies, as described hereinabove with reference to VGAM640. T-cell Leukemia/lymphoma 1A (TCL1A, Accession NM_021966) is another VGAM1011 host target gene. TCL1A BINDING SITE is HOST TARGET binding site found in the 3' untranslated region of mRNA encoded by TCL1A, corresponding to a HOST TARGET binding site such as BINDING SITE I, BINDING SITE II or BINDING SITE III. Table 2 illustrates the complementarity of the nucleotide sequences of TCL1A BINDING SITE, designated SEQ ID:22498, to the nucleotide sequence of VGAM1011 RNA, herein designated VGAM RNA, also designated SEQ ID:3722.

Another function of VGAM1011 is therefore inhibition of T-cell Leukemia/lymphoma 1A (TCL1A, Accession NM_021966). Accordingly, utilities of VGAM1011 include diagnosis, prevention and treatment of diseases and clinical conditions associated with TCL1A. Calpain 6 (CAPN6, Accession NM_014289) is another VGAM1011 host target gene. CAPN6 BINDING SITE is HOST TARGET binding site found in the 3' untranslated region of mRNA encoded by CAPN6, corresponding to a HOST TARGET binding site such as BINDING SITE I, BINDING SITE II or BINDING SITE III. Table 2 illustrates the complementarity of the nucleotide sequences of CAPN6 BINDING SITE, designated SEQ ID:15569, to the nucleotide sequence of VGAM1011 RNA, herein designated VGAM RNA, also designated SEQ ID:3722.

Another function of VGAM1011 is therefore inhibition of Calpain 6 (CAPN6, Accession NM_014289). Accordingly, utilities of VGAM1011 include diagnosis, prevention and treatment of diseases and clinical conditions associated with CAPN6. FLJ11127 (Accession NM_019018) is another VGAM1011 host target gene. FLJ11127 BINDING SITE is HOST TARGET binding site found in the 3' untranslated region of mRNA encoded by FLJ11127, corresponding to a HOST TARGET binding site such as BINDING SITE I, BINDING SITE II or BINDING SITE III. Table 2 illustrates the complementarity of the nucleotide sequences of FLJ11127 BINDING SITE, designated SEQ ID:21108, to the nucleotide sequence of VGAM1011 RNA, herein designated VGAM RNA, also designated SEQ ID:3722.

Another function of VGAM1011 is therefore inhibition of FLJ11127 (Accession NM_019018). Accordingly, utilities of VGAM1011 include diagnosis, prevention and treatment of diseases and clinical conditions associated with FLJ11127. KIAA1971 (Accession XM_058720) is another VGAM1011 host target gene. KIAA1971 BINDING SITE is HOST TARGET binding site found in the 3' untranslated region of mRNA encoded by KIAA1971, corresponding to a HOST TARGET binding site such as BINDING SITE I, BINDING SITE II or BINDING SITE III. Table 2 illustrates the complementarity of the nucleotide sequences of KIAA1971 BINDING SITE, designated SEQ ID:36726, to the nucleotide sequence of VGAM1011 RNA, herein designated VGAM RNA, also designated SEQ ID:3722.

Another function of VGAM1011 is therefore inhibition of KIAA1971 (Accession XM_058720). Accordingly, utilities of VGAM1011 include diagnosis, prevention and treatment of diseases and clinical conditions associated with KIAA1971. LOC146756 (Accession XM_097085) is another VGAM1011 host target gene. LOC146756 BINDING SITE is HOST TARGET binding site found in the 3' untranslated region of mRNA encoded by LOC146756, corresponding to a HOST TARGET binding site such as BINDING SITE I, BINDING SITE II or BINDING SITE III. Table 2 illustrates the complementarity of the nucleotide sequences of LOC146756 BINDING SITE, designated SEQ ID:40733, to the nucleotide sequence of VGAM1011 RNA, herein designated VGAM RNA, also designated SEQ ID:3722.

Another function of VGAM1011 is therefore inhibition of LOC146756 (Accession XM_097085). Accordingly, utilities of VGAM1011 include diagnosis, prevention and treatment of diseases and clinical conditions associated with LOC146756. LOC254015 (Accession XM_172977) is another VGAM1011 host target gene. LOC254015 BINDING SITE is HOST TARGET binding site found in the 3' untranslated region of mRNA encoded by LOC254015, corresponding to a HOST TARGET binding site such as BINDING SITE I, BINDING SITE II or BINDING SITE III. Table 2 illustrates the complementarity of the nucleotide sequences of LOC254015 BINDING SITE, designated SEQ ID:46241, to the nucleotide sequence of VGAM1011 RNA, herein designated VGAM RNA, also designated SEQ ID:3722.

Another function of VGAM1011 is therefore inhibition of LOC254015 (Accession XM_172977). Accordingly, utilities of VGAM1011 include diagnosis, prevention and treatment of diseases and clinical conditions associated with LOC254015. FIG. 1 further provides a conceptual description of a novel bioinformatically detected viral gene of the present invention, referred to here as Viral Genomic Address Messenger 1012 (VGAM1012) viral gene, which modulates expression of respective host target genes thereof, the function and utility of which host target genes is known in the art.

VGAM1012 is a novel bioinformatically detected regulatory, non protein coding, viral micro RNA (miRNA) gene. The method by which VGAM1012 was detected is described hereinabove with reference to FIGS. 1-8.

VGAM1012 gene, herein designated VGAM GENE, is a viral gene contained in the genome of Equine Herpesvirus 1. VGAM1012 host target gene, herein designated VGAM HOST TARGET GENE, is a human gene contained in the human genome.

VGAM1012 gene encodes a VGAM1012 precursor RNA, herein designated VGAM PRECURSOR RNA. Similar to other miRNA genes, and unlike most ordinary genes, VGAM1012 precursor RNA does not encode a protein. A nucleotide sequence identical or highly similar to the nucleotide sequence of VGAM1012 precursor RNA is designated SEQ ID:998, and is provided hereinbelow with reference to the sequence listing part. Nucleotide sequence SEQ ID:998 is located at position 27830 relative to the genome of Equine Herpesvirus 1.

VGAM1012 precursor RNA folds onto itself, forming VGAM1012 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1012 folded precursor RNA into VGAM1012 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1012 RNA is designated SEQ ID:3723, and is provided hereinbelow with reference to the sequence listing part.

VGAM1012 host target gene, herein designated VGAM HOST TARGET GENE, encodes a corresponding messenger RNA, VGAM1012 host target RNA, herein designated VGAM HOST TARGET RNA. VGAM1012 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1012 RNA, herein designated VGAM RNA, binds complementarily to one or more host target binding sites located in untranslated regions of VGAM1012 host target RNA, herein designated VGAM HOST TARGET RNA. This complementary binding is due to the fact that the nucleotide sequence of VGAM1012 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1012 RNA, herein designated VGAM RNA, may have a different number of host target binding sites in untranslated regions of a VGAM1012 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1012 RNA, herein designated VGAM RNA, to host target binding sites on VGAM1012 host target RNA, herein designated VGAM HOST TARGET RNA, such as BINDING SITE I, BINDING SITE II and BINDING SITE III, inhibits translation of VGAM1012 host target RNA into VGAM1012 host target protein, herein designated VGAM HOST TARGET PROTEIN. VGAM host target protein is therefore outlined by a broken line.

It is appreciated that VGAM1012 host target gene, herein designated VGAM HOST TARGET GENE, in fact represents a plurality of VGAM1012 host target genes. The mRNA of each one of this plurality of VGAM1012 host target genes comprises one or more host target binding sites, each having a nucleotide sequence which is at least partly complementary to VGAM1012 RNA, herein designated VGAM RNA, and which when bound by VGAM1012 RNA causes inhibition of translation of respective one or more VGAM1012 host target proteins.

It is further appreciated by one skilled in the art that the mode of translational inhibition illustrated by FIG. 1 with specific reference to translational inhibition exerted by VGAM1012 gene, herein designated VGAM GENE, on one or more VGAM1012 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1012 is inhibition of expression of host target genes, as part of a novel viral mechanism of attacking a host. Accordingly, utilities of VGAM1012 include diagnosis, prevention and treatment of viral infection by Equine Herpesvirus 1. Specific functions, and accordingly utilities, of VGAM1012 correlate with, and may be deduced from, the identity of the host target genes which VGAM1012 binds and inhibits, and the function of these host target genes, as elaborated hereinbelow.

Nucleotide sequences of the VGAM1012 precursor RNA, herein designated VGAM PRECURSOR RNA, and of the 'diced' VGAM1012 RNA, herein designated VGAM RNA, and a schematic representation of the secondary folding of VGAM1012 folded precursor RNA, herein designated VGAM FOLDED PRECURSOR RNA, of VGAM1012 are further described hereinbelow with reference to Table 1.

Nucleotide sequences of host target binding sites, such as BINDING SITE-I, BINDING SITE-II and BINDING SITE-III of FIG. 1, found on VGAM1012 host target RNA, and schematic representation of the complementarity of each of these host target binding sites to VGAM1012 RNA, herein designated VGAM RNA, are described hereinbelow with reference to Table 2.

As mentioned hereinabove with reference to FIG. 1, a function of VGAM1012 gene, herein designated VGAM is inhibition of expression of VGAM1012 target genes. It is appreciated that specific functions, and accordingly utilities, of VGAM1012 correlate with, and may be deduced from, the identity of the target genes which VGAM1012 binds and inhibits, and the function of these target genes, as elaborated hereinbelow.

Collagen, Type XVIII, Alpha 1 (COL18A1, Accession NM_030582) is a VGAM1012 host target gene. COL18A1 BINDING SITE1 through COL18A1 BINDING SITE3 are HOST TARGET binding sites found in untranslated regions of mRNA encoded by COL18A1, corresponding to HOST TARGET binding sites such as BINDING SITE I, BINDING SITE II or BINDING SITE III. Table 2 illustrates the complementarity of the nucleotide sequences of COL18A1 BINDING SITE1 through COL18A1 BINDING SITE3, designated SEQ ID:24955, SEQ ID:28206 and SEQ ID:28207 respectively, to the nucleotide sequence of VGAM1012 RNA, herein designated VGAM RNA, also designated SEQ ID:3723.

A function of VGAM1012 is therefore inhibition of Collagen, Type XVIII, Alpha 1 (COL18A1, Accession NM_030582). Accordingly, utilities of VGAM1012 include diagnosis, prevention and treatment of diseases and clinical conditions associated with COL18A1. EFS2 (Accession NM_005864) is another VGAM1012 host target gene. EFS2 BINDING SITE is HOST TARGET binding site found in the 3' untranslated region of mRNA encoded by EFS2, corresponding to a HOST TARGET binding site such as BINDING SITE I, BINDING SITE II or BINDING SITE III. Table 2 illustrates the complementarity of the nucleotide sequences of EFS2 BINDING SITE, designated SEQ ID:12479, to the nucleotide sequence of VGAM1012 RNA, herein designated VGAM RNA, also designated SEQ ID:3723.

Another function of VGAM1012 is therefore inhibition of EFS2 (Accession NM_005864). Accordingly, utilities of VGAM1012 include diagnosis, prevention and treatment of diseases and clinical conditions associated with EFS2. FLJ21032 (Accession NM_024906) is another VGAM1012 host target gene. FLJ21032 BINDING SITE is HOST TARGET binding site found in the 3' untranslated region of mRNA encoded by FLJ21032, corresponding to a HOST TARGET binding site such as BINDING SITE I, BINDING SITE II or BINDING SITE III. Table 2 illustrates the complementarity of the nucleotide sequences of FLJ21032 BINDING SITE, designated SEQ ID:24402, to the nucleotide sequence of VGAM1012 RNA, herein designated VGAM RNA, also designated SEQ ID:3723.

Another function of VGAM1012 is therefore inhibition of FLJ21032 (Accession NM_024906). Accordingly, utilities of VGAM1012 include diagnosis, prevention and treatment of diseases and clinical conditions associated with FLJ21032. FLJ23120 (Accession XM_097961) is another VGAM1012 host target gene. FLJ23120 BINDING SITE is HOST TARGET binding site found in the 3' untranslated region of mRNA encoded by FLJ23120, corresponding to a HOST TARGET binding site such as BINDING SITE I, BINDING SITE II or BINDING SITE III. Table 2 illustrates the complementarity of the nucleotide sequences of FLJ23120 BINDING SITE, designated SEQ ID:41266, to the nucleotide sequence of VGAM1012 RNA, herein designated VGAM RNA, also designated SEQ ID:3723.

Another function of VGAM1012 is therefore inhibition of FLJ23120 (Accession XM_097961). Accordingly, utilities of VGAM1012 include diagnosis, prevention and treatment of diseases and clinical conditions associated with FLJ23120. KIAA0379 (Accession XM_042860) is another VGAM1012 host target gene. KIAA0379 BINDING SITE is HOST TARGET binding site found in the 5' untranslated region of mRNA encoded by KIAA0379, corresponding to a HOST TARGET binding site such as BINDING SITE I, BINDING SITE II or BINDING SITE III. Table 2 illustrates the complementarity of the nucleotide sequences of KIAA0379 BINDING SITE, designated SEQ ID:33810, to the nucleotide sequence of VGAM1012 RNA, herein designated VGAM RNA, also designated SEQ ID:3723.

Another function of VGAM1012 is therefore inhibition of KIAA0379 (Accession XM_042860). Accordingly, utilities of VGAM1012 include diagnosis, prevention and treatment of diseases and clinical conditions associated with KIAA0379. LAP1B (Accession XM_035429) is another VGAM1012 host target gene. LAP1B BINDING SITE is HOST TARGET binding site found in the 3' untranslated region of mRNA encoded by LAP1B, corresponding to a HOST TARGET binding site such as BINDING SITE I, BINDING SITE II or BINDING SITE III. Table 2 illustrates the complementarity of the nucleotide sequences of LAP1B BINDING SITE, designated SEQ ID:32263, to the nucleotide sequence of VGAM1012 RNA, herein designated VGAM RNA, also designated SEQ ID:3723.

Another function of VGAM1012 is therefore inhibition of LAP1B (Accession XM_035429). Accordingly, utilities of VGAM1012 include diagnosis, prevention and treatment of diseases and clinical conditions associated with LAP1B. PBEF (Accession NM_005746) is another VGAM1012 host target gene. PBEF BINDING SITE is HOST TARGET binding site found in the 3' untranslated region of mRNA encoded by PBEF, corresponding to a HOST TARGET binding site such as BINDING SITE I, BINDING SITE II or BINDING SITE III. Table 2 illustrates the complementarity of the nucleotide sequences of PBEF BINDING SITE, designated SEQ ID:12307, to the nucleotide sequence of VGAM1012 RNA, herein designated VGAM RNA, also designated SEQ ID:3723.

Another function of VGAM1012 is therefore inhibition of PBEF (Accession NM_005746). Accordingly, utilities of VGAM1012 include diagnosis, prevention and treatment of diseases and clinical conditions associated with PBEF. FIG. 1 further provides a conceptual description of a novel bioinformatically detected viral gene of the present invention, referred to here as Viral Genomic Address Messenger 1013 (VGAM1013) viral gene, which modulates expression of respective host target genes thereof, the function and utility of which host target genes is known in the art.

VGAM1013 is a novel bioinformatically detected regulatory, non protein coding, viral micro RNA (miRNA) gene. The method by which VGAM1013 was detected is described hereinabove with reference to FIGS. 1-8.

VGAM1013 gene, herein designated VGAM GENE, is a viral gene contained in the genome of Equine Herpesvirus 1. VGAM1013 host target gene, herein designated VGAM HOST TARGET GENE, is a human gene contained in the human genome.

VGAM1013 gene encodes a VGAM1013 precursor RNA, herein designated VGAM PRECURSOR RNA. Similar to other miRNA genes, and unlike most ordinary genes, VGAM1013 precursor RNA does not encode a protein. A nucleotide sequence identical or highly similar to the nucleotide sequence of VGAM1013 precursor RNA is designated SEQ ID:999, and is provided hereinbelow with reference to the sequence listing part. Nucleotide sequence SEQ ID:999 is located at position 32583 relative to the genome of Equine Herpesvirus 1.

VGAM1013 precursor RNA folds onto itself, forming VGAM1013 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1013 folded precursor RNA into VGAM1013 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 86%) nucleotide sequence of VGAM1013 RNA is designated SEQ ID:3724, and is provided hereinbelow with reference to the sequence listing part.

VGAM1013 host target gene, herein designated VGAM HOST TARGET GENE, encodes a corresponding messenger RNA, VGAM1013 host target RNA, herein designated VGAM HOST TARGET RNA. VGAM1013 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1013 RNA, herein designated VGAM RNA, binds complementarily to one or more host target binding sites located in untranslated regions of VGAM1013 host target RNA, herein designated VGAM HOST TARGET RNA. This complementary binding is due to the fact that the nucleotide sequence of VGAM1013 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1013 RNA, herein designated VGAM RNA, may have a different number of host target binding sites in untranslated regions of a VGAM1013 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1013 RNA, herein designated VGAM RNA, to host target binding sites on VGAM1013 host target RNA, herein designated VGAM HOST TARGET RNA, such as BINDING SITE I, BINDING SITE II and BINDING SITE III, inhibits translation of VGAM1013 host target RNA into VGAM1013 host target protein, herein designated VGAM HOST TARGET PROTEIN. VGAM host target protein is therefore outlined by a broken line.

It is appreciated that VGAM1013 host target gene, herein designated VGAM HOST TARGET GENE, in fact represents a plurality of VGAM1013 host target genes. The mRNA of each one of this plurality of VGAM1013 host target genes comprises one or more host target binding sites, each having a nucleotide sequence which is at least partly complementary to VGAM1013 RNA, herein designated VGAM RNA, and which when bound by VGAM1013 RNA causes inhibition of translation of respective one or more VGAM1013 host target proteins.

It is further appreciated by one skilled in the art that the mode of translational inhibition illustrated by FIG. 1 with specific reference to translational inhibition exerted by VGAM1013 gene, herein designated VGAM GENE, on one or more VGAM1013 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1013 is inhibition of expression of host target genes, as part of a novel viral mechanism of attacking a host. Accordingly, utilities of VGAM1013 include diagnosis, prevention and treatment of viral infection by Equine Herpesvirus 1. Specific functions, and accordingly utilities, of VGAM1013 correlate with, and may be deduced from, the identity of the host target genes which VGAM1013 binds and inhibits, and the function of these host target genes, as elaborated hereinbelow.

Nucleotide sequences of the VGAM1013 precursor RNA, herein designated VGAM PRECURSOR RNA, and of the 'diced' VGAM1013 RNA, herein designated VGAM RNA, and a schematic representation of the secondary folding of VGAM1013 folded precursor RNA, herein designated VGAM FOLDED PRECURSOR RNA, of VGAM1013 are further described hereinbelow with reference to Table 1.

Nucleotide sequences of host target binding sites, such as BINDING SITE-I, BINDING SITE-II and BINDING SITE-III of FIG. 1, found on VGAM1013 host target RNA, and schematic representation of the complementarity of each of these host target binding sites to VGAM1013 RNA, herein designated VGAM RNA, are described hereinbelow with reference to Table 2.

As mentioned hereinabove with reference to FIG. 1, a function of VGAM1013 gene, herein designated VGAM is inhibition of expression of VGAM1013 target genes. It is appreciated that specific functions, and accordingly utilities, of VGAM1013 correlate with, and may be deduced from, the identity of the target genes which VGAM1013 binds and inhibits, and the function of these target genes, as elaborated hereinbelow.

DKFZP434O047 (Accession NM_015594) is a VGAM1013 host target gene. DKFZP434O047 BINDING SITE is HOST TARGET binding site found in the 5' untranslated region of mRNA encoded by DKFZP434O047, corresponding to a HOST TARGET binding site such as BINDING SITE I, BINDING SITE II or BINDING SITE III. Table 2 illustrates the complementarity of the nucleotide sequences of DKFZP434O047 BINDING SITE, designated SEQ ID:17859, to the nucleotide sequence of VGAM1013 RNA, herein designated VGAM RNA, also designated SEQ ID:3724.

A function of VGAM1013 is therefore inhibition of DKFZP434O047 (Accession NM_015594). Accordingly, utilities of VGAM1013 include diagnosis, prevention and treatment of diseases and clinical conditions associated with DKFZP434O047. FLJ32894 (Accession NM_144667) is another VGAM1013 host target gene. FLJ32894 BINDING SITE is HOST TARGET binding site found in the 3' untranslated region of mRNA encoded by FLJ32894, corresponding to a HOST TARGET binding site such as BINDING SITE I, BINDING SITE II or BINDING SITE III. Table 2 illustrates the complementarity of the nucleotide sequences of FLJ32894 BINDING SITE, designated SEQ ID:29484, to the nucleotide sequence of VGAM1013 RNA, herein designated VGAM RNA, also designated SEQ ID:3724.

Another function of VGAM1013 is therefore inhibition of FLJ32894 (Accession NM_144667). Accordingly, utilities of VGAM1013 include diagnosis, prevention and treatment of diseases and clinical conditions associated with FLJ32894. LOC151248 (Accession XM_087143) is another VGAM1013 host target gene. LOC151248 BINDING SITE is HOST TARGET binding site found in the 5' untranslated region of mRNA encoded by LOC151248, corresponding to a HOST TARGET binding site such as BINDING SITE I, BINDING SITE II or BINDING SITE III. Table 2 illustrates the complementarity of the nucleotide sequences of LOC151248 BINDING SITE, designated SEQ ID:39084, to the nucleotide sequence of VGAM1013 RNA, herein designated VGAM RNA, also designated SEQ ID:3724.

Another function of VGAM1013 is therefore inhibition of LOC151248 (Accession XM_087143). Accordingly, utilities of VGAM1013 include diagnosis, prevention and treatment of diseases and clinical conditions associated with LOC151248. FIG. 1 further provides a conceptual description of a novel bioinformatically detected viral gene of the present invention, referred to here as Viral Genomic Address Messenger 1014 (VGAM1014) viral gene, which modulates expression of respective host target genes thereof, the function and utility of which host target genes is known in the art.

VGAM1014 is a novel bioinformatically detected regulatory, non protein coding, viral micro RNA (miRNA) gene. The method by which VGAM1014 was detected is described hereinabove with reference to FIGS. 1-8.

VGAM1014 gene, herein designated VGAM GENE, is a viral gene contained in the genome of Rana Tigrina Ranavirus. VGAM1014 host target gene, herein designated VGAM HOST TARGET GENE, is a human gene contained in the human genome.

VGAM1014 gene encodes a VGAM1014 precursor RNA, herein designated VGAM PRECURSOR RNA. Similar to other miRNA genes, and unlike most ordinary genes, VGAM1014 precursor RNA does not encode a protein. A nucleotide sequence identical or highly similar to the nucleotide sequence of VGAM1014 precursor RNA is designated SEQ ID:1000, and is provided hereinbelow with reference to the sequence listing part. Nucleotide sequence SEQ ID:1000 is located at position 82653 relative to the genome of Rana Tigrina Ranavirus.

VGAM1014 precursor RNA folds onto itself, forming VGAM1014 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1014 folded precursor RNA into VGAM1014 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1014 RNA is designated SEQ ID:3725, and is provided hereinbelow with reference to the sequence listing part.

VGAM1014 host target gene, herein designated VGAM HOST TARGET GENE, encodes a corresponding messenger RNA, VGAM1014 host target RNA, herein designated VGAM HOST TARGET RNA. VGAM1014 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1014 RNA, herein designated VGAM RNA, binds complementarily to one or more host target binding sites located in untranslated regions of VGAM1014 host target RNA, herein designated VGAM HOST TARGET RNA. This complementary binding is due to the fact that the nucleotide sequence of VGAM1014 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1014 RNA, herein designated VGAM RNA, may have a different number of host target binding sites in untranslated regions of a VGAM1014 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1014 RNA, herein designated VGAM RNA, to host target binding sites on VGAM1014 host target RNA, herein designated VGAM HOST TARGET RNA, such as BINDING SITE I, BINDING SITE II and BINDING SITE III, inhibits translation of VGAM1014 host target RNA into VGAM1014 host target protein, herein designated VGAM HOST TARGET PROTEIN. VGAM host target protein is therefore outlined by a broken line.

It is appreciated that VGAM1014 host target gene, herein designated VGAM HOST TARGET GENE, in fact represents a plurality of VGAM1014 host target genes. The mRNA of each one of this plurality of VGAM1014 host target genes comprises one or more host target binding sites, each having a nucleotide sequence which is at least partly complementary to VGAM1014 RNA, herein designated VGAM RNA, and which when bound by VGAM1014 RNA causes inhibition of translation of respective one or more VGAM1014 host target proteins.

It is further appreciated by one skilled in the art that the mode of translational inhibition illustrated by FIG. 1 with specific reference to translational inhibition exerted by VGAM1014 gene, herein designated VGAM GENE, on one or more VGAM1014 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1014 is inhibition of expression of host target genes, as part of a novel viral mechanism of attacking a host. Accordingly, utilities of VGAM1014 include diagnosis, prevention and treatment of viral infection by Rana Tigrina Ranavirus. Specific functions, and accordingly utilities, of VGAM1014 correlate with, and may be deduced from, the identity of the host target genes which VGAM1014 binds and inhibits, and the function of these host target genes, as elaborated hereinbelow.

Nucleotide sequences of the VGAM1014 precursor RNA, herein designated VGAM PRECURSOR RNA, and of the 'diced' VGAM1014 RNA, herein designated VGAM RNA, and a schematic representation of the secondary folding of VGAM1014 folded precursor RNA, herein designated VGAM FOLDED PRECURSOR RNA, of VGAM1014 are further described hereinbelow with reference to Table 1.

Nucleotide sequences of host target binding sites, such as BINDING SITE-I, BINDING SITE-II and BINDING SITE-III of FIG. 1, found on VGAM1014 host target RNA, and schematic representation of the complementarity of each of these host target binding sites to VGAM1014 RNA, herein designated VGAM RNA, are described hereinbelow with reference to Table 2.

As mentioned hereinabove with reference to FIG. 1, a function of VGAM1014 gene, herein designated VGAM is inhibition of expression of VGAM1014 target genes. It is appreciated that specific functions, and accordingly utilities, of VGAM1014 correlate with, and may be deduced from, the identity of the target genes which VGAM1014 binds and inhibits, and the function of these target genes, as elaborated hereinbelow.

Chromosome 6 Open Reading Frame 37 (C6orf37, Accession XM_041375) is a VGAM1014 host target gene. C6orf37 BINDING SITE is HOST TARGET binding site found in the 3' untranslated region of mRNA encoded by C6orf37, corresponding to a HOST TARGET binding site such as BINDING SITE I, BINDING SITE II or BINDING SITE III. Table 2 illustrates the complementarity of the nucleotide sequences of C6orf37 BINDING SITE, designated SEQ ID:33510, to the nucleotide sequence of VGAM1014 RNA, herein designated VGAM RNA, also designated SEQ ID:3725.

A function of VGAM1014 is therefore inhibition of Chromosome 6 Open Reading Frame 37 (C6orf37, Accession XM_041375). Accordingly, utilities of VGAM1014 include diagnosis, prevention and treatment of diseases and clinical conditions associated with C6orf37. LOC196761 (Accession XM_116865) is another VGAM1014 host target gene. LOC196761 BINDING SITE is HOST TARGET binding site found in the 5' untranslated region of mRNA encoded by LOC196761, corresponding to a HOST TARGET binding site such as BINDING SITE I, BINDING SITE II or BINDING SITE III. Table 2 illustrates the complementarity of the nucleotide sequences of LOC196761 BINDING SITE, designated SEQ ID:43127, to the nucleotide sequence of VGAM1014 RNA, herein designated VGAM RNA, also designated SEQ ID:3725.

Another function of VGAM1014 is therefore inhibition of LOC196761 (Accession XM_116865). Accordingly, utilities of VGAM1014 include diagnosis, prevention and treatment of diseases and clinical conditions associated with LOC196761. LOC200609 (Accession XM_117256) is another VGAM1014 host target gene. LOC200609 BINDING SITE is HOST TARGET binding site found in the 3' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43326, to the nucleotide sequence of VGAM1014 RNA, herein designated VGAM RNA, also designated SEQ ID:3725.

Another function of VGAM1014 is therefore inhibition of LOC200609 (Accession XM_117256). Accordingly, utilities of VGAM1014 include diagnosis, prevention and treatment of diseases and clinical conditions associated with LOC200609. FIG. 1 further provides a conceptual description of a novel bioinformatically detected viral gene of the present invention, referred to here as Viral Genomic Address Messenger 1015 (VGAM1015) viral gene, which modulates expression of respective host target genes thereof, the function and utility of which host target genes is known in the art.

VGAM1015 is a novel bioinformatically detected regulatory, non protein coding, viral micro RNA (miRNA) gene. The method by which VGAM1015 was detected is described hereinabove with reference to FIGS. 1-8.

VGAM1015 gene, herein designated VGAM GENE, is a viral gene contained in the genome of Broad Bean Necrosis Virus. VGAM1015 host target gene, herein designated VGAM HOST TARGET GENE, is a human gene contained in the human genome.

VGAM1015 gene encodes a VGAM1015 precursor RNA, herein designated VGAM PRECURSOR RNA. Similar to other miRNA genes, and unlike most ordinary genes, VGAM1015 precursor RNA does not encode a protein. A nucleotide sequence identical or highly similar to the nucleotide sequence of VGAM1015 precursor RNA is designated SEQ ID:1001, and is provided hereinbelow with reference to the sequence listing part. Nucleotide sequence SEQ ID:1001 is located at position 1200 relative to the genome of Broad Bean Necrosis Virus.

VGAM1015 precursor RNA folds onto itself, forming VGAM1015 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1015 folded precursor RNA into VGAM1015 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1015 RNA is designated SEQ ID:3726, and is provided hereinbelow with reference to the sequence listing part.

VGAM1015 host target gene, herein designated VGAM HOST TARGET GENE, encodes a corresponding messenger RNA, VGAM1015 host target RNA, herein designated VGAM HOST TARGET RNA. VGAM1015 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1015 RNA, herein designated VGAM RNA, binds complementarily to one or more host target binding sites located in untranslated regions of VGAM1015 host target RNA, herein designated VGAM HOST TARGET RNA. This complementary binding is due to the fact that the nucleotide sequence of VGAM1015 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1015 RNA, herein designated VGAM RNA, may have a different number of host target binding sites in untranslated regions of a VGAM1015 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1015 RNA, herein designated VGAM RNA, to host target binding sites on VGAM1015 host target RNA, herein designated VGAM HOST TARGET RNA, such as BINDING SITE I, BINDING SITE II and BINDING SITE III, inhibits translation of VGAM1015 host target RNA into VGAM1015 host target protein, herein designated VGAM HOST TARGET PROTEIN. VGAM host target protein is therefore outlined by a broken line.

It is appreciated that VGAM1015 host target gene, herein designated VGAM HOST TARGET GENE, in fact represents a plurality of VGAM1015 host target genes. The mRNA of each one of this plurality of VGAM1015 host target genes comprises one or more host target binding sites, each having a nucleotide sequence which is at least partly complementary to VGAM1015 RNA, herein designated VGAM RNA, and which when bound by VGAM1015 RNA causes inhibition of translation of respective one or more VGAM1015 host target proteins.

It is further appreciated by one skilled in the art that the mode of translational inhibition illustrated by FIG. 1 with specific reference to translational inhibition exerted by VGAM1015 gene, herein designated VGAM GENE, on one or more VGAM1015 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1015 is inhibition of expression of host target genes, as part of a novel viral mechanism of attacking a host. Accordingly, utilities of VGAM1015 include diagnosis, prevention and treatment of viral infection by Broad Bean Necrosis Virus. Specific functions, and accordingly utilities, of VGAM1015 correlate with, and may be deduced from, the identity of the host target genes which VGAM1015 binds and inhibits, and the function of these host target genes, as elaborated hereinbelow.

Nucleotide sequences of the VGAM1015 precursor RNA, herein designated VGAM PRECURSOR RNA, and of the 'diced' VGAM1015 RNA, herein designated VGAM RNA, and a schematic representation of the secondary folding of VGAM1015 folded precursor RNA, herein designated VGAM FOLDED PRECURSOR RNA, of VGAM1015 are further described hereinbelow with reference to Table 1.

Nucleotide sequences of host target binding sites, such as BINDING SITE-I, BINDING SITE-II and BINDING SITE-III of FIG. 1, found on VGAM1015 host target RNA, and schematic representation of the complementarity of each of these host target binding sites to VGAM1015 RNA, herein designated VGAM RNA, are described hereinbelow with reference to Table 2.

As mentioned hereinabove with reference to FIG. 1, a function of VGAM1015 gene, herein designated VGAM is inhibition of expression of VGAM1015 target genes. It is appreciated that specific functions, and accordingly utilities, of VGAM1015 correlate with, and may be deduced from, the identity of the target genes which VGAM1015 binds and inhibits, and the function of these target genes, as elaborated hereinbelow.

Endothelin 2 (EDN2, Accession NM_001956) is a VGAM1015 host target gene. EDN2 BINDING SITE is HOST TARGET binding site found in the 3' untranslated region of mRNA encoded by EDN2, corresponding to a HOST TARGET binding site such as BINDING SITE I, BINDING SITE II or BINDING SITE III. Table 2 illustrates the complementarity of the nucleotide sequences of EDN2 BINDING SITE, designated SEQ ID:7680, to the nucleotide sequence of VGAM1015 RNA, herein designated VGAM RNA, also designated SEQ ID:3726.

A function of VGAM1015 is therefore inhibition of Endothelin 2 (EDN2, Accession NM_001956), a gene which is a precursor of the hormone endothelin 2 which is an endothelium-derived vasoconstrictor peptide. Accordingly, utilities of VGAM1015 include diagnosis, prevention and treatment of diseases and clinical conditions associated with EDN2. The function of EDN2 has been established by previous studies. The human endothelins represent a gene family comprised of endothelin-1 (OMIM Ref. No. 131240), endothelin-2, and endothelin-3 (OMIM Ref. No. 131242). Based on the deduced amino acid sequences of the cloned ET2 and ET3 genes, corresponding proteins have been chemically synthesized and their vasoconstrictor activities studied. Of the 3 isopeptides, ET-2 has the most potent vasoconstrictor activity. Ohkubo et al. (1990) cloned cDNAs encoding human ET-2 precursor from a cDNA library constructed with mRNA derived from the human renal adenocarcinoma cell line, ACHN, which specifically secretes immunoreactive ET-2. The cDNA was found to contain 1.3 kb and to encode the preproprotein consisting of 178 amino acid residues. Northern blot analysis of mRNA suggested that the transcript was 1.4 kb. Bloch et al. (1991) used a cDNA clone for endothelin-2 to map the EDN2 gene to 1pter-p21 in human-mouse somatic cell hybrids. Southern blot hybridization demonstrated a single gene in both the human and the rat genome. Bloch et al. (1991) cloned the rat gene; the rat peptide differed from the human peptide at only 1 of 21 residues and was identical to mouse vasoactive intestinal contractor peptide (VIC). They concluded, therefore, that VIC is the mouse and rat analog of the human EDN2 gene. By Southern blot analysis of somatic cell hybrid DNAs and by in situ hybridization, Arinami et al. (1991) confirmed the assignment of EDN2 to chromosome 1 and regionalized it to 1p34. Deng et al. (1994) found in the rat that the endothelin-2 gene is located on chromosome 5 and cosegregates strongly with systolic blood pressure in an F2 population derived from a cross of the Dahl salt-sensitive rat and the Lewis rat. Thus, ET2 is a quantitative trait locus (QTL) for blood pressure in the rat. ET1, ET3, and endothelin receptor type A (ETA; 131243) in the rat did not cosegregate with blood pressure in the several F2 populations tested.

Full details of the abovementioned studies are described in the following publications, the disclosure of which are hereby incorporated by reference:

Bloch, K. D.; Hong, C. C.; Eddy, R. L.; Shows, T. B.; Quertermous, T.: cDNA cloning and chromosomal assignment of the endothelin 2 gene: vasoactive intestinal contractor peptide is rat endothelin 2. Genomics 10:236-242, 1991; and Deng, A. Y.; Dene, H.; Pravenec, M.; Rapp, J. P.: Genetic mapping of two new blood pressure quantitative trait loci in the rat by genotyping endothelin system genes. J. Clin. Invest. 93.

Further studies establishing the function and utilities of EDN2 are found in John Hopkins OMIM database record ID 131241, and in sited publications numbered 12211-2289 listed in the bibliography section hereinbelow, which are also hereby incorporated by reference. Solute Carrier Family 20 (phosphate transporter), Member 2 (SLC20A2, Accession NM_006749) is another VGAM1015 host target gene. SLC20A2 BINDING SITE is HOST TARGET binding site found in the 5' untranslated region of mRNA encoded by SLC20A2, corresponding to a HOST TARGET binding site such as BINDING SITE I, BINDING SITE II or BINDING SITE III. Table 2 illustrates the complementarity of the nucleotide sequences of SLC20A2 BINDING SITE, designated SEQ ID:13602, to the nucleotide sequence of VGAM1015 RNA, herein designated VGAM RNA, also designated SEQ ID:3726.

Another function of VGAM1015 is therefore inhibition of Solute Carrier Family 20 (phosphate transporter), Member 2 (SLC20A2, Accession NM_006749), a gene which is a sodium-phosphate symporter. Accordingly, utilities of VGAM1015 include diagnosis, prevention and treatment of diseases and clinical conditions associated with SLC20A2. The function of SLC20A2 and its association with various diseases and clinical conditions, has been established by previous studies, as described hereinabove with reference to VGAM232. FLJ13231 (Accession NM_023073) is another VGAM1015 host target gene. FLJ13231 BINDING SITE is HOST TARGET binding site found in the 3' untranslated region of mRNA encoded by FLJ13231, corresponding to a HOST TARGET binding site such as BINDING SITE I, BINDING SITE II or BINDING SITE III. Table 2 illustrates the complementarity of the nucleotide sequences of FLJ13231 BINDING SITE, designated SEQ ID:23329, to the nucleotide sequence of VGAM1015 RNA, herein designated VGAM RNA, also designated SEQ ID:3726.

Another function of VGAM1015 is therefore inhibition of FLJ13231 (Accession NM_023073). Accordingly, utilities of VGAM1015 include diagnosis, prevention and treatment of diseases and clinical conditions associated with FLJ13231. KIAA0981 (Accession XM_028867) is another VGAM1015 host target gene. KIAA0981 BINDING SITE is HOST TARGET binding site found in the 3' untranslated region of mRNA encoded by KIAA0981, corresponding to a HOST TARGET binding site such as BINDING SITE I, BINDING SITE II or BINDING SITE III. Table 2 illustrates the complementarity of the nucleotide sequences of KIAA0981 BINDING SITE, designated SEQ ID:30795, to the nucleotide sequence of VGAM1015 RNA, herein designated VGAM RNA, also designated SEQ ID:3726.

Another function of VGAM1015 is therefore inhibition of KIAA0981 (Accession XM_028867). Accordingly, utilities of VGAM1015 include diagnosis, prevention and treatment of diseases and clinical conditions associated with KIAA0981. LOC148014 (Accession XM_085999) is another VGAM1015 host target gene. LOC148014 BINDING SITE is HOST TARGET binding site found in the 3' untranslated region of mRNA encoded by LOC148014, corresponding to a HOST TARGET binding site such as BINDING SITE I, BINDING SITE II or BINDING SITE III. Table 2 illustrates the complementarity of the nucleotide sequences of LOC148014 BINDING SITE, designated SEQ ID:38441, to the nucleotide sequence of VGAM1015 RNA, herein designated VGAM RNA, also designated SEQ ID:3726.

Another function of VGAM1015 is therefore inhibition of LOC148014 (Accession XM_085999). Accordingly, utilities of VGAM1015 include diagnosis, prevention and treatment of diseases and clinical conditions associated with LOC148014. LOC152627 (Accession XM_087495) is another VGAM1015 host target gene. LOC152627 BINDING SITE is HOST TARGET binding site found in the 5' untranslated region of mRNA encoded by LOC152627, corresponding to a HOST TARGET binding site such as BINDING SITE I, BINDING SITE II or BINDING SITE III. Table 2 illustrates the complementarity of the nucleotide sequences of LOC152627 BINDING SITE, designated SEQ ID:39292, to the nucleotide sequence of VGAM1015 RNA, herein designated VGAM RNA, also designated SEQ ID:3726.

Another function of VGAM1015 is therefore inhibition of LOC152627 (Accession XM_087495). Accordingly, utilities of VGAM1015 include diagnosis, prevention and treatment of diseases and clinical conditions associated with LOC152627. FIG. 1 further provides a conceptual description of a novel bioinformatically detected viral gene of the present invention, referred to here as Viral Genomic Address Messenger 1016 (VGAM1016) viral gene, which modulates expression of respective host target genes thereof, the function and utility of which host target genes is known in the art.

VGAM1016 is a novel bioinformatically detected regulatory, non protein coding, viral micro RNA (miRNA) gene. The method by which VGAM1016 was detected is described hereinabove with reference to FIGS. 1-8.

VGAM1016 gene, herein designated VGAM GENE, is a viral gene contained in the genome of Broad Bean Necrosis Virus. VGAM1016 host target gene, herein designated VGAM HOST TARGET GENE, is a human gene contained in the human genome.

VGAM1016 gene encodes a VGAM1016 precursor RNA, herein designated VGAM PRECURSOR RNA. Similar to other miRNA genes, and unlike most ordinary genes, VGAM1016 precursor RNA does not encode a protein. A nucleotide sequence identical or highly similar to the nucleotide sequence of VGAM1016 precursor RNA is designated SEQ ID:1002, and is provided hereinbelow with reference to the sequence listing part. Nucleotide sequence SEQ ID:1002 is located at position 4420 relative to the genome of Broad Bean Necrosis Virus.

VGAM1016 precursor RNA folds onto itself, forming VGAM1016 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1016 folded precursor RNA into VGAM1016 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1016 RNA is designated SEQ ID:3727, and is provided hereinbelow with reference to the sequence listing part.

VGAM1016 host target gene, herein designated VGAM HOST TARGET GENE, encodes a corresponding messenger RNA, VGAM1016 host target RNA, herein designated VGAM HOST TARGET RNA. VGAM1016 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1016 RNA, herein designated VGAM RNA, binds complementarily to one or more host target binding sites located in untranslated regions of VGAM1016 host target RNA, herein designated VGAM HOST TARGET RNA. This complementary binding is due to the fact that the nucleotide sequence of VGAM1016 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1016 RNA, herein designated VGAM RNA, may have a different number of host target binding sites in untranslated regions of a VGAM1016 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1016 RNA, herein designated VGAM RNA, to host target binding sites on VGAM1016 host target RNA, herein designated VGAM HOST TARGET RNA, such as BINDING SITE I, BINDING SITE II and BINDING SITE III, inhibits translation of VGAM1016 host target RNA into VGAM1016 host target protein, herein designated VGAM HOST TARGET PROTEIN. VGAM host target protein is therefore outlined by a broken line.

It is appreciated that VGAM1016 host target gene, herein designated VGAM HOST TARGET GENE, in fact represents a plurality of VGAM1016 host target genes. The mRNA of each one of this plurality of VGAM1016 host target genes comprises one or more host target binding sites, each having a nucleotide sequence which is at least partly complementary to VGAM1016 RNA, herein designated VGAM RNA, and which when bound by VGAM1016 RNA causes inhibition of translation of respective one or more VGAM1016 host target proteins.

It is further appreciated by one skilled in the art that the mode of translational inhibition illustrated by FIG. 1 with specific reference to translational inhibition exerted by VGAM1016 gene, herein designated VGAM GENE, on one or more VGAM1016 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1016 is inhibition of expression of host target genes, as part of a novel viral mechanism of attacking a host. Accordingly, utilities of VGAM1016 include diagnosis, prevention and treatment of viral infection by Broad Bean Necrosis Virus. Specific functions, and accordingly utilities, of VGAM1016 correlate with, and may be deduced from, the identity of the host target genes which VGAM1016 binds and inhibits, and the function of these host target genes, as elaborated hereinbelow.

Nucleotide sequences of the VGAM1016 precursor RNA, herein designated VGAM PRECURSOR RNA, and of the 'diced' VGAM1016 RNA, herein designated VGAM RNA, and a schematic representation of the secondary folding of VGAM1016 folded precursor RNA, herein designated VGAM FOLDED PRECURSOR RNA, of VGAM1016 are further described hereinbelow with reference to Table 1.

Nucleotide sequences of host target binding sites, such as BINDING SITE-I, BINDING SITE-II and BINDING SITE-III of FIG. 1, found on VGAM1016 host target RNA, and schematic representation of the complementarity of each of these host target binding sites to VGAM1016 RNA, herein designated VGAM RNA, are described hereinbelow with reference to Table 2.

As mentioned hereinabove with reference to FIG. 1, a function of VGAM1016 gene, herein designated VGAM is inhibition of expression of VGAM1016 target genes. It is appreciated that specific functions, and accordingly utilities, of VGAM1016 correlate with, and may be deduced from, the identity of the target genes which VGAM1016 binds and inhibits, and the function of these target genes, as elaborated hereinbelow.

S-adenosylmethionine Decarboxylase 1 (AMD1, Accession NM_001634) is a VGAM1016 host target gene. AMD1 BINDING SITE is HOST TARGET binding site found in the 3' untranslated region of mRNA encoded by AMD1, corresponding to a HOST TARGET binding site such as BINDING SITE I, BINDING SITE II or BINDING SITE III. Table 2 illustrates the complementarity of the nucleotide sequences of AMD1 BINDING SITE, designated SEQ ID:7348, to the nucleotide sequence of VGAM1016 RNA, herein designated VGAM RNA, also designated SEQ ID:3727.

A function of VGAM1016 is therefore inhibition of S-adenosylmethionine Decarboxylase 1 (AMD1, Accession NM_001634), a gene which catalyzes the removal of the carboxylate group of S-adenosylmethionine in the polyamine biosynthesis pathway. Accordingly, utilities of VGAM1016 include diagnosis, prevention and treatment of diseases and clinical conditions associated with AMD1. The function of AMD1 has been established by previous studies. The polyamines spermine, spermidine, and putrescine are low molecular weight aliphatic amines essential for cellular proliferation and tumor promotion. Ornithine decarboxylase (ODC; 165640) and S-adenosylmethionine decarboxylase (AdoMetDC) catalyze the rate-limiting steps in polyamine biosynthesis. A concordant rise in ODC and AdoMetDC activity is seen in various neoplastic conditions including colon cancer and benign colonic polyps. A rat cDNA clone for AdoMetDC was used by Radford et al. (1987, 1989) in mouse-human somatic cell hybrid experiments to map the AMD gene to chromosomes 6 and X. They demonstrated that the gene on chromosome 6, symbolized AMD1, is not amplified in colon neoplasia. The sequence on X, symbolized AMD2, was localized to Xq22-q28 and may represent a pseudogene. That AMD2 is indeed a pseudogene was indicated by the findings of Maric et al. (1992) that the X-chromosome gene lacks introns which are present in the chromosome 6 gene. The gene on chromosome 6 encompasses at least 22 kb and comprises 9 exons and 8 introns, in contrast to the corresponding rat gene that has only 8 exons. Other aspects of the structure and organization were presented by Maric et al. (1992). Pulkka et al. (1993) characterized 2 AMD genes in the rat and localized both to rat chromosome 20 by mouse-rat somatic cell hybrids. They showed a high degree of conservation of sequence and structural organization in the coding portions but the 5-prime flanking regions were totally different. Maric et al. (1995) characterized the AMD pseudogene on the X chromosome. It lacks all the introns present in AMD1 and has numerous mutations in the protein-coding region. By fluorescence in situ hybridization, they mapped AMD1 to 6q21-q22 and the pseudogene, which they referred to as AMD2, to Xq28.

Full details of the abovementioned studies are described in the following publications, the disclosure of which are hereby incorporated by reference:

Maric, S. C.; Crozat, A.; Janne, O. A.: Structure and organization of the human S-adenosylmethionine decarboxylase gene. J. Biol. Chem. 267:18915-18923, 1992; and Maric, S. C.; Crozat, A.; Louhimo, J.; Knuutila, S.; Janne, O. A.: The human S-adenosylmethionine decarboxylase gene: nucleotide sequence of a pseudogene and chromosomal localization o.

Further studies establishing the function and utilities of AMD1 are found in John Hopkins OMIM database record ID 180980, and in sited publications numbered 11117-11118, 10267-1026 and 44 listed in the bibliography section hereinbelow, which are also hereby incorporated by reference. Phosphotidylinositol Transfer Protein, Beta (PITPNB, Accession NM_012399) is another VGAM1016 host target gene. PITPNB BINDING SITE is HOST TARGET binding site found in the 3' untranslated region of mRNA encoded by PITPNB, corresponding to a HOST TARGET binding site such as BINDING SITE I, BINDING SITE II or BINDING SITE III. Table 2 illustrates the complementarity of the nucleotide sequences of PITPNB BINDING SITE, designated SEQ ID:14764, to the nucleotide sequence of VGAM1016 RNA, herein designated VGAM RNA, also designated SEQ ID:3727.

Another function of VGAM1016 is therefore inhibition of Phosphotidylinositol Transfer Protein, Beta (PITPNB, Accession NM_012399), a gene which catalyzes the transfer of ptdins and phosphatidylcholine between membranes. Accordingly, utilities of VGAM1016 include diagnosis, prevention and treatment of diseases and clinical conditions associated with PITPNB. The function of PITPNB has been established by previous studies. Tanaka et al. (1995) cloned PITPNB cDNA by screening a human brain cDNA library with the rat brain cDNA homolog as probe. The deduced 271-amino acid protein has a calculated molecular mass of 31.5 kD and shows 98.1% sequence identity with the rat protein. Northern blot analysis detected ubiquitous expression of a 3.4-kb transcript, with highest expression in liver and lowest in skeletal muscle. Expression was found in all regions of the brain examined, with highest expression in amygdala. Phosphatidylinositol transfer protein is a member of a diverse set of cytosolic phospholipid transfer proteins that are distinguished by their ability to transfer phospholipids between membranes in vitro (Wirtz, 1991).

Full details of the abovementioned studies are described in the following publications, the disclosure of which are hereby incorporated by reference:

Tanaka, S.; Yamashita, S.; Hosaka, K.: Cloning and expression of human cDNA encoding phosphatidylinositol transfer protein beta. Biochim. Biophys. Acta 1259:199-202, 1995; and Wirtz, K. W. A.: Phospholipid transfer proteins. Annu. Rev. Biochem. 60:73-99, 1991.

Further studies establishing the function and utilities of PITPNB are found in John Hopkins OMIM database record ID 606876, and in sited publications numbered 608 and 8227 listed in the bibliography section hereinbelow, which are also hereby incorporated by reference. Retinitis Pigmentosa 2 (X-linked recessive) (RP2, Accession NM_006915) is another VGAM1016 host target gene. RP2 BINDING SITE is HOST TARGET binding site found in the 3' untranslated region of mRNA encoded by RP2, corresponding to a HOST TARGET binding site such as BINDING SITE I, BINDING SITE II or BINDING SITE III. Table 2 illustrates the complementarity of the nucleotide sequences of RP2 BINDING SITE, designated SEQ ID:13791, to the nucleotide sequence of VGAM1016 RNA, herein designated VGAM RNA, also designated SEQ ID:3727.

Another function of VGAM1016 is therefore inhibition of Retinitis Pigmentosa 2 (X-linked recessive) (RP2, Accession NM_006915). Accordingly, utilities of VGAM1016 include diagnosis, prevention and treatment of diseases and clinical conditions associated with RP2. Rho/rac Guanine Nucleotide Exchange Factor (GEF) 2 (ARHGEF2, Accession NM_004723) is another VGAM1016 host target gene. ARHGEF2 BINDING SITE is HOST TARGET binding site found in the 3' untranslated region of mRNA encoded by ARHGEF2, corresponding has a HOST TARGET binding site such as BINDING SITE I, BINDING SITE II or BINDING SITE III. Table 2 illustrates the complementarity of the nucleotide sequences of ARHGEF2 BINDING SITE, designated SEQ ID:11089, to the nucleotide sequence of VGAM1016 RNA, herein designated VGAM RNA, also designated SEQ ID:3727.

Another function of VGAM1016 is therefore inhibition of Rho/rac Guanine Nucleotide Exchange Factor (GEF) 2 (ARHGEF2, Accession NM_004723). Accordingly, utilities of VGAM1016 include diagnosis, prevention and treatment of diseases and clinical conditions associated with ARHGEF2. CCR4-NOT Transcription Complex, Subunit 7 (CNOT7, Accession NM_013354) is another VGAM1016 host target gene. CNOT7 BINDING SITE is HOST TARGET binding site found in the 3' untranslated region of mRNA encoded by CNOT7, corresponding to a HOST TARGET binding site such as BINDING SITE I, BINDING SITE II or BINDING SITE III. Table 2 illustrates the complementarity of the nucleotide sequences of CNOT7 BINDING SITE, designated SEQ ID:14999, to the nucleotide sequence of VGAM1016 RNA, herein designated VGAM RNA, also designated SEQ ID:3727.

Another function of VGAM1016 is therefore inhibition of CCR4-NOT Transcription Complex, Subunit 7 (CNOT7, Accession NM_013354). Accordingly, utilities of VGAM1016 include diagnosis, prevention and treatment of diseases and clinical conditions associated with CNOT7. LOC163341 (Accession XM_088817) is another VGAM1016 host target gene. LOC163341 BINDING SITE is HOST TARGET binding site found in the 3' untranslated region of mRNA encoded by LOC163341, corresponding to a HOST TARGET binding site such as BINDING SITE I, BINDING SITE II or BINDING SITE III. Table 2 illustrates the complementarity of the nucleotide sequences of LOC163341 BINDING SITE, designated SEQ ID:39948, to the nucleotide sequence of VGAM1016 RNA, herein designated VGAM RNA, also designated SEQ ID:3727.

Another function of VGAM1016 is therefore inhibition of LOC163341 (Accession XM_088817). Accordingly, utilities of VGAM1016 include diagnosis, prevention and treatment of diseases and clinical conditions associated with LOC163341. LOC219920 (Accession XM_167787) is another VGAM1016 host target gene. LOC219920 BINDING SITE is HOST TARGET binding site found in the 5' untranslated region of mRNA encoded by LOC219920, corresponding to a HOST TARGET binding site such as BINDING SITE I, BINDING SITE II or BINDING SITE III. Table 2 illustrates the complementarity of the nucleotide sequences of LOC219920 BINDING SITE, designated SEQ ID:44811, to the nucleotide sequence of VGAM1016 RNA, herein designated VGAM RNA, also designated SEQ ID:3727.

Another function of VGAM1016 is therefore inhibition of LOC219920 (Accession XM_167787). Accordingly, utilities of VGAM1016 include diagnosis, prevention and treatment of diseases and clinical conditions associated with LOC219920. FIG. 1 further provides a conceptual description of a novel bioinformatically detected viral gene of the present invention, referred to here as Viral Genomic Address Messenger 1017 (VGAM1017) viral gene, which modulates expression of respective host target genes thereof, the function and utility of which host target genes is known in the art.

VGAM1017 is a novel bioinformatically detected regulatory, non protein coding, viral micro RNA (miRNA) gene. The method by which VGAM1017 was detected is described hereinabove with reference to FIGS. 1-8.

VGAM1017 gene, herein designated VGAM GENE, is a viral gene contained in the genome of Beet Western Yellows Virus. VGAM1017 host target gene, herein designated VGAM HOST TARGET GENE, is a human gene contained in the human genome.

VGAM1017 gene encodes a VGAM1017 precursor RNA, herein designated VGAM PRECURSOR RNA. Similar to other miRNA genes, and unlike most ordinary genes, VGAM1017 precursor RNA does not encode a protein. A nucleotide sequence identical or highly similar to the nucleotide sequence of VGAM1017 precursor RNA is designated SEQ ID:1003, and is provided hereinbelow with reference to the sequence listing part. Nucleotide sequence SEQ ID:1003 is located at position 4604 relative to the genome of Beet Western Yellows Virus.

VGAM1017 precursor RNA folds onto itself, forming VGAM1017 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1017 folded precursor RNA into VGAM1017 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM1017 RNA is designated SEQ ID:3728, and is provided hereinbelow with reference to the sequence listing part.

VGAM1017 host target gene, herein designated VGAM HOST TARGET GENE, encodes a corresponding messenger RNA, VGAM1017 host target RNA, herein designated VGAM HOST TARGET RNA. VGAM1017 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1017 RNA, herein designated VGAM RNA, binds complementarily to one or more host target binding sites located in untranslated regions of VGAM1017 host target RNA, herein designated VGAM HOST TARGET RNA. This complementary binding is due to the fact that the nucleotide sequence of VGAM1017 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1017 RNA, herein designated VGAM RNA, may have a different number of host target binding sites in untranslated regions of a VGAM1017 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1017 RNA, herein designated VGAM RNA, to host target binding sites on VGAM1017 host target RNA, herein designated VGAM HOST TARGET RNA, such as BINDING SITE I, BINDING SITE II and BINDING SITE III, inhibits translation of VGAM1017 host target RNA into VGAM1017 host target protein, herein designated VGAM HOST TARGET PROTEIN. VGAM host target protein is therefore outlined by a broken line.

It is appreciated that VGAM1017 host target gene, herein designated VGAM HOST TARGET GENE, in fact represents a plurality of VGAM1017 host target genes. The mRNA of each one of this plurality of VGAM1017 host target genes comprises one or more host target binding sites, each having a nucleotide sequence which is at least partly complementary to VGAM1017 RNA, herein designated VGAM RNA, and which when bound by VGAM1017 RNA causes inhibition of translation of respective one or more VGAM1017 host target proteins.

It is further appreciated by one skilled in the art that the mode of translational inhibition illustrated by FIG. 1 with specific reference to translational inhibition exerted by VGAM1017 gene, herein designated VGAM GENE, on one or more VGAM1017 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1017 is inhibition of expression of host target genes, as part of a novel viral mechanism of attacking a host. Accordingly, utilities of VGAM1017 include diagnosis, prevention and treatment of viral infection by Beet Western Yellows Virus. Specific functions, and accordingly utilities, of VGAM1017 correlate with, and may be deduced from, the identity of the host target genes which VGAM1017 binds and inhibits, and the function of these host target genes, as elaborated hereinbelow.

Nucleotide sequences of the VGAM1017 precursor RNA, herein designated VGAM PRECURSOR RNA, and of the 'diced' VGAM1017 RNA, herein designated VGAM RNA, and a schematic representation of the secondary folding of VGAM1017 folded precursor RNA, herein designated VGAM FOLDED PRECURSOR RNA, of VGAM1017 are further described hereinbelow with reference to Table 1.

Nucleotide sequences of host target binding sites, such as BINDING SITE-I, BINDING SITE-II and BINDING SITE-III of FIG. 1, found on VGAM1017 host target RNA, and schematic representation of the complementarity of each of these host target binding sites to VGAM1017 RNA, herein designated VGAM RNA, are described hereinbelow with reference to Table 2.

As mentioned hereinabove with reference to FIG. 1, a function of VGAM1017 gene, herein designated VGAM is inhibition of expression of VGAM1017 target genes. It is appreciated that specific functions, and accordingly utilities, of VGAM1017 correlate with, and may be deduced from, the identity of the target genes which VGAM1017 binds and inhibits, and the function of these target genes, as elaborated hereinbelow.

Kinesin Family Member 3B (KIF3B, Accession NM_004798) is a VGAM1017 host target gene. KIF3B BINDING SITE is HOST TARGET binding site found in the 3' untranslated region of mRNA encoded by KIF3B, corresponding to a HOST TARGET binding site such as BINDING SITE I, BINDING SITE II or BINDING SITE III. Table 2 illustrates the complementarity of the nucleotide sequences of KIF3B BINDING SITE, designated SEQ ID:11215, to the nucleotide sequence of VGAM1017 RNA, herein designated VGAM RNA, also designated SEQ ID:3728.

A function of VGAM1017 is therefore inhibition of Kinesin Family Member 3B (KIF3B, Accession NM_004798), a gene which is a microtubule-based anterograde translocator for membranous organelles. Accordingly, utilities of VGAM1017 include diagnosis, prevention and treatment of diseases and clinical conditions associated with KIF3B. The function of KIF3B has been established by previous studies. In eukaryotic cells, proteins and lipids are sorted and transported to their correct destinations at distinct velocities by each organelle or protein complex. Kinesin superfamily proteins are a molecular motor superfamily involved in these processes, conveying their own cargoes along microtubules. Nagase et al. (1997) cloned the KIF3B gene, which they referred to as KIAA0359, the human homolog of the mouse kinase superfamily 3B gene (Yamazaki et al., 1995). The human KIF3B gene encodes a 747-amino acid protein that shares 98% identity with the mouse Kif3b protein. RT-PCR analysis revealed that the KIF3B gene was ubiquitously expressed in all human tissues tested. By analysis of radiation hybrid panels, Nagase et al. (1997) mapped the KIF3B gene to chromosome 20 Animal model experiments lend further support to the function of KIF3B. By gene targeting, Nonaka et al. (1998) disrupted the murine Kif3b gene. The null mutants did not survive beyond midgestation, exhibiting growth retardation, pericardial sac ballooning, and neural tube disorganization. Prominently, the left-right asymmetry was randomized in the heart loop and the direction of embryonic turning. Lefty-2 (OMIM Ref. No. 603037) expression was either bilateral or absent. Furthermore, the node lacked monocilia while the basal bodies were present. Immunocytochemistry revealed Kif3b localization in wildtype nodal cilia. Video microscopy showed that these cilia were motile and generated a leftward flow. These data suggested that KIF3B is essential for the left-right determination through intraciliary transportation of materials for ciliogenesis of motile primary cilia that could produce a gradient of putative morphogen along the left-right axis in the node It is appreciated that the abovementioned animal model for KIF3B is acknowledged by those skilled in the art as a scientifically valid animal model, as can be further appreciated from the publications sited hereinbelow.

Full details of the abovementioned studies are described in the following publications, the disclosure of which are hereby incorporated by reference:

Nagase, T.; Ishikawa, K.; Nakajima, D.; Ohira, M.; Seki, N.; Miyajima, N.; Tanaka, A.; Kotani, H.; Nomura, N.; Ohara, O.: Prediction of the coding sequences of unidentified human genes. VII. The complete sequences of 100 new cDNA clones from brain which can code for large proteins in vitro. DNA Res. 4:141-150, 1997; and Nonaka, S.; Tanaka, Y.; Okada, Y.; Takeda, S.; Harada, A.; Kanai, Y.; Kido, M.; Hirokawa, N.: Randomization of left-right asymmetry due to loss of nodal cilia generating leftward flow.

Further studies establishing the function and utilities of KIF3B are found in John Hopkins OMIM database record ID 603754, and in sited publications numbered 95 and 7600-7601 listed in the bibliography section hereinbelow, which are also hereby incorporated by reference. Lactate Dehydrogenase B (LDHB, Accession NM_002300) is another VGAM1017 host target gene. LDHB BINDING SITE is HOST TARGET binding site found in the 5' untranslated region of mRNA encoded by LDHB, corresponding to a HOST TARGET binding site such as BINDING SITE I, BINDING SITE II or BINDING SITE III. Table 2 illustrates the complementarity of the nucleotide sequences of LDHB BINDING SITE, designated SEQ ID:8086, to the nucleotide sequence of VGAM1017 RNA, herein designated VGAM RNA, also designated SEQ ID:3728.

Another function of VGAM1017 is therefore inhibition of Lactate Dehydrogenase B (LDHB, Accession NM_002300), a gene which causes dehydrogenation of lactate. Accordingly, utilities of VGAM1017 include diagnosis, prevention and treatment of diseases and clinical conditions associated with LDHB. The function of LDHB and its association with various diseases and clinical conditions, has been established by previous studies, as described hereinabove with reference to VGAM273. Neural Precursor Cell Expressed, Developmentally Down-regulated 4-like (NEDD4L, Accession NM_015277) is another VGAM1017 host target gene. NEDD4L BINDING SITE is HOST TARGET binding site found in the 3' untranslated region of mRNA encoded by NEDD4L, corresponding to a HOST TARGET binding site such as BINDING SITE I, BINDING SITE II or BINDING SITE III. Table 2 illustrates the complementarity of the nucleotide sequences of NEDD4L BINDING SITE, designated SEQ ID:17605, to the nucleotide sequence of VGAM1017 RNA, herein designated VGAM RNA, also designated SEQ ID:3728.

Another function of VGAM1017 is therefore inhibition of Neural Precursor Cell Expressed, Developmentally Downregulated 4-like (NEDD4L, Accession NM_015277), a gene which may play a role in the regulation of epithelial sodium channel function. Accordingly, utilities of VGAM1017 include diagnosis, prevention and treatment of diseases and clinical conditions associated with NEDD4L. The function of NEDD4L and its association with various diseases and clinical conditions, has been established by previous studies, as described hereinabove with reference to VGAM603. Protein Phosphatase 1, Regulatory (inhibitor) Subunit 3C (PPP1R3C, Accession NM_005398) is another VGAM1017 host target gene. PPP1R3C BINDING SITE is HOST TARGET binding site found in the 3' untranslated region of mRNA encoded by PPP1R3C, corresponding to a HOST TARGET binding site such as BINDING SITE I, BINDING SITE II or BINDING SITE III. Table 2 illustrates the complementarity of the nucleotide sequences of PPP1R3C BINDING SITE, designated SEQ ID:11877, to the nucleotide sequence of VGAM1017 RNA, herein designated VGAM RNA, also designated SEQ ID:3728.

Another function of VGAM1017 is therefore inhibition of Protein Phosphatase 1, Regulatory (inhibitor) Subunit 3C (PPP1R3C, Accession NM_005398). Accordingly, utilities of VGAM1017 include diagnosis, prevention and treatment of diseases and clinical conditions associated with PPP1R3C. Regulatory Factor X-associated Protein (RFXAP, Accession NM_000538) is another VGAM1017 host target gene. RFXAP BINDING SITE is HOST TARGET binding site found in the 3' untranslated region of mRNA encoded by RFXAP, corresponding to a HOST TARGET binding site such as BINDING SITE I, BINDING SITE II or BINDING SITE III. Table 2 illustrates the complementarity of the nucleotide sequences of RFXAP BINDING SITE, designated SEQ ID:6137, to the nucleotide sequence of VGAM1017 RNA, herein designated VGAM RNA, also designated SEQ ID:3728.

Another function of VGAM1017 is therefore inhibition of Regulatory Factor X-associated Protein (RFXAP, Accession NM_000538), a gene which binds to the x-box of mhc ii promoters and is a transcriptional regulator. Accordingly, utilities of VGAM1017 include diagnosis, prevention and treatment of diseases and clinical conditions associated with RFXAP. The function of RFXAP and its association with various diseases and clinical conditions, has been established by previous studies, as described hereinabove with reference to VGAM797. Kell Blood Group Precursor (McLeod phenotype) (XK, Accession NM_021083) is another VGAM1017 host target gene. XK BINDING SITE is HOST TARGET binding site found in the 3" untranslated region of mRNA encoded by XK, corresponding to a HOST TARGET binding site such as BINDING SITE I, BINDING SITE II or BINDING SITE III. Table 2 illustrates the complementarity of the nucleotide sequences of XK BINDING SITE, designated SEQ ID:22054, to the nucleotide sequence of VGAM1017 RNA, herein designated VGAM RNA, also designated SEQ ID:3728.

Another function of VGAM1017 is therefore inhibition of Kell Blood Group Precursor (McLeod phenotype) (XK, Accession NM_021083). Accordingly, utilities of VGAM1017 include diagnosis, prevention and treatment of diseases and clinical conditions associated with XK. Ecotropic Viral Integration Site 5 (EVI5, Accession NM_005665) is another VGAM1017 host target gene. EVI5 BINDING SITE is HOST TARGET binding site found in the 3' untranslated region of mRNA encoded by EVI5, corresponding to a HOST TARGET binding site such as BINDING SITE I, BINDING SITE II or BINDING SITE III. Table 2 illustrates the complementarity of the nucleotide sequences of EVI5 BINDING SITE, designated SEQ ID:12206, to the nucleotide sequence of VGAM1017 RNA, herein designated VGAM RNA, also designated SEQ ID:3728.

Another function of VGAM1017 is therefore inhibition of Ecotropic Viral Integration Site 5 (EVI5, Accession NM_005665). Accordingly, utilities of VGAM1017 include diagnosis, prevention and treatment of diseases and clinical conditions associated with EVI5. IMAGE145052 (Accession NM_014267) is another VGAM1017 host target gene. IMAGE145052 BINDING SITE is HOST TARGET binding site found in the 3' untranslated region of mRNA encoded by IMAGE145052, corresponding to a HOST TARGET binding site such as BINDING SITE I, BINDING SITE II or BINDING SITE III. Table 2 illustrates the complementarity of the nucleotide sequences of IMAGE145052 BINDING SITE, designated SEQ ID:15542, to the nucleotide sequence of VGAM1017 RNA, herein designated VGAM RNA, also designated SEQ ID:3728.

Another function of VGAM1017 is therefore inhibition of IMAGE145052 (Accession NM_014267). Accordingly, utilities of VGAM1017 include diagnosis, prevention and treatment of diseases and clinical conditions associated with IMAGE145052. KIAA0040 (Accession NM_014656) is another VGAM1017 host target gene. KIAA0040 BINDING SITE is HOST TARGET binding site found in the 5' untranslated region of mRNA encoded by KIAA0040, corresponding to a HOST TARGET binding site such as BINDING SITE I, BINDING SITE II or BINDING SITE III. Table 2 illustrates the complementarity of the nucleotide sequences of KIAA0040 BINDING SITE, designated SEQ ID:16093, to the nucleotide sequence of VGAM1017 RNA, herein designated VGAM RNA, also designated SEQ ID:3728.

Another function of VGAM1017 is therefore inhibition of KIAA0040 (Accession NM_014656). Accordingly, utilities of VGAM1017 include diagnosis, prevention and treatment of diseases and clinical conditions associated with KIAA0040. KIAA0410 (Accession NM_014778) is another VGAM1017 host target gene. KIAA0410 BINDING SITE is HOST TARGET binding site found in the 3' untranslated region of mRNA encoded by KIAA0410, corresponding to a HOST TARGET binding site such as BINDING SITE I, BINDING SITE II or BINDING SITE III. Table 2 illustrates the complementarity of the nucleotide sequences of KIAA0410 BINDING SITE, designated SEQ ID:16613, to the nucleotide sequence of VGAM1017 RNA, herein designated VGAM RNA, also designated SEQ ID:3728.

Another function of VGAM1017 is therefore inhibition of KIAA0410 (Accession NM_014778). Accordingly, utilities of VGAM1017 include diagnosis, prevention and treatment of diseases and clinical conditions associated with KIAA0410. KIAA1579 (Accession NM_018211) is another VGAM1017 host target gene. KIAA1579 BINDING SITE is HOST TARGET binding site found in the 3' untranslated region of mRNA encoded by KIAA1579, corresponding to a HOST TARGET binding site such as BINDING SITE I, BINDING SITE II or BINDING SITE III. Table 2 illustrates the complementarity of the nucleotide sequences of KIAA1579 BINDING SITE, designated SEQ ID:20117, to the nucleotide sequence of VGAM1017 RNA, herein designated VGAM RNA, also designated SEQ ID:3728.

Another function of VGAM1017 is therefore inhibition of KIAA1579 (Accession NM_018211). Accordingly, utilities of VGAM1017 include diagnosis, prevention and treatment of diseases and clinical conditions associated with KIAA1579. MGC10999 (Accession NM_032307) is another VGAM1017 host target gene. MGC10999 BINDING SITE is HOST TARGET binding site found in the 3' untranslated region of mRNA encoded by MGC10999, corresponding to a HOST TARGET binding site such as BINDING SITE I, BINDING SITE II or BINDING SITE III. Table 2 illustrates the complementarity of the nucleotide sequences of MGC10999 BINDING SITE, designated SEQ ID:26088, to the nucleotide sequence of VGAM1017 RNA, herein designated VGAM RNA, also designated SEQ ID:3728.

Another function of VGAM1017 is therefore inhibition of MGC10999 (Accession NM_032307). Accordingly, utilities of VGAM1017 include diagnosis, prevention and treatment of diseases and clinical conditions associated with MGC10999. Nei Like 2 (E. coli) (NEIL2, Accession NM_145043) is another VGAM1017 host target gene. NEIL2 BINDING SITE is HOST TARGET binding site found in the 3' untranslated region of mRNA encoded by NEIL2, corresponding to a HOST TARGET binding site such as BINDING SITE I, BINDING SITE II or BINDING SITE III. Table 2 illustrates the complementarity of the nucleotide sequences of NEIL2 BINDING SITE, designated SEQ ID:29674, to the nucleotide sequence of VGAM1017 RNA, herein designated VGAM RNA, also designated SEQ ID:3728.

Another function of VGAM1017 is therefore inhibition of Nei Like 2 (E. coli) (NEIL2, Accession NM_145043). Accordingly, utilities of VGAM1017 include diagnosis, prevention and treatment of diseases and clinical conditions associated with NEIL2. SSH2 (Accession XM_030846) is another VGAM1017 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31174, to the nucleotide sequence of VGAM1017 RNA, herein designated VGAM RNA, also designated SEQ ID:3728.

Another function of VGAM1017 is therefore inhibition of SSH2 (Accession XM_030846). Accordingly, utilities of VGAM1017 include diagnosis, prevention and treatment of diseases and clinical conditions associated with SSH2. LOC126302 (Accession XM_059020) is another VGAM1017 host target gene. LOC126302 BINDING SITE is HOST TARGET binding site found in the 3' untranslated region of mRNA encoded by LOC126302, corresponding to a HOST TARGET binding site such as BINDING SITE I, BINDING SITE II or BINDING SITE III. Table 2 illustrates the complementarity of the nucleotide sequences of LOC126302 BINDING SITE, designated SEQ ID:36818, to the nucleotide sequence of VGAM1017 RNA, herein designated VGAM RNA, also designated SEQ ID:3728.

Another function of VGAM1017 is therefore inhibition of LOC126302 (Accession XM_059020). Accordingly, utilities of VGAM1017 include diagnosis, prevention and treatment of diseases and clinical conditions associated with LOC126302. LOC145463 (Accession XM_048173) is another VGAM1017 host target gene. LOC145463 BINDING SITE is HOST TARGET binding site found in the 3' untranslated region of mRNA encoded by LOC145463, corresponding to a HOST TARGET binding site such as BINDING SITE I, BINDING SITE II or BINDING SITE III. Table 2 illustrates the complementarity of the nucleotide sequences of LOC145463 BINDING SITE, designated SEQ ID:35121, to the nucleotide sequence of VGAM1017 RNA, herein designated VGAM RNA, also designated SEQ ID:3728.

Another function of VGAM1017 is therefore inhibition of LOC145463 (Accession XM_048173). Accordingly, utilities of VGAM1017 include diagnosis, prevention and treatment of diseases and clinical conditions associated with LOC145463. LOC255082 (Accession XM_172843) is another VGAM1017 host target gene. LOC255082 BINDING SITE is HOST TARGET binding site found in the 5' untranslated region of mRNA encoded by LOC255082, corresponding to a HOST TARGET binding site such as BINDING SITE I, BINDING SITE II or BINDING SITE III. Table 2 illustrates the complementarity of the nucleotide sequences of LOC255082 BINDING SITE, designated SEQ ID:46117, to the nucleotide sequence of VGAM1017 RNA, herein designated VGAM RNA, also designated SEQ ID:3728.

Another function of VGAM1017 is therefore inhibition of LOC255082 (Accession XM_172843). Accordingly, utilities of VGAM1017 include diagnosis, prevention and treatment of diseases and clinical conditions associated with LOC255082. FIG. 1 further provides a conceptual description of a novel bioinformatically detected viral gene of the present invention, referred to here as Viral Genomic Address Messenger 1018 (VGAM1018) viral gene, which modulates expression of respective host target genes thereof, the function and utility of which host target genes is known in the art.

VGAM1018 is a novel bioinformatically detected regulatory, non protein coding, viral micro RNA (miRNA) gene. The method by which VGAM1018 was detected is described hereinabove with reference to FIGS. 1-8.

VGAM1018 gene, herein designated VGAM GENE, is a viral gene contained in the genome of Beet Western Yellows Virus. VGAM1018 host target gene, herein designated VGAM HOST TARGET GENE, is a human gene contained in the human genome.

VGAM1018 gene encodes a VGAM1018 precursor RNA, herein designated VGAM PRECURSOR RNA. Similar to other miRNA genes, and unlike most ordinary genes, VGAM1018 precursor RNA does not encode a protein. A nucleotide sequence identical or highly similar to the nucleotide sequence of VGAM1018 precursor RNA is designated SEQ ID:1004, and is provided hereinbelow with reference to the sequence listing part. Nucleotide sequence SEQ ID:1004 is located at position 3512 relative to the genome of Beet Western Yellows Virus.

VGAM1018 precursor RNA folds onto itself, forming VGAM1018 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1018 folded precursor RNA into VGAM1018 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1018 RNA is designated SEQ ID:3729, and is provided hereinbelow with reference to the sequence listing part.

VGAM1018 host target gene, herein designated VGAM HOST TARGET GENE, encodes a corresponding messenger RNA, VGAM1018 host target RNA, herein designated VGAM HOST TARGET RNA. VGAM1018 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1018 RNA, herein designated VGAM RNA, binds complementarily to one or more host target binding sites located in untranslated regions of VGAM1018 host target RNA, herein designated VGAM HOST TARGET RNA. This complementary binding is due to the fact that the nucleotide sequence of VGAM1018 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1018 RNA, herein designated VGAM RNA, may have a different number of host target binding sites in untranslated regions of a VGAM1018 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1018 RNA, herein designated VGAM RNA, to host target binding sites on VGAM1018 host target RNA, herein designated VGAM HOST TARGET RNA, such as BINDING SITE I, BINDING SITE II and BINDING SITE III, inhibits translation of VGAM1018 host target RNA into VGAM1018 host target protein, herein designated VGAM HOST TARGET PROTEIN. VGAM host target protein is therefore outlined by a broken line.

It is appreciated that VGAM1018 host target gene, herein designated VGAM HOST TARGET GENE, in fact represents a plurality of VGAM1018 host target genes. The mRNA of each one of this plurality of VGAM1018 host target genes comprises one or more host target binding sites, each having a nucleotide sequence which is at least partly complementary to VGAM1018 RNA, herein designated VGAM RNA, and which when bound by VGAM1018 RNA causes inhibition of translation of respective one or more VGAM1018 host target proteins.

It is further appreciated by one skilled in the art that the mode of translational inhibition illustrated by FIG. 1 with specific reference to translational inhibition exerted by VGAM1018 gene, herein designated VGAM GENE, on one or more VGAM1018 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1018 is inhibition of expression of host target genes, as part of a novel viral mechanism of attacking a host. Accordingly, utilities of VGAM1018 include diagnosis, prevention and treatment of viral infection by Beet Western Yellows Virus. Specific functions, and accordingly utilities, of VGAM1018 correlate with, and may be deduced from, the identity of the host target genes which VGAM1018 binds and inhibits, and the function of these host target genes, as elaborated hereinbelow.

Nucleotide sequences of the VGAM1018 precursor RNA, herein designated VGAM PRECURSOR RNA, and of the 'diced' VGAM1018 RNA, herein designated VGAM RNA, and a schematic representation of the secondary folding of VGAM1018 folded precursor RNA, herein designated VGAM FOLDED PRECURSOR RNA, of VGAM1018 are further described hereinbelow with reference to Table 1.

Nucleotide sequences of host target binding sites, such as BINDING SITE-I, BINDING SITE-II and BINDING SITE-III of FIG. 1, found on VGAM1018 host target RNA, and schematic representation of the complementarity of each of these host target binding sites to VGAM1018 RNA, herein designated VGAM RNA, are described hereinbelow with reference to Table 2.

As mentioned hereinabove with reference to FIG. 1, a function of VGAM1018 gene, herein designated VGAM is inhibition of expression of VGAM1018 target genes. It is appreciated that specific functions, and accordingly utilities, of VGAM1018 correlate with, and may be deduced from, the identity of the target genes which VGAM1018 binds and inhibits, and the function of these target genes, as elaborated hereinbelow.

KIAA0556 (Accession XM_044632) is a VGAM1018 host target gene. KIAA0556 BINDING SITE is HOST TARGET binding site found in the 3' untranslated region of mRNA encoded by KIAA0556, corresponding to a HOST TARGET binding site such as BINDING SITE I, BINDING SITE II or BINDING SITE III. Table 2 illustrates the complementarity of the nucleotide sequences of KIAA0556 BINDING SITE, designated SEQ ID:34247, to the nucleotide sequence of VGAM1018 RNA, herein designated VGAM RNA, also designated SEQ ID:3729.

A function of VGAM1018 is therefore inhibition of KIAA0556 (Accession XM_044632). Accordingly, utilities of VGAM1018 include diagnosis, prevention and treatment of diseases and clinical conditions associated with KIAA0556. LOC256052 (Accession XM_174732) is another VGAM1018 host target gene. LOC256052 BINDING SITE is HOST TARGET binding site found in the 5' untranslated region of mRNA encoded by LOC256052, corresponding to a HOST TARGET binding site such as BINDING SITE I, BINDING SITE II or BINDING SITE III. Table 2 illustrates the complementarity of the nucleotide sequences of LOC256052 BINDING SITE, designated SEQ ID:46603, to the nucleotide sequence of VGAM1018 RNA, herein designated VGAM RNA, also designated SEQ ID:3729.

Another function of VGAM1018 is therefore inhibition of LOC256052 (Accession XM_174732). Accordingly, utilities of VGAM1018 include diagnosis, prevention and treatment of diseases and clinical conditions associated with LOC256052. LOC90139 (Accession NM_130783) is another VGAM1018 host target gene. LOC90139 BINDING SITE is HOST TARGET binding site found in the 3' untranslated region of mRNA encoded by LOC90139, corresponding to a HOST TARGET binding site such as BINDING SITE I, BINDING SITE II or BINDING SITE III. Table 2 illustrates the complementarity of the nucleotide sequences of LOC90139 BINDING SITE, designated SEQ ID:28272, to the nucleotide sequence of VGAM1018 RNA, herein designated VGAM RNA, also designated SEQ ID:3729.

Another function of VGAM1018 is therefore inhibition of LOC90139 (Accession NM_130783). Accordingly, utilities of VGAM1018 include diagnosis, prevention and treatment of diseases and clinical conditions associated with LOC90139. FIG. 1 further provides a conceptual description of a novel bioinformatically detected viral gene of the present invention, referred to here as Viral Genomic Address Messenger 1019 (VGAM1019) viral gene, which modulates expression of respective host target genes thereof, the function and utility of which host target genes is known in the art.

VGAM1019 is a novel bioinformatically detected regulatory, non protein coding, viral micro RNA (miRNA) gene. The method by which VGAM1019 was detected is described hereinabove with reference to FIGS. 1-8.

VGAM1019 gene, herein designated VGAM GENE, is a viral gene contained in the genome of Beet Western Yellows Virus. VGAM1019 host target gene, herein designated VGAM HOST TARGET GENE, is a human gene contained in the human genome.

VGAM1019 gene encodes a VGAM1019 precursor RNA, herein designated VGAM PRECURSOR RNA. Similar to other miRNA genes, and unlike most ordinary genes, VGAM1019 precursor RNA does not encode a protein. A nucleotide sequence identical or highly similar to the nucleotide sequence of VGAM1019 precursor RNA is designated SEQ ID:1005, and is provided hereinbelow with reference to the sequence listing part. Nucleotide sequence SEQ ID:1005 is located at position 5178 relative to the genome of Beet Western Yellows Virus.

VGAM1019 precursor RNA folds onto itself, forming VGAM1019 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1019 folded precursor RNA into VGAM1019 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1019 RNA is designated SEQ ID:3730, and is provided hereinbelow with reference to the sequence listing part.

VGAM1019 host target gene, herein designated VGAM HOST TARGET GENE, encodes a corresponding messenger RNA, VGAM1019 host target RNA, herein designated VGAM HOST TARGET RNA. VGAM1019 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1019 RNA, herein designated VGAM RNA, binds complementarily to one or more host target binding sites located in untranslated regions of VGAM1019 host target RNA, herein designated VGAM HOST TARGET RNA. This complementary binding is due to the fact that the nucleotide sequence of VGAM1019 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1019 RNA, herein designated VGAM RNA, may have a different number of host target binding sites in untranslated regions of a VGAM1019 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1019 RNA, herein designated VGAM RNA, to host target binding sites on VGAM1019 host target RNA, herein designated VGAM HOST TARGET RNA, such as BINDING SITE I, BINDING SITE II and BINDING SITE III, inhibits translation of VGAM1019 host target RNA into VGAM1019 host target protein, herein designated VGAM HOST TARGET PROTEIN. VGAM host target protein is therefore outlined by a broken line.

It is appreciated that VGAM1019 host target gene, herein designated VGAM HOST TARGET GENE, in fact represents a plurality of VGAM1019 host target genes. The mRNA of each one of this plurality of VGAM1019 host target genes comprises one or more host target binding sites, each having a nucleotide sequence which is at least partly complementary to VGAM1019 RNA, herein designated VGAM RNA, and which when bound by VGAM1019 RNA causes inhibition of translation of respective one or more VGAM1019 host target proteins.

It is further appreciated by one skilled in the art that the mode of translational inhibition illustrated by FIG. 1 with specific reference to translational inhibition exerted by VGAM1019 gene, herein designated VGAM GENE, on one or more VGAM1019 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1019 is inhibition of expression of host target genes, as part of a novel viral mechanism of attacking a host. Accordingly, utilities of VGAM1019 include diagnosis, prevention and treatment of viral infection by Beet Western Yellows Virus. Specific functions, and accordingly utilities, of VGAM1019 correlate with, and may be deduced from, the identity of the host target genes which VGAM1019 binds and inhibits, and the function of these host target genes, as elaborated hereinbelow.

Nucleotide sequences of the VGAM1019 precursor RNA, herein designated VGAM PRECURSOR RNA, and of the 'diced' VGAM1019 RNA, herein designated VGAM RNA, and a schematic representation of the secondary folding of VGAM1019 folded precursor RNA, herein designated VGAM FOLDED PRECURSOR RNA, of VGAM1019 are further described hereinbelow with reference to Table 1.

Nucleotide sequences of host target binding sites, such as BINDING SITE-I, BINDING SITE-II and BINDING SITE-III of FIG. 1, found on VGAM1019 host target RNA, and schematic representation of the complementarity of each of these host target binding sites to VGAM1019 RNA, herein designated VGAM RNA, are described hereinbelow with reference to Table 2.

As mentioned hereinabove with reference to FIG. 1, a function of VGAM1019 gene, herein designated VGAM is inhibition of expression of VGAM1019 target genes. It is appreciated that specific functions, and accordingly utilities, of VGAM1019 correlate with, and may be deduced from, the identity of the target genes which VGAM1019 binds and inhibits, and the function of these target genes, as elaborated hereinbelow.

Ankyrin 1, Erythrocytic (ANK1, Accession XM_016774) is a VGAM1019 host target gene. ANK1 BINDING SITE is HOST TARGET binding site found in the 3' untranslated region of mRNA encoded by ANK1, corresponding to a HOST TARGET binding site such as BINDING SITE I, BINDING SITE II or BINDING SITE III. Table 2 illustrates the complementarity of the nucleotide sequences of ANK1 BINDING SITE, designated SEQ ID:30290, to the nucleotide sequence of VGAM1019 RNA, herein designated VGAM RNA, also designated SEQ ID:3730.

A function of VGAM1019 is therefore inhibition of Ankyrin 1, Erythrocytic (ANK1, Accession XM_016774). Accordingly, utilities of VGAM1019 include diagnosis, prevention and treatment of diseases and clinical conditions associated with ANK1. EphB6 (EPHB6, Accession NM_004445) is another VGAM1019 host target gene. EPHB6 BINDING SITE is HOST TARGET binding site found in the 5' untranslated region of mRNA encoded by EPHB6, corresponding to a HOST TARGET binding site such as BINDING SITE I, BINDING SITE II or BINDING SITE III. Table 2 illustrates the complementarity of the nucleotide sequences of EPHB6 BINDING SITE, designated SEQ ID:10740, to the nucleotide sequence of VGAM1019 RNA, herein designated VGAM RNA, also designated SEQ ID:3730.

Another function of VGAM1019 is therefore inhibition of EphB6 (EPHB6, Accession NM_004445), a gene which Putative Eph-related receptor tyrosine kinase B6. Accordingly, utilities of VGAM1019 include diagnosis, prevention and treatment of diseases and clinical conditions associated with EPHB6. The function of EPHB6 has been established by previous studies. See 179610 for background on Eph receptors and their ligands, the ephrins. By screening human brain and hematopoietic cell cDNA libraries with the catalytic domain of EPHB4 (OMIM Ref. No. 600011), Matsuoka et al. (1997) cloned a cDNA encoding EPHB6. The predicted 1,006-amino acid EPHB6 protein has the primary structural features of Eph-family receptor tyrosine kinases, but it lacks several invariant residues that have been shown to be essential for tyrosine kinase activity. Expression of the catalytic domain of EPHB6 in mammalian cells resulted in no detectable tyrosine kinase activity in an in vitro assay. Northern blot analysis of normal human adult tissues showed that EPHB6 was expressed as a single 4.0-kb transcript in all tissues examined, with very strong expression in the brain and pancreas. EPHB6 is expressed in normal human brain as a 135-kD protein. By fluorescence in situ hybridization, Matsuoka et al. (1997) mapped the EPHB6 gene to 7q33-q35. Neuroblastoma (NB; 256700) is a common pediatric tumor that exhibits a wide range of biologic and clinical heterogeneity. EPH family receptor tyrosine kinases and ligand ephrins play pivotal roles in neural and cardiovascular development. High-level expression of transcripts encoding EPHB6 and its ligands ephrin-B2 (EFNB2; 600527) and ephrin-B3 (EFNB3; 602297) is associated with low-stage NB (stages 1, 2, and 4S) and high expression of TRKA (NTRK1; 191315). Tang et al. (2000) showed that EFNB2 and TRKA expressions were associated with both tumor stage and patient age, whereas EPHB6 and EFNB3 expressions were solely associated with tumor stage, suggesting that these genes were expressed in different subsets of NB. High-level expression of EPHB6, EFNB2, and EFNB3 predicted favorable NB outcome, and their expression combined with TRKA expression predicted the disease outcome more accurately than each variable alone. If any 1 of the 4 genes was expressed at high levels in NB, the patient survival was excellent (more than 90%). Tang et al. (2000) found that transfection of EPHB6 cDNA into neuroblastoma cell lines expressing little endogenous EPHB6 resulted in inhibition of their clonogenicity in culture. Furthermore, transfection of EPHB6 suppressed the tumorigenicity of a cell line in a mouse xenograft model, demonstrating that high-level expressions of favorable NB genes, such as EPHB6, can in fact suppress malignant phenotype of unfavorable NB.

Full details of the abovementioned studies are described in the following publications, the disclosure of which are hereby incorporated by reference:

Matsuoka, H.; Iwata, N.; Ito, M.; Shimoyama, M.; Nagata, A.; Chihara, K.; Takai, S.; Matsui, T.: Expression of a kinase-defective Eph-like receptor in the normal human brain. Biochem. Biophys. Res. Commun. 235:487-492, 1997; and Tang, X. X.; Zhao, H.; Robinson, M. E.; Cohen, B.; Cnaan, A.; London, W.; Cohn, S. L.; Cheung, N.-K. V.; Brodeur, G. M.; Evans, A. E.; Ikegaki, N.: Implications of EPHB6, EFNB2, and EFN.

Further studies establishing the function and utilities of EPHB6 are found in John Hopkins OMIM database record ID 602757, and in sited publications numbered 5887-5888 listed in the bibliography section hereinbelow, which are also hereby incorporated by reference. Erbb2 Interacting Protein (ERBB2IP, Accession NM_018695) is another VGAM1019 host target gene. ERBB2IP BINDING SITE1 and ERBB2IP BINDING SITE2 are HOST TARGET binding sites found in untranslated regions of mRNA encoded by ERBB2IP, corresponding to HOST TARGET binding sites such as BINDING SITE I, BINDING SITE II or BINDING SITE III. Table 2 illustrates the complementarity of the nucleotide sequences of ERBB2IP BINDING SITE1 and ERBB2IP BINDING SITE2, designated SEQ ID:20771 and SEQ ID:20772 respectively, to the nucleotide sequence of VGAM1019 RNA, herein designated VGAM RNA, also designated SEQ ID:3730.

Another function of VGAM1019 is therefore inhibition of Erbb2 Interacting Protein (ERBB2IP, Accession NM_018695), a gene which ERBB2 interacting protein; acts as an adaptor for the receptor ERBB2/HER2. Accordingly, utilities of VGAM1019 include diagnosis, prevention and treatment of diseases and clinical conditions associated with ERBB2IP. The function of ERBB2IP has been established by previous studies. In a yeast 2-hybrid screen of a mouse kidney cDNA library with the 9 C-terminal residues of Erbb2 (OMIM Ref. No. 164870) as bait, Borg et al. (2000) cloned Erbb2ip, which they called Erbin. They cloned human ERBB2IP by RT-PCR of a human B-lymphocyte cell line. The deduced 1,371-amino acid protein contains 16 canonical LRR (leucine-rich repeat) motifs at the N terminus, followed by an LRR-like domain, proline-rich stretches that may represent binding sites for SH3 and WW domains, and a C-terminal PDZ domain. Northern blot analysis revealed a 7.2-kb transcript in most human and mouse tissues. Western blot analysis indicated a 180-kD doublet in all tissues tested. Favre et al. (2001) cloned ERBB2IP in a yeast 2-hybrid screen of a human keratinocyte cDNA library with the N terminus of a bullous pemphigoid antigen-1 (BPAG1; 113810) as bait. They observed several splice variants. ERBB2IP was expressed as a doublet of about 6.9 to 7.4 kb in human keratinocytes and in a keratinocyte cell line. Semiquantitative RT-PCR indicated numerous transcripts expressed in most tissues. Western blot analysis showed a 200-kD in differentiated cells but not in undifferentiated keratinocytes. Huang et al. (2001) cloned Erbb2ip from mouse muscle, brain, and heart cDNA libraries in a yeast 2-hybrid screen using Erbb2 as bait. Erbb2ip was expressed as a 180-kD protein in brain, skeletal muscle, primary muscle cultures, and muscle cell lines. Erbb2ip expression was found at a similar level in myoblasts and myotubes, suggesting that expression is not differentially regulated in muscle. By immunolocalization studies, they colocalized Erbb2ip with the acetylcholine receptor at the neuromuscular junction. Both Erbb2 and Erbb2ip were also found in synaptosomes from adult mouse brain and copurified with postsynaptic densities. The International Radiation Hybrid Mapping Consortium mapped the ERBB2IP gene to chromosome 5 (WI-31186). Favre et al. (2001) stated that sequence analysis places the ERBB2IP gene on the long arm of chromosome 5 between D5S427 and D5S647.

Full details of the abovementioned studies are described in the following publications, the disclosure of which are hereby incorporated by reference:

Favre, B.; Fontao, L.; Koster, J.; Shafaatian, R.; Jaunin, F.; Saurat, J.-H.; Sonnenberg, A.; Borradori, L.: The hemidesmosomal protein bullous pemphigoid antigen 1 and the integrin beta-4 subunit bind to ERBIN: molecular cloning of multiple alternative splice variants of ERBIN and analysis of their tissue expression. J. Biol. Chem. 276:32427-32436, 2001; and Huang, Y. Z.; Wang, Q.; Xiong, W. C.; Mei, L.: Erbin is a protein concentrated at postsynaptic membranes that interacts with PSD-95. J. Biol. Chem. 276: 19318-19326, 2001.

Further studies establishing the function and utilities of ERBB2IP are found in John Hopkins OMIM database record ID 606944, and in sited publications numbered 527 and 5367 listed in the bibliography section hereinbelow, which are also hereby incorporated by reference. Golgi Associated, Gamma Adaptin Ear Containing, ARF Binding Protein 3 (GGA3, Accession NM_014001) is another VGAM1019 host target gene. GGA3 BINDING SITE1 and GGA3 BINDING SITE2 are HOST TARGET binding sites found in untranslated regions of mRNA encoded by GGA3, corresponding to HOST TARGET binding sites such as BINDING SITE I, BINDING SITE II or BINDING SITE III. Table 2 illustrates the complementarity of the nucleotide sequences of GGA3 BINDING SITE1 and GGA3 BINDING SITE2, designated SEQ ID:15198 and SEQ ID:42262 respectively, to the nucleotide sequence of VGAM1019 RNA, herein designated VGAM RNA, also designated SEQ ID:3730.

Another function of VGAM1019 is therefore inhibition of Golgi Associated, Gamma Adaptin Ear Containing, ARF Binding Protein 3 (GGA3, Accession NM_014001), a gene which may play a role in the regulation of membrane traffic through the trans-golgi network. Accordingly, utilities of VGAM1019 include diagnosis, prevention and treatment of diseases and clinical conditions associated with GGA3. The function of GGA3 and its association with various diseases and clinical conditions, has been established by previous studies, as described hereinabove with reference to VGAM353. BART1 (Accession NM_012106) is another VGAM1019 host target gene. BART1 BINDING SITE is HOST TARGET binding site found in the 3' untranslated region of mRNA encoded by BART1, corresponding to a HOST TARGET binding site such as BINDING SITE I, BINDING SITE II or BINDING SITE III. Table 2 illustrates the complementarity of the nucleotide sequences of BART1 BINDING SITE, designated SEQ ID:14424, to the nucleotide sequence of VGAM1019 RNA, herein designated VGAM RNA, also designated SEQ ID:3730.

Another function of VGAM1019 is therefore inhibition of BART1 (Accession NM_012106). Accordingly, utilities of VGAM1019 include diagnosis, prevention and treatment of diseases and clinical conditions associated with BART1. Chloride Intracellular Channel 4 (CLIC4, Accession NM_013943) is another VGAM1019 host target gene. CLIC4 BINDING SITE is HOST TARGET binding site found in the 3' untranslated region of mRNA encoded by CLIC4, corresponding to a HOST TARGET binding site such as BINDING SITE I, BINDING SITE II or BINDING SITE III. Table 2 illustrates the complementarity of the nucleotide sequences of CLIC4 BINDING SITE, designated SEQ ID:15130, to the nucleotide sequence of VGAM1019 RNA, herein designated VGAM RNA, also designated SEQ ID:3730.

Another function of VGAM1019 is therefore inhibition of Chloride Intracellular Channel 4 (CLIC4, Accession NM_013943). Accordingly, utilities of VGAM1019 include diagnosis, prevention and treatment of diseases and clinical conditions associated with CLIC4. CMG2 (Accession NM_058172) is another VGAM1019 host target gene. CMG2 BINDING SITE is HOST TARGET binding site found in the 3' untranslated region of mRNA encoded by CMG2, corresponding to a HOST TARGET binding site such as BINDING SITE I, BINDING SITE II or BINDING SITE III. Table 2 illustrates the complementarity of the nucleotide sequences of CMG2 BINDING SITE, designated SEQ ID:27721, to the nucleotide sequence of VGAM1019 RNA, herein designated VGAM RNA, also designated SEQ ID:3730.

Another function of VGAM1019 is therefore inhibition of CMG2 (Accession NM_058172). Accordingly, utilities of VGAM1019 include diagnosis, prevention and treatment of diseases and clinical conditions associated with CMG2. DKFZp761K1423 (Accession NM_018422) is another VGAM1019 host target gene. DKFZp761K1423 BINDING SITE is HOST TARGET binding site found in the 5' untranslated region of mRNA encoded by DKFZp761K1423, corresponding to a HOST TARGET binding site such as BINDING SITE I, BINDING SITE II or BINDING SITE III. Table 2 illustrates the complementarity of the nucleotide sequences of DKFZp761K1423 BINDING SITE, designated SEQ ID:20472, to the nucleotide sequence of VGAM1019 RNA, herein designated VGAM RNA, also designated SEQ ID:3730.

Another function of VGAM1019 is therefore inhibition of DKFZp761K1423 (Accession NM_018422). Accordingly, utilities of VGAM1019 include diagnosis, prevention and treatment of diseases and clinical conditions associated with DKFZp761K1423. GAPCENA (Accession NM_012197) is another VGAM1019 host target gene. GAPCENA BINDING SITE is HOST TARGET binding site found in the 5' untranslated region of mRNA encoded by GAPCENA, corresponding to a HOST TARGET binding site such as BINDING SITE I, BINDING SITE II or BINDING SITE III. Table 2 illustrates the complementarity of the nucleotide sequences of GAPCENA BINDING SITE, designated SEQ ID:14493, to the nucleotide sequence of VGAM1019 RNA, herein designated VGAM RNA, also designated SEQ ID:3730.

Another function of VGAM1019 is therefore inhibition of GAPCENA (Accession NM_012197). Accordingly, utilities of VGAM1019 include diagnosis, prevention and treatment of diseases and clinical conditions associated with GAPCENA. G Protein Pathway Suppressor 2 (GPS2, Accession XM_102749) is another VGAM1019 host target gene. GPS2 BINDING SITE is HOST TARGET binding site found in the 5' untranslated region of mRNA encoded by GPS2, corresponding to a HOST TARGET binding site such as BINDING SITE I, BINDING SITE II or BINDING SITE III. Table 2 illustrates the complementarity of the nucleotide sequences of GPS2 BINDING SITE, designated SEQ ID:42145, to the nucleotide sequence of VGAM1019 RNA, herein designated VGAM RNA, also designated SEQ ID:3730.

Another function of VGAM1019 is therefore inhibition of G Protein Pathway Suppressor 2 (GPS2, Accession XM_102749). Accordingly, utilities of VGAM1019 include diagnosis, prevention and treatment of diseases and clinical conditions associated with GPS2. HTEX4 (Accession XM_166378) is another VGAM1019 host target gene. HTEX4 BINDING SITE1 through HTEX4 BINDING SITE3 are HOST TARGET binding sites found in untranslated regions of mRNA encoded by HTEX4, corresponding to HOST TARGET binding sites such as BINDING SITE I, BINDING SITE II or BINDING SITE III. Table 2 illustrates the complementarity of the nucleotide sequences of HTEX4 BINDING SITE1 through HTEX4 BINDING SITE3, designated SEQ ID:44216, SEQ ID:46652 and SEQ ID:46721 respectively, to the nucleotide sequence of VGAM1019 RNA, herein designated VGAM RNA, also designated SEQ ID:3730.

Another function of VGAM1019 is therefore inhibition of HTEX4 (Accession XM_166378). Accordingly, utilities of VGAM1019 include diagnosis, prevention and treatment of diseases and clinical conditions associated with HTEX4. KIAA1887 (Accession XM_084801) is another VGAM1019 host target gene. KIAA1887 BINDING SITE is HOST TARGET binding site found in the 5' untranslated region of mRNA encoded by KIAA1887, corresponding to a HOST TARGET binding site such as BINDING SITE I, BINDING SITE II or BINDING SITE III. Table 2 illustrates the complementarity of the nucleotide sequences of KIAA1887 BINDING SITE, designated SEQ ID:37716, to the nucleotide sequence of VGAM1019 RNA, herein designated VGAM RNA, also designated SEQ ID:3730.

Another function of VGAM1019 is therefore inhibition of KIAA1887 (Accession XM_084801). Accordingly, utilities of VGAM1019 include diagnosis, prevention and treatment of diseases and clinical conditions associated with KIAA1887. MGC13061 (Accession NM_032322) is another VGAM1019 host target gene. MGC13061 BINDING SITE is HOST TARGET binding site found in the 3' untranslated region of mRNA encoded by MGC13061, corresponding to a HOST TARGET binding site such as BINDING SITE I, BINDING SITE II or BINDING SITE III. Table 2 illustrates the complementarity of the nucleotide sequences of MGC13061 BINDING SITE, designated SEQ ID:26128, to the nucleotide sequence of VGAM1019 RNA, herein designated VGAM RNA, also designated SEQ ID:3730.

Another function of VGAM1019 is therefore inhibition of MGC13061 (Accession NM_032322). Accordingly, utilities of VGAM1019 include diagnosis, prevention and treatment of diseases and clinical conditions associated with MGC13061. Phospholipid Scramblase 2 (PLSCR2, Accession NM_020359) is another VGAM1019 host target gene. PLSCR2 BINDING SITE is HOST TARGET binding site found in the 5' untranslated region of mRNA encoded by PLSCR2, corresponding to a HOST TARGET binding site such as BINDING SITE I, BINDING SITE II or BINDING SITE III. Table 2 illustrates the complementarity of the nucleotide sequences of PLSCR2 BINDING SITE, designated SEQ ID:21630, to the nucleotide sequence of VGAM1019 RNA, herein designated VGAM RNA, also designated SEQ ID:3730.

Another function of VGAM1019 is therefore inhibition of Phospholipid Scramblase 2 (PLSCR2, Accession NM_020359). Accordingly, utilities of VGAM1019 include diagnosis, prevention and treatment of diseases and clinical conditions associated with PLSCR2. Suppression of Tumorigenicity 7 Like (ST7L, Accession NM_138727) is another VGAM1019 host target gene. ST7L BINDING SITE1 through ST7L BINDING SITE3 are HOST TARGET binding sites found in untranslated regions of mRNA encoded by ST7L, corresponding to HOST TARGET binding sites such as BINDING SITE I, BINDING SITE II or BINDING SITE III. Table 2 illustrates the complementarity of the nucleotide sequences of ST7L BINDING SITE1 through ST7L BINDING SITE3, designated SEQ ID:28975, SEQ ID:29205 and SEQ ID:19333 respectively, to the nucleotide sequence of VGAM1019 RNA, herein designated VGAM RNA, also designated SEQ ID:3730.

Another function of VGAM1019 is therefore inhibition of Suppression of Tumorigenicity 7 Like (ST7L, Accession NM_138727). Accordingly, utilities of VGAM1019 include diagnosis, prevention and treatment of diseases and clinical conditions associated with ST7L. Trinucleotide Repeat Containing 9 (TNRC9, Accession XM_049037) is another VGAM1019 host target gene. TNRC9 BINDING SITE is HOST TARGET binding site found in the 3' untranslated region of mRNA encoded by TNRC9, corresponding to a HOST TARGET binding site such as BINDING SITE I, BINDING SITE II or BINDING SITE III. Table 2 illustrates the complementarity of the nucleotide sequences of TNRC9 BINDING SITE, designated SEQ ID:35320, to the nucleotide sequence of VGAM1019 RNA, herein designated VGAM RNA, also designated SEQ ID:3730.

Another function of VGAM1019 is therefore inhibition of Trinucleotide Repeat Containing 9 (TNRC9, Accession XM_049037). Accordingly, utilities of VGAM1019 include diagnosis, prevention and treatment of diseases and clinical conditions associated with TNRC9. LOC120534 (Accession XM_058476) is another VGAM1019 host target gene. LOC120534 BINDING SITE is HOST TARGET binding site found in the 3' untranslated region of mRNA encoded by LOC120534, corresponding to a HOST TARGET binding site such as BINDING SITE I, BINDING SITE II or BINDING SITE III. Table 2 illustrates the complementarity of the nucleotide sequences of LOC120534 BINDING SITE, designated SEQ ID:36625, to the nucleotide sequence of VGAM1019 RNA, herein designated VGAM RNA, also designated SEQ ID:3730.

Another function of VGAM1019 is therefore inhibition of LOC120534 (Accession XM_058476). Accordingly, utilities of VGAM1019 include diagnosis, prevention and treatment of diseases and clinical conditions associated with LOC120534. LOC147991 (Accession XM_085993) is another VGAM1019 host target gene. LOC147991 BINDING SITE is HOST TARGET binding site found in the 5' untranslated region of mRNA encoded by LOC147991, corresponding to a HOST TARGET binding site such as BINDING SITE I, BINDING SITE II or BINDING SITE III. Table 2 illustrates the complementarity of the nucleotide sequences of LOC147991 BINDING SITE, designated SEQ ID:38434, to the nucleotide sequence of VGAM1019 RNA, herein designated VGAM RNA, also designated SEQ ID:3730.

Another function of VGAM1019 is therefore inhibition of LOC147991 (Accession XM_085993). Accordingly, utilities of VGAM1019 include diagnosis, prevention and treatment of diseases and clinical conditions associated with LOC147991. LOC149386 (Accession XM_097631) is another VGAM1019 host target gene. LOC149386 BINDING SITE is HOST TARGET binding site found in the 5' untranslated region of mRNA encoded by LOC149386, corresponding to a HOST TARGET binding site such as BINDING SITE I, BINDING SITE II or BINDING SITE III. Table 2 illustrates the complementarity of the nucleotide sequences of LOC149386 BINDING SITE, designated SEQ ID:40986, to the nucleotide sequence of VGAM1019 RNA, herein designated VGAM RNA, also designated SEQ ID:3730.

Another function of VGAM1019 is therefore inhibition of LOC149386 (Accession XM_097631). Accordingly, utilities of VGAM1019 include diagnosis, prevention and treatment of diseases and clinical conditions associated with LOC149386. LOC150378 (Accession XM_086857) is another VGAM1019 host target gene. LOC150378 BINDING SITE is HOST TARGET binding site found in the 5' untranslated region of mRNA encoded by LOC150378, corresponding to a HOST TARGET binding site such as BINDING SITE I, BINDING SITE II or BINDING SITE III. Table 2 illustrates the complementarity of the nucleotide sequences of LOC150378 BINDING SITE, designated SEQ ID:38923, to the nucleotide sequence of VGAM1019 RNA, herein designated VGAM RNA, also designated SEQ ID:3730.

Another function of VGAM1019 is therefore inhibition of LOC150378 (Accession XM_086857). Accordingly, utilities of VGAM1019 include diagnosis, prevention and treatment of diseases and clinical conditions associated with LOC150378. LOC151194 (Accession NM_145280) is another VGAM1019 host target gene. LOC151194 BINDING SITE is HOST TARGET binding site found in the 3' untranslated region of mRNA encoded by LOC151194, corresponding to a HOST TARGET binding site such as BINDING SITE I, BINDING SITE II or BINDING SITE III. Table 2 illustrates the complementarity of the nucleotide sequences of LOC151194 BINDING SITE, designated SEQ ID:29797, to the nucleotide sequence of VGAM1019 RNA, herein designated VGAM RNA, also designated SEQ ID:3730.

Another function of VGAM1019 is therefore inhibition of LOC151194 (Accession NM_145280). Accordingly, utilities of VGAM1019 include diagnosis, prevention and treatment of diseases and clinical conditions associated with LOC151194. LOC152402 (Accession XM_098222) is another VGAM1019 host target gene. LOC152402 BINDING SITE is HOST TARGET binding site found in the 5' untranslated region of mRNA encoded by LOC152402, corresponding to a HOST TARGET binding site such as BINDING SITE I, BINDING SITE II or BINDING SITE III. Table 2 illustrates the complementarity of the nucleotide sequences of LOC152402 BINDING SITE, designated SEQ ID:41495, to the nucleotide sequence of VGAM1019 RNA, herein designated VGAM RNA, also designated SEQ ID:3730.

Another function of VGAM1019 is therefore inhibition of LOC152402 (Accession XM_098222). Accordingly, utilities of VGAM1019 include diagnosis, prevention and treatment of diseases and clinical conditions associated with LOC152402. LOC152633 (Accession XM_098248) is another VGAM1019 host target gene. LOC152633 BINDING SITE is HOST TARGET binding site found in the 5' untranslated region of mRNA encoded by LOC152633, corresponding to a HOST TARGET binding site such as BINDING SITE I, BINDING SITE II or BINDING SITE III. Table 2 illustrates the complementarity of the nucleotide sequences of LOC152633 BINDING SITE, designated SEQ ID:41533, to the nucleotide sequence of VGAM1019 RNA, herein designated VGAM RNA, also designated SEQ ID:3730.

Another function of VGAM1019 is therefore inhibition of LOC152633 (Accession XM_098248). Accordingly, utilities of VGAM1019 include diagnosis, prevention and treatment of diseases and clinical conditions associated with LOC152633. LOC201116 (Accession XM_113896) is another VGAM1019 host target gene. LOC201116 BINDING SITE is HOST TARGET binding site found in the 5' untranslated region of mRNA encoded by LOC201116, corresponding to a HOST TARGET binding site such as BINDING SITE I, BINDING SITE II or BINDING SITE III. Table 2 illustrates the complementarity of the nucleotide sequences of LOC201116 BINDING SITE, designated SEQ ID:42525, to the nucleotide sequence of VGAM1019 RNA, herein designated VGAM RNA, also designated SEQ ID:3730.

Another function of VGAM1019 is therefore inhibition of LOC201116 (Accession XM_113896). Accordingly, utilities of VGAM1019 include diagnosis, prevention and treatment of diseases and clinical conditions associated with LOC201116. LOC253142 (Accession XM_173229) is another VGAM1019 host target gene. LOC253142 BINDING SITE is HOST TARGET binding site found in the 5' untranslated region of mRNA encoded by LOC253142, corresponding to a HOST TARGET binding site such as BINDING SITE I, BINDING SITE II or BINDING SITE III. Table 2 illustrates the complementarity of the nucleotide sequences of LOC253142 BINDING SITE, designated SEQ ID:46501, to the nucleotide sequence of VGAM1019 RNA, herein designated VGAM RNA, also designated SEQ ID:3730.

Another function of VGAM1019 is therefore inhibition of LOC253142 (Accession XM_173229). Accordingly, utilities of VGAM1019 include diagnosis, prevention and treatment of diseases and clinical conditions associated with LOC253142. LOC254065 (Accession XM_173239) is another VGAM1019 host target gene. LOC254065 BINDING SITE is HOST TARGET binding site found in the 5' untranslated region of mRNA encoded by LOC254065, corresponding to a HOST TARGET binding site such as BINDING SITE I, BINDING SITE II or BINDING SITE III. Table 2 illustrates the complementarity of the nucleotide sequences of LOC254065 BINDING SITE, designated SEQ ID:46520, to the nucleotide sequence of VGAM1019 RNA, herein designated VGAM RNA, also designated SEQ ID:3730.

Another function of VGAM1019 is therefore inhibition of LOC254065 (Accession XM_173239). Accordingly, utilities of VGAM1019 include diagnosis, prevention and treatment of diseases and clinical conditions associated with LOC254065. FIG. 1 further provides a conceptual description of a novel bioinformatically detected viral gene of the present invention, referred to here as Viral Genomic Address Messenger 1020 (VGAM1020) viral gene, which modulates expression of respective host target genes thereof, the function and utility of which host target genes is known in the art.

VGAM1020 is a novel bioinformatically detected regulatory, non protein coding, viral micro RNA (miRNA) gene. The method by which VGAM1020 was detected is described hereinabove with reference to FIGS. 1-8.

VGAM1020 gene, herein designated VGAM GENE, is a viral gene contained in the genome of Cereal Yellow Dwarf Virus - RPV. VGAM1020 host target gene, herein designated VGAM HOST TARGET GENE, is a human gene contained in the human genome.

VGAM1020 gene encodes a VGAM1020 precursor RNA, herein designated VGAM PRECURSOR RNA. Similar to other miRNA genes, and unlike most ordinary genes, VGAM1020 precursor RNA does not encode a protein. A nucleotide sequence identical or highly similar to the nucleotide sequence of VGAM1020 precursor RNA is designated SEQ ID:1006, and is provided hereinbelow with reference to the sequence listing part. Nucleotide sequence SEQ ID:1006 is located at position 3793 relative to the genome of Cereal Yellow Dwarf Virus - RPV.

VGAM1020 precursor RNA folds onto itself, forming VGAM1020 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1020 folded precursor RNA into VGAM1020 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1020 RNA is designated SEQ ID:3731, and is provided hereinbelow with reference to the sequence listing part.

VGAM1020 host target gene, herein designated VGAM HOST TARGET GENE, encodes a corresponding messenger RNA, VGAM1020 host target RNA, herein designated VGAM HOST TARGET RNA. VGAM1020 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1020 RNA, herein designated VGAM RNA, binds complementarily to one or more host target binding sites located in untranslated regions of VGAM1020 host target RNA, herein designated VGAM HOST TARGET RNA. This complementary binding is due to the fact that the nucleotide sequence of VGAM1020 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1020 RNA, herein designated VGAM RNA, may have a different number of host target binding sites in untranslated regions of a VGAM1020 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1020 RNA, herein designated VGAM RNA, to host target binding sites on VGAM1020 host target RNA, herein designated VGAM HOST TARGET RNA, such as BINDING SITE I, BINDING SITE II and BINDING SITE III, inhibits translation of VGAM1020 host target RNA into VGAM1020 host target protein, herein designated VGAM HOST TARGET PROTEIN. VGAM host target protein is therefore outlined by a broken line.

It is appreciated that VGAM1020 host target gene, herein designated VGAM HOST TARGET GENE, in fact represents a plurality of VGAM1020 host target genes. The mRNA of each one of this plurality of VGAM1020 host target genes comprises one or more host target binding sites, each having a nucleotide sequence which is at least partly complementary to VGAM1020 RNA, herein designated VGAM RNA, and which when bound by VGAM1020 RNA causes inhibition of translation of respective one or more VGAM1020 host target proteins.

It is further appreciated by one skilled in the art that the mode of translational inhibition illustrated by FIG. 1 with specific reference to translational inhibition exerted by VGAM1020 gene, herein designated VGAM GENE, on one or more VGAM1020 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1020 is inhibition of expression of host target genes, as part of a novel viral mechanism of attacking a host. Accordingly, utilities of VGAM1020 include diagnosis, prevention and treatment of viral infection by Cereal Yellow Dwarf Virus - RPV. Specific functions, and accordingly utilities, of VGAM1020 correlate with, and may be deduced from, the identity of the host target genes which VGAM1020 binds and inhibits, and the function of these host target genes, as elaborated hereinbelow.

Nucleotide sequences of the VGAM1020 precursor RNA, herein designated VGAM PRECURSOR RNA, and of the 'diced' VGAM1020 RNA, herein designated VGAM RNA, and a schematic representation of the secondary folding of VGAM1020 folded precursor RNA, herein designated VGAM FOLDED PRECURSOR RNA, of VGAM1020 are further described hereinbelow with reference to Table 1.

Nucleotide sequences of host target binding sites, such as BINDING SITE-I, BINDING SITE-II and BINDING SITE-III of FIG. 1, found on VGAM1020 host target RNA, and schematic representation of the complementarity of each of these host target binding sites to VGAM1020 RNA, herein designated VGAM RNA, are described hereinbelow with reference to Table 2.

As mentioned hereinabove with reference to FIG. 1, a function of VGAM1020 gene, herein designated VGAM is inhibition of expression of VGAM1020 target genes. It is appreciated that specific functions, and accordingly utilities, of VGAM1020 correlate with, and may be deduced from, the identity of the target genes which VGAM1020 binds and inhibits, and the function of these target genes, as elaborated hereinbelow.

Acetylcholinesterase (YT blood group) (ACHE, Accession NM_015831) is a VGAM1020 host target gene. ACHE BINDING SITE is HOST TARGET binding site found in the 3' untranslated region of mRNA encoded by ACHE, corresponding to a HOST TARGET binding site such as BINDING SITE I, BINDING SITE II or BINDING SITE III. Table 2 illustrates the complementarity of the nucleotide sequences of ACHE BINDING SITE, designated SEQ ID:17942, to the nucleotide sequence of VGAM1020 RNA, herein designated VGAM RNA, also designated SEQ ID:3731.

A function of VGAM1020 is therefore inhibition of Acetylcholinesterase (YT blood group) (ACHE, Accession NM_015831), a gene which rapidly hydrolyzes choline released into the synapse. Accordingly, utilities of VGAM1020 include diagnosis, prevention and treatment of diseases and clinical conditions associated with ACHE. The function of ACHE has been established by previous studies. Coates and Simpson (1972) concluded that 3 phenotypic variants of acetylcholinesterase (EC 3.1.1.7) result from 2 codominant alleles at a single locus. Rotundo et al. (1988) showed that all the forms of acetylcholinesterase observed in avian nerves and muscle are encoded by a single autosomal gene. Differences in assembly and localization of the multiple synaptic forms of acetylcholinesterase are thought to arise through posttranscriptional events. Lapidot-Lifson et al. (1989) referred to the cloning of the gene for acetylcholinesterase. They used these clones to study the coamplification of acetylcholinesterase and pseudocholinesterase (butyrylcholinesterase; BCHE; 177400). Their coamplification in certain leukemias and in disorders of platelet formation suggest that the 2 loci may be linked. (The pseudocholinesterase gene is located at 3q25.2.) Whereas pseudocholinesterase is a soluble plasma enzyme presumed to be produced by the liver but also present in muscle and brain, acetylcholinesterase or 'true' cholinesterase is involved in the signal transmission at neuromuscular junctions and is also intensely expressed in the human central nervous system and the erythrocyte membrane. That such was the case was demonstrated by Getman et al. (1992). By chromosomal in situ suppression hybridization analysis, they showed that a single gene is located at 7q22 and confirmed the results by PCR analysis of genomic DNA from a human/hamster somatic cell hybrid containing a single human chromosome 7. Thus the gene maps to the same region that is frequently the site of nonrandom deletion in leukemias of myeloid cell precursors known to express acetylcholinesterase during normal differentiation. Animal model experiments lend further support to the function of ACHE. Feng et al. (1999) generated ColQ (OMIM Ref. No. 603033) -/- mice to study the roles played by ColQ and AChE in synapses and elsewhere.

It is appreciated that the abovementioned animal model for ACHE is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lapidot-Lifson, Y.; Prody, C. A.; Ginzberg, D.; Meytes, D.; Zakut, H.; Soreq, H.: Coamplification of human acetylcholinesterase and butyrylcholinesterase genes in blood cells: correlation with various leukemias and abnormal megakaryocytopoiesis. Proc. Nat. Acad. Sci. 86:4715-4719, 1989; and Feng, G.; Krejci, E.; Molgo, J.; Cunningham, J. M.; Massoulie, J.; Sanes, J. R.: Genetic analysis of collagen Q: roles in acetylcholinesterase and butyrylcholinesterase assembly and in.

Further studies establishing the function and utilities of ACHE are found in John Hopkins OMIM database record ID 100740, and in sited publications numbered 4120-412 and 4224 listed in the bibliography section hereinbelow, which are also hereby incorporated by reference. Adducin 1 (alpha) (ADD1, Accession NM_014190) is another VGAM1020 host target gene. ADD1 BINDING SITE is HOST TARGET binding site found in the 3' untranslated region of mRNA encoded by ADD1, corresponding to a HOST TARGET binding site such as BINDING SITE I, BINDING SITE II or BINDING SITE III. Table 2 illustrates the complementarity of the nucleotide sequences of ADD1 BINDING SITE, designated SEQ ID:15472, to the nucleotide sequence of VGAM1020 RNA, herein designated VGAM RNA, also designated SEQ ID:3731.

Another function of VGAM1020 is therefore inhibition of Adducin 1 (alpha) (ADD1, Accession NM_014190), a gene which membrane-cytoskeleton- protein that promotes the assembly of the spectrin-actin network. Accordingly, utilities of VGAM1020 include diagnosis, prevention and treatment of diseases and clinical conditions associated with ADD1. The function of ADD1 and its association with various diseases and clinical conditions, has been established by previous studies, as described hereinabove with reference to VGAM474. UDP-Gal:betaGlcNAc Beta 1,3-galactosyltransferase, Polypeptide 5 (B3GALT5, Accession NM_006057) is another VGAM1020 host target gene. B3GALT5 BINDING SITE1 through B3GALT5 BINDING SITE5 are HOST TARGET binding sites found in untranslated regions of mRNA encoded by B3GALT5, corresponding to HOST TARGET binding sites such as BINDING SITE I, BINDING SITE II or BINDING SITE III. Table 2 illustrates the complementarity of the nucleotide sequences of B3GALT5 BINDING SITE1 through B3GALT5 BINDING SITE5, designated SEQ ID:12697, SEQ ID:27021, SEQ ID:27025, SEQ ID:27030 and SEQ ID:27035 respectively, to the nucleotide sequence of VGAM1020 RNA, herein designated VGAM RNA, also designated SEQ ID:3731.

Another function of VGAM1020 is therefore inhibition of UDP-Gal:betaGlcNAc Beta 1,3-galactosyltransferase, Polypeptide 5 (B3GALT5, Accession NM_006057). Accordingly, utilities of VGAM1020 include diagnosis, prevention and treatment of diseases and clinical conditions associated with B3GALT5. Cysteine-rich Motor Neuron 1 (CRIM1, Accession NM_016441) is another VGAM1020 host target gene. CRIM1 BINDING SITE is HOST TARGET binding site found in the 3' untranslated region of mRNA encoded by CRIM1, corresponding to a HOST TARGET binding site such as BINDING SITE I, BINDING SITE II or BINDING SITE III. Table 2 illustrates the complementarity of the nucleotide sequences of CRIM1 BINDING SITE, designated SEQ ID:18560, to the nucleotide sequence of VGAM1020 RNA, herein designated VGAM RNA, also designated SEQ ID:3731.

Another function of VGAM1020 is therefore inhibition of Cysteine-rich Motor Neuron 1 (CRIM1, Accession NM_016441). Accordingly, utilities of VGAM1020 include diagnosis, prevention and treatment of diseases and clinical conditions associated with CRIM1. Epithelial Membrane Protein 1 (EMP1, Accession NM_001423) is another VGAM1020 host target gene. EMP1 BINDING SITE is HOST TARGET binding site found in the 3' untranslated region of mRNA encoded by EMP1, corresponding to a HOST TARGET binding site such as BINDING SITE I, BINDING SITE II or BINDING SITE III. Table 2 illustrates the complementarity of the nucleotide sequences of EMP1 BINDING SITE, designated SEQ ID:7133, to the nucleotide sequence of VGAM1020 RNA, herein designated VGAM RNA, also designated SEQ ID:3731.

Another function of VGAM1020 is therefore inhibition of Epithelial Membrane Protein 1 (EMP1, Accession NM_001423), a gene which plays a role in squamous cell differentiation; member of the PMP22/EMP/MP20 family of membrane glycoproteins. Accordingly, utilities of VGAM1020 include diagnosis, prevention and treatment of diseases and clinical conditions associated with EMP1. The function of EMP1 and its association with various diseases and clinical conditions, has been established by previous studies, as described hereinabove with reference to VGAM107. Coagulation Factor II (thrombin) Receptor-like 3 (F2RL3, Accession NM_003950) is another VGAM1020 host target gene. F2RL3 BINDING SITE is HOST TARGET binding site found in the 3' untranslated region of mRNA encoded by F2RL3, corresponding to a HOST TARGET binding site such as BINDING SITE I, BINDING SITE II or BINDING SITE III. Table 2 illustrates the complementarity of the nucleotide sequences of F2RL3 BINDING SITE, designated SEQ ID:10081, to the nucleotide sequence of VGAM1020 RNA, herein designated VGAM RNA, also designated SEQ ID:3731.

Another function of VGAM1020 is therefore inhibition of Coagulation Factor II (thrombin) Receptor-like 3 (F2RL3, Accession NM_003950), a gene which Protease-activated receptor 4; G protein-coupled receptor that increases phosphoinositide hydrolysis. Accordingly, utilities of VGAM1020 include diagnosis, prevention and treatment of diseases and clinical conditions associated with F2RL3. The function of F2RL3 and its association with various diseases and clinical conditions, has been established by previous studies, as described hereinabove with reference to VGAM193. Gamma-aminobutyric Acid (GABA) A Receptor, Epsilon (GABRE, Accession NM_004961) is another VGAM1020 host target gene. GABRE BINDING SITE1 through GABRE BINDING SITE4 are HOST TARGET binding sites found in untranslated regions of mRNA encoded by GABRE, corresponding to HOST TARGET binding sites such as BINDING SITE I, BINDING SITE II or BINDING SITE III. Table 2 illustrates the complementarity of the nucleotide sequences of GABRE BINDING SITE1 through GABRE BINDING SITE4, designated SEQ ID:11408, SEQ ID:22510, SEQ ID:22514 and SEQ ID:22531 respectively, to the nucleotide sequence of VGAM1020 RNA, herein designated VGAM RNA, also designated SEQ ID:3731.

Another function of VGAM1020 is therefore inhibition of Gamma-aminobutyric Acid (GABA) A Receptor, Epsilon (GABRE, Accession NM_004961), a gene which mediates neuronal inhibition by binding to the gaba/benzodiazepine receptor and opening an integral chloride channel. Accordingly, utilities of VGAM1020 include diagnosis, prevention and treatment of diseases and clinical conditions associated with GABRE. The function of GABRE and its association with various diseases and clinical conditions, has been established by previous studies, as described hereinabove with reference to VGAM259. Glutamate-ammonia Ligase (glutamine synthase) (GLUL, Accession NM_002065) is another VGAM1020 host target gene. GLUL BINDING SITE is HOST TARGET binding site found in the 3' untranslated region of mRNA encoded by GLUL, corresponding to a HOST TARGET binding site such as BINDING SITE I, BINDING SITE II or BINDING SITE III. Table 2 illustrates the complementarity of the nucleotide sequences of GLUL BINDING SITE, designated SEQ ID:7835, to the nucleotide sequence of VGAM1020 RNA, herein designated VGAM RNA, also designated SEQ ID:3731.

Another function of VGAM1020 is therefore inhibition of Glutamate-ammonia Ligase (glutamine synthase) (GLUL, Accession NM_002065), a gene which catalyzes the condensation of glutamate and ammonia to form glutamine. Accordingly, utilities of VGAM1020 include diagnosis, prevention and treatment of diseases and clinical conditions associated with GLUL. The function of GLUL and its association with various diseases and clinical conditions, has been established by previous studies, as described hereinabove with reference to VGAM948. Hairless Homolog (mouse) (HR, Accession NM_005144) is another VGAM1020 host target gene. HR BINDING SITE is HOST TARGET binding site found in the 5' untranslated region of mRNA encoded by HR, corresponding to a HOST TARGET binding site such as BINDING SITE I, BINDING SITE II or BINDING SITE III. Table 2 illustrates the complementarity of the nucleotide sequences of HR BINDING SITE, designated SEQ ID:11617, to the nucleotide sequence of VGAM1020 RNA, herein designated VGAM RNA, also designated SEQ ID:3731.

Another function of VGAM1020 is therefore inhibition of Hairless Homolog (mouse) (HR, Accession NM_005144). Accordingly, utilities of VGAM1020 include diagnosis, prevention and treatment of diseases and clinical conditions associated with HR. Integrin, Alpha 3 (antigen CD49C, alpha 3 subunit of VLA-3 receptor) (ITGA3, Accession NM_005501) is another VGAM1020 host target gene. ITGA3 BINDING SITE1 and ITGA3 BINDING SITE2 are HOST TARGET binding sites found in untranslated regions of mRNA encoded by ITGA3, corresponding to HOST TARGET binding sites such as BINDING SITE I, BINDING SITE II or BINDING SITE III. Table 2 illustrates the complementarity of the nucleotide sequences of ITGA3 BINDING SITE1 and ITGA3 BINDING SITE2, designated SEQ ID:12009 and SEQ ID:7966 respectively, to the nucleotide sequence of VGAM1020 RNA, herein designated VGAM RNA, also designated SEQ ID:3731.

Another function of VGAM1020 is therefore inhibition of Integrin, Alpha 3 (antigen CD49C, alpha 3 subunit of VLA-3 receptor) (ITGA3, Accession NM_005501), a gene which is a receptor for fibronectin, laminin, collagen, epligrin and thrombospondin. Accordingly, utilities of VGAM1020 include diagnosis, prevention and treatment of diseases and clinical conditions associated with ITGA3. The function of ITGA3 has been established by previous studies. Integrins are a family of cell surface adhesion molecules. Each integrin consists of a pair of noncovalently associated alpha and beta chains. Integrin alpha-chain sequences are characterized by a 7-fold repeated amino acid motif, of which the last 3 or 4 contain divalent cation-binding sites. The ITGA3 subunit is associated with ITGB1 (OMIM Ref. No. 135630). By screening a bladder carcinoma cDNA library with a hamster galactoprotein B3 (Gapb3) probe, Tsuji et al. (1991) isolated cDNAs encoding ITGA3. The deduced 1,019-amino acid mature ITGA3 protein contains 14 potential N-glycosylation sites and a potential cleavage site. Northern blot analysis detected a 4.8-kb ITGA3 transcript whose expression was induced by SV-40 transformation. By immunoscreening an endothelial cell cDNA library for ITGA3 protein, Takada et al. (1991) obtained an ITGA3 cDNA. Western blot analysis showed that recombinant ITGA3 was expressed as a 150-kD protein, the same size as the native protein. The deduced 1,051-amino acid ITGA3 protein has a 32-amino acid signal peptide, a 28-amino acid transmembrane domain, and a 32-amino acid cytoplasmic segment. ITGA3 also contains 13 potential N-glycosylation sites, 2 potential cleavage sites, and the 7 N-terminal repeating units characteristic of ITGAs. Northern blot analysis detected a 5-kb ITGA3 transcript in fibroblasts. Jones et al. (1998) determined that the ITGA3 gene spans 36.3 kb and contains 26 exons. By searching for sequences related to murine Itga3, Jones et al. (1998) identified a chromosome 17 clone corresponding to ITGA3. Human herpesvirus-8 (HHV-8) is implicated in the pathogenesis of Kaposi sarcoma. HHV-8 envelope glycoprotein B possesses the RGD amino acid motif known to interact with integrin molecules. Akula et al. (2002) found that HHV-8 infectivity was inhibited by RGD peptides, antibodies against the RGD-dependent integrins ITGA3 and ITGB1, and by soluble ITGA3/ITGB1. Expression of human ITGA3 increased the infectivity of virus for Chinese hamster ovary cells. Anti-glycoprotein B antibodies immunoprecipitated the virus-ITGA3 and -ITGB1 complexes, and virus-binding studies suggested a role for ITGA3/ITGB1 in HHV-8 entry. Further, HHV-8 infection induced the integrin-mediated activation of focal adhesion kinase (FAK; 600758). These findings implicated a role for ITGA3/ITGB1 and the associated signaling pathways in HHV-8 entry into target cells.

Full details of the abovementioned studies are described in the following publications, the disclosure of which are hereby incorporated by reference:

Akula, S. M.; Pramod, N. P.; Wang, F.-Z.; Chandran, B.: Integrin alpha-3/beta-1 (CD 49c/29) is a cellular receptor for Kaposi's sarcoma-associated herpesvirus (KSHV/HHV-8) entry into the target cells. Cell 108:407-419, 2002; and Jones, S. D.; van der Flier, A.; Sonnenberg, A.: Genomic organization of the human alpha-3 integrin subunit gene. Biochem. Biophys. Res. Commun. 248:896-898, 1998.

Further studies establishing the function and utilities of ITGA3 are found in John Hopkins OMIM database record ID 605025, and in sited publications numbered 334 and 4796-4798 listed in the bibliography section hereinbelow, which are also hereby incorporated by reference. Microtubule-associated Protein 1B (MAP1B, Accession NM_005909) is another VGAM1020 host target gene. MAP1B BINDING SITE is HOST TARGET binding site found in the 5' untranslated region of mRNA encoded by MAP1B, corresponding to a HOST TARGET binding site such as BINDING SITE I, BINDING SITE II or BINDING SITE III. Table 2 illustrates the complementarity of the nucleotide sequences of MAP1B BINDING SITE, designated SEQ ID:12534, to the nucleotide sequence of VGAM1020 RNA, herein designated VGAM RNA, also designated SEQ ID:3731.

Another function of VGAM1020 is therefore inhibition of Microtubule-associated Protein 1B (MAP1B, Accession NM_005909), a gene which may have a role in neuronal plasticity and brain development. Accordingly, utilities of VGAM1020 include diagnosis, prevention and treatment of diseases and clinical conditions associated with MAP1B. The function of MAP1B and its association with various diseases and clinical conditions, has been established by previous studies, as described hereinabove with reference to VGAM316. RAD51-like 1 (S. cerevisiae) (RAD51L1, Accession NM_002877) is another VGAM1020 host target gene. RAD51L1 BINDING SITE1 and RAD51L1 BINDING SITE2 are HOST TARGET binding sites found in untranslated regions of mRNA encoded by RAD51L1, corresponding to HOST TARGET binding sites such as BINDING SITE I, BINDING SITE II or BINDING SITE III. Table 2 illustrates the complementarity of the nucleotide sequences of RAD51L1 BINDING SITE1 and RAD51L1 BINDING SITE2, designated SEQ ID:8786 and SEQ ID:28575 respectively, to the nucleotide sequence of VGAM1020 RNA, herein designated VGAM RNA, also designated SEQ ID:3731.

Another function of VGAM1020 is therefore inhibition of RAD51-like 1 (S. cerevisiae) (RAD51L1, Accession NM_002877), a gene which is a member of the RAD51 family of strand-transfer proteins. Accordingly, utilities of VGAM1020 include diagnosis, prevention and treatment of diseases and clinical conditions associated with RAD51L1. The function of RAD51L1 has been established by previous studies. The E. coli RecA protein plays a major role in recombination and repair. The S. cerevisiae RAD51 protein is homologous to RecA and functions in both mitotic and meiotic homologous recombination and in double-stranded break repair. See RAD51A (OMIM Ref. No. 179617). By computerized searching of an EST database, Albala et al. (1997) identified human and mouse cDNAs encoding a protein with homology to RAD51. The predicted 350-amino acid human protein, designated RAD51B by them, shares 27 to 30% sequence identity with yeast and chicken RAD51 and human RAD51A. RAD51B contains conserved nucleotide-binding motifs, suggesting that it is an ATPase. Northern blot analysis revealed that RAD51B was expressed as a 1.8-kb mRNA in all tissues examined. In both mouse and human, the highest levels of expression were seen in testis, thymus, ovary, and spleen, tissues that undergo recombination events.

Full details of the abovementioned studies are described in the following publications, the disclosure of which are hereby incorporated by reference:

Albala, J. S.; Thelen, M. P.; Prange, C.; Fan, W.; Christensen, M.; Thompson, L. H.; Lennon, G. G.: Identification of a novel human RAD51 homolog, RAD51B. Genomics 46:476-479, 1997; and Masson, J.-Y.; Tarsounas, M. C.; Stasiak, A. Z.; Stasiak, A.; Shah, R.; McIlwraith, M. J.; Benson, F. E.; West, S. C.: Identification and purification of two distinct complexes containi.

Further studies establishing the function and utilities of RAD51L1 are found in John Hopkins OMIM database record ID 602948, and in sited publications numbered 1056-1057, 2743-1603, 105 and 1692 listed in the bibliography section hereinbelow, which are also hereby incorporated by reference. Wolf-Hirschhorn Syndrome Candidate 1 (WHSC1, Accession NM_133332) is another VGAM1020 host target gene. WHSC1 BINDING SITE1 through WHSC1 BINDING SITE3 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE3, designated SEQ ID:28445, SEQ ID:28462 and SEQ ID:11347 respectively, to the nucleotide sequence of VGAM1020 RNA, herein designated VGAM RNA, also designated SEQ ID:3731.

Another function of VGAM1020 is therefore inhibition of Wolf-Hirschhorn Syndrome Candidate 1 (WHSC1, Accession NM_133332), a gene which binds covalently to and repairs g/t mismatches. Accordingly, utilities of VGAM1020 include diagnosis, prevention and treatment of diseases and clinical conditions associated with WHSC1. The function of WHSC1 and its association with various diseases and clinical conditions, has been established by previous studies, as described hereinabove with reference to VGAM200. Chromosome 20 Open Reading Frame 12 (C20orf12, Accession NM_018152) is another VGAM1020 host target gene. C20orf12 BINDING SITE is HOST TARGET binding site found in the 5' untranslated region of mRNA encoded by C20orf12, corresponding to a HOST TARGET binding site such as BINDING SITE I, BINDING SITE II or BINDING SITE III. Table 2 illustrates the complementarity of the nucleotide sequences of C20orf12 BINDING SITE, designated SEQ ID:19956, to the nucleotide sequence of VGAM1020 RNA, herein designated VGAM RNA, also designated SEQ ID:3731.

Another function of VGAM1020 is therefore inhibition of Chromosome 20 Open Reading Frame 12 (C20orf12, Accession NM_018152). Accordingly, utilities of VGAM1020 include diagnosis, prevention and treatment of diseases and clinical conditions associated with C20orf12. CREB-H (Accession NM_032607) is another VGAM1020 host target gene. CREB-H BINDING SITE is HOST TARGET binding site found in the 3' untranslated region of mRNA encoded by CREB-H, corresponding to a HOST TARGET binding site such as BINDING SITE I, BINDING SITE II or BINDING SITE III. Table 2 illustrates the complementarity of the nucleotide sequences of CREB-H BINDING SITE, designated SEQ ID:26330, to the nucleotide sequence of VGAM1020 RNA, herein designated VGAM RNA, also designated SEQ ID:3731.

Another function of VGAM1020 is therefore inhibition of CREB-H (Accession NM_032607). Accordingly, utilities of VGAM1020 include diagnosis, prevention and treatment of diseases and clinical conditions associated with CREB-H. DEAD/H (Asp-Glu-Ala-Asp/His) Box Polypeptide 12 (CHL1-like helicase homolog, S. cerevisiae) (DDX12, Accession XM_006936) is another VGAM1020 host target gene. DDX12 BINDING SITE is HOST TARGET binding site found in the 3' untranslated region of mRNA encoded by DDX12, corresponding to a HOST TARGET binding site such as BINDING SITE I, BINDING SITE II or BINDING SITE III. Table 2 illustrates the complementarity of the nucleotide sequences of DDX12 BINDING SITE, designated SEQ ID:30023, to the nucleotide sequence of VGAM1020 RNA, herein designated VGAM RNA, also designated SEQ ID:3731.

Another function of VGAM1020 is therefore inhibition of DEAD/H (Asp-Glu-Ala-Asp/His) Box Polypeptide 12 (CHL1-like helicase homolog, S. cerevisiae) (DDX12, Accession XM_006936). Accordingly, utilities of VGAM1020 include diagnosis, prevention and treatment of diseases and clinical conditions associated with DDX12. DKFZp566H0824 (Accession NM_017535) is another VGAM1020 host target gene. DKFZp566H0824 BINDING SITE is HOST TARGET binding site found in the 5' untranslated region of mRNA encoded by DKFZp566H0824, corresponding to a HOST TARGET binding site such as BINDING SITE I, BINDING SITE II or BINDING SITE III. Table 2 illustrates the complementarity of the nucleotide sequences of DKFZp566H0824 BINDING SITE, designated SEQ ID:18973, to the nucleotide sequence of VGAM1020 RNA, herein designated VGAM RNA, also designated SEQ ID:3731.

Another function of VGAM1020 is therefore inhibition of DKFZp566H0824 (Accession NM_017535). Accordingly, utilities of VGAM1020 include diagnosis, prevention and treatment of diseases and clinical conditions associated with DKFZp566H0824. FLJ11259 (Accession NM_018370) is another VGAM1020 host target gene. FLJ11259 BINDING SITE is HOST TARGET binding site found in the 3' untranslated region of mRNA encoded by FLJ11259, corresponding to a HOST TARGET binding site such as BINDING SITE I, BINDING SITE II or BINDING SITE III. Table 2 illustrates the complementarity of the nucleotide sequences of FLJ11259 BINDING SITE, designated SEQ ID:20384, to the nucleotide sequence of VGAM1020 RNA, herein designated VGAM RNA, also designated SEQ ID:3731.

Another function of VGAM1020 is therefore inhibition of FLJ11259 (Accession NM_018370). Accordingly, utilities of VGAM1020 include diagnosis, prevention and treatment of diseases and clinical conditions associated with FLJ11259. FLJ14327 (Accession NM_024912) is another VGAM1020 host target gene. FLJ14327 BINDING SITE is HOST TARGET binding site found in the 3' untranslated region of mRNA encoded by FLJ14327, corresponding to a HOST TARGET binding site such as BINDING SITE I, BINDING SITE II or BINDING SITE III. Table 2 illustrates the complementarity of the nucleotide sequences of FLJ14327 BINDING SITE, designated SEQ ID:24428, to the nucleotide sequence of VGAM1020 RNA, herein designated VGAM RNA, also designated SEQ ID:3731.

Another function of VGAM1020 is therefore inhibition of FLJ14327 (Accession NM_024912). Accordingly, utilities of VGAM1020 include diagnosis, prevention and treatment of diseases and clinical conditions associated with FLJ14327. Forkhead Box D4 (FOXD4, Accession XM_095746) is another VGAM1020 host target gene. FOXD4 BINDING SITE is HOST TARGET binding site found in the 5' untranslated region of mRNA encoded by FOXD4, corresponding to a HOST TARGET binding site such as BINDING SITE I, BINDING SITE II or BINDING SITE III. Table 2 illustrates the complementarity of the nucleotide sequences of FOXD4 BINDING SITE, designated SEQ ID:40282, to the nucleotide sequence of VGAM1020 RNA, herein designated VGAM RNA, also designated SEQ ID:3731.

Another function of VGAM1020 is therefore inhibition of Forkhead Box D4 (FOXD4, Accession XM_095746). Accordingly, utilities of VGAM1020 include diagnosis, prevention and treatment of diseases and clinical conditions associated with FOXD4. Integrin, Alpha 10 (ITGA10, Accession XM_002097) is another VGAM1020 host target gene. ITGA10 BINDING SITE is HOST TARGET binding site found in the 3' untranslated region of mRNA encoded by ITGA10, corresponding to a HOST TARGET binding site such as BINDING SITE I, BINDING SITE II or BINDING SITE III. Table 2 illustrates the complementarity of the nucleotide sequences of ITGA10 BINDING SITE, designated SEQ ID:29865, to the nucleotide sequence of VGAM1020 RNA, herein designated VGAM RNA, also designated SEQ ID:3731.

Another function of VGAM1020 is therefore inhibition of Integrin, Alpha 10 (ITGA10, Accession XM_002097). Accordingly, utilities of VGAM1020 include diagnosis, prevention and treatment of diseases and clinical conditions associated with ITGA10. KIAA0544 (Accession XM_048119) is another VGAM1020 host target gene. KIAA0544 BINDING SITE is HOST TARGET binding site found in the 3' untranslated region of mRNA encoded by KIAA0544, corresponding to a HOST TARGET binding site such as BINDING SITE I, BINDING SITE II or BINDING SITE III. Table 2 illustrates the complementarity of the nucleotide sequences of KIAA0544 BINDING SITE, designated SEQ ID:35113, to the nucleotide sequence of VGAM1020 RNA, herein designated VGAM RNA, also designated SEQ ID:3731.

Another function of VGAM1020 is therefore inhibition of KIAA0544 (Accession XM_048119). Accordingly, utilities of VGAM1020 include diagnosis, prevention and treatment of diseases and clinical conditions associated with KIAA0544. KIAA0668 (Accession XM_039332) is another VGAM1020 host target gene. KIAA0668 BINDING SITE is HOST TARGET binding site found in the 3' untranslated region of mRNA encoded by KIAA0668, corresponding to a HOST TARGET binding site such as BINDING SITE I, BINDING SITE II or BINDING SITE III. Table 2 illustrates the complementarity of the nucleotide sequences of KIAA0668 BINDING SITE, designated SEQ ID:33052, to the nucleotide sequence of VGAM1020 RNA, herein designated VGAM RNA, also designated SEQ ID:3731.

Another function of VGAM1020 is therefore inhibition of KIAA0668 (Accession XM_039332). Accordingly, utilities of VGAM1020 include diagnosis, prevention and treatment of diseases and clinical conditions associated with KIAA0668. KIAA0774 (Accession XM_166270) is another VGAM1020 host target gene. KIAA0774 BINDING SITE is HOST TARGET binding site found in the 5' untranslated region of mRNA encoded by KIAA0774, corresponding to a HOST TARGET binding site such as BINDING SITE I, BINDING SITE II or BINDING SITE III. Table 2 illustrates the complementarity of the nucleotide sequences of KIAA0774 BINDING SITE, designated SEQ ID:44091, to the nucleotide sequence of VGAM1020 RNA, herein designated VGAM RNA, also designated SEQ ID:3731.

Another function of VGAM1020 is therefore inhibition of KIAA0774 (Accession XM_166270). Accordingly, utilities of VGAM1020 include diagnosis, prevention and treatment of diseases and clinical conditions associated with KIAA0774. KIAA0789 (Accession XM_033113) is another VGAM1020 host target gene. KIAA0789 BINDING SITE is HOST TARGET binding site found in the 5' untranslated region of mRNA encoded by KIAA0789, corresponding to a HOST TARGET binding site such as BINDING SITE I, BINDING SITE II or BINDING SITE III. Table 2 illustrates the complementarity of the nucleotide sequences of KIAA0789 BINDING SITE, designated SEQ ID:31848, to the nucleotide sequence of VGAM1020 RNA, herein designated VGAM RNA, also designated SEQ ID:3731.

Another function of VGAM1020 is therefore inhibition of KIAA0789 (Accession XM_033113). Accordingly, utilities of VGAM1020 include diagnosis, prevention and treatment of diseases and clinical conditions associated with KIAA0789. KIAA1855 (Accession XM_166453) is another VGAM1020 host target gene. KIAA1855 BINDING SITE is HOST TARGET binding site found in the 3' untranslated region of mRNA encoded by KIAA1855, corresponding to a HOST TARGET binding site such as BINDING SITE I, BINDING SITE II or BINDING SITE III. Table 2 illustrates the complementarity of the nucleotide sequences of KIAA1855 BINDING SITE, designated SEQ ID:44352, to the nucleotide sequence of VGAM1020 RNA, herein designated VGAM RNA, also designated SEQ ID:3731.

Another function of VGAM1020 is therefore inhibition of KIAA1855 (Accession XM_166453). Accordingly, utilities of VGAM1020 include diagnosis, prevention and treatment of diseases and clinical conditions associated with KIAA1855. MGC12538 (Accession NM_032746) is another VGAM1020 host target gene. MGC12538 BINDING SITE is HOST TARGET binding site found in the 3' untranslated region of mRNA encoded by MGC12538, corresponding to a HOST TARGET binding site such as BINDING SITE I, BINDING SITE II or BINDING SITE III. Table 2 illustrates the complementarity of the nucleotide sequences of MGC12538 BINDING SITE, designated SEQ ID:26482, to the nucleotide sequence of VGAM1020 RNA, herein designated VGAM RNA, also designated SEQ ID:3731.

Another function of VGAM1020 is therefore inhibition of MGC12538 (Accession NM_032746). Accordingly, utilities of VGAM1020 include diagnosis, prevention and treatment of diseases and clinical conditions associated with MGC12538. MIC2 Like 1 (MIC2L1, Accession NM_031462) is another VGAM1020 host target gene. MIC2L1 BINDING SITE is HOST TARGET binding site found in the 3' untranslated region of mRNA encoded by MIC2L1, corresponding to a HOST TARGET binding site such as BINDING SITE I, BINDING SITE II or BINDING SITE III. Table 2 illustrates the complementarity of the nucleotide sequences of MIC2L1 BINDING SITE, designated SEQ ID:25491, to the nucleotide sequence of VGAM1020 RNA, herein designated VGAM RNA, also designated SEQ ID:3731.

Another function of VGAM1020 is therefore inhibition of MIC2 Like 1 (MIC2L1, Accession NM_031462). Accordingly, utilities of VGAM1020 include diagnosis, prevention and treatment of diseases and clinical conditions associated with MIC2L1. NFASC (Accession XM_046808) is another VGAM1020 host target gene. NFASC BINDING SITE is HOST TARGET binding site found in the 3' untranslated region of mRNA encoded by NFASC, corresponding to a HOST TARGET binding site such as BINDING SITE I, BINDING SITE II or BINDING SITE III. Table 2 illustrates the complementarity of the nucleotide sequences of NFASC BINDING SITE, designated SEQ ID:34832, to the nucleotide sequence of VGAM1020 RNA, herein designated VGAM RNA, also designated SEQ ID:3731.

Another function of VGAM1020 is therefore inhibition of NFASC (Accession XM_046808). Accordingly, utilities of VGAM1020 include diagnosis, prevention and treatment of diseases and clinical conditions associated with NFASC. PEPP3 (Accession NM_014935) is another VGAM1020 host target gene. PEPP3 BINDING SITE is HOST TARGET binding site found in the 3' untranslated region of mRNA encoded by PEPP3, corresponding to a HOST TARGET binding site such as BINDING SITE I, BINDING SITE II or BINDING SITE III. Table 2 illustrates the complementarity of the nucleotide sequences of PEPP3 BINDING SITE, designated SEQ ID:17234, to the nucleotide sequence of VGAM1020 RNA, herein designated VGAM RNA, also designated SEQ ID:3731.

Another function of VGAM1020 is therefore inhibition of PEPP3 (Accession NM_014935). Accordingly, utilities of VGAM1020 include diagnosis, prevention and treatment of diseases and clinical conditions associated with PEPP3. Sialyltransferase 4A (beta-galactoside alpha-2,3-sialyltransferase) (SIAT4A, Accession NM_003033) is another VGAM1020 host target gene. SIAT4A BINDING SITE is HOST TARGET binding site found in the 5' untranslated region of mRNA encoded by SIAT4A, corresponding to a HOST TARGET binding site such as BINDING SITE I, BINDING SITE II or BINDING SITE III. Table 2 illustrates the complementarity of the nucleotide sequences of SIAT4A BINDING SITE, designated SEQ ID:8981, to the nucleotide sequence of VGAM1020 RNA, herein designated VGAM RNA, also designated SEQ ID:3731.

Another function of VGAM1020 is therefore inhibition of Sialyltransferase 4A (beta-galactoside alpha-2,3-sialyltransferase) (SIAT4A, Accession NM_003033). Accordingly, utilities of VGAM1020 include diagnosis, prevention and treatment of diseases and clinical conditions associated with SIAT4A. Signal-regulatory Protein Beta 1 (SIRPB1, Accession NM_006065) is another VGAM1020 host target gene. SIRPB1 BINDING SITE is HOST TARGET binding site found in the 3' untranslated region of mRNA encoded by SIRPB1, corresponding to a HOST TARGET binding site such as BINDING SITE I, BINDING SITE II or BINDING SITE III. Table 2 illustrates the complementarity of the nucleotide sequences of SIRPB1 BINDING SITE, designated SEQ ID:12708, to the nucleotide sequence of VGAM1020 RNA, herein designated VGAM RNA, also designated SEQ ID:3731.

Another function of VGAM1020 is therefore inhibition of Signal-regulatory Protein Beta 1 (SIRPB1, Accession NM_006065). Accordingly, utilities of VGAM1020 include diagnosis, prevention and treatment of diseases and clinical conditions associated with SIRPB1. STRAIT11499 (Accession NM_021242) is another VGAM1020 host target gene. STRAIT11499 BINDING SITE is HOST TARGET binding site found in the 3' untranslated region of mRNA encoded by STRAIT11499, corresponding to a HOST TARGET binding site such as BINDING SITE I, BINDING SITE II or BINDING SITE III. Table 2 illustrates the complementarity of the nucleotide sequences of STRAIT11499 BINDING SITE, designated SEQ ID:22212, to the nucleotide sequence of VGAM1020 RNA, herein designated VGAM RNA, also designated SEQ ID:3731.

Another function of VGAM1020 is therefore inhibition of STRAIT11499 (Accession NM_021242). Accordingly, utilities of VGAM1020 include diagnosis, prevention and treatment of diseases and clinical conditions associated with STRAIT11499. Zinc Finger Protein 339 (ZNF339, Accession NM_021220) is another VGAM1020 host target gene. ZNF339 BINDING SITE is HOST TARGET binding site found in the 5' untranslated region of mRNA encoded by ZNF339, corresponding to a HOST TARGET binding site such as BINDING SITE I, BINDING SITE II or BINDING SITE III. Table 2 illustrates the complementarity of the nucleotide sequences of ZNF339 BINDING SITE, designated SEQ ID:22199, to the nucleotide sequence of VGAM1020 RNA, herein designated VGAM RNA, also designated SEQ ID:3731.

Another function of VGAM1020 is therefore inhibition of Zinc Finger Protein 339 (ZNF339, Accession NM_021220). Accordingly, utilities of VGAM1020 include diagnosis, prevention and treatment of diseases and clinical conditions associated with ZNF339. LOC129676 (Accession XM_065341) is another VGAM1020 host target gene. LOC129676 BINDING SITE is HOST TARGET binding site found in the 5' untranslated region of mRNA encoded by LOC129676, corresponding to a HOST TARGET binding site such as BINDING SITE I, BINDING SITE II or BINDING SITE III. Table 2 illustrates the complementarity of the nucleotide sequences of LOC129676 BINDING SITE, designated SEQ ID:37286, to the nucleotide sequence of VGAM1020 RNA, herein designated VGAM RNA, also designated SEQ ID:3731.

Another function of VGAM1020 is therefore inhibition of LOC129676 (Accession XM_065341). Accordingly, utilities of VGAM1020 include diagnosis, prevention and treatment of diseases and clinical conditions associated with LOC129676. LOC132299 (Accession XM_059584) is another VGAM1020 host target gene. LOC132299 BINDING SITE is HOST TARGET binding site found in the 5' untranslated region of mRNA encoded by LOC132299, corresponding to a HOST TARGET binding site such as BINDING SITE I, BINDING SITE II or BINDING SITE III. Table 2 illustrates the complementarity of the nucleotide sequences of LOC132299 BINDING SITE, designated SEQ ID:37023, to the nucleotide sequence of VGAM1020 RNA, herein designated VGAM RNA, also designated SEQ ID:3731.

Another function of VGAM1020 is therefore inhibition of LOC132299 (Accession XM_059584). Accordingly, utilities of VGAM1020 include diagnosis, prevention and treatment of diseases and clinical conditions associated with LOC132299. LOC143287 (Accession XM_096410) is another VGAM1020 host target gene. LOC143287 BINDING SITE is HOST TARGET binding site found in the 3' untranslated region of mRNA encoded by LOC143287, corresponding to a HOST TARGET binding site such as BINDING SITE I, BINDING SITE II or BINDING SITE III. Table 2 illustrates the complementarity of the nucleotide sequences of LOC143287 BINDING SITE, designated SEQ ID:40345, to the nucleotide sequence of VGAM1020 RNA, herein designated VGAM RNA, also designated SEQ ID:3731.

Another function of VGAM1020 is therefore inhibition of LOC143287 (Accession XM_096410). Accordingly, utilities of VGAM1020 include diagnosis, prevention and treatment of diseases and clinical conditions associated with LOC143287. LOC144110 (Accession XM_084735) is another VGAM1020 host target gene. LOC144110 BINDING SITE is HOST TARGET binding site found in the 3' untranslated region of mRNA encoded by LOC144110, corresponding to a HOST TARGET binding site such as BINDING SITE I, BINDING SITE II or BINDING SITE III. Table 2 illustrates the complementarity of the nucleotide sequences of LOC144110 BINDING SITE, designated SEQ ID:37681, to the nucleotide sequence of VGAM1020 RNA, herein designated VGAM RNA, also designated SEQ ID:3731.

Another function of VGAM1020 is therefore inhibition of LOC144110 (Accession XM_084735). Accordingly, utilities of VGAM1020 include diagnosis, prevention and treatment of diseases and clinical conditions associated with LOC144110. LOC144373 (Accession XM_084841) is another VGAM1020 host target gene. LOC144373 BINDING SITE is HOST TARGET binding site found in the 3' untranslated region of mRNA encoded by LOC144373, corresponding to a HOST TARGET binding site such as BINDING SITE I, BINDING SITE II or BINDING SITE III. Table 2 illustrates the complementarity of the nucleotide sequences of LOC144373 BINDING SITE, designated SEQ ID:37728, to the nucleotide sequence of VGAM1020 RNA, herein designated VGAM RNA, also designated SEQ ID:3731.

Another function of VGAM1020 is therefore inhibition of LOC144373 (Accession XM_084841). Accordingly, utilities of VGAM1020 include diagnosis, prevention and treatment of diseases and clinical conditions associated with LOC144373. LOC145622 (Accession XM_085186) is another VGAM1020 host target gene. LOC145622 BINDING SITE is HOST TARGET binding site found in the 3' untranslated region of mRNA encoded by LOC145622, corresponding to a HOST TARGET binding site such as BINDING SITE I, BINDING SITE II or BINDING SITE III. Table 2 illustrates the complementarity of the nucleotide sequences of LOC145622 BINDING SITE, designated SEQ ID:37911, to the nucleotide sequence of VGAM1020 RNA, herein designated VGAM RNA, also designated SEQ ID:3731.

Another function of VGAM1020 is therefore inhibition of LOC145622 (Accession XM_085186). Accordingly, utilities of VGAM1020 include diagnosis, prevention and treatment of diseases and clinical conditions associated with LOC145622. LOC146520 (Accession XM_085492) is another VGAM1020 host target gene. LOC146520 BINDING SITE is HOST TARGET binding site found in the 5' untranslated region of mRNA encoded by LOC146520, corresponding to a HOST TARGET binding site such as BINDING SITE I, BINDING SITE II or BINDING SITE III. Table 2 illustrates the complementarity of the nucleotide sequences of LOC146520 BINDING SITE, designated SEQ ID:38187, to the nucleotide sequence of VGAM1020 RNA, herein designated VGAM RNA, also designated SEQ ID:3731.

Another function of VGAM1020 is therefore inhibition of LOC146520 (Accession XM_085492). Accordingly, utilities of VGAM1020 include diagnosis, prevention and treatment of diseases and clinical conditions associated with LOC146520. LOC146953 (Accession XM_085659) is another VGAM1020 host target gene. LOC146953 BINDING SITE is HOST TARGET binding site found in the 5' untranslated region of mRNA encoded by LOC146953, corresponding to a HOST TARGET binding site such as BINDING SITE I, BINDING SITE II or BINDING SITE III. Table 2 illustrates the complementarity of the nucleotide sequences of LOC146953 BINDING SITE, designated SEQ ID:38286, to the nucleotide sequence of VGAM1020 RNA, herein designated VGAM RNA, also designated SEQ ID:3731.

Another function of VGAM1020 is therefore inhibition of LOC146953 (Accession XM_085659). Accordingly, utilities of VGAM1020 include diagnosis, prevention and treatment of diseases and clinical conditions associated with LOC146953. LOC152283 (Accession XM_098196) is another VGAM1020 host target gene. LOC152283 BINDING SITE1 and LOC152283 BINDING SITE2 are HOST TARGET binding sites found in untranslated regions of mRNA encoded by LOC152283, corresponding to HOST TARGET binding sites such as BINDING SITE I, BINDING SITE II or BINDING SITE III. Table 2 illustrates the complementarity of the nucleotide sequences of LOC152283 BINDING SITE1 and LOC152283 BINDING SITE2, designated SEQ ID:41486 and SEQ ID:41487 respectively, to the nucleotide sequence of VGAM1020 RNA, herein designated VGAM RNA, also designated SEQ ID:3731.

Another function of VGAM1020 is therefore inhibition of LOC152283 (Accession XM_098196). Accordingly, utilities of VGAM1020 include diagnosis, prevention and treatment of diseases and clinical conditions associated with LOC152283. LOC155389 (Accession XM_088229) is another VGAM1020 host target gene. LOC155389 BINDING SITE is HOST TARGET binding site found in the 5' untranslated region of mRNA encoded by LOC155389, corresponding to a HOST TARGET binding site such as BINDING SITE I, BINDING SITE II or BINDING SITE III. Table 2 illustrates the complementarity of the nucleotide sequences of LOC155389 BINDING SITE, designated SEQ ID:39562, to the nucleotide sequence of VGAM1020 RNA, herein designated VGAM RNA, also designated SEQ ID:3731.

Another function of VGAM1020 is therefore inhibition of LOC155389 (Accession XM_088229). Accordingly, utilities of VGAM1020 include diagnosis, prevention and treatment of diseases and clinical conditions associated with LOC155389. LOC221218 (Accession XM_166281) is another VGAM1020 host target gene. LOC221218 BINDING SITE is HOST TARGET binding site found in the 5' untranslated region of mRNA encoded by LOC221218, corresponding to a HOST TARGET binding site such as BINDING SITE I, BINDING SITE II or BINDING SITE III. Table 2 illustrates the complementarity of the nucleotide sequences of LOC221218 BINDING SITE, designated SEQ ID:44092, to the nucleotide sequence of VGAM1020 RNA, herein designated VGAM RNA, also designated SEQ ID:3731.

Another function of VGAM1020 is therefore inhibition of LOC221218 (Accession XM_166281). Accordingly, utilities of VGAM1020 include diagnosis, prevention and treatment of diseases and clinical conditions associated with LOC221218. LOC253451 (Accession XM_171151) is another VGAM1020 host target gene. LOC253451 BINDING SITE is HOST TARGET binding site found in the 5' untranslated region of mRNA encoded by LOC253451, corresponding to a HOST TARGET binding site such as BINDING SITE I, BINDING SITE II or BINDING SITE III. Table 2 illustrates the complementarity of the nucleotide sequences of LOC253451 BINDING SITE, designated SEQ ID:45948, to the nucleotide sequence of VGAM1020 RNA, herein designated VGAM RNA, also designated SEQ ID:3731.

Another function of VGAM1020 is therefore inhibition of LOC253451 (Accession XM_171151). Accordingly, utilities of VGAM1020 include diagnosis, prevention and treatment of diseases and clinical conditions associated with LOC253451. LOC256974 (Accession XM_173190) is another VGAM1020 host target gene. LOC256974 BINDING SITE is HOST TARGET binding site found in the 5' untranslated region of mRNA encoded by LOC256974, corresponding to a HOST TARGET binding site such as BINDING SITE I, BINDING SITE II or BINDING SITE III. Table 2 illustrates the complementarity of the nucleotide sequences of LOC256974 BINDING SITE, designated SEQ ID:46436, to the nucleotide sequence of VGAM1020 RNA, herein designated VGAM RNA, also designated SEQ ID:3731.

Another function of VGAM1020 is therefore inhibition of LOC256974 (Accession XM_173190). Accordingly, utilities of VGAM1020 include diagnosis, prevention and treatment of diseases and clinical conditions associated with LOC256974. LOC90495 (Accession XM_032166) is another VGAM1020 host target gene. LOC90495 BINDING SITE is HOST TARGET binding site found in the 3' untranslated region of mRNA encoded by LOC90495, corresponding to a HOST TARGET binding site such as BINDING SITE I, BINDING SITE II or BINDING SITE III. Table 2 illustrates the complementarity of the nucleotide sequences of LOC90495 BINDING SITE, designated SEQ ID:31579, to the nucleotide sequence of VGAM1020 RNA, herein designated VGAM RNA, also designated SEQ ID:3731.

Another function of VGAM1020 is therefore inhibition of LOC90495 (Accession XM_032166). Accordingly, utilities of VGAM1020 include diagnosis, prevention and treatment of diseases and clinical conditions associated with LOC90495. FIG. 1 further provides a conceptual description of a novel bioinformatically detected viral gene of the present invention, referred to here as Viral Genomic Address Messenger 1021 (VGAM1021) viral gene, which modulates expression of respective host target genes thereof, the function and utility of which host target genes is known in the art.

VGAM1021 is a novel bioinformatically detected regulatory, non protein coding, viral micro RNA (miRNA) gene. The method by which VGAM1021 was detected is described hereinabove with reference to FIGS. 1-8.

VGAM1021 gene, herein designated VGAM GENE, is a viral gene contained in the genome of Cereal Yellow Dwarf Virus - RPV. VGAM1021 host target gene, herein designated VGAM HOST TARGET GENE, is a human gene contained in the human genome.

VGAM1021 gene encodes a VGAM1021 precursor RNA, herein designated VGAM PRECURSOR RNA. Similar to other miRNA genes, and unlike most ordinary genes, VGAM1021 precursor RNA does not encode a protein. A nucleotide sequence identical or highly similar to the nucleotide sequence of VGAM1021 precursor RNA is designated SEQ ID:1007, and is provided hereinbelow with reference to the sequence listing part. Nucleotide sequence SEQ ID:1007 is located at position 2132 relative to the genome of Cereal Yellow Dwarf Virus - RPV.

VGAM1021 precursor RNA folds onto itself, forming VGAM1021 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1021 folded precursor RNA into VGAM1021 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1021 RNA is designated SEQ ID:3732, and is provided hereinbelow with reference to the sequence listing part.

VGAM1021 host target gene, herein designated VGAM HOST TARGET GENE, encodes a corresponding messenger RNA, VGAM1021 host target RNA, herein designated VGAM HOST TARGET RNA. VGAM1021 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1021 RNA, herein designated VGAM RNA, binds complementarily to one or more host target binding sites located in untranslated regions of VGAM1021 host target RNA, herein designated VGAM HOST TARGET RNA. This complementary binding is due to the fact that the nucleotide sequence of VGAM1021 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1021 RNA, herein designated VGAM RNA, may have a different number of host target binding sites in untranslated regions of a VGAM1021 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1021 RNA, herein designated VGAM RNA, to host target binding sites on VGAM1021 host target RNA, herein designated VGAM HOST TARGET RNA, such as BINDING SITE I, BINDING SITE II and BINDING SITE III, inhibits translation of VGAM1021 host target RNA into VGAM1021 host target protein, herein designated VGAM HOST TARGET PROTEIN. VGAM host target protein is therefore outlined by a broken line.

It is appreciated that VGAM1021 host target gene, herein designated VGAM HOST TARGET GENE, in fact represents a plurality of VGAM1021 host target genes. The mRNA of each one of this plurality of VGAM1021 host target genes comprises one or more host target binding sites, each having a nucleotide sequence which is at least partly complementary to VGAM1021 RNA, herein designated VGAM RNA, and which when bound by VGAM1021 RNA causes inhibition of translation of respective one or more VGAM1021 host target proteins.

It is further appreciated by one skilled in the art that the mode of translational inhibition illustrated by FIG. 1 with specific reference to translational inhibition exerted by VGAM1021 gene, herein designated VGAM GENE, on one or more VGAM1021 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1021 is inhibition of expression of host target genes, as part of a novel viral mechanism of attacking a host. Accordingly, utilities of VGAM1021 include diagnosis, prevention and treatment of viral infection by Cereal Yellow Dwarf Virus - RPV. Specific functions, and accordingly utilities, of VGAM1021 correlate with, and may be deduced from, the identity of the host target genes which VGAM1021 binds and inhibits, and the function of these host target genes, as elaborated hereinbelow.

Nucleotide sequences of the VGAM1021 precursor RNA, herein designated VGAM PRECURSOR RNA, and of the 'diced' VGAM1021 RNA, herein designated VGAM RNA, and a schematic representation of the secondary folding of VGAM1021 folded precursor RNA, herein designated VGAM FOLDED PRECURSOR RNA, of VGAM1021 are further described hereinbelow with reference to Table 1.

Nucleotide sequences of host target binding sites, such as BINDING SITE-I, BINDING SITE-II and BINDING SITE-III of FIG. 1, found on VGAM1021 host target RNA, and schematic representation of the complementarity of each of these host target binding sites to VGAM1021 RNA, herein designated VGAM RNA, are described hereinbelow with reference to Table 2.

As mentioned hereinabove with reference to FIG. 1, a function of VGAM1021 gene, herein designated VGAM is inhibition of expression of VGAM1021 target genes. It is appreciated that specific functions, and accordingly utilities, of VGAM1021 correlate with, and may be deduced from, the identity of the target genes which VGAM1021 binds and inhibits, and the function of these target genes, as elaborated hereinbelow.

Centrosomal Protein 2 (CEP2, Accession NM_006779) is a VGAM1021 host target gene. CEP2 BINDING SITE is HOST TARGET binding site found in the 5' untranslated region of mRNA encoded by CEP2, corresponding to a HOST TARGET binding site such as BINDING SITE I, BINDING SITE II or BINDING SITE III. Table 2 illustrates the complementarity of the nucleotide sequences of CEP2 BINDING SITE, designated SEQ ID:13652, to the nucleotide sequence of VGAM1021 RNA, herein designated VGAM RNA, also designated SEQ ID:3732.

A function of VGAM1021 is therefore inhibition of Centrosomal Protein 2 (CEP2, Accession NM_006779), a gene which interacts with TC10 and CDC42. Accordingly, utilities of VGAM1021 include diagnosis, prevention and treatment of diseases and clinical conditions associated with CEP2. The function of CEP2 and its association with various diseases and clinical conditions, has been established by previous studies, as described hereinabove with reference to VGAM329. Dystrobrevin, Alpha (DTNA, Accession NM_001391) is another VGAM1021 host target gene. DTNA BINDING SITE1 through DTNA BINDING SITE4 are HOST TARGET binding sites found in untranslated regions of mRNA encoded by DTNA, corresponding to HOST TARGET binding sites such as BINDING SITE I, BINDING SITE II or BINDING SITE III. Table 2 illustrates the complementarity of the nucleotide sequences of DTNA BINDING SITE1 through DTNA BINDING SITE4, designated SEQ ID:7080, SEQ ID:26838, SEQ ID:26843 and SEQ ID:26848 respectively, to the nucleotide sequence of VGAM1021 RNA, herein designated VGAM RNA, also designated SEQ ID:3732.

Another function of VGAM1021 is therefore inhibition of Dystrobrevin, Alpha (DTNA, Accession NM_001391), a gene which may be involved in the formation and stability of synapses. Accordingly, utilities of VGAM1021 include diagnosis, prevention and treatment of diseases and clinical conditions associated with DTNA. The function of DTNA has been established by previous studies. The dystrophin-associated protein complex (DPC), located at the sarcolemma, can be divided into 3 subcomplexes: the dystroglycan complex, the sarcoglycan complex, and the cytoplasmic complex. The last consists of 2 families of proteins, the syntrophins and dystrobrevin. Metzinger et al. (1997) found that anti-dystrobrevin antibodies stain the sarcolemma in normal skeletal muscle, indicating that dystrobrevin colocalizes with dystrophin and the dystrophin-associated protein complex. By contrast, dystrobrevin membrane staining was severely reduced in muscles of Duchenne muscular dystrophy patients and also dramatically reduced in patients with limb-girdle muscular dystrophy arising from the loss of 1 or all of the sarcoglycan components (e.g., LGMD2C; 253700). Normal dystrobrevin staining was observed in patients with other forms of limb-girdle muscular dystrophy where dystrophin and the rest of the dystrophin-associated protein complex are normally expressed (e.g., LGMD2A; 253600), as well as in other neuromuscular disorders. Their results showed that dystrobrevin deficiency is a generic feature of dystrophies linked to dystrophin and the dystrophin-associated proteins. This was the first indication that a cytoplasmic component of the dystrophin-associated protein complex may be involved in the pathogenesis of limb-girdle muscular dystrophy. Left ventricular noncompaction (LVNC) is due to an arrest of myocardial morphogenesis. The disorder is characterized by a hypertrophic left ventricular with deep trabeculations and with poor systolic function, with or without associated left ventricular dilation. In some cases, the right ventricle is also affected. LVNC may be isolated (see OMIM Ref. No. 300183 and 604169) or associated with congenital heart anomalies such as ventricular septal defects, pulmonic stenosis, and atrial septal defects. Ichida et al. (2001) screened the DTNA gene in a Japanese family in which members of 4 generations were affected, 5 with LVNC associated with congenital heart defects (OMIM Ref. No. 606617) and 1 with isolated LVNC. They found a missense mutation in the DTNA gene, P121L (601239.0001).

Full details of the abovementioned studies are described in the following publications, the disclosure of which are hereby incorporated by reference:

Ichida, F.; Tsubata, S.; Bowles, K. R.; Haneda, N.; Uese, K.; Miyawaki, T.; Dreyer, W. J.; Messina, J.; Li, H.; Bowles, N. E.; Towbin, J. A.: Novel gene mutations in patients with left ventricular noncompaction or Barth syndrome. Circulation 103:1256-1263, 2001; and Metzinger, L.; Blake, D. J.; Squier, M. V.; Anderson, L. V. B.; Deconinck, A. E.; Nawrotzki, R.; Hilton-Jones, D.; Davies, K. E.: Dystrobrevin deficiency at the sarcolemma of patients.

Further studies establishing the function and utilities of DTNA are found in John Hopkins OMIM database record ID 601239, and in sited publications numbered 2841-2843, 751 and 7517-7520 listed in the bibliography section hereinbelow, which are also hereby incorporated by reference. Chromosome 6 Open Reading Frame 33 (C6orf33, Accession NM_133367) is another VGAM1021 host target gene. C6orf33 BINDING SITE is HOST TARGET binding site found in the 3' untranslated region of mRNA encoded by C6orf33, corresponding to a HOST TARGET binding site such as BINDING SITE I, BINDING SITE II or BINDING SITE III. Table 2 illustrates the complementarity of the nucleotide sequences of C6orf33 BINDING SITE, designated SEQ ID:28493, to the nucleotide sequence of VGAM1021 RNA, herein designated VGAM RNA, also designated SEQ ID:3732.

Another function of VGAM1021 is therefore inhibition of Chromosome 6 Open Reading Frame 33 (C6orf33, Accession NM_133367). Accordingly, utilities of VGAM1021 include diagnosis, prevention and treatment of diseases and clinical conditions associated with C6orf33. KIAA0089 (Accession XM_046056) is another VGAM1021 host target gene. KIAA0089 BINDING SITE is HOST TARGET binding site found in the 3' untranslated region of mRNA encoded by KIAA0089, corresponding to a HOST TARGET binding site such as BINDING SITE I, BINDING SITE II or BINDING SITE III. Table 2 illustrates the complementarity of the nucleotide sequences of KIAA0089 BINDING SITE, designated SEQ ID:34667, to the nucleotide sequence of VGAM1021 RNA, herein designated VGAM RNA, also designated SEQ ID:3732.

Another function of VGAM1021 is therefore inhibition of KIAA0089 (Accession XM_046056). Accordingly, utilities of VGAM1021 include diagnosis, prevention and treatment of diseases and clinical conditions associated with KIAA0089. Phosphatidylserine Decarboxylase (PISD, Accession NM_014338) is another VGAM1021 host target gene. PISD BINDING SITE is HOST TARGET binding site found in the 5' untranslated region of mRNA encoded by PISD, corresponding to a HOST TARGET binding site such as BINDING SITE I, BINDING SITE II or BINDING SITE III. Table 2 illustrates the complementarity of the nucleotide sequences of PISD BINDING SITE, designated SEQ ID:15657, to the nucleotide sequence of VGAM1021 RNA, herein designated VGAM RNA, also designated SEQ ID:3732.

Another function of VGAM1021 is therefore inhibition of Phosphatidylserine Decarboxylase (PISD, Accession NM_014338). Accordingly, utilities of VGAM1021 include diagnosis, prevention and treatment of diseases and clinical conditions associated with PISD. PNAS-127 (Accession NM_032490) is another VGAM1021 host target gene. PNAS-127 BINDING SITE is HOST TARGET binding site found in the 5' untranslated region of mRNA encoded by PNAS-127, corresponding to a HOST TARGET binding site such as BINDING SITE I, BINDING SITE II or BINDING SITE III. Table 2 illustrates the complementarity of the nucleotide sequences of PNAS-127 BINDING SITE, designated SEQ ID:26241, to the nucleotide sequence of VGAM1021 RNA, herein designated VGAM RNA, also designated SEQ ID:3732.

Another function of VGAM1021 is therefore inhibition of PNAS-127 (Accession NM_032490). Accordingly, utilities of VGAM1021 include diagnosis, prevention and treatment of diseases and clinical conditions associated with PNAS-127. Williams Beuren Syndrome Chromosome Region 21 (WBSCR21, Accession NM_031295) is another VGAM1021 host target gene. WBSCR21 BINDING SITE is HOST TARGET binding site found in the 5' untranslated region of mRNA encoded by WBSCR21, corresponding to a HOST TARGET binding site such as BINDING SITE I, BINDING SITE II or BINDING SITE III. Table 2 illustrates the complementarity of the nucleotide sequences of WBSCR21 BINDING SITE, designated SEQ ID:25326, to the nucleotide sequence of VGAM1021 RNA, herein designated VGAM RNA, also designated SEQ ID:3732.

Another function of VGAM1021 is therefore inhibition of Williams Beuren Syndrome Chromosome Region 21 (WBSCR21, Accession NM_031295). Accordingly, utilities of VGAM1021 include diagnosis, prevention and treatment of diseases and clinical conditions associated with WBSCR21.

LOC149721 (Accession XM_086649) is another VGAM1021 host target gene. LOC149721 BINDING SITE is HOST TARGET binding site found in the 5' untranslated region of mRNA encoded by LOC149721, corresponding to a HOST TARGET binding site such as BINDING SITE I, BINDING SITE II or BINDING SITE III. Table 2 illustrates the complementarity of the nucleotide sequences of LOC149721 BINDING SITE, designated SEQ ID:38809, to the nucleotide sequence of VGAM1021 RNA, herein designated VGAM RNA, also designated SEQ ID:3732.

Another function of VGAM1021 is therefore inhibition of LOC149721 (Accession XM_086649). Accordingly, utilities of VGAM1021 include diagnosis, prevention and treatment of diseases and clinical conditions associated with LOC149721. FIG. 1 further provides a conceptual description of a novel bioinformatically detected viral gene of the present invention, referred to here as Viral Genomic Address Messenger 1022 (VGAM1022) viral gene, which modulates expression of respective host target genes thereof, the function and utility of which host target genes is known in the art.

VGAM1022 is a novel bioinformatically detected regulatory, non protein coding, viral micro RNA (miRNA) gene. The method by which VGAM1022 was detected is described hereinabove with reference to FIGS. 1-8.

VGAM1022 gene, herein designated VGAM GENE, is a viral gene contained in the genome of Cereal Yellow Dwarf Virus - RPV. VGAM1022 host target gene, herein designated VGAM HOST TARGET GENE, is a human gene contained in the human genome.

VGAM1022 gene encodes a VGAM1022 precursor RNA, herein designated VGAM PRECURSOR RNA. Similar to other miRNA genes, and unlike most ordinary genes, VGAM1022 precursor RNA does not encode a protein. A nucleotide sequence identical or highly similar to the nucleotide sequence of VGAM1022 precursor RNA is designated SEQ ID:1008, and is provided hereinbelow with reference to the sequence listing part. Nucleotide sequence SEQ ID:1008 is located at position 2327 relative to the genome of Cereal Yellow Dwarf Virus - RPV.

VGAM1022 precursor RNA folds onto itself, forming VGAM1022 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1022 folded precursor RNA into VGAM1022 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1022 RNA is designated SEQ ID:3733, and is provided hereinbelow with reference to the sequence listing part.

VGAM1022 host target gene, herein designated VGAM HOST TARGET GENE, encodes a corresponding messenger RNA, VGAM1022 host target RNA, herein designated VGAM HOST TARGET RNA. VGAM1022 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1022 RNA, herein designated VGAM RNA, binds complementarily to one or more host target binding sites located in untranslated regions of VGAM1022 host target RNA, herein designated VGAM HOST TARGET RNA. This complementary binding is due to the fact that the nucleotide sequence of VGAM1022 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1022 RNA, herein designated VGAM RNA, may have a different number of host target binding sites in untranslated regions of a VGAM1022 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1022 RNA, herein designated VGAM RNA, to host target binding sites on VGAM1022 host target RNA, herein designated VGAM HOST TARGET RNA, such as BINDING SITE I, BINDING SITE II and BINDING SITE III, inhibits translation of VGAM1022 host target RNA into VGAM1022 host target protein, herein designated VGAM HOST TARGET PROTEIN. VGAM host target protein is therefore outlined by a broken line.

It is appreciated that VGAM1022 host target gene, herein designated VGAM HOST TARGET GENE, in fact represents a plurality of VGAM1022 host target genes. The mRNA of each one of this plurality of VGAM1022 host target genes comprises one or more host target binding sites, each having a nucleotide sequence which is at least partly complementary to VGAM1022 RNA, herein designated VGAM RNA, and which when bound by VGAM1022 RNA causes inhibition of translation of respective one or more VGAM1022 host target proteins.

It is further appreciated by one skilled in the art that the mode of translational inhibition illustrated by FIG. 1 with specific reference to translational inhibition exerted by VGAM1022 gene, herein designated VGAM GENE, on one or more VGAM1022 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1022 is inhibition of expression of host target genes, as part of a novel viral mechanism of attacking a host. Accordingly, utilities of VGAM1022 include diagnosis, prevention and treatment of viral infection by Cereal Yellow Dwarf Virus - RPV. Specific functions, and accordingly utilities, of VGAM1022 correlate with, and may be deduced from, the identity of the host target genes which VGAM1022 binds and inhibits, and the function of these host target genes, as elaborated hereinbelow.

Nucleotide sequences of the VGAM1022 precursor RNA, herein designated VGAM PRECURSOR RNA, and of the 'diced' VGAM1022 RNA, herein designated VGAM RNA, and a schematic representation of the secondary folding of VGAM1022 folded precursor RNA, herein designated VGAM FOLDED PRECURSOR RNA, of VGAM1022 are further described hereinbelow with reference to Table 1.

Nucleotide sequences of host target binding sites, such as BINDING SITE-I, BINDING SITE-II and BINDING SITE-III of FIG. 1, found on VGAM1022 host target RNA, and schematic representation of the complementarity of each of these host target binding sites to VGAM1022 RNA, herein designated VGAM RNA, are described hereinbelow with reference to Table 2.

As mentioned hereinabove with reference to FIG. 1, a function of VGAM1022 gene, herein designated VGAM is inhibition of expression of VGAM1022 target genes. It is appreciated that specific functions, and accordingly utilities, of VGAM1022 correlate with, and may be deduced from, the identity of the target genes which VGAM1022 binds and inhibits, and the function of these target genes, as elaborated hereinbelow.

Calsequestrin 2 (cardiac muscle) (CASQ2, Accession NM_001232) is a VGAM1022 host target gene. CASQ2 BINDING SITE is HOST TARGET binding site found in the 3' untranslated region of mRNA encoded by CASQ2, corresponding to a HOST TARGET binding site such as BINDING SITE I, BINDING SITE II or BINDING SITE III. Table 2 illustrates the complementarity of the nucleotide sequences of CASQ2 BINDING SITE, designated SEQ ID:6902, to the nucleotide sequence of VGAM1022 RNA, herein designated VGAM RNA, also designated SEQ ID:3733.

A function of VGAM1022 is therefore inhibition of Calsequestrin 2 (cardiac muscle) (CASQ2, Accession NM_001232). Accordingly, utilities of VGAM1022 include diagnosis, prevention and treatment of diseases and clinical conditions associated with CASQ2. RAP1A, Member of RAS Oncogene Family (RAP1A, Accession NM_002884) is another VGAM1022 host target gene. RAP1A BINDING SITE is HOST TARGET binding site found in the 3' untranslated region of mRNA encoded by RAP1A, corresponding to a HOST TARGET binding site such as BINDING SITE I, BINDING SITE II or BINDING SITE III. Table 2 illustrates the complementarity of the nucleotide sequences of RAP1A BINDING SITE, designated SEQ ID:8792, to the nucleotide sequence of VGAM1022 RNA, herein designated VGAM RNA, also designated SEQ ID:3733.

Another function of VGAM1022 is therefore inhibition of RAP1A, Member of RAS Oncogene Family (RAP1A, Accession NM_002884), a gene which induces morphological reversion of a cell line transformed by a ras oncogene. Accordingly, utilities of VGAM1022 include diagnosis, prevention and treatment of diseases and clinical conditions associated with RAP1A. The function of RAP1A and its association with various diseases and clinical conditions, has been established by previous studies, as described hereinabove with reference to VGAM993. DKFZp547I094 (Accession NM_032155) is another VGAM1022 host target gene. DKFZp547I094 BINDING SITE is HOST TARGET binding site found in the 3' untranslated region of mRNA encoded by DKFZp547I094, corresponding to a HOST TARGET binding site such as BINDING SITE I, BINDING SITE II or BINDING SITE III. Table 2 illustrates the complementarity of the nucleotide sequences of DKFZp547I094 BINDING SITE, designated SEQ ID:25855, to the nucleotide sequence of VGAM1022 RNA, herein designated VGAM RNA, also designated SEQ ID:3733.

Another function of VGAM1022 is therefore inhibition of DKFZp547I094 (Accession NM_032155). Accordingly, utilities of VGAM1022 include diagnosis, prevention and treatment of diseases and clinical conditions associated with DKFZp547I094. MGC11082 (Accession NM_032691) is another VGAM1022 host target gene. MGC11082 BINDING SITE is HOST TARGET binding site found in the 5' untranslated region of mRNA encoded by MGC11082, corresponding to a HOST TARGET binding site such as BINDING SITE I, BINDING SITE II or BINDING SITE III. Table 2 illustrates the complementarity of the nucleotide sequences of MGC11082 BINDING SITE, designated SEQ ID:26411, to the nucleotide sequence of VGAM1022 RNA, herein designated VGAM RNA, also designated SEQ ID:3733.

Another function of VGAM1022 is therefore inhibition of MGC11082 (Accession NM_032691). Accordingly, utilities of VGAM1022 include diagnosis, prevention and treatment of diseases and clinical conditions associated with MGC11082. FIG. 1 further provides a conceptual description of a novel bioinformatically detected viral gene of the present invention, referred to here as Viral Genomic Address Messenger 1023 (VGAM1023) viral gene, which modulates expression of respective host target genes thereof, the function and utility of which host target genes is known in the art.

VGAM1023 is a novel bioinformatically detected regulatory, non protein coding, viral micro RNA (miRNA) gene. The method by which VGAM1023 was detected is described hereinabove with reference to FIGS. 1-8.

VGAM1023 gene, herein designated VGAM GENE, is a viral gene contained in the genome of Cereal Yellow Dwarf Virus - RPV. VGAM1023 host target gene, herein designated VGAM HOST TARGET GENE, is a human gene contained in the human genome.

VGAM1023 gene encodes a VGAM1023 precursor RNA, herein designated VGAM PRECURSOR RNA. Similar to other miRNA genes, and unlike most ordinary genes, VGAM1023 precursor RNA does not encode a protein. A nucleotide sequence identical or highly similar to the nucleotide sequence of VGAM1023 precursor RNA is designated SEQ ID:1009, and is provided hereinbelow with reference to the sequence listing part. Nucleotide sequence SEQ ID:1009 is located at position 3936 relative to the genome of Cereal Yellow Dwarf Virus - RPV.

VGAM1023 precursor RNA folds onto itself, forming VGAM1023 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1023 folded precursor RNA into VGAM1023 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1023 RNA is designated SEQ ID:3734, and is provided hereinbelow with reference to the sequence listing part.

VGAM1023 host target gene, herein designated VGAM HOST TARGET GENE, encodes a corresponding messenger RNA, VGAM1023 host target RNA, herein designated VGAM HOST TARGET RNA. VGAM1023 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1023 RNA, herein designated VGAM RNA, binds complementarily to one or more host target binding sites located in untranslated regions of VGAM1023 host target RNA, herein designated VGAM HOST TARGET RNA. This complementary binding is due to the fact that the nucleotide sequence of VGAM1023 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1023 RNA, herein designated VGAM RNA, may have a different number of host target binding sites in untranslated regions of a VGAM1023 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1023 RNA, herein designated VGAM RNA, to host target binding sites on VGAM1023 host target RNA, herein designated VGAM HOST TARGET RNA, such as BINDING SITE I, BINDING SITE II and BINDING SITE III, inhibits translation of VGAM1023 host target RNA into VGAM1023 host target protein, herein designated VGAM HOST TARGET PROTEIN. VGAM host target protein is therefore outlined by a broken line.

It is appreciated that VGAM1023 host target gene, herein designated VGAM HOST TARGET GENE, in fact represents a plurality of VGAM1023 host target genes. The mRNA of each one of this plurality of VGAM1023 host target genes comprises one or more host target binding sites, each having a nucleotide sequence which is at least partly complementary to VGAM1023 RNA, herein designated VGAM RNA, and which when bound by VGAM1023 RNA causes inhibition of translation of respective one or more VGAM1023 host target proteins.

It is further appreciated by one skilled in the art that the mode of translational inhibition illustrated by FIG. 1 with specific reference to translational inhibition exerted by VGAM1023 gene, herein designated VGAM GENE, on one or more VGAM1023 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1023 is inhibition of expression of host target genes, as part of a novel viral mechanism of attacking a host. Accordingly, utilities of VGAM1023 include diagnosis, prevention and treatment of viral infection by Cereal Yellow Dwarf Virus - RPV. Specific functions, and accordingly utilities, of VGAM1023 correlate with, and may be deduced from, the identity of the host target genes which VGAM1023 binds and inhibits, and the function of these host target genes, as elaborated hereinbelow.

Nucleotide sequences of the VGAM1023 precursor RNA, herein designated VGAM PRECURSOR RNA, and of the 'diced' VGAM1023 RNA, herein designated VGAM RNA, and a schematic representation of the secondary folding of VGAM1023 folded precursor RNA, herein designated VGAM FOLDED PRECURSOR RNA, of VGAM1023 are further described hereinbelow with reference to Table 1.

Nucleotide sequences of host target binding sites, such as BINDING SITE-I, BINDING SITE-II and BINDING SITE-III of FIG. 1, found on VGAM1023 host target RNA, and schematic representation of the complementarity of each of these host target binding sites to VGAM1023 RNA, herein designated VGAM RNA, are described hereinbelow with reference to Table 2.

As mentioned hereinabove with reference to FIG. 1, a function of VGAM1023 gene, herein designated VGAM is inhibition of expression of VGAM1023 target genes. It is appreciated that specific functions, and accordingly utilities, of VGAM1023 correlate with, and may be deduced from, the identity of the target genes which VGAM1023 binds and inhibits, and the function of these target genes, as elaborated hereinbelow.

A Kinase (PRKA) Anchor Protein 13 (AKAP13, Accession NM_144767) is a VGAM1023 host target gene. AKAP13 BINDING SITE1 through AKAP13 BINDING SITE3 are HOST TARGET binding sites found in untranslated regions of mRNA encoded by AKAP13, corresponding to HOST TARGET binding sites such as BINDING SITE I, BINDING SITE II or BINDING SITE III. Table 2 illustrates the complementarity of the nucleotide sequences of AKAP13 BINDING SITE1 through AKAP13 BINDING SITE3, designated SEQ ID:29558, SEQ ID:13589 and SEQ ID:14054 respectively, to the nucleotide sequence of VGAM1023 RNA, herein designated VGAM RNA, also designated SEQ ID:3734.

A function of VGAM1023 is therefore inhibition of A Kinase (PRKA) Anchor Protein 13 (AKAP13, Accession NM_144767), a gene which regulates subcellular localization of type II cAMP-dependent PKA. Accordingly, utilities of VGAM1023 include diagnosis, prevention and treatment of diseases and clinical conditions associated with AKAP13. The function of AKAP13 and its association with various diseases and clinical conditions, has been established by previous studies, as described hereinabove with reference to VGAM17. Collagen, Type IV, Alpha 3 (Goodpasture antigen) (COL4A3, Accession NM_031364) is another VGAM1023 host target gene. COL4A3 BINDING SITE1 through COL4A3 BINDING SITE3 are HOST TARGET binding sites found in untranslated regions of mRNA encoded by COL4A3, corresponding to HOST TARGET binding sites such as BINDING SITE I, BINDING SITE II or BINDING SITE III. Table 2 illustrates the complementarity of the nucleotide sequences of COL4A3 BINDING SITE1 through COL4A3 BINDING SITE3, designated SEQ ID:25357, SEQ ID:5544 and SEQ ID:19255 respectively, to the nucleotide sequence of VGAM1023 RNA, herein designated VGAM RNA, also designated SEQ ID:3734.

Another function of VGAM1023 is therefore inhibition of Collagen, Type IV, Alpha 3 (Goodpasture antigen) (COL4A3, Accession NM_031364). Accordingly, utilities of VGAM1023 include diagnosis, prevention and treatment of diseases and clinical conditions associated with COL4A3. Potassium Channel, Subfamily T, Member 1 (KCNT1, Accession XM_029962) is another VGAM1023 host target gene. KCNT1 BINDING SITE is HOST TARGET binding site found in the 3' untranslated region of mRNA encoded by KCNT1, corresponding to a HOST TARGET binding site such as BINDING SITE I, BINDING SITE II or BINDING SITE III. Table 2 illustrates the complementarity of the nucleotide sequences of KCNT1 BINDING SITE, designated SEQ ID:30970, to the nucleotide sequence of VGAM1023 RNA, herein designated VGAM RNA, also designated SEQ ID:3734.

Another function of VGAM1023 is therefore inhibition of Potassium Channel, Subfamily T, Member 1 (KCNT1, Accession XM_029962). Accordingly, utilities of VGAM1023 include diagnosis, prevention and treatment of diseases and clinical conditions associated with KCNT1. KIAA0522 (Accession XM_050404) is another VGAM1023 host target gene. KIAA0522 BINDING SITE is HOST TARGET binding site found in the 3' untranslated region of mRNA encoded by KIAA0522, corresponding to a HOST TARGET binding site such as BINDING SITE I, BINDING SITE II or BINDING SITE III. Table 2 illustrates the complementarity of the nucleotide sequences of KIAA0522 BINDING SITE, designated SEQ ID:35621, to the nucleotide sequence of VGAM1023 RNA, herein designated VGAM RNA, also designated SEQ ID:3734.

Another function of VGAM1023 is therefore inhibition of KIAA0522 (Accession XM_050404). Accordingly, utilities of VGAM1023 include diagnosis, prevention and treatment of diseases and clinical conditions associated with KIAA0522. LOC145717 (Accession XM_039771) is another VGAM1023 host target gene. LOC145717 BINDING SITE is HOST TARGET binding site found in the 3' untranslated region of mRNA encoded by LOC145717, corresponding to a HOST TARGET binding site such as BINDING SITE I, BINDING SITE II or BINDING SITE III. Table 2 illustrates the complementarity of the nucleotide sequences of LOC145717 BINDING SITE, designated SEQ ID:33187, to the nucleotide sequence of VGAM1023 RNA, herein designated VGAM RNA, also designated SEQ ID:3734.

Another function of VGAM1023 is therefore inhibition of LOC145717 (Accession XM_039771). Accordingly, utilities of VGAM1023 include diagnosis, prevention and treatment of diseases and clinical conditions associated with LOC145717. LOC152925 (Accession XM_087559) is another VGAM1023 host target gene. LOC152925 BINDING SITE is HOST TARGET binding site found in the 3' untranslated region of mRNA encoded by LOC152925, corresponding to a HOST TARGET binding site such as BINDING SITE I, BINDING SITE II or BINDING SITE III. Table 2 illustrates the complementarity of the nucleotide sequences of LOC152925 BINDING SITE, designated SEQ ID:39333, to the nucleotide sequence of VGAM1023 RNA, herein designated VGAM RNA, also designated SEQ ID:3734.

Another function of VGAM1023 is therefore inhibition of LOC152925 (Accession XM_087559). Accordingly, utilities of VGAM1023 include diagnosis, prevention and treatment of diseases and clinical conditions associated with LOC152925. LOC158301 (Accession XM_088543) is another VGAM1023 host target gene. LOC158301 BINDING SITE is HOST TARGET binding site found in the 3' untranslated region of mRNA encoded by LOC158301, corresponding to a HOST TARGET binding site such as BINDING SITE I, BINDING SITE II or BINDING SITE III. Table 2 illustrates the complementarity of the nucleotide sequences of LOC158301 BINDING SITE, designated SEQ ID:39808, to the nucleotide sequence of VGAM1023 RNA, herein designated VGAM RNA, also designated SEQ ID:3734.

Another function of VGAM1023 is therefore inhibition of LOC158301 (Accession XM_088543). Accordingly, utilities of VGAM1023 include diagnosis, prevention and treatment of diseases and clinical conditions associated with LOC158301. LOC196957 (Accession XM_113789) is another VGAM1023 host target gene. LOC196957 BINDING SITE is HOST TARGET binding site found in the 3' untranslated region of mRNA encoded by LOC196957, corresponding to a HOST TARGET binding site such as BINDING SITE I, BINDING SITE II or BINDING SITE III. Table 2 illustrates the complementarity of the nucleotide sequences of LOC196957 BINDING SITE, designated SEQ ID:42425, to the nucleotide sequence of VGAM1023 RNA, herein designated VGAM RNA, also designated SEQ ID:3734.

Another function of VGAM1023 is therefore inhibition of LOC196957 (Accession XM_113789). Accordingly, utilities of VGAM1023 include diagnosis, prevention and treatment of diseases and clinical conditions associated with LOC196957. LOC196961 (Accession XM_113790) is another VGAM1023 host target gene. LOC196961 BINDING SITE is HOST TARGET binding site found in the 3' untranslated region of mRNA encoded by LOC196961, corresponding to a HOST TARGET binding site such as BINDING SITE I, BINDING SITE II or BINDING SITE III. Table 2 illustrates the complementarity of the nucleotide sequences of LOC196961 BINDING SITE, designated SEQ ID:42434, to the nucleotide sequence of VGAM1023 RNA, herein designated VGAM RNA, also designated SEQ ID:3734.

Another function of VGAM1023 is therefore inhibition of LOC196961 (Accession XM_113790). Accordingly, utilities of VGAM1023 include diagnosis, prevention and treatment of diseases and clinical conditions associated with LOC196961. LOC197138 (Accession XM_113829) is another VGAM1023 host target gene. LOC197138 BINDING SITE is HOST TARGET binding site found in the 3' untranslated region of mRNA encoded by LOC197138, corresponding to a HOST TARGET binding site such as BINDING SITE I, BINDING SITE II or BINDING SITE III. Table 2 illustrates the complementarity of the nucleotide sequences of LOC197138 BINDING SITE, designated SEQ ID:42452, to the nucleotide sequence of VGAM1023 RNA, herein designated VGAM RNA, also designated SEQ ID:3734.

Another function of VGAM1023 is therefore inhibition of LOC197138 (Accession XM_113829). Accordingly, utilities of VGAM1023 include diagnosis, prevention and treatment of diseases and clinical conditions associated with LOC197138. LOC200014 (Accession XM_114087) is another VGAM1023 host target gene. LOC200014 BINDING SITE is HOST TARGET binding site found in the 3' untranslated region of mRNA encoded by LOC200014, corresponding to a HOST TARGET binding site such as BINDING SITE I, BINDING SITE II or BINDING SITE III. Table 2 illustrates the complementarity of the nucleotide sequences of LOC200014 BINDING SITE, designated SEQ ID:42687, to the nucleotide sequence of VGAM1023 RNA, herein designated VGAM RNA, also designated SEQ ID:3734.

Another function of VGAM1023 is therefore inhibition of LOC200014 (Accession XM_114087). Accordingly, utilities of VGAM1023 include diagnosis, prevention and treatment of diseases and clinical conditions associated with LOC200014. LOC202018 (Accession XM_114420) is another VGAM1023 host target gene. LOC202018 BINDING SITE is HOST TARGET binding site found in the 3' untranslated region of mRNA encoded by LOC202018, corresponding to a HOST TARGET binding site such as BINDING SITE I, BINDING SITE II or BINDING SITE III. Table 2 illustrates the complementarity of the nucleotide sequences of LOC202018 BINDING SITE, designated SEQ ID:42956, to the nucleotide sequence of VGAM1023 RNA, herein designated VGAM RNA, also designated SEQ ID:3734.

Another function of VGAM1023 is therefore inhibition of LOC202018 (Accession XM_114420). Accordingly, utilities of VGAM1023 include diagnosis, prevention and treatment of diseases and clinical conditions associated with LOC202018. LOC245727 (Accession XM_165913) is another VGAM1023 host target gene. LOC245727 BINDING SITE is HOST TARGET binding site found in the 3' untranslated region of mRNA encoded by LOC245727, corresponding to a HOST TARGET binding site such as BINDING SITE I, BINDING SITE II or BINDING SITE III. Table 2 illustrates the complementarity of the nucleotide sequences of LOC245727 BINDING SITE, designated SEQ ID:43794, to the nucleotide sequence of VGAM1023 RNA, herein designated VGAM RNA, also designated SEQ ID:3734.

Another function of VGAM1023 is therefore inhibition of LOC245727 (Accession XM_165913). Accordingly, utilities of VGAM1023 include diagnosis, prevention and treatment of diseases and clinical conditions associated with LOC245727. FIG. 1 further provides a conceptual description of a novel bioinformatically detected viral gene of the present invention, referred to here as Viral Genomic Address Messenger 1024 (VGAM1024) viral gene, which modulates expression of respective host target genes thereof, the function and utility of which host target genes is known in the art.

VGAM1024 is a novel bioinformatically detected regulatory, non protein coding, viral micro RNA (miRNA) gene. The method by which VGAM1024 was detected is described hereinabove with reference to FIGS. 1-8.

VGAM1024 gene, herein designated VGAM GENE, is a viral gene contained in the genome of Cereal Yellow Dwarf Virus - RPV. VGAM1024 host target gene, herein designated VGAM HOST TARGET GENE, is a human gene contained in the human genome.

VGAM1024 gene encodes a VGAM1024 precursor RNA, herein designated VGAM PRECURSOR RNA. Similar to other miRNA genes, and unlike most ordinary genes, VGAM1024 precursor RNA does not encode a protein. A nucleotide sequence identical or highly similar to the nucleotide sequence of VGAM1024 precursor RNA is designated SEQ ID:1010, and is provided hereinbelow with reference to the sequence listing part. Nucleotide sequence SEQ ID:1010 is located at position 672 relative to the genome of Cereal Yellow Dwarf Virus - RPV.

VGAM1024 precursor RNA folds onto itself, forming VGAM1024 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1024 folded precursor RNA into VGAM1024 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1024 RNA is designated SEQ ID:3735, and is provided hereinbelow with reference to the sequence listing part.

VGAM1024 host target gene, herein designated VGAM HOST TARGET GENE, encodes a corresponding messenger RNA, VGAM1024 host target RNA, herein designated VGAM HOST TARGET RNA. VGAM1024 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1024 RNA, herein designated VGAM RNA, binds complementarily to one or more host target binding sites located in untranslated regions of VGAM1024 host target RNA, herein designated VGAM HOST TARGET RNA. This complementary binding is due to the fact that the nucleotide sequence of VGAM1024 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1024 RNA, herein designated VGAM RNA, may have a different number of host target binding sites in untranslated regions of a VGAM1024 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1024 RNA, herein designated VGAM RNA, to host target binding sites on VGAM1024 host target RNA, herein designated VGAM HOST TARGET RNA, such as BINDING SITE I, BINDING SITE II and BINDING SITE III, inhibits translation of VGAM1024 host target RNA into VGAM1024 host target protein, herein designated VGAM HOST TARGET PROTEIN. VGAM host target protein is therefore outlined by a broken line.

It is appreciated that VGAM1024 host target gene, herein designated VGAM HOST TARGET GENE, in fact represents a plurality of VGAM1024 host target genes. The mRNA of each one of this plurality of VGAM1024 host target genes comprises one or more host target binding sites, each having a nucleotide sequence which is at least partly complementary to VGAM1024 RNA, herein designated VGAM RNA, and which when bound by VGAM1024 RNA causes inhibition of translation of respective one or more VGAM1024 host target proteins.

It is further appreciated by one skilled in the art that the mode of translational inhibition illustrated by FIG. 1 with specific reference to translational inhibition exerted by VGAM1024 gene, herein designated VGAM GENE, on one or more VGAM1024 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1024 is inhibition of expression of host target genes, as part of a novel viral mechanism of attacking a host. Accordingly, utilities of VGAM1024 include diagnosis, prevention and treatment of viral infection by Cereal Yellow Dwarf Virus - RPV. Specific functions, and accordingly utilities, of VGAM1024 correlate with, and may be deduced from, the identity of the host target genes which VGAM1024 binds and inhibits, and the function of these host target genes, as elaborated hereinbelow.

Nucleotide sequences of the VGAM1024 precursor RNA, herein designated VGAM PRECURSOR RNA, and of the 'diced' VGAM1024 RNA, herein designated VGAM RNA, and a schematic representation of the secondary folding of VGAM1024 folded precursor RNA, herein designated VGAM FOLDED PRECURSOR RNA, of VGAM1024 are further described hereinbelow with reference to Table 1.

Nucleotide sequences of host target binding sites, such as BINDING SITE-I, BINDING SITE-II and BINDING SITE-III of FIG. 1, found on VGAM1024 host target RNA, and schematic representation of the complementarity of each of these host target binding sites to VGAM1024 RNA, herein designated VGAM RNA, are described hereinbelow with reference to Table 2.

As mentioned hereinabove with reference to FIG. 1, a function of VGAM1024 gene, herein designated VGAM is inhibition of expression of VGAM1024 target genes. It is appreciated that specific functions, and accordingly utilities, of VGAM1024 correlate with, and may be deduced from, the identity of the target genes which VGAM1024 binds and inhibits, and the function of these target genes, as elaborated hereinbelow.

Retinoic Acid Induced 3 (RAI3, Accession NM_003979) is a VGAM1024 host target gene. RAI3 BINDING SITE is HOST TARGET binding site found in the 3' untranslated region of mRNA encoded by RAI3, corresponding to a HOST TARGET binding site such as BINDING SITE I, BINDING SITE II or BINDING SITE III. Table 2 illustrates the complementarity of the nucleotide sequences of RAI3 BINDING SITE, designated SEQ ID:10111, to the nucleotide sequence of VGAM1024 RNA, herein designated VGAM RNA, also designated SEQ ID:3735.

A function of VGAM1024 is therefore inhibition of Retinoic Acid Induced 3 (RAI3, Accession NM_003979). Accordingly, utilities of VGAM1024 include diagnosis, prevention and treatment of diseases and clinical conditions associated with RAI3. START Domain Containing 4, Sterol Regulated (STARD4, Accession NM_139164) is another VGAM1024 host target gene. STARD4 BINDING SITE is HOST TARGET binding site found in the 3' untranslated region of mRNA encoded by STARD4, corresponding to a HOST TARGET binding site such as BINDING SITE I, BINDING SITE II or BINDING SITE III. Table 2 illustrates the complementarity of the nucleotide sequences of STARD4 BINDING SITE, designated SEQ ID:29172, to the nucleotide sequence of VGAM1024 RNA, herein designated VGAM RNA, also designated SEQ ID:3735.

Another function of VGAM1024 is therefore inhibition of START Domain Containing 4, Sterol Regulated (STARD4, Accession NM_139164). Accordingly, utilities of VGAM1024 include diagnosis, prevention and treatment of diseases and clinical conditions associated with STARD4. Transient Receptor Potential Cation Channel, Subfamily M, Member 6 (TRPM6, Accession NM_017662) is another VGAM1024 host target gene. TRPM6 BINDING SITE is HOST TARGET binding site found in the 3' untranslated region of mRNA encoded by TRPM6, corresponding to a HOST TARGET binding site such as BINDING SITE I, BINDING SITE II or BINDING SITE III. Table 2 illustrates the complementarity of the nucleotide sequences of TRPM6 BINDING SITE, designated SEQ ID:19194, to the nucleotide sequence of VGAM1024 RNA, herein designated VGAM RNA, also designated SEQ ID:3735.

Another function of VGAM1024 is therefore inhibition of Transient Receptor Potential Cation Channel, Subfamily M, Member 6 (TRPM6, Accession NM_017662), a gene which contains a predicted ion channel domain and a protein kinase domain. Accordingly, utilities of VGAM1024 include diagnosis, prevention and treatment of diseases and clinical conditions associated with TRPM6. The function of TRPM6 and its association with various diseases and clinical conditions, has been established by previous studies, as described hereinabove with reference to VGAM173. G Protein-coupled Receptor Kinase-interactor 2 (GIT2, Accession NM_014776) is another VGAM1024 host target gene. GIT2 BINDING SITE1 through GIT2 BINDING SITE3 are HOST TARGET binding sites found in untranslated regions of mRNA encoded by GIT2, corresponding to HOST TARGET binding sites such as BINDING SITE I, BINDING SITE II or BINDING SITE III. Table 2 illustrates the complementarity of the nucleotide sequences of GIT2 BINDING SITE1 through GIT2 BINDING SITE3, designated SEQ ID:16598, SEQ ID:27680 and SEQ ID:27693 respectively, to the nucleotide sequence of VGAM1024 RNA, herein designated VGAM RNA, also designated SEQ ID:3735.

Another function of VGAM1024 is therefore inhibition of G Protein-coupled Receptor Kinase-interactor 2 (GIT2, Accession NM_014776). Accordingly, utilities of VGAM1024 include diagnosis, prevention and treatment of diseases and clinical conditions associated with GIT2. LOC90408 (Accession XM_031517) is another VGAM1024 host target gene. LOC90408 BINDING SITE is HOST TARGET binding site found in the 5' untranslated region of mRNA encoded by LOC90408, corresponding to a HOST TARGET binding site such as BINDING SITE I, BINDING SITE II or BINDING SITE III. Table 2 illustrates the complementarity of the nucleotide sequences of LOC90408 BINDING SITE, designated SEQ ID:31396, to the nucleotide sequence of VGAM1024 RNA, herein designated VGAM RNA, also designated SEQ ID:3735.

Another function of VGAM1024 is therefore inhibition of LOC90408 (Accession XM_031517). Accordingly, utilities of VGAM1024 include diagnosis, prevention and treatment of diseases and clinical conditions associated with LOC90408. FIG. 1 further provides a conceptual description of a novel bioinformatically detected viral gene of the present invention, referred to here as Viral Genomic Address Messenger 1025 (VGAM1025) viral gene, which modulates expression of respective host target genes thereof, the function and utility of which host target genes is known in the art.

VGAM1025 is a novel bioinformatically detected regulatory, non protein coding, viral micro RNA (miRNA) gene. The method by which VGAM1025 was detected is described hereinabove with reference to FIGS. 1-8.

VGAM1025 gene, herein designated VGAM GENE, is a viral gene contained in the genome of Cereal Yellow Dwarf Virus - RPV. VGAM1025 host target gene, herein designated VGAM HOST TARGET GENE, is a human gene contained in the human genome.

VGAM1025 gene encodes a VGAM1025 precursor RNA, herein designated VGAM PRECURSOR RNA. Similar to other miRNA genes, and unlike most ordinary genes, VGAM1025 precursor RNA does not encode a protein. A nucleotide sequence identical or highly similar to the nucleotide sequence of VGAM1025 precursor RNA is designated SEQ ID:1011, and is provided hereinbelow with reference to the sequence listing part. Nucleotide sequence SEQ ID:1011 is located at position 3393 relative to the genome of Cereal Yellow Dwarf Virus - RPV.

VGAM1025 precursor RNA folds onto itself, forming VGAM1025 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1025 folded precursor RNA into VGAM1025 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 62%) nucleotide sequence of VGAM1025 RNA is designated SEQ ID:3736, and is provided hereinbelow with reference to the sequence listing part.

VGAM1025 host target gene, herein designated VGAM HOST TARGET GENE, encodes a corresponding messenger RNA, VGAM1025 host target RNA, herein designated VGAM HOST TARGET RNA. VGAM1025 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1025 RNA, herein designated VGAM RNA, binds complementarily to one or more host target binding sites located in untranslated regions of VGAM1025 host target RNA, herein designated VGAM HOST TARGET RNA. This complementary binding is due to the fact that the nucleotide sequence of VGAM1025 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1025 RNA, herein designated VGAM RNA, may have a different number of host target binding sites in untranslated regions of a VGAM1025 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1025 RNA, herein designated VGAM RNA, to host target binding sites on VGAM1025 host target RNA, herein designated VGAM HOST TARGET RNA, such as BINDING SITE I, BINDING SITE II and BINDING SITE III, inhibits translation of VGAM1025 host target RNA into VGAM1025 host target protein, herein designated VGAM HOST TARGET PROTEIN. VGAM host target protein is therefore outlined by a broken line.

It is appreciated that VGAM1025 host target gene, herein designated VGAM HOST TARGET GENE, in fact represents a plurality of VGAM1025 host target genes. The mRNA of each one of this plurality of VGAM1025 host target genes comprises one or more host target binding sites, each having a nucleotide sequence which is at least partly complementary to VGAM1025 RNA, herein designated VGAM RNA, and which when bound by VGAM1025 RNA causes inhibition of translation of respective one or more VGAM1025 host target proteins.

It is further appreciated by one skilled in the art that the mode of translational inhibition illustrated by FIG. 1 with specific reference to translational inhibition exerted by VGAM1025 gene, herein designated VGAM GENE, on one or more VGAM1025 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1025 is inhibition of expression of host target genes, as part of a novel viral mechanism of attacking a host. Accordingly, utilities of VGAM1025 include diagnosis, prevention and treatment of viral infection by Cereal Yellow Dwarf Virus - RPV. Specific functions, and accordingly utilities, of VGAM1025 correlate with, and may be deduced from, the identity of the host target genes which VGAM1025 binds and inhibits, and the function of these host target genes, as elaborated hereinbelow.

Nucleotide sequences of the VGAM1025 precursor RNA, herein designated VGAM PRECURSOR RNA, and of the 'diced' VGAM1025 RNA, herein designated VGAM RNA, and a schematic representation of the secondary folding of VGAM1025 folded precursor RNA, herein designated VGAM FOLDED PRECURSOR RNA, of VGAM1025 are further described hereinbelow with reference to Table 1.

Nucleotide sequences of host target binding sites, such as BINDING SITE-I, BINDING SITE-II and BINDING SITE-III of FIG. 1, found on VGAM1025 host target RNA, and schematic representation of the complementarity of each of these host target binding sites to VGAM1025 RNA, herein designated VGAM RNA, are described hereinbelow with reference to Table 2.

As mentioned hereinabove with reference to FIG. 1, a function of VGAM1025 gene, herein designated VGAM is inhibition of expression of VGAM1025 target genes. It is appreciated that specific functions, and accordingly utilities, of VGAM1025 correlate with, and may be deduced from, the identity of the target genes which VGAM1025 binds and inhibits, and the function of these target genes, as elaborated hereinbelow.

Annexin A7 (ANXA7, Accession NM_004034) is a VGAM1025 host target gene. ANXA7 BINDING SITE1 and ANXA7 BINDING SITE2 are HOST TARGET binding sites found in untranslated regions of mRNA encoded by ANXA7, corresponding to HOST TARGET binding sites such as BINDING SITE I, BINDING SITE II or BINDING SITE III. Table 2 illustrates the complementarity of the nucleotide sequences of ANXA7 BINDING SITE1 and ANXA7 BINDING SITE2, designated SEQ ID:10254 and SEQ ID:6825 respectively, to the nucleotide sequence of VGAM1025 RNA, herein designated VGAM RNA, also designated SEQ ID:3736.

A function of VGAM1025 is therefore inhibition of Annexin A7 (ANXA7, Accession NM_004034), a gene which promotes membrane fusion and is involved in exocytosis. Accordingly, utilities of VGAM1025 include diagnosis, prevention and treatment of diseases and clinical conditions associated with ANXA7. The function of ANXA7 and its association with various diseases and clinical conditions, has been established by previous studies, as described hereinabove with reference to VGAM846. Potassium Voltage-gated Channel, KQT-like Subfamily, Member 1 (KCNQ1, Accession NM_000218) is another VGAM1025 host target gene. KCNQ1 BINDING SITE is HOST TARGET binding site found in the 5' untranslated region of mRNA encoded by KCNQ1, corresponding to a HOST TARGET binding site such as BINDING SITE I, BINDING SITE II or BINDING SITE III. Table 2 illustrates the complementarity of the nucleotide sequences of KCNQ1 BINDING SITE, designated SEQ ID:5725, to the nucleotide sequence of VGAM1025 RNA, herein designated VGAM RNA, also designated SEQ ID:3736.

Another function of VGAM1025 is therefore inhibition of Potassium Voltage-gated Channel, KQT-like Subfamily, Member 1 (KCNQ1, Accession NM_000218), a gene which probably important in cardiac repolarization. associates with kcne1 (mink) to form the i (ks) cardiac potassium current. elicits a rapidly activating, k(+)-selective outward current. muscarinic agonist oxotremorine-m strongly suppresses kcnq1/kcne1 current in cho cells in which cloned kcnq1/kcne1 channels were coexpressed with m1 muscarinic receptors. may associate also with kcne3 (mirp2) to form the potassium channel that is important for cyclic amp-stimulated intestinal secretion of chloride io TISSUE:abondantly expressed in heart, pancreas, prostate, kidney, small intestine and peripheral blood leukocytes. less abondant in placenta, lung, spleen, colon, thymus, testis and ovaries. Accordingly, utilities of VGAM1025 include diagnosis, prevention and treatment of diseases and clinical conditions associated with KCNQ1. The function of KCNQ1 and its association with various diseases and clinical conditions, has been established by previous studies, as described hereinabove with reference to VGAM339. ATPase, Class II, Type 9A (ATP9A, Accession XM_030577) is another VGAM1025 host target gene. ATP9A BINDING SITE is HOST TARGET binding site found in the 3' untranslated region of mRNA encoded by ATP9A, corresponding to a HOST TARGET binding site such as BINDING SITE I, BINDING SITE II or BINDING SITE III. Table 2 illustrates the complementarity of the nucleotide sequences of ATP9A BINDING SITE, designated SEQ ID:31088, to the nucleotide sequence of VGAM1025 RNA, herein designated VGAM RNA, also designated SEQ ID:3736.

Another function of VGAM1025 is therefore inhibition of ATPase, Class II, Type 9A (ATP9A, Accession XM_030577). Accordingly, utilities of VGAM1025 include diagnosis, prevention and treatment of diseases and clinical conditions associated with ATP9A. Chromosome 20 Open Reading Frame 13 (C20orf13, Accession NM_017714) is another VGAM1025 host target gene. C20orf13 BINDING SITE is HOST TARGET binding site found in the 3' untranslated region of mRNA encoded by C20orf13, corresponding to a HOST TARGET binding site such as BINDING SITE I, BINDING SITE II or BINDING SITE III. Table 2 illustrates the complementarity of the nucleotide sequences of C20orf13 BINDING SITE, designated SEQ ID:19301, to the nucleotide sequence of VGAM1025 RNA, herein designated VGAM RNA, also designated SEQ ID:3736.

Another function of VGAM1025 is therefore inhibition of Chromosome 20 Open Reading Frame 13 (C20orf13, Accession NM_017714). Accordingly, utilities of VGAM1025 include diagnosis, prevention and treatment of diseases and clinical conditions associated with C20orf13.

DKFZp566H0824 (Accession NM_017535) is another VGAM1025 host target gene. DKFZp566H0824 BINDING SITE is HOST TARGET binding site found in the 5' untranslated region of mRNA encoded by DKFZp566H0824, corresponding to a HOST TARGET binding site such as BINDING SITE I, BINDING SITE II or BINDING SITE III. Table 2 illustrates the complementarity of the nucleotide sequences of DKFZp566H0824 BINDING SITE, designated SEQ ID:18976, to the nucleotide sequence of VGAM1025 RNA, herein designated VGAM RNA, also designated SEQ ID:3736.

Another function of VGAM1025 is therefore inhibition of DKFZp566H0824 (Accession NM_017535). Accordingly, utilities of VGAM1025 include diagnosis, prevention and treatment of diseases and clinical conditions associated with DKFZp566H0824. IMPACT (Accession NM_018439) is another VGAM1025 host target gene. IMPACT BINDING SITE is HOST TARGET binding site found in the 3' untranslated region of mRNA encoded by IMPACT, corresponding to a HOST TARGET binding site such as BINDING SITE I, BINDING SITE II or BINDING SITE III. Table 2 illustrates the complementarity of the nucleotide sequences of IMPACT BINDING SITE, designated SEQ ID:20506, to the nucleotide sequence of VGAM1025 RNA, herein designated VGAM RNA, also designated SEQ ID:3736.

Another function of VGAM1025 is therefore inhibition of IMPACT (Accession NM_018439). Accordingly, utilities of VGAM1025 include diagnosis, prevention and treatment of diseases and clinical conditions associated with IMPACT. KIAA0010 (Accession NM_014671) is another VGAM1025 host target gene. KIAA0010 BINDING SITE is HOST TARGET binding site found in the 3' untranslated region of mRNA encoded by KIAA0010, corresponding to a HOST TARGET binding site such as BINDING SITE I, BINDING SITE II or BINDING SITE III. Table 2 illustrates the complementarity of the nucleotide sequences of KIAA0010 BINDING SITE, designated SEQ ID:16132, to the nucleotide sequence of VGAM1025 RNA, herein designated VGAM RNA, also designated SEQ ID:3736.

Another function of VGAM1025 is therefore inhibition of KIAA0010 (Accession NM_014671). Accordingly, utilities of VGAM1025 include diagnosis, prevention and treatment of diseases and clinical conditions associated with KIAA0010. KIAA0978 (Accession XM_047013) is another VGAM1025 host target gene. KIAA0978 BINDING SITE is HOST TARGET binding site found in the 3' untranslated region of mRNA encoded by KIAA0978, corresponding to a HOST TARGET binding site such as BINDING SITE I, BINDING SITE II or BINDING SITE III. Table 2 illustrates the complementarity of the nucleotide sequences of KIAA0978 BINDING SITE, designated SEQ ID:34890, to the nucleotide sequence of VGAM1025 RNA, herein designated VGAM RNA, also designated SEQ ID:3736.

Another function of VGAM1025 is therefore inhibition of KIAA0978 (Accession XM_047013). Accordingly, utilities of VGAM1025 include diagnosis, prevention and treatment of diseases and clinical conditions associated with KIAA0978. KIAA1550 (Accession XM_039393) is another VGAM1025 host target gene. KIAA1550 BINDING SITE is HOST TARGET binding site found in the 3' untranslated region of mRNA encoded by KIAA1550, corresponding to a HOST TARGET binding site such as BINDING SITE I, BINDING SITE II or BINDING SITE III. Table 2 illustrates the complementarity of the nucleotide sequences of KIAA1550 BINDING SITE, designated SEQ ID:33072, to the nucleotide sequence of VGAM1025 RNA, herein designated VGAM RNA, also designated SEQ ID:3736.

Another function of VGAM1025 is therefore inhibition of KIAA1550 (Accession XM_039393). Accordingly, utilities of VGAM1025 include diagnosis, prevention and treatment of diseases and clinical conditions associated with KIAA1550. LOC157918 (Accession XM_098842) is another VGAM1025 host target gene. LOC157918 BINDING SITE is HOST TARGET binding site found in the 3' untranslated region of mRNA encoded by LOC157918, corresponding to a HOST TARGET binding site such as BINDING SITE I, BINDING SITE II or BINDING SITE III. Table 2 illustrates the complementarity of the nucleotide sequences of LOC157918 BINDING SITE, designated SEQ ID:41900, to the nucleotide sequence of VGAM1025 RNA, herein designated VGAM RNA, also designated SEQ ID:3736.

Another function of VGAM1025 is therefore inhibition of LOC157918 (Accession XM_098842). Accordingly, utilities of VGAM1025 include diagnosis, prevention and treatment of diseases and clinical conditions associated with LOC157918. LOC202347 (Accession XM_117390) is another VGAM1025 host target gene. LOC202347 BINDING SITE is HOST TARGET binding site found in the 3' untranslated region of mRNA encoded by LOC202347, corresponding to a HOST TARGET binding site such as BINDING SITE I, BINDING SITE II or BINDING SITE III. Table 2 illustrates the complementarity of the nucleotide sequences of LOC202347 BINDING SITE, designated SEQ ID:43432, to the nucleotide sequence of VGAM1025 RNA, herein designated VGAM RNA, also designated SEQ ID:3736.

Another function of VGAM1025 is therefore inhibition of LOC202347 (Accession XM_117390). Accordingly, utilities of VGAM1025 include diagnosis, prevention and treatment of diseases and clinical conditions associated with LOC202347. LOC203504 (Accession XM_117550) is another VGAM1025 host target gene. LOC203504 BINDING SITE is HOST TARGET binding site found in the 3' untranslated region of mRNA encoded by LOC203504, corresponding to a HOST TARGET binding site such as BINDING SITE I, BINDING SITE II or BINDING SITE III. Table 2 illustrates the complementarity of the nucleotide sequences of LOC203504 BINDING SITE, designated SEQ ID:43574, to the nucleotide sequence of VGAM1025 RNA, herein designated VGAM RNA, also designated SEQ ID:3736.

Another function of VGAM1025 is therefore inhibition of LOC203504 (Accession XM_117550). Accordingly, utilities of VGAM1025 include diagnosis, prevention and treatment of diseases and clinical conditions associated with LOC203504. LOC257159 (Accession XM_173158) is another VGAM1025 host target gene. LOC257159 BINDING SITE is HOST TARGET binding site found in the 5' untranslated region of mRNA encoded by LOC257159, corresponding to a HOST TARGET binding site such as BINDING SITE I, BINDING SITE II or BINDING SITE III. Table 2 illustrates the complementarity of the nucleotide sequences of LOC257159 BINDING SITE, designated SEQ ID:46417, to the nucleotide sequence of VGAM1025 RNA, herein designated VGAM RNA, also designated SEQ ID:3736.

Another function of VGAM1025 is therefore inhibition of LOC257159 (Accession XM_173158). Accordingly, utilities of VGAM1025 include diagnosis, prevention and treatment of diseases and clinical conditions associated with LOC257159. LOC89919 (Accession XM_027244) is another VGAM1025 host target gene. LOC89919 BINDING SITE is HOST TARGET binding site found in the 3' untranslated region of mRNA encoded by LOC89919, corresponding to a HOST TARGET binding site such as BINDING SITE I, BINDING SITE II or BINDING SITE III. Table 2 illustrates the complementarity of the nucleotide sequences of LOC89919 BINDING SITE, designated SEQ ID:30466, to the nucleotide sequence of VGAM1025 RNA, herein designated VGAM RNA, also designated SEQ ID:3736.

Another function of VGAM1025 is therefore inhibition of LOC89919 (Accession XM_027244). Accordingly, utilities of VGAM1025 include diagnosis, prevention and treatment of diseases and clinical conditions associated with LOC89919. FIG. 1 further provides a conceptual description of a novel bioinformatically detected viral gene of the present invention, referred to here as Viral Genomic Address Messenger 1026 (VGAM1026) viral gene, which modulates expression of respective host target genes thereof, the function and utility of which host target genes is known in the art.

VGAM1026 is a novel bioinformatically detected regulatory, non protein coding, viral micro RNA (miRNA) gene. The method by which VGAM1026 was detected is described hereinabove with reference to FIGS. 1-8.

VGAM1026 gene, herein designated VGAM GENE, is a viral gene contained in the genome of Cereal Yellow Dwarf Virus - RPV. VGAM1026 host target gene, herein designated VGAM HOST TARGET GENE, is a human gene contained in the human genome.

VGAM1026 gene encodes a VGAM1026 precursor RNA, herein designated VGAM PRECURSOR RNA. Similar to other miRNA genes, and unlike most ordinary genes, VGAM1026 precursor RNA does not encode a protein. A nucleotide sequence identical or highly similar to the nucleotide sequence of VGAM1026 precursor RNA is designated SEQ ID:1012, and is provided hereinbelow with reference to the sequence listing part. Nucleotide sequence SEQ ID:1012 is located at position 1766 relative to the genome of Cereal Yellow Dwarf Virus - RPV.

VGAM1026 precursor RNA folds onto itself, forming VGAM1026 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1026 folded precursor RNA into VGAM1026 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1026 RNA is designated SEQ ID:3737, and is provided hereinbelow with reference to the sequence listing part.

VGAM1026 host target gene, herein designated VGAM HOST TARGET GENE, encodes a corresponding messenger RNA, VGAM1026 host target RNA, herein designated VGAM HOST TARGET RNA. VGAM1026 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1026 RNA, herein designated VGAM RNA, binds complementarily to one or more host target binding sites located in untranslated regions of VGAM1026 host target RNA, herein designated VGAM HOST TARGET RNA. This complementary binding is due to the fact that the nucleotide sequence of VGAM1026 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1026 RNA, herein designated VGAM RNA, may have a different number of host target binding sites in untranslated regions of a VGAM1026 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1026 RNA, herein designated VGAM RNA, to host target binding sites on VGAM1026 host target RNA, herein designated VGAM HOST TARGET RNA, such as BINDING SITE I, BINDING SITE II and BINDING SITE III, inhibits translation of VGAM1026 host target RNA into VGAM1026 host target protein, herein designated VGAM HOST TARGET PROTEIN. VGAM host target protein is therefore outlined by a broken line.

It is appreciated that VGAM1026 host target gene, herein designated VGAM HOST TARGET GENE, in fact represents a plurality of VGAM1026 host target genes. The mRNA of each one of this plurality of VGAM1026 host target genes comprises one or more host target binding sites, each having a nucleotide sequence which is at least partly complementary to VGAM1026 RNA, herein designated VGAM RNA, and which when bound by VGAM1026 RNA causes inhibition of translation of respective one or more VGAM1026 host target proteins.

It is further appreciated by one skilled in the art that the mode of translational inhibition illustrated by FIG. 1 with specific reference to translational inhibition exerted by VGAM1026 gene, herein designated VGAM GENE, on one or more VGAM1026 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1026 is inhibition of expression of host target genes, as part of a novel viral mechanism of attacking a host. Accordingly, utilities of VGAM1026 include diagnosis, prevention and treatment of viral infection by Cereal Yellow Dwarf Virus - RPV. Specific functions, and accordingly utilities, of VGAM1026 correlate with, and may be deduced from, the identity of the host target genes which VGAM1026 binds and inhibits, and the function of these host target genes, as elaborated hereinbelow.

Nucleotide sequences of the VGAM1026 precursor RNA, herein designated VGAM PRECURSOR RNA, and of the 'diced' VGAM1026 RNA, herein designated VGAM RNA, and a schematic representation of the secondary folding of VGAM1026 folded precursor RNA, herein designated VGAM FOLDED PRECURSOR RNA, of VGAM1026 are further described hereinbelow with reference to Table 1.

Nucleotide sequences of host target binding sites, such as BINDING SITE-I, BINDING SITE-II and BINDING SITE-III of FIG. 1, found on VGAM1026 host target RNA, and schematic representation of the complementarity of each of these host target binding sites to VGAM1026 RNA, herein designated VGAM RNA, are described hereinbelow with reference to Table 2.

As mentioned hereinabove with reference to FIG. 1, a function of VGAM1026 gene, herein designated VGAM is inhibition of expression of VGAM1026 target genes. It is appreciated that specific functions, and accordingly utilities, of VGAM1026 correlate with, and may be deduced from, the identity of the target genes which VGAM1026 binds and inhibits, and the function of these target genes, as elaborated hereinbelow.

CERD4 (Accession NM_012074) is a VGAM1026 host target gene. CERD4 BINDING SITE is HOST TARGET binding site found in the 3' untranslated region of mRNA encoded by CERD4, corresponding to a HOST TARGET binding site such as BINDING SITE I, BINDING SITE II or BINDING SITE III. Table 2 illustrates the complementarity of the nucleotide sequences of CERD4 BINDING SITE, designated SEQ ID:14349, to the nucleotide sequence of VGAM1026 RNA, herein designated VGAM RNA, also designated SEQ ID:3737.

A function of VGAM1026 is therefore inhibition of CERD4 (Accession NM_012074). Accordingly, utilities of VGAM1026 include diagnosis, prevention and treatment of diseases and clinical conditions associated with CERD4. Gap Junction Protein, Beta 3, 31 kDa (connexin 31) (GJB3, Accession NM_024009) is another VGAM1026 host target gene. GJB3 BINDING SITE is HOST TARGET binding site found in the 3' untranslated region of mRNA encoded by GJB3, corresponding to a HOST TARGET binding site such as BINDING SITE I, BINDING SITE II or BINDING SITE III. Table 2 illustrates the complementarity of the nucleotide sequences of GJB3 BINDING SITE, designated SEQ ID:23438, to the nucleotide sequence of VGAM1026 RNA, herein designated VGAM RNA, also designated SEQ ID:3737.

Another function of VGAM1026 is therefore inhibition of Gap Junction Protein, Beta 3, 31 kDa (connexin 31) (GJB3, Accession NM_024009). Accordingly, utilities of VGAM1026 include diagnosis, prevention and treatment of diseases and clinical conditions associated with GJB3. Kinesin Family Member 1B (KIF1B, Accession NM_015074) is another VGAM1026 host target gene. KIF1B BINDING SITE is HOST TARGET binding site found in the 3' untranslated region of mRNA encoded by KIF1B, corresponding to a HOST TARGET binding site such as BINDING SITE I, BINDING SITE II or BINDING SITE III. Table 2 illustrates the complementarity of the nucleotide sequences of KIF1B BINDING SITE, designated SEQ ID:17449, to the nucleotide sequence of VGAM1026 RNA, herein designated VGAM RNA, also designated SEQ ID:3737.

Another function of VGAM1026 is therefore inhibition of Kinesin Family Member 1B (KIF1B, Accession NM_015074), a gene which motor for anterograde transport of mitochondria. has a microtubule plus end-directed motility. Accordingly, utilities of VGAM1026 include diagnosis, prevention and treatment of diseases and clinical conditions associated with KIF1B. The function of KIF1B has been established by previous studies. Nangaku et al. (1994) cloned a member of the mouse kinesin superfamily, Kif1b, which encodes an N-terminal-type motor protein. Kif1b was expressed in all tissues tested. In situ hybridization revealed that Kif1b is expressed abundantly in differentiated nerve cells. The authors found that Kif1b works as a monomer, having a microtubule plus-end-directed motility. Rotary shadowing electron microscopy revealed mostly single globular structures. Immunocytochemically, Kif1b was colocalized with mitochondria in vivo. A subcellular fractionation study showed that Kif1b is concentrated in the mitochondrial fraction, and purified Kif1b could transport mitochondria along microtubules in vitro. These data suggested that Kif1b works as a monomeric motor for anterograde transport of mitochondria. Zhao et al. (2001) identified an isoform of mouse Kif1b, which they called Kif1b-beta, that is distinct from Kif1b-alpha (Nangaku et al., 1994) in its cargo-binding domain. Yang et al. (2001) identified the KIF1B gene in a homozygously deleted region of chromosome 1p36.2 in a neuroblastoma cell line. They reported results suggesting that the gene is not a candidate for tumor suppressor gene of neuroblastoma. Northern blot analysis demonstrated that human KIF1B has at least 2 isoforms. The long isoform (KIF1B-beta) was expressed in a wide variety of tissues, while the short isoform (KIF1B-alpha) was detected only in adult testis.

Full details of the abovementioned studies are described in the following publications, the disclosure of which are hereby incorporated by reference:

Yang, H. W.; Chen, Y. Z.; Takita, J.; Soeda, E.; Piao, H. Y.; Hayashi, Y.: Genomic structure and mutational analysis of the human KIF1B gene which is homozygously deleted in neuroblastoma at chromosome 1p36.2. Oncogene 20:5075-5083, 2001; and Nangaku, M.; Sato-Yoshitake, R.; Okada, Y.; Noda, Y.; Takemura, R.; Yamazaki, H.; Hirokawa, N.: KIF1B, a novel microtubule plus end-directed monomeric motor protein for transport of mi.

Further studies establishing the function and utilities of KIF1B are found in John Hopkins OMIM database record ID 605995, and in sited publications numbered 4431-443 and 2276 listed in the bibliography section hereinbelow, which are also hereby incorporated by reference. POU Domain, Class 4, Transcription Factor 1 (POU4F1, Accession NM_006237) is another VGAM1026 host target gene. POU4F1 BINDING SITE is HOST TARGET binding site found in the 3' untranslated region of mRNA encoded by POU4F1, corresponding to a HOST TARGET binding site such as BINDING SITE I, BINDING SITE II or BINDING SITE III. Table 2 illustrates the complementarity of the nucleotide sequences of POU4F1 BINDING SITE, designated SEQ ID:12897, to the nucleotide sequence of VGAM1026 RNA, herein designated VGAM RNA, also designated SEQ ID:3737.

Another function of VGAM1026 is therefore inhibition of POU Domain, Class 4, Transcription Factor 1 (POU4F1, Accession NM_006237), a gene which plays a role in the regulation of specific gene expression within a subset of neuronal lineages. Accordingly, utilities of VGAM1026 include diagnosis, prevention and treatment of diseases and clinical conditions associated with POU4F1. The function of POU4F1 has been established by previous studies. BRN3A (OMIM Ref. No. POU4F1) is a class IV POU domain-containing transcription factor highly expressed in the developing sensory nervous system and in cells of the B- and T-lymphocytic lineages (Gerrero et al., 1993). Xiang et al. (1995) analyzed the expression patterns of brn3a, brn3b, and brn3c in fetal and adult mouse retina and brain. Antibodies to brn3a identify a large fraction of retinal ganglion cells. The 3 factors identify overlapping subsets of retinal ganglion cells and of neurons in the dorsal root and trigeminal ganglia, suggesting that primary somatosensory neurons and retinal ganglion cells share genetic regulatory hierarchies.

Full details of the abovementioned studies are described in the following publications, the disclosure of which are hereby incorporated by reference:

Gerrero, M. R.; McEvilly, R. J.; Turner, E.; Lin, C. R.; O'Connell, S.; Jenne, K. J.; Hobbs, M. V.; Rosenfeld, M. G.: Brn-3.0: a POU-domain protein expressed in the sensory immune and endocrine systems that functions on elements distinct from known octamer motifs. Proc. Nat. Acad. Sci. 90:10841-10845, 1993; and Xiang, M.; Zhou, L.; Macke, J. P.; Yoshioka, T.; Hendry, S. H. C.; Eddy, R. L.; Shows, T. B.; Nathans, J.: The Brn-3 family of POU-domain factors: primary structure, binding specificity, a.

Further studies establishing the function and utilities of POU4F1 are found in John Hopkins OMIM database record ID 601632, and in sited publications numbered 2805-2806, 2018, 280 and 3699 listed in the bibliography section hereinbelow, which are also hereby incorporated by reference. BCL2/adenovirus E1B 19 kDa Interacting Protein 2 (BNIP2, Accession XM_039703) is another VGAM1026 host target gene. BNIP2 BINDING SITE is HOST TARGET binding site found in the 3' untranslated region of mRNA encoded by BNIP2, corresponding to a HOST TARGET binding site such as BINDING SITE I, BINDING SITE II or BINDING SITE III. Table 2 illustrates the complementarity of the nucleotide sequences of BNIP2 BINDING SITE, designated SEQ ID:33163, to the nucleotide sequence of VGAM1026 RNA, herein designated VGAM RNA, also designated SEQ ID:3737.

Another function of VGAM1026 is therefore inhibition of BCL2/adenovirus E1B 19 kDa Interacting Protein 2 (BNIP2, Accession XM_039703). Accordingly, utilities of VGAM1026 include diagnosis, prevention and treatment of diseases and clinical conditions associated with BNIP2. Chromosome 20 Open Reading Frame 173 (C20orf173, Accession NM_080828) is another VGAM1026 host target gene. C20orf173 BINDING SITE is HOST TARGET binding site found in the 5" untranslated region of mRNA encoded by C20orf173, corresponding to a HOST TARGET binding site such as BINDING SITE I, BINDING SITE II or BINDING SITE III. Table 2 illustrates the complementarity of the nucleotide sequences of C20orf173 BINDING SITE, designated SEQ ID:28092, to the nucleotide sequence of VGAM1026 RNA, herein designated VGAM RNA, also designated SEQ ID:3737.

Another function of VGAM1026 is therefore inhibition of Chromosome 20 Open Reading Frame 173 (C20orf173, Accession NM_080828). Accordingly, utilities of VGAM1026 include diagnosis, prevention and treatment of diseases and clinical conditions associated with C20orf173. DJ122O8.2 (Accession NM_020466) is another VGAM1026 host target gene. DJ122O8.2 BINDING SITE is HOST TARGET binding site found in the 3' untranslated region of mRNA encoded by DJ122O8.2, corresponding to a HOST TARGET binding site such as BINDING SITE I, BINDING SITE II or BINDING SITE III. Table 2 illustrates the complementarity of the nucleotide sequences of DJ122O8.2 BINDING SITE, designated SEQ ID:21704, to the nucleotide sequence of VGAM1026 RNA, herein designated VGAM RNA, also designated SEQ ID:3737.

Another function of VGAM1026 is therefore inhibition of DJ122O8.2 (Accession NM_020466). Accordingly, utilities of VGAM1026 include diagnosis, prevention and treatment of diseases and clinical conditions associated with DJ122O8.2. DKFZp547A023 (Accession XM_052065) is another VGAM1026 host target gene. DKFZp547A023 BINDING SITE is HOST TARGET binding site found in the 3' untranslated region of mRNA encoded by DKFZp547A023, corresponding to a HOST TARGET binding site such as BINDING SITE I, BINDING SITE II or BINDING SITE III. Table 2 illustrates the complementarity of the nucleotide sequences of DKFZp547A023 BINDING SITE, designated SEQ ID:35941, to the nucleotide sequence of VGAM1026 RNA, herein designated VGAM RNA, also designated SEQ ID:3737.

Another function of VGAM1026 is therefore inhibition of DKFZp547A023 (Accession XM_052065). Accordingly, utilities of VGAM1026 include diagnosis, prevention and treatment of diseases and clinical conditions associated with DKFZp547A023. FLJ10607 (Accession XM_085119) is another VGAM1026 host target gene. FLJ10607 BINDING SITE is HOST TARGET binding site found in the 3' untranslated region of mRNA encoded by FLJ10607, corresponding to a HOST TARGET binding site such as BINDING SITE I, BINDING SITE II or BINDING SITE III. Table 2 illustrates the complementarity of the nucleotide sequences of FLJ10607 BINDING SITE, designated SEQ ID:37833, to the nucleotide sequence of VGAM1026 RNA, herein designated VGAM RNA, also designated SEQ ID:3737.

Another function of VGAM1026 is therefore inhibition of FLJ10607 (Accession XM_085119). Accordingly, utilities of VGAM1026 include diagnosis, prevention and treatment of diseases and clinical conditions associated with FLJ10607. FLJ22795 (Accession NM_025084) is another VGAM1026 host target gene. FLJ22795 BINDING SITE is HOST TARGET binding site found in the 3' untranslated region of mRNA encoded by FLJ22795, corresponding to a HOST TARGET binding site such as BINDING SITE I, BINDING SITE II or BINDING SITE III. Table 2 illustrates the complementarity of the nucleotide sequences of FLJ22795 BINDING SITE, designated SEQ ID:24689, to the nucleotide sequence of VGAM1026 RNA, herein designated VGAM RNA, also designated SEQ ID:3737.

Another function of VGAM1026 is therefore inhibition of FLJ22795 (Accession NM_025084). Accordingly, utilities of VGAM1026 include diagnosis, prevention and treatment of diseases and clinical conditions associated with FLJ22795. Gamma-aminobutyric Acid (GABA) B Receptor, 1 (GABBR1, Accession NM_021903) is another VGAM1026 host target gene. GABBR1 BINDING SITE is HOST TARGET binding site found in the 5' untranslated region of mRNA encoded by GABBR1, corresponding to a HOST TARGET binding site such as BINDING SITE I, BINDING SITE II or BINDING SITE III. Table 2 illustrates the complementarity of the nucleotide sequences of GABBR1 BINDING SITE, designated SEQ ID:22419, to the nucleotide sequence of VGAM1026 RNA, herein designated VGAM RNA, also designated SEQ ID:3737.

Another function of VGAM1026 is therefore inhibition of Gamma-aminobutyric Acid (GABA) B Receptor, 1 (GABBR1, Accession NM_021903). Accordingly, utilities of VGAM1026 include diagnosis, prevention and treatment of diseases and clinical conditions associated with GABBR1. KIAA0377 (Accession NM_014659) is another VGAM1026 host target gene. KIAA0377 BINDING SITE is HOST TARGET binding site found in the 3' untranslated region of mRNA encoded by KIAA0377, corresponding to a HOST TARGET binding site such as BINDING SITE I, BINDING SITE II or BINDING SITE III. Table 2 illustrates the complementarity of the nucleotide sequences of KIAA0377 BINDING SITE, designated SEQ ID:16102, to the nucleotide sequence of VGAM1026 RNA, herein designated VGAM RNA, also designated SEQ ID:3737.

Another function of VGAM1026 is therefore inhibition of KIAA0377 (Accession NM_014659). Accordingly, utilities of VGAM1026 include diagnosis, prevention and treatment of diseases and clinical conditions associated with KIAA0377. KIAA0546 (Accession XM_049055) is another VGAM1026 host target gene. KIAA0546 BINDING SITE is HOST TARGET binding site found in the 3' untranslated region of mRNA encoded by KIAA0546, corresponding to a HOST TARGET binding site such as BINDING SITE I, BINDING SITE II or BINDING SITE III. Table 2 illustrates the complementarity of the nucleotide sequences of KIAA0546 BINDING SITE, designated SEQ ID:35334, to the nucleotide sequence of VGAM1026 RNA, herein designated VGAM RNA, also designated SEQ ID:3737.

Another function of VGAM1026 is therefore inhibition of KIAA0546 (Accession XM_049055). Accordingly, utilities of VGAM1026 include diagnosis, prevention and treatment of diseases and clinical conditions associated with KIAA0546. KIAA1348 (Accession XM_043826) is another VGAM1026 host target gene. KIAA1348 BINDING SITE is HOST TARGET binding site found in the 3' untranslated region of mRNA encoded by KIAA1348, corresponding to a HOST TARGET binding site such as BINDING SITE I, BINDING SITE II or BINDING SITE III. Table 2 illustrates the complementarity of the nucleotide sequences of KIAA1348 BINDING SITE, designated SEQ ID:34033, to the nucleotide sequence of VGAM1026 RNA, herein designated VGAM RNA, also designated SEQ ID:3737.

Another function of VGAM1026 is therefore inhibition of KIAA1348 (Accession XM_043826). Accordingly, utilities of VGAM1026 include diagnosis, prevention and treatment of diseases and clinical conditions associated with KIAA1348. KIAA1706 (Accession XM_166595) is another VGAM1026 host target gene. KIAA1706 BINDING SITE is HOST TARGET binding site found in the 3' untranslated region of mRNA encoded by KIAA1706, corresponding to a HOST TARGET binding site such as BINDING SITE I, BINDING SITE II or BINDING SITE III. Table 2 illustrates the complementarity of the nucleotide sequences of KIAA1706 BINDING SITE, designated SEQ ID:44574, to the nucleotide sequence of VGAM1026 RNA, herein designated VGAM RNA, also designated SEQ ID:3737.

Another function of VGAM1026 is therefore inhibition of KIAA1706 (Accession XM_166595). Accordingly, utilities of VGAM1026 include diagnosis, prevention and treatment of diseases and clinical conditions associated with KIAA1706. RNP24 (Accession NM_006815) is another VGAM1026 host target gene. RNP24 BINDING SITE is HOST TARGET binding site found in the 3' untranslated region of mRNA encoded by RNP24, corresponding to a HOST TARGET binding site such as BINDING SITE I, BINDING SITE II or BINDING SITE III. Table 2 illustrates the complementarity of the nucleotide sequences of RNP24 BINDING SITE, designated SEQ ID:13692, to the nucleotide sequence of VGAM1026 RNA, herein designated VGAM RNA, also designated SEQ ID:3737.

Another function of VGAM1026 is therefore inhibition of RNP24 (Accession NM_006815). Accordingly, utilities of VGAM1026 include diagnosis, prevention and treatment of diseases and clinical conditions associated with RNP24. LOC145717 (Accession XM_039771) is another VGAM1026 host target gene. LOC145717 BINDING SITE is HOST TARGET binding site found in the 3' untranslated region of mRNA encoded by LOC145717, corresponding to a HOST TARGET binding site such as BINDING SITE I, BINDING SITE II or BINDING SITE III. Table 2 illustrates the complementarity of the nucleotide sequences of LOC145717 BINDING SITE, designated SEQ ID:33192, to the nucleotide sequence of VGAM1026 RNA, herein designated VGAM RNA, also designated SEQ ID:3737.

Another function of VGAM1026 is therefore inhibition of LOC145717 (Accession XM_039771). Accordingly, utilities of VGAM1026 include diagnosis, prevention and treatment of diseases and clinical conditions associated with LOC145717. LOC145725 (Accession XM_085211) is another VGAM1026 host target gene. LOC145725 BINDING SITE is HOST TARGET binding site found in the 5' untranslated region of mRNA encoded by LOC145725, corresponding to a HOST TARGET binding site such as BINDING SITE I, BINDING SITE II or BINDING SITE III. Table 2 illustrates the complementarity of the nucleotide sequences of LOC145725 BINDING SITE, designated SEQ ID:37948, to the nucleotide sequence of VGAM1026 RNA, herein designated VGAM RNA, also designated SEQ ID:3737.

Another function of VGAM1026 is therefore inhibition of LOC145725 (Accession XM_085211). Accordingly, utilities of VGAM1026 include diagnosis, prevention and treatment of diseases and clinical conditions associated with LOC145725. LOC145732 (Accession XM_085218) is another VGAM1026 host target gene. LOC145732 BINDING SITE is HOST TARGET binding site found in the 5' untranslated region of mRNA encoded by LOC145732, corresponding to a HOST TARGET binding site such as BINDING SITE I, BINDING SITE II or BINDING SITE III. Table 2 illustrates the complementarity of the nucleotide sequences of LOC145732 BINDING SITE, designated SEQ ID:37957, to the nucleotide sequence of VGAM1026 RNA, herein designated VGAM RNA, also designated SEQ ID:3737.

Another function of VGAM1026 is therefore inhibition of LOC145732 (Accession XM_085218). Accordingly, utilities of VGAM1026 include diagnosis, prevention and treatment of diseases and clinical conditions associated with LOC145732. LOC196957 (Accession XM_113789) is another VGAM1026 host target gene. LOC196957 BINDING SITE is HOST TARGET binding site found in the 5' untranslated region of mRNA encoded by LOC196957, corresponding to a HOST TARGET binding site such as BINDING SITE I, BINDING SITE II or BINDING SITE III. Table 2 illustrates the complementarity of the nucleotide sequences of LOC196957 BINDING SITE, designated SEQ ID:42429, to the nucleotide sequence of VGAM1026 RNA, herein designated VGAM RNA, also designated SEQ ID:3737.

Another function of VGAM1026 is therefore inhibition of LOC196957 (Accession XM_113789). Accordingly, utilities of VGAM1026 include diagnosis, prevention and treatment of diseases and clinical conditions associated with LOC196957. LOC196961 (Accession XM_113790) is another VGAM1026 host target gene. LOC196961 BINDING SITE is HOST TARGET binding site found in the 5' untranslated region of mRNA encoded by LOC196961, corresponding to a HOST TARGET binding site such as BINDING SITE I, BINDING SITE II or BINDING SITE III. Table 2 illustrates the complementarity of the nucleotide sequences of LOC196961 BINDING SITE, designated SEQ ID:42438, to the nucleotide sequence of VGAM1026 RNA, herein designated VGAM RNA, also designated SEQ ID:3737.

Another function of VGAM1026 is therefore inhibition of LOC196961 (Accession XM_113790). Accordingly, utilities of VGAM1026 include diagnosis, prevention and treatment of diseases and clinical conditions associated with LOC196961. LOC197138 (Accession XM_113829) is another VGAM1026 host target gene. LOC197138 BINDING SITE is HOST TARGET binding site found in the 5' untranslated region of mRNA encoded by LOC197138, corresponding to a HOST TARGET binding site such as BINDING SITE I, BINDING SITE II or BINDING SITE III. Table 2 illustrates the complementarity of the nucleotide sequences of LOC197138 BINDING SITE, designated SEQ ID:42456, to the nucleotide sequence of VGAM1026 RNA, herein designated VGAM RNA, also designated SEQ ID:3737.

Another function of VGAM1026 is therefore inhibition of LOC197138 (Accession XM_113829). Accordingly, utilities of VGAM1026 include diagnosis, prevention and treatment of diseases and clinical conditions associated with LOC197138. LOC220537 (Accession XM_165406) is another VGAM1026 host target gene. LOC220537 BINDING SITE is HOST TARGET binding site found in the 3' untranslated region of mRNA encoded by LOC220537, corresponding to a HOST TARGET binding site such as BINDING SITE I, BINDING SITE II or BINDING SITE III. Table 2 illustrates the complementarity of the nucleotide sequences of LOC220537 BINDING SITE, designated SEQ ID:43622, to the nucleotide sequence of VGAM1026 RNA, herein designated VGAM RNA, also designated SEQ ID:3737.

Another function of VGAM1026 is therefore inhibition of LOC220537 (Accession XM_165406). Accordingly, utilities of VGAM1026 include diagnosis, prevention and treatment of diseases and clinical conditions associated with LOC220537. LOC245727 (Accession XM_165913) is another VGAM1026 host target gene. LOC245727 BINDING SITE is HOST TARGET binding site found in the 5' untranslated region of mRNA encoded by LOC245727, corresponding to a HOST TARGET binding site such as BINDING SITE I, BINDING SITE II or BINDING SITE III. Table 2 illustrates the complementarity of the nucleotide sequences of LOC245727 BINDING SITE, designated SEQ ID:43797, to the nucleotide sequence of VGAM1026 RNA, herein designated VGAM RNA, also designated SEQ ID:3737.

Another function of VGAM1026 is therefore inhibition of LOC245727 (Accession XM_165913). Accordingly, utilities of VGAM1026 include diagnosis, prevention and treatment of diseases and clinical conditions associated with LOC245727. FIG. 1 further provides a conceptual description of a novel bioinformatically detected viral gene of the present invention, referred to here as Viral Genomic Address Messenger 1027 (VGAM1027) viral gene, which modulates expression of respective host target genes thereof, the function and utility of which host target genes is known in the art.

VGAM1027 is a novel bioinformatically detected regulatory, non protein coding, viral micro RNA (miRNA) gene. The method by which VGAM1027 was detected is described hereinabove with reference to FIGS. 1-8.

VGAM1027 gene, herein designated VGAM GENE, is a viral gene contained in the genome of Ictalurid Herpesvirus 1. VGAM1027 host target gene, herein designated VGAM HOST TARGET GENE, is a human gene contained in the human genome.

VGAM1027 gene encodes a VGAM1027 precursor RNA, herein designated VGAM PRECURSOR RNA. Similar to other miRNA genes, and unlike most ordinary genes, VGAM1027 precursor RNA does not encode a protein. A nucleotide sequence identical or highly similar to the nucleotide sequence of VGAM1027 precursor RNA is designated SEQ ID:1013, and is provided hereinbelow with reference to the sequence listing part. Nucleotide sequence SEQ ID:1013 is located at position 89420 relative to the genome of Ictalurid Herpesvirus 1.

VGAM1027 precursor RNA folds onto itself, forming VGAM1027 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1027 folded precursor RNA into VGAM1027 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1027 RNA is designated SEQ ID:3738, and is provided hereinbelow with reference to the sequence listing part.

VGAM1027 host target gene, herein designated VGAM HOST TARGET GENE, encodes a corresponding messenger RNA, VGAM1027 host target RNA, herein designated VGAM HOST TARGET RNA. VGAM1027 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1027 RNA, herein designated VGAM RNA, binds complementarily to one or more host target binding sites located in untranslated regions of VGAM1027 host target RNA, herein designated VGAM HOST TARGET RNA. This complementary binding is due to the fact that the nucleotide sequence of VGAM1027 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1027 RNA, herein designated VGAM RNA, may have a different number of host target binding sites in untranslated regions of a VGAM1027 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1027 RNA, herein designated VGAM RNA, to host target binding sites on VGAM1027 host target RNA, herein designated VGAM HOST TARGET RNA, such as BINDING SITE I, BINDING SITE II and BINDING SITE III, inhibits translation of VGAM1027 host target RNA into VGAM1027 host target protein, herein designated VGAM HOST TARGET PROTEIN. VGAM host target protein is therefore outlined by a broken line.

It is appreciated that VGAM1027 host target gene, herein designated VGAM HOST TARGET GENE, in fact represents a plurality of VGAM1027 host target genes. The mRNA of each one of this plurality of VGAM1027 host target genes comprises one or more host target binding sites, each having a nucleotide sequence which is at least partly complementary to VGAM1027 RNA, herein designated VGAM RNA, and which when bound by VGAM1027 RNA causes inhibition of translation of respective one or more VGAM1027 host target proteins.

It is further appreciated by one skilled in the art that the mode of translational inhibition illustrated by FIG. 1 with specific reference to translational inhibition exerted by VGAM1027 gene, herein designated VGAM GENE, on one or more VGAM1027 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1027 is inhibition of expression of host target genes, as part of a novel viral mechanism of attacking a host. Accordingly, utilities of VGAM1027 include diagnosis, prevention and treatment of viral infection by Ictalurid Herpesvirus 1. Specific functions, and accordingly utilities, of VGAM1027 correlate with, and may be deduced from, the identity of the host target genes which VGAM1027 binds and inhibits, and the function of these host target genes, as elaborated hereinbelow.

Nucleotide sequences of the VGAM1027 precursor RNA, herein designated VGAM PRECURSOR RNA, and of the 'diced' VGAM1027 RNA, herein designated VGAM RNA, and a schematic representation of the secondary folding of VGAM1027 folded precursor RNA, herein designated VGAM FOLDED PRECURSOR RNA, of VGAM1027 are further described hereinbelow with reference to Table 1.

Nucleotide sequences of host target binding sites, such as BINDING SITE-I, BINDING SITE-II and BINDING SITE-III of FIG. 1, found on VGAM1027 host target RNA, and schematic representation of the complementarity of each of these host target binding sites to VGAM1027 RNA, herein designated VGAM RNA, are described hereinbelow with reference to Table 2.

As mentioned hereinabove with reference to FIG. 1, a function of VGAM1027 gene, herein designated VGAM is inhibition of expression of VGAM1027 target genes. It is appreciated that specific functions, and accordingly utilities, of VGAM1027 correlate with, and may be deduced from, the identity of the target genes which VGAM1027 binds and inhibits, and the function of these target genes, as elaborated hereinbelow.

BarH-like Homeobox 1 (BARX1, Accession NM_021570) is a VGAM1027 host target gene. BARX1 BINDING SITE is HOST TARGET binding site found in the 5' untranslated region of mRNA encoded by BARX1, corresponding to a HOST TARGET binding site such as BINDING SITE I, BINDING SITE II or BINDING SITE III. Table 2 illustrates the complementarity of the nucleotide sequences of BARX1 BINDING SITE, designated SEQ ID:22236, to the nucleotide sequence of VGAM1027 RNA, herein designated VGAM RNA, also designated SEQ ID:3738.

A function of VGAM1027 is therefore inhibition of BarH-like Homeobox 1 (BARX1, Accession NM_021570), a gene which involves in craniofacial development, in odontogenesis and in stomach organogenesis. Accordingly, utilities of VGAM1027 include diagnosis, prevention and treatment of diseases and clinical conditions associated with BARX1. The function of BARX1 has been established by previous studies. Using the mouse Barx1 sequence to search sequence databases, followed by PCR screening of cDNA libraries, Gould and Walter (2000) isolated a cDNA encoding human BARX1.

The predicted 226-amino acid protein is identical in the homeodomain to the mouse and chick sequences and is approximately 90% identical overall. Northern blot analysis detected expression of a 1.6-kb transcript, with highest expression in testis and heart and lower levels in other tissues. Genomic sequence analysis determined that the BARX1 gene contains 4 exons. Animal model experiments lend further support to the function of BARX1. In a series of expression studies in mouse, Tucker et al. (1998) demonstrated that bone morphogenetic protein-4 (Bmp4) activates the expression of Msx1 (OMIM Ref. No. 142983), leading to incisor tooth development. BMP4 inhibited expression of Barx1, which marks presumptive molar teeth, and limits expression to the proximal, presumptive molar mesenchyme at embryonic day 10. Fibroblast growth factor-8 (FGF8; 600483) stimulated Barx1 expression. When BMP4 signaling in early development was inhibited by application of exogenous Noggin (OMIM Ref. No. 602991) protein, ectopic Barx1 expression resulted in transformation of tooth identity from incisor to molar It is appreciated that the abovementioned animal model for BARX1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gould, D. B.; Walter, M. A.: Cloning, characterization, localization, and mutational screening of the human BARX1 gene. Genomics 68:336-342, 2000; and Tucker, A. S.; Matthews, K. L.; Sharpe, P. T.: Transformation of tooth type induced by inhibition of BMP signaling. Science 282:1136-1138, 1998.

Further studies establishing the function and utilities of BARX1 are found in John Hopkins OMIM database record ID 603260, and in sited publications numbered 8739-874 and 11637 listed in the bibliography section hereinbelow, which are also hereby incorporated by reference. Forkhead Box E3 (FOXE3, Accession NM_012186) is another VGAM1027 host target gene. FOXE3 BINDING SITE is HOST TARGET binding site found in the 3' untranslated region of mRNA encoded by FOXE3, corresponding to a HOST TARGET binding site such as BINDING SITE I, BINDING SITE II or BINDING SITE III. Table 2 illustrates the complementarity of the nucleotide sequences of FOXE3 BINDING SITE, designated SEQ ID:14469, to the nucleotide sequence of VGAM1027 RNA, herein designated VGAM RNA, also designated SEQ ID:3738.

Another function of VGAM1027 is therefore inhibition of Forkhead Box E3 (FOXE3, Accession NM_012186), a gene which regulates embryonic development. Accordingly, utilities of VGAM1027 include diagnosis, prevention and treatment of diseases and clinical conditions associated with FOXE3. The function of FOXE3 and its association with various diseases and clinical conditions, has been established by previous studies, as described hereinabove with reference to VGAM632. Glucose-6-phosphate Dehydrogenase (G6PD, Accession NM_000402) is another VGAM1027 host target gene. G6PD BINDING SITE is HOST TARGET binding site found in the 5' untranslated region of mRNA encoded by G6PD, corresponding to a HOST TARGET binding site such as BINDING SITE I, BINDING SITE II or BINDING SITE III. Table 2 illustrates the complementarity of the nucleotide sequences of G6PD BINDING SITE, designated SEQ ID:5979, to the nucleotide sequence of VGAM1027 RNA, herein designated VGAM RNA, also designated SEQ ID:3738.

Another function of VGAM1027 is therefore inhibition of Glucose-6-phosphate Dehydrogenase (G6PD, Accession NM_000402), a gene which produces pentose sugars for nucleic acid synthesis and main producer of nadph reducing power. Accordingly, utilities of VGAM1027 include diagnosis, prevention and treatment of diseases and clinical conditions associated with G6PD. The function of G6PD has been established by previous studies. Since identification of deficiency of G6PD (Carson et al., 1956) and of its X-chromosomal determination (Childs et al., 1958) in the 1950s and demonstration of electrophoretic variants of this enzyme in the early 1960s (Boyer et al., 1962), the genetic, clinical and biochemical significance of this polymorphism has been found to be great. G6PD is in the hexose monophosphate pathway, the only NADPH-generation process in mature red cells, which lack the citric acid cycle. For this reason G6PD deficiency has adverse physiologic effects. Deficiency of the red cell enzyme, in various forms, is the basis of favism, primaquine sensitivity and some other drug-sensitive hemolytic anemias, anemia and jaundice in the newborn, and chronic nonspherocytic hemolytic anemia (Beutler et al., 1968). Beaconsfield et al. (1965) advanced the hypothesis that the incidence of cancer is inversely related to the frequency of G6PD deficiency in blacks. Since the metabolism of xylitol remains intact in G6PD-dependent red cells, Wang et al. (1971) suggested use of xylitol in the treatment of hemolytic crisis. Different variants of the enzyme are found in high frequency in African, Mediterranean and Asiatic populations (Porter et al., 1964), and heterozygote advantage vis-a-vis malaria (Luzzatto et al., 1969) has been invoked to account for the high frequency of the particular alleles in particular populations. The variety of forms of the enzyme is great, as illustrated by the published tables (Yoshida et al., 1971; Beutler and Yoshida, 1973; Yoshida and Beutler, 1978) and by the listing of allelic variants in this entry. The World Health Organization (363,364:WHO, 1967,1967) gave its attention to problems of nomenclature and standard procedures for study. The demonstrated polymorphism at this X-linked locus rivals that of the autosomal loci for the polypeptide chains of hemoglobin. As in the latter instance, single amino acid substitution has been demonstrated as the basis of the change in the G6PD molecule resulting from mutation (Yoshida et al., 1967). Polymorphism at the G6PD locus has made it a useful X-chromosome marker, like the colorblindness and Xg blood group loci; close linkage of the colorblindness loci, the G6PD locus, and the hemophilia A locus (Adam et al., 1966; Boyer and Graham, 1965) has been demonstrated. Also, as a biochemical phenotype identifiable at the cellular level, G6PD variants have been useful in somatic cell genetics, permitting, for example, one of the critical proofs in man of the Lyon hypothesis (Davidson et al., 1963). The relative stability of the X chromosome during evolution has been shown by the fact that the G6PD locus is X-borne also in a number of other species (Ohno, 1967). That G6PD is X-linked in the mouse is supported by Epstein's finding (1969) that oocytes of XO females have half as much G6PD as do oocytes of XX female mice. The level of lactate dehydrogenase was the same. Epstein's conclusion was that the G6PD gene is X-linked in the mouse, that synthesis occurs in the oocyte and is dosage-dependent, and that X-inactivation does not occur in oocytes. G6PD and HPRT are linked in the Chinese hamster (Rosenstraus and Chasin, 1975) and presumably are on the X chromosome as in man. By study of cell hybrids, Shows et al. (1976) found that HPRT and G6PD are closely linked in the Muntjac deer. Smith et al. (1976) found G6PD deficiency in a male Weimaraner dog, but were not able to do genetic studies. Alpha-GAL, HPRT, PGK and G6PD are X-linked in the rabbit, according to mouse-rabbit hybrid cell studies (Cianfriglia et al., 1979; Echard and Gillois, 1979). By comparable methods, Hors-Cayla et al. (1979) found them to be X-linked also in cattle. According to cell hybridization studies, HPRT, G6PD, and PGK are X-linked in the pig (Gellin et al., 1979) and in sheep (Saidi et al., 1979). Pretsch et al. (1988) recovered a mouse with X-linked G6PD deficiency from the offspring of 1-ethyl-1-nitrosourea-treated male mice. Using pulsed field gel electrophoresis, Faust et al. (1992) demonstrated that, in the mouse, Gdx (OMIM Ref. No. 312070), P3 (OMIM Ref. No. 312090), and G6pd are physically linked to the X-linked visual pigment locus (Rsvp) within a maximal distance of 340 kb, while G6pd and Cf-8 (OMIM Ref. No. 306700) are approximately 900 kb apart.

Full details of the abovementioned studies are described in the following publications, the disclosure of which are hereby incorporated by reference:

Beutler, E.; Mathai, C. K.; Smith, J. E.: Biochemical variants of glucose-6-phosphate dehydrogenase giving rise to congenital nonspherocytic hemolytic disease. Blood 31:131-150, 1968; and Wang, Y. M.; Patterson, J. H.; Van Eys, J.: The potential use of xylitol in glucose-6-phosphate dehydrogenase deficiency anemia. J. Clin. Invest. 50:1421-1428, 1971.

Further studies establishing the function and utilities of G6PD are found in John Hopkins OMIM database record ID 305900, and in sited publications numbered 11064-11075, 4212, 8019-8055, 8676-8678, 7352, 8679-8691, 8804-870 and 8258-8276 listed in the bibliography section hereinbelow, which are also hereby incorporated by reference. Glutamate-cysteine Ligase, Modifier Subunit (GCLM, Accession NM_002061) is another VGAM1027 host target gene. GCLM BINDING SITE is HOST TARGET binding site found in the 5' untranslated region of mRNA encoded by GCLM, corresponding to a HOST TARGET binding site such as BINDING SITE I, BINDING SITE II or BINDING SITE III. Table 2 illustrates the complementarity of the nucleotide sequences of GCLM BINDING SITE, designated SEQ ID:7821, to the nucleotide sequence of VGAM1027 RNA, herein designated VGAM RNA, also designated SEQ ID:3738.

Another function of VGAM1027 is therefore inhibition of Glutamate-cysteine Ligase, Modifier Subunit (GCLM, Accession NM_002061), a gene which is GLUTAMATE-CYSTEINE LIGASE. Accordingly, utilities of VGAM1027 include diagnosis, prevention and treatment of diseases and clinical conditions associated with GCLM. The function of GCLM has been established by previous studies. Gamma-glutamylcysteine synthetase, also known as glutamate-cysteine ligase (EC 6.3.2.2), is the first rate-limiting enzyme in glutathione biosynthesis.

Full details of the abovementioned studies are described in the following publications, the disclosure of which are hereby incorporated by reference:

Gipp, J. J.; Bailey, H. H.; Mulcahy, R. T.: Cloning and sequencing of the cDNA for the light subunit of human liver gamma-glutamylcysteine synthetase and relative mRNA levels for heavy and light subunits in human normal tissues. Biochem. Biophys. Res. Commun. 206:584-589, 1995; and Tsuchiya, K.; Mulcahy, R. T.; Reid, L. L.; Disteche, C. M.; Kavanagh, T. J.: Mapping of the glutamate-cysteine ligase catalytic subunit gene (GLCLC) to human chromosome 6p12 and mouse c.

Further studies establishing the function and utilities of GCLM are found in John Hopkins OMIM database record ID 601176, and in sited publications numbered 9314-931 and 9320-9317 listed in the bibliography section hereinbelow, which are also hereby incorporated by reference. Ret Finger Protein (RFP, Accession NM_006510) is another VGAM1027 host target gene. RFP BINDING SITE is HOST TARGET binding site found in the 5' untranslated region of mRNA encoded by RFP, corresponding to a HOST TARGET binding site such as BINDING SITE I, BINDING SITE II or BINDING SITE III. Table 2 illustrates the complementarity of the nucleotide sequences of RFP BINDING SITE, designated SEQ ID:13258, to the nucleotide sequence of VGAM1027 RNA, herein designated VGAM RNA, also designated SEQ ID:3738.

Another function of VGAM1027 is therefore inhibition of Ret Finger Protein (RFP, Accession NM_006510), a gene which involvels in transcriptional regulation and may act in male germ cell development. Accordingly, utilities of VGAM1027 include diagnosis, prevention and treatment of diseases and clinical conditions associated with RFP. The function of RFP and its association with various diseases and clinical conditions, has been established by previous studies, as described hereinabove with reference to VGAM302. SORCS2 (Accession NM_020777) is another VGAM1027 host target gene. SORCS2 BINDING SITE is HOST TARGET binding site found in the 5' untranslated region of mRNA encoded by SORCS2, corresponding to a HOST TARGET binding site such as BINDING SITE I, BINDING SITE II or BINDING SITE III. Table 2 illustrates the complementarity of the nucleotide sequences of SORCS2 BINDING SITE, designated SEQ ID:21877, to the nucleotide sequence of VGAM1027 RNA, herein designated VGAM RNA, also designated SEQ ID:3738.

Another function of VGAM1027 is therefore inhibition of SORCS2 (Accession NM_020777). Accordingly, utilities of VGAM1027 include diagnosis, prevention and treatment of diseases and clinical conditions associated with SORCS2. Chromosome 17 Open Reading Frame 31 (C17orf31, Accession NM_017575) is another VGAM1027 host target gene. C17orf31 BINDING SITE is HOST TARGET binding site found in the 5' untranslated region of mRNA encoded by C17orf31, corresponding to a HOST TARGET binding site such as BINDING SITE I, BINDING SITE II or BINDING SITE III. Table 2 illustrates the complementarity of the nucleotide sequences of C17orf31 BINDING SITE, designated SEQ ID:19003, to the nucleotide sequence of VGAM1027 RNA, herein designated VGAM RNA, also designated SEQ ID:3738.

Another function of VGAM1027 is therefore inhibition of Chromosome 17 Open Reading Frame 31 (C17orf31, Accession NM_017575). Accordingly, utilities of VGAM1027 include diagnosis, prevention and treatment of diseases and clinical conditions associated with C17orf31. Centaurin, Gamma 2 (CENTG2, Accession NM_014914) is another VGAM1027 host target gene. CENTG2 BINDING SITE is HOST TARGET binding site found in the 5' untranslated region of mRNA encoded by CENTG2, corresponding to a HOST TARGET binding site such as BINDING SITE I, BINDING SITE II or BINDING SITE III. Table 2 illustrates the complementarity of the nucleotide sequences of CENTG2 BINDING SITE, designated SEQ ID:17158, to the nucleotide sequence of VGAM1027 RNA, herein designated VGAM RNA, also designated SEQ ID:3738.

Another function of VGAM1027 is therefore inhibition of Centaurin, Gamma 2 (CENTG2, Accession NM_014914). Accordingly, utilities of VGAM1027 include diagnosis, prevention and treatment of diseases and clinical conditions associated with CENTG2. DT1P1A10 (Accession XM_029187) is another VGAM1027 host target gene.

DT1P1A10 BINDING SITE is HOST TARGET binding site found in the 3' untranslated region of mRNA encoded by DT1P1A10, corresponding to a HOST TARGET binding site such as BINDING SITE I, BINDING SITE II or BINDING SITE III. Table 2 illustrates the complementarity of the nucleotide sequences of DT1P1A10 BINDING SITE, designated SEQ ID:30858, to the nucleotide sequence of VGAM1027 RNA, herein designated VGAM RNA, also designated SEQ ID:3738.

Another function of VGAM1027 is therefore inhibition of DT1P1A10 (Accession XM_029187). Accordingly, utilities of VGAM1027 include diagnosis, prevention and treatment of diseases and clinical conditions associated with DT1P1A10. E2IG3 (Accession NM_014366) is another VGAM1027 host target gene. E2IG3 BINDING SITE is HOST TARGET binding site found in the 5' untranslated region of mRNA encoded by E2IG3, corresponding to a HOST TARGET binding site such as BINDING SITE I, BINDING SITE II or BINDING SITE III. Table 2 illustrates the complementarity of the nucleotide sequences of E2IG3 BINDING SITE, designated SEQ ID:15696, to the nucleotide sequence of VGAM1027 RNA, herein designated VGAM RNA, also designated SEQ ID:3738.

Another function of VGAM1027 is therefore inhibition of E2IG3 (Accession NM_014366). Accordingly, utilities of VGAM1027 include diagnosis, prevention and treatment of diseases and clinical conditions associated with E2IG3. Epsin 2 (EPN2, Accession NM_014964) is another VGAM1027 host target gene. EPN2 BINDING SITE is HOST TARGET binding site found in the 3' untranslated region of mRNA encoded by EPN2, corresponding to a HOST TARGET binding site such as BINDING SITE I, BINDING SITE II or BINDING SITE III. Table 2 illustrates the complementarity of the nucleotide sequences of EPN2 BINDING SITE, designated SEQ ID:17347, to the nucleotide sequence of VGAM1027 RNA, herein designated VGAM RNA, also designated SEQ ID:3738.

Another function of VGAM1027 is therefore inhibition of Epsin 2 (EPN2, Accession NM_014964). Accordingly, utilities of VGAM1027 include diagnosis, prevention and treatment of diseases and clinical conditions associated with EPN2. FLJ20400 (Accession XM_039306) is another VGAM1027 host target gene. FLJ20400 BINDING SITE is HOST TARGET binding site found in the 5' untranslated region of mRNA encoded by FLJ20400, corresponding to a HOST TARGET binding site such as BINDING SITE I, BINDING SITE II or BINDING SITE III. Table 2 illustrates the complementarity of the nucleotide sequences of FLJ20400 BINDING SITE, designated SEQ ID:33045, to the nucleotide sequence of VGAM1027 RNA, herein designated VGAM RNA, also designated SEQ ID:3738.

Another function of VGAM1027 is therefore inhibition of FLJ20400 (Accession XM_039306). Accordingly, utilities of VGAM1027 include diagnosis, prevention and treatment of diseases and clinical conditions associated with FLJ20400. FLJ20979 (Accession NM_024121) is another VGAM1027 host target gene. FLJ20979 BINDING SITE is HOST TARGET binding site found in the 5' untranslated region of mRNA encoded by FLJ20979, corresponding to a HOST TARGET binding site such as BINDING SITE I, BINDING SITE II or BINDING SITE III. Table 2 illustrates the complementarity of the nucleotide sequences of FLJ20979 BINDING SITE, designated SEQ ID:23573, to the nucleotide sequence of VGAM1027 RNA, herein designated VGAM RNA, also designated SEQ ID:3738.

Another function of VGAM1027 is therefore inhibition of FLJ20979 (Accession NM_024121). Accordingly, utilities of VGAM1027 include diagnosis, prevention and treatment of diseases and clinical conditions associated with FLJ20979. FLJ21195 (Accession NM_022469) is another VGAM1027 host target gene. FLJ21195 BINDING SITE is HOST TARGET binding site found in the 5' untranslated region of mRNA encoded by FLJ21195, corresponding to a HOST TARGET binding site such as BINDING SITE I, BINDING SITE II or BINDING SITE III. Table 2 illustrates the complementarity of the nucleotide sequences of FLJ21195 BINDING SITE, designated SEQ ID:22826, to the nucleotide sequence of VGAM1027 RNA, herein designated VGAM RNA, also designated SEQ ID:3738.

Another function of VGAM1027 is therefore inhibition of FLJ21195 (Accession NM_022469). Accordingly, utilities of VGAM1027 include diagnosis, prevention and treatment of diseases and clinical conditions associated with FLJ21195. FLJ21562 (Accession NM_025113) is another VGAM1027 host target gene. FLJ21562 BINDING SITE is HOST TARGET binding site found in the 5' untranslated region of mRNA encoded by FLJ21562, corresponding to a HOST TARGET binding site such as BINDING SITE I, BINDING SITE II or BINDING SITE III. Table 2 illustrates the complementarity of the nucleotide sequences of FLJ21562 BINDING SITE, designated SEQ ID:24762, to the nucleotide sequence of VGAM1027 RNA, herein designated VGAM RNA, also designated SEQ ID:3738.

Another function of VGAM1027 is therefore inhibition of FLJ21562 (Accession NM_025113). Accordingly, utilities of VGAM1027 include diagnosis, prevention and treatment of diseases and clinical conditions associated with FLJ21562. KIAA0415 (Accession XM_166527) is another VGAM1027 host target gene. KIAA0415 BINDING SITE is HOST TARGET binding site found in the 3' untranslated region of mRNA encoded by KIAA0415, corresponding to a HOST TARGET binding site such as BINDING SITE I, BINDING SITE II or BINDING SITE III. Table 2 illustrates the complementarity of the nucleotide sequences of KIAA0415 BINDING SITE, designated SEQ ID:44476, to the nucleotide sequence of VGAM1027 RNA, herein designated VGAM RNA, also designated SEQ ID:3738.

Another function of VGAM1027 is therefore inhibition of KIAA0415 (Accession XM_166527). Accordingly, utilities of VGAM1027 include diagnosis, prevention and treatment of diseases and clinical conditions associated with KIAA0415. KIAA0683 (Accession NM_016111) is another VGAM1027 host target gene. KIAA0683 BINDING SITE is HOST TARGET binding site found in the 5' untranslated region of mRNA encoded by KIAA0683, corresponding to a HOST TARGET binding site such as BINDING SITE I, BINDING SITE II or BINDING SITE III. Table 2 illustrates the complementarity of the nucleotide sequences of KIAA0683 BINDING SITE, designated SEQ ID:18191, to the nucleotide sequence of VGAM1027 RNA, herein designated VGAM RNA, also designated SEQ ID:3738.

Another function of VGAM1027 is therefore inhibition of KIAA0683 (Accession NM_016111). Accordingly, utilities of VGAM1027 include diagnosis, prevention and treatment of diseases and clinical conditions associated with KIAA0683. KIAA1643 (Accession XM_035371) is another VGAM1027 host target gene. KIAA1643 BINDING SITE is HOST TARGET binding site found in the 5' untranslated region of mRNA encoded by KIAA1643, corresponding to a HOST TARGET binding site such as BINDING SITE I, BINDING SITE II or BINDING SITE III. Table 2 illustrates the complementarity of the nucleotide sequences of KIAA1643 BINDING SITE, designated SEQ ID:32240, to the nucleotide sequence of VGAM1027 RNA, herein designated VGAM RNA, also designated SEQ ID:3738.

Another function of VGAM1027 is therefore inhibition of KIAA1643 (Accession XM_035371). Accordingly, utilities of VGAM1027 include diagnosis, prevention and treatment of diseases and clinical conditions associated with KIAA1643. MGC10986 (Accession NM_030576) is another VGAM1027 host target gene. MGC10986 BINDING SITE is HOST TARGET binding site found in the 5' untranslated region of mRNA encoded by MGC10986, corresponding to a HOST TARGET binding site such as BINDING SITE I, BINDING SITE II or BINDING SITE III. Table 2 illustrates the complementarity of the nucleotide sequences of MGC10986 BINDING SITE, designated SEQ ID:24950, to the nucleotide sequence of VGAM1027 RNA, herein designated VGAM RNA, also designated SEQ ID:3738.

Another function of VGAM1027 is therefore inhibition of MGC10986 (Accession NM_030576). Accordingly, utilities of VGAM1027 include diagnosis, prevention and treatment of diseases and clinical conditions associated with MGC10986. Phosphatidylserine Synthase 2 (PTDSS2, Accession NM_030783) is another VGAM1027 host target gene. PTDSS2 BINDING SITE is HOST TARGET binding site found in the 3' untranslated region of mRNA encoded by PTDSS2, corresponding to a HOST TARGET binding site such as BINDING SITE I, BINDING SITE II or BINDING SITE III. Table 2 illustrates the complementarity of the nucleotide sequences of PTDSS2 BINDING SITE, designated SEQ ID:25075, to the nucleotide sequence of VGAM1027 RNA, herein designated VGAM RNA, also designated SEQ ID:3738.

Another function of VGAM1027 is therefore inhibition of Phosphatidylserine Synthase 2 (PTDSS2, Accession NM_030783). Accordingly, utilities of VGAM1027 include diagnosis, prevention and treatment of diseases and clinical conditions associated with PTDSS2. LOC254057 (Accession XM_173085) is another VGAM1027 host target gene. LOC254057 BINDING SITE is HOST TARGET binding site found in the 5' untranslated region of mRNA encoded by LOC254057, corresponding to a HOST TARGET binding site such as BINDING SITE I, BINDING SITE II or BINDING SITE III. Table 2 illustrates the complementarity of the nucleotide sequences of LOC254057 BINDING SITE, designated SEQ ID:46344, to the nucleotide sequence of VGAM1027 RNA, herein designated VGAM RNA, also designated SEQ ID:3738.

Another function of VGAM1027 is therefore inhibition of LOC254057 (Accession XM_173085). Accordingly, utilities of VGAM1027 include diagnosis, prevention and treatment of diseases and clinical conditions associated with LOC254057. LOC254528 (Accession XM_170797) is another VGAM1027 host target gene. LOC254528 BINDING SITE is HOST TARGET binding site found in the 5' untranslated region of mRNA encoded by LOC254528, corresponding to a HOST TARGET binding site such as BINDING SITE I, BINDING SITE II or BINDING SITE III. Table 2 illustrates the complementarity of the nucleotide sequences of LOC254528 BINDING SITE, designated SEQ ID:45567, to the nucleotide sequence of VGAM1027 RNA, herein designated VGAM RNA, also designated SEQ ID:3738.

Another function of VGAM1027 is therefore inhibition of LOC254528 (Accession XM_170797). Accordingly, utilities of VGAM1027 include diagnosis, prevention and treatment of diseases and clinical conditions associated with LOC254528. LOC257479 (Accession XM_171548) is another VGAM1027 host target gene. LOC257479 BINDING SITE is HOST TARGET binding site found in the 5' untranslated region of mRNA encoded by LOC257479, corresponding to a HOST TARGET binding site such as BINDING SITE I, BINDING SITE II or BINDING SITE III. Table 2 illustrates the complementarity of the nucleotide sequences of LOC257479 BINDING SITE, designated SEQ ID:46052, to the nucleotide sequence of VGAM1027 RNA, herein designated VGAM RNA, also designated SEQ ID:3738.

Another function of VGAM1027 is therefore inhibition of LOC257479 (Accession XM_171548). Accordingly, utilities of VGAM1027 include diagnosis, prevention and treatment of diseases and clinical conditions associated with LOC257479. LOC56926 (Accession XM_052629) is another VGAM1027 host target gene. LOC56926 BINDING SITE is HOST TARGET binding site found in the 5' untranslated region of mRNA encoded by LOC56926, corresponding to a HOST TARGET binding site such as BINDING SITE I, BINDING SITE II or BINDING SITE III. Table 2 illustrates the complementarity of the nucleotide sequences of LOC56926 BINDING SITE, designated SEQ ID:36042, to the nucleotide sequence of VGAM1027 RNA, herein designated VGAM RNA, also designated SEQ ID:3738.

Another function of VGAM1027 is therefore inhibition of LOC56926 (Accession XM_052629). Accordingly, utilities of VGAM1027 include diagnosis, prevention and treatment of diseases and clinical conditions associated with LOC56926. LOC56961 (Accession XM_031857) is another VGAM1027 host target gene. LOC56961 BINDING SITE is HOST TARGET binding site found in the 5' untranslated region of mRNA encoded by LOC56961, corresponding to a HOST TARGET binding site such as BINDING SITE I, BINDING SITE II or BINDING SITE III. Table 2 illustrates the complementarity of the nucleotide sequences of LOC56961 BINDING SITE, designated SEQ ID:31507, to the nucleotide sequence of VGAM1027 RNA, herein designated VGAM RNA, also designated SEQ ID:3738.

Another function of VGAM1027 is therefore inhibition of LOC56961 (Accession XM_031857). Accordingly, utilities of VGAM1027 include diagnosis, prevention and treatment of diseases and clinical conditions associated with LOC56961. FIG. 1 further provides a conceptual description of a novel bioinformatically detected viral gene of the present invention, referred to here as Viral Genomic Address Messenger 1028 (VGAM1028) viral gene, which modulates expression of respective host target genes thereof, the function and utility of which host target genes is known in the art.

VGAM1028 is a novel bioinformatically detected regulatory, non protein coding, viral micro RNA (miRNA) gene. The method by which VGAM1028 was detected is described hereinabove with reference to FIGS. 1-8.

VGAM1028 gene, herein designated VGAM GENE, is a viral gene contained in the genome of Ictalurid Herpesvirus 1. VGAM1028 host target gene, herein designated VGAM HOST TARGET GENE, is a human gene contained in the human genome.

VGAM1028 gene encodes a VGAM1028 precursor RNA, herein designated VGAM PRECURSOR RNA. Similar to other miRNA genes, and unlike most ordinary genes, VGAM1028 precursor RNA does not encode a protein. A nucleotide sequence identical or highly similar to the nucleotide sequence of VGAM1028 precursor RNA is designated SEQ ID:1014, and is provided hereinbelow with reference to the sequence listing part. Nucleotide sequence SEQ ID:1014 is located at position 86483 relative to the genome of Ictalurid Herpesvirus 1.

VGAM1028 precursor RNA folds onto itself, forming VGAM1028 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1028 folded precursor RNA into VGAM1028 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1028 RNA is designated SEQ ID:3739, and is provided hereinbelow with reference to the sequence listing part.

VGAM1028 host target gene, herein designated VGAM HOST TARGET GENE, encodes a corresponding messenger RNA, VGAM1028 host target RNA, herein designated VGAM HOST TARGET RNA. VGAM1028 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1028 RNA, herein designated VGAM RNA, binds complementarily to one or more host target binding sites located in untranslated regions of VGAM1028 host target RNA, herein designated VGAM HOST TARGET RNA. This complementary binding is due to the fact that the nucleotide sequence of VGAM1028 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1028 RNA, herein designated VGAM RNA, may have a different number of host target binding sites in untranslated regions of a VGAM1028 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1028 RNA, herein designated VGAM RNA, to host target binding sites on VGAM1028 host target RNA, herein designated VGAM HOST TARGET RNA, such as BINDING SITE I, BINDING SITE II and BINDING SITE III, inhibits translation of VGAM1028 host target RNA into VGAM1028 host target protein, herein designated VGAM HOST TARGET PROTEIN. VGAM host target protein is therefore outlined by a broken line.

It is appreciated that VGAM1028 host target gene, herein designated VGAM HOST TARGET GENE, in fact represents a plurality of VGAM1028 host target genes. The mRNA of each one of this plurality of VGAM1028 host target genes comprises one or more host target binding sites, each having a nucleotide sequence which is at least partly complementary to VGAM1028 RNA, herein designated VGAM RNA, and which when bound by VGAM1028 RNA causes inhibition of translation of respective one or more VGAM1028 host target proteins.

It is further appreciated by one skilled in the art that the mode of translational inhibition illustrated by FIG. 1 with specific reference to translational inhibition exerted by VGAM1028 gene, herein designated VGAM GENE, on one or more VGAM1028 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1028 is inhibition of expression of host target genes, as part of a novel viral mechanism of attacking a host. Accordingly, utilities of VGAM1028 include diagnosis, prevention and treatment of viral infection by Ictalurid Herpesvirus 1. Specific functions, and accordingly utilities, of VGAM1028 correlate with, and may be deduced from, the identity of the host target genes which VGAM1028 binds and inhibits, and the function of these host target genes, as elaborated hereinbelow.

Nucleotide sequences of the VGAM1028 precursor RNA, herein designated VGAM PRECURSOR RNA, and of the 'diced' VGAM1028 RNA, herein designated VGAM RNA, and a schematic representation of the secondary folding of VGAM1028 folded precursor RNA, herein designated VGAM FOLDED PRECURSOR RNA, of VGAM1028 are further described hereinbelow with reference to Table 1.

Nucleotide sequences of host target binding sites, such as BINDING SITE-I, BINDING SITE-II and BINDING SITE-III of FIG. 1, found on VGAM1028 host target RNA, and schematic representation of the complementarity of each of these host target binding sites to VGAM1028 RNA, herein designated VGAM RNA, are described hereinbelow with reference to Table 2.

As mentioned hereinabove with reference to FIG. 1, a function of VGAM1028 gene, herein designated VGAM is inhibition of expression of VGAM1028 target genes. It is appreciated that specific functions, and accordingly utilities, of VGAM1028 correlate with, and may be deduced from, the identity of the target genes which VGAM1028 binds and inhibits, and the function of these target genes, as elaborated hereinbelow.

A Kinase (PRKA) Anchor Protein 13 (AKAP13, Accession XM_116974) is a VGAM1028 host target gene. AKAP13 BINDING SITE is HOST TARGET binding site found in the 3' untranslated region of mRNA encoded by AKAP13, corresponding to a HOST TARGET binding site such as BINDING SITE I, BINDING SITE II or BINDING SITE III. Table 2 illustrates the complementarity of the nucleotide sequences of AKAP13 BINDING SITE, designated SEQ ID:43174, to the nucleotide sequence of VGAM1028 RNA, herein designated VGAM RNA, also designated SEQ ID:3739.

A function of VGAM1028 is therefore inhibition of A Kinase (PRKA) Anchor Protein 13 (AKAP13, Accession XM_116974), a gene which regulates subcellular localization of type II cAMP-dependent PKA. Accordingly, utilities of VGAM1028 include diagnosis, prevention and treatment of diseases and clinical conditions associated with AKAP13. The function of AKAP13 and its association with various diseases and clinical conditions, has been established by previous studies, as described hereinabove with reference to VGAM17. DKFZP434N014 (Accession XM_027012) is another VGAM1028 host target gene. DKFZP434N014

BINDING SITE is HOST TARGET binding site found in the 3' untranslated region of mRNA encoded by DKFZP434N014, corresponding to a HOST TARGET binding site such as BINDING SITE I, BINDING SITE II or BINDING SITE III. Table 2 illustrates the complementarity of the nucleotide sequences of DKFZP434N014 BINDING SITE, designated SEQ ID:30388, to the nucleotide sequence of VGAM1028 RNA, herein designated VGAM RNA, also designated SEQ ID:3739.

Another function of VGAM1028 is therefore inhibition of DKFZP434N014 (Accession XM_027012). Accordingly, utilities of VGAM1028 include diagnosis, prevention and treatment of diseases and clinical conditions associated with DKFZP434N014. FLJ23598 (Accession NM_024783) is another VGAM1028 host target gene. FLJ23598 BINDING SITE is HOST TARGET binding site found in the 3' untranslated region of mRNA encoded by FLJ23598, corresponding to a HOST TARGET binding site such as BINDING SITE I, BINDING SITE II or BINDING SITE III. Table 2 illustrates the complementarity of the nucleotide sequences of FLJ23598 BINDING SITE, designated SEQ ID:24152, to the nucleotide sequence of VGAM1028 RNA, herein designated VGAM RNA, also designated SEQ ID:3739.

Another function of VGAM1028 is therefore inhibition of FLJ23598 (Accession NM_024783). Accordingly, utilities of VGAM1028 include diagnosis, prevention and treatment of diseases and clinical conditions associated with FLJ23598. LOC149086 (Accession XM_097580) is another VGAM1028 host target gene. LOC149086 BINDING SITE is HOST TARGET binding site found in the 3' untranslated region of mRNA encoded by LOC149086, corresponding to a HOST TARGET binding site such as BINDING SITE I, BINDING SITE II or BINDING SITE III. Table 2 illustrates the complementarity of the nucleotide sequences of LOC149086 BINDING SITE, designated SEQ ID:40945, to the nucleotide sequence of VGAM1028 RNA, herein designated VGAM RNA, also designated SEQ ID:3739.

Another function of VGAM1028 is therefore inhibition of LOC149086 (Accession XM_097580). Accordingly, utilities of VGAM1028 include diagnosis, prevention and treatment of diseases and clinical conditions associated with LOC149086. LOC92568 (Accession XM_045852) is another VGAM1028 host target gene. LOC92568 BINDING SITE is HOST TARGET binding site found in the 3' untranslated region of mRNA encoded by LOC92568, corresponding to a HOST TARGET binding site such as BINDING SITE I, BINDING SITE II or BINDING SITE III. Table 2 illustrates the complementarity of the nucleotide sequences of LOC92568 BINDING SITE, designated SEQ ID:34572, to the nucleotide sequence of VGAM1028 RNA, herein designated VGAM RNA, also designated SEQ ID:3739.

Another function of VGAM1028 is therefore inhibition of LOC92568 (Accession XM_045852). Accordingly, utilities of VGAM1028 include diagnosis, prevention and treatment of diseases and clinical conditions associated with LOC92568. FIG. 1 further provides a conceptual description of a novel bioinformatically detected viral gene of the present invention, referred to here as Viral Genomic Address Messenger 1029 (VGAM1029) viral gene, which modulates expression of respective host target genes thereof, the function and utility of which host target genes is known in the art.

VGAM1029 is a novel bioinformatically detected regulatory, non protein coding, viral micro RNA (miRNA) gene. The method by which VGAM1029 was detected is described hereinabove with reference to FIGS. 1-8.

VGAM1029 gene, herein designated VGAM GENE, is a viral gene contained in the genome of Barley Yellow Dwarf Virus - PAV. VGAM1029 host target gene, herein designated VGAM HOST TARGET GENE, is a human gene contained in the human genome.

VGAM1029 gene encodes a VGAM1029 precursor RNA, herein designated VGAM PRECURSOR RNA. Similar to other miRNA genes, and unlike most ordinary genes, VGAM1029 precursor RNA does not encode a protein. A nucleotide sequence identical or highly similar to the nucleotide sequence of VGAM1029 precursor RNA is designated SEQ ID:1015, and is provided hereinbelow with reference to the sequence listing part. Nucleotide sequence SEQ ID:1015 is located at position 1469 relative to the genome of Barley Yellow Dwarf Virus - PAV.

VGAM1029 precursor RNA folds onto itself, forming VGAM1029 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1029 folded precursor RNA into VGAM1029 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM1029 RNA is designated SEQ ID:3740, and is provided hereinbelow with reference to the sequence listing part.

VGAM1029 host target gene, herein designated VGAM HOST TARGET GENE, encodes a corresponding messenger RNA, VGAM1029 host target RNA, herein designated VGAM HOST TARGET RNA. VGAM1029 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1029 RNA, herein designated VGAM RNA, binds complementarily to one or more host target binding sites located in untranslated regions of VGAM1029 host target RNA, herein designated VGAM HOST TARGET RNA. This complementary binding is due to the fact that the nucleotide sequence of VGAM1029 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1029 RNA, herein designated VGAM RNA, may have a different number of host target binding sites in untranslated regions of a VGAM1029 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1029 RNA, herein designated VGAM RNA, to host target binding sites on VGAM1029 host target RNA, herein designated VGAM HOST TARGET RNA, such as BINDING SITE I, BINDING SITE II and BINDING SITE III, inhibits translation of VGAM1029 host target RNA into VGAM1029 host target protein, herein designated VGAM HOST TARGET PROTEIN. VGAM host target protein is therefore outlined by a broken line.

It is appreciated that VGAM1029 host target gene, herein designated VGAM HOST TARGET GENE, in fact represents a plurality of VGAM1029 host target genes. The mRNA of each one of this plurality of VGAM1029 host target genes comprises one or more host target binding sites, each having a nucleotide sequence which is at least partly complementary to VGAM1029 RNA, herein designated VGAM RNA, and which when bound by VGAM1029 RNA causes inhibition of translation of respective one or more VGAM1029 host target proteins.

It is further appreciated by one skilled in the art that the mode of translational inhibition illustrated by FIG. 1 with specific reference to translational inhibition exerted by VGAM1029 gene, herein designated VGAM GENE, on one or more VGAM1029 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1029 is inhibition of expression of host target genes, as part of a novel viral mechanism of attacking a host. Accordingly, utilities of VGAM1029 include diagnosis, prevention and treatment of viral infection by Barley Yellow Dwarf Virus - PAV. Specific functions, and accordingly utilities, of VGAM1029 correlate with, and may be deduced from, the identity of the host target genes which VGAM1029 binds and inhibits, and the function of these host target genes, as elaborated hereinbelow.

Nucleotide sequences of the VGAM1029 precursor RNA, herein designated VGAM PRECURSOR RNA, and of the 'diced' VGAM1029 RNA, herein designated VGAM RNA, and a schematic representation of the secondary folding of VGAM1029 folded precursor RNA, herein designated VGAM FOLDED PRECURSOR RNA, of VGAM1029 are further described hereinbelow with reference to Table 1.

Nucleotide sequences of host target binding sites, such as BINDING SITE-I, BINDING SITE-II and BINDING SITE-III of FIG. 1, found on VGAM1029 host target RNA, and schematic representation of the complementarity of each of these host target binding sites to VGAM1029 RNA, herein designated VGAM RNA, are described hereinbelow with reference to Table 2.

As mentioned hereinabove with reference to FIG. 1, a function of VGAM1029 gene, herein designated VGAM is inhibition of expression of VGAM1029 target genes. It is appreciated that specific functions, and accordingly utilities, of VGAM1029 correlate with, and may be deduced from, the identity of the target genes which VGAM1029 binds and inhibits, and the function of these target genes, as elaborated hereinbelow.

Glycine Receptor, Alpha 3 (GLRA3, Accession XM_011092) is a VGAM1029 host target gene. GLRA3 BINDING SITE is HOST TARGET binding site found in the 5' untranslated region of mRNA encoded by GLRA3, corresponding to a HOST TARGET binding site such as BINDING SITE I, BINDING SITE II or BINDING SITE III. Table 2 illustrates the complementarity of the nucleotide sequences of GLRA3 BINDING SITE, designated SEQ ID:30167, to the nucleotide sequence of VGAM1029 RNA, herein designated VGAM RNA, also designated SEQ ID:3740.

A function of VGAM1029 is therefore inhibition of Glycine Receptor, Alpha 3 (GLRA3, Accession XM_011092), a gene which increases the chloride conductance and thus produces hyperpolarization (inhibition of neuronal firing). Accordingly, utilities of VGAM1029 include diagnosis, prevention and treatment of diseases and clinical conditions associated with GLRA3. The function of GLRA3 and its association with various diseases and clinical conditions, has been established by previous studies, as described hereinabove with reference to VGAM602. ATP-binding Cassette, Sub-family A (ABC1), Member 9 (ABCA9, Accession NM_080283) is another VGAM1029 host target gene. ABCA9 BINDING SITE is HOST TARGET binding site found in the 3' untranslated region of mRNA encoded by ABCA9, corresponding to a HOST TARGET binding site such as BINDING SITE I, BINDING SITE II or BINDING SITE III. Table 2 illustrates the complementarity of the nucleotide sequences of ABCA9 BINDING SITE, designated SEQ ID:27827, to the nucleotide sequence of VGAM1029 RNA, herein designated VGAM RNA, also designated SEQ ID:3740.

Another function of VGAM1029 is therefore inhibition of ATP-binding Cassette, Sub-family A (ABC1), Member 9 (ABCA9, Accession NM_080283). Accordingly, utilities of VGAM1029 include diagnosis, prevention and treatment of diseases and clinical conditions associated with ABCA9. Histamine Receptor H3 (HRH3, Accession NM_007232) is another VGAM1029 host target gene. HRH3 BINDING SITE is HOST TARGET binding site found in the 3' untranslated region of mRNA encoded by HRH3, corresponding to a HOST TARGET binding site such as BINDING SITE I, BINDING SITE II or BINDING SITE III. Table 2 illustrates the complementarity of the nucleotide sequences of HRH3 BINDING SITE, designated SEQ ID:14109, to the nucleotide sequence of VGAM1029 RNA, herein designated VGAM RNA, also designated SEQ ID:3740.

Another function of VGAM1029 is therefore inhibition of Histamine Receptor H3 (HRH3, Accession NM_007232). Accordingly, utilities of VGAM1029 include diagnosis, prevention and treatment of diseases and clinical conditions associated with HRH3. KIAA0892 (Accession XM_048457) is another VGAM1029 host target gene. KIAA0892 BINDING SITE is HOST TARGET binding site found in the 3' untranslated region of mRNA encoded by KIAA0892, corresponding to a HOST TARGET binding site such as BINDING SITE I, BINDING SITE II or BINDING SITE III. Table 2 illustrates the complementarity of the nucleotide sequences of KIAA0892 BINDING SITE, designated SEQ ID:35168, to the nucleotide sequence of VGAM1029 RNA, herein designated VGAM RNA, also designated SEQ ID:3740.

Another function of VGAM1029 is therefore inhibition of KIAA0892 (Accession XM_048457). Accordingly, utilities of VGAM1029 include diagnosis, prevention and treatment of diseases and clinical conditions associated with KIAA0892. KIAA1546 (Accession XM_042301) is another VGAM1029 host target gene. KIAA1546 BINDING SITE is HOST TARGET binding site found in the 3' untranslated region of mRNA encoded by KIAA1546, corresponding to a HOST TARGET binding site such as BINDING SITE I, BINDING SITE II or BINDING SITE III. Table 2 illustrates the complementarity of the nucleotide sequences of KIAA1546 BINDING SITE, designated SEQ ID:33715, to the nucleotide sequence of VGAM1029 RNA, herein designated VGAM RNA, also designated SEQ ID:3740.

Another function of VGAM1029 is therefore inhibition of KIAA1546 (Accession XM_042301). Accordingly, utilities of VGAM1029 include diagnosis, prevention and treatment of diseases and clinical conditions associated with KIAA1546. LOC149832 (Accession XM_097733) is another VGAM1029 host target gene. LOC149832 BINDING SITE is HOST TARGET binding site found in the 5' untranslated region of mRNA encoded by LOC149832, corresponding to a HOST TARGET binding site such as BINDING SITE I, BINDING SITE II or BINDING SITE III. Table 2 illustrates the complementarity of the nucleotide sequences of LOC149832 BINDING SITE, designated SEQ ID:41079, to the nucleotide sequence of VGAM1029 RNA, herein designated VGAM RNA, also designated SEQ ID:3740.

Another function of VGAM1029 is therefore inhibition of LOC149832 (Accession XM_097733). Accordingly, utilities of VGAM1029 include diagnosis, prevention and treatment of diseases and clinical conditions associated with LOC149832. LOC152274 (Accession XM_087418) is another VGAM1029 host target gene. LOC152274 BINDING SITE is HOST TARGET binding site found in the 3' untranslated region of mRNA encoded by LOC152274, corresponding to a HOST TARGET binding site such as BINDING SITE I, BINDING SITE II or BINDING SITE III. Table 2 illustrates the complementarity of the nucleotide sequences of LOC152274 BINDING SITE, designated SEQ ID:39234, to the nucleotide sequence of VGAM1029 RNA, herein designated VGAM RNA, also designated SEQ ID:3740.

Another function of VGAM1029 is therefore inhibition of LOC152274 (Accession XM_087418). Accordingly, utilities of VGAM1029 include diagnosis, prevention and treatment of diseases and clinical conditions associated with LOC152274. LOC157247 (Accession XM_088275) is another VGAM1029 host target gene. LOC157247 BINDING SITE is HOST TARGET binding site found in the 5' untranslated region of mRNA encoded by LOC157247, corresponding to a HOST TARGET binding site such as BINDING SITE I, BINDING SITE II or BINDING SITE III. Table 2 illustrates the complementarity of the nucleotide sequences of LOC157247 BINDING SITE, designated SEQ ID:39571, to the nucleotide sequence of VGAM1029 RNA, herein designated VGAM RNA, also designated SEQ ID:3740.

Another function of VGAM1029 is therefore inhibition of LOC157247 (Accession XM_088275). Accordingly, utilities of VGAM1029 include diagnosis, prevention and treatment of diseases and clinical conditions associated with LOC157247. FIG. 1 further provides a conceptual description of a novel bioinformatically detected viral gene of the present invention, referred to here as Viral Genomic Address Messenger 1030 (VGAM1030) viral gene, which modulates expression of respective host target genes thereof, the function and utility of which host target genes is known in the art.

VGAM1030 is a novel bioinformatically detected regulatory, non protein coding, viral micro RNA (miRNA) gene. The method by which VGAM1030 was detected is described hereinabove with reference to FIGS. 1-8.

VGAM1030 gene, herein designated VGAM GENE, is a viral gene contained in the genome of Beet Mild Yellowing Virus. VGAM1030 host target gene, herein designated VGAM HOST TARGET GENE, is a human gene contained in the human genome.

VGAM1030 gene encodes a VGAM1030 precursor RNA, herein designated VGAM PRECURSOR RNA. Similar to other miRNA genes, and unlike most ordinary genes, VGAM1030 precursor RNA does not encode a protein. A nucleotide sequence identical or highly similar to the nucleotide sequence of VGAM1030 precursor RNA is designated SEQ ID:1016, and is provided hereinbelow with reference to the sequence listing part. Nucleotide sequence SEQ ID:1016 is located at position 3757 relative to the genome of Beet Mild Yellowing Virus.

VGAM1030 precursor RNA folds onto itself, forming VGAM1030 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1030 folded precursor RNA into VGAM1030 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1030 RNA is designated SEQ ID:3741, and is provided hereinbelow with reference to the sequence listing part.

VGAM1030 host target gene, herein designated VGAM HOST TARGET GENE, encodes a corresponding messenger RNA, VGAM1030 host target RNA, herein designated VGAM HOST TARGET RNA. VGAM1030 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1030 RNA, herein designated VGAM RNA, binds complementarily to one or more host target binding sites located in untranslated regions of VGAM1030 host target RNA, herein designated VGAM HOST TARGET RNA. This complementary binding is due to the fact that the nucleotide sequence of VGAM1030 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1030 RNA, herein designated VGAM RNA, may have a different number of host target binding sites in untranslated regions of a VGAM1030 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1030 RNA, herein designated VGAM RNA, to host target binding sites on VGAM1030 host target RNA, herein designated VGAM HOST TARGET RNA, such as BINDING SITE I, BINDING SITE II and BINDING SITE III, inhibits translation of VGAM1030 host target RNA into VGAM1030 host target protein, herein designated VGAM HOST TARGET PROTEIN. VGAM host target protein is therefore outlined by a broken line.

It is appreciated that VGAM1030 host target gene, herein designated VGAM HOST TARGET GENE, in fact represents a plurality of VGAM1030 host target genes. The mRNA of each one of this plurality of VGAM1030 host target genes comprises one or more host target binding sites, each having a nucleotide sequence which is at least partly complementary to VGAM1030 RNA, herein designated VGAM RNA, and which when bound by VGAM1030 RNA causes inhibition of translation of respective one or more VGAM1030 host target proteins.

It is further appreciated by one skilled in the art that the mode of translational inhibition illustrated by FIG. 1 with specific reference to translational inhibition exerted by VGAM1030 gene, herein designated VGAM GENE, on one or more VGAM1030 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1030 is inhibition of expression of host target genes, as part of a novel viral mechanism of attacking a host. Accordingly, utilities of VGAM1030 include diagnosis, prevention and treatment of viral infection by Beet Mild Yellowing Virus. Specific functions, and accordingly utilities, of VGAM1030 correlate with, and may be deduced from, the identity of the host target genes which VGAM1030 binds and inhibits, and the function of these host target genes, as elaborated hereinbelow.

Nucleotide sequences of the VGAM1030 precursor RNA, herein designated VGAM PRECURSOR RNA, and of the 'diced' VGAM1030 RNA, herein designated VGAM RNA, and a schematic representation of the secondary folding of VGAM1030 folded precursor RNA, herein designated VGAM FOLDED PRECURSOR RNA, of VGAM1030 are further described hereinbelow with reference to Table 1.

Nucleotide sequences of host target binding sites, such as BINDING SITE-I, BINDING SITE-II and BINDING SITE-III of FIG. 1, found on VGAM1030 host target RNA, and schematic representation of the complementarity of each of these host target binding sites to VGAM1030 RNA, herein designated VGAM RNA, are described hereinbelow with reference to Table 2.

As mentioned hereinabove with reference to FIG. 1, a function of VGAM1030 gene, herein designated VGAM is inhibition of expression of VGAM1030 target genes. It is appreciated that specific functions, and accordingly utilities, of VGAM1030 correlate with, and may be deduced from, the identity of the target genes which VGAM1030 binds and inhibits, and the function of these target genes, as elaborated hereinbelow.

Low Density Lipoprotein Receptor (familial hypercholesterolemia) (LDLR, Accession NM_000527) is a VGAM1030 host target gene. LDLR BINDING SITE is HOST TARGET binding site found in the 3' untranslated region of mRNA encoded by LDLR, corresponding to a HOST TARGET binding site such as BINDING SITE I, BINDING SITE II or BINDING SITE III. Table 2 illustrates the complementarity of the nucleotide sequences of LDLR BINDING SITE, designated SEQ ID:6125, to the nucleotide sequence of VGAM1030 RNA, herein designated VGAM RNA, also designated SEQ ID:3741.

A function of VGAM1030 is therefore inhibition of Low Density Lipoprotein Receptor (familial hypercholesterolemia) (LDLR, Accession NM_000527), a gene which also acts as a tumor suppressor. Accordingly, utilities of VGAM1030 include diagnosis, prevention and treatment of diseases and clinical conditions associated with LDLR. The function of LDLR has been established by previous studies. The low density lipoprotein receptor is a cell surface receptor that plays an important role in cholesterol homeostasis. The low density lipoprotein receptor is synthesized as a 120-kD glycoprotein precursor that undergoes change to a 160-kD mature glycoprotein through the covalent addition of a 40-kD protein (Tolleshaug et al., 1982). Yamamoto et al. (1984) reported that the human LDL receptor is an 839-amino acid protein rich in cysteine, with multiple copies of the Alu family of repetitive DNAs. Russell et al. (1984) demonstrated DNA sequence homology of the LDL receptor with the epidermal growth factor receptor (EGF; 131530). Francke et al. (1984) assigned the LDL receptor to chromosome 19 on the basis of expression studies in hamster-human somatic cell hybrids. The LDLR gene was regionalized to 19p13.1-p13.3 by in situ hybridization (Lindgren et al., 1985). Frank et al. (1989) identified RFLPs of the mouse LDL receptor gene and used them to map the gene, designated Ldlr, to the proximal region of chromosome 9. Using interspecific backcrosses, they established the order and interval distances for this and several other loci on mouse chromosome 9, namely, APOA4 (OMIM Ref. No. 107690), which is on chromosome 11 in man, and mannosephosphate isomerase (OMIM Ref. No. 154550), which is on chromosome 15 in man. In a patient with homozygous familial hypercholesterolemia (FH; 143890), Hobbs et al. (1986) described an LDL receptor mutant in which 1 of the 7 repeating units constituting the ligand binding domain had been deleted. The deletion arose by homologous recombination by repetitive Alu sequences in intron 4 and intron 5 of the gene. The deletion removed exon 5, which normally encodes the sixth repeat of the ligand binding domain. In the resultant mRNA, exon 4 was found to be spliced to exon 6, preserving the reading frame. The resulting shortened protein reaches the cell surface and reacts with antireceptor antibodies but does not bind LDL. It does, however, bind VLDL, a lipoprotein that contains apoprotein E as well as apoprotein B-100. The findings in this instructive case support the hypothesis that the 7 repeated sequences in the receptor constitute the LDL binding domain, that the sixth repeat is required for binding of LDL but not of VLDL, and that deletion of a single repeat can alter the binding specificity of the LDL receptor. Horsthemke et al. (1987) analyzed DNA from 70 patients in the UK with heterozygous familial hypercholesterolemia. In most, the restriction fragment pattern of the LDLR gene was indistinguishable from the normal; however, 3 patients were found to have a deletion of about 1 kb in the central portion of the gene. In 2 patients, the deletion included all or part of exon 5 (606945.0027); in the third, the deletion included exon 7 (606945.0033). Including a previously described patient with a deletion in the 3-prime part of the gene, these results indicated that 4 out of 70 patients, or 6%, have deletions. Langlois et al. (1988) screened 234 unrelated heterozygotes for FH to detect major rearrangements in the LDLR gene. Total genomic DNA was analyzed by Southern blot hybridization to probes encompassing exons 1 to 18 of the LDLR gene. Six different mutations were detected and characterized by use of exon-specific probes and detailed restriction mapping. The frequency of deletions in the Langlois et al. (1988) study was 2.5% (6 out of 234 patients). An illustration of previously mapped deletions and the deletions identified in this study (a total of 16) suggested that particular areas in the LDLR gene are susceptible to deletion. In a Japanese subject with homozygous hypercholesterolemia, Lehrman et al. (1987) found a 7.8-kb deletion in LDLR (606945.0029). The deletion joined intron 15 to the middle of exon 18, which encodes the 3-prime untranslated region, thereby removing all 3-prime splice acceptor sites distal to intron 15. The mRNA should produce a truncated receptor that lacks the normal membrane-COOH terminus. Rudiger et al. (1991) reviewed previously described deletions in the LDLR gene in cases of familial hypercholesterolemia and reported the finding of a deletion in 3 of 25 unrelated patients with FH. Defesche and Kastelein (1998) stated that more than 350 different mutations had been found in patients with familial hypercholesterolemia. They tabulated the preferential geographic distribution that has been demonstrated for some of the LDL receptor mutations. For example, in the West of Scotland about half of the index cases of FH were found to have the cys163-to-tyr mutation (606945.0058). Defesche and Kastelein (1998) commented on the geographic associations of LDL receptor mutations within the Netherlands.

Full details of the abovementioned studies are described in the following publications, the disclosure of which are hereby incorporated by reference:

Durst, R.; Colombo, R.; Shpitzen, S.; Ben Avi, L.; Friedlander, Y.; Wexler, R.; Raal, F. J.; Marais, D. A.; Defesche, J. C.; Mandelshtam, M. Y.; Kotze, M. J.; Leitersdorf, E.; Meiner, V.: Recent origin and spread of a common Lithuanian mutation, G197del LDLR, causing familial hypercholesterolemia: positive selection is not always necessary to account for disease incidence among Ashkenazi Jews. Am. J. Hum. Genet. 68:1172-1188, 2001; and Rudiger, N. S.; Heinsvig, E. M.; Hansen, F. A.; Faergeman, O.; Bolund, L.; Gregersen, N.: DNA deletions in the low density lipoprotein (LDL) receptor gene in Danish families with fami.

Further studies establishing the function and utilities of LDLR are found in John Hopkins OMIM database record ID 606945, and in sited publications numbered 732-733, 5368-5373, 3029, 5374, 3032-3034, 5376-3037, 5141-3040, 5142-5144, 3897-3898, 5145-5149, 3899-3900, 5150-5152, 104, 3901-3902, 5153-5158, 3903-3906, 5505-5507, 3907-3908, 5508-5514, 3924, 5515-5525, 3614, 5568, 6088, 6089-6090, 3927, 6091-6100, 4958, 6101-6102, 392 and 6103 listed in the bibliography section hereinbelow, which are also hereby incorporated by reference. Microtubule-associated Protein 1B (MAP1B, Accession NM_005909) is another VGAM1030 host target gene. MAP1B BINDING SITE is HOST TARGET binding site found in the 5' untranslated region of mRNA encoded by MAP1B, corresponding to a HOST TARGET binding site such as BINDING SITE I, BINDING SITE II or BINDING SITE III. Table 2 illustrates the complementarity of the nucleotide sequences of MAP1B BINDING SITE, designated SEQ ID:12532, to the nucleotide sequence of VGAM1030 RNA, herein designated VGAM RNA, also designated SEQ ID:3741.

Another function of VGAM1030 is therefore inhibition of Microtubule-associated Protein 1B (MAP1B, Accession NM_005909), a gene which may have a role in neuronal plasticity and brain development. Accordingly, utilities of VGAM1030 include diagnosis, prevention and treatment of diseases and clinical conditions associated with MAP1B. The function of MAP1B and its association with various diseases and clinical conditions, has been established by previous studies, as described hereinabove with reference to VGAM316. Arginyl Aminopeptidase (aminopeptidase B)-like 1 (RNPEPL1, Accession NM_018226) is another VGAM1030 host target gene. RNPEPL1 BINDING SITE is HOST TARGET binding site found in the 3' untranslated region of mRNA encoded by RNPEPL1, corresponding to a HOST TARGET binding site such as BINDING SITE I, BINDING SITE II or BINDING SITE III. Table 2 illustrates the complementarity of the nucleotide sequences of RNPEPL1 BINDING SITE, designated SEQ ID:20158, to the nucleotide sequence of VGAM1030 RNA, herein designated VGAM RNA, also designated SEQ ID:3741.

Another function of VGAM1030 is therefore inhibition of Arginyl Aminopeptidase (aminopeptidase B)-like 1 (RNPEPL1, Accession NM_018226). Accordingly, utilities of VGAM1030 include diagnosis, prevention and treatment of diseases and clinical conditions associated with RNPEPL1. Von Hippel-Lindau Syndrome (VHL, Accession NM_000551) is another VGAM1030 host target gene. VHL BINDING SITE is HOST TARGET binding site found in the 3' untranslated region of mRNA encoded by VHL, corresponding to a HOST TARGET binding site such as BINDING SITE I, BINDING SITE II or BINDING SITE III. Table 2 illustrates the complementarity of the nucleotide sequences of VHL BINDING SITE, designated SEQ ID:6158, to the nucleotide sequence of VGAM1030 RNA, herein designated VGAM RNA, also designated SEQ ID:3741.

Another function of VGAM1030 is therefore inhibition of Von Hippel-Lindau Syndrome (VHL, Accession NM_000551), a gene which may control rna stability through the selective degradation of rna-bound proteins. Accordingly, utilities of VGAM1030 include diagnosis, prevention and treatment of diseases and clinical conditions associated with VHL. The function of VHL and its association with various diseases and clinical conditions, has been established by previous studies, as described hereinabove with reference to VGAM197. FLJ00007 (Accession XM_048928) is another VGAM1030 host target gene. FLJ00007 BINDING SITE is HOST TARGET binding site found in the 3' untranslated region of mRNA encoded by FLJ00007, corresponding to a HOST TARGET binding site such as BINDING SITE I, BINDING SITE II or BINDING SITE III. Table 2 illustrates the complementarity of the nucleotide sequences of FLJ00007 BINDING SITE, designated SEQ ID:35305, to the nucleotide sequence of VGAM1030 RNA, herein designated VGAM RNA, also designated SEQ ID:3741.

Another function of VGAM1030 is therefore inhibition of FLJ00007 (Accession XM_048928). Accordingly, utilities of VGAM1030 include diagnosis, prevention and treatment of diseases and clinical conditions associated with FLJ00007. FLJ10298 (Accession NM_018050) is another VGAM1030 host target gene. FLJ10298 BINDING SITE is HOST TARGET binding site found in the 3' untranslated region of mRNA encoded by FLJ10298, corresponding to a HOST TARGET binding site such as BINDING SITE I, BINDING SITE II or BINDING SITE III. Table 2 illustrates the complementarity of the nucleotide sequences of FLJ10298 BINDING SITE, designated SEQ ID:19807, to the nucleotide sequence of VGAM1030 RNA, herein designated VGAM RNA, also designated SEQ ID:3741.

Another function of VGAM1030 is therefore inhibition of FLJ10298 (Accession NM_018050). Accordingly, utilities of VGAM1030 include diagnosis, prevention and treatment of diseases and clinical conditions associated with FLJ10298. PRO1048 (Accession NM_018497) is another VGAM1030 host target gene. PRO1048 BINDING SITE is HOST TARGET binding site found in the 3' untranslated region of mRNA encoded by PRO1048, corresponding to a HOST TARGET binding site such as BINDING SITE I, BINDING SITE II or BINDING SITE III. Table 2 illustrates the complementarity of the nucleotide sequences of PRO1048 BINDING SITE, designated SEQ ID:20556, to the nucleotide sequence of VGAM1030 RNA, herein designated VGAM RNA, also designated SEQ ID:3741.

Another function of VGAM1030 is therefore inhibition of PRO1048 (Accession NM_018497). Accordingly, utilities of VGAM1030 include diagnosis, prevention and treatment of diseases and clinical conditions associated with PRO1048. LOC144108 (Accession XM_084736) is another VGAM1030 host target gene. LOC144108 BINDING SITE is HOST TARGET binding site found in the 5' untranslated region of mRNA encoded by LOC144108, corresponding to a HOST TARGET binding site such as BINDING SITE I, BINDING SITE II or BINDING SITE III. Table 2 illustrates the complementarity of the nucleotide sequences of LOC144108 BINDING SITE, designated SEQ ID:37682, to the nucleotide sequence of VGAM1030 RNA, herein designated VGAM RNA, also designated SEQ ID:3741.

Another function of VGAM1030 is therefore inhibition of LOC144108 (Accession XM_084736). Accordingly, utilities of VGAM1030 include diagnosis, prevention and treatment of diseases and clinical conditions associated with LOC144108. LOC152441 (Accession XM_098230) is another VGAM1030 host target gene. LOC152441 BINDING SITE is HOST TARGET binding site found in the 3' untranslated region of mRNA encoded by LOC152441, corresponding to a HOST TARGET binding site such as BINDING SITE I, BINDING SITE II or BINDING SITE III. Table 2 illustrates the complementarity of the nucleotide sequences of LOC152441 BINDING SITE, designated SEQ ID:41504, to the nucleotide sequence of VGAM1030 RNA, herein designated VGAM RNA, also designated SEQ ID:3741.

Another function of VGAM1030 is therefore inhibition of LOC152441 (Accession XM_098230). Accordingly, utilities of VGAM1030 include diagnosis, prevention and treatment of diseases and clinical conditions associated with LOC152441. LOC153688 (Accession XM_098416) is another VGAM1030 host target gene. LOC153688 BINDING SITE is HOST TARGET binding site found in the 3' untranslated region of mRNA encoded by LOC153688, corresponding to a HOST TARGET binding site such as BINDING SITE I, BINDING SITE II or BINDING SITE III. Table 2 illustrates the complementarity of the nucleotide sequences of LOC153688 BINDING SITE, designated SEQ ID:41652, to the nucleotide sequence of VGAM1030 RNA, herein designated VGAM RNA, also designated SEQ ID:3741.

Another function of VGAM1030 is therefore inhibition of LOC153688 (Accession XM_098416). Accordingly, utilities of VGAM1030 include diagnosis, prevention and treatment of diseases and clinical conditions associated with LOC153688. FIG. 1 further provides a conceptual description of a novel bioinformatically detected viral gene of the present invention, referred to here as Viral Genomic Address Messenger 1031 (VGAM1031) viral gene, which modulates expression of respective host target genes thereof, the function and utility of which host target genes is known in the art.

VGAM1031 is a novel bioinformatically detected regulatory, non protein coding, viral micro RNA (miRNA) gene. The method by which VGAM1031 was detected is described hereinabove with reference to FIGS. 1-8.

VGAM1031 gene, herein designated VGAM GENE, is a viral gene contained in the genome of Beet Mild Yellowing Virus. VGAM1031 host target gene, herein designated VGAM HOST TARGET GENE, is a human gene contained in the human genome.

VGAM1031 gene encodes a VGAM1031 precursor RNA, herein designated VGAM PRECURSOR RNA. Similar to other miRNA genes, and unlike most ordinary genes, VGAM1031 precursor RNA does not encode a protein. A nucleotide sequence identical or highly similar to the nucleotide sequence of VGAM1031 precursor RNA is designated SEQ ID:1017, and is provided hereinbelow with reference to the sequence listing part. Nucleotide sequence SEQ ID:1017 is located at position 2997 relative to the genome of Beet Mild Yellowing Virus.

VGAM1031 precursor RNA folds onto itself, forming VGAM1031 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1031 folded precursor RNA into VGAM1031 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM1031 RNA is designated SEQ ID:3742, and is provided hereinbelow with reference to the sequence listing part.

VGAM1031 host target gene, herein designated VGAM HOST TARGET GENE, encodes a corresponding messenger RNA, VGAM1031 host target RNA, herein designated VGAM HOST TARGET RNA. VGAM1031 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1031 RNA, herein designated VGAM RNA, binds complementarily to one or more host target binding sites located in untranslated regions of VGAM1031 host target RNA, herein designated VGAM HOST TARGET RNA. This complementary binding is due to the fact that the nucleotide sequence of VGAM1031 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1031 RNA, herein designated VGAM RNA, may have a different number of host target binding sites in untranslated regions of a VGAM1031 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1031 RNA, herein designated VGAM RNA, to host target binding sites on VGAM1031 host target RNA, herein designated VGAM HOST TARGET RNA, such as BINDING SITE I, BINDING SITE II and BINDING SITE III, inhibits translation of VGAM1031 host target RNA into VGAM1031 host target protein, herein designated VGAM HOST TARGET PROTEIN. VGAM host target protein is therefore outlined by a broken line.

It is appreciated that VGAM1031 host target gene, herein designated VGAM HOST TARGET GENE, in fact represents a plurality of VGAM1031 host target genes. The mRNA of each one of this plurality of VGAM1031 host target genes comprises one or more host target binding sites, each having a nucleotide sequence which is at least partly complementary to VGAM1031 RNA, herein designated VGAM RNA, and which when bound by VGAM1031 RNA causes inhibition of translation of respective one or more VGAM1031 host target proteins.

It is further appreciated by one skilled in the art that the mode of translational inhibition illustrated by FIG. 1 with specific reference to translational inhibition exerted by VGAM1031 gene, herein designated VGAM GENE, on one or more VGAM1031 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1031 is inhibition of expression of host target genes, as part of a novel viral mechanism of attacking a host. Accordingly, utilities of VGAM1031 include diagnosis, prevention and treatment of viral infection by Beet Mild Yellowing Virus. Specific functions, and accordingly utilities, of VGAM1031 correlate with, and may be deduced from, the identity of the host target genes which VGAM1031 binds and inhibits, and the function of these host target genes, as elaborated hereinbelow.

Nucleotide sequences of the VGAM1031 precursor RNA, herein designated VGAM PRECURSOR RNA, and of the 'diced' VGAM1031 RNA, herein designated VGAM RNA, and a schematic representation of the secondary folding of VGAM1031 folded precursor RNA, herein designated VGAM FOLDED PRECURSOR RNA, of VGAM1031 are further described hereinbelow with reference to Table 1.

Nucleotide sequences of host target binding sites, such as BINDING SITE-I, BINDING SITE-II and BINDING SITE-III of FIG. 1, found on VGAM1031 host target RNA, and schematic representation of the complementarity of each of these host target binding sites to VGAM1031 RNA, herein designated VGAM RNA, are described hereinbelow with reference to Table 2.

As mentioned hereinabove with reference to FIG. 1, a function of VGAM1031 gene, herein designated VGAM is inhibition of expression of VGAM1031 target genes. It is appreciated that specific functions, and accordingly utilities, of VGAM1031 correlate with, and may be deduced from, the identity of the target genes which VGAM1031 binds and inhibits, and the function of these target genes, as elaborated hereinbelow.

TAR (HIV) RNA Binding Protein 2 (TARBP2, Accession NM_134323) is a VGAM1031 host target gene. TARBP2 BINDING SITE1 and TARBP2 BINDING SITE2 are HOST TARGET binding sites found in untranslated regions of mRNA encoded by TARBP2, corresponding to HOST TARGET binding sites such as BINDING SITE I, BINDING SITE II or BINDING SITE III. Table 2 illustrates the complementarity of the nucleotide sequences of TARBP2 BINDING SITE1 and TARBP2 BINDING SITE2, designated SEQ ID:28625 and SEQ ID:28627 respectively, to the nucleotide sequence of VGAM1031 RNA, herein designated VGAM RNA, also designated SEQ ID:3742.

A function of VGAM1031 is therefore inhibition of TAR (HIV) RNA Binding Protein 2 (TARBP2, Accession NM_134323), a gene which is involved in the regulation of HIV replication. Accordingly, utilities of VGAM1031 include diagnosis, prevention and treatment of diseases and clinical conditions associated with TARBP2. The function of TARBP2 and its association with various diseases and clinical conditions, has been established by previous studies, as described hereinabove with reference to VGAM95. EGF-like-domain, Multiple 4 (EGFL4, Accession XM_029883) is another VGAM1032 host target gene. EGFL4 BINDING SITE is HOST TARGET binding site found in the 5' untranslated region of mRNA encoded by EGFL4, corresponding to a HOST TARGET binding site such as BINDING SITE I, BINDING SITE II or BINDING SITE III. Table 2 illustrates the complementarity of the nucleotide sequences of EGFL4 BINDING SITE, designated SEQ ID:30966, to the nucleotide sequence of VGAM1032 RNA, herein designated VGAM RNA, also designated SEQ ID:3743.

Another function of VGAM1032 is therefore inhibition of EGF-like-domain, Multiple 4 (EGFL4, Accession XM_029883). Accordingly, utilities of VGAM1032 include diagnosis, prevention and treatment of diseases and clinical conditions associated with EGFL4. Galactosamine (N-acetyl)-6-sulfate Sulfatase (Morquio syndrome, mucopolysaccharidosis type IVA) (GALNS, Accession NM_000512) is another VGAM1032 host target gene. GALNS BINDING SITE1 and GALNS BINDING SITE2 are HOST TARGET binding sites found in untranslated regions of mRNA encoded by GALNS, corresponding to HOST TARGET binding sites such as BINDING SITE I, BINDING SITE II or BINDING SITE III. Table 2 illustrates the complementarity of the nucleotide sequences of GALNS BINDING SITE1 and GALNS BINDING SITE2, designated SEQ ID:6123 and SEQ ID:6122 respectively, to the nucleotide sequence of VGAM1032 RNA, herein designated VGAM RNA, also designated SEQ ID:3743.

Another function of VGAM1032 is therefore inhibition of Galactosamine (N-acetyl)-6-sulfate Sulfatase (Morquio syndrome, mucopolysaccharidosis type IVA) (GALNS, Accession NM_000512). Accordingly, utilities of VGAM1032 include diagnosis, prevention and treatment of diseases and clinical conditions associated with GALNS. Leukemia Inhibitory Factor (cholinergic differentiation factor) (LIF, Accession NM_002309) is another VGAM1032 host target gene. LIF BINDING SITE is HOST TARGET binding site found in the 3' untranslated region of mRNA encoded by LIF, corresponding to a HOST TARGET binding site such as BINDING SITE I, BINDING SITE II or BINDING SITE III. Table 2 illustrates the complementarity of the nucleotide sequences of LIF BINDING SITE, designated SEQ ID:8094, to the nucleotide sequence of VGAM1032 RNA, herein designated VGAM RNA, also designated SEQ ID:3743.

Another function of VGAM1032 is therefore inhibition of Leukemia Inhibitory Factor (cholinergic differentiation factor) (LIF, Accession NM_002309). Accordingly, utilities of VGAM1032 include diagnosis, prevention and treatment of diseases and clinical conditions associated with LIF. Methyl-CpG Binding Domain Protein 3 (MBD3, Accession NM_003926) is another VGAM1032 host target gene. MBD3 BINDING SITE is HOST TARGET binding site found in the 3' untranslated region of mRNA encoded by MBD3, corresponding to a HOST TARGET binding site such as BINDING SITE I, BINDING SITE II or BINDING SITE III. Table 2 illustrates the complementarity of the nucleotide sequences of MBD3 BINDING SITE, designated SEQ ID:10019, to the nucleotide sequence of VGAM1032 RNA, herein designated VGAM RNA, also designated SEQ ID:3743.

Another function of VGAM1032 is therefore inhibition of Methyl-CpG Binding Domain Protein 3 (MBD3, Accession NM_003926), a gene which are subunits of the NURD (nucleosome remodeling and histone deacetylase) complex. Accordingly, utilities of VGAM1032 include diagnosis, prevention and treatment of diseases and clinical conditions associated with MBD3. The function of MBD3 and its association with various diseases and clinical conditions, has been established by previous studies, as described hereinabove with reference to VGAM247. Prospero-related Homeobox 1 (PROX1, Accession NM_002763) is another VGAM1032 host target gene. PROX1 BINDING SITE is HOST TARGET binding site found in the 3' untranslated region of mRNA encoded by PROX1, corresponding to a HOST TARGET binding site such as BINDING SITE I, BINDING SITE II or BINDING SITE III. Table 2 illustrates the complementarity of the nucleotide sequences of PROX1 BINDING SITE, designated SEQ ID:8650, to the nucleotide sequence of VGAM1032 RNA, herein designated VGAM RNA, also designated SEQ ID:3743.

Another function of VGAM1032 is therefore inhibition of Prospero-related Homeobox 1 (PROX1, Accession NM_002763), a gene which may regulate gene expression and development of postmitotic undifferentiated young neurons. Accordingly, utilities of VGAM1032 include diagnosis, prevention and treatment of diseases and clinical conditions associated with PROX1. The function of PROX1 and its association with various diseases and clinical conditions, has been established by previous studies, as described hereinabove with reference to VGAM430. Transient Receptor Potential Cation Channel, Subfamily C, Member 6 (TRPC6, Accession NM_004621) is another VGAM1032 host target gene. TRPC6 BINDING SITE is HOST TARGET binding site found in the 5' untranslated region of mRNA encoded by TRPC6, corresponding to a HOST TARGET binding site such as BINDING SITE I, BINDING SITE II or BINDING SITE III. Table 2 illustrates the complementarity of the nucleotide sequences of TRPC6 BINDING SITE, designated SEQ ID:10973, to the nucleotide sequence of VGAM1032 RNA, herein designated VGAM RNA, also designated SEQ ID:3743.

Another function of VGAM1032 is therefore inhibition of Transient Receptor Potential Cation Channel, Subfamily C, Member 6 (TRPC6, Accession NM_004621), a gene which has calcium channel activity. Accordingly, utilities of VGAM1032 include diagnosis, prevention and treatment of diseases and clinical conditions associated with TRPC6. The function of TRPC6 and its association with various diseases and clinical conditions, has been established by previous studies, as described hereinabove with reference to VGAM25. Ubiquitin-conjugating Enzyme E2 Variant 1 (UBE2V1, Accession NM_003349) is another VGAM1032 host target gene. UBE2V1 BINDING SITE1 through UBE2V1 BINDING SITE3 are HOST TARGET binding sites found in untranslated regions of mRNA encoded by UBE2V1, corresponding to HOST TARGET binding sites such as BINDING SITE I, BINDING SITE II or BINDING SITE III. Table 2 illustrates the complementarity of the nucleotide sequences of UBE2V1 BINDING SITE1 through UBE2V1 BINDING SITE3, designated SEQ ID:9371, SEQ ID:22523 and SEQ ID:22770 respectively, to the nucleotide sequence of VGAM1032 RNA, herein designated VGAM RNA, also designated SEQ ID:3743.

Another function of VGAM1032 is therefore inhibition of Ubiquitin-conjugating Enzyme E2 Variant 1 (UBE2V1, Accession NM_003349), a gene which may play a role in signaling for DNA repair. Accordingly, utilities of VGAM1032 include diagnosis, prevention and treatment of diseases and clinical conditions associated with UBE2V1. The function of UBE2V1 and its association with various diseases and clinical conditions, has been established by previous studies, as described hereinabove with reference to VGAM155. YY1 Transcription Factor (YY1, Accession NM_003403) is another VGAM1032 host target gene. YY1 BINDING SITE is HOST TARGET binding site found in the 5' untranslated region of mRNA encoded by YY1, corresponding to a HOST TARGET binding site such as BINDING SITE I, BINDING SITE II or BINDING SITE III. Table 2 illustrates the complementarity of the nucleotide sequences of YY1 BINDING SITE, designated SEQ ID:9437, to the nucleotide sequence of VGAM1032 RNA, herein designated VGAM RNA, also designated SEQ ID:3743.

Another function of VGAM1032 is therefore inhibition of YY1 Transcription Factor (YY1, Accession NM_003403), a gene which is involved in transcriptional regulation and may play an important role in development and differentiation. Accordingly, utilities of VGAM1032 include diagnosis, prevention and treatment of diseases and clinical conditions associated with YY1. The function of YY1 has been established by previous studies. Functionally, YY1 is a versatile factor, being a negative regulator in some systems and a positive regulator in others. In some systems, the function of YY1 as an activator or a repressor is specified by the presence of other proteins. By site-directed mutagenesis and overexpression of YY1 in human fibroblasts, Yan et al. (2002) showed that YY1, as well as HRY (OMIM Ref. No. 139605), functions as a transcriptional activator of acid alpha-glucosidase (GAA; 232300). In previous studies, Yan et al. (2001) had found that YY1, binding to the same element of the GAA gene in hepatoma cells, acts as a GAA transcription silencer. Oei and Shi (2001) noted that physical interaction had been reported between YY1 and poly (ADP-ribose) polymerase (PARP; 173870). PARP is a nuclear enzyme that catalyzes the synthesis of ADP-ribose polymers from NAD+, a function related to DNA repair and transcription. Oei and Shi (2001) found that overexpression of YY1 in HeLa cells resulted in intracellular accumulation of poly (ADP-ribose) and acceleration of DNA repair following damage with genotoxic agents, suggesting a functional as well as physical interaction between the proteins.

Full details of the abovementioned studies are described in the following publications, the disclosure of which are hereby incorporated by reference:

Oei, S. L.; Shi, Y.: Transcription factor Yin Yang 1 stimulates poly (ADP-ribosyl)ation and DNA repair. Biochem. Biophys. Res. Commun. 284:450-454, 2001; and Yan, B.; Raben, N.; Plotz, P. H.: Hes-1, a known transcriptional repressor, acts as a transcriptional activator for the human acid alpha-glucosidase gene in human fibroblast cells. Bi.

Further studies establishing the function and utilities of YY1 are found in John Hopkins OMIM database record ID 600013, and in sited publications numbered 8350-8354, 3574-357 and 8355-8356 listed in the bibliography section hereinbelow, which are also hereby incorporated by reference. E46L (Accession NM_013236) is another VGAM1032 host target gene. E46L BINDING SITE1 and E46L BINDING SITE2 are HOST TARGET binding sites found in untranslated regions of mRNA encoded by E46L, corresponding to HOST TARGET binding sites such as BINDING SITE I, BINDING SITE II or BINDING SITE III. Table 2 illustrates the complementarity of the nucleotide sequences of E46L BINDING SITE1 and E46L BINDING SITE2, designated SEQ ID:14896 and SEQ ID:14897 respectively, to the nucleotide sequence of VGAM1032 RNA, herein designated VGAM RNA, also designated SEQ ID:3743.

Another function of VGAM1032 is therefore inhibition of E46L (Accession NM_013236). Accordingly, utilities of VGAM1032 include diagnosis, prevention and treatment of diseases and clinical conditions associated with E46L. FLJ14249 (Accession NM_106552) is another VGAM1032 host target gene. FLJ14249 BINDING SITE1 and FLJ14249 BINDING SITE2 are HOST TARGET binding sites found in untranslated regions of mRNA encoded by FLJ14249, corresponding to HOST TARGET binding sites such as BINDING SITE I, BINDING SITE II or BINDING SITE III. Table 2 illustrates the complementarity of the nucleotide sequences of FLJ14249 BINDING SITE1 and FLJ14249 BINDING SITE2, designated SEQ ID:28169 and SEQ ID:23986 respectively, to the nucleotide sequence of VGAM1032 RNA, herein designated VGAM RNA, also designated SEQ ID:3743.

Another function of VGAM1032 is therefore inhibition of FLJ14249 (Accession NM_106552). Accordingly, utilities of VGAM1032 include diagnosis, prevention and treatment of diseases and clinical conditions associated with FLJ14249. KIAA0939 (Accession XM_030524) is another VGAM1032 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31061, to the nucleotide sequence of VGAM1032 RNA, herein designated VGAM RNA, also designated SEQ ID:3743.

Another function of VGAM1032 is therefore inhibition of KIAA0939 (Accession XM_030524). Accordingly, utilities of VGAM1032 include diagnosis, prevention and treatment of diseases and clinical conditions associated with KIAA0939. MGC13170 (Accession NM_032712) is another VGAM1032 host target gene. MGC13170 BINDING SITE is HOST TARGET binding site found in the 5' untranslated region of mRNA encoded by MGC13170, corresponding to a HOST TARGET binding site such as BINDING SITE I, BINDING SITE II or BINDING SITE III. Table 2 illustrates the complementarity of the nucleotide sequences of MGC13170 BINDING SITE, designated SEQ ID:26431, to the nucleotide sequence of VGAM1032 RNA, herein designated VGAM RNA, also designated SEQ ID:3743.

Another function of VGAM1032 is therefore inhibition of MGC13170 (Accession NM_032712). Accordingly, utilities of VGAM1032 include diagnosis, prevention and treatment of diseases and clinical conditions associated with MGC13170. Sialyltransferase 8C (alpha2,3Galbeta1,4GlcNAcalpha 2,8-sialyl transferase) (SIAT8C, Accession NM_015879) is another VGAM1032 host target gene. SIAT8C BINDING SITE is HOST TARGET binding site found in the 5' untranslated region of mRNA encoded by SIAT8C, corresponding to a HOST TARGET binding site such as BINDING SITE I, BINDING SITE II or BINDING SITE III. Table 2 illustrates the complementarity of the nucleotide sequences of SIAT8C BINDING SITE, designated SEQ ID:18026, to the nucleotide sequence of VGAM1032 RNA, herein designated VGAM RNA, also designated SEQ ID:3743.

Another function of VGAM1032 is therefore inhibition of Sialyltransferase 8C (alpha2,3Galbeta1,4GlcNAcalpha 2,8-sialyl transferase) (SIAT8C, Accession NM_015879). Accordingly, utilities of VGAM1032 include diagnosis, prevention and treatment of diseases and clinical conditions associated with SIAT8C. Ubiquitin Specific Protease 24 (USP24, Accession XM_165973) is another VGAM1032 host target gene. USP24 BINDING SITE is HOST TARGET binding site found in the 3' untranslated region of mRNA encoded by USP24, corresponding to a HOST TARGET binding site such as BINDING SITE I, BINDING SITE II or BINDING SITE III. Table 2 illustrates the complementarity of the nucleotide sequences of USP24 BINDING SITE, designated SEQ ID:43816, to the nucleotide sequence of VGAM1032 RNA, herein designated VGAM RNA, also designated SEQ ID:3743.

Another function of VGAM1032 is therefore inhibition of Ubiquitin Specific Protease 24 (USP24, Accession XM_165973). Accordingly, utilities of VGAM1032 include diagnosis, prevention and treatment of diseases and clinical conditions associated with USP24. LOC115330 (Accession NM_138445) is another VGAM1032 host target gene. LOC115330 BINDING SITE is HOST TARGET binding site found in the 3' untranslated region of mRNA encoded by LOC115330, corresponding to a HOST TARGET binding site such as BINDING SITE I, BINDING SITE II or BINDING SITE III. Table 2 illustrates the complementarity of the nucleotide sequences of LOC115330 BINDING SITE, designated SEQ ID:28809, to the nucleotide sequence of VGAM1032 RNA, herein designated VGAM RNA, also designated SEQ ID:3743.

Another function of VGAM1032 is therefore inhibition of LOC115330 (Accession NM_138445). Accordingly, utilities of VGAM1032 include diagnosis, prevention and treatment of diseases and clinical conditions associated with LOC115330. LOC149650 (Accession XM_086623) is another VGAM1032 host target gene. LOC149650 BINDING SITE is HOST TARGET binding site found in the 3' untranslated region of mRNA encoded by LOC149650, corresponding to a HOST TARGET binding site such as BINDING SITE I, BINDING SITE II or BINDING SITE III. Table 2 illustrates the complementarity of the nucleotide sequences of LOC149650 BINDING SITE, designated SEQ ID:38792, to the nucleotide sequence of VGAM1032 RNA, herein designated VGAM RNA, also designated SEQ ID:3743.

Another function of VGAM1032 is therefore inhibition of LOC149650 (Accession XM_086623). Accordingly, utilities of VGAM1032 include diagnosis, prevention and treatment of diseases and clinical conditions associated with LOC149650. LOC158046 (Accession NM_145283) is another VGAM1032 host target gene. LOC158046 BINDING SITE is HOST TARGET binding site found in the 5' untranslated region of mRNA encoded by LOC158046, corresponding to a HOST TARGET binding site such as BINDING SITE I, BINDING SITE II or BINDING SITE III. Table 2 illustrates the complementarity of the nucleotide sequences of LOC158046 BINDING SITE, designated SEQ ID:29799, to the nucleotide sequence of VGAM1032 RNA, herein designated VGAM RNA, also designated SEQ ID:3743.

Another function of VGAM1032 is therefore inhibition of LOC158046 (Accession NM_145283). Accordingly, utilities of VGAM1032 include diagnosis, prevention and treatment of diseases and clinical conditions associated with LOC158046. LOC220565 (Accession XM_165417) is another VGAM1032 host target gene. LOC220565 BINDING SITE is HOST TARGET binding site found in the 5' untranslated region of mRNA encoded by LOC220565, corresponding to a HOST TARGET binding site such as BINDING SITE I, BINDING SITE II or BINDING SITE III. Table 2 illustrates the complementarity of the nucleotide sequences of LOC220565 BINDING SITE, designated SEQ ID:43633, to the nucleotide sequence of VGAM1032 RNA, herein designated VGAM RNA, also designated SEQ ID:3743.

Another function of VGAM1032 is therefore inhibition of LOC220565 (Accession XM_165417). Accordingly, utilities of VGAM1032 include diagnosis, prevention and treatment of diseases and clinical conditions associated with LOC220565. LOC222031 (Accession XM_168371) is another VGAM1032 host target gene. LOC222031 BINDING SITE is HOST TARGET binding site found in the 3' untranslated region of mRNA encoded by LOC222031, corresponding to a HOST TARGET binding site such as BINDING SITE I, BINDING SITE II or BINDING SITE III. Table 2 illustrates the complementarity of the nucleotide sequences of LOC222031 BINDING SITE, designated SEQ ID:45132, to the nucleotide sequence of VGAM1032 RNA, herein designated VGAM RNA, also designated SEQ ID:3743.

Another function of VGAM1032 is therefore inhibition of LOC222031 (Accession XM_168371). Accordingly, utilities of VGAM1032 include diagnosis, prevention and treatment of diseases and clinical conditions associated with LOC222031. LOC222962 (Accession XM_167291) is another VGAM1032 host target gene. LOC222962 BINDING SITE is HOST TARGET binding site found in the 3' untranslated region of mRNA encoded by LOC222962, corresponding to a HOST TARGET binding site such as BINDING SITE I, BINDING SITE II or BINDING SITE III. Table 2 illustrates the complementarity of the nucleotide sequences of LOC222962 BINDING SITE, designated SEQ ID:44627, to the nucleotide sequence of VGAM1032 RNA, herein designated VGAM RNA, also designated SEQ ID:3743.

Another function of VGAM1032 is therefore inhibition of LOC222962 (Accession XM_167291). Accordingly, utilities of VGAM1032 include diagnosis, prevention and treatment of diseases and clinical conditions associated with LOC222962. LOC256867 (Accession XM_170694) is another VGAM1032 host target gene. LOC256867 BINDING SITE is HOST TARGET binding site found in the 5' untranslated region of mRNA encoded by LOC256867, corresponding to a HOST TARGET binding site such as BINDING SITE I, BINDING SITE II or BINDING SITE III. Table 2 illustrates the complementarity of the nucleotide sequences of LOC256867 BINDING SITE, designated SEQ ID:45472, to the nucleotide sequence of VGAM1032 RNA, herein designated VGAM RNA, also designated SEQ ID:3743.

Another function of VGAM1032 is therefore inhibition of LOC256867 (Accession XM_170694). Accordingly, utilities of VGAM1032 include diagnosis, prevention and treatment of diseases and clinical conditions associated with LOC256867. LOC91923 (Accession XM_041526) is another VGAM1032 host target gene. LOC91923 BINDING SITE is HOST TARGET binding site found in the 5' untranslated region of mRNA encoded by LOC91923, corresponding to a HOST TARGET binding site such as BINDING SITE I, BINDING SITE II or BINDING SITE III. Table 2 illustrates the complementarity of the nucleotide sequences of LOC91923 BINDING SITE, designated SEQ ID:33544, to the nucleotide sequence of VGAM1032 RNA, herein designated VGAM RNA, also designated SEQ ID:3743.

Another function of VGAM1032 is therefore inhibition of LOC91923 (Accession XM_041526). Accordingly, utilities of VGAM1032 include diagnosis, prevention and treatment of diseases and clinical conditions associated with LOC91923. LOC92299 (Accession XM_044075) is another VGAM1032 host target gene. LOC92299 BINDING SITE is HOST TARGET binding site found in the 5' untranslated region of mRNA encoded by LOC92299, corresponding to a HOST TARGET binding site such as BINDING SITE I, BINDING SITE II or BINDING SITE III. Table 2 illustrates the complementarity of the nucleotide sequences of LOC92299 BINDING SITE, designated SEQ ID:34129, to the nucleotide sequence of VGAM1032 RNA, herein designated VGAM RNA, also designated SEQ ID:3743.

Another function of VGAM1032 is therefore inhibition of LOC92299 (Accession XM_044075). Accordingly, utilities of VGAM1032 include diagnosis, prevention and treatment of diseases and clinical conditions associated with LOC92299. FIG. 1 further provides a conceptual description of a novel bioinformatically detected viral gene of the present invention, referred to here as Viral Genomic Address Messenger 1033 (VGAM1033) viral gene, which modulates expression of respective host target genes thereof, the function and utility of which host target genes is known in the art.

VGAM1033 is a novel bioinformatically detected regulatory, non protein coding, viral micro RNA (miRNA) gene. The method by which VGAM1033 was detected is described hereinabove with reference to FIGS. 1-8.

VGAM1033 gene, herein designated VGAM GENE, is a viral gene contained in the genome of Cercopithecine Herpesvirus 7. VGAM1033 host target gene, herein designated VGAM HOST TARGET GENE, is a human gene contained in the human genome.

VGAM1033 gene encodes a VGAM1033 precursor RNA, herein designated VGAM PRECURSOR RNA. Similar to other miRNA genes, and unlike most ordinary genes, VGAM1033 precursor RNA does not encode a protein. A nucleotide sequence identical or highly similar to the nucleotide sequence of VGAM1033 precursor RNA is designated SEQ ID:1019, and is provided hereinbelow with reference to the sequence listing part. Nucleotide sequence SEQ ID:1019 is located at position 105205 relative to the genome of Cercopithecine Herpesvirus 7.

VGAM1033 precursor RNA folds onto itself, forming VGAM1033 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1033 folded precursor RNA into VGAM1033 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM1033 RNA is designated SEQ ID:3744, and is provided hereinbelow with reference to the sequence listing part.

VGAM1033 host target gene, herein designated VGAM HOST TARGET GENE, encodes a corresponding messenger RNA, VGAM1033 host target RNA, herein designated VGAM HOST TARGET RNA. VGAM1033 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1033 RNA, herein designated VGAM RNA, binds complementarily to one or more host target binding sites located in untranslated regions of VGAM1033 host target RNA, herein designated VGAM HOST TARGET RNA. This complementary binding is due to the fact that the nucleotide sequence of VGAM1033 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1033 RNA, herein designated VGAM RNA, may have a different number of host target binding sites in untranslated regions of a VGAM1033 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1033 RNA, herein designated VGAM RNA, to host target binding sites on VGAM1033 host target RNA, herein designated VGAM HOST TARGET RNA, such as BINDING SITE I, BINDING SITE II and BINDING SITE III, inhibits translation of VGAM1033 host target RNA into VGAM1033 host target protein, herein designated VGAM HOST TARGET PROTEIN. VGAM host target protein is therefore outlined by a broken line.

It is appreciated that VGAM1033 host target gene, herein designated VGAM HOST TARGET GENE, in fact represents a plurality of VGAM1033 host target genes. The mRNA of each one of this plurality of VGAM1033 host target genes comprises one or more host target binding sites, each having a nucleotide sequence which is at least partly complementary to VGAM1033 RNA, herein designated VGAM RNA, and which when bound by VGAM1033 RNA causes inhibition of translation of respective one or more VGAM1033 host target proteins.

It is further appreciated by one skilled in the art that the mode of translational inhibition illustrated by FIG. 1 with specific reference to translational inhibition exerted by VGAM1033 gene, herein designated VGAM GENE, on one or more VGAM1033 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1033 is inhibition of expression of host target genes, as part of a novel viral mechanism of attacking a host. Accordingly, utilities of VGAM1033 include diagnosis, prevention and treatment of viral infection by Cercopithecine Herpesvirus 7. Specific functions, and accordingly utilities, of VGAM1033 correlate with, and may be deduced from, the identity of the host target genes which VGAM1033 binds and inhibits, and the function of these host target genes, as elaborated hereinbelow.

Nucleotide sequences of the VGAM1033 precursor RNA, herein designated VGAM PRECURSOR RNA, and of the 'diced' VGAM1033 RNA, herein designated VGAM RNA, and a schematic representation of the secondary folding of VGAM1033 folded precursor RNA, herein designated VGAM FOLDED PRECURSOR RNA, of VGAM1033 are further described hereinbelow with reference to Table 1.

Nucleotide sequences of host target binding sites, such as BINDING SITE-I, BINDING SITE-II and BINDING SITE-III of FIG. 1, found on VGAM1033 host target RNA, and schematic representation of the complementarity of each of these host target binding sites to VGAM1033 RNA, herein designated VGAM RNA, are described hereinbelow with reference to Table 2.

As mentioned hereinabove with reference to FIG. 1, a function of VGAM1033 gene, herein designated VGAM is inhibition of expression of VGAM1033 target genes. It is appreciated that specific functions, and accordingly utilities, of VGAM1033 correlate with, and may be deduced from, the identity of the target genes which VGAM1033 binds and inhibits, and the function of these target genes, as elaborated hereinbelow.

BRF1 Homolog, Subunit of RNA Polymerase III Transcription Initiation Factor IIIB (S. cerevisiae) (BRF1, Accession NM_001519) is a VGAM1033 host target gene. BRF1 BINDING SITE is HOST TARGET binding site found in the 3' untranslated region of mRNA encoded by BRF1, corresponding to a HOST TARGET binding site such as BINDING SITE I, BINDING SITE II or BINDING SITE III. Table 2 illustrates the complementarity of the nucleotide sequences of BRF1 BINDING SITE, designated SEQ ID:7256, to the nucleotide sequence of VGAM1033 RNA, herein designated VGAM RNA, also designated SEQ ID:3744.

A function of VGAM1033 is therefore inhibition of BRF1 Homolog, Subunit of RNA Polymerase III Transcription Initiation Factor IIIB (S. cerevisiae) (BRF1, Accession NM_001519), a gene which is a general activator of RNA polymerase III. Accordingly, utilities of VGAM1033 include diagnosis, prevention and treatment of diseases and clinical conditions associated with BRF1. The function of BRF1 and its association with various diseases and clinical conditions, has been established by previous studies, as described hereinabove with reference to VGAM232. CD34 Antigen (CD34, Accession NM_001773) is another VGAM1033 host target gene. CD34 BINDING SITE is HOST TARGET binding site found in the 3' untranslated region of mRNA encoded by CD34, corresponding to a HOST TARGET binding site such as BINDING SITE I, BINDING SITE II or BINDING SITE III. Table 2 illustrates the complementarity of the nucleotide sequences of CD34 BINDING SITE, designated SEQ ID:7533, to the nucleotide sequence of VGAM1033 RNA, herein designated VGAM RNA, also designated SEQ ID:3744.

Another function of VGAM1033 is therefore inhibition of CD34 Antigen (CD34, Accession NM_001773), a gene which is a monomeric cell surface antigen that is selectively expressed on human hematopoietic progenitor cells. Accordingly, utilities of VGAM1033 include diagnosis, prevention and treatment of diseases and clinical conditions associated with CD34. The function of CD34 and its association with various diseases and clinical conditions, has been established by previous studies, as described hereinabove with reference to VGAM55. GRB2-associated Binding Protein 2 (GAB2, Accession NM_080491) is another VGAM1033 host target gene. GAB2 BINDING SITE1 and GAB2 BINDING SITE2 are HOST TARGET binding sites found in untranslated regions of mRNA encoded by GAB2, corresponding to HOST TARGET binding sites such as BINDING SITE I, BINDING SITE II or BINDING SITE III. Table 2 illustrates the complementarity of the nucleotide sequences of GAB2 BINDING SITE1 and GAB2 BINDING SITE2, designated SEQ ID:27844 and SEQ ID:14648 respectively, to the nucleotide sequence of VGAM1033 RNA, herein designated VGAM RNA, also designated SEQ ID:3744.

Another function of VGAM1033 is therefore inhibition of GRB2-associated Binding Protein 2 (GAB2, Accession NM_080491), a gene which act as adapters for transmitting various signals. Accordingly, utilities of VGAM1033 include diagnosis, prevention and treatment of diseases and clinical conditions associated with GAB2. The function of GAB2 and its association with various diseases and clinical conditions, has been established by previous studies, as described hereinabove with reference to VGAM53. Megalencephalic Leukoencephalopathy with Subcortical Cysts 1 (MLC1, Accession NM_139202) is another VGAM1033 host target gene. MLC1 BINDING SITE1 and MLC1 BINDING SITE2 are HOST TARGET binding sites found in untranslated regions of mRNA encoded by MLC1, corresponding to HOST TARGET binding sites such as BINDING SITE I, BINDING SITE II or BINDING SITE III. Table 2 illustrates the complementarity of the nucleotide sequences of MLC1 BINDING SITE1 and MLC1 BINDING SITE2, designated SEQ ID:29215 and SEQ ID:10311 respectively, to the nucleotide sequence of VGAM1033 RNA, herein designated VGAM RNA, also designated SEQ ID:3744.

Another function of VGAM1033 is therefore inhibition of Megalencephalic Leukoencephalopathy with Subcortical Cysts 1 (MLC1, Accession NM_139202). Accordingly, utilities of VGAM1033 include diagnosis, prevention and treatment of diseases and clinical conditions associated with MLC1. DKFZP434B195 (Accession NM_031284) is another VGAM1033 host target gene. DKFZP434B195 BINDING SITE is HOST TARGET binding site found in the 5' untranslated region of mRNA encoded by DKFZP434B195, corresponding to a HOST TARGET binding site such as BINDING SITE I, BINDING SITE II or BINDING SITE III. Table 2 illustrates the complementarity of the nucleotide sequences of DKFZP434B195 BINDING SITE, designated SEQ ID:25309, to the nucleotide sequence of VGAM1033 RNA, herein designated VGAM RNA, also designated SEQ ID:3744.

Another function of VGAM1033 is therefore inhibition of DKFZP434B195 (Accession NM_031284). Accordingly, utilities of VGAM1033 include diagnosis, prevention and treatment of diseases and clinical conditions associated with DKFZP434B195. FLJ20195 (Accession NM_017706) is another VGAM1033 host target gene. FLJ20195 BINDING SITE is HOST TARGET binding site found in the 3' untranslated region of mRNA encoded by FLJ20195, corresponding to a HOST TARGET binding site such as BINDING SITE I, BINDING SITE II or BINDING SITE III. Table 2 illustrates the complementarity of the nucleotide sequences of FLJ20195 BINDING SITE, designated SEQ ID:19281, to the nucleotide sequence of VGAM1033 RNA, herein designated VGAM RNA, also designated SEQ ID:3744.

Another function of VGAM1033 is therefore inhibition of FLJ20195 (Accession NM_017706). Accordingly, utilities of VGAM1033 include diagnosis, prevention and treatment of diseases and clinical conditions associated with FLJ20195. Interleukin 18 Binding Protein (IL18BP, Accession NM_005699) is another VGAM1033 host target gene. IL18BP BINDING SITE is HOST TARGET binding site found in the 3' untranslated region of mRNA encoded by IL18BP, corresponding to a HOST TARGET binding site such as BINDING SITE I, BINDING SITE II or BINDING SITE III. Table 2 illustrates the complementarity of the nucleotide sequences of IL18BP BINDING SITE, designated SEQ ID:12252, to the nucleotide sequence of VGAM1033 RNA, herein designated VGAM RNA, also designated SEQ ID:3744.

Another function of VGAM1033 is therefore inhibition of Interleukin 18 Binding Protein (IL18BP, Accession NM_005699). Accordingly, utilities of VGAM1033 include diagnosis, prevention and treatment of diseases and clinical conditions associated with IL18BP. KIAA1196 (Accession XM_028968) is another VGAM1033 host target gene. KIAA1196 BINDING SITE is HOST TARGET binding site found in the 3' untranslated region of mRNA encoded by KIAA1196, corresponding to a HOST TARGET binding site such as BINDING SITE I, BINDING SITE II or BINDING SITE III. Table 2 illustrates the complementarity of the nucleotide sequences of KIAA1196 BINDING SITE, designated SEQ ID:30820, to the nucleotide sequence of VGAM1033 RNA, herein designated VGAM RNA, also designated SEQ ID:3744.

Another function of VGAM1033 is therefore inhibition of KIAA1196 (Accession XM_028968). Accordingly, utilities of VGAM1033 include diagnosis, prevention and treatment of diseases and clinical conditions associated with KIAA1196. RASD Family, Member 2 (RASD2, Accession NM_014310) is another VGAM1033 host target gene. RASD2 BINDING SITE is HOST TARGET binding site found in the 3' untranslated region of mRNA encoded by RASD2, corresponding to a HOST TARGET binding site such as BINDING SITE I, BINDING SITE II or BINDING SITE III. Table 2 illustrates the complementarity of the nucleotide sequences of RASD2 BINDING SITE, designated SEQ ID:15605, to the nucleotide sequence of VGAM1033 RNA, herein designated VGAM RNA, also designated SEQ ID:3744.

Another function of VGAM1033 is therefore inhibition of RASD Family, Member 2 (RASD2, Accession NM_014310). Accordingly, utilities of VGAM1033 include diagnosis, prevention and treatment of diseases and clinical conditions associated with RASD2. SCAMP5 (Accession NM_138967) is another VGAM1033 host target gene. SCAMP5 BINDING SITE is HOST TARGET binding site found in the 3' untranslated region of mRNA encoded by SCAMP5, corresponding to a HOST TARGET binding site such as BINDING SITE I, BINDING SITE II or BINDING SITE III. Table 2 illustrates the complementarity of the nucleotide sequences of SCAMP5 BINDING SITE, designated SEQ ID:29072, to the nucleotide sequence of VGAM1033 RNA, herein designated VGAM RNA, also designated SEQ ID:3744.

Another function of VGAM1033 is therefore inhibition of SCAMP5 (Accession NM_138967). Accordingly, utilities of VGAM1033 include diagnosis, prevention and treatment of diseases and clinical conditions associated with SCAMP5. Sialyltransferase 8D (alpha-2, 8-polysialytransferase) (SIAT8D, Accession NM_005668) is another VGAM1033 host target gene. SIAT8D BINDING SITE is HOST TARGET binding site found in the 5' untranslated region of mRNA encoded by SIAT8D, corresponding to a HOST TARGET binding site such as BINDING SITE I, BINDING SITE II or BINDING SITE III. Table 2 illustrates the complementarity of the nucleotide sequences of SIAT8D BINDING SITE, designated SEQ ID:12223, to the nucleotide sequence of VGAM1033 RNA, herein designated VGAM RNA, also designated SEQ ID:3744.

Another function of VGAM1033 is therefore inhibition of Sialyltransferase 8D (alpha-2, 8-polysialytransferase) (SIAT8D, Accession NM_005668). Accordingly, utilities of VGAM1033 include diagnosis, prevention and treatment of diseases and clinical conditions associated with SIAT8D. TRIP-Br2 (Accession NM_014755) is another VGAM1033 host target gene. TRIP-Br2 BINDING SITE is HOST TARGET binding site found in the 5' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16492, to the nucleotide sequence of VGAM1033 RNA, herein designated VGAM RNA, also designated SEQ ID:3744.

Another function of VGAM1033 is therefore inhibition of TRIP-Br2 (Accession NM_014755). Accordingly, utilities of VGAM1033 include diagnosis, prevention and treatment of diseases and clinical conditions associated with TRIP-Br2. LOC123242 (Accession XM_063548) is another VGAM1033 host target gene. LOC123242 BINDING SITE is HOST TARGET binding site found in the 5' untranslated region of mRNA encoded by LOC123242, corresponding to a HOST TARGET binding site such as BINDING SITE I, BINDING SITE II or BINDING SITE III. Table 2 illustrates the complementarity of the nucleotide sequences of LOC123242 BINDING SITE, designated SEQ ID:37241, to the nucleotide sequence of VGAM1033 RNA, herein designated VGAM RNA, also designated SEQ ID:3744.

Another function of VGAM1033 is therefore inhibition of LOC123242 (Accession XM_063548). Accordingly, utilities of VGAM1033 include diagnosis, prevention and treatment of diseases and clinical conditions associated with LOC123242. LOC124245 (Accession NM_144604) is another VGAM1033 host target gene. LOC124245 BINDING SITE is HOST TARGET binding site found in the 3' untranslated region of mRNA encoded by LOC124245, corresponding to a HOST TARGET binding site such as BINDING SITE I, BINDING SITE II or BINDING SITE III. Table 2 illustrates the complementarity of the nucleotide sequences of LOC124245 BINDING SITE, designated SEQ ID:29419, to the nucleotide sequence of VGAM1033 RNA, herein designated VGAM RNA, also designated SEQ ID:3744.

Another function of VGAM1033 is therefore inhibition of LOC124245 (Accession NM_144604). Accordingly, utilities of VGAM1033 include diagnosis, prevention and treatment of diseases and clinical conditions associated with LOC124245. LOC129303 (Accession XM_059343) is another VGAM1033 host target gene. LOC129303 BINDING SITE is HOST TARGET binding site found in the 5' untranslated region of mRNA encoded by LOC129303, corresponding to a HOST TARGET binding site such as BINDING SITE I, BINDING SITE II or BINDING SITE III. Table 2 illustrates the complementarity of the nucleotide sequences of LOC129303 BINDING SITE, designated SEQ ID:36970, to the nucleotide sequence of VGAM1033 RNA, herein designated VGAM RNA, also designated SEQ ID:3744.

Another function of VGAM1033 is therefore inhibition of LOC129303 (Accession XM_059343). Accordingly, utilities of VGAM1033 include diagnosis, prevention and treatment of diseases and clinical conditions associated with LOC129303. LOC130497 (Accession XM_059439) is another VGAM1033 host target gene. LOC130497 BINDING SITE is HOST TARGET binding site found in the 3' untranslated region of mRNA encoded by LOC130497, corresponding to a HOST TARGET binding site such as BINDING SITE I, BINDING SITE II or BINDING SITE III. Table 2 illustrates the complementarity of the nucleotide sequences of LOC130497 BINDING SITE, designated SEQ ID:36993, to the nucleotide sequence of VGAM1033 RNA, herein designated VGAM RNA, also designated SEQ ID:3744.

Another function of VGAM1033 is therefore inhibition of LOC130497 (Accession XM_059439). Accordingly, utilities of VGAM1033 include diagnosis, prevention and treatment of diseases and clinical conditions associated with LOC130497. LOC150319 (Accession XM_086816) is another VGAM1033 host target gene. LOC150319 BINDING SITE is HOST TARGET binding site found in the 3' untranslated region of mRNA encoded by LOC150319, corresponding to a HOST TARGET binding site such as BINDING SITE I, BINDING SITE II or BINDING SITE III. Table 2 illustrates the complementarity of the nucleotide sequences of LOC150319 BINDING SITE, designated SEQ ID:38891, to the nucleotide sequence of VGAM1033 RNA, herein designated VGAM RNA, also designated SEQ ID:3744.

Another function of VGAM1033 is therefore inhibition of LOC150319 (Accession XM_086816). Accordingly, utilities of VGAM1033 include diagnosis, prevention and treatment of diseases and clinical conditions associated with LOC150319. LOC222962 (Accession XM_167291) is another VGAM1033 host target gene. LOC222962 BINDING SITE is HOST TARGET binding site found in the 3' untranslated region of mRNA encoded by LOC222962, corresponding to a HOST TARGET binding site such as BINDING SITE I, BINDING SITE II or BINDING SITE III. Table 2 illustrates the complementarity of the nucleotide sequences of LOC222962 BINDING SITE, designated SEQ ID:44628, to the nucleotide sequence of VGAM1033 RNA, herein designated VGAM RNA, also designated SEQ ID:3744.

Another function of VGAM1033 is therefore inhibition of LOC222962 (Accession XM_167291). Accordingly, utilities of VGAM1033 include diagnosis, prevention and treatment of diseases and clinical conditions associated with LOC222962. FIG. 1 further provides a conceptual description of a novel bioinformatically detected viral gene of the present invention, referred to here as Viral Genomic Address Messenger 1034 (VGAM1034) viral gene, which modulates expression of respective host target genes thereof, the function and utility of which host target genes is known in the art.

VGAM1034 is a novel bioinformatically detected regulatory, non protein coding, viral micro RNA (miRNA) gene. The method by which VGAM1034 was detected is described hereinabove with reference to FIGS. 1-8.

VGAM1034 gene, herein designated VGAM GENE, is a viral gene contained in the genome of Cercopithecine Herpesvirus 7. VGAM1034 host target gene, herein designated VGAM HOST TARGET GENE, is a human gene contained in the human genome.

VGAM1034 gene encodes a VGAM1034 precursor RNA, herein designated VGAM PRECURSOR RNA. Similar to other miRNA genes, and unlike most ordinary genes, VGAM1034 precursor RNA does not encode a protein. A nucleotide sequence identical or highly similar to the nucleotide sequence of VGAM1034 precursor RNA is designated SEQ ID:1020, and is provided hereinbelow with reference to the sequence listing part. Nucleotide sequence SEQ ID:1020 is located at position 108515 relative to the genome of Cercopithecine Herpesvirus 7.

VGAM1034 precursor RNA folds onto itself, forming VGAM1034 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1034 folded precursor RNA into VGAM1034 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1034 RNA is designated SEQ ID:3745, and is provided hereinbelow with reference to the sequence listing part.

VGAM1034 host target gene, herein designated VGAM HOST TARGET GENE, encodes a corresponding messenger RNA, VGAM1034 host target RNA, herein designated VGAM HOST TARGET RNA. VGAM1034 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1034 RNA, herein designated VGAM RNA, binds complementarily to one or more host target binding sites located in untranslated regions of VGAM1034 host target RNA, herein designated VGAM HOST TARGET RNA. This complementary binding is due to the fact that the nucleotide sequence of VGAM1034 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1034 RNA, herein designated VGAM RNA, may have a different number of host target binding sites in untranslated regions of a VGAM1034 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1034 RNA, herein designated VGAM RNA, to host target binding sites on VGAM1034 host target RNA, herein designated VGAM HOST TARGET RNA, such as BINDING SITE I, BINDING SITE II and BINDING SITE III, inhibits translation of VGAM1034 host target RNA into VGAM1034 host target protein, herein designated VGAM HOST TARGET PROTEIN. VGAM host target protein is therefore outlined by a broken line.

It is appreciated that VGAM1034 host target gene, herein designated VGAM HOST TARGET GENE, in fact represents a plurality of VGAM1034 host target genes. The mRNA of each one of this plurality of VGAM1034 host target genes comprises one or more host target binding sites, each having a nucleotide sequence which is at least partly complementary to VGAM1034 RNA, herein designated VGAM RNA, and which when bound by VGAM1034 RNA causes inhibition of translation of respective one or more VGAM1034 host target proteins.

It is further appreciated by one skilled in the art that the mode of translational inhibition illustrated by FIG. 1 with specific reference to translational inhibition exerted by VGAM1034 gene, herein designated VGAM GENE, on one or more VGAM1034 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1034 is inhibition of expression of host target genes, as part of a novel viral mechanism of attacking a host. Accordingly, utilities of VGAM1034 include diagnosis, prevention and treatment of viral infection by Cercopithecine Herpesvirus 7. Specific functions, and accordingly utilities, of VGAM1034 correlate with, and may be deduced from, the identity of the host target genes which VGAM1034 binds and inhibits, and the function of these host target genes, as elaborated hereinbelow.

Nucleotide sequences of the VGAM1034 precursor RNA, herein designated VGAM PRECURSOR RNA, and of the 'diced' VGAM1034 RNA, herein designated VGAM RNA, and a schematic representation of the secondary folding of VGAM1034 folded precursor RNA, herein designated VGAM FOLDED PRECURSOR RNA, of VGAM1034 are further described hereinbelow with reference to Table 1.

Nucleotide sequences of host target binding sites, such as BINDING SITE-I, BINDING SITE-II and BINDING SITE-III of FIG. 1, found on VGAM1034 host target RNA, and schematic representation of the complementarity of each of these host target binding sites to VGAM1034 RNA, herein designated VGAM RNA, are described hereinbelow with reference to Table 2.

As mentioned hereinabove with reference to FIG. 1, a function of VGAM1034 gene, herein designated VGAM is inhibition of expression of VGAM1034 target genes. It is appreciated that specific functions, and accordingly utilities, of VGAM1034 correlate with, and may be deduced from, the identity of the target genes which VGAM1034 binds and inhibits, and the function of these target genes, as elaborated hereinbelow.

Protocadherin Alpha 1 (PCDHA1, Accession NM_031411) is a VGAM1034 host target gene. PCDHA1 BINDING SITE1 and PCDHA1 BINDING SITE2 are HOST TARGET binding sites found in untranslated regions of mRNA encoded by PCDHA1, corresponding to HOST TARGET binding sites such as BINDING SITE I, BINDING SITE II or BINDING SITE III. Table 2 illustrates the complementarity of the nucleotide sequences of PCDHA1 BINDING SITE1 and PCDHA1 BINDING SITE2, designated SEQ ID:25383 and SEQ ID:20864 respectively, to the nucleotide sequence of VGAM1034 RNA, herein designated VGAM RNA, also designated SEQ ID:3745.

A function of VGAM1034 is therefore inhibition of Protocadherin Alpha 1 (PCDHA1, Accession NM_031411). Accordingly, utilities of VGAM1034 include diagnosis, prevention and treatment of diseases and clinical conditions associated with PCDHA1. Protocadherin Alpha 10 (PCDHA10, Accession NM_018901) is another VGAM1034 host target gene. PCDHA10 BINDING SITE1 and PCDHA10 BINDING SITE2 are HOST TARGET binding sites found in untranslated regions of mRNA encoded by PCDHA10, corresponding to HOST TARGET binding sites such as BINDING SITE I, BINDING SITE II or BINDING SITE III. Table 2 illustrates the complementarity of the nucleotide sequences of PCDHA10 BINDING SITE1 and PCDHA10 BINDING SITE2, designated SEQ ID:20874 and SEQ ID:20884 respectively, to the nucleotide sequence of VGAM1034 RNA, herein designated VGAM RNA, also designated SEQ ID:3745.

Another function of VGAM1034 is therefore inhibition of Protocadherin Alpha 10 (PCDHA10, Accession NM_018901). Accordingly, utilities of VGAM1034 include diagnosis, prevention and treatment of diseases and clinical conditions associated with PCDHA10. Protocadherin Alpha 13 (PCDHA13, Accession NM_018904) is another VGAM1034 host target gene. PCDHA13 BINDING SITE is HOST TARGET binding site found in the 3' untranslated region of mRNA encoded by PCDHA13, corresponding to a HOST TARGET binding site such as BINDING SITE I, BINDING SITE II or BINDING SITE III. Table 2 illustrates the complementarity of the nucleotide sequences of PCDHA13 BINDING SITE, designated SEQ ID:20905, to the nucleotide sequence of VGAM1034 RNA, herein designated VGAM RNA, also designated SEQ ID:3745.

Another function of VGAM1034 is therefore inhibition of Protocadherin Alpha 13 (PCDHA13, Accession NM_018904). Accordingly, utilities of VGAM1034 include diagnosis, prevention and treatment of diseases and clinical conditions associated with PCDHA13. Protocadherin Alpha 2 (PCDHA2, Accession NM_018905) is another VGAM1034 host target gene. PCDHA2 BINDING SITE is HOST TARGET binding site found in the 3' untranslated region of mRNA encoded by PCDHA2, corresponding to a HOST TARGET binding site such as BINDING SITE I, BINDING SITE II or BINDING SITE III. Table 2 illustrates the complementarity of the nucleotide sequences of PCDHA2 BINDING SITE, designated SEQ ID:20915, to the nucleotide sequence of VGAM1034 RNA, herein designated VGAM RNA, also designated SEQ ID:3745.

Another function of VGAM1034 is therefore inhibition of Protocadherin Alpha 2 (PCDHA2, Accession NM_018905). Accordingly, utilities of VGAM1034 include diagnosis, prevention and treatment of diseases and clinical conditions associated with PCDHA2. Protocadherin Alpha 3 (PCDHA3, Accession NM_018906) is another VGAM1034 host target gene. PCDHA3 BINDING SITE is HOST TARGET binding site found in the 3' untranslated region of mRNA encoded by PCDHA3, corresponding to a HOST TARGET binding site such as BINDING SITE I, BINDING SITE II or BINDING SITE III. Table 2 illustrates the complementarity of the nucleotide sequences of PCDHA3 BINDING SITE, designated SEQ ID:20925, to the nucleotide sequence of VGAM1034 RNA, herein designated VGAM RNA, also designated SEQ ID:3745.

Another function of VGAM1034 is therefore inhibition of Protocadherin Alpha 3 (PCDHA3, Accession NM_018906). Accordingly, utilities of VGAM1034 include diagnosis, prevention and treatment of diseases and clinical conditions associated with PCDHA3. Protocadherin Alpha 4 (PCDHA4, Accession NM_018907) is another VGAM1034 host target gene. PCDHA4 BINDING SITE is HOST TARGET binding site found in the 3' untranslated region of mRNA encoded by PCDHA4, corresponding to a HOST TARGET binding site such as BINDING SITE I, BINDING SITE II or BINDING SITE III. Table 2 illustrates the complementarity of the nucleotide sequences of PCDHA4 BINDING SITE, designated SEQ ID:20935, to the nucleotide sequence of VGAM1034 RNA, herein designated VGAM RNA, also designated SEQ ID:3745.

Another function of VGAM1034 is therefore inhibition of Protocadherin Alpha 4 (PCDHA4, Accession NM_018907). Accordingly, utilities of VGAM1034 include diagnosis, prevention and treatment of diseases and clinical conditions associated with PCDHA4. Protocadherin Alpha 5 (PCDHA5, Accession NM_018908) is another VGAM1034 host target gene. PCDHA5 BINDING SITE is HOST TARGET binding site found in the 3' untranslated region of mRNA encoded by PCDHA5, corresponding to a HOST TARGET binding site such as BINDING SITE I, BINDING SITE II or BINDING SITE III. Table 2 illustrates the complementarity of the nucleotide sequences of PCDHA5 BINDING SITE, designated SEQ ID:20945, to the nucleotide sequence of VGAM1034 RNA, herein designated VGAM RNA, also designated SEQ ID:3745.

Another function of VGAM1034 is therefore inhibition of Protocadherin Alpha 5 (PCDHA5, Accession NM_018908). Accordingly, utilities of VGAM1034 include diagnosis, prevention and treatment of diseases and clinical conditions associated with PCDHA5. Protocadherin Alpha 6 (PCDHA6, Accession NM_018909) is another VGAM1034 host target gene. PCDHA6 BINDING SITE1 and PCDHA6 BINDING SITE2 are HOST TARGET binding sites found in untranslated regions of mRNA encoded by PCDHA6, corresponding to HOST TARGET binding sites such as BINDING SITE I, BINDING SITE II or BINDING SITE III. Table 2 illustrates the complementarity of the nucleotide sequences of PCDHA6 BINDING SITE1 and PCDHA6 BINDING SITE2, designated SEQ ID:20955 and SEQ ID:25587 respectively, to the nucleotide sequence of VGAM1034 RNA, herein designated VGAM RNA, also designated SEQ ID:3745.

Another function of VGAM1034 is therefore inhibition of Protocadherin Alpha 6 (PCDHA6, Accession NM_018909). Accordingly, utilities of VGAM1034 include diagnosis, prevention and treatment of diseases and clinical conditions associated with PCDHA6. Protocadherin Alpha 8 (PCDHA8, Accession NM_018911) is another VGAM1034 host target gene. PCDHA8 BINDING SITE is HOST TARGET binding site found in the 3' untranslated region of mRNA encoded by PCDHA8, corresponding to a HOST TARGET binding site such as BINDING SITE I, BINDING SITE II or BINDING SITE III. Table 2 illustrates the complementarity of the nucleotide sequences of PCDHA8 BINDING SITE, designated SEQ ID:20975, to the nucleotide sequence of VGAM1034 RNA, herein designated VGAM RNA, also designated SEQ ID:3745.

Another function of VGAM1034 is therefore inhibition of Protocadherin Alpha 8 (PCDHA8, Accession NM_018911). Accordingly, utilities of VGAM1034 include diagnosis, prevention and treatment of diseases and clinical conditions associated with PCDHA8. Protocadherin Alpha 9 (PCDHA9, Accession NM_031857) is another VGAM1034 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:25600, to the nucleotide sequence of VGAM1034 RNA, herein designated VGAM RNA, also designated SEQ ID:3745.

Another function of VGAM1034 is therefore inhibition of Protocadherin Alpha 9 (PCDHA9, Accession NM_031857), a gene which is a calcium-dependent cell-adhesion protein. Accordingly, utilities of VGAM1034 include diagnosis, prevention and treatment of diseases and clinical conditions associated with PCDHA9. The function of PCDHA9 and its association with various diseases and clinical conditions, has been established by previous studies, as described hereinabove with reference to VGAM71. Protocadherin Alpha Subfamily C, 1 (PCDHAC1, Accession NM_018898) is another VGAM1034 host target gene. PCDHAC1 BINDING SITE is HOST TARGET binding site found in the 3' untranslated region of mRNA encoded by PCDHAC1, corresponding to a HOST TARGET binding site such as BINDING SITE I, BINDING SITE II or BINDING SITE III. Table 2 illustrates the complementarity of the nucleotide sequences of PCDHAC1 BINDING SITE, designated SEQ ID:20844, to the nucleotide sequence of VGAM1034 RNA, herein designated VGAM RNA, also designated SEQ ID:3745.

Another function of VGAM1034 is therefore inhibition of Protocadherin Alpha Subfamily C, 1 (PCDHAC1, Accession NM_018898). Accordingly, utilities of VGAM1034 include diagnosis, prevention and treatment of diseases and clinical conditions associated with PCDHAC1. Protocadherin Alpha Subfamily C, 2 (PCDHAC2, Accession NM_018899) is another VGAM1034 host target gene. PCDHAC2 BINDING SITE is HOST TARGET binding site found in the 3' untranslated region of mRNA encoded by PCDHAC2, corresponding to a HOST TARGET binding site such as BINDING SITE I, BINDING SITE II or BINDING SITE III. Table 2 illustrates the complementarity of the nucleotide sequences of PCDHAC2 BINDING SITE, designated SEQ ID:20854, to the nucleotide sequence of VGAM1034 RNA, herein designated VGAM RNA, also designated SEQ ID:3745.

Another function of VGAM1034 is therefore inhibition of Protocadherin Alpha Subfamily C, 2 (PCDHAC2, Accession NM_018899). Accordingly, utilities of VGAM1034 include diagnosis, prevention and treatment of diseases and clinical conditions associated with PCDHAC2. Solute Carrier Family 22 (organic anion/cation transporter), Member 12 (SLC22A12, Accession NM_144585) is another VGAM1034 host target gene. SLC22A12 BINDING SITE is HOST TARGET binding site found in the 3" untranslated region of mRNA encoded by SLC22A12, corresponding to a HOST TARGET binding site such as BINDING SITE I, BINDING SITE II or BINDING SITE III. Table 2 illustrates the complementarity of the nucleotide sequences of SLC22A12 BINDING SITE, designated SEQ ID:29402, to the nucleotide sequence of VGAM1034 RNA, herein designated VGAM RNA, also designated SEQ ID:3745.

Another function of VGAM1034 is therefore inhibition of Solute Carrier Family 22 (organic anion/cation transporter), Member 12 (SLC22A12, Accession NM_144585), a gene which is a urate -anion exchanger regulating blood yrate levels. Accordingly, utilities of VGAM1034 include diagnosis, prevention and treatment of diseases and clinical conditions associated with SLC22A12. The function of SLC22A12 has been established by previous studies. Enomoto et al. (2002) isolated a SLC22A12 cDNA from a human kidney cDNA library. The cDNA, which they called URAT1 for 'urate transporter-1,' corresponds to a gene of 2,642 basepairs encoding a protein of 555 amino acids, which they called URAT1 for 'urate transporter-1,' that is 42% identical to OAT4 (OMIM Ref. No. 607097). The hydropathy plot predicts 12 membrane-spanning domains in URAT1, which are similar to those in members of the OAT family. URAT1 has 3 consensus sequences for N-glycosylation and 2 cyclic AMP-dependent protein kinase phosphorylation sites. High stringency Northern analysis revealed predominant expression of URAT1 mRNA in the human adult and fetal kidney, and immunohistochemical analysis revealed that URAT1 protein is prominent in epithelial cells of the proximal tubule of the renal cortex. Under high magnification, the protein was found to be located in the luminal membrane of the epithelium of proximal tubules but not in that of distal tubules Enomoto et al. (2002) demonstrated that Xenopus oocytes injected with URAT1 cRNA exhibited time-dependent transport activity of [14C]urate but not of various typical substrates of OATs or organic cation transporters. URAT1 was found to be a cotransporter with anions, in particular chloride, bromide, or iodine, but not fluoride. Enomoto et al. (2002) found that urate transport via URAT1 is inhibited selectively by organic anions such as lactate, nicotinate, acetoacetate, hydroxybutyrate, and succinate. Para-aminohippurate (PAH), the representative substrate of OATs, did not exert an inhibitory effect on urate uptake via URAT1, consistent with the observation that PAH has no effect on the fractional excretion of urate in human S. Benzbromarone, probenecid, phenylbutazone, sulfinpyrazone, nonsteroidal antiinflammatory drugs, and diuretics inhibited urate uptake. Trans-stimulation experiments indicated that the major counteranions that exchange for urate via URAT1 are organic anions rather than inorganic chloride. Patients with renal hypouricemia (OMIM Ref. No. 220150) have mutations in URAT1.

Full details of the abovementioned studies are described in the following publications, the disclosure of which are hereby incorporated by reference:

Enomoto, A.; Kimura, H.; Chairoungdua, A.; Shigeta, Y.; Jutabha, P.; Cha, S. H.; Hosoyamada, M.; Takeda, M.; Sekine, T.; Igarashi, T.; Matsuo, H.; Kikuchi, Y.; Oda, T.; Ichida, K.; Hosoya, T.; Shimokata, K.; Niwa, T.; Kanai, Y.; Endou, H.: Molecular identification of a renal urate-anion exchanger that regulates blood urate levels. Nature 417:447-452, 2002; and Enomoto, A.; Kimura, H.; Chairoungdua, A.; Shigeta, Y.; Jutabha, P.; Cha, S. H.; Hosoyamada, M.; Takeda, M.; Sekine, T.; Igarashi, T.; Matsuo, H.; Kikuchi, Y.; Oda, T.; Ichida, K.; Hosoya.

Further studies establishing the function and utilities of SLC22A12 are found in John Hopkins OMIM database record ID 607096, and in sited publications numbered 10108 listed in the bibliography section hereinbelow, which are also hereby incorporated by reference. FIG. 1 further provides a conceptual description of a novel bioinformatically detected viral gene of the present invention, referred to here as Viral Genomic Address Messenger 1035 (VGAM1035) viral gene, which modulates expression of respective host target genes thereof, the function and utility of which host target genes is known in the art.

VGAM1035 is a novel bioinformatically detected regulatory, non protein coding, viral micro RNA (miRNA) gene. The method by which VGAM1035 was detected is described hereinabove with reference to FIGS. 1-8.

VGAM1035 gene, herein designated VGAM GENE, is a viral gene contained in the genome of Cercopithecine Herpesvirus 7. VGAM1035 host target gene, herein designated VGAM HOST TARGET GENE, is a human gene contained in the human genome.

VGAM1035 gene encodes a VGAM1035 precursor RNA, herein designated VGAM PRECURSOR RNA. Similar to other miRNA genes, and unlike most ordinary genes, VGAM1035 precursor RNA does not encode a protein. A nucleotide sequence identical or highly similar to the nucleotide sequence of VGAM1035 precursor RNA is designated SEQ ID:1021, and is provided hereinbelow with reference to the sequence listing part. Nucleotide sequence SEQ ID:1021 is located at position 105937 relative to the genome of Cercopithecine Herpesvirus 7.

VGAM1035 precursor RNA folds onto itself, forming VGAM1035 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1035 folded precursor RNA into VGAM1035 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1035 RNA is designated SEQ ID:3746, and is provided hereinbelow with reference to the sequence listing part.

VGAM1035 host target gene, herein designated VGAM HOST TARGET GENE, encodes a corresponding messenger RNA, VGAM1035 host target RNA, herein designated VGAM HOST TARGET RNA. VGAM1035 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1035 RNA, herein designated VGAM RNA, binds complementarily to one or more host target binding sites located in untranslated regions of VGAM1035 host target RNA, herein designated VGAM HOST TARGET RNA. This complementary binding is due to the fact that the nucleotide sequence of VGAM1035 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1035 RNA, herein designated VGAM RNA, may have a different number of host target binding sites in untranslated regions of a VGAM1035 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1035 RNA, herein designated VGAM RNA, to host target binding sites on VGAM1035 host target RNA, herein designated VGAM HOST TARGET RNA, such as BINDING SITE I, BINDING SITE II and BINDING SITE III, inhibits translation of VGAM1035 host target RNA into VGAM1035 host target protein, herein designated VGAM HOST TARGET PROTEIN. VGAM host target protein is therefore outlined by a broken line.

It is appreciated that VGAM1035 host target gene, herein designated VGAM HOST TARGET GENE, in fact represents a plurality of VGAM1035 host target genes. The mRNA of each one of this plurality of VGAM1035 host target genes comprises one or more host target binding sites, each having a nucleotide sequence which is at least partly complementary to VGAM1035 RNA, herein designated VGAM RNA, and which when bound by VGAM1035 RNA causes inhibition of translation of respective one or more VGAM1035 host target proteins.

It is further appreciated by one skilled in the art that the mode of translational inhibition illustrated by FIG. 1 with specific reference to translational inhibition exerted by VGAM1035 gene, herein designated VGAM GENE, on one or more VGAM1035 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1035 is inhibition of expression of host target genes, as part of a novel viral mechanism of attacking a host. Accordingly, utilities of VGAM1035 include diagnosis, prevention and treatment of viral infection by Cercopithecine Herpesvirus 7. Specific functions, and accordingly utilities, of VGAM1035 correlate with, and may be deduced from, the identity of the host target genes which VGAM1035 binds and inhibits, and the function of these host target genes, as elaborated hereinbelow.

Nucleotide sequences of the VGAM1035 precursor RNA, herein designated VGAM PRECURSOR RNA, and of the 'diced' VGAM1035 RNA, herein designated VGAM RNA, and a schematic representation of the secondary folding of VGAM1035 folded precursor RNA, herein designated VGAM FOLDED PRECURSOR RNA, of VGAM1035 are further described hereinbelow with reference to Table 1.

Nucleotide sequences of host target binding sites, such as BINDING SITE-I, BINDING SITE-II and BINDING SITE-III of FIG. 1, found on VGAM1035 host target RNA, and schematic representation of the complementarity of each of these host target binding sites to VGAM1035 RNA, herein designated VGAM RNA, are described hereinbelow with reference to Table 2.

As mentioned hereinabove with reference to FIG. 1, a function of VGAM1035 gene, herein designated VGAM is inhibition of expression of VGAM1035 target genes. It is appreciated that specific functions, and accordingly utilities, of VGAM1035 correlate with, and may be deduced from, the identity of the target genes which VGAM1035 binds and inhibits, and the function of these target genes, as elaborated hereinbelow.

CRACC (Accession NM_021181) is a VGAM1035 host target gene. CRACC BINDING SITE is HOST TARGET binding site found in the 3' untranslated region of mRNA encoded by CRACC, corresponding to a HOST TARGET binding site such as BINDING SITE I, BINDING SITE II or BINDING SITE III. Table 2 illustrates the complementarity of the nucleotide sequences of CRACC BINDING SITE, designated SEQ ID:22152, to the nucleotide sequence of VGAM1035 RNA, herein designated VGAM RNA, also designated SEQ ID:3746.

A function of VGAM1035 is therefore inhibition of CRACC (Accession NM_021181), a gene which may participate in adhesion reactions between t lymphocytes and accessory cells. Accordingly, utilities of VGAM1035 include diagnosis, prevention and treatment of diseases and clinical conditions associated with CRACC. The function of CRACC and its association with various diseases and clinical conditions, has been established by previous studies, as described hereinabove with reference to VGAM26. LOC112885 (Accession NM_138415) is another VGAM1035 host target gene. LOC112885 BINDING SITE is HOST TARGET binding site found in the 3' untranslated region of mRNA encoded by LOC112885, corresponding to a HOST TARGET binding site such as BINDING SITE I, BINDING SITE II or BINDING SITE III. Table 2 illustrates the complementarity of the nucleotide sequences of LOC112885 BINDING SITE, designated SEQ ID:28785, to the nucleotide sequence of VGAM1035 RNA, herein designated VGAM RNA, also designated SEQ ID:3746.

Another function of VGAM1035 is therefore inhibition of LOC112885 (Accession NM_138415). Accordingly, utilities of VGAM1035 include diagnosis, prevention and treatment of diseases and clinical conditions associated with LOC112885. FIG. 1 further provides a conceptual description of a novel bioinformatically detected viral gene of the present invention, referred to here as Viral Genomic Address Messenger 1036 (VGAM1036) viral gene, which modulates expression of respective host target genes thereof, the function and utility of which host target genes is known in the art.

VGAM1036 is a novel bioinformatically detected regulatory, non protein coding, viral micro RNA (miRNA) gene. The method by which VGAM1036 was detected is described hereinabove with reference to FIGS. 1-8.

VGAM1036 gene, herein designated VGAM GENE, is a viral gene contained in the genome of Cercopithecine Herpesvirus 7. VGAM1036 host target gene, herein designated VGAM HOST TARGET GENE, is a human gene contained in the human genome.

VGAM1036 gene encodes a VGAM1036 precursor RNA, herein designated VGAM PRECURSOR RNA. Similar to other miRNA genes, and unlike most ordinary genes, VGAM1036 precursor RNA does not encode a protein. A nucleotide sequence identical or highly similar to the nucleotide sequence of VGAM1036 precursor RNA is designated SEQ ID:1022, and is provided hereinbelow with reference to the sequence listing part. Nucleotide sequence SEQ ID:1022 is located at position 108759 relative to the genome of Cercopithecine Herpesvirus 7.

VGAM1036 precursor RNA folds onto itself, forming VGAM1036 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1036 folded precursor RNA into VGAM1036 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1036 RNA is designated SEQ ID:3747, and is provided hereinbelow with reference to the sequence listing part.

VGAM1036 host target gene, herein designated VGAM HOST TARGET GENE, encodes a corresponding messenger RNA, VGAM1036 host target RNA, herein designated VGAM HOST TARGET RNA. VGAM1036 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1036 RNA, herein designated VGAM RNA, binds complementarily to one or more host target binding sites located in untranslated regions of VGAM1036 host target RNA, herein designated VGAM HOST TARGET RNA. This complementary binding is due to the fact that the nucleotide sequence of VGAM1036 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1036 RNA, herein designated VGAM RNA, may have a different number of host target binding sites in untranslated regions of a VGAM1036 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1036 RNA, herein designated VGAM RNA, to host target binding sites on VGAM1036 host target RNA, herein designated VGAM HOST TARGET RNA, such as BINDING SITE I, BINDING SITE II and BINDING SITE III, inhibits translation of VGAM1036 host target RNA into VGAM1036 host target protein, herein designated VGAM HOST TARGET PROTEIN. VGAM host target protein is therefore outlined by a broken line.

It is appreciated that VGAM1036 host target gene, herein designated VGAM HOST TARGET GENE, in fact represents a plurality of VGAM1036 host target genes. The mRNA of each one of this plurality of VGAM1036 host target genes comprises one or more host target binding sites, each having a nucleotide sequence which is at least partly complementary to VGAM1036 RNA, herein designated VGAM RNA, and which when bound by VGAM1036 RNA causes inhibition of translation of respective one or more VGAM1036 host target proteins.

It is further appreciated by one skilled in the art that the mode of translational inhibition illustrated by FIG. 1 with specific reference to translational inhibition exerted by VGAM1036 gene, herein designated VGAM GENE, on one or more VGAM1036 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1036 is inhibition of expression of host target genes, as part of a novel viral mechanism of attacking a host. Accordingly, utilities of VGAM1036 include diagnosis, prevention and treatment of viral infection by Cercopithecine Herpesvirus 7. Specific functions, and accordingly utilities, of VGAM1036 correlate with, and may be deduced from, the identity of the host target genes which VGAM1036 binds and inhibits, and the function of these host target genes, as elaborated hereinbelow.

Nucleotide sequences of the VGAM1036 precursor RNA, herein designated VGAM PRECURSOR RNA, and of the 'diced' VGAM1036 RNA, herein designated VGAM RNA, and a schematic representation of the secondary folding of VGAM1036 folded precursor RNA, herein designated VGAM FOLDED PRECURSOR RNA, of VGAM1036 are further described hereinbelow with reference to Table 1.

Nucleotide sequences of host target binding sites, such as BINDING SITE-I, BINDING SITE-II and BINDING SITE- III of FIG. 1, found on VGAM1036 host target RNA, and schematic representation of the complementarity of each of these host target binding sites to VGAM1036 RNA, herein designated VGAM RNA, are described hereinbelow with reference to Table 2.

As mentioned hereinabove with reference to FIG. 1, a function of VGAM1036 gene, herein designated VGAM is inhibition of expression of VGAM1036 target genes. It is appreciated that specific functions, and accordingly utilities, of VGAM1036 correlate with, and may be deduced from, the identity of the target genes which VGAM1036 binds and inhibits, and the function of these target genes, as elaborated hereinbelow.

Retinoic Acid Induced 14 (RAI14, Accession NM_015577) is a VGAM1036 host target gene. RAI14 BINDING SITE is HOST TARGET binding site found in the 3' untranslated region of mRNA encoded by RAI14, corresponding to a HOST TARGET binding site such as BINDING SITE I, BINDING SITE II or BINDING SITE III. Table 2 illustrates the complementarity of the nucleotide sequences of RAI14 BINDING SITE, designated SEQ ID:17847, to the nucleotide sequence of VGAM1036 RNA, herein designated VGAM RNA, also designated SEQ ID:3747.

A function of VGAM1036 is therefore inhibition of Retinoic Acid Induced 14 (RAI14, Accession NM_015577), a gene which is required for protein transport from the er to the golgi complex. Accordingly, utilities of VGAM1036 include diagnosis, prevention and treatment of diseases and clinical conditions associated with RAI14. The function of RAI14 has been established by previous studies. Nagase et al. (2000) isolated a cDNA encoding RAI14, which they called KIAA1334, from a size-fractionated fetal brain cDNA library. Kutty et al. (2001) characterized the RAI14 gene, which they called NORPEG, from human retinal pigment epithelial cells (ARPE-19), in which its expression is induced by all-trans-retinoic acid. The predicted human and mouse proteins contain 980 and 979 amino acids, respectively, and share 84% sequence identity. Human RAI14 has a predicted molecular mass of 110 kD, a pI of 5.83, 6 potential N-glycosylation sites, several ankyrin repeats, and several coiled-coil helical domains. Northern blot analysis of human tissues detected expression of 2 transcripts of approximately 5 and 3 kb. Like the ARPE-19 cells, placenta showed an intense signal at 5 kb and a weak signal at 3 kb; the reverse was observed in testis, with an intense signal at 3 kb and a weak signal at 5 kb. RAI14 was also highly expressed in several human cancer cell lines. Expression studies showed that RAI14 localizes to the cytoplasm. Confocal microscopic analysis in ARPE-19 cells showed threadlike projections in the cytoplasm reminiscent of the cytoskeleton. The expression of Rai14 was detected in mouse embryo at embryonic day 9.5 by in situ hybridization, and the expression appeared to be developmentally regulated. In adult mouse, the highest level of expression was detected in the seminiferous tubules of testis.

Full details of the abovementioned studies are described in the following publications, the disclosure of which are hereby incorporated by reference:

Kutty, R. K.; Kutty, G.; Samuel, W.; Duncan, T.; Bridges, C. C.; El-Sherbeeny, A.; Nagineni, C. N.; Smith, S. B.; Wiggert, B.: Molecular characterization and developmental expression of NORPEG, a novel gene induced by retinoic acid. J. Biol. Chem. 276:2831-2840, 2001; and Nagase, T.; Kikuno, R.; Ishikawa, K.; Hirosawa, M.; Ohara, O.: Prediction of the coding sequences of unidentified human genes. XVI. The complete sequences of 150 new cDNA clones from.

Further studies establishing the function and utilities of RAI14 are found in John Hopkins OMIM database record ID 606586, and in sited publications numbered 627 and 6371 listed in the bibliography section hereinbelow, which are also hereby incorporated by reference. UV Radiation Resistance Associated Gene (UVRAG, Accession NM_003369) is another VGAM1036 host target gene. UVRAG BINDING SITE is HOST TARGET binding site found in the 3' untranslated region of mRNA encoded by UVRAG, corresponding to a HOST TARGET binding site such as BINDING SITE I, BINDING SITE II or BINDING SITE III. Table 2 illustrates the complementarity of the nucleotide sequences of UVRAG BINDING SITE, designated SEQ ID:9393, to the nucleotide sequence of VGAM1036 RNA, herein designated VGAM RNA, also designated SEQ ID:3747.

Another function of VGAM1036 is therefore inhibition of UV Radiation Resistance Associated Gene (UVRAG, Accession NM_003369). Accordingly, utilities of VGAM1036 include diagnosis, prevention and treatment of diseases and clinical conditions associated with UVRAG. Zinc Finger Protein 36, C3H Type-like 1 (ZFP36L1, Accession NM_004926) is another VGAM1036 host target gene. ZFP36L1 BINDING SITE is HOST TARGET binding site found in the 3' untranslated region of mRNA encoded by ZFP36L1, corresponding to a HOST TARGET binding site such as BINDING SITE I, BINDING SITE II or BINDING SITE III. Table 2 illustrates the complementarity of the nucleotide sequences of ZFP36L1 BINDING SITE, designated SEQ ID:11365, to the nucleotide sequence of VGAM1036 RNA, herein designated VGAM RNA, also designated SEQ ID:3747.

Another function of VGAM1036 is therefore inhibition of Zinc Finger Protein 36, C3H Type-like 1 (ZFP36L1, Accession NM_004926), a gene which is a regulatory protein involved in regulating the response to growth factors. Accordingly, utilities of VGAM1036 include diagnosis, prevention and treatment of diseases and clinical conditions associated with ZFP36L1. The function of ZFP36L1 and its association with various diseases and clinical conditions, has been established by previous studies, as described hereinabove with reference to VGAM74. Chromosome 1 Open Reading Frame 34 (C1orf34, Accession XM_027172) is another VGAM1036 host target gene. C1orf34 BINDING SITE is HOST TARGET binding site found in the 3' untranslated region of mRNA encoded by C1orf34, corresponding to a HOST TARGET binding site such as BINDING SITE I, BINDING SITE II or BINDING SITE III. Table 2 illustrates the complementarity of the nucleotide sequences of C1orf34 BINDING SITE, designated SEQ ID:30439, to the nucleotide sequence of VGAM1036 RNA, herein designated VGAM RNA, also designated SEQ ID:3747.

Another function of VGAM1036 is therefore inhibition of Chromosome 1 Open Reading Frame 34 (C1orf34, Accession XM_027172). Accordingly, utilities of VGAM1036 include diagnosis, prevention and treatment of diseases and clinical conditions associated with C1orf34. HYPH (Accession XM_170722) is another VGAM1036 host target gene. HYPH BINDING SITE is HOST TARGET binding site found in the 3' untranslated region of mRNA encoded by HYPH, corresponding to a HOST TARGET binding site such as BINDING SITE I, BINDING SITE II or BINDING SITE III. Table 2 illustrates the complementarity of the nucleotide sequences of HYPH BINDING SITE, designated SEQ ID:45484, to the nucleotide sequence of VGAM1036 RNA, herein designated VGAM RNA, also designated SEQ ID:3747.

Another function of VGAM1036 is therefore inhibition of HYPH (Accession XM_170722). Accordingly, utilities of VGAM1036 include diagnosis, prevention and treatment of diseases and clinical conditions associated with HYPH. KIAA1719 (Accession XM_042936) is another VGAM1036 host target gene. KIAA1719 BINDING SITE is HOST TARGET binding site found in the 3" untranslated region of mRNA encoded by KIAA1719, corresponding to a HOST TARGET binding site such as BINDING SITE I, BINDING SITE II or BINDING SITE III. Table 2 illustrates the complementarity of the nucleotide sequences of KIAA1719 BINDING SITE, designated SEQ ID:33828, to the nucleotide sequence of VGAM1036 RNA, herein designated VGAM RNA, also designated SEQ ID:3747.

Another function of VGAM1036 is therefore inhibition of KIAA1719 (Accession XM_042936). Accordingly, utilities of VGAM1036 include diagnosis, prevention and treatment of diseases and clinical conditions associated with KIAA1719. Ring Finger Protein (C3HC4 type) 8 (RNF8, Accession NM_003958) is another VGAM1036 host target gene. RNF8 BINDING SITE is HOST TARGET binding site found in the 3' untranslated region of mRNA encoded by RNF8, corresponding to a HOST TARGET binding site such as BINDING SITE I, BINDING SITE II or BINDING SITE III. Table 2 illustrates the complementarity of the nucleotide sequences of RNF8 BINDING SITE, designated SEQ ID:10100, to the nucleotide sequence of VGAM1036 RNA, herein designated VGAM RNA, also designated SEQ ID:3747.

Another function of VGAM1036 is therefore inhibition of Ring Finger Protein (C3HC4 type) 8 (RNF8, Accession NM_003958). Accordingly, utilities of VGAM1036 include diagnosis, prevention and treatment of diseases and clinical conditions associated with RNF8. Zinc Metalloproteinase (STE24 homolog, yeast) (ZMPSTE24, Accession NM_005857) is another VGAM1036 host target gene. ZMPSTE24 BINDING SITE is HOST TARGET binding site found in the 3' untranslated region of mRNA encoded by ZMPSTE24, corresponding to a HOST TARGET binding site such as BINDING SITE I, BINDING SITE II or BINDING SITE III. Table 2 illustrates the complementarity of the nucleotide sequences of ZMPSTE24 BINDING SITE, designated SEQ ID:12462, to the nucleotide sequence of VGAM1036 RNA, herein designated VGAM RNA, also designated SEQ ID:3747.

Another function of VGAM1036 is therefore inhibition of Zinc Metalloproteinase (STE24 homolog, yeast) (ZMPSTE24, Accession NM_005857). Accordingly, utilities of VGAM1036 include diagnosis, prevention and treatment of diseases and clinical conditions associated with ZMPSTE24. LOC200301 (Accession XM_114197) is another VGAM1036 host target gene. LOC200301 BINDING SITE is HOST TARGET binding site found in the 5' untranslated region of mRNA encoded by LOC200301, corresponding to a HOST TARGET binding site such as BINDING SITE I, BINDING SITE II or BINDING SITE III. Table 2 illustrates the complementarity of the nucleotide sequences of LOC200301 BINDING SITE, designated SEQ ID:42781, to the nucleotide sequence of VGAM1036 RNA, herein designated VGAM RNA, also designated SEQ ID:3747.

Another function of VGAM1036 is therefore inhibition of LOC200301 (Accession XM_114197). Accordingly, utilities of VGAM1036 include diagnosis, prevention and treatment of diseases and clinical conditions associated with LOC200301. LOC203286 (Accession XM_117526) is another VGAM1036 host target gene. LOC203286 BINDING SITE is HOST TARGET binding site found in the 5' untranslated region of mRNA encoded by LOC203286, corresponding to a HOST TARGET binding site such as BINDING SITE I, BINDING SITE II or BINDING SITE III. Table 2 illustrates the complementarity of the nucleotide sequences of LOC203286 BINDING SITE, designated SEQ ID:43494, to the nucleotide sequence of VGAM1036 RNA, herein designated VGAM RNA, also designated SEQ ID:3747.

Another function of VGAM1036 is therefore inhibition of LOC203286 (Accession XM_117526). Accordingly, utilities of VGAM1036 include diagnosis, prevention and treatment of diseases and clinical conditions associated with LOC203286. LOC257479 (Accession XM_171548) is another VGAM1036 host target gene. LOC257479 BINDING SITE is HOST TARGET binding site found in the 5' untranslated region of mRNA encoded by LOC257479, corresponding to a HOST TARGET binding site such as BINDING SITE I, BINDING SITE II or BINDING SITE III. Table 2 illustrates the complementarity of the nucleotide sequences of LOC257479 BINDING SITE, designated SEQ ID:46049, to the nucleotide sequence of VGAM1036 RNA, herein designated VGAM RNA, also designated SEQ ID:3747.

Another function of VGAM1036 is therefore inhibition of LOC257479 (Accession XM_171548). Accordingly, utilities of VGAM1036 include diagnosis, prevention and treatment of diseases and clinical conditions associated with LOC257479. LOC51696 (Accession NM_016217) is another VGAM1036 host target gene. LOC51696 BINDING SITE is HOST TARGET binding site found in the 3' untranslated region of mRNA encoded by LOC51696, corresponding to a HOST TARGET binding site such as BINDING SITE I, BINDING SITE II or BINDING SITE III. Table 2 illustrates the complementarity of the nucleotide sequences of LOC51696 BINDING SITE, designated SEQ ID:18312, to the nucleotide sequence of VGAM1036 RNA, herein designated VGAM RNA, also designated SEQ ID:3747.

Another function of VGAM1036 is therefore inhibition of LOC51696 (Accession NM_016217). Accordingly, utilities of VGAM1036 include diagnosis, prevention and treatment of diseases and clinical conditions associated with LOC51696. LOC91907 (Accession XM_041430) is another VGAM1036 host target gene. LOC91907 BINDING SITE is HOST TARGET binding site found in the 3' untranslated region of mRNA encoded by LOC91907, corresponding to a HOST TARGET binding site such as BINDING SITE I, BINDING SITE II or BINDING SITE III. Table 2 illustrates the complementarity of the nucleotide sequences of LOC91907 BINDING SITE, designated SEQ ID:33521, to the nucleotide sequence of VGAM1036 RNA, herein designated VGAM RNA, also designated SEQ ID:3747.

Another function of VGAM1036 is therefore inhibition of LOC91907 (Accession XM_041430). Accordingly, utilities of VGAM1036 include diagnosis, prevention and treatment of diseases and clinical conditions associated with LOC91907. FIG. 1 further provides a conceptual description of a novel bioinformatically detected viral gene of the present invention, referred to here as Viral Genomic Address Messenger 1037 (VGAM1037) viral gene, which modulates expression of respective host target genes thereof, the function and utility of which host target genes is known in the art.

VGAM1037 is a novel bioinformatically detected regulatory, non protein coding, viral micro RNA (miRNA) gene. The method by which VGAM1037 was detected is described hereinabove with reference to FIGS. 1-8.

VGAM1037 gene, herein designated VGAM GENE, is a viral gene contained in the genome of Molluscum Contagiosum Virus. VGAM1037 host target gene, herein designated VGAM HOST TARGET GENE, is a human gene contained in the human genome.

VGAM1037 gene encodes a VGAM1037 precursor RNA, herein designated VGAM PRECURSOR RNA. Similar to other miRNA genes, and unlike most ordinary genes, VGAM1037 precursor RNA does not encode a protein. A nucleotide sequence identical or highly similar to the nucleotide sequence of VGAM1037 precursor RNA is designated SEQ ID:1023, and is provided hereinbelow with reference to the sequence listing part. Nucleotide sequence SEQ ID:1023 is located at position 96311 relative to the genome of Molluscum Contagiosum Virus.

VGAM1037 precursor RNA folds onto itself, forming VGAM1037 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1037 folded precursor RNA into VGAM1037 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM1037 RNA is designated SEQ ID:3748, and is provided hereinbelow with reference to the sequence listing part.

VGAM1037 host target gene, herein designated VGAM HOST TARGET GENE, encodes a corresponding messenger RNA, VGAM1037 host target RNA, herein designated VGAM HOST TARGET RNA. VGAM1037 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1037 RNA, herein designated VGAM RNA, binds complementarily to one or more host target binding sites located in untranslated regions of VGAM1037 host target RNA, herein designated VGAM HOST TARGET RNA. This complementary binding is due to the fact that the nucleotide sequence of VGAM1037 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1037 RNA, herein designated VGAM RNA, may have a different number of host target binding sites in untranslated regions of a VGAM1037 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1037 RNA, herein designated VGAM RNA, to host target binding sites on VGAM1037 host target RNA, herein designated VGAM HOST TARGET RNA, such as BINDING SITE I, BINDING SITE II and BINDING SITE III, inhibits translation of VGAM1037 host target RNA into VGAM1037 host target protein, herein designated VGAM HOST TARGET PROTEIN. VGAM host target protein is therefore outlined by a broken line.

It is appreciated that VGAM1037 host target gene, herein designated VGAM HOST TARGET GENE, in fact represents a plurality of VGAM1037 host target genes. The mRNA of each one of this plurality of VGAM1037 host target genes comprises one or more host target binding sites, each having a nucleotide sequence which is at least partly complementary to VGAM1037 RNA, herein designated VGAM RNA, and which when bound by VGAM1037 RNA causes inhibition of translation of respective one or more VGAM1037 host target proteins.

It is further appreciated by one skilled in the art that the mode of translational inhibition illustrated by FIG. 1 with specific reference to translational inhibition exerted by VGAM1037 gene, herein designated VGAM GENE, on one or more VGAM1037 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1037 is inhibition of expression of host target genes, as part of a novel viral mechanism of attacking a host. Accordingly, utilities of VGAM1037 include diagnosis, prevention and treatment of viral infection by Molluscum Contagiosum Virus. Specific functions, and accordingly utilities, of VGAM1037 correlate with, and may be deduced from, the identity of the host target genes which VGAM1037 binds and inhibits, and the function of these host target genes, as elaborated hereinbelow.

Nucleotide sequences of the VGAM1037 precursor RNA, herein designated VGAM PRECURSOR RNA, and of the 'diced' VGAM1037 RNA, herein designated VGAM RNA, and a schematic representation of the secondary folding of VGAM1037 folded precursor RNA, herein designated VGAM FOLDED PRECURSOR RNA, of VGAM1037 are further described hereinbelow with reference to Table 1.

Nucleotide sequences of host target binding sites, such as BINDING SITE-I, BINDING SITE-II and BINDING SITE-III of FIG. 1, found on VGAM1037 host target RNA, and schematic representation of the complementarity of each of these host target binding sites to VGAM1037 RNA, herein designated VGAM RNA, are described hereinbelow with reference to Table 2.

As mentioned hereinabove with reference to FIG. 1, a function of VGAM1037 gene, herein designated VGAM is inhibition of expression of VGAM1037 target genes. It is appreciated that specific functions, and accordingly utilities, of VGAM1037 correlate with, and may be deduced from, the identity of the target genes which VGAM1037 binds and inhibits, and the function of these target genes, as elaborated hereinbelow.

Collagen, Type XI, Alpha 2 (COL11A2, Accession NM_080680) is a VGAM1037 host target gene. COL11A2 BINDING SITE1 and COL11A2 BINDING SITE2 are HOST TARGET binding sites found in untranslated regions of mRNA encoded by COL11A2, corresponding to HOST TARGET binding sites such as BINDING SITE I, BINDING SITE II or BINDING SITE III. Table 2 illustrates the complementarity of the nucleotide sequences of COL11A2 BINDING SITE1 and COL11A2 BINDING SITE2, designated SEQ ID:27973 and SEQ ID:27978 respectively, to the nucleotide sequence of VGAM1037 RNA, herein designated VGAM RNA, also designated SEQ ID:3748.

A function of VGAM1037 is therefore inhibition of Collagen, Type XI, Alpha 2 (COL11A2, Accession NM_080680). Accordingly, utilities of VGAM1037 include diagnosis, prevention and treatment of diseases and clinical conditions associated with COL11A2. KIAA1388 (Accession XM_168030) is another VGAM1037 host target gene. KIAA1388 BINDING SITE is HOST TARGET binding site found in the 3' untranslated region of mRNA encoded by KIAA1388, corresponding to a HOST TARGET binding site such as BINDING SITE I, BINDING SITE II or BINDING SITE III. Table 2 illustrates the complementarity of the nucleotide sequences of KIAA1388 BINDING SITE, designated SEQ ID:44948, to the nucleotide sequence of VGAM1037 RNA, herein designated VGAM RNA, also designated SEQ ID:3748.

Another function of VGAM1037 is therefore inhibition of KIAA1388 (Accession XM_168030). Accordingly, utilities of VGAM1037 include diagnosis, prevention and treatment of diseases and clinical conditions associated with KIAA1388. LOC147299 (Accession XM_085763) is another VGAM1037 host target gene. LOC147299 BINDING SITE is HOST TARGET binding site found in the 5' untranslated region of mRNA encoded by LOC147299, corresponding to a HOST TARGET binding site such as BINDING SITE I, BINDING SITE II or BINDING SITE III. Table 2 illustrates the complementarity of the nucleotide sequences of LOC147299 BINDING SITE, designated SEQ ID:38330, to the nucleotide sequence of VGAM1037 RNA, herein designated VGAM RNA, also designated SEQ ID:3748.

Another function of VGAM1037 is therefore inhibition of LOC147299 (Accession XM_085763). Accordingly, utilities of VGAM1037 include diagnosis, prevention and treatment of diseases and clinical conditions associated with LOC147299. FIG. 1 further provides a conceptual description of a novel bioinformatically detected viral gene of the present invention, referred to here as Viral Genomic Address Messenger 1038 (VGAM1038) viral gene, which modulates expression of respective host target genes thereof, the function and utility of which host target genes is known in the art.

VGAM1038 is a novel bioinformatically detected regulatory, non protein coding, viral micro RNA (miRNA) gene. The method by which VGAM1038 was detected is described hereinabove with reference to FIGS. 1-8.

VGAM1038 gene, herein designated VGAM GENE, is a viral gene contained in the genome of Molluscum Contagiosum Virus. VGAM1038 host target gene, herein designated VGAM HOST TARGET GENE, is a human gene contained in the human genome.

VGAM1038 gene encodes a VGAM1038 precursor RNA, herein designated VGAM PRECURSOR RNA. Similar to other miRNA genes, and unlike most ordinary genes, VGAM1038 precursor RNA does not encode a protein. A nucleotide sequence identical or highly similar to the nucleotide sequence of VGAM1038 precursor RNA is designated SEQ ID:1024, and is provided hereinbelow with reference to the sequence listing part. Nucleotide sequence SEQ ID:1024 is located at position 96469 relative to the genome of Molluscum Contagiosum Virus.

VGAM1038 precursor RNA folds onto itself, forming VGAM1038 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1038 folded precursor RNA into VGAM1038 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1038 RNA is designated SEQ ID:3749, and is provided hereinbelow with reference to the sequence listing part.

VGAM1038 host target gene, herein designated VGAM HOST TARGET GENE, encodes a corresponding messenger RNA, VGAM1038 host target RNA, herein designated VGAM HOST TARGET RNA. VGAM1038 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1038 RNA, herein designated VGAM RNA, binds complementarily to one or more host target binding sites located in untranslated regions of VGAM1038 host target RNA, herein designated VGAM HOST TARGET RNA. This complementary binding is due to the fact that the nucleotide sequence of VGAM1038 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1038 RNA, herein designated VGAM RNA, may have a different number of host target binding sites in untranslated regions of a VGAM1038 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1038 RNA, herein designated VGAM RNA, to host target binding sites on VGAM1038 host target RNA, herein designated VGAM HOST TARGET RNA, such as BINDING SITE I, BINDING SITE II and BINDING SITE III, inhibits translation of VGAM1038 host target RNA into VGAM1038 host target protein, herein designated VGAM HOST TARGET PROTEIN. VGAM host target protein is therefore outlined by a broken line.

It is appreciated that VGAM1038 host target gene, herein designated VGAM HOST TARGET GENE, in fact represents a plurality of VGAM1038 host target genes. The mRNA of each one of this plurality of VGAM1038 host target genes comprises one or more host target binding sites, each having a nucleotide sequence which is at least partly complementary to VGAM1038 RNA, herein designated VGAM RNA, and which when bound by VGAM1038 RNA causes inhibition of translation of respective one or more VGAM1038 host target proteins.

It is further appreciated by one skilled in the art that the mode of translational inhibition illustrated by FIG. 1 with specific reference to translational inhibition exerted by VGAM1038 gene, herein designated VGAM GENE, on one or more VGAM1038 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1038 is inhibition of expression of host target genes, as part of a novel viral mechanism of attacking a host. Accordingly, utilities of VGAM1038 include diagnosis, prevention and treatment of viral infection by Molluscum Contagiosum Virus. Specific functions, and accordingly utilities, of VGAM1038 correlate with, and may be deduced from, the identity of the host target genes which VGAM1038 binds and inhibits, and the function of these host target genes, as elaborated hereinbelow.

Nucleotide sequences of the VGAM1038 precursor RNA, herein designated VGAM PRECURSOR RNA, and of the 'diced' VGAM1038 RNA, herein designated VGAM RNA, and a schematic representation of the secondary folding of VGAM1038 folded precursor RNA, herein designated VGAM FOLDED PRECURSOR RNA, of VGAM1038 are further described hereinbelow with reference to Table 1.

Nucleotide sequences of host target binding sites, such as BINDING SITE-I, BINDING SITE-II and BINDING SITE-III of FIG. 1, found on VGAM1038 host target RNA, and schematic representation of the complementarity of each of these host target binding sites to VGAM1038 RNA, herein designated VGAM RNA, are described hereinbelow with reference to Table 2.

As mentioned hereinabove with reference to FIG. 1, a function of VGAM1038 gene, herein designated VGAM is inhibition of expression of VGAM1038 target genes. It is appreciated that specific functions, and accordingly utilities, of VGAM1038 correlate with, and may be deduced from, the identity of the target genes which VGAM1038 binds and inhibits, and the function of these target genes, as elaborated hereinbelow.

Chaperone, ABC1 Activity of Bc1 Complex Like (S. pombe) (CABC1, Accession NM_020247) is a VGAM1038 host target gene. CABC1 BINDING SITE is HOST TARGET binding site found in the 5' untranslated region of mRNA encoded by CABC1, corresponding to a HOST TARGET binding site such as BINDING SITE I, BINDING SITE II or BINDING SITE III. Table 2 illustrates the complementarity of the nucleotide sequences of CABC1 BINDING SITE, designated SEQ ID:21540, to the nucleotide sequence of VGAM1038 RNA, herein designated VGAM RNA, also designated SEQ ID:3749.

A function of VGAM1038 is therefore inhibition of Chaperone, ABC1 Activity of Bc1 Complex Like (S. pombe) (CABC1, Accession NM_020247). Accordingly, utilities of VGAM1038 include diagnosis, prevention and treatment of diseases and clinical conditions associated with CABC1. Neuron Navigator 2 (NAV2, Accession XM_012028) is another VGAM1038 host target gene. NAV2 BINDING SITE is HOST TARGET binding site found in the 3' untranslated region of mRNA encoded by NAV2, corresponding to a HOST TARGET binding site such as BINDING SITE I, BINDING SITE II or BINDING SITE III. Table 2 illustrates the complementarity of the nucleotide sequences of NAV2 BINDING SITE, designated SEQ ID:30203, to the nucleotide sequence of VGAM1038 RNA, herein designated VGAM RNA, also designated SEQ ID:3749.

Another function of VGAM1038 is therefore inhibition of Neuron Navigator 2 (NAV2, Accession XM_012028), a gene which plays an important role in neuronal development, including neurite outgrowth. Accordingly, utilities of VGAM1038 include diagnosis, prevention and treatment of diseases and clinical conditions associated with NAV2. The function of NAV2 and its association with various diseases and clinical conditions, has been established by previous studies, as described hereinabove with reference to VGAM481. Promyelocytic Leukemia (PML, Accession NM_033245) is another VGAM1038 host target gene. PML BINDING SITE1 and PML BINDING SITE2 are HOST TARGET binding sites found in untranslated regions of mRNA encoded by PML, corresponding to HOST TARGET binding sites such as BINDING SITE I, BINDING SITE II or BINDING SITE III. Table 2 illustrates the complementarity of the nucleotide sequences of PML BINDING SITE1 and PML BINDING SITE2, designated SEQ ID:27084 and SEQ ID:27080 respectively, to the nucleotide sequence of VGAM1038 RNA, herein designated VGAM RNA, also designated SEQ ID:3749.

Another function of VGAM1038 is therefore inhibition of Promyelocytic Leukemia (PML, Accession NM_033245). Accordingly, utilities of VGAM1038 include diagnosis, prevention and treatment of diseases and clinical conditions associated with PML. DKFZP547L112 (Accession XM_039353) is another VGAM1038 host target gene. DKFZP547L112 BINDING SITE1 and DKFZP547L112 BINDING SITE2 are HOST TARGET binding sites found in untranslated regions of mRNA encoded by DKFZP547L112, corresponding to HOST TARGET binding sites such as BINDING SITE I, BINDING SITE II or BINDING SITE III. Table 2 illustrates the complementarity of the nucleotide sequences of DKFZP547L112 BINDING SITE1 and DKFZP547L112 BINDING SITE2, designated SEQ ID:33059 and SEQ ID:33055 respectively, to the nucleotide sequence of VGAM1038 RNA, herein designated VGAM RNA, also designated SEQ ID:3749.

Another function of VGAM1038 is therefore inhibition of DKFZP547L112 (Accession XM_039353). Accordingly, utilities of VGAM1038 include diagnosis, prevention and treatment of diseases and clinical conditions associated with DKFZP547L112. KIAA1691 (Accession XM_166523) is another VGAM1038 host target gene. KIAA1691 BINDING SITE is HOST TARGET binding site found in the 3' untranslated region of mRNA encoded by KIAA1691, corresponding to a HOST TARGET binding site such as BINDING SITE I, BINDING SITE II or BINDING SITE III. Table 2 illustrates the complementarity of the nucleotide sequences of KIAA1691 BINDING SITE, designated SEQ ID:44460, to the nucleotide sequence of VGAM1038 RNA, herein designated VGAM RNA, also designated SEQ ID:3749.

Another function of VGAM1038 is therefore inhibition of KIAA1691 (Accession XM_166523). Accordingly, utilities of VGAM1038 include diagnosis, prevention and treatment of diseases and clinical conditions associated with KIAA1691. KIAA1856 (Accession XM_166549) is another VGAM1038 host target gene. KIAA1856 BINDING SITE is HOST TARGET binding site found in the 3' untranslated region of mRNA encoded by KIAA1856, corresponding to a HOST TARGET binding site such as BINDING SITE I, BINDING SITE II or BINDING SITE III. Table 2 illustrates the complementarity of the nucleotide sequences of KIAA1856 BINDING SITE, designated SEQ ID:44521, to the nucleotide sequence of VGAM1038 RNA, herein designated VGAM RNA, also designated SEQ ID:3749.

Another function of VGAM1038 is therefore inhibition of KIAA1856 (Accession XM_166549). Accordingly, utilities of VGAM1038 include diagnosis, prevention and treatment of diseases and clinical conditions associated with KIAA1856. PRO0386 (Accession NM_018562) is another VGAM1038 host target gene. PRO0386 BINDING SITE is HOST TARGET binding site found in the 5' untranslated region of mRNA encoded by PRO0386, corresponding to a HOST TARGET binding site such as BINDING SITE I, BINDING SITE II or BINDING SITE III. Table 2 illustrates the complementarity of the nucleotide sequences of PRO0386 BINDING SITE, designated SEQ ID:20647, to the nucleotide sequence of VGAM1038 RNA, herein designated VGAM RNA, also designated SEQ ID:3749.

Another function of VGAM1038 is therefore inhibition of PRO0386 (Accession NM_018562). Accordingly, utilities of VGAM1038 include diagnosis, prevention and treatment of diseases and clinical conditions associated with PRO0386. RAP140 (Accession NM_015224) is another VGAM1038 host target gene. RAP140 BINDING SITE is HOST TARGET binding site found in the 3' untranslated region of mRNA encoded by RAP140, corresponding to a HOST TARGET binding site such as BINDING SITE I, BINDING SITE II or BINDING SITE III. Table 2 illustrates the complementarity of the nucleotide sequences of RAP140 BINDING SITE, designated SEQ ID:17556, to the nucleotide sequence of VGAM1038 RNA, herein designated VGAM RNA, also designated SEQ ID:3749.

Another function of VGAM1038 is therefore inhibition of RAP140 (Accession NM_015224). Accordingly, utilities of VGAM1038 include diagnosis, prevention and treatment of diseases and clinical conditions associated with RAP140. Serologically Defined Colon Cancer Antigen 3 (SDCCAG3, Accession NM_006643) is another VGAM1038 host target gene. SDCCAG3 BINDING SITE is HOST TARGET binding site found in the 5' untranslated region of mRNA encoded by SDCCAG3, corresponding to a HOST TARGET binding site such as BINDING SITE I, BINDING SITE II or BINDING SITE III. Table 2 illustrates the complementarity of the nucleotide sequences of SDCCAG3 BINDING SITE, designated SEQ ID:13434, to the nucleotide sequence of VGAM1038 RNA, herein designated VGAM RNA, also designated SEQ ID:3749.

Another function of VGAM1038 is therefore inhibition of Serologically Defined Colon Cancer Antigen 3 (SDCCAG3, Accession NM_006643). Accordingly, utilities of VGAM1038 include diagnosis, prevention and treatment of diseases and clinical conditions associated with SDCCAG3. LOC122769 (Accession XM_058657) is another VGAM1038 host target gene. LOC122769 BINDING SITE is HOST TARGET binding site found in the 5' untranslated region of mRNA encoded by LOC122769, corresponding to a HOST TARGET binding site such as BINDING SITE I, BINDING SITE II or BINDING SITE III. Table 2 illustrates the complementarity of the nucleotide sequences of LOC122769 BINDING SITE, designated SEQ ID:36694, to the nucleotide sequence of VGAM1038 RNA, herein designated VGAM RNA, also designated SEQ ID:3749.

Another function of VGAM1038 is therefore inhibition of LOC122769 (Accession XM_058657). Accordingly, utilities of VGAM1038 include diagnosis, prevention and treatment of diseases and clinical conditions associated with LOC122769. LOC256901 (Accession XM_172952) is another VGAM1038 host target gene. LOC256901 BINDING SITE is HOST TARGET binding site found in the 5' untranslated region of mRNA encoded by LOC256901, corresponding to a HOST TARGET binding site such as BINDING SITE I, BINDING SITE II or BINDING SITE III. Table 2 illustrates the complementarity of the nucleotide sequences of LOC256901 BINDING SITE, designated SEQ ID:46206, to the nucleotide sequence of VGAM1038 RNA, herein designated VGAM RNA, also designated SEQ ID:3749.

Another function of VGAM1038 is therefore inhibition of LOC256901 (Accession XM_172952). Accordingly, utilities of VGAM1038 include diagnosis, prevention and treatment of diseases and clinical conditions associated with LOC256901. FIG. 1 further provides a conceptual description of a novel bioinformatically detected viral gene of the present invention, referred to here as Viral Genomic Address Messenger 1039 (VGAM1039) viral gene, which modulates expression of respective host target genes thereof, the function and utility of which host target genes is known in the art.

VGAM1039 is a novel bioinformatically detected regulatory, non protein coding, viral micro RNA (miRNA) gene. The method by which VGAM1039 was detected is described hereinabove with reference to FIGS. 1-8.

VGAM1039 gene, herein designated VGAM GENE, is a viral gene contained in the genome of Molluscum Contagiosum Virus. VGAM1039 host target gene, herein designated VGAM HOST TARGET GENE, is a human gene contained in the human genome.

VGAM1039 gene encodes a VGAM1039 precursor RNA, herein designated VGAM PRECURSOR RNA. Similar to other miRNA genes, and unlike most ordinary genes, VGAM1039 precursor RNA does not encode a protein. A nucleotide sequence identical or highly similar to the nucleotide sequence of VGAM1039 precursor RNA is designated SEQ ID:1025, and is provided hereinbelow with reference to the sequence listing part. Nucleotide sequence SEQ ID:1025 is located at position 95607 relative to the genome of Molluscum Contagiosum Virus.

VGAM1039 precursor RNA folds onto itself, forming VGAM1039 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1039 folded precursor RNA into VGAM1039 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1039 RNA is designated SEQ ID:3750, and is provided hereinbelow with reference to the sequence listing part.

VGAM1039 host target gene, herein designated VGAM HOST TARGET GENE, encodes a corresponding messenger RNA, VGAM1039 host target RNA, herein designated VGAM HOST TARGET RNA. VGAM1039 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1039 RNA, herein designated VGAM RNA, binds complementarily to one or more host target binding sites located in untranslated regions of VGAM1039 host target RNA, herein designated VGAM HOST TARGET RNA. This complementary binding is due to the fact that the nucleotide sequence of VGAM1039 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1039 RNA, herein designated VGAM RNA, may have a different number of host target binding sites in untranslated regions of a VGAM1039 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1039 RNA, herein designated VGAM RNA, to host target binding sites on VGAM1039 host target RNA, herein designated VGAM HOST TARGET RNA, such as BINDING SITE I, BINDING SITE II and BINDING SITE III, inhibits translation of VGAM1039 host target RNA into VGAM1039 host target protein, herein designated VGAM HOST TARGET PROTEIN. VGAM host target protein is therefore outlined by a broken line.

It is appreciated that VGAM1039 host target gene, herein designated VGAM HOST TARGET GENE, in fact represents a plurality of VGAM1039 host target genes. The mRNA of each one of this plurality of VGAM1039 host target genes comprises one or more host target binding sites, each having a nucleotide sequence which is at least partly complementary to VGAM1039 RNA, herein designated VGAM RNA, and which when bound by VGAM1039 RNA causes inhibition of translation of respective one or more VGAM1039 host target proteins.

It is further appreciated by one skilled in the art that the mode of translational inhibition illustrated by FIG. 1 with specific reference to translational inhibition exerted by VGAM1039 gene, herein designated VGAM GENE, on one or more VGAM1039 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1039 is inhibition of expression of host target genes, as part of a novel viral mechanism of attacking a host. Accordingly, utilities of VGAM1039 include diagnosis, prevention and treatment of viral infection by Molluscum Contagiosum Virus. Specific functions, and accordingly utilities, of VGAM1039 correlate with, and may be deduced from, the identity of the host target genes which VGAM1039 binds and inhibits, and the function of these target genes, as elaborated hereinbelow.

Nucleotide sequences of the VGAM1039 precursor RNA, herein designated VGAM PRECURSOR RNA, and of the 'diced' VGAM1039 RNA, herein designated VGAM RNA, and a schematic representation of the secondary folding of VGAM1039 folded precursor RNA, herein designated VGAM FOLDED PRECURSOR RNA, of VGAM1039 are further described hereinbelow with reference to Table 1.

Nucleotide sequences of host target binding sites, such as BINDING SITE-I, BINDING SITE-II and BINDING SITE-III of FIG. 1, found on VGAM1039 host target RNA, and schematic representation of the complementarity of each of these host target binding sites to VGAM1039 RNA, herein designated VGAM RNA, are described hereinbelow with reference to Table 2.

As mentioned hereinabove with reference to FIG. 1, a function of VGAM1039 gene, herein designated VGAM is inhibition of expression of VGAM1039 target genes. It is appreciated that specific functions, and accordingly utilities, of VGAM1039 correlate with, and may be deduced from, the identity of the target genes which VGAM1039 binds and inhibits, and the function of these target genes, as elaborated hereinbelow.

A Disintegrin and Metalloproteinase Domain 12 (meltrin alpha) (ADAM12, Accession NM_003474) is a VGAM1039 host target gene. ADAM12 BINDING SITE is HOST TARGET binding site found in the 5' untranslated region of mRNA encoded by ADAM12, corresponding to a HOST TARGET binding site such as BINDING SITE I, BINDING SITE II or BINDING SITE III. Table 2 illustrates the complementarity of the nucleotide sequences of ADAM12 BINDING SITE, designated SEQ ID:9544, to the nucleotide sequence of VGAM1039 RNA, herein designated VGAM RNA, also designated SEQ ID:3750.

A function of VGAM1039 is therefore inhibition of A Disintegrin and Metalloproteinase Domain 12 (meltrin alpha) (ADAM12, Accession NM_003474), a gene which involved in skeletal muscle regeneration, specifically at the onset of cell fusion. Accordingly, utilities of VGAM1039 include diagnosis, prevention and treatment of diseases and clinical conditions associated with ADAM12. The function of ADAM12 and its association with various diseases and clinical conditions, has been established by previous studies, as described hereinabove with reference to VGAM675. Cyclin-dependent Kinase Inhibitor 2A (melanoma, p16, inhibits CDK4) (CDKN2A, Accession NM_058197) is another VGAM1039 host target gene. CDKN2A BINDING SITE is HOST TARGET binding site found in the 3' untranslated region of mRNA encoded by CDKN2A, corresponding to a HOST TARGET binding site such as BINDING SITE I, BINDING SITE II or BINDING SITE III. Table 2 illustrates the complementarity of the nucleotide sequences of CDKN2A BINDING SITE, designated SEQ ID:27758, to the nucleotide sequence of VGAM1039 RNA, herein designated VGAM RNA, also designated SEQ ID:3750.

Another function of VGAM1039 is therefore inhibition of Cyclin-dependent Kinase Inhibitor 2A (melanoma, p16, inhibits CDK4) (CDKN2A, Accession NM_058197). Accordingly, utilities of VGAM1039 include diagnosis, prevention and treatment of diseases and clinical conditions associated with CDKN2A. Cyclin-dependent Kinase Inhibitor 2B (p15, inhibits CDK4) (CDKN2B, Accession NM_078487) is another VGAM1039 host target gene. CDKN2B BINDING SITE is HOST TARGET binding site found in the 3" untranslated region of mRNA encoded by CDKN2B, corresponding to a HOST TARGET binding site such as BINDING SITE I, BINDING SITE II or BINDING SITE III. Table 2 illustrates the complementarity of the nucleotide sequences of CDKN2B BINDING SITE, designated SEQ ID:27808, to the nucleotide sequence of VGAM1039 RNA, herein designated VGAM RNA, also designated SEQ ID:3750.

Another function of VGAM1039 is therefore inhibition of Cyclin-dependent Kinase Inhibitor 2B (p15, inhibits CDK4) (CDKN2B, Accession NM_078487). Accordingly, utilities of VGAM1039 include diagnosis, prevention and treatment of diseases and clinical conditions associated with CDKN2B. Cerebellin 1 Precursor (CBLN1, Accession NM_004352) is another VGAM1039 host target gene. CBLN1 BINDING SITE is HOST TARGET binding site found in the 5' untranslated region of mRNA encoded by CBLN1, corresponding to a HOST TARGET binding site such as BINDING SITE I, BINDING SITE II or BINDING SITE III. Table 2 illustrates the complementarity of the nucleotide sequences of CBLN1 BINDING SITE, designated SEQ ID:10558, to the nucleotide sequence of VGAM1039 RNA, herein designated VGAM RNA, also designated SEQ ID:3750.

Another function of VGAM1039 is therefore inhibition of Cerebellin 1 Precursor (CBLN1, Accession NM_004352). Accordingly, utilities of VGAM1039 include diagnosis, prevention and treatment of diseases and clinical conditions associated with CBLN1. KIAA1904 (Accession XM_056282) is another VGAM1039 host target gene. KIAA1904 BINDING SITE is HOST TARGET binding site found in the 3' untranslated region of mRNA encoded by KIAA1904, corresponding to a HOST TARGET binding site such as BINDING SITE I, BINDING SITE II or BINDING SITE III. Table 2 illustrates the complementarity of the nucleotide sequences of KIAA1904 BINDING SITE, designated SEQ ID:36380, to the nucleotide sequence of VGAM1039 RNA, herein designated VGAM RNA, also designated SEQ ID:3750.

Another function of VGAM1039 is therefore inhibition of KIAA1904 (Accession XM_056282). Accordingly, utilities of VGAM1039 include diagnosis, prevention and treatment of diseases and clinical conditions associated with KIAA1904. Retinoic Acid Induced 1 (RAI1, Accession XM_016259) is another VGAM1039 host target gene. RAI1 BINDING SITE is HOST TARGET binding site found in the 5' untranslated region of mRNA encoded by RAI1, corresponding to a HOST TARGET binding site such as BINDING SITE I, BINDING SITE II or BINDING SITE III. Table 2 illustrates the complementarity of the nucleotide sequences of RAI1 BINDING SITE, designated SEQ ID:30254, to the nucleotide sequence of VGAM1039 RNA, herein designated VGAM RNA, also designated SEQ ID:3750.

Another function of VGAM1039 is therefore inhibition of Retinoic Acid Induced 1 (RAI1, Accession XM_016259). Accordingly, utilities of VGAM1039 include diagnosis, prevention and treatment of diseases and clinical conditions associated with RAI1. RINZF (Accession NM_023929) is another VGAM1039 host target gene. RINZF BINDING SITE is HOST TARGET binding site found in the 5' untranslated region of mRNA encoded by RINZF, corresponding to a HOST TARGET binding site such as BINDING SITE I, BINDING SITE II or BINDING SITE III. Table 2 illustrates the complementarity of the nucleotide sequences of RINZF BINDING SITE, designated SEQ ID:23412, to the nucleotide sequence of VGAM1039 RNA, herein designated VGAM RNA, also designated SEQ ID:3750.

Another function of VGAM1039 is therefore inhibition of RINZF (Accession NM_023929). Accordingly, utilities of VGAM1039 include diagnosis, prevention and treatment of diseases and clinical conditions associated with RINZF. SH3 and Multiple Ankyrin Repeat Domains 3 (SHANK3, Accession XM_037493) is another VGAM1039 host target gene. SHANK3 BINDING SITE is HOST TARGET binding site found in the 5' untranslated region of mRNA encoded by SHANK3, corresponding to a HOST TARGET binding site such as BINDING SITE I, BINDING SITE II or BINDING SITE III. Table 2 illustrates the complementarity of the nucleotide sequences of SHANK3 BINDING SITE, designated SEQ ID:32635, to the nucleotide sequence of VGAM1039 RNA, herein designated VGAM RNA, also designated SEQ ID:3750.

Another function of VGAM1039 is therefore inhibition of SH3 and Multiple Ankyrin Repeat Domains 3 (SHANK3, Accession XM_037493). Accordingly, utilities of VGAM1039 include diagnosis, prevention and treatment of diseases and clinical conditions associated with SHANK3. LOC201292 (Accession XM_113949) is another VGAM1039 host target gene. LOC201292 BINDING SITE is HOST TARGET binding site found in the 5' untranslated region of mRNA encoded by LOC201292, corresponding to a HOST TARGET binding site such as BINDING SITE I, BINDING SITE II or BINDING SITE III. Table 2 illustrates the complementarity of the nucleotide sequences of LOC201292 BINDING SITE, designated SEQ ID:42564, to the nucleotide sequence of VGAM1039 RNA, herein designated VGAM RNA, also designated SEQ ID:3750.

Another function of VGAM1039 is therefore inhibition of LOC201292 (Accession XM_113949). Accordingly, utilities of VGAM1039 include diagnosis, prevention and treatment of diseases and clinical conditions associated with LOC201292. FIG. 1 further provides a conceptual description of a novel bioinformatically detected viral gene of the present invention, referred to here as Viral Genomic Address Messenger 1040 (VGAM1040) viral gene, which modulates expression of respective host target genes thereof, the function and utility of which host target genes is known in the art.

VGAM1040 is a novel bioinformatically detected regulatory, non protein coding, viral micro RNA (miRNA) gene. The method by which VGAM1040 was detected is described hereinabove with reference to FIGS. 1-8.

VGAM1040 gene, herein designated VGAM GENE, is a viral gene contained in the genome of Molluscum Contagiosum Virus. VGAM1040 host target gene, herein designated VGAM HOST TARGET GENE, is a human gene contained in the human genome.

VGAM1040 gene encodes a VGAM1040 precursor RNA, herein designated VGAM PRECURSOR RNA. Similar to other miRNA genes, and unlike most ordinary genes, VGAM1040 precursor RNA does not encode a protein. A nucleotide sequence identical or highly similar to the nucleotide sequence of VGAM1040 precursor RNA is designated SEQ ID:1026, and is provided hereinbelow with reference to the sequence listing part. Nucleotide sequence SEQ ID:1026 is located at position 92882 relative to the genome of Molluscum Contagiosum Virus.

VGAM1040 precursor RNA folds onto itself, forming VGAM1040 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1040 folded precursor RNA into VGAM1040 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 45%) nucleotide sequence of VGAM1040 RNA is designated SEQ ID:3751, and is provided hereinbelow with reference to the sequence listing part.

VGAM1040 host target gene, herein designated VGAM HOST TARGET GENE, encodes a corresponding messenger RNA, VGAM1040 host target RNA, herein designated VGAM HOST TARGET RNA. VGAM1040 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1040 RNA, herein designated VGAM RNA, binds complementarily to one or more host target binding sites located in untranslated regions of VGAM1040 host target RNA, herein designated VGAM HOST TARGET RNA. This complementary binding is due to the fact that the nucleotide sequence of VGAM1040 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1040 RNA, herein designated VGAM RNA, may have a different number of host target binding sites in untranslated regions of a VGAM1040 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1040 RNA, herein designated VGAM RNA, to host target binding sites on VGAM1040 host target RNA, herein designated VGAM HOST TARGET RNA, such as BINDING SITE I, BINDING SITE II and BINDING SITE III, inhibits translation of VGAM1040 host target RNA into VGAM1040 host target protein, herein designated VGAM HOST TARGET PROTEIN. VGAM host target protein is therefore outlined by a broken line.

It is appreciated that VGAM1040 host target gene, herein designated VGAM HOST TARGET GENE, in fact represents a plurality of VGAM1040 host target genes. The mRNA of each one of this plurality of VGAM1040 host target genes comprises one or more host target binding sites, each having a nucleotide sequence which is at least partly complementary to VGAM1040 RNA, herein designated VGAM RNA, and which when bound by VGAM1040 RNA causes inhibition of translation of respective one or more VGAM1040 host target proteins.

It is further appreciated by one skilled in the art that the mode of translational inhibition illustrated by FIG. 1 with specific reference to translational inhibition exerted by VGAM1040 gene, herein designated VGAM GENE, on one or more VGAM1040 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1040 is inhibition of expression of host target genes, as part of a novel viral mechanism of attacking a host. Accordingly, utilities of VGAM1040 include diagnosis, prevention and treatment of viral infection by Molluscum Contagiosum Virus. Specific functions, and accordingly utilities, of VGAM1040 correlate with, and may be deduced from, the identity of the host target genes which VGAM1040 binds and inhibits, and the function of these host target genes, as elaborated hereinbelow.

Nucleotide sequences of the VGAM1040 precursor RNA, herein designated VGAM PRECURSOR RNA, and of the 'diced' VGAM1040 RNA, herein designated VGAM RNA, and a schematic representation of the secondary folding of VGAM1040 folded precursor RNA, herein designated VGAM FOLDED PRECURSOR RNA, of VGAM1040 are further described hereinbelow with reference to Table 1.

Nucleotide sequences of host target binding sites, such as BINDING SITE-I, BINDING SITE-II and BINDING SITE-III of FIG. 1, found on VGAM1040 host target RNA, and schematic representation of the complementarity of each of these host target binding sites to VGAM1040 RNA, herein designated VGAM RNA, are described hereinbelow with reference to Table 2.

As mentioned hereinabove with reference to FIG. 1, a function of VGAM1040 gene, herein designated VGAM is inhibition of expression of VGAM1040 target genes. It is appreciated that specific functions, and accordingly utilities, of VGAM1040 correlate with, and may be deduced from, the identity of the target genes which VGAM1040 binds and inhibits, and the function of these target genes, as elaborated hereinbelow.

Sodium Channel, Nonvoltage-gated 1 Alpha (SCNN1A, Accession NM_001038) is a VGAM1040 host target gene. SCNN1A BINDING SITE is HOST TARGET binding site found in the 3' untranslated region of mRNA encoded by SCNN1A, corresponding to a HOST TARGET binding site such as BINDING SITE I, BINDING SITE II or BINDING SITE III. Table 2 illustrates the complementarity of the nucleotide sequences of SCNN1A BINDING SITE, designated SEQ ID:6702, to the nucleotide sequence of VGAM1040 RNA, herein designated VGAM RNA, also designated SEQ ID:3751.

A function of VGAM1040 is therefore inhibition of Sodium Channel, Nonvoltage-gated 1 Alpha (SCNN1A, Accession NM_001038). Accordingly, utilities of VGAM1040 include diagnosis, prevention and treatment of diseases and clinical conditions associated with SCNN1A. Degenerative Spermatocyte Homolog, Lipid Desaturase (Drosophila) (DEGS, Accession NM_003676) is another VGAM1040 host target gene. DEGS BINDING SITE is HOST TARGET binding site found in the 3' untranslated region of mRNA encoded by DEGS, corresponding to a HOST TARGET binding site such as BINDING SITE I, BINDING SITE II or BINDING SITE III. Table 2 illustrates the complementarity of the nucleotide sequences of DEGS BINDING SITE, designated SEQ ID:9769, to the nucleotide sequence of VGAM1040 RNA, herein designated VGAM RNA, also designated SEQ ID:3751.

Another function of VGAM1040 is therefore inhibition of Degenerative Spermatocyte Homolog, Lipid Desaturase (Drosophila) (DEGS, Accession NM_003676). Accordingly, utilities of VGAM1040 include diagnosis, prevention and treatment of diseases and clinical conditions associated with DEGS. KIAA0040 (Accession NM_014656) is another VGAM1040 host target gene. KIAA0040 BINDING SITE is HOST TARGET binding site found in the 3' untranslated region of mRNA encoded by KIAA0040, corresponding to a HOST TARGET binding site such as BINDING SITE I, BINDING SITE II or BINDING SITE III. Table 2 illustrates the complementarity of the nucleotide sequences of KIAA0040 BINDING SITE, designated SEQ ID:16099, to the nucleotide sequence of VGAM1040 RNA, herein designated VGAM RNA, also designated SEQ ID:3751.

Another function of VGAM1040 is therefore inhibition of KIAA0040 (Accession NM_014656). Accordingly, utilities of VGAM1040 include diagnosis, prevention and treatment of diseases and clinical conditions associated with KIAA0040. TNF Receptor-associated Factor 4 (TRAF4, Accession XM_031427) is another VGAM1040 host target gene. TRAF4 BINDING SITE is HOST TARGET binding site found in the 3' untranslated region of mRNA encoded by TRAF4, corresponding to a HOST TARGET binding site such as BINDING SITE I, BINDING SITE II or BINDING SITE III. Table 2 illustrates the complementarity of the nucleotide sequences of TRAF4 BINDING SITE, designated SEQ ID:31377, to the nucleotide sequence of VGAM1040 RNA, herein designated VGAM RNA, also designated SEQ ID:3751.

Another function of VGAM1040 is therefore inhibition of TNF Receptor-associated Factor 4 (TRAF4, Accession XM_031427). Accordingly, utilities of VGAM1040 include diagnosis, prevention and treatment of diseases and clinical conditions associated with TRAF4. LOC153196 (Accession XM_098323) is another VGAM1040 host target gene. LOC153196 BINDING SITE is HOST TARGET binding site found in the 5' untranslated region of mRNA encoded by LOC153196, corresponding to a HOST TARGET binding site such as BINDING SITE I, BINDING SITE II or BINDING SITE III. Table 2 illustrates the complementarity of the nucleotide sequences of LOC153196 BINDING SITE, designated SEQ ID:41585, to the nucleotide sequence of VGAM1040 RNA, herein designated VGAM RNA, also designated SEQ ID:3751.

Another function of VGAM1040 is therefore inhibition of LOC153196 (Accession XM_098323). Accordingly, utilities of VGAM1040 include diagnosis, prevention and treatment of diseases and clinical conditions associated with LOC153196. FIG. 1 further provides a conceptual description of a novel bioinformatically detected viral gene of the present invention, referred to here as Viral Genomic Address Messenger 1041 (VGAM1041) viral gene, which modulates expression of respective host target genes thereof, the function and utility of which host target genes is known in the art.

VGAM1041 is a novel bioinformatically detected regulatory, non protein coding, viral micro RNA (miRNA) gene. The method by which VGAM1041 was detected is described hereinabove with reference to FIGS. 1-8.

VGAM1041 gene, herein designated VGAM GENE, is a viral gene contained in the genome of White Clover Mosaic Virus. VGAM1041 host target gene, herein designated VGAM HOST TARGET GENE, is a human gene contained in the human genome.

VGAM1041 gene encodes a VGAM1041 precursor RNA, herein designated VGAM PRECURSOR RNA. Similar to other miRNA genes, and unlike most ordinary genes, VGAM1041 precursor RNA does not encode a protein. A nucleotide sequence identical or highly similar to the nucleotide sequence of VGAM1041 precursor RNA is designated SEQ ID:1027, and is provided hereinbelow with reference to the sequence listing part. Nucleotide sequence SEQ ID:1027 is located at position 1636 relative to the genome of White Clover Mosaic Virus.

VGAM1041 precursor RNA folds onto itself, forming VGAM1041 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1041 folded precursor RNA into VGAM1041 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1041 RNA is designated SEQ ID:3752, and is provided hereinbelow with reference to the sequence listing part.

VGAM1041 host target gene, herein designated VGAM HOST TARGET GENE, encodes a corresponding messenger RNA, VGAM1041 host target RNA, herein designated VGAM HOST TARGET RNA. VGAM1041 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1041 RNA, herein designated VGAM RNA, binds complementarily to one or more host target binding sites located in untranslated regions of VGAM1041 host target RNA, herein designated VGAM HOST TARGET RNA. This complementary binding is due to the fact that the nucleotide sequence of VGAM1041 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1041 RNA, herein designated VGAM RNA, may have a different number of host target binding sites in untranslated regions of a VGAM1041 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1041 RNA, herein designated VGAM RNA, to host target binding sites on VGAM1041 host target RNA, herein designated VGAM HOST TARGET RNA, such as BINDING SITE I, BINDING SITE II and BINDING SITE III, inhibits translation of VGAM1041 host target RNA into VGAM1041 host target protein, herein designated VGAM HOST TARGET PROTEIN. VGAM host target protein is therefore outlined by a broken line.

It is appreciated that VGAM1041 host target gene, herein designated VGAM HOST TARGET GENE, in fact represents a plurality of VGAM1041 host target genes. The mRNA of each one of this plurality of VGAM1041 host target genes comprises one or more host target binding sites, each having a nucleotide sequence which is at least partly complementary to VGAM1041 RNA, herein designated VGAM RNA, and which when bound by VGAM1041 RNA causes inhibition of translation of respective one or more VGAM1041 host target proteins.

It is further appreciated by one skilled in the art that the mode of translational inhibition illustrated by FIG. 1 with specific reference to translational inhibition exerted by VGAM1041 gene, herein designated VGAM GENE, on one or more VGAM1041 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1041 is inhibition of expression of host target genes, as part of a novel viral mechanism of attacking a host. Accordingly, utilities of VGAM1041 include diagnosis, prevention and treatment of viral infection by White Clover Mosaic Virus. Specific functions, and accordingly utilities, of VGAM1041 correlate with, and may be deduced from, the identity of the host target genes which VGAM1041 binds and inhibits, and the function of these host target genes, as elaborated hereinbelow.

Nucleotide sequences of the VGAM1041 precursor RNA, herein designated VGAM PRECURSOR RNA, and of the 'diced' VGAM1041 RNA, herein designated VGAM RNA, and a schematic representation of the secondary folding of VGAM1041 folded precursor RNA, herein designated VGAM FOLDED PRECURSOR RNA, of VGAM1041 are further described hereinbelow with reference to Table 1.

Nucleotide sequences of host target binding sites, such as BINDING SITE-I, BINDING SITE-II and BINDING SITE-III of FIG. 1, found on VGAM1041 host target RNA, and schematic representation of the complementarity of each of these host target binding sites to VGAM1041 RNA, herein designated VGAM RNA, are described hereinbelow with reference to Table 2.

As mentioned hereinabove with reference to FIG. 1, a function of VGAM1041 gene, herein designated VGAM is inhibition of expression of VGAM1041 target genes. It is appreciated that specific functions, and accordingly utilities, of VGAM1041 correlate with, and may be deduced from, the identity of the target genes which VGAM1041 binds and inhibits, and the function of these target genes, as elaborated hereinbelow.

Glucocorticoid Receptor DNA Binding Factor 1 (GRLF1, Accession XM_085943) is a VGAM1041 host target gene. GRLF1 BINDING SITE is HOST TARGET binding site found in the 3' untranslated region of mRNA encoded by GRLF1, corresponding to a HOST TARGET binding site such as BINDING SITE I, BINDING SITE II or BINDING SITE III. Table 2 illustrates the complementarity of the nucleotide sequences of GRLF1 BINDING SITE, designated SEQ ID:38410, to the nucleotide sequence of VGAM1041 RNA, herein designated VGAM RNA, also designated SEQ ID:3752.

A function of VGAM1041 is therefore inhibition of Glucocorticoid Receptor DNA Binding Factor 1 (GRLF1, Accession XM_085943), a gene which inhibits transcription of the glucocorticoid receptor gene. Accordingly, utilities of VGAM1041 include diagnosis, prevention and treatment of diseases and clinical conditions associated with GRLF1. The function of GRLF1 and its association with various diseases and clinical conditions, has been established by previous studies, as described hereinabove with reference to VGAM55. BA108L7.2 (Accession NM_030971) is another VGAM1041 host target gene. BA108L7.2 BINDING SITE is HOST TARGET binding site found in the 3' untranslated region of mRNA encoded by BA108L7.2, corresponding to a HOST TARGET binding site such as BINDING SITE I, BINDING SITE II or BINDING SITE III. Table 2 illustrates the complementarity of the nucleotide sequences of BA108L7.2 BINDING SITE, designated SEQ ID:25236, to the nucleotide sequence of VGAM1041 RNA, herein designated VGAM RNA, also designated SEQ ID:3752.

Another function of VGAM1041 is therefore inhibition of BA108L7.2 (Accession NM_030971). Accordingly, utilities of VGAM1041 include diagnosis, prevention and treatment of diseases and clinical conditions associated with BA108L7.2. CDT1 (Accession XM_085327) is another VGAM1041 host target gene. CDT1 BINDING SITE is HOST TARGET binding site found in the 5' untranslated region of mRNA encoded by CDT1, corresponding to a HOST TARGET binding site such as BINDING SITE I, BINDING SITE II or BINDING SITE III. Table 2 illustrates the complementarity of the nucleotide sequences of CDT1 BINDING SITE, designated SEQ ID:38068, to the nucleotide sequence of VGAM1041 RNA, herein designated VGAM RNA, also designated SEQ ID:3752.

Another function of VGAM1041 is therefore inhibition of CDT1 (Accession XM_085327). Accordingly, utilities of VGAM1041 include diagnosis, prevention and treatment of diseases and clinical conditions associated with CDT1. KIAA0992 (Accession NM_016081) is another VGAM1041 host target gene. KIAA0992 BINDING SITE is HOST TARGET binding site found in the 3' untranslated region of mRNA encoded by KIAA0992, corresponding to a HOST TARGET binding site such as BINDING SITE I, BINDING SITE II or BINDING SITE III. Table 2 illustrates the complementarity of the nucleotide sequences of KIAA0992 BINDING SITE, designated SEQ ID:18155, to the nucleotide sequence of VGAM1041 RNA, herein designated VGAM RNA, also designated SEQ ID:3752.

Another function of VGAM1041 is therefore inhibition of KIAA0992 (Accession NM_016081). Accordingly, utilities of VGAM1041 include diagnosis, prevention and treatment of diseases and clinical conditions associated with KIAA0992. KIAA1181 (Accession XM_043340) is another VGAM1041 host target gene. KIAA1181 BINDING SITE is HOST TARGET binding site found in the 3' untranslated region of mRNA encoded by KIAA1181, corresponding to a HOST TARGET binding site such as BINDING SITE I, BINDING SITE II or BINDING SITE III. Table 2 illustrates the complementarity of the nucleotide sequences of KIAA1181 BINDING SITE, designated SEQ ID:33922, to the nucleotide sequence of VGAM1041 RNA, herein designated VGAM RNA, also designated SEQ ID:3752.

Another function of VGAM1041 is therefore inhibition of KIAA1181 (Accession XM_043340). Accordingly, utilities of VGAM1041 include diagnosis, prevention and treatment of diseases and clinical conditions associated with KIAA1181. MIG (Accession NM_002416) is another VGAM1041 host target gene. MIG BINDING SITE is HOST TARGET binding site found in the 3' untranslated region of mRNA encoded by MIG, corresponding to a HOST TARGET binding site such as BINDING SITE I, BINDING SITE II or BINDING SITE III. Table 2 illustrates the complementarity of the nucleotide sequences of MIG BINDING SITE, designated SEQ ID:8242, to the nucleotide sequence of VGAM1041 RNA, herein designated VGAM RNA, also designated SEQ ID:3752.

Another function of VGAM1041 is therefore inhibition of MIG (Accession NM_002416). Accordingly, utilities of VGAM1041 include diagnosis, prevention and treatment of diseases and clinical conditions associated with MIG. LOC196485 (Accession XM_113731) is another VGAM1041 host target gene. LOC196485 BINDING SITE is HOST TARGET binding site found in the 5' untranslated region of mRNA encoded by LOC196485, corresponding to a HOST TARGET binding site such as BINDING SITE I, BINDING SITE II or BINDING SITE III. Table 2 illustrates the complementarity of the nucleotide sequences of LOC196485 BINDING SITE, designated SEQ ID:42380, to the nucleotide sequence of VGAM1041 RNA, herein designated VGAM RNA, also designated SEQ ID:3752.

Another function of VGAM1041 is therefore inhibition of LOC196485 (Accession XM_113731). Accordingly, utilities of VGAM1041 include diagnosis, prevention and treatment of diseases and clinical conditions associated with LOC196485. FIG. 1 further provides a conceptual description of a novel bioinformatically detected viral gene of the present invention, referred to here as Viral Genomic Address Messenger 1042 (VGAM1042) viral gene, which modulates expression of respective host target genes thereof, the function and utility of which host target genes is known in the art.

VGAM1042 is a novel bioinformatically detected regulatory, non protein coding, viral micro RNA (miRNA) gene. The method by which VGAM1042 was detected is described hereinabove with reference to FIGS. 1-8.

VGAM1042 gene, herein designated VGAM GENE, is a viral gene contained in the genome of White Clover Mosaic Virus. VGAM1042 host target gene, herein designated VGAM HOST TARGET GENE, is a human gene contained in the human genome.

VGAM1042 gene encodes a VGAM1042 precursor RNA, herein designated VGAM PRECURSOR RNA. Similar to other miRNA genes, and unlike most ordinary genes, VGAM1042 precursor RNA does not encode a protein. A nucleotide sequence identical or highly similar to the nucleotide sequence of VGAM1042 precursor RNA is designated SEQ ID:1028, and is provided hereinbelow with reference to the sequence listing part. Nucleotide sequence SEQ ID:1028 is located at position 3519 relative to the genome of White Clover Mosaic Virus.

VGAM1042 precursor RNA folds onto itself, forming VGAM1042 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1042 folded precursor RNA into VGAM1042 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM1042 RNA is designated SEQ ID:3753, and is provided hereinbelow with reference to the sequence listing part.

VGAM1042 host target gene, herein designated VGAM HOST TARGET GENE, encodes a corresponding messenger RNA, VGAM1042 host target RNA, herein designated VGAM HOST TARGET RNA. VGAM1042 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1042 RNA, herein designated VGAM RNA, binds complementarily to one or more host target binding sites located in untranslated regions of VGAM1042 host target RNA, herein designated VGAM HOST TARGET RNA. This complementary binding is due to the fact that the nucleotide sequence of VGAM1042 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1042 RNA, herein designated VGAM RNA, may have a different number of host target binding sites in untranslated regions of a VGAM1042 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1042 RNA, herein designated VGAM RNA, to host target binding sites on VGAM1042 host target RNA, herein designated VGAM HOST TARGET RNA, such as BINDING SITE I, BINDING SITE II and BINDING SITE III, inhibits translation of VGAM1042 host target RNA into VGAM1042 host target protein, herein designated VGAM HOST TARGET PROTEIN. VGAM host target protein is therefore outlined by a broken line.

It is appreciated that VGAM1042 host target gene, herein designated VGAM HOST TARGET GENE, in fact represents a plurality of VGAM1042 host target genes. The mRNA of each one of this plurality of VGAM1042 host target genes comprises one or more host target binding sites, each having a nucleotide sequence which is at least partly complementary to VGAM1042 RNA, herein designated VGAM RNA, and which when bound by VGAM1042 RNA causes inhibition of translation of respective one or more VGAM1042 host target proteins.

It is further appreciated by one skilled in the art that the mode of translational inhibition illustrated by FIG. 1 with specific reference to translational inhibition exerted by VGAM1042 gene, herein designated VGAM GENE, on one or more VGAM1042 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1042 is inhibition of expression of host target genes, as part of a novel viral mechanism of attacking a host. Accordingly, utilities of VGAM1042 include diagnosis, prevention and treatment of viral infection by White Clover Mosaic Virus. Specific functions, and accordingly utilities, of VGAM1042 correlate with, and may be deduced from, the identity of the host target genes which VGAM1042 binds and inhibits, and the function of these host target genes, as elaborated hereinbelow.

Nucleotide sequences of the VGAM1042 precursor RNA, herein designated VGAM PRECURSOR RNA, and of the 'diced' VGAM1042 RNA, herein designated VGAM RNA, and a schematic representation of the secondary folding of VGAM1042 folded precursor RNA, herein designated VGAM FOLDED PRECURSOR RNA, of VGAM1042 are further described hereinbelow with reference to Table 1.

Nucleotide sequences of host target binding sites, such as BINDING SITE-I, BINDING SITE-II and BINDING SITE-III of FIG. 1, found on VGAM1042 host target RNA, and schematic representation of the complementarity of each of these host target binding sites to VGAM1042 RNA, herein designated VGAM RNA, are described hereinbelow with reference to Table 2.

As mentioned hereinabove with reference to FIG. 1, a function of VGAM1042 gene, herein designated VGAM is inhibition of expression of VGAM1042 target genes. It is appreciated that specific functions, and accordingly utilities, of VGAM1042 correlate with, and may be deduced from, the identity of the target genes which VGAM1042 binds and inhibits, and the function of these target genes, as elaborated hereinbelow.

Endothelin 2 (EDN2, Accession NM_001956) is a VGAM1042 host target gene. EDN2 BINDING SITE is HOST TARGET binding site found in the 3' untranslated region of mRNA encoded by EDN2, corresponding to a HOST TARGET binding site such as BINDING SITE I, BINDING SITE II or BINDING SITE III. Table 2 illustrates the complementarity of the nucleotide sequences of EDN2 BINDING SITE, designated SEQ ID:7681, to the nucleotide sequence of VGAM1042 RNA, herein designated VGAM RNA, also designated SEQ ID:3753.

A function of VGAM1042 is therefore inhibition of Endothelin 2 (EDN2, Accession NM_001956), a gene which is a precursor of the hormone endothelin 2 which is an endothelium-derived vasoconstrictor peptide. Accordingly, utilities of VGAM1042 include diagnosis, prevention and treatment of diseases and clinical conditions associated with EDN2. The function of EDN2 and its association with various diseases and clinical conditions, has been established by previous studies, as described hereinabove with reference to VGAM1015. Centaurin, Gamma 2 (CENTG2, Accession NM_014914) is another VGAM1042 host target gene. CENTG2 BINDING SITE is HOST TARGET binding site found in the 3' untranslated region of mRNA encoded by CENTG2, corresponding to a HOST TARGET binding site such as BINDING SITE I, BINDING SITE II or BINDING SITE III. Table 2 illustrates the complementarity of the nucleotide sequences of CENTG2 BINDING SITE, designated SEQ ID:17156, to the nucleotide sequence of VGAM1042 RNA, herein designated VGAM RNA, also designated SEQ ID:3753.

Another function of VGAM1042 is therefore inhibition of Centaurin, Gamma 2 (CENTG2, Accession NM_014914). Accordingly, utilities of VGAM1042 include diagnosis, prevention and treatment of diseases and clinical conditions associated with CENTG2. Carbohydrate (N-acetylglucosamine 6-O) Sulfotransferase 4 (CHST4, Accession NM_005769) is another VGAM1042 host target gene. CHST4 BINDING SITE is HOST TARGET binding site found in the 3' untranslated region of mRNA encoded by CHST4, corresponding to a HOST TARGET binding site such as BINDING SITE I, BINDING SITE II or BINDING SITE III. Table 2 illustrates the complementarity of the nucleotide sequences of CHST4 BINDING SITE, designated SEQ ID:12336, to the nucleotide sequence of VGAM1042 RNA, herein designated VGAM RNA, also designated SEQ ID:3753.

Another function of VGAM1042 is therefore inhibition of Carbohydrate (N-acetylglucosamine 6-O) Sulfotransferase 4 (CHST4, Accession NM_005769). Accordingly, utilities of VGAM1042 include diagnosis, prevention and treatment of diseases and clinical conditions associated with CHST4. KIAA1889 (Accession XM_056298) is another VGAM1042 host target gene. KIAA1889 BINDING SITE is HOST TARGET binding site found in the 3' untranslated region of mRNA encoded by KIAA1889, corresponding to a HOST TARGET binding site such as BINDING SITE I, BINDING SITE II or BINDING SITE III. Table 2 illustrates the complementarity of the nucleotide sequences of KIAA1889 BINDING SITE, designated SEQ ID:36386, to the nucleotide sequence of VGAM1042 RNA, herein designated VGAM RNA, also designated SEQ ID:3753.

Another function of VGAM1042 is therefore inhibition of KIAA1889 (Accession XM_056298). Accordingly, utilities of VGAM1042 include diagnosis, prevention and treatment of diseases and clinical conditions associated with KIAA1889. Ribosomal Protein S6 Kinase, 90 kDa, Polypeptide 4 (RPS6KA4, Accession NM_003942) is another VGAM1042 host target gene. RPS6KA4 BINDING SITE is HOST TARGET binding site found in the 3' untranslated region of mRNA encoded by RPS6KA4, corresponding to a HOST TARGET binding site such as BINDING SITE I, BINDING SITE II or BINDING SITE III. Table 2 illustrates the complementarity of the nucleotide sequences of RPS6KA4 BINDING SITE, designated SEQ ID:10053, to the nucleotide sequence of VGAM1042 RNA, herein designated VGAM RNA, also designated SEQ ID:3753.

Another function of VGAM1042 is therefore inhibition of Ribosomal Protein S6 Kinase, 90 kDa, Polypeptide 4 (RPS6KA4, Accession NM_003942). Accordingly, utilities of VGAM1042 include diagnosis, prevention and treatment of diseases and clinical conditions associated with RPS6KA4. LOC151719 (Accession XM_087280) is another VGAM1042 host target gene. LOC151719 BINDING SITE is HOST TARGET binding site found in the 5' untranslated region of mRNA encoded by LOC151719, corresponding to a HOST TARGET binding site such as BINDING SITE I, BINDING SITE II or BINDING SITE III. Table 2 illustrates the complementarity of the nucleotide sequences of LOC151719 BINDING SITE, designated SEQ ID:39162, to the nucleotide sequence of VGAM1042 RNA, herein designated VGAM RNA, also designated SEQ ID:3753.

Another function of VGAM1042 is therefore inhibition of LOC151719 (Accession XM_087280). Accordingly, utilities of VGAM1042 include diagnosis, prevention and treatment of diseases and clinical conditions associated with LOC151719. LOC255040 (Accession XM_172837) is another VGAM1042 host target gene. LOC255040 BINDING SITE is HOST TARGET binding site found in the 5' untranslated region of mRNA encoded by LOC255040, corresponding to a HOST TARGET binding site such as BINDING SITE I, BINDING SITE II or BINDING SITE III. Table 2 illustrates the complementarity of the nucleotide sequences of LOC255040 BINDING SITE, designated SEQ ID:46110, to the nucleotide sequence of VGAM1042 RNA, herein designated VGAM RNA, also designated SEQ ID:3753.

Another function of VGAM1042 is therefore inhibition of LOC255040 (Accession XM_172837). Accordingly, utilities of VGAM1042 include diagnosis, prevention and treatment of diseases and clinical conditions associated with LOC255040. FIG. 1 further provides a conceptual description of a novel bioinformatically detected viral gene of the present invention, referred to here as Viral Genomic Address Messenger 1043 (VGAM1043) viral gene, which modulates expression of respective host target genes thereof, the function and utility of which host target genes is known in the art.

VGAM1043 is a novel bioinformatically detected regulatory, non protein coding, viral micro RNA (miRNA) gene. The method by which VGAM1043 was detected is described hereinabove with reference to FIGS. 1-8.

VGAM1043 gene, herein designated VGAM GENE, is a viral gene contained in the genome of White Clover Mosaic Virus. VGAM1043 host target gene, herein designated VGAM HOST TARGET GENE, is a human gene contained in the human genome.

VGAM1043 gene encodes a VGAM1043 precursor RNA, herein designated VGAM PRECURSOR RNA. Similar to other miRNA genes, and unlike most ordinary genes, VGAM1043 precursor RNA does not encode a protein. A nucleotide sequence identical or highly similar to the nucleotide sequence of VGAM1043 precursor RNA is designated SEQ ID:1029, and is provided hereinbelow with reference to the sequence listing part. Nucleotide sequence SEQ ID:1029 is located at position 5056 relative to the genome of White Clover Mosaic Virus.

VGAM1043 precursor RNA folds onto itself, forming VGAM1043 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1043 folded precursor RNA into VGAM1043 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 40%) nucleotide sequence of VGAM1043 RNA is designated SEQ ID:3754, and is provided hereinbelow with reference to the sequence listing part.

VGAM1043 host target gene, herein designated VGAM HOST TARGET GENE, encodes a corresponding messenger RNA, VGAM1043 host target RNA, herein designated VGAM HOST TARGET RNA. VGAM1043 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1043 RNA, herein designated VGAM RNA, binds complementarily to one or more host target binding sites located in untranslated regions of VGAM1043 host target RNA, herein designated VGAM HOST TARGET RNA. This complementary binding is due to the fact that the nucleotide sequence of VGAM1043 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1043 RNA, herein designated VGAM RNA, may have a different number of host target binding sites in untranslated regions of a VGAM1043 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1043 RNA, herein designated VGAM RNA, to host target binding sites on VGAM1043 host target RNA, herein designated VGAM HOST TARGET RNA, such as BINDING SITE I, BINDING SITE II and BINDING SITE III, inhibits translation of VGAM1043 host target RNA into VGAM1043 host target protein, herein designated VGAM HOST TARGET PROTEIN. VGAM host target protein is therefore outlined by a broken line.

It is appreciated that VGAM1043 host target gene, herein designated VGAM HOST TARGET GENE, in fact represents a plurality of VGAM1043 host target genes. The mRNA of each one of this plurality of VGAM1043 host target genes comprises one or more host target binding sites, each having a nucleotide sequence which is at least partly complementary to VGAM1043 RNA, herein designated VGAM RNA, and which when bound by VGAM1043 RNA causes inhibition of translation of respective one or more VGAM1043 host target proteins.

It is further appreciated by one skilled in the art that the mode of translational inhibition illustrated by FIG. 1 with specific reference to translational inhibition exerted by VGAM1043 gene, herein designated VGAM GENE, on one or more VGAM1043 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1043 is inhibition of expression of host target genes, as part of a novel viral mechanism of attacking a host. Accordingly, utilities of VGAM1043 include diagnosis, prevention and treatment of viral infection by White Clover Mosaic Virus. Specific functions, and accordingly utilities, of VGAM1043 correlate with, and may be deduced from, the identity of the host target genes which VGAM1043 binds and inhibits, and the function of these host target genes, as elaborated hereinbelow.

Nucleotide sequences of the VGAM1043 precursor RNA, herein designated VGAM PRECURSOR RNA, and of the ‘diced’ VGAM1043 RNA, herein designated VGAM RNA, and a schematic representation of the secondary folding of VGAM1043 folded precursor RNA, herein designated VGAM FOLDED PRECURSOR RNA, of VGAM1043 are further described hereinbelow with reference to Table 1.

Nucleotide sequences of host target binding sites, such as BINDING SITE-I, BINDING SITE-II and BINDING SITE-III of FIG. 1, found on VGAM1043 host target RNA, and schematic representation of the complementarity of each of these host target binding sites to VGAM1043 RNA, herein designated VGAM RNA, are described hereinbelow with reference to Table 2.

As mentioned hereinabove with reference to FIG. 1, a function of VGAM1043 gene, herein designated VGAM is inhibition of expression of VGAM1043 target genes. It is appreciated that specific functions, and accordingly utilities, of VGAM1043 correlate with, and may be deduced from, the identity of the target genes which VGAM1043 binds and inhibits, and the function of these target genes, as elaborated hereinbelow.

Acyl-Coenzyme A Dehydrogenase, C-4 to C-12 Straight Chain (ACADM, Accession NM_000016) is a VGAM1043 host target gene. ACADM BINDING SITE is HOST TARGET binding site found in the 3' untranslated region of mRNA encoded by ACADM, corresponding to a HOST TARGET binding site such as BINDING SITE I, BINDING SITE II or BINDING SITE III. Table 2 illustrates the complementarity of the nucleotide sequences of ACADM BINDING SITE, designated SEQ ID:5452, to the nucleotide sequence of VGAM1043 RNA, herein designated VGAM RNA, also designated SEQ ID:3754.

A function of VGAM1043 is therefore inhibition of Acyl-Coenzyme A Dehydrogenase, C-4 to C-12 Straight Chain (ACADM, Accession NM_000016). Accordingly, utilities of VGAM1043 include diagnosis, prevention and treatment of diseases and clinical conditions associated with ACADM. Adenylate Cyclase 9 (ADCY9, Accession NM_001116) is another VGAM1043 host target gene. ADCY9 BINDING SITE is HOST TARGET binding site found in the 3' untranslated region of mRNA encoded by ADCY9, corresponding to a HOST TARGET binding site such as BINDING SITE I, BINDING SITE II or BINDING SITE III. Table 2 illustrates the complementarity of the nucleotide sequences of ADCY9 BINDING SITE, designated SEQ ID:6790, to the nucleotide sequence of VGAM1043 RNA, herein designated VGAM RNA, also designated SEQ ID:3754.

Another function of VGAM1043 is therefore inhibition of Adenylate Cyclase 9 (ADCY9, Accession NM_001116), a gene which. may be a physiologically relevant docking site for calcineurin (by similarity). Accordingly, utilities of VGAM1043 include diagnosis, prevention and treatment of diseases and clinical conditions associated with ADCY9. The function of ADCY9 and its association with various diseases and clinical conditions, has been established by previous studies, as described hereinabove with reference to VGAM477. ADP-ribosylation Factor 1 (ARF1, Accession XM_047545) is another VGAM1043 host target gene. ARF1 BINDING SITE is HOST TARGET binding site found in the 3' untranslated region of mRNA encoded by ARF1, corresponding to a HOST TARGET binding site such as BINDING SITE I, BINDING SITE II or BINDING SITE III. Table 2 illustrates the complementarity of the nucleotide sequences of ARF1 BINDING SITE, designated SEQ ID:34991, to the nucleotide sequence of VGAM1043 RNA, herein designated VGAM RNA, also designated SEQ ID:3754.

Another function of VGAM1043 is therefore inhibition of ADP-ribosylation Factor 1 (ARF1, Accession XM_047545). Accordingly, utilities of VGAM1043 include diagnosis, prevention and treatment of diseases and clinical conditions associated with ARF1. ATPase, Na+/K+ Transporting, Alpha 2 (+) Polypeptide (ATP1A2, Accession NM_000702) is another VGAM1043 host target gene. ATP1A2 BINDING SITE is HOST TARGET binding site found in the 3' untranslated region of mRNA encoded by ATP1A2, corresponding to a HOST TARGET binding site such as BINDING SITE I, BINDING SITE II or BINDING SITE III. Table 2 illustrates the complementarity of the nucleotide sequences of ATP1A2 BINDING SITE, designated SEQ ID:6368, to the nucleotide sequence of VGAM1043 RNA, herein designated VGAM RNA, also designated SEQ ID:3754.

Another function of VGAM1043 is therefore inhibition of ATPase, Na+/K+ Transporting, Alpha 2 (+) Polypeptide (ATP1A2, Accession NM_000702). Accordingly, utilities of VGAM1043 include diagnosis, prevention and treatment of diseases and clinical conditions associated with ATP1A2. Collagen, Type XV, Alpha 1 (COL15A1, Accession NM_001855) is another VGAM1043 host target gene. COL15A1 BINDING SITE is HOST TARGET binding site found in the 3' untranslated region of mRNA encoded by COL15A1, corresponding to a HOST TARGET binding site such as BINDING SITE I, BINDING SITE II or BINDING SITE III. Table 2 illustrates the complementarity of the nucleotide sequences of COL15A1 BINDING SITE, designated SEQ ID:7588, to the nucleotide sequence of VGAM1043 RNA, herein designated VGAM RNA, also designated SEQ ID:3754.

Another function of VGAM1043 is therefore inhibition of Collagen, Type XV, Alpha 1 (COL15A1, Accession NM_001855), a gene which may be involved in maintaining the structure of connective tissue. Accordingly, utilities of VGAM1043 include diagnosis, prevention and treatment of diseases and clinical conditions associated with COL15A1. The function of COL15A1 and its association with various diseases and clinical conditions, has been established by previous studies, as described hereinabove with reference to VGAM304. Casein Kinase 1, Gamma 3 (CSNK1G3, Accession NM_004384) is another VGAM1043 host target gene. CSNK1G3 BINDING SITE is HOST TARGET binding site found in the 3' untranslated region of mRNA encoded by CSNK1G3, corresponding to a HOST TARGET binding site such as BINDING SITE I, BINDING SITE II or BINDING SITE III. Table 2 illustrates the complementarity of the nucleotide sequences of CSNK1G3 BINDING SITE, designated SEQ ID:10609, to the nucleotide sequence of VGAM1043 RNA, herein designated VGAM RNA, also designated SEQ ID:3754.

Another function of VGAM1043 is therefore inhibition of Casein Kinase 1, Gamma 3 (CSNK1G3, Accession NM_004384). Accordingly, utilities of VGAM1043 include diagnosis, prevention and treatment of diseases and clinical conditions associated with CSNK1G3. Chemokine (C-X3-C motif) Receptor 1 (CX3CR1, Accession XM_047502) is another VGAM1043 host target gene. CX3CR1 BINDING SITE is HOST TARGET binding site found in the 3' untranslated region of mRNA encoded by CX3CR1, corresponding to a HOST TARGET binding site such as BINDING SITE I, BINDING SITE II or BINDING SITE III. Table 2 illustrates the complementarity of the nucleotide sequences of CX3CR1 BINDING SITE, designated SEQ ID:34974, to the nucleotide sequence of VGAM1043 RNA, herein designated VGAM RNA, also designated SEQ ID:3754.

Another function of VGAM1043 is therefore inhibition of Chemokine (C-X3-C motif) Receptor 1 (CX3CR1, Accession XM_047502), a gene which mediates both the adhesive and migratory functions of fractalkine. Accordingly, utilities of VGAM1043 include diagnosis, prevention and treatment of diseases and clinical conditions associated with CX3CR1. The function of CX3CR1 and its association with various diseases and clinical conditions, has been established by previous studies, as described hereinabove with reference to VGAM25. DNA (cytosine-5-)-methyltransferase 2 (DNMT2, Accession NM_004412) is another VGAM1043 host target gene. DNMT2 BINDING SITE is HOST TARGET binding site found in the 3' untranslated region of mRNA encoded by DNMT2, corresponding to a HOST TARGET binding site such as BINDING SITE I, BINDING SITE II or BINDING SITE III. Table 2 illustrates the complementarity of the nucleotide sequences of DNMT2 BINDING SITE, designated SEQ ID:10670, to the nucleotide sequence of VGAM1043 RNA, herein designated VGAM RNA, also designated SEQ ID:3754.

Another function of VGAM1043 is therefore inhibition of DNA (cytosine-5-)-methyltransferase 2 (DNMT2, Accession NM_004412), a gene which may mark specific sequences in the genome. Accordingly, utilities of VGAM1043 include diagnosis, prevention and treatment of diseases and clinical conditions associated with DNMT2. The function of DNMT2 and its association with various diseases and clinical conditions, has been established by previous studies, as described hereinabove with reference to VGAM177. Desmocollin 3 (DSC3, Accession NM_024423) is another VGAM1043 host target gene. DSC3 BINDING SITE1 and DSC3 BINDING SITE2 are HOST TARGET binding sites found in untranslated regions of mRNA encoded by DSC3, corresponding to HOST TARGET binding sites such as BINDING SITE I, BINDING SITE II or BINDING SITE III. Table 2 illustrates the complementarity of the nucleotide sequences of DSC3 BINDING SITE1 and DSC3 BINDING SITE2, designated SEQ ID:23664 and SEQ ID:7653 respectively, to the nucleotide sequence of VGAM1043 RNA, herein designated VGAM RNA, also designated SEQ ID:3754.

Another function of VGAM1043 is therefore inhibition of Desmocollin 3 (DSC3, Accession NM_024423), a gene which is a component of intercellular desmosome junctions. Accordingly, utilities of VGAM1043 include diagnosis, prevention and treatment of diseases and clinical conditions associated with DSC3. The function of DSC3 and its association with various diseases and clinical conditions, has been established by previous studies, as described hereinabove with reference to VGAM230. Down Syndrome Critical Region Gene 3 (DSCR3, Accession NM_006052) is another VGAM1043 host target gene. DSCR3 BINDING SITE1 and DSCR3 BINDING SITE2 are HOST TARGET binding sites found in untranslated regions of mRNA encoded by DSCR3, corresponding to HOST TARGET binding sites such as BINDING SITE I, BINDING SITE II or BINDING SITE III. Table 2 illustrates the complementarity of the nucleotide sequences of DSCR3 BINDING SITE1 and DSCR3 BINDING SITE2, designated SEQ ID:12686 and SEQ ID:11722 respectively, to the nucleotide sequence of VGAM1043 RNA, herein designated VGAM RNA, also designated SEQ ID:3754.

Another function of VGAM1043 is therefore inhibition of Down Syndrome Critical Region Gene 3 (DSCR3, Accession NM_006052). Accordingly, utilities of VGAM1043 include diagnosis, prevention and treatment of diseases and clinical conditions associated with DSCR3. UDP-N-acetyl-alpha-D-galactosamine:polypeptide N-acetylgalactosaminyltransferase 7 (GalNAc-T7) (GALNT7, Accession NM_017423) is another VGAM1043 host target gene. GALNT7 BINDING SITE is HOST TARGET binding site found in the 3' untranslated region of mRNA encoded by GALNT7, corresponding to a HOST TARGET binding site such as BINDING SITE I, BINDING SITE II or BINDING SITE III. Table 2 illustrates the complementarity of the nucleotide sequences of GALNT7 BINDING SITE, designated SEQ ID:18877, to the nucleotide sequence of VGAM1043 RNA, herein designated VGAM RNA, also designated SEQ ID:3754.

Another function of VGAM1043 is therefore inhibition of UDP-N-acetyl-alpha-D-galactosamine:polypeptide N-acetylgalactosaminyltransferase 7 (GalNAc-T7) (GALNT7, Accession NM_017423). Accordingly, utilities of VGAM1043 include diagnosis, prevention and treatment of diseases and clinical conditions associated with GALNT7. Integral Membrane Protein 2B (ITM2B, Accession NM_021999) is another VGAM1043 host target gene. ITM2B BINDING SITE is HOST TARGET binding site found in the 5" untranslated region of mRNA encoded by ITM2B, corresponding to a HOST TARGET binding site such as BINDING SITE I, BINDING SITE II or BINDING SITE III. Table 2 illustrates the complementarity of the nucleotide sequences of ITM2B BINDING SITE, designated SEQ ID:22540, to the nucleotide sequence of VGAM1043 RNA, herein designated VGAM RNA, also designated SEQ ID:3754.

Another function of VGAM1043 is therefore inhibition of Integral Membrane Protein 2B (ITM2B, Accession NM_021999), a gene which is a member of the type II integral membrane protein family. Accordingly, utilities of VGAM1043 include diagnosis, prevention and treatment of diseases and clinical conditions associated with ITM2B. The function of ITM2B and its association with various diseases and clinical conditions, has been established by previous studies, as described hereinabove with reference to VGAM458. Kinesin Family Member 3C (KIF3C, Accession NM_002254) is another VGAM1043 host target gene. KIF3C BINDING SITE is HOST TARGET binding site found in the 3" untranslated region of mRNA encoded by KIF3C, corresponding to a HOST TARGET binding site such as BINDING SITE I, BINDING SITE II or BINDING SITE III. Table 2 illustrates the complementarity of the nucleotide sequences of KIF3C BINDING SITE, designated SEQ ID:8058, to the nucleotide sequence of VGAM1043 RNA, herein designated VGAM RNA, also designated SEQ ID:3754.

Another function of VGAM1043 is therefore inhibition of Kinesin Family Member 3C (KIF3C, Accession NM_002254). Accordingly, utilities of VGAM1043 include diagnosis, prevention and treatment of diseases and clinical conditions associated with KIF3C. Latent Transforming Growth Factor Beta Binding Protein 1 (LTBP1, Accession NM_000627) is another VGAM1043 host target gene. LTBP1 BINDING SITE is HOST TARGET binding site found in the 3' untranslated region of mRNA encoded by LTBP1, corresponding to a HOST TARGET binding site such as BINDING SITE I, BINDING SITE II or BINDING SITE III. Table 2 illustrates the complementarity of the nucleotide sequences of LTBP1 BINDING SITE, designated SEQ ID:6243, to the nucleotide sequence of VGAM1043 RNA, herein designated VGAM RNA, also designated SEQ ID:3754.

Another function of VGAM1043 is therefore inhibition of Latent Transforming Growth Factor Beta Binding Protein 1 (LTBP1, Accession NM_000627), a gene which is involved in assembly and secretion of latent TGF-beta. Accordingly, utilities of VGAM1043 include diagnosis, prevention and treatment of diseases and clinical conditions associated with LTBP1. The function of LTBP1 and its association with various diseases and clinical conditions, has been established by previous studies, as described hereinabove with reference to VGAM80. Meningioma (disrupted in balanced translocation) 1 (MN1, Accession NM_002430) is another VGAM1043 host target gene. MN1 BINDING SITE is HOST TARGET binding site found in the 3' untranslated region of mRNA encoded by MN1, corresponding to a HOST TARGET binding site such as BINDING SITE I, BINDING SITE II or BINDING SITE III. Table 2 illustrates the complementarity of the nucleotide sequences of MN1 BINDING SITE, designated SEQ ID:8275, to the nucleotide sequence of VGAM1043 RNA, herein designated VGAM RNA, also designated SEQ ID:3754.

Another function of VGAM1043 is therefore inhibition of Meningioma (disrupted in balanced translocation) 1 (MN1, Accession NM_002430). Accordingly, utilities of VGAM1043 include diagnosis, prevention and treatment of diseases and clinical conditions associated with MN1. RNA Binding Motif Protein, X Chromosome (RBMX, Accession XM_042968) is another VGAM1043 host target gene. RBMX BINDING SITE is HOST TARGET binding site found in the 3' untranslated region of mRNA encoded by RBMX, corresponding to a HOST TARGET binding site such as BINDING SITE I, BINDING SITE II or BINDING SITE III. Table 2 illustrates the complementarity of the nucleotide sequences of RBMX BINDING SITE, designated SEQ ID:33857, to the nucleotide sequence of VGAM1043 RNA, herein designated VGAM RNA, also designated SEQ ID:3754.

Another function of VGAM1043 is therefore inhibition of RNA Binding Motif Protein, X Chromosome (RBMX, Accession XM_042968), a gene which binds rna as a component of the ribonucleosome. Accordingly, utilities of VGAM1043 include diagnosis, prevention and treatment of diseases and clinical conditions associated with RBMX. The function of RBMX has been established by previous studies. The genes on the human Y chromosome fall into 2 classes with distinct evolutionary origins. Widely expressed, single-copy genes with X homologs that escape inactivation (X-Y shared genes) derive from the ancient proto X-Y chromosome pair. Testis-specific, multicopy genes with no X homologs originate from autosomes and have accumulated on a 'selfish Y' because of their male-specific function. Copies of genes in the RBMY gene family (see OMIM Ref. No. RBMY1A1, 400006) are candidate spermatogenesis genes because they are found in all 3 azoospermia factor (AZF) deletion intervals on the human Yq, which are associated with oligospermia or azoospermia (Vogt et al., 1997). An active X-borne homolog of the Y-borne RBMY gene was demonstrated in human S and marsupials by Delbridge et al. (1999) and in the mouse by Mazeyrat et al. (1999). Delbridge et al. (1999) stated that, like other gene pairs on the X and Y chromosomes (e.g., OMIM Ref. No. 400005), RBMX retained a widespread function and RBMY evolved a male-specific function in spermatogenesis. Thus, RBMY1A1, far from belonging to a 'second class' of testis-specific elements, is a diverged X-Y shared gene. Venables et al. (2000) used a yeast 2-hybrid system to show that the RBMY gene product hnRNP G and a novel testis-specific relative (termed hnRNP G-T) interact with Tra2-beta (OMIM Ref. No. 602719), an activator of pre-mRNA splicing that is ubiquitous but highly expressed in testis. The RBMY gene product and Tra2-beta colocalized in 2 major domains in human spermatocyte nuclei. Incubation with the protein interaction domain of the RBMY gene product inhibited splicing in vitro of a specific pre-mRNA substrate containing an essential enhancer bound by Tra2-beta. The RNA-binding domain of RBM affected 5-prime splice site selection. The authors concluded that the hnRNP G family of proteins is involved in pre-mRNA splicing and hypothesized that RBM may be involved in Tra2-beta-dependent splicing in spermatocytes.

Full details of the abovementioned studies are described in the following publications, the disclosure of which are hereby incorporated by reference:

Delbridge, M. L.; Lingenfelter, P. A.; Disteche, C. M.; Marshall Graves, J. A.: The candidate spermatogenesis gene RBMY has a homologue on the human X chromosome. (Letter) Nature Genet. 22:223-224, 1999; and Venables, J. P.; Elliott, D. J.; Makarova, O. V.; Makarov, E. M.; Cooke, H. J.; Eperon, I. C.: RBMY, a probable human spermatogenesis factor, and other hnRNP G proteins interact with T.

Further studies establishing the function and utilities of RBMX are found in John Hopkins OMIM database record ID 300199, and in sited publications numbered 11402-11406 listed in the bibliography section hereinbelow, which are also hereby incorporated by reference. Thy-1 Cell Surface Antigen (THY1, Accession NM_006288) is another VGAM1043 host target gene. THY1 BINDING SITE is HOST TARGET binding site found in the 3' untranslated region of mRNA encoded by THY1, corresponding to a HOST TARGET binding site such as BINDING SITE I, BINDING SITE II or BINDING SITE III. Table 2 illustrates the complementarity of the nucleotide sequences of THY1 BINDING SITE, designated SEQ ID:12977, to the nucleotide sequence of VGAM1043 RNA, herein designated VGAM RNA, also designated SEQ ID:3754.

Another function of VGAM1043 is therefore inhibition of Thy-1 Cell Surface Antigen (THY1, Accession NM_006288), a gene which plays a role in cell-cell or cell-ligand interactions during synaptogenesis. Accordingly, utilities of VGAM1043 include diagnosis, prevention and treatment of diseases and clinical conditions associated with THY1. The function of THY1 and its association with various diseases and clinical conditions, has been established by previous studies, as described hereinabove with reference to VGAM396. Activating Transcription Factor 3 (ATF3, Accession NM_004024) is another VGAM1043 host target gene. ATF3 BINDING SITE is HOST TARGET binding site found in the 3' untranslated region of mRNA encoded by ATF3, corresponding to a HOST TARGET binding site such as BINDING SITE I, BINDING SITE II or BINDING SITE III. Table 2 illustrates the complementarity of the nucleotide sequences of ATF3 BINDING SITE, designated SEQ ID:10245, to the nucleotide sequence of VGAM1043 RNA, herein designated VGAM RNA, also designated SEQ ID:3754.

Another function of VGAM1043 is therefore inhibition of Activating Transcription Factor 3 (ATF3, Accession NM_004024). Accordingly, utilities of VGAM1043 include diagnosis, prevention and treatment of diseases and clinical conditions associated with ATF3. ATPase, Class V, Type 10D (ATP10D, Accession XM_054907) is another VGAM1043 host target gene. ATP10D BINDING SITE is HOST TARGET binding site found in the 3' untranslated region of mRNA encoded by ATP10D, corresponding to a HOST TARGET binding site such as BINDING SITE I, BINDING SITE II or BINDING SITE III. Table 2 illustrates the complementarity of the nucleotide sequences of ATP10D BINDING SITE, designated SEQ ID:36201, to the nucleotide sequence of VGAM1043 RNA, herein designated VGAM RNA, also designated SEQ ID:3754.

Another function of VGAM1043 is therefore inhibition of ATPase, Class V, Type 10D (ATP10D, Accession XM_054907). Accordingly, utilities of VGAM1043 include diagnosis, prevention and treatment of diseases and clinical conditions associated with ATP10D. BA108L7.2 (Accession NM_030971) is another VGAM1043 host target gene. BA108L7.2 BINDING SITE is HOST TARGET binding site found in the 3' untranslated region of mRNA encoded by BA108L7.2, corresponding to a HOST TARGET binding site such as BINDING SITE I, BINDING SITE II or BINDING SITE III. Table 2 illustrates the complementarity of the nucleotide sequences of BA108L7.2 BINDING SITE, designated SEQ ID:25240, to the nucleotide sequence of VGAM1043

RNA, herein designated VGAM RNA, also designated SEQ ID:3754.

Another function of VGAM1043 is therefore inhibition of BA108L7.2 (Accession NM_030971). Accordingly, utilities of VGAM1043 include diagnosis, prevention and treatment of diseases and clinical conditions associated with BA108L7.2. Chromosome 15 Open Reading Frame 5 (C15orf5, Accession NM_030944) is another VGAM1043 host target gene. C15orf5 BINDING SITE is HOST TARGET binding site found in the 3' untranslated region of mRNA encoded by C15orf5, corresponding to a HOST TARGET binding site such as BINDING SITE I, BINDING SITE II or BINDING SITE III. Table 2 illustrates the complementarity of the nucleotide sequences of C15orf5 BINDING SITE, designated SEQ ID:25214, to the nucleotide sequence of VGAM1043 RNA, herein designated VGAM RNA, also designated SEQ ID:3754.

Another function of VGAM1043 is therefore inhibition of Chromosome 15 Open Reading Frame 5 (C15orf5, Accession NM_030944). Accordingly, utilities of VGAM1043 include diagnosis, prevention and treatment of diseases and clinical conditions associated with C15orf5. Cat Eye Syndrome Chromosome Region, Candidate 1 (CECR1, Accession NM_017424) is another VGAM1043 host target gene. CECR1 BINDING SITE is HOST TARGET binding site found in the 3' untranslated region of mRNA encoded by CECR1, corresponding to a HOST TARGET binding site such as BINDING SITE I, BINDING SITE II or BINDING SITE III. Table 2 illustrates the complementarity of the nucleotide sequences of CECR1 BINDING SITE, designated SEQ ID:18883, to the nucleotide sequence of VGAM1043 RNA, herein designated VGAM RNA, also designated SEQ ID:3754.

Another function of VGAM1043 is therefore inhibition of Cat Eye Syndrome Chromosome Region, Candidate 1 (CECR1, Accession NM_017424). Accordingly, utilities of VGAM1043 include diagnosis, prevention and treatment of diseases and clinical conditions associated with CECR1. Centaurin, Alpha 2 (CENTA2, Accession NM_018404) is another VGAM1043 host target gene. CENTA2 BINDING SITE is HOST TARGET binding site found in the 3' untranslated region of mRNA encoded by CENTA2, corresponding to a HOST TARGET binding site such as BINDING SITE I, BINDING SITE II or BINDING SITE III. Table 2 illustrates the complementarity of the nucleotide sequences of CENTA2 BINDING SITE, designated SEQ ID:20443, to the nucleotide sequence of VGAM1043 RNA, herein designated VGAM RNA, also designated SEQ ID:3754.

Another function of VGAM1043 is therefore inhibition of Centaurin, Alpha 2 (CENTA2, Accession NM_018404). Accordingly, utilities of VGAM1043 include diagnosis, prevention and treatment of diseases and clinical conditions associated with CENTA2. CGG Triplet Repeat Binding Protein 1 (CGGBP1, Accession NM_003663) is another VGAM1043 host target gene. CGGBP1 BINDING SITE is HOST TARGET binding site found in the 3' untranslated region of mRNA encoded by CGGBP1, corresponding to a HOST TARGET binding site such as BINDING SITE I, BINDING SITE II or BINDING SITE III. Table 2 illustrates the complementarity of the nucleotide sequences of CGGBP1 BINDING SITE, designated SEQ ID:9740, to the nucleotide sequence of VGAM1043 RNA, herein designated VGAM RNA, also designated SEQ ID:3754.

Another function of VGAM1043 is therefore inhibition of CGG Triplet Repeat Binding Protein 1 (CGGBP1, Accession NM_003663). Accordingly, utilities of VGAM1043 include diagnosis, prevention and treatment of diseases and clinical conditions associated with CGGBP1. DKFZP434P211 (Accession NM_014549) is another VGAM1043 host target gene. DKFZP434P211 BINDING SITE is HOST TARGET binding site found in the 3' untranslated region of mRNA encoded by DKFZP434P211, corresponding to a HOST TARGET binding site such as BINDING SITE I, BINDING SITE II or BINDING SITE III. Table 2 illustrates the complementarity of the nucleotide sequences of DKFZP434P211 BINDING SITE, designated SEQ ID:15868, to the nucleotide sequence of VGAM1043 RNA, herein designated VGAM RNA, also designated SEQ ID:3754.

Another function of VGAM1043 is therefore inhibition of DKFZP434P211 (Accession NM_014549). Accordingly, utilities of VGAM1043 include diagnosis, prevention and treatment of diseases and clinical conditions associated with DKFZP434P211. DKFZP547N043 (Accession NM_032018) is another VGAM1043 host target gene. DKFZP547N043 BINDING SITE is HOST TARGET binding site found in the 3' untranslated region of mRNA encoded by DKFZP547N043, corresponding to a HOST TARGET binding site such as BINDING SITE I, BINDING SITE II or BINDING SITE III. Table 2 illustrates the complementarity of the nucleotide sequences of DKFZP547N043 BINDING SITE, designated SEQ ID:25731, to the nucleotide sequence of VGAM1043 RNA, herein designated VGAM RNA, also designated SEQ ID:3754.

Another function of VGAM1043 is therefore inhibition of DKFZP547N043 (Accession NM_032018). Accordingly, utilities of VGAM1043 include diagnosis, prevention and treatment of diseases and clinical conditions associated with DKFZP547N043. DKFZP564M182 (Accession XM_085525) is another VGAM1043 host target gene. DKFZP564M182 BINDING SITE is HOST TARGET binding site found in the 3' untranslated region of mRNA encoded by DKFZP564M182, corresponding to a HOST TARGET binding site such as BINDING SITE I, BINDING SITE II or BINDING SITE III. Table 2 illustrates the complementarity of the nucleotide sequences of DKFZP564M182 BINDING SITE, designated SEQ ID:38219, to the nucleotide sequence of VGAM1043 RNA, herein designated VGAM RNA, also designated SEQ ID:3754.

Another function of VGAM1043 is therefore inhibition of DKFZP564M182 (Accession XM_085525). Accordingly, utilities of VGAM1043 include diagnosis, prevention and treatment of diseases and clinical conditions associated with DKFZP564M182. Cyclin D Binding Myb-like Transcription Factor 1 (DMTF1, Accession NM_021145) is another VGAM1043 host target gene. DMTF1 BINDING SITE is HOST TARGET binding site found in the 5' untranslated region of mRNA encoded by DMTF1, corresponding to a HOST TARGET binding site such as BINDING SITE I, BINDING SITE II or BINDING SITE III. Table 2 illustrates the complementarity of the nucleotide sequences of DMTF1 BINDING SITE, designated SEQ ID:22116, to the nucleotide sequence of VGAM1043 RNA, herein designated VGAM RNA, also designated SEQ ID:3754.

Another function of VGAM1043 is therefore inhibition of Cyclin D Binding Myb-like Transcription Factor 1 (DMTF1, Accession NM_021145). Accordingly, utilities of VGAM1043 include diagnosis, prevention and treatment of diseases and clinical conditions associated with DMTF1. FBP17 (Accession XM_052666) is another VGAM1043 host target gene. FBP17 BINDING SITE is HOST TARGET binding site found in the 3' untranslated region of mRNA encoded by FBP17, corresponding to a HOST TARGET binding site such as BINDING SITE I, BINDING SITE II or BINDING SITE III. Table 2 illustrates the complementarity of the nucleotide sequences of FBP17 BINDING SITE, designated SEQ ID:36049, to the nucleotide sequence of VGAM1043 RNA, herein designated VGAM RNA, also designated SEQ ID:3754.

Another function of VGAM1043 is therefore inhibition of FBP17 (Accession XM_052666). Accordingly, utilities of VGAM1043 include diagnosis, prevention and treatment of diseases and clinical conditions associated with FBP17. FLJ10392 (Accession NM_018084) is another VGAM1043 host target gene. FLJ10392 BINDING SITE is HOST TARGET binding site found in the 5' untranslated region of mRNA encoded by FLJ10392, corresponding to a HOST TARGET binding site such as BINDING SITE I, BINDING SITE II or BINDING SITE III. Table 2 illustrates the complementarity of the nucleotide sequences of FLJ10392 BINDING SITE, designated SEQ ID:19846, to the nucleotide sequence of VGAM1043 RNA, herein designated VGAM RNA, also designated SEQ ID:3754.

Another function of VGAM1043 is therefore inhibition of FLJ10392 (Accession NM_018084). Accordingly, utilities of VGAM1043 include diagnosis, prevention and treatment of diseases and clinical conditions associated with FLJ10392. FLJ10898 (Accession XM_002486) is another VGAM1043 host target gene. FLJ10898 BINDING SITE is HOST TARGET binding site found in the 5' untranslated region of mRNA encoded by FLJ10898, corresponding to a HOST TARGET binding site such as BINDING SITE I, BINDING SITE II or BINDING SITE III. Table 2 illustrates the complementarity of the nucleotide sequences of FLJ10898 BINDING SITE, designated SEQ ID:29893, to the nucleotide sequence of VGAM1043 RNA, herein designated VGAM RNA, also designated SEQ ID:3754.

Another function of VGAM1043 is therefore inhibition of FLJ10898 (Accession XM_002486). Accordingly, utilities of VGAM1043 include diagnosis, prevention and treatment of diseases and clinical conditions associated with FLJ10898. FLJ11106 (Accession NM_018324) is another VGAM1043 host target gene. FLJ11106 BINDING SITE is HOST TARGET binding site found in the 3' untranslated region of mRNA encoded by FLJ11106, corresponding to a HOST TARGET binding site such as BINDING SITE I, BINDING SITE II or BINDING SITE III. Table 2 illustrates the complementarity of the nucleotide sequences of FLJ11106 BINDING SITE, designated SEQ ID:20318, to the nucleotide sequence of VGAM1043 RNA, herein designated VGAM RNA, also designated SEQ ID:3754.

Another function of VGAM1043 is therefore inhibition of FLJ11106 (Accession NM_018324). Accordingly, utilities of VGAM1043 include diagnosis, prevention and treatment of diseases and clinical conditions associated with FLJ11106. FLJ14166 (Accession NM_024565) is another VGAM1043 host target gene. FLJ14166 BINDING SITE is HOST TARGET binding site found in the 3' untranslated region of mRNA encoded by FLJ14166, corresponding to a HOST TARGET binding site such as BINDING SITE I, BINDING SITE II or BINDING SITE III. Table 2 illustrates the complementarity of the nucleotide sequences of FLJ14166 BINDING SITE, designated SEQ ID:23792, to the nucleotide sequence of VGAM1043 RNA, herein designated VGAM RNA, also designated SEQ ID:3754.

Another function of VGAM1043 is therefore inhibition of FLJ14166 (Accession NM_024565). Accordingly, utilities of VGAM1043 include diagnosis, prevention and treatment of diseases and clinical conditions associated with FLJ14166. FLJ20170 (Accession NM_017696) is another VGAM1043 host target gene. FLJ20170 BINDING SITE is HOST TARGET binding site found in the 3' untranslated region of mRNA encoded by FLJ20170, corresponding to a HOST TARGET binding site such as BINDING SITE I, BINDING SITE II or BINDING SITE III. Table 2 illustrates the complementarity of the nucleotide sequences of FLJ20170 BINDING SITE, designated SEQ ID:19259, to the nucleotide sequence of VGAM1043 RNA, herein designated VGAM RNA, also designated SEQ ID:3754.

Another function of VGAM1043 is therefore inhibition of FLJ20170 (Accession NM_017696). Accordingly, utilities of VGAM1043 include diagnosis, prevention and treatment of diseases and clinical conditions associated with FLJ20170. FLJ22690 (Accession NM_024711) is another VGAM1043 host target gene. FLJ22690 BINDING SITE is HOST TARGET binding site found in the 3' untranslated region of mRNA encoded by FLJ22690, corresponding to a HOST TARGET binding site such as BINDING SITE I, BINDING SITE II or BINDING SITE III. Table 2 illustrates the complementarity of the nucleotide sequences of FLJ22690 BINDING SITE, designated SEQ ID:24038, to the nucleotide sequence of VGAM1043 RNA, herein designated VGAM RNA, also designated SEQ ID:3754.

Another function of VGAM1043 is therefore inhibition of FLJ22690 (Accession NM_024711). Accordingly, utilities of VGAM1043 include diagnosis, prevention and treatment of diseases and clinical conditions associated with FLJ22690. GLP (Accession NM_018652) is another VGAM1043 host target gene. GLP BINDING SITE is HOST TARGET binding site found in the 3' untranslated region of mRNA encoded by GLP, corresponding to a HOST TARGET binding site such as BINDING SITE I, BINDING SITE II or BINDING SITE III. Table 2 illustrates the complementarity of the nucleotide sequences of GLP BINDING SITE, designated SEQ ID:20723, to the nucleotide sequence of VGAM1043 RNA, herein designated VGAM RNA, also designated SEQ ID:3754.

Another function of VGAM1043 is therefore inhibition of GLP (Accession NM_018652). Accordingly, utilities of VGAM1043 include diagnosis, prevention and treatment of diseases and clinical conditions associated with GLP. GOLGIN-67 (Accession XM_170772) is another VGAM1043 host target gene. GOLGIN-67 BINDING SITE is HOST TARGET binding site found in the 3' untranslated region of mRNA encoded by GOLGIN-67, corresponding to a HOST TARGET binding site such as BINDING SITE I, BINDING SITE II or BINDING SITE III. Table 2 illustrates the complementarity of the nucleotide sequences of GOLGIN-67 BINDING SITE, designated SEQ ID:45536, to the nucleotide sequence of VGAM1043 RNA, herein designated VGAM RNA, also designated SEQ ID:3754.

Another function of VGAM1043 is therefore inhibition of GOLGIN-67 (Accession XM_170772). Accordingly, utilities of VGAM1043 include diagnosis, prevention and treatment of diseases and clinical conditions associated with GOLGIN-67. Interleukin 17D (IL17D, Accession NM_138284) is another VGAM1043 host target gene. IL17D BINDING SITE is HOST TARGET binding site found in the 3' untranslated region of mRNA encoded by IL17D, corresponding to a HOST TARGET binding site such as BINDING SITE I, BINDING SITE II or BINDING SITE III. Table 2 illustrates the complementarity of the nucleotide sequences of IL17D BINDING SITE, designated SEQ ID:28699, to the nucleotide sequence of VGAM1043 RNA, herein designated VGAM RNA, also designated SEQ ID:3754.

Another function of VGAM1043 is therefore inhibition of Interleukin 17D (IL17D, Accession NM_138284). Accordingly, utilities of VGAM1043 include diagnosis, prevention and treatment of diseases and clinical conditions associated with IL17D. KIAA0152 (Accession NM_014730) is another VGAM1043 host target gene. KIAA0152 BINDING SITE is HOST TARGET binding site found in the 3' untranslated region of mRNA encoded by KIAA0152, corresponding to a HOST TARGET binding site such as BINDING SITE I, BINDING SITE II or BINDING SITE III. Table 2 illustrates the complementarity of the nucleotide sequences of KIAA0152 BINDING SITE, designated SEQ ID:16337, to the nucleotide sequence of VGAM1043 RNA, herein designated VGAM RNA, also designated SEQ ID:3754.

Another function of VGAM1043 is therefore inhibition of KIAA0152 (Accession NM_014730). Accordingly, utilities of VGAM1043 include diagnosis, prevention and treatment of diseases and clinical conditions associated with KIAA0152. KIAA0193 (Accession NM_014766) is another VGAM1043 host target gene. KIAA0193 BINDING SITE is HOST TARGET binding site found in the 3' untranslated region of mRNA encoded by KIAA0193, corresponding to a HOST TARGET binding site such as BINDING SITE I, BINDING SITE II or BINDING SITE III. Table 2 illustrates the complementarity of the nucleotide sequences of KIAA0193 BINDING SITE, designated SEQ ID:16538, to the nucleotide sequence of VGAM1043 RNA, herein designated VGAM RNA, also designated SEQ ID:3754.

Another function of VGAM1043 is therefore inhibition of KIAA0193 (Accession NM_014766). Accordingly, utilities of VGAM1043 include diagnosis, prevention and treatment of diseases and clinical conditions associated with KIAA0193. KIAA0254 (Accession NM_014758) is another VGAM1043 host target gene. KIAA0254 BINDING SITE is HOST TARGET binding site found in the 3' untranslated region of mRNA encoded by KIAA0254, corresponding to a HOST TARGET binding site such as BINDING SITE I, BINDING SITE II or BINDING SITE III. Table 2 illustrates the complementarity of the nucleotide sequences of KIAA0254 BINDING SITE, designated SEQ ID:16503, to the nucleotide sequence of VGAM1043 RNA, herein designated VGAM RNA, also designated SEQ ID:3754.

Another function of VGAM1043 is therefore inhibition of KIAA0254 (Accession NM_014758). Accordingly, utilities of VGAM1043 include diagnosis, prevention and treatment of diseases and clinical conditions associated with KIAA0254. KIAA0379 (Accession XM_042860) is another VGAM1043 host target gene. KIAA0379 BINDING SITE is HOST TARGET binding site found in the 3' untranslated region of mRNA encoded by KIAA0379, corresponding to a HOST TARGET binding site such as BINDING SITE I, BINDING SITE II or BINDING SITE III. Table 2 illustrates the complementarity of the nucleotide sequences of KIAA0379 BINDING SITE, designated SEQ ID:33812, to the nucleotide sequence of VGAM1043 RNA, herein designated VGAM RNA, also designated SEQ ID:3754.

Another function of VGAM1043 is therefore inhibition of KIAA0379 (Accession XM_042860). Accordingly, utilities of VGAM1043 include diagnosis, prevention and treatment of diseases and clinical conditions associated with KIAA0379. KIAA0603 (Accession NM_014832) is another VGAM1043 host target gene. KIAA0603 BINDING SITE is HOST TARGET binding site found in the 3' untranslated region of mRNA encoded by KIAA0603, corresponding to a HOST TARGET binding site such as BINDING SITE I, BINDING SITE II or BINDING SITE III. Table 2 illustrates the complementarity of the nucleotide sequences of KIAA0603 BINDING SITE, designated SEQ ID:16829, to the nucleotide sequence of VGAM1043 RNA, herein designated VGAM RNA, also designated SEQ ID:3754.

Another function of VGAM1043 is therefore inhibition of KIAA0603 (Accession NM_014832). Accordingly, utilities of VGAM1043 include diagnosis, prevention and treatment of diseases and clinical conditions associated with KIAA0603. KIAA0620 (Accession XM_030707) is another VGAM1043 host target gene. KIAA0620 BINDING SITE is HOST TARGET binding site found in the 3' untranslated region of mRNA encoded by KIAA0620, corresponding to a HOST TARGET binding site such as BINDING SITE I, BINDING SITE II or BINDING SITE III. Table 2 illustrates the complementarity of the nucleotide sequences of KIAA0620 BINDING SITE, designated SEQ ID:31122, to the nucleotide sequence of VGAM1043 RNA, herein designated VGAM RNA, also designated SEQ ID:3754.

Another function of VGAM1043 is therefore inhibition of KIAA0620 (Accession XM_030707). Accordingly, utilities of VGAM1043 include diagnosis, prevention and treatment of diseases and clinical conditions associated with KIAA0620. KIAA0855 (Accession NM_015003) is another VGAM1043 host target gene. KIAA0855 BINDING SITE is HOST TARGET binding site found in the 3' untranslated region of mRNA encoded by KIAA0855, corresponding to a HOST TARGET binding site such as BINDING SITE I, BINDING SITE II or BINDING SITE III. Table 2 illustrates the complementarity of the nucleotide sequences of KIAA0855 BINDING SITE, designated SEQ ID:17376, to the nucleotide sequence of VGAM1043 RNA, herein designated VGAM RNA, also designated SEQ ID:3754.

Another function of VGAM1043 is therefore inhibition of KIAA0855 (Accession NM_015003). Accordingly, utilities of VGAM1043 include diagnosis, prevention and treatment of diseases and clinical conditions associated with KIAA0855. KIAA0976 (Accession NM_014917) is another VGAM1043 host target gene. KIAA0976 BINDING SITE is HOST TARGET binding site found in the 3' untranslated region of mRNA encoded by KIAA0976, corresponding to a HOST TARGET binding site such as BINDING SITE I, BINDING SITE II or BINDING SITE III. Table 2 illustrates the complementarity of the nucleotide sequences of KIAA0976 BINDING SITE, designated SEQ ID:17167, to the nucleotide sequence of VGAM1043 RNA, herein designated VGAM RNA, also designated SEQ ID:3754.

Another function of VGAM1043 is therefore inhibition of KIAA0976 (Accession NM_014917). Accordingly, utilities of VGAM1043 include diagnosis, prevention and treatment of diseases and clinical conditions associated with KIAA0976. KIAA1170 (Accession XM_045907) is another VGAM1043 host target gene. KIAA1170 BINDING SITE is HOST TARGET binding site found in the 3' untranslated region of mRNA encoded by KIAA1170, corresponding to a HOST TARGET binding site such as BINDING SITE I, BINDING SITE II or BINDING SITE III. Table 2 illustrates the complementarity of the nucleotide sequences of KIAA1170 BINDING SITE, designated SEQ ID:34611, to the nucleotide sequence of VGAM1043 RNA, herein designated VGAM RNA, also designated SEQ ID:3754.

Another function of VGAM1043 is therefore inhibition of KIAA1170 (Accession XM_045907). Accordingly, utilities of VGAM1043 include diagnosis, prevention and treatment of diseases and clinical conditions associated with KIAA1170. KIAA1361 (Accession XM_030845) is another VGAM1043 host target gene. KIAA1361 BINDING SITE is HOST TARGET binding site found in the 5' untranslated region of mRNA encoded by KIAA1361, corresponding to a HOST TARGET binding site such as BINDING SITE I, BINDING SITE II or BINDING SITE III. Table 2 illustrates the complementarity of the nucleotide sequences of KIAA1361 BINDING SITE, designated SEQ ID:31165, to the nucleotide sequence of VGAM1043 RNA, herein designated VGAM RNA, also designated SEQ ID:3754.

Another function of VGAM1043 is therefore inhibition of KIAA1361 (Accession XM_030845). Accordingly, utilities of VGAM1043 include diagnosis, prevention and treatment of diseases and clinical conditions associated with KIAA1361. KIAA1789 (Accession XM_040486) is another VGAM1043 host target gene. KIAA1789 BINDING SITE is HOST TARGET binding site found in the 5' untranslated region of mRNA encoded by KIAA1789, corresponding to a HOST TARGET binding site such as BINDING SITE I, BINDING SITE II or BINDING SITE III. Table 2 illustrates the complementarity of the nucleotide sequences of KIAA1789 BINDING SITE, designated SEQ ID:33311, to the nucleotide sequence of VGAM1043 RNA, herein designated VGAM RNA, also designated SEQ ID:3754.

Another function of VGAM1043 is therefore inhibition of KIAA1789 (Accession XM_040486). Accordingly, utilities of VGAM1043 include diagnosis, prevention and treatment of diseases and clinical conditions associated with KIAA1789. KIAA1900 (Accession XM_055299) is another VGAM1043 host target gene. KIAA1900 BINDING SITE is HOST TARGET binding site found in the 3' untranslated region of mRNA encoded by KIAA1900, corresponding to a HOST TARGET binding site such as BINDING SITE I, BINDING SITE II or BINDING SITE III. Table 2 illustrates the complementarity of the nucleotide sequences of KIAA1900 BINDING SITE, designated SEQ ID:36260, to the nucleotide sequence of VGAM1043 RNA, herein designated VGAM RNA, also designated SEQ ID:3754.

Another function of VGAM1043 is therefore inhibition of KIAA1900 (Accession XM_055299). Accordingly, utilities of VGAM1043 include diagnosis, prevention and treatment of diseases and clinical conditions associated with KIAA1900. MGC10940 (Accession NM_032303) is another VGAM1043 host target gene. MGC10940 BINDING SITE is HOST TARGET binding site found in the 3' untranslated region of mRNA encoded by MGC10940, corresponding to a HOST TARGET binding site such as BINDING SITE I, BINDING SITE II or BINDING SITE III. Table 2 illustrates the complementarity of the nucleotide sequences of MGC10940 BINDING SITE, designated SEQ ID:26085, to the nucleotide sequence of VGAM1043 RNA, herein designated VGAM RNA, also designated SEQ ID:3754.

Another function of VGAM1043 is therefore inhibition of MGC10940 (Accession NM_032303). Accordingly, utilities of VGAM1043 include diagnosis, prevention and treatment of diseases and clinical conditions associated with MGC10940. MGC10977 (Accession NM_032681) is another VGAM1043 host target gene. MGC10977 BINDING SITE is HOST TARGET binding site found in the 5' untranslated region of mRNA encoded by MGC10977, corresponding to a HOST TARGET binding site such as BINDING SITE I, BINDING SITE II or BINDING SITE III. Table 2 illustrates the complementarity of the nucleotide sequences of MGC10977 BINDING SITE, designated SEQ ID:26402, to the nucleotide sequence of VGAM1043 RNA, herein designated VGAM RNA, also designated SEQ ID:3754.

Another function of VGAM1043 is therefore inhibition of MGC10977 (Accession NM_032681). Accordingly, utilities of VGAM1043 include diagnosis, prevention and treatment of diseases and clinical conditions associated with MGC10977. MGC12538 (Accession NM_032746) is another VGAM1043 host target gene. MGC12538 BINDING SITE is HOST TARGET binding site found in the 5' untranslated region of mRNA encoded by MGC12538, corresponding to a HOST TARGET binding site such as BINDING SITE I, BINDING SITE II or BINDING SITE III. Table 2 illustrates the complementarity of the nucleotide sequences of MGC12538 BINDING SITE, designated SEQ ID:26480, to the nucleotide sequence of VGAM1043 RNA, herein designated VGAM RNA, also designated SEQ ID:3754.

Another function of VGAM1043 is therefore inhibition of MGC12538 (Accession NM_032746). Accordingly, utilities of VGAM1043 include diagnosis, prevention and treatment of diseases and clinical conditions associated with MGC12538. mPA-PLA1 (Accession NM_139248) is another VGAM1043 host target gene. mPA-PLA1 BINDING SITE is HOST TARGET binding site found in the 3' untranslated region of mRNA encoded by mPA-PLA1, corresponding to a HOST TARGET binding site such as BINDING SITE I, BINDING SITE II or BINDING SITE III. Table 2 illustrates the complementarity of the nucleotide sequences of mPA-PLA1 BINDING SITE, designated SEQ ID:29252, to the nucleotide sequence of VGAM1043 RNA, herein designated VGAM RNA, also designated SEQ ID:3754.

Another function of VGAM1043 is therefore inhibition of mPA-PLA1 (Accession NM_139248). Accordingly, utilities of VGAM1043 include diagnosis, prevention and treatment of diseases and clinical conditions associated with mPA-PLA1. Nudix (nucleoside diphosphate linked moiety X)-type Motif 12 (NUDT12, Accession NM_031438) is another VGAM1043 host target gene. NUDT12 BINDING SITE is HOST TARGET binding site found in the 3' untranslated region of mRNA encoded by NUDT12, corresponding to a HOST TARGET binding site such as BINDING SITE I, BINDING SITE II or BINDING SITE III. Table 2 illustrates the complementarity of the nucleotide sequences of NUDT12 BINDING SITE, designated SEQ ID:25449, to the nucleotide sequence of VGAM1043 RNA, herein designated VGAM RNA, also designated SEQ ID:3754.

Another function of VGAM1043 is therefore inhibition of Nudix (nucleoside diphosphate linked moiety X)-type Motif 12 (NUDT12, Accession NM_031438). Accordingly, utilities of VGAM1043 include diagnosis, prevention and treatment of diseases and clinical conditions associated with NUDT12. PB1 (Accession NM_018165) is another VGAM1043 host target gene. PB1 BINDING SITE is HOST TARGET binding site found in the 3" untranslated region of mRNA encoded by PB1, corresponding to a HOST TARGET binding site such as BINDING SITE I, BINDING SITE II or BINDING SITE III. Table 2 illustrates the complementarity of the nucleotide sequences of PB1 BINDING SITE, designated SEQ ID:19980, to the nucleotide sequence of VGAM1043 RNA, herein designated VGAM RNA, also designated SEQ ID:3754.

Another function of VGAM1043 is therefore inhibition of PB1 (Accession NM_018165). Accordingly, utilities of VGAM1043 include diagnosis, prevention and treatment of diseases and clinical conditions associated with PB1. SDF1 (Accession XM_165565) is another VGAM1043 host target gene. SDF1 BINDING SITE is HOST TARGET binding site found in the 3' untranslated region of mRNA encoded by SDF1, corresponding to a HOST TARGET binding site such as BINDING SITE I, BINDING SITE II or BINDING SITE III. Table 2 illustrates the complementarity of the nucleotide sequences of SDF1 BINDING SITE, designated SEQ ID:43690, to the nucleotide sequence of VGAM1043 RNA, herein designated VGAM RNA, also designated SEQ ID:3754.

Another function of VGAM1043 is therefore inhibition of SDF1 (Accession XM_165565). Accordingly, utilities of VGAM1043 include diagnosis, prevention and treatment of diseases and clinical conditions associated with SDF1. STI2 (Accession XM_114335) is another VGAM1043 host target gene. STI2 BINDING SITE is HOST TARGET binding site found in the 3' untranslated region of mRNA encoded by STI2, corresponding to a HOST TARGET binding site such as BINDING SITE I, BINDING SITE II or BINDING SITE III. Table 2 illustrates the complementarity of the nucleotide sequences of STI2 BINDING SITE, designated SEQ ID:42877, to the nucleotide sequence of VGAM1043 RNA, herein designated VGAM RNA, also designated SEQ ID:3754.

Another function of VGAM1043 is therefore inhibition of STI2 (Accession XM_114335). Accordingly, utilities of VGAM1043 include diagnosis, prevention and treatment of diseases and clinical conditions associated with STI2. Tripartite Motif-containing 26 (TRIM26, Accession NM_003449) is another VGAM1043 host target gene. TRIM26 BINDING SITE is HOST TARGET binding site found in the 3' untranslated region of mRNA encoded by TRIM26, corresponding to a HOST TARGET binding site such as BINDING SITE I, BINDING SITE II or BINDING SITE III. Table 2 illustrates the complementarity of the nucleotide sequences of TRIM26 BINDING SITE, designated SEQ ID:9501, to the nucleotide sequence of VGAM1043 RNA, herein designated VGAM RNA, also designated SEQ ID:3754.

Another function of VGAM1043 is therefore inhibition of Tripartite Motif-containing 26 (TRIM26, Accession NM_003449). Accordingly, utilities of VGAM1043 include diagnosis, prevention and treatment of diseases and clinical conditions associated with TRIM26. Ubiquitin Specific Protease 8 (USP8, Accession NM_005154) is another VGAM1043 host target gene. USP8 BINDING SITE is HOST TARGET binding site found in the 3' untranslated region of mRNA encoded by USP8, corresponding to a HOST TARGET binding site such as BINDING SITE I, BINDING SITE II or BINDING SITE III. Table 2 illustrates the complementarity of the nucleotide sequences of USP8 BINDING SITE, designated SEQ ID:11628, to the nucleotide sequence of VGAM1043 RNA, herein designated VGAM RNA, also designated SEQ ID:3754.

Another function of VGAM1043 is therefore inhibition of Ubiquitin Specific Protease 8 (USP8, Accession NM_005154). Accordingly, utilities of VGAM1043 include diagnosis, prevention and treatment of diseases and clinical conditions associated with USP8. LOC115131 (Accession NM_145242) is another VGAM1043 host target gene. LOC115131 BINDING SITE is HOST TARGET binding site found in the 5' untranslated region of mRNA encoded by LOC115131, corresponding to a HOST TARGET binding site such as BINDING SITE I, BINDING SITE II or BINDING SITE III. Table 2 illustrates the complementarity of the nucleotide sequences of LOC115131 BINDING SITE, designated SEQ ID:29756, to the nucleotide sequence of VGAM1043 RNA, herein designated VGAM RNA, also designated SEQ ID:3754.

Another function of VGAM1043 is therefore inhibition of LOC115131 (Accession NM_145242). Accordingly, utilities of VGAM1043 include diagnosis, prevention and treatment of diseases and clinical conditions associated with LOC115131. LOC116236 (Accession XM_057674) is another VGAM1043 host target gene. LOC116236 BINDING SITE is HOST TARGET binding site found in the 3' untranslated region of mRNA encoded by LOC116236, corresponding to a HOST TARGET binding site such as BINDING SITE I, BINDING SITE II or BINDING SITE III. Table 2 illustrates the complementarity of the nucleotide sequences of LOC116236 BINDING SITE, designated SEQ ID:36542, to the nucleotide sequence of VGAM1043 RNA, herein designated VGAM RNA, also designated SEQ ID:3754.

Another function of VGAM1043 is therefore inhibition of LOC116236 (Accession XM_057674). Accordingly, utilities of VGAM1043 include diagnosis, prevention and treatment of diseases and clinical conditions associated with LOC116236. LOC135398 (Accession XM_069333) is another VGAM1043 host target gene. LOC135398 BINDING SITE is HOST TARGET binding site found in the 3' untranslated region of mRNA encoded by LOC135398, corresponding to a HOST TARGET binding site such as BINDING SITE I, BINDING SITE II or BINDING SITE III. Table 2 illustrates the complementarity of the nucleotide sequences of LOC135398 BINDING SITE, designated SEQ ID:37387, to the nucleotide sequence of VGAM1043 RNA, herein designated VGAM RNA, also designated SEQ ID:3754.

Another function of VGAM1043 is therefore inhibition of LOC135398 (Accession XM_069333). Accordingly, utilities of VGAM1043 include diagnosis, prevention and treatment of diseases and clinical conditions associated with LOC135398. LOC143719 (Accession XM_027090) is another VGAM1043 host target gene. LOC143719 BINDING SITE is HOST TARGET binding site found in the 5' untranslated region of mRNA encoded by LOC143719, corresponding to a HOST TARGET binding site such as BINDING SITE I, BINDING SITE II or BINDING SITE III. Table 2 illustrates the complementarity of the nucleotide sequences of LOC143719 BINDING SITE, designated SEQ ID:30404, to the nucleotide sequence of VGAM1043 RNA, herein designated VGAM RNA, also designated SEQ ID:3754.

Another function of VGAM1043 is therefore inhibition of LOC143719 (Accession XM_027090). Accordingly, utilities of VGAM1043 include diagnosis, prevention and treatment of diseases and clinical conditions associated with LOC143719. LOC144438 (Accession XM_084860) is another VGAM1043 host target gene. LOC144438 BINDING SITE is HOST TARGET binding site found in the 3' untranslated region of mRNA encoded by LOC144438, corresponding to a HOST TARGET binding site such as BINDING SITE I, BINDING SITE II or BINDING SITE III. Table 2 illustrates the complementarity of the nucleotide sequences of LOC144438 BINDING SITE, designated SEQ ID:37734, to the nucleotide sequence of VGAM1043 RNA, herein designated VGAM RNA, also designated SEQ ID:3754.

Another function of VGAM1043 is therefore inhibition of LOC144438 (Accession XM_084860). Accordingly, utilities of VGAM1043 include diagnosis, prevention and treatment of diseases and clinical conditions associated with LOC144438. LOC144519 (Accession XM_084890) is another VGAM1043 host target gene. LOC144519 BINDING SITE is HOST TARGET binding site found in the 5' untranslated region of mRNA encoded by LOC144519, corresponding to a HOST TARGET binding site such as BINDING SITE I, BINDING SITE II or BINDING SITE III. Table 2 illustrates the complementarity of the nucleotide sequences of LOC144519 BINDING SITE, designated SEQ ID:37756, to the nucleotide sequence of VGAM1043 RNA, herein designated VGAM RNA, also designated SEQ ID:3754.

Another function of VGAM1043 is therefore inhibition of LOC144519 (Accession XM_084890). Accordingly, utilities of VGAM1043 include diagnosis, prevention and treatment of diseases and clinical conditions associated with LOC144519. LOC145842 (Accession XM_085254) is another VGAM1043 host target gene. LOC145842 BINDING SITE is HOST TARGET binding site found in the 5' untranslated region of mRNA encoded by LOC145842, corresponding to a HOST TARGET binding site such as BIND- ING SITE I, BINDING SITE II or BINDING SITE III. Table 2 illustrates the complementarity of the nucleotide sequences of LOC145842 BINDING SITE, designated SEQ ID:37996, to the nucleotide sequence of VGAM1043 RNA, herein designated VGAM RNA, also designated SEQ ID:3754.

Another function of VGAM1043 is therefore inhibition of LOC145842 (Accession XM_085254). Accordingly, utilities of VGAM1043 include diagnosis, prevention and treatment of diseases and clinical conditions associated with LOC145842. LOC145900 (Accession XM_085276) is another VGAM1043 host target gene. LOC145900 BINDING SITE is HOST TARGET binding site found in the 3' untranslated region of mRNA encoded by LOC145900, corresponding to a HOST TARGET binding site such as BINDING SITE I, BINDING SITE II or BINDING SITE III. Table 2 illustrates the complementarity of the nucleotide sequences of LOC145900 BINDING SITE, designated SEQ ID:38013, to the nucleotide sequence of VGAM1043 RNA, herein designated VGAM RNA, also designated SEQ ID:3754.

Another function of VGAM1043 is therefore inhibition of LOC145900 (Accession XM_085276). Accordingly, utilities of VGAM1043 include diagnosis, prevention and treatment of diseases and clinical conditions associated with LOC145900. LOC145988 (Accession XM_085290) is another VGAM1043 host target gene. LOC145988 BINDING SITE is HOST TARGET binding site found in the 3' untranslated region of mRNA encoded by LOC145988, corresponding to a HOST TARGET binding site such as BINDING SITE I, BINDING SITE II or BINDING SITE III. Table 2 illustrates the complementarity of the nucleotide sequences of LOC145988 BINDING SITE, designated SEQ ID:38041, to the nucleotide sequence of VGAM1043 RNA, herein designated VGAM RNA, also designated SEQ ID:3754.

Another function of VGAM1043 is therefore inhibition of LOC145988 (Accession XM_085290). Accordingly, utilities of VGAM1043 include diagnosis, prevention and treatment of diseases and clinical conditions associated with LOC145988. LOC146723 (Accession XM_085565) is another VGAM1043 host target gene. LOC146723 BINDING SITE is HOST TARGET binding site found in the 3' untranslated region of mRNA encoded by LOC146723, corresponding to a HOST TARGET binding site such as BINDING SITE I, BINDING SITE II or BINDING SITE III. Table 2 illustrates the complementarity of the nucleotide sequences of LOC146723 BINDING SITE, designated SEQ ID:38229, to the nucleotide sequence of VGAM1043 RNA, herein designated VGAM RNA, also designated SEQ ID:3754.

Another function of VGAM1043 is therefore inhibition of LOC146723 (Accession XM_085565). Accordingly, utilities of VGAM1043 include diagnosis, prevention and treatment of diseases and clinical conditions associated with LOC146723. LOC148266 (Accession XM_086128) is another VGAM1043 host target gene. LOC148266 BINDING SITE is HOST TARGET binding site found in the 5' untranslated region of mRNA encoded by LOC148266, corresponding to a HOST TARGET binding site such as BINDING SITE I, BINDING SITE II or BINDING SITE III. Table 2 illustrates the complementarity of the nucleotide sequences of LOC148266 BINDING SITE, designated SEQ ID:38512, to the nucleotide sequence of VGAM1043 RNA, herein designated VGAM RNA, also designated SEQ ID:3754.

Another function of VGAM1043 is therefore inhibition of LOC148266 (Accession XM_086128). Accordingly, utilities of VGAM1043 include diagnosis, prevention and treatment of diseases and clinical conditions associated with LOC148266. LOC150174 (Accession XM_086802) is another VGAM1043 host target gene. LOC150174 BINDING SITE is HOST TARGET binding site found in the 3' untranslated region of mRNA encoded by LOC150174, corresponding to a HOST TARGET binding site such as BINDING SITE I, BINDING SITE II or BINDING SITE III. Table 2 illustrates the complementarity of the nucleotide sequences of LOC150174 BINDING SITE, designated SEQ ID:38874, to the nucleotide sequence of VGAM1043 RNA, herein designated VGAM RNA, also designated SEQ ID:3754.

Another function of VGAM1043 is therefore inhibition of LOC150174 (Accession XM_086802). Accordingly, utilities of VGAM1043 include diagnosis, prevention and treatment of diseases and clinical conditions associated with LOC150174. LOC150213 (Accession XM_059324) is another VGAM1043 host target gene. LOC150213 BINDING SITE is HOST TARGET binding site found in the 3' untranslated region of mRNA encoded by LOC150213, corresponding to a HOST TARGET binding site such as BINDING SITE I, BINDING SITE II or BINDING SITE III. Table 2 illustrates the complementarity of the nucleotide sequences of LOC150213 BINDING SITE, designated SEQ ID:36960, to the nucleotide sequence of VGAM1043 RNA, herein designated VGAM RNA, also designated SEQ ID:3754.

Another function of VGAM1043 is therefore inhibition of LOC150213 (Accession XM_059324). Accordingly, utilities of VGAM1043 include diagnosis, prevention and treatment of diseases and clinical conditions associated with LOC150213. LOC152313 (Accession XM_098190) is another VGAM1043 host target gene. LOC152313 BINDING SITE is HOST TARGET binding site found in the 5' untranslated region of mRNA encoded by LOC152313, corresponding to a HOST TARGET binding site such as BINDING SITE I, BINDING SITE II or BINDING SITE III. Table 2 illustrates the complementarity of the nucleotide sequences of LOC152313 BINDING SITE, designated SEQ ID:41471, to the nucleotide sequence of VGAM1043 RNA, herein designated VGAM RNA, also designated SEQ ID:3754.

Another function of VGAM1043 is therefore inhibition of LOC152313 (Accession XM_098190). Accordingly, utilities of VGAM1043 include diagnosis, prevention and treatment of diseases and clinical conditions associated with LOC152313. LOC152485 (Accession XM_087479) is another VGAM1043 host target gene. LOC152485 BINDING SITE is HOST TARGET binding site found in the 3' untranslated region of mRNA encoded by LOC152485, corresponding to a HOST TARGET binding site such as BINDING SITE I, BINDING SITE II or BINDING SITE III. Table 2 illustrates the complementarity of the nucleotide sequences of LOC152485 BINDING SITE, designated SEQ ID:39281, to the nucleotide sequence of VGAM1043 RNA, herein designated VGAM RNA, also designated SEQ ID:3754.

Another function of VGAM1043 is therefore inhibition of LOC152485 (Accession XM_087479). Accordingly, utilities of VGAM1043 include diagnosis, prevention and treatment of diseases and clinical conditions associated with LOC152485. LOC154860 (Accession XM_098623) is another VGAM1043 host target gene. LOC154860 BINDING SITE is HOST TARGET binding site found in the 5' untranslated region of mRNA encoded by LOC154860, corresponding to a HOST TARGET binding site such as BINDING SITE I, BINDING SITE II or BINDING SITE III. Table 2 illustrates the complementarity of the nucleotide sequences of LOC154860 BINDING SITE, designated SEQ ID:41737, to the nucleotide sequence of VGAM1043 RNA, herein designated VGAM RNA, also designated SEQ ID:3754.

Another function of VGAM1043 is therefore inhibition of LOC154860 (Accession XM_098623). Accordingly, utilities of VGAM1043 include diagnosis, prevention and treatment of diseases and clinical conditions associated with LOC154860. LOC155006 (Accession XM_088117) is another VGAM1043 host target gene. LOC155006 BINDING SITE is HOST TARGET binding site found in the 3' untranslated region of mRNA encoded by LOC155006, corresponding to a HOST TARGET binding site such as BINDING SITE I, BINDING SITE II or BINDING SITE III. Table 2 illustrates the complementarity of the nucleotide sequences of LOC155006 BINDING SITE, designated SEQ ID:39527, to the nucleotide sequence of VGAM1043 RNA, herein designated VGAM RNA, also designated SEQ ID:3754.

Another function of VGAM1043 is therefore inhibition of LOC155006 (Accession XM_088117). Accordingly, utilities of VGAM1043 include diagnosis, prevention and treatment of diseases and clinical conditions associated with LOC155006. LOC158014 (Accession XM_088442) is another VGAM1043 host target gene. LOC158014 BINDING SITE is HOST TARGET binding site found in the 3' untranslated region of mRNA encoded by LOC158014, corresponding to a HOST TARGET binding site such as BINDING SITE I, BINDING SITE II or BINDING SITE III. Table 2 illustrates the complementarity of the nucleotide sequences of LOC158014 BINDING SITE, designated SEQ ID:39694, to the nucleotide sequence of VGAM1043 RNA, herein designated VGAM RNA, also designated SEQ ID:3754.

Another function of VGAM1043 is therefore inhibition of LOC158014 (Accession XM_088442). Accordingly, utilities of VGAM1043 include diagnosis, prevention and treatment of diseases and clinical conditions associated with LOC158014. LOC158056 (Accession XM_088463) is another VGAM1043 host target gene. LOC158056 BINDING SITE is HOST TARGET binding site found in the 5' untranslated region of mRNA encoded by LOC158056, corresponding to a HOST TARGET binding site such as BINDING SITE I, BINDING SITE II or BINDING SITE III. Table 2 illustrates the complementarity of the nucleotide sequences of LOC158056 BINDING SITE, designated SEQ ID:39718, to the nucleotide sequence of VGAM1043 RNA, herein designated VGAM RNA, also designated SEQ ID:3754.

Another function of VGAM1043 is therefore inhibition of LOC158056 (Accession XM_088463). Accordingly, utilities of VGAM1043 include diagnosis, prevention and treatment of diseases and clinical conditions associated with LOC158056. LOC163882 (Accession XM_089211) is another VGAM1043 host target gene. LOC163882 BINDING SITE is HOST TARGET binding site found in the 3' untranslated region of mRNA encoded by LOC163882, corresponding to a HOST TARGET binding site such as BINDING SITE I, BINDING SITE II or BINDING SITE III. Table 2 illustrates the complementarity of the nucleotide sequences of LOC163882 BINDING SITE, designated SEQ ID:39970, to the nucleotide sequence of VGAM1043 RNA, herein designated VGAM RNA, also designated SEQ ID:3754.

Another function of VGAM1043 is therefore inhibition of LOC163882 (Accession XM_089211). Accordingly, utilities of VGAM1043 include diagnosis, prevention and treatment of diseases and clinical conditions associated with LOC163882. LOC169021 (Accession XM_095459) is another VGAM1043 host target gene. LOC169021 BINDING SITE is HOST TARGET binding site found in the 5' untranslated region of mRNA encoded by LOC169021, corresponding to a HOST TARGET binding site such as BINDING SITE I, BINDING SITE II or BINDING SITE III. Table 2 illustrates the complementarity of the nucleotide sequences of LOC169021 BINDING SITE, designated SEQ ID:40257, to the nucleotide sequence of VGAM1043 RNA, herein designated VGAM RNA, also designated SEQ ID:3754.

Another function of VGAM1043 is therefore inhibition of LOC169021 (Accession XM_095459). Accordingly, utilities of VGAM1043 include diagnosis, prevention and treatment of diseases and clinical conditions associated with LOC169021. LOC203523 (Accession XM_114713) is another VGAM1043 host target gene. LOC203523 BINDING SITE is HOST TARGET binding site found in the 3' untranslated region of mRNA encoded by LOC203523, corresponding to a HOST TARGET binding site such as BINDING SITE I, BINDING SITE II or BINDING SITE III. Table 2 illustrates the complementarity of the nucleotide sequences of LOC203523 BINDING SITE, designated SEQ ID:43054, to the nucleotide sequence of VGAM1043 RNA, herein designated VGAM RNA, also designated SEQ ID:3754.

Another function of VGAM1043 is therefore inhibition of LOC203523 (Accession XM_114713). Accordingly, utilities of VGAM1043 include diagnosis, prevention and treatment of diseases and clinical conditions associated with LOC203523. LOC204301 (Accession XM_115306) is another VGAM1043 host target gene. LOC204301 BINDING SITE is HOST TARGET binding site found in the 3' untranslated region of mRNA encoded by LOC204301, corresponding to a HOST TARGET binding site such as BINDING SITE I, BINDING SITE II or BINDING SITE III. Table 2 illustrates the complementarity of the nucleotide sequences of LOC204301 BINDING SITE, designated SEQ ID:43094, to the nucleotide sequence of VGAM1043 RNA, herein designated VGAM RNA, also designated SEQ ID:3754.

Another function of VGAM1043 is therefore inhibition of LOC204301 (Accession XM_115306). Accordingly, utilities of VGAM1043 include diagnosis, prevention and treatment of diseases and clinical conditions associated with LOC204301. LOC219988 (Accession XM_166223) is another VGAM1043 host target gene. LOC219988 BINDING SITE is HOST TARGET binding site found in the 5' untranslated region of mRNA encoded by LOC219988, corresponding to a HOST TARGET binding site such as BINDING SITE I, BINDING SITE II or BINDING SITE III. Table 2 illustrates the complementarity of the nucleotide sequences of LOC219988 BINDING SITE, designated SEQ ID:44040, to the nucleotide sequence of VGAM1043 RNA, herein designated VGAM RNA, also designated SEQ ID:3754.

Another function of VGAM1043 is therefore inhibition of LOC219988 (Accession XM_166223). Accordingly, utilities of VGAM1043 include diagnosis, prevention and treatment of diseases and clinical conditions associated with LOC219988. LOC220534 (Accession XM_165405) is another VGAM1043 host target gene. LOC220534 BINDING SITE is HOST TARGET binding site found in the 3' untranslated region of mRNA encoded by LOC220534, corresponding to a HOST TARGET binding site such as BINDING SITE I, BINDING SITE II or BINDING SITE III. Table 2 illustrates the complementarity of the nucleotide sequences of LOC220534 BINDING SITE, designated SEQ ID:43617, to the nucleotide sequence of VGAM1043 RNA, herein designated VGAM RNA, also designated SEQ ID:3754.

Another function of VGAM1043 is therefore inhibition of LOC220534 (Accession XM_165405). Accordingly, utilities of VGAM1043 include diagnosis, prevention and treatment of diseases and clinical conditions associated with LOC220534. LOC220538 (Accession XM_165407) is another VGAM1043 host target gene. LOC220538 BINDING SITE is HOST TARGET binding site found in the 3' untranslated region of mRNA encoded by LOC220538, corresponding to a HOST TARGET binding site such as BINDING SITE I, BINDING SITE II or BINDING SITE III. Table 2 illustrates the complementarity of the nucleotide sequences of LOC220538 BINDING SITE, designated SEQ ID:43627, to the nucleotide sequence of VGAM1043 RNA, herein designated VGAM RNA, also designated SEQ ID:3754.

Another function of VGAM1043 is therefore inhibition of LOC220538 (Accession XM_165407). Accordingly, utilities of VGAM1043 include diagnosis, prevention and treatment of diseases and clinical conditions associated with LOC220538. LOC222234 (Accession XM_168558) is another VGAM1043 host target gene. LOC222234 BINDING SITE is HOST TARGET binding site found in the 5' untranslated region of mRNA encoded by LOC222234, corresponding to a HOST TARGET binding site such as BINDING SITE I, BINDING SITE II or BINDING SITE III. Table 2 illustrates the complementarity of the nucleotide sequences of LOC222234 BINDING SITE, designated SEQ ID:45240, to the nucleotide sequence of VGAM1043 RNA, herein designated VGAM RNA, also designated SEQ ID:3754.

Another function of VGAM1043 is therefore inhibition of LOC222234 (Accession XM_168558). Accordingly, utilities of VGAM1043 include diagnosis, prevention and treatment of diseases and clinical conditions associated with LOC222234. LOC254358 (Accession XM_170771) is another VGAM1043 host target gene. LOC254358 BINDING SITE is HOST TARGET binding site found in the 3' untranslated region of mRNA encoded by LOC254358, corresponding to a HOST TARGET binding site such as BINDING SITE I, BINDING SITE II or BINDING SITE III. Table 2 illustrates the complementarity of the nucleotide sequences of LOC254358 BINDING SITE, designated SEQ ID:45532, to the nucleotide sequence of VGAM1043 RNA, herein designated VGAM RNA, also designated SEQ ID:3754.

Another function of VGAM1043 is therefore inhibition of LOC254358 (Accession XM_170771). Accordingly, utilities of VGAM1043 include diagnosis, prevention and treatment of diseases and clinical conditions associated with LOC254358. LOC254936 (Accession XM_170770) is another VGAM1043 host target gene. LOC254936 BINDING SITE is HOST TARGET binding site found in the 3' untranslated region of mRNA encoded by LOC254936, corresponding to a HOST TARGET binding site such as BINDING SITE I, BINDING SITE II or BINDING SITE III. Table 2 illustrates the complementarity of the nucleotide sequences of LOC254936 BINDING SITE, designated SEQ ID:45529, to the nucleotide sequence of VGAM1043 RNA, herein designated VGAM RNA, also designated SEQ ID:3754.

Another function of VGAM1043 is therefore inhibition of LOC254936 (Accession XM_170770). Accordingly, utilities of VGAM1043 include diagnosis, prevention and treatment of diseases and clinical conditions associated with LOC254936. LOC257286 (Accession XM_170549) is another VGAM1043 host target gene. LOC257286 BINDING SITE is HOST TARGET binding site found in the 3' untranslated region of mRNA encoded by LOC257286, corresponding to a HOST TARGET binding site such as BINDING SITE I, BINDING SITE II or BINDING SITE III. Table 2 illustrates the complementarity of the nucleotide sequences of LOC257286 BINDING SITE, designated SEQ ID:45374, to the nucleotide sequence of VGAM1043 RNA, herein designated VGAM RNA, also designated SEQ ID:3754.

Another function of VGAM1043 is therefore inhibition of LOC257286 (Accession XM_170549). Accordingly, utilities of VGAM1043 include diagnosis, prevention and treatment of diseases and clinical conditions associated with LOC257286. LOC257464 (Accession XM_116972) is another VGAM1043 host target gene. LOC257464 BINDING SITE is HOST TARGET binding site found in the 3' untranslated region of mRNA encoded by LOC257464, corresponding to a HOST TARGET binding site such as BINDING SITE I, BINDING SITE II or BINDING SITE III. Table 2 illustrates the complementarity of the nucleotide sequences of LOC257464 BINDING SITE, designated SEQ ID:43166, to the nucleotide sequence of VGAM1043 RNA, herein designated VGAM RNA, also designated SEQ ID:3754.

Another function of VGAM1043 is therefore inhibition of LOC257464 (Accession XM_116972). Accordingly, utilities of VGAM1043 include diagnosis, prevention and treatment of diseases and clinical conditions associated with LOC257464. LOC257494 (Accession XM_175212) is another VGAM1043 host target gene. LOC257494 BINDING SITE is HOST TARGET binding site found in the 3' untranslated region of mRNA encoded by LOC257494, corresponding to a HOST TARGET binding site such as BINDING SITE I, BINDING SITE II or BINDING SITE III. Table 2 illustrates the complementarity of the nucleotide sequences of LOC257494 BINDING SITE, designated SEQ ID:46688, to the nucleotide sequence of VGAM1043 RNA, herein designated VGAM RNA, also designated SEQ ID:3754.

Another function of VGAM1043 is therefore inhibition of LOC257494 (Accession XM_175212). Accordingly, utilities of VGAM1043 include diagnosis, prevention and treatment of diseases and clinical conditions associated with LOC257494. LOC58489 (Accession XM_051862) is another VGAM1043 host target gene. LOC58489 BINDING SITE is HOST TARGET binding site found in the 3' untranslated region of mRNA encoded by LOC58489, corresponding to a HOST TARGET binding site such as BINDING SITE I, BINDING SITE II or BINDING SITE III. Table 2 illustrates the complementarity of the nucleotide sequences of LOC58489 BINDING SITE, designated SEQ ID:35903, to the nucleotide sequence of VGAM1043 RNA, herein designated VGAM RNA, also designated SEQ ID:3754.

Another function of VGAM1043 is therefore inhibition of LOC58489 (Accession XM_051862). Accordingly, utilities of VGAM1043 include diagnosis, prevention and treatment of diseases and clinical conditions associated with LOC58489. LOC92017 (Accession XM_042234) is another VGAM1043 host target gene. LOC92017 BINDING SITE is HOST TARGET binding site found in the 5' untranslated region of mRNA encoded by LOC92017, corresponding to a HOST TARGET binding site such as BINDING SITE I, BINDING SITE II or BINDING SITE III. Table 2 illustrates the complementarity of the nucleotide sequences of LOC92017 BINDING SITE, designated SEQ ID:33708, to the nucleotide sequence of VGAM1043 RNA, herein designated VGAM RNA, also designated SEQ ID:3754.

Another function of VGAM1043 is therefore inhibition of LOC92017 (Accession XM_042234). Accordingly, utilities of VGAM1043 include diagnosis, prevention and treatment of diseases and clinical conditions associated with LOC92017. LOC92303 (Accession XM_044108) is another VGAM1043 host target gene. LOC92303 BINDING SITE is HOST TARGET binding site found in the 3' untranslated region of mRNA encoded by LOC92303, corresponding to a HOST TARGET binding site such as BINDING SITE I, BINDING SITE II or BINDING SITE III. Table 2 illustrates the complementarity of the nucleotide sequences of LOC92303 BINDING SITE, designated SEQ ID:34137, to the nucleotide sequence of VGAM1043 RNA, herein designated VGAM RNA, also designated SEQ ID:3754.

Another function of VGAM1043 is therefore inhibition of LOC92303 (Accession XM_044108). Accordingly, utilities of VGAM1043 include diagnosis, prevention and treatment of diseases and clinical conditions associated with LOC92303. LOC92822 (Accession XM_047520) is another VGAM1043 host target gene. LOC92822 BINDING SITE is HOST TARGET binding site found in the 3' untranslated region of mRNA encoded by LOC92822, corresponding to a HOST TARGET binding site such as BINDING SITE I, BINDING SITE II or BINDING SITE III. Table 2 illustrates the complementarity of the nucleotide sequences of LOC92822 BINDING SITE, designated SEQ ID:34986, to the nucleotide sequence of VGAM1043 RNA, herein designated VGAM RNA, also designated SEQ ID:3754.

Another function of VGAM1043 is therefore inhibition of LOC92822 (Accession XM_047520). Accordingly, utilities of VGAM1043 include diagnosis, prevention and treatment of diseases and clinical conditions associated with LOC92822. FIG. 1 further provides a conceptual description of a novel bioinformatically detected viral gene of the present invention, referred to here as Viral Genomic Address Messenger 1044 (VGAM1044) viral gene, which modulates expression of respective host target genes thereof, the function and utility of which host target genes is known in the art.

VGAM1044 is a novel bioinformatically detected regulatory, non protein coding, viral micro RNA (miRNA) gene. The method by which VGAM1044 was detected is described hereinabove with reference to FIGS. 1-8.

VGAM1044 gene, herein designated VGAM GENE, is a viral gene contained in the genome of Human Herpesvirus 8. VGAM1044 host target gene, herein designated VGAM HOST TARGET GENE, is a human gene contained in the human genome.

VGAM1044 gene encodes a VGAM1044 precursor RNA, herein designated VGAM PRECURSOR RNA. Similar to other miRNA genes, and unlike most ordinary genes, VGAM1044 precursor RNA does not encode a protein. A nucleotide sequence identical or highly similar to the nucleotide sequence of VGAM1044 precursor RNA is designated SEQ ID:1030, and is provided hereinbelow with reference to the sequence listing part. Nucleotide sequence SEQ ID:1030 is located at position 131364 relative to the genome of Human Herpesvirus 8.

VGAM1044 precursor RNA folds onto itself, forming VGAM1044 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1044 folded precursor RNA into VGAM1044 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM1044 RNA is designated SEQ ID:3755, and is provided hereinbelow with reference to the sequence listing part.

VGAM1044 host target gene, herein designated VGAM HOST TARGET GENE, encodes a corresponding messenger RNA, VGAM1044 host target RNA, herein designated VGAM HOST TARGET RNA. VGAM1044 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1044 RNA, herein designated VGAM RNA, binds complementarily to one or more host target binding sites located in untranslated regions of VGAM1044 host target RNA, herein designated VGAM HOST TARGET RNA. This complementary binding is due to the fact that the nucleotide sequence of VGAM1044 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1044 RNA, herein designated VGAM RNA, may have a different number of host target binding sites in untranslated regions of a VGAM1044 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1044 RNA, herein designated VGAM RNA, to host target binding sites on VGAM1044 host target RNA, herein designated VGAM HOST TARGET RNA, such as BINDING SITE I, BINDING SITE II and BINDING SITE III, inhibits translation of VGAM1044 host target RNA into VGAM1044 host target protein, herein designated VGAM HOST TARGET PROTEIN. VGAM host target protein is therefore outlined by a broken line.

It is appreciated that VGAM1044 host target gene, herein designated VGAM HOST TARGET GENE, in fact represents a plurality of VGAM1044 host target genes. The mRNA of each one of this plurality of VGAM1044 host target genes comprises one or more host target binding sites, each having a nucleotide sequence which is at least partly complementary to VGAM1044 RNA, herein designated VGAM RNA, and which when bound by VGAM1044 RNA causes inhibition of translation of respective one or more VGAM1044 host target proteins.

It is further appreciated by one skilled in the art that the mode of translational inhibition illustrated by FIG. 1 with specific reference to translational inhibition exerted by VGAM1044 gene, herein designated VGAM GENE, on one or more VGAM1044 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1044 is inhibition of expression of host target genes, as part of a novel viral mechanism of attacking a host. Accordingly, utilities of VGAM1044 include diagnosis, prevention and treatment of viral infection by Human Herpesvirus 8. Specific functions, and accordingly utilities, of VGAM1044 correlate with, and may be deduced from, the identity of the host target genes which VGAM1044 binds and inhibits, and the function of these host target genes, as elaborated hereinbelow.

Nucleotide sequences of the VGAM1044 precursor RNA, herein designated VGAM PRECURSOR RNA, and of the 'diced' VGAM1044 RNA, herein designated VGAM RNA, and a schematic representation of the secondary folding of VGAM1044 folded precursor RNA, herein designated VGAM FOLDED PRECURSOR RNA, of VGAM1044 are further described hereinbelow with reference to Table 1.

Nucleotide sequences of host target binding sites, such as BINDING SITE-I, BINDING SITE-II and BINDING SITE-III of FIG. 1, found on VGAM1044 host target RNA, and schematic representation of the complementarity of each of these host target binding sites to VGAM1044 RNA, herein designated VGAM RNA, are described hereinbelow with reference to Table 2.

As mentioned hereinabove with reference to FIG. 1, a function of VGAM1044 gene, herein designated VGAM is inhibition of expression of VGAM1044 target genes. It is appreciated that specific functions, and accordingly utilities, of VGAM1044 correlate with, and may be deduced from, the identity of the target genes which VGAM1044 binds and inhibits, and the function of these target genes, as elaborated hereinbelow.

Aldehyde Dehydrogenase 1 Family, Member A3 (ALDH1A3, Accession NM_000693) is a VGAM1044 host target gene. ALDH1A3 BINDING SITE is HOST TARGET binding site found in the 3' untranslated region of mRNA encoded by ALDH1A3, corresponding to a HOST TARGET binding site such as BINDING SITE I, BINDING SITE II or BINDING SITE III. Table 2 illustrates the complementarity of the nucleotide sequences of ALDH1A3 BINDING SITE, designated SEQ ID:6353, to the nucleotide sequence of VGAM1044 RNA, herein designated VGAM RNA, also designated SEQ ID:3755.

A function of VGAM1044 is therefore inhibition of Aldehyde Dehydrogenase 1 Family, Member A3 (ALDH1A3, Accession NM_000693), a gene which plays a major role in the detoxification of aldehydes generated by alcohol metabolism and lipid peroxidation. Accordingly, utilities of VGAM1044 include diagnosis, prevention and treatment of diseases and clinical conditions associated with ALDH1A3. The function of ALDH1A3 and its association with various diseases and clinical conditions, has been established by previous studies, as described hereinabove with reference to VGAM565. UDP-Gal:betaGlcNAc Beta 1,4-Galactosyltransferase, Polypeptide 1 (B4GALT1, Accession NM_001497) is another VGAM1044 host target gene. B4GALT1 BINDING SITE is HOST TARGET binding site found in the 3' untranslated region of mRNA encoded by B4GALT1, corresponding to a HOST TARGET binding site such as BINDING SITE I, BINDING SITE II or BINDING SITE III. Table 2 illustrates the complementarity of the nucleotide sequences of B4GALT1 BINDING SITE, designated SEQ ID:7244, to the nucleotide sequence of VGAM1044 RNA, herein designated VGAM RNA, also designated SEQ ID:3755.

Another function of VGAM1044 is therefore inhibition of UDP-Gal:betaGlcNAc Beta 1,4-Galactosyltransferase, Polypeptide 1 (B4GALT1, Accession NM_001497). Accordingly, utilities of VGAM1044 include diagnosis, prevention and treatment of diseases and clinical conditions associated with B4GALT1. Prokineticin 1 (PROK1, Accession NM_032414) is another VGAM1044 host target gene. PROK1 BINDING SITE is HOST TARGET binding site found in the 3' untranslated region of mRNA encoded by PROK1, corresponding to a HOST TARGET binding site such as BINDING SITE I, BINDING SITE II or BINDING SITE III. Table 2 illustrates the complementarity of the nucleotide sequences of PROK1 BINDING SITE, designated SEQ ID:26197, to the nucleotide sequence of VGAM1044 RNA, herein designated VGAM RNA, also designated SEQ ID:3755.

Another function of VGAM1044 is therefore inhibition of Prokineticin 1 (PROK1, Accession NM_032414), a gene which induces proliferation, migration and fenestration in capillary endothelial cells derived from endocrine glands. Accordingly, utilities of VGAM1044 include diagnosis, prevention and treatment of diseases and clinical conditions associated with PROK1. The function of PROK1 and its association with various diseases and clinical conditions, has been established by previous studies, as described hereinabove with reference to VGAM1000. Solute Carrier Family 21 (prostaglandin transporter), Member 2 (SLC21A2, Accession NM_005630) is another VGAM1044 host target gene. SLC21A2 BINDING SITE is HOST TARGET binding site found in the 3' untranslated region of mRNA encoded by SLC21A2, corresponding to a HOST TARGET binding site such as BINDING SITE I, BINDING SITE II or BINDING SITE III. Table 2 illustrates the complementarity of the nucleotide sequences of SLC21A2 BINDING SITE, designated SEQ ID:12158, to the nucleotide sequence of VGAM1044 RNA, herein designated VGAM RNA, also designated SEQ ID:3755.

Another function of VGAM1044 is therefore inhibition of Solute Carrier Family 21 (prostaglandin transporter), Member 2 (SLC21A2, Accession NM_005630), a gene which is a Prostaglandin transporter. Accordingly, utilities of VGAM1044 include diagnosis, prevention and treatment of diseases and clinical conditions associated with SLC21A2. The function of SLC21A2 and its association with various diseases and clinical conditions, has been established by previous studies, as described hereinabove with reference to VGAM83. Unc-119 Homolog (C. elegans) (UNC119, Accession NM_005148) is another VGAM1044 host target gene. UNC119 BINDING SITE1 and UNC119 BINDING SITE2 are HOST TARGET binding sites found in untranslated regions of mRNA encoded by UNC119, corresponding to HOST TARGET binding sites such as BINDING SITE I, BINDING SITE II or BINDING SITE III. Table 2 illustrates the complementarity of the nucleotide sequences of UNC119 BINDING SITE1 and UNC119 BINDING SITE2, designated SEQ ID:11620 and SEQ ID:27646 respectively, to the nucleotide sequence of VGAM1044 RNA, herein designated VGAM RNA, also designated SEQ ID:3755.

Another function of VGAM1044 is therefore inhibition of Unc-119 Homolog (C. elegans) (UNC119, Accession NM_005148), a gene which is expressed in the retina and may play a role in the mechanism of photoreceptor neurotransmitter release through the synaptic vesicle cycle. Accordingly, utilities of VGAM1044 include diagnosis, prevention and treatment of diseases and clinical conditions associated with UNC119. The function of UNC119 has been established by previous studies. Using a subtractive hybridization strategy, Higashide et al. (1996) identified a retina-specific cDNA that they designated HRG4 (human retinal gene-4). Northern blot analysis revealed that the approximately 1.4-kb HRG4 mRNA is expressed specifically in human retina. The authors also cloned a cDNA encoding RRG4, the rat HRG4 homolog. The predicted 240-amino acid human and rat proteins both contain an N-terminal region rich in proline and glycine followed by a region with a mixture of alpha helices, beta sheets, and turns. Sequence comparisons indicated that the proline-glycine domains of RRG4 and HRG4 share only 67% homology, while the rest of the sequence is 100% identical. By in situ hybridization, Higashide et al. (1996) demonstrated that the HRG4 gene is expressed specifically in photoreceptors, both rods and cones, in human retina. In rat, the authors observed high levels of RRG4 expression in the outer retina beginning around postnatal day 5, when the photoreceptors begin to differentiate, and expression increased rapidly to reach the adult level by postnatal day 23. Mutations in the C. elegans unc119 gene lead to defects in locomotion, feeding behavior, and chemosensation. Both Swanson et al. (1998) and Higashide et al. (1998) observed that HRG4 shares strong homology with the C. elegans unc119 protein, leading Swanson et al. (1998) to designate the human protein UNC119. Swanson et al. (1998) stated that a human UNC119 cDNA functionally complemented the C. elegans unc119 mutation. Using immunofluorescence, Higashide et al. (1998) localized HRG4 to the outer plexiform layer of the retina in the synaptic termini of rod and cone photoreceptors. Electron microscopic immunolocalization showed that the protein is present in the cytoplasm and on the presynaptic membranes of the photoreceptor synapses. The authors suggested that HRG4 may play a role in the mechanism of photoreceptor neurotransmitter release through the synaptic vesicle cycle. They noted that the homology of HRG4 and unc119 is consistent with a possible role of HRG4 in the synaptic vesicle cycle, because the broad effects of unc119 on neuronal function are consistent with a defect in neurotransmission.

Full details of the abovementioned studies are described in the following publications, the disclosure of which are hereby incorporated by reference:

Higashide, T.; Murakami, A.; McLaren, M. J.; Inana, G.: Cloning of the cDNA for a novel photoreceptor protein. J. Biol. Chem. 271:1797-1804, 1996; and Swanson, D. A.; Chang, J. T.; Campochiaro, P. A.; Zack, D. J.; Valle, D.: Mammalian orthologs of C. elegans unc-119 highly expressed in photoreceptors. Invest. Ophthal. Vis. Sci. 39:20.

Further studies establishing the function and utilities of UNC119 are found in John Hopkins OMIM database record ID 604011, and in sited publications numbered 7608-7611 listed in the bibliography section hereinbelow, which are also hereby incorporated by reference. Double C2-like Domains, Beta (DOC2B, Accession NM_003585) is another VGAM1044 host target gene. DOC2B BINDING SITE is HOST TARGET binding site found in the 3' untranslated region of mRNA encoded by DOC2B, corresponding to a HOST TARGET binding site such as BINDING SITE I, BINDING SITE II or BINDING SITE III. Table 2 illustrates the complementarity of the nucleotide sequences of DOC2B BINDING SITE, designated SEQ ID:9636, to the nucleotide sequence of VGAM1044 RNA, herein designated VGAM RNA, also designated SEQ ID:3755.

Another function of VGAM1044 is therefore inhibition of Double C2-like Domains, Beta (DOC2B, Accession NM_003585). Accordingly, utilities of VGAM1044 include diagnosis, prevention and treatment of diseases and clinical conditions associated with DOC2B. KIAA0767 (Accession XM_027105) is another VGAM1044 host target gene. KIAA0767 BINDING SITE is HOST TARGET binding site found in the 3' untranslated region of mRNA encoded by KIAA0767, corresponding to a HOST TARGET binding site such as BINDING SITE I, BINDING SITE II or BINDING SITE III. Table 2 illustrates the complementarity of the nucleotide sequences of KIAA0767 BINDING SITE, designated SEQ ID:30407, to the nucleotide sequence of VGAM1044 RNA, herein designated VGAM RNA, also designated SEQ ID:3755.

Another function of VGAM1044 is therefore inhibition of KIAA0767 (Accession XM_027105). Accordingly, utilities of VGAM1044 include diagnosis, prevention and treatment of diseases and clinical conditions associated with KIAA0767. KIAA1297 (Accession XM_051005) is another VGAM1044 host target gene. KIAA1297 BINDING SITE is HOST TARGET binding site found in the 3' untranslated region of mRNA encoded by KIAA1297, corresponding to a HOST TARGET binding site such as BINDING SITE I, BINDING SITE II or BINDING SITE III. Table 2 illustrates the complementarity of the nucleotide sequences of KIAA1297 BINDING SITE, designated SEQ ID:35711, to the nucleotide sequence of VGAM1044 RNA, herein designated VGAM RNA, also designated SEQ ID:3755.

Another function of VGAM1044 is therefore inhibition of KIAA1297 (Accession XM_051005). Accordingly, utilities of VGAM1044 include diagnosis, prevention and treatment of diseases and clinical conditions associated with KIAA1297. KIAA1822 (Accession XM_041566) is another VGAM1044 host target gene. KIAA1822 BINDING SITE is HOST TARGET binding site found in the 3' untranslated region of mRNA encoded by KIAA1822, corresponding to a HOST TARGET binding site such as BINDING SITE I, BINDING SITE II or BINDING SITE III. Table 2 illustrates the complementarity of the nucleotide sequences of KIAA1822 BINDING SITE, designated SEQ ID:33554, to the nucleotide sequence of VGAM1044 RNA, herein designated VGAM RNA, also designated SEQ ID:3755.

Another function of VGAM1044 is therefore inhibition of KIAA1822 (Accession XM_041566). Accordingly, utilities of VGAM1044 include diagnosis, prevention and treatment of diseases and clinical conditions associated with KIAA1822. NRF (Accession NM_017544) is another VGAM1044 host target gene. NRF BINDING SITE is HOST TARGET binding site found in the 3' untranslated region of mRNA encoded by NRF, corresponding to a HOST TARGET binding site such as BINDING SITE I, BINDING SITE II or BINDING SITE III. Table 2 illustrates the complementarity of the nucleotide sequences of NRF BINDING SITE, designated SEQ ID:18984, to the nucleotide sequence of VGAM1044 RNA, herein designated VGAM RNA, also designated SEQ ID:3755.

Another function of VGAM1044 is therefore inhibition of NRF (Accession NM_017544). Accordingly, utilities of VGAM1044 include diagnosis, prevention and treatment of diseases and clinical conditions associated with NRF. Tubby Homolog (mouse) (TUB, Accession NM_003320) is another VGAM1044 host target gene. TUB BINDING SITE is HOST TARGET binding site found in the 3" untranslated region of mRNA encoded by TUB, corresponding to a HOST TARGET binding site such as BINDING SITE I, BINDING SITE II or BINDING SITE III. Table 2 illustrates the complementarity of the nucleotide sequences of TUB BINDING SITE, designated SEQ ID:9322, to the nucleotide sequence of VGAM1044 RNA, herein designated VGAM RNA, also designated SEQ ID:3755.

Another function of VGAM1044 is therefore inhibition of Tubby Homolog (mouse) (TUB, Accession NM_003320). Accordingly, utilities of VGAM1044 include diagnosis, prevention and treatment of diseases and clinical conditions associated with TUB. LOC127702 (Accession XM_060619) is another VGAM1044 host target gene. LOC127702 BINDING SITE is HOST TARGET binding site found in the 3' untranslated region of mRNA encoded by LOC127702, corresponding to a HOST TARGET binding site such as BINDING SITE I, BINDING SITE II or BINDING SITE III. Table 2 illustrates the complementarity of the nucleotide sequences of LOC127702 BINDING SITE, designated SEQ ID:37180, to the nucleotide sequence of VGAM1044 RNA, herein designated VGAM RNA, also designated SEQ ID:3755.

Another function of VGAM1044 is therefore inhibition of LOC127702 (Accession XM_060619). Accordingly, utilities of VGAM1044 include diagnosis, prevention and treatment of diseases and clinical conditions associated with LOC127702. LOC150407 (Accession XM_086906) is another VGAM1044 host target gene. LOC150407 BINDING SITE is HOST TARGET binding site found in the 3' untranslated region of mRNA encoded by LOC150407, corresponding to a HOST TARGET binding site such as BINDING SITE I, BINDING SITE II or BINDING SITE III. Table 2 illustrates the complementarity of the nucleotide sequences of LOC150407 BINDING SITE, designated SEQ ID:38950, to the nucleotide sequence of VGAM1044 RNA, herein designated VGAM RNA, also designated SEQ ID:3755.

Another function of VGAM1044 is therefore inhibition of LOC150407 (Accession XM_086906). Accordingly, utilities of VGAM1044 include diagnosis, prevention and treatment of diseases and clinical conditions associated with LOC150407. LOC166341 (Accession XM_093804) is another VGAM1044 host target gene. LOC166341 BINDING SITE is HOST TARGET binding site found in the 3' untranslated region of mRNA encoded by LOC166341, corresponding to a HOST TARGET binding site such as BINDING SITE I, BINDING SITE II or BINDING SITE III. Table 2 illustrates the complementarity of the nucleotide sequences of LOC166341 BINDING SITE, designated SEQ ID:40210, to the nucleotide sequence of VGAM1044 RNA, herein designated VGAM RNA, also designated SEQ ID:3755.

Another function of VGAM1044 is therefore inhibition of LOC166341 (Accession XM_093804). Accordingly, utilities of VGAM1044 include diagnosis, prevention and treatment of diseases and clinical conditions associated with LOC166341. LOC219942 (Accession XM_167790) is another VGAM1044 host target gene. LOC219942 BINDING SITE is HOST TARGET binding site found in the 3' untranslated region of mRNA encoded by LOC219942, corresponding to a HOST TARGET binding site such as BINDING SITE I, BINDING SITE II or BINDING SITE III. Table 2 illustrates the complementarity of the nucleotide sequences of LOC219942 BINDING SITE, designated SEQ ID:44824, to the nucleotide sequence of VGAM1044 RNA, herein designated VGAM RNA, also designated SEQ ID:3755.

Another function of VGAM1044 is therefore inhibition of LOC219942 (Accession XM_167790). Accordingly, utilities of VGAM1044 include diagnosis, prevention and treatment of diseases and clinical conditions associated with LOC219942. LOC253868 (Accession XM_170975) is another VGAM1044 host target gene. LOC253868 BINDING SITE is HOST TARGET binding site found in the 5' untranslated region of mRNA encoded by LOC253868, corresponding to a HOST TARGET binding site such as BINDING SITE I, BINDING SITE II or BINDING SITE III. Table 2 illustrates the complementarity of the nucleotide sequences of LOC253868 BINDING SITE, designated SEQ ID:45751, to the nucleotide sequence of VGAM1044 RNA, herein designated VGAM RNA, also designated SEQ ID:3755.

Another function of VGAM1044 is therefore inhibition of LOC253868 (Accession XM_170975). Accordingly, utilities of VGAM1044 include diagnosis, prevention and treatment of diseases and clinical conditions associated with LOC253868. FIG. 1 further provides a conceptual description of a novel bioinformatically detected viral gene of the present invention, referred to here as Viral Genomic Address Messenger 1045 (VGAM1045) viral gene, which modulates expression of respective host target genes thereof, the function and utility of which host target genes is known in the art.

VGAM1045 is a novel bioinformatically detected regulatory, non protein coding, viral micro RNA (miRNA) gene. The method by which VGAM1045 was detected is described hereinabove with reference to FIGS. 1-8.

VGAM1045 gene, herein designated VGAM GENE, is a viral gene contained in the genome of Sulfolobus Virus SIRV-1. VGAM1045 host target gene, herein designated VGAM HOST TARGET GENE, is a human gene contained in the human genome.

VGAM1045 gene encodes a VGAM1045 precursor RNA, herein designated VGAM PRECURSOR RNA. Similar to other miRNA genes, and unlike most ordinary genes, VGAM1045 precursor RNA does not encode a protein. A nucleotide sequence identical or highly similar to the nucleotide sequence of VGAM1045 precursor RNA is designated SEQ ID:1031, and is provided hereinbelow with reference to the sequence listing part. Nucleotide sequence SEQ ID:1031 is located at position 26929 relative to the genome of Sulfolobus Virus SIRV-1.

VGAM1045 precursor RNA folds onto itself, forming VGAM1045 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1045 folded precursor RNA into VGAM1045 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1045 RNA is designated SEQ ID:3756, and is provided hereinbelow with reference to the sequence listing part.

VGAM1045 host target gene, herein designated VGAM HOST TARGET GENE, encodes a corresponding messenger RNA, VGAM1045 host target RNA, herein designated VGAM HOST TARGET RNA. VGAM1045 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1045 RNA, herein designated VGAM RNA, binds complementarily to one or more host target binding sites located in untranslated regions of VGAM1045 host target RNA, herein designated VGAM HOST TARGET RNA. This complementary binding is due to the fact that the nucleotide sequence of VGAM1045 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1045 RNA, herein designated VGAM RNA, may have a different number of host target binding sites in untranslated regions of a VGAM1045 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1045 RNA, herein designated VGAM RNA, to host target binding sites on VGAM1045 host target RNA, herein designated VGAM HOST TARGET RNA, such as BINDING SITE I, BINDING SITE II and BINDING SITE III, inhibits translation of VGAM1045 host target RNA into VGAM1045 host target protein, herein designated VGAM HOST TARGET PROTEIN. VGAM host target protein is therefore outlined by a broken line.

It is appreciated that VGAM1045 host target gene, herein designated VGAM HOST TARGET GENE, in fact represents a plurality of VGAM1045 host target genes. The mRNA of each one of this plurality of VGAM1045 host target genes comprises one or more host target binding sites, each having a nucleotide sequence which is at least partly complementary to VGAM1045 RNA, herein designated VGAM RNA, and which when bound by VGAM1045 RNA causes inhibition of translation of respective one or more VGAM1045 host target proteins.

It is further appreciated by one skilled in the art that the mode of translational inhibition illustrated by FIG. 1 with specific reference to translational inhibition exerted by VGAM1045 gene, herein designated VGAM GENE, on one or more VGAM1045 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1045 is inhibition of expression of host target genes, as part of a novel viral mechanism of attacking a host. Accordingly, utilities of VGAM1045 include diagnosis, prevention and treatment of viral infection by Sulfolobus Virus SIRV-1. Specific functions, and accordingly utilities, of VGAM1045 correlate with, and may be deduced from, the identity of the host target genes which VGAM1045 binds and inhibits, and the function of these host target genes, as elaborated hereinbelow.

Nucleotide sequences of the VGAM1045 precursor RNA, herein designated VGAM PRECURSOR RNA, and of the 'diced' VGAM1045 RNA, herein designated VGAM RNA, and a schematic representation of the secondary folding of VGAM1045 folded precursor RNA, herein designated VGAM FOLDED PRECURSOR RNA, of VGAM1045 are further described hereinbelow with reference to Table 1.

Nucleotide sequences of host target binding sites, such as BINDING SITE-I, BINDING SITE-II and BINDING SITE-III of FIG. 1, found on VGAM1045 host target RNA, and schematic representation of the complementarity of each of these host target binding sites to VGAM1045 RNA, herein designated VGAM RNA, are described hereinbelow with reference to Table 2.

As mentioned hereinabove with reference to FIG. 1, a function of VGAM1045 gene, herein designated VGAM is inhibition of expression of VGAM1045 target genes. It is appreciated that specific functions, and accordingly utilities, of VGAM1045 correlate with, and may be deduced from, the identity of the target genes which VGAM1045 binds and inhibits, and the function of these target genes, as elaborated hereinbelow.

Enamelin (ENAM, Accession NM_031889) is a VGAM1045 host target gene. ENAM BINDING SITE is HOST TARGET binding site found in the 3' untranslated region of mRNA encoded by ENAM, corresponding to a HOST TARGET binding site such as BINDING SITE I, BINDING SITE II or BINDING SITE III. Table 2 illustrates the complementarity of the nucleotide sequences of ENAM BINDING SITE, designated SEQ ID:25633, to the nucleotide sequence of VGAM1045 RNA, herein designated VGAM RNA, also designated SEQ ID:3756.

A function of VGAM1045 is therefore inhibition of Enamelin (ENAM, Accession NM_031889). Accordingly, utilities of VGAM1045 include diagnosis, prevention and treatment of diseases and clinical conditions associated with ENAM. MAX Interacting Protein 1 (MXI1, Accession NM_005962) is another VGAM1045 host target gene. MXI1 BINDING SITE1 and MXI1 BINDING SITE2 are HOST TARGET binding sites found in untranslated regions of mRNA encoded by MXI1, corresponding to HOST TARGET binding sites such as BINDING SITE I, BINDING SITE II or BINDING SITE III. Table 2 illustrates the complementarity of the nucleotide sequences of MXI1 BINDING SITE1 and MXI1 BINDING SITE2, designated SEQ ID:12585 and SEQ ID:28195 respectively, to the nucleotide sequence of VGAM1045 RNA, herein designated VGAM RNA, also designated SEQ ID:3756.

Another function of VGAM1045 is therefore inhibition of MAX Interacting Protein 1 (MXI1, Accession NM_005962), a gene which acts as a tumor suppressor in vivo, engages the MYC network in a functionally relevant manner. Accordingly, utilities of VGAM1045 include diagnosis, prevention and treatment of diseases and clinical conditions associated with MXI1. The function of MXI1 and its association with various diseases and clinical conditions, has been established by previous studies, as described hereinabove with reference to VGAM128. Rabphilin 3A-like (without C2 domains) (RPH3AL, Accession NM_006987) is another VGAM1045 host target gene. RPH3AL BINDING SITE is HOST TARGET binding site found in the 3' untranslated region of mRNA encoded by RPH3AL, corresponding to a HOST TARGET binding site such as BINDING SITE I, BINDING SITE II or BINDING SITE III. Table 2 illustrates the complementarity of the nucleotide sequences of RPH3AL BINDING SITE, designated SEQ ID:13847, to the nucleotide sequence of VGAM1045 RNA, herein designated VGAM RNA, also designated SEQ ID:3756.

Another function of VGAM1045 is therefore inhibition of Rabphilin 3A-like (without C2 domains) (RPH3AL, Accession NM_006987), a gene which is a protein transporter. could play a role in neurotransmitter release by regulating membrane flow in the nerve terminal. Accordingly, utilities of VGAM1045 include diagnosis, prevention and treatment of diseases and clinical conditions associated with RPH3AL. The function of RPH3AL and its association with various diseases and clinical conditions, has been established by previous studies, as described hereinabove with reference to VGAM923. FHR5 (Accession NM_030787) is another VGAM1045 host target gene. FHR5 BINDING SITE is HOST TARGET binding site found in the 3' untranslated region of mRNA encoded by FHR5, corresponding to a HOST TARGET binding site such as BINDING SITE I, BINDING SITE II or BINDING SITE III. Table 2 illustrates the complementarity of the nucleotide sequences of FHR5 BINDING SITE, designated SEQ ID:25085, to the nucleotide sequence of VGAM1045 RNA, herein designated VGAM RNA, also designated SEQ ID:3756.

Another function of VGAM1045 is therefore inhibition of FHR5 (Accession NM_030787). Accordingly, utilities of VGAM1045 include diagnosis, prevention and treatment of diseases and clinical conditions associated with FHR5. FLJ10922 (Accession NM_018273) is another VGAM1045 host target gene. FLJ10922 BINDING SITE is HOST TARGET binding site found in the 3' untranslated region of mRNA encoded by FLJ10922, corresponding to a HOST TARGET binding site such as BINDING SITE I, BINDING SITE II or BINDING SITE III. Table 2 illustrates the complementarity of the nucleotide sequences of FLJ10922 BINDING SITE, designated SEQ ID:20257, to the nucleotide sequence of VGAM1045 RNA, herein designated VGAM RNA, also designated SEQ ID:3756.

Another function of VGAM1045 is therefore inhibition of FLJ10922 (Accession NM_018273). Accordingly, utilities of VGAM1045 include diagnosis, prevention and treatment of diseases and clinical conditions associated with FLJ10922. FLJ20730 (Accession NM_017945) is another VGAM1045 host target gene. FLJ20730 BINDING SITE is HOST TARGET binding site found in the 3' untranslated region of mRNA encoded by FLJ20730, corresponding to a HOST TARGET binding site such as BINDING SITE I, BINDING SITE II or BINDING SITE III. Table 2 illustrates the complementarity of the nucleotide sequences of FLJ20730 BINDING SITE, designated SEQ ID:19642, to the nucleotide sequence of VGAM1045 RNA, herein designated VGAM RNA, also designated SEQ ID:3756.

Another function of VGAM1045 is therefore inhibition of FLJ20730 (Accession NM_017945). Accordingly, utilities of VGAM1045 include diagnosis, prevention and treatment of diseases and clinical conditions associated with FLJ20730. FLJ21820 (Accession NM_021925) is another VGAM1045 host target gene. FLJ21820 BINDING SITE is HOST TARGET binding site found in the 3' untranslated region of mRNA encoded by FLJ21820, corresponding to a HOST TARGET binding site such as BINDING SITE I, BINDING SITE II or BINDING SITE III. Table 2 illustrates the complementarity of the nucleotide sequences of FLJ21820 BINDING SITE, designated SEQ ID:22453, to the nucleotide sequence of VGAM1045 RNA, herein designated VGAM RNA, also designated SEQ ID:3756.

Another function of VGAM1045 is therefore inhibition of FLJ21820 (Accession NM_021925). Accordingly, utilities of VGAM1045 include diagnosis, prevention and treatment of diseases and clinical conditions associated with FLJ21820. ICK (Accession NM_014920) is another VGAM1045 host target gene. ICK BINDING SITE is HOST TARGET binding site found in the 3' untranslated region of mRNA encoded by ICK, corresponding to a HOST TARGET binding site such as BINDING SITE I, BINDING SITE II or BINDING SITE III. Table 2 illustrates the complementarity of the nucleotide sequences of ICK BINDING SITE, designated SEQ ID:17197, to the nucleotide sequence of VGAM1045 RNA, herein designated VGAM RNA, also designated SEQ ID:3756.

Another function of VGAM1045 is therefore inhibition of ICK (Accession NM_014920). Accordingly, utilities of VGAM1045 include diagnosis, prevention and treatment of diseases and clinical conditions associated with ICK. IPLA2(GAMMA) (Accession XM_027224) is another VGAM1045 host target gene. IPLA2(GAMMA) BINDING SITE is HOST TARGET binding site found in the 5' untranslated region of mRNA encoded by IPLA2(GAMMA), corresponding to a HOST TARGET binding site such as BINDING SITE I, BINDING SITE II or BINDING SITE III. Table 2 illustrates the complementarity of the nucleotide sequences of IPLA2(GAMMA) BINDING SITE, designated SEQ ID:30446, to the nucleotide sequence of VGAM1045 RNA, herein designated VGAM RNA, also designated SEQ ID:3756.

Another function of VGAM1045 is therefore inhibition of IPLA2(GAMMA) (Accession XM_027224). Accordingly, utilities of VGAM1045 include diagnosis, prevention and treatment of diseases and clinical conditions associated with IPLA2(GAMMA). KIAA0276 (Accession XM_048199) is another VGAM1045 host target gene. KIAA0276 BINDING SITE is HOST TARGET binding site found in the 3' untranslated region of mRNA encoded by KIAA0276, corresponding to a HOST TARGET binding site such as BINDING SITE I, BINDING SITE II or BINDING SITE III. Table 2 illustrates the complementarity of the nucleotide sequences of KIAA0276 BINDING SITE, designated SEQ ID:35136, to the nucleotide sequence of VGAM1045 RNA, herein designated VGAM RNA, also designated SEQ ID:3756.

Another function of VGAM1045 is therefore inhibition of KIAA0276 (Accession XM_048199). Accordingly, utilities of VGAM1045 include diagnosis, prevention and treatment of diseases and clinical conditions associated with KIAA0276. moblak (Accession NM_130807) is another VGAM1045 host target gene. moblak BINDING SITE is HOST TARGET binding site found in the 3' untranslated region of mRNA encoded by moblak, corresponding to a HOST TARGET binding site such as BINDING SITE I, BINDING SITE II or BINDING SITE III. Table 2 illustrates the complementarity of the nucleotide sequences of moblak BINDING SITE, designated SEQ ID:28311, to the nucleotide sequence of VGAM1045 RNA, herein designated VGAM RNA, also designated SEQ ID:3756.

Another function of VGAM1045 is therefore inhibition of moblak (Accession NM_130807). Accordingly, utilities of VGAM1045 include diagnosis, prevention and treatment of diseases and clinical conditions associated with moblak. LOC221760 (Accession XM_168105) is another VGAM1045 host target gene. LOC221760 BINDING SITE is HOST TARGET binding site found in the 3' untranslated region of mRNA encoded by LOC221760, corresponding to a HOST TARGET binding site such as BINDING SITE I, BINDING SITE II or BINDING SITE III. Table 2 illustrates the complementarity of the nucleotide sequences of LOC221760 BINDING SITE, designated SEQ ID:45032, to the nucleotide sequence of VGAM1045 RNA, herein designated VGAM RNA, also designated SEQ ID:3756.

Another function of VGAM1045 is therefore inhibition of LOC221760 (Accession XM_168105). Accordingly, utilities of VGAM1045 include diagnosis, prevention and treatment of diseases and clinical conditions associated with LOC221760. LOC257422 (Accession XM_172923) is another VGAM1045 host target gene. LOC257422 BINDING SITE is HOST TARGET binding site found in the 5' untranslated region of mRNA encoded by LOC257422, corresponding to a HOST TARGET binding site such as BINDING SITE I, BINDING SITE II or BINDING SITE III. Table 2 illustrates the complementarity of the nucleotide sequences of LOC257422 BINDING SITE, designated SEQ ID:46189, to the nucleotide sequence of VGAM1045 RNA, herein designated VGAM RNA, also designated SEQ ID:3756.

Another function of VGAM1045 is therefore inhibition of LOC257422 (Accession XM_172923). Accordingly, utilities of VGAM1045 include diagnosis, prevention and treatment of diseases and clinical conditions associated with LOC257422. LOC90459 (Accession XM_031826) is another VGAM1045 host target gene. LOC90459 BINDING SITE is HOST TARGET binding site found in the 3' untranslated region of mRNA encoded by LOC90459, corresponding to a HOST TARGET binding site such as BINDING SITE I, BINDING SITE II or BINDING SITE III. Table 2 illustrates the complementarity of the nucleotide sequences of LOC90459 BINDING SITE, designated SEQ ID:31492, to the nucleotide sequence of VGAM1045 RNA, herein designated VGAM RNA, also designated SEQ ID:3756.

Another function of VGAM1045 is therefore inhibition of LOC90459 (Accession XM_031826). Accordingly, utilities of VGAM1045 include diagnosis, prevention and treatment of diseases and clinical conditions associated with LOC90459. FIG. 1 further provides a conceptual description of a novel bioinformatically detected viral gene of the present invention, referred to here as Viral Genomic Address Messenger 1046 (VGAM1046) viral gene, which modulates expression of respective host target genes thereof, the function and utility of which host target genes is known in the art.

VGAM1046 is a novel bioinformatically detected regulatory, non protein coding, viral micro RNA (miRNA) gene. The method by which VGAM1046 was detected is described hereinabove with reference to FIGS. 1-8.

VGAM1046 gene, herein designated VGAM GENE, is a viral gene contained in the genome of Human Herpesvirus 8. VGAM1046 host target gene, herein designated VGAM HOST TARGET GENE, is a human gene contained in the human genome.

VGAM1046 gene encodes a VGAM1046 precursor RNA, herein designated VGAM PRECURSOR RNA. Similar to other miRNA genes, and unlike most ordinary genes, VGAM1046 precursor RNA does not encode a protein. A nucleotide sequence identical or highly similar to the nucleotide sequence of VGAM1046 precursor RNA is designated SEQ ID:1032, and is provided hereinbelow with reference to the sequence listing part. Nucleotide sequence SEQ ID:1032 is located at position 131131 relative to the genome of Human Herpesvirus 8.

VGAM1046 precursor RNA folds onto itself, forming VGAM1046 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1046 folded precursor RNA into VGAM1046 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM1046 RNA is designated SEQ ID:3757, and is provided hereinbelow with reference to the sequence listing part.

VGAM1046 host target gene, herein designated VGAM HOST TARGET GENE, encodes a corresponding messenger RNA, VGAM1046 host target RNA, herein designated VGAM HOST TARGET RNA. VGAM1046 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1046 RNA, herein designated VGAM RNA, binds complementarily to one or more host target binding sites located in untranslated regions of VGAM1046 host target RNA, herein designated VGAM HOST TARGET RNA. This complementary binding is due to the fact that the nucleotide sequence of VGAM1046 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1046 RNA, herein designated VGAM RNA, may have a different number of host target binding sites in untranslated regions of a VGAM1046 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1046 RNA, herein designated VGAM RNA, to host target binding sites on VGAM1046 host target RNA, herein designated VGAM HOST TARGET RNA, such as BINDING SITE I, BINDING SITE II and BINDING SITE III, inhibits translation of VGAM1046 host target RNA into VGAM1046 host target protein, herein designated VGAM HOST TARGET PROTEIN. VGAM host target protein is therefore outlined by a broken line.

It is appreciated that VGAM1046 host target gene, herein designated VGAM HOST TARGET GENE, in fact represents a plurality of VGAM1046 host target genes. The mRNA of each one of this plurality of VGAM1046 host target genes comprises one or more host target binding sites, each having a nucleotide sequence which is at least partly complementary to VGAM1046 RNA, herein designated VGAM RNA, and which when bound by VGAM1046 RNA causes inhibition of translation of respective one or more VGAM1046 host target proteins.

It is further appreciated by one skilled in the art that the mode of translational inhibition illustrated by FIG. 1 with specific reference to translational inhibition exerted by VGAM1046 gene, herein designated VGAM GENE, on one or more VGAM1046 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1046 is inhibition of expression of host target genes, as part of a novel viral mechanism of attacking a host. Accordingly, utilities of VGAM1046 include diagnosis, prevention and treatment of viral infection by Human Herpesvirus 8. Specific functions, and accordingly utilities, of VGAM1046 correlate with, and may be deduced from, the identity of the host target genes which VGAM1046 binds and inhibits, and the function of these host target genes, as elaborated hereinbelow.

Nucleotide sequences of the VGAM1046 precursor RNA, herein designated VGAM PRECURSOR RNA, and of the 'diced' VGAM1046 RNA, herein designated VGAM RNA, and a schematic representation of the secondary folding of VGAM1046 folded precursor RNA, herein designated VGAM FOLDED PRECURSOR RNA, of VGAM1046 are further described hereinbelow with reference to Table 1.

Nucleotide sequences of host target binding sites, such as BINDING SITE-I, BINDING SITE-II and BINDING SITE-III of FIG. 1, found on VGAM1046 host target RNA, and schematic representation of the complementarity of each of these host target binding sites to VGAM1046 RNA, herein designated VGAM RNA, are described hereinbelow with reference to Table 2.

As mentioned hereinabove with reference to FIG. 1, a function of VGAM1046 gene, herein designated VGAM is inhibition of expression of VGAM1046 target genes. It is appreciated that specific functions, and accordingly utilities, of VGAM1046 correlate with, and may be deduced from, the identity of the target genes which VGAM1046 binds and inhibits, and the function of these target genes, as elaborated hereinbelow.

Potassium Voltage-gated Channel, KQT-like Subfamily, Member 1 (KCNQ1, Accession NM_000218) is a VGAM1046 host target gene. KCNQ1 BINDING SITE is HOST TARGET binding site found in the 3' untranslated region of mRNA encoded by KCNQ1, corresponding to a HOST TARGET binding site such as BINDING SITE I, BINDING SITE II or BINDING SITE III. Table 2 illustrates the complementarity of the nucleotide sequences of KCNQ1 BINDING SITE, designated SEQ ID:5721, to the nucleotide sequence of VGAM1046 RNA, herein designated VGAM RNA, also designated SEQ ID:3757.

A function of VGAM1046 is therefore inhibition of Potassium Voltage-gated Channel, KQT-like Subfamily, Member 1 (KCNQ1, Accession NM_000218), a gene which probably important in cardiac repolarization. associates with kcne1 (mink) to form the i (ks) cardiac potassium current. elicits a rapidly activating, k(+)-selective outward current. muscarinic agonist oxotremorine-m strongly suppresses kcnq1/kcne1 current in cho cells in which cloned kcnq1/kcne1 channels were coexpressed with m1 muscarinic receptors. may associate also with kcne3 (mirp2) to form the potassium channel that is important for cyclic amp-stimulated intestinal secretion of chloride io TISSUE:abondantly expressed in heart, pancreas, prostate, kidney, small intestine and peripheral blood leukocytes. less abondant in placenta, lung, spleen, colon, thymus, testis and ovaries. Accordingly, utilities of VGAM1046 include diagnosis, prevention and treatment of diseases and clinical conditions associated with KCNQ1. The function of KCNQ1 and its association with various diseases and clinical conditions, has been established by previous studies, as described hereinabove with reference to VGAM339. DKFZP761D0211 (Accession NM_032039) is another VGAM1046 host target gene. DKFZP761D0211 BINDING SITE is HOST TARGET binding site found in the 5' untranslated region of mRNA encoded by DKFZP761D0211, corresponding to a HOST TARGET binding site such as BINDING SITE I, BINDING SITE II or BINDING SITE III. Table 2 illustrates the complementarity of the nucleotide sequences of DKFZP761D0211 BINDING SITE, designated SEQ ID:25735, to the nucleotide sequence of VGAM1046 RNA, herein designated VGAM RNA, also designated SEQ ID:3757.

Another function of VGAM1046 is therefore inhibition of DKFZP761D0211 (Accession NM_032039). Accordingly, utilities of VGAM1046 include diagnosis, prevention and treatment of diseases and clinical conditions associated with DKFZP761D0211. LOC149132 (Accession XM_086428) is another VGAM1046 host target gene. LOC149132 BINDING SITE is HOST TARGET binding site found in the 5' untranslated region of mRNA encoded by LOC149132, corresponding to a HOST TARGET binding site such as BINDING SITE I, BINDING SITE II or BINDING SITE III. Table 2 illustrates the complementarity of the nucleotide sequences of LOC149132 BINDING SITE, designated SEQ ID:38643, to the nucleotide sequence of VGAM1046 RNA, herein designated VGAM RNA, also designated SEQ ID:3757.

Another function of VGAM1046 is therefore inhibition of LOC149132 (Accession XM_086428). Accordingly, utilities of VGAM1046 include diagnosis, prevention and treatment of diseases and clinical conditions associated with LOC149132. LOC255975 (Accession XM_171083) is another VGAM1046 host target gene. LOC255975 BINDING SITE is HOST TARGET binding site found in the 5' untranslated region of mRNA encoded by LOC255975, corresponding to a HOST TARGET binding site such as BINDING SITE I, BINDING SITE II or BINDING SITE III. Table 2 illustrates the complementarity of the nucleotide sequences of LOC255975 BINDING SITE, designated SEQ ID:45887, to the nucleotide sequence of VGAM1046 RNA, herein designated VGAM RNA, also designated SEQ ID:3757.

Another function of VGAM1046 is therefore inhibition of LOC255975 (Accession XM_171083). Accordingly, utilities of VGAM1046 include diagnosis, prevention and treatment of diseases and clinical conditions associated with LOC255975. FIG. 1 further provides a conceptual description of a novel bioinformatically detected viral gene of the present invention, referred to here as Viral Genomic Address Messenger 1047 (VGAM1047) viral gene, which modulates expression of respective host target genes thereof, the function and utility of which host target genes is known in the art.

VGAM1047 is a novel bioinformatically detected regulatory, non protein coding, viral micro RNA (miRNA) gene. The method by which VGAM1047 was detected is described hereinabove with reference to FIGS. 1-8.

VGAM1047 gene, herein designated VGAM GENE, is a viral gene contained in the genome of Strawberry Mild Yellow Edge Virus. VGAM1047 host target gene, herein designated VGAM HOST TARGET GENE, is a human gene contained in the human genome.

VGAM1047 gene encodes a VGAM1047 precursor RNA, herein designated VGAM PRECURSOR RNA. Similar to other miRNA genes, and unlike most ordinary genes, VGAM1047 precursor RNA does not encode a protein. A nucleotide sequence identical or highly similar to the nucleotide sequence of VGAM1047 precursor RNA is designated SEQ ID:1033, and is provided hereinbelow with reference to the sequence listing part. Nucleotide sequence SEQ ID:1033 is located at position 3766 relative to the genome of Strawberry Mild Yellow Edge Virus.

VGAM1047 precursor RNA folds onto itself, forming VGAM1047 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1047 folded precursor RNA into VGAM1047 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM1047 RNA is designated SEQ ID:3758, and is provided hereinbelow with reference to the sequence listing part.

VGAM1047 host target gene, herein designated VGAM HOST TARGET GENE, encodes a corresponding messenger RNA, VGAM1047 host target RNA, herein designated VGAM HOST TARGET RNA. VGAM1047 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1047 RNA, herein designated VGAM RNA, binds complementarily to one or more host target binding sites located in untranslated regions of VGAM1047 host target RNA, herein designated VGAM HOST TARGET RNA. This complementary binding is due to the fact that the nucleotide sequence of VGAM1047 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1047 RNA, herein designated VGAM RNA, may have a different number of host target binding sites in untranslated regions of a VGAM1047 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1047 RNA, herein designated VGAM RNA, to host target binding sites on VGAM1047 host target RNA, herein designated VGAM HOST TARGET RNA, such as BINDING SITE I, BINDING SITE II and BINDING SITE III, inhibits translation of VGAM1047 host target RNA into VGAM1047 host target protein, herein designated VGAM HOST TARGET PROTEIN. VGAM host target protein is therefore outlined by a broken line.

It is appreciated that VGAM1047 host target gene, herein designated VGAM HOST TARGET GENE, in fact represents a plurality of VGAM1047 host target genes. The mRNA of each one of this plurality of VGAM1047 host target genes comprises one or more host target binding sites, each having a nucleotide sequence which is at least partly complementary to VGAM1047 RNA, herein designated VGAM RNA, and which when bound by VGAM1047 RNA causes inhibition of translation of respective one or more VGAM1047 host target proteins.

It is further appreciated by one skilled in the art that the mode of translational inhibition illustrated by FIG. 1 with specific reference to translational inhibition exerted by VGAM1047 gene, herein designated VGAM GENE, on one or more VGAM1047 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1047 is inhibition of expression of host target genes, as part of a novel viral mechanism of attacking a host. Accordingly, utilities of VGAM1047 include diagnosis, prevention and treatment of viral infection by Strawberry Mild Yellow Edge Virus. Specific functions, and accordingly utilities, of VGAM1047 correlate with, and may be deduced from, the identity of the host target genes which VGAM1047 binds and inhibits, and the function of these host target genes, as elaborated hereinbelow.

Nucleotide sequences of the VGAM1047 precursor RNA, herein designated VGAM PRECURSOR RNA, and of the 'diced' VGAM1047 RNA, herein designated VGAM RNA, and a schematic representation of the secondary folding of VGAM1047 folded precursor RNA, herein designated VGAM FOLDED PRECURSOR RNA, of VGAM1047 are further described hereinbelow with reference to Table 1.

Nucleotide sequences of host target binding sites, such as BINDING SITE-I, BINDING SITE-II and BINDING SITE-III of FIG. 1, found on VGAM1047 host target RNA, and schematic representation of the complementarity of each of these host target binding sites to VGAM1047 RNA, herein designated VGAM RNA, are described hereinbelow with reference to Table 2.

As mentioned hereinabove with reference to FIG. 1, a function of VGAM1047 gene, herein designated VGAM is inhibition of expression of VGAM1047 target genes. It is appreciated that specific functions, and accordingly utilities, of VGAM1047 correlate with, and may be deduced from, the identity of the target genes which VGAM1047 binds and inhibits, and the function of these target genes, as elaborated hereinbelow.

Homeo Box C13 (HOXC13, Accession XM_006804) is a VGAM1047 host target gene. HOXC13 BINDING SITE is HOST TARGET binding site found in the 3' untranslated region of mRNA encoded by HOXC13, corresponding to a HOST TARGET binding site such as BINDING SITE I, BINDING SITE II or BINDING SITE III. Table 2 illustrates the complementarity of the nucleotide sequences of HOXC13 BINDING SITE, designated SEQ ID:30016, to the nucleotide sequence of VGAM1047 RNA, herein designated VGAM RNA, also designated SEQ ID:3758.

A function of VGAM1047 is therefore inhibition of Homeo Box C13 (HOXC13, Accession XM_006804). Accordingly, utilities of VGAM1047 include diagnosis, prevention and treatment of diseases and clinical conditions associated with HOXC13. P53AIP1 (Accession NM_022112) is another VGAM1047 host target gene. P53AIP1 BINDING SITE is HOST TARGET binding site found in the 3' untranslated region of mRNA encoded by P53AIP1, corresponding to a HOST TARGET binding site such as BINDING SITE I, BINDING SITE II or BINDING SITE III. Table 2 illustrates the complementarity of the nucleotide sequences of P53AIP1 BINDING SITE, designated SEQ ID:22658, to the nucleotide sequence of VGAM1047 RNA, herein designated VGAM RNA, also designated SEQ ID:3758.

Another function of VGAM1047 is therefore inhibition of P53AIP1 (Accession NM_022112). Accordingly, utilities of VGAM1047 include diagnosis, prevention and treatment of diseases and clinical conditions associated with P53AIP1. Vinculin (VCL, Accession NM_003373) is another VGAM1047 host target gene. VCL BINDING SITE1 and VCL BINDING SITE2 are HOST TARGET binding sites found in untranslated regions of mRNA encoded by VCL, corresponding to HOST TARGET binding sites such as BINDING SITE I, BINDING SITE II or BINDING SITE III. Table 2 illustrates the complementarity of the nucleotide sequences of VCL BINDING SITE1 and VCL BINDING SITE2, designated SEQ ID:9403 and SEQ ID:15192 respectively, to the nucleotide sequence of VGAM1047 RNA, herein designated VGAM RNA, also designated SEQ ID:3758.

Another function of VGAM1047 is therefore inhibition of Vinculin (VCL, Accession NM_003373). Accordingly, utilities of VGAM1047 include diagnosis, prevention and treatment of diseases and clinical conditions associated with VCL. MGC11242 (Accession NM_024320) is another VGAM1047 host target gene. MGC11242 BINDING SITE is HOST TARGET binding site found in the 3' untranslated region of mRNA encoded by MGC11242, corresponding to a HOST TARGET binding site such as BINDING SITE I, BINDING SITE II or BINDING SITE III. Table 2 illustrates the complementarity of the nucleotide sequences of MGC11242 BINDING SITE, designated SEQ ID:23610, to the nucleotide sequence of VGAM1047 RNA, herein designated VGAM RNA, also designated SEQ ID:3758.

Another function of VGAM1047 is therefore inhibition of MGC11242 (Accession NM_024320). Accordingly, utilities of VGAM1047 include diagnosis, prevention and treatment of diseases and clinical conditions associated with MGC11242. FIG. 1 further provides a conceptual description of a novel bioinformatically detected viral gene of the present invention, referred to here as Viral Genomic Address Messenger 1048 (VGAM1048) viral gene, which modulates expression of respective host target genes thereof, the function and utility of which host target genes is known in the art.

VGAM1048 is a novel bioinformatically detected regulatory, non protein coding, viral micro RNA (miRNA) gene. The method by which VGAM1048 was detected is described hereinabove with reference to FIGS. 1-8.

VGAM1048 gene, herein designated VGAM GENE, is a viral gene contained in the genome of Strawberry Mild Yellow Edge Virus. VGAM1048 host target gene, herein designated VGAM HOST TARGET GENE, is a human gene contained in the human genome.

VGAM1048 gene encodes a VGAM1048 precursor RNA, herein designated VGAM PRECURSOR RNA. Similar to other miRNA genes, and unlike most ordinary genes, VGAM1048 precursor RNA does not encode a protein. A nucleotide sequence identical or highly similar to the nucleotide sequence of VGAM1048 precursor RNA is designated SEQ ID:1034, and is provided hereinbelow with reference to the sequence listing part. Nucleotide sequence SEQ ID:1034 is located at position 1114 relative to the genome of Strawberry Mild Yellow Edge Virus.

VGAM1048 precursor RNA folds onto itself, forming VGAM1048 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1048 folded precursor RNA into VGAM1048 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1048 RNA is designated SEQ ID:3759, and is provided hereinbelow with reference to the sequence listing part.

VGAM1048 host target gene, herein designated VGAM HOST TARGET GENE, encodes a corresponding messenger RNA, VGAM1048 host target RNA, herein designated VGAM HOST TARGET RNA. VGAM1048 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1048 RNA, herein designated VGAM RNA, binds complementarily to one or more host target binding sites located in untranslated regions of VGAM1048 host target RNA, herein designated VGAM HOST TARGET RNA. This complementary binding is due to the fact that the nucleotide sequence of VGAM1048 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1048 RNA, herein designated VGAM RNA, may have a different number of host target binding sites in untranslated regions of a VGAM1048 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1048 RNA, herein designated VGAM RNA, to host target binding sites on VGAM1048 host target RNA, herein designated VGAM HOST TARGET RNA, such as BINDING SITE I, BINDING SITE II and BINDING SITE III, inhibits translation of VGAM1048 host target RNA into VGAM1048 host target protein, herein designated VGAM HOST TARGET PROTEIN. VGAM host target protein is therefore outlined by a broken line.

It is appreciated that VGAM1048 host target gene, herein designated VGAM HOST TARGET GENE, in fact represents a plurality of VGAM1048 host target genes. The mRNA of each one of this plurality of VGAM1048 host target genes comprises one or more host target binding sites, each having a nucleotide sequence which is at least partly complementary to VGAM1048 RNA, herein designated VGAM RNA, and which when bound by VGAM1048 RNA causes inhibition of translation of respective one or more VGAM1048 host target proteins.

It is further appreciated by one skilled in the art that the mode of translational inhibition illustrated by FIG. 1 with specific reference to translational inhibition exerted by VGAM1048 gene, herein designated VGAM GENE, on one or more VGAM1048 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1048 is inhibition of expression of host target genes, as part of a novel viral mechanism of attacking a host. Accordingly, utilities of VGAM1048 include diagnosis, prevention and treatment of viral infection by Strawberry Mild Yellow Edge Virus. Specific functions, and accordingly utilities, of VGAM1048 correlate with, and may be deduced from, the identity of the host target genes which VGAM1048 binds and inhibits, and the function of these host target genes, as elaborated hereinbelow.

Nucleotide sequences of the VGAM1048 precursor RNA, herein designated VGAM PRECURSOR RNA, and of the 'diced' VGAM1048 RNA, herein designated VGAM RNA, and a schematic representation of the secondary folding of VGAM1048 folded precursor RNA, herein designated VGAM FOLDED PRECURSOR RNA, of VGAM1048 are further described hereinbelow with reference to Table 1.

Nucleotide sequences of host target binding sites, such as BINDING SITE-I, BINDING SITE-II and BINDING SITE-III of FIG. 1, found on VGAM1048 host target RNA, and schematic representation of the complementarity of each of these host target binding sites to VGAM1048 RNA, herein designated VGAM RNA, are described hereinbelow with reference to Table 2.

As mentioned hereinabove with reference to FIG. 1, a function of VGAM1048 gene, herein designated VGAM is inhibition of expression of VGAM1048 target genes. It is appreciated that specific functions, and accordingly utilities, of VGAM1048 correlate with, and may be deduced from, the identity of the target genes which VGAM1048 binds and inhibits, and the function of these target genes, as elaborated hereinbelow.

Adaptor-related Protein Complex 1, Beta 1 Subunit (AP1B1, Accession NM_001127) is a VGAM1048 host target gene. AP1B1 BINDING SITE is HOST TARGET binding site found in the 3' untranslated region of mRNA encoded by AP1B1, corresponding to a HOST TARGET binding site such as BINDING SITE I, BINDING SITE II or BINDING SITE III. Table 2 illustrates the complementarity of the nucleotide sequences of AP1B1 BINDING SITE, designated SEQ ID:6797, to the nucleotide sequence of VGAM1048 RNA, herein designated VGAM RNA, also designated SEQ ID:3759.

A function of VGAM1048 is therefore inhibition of Adaptor-related Protein Complex 1, Beta 1 Subunit (AP1B1, Accession NM_001127), a gene which plays a role in protein sorting in the late-golgi/trans-golgi network (tgn) and/or endosomes. Accordingly, utilities of VGAM1048 include diagnosis, prevention and treatment of diseases and clinical conditions associated with AP1B1. The function of AP1B1 has been established by previous studies. A 140-kb homozygous deletion in 22q12 in a sporadic meningioma directed Peyrard et al. (1994) to the cloning and characterization of a new member of the human beta-adaptin gene family, which was named BAM22 for 'beta-adaptin-meningioma-chromosome 22.' The BAM22 gene was totally inactivated in the tumor with homozygous deletion. Northern blot analysis of 70 sporadic meningiomas showed specific loss of expression in 8 tumors, suggesting inactivation of BAM22. Based on this, Peyrard et al. (1994) suggested that BAM22 is a second chromosome 22 locus important in meningioma development and second in importance to the neurofibromatosis type 2 gene (NF2; 101000). The likelihood that multiple loci on chromosome 22 are involved in the oncogenesis of meningioma is suggested by the facts that monosomy 22 is observed in as many as 65% of tumors (Zankl and Zang, 1980); some meningiomas have chromosome 22 deletions not encompassing the NF2 gene region and do not show mutations in the NF2 gene; and constitutional ring chromosome 22 has been observed in young patients with multiple tumors (Arinami et al., 1986; Petrella et al., 1993).

Full details of the abovementioned studies are described in the following publications, the disclosure of which are hereby incorporated by reference:

Peyrard, M.; Pan, H.-Q.; Kedra, D.; Fransson, I.; Swahn, S.; Hartman, K.; Clifton, S. W.; Roe, B. A.; Dumanski, J. P.: Structure of the promoter and genomic organization of the human beta-prime-adaptin gene (BAM22) from chromosome 22q12. Genomics 36:112-117, 1996; and Zankl, H.; Zang, K. D.: Correlations between clinical and cytogenetical data in 180 human meningiomas. Cancer Genet. Cytogenet. 1:351-356, 1980.

Further studies establishing the function and utilities of AP1B1 are found in John Hopkins OMIM database record ID 600157, and in sited publications numbered 754 and 12596-7550 listed in the bibliography section hereinbelow, which are also hereby incorporated by reference. Piccolo (presynaptic cytomatrix protein) (PCLO, Accession XM_168530) is another VGAM1048 host target gene. PCLO BINDING SITE is HOST TARGET binding site found in the 3' untranslated region of mRNA encoded by PCLO, corresponding to a HOST TARGET binding site such as BINDING SITE I, BINDING SITE II or BINDING SITE III. Table 2 illustrates the complementarity of the nucleotide sequences of PCLO BINDING SITE, designated SEQ ID:45213, to the nucleotide sequence of VGAM1048 RNA, herein designated VGAM RNA, also designated SEQ ID:3759.

Another function of VGAM1048 is therefore inhibition of Piccolo (presynaptic cytomatrix protein) (PCLO, Accession XM_168530), a gene which involves in the cycling of synaptic vesicles. Accordingly, utilities of VGAM1048 include diagnosis, prevention and treatment of diseases and clinical conditions associated with PCLO. The function of PCLO and its association with various diseases and clinical conditions, has been established by previous studies, as described hereinabove with reference to VGAM71. TRHDE (Accession NM_013381) is another VGAM1048 host target gene. TRHDE BINDING SITE is HOST TARGET binding site found in the 3' untranslated region of mRNA encoded by TRHDE, corresponding to a HOST TARGET binding site such as BINDING SITE I, BINDING SITE II or BINDING SITE III. Table 2 illustrates the complementarity of the nucleotide sequences of TRHDE BINDING SITE, designated SEQ ID:15032, to the nucleotide sequence of VGAM1048 RNA, herein designated VGAM RNA, also designated SEQ ID:3759.

Another function of VGAM1048 is therefore inhibition of TRHDE (Accession NM_013381). Accordingly, utilities of VGAM1048 include diagnosis, prevention and treatment of diseases and clinical conditions associated with TRHDE. FLJ10932 (Accession NM_018277) is another VGAM1048 host target gene. FLJ10932 BINDING SITE is HOST TARGET binding site found in the 3' untranslated region of mRNA encoded by FLJ10932, corresponding to a HOST TARGET binding site such as BINDING SITE I, BINDING SITE II or BINDING SITE III. Table 2 illustrates the complementarity of the nucleotide sequences of FLJ10932 BINDING SITE, designated SEQ ID:20262, to the nucleotide sequence of VGAM1048 RNA, herein designated VGAM RNA, also designated SEQ ID:3759.

Another function of VGAM1048 is therefore inhibition of FLJ10932 (Accession NM_018277). Accordingly, utilities of VGAM1048 include diagnosis, prevention and treatment of diseases and clinical conditions associated with FLJ10932. KIAA0349 (Accession XM_166449) is another VGAM1048 host target gene. KIAA0349 BINDING SITE is HOST TARGET binding site found in the 3' untranslated region of mRNA encoded by KIAA0349, corresponding to a HOST TARGET binding site such as BINDING SITE I, BINDING SITE II or BINDING SITE III. Table 2 illustrates the complementarity of the nucleotide sequences of KIAA0349 BINDING SITE, designated SEQ ID:44338, to the nucleotide sequence of VGAM1048 RNA, herein designated VGAM RNA, also designated SEQ ID:3759.

Another function of VGAM1048 is therefore inhibition of KIAA0349 (Accession XM_166449). Accordingly, utilities of VGAM1048 include diagnosis, prevention and treatment of diseases and clinical conditions associated with KIAA0349. KIAA1954 (Accession XM_085375) is another VGAM1048 host target gene. KIAA1954 BINDING SITE is HOST TARGET binding site found in the 3' untranslated region of mRNA encoded by KIAA1954, corresponding to a HOST TARGET binding site such as BINDING SITE I, BINDING SITE II or BINDING SITE III. Table 2 illustrates the complementarity of the nucleotide sequences of KIAA1954 BINDING SITE, designated SEQ ID:38097, to the nucleotide sequence of VGAM1048 RNA, herein designated VGAM RNA, also designated SEQ ID:3759.

Another function of VGAM1048 is therefore inhibition of KIAA1954 (Accession XM_085375). Accordingly, utilities of VGAM1048 include diagnosis, prevention and treatment of diseases and clinical conditions associated with KIAA1954. LOC148443 (Accession XM_086196) is another VGAM1048 host target gene. LOC148443 BINDING SITE is HOST TARGET binding site found in the 3' untranslated region of mRNA encoded by LOC148443, corresponding to a HOST TARGET binding site such as BINDING SITE I, BINDING SITE II or BINDING SITE III. Table 2 illustrates the complementarity of the nucleotide sequences of LOC148443 BINDING SITE, designated SEQ ID:38538, to the nucleotide sequence of VGAM1048 RNA, herein designated VGAM RNA, also designated SEQ ID:3759.

Another function of VGAM1048 is therefore inhibition of LOC148443 (Accession XM_086196). Accordingly, utilities of VGAM1048 include diagnosis, prevention and treatment of diseases and clinical conditions associated with LOC148443. LOC149506 (Accession XM_097661) is another VGAM1048 host target gene. LOC149506 BINDING SITE is HOST TARGET binding site found in the 3' untranslated region of mRNA encoded by LOC149506, corresponding to a HOST TARGET binding site such as BINDING SITE I, BINDING SITE II or BINDING SITE III. Table 2 illustrates the complementarity of the nucleotide sequences of LOC149506 BINDING SITE, designated SEQ ID:41010, to the nucleotide sequence of VGAM1048 RNA, herein designated VGAM RNA, also designated SEQ ID:3759.

Another function of VGAM1048 is therefore inhibition of LOC149506 (Accession XM_097661). Accordingly, utilities of VGAM1048 include diagnosis, prevention and treatment of diseases and clinical conditions associated with LOC149506. LOC157556 (Accession XM_098783) is another VGAM1048 host target gene. LOC157556 BINDING SITE is HOST TARGET binding site found in the 3' untranslated region of mRNA encoded by LOC157556, corresponding to a HOST TARGET binding site such as BINDING SITE I, BINDING SITE II or BINDING SITE III. Table 2 illustrates the complementarity of the nucleotide sequences of LOC157556 BINDING SITE, designated SEQ ID:41819, to the nucleotide sequence of VGAM1048 RNA, herein designated VGAM RNA, also designated SEQ ID:3759.

Another function of VGAM1048 is therefore inhibition of LOC157556 (Accession XM_098783). Accordingly, utilities of VGAM1048 include diagnosis, prevention and treatment of diseases and clinical conditions associated with LOC157556. LOC203427 (Accession XM_114699) is another VGAM1048 host target gene. LOC203427 BINDING SITE is HOST TARGET binding site found in the 3' untranslated region of mRNA encoded by LOC203427, corresponding to a HOST TARGET binding site such as BINDING SITE I, BINDING SITE II or BINDING SITE III. Table 2 illustrates the complementarity of the nucleotide sequences of LOC203427 BINDING SITE, designated SEQ ID:43043, to the nucleotide sequence of VGAM1048 RNA, herein designated VGAM RNA, also designated SEQ ID:3759.

Another function of VGAM1048 is therefore inhibition of LOC203427 (Accession XM_114699). Accordingly, utilities of VGAM1048 include diagnosis, prevention and treatment of diseases and clinical conditions associated with LOC203427. FIG. 1 further provides a conceptual description of a novel bioinformatically detected viral gene of the present invention, referred to here as Viral Genomic Address Messenger 1049 (VGAM1049) viral gene, which modulates expression of respective host target genes thereof, the function and utility of which host target genes is known in the art.

VGAM1049 is a novel bioinformatically detected regulatory, non protein coding, viral micro RNA (miRNA) gene. The method by which VGAM1049 was detected is described hereinabove with reference to FIGS. 1-8.

VGAM1049 gene, herein designated VGAM GENE, is a viral gene contained in the genome of Strawberry Mild Yellow Edge Virus. VGAM1049 host target gene, herein designated VGAM HOST TARGET GENE, is a human gene contained in the human genome.

VGAM1049 gene encodes a VGAM1049 precursor RNA, herein designated VGAM PRECURSOR RNA. Similar to other miRNA genes, and unlike most ordinary genes, VGAM1049 precursor RNA does not encode a protein. A nucleotide sequence identical or highly similar to the nucleotide sequence of VGAM1049 precursor RNA is designated SEQ ID:1035, and is provided hereinbelow with reference to the sequence listing part. Nucleotide sequence SEQ ID:1035 is located at position 4885 relative to the genome of Strawberry Mild Yellow Edge Virus.

VGAM1049 precursor RNA folds onto itself, forming VGAM1049 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1049 folded precursor RNA into VGAM1049 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1049 RNA is designated SEQ ID:3760, and is provided hereinbelow with reference to the sequence listing part.

VGAM1049 host target gene, herein designated VGAM HOST TARGET GENE, encodes a corresponding messenger RNA, VGAM1049 host target RNA, herein designated VGAM HOST TARGET RNA. VGAM1049 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1049 RNA, herein designated VGAM RNA, binds complementarily to one or more host target binding sites located in untranslated regions of VGAM1049 host target RNA, herein designated VGAM HOST TARGET RNA. This complementary binding is due to the fact that the nucleotide sequence of VGAM1049 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1049 RNA, herein designated VGAM RNA, may have a different number of host target binding sites in untranslated regions of a VGAM1049 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1049 RNA, herein designated VGAM RNA, to host target binding sites on VGAM1049 host target RNA, herein designated VGAM HOST TARGET RNA, such as BINDING SITE I, BINDING SITE II and BINDING SITE III, inhibits translation of VGAM1049 host target RNA into VGAM1049 host target protein, herein designated VGAM HOST TARGET PROTEIN. VGAM host target protein is therefore outlined by a broken line.

It is appreciated that VGAM1049 host target gene, herein designated VGAM HOST TARGET GENE, in fact represents a plurality of VGAM1049 host target genes. The mRNA of each one of this plurality of VGAM1049 host target genes comprises one or more host target binding sites, each having a nucleotide sequence which is at least partly complementary to VGAM1049 RNA, herein designated VGAM RNA, and which when bound by VGAM1049 RNA causes inhibition of translation of respective one or more VGAM1049 host target proteins.

It is further appreciated by one skilled in the art that the mode of translational inhibition illustrated by FIG. 1 with specific reference to translational inhibition exerted by VGAM1049 gene, herein designated VGAM GENE, on one or more VGAM1049 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1049 is inhibition of expression of host target genes, as part of a novel viral mechanism of attacking a host. Accordingly, utilities of VGAM1049 include diagnosis, prevention and treatment of viral infection by Strawberry Mild Yellow Edge Virus. Specific functions, and accordingly utilities, of VGAM1049 correlate with, and may be deduced from, the identity of the host target genes which VGAM1049 binds and inhibits, and the function of these host target genes, as elaborated hereinbelow.

Nucleotide sequences of the VGAM1049 precursor RNA, herein designated VGAM PRECURSOR RNA, and of the 'diced' VGAM1049 RNA, herein designated VGAM RNA, and a schematic representation of the secondary folding of VGAM1049 folded precursor RNA, herein designated VGAM FOLDED PRECURSOR RNA, of VGAM1049 are further described hereinbelow with reference to Table 1.

Nucleotide sequences of host target binding sites, such as BINDING SITE-I, BINDING SITE-II and BINDING SITE-III of FIG. 1, found on VGAM1049 host target RNA, and schematic representation of the complementarity of each of these host target binding sites to VGAM1049 RNA, herein designated VGAM RNA, are described hereinbelow with reference to Table 2.

As mentioned hereinabove with reference to FIG. 1, a function of VGAM1049 gene, herein designated VGAM is inhibition of expression of VGAM1049 target genes. It is appreciated that specific functions, and accordingly utilities, of VGAM1049 correlate with, and may be deduced from, the identity of the target genes which VGAM1049 binds and inhibits, and the function of these target genes, as elaborated hereinbelow.

Solute Carrier Family 39 (zinc transporter), Member 1 (SLC39A1, Accession NM_014437) is a VGAM1049 host target gene. SLC39A1 BINDING SITE is HOST TARGET binding site found in the 3" untranslated region of mRNA encoded by SLC39A1, corresponding to a HOST TARGET binding site such as BINDING SITE I, BINDING SITE II or BINDING SITE III. Table 2 illustrates the complementarity of the nucleotide sequences of SLC39A1 BINDING SITE, designated SEQ ID:15793, to the nucleotide sequence of VGAM1049 RNA, herein designated VGAM RNA, also designated SEQ ID:3760.

A function of VGAM1049 is therefore inhibition of Solute Carrier Family 39 (zinc transporter), Member 1 (SLC39A1, Accession NM_014437), a gene which is a divalent (zinc/iron) metal ion transporter. Accordingly, utilities of VGAM1049 include diagnosis, prevention and treatment of diseases and clinical conditions associated with SLC39A1. The function of SLC39A1 has been established by previous studies. The ZRT- and IRT-related protein (ZIP) family is composed of divalent metal ion transporters, including A. thaliana IRT1 (iron-regulated transporter-1), which appears to play a role in iron uptake, and S. cerevisiae ZRT1 (zinc-regulated transporter-1) and ZRT2, and A. thaliana ZIP1 to ZIP4, all of which are probably zinc transporters (reviewed by Eng et al., 1998). The human growth arrest-inducible gene product (GAIP) is also a ZIP family member based on sequence similarity. Lioumi et al. (1998) generated a transcript map of the region within and in the proximity of the epidermal differentiation complex (EDC; 601588), which is located in 1q21. They identified a partial ZIRTL cDNA as mapping to the distal end of the EDC, 200 kb from the S100A1 gene (OMIM Ref. No. 176940). Lioumi et al. (1998) found that a portion of the ZIRTL cDNA encodes a polypeptide with significant sequence similarity to the ZIP family of iron and zinc transporters from plants and yeast. By screening a human keratinocyte cDNA library with the partial ZIRTL cDNA, Lioumi et al. (1999) isolated a full-length ZIRTL cDNA. The predicted 324-amino acid ZIRTL protein contains 8 transmembrane domains, 9 possible N-myristylation sites, a potential protein kinase C phosphorylation site, and 4 potential protein kinase II phosphorylation sites. Human ZIRTL shares 21 to 22% amino acid sequence identity with A. thaliana IRT1 and ZIP1 to ZIP4, Pisum sativum Rit1, and S. cerevisiae ZRT1 and ZRT2. ZIRTL also shares 34% amino acid sequence identity with GAIP. The human and mouse Zirtl proteins are 90% similar. The ZIRTL gene contains 4 exons. Northern blot analysis detected a 2.1-kb ZIRTL transcript in all human tissues tested, namely adult heart, lung, brain, liver, pancreas, small intestine, colon, kidney, spleen, thymus, peripheral blood leukocytes, skeletal muscle, testis, ovary, placenta, prostate, and keratinocytes, and fetal heart, kidney, small intestine, and skin. In situ hybridization showed that mouse Zirtl is developmentally regulated in the skin, where it was expressed in the epidermal layer, excluding the dermis, at E17.5, but not in embryonic days 10.5 and 15.5 or P21. In the small intestine, Zirtl was found toward the base of the intestinal villi from E17.5. In the pancreas, Zirtl expression was found from E17.5. Zirtl expression was not detected in the liver. Zirtl was expressed in osteoblasts of developing bone from E15.5 and in ameloblasts and odontoblasts at late stages of tooth development at P21. Moderate expression of Zirtl was observed in brain in the hippocampus Full details of the abovementioned studies are described in the following publications, the disclosure of which are hereby incorporated by reference:

Lioumi, M.; Ferguson, C. A.; Sharpe, P. T.; Freeman, T.; Marenholz, I.; Mischke, D.; Heizmann, C.; Ragoussis, J.: Isolation and characterization of human and mouse ZIRTL, a member of the IRT1 family of transporters, mapping within the epidermal differentiation complex. Genomics 62:272-280, 1999; and Lioumi, M.; Olavesen, M. G.; Nizetic, D.; Ragoussis, J.: High-resolution YAC fragmentation map of 1q21. Genomics 49:200-208, 1998.

Further studies establishing the function and utilities of SLC39A1 are found in John Hopkins OMIM database record ID 604740, and in sited publications numbered 6744-6746 listed in the bibliography section hereinbelow, which are also hereby incorporated by reference. Spastic Paraplegia 4 (autosomal dominant; spastin) (SPG4, Accession NM_014946) is another VGAM1049 host target gene. SPG4 BINDING SITE is HOST TARGET binding site found in the 3' untranslated region of mRNA encoded by SPG4, corresponding to a HOST TARGET binding site such as BINDING SITE I, BINDING SITE II or BINDING SITE III. Table 2 illustrates the complementarity of the nucleotide sequences of SPG4 BINDING SITE, designated SEQ ID:17261, to the nucleotide sequence of VGAM1049 RNA, herein designated VGAM RNA, also designated SEQ ID:3760.

Another function of VGAM1049 is therefore inhibition of Spastic Paraplegia 4 (autosomal dominant; spastin) (SPG4, Accession NM_014946), a gene which is probably an ATPase involved in the assembly or function of nuclear protein complexes. Accordingly, utilities of VGAM1049 include diagnosis, prevention and treatment of diseases and clinical conditions associated with SPG4. The function of SPG4 has been established by previous studies. SPG4 is ubiquitously expressed in human adult and fetal tissue, showing slightly higher expression in fetal brain. Hazan et al. (1999) cloned the mouse ortholog of SPG4, which between amino acids 113 and 616 has 96% identity with human SPG4. Spg4 transcripts are ubiquitously expressed in adult tissues and from embryonic day 7 to 17 in mouse. Interaction with the cytoskeleton was mediated by the N-terminal region of spastin and was regulated through the ATPase activity of the AAA domain. Expression of missense mutations (including 604277.0001, 604277.0002, and 604277.0004) into the AAA domain led to constitutive binding to microtubules in transfected cells and induced the disappearance of the aster and the formation of thick perinuclear bundles, suggesting a role of spastin in microtubule dynamics. Consistently, wildtype spastin promoted microtubule disassembly in transfected cells. The authors suggested that spastin may be involved in microtubule dynamics similarly to the highly homologous microtubule-severing protein katanin (OMIM Ref. No. 606696). The authors hypothesized that impairment of fine regulation of the microtubule cytoskeleton in long axons, due to spastin mutations, may underlie the pathogenesis of hereditary spastic paraplegia Full details of the abovementioned studies are described in the following publications, the disclosure of which are hereby incorporated by reference:

Hazan, J.; Fonknechten, N.; Mavel, D.; Paternotte, C.; Samson, D.; Artiguenave, F.; Davoine, C.-S.; Cruaud, C.; Durr, A.; Wincker, P.; Brottier, P.; Cattolico, L.; Barbe, V.; Burgunder, J.-M.; Prud'homme, J.-F.; Brice, A.; Fontaine, B.; Heilig, R.; Weissenbach, J.: Spastin, a new AAA protein, is altered in the most frequent form of autosomal dominant spastic paraplegia. Nature Genet. 23:296-303, 1999; and Errico, A.; Ballabio, A.; Rugarli, E. I.: Spastin, the protein mutated in autosomal dominant hereditary spastic paraplegia, is involved in microtubule dynamics. Hum. Molec. Genet. 11:153.

Further studies establishing the function and utilities of SPG4 are found in John Hopkins OMIM database record ID 604277, and in sited publications numbered 10496-7390, 10497-7396, 7391, 10498-761 and 10499 listed in the bibliography section hereinbelow, which are also hereby incorporated by reference. DKFZP434A043 (Accession NM_015396) is another VGAM1049 host target gene. DKFZP434A043 BINDING SITE is HOST TARGET binding site found in the 3' untranslated region of mRNA encoded by DKFZP434A043, corresponding to a HOST TARGET binding site such as BINDING SITE I, BINDING SITE II or BINDING SITE III. Table 2 illustrates the complementarity of the nucleotide sequences of DKFZP434A043 BINDING SITE, designated SEQ ID:17702, to the nucleotide sequence of VGAM1049 RNA, herein designated VGAM RNA, also designated SEQ ID:3760.

Another function of VGAM1049 is therefore inhibition of DKFZP434A043 (Accession NM_015396). Accordingly, utilities of VGAM1049 include diagnosis, prevention and treatment of diseases and clinical conditions associated with DKFZP434A043. FLJ12526 (Accession NM_024787) is another VGAM1049 host target gene. FLJ12526 BINDING SITE is HOST TARGET binding site found in the 3' untranslated region of mRNA encoded by FLJ12526, corresponding to a HOST TARGET binding site such as BINDING SITE I, BINDING SITE II or BINDING SITE III. Table 2 illustrates the complementarity of the nucleotide sequences of FLJ12526 BINDING SITE, designated SEQ ID:24168, to the nucleotide sequence of VGAM1049 RNA, herein designated VGAM RNA, also designated SEQ ID:3760.

Another function of VGAM1049 is therefore inhibition of FLJ12526 (Accession NM_024787). Accordingly, utilities of VGAM1049 include diagnosis, prevention and treatment of diseases and clinical conditions associated with FLJ12526. KIAA0513 (Accession NM_014732) is another VGAM1049 host target gene. KIAA0513 BINDING SITE is HOST TARGET binding site found in the 3' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BIND- ING SITE, designated SEQ ID:16358, to the nucleotide sequence of VGAM1049 RNA, herein designated VGAM RNA, also designated SEQ ID:3760.

Another function of VGAM1049 is therefore inhibition of KIAA0513 (Accession NM_014732). Accordingly, utilities of VGAM1049 include diagnosis, prevention and treatment of diseases and clinical conditions associated with KIAA0513. Placenta-specific 3 (PLAC3, Accession XM_045115) is another VGAM1049 host target gene. PLAC3 BINDING SITE is HOST TARGET binding site found in the 5' untranslated region of mRNA encoded by PLAC3, corresponding to a HOST TARGET binding site such as BINDING SITE I, BINDING SITE II or BINDING SITE III. Table 2 illustrates the complementarity of the nucleotide sequences of PLAC3 BINDING SITE, designated SEQ ID:34366, to the nucleotide sequence of VGAM1049 RNA, herein designated VGAM RNA, also designated SEQ ID:3760.

Another function of VGAM1049 is therefore inhibition of Placenta-specific 3 (PLAC3, Accession XM_045115). Accordingly, utilities of VGAM1049 include diagnosis, prevention and treatment of diseases and clinical conditions associated with PLAC3. FIG. 1 further provides a conceptual description of a novel bioinformatically detected viral gene of the present invention, referred to here as Viral Genomic Address Messenger 1050 (VGAM1050) viral gene, which modulates expression of respective host target genes thereof, the function and utility of which host target genes is known in the art.

VGAM1050 is a novel bioinformatically detected regulatory, non protein coding, viral micro RNA (miRNA) gene. The method by which VGAM1050 was detected is described hereinabove with reference to FIGS. 1-8.

VGAM1050 gene, herein designated VGAM GENE, is a viral gene contained in the genome of Meleagrid Herpesvirus 1. VGAM1050 host target gene, herein designated VGAM HOST TARGET GENE, is a human gene contained in the human genome.

VGAM1050 gene encodes a VGAM1050 precursor RNA, herein designated VGAM PRECURSOR RNA. Similar to other miRNA genes, and unlike most ordinary genes, VGAM1050 precursor RNA does not encode a protein. A nucleotide sequence identical or highly similar to the nucleotide sequence of VGAM1050 precursor RNA is designated SEQ ID:1036, and is provided hereinbelow with reference to the sequence listing part. Nucleotide sequence SEQ ID:1036 is located at position 108185 relative to the genome of Meleagrid Herpesvirus 1.

VGAM1050 precursor RNA folds onto itself, forming VGAM1050 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1050 folded precursor RNA into VGAM1050 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM1050 RNA is designated SEQ ID:3761, and is provided hereinbelow with reference to the sequence listing part.

VGAM1050 host target gene, herein designated VGAM HOST TARGET GENE, encodes a corresponding messenger RNA, VGAM1050 host target RNA, herein designated VGAM HOST TARGET RNA. VGAM1050 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1050 RNA, herein designated VGAM RNA, binds complementarily to one or more host target binding sites located in untranslated regions of VGAM1050 host target RNA, herein designated VGAM HOST TARGET RNA. This complementary binding is due to the fact that the nucleotide sequence of VGAM1050 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1050 RNA, herein designated VGAM RNA, may have a different number of host target binding sites in untranslated regions of a VGAM1050 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1050 RNA, herein designated VGAM RNA, to host target binding sites on VGAM1050 host target RNA, herein designated VGAM HOST TARGET RNA, such as BINDING SITE I, BINDING SITE II and BINDING SITE III, inhibits translation of VGAM1050 host target RNA into VGAM1050 host target protein, herein designated VGAM HOST TARGET PROTEIN. VGAM host target protein is therefore outlined by a broken line.

It is appreciated that VGAM1050 host target gene, herein designated VGAM HOST TARGET GENE, in fact represents a plurality of VGAM1050 host target genes. The mRNA of each one of this plurality of VGAM1050 host target genes comprises one or more host target binding sites, each having a nucleotide sequence which is at least partly complementary to VGAM1050 RNA, herein designated VGAM RNA, and which when bound by VGAM1050 RNA causes inhibition of translation of respective one or more VGAM1050 host target proteins.

It is further appreciated by one skilled in the art that the mode of translational inhibition illustrated by FIG. 1 with specific reference to translational inhibition exerted by VGAM1050 gene, herein designated VGAM GENE, on one or more VGAM1050 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1050 is inhibition of expression of host target genes, as part of a novel viral mechanism of attacking a host. Accordingly, utilities of VGAM1050 include diagnosis, prevention and treatment of viral infection by Meleagrid Herpesvirus 1. Specific functions, and accordingly utilities, of VGAM1050 correlate with, and may be deduced from, the identity of the host target genes which VGAM1050 binds and inhibits, and the function of these host target genes, as elaborated hereinbelow.

Nucleotide sequences of the VGAM1050 precursor RNA, herein designated VGAM PRECURSOR RNA, and of the 'diced' VGAM1050 RNA, herein designated VGAM RNA, and a schematic representation of the secondary folding of VGAM1050 folded precursor RNA, herein designated VGAM FOLDED PRECURSOR RNA, of VGAM1050 are further described hereinbelow with reference to Table 1.

Nucleotide sequences of host target binding sites, such as BINDING SITE-I, BINDING SITE-II and BINDING SITE-III of FIG. 1, found on VGAM1050 host target RNA, and schematic representation of the complementarity of each of these host target binding sites to VGAM1050 RNA, herein designated VGAM RNA, are described hereinbelow with reference to Table 2.

As mentioned hereinabove with reference to FIG. 1, a function of VGAM1050 gene, herein designated VGAM is inhibition of expression of VGAM1050 target genes. It is appreciated that specific functions, and accordingly utilities, of VGAM1050 correlate with, and may be deduced from, the identity of the target genes which VGAM1050 binds and inhibits, and the function of these target genes, as elaborated hereinbelow.

ADP-ribosylation Factor-like 4 (ARL4, Accession NM_005738) is a VGAM1050 host target gene. ARL4 BINDING SITE is HOST TARGET binding site found in the 5' untranslated region of mRNA encoded by ARL4, corresponding to a HOST TARGET binding site such as BINDING SITE I, BINDING SITE II or BINDING SITE III. Table 2 illustrates the complementarity of the nucleotide sequences of ARL4 BINDING SITE, designated SEQ ID:12298, to the nucleotide sequence of VGAM1050 RNA, herein designated VGAM RNA, also designated SEQ ID:3761.

A function of VGAM1050 is therefore inhibition of ADP-ribosylation Factor-like 4 (ARL4, Accession NM_005738), a gene which may be required for the progression of cells through meiosis. Accordingly, utilities of VGAM1050 include diagnosis, prevention and treatment of diseases and clinical conditions associated with ARL4. The function of ARL4 has been established by previous studies. Schurmann et al. (1994) identified mouse Arl4 as a gene that is abundantly expressed in differentiated cells of the preadipocyte cell line 3T3-L1 but is not detectably expressed in undifferentiated 3T3-L1 cells. By Northern blot analysis, Jacobs et al. (1998) found that rat Arl4 is expressed predominantly in testis, at lower levels in spleen and intestine, and at even lower levels in brain, heart, total fat, liver, lung, and thymus. In situ hybridization of rat testis showed that Arl4 is expressed in germ cells of puberal and adult testis, but not in prepuberal testis. Jacobs et al. (1998) suggested that Arl4 is involved in sperm production. Animal model experiments lend further support to the function of ARL4. Schurmann et al. (2002) generated mice lacking Arl4. These mice did not have upregulated expression of other Arl genes in testis, were viable, and were apparently normal except for reduced testicular weight and sperm count. However, the remaining sperm had normal motility, and Arl4 -/- mice were fertile and sired normal-size litters. Schurmann et al. (2002) proposed that ARL4 is required for the progression of cells through meiosis and that its deletion causes a retardation of the formation of haploid spermatides It is appreciated that the abovementioned animal model for ARL4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Schurmann, A.; Breiner, M.; Becker, W.; Huppertz, C.; Kainulainen, H.; Kentrup, H.; Joost, H.-G.: Cloning of two novel ADP-ribosylation factor-like proteins and characterization of their differential expression in 3T3-L1 cells. J. Biol. Chem. 269:15683-15688, 1994; and Schurmann, A.; Koling, S.; Jacobs, S.; Saftig, P.; Kraub, S.; Wennemuth, G.; Kluge, R.; Joost, H.-G.: Reduced sperm count and normal fertility in male mice with targeted disruption of.

Further studies establishing the function and utilities of ARL4 are found in John Hopkins OMIM database record ID 604786, and in sited publications numbered 665 and 7445-2905 listed in the bibliography section hereinbelow, which are also hereby incorporated by reference. GEMIN5 (Accession XM_114471) is another VGAM1050 host target gene. GEMIN5 BINDING SITE is HOST TARGET binding site found in the 5' untranslated region of mRNA encoded by GEMIN5, corresponding to a HOST TARGET binding site such as BINDING SITE I, BINDING SITE II or BINDING SITE III. Table 2 illustrates the complementarity of the nucleotide sequences of GEMIN5 BINDING SITE, designated SEQ ID:42971, to the nucleotide sequence of VGAM1050 RNA, herein designated VGAM RNA, also designated SEQ ID:3761.

Another function of VGAM1050 is therefore inhibition of GEMIN5 (Accession XM_114471). Accordingly, utilities of VGAM1050 include diagnosis, prevention and treatment of diseases and clinical conditions associated with GEMIN5. MAP-kinase Activating Death Domain (MADD, Accession NM_130476) is another VGAM1050 host target gene. MADD BINDING SITE1 through MADD BINDING SITE6 are HOST TARGET binding sites found in untranslated regions of mRNA encoded by MADD, corresponding to HOST TARGET binding sites such as BINDING SITE I, BINDING SITE II or BINDING SITE III. Table 2 illustrates the complementarity of the nucleotide sequences of MADD BINDING SITE1 through MADD BINDING SITE6, designated SEQ ID:28254, SEQ ID:28239, SEQ ID:28233, SEQ ID:9784, SEQ ID:28249 and SEQ ID:28244 respectively, to the nucleotide sequence of VGAM1050 RNA, herein designated VGAM RNA, also designated SEQ ID:3761.

Another function of VGAM1050 is therefore inhibition of MAP-kinase Activating Death Domain (MADD, Accession NM_130476), a gene which may regulate two different pathways for neural activities.interacts with the type-1 tumor necrosis factor receptor (TNFR1); death domain-containing protein. Accordingly, utilities of VGAM1050 include diagnosis, prevention and treatment of diseases and clinical conditions associated with MADD. The function of MADD and its association with various diseases and clinical conditions, has been established by previous studies, as described hereinabove with reference to VGAM430. Solute Carrier Family 4, Sodium Bicarbonate Cotransporter, Member 7 (SLC4A7, Accession NM_003615) is another VGAM1050 host target gene. SLC4A7 BINDING SITE is HOST TARGET binding site found in the 3' untranslated region of mRNA encoded by SLC4A7, corresponding to a HOST TARGET binding site such as BINDING SITE I, BINDING SITE II or BINDING SITE III. Table 2 illustrates the complementarity of the nucleotide sequences of SLC4A7 BINDING SITE, designated SEQ ID:9666, to the nucleotide sequence of VGAM1050 RNA, herein designated VGAM RNA, also designated SEQ ID:3761.

Another function of VGAM1050 is therefore inhibition of Solute Carrier Family 4, Sodium Bicarbonate Cotransporter, Member 7 (SLC4A7, Accession NM_003615), a gene which mediates the coupled movement of sodium and bicarbonate ions across the plasma membrane. Accordingly, utilities of VGAM1050 include diagnosis, prevention and treatment of diseases and clinical conditions associated with SLC4A7. The function of SLC4A7 and its association with various diseases and clinical conditions, has been established by previous studies, as described hereinabove with reference to VGAM66. Chromosome 1 Open Reading Frame 16 (C1orf16, Accession NM_014837) is another VGAM1050 host target gene. C1orf16 BINDING SITE is HOST TARGET binding site found in the 3' untranslated region of mRNA encoded by C1orf16, corresponding to a HOST TARGET binding site such as BINDING SITE I, BINDING SITE II or BINDING SITE III. Table 2 illustrates the complementarity of the nucleotide sequences of C1orf16 BINDING SITE, designated SEQ ID:16853, to the nucleotide sequence of VGAM1050 RNA, herein designated VGAM RNA, also designated SEQ ID:3761.

Another function of VGAM1050 is therefore inhibition of Chromosome 1 Open Reading Frame 16 (C1orf16, Accession NM_014837). Accordingly, utilities of VGAM1050 include diagnosis, prevention and treatment of diseases and clinical conditions associated with C1orf16. LOC113612 (Accession XM_054492) is another VGAM1050 host target gene. LOC113612 BINDING SITE is HOST TARGET binding site found in the 3' untranslated region of mRNA encoded by LOC113612, corresponding to a HOST TARGET binding site such as BINDING SITE I, BINDING SITE II or BINDING SITE III. Table 2 illustrates the complementarity of the nucleotide sequences of LOC113612 BINDING SITE, designated SEQ ID:36171, to the nucleotide sequence of VGAM1050 RNA, herein designated VGAM RNA, also designated SEQ ID:3761.

Another function of VGAM1050 is therefore inhibition of LOC113612 (Accession XM_054492). Accordingly, utilities of VGAM1050 include diagnosis, prevention and treatment of diseases and clinical conditions associated with LOC113612. LOC199920 (Accession XM_114056) is another VGAM1050 host target gene. LOC199920 BINDING SITE is HOST TARGET binding site found in the 5' untranslated region of mRNA encoded by LOC199920, corresponding to a HOST TARGET binding site such as BINDING SITE I, BINDING SITE II or BINDING SITE III. Table 2 illustrates the complementarity of the nucleotide sequences of LOC199920 BINDING SITE, designated SEQ ID:42659, to the nucleotide sequence of VGAM1050 RNA, herein designated VGAM RNA, also designated SEQ ID:3761.

Another function of VGAM1050 is therefore inhibition of LOC199920 (Accession XM_114056). Accordingly, utilities of VGAM1050 include diagnosis, prevention and treatment of diseases and clinical conditions associated with LOC199920. FIG. 1 further provides a conceptual description of a novel bioinformatically detected viral gene of the present invention, referred to here as Viral Genomic Address Messenger 1051 (VGAM1051) viral gene, which modulates expression of respective host target genes thereof, the function and utility of which host target genes is known in the art.

VGAM1051 is a novel bioinformatically detected regulatory, non protein coding, viral micro RNA (miRNA) gene. The method by which VGAM1051 was detected is described hereinabove with reference to FIGS. 1-8.

VGAM1051 gene, herein designated VGAM GENE, is a viral gene contained in the genome of Meleagrid Herpesvirus 1. VGAM1051 host target gene, herein designated VGAM HOST TARGET GENE, is a human gene contained in the human genome.

VGAM1051 gene encodes a VGAM1051 precursor RNA, herein designated VGAM PRECURSOR RNA. Similar to other miRNA genes, and unlike most ordinary genes, VGAM1051 precursor RNA does not encode a protein. A nucleotide sequence identical or highly similar to the nucleotide sequence of VGAM1051 precursor RNA is designated SEQ ID:1037, and is provided hereinbelow with reference to the sequence listing part. Nucleotide sequence SEQ ID:1037 is located at position 110396 relative to the genome of Meleagrid Herpesvirus 1.

VGAM1051 precursor RNA folds onto itself, forming VGAM1051 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1051 folded precursor RNA into VGAM1051 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1051 RNA is designated SEQ ID:3762, and is provided hereinbelow with reference to the sequence listing part.

VGAM1051 host target gene, herein designated VGAM HOST TARGET GENE, encodes a corresponding messenger RNA, VGAM1051 host target RNA, herein designated VGAM HOST TARGET RNA. VGAM1051 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1051 RNA, herein designated VGAM RNA, binds complementarily to one or more host target binding sites located in untranslated regions of VGAM1051 host target RNA, herein designated VGAM HOST TARGET RNA. This complementary binding is due to the fact that the nucleotide sequence of VGAM1051 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1051 RNA, herein designated VGAM RNA, may have a different number of host target binding sites in untranslated regions of a VGAM1051 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1051 RNA, herein designated VGAM RNA, to host target binding sites on VGAM1051 host target RNA, herein designated VGAM HOST TARGET RNA, such as BINDING SITE I, BINDING SITE II and BINDING SITE III, inhibits translation of VGAM1051 host target RNA into VGAM1051 host target protein, herein designated VGAM HOST TARGET PROTEIN. VGAM host target protein is therefore outlined by a broken line.

It is appreciated that VGAM1051 host target gene, herein designated VGAM HOST TARGET GENE, in fact represents a plurality of VGAM1051 host target genes. The mRNA of each one of this plurality of VGAM1051 host target genes comprises one or more host target binding sites, each having a nucleotide sequence which is at least partly complementary to VGAM1051 RNA, herein designated VGAM RNA, and which when bound by VGAM1051 RNA causes inhibition of translation of respective one or more VGAM1051 host target proteins.

It is further appreciated by one skilled in the art that the mode of translational inhibition illustrated by FIG. 1 with specific reference to translational inhibition exerted by VGAM1051 gene, herein designated VGAM GENE, on one or more VGAM1051 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1051 is inhibition of expression of host target genes, as part of a novel viral mechanism of attacking a host. Accordingly, utilities of VGAM1051 include diagnosis, prevention and treatment of viral infection by Meleagrid Herpesvirus 1. Specific functions, and accordingly utilities, of VGAM1051 correlate with, and may be deduced from, the identity of the host target genes which VGAM1051 binds and inhibits, and the function of these host target genes, as elaborated hereinbelow.

Nucleotide sequences of the VGAM1051 precursor RNA, herein designated VGAM PRECURSOR RNA, and of the 'diced' VGAM1051 RNA, herein designated VGAM RNA, and a schematic representation of the secondary folding of VGAM1051 folded precursor RNA, herein designated VGAM FOLDED PRECURSOR RNA, of VGAM1051 are further described hereinbelow with reference to Table 1.

Nucleotide sequences of host target binding sites, such as BINDING SITE-I, BINDING SITE-II and BINDING SITE-III of FIG. 1, found on VGAM1051 host target RNA, and schematic representation of the complementarity of each of these host target binding sites to VGAM1051 RNA, herein designated VGAM RNA, are described hereinbelow with reference to Table 2.

As mentioned hereinabove with reference to FIG. 1, a function of VGAM1051 gene, herein designated VGAM is inhibition of expression of VGAM1051 target genes. It is appreciated that specific functions, and accordingly utilities, of VGAM1051 correlate with, and may be deduced from, the identity of the target genes which VGAM1051 binds and inhibits, and the function of these target genes, as elaborated hereinbelow.

Flavin Containing Monooxygenase 5 (FMO5, Accession NM_001461) is a VGAM1051 host target gene. FMO5 BINDING SITE is HOST TARGET binding site found in the 3' untranslated region of mRNA encoded by FMO5, corresponding to a HOST TARGET binding site such as BINDING SITE I, BINDING SITE II or BINDING SITE III. Table 2 illustrates the complementarity of the nucleotide sequences of FMO5 BINDING SITE, designated SEQ ID:7193, to the nucleotide sequence of VGAM1051 RNA, herein designated VGAM RNA, also designated SEQ ID:3762.

A function of VGAM1051 is therefore inhibition of Flavin Containing Monooxygenase 5 (FMO5, Accession NM_001461), a gene which Flavin-containing monooxygenase 5; may catalyze the monooxygenation of xenobiotic soft nucleophiles. Accordingly, utilities of VGAM1051 include diagnosis, prevention and treatment of diseases and clinical conditions associated with FMO5. The function of FMO5 has been established by previous studies. The flavin-containing monooxygenases (FMOs; EC 1.14.13.8) catalyze the oxidation of nucleophilic nitrogen, sulfur, and phosphorus atoms in a wide variety of compounds, including many pesticides and drugs. See FMO1 (OMIM Ref. No. 136130). By screening liver libraries with a rabbit FMO5 cDNA, Overby et al. (1995) isolated cDNAs encoding guinea pig and human FMO5. The predicted 533-amino acid human protein shares 85% and 87% identity with rabbit and guinea pig FMO5, respectively. Northern blot analysis revealed that the human FMO5 gene was expressed as 2.6- and 3.8-kb mRNAs in liver. The FMO5 protein had an apparent molecular mass of 60 kD on Western blots of adult and neonatal human liver. All 3 mammalian FMO5 enzymes exhibited similar catalytic activities, which were distinct from those of other FMOs. The authors concluded that FMO5 is not an efficient drug-metabolizing enzyme and that it may have an alternative physiologic role. By PCR analysis of somatic cell hybrids, McCombie et al. (1996) mapped the FMO2 (OMIM Ref. No. 603955) and FMO5 genes to chromosome 1q, where 3 other human FMO genes are located. Using sequence analysis of a YAC contig, Gelb et al. (1997) found that the FMO5 gene is located between the NPR1 (OMIM Ref. No. 108960) and CX40 (GJA5; 121013) genes. By FISH, they mapped this contig to 1q21.1. Gelb et al. (1997) noted that since the FMO1 gene maps to 1q23-q25, this excluded the possibility that a single gene cluster contains the entire FMO family.

Full details of the abovementioned studies are described in the following publications, the disclosure of which are hereby incorporated by reference:

McCombie, R. R.; Dolphin, C. T.; Povey, S.; Phillips, I. R.; Shephard, E. A.: Localization of human flavin-containing monooxygenase genes FMO2 and FMO5 to chromosome 1q. Genomics 34:426-429, 1996; and Overby, L. H.; Buckpitt, A. R.; Lawton, M. P.; Atta-Asafo-Adjei, E.; Schulze, J.; Philpot, R. M.: Characterization of flavin-containing monooxygenase 5 (FMO5) cloned from human and gui.

Further studies establishing the function and utilities of FMO5 are found in John Hopkins OMIM database record ID 603957, and in sited publications numbered 528 and 5285 listed in the bibliography section hereinbelow, which are also hereby incorporated by reference. Tripartite Motif-containing 6 (TRIM6, Accession NM_058166) is another VGAM1051 host target gene. TRIM6 BINDING SITE is HOST TARGET binding site found in the 3' untranslated region of mRNA encoded by TRIM6, corresponding to a HOST TARGET binding site such as BINDING SITE I, BINDING SITE II or BINDING SITE III. Table 2 illustrates the complementarity of the nucleotide sequences of TRIM6

BINDING SITE, designated SEQ ID:27713, to the nucleotide sequence of VGAM1051 RNA, herein designated VGAM RNA, also designated SEQ ID:3762.

Another function of VGAM1051 is therefore inhibition of Tripartite Motif-containing 6 (TRIM6, Accession NM_058166). Accordingly, utilities of VGAM1051 include diagnosis, prevention and treatment of diseases and clinical conditions associated with TRIM6. LOC152059 (Accession XM_087372) is another VGAM1051 host target gene. LOC152059 BINDING SITE is HOST TARGET binding site found in the 3' untranslated region of mRNA encoded by LOC152059, corresponding to a HOST TARGET binding site such as BINDING SITE I, BINDING SITE II or BINDING SITE III. Table 2 illustrates the complementarity of the nucleotide sequences of LOC152059 BINDING SITE, designated SEQ ID:39209, to the nucleotide sequence of VGAM1051 RNA, herein designated VGAM RNA, also designated SEQ ID:3762.

Another function of VGAM1051 is therefore inhibition of LOC152059 (Accession XM_087372). Accordingly, utilities of VGAM1051 include diagnosis, prevention and treatment of diseases and clinical conditions associated with LOC152059. FIG. 1 further provides a conceptual description of a novel bioinformatically detected viral gene of the present invention, referred to here as Viral Genomic Address Messenger 1052 (VGAM1052) viral gene, which modulates expression of respective host target genes thereof, the function and utility of which host target genes is known in the art.

VGAM1052 is a novel bioinformatically detected regulatory, non protein coding, viral micro RNA (miRNA) gene. The method by which VGAM1052 was detected is described hereinabove with reference to FIGS. 1-8.

VGAM1052 gene, herein designated VGAM GENE, is a viral gene contained in the genome of Meleagrid Herpesvirus 1. VGAM1052 host target gene, herein designated VGAM HOST TARGET GENE, is a human gene contained in the human genome.

VGAM1052 gene encodes a VGAM1052 precursor RNA, herein designated VGAM PRECURSOR RNA. Similar to other miRNA genes, and unlike most ordinary genes, VGAM1052 precursor RNA does not encode a protein. A nucleotide sequence identical or highly similar to the nucleotide sequence of VGAM1052 precursor RNA is designated SEQ ID:1038, and is provided hereinbelow with reference to the sequence listing part. Nucleotide sequence SEQ ID:1038 is located at position 106911 relative to the genome of Meleagrid Herpesvirus 1.

VGAM1052 precursor RNA folds onto itself, forming VGAM1052 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1052 folded precursor RNA into VGAM1052 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1052 RNA is designated SEQ ID:3763, and is provided hereinbelow with reference to the sequence listing part.

VGAM1052 host target gene, herein designated VGAM HOST TARGET GENE, encodes a corresponding messenger RNA, VGAM1052 host target RNA, herein designated VGAM HOST TARGET RNA. VGAM1052 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1052 RNA, herein designated VGAM RNA, binds complementarily to one or more host target binding sites located in untranslated regions of VGAM1052 host target RNA, herein designated VGAM HOST TARGET RNA. This complementary binding is due to the fact that the nucleotide sequence of VGAM1052 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1052 RNA, herein designated VGAM RNA, may have a different number of host target binding sites in untranslated regions of a VGAM1052 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1052 RNA, herein designated VGAM RNA, to host target binding sites on VGAM1052 host target RNA, herein designated VGAM HOST TARGET RNA, such as BINDING SITE I, BINDING SITE II and BINDING SITE III, inhibits translation of VGAM1052 host target RNA into VGAM1052 host target protein, herein designated VGAM HOST TARGET PROTEIN. VGAM host target protein is therefore outlined by a broken line.

It is appreciated that VGAM1052 host target gene, herein designated VGAM HOST TARGET GENE, in fact represents a plurality of VGAM1052 host target genes. The mRNA of each one of this plurality of VGAM1052 host target genes comprises one or more host target binding sites, each having a nucleotide sequence which is at least partly complementary to VGAM1052 RNA, herein designated VGAM RNA, and which when bound by VGAM1052 RNA causes inhibition of translation of respective one or more VGAM1052 host target proteins.

It is further appreciated by one skilled in the art that the mode of translational inhibition illustrated by FIG. 1 with specific reference to translational inhibition exerted by VGAM1052 gene, herein designated VGAM GENE, on one or more VGAM1052 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1052 is inhibition of expression of host target genes, as part of a novel viral mechanism of attacking a host. Accordingly, utilities of VGAM1052 include diagnosis, prevention and treatment of viral infection by Meleagrid Herpesvirus 1. Specific functions, and accordingly utilities, of VGAM1052 correlate with, and may be deduced from, the identity of the host target genes which VGAM1052 binds and inhibits, and the function of these host target genes, as elaborated hereinbelow.

Nucleotide sequences of the VGAM1052 precursor RNA, herein designated VGAM PRECURSOR RNA, and of the 'diced' VGAM1052 RNA, herein designated VGAM RNA, and a schematic representation of the secondary folding of VGAM1052 folded precursor RNA, herein designated VGAM FOLDED PRECURSOR RNA, of VGAM1052 are further described hereinbelow with reference to Table 1.

Nucleotide sequences of host target binding sites, such as BINDING SITE-I, BINDING SITE-II and BINDING SITE-III of FIG. 1, found on VGAM1052 host target RNA, and schematic representation of the complementarity of each of these host target binding sites to VGAM1052 RNA, herein designated VGAM RNA, are described hereinbelow with reference to Table 2.

As mentioned hereinabove with reference to FIG. 1, a function of VGAM1052 gene, herein designated VGAM is inhibition of expression of VGAM1052 target genes. It is appreciated that specific functions, and accordingly utilities, of VGAM1052 correlate with, and may be deduced from, the identity of the target genes which VGAM1052 binds and inhibits, and the function of these target genes, as elaborated hereinbelow.

Bromodomain and PHD Finger Containing, 1 (BRPF1, Accession XM_054520) is a VGAM1052 host target gene. BRPF1 BINDING SITE is HOST TARGET binding site found in the 3' untranslated region of mRNA encoded by BRPF1, corresponding to a HOST TARGET binding site such as BINDING SITE I, BINDING SITE II or BINDING SITE III. Table 2 illustrates the complementarity of the nucleotide sequences of BRPF1 BINDING SITE, designated SEQ ID:36172, to the nucleotide sequence of VGAM1052 RNA, herein designated VGAM RNA, also designated SEQ ID:3763.

A function of VGAM1052 is therefore inhibition of Bromodomain and PHD Finger Containing, 1 (BRPF1, Accession XM_054520), a gene which has 6 zinc finger motifs and a bromodomain. Accordingly, utilities of VGAM1052 include diagnosis, prevention and treatment of diseases and clinical conditions associated with BRPF1. The function of BRPF1 and its association with various diseases and clinical conditions, has been established by previous studies, as described hereinabove with reference to VGAM497. Caspase 8, Apoptosis-related Cysteine Protease (CASP8, Accession NM_033355) is another VGAM1052 host target gene. CASP8 BINDING SITE1 and CASP8 BINDING SITE2 are HOST TARGET binding sites found in untranslated regions of mRNA encoded by CASP8, corresponding to HOST TARGET binding sites such as BINDING SITE I, BINDING SITE II or BINDING SITE III. Table 2 illustrates the complementarity of the nucleotide sequences of CASP8 BINDING SITE1 and CASP8 BINDING SITE2, designated SEQ ID:27202 and SEQ ID:27206 respectively, to the nucleotide sequence of VGAM1052 RNA, herein designated VGAM RNA, also designated SEQ ID:3763.

Another function of VGAM1052 is therefore inhibition of Caspase 8, Apoptosis-related Cysteine Protease (CASP8, Accession NM_033355), a gene which is an apoptosis-related caspase and an upstream component of Fas receptor and tumor necrosis factor (TNF) receptor-induced apoptosis. Accordingly, utilities of VGAM1052 include diagnosis, prevention and treatment of diseases and clinical conditions associated with CASP8. The function of CASP8 and its association with various diseases and clinical conditions, has been established by previous studies, as described hereinabove with reference to VGAM145. DNA Fragmentation Factor, 40 kDa, Beta Polypeptide (caspase-activated DNase) (DFFB, Accession XM_113366) is another VGAM1052 host target gene. DFFB BINDING SITE is HOST TARGET binding site found in the 3' untranslated region of mRNA encoded by DFFB, corresponding to a HOST TARGET binding site such as BINDING SITE I, BINDING SITE II or BINDING SITE III. Table 2 illustrates the complementarity of the nucleotide sequences of DFFB BINDING SITE, designated SEQ ID:42240, to the nucleotide sequence of VGAM1052 RNA, herein designated VGAM RNA, also designated SEQ ID:3763.

Another function of VGAM1052 is therefore inhibition of DNA Fragmentation Factor, 40 kDa, Beta Polypeptide (caspase-activated DNase) (DFFB, Accession XM_113366), a gene which induces DNA fragmentation and chromatin condensation during apoptosis. Accordingly, utilities of VGAM1052 include diagnosis, prevention and treatment of diseases and clinical conditions associated with DFFB. The function of DFFB and its association with various diseases and clinical conditions, has been established by previous studies, as described hereinabove with reference to VGAM74. Thyroid Autoantigen 70 kDa (Ku antigen) (G22P1, Accession NM_001469) is another VGAM1052 host target gene. G22P1 BINDING SITE is HOST TARGET binding site found in the 5' untranslated region of mRNA encoded by G22P1, corresponding to a HOST TARGET binding site such as BINDING SITE I, BINDING SITE II or BINDING SITE III. Table 2 illustrates the complementarity of the nucleotide sequences of G22P1 BINDING SITE, designated SEQ ID:7202, to the nucleotide sequence of VGAM1052 RNA, herein designated VGAM RNA, also designated SEQ ID:3763.

Another function of VGAM1052 is therefore inhibition of Thyroid Autoantigen 70 kDa (Ku antigen) (G22P1, Accession NM_001469), a gene which has a role in chromosome translocation. Accordingly, utilities of VGAM1052 include diagnosis, prevention and treatment of diseases and clinical conditions associated with G22P1. The function of G22P1 has been established by previous studies. The G22P1 gene encodes subunit p70 of the p70/p80 autoantigen. The p70/p80 autoantigen consists of 2 proteins of molecular mass of approximately 70,000 and 80,000 daltons that dimerize to form a 10 S DNA-binding complex. See 194364 for discussion of the gene encoding the p80 subunit. Exchange of immunologic reagents showed that the p70/p80 autoantigen is identical to the Ku antigen, the Ki antigen, and the 86- to 70-kD protein complex. The p70/p80 complex binds to the ends of double-stranded DNA in a cell cycle-dependent manner, being associated with chromosomes of interphase cells, followed by complete dissociation from the condensing chromosomes in early prophase. Both p70 and p80 contain phosphoserine residues. A role for the antigen in DNA repair or transposition has been proposed. Animal model experiments lend further support to the function of G22P1. Li et al. (1998) presented evidence that inactivation of the Ku70 gene by targeted disruption in mice and derived cell lines leads to a propensity for malignant transformation both in vitro and in vivo. In vitro, Ku70 -/- mouse fibroblasts displayed an increased rate of sister chromatid exchange and a high frequency of spontaneous neoplastic transformation. In vivo, Ku70 -/- mice, known to be defective in B- but not T-lymphocyte maturation, developed thymic and disseminated T-cell lymphomas at a mean age of 6 months with CD4+/CD8+ tumor cells. In addition, many of the knockout mice showed segmental aganglionosis affecting the small intestine and the colon. These findings demonstrated that Ku70 deficiency facilitates neoplastic growth and suggested a role of the Ku70 locus in tumor suppression.

It is appreciated that the abovementioned animal model for G22P1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Li, G. C.; Ouyang, H.; Li, X.; Nagasawa, H.; Little, J. B.; Chen, D. J.; Ling, C. C.; Fuks, Z.; Cordon-Cardo, C.: Ku70: a candidate tumor suppressor gene for murine T cell lymphoma. Molec. Cell 2:1-8, 1998; and Reeves, W. H.; Sthoeger, Z. M.: Molecular cloning of cDNA encoding the p70 (Ku) lupus autoantigen. J. Biol. Chem. 264:5047-5052, 1989.

Further studies establishing the function and utilities of G22P1 are found in John Hopkins OMIM database record ID 152690, and in sited publications numbered 88 and 1828-1840 listed in the bibliography section hereinbelow, which are also hereby incorporated by reference. Glutamate Receptor, Metabotropic 4 (GRM4, Accession NM_000841) is another VGAM1052 host target gene. GRM4 BINDING SITE is HOST TARGET binding site found in the 3' untranslated region of mRNA encoded by GRM4, corresponding to a HOST TARGET binding site such as BINDING SITE I, BINDING SITE II or BINDING SITE III. Table 2 illustrates the complementarity of the nucleotide sequences of GRM4 BINDING SITE, designated SEQ ID:6503, to the nucleotide sequence of VGAM1052 RNA, herein designated VGAM RNA, also designated SEQ ID:3763.

Another function of VGAM1052 is therefore inhibition of Glutamate Receptor, Metabotropic 4 (GRM4, Accession NM_000841), a gene which is mediated by a g-protein that inhibits adenylate cyclase activity. Accordingly, utilities of VGAM1052 include diagnosis, prevention and treatment of diseases and clinical conditions associated with GRM4. The function of GRM4 has been established by previous studies. L-glutamate is the major excitatory neurotransmitter in the central nervous system and activates both ionotropic and metabotropic glutamate receptors. See mGluR3 (OMIM Ref. No. 601115). The metabotropic glutamate receptors (OMIM Ref. No. mGluRs), which are G protein-coupled receptors, have been divided into 3 groups on the basis of sequence homology, putative signal transduction mechanisms, and pharmacologic properties. Group II and group III mGluRs are linked to the inhibition of the cyclic AMP cascade, but differ in their agonist selectivities. Group III agonists include L-2-amino-4-phosphonobutyrate (L-AP4) and L-serine-O-phosphate (Wu et al., 1998). Animal model experiments lend further support to the function of GRM4. To provide a better understanding of the L-AP4 receptors, Pekhletski et al. (1996) generated knockout mice lacking the mGluR4 gene. The mutant mice did not display any gross motor abnormalities, impairments of novelty-induced exploratory behaviors, or alterations in fine motor coordination. However, they were deficient on the rotating rod motor-learning test, suggesting that they may have an impaired ability to learn complex motor tasks. Analysis of presynaptic short-term synaptic plasticity at the parallel fiber-Purkinje cell synapse demonstrated that paired-pulse facilitation and post-tetanic potentiation were impaired in the mutant mice, although long-term depression was unaffected. Pekhletski et al. (1996) concluded that an important function of mGluR4 is to provide a presynaptic mechanism for maintaining synaptic efficacy during repetitive activation, and that the presence of mGluR4 at the parallel fiber-Purkinje cell synapse is required for maintaining normal motor function. Gerlai et al. (1998) found that mGluR4 mutant mice exhibited significantly accelerated learning performance in a spatial reversal learning task. In a probe trial administered 6 weeks posttraining, the mice showed impaired spatial accuracy. These results suggested that mGluR4 mutant mice differ in their ability to learn and integrate new spatial information into previously formed memory traces and that their use of stored spatial information is altered.

It is appreciated that the abovementioned animal model for GRM4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pekhletski, R.; Gerlai, R.; Overstreet, L. S.; Huang, X. P.; Agopyan, N.; Slater, N. T.; Abramow-Newerly, W.; Roder, J. C.; Hampson, D. R.: Impaired cerebellar synaptic plasticity and motor performance in mice lacking the mGluR4 subtype of metabotropic glutamate receptor. J. Neurosci. 16:6364-6373, 1996; and Wu, S.; Wright, R. A.; Rockey, P. K.; Burgett, S. G.; Arnold, J. S.; Rosteck, P. R., Jr.; Johnson, B. G.; Schoepp, D. D.; Belagaje, R. M.: Group III human metabotropic glutamate recepto.

Further studies establishing the function and utilities of GRM4 are found in John Hopkins OMIM database record ID 604100, and in sited publications numbered 5436, 5844-504 and 6361 listed in the bibliography section hereinbelow, which are also hereby incorporated by reference.5-hydroxytryptamine (serotonin) Receptor 2C (HTR2C, Accession NM_000868) is another VGAM1052 host target gene. HTR2C BINDING SITE is HOST TARGET binding site found in the 5' untranslated region of mRNA encoded by HTR2C, corresponding to a HOST TARGET binding site such as BINDING SITE I, BINDING SITE II or BINDING SITE III. Table 2 illustrates the complementarity of the nucleotide sequences of HTR2C BINDING SITE, designated SEQ ID:6533, to the nucleotide sequence of VGAM1052 RNA, herein designated VGAM RNA, also designated SEQ ID:3763.

Another function of VGAM1052 is therefore inhibition of 5-hydroxytryptamine (serotonin) Receptor 2C (HTR2C, Accession NM_000868), a gene which activates phospholipase C and regulates intracellular calcium flux. Accordingly, utilities of VGAM1052 include diagnosis, prevention and treatment of diseases and clinical conditions associated with HTR2C. The function of HTR2C has been established by previous studies. Hall (1947) found that DBA/2 mice exhibited genetic susceptibility to audiogenic seizures (AGSs) stimulated by a doorbell mounted in an iron tub. Thereafter, audiogenic seizures were among the intensively studied phenotypes in behavioral genetics. Brennan et al. (1997) found that null mutant mice lacking serotonin 5-HT-2C receptors are extremely susceptible to AGSs. The onset of susceptibility was between 2 and 3 months of age, with complete penetrance in adult animals. Heisler et al. (2002) hypothesized that 5-HT receptors are expressed in POMC (OMIM Ref. No. 176830) neurons and that action at these receptors mediates a component of the anorexic effect of d-FEN (D-fenfluramine). Heisler et al. (2002) found that up to 80% of alpha-MSH neurons express HTR2C mRNA and that the pattern of coexpression was greatest in the caudal arcuate nucleus of the hypothalamus. Heisler et al. (2002) demonstrated that direct activation of HTR2C by agonist in rats decreased their food intake and showed increased induction of FOS-like immunoreactivity in a pattern persistent with d-FEN-induced FOS-like immunoreactivity expression in the arcuate nucleus and paraventricular nucleus of the hypothalamus. Heisler et al. (2002) demonstrated that d-FEN directly activates POMC neurons, indicating that central 5-HT systems directly activate POMC neurons.

Full details of the abovementioned studies are described in the following publications, the disclosure of which are hereby incorporated by reference:

Heisler, L. K.; Cowley, M. A.; Tecott, L. H.; Fan, W.; Low, M. J.; Smart, J. L.; Rubinstein, M.; Tatro, J. B.; Marcus, J. N.; Holstege, H.; Lee, C. E.; Cone, R. D.; Elmquist, J. K.: Activation of central melanocortin pathways by fenfluramine. Science 297:609-611, 2002; and Tecott, L. H.; Sun, L. M.; Akana, S. F.; Strack, A. M.; Lowenstein, D. H.; Dallman, M. F.; Julius, D.: Eating disorder and epilepsy in mice lacking 5-HT2C serotonin receptors. Nature 3.

Further studies establishing the function and utilities of HTR2C are found in John Hopkins OMIM database record ID 312861, and in sited publications numbered 10618-1062 and 11464-10623 listed in the bibliography section hereinbelow, which are also hereby incorporated by reference. Kelch-like 1 (Drosophila) (KLHL1, Accession NM_020866) is another VGAM1052 host target gene. KLHL1 BINDING SITE is HOST TARGET binding site found in the 5' untranslated region of mRNA encoded by KLHL1, corresponding to a HOST TARGET binding site such as BINDING SITE I, BINDING SITE II or BINDING SITE III. Table 2 illustrates the complementarity of the nucleotide sequences of KLHL1 BINDING SITE, designated SEQ ID:21918, to the nucleotide sequence of VGAM1052 RNA, herein designated VGAM RNA, also designated SEQ ID:3763.

Another function of VGAM1052 is therefore inhibition of Kelch-like 1 (Drosophila) (KLHL1, Accession NM_020866). Accordingly, utilities of VGAM1052 include diagnosis, prevention and treatment of diseases and clinical conditions associated with KLHL1. LIM Homeobox Protein 2 (LHX2, Accession NM_004789) is another VGAM1052 host target gene. LHX2 BINDING SITE is HOST TARGET binding site found in the 5' untranslated region of mRNA encoded by LHX2, corresponding to a HOST TARGET binding site such as BINDING SITE I, BINDING SITE II or BINDING SITE III. Table 2 illustrates the complementarity of the nucleotide sequences of LHX2 BINDING SITE, designated SEQ ID:11199, to the nucleotide sequence of VGAM1052 RNA, herein designated VGAM RNA, also designated SEQ ID:3763.

Another function of VGAM1052 is therefore inhibition of LIM Homeobox Protein 2 (LHX2, Accession NM_004789). Accordingly, utilities of VGAM1052 include diagnosis, prevention and treatment of diseases and clinical conditions associated with LHX2. NIMA (never in mitosis gene a)-related Kinase 4 (NEK4, Accession NM_003157) is another VGAM1052 host target gene. NEK4 BINDING SITE is HOST TARGET binding site found in the 5' untranslated region of mRNA encoded by NEK4, corresponding to a HOST TARGET binding site such as BINDING SITE I, BINDING SITE II or BINDING SITE III. Table 2 illustrates the complementarity of the nucleotide sequences of NEK4 BINDING SITE, designated SEQ ID:9137, to the nucleotide sequence of VGAM1052 RNA, herein designated VGAM RNA, also designated SEQ ID:3763.

Another function of VGAM1052 is therefore inhibition of NIMA (never in mitosis gene a)-related Kinase 4 (NEK4, Accession NM_003157). Accordingly, utilities of VGAM1052 include diagnosis, prevention and treatment of diseases and clinical conditions associated with NEK4. Synaptogyrin 1 (SYNGR1, Accession NM_004711) is another VGAM1052 host target gene. SYNGR1 BINDING SITE is HOST TARGET binding site found in the 3' untranslated region of mRNA encoded by SYNGR1, corresponding to a HOST TARGET binding site such as BINDING SITE I, BINDING SITE II or BINDING SITE III. Table 2 illustrates the complementarity of the nucleotide sequences of SYNGR1 BINDING SITE, designated SEQ ID:11062, to the nucleotide sequence of VGAM1052 RNA, herein designated VGAM RNA, also designated SEQ ID:3763.

Another function of VGAM1052 is therefore inhibition of Synaptogyrin 1 (SYNGR1, Accession NM_004711), a gene which belongs to transmembrane synaptic vesicle protein and may function in membrane recycling. Accordingly, utilities of VGAM1052 include diagnosis, prevention and treatment of diseases and clinical conditions associated with SYNGR1. The function of SYNGR1 and its association with various diseases and clinical conditions, has been established by previous studies, as described hereinabove with reference to VGAM107. ADP-ribosylation Factor GTPase Activating Protein 1 (ARFGAP1, Accession NM_018209) is another VGAM1052 host target gene. ARFGAP1 BINDING SITE is HOST TARGET binding site found in the 3' untranslated region of mRNA encoded by ARFGAP1, corresponding to a HOST TARGET binding site such as BINDING SITE I, BINDING SITE II or BINDING SITE III. Table 2 illustrates the complementarity of the nucleotide sequences of ARFGAP1 BINDING SITE, designated SEQ ID:20109, to the nucleotide sequence of VGAM1052 RNA, herein designated VGAM RNA, also designated SEQ ID:3763.

Another function of VGAM1052 is therefore inhibition of ADP-ribosylation Factor GTPase Activating Protein 1 (ARFGAP1, Accession NM_018209). Accordingly, utilities of VGAM1052 include diagnosis, prevention and treatment of diseases and clinical conditions associated with ARFGAP1. Chromosome 20 Open Reading Frame 124 (C20orf124, Accession NM_024777) is another VGAM1052 host target gene. C20orf124 BINDING SITE is HOST TARGET binding site found in the 3' untranslated region of mRNA encoded by C20orf124, corresponding to a HOST TARGET binding site such as BINDING SITE I, BINDING SITE II or BINDING SITE III. Table 2 illustrates the complementarity of the nucleotide sequences of C20orf124 BINDING SITE, designated SEQ ID:24144, to the nucleotide sequence of VGAM1052 RNA, herein designated VGAM RNA, also designated SEQ ID:3763.

Another function of VGAM1052 is therefore inhibition of Chromosome 20 Open Reading Frame 124 (C20orf124, Accession NM_024777). Accordingly, utilities of VGAM1052 include diagnosis, prevention and treatment of diseases and clinical conditions associated with C20orf124. CG012 (Accession XM_096710) is another VGAM1052 host target gene. CG012 BINDING SITE is HOST TARGET binding site found in the 5' untranslated region of mRNA encoded by CG012, corresponding to a HOST TARGET binding site such as BINDING SITE I, BINDING SITE II or BINDING SITE III. Table 2 illustrates the complementarity of the nucleotide sequences of CG012 BINDING SITE, designated SEQ ID:40486, to the nucleotide sequence of VGAM1052 RNA, herein designated VGAM RNA, also designated SEQ ID:3763.

Another function of VGAM1052 is therefore inhibition of CG012 (Accession XM_096710). Accordingly, utilities of VGAM1052 include diagnosis, prevention and treatment of diseases and clinical conditions associated with CG012. DJ667H12.2 (Accession NM_019605) is another VGAM1052 host target gene. DJ667H12.2 BINDING SITE is HOST TARGET binding site found in the 5' untranslated region of mRNA encoded by DJ667H12.2, corresponding to a HOST TARGET binding site such as BINDING SITE I, BINDING SITE II or BINDING SITE III. Table 2 illustrates the complementarity of the nucleotide sequences of DJ667H12.2 BINDING SITE, designated SEQ ID:21215, to the nucleotide sequence of VGAM1052 RNA, herein designated VGAM RNA, also designated SEQ ID:3763.

Another function of VGAM1052 is therefore inhibition of DJ667H12.2 (Accession NM_019605). Accordingly, utilities of VGAM1052 include diagnosis, prevention and treatment of diseases and clinical conditions associated with DJ667H12.2. Dystrophia Myotonica-containing WD Repeat Motif (DMWD, Accession XM_027569) is another VGAM1052 host target gene. DMWD BINDING SITE1 and DMWD BINDING SITE2 are HOST TARGET binding sites found in untranslated regions of mRNA encoded by DMWD, corresponding to HOST TARGET binding sites such as BINDING SITE I, BINDING SITE II or BINDING SITE III. Table 2 illustrates the complementarity of the nucleotide sequences of DMWD BINDING SITE1 and DMWD BINDING SITE2, designated SEQ ID:30528 and SEQ ID:30530 respectively, to the nucleotide sequence of VGAM1052 RNA, herein designated VGAM RNA, also designated SEQ ID:3763.

Another function of VGAM1052 is therefore inhibition of Dystrophia Myotonica-containing WD Repeat Motif (DMWD, Accession XM_027569). Accordingly, utilities of VGAM1052 include diagnosis, prevention and treatment of diseases and clinical conditions associated with DMWD. FLJ10661 (Accession NM_018172) is another VGAM1052 host target gene. FLJ10661 BINDING SITE is HOST TARGET binding site found in the 3' untranslated region of mRNA encoded by FLJ10661, corresponding to a HOST TARGET binding site such as BINDING SITE I, BINDING SITE II or BINDING SITE III. Table 2 illustrates the complementarity of the nucleotide sequences of FLJ10661 BINDING SITE, designated SEQ ID:19994, to the nucleotide sequence of VGAM1052 RNA, herein designated VGAM RNA, also designated SEQ ID:3763.

Another function of VGAM1052 is therefore inhibition of FLJ10661 (Accession NM_018172). Accordingly, utilities of VGAM1052 include diagnosis, prevention and treatment of diseases and clinical conditions associated with FLJ10661. FLJ12650 (Accession NM_024522) is another VGAM1052 host target gene. FLJ12650 BINDING SITE is HOST TARGET binding site found in the 3' untranslated region of mRNA encoded by FLJ12650, corresponding to a HOST TARGET binding site such as BINDING SITE I, BINDING SITE II or BINDING SITE III. Table 2 illustrates the complementarity of the nucleotide sequences of FLJ12650 BINDING SITE, designated SEQ ID:23722, to the nucleotide sequence of VGAM1052 RNA, herein designated VGAM RNA, also designated SEQ ID:3763.

Another function of VGAM1052 is therefore inhibition of FLJ12650 (Accession NM_024522). Accordingly, utilities of VGAM1052 include diagnosis, prevention and treatment of diseases and clinical conditions associated with FLJ12650. KIAA0356 (Accession XM_038655) is another VGAM1052 host target gene. KIAA0356 BINDING SITE is HOST TARGET binding site found in the 3' untranslated region of mRNA encoded by KIAA0356, corresponding to a HOST TARGET binding site such as BINDING SITE I, BINDING SITE II or BINDING SITE III. Table 2 illustrates the complementarity of the nucleotide sequences of KIAA0356 BINDING SITE, designated SEQ ID:32891, to the nucleotide sequence of VGAM1052 RNA, herein designated VGAM RNA, also designated SEQ ID:3763.

Another function of VGAM1052 is therefore inhibition of KIAA0356 (Accession XM_038655). Accordingly, utilities of VGAM1052 include diagnosis, prevention and treatment of diseases and clinical conditions associated with KIAA0356. KIAA1464 (Accession XM_043069) is another VGAM1052 host target gene. KIAA1464 BINDING SITE is HOST TARGET binding site found in the 5' untranslated region of mRNA encoded by KIAA1464, corresponding to a HOST TARGET binding site such as BINDING SITE I, BINDING SITE II or BINDING SITE III. Table 2 illustrates the complementarity of the nucleotide sequences of KIAA1464 BINDING SITE, designated SEQ ID:33881, to the nucleotide sequence of VGAM1052 RNA, herein designated VGAM RNA, also designated SEQ ID:3763.

Another function of VGAM1052 is therefore inhibition of KIAA1464 (Accession XM_043069). Accordingly, utilities of VGAM1052 include diagnosis, prevention and treatment of diseases and clinical conditions associated with KIAA1464. PRO0365 (Accession NM_014126) is another VGAM1052 host target gene. PRO0365 BINDING SITE is HOST TARGET binding site found in the 3' untranslated region of mRNA encoded by PRO0365, corresponding to a HOST TARGET binding site such as BINDING SITE I, BINDING SITE II or BINDING SITE III. Table 2 illustrates the complementarity of the nucleotide sequences of PRO0365 BINDING SITE, designated SEQ ID:15388, to the nucleotide sequence of VGAM1052 RNA, herein designated VGAM RNA, also designated SEQ ID:3763.

Another function of VGAM1052 is therefore inhibition of PRO0365 (Accession NM_014126). Accordingly, utilities of VGAM1052 include diagnosis, prevention and treatment of diseases and clinical conditions associated with PRO0365. SC65 (Accession NM_006455) is another VGAM1052 host target gene. SC65 BINDING SITE is HOST TARGET binding site found in the 3' untranslated region of mRNA encoded by SC65, corresponding to a HOST TARGET binding site such as BINDING SITE I, BINDING SITE II or BINDING SITE III. Table 2 illustrates the complementarity of the nucleotide sequences of SC65 BINDING SITE, designated SEQ ID:13174, to the nucleotide sequence of VGAM1052 RNA, herein designated VGAM RNA, also designated SEQ ID:3763.

Another function of VGAM1052 is therefore inhibition of SC65 (Accession NM_006455). Accordingly, utilities of VGAM1052 include diagnosis, prevention and treatment of diseases and clinical conditions associated with SC65. Sep.in 3 (SEPT3, Accession NM_019106) is another VGAM1052 host target gene. SEPT3 BINDING SITE is HOST TARGET binding site found in the 3' untranslated region of mRNA encoded by SEPT3, corresponding to a HOST TARGET binding site such as BINDING SITE I, BINDING SITE II or BINDING SITE III. Table 2 illustrates the complementarity of the nucleotide sequences of SEPT3 BINDING SITE, designated SEQ ID:21179, to the nucleotide sequence of VGAM1052 RNA, herein designated VGAM RNA, also designated SEQ ID:3763.

Another function of VGAM1052 is therefore inhibition of Sep.in 3 (SEPT3, Accession NM_019106). Accordingly, utilities of VGAM1052 include diagnosis, prevention and treatment of diseases and clinical conditions associated with SEPT3. TED (Accession NM_015686) is another VGAM1052 host target gene. TED BINDING SITE is HOST TARGET binding site found in the 3' untranslated region of mRNA encoded by TED, corresponding to a HOST TARGET binding site such as BINDING SITE I, BINDING SITE II or BINDING SITE III. Table 2 illustrates the complementarity of the nucleotide sequences of TED BINDING SITE, designated SEQ ID:17914, to the nucleotide sequence of VGAM1052 RNA, herein designated VGAM RNA, also designated SEQ ID:3763.

Another function of VGAM1052 is therefore inhibition of TED (Accession NM_015686). Accordingly, utilities of VGAM1052 include diagnosis, prevention and treatment of diseases and clinical conditions associated with TED. LOC129195 (Accession XM_066378) is another VGAM1052 host target gene. LOC129195 BINDING SITE1 through LOC129195 BINDING SITE3 are HOST TARGET binding sites found in untranslated regions of mRNA encoded by LOC129195, corresponding to HOST TARGET binding sites such as BINDING SITE I, BINDING SITE II or BINDING SITE III. Table 2 illustrates the complementarity of the nucleotide sequences of LOC129195 BINDING SITE1 through LOC129195 BINDING SITE3, designated SEQ ID:37323, SEQ ID:37324 and SEQ ID:37325 respectively, to the nucleotide sequence of VGAM1052 RNA, herein designated VGAM RNA, also designated SEQ ID:3763.

Another function of VGAM1052 is therefore inhibition of LOC129195 (Accession XM_066378). Accordingly, utilities of VGAM1052 include diagnosis, prevention and treatment of diseases and clinical conditions associated with LOC129195. LOC149606 (Accession XM_086600) is another VGAM1052 host target gene. LOC149606 BINDING SITE is HOST TARGET binding site found in the 3' untranslated region of mRNA encoded by LOC149606, corresponding to a HOST TARGET binding site such as BINDING SITE I, BINDING SITE II or BINDING SITE III. Table 2 illustrates the complementarity of the nucleotide sequences of LOC149606 BINDING SITE, designated SEQ ID:38782, to the nucleotide sequence of VGAM1052 RNA, herein designated VGAM RNA, also designated SEQ ID:3763.

Another function of VGAM1052 is therefore inhibition of LOC149606 (Accession XM_086600). Accordingly, utilities of VGAM1052 include diagnosis, prevention and treatment of diseases and clinical conditions associated with LOC149606. LOC150197 (Accession XM_086801) is another VGAM1052 host target gene. LOC150197 BINDING SITE is HOST TARGET binding site found in the 3' untranslated region of mRNA encoded by LOC150197, corresponding to a HOST TARGET binding site such as BINDING SITE I, BINDING SITE II or BINDING SITE III. Table 2 illustrates the complementarity of the nucleotide sequences of LOC150197 BINDING SITE, designated SEQ ID:38866, to the nucleotide sequence of VGAM1052 RNA, herein designated VGAM RNA, also designated SEQ ID:3763.

Another function of VGAM1052 is therefore inhibition of LOC150197 (Accession XM_086801). Accordingly, utilities of VGAM1052 include diagnosis, prevention and treatment of diseases and clinical conditions associated with LOC150197. LOC158490 (Accession XM_088585) is another VGAM1052 host target gene. LOC158490 BINDING SITE is HOST TARGET binding site found in the 3' untranslated region of mRNA encoded by LOC158490, corresponding to a HOST TARGET binding site such as BINDING SITE I, BINDING SITE II or BINDING SITE III. Table 2 illustrates the complementarity of the nucleotide sequences of LOC158490 BINDING SITE, designated SEQ ID:39848, to the nucleotide sequence of VGAM1052 RNA, herein designated VGAM RNA, also designated SEQ ID:3763.

Another function of VGAM1052 is therefore inhibition of LOC158490 (Accession XM_088585). Accordingly, utilities of VGAM1052 include diagnosis, prevention and treatment of diseases and clinical conditions associated with LOC158490. LOC220073 (Accession XM_167847) is another VGAM1052 host target gene. LOC220073 BINDING SITE is HOST TARGET binding site found in the 5' untranslated region of mRNA encoded by LOC220073, corresponding to a HOST TARGET binding site such as BINDING SITE I, BINDING SITE II or BINDING SITE III. Table 2 illustrates the complementarity of the nucleotide sequences of LOC220073 BINDING SITE, designated SEQ ID:44874, to the nucleotide sequence of VGAM1052 RNA, herein designated VGAM RNA, also designated SEQ ID:3763.

Another function of VGAM1052 is therefore inhibition of LOC220073 (Accession XM_167847). Accordingly, utilities of VGAM1052 include diagnosis, prevention and treatment of diseases and clinical conditions associated with LOC220073. LOC90917 (Accession XM_034861) is another VGAM1052 host target gene. LOC90917 BINDING SITE is HOST TARGET binding site found in the 3' untranslated region of mRNA encoded by LOC90917, corresponding to a HOST TARGET binding site such as BINDING SITE I, BINDING SITE II or BINDING SITE III. Table 2 illustrates the complementarity of the nucleotide sequences of LOC90917 BINDING SITE, designated SEQ ID:32164, to the nucleotide sequence of VGAM1052 RNA, herein designated VGAM RNA, also designated SEQ ID:3763.

Another function of VGAM1052 is therefore inhibition of LOC90917 (Accession XM_034861). Accordingly, utilities of VGAM1052 include diagnosis, prevention and treatment of diseases and clinical conditions associated with LOC90917. LOC91069 (Accession XM_035824) is another VGAM1052 host target gene. LOC91069 BINDING SITE is HOST TARGET binding site found in the 3' untranslated region of mRNA encoded by LOC91069, corresponding to a HOST TARGET binding site such as BINDING SITE I, BINDING SITE II or BINDING SITE III. Table 2 illustrates the complementarity of the nucleotide sequences of LOC91069 BINDING SITE, designated SEQ ID:32346, to the nucleotide sequence of VGAM1052 RNA, herein designated VGAM RNA, also designated SEQ ID:3763.

Another function of VGAM1052 is therefore inhibition of LOC91069 (Accession XM_035824). Accordingly, utilities of VGAM1052 include diagnosis, prevention and treatment of diseases and clinical conditions associated with LOC91069. FIG. 1 further provides a conceptual description of a novel bioinformatically detected viral gene of the present invention, referred to here as Viral Genomic Address Messenger 1053 (VGAM1053) viral gene, which modulates expression of respective host target genes thereof, the function and utility of which host target genes is known in the art.

VGAM1053 is a novel bioinformatically detected regulatory, non protein coding, viral micro RNA (miRNA) gene. The method by which VGAM1053 was detected is described hereinabove with reference to FIGS. 1-8.

VGAM1053 gene, herein designated VGAM GENE, is a viral gene contained in the genome of Meleagrid Herpesvirus 1. VGAM1053 host target gene, herein designated VGAM HOST TARGET GENE, is a human gene contained in the human genome.

VGAM1053 gene encodes a VGAM1053 precursor RNA, herein designated VGAM PRECURSOR RNA. Similar to other miRNA genes, and unlike most ordinary genes, VGAM1053 precursor RNA does not encode a protein. A nucleotide sequence identical or highly similar to the nucleotide sequence of VGAM1053 precursor RNA is designated SEQ ID:1039, and is provided hereinbelow with reference to the sequence listing part. Nucleotide sequence SEQ ID:1039 is located at position 104991 relative to the genome of Meleagrid Herpesvirus 1.

VGAM1053 precursor RNA folds onto itself, forming VGAM1053 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1053 folded precursor RNA into VGAM1053 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1053 RNA is designated SEQ ID:3764, and is provided hereinbelow with reference to the sequence listing part.

VGAM1053 host target gene, herein designated VGAM HOST TARGET GENE, encodes a corresponding messenger RNA, VGAM1053 host target RNA, herein designated VGAM HOST TARGET RNA. VGAM1053 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1053 RNA, herein designated VGAM RNA, binds complementarily to one or more host target binding sites located in untranslated regions of VGAM1053 host target RNA, herein designated VGAM HOST TARGET RNA. This complementary binding is due to the fact that the nucleotide sequence of VGAM1053 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1053 RNA, herein designated VGAM RNA, may have a different number of host target binding sites in untranslated regions of a VGAM1053 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1053 RNA, herein designated VGAM RNA, to host target binding sites on VGAM1053 host target RNA, herein designated VGAM HOST TARGET RNA, such as BINDING SITE I, BINDING SITE II and BINDING SITE III, inhibits translation of VGAM1053 host target RNA into VGAM1053 host target protein, herein designated VGAM HOST TARGET PROTEIN. VGAM host target protein is therefore outlined by a broken line.

It is appreciated that VGAM1053 host target gene, herein designated VGAM HOST TARGET GENE, in fact represents a plurality of VGAM1053 host target genes. The mRNA of each one of this plurality of VGAM1053 host target genes comprises one or more host target binding sites, each having a nucleotide sequence which is at least partly complementary to VGAM1053 RNA, herein designated VGAM RNA, and which when bound by VGAM1053 RNA causes inhibition of translation of respective one or more VGAM1053 host target proteins.

It is further appreciated by one skilled in the art that the mode of translational inhibition illustrated by FIG. 1 with specific reference to translational inhibition exerted by VGAM1053 gene, herein designated VGAM GENE, on one or more VGAM1053 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1053 is inhibition of expression of host target genes, as part of a novel viral mechanism of attacking a host. Accordingly, utilities of VGAM1053 include diagnosis, prevention and treatment of viral infection by Meleagrid Herpesvirus 1. Specific functions, and accordingly utilities, of VGAM1053 correlate with, and may be deduced from, the identity of the host target genes which VGAM1053 binds and inhibits, and the function of these host target genes, as elaborated hereinbelow.

Nucleotide sequences of the VGAM1053 precursor RNA, herein designated VGAM PRECURSOR RNA, and of the 'diced' VGAM1053 RNA, herein designated VGAM RNA, and a schematic representation of the secondary folding of VGAM1053 folded precursor RNA, herein designated VGAM FOLDED PRECURSOR RNA, of VGAM1053 are further described hereinbelow with reference to Table 1.

Nucleotide sequences of host target binding sites, such as BINDING SITE-I, BINDING SITE-II and BINDING SITE-III of FIG. 1, found on VGAM1053 host target RNA, and schematic representation of the complementarity of each of these host target binding sites to VGAM1053 RNA, herein designated VGAM RNA, are described hereinbelow with reference to Table 2.

As mentioned hereinabove with reference to FIG. 1, a function of VGAM1053 gene, herein designated VGAM is inhibition of expression of VGAM1053 target genes. It is appreciated that specific functions, and accordingly utilities, of VGAM1053 correlate with, and may be deduced from, the identity of the target genes which VGAM1053 binds and inhibits, and the function of these target genes, as elaborated hereinbelow.

Oncostatin M Receptor (OSMR, Accession NM_003999) is a VGAM1053 host target gene. OSMR BINDING SITE is HOST TARGET binding site found in the 5' untranslated region of mRNA encoded by OSMR, corresponding to a HOST TARGET binding site such as BINDING SITE I, BINDING SITE II or BINDING SITE III. Table 2 illustrates the complementarity of the nucleotide sequences of OSMR BINDING SITE, designated SEQ ID:10150, to the nucleotide sequence of VGAM1053 RNA, herein designated VGAM RNA, also designated SEQ ID:3764.

A function of VGAM1053 is therefore inhibition of Oncostatin M Receptor (OSMR, Accession NM_003999). Accordingly, utilities of VGAM1053 include diagnosis, prevention and treatment of diseases and clinical conditions associated with OSMR. LOC127943 (Accession XM_059195) is another VGAM1053 host target gene. LOC127943 BINDING SITE is HOST TARGET binding site found in the 3' untranslated region of mRNA encoded by LOC127943, corresponding to a HOST TARGET binding site such as BINDING SITE I, BINDING SITE II or BINDING SITE III. Table 2 illustrates the complementarity of the nucleotide sequences of LOC127943 BINDING SITE, designated SEQ ID:36913, to the nucleotide sequence of VGAM1053 RNA, herein designated VGAM RNA, also designated SEQ ID:3764.

Another function of VGAM1053 is therefore inhibition of LOC127943 (Accession XM_059195). Accordingly, utilities of VGAM1053 include diagnosis, prevention and treatment of diseases and clinical conditions associated with LOC127943. LOC131873 (Accession XM_067585) is another VGAM1053 host target gene. LOC131873 BINDING SITE is HOST TARGET binding site found in the 3' untranslated region of mRNA encoded by LOC131873, corresponding to a HOST TARGET binding site such as BINDING SITE I, BINDING SITE II or BINDING SITE III. Table 2 illustrates the complementarity of the nucleotide sequences of LOC131873 BINDING SITE, designated SEQ ID:37365, to the nucleotide sequence of VGAM1053 RNA, herein designated VGAM RNA, also designated SEQ ID:3764.

Another function of VGAM1053 is therefore inhibition of LOC131873 (Accession XM_067585). Accordingly, utilities of VGAM1053 include diagnosis, prevention and treatment of diseases and clinical conditions associated with LOC131873. FIG. 1 further provides a conceptual description of a novel bioinformatically detected viral gene of the present invention, referred to here as Viral Genomic Address Messenger 1054 (VGAM1054) viral gene, which modulates expression of respective host target genes thereof, the function and utility of which host target genes is known in the art.

VGAM1054 is a novel bioinformatically detected regulatory, non protein coding, viral micro RNA (miRNA) gene. The method by which VGAM1054 was detected is described hereinabove with reference to FIGS. 1-8.

VGAM1054 gene, herein designated VGAM GENE, is a viral gene contained in the genome of Melanoplus Sanguinipes Entomopoxvirus. VGAM1054 host target gene, herein designated VGAM HOST TARGET GENE, is a human gene contained in the human genome.

VGAM1054 gene encodes a VGAM1054 precursor RNA, herein designated VGAM PRECURSOR RNA. Similar to other miRNA genes, and unlike most ordinary genes, VGAM1054 precursor RNA does not encode a protein. A nucleotide sequence identical or highly similar to the nucleotide sequence of VGAM1054 precursor RNA is designated SEQ ID:1040, and is provided hereinbelow with reference to the sequence listing part. Nucleotide sequence SEQ ID:1040 is located at position 193129 relative to the genome of Melanoplus Sanguinipes Entomopoxvirus.

VGAM1054 precursor RNA folds onto itself, forming VGAM1054 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1054 folded precursor RNA into VGAM1054 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1054 RNA is designated SEQ ID:3765, and is provided hereinbelow with reference to the sequence listing part.

VGAM1054 host target gene, herein designated VGAM HOST TARGET GENE, encodes a corresponding messenger RNA, VGAM1054 host target RNA, herein designated VGAM HOST TARGET RNA. VGAM1054 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1054 RNA, herein designated VGAM RNA, binds complementarily to one or more host target binding sites located in untranslated regions of VGAM1054 host target RNA, herein designated VGAM HOST TARGET RNA. This complementary binding is due to the fact that the nucleotide sequence of VGAM1054 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1054 RNA, herein designated VGAM RNA, may have a different number of host target binding sites in untranslated regions of a VGAM1054 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1054 RNA, herein designated VGAM RNA, to host target binding sites on VGAM1054 host target RNA, herein designated VGAM HOST TARGET RNA, such as BINDING SITE I, BINDING SITE II and BINDING SITE III, inhibits translation of VGAM1054 host target RNA into VGAM1054 host target protein, herein designated VGAM HOST TARGET PROTEIN. VGAM host target protein is therefore outlined by a broken line.

It is appreciated that VGAM1054 host target gene, herein designated VGAM HOST TARGET GENE, in fact represents a plurality of VGAM1054 host target genes. The mRNA of each one of this plurality of VGAM1054 host target genes comprises one or more host target binding sites, each having a nucleotide sequence which is at least partly complementary to VGAM1054 RNA, herein designated VGAM RNA, and which when bound by VGAM1054 RNA causes inhibition of translation of respective one or more VGAM1054 host target proteins.

It is further appreciated by one skilled in the art that the mode of translational inhibition illustrated by FIG. 1 with specific reference to translational inhibition exerted by VGAM1054 gene, herein designated VGAM GENE, on one or more VGAM1054 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1054 is inhibition of expression of host target genes, as part of a novel viral mechanism of attacking a host. Accordingly, utilities of VGAM1054 include diagnosis, prevention and treatment of viral infection by Melanoplus Sanguinipes Entomopoxvirus. Specific functions, and accordingly utilities, of VGAM1054 correlate with, and may be deduced from, the identity of the host target genes which VGAM1054 binds and inhibits, and the function of these host target genes, as elaborated hereinbelow.

Nucleotide sequences of the VGAM1054 precursor RNA, herein designated VGAM PRECURSOR RNA, and of the 'diced' VGAM1054 RNA, herein designated VGAM RNA, and a schematic representation of the secondary folding of VGAM1054 folded precursor RNA, herein designated VGAM FOLDED PRECURSOR RNA, of VGAM1054 are further described hereinbelow with reference to Table 1.

Nucleotide sequences of host target binding sites, such as BINDING SITE-I, BINDING SITE-II and BINDING SITE-III of FIG. 1, found on VGAM1054 host target RNA, and schematic representation of the complementarity of each of these host target binding sites to VGAM1054 RNA, herein designated VGAM RNA, are described hereinbelow with reference to Table 2.

As mentioned hereinabove with reference to FIG. 1, a function of VGAM1054 gene, herein designated VGAM is inhibition of expression of VGAM1054 target genes. It is appreciated that specific functions, and accordingly utilities, of VGAM1054 correlate with, and may be deduced from, the identity of the target genes which VGAM1054 binds and inhibits, and the function of these target genes, as elaborated hereinbelow.

Ras Homolog Gene Family, Member E (ARHE, Accession NM_005168) is a VGAM1054 host target gene. ARHE BINDING SITE is HOST TARGET binding site found in the 3' untranslated region of mRNA encoded by ARHE, corresponding to a HOST TARGET binding site such as BINDING SITE I, BINDING SITE II or BINDING SITE III. Table 2 illustrates the complementarity of the nucleotide sequences of ARHE BINDING SITE, designated SEQ ID:11670, to the nucleotide sequence of VGAM1054 RNA, herein designated VGAM RNA, also designated SEQ ID:3765.

A function of VGAM1054 is therefore inhibition of Ras Homolog Gene Family, Member E (ARHE, Accession NM_005168). Accordingly, utilities of VGAM1054 include diagnosis, prevention and treatment of diseases and clinical conditions associated with ARHE. FLJ11116 (Accession XM_093216) is another VGAM1054 host target gene. FLJ11116 BINDING SITE is HOST TARGET binding site found in the 3' untranslated region of mRNA encoded by FLJ11116, corresponding to a HOST TARGET binding site such as BINDING SITE I, BINDING SITE II or BINDING SITE III. Table 2 illustrates the complementarity of the nucleotide sequences of FLJ11116 BINDING SITE, designated SEQ ID:40185, to the nucleotide sequence of VGAM1054 RNA, herein designated VGAM RNA, also designated SEQ ID:3765.

Another function of VGAM1054 is therefore inhibition of FLJ11116 (Accession XM_093216). Accordingly, utilities of VGAM1054 include diagnosis, prevention and treatment of diseases and clinical conditions associated with FLJ11116. KIAA1136 (Accession XM_166110) is another VGAM1054 host target gene. KIAA1136 BINDING SITE is HOST TARGET binding site found in the 3' untranslated region of mRNA encoded by KIAA1136, corresponding to a HOST TARGET binding site such as BINDING SITE I, BINDING SITE II or BINDING SITE III. Table 2 illustrates the complementarity of the nucleotide sequences of KIAA1136 BINDING SITE, designated SEQ ID:43886, to the nucleotide sequence of VGAM1054 RNA, herein designated VGAM RNA, also designated SEQ ID:3765.

Another function of VGAM1054 is therefore inhibition of KIAA1136 (Accession XM_166110). Accordingly, utilities of VGAM1054 include diagnosis, prevention and treatment of diseases and clinical conditions associated with KIAA1136. FIG. 1 further provides a conceptual description of a novel bioinformatically detected viral gene of the present invention, referred to here as Viral Genomic Address Messenger 1055 (VGAM1055) viral gene, which modulates expression of respective host target genes thereof, the function and utility of which host target genes is known in the art.

VGAM1055 is a novel bioinformatically detected regulatory, non protein coding, viral micro RNA (miRNA) gene. The method by which VGAM1055 was detected is described hereinabove with reference to FIGS. 1-8.

VGAM1055 gene, herein designated VGAM GENE, is a viral gene contained in the genome of Mayaro Virus. VGAM1055 host target gene, herein designated VGAM HOST TARGET GENE, is a human gene contained in the human genome.

VGAM1055 gene encodes a VGAM1055 precursor RNA, herein designated VGAM PRECURSOR RNA. Similar to other miRNA genes, and unlike most ordinary genes, VGAM1055 precursor RNA does not encode a protein. A nucleotide sequence identical or highly similar to the nucleotide sequence of VGAM1055 precursor RNA is designated SEQ ID:1041, and is provided hereinbelow with reference to the sequence listing part. Nucleotide sequence SEQ ID:1041 is located at position 10628 relative to the genome of Mayaro Virus.

VGAM1055 precursor RNA folds onto itself, forming VGAM1055 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1055 folded precursor RNA into VGAM1055 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM1055 RNA is designated SEQ ID:3766, and is provided hereinbelow with reference to the sequence listing part.

VGAM1055 host target gene, herein designated VGAM HOST TARGET GENE, encodes a corresponding messenger RNA, VGAM1055 host target RNA, herein designated VGAM HOST TARGET RNA. VGAM1055 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1055 RNA, herein designated VGAM RNA, binds complementarily to one or more host target binding sites located in untranslated regions of VGAM1055 host target RNA, herein designated VGAM HOST TARGET RNA. This complementary binding is due to the fact that the nucleotide sequence of VGAM1055 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1055 RNA, herein designated VGAM RNA, may have a different number of host target binding sites in untranslated regions of a VGAM1055 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1055 RNA, herein designated VGAM RNA, to host target binding sites on VGAM1055 host target RNA, herein designated VGAM HOST TARGET RNA, such as BINDING SITE I, BINDING SITE II and BINDING SITE III, inhibits translation of VGAM1055 host target RNA into VGAM1055 host target protein, herein designated VGAM HOST TARGET PROTEIN. VGAM host target protein is therefore outlined by a broken line.

It is appreciated that VGAM1055 host target gene, herein designated VGAM HOST TARGET GENE, in fact represents a plurality of VGAM1055 host target genes. The mRNA of each one of this plurality of VGAM1055 host target genes comprises one or more host target binding sites, each having a nucleotide sequence which is at least partly complementary to VGAM1055 RNA, herein designated VGAM RNA, and which when bound by VGAM1055 RNA causes inhibition of translation of respective one or more VGAM1055 host target proteins.

It is further appreciated by one skilled in the art that the mode of translational inhibition illustrated by FIG. 1 with specific reference to translational inhibition exerted by VGAM1055 gene, herein designated VGAM GENE, on one or more VGAM1055 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1055 is inhibition of expression of host target genes, as part of a novel viral mechanism of attacking a host. Accordingly, utilities of VGAM1055 include diagnosis, prevention and treatment of viral infection by Mayaro Virus. Specific functions, and accordingly utilities, of VGAM1055 correlate with, and may be deduced from, the identity of the host target genes which VGAM1055 binds and inhibits, and the function of these host target genes, as elaborated hereinbelow.

Nucleotide sequences of the VGAM1055 precursor RNA, herein designated VGAM PRECURSOR RNA, and of the 'diced' VGAM1055 RNA, herein designated VGAM RNA, and a schematic representation of the secondary folding of VGAM1055 folded precursor RNA, herein designated VGAM FOLDED PRECURSOR RNA, of VGAM1055 are further described hereinbelow with reference to Table 1.

Nucleotide sequences of host target binding sites, such as BINDING SITE-I, BINDING SITE-II and BINDING SITE-III of FIG. 1, found on VGAM1055 host target RNA, and schematic representation of the complementarity of each of these host target binding sites to VGAM1055 RNA, herein designated VGAM RNA, are described hereinbelow with reference to Table 2.

As mentioned hereinabove with reference to FIG. 1, a function of VGAM1055 gene, herein designated VGAM is inhibition of expression of VGAM1055 target genes. It is appreciated that specific functions, and accordingly utilities, of VGAM1055 correlate with, and may be deduced from, the identity of the target genes which VGAM1055 binds and inhibits, and the function of these target genes, as elaborated hereinbelow.

ATPase, Class VI, Type 11B (ATP11B, Accession XM_087254) is a VGAM1055 host target gene. ATP11B BINDING SITE is HOST TARGET binding site found in the 3' untranslated region of mRNA encoded by ATP11B, corresponding to a HOST TARGET binding site such as BINDING SITE I, BINDING SITE II or BINDING SITE III. Table 2 illustrates the complementarity of the nucleotide sequences of ATP11B BINDING SITE, designated SEQ ID:39143, to the nucleotide sequence of VGAM1055 RNA, herein designated VGAM RNA, also designated SEQ ID:3766.

A function of VGAM1055 is therefore inhibition of ATPase, Class VI, Type 11B (ATP11B, Accession XM_087254), a gene which is phosphorylated in their intermediate state, drives uphill transport of ions across membranes. Accordingly, utilities of VGAM1055 include diagnosis, prevention and treatment of diseases and clinical conditions associated with ATP11B. The function of ATP11B and its association with various diseases and clinical conditions, has been established by previous studies, as described hereinabove with reference to VGAM665. KIAA0442 (Accession NM_015570) is another VGAM1055 host target gene. KIAA0442 BINDING SITE is HOST TARGET binding site found in the 3' untranslated region of mRNA encoded by KIAA0442, corresponding to a HOST TARGET binding site such as BINDING SITE I, BINDING SITE II or BINDING SITE III. Table 2 illustrates the complementarity of the nucleotide sequences of KIAA0442 BINDING SITE, designated SEQ ID:17843, to the nucleotide sequence of VGAM1055 RNA, herein designated VGAM RNA, also designated SEQ ID:3766.

Another function of VGAM1055 is therefore inhibition of KIAA0442 (Accession NM_015570). Accordingly, utilities of VGAM1055 include diagnosis, prevention and treatment of diseases and clinical conditions associated with KIAA0442. MIPOL1 (Accession XM_085077) is another VGAM1055 host target gene. MIPOL1 BINDING SITE is HOST TARGET binding site found in the 5' untranslated region of mRNA encoded by MIPOL1, corresponding to a HOST TARGET binding site such as BINDING SITE I, BINDING SITE II or BINDING SITE III. Table 2 illustrates the complementarity of the nucleotide sequences of MIPOL1 BINDING SITE, designated SEQ ID:37814, to the nucleotide sequence of VGAM1055 RNA, herein designated VGAM RNA, also designated SEQ ID:3766.

Another function of VGAM1055 is therefore inhibition of MIPOL1 (Accession XM_085077). Accordingly, utilities of VGAM1055 include diagnosis, prevention and treatment of diseases and clinical conditions associated with MIPOL1. LOC256789 (Accession XM_173369) is another VGAM1055 host target gene. LOC256789 BINDING SITE is HOST TARGET binding site found in the 3' untranslated region of mRNA encoded by LOC256789, corresponding to a HOST TARGET binding site such as BINDING SITE I, BINDING SITE II or BINDING SITE III. Table 2 illustrates the complementarity of the nucleotide sequences of LOC256789 BINDING SITE, designated SEQ ID:46539, to the nucleotide sequence of VGAM1055 RNA, herein designated VGAM RNA, also designated SEQ ID:3766.

Another function of VGAM1055 is therefore inhibition of LOC256789 (Accession XM_173369). Accordingly, utilities of VGAM1055 include diagnosis, prevention and treatment of diseases and clinical conditions associated with LOC256789. FIG. 1 further provides a conceptual description of a novel bioinformatically detected viral gene of the present invention, referred to here as Viral Genomic Address Messenger 1056 (VGAM1056) viral gene, which modulates expression of respective host target genes thereof, the function and utility of which host target genes is known in the art.

VGAM1056 is a novel bioinformatically detected regulatory, non protein coding, viral micro RNA (miRNA) gene. The method by which VGAM1056 was detected is described hereinabove with reference to FIGS. 1-8.

VGAM1056 gene, herein designated VGAM GENE, is a viral gene contained in the genome of Mayaro Virus. VGAM1056 host target gene, herein designated VGAM HOST TARGET GENE, is a human gene contained in the human genome.

VGAM1056 gene encodes a VGAM1056 precursor RNA, herein designated VGAM PRECURSOR RNA. Similar to other miRNA genes, and unlike most ordinary genes, VGAM1056 precursor RNA does not encode a protein. A nucleotide sequence identical or highly similar to the nucleotide sequence of VGAM1056 precursor RNA is designated SEQ ID:1042, and is provided hereinbelow with reference to the sequence listing part. Nucleotide sequence SEQ ID:1042 is located at position 10251 relative to the genome of Mayaro Virus.

VGAM1056 precursor RNA folds onto itself, forming VGAM1056 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1056 folded precursor RNA into VGAM1056 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1056 RNA is designated SEQ ID:3767, and is provided hereinbelow with reference to the sequence listing part.

VGAM1056 host target gene, herein designated VGAM HOST TARGET GENE, encodes a corresponding messenger RNA, VGAM1056 host target RNA, herein designated VGAM HOST TARGET RNA. VGAM1056 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1056 RNA, herein designated VGAM RNA, binds complementarily to one or more host target binding sites located in untranslated regions of VGAM1056 host target RNA, herein designated VGAM HOST TARGET RNA. This complementary binding is due to the fact that the nucleotide sequence of VGAM1056 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1056 RNA, herein designated VGAM RNA, may have a different number of host target binding sites in untranslated regions of a VGAM1056 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1056 RNA, herein designated VGAM RNA, to host target binding sites on VGAM1056 host target RNA, herein designated VGAM HOST TARGET RNA, such as BINDING SITE I, BINDING SITE II and BINDING SITE III, inhibits translation of VGAM1056 host target RNA into VGAM1056 host target protein, herein designated VGAM HOST TARGET PROTEIN. VGAM host target protein is therefore outlined by a broken line.

It is appreciated that VGAM1056 host target gene, herein designated VGAM HOST TARGET GENE, in fact represents a plurality of VGAM1056 host target genes. The mRNA of each one of this plurality of VGAM1056 host target genes comprises one or more host target binding sites, each having a nucleotide sequence which is at least partly complementary to VGAM1056 RNA, herein designated VGAM RNA, and which when bound by VGAM1056 RNA causes inhibition of translation of respective one or more VGAM1056 host target proteins.

It is further appreciated by one skilled in the art that the mode of translational inhibition illustrated by FIG. 1 with specific reference to translational inhibition exerted by VGAM1056 gene, herein designated VGAM GENE, on one or more VGAM1056 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1056 is inhibition of expression of host target genes, as part of a novel viral mechanism of attacking a host. Accordingly, utilities of VGAM1056 include diagnosis, prevention and treatment of viral infection by Mayaro Virus. Specific functions, and accordingly utilities, of VGAM1056 correlate with, and may be deduced from, the identity of the host target genes which VGAM1056 binds and inhibits, and the function of these host target genes, as elaborated hereinbelow.

Nucleotide sequences of the VGAM1056 precursor RNA, herein designated VGAM PRECURSOR RNA, and of the 'diced' VGAM1056 RNA, herein designated VGAM RNA, and a schematic representation of the secondary folding of VGAM1056 folded precursor RNA, herein designated VGAM FOLDED PRECURSOR RNA, of VGAM1056 are further described hereinbelow with reference to Table 1.

Nucleotide sequences of host target binding sites, such as BINDING SITE-I, BINDING SITE-II and BINDING SITE-III of FIG. 1, found on VGAM1056 host target RNA, and schematic representation of the complementarity of each of these host target binding sites to VGAM1056 RNA, herein designated VGAM RNA, are described hereinbelow with reference to Table 2.

As mentioned hereinabove with reference to FIG. 1, a function of VGAM1056 gene, herein designated VGAM is inhibition of expression of VGAM1056 target genes. It is appreciated that specific functions, and accordingly utilities, of VGAM1056 correlate with, and may be deduced from, the identity of the target genes which VGAM1056 binds and inhibits, and the function of these target genes, as elaborated hereinbelow.

LOC148887 (Accession XM_097537) is a VGAM1056 host target gene. LOC148887 BINDING SITE is HOST TARGET binding site found in the 3' untranslated region of mRNA encoded by LOC148887, corresponding to a HOST TARGET binding site such as BINDING SITE I, BINDING SITE II or BINDING SITE III. Table 2 illustrates the complementarity of the nucleotide sequences of LOC148887 BINDING SITE, designated SEQ ID:40911, to the nucleotide sequence of VGAM1056 RNA, herein designated VGAM RNA, also designated SEQ ID:3767.

A function of VGAM1056 is therefore inhibition of LOC148887 (Accession XM_097537). Accordingly, utilities of VGAM1056 include diagnosis, prevention and treatment of diseases and clinical conditions associated with LOC148887. LOC90632 (Accession XM_033067) is another VGAM1056 host target gene. LOC90632 BINDING SITE is HOST TARGET binding site found in the 5' untranslated region of mRNA encoded by LOC90632, corresponding to a HOST TARGET binding site such as BINDING SITE I, BINDING SITE II or BINDING SITE III. Table 2 illustrates the complementarity of the nucleotide sequences of LOC90632 BINDING SITE, designated SEQ ID:31830, to the nucleotide sequence of VGAM1056 RNA, herein designated VGAM RNA, also designated SEQ ID:3767.

Another function of VGAM1056 is therefore inhibition of LOC90632 (Accession XM_033067). Accordingly, utilities of VGAM1056 include diagnosis, prevention and treatment of diseases and clinical conditions associated with LOC90632. FIG. 1 further provides a conceptual description of a novel bioinformatically detected viral gene of the present invention, referred to here as Viral Genomic Address Messenger 1057 (VGAM1057) viral gene, which modulates expression of respective host target genes thereof, the function and utility of which host target genes is known in the art.

VGAM1057 is a novel bioinformatically detected regulatory, non protein coding, viral micro RNA (miRNA) gene. The method by which VGAM1057 was detected is described hereinabove with reference to FIGS. 1-8.

VGAM1057 gene, herein designated VGAM GENE, is a viral gene contained in the genome of Murid Herpesvirus 4. VGAM1057 host target gene, herein designated VGAM HOST TARGET GENE, is a human gene contained in the human genome.

VGAM1057 gene encodes a VGAM1057 precursor RNA, herein designated VGAM PRECURSOR RNA. Similar to other miRNA genes, and unlike most ordinary genes, VGAM1057 precursor RNA does not encode a protein. A nucleotide sequence identical or highly similar to the nucleotide sequence of VGAM1057 precursor RNA is designated SEQ ID:1043, and is provided hereinbelow with reference to the sequence listing part. Nucleotide sequence SEQ ID:1043 is located at position 101664 relative to the genome of Murid Herpesvirus 4.

VGAM1057 precursor RNA folds onto itself, forming VGAM1057 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1057 folded precursor RNA into VGAM1057 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 86%) nucleotide sequence of VGAM1057 RNA is designated SEQ ID:3768, and is provided hereinbelow with reference to the sequence listing part.

VGAM1057 host target gene, herein designated VGAM HOST TARGET GENE, encodes a corresponding messenger RNA, VGAM1057 host target RNA, herein designated VGAM HOST TARGET RNA. VGAM1057 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1057 RNA, herein designated VGAM RNA, binds complementarily to one or more host target binding sites located in untranslated regions of VGAM1057 host target RNA, herein designated VGAM HOST TARGET RNA. This complementary binding is due to the fact that the nucleotide sequence of VGAM1057 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1057 RNA, herein designated VGAM RNA, may have a different number of host target binding sites in untranslated regions of a VGAM1057 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1057 RNA, herein designated VGAM RNA, to host target binding sites on VGAM1057 host target RNA, herein designated VGAM HOST TARGET RNA, such as BINDING SITE I, BINDING SITE II and BINDING SITE III, inhibits translation of VGAM1057 host target RNA into VGAM1057 host target protein, herein designated VGAM HOST TARGET PROTEIN. VGAM host target protein is therefore outlined by a broken line.

It is appreciated that VGAM1057 host target gene, herein designated VGAM HOST TARGET GENE, in fact represents a plurality of VGAM1057 host target genes. The mRNA of each one of this plurality of VGAM1057 host target genes comprises one or more host target binding sites, each having a nucleotide sequence which is at least partly complementary to VGAM1057 RNA, herein designated VGAM RNA, and which when bound by VGAM1057 RNA causes inhibition of translation of respective one or more VGAM1057 host target proteins.

It is further appreciated by one skilled in the art that the mode of translational inhibition illustrated by FIG. 1 with specific reference to translational inhibition exerted by VGAM1057 gene, herein designated VGAM GENE, on one or more VGAM1057 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1057 is inhibition of expression of host target genes, as part of a novel viral mechanism of attacking a host. Accordingly, utilities of VGAM1057 include diagnosis, prevention and treatment of viral infection by Murid Herpesvirus 4. Specific functions, and accordingly utilities, of VGAM1057 correlate with, and may be deduced from, the identity of the host target genes which VGAM1057 binds and inhibits, and the function of these host target genes, as elaborated hereinbelow.

Nucleotide sequences of the VGAM1057 precursor RNA, herein designated VGAM PRECURSOR RNA, and of the 'diced' VGAM1057 RNA, herein designated VGAM RNA, and a schematic representation of the secondary folding of VGAM1057 folded precursor RNA, herein designated VGAM FOLDED PRECURSOR RNA, of VGAM1057 are further described hereinbelow with reference to Table 1.

Nucleotide sequences of host target binding sites, such as BINDING SITE-I, BINDING SITE-II and BINDING SITE-III of FIG. 1, found on VGAM1057 host target RNA, and schematic representation of the complementarity of each of these host target binding sites to VGAM1057 RNA, herein designated VGAM RNA, are described hereinbelow with reference to Table 2.

As mentioned hereinabove with reference to FIG. 1, a function of VGAM1057 gene, herein designated VGAM is inhibition of expression of VGAM1057 target genes. It is appreciated that specific functions, and accordingly utilities, of VGAM1057 correlate with, and may be deduced from, the identity of the target genes which VGAM1057 binds and inhibits, and the function of these target genes, as elaborated hereinbelow.

Integrin, Beta 1 (fibronectin receptor, beta polypeptide, antigen CD29 includes MDF2, MSK12) (ITGB1, Accession NM_033666) is a VGAM1057 host target gene. ITGB1 BINDING SITE is HOST TARGET binding site found in the 3' untranslated region of mRNA encoded by ITGB1, corresponding to a HOST TARGET binding site such as BINDING SITE I, BINDING SITE II or BINDING SITE III. Table 2 illustrates the complementarity of the nucleotide sequences of ITGB1 BINDING SITE, designated SEQ ID:27394, to the nucleotide sequence of VGAM1057 RNA, herein designated VGAM RNA, also designated SEQ ID:3768.

A function of VGAM1057 is therefore inhibition of Integrin, Beta 1 (fibronectin receptor, beta polypeptide, antigen CD29 includes MDF2, MSK12) (ITGB1, Accession NM_033666), a gene which acts as a fibronectin receptor. Accordingly, utilities of VGAM1057 include diagnosis, prevention and treatment of diseases and clinical conditions associated with ITGB1. The function of ITGB1 and its association with various diseases and clinical conditions, has been established by previous studies, as described hereinabove with reference to VGAM427. KIAA0258 (Accession NM_014785) is another VGAM1057 host target gene. KIAA0258 BINDING SITE is HOST TARGET binding site found in the 3' untranslated region of mRNA encoded by KIAA0258, corresponding to a HOST TARGET binding site such as BINDING SITE I, BINDING SITE II or BINDING SITE III. Table 2 illustrates the complementarity of the nucleotide sequences of KIAA0258 BINDING SITE, designated SEQ ID:16650, to the nucleotide sequence of VGAM1057 RNA, herein designated VGAM RNA, also designated SEQ ID:3768.

Another function of VGAM1057 is therefore inhibition of KIAA0258 (Accession NM_014785). Accordingly, utilities of VGAM1057 include diagnosis, prevention and treatment of diseases and clinical conditions associated with KIAA0258. KIAA1819 (Accession XM_045716) is another VGAM1057 host target gene. KIAA1819 BINDING SITE is HOST TARGET binding site found in the 3' untranslated region of mRNA encoded by KIAA1819, corresponding to a HOST TARGET binding site such as BINDING SITE I, BINDING SITE II or BINDING SITE III. Table 2 illustrates the complementarity of the nucleotide sequences of KIAA1819 BINDING SITE, designated SEQ ID:34535, to the nucleotide sequence of VGAM1057 RNA, herein designated VGAM RNA, also designated SEQ ID:3768.

Another function of VGAM1057 is therefore inhibition of KIAA1819 (Accession XM_045716). Accordingly, utilities of VGAM1057 include diagnosis, prevention and treatment of diseases and clinical conditions associated with KIAA1819. LOC255862 (Accession XM_170505) is another VGAM1057 host target gene. LOC255862 BINDING SITE is HOST TARGET binding site found in the 3' untranslated region of mRNA encoded by LOC255862, corresponding to a HOST TARGET binding site such as BINDING SITE I, BINDING SITE II or BINDING SITE III. Table 2 illustrates the complementarity of the nucleotide sequences of LOC255862 BINDING SITE, designated SEQ ID:45340, to the nucleotide sequence of VGAM1057 RNA, herein designated VGAM RNA, also designated SEQ ID:3768.

Another function of VGAM1057 is therefore inhibition of LOC255862 (Accession XM_170505). Accordingly, utilities of VGAM1057 include diagnosis, prevention and treatment of diseases and clinical conditions associated with LOC255862. FIG. 1 further provides a conceptual description of a novel bioinformatically detected viral gene of the present invention, referred to here as Viral Genomic Address Messenger 1058 (VGAM1058) viral gene, which modulates expression of respective host target genes thereof, the function and utility of which host target genes is known in the art.

VGAM1058 is a novel bioinformatically detected regulatory, non protein coding, viral micro RNA (miRNA) gene. The method by which VGAM1058 was detected is described hereinabove with reference to FIGS. 1-8.

VGAM1058 gene, herein designated VGAM GENE, is a viral gene contained in the genome of Murid Herpesvirus 4. VGAM1058 host target gene, herein designated VGAM HOST TARGET GENE, is a human gene contained in the human genome.

VGAM1058 gene encodes a VGAM1058 precursor RNA, herein designated VGAM PRECURSOR RNA. Similar to other miRNA genes, and unlike most ordinary genes, VGAM1058 precursor RNA does not encode a protein. A nucleotide sequence identical or highly similar to the nucleotide sequence of VGAM1058 precursor RNA is designated SEQ ID:1044, and is provided hereinbelow with reference to the sequence listing part. Nucleotide sequence SEQ ID:1044 is located at position 98739 relative to the genome of Murid Herpesvirus 4.

VGAM1058 precursor RNA folds onto itself, forming VGAM1058 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1058 folded precursor RNA into VGAM1058 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1058 RNA is designated SEQ ID:3769, and is provided hereinbelow with reference to the sequence listing part.

VGAM1058 host target gene, herein designated VGAM HOST TARGET GENE, encodes a corresponding messenger RNA, VGAM1058 host target RNA, herein designated VGAM HOST TARGET RNA. VGAM1058 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1058 RNA, herein designated VGAM RNA, binds complementarily to one or more host target binding sites located in untranslated regions of VGAM1058 host target RNA, herein designated VGAM HOST TARGET RNA. This complementary binding is due to the fact that the nucleotide sequence of VGAM1058 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1058 RNA, herein designated VGAM RNA, may have a different number of host target binding sites in untranslated regions of a VGAM1058 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1058 RNA, herein designated VGAM RNA, to host target binding sites on VGAM1058 host target RNA, herein designated VGAM HOST TARGET RNA, such as BINDING SITE I, BINDING SITE II and BINDING SITE III, inhibits translation of VGAM1058 host target RNA into VGAM1058 host target protein, herein designated VGAM HOST TARGET PROTEIN. VGAM host target protein is therefore outlined by a broken line.

It is appreciated that VGAM1058 host target gene, herein designated VGAM HOST TARGET GENE, in fact represents a plurality of VGAM1058 host target genes. The mRNA of each one of this plurality of VGAM1058 host target genes comprises one or more host target binding sites, each having a nucleotide sequence which is at least partly complementary to VGAM1058 RNA, herein designated VGAM RNA, and which when bound by VGAM1058 RNA causes inhibition of translation of respective one or more VGAM1058 host target proteins.

It is further appreciated by one skilled in the art that the mode of translational inhibition illustrated by FIG. 1 with specific reference to translational inhibition exerted by VGAM1058 gene, herein designated VGAM GENE, on one or more VGAM1058 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1058 is inhibition of expression of host target genes, as part of a novel viral mechanism of attacking a host. Accordingly, utilities of VGAM1058 include diagnosis, prevention and treatment of viral infection by Murid Herpesvirus 4. Specific functions, and accordingly utilities, of VGAM1058 correlate with, and may be deduced from, the identity of the host target genes which VGAM1058 binds and inhibits, and the function of these host target genes, as elaborated hereinbelow.

Nucleotide sequences of the VGAM1058 precursor RNA, herein designated VGAM PRECURSOR RNA, and of the 'diced' VGAM1058 RNA, herein designated VGAM RNA, and a schematic representation of the secondary folding of VGAM1058 folded precursor RNA, herein designated VGAM FOLDED PRECURSOR RNA, of VGAM1058 are further described hereinbelow with reference to Table 1.

Nucleotide sequences of host target binding sites, such as BINDING SITE-I, BINDING SITE-II and BINDING SITE-III of FIG. 1, found on VGAM1058 host target RNA, and schematic representation of the complementarity of each of these host target binding sites to VGAM1058 RNA, herein designated VGAM RNA, are described hereinbelow with reference to Table 2.

As mentioned hereinabove with reference to FIG. 1, a function of VGAM1058 gene, herein designated VGAM is inhibition of expression of VGAM1058 target genes. It is appreciated that specific functions, and accordingly utilities, of VGAM1058 correlate with, and may be deduced from, the identity of the target genes which VGAM1058 binds and inhibits, and the function of these target genes, as elaborated hereinbelow.

Absent In Melanoma 1 (AIM1, Accession XM_166300) is a VGAM1058 host target gene. AIM1 BINDING SITE is HOST TARGET binding site found in the 3' untranslated region of mRNA encoded by AIM1, corresponding to a HOST TARGET binding site such as BINDING SITE I, BINDING SITE II or BINDING SITE III. Table 2 illustrates the complementarity of the nucleotide sequences of AIM1 BINDING SITE, designated SEQ ID:44116, to the nucleotide sequence of VGAM1058 RNA, herein designated VGAM RNA, also designated SEQ ID:3769.

A function of VGAM1058 is therefore inhibition of Absent In Melanoma 1 (AIM1, Accession XM_166300), a gene which interactions with the cytoskeleton. Accordingly, utilities of VGAM1058 include diagnosis, prevention and treatment of diseases and clinical conditions associated with AIM1. The function of AIM1 and its association with various diseases and clinical conditions, has been established by previous studies, as described hereinabove with reference to VGAM808. Aspartate Beta-hydroxylase (ASPH, Accession NM_032466) is another VGAM1058 host target gene. ASPH BINDING SITE1 and ASPH BINDING SITE2 are HOST TARGET binding sites found in untranslated regions of mRNA encoded by ASPH, corresponding to HOST TARGET binding sites such as BINDING SITE I, BINDING SITE II or BINDING SITE III. Table 2 illustrates the complementarity of the nucleotide sequences of ASPH BINDING SITE1 and ASPH BINDING SITE2, designated SEQ ID:26221 and SEQ ID:26226 respectively, to the nucleotide sequence of VGAM1058 RNA, herein designated VGAM RNA, also designated SEQ ID:3769.

Another function of VGAM1058 is therefore inhibition of Aspartate Beta-hydroxylase (ASPH, Accession NM_032466), a gene which specifically hydroxylates the beta carbon of aspartic acid or asparagine residues in certain epidermal growth factor (EGF)-like domains of a number of proteins. Accordingly, utilities of VGAM1058 include diagnosis, prevention and treatment of diseases and clinical conditions associated with ASPH. The function of ASPH and its association with various diseases and clinical conditions, has been established by previous studies, as described hereinabove with reference to VGAM47. Methionine Adenosyltransferase I, Alpha (MAT1A, Accession XM_165540) is another VGAM1058 host target gene. MAT1A BINDING SITE is HOST TARGET binding site found in the 3' untranslated region of mRNA encoded by MAT1A, corresponding to a HOST TARGET binding site such as BINDING SITE I, BINDING SITE II or BINDING SITE III. Table 2 illustrates the complementarity of the nucleotide sequences of MAT1A BINDING SITE, designated SEQ ID:43669, to the nucleotide sequence of VGAM1058 RNA, herein designated VGAM RNA, also designated SEQ ID:3769.

Another function of VGAM1058 is therefore inhibition of Methionine Adenosyltransferase I, Alpha (MAT1A, Accession XM_165540). Accordingly, utilities of VGAM1058 include diagnosis, prevention and treatment of diseases and clinical conditions associated with MAT1A. Neuroblastoma RAS Viral (v-ras) Oncogene Homolog (NRAS, Accession NM_002524) is another VGAM1058 host target gene. NRAS BINDING SITE is HOST TARGET binding site found in the 3' untranslated region of mRNA encoded by NRAS, corresponding to a HOST TARGET binding site such as BINDING SITE I, BINDING SITE II or BINDING SITE III. Table 2 illustrates the complementarity of the nucleotide sequences of NRAS BINDING SITE, designated SEQ ID:8363, to the nucleotide sequence of VGAM1058 RNA, herein designated VGAM RNA, also designated SEQ ID:3769.

Another function of VGAM1058 is therefore inhibition of Neuroblastoma RAS Viral (v-ras) Oncogene Homolog (NRAS, Accession NM_002524), a gene which ras proteins bind gdp/gtp and possess intrinsic gtpase activity. Accordingly, utilities of VGAM1058 include diagnosis, prevention and treatment of diseases and clinical conditions associated with NRAS. The function of NRAS and its association with various diseases and clinical conditions, has been established by previous studies, as described hereinabove with reference to VGAM351.3-oxoacid CoA Transferase (OXCT, Accession NM_000436) is another VGAM1058 host target gene. OXCT BINDING SITE is HOST TARGET binding site found in the 3' untranslated region of mRNA encoded by OXCT, corresponding to a HOST TARGET binding site such as BINDING SITE I, BINDING SITE II or BINDING SITE III. Table 2 illustrates the complementarity of the nucleotide sequences of OXCT BINDING SITE, designated SEQ ID:6019, to the nucleotide sequence of VGAM1058 RNA, herein designated VGAM RNA, also designated SEQ ID:3769.

Another function of VGAM1058 is therefore inhibition of 3-oxoacid CoA Transferase (OXCT, Accession NM_000436). Accordingly, utilities of VGAM1058 include diagnosis, prevention and treatment of diseases and clinical conditions associated with OXCT. Calcium-binding tyrosine-(Y)-phosphorylation Regulated (fibrousheathin 2) (CABYR, Accession NM_012189) is another VGAM1058 host target gene. CABYR BINDING SITE is HOST TARGET binding site found in the 3' untranslated region of mRNA encoded by CABYR, corresponding to a HOST TARGET binding site such as BINDING SITE I, BINDING SITE II or BINDING SITE III. Table 2 illustrates the complementarity of the nucleotide sequences of CABYR BINDING SITE, designated SEQ ID:14478, to the nucleotide sequence of VGAM1058 RNA, herein designated VGAM RNA, also designated SEQ ID:3769.

Another function of VGAM1058 is therefore inhibition of Calcium-binding tyrosine-(Y)-phosphorylation Regulated (fibrousheathin 2) (CABYR, Accession NM_012189). Accordingly, utilities of VGAM1058 include diagnosis, prevention and treatment of diseases and clinical conditions associated with CABYR. DKFZp434K1210 (Accession NM_017606) is another VGAM1058 host target gene. DKFZp434K1210 BINDING SITE is HOST TARGET binding site found in the 3' untranslated region of mRNA encoded by DKFZp434K1210, corresponding to a HOST TARGET binding site such as BINDING SITE I, BINDING SITE II or BINDING SITE III. Table 2 illustrates the complementarity of the nucleotide sequences of DKFZp434K1210 BINDING SITE, designated SEQ ID:19101, to the nucleotide sequence of VGAM1058 RNA, herein designated VGAM RNA, also designated SEQ ID:3769.

Another function of VGAM1058 is therefore inhibition of DKFZp434K1210 (Accession NM_017606). Accordingly, utilities of VGAM1058 include diagnosis, prevention and treatment of diseases and clinical conditions associated with DKFZp434K1210. DKFZP566D1346 (Accession NM_030816) is another VGAM1058 host target gene. DKFZP566D1346 BINDING SITE is HOST TARGET binding site found in the 3' untranslated region of mRNA encoded by DKFZP566D1346, corresponding to a HOST TARGET binding site such as BINDING SITE I, BINDING SITE II or BINDING SITE III. Table 2 illustrates the complementarity of the nucleotide sequences of DKFZP566D1346 BINDING SITE, designated SEQ ID:25137, to the nucleotide sequence of VGAM1058 RNA, herein designated VGAM RNA, also designated SEQ ID:3769.

Another function of VGAM1058 is therefore inhibition of DKFZP566D1346 (Accession NM_030816). Accordingly, utilities of VGAM1058 include diagnosis, prevention and treatment of diseases and clinical conditions associated with DKFZP566D1346. DKFZp586H0623 (Accession NM_017540) is another VGAM1058 host target gene. DKFZp586H0623 BINDING SITE is HOST TARGET binding site found in the 3' untranslated region of mRNA encoded by DKFZp586H0623, corresponding to a HOST TARGET binding site such as BINDING SITE I, BINDING SITE II or BINDING SITE III. Table 2 illustrates the complementarity of the nucleotide sequences of DKFZp586H0623 BINDING SITE, designated SEQ ID:18982, to the nucleotide sequence of VGAM1058 RNA, herein designated VGAM RNA, also designated SEQ ID:3769.

Another function of VGAM1058 is therefore inhibition of DKFZp586H0623 (Accession NM_017540). Accordingly, utilities of VGAM1058 include diagnosis, prevention and treatment of diseases and clinical conditions associated with DKFZp586H0623. FLJ11383 (Accession NM_024938) is another VGAM1058 host target gene. FLJ11383 BINDING SITE is HOST TARGET binding site found in the 3' untranslated region of mRNA encoded by FLJ11383, corresponding to a HOST TARGET binding site such as BINDING SITE I, BINDING SITE II or BINDING SITE III. Table 2 illustrates the complementarity of the nucleotide sequences of FLJ11383 BINDING SITE, designated SEQ ID:24478, to the nucleotide sequence of VGAM1058 RNA, herein designated VGAM RNA, also designated SEQ ID:3769.

Another function of VGAM1058 is therefore inhibition of FLJ11383 (Accession NM_024938). Accordingly, utilities of VGAM1058 include diagnosis, prevention and treatment of diseases and clinical conditions associated with FLJ11383. FLJ20694 (Accession NM_017928) is another VGAM1058 host target gene. FLJ20694 BINDING SITE is HOST TARGET binding site found in the 3' untranslated region of mRNA encoded by FLJ20694, corresponding to a HOST TARGET binding site such as BINDING SITE I, BINDING SITE II or BINDING SITE III. Table 2 illustrates the complementarity of the nucleotide sequences of FLJ20694 BINDING SITE, designated SEQ ID:19609, to the nucleotide sequence of VGAM1058 RNA, herein designated VGAM RNA, also designated SEQ ID:3769.

Another function of VGAM1058 is therefore inhibition of FLJ20694 (Accession NM_017928). Accordingly, utilities of VGAM1058 include diagnosis, prevention and treatment of diseases and clinical conditions associated with FLJ20694. KIAA1691 (Accession XM_166523) is another VGAM1058 host target gene. KIAA1691 BINDING SITE is HOST TARGET binding site found in the 3' untranslated region of mRNA encoded by KIAA1691, corresponding to a HOST TARGET binding site such as BINDING SITE I, BINDING SITE II or BINDING SITE III. Table 2 illustrates the complementarity of the nucleotide sequences of KIAA1691 BINDING SITE, designated SEQ ID:44469, to the nucleotide sequence of VGAM1058 RNA, herein designated VGAM RNA, also designated SEQ ID:3769.

Another function of VGAM1058 is therefore inhibition of KIAA1691 (Accession XM_166523). Accordingly, utilities of VGAM1058 include diagnosis, prevention and treatment of diseases and clinical conditions associated with KIAA1691. MGC35558 (Accession NM_145013) is another VGAM1058 host target gene. MGC35558 BINDING SITE is HOST TARGET binding site found in the 3' untranslated region of mRNA encoded by MGC35558, corresponding to a HOST TARGET binding site such as BINDING SITE I, BINDING SITE II or BINDING SITE III. Table 2 illustrates the complementarity of the nucleotide sequences of MGC35558 BINDING SITE, designated SEQ ID:29617, to the nucleotide sequence of VGAM1058 RNA, herein designated VGAM RNA, also designated SEQ ID:3769.

Another function of VGAM1058 is therefore inhibition of MGC35558 (Accession NM_145013). Accordingly, utilities of VGAM1058 include diagnosis, prevention and treatment of diseases and clinical conditions associated with MGC35558. PRO1843 (Accession NM_018507) is another VGAM1058 host target gene. PRO1843 BINDING SITE is HOST TARGET binding site found in the 5' untranslated region of mRNA encoded by PRO1843, corresponding to a HOST TARGET binding site such as BINDING SITE I, BINDING SITE II or BINDING SITE III. Table 2 illustrates the complementarity of the nucleotide sequences of PRO1843 BINDING SITE, designated SEQ ID:20573, to the nucleotide sequence of VGAM1058 RNA, herein designated VGAM RNA, also designated SEQ ID:3769.

Another function of VGAM1058 is therefore inhibition of PRO1843 (Accession NM_018507). Accordingly, utilities of VGAM1058 include diagnosis, prevention and treatment of diseases and clinical conditions associated with PRO1843. SH3 Domain Binding Glutamic Acid-rich Protein Like (SH3BGRL, Accession XM_030373) is another VGAM1058 host target gene. SH3BGRL BINDING SITE is HOST TARGET binding site found in the 3' untranslated region of mRNA encoded by SH3BGRL, corresponding to a HOST TARGET binding site such as BINDING SITE I, BINDING SITE II or BINDING SITE III. Table 2 illustrates the complementarity of the nucleotide sequences of SH3BGRL BINDING SITE, designated SEQ ID:31025, to the nucleotide sequence of VGAM1058 RNA, herein designated VGAM RNA, also designated SEQ ID:3769.

Another function of VGAM1058 is therefore inhibition of SH3 Domain Binding Glutamic Acid-rich Protein Like (SH3BGRL, Accession XM_030373). Accordingly, utilities of VGAM1058 include diagnosis, prevention and treatment of diseases and clinical conditions associated with SH3BGRL. Zinc Finger Protein 387 (ZNF387, Accession NM_014682) is another VGAM1058 host target gene. ZNF387 BINDING SITE is HOST TARGET binding site found in the 3' untranslated region of mRNA encoded by ZNF387, corresponding to a HOST TARGET binding site such as BINDING SITE I, BINDING SITE II or BINDING SITE III. Table 2 illustrates the complementarity of the nucleotide sequences of ZNF387 BINDING SITE, designated SEQ ID:16177, to the nucleotide sequence of VGAM1058 RNA, herein designated VGAM RNA, also designated SEQ ID:3769.

Another function of VGAM1058 is therefore inhibition of Zinc Finger Protein 387 (ZNF387, Accession NM_014682). Accordingly, utilities of VGAM1058 include diagnosis, prevention and treatment of diseases and clinical conditions associated with ZNF387. LOC152627 (Accession XM_087495) is another VGAM1058 host target gene. LOC152627 BINDING SITE is HOST TARGET binding site found in the 5' untranslated region of mRNA encoded by LOC152627, corresponding to a HOST TARGET binding site such as BINDING SITE I, BINDING SITE II or BINDING SITE III. Table 2 illustrates the complementarity of the nucleotide sequences of LOC152627 BINDING SITE, designated SEQ ID:39294, to the nucleotide sequence of VGAM1058 RNA, herein designated VGAM RNA, also designated SEQ ID:3769.

Another function of VGAM1058 is therefore inhibition of LOC152627 (Accession XM_087495). Accordingly, utilities of VGAM1058 include diagnosis, prevention and treatment of diseases and clinical conditions associated with LOC152627. LOC162333 (Accession XM_102591) is another VGAM1058 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42131, to the nucleotide sequence of VGAM1058 RNA, herein designated VGAM RNA, also designated SEQ ID:3769.

Another function of VGAM1058 is therefore inhibition of LOC162333 (Accession XM_102591). Accordingly, utilities of VGAM1058 include diagnosis, prevention and treatment of diseases and clinical conditions associated with LOC162333. LOC168082 (Accession XM_094852) is another VGAM1058 host target gene. LOC168082 BINDING SITE is HOST TARGET binding site found in the 5' untranslated region of mRNA encoded by LOC168082, corresponding to a HOST TARGET binding site such as BINDING SITE I, BINDING SITE II or BINDING SITE III. Table 2 illustrates the complementarity of the nucleotide sequences of LOC168082 BINDING SITE, designated SEQ ID:40238, to the nucleotide sequence of VGAM1058 RNA, herein designated VGAM RNA, also designated SEQ ID:3769.

Another function of VGAM1058 is therefore inhibition of LOC168082 (Accession XM_094852). Accordingly, utilities of VGAM1058 include diagnosis, prevention and treatment of diseases and clinical conditions associated with LOC168082. LOC90906 (Accession XM_034809) is another VGAM1058 host target gene. LOC90906 BINDING SITE is HOST TARGET binding site found in the 5' untranslated region of mRNA encoded by LOC90906, corresponding to a HOST TARGET binding site such as BINDING SITE I, BINDING SITE II or BINDING SITE III. Table 2 illustrates the complementarity of the nucleotide sequences of LOC90906 BINDING SITE, designated SEQ ID:32153, to the nucleotide sequence of VGAM1058 RNA, herein designated VGAM RNA, also designated SEQ ID:3769.

Another function of VGAM1058 is therefore inhibition of LOC90906 (Accession XM_034809). Accordingly, utilities of VGAM1058 include diagnosis, prevention and treatment of diseases and clinical conditions associated with LOC90906. FIG. 1 further provides a conceptual description of a novel bioinformatically detected viral gene of the present invention, referred to here as Viral Genomic Address Messenger 1059 (VGAM1059) viral gene, which modulates expression of respective host target genes thereof, the function and utility of which host target genes is known in the art.

VGAM1059 is a novel bioinformatically detected regulatory, non protein coding, viral micro RNA (miRNA) gene. The method by which VGAM1059 was detected is described hereinabove with reference to FIGS. 1-8.

VGAM1059 gene, herein designated VGAM GENE, is a viral gene contained in the genome of Murid Herpesvirus 4. VGAM1059 host target gene, herein designated VGAM HOST TARGET GENE, is a human gene contained in the human genome.

VGAM1059 gene encodes a VGAM1059 precursor RNA, herein designated VGAM PRECURSOR RNA. Similar to other miRNA genes, and unlike most ordinary genes, VGAM1059 precursor RNA does not encode a protein. A nucleotide sequence identical or highly similar to the nucleotide sequence of VGAM1059 precursor RNA is designated SEQ ID:1045, and is provided hereinbelow with reference to the sequence listing part. Nucleotide sequence SEQ ID:1045 is located at position 97788 relative to the genome of Murid Herpesvirus 4.

VGAM1059 precursor RNA folds onto itself, forming VGAM1059 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1059 folded precursor RNA into VGAM1059 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1059 RNA is designated SEQ ID:3770, and is provided hereinbelow with reference to the sequence listing part.

VGAM1059 host target gene, herein designated VGAM HOST TARGET GENE, encodes a corresponding messenger RNA, VGAM1059 host target RNA, herein designated VGAM HOST TARGET RNA. VGAM1059 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1059 RNA, herein designated VGAM RNA, binds complementarily to one or more host target binding sites located in untranslated regions of VGAM1059 host target RNA, herein designated VGAM HOST TARGET RNA. This complementary binding is due to the fact that the nucleotide sequence of VGAM1059 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1059 RNA, herein designated VGAM RNA, may have a different number of host target binding sites in untranslated regions of a VGAM1059 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1059 RNA, herein designated VGAM RNA, to host target binding sites on VGAM1059 host target RNA, herein designated VGAM HOST TARGET RNA, such as BINDING SITE I, BINDING SITE II and BINDING SITE III, inhibits translation of VGAM1059 host target RNA into VGAM1059 host target protein, herein designated VGAM HOST TARGET PROTEIN. VGAM host target protein is therefore outlined by a broken line.

It is appreciated that VGAM1059 host target gene, herein designated VGAM HOST TARGET GENE, in fact represents a plurality of VGAM1059 host target genes. The mRNA of each one of this plurality of VGAM1059 host target genes comprises one or more host target binding sites, each having a nucleotide sequence which is at least partly complementary to VGAM1059 RNA, herein designated VGAM RNA, and which when bound by VGAM1059 RNA causes inhibition of translation of respective one or more VGAM1059 host target proteins.

It is further appreciated by one skilled in the art that the mode of translational inhibition illustrated by FIG. 1 with specific reference to translational inhibition exerted by VGAM1059 gene, herein designated VGAM GENE, on one or more VGAM1059 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1059 is inhibition of expression of host target genes, as part of a novel viral mechanism of attacking a host. Accordingly, utilities of VGAM1059 include diagnosis, prevention and treatment of viral infection by Murid Herpesvirus 4. Specific functions, and accordingly utilities, of VGAM1059 correlate with, and may be deduced from, the identity of the host target genes which VGAM1059 binds and inhibits, and the function of these host target genes, as elaborated hereinbelow.

Nucleotide sequences of the VGAM1059 precursor RNA, herein designated VGAM PRECURSOR RNA, and of the 'diced' VGAM1059 RNA, herein designated VGAM RNA, and a schematic representation of the secondary folding of VGAM1059 folded precursor RNA, herein designated VGAM FOLDED PRECURSOR RNA, of VGAM1059 are further described hereinbelow with reference to Table 1.

Nucleotide sequences of host target binding sites, such as BINDING SITE-I, BINDING SITE-II and BINDING SITE-III of FIG. 1, found on VGAM1059 host target RNA, and schematic representation of the complementarity of each of these host target binding sites to VGAM1059 RNA, herein designated VGAM RNA, are described hereinbelow with reference to Table 2.

As mentioned hereinabove with reference to FIG. 1, a function of VGAM1059 gene, herein designated VGAM is inhibition of expression of VGAM1059 target genes. It is appreciated that specific functions, and accordingly utilities, of VGAM1059 correlate with, and may be deduced from, the identity of the target genes which VGAM1059 binds and inhibits, and the function of these target genes, as elaborated hereinbelow.

A Disintegrin-like and Metalloprotease (reprolysin type) with Thrombospondin Type 1 Motif, 4 (ADAMTS4, Accession NM_005099) is a VGAM1059 host target gene. ADAMTS4 BINDING SITE is HOST TARGET binding site found in the 5' untranslated region of mRNA encoded by ADAMTS4, corresponding to a HOST TARGET binding site such as BINDING SITE I, BINDING SITE II or BINDING SITE III. Table 2 illustrates the complementarity of the nucleotide sequences of ADAMTS4 BINDING SITE, designated SEQ ID:11568, to the nucleotide sequence of VGAM1059 RNA, herein designated VGAM RNA, also designated SEQ ID:3770.

A function of VGAM1059 is therefore inhibition of A Disintegrin-like and Metalloprotease (reprolysin type) with Thrombospondin Type 1 Motif, 4 (ADAMTS4, Accession NM_005099), a gene which cleaves aggrecan, a cartilage proteoglycan, and may be involved in its turnover. Accordingly, utilities of VGAM1059 include diagnosis, prevention and treatment of diseases and clinical conditions associated with ADAMTS4. The function of ADAMTS4 and its association with various diseases and clinical conditions, has been established by previous studies, as described hereinabove with reference to VGAM809. Angiopoietin 1 (ANGPT1, Accession NM_001146) is another VGAM1059 host target gene. ANGPT1 BINDING SITE is HOST TARGET binding site found in the 3' untranslated region of mRNA encoded by ANGPT1, corresponding to a HOST TARGET binding site such as BINDING SITE I, BINDING SITE II or BINDING SITE III. Table 2 illustrates the complementarity of the nucleotide sequences of ANGPT1 BINDING SITE, designated SEQ ID:6816, to the nucleotide sequence of VGAM1059 RNA, herein designated VGAM RNA, also designated SEQ ID:3770.

Another function of VGAM1059 is therefore inhibition of Angiopoietin 1 (ANGPT1, Accession NM_001146), a gene which binds and activates tie2 receptor by inducing its tyrosine phosphorylation. Accordingly, utilities of VGAM1059 include diagnosis, prevention and treatment of diseases and clinical conditions associated with ANGPT1. The function of ANGPT1 and its association with various diseases and clinical conditions, has been established by previous studies, as described hereinabove with reference to VGAM291. Cystic Fibrosis Transmembrane Conductance Regulator, ATP-binding Cassette (sub-family C, member 7) (CFTR, Accession NM_000492) is another VGAM1059 host target gene. CFTR BINDING SITE is HOST TARGET binding site found in the 3' untranslated region of mRNA encoded by CFTR, corresponding to a HOST TARGET binding site such as BINDING SITE I, BINDING SITE II or BINDING SITE III. Table 2 illustrates the complementarity of the nucleotide sequences of CFTR BINDING SITE, designated SEQ ID:6101, to the nucleotide sequence of VGAM1059 RNA, herein designated VGAM RNA, also designated SEQ ID:3770.

Another function of VGAM1059 is therefore inhibition of Cystic Fibrosis Transmembrane Conductance Regulator, ATP-binding Cassette (sub-family C, member 7) (CFTR, Accession NM_000492). Accordingly, utilities of VGAM1059 include diagnosis, prevention and treatment of diseases and clinical conditions associated with CFTR. Glutamate Decarboxylase 1 (brain, 67 kDa) (GAD1, Accession NM_000817) is another VGAM1059 host target gene. GAD1 BINDING SITE is HOST TARGET binding site found in the 3' untranslated region of mRNA encoded by GAD1, corresponding to a HOST TARGET binding site such as BINDING SITE I, BINDING SITE II or BINDING SITE III. Table 2 illustrates the complementarity of the nucleotide sequences of GAD1 BINDING SITE, designated SEQ ID:6481, to the nucleotide sequence of VGAM1059 RNA, herein designated VGAM RNA, also designated SEQ ID:3770.

Another function of VGAM1059 is therefore inhibition of Glutamate Decarboxylase 1 (brain, 67 kDa) (GAD1, Accession NM_000817), a gene which catalyzes the conversion of glutamic acid to gamma-aminobutyric acid. Accordingly, utilities of VGAM1059 include diagnosis, prevention and treatment of diseases and clinical conditions associated with GAD1. The function of GAD1 and its association with various diseases and clinical conditions, has been established by previous studies, as described hereinabove with reference to VGAM691. Potassium Channel, Subfamily K, Member 3 (KCNK3, Accession NM_002246) is another VGAM1059 host target gene. KCNK3 BINDING SITE is HOST TARGET binding site found in the 3' untranslated region of mRNA encoded by KCNK3, corresponding to a HOST TARGET binding site such as BINDING SITE I, BINDING SITE II or BINDING SITE III. Table 2 illustrates the complementarity of the nucleotide sequences of KCNK3 BINDING SITE, designated SEQ ID:8034, to the nucleotide sequence of VGAM1059 RNA, herein designated VGAM RNA, also designated SEQ ID:3770.

Another function of VGAM1059 is therefore inhibition of Potassium Channel, Subfamily K, Member 3 (KCNK3, Accession NM_002246), a gene which is a ph-dependent, voltage-insensitive, background potassium channel. Accordingly, utilities of VGAM1059 include diagnosis, prevention and treatment of diseases and clinical conditions associated with KCNK3. The function of KCNK3 has been established by previous studies. Potassium channels are ubiquitous multisubunit membrane proteins that regulate membrane potential in numerous cell types. One family of mammalian K+ channels is characterized by the presence of 4 transmembrane domains and 2 P domains per subunit; this family includes TASK, TWIK (KCNK1; 601745), and TREK (KCNK2; 603219). Duprat et al. (1997) identified mouse expressed sequence tags with similarity to TREK and TWIK and cloned a corresponding cDNA from a mouse brain library. The mouse cDNA was used to clone the human counterpart from a kidney cDNA library. The human cDNA, designated TASK, encodes a 394-amino acid polypeptide with 85% identity to the mouse ortholog. The sequence contains consensus sites for N-linked glycosylation and for phosphorylation at the C-terminal. Northern blot analysis showed that TASK is expressed in a variety of human tissues, with highest levels in pancreas and placenta. Expression of the TASK cDNA revealed that the functional protein creates currents that are K(+)-selective, instantaneous, and noninactivating. These currents showed an outward rectification when external K+ was low, but evinced absence of activation and inactivation kinetics as well as voltage independence, characteristics of so-called leak or background conductances. TASK currents were very sensitive to small changes in extracellular pH, suggesting that TASK has a role in cellular responses to changes in extracellular pH. Lesage and Lazdunski (1998) used a radiation hybrid mapping panel to map the human KCNK3 gene to chromosome 2p23 between markers WI13615 and WI11298. By fluorescence in situ hybridization, Manjunath et al. (1999) mapped the KCNK3 gene to 2p24.1-p23.3 and the mouse homolog to chromosome 5B.

Full details of the abovementioned studies are described in the following publications, the disclosure of which are hereby incorporated by reference:

Lesage, F.; Lazdunski, M.: Mapping of human potassium channel genes TREK-1 (KCNK2) and TASK (KCNK3) to chromosomes 1q41 and 2p23. Genomics 51:478-479, 1998; and Manjunath, N. A.; Bray-Ward, P.; Goldstein, S. A. N.; Gallagher, P. G.: Assignment of the 2P domain, acid-sensitive potassium channel OAT1 gene KCNK3 to human chromosome bands 2p24.1-p.

Further studies establishing the function and utilities of KCNK3 are found in John Hopkins OMIM database record ID 603220, and in sited publications numbered 243 and 2437 listed in the bibliography section hereinbelow, which are also hereby incorporated by reference. Antigen P97 (melanoma associated) Identified By Monoclonal Antibodies 133.2 and 96.5 (MFI2, Accession NM_033316) is another VGAM1059 host target gene. MFI2 BINDING SITE is HOST TARGET binding site found in the 3' untranslated region of mRNA encoded by MFI2, corresponding to a HOST TARGET binding site such as BINDING SITE I, BINDING SITE II or BINDING SITE III. Table 2 illustrates the complementarity of the nucleotide sequences of MFI2 BINDING SITE, designated SEQ ID:27153, to the nucleotide sequence of VGAM1059 RNA, herein designated VGAM RNA, also designated SEQ ID:3770.

Another function of VGAM1059 is therefore inhibition of Antigen P97 (melanoma associated) Identified By Monoclonal Antibodies 133.2 and 96.5 (MFI2, Accession NM_033316). Accordingly, utilities of VGAM1059 include diagnosis, prevention and treatment of diseases and clinical conditions associated with MFI2. Nuclear Receptor Coactivator 3 (NCOA3, Accession NM_006534) is another VGAM1059 host target gene. NCOA3 BINDING SITE is HOST TARGET binding site found in the 3' untranslated region of mRNA encoded by NCOA3, corresponding to a HOST TARGET binding site such as BINDING SITE I, BINDING SITE II or BINDING SITE III. Table 2 illustrates the complementarity of the nucleotide sequences of NCOA3 BINDING SITE, designated SEQ ID:13287, to the nucleotide sequence of VGAM1059 RNA, herein designated VGAM RNA, also designated SEQ ID:3770.

Another function of VGAM1059 is therefore inhibition of Nuclear Receptor Coactivator 3 (NCOA3, Accession NM_006534), a gene which directly binds nuclear receptors and stimulates the transcriptional activities in hormone-dependent fashion. Accordingly, utilities of VGAM1059 include diagnosis, prevention and treatment of diseases and clinical conditions associated with NCOA3. The function of NCOA3 and its association with various diseases and clinical conditions, has been established by previous studies, as described hereinabove with reference to VGAM215. Nuclear Receptor Subfamily 2, Group E, Member 1 (NR2E1, Accession NM_003269) is another VGAM1059 host target gene. NR2E1 BINDING SITE is HOST TARGET binding site found in the 3' untranslated region of mRNA encoded by NR2E1, corresponding to a HOST TARGET binding site such as BINDING SITE I, BINDING SITE II or BINDING SITE III. Table 2 illustrates the complementarity of the nucleotide sequences of NR2E1 BINDING SITE, designated SEQ ID:9279, to the nucleotide sequence of VGAM1059 RNA, herein designated VGAM RNA, also designated SEQ ID:3770.

Another function of VGAM1059 is therefore inhibition of Nuclear Receptor Subfamily 2, Group E, Member 1 (NR2E1, Accession NM_003269), a gene which may be required for brain development and be involved in the regulation of retinal development. Accordingly, utilities of VGAM1059 include diagnosis, prevention and treatment of diseases and clinical conditions associated with NR2E1. The function of NR2E1 and its association with various diseases and clinical conditions, has been established by previous studies, as described hereinabove with reference to VGAM689. Radixin (RDX, Accession NM_002906) is another VGAM1059 host target gene. RDX BINDING SITE is HOST TARGET binding site found in the 3' untranslated region of mRNA encoded by RDX, corresponding to a HOST TARGET binding site such as BINDING SITE I, BINDING SITE II or BINDING SITE III. Table 2 illustrates the complementarity of the nucleotide sequences of RDX BINDING SITE, designated SEQ ID:8810, to the nucleotide sequence of VGAM1059 RNA, herein designated VGAM RNA, also designated SEQ ID:3770.

Another function of VGAM1059 is therefore inhibition of Radixin (RDX, Accession NM_002906), a gene which plays a crucial role in the binding of the barbed end of actin filaments to the plasma membrane. Accordingly, utilities of VGAM1059 include diagnosis, prevention and treatment of diseases and clinical conditions associated with RDX. The function of RDX and its association with various diseases and clinical conditions, has been established by previous studies, as described hereinabove with reference to VGAM290. Surfeit 4 (SURF4, Accession NM_033161) is another VGAM1059 host target gene. SURF4 BINDING SITE is HOST TARGET binding site found in the 3' untranslated region of mRNA encoded by SURF4, corresponding to a HOST TARGET binding site such as BINDING SITE I, BINDING SITE II or BINDING SITE III. Table 2 illustrates the complementarity of the nucleotide sequences of SURF4 BINDING SITE, designated SEQ ID:27014, to the nucleotide sequence of VGAM1059 RNA, herein designated VGAM RNA, also designated SEQ ID:3770.

Another function of VGAM1059 is therefore inhibition of Surfeit 4 (SURF4, Accession NM_033161), a gene which is a conserved integral membrane protein containing multiple putative transmembrane regions. Accordingly, utilities of VGAM1059 include diagnosis, prevention and treatment of diseases and clinical conditions associated with SURF4. The function of SURF4 and its association with various diseases and clinical conditions, has been established by previous studies, as described hereinabove with reference to VGAM496. Ubiquitin-conjugating Enzyme E2L 6 (UBE2L6, Accession NM_004223) is another VGAM1059 host target gene. UBE2L6 BINDING SITE is HOST TARGET binding site found in the 3' untranslated region of mRNA encoded by UBE2L6, corresponding to a HOST TARGET binding site such as BINDING SITE I, BINDING SITE II or BINDING SITE III. Table 2 illustrates the complementarity of the nucleotide sequences of UBE2L6 BINDING SITE, designated SEQ ID:10420, to the nucleotide sequence of VGAM1059 RNA, herein designated VGAM RNA, also designated SEQ ID:3770.

Another function of VGAM1059 is therefore inhibition of Ubiquitin-conjugating Enzyme E2L 6 (UBE2L6, Accession NM_004223), a gene which catalyzes the covalent attachment of ubiquitin to other proteins. Accordingly, utilities of VGAM1059 include diagnosis, prevention and treatment of diseases and clinical conditions associated with UBE2L6. The function of UBE2L6 has been established by previous studies. Ubiquitination of a protein substrate requires the concerted action of 3 classes of enzymes: E1 ubiquitin-activating enzymes, E2 ubiquitin-conjugating enzymes, and E3 ubiquitin protein ligases. See 600012. E2 enzymes may transfer ubiquitin either directly to a substrate or to an E3 protein. Class I E2s are unable to transfer ubiquitin to proteins in vitro, suggesting that this class of E2s may require an E3 enzyme for substrate recognition. Using a yeast 2-hybrid assay with the E3 enzyme E6AP (OMIM Ref. No. 601623) as bait, Kumar et al. (1997) identified cDNAs encoding a novel class I E2 that they named UBCH8. The predicted 152-amino acid UBCH8 protein is 46% identical to UBCH7 (OMIM Ref. No. 603721). In vitro, recombinant Ubch8 formed thiol ester complexes with ubiquitin and was able to transfer ubiquitin to E6AP. Both UBCH7 and UBCH8 specifically associated with E6AP in yeast 2-hybrid assays, while UBCH5 (OMIM Ref. No. 602961) and UBCH6 (OMIM Ref. No. 602916) interacted selectively with an S. cerevisiae E3, RSP5 (see OMIM Ref. No. 602278). In vitro, the E6AP-interacting E2s were also able to function with E6AP in the ubiquitination of a substrate, whereas noninteracting E2s were unable to do so. The authors suggested that selective physical interaction between E2 and E3 enzymes forms the basis of specificity for functionally distinct E2-E3 combinations. By fluorescence in situ hybridization, Ardley et al. (2000) mapped the UBE2L6 gene to chromosome 11q12.

Full details of the abovementioned studies are described in the following publications, the disclosure of which are hereby incorporated by reference:

Ardley, H. C.; Rose, S. A.; Tan, N.; Leek, J. P.; Markham, A. F.; Robinson, P. A.: Genomic organization of the human ubiquitin-conjugating enzyme gene, UBE2L6 on chromosome 11q12. Cytogenet. Cell Genet. 89:137-140, 2000; and Kumar, S.; Kao, W. H.; Howley, P. M.: Physical interaction between specific E2 and Hect E3 enzymes determines functional cooperativity. J. Biol. Chem. 272:13548-13554, 1997.

Further studies establishing the function and utilities of UBE2L6 are found in John Hopkins OMIM database record ID 603890, and in sited publications numbered 7630-7631 listed in the bibliography section hereinbelow, which are also hereby incorporated by reference. Vacuolar Protein Sorting 41 (yeast) (VPS41, Accession NM_014396) is another VGAM1059 host target gene. VPS41 BINDING SITE is HOST TARGET binding site found in the 3' untranslated region of mRNA encoded by VPS41, corresponding to a HOST TARGET binding site such as BINDING SITE I, BINDING SITE II or BINDING SITE III. Table 2 illustrates the complementarity of the nucleotide sequences of VPS41 BINDING SITE, designated SEQ ID:15738, to the nucleotide sequence of VGAM1059 RNA, herein designated VGAM RNA, also designated SEQ ID:3770.

Another function of VGAM1059 is therefore inhibition of Vacuolar Protein Sorting 41 (yeast) (VPS41, Accession NM_014396). Accordingly, utilities of VGAM1059 include diagnosis, prevention and treatment of diseases and clinical conditions associated with VPS41. BC022889 (Accession XM_096964) is another VGAM1059 host target gene. BC022889 BINDING SITE is HOST TARGET binding site found in the 3' untranslated region of mRNA encoded by BC022889, corresponding to a HOST TARGET binding site such as BINDING SITE I, BINDING SITE II or BINDING SITE III. Table 2 illustrates the complementarity of the nucleotide sequences of BC022889 BINDING SITE, designated SEQ ID:40683, to the nucleotide sequence of VGAM1059 RNA, herein designated VGAM RNA, also designated SEQ ID:3770.

Another function of VGAM1059 is therefore inhibition of BC022889 (Accession XM_096964). Accordingly, utilities of VGAM1059 include diagnosis, prevention and treatment of diseases and clinical conditions associated with BC022889. DKFZP434P0111 (Accession XM_041116) is another VGAM1059 host target gene. DKFZP434P0111 BINDING SITE is HOST TARGET binding site found in the 3' untranslated region of mRNA encoded by DKFZP434P0111, corresponding to a HOST TARGET binding site such as BINDING SITE I, BINDING SITE II or BINDING SITE III. Table 2 illustrates the complementarity of the nucleotide sequences of DKFZP434P0111 BINDING SITE, designated SEQ ID:33455, to the nucleotide sequence of VGAM1059 RNA, herein designated VGAM RNA, also designated SEQ ID:3770.

Another function of VGAM1059 is therefore inhibition of DKFZP434P0111 (Accession XM_041116). Accordingly, utilities of VGAM1059 include diagnosis, prevention and treatment of diseases and clinical conditions associated with DKFZP434P0111. F-box Only Protein 9 (FBXO9, Accession NM_033480) is another VGAM1059 host target gene. FBXO9 BINDING SITE is HOST TARGET binding site found in the 5' untranslated region of mRNA encoded by FBXO9, corresponding to a HOST TARGET binding site such as BINDING SITE I, BINDING SITE II or BINDING SITE III. Table 2 illustrates the complementarity of the nucleotide sequences of FBXO9 BINDING SITE, designated SEQ ID:27256, to the nucleotide sequence of VGAM1059 RNA, herein designated VGAM RNA, also designated SEQ ID:3770.

Another function of VGAM1059 is therefore inhibition of F-box Only Protein 9 (FBXO9, Accession NM_033480). Accordingly, utilities of VGAM1059 include diagnosis, prevention and treatment of diseases and clinical conditions associated with FBXO9. FLJ00001 (Accession XM_088525) is another VGAM1059 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39787, to the nucleotide sequence of VGAM1059 RNA, herein designated VGAM RNA, also designated SEQ ID:3770.

Another function of VGAM1059 is therefore inhibition of FLJ00001 (Accession XM_088525). Accordingly, utilities of VGAM1059 include diagnosis, prevention and treatment of diseases and clinical conditions associated with FLJ00001. FLJ10420 (Accession NM_018090) is another VGAM1059 host target gene. FLJ10420 BINDING SITE is HOST TARGET binding site found in the 3' untranslated region of mRNA encoded by FLJ10420, corresponding to a HOST TARGET binding site such as BINDING SITE I, BINDING SITE II or BINDING SITE III. Table 2 illustrates the complementarity of the nucleotide sequences of FLJ10420 BINDING SITE, designated SEQ ID:19857, to the nucleotide sequence of VGAM1059 RNA, herein designated VGAM RNA, also designated SEQ ID:3770.

Another function of VGAM1059 is therefore inhibition of FLJ10420 (Accession NM_018090). Accordingly, utilities of VGAM1059 include diagnosis, prevention and treatment of diseases and clinical conditions associated with FLJ10420. FLJ11175 (Accession NM_018349) is another VGAM1059 host target gene. FLJ11175 BINDING SITE is HOST TARGET binding site found in the 3' untranslated region of mRNA encoded by FLJ11175, corresponding to a HOST TARGET binding site such as BINDING SITE I, BINDING SITE II or BINDING SITE III. Table 2 illustrates the complementarity of the nucleotide sequences of FLJ11175 BINDING SITE, designated SEQ ID:20362, to the nucleotide sequence of VGAM1059 RNA, herein designated VGAM RNA, also designated SEQ ID:3770.

Another function of VGAM1059 is therefore inhibition of FLJ11175 (Accession NM_018349). Accordingly, utilities of VGAM1059 include diagnosis, prevention and treatment of diseases and clinical conditions associated with FLJ11175. FLJ12747 (Accession NM_032173) is another VGAM1059 host target gene. FLJ12747 BINDING SITE is HOST TARGET binding site found in the 5' untranslated region of mRNA encoded by FLJ12747, corresponding to a HOST TARGET binding site such as BINDING SITE I, BINDING SITE II or BINDING SITE III. Table 2 illustrates the complementarity of the nucleotide sequences of FLJ12747 BINDING SITE, designated SEQ ID:25879, to the nucleotide sequence of VGAM1059 RNA, herein designated VGAM RNA, also designated SEQ ID:3770.

Another function of VGAM1059 is therefore inhibition of FLJ12747 (Accession NM_032173). Accordingly, utilities of VGAM1059 include diagnosis, prevention and treatment of diseases and clinical conditions associated with FLJ12747. FLJ22679 (Accession NM_032227) is another VGAM1059 host target gene. FLJ22679 BINDING SITE is HOST TARGET binding site found in the 5' untranslated region of mRNA encoded by FLJ22679, corresponding to a HOST TARGET binding site such as BINDING SITE I, BINDING SITE II or BINDING SITE III. Table 2 illustrates the complementarity of the nucleotide sequences of FLJ22679 BINDING SITE, designated SEQ ID:25952, to the nucleotide sequence of VGAM1059 RNA, herein designated VGAM RNA, also designated SEQ ID:3770.

Another function of VGAM1059 is therefore inhibition of FLJ22679 (Accession NM_032227). Accordingly, utilities of VGAM1059 include diagnosis, prevention and treatment of diseases and clinical conditions associated with FLJ22679. GEMIN7 (Accession NM_024707) is another VGAM1059 host target gene. GEMIN7 BINDING SITE is HOST TARGET binding site found in the 3' untranslated region of mRNA encoded by GEMIN7, corresponding to a HOST TARGET binding site such as BINDING SITE I, BINDING SITE II or BINDING SITE III. Table 2 illustrates the complementarity of the nucleotide sequences of GEMIN7 BINDING SITE, designated SEQ ID:24023, to the nucleotide sequence of VGAM1059 RNA, herein designated VGAM RNA, also designated SEQ ID:3770.

Another function of VGAM1059 is therefore inhibition of GEMIN7 (Accession NM_024707). Accordingly, utilities of VGAM1059 include diagnosis, prevention and treatment of diseases and clinical conditions associated with GEMIN7. Hypermethylated In Cancer 2 (HIC2, Accession XM_036937) is another VGAM1059 host target gene. HIC2 BINDING SITE is HOST TARGET binding site found in the 3' untranslated region of mRNA encoded by HIC2, corresponding to a HOST TARGET binding site such as BINDING SITE I, BINDING SITE II or BINDING SITE III. Table 2 illustrates the complementarity of the nucleotide sequences of HIC2 BINDING SITE, designated SEQ ID:32528, to the nucleotide sequence of VGAM1059 RNA, herein designated VGAM RNA, also designated SEQ ID:3770.

Another function of VGAM1059 is therefore inhibition of Hypermethylated In Cancer 2 (HIC2, Accession XM_036937). Accordingly, utilities of VGAM1059 include diagnosis, prevention and treatment of diseases and clinical conditions associated with HIC2. KIAA0237 (Accession NM_014747) is another VGAM1059 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16455, to the nucleotide sequence of VGAM1059 RNA, herein designated VGAM RNA, also designated SEQ ID:3770.

Another function of VGAM1059 is therefore inhibition of KIAA0237 (Accession NM_014747). Accordingly, utilities of VGAM1059 include diagnosis, prevention and treatment of diseases and clinical conditions associated with KIAA0237. KIAA0459 (Accession XM_027862) is another VGAM1059 host target gene. KIAA0459 BINDING SITE is HOST TARGET binding site found in the 3' untranslated region of mRNA encoded by KIAA0459, corresponding to a HOST TARGET binding site such as BINDING SITE I, BINDING SITE II or BINDING SITE III. Table 2 illustrates the complementarity of the nucleotide sequences of KIAA0459 BINDING SITE, designated SEQ ID:30579, to the nucleotide sequence of VGAM1059 RNA, herein designated VGAM RNA, also designated SEQ ID:3770.

Another function of VGAM1059 is therefore inhibition of KIAA0459 (Accession XM_027862). Accordingly, utilities of VGAM1059 include diagnosis, prevention and treatment of diseases and clinical conditions associated with KIAA0459. KIAA0493 (Accession XM_034717) is another VGAM1059 host target gene. KIAA0493 BINDING SITE is HOST TARGET binding site found in the 3' untranslated region of mRNA encoded by KIAA0493, corresponding to a HOST TARGET binding site such as BINDING SITE I, BINDING SITE II or BINDING SITE III. Table 2 illustrates the complementarity of the nucleotide sequences of KIAA0493 BINDING SITE, designated SEQ ID:32144, to the nucleotide sequence of VGAM1059 RNA, herein designated VGAM RNA, also designated SEQ ID:3770.

Another function of VGAM1059 is therefore inhibition of KIAA0493 (Accession XM_034717). Accordingly, utilities of VGAM1059 include diagnosis, prevention and treatment of diseases and clinical conditions associated with KIAA0493. KIAA0682 (Accession NM_014852) is another VGAM1059 host target gene. KIAA0682 BINDING SITE is HOST TARGET binding site found in the 3' untranslated region of mRNA encoded by KIAA0682, corresponding to a HOST TARGET binding site such as BINDING SITE I, BINDING SITE II or BINDING SITE III. Table 2 illustrates the complementarity of the nucleotide sequences of KIAA0682 BINDING SITE, designated SEQ ID:16903, to the nucleotide sequence of VGAM1059 RNA, herein designated VGAM RNA, also designated SEQ ID:3770.

Another function of VGAM1059 is therefore inhibition of KIAA0682 (Accession NM_014852). Accordingly, utilities of VGAM1059 include diagnosis, prevention and treatment of diseases and clinical conditions associated with KIAA0682. KIAA0763 (Accession NM_014869) is another VGAM1059 host target gene. KIAA0763 BINDING SITE is HOST TARGET binding site found in the 3' untranslated region of mRNA encoded by KIAA0763, corresponding to a HOST TARGET binding site such as BINDING SITE I, BINDING SITE II or BINDING SITE III. Table 2 illustrates the complementarity of the nucleotide sequences of KIAA0763 BINDING SITE, designated SEQ ID:16968, to the nucleotide sequence of VGAM1059 RNA, herein designated VGAM RNA, also designated SEQ ID:3770.

Another function of VGAM1059 is therefore inhibition of KIAA0763 (Accession NM_014869). Accordingly, utilities of VGAM1059 include diagnosis, prevention and treatment of diseases and clinical conditions associated with KIAA0763. KIAA1463 (Accession XM_051160) is another VGAM1059 host target gene. KIAA1463 BINDING SITE is HOST TARGET binding site found in the 3' untranslated region of mRNA encoded by KIAA1463, corresponding to a HOST TARGET binding site such as BINDING SITE I, BINDING SITE II or BINDING SITE III. Table 2 illustrates the complementarity of the nucleotide sequences of KIAA1463 BINDING SITE, designated SEQ ID:35773, to the nucleotide sequence of VGAM1059 RNA, herein designated VGAM RNA, also designated SEQ ID:3770.

Another function of VGAM1059 is therefore inhibition of KIAA1463 (Accession XM_051160). Accordingly, utilities of VGAM1059 include diagnosis, prevention and treatment of diseases and clinical conditions associated with KIAA1463. Lysyl Oxidase-like 4 (LOXL4, Accession NM_032211) is another VGAM1059 host target gene. LOXL4 BINDING SITE is HOST TARGET binding site found in the 3' untranslated region of mRNA encoded by LOXL4, corresponding to a HOST TARGET binding site such as BINDING SITE I, BINDING SITE II or BINDING SITE III. Table 2 illustrates the complementarity of the nucleotide sequences of LOXL4 BINDING SITE, designated SEQ ID:25926, to the nucleotide sequence of VGAM1059 RNA, herein designated VGAM RNA, also designated SEQ ID:3770.

Another function of VGAM1059 is therefore inhibition of Lysyl Oxidase-like 4 (LOXL4, Accession NM_032211). Accordingly, utilities of VGAM1059 include diagnosis, prevention and treatment of diseases and clinical conditions associated with LOXL4. MBLL39 (Accession NM_144778) is another VGAM1059 host target gene. MBLL39 BINDING SITE is HOST TARGET binding site found in the 3' untranslated region of mRNA encoded by MBLL39, corresponding to a HOST TARGET binding site such as BINDING SITE I, BINDING SITE II or BINDING SITE III. Table 2 illustrates the complementarity of the nucleotide sequences of MBLL39 BINDING SITE, designated SEQ ID:29575, to the nucleotide sequence of VGAM1059 RNA, herein designated VGAM RNA, also designated SEQ ID:3770.

Another function of VGAM1059 is therefore inhibition of MBLL39 (Accession NM_144778). Accordingly, utilities of VGAM1059 include diagnosis, prevention and treatment of diseases and clinical conditions associated with MBLL39. PP2447 (Accession NM_025204) is another VGAM1059 host target gene. PP2447 BINDING SITE is HOST TARGET binding site found in the 5' untranslated region of mRNA encoded by PP2447, corresponding to a HOST TARGET binding site such as BINDING SITE I, BINDING SITE II or BINDING SITE III. Table 2 illustrates the complementarity of the nucleotide sequences of PP2447 BINDING SITE, designated SEQ ID:24870, to the nucleotide sequence of VGAM1059 RNA, herein designated VGAM RNA, also designated SEQ ID:3770.

Another function of VGAM1059 is therefore inhibition of PP2447 (Accession NM_025204). Accordingly, utilities of VGAM1059 include diagnosis, prevention and treatment of diseases and clinical conditions associated with PP2447. PRO1331 (Accession NM_030778) is another VGAM1059 host target gene. PRO1331 BINDING SITE is HOST TARGET binding site found in the 3' untranslated region of mRNA encoded by PRO1331, corresponding to a HOST TARGET binding site such as BINDING SITE I, BINDING SITE II or BINDING SITE III. Table 2 illustrates the complementarity of the nucleotide sequences of PRO1331 BINDING SITE, designated SEQ ID:25068, to the nucleotide sequence of VGAM1059 RNA, herein designated VGAM RNA, also designated SEQ ID:3770.

Another function of VGAM1059 is therefore inhibition of PRO1331 (Accession NM_030778). Accordingly, utilities of VGAM1059 include diagnosis, prevention and treatment of diseases and clinical conditions associated with PRO1331. Ribosomal Protein S6 Kinase, 90 kDa, Polypeptide 4 (RPS6KA4, Accession NM_003942) is another VGAM1059 host target gene. RPS6KA4 BINDING SITE is HOST TARGET binding site found in the 3' untranslated region of mRNA encoded by RPS6KA4, corresponding to a HOST TARGET binding site such as BINDING SITE I, BINDING SITE II or BINDING SITE III. Table 2 illustrates the complementarity of the nucleotide sequences of RPS6KA4 BINDING SITE, designated SEQ ID:10055, to the nucleotide sequence of VGAM1059 RNA, herein designated VGAM RNA, also designated SEQ ID:3770.

Another function of VGAM1059 is therefore inhibition of Ribosomal Protein S6 Kinase, 90 kDa, Polypeptide 4 (RPS6KA4, Accession NM_003942). Accordingly, utilities of VGAM1059 include diagnosis, prevention and treatment of diseases and clinical conditions associated with RPS6KA4. SCYD1 (Accession XM_165650) is another VGAM1059 host target gene. SCYD1 BINDING SITE is HOST TARGET binding site found in the 3' untranslated region of mRNA encoded by SCYD1, corresponding to a HOST TARGET binding site such as BINDING SITE I, BINDING SITE II or BINDING SITE III. Table 2 illustrates the complementarity of the nucleotide sequences of SCYD1 BINDING SITE, designated SEQ ID:43707, to the nucleotide sequence of VGAM1059 RNA, herein designated VGAM RNA, also designated SEQ ID:3770.

Another function of VGAM1059 is therefore inhibition of SCYD1 (Accession XM_165650). Accordingly, utilities of VGAM1059 include diagnosis, prevention and treatment of diseases and clinical conditions associated with SCYD1. SPARC-like 1 (mast9, hevin) (SPARCL1, Accession NM_004684) is another VGAM1059 host target gene. SPARCL1 BINDING SITE is HOST TARGET binding site found in the 5' untranslated region of mRNA encoded by SPARCL1, corresponding to a HOST TARGET binding site such as BINDING SITE I, BINDING SITE II or BINDING SITE III. Table 2 illustrates the complementarity of the nucleotide sequences of SPARCL1 BINDING SITE, designated SEQ ID:11046, to the nucleotide sequence of VGAM1059 RNA, herein designated VGAM RNA, also designated SEQ ID:3770.

Another function of VGAM1059 is therefore inhibition of SPARC-like 1 (mast9, hevin) (SPARCL1, Accession NM_004684). Accordingly, utilities of VGAM1059 include diagnosis, prevention and treatment of diseases and clinical conditions associated with SPARCL1. Triple Homeobox 1 (TIX1, Accession XM_029734) is another VGAM1059 host target gene. TIX1 BINDING SITE is HOST TARGET binding site found in the 3' untranslated region of mRNA encoded by TIX1, corresponding to a HOST TARGET binding site such as BINDING SITE I, BINDING SITE II or BINDING SITE III. Table 2 illustrates the complementarity of the nucleotide sequences of TIX1 BINDING SITE, designated SEQ ID:30931, to the nucleotide sequence of VGAM1059 RNA, herein designated VGAM RNA, also designated SEQ ID:3770.

Another function of VGAM1059 is therefore inhibition of Triple Homeobox 1 (TIX1, Accession XM_029734). Accordingly, utilities of VGAM1059 include diagnosis, prevention and treatment of diseases and clinical conditions associated with TIX1. TNF Receptor-associated Factor 3 (TRAF3, Accession XM_007256) is another VGAM1059 host target gene. TRAF3 BINDING SITE is HOST TARGET binding site found in the 3' untranslated region of mRNA encoded by TRAF3, corresponding to a HOST TARGET binding site such as BINDING SITE I, BINDING SITE II or BINDING SITE III. Table 2 illustrates the complementarity of the nucleotide sequences of TRAF3 BINDING SITE, designated SEQ ID:30044, to the nucleotide sequence of VGAM1059 RNA, herein designated VGAM RNA, also designated SEQ ID:3770.

Another function of VGAM1059 is therefore inhibition of TNF Receptor-associated Factor 3 (TRAF3, Accession XM_007256). Accordingly, utilities of VGAM1059 include diagnosis, prevention and treatment of diseases and clinical conditions associated with TRAF3. LOC115219 (Accession XM_055499) is another VGAM1059 host target gene. LOC115219 BINDING SITE is HOST TARGET binding site found in the 3' untranslated region of mRNA encoded by LOC115219, corresponding to a HOST TARGET binding site such as BINDING SITE I, BINDING SITE II or BINDING SITE III. Table 2 illustrates the complementarity of the nucleotide sequences of LOC115219 BINDING SITE, designated SEQ ID:36278, to the nucleotide sequence of VGAM1059 RNA, herein designated VGAM RNA, also designated SEQ ID:3770.

Another function of VGAM1059 is therefore inhibition of LOC115219 (Accession XM_055499). Accordingly, utilities of VGAM1059 include diagnosis, prevention and treatment of diseases and clinical conditions associated with LOC115219. LOC133418 (Accession XM_059649) is another VGAM1059 host target gene. LOC133418 BINDING SITE is HOST TARGET binding site found in the 5' untranslated region of mRNA encoded by LOC133418, corresponding to a HOST TARGET binding site such as BINDING SITE I, BINDING SITE II or BINDING SITE III. Table 2 illustrates the complementarity of the nucleotide sequences of LOC133418 BINDING SITE, designated SEQ ID:37039, to the nucleotide sequence of VGAM1059 RNA, herein designated VGAM RNA, also designated SEQ ID:3770.

Another function of VGAM1059 is therefore inhibition of LOC133418 (Accession XM_059649). Accordingly, utilities of VGAM1059 include diagnosis, prevention and treatment of diseases and clinical conditions associated with LOC133418. LOC143173 (Accession XM_016685) is another VGAM1059 host target gene. LOC143173 BINDING SITE is HOST TARGET binding site found in the 5' untranslated region of mRNA encoded by LOC143173, corresponding to a HOST TARGET binding site such as BINDING SITE I, BINDING SITE II or BINDING SITE III. Table 2 illustrates the complementarity of the nucleotide sequences of LOC143173 BINDING SITE, designated SEQ ID:30273, to the nucleotide sequence of VGAM1059 RNA, herein designated VGAM RNA, also designated SEQ ID:3770.

Another function of VGAM1059 is therefore inhibition of LOC143173 (Accession XM_016685). Accordingly, utilities of VGAM1059 include diagnosis, prevention and treatment of diseases and clinical conditions associated with LOC143173. LOC149837 (Accession XM_097747) is another VGAM1059 host target gene. LOC149837 BINDING SITE is HOST TARGET binding site found in the 5' untranslated region of mRNA encoded by LOC149837, corresponding to a HOST TARGET binding site such as BINDING SITE I, BINDING SITE II or BINDING SITE III. Table 2 illustrates the complementarity of the nucleotide sequences of LOC149837 BINDING SITE, designated SEQ ID:41102, to the nucleotide sequence of VGAM1059 RNA, herein designated VGAM RNA, also designated SEQ ID:3770.

Another function of VGAM1059 is therefore inhibition of LOC149837 (Accession XM_097747). Accordingly, utilities of VGAM1059 include diagnosis, prevention and treatment of diseases and clinical conditions associated with LOC149837. LOC150271 (Accession XM_097859) is another VGAM1059 host target gene. LOC150271 BINDING SITE is HOST TARGET binding site found in the 5' untranslated region of mRNA encoded by LOC150271, corresponding to a HOST TARGET binding site such as BINDING SITE I, BINDING SITE II or BINDING SITE III. Table 2 illustrates the complementarity of the nucleotide sequences of LOC150271 BINDING SITE, designated SEQ ID:41169, to the nucleotide sequence of VGAM1059 RNA, herein designated VGAM RNA, also designated SEQ ID:3770.

Another function of VGAM1059 is therefore inhibition of LOC150271 (Accession XM_097859). Accordingly, utilities of VGAM1059 include diagnosis, prevention and treatment of diseases and clinical conditions associated with LOC150271. LOC151318 (Accession XM_087170) is another VGAM1059 host target gene. LOC151318 BINDING SITE is HOST TARGET binding site found in the 3' untranslated region of mRNA encoded by LOC151318, corresponding to a HOST TARGET binding site such as BINDING SITE I, BINDING SITE II or BINDING SITE III. Table 2 illustrates the complementarity of the nucleotide sequences of LOC151318 BINDING SITE, designated SEQ ID:39105, to the nucleotide sequence of VGAM1059 RNA, herein designated VGAM RNA, also designated SEQ ID:3770.

Another function of VGAM1059 is therefore inhibition of LOC151318 (Accession XM_087170). Accordingly, utilities of VGAM1059 include diagnosis, prevention and treatment of diseases and clinical conditions associated with LOC151318. LOC158987 (Accession XM_099015) is another VGAM1059 host target gene. LOC158987 BINDING SITE is HOST TARGET binding site found in the 3' untranslated region of mRNA encoded by LOC158987, corresponding to a HOST TARGET binding site such as BINDING SITE I, BINDING SITE II or BINDING SITE III. Table 2 illustrates the complementarity of the nucleotide sequences of LOC158987 BINDING SITE, designated SEQ ID:42050, to the nucleotide sequence of VGAM1059 RNA, herein designated VGAM RNA, also designated SEQ ID:3770.

Another function of VGAM1059 is therefore inhibition of LOC158987 (Accession XM_099015). Accordingly, utilities of VGAM1059 include diagnosis, prevention and treatment of diseases and clinical conditions associated with LOC158987. LOC220954 (Accession XM_167628) is another VGAM1059 host target gene. LOC220954 BINDING SITE is HOST TARGET binding site found in the 5' untranslated region of mRNA encoded by LOC220954, corresponding to a HOST TARGET binding site such as BINDING SITE I, BINDING SITE II or BINDING SITE III. Table 2 illustrates the complementarity of the nucleotide sequences of LOC220954 BINDING SITE, designated SEQ ID:44737, to the nucleotide sequence of VGAM1059 RNA, herein designated VGAM RNA, also designated SEQ ID:3770.

Another function of VGAM1059 is therefore inhibition of LOC220954 (Accession XM_167628). Accordingly, utilities of VGAM1059 include diagnosis, prevention and treatment of diseases and clinical conditions associated with LOC220954. LOC254532 (Accession XM_172961) is another VGAM1059 host target gene. LOC254532 BINDING SITE is HOST TARGET binding site found in the 3' untranslated region of mRNA encoded by LOC254532, corresponding to a HOST TARGET binding site such as BINDING SITE I, BINDING SITE II or BINDING SITE III. Table 2 illustrates the complementarity of the nucleotide sequences of LOC254532 BINDING SITE, designated SEQ ID:46209, to the nucleotide sequence of VGAM1059 RNA, herein designated VGAM RNA, also designated SEQ ID:3770.

Another function of VGAM1059 is therefore inhibition of LOC254532 (Accession XM_172961). Accordingly, utilities of VGAM1059 include diagnosis, prevention and treatment of diseases and clinical conditions associated with LOC254532. LOC255598 (Accession XM_173715) is another VGAM1059 host target gene. LOC255598 BINDING SITE is HOST TARGET binding site found in the 5' untranslated region of mRNA encoded by LOC255598, corresponding to a HOST TARGET binding site such as BINDING SITE I, BINDING SITE II or BINDING SITE III. Table 2 illustrates the complementarity of the nucleotide sequences of LOC255598 BINDING SITE, designated SEQ ID:46559, to the nucleotide sequence of VGAM1059 RNA, herein designated VGAM RNA, also designated SEQ ID:3770.

Another function of VGAM1059 is therefore inhibition of LOC255598 (Accession XM_173715). Accordingly, utilities of VGAM1059 include diagnosis, prevention and treatment of diseases and clinical conditions associated with LOC255598. FIG. 1 further provides a conceptual description of a novel bioinformatically detected viral gene of the present invention, referred to here as Viral Genomic Address Messenger 1060 (VGAM1060) viral gene, which modulates expression of respective host target genes thereof, the function and utility of which host target genes is known in the art.

VGAM1060 is a novel bioinformatically detected regulatory, non protein coding, viral micro RNA (miRNA) gene. The method by which VGAM1060 was detected is described hereinabove with reference to FIGS. 1-8.

VGAM1060 gene, herein designated VGAM GENE, is a viral gene contained in the genome of Potato Mop-top Virus. VGAM1060 host target gene, herein designated VGAM HOST TARGET GENE, is a human gene contained in the human genome.

VGAM1060 gene encodes a VGAM1060 precursor RNA, herein designated VGAM PRECURSOR RNA. Similar to other miRNA genes, and unlike most ordinary genes, VGAM1060 precursor RNA does not encode a protein. A nucleotide sequence identical or highly similar to the nucleotide sequence of VGAM1060 precursor RNA is designated SEQ ID:1046, and is provided hereinbelow with reference to the sequence listing part. Nucleotide sequence SEQ ID:1046 is located at position 2755 relative to the genome of Potato Mop-top Virus.

VGAM1060 precursor RNA folds onto itself, forming VGAM1060 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1060 folded precursor RNA into VGAM1060 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1060 RNA is designated SEQ ID:3771, and is provided hereinbelow with reference to the sequence listing part.

VGAM1060 host target gene, herein designated VGAM HOST TARGET GENE, encodes a corresponding messenger RNA, VGAM1060 host target RNA, herein designated VGAM HOST TARGET RNA. VGAM1060 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1060 RNA, herein designated VGAM RNA, binds complementarily to one or more host target binding sites located in untranslated regions of VGAM1060 host target RNA, herein designated VGAM HOST TARGET RNA. This complementary binding is due to the fact that the nucleotide sequence of VGAM1060 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1060 RNA, herein designated VGAM RNA, may have a different number of host target binding sites in untranslated regions of a VGAM1060 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1060 RNA, herein designated VGAM RNA, to host target binding sites on VGAM1060 host target RNA, herein designated VGAM HOST TARGET RNA, such as BINDING SITE I, BINDING SITE II and BINDING SITE III, inhibits translation of VGAM1060 host target RNA into VGAM1060 host target protein, herein designated VGAM HOST TARGET PROTEIN. VGAM host target protein is therefore outlined by a broken line.

It is appreciated that VGAM1060 host target gene, herein designated VGAM HOST TARGET GENE, in fact represents a plurality of VGAM1060 host target genes. The mRNA of each one of this plurality of VGAM1060 host target genes comprises one or more host target binding sites, each having a nucleotide sequence which is at least partly complementary to VGAM1060 RNA, herein designated VGAM RNA, and which when bound by VGAM1060 RNA causes inhibition of translation of respective one or more VGAM1060 host target proteins.

It is further appreciated by one skilled in the art that the mode of translational inhibition illustrated by FIG. 1 with specific reference to translational inhibition exerted by VGAM1060 gene, herein designated VGAM GENE, on one or more VGAM1060 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1060 is inhibition of expression of host target genes, as part of a novel viral mechanism of attacking a host. Accordingly, utilities of VGAM1060 include diagnosis, prevention and treatment of viral infection by Potato Mop-top Virus. Specific functions, and accordingly utilities, of VGAM1060 correlate with, and may be deduced from, the identity of the host target genes which VGAM1060 binds and inhibits, and the function of these host target genes, as elaborated hereinbelow.

Nucleotide sequences of the VGAM1060 precursor RNA, herein designated VGAM PRECURSOR RNA, and of the 'diced' VGAM1060 RNA, herein designated VGAM RNA, and a schematic representation of the secondary folding of VGAM1060 folded precursor RNA, herein designated VGAM FOLDED PRECURSOR RNA, of VGAM1060 are further described hereinbelow with reference to Table 1.

Nucleotide sequences of host target binding sites, such as BINDING SITE-I, BINDING SITE-II and BINDING SITE-III of FIG. 1, found on VGAM1060 host target RNA, and schematic representation of the complementarity of each of these host target binding sites to VGAM1060 RNA, herein designated VGAM RNA, are described hereinbelow with reference to Table 2.

As mentioned hereinabove with reference to FIG. 1, a function of VGAM1060 gene, herein designated VGAM is inhibition of expression of VGAM1060 target genes. It is appreciated that specific functions, and accordingly utilities, of VGAM1060 correlate with, and may be deduced from, the identity of the target genes which VGAM1060 binds and inhibits, and the function of these target genes, as elaborated hereinbelow.

Protocadherin Alpha 1 (PCDHA1, Accession NM_031411) is a VGAM1060 host target gene. PCDHA1 BINDING SITE1 and PCDHA1 BINDING SITE2 are HOST TARGET binding sites found in untranslated regions of mRNA encoded by PCDHA1, corresponding to HOST TARGET binding sites such as BINDING SITE I, BINDING SITE II or BINDING SITE III. Table 2 illustrates the complementarity of the nucleotide sequences of PCDHA1 BINDING SITE1 and PCDHA1 BINDING SITE2, designated SEQ ID:25381 and SEQ ID:20862 respectively, to the nucleotide sequence of VGAM1060 RNA, herein designated VGAM RNA, also designated SEQ ID:3771.

A function of VGAM1060 is therefore inhibition of Protocadherin Alpha 1 (PCDHA1, Accession NM_031411). Accordingly, utilities of VGAM1060 include diagnosis, prevention and treatment of diseases and clinical conditions associated with PCDHA1. Protocadherin Alpha 10 (PCDHA10, Accession NM_031860) is another VGAM1060 host target gene. PCDHA10 BINDING SITE1 and PCDHA10 BINDING SITE2 are HOST TARGET binding sites found in untranslated regions of mRNA encoded by PCDHA10, corresponding to HOST TARGET binding sites such as BINDING SITE I, BINDING SITE II or BINDING SITE III. Table 2 illustrates the complementarity of the nucleotide sequences of PCDHA10 BINDING SITE1 and PCDHA10 BINDING SITE2, designated SEQ ID:25613 and SEQ ID:20882 respectively, to the nucleotide sequence of VGAM1060 RNA, herein designated VGAM RNA, also designated SEQ ID:3771.

Another function of VGAM1060 is therefore inhibition of Protocadherin Alpha 10 (PCDHA10, Accession NM_031860). Accordingly, utilities of VGAM1060 include diagnosis, prevention and treatment of diseases and clinical conditions associated with PCDHA10. Protocadherin Alpha 13 (PCDHA13, Accession NM_018904) is another VGAM1060 host target gene. PCDHA13 BINDING SITE is HOST TARGET binding site found in the 3' untranslated region of mRNA encoded by PCDHA13, corresponding to a HOST TARGET binding site such as BINDING SITE I, BINDING SITE II or BINDING SITE III. Table 2 illustrates the complementarity of the nucleotide sequences of PCDHA13 BINDING SITE, designated SEQ ID:20903, to the nucleotide sequence of VGAM1060 RNA, herein designated VGAM RNA, also designated SEQ ID:3771.

Another function of VGAM1060 is therefore inhibition of Protocadherin Alpha 13 (PCDHA13, Accession NM_018904). Accordingly, utilities of VGAM1060 include diagnosis, prevention and treatment of diseases and clinical conditions associated with PCDHA13. Protocadherin Alpha 2 (PCDHA2, Accession NM_018905) is another VGAM1060 host target gene. PCDHA2 BINDING SITE is HOST TARGET binding site found in the 3' untranslated region of mRNA encoded by PCDHA2, corresponding to a HOST TARGET binding site such as BINDING SITE I, BINDING SITE II or BINDING SITE III. Table 2 illustrates the complementarity of the nucleotide sequences of PCDHA2 BINDING SITE, designated SEQ ID:20913, to the nucleotide sequence of VGAM1060 RNA, herein designated VGAM RNA, also designated SEQ ID:3771.

Another function of VGAM1060 is therefore inhibition of Protocadherin Alpha 2 (PCDHA2, Accession NM_018905). Accordingly, utilities of VGAM1060 include diagnosis, prevention and treatment of diseases and clinical conditions associated with PCDHA2. Protocadherin Alpha 3 (PCDHA3, Accession NM_018906) is another VGAM1060 host target gene. PCDHA3 BINDING SITE is HOST TARGET binding site found in the 3' untranslated region of mRNA encoded by PCDHA3, corresponding to a HOST TARGET binding site such as BINDING SITE I, BINDING SITE II or BINDING SITE III. Table 2 illustrates the complementarity of the nucleotide sequences of PCDHA3 BINDING SITE, designated SEQ ID:20923, to the nucleotide sequence of VGAM1060 RNA, herein designated VGAM RNA, also designated SEQ ID:3771.

Another function of VGAM1060 is therefore inhibition of Protocadherin Alpha 3 (PCDHA3, Accession NM_018906). Accordingly, utilities of VGAM1060 include diagnosis, prevention and treatment of diseases and clinical conditions associated with PCDHA3. Protocadherin Alpha 4 (PCDHA4, Accession NM_018907) is another VGAM1060 host target gene. PCDHA4 BINDING SITE is HOST TARGET binding site found in the 3' untranslated region of mRNA encoded by PCDHA4, corresponding to a HOST TARGET binding site such as BINDING SITE I, BINDING SITE II or BINDING SITE III. Table 2 illustrates the complementarity of the nucleotide sequences of PCDHA4 BINDING SITE, designated SEQ ID:20933, to the nucleotide sequence of VGAM1060 RNA, herein designated VGAM RNA, also designated SEQ ID:3771.

Another function of VGAM1060 is therefore inhibition of Protocadherin Alpha 4 (PCDHA4, Accession NM_018907). Accordingly, utilities of VGAM1060 include diagnosis, prevention and treatment of diseases and clinical conditions associated with PCDHA4. Protocadherin Alpha 5 (PCDHA5, Accession NM_018908) is another VGAM1060 host target gene. PCDHA5 BINDING SITE is HOST TARGET binding site found in the 3' untranslated region of mRNA encoded by PCDHA5, corresponding to a HOST TARGET binding site such as BINDING SITE I, BINDING SITE II or BINDING SITE III. Table 2 illustrates the complementarity of the nucleotide sequences of PCDHA5 BINDING SITE, designated SEQ ID:20943, to the nucleotide sequence of VGAM1060 RNA, herein designated VGAM RNA, also designated SEQ ID:3771.

Another function of VGAM1060 is therefore inhibition of Protocadherin Alpha 5 (PCDHA5, Accession NM_018908). Accordingly, utilities of VGAM1060 include diagnosis, prevention and treatment of diseases and clinical conditions associated with PCDHA5. Protocadherin Alpha 6 (PCDHA6, Accession NM_018909) is another VGAM1060 host target gene. PCDHA6 BINDING SITE1 and PCDHA6 BINDING SITE2 are HOST TARGET binding sites found in untranslated regions of mRNA encoded by PCDHA6, corresponding to HOST TARGET binding sites such as BINDING SITE I, BINDING SITE II or BINDING SITE III. Table 2 illustrates the complementarity of the nucleotide sequences of PCDHA6 BINDING SITE1 and PCDHA6 BINDING SITE2, designated SEQ ID:20953 and SEQ ID:25585 respectively, to the nucleotide sequence of VGAM1060 RNA, herein designated VGAM RNA, also designated SEQ ID:3771.

Another function of VGAM1060 is therefore inhibition of Protocadherin Alpha 6 (PCDHA6, Accession NM_018909). Accordingly, utilities of VGAM1060 include diagnosis, prevention and treatment of diseases and clinical conditions associated with PCDHA6. Protocadherin Alpha 8 (PCDHA8, Accession NM_018911) is another VGAM1060 host target gene. PCDHA8 BINDING SITE is HOST TARGET binding site found in the 3' untranslated region of mRNA encoded by PCDHA8, corresponding to a HOST TARGET binding site such as BINDING SITE I, BINDING SITE II or BINDING SITE III. Table 2 illustrates the complementarity of the nucleotide sequences of PCDHA8 BINDING SITE, designated SEQ ID:20973, to the nucleotide sequence of VGAM1060 RNA, herein designated VGAM RNA, also designated SEQ ID:3771.

Another function of VGAM1060 is therefore inhibition of Protocadherin Alpha 8 (PCDHA8, Accession NM_018911). Accordingly, utilities of VGAM1060 include diagnosis, prevention and treatment of diseases and clinical conditions associated with PCDHA8. Protocadherin Alpha 9 (PCDHA9, Accession NM_031857) is another VGAM1060 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:25598, to the nucleotide sequence of VGAM1060 RNA, herein designated VGAM RNA, also designated SEQ ID:3771.

Another function of VGAM1060 is therefore inhibition of Protocadherin Alpha 9 (PCDHA9, Accession NM_031857), a gene which is a calcium-dependent cell-adhesion protein. Accordingly, utilities of VGAM1060 include diagnosis, prevention and treatment of diseases and clinical conditions associated with PCDHA9. The function of PCDHA9 and its association with various diseases and clinical conditions, has been established by previous studies, as described hereinabove with reference to VGAM71. Protocadherin Alpha Subfamily C, 1 (PCDHAC1, Accession NM_018898) is another VGAM1060 host target gene. PCDHAC1 BINDING SITE is HOST TARGET binding site found in the 3' untranslated region of mRNA encoded by PCDHAC1, corresponding to a HOST TARGET binding site such as BINDING SITE I, BINDING SITE II or BINDING SITE III. Table 2 illustrates the complementarity of the nucleotide sequences of PCDHAC1 BINDING SITE, designated SEQ ID:20842, to the nucleotide sequence of VGAM1060 RNA, herein designated VGAM RNA, also designated SEQ ID:3771.

Another function of VGAM1060 is therefore inhibition of Protocadherin Alpha Subfamily C, 1 (PCDHAC1, Accession NM_018898). Accordingly, utilities of VGAM1060 include diagnosis, prevention and treatment of diseases and clinical conditions associated with PCDHAC1. Protocadherin Alpha Subfamily C, 2 (PCDHAC2, Accession NM_018899) is another VGAM1060 host target gene. PCDHAC2 BINDING SITE is HOST TARGET binding site found in the 3' untranslated region of mRNA encoded by PCDHAC2, corresponding to a HOST TARGET binding site such as BINDING SITE I, BINDING SITE II or BINDING SITE III. Table 2 illustrates the complementarity of the nucleotide sequences of PCDHAC2 BINDING SITE, designated SEQ ID:20852, to the nucleotide sequence of VGAM1060 RNA, herein designated VGAM RNA, also designated SEQ ID:3771.

Another function of VGAM1060 is therefore inhibition of Protocadherin Alpha Subfamily C, 2 (PCDHAC2, Accession NM_018899). Accordingly, utilities of VGAM1060 include diagnosis, prevention and treatment of diseases and clinical conditions associated with PCDHAC2. Replication Protein A2, 32 kDa (RPA2, Accession NM_002946) is another VGAM1060 host target gene. RPA2 BINDING SITE is HOST TARGET binding site found in the 3' untranslated region of mRNA encoded by RPA2, corresponding to a HOST TARGET binding site such as BINDING SITE I, BINDING SITE II or BINDING SITE III. Table 2 illustrates the complementarity of the nucleotide sequences of RPA2 BINDING SITE, designated SEQ ID:8857, to the nucleotide sequence of VGAM1060 RNA, herein designated VGAM RNA, also designated SEQ ID:3771.

Another function of VGAM1060 is therefore inhibition of Replication Protein A2, 32 kDa (RPA2, Accession NM_002946). Accordingly, utilities of VGAM1060 include diagnosis, prevention and treatment of diseases and clinical conditions associated with RPA2. FLJ20079 (Accession NM_017656) is another VGAM1060 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19168, to the nucleotide sequence of VGAM1060

RNA, herein designated VGAM RNA, also designated SEQ ID:3771.

Another function of VGAM1060 is therefore inhibition of FLJ20079 (Accession NM_017656). Accordingly, utilities of VGAM1060 include diagnosis, prevention and treatment of diseases and clinical conditions associated with FLJ20079. G-protein Coupled Receptor 88 (GPR88, Accession NM_022049) is another VGAM1060 host target gene. GPR88 BINDING SITE is HOST TARGET binding site found in the 3' untranslated region of mRNA encoded by GPR88, corresponding to a HOST TARGET binding site such as BINDING SITE I, BINDING SITE II or BINDING SITE III. Table 2 illustrates the complementarity of the nucleotide sequences of GPR88 BINDING SITE, designated SEQ ID:22574, to the nucleotide sequence of VGAM1060 RNA, herein designated VGAM RNA, also designated SEQ ID:3771.

Another function of VGAM1060 is therefore inhibition of G-protein Coupled Receptor 88 (GPR88, Accession NM_022049). Accordingly, utilities of VGAM1060 include diagnosis, prevention and treatment of diseases and clinical conditions associated with GPR88. LOC116064 (Accession XM_057296) is another VGAM1060 host target gene. LOC116064 BINDING SITE is HOST TARGET binding site found in the 3' untranslated region of mRNA encoded by LOC116064, corresponding to a HOST TARGET binding site such as BINDING SITE I, BINDING SITE II or BINDING SITE III. Table 2 illustrates the complementarity of the nucleotide sequences of LOC116064 BINDING SITE, designated SEQ ID:36498, to the nucleotide sequence of VGAM1060 RNA, herein designated VGAM RNA, also designated SEQ ID:3771.

Another function of VGAM1060 is therefore inhibition of LOC116064 (Accession XM_057296). Accordingly, utilities of VGAM1060 include diagnosis, prevention and treatment of diseases and clinical conditions associated with LOC116064. LOC168448 (Accession XM_095105) is another VGAM1060 host target gene. LOC168448 BINDING SITE is HOST TARGET binding site found in the 3' untranslated region of mRNA encoded by LOC168448, corresponding to a HOST TARGET binding site such as BINDING SITE I, BINDING SITE II or BINDING SITE III. Table 2 illustrates the complementarity of the nucleotide sequences of LOC168448 BINDING SITE, designated SEQ ID:40246, to the nucleotide sequence of VGAM1060 RNA, herein designated VGAM RNA, also designated SEQ ID:3771.

Another function of VGAM1060 is therefore inhibition of LOC168448 (Accession XM_095105). Accordingly, utilities of VGAM1060 include diagnosis, prevention and treatment of diseases and clinical conditions associated with LOC168448. LOC220477 (Accession XM_071675) is another VGAM1060 host target gene. LOC220477 BINDING SITE is HOST TARGET binding site found in the 5' untranslated region of mRNA encoded by LOC220477, corresponding to a HOST TARGET binding site such as BINDING SITE I, BINDING SITE II or BINDING SITE III. Table 2 illustrates the complementarity of the nucleotide sequences of LOC220477 BINDING SITE, designated SEQ ID:37411, to the nucleotide sequence of VGAM1060 RNA, herein designated VGAM RNA, also designated SEQ ID:3771.

Another function of VGAM1060 is therefore inhibition of LOC220477 (Accession XM_071675). Accordingly, utilities of VGAM1060 include diagnosis, prevention and treatment of diseases and clinical conditions associated with LOC220477. LOC83693 (Accession NM_031463) is another VGAM1060 host target gene. LOC83693 BINDING SITE is HOST TARGET binding site found in the 3' untranslated region of mRNA encoded by LOC83693, corresponding to a HOST TARGET binding site such as BINDING SITE I, BINDING SITE II or BINDING SITE III. Table 2 illustrates the complementarity of the nucleotide sequences of LOC83693 BINDING SITE, designated SEQ ID:25499, to the nucleotide sequence of VGAM1060 RNA, herein designated VGAM RNA, also designated SEQ ID:3771.

Another function of VGAM1060 is therefore inhibition of LOC83693 (Accession NM_031463). Accordingly, utilities of VGAM1060 include diagnosis, prevention and treatment of diseases and clinical conditions associated with LOC83693. FIG. 1 further provides a conceptual description of a novel bioinformatically detected viral gene of the present invention, referred to here as Viral Genomic Address Messenger 1061 (VGAM1061) viral gene, which modulates expression of respective host target genes thereof, the function and utility of which host target genes is known in the art.

VGAM1061 is a novel bioinformatically detected regulatory, non protein coding, viral micro RNA (miRNA) gene. The method by which VGAM1061 was detected is described hereinabove with reference to FIGS. 1-8.

VGAM1061 gene, herein designated VGAM GENE, is a viral gene contained in the genome of Canine Adenovirus Type 1. VGAM1061 host target gene, herein designated VGAM HOST TARGET GENE, is a human gene contained in the human genome.

VGAM1061 gene encodes a VGAM1061 precursor RNA, herein designated VGAM PRECURSOR RNA. Similar to other miRNA genes, and unlike most ordinary genes, VGAM1061 precursor RNA does not encode a protein. A nucleotide sequence identical or highly similar to the nucleotide sequence of VGAM1061 precursor RNA is designated SEQ ID:1047, and is provided hereinbelow with reference to the sequence listing part. Nucleotide sequence SEQ ID:1047 is located at position 7412 relative to the genome of Canine Adenovirus Type 1.

VGAM1061 precursor RNA folds onto itself, forming VGAM1061 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1061 folded precursor RNA into VGAM1061 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1061 RNA is designated SEQ ID:3772, and is provided hereinbelow with reference to the sequence listing part.

VGAM1061 host target gene, herein designated VGAM HOST TARGET GENE, encodes a corresponding messenger RNA, VGAM1061 host target RNA, herein designated VGAM HOST TARGET RNA. VGAM1061 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1061 RNA, herein designated VGAM RNA, binds complementarily to one or more host target binding sites located in untranslated regions of VGAM1061 host target RNA, herein designated VGAM HOST TARGET RNA. This complementary binding is due to the fact that the nucleotide sequence of VGAM1061 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1061 RNA, herein designated VGAM RNA, may have a different number of host target binding sites in untranslated regions of a VGAM1061 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1061 RNA, herein designated VGAM RNA, to host target binding sites on VGAM1061 host target RNA, herein designated VGAM HOST TARGET RNA, such as BINDING SITE I, BINDING SITE II and BINDING SITE III, inhibits translation of VGAM1061 host target RNA into VGAM1061 host target protein, herein designated VGAM HOST TARGET PROTEIN. VGAM host target protein is therefore outlined by a broken line.

It is appreciated that VGAM1061 host target gene, herein designated VGAM HOST TARGET GENE, in fact represents a plurality of VGAM1061 host target genes. The mRNA of each one of this plurality of VGAM1061 host target genes comprises one or more host target binding sites, each having a nucleotide sequence which is at least partly complementary to VGAM1061 RNA, herein designated VGAM RNA, and which when bound by VGAM1061 RNA causes inhibition of translation of respective one or more VGAM1061 host target proteins.

It is further appreciated by one skilled in the art that the mode of translational inhibition illustrated by FIG. 1 with specific reference to translational inhibition exerted by VGAM1061 gene, herein designated VGAM GENE, on one or more VGAM1061 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1061 is inhibition of expression of host target genes, as part of a novel viral mechanism of attacking a host. Accordingly, utilities of VGAM1061 include diagnosis, prevention and treatment of viral infection by Canine Adenovirus Type 1. Specific functions, and accordingly utilities, of VGAM1061 correlate with, and may be deduced from, the identity of the host target genes which VGAM1061 binds and inhibits, and the function of these host target genes, as elaborated hereinbelow.

Nucleotide sequences of the VGAM1061 precursor RNA, herein designated VGAM PRECURSOR RNA, and of the 'diced' VGAM1061 RNA, herein designated VGAM RNA, and a schematic representation of the secondary folding of VGAM1061 folded precursor RNA, herein designated VGAM FOLDED PRECURSOR RNA, of VGAM1061 are further described hereinbelow with reference to Table 1.

Nucleotide sequences of host target binding sites, such as BINDING SITE-I, BINDING SITE-II and BINDING SITE-III of FIG. 1, found on VGAM1061 host target RNA, and schematic representation of the complementarity of each of these host target binding sites to VGAM1061 RNA, herein designated VGAM RNA, are described hereinbelow with reference to Table 2.

As mentioned hereinabove with reference to FIG. 1, a function of VGAM1061 gene, herein designated VGAM is inhibition of expression of VGAM1061 target genes. It is appreciated that specific functions, and accordingly utilities, of VGAM1061 correlate with, and may be deduced from, the identity of the target genes which VGAM1061 binds and inhibits, and the function of these target genes, as elaborated hereinbelow.

Inositol Hexaphosphate Kinase 1 (IHPK1, Accession XM_171045) is a VGAM1061 host target gene. IHPK1 BINDING SITE is HOST TARGET binding site found in the 3' untranslated region of mRNA encoded by IHPK1, corresponding to a HOST TARGET binding site such as BINDING SITE I, BINDING SITE II or BINDING SITE III. Table 2 illustrates the complementarity of the nucleotide sequences of IHPK1 BINDING SITE, designated SEQ ID:45821, to the nucleotide sequence of VGAM1061 RNA, herein designated VGAM RNA, also designated SEQ ID:3772.

A function of VGAM1061 is therefore inhibition of Inositol Hexaphosphate Kinase 1 (IHPK1, Accession XM_171045), a gene which is a messenger molecule that releases calcium from intracellular stores. Accordingly, utilities of VGAM1061 include diagnosis, prevention and treatment of diseases and clinical conditions associated with IHPK1. The function of IHPK1 has been established by previous studies. Inositol trisphosphate is a messenger molecule that releases calcium from intracellular stores. Homologs with multiple phosphates, including pyrophosphates, have also been identified. Inositol pyrophosphates are formed by several enzymes, including IHPK1. By screening an immature myeloid cell line for cDNAs with the potential to encode large proteins, Nagase et al. (1996) identified a cDNA encoding IHPK1, which they called KIAA0263, a deduced 462-amino acid protein. Northern blot analysis detected ubiquitous, low-level expression that was highest in testis. By comparison with rat Ihpk1 and database searching, Saiardi et al. (1999) identified mouse Ihpk1, which is 97% homologous to KIAA0263. Western blot analysis showed expression of a 50-kD protein. Northern blot analysis revealed expression of a 5.0-kb transcript in mouse brain and testis, with much lower levels in heart, liver, kidney, lung, and spleen. Using confocal microscopy, Saiardi et al. (2001) demonstrated that mouse Ihpk1 is present in both the nucleus and the cytoplasm, whereas IHPK2 is almost exclusively nuclear and IHPK3 (OMIM Ref. No. 606993) is predominantly cytoplasmic. Saiardi et al. (1999) showed that cells expressing Ihpk1 displayed a robust InsP6 kinase activity. They proposed that IHPK1 and IHPK2 (OMIM Ref. No. 606992) may act as energy reserves in selected intracellular sites.

Full details of the abovementioned studies are described in the following publications, the disclosure of which are hereby incorporated by reference:

Saiardi, A.; Erdjument-Bromage, H.; Snowman, A. M.; Tempst, P.; Snyder, S. H.: Synthesis of diphosphoinositol pentakisphosphate by a newly identified family of higher inositol polyphosphate kinases. Curr. Biol. 9:1323-1326, 1999; and Saiardi, A.; Nagata, E.; Luo, H. R.; Snowman, A. M.; Snyder, S. H.: Identification and characterization of a novel inositol hexakisphosphate kinase. J. Biol. Chem. 276:39179-39185, 20.

Further studies establishing the function and utilities of IHPK1 are found in John Hopkins OMIM database record ID 606991, and in sited publications numbered 9011-6162 listed in the bibliography section hereinbelow, which are also hereby incorporated by reference. Muscleblind-like (Drosophila) (MBNL, Accession NM_021038) is another VGAM1061 host target gene. MBNL BINDING SITE is HOST TARGET binding site found in the 3' untranslated region of mRNA encoded by MBNL, corresponding to a HOST TARGET binding site such as BINDING SITE I, BINDING SITE II or BINDING SITE III. Table 2 illustrates the complementarity of the nucleotide sequences of MBNL BINDING SITE, designated SEQ ID:22032, to the nucleotide sequence of VGAM1061 RNA, herein designated VGAM RNA, also designated SEQ ID:3772.

Another function of VGAM1061 is therefore inhibition of Muscleblind-like (Drosophila) (MBNL, Accession NM_021038), a gene which binds to cug triplet repeat expansion dsrna (by similarity). Accordingly, utilities of VGAM1061 include diagnosis, prevention and treatment of diseases and clinical conditions associated with MBNL. The function of MBNL and its association with various diseases and clinical conditions, has been established by previous studies, as described hereinabove with reference to VGAM95. SET Translocation (myeloid leukemia-associated) (SET, Accession NM_003011) is another VGAM1061 host target gene. SET BINDING SITE is HOST TARGET binding site found in the 3" untranslated region of mRNA encoded by SET, corresponding to a HOST TARGET binding site such as BINDING SITE I, BINDING SITE II or BINDING SITE III. Table 2 illustrates the complementarity of the nucleotide sequences of SET BINDING SITE, designated SEQ ID:8922, to the nucleotide sequence of VGAM1061 RNA, herein designated VGAM RNA, also designated SEQ ID:3772.

Another function of VGAM1061 is therefore inhibition of SET Translocation (myeloid leukemia-associated) (SET, Accession NM_003011). Accordingly, utilities of VGAM1061 include diagnosis, prevention and treatment of diseases and clinical conditions associated with SET. Zinc Finger Protein 219 (ZNF219, Accession NM_016423) is another VGAM1061 host target gene. ZNF219 BINDING SITE is HOST TARGET binding site found in the 5' untranslated region of mRNA encoded by ZNF219, corresponding to a HOST TARGET binding site such as BINDING SITE I, BINDING SITE II or BINDING SITE III. Table 2 illustrates the complementarity of the nucleotide sequences of ZNF219 BINDING SITE, designated SEQ ID:18546, to the nucleotide sequence of VGAM1061 RNA, herein designated VGAM RNA, also designated SEQ ID:3772.

Another function of VGAM1061 is therefore inhibition of Zinc Finger Protein 219 (ZNF219, Accession NM_016423). Accordingly, utilities of VGAM1061 include diagnosis, prevention and treatment of diseases and clinical conditions associated with ZNF219. Chromosome 6 Open Reading Frame 37 (C6orf37, Accession XM_041375) is another VGAM1061 host target gene. C6orf37 BINDING SITE is HOST TARGET binding site found in the 3' untranslated region of mRNA encoded by C6orf37, corresponding to a HOST TARGET binding site such as BINDING SITE I, BINDING SITE II or BINDING SITE III. Table 2 illustrates the complementarity of the nucleotide sequences of C6orf37 BINDING SITE, designated SEQ ID:33511, to the nucleotide sequence of VGAM1061 RNA, herein designated VGAM RNA, also designated SEQ ID:3772.

Another function of VGAM1061 is therefore inhibition of Chromosome 6 Open Reading Frame 37 (C6orf37, Accession XM_041375). Accordingly, utilities of VGAM1061 include diagnosis, prevention and treatment of diseases and clinical conditions associated with C6orf37. ETAA16 (Accession NM_019002) is another VGAM1061 host target gene. ETAA16 BINDING SITE is HOST TARGET binding site found in the 5' untranslated region of mRNA encoded by ETAA16, corresponding to a HOST TARGET binding site such as BINDING SITE I, BINDING SITE II or BINDING SITE III. Table 2 illustrates the complementarity of the nucleotide sequences of ETAA16 BINDING SITE, designated SEQ ID:21073, to the nucleotide sequence of VGAM1061 RNA, herein designated VGAM RNA, also designated SEQ ID:3772.

Another function of VGAM1061 is therefore inhibition of ETAA16 (Accession NM_019002). Accordingly, utilities of VGAM1061 include diagnosis, prevention and treatment of diseases and clinical conditions associated with ETAA16. FLJ21736 (Accession NM_024922) is another VGAM1061 host target gene. FLJ21736 BINDING SITE is HOST TARGET binding site found in the 3' untranslated region of mRNA encoded by FLJ21736, corresponding to a HOST TARGET binding site such as BINDING SITE I, BINDING SITE II or BINDING SITE III. Table 2 illustrates the complementarity of the nucleotide sequences of FLJ21736 BINDING SITE, designated SEQ ID:24459, to the nucleotide sequence of VGAM1061 RNA, herein designated VGAM RNA, also designated SEQ ID:3772.

Another function of VGAM1061 is therefore inhibition of FLJ21736 (Accession NM_024922). Accordingly, utilities of VGAM1061 include diagnosis, prevention and treatment of diseases and clinical conditions associated with FLJ21736. KIAA0420 (Accession XM_032693) is another VGAM1061 host target gene. KIAA0420 BINDING SITE is HOST TARGET binding site found in the 3' untranslated region of mRNA encoded by KIAA0420, corresponding to a HOST TARGET binding site such as BINDING SITE I, BINDING SITE II or BINDING SITE III. Table 2 illustrates the complementarity of the nucleotide sequences of KIAA0420 BINDING SITE, designated SEQ ID:31724, to the nucleotide sequence of VGAM1061 RNA, herein designated VGAM RNA, also designated SEQ ID:3772.

Another function of VGAM1061 is therefore inhibition of KIAA0420 (Accession XM_032693). Accordingly, utilities of VGAM1061 include diagnosis, prevention and treatment of diseases and clinical conditions associated with KIAA0420. KIAA0644 (Accession NM_014817) is another VGAM1061 host target gene. KIAA0644 BINDING SITE is HOST TARGET binding site found in the 3' untranslated region of mRNA encoded by KIAA0644, corresponding to a HOST TARGET binding site such as BINDING SITE I, BINDING SITE II or BINDING SITE III. Table 2 illustrates the complementarity of the nucleotide sequences of KIAA0644 BINDING SITE, designated SEQ ID:16782, to the nucleotide sequence of VGAM1061 RNA, herein designated VGAM RNA, also designated SEQ ID:3772.

Another function of VGAM1061 is therefore inhibition of KIAA0644 (Accession NM_014817). Accordingly, utilities of VGAM1061 include diagnosis, prevention and treatment of diseases and clinical conditions associated with KIAA0644. KIAA1796 (Accession XM_166146) is another VGAM1061 host target gene. KIAA1796 BINDING SITE is HOST TARGET binding site found in the 3' untranslated region of mRNA encoded by KIAA1796, corresponding to a HOST TARGET binding site such as BINDING SITE I, BINDING SITE II or BINDING SITE III. Table 2 illustrates the complementarity of the nucleotide sequences of KIAA1796 BINDING SITE, designated SEQ ID:43965, to the nucleotide sequence of VGAM1061 RNA, herein designated VGAM RNA, also designated SEQ ID:3772.

Another function of VGAM1061 is therefore inhibition of KIAA1796 (Accession XM_166146). Accordingly, utilities of VGAM1061 include diagnosis, prevention and treatment of diseases and clinical conditions associated with KIAA1796. Myristoylated Alanine-rich Protein Kinase C Substrate (MARCKS, Accession NM_002356) is another VGAM1061 host target gene. MARCKS BINDING SITE is HOST TARGET binding site found in the 3' untranslated region of mRNA encoded by MARCKS, corresponding to a HOST TARGET binding site such as BINDING SITE I, BINDING SITE II or BINDING SITE III. Table 2 illustrates the complementarity of the nucleotide sequences of MARCKS BINDING SITE, designated SEQ ID:8168, to the nucleotide sequence of VGAM1061 RNA, herein designated VGAM RNA, also designated SEQ ID:3772.

Another function of VGAM1061 is therefore inhibition of Myristoylated Alanine-rich Protein Kinase C Substrate (MARCKS, Accession NM_002356). Accordingly, utilities of VGAM1061 include diagnosis, prevention and treatment of diseases and clinical conditions associated with MARCKS. MGC15634 (Accession NM_032755) is another VGAM1061 host target gene. MGC15634 BINDING SITE is HOST TARGET binding site found in the 5' untranslated region of mRNA encoded by MGC15634, corresponding to a HOST TARGET binding site such as BINDING SITE I, BINDING SITE II or BINDING SITE III. Table 2 illustrates the complementarity of the nucleotide sequences of MGC15634 BINDING SITE, designated SEQ ID:26496, to the nucleotide sequence of VGAM1061 RNA, herein designated VGAM RNA, also designated SEQ ID:3772.

Another function of VGAM1061 is therefore inhibition of MGC15634 (Accession NM_032755). Accordingly, utilities of VGAM1061 include diagnosis, prevention and treatment of diseases and clinical conditions associated with MGC15634. LOC130497 (Accession XM_059439) is another VGAM1061 host target gene. LOC130497 BINDING SITE is HOST TARGET binding site found in the 3' untranslated region of mRNA encoded by LOC130497, corresponding to a HOST TARGET binding site such as BINDING SITE I, BINDING SITE II or BINDING SITE III. Table 2 illustrates the complementarity of the nucleotide sequences of LOC130497 BINDING SITE, designated SEQ ID:36992, to the nucleotide sequence of VGAM1061 RNA, herein designated VGAM RNA, also designated SEQ ID:3772.

Another function of VGAM1061 is therefore inhibition of LOC130497 (Accession XM_059439). Accordingly, utilities of VGAM1061 include diagnosis, prevention and treatment of diseases and clinical conditions associated with LOC130497. LOC133418 (Accession XM_059649) is another VGAM1061 host target gene. LOC133418 BINDING SITE is HOST TARGET binding site found in the 3' untranslated region of mRNA encoded by LOC133418, corresponding to a HOST TARGET binding site such as BINDING SITE I, BINDING SITE II or BINDING SITE III. Table 2 illustrates the complementarity of the nucleotide sequences of LOC133418 BINDING SITE, designated SEQ ID:37040, to the nucleotide sequence of VGAM1061 RNA, herein designated VGAM RNA, also designated SEQ ID:3772.

Another function of VGAM1061 is therefore inhibition of LOC133418 (Accession XM_059649). Accordingly, utilities of VGAM1061 include diagnosis, prevention and treatment of diseases and clinical conditions associated with LOC133418. LOC144231 (Accession XM_096561) is another VGAM1061 host target gene. LOC144231 BINDING SITE is HOST TARGET binding site found in the 5' untranslated region of mRNA encoded by LOC144231, corresponding to a HOST TARGET binding site such as BINDING SITE I, BINDING SITE II or BINDING SITE III. Table 2 illustrates the complementarity of the nucleotide sequences of LOC144231 BINDING SITE, designated SEQ ID:40390, to the nucleotide sequence of VGAM1061 RNA, herein designated VGAM RNA, also designated SEQ ID:3772.

Another function of VGAM1061 is therefore inhibition of LOC144231 (Accession XM_096561). Accordingly, utilities of VGAM1061 include diagnosis, prevention and treatment of diseases and clinical conditions associated with LOC144231. LOC152426 (Accession XM_098225) is another VGAM1061 host target gene. LOC152426 BINDING SITE is HOST TARGET binding site found in the 3' untranslated region of mRNA encoded by LOC152426, corresponding to a HOST TARGET binding site such as BINDING SITE I, BINDING SITE II or BINDING SITE III. Table 2 illustrates the complementarity of the nucleotide sequences of LOC152426 BINDING SITE, designated SEQ ID:41497, to the nucleotide sequence of VGAM1061 RNA, herein designated VGAM RNA, also designated SEQ ID:3772.

Another function of VGAM1061 is therefore inhibition of LOC152426 (Accession XM_098225). Accordingly, utilities of VGAM1061 include diagnosis, prevention and treatment of diseases and clinical conditions associated with LOC152426. LOC165693 (Accession XM_093373) is another VGAM1061 host target gene. LOC165693 BINDING SITE is HOST TARGET binding site found in the 5' untranslated region of mRNA encoded by LOC165693, corresponding to a HOST TARGET binding site such as BINDING SITE I, BINDING SITE II or BINDING SITE III. Table 2 illustrates the complementarity of the nucleotide sequences of LOC165693 BINDING SITE, designated SEQ ID:40190, to the nucleotide sequence of VGAM1061 RNA, herein designated VGAM RNA, also designated SEQ ID:3772.

Another function of VGAM1061 is therefore inhibition of LOC165693 (Accession XM_093373). Accordingly, utilities of VGAM1061 include diagnosis, prevention and treatment of diseases and clinical conditions associated with LOC165693. LOC221895 (Accession XM_166511) is another VGAM1061 host target gene. LOC221895 BINDING SITE is HOST TARGET binding site found in the 3' untranslated region of mRNA encoded by LOC221895, corresponding to a HOST TARGET binding site such as BINDING SITE I, BINDING SITE II or BINDING SITE III. Table 2 illustrates the complementarity of the nucleotide sequences of LOC221895 BINDING SITE, designated SEQ ID:44443, to the nucleotide sequence of VGAM1061 RNA, herein designated VGAM RNA, also designated SEQ ID:3772.

Another function of VGAM1061 is therefore inhibition of LOC221895 (Accession XM_166511). Accordingly, utilities of VGAM1061 include diagnosis, prevention and treatment of diseases and clinical conditions associated with LOC221895. LOC257354 (Accession XM_170810) is another VGAM1061 host target gene. LOC257354 BINDING SITE is HOST TARGET binding site found in the 3' untranslated region of mRNA encoded by LOC257354, corresponding to a HOST TARGET binding site such as BINDING SITE I, BINDING SITE II or BINDING SITE III. Table 2 illustrates the complementarity of the nucleotide sequences of LOC257354 BINDING SITE, designated SEQ ID:45577, to the nucleotide sequence of VGAM1061 RNA, herein designated VGAM RNA, also designated SEQ ID:3772.

Another function of VGAM1061 is therefore inhibition of LOC257354 (Accession XM_170810). Accordingly, utilities of VGAM1061 include diagnosis, prevention and treatment of diseases and clinical conditions associated with LOC257354. LOC257476 (Accession XM_028610) is another VGAM1061 host target gene. LOC257476 BINDING SITE is HOST TARGET binding site found in the 3' untranslated region of mRNA encoded by LOC257476, corresponding to a HOST TARGET binding site such as BINDING SITE I, BINDING SITE II or BINDING SITE III. Table 2 illustrates the complementarity of the nucleotide sequences of LOC257476 BINDING SITE, designated SEQ ID:30713, to the nucleotide sequence of VGAM1061 RNA, herein designated VGAM RNA, also designated SEQ ID:3772.

Another function of VGAM1061 is therefore inhibition of LOC257476 (Accession XM_028610). Accordingly, utilities of VGAM1061 include diagnosis, prevention and treatment of diseases and clinical conditions associated with LOC257476. FIG. 1 further provides a conceptual description of a novel bioinformatically detected viral gene of the present invention, referred to here as Viral Genomic Address Messenger 1062 (VGAM1062) viral gene, which modulates expression of respective host target genes thereof, the function and utility of which host target genes is known in the art.

VGAM1062 is a novel bioinformatically detected regulatory, non protein coding, viral micro RNA (miRNA) gene. The method by which VGAM1062 was detected is described hereinabove with reference to FIGS. 1-8.

VGAM1062 gene, herein designated VGAM GENE, is a viral gene contained in the genome of Canine Adenovirus Type 1. VGAM1062 host target gene, herein designated VGAM HOST TARGET GENE, is a human gene contained in the human genome.

VGAM1062 gene encodes a VGAM1062 precursor RNA, herein designated VGAM PRECURSOR RNA. Similar to other miRNA genes, and unlike most ordinary genes, VGAM1062 precursor RNA does not encode a protein. A nucleotide sequence identical or highly similar to the nucleotide sequence of VGAM1062 precursor RNA is designated SEQ ID:1048, and is provided hereinbelow with reference to the sequence listing part. Nucleotide sequence SEQ ID:1048 is located at position 6331 relative to the genome of Canine Adenovirus Type 1.

VGAM1062 precursor RNA folds onto itself, forming VGAM1062 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1062 folded precursor RNA into VGAM1062 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM1062 RNA is designated SEQ ID:3773, and is provided hereinbelow with reference to the sequence listing part.

VGAM1062 host target gene, herein designated VGAM HOST TARGET GENE, encodes a corresponding messenger RNA, VGAM1062 host target RNA, herein designated VGAM HOST TARGET RNA. VGAM1062 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1062 RNA, herein designated VGAM RNA, binds complementarily to one or more host target binding sites located in untranslated regions of VGAM1062 host target RNA, herein designated VGAM HOST TARGET RNA. This complementary binding is due to the fact that the nucleotide sequence of VGAM1062 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1062 RNA, herein designated VGAM RNA, may have a different number of host target binding sites in untranslated regions of a VGAM1062 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1062 RNA, herein designated VGAM RNA, to host target binding sites on VGAM1062 host target RNA, herein designated VGAM HOST TARGET RNA, such as BINDING SITE I, BINDING SITE II and BINDING SITE III, inhibits translation of VGAM1062 host target RNA into VGAM1062 host target protein, herein designated VGAM HOST TARGET PROTEIN. VGAM host target protein is therefore outlined by a broken line.

It is appreciated that VGAM1062 host target gene, herein designated VGAM HOST TARGET GENE, in fact represents a plurality of VGAM1062 host target genes. The mRNA of each one of this plurality of VGAM1062 host target genes comprises one or more host target binding sites, each having a nucleotide sequence which is at least partly complementary to VGAM1062 RNA, herein designated VGAM RNA, and which when bound by VGAM1062 RNA causes inhibition of translation of respective one or more VGAM1062 host target proteins.

It is further appreciated by one skilled in the art that the mode of translational inhibition illustrated by FIG. 1 with specific reference to translational inhibition exerted by VGAM1062 gene, herein designated VGAM GENE, on one or more VGAM1062 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1062 is inhibition of expression of host target genes, as part of a novel viral mechanism of attacking a host. Accordingly, utilities of VGAM1062 include diagnosis, prevention and treatment of viral infection by Canine Adenovirus Type 1. Specific functions, and accordingly utilities, of VGAM1062 correlate with, and may be deduced from, the identity of the host target genes which VGAM1062 binds and inhibits, and the function of these host target genes, as elaborated hereinbelow.

Nucleotide sequences of the VGAM1062 precursor RNA, herein designated VGAM PRECURSOR RNA, and of the 'diced' VGAM1062 RNA, herein designated VGAM RNA, and a schematic representation of the secondary folding of VGAM1062 folded precursor RNA, herein designated VGAM FOLDED PRECURSOR RNA, of VGAM1062 are further described hereinbelow with reference to Table 1.

Nucleotide sequences of host target binding sites, such as BINDING SITE-I, BINDING SITE-II and BINDING SITE-III of FIG. 1, found on VGAM1062 host target RNA, and schematic representation of the complementarity of each of these host target binding sites to VGAM1062 RNA, herein designated VGAM RNA, are described hereinbelow with reference to Table 2.

As mentioned hereinabove with reference to FIG. 1, a function of VGAM1062 gene, herein designated VGAM is inhibition of expression of VGAM1062 target genes. It is appreciated that specific functions, and accordingly utilities, of VGAM1062 correlate with, and may be deduced from, the identity of the target genes which VGAM1062 binds and inhibits, and the function of these target genes, as elaborated hereinbelow.

Protein Phosphatase 1, Catalytic Subunit, Beta Isoform (PPP1CB, Accession NM_002709) is a VGAM1062 host target gene. PPP1CB BINDING SITE is HOST TARGET binding site found in the 3' untranslated region of mRNA encoded by PPP1CB, corresponding to a HOST TARGET binding site such as BINDING SITE I, BINDING SITE II or BINDING SITE III. Table 2 illustrates the complementarity of the nucleotide sequences of PPP1CB BINDING SITE, designated SEQ ID:8562, to the nucleotide sequence of VGAM1062 RNA, herein designated VGAM RNA, also designated SEQ ID:3773.

A function of VGAM1062 is therefore inhibition of Protein Phosphatase 1, Catalytic Subunit, Beta Isoform (PPP1CB, Accession NM_002709), a gene which is the catalytic subunit of protein phosphatase 1. Accordingly, utilities of VGAM1062 include diagnosis, prevention and treatment of diseases and clinical conditions associated with PPP1CB. The function of PPP1CB and its association with various diseases and clinical conditions, has been established by previous studies, as described hereinabove with reference to VGAM46. PRO0082 (Accession NM_018590) is another VGAM1062 host target gene. PRO0082 BINDING SITE is HOST TARGET binding site found in the 3' untranslated region of mRNA encoded by PRO0082, corresponding to a HOST TARGET binding site such as BINDING SITE I, BINDING SITE II or BINDING SITE III. Table 2 illustrates the complementarity of the nucleotide sequences of PRO0082 BINDING SITE, designated SEQ ID:20669, to the nucleotide sequence of VGAM1062 RNA, herein designated VGAM RNA, also designated SEQ ID:3773.

Another function of VGAM1062 is therefore inhibition of PRO0082 (Accession NM_018590). Accordingly, utilities of VGAM1062 include diagnosis, prevention and treatment of diseases and clinical conditions associated with PRO0082. FIG. 1 further provides a conceptual description of a novel bioinformatically detected viral gene of the present invention, referred to here as Viral Genomic Address Messenger 1063 (VGAM1063) viral gene, which modulates expression of respective host target genes thereof, the function and utility of which host target genes is known in the art.

VGAM1063 is a novel bioinformatically detected regulatory, non protein coding, viral micro RNA (miRNA) gene.

The method by which VGAM1063 was detected is described hereinabove with reference to FIGS. 1-8.

VGAM1063 gene, herein designated VGAM GENE, is a viral gene contained in the genome of Tulip Virus X. VGAM1063 host target gene, herein designated VGAM HOST TARGET GENE, is a human gene contained in the human genome.

VGAM1063 gene encodes a VGAM1063 precursor RNA, herein designated VGAM PRECURSOR RNA. Similar to other miRNA genes, and unlike most ordinary genes, VGAM1063 precursor RNA does not encode a protein. A nucleotide sequence identical or highly similar to the nucleotide sequence of VGAM1063 precursor RNA is designated SEQ ID:1049, and is provided hereinbelow with reference to the sequence listing part. Nucleotide sequence SEQ ID:1049 is located at position 2404 relative to the genome of Tulip Virus X.

VGAM1063 precursor RNA folds onto itself, forming VGAM1063 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1063 folded precursor RNA into VGAM1063 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1063 RNA is designated SEQ ID:3774, and is provided hereinbelow with reference to the sequence listing part.

VGAM1063 host target gene, herein designated VGAM HOST TARGET GENE, encodes a corresponding messenger RNA, VGAM1063 host target RNA, herein designated VGAM HOST TARGET RNA. VGAM1063 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1063 RNA, herein designated VGAM RNA, binds complementarily to one or more host target binding sites located in untranslated regions of VGAM1063 host target RNA, herein designated VGAM HOST TARGET RNA. This complementary binding is due to the fact that the nucleotide sequence of VGAM1063 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1063 RNA, herein designated VGAM RNA, may have a different number of host target binding sites in untranslated regions of a VGAM1063 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1063 RNA, herein designated VGAM RNA, to host target binding sites on VGAM1063 host target RNA, herein designated VGAM HOST TARGET RNA, such as BINDING SITE I, BINDING SITE II and BINDING SITE III, inhibits translation of VGAM1063 host target RNA into VGAM1063 host target protein, herein designated VGAM HOST TARGET PROTEIN. VGAM host target protein is therefore outlined by a broken line.

It is appreciated that VGAM1063 host target gene, herein designated VGAM HOST TARGET GENE, in fact represents a plurality of VGAM1063 host target genes. The mRNA of each one of this plurality of VGAM1063 host target genes comprises one or more host target binding sites, each having a nucleotide sequence which is at least partly complementary to VGAM1063 RNA, herein designated VGAM RNA, and which when bound by VGAM1063 RNA causes inhibition of translation of respective one or more VGAM1063 host target proteins.

It is further appreciated by one skilled in the art that the mode of translational inhibition illustrated by FIG. 1 with specific reference to translational inhibition exerted by VGAM1063 gene, herein designated VGAM GENE, on one or more VGAM1063 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1063 is inhibition of expression of host target genes, as part of a novel viral mechanism of attacking a host. Accordingly, utilities of VGAM1063 include diagnosis, prevention and treatment of viral infection by Tulip Virus X. Specific functions, and accordingly utilities, of VGAM1063 correlate with, and may be deduced from, the identity of the host target genes which VGAM1063 binds and inhibits, and the function of these host target genes, as elaborated hereinbelow.

Nucleotide sequences of the VGAM1063 precursor RNA, herein designated VGAM PRECURSOR RNA, and of the 'diced' VGAM1063 RNA, herein designated VGAM RNA, and a schematic representation of the secondary folding of VGAM1063 folded precursor RNA, herein designated VGAM FOLDED PRECURSOR RNA, of VGAM1063 are further described hereinbelow with reference to Table 1.

Nucleotide sequences of host target binding sites, such as BINDING SITE-I, BINDING SITE-II and BINDING SITE-III of FIG. 1, found on VGAM1063 host target RNA, and schematic representation of the complementarity of each of these host target binding sites to VGAM1063 RNA, herein designated VGAM RNA, are described hereinbelow with reference to Table 2.

As mentioned hereinabove with reference to FIG. 1, a function of VGAM1063 gene, herein designated VGAM is inhibition of expression of VGAM1063 target genes. It is appreciated that specific functions, and accordingly utilities, of VGAM1063 correlate with, and may be deduced from, the identity of the target genes which VGAM1063 binds and inhibits, and the function of these target genes, as elaborated hereinbelow.

Agrin (AGRN, Accession XM_086178) is a VGAM1063 host target gene. AGRN BINDING SITE is HOST TARGET binding site found in the 3' untranslated region of mRNA encoded by AGRN, corresponding to a HOST TARGET binding site such as BINDING SITE I, BINDING SITE II or BINDING SITE III. Table 2 illustrates the complementarity of the nucleotide sequences of AGRN BINDING SITE, designated SEQ ID:38534, to the nucleotide sequence of VGAM1063 RNA, herein designated VGAM RNA, also designated SEQ ID:3774.

A function of VGAM1063 is therefore inhibition of Agrin (AGRN, Accession XM_086178), a gene which a neuronal aggregating factor that induces the aggregation of acetylcholine receptors. Accordingly, utilities of VGAM1063 include diagnosis, prevention and treatment of diseases and clinical conditions associated with AGRN. The function of AGRN has been established by previous studies. Agrin is a neuronal aggregating factor that induces the aggregation of acetylcholine receptors and other postsynaptic proteins on muscle fibers and is crucial for the formation of the neuromuscular junction. Rupp et al. (1991) isolated cDNAs from a rat embryonic spinal cord library using an agrin cDNA clone isolated from electromotor neurons of a marine ray. Analysis of a set of clones predicted a protein with 1,940 amino acids, including 141 cysteine residues. The predicted protein had 9 domains homologous to protease inhibitors, a region similar to domain III of laminin (see OMIM Ref. No. 150240), and 4 epidermal growth factor (OMIM Ref. No. 131530) repeats. The gene was expressed in rat embryonic nervous system and muscle. The protein was concentrated at synapses. Rupp et al. (1992) described alternative RNA splicing in mammalian agrin resulting in many extracellular matrix protein isoforms. Rupp et al. (1992) mapped the human AGRN gene to 1pter-p32 by analysis of Chinese hamster/human somatic cell hybrids, including one that carried chromosome 1 region p32-qter (which was negative for the human signal). The mouse gene was mapped to chromosome 4 by study of Chinese hamster/mouse somatic cell hybrids. Thus, this is another example of extensive homology of synteny between 1pter-p32 and the distal half of mouse chromosome 4. Three neurologic mutants in that region of mouse chromosome 4 were pointed to as possible candidate diseases for mutations in the Agrn gene. Animal model experiments lend further support to the function of AGRN. To test critically the 'agrin hypothesis' (McMahan, 1990), Gautam et al. (1996) generated knockout mice deficient for agrin and showed that neuromuscular differentiation is grossly defective in these mice.

It is appreciated that the abovementioned animal model for AGRN is acknowledged by those skilled in the art as a scientifically valid animal model, as can be further appreciated from the publications sited hereinbelow.

Full details of the abovementioned studies are described in the following publications, the disclosure of which are hereby incorporated by reference:

Rupp, F.; Payan, D. G.; Magill-Solc, C.; Cowan, D. M.; Scheller, R. H.: Structure and expression of a rat agrin. Neuron 6:811-823, 1991; and Gautam, M.; Noakes, P. G.; Moscoso, L.; Rupp, F.; Scheller, R. H.; Merlie, J. P.; Sanes, J. R.: Defective neuromuscular synaptogenesis in agrin-deficient mutant mice. Cell 85:525-535.

Further studies establishing the function and utilities of AGRN are found in John Hopkins OMIM database record ID 103320, and in sited publications numbered 11875-1187 and 12115-12121 listed in the bibliography section hereinbelow, which are also hereby incorporated by reference. Ankyrin 1, Erythrocytic (ANK1, Accession XM_016774) is another VGAM1063 host target gene. ANK1 BINDING SITE1 through ANK1 BINDING SITE3 are HOST TARGET binding sites found in untranslated regions of mRNA encoded by ANK1, corresponding to HOST TARGET binding sites such as BINDING SITE I, BINDING SITE II or BINDING SITE III. Table 2 illustrates the complementarity of the nucleotide sequences of ANK1 BINDING SITE1 through ANK1 BINDING SITE3, designated SEQ ID:30280, SEQ ID:21729 and SEQ ID:5476 respectively, to the nucleotide sequence of VGAM1063 RNA, herein designated VGAM RNA, also designated SEQ ID:3774.

Another function of VGAM1063 is therefore inhibition of Ankyrin 1, Erythrocytic (ANK1, Accession XM_016774). Accordingly, utilities of VGAM1063 include diagnosis, prevention and treatment of diseases and clinical conditions associated with ANK1. E74-like Factor 3 (ets domain transcription factor, epithelial-specific ) (ELF3, Accession NM_004433) is another VGAM1063 host target gene. ELF3 BINDING SITE is HOST TARGET binding site found in the 3' untranslated region of mRNA encoded by ELF3, corresponding to a HOST TARGET binding site such as BINDING SITE I, BINDING SITE II or BINDING SITE III. Table 2 illustrates the complementarity of the nucleotide sequences of ELF3 BINDING SITE, designated SEQ ID:10719, to the nucleotide sequence of VGAM1063 RNA, herein designated VGAM RNA, also designated SEQ ID:3774.

Another function of VGAM1063 is therefore inhibition of E74-like Factor 3 (ets domain transcription factor, epithelial-specific ) (ELF3, Accession NM_004433), a gene which is a transcription factor known to be exclusively expressed in epithelial cells. Accordingly, utilities of VGAM1063 include diagnosis, prevention and treatment of diseases and clinical conditions associated with ELF3. The function of ELF3 has been established by previous studies. Oettgen et al. (1997) isolated and characterized a novel member of the ETS transcription factor family (see OMIM Ref. No. 164720), which they called ESX (also known as ESS-E). This was the first ETS factor and one of only a few transcription factors known to be exclusively expressed in epithelial cells. ESX contains 2 putative DNA-binding domains: an ETS domain and an A/T hook domain. Oettgen et al. (1999) determined that the ELF3 gene contains 9 exons spanning approximately 5.8 kb of genomic DNA. By fluorescence in situ hybridization (FISH), Oettgen et al. (1997) mapped the ESX gene to 1q32. By the same method, Tymms et al. (1997) refined the location to 1q32.2.

Full details of the abovementioned studies are described in the following publications, the disclosure of which are hereby incorporated by reference:

Oettgen, P.; Alani, R. M.; Barcinski, M. A.; Brown, L.; Akbarali, Y.; Boltax, J.; Kunsch, C.; Munger, K.; Liebermann, T. A.: Isolation and characterization of a novel epithelium-specific transcription factor, ESE-1, a member of the Ets family. Molec. Cell. Biol. 17:4419-4433, 1997; and Oettgen, P.; Barcinski, M.; Boltax, J.; Stolt, P.; Akbarali, Y.; Libermann, T. A.: Genomic organization of the human ELF3 (ESE-1/ESX) gene, a member of the Ets transcription factor fami.

Further studies establishing the function and utilities of ELF3 are found in John Hopkins OMIM database record ID 602191, and in sited publications numbered 5847-584 and 5851 listed in the bibliography section hereinbelow, which are also hereby incorporated by reference. Fibronectin 1 (FN1, Accession NM_002026) is another VGAM1063 host target gene. FN1 BINDING SITE1 and FN1 BINDING SITE2 are HOST TARGET binding sites found in untranslated regions of mRNA encoded by FN1, corresponding to HOST TARGET binding sites such as BINDING SITE I, BINDING SITE II or BINDING SITE III. Table 2 illustrates the complementarity of the nucleotide sequences of FN1 BINDING SITE1 and FN1 BINDING SITE2, designated SEQ ID:7778 and SEQ ID:27644 respectively, to the nucleotide sequence of VGAM1063 RNA, herein designated VGAM RNA, also designated SEQ ID:3774.

Another function of VGAM1063 is therefore inhibition of Fibronectin 1 (FN1, Accession NM_002026), a gene which binds cell surfaces and various compounds including collagen, fibrin, heparin, dna, and actin. Accordingly, utilities of VGAM1063 include diagnosis, prevention and treatment of diseases and clinical conditions associated with FN1. The function of FN1 has been established by previous studies. Fibronectin deficiency has been identified in association with a form of the Ehlers-Danlos syndrome (OMIM Ref. No. type X); see 225310. Is the mutation in that disorder at the locus referred to here? Shirakami et al. (1986) reported plasma fibronectin deficiency in 8 members of 1 family. Enzyme levels were about half-normal in the deficient persons, who were distributed in 3 generations and 4 sibships in a regular autosomal dominant pattern with male-to-male transmission. The proband, a 31-year-old woman, had keloids at sites of surgery and burns but no other abnormalities; no keloids were found in the deficient relatives. Specifically, there was no unusual susceptibility to infections, bleeding diathesis, or hyperextensibility of joints or skin (see OMIM Ref. No. 225310). No homozygote was definitely demonstrated; a possible homozygote with first-cousin parents died soon after birth. Animal model experiments lend further support to the function of FN1. To investigate the role of plasma fibronectin in vivo, Sakai et al. (2001) generated plasma fibronectin-deficient adult mice using Cre-loxP conditional gene-knockout technology. Sakai et al. (2001) demonstrated that plasma fibronectin-deficient mice show increased neuronal apoptosis and larger infarction areas following transient focal cerebral ischemia. Surprisingly, plasma fibronectin is not essential for skin-wound healing or hemostasis.

It is appreciated that the abovementioned animal model for FN1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sakai, T.; Johnson, K. J.; Murozono, M.; Sakai, K.; Magnuson, M. A.; Wieloch, T.; Cronberg, T.; Isshiki, A.; Erickson, H. P.; Fassler, R.: Plasma fibronectin supports neuronal survival and reduces brain injury following transient focal cerebral ischemia but is not essential for skin-wound healing and hemostasis. Nature Med. 7:324-330, 2001; and Shirakami, A.; Shigekiyo, T.; Hirai, Y.; Takeichi, T.; Kawauchi, S.; Saito, S.; Miyoshi, K.: Plasma fibronectin deficiency in eight members of one family. Lancet I: 473-474, 1986.

Further studies establishing the function and utilities of FN1 are found in John Hopkins OMIM database record ID 135600, and in sited publications numbered 2153-2176, 878, 3324-333 and 12153 listed in the bibliography section hereinbelow, which are also hereby incorporated by reference. Heparan Sulfate 2-O-sulfotransferase 1 (HS2ST1, Accession NM_012262) is another VGAM1063 host target gene. HS2ST1 BINDING SITE is HOST TARGET binding site found in the 3' untranslated region of mRNA encoded by HS2ST1, corresponding to a HOST TARGET binding site such as BINDING SITE I, BINDING SITE II or BINDING SITE III. Table 2 illustrates the complementarity of the nucleotide sequences of HS2ST1 BINDING SITE, designated SEQ ID:14574, to the nucleotide sequence of VGAM1063 RNA, herein designated VGAM RNA, also designated SEQ ID:3774.

Another function of VGAM1063 is therefore inhibition of Heparan Sulfate 2-O-sulfotransferase 1 (HS2ST1, Accession NM_012262). Accordingly, utilities of VGAM1063 include diagnosis, prevention and treatment of diseases and clinical conditions associated with HS2ST1. Integrin, Alpha 3 (antigen CD49C, alpha 3 subunit of VLA-3 receptor) (ITGA3, Accession NM_005501) is another VGAM1063 host target gene. ITGA3 BINDING SITE1 and ITGA3 BINDING SITE2 are HOST TARGET binding sites found in untranslated regions of mRNA encoded by ITGA3, corresponding to HOST TARGET binding sites such as BINDING SITE I, BINDING SITE II or BINDING SITE III. Table 2 illustrates the complementarity of the nucleotide sequences of ITGA3 BINDING SITE1 and ITGA3 BINDING SITE2, designated SEQ ID:12008 and SEQ ID:7965 respectively, to the nucleotide sequence of VGAM1063 RNA, herein designated VGAM RNA, also designated SEQ ID:3774.

Another function of VGAM1063 is therefore inhibition of Integrin, Alpha 3 (antigen CD49C, alpha 3 subunit of VLA-3 receptor) (ITGA3, Accession NM_005501), a gene which is a receptor for fibronectin, laminin, collagen, epiligrin and thrombospondin. Accordingly, utilities of VGAM1063 include diagnosis, prevention and treatment of diseases and clinical conditions associated with ITGA3. The function of ITGA3 and its association with various diseases and clinical conditions, has been established by previous studies, as described hereinabove with reference to VGAM1020. Polymerase (RNA) II (DNA directed) Polypeptide E, 25 kDa (POLR2E, Accession XM_009279) is another VGAM1063 host target gene. POLR2E BINDING SITE is HOST TARGET binding site found in the 3' untranslated region of mRNA encoded by POLR2E, corresponding to a HOST TARGET binding site such as BINDING SITE I, BINDING SITE II or BINDING SITE III. Table 2 illustrates the complementarity of the nucleotide sequences of POLR2E BINDING SITE, designated SEQ ID:30107, to the nucleotide sequence of VGAM1063 RNA, herein designated VGAM RNA, also designated SEQ ID:3774.

Another function of VGAM1063 is therefore inhibition of Polymerase (RNA) II (DNA directed) Polypeptide E, 25 kDa (POLR2E, Accession XM_009279), a gene which is a subunit of a DNA-dependent RNA polymerase. Accordingly, utilities of VGAM1063 include diagnosis, prevention and treatment of diseases and clinical conditions associated with POLR2E. The function of POLR2E has been established by previous studies. Acker et al. (1994) isolated cDNAs of 5 subunits of RNA polymerase II. Cramer et al. (2000) derived a backbone model of a 10-subunit yeast RNA polymerase II using x-ray diffraction data extending to 3-angstrom resolution. All 10 subunits exhibited a high degree of identity with the corresponding human proteins, and 9 of the 10 subunits are conserved among the 3 eukaryotic RNA polymerases I, II, and III. Notable features of the model include a pair of jaws, formed by subunits Rpb1 (OMIM Ref. No. 180660), Rpb5 (homologous to human POLR2E), and Rpb9 (OMIM Ref. No. 180662), that appear to grip DNA downstream of the active center. A clamp on the DNA nearer the active center, formed by Rpb1, Rpb2 (OMIM Ref. No. 180661), and Rpb6 (OMIM Ref. No. 604414), may be locked in the closed position by RNA, accounting for the great stability of transcribing complexes. A pore in the protein complex beneath the active center may allow entry of substrates for polymerization and exit of the transcript during proofreading and passage through pause sites in the DNA.

Full details of the abovementioned studies are described in the following publications, the disclosure of which are hereby incorporated by reference:

Acker, J.; Mattei, M.-G.; Wintzerith, M.; Roeckel, N.; Depetris, D.; Vigneron, M.; Kedinger, C.: Chromosomal localization of human RNA polymerase II subunit genes. Genomics 20:496-499, 1994; and Cramer, P.; Bushnell, D. A.; Fu, J.; Gnatt, A. L.; Maier-Davis, B.; Thompson, N. E.; Burgess, R. R.; Edwards, A. M.; David, P. R.; Kornberg, R. D.: Architecture of RNA polymerase II and im.

Further studies establishing the function and utilities of POLR2E are found in John Hopkins OMIM database record ID 180664, and in sited publications numbered 12398 listed in the bibliography section hereinbelow, which are also hereby incorporated by reference. Ribonuclease, RNase A Family, 1 (pancreatic) (RNASE1, Accession NM_002933) is another VGAM1063 host target gene. RNASE1 BINDING SITE is HOST TARGET binding site found in the 5' untranslated region of mRNA encoded by RNASE1, corresponding to a HOST TARGET binding site such as BINDING SITE I, BINDING SITE II or BINDING SITE III. Table 2 illustrates the complementarity of the nucleotide sequences of RNASE1 BINDING SITE, designated SEQ ID:8835, to the nucleotide sequence of VGAM1063 RNA, herein designated VGAM RNA, also designated SEQ ID:3774.

Another function of VGAM1063 is therefore inhibition of Ribonuclease, RNase A Family, 1 (pancreatic) (RNASE1, Accession NM_002933), a gene which is a Pancreatic ribonuclease; a pyrimidine-specific endonuclease that generates 2',3'-cyclic phosphate products. Accordingly, utilities of VGAM1063 include diagnosis, prevention and treatment of diseases and clinical conditions associated with RNASE1. The function of RNASE1 and its association with various diseases and clinical conditions, has been established by previous studies, as described hereinabove with reference to VGAM210. SH3-domain GRB2-like 1 (SH3GL1, Accession NM_003025) is another VGAM1063 host target gene. SH3GL1 BINDING SITE is HOST TARGET binding site found in the 3' untranslated region of mRNA encoded by SH3GL1, corresponding to a HOST TARGET binding site such as BINDING SITE I, BINDING SITE II or BINDING SITE III. Table 2 illustrates the complementarity of the nucleotide sequences of SH3GL1 BINDING SITE, designated SEQ ID:8961, to the nucleotide sequence of VGAM1063 RNA, herein designated VGAM RNA, also designated SEQ ID:3774.

Another function of VGAM1063 is therefore inhibition of SH3-domain GRB2-like 1 (SH3GL1, Accession NM_003025). Accordingly, utilities of VGAM1063 include diagnosis, prevention and treatment of diseases and clinical conditions associated with SH3GL1. SH3 and Multiple Ankyrin Repeat Domains 2 (SHANK2, Accession NM_133266) is another VGAM1063 host target gene. SHANK2 BINDING SITE is HOST TARGET binding site found in the 3' untranslated region of mRNA encoded by SHANK2, corresponding to a HOST TARGET binding site such as BINDING SITE I, BINDING SITE II or BINDING SITE III. Table 2 illustrates the complementarity of the nucleotide sequences of SHANK2 BINDING SITE, designated SEQ ID:28421, to the nucleotide sequence of VGAM1063 RNA, herein designated VGAM RNA, also designated SEQ ID:3774.

Another function of VGAM1063 is therefore inhibition of SH3 and Multiple Ankyrin Repeat Domains 2 (SHANK2, Accession NM_133266). Accordingly, utilities of VGAM1063 include diagnosis, prevention and treatment of diseases and clinical conditions associated with SHANK2. Solute Carrier Family 4, Anion Exchanger, Member 1 (erythrocyte membrane protein band 3, Diego blood group) (SLC4A1, Accession NM_000342) is another VGAM1063 host target gene. SLC4A1 BINDING SITE1 and SLC4A1 BINDING SITE2 are HOST TARGET binding sites found in untranslated regions of mRNA encoded by SLC4A1, corresponding to HOST TARGET binding sites such as BINDING SITE I, BINDING SITE II or BINDING SITE III. Table 2 illustrates the complementarity of the nucleotide sequences of SLC4A1 BINDING SITE1 and SLC4A1 BINDING SITE2, designated SEQ ID:5893 and SEQ ID:5894 respectively, to the nucleotide sequence of VGAM1063 RNA, herein designated VGAM RNA, also designated SEQ ID:3774.

Another function of VGAM1063 is therefore inhibition of Solute Carrier Family 4, Anion Exchanger, Member 1 (erythrocyte membrane protein band 3, Diego blood group) (SLC4A1, Accession NM_000342). Accordingly, utilities of VGAM1063 include diagnosis, prevention and treatment of diseases and clinical conditions associated with SLC4A1. SORCS2 (Accession NM_020777) is another VGAM1063 host target gene. SORCS2 BINDING SITE is HOST TARGET binding site found in the 3' untranslated region of mRNA encoded by SORCS2, corresponding to a HOST TARGET binding site such as BINDING SITE I, BINDING SITE II or BINDING SITE III. Table 2 illustrates the complementarity of the nucleotide sequences of SORCS2 BINDING SITE, designated SEQ ID:21875, to the nucleotide sequence of VGAM1063 RNA, herein designated VGAM RNA, also designated SEQ ID:3774.

Another function of VGAM1063 is therefore inhibition of SORCS2 (Accession NM_020777). Accordingly, utilities of VGAM1063 include diagnosis, prevention and treatment of diseases and clinical conditions associated with SORCS2. SORCS3 (Accession NM_014978) is another VGAM1063 host target gene. SORCS3 BINDING SITE is HOST TARGET binding site found in the 5' untranslated region of mRNA encoded by SORCS3, corresponding to a HOST TARGET binding site such as BINDING SITE I, BINDING SITE II or BINDING SITE III. Table 2 illustrates the complementarity of the nucleotide sequences of SORCS3 BINDING SITE, designated SEQ ID:17363, to the nucleotide sequence of VGAM1063 RNA, herein designated VGAM RNA, also designated SEQ ID:3774.

Another function of VGAM1063 is therefore inhibition of SORCS3 (Accession NM_014978). Accordingly, utilities of VGAM1063 include diagnosis, prevention and treatment of diseases and clinical conditions associated with SORCS3. Suppression of Tumorigenicity 7 (ST7, Accession NM_021908) is another VGAM1063 host target gene. ST7 BINDING SITE is HOST TARGET binding site found in the 3' untranslated region of mRNA encoded by ST7, corresponding to a HOST TARGET binding site such as BINDING SITE I, BINDING SITE II or BINDING SITE III. Table 2 illustrates the complementarity of the nucleotide sequences of ST7 BINDING SITE, designated SEQ ID:22429, to the nucleotide sequence of VGAM1063 RNA, herein designated VGAM RNA, also designated SEQ ID:3774.

Another function of VGAM1063 is therefore inhibition of Suppression of Tumorigenicity 7 (ST7, Accession NM_021908), a gene which has a role in regulating cell-environment or cell-cell interactions. Accordingly, utilities of VGAM1063 include diagnosis, prevention and treatment of diseases and clinical conditions associated with ST7. The function of ST7 and its association with various diseases and clinical conditions, has been established by previous studies, as described hereinabove with reference to VGAM107. APELIN (Accession NM_017413) is another VGAM1063 host target gene. APELIN BINDING SITE is HOST TARGET binding site found in the 3' untranslated region of mRNA encoded by APELIN, corresponding to a HOST TARGET binding site such as BINDING SITE I, BINDING SITE II or BINDING SITE III. Table 2 illustrates the complementarity of the nucleotide sequences of APELIN BINDING SITE, designated SEQ ID:18871, to the nucleotide sequence of VGAM1063 RNA, herein designated VGAM RNA, also designated SEQ ID:3774.

Another function of VGAM1063 is therefore inhibition of APELIN (Accession NM_017413). Accordingly, utilities of VGAM1063 include diagnosis, prevention and treatment of diseases and clinical conditions associated with APELIN. Chromosome 5 Open Reading Frame 6 (C5orf6, Accession NM_016605) is another VGAM1063 host target gene. C5orf6 BINDING SITE is HOST TARGET binding site found in the 3' untranslated region of mRNA encoded by C5orf6, corresponding to a HOST TARGET binding site such as BINDING SITE I, BINDING SITE II or BINDING SITE III. Table 2 illustrates the complementarity of the nucleotide sequences of C5orf6 BINDING SITE, designated SEQ ID:18701, to the nucleotide sequence of VGAM1063 RNA, herein designated VGAM RNA, also designated SEQ ID:3774.

Another function of VGAM1063 is therefore inhibition of Chromosome 5 Open Reading Frame 6 (C5orf6, Accession NM_016605). Accordingly, utilities of VGAM1063 include diagnosis, prevention and treatment of diseases and clinical conditions associated with C5orf6. DJ37E16.5 (Accession NM_020315) is another VGAM1063 host target gene. DJ37E16.5 BINDING SITE is HOST TARGET binding site found in the 3' untranslated region of mRNA encoded by DJ37E16.5, corresponding to a HOST TARGET binding site such as BINDING SITE I, BINDING SITE II or BINDING SITE III. Table 2 illustrates the complementarity of the nucleotide sequences of DJ37E16.5 BINDING SITE, designated SEQ ID:21575, to the nucleotide sequence of VGAM1063 RNA, herein designated VGAM RNA, also designated SEQ ID:3774.

Another function of VGAM1063 is therefore inhibition of DJ37E16.5 (Accession NM_020315). Accordingly, utilities of VGAM1063 include diagnosis, prevention and treatment of diseases and clinical conditions associated with DJ37E16.5. DKFZP434L1435 (Accession XM_166401) is another VGAM1063 host target gene. DKFZP434L1435 BINDING SITE1 through DKFZP434L1435 BINDING SITE3 are HOST TARGET binding sites found in untranslated regions of mRNA encoded by DKFZP434L1435, corresponding to HOST TARGET binding sites such as BINDING SITE I, BINDING SITE II or BINDING SITE III. Table 2 illustrates the complementarity of the nucleotide sequences of DKFZP434L1435 BINDING SITE1 through DKFZP434L1435 BINDING SITE3, designated SEQ ID:44267, SEQ ID:46664 and SEQ ID:46702 respectively, to the nucleotide sequence of VGAM1063 RNA, herein designated VGAM RNA, also designated SEQ ID:3774.

Another function of VGAM1063 is therefore inhibition of DKFZP434L1435 (Accession XM_166401). Accordingly, utilities of VGAM1063 include diagnosis, prevention and treatment of diseases and clinical conditions associated with DKFZP434L1435. FLJ10074 (Accession NM_017988) is another VGAM1063 host target gene. FLJ10074 BINDING SITE is HOST TARGET binding site found in the 5' untranslated region of mRNA encoded by FLJ10074, corresponding to a HOST TARGET binding site such as BINDING SITE I, BINDING SITE II or BINDING SITE III. Table 2 illustrates the complementarity of the nucleotide sequences of FLJ10074 BINDING SITE, designated SEQ ID:19719, to the nucleotide sequence of VGAM1063 RNA, herein designated VGAM RNA, also designated SEQ ID:3774.

Another function of VGAM1063 is therefore inhibition of FLJ10074 (Accession NM_017988). Accordingly, utilities of VGAM1063 include diagnosis, prevention and treatment of diseases and clinical conditions associated with FLJ10074. FLJ13204 (Accession NM_024761) is another VGAM1063 host target gene. FLJ13204 BINDING SITE is HOST TARGET binding site found in the 3' untranslated region of mRNA encoded by FLJ13204, corresponding to a HOST TARGET binding site such as BINDING SITE I, BINDING SITE II or BINDING SITE III. Table 2 illustrates the complementarity of the nucleotide sequences of FLJ13204 BINDING SITE, designated SEQ ID:24116, to the nucleotide sequence of VGAM1063 RNA, herein designated VGAM RNA, also designated SEQ ID:3774.

Another function of VGAM1063 is therefore inhibition of FLJ13204 (Accession NM_024761). Accordingly, utilities of VGAM1063 include diagnosis, prevention and treatment of diseases and clinical conditions associated with FLJ13204. FLJ22671 (Accession NM_024861) is another VGAM1063 host target gene. FLJ22671 BINDING SITE is HOST TARGET binding site found in the 3' untranslated region of mRNA encoded by FLJ22671, corresponding to a HOST TARGET binding site such as BINDING SITE I, BINDING SITE II or BINDING SITE III. Table 2 illustrates the complementarity of the nucleotide sequences of FLJ22671 BINDING SITE, designated SEQ ID:24294, to the nucleotide sequence of VGAM1063 RNA, herein designated VGAM RNA, also designated SEQ ID:3774.

Another function of VGAM1063 is therefore inhibition of FLJ22671 (Accession NM_024861). Accordingly, utilities of VGAM1063 include diagnosis, prevention and treatment of diseases and clinical conditions associated with FLJ22671. Glycoprotein V (platelet) (GP5, Accession NM_004488) is another VGAM1063 host target gene. GP5 BINDING SITE is HOST TARGET binding site found in the 3' untranslated region of mRNA encoded by GP5, corresponding to a HOST TARGET binding site such as BINDING SITE I, BINDING SITE II or BINDING SITE III. Table 2 illustrates the complementarity of the nucleotide sequences of GP5 BINDING SITE, designated SEQ ID:10817, to the nucleotide sequence of VGAM1063 RNA, herein designated VGAM RNA, also designated SEQ ID:3774.

Another function of VGAM1063 is therefore inhibition of Glycoprotein V (platelet) (GP5, Accession NM_004488). Accordingly, utilities of VGAM1063 include diagnosis, prevention and treatment of diseases and clinical conditions associated with GP5. KIAA0296 (Accession NM_014699) is another VGAM1063 host target gene. KIAA0296 BINDING SITE is HOST TARGET binding site found in the 3' untranslated region of mRNA encoded by KIAA0296, corresponding to a HOST TARGET binding site such as BINDING SITE I, BINDING SITE II or BINDING SITE III. Table 2 illustrates the complementarity of the nucleotide sequences of KIAA0296 BINDING SITE, designated SEQ ID:16220, to the nucleotide sequence of VGAM1063 RNA, herein designated VGAM RNA, also designated SEQ ID:3774.

Another function of VGAM1063 is therefore inhibition of KIAA0296 (Accession NM_014699). Accordingly, utilities of VGAM1063 include diagnosis, prevention and treatment of diseases and clinical conditions associated with KIAA0296. KIAA0429 (Accession NM_014751) is another VGAM1063 host target gene. KIAA0429 BINDING SITE is HOST TARGET binding site found in the 5' untranslated region of mRNA encoded by KIAA0429, corresponding to a HOST TARGET binding site such as BINDING SITE I, BINDING SITE II or BINDING SITE III. Table 2 illustrates the complementarity of the nucleotide sequences of KIAA0429 BINDING SITE, designated SEQ ID:16469, to the nucleotide sequence of VGAM1063 RNA, herein designated VGAM RNA, also designated SEQ ID:3774.

Another function of VGAM1063 is therefore inhibition of KIAA0429 (Accession NM_014751). Accordingly, utilities of VGAM1063 include diagnosis, prevention and treatment of diseases and clinical conditions associated with KIAA0429. KIAA1193 (Accession XM_041843) is another VGAM1063 host target gene. KIAA1193 BINDING SITE is HOST TARGET binding site found in the 3' untranslated region of mRNA encoded by KIAA1193, corresponding to a HOST TARGET binding site such as BINDING SITE I, BINDING SITE II or BINDING SITE III. Table 2 illustrates the complementarity of the nucleotide sequences of KIAA1193 BINDING SITE, designated SEQ ID:33580, to the nucleotide sequence of VGAM1063 RNA, herein designated VGAM RNA, also designated SEQ ID:3774.

Another function of VGAM1063 is therefore inhibition of KIAA1193 (Accession XM_041843). Accordingly, utilities of VGAM1063 include diagnosis, prevention and treatment of diseases and clinical conditions associated with KIAA1193. KIAA1322 (Accession XM_052626) is another VGAM1063 host target gene. KIAA1322 BINDING SITE is HOST TARGET binding site found in the 3' untranslated region of mRNA encoded by KIAA1322, corresponding to a HOST TARGET binding site such as BINDING SITE I, BINDING SITE II or BINDING SITE III. Table 2 illustrates the complementarity of the nucleotide sequences of KIAA1322 BINDING SITE, designated SEQ ID:36024, to the nucleotide sequence of VGAM1063 RNA, herein designated VGAM RNA, also designated SEQ ID:3774.

Another function of VGAM1063 is therefore inhibition of KIAA1322 (Accession XM_052626). Accordingly, utilities of VGAM1063 include diagnosis, prevention and treatment of diseases and clinical conditions associated with KIAA1322. KIAA1813 (Accession XM_046743) is another VGAM1063 host target gene. KIAA1813 BINDING SITE is HOST TARGET binding site found in the 5' untranslated region of mRNA encoded by KIAA1813, corresponding to a HOST TARGET binding site such as BINDING SITE I, BINDING SITE II or BINDING SITE III. Table 2 illustrates the complementarity of the nucleotide sequences of KIAA1813 BINDING SITE, designated SEQ ID:34810, to the nucleotide sequence of VGAM1063 RNA, herein designated VGAM RNA, also designated SEQ ID:3774.

Another function of VGAM1063 is therefore inhibition of KIAA1813 (Accession XM_046743). Accordingly, utilities of VGAM1063 include diagnosis, prevention and treatment of diseases and clinical conditions associated with KIAA1813. MGC19556 (Accession NM_033551) is another VGAM1063 host target gene. MGC19556 BINDING SITE is HOST TARGET binding site found in the 5' untranslated region of mRNA encoded by MGC19556, corresponding to a HOST TARGET binding site such as BINDING SITE I, BINDING SITE II or BINDING SITE III. Table 2 illustrates the complementarity of the nucleotide sequences of MGC19556 BINDING SITE, designated SEQ ID:27316, to the nucleotide sequence of VGAM1063 RNA, herein designated VGAM RNA, also designated SEQ ID:3774.

Another function of VGAM1063 is therefore inhibition of MGC19556 (Accession NM_033551). Accordingly, utilities of VGAM1063 include diagnosis, prevention and treatment of diseases and clinical conditions associated with MGC19556. MGC2780 (Accession NM_025266) is another VGAM1063 host target gene. MGC2780 BINDING SITE is HOST TARGET binding site found in the 5' untranslated region of mRNA encoded by MGC2780, corresponding to a HOST TARGET binding site such as BINDING SITE I, BINDING SITE II or BINDING SITE III. Table 2 illustrates the complementarity of the nucleotide sequences of MGC2780 BINDING SITE, designated SEQ ID:24934, to the nucleotide sequence of VGAM1063 RNA, herein designated VGAM RNA, also designated SEQ ID:3774.

Another function of VGAM1063 is therefore inhibition of MGC2780 (Accession NM_025266). Accordingly, utilities of VGAM1063 include diagnosis, prevention and treatment of diseases and clinical conditions associated with MGC2780. Phosphatase, Orphan 1 (phospho1, Accession XM_091572) is another VGAM1063 host target gene. phospho1 BINDING SITE is HOST TARGET binding site found in the 5' untranslated region of mRNA encoded by phospho1, corresponding to a HOST TARGET binding site such as BINDING SITE I, BINDING SITE II or BINDING SITE III. Table 2 illustrates the complementarity of the nucleotide sequences of phospho1 BINDING SITE, designated SEQ ID:40061, to the nucleotide sequence of VGAM1063 RNA, herein designated VGAM RNA, also designated SEQ ID:3774.

Another function of VGAM1063 is therefore inhibition of Phosphatase, Orphan 1 (phospho1, Accession XM_091572). Accordingly, utilities of VGAM1063 include diagnosis, prevention and treatment of diseases and clinical conditions associated with phospho1. SNRK (Accession NM_017719) is another VGAM1063 host target gene. SNRK BINDING SITE is HOST TARGET binding site found in the 3' untranslated region of mRNA encoded by SNRK, corresponding to a HOST TARGET binding site such as BINDING SITE I, BINDING SITE II or BINDING SITE III. Table 2 illustrates the complementarity of the nucleotide sequences of SNRK BINDING SITE, designated SEQ ID:19309, to the nucleotide sequence of VGAM1063 RNA, herein designated VGAM RNA, also designated SEQ ID:3774.

Another function of VGAM1063 is therefore inhibition of SNRK (Accession NM_017719). Accordingly, utilities of VGAM1063 include diagnosis, prevention and treatment of diseases and clinical conditions associated with SNRK. Torsin Family 2, Member A (TOR2A, Accession NM_130459) is another VGAM1063 host target gene. TOR2A BINDING SITE is HOST TARGET binding site found in the 3' untranslated region of mRNA encoded by TOR2A, corresponding to a HOST TARGET binding site such as BINDING SITE I, BINDING SITE II or BINDING SITE III. Table 2 illustrates the complementarity of the nucleotide sequences of TOR2A BINDING SITE, designated SEQ ID:28218, to the nucleotide sequence of VGAM1063 RNA, herein designated VGAM RNA, also designated SEQ ID:3774.

Another function of VGAM1063 is therefore inhibition of Torsin Family 2, Member A (TOR2A, Accession NM_130459). Accordingly, utilities of VGAM1063 include diagnosis, prevention and treatment of diseases and clinical conditions associated with TOR2A. Tumor Protein P53 Inducible Nuclear Protein 1 (TP53INP1, Accession NM_033285) is another VGAM1063 host target gene. TP53INP1 BINDING SITE is HOST TARGET binding site found in the 5' untranslated region of mRNA encoded by TP53INP1, corresponding to a HOST TARGET binding site such as BINDING SITE I, BINDING SITE II or BINDING SITE III. Table 2 illustrates the complementarity of the nucleotide sequences of TP53INP1 BINDING SITE, designated SEQ ID:27106, to the nucleotide sequence of VGAM1063 RNA, herein designated VGAM RNA, also designated SEQ ID:3774.

Another function of VGAM1063 is therefore inhibition of Tumor Protein P53 Inducible Nuclear Protein 1 (TP53INP1, Accession NM_033285). Accordingly, utilities of VGAM1063 include diagnosis, prevention and treatment of diseases and clinical conditions associated with TP53INP1. Zinc Finger Protein 304 (ZNF304, Accession NM_020657) is another VGAM1063 host target gene. ZNF304 BINDING SITE is HOST TARGET binding site found in the 3' untranslated region of mRNA encoded by ZNF304, corresponding to a HOST TARGET binding site such as BINDING SITE I, BINDING SITE II or BINDING SITE III. Table 2 illustrates the complementarity of the nucleotide sequences of ZNF304 BINDING SITE, designated SEQ ID:21829, to the nucleotide sequence of VGAM1063 RNA, herein designated VGAM RNA, also designated SEQ ID:3774.

Another function of VGAM1063 is therefore inhibition of Zinc Finger Protein 304 (ZNF304, Accession NM_020657). Accordingly, utilities of VGAM1063 include diagnosis, prevention and treatment of diseases and clinical conditions associated with ZNF304. LOC146733 (Accession XM_097076) is another VGAM1063 host target gene. LOC146733 BINDING SITE1 and LOC146733 BINDING SITE2 are HOST TARGET binding sites found in untranslated regions of mRNA encoded by LOC146733, corresponding to HOST TARGET binding sites such as BINDING SITE I, BINDING SITE II or BINDING SITE III. Table 2 illustrates the complementarity of the nucleotide sequences of LOC146733 BINDING SITE1 and LOC146733 BINDING SITE2, designated SEQ ID:40727 and SEQ ID:40728 respectively, to the nucleotide sequence of VGAM1063 RNA, herein designated VGAM RNA, also designated SEQ ID:3774.

Another function of VGAM1063 is therefore inhibition of LOC146733 (Accession XM_097076). Accordingly, utilities of VGAM1063 include diagnosis, prevention and treatment of diseases and clinical conditions associated with LOC146733. LOC157931 (Accession XM_098845) is another VGAM1063 host target gene. LOC157931 BINDING SITE is HOST TARGET binding site found in the 3' untranslated region of mRNA encoded by LOC157931, corresponding to a HOST TARGET binding site such as BINDING SITE I, BINDING SITE II or BINDING SITE III. Table 2 illustrates the complementarity of the nucleotide sequences of LOC157931 BINDING SITE, designated SEQ ID:41902, to the nucleotide sequence of VGAM1063 RNA, herein designated VGAM RNA, also designated SEQ ID:3774.

Another function of VGAM1063 is therefore inhibition of LOC157931 (Accession XM_098845). Accordingly, utilities of VGAM1063 include diagnosis, prevention and treatment of diseases and clinical conditions associated with LOC157931. LOC166341 (Accession XM_093804) is another VGAM1063 host target gene. LOC166341 BINDING SITE is HOST TARGET binding site found in the 3' untranslated region of mRNA encoded by LOC166341, corresponding to a HOST TARGET binding site such as BINDING SITE I, BINDING SITE II or BINDING SITE III. Table 2 illustrates the complementarity of the nucleotide sequences of LOC166341 BINDING SITE, designated SEQ ID:40212, to the nucleotide sequence of VGAM1063 RNA, herein designated VGAM RNA, also designated SEQ ID:3774.

Another function of VGAM1063 is therefore inhibition of LOC166341 (Accession XM_093804). Accordingly, utilities of VGAM1063 include diagnosis, prevention and treatment of diseases and clinical conditions associated with LOC166341. LOC220020 (Accession XM_167821) is another VGAM1063 host target gene. LOC220020 BINDING SITE is HOST TARGET binding site found in the 5' untranslated region of mRNA encoded by LOC220020, corresponding to a HOST TARGET binding site such as BINDING SITE I, BINDING SITE II or BINDING SITE III. Table 2 illustrates the complementarity of the nucleotide sequences of LOC220020 BINDING SITE, designated SEQ ID:44863, to the nucleotide sequence of VGAM1063 RNA, herein designated VGAM RNA, also designated SEQ ID:3774.

Another function of VGAM1063 is therefore inhibition of LOC220020 (Accession XM_167821). Accordingly, utilities of VGAM1063 include diagnosis, prevention and treatment of diseases and clinical conditions associated with LOC220020. LOC222070 (Accession XM_168433) is another VGAM1063 host target gene. LOC222070 BINDING SITE is HOST TARGET binding site found in the 5' untranslated region of mRNA encoded by LOC222070, corresponding to a HOST TARGET binding site such as BINDING SITE I, BINDING SITE II or BINDING SITE III. Table 2 illustrates the complementarity of the nucleotide sequences of LOC222070 BINDING SITE, designated SEQ ID:45178, to the nucleotide sequence of VGAM1063 RNA, herein designated VGAM RNA, also designated SEQ ID:3774.

Another function of VGAM1063 is therefore inhibition of LOC222070 (Accession XM_168433). Accordingly, utilities of VGAM1063 include diagnosis, prevention and treatment of diseases and clinical conditions associated with LOC222070. LOC257490 (Accession XM_175163) is another VGAM1063 host target gene. LOC257490 BINDING SITE is HOST TARGET binding site found in the 5' untranslated region of mRNA encoded by LOC257490, corresponding to a HOST TARGET binding site such as BINDING SITE I, BINDING SITE II or BINDING SITE III. Table 2 illustrates the complementarity of the nucleotide sequences of LOC257490 BINDING SITE, designated SEQ ID:46647, to the nucleotide sequence of VGAM1063 RNA, herein designated VGAM RNA, also designated SEQ ID:3774.

Another function of VGAM1063 is therefore inhibition of LOC257490 (Accession XM_175163). Accordingly, utilities of VGAM1063 include diagnosis, prevention and treatment of diseases and clinical conditions associated with LOC257490. LOC90784 (Accession XM_034109) is another VGAM1063 host target gene. LOC90784 BINDING SITE is HOST TARGET binding site found in the 5' untranslated region of mRNA encoded by LOC90784, corresponding to a HOST TARGET binding site such as BINDING SITE I, BINDING SITE II or BINDING SITE III. Table 2 illustrates the complementarity of the nucleotide sequences of LOC90784 BINDING SITE, designated SEQ ID:32004, to the nucleotide sequence of VGAM1063 RNA, herein designated VGAM RNA, also designated SEQ ID:3774.

Another function of VGAM1063 is therefore inhibition of LOC90784 (Accession XM_034109). Accordingly, utilities of VGAM1063 include diagnosis, prevention and treatment of diseases and clinical conditions associated with LOC90784. FIG. 1 further provides a conceptual description of a novel bioinformatically detected viral gene of the present invention, referred to here as Viral Genomic Address Messenger 1064 (VGAM1064) viral gene, which modulates expression of respective host target genes thereof, the function and utility of which host target genes is known in the art.

VGAM1064 is a novel bioinformatically detected regulatory, non protein coding, viral micro RNA (miRNA) gene. The method by which VGAM1064 was detected is described hereinabove with reference to FIGS. 1-8.

VGAM1064 gene, herein designated VGAM GENE, is a viral gene contained in the genome of Tulip Virus X. VGAM1064 host target gene, herein designated VGAM HOST TARGET GENE, is a human gene contained in the human genome.

VGAM1064 gene encodes a VGAM1064 precursor RNA, herein designated VGAM PRECURSOR RNA. Similar to other miRNA genes, and unlike most ordinary genes, VGAM1064 precursor RNA does not encode a protein. A nucleotide sequence identical or highly similar to the nucleotide sequence of VGAM1064 precursor RNA is designated SEQ ID:1050, and is provided hereinbelow with reference to the sequence listing part. Nucleotide sequence SEQ ID:1050 is located at position 3436 relative to the genome of Tulip Virus X.

VGAM1064 precursor RNA folds onto itself, forming VGAM1064 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1064 folded precursor RNA into VGAM1064 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1064 RNA is designated SEQ ID:3775, and is provided hereinbelow with reference to the sequence listing part.

VGAM1064 host target gene, herein designated VGAM HOST TARGET GENE, encodes a corresponding messenger RNA, VGAM1064 host target RNA, herein designated VGAM HOST TARGET RNA. VGAM1064 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1064 RNA, herein designated VGAM RNA, binds complementarily to one or more host target binding sites located in untranslated regions of VGAM1064 host target RNA, herein designated VGAM HOST TARGET RNA. This complementary binding is due to the fact that the nucleotide sequence of VGAM1064 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1064 RNA, herein designated VGAM RNA, may have a different number of host target binding sites in untranslated regions of a VGAM1064 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1064 RNA, herein designated VGAM RNA, to host target binding sites on VGAM1064 host target RNA, herein designated VGAM HOST TARGET RNA, such as BINDING SITE I, BINDING SITE II and BINDING SITE III, inhibits translation of VGAM1064 host target RNA into VGAM1064 host target protein, herein designated VGAM HOST TARGET PROTEIN. VGAM host target protein is therefore outlined by a broken line.

It is appreciated that VGAM1064 host target gene, herein designated VGAM HOST TARGET GENE, in fact represents a plurality of VGAM1064 host target genes. The mRNA of each one of this plurality of VGAM1064 host target genes comprises one or more host target binding sites, each having a nucleotide sequence which is at least partly complementary to VGAM1064 RNA, herein designated VGAM RNA, and which when bound by VGAM1064 RNA causes inhibition of translation of respective one or more VGAM1064 host target proteins.

It is further appreciated by one skilled in the art that the mode of translational inhibition illustrated by FIG. 1 with specific reference to translational inhibition exerted by VGAM1064 gene, herein designated VGAM GENE, on one or more VGAM1064 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1064 is inhibition of expression of host target genes, as part of a novel viral mechanism of attacking a host. Accordingly, utilities of VGAM1064 include diagnosis, prevention and treatment of viral infection by Tulip Virus X. Specific functions, and accordingly utilities, of VGAM1064 correlate with, and may be deduced from, the identity of the host target genes which VGAM1064 binds and inhibits, and the function of these host target genes, as elaborated hereinbelow.

Nucleotide sequences of the VGAM1064 precursor RNA, herein designated VGAM PRECURSOR RNA, and of the 'diced' VGAM1064 RNA, herein designated VGAM RNA, and a schematic representation of the secondary folding of VGAM1064 folded precursor RNA, herein designated VGAM FOLDED PRECURSOR RNA, of VGAM1064 are further described hereinbelow with reference to Table 1.

Nucleotide sequences of host target binding sites, such as BINDING SITE-I, BINDING SITE-II and BINDING SITE-III of FIG. 1, found on VGAM1064 host target RNA, and schematic representation of the complementarity of each of these host target binding sites to VGAM1064 RNA, herein designated VGAM RNA, are described hereinbelow with reference to Table 2.

As mentioned hereinabove with reference to FIG. 1, a function of VGAM1064 gene, herein designated VGAM is inhibition of expression of VGAM1064 target genes. It is appreciated that specific functions, and accordingly utilities, of VGAM1064 correlate with, and may be deduced from, the identity of the target genes which VGAM1064 binds and inhibits, and the function of these target genes, as elaborated hereinbelow.

UDP-Gal:betaGlcNAc Beta 1,4-Galactosyltransferase, Polypeptide 5 (B4GALT5, Accession NM_004776) is a VGAM1064 host target gene. B4GALT5 BINDING SITE is HOST TARGET binding site found in the 3' untranslated region of mRNA encoded by B4GALT5, corresponding to a HOST TARGET binding site such as BINDING SITE I, BINDING SITE II or BINDING SITE III. Table 2 illustrates the complementarity of the nucleotide sequences of B4GALT5 BINDING SITE, designated SEQ ID:11165, to the nucleotide sequence of VGAM1064 RNA, herein designated VGAM RNA, also designated SEQ ID:3775.

A function of VGAM1064 is therefore inhibition of UDP-Gal:betaGlcNAc Beta 1,4-Galactosyltransferase, Polypeptide 5 (B4GALT5, Accession NM_004776). Accordingly, utilities of VGAM1064 include diagnosis, prevention and treatment of diseases and clinical conditions associated with B4GALT5. NIMA (never in mitosis gene a)-related Kinase 6 (NEK6, Accession NM_014397) is another VGAM1064 host target gene. NEK6 BINDING SITE is HOST TARGET binding site found in the 3' untranslated region of mRNA encoded by NEK6, corresponding to a HOST TARGET binding site such as BINDING SITE I, BINDING SITE II or BINDING SITE III. Table 2 illustrates the complementarity of the nucleotide sequences of NEK6 BINDING SITE, designated SEQ ID:15739, to the nucleotide sequence of VGAM1064 RNA, herein designated VGAM RNA, also designated SEQ ID:3775.

Another function of VGAM1064 is therefore inhibition of NIMA (never in mitosis gene a)-related Kinase 6 (NEK6, Accession NM_014397), a gene which regulates nuclear and cytoplasmic aspects of the mitotic cycle. Accordingly, utilities of VGAM1064 include diagnosis, prevention and treatment of diseases and clinical conditions associated with NEK6. The function of NEK6 and its association with various diseases and clinical conditions, has been established by previous studies, as described hereinabove with reference to VGAM426. FLJ13397 (Accession NM_024948) is another VGAM1064 host target gene. FLJ13397 BINDING SITE is HOST TARGET binding site found in the 3' untranslated region of mRNA encoded by FLJ13397, corresponding to a HOST TARGET binding site such as BINDING SITE I, BINDING SITE II or BINDING SITE III. Table 2 illustrates the complementarity of the nucleotide sequences of FLJ13397 BINDING SITE, designated SEQ ID:24502, to the nucleotide sequence of VGAM1064 RNA, herein designated VGAM RNA, also designated SEQ ID:3775.

Another function of VGAM1064 is therefore inhibition of FLJ13397 (Accession NM_024948). Accordingly, utilities of VGAM1064 include diagnosis, prevention and treatment of diseases and clinical conditions associated with FLJ13397. KIAA0993 (Accession XM_034413) is another VGAM1064 host target gene. KIAA0993 BINDING SITE is HOST TARGET binding site found in the 3' untranslated region of mRNA encoded by KIAA0993, corresponding to a HOST TARGET binding site such as BINDING SITE I, BINDING SITE II or BINDING SITE III. Table 2 illustrates the complementarity of the nucleotide sequences of KIAA0993 BINDING SITE, designated SEQ ID:32077, to the nucleotide sequence of VGAM1064 RNA, herein designated VGAM RNA, also designated SEQ ID:3775.

Another function of VGAM1064 is therefore inhibition of KIAA0993 (Accession XM_034413). Accordingly, utilities of VGAM1064 include diagnosis, prevention and treatment of diseases and clinical conditions associated with KIAA0993. Neuron Navigator 3 (NAV3, Accession NM_014903) is another VGAM1064 host target gene. NAV3 BINDING SITE is HOST TARGET binding site found in the 3' untranslated region of mRNA encoded by NAV3, corresponding to a HOST TARGET binding site such as BINDING SITE I, BINDING SITE II or BINDING SITE III. Table 2 illustrates the complementarity of the nucleotide sequences of NAV3 BINDING SITE, designated SEQ ID:17089, to the nucleotide sequence of VGAM1064 RNA, herein designated VGAM RNA, also designated SEQ ID:3775.

Another function of VGAM1064 is therefore inhibition of Neuron Navigator 3 (NAV3, Accession NM_014903). Accordingly, utilities of VGAM1064 include diagnosis, prevention and treatment of diseases and clinical conditions associated with NAV3. Signal Transducing Adaptor Molecule (SH3 domain and ITAM motif) 2 (STAM2, Accession NM_005843) is another VGAM1064 host target gene. STAM2 BINDING SITE is HOST TARGET binding site found in the 3' untranslated region of mRNA encoded by STAM2, corresponding to a HOST TARGET binding site such as BINDING SITE I, BINDING SITE II or BINDING SITE III. Table 2 illustrates the complementarity of the nucleotide sequences of STAM2 BINDING SITE, designated SEQ ID:12457, to the nucleotide sequence of VGAM1064 RNA, herein designated VGAM RNA, also designated SEQ ID:3775.

Another function of VGAM1064 is therefore inhibition of Signal Transducing Adaptor Molecule (SH3 domain and ITAM motif) 2 (STAM2, Accession NM_005843). Accordingly, utilities of VGAM1064 include diagnosis, prevention and treatment of diseases and clinical conditions associated with STAM2. LOC146452 (Accession XM_085473) is another VGAM1064 host target gene. LOC146452 BINDING SITE is HOST TARGET binding site found in the 3' untranslated region of mRNA encoded by LOC146452, corresponding to a HOST TARGET binding site such as BINDING SITE I, BINDING SITE II or BINDING SITE III. Table 2 illustrates the complementarity of the nucleotide sequences of LOC146452 BINDING SITE, designated SEQ ID:38163, to the nucleotide sequence of VGAM1064 RNA, herein designated VGAM RNA, also designated SEQ ID:3775.

Another function of VGAM1064 is therefore inhibition of LOC146452 (Accession XM_085473). Accordingly, utilities of VGAM1064 include diagnosis, prevention and treatment of diseases and clinical conditions associated with LOC146452. LOC149153 (Accession XM_097599) is another VGAM1064 host target gene. LOC149153 BINDING SITE is HOST TARGET binding site found in the 5' untranslated region of mRNA encoded by LOC149153, corresponding to a HOST TARGET binding site such as BINDING SITE I, BINDING SITE II or BINDING SITE III. Table 2 illustrates the complementarity of the nucleotide sequences of LOC149153 BINDING SITE, designated SEQ ID:40963, to the nucleotide sequence of VGAM1064 RNA, herein designated VGAM RNA, also designated SEQ ID:3775.

Another function of VGAM1064 is therefore inhibition of LOC149153 (Accession XM_097599). Accordingly, utilities of VGAM1064 include diagnosis, prevention and treatment of diseases and clinical conditions associated with LOC149153. LOC90750 (Accession XM_033868) is another VGAM1064 host target gene. LOC90750 BINDING SITE is HOST TARGET binding site found in the 3' untranslated region of mRNA encoded by LOC90750, corresponding to a HOST TARGET binding site such as BINDING SITE I, BINDING SITE II or BINDING SITE III. Table 2 illustrates the complementarity of the nucleotide sequences of LOC90750 BINDING SITE, designated SEQ ID:31964, to the nucleotide sequence of VGAM1064 RNA, herein designated VGAM RNA, also designated SEQ ID:3775.

Another function of VGAM1064 is therefore inhibition of LOC90750 (Accession XM_033868). Accordingly, utilities of VGAM1064 include diagnosis, prevention and treatment of diseases and clinical conditions associated with LOC90750. FIG. 1 further provides a conceptual description of a novel bioinformatically detected viral gene of the present invention, referred to here as Viral Genomic Address Messenger 1065 (VGAM1065) viral gene, which modulates expression of respective host target genes thereof, the function and utility of which host target genes is known in the art.

VGAM1065 is a novel bioinformatically detected regulatory, non protein coding, viral micro RNA (miRNA) gene. The method by which VGAM1065 was detected is described hereinabove with reference to FIGS. 1-8.

VGAM1065 gene, herein designated VGAM GENE, is a viral gene contained in the genome of Tulip Virus X. VGAM1065 host target gene, herein designated VGAM HOST TARGET GENE, is a human gene contained in the human genome.

VGAM1065 gene encodes a VGAM1065 precursor RNA, herein designated VGAM PRECURSOR RNA. Similar to other miRNA genes, and unlike most ordinary genes, VGAM1065 precursor RNA does not encode a protein. A nucleotide sequence identical or highly similar to the nucleotide sequence of VGAM1065 precursor RNA is designated SEQ ID:1051, and is provided hereinbelow with reference to the sequence listing part. Nucleotide sequence SEQ ID:1051 is located at position 1206 relative to the genome of Tulip Virus X.

VGAM1065 precursor RNA folds onto itself, forming VGAM1065 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1065 folded precursor RNA into VGAM1065 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1065 RNA is designated SEQ ID:3776, and is provided hereinbelow with reference to the sequence listing part.

VGAM1065 host target gene, herein designated VGAM HOST TARGET GENE, encodes a corresponding messenger RNA, VGAM1065 host target RNA, herein designated VGAM HOST TARGET RNA. VGAM1065 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1065 RNA, herein designated VGAM RNA, binds complementarily to one or more host target binding sites located in untranslated regions of VGAM1065 host target RNA, herein designated VGAM HOST TARGET RNA. This complementary binding is due to the fact that the nucleotide sequence of VGAM1065 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1065 RNA, herein designated VGAM RNA, may have a different number of host target binding sites in untranslated regions of a VGAM1065 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1065 RNA, herein designated VGAM RNA, to host target binding sites on VGAM1065 host target RNA, herein designated VGAM HOST TARGET RNA, such as BINDING SITE I, BINDING SITE II and BINDING SITE III, inhibits translation of VGAM1065 host target RNA into VGAM1065 host target protein, herein designated VGAM HOST TARGET PROTEIN. VGAM host target protein is therefore outlined by a broken line.

It is appreciated that VGAM1065 host target gene, herein designated VGAM HOST TARGET GENE, in fact represents a plurality of VGAM1065 host target genes. The mRNA of each one of this plurality of VGAM1065 host target genes comprises one or more host target binding sites, each having a nucleotide sequence which is at least partly complementary to VGAM1065 RNA, herein designated VGAM RNA, and which when bound by VGAM1065 RNA causes inhibition of translation of respective one or more VGAM1065 host target proteins.

It is further appreciated by one skilled in the art that the mode of translational inhibition illustrated by FIG. 1 with specific reference to translational inhibition exerted by VGAM1065 gene, herein designated VGAM GENE, on one or more VGAM1065 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1065 is inhibition of expression of host target genes, as part of a novel viral mechanism of attacking a host. Accordingly, utilities of VGAM1065 include diagnosis, prevention and treatment of viral infection by Tulip Virus X. Specific functions, and accordingly utilities, of VGAM1065 correlate with, and may be deduced from, the identity of the host target genes which VGAM1065 binds and inhibits, and the function of these host target genes, as elaborated hereinbelow.

Nucleotide sequences of the VGAM1065 precursor RNA, herein designated VGAM PRECURSOR RNA, and of the 'diced' VGAM1065 RNA, herein designated VGAM RNA, and a schematic representation of the secondary folding of VGAM1065 folded precursor RNA, herein designated VGAM FOLDED PRECURSOR RNA, of VGAM1065 are further described hereinbelow with reference to Table 1.

Nucleotide sequences of host target binding sites, such as BINDING SITE-I, BINDING SITE-II and BINDING SITE-III of FIG. 1, found on VGAM1065 host target RNA, and schematic representation of the complementarity of each of these host target binding sites to VGAM1065 RNA, herein designated VGAM RNA, are described hereinbelow with reference to Table 2.

As mentioned hereinabove with reference to FIG. 1, a function of VGAM1065 gene, herein designated VGAM is inhibition of expression of VGAM1065 target genes. It is appreciated that specific functions, and accordingly utilities, of VGAM1065 correlate with, and may be deduced from, the identity of the target genes which VGAM1065 binds and inhibits, and the function of these target genes, as elaborated hereinbelow.

Citron (rho-interacting, serine/threonine kinase 21) (CIT, Accession XM_045786) is a VGAM1065 host target gene. CIT BINDING SITE is HOST TARGET binding site found in the 3' untranslated region of mRNA encoded by CIT, corresponding to a HOST TARGET binding site such as BINDING SITE I, BINDING SITE II or BINDING SITE III. Table 2 illustrates the complementarity of the nucleotide sequences of CIT BINDING SITE, designated SEQ ID:34560, to the nucleotide sequence of VGAM1065 RNA, herein designated VGAM RNA, also designated SEQ ID:3776.

A function of VGAM1065 is therefore inhibition of Citron (rho-interacting, serine/threonine kinase 21) (CIT, Accession XM_045786), a gene which is increased several-fold by coexpression of constitutively active Rho. Accordingly, utilities of VGAM1065 include diagnosis, prevention and treatment of diseases and clinical conditions associated with CIT. The function of CIT and its association with various diseases and clinical conditions, has been established by previous studies, as described hereinabove with reference to VGAM393. Eukaryotic Translation Initiation Factor 4 Gamma, 2 (EIF4G2, Accession NM_001418) is another VGAM1065 host target gene. EIF4G2 BINDING SITE is HOST TARGET binding site found in the 3' untranslated region of mRNA encoded by EIF4G2, corresponding to a HOST TARGET binding site such as BINDING SITE I, BINDING SITE II or BINDING SITE III. Table 2 illustrates the complementarity of the nucleotide sequences of EIF4G2 BINDING SITE, designated SEQ ID:7115, to the nucleotide sequence of VGAM1065 RNA, herein designated VGAM RNA, also designated SEQ ID:3776.

Another function of VGAM1065 is therefore inhibition of Eukaryotic Translation Initiation Factor 4 Gamma, 2 (EIF4G2, Accession NM_001418), a gene which is a repressor of translation. Accordingly, utilities of VGAM1065 include diagnosis, prevention and treatment of diseases and clinical conditions associated with EIF4G2. The function of EIF4G2 has been established by previous studies. Imataka et al. (1997) used immunoprecipitation studies with HA- or FLAG-tagged proteins to show that p97 specifically binds to EIF4A and EIF3, but not to EIF4E (OMIM Ref. No. 133440) in vitro. Transient transfection experiments showed that p97 suppressed both cap-dependent and independent translation, and that overexpression of p97 reduced overall protein synthesis. Imataka et al. (1997) suggested that p97 is a general repressor of translation that acts by forming translationally inactive complexes. Levy-Strumpf et al. (1997) showed that while a fragment of DAP5 cDNA from the C-terminal region (encoding a 28-kD 'miniprotein') protected cells from IFNG-induced programmed cell death at low levels of expression, higher levels of expression were toxic. They proposed that the miniprotein may be a dominant-negative inhibitor of the essential DAP5 protein, and that DAP5 may play a specific role in apoptosis.

Full details of the abovementioned studies are described in the following publications, the disclosure of which are hereby incorporated by reference:

Imataka, H.; Olsen, H. S.; Sonenberg. N.: A new translational regulator with homology to eukaryotic translation initiation factor 4G. EMBO J. 16:817-825, 1997; and Levy-Strumpf, N.; Deiss, L. P.; Berissi, H.; Kimchi, A.: DAP-5, a novel homolog of eukaryotic translation initiation factor 4G isolated as a putative modulator of gamma interferon-indu.

Further studies establishing the function and utilities of EIF4G2 are found in John Hopkins OMIM database record ID 602325, and in sited publications numbered 6302-6303, 346 and 6304-6305 listed in the bibliography section hereinbelow, which are also hereby incorporated by reference. Nuclear Receptor Coactivator 4 (NCOA4, Accession NM_005437) is another VGAM1065 host target gene. NCOA4 BINDING SITE is HOST TARGET binding site found in the 3' untranslated region of mRNA encoded by NCOA4, corresponding to a HOST TARGET binding site such as BINDING SITE I, BINDING SITE II or BINDING SITE III. Table 2 illustrates the complementarity of the nucleotide sequences of NCOA4 BINDING SITE, designated SEQ ID:11923, to the nucleotide sequence of VGAM1065 RNA, herein designated VGAM RNA, also designated SEQ ID:3776.

Another function of VGAM1065 is therefore inhibition of Nuclear Receptor Coactivator 4 (NCOA4, Accession NM_005437), a gene which Binds and activates androgen receptor (AR) in ligand-dependent manner. Accordingly, utilities of VGAM1065 include diagnosis, prevention and treatment of diseases and clinical conditions associated with NCOA4. The function of NCOA4 and its association with various diseases and clinical conditions, has been established by previous studies, as described hereinabove with reference to VGAM420. FLJ11850 (Accession NM_022741) is another VGAM1065 host target gene. FLJ11850 BINDING SITE is HOST TARGET binding site found in the 3' untranslated region of mRNA encoded by FLJ11850, corresponding to a HOST TARGET binding site such as BINDING SITE I, BINDING SITE II or BINDING SITE III. Table 2 illustrates the complementarity of the nucleotide sequences of FLJ11850 BINDING SITE, designated SEQ ID:22948, to the nucleotide sequence of VGAM1065 RNA, herein designated VGAM RNA, also designated SEQ ID:3776.

Another function of VGAM1065 is therefore inhibition of FLJ11850 (Accession NM_022741). Accordingly, utilities of VGAM1065 include diagnosis, prevention and treatment of diseases and clinical conditions associated with FLJ11850. Golgi Autoantigen, Golgin Subfamily A, 1 (GOLGA1, Accession NM_002077) is another VGAM1065 host target gene. GOLGA1 BINDING SITE is HOST TARGET binding site found in the 3' untranslated region of mRNA encoded by GOLGA1, corresponding to a HOST TARGET binding site such as BINDING SITE I, BINDING SITE II or BINDING SITE III. Table 2 illustrates the complementarity of the nucleotide sequences of GOLGA1 BINDING SITE, designated SEQ ID:7859, to the nucleotide sequence of VGAM1065 RNA, herein designated VGAM RNA, also designated SEQ ID:3776.

Another function of VGAM1065 is therefore inhibition of Golgi Autoantigen, Golgin Subfamily A, 1 (GOLGA1, Accession NM_002077). Accordingly, utilities of VGAM1065 include diagnosis, prevention and treatment of diseases and clinical conditions associated with GOLGA1. FIG. 1 further provides a conceptual description of a novel bioinformatically detected viral gene of the present invention, referred to here as Viral Genomic Address Messenger 1066 (VGAM1066) viral gene, which modulates expression of respective host target genes thereof, the function and utility of which host target genes is known in the art.

VGAM1066 is a novel bioinformatically detected regulatory, non protein coding, viral micro RNA (miRNA) gene. The method by which VGAM1066 was detected is described hereinabove with reference to FIGS. 1-8.

VGAM1066 gene, herein designated VGAM GENE, is a viral gene contained in the genome of Tulip Virus X. VGAM1066 host target gene, herein designated VGAM HOST TARGET GENE, is a human gene contained in the human genome.

VGAM1066 gene encodes a VGAM1066 precursor RNA, herein designated VGAM PRECURSOR RNA. Similar to other miRNA genes, and unlike most ordinary genes, VGAM1066 precursor RNA does not encode a protein. A nucleotide sequence identical or highly similar to the nucleotide sequence of VGAM1066 precursor RNA is designated SEQ ID:1052, and is provided hereinbelow with reference to the sequence listing part. Nucleotide sequence SEQ ID:1052 is located at position 2880 relative to the genome of Tulip Virus X.

VGAM1066 precursor RNA folds onto itself, forming VGAM1066 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1066 folded precursor RNA into VGAM1066 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM1066 RNA is designated SEQ ID:3777, and is provided hereinbelow with reference to the sequence listing part.

VGAM1066 host target gene, herein designated VGAM HOST TARGET GENE, encodes a corresponding messenger RNA, VGAM1066 host target RNA, herein designated VGAM HOST TARGET RNA. VGAM1066 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1066 RNA, herein designated VGAM RNA, binds complementarily to one or more host target binding sites located in untranslated regions of VGAM1066 host target RNA, herein designated VGAM HOST TARGET RNA. This complementary binding is due to the fact that the nucleotide sequence of VGAM1066 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1066 RNA, herein designated VGAM RNA, may have a different number of host target binding sites in untranslated regions of a VGAM1066 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1066 RNA, herein designated VGAM RNA, to host target binding sites on VGAM1066 host target RNA, herein designated VGAM HOST TARGET RNA, such as BINDING SITE I, BINDING SITE II and BINDING SITE III, inhibits translation of VGAM1066 host target RNA into VGAM1066 host target protein, herein designated VGAM HOST TARGET PROTEIN. VGAM host target protein is therefore outlined by a broken line.

It is appreciated that VGAM1066 host target gene, herein designated VGAM HOST TARGET GENE, in fact represents a plurality of VGAM1066 host target genes. The mRNA of each one of this plurality of VGAM1066 host target genes comprises one or more host target binding sites, each having a nucleotide sequence which is at least partly complementary to VGAM1066 RNA, herein designated VGAM RNA, and which when bound by VGAM1066 RNA causes inhibition of translation of respective one or more VGAM1066 host target proteins.

It is further appreciated by one skilled in the art that the mode of translational inhibition illustrated by FIG. 1 with specific reference to translational inhibition exerted by VGAM1066 gene, herein designated VGAM GENE, on one or more VGAM1066 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1066 is inhibition of expression of host target genes, as part of a novel viral mechanism of attacking a host. Accordingly, utilities of VGAM1066 include diagnosis, prevention and treatment of viral infection by Tulip Virus X. Specific functions, and accordingly utilities, of VGAM1066 correlate with, and may be deduced from, the identity of the host target genes which VGAM1066 binds and inhibits, and the function of these target genes, as elaborated hereinbelow.

Nucleotide sequences of the VGAM1066 precursor RNA, herein designated VGAM PRECURSOR RNA, and of the 'diced' VGAM1066 RNA, herein designated VGAM RNA, and a schematic representation of the secondary folding of VGAM1066 folded precursor RNA, herein designated VGAM FOLDED PRECURSOR RNA, of VGAM1066 are further described hereinbelow with reference to Table 1.

Nucleotide sequences of host target binding sites, such as BINDING SITE-I, BINDING SITE-II and BINDING SITE-III of FIG. 1, found on VGAM1066 host target RNA, and schematic representation of the complementarity of each of these host target binding sites to VGAM1066 RNA, herein designated VGAM RNA, are described hereinbelow with reference to Table 2.

As mentioned hereinabove with reference to FIG. 1, a function of VGAM1066 gene, herein designated VGAM is inhibition of expression of VGAM1066 target genes. It is appreciated that specific functions, and accordingly utilities, of VGAM1066 correlate with, and may be deduced from, the identity of the target genes which VGAM1066 binds and inhibits, and the function of these target genes, as elaborated hereinbelow.

Retinal Degeneration, Slow (retinitis pigmentosa 7) (RDS, Accession NM_000322) is a VGAM1066 host target gene. RDS BINDING SITE is HOST TARGET binding site found in the 5' untranslated region of mRNA encoded by RDS, corresponding to a HOST TARGET binding site such as BINDING SITE I, BINDING SITE II or BINDING SITE III. Table 2 illustrates the complementarity of the nucleotide sequences of RDS BINDING SITE, designated SEQ ID:5861, to the nucleotide sequence of VGAM1066 RNA, herein designated VGAM RNA, also designated SEQ ID:3777.

A function of VGAM1066 is therefore inhibition of Retinal Degeneration, Slow (retinitis pigmentosa 7) (RDS, Accession NM_000322), a gene which may function as an adhesion molecule involved in stabilization and compaction of outer segment disks or in the maintenance of the curvature of the rim. Accordingly, utilities of VGAM1066 include diagnosis, prevention and treatment of diseases and clinical conditions associated with RDS. The function of RDS and its association with various diseases and clinical conditions, has been established by previous studies, as described hereinabove with reference to VGAM341. CUB and Sushi Multiple Domains 1 (CSMD1, Accession XM_054838) is another VGAM1066 host target gene. CSMD1 BINDING SITE is HOST TARGET binding site found in the 3' untranslated region of mRNA encoded by CSMD1, corresponding to a HOST TARGET binding site such as BINDING SITE I, BINDING SITE II or BINDING SITE III. Table 2 illustrates the complementarity of the nucleotide sequences of CSMD1 BINDING SITE, designated SEQ ID:36190, to the nucleotide sequence of VGAM1066 RNA, herein designated VGAM RNA, also designated SEQ ID:3777.

Another function of VGAM1066 is therefore inhibition of CUB and Sushi Multiple Domains 1 (CSMD1, Accession XM_054838). Accordingly, utilities of VGAM1066 include diagnosis, prevention and treatment of diseases and clinical conditions associated with CSMD1. GRWD (Accession NM_031485) is another VGAM1066 host target gene. GRWD BINDING SITE is HOST TARGET binding site found in the 3' untranslated region of mRNA encoded by GRWD, corresponding to a HOST TARGET binding site such as BINDING SITE I, BINDING SITE II or BINDING SITE III. Table 2 illustrates the complementarity of the nucleotide sequences of GRWD BINDING SITE, designated SEQ ID:25575, to the nucleotide sequence of VGAM1066 RNA, herein designated VGAM RNA, also designated SEQ ID:3777.

Another function of VGAM1066 is therefore inhibition of GRWD (Accession NM_031485). Accordingly, utilities of VGAM1066 include diagnosis, prevention and treatment of diseases and clinical conditions associated with GRWD. LOC257364 (Accession XM_170768) is another VGAM1066 host target gene. LOC257364 BINDING SITE is HOST TARGET binding site found in the 3' untranslated region of mRNA encoded by LOC257364, corresponding to a HOST TARGET binding site such as BINDING SITE I, BINDING SITE II or BINDING SITE III. Table 2 illustrates the complementarity of the nucleotide sequences of LOC257364 BINDING SITE, designated SEQ ID:45524, to the nucleotide sequence of VGAM1066 RNA, herein designated VGAM RNA, also designated SEQ ID:3777.

Another function of VGAM1066 is therefore inhibition of LOC257364 (Accession XM_170768). Accordingly, utilities of VGAM1066 include diagnosis, prevention and treatment of diseases and clinical conditions associated with LOC257364. FIG. 1 further provides a conceptual description of a novel bioinformatically detected viral gene of the present invention, referred to here as Viral Genomic Address Messenger 1067 (VGAM1067) viral gene, which modulates expression of respective host target genes thereof, the function and utility of which host target genes is known in the art.

VGAM1067 is a novel bioinformatically detected regulatory, non protein coding, viral micro RNA (miRNA) gene. The method by which VGAM1067 was detected is described hereinabove with reference to FIGS. 1-8.

VGAM1067 gene, herein designated VGAM GENE, is a viral gene contained in the genome of Porcine Epidemic Diarrhea Virus. VGAM1067 host target gene, herein designated VGAM HOST TARGET GENE, is a human gene contained in the human genome.

VGAM1067 gene encodes a VGAM1067 precursor RNA, herein designated VGAM PRECURSOR RNA. Similar to other miRNA genes, and unlike most ordinary genes, VGAM1067 precursor RNA does not encode a protein. A nucleotide sequence identical or highly similar to the nucleotide sequence of VGAM1067 precursor RNA is designated SEQ ID:1053, and is provided hereinbelow with reference to the sequence listing part. Nucleotide sequence SEQ ID:1053 is located at position 2170 relative to the genome of Porcine Epidemic Diarrhea Virus.

VGAM1067 precursor RNA folds onto itself, forming VGAM1067 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1067 folded precursor RNA into VGAM1067 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1067 RNA is designated SEQ ID:3778, and is provided hereinbelow with reference to the sequence listing part.

VGAM1067 host target gene, herein designated VGAM HOST TARGET GENE, encodes a corresponding messenger RNA, VGAM1067 host target RNA, herein designated VGAM HOST TARGET RNA. VGAM1067 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1067 RNA, herein designated VGAM RNA, binds complementarily to one or more host target binding sites located in untranslated regions of VGAM1067 host target RNA, herein designated VGAM HOST TARGET RNA. This complementary binding is due to the fact that the nucleotide sequence of VGAM1067 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1067 RNA, herein designated VGAM RNA, may have a different number of host target binding sites in untranslated regions of a VGAM1067 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1067 RNA, herein designated VGAM RNA, to host target binding sites on VGAM1067 host target RNA, herein designated VGAM HOST TARGET RNA, such as BINDING SITE I, BINDING SITE II and BINDING SITE III, inhibits translation of VGAM1067 host target RNA into VGAM1067 host target protein, herein designated VGAM HOST TARGET PROTEIN. VGAM host target protein is therefore outlined by a broken line.

It is appreciated that VGAM1067 host target gene, herein designated VGAM HOST TARGET GENE, in fact represents a plurality of VGAM1067 host target genes. The mRNA of each one of this plurality of VGAM1067 host target genes comprises one or more host target binding sites, each having a nucleotide sequence which is at least partly complementary to VGAM1067 RNA, herein designated VGAM RNA, and which when bound by VGAM1067 RNA causes inhibition of translation of respective one or more VGAM1067 host target proteins.

It is further appreciated by one skilled in the art that the mode of translational inhibition illustrated by FIG. 1 with specific reference to translational inhibition exerted by VGAM1067 gene, herein designated VGAM GENE, on one or more VGAM1067 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1067 is inhibition of expression of host target genes, as part of a novel viral mechanism of attacking a host. Accordingly, utilities of VGAM1067 include diagnosis, prevention and treatment of viral infection by Porcine Epidemic Diarrhea Virus. Specific functions, and accordingly utilities, of VGAM1067 correlate with, and may be deduced from, the identity of the host target genes which VGAM1067 binds and inhibits, and the function of these host target genes, as elaborated hereinbelow.

Nucleotide sequences of the VGAM1067 precursor RNA, herein designated VGAM PRECURSOR RNA, and of the 'diced' VGAM1067 RNA, herein designated VGAM RNA, and a schematic representation of the secondary folding of VGAM1067 folded precursor RNA, herein designated VGAM FOLDED PRECURSOR RNA, of VGAM1067 are further described hereinbelow with reference to Table 1.

Nucleotide sequences of host target binding sites, such as BINDING SITE-I, BINDING SITE-II and BINDING SITE-III of FIG. 1, found on VGAM1067 host target RNA, and schematic representation of the complementarity of each of these host target binding sites to VGAM1067 RNA, herein designated VGAM RNA, are described hereinbelow with reference to Table 2.

As mentioned hereinabove with reference to FIG. 1, a function of VGAM1067 gene, herein designated VGAM is inhibition of expression of VGAM1067 target genes. It is appreciated that specific functions, and accordingly utilities, of VGAM1067 correlate with, and may be deduced from, the identity of the target genes which VGAM1067 binds and inhibits, and the function of these target genes, as elaborated hereinbelow.

UDP-Gal:betaGlcNAc Beta 1,4-Galactosyltransferase, Polypeptide 6 (B4GALT6, Accession XM_008799) is a VGAM1067 host target gene. B4GALT6 BINDING SITE is HOST TARGET binding site found in the 3' untranslated region of mRNA encoded by B4GALT6, corresponding to a HOST TARGET binding site such as BINDING SITE I, BINDING SITE II or BINDING SITE III. Table 2 illustrates the complementarity of the nucleotide sequences of B4GALT6 BINDING SITE, designated SEQ ID:30094, to the nucleotide sequence of VGAM1067 RNA, herein designated VGAM RNA, also designated SEQ ID:3778.

A function of VGAM1067 is therefore inhibition of UDP-Gal:betaGlcNAc Beta1,4-Galactosyltransferase, Polypeptide 6 (B4GALT6, Accession XM_008799). Accordingly, utilities of VGAM1067 include diagnosis, prevention and treatment of diseases and clinical conditions associated with B4GALT6. CDC-like Kinase 2 (CLK2, Accession NM_001291) is another VGAM1067 host target gene. CLK2 BINDING SITE is HOST TARGET binding site found in the 3' untranslated region of mRNA encoded by CLK2, corresponding to a HOST TARGET binding site such as BINDING SITE I, BINDING SITE II or BINDING SITE III. Table 2 illustrates the complementarity of the nucleotide sequences of CLK2 BINDING SITE, designated SEQ ID:6973, to the nucleotide sequence of VGAM1067 RNA, herein designated VGAM RNA, also designated SEQ ID:3778.

Another function of VGAM1067 is therefore inhibition of CDC-like Kinase 2 (CLK2, Accession NM_001291), a gene which catalyzes the phosphorylation of proteins. Accordingly, utilities of VGAM1067 include diagnosis, prevention and treatment of diseases and clinical conditions associated with CLK2. The function of CLK2 and its association with various diseases and clinical conditions, has been established by previous studies, as described hereinabove with reference to VGAM356. Cannabinoid Receptor 1 (brain) (CNR1, Accession NM_016083) is another VGAM1067 host target gene. CNR1 BINDING SITE is HOST TARGET binding site found in the 3' untranslated region of mRNA encoded by CNR1, corresponding to a HOST TARGET binding site such as BINDING SITE I, BINDING SITE II or BINDING SITE III. Table 2 illustrates the complementarity of the nucleotide sequences of CNR1 BINDING SITE, designated SEQ ID:18164, to the nucleotide sequence of VGAM1067 RNA, herein designated VGAM RNA, also designated SEQ ID:3778.

Another function of VGAM1067 is therefore inhibition of Cannabinoid Receptor 1 (brain) (CNR1, Accession NM_016083), a gene which is involved in the cannabinoid-induced CNS effects. Accordingly, utilities of VGAM1067 include diagnosis, prevention and treatment of diseases and clinical conditions associated with CNR1. The function of CNR1 and its association with various diseases and clinical conditions, has been established by previous studies, as described hereinabove with reference to VGAM533. Laminin, Gamma 1 (formerly LAMB2) (LAMC1, Accession NM_002293) is another VGAM1067 host target gene. LAMC1 BINDING SITE is HOST TARGET binding site found in the 3' untranslated region of mRNA encoded by LAMC1, corresponding to a HOST TARGET binding site such as BINDING SITE I, BINDING SITE II or BINDING SITE III. Table 2 illustrates the complementarity of the nucleotide sequences of LAMC1 BINDING SITE, designated SEQ ID:8077, to the nucleotide sequence of VGAM1067 RNA, herein designated VGAM RNA, also designated SEQ ID:3778.

Another function of VGAM1067 is therefore inhibition of Laminin, Gamma 1 (formerly LAMB2) (LAMC1, Accession NM_002293), a gene which may mediate the attachment, migration, and organization of cells into tissues. Accordingly, utilities of VGAM1067 include diagnosis, prevention and treatment of diseases and clinical conditions associated with LAMC1. The function of LAMC1 and its association with various diseases and clinical conditions, has been established by previous studies, as described hereinabove with reference to VGAM812. KIAA1674 (Accession XM_044065) is another VGAM1067 host target gene. KIAA1674 BINDING SITE is HOST TARGET binding site found in the 3' untranslated region of mRNA encoded by KIAA1674, corresponding to a HOST TARGET binding site such as BINDING SITE I, BINDING SITE II or BINDING SITE III. Table 2 illustrates the complementarity of the nucleotide sequences of KIAA1674 BINDING SITE, designated SEQ ID:34114, to the nucleotide sequence of VGAM1067 RNA, herein designated VGAM RNA, also designated SEQ ID:3778.

Another function of VGAM1067 is therefore inhibition of KIAA1674 (Accession XM_044065). Accordingly, utilities of VGAM1067 include diagnosis, prevention and treatment of diseases and clinical conditions associated with KIAA1674. LOC147093 (Accession XM_097184) is another VGAM1067 host target gene. LOC147093 BINDING SITE is HOST TARGET binding site found in the 5' untranslated region of mRNA encoded by LOC147093, corresponding to a HOST TARGET binding site such as BINDING SITE I, BINDING SITE II or BINDING SITE III. Table 2 illustrates the complementarity of the nucleotide sequences of LOC147093 BINDING SITE, designated SEQ ID:40804, to the nucleotide sequence of VGAM1067 RNA, herein designated VGAM RNA, also designated SEQ ID:3778.

Another function of VGAM1067 is therefore inhibition of LOC147093 (Accession XM_097184). Accordingly, utilities of VGAM1067 include diagnosis, prevention and treatment of diseases and clinical conditions associated with LOC147093. LOC170395 (Accession XM_084325) is another VGAM1067 host target gene. LOC170395 BINDING SITE is HOST TARGET binding site found in the 3' untranslated region of mRNA encoded by LOC170395, corresponding to a HOST TARGET binding site such as BINDING SITE I, BINDING SITE II or BINDING SITE III. Table 2 illustrates the complementarity of the nucleotide sequences of LOC170395 BINDING SITE, designated SEQ ID:37546, to the nucleotide sequence of VGAM1067 RNA, herein designated VGAM RNA, also designated SEQ ID:3778.

Another function of VGAM1067 is therefore inhibition of LOC170395 (Accession XM_084325). Accordingly, utilities of VGAM1067 include diagnosis, prevention and treatment of diseases and clinical conditions associated with LOC170395. LOC200609 (Accession XM_117256) is another VGAM1067 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43331, to the nucleotide sequence of VGAM1067 RNA, herein designated VGAM RNA, also designated SEQ ID:3778.

Another function of VGAM1067 is therefore inhibition of LOC200609 (Accession XM_117256). Accordingly, utilities of VGAM1067 include diagnosis, prevention and treatment of diseases and clinical conditions associated with LOC200609. FIG. 1 further provides a conceptual description of a novel bioinformatically detected viral gene of the present invention, referred to here as Viral Genomic Address Messenger 1068 (VGAM1068) viral gene, which modulates expression of respective host target genes thereof, the function and utility of which host target genes is known in the art.

VGAM1068 is a novel bioinformatically detected regulatory, non protein coding, viral micro RNA (miRNA) gene. The method by which VGAM1068 was detected is described hereinabove with reference to FIGS. 1-8.

VGAM1068 gene, herein designated VGAM GENE, is a viral gene contained in the genome of Porcine Epidemic Diarrhea Virus. VGAM1068 host target gene, herein designated VGAM HOST TARGET GENE, is a human gene contained in the human genome.

VGAM1068 gene encodes a VGAM1068 precursor RNA, herein designated VGAM PRECURSOR RNA. Similar to other miRNA genes, and unlike most ordinary genes, VGAM1068 precursor RNA does not encode a protein. A nucleotide sequence identical or highly similar to the nucleotide sequence of VGAM1068 precursor RNA is designated SEQ ID:1054, and is provided hereinbelow with reference to the sequence listing part. Nucleotide sequence SEQ ID:1054 is located at position 12381 relative to the genome of Porcine Epidemic Diarrhea Virus.

VGAM1068 precursor RNA folds onto itself, forming VGAM1068 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1068 folded precursor RNA into VGAM1068 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM1068 RNA is designated SEQ ID:3779, and is provided hereinbelow with reference to the sequence listing part.

VGAM1068 host target gene, herein designated VGAM HOST TARGET GENE, encodes a corresponding messenger RNA, VGAM1068 host target RNA, herein designated VGAM HOST TARGET RNA. VGAM1068 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1068 RNA, herein designated VGAM RNA, binds complementarily to one or more host target binding sites located in untranslated regions of VGAM1068 host target RNA, herein designated VGAM HOST TARGET RNA. This complementary binding is due to the fact that the nucleotide sequence of VGAM1068 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1068 RNA, herein designated VGAM RNA, may have a different number of host target binding sites in untranslated regions of a VGAM1068 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1068 RNA, herein designated VGAM RNA, to host target binding sites on VGAM1068 host target RNA, herein designated VGAM HOST TARGET RNA, such as BINDING SITE I, BINDING SITE II and BINDING SITE III, inhibits translation of VGAM1068 host target RNA into VGAM1068 host target protein, herein designated VGAM HOST TARGET PROTEIN. VGAM host target protein is therefore outlined by a broken line.

It is appreciated that VGAM1068 host target gene, herein designated VGAM HOST TARGET GENE, in fact represents a plurality of VGAM1068 host target genes. The mRNA of each one of this plurality of VGAM1068 host target genes comprises one or more host target binding sites, each having a nucleotide sequence which is at least partly complementary to VGAM1068 RNA, herein designated VGAM RNA, and which when bound by VGAM1068 RNA causes inhibition of translation of respective one or more VGAM1068 host target proteins.

It is further appreciated by one skilled in the art that the mode of translational inhibition illustrated by FIG. 1 with specific reference to translational inhibition exerted by VGAM1068 gene, herein designated VGAM GENE, on one or more VGAM1068 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1068 is inhibition of expression of host target genes, as part of a novel viral mechanism of attacking a host. Accordingly, utilities of VGAM1068 include diagnosis, prevention and treatment of viral infection by Porcine Epidemic Diarrhea Virus. Specific functions, and accordingly utilities, of VGAM1068 correlate with, and may be deduced from, the identity of the host target genes which VGAM1068 binds and inhibits, and the function of these host target genes, as elaborated hereinbelow.

Nucleotide sequences of the VGAM1068 precursor RNA, herein designated VGAM PRECURSOR RNA, and of the 'diced' VGAM1068 RNA, herein designated VGAM RNA, and a schematic representation of the secondary folding of VGAM1068 folded precursor RNA, herein designated VGAM FOLDED PRECURSOR RNA, of VGAM1068 are further described hereinbelow with reference to Table 1.

Nucleotide sequences of host target binding sites, such as BINDING SITE-I, BINDING SITE-II and BINDING SITE- III of FIG. 1, found on VGAM1068 host target RNA, and schematic representation of the complementarity of each of these host target binding sites to VGAM1068 RNA, herein designated VGAM RNA, are described hereinbelow with reference to Table 2.

As mentioned hereinabove with reference to FIG. 1, a function of VGAM1068 gene, herein designated VGAM is inhibition of expression of VGAM1068 target genes. It is appreciated that specific functions, and accordingly utilities, of VGAM1068 correlate with, and may be deduced from, the identity of the target genes which VGAM1068 binds and inhibits, and the function of these target genes, as elaborated hereinbelow.

Nuclear Receptor Subfamily 5, Group A, Member 2 (NR5A2, Accession NM_003822) is a VGAM1068 host target gene. NR5A2 BINDING SITE is HOST TARGET binding site found in the 3' untranslated region of mRNA encoded by NR5A2, corresponding to a HOST TARGET binding site such as BINDING SITE I, BINDING SITE II or BINDING SITE III. Table 2 illustrates the complementarity of the nucleotide sequences of NR5A2 BINDING SITE, designated SEQ ID:9914, to the nucleotide sequence of VGAM1068 RNA, herein designated VGAM RNA, also designated SEQ ID:3779.

A function of VGAM1068 is therefore inhibition of Nuclear Receptor Subfamily 5, Group A, Member 2 (NR5A2, Accession NM_003822), a gene which is a member of nuclear receptor superfamily of trancriptional activators and activates the hepatitis B virus (HBV) promoter. Accordingly, utilities of VGAM1068 include diagnosis, prevention and treatment of diseases and clinical conditions associated with NR5A2. The function of NR5A2 and its association with various diseases and clinical conditions, has been established by previous studies, as described hereinabove with reference to VGAM375. Pyruvate Dehydrogenase Kinase, Isoenzyme 4 (PDK4, Accession XM_173198) is another VGAM1068 host target gene. PDK4 BINDING SITE is HOST TARGET binding site found in the 3' untranslated region of mRNA encoded by PDK4, corresponding to a HOST TARGET binding site such as BINDING SITE I, BINDING SITE II or BINDING SITE III. Table 2 illustrates the complementarity of the nucleotide sequences of PDK4 BINDING SITE, designated SEQ ID:46443, to the nucleotide sequence of VGAM1068 RNA, herein designated VGAM RNA, also designated SEQ ID:3779.

Another function of VGAM1068 is therefore inhibition of Pyruvate Dehydrogenase Kinase, Isoenzyme 4 (PDK4, Accession XM_173198). Accordingly, utilities of VGAM1068 include diagnosis, prevention and treatment of diseases and clinical conditions associated with PDK4. Phosphoinositide-3-kinase, Class 2, Beta Polypeptide (PIK3C2B, Accession NM_002646) is another VGAM1068 host target gene. PIK3C2B BINDING SITE is HOST TARGET binding site found in the 3' untranslated region of mRNA encoded by PIK3C2B, corresponding to a HOST TARGET binding site such as BINDING SITE I, BINDING SITE II or BINDING SITE III. Table 2 illustrates the complementarity of the nucleotide sequences of PIK3C2B BINDING SITE, designated SEQ ID:8504, to the nucleotide sequence of VGAM1068 RNA, herein designated VGAM RNA, also designated SEQ ID:3779.

Another function of VGAM1068 is therefore inhibition of Phosphoinositide-3-kinase, Class 2, Beta Polypeptide (PIK3C2B, Accession NM_002646). Accordingly, utilities of VGAM1068 include diagnosis, prevention and treatment of diseases and clinical conditions associated with PIK3C2B. Prostaglandin I2 (prostacyclin) Synthase (PTGIS, Accession NM_000961) is another VGAM1068 host target gene. PTGIS BINDING SITE is HOST TARGET binding site found in the 3' untranslated region of mRNA encoded by PTGIS, corresponding to a HOST TARGET binding site such as BINDING SITE I, BINDING SITE II or BINDING SITE III. Table 2 illustrates the complementarity of the nucleotide sequences of PTGIS BINDING SITE, designated SEQ ID:6665, to the nucleotide sequence of VGAM1068 RNA, herein designated VGAM RNA, also designated SEQ ID:3779.

Another function of VGAM1068 is therefore inhibition of Prostaglandin I2 (prostacyclin) Synthase (PTGIS, Accession NM_000961), a gene which catalyzes the isomerization of prostaglandin h2 to prostacyclin (= prostaglandin i2). Accordingly, utilities of VGAM1068 include diagnosis, prevention and treatment of diseases and clinical conditions associated with PTGIS. The function of PTGIS and its association with various diseases and clinical conditions, has been established by previous studies, as described hereinabove with reference to VGAM206. Bromodomain Containing 3 (BRD3, Accession NM_007371) is another VGAM1068 host target gene. BRD3 BINDING SITE is HOST TARGET binding site found in the 3' untranslated region of mRNA encoded by BRD3, corresponding to a HOST TARGET binding site such as BINDING SITE I, BINDING SITE II or BINDING SITE III. Table 2 illustrates the complementarity of the nucleotide sequences of BRD3 BINDING SITE, designated SEQ ID:14296, to the nucleotide sequence of VGAM1068 RNA, herein designated VGAM RNA, also designated SEQ ID:3779.

Another function of VGAM1068 is therefore inhibition of Bromodomain Containing 3 (BRD3, Accession NM_007371). Accordingly, utilities of VGAM1068 include diagnosis, prevention and treatment of diseases and clinical conditions associated with BRD3. Cyclin E2 (CCNE2, Accession NM_057749) is another VGAM1068 host target gene. CCNE2 BINDING SITE1 and CCNE2 BINDING SITE2 are HOST TARGET binding sites found in untranslated regions of mRNA encoded by CCNE2, corresponding to HOST TARGET binding sites such as BINDING SITE I, BINDING SITE II or BINDING SITE III. Table 2 illustrates the complementarity of the nucleotide sequences of CCNE2 BINDING SITE1 and CCNE2 BINDING SITE2, designated SEQ ID:27710 and SEQ ID:11049 respectively, to the nucleotide sequence of VGAM1068 RNA, herein designated VGAM RNA, also designated SEQ ID:3779.

Another function of VGAM1068 is therefore inhibition of Cyclin E2 (CCNE2, Accession NM_057749). Accordingly, utilities of VGAM1068 include diagnosis, prevention and treatment of diseases and clinical conditions associated with CCNE2. KIAA0475 (Accession NM_014864) is another VGAM1068 host target gene. KIAA0475 BINDING SITE is HOST TARGET binding site found in the 3' untranslated region of mRNA encoded by KIAA0475, corresponding to a HOST TARGET binding site such as BINDING SITE I, BINDING SITE II or BINDING SITE III. Table 2 illustrates the complementarity of the nucleotide sequences of KIAA0475 BINDING SITE, designated SEQ ID:16950, to the nucleotide sequence of VGAM1068 RNA, herein designated VGAM RNA, also designated SEQ ID:3779.

Another function of VGAM1068 is therefore inhibition of KIAA0475 (Accession NM_014864). Accordingly, utilities of VGAM1068 include diagnosis, prevention and treatment of diseases and clinical conditions associated with KIAA0475. KIAA0931 (Accession XM_041191) is another VGAM1068 host target gene. KIAA0931 BINDING SITE is HOST TARGET binding site found in the 3' untranslated region of mRNA encoded by KIAA0931, corresponding to a HOST TARGET binding site such as BINDING SITE I, BINDING SITE II or BINDING SITE III. Table 2 illustrates the complementarity of the nucleotide sequences of KIAA0931 BINDING SITE, designated SEQ ID:33486, to the nucleotide sequence of VGAM1068 RNA, herein designated VGAM RNA, also designated SEQ ID:3779.

Another function of VGAM1068 is therefore inhibition of KIAA0931 (Accession XM_041191). Accordingly, utilities of VGAM1068 include diagnosis, prevention and treatment of diseases and clinical conditions associated with KIAA0931. Protocadherin 17 (PCDH17, Accession NM_014459) is another VGAM1068 host target gene. PCDH17 BINDING SITE is HOST TARGET binding site found in the 3' untranslated region of mRNA encoded by PCDH17, corresponding to a HOST TARGET binding site such as BINDING SITE I, BINDING SITE II or BINDING SITE III. Table 2 illustrates the complementarity of the nucleotide sequences of PCDH17 BINDING SITE, designated SEQ ID:15810, to the nucleotide sequence of VGAM1068 RNA, herein designated VGAM RNA, also designated SEQ ID:3779.

Another function of VGAM1068 is therefore inhibition of Protocadherin 17 (PCDH17, Accession NM_014459). Accordingly, utilities of VGAM1068 include diagnosis, prevention and treatment of diseases and clinical conditions associated with PCDH17. FIG. 1 further provides a conceptual description of a novel bioinformatically detected viral gene of the present invention, referred to here as Viral Genomic Address Messenger 1069 (VGAM1069) viral gene, which modulates expression of respective host target genes thereof, the function and utility of which host target genes is known in the art.

VGAM1069 is a novel bioinformatically detected regulatory, non protein coding, viral micro RNA (miRNA) gene. The method by which VGAM1069 was detected is described hereinabove with reference to FIGS. 1-8.

VGAM1069 gene, herein designated VGAM GENE, is a viral gene contained in the genome of Porcine Epidemic Diarrhea Virus. VGAM1069 host target gene, herein designated VGAM HOST TARGET GENE, is a human gene contained in the human genome.

VGAM1069 gene encodes a VGAM1069 precursor RNA, herein designated VGAM PRECURSOR RNA. Similar to other miRNA genes, and unlike most ordinary genes, VGAM1069 precursor RNA does not encode a protein. A nucleotide sequence identical or highly similar to the nucleotide sequence of VGAM1069 precursor RNA is designated SEQ ID:1055, and is provided hereinbelow with reference to the sequence listing part. Nucleotide sequence SEQ ID:1055 is located at position 4727 relative to the genome of Porcine Epidemic Diarrhea Virus.

VGAM1069 precursor RNA folds onto itself, forming VGAM1069 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1069 folded precursor RNA into VGAM1069 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1069 RNA is designated SEQ ID:3780, and is provided hereinbelow with reference to the sequence listing part.

VGAM1069 host target gene, herein designated VGAM HOST TARGET GENE, encodes a corresponding messenger RNA, VGAM1069 host target RNA, herein designated VGAM HOST TARGET RNA. VGAM1069 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1069 RNA, herein designated VGAM RNA, binds complementarily to one or more host target binding sites located in untranslated regions of VGAM1069 host target RNA, herein designated VGAM HOST TARGET RNA. This complementary binding is due to the fact that the nucleotide sequence of VGAM1069 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1069 RNA, herein designated VGAM RNA, may have a different number of host target binding sites in untranslated regions of a VGAM1069 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1069 RNA, herein designated VGAM RNA, to host target binding sites on VGAM1069 host target RNA, herein designated VGAM HOST TARGET RNA, such as BINDING SITE I, BINDING SITE II and BINDING SITE III, inhibits translation of VGAM1069 host target RNA into VGAM1069 host target protein, herein designated VGAM HOST TARGET PROTEIN. VGAM host target protein is therefore outlined by a broken line.

It is appreciated that VGAM1069 host target gene, herein designated VGAM HOST TARGET GENE, in fact represents a plurality of VGAM1069 host target genes. The mRNA of each one of this plurality of VGAM1069 host target genes comprises one or more host target binding sites, each having a nucleotide sequence which is at least partly complementary to VGAM1069 RNA, herein designated VGAM RNA, and which when bound by VGAM1069 RNA causes inhibition of translation of respective one or more VGAM1069 host target proteins.

It is further appreciated by one skilled in the art that the mode of translational inhibition illustrated by FIG. 1 with specific reference to translational inhibition exerted by VGAM1069 gene, herein designated VGAM GENE, on one or more VGAM1069 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1069 is inhibition of expression of host target genes, as part of a novel viral mechanism of attacking a host. Accordingly, utilities of VGAM1069 include diagnosis, prevention and treatment of viral infection by Porcine Epidemic Diarrhea Virus. Specific functions, and accordingly utilities, of VGAM1069 correlate with, and may be deduced from, the identity of the host target genes which VGAM1069 binds and inhibits, and the function of these host target genes, as elaborated hereinbelow.

Nucleotide sequences of the VGAM1069 precursor RNA, herein designated VGAM PRECURSOR RNA, and of the 'diced' VGAM1069 RNA, herein designated VGAM RNA, and a schematic representation of the secondary folding of VGAM1069 folded precursor RNA, herein designated VGAM FOLDED PRECURSOR RNA, of VGAM1069 are further described hereinbelow with reference to Table 1.

Nucleotide sequences of host target binding sites, such as BINDING SITE-I, BINDING SITE-II and BINDING SITE-III of FIG. 1, found on VGAM1069 host target RNA, and schematic representation of the complementarity of each of these host target binding sites to VGAM1069 RNA, herein designated VGAM RNA, are described hereinbelow with reference to Table 2.

As mentioned hereinabove with reference to FIG. 1, a function of VGAM1069 gene, herein designated VGAM is inhibition of expression of VGAM1069 target genes. It is appreciated that specific functions, and accordingly utilities, of VGAM1069 correlate with, and may be deduced from, the identity of the target genes which VGAM1069 binds and inhibits, and the function of these target genes, as elaborated hereinbelow.

A Disintegrin and Metalloproteinase Domain 17 (tumor necrosis factor, alpha, converting enzyme) (ADAM17, Accession NM_021832) is a VGAM1069 host target gene. ADAM17 BINDING SITE is HOST TARGET binding site found in the 3' untranslated region of mRNA encoded by ADAM17, corresponding to a HOST TARGET binding site such as BINDING SITE I, BINDING SITE II or BINDING SITE III. Table 2 illustrates the complementarity of the nucleotide sequences of ADAM17 BINDING SITE, designated SEQ ID:22407, to the nucleotide sequence of VGAM1069 RNA, herein designated VGAM RNA, also designated SEQ ID:3780.

A function of VGAM1069 is therefore inhibition of A Disintegrin and Metalloproteinase Domain 17 (tumor necrosis factor, alpha, converting enzyme) (ADAM17, Accession NM_021832), a gene which member of ADAM family of zinc metalloproteases. Accordingly, utilities of VGAM1069 include diagnosis, prevention and treatment of diseases and clinical conditions associated with ADAM17. The function of ADAM17 and its association with various diseases and clinical conditions, has been established by previous studies, as described hereinabove with reference to VGAM264. Cadherin 3, Type 1, P-cadherin (placental) (CDH3, Accession NM_001793) is another VGAM1069 host target gene. CDH3 BINDING SITE is HOST TARGET binding site found in the 3' untranslated region of mRNA encoded by CDH3, corresponding to a HOST TARGET binding site such as BINDING SITE I, BINDING SITE II or BINDING SITE III. Table 2 illustrates the complementarity of the nucleotide sequences of CDH3 BINDING SITE, designated SEQ ID:7544, to the nucleotide sequence of VGAM1069 RNA, herein designated VGAM RNA, also designated SEQ ID:3780.

Another function of VGAM1069 is therefore inhibition of Cadherin 3, Type 1, P-cadherin (placental) (CDH3, Accession NM_001793), a gene which is a calcium dependent cell adhesion protein. Accordingly, utilities of VGAM1069 include diagnosis, prevention and treatment of diseases and clinical conditions associated with CDH3. The function of CDH3 and its association with various diseases and clinical conditions, has been established by previous studies, as described hereinabove with reference to VGAM210. Transient Receptor Potential Cation Channel, Subfamily M, Member 6 (TRPM6, Accession NM_017662) is another VGAM1069 host target gene. TRPM6 BINDING SITE is HOST TARGET binding site found in the 3' untranslated region of mRNA encoded by TRPM6, corresponding to a HOST TARGET binding site such as BINDING SITE I, BINDING SITE II or BINDING SITE III. Table 2 illustrates the complementarity of the nucleotide sequences of TRPM6 BINDING SITE, designated SEQ ID:19193, to the nucleotide sequence of VGAM1069 RNA, herein designated VGAM RNA, also designated SEQ ID:3780.

Another function of VGAM1069 is therefore inhibition of Transient Receptor Potential Cation Channel, Subfamily M, Member 6 (TRPM6, Accession NM_017662), a gene which contains a predicted ion channel domain and a protein kinase domain. Accordingly, utilities of VGAM1069 include diagnosis, prevention and treatment of diseases and clinical conditions associated with TRPM6. The function of TRPM6 and its association with various diseases and clinical conditions, has been established by previous studies, as described hereinabove with reference to VGAM173. CAMP-GEFII (Accession NM_007023) is another VGAM1069 host target gene. CAMP-GEFII BINDING SITE is HOST TARGET binding site found in the 3' untranslated region of mRNA encoded by CAMP-GEFII, corresponding to a HOST TARGET binding site such as BINDING SITE I, BINDING SITE II or BINDING SITE III. Table 2 illustrates the complementarity of the nucleotide sequences of CAMP-GEFII BINDING SITE, designated SEQ ID:13878, to the nucleotide sequence of VGAM1069 RNA, herein designated VGAM RNA, also designated SEQ ID:3780.

Another function of VGAM1069 is therefore inhibition of CAMP-GEFII (Accession NM_007023). Accordingly, utilities of VGAM1069 include diagnosis, prevention and treatment of diseases and clinical conditions associated with CAMP-GEFII. FLJ11827 (Accession NM_025093) is another VGAM1069 host target gene. FLJ11827 BINDING SITE is HOST TARGET binding site found in the 3' untranslated region of mRNA encoded by FLJ11827, corresponding to a HOST TARGET binding site such as BINDING SITE I, BINDING SITE II or BINDING SITE III. Table 2 illustrates the complementarity of the nucleotide sequences of FLJ11827 BINDING SITE, designated SEQ ID:24724, to the nucleotide sequence of VGAM1069 RNA, herein designated VGAM RNA, also designated SEQ ID:3780.

Another function of VGAM1069 is therefore inhibition of FLJ11827 (Accession NM_025093). Accordingly, utilities of VGAM1069 include diagnosis, prevention and treatment of diseases and clinical conditions associated with FLJ11827. FLJ20035 (Accession NM_017631) is another VGAM1069 host target gene. FLJ20035 BINDING SITE is HOST TARGET binding site found in the 3' untranslated region of mRNA encoded by FLJ20035, corresponding to a HOST TARGET binding site such as BINDING SITE I, BINDING SITE II or BINDING SITE III. Table 2 illustrates the complementarity of the nucleotide sequences of FLJ20035 BINDING SITE, designated SEQ ID:19139, to the nucleotide sequence of VGAM1069 RNA, herein designated VGAM RNA, also designated SEQ ID:3780.

Another function of VGAM1069 is therefore inhibition of FLJ20035 (Accession NM_017631). Accordingly, utilities of VGAM1069 include diagnosis, prevention and treatment of diseases and clinical conditions associated with FLJ20035. KIAA0319 (Accession NM_014809) is another VGAM1069 host target gene. KIAA0319 BINDING SITE is HOST TARGET binding site found in the 5' untranslated region of mRNA encoded by KIAA0319, corresponding to a HOST TARGET binding site such as BINDING SITE I, BINDING SITE II or BINDING SITE III. Table 2 illustrates the complementarity of the nucleotide sequences of KIAA0319 BINDING SITE, designated SEQ ID:16759, to the nucleotide sequence of VGAM1069 RNA, herein designated VGAM RNA, also designated SEQ ID:3780.

Another function of VGAM1069 is therefore inhibition of KIAA0319 (Accession NM_014809). Accordingly, utilities of VGAM1069 include diagnosis, prevention and treatment of diseases and clinical conditions associated with KIAA0319. KIAA0630 (Accession XM_114729) is another VGAM1069 host target gene. KIAA0630 BINDING SITE is HOST TARGET binding site found in the 5' untranslated region of mRNA encoded by KIAA0630, corresponding to a HOST TARGET binding site such as BINDING SITE I, BINDING SITE II or BINDING SITE III. Table 2 illustrates the complementarity of the nucleotide sequences of KIAA0630 BINDING SITE, designated SEQ ID:43060, to the nucleotide sequence of VGAM1069 RNA, herein designated VGAM RNA, also designated SEQ ID:3780.

Another function of VGAM1069 is therefore inhibition of KIAA0630 (Accession XM_114729). Accordingly, utilities of VGAM1069 include diagnosis, prevention and treatment of diseases and clinical conditions associated with KIAA0630. KIAA0924 (Accession NM_014897) is another VGAM1069 host target gene. KIAA0924 BINDING SITE is HOST TARGET binding site found in the 5' untranslated region of mRNA encoded by KIAA0924, corresponding to a HOST TARGET binding site such as BINDING SITE I, BINDING SITE II or BINDING SITE III. Table 2 illustrates the complementarity of the nucleotide sequences of KIAA0924 BINDING SITE, designated SEQ ID:17063, to the nucleotide sequence of VGAM1069 RNA, herein designated VGAM RNA, also designated SEQ ID:3780.

Another function of VGAM1069 is therefore inhibition of KIAA0924 (Accession NM_014897). Accordingly, utilities of VGAM1069 include diagnosis, prevention and treatment of diseases and clinical conditions associated with KIAA0924. YKT6 (Accession NM_006555) is another VGAM1069 host target gene. YKT6 BINDING SITE is HOST TARGET binding site found in the 3' untranslated region of mRNA encoded by YKT6, corresponding to a HOST TARGET binding site such as BINDING SITE I, BINDING SITE II or BINDING SITE III. Table 2 illustrates the complementarity of the nucleotide sequences of YKT6 BINDING SITE, designated SEQ ID:13320, to the nucleotide sequence of VGAM1069 RNA, herein designated VGAM RNA, also designated SEQ ID:3780.

Another function of VGAM1069 is therefore inhibition of YKT6 (Accession NM_006555). Accordingly, utilities of VGAM1069 include diagnosis, prevention and treatment of diseases and clinical conditions associated with YKT6. LOC148413 (Accession XM_086176) is another VGAM1069 host target gene. LOC148413 BINDING SITE is HOST TARGET binding site found in the 3' untranslated region of mRNA encoded by LOC148413, corresponding to a HOST TARGET binding site such as BINDING SITE I, BINDING SITE II or BINDING SITE III. Table 2 illustrates the complementarity of the nucleotide sequences of LOC148413 BINDING SITE, designated SEQ ID:38531, to the nucleotide sequence of VGAM1069 RNA, herein designated VGAM RNA, also designated SEQ ID:3780.

Another function of VGAM1069 is therefore inhibition of LOC148413 (Accession XM_086176). Accordingly, utilities of VGAM1069 include diagnosis, prevention and treatment of diseases and clinical conditions associated with LOC148413. LOC150225 (Accession XM_097870) is another VGAM1069 host target gene. LOC150225 BINDING SITE is HOST TARGET binding site found in the 5' untranslated region of mRNA encoded by LOC150225, corresponding to a HOST TARGET binding site such as BINDING SITE I, BINDING SITE II or BINDING SITE III. Table 2 illustrates the complementarity of the nucleotide sequences of LOC150225 BINDING SITE, designated SEQ ID:41188, to the nucleotide sequence of VGAM1069 RNA, herein designated VGAM RNA, also designated SEQ ID:3780.

Another function of VGAM1069 is therefore inhibition of LOC150225 (Accession XM_097870). Accordingly, utilities of VGAM1069 include diagnosis, prevention and treatment of diseases and clinical conditions associated with LOC150225. LOC91812 (Accession XM_040857) is another VGAM1069 host target gene. LOC91812 BINDING SITE is HOST TARGET binding site found in the 5' untranslated region of mRNA encoded by LOC91812, corresponding to a HOST TARGET binding site such as BINDING SITE I, BINDING SITE II or BINDING SITE III. Table 2 illustrates the complementarity of the nucleotide sequences of LOC91812 BINDING SITE, designated SEQ ID:33390, to the nucleotide sequence of VGAM1069 RNA, herein designated VGAM RNA, also designated SEQ ID:3780.

Another function of VGAM1069 is therefore inhibition of LOC91812 (Accession XM_040857). Accordingly, utilities of VGAM1069 include diagnosis, prevention and treatment of diseases and clinical conditions associated with LOC91812. LOC91813 (Accession XM_040862) is another VGAM1069 host target gene. LOC91813 BINDING SITE is HOST TARGET binding site found in the 5' untranslated region of mRNA encoded by LOC91813, corresponding to a HOST TARGET binding site such as BINDING SITE I, BINDING SITE II or BINDING SITE III. Table 2 illustrates the complementarity of the nucleotide sequences of LOC91813 BINDING SITE, designated SEQ ID:33396, to the nucleotide sequence of VGAM1069 RNA, herein designated VGAM RNA, also designated SEQ ID:3780.

Another function of VGAM1069 is therefore inhibition of LOC91813 (Accession XM_040862). Accordingly, utilities of VGAM1069 include diagnosis, prevention and treatment of diseases and clinical conditions associated with LOC91813. FIG. 1 further provides a conceptual description of a novel bioinformatically detected viral gene of the present invention, referred to here as Viral Genomic Address Messenger 1070 (VGAM1070) viral gene, which modulates expression of respective host target genes thereof, the function and utility of which host target genes is known in the art.

VGAM1070 is a novel bioinformatically detected regulatory, non protein coding, viral micro RNA (miRNA) gene. The method by which VGAM1070 was detected is described hereinabove with reference to FIGS. 1-8.

VGAM1070 gene, herein designated VGAM GENE, is a viral gene contained in the genome of Porcine Epidemic Diarrhea Virus. VGAM1070 host target gene, herein designated VGAM HOST TARGET GENE, is a human gene contained in the human genome.

VGAM1070 gene encodes a VGAM1070 precursor RNA, herein designated VGAM PRECURSOR RNA. Similar to other miRNA genes, and unlike most ordinary genes, VGAM1070 precursor RNA does not encode a protein. A nucleotide sequence identical or highly similar to the nucleotide sequence of VGAM1070 precursor RNA is designated SEQ ID:1056, and is provided hereinbelow with reference to the sequence listing part. Nucleotide sequence SEQ ID:1056 is located at position 6437 relative to the genome of Porcine Epidemic Diarrhea Virus.

VGAM1070 precursor RNA folds onto itself, forming VGAM1070 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1070 folded precursor RNA into VGAM1070 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1070 RNA is designated SEQ ID:3781, and is provided hereinbelow with reference to the sequence listing part.

VGAM1070 host target gene, herein designated VGAM HOST TARGET GENE, encodes a corresponding messenger RNA, VGAM1070 host target RNA, herein designated VGAM HOST TARGET RNA. VGAM1070 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1070 RNA, herein designated VGAM RNA, binds complementarily to one or more host target binding sites located in untranslated regions of VGAM1070 host target RNA, herein designated VGAM HOST TARGET RNA. This complementary binding is due to the fact that the nucleotide sequence of VGAM1070 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1070 RNA, herein designated VGAM RNA, may have a different number of host target binding sites in untranslated regions of a VGAM1070 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1070 RNA, herein designated VGAM RNA, to host target binding sites on VGAM1070 host target RNA, herein designated VGAM HOST TARGET RNA, such as BINDING SITE I, BINDING SITE II and BINDING SITE III, inhibits translation of VGAM1070 host target RNA into VGAM1070 host target protein, herein designated VGAM HOST TARGET PROTEIN. VGAM host target protein is therefore outlined by a broken line.

It is appreciated that VGAM1070 host target gene, herein designated VGAM HOST TARGET GENE, in fact represents a plurality of VGAM1070 host target genes. The mRNA of each one of this plurality of VGAM1070 host target genes comprises one or more host target binding sites, each having a nucleotide sequence which is at least partly complementary to VGAM1070 RNA, herein designated VGAM RNA, and which when bound by VGAM1070 RNA causes inhibition of translation of respective one or more VGAM1070 host target proteins.

It is further appreciated by one skilled in the art that the mode of translational inhibition illustrated by FIG. 1 with specific reference to translational inhibition exerted by VGAM1070 gene, herein designated VGAM GENE, on one or more VGAM1070 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1070 is inhibition of expression of host target genes, as part of a novel viral mechanism of attacking a host. Accordingly, utilities of VGAM1070 include diagnosis, prevention and treatment of viral infection by Porcine Epidemic Diarrhea Virus. Specific functions, and accordingly utilities, of VGAM1070 correlate with, and may be deduced from, the identity of the host target genes which VGAM1070 binds and inhibits, and the function of these host target genes, as elaborated hereinbelow.

Nucleotide sequences of the VGAM1070 precursor RNA, herein designated VGAM PRECURSOR RNA, and of the 'diced' VGAM1070 RNA, herein designated VGAM RNA, and a schematic representation of the secondary folding of VGAM1070 folded precursor RNA, herein designated VGAM FOLDED PRECURSOR RNA, of VGAM1070 are further described hereinbelow with reference to Table 1.

Nucleotide sequences of host target binding sites, such as BINDING SITE-I, BINDING SITE-II and BINDING SITE-III of FIG. 1, found on VGAM1070 host target RNA, and schematic representation of the complementarity of each of these host target binding sites to VGAM1070 RNA, herein designated VGAM RNA, are described hereinbelow with reference to Table 2.

As mentioned hereinabove with reference to FIG. 1, a function of VGAM1070 gene, herein designated VGAM is inhibition of expression of VGAM1070 target genes. It is appreciated that specific functions, and accordingly utilities, of VGAM1070 correlate with, and may be deduced from, the identity of the target genes which VGAM1070 binds and inhibits, and the function of these target genes, as elaborated hereinbelow.

Angiopoietin 1 (ANGPT1, Accession NM_001146) is a VGAM1070 host target gene. ANGPT1 BINDING SITE is HOST TARGET binding site found in the 3' untranslated region of mRNA encoded by ANGPT1, corresponding to a HOST TARGET binding site such as BINDING SITE I, BINDING SITE II or BINDING SITE III. Table 2 illustrates the complementarity of the nucleotide sequences of ANGPT1

BINDING SITE, designated SEQ ID:6812, to the nucleotide sequence of VGAM1070 RNA, herein designated VGAM RNA, also designated SEQ ID:3781.

A function of VGAM1070 is therefore inhibition of Angiopoietin 1 (ANGPT1, Accession NM_001146), a gene which binds and activates tie2 receptor by inducing its tyrosine phosphorylation. Accordingly, utilities of VGAM1070 include diagnosis, prevention and treatment of diseases and clinical conditions associated with ANGPT1. The function of ANGPT1 and its association with various diseases and clinical conditions, has been established by previous studies, as described hereinabove with reference to VGAM291. Cyclin-dependent Kinase Inhibitor 2B (p15, inhibits CDK4) (CDKN2B, Accession NM_078487) is another VGAM1070 host target gene. CDKN2B BINDING SITE is HOST TARGET binding site found in the 3' untranslated region of mRNA encoded by CDKN2B, corresponding to a HOST TARGET binding site such as BINDING SITE I, BINDING SITE II or BINDING SITE III. Table 2 illustrates the complementarity of the nucleotide sequences of CDKN2B BINDING SITE, designated SEQ ID:27806, to the nucleotide sequence of VGAM1070 RNA, herein designated VGAM RNA, also designated SEQ ID:3781.

Another function of VGAM1070 is therefore inhibition of Cyclin-dependent Kinase Inhibitor 2B (p15, inhibits CDK4) (CDKN2B, Accession NM_078487). Accordingly, utilities of VGAM1070 include diagnosis, prevention and treatment of diseases and clinical conditions associated with CDKN2B. ATIP1 (Accession NM_020749) is another VGAM1070 host target gene. ATIP1 BINDING SITE is HOST TARGET binding site found in the 3' untranslated region of mRNA encoded by ATIP1, corresponding to a HOST TARGET binding site such as BINDING SITE I, BINDING SITE II or BINDING SITE III. Table 2 illustrates the complementarity of the nucleotide sequences of ATIP1 BINDING SITE, designated SEQ ID:21862, to the nucleotide sequence of VGAM1070 RNA, herein designated VGAM RNA, also designated SEQ ID:3781.

Another function of VGAM1070 is therefore inhibition of ATIP1 (Accession NM_020749). Accordingly, utilities of VGAM1070 include diagnosis, prevention and treatment of diseases and clinical conditions associated with ATIP1. FLJ11273 (Accession NM_018374) is another VGAM1070 host target gene. FLJ11273 BINDING SITE is HOST TARGET binding site found in the 3' untranslated region of mRNA encoded by FLJ11273, corresponding to a HOST TARGET binding site such as BINDING SITE I, BINDING SITE II or BINDING SITE III. Table 2 illustrates the complementarity of the nucleotide sequences of FLJ11273 BINDING SITE, designated SEQ ID:20395, to the nucleotide sequence of VGAM1070 RNA, herein designated VGAM RNA, also designated SEQ ID:3781.

Another function of VGAM1070 is therefore inhibition of FLJ11273 (Accession NM_018374). Accordingly, utilities of VGAM1070 include diagnosis, prevention and treatment of diseases and clinical conditions associated with FLJ11273. FLJ20716 (Accession NM_017938) is another VGAM1070 host target gene. FLJ20716 BINDING SITE is HOST TARGET binding site found in the 3' untranslated region of mRNA encoded by FLJ20716, corresponding to a HOST TARGET binding site such as BINDING SITE I, BINDING SITE II or BINDING SITE III. Table 2 illustrates the complementarity of the nucleotide sequences of FLJ20716 BINDING SITE, designated SEQ ID:19630, to the nucleotide sequence of VGAM1070 RNA, herein designated VGAM RNA, also designated SEQ ID:3781.

Another function of VGAM1070 is therefore inhibition of FLJ20716 (Accession NM_017938). Accordingly, utilities of VGAM1070 include diagnosis, prevention and treatment of diseases and clinical conditions associated with FLJ20716. MGC13138 (Accession NM_033410) is another VGAM1070 host target gene. MGC13138 BINDING SITE is HOST TARGET binding site found in the 3' untranslated region of mRNA encoded by MGC13138, corresponding to a HOST TARGET binding site such as BINDING SITE I, BINDING SITE II or BINDING SITE III. Table 2 illustrates the complementarity of the nucleotide sequences of MGC13138 BINDING SITE, designated SEQ ID:27230, to the nucleotide sequence of VGAM1070 RNA, herein designated VGAM RNA, also designated SEQ ID:3781.

Another function of VGAM1070 is therefore inhibition of MGC13138 (Accession NM_033410). Accordingly, utilities of VGAM1070 include diagnosis, prevention and treatment of diseases and clinical conditions associated with MGC13138. QKI (Accession XM_037438) is another VGAM1070 host target gene. QKI BINDING SITE is HOST TARGET binding site found in the 3' untranslated region of mRNA encoded by QKI, corresponding to a HOST TARGET binding site such as BINDING SITE I, BINDING SITE II or BINDING SITE III. Table 2 illustrates the complementarity of the nucleotide sequences of QKI BINDING SITE, designated SEQ ID:32616, to the nucleotide sequence of VGAM1070 RNA, herein designated VGAM RNA, also designated SEQ ID:3781.

Another function of VGAM1070 is therefore inhibition of QKI (Accession XM_037438). Accordingly, utilities of VGAM1070 include diagnosis, prevention and treatment of diseases and clinical conditions associated with QKI. LOC148188 (Accession XM_086088) is another VGAM1070 host target gene. LOC148188 BINDING SITE is HOST TARGET binding site found in the 5' untranslated region of mRNA encoded by LOC148188, corresponding to a HOST TARGET binding site such as BINDING SITE I, BINDING SITE II or BINDING SITE III. Table 2 illustrates the complementarity of the nucleotide sequences of LOC148188 BINDING SITE, designated SEQ ID:38489, to the nucleotide sequence of VGAM1070 RNA, herein designated VGAM RNA, also designated SEQ ID:3781.

Another function of VGAM1070 is therefore inhibition of LOC148188 (Accession XM_086088). Accordingly, utilities of VGAM1070 include diagnosis, prevention and treatment of diseases and clinical conditions associated with LOC148188. LOC201522 (Accession XM_113978) is another VGAM1070 host target gene. LOC201522 BINDING SITE is HOST TARGET binding site found in the 3' untranslated region of mRNA encoded by LOC201522, corresponding to a HOST TARGET binding site such as BINDING SITE I, BINDING SITE II or BINDING SITE III. Table 2 illustrates the complementarity of the nucleotide sequences of LOC201522 BINDING SITE, designated SEQ ID:42585, to the nucleotide sequence of VGAM1070 RNA, herein designated VGAM RNA, also designated SEQ ID:3781.

Another function of VGAM1070 is therefore inhibition of LOC201522 (Accession XM_113978). Accordingly, utilities of VGAM1070 include diagnosis, prevention and treatment of diseases and clinical conditions associated with LOC201522. FIG. 1 further provides a conceptual description of a novel bioinformatically detected viral gene of the present invention, referred to here as Viral Genomic Address Messenger 1071 (VGAM1071) viral gene, which modulates expression of respective host target genes thereof, the function and utility of which host target genes is known in the art.

VGAM1071 is a novel bioinformatically detected regulatory, non protein coding, viral micro RNA (miRNA) gene. The method by which VGAM1071 was detected is described hereinabove with reference to FIGS. 1-8.

VGAM1071 gene, herein designated VGAM GENE, is a viral gene contained in the genome of Porcine Epidemic Diarrhea Virus. VGAM1071 host target gene, herein designated VGAM HOST TARGET GENE, is a human gene contained in the human genome.

VGAM1071 gene encodes a VGAM1071 precursor RNA, herein designated VGAM PRECURSOR RNA. Similar to other miRNA genes, and unlike most ordinary genes, VGAM1071 precursor RNA does not encode a protein. A nucleotide sequence identical or highly similar to the nucleotide sequence of VGAM1071 precursor RNA is designated SEQ ID:1057, and is provided hereinbelow with reference to the sequence listing part. Nucleotide sequence SEQ ID:1057 is located at position 5412 relative to the genome of Porcine Epidemic Diarrhea Virus.

VGAM1071 precursor RNA folds onto itself, forming VGAM1071 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1071 folded precursor RNA into VGAM1071 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM1071 RNA is designated SEQ ID:3782, and is provided hereinbelow with reference to the sequence listing part.

VGAM1071 host target gene, herein designated VGAM HOST TARGET GENE, encodes a corresponding messenger RNA, VGAM1071 host target RNA, herein designated VGAM HOST TARGET RNA. VGAM1071 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1071 RNA, herein designated VGAM RNA, binds complementarily to one or more host target binding sites located in untranslated regions of VGAM1071 host target RNA, herein designated VGAM HOST TARGET RNA. This complementary binding is due to the fact that the nucleotide sequence of VGAM1071 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1071 RNA, herein designated VGAM RNA, may have a different number of host target binding sites in untranslated regions of a VGAM1071 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1071 RNA, herein designated VGAM RNA, to host target binding sites on VGAM1071 host target RNA, herein designated VGAM HOST TARGET RNA, such as BINDING SITE I, BINDING SITE II and BINDING SITE III, inhibits translation of VGAM1071 host target RNA into VGAM1071 host target protein, herein designated VGAM HOST TARGET PROTEIN. VGAM host target protein is therefore outlined by a broken line.

It is appreciated that VGAM1071 host target gene, herein designated VGAM HOST TARGET GENE, in fact represents a plurality of VGAM1071 host target genes. The mRNA of each one of this plurality of VGAM1071 host target genes comprises one or more host target binding sites, each having a nucleotide sequence which is at least partly complementary to VGAM1071 RNA, herein designated VGAM RNA, and which when bound by VGAM1071 RNA causes inhibition of translation of respective one or more VGAM1071 host target proteins.

It is further appreciated by one skilled in the art that the mode of translational inhibition illustrated by FIG. 1 with specific reference to translational inhibition exerted by VGAM1071 gene, herein designated VGAM GENE, on one or more VGAM1071 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1071 is inhibition of expression of host target genes, as part of a novel viral mechanism of attacking a host. Accordingly, utilities of VGAM1071 include diagnosis, prevention and treatment of viral infection by Porcine Epidemic Diarrhea Virus. Specific functions, and accordingly utilities, of VGAM1071 correlate with, and may be deduced from, the identity of the host target genes which VGAM1071 binds and inhibits, and the function of these host target genes, as elaborated hereinbelow.

Nucleotide sequences of the VGAM1071 precursor RNA, herein designated VGAM PRECURSOR RNA, and of the 'diced' VGAM1071 RNA, herein designated VGAM RNA, and a schematic representation of the secondary folding of VGAM1071 folded precursor RNA, herein designated VGAM FOLDED PRECURSOR RNA, of VGAM1071 are further described hereinbelow with reference to Table 1.

Nucleotide sequences of host target binding sites, such as BINDING SITE-I, BINDING SITE-II and BINDING SITE-III of FIG. 1, found on VGAM1071 host target RNA, and schematic representation of the complementarity of each of these host target binding sites to VGAM1071 RNA, herein designated VGAM RNA, are described hereinbelow with reference to Table 2.

As mentioned hereinabove with reference to FIG. 1, a function of VGAM1071 gene, herein designated VGAM is inhibition of expression of VGAM1071 target genes. It is appreciated that specific functions, and accordingly utilities, of VGAM1071 correlate with, and may be deduced from, the identity of the target genes which VGAM1071 binds and inhibits, and the function of these target genes, as elaborated hereinbelow.

Protein Kinase (cAMP-dependent, catalytic) Inhibitor Alpha (PKIA, Accession NM_006823) is a VGAM1071 host target gene. PKIA BINDING SITE is HOST TARGET binding site found in the 5' untranslated region of mRNA encoded by PKIA, corresponding to a HOST TARGET binding site such as BINDING SITE I, BINDING SITE II or BINDING SITE III. Table 2 illustrates the complementarity of the nucleotide sequences of PKIA BINDING SITE, designated SEQ ID:13696, to the nucleotide sequence of VGAM1071 RNA, herein designated VGAM RNA, also designated SEQ ID:3782.

A function of VGAM1071 is therefore inhibition of Protein Kinase (cAMP-dependent, catalytic) Inhibitor Alpha (PKIA, Accession NM_006823). Accordingly, utilities of VGAM1071 include diagnosis, prevention and treatment of diseases and clinical conditions associated with PKIA. LOC253260 (Accession XM_171097) is another VGAM1071 host target gene. LOC253260 BINDING SITE is HOST TARGET binding site found in the 3' untranslated region of mRNA encoded by LOC253260, corresponding to a HOST TARGET binding site such as BINDING SITE I, BINDING SITE II or BINDING SITE III. Table 2 illustrates the complementarity of the nucleotide sequences of LOC253260 BINDING SITE, designated SEQ ID:45908, to the nucleotide sequence of VGAM1071 RNA, herein designated VGAM RNA, also designated SEQ ID:3782.

Another function of VGAM1071 is therefore inhibition of LOC253260 (Accession XM_171097). Accordingly, utilities of VGAM1071 include diagnosis, prevention and treatment of diseases and clinical conditions associated with LOC253260. FIG. 1 further provides a conceptual description of a novel bioinformatically detected viral gene of the present invention, referred to here as Viral Genomic Address Messenger 1072 (VGAM1072) viral gene, which modulates expression of respective host target genes thereof, the function and utility of which host target genes is known in the art.

VGAM1072 is a novel bioinformatically detected regulatory, non protein coding, viral micro RNA (miRNA) gene. The method by which VGAM1072 was detected is described hereinabove with reference to FIGS. 1-8.

VGAM1072 gene, herein designated VGAM GENE, is a viral gene contained in the genome of Porcine Epidemic Diarrhea Virus. VGAM1072 host target gene, herein designated VGAM HOST TARGET GENE, is a human gene contained in the human genome.

VGAM1072 gene encodes a VGAM1072 precursor RNA, herein designated VGAM PRECURSOR RNA. Similar to other miRNA genes, and unlike most ordinary genes, VGAM1072 precursor RNA does not encode a protein. A nucleotide sequence identical or highly similar to the nucleotide sequence of VGAM1072 precursor RNA is designated SEQ ID:1058, and is provided hereinbelow with reference to the sequence listing part. Nucleotide sequence SEQ ID:1058 is located at position 10299 relative to the genome of Porcine Epidemic Diarrhea Virus.

VGAM1072 precursor RNA folds onto itself, forming VGAM1072 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1072 folded precursor RNA into VGAM1072 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1072 RNA is designated SEQ ID:3783, and is provided hereinbelow with reference to the sequence listing part.

VGAM1072 host target gene, herein designated VGAM HOST TARGET GENE, encodes a corresponding messenger RNA, VGAM1072 host target RNA, herein designated VGAM HOST TARGET RNA. VGAM1072 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1072 RNA, herein designated VGAM RNA, binds complementarily to one or more host target binding sites located in untranslated regions of VGAM1072 host target RNA, herein designated VGAM HOST TARGET RNA. This complementary binding is due to the fact that the nucleotide sequence of VGAM1072 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1072 RNA, herein designated VGAM RNA, may have a different number of host target binding sites in untranslated regions of a VGAM1072 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1072 RNA, herein designated VGAM RNA, to host target binding sites on VGAM1072 host target RNA, herein designated VGAM HOST TARGET RNA, such as BINDING SITE I, BINDING SITE II and BINDING SITE III, inhibits translation of VGAM1072 host target RNA into VGAM1072 host target protein, herein designated VGAM HOST TARGET PROTEIN. VGAM host target protein is therefore outlined by a broken line.

It is appreciated that VGAM1072 host target gene, herein designated VGAM HOST TARGET GENE, in fact represents a plurality of VGAM1072 host target genes. The mRNA of each one of this plurality of VGAM1072 host target genes comprises one or more host target binding sites, each having a nucleotide sequence which is at least partly complementary to VGAM1072 RNA, herein designated VGAM RNA, and which when bound by VGAM1072 RNA causes inhibition of translation of respective one or more VGAM1072 host target proteins.

It is further appreciated by one skilled in the art that the mode of translational inhibition illustrated by FIG. 1 with specific reference to translational inhibition exerted by VGAM1072 gene, herein designated VGAM GENE, on one or more VGAM1072 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1072 is inhibition of expression of host target genes, as part of a novel viral mechanism of attacking a host. Accordingly, utilities of VGAM1072 include diagnosis, prevention and treatment of viral infection by Porcine Epidemic Diarrhea Virus. Specific functions, and accordingly utilities, of VGAM1072 correlate with, and may be deduced from, the identity of the host target genes which VGAM1072 binds and inhibits, and the function of these host target genes, as elaborated hereinbelow.

Nucleotide sequences of the VGAM1072 precursor RNA, herein designated VGAM PRECURSOR RNA, and of the 'diced' VGAM1072 RNA, herein designated VGAM RNA, and a schematic representation of the secondary folding of VGAM1072 folded precursor RNA, herein designated VGAM FOLDED PRECURSOR RNA, of VGAM1072 are further described hereinbelow with reference to Table 1.

Nucleotide sequences of host target binding sites, such as BINDING SITE-I, BINDING SITE-II and BINDING SITE-III of FIG. 1, found on VGAM1072 host target RNA, and schematic representation of the complementarity of each of these host target binding sites to VGAM1072 RNA, herein designated VGAM RNA, are described hereinbelow with reference to Table 2.

As mentioned hereinabove with reference to FIG. 1, a function of VGAM1072 gene, herein designated VGAM is inhibition of expression of VGAM1072 target genes. It is appreciated that specific functions, and accordingly utilities, of VGAM1072 correlate with, and may be deduced from, the identity of the target genes which VGAM1072 binds and inhibits, and the function of these target genes, as elaborated hereinbelow.

Sialic Acid Binding Ig-like Lectin 11 (SIGLEC11, Accession NM_052884) is a VGAM1072 host target gene. SIGLEC11 BINDING SITE is HOST TARGET binding site found in the 3' untranslated region of mRNA encoded by SIGLEC11, corresponding to a HOST TARGET binding site such as BINDING SITE I, BINDING SITE II or BINDING SITE III. Table 2 illustrates the complementarity of the nucleotide sequences of SIGLEC11 BINDING SITE, designated SEQ ID:27463, to the nucleotide sequence of VGAM1072 RNA, herein designated VGAM RNA, also designated SEQ ID:3783.

A function of VGAM1072 is therefore inhibition of Sialic Acid Binding Ig-like Lectin 11 (SIGLEC11, Accession NM_052884). Accordingly, utilities of VGAM1072 include diagnosis, prevention and treatment of diseases and clinical conditions associated with SIGLEC11. KIAA0977 (Accession NM_014900) is another VGAM1072 host target gene. KIAA0977 BINDING SITE is HOST TARGET binding site found in the 3' untranslated region of mRNA encoded by KIAA0977, corresponding to a HOST TARGET binding site such as BINDING SITE I, BINDING SITE II or BINDING SITE III. Table 2 illustrates the complementarity of the nucleotide sequences of KIAA0977 BINDING SITE, designated SEQ ID:17081, to the nucleotide sequence of VGAM1072 RNA, herein designated VGAM RNA, also designated SEQ ID:3783.

Another function of VGAM1072 is therefore inhibition of KIAA0977 (Accession NM_014900). Accordingly, utilities of VGAM1072 include diagnosis, prevention and treatment of diseases and clinical conditions associated with KIAA0977. SEC24 Related Gene Family, Member A (S. cerevisiae) (SEC24A, Accession XM_094581) is another VGAM1072 host target gene. SEC24A BINDING SITE is HOST TARGET binding site found in the 3' untranslated region of mRNA encoded by SEC24A, corresponding to a HOST TARGET binding site such as BINDING SITE I, BINDING SITE II or BINDING SITE III. Table 2 illustrates the complementarity of the nucleotide sequences of SEC24A BINDING SITE, designated SEQ ID:40236, to the nucleotide sequence of VGAM1072 RNA, herein designated VGAM RNA, also designated SEQ ID:3783.

Another function of VGAM1072 is therefore inhibition of SEC24 Related Gene Family, Member A (S. cerevisiae) (SEC24A, Accession XM_094581). Accordingly, utilities of VGAM1072 include diagnosis, prevention and treatment of diseases and clinical conditions associated with SEC24A. LOC146050 (Accession XM_085301) is another VGAM1072 host target gene. LOC146050 BINDING SITE is HOST TARGET binding site found in the 3' untranslated region of mRNA encoded by LOC146050, corresponding to a HOST TARGET binding site such as BINDING SITE I, BINDING SITE II or BINDING SITE III. Table 2 illustrates the complementarity of the nucleotide sequences of LOC146050 BINDING SITE, designated SEQ ID:38054, to the nucleotide sequence of VGAM1072 RNA, herein designated VGAM RNA, also designated SEQ ID:3783.

Another function of VGAM1072 is therefore inhibition of LOC146050 (Accession XM_085301). Accordingly, utilities of VGAM1072 include diagnosis, prevention and treatment of diseases and clinical conditions associated with LOC146050. FIG. 1 further provides a conceptual description of a novel bioinformatically detected viral gene of the present invention, referred to here as Viral Genomic Address Messenger 1073 (VGAM1073) viral gene, which modulates expression of respective host target genes thereof, the function and utility of which host target genes is known in the art.

VGAM1073 is a novel bioinformatically detected regulatory, non protein coding, viral micro RNA (miRNA) gene. The method by which VGAM1073 was detected is described hereinabove with reference to FIGS. 1-8.

VGAM1073 gene, herein designated VGAM GENE, is a viral gene contained in the genome of Porcine Epidemic Diarrhea Virus. VGAM1073 host target gene, herein designated VGAM HOST TARGET GENE, is a human gene contained in the human genome.

VGAM1073 gene encodes a VGAM1073 precursor RNA, herein designated VGAM PRECURSOR RNA. Similar to other miRNA genes, and unlike most ordinary genes, VGAM1073 precursor RNA does not encode a protein. A nucleotide sequence identical or highly similar to the nucleotide sequence of VGAM1073 precursor RNA is designated SEQ ID:1059, and is provided hereinbelow with reference to the sequence listing part. Nucleotide sequence SEQ ID:1059 is located at position 11550 relative to the genome of Porcine Epidemic Diarrhea Virus.

VGAM1073 precursor RNA folds onto itself, forming VGAM1073 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1073 folded precursor RNA into VGAM1073 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1073 RNA is designated SEQ ID:3784, and is provided hereinbelow with reference to the sequence listing part.

VGAM1073 host target gene, herein designated VGAM HOST TARGET GENE, encodes a corresponding messenger RNA, VGAM1073 host target RNA, herein designated VGAM HOST TARGET RNA. VGAM1073 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1073 RNA, herein designated VGAM RNA, binds complementarily to one or more host target binding sites located in untranslated regions of VGAM1073 host target RNA, herein designated VGAM HOST TARGET RNA. This complementary binding is due to the fact that the nucleotide sequence of VGAM1073 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1073 RNA, herein designated VGAM RNA, may have a different number of host target binding sites in untranslated regions of a VGAM1073 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1073 RNA, herein designated VGAM RNA, to host target binding sites on VGAM1073 host target RNA, herein designated VGAM HOST TARGET RNA, such as BINDING SITE I, BINDING SITE II and BINDING SITE III, inhibits translation of VGAM1073 host target RNA into VGAM1073 host target protein, herein designated VGAM HOST TARGET PROTEIN. VGAM host target protein is therefore outlined by a broken line.

It is appreciated that VGAM1073 host target gene, herein designated VGAM HOST TARGET GENE, in fact represents a plurality of VGAM1073 host target genes. The mRNA of each one of this plurality of VGAM1073 host target genes comprises one or more host target binding sites, each having a nucleotide sequence which is at least partly complementary to VGAM1073 RNA, herein designated VGAM RNA, and which when bound by VGAM1073 RNA causes inhibition of translation of respective one or more VGAM1073 host target proteins.

It is further appreciated by one skilled in the art that the mode of translational inhibition illustrated by FIG. 1 with specific reference to translational inhibition exerted by VGAM1073 gene, herein designated VGAM GENE, on one or more VGAM1073 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1073 is inhibition of expression of host target genes, as part of a novel viral mechanism of attacking a host. Accordingly, utilities of VGAM1073 include diagnosis, prevention and treatment of viral infection by Porcine Epidemic Diarrhea Virus. Specific functions, and accordingly utilities, of VGAM1073 correlate with, and may be deduced from, the identity of the host target genes which VGAM1073 binds and inhibits, and the function of these host target genes, as elaborated hereinbelow.

Nucleotide sequences of the VGAM1073 precursor RNA, herein designated VGAM PRECURSOR RNA, and of the 'diced' VGAM1073 RNA, herein designated VGAM RNA, and a schematic representation of the secondary folding of VGAM1073 folded precursor RNA, herein designated VGAM FOLDED PRECURSOR RNA, of VGAM1073 are further described hereinbelow with reference to Table 1.

Nucleotide sequences of host target binding sites, such as BINDING SITE-I, BINDING SITE-II and BINDING SITE-III of FIG. 1, found on VGAM1073 host target RNA, and schematic representation of the complementarity of each of these host target binding sites to VGAM1073 RNA, herein designated VGAM RNA, are described hereinbelow with reference to Table 2.

As mentioned hereinabove with reference to FIG. 1, a function of VGAM1073 gene, herein designated VGAM is inhibition of expression of VGAM1073 target genes. It is appreciated that specific functions, and accordingly utilities, of VGAM1073 correlate with, and may be deduced from, the identity of the target genes which VGAM1073 binds and inhibits, and the function of these target genes, as elaborated hereinbelow.

Lipase, Member I (LIPI, Accession XM_086767) is a VGAM1073 host target gene. LIPI BINDING SITE is HOST TARGET binding site found in the 3" untranslated region of mRNA encoded by LIPI, corresponding to a HOST TARGET binding site such as BINDING SITE I, BINDING SITE II or BINDING SITE III. Table 2 illustrates the complementarity of the nucleotide sequences of LIPI BINDING SITE, designated SEQ ID:38843, to the nucleotide sequence of VGAM1073 RNA, herein designated VGAM RNA, also designated SEQ ID:3784.

A function of VGAM1073 is therefore inhibition of Lipase, Member I (LIPI, Accession XM_086767). Accordingly, utilities of VGAM1073 include diagnosis, prevention and treatment of diseases and clinical conditions associated with LIPI. PRO0902 (Accession NM_053057) is another VGAM1073 host target gene. PRO0902 BINDING SITE is HOST TARGET binding site found in the 5' untranslated region of mRNA encoded by PRO0902, corresponding to a HOST TARGET binding site such as BINDING SITE I, BINDING SITE II or BINDING SITE III. Table 2 illustrates the complementarity of the nucleotide sequences of PRO0902 BINDING SITE, designated SEQ ID:27607, to the nucleotide sequence of VGAM1073 RNA, herein designated VGAM RNA, also designated SEQ ID:3784.

Another function of VGAM1073 is therefore inhibition of PRO0902 (Accession NM_053057). Accordingly, utilities of VGAM1073 include diagnosis, prevention and treatment of diseases and clinical conditions associated with PRO0902. LOC153937 (Accession XM_087813) is another VGAM1073 host target gene. LOC153937 BINDING SITE is HOST TARGET binding site found in the 3' untranslated region of mRNA encoded by LOC153937, corresponding to a HOST TARGET binding site such as BINDING SITE I, BINDING SITE II or BINDING SITE III. Table 2 illustrates the complementarity of the nucleotide sequences of LOC153937 BINDING SITE, designated SEQ ID:39445, to the nucleotide sequence of VGAM1073 RNA, herein designated VGAM RNA, also designated SEQ ID:3784.

Another function of VGAM1073 is therefore inhibition of LOC153937 (Accession XM_087813). Accordingly, utilities of VGAM1073 include diagnosis, prevention and treatment of diseases and clinical conditions associated with LOC153937. LOC51028 (Accession NM_016075) is another VGAM1073 host target gene. LOC51028 BINDING SITE is HOST TARGET binding site found in the 3' untranslated region of mRNA encoded by LOC51028, corresponding to a HOST TARGET binding site such as BINDING SITE I, BINDING SITE II or BINDING SITE III. Table 2 illustrates the complementarity of the nucleotide sequences of LOC51028 BINDING SITE, designated SEQ ID:18149, to the nucleotide sequence of VGAM1073 RNA, herein designated VGAM RNA, also designated SEQ ID:3784.

Another function of VGAM1073 is therefore inhibition of LOC51028 (Accession NM_016075). Accordingly, utilities of VGAM1073 include diagnosis, prevention and treatment of diseases and clinical conditions associated with LOC51028. FIG. 1 further provides a conceptual description of a novel bioinformatically detected viral gene of the present invention, referred to here as Viral Genomic Address Messenger 1074 (VGAM1074) viral gene, which modulates expression of respective host target genes thereof, the function and utility of which host target genes is known in the art.

VGAM1074 is a novel bioinformatically detected regulatory, non protein coding, viral micro RNA (miRNA) gene. The method by which VGAM1074 was detected is described hereinabove with reference to FIGS. 1-8.

VGAM1074 gene, herein designated VGAM GENE, is a viral gene contained in the genome of Porcine Epidemic Diarrhea Virus. VGAM1074 host target gene, herein designated VGAM HOST TARGET GENE, is a human gene contained in the human genome.

VGAM1074 gene encodes a VGAM1074 precursor RNA, herein designated VGAM PRECURSOR RNA. Similar to other miRNA genes, and unlike most ordinary genes, VGAM1074 precursor RNA does not encode a protein. A nucleotide sequence identical or highly similar to the nucleotide sequence of VGAM1074 precursor RNA is designated SEQ ID:1060, and is provided hereinbelow with reference to the sequence listing part. Nucleotide sequence SEQ ID:1060 is located at position 2902 relative to the genome of Porcine Epidemic Diarrhea Virus.

VGAM1074 precursor RNA folds onto itself, forming VGAM1074 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1074 folded precursor RNA into VGAM1074 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1074 RNA is designated SEQ ID:3785, and is provided hereinbelow with reference to the sequence listing part.

VGAM1074 host target gene, herein designated VGAM HOST TARGET GENE, encodes a corresponding messenger RNA, VGAM1074 host target RNA, herein designated VGAM HOST TARGET RNA. VGAM1074 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1074 RNA, herein designated VGAM RNA, binds complementarily to one or more host target binding sites located in untranslated regions of VGAM1074 host target RNA, herein designated VGAM HOST TARGET RNA. This complementary binding is due to the fact that the nucleotide sequence of VGAM1074 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1074 RNA, herein designated VGAM RNA, may have a different number of host target binding sites in untranslated regions of a VGAM1074 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1074 RNA, herein designated VGAM RNA, to host target binding sites on VGAM1074 host target RNA, herein designated VGAM HOST TARGET RNA, such as BINDING SITE I, BINDING SITE II and BINDING SITE III, inhibits translation of VGAM1074 host target RNA into VGAM1074 host target protein, herein designated VGAM HOST TARGET PROTEIN. VGAM host target protein is therefore outlined by a broken line.

It is appreciated that VGAM1074 host target gene, herein designated VGAM HOST TARGET GENE, in fact represents a plurality of VGAM1074 host target genes. The mRNA of each one of this plurality of VGAM1074 host target genes comprises one or more host target binding sites, each having a nucleotide sequence which is at least partly complementary to VGAM1074 RNA, herein designated VGAM RNA, and which when bound by VGAM1074 RNA causes inhibition of translation of respective one or more VGAM1074 host target proteins.

It is further appreciated by one skilled in the art that the mode of translational inhibition illustrated by FIG. 1 with specific reference to translational inhibition exerted by VGAM1074 gene, herein designated VGAM GENE, on one or more VGAM1074 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1074 is inhibition of expression of host target genes, as part of a novel viral mechanism of attacking a host. Accordingly, utilities of VGAM1074 include diagnosis, prevention and treatment of viral infection by Porcine Epidemic Diarrhea Virus. Specific functions, and accordingly utilities, of VGAM1074 correlate with, and may be deduced from, the identity of the host target genes which VGAM1074 binds and inhibits, and the function of these host target genes, as elaborated hereinbelow.

Nucleotide sequences of the VGAM1074 precursor RNA, herein designated VGAM PRECURSOR RNA, and of the 'diced' VGAM1074 RNA, herein designated VGAM RNA, and a schematic representation of the secondary folding of VGAM1074 folded precursor RNA, herein designated VGAM FOLDED PRECURSOR RNA, of VGAM1074 are further described hereinbelow with reference to Table 1.

Nucleotide sequences of host target binding sites, such as BINDING SITE-I, BINDING SITE-II and BINDING SITE-III of FIG. 1, found on VGAM1074 host target RNA, and schematic representation of the complementarity of each of these host target binding sites to VGAM1074 RNA, herein designated VGAM RNA, are described hereinbelow with reference to Table 2.

As mentioned hereinabove with reference to FIG. 1, a function of VGAM1074 gene, herein designated VGAM is inhibition of expression of VGAM1074 target genes. It is appreciated that specific functions, and accordingly utilities, of VGAM1074 correlate with, and may be deduced from, the identity of the target genes which VGAM1074 binds and inhibits, and the function of these target genes, as elaborated hereinbelow.

Fibroblast Growth Factor Receptor 2 (bacteria-expressed kinase, keratinocyte growth factor receptor, craniofacial dysostosis 1, Crouzon syndrome, Pfeiffer syndrome, Jackson-Weiss syndrome) (FGFR2, Accession NM_023030) is a VGAM1074 host target gene. FGFR2 BINDING SITE1 through FGFR2 BINDING SITE6 are HOST TARGET binding sites found in untranslated regions of mRNA encoded by FGFR2, corresponding to HOST TARGET binding sites such as BINDING SITE I, BINDING SITE II or BINDING SITE III. Table 2 illustrates the complementarity of the nucleotide sequences of FGFR2 BINDING SITE1 through FGFR2 BINDING SITE6, designated SEQ ID:23296, SEQ ID:23290, SEQ ID:23236, SEQ ID:23302, SEQ ID:5640 and SEQ ID:23243 respectively, to the nucleotide sequence of VGAM1074 RNA, herein designated VGAM RNA, also designated SEQ ID:3785.

A function of VGAM1074 is therefore inhibition of Fibroblast Growth Factor Receptor 2 (bacteria-expressed kinase, keratinocyte growth factor receptor, craniofacial dysostosis 1, Crouzon syndrome, Pfeiffer syndrome, Jackson-Weiss syndrome) (FGFR2, Accession NM_023030). Accordingly, utilities of VGAM1074 include diagnosis, prevention and treatment of diseases and clinical conditions associated with FGFR2. T-cell Leukemia Translocation Altered Gene (TCTA, Accession NM_022171) is another VGAM1074 host target gene. TCTA BINDING SITE is HOST TARGET binding site found in the 3' untranslated region of mRNA encoded by TCTA, corresponding to a HOST TARGET binding site such as BINDING SITE I, BINDING SITE II or BINDING SITE III. Table 2 illustrates the complementarity of the nucleotide sequences of TCTA BINDING SITE, designated SEQ ID:22728, to the nucleotide sequence of VGAM1074 RNA, herein designated VGAM RNA, also designated SEQ ID:3785.

Another function of VGAM1074 is therefore inhibition of T-cell Leukemia Translocation Altered Gene (TCTA, Accession NM_022171). Accordingly, utilities of VGAM1074 include diagnosis, prevention and treatment of diseases and clinical conditions associated with TCTA. Abhydrolase Domain Containing 3 (ABHD3, Accession NM_138340) is another VGAM1074 host target gene. ABHD3 BINDING SITE is HOST TARGET binding site found in the 3' untranslated region of mRNA encoded by ABHD3, corresponding to a HOST TARGET binding site such as BINDING SITE I, BINDING SITE II or BINDING SITE III. Table 2 illustrates the complementarity of the nucleotide sequences of ABHD3 BINDING SITE, designated SEQ ID:28740, to the nucleotide sequence of VGAM1074 RNA, herein designated VGAM RNA, also designated SEQ ID:3785.

Another function of VGAM1074 is therefore inhibition of Abhydrolase Domain Containing 3 (ABHD3, Accession NM_138340). Accordingly, utilities of VGAM1074 include diagnosis, prevention and treatment of diseases and clinical conditions associated with ABHD3. FLJ10781 (Accession NM_018215) is another VGAM1074 host target gene. FLJ10781 BINDING SITE is HOST TARGET binding site found in the 3' untranslated region of mRNA encoded by FLJ10781, corresponding to a HOST TARGET binding site such as BINDING SITE I, BINDING SITE II or BINDING SITE III. Table 2 illustrates the complementarity of the nucleotide sequences of FLJ10781 BINDING SITE, designated SEQ ID:20137, to the nucleotide sequence of VGAM1074 RNA, herein designated VGAM RNA, also designated SEQ ID:3785.

Another function of VGAM1074 is therefore inhibition of FLJ10781 (Accession NM_018215). Accordingly, utilities of VGAM1074 include diagnosis, prevention and treatment of diseases and clinical conditions associated with FLJ10781. FLJ31737 (Accession NM_144984) is another VGAM1074 host target gene. FLJ31737 BINDING SITE is HOST TARGET binding site found in the 3' untranslated region of mRNA encoded by FLJ31737, corresponding to a HOST TARGET binding site such as BINDING SITE I, BINDING SITE II or BINDING SITE III. Table 2 illustrates the complementarity of the nucleotide sequences of FLJ31737 BINDING SITE, designated SEQ ID:29591, to the nucleotide sequence of VGAM1074 RNA, herein designated VGAM RNA, also designated SEQ ID:3785.

Another function of VGAM1074 is therefore inhibition of FLJ31737 (Accession NM_144984). Accordingly, utilities of VGAM1074 include diagnosis, prevention and treatment of diseases and clinical conditions associated with FLJ31737. Hepatitis B Virus X Associated Protein (HBXAP, Accession NM_016578) is another VGAM1074 host target gene. HBXAP BINDING SITE is HOST TARGET binding site found in the 3' untranslated region of mRNA encoded by HBXAP, corresponding to a HOST TARGET binding site such as BINDING SITE I, BINDING SITE II or BINDING SITE III. Table 2 illustrates the complementarity of the nucleotide sequences of HBXAP BINDING SITE, designated SEQ ID:18655, to the nucleotide sequence of VGAM1074 RNA, herein designated VGAM RNA, also designated SEQ ID:3785.

Another function of VGAM1074 is therefore inhibition of Hepatitis B Virus X Associated Protein (HBXAP, Accession NM_016578). Accordingly, utilities of VGAM1074 include diagnosis, prevention and treatment of diseases and clinical conditions associated with HBXAP. MEGF10 (Accession NM_032446) is another VGAM1074 host target gene. MEGF10 BINDING SITE is HOST TARGET binding site found in the 3' untranslated region of mRNA encoded by MEGF10, corresponding to a HOST TARGET binding site such as BINDING SITE I, BINDING SITE II or BINDING SITE III. Table 2 illustrates the complementarity of the nucleotide sequences of MEGF10 BINDING SITE, designated SEQ ID:26210, to the nucleotide sequence of VGAM1074 RNA, herein designated VGAM RNA, also designated SEQ ID:3785.

Another function of VGAM1074 is therefore inhibition of MEGF10 (Accession NM_032446). Accordingly, utilities of VGAM1074 include diagnosis, prevention and treatment of diseases and clinical conditions associated with MEGF10. LOC219333 (Accession XM_167944) is another VGAM1074 host target gene. LOC219333 BINDING SITE is HOST TARGET binding site found in the 3' untranslated region of mRNA encoded by LOC219333, corresponding to a HOST TARGET binding site such as BINDING SITE I, BINDING SITE II or BINDING SITE III. Table 2 illustrates the complementarity of the nucleotide sequences of LOC219333 BINDING SITE, designated SEQ ID:44932, to the nucleotide sequence of VGAM1074 RNA, herein designated VGAM RNA, also designated SEQ ID:3785.

Another function of VGAM1074 is therefore inhibition of LOC219333 (Accession XM_167944). Accordingly, utilities of VGAM1074 include diagnosis, prevention and treatment of diseases and clinical conditions associated with LOC219333. LOC221405 (Accession XM_168138) is another VGAM1074 host target gene. LOC221405 BINDING SITE is HOST TARGET binding site found in the 5' untranslated region of mRNA encoded by LOC221405, corresponding to a HOST TARGET binding site such as BINDING SITE I, BINDING SITE II or BINDING SITE III. Table 2 illustrates the complementarity of the nucleotide sequences of LOC221405 BINDING SITE, designated SEQ ID:45066, to the nucleotide sequence of VGAM1074 RNA, herein designated VGAM RNA, also designated SEQ ID:3785.

Another function of VGAM1074 is therefore inhibition of LOC221405 (Accession XM_168138). Accordingly, utilities of VGAM1074 include diagnosis, prevention and treatment of diseases and clinical conditions associated with LOC221405. FIG. 1 further provides a conceptual description of a novel bioinformatically detected viral gene of the present invention, referred to here as Viral Genomic Address Messenger 1075 (VGAM1075) viral gene, which modulates expression of respective host target genes thereof, the function and utility of which host target genes is known in the art.

VGAM1075 is a novel bioinformatically detected regulatory, non protein coding, viral micro RNA (miRNA) gene. The method by which VGAM1075 was detected is described hereinabove with reference to FIGS. 1-8.

VGAM1075 gene, herein designated VGAM GENE, is a viral gene contained in the genome of Porcine Epidemic Diarrhea Virus. VGAM1075 host target gene, herein designated VGAM HOST TARGET GENE, is a human gene contained in the human genome.

VGAM1075 gene encodes a VGAM1075 precursor RNA, herein designated VGAM PRECURSOR RNA. Similar to other miRNA genes, and unlike most ordinary genes, VGAM1075 precursor RNA does not encode a protein. A nucleotide sequence identical or highly similar to the nucleotide sequence of VGAM1075 precursor RNA is designated SEQ ID:1061, and is provided hereinbelow with reference to the sequence listing part. Nucleotide sequence SEQ ID:1061 is located at position 17939 relative to the genome of Porcine Epidemic Diarrhea Virus.

VGAM1075 precursor RNA folds onto itself, forming VGAM1075 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1075 folded precursor RNA into VGAM1075 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM1075 RNA is designated SEQ ID:3786, and is provided hereinbelow with reference to the sequence listing part.

VGAM1075 host target gene, herein designated VGAM HOST TARGET GENE, encodes a corresponding messenger RNA, VGAM1075 host target RNA, herein designated VGAM HOST TARGET RNA. VGAM1075 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1075 RNA, herein designated VGAM RNA, binds complementarily to one or more host target binding sites located in untranslated regions of VGAM1075 host target RNA, herein designated VGAM HOST TARGET RNA. This complementary binding is due to the fact that the nucleotide sequence of VGAM1075 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1075 RNA, herein designated VGAM RNA, may have a different number of host target binding sites in untranslated regions of a VGAM1075 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1075 RNA, herein designated VGAM RNA, to host target binding sites on VGAM1075 host target RNA, herein designated VGAM HOST TARGET RNA, such as BINDING SITE I, BINDING SITE II and BINDING SITE III, inhibits translation of VGAM1075 host target RNA into VGAM1075 host target protein, herein designated VGAM HOST TARGET PROTEIN. VGAM host target protein is therefore outlined by a broken line.

It is appreciated that VGAM1075 host target gene, herein designated VGAM HOST TARGET GENE, in fact represents a plurality of VGAM1075 host target genes. The mRNA of each one of this plurality of VGAM1075 host target genes comprises one or more host target binding sites, each having a nucleotide sequence which is at least partly complementary to VGAM1075 RNA, herein designated VGAM RNA, and which when bound by VGAM1075 RNA causes inhibition of translation of respective one or more VGAM1075 host target proteins.

It is further appreciated by one skilled in the art that the mode of translational inhibition illustrated by FIG. 1 with specific reference to translational inhibition exerted by VGAM1075 gene, herein designated VGAM GENE, on one or more VGAM1075 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1075 is inhibition of expression of host target genes, as part of a novel viral mechanism of attacking a host. Accordingly, utilities of VGAM1075 include diagnosis, prevention and treatment of viral infection by Porcine Epidemic Diarrhea Virus. Specific functions, and accordingly utilities, of VGAM1075 correlate with, and may be deduced from, the identity of the host target genes which VGAM1075 binds and inhibits, and the function of these host target genes, as elaborated hereinbelow.

Nucleotide sequences of the VGAM1075 precursor RNA, herein designated VGAM PRECURSOR RNA, and of the 'diced' VGAM1075 RNA, herein designated VGAM RNA, and a schematic representation of the secondary folding of VGAM1075 folded precursor RNA, herein designated VGAM FOLDED PRECURSOR RNA, of VGAM1075 are further described hereinbelow with reference to Table 1.

Nucleotide sequences of host target binding sites, such as BINDING SITE-I, BINDING SITE-II and BINDING SITE-III of FIG. 1, found on VGAM1075 host target RNA, and schematic representation of the complementarity of each of these host target binding sites to VGAM1075 RNA, herein designated VGAM RNA, are described hereinbelow with reference to Table 2.

As mentioned hereinabove with reference to FIG. 1, a function of VGAM1075 gene, herein designated VGAM is inhibition of expression of VGAM1075 target genes. It is appreciated that specific functions, and accordingly utilities, of VGAM1075 correlate with, and may be deduced from, the identity of the target genes which VGAM1075 binds and inhibits, and the function of these target genes, as elaborated hereinbelow.

KIAA0630 (Accession XM_114729) is a VGAM1075 host target gene. KIAA0630 BINDING SITE is HOST TARGET binding site found in the 5' untranslated region of mRNA encoded by KIAA0630, corresponding to a HOST TARGET binding site such as BINDING SITE I, BINDING SITE II or BINDING SITE III. Table 2 illustrates the complementarity of the nucleotide sequences of KIAA0630 BINDING SITE, designated SEQ ID:43062, to the nucleotide sequence of VGAM1075 RNA, herein designated VGAM RNA, also designated SEQ ID:3786.

A function of VGAM1075 is therefore inhibition of KIAA0630 (Accession XM_114729). Accordingly, utilities of VGAM1075 include diagnosis, prevention and treatment of diseases and clinical conditions associated with KIAA0630. FIG. 1 further provides a conceptual description of a novel bioinformatically detected viral gene of the present invention, referred to here as Viral Genomic Address Messenger 1076 (VGAM1076) viral gene, which modulates expression of respective host target genes thereof, the function and utility of which host target genes is known in the art.

VGAM1076 is a novel bioinformatically detected regulatory, non protein coding, viral micro RNA (miRNA) gene. The method by which VGAM1076 was detected is described hereinabove with reference to FIGS. 1-8.

VGAM1076 gene, herein designated VGAM GENE, is a viral gene contained in the genome of Porcine Epidemic Diarrhea Virus. VGAM1076 host target gene, herein designated VGAM HOST TARGET GENE, is a human gene contained in the human genome.

VGAM1076 gene encodes a VGAM1076 precursor RNA, herein designated VGAM PRECURSOR RNA. Similar to other miRNA genes, and unlike most ordinary genes, VGAM1076 precursor RNA does not encode a protein. A nucleotide sequence identical or highly similar to the nucleotide sequence of VGAM1076 precursor RNA is designated SEQ ID:1062, and is provided hereinbelow with reference to the sequence listing part. Nucleotide sequence SEQ ID:1062 is located at position 17488 relative to the genome of Porcine Epidemic Diarrhea Virus.

VGAM1076 precursor RNA folds onto itself, forming VGAM1076 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1076 folded precursor RNA into VGAM1076 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1076 RNA is designated SEQ ID:3787, and is provided hereinbelow with reference to the sequence listing part.

VGAM1076 host target gene, herein designated VGAM HOST TARGET GENE, encodes a corresponding messenger RNA, VGAM1076 host target RNA, herein designated VGAM HOST TARGET RNA. VGAM1076 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1076 RNA, herein designated VGAM RNA, binds complementarily to one or more host target binding sites located in untranslated regions of VGAM1076 host target RNA, herein designated VGAM HOST TARGET RNA. This complementary binding is due to the fact that the nucleotide sequence of VGAM1076 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1076 RNA, herein designated VGAM RNA, may have a different number of host target binding sites in untranslated regions of a VGAM1076 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1076 RNA, herein designated VGAM RNA, to host target binding sites on VGAM1076 host target RNA, herein designated VGAM HOST TARGET RNA, such as BINDING SITE I, BINDING SITE II and BINDING SITE III, inhibits translation of VGAM1076 host target RNA into VGAM1076 host target protein, herein designated VGAM HOST TARGET PROTEIN. VGAM host target protein is therefore outlined by a broken line.

It is appreciated that VGAM1076 host target gene, herein designated VGAM HOST TARGET GENE, in fact represents a plurality of VGAM1076 host target genes. The mRNA of each one of this plurality of VGAM1076 host target genes comprises one or more host target binding sites, each having a nucleotide sequence which is at least partly complementary to VGAM1076 RNA, herein designated VGAM RNA, and which when bound by VGAM1076 RNA causes inhibition of translation of respective one or more VGAM1076 host target proteins.

It is further appreciated by one skilled in the art that the mode of translational inhibition illustrated by FIG. 1 with specific reference to translational inhibition exerted by VGAM1076 gene, herein designated VGAM GENE, on one or more VGAM1076 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1076 is inhibition of expression of host target genes, as part of a novel viral mechanism of attacking a host. Accordingly, utilities of VGAM1076 include diagnosis, prevention and treatment of viral infection by Porcine Epidemic Diarrhea Virus. Specific functions, and accordingly utilities, of VGAM1076 correlate with, and may be deduced from, the identity of the host target genes which VGAM1076 binds and inhibits, and the function of these host target genes, as elaborated hereinbelow.

Nucleotide sequences of the VGAM1076 precursor RNA, herein designated VGAM PRECURSOR RNA, and of the 'diced' VGAM1076 RNA, herein designated VGAM RNA, and a schematic representation of the secondary folding of VGAM1076 folded precursor RNA, herein designated VGAM FOLDED PRECURSOR RNA, of VGAM1076 are further described hereinbelow with reference to Table 1.

Nucleotide sequences of host target binding sites, such as BINDING SITE-I, BINDING SITE-II and BINDING SITE-III of FIG. 1, found on VGAM1076 host target RNA, and schematic representation of the complementarity of each of these host target binding sites to VGAM1076 RNA, herein designated VGAM RNA, are described hereinbelow with reference to Table 2.

As mentioned hereinabove with reference to FIG. 1, a function of VGAM1076 gene, herein designated VGAM is inhibition of expression of VGAM1076 target genes. It is appreciated that specific functions, and accordingly utilities, of VGAM1076 correlate with, and may be deduced from, the identity of the target genes which VGAM1076 binds and inhibits, and the function of these target genes, as elaborated hereinbelow.

Indolethylamine N-methyltransferase (INMT, Accession NM_006774) is a VGAM1076 host target gene. INMT BINDING SITE is HOST TARGET binding site found in the 3' untranslated region of mRNA encoded by INMT, corresponding to a HOST TARGET binding site such as BINDING SITE I, BINDING SITE II or BINDING SITE III. Table 2 illustrates the complementarity of the nucleotide sequences of INMT BINDING SITE, designated SEQ ID:13648, to the nucleotide sequence of VGAM1076 RNA, herein designated VGAM RNA, also designated SEQ ID:3787.

A function of VGAM1076 is therefore inhibition of Indolethylamine N-methyltransferase (INMT, Accession NM_006774). Accordingly, utilities of VGAM1076 include diagnosis, prevention and treatment of diseases and clinical conditions associated with INMT. SRGAP1 (Accession XM_051143) is another VGAM1076 host target gene. SRGAP1 BINDING SITE is HOST TARGET binding site found in the 3' untranslated region of mRNA encoded by SRGAP1, corresponding to a HOST TARGET binding site such as BINDING SITE I, BINDING SITE II or BINDING SITE III. Table 2 illustrates the complementarity of the nucleotide sequences of SRGAP1 BINDING SITE, designated SEQ ID:35758, to the nucleotide sequence of VGAM1076 RNA, herein designated VGAM RNA, also designated SEQ ID:3787.

Another function of VGAM1076 is therefore inhibition of SRGAP1 (Accession XM_051143). Accordingly, utilities of VGAM1076 include diagnosis, prevention and treatment of diseases and clinical conditions associated with SRGAP1. Von Hippel-Lindau Syndrome (VHL, Accession NM_000551) is another VGAM1076 host target gene. VHL BINDING SITE is HOST TARGET binding site found in the 3' untranslated region of mRNA encoded by VHL, corresponding to a HOST TARGET binding site such as BINDING SITE I, BINDING SITE II or BINDING SITE III. Table 2 illustrates the complementarity of the nucleotide sequences of VHL BINDING SITE, designated SEQ ID:6157, to the nucleotide sequence of VGAM1076 RNA, herein designated VGAM RNA, also designated SEQ ID:3787.

Another function of VGAM1076 is therefore inhibition of Von Hippel-Lindau Syndrome (VHL, Accession NM_000551), a gene which may control rna stability through the selective degradation of rna-bound proteins. Accordingly, utilities of VGAM1076 include diagnosis, prevention and treatment of diseases and clinical conditions associated with VHL. The function of VHL and its association with various diseases and clinical conditions, has been established by previous studies, as described hereinabove with reference to VGAM197. DKFZP566F2124 (Accession NM_015630) is another VGAM1076 host target gene. DKFZP566F2124 BINDING SITE is HOST TARGET binding site found in the 3' untranslated region of mRNA encoded by DKFZP566F2124, corresponding to a HOST TARGET binding site such as BINDING SITE I, BINDING SITE II or BINDING SITE III. Table 2 illustrates the complementarity of the nucleotide sequences of DKFZP566F2124 BINDING SITE, designated SEQ ID:17891, to the nucleotide sequence of VGAM1076 RNA, herein designated VGAM RNA, also designated SEQ ID:3787.

Another function of VGAM1076 is therefore inhibition of DKFZP566F2124 (Accession NM_015630). Accordingly, utilities of VGAM1076 include diagnosis, prevention and treatment of diseases and clinical conditions associated with DKFZP566F2124. FLJ13910 (Accession NM_022780) is another VGAM1076 host target gene. FLJ13910 BINDING SITE is HOST TARGET binding site found in the 3' untranslated region of mRNA encoded by FLJ13910, corresponding to a HOST TARGET binding site such as BINDING SITE I, BINDING SITE II or BINDING SITE III. Table 2 illustrates the complementarity of the nucleotide sequences of FLJ13910 BINDING SITE, designated SEQ ID:23052, to the nucleotide sequence of VGAM1076 RNA, herein designated VGAM RNA, also designated SEQ ID:3787.

Another function of VGAM1076 is therefore inhibition of FLJ13910 (Accession NM_022780). Accordingly, utilities of VGAM1076 include diagnosis, prevention and treatment of diseases and clinical conditions associated with FLJ13910. FLJ22679 (Accession NM_017698) is another VGAM1076 host target gene. FLJ22679 BINDING SITE is HOST TARGET binding site found in the 3' untranslated region of mRNA encoded by FLJ22679, corresponding to a HOST TARGET binding site such as BINDING SITE I, BINDING SITE II or BINDING SITE III. Table 2 illustrates the complementarity of the nucleotide sequences of FLJ22679 BINDING SITE, designated SEQ ID:19265, to the nucleotide sequence of VGAM1076 RNA, herein designated VGAM RNA, also designated SEQ ID:3787.

Another function of VGAM1076 is therefore inhibition of FLJ22679 (Accession NM_017698). Accordingly, utilities of VGAM1076 include diagnosis, prevention and treatment of diseases and clinical conditions associated with FLJ22679. Pleiomorphic Adenoma Gene-like 2 (PLAGL2, Accession XM_047007) is another VGAM1076 host target gene. PLAGL2 BINDING SITE is HOST TARGET binding site found in the 3' untranslated region of mRNA encoded by PLAGL2, corresponding to a HOST TARGET binding site such as BINDING SITE I, BINDING SITE II or BINDING SITE III. Table 2 illustrates the complementarity of the nucleotide sequences of PLAGL2 BINDING SITE, designated SEQ ID:34879, to the nucleotide sequence of VGAM1076 RNA, herein designated VGAM RNA, also designated SEQ ID:3787.

Another function of VGAM1076 is therefore inhibition of Pleiomorphic Adenoma Gene-like 2 (PLAGL2, Accession XM_047007). Accordingly, utilities of VGAM1076 include diagnosis, prevention and treatment of diseases and clinical conditions associated with PLAGL2. Rho-related BTB Domain Containing 2 (RHOBTB2, Accession XM_027679) is another VGAM1076 host target gene. RHOBTB2 BINDING SITE is HOST TARGET binding site found in the 3' untranslated region of mRNA encoded by RHOBTB2, corresponding to a HOST TARGET binding site such as BINDING SITE I, BINDING SITE II or BINDING SITE III. Table 2 illustrates the complementarity of the nucleotide sequences of RHOBTB2 BINDING SITE, designated SEQ ID:30561, to the nucleotide sequence of VGAM1076 RNA, herein designated VGAM RNA, also designated SEQ ID:3787.

Another function of VGAM1076 is therefore inhibition of Rho-related BTB Domain Containing 2 (RHOBTB2, Accession XM_027679). Accordingly, utilities of VGAM1076 include diagnosis, prevention and treatment of diseases and clinical conditions associated with RHOBTB2. UCK1 (Accession NM_031432) is another VGAM1076 host target gene. UCK1 BINDING SITE is HOST TARGET binding site found in the 3' untranslated region of mRNA encoded by UCK1, corresponding to a HOST TARGET binding site such as BINDING SITE I, BINDING SITE II or BINDING SITE III. Table 2 illustrates the complementarity of the nucleotide sequences of UCK1 BINDING SITE, designated SEQ ID:25427, to the nucleotide sequence of VGAM1076 RNA, herein designated VGAM RNA, also designated SEQ ID:3787.

Another function of VGAM1076 is therefore inhibition of UCK1 (Accession NM_031432). Accordingly, utilities of VGAM1076 include diagnosis, prevention and treatment of diseases and clinical conditions associated with UCK1. LOC149465 (Accession XM_086543) is another VGAM1076 host target gene. LOC149465 BINDING SITE is HOST TARGET binding site found in the 3' untranslated region of mRNA encoded by LOC149465, corresponding to a HOST TARGET binding site such as BINDING SITE I, BINDING SITE II or BINDING SITE III. Table 2 illustrates the complementarity of the nucleotide sequences of LOC149465 BINDING SITE, designated SEQ ID:38758, to the nucleotide sequence of VGAM1076 RNA, herein designated VGAM RNA, also designated SEQ ID:3787.

Another function of VGAM1076 is therefore inhibition of LOC149465 (Accession XM_086543). Accordingly, utilities of VGAM1076 include diagnosis, prevention and treatment of diseases and clinical conditions associated with LOC149465. LOC199858 (Accession XM_114040) is another VGAM1076 host target gene. LOC199858 BINDING SITE is HOST TARGET binding site found in the 5' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42641, to the nucleotide sequence of VGAM1076 RNA, herein designated VGAM RNA, also designated SEQ ID:3787.

Another function of VGAM1076 is therefore inhibition of LOC199858 (Accession XM_114040). Accordingly, utilities of VGAM1076 include diagnosis, prevention and treatment of diseases and clinical conditions associated with LOC199858. LOC201182 (Accession XM_117055) is another VGAM1076 host target gene. LOC201182 BINDING SITE is HOST TARGET binding site found in the 5' untranslated region of mRNA encoded by LOC201182, corresponding to a HOST TARGET binding site such as BINDING SITE I, BINDING SITE II or BINDING SITE III. Table 2 illustrates the complementarity of the nucleotide sequences of LOC201182 BINDING SITE, designated SEQ ID:43210, to the nucleotide sequence of VGAM1076 RNA, herein designated VGAM RNA, also designated SEQ ID:3787.

Another function of VGAM1076 is therefore inhibition of LOC201182 (Accession XM_117055). Accordingly, utilities of VGAM1076 include diagnosis, prevention and treatment of diseases and clinical conditions associated with LOC201182. LOC91050 (Accession XM_035703) is another VGAM1076 host target gene. LOC91050 BINDING SITE is HOST TARGET binding site found in the 3' untranslated region of mRNA encoded by LOC91050, corresponding to a HOST TARGET binding site such as BINDING SITE I, BINDING SITE II or BINDING SITE III. Table 2 illustrates the complementarity of the nucleotide sequences of LOC91050 BINDING SITE, designated SEQ ID:32331, to the nucleotide sequence of VGAM1076 RNA, herein designated VGAM RNA, also designated SEQ ID:3787.

Another function of VGAM1076 is therefore inhibition of LOC91050 (Accession XM_035703). Accordingly, utilities of VGAM1076 include diagnosis, prevention and treatment of diseases and clinical conditions associated with LOC91050. FIG. 1 further provides a conceptual description of a novel bioinformatically detected viral gene of the present invention, referred to here as Viral Genomic Address Messenger 1077 (VGAM1077) viral gene, which modulates expression of respective host target genes thereof, the function and utility of which host target genes is known in the art.

VGAM1077 is a novel bioinformatically detected regulatory, non protein coding, viral micro RNA (miRNA) gene. The method by which VGAM1077 was detected is described hereinabove with reference to FIGS. 1-8.

VGAM1077 gene, herein designated VGAM GENE, is a viral gene contained in the genome of Porcine Epidemic Diarrhea Virus. VGAM1077 host target gene, herein designated VGAM HOST TARGET GENE, is a human gene contained in the human genome.

VGAM1077 gene encodes a VGAM1077 precursor RNA, herein designated VGAM PRECURSOR RNA. Similar to other miRNA genes, and unlike most ordinary genes, VGAM1077 precursor RNA does not encode a protein. A nucleotide sequence identical or highly similar to the nucleotide sequence of VGAM1077 precursor RNA is designated SEQ ID:1063, and is provided hereinbelow with reference to the sequence listing part. Nucleotide sequence SEQ ID:1063 is located at position 1109 relative to the genome of Porcine Epidemic Diarrhea Virus.

VGAM1077 precursor RNA folds onto itself, forming VGAM1077 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1077 folded precursor RNA into VGAM1077 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1077 RNA is designated SEQ ID:3788, and is provided hereinbelow with reference to the sequence listing part.

VGAM1077 host target gene, herein designated VGAM HOST TARGET GENE, encodes a corresponding messenger RNA, VGAM1077 host target RNA, herein designated VGAM HOST TARGET RNA. VGAM1077 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1077 RNA, herein designated VGAM RNA, binds complementarily to one or more host target binding sites located in untranslated regions of VGAM1077 host target RNA, herein designated VGAM HOST TARGET RNA. This complementary binding is due to the fact that the nucleotide sequence of VGAM1077 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1077 RNA, herein designated VGAM RNA, may have a different number of host target binding sites in untranslated regions of a VGAM1077 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1077 RNA, herein designated VGAM RNA, to host target binding sites on VGAM1077 host target RNA, herein designated VGAM HOST TARGET RNA, such as BINDING SITE I, BINDING SITE II and BINDING SITE III, inhibits translation of VGAM1077 host target RNA into VGAM1077 host target protein, herein designated VGAM HOST TARGET PROTEIN. VGAM host target protein is therefore outlined by a broken line.

It is appreciated that VGAM1077 host target gene, herein designated VGAM HOST TARGET GENE, in fact represents a plurality of VGAM1077 host target genes. The mRNA of each one of this plurality of VGAM1077 host target genes comprises one or more host target binding sites, each having a nucleotide sequence which is at least partly complementary to VGAM1077 RNA, herein designated VGAM RNA, and which when bound by VGAM1077 RNA causes inhibition of translation of respective one or more VGAM1077 host target proteins.

It is further appreciated by one skilled in the art that the mode of translational inhibition illustrated by FIG. 1 with specific reference to translational inhibition exerted by VGAM1077 gene, herein designated VGAM GENE, on one or more VGAM1077 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1077 is inhibition of expression of host target genes, as part of a novel viral mechanism of attacking a host. Accordingly, utilities of VGAM1077 include diagnosis, prevention and treatment of viral infection by Porcine Epidemic Diarrhea Virus. Specific functions, and accordingly utilities, of VGAM1077 correlate with, and may be deduced from, the identity of the host target genes which VGAM1077 binds and inhibits, and the function of these host target genes, as elaborated hereinbelow.

Nucleotide sequences of the VGAM1077 precursor RNA, herein designated VGAM PRECURSOR RNA, and of the 'diced' VGAM1077 RNA, herein designated VGAM RNA, and a schematic representation of the secondary folding of VGAM1077 folded precursor RNA, herein designated VGAM FOLDED PRECURSOR RNA, of VGAM1077 are further described hereinbelow with reference to Table 1.

Nucleotide sequences of host target binding sites, such as BINDING SITE-I, BINDING SITE-II and BINDING SITE-III of FIG. 1, found on VGAM1077 host target RNA, and schematic representation of the complementarity of each of these host target binding sites to VGAM1077 RNA, herein designated VGAM RNA, are described hereinbelow with reference to Table 2.

As mentioned hereinabove with reference to FIG. 1, a function of VGAM1077 gene, herein designated VGAM is inhibition of expression of VGAM1077 target genes. It is appreciated that specific functions, and accordingly utilities, of VGAM1077 correlate with, and may be deduced from, the identity of the target genes which VGAM1077 binds and inhibits, and the function of these target genes, as elaborated hereinbelow.

KIAA0618 (Accession NM_014833) is a VGAM1077 host target gene. KIAA0618 BINDING SITE is HOST TARGET binding site found in the 3' untranslated region of mRNA encoded by KIAA0618, corresponding to a HOST TARGET binding site such as BINDING SITE I, BINDING SITE II or BINDING SITE III. Table 2 illustrates the complementarity of the nucleotide sequences of KIAA0618 BINDING SITE, designated SEQ ID:16832, to the nucleotide sequence of VGAM1077 RNA, herein designated VGAM RNA, also designated SEQ ID:3788.

A function of VGAM1077 is therefore inhibition of KIAA0618 (Accession NM_014833). Accordingly, utilities of VGAM1077 include diagnosis, prevention and treatment of diseases and clinical conditions associated with KIAA0618. KIAA1467 (Accession XM_049605) is another VGAM1077 host target gene. KIAA1467 BINDING SITE is HOST TARGET binding site found in the 3' untranslated region of mRNA encoded by KIAA1467, corresponding to a HOST TARGET binding site such as BINDING SITE I, BINDING SITE II or BINDING SITE III. Table 2 illustrates the complementarity of the nucleotide sequences of KIAA1467 BINDING SITE, designated SEQ ID:35456, to the nucleotide sequence of VGAM1077 RNA, herein designated VGAM RNA, also designated SEQ ID:3788.

Another function of VGAM1077 is therefore inhibition of KIAA1467 (Accession XM_049605). Accordingly, utilities of VGAM1077 include diagnosis, prevention and treatment of diseases and clinical conditions associated with KIAA1467. MO25 (Accession NM_016289) is another VGAM1077 host target gene. MO25 BINDING SITE is HOST TARGET binding site found in the 3' untranslated region of mRNA encoded by MO25, corresponding to a HOST TARGET binding site such as BINDING SITE I, BINDING SITE II or BINDING SITE III. Table 2 illustrates the complementarity of the nucleotide sequences of MO25 BINDING SITE, designated SEQ ID:18416, to the nucleotide sequence of VGAM1077 RNA, herein designated VGAM RNA, also designated SEQ ID:3788.

Another function of VGAM1077 is therefore inhibition of MO25 (Accession NM_016289). Accordingly, utilities of VGAM1077 include diagnosis, prevention and treatment of diseases and clinical conditions associated with MO25. LOC129011 (Accession XM_059326) is another VGAM1077 host target gene. LOC129011 BINDING SITE is HOST TARGET binding site found in the 3' untranslated region of mRNA encoded by LOC129011, corresponding to a HOST TARGET binding site such as BINDING SITE I, BINDING SITE II or BINDING SITE III. Table 2 illustrates the complementarity of the nucleotide sequences of LOC129011 BINDING SITE, designated SEQ ID:36963, to the nucleotide sequence of VGAM1077 RNA, herein designated VGAM RNA, also designated SEQ ID:3788.

Another function of VGAM1077 is therefore inhibition of LOC129011 (Accession XM_059326). Accordingly, utilities of VGAM1077 include diagnosis, prevention and treatment of diseases and clinical conditions associated with LOC129011. LOC145945 (Accession XM_096908) is another VGAM1077 host target gene. LOC145945 BINDING SITE is HOST TARGET binding site found in the 3' untranslated region of mRNA encoded by LOC145945, corresponding to a HOST TARGET binding site such as BINDING SITE I, BINDING SITE II or BINDING SITE III. Table 2 illustrates the complementarity of the nucleotide sequences of LOC145945 BINDING SITE, designated SEQ ID:40639, to the nucleotide sequence of VGAM1077 RNA, herein designated VGAM RNA, also designated SEQ ID:3788.

Another function of VGAM1077 is therefore inhibition of LOC145945 (Accession XM_096908). Accordingly, utilities of VGAM1077 include diagnosis, prevention and treatment of diseases and clinical conditions associated with LOC145945. LOC148534 (Accession XM_086222) is another VGAM1077 host target gene. LOC148534 BINDING SITE is HOST TARGET binding site found in the 3' untranslated region of mRNA encoded by LOC148534, corresponding to a HOST TARGET binding site such as BINDING SITE I, BINDING SITE II or BINDING SITE III. Table 2 illustrates the complementarity of the nucleotide sequences of LOC148534 BINDING SITE, designated SEQ ID:38549, to the nucleotide sequence of VGAM1077 RNA, herein designated VGAM RNA, also designated SEQ ID:3788.

Another function of VGAM1077 is therefore inhibition of LOC148534 (Accession XM_086222). Accordingly, utilities of VGAM1077 include diagnosis, prevention and treatment of diseases and clinical conditions associated with LOC148534. LOC150407 (Accession XM_086906) is another VGAM1077 host target gene. LOC150407 BINDING SITE is HOST TARGET binding site found in the 3' untranslated region of mRNA encoded by LOC150407, corresponding to a HOST TARGET binding site such as BINDING SITE I, BINDING SITE II or BINDING SITE III. Table 2 illustrates the complementarity of the nucleotide sequences of LOC150407 BINDING SITE, designated SEQ ID:38949, to the nucleotide sequence of VGAM1077 RNA, herein designated VGAM RNA, also designated SEQ ID:3788.

Another function of VGAM1077 is therefore inhibition of LOC150407 (Accession XM_086906). Accordingly, utilities of VGAM1077 include diagnosis, prevention and treatment of diseases and clinical conditions associated with LOC150407. LOC221354 (Accession XM_166468) is another VGAM1077 host target gene. LOC221354 BINDING SITE is HOST TARGET binding site found in the 3' untranslated region of mRNA encoded by LOC221354, corresponding to a HOST TARGET binding site such as BINDING SITE I, BINDING SITE II or BINDING SITE III. Table 2 illustrates the complementarity of the nucleotide sequences of LOC221354 BINDING SITE, designated SEQ ID:44392, to the nucleotide sequence of VGAM1077 RNA, herein designated VGAM RNA, also designated SEQ ID:3788.

Another function of VGAM1077 is therefore inhibition of LOC221354 (Accession XM_166468). Accordingly, utilities of VGAM1077 include diagnosis, prevention and treatment of diseases and clinical conditions associated with LOC221354. FIG. 1 further provides a conceptual description of a novel bioinformatically detected viral gene of the present invention, referred to here as Viral Genomic Address Messenger 1078 (VGAM1078) viral gene, which modulates expression of respective host target genes thereof, the function and utility of which host target genes is known in the art.

VGAM1078 is a novel bioinformatically detected regulatory, non protein coding, viral micro RNA (miRNA) gene. The method by which VGAM1078 was detected is described hereinabove with reference to FIGS. 1-8.

VGAM1078 gene, herein designated VGAM GENE, is a viral gene contained in the genome of Porcine Epidemic Diarrhea Virus. VGAM1078 host target gene, herein designated VGAM HOST TARGET GENE, is a human gene contained in the human genome.

VGAM1078 gene encodes a VGAM1078 precursor RNA, herein designated VGAM PRECURSOR RNA. Similar to other miRNA genes, and unlike most ordinary genes, VGAM1078 precursor RNA does not encode a protein. A nucleotide sequence identical or highly similar to the nucleotide sequence of VGAM1078 precursor RNA is designated SEQ ID:1064, and is provided hereinbelow with reference to the sequence listing part. Nucleotide sequence SEQ ID:1064 is located at position 1314 relative to the genome of Porcine Epidemic Diarrhea Virus.

VGAM1078 precursor RNA folds onto itself, forming VGAM1078 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1078 folded precursor RNA into VGAM1078 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1078 RNA is designated SEQ ID:3789, and is provided hereinbelow with reference to the sequence listing part.

VGAM1078 host target gene, herein designated VGAM HOST TARGET GENE, encodes a corresponding messenger RNA, VGAM1078 host target RNA, herein designated VGAM HOST TARGET RNA. VGAM1078 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1078 RNA, herein designated VGAM RNA, binds complementarily to one or more host target binding sites located in untranslated regions of VGAM1078 host target RNA, herein designated VGAM HOST TARGET RNA. This complementary binding is due to the fact that the nucleotide sequence of VGAM1078 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1078 RNA, herein designated VGAM RNA, may have a different number of host target binding sites in untranslated regions of a VGAM1078 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1078 RNA, herein designated VGAM RNA, to host target binding sites on VGAM1078 host target RNA, herein designated VGAM HOST TARGET RNA, such as BINDING SITE I, BINDING SITE II and BINDING SITE III, inhibits translation of VGAM1078 host target RNA into VGAM1078 host target protein, herein designated VGAM HOST TARGET PROTEIN. VGAM host target protein is therefore outlined by a broken line.

It is appreciated that VGAM1078 host target gene, herein designated VGAM HOST TARGET GENE, in fact represents a plurality of VGAM1078 host target genes. The mRNA of each one of this plurality of VGAM1078 host target genes comprises one or more host target binding sites, each having a nucleotide sequence which is at least partly complementary to VGAM1078 RNA, herein designated VGAM RNA, and which when bound by VGAM1078 RNA causes inhibition of translation of respective one or more VGAM1078 host target proteins.

It is further appreciated by one skilled in the art that the mode of translational inhibition illustrated by FIG. 1 with specific reference to translational inhibition exerted by VGAM1078 gene, herein designated VGAM GENE, on one or more VGAM1078 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1078 is inhibition of expression of host target genes, as part of a novel viral mechanism of attacking a host. Accordingly, utilities of VGAM1078 include diagnosis, prevention and treatment of viral infection by Porcine Epidemic Diarrhea Virus. Specific functions, and accordingly utilities, of VGAM1078 correlate with, and may be deduced from, the identity of the host target genes which VGAM1078 binds and inhibits, and the function of these host target genes, as elaborated hereinbelow.

Nucleotide sequences of the VGAM1078 precursor RNA, herein designated VGAM PRECURSOR RNA, and of the 'diced' VGAM1078 RNA, herein designated VGAM RNA, and a schematic representation of the secondary folding of VGAM1078 folded precursor RNA, herein designated VGAM FOLDED PRECURSOR RNA, of VGAM1078 are further described hereinbelow with reference to Table 1.

Nucleotide sequences of host target binding sites, such as BINDING SITE-I, BINDING SITE-II and BINDING SITE-III of FIG. 1, found on VGAM1078 host target RNA, and schematic representation of the complementarity of each of these host target binding sites to VGAM1078 RNA, herein designated VGAM RNA, are described hereinbelow with reference to Table 2.

As mentioned hereinabove with reference to FIG. 1, a function of VGAM1078 gene, herein designated VGAM is inhibition of expression of VGAM1078 target genes. It is appreciated that specific functions, and accordingly utilities, of VGAM1078 correlate with, and may be deduced from, the identity of the target genes which VGAM1078 binds and inhibits, and the function of these target genes, as elaborated hereinbelow.

Active BCR-related Gene (ABR, Accession NM_001092) is a VGAM1078 host target gene. ABR BINDING SITE1 and ABR BINDING SITE2 are HOST TARGET binding sites found in untranslated regions of mRNA encoded by ABR, corresponding to HOST TARGET binding sites such as BINDING SITE I, BINDING SITE II or BINDING SITE III. Table 2 illustrates the complementarity of the nucleotide sequences of ABR BINDING SITE1 and ABR BINDING SITE2, designated SEQ ID:6748 and SEQ ID:22493 respectively, to the nucleotide sequence of VGAM1078 RNA, herein designated VGAM RNA, also designated SEQ ID:3789.

A function of VGAM1078 is therefore inhibition of Active BCR-related Gene (ABR, Accession NM_001092), a gene which gtpase-activating protein for rac and cdc42. Accordingly, utilities of VGAM1078 include diagnosis, prevention and treatment of diseases and clinical conditions associated with ABR. The function of ABR and its association with various diseases and clinical conditions, has been established by previous studies, as described hereinabove with reference to VGAM489. Ephrin-A1 (EFNA1, Accession NM_004428) is another VGAM1078 host target gene. EFNA1 BINDING SITE is HOST TARGET binding site found in the 3' untranslated region of mRNA encoded by EFNA1, corresponding to a HOST TARGET binding site such as BINDING SITE I, BINDING SITE II or BINDING SITE III. Table 2 illustrates the complementarity of the nucleotide sequences of EFNA1 BINDING SITE, designated SEQ ID:10703, to the nucleotide sequence of VGAM1078 RNA, herein designated VGAM RNA, also designated SEQ ID:3789.

Another function of VGAM1078 is therefore inhibition of Ephrin-A1 (EFNA1, Accession NM_004428), a gene which is a ligand of Eph-related receptor tyrosine kinases. Accordingly, utilities of VGAM1078 include diagnosis, prevention and treatment of diseases and clinical conditions associated with EFNA1. The function of EFNA1 has been established by previous studies. Holzman et al. (1990) characterized the product of B61, one of 3 novel genes whose expression in human umbilical vein endothelial cells is induced by tumor necrosis factor-alpha in the presence of cycloheximide (see OMIM Ref. No. 191163). Southern analysis suggested to them that it is an evolutionarily conserved single-copy gene. Although primarily a hydrophilic molecule, it contained both a hydrophobic N-terminal and a hydrophobic C-terminal region. The N-terminal region was typical of a signal peptide, which is consistent with the secreted nature of the protein. The mature form of the predicted protein consists of 187 amino acid residues with a predicted molecular weight of 22,000. Sequence analysis of cDNA clones showed that the protein product of B61 had no significant homology to previously described proteins. Later it was shown to be a member of the subfamily of ligands that bind to the EPH group of receptor tyrosine kinases. These so-called LERK proteins, also called ephrins, share sequence similarity and are attached to the cell membrane by glycosylphosphatidylinositol (GPI) linkages or by a single transmembrane domain (Cerretti et al., 1996). See 179610 for additional information on ephrins and the Eph receptor family. Pandey et al. (1995) presented evidence that LERK1 is involved in TNF-alpha (OMIM Ref. No. 191160)-induced angiogenesis.

Full details of the abovementioned studies are described in the following publications, the disclosure of which are hereby incorporated by reference:

Cerretti, D. P.; Lyman, S. D.; Kozlosky, C. J.; Copeland, N. G.; Gilbert, D. J.; Jenkins, N. A.; Valentine, V.; Kirstein, M. N.; Shapiro, D. N.; Morris, S. W.: The genes encoding the Eph-related receptor tyrosine kinase ligands LERK-1 (EPLG1, Epl1), LERK-3 (EPLG3, Epl3), and LERK-4 (EPLG4, Epl4) are clustered on human chromosome 1 and mouse chromosome 3. Genomics 33:277-282, 1996; and Pandey, A.; Lindberg, R. A.; Dixit, V. M.: Receptor orphans find a family. Curr. Biol. 5:986-989, 1995.

Further studies establishing the function and utilities of EFNA1 are found in John Hopkins OMIM database record ID 191164, and in sited publications numbered 9824-9826 listed in the bibliography section hereinbelow, which are also hereby incorporated by reference. Oxidised Low Density Lipoprotein (lectin-like) Receptor 1 (OLR1, Accession NM_002543) is another VGAM1078 host target gene. OLR1 BINDING SITE is HOST TARGET binding site found in the 3' untranslated region of mRNA encoded by OLR1, corresponding to a HOST TARGET binding site such as BINDING SITE I, BINDING SITE II or BINDING SITE III. Table 2 illustrates the complementarity of the nucleotide sequences of OLR1 BINDING SITE, designated SEQ ID:8395, to the nucleotide sequence of VGAM1078 RNA, herein designated VGAM RNA, also designated SEQ ID:3789.

Another function of VGAM1078 is therefore inhibition of Oxidised Low Density Lipoprotein (lectin-like) Receptor 1 (OLR1, Accession NM_002543), a gene which is involved in degradation of oxidized LDL by vascular endothelial cells. Accordingly, utilities of VGAM1078 include diagnosis, prevention and treatment of diseases and clinical conditions associated with OLR1. The function of OLR1 has been established by previous studies. Endothelial cell dysfunction or activation elicited by oxidatively modified low density lipoprotein (OMIM Ref. No. Ox-LDL) has been implicated in the pathogenesis of atherosclerosis. Vascular endothelial cells internalize and degrade Ox-LDL through a putative receptor-mediated pathway that does not involve macrophage scavenger receptors (see OMIM Ref. No. MSR1; 153622). To identify genes encoding Ox-LDL receptors, Sawamura et al. (1997) transfected mammalian cells with a cDNA expression library derived from bovine aortic endothelial cells and assayed for uptake of labeled Ox-LDL. They recovered a cDNA encoding an Ox-LDL receptor, which they designated lectin-like Ox-LDL receptor-1 (LOX1). Immunofluorescence studies showed that bovine LOX1 is expressed on the cell surface. Sawamura et al. (1997) cloned a cDNA encoding the human homolog of LOX1 by screening a human lung cDNA library with the bovine LOX1 cDNA. Cells stably expressing human LOX1 showed uptake of labeled Ox-LDL. The predicted 273-amino acid human LOX1 protein is 72% identical to bovine LOX1. Its structure is similar to that of C-type lectins such as CD94 (KLRD1) and NKR-P1 (KLRB1). Northern blot analysis revealed that human LOX1 is expressed as a 2.8-kb mRNA in various tissues, with the most abundant expression in placenta. Yamanaka et al. (1998) determined that LOX1 is expressed in vascular-rich organs but not in lymphocytes. Yamanaka et al. (1998) found that the LOX1 gene spans approximately 15 kb and consists of 6 exons. By fluorescence in situ hybridization, they mapped the gene to 12p12-p13, where genes of the natural killer cell receptors are clustered.

Full details of the abovementioned studies are described in the following publications, the disclosure of which are hereby incorporated by reference:

Sawamura, T.; Kume, N.; Aoyama, T.; Moriwaki, H.; Hoshikawa, H.; Aiba, Y.; Tanaka, T.; Miwa, S.; Katsura, Y.; Kita, T.; Masaki, T.: An endothelial receptor for oxidized low-density lipoprotein. Nature 386:73-77, 1997; and Yamanaka, S.; Zhang, X.-Y.; Miura, K.; Kim, S.; Iwao, H.: The human gene encoding the lectin-type oxidized LDL receptor (OLR1) is a novel member of the natural killer gene complex with.

Further studies establishing the function and utilities of OLR1 are found in John Hopkins OMIM database record ID 602601, and in sited publications numbered 1112-1113 listed in the bibliography section hereinbelow, which are also hereby incorporated by reference. Oncostatin M (OSM, Accession NM_020530) is another VGAM1078 host target gene. OSM BINDING SITE is HOST TARGET binding site found in the 3' untranslated region of mRNA encoded by OSM, corresponding to a HOST TARGET binding site such as BINDING SITE I, BINDING SITE II or BINDING SITE III. Table 2 illustrates the complementarity of the nucleotide sequences of OSM BINDING SITE, designated SEQ ID:21753, to the nucleotide sequence of VGAM1078 RNA, herein designated VGAM RNA, also designated SEQ ID:3789.

Another function of VGAM1078 is therefore inhibition of Oncostatin M (OSM, Accession NM_020530), a gene which inhibits the proliferation of a number of tumor cell lines, caused an acute inflammatory reaction. Accordingly, utilities of VGAM1078 include diagnosis, prevention and treatment of diseases and clinical conditions associated with OSM. The function of OSM has been established by previous studies. Oncostatin M, a glycoprotein with an approximate molecular weight of 28,000, was originally isolated from a conditioned medium of human leukemia cells that had been induced to differentiate into macrophage-like cells by treatment with phorbol 12-myristate 13-acetate (Zarling et al., 1986). OSM has the ability to inhibit the growth of human A375 melanoma cells but not normal human fibroblasts; hence, its name. Treatment with recombinant OSM leads to the inhibition of proliferation and changes in cellular morphology of a number of tumor cell lines derived from a wide variety of tissue types. Rose and Bruce (1991) detected significant similarities in the primary amino acid sequences and predicted secondary structures of OSM, leukemia-inhibitory factor (LIF; 159540), granulocyte colony-stimulating factor (CSF3; 138970), and interleukin-6 (IL6; 147620). Using a panel of DNAs from interspecies somatic cell hybrids, they showed, furthermore, that OSM, like LIF, is located on human chromosome 22. They also demonstrated that OSM has the ability to inhibit the proliferation of murine M1 myeloid leukemic cells and can induce their differentiation into macrophage-like cells, a function shared by LIF, CSF3, and IL6. They proposed that these 4 molecules are structurally related members of a cytokine family that have in common the ability to modulate differentiation of a variety of cell types. Although oncostatin M inhibits the growth of a variety of cancer and other cells, Nair et al. (1992) and Miles et al. (1992) found that it is a potent mitogen for cells derived from HIV-related Kaposi sarcoma (OMIM Ref. No. 148000). Rose et al. (1993) found that the genes for OSM and LIF were segregating when cDNA probes were hybridized to DNA from somatic cell hybrids containing defined regions of human chromosome 22. They found a contig of approximately 100 kb surrounding the 2 genes which were tandemly arranged in the same transcriptional orientation and separated by approximately 10 kb. The direction of gene transcription was telomeric to centromeric, with the OSM gene located upstream of the LIF gene. The findings constituted strong evidence that OSM and LIF resulted from duplication of a common ancestral gene. Oncostatin M is a member of the IL-6 family of cytokines that is primarily known for its effects on cell growth. In exploration of the potential of oncostatin M as an inflammatory effector, Modur et al. (1997) found that oncostatin M caused an acute inflammatory reaction in vivo and that it colocalized with TNF-secreting cells in chronically inflamed human vascular tissue. It induced transmigration of human neutrophils through monolayers of endothelial cells by stimulating the expression of adhesion molecules and chemokines. The pattern of endothelial cell responses, however, significantly differed from the response to TNF (OMIM Ref. No. 191160). Modur et al. (1997) concluded that oncostatin M, but not other IL-6 family members, fulfilled Koch's postulates as an inflammatory mediator. Since its effects on endothelial cells differ significantly from established mediators like TNF-alpha, it may uniquely contribute to the inflammatory cycle.

Full details of the abovementioned studies are described in the following publications, the disclosure of which are hereby incorporated by reference:

Rose, T. M.; Bruce, A. G.: Oncostatin M is a member of a cytokine family that includes leukemia-inhibitory factor, granulocyte colony-stimulating factor, and interleukin 6. Proc. Nat. Acad. Sci. 88:8641-8645, 1991; and Modur, V.; Feldhaus, M. J.; Weyrich, A. S.; Jicha, D. L.; Prescott, S. M.; Zimmerman, G. A.; McIntyre, T. M.: Oncostatin M is a proinflammatory mediator: in vivo effects correlate with end.

Further studies establishing the function and utilities of OSM are found in John Hopkins OMIM database record ID 165095, and in sited publications numbered 2970-297 and 11683 listed in the bibliography section hereinbelow, which are also hereby incorporated by reference. Paired Box Gene 2 (PAX2, Accession NM_003987) is another VGAM1078 host target gene. PAX2 BINDING SITE1 and PAX2 BINDING SITE2 are HOST TARGET binding sites found in untranslated regions of mRNA encoded by PAX2, corresponding to HOST TARGET binding sites such as BINDING SITE I, BINDING SITE II or BINDING SITE III. Table 2 illustrates the complementarity of the nucleotide sequences of PAX2 BINDING SITE1 and PAX2 BINDING SITE2, designated SEQ ID:10136 and SEQ ID:10142 respectively, to the nucleotide sequence of VGAM1078 RNA, herein designated VGAM RNA, also designated SEQ ID:3789.

Another function of VGAM1078 is therefore inhibition of Paired Box Gene 2 (PAX2, Accession NM_003987), a gene which involves in kidney cell differentiation. Accordingly, utilities of VGAM1078 include diagnosis, prevention and treatment of diseases and clinical conditions associated with PAX2. The function of PAX2 and its association with various diseases and clinical conditions, has been established by previous studies, as described hereinabove with reference to VGAM407. S100 Calcium Binding Protein, Beta (neural) (S100B, Accession NM_006272) is another VGAM1078 host target gene. S100B BINDING SITE is HOST TARGET binding site found in the 3" untranslated region of mRNA encoded by S100B, corresponding to a HOST TARGET binding site such as BINDING SITE I, BINDING SITE II or BINDING SITE III. Table 2 illustrates the complementarity of the nucleotide sequences of S100B BINDING SITE, designated SEQ ID:12955, to the nucleotide sequence of VGAM1078 RNA, herein designated VGAM RNA, also designated SEQ ID:3789.

Another function of VGAM1078 is therefore inhibition of S100 Calcium Binding Protein, Beta (neural) (S100B, Accession NM_006272), a gene which weakly binds calcium but binds zinc very tightly-distinct binding sites with different affinities exist for both ions on each monomer. Accordingly, utilities of VGAM1078 include diagnosis, prevention and treatment of diseases and clinical conditions associated with S100B. The function of S100B has been established by previous studies. See 176940. The beta-subunit of S100 protein is expressed in glial cells at levels at least tenfold higher than in most other cell types. The brain also contains small amounts of the alpha subunits at levels approximately one-tenth that of the beta subunit. Allore et al. (1988) used genomic and cDNA probes in connection with a panel of rodent-human somatic cell hybrids to assign the S100B gene to 21q22. They suggested that this is a candidate gene for the neurologic disturbances in Down syndrome when present in trisomic state. By in situ hybridization, Duncan et al. (1989)

localized the S100B gene to 21q22.2-q22.3. Allore et al. (1990) isolated overlapping genomic clones spanning the region coding for S100B and its flanking sequences. The intron/exon organization is similar to that of the genes coding for several other members of the S100 protein subfamily. The S100B gene is composed of 3 exons, the first of which specifies the 5-prime untranslated region. Morii et al. (1991) isolated the S100A (OMIM Ref. No. 176940) and S100B genes from a human genomic DNA library. Endonuclease mapping and DNA sequencing showed that both comprise 3 exons and 2 introns. Two Ca (2+)-binding domains were independently encoded by exons 2 and 3. By spot-blot hybridization analysis of flow-sorted chromosomes, Morii et al. (1991) showed that the S100A and S100B genes are located on chromosome 1 and chromosome 21, respectively. Using restriction endonuclease fragment length variations (RFLV) in multipoint backcrosses, Shimizu et al. (1992) mapped the S100b gene in relation to other genes on mouse chromosome 10. The S100B gene is expressed at high levels in brain primarily by astrocytes. Addition of the disulfide-bonded dimeric form of the protein to primary neuronal and glial cultures and established cell lines induces axonal extension and alterations in astrocyte proliferation and phenotype. Reeves et al. (1994) demonstrated that the same effects of the S100B protein are exerted in vivo. They found that both astrocytosis and neurite proliferation occurred in transgenic mice expressing elevated levels of S100b. They suggested that these transgenic mice represent a useful model for studies of the role of S100B in glial-neuronal interactions in normal development and function of the brain and for analyzing the significance of elevated levels of the protein in Down syndrome and Alzheimer disease.

Full details of the abovementioned studies are described in the following publications, the disclosure of which are hereby incorporated by reference:

Reeves, R. H.; Yao, J.; Crowley, M. R.; Buck, S.; Zhang, X.; Yarowsky, P.; Gearhart, J. D.; Hilt, D. C.: Astrocytosis and axonal proliferation in the hippocampus of S100b transgenic mice. Proc. Nat. Acad. Sci. 91:5359-5363, 1994; and Shimizu, A.; Sakai, Y.; Ohno, K.; Masaki, S.; Kuwano, R.; Takahashi, Y.; Miyashita, N.; Watanabe, T.: A molecular genetic linkage map of mouse chromosome 10, including the Myb, S100b, P.

Further studies establishing the function and utilities of S100B are found in John Hopkins OMIM database record ID 176990, and in sited publications numbered 888-890, 1236 and 2742 listed in the bibliography section hereinbelow, which are also hereby incorporated by reference. SH3-domain Binding Protein 2 (SH3BP2, Accession NM_003023) is another VGAM1078 host target gene. SH3BP2 BINDING SITE is HOST TARGET binding site found in the 3' untranslated region of mRNA encoded by SH3BP2, corresponding to a HOST TARGET binding site such as BINDING SITE I, BINDING SITE II or BINDING SITE III. Table 2 illustrates the complementarity of the nucleotide sequences of SH3BP2 BINDING SITE, designated SEQ ID:8946, to the nucleotide sequence of VGAM1078 RNA, herein designated VGAM RNA, also designated SEQ ID:3789.

Another function of VGAM1078 is therefore inhibition of SH3-domain Binding Protein 2 (SH3BP2, Accession NM_003023). Accordingly, utilities of VGAM1078 include diagnosis, prevention and treatment of diseases and clinical conditions associated with SH3BP2. DKFZP566K023 (Accession NM_015485) is another VGAM1078 host target gene. DKFZP566K023 BINDING SITE is HOST TARGET binding site found in the 3' untranslated region of mRNA encoded by DKFZP566K023, corresponding to a HOST TARGET binding site such as BINDING SITE I, BINDING SITE II or BINDING SITE III. Table 2 illustrates the complementarity of the nucleotide sequences of DKFZP566K023 BINDING SITE, designated SEQ ID:17759, to the nucleotide sequence of VGAM1078 RNA, herein designated VGAM RNA, also designated SEQ ID:3789.

Another function of VGAM1078 is therefore inhibition of DKFZP566K023 (Accession NM_015485). Accordingly, utilities of VGAM1078 include diagnosis, prevention and treatment of diseases and clinical conditions associated with DKFZP566K023. ELKS (Accession NM_015064) is another VGAM1078 host target gene. ELKS BINDING SITE is HOST TARGET binding site found in the 3' untranslated region of mRNA encoded by ELKS, corresponding to a HOST TARGET binding site such as BINDING SITE I, BINDING SITE II or BINDING SITE III. Table 2 illustrates the complementarity of the nucleotide sequences of ELKS BINDING SITE, designated SEQ ID:17419, to the nucleotide sequence of VGAM1078 RNA, herein designated VGAM RNA, also designated SEQ ID:3789.

Another function of VGAM1078 is therefore inhibition of ELKS (Accession NM_015064). Accordingly, utilities of VGAM1078 include diagnosis, prevention and treatment of diseases and clinical conditions associated with ELKS. FLJ20371 (Accession NM_017791) is another VGAM1078 host target gene. FLJ20371 BINDING SITE is HOST TARGET binding site found in the 3' untranslated region of mRNA encoded by FLJ20371, corresponding to a HOST TARGET binding site such as BINDING SITE I, BINDING SITE II or BINDING SITE III. Table 2 illustrates the complementarity of the nucleotide sequences of FLJ20371 BINDING SITE, designated SEQ ID:19424, to the nucleotide sequence of VGAM1078 RNA, herein designated VGAM RNA, also designated SEQ ID:3789.

Another function of VGAM1078 is therefore inhibition of FLJ20371 (Accession NM_017791). Accordingly, utilities of VGAM1078 include diagnosis, prevention and treatment of diseases and clinical conditions associated with FLJ20371. FLJ23071 (Accession NM_025192) is another VGAM1078 host target gene. FLJ23071 BINDING SITE is HOST TARGET binding site found in the 3' untranslated region of mRNA encoded by FLJ23071, corresponding to a HOST TARGET binding site such as BINDING SITE I, BINDING SITE II or BINDING SITE III. Table 2 illustrates the complementarity of the nucleotide sequences of FLJ23071 BINDING SITE, designated SEQ ID:24846, to the nucleotide sequence of VGAM1078 RNA, herein designated VGAM RNA, also designated SEQ ID:3789.

Another function of VGAM1078 is therefore inhibition of FLJ23071 (Accession NM_025192). Accordingly, utilities of VGAM1078 include diagnosis, prevention and treatment of diseases and clinical conditions associated with FLJ23071. Hydroxysteroid (17-beta) Dehydrogenase 12 (HSD17B12, Accession NM_016142) is another VGAM1078 host target gene. HSD17B12 BINDING SITE is HOST TARGET binding site found in the 3' untranslated region of mRNA encoded by HSD17B12, corresponding to a HOST TARGET binding site such as BINDING SITE I, BINDING SITE II or BINDING SITE III. Table 2 illustrates the complementarity of the nucleotide sequences of HSD17B12 BINDING SITE, designated SEQ ID:18225, to the nucleotide sequence of VGAM1078 RNA, herein designated VGAM RNA, also designated SEQ ID:3789.

Another function of VGAM1078 is therefore inhibition of Hydroxysteroid (17-beta) Dehydrogenase 12 (HSD17B12, Accession NM_016142). Accordingly, utilities of VGAM1078 include diagnosis, prevention and treatment of diseases and clinical conditions associated with HSD17B12. HT002 (Accession NM_014066) is another VGAM1078 host target gene. HT002 BINDING SITE is HOST TARGET binding site found in the 3' untranslated region of mRNA encoded by HT002, corresponding to a HOST TARGET binding site such as BINDING SITE I, BINDING SITE II or BINDING SITE III. Table 2 illustrates the complementarity of the nucleotide sequences of HT002 BINDING SITE, designated SEQ ID:15282, to the nucleotide sequence of VGAM1078 RNA, herein designated VGAM RNA, also designated SEQ ID:3789.

Another function of VGAM1078 is therefore inhibition of HT002 (Accession NM_014066). Accordingly, utilities of VGAM1078 include diagnosis, prevention and treatment of diseases and clinical conditions associated with HT002. KIAA0061 (Accession XM_043094) is another VGAM1078 host target gene. KIAA0061 BINDING SITE is HOST TARGET binding site found in the 3' untranslated region of mRNA encoded by KIAA0061, corresponding to a HOST TARGET binding site such as BINDING SITE I, BINDING SITE II or BINDING SITE III. Table 2 illustrates the complementarity of the nucleotide sequences of KIAA0061 BINDING SITE, designated SEQ ID:33891, to the nucleotide sequence of VGAM1078 RNA, herein designated VGAM RNA, also designated SEQ ID:3789.

Another function of VGAM1078 is therefore inhibition of KIAA0061 (Accession XM_043094). Accordingly, utilities of VGAM1078 include diagnosis, prevention and treatment of diseases and clinical conditions associated with KIAA0061. KIAA0252 (Accession XM_031646) is another VGAM1078 host target gene. KIAA0252 BINDING SITE is HOST TARGET binding site found in the 3' untranslated region of mRNA encoded by KIAA0252, corresponding to a HOST TARGET binding site such as BINDING SITE I, BINDING SITE II or BINDING SITE III. Table 2 illustrates the complementarity of the nucleotide sequences of KIAA0252 BINDING SITE, designated SEQ ID:31447, to the nucleotide sequence of VGAM1078 RNA, herein designated VGAM RNA, also designated SEQ ID:3789.

Another function of VGAM1078 is therefore inhibition of KIAA0252 (Accession XM_031646). Accordingly, utilities of VGAM1078 include diagnosis, prevention and treatment of diseases and clinical conditions associated with KIAA0252. KIAA0729 (Accession XM_171027) is another VGAM1078 host target gene. KIAA0729 BINDING SITE is HOST TARGET binding site found in the 3' untranslated region of mRNA encoded by KIAA0729, corresponding to a HOST TARGET binding site such as BINDING SITE I, BINDING SITE II or BINDING SITE III. Table 2 illustrates the complementarity of the nucleotide sequences of KIAA0729 BINDING SITE, designated SEQ ID:45804, to the nucleotide sequence of VGAM1078 RNA, herein designated VGAM RNA, also designated SEQ ID:3789.

Another function of VGAM1078 is therefore inhibition of KIAA0729 (Accession XM_171027). Accordingly, utilities of VGAM1078 include diagnosis, prevention and treatment of diseases and clinical conditions associated with KIAA0729. Lipase, Endothelial (LIPG, Accession NM_006033) is another VGAM1078 host target gene. LIPG BINDING SITE is HOST TARGET binding site found in the 3' untranslated region of mRNA encoded by LIPG, corresponding to a HOST TARGET binding site such as BINDING SITE I, BINDING SITE II or BINDING SITE III. Table 2 illustrates the complementarity of the nucleotide sequences of LIPG BINDING SITE, designated SEQ ID:12653, to the nucleotide sequence of VGAM1078 RNA, herein designated VGAM RNA, also designated SEQ ID:3789.

Another function of VGAM1078 is therefore inhibition of Lipase, Endothelial (LIPG, Accession NM_006033). Accordingly, utilities of VGAM1078 include diagnosis, prevention and treatment of diseases and clinical conditions associated with LIPG. Synaptopodin 2 (SYNPO2, Accession XM_050219) is another VGAM1078 host target gene. SYNPO2 BINDING SITE is HOST TARGET binding site found in the 3' untranslated region of mRNA encoded by SYNPO2, corresponding to a HOST TARGET binding site such as BINDING SITE I, BINDING SITE II or BINDING SITE III. Table 2 illustrates the complementarity of the nucleotide sequences of SYNPO2 BINDING SITE, designated SEQ ID:35592, to the nucleotide sequence of VGAM1078 RNA, herein designated VGAM RNA, also designated SEQ ID:3789.

Another function of VGAM1078 is therefore inhibition of Synaptopodin 2 (SYNPO2, Accession XM_050219). Accordingly, utilities of VGAM1078 include diagnosis, prevention and treatment of diseases and clinical conditions associated with SYNPO2. TBLR1 (Accession NM_024665) is another VGAM1078 host target gene. TBLR1 BINDING SITE is HOST TARGET binding site found in the 3' untranslated region of mRNA encoded by TBLR1, corresponding to a HOST TARGET binding site such as BINDING SITE I, BINDING SITE II or BINDING SITE III. Table 2 illustrates the complementarity of the nucleotide sequences of TBLR1 BINDING SITE, designated SEQ ID:23964, to the nucleotide sequence of VGAM1078 RNA, herein designated VGAM RNA, also designated SEQ ID:3789.

Another function of VGAM1078 is therefore inhibition of TBLR1 (Accession NM_024665). Accordingly, utilities of VGAM1078 include diagnosis, prevention and treatment of diseases and clinical conditions associated with TBLR1. Zinc Finger Protein 300 (ZNF300, Accession NM_052860) is another VGAM1078 host target gene. ZNF300 BINDING SITE is HOST TARGET binding site found in the 5' untranslated region of mRNA encoded by ZNF300, corresponding to a HOST TARGET binding site such as BINDING SITE I, BINDING SITE II or BINDING SITE III. Table 2 illustrates the complementarity of the nucleotide sequences of ZNF300 BINDING SITE, designated SEQ ID:27439, to the nucleotide sequence of VGAM1078 RNA, herein designated VGAM RNA, also designated SEQ ID:3789.

Another function of VGAM1078 is therefore inhibition of Zinc Finger Protein 300 (ZNF300, Accession NM_052860). Accordingly, utilities of VGAM1078 include diagnosis, prevention and treatment of diseases and clinical conditions associated with ZNF300. LOC145757 (Accession XM_085227) is another VGAM1078 host target gene. LOC145757 BINDING SITE is HOST TARGET binding site found in the 5' untranslated region of mRNA encoded by LOC145757, corresponding to a HOST TARGET binding site such as BINDING SITE I, BINDING SITE II or BINDING SITE III. Table 2 illustrates the complementarity of the nucleotide sequences of LOC145757 BINDING SITE, designated SEQ ID:37968, to the nucleotide sequence of VGAM1078 RNA, herein designated VGAM RNA, also designated SEQ ID:3789.

Another function of VGAM1078 is therefore inhibition of LOC145757 (Accession XM_085227). Accordingly, utilities of VGAM1078 include diagnosis, prevention and treatment of diseases and clinical conditions associated with LOC145757. LOC145945 (Accession XM_096908) is another VGAM1078 host target gene. LOC145945 BINDING SITE is HOST TARGET binding site found in the 5' untranslated region of mRNA encoded by LOC145945, corresponding to a HOST TARGET binding site such as BIND- ING SITE I, BINDING SITE II or BINDING SITE III. Table 2 illustrates the complementarity of the nucleotide sequences of LOC145945 BINDING SITE, designated SEQ ID:40629, to the nucleotide sequence of VGAM1078 RNA, herein designated VGAM RNA, also designated SEQ ID:3789.

Another function of VGAM1078 is therefore inhibition of LOC145945 (Accession XM_096908). Accordingly, utilities of VGAM1078 include diagnosis, prevention and treatment of diseases and clinical conditions associated with LOC145945. LOC152190 (Accession XM_045692) is another VGAM1078 host target gene. LOC152190 BINDING SITE is HOST TARGET binding site found in the 5' untranslated region of mRNA encoded by LOC152190, corresponding to a HOST TARGET binding site such as BINDING SITE I, BINDING SITE II or BINDING SITE III. Table 2 illustrates the complementarity of the nucleotide sequences of LOC152190 BINDING SITE, designated SEQ ID:34524, to the nucleotide sequence of VGAM1078 RNA, herein designated VGAM RNA, also designated SEQ ID:3789.

Another function of VGAM1078 is therefore inhibition of LOC152190 (Accession XM_045692). Accordingly, utilities of VGAM1078 include diagnosis, prevention and treatment of diseases and clinical conditions associated with LOC152190. LOC201164 (Accession XM_113904) is another VGAM1078 host target gene. LOC201164 BINDING SITE is HOST TARGET binding site found in the 3' untranslated region of mRNA encoded by LOC201164, corresponding to a HOST TARGET binding site such as BINDING SITE I, BINDING SITE II or BINDING SITE III. Table 2 illustrates the complementarity of the nucleotide sequences of LOC201164 BINDING SITE, designated SEQ ID:42528, to the nucleotide sequence of VGAM1078 RNA, herein designated VGAM RNA, also designated SEQ ID:3789.

Another function of VGAM1078 is therefore inhibition of LOC201164 (Accession XM_113904). Accordingly, utilities of VGAM1078 include diagnosis, prevention and treatment of diseases and clinical conditions associated with LOC201164. LOC219899 (Accession XM_166173) is another VGAM1078 host target gene. LOC219899 BINDING SITE is HOST TARGET binding site found in the 3' untranslated region of mRNA encoded by LOC219899, corresponding to a HOST TARGET binding site such as BINDING SITE I, BINDING SITE II or BINDING SITE III. Table 2 illustrates the complementarity of the nucleotide sequences of LOC219899 BINDING SITE, designated SEQ ID:43988, to the nucleotide sequence of VGAM1078 RNA, herein designated VGAM RNA, also designated SEQ ID:3789.

Another function of VGAM1078 is therefore inhibition of LOC219899 (Accession XM_166173). Accordingly, utilities of VGAM1078 include diagnosis, prevention and treatment of diseases and clinical conditions associated with LOC219899. LOC220883 (Accession XM_166076) is another VGAM1078 host target gene. LOC220883 BINDING SITE is HOST TARGET binding site found in the 5' untranslated region of mRNA encoded by LOC220883, corresponding to a HOST TARGET binding site such as BINDING SITE I, BINDING SITE II or BINDING SITE III. Table 2 illustrates the complementarity of the nucleotide sequences of LOC220883 BINDING SITE, designated SEQ ID:43848, to the nucleotide sequence of VGAM1078 RNA, herein designated VGAM RNA, also designated SEQ ID:3789.

Another function of VGAM1078 is therefore inhibition of LOC220883 (Accession XM_166076). Accordingly, utilities of VGAM1078 include diagnosis, prevention and treatment of diseases and clinical conditions associated with LOC220883. LOC255520 (Accession XM_171073) is another VGAM1078 host target gene. LOC255520 BINDING SITE is HOST TARGET binding site found in the 3' untranslated region of mRNA encoded by LOC255520, corresponding to a HOST TARGET binding site such as BINDING SITE I, BINDING SITE II or BINDING SITE III. Table 2 illustrates the complementarity of the nucleotide sequences of LOC255520 BINDING SITE, designated SEQ ID:45877, to the nucleotide sequence of VGAM1078 RNA, herein designated VGAM RNA, also designated SEQ ID:3789.

Another function of VGAM1078 is therefore inhibition of LOC255520 (Accession XM_171073). Accordingly, utilities of VGAM1078 include diagnosis, prevention and treatment of diseases and clinical conditions associated with LOC255520. LOC255919 (Accession XM_170794) is another VGAM1078 host target gene. LOC255919 BINDING SITE is HOST TARGET binding site found in the 3' untranslated region of mRNA encoded by LOC255919, corresponding to a HOST TARGET binding site such as BINDING SITE I, BINDING SITE II or BINDING SITE III. Table 2 illustrates the complementarity of the nucleotide sequences of LOC255919 BINDING SITE, designated SEQ ID:45556, to the nucleotide sequence of VGAM1078 RNA, herein designated VGAM RNA, also designated SEQ ID:3789.

Another function of VGAM1078 is therefore inhibition of LOC255919 (Accession XM_170794). Accordingly, utilities of VGAM1078 include diagnosis, prevention and treatment of diseases and clinical conditions associated with LOC255919. LOC257355 (Accession XM_170482) is another VGAM1078 host target gene. LOC257355 BINDING SITE is HOST TARGET binding site found in the 3' untranslated region of mRNA encoded by LOC257355, corresponding to a HOST TARGET binding site such as BINDING SITE I, BINDING SITE II or BINDING SITE III. Table 2 illustrates the complementarity of the nucleotide sequences of LOC257355 BINDING SITE, designated SEQ ID:45321, to the nucleotide sequence of VGAM1078 RNA, herein designated VGAM RNA, also designated SEQ ID:3789.

Another function of VGAM1078 is therefore inhibition of LOC257355 (Accession XM_170482). Accordingly, utilities of VGAM1078 include diagnosis, prevention and treatment of diseases and clinical conditions associated with LOC257355. LOC51172 (Accession XM_032690) is another VGAM1078 host target gene. LOC51172 BINDING SITE is HOST TARGET binding site found in the 3' untranslated region of mRNA encoded by LOC51172, corresponding to a HOST TARGET binding site such as BINDING SITE I, BINDING SITE II or BINDING SITE III. Table 2 illustrates the complementarity of the nucleotide sequences of LOC51172 BINDING SITE, designated SEQ ID:31720, to the nucleotide sequence of VGAM1078 RNA, herein designated VGAM RNA, also designated SEQ ID:3789.

Another function of VGAM1078 is therefore inhibition of LOC51172 (Accession XM_032690). Accordingly, utilities of VGAM1078 include diagnosis, prevention and treatment of diseases and clinical conditions associated with LOC51172. LOC89231 (Accession XM_166577) is another VGAM1078 host target gene. LOC89231 BINDING SITE is HOST TARGET binding site found in the 3' untranslated region of mRNA encoded by LOC89231, corresponding to a HOST TARGET binding site such as BINDING SITE I, BINDING SITE II or BINDING SITE III. Table 2 illustrates the complementarity of the nucleotide sequences of LOC89231 BINDING SITE, designated SEQ ID:44550, to the nucleotide sequence of VGAM1078 RNA, herein designated VGAM RNA, also designated SEQ ID:3789.

Another function of VGAM1078 is therefore inhibition of LOC89231 (Accession XM_166577). Accordingly, utilities of VGAM1078 include diagnosis, prevention and treatment of diseases and clinical conditions associated with LOC89231. LOC90639 (Accession XM_033092) is another VGAM1078 host target gene. LOC90639 BINDING SITE is HOST TARGET binding site found in the 5' untranslated region of mRNA encoded by LOC90639, corresponding to a HOST TARGET binding site such as BINDING SITE I, BINDING SITE II or BINDING SITE III. Table 2 illustrates the complementarity of the nucleotide sequences of LOC90639 BINDING SITE, designated SEQ ID:31832, to the nucleotide sequence of VGAM1078 RNA, herein designated VGAM RNA, also designated SEQ ID:3789.

Another function of VGAM1078 is therefore inhibition of LOC90639 (Accession XM_033092). Accordingly, utilities of VGAM1078 include diagnosis, prevention and treatment of diseases and clinical conditions associated with LOC90639. LOC91565 (Accession XM_039231) is another VGAM1078 host target gene. LOC91565 BINDING SITE is HOST TARGET binding site found in the 3' untranslated region of mRNA encoded by LOC91565, corresponding to a HOST TARGET binding site such as BINDING SITE I, BINDING SITE II or BINDING SITE III. Table 2 illustrates the complementarity of the nucleotide sequences of LOC91565 BINDING SITE, designated SEQ ID:33022, to the nucleotide sequence of VGAM1078 RNA, herein designated VGAM RNA, also designated SEQ ID:3789.

Another function of VGAM1078 is therefore inhibition of LOC91565 (Accession XM_039231). Accordingly, utilities of VGAM1078 include diagnosis, prevention and treatment of diseases and clinical conditions associated with LOC91565. FIG. 1 further provides a conceptual description of a novel bioinformatically detected viral gene of the present invention, referred to here as Viral Genomic Address Messenger 1079 (VGAM1079) viral gene, which modulates expression of respective host target genes thereof, the function and utility of which host target genes is known in the art.

VGAM1079 is a novel bioinformatically detected regulatory, non protein coding, viral micro RNA (miRNA) gene. The method by which VGAM1079 was detected is described hereinabove with reference to FIGS. 1-8.

VGAM1079 gene, herein designated VGAM GENE, is a viral gene contained in the genome of Porcine Epidemic Diarrhea Virus. VGAM1079 host target gene, herein designated VGAM HOST TARGET GENE, is a human gene contained in the human genome.

VGAM1079 gene encodes a VGAM1079 precursor RNA, herein designated VGAM PRECURSOR RNA. Similar to other miRNA genes, and unlike most ordinary genes, VGAM1079 precursor RNA does not encode a protein. A nucleotide sequence identical or highly similar to the nucleotide sequence of VGAM1079 precursor RNA is designated SEQ ID:1065, and is provided hereinbelow with reference to the sequence listing part. Nucleotide sequence SEQ ID:1065 is located at position 5967 relative to the genome of Porcine Epidemic Diarrhea Virus.

VGAM1079 precursor RNA folds onto itself, forming VGAM1079 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1079 folded precursor RNA into VGAM1079 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM1079 RNA is designated SEQ ID:3790, and is provided hereinbelow with reference to the sequence listing part.

VGAM1079 host target gene, herein designated VGAM HOST TARGET GENE, encodes a corresponding messenger RNA, VGAM1079 host target RNA, herein designated VGAM HOST TARGET RNA. VGAM1079 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1079 RNA, herein designated VGAM RNA, binds complementarily to one or more host target binding sites located in untranslated regions of VGAM1079 host target RNA, herein designated VGAM HOST TARGET RNA. This complementary binding is due to the fact that the nucleotide sequence of VGAM1079 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1079 RNA, herein designated VGAM RNA, may have a different number of host target binding sites in untranslated regions of a VGAM1079 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1079 RNA, herein designated VGAM RNA, to host target binding sites on VGAM1079 host target RNA, herein designated VGAM HOST TARGET RNA, such as BINDING SITE I, BINDING SITE II and BINDING SITE III, inhibits translation of VGAM1079 host target RNA into VGAM1079 host target protein, herein designated VGAM HOST TARGET PROTEIN. VGAM host target protein is therefore outlined by a broken line.

It is appreciated that VGAM1079 host target gene, herein designated VGAM HOST TARGET GENE, in fact represents a plurality of VGAM1079 host target genes. The mRNA of each one of this plurality of VGAM1079 host target genes comprises one or more host target binding sites, each having a nucleotide sequence which is at least partly complementary to VGAM1079 RNA, herein designated VGAM RNA, and which when bound by VGAM1079 RNA causes inhibition of translation of respective one or more VGAM1079 host target proteins.

It is further appreciated by one skilled in the art that the mode of translational inhibition illustrated by FIG. 1 with specific reference to translational inhibition exerted by VGAM1079 gene, herein designated VGAM GENE, on one or more VGAM1079 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1079 is inhibition of expression of host target genes, as part of a novel viral mechanism of attacking a host. Accordingly, utilities of VGAM1079 include diagnosis, prevention and treatment of viral infection by Porcine Epidemic Diarrhea Virus. Specific functions, and accordingly utilities, of VGAM1079 correlate with, and may be deduced from, the identity of the host target genes which VGAM1079 binds and inhibits, and the function of these host target genes, as elaborated hereinbelow.

Nucleotide sequences of the VGAM1079 precursor RNA, herein designated VGAM PRECURSOR RNA, and of the 'diced' VGAM1079 RNA, herein designated VGAM RNA, and a schematic representation of the secondary folding of VGAM1079 folded precursor RNA, herein designated VGAM FOLDED PRECURSOR RNA, of VGAM1079 are further described hereinbelow with reference to Table 1.

Nucleotide sequences of host target binding sites, such as BINDING SITE-I, BINDING SITE-II and BINDING SITE-III of FIG. 1, found on VGAM1079 host target RNA, and schematic representation of the complementarity of each of these host target binding sites to VGAM1079 RNA, herein designated VGAM RNA, are described hereinbelow with reference to Table 2.

As mentioned hereinabove with reference to FIG. 1, a function of VGAM1079 gene, herein designated VGAM is inhibition of expression of VGAM1079 target genes. It is appreciated that specific functions, and accordingly utilities, of VGAM1079 correlate with, and may be deduced from, the identity of the target genes which VGAM1079 binds and inhibits, and the function of these target genes, as elaborated hereinbelow.

CGTHBA (Accession NM_012075) is a VGAM1079 host target gene. CGTHBA BINDING SITE is HOST TARGET binding site found in the 3' untranslated region of mRNA encoded by CGTHBA, corresponding to a HOST TARGET binding site such as BINDING SITE I, BINDING SITE II or BINDING SITE III. Table 2 illustrates the complementarity of the nucleotide sequences of CGTHBA BINDING SITE, designated SEQ ID:14363, to the nucleotide sequence of VGAM1079 RNA, herein designated VGAM RNA, also designated SEQ ID:3790.

A function of VGAM1079 is therefore inhibition of CGTHBA (Accession NM_012075). Accordingly, utilities of VGAM1079 include diagnosis, prevention and treatment of diseases and clinical conditions associated with CGTHBA. Chloride Channel 6 (CLCN6, Accession NM_021735) is another VGAM1079 host target gene. CLCN6 BINDING SITE1 through CLCN6 BINDING SITE3 are HOST TARGET binding sites found in untranslated regions of mRNA encoded by CLCN6, corresponding to HOST TARGET binding sites such as BINDING SITE I, BINDING SITE II or BINDING SITE III. Table 2 illustrates the complementarity of the nucleotide sequences of CLCN6 BINDING SITE1 through CLCN6 BINDING SITE3, designated SEQ ID:22336, SEQ ID:6959 and SEQ ID:22341 respectively, to the nucleotide sequence of VGAM1079 RNA, herein designated VGAM RNA, also designated SEQ ID:3790.

Another function of VGAM1079 is therefore inhibition of Chloride Channel 6 (CLCN6, Accession NM_021735), a gene which is a voltage-gated chloride channel. Accordingly, utilities of VGAM1079 include diagnosis, prevention and treatment of diseases and clinical conditions associated with CLCN6. The function of CLCN6 and its association with various diseases and clinical conditions, has been established by previous studies, as described hereinabove with reference to VGAM599. LBP-9 (Accession NM_014553) is another VGAM1079 host target gene. LBP-9 BINDING SITE is HOST TARGET binding site found in the 3' untranslated region of mRNA encoded by LBP-9, corresponding to a HOST TARGET binding site such as BINDING SITE I, BINDING SITE II or BINDING SITE III. Table 2 illustrates the complementarity of the nucleotide sequences of LBP-9 BINDING SITE, designated SEQ ID:15873, to the nucleotide sequence of VGAM1079 RNA, herein designated VGAM RNA, also designated SEQ ID:3790.

Another function of VGAM1079 is therefore inhibition of LBP-9 (Accession NM_014553). Accordingly, utilities of VGAM1079 include diagnosis, prevention and treatment of diseases and clinical conditions associated with LBP-9. Mitochondrial Ribosomal Protein L10 (MRPL10, Accession NM_145255) is another VGAM1079 host target gene. MRPL10 BINDING SITE is HOST TARGET binding site found in the 3' untranslated region of mRNA encoded by MRPL10, corresponding to a HOST TARGET binding site such as BINDING SITE I, BINDING SITE II or BINDING SITE III. Table 2 illustrates the complementarity of the nucleotide sequences of MRPL10 BINDING SITE, designated SEQ ID:29767, to the nucleotide sequence of VGAM1079 RNA, herein designated VGAM RNA, also designated SEQ ID:3790.

Another function of VGAM1079 is therefore inhibition of Mitochondrial Ribosomal Protein L10 (MRPL10, Accession NM_145255). Accordingly, utilities of VGAM1079 include diagnosis, prevention and treatment of diseases and clinical conditions associated with MRPL10. LOC202126 (Accession XM_117362) is another VGAM1079 host target gene. LOC202126 BINDING SITE is HOST TARGET binding site found in the 3' untranslated region of mRNA encoded by LOC202126, corresponding to a HOST TARGET binding site such as BINDING SITE I, BINDING SITE II or BINDING SITE III. Table 2 illustrates the complementarity of the nucleotide sequences of LOC202126 BINDING SITE, designated SEQ ID:43411, to the nucleotide sequence of VGAM1079 RNA, herein designated VGAM RNA, also designated SEQ ID:3790.

Another function of VGAM1079 is therefore inhibition of LOC202126 (Accession XM_117362). Accordingly, utilities of VGAM1079 include diagnosis, prevention and treatment of diseases and clinical conditions associated with LOC202126. FIG. 1 further provides a conceptual description of a novel bioinformatically detected viral gene of the present invention, referred to here as Viral Genomic Address Messenger 1080 (VGAM1080) viral gene, which modulates expression of respective host target genes thereof, the function and utility of which host target genes is known in the art.

VGAM1080 is a novel bioinformatically detected regulatory, non protein coding, viral micro RNA (miRNA) gene. The method by which VGAM1080 was detected is described hereinabove with reference to FIGS. 1-8.

VGAM1080 gene, herein designated VGAM GENE, is a viral gene contained in the genome of Porcine Epidemic Diarrhea Virus. VGAM1080 host target gene, herein designated VGAM HOST TARGET GENE, is a human gene contained in the human genome.

VGAM1080 gene encodes a VGAM1080 precursor RNA, herein designated VGAM PRECURSOR RNA. Similar to other miRNA genes, and unlike most ordinary genes, VGAM1080 precursor RNA does not encode a protein. A nucleotide sequence identical or highly similar to the nucleotide sequence of VGAM1080 precursor RNA is designated SEQ ID:1066, and is provided hereinbelow with reference to the sequence listing part. Nucleotide sequence SEQ ID:1066 is located at position 15169 relative to the genome of Porcine Epidemic Diarrhea Virus.

VGAM1080 precursor RNA folds onto itself, forming VGAM1080 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1080 folded precursor RNA into VGAM1080 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM1080 RNA is designated SEQ ID:3791, and is provided hereinbelow with reference to the sequence listing part.

VGAM1080 host target gene, herein designated VGAM HOST TARGET GENE, encodes a corresponding messenger RNA, VGAM1080 host target RNA, herein designated VGAM HOST TARGET RNA. VGAM1080 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1080 RNA, herein designated VGAM RNA, binds complementarily to one or more host target binding sites located in untranslated regions of VGAM1080 host target RNA, herein designated VGAM HOST TARGET RNA. This complementary binding is due to the fact that the nucleotide sequence of VGAM1080 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1080 RNA, herein designated VGAM RNA, may have a different number of host target binding sites in untranslated regions of a VGAM1080 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1080 RNA, herein designated VGAM RNA, to host target binding sites on VGAM1080 host target RNA, herein designated VGAM HOST TARGET RNA, such as BINDING SITE I, BINDING SITE II and BINDING SITE III, inhibits translation of VGAM1080 host target RNA into VGAM1080 host target protein, herein designated VGAM HOST TARGET PROTEIN. VGAM host target protein is therefore outlined by a broken line.

It is appreciated that VGAM1080 host target gene, herein designated VGAM HOST TARGET GENE, in fact represents a plurality of VGAM1080 host target genes. The mRNA of each one of this plurality of VGAM1080 host target genes comprises one or more host target binding sites, each having a nucleotide sequence which is at least partly complementary to VGAM1080 RNA, herein designated VGAM RNA, and which when bound by VGAM1080 RNA causes inhibition of translation of respective one or more VGAM1080 host target proteins.

It is further appreciated by one skilled in the art that the mode of translational inhibition illustrated by FIG. 1 with specific reference to translational inhibition exerted by VGAM1080 gene, herein designated VGAM GENE, on one or more VGAM1080 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1080 is inhibition of expression of host target genes, as part of a novel viral mechanism of attacking a host. Accordingly, utilities of VGAM1080 include diagnosis, prevention and treatment of viral infection by Porcine Epidemic Diarrhea Virus. Specific functions, and accordingly utilities, of VGAM1080 correlate with, and may be deduced from, the identity of the host target genes which VGAM1080 binds and inhibits, and the function of these host target genes, as elaborated hereinbelow.

Nucleotide sequences of the VGAM1080 precursor RNA, herein designated VGAM PRECURSOR RNA, and of the 'diced' VGAM1080 RNA, herein designated VGAM RNA, and a schematic representation of the secondary folding of VGAM1080 folded precursor RNA, herein designated VGAM FOLDED PRECURSOR RNA, of VGAM1080 are further described hereinbelow with reference to Table 1.

Nucleotide sequences of host target binding sites, such as BINDING SITE-I, BINDING SITE-II and BINDING SITE-III of FIG. 1, found on VGAM1080 host target RNA, and schematic representation of the complementarity of each of these host target binding sites to VGAM1080 RNA, herein designated VGAM RNA, are described hereinbelow with reference to Table 2.

As mentioned hereinabove with reference to FIG. 1, a function of VGAM1080 gene, herein designated VGAM is inhibition of expression of VGAM1080 target genes. It is appreciated that specific functions, and accordingly utilities, of VGAM1080 correlate with, and may be deduced from, the identity of the target genes which VGAM1080 binds and inhibits, and the function of these target genes, as elaborated hereinbelow.

UDP-N-acetyl-alpha-D-galactosamine:polypeptide N-acetylgalactosaminyltransferase 1 (GalNAc-T1) (GALNT1, Accession NM_020474) is a VGAM1080 host target gene. GALNT1 BINDING SITE is HOST TARGET binding site found in the 3' untranslated region of mRNA encoded by GALNT1, corresponding to a HOST TARGET binding site such as BINDING SITE I, BINDING SITE II or BINDING SITE III. Table 2 illustrates the complementarity of the nucleotide sequences of GALNT1 BINDING SITE, designated SEQ ID:21726, to the nucleotide sequence of VGAM1080 RNA, herein designated VGAM RNA, also designated SEQ ID:3791.

A function of VGAM1080 is therefore inhibition of UDP-N-acetyl-alpha-D-galactosamine:polypeptide N-acetylgalactosaminyltransferase 1 (GalNAc-T1) (GALNT1, Accession NM_020474), a gene which transfers an N-acetyl galactosamine (GalNAc) to a serine or threonine residue in the first step of O-linked oligosaccharide biosynthesis. Accordingly, utilities of VGAM1080 include diagnosis, prevention and treatment of diseases and clinical conditions associated with GALNT1. The function of GALNT1 and its association with various diseases and clinical conditions, has been established by previous studies, as described hereinabove with reference to VGAM120. Cytoskeleton-associated Protein 4 (CKAP4, Accession NM_006825) is another VGAM1080 host target gene. CKAP4 BINDING SITE is HOST TARGET binding site found in the 3' untranslated region of mRNA encoded by CKAP4, corresponding to a HOST TARGET binding site such as BINDING SITE I, BINDING SITE II or BINDING SITE III. Table 2 illustrates the complementarity of the nucleotide sequences of CKAP4 BINDING SITE, designated SEQ ID:13706, to the nucleotide sequence of VGAM1080 RNA, herein designated VGAM RNA, also designated SEQ ID:3791.

Another function of VGAM1080 is therefore inhibition of Cytoskeleton-associated Protein 4 (CKAP4, Accession NM_006825). Accordingly, utilities of VGAM1080 include diagnosis, prevention and treatment of diseases and clinical conditions associated with CKAP4. FLJ13081 (Accession NM_024834) is another VGAM1080 host target gene. FLJ13081 BINDING SITE is HOST TARGET binding site found in the 3' untranslated region of mRNA encoded by FLJ13081, corresponding to a HOST TARGET binding site such as BINDING SITE I, BINDING SITE II or BINDING SITE III. Table 2 illustrates the complementarity of the nucleotide sequences of FLJ13081 BINDING SITE, designated SEQ ID:24238, to the nucleotide sequence of VGAM1080 RNA, herein designated VGAM RNA, also designated SEQ ID:3791.

Another function of VGAM1080 is therefore inhibition of FLJ13081 (Accession NM_024834). Accordingly, utilities of VGAM1080 include diagnosis, prevention and treatment of diseases and clinical conditions associated with FLJ13081. FLJ23024 (Accession NM_024936) is another VGAM1080 host target gene. FLJ23024 BINDING SITE is HOST TARGET binding site found in the 3' untranslated region of mRNA encoded by FLJ23024, corresponding to a HOST TARGET binding site such as BINDING SITE I, BINDING SITE II or BINDING SITE III. Table 2 illustrates the complementarity of the nucleotide sequences of FLJ23024 BINDING SITE, designated SEQ ID:24475, to the nucleotide sequence of VGAM1080 RNA, herein designated VGAM RNA, also designated SEQ ID:3791.

Another function of VGAM1080 is therefore inhibition of FLJ23024 (Accession NM_024936). Accordingly, utilities of VGAM1080 include diagnosis, prevention and treatment of diseases and clinical conditions associated with FLJ23024. KIAA0121 (Accession XM_052386) is another VGAM1080 host target gene. KIAA0121 BINDING SITE is HOST TARGET binding site found in the 5' untranslated region of mRNA encoded by KIAA0121, corresponding to a HOST TARGET binding site such as BINDING SITE I, BINDING SITE II or BINDING SITE III. Table 2 illustrates the complementarity of the nucleotide sequences of KIAA0121 BINDING SITE, designated SEQ ID:35971, to the nucleotide sequence of VGAM1080 RNA, herein designated VGAM RNA, also designated SEQ ID:3791.

Another function of VGAM1080 is therefore inhibition of KIAA0121 (Accession XM_052386). Accordingly, utilities of VGAM1080 include diagnosis, prevention and treatment of diseases and clinical conditions associated with KIAA0121. Sema Domain, Immunoglobulin Domain (Ig), Short Basic Domain, Secreted, (semaphorin) 3C (SEMA3C, Accession NM_006379) is another VGAM1080 host target gene. SEMA3C BINDING SITE is HOST TARGET binding site found in the 3' untranslated region of mRNA encoded by SEMA3C, corresponding to a HOST TARGET binding site such as BINDING SITE I, BINDING SITE II or BINDING SITE III. Table 2 illustrates the complementarity of the nucleotide sequences of SEMA3C BINDING SITE, designated SEQ ID:13076, to the nucleotide sequence of VGAM1080 RNA, herein designated VGAM RNA, also designated SEQ ID:3791.

Another function of VGAM1080 is therefore inhibition of Sema Domain, Immunoglobulin Domain (Ig), Short Basic Domain, Secreted, (semaphorin) 3C (SEMA3C, Accession NM_006379). Accordingly, utilities of VGAM1080 include diagnosis, prevention and treatment of diseases and clinical conditions associated with SEMA3C. Solute Carrier Family 26, Member 7 (SLC26A7, Accession NM_052832) is another VGAM1080 host target gene. SLC26A7 BINDING SITE is HOST TARGET binding site found in the 3' untranslated region of mRNA encoded by SLC26A7, corresponding to a HOST TARGET binding site such as BINDING SITE I, BINDING SITE II or BINDING SITE III. Table 2 illustrates the complementarity of the nucleotide sequences of SLC26A7 BINDING SITE, designated SEQ ID:27415, to the nucleotide sequence of VGAM1080 RNA, herein designated VGAM RNA, also designated SEQ ID:3791.

Another function of VGAM1080 is therefore inhibition of Solute Carrier Family 26, Member 7 (SLC26A7, Accession NM_052832). Accordingly, utilities of VGAM1080 include diagnosis, prevention and treatment of diseases and clinical conditions associated with SLC26A7. Serine Palmitoyltransferase, Long Chain Base Subunit 2 (SPTLC2, Accession NM_004863) is another VGAM1080 host target gene. SPTLC2 BINDING SITE is HOST TARGET binding site found in the 3' untranslated region of mRNA encoded by SPTLC2, corresponding to a HOST TARGET binding site such as BINDING SITE I, BINDING SITE II or BINDING SITE III. Table 2 illustrates the complementarity of the nucleotide sequences of SPTLC2 BINDING SITE, designated SEQ ID:11284, to the nucleotide sequence of VGAM1080 RNA, herein designated VGAM RNA, also designated SEQ ID:3791.

Another function of VGAM1080 is therefore inhibition of Serine Palmitoyltransferase, Long Chain Base Subunit 2 (SPTLC2, Accession NM_004863). Accordingly, utilities of VGAM1080 include diagnosis, prevention and treatment of diseases and clinical conditions associated with SPTLC2. LOC145748 (Accession XM_096853) is another VGAM1080 host target gene. LOC145748 BINDING SITE is HOST TARGET binding site found in the 3' untranslated region of mRNA encoded by LOC145748, corresponding to a HOST TARGET binding site such as BINDING SITE I, BINDING SITE II or BINDING SITE III. Table 2 illustrates the complementarity of the nucleotide sequences of LOC145748 BINDING SITE, designated SEQ ID:40580, to the nucleotide sequence of VGAM1080 RNA, herein designated VGAM RNA, also designated SEQ ID:3791.

Another function of VGAM1080 is therefore inhibition of LOC145748 (Accession XM_096853). Accordingly, utilities of VGAM1080 include diagnosis, prevention and treatment of diseases and clinical conditions associated with LOC145748. LOC91145 (Accession XM_036454) is another VGAM1080 host target gene. LOC91145 BINDING SITE is HOST TARGET binding site found in the 5' untranslated region of mRNA encoded by LOC91145, corresponding to a HOST TARGET binding site such as BINDING SITE I, BINDING SITE II or BINDING SITE III. Table 2 illustrates the complementarity of the nucleotide sequences of LOC91145 BINDING SITE, designated SEQ ID:32450, to the nucleotide sequence of VGAM1080 RNA, herein designated VGAM RNA, also designated SEQ ID:3791.

Another function of VGAM1080 is therefore inhibition of LOC91145 (Accession XM_036454). Accordingly, utilities of VGAM1080 include diagnosis, prevention and treatment of diseases and clinical conditions associated with LOC91145. FIG. 1 further provides a conceptual description of a novel bioinformatically detected viral gene of the present invention, referred to here as Viral Genomic Address Messenger 1081 (VGAM1081) viral gene, which modulates expression of respective host target genes thereof, the function and utility of which host target genes is known in the art.

VGAM1081 is a novel bioinformatically detected regulatory, non protein coding, viral micro RNA (miRNA) gene. The method by which VGAM1081 was detected is described hereinabove with reference to FIGS. 1-8.

VGAM1081 gene, herein designated VGAM GENE, is a viral gene contained in the genome of Porcine Epidemic Diarrhea Virus. VGAM1081 host target gene, herein designated VGAM HOST TARGET GENE, is a human gene contained in the human genome.

VGAM1081 gene encodes a VGAM1081 precursor RNA, herein designated VGAM PRECURSOR RNA. Similar to other miRNA genes, and unlike most ordinary genes, VGAM1081 precursor RNA does not encode a protein. A nucleotide sequence identical or highly similar to the nucleotide sequence of VGAM1081 precursor RNA is designated SEQ ID:1067, and is provided hereinbelow with reference to the sequence listing part. Nucleotide sequence SEQ ID:1067 is located at position 11817 relative to the genome of Porcine Epidemic Diarrhea Virus.

VGAM1081 precursor RNA folds onto itself, forming VGAM1081 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1081 folded precursor RNA into VGAM1081 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 78%) nucleotide sequence of VGAM1081 RNA is designated SEQ ID:3792, and is provided hereinbelow with reference to the sequence listing part.

VGAM1081 host target gene, herein designated VGAM HOST TARGET GENE, encodes a corresponding messenger RNA, VGAM1081 host target RNA, herein designated VGAM HOST TARGET RNA. VGAM1081 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1081 RNA, herein designated VGAM RNA, binds complementarily to one or more host target binding sites located in untranslated regions of VGAM1081 host target RNA, herein designated VGAM HOST TARGET RNA. This complementary binding is due to the fact that the nucleotide sequence of VGAM1081 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1081 RNA, herein designated VGAM RNA, may have a different number of host target binding sites in untranslated regions of a VGAM1081 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1081 RNA, herein designated VGAM RNA, to host target binding sites on VGAM1081 host target RNA, herein designated VGAM HOST TARGET RNA, such as BINDING SITE I, BINDING SITE II and BINDING SITE III, inhibits translation of VGAM1081 host target RNA into VGAM1081 host target protein, herein designated VGAM HOST TARGET PROTEIN. VGAM host target protein is therefore outlined by a broken line.

It is appreciated that VGAM1081 host target gene, herein designated VGAM HOST TARGET GENE, in fact represents a plurality of VGAM1081 host target genes. The mRNA of each one of this plurality of VGAM1081 host target genes comprises one or more host target binding sites, each having a nucleotide sequence which is at least partly complementary to VGAM1081 RNA, herein designated VGAM RNA, and which when bound by VGAM1081 RNA causes inhibition of translation of respective one or more VGAM1081 host target proteins.

It is further appreciated by one skilled in the art that the mode of translational inhibition illustrated by FIG. 1 with specific reference to translational inhibition exerted by VGAM1081 gene, herein designated VGAM GENE, on one or more VGAM1081 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1081 is inhibition of expression of host target genes, as part of a novel viral mechanism of attacking a host. Accordingly, utilities of VGAM1081 include diagnosis, prevention and treatment of viral infection by Porcine Epidemic Diarrhea Virus. Specific functions, and accordingly utilities, of VGAM1081 correlate with, and may be deduced from, the identity of the host target genes which VGAM1081 binds and inhibits, and the function of these host target genes, as elaborated hereinbelow.

Nucleotide sequences of the VGAM1081 precursor RNA, herein designated VGAM PRECURSOR RNA, and of the 'diced' VGAM1081 RNA, herein designated VGAM RNA, and a schematic representation of the secondary folding of VGAM1081 folded precursor RNA, herein designated VGAM FOLDED PRECURSOR RNA, of VGAM1081 are further described hereinbelow with reference to Table 1.

Nucleotide sequences of host target binding sites, such as BINDING SITE-I, BINDING SITE-II and BINDING SITE-III of FIG. 1, found on VGAM1081 host target RNA, and schematic representation of the complementarity of each of these host target binding sites to VGAM1081 RNA, herein designated VGAM RNA, are described hereinbelow with reference to Table 2.

As mentioned hereinabove with reference to FIG. 1, a function of VGAM1081 gene, herein designated VGAM is inhibition of expression of VGAM1081 target genes. It is appreciated that specific functions, and accordingly utilities, of VGAM1081 correlate with, and may be deduced from, the identity of the target genes which VGAM1081 binds and inhibits, and the function of these target genes, as elaborated hereinbelow.

Calpain 10 (CAPN10, Accession NM_023088) is a VGAM1081 host target gene. CAPN10 BINDING SITE is HOST TARGET binding site found in the 3' untranslated region of mRNA encoded by CAPN10, corresponding to a HOST TARGET binding site such as BINDING SITE I, BINDING SITE II or BINDING SITE III. Table 2 illustrates the complementarity of the nucleotide sequences of CAPN10 BINDING SITE, designated SEQ ID:23356, to the nucleotide sequence of VGAM1081 RNA, herein designated VGAM RNA, also designated SEQ ID:3792.

A function of VGAM1081 is therefore inhibition of Calpain 10 (CAPN10, Accession NM_023088), a gene which catalyzes limited proteolysis of substrates involved in cytoskeletal remodelling and signal tranduction. Accordingly, utilities of VGAM1081 include diagnosis, prevention and treatment of diseases and clinical conditions associated with CAPN10. The function of CAPN10 and its association with various diseases and clinical conditions, has been established by previous studies, as described hereinabove with reference to VGAM247. Endoglin (Osler-Rendu-Weber syndrome 1) (ENG, Accession NM_000118) is another VGAM1081 host target gene. ENG BINDING SITE is HOST TARGET binding site found in the 3' untranslated region of mRNA encoded by ENG, corresponding to a HOST TARGET binding site such as BINDING SITE I, BINDING SITE II or BINDING SITE III. Table 2 illustrates the complementarity of the nucleotide sequences of ENG BINDING SITE, designated SEQ ID:5591, to the nucleotide sequence of VGAM1081 RNA, herein designated VGAM RNA, also designated SEQ ID:3792.

Another function of VGAM1081 is therefore inhibition of Endoglin (Osler-Rendu-Weber syndrome 1) (ENG, Accession NM_000118). Accordingly, utilities of VGAM1081 include diagnosis, prevention and treatment of diseases and clinical conditions associated with ENG. LARS2 (Accession NM_015340) is another VGAM1081 host target gene. LARS2 BINDING SITE is HOST TARGET binding site found in the 3' untranslated region of mRNA encoded by LARS2, corresponding to a HOST TARGET binding site such as BINDING SITE I, BINDING SITE II or BINDING SITE III. Table 2 illustrates the complementarity of the nucleotide sequences of LARS2 BINDING SITE, designated SEQ ID:17648, to the nucleotide sequence of VGAM1081 RNA, herein designated VGAM RNA, also designated SEQ ID:3792.

Another function of VGAM1081 is therefore inhibition of LARS2 (Accession NM_015340). Accordingly, utilities of VGAM1081 include diagnosis, prevention and treatment of diseases and clinical conditions associated with LARS2. Membrane Component, Chromosome 17, Surface Marker 2 (ovarian carcinoma antigen CA125) (M17S2, Accession NM_031858) is another VGAM1081 host target gene. M17S2 BINDING SITE is HOST TARGET binding site found in the 5' untranslated region of mRNA encoded by M17S2, corresponding to a HOST TARGET binding site such as BINDING SITE I, BINDING SITE II or BINDING SITE III. Table 2 illustrates the complementarity of the nucleotide sequences of M17S2 BINDING SITE, designated SEQ ID:25610, to the nucleotide sequence of VGAM1081 RNA, herein designated VGAM RNA, also designated SEQ ID:3792.

Another function of VGAM1081 is therefore inhibition of Membrane Component, Chromosome 17, Surface Marker 2 (ovarian carcinoma antigen CA125) (M17S2, Accession NM_031858), a gene which Contains a B-box/coiled coil motif. Accordingly, utilities of VGAM1081 include diagnosis, prevention and treatment of diseases and clinical conditions associated with M17S2. The function of M17S2 has been established by previous studies. In an attempt to clone the CA125 gene (OMIM Ref. No. 606154), Campbell et al. (1994) isolated a cDNA from an expression library that mapped close to the BRCA1 locus (OMIM Ref. No. 113705) at 17q21.1. Closer investigation showed that it was within the smallest known region containing the BRCA1 gene. The predicted 966-amino acid polypeptide lacks the membrane protein characteristics expected for CA125 but does include a B-box/coiled coil motif present in many genes with transformation potential. Campbell et al. (1994) used fluorescence in situ hybridization to demonstrate mapping within the BRCA1 minimum region. YAC and cosmid clones were isolated and used to refine the location of this gene adjacent and proximal to the RNU2 locus (OMIM Ref. No. 180690). The exon structure of the gene was also determined. Extensive SSCP and sequence analysis of over 100 tumor and normal DNAs from familial and sporadic breast cancers and sporadic ovarian cancers failed to detect mutations in the coding region of this gene. Brown et al. (1994), who referred to the gene as 1A1-3B, showed that the transcription start site of M17S2 is 295 bp distal from the initiation site of BRCA1 and that the gene is transcribed divergently from BRCA1. The authors speculated that M17S2 may be involved in the regulation of transcription or translation of BRCA1. Brown et al. (1996) described the genomic region that encompasses both the BRCA1 and M17S2 genes. They found a tandem duplication of 30 kb that results in 2 copies of exons 1 and 2 of BRCA1 and exons 1 and 3 of M17S2.

Full details of the abovementioned studies are described in the following publications, the disclosure of which are hereby incorporated by reference:

Brown, M. A.; Xu, C.-F.; Nicolai, H.; Griffiths, B.; Chambers, J. A.; Black, D.; Solomon, E.: The 5-prime end of the BRCA1 gene lies within a duplicated region of human chromosome 17q21. Oncogene 12:2507-2513, 1996; and Campbell, I. G.; Nicolai, H. M.; Foulkes, W. D.; Senger, G.; Stamp, G. W.; Allan, G.; Boyer, C.; Jones, K.; Bast, R. C., Jr.; Solomon, E.; Trowsdale, J.; Black, D. M.: A novel gene encodin.

Further studies establishing the function and utilities of M17S2 are found in John Hopkins OMIM database record ID 166945, and in sited publications numbered 1815-1817 listed in the bibliography section hereinbelow, which are also hereby incorporated by reference. Mannan-binding Lectin Serine Protease 1 (C4/C2 activating component of Ra-reactive factor) (MASP1, Accession NM_001879) is another VGAM1081 host target gene. MASP1 BINDING SITE is HOST TARGET binding site found in the 3' untranslated region of mRNA encoded by MASP1, corresponding to a HOST TARGET binding site such as BINDING SITE I, BINDING SITE II or BINDING SITE III. Table 2 illustrates the complementarity of the nucleotide sequences of MASP1 BINDING SITE, designated SEQ ID:7608, to the nucleotide sequence of VGAM1081 RNA, herein designated VGAM RNA, also designated SEQ ID:3792.

Another function of VGAM1081 is therefore inhibition of Mannan-binding Lectin Serine Protease 1 (C4/C2 activating component of Ra-reactive factor) (MASP1, Accession NM_001879), a gene which a complement-dependent bactericidal factor. Accordingly, utilities of VGAM1081 include diagnosis, prevention and treatment of diseases and clinical conditions associated with MASP1. The function of MASP1 and its association with various diseases and clinical conditions, has been established by previous studies, as described hereinabove with reference to VGAM566. Myeloid/lymphoid Or Mixed-lineage Leukemia (trithorax homolog, Drosophila); Translocated To, 2 (MLLT2, Accession NM_005935) is another VGAM1081 host target gene. MLLT2 BINDING SITE is HOST TARGET binding site found in the 3' untranslated region of mRNA encoded by MLLT2, corresponding to a HOST TARGET binding site such as BINDING SITE I, BINDING SITE II or BINDING SITE III. Table 2 illustrates the complementarity of the nucleotide sequences of MLLT2 BINDING SITE, designated SEQ ID:12574, to the nucleotide sequence of VGAM1081 RNA, herein designated VGAM RNA, also designated SEQ ID:3792.

Another function of VGAM1081 is therefore inhibition of Myeloid/lymphoid Or Mixed-lineage Leukemia (trithorax homolog, Drosophila); Translocated To, 2 (MLLT2, Accession NM_005935), a gene which is a Putative transcription factor. Accordingly, utilities of VGAM1081 include diagnosis, prevention and treatment of diseases and clinical conditions associated with MLLT2. The function of MLLT2 and its association with various diseases and clinical conditions, has been established by previous studies, as described hereinabove with reference to VGAM57. MAX Binding Protein (MNT, Accession NM_020310) is another VGAM1081 host target gene. MNT BINDING SITE is HOST TARGET binding site found in the 3' untranslated region of mRNA encoded by MNT, corresponding to a HOST TARGET binding site such as BINDING SITE I, BINDING SITE II or BINDING SITE III. Table 2 illustrates the complementarity of the nucleotide sequences of MNT BINDING SITE, designated SEQ ID:21567, to the nucleotide sequence of VGAM1081 RNA, herein designated VGAM RNA, also designated SEQ ID:3792.

Another function of VGAM1081 is therefore inhibition of MAX Binding Protein (MNT, Accession NM_020310). Accordingly, utilities of VGAM1081 include diagnosis, prevention and treatment of diseases and clinical conditions associated with MNT. Mature T-cell Proliferation 1 (MTCP1, Accession NM_014221) is another VGAM1081 host target gene. MTCP1 BINDING SITE is HOST TARGET binding site found in the 5' untranslated region of mRNA encoded by MTCP1, corresponding to a HOST TARGET binding site such as BINDING SITE I, BINDING SITE II or BINDING SITE III. Table 2 illustrates the complementarity of the nucleotide sequences of MTCP1 BINDING SITE, designated SEQ ID:15489, to the nucleotide sequence of VGAM1081 RNA, herein designated VGAM RNA, also designated SEQ ID:3792.

Another function of VGAM1081 is therefore inhibition of Mature T-cell Proliferation 1 (MTCP1, Accession NM_014221). Accordingly, utilities of VGAM1081 include diagnosis, prevention and treatment of diseases and clinical conditions associated with MTCP1. Nuclear Receptor Coactivator 6 (NCOA6, Accession NM_014071) is another VGAM1081 host target gene. NCOA6 BINDING SITE is HOST TARGET binding site found in the 5' untranslated region of mRNA encoded by NCOA6, corresponding to a HOST TARGET binding site such as BINDING SITE I, BINDING SITE II or BINDING SITE III. Table 2 illustrates the complementarity of the nucleotide sequences of NCOA6 BINDING SITE, designated SEQ ID:15288, to the nucleotide sequence of VGAM1081 RNA, herein designated VGAM RNA, also designated SEQ ID:3792.

Another function of VGAM1081 is therefore inhibition of Nuclear Receptor Coactivator 6 (NCOA6, Accession NM_014071), a gene which activates gene transcription through ligand-dependent association with coactivators. Accordingly, utilities of VGAM1081 include diagnosis, prevention and treatment of diseases and clinical conditions associated with NCOA6. The function of NCOA6 and its association with various diseases and clinical conditions, has been established by previous studies, as described hereinabove with reference to VGAM25. Nuclear Factor Related to Kappa B Binding Protein (NFRKB, Accession NM_006165) is another VGAM1081 host target gene. NFRKB BINDING SITE is HOST TARGET binding site found in the 5' untranslated region of mRNA encoded by NFRKB, corresponding to a HOST TARGET binding site such as BINDING SITE I, BINDING SITE II or BINDING SITE III. Table 2 illustrates the complementarity of the nucleotide sequences of NFRKB BINDING SITE, designated SEQ ID:12823, to the nucleotide sequence of VGAM1081 RNA, herein designated VGAM RNA, also designated SEQ ID:3792.

Another function of VGAM1081 is therefore inhibition of Nuclear Factor Related to Kappa B Binding Protein (NFRKB, Accession NM_006165). Accordingly, utilities of VGAM1081 include diagnosis, prevention and treatment of diseases and clinical conditions associated with NFRKB. Plexin A2 (PLXNA2, Accession NM_025179) is another VGAM1081 host target gene. PLXNA2 BINDING SITE is HOST TARGET binding site found in the 3' untranslated region of mRNA encoded by PLXNA2, corresponding to a HOST TARGET binding site such as BINDING SITE I, BINDING SITE II or BINDING SITE III. Table 2 illustrates the complementarity of the nucleotide sequences of PLXNA2 BINDING SITE, designated SEQ ID:24816, to the nucleotide sequence of VGAM1081 RNA, herein designated VGAM RNA, also designated SEQ ID:3792.

Another function of VGAM1081 is therefore inhibition of Plexin A2 (PLXNA2, Accession NM_025179), a gene which is a transmembrane protein. Accordingly, utilities of VGAM1081 include diagnosis, prevention and treatment of diseases and clinical conditions associated with PLXNA2. The function of PLXNA2 and its association with various diseases and clinical conditions, has been established by previous studies, as described hereinabove with reference to VGAM538. Syndecan 2 (heparan sulfate proteoglycan 1, cell surface-associated, fibroglycan) (SDC2, Accession XM_040582) is another VGAM1081 host target gene. SDC2 BINDING SITE is HOST TARGET binding site found in the 5' untranslated region of mRNA encoded by SDC2, corresponding to a HOST TARGET binding site such as BINDING SITE I, BINDING SITE II or BINDING SITE III. Table 2 illustrates the complementarity of the nucleotide sequences of SDC2 BINDING SITE, designated SEQ ID:33327, to the nucleotide sequence of VGAM1081 RNA, herein designated VGAM RNA, also designated SEQ ID:3792.

Another function of VGAM1081 is therefore inhibition of Syndecan 2 (heparan sulfate proteoglycan 1, cell surface-associated, fibroglycan) (SDC2, Accession XM_040582). Accordingly, utilities of VGAM1081 include diagnosis, prevention and treatment of diseases and clinical conditions associated with SDC2. Steroid Sulfatase (microsomal), Arylsulfatase C, Isozyme S (STS, Accession NM_000351) is another VGAM1081 host target gene. STS BINDING SITE is HOST TARGET binding site found in the 3' untranslated region of mRNA encoded by STS, corresponding to a HOST TARGET binding site such as BINDING SITE I, BINDING SITE II or BINDING SITE III. Table 2 illustrates the complementarity of the nucleotide sequences of STS BINDING SITE, designated SEQ ID:5908, to the nucleotide sequence of VGAM1081 RNA, herein designated VGAM RNA, also designated SEQ ID:3792.

Another function of VGAM1081 is therefore inhibition of Steroid Sulfatase (microsomal), Arylsulfatase C, Isozyme S (STS, Accession NM_000351). Accordingly, utilities of VGAM1081 include diagnosis, prevention and treatment of diseases and clinical conditions associated with STS. Transcription Factor 2, Hepatic; LF-B3; Variant Hepatic Nuclear Factor (TCF2, Accession NM_006481) is another VGAM1081 host target gene. TCF2 BINDING SITE is HOST TARGET binding site found in the 3' untranslated region of mRNA encoded by TCF2, corresponding to a HOST TARGET binding site such as BINDING SITE I, BINDING SITE II or BINDING SITE III. Table 2 illustrates the complementarity of the nucleotide sequences of TCF2 BINDING SITE, designated SEQ ID:13203, to the nucleotide sequence of VGAM1081 RNA, herein designated VGAM RNA, also designated SEQ ID:3792.

Another function of VGAM1081 is therefore inhibition of Transcription Factor 2, Hepatic; LF-B3; Variant Hepatic Nuclear Factor (TCF2, Accession NM_006481), a gene which probably binds to the inverted palindrome 5'-gttaatnat-taac-3'. Accordingly, utilities of VGAM1081 include diagnosis, prevention and treatment of diseases and clinical conditions associated with TCF2. The function of TCF2 and its association with various diseases and clinical conditions, has been established by previous studies, as described hereinabove with reference to VGAM118. T-cell Leukemia Translocation Altered Gene (TCTA, Accession NM_022171) is another VGAM1081 host target gene. TCTA BINDING SITE is HOST TARGET binding site found in the 3' untranslated region of mRNA encoded by TCTA, corresponding to a HOST TARGET binding site such as BINDING SITE I, BINDING SITE II or BINDING SITE III. Table 2 illustrates the complementarity of the nucleotide sequences of TCTA BINDING SITE, designated SEQ ID:22732, to the nucleotide sequence of VGAM1081 RNA, herein designated VGAM RNA, also designated SEQ ID:3792.

Another function of VGAM1081 is therefore inhibition of T-cell Leukemia Translocation Altered Gene (TCTA, Accession NM_022171). Accordingly, utilities of VGAM1081 include diagnosis, prevention and treatment of diseases and clinical conditions associated with TCTA. Chromosome 20 Open Reading Frame 110 (C20orf110, Accession XM_086728) is another VGAM1081 host target gene. C20orf110 BINDING SITE is HOST TARGET binding site found in the 3' untranslated region of mRNA encoded by C20orf110, corresponding to a HOST TARGET binding site such as BINDING SITE I, BINDING SITE II or BINDING SITE III. Table 2 illustrates the complementarity of the nucleotide sequences of C20orf110 BINDING SITE, designated SEQ ID:38839, to the nucleotide sequence of VGAM1081 RNA, herein designated VGAM RNA, also designated SEQ ID:3792.

Another function of VGAM1081 is therefore inhibition of Chromosome 20 Open Reading Frame 110 (C20orf110, Accession XM_086728). Accordingly, utilities of VGAM1081 include diagnosis, prevention and treatment of diseases and clinical conditions associated with C20orf110. Chromosome 20 Open Reading Frame 42 (C20orf42, Accession NM_017671) is another VGAM1081 host target gene. C20orf42 BINDING SITE is HOST TARGET binding site found in the 3' untranslated region of mRNA encoded by C20orf42, corresponding to a HOST TARGET binding site such as BINDING SITE I, BINDING SITE II or BINDING SITE III. Table 2 illustrates the complementarity of the nucleotide sequences of C20orf42 BINDING SITE, designated SEQ ID:19216, to the nucleotide sequence of VGAM1081 RNA, herein designated VGAM RNA, also designated SEQ ID:3792.

Another function of VGAM1081 is therefore inhibition of Chromosome 20 Open Reading Frame 42 (C20orf42, Accession NM_017671). Accordingly, utilities of VGAM1081 include diagnosis, prevention and treatment of diseases and clinical conditions associated with C20orf42. Diacylglycerol Kinase, Zeta 104 kDa (DGKZ, Accession NM_003646) is another VGAM1081 host target gene. DGKZ BINDING SITE is HOST TARGET binding site found in the 3' untranslated region of mRNA encoded by DGKZ, corresponding to a HOST TARGET binding site such as BINDING SITE I, BINDING SITE II or BINDING SITE III. Table 2 illustrates the complementarity of the nucleotide sequences of DGKZ BINDING SITE, designated SEQ ID:9722, to the nucleotide sequence of VGAM1081 RNA, herein designated VGAM RNA, also designated SEQ ID:3792.

Another function of VGAM1081 is therefore inhibition of Diacylglycerol Kinase, Zeta 104 kDa (DGKZ, Accession NM_003646). Accordingly, utilities of VGAM1081 include diagnosis, prevention and treatment of diseases and clinical conditions associated with DGKZ. FLJ10097 (Accession XM_043653) is another VGAM1081 host target gene. FLJ10097 BINDING SITE is HOST TARGET binding site found in the 3' untranslated region of mRNA encoded by FLJ10097, corresponding to a HOST TARGET binding site such as BINDING SITE I, BINDING SITE II or BINDING SITE III. Table 2 illustrates the complementarity of the nucleotide sequences of FLJ10097 BINDING SITE, designated SEQ ID:33989, to the nucleotide sequence of VGAM1081 RNA, herein designated VGAM RNA, also designated SEQ ID:3792.

Another function of VGAM1081 is therefore inhibition of FLJ10097 (Accession XM_043653). Accordingly, utilities of VGAM1081 include diagnosis, prevention and treatment of diseases and clinical conditions associated with FLJ10097. FLJ20686 (Accession NM_017925) is another VGAM1081 host target gene. FLJ20686 BINDING SITE is HOST TARGET binding site found in the 3' untranslated region of mRNA encoded by FLJ20686, corresponding to a HOST TARGET binding site such as BINDING SITE I, BINDING SITE II or BINDING SITE III. Table 2 illustrates the complementarity of the nucleotide sequences of FLJ20686 BINDING SITE, designated SEQ ID:19597, to the nucleotide sequence of VGAM1081 RNA, herein designated VGAM RNA, also designated SEQ ID:3792.

Another function of VGAM1081 is therefore inhibition of FLJ20686 (Accession NM_017925). Accordingly, utilities of VGAM1081 include diagnosis, prevention and treatment of diseases and clinical conditions associated with FLJ20686. Golgi Autoantigen, Golgin Subfamily A, 1 (GOLGA1, Accession NM_002077) is another VGAM1081 host target gene. GOLGA1 BINDING SITE is HOST TARGET binding site found in the 3' untranslated region of mRNA encoded by GOLGA1, corresponding to a HOST TARGET binding site such as BINDING SITE I, BINDING SITE II or BINDING SITE III. Table 2 illustrates the complementarity of the nucleotide sequences of GOLGA1 BINDING SITE, designated SEQ ID:7865, to the nucleotide sequence of VGAM1081 RNA, herein designated VGAM RNA, also designated SEQ ID:3792.

Another function of VGAM1081 is therefore inhibition of Golgi Autoantigen, Golgin Subfamily A, 1 (GOLGA1, Accession NM_002077). Accordingly, utilities of VGAM1081 include diagnosis, prevention and treatment of diseases and clinical conditions associated with GOLGA1. Potassium Channel, Subfamily V, Member 1 (KCNV1, Accession NM_014379) is another VGAM1081 host target gene. KCNV1 BINDING SITE is HOST TARGET binding site found in the 5' untranslated region of mRNA encoded by KCNV1, corresponding to a HOST TARGET binding site such as BINDING SITE I, BINDING SITE II or BINDING SITE III. Table 2 illustrates the complementarity of the nucleotide sequences of KCNV1 BINDING SITE, designated SEQ ID:15713, to the nucleotide sequence of VGAM1081 RNA, herein designated VGAM RNA, also designated SEQ ID:3792.

Another function of VGAM1081 is therefore inhibition of Potassium Channel, Subfamily V, Member 1 (KCNV1, Accession NM_014379). Accordingly, utilities of VGAM1081 include diagnosis, prevention and treatment of diseases and clinical conditions associated with KCNV1. LAT1-3TM (Accession NM_031211) is another VGAM1081 host target gene. LAT1-3TM BINDING SITE is HOST TARGET binding site found in the 3' untranslated region of mRNA encoded by LAT1-3TM, corresponding to a HOST TARGET binding site such as BINDING SITE I, BINDING SITE II or BINDING SITE III. Table 2 illustrates the complementarity of the nucleotide sequences of LAT1-3TM BINDING SITE, designated SEQ ID:25252, to the nucleotide sequence of VGAM1081 RNA, herein designated VGAM RNA, also designated SEQ ID:3792.

Another function of VGAM1081 is therefore inhibition of LAT1-3TM (Accession NM_031211). Accordingly, utilities of VGAM1081 include diagnosis, prevention and treatment of diseases and clinical conditions associated with LAT1-3TM. MCF.2 Cell Line Derived Transforming Sequence-like (MCF2L, Accession XM_027516) is another VGAM1081 host target gene. MCF2L BINDING SITE is HOST TARGET binding site found in the 3' untranslated region of mRNA encoded by MCF2L, corresponding to a HOST TARGET binding site such as BINDING SITE I, BINDING SITE II or BINDING SITE III. Table 2 illustrates the complementarity of the nucleotide sequences of MCF2L BINDING SITE, designated SEQ ID:30510, to the nucleotide sequence of VGAM1081 RNA, herein designated VGAM RNA, also designated SEQ ID:3792.

Another function of VGAM1081 is therefore inhibition of MCF.2 Cell Line Derived Transforming Sequence-like (MCF2L, Accession XM_027516). Accordingly, utilities of VGAM1081 include diagnosis, prevention and treatment of diseases and clinical conditions associated with MCF2L. MGC5601 (Accession NM_025247) is another VGAM1081 host target gene. MGC5601 BINDING SITE is HOST TARGET binding site found in the 5' untranslated region of mRNA encoded by MGC5601, corresponding to a HOST TARGET binding site such as BINDING SITE I, BINDING SITE II or BINDING SITE III. Table 2 illustrates the complementarity of the nucleotide sequences of MGC5601 BINDING SITE, designated SEQ ID:24927, to the nucleotide sequence of VGAM1081 RNA, herein designated VGAM RNA, also designated SEQ ID:3792.

Another function of VGAM1081 is therefore inhibition of MGC5601 (Accession NM_025247). Accordingly, utilities of VGAM1081 include diagnosis, prevention and treatment of diseases and clinical conditions associated with MGC5601. NBR2 (Accession NM_005821) is another VGAM1081 host target gene. NBR2 BINDING SITE is HOST TARGET binding site found in the 5' untranslated region of mRNA encoded by NBR2, corresponding to a HOST TARGET binding site such as BINDING SITE I, BINDING SITE II or BINDING SITE III. Table 2 illustrates the complementarity of the nucleotide sequences of NBR2 BINDING SITE, designated SEQ ID:12426, to the nucleotide sequence of VGAM1081 RNA, herein designated VGAM RNA, also designated SEQ ID:3792.

Another function of VGAM1081 is therefore inhibition of NBR2 (Accession NM_005821). Accordingly, utilities of VGAM1081 include diagnosis, prevention and treatment of diseases and clinical conditions associated with NBR2. Phosphatidylethanolamine N-methyltransferase (PEMT, Accession NM_007169) is another VGAM1081 host target gene. PEMT BINDING SITE is HOST TARGET binding site found in the 5' untranslated region of mRNA encoded by PEMT, corresponding to a HOST TARGET binding site such as BINDING SITE I, BINDING SITE II or BINDING SITE III. Table 2 illustrates the complementarity of the nucleotide sequences of PEMT BINDING SITE, designated SEQ ID:14014, to the nucleotide sequence of VGAM1081 RNA, herein designated VGAM RNA, also designated SEQ ID:3792.

Another function of VGAM1081 is therefore inhibition of Phosphatidylethanolamine N-methyltransferase (PEMT, Accession NM_007169). Accordingly, utilities of VGAM1081 include diagnosis, prevention and treatment of diseases and clinical conditions associated with PEMT. Protein Phosphatase 2 (formerly 2A), Regulatory Subunit B'', Alpha (PPP2R3A, Accession NM_002718) is another VGAM1081 host target gene. PPP2R3A BINDING SITE is HOST TARGET binding site found in the 5' untranslated region of mRNA encoded by PPP2R3A, corresponding to a HOST TARGET binding site such as BINDING SITE I, BINDING SITE II or BINDING SITE III. Table 2 illustrates the complementarity of the nucleotide sequences of PPP2R3A BINDING SITE, designated SEQ ID:8586, to the nucleotide sequence of VGAM1081 RNA, herein designated VGAM RNA, also designated SEQ ID:3792.

Another function of VGAM1081 is therefore inhibition of Protein Phosphatase 2 (formerly 2A), Regulatory Subunit B'', Alpha (PPP2R3A, Accession NM_002718). Accordingly, utilities of VGAM1081 include diagnosis, prevention and treatment of diseases and clinical conditions associated with PPP2R3A. LOC119188 (Accession XM_058373) is another VGAM1081 host target gene. LOC119188 BINDING SITE is HOST TARGET binding site found in the 5' untranslated region of mRNA encoded by LOC119188, corresponding to a HOST TARGET binding site such as BINDING SITE I, BINDING SITE II or BINDING SITE III. Table 2 illustrates the complementarity of the nucleotide sequences of LOC119188 BINDING SITE, designated SEQ ID:36612, to the nucleotide sequence of VGAM1081 RNA, herein designated VGAM RNA, also designated SEQ ID:3792.

Another function of VGAM1081 is therefore inhibition of LOC119188 (Accession XM_058373). Accordingly, utilities of VGAM1081 include diagnosis, prevention and treatment of diseases and clinical conditions associated with LOC119188. LOC143153 (Accession XM_084440) is another VGAM1081 host target gene. LOC143153 BINDING SITE is HOST TARGET binding site found in the 3' untranslated region of mRNA encoded by LOC143153, corresponding to a HOST TARGET binding site such as BINDING SITE I, BINDING SITE II or BINDING SITE III. Table 2 illustrates the complementarity of the nucleotide sequences of LOC143153 BINDING SITE, designated SEQ ID:37579, to the nucleotide sequence of VGAM1081 RNA, herein designated VGAM RNA, also designated SEQ ID:3792.

Another function of VGAM1081 is therefore inhibition of LOC143153 (Accession XM_084440). Accordingly, utilities of VGAM1081 include diagnosis, prevention and treatment of diseases and clinical conditions associated with LOC143153. LOC143154 (Accession XM_084441) is another VGAM1081 host target gene. LOC143154 BINDING SITE is HOST TARGET binding site found in the 3' untranslated region of mRNA encoded by LOC143154, corresponding to a HOST TARGET binding site such as BINDING SITE I, BINDING SITE II or BINDING SITE III. Table 2 illustrates the complementarity of the nucleotide sequences of LOC143154 BINDING SITE, designated SEQ ID:37586, to the nucleotide sequence of VGAM1081 RNA, herein designated VGAM RNA, also designated SEQ ID:3792.

Another function of VGAM1081 is therefore inhibition of LOC143154 (Accession XM_084441). Accordingly, utilities of VGAM1081 include diagnosis, prevention and treatment of diseases and clinical conditions associated with LOC143154. LOC148195 (Accession XM_097419) is another VGAM1081 host target gene. LOC148195 BINDING SITE is HOST TARGET binding site found in the 5' untranslated region of mRNA encoded by LOC148195, corresponding to a HOST TARGET binding site such as BINDING SITE I, BINDING SITE II or BINDING SITE III. Table 2 illustrates the complementarity of the nucleotide sequences of LOC148195 BINDING SITE, designated SEQ ID:40874, to the nucleotide sequence of VGAM1081 RNA, herein designated VGAM RNA, also designated SEQ ID:3792.

Another function of VGAM1081 is therefore inhibition of LOC148195 (Accession XM_097419). Accordingly, utilities of VGAM1081 include diagnosis, prevention and treatment of diseases and clinical conditions associated with LOC148195. LOC149010 (Accession XM_086397) is another VGAM1081 host target gene. LOC149010 BINDING SITE is HOST TARGET binding site found in the 3' untranslated region of mRNA encoded by LOC149010, corresponding to a HOST TARGET binding site such as BINDING SITE I, BINDING SITE II or BINDING SITE III. Table 2 illustrates the complementarity of the nucleotide sequences of LOC149010 BINDING SITE, designated SEQ ID:38630, to the nucleotide sequence of VGAM1081 RNA, herein designated VGAM RNA, also designated SEQ ID:3792.

Another function of VGAM1081 is therefore inhibition of LOC149010 (Accession XM_086397). Accordingly, utilities of VGAM1081 include diagnosis, prevention and treatment of diseases and clinical conditions associated with LOC149010. LOC149182 (Accession XM_097605) is another VGAM1081 host target gene. LOC149182 BINDING SITE is HOST TARGET binding site found in the 5' untranslated region of mRNA encoded by LOC149182, corresponding to a HOST TARGET binding site such as BINDING SITE I, BINDING SITE II or BINDING SITE III. Table 2 illustrates the complementarity of the nucleotide sequences of LOC149182 BINDING SITE, designated SEQ ID:40970, to the nucleotide sequence of VGAM1081 RNA, herein designated VGAM RNA, also designated SEQ ID:3792.

Another function of VGAM1081 is therefore inhibition of LOC149182 (Accession XM_097605). Accordingly, utilities of VGAM1081 include diagnosis, prevention and treatment of diseases and clinical conditions associated with LOC149182. LOC150159 (Accession NM_139173) is another VGAM1081 host target gene. LOC150159 BINDING SITE is HOST TARGET binding site found in the 3' untranslated region of mRNA encoded by LOC150159, corresponding to a HOST TARGET binding site such as BINDING SITE I, BINDING SITE II or BINDING SITE III. Table 2 illustrates the complementarity of the nucleotide sequences of LOC150159 BINDING SITE, designated SEQ ID:29180, to the nucleotide sequence of VGAM1081 RNA, herein designated VGAM RNA, also designated SEQ ID:3792.

Another function of VGAM1081 is therefore inhibition of LOC150159 (Accession NM_139173). Accordingly, utilities of VGAM1081 include diagnosis, prevention and treatment of diseases and clinical conditions associated with LOC150159. LOC197423 (Accession XM_085436) is another VGAM1081 host target gene. LOC197423 BINDING SITE is HOST TARGET binding site found in the 5' untranslated region of mRNA encoded by LOC197423, corresponding to a HOST TARGET binding site such as BINDING SITE I, BINDING SITE II or BINDING SITE III. Table 2 illustrates the complementarity of the nucleotide sequences of LOC197423 BINDING SITE, designated SEQ ID:38142, to the nucleotide sequence of VGAM1081 RNA, herein designated VGAM RNA, also designated SEQ ID:3792.

Another function of VGAM1081 is therefore inhibition of LOC197423 (Accession XM_085436). Accordingly, utilities of VGAM1081 include diagnosis, prevention and treatment of diseases and clinical conditions associated with LOC197423. LOC200597 (Accession XM_114266) is another VGAM1081 host target gene. LOC200597 BINDING SITE is HOST TARGET binding site found in the 3' untranslated region of mRNA encoded by LOC200597, corresponding to a HOST TARGET binding site such as BINDING SITE I, BINDING SITE II or BINDING SITE III. Table 2 illustrates the complementarity of the nucleotide sequences of LOC200597 BINDING SITE, designated SEQ ID:42826, to the nucleotide sequence of VGAM1081 RNA, herein designated VGAM RNA, also designated SEQ ID:3792.

Another function of VGAM1081 is therefore inhibition of LOC200597 (Accession XM_114266). Accordingly, utilities of VGAM1081 include diagnosis, prevention and treatment of diseases and clinical conditions associated with LOC200597. LOC204970 (Accession XM_114795) is another VGAM1081 host target gene. LOC204970 BINDING SITE is HOST TARGET binding site found in the 3' untranslated region of mRNA encoded by LOC204970, corresponding to a HOST TARGET binding site such as BINDING SITE I, BINDING SITE II or BINDING SITE III. Table 2 illustrates the complementarity of the nucleotide sequences of LOC204970 BINDING SITE, designated SEQ ID:43069, to the nucleotide sequence of VGAM1081 RNA, herein designated VGAM RNA, also designated SEQ ID:3792.

Another function of VGAM1081 is therefore inhibition of LOC204970 (Accession XM_114795). Accordingly, utilities of VGAM1081 include diagnosis, prevention and treatment of diseases and clinical conditions associated with LOC204970. LOC219294 (Accession XM_167566) is another VGAM1081 host target gene. LOC219294 BINDING SITE is HOST TARGET binding site found in the 3' untranslated region of mRNA encoded by LOC219294, corresponding to a HOST TARGET binding site such as BINDING SITE I, BINDING SITE II or BINDING SITE III. Table 2 illustrates the complementarity of the nucleotide sequences of LOC219294 BINDING SITE, designated SEQ ID:44686, to the nucleotide sequence of VGAM1081 RNA, herein designated VGAM RNA, also designated SEQ ID:3792.

Another function of VGAM1081 is therefore inhibition of LOC219294 (Accession XM_167566). Accordingly, utilities of VGAM1081 include diagnosis, prevention and treatment of diseases and clinical conditions associated with LOC219294. LOC219295 (Accession XM_167565) is another VGAM1081 host target gene. LOC219295 BINDING SITE is HOST TARGET binding site found in the 3' untranslated region of mRNA encoded by LOC219295, corresponding to a HOST TARGET binding site such as BINDING SITE I, BINDING SITE II or BINDING SITE III. Table 2 illustrates the complementarity of the nucleotide sequences of LOC219295 BINDING SITE, designated SEQ ID:44681, to the nucleotide sequence of VGAM1081 RNA, herein designated VGAM RNA, also designated SEQ ID:3792.

Another function of VGAM1081 is therefore inhibition of LOC219295 (Accession XM_167565). Accordingly, utilities of VGAM1081 include diagnosis, prevention and treatment of diseases and clinical conditions associated with LOC219295. LOC219513 (Accession XM_169166) is another VGAM1081 host target gene. LOC219513 BINDING SITE is HOST TARGET binding site found in the 5' untranslated region of mRNA encoded by LOC219513, corresponding to a HOST TARGET binding site such as BINDING SITE I, BINDING SITE II or BINDING SITE III. Table 2 illustrates the complementarity of the nucleotide sequences of LOC219513 BINDING SITE, designated SEQ ID:45296, to the nucleotide sequence of VGAM1081 RNA, herein designated VGAM RNA, also designated SEQ ID:3792.

Another function of VGAM1081 is therefore inhibition of LOC219513 (Accession XM_169166). Accordingly, utilities of VGAM1081 include diagnosis, prevention and treatment of diseases and clinical conditions associated with LOC219513. LOC221641 (Accession XM_168090) is another VGAM1081 host target gene. LOC221641 BINDING SITE is HOST TARGET binding site found in the 5' untranslated region of mRNA encoded by LOC221641, corresponding to a HOST TARGET binding site such as BINDING SITE I, BINDING SITE II or BINDING SITE III. Table 2 illustrates the complementarity of the nucleotide sequences of LOC221641 BINDING SITE, designated SEQ ID:45009, to the nucleotide sequence of VGAM1081 RNA, herein designated VGAM RNA, also designated SEQ ID:3792.

Another function of VGAM1081 is therefore inhibition of LOC221641 (Accession XM_168090). Accordingly, utilities of VGAM1081 include diagnosis, prevention and treatment of diseases and clinical conditions associated with LOC221641. FIG. 1 further provides a conceptual description of a novel bioinformatically detected viral gene of the present invention, referred to here as Viral Genomic Address Messenger 1082 (VGAM1082) viral gene, which modulates expression of respective host target genes thereof, the function and utility of which host target genes is known in the art.

VGAM1082 is a novel bioinformatically detected regulatory, non protein coding, viral micro RNA (miRNA) gene. The method by which VGAM1082 was detected is described hereinabove with reference to FIGS. 1-8.

VGAM1082 gene, herein designated VGAM GENE, is a viral gene contained in the genome of Porcine Epidemic Diarrhea Virus. VGAM1082 host target gene, herein designated VGAM HOST TARGET GENE, is a human gene contained in the human genome.

VGAM1082 gene encodes a VGAM1082 precursor RNA, herein designated VGAM PRECURSOR RNA. Similar to other miRNA genes, and unlike most ordinary genes, VGAM1082 precursor RNA does not encode a protein. A nucleotide sequence identical or highly similar to the nucleotide sequence of VGAM1082 precursor RNA is designated SEQ ID:1068, and is provided hereinbelow with reference to the sequence listing part. Nucleotide sequence SEQ ID:1068 is located at position 15710 relative to the genome of Porcine Epidemic Diarrhea Virus.

VGAM1082 precursor RNA folds onto itself, forming VGAM1082 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1082 folded precursor RNA into VGAM1082 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1082 RNA is designated SEQ ID:3793, and is provided hereinbelow with reference to the sequence listing part.

VGAM1082 host target gene, herein designated VGAM HOST TARGET GENE, encodes a corresponding messenger RNA, VGAM1082 host target RNA, herein designated VGAM HOST TARGET RNA. VGAM1082 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1082 RNA, herein designated VGAM RNA, binds complementarily to one or more host target binding sites located in untranslated regions of VGAM1082 host target RNA, herein designated VGAM HOST TARGET RNA. This complementary binding is due to the fact that the nucleotide sequence of VGAM1082 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1082 RNA, herein designated VGAM RNA, may have a different number of host target binding sites in untranslated regions of a VGAM1082 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1082 RNA, herein designated VGAM RNA, to host target binding sites on VGAM1082 host target RNA, herein designated VGAM HOST TARGET RNA, such as BINDING SITE I, BINDING SITE II and BINDING SITE III, inhibits translation of VGAM1082 host target RNA into VGAM1082 host target protein, herein designated VGAM HOST TARGET PROTEIN. VGAM host target protein is therefore outlined by a broken line.

It is appreciated that VGAM1082 host target gene, herein designated VGAM HOST TARGET GENE, in fact represents a plurality of VGAM1082 host target genes. The mRNA of each one of this plurality of VGAM1082 host target genes comprises one or more host target binding sites, each having a nucleotide sequence which is at least partly complementary to VGAM1082 RNA, herein designated VGAM RNA, and which when bound by VGAM1082 RNA causes inhibition of translation of respective one or more VGAM1082 host target proteins.

It is further appreciated by one skilled in the art that the mode of translational inhibition illustrated by FIG. 1 with specific reference to translational inhibition exerted by VGAM1082 gene, herein designated VGAM GENE, on one or more VGAM1082 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1082 is inhibition of expression of host target genes, as part of a novel viral mechanism of attacking a host. Accordingly, utilities of VGAM1082 include diagnosis, prevention and treatment of viral infection by Porcine Epidemic Diarrhea Virus. Specific functions, and accordingly utilities, of VGAM1082 correlate with, and may be deduced from, the identity of the host target genes which VGAM1082 binds and inhibits, and the function of these host target genes, as elaborated hereinbelow.

Nucleotide sequences of the VGAM1082 precursor RNA, herein designated VGAM PRECURSOR RNA, and of the 'diced' VGAM1082 RNA, herein designated VGAM RNA, and a schematic representation of the secondary folding of VGAM1082 folded precursor RNA, herein designated VGAM FOLDED PRECURSOR RNA, of VGAM1082 are further described hereinbelow with reference to Table 1.

Nucleotide sequences of host target binding sites, such as BINDING SITE-I, BINDING SITE-II and BINDING SITE-III of FIG. 1, found on VGAM1082 host target RNA, and schematic representation of the complementarity of each of these host target binding sites to VGAM1082 RNA, herein designated VGAM RNA, are described hereinbelow with reference to Table 2.

As mentioned hereinabove with reference to FIG. 1, a function of VGAM1082 gene, herein designated VGAM is inhibition of expression of VGAM1082 target genes. It is appreciated that specific functions, and accordingly utilities, of VGAM1082 correlate with, and may be deduced from, the identity of the target genes which VGAM1082 binds and inhibits, and the function of these target genes, as elaborated hereinbelow.

Solute Carrier Family 30 (zinc transporter), Member 3 (SLC30A3, Accession NM_003459) is a VGAM1082 host target gene. SLC30A3 BINDING SITE is HOST TARGET binding site found in the 3" untranslated region of mRNA encoded by SLC30A3, corresponding to a HOST TARGET binding site such as BINDING SITE I, BINDING SITE II or BINDING SITE III. Table 2 illustrates the complementarity of the nucleotide sequences of SLC30A3 BINDING SITE, designated SEQ ID:9529, to the nucleotide sequence of VGAM1082 RNA, herein designated VGAM RNA, also designated SEQ ID:3793.

A function of VGAM1082 is therefore inhibition of Solute Carrier Family 30 (zinc transporter), Member 3 (SLC30A3, Accession NM_003459). Accordingly, utilities of VGAM1082 include diagnosis, prevention and treatment of diseases and clinical conditions associated with SLC30A3. FLJ20294 (Accession NM_017749) is another VGAM1082 host target gene. FLJ20294 BINDING SITE is HOST TARGET binding site found in the 3' untranslated region of mRNA encoded by FLJ20294, corresponding to a HOST TARGET binding site such as BINDING SITE I, BINDING SITE II or BINDING SITE III. Table 2 illustrates the complementarity of the nucleotide sequences of FLJ20294 BINDING SITE, designated SEQ ID:19351, to the nucleotide sequence of VGAM1082 RNA, herein designated VGAM RNA, also designated SEQ ID:3793.

Another function of VGAM1082 is therefore inhibition of FLJ20294 (Accession NM_017749). Accordingly, utilities of VGAM1082 include diagnosis, prevention and treatment of diseases and clinical conditions associated with FLJ20294. LOC149721 (Accession XM_086649) is another VGAM1082 host target gene. LOC149721 BINDING SITE is HOST TARGET binding site found in the 5' untranslated region of mRNA encoded by LOC149721, corresponding to a HOST TARGET binding site such as BINDING SITE I, BINDING SITE II or BINDING SITE III. Table 2 illustrates the complementarity of the nucleotide sequences of LOC149721 BINDING SITE, designated SEQ ID:38812, to the nucleotide sequence of VGAM1082 RNA, herein designated VGAM RNA, also designated SEQ ID:3793.

Another function of VGAM1082 is therefore inhibition of LOC149721 (Accession XM_086649). Accordingly, utilities of VGAM1082 include diagnosis, prevention and treatment of diseases and clinical conditions associated with LOC149721. FIG. 1 further provides a conceptual description of a novel bioinformatically detected viral gene of the present invention, referred to here as Viral Genomic Address Messenger 1083 (VGAM1083) viral gene, which modulates expression of respective host target genes thereof, the function and utility of which host target genes is known in the art.

VGAM1083 is a novel bioinformatically detected regulatory, non protein coding, viral micro RNA (miRNA) gene. The method by which VGAM1083 was detected is described hereinabove with reference to FIGS. 1-8.

VGAM1083 gene, herein designated VGAM GENE, is a viral gene contained in the genome of Porcine Epidemic Diarrhea Virus. VGAM1083 host target gene, herein designated VGAM HOST TARGET GENE, is a human gene contained in the human genome.

VGAM1083 gene encodes a VGAM1083 precursor RNA, herein designated VGAM PRECURSOR RNA. Similar to other miRNA genes, and unlike most ordinary genes, VGAM1083 precursor RNA does not encode a protein. A nucleotide sequence identical or highly similar to the nucleotide sequence of VGAM1083 precursor RNA is designated SEQ ID:1069, and is provided hereinbelow with reference to the sequence listing part. Nucleotide sequence SEQ ID:1069 is located at position 13354 relative to the genome of Porcine Epidemic Diarrhea Virus.

VGAM1083 precursor RNA folds onto itself, forming VGAM1083 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1083 folded precursor RNA into VGAM1083 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1083 RNA is designated SEQ ID:3794, and is provided hereinbelow with reference to the sequence listing part.

VGAM1083 host target gene, herein designated VGAM HOST TARGET GENE, encodes a corresponding messenger RNA, VGAM1083 host target RNA, herein designated VGAM HOST TARGET RNA. VGAM1083 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1083 RNA, herein designated VGAM RNA, binds complementarily to one or more host target binding sites located in untranslated regions of VGAM1083 host target RNA, herein designated VGAM HOST TARGET RNA. This complementary binding is due to the fact that the nucleotide sequence of VGAM1083 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1083 RNA, herein designated VGAM RNA, may have a different number of host target binding sites in untranslated regions of a VGAM1083 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1083 RNA, herein designated VGAM RNA, to host target binding sites on VGAM1083 host target RNA, herein designated VGAM HOST TARGET RNA, such as BINDING SITE I, BINDING SITE II and BINDING SITE III, inhibits translation of VGAM1083 host target RNA into VGAM1083 host target protein, herein designated VGAM HOST TARGET PROTEIN. VGAM host target protein is therefore outlined by a broken line.

It is appreciated that VGAM1083 host target gene, herein designated VGAM HOST TARGET GENE, in fact represents a plurality of VGAM1083 host target genes. The mRNA of each one of this plurality of VGAM1083 host target genes comprises one or more host target binding sites, each having a nucleotide sequence which is at least partly complementary to VGAM1083 RNA, herein designated VGAM RNA, and which when bound by VGAM1083 RNA causes inhibition of translation of respective one or more VGAM1083 host target proteins.

It is further appreciated by one skilled in the art that the mode of translational inhibition illustrated by FIG. 1 with specific reference to translational inhibition exerted by VGAM1083 gene, herein designated VGAM GENE, on one or more VGAM1083 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1083 is inhibition of expression of host target genes, as part of a novel viral mechanism of attacking a host. Accordingly, utilities of VGAM1083 include diagnosis, prevention and treatment of viral infection by Porcine Epidemic Diarrhea Virus. Specific functions, and accordingly utilities, of VGAM1083 correlate with, and may be deduced from, the identity of the host target genes which VGAM1083 binds and inhibits, and the function of these host target genes, as elaborated hereinbelow.

Nucleotide sequences of the VGAM1083 precursor RNA, herein designated VGAM PRECURSOR RNA, and of the 'diced' VGAM1083 RNA, herein designated VGAM RNA, and a schematic representation of the secondary folding of VGAM1083 folded precursor RNA, herein designated VGAM FOLDED PRECURSOR RNA, of VGAM1083 are further described hereinbelow with reference to Table 1.

Nucleotide sequences of host target binding sites, such as BINDING SITE-I, BINDING SITE-II and BINDING SITE-III of FIG. 1, found on VGAM1083 host target RNA, and schematic representation of the complementarity of each of these host target binding sites to VGAM1083 RNA, herein designated VGAM RNA, are described hereinbelow with reference to Table 2.

As mentioned hereinabove with reference to FIG. 1, a function of VGAM1083 gene, herein designated VGAM is inhibition of expression of VGAM1083 target genes. It is appreciated that specific functions, and accordingly utilities, of VGAM1083 correlate with, and may be deduced from, the identity of the target genes which VGAM1083 binds and inhibits, and the function of these target genes, as elaborated hereinbelow.

HNF3G (Accession XM_051332) is a VGAM1083 host target gene. HNF3G BINDING SITE is HOST TARGET binding site found in the 3' untranslated region of mRNA encoded by HNF3G, corresponding to a HOST TARGET binding site such as BINDING SITE I, BINDING SITE II or BINDING SITE III. Table 2 illustrates the complementarity of the nucleotide sequences of HNF3G BINDING SITE, designated SEQ ID:35809, to the nucleotide sequence of VGAM1083 RNA, herein designated VGAM RNA, also designated SEQ ID:3794.

A function of VGAM1083 is therefore inhibition of HNF3G (Accession XM_051332). Accordingly, utilities of VGAM1083 include diagnosis, prevention and treatment of diseases and clinical conditions associated with HNF3G. Lamin B Receptor (LBR, Accession XM_001795) is another VGAM1083 host target gene. LBR BINDING SITE is HOST TARGET binding site found in the 3' untranslated region of mRNA encoded by LBR, corresponding to a HOST TARGET binding site such as BINDING SITE I, BINDING SITE II or BINDING SITE III. Table 2 illustrates the complementarity of the nucleotide sequences of LBR BINDING SITE, designated SEQ ID:29855, to the nucleotide sequence of VGAM1083 RNA, herein designated VGAM RNA, also designated SEQ ID:3794.

Another function of VGAM1083 is therefore inhibition of Lamin B Receptor (LBR, Accession XM_001795). Accordingly, utilities of VGAM1083 include diagnosis, prevention and treatment of diseases and clinical conditions associated with LBR. Myeloid Cell Leukemia Sequence 1 (BCL2-related) (MCL1, Accession NM_021960) is another VGAM1083 host target gene. MCL1 BINDING SITE is HOST TARGET binding site found in the 3' untranslated region of mRNA encoded by MCL1, corresponding to a HOST TARGET binding site such as BINDING SITE I, BINDING SITE II or BINDING SITE III. Table 2 illustrates the complementarity of the nucleotide sequences of MCL1 BINDING SITE, designated SEQ ID:22489, to the nucleotide sequence of VGAM1083 RNA, herein designated VGAM RNA, also designated SEQ ID:3794.

Another function of VGAM1083 is therefore inhibition of Myeloid Cell Leukemia Sequence 1 (BCL2-related) (MCL1, Accession NM_021960), a gene which involved in programing of differentiation and concomitant maintenance of viability. Accordingly, utilities of VGAM1083 include diagnosis, prevention and treatment of diseases and clinical conditions associated with MCL1. The function of MCL1 has been established by previous studies. Kozopas et al. (1993) isolated a gene, MCL1, from the ML-1 human myeloid leukemia cell line. Expression of MCL1 increased early in the induction, or programming, of differentiation in ML-1 (at 1-3 hr), before the appearance of differentiation markers and mature morphology (at 1-3 days). MCL1 showed sequence similarity, particularly in the carboxyl portion, to BCL2 (OMIM Ref. No. 151430), a gene involved in normal lymphoid development and in lymphomas with the t (14;18) chromosome translocation. Further, in contrast to proliferation-associated oncogenes, the expression of MCL1 and BCL2 relates to the programming of differentiation/development and cell viability/death. Kozopas et al. (1993) suggested that MCL1 and BCL2 are 2 members of a 'new' gene family. Bae et al. (2000) identified a short splicing variant of MCL1, which they termed MCL1S. Sequence analysis indicated that the 271-amino acid variant lacks BCL2 homology domains 1 and 2 and the transmembrane domain due to the splicing out of exon 2 during mRNA processing. Unlike the full-length 350-amino acid MCL1 protein (MCL1L), yeast 2-hybrid analysis showed that MCL1S does not interact with proapoptotic BCL2 family proteins but dimerizes with the antiapoptotic MCL1L. Overexpression of MCL1S induced apoptosis in transfected CHO cells that could be antagonized by a caspase inhibitor or specifically by MCL1L. Therefore, the authors concluded that the fate of MCL1-expressing cells may be regulated through alternative splicing mechanisms and the interactions of the resulting gene products. Using the methods of somatic cell hybrid analysis and fluorescence in situ hybridization, Craig et al. (1994) mapped MCL1 to 1q21. In the mouse, MCL1-related sequences were mapped to positions on 2 mouse chromosomes, 3 and 5, using haplotype analysis of an interspecific cross. The locus on mouse chromosome 3, Mcl1, was homologous to MCL1 on human chromosome 1; the second locus, Mcl-rs, on mouse chromosome 5, may represent a pseudogene. The proximal long arm of human chromosome 1, where MCL1 is located, is duplicated and/or rearranged in a variety of preneoplastic and neoplastic diseases, including hematologic and solid tumors. Thus, MCL1 is a candidate gene for involvement in cancer. Animal model experiments lend further support to the function of MCL1. Rinkenberger et al. (2000) disrupted the Mcl1 locus in murine ES cells to determine the developmental roles of this Bcl2 family member. Deletion of Mcl1 resulted in periimplantation embryonic lethality. Homozygous Mcl1-deficient embryos did not implant in utero, but could be recovered at E3.5 to E4.0. Null blastocysts failed to hatch or attach in vitro, indicating a trophectoderm defect, although the inner cell mass could grow in culture. Of note, homozygous Mcl1-deficient blastocysts showed no evidence of increased apoptosis, but exhibited a delay in maturation beyond the precompaction stage. This model indicates that Mcl1 is essential for preimplantation development and implantation, and suggests that it has a function beyond regulating apoptosis.

It is appreciated that the abovementioned animal model for MCL1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kozopas, K. M.; Yang, T.; Buchan, H. L.; Zhou, P.; Craig, R. W.: MCL1, a gene expressed in programmed myeloid cell differentiation, has sequence similarity to BCL2. Proc. Nat. Acad. Sci. 90:3516-3520, 1993; and Bae, J.; Leo, C. P.; Hsu, S. Y.; Hsueh, A. J. W.: MCL-1S, a splicing variant of the antiapoptotic BCL-2 family member MCL-1, encodes a proapoptotic protein possessing only the BH3 domai.

Further studies establishing the function and utilities of MCL1 are found in John Hopkins OMIM database record ID 159552, and in sited publications numbered 3382-3385 listed in the bibliography section hereinbelow, which are also hereby incorporated by reference. T, Brachyury Homolog (mouse) (T, Accession NM_003181) is another VGAM1083 host target gene. T BINDING SITE is HOST TARGET binding site found in the 3' untranslated region of mRNA encoded by T, corresponding to a HOST TARGET binding site such as BINDING SITE I, BINDING SITE II or BINDING SITE III. Table 2 illustrates the complementarity of the nucleotide sequences of T BINDING SITE, designated SEQ ID:9153, to the nucleotide sequence of VGAM1083 RNA, herein designated VGAM RNA, also designated SEQ ID:3794.

Another function of VGAM1083 is therefore inhibition of T, Brachyury Homolog (mouse) (T, Accession NM_003181), a gene which is a potent transcription factor. Accordingly, utilities of VGAM1083 include diagnosis, prevention and treatment of diseases and clinical conditions associated with T. The function of T has been established by previous studies. T protein is vital for the formation and differentiation of posterior mesoderm and for axial development in all vertebrates. Edwards et al. (1996) cited as evidence the analysis of T mutant mice and zebrafish. 'Brachyury' mutant mice lack T protein and die in utero with abnormal notochord, absent somites, and reduced allantois. In zebrafish the 'no tail' mutation (ntl) is the homolog of 'Brachyury.' Ntl embryos die after hatching, lack notochords and tails, and possess abnormal trunk somites. The T gene encodes a transcription factor that binds to a specific DNA element via its N-terminal region. A protein motif within the DNA-binding domain, the so-called T box, is highly conserved among T homologs from different species and also defines a broader family of T-box genes; see TBX2 (OMIM Ref. No. 600747). Using the rat c-myc gene driven by a human metallothionein promoter, Abe et al. (2000) created several transgenic mouse lines. All of the males were sterile except those in line 137, indicating that the transgene is functionless in that line. However, most of the mice in line 137 had a kinked or bent tail. Abe et al. (2000) found that the transgene was integrated within intron 7 of the mouse Brachyury (T) gene and referred to the mutation as T-137, a null allele of the T gene. T-137 homozygotes showed an embryonic lethal phenotype. At embryonic day 9.5, fragmentation of the notochord was seen both anteriorly and posteriorly. At embryonic day 10.5, the embryos tended to have an unlooped heart tube and a swollen pericardium cavity, indicating abnormality in heart function. The embryos died after embryonic day 10.5.

Full details of the abovementioned studies are described in the following publications, the disclosure of which are hereby incorporated by reference:

Abe, K.; Yamamura, K.; Suzuki, M.: Molecular and embryological characterization of a new transgene-induced null allele of mouse Brachyury locus. Mammalian Genome 11:238-240, 2000; and Edwards, Y. H.; Putt, W.; Lekoape, K. M.; Stott, D.; Fox, M.; Hopkinson, D. A.; Sowden, J.: The human homolog T of the mouse T (Brachyury) gene: gene structure, cDNA sequence, and ass.

Further studies establishing the function and utilities of T are found in John Hopkins OMIM database record ID 601397, and in sited publications numbered 648 and 6490-6495 listed in the bibliography section hereinbelow, which are also hereby incorporated by reference. Transglutaminase 4 (prostate) (TGM4, Accession NM_003241) is another VGAM1083 host target gene. TGM4 BINDING SITE is HOST TARGET binding site found in the 3' untranslated region of mRNA encoded by TGM4, corresponding to a HOST TARGET binding site such as BINDING SITE I, BINDING SITE II or BINDING SITE III. Table 2 illustrates the complementarity of the nucleotide sequences of TGM4 BINDING SITE, designated SEQ ID:9235, to the nucleotide sequence of VGAM1083 RNA, herein designated VGAM RNA, also designated SEQ ID:3794.

Another function of VGAM1083 is therefore inhibition of Transglutaminase 4 (prostate) (TGM4, Accession NM_003241), a gene which catalyzes the cross-linking of proteins and the conjugation of polyamines to specific proteins in the seminal tract. Accordingly, utilities of VGAM1083 include diagnosis, prevention and treatment of diseases and clinical conditions associated with TGM4. The function of TGM4 has been established by previous studies. In rodents, TGP is involved in the formation of copulatory plugs in the female genital tract after coitus, and may play a role in masking the antigenicity of the male gamete, thereby suppressing an immune response in the female genital tract against the sperm cells. By screening a human prostate library with a cDNA segment corresponding to the active-site region of TGC (TGM2), Dubbink et al. (1996) isolated a cDNA encoding human TGP. The predicted 684-amino acid protein is 53% identical to rat TGP. In vitro translated human TGP has a molecular mass of approximately 77 kD. Northern blot analysis revealed that TGP is expressed as a 3.5-kb mRNA exclusively in prostate. Androgen induced TGP expression approximately 3-fold in a human prostate cancer cell line. Independently, Grant et al. (1994) cloned TGM4 cDNAs. They reported that the predicted protein contains 679 amino acids.

Full details of the abovementioned studies are described in the following publications, the disclosure of which are hereby incorporated by reference:

Dubbink, H. J.; Verkaik, N. S.; Faber, P. W.; Trapman, J.; Schroder, F. H.; Romijn, J. C.: Tissue-specific and androgen-regulated expression of human prostate-specific transglutaminase. Biochem. J. 315:901-908, 1996; and Grant, F. J.; Taylor, D. A.; Sheppard, P. O.; Mathewes, S. L.; Lint, W.; Vanaja, E.; Bishop, P. D.; O'Hara, P. J.: Molecular cloning and characterization of a novel transglutaminase cDN.

Further studies establishing the function and utilities of TGM4 are found in John Hopkins OMIM database record ID 600585, and in sited publications numbered 10212-10214 listed in the bibliography section hereinbelow, which are also hereby incorporated by reference. CGG Triplet Repeat Binding Protein 1 (CGGBP1, Accession NM_003663) is another VGAM1083 host target gene. CGGBP1 BINDING SITE is HOST TARGET binding site found in the 5' untranslated region of mRNA encoded by CGGBP1, corresponding to a HOST TARGET binding site such as BINDING SITE I, BINDING SITE II or BINDING SITE III. Table 2 illustrates the complementarity of the nucleotide sequences of CGGBP1 BINDING SITE, designated SEQ ID:9738, to the nucleotide sequence of VGAM1083 RNA, herein designated VGAM RNA, also designated SEQ ID:3794.

Another function of VGAM1083 is therefore inhibition of CGG Triplet Repeat Binding Protein 1 (CGGBP1, Accession NM_003663). Accordingly, utilities of VGAM1083 include diagnosis, prevention and treatment of diseases and clinical conditions associated with CGGBP1. E74-like Factor 4 (ets domain transcription factor) (ELF4, Accession NM_001421) is another VGAM1083 host target gene. ELF4 BINDING SITE is HOST TARGET binding site found in the 3' untranslated region of mRNA encoded by ELF4, corresponding to a HOST TARGET binding site such as BINDING SITE I, BINDING SITE II or BINDING SITE III. Table 2 illustrates the complementarity of the nucleotide sequences of ELF4 BINDING SITE, designated SEQ ID:7127, to the nucleotide sequence of VGAM1083 RNA, herein designated VGAM RNA, also designated SEQ ID:3794.

Another function of VGAM1083 is therefore inhibition of E74-like Factor 4 (ets domain transcription factor) (ELF4, Accession NM_001421). Accordingly, utilities of VGAM1083 include diagnosis, prevention and treatment of diseases and clinical conditions associated with ELF4. MGC4832 (Accession NM_145061) is another VGAM1083 host target gene. MGC4832 BINDING SITE is HOST TARGET binding site found in the 3" untranslated region of mRNA encoded by MGC4832, corresponding to a HOST TARGET binding site such as BINDING SITE I, BINDING SITE II or BINDING SITE III. Table 2 illustrates the complementarity of the nucleotide sequences of MGC4832 BINDING SITE, designated SEQ ID:29701, to the nucleotide sequence of VGAM1083 RNA, herein designated VGAM RNA, also designated SEQ ID:3794.

Another function of VGAM1083 is therefore inhibition of MGC4832 (Accession NM_145061). Accordingly, utilities of VGAM1083 include diagnosis, prevention and treatment of diseases and clinical conditions associated with MGC4832. Purinergic Receptor P2X-like 1, Orphan Receptor (P2RXL1, Accession NM_005446) is another VGAM1083 host target gene. P2RXL1 BINDING SITE is HOST TARGET binding site found in the 3' untranslated region of mRNA encoded by P2RXL1, corresponding to a HOST TARGET binding site such as BINDING SITE I, BINDING SITE II or BINDING SITE III. Table 2 illustrates the complementarity of the nucleotide sequences of P2RXL1 BINDING SITE, designated SEQ ID:11931, to the nucleotide sequence of VGAM1083 RNA, herein designated VGAM RNA, also designated SEQ ID:3794.

Another function of VGAM1083 is therefore inhibition of Purinergic Receptor P2X-like 1, Orphan Receptor (P2RXL1, Accession NM_005446). Accordingly, utilities of VGAM1083 include diagnosis, prevention and treatment of diseases and clinical conditions associated with P2RXL1. TRIP-Br2 (Accession NM_014755) is another VGAM1083 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16482, to the nucleotide sequence of VGAM1083 RNA, herein designated VGAM RNA, also designated SEQ ID:3794.

Another function of VGAM1083 is therefore inhibition of TRIP-Br2 (Accession NM_014755). Accordingly, utilities of VGAM1083 include diagnosis, prevention and treatment of diseases and clinical conditions associated with TRIP-Br2. FIG. 1 further provides a conceptual description of a novel bioinformatically detected viral gene of the present invention, referred to here as Viral Genomic Address Messenger 1084 (VGAM1084) viral gene, which modulates expression of respective host target genes thereof, the function and utility of which host target genes is known in the art.

VGAM1084 is a novel bioinformatically detected regulatory, non protein coding, viral micro RNA (miRNA) gene. The method by which VGAM1084 was detected is described hereinabove with reference to FIGS. 1-8.

VGAM1084 gene, herein designated VGAM GENE, is a viral gene contained in the genome of Porcine Epidemic Diarrhea Virus. VGAM1084 host target gene, herein designated VGAM HOST TARGET GENE, is a human gene contained in the human genome.

VGAM1084 gene encodes a VGAM1084 precursor RNA, herein designated VGAM PRECURSOR RNA. Similar to other miRNA genes, and unlike most ordinary genes, VGAM1084 precursor RNA does not encode a protein. A nucleotide sequence identical or highly similar to the nucleotide sequence of VGAM1084 precursor RNA is designated SEQ ID:1070, and is provided hereinbelow with reference to the sequence listing part. Nucleotide sequence SEQ ID:1070 is located at position 11654 relative to the genome of Porcine Epidemic Diarrhea Virus.

VGAM1084 precursor RNA folds onto itself, forming VGAM1084 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1084 folded precursor RNA into VGAM1084 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1084 RNA is designated SEQ ID:3795, and is provided hereinbelow with reference to the sequence listing part.

VGAM1084 host target gene, herein designated VGAM HOST TARGET GENE, encodes a corresponding messenger RNA, VGAM1084 host target RNA, herein designated VGAM HOST TARGET RNA. VGAM1084 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1084 RNA, herein designated VGAM RNA, binds complementarily to one or more host target binding sites located in untranslated regions of VGAM1084 host target RNA, herein designated VGAM HOST TARGET RNA. This complementary binding is due to the fact that the nucleotide sequence of VGAM1084 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1084 RNA, herein designated VGAM RNA, may have a different number of host target binding sites in untranslated regions of a VGAM1084 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1084 RNA, herein designated VGAM RNA, to host target binding sites on VGAM1084 host target RNA, herein designated VGAM HOST TARGET RNA, such as BINDING SITE I, BINDING SITE II and BINDING SITE III, inhibits translation of VGAM1084 host target RNA into VGAM1084 host target protein, herein designated VGAM HOST TARGET PROTEIN. VGAM host target protein is therefore outlined by a broken line.

It is appreciated that VGAM1084 host target gene, herein designated VGAM HOST TARGET GENE, in fact represents a plurality of VGAM1084 host target genes. The mRNA of each one of this plurality of VGAM1084 host target genes comprises one or more host target binding sites, each having a nucleotide sequence which is at least partly complementary to VGAM1084 RNA, herein designated VGAM RNA, and which when bound by VGAM1084 RNA causes inhibition of translation of respective one or more VGAM1084 host target proteins.

It is further appreciated by one skilled in the art that the mode of translational inhibition illustrated by FIG. 1 with specific reference to translational inhibition exerted by VGAM1084 gene, herein designated VGAM GENE, on one or more VGAM1084 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1084 is inhibition of expression of host target genes, as part of a novel viral mechanism of attacking a host. Accordingly, utilities of VGAM1084 include diagnosis, prevention and treatment of viral infection by Porcine Epidemic Diarrhea Virus. Specific functions, and accordingly utilities, of VGAM1084 correlate with, and may be deduced from, the identity of the host target genes which VGAM1084 binds and inhibits, and the function of these host target genes, as elaborated hereinbelow.

Nucleotide sequences of the VGAM1084 precursor RNA, herein designated VGAM PRECURSOR RNA, and of the 'diced' VGAM1084 RNA, herein designated VGAM RNA, and a schematic representation of the secondary folding of VGAM1084 folded precursor RNA, herein designated VGAM FOLDED PRECURSOR RNA, of VGAM1084 are further described hereinbelow with reference to Table 1.

Nucleotide sequences of host target binding sites, such as BINDING SITE-I, BINDING SITE-II and BINDING SITE-III of FIG. 1, found on VGAM1084 host target RNA, and schematic representation of the complementarity of each of these host target binding sites to VGAM1084 RNA, herein designated VGAM RNA, are described hereinbelow with reference to Table 2.

As mentioned hereinabove with reference to FIG. 1, a function of VGAM1084 gene, herein designated VGAM is inhibition of expression of VGAM1084 target genes. It is appreciated that specific functions, and accordingly utilities, of VGAM1084 correlate with, and may be deduced from, the identity of the target genes which VGAM1084 binds and inhibits, and the function of these target genes, as elaborated hereinbelow.

Fibromodulin (FMOD, Accession NM_002023) is a VGAM1084 host target gene. FMOD BINDING SITE is HOST TARGET binding site found in the 3' untranslated region of mRNA encoded by FMOD, corresponding to a HOST TARGET binding site such as BINDING SITE I, BINDING SITE II or BINDING SITE III. Table 2 illustrates the complementarity of the nucleotide sequences of FMOD BINDING SITE, designated SEQ ID:7773, to the nucleotide sequence of VGAM1084 RNA, herein designated VGAM RNA, also designated SEQ ID:3795.

A function of VGAM1084 is therefore inhibition of Fibromodulin (FMOD, Accession NM_002023), a gene which affects the rate of fibrils formation. Accordingly, utilities of VGAM1084 include diagnosis, prevention and treatment of diseases and clinical conditions associated with FMOD. The function of FMOD and its association with various diseases and clinical conditions, has been established by previous studies, as described hereinabove with reference to VGAM39. Ribonuclease/angiogenin Inhibitor (RNH, Accession NM_002939) is another VGAM1084 host target gene. RNH BINDING SITE1 and RNH BINDING SITE2 are HOST TARGET binding sites found in untranslated regions of mRNA encoded by RNH, corresponding to HOST TARGET binding sites such as BINDING SITE I, BINDING SITE II or BINDING SITE III. Table 2 illustrates the complementarity of the nucleotide sequences of RNH BINDING SITE1 and RNH BINDING SITE2, designated SEQ ID:8846 and SEQ ID:29995 respectively, to the nucleotide sequence of VGAM1084 RNA, herein designated VGAM RNA, also designated SEQ ID:3795.

Another function of VGAM1084 is therefore inhibition of Ribonuclease/angiogenin Inhibitor (RNH, Accession NM_002939), a gene which is an inhibitor of pancreatic rnase and angiogenin. may also function in the modulation of cellular activities. Accordingly, utilities of VGAM1084 include diagnosis, prevention and treatment of diseases and clinical conditions associated with RNH. The function of RNH and its association with various diseases and clinical conditions, has been established by previous studies, as described hereinabove with reference to VGAM484. ELKS (Accession NM_015064) is another VGAM1084 host target gene. ELKS BINDING SITE is HOST TARGET binding site found in the 3' untranslated region of mRNA encoded by ELKS, corresponding to a HOST TARGET binding site such as BINDING SITE I, BINDING SITE II or BINDING SITE III. Table 2 illustrates the complementarity of the nucleotide sequences of ELKS BINDING SITE, designated SEQ ID:17418, to the nucleotide sequence of VGAM1084 RNA, herein designated VGAM RNA, also designated SEQ ID:3795.

Another function of VGAM1084 is therefore inhibition of ELKS (Accession NM_015064). Accordingly, utilities of VGAM1084 include diagnosis, prevention and treatment of diseases and clinical conditions associated with ELKS. FLJ22313 (Accession NM_022373) is another VGAM1084 host target gene. FLJ22313 BINDING SITE is HOST TARGET binding site found in the 5' untranslated region of mRNA encoded by FLJ22313, corresponding to a HOST TARGET binding site such as BINDING SITE I, BINDING SITE II or BINDING SITE III. Table 2 illustrates the complementarity of the nucleotide sequences of FLJ22313 BINDING SITE, designated SEQ ID:22761, to the nucleotide sequence of VGAM1084 RNA, herein designated VGAM RNA, also designated SEQ ID:3795.

Another function of VGAM1084 is therefore inhibition of FLJ22313 (Accession NM_022373). Accordingly, utilities of VGAM1084 include diagnosis, prevention and treatment of diseases and clinical conditions associated with FLJ22313. FLJ23519 (Accession XM_044932) is another VGAM1084 host target gene. FLJ23519 BINDING SITE is HOST TARGET binding site found in the 5' untranslated region of mRNA encoded by FLJ23519, corresponding to a HOST TARGET binding site such as BINDING SITE I, BINDING SITE II or BINDING SITE III. Table 2 illustrates the complementarity of the nucleotide sequences of FLJ23519 BINDING SITE, designated SEQ ID:34309, to the nucleotide sequence of VGAM1084 RNA, herein designated VGAM RNA, also designated SEQ ID:3795.

Another function of VGAM1084 is therefore inhibition of FLJ23519 (Accession XM_044932). Accordingly, utilities of VGAM1084 include diagnosis, prevention and treatment of diseases and clinical conditions associated with FLJ23519. MGC4309 (Accession NM_024115) is another VGAM1084 host target gene. MGC4309 BINDING SITE is HOST TARGET binding site found in the 3' untranslated region of mRNA encoded by MGC4309, corresponding to a HOST TARGET binding site such as BINDING SITE I, BINDING SITE II or BINDING SITE III. Table 2 illustrates the complementarity of the nucleotide sequences of MGC4309 BINDING SITE, designated SEQ ID:23567, to the nucleotide sequence of VGAM1084 RNA, herein designated VGAM RNA, also designated SEQ ID:3795.

Another function of VGAM1084 is therefore inhibition of MGC4309 (Accession NM_024115). Accordingly, utilities of VGAM1084 include diagnosis, prevention and treatment of diseases and clinical conditions associated with MGC4309. Zinc Finger Protein 33a (KOX 31) (ZNF33A, Accession XM_166119) is another VGAM1084 host target gene. ZNF33A BINDING SITE is HOST TARGET binding site found in the 3' untranslated region of mRNA encoded by ZNF33A, corresponding to a HOST TARGET binding site such as BINDING SITE I, BINDING SITE II or BINDING SITE III. Table 2 illustrates the complementarity of the nucleotide sequences of ZNF33A BINDING SITE, designated SEQ ID:43897, to the nucleotide sequence of VGAM1084 RNA, herein designated VGAM RNA, also designated SEQ ID:3795.

Another function of VGAM1084 is therefore inhibition of Zinc Finger Protein 33a (KOX 31) (ZNF33A, Accession XM_166119). Accordingly, utilities of VGAM1084 include diagnosis, prevention and treatment of diseases and clinical conditions associated with ZNF33A. LOC152503 (Accession XM_098238) is another VGAM1084 host target gene. LOC152503 BINDING SITE is HOST TARGET binding site found in the 5' untranslated region of mRNA encoded by LOC152503, corresponding to a HOST TARGET binding site such as BINDING SITE I, BINDING SITE II or BINDING SITE III. Table 2 illustrates the complementarity of the nucleotide sequences of LOC152503 BINDING SITE, designated SEQ ID:41517, to the nucleotide sequence of VGAM1084 RNA, herein designated VGAM RNA, also designated SEQ ID:3795.

Another function of VGAM1084 is therefore inhibition of LOC152503 (Accession XM_098238). Accordingly, utilities of VGAM1084 include diagnosis, prevention and treatment of diseases and clinical conditions associated with LOC152503. LOC51236 (Accession NM_016458) is another VGAM1084 host target gene. LOC51236 BINDING SITE is HOST TARGET binding site found in the 3' untranslated region of mRNA encoded by LOC51236, corresponding to a HOST TARGET binding site such as BINDING SITE I, BINDING SITE II or BINDING SITE III. Table 2 illustrates the complementarity of the nucleotide sequences of LOC51236 BINDING SITE, designated SEQ ID:18569, to the nucleotide sequence of VGAM1084 RNA, herein designated VGAM RNA, also designated SEQ ID:3795.

Another function of VGAM1084 is therefore inhibition of LOC51236 (Accession NM_016458). Accordingly, utilities of VGAM1084 include diagnosis, prevention and treatment of diseases and clinical conditions associated with LOC51236. FIG. 1 further provides a conceptual description of a novel bioinformatically detected viral gene of the present invention, referred to here as Viral Genomic Address Messenger 1085 (VGAM1085) viral gene, which modulates expression of respective host target genes thereof, the function and utility of which host target genes is known in the art.

VGAM1085 is a novel bioinformatically detected regulatory, non protein coding, viral micro RNA (miRNA) gene. The method by which VGAM1085 was detected is described hereinabove with reference to FIGS. 1-8.

VGAM1085 gene, herein designated VGAM GENE, is a viral gene contained in the genome of Porcine Epidemic Diarrhea Virus. VGAM1085 host target gene, herein designated VGAM HOST TARGET GENE, is a human gene contained in the human genome.

VGAM1085 gene encodes a VGAM1085 precursor RNA, herein designated VGAM PRECURSOR RNA. Similar to other miRNA genes, and unlike most ordinary genes, VGAM1085 precursor RNA does not encode a protein. A nucleotide sequence identical or highly similar to the nucleotide sequence of VGAM1085 precursor RNA is designated SEQ ID:1071, and is provided hereinbelow with reference to the sequence listing part. Nucleotide sequence SEQ ID:1071 is located at position 14382 relative to the genome of Porcine Epidemic Diarrhea Virus.

VGAM1085 precursor RNA folds onto itself, forming VGAM1085 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1085 folded precursor RNA into VGAM1085 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1085 RNA is designated SEQ ID:3796, and is provided hereinbelow with reference to the sequence listing part.

VGAM1085 host target gene, herein designated VGAM HOST TARGET GENE, encodes a corresponding messenger RNA, VGAM1085 host target RNA, herein designated VGAM HOST TARGET RNA. VGAM1085 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1085 RNA, herein designated VGAM RNA, binds complementarily to one or more host target binding sites located in untranslated regions of VGAM1085 host target RNA, herein designated VGAM HOST TARGET RNA. This complementary binding is due to the fact that the nucleotide sequence of VGAM1085 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1085 RNA, herein designated VGAM RNA, may have a different number of host target binding sites in untranslated regions of a VGAM1085 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1085 RNA, herein designated VGAM RNA, to host target binding sites on VGAM1085 host target RNA, herein designated VGAM HOST TARGET RNA, such as BINDING SITE I, BINDING SITE II and BINDING SITE III, inhibits translation of VGAM1085 host target RNA into VGAM1085 host target protein, herein designated VGAM HOST TARGET PROTEIN. VGAM host target protein is therefore outlined by a broken line.

It is appreciated that VGAM1085 host target gene, herein designated VGAM HOST TARGET GENE, in fact represents a plurality of VGAM1085 host target genes. The mRNA of each one of this plurality of VGAM1085 host target genes comprises one or more host target binding sites, each having a nucleotide sequence which is at least partly complementary to VGAM1085 RNA, herein designated VGAM RNA, and which when bound by VGAM1085 RNA causes inhibition of translation of respective one or more VGAM1085 host target proteins.

It is further appreciated by one skilled in the art that the mode of translational inhibition illustrated by FIG. 1 with specific reference to translational inhibition exerted by VGAM1085 gene, herein designated VGAM GENE, on one or more VGAM1085 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1085 is inhibition of expression of host target genes, as part of a novel viral mechanism of attacking a host. Accordingly, utilities of VGAM1085 include diagnosis, prevention and treatment of viral infection by Porcine Epidemic Diarrhea Virus.

Specific functions, and accordingly utilities, of VGAM1085 correlate with, and may be deduced from, the identity of the host target genes which VGAM1085 binds and inhibits, and the function of these host target genes, as elaborated hereinbelow.

Nucleotide sequences of the VGAM1085 precursor RNA, herein designated VGAM PRECURSOR RNA, and of the 'diced' VGAM1085 RNA, herein designated VGAM RNA, and a schematic representation of the secondary folding of VGAM1085 folded precursor RNA, herein designated VGAM FOLDED PRECURSOR RNA, of VGAM1085 are further described hereinbelow with reference to Table 1.

Nucleotide sequences of host target binding sites, such as BINDING SITE-I, BINDING SITE-II and BINDING SITE-III of FIG. 1, found on VGAM1085 host target RNA, and schematic representation of the complementarity of each of these host target binding sites to VGAM1085 RNA, herein designated VGAM RNA, are described hereinbelow with reference to Table 2.

As mentioned hereinabove with reference to FIG. 1, a function of VGAM1085 gene, herein designated VGAM is inhibition of expression of VGAM1085 target genes. It is appreciated that specific functions, and accordingly utilities, of VGAM1085 correlate with, and may be deduced from, the identity of the target genes which VGAM1085 binds and inhibits, and the function of these target genes, as elaborated hereinbelow.

HCS (Accession NM_018947) is a VGAM1085 host target gene. HCS BINDING SITE is HOST TARGET binding site found in the 3' untranslated region of mRNA encoded by HCS, corresponding to a HOST TARGET binding site such as BINDING SITE I, BINDING SITE II or BINDING SITE III. Table 2 illustrates the complementarity of the nucleotide sequences of HCS BINDING SITE, designated SEQ ID:21015, to the nucleotide sequence of VGAM1085 RNA, herein designated VGAM RNA, also designated SEQ ID:3796.

A function of VGAM1085 is therefore inhibition of HCS (Accession NM_018947). Accordingly, utilities of VGAM1085 include diagnosis, prevention and treatment of diseases and clinical conditions associated with HCS. FLJ11164 (Accession NM_018346) is another VGAM1085 host target gene. FLJ11164 BINDING SITE is HOST TARGET binding site found in the 3' untranslated region of mRNA encoded by FLJ11164, corresponding to a HOST TARGET binding site such as BINDING SITE I, BINDING SITE II or BINDING SITE III. Table 2 illustrates the complementarity of the nucleotide sequences of FLJ11164 BINDING SITE, designated SEQ ID:20356, to the nucleotide sequence of VGAM1085 RNA, herein designated VGAM RNA, also designated SEQ ID:3796.

Another function of VGAM1085 is therefore inhibition of FLJ11164 (Accession NM_018346). Accordingly, utilities of VGAM1085 include diagnosis, prevention and treatment of diseases and clinical conditions associated with FLJ11164. Mitogen-activated Protein Kinase-activated Protein Kinase 3 (MAPKAPK3, Accession NM_004635) is another VGAM1085 host target gene. MAPKAPK3 BINDING SITE is HOST TARGET binding site found in the 3' untranslated region of mRNA encoded by MAPKAPK3, corresponding to a HOST TARGET binding site such as BINDING SITE I, BINDING SITE II or BINDING SITE III. Table 2 illustrates the complementarity of the nucleotide sequences of MAPKAPK3 BINDING SITE, designated SEQ ID:11011, to the nucleotide sequence of VGAM1085 RNA, herein designated VGAM RNA, also designated SEQ ID:3796.

Another function of VGAM1085 is therefore inhibition of Mitogen-activated Protein Kinase-activated Protein Kinase 3 (MAPKAPK3, Accession NM_004635). Accordingly, utilities of VGAM1085 include diagnosis, prevention and treatment of diseases and clinical conditions associated with MAPKAPK3. SE57-1 (Accession NM_025214) is another VGAM1085 host target gene. SE57-1 BINDING SITE is HOST TARGET binding site found in the 3' untranslated region of mRNA encoded by SE57-1, corresponding to a HOST TARGET binding site such as BINDING SITE I, BINDING SITE II or BINDING SITE III. Table 2 illustrates the complementarity of the nucleotide sequences of SE57-1 BINDING SITE, designated SEQ ID:24892, to the nucleotide sequence of VGAM1085 RNA, herein designated VGAM RNA, also designated SEQ ID:3796.

Another function of VGAM1085 is therefore inhibition of SE57-1 (Accession NM_025214). Accordingly, utilities of VGAM1085 include diagnosis, prevention and treatment of diseases and clinical conditions associated with SE57-1. LOC143920 (Accession XM_084658) is another VGAM1085 host target gene. LOC143920 BINDING SITE is HOST TARGET binding site found in the 5' untranslated region of mRNA encoded by LOC143920, corresponding to a HOST TARGET binding site such as BINDING SITE I, BINDING SITE II or BINDING SITE III. Table 2 illustrates the complementarity of the nucleotide sequences of LOC143920 BINDING SITE, designated SEQ ID:37638, to the nucleotide sequence of VGAM1085 RNA, herein designated VGAM RNA, also designated SEQ ID:3796.

Another function of VGAM1085 is therefore inhibition of LOC143920 (Accession XM_084658). Accordingly, utilities of VGAM1085 include diagnosis, prevention and treatment of diseases and clinical conditions associated with LOC143920. LOC157317 (Accession XM_088293) is another VGAM1085 host target gene. LOC157317 BINDING SITE is HOST TARGET binding site found in the 3' untranslated region of mRNA encoded by LOC157317, corresponding to a HOST TARGET binding site such as BINDING SITE I, BINDING SITE II or BINDING SITE III. Table 2 illustrates the complementarity of the nucleotide sequences of LOC157317 BINDING SITE, designated SEQ ID:39585, to the nucleotide sequence of VGAM1085 RNA, herein designated VGAM RNA, also designated SEQ ID:3796.

Another function of VGAM1085 is therefore inhibition of LOC157317 (Accession XM_088293). Accordingly, utilities of VGAM1085 include diagnosis, prevention and treatment of diseases and clinical conditions associated with LOC157317. LOC203429 (Accession XM_114701) is another VGAM1085 host target gene. LOC203429 BINDING SITE1 and LOC203429 BINDING SITE2 are HOST TARGET binding sites found in untranslated regions of mRNA encoded by LOC203429, corresponding to HOST TARGET binding sites such as BINDING SITE I, BINDING SITE II or BINDING SITE III. Table 2 illustrates the complementarity of the nucleotide sequences of LOC203429 BINDING SITE1 and LOC203429 BINDING SITE2, designated SEQ ID:43049 and SEQ ID:43050 respectively, to the nucleotide sequence of VGAM1085 RNA, herein designated VGAM RNA, also designated SEQ ID:3796.

Another function of VGAM1085 is therefore inhibition of LOC203429 (Accession XM_114701). Accordingly, utilities of VGAM1085 include diagnosis, prevention and treatment of diseases and clinical conditions associated with LOC203429. CBCIP2 (Accession NM_032831) is another VGAM1086 host target gene. CBCIP2 BINDING SITE is HOST TARGET binding site found in the 3' untranslated region of mRNA encoded by CBCIP2, corresponding to a HOST TARGET binding site such as BINDING SITE I, BINDING SITE II or BINDING SITE III. Table 2 illustrates the complementarity of the nucleotide sequences of CBCIP2 BINDING SITE, designated SEQ ID:26606, to the nucleotide sequence of VGAM1086 RNA, herein designated VGAM RNA, also designated SEQ ID:3797.

Another function of VGAM1086 is therefore inhibition of CBCIP2 (Accession NM_032831). Accordingly, utilities of VGAM1086 include diagnosis, prevention and treatment of diseases and clinical conditions associated with CBCIP2. Cyclin M1 (CNNM1, Accession NM_020348) is another VGAM1086 host target gene. CNNM1 BINDING SITE is HOST TARGET binding site found in the 3' untranslated region of mRNA encoded by CNNM1, corresponding to a HOST TARGET binding site such as BINDING SITE I, BINDING SITE II or BINDING SITE III. Table 2 illustrates the complementarity of the nucleotide sequences of CNNM1 BINDING SITE, designated SEQ ID:21604, to the nucleotide sequence of VGAM1086 RNA, herein designated VGAM RNA, also designated SEQ ID:3797.

Another function of VGAM1086 is therefore inhibition of Cyclin M1 (CNNM1, Accession NM_020348). Accordingly, utilities of VGAM1086 include diagnosis, prevention and treatment of diseases and clinical conditions associated with CNNM1. FLJ00024 (Accession XM_033361) is another VGAM1086 host target gene. FLJ00024 BINDING SITE is HOST TARGET binding site found in the 3' untranslated region of mRNA encoded by FLJ00024, corresponding to a HOST TARGET binding site such as BINDING SITE I, BINDING SITE II or BINDING SITE III. Table 2 illustrates the complementarity of the nucleotide sequences of FLJ00024 BINDING SITE, designated SEQ ID:31897, to the nucleotide sequence of VGAM1086 RNA, herein designated VGAM RNA, also designated SEQ ID:3797.

Another function of VGAM1086 is therefore inhibition of FLJ00024 (Accession XM_033361). Accordingly, utilities of VGAM1086 include diagnosis, prevention and treatment of diseases and clinical conditions associated with FLJ00024. FLJ13984 (Accession NM_024770) is another VGAM1086 host target gene. FLJ13984 BINDING SITE is HOST TARGET binding site found in the 3' untranslated region of mRNA encoded by FLJ13984, corresponding to a HOST TARGET binding site such as BINDING SITE I, BINDING SITE II or BINDING SITE III. Table 2 illustrates the complementarity of the nucleotide sequences of FLJ13984 BINDING SITE, designated SEQ ID:24130, to the nucleotide sequence of VGAM1086 RNA, herein designated VGAM RNA, also designated SEQ ID:3797.

Another function of VGAM1086 is therefore inhibition of FLJ13984 (Accession NM_024770). Accordingly, utilities of VGAM1086 include diagnosis, prevention and treatment of diseases and clinical conditions associated with FLJ13984. LOC196485 (Accession XM_113731) is another VGAM1086 host target gene. LOC196485 BINDING SITE is HOST TARGET binding site found in the 3' untranslated region of mRNA encoded by LOC196485, corresponding to a HOST TARGET binding site such as BINDING SITE I, BINDING SITE II or BINDING SITE III. Table 2 illustrates the complementarity of the nucleotide sequences of LOC196485 BINDING SITE, designated SEQ ID:42382, to the nucleotide sequence of VGAM1086 RNA, herein designated VGAM RNA, also designated SEQ ID:3797.

Another function of VGAM1086 is therefore inhibition of LOC196485 (Accession XM_113731). Accordingly, utilities of VGAM1086 include diagnosis, prevention and treatment of diseases and clinical conditions associated with LOC196485. LOC202986 (Accession XM_117489) is another VGAM1086 host target gene. LOC202986 BINDING SITE is HOST TARGET binding site found in the 3' untranslated region of mRNA encoded by LOC202986, corresponding to a HOST TARGET binding site such as BINDING SITE I, BINDING SITE II or BINDING SITE III. Table 2 illustrates the complementarity of the nucleotide sequences of LOC202986 BINDING SITE, designated SEQ ID:43473, to the nucleotide sequence of VGAM1086 RNA, herein designated VGAM RNA, also designated SEQ ID:3797.

Another function of VGAM1086 is therefore inhibition of LOC202986 (Accession XM_117489). Accordingly, utilities of VGAM1086 include diagnosis, prevention and treatment of diseases and clinical conditions associated with LOC202986. LOC221354 (Accession XM_166468) is another VGAM1086 host target gene. LOC221354 BINDING SITE is HOST TARGET binding site found in the 3' untranslated region of mRNA encoded by LOC221354, corresponding to a HOST TARGET binding site such as BINDING SITE I, BINDING SITE II or BINDING SITE III. Table 2 illustrates the complementarity of the nucleotide sequences of LOC221354 BINDING SITE, designated SEQ ID:44393, to the nucleotide sequence of VGAM1086 RNA, herein designated VGAM RNA, also designated SEQ ID:3797.

Another function of VGAM1086 is therefore inhibition of LOC221354 (Accession XM_166468). Accordingly, utilities of VGAM1086 include diagnosis, prevention and treatment of diseases and clinical conditions associated with LOC221354. LOC90333 (Accession XM_030958) is another VGAM1086 host target gene. LOC90333 BINDING SITE is HOST TARGET binding site found in the 3' untranslated region of mRNA encoded by LOC90333, corresponding to a HOST TARGET binding site such as BINDING SITE I, BINDING SITE II or BINDING SITE III. Table 2 illustrates the complementarity of the nucleotide sequences of LOC90333 BINDING SITE, designated SEQ ID:31219, to the nucleotide sequence of VGAM1086 RNA, herein designated VGAM RNA, also designated SEQ ID:3797.

Another function of VGAM1086 is therefore inhibition of LOC90333 (Accession XM_030958). Accordingly, utilities of VGAM1086 include diagnosis, prevention and treatment of diseases and clinical conditions associated with LOC90333. FIG. 1 further provides a conceptual description of a novel bioinformatically detected viral gene of the present invention, referred to here as Viral Genomic Address Messenger 1087 (VGAM1087) viral gene, which modulates expression of respective host target genes thereof, the function and utility of which host target genes is known in the art.

VGAM1087 is a novel bioinformatically detected regulatory, non protein coding, viral micro RNA (miRNA) gene. The method by which VGAM1087 was detected is described hereinabove with reference to FIGS. 1-8.

VGAM1087 gene, herein designated VGAM GENE, is a viral gene contained in the genome of Porcine Epidemic Diarrhea Virus. VGAM1087 host target gene, herein designated VGAM HOST TARGET GENE, is a human gene contained in the human genome.

VGAM1087 gene encodes a VGAM1087 precursor RNA, herein designated VGAM PRECURSOR RNA. Similar to other miRNA genes, and unlike most ordinary genes, VGAM1087 precursor RNA does not encode a protein. A nucleotide sequence identical or highly similar to the nucleotide sequence of VGAM1087 precursor RNA is designated SEQ ID:1073, and is provided hereinbelow with reference to the sequence listing part. Nucleotide sequence SEQ ID:1073 is located at position 5802 relative to the genome of Porcine Epidemic Diarrhea Virus.

VGAM1087 precursor RNA folds onto itself, forming VGAM1087 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1087 folded precursor RNA into VGAM1087 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1087 RNA is designated SEQ ID:3798, and is provided hereinbelow with reference to the sequence listing part.

VGAM1087 host target gene, herein designated VGAM HOST TARGET GENE, encodes a corresponding messenger RNA, VGAM1087 host target RNA, herein designated VGAM HOST TARGET RNA. VGAM1087 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1087 RNA, herein designated VGAM RNA, binds complementarily to one or more host target binding sites located in untranslated regions of VGAM1087 host target RNA, herein designated VGAM HOST TARGET RNA. This complementary binding is due to the fact that the nucleotide sequence of VGAM1087 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1087 RNA, herein designated VGAM RNA, may have a different number of host target binding sites in untranslated regions of a VGAM1087 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1087 RNA, herein designated VGAM RNA, to host target binding sites on VGAM1087 host target RNA, herein designated VGAM HOST TARGET RNA, such as BINDING SITE I, BINDING SITE II and BINDING SITE III, inhibits translation of VGAM1087 host target RNA into VGAM1087 host target protein, herein designated VGAM HOST TARGET PROTEIN. VGAM host target protein is therefore outlined by a broken line.

It is appreciated that VGAM1087 host target gene, herein designated VGAM HOST TARGET GENE, in fact represents a plurality of VGAM1087 host target genes. The mRNA of each one of this plurality of VGAM1087 host target genes comprises one or more host target binding sites, each having a nucleotide sequence which is at least partly complementary to VGAM1087 RNA, herein designated VGAM RNA, and which when bound by VGAM1087 RNA causes inhibition of translation of respective one or more VGAM1087 host target proteins.

It is further appreciated by one skilled in the art that the mode of translational inhibition illustrated by FIG. 1 with specific reference to translational inhibition exerted by VGAM1087 gene, herein designated VGAM GENE, on one or more VGAM1087 host target gene, herein designated or more VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1087 is inhibition of expression of host target genes, as part of a novel viral mechanism of attacking a host. Accordingly, utilities of VGAM1087 include diagnosis, prevention and treatment of viral infection by Porcine Epidemic Diarrhea Virus. Specific functions, and accordingly utilities, of VGAM1087 correlate with, and may be deduced from, the identity of the host target genes which VGAM1087 binds and inhibits, and the function of these host target genes, as elaborated hereinbelow.

Nucleotide sequences of the VGAM1087 precursor RNA, herein designated VGAM PRECURSOR RNA, and of the 'diced' VGAM1087 RNA, herein designated VGAM RNA, and a schematic representation of the secondary folding of VGAM1087 folded precursor RNA, herein designated VGAM FOLDED PRECURSOR RNA, of VGAM1087 are further described hereinbelow with reference to Table 1.

Nucleotide sequences of host target binding sites, such as BINDING SITE-I, BINDING SITE-II and BINDING SITE-III of FIG. 1, found on VGAM1087 host target RNA, and schematic representation of the complementarity of each of these host target binding sites to VGAM1087 RNA, herein designated VGAM RNA, are described hereinbelow with reference to Table 2.

As mentioned hereinabove with reference to FIG. 1, a function of VGAM1087 gene, herein designated VGAM is inhibition of expression of VGAM1087 target genes. It is appreciated that specific functions, and accordingly utilities, of VGAM1087 correlate with, and may be deduced from, the identity of the target genes which VGAM1087 binds and inhibits, and the function of these target genes, as elaborated hereinbelow.

PAG (Accession NM_018440) is a VGAM1087 host target gene. PAG BINDING SITE is HOST TARGET binding site found in the 3' untranslated region of mRNA encoded by PAG, corresponding to a HOST TARGET binding site such as BINDING SITE I, BINDING SITE II or BINDING SITE III. Table 2 illustrates the complementarity of the nucleotide sequences of PAG BINDING SITE, designated SEQ ID:20509, to the nucleotide sequence of VGAM1087 RNA, herein designated VGAM RNA, also designated SEQ ID:3798.

A function of VGAM1087 is therefore inhibition of PAG (Accession NM_018440). Accordingly, utilities of VGAM1087 include diagnosis, prevention and treatment of diseases and clinical conditions associated with PAG. Phosphoprotein Enriched In Astrocytes 15 (PEA15, Accession NM_003768) is another VGAM1087 host target gene. PEA15 BINDING SITE is HOST TARGET binding site found in the 3' untranslated region of mRNA encoded by PEA15, corresponding to a HOST TARGET binding site such as BINDING SITE I, BINDING SITE II or BINDING SITE III. Table 2 illustrates the complementarity of the nucleotide sequences of PEA15 BINDING SITE, designated SEQ ID:9848, to the nucleotide sequence of VGAM1087 RNA, herein designated VGAM RNA, also designated SEQ ID:3798.

Another function of VGAM1087 is therefore inhibition of Phosphoprotein Enriched In Astrocytes 15 (PEA15, Accession NM_003768), a gene which is a phosphoprotein and involved in glucose uptake. Accordingly, utilities of VGAM1087 include diagnosis, prevention and treatment of diseases and clinical conditions associated with PEA15. The function of PEA15 and its association with various diseases and clinical conditions, has been established by previous studies, as described hereinabove with reference to VGAM949. Xeroderma Pigmentosum, Complementation Group C (XPC, Accession NM_004628) is another VGAM1087 host target gene. XPC BINDING SITE is HOST TARGET binding site found in the 3' untranslated region of mRNA encoded by XPC, corresponding to a HOST TARGET binding site such as BINDING SITE I, BINDING SITE II or BINDING SITE III. Table 2 illustrates the complementarity of the nucleotide sequences of XPC BINDING SITE, designated SEQ ID:10999, to the nucleotide sequence of VGAM1087 RNA, herein designated VGAM RNA, also designated SEQ ID:3798.

Another function of VGAM1087 is therefore inhibition of Xeroderma Pigmentosum, Complementation Group C (XPC, Accession NM_004628). Accordingly, utilities of VGAM1087 include diagnosis, prevention and treatment of diseases and clinical conditions associated with XPC. Bromodomain Containing 3 (BRD3, Accession NM_007371) is another VGAM1087 host target gene. BRD3 BINDING SITE is HOST TARGET binding site found in the 3' untranslated region of mRNA encoded by BRD3, corresponding to a HOST TARGET binding site such as BINDING SITE I, BINDING SITE II or BINDING SITE III. Table 2 illustrates the complementarity of the nucleotide sequences of BRD3 BINDING SITE, designated SEQ ID:14297, to the nucleotide sequence of VGAM1087 RNA, herein designated VGAM RNA, also designated SEQ ID:3798.

Another function of VGAM1087 is therefore inhibition of Bromodomain Containing 3 (BRD3, Accession NM_007371). Accordingly, utilities of VGAM1087 include diagnosis, prevention and treatment of diseases and clinical conditions associated with BRD3. Chromosome 21 Open Reading Frame 108 (C21orf108, Accession XM_114191) is another VGAM1087 host target gene. C21orf108 BINDING SITE is HOST TARGET binding site found in the 3' untranslated region of mRNA encoded by C21orf108, corresponding to a HOST TARGET binding site such as BINDING SITE I, BINDING SITE II or BINDING SITE III. Table 2 illustrates the complementarity of the nucleotide sequences of C21orf108 BINDING SITE, designated SEQ ID:42766, to the nucleotide sequence of VGAM1087 RNA, herein designated VGAM RNA, also designated SEQ ID:3798.

Another function of VGAM1087 is therefore inhibition of Chromosome 21 Open Reading Frame 108 (C21orf108, Accession XM_114191). Accordingly, utilities of VGAM1087 include diagnosis, prevention and treatment of diseases and clinical conditions associated with C21orf108. FLJ22965 (Accession NM_022101) is another VGAM1087 host target gene. FLJ22965 BINDING SITE is HOST TARGET binding site found in the 3' untranslated region of mRNA encoded by FLJ22965, corresponding to a HOST TARGET binding site such as BINDING SITE I, BINDING SITE II or BINDING SITE III. Table 2 illustrates the complementarity of the nucleotide sequences of FLJ22965 BINDING SITE, designated SEQ ID:22644, to the nucleotide sequence of VGAM1087 RNA, herein designated VGAM RNA, also designated SEQ ID:3798.

Another function of VGAM1087 is therefore inhibition of FLJ22965 (Accession NM_022101). Accordingly, utilities of VGAM1087 include diagnosis, prevention and treatment of diseases and clinical conditions associated with FLJ22965. KIAA0895 (Accession XM_166573) is another VGAM1087 host target gene. KIAA0895 BINDING SITE is HOST TARGET binding site found in the 3' untranslated region of mRNA encoded by KIAA0895, corresponding to a HOST TARGET binding site such as BINDING SITE I, BINDING SITE II or BINDING SITE III. Table 2 illustrates the complementarity of the nucleotide sequences of KIAA0895 BINDING SITE, designated SEQ ID:44546, to the nucleotide sequence of VGAM1087 RNA, herein designated VGAM RNA, also designated SEQ ID:3798.

Another function of VGAM1087 is therefore inhibition of KIAA0895 (Accession XM_166573). Accordingly, utilities of VGAM1087 include diagnosis, prevention and treatment of diseases and clinical conditions associated with KIAA0895. KIAA1305 (Accession NM_025081) is another VGAM1087 host target gene. KIAA1305 BINDING SITE is HOST TARGET binding site found in the 5' untranslated region of mRNA encoded by KIAA1305, corresponding to a HOST TARGET binding site such as BINDING SITE I, BINDING SITE II or BINDING SITE III. Table 2 illustrates the complementarity of the nucleotide sequences of KIAA1305 BINDING SITE, designated SEQ ID:24681, to the nucleotide sequence of VGAM1087 RNA, herein designated VGAM RNA, also designated SEQ ID:3798.

Another function of VGAM1087 is therefore inhibition of KIAA1305 (Accession NM_025081). Accordingly, utilities of VGAM1087 include diagnosis, prevention and treatment of diseases and clinical conditions associated with KIAA1305. MGC4737 (Accession NM_031466) is another VGAM1087 host target gene. MGC4737 BINDING SITE is HOST TARGET binding site found in the 3' untranslated region of mRNA encoded by MGC4737, corresponding to a HOST TARGET binding site such as BINDING SITE I, BINDING SITE II or BINDING SITE III. Table 2 illustrates the complementarity of the nucleotide sequences of MGC4737 BINDING SITE, designated SEQ ID:25505, to the nucleotide sequence of VGAM1087 RNA, herein designated VGAM RNA, also designated SEQ ID:3798.

Another function of VGAM1087 is therefore inhibition of MGC4737 (Accession NM_031466). Accordingly, utilities of VGAM1087 include diagnosis, prevention and treatment of diseases and clinical conditions associated with MGC4737. LOC163812 (Accession XM_089158) is another VGAM1087 host target gene. LOC163812 BINDING SITE is HOST TARGET binding site found in the 5' untranslated region of mRNA encoded by LOC163812, corresponding to a HOST TARGET binding site such as BINDING SITE I, BINDING SITE II or BINDING SITE III. Table 2 illustrates the complementarity of the nucleotide sequences of LOC163812 BINDING SITE, designated SEQ ID:39967, to the nucleotide sequence of VGAM1087 RNA, herein designated VGAM RNA, also designated SEQ ID:3798.

Another function of VGAM1087 is therefore inhibition of LOC163812 (Accession XM_089158). Accordingly, utilities of VGAM1087 include diagnosis, prevention and treatment of diseases and clinical conditions associated with LOC163812. FIG. 1 further provides a conceptual description of a novel bioinformatically detected viral gene of the present invention, referred to here as Viral Genomic Address Messenger 1088 (VGAM1088) viral gene, which modulates expression of respective host target genes thereof, the function and utility of which host target genes is known in the art.

VGAM1088 is a novel bioinformatically detected regulatory, non protein coding, viral micro RNA (miRNA) gene. The method by which VGAM1088 was detected is described hereinabove with reference to FIGS. 1-8.

VGAM1088 gene, herein designated VGAM GENE, is a viral gene contained in the genome of Porcine Epidemic Diarrhea Virus. VGAM1088 host target gene, herein designated VGAM HOST TARGET GENE, is a human gene contained in the human genome.

VGAM1088 gene encodes a VGAM1088 precursor RNA, herein designated VGAM PRECURSOR RNA. Similar to other miRNA genes, and unlike most ordinary genes, VGAM1088 precursor RNA does not encode a protein. A nucleotide sequence identical or highly similar to the nucleotide sequence of VGAM1088 precursor RNA is designated SEQ ID:1074, and is provided hereinbelow with reference to the sequence listing part. Nucleotide sequence SEQ ID:1074 is located at position 1913 relative to the genome of Porcine Epidemic Diarrhea Virus.

VGAM1088 precursor RNA folds onto itself, forming VGAM1088 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1088 folded precursor RNA into VGAM1088 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1088 RNA is designated SEQ ID:3799, and is provided hereinbelow with reference to the sequence listing part.

VGAM1088 host target gene, herein designated VGAM HOST TARGET GENE, encodes a corresponding messenger RNA, VGAM1088 host target RNA, herein designated VGAM HOST TARGET RNA. VGAM1088 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1088 RNA, herein designated VGAM RNA, binds complementarily to one or more host target binding sites located in untranslated regions of VGAM1088 host target RNA, herein designated VGAM HOST TARGET RNA. This complementary binding is due to the fact that the nucleotide sequence of VGAM1088 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1088 RNA, herein designated VGAM RNA, may have a different number of host target binding sites in untranslated regions of a VGAM1088 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1088 RNA, herein designated VGAM RNA, to host target binding sites on VGAM1088 host target RNA, herein designated VGAM HOST TARGET RNA, such as BINDING SITE I, BINDING SITE II and BINDING SITE III, inhibits translation of VGAM1088 host target RNA into VGAM1088 host target protein, herein designated VGAM HOST TARGET PROTEIN. VGAM host target protein is therefore outlined by a broken line.

It is appreciated that VGAM1088 host target gene, herein designated VGAM HOST TARGET GENE, in fact represents a plurality of VGAM1088 host target genes. The mRNA of each one of this plurality of VGAM1088 host target genes comprises one or more host target binding sites, each having a nucleotide sequence which is at least partly complementary to VGAM1088 RNA, herein designated VGAM RNA, and which when bound by VGAM1088 RNA causes inhibition of translation of respective one or more VGAM1088 host target proteins.

It is further appreciated by one skilled in the art that the mode of translational inhibition illustrated by FIG. 1 with specific reference to translational inhibition exerted by VGAM1088 gene, herein designated VGAM GENE, on one or more VGAM1088 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1088 is inhibition of expression of host target genes, as part of a novel viral mechanism of attacking a host. Accordingly, utilities of VGAM1088 include diagnosis, prevention and treatment of viral infection by Porcine Epidemic Diarrhea Virus. Specific functions, and accordingly utilities, of VGAM1088 correlate with, and may be deduced from, the identity of the host target genes which VGAM1088 binds and inhibits, and the function of these host target genes, as elaborated hereinbelow.

Nucleotide sequences of the VGAM1088 precursor RNA, herein designated VGAM PRECURSOR RNA, and of the 'diced' VGAM1088 RNA, herein designated VGAM RNA, and a schematic representation of the secondary folding of VGAM1088 folded precursor RNA, herein designated VGAM FOLDED PRECURSOR RNA, of VGAM1088 are further described hereinbelow with reference to Table 1.

Nucleotide sequences of host target binding sites, such as BINDING SITE-I, BINDING SITE-II and BINDING SITE-III of FIG. 1, found on VGAM1088 host target RNA, and schematic representation of the complementarity of each of these host target binding sites to VGAM1088 RNA, herein designated VGAM RNA, are described hereinbelow with reference to Table 2.

As mentioned hereinabove with reference to FIG. 1, a function of VGAM1088 gene, herein designated VGAM is inhibition of expression of VGAM1088 target genes. It is appreciated that specific functions, and accordingly utilities, of VGAM1088 correlate with, and may be deduced from, the identity of the target genes which VGAM1088 binds and inhibits, and the function of these target genes, as elaborated hereinbelow.

Cytotoxic T-lymphocyte-associated Protein 4 (CTLA4, Accession NM_005214) is a VGAM1088 host target gene. CTLA4 BINDING SITE is HOST TARGET binding site found in the 3' untranslated region of mRNA encoded by CTLA4, corresponding to a HOST TARGET binding site such as BINDING SITE I, BINDING SITE II or BINDING SITE III. Table 2 illustrates the complementarity of the nucleotide sequences of CTLA4 BINDING SITE, designated SEQ ID:11711, to the nucleotide sequence of VGAM1088 RNA, herein designated VGAM RNA, also designated SEQ ID:3799.

A function of VGAM1088 is therefore inhibition of Cytotoxic T-lymphocyte-associated Protein 4 (CTLA4, Accession NM_005214). Accordingly, utilities of VGAM1088 include diagnosis, prevention and treatment of diseases and clinical conditions associated with CTLA4. Neuronal Cell Adhesion Molecule (NRCAM, Accession NM_005010) is another VGAM1088 host target gene. NRCAM BINDING SITE is HOST TARGET binding site found in the 3' untranslated region of mRNA encoded by NRCAM, corresponding to a HOST TARGET binding site such as BINDING SITE I, BINDING SITE II or BINDING SITE III. Table 2 illustrates the complementarity of the nucleotide sequences of NRCAM BINDING SITE, designated SEQ ID:11448, to the nucleotide sequence of VGAM1088 RNA, herein designated VGAM RNA, also designated SEQ ID:3799.

Another function of VGAM1088 is therefore inhibition of Neuronal Cell Adhesion Molecule (NRCAM, Accession NM_005010), a gene which functions as a cell surface protein and belongs to the immunoglobulin superfamily. Accordingly, utilities of VGAM1088 include diagnosis, prevention and treatment of diseases and clinical conditions associated with NRCAM. The function of NRCAM and its association with various diseases and clinical conditions, has been established by previous studies, as described hereinabove with reference to VGAM268. FLJ21432 (Accession NM_024551) is another VGAM1088 host target gene. FLJ21432 BINDING SITE is HOST TARGET binding site found in the 3' untranslated region of mRNA encoded by FLJ21432, corresponding to a HOST TARGET binding site such as BINDING SITE I, BINDING SITE II or BINDING SITE III. Table 2 illustrates the complementarity of the nucleotide sequences of FLJ21432 BINDING SITE, designated SEQ ID:23766, to the nucleotide sequence of VGAM1088 RNA, herein designated VGAM RNA, also designated SEQ ID:3799.

Another function of VGAM1088 is therefore inhibition of FLJ21432 (Accession NM_024551). Accordingly, utilities of VGAM1088 include diagnosis, prevention and treatment of diseases and clinical conditions associated with FLJ21432. PP1628 (Accession NM_025201) is another VGAM1088 host target gene. PP1628 BINDING SITE is HOST TARGET binding site found in the 5' untranslated region of mRNA encoded by PP1628, corresponding to a HOST TARGET binding site such as BINDING SITE I, BINDING SITE II or BINDING SITE III. Table 2 illustrates the complementarity of the nucleotide sequences of PP1628 BINDING SITE, designated SEQ ID:24857, to the nucleotide sequence of VGAM1088 RNA, herein designated VGAM RNA, also designated SEQ ID:3799.

Another function of VGAM1088 is therefore inhibition of PP1628 (Accession NM_025201). Accordingly, utilities of VGAM1088 include diagnosis, prevention and treatment of diseases and clinical conditions associated with PP1628. LOC159199 (Accession XM_089441) is another VGAM1088 host target gene. LOC159199 BINDING SITE is HOST TARGET binding site found in the 5' untranslated region of mRNA encoded by LOC159199, corresponding to a HOST TARGET binding site such as BINDING SITE I, BINDING SITE II or BINDING SITE III. Table 2 illustrates the complementarity of the nucleotide sequences of LOC159199 BINDING SITE, designated SEQ ID:39979, to the nucleotide sequence of VGAM1088 RNA, herein designated VGAM RNA, also designated SEQ ID:3799.

Another function of VGAM1088 is therefore inhibition of LOC159199 (Accession XM_089441). Accordingly, utilities of VGAM1088 include diagnosis, prevention and treatment of diseases and clinical conditions associated with LOC159199. FIG. 1 further provides a conceptual description of a novel bioinformatically detected viral gene of the present invention, referred to here as Viral Genomic Address Messenger 1089 (VGAM1089) viral gene, which modulates expression of respective host target genes thereof, the function and utility of which host target genes is known in the art.

VGAM1089 is a novel bioinformatically detected regulatory, non protein coding, viral micro RNA (miRNA) gene. The method by which VGAM1089 was detected is described hereinabove with reference to FIGS. 1-8.

VGAM1089 gene, herein designated VGAM GENE, is a viral gene contained in the genome of Porcine Epidemic Diarrhea Virus. VGAM1089 host target gene, herein designated VGAM HOST TARGET GENE, is a human gene contained in the human genome.

VGAM1089 gene encodes a VGAM1089 precursor RNA, herein designated VGAM PRECURSOR RNA. Similar to other miRNA genes, and unlike most ordinary genes, VGAM1089 precursor RNA does not encode a protein. A nucleotide sequence identical or highly similar to the nucleotide sequence of VGAM1089 precursor RNA is designated SEQ ID:1075, and is provided hereinbelow with reference to the sequence listing part. Nucleotide sequence SEQ ID:1075 is located at position 3305 relative to the genome of Porcine Epidemic Diarrhea Virus.

VGAM1089 precursor RNA folds onto itself, forming VGAM1089 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1089 folded precursor RNA into VGAM1089 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM1089 RNA is designated SEQ ID:3800, and is provided hereinbelow with reference to the sequence listing part.

VGAM1089 host target gene, herein designated VGAM HOST TARGET GENE, encodes a corresponding messenger RNA, VGAM1089 host target RNA, herein designated VGAM HOST TARGET RNA. VGAM1089 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1089 RNA, herein designated VGAM RNA, binds complementarily to one or more host target binding sites located in untranslated regions of VGAM1089 host target RNA, herein designated VGAM HOST TARGET RNA. This complementary binding is due to the fact that the nucleotide sequence of VGAM1089 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1089 RNA, herein designated VGAM RNA, may have a different number of host target binding sites in untranslated regions of a VGAM1089 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1089 RNA, herein designated VGAM RNA, to host target binding sites on VGAM1089 host target RNA, herein designated VGAM HOST TARGET RNA, such as BINDING SITE I, BINDING SITE II and BINDING SITE III, inhibits translation of VGAM1089 host target RNA into VGAM1089 host target protein, herein designated VGAM HOST TARGET PROTEIN. VGAM host target protein is therefore outlined by a broken line.

It is appreciated that VGAM1089 host target gene, herein designated VGAM HOST TARGET GENE, in fact represents a plurality of VGAM1089 host target genes. The mRNA of each one of this plurality of VGAM1089 host target genes comprises one or more host target binding sites, each having a nucleotide sequence which is at least partly complementary to VGAM1089 RNA, herein designated VGAM RNA, and which when bound by VGAM1089 RNA causes inhibition of translation of respective one or more VGAM1089 host target proteins.

It is further appreciated by one skilled in the art that the mode of translational inhibition illustrated by FIG. 1 with specific reference to translational inhibition exerted by VGAM1089 gene, herein designated VGAM GENE, on one or more VGAM1089 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1089 is inhibition of expression of host target genes, as part of a novel viral mechanism of attacking a host. Accordingly, utilities of VGAM1089 include diagnosis, prevention and treatment of viral infection by Porcine Epidemic Diarrhea Virus. Specific functions, and accordingly utilities, of VGAM1089 correlate with, and may be deduced from, the identity of the host target genes which VGAM1089 binds and inhibits, and the function of these host target genes, as elaborated hereinbelow.

Nucleotide sequences of the VGAM1089 precursor RNA, herein designated VGAM PRECURSOR RNA, and of the 'diced' VGAM1089 RNA, herein designated VGAM RNA, and a schematic representation of the secondary folding of VGAM1089 folded precursor RNA, herein designated VGAM FOLDED PRECURSOR RNA, of VGAM1089 are further described hereinbelow with reference to Table 1.

Nucleotide sequences of host target binding sites, such as BINDING SITE-I, BINDING SITE-II and BINDING SITE-III of FIG. 1, found on VGAM1089 host target RNA, and schematic representation of the complementarity of each of these host target binding sites to VGAM1089 RNA, herein designated VGAM RNA, are described hereinbelow with reference to Table 2.

As mentioned hereinabove with reference to FIG. 1, a function of VGAM1089 gene, herein designated VGAM is inhibition of expression of VGAM1089 target genes. It is appreciated that specific functions, and accordingly utilities, of VGAM1089 correlate with, and may be deduced from, the identity of the target genes which VGAM1089 binds and inhibits, and the function of these target genes, as elaborated hereinbelow.

Hyaluronan Synthase 3 (HAS3, Accession NM_005329) is a VGAM1089 host target gene. HAS3 BINDING SITE is HOST TARGET binding site found in the 3' untranslated region of mRNA encoded by HAS3, corresponding to a HOST TARGET binding site such as BINDING SITE I, BINDING SITE II or BINDING SITE III. Table 2 illustrates the complementarity of the nucleotide sequences of HAS3 BINDING SITE, designated SEQ ID:11802, to the nucleotide sequence of VGAM1089 RNA, herein designated VGAM RNA, also designated SEQ ID:3800.

A function of VGAM1089 is therefore inhibition of Hyaluronan Synthase 3 (HAS3, Accession NM_005329), a gene which plays a role in hyaluronan/hyaluronic acid (ha) synthesis. Accordingly, utilities of VGAM1089 include diagnosis, prevention and treatment of diseases and clinical conditions associated with HAS3. The function of HAS3 and its association with various diseases and clinical conditions, has been established by previous studies, as described hereinabove with reference to VGAM498. Chromosome 21 Open Reading Frame 25 (C21orf25, Accession XM_032945) is another VGAM1089 host target gene. C21orf25 BINDING SITE is HOST TARGET binding site found in the 3' untranslated region of mRNA encoded by C21orf25, corresponding to a HOST TARGET binding site such as BINDING SITE I, BINDING SITE II or BINDING SITE III. Table 2 illustrates the complementarity of the nucleotide sequences of C21orf25 BINDING SITE, designated SEQ ID:31796, to the nucleotide sequence of VGAM1089 RNA, herein designated VGAM RNA, also designated SEQ ID:3800.

Another function of VGAM1089 is therefore inhibition of Chromosome 21 Open Reading Frame 25 (C21orf25, Accession XM_032945). Accordingly, utilities of VGAM1089 include diagnosis, prevention and treatment of diseases and clinical conditions associated with C21orf25. ERG-1 (Accession NM_022034) is another VGAM1089 host target gene. ERG-1 BINDING SITE is HOST TARGET binding site found in the 5' untranslated region of mRNA encoded by ERG-1, corresponding to a HOST TARGET binding site such as BINDING SITE I, BINDING SITE II or BINDING SITE III. Table 2 illustrates the complementarity of the nucleotide sequences of ERG-1 BINDING SITE, designated SEQ ID:22557, to the nucleotide sequence of VGAM1089 RNA, herein designated VGAM RNA, also designated SEQ ID:3800.

Another function of VGAM1089 is therefore inhibition of ERG-1 (Accession NM_022034). Accordingly, utilities of VGAM1089 include diagnosis, prevention and treatment of diseases and clinical conditions associated with ERG-1. FLJ13590 (Accession NM_024840) is another VGAM1089 host target gene. FLJ13590 BINDING SITE is HOST TARGET binding site found in the 5' untranslated region of mRNA encoded by FLJ13590, corresponding to a HOST TARGET binding site such as BINDING SITE I, BINDING SITE II or BINDING SITE III. Table 2 illustrates the complementarity of the nucleotide sequences of FLJ13590 BINDING SITE, designated SEQ ID:24250, to the nucleotide sequence of VGAM1089 RNA, herein designated VGAM RNA, also designated SEQ ID:3800.

Another function of VGAM1089 is therefore inhibition of FLJ13590 (Accession NM_024840). Accordingly, utilities of VGAM1089 include diagnosis, prevention and treatment of diseases and clinical conditions associated with FLJ13590. FLJ14810 (Accession NM_032843) is another VGAM1089 host target gene. FLJ14810 BINDING SITE is HOST TARGET binding site found in the 3' untranslated region of mRNA encoded by FLJ14810, corresponding to a HOST TARGET binding site such as BINDING SITE I, BINDING SITE II or BINDING SITE III. Table 2 illustrates the complementarity of the nucleotide sequences of FLJ14810 BINDING SITE, designated SEQ ID:26632, to the nucleotide sequence of VGAM1089 RNA, herein designated VGAM RNA, also designated SEQ ID:3800.

Another function of VGAM1089 is therefore inhibition of FLJ14810 (Accession NM_032843). Accordingly, utilities of VGAM1089 include diagnosis, prevention and treatment of diseases and clinical conditions associated with FLJ14810. Internexin Neuronal Intermediate Filament Protein, Alpha (INA, Accession NM_032727) is another VGAM1089 host target gene. INA BINDING SITE is HOST TARGET binding site found in the 3' untranslated region of mRNA encoded by INA, corresponding to a HOST TARGET binding site such as BINDING SITE I, BINDING SITE II or BINDING SITE III. Table 2 illustrates the complementarity of the nucleotide sequences of INA BINDING SITE, designated SEQ ID:26454, to the nucleotide sequence of VGAM1089 RNA, herein designated VGAM RNA, also designated SEQ ID:3800.

Another function of VGAM1089 is therefore inhibition of Internexin Neuronal Intermediate Filament Protein, Alpha (INA, Accession NM_032727). Accordingly, utilities of VGAM1089 include diagnosis, prevention and treatment of diseases and clinical conditions associated with INA. INSM2 (Accession NM_032594) is another VGAM1089 host target gene. INSM2 BINDING SITE is HOST TARGET binding site found in the 3' untranslated region of mRNA encoded by INSM2, corresponding to a HOST TARGET binding site such as BINDING SITE I, BINDING SITE II or BINDING SITE III. Table 2 illustrates the complementarity of the nucleotide sequences of INSM2 BINDING SITE, designated SEQ ID:26326, to the nucleotide sequence of VGAM1089 RNA, herein designated VGAM RNA, also designated SEQ ID:3800.

Another function of VGAM1089 is therefore inhibition of INSM2 (Accession NM_032594). Accordingly, utilities of VGAM1089 include diagnosis, prevention and treatment of diseases and clinical conditions associated with INSM2. KIAA0261 (Accession XM_042946) is another VGAM1089 host target gene. KIAA0261 BINDING SITE is HOST TARGET binding site found in the 3' untranslated region of mRNA encoded by KIAA0261, corresponding to a HOST TARGET binding site such as BINDING SITE I, BINDING SITE II or BINDING SITE III. Table 2 illustrates the complementarity of the nucleotide sequences of KIAA0261 BINDING SITE, designated SEQ ID:33830, to the nucleotide sequence of VGAM1089 RNA, herein designated VGAM RNA, also designated SEQ ID:3800.

Another function of VGAM1089 is therefore inhibition of KIAA0261 (Accession XM_042946). Accordingly, utilities of VGAM1089 include diagnosis, prevention and treatment of diseases and clinical conditions associated with KIAA0261. KIAA1483 (Accession XM_045920) is another VGAM1089 host target gene. KIAA1483 BINDING SITE is HOST TARGET binding site found in the 3' untranslated region of mRNA encoded by KIAA1483, corresponding to a HOST TARGET binding site such as BINDING SITE I, BINDING SITE II or BINDING SITE III. Table 2 illustrates the complementarity of the nucleotide sequences of KIAA1483 BINDING SITE, designated SEQ ID:34617, to the nucleotide sequence of VGAM1089 RNA, herein designated VGAM RNA, also designated SEQ ID:3800.

Another function of VGAM1089 is therefore inhibition of KIAA1483 (Accession XM_045920). Accordingly, utilities of VGAM1089 include diagnosis, prevention and treatment of diseases and clinical conditions associated with KIAA1483. KIAA1530 (Accession XM_042661) is another VGAM1089 host target gene. KIAA1530 BINDING SITE is HOST TARGET binding site found in the 3' untranslated region of mRNA encoded by KIAA1530, corresponding to a HOST TARGET binding site such as BINDING SITE I, BINDING SITE II or BINDING SITE III. Table 2 illustrates the complementarity of the nucleotide sequences of KIAA1530 BINDING SITE, designated SEQ ID:33737, to the nucleotide sequence of VGAM1089 RNA, herein designated VGAM RNA, also designated SEQ ID:3800.

Another function of VGAM1089 is therefore inhibition of KIAA1530 (Accession XM_042661). Accordingly, utilities of VGAM1089 include diagnosis, prevention and treatment of diseases and clinical conditions associated with KIAA1530. Mitochondrial Ribosomal Protein L35 (MRPL35, Accession NM_016622) is another VGAM1089 host target gene. MRPL35 BINDING SITE is HOST TARGET binding site found in the 3' untranslated region of mRNA encoded by MRPL35, corresponding to a HOST TARGET binding site such as BINDING SITE I, BINDING SITE II or BINDING SITE III. Table 2 illustrates the complementarity of the nucleotide sequences of MRPL35 BINDING SITE, designated SEQ ID:18733, to the nucleotide sequence of VGAM1089 RNA, herein designated VGAM RNA, also designated SEQ ID:3800.

Another function of VGAM1089 is therefore inhibition of Mitochondrial Ribosomal Protein L35 (MRPL35, Accession NM_016622). Accordingly, utilities of VGAM1089 include diagnosis, prevention and treatment of diseases and clinical conditions associated with MRPL35. N-ethylmaleimide-sensitive Factor Attachment Protein, Gamma (NAPG, Accession XM_172983) is another VGAM1089 host target gene. NAPG BINDING SITE is HOST TARGET binding site found in the 3' untranslated region of mRNA encoded by NAPG, corresponding to a HOST TARGET binding site such as BINDING SITE I, BINDING SITE II or BINDING SITE III. Table 2 illustrates the complementarity of the nucleotide sequences of NAPG BINDING SITE, designated SEQ ID:46251, to the nucleotide sequence of VGAM1089 RNA, herein designated VGAM RNA, also designated SEQ ID:3800.

Another function of VGAM1089 is therefore inhibition of N-ethylmaleimide-sensitive Factor Attachment Protein, Gamma (NAPG, Accession XM_172983). Accordingly, utilities of VGAM1089 include diagnosis, prevention and treatment of diseases and clinical conditions associated with NAPG. Solute Carrier Family 26 (sulfate transporter), Member 1 (SLC26A1, Accession NM_022042) is another VGAM1089 host target gene. SLC26A1 BINDING SITE is HOST TARGET binding site found in the 3" untranslated region of mRNA encoded by SLC26A1, corresponding to a HOST TARGET binding site such as BINDING SITE I, BINDING SITE II or BINDING SITE III. Table 2 illustrates the complementarity of the nucleotide sequences of SLC26A1 BINDING SITE, designated SEQ ID:22567, to the nucleotide sequence of VGAM1089 RNA, herein designated VGAM RNA, also designated SEQ ID:3800.

Another function of VGAM1089 is therefore inhibition of Solute Carrier Family 26 (sulfate transporter), Member 1 (SLC26A1, Accession NM_022042). Accordingly, utilities of VGAM1089 include diagnosis, prevention and treatment of diseases and clinical conditions associated with SLC26A1. Serine/threonine Kinase 29 (STK29, Accession XM_113646) is another VGAM1089 host target gene. STK29 BINDING SITE is HOST TARGET binding site found in the 3' untranslated region of mRNA encoded by STK29, corresponding to a HOST TARGET binding site such as BINDING SITE I, BINDING SITE II or BINDING SITE III. Table 2 illustrates the complementarity of the nucleotide sequences of STK29 BINDING SITE, designated SEQ ID:42317, to the nucleotide sequence of VGAM1089 RNA, herein designated VGAM RNA, also designated SEQ ID:3800.

Another function of VGAM1089 is therefore inhibition of Serine/threonine Kinase 29 (STK29, Accession XM_113646). Accordingly, utilities of VGAM1089 include diagnosis, prevention and treatment of diseases and clinical conditions associated with STK29. LOC162165 (Accession XM_102442) is another VGAM1089 host target gene. LOC162165 BINDING SITE is HOST TARGET binding site found in the 5' untranslated region of mRNA encoded by LOC162165, corresponding to a HOST TARGET binding site such as BINDING SITE I, BINDING SITE II or BINDING SITE III. Table 2 illustrates the complementarity of the nucleotide sequences of LOC162165 BINDING SITE, designated SEQ ID:42117, to the nucleotide sequence of VGAM1089 RNA, herein designated VGAM RNA, also designated SEQ ID:3800.

Another function of VGAM1089 is therefore inhibition of LOC162165 (Accession XM_102442). Accordingly, utilities of VGAM1089 include diagnosis, prevention and treatment of diseases and clinical conditions associated with LOC162165. LOC196527 (Accession XM_113743) is another VGAM1089 host target gene. LOC196527 BINDING SITE is HOST TARGET binding site found in the 3' untranslated region of mRNA encoded by LOC196527, corresponding to a HOST TARGET binding site such as BINDING SITE I, BINDING SITE II or BINDING SITE III. Table 2 illustrates the complementarity of the nucleotide sequences of LOC196527 BINDING SITE, designated SEQ ID:42400, to the nucleotide sequence of VGAM1089 RNA, herein designated VGAM RNA, also designated SEQ ID:3800.

Another function of VGAM1089 is therefore inhibition of LOC196527 (Accession XM_113743). Accordingly, utilities of VGAM1089 include diagnosis, prevention and treatment of diseases and clinical conditions associated with LOC196527. LOC221002 (Accession XM_166156) is another VGAM1089 host target gene. LOC221002 BINDING SITE is HOST TARGET binding site found in the 3' untranslated region of mRNA encoded by LOC221002, corresponding to a HOST TARGET binding site such as BINDING SITE I, BINDING SITE II or BINDING SITE III. Table 2 illustrates the complementarity of the nucleotide sequences of LOC221002 BINDING SITE, designated SEQ ID:43972, to the nucleotide sequence of VGAM1089 RNA, herein designated VGAM RNA, also designated SEQ ID:3800.

Another function of VGAM1089 is therefore inhibition of LOC221002 (Accession XM_166156). Accordingly, utilities of VGAM1089 include diagnosis, prevention and treatment of diseases and clinical conditions associated with LOC221002. FIG. 1 further provides a conceptual description of a novel bioinformatically detected viral gene of the present invention, referred to here as Viral Genomic Address Messenger 1090 (VGAM1090) viral gene, which modulates expression of respective host target genes thereof, the function and utility of which host target genes is known in the art.

VGAM1090 is a novel bioinformatically detected regulatory, non protein coding, viral micro RNA (miRNA) gene. The method by which VGAM1090 was detected is described hereinabove with reference to FIGS. 1-8.

VGAM1090 gene, herein designated VGAM GENE, is a viral gene contained in the genome of Porcine Epidemic Diarrhea Virus. VGAM1090 host target gene, herein designated VGAM HOST TARGET GENE, is a human gene contained in the human genome.

VGAM1090 gene encodes a VGAM1090 precursor RNA, herein designated VGAM PRECURSOR RNA. Similar to other miRNA genes, and unlike most ordinary genes, VGAM1090 precursor RNA does not encode a protein. A nucleotide sequence identical or highly similar to the nucleotide sequence of VGAM1090 precursor RNA is designated SEQ ID:1076, and is provided hereinbelow with reference to the sequence listing part. Nucleotide sequence SEQ ID:1076 is located at position 2399 relative to the genome of Porcine Epidemic Diarrhea Virus.

VGAM1090 precursor RNA folds onto itself, forming VGAM1090 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1090 folded precursor RNA into VGAM1090 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1090 RNA is designated SEQ ID:3801, and is provided hereinbelow with reference to the sequence listing part.

VGAM1090 host target gene, herein designated VGAM HOST TARGET GENE, encodes a corresponding messenger RNA, VGAM1090 host target RNA, herein designated VGAM HOST TARGET RNA. VGAM1090 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1090 RNA, herein designated VGAM RNA, binds complementarily to one or more host target binding sites located in untranslated regions of VGAM1090 host target RNA, herein designated VGAM HOST TARGET RNA. This complementary binding is due to the fact that the nucleotide sequence of VGAM1090 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1090 RNA, herein designated VGAM RNA, may have a different number of host target binding sites in untranslated regions of a VGAM1090 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1090 RNA, herein designated VGAM RNA, to host target binding sites on VGAM1090 host target RNA, herein designated VGAM HOST TARGET RNA, such as BINDING SITE I, BINDING SITE II and BINDING SITE III, inhibits translation of VGAM1090 host target RNA into VGAM1090 host target protein, herein designated VGAM HOST TARGET PROTEIN. VGAM host target protein is therefore outlined by a broken line.

It is appreciated that VGAM1090 host target gene, herein designated VGAM HOST TARGET GENE, in fact represents a plurality of VGAM1090 host target genes. The mRNA of each one of this plurality of VGAM1090 host target genes comprises one or more host target binding sites, each having a nucleotide sequence which is at least partly complementary to VGAM1090 RNA, herein designated VGAM RNA, and which when bound by VGAM1090 RNA causes inhibition of translation of respective one or more VGAM1090 host target proteins.

It is further appreciated by one skilled in the art that the mode of translational inhibition illustrated by FIG. 1 with specific reference to translational inhibition exerted by VGAM1090 gene, herein designated VGAM GENE, on one or more VGAM1090 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1090 is inhibition of expression of host target genes, as part of a novel viral mechanism of attacking a host. Accordingly, utilities of VGAM1090 include diagnosis, prevention and treatment of viral infection by Porcine Epidemic Diarrhea Virus. Specific functions, and accordingly utilities, of VGAM1090 correlate with, and may be deduced from, the identity of the host target genes which VGAM1090 binds and inhibits, and the function of these host target genes, as elaborated hereinbelow.

Nucleotide sequences of the VGAM1090 precursor RNA, herein designated VGAM PRECURSOR RNA, and of the 'diced' VGAM1090 RNA, herein designated VGAM RNA, and a schematic representation of the secondary folding of VGAM1090 folded precursor RNA, herein designated VGAM FOLDED PRECURSOR RNA, of VGAM1090 are further described hereinbelow with reference to Table 1.

Nucleotide sequences of host target binding sites, such as BINDING SITE-I, BINDING SITE-II and BINDING SITE-III of FIG. 1, found on VGAM1090 host target RNA, and schematic representation of the complementarity of each of these host target binding sites to VGAM1090 RNA, herein designated VGAM RNA, are described hereinbelow with reference to Table 2.

As mentioned hereinabove with reference to FIG. 1, a function of VGAM1090 gene, herein designated VGAM is inhibition of expression of VGAM1090 target genes. It is appreciated that specific functions, and accordingly utilities, of VGAM1090 correlate with, and may be deduced from, the identity of the target genes which VGAM1090 binds and inhibits, and the function of these target genes, as elaborated hereinbelow.

B-cell CLL/lymphoma 11A (zinc finger protein) (BCL11A, Accession NM_018014) is a VGAM1090 host target gene. BCL11A BINDING SITE1 and BCL11A BINDING SITE2 are HOST TARGET binding sites found in untranslated regions of mRNA encoded by BCL11A, corresponding to HOST TARGET binding sites such as BINDING SITE I, BINDING SITE II or BINDING SITE III. Table 2 illustrates the complementarity of the nucleotide sequences of BCL11A BINDING SITE1 and BCL11A BINDING SITE2, designated SEQ ID:19752 and SEQ ID:28852 respectively, to the nucleotide sequence of VGAM1090 RNA, herein designated VGAM RNA, also designated SEQ ID:3801.

A function of VGAM1090 is therefore inhibition of B-cell CLL/lymphoma 11A (zinc finger protein) (BCL11A, Accession NM_018014), a gene which acts as a transcriptional repressor. Accordingly, utilities of VGAM1090 include diagnosis, prevention and treatment of diseases and clinical conditions associated with BCL11A. The function of BCL11A and its association with various diseases and clinical conditions, has been established by previous studies, as described hereinabove with reference to VGAM190. SWAP70 (Accession XM_049197) is another VGAM1090 host target gene. SWAP70 BINDING SITE is HOST TARGET binding site found in the 3' untranslated region of mRNA encoded by SWAP70, corresponding to a HOST TARGET binding site such as BINDING SITE I, BINDING SITE II or BINDING SITE III. Table 2 illustrates the complementarity of the nucleotide sequences of SWAP70 BINDING SITE, designated SEQ ID:35346, to the nucleotide sequence of VGAM1090 RNA, herein designated VGAM RNA, also designated SEQ ID:3801.

Another function of VGAM1090 is therefore inhibition of SWAP70 (Accession XM_049197), a gene which is involved not only in nuclear events but also in signaling in B-cell activation. Accordingly, utilities of VGAM1090 include diagnosis, prevention and treatment of diseases and clinical conditions associated with SWAP70. The function of SWAP70 has been established by previous studies. The B-cell receptor is composed of the immunoglobulin (Ig) heavy and light chains and the covalently bound accessory molecules Ig-alpha (CD79A; 112205) and Ig-beta (CD79B; 147245). Crosslinking of the B-cell receptor by antigens stimulates the activation of intracellular protein kinases. B-cell activation leads to hypermutation of the Ig variable regions and to heavy chain class switching, in which the Ig constant region of mu (IgM; OMIM Ref. No. 147020) is replaced by that of another class: gamma (IgG; OMIM Ref. No. 147100), alpha (IgA; OMIM Ref. No. 146900), or epsilon (IgE; OMIM Ref. No. 147180). Class switching is achieved by a looping out and deletion mechanism between the switch region of mu and the switch region of the isotope that is to be expressed. Masat et al. (2000) explored the possibility that switch-associated protein-70 (OMIM Ref. No. SWAP70) acts as a link between the recognition of specific switch regions and causation of a DNA break. Swap70 had been isolated in the mouse as part of a complex that is able to promote recombination between 2 switch regions in vitro (Borggrefe et al., 1998; Borggrefe et al., 1999). By screening a human lymphoma cDNA library using mouse Swap70 sequences as the probe, Masat et al. (2000) isolated a cDNA encoding SWAP70. Although the 585-amino acid SWAP70 protein contains 3 nuclear localization signals, SWAP70 was found mainly in the cytoplasm in small resting B cells. On stimulation, SWAP70 translocated to the nucleus. In activated, class-switching B cell cultures, it was associated with membrane IgG, but not IgM. Masat et al. (2000) suggested that SWAP70 is involved not only in nuclear events but also in signaling in B-cell activation. Shinohara et al. (2002) demonstrated that SWAP70 specifically binds phosphatidylinositol-3,4,5-triphosphate. On stimulation by growth factors, cytoplasmic SWAP70, which is dependent on phosphoinositide-3-hydroxykinase but independent of Ras (see OMIM Ref. No. 190020), moved to cell membrane rearrangements known as ruffles. However, mutant SWAP70 lacking the ability to bind phosphatidylinositol-3,4,5-triphosphate blocked membrane ruffling induced by epidermal growth factor (EGF; 131530) or platelet-derived growth factor (see OMIM Ref. No. 173430). SWAP70 shows low homology with Rac-guanine nucleotide exchange factors, and catalyzes phosphatidylinositol-3,4,5-triphosphate-dependent guanine nucleotide exchange to Rac (see OMIM Ref. No. 602048). SWAP70-deficient fibroblasts showed impaired membrane ruffling after stimulation with EGF, and failed to activate Rac fully. Shinohara et al. (2002) concluded that SWAP70 is a different type of Rac-GEF which, independently of Ras, transduces signals from tyrosine kinase receptors to Rac.

Full details of the abovementioned studies are described in the following publications, the disclosure of which are hereby incorporated by reference:

Masat, L.; Caldwell, J.; Armstrong, R.; Khoshnevisan, H.; Jessberger, R.; Herndier, B.; Wabl, M.; Ferrick, D.: Association of SWAP-70 with the B cell antigen receptor complex. Proc. Nat. Acad. Sci. 97:2180-2184, 2000; and Shinohara, M.; Terada, Y.; Iwamatsu, A.; Shinohara, A.; Mochizuki, N.; Higuchi, M.; Gotoh, Y.; Ihara, S.; Nagata, S.; Itoh, H.; Fukui, Y.; Jessberger, R.: SWAP-70 is a guanine-nucleot.

Further studies establishing the function and utilities of SWAP70 are found in John Hopkins OMIM database record ID 604762, and in sited publications numbered 7286-7290 listed in the bibliography section hereinbelow, which are also hereby incorporated by reference. Adenylate Kinase 5 (AK5, Accession NM_012093) is another VGAM1090 host target gene. AK5 BINDING SITE is HOST TARGET binding site found in the 3' untranslated region of mRNA encoded by AK5, corresponding to a HOST TARGET binding site such as BINDING SITE I, BINDING SITE II or BINDING SITE III. Table 2 illustrates the complementarity of the nucleotide sequences of AK5 BINDING SITE, designated SEQ ID:14394, to the nucleotide sequence of VGAM1090 RNA, herein designated VGAM RNA, also designated SEQ ID:3801.

Another function of VGAM1090 is therefore inhibition of Adenylate Kinase 5 (AK5, Accession NM_012093). Accordingly, utilities of VGAM1090 include diagnosis, prevention and treatment of diseases and clinical conditions associated with AK5. CHRNA7 (cholinergic receptor, nicotinic, alpha polypeptide 7, exons 5-10) and FAM7A (family with sequence similarity 7A, exons A-E) Fusion (CHRFAM7A, Accession XM_170784) is another VGAM1090 host target gene. CHRFAM7A BINDING SITE is HOST TARGET binding site found in the 3' untranslated region of mRNA encoded by CHRFAM7A, corresponding to a HOST TARGET binding site such as BINDING SITE I, BINDING SITE II or BINDING SITE III. Table 2 illustrates the complementarity of the nucleotide sequences of CHRFAM7A BINDING SITE, designated SEQ ID:45553, to the nucleotide sequence of VGAM1090 RNA, herein designated VGAM RNA, also designated SEQ ID:3801.

Another function of VGAM1090 is therefore inhibition of CHRNA7 (cholinergic receptor, nicotinic, alpha polypeptide 7, exons 5-10) and FAM7A (family with sequence similarity 7A, exons A-E) Fusion (CHRFAM7A, Accession XM_170784). Accordingly, utilities of VGAM1090 include diagnosis, prevention and treatment of diseases and clinical conditions associated with CHRFAM7A. FLJ13215 (Accession NM_025004) is another VGAM1090 host target gene. FLJ13215 BINDING SITE is HOST TARGET binding site found in the 3' untranslated region of mRNA encoded by FLJ13215, corresponding to a HOST TARGET binding site such as BINDING SITE I, BINDING SITE II or BINDING SITE III. Table 2 illustrates the complementarity of the nucleotide sequences of FLJ13215 BINDING SITE, designated SEQ ID:24576, to the nucleotide sequence of VGAM1090 RNA, herein designated VGAM RNA, also designated SEQ ID:3801.

Another function of VGAM1090 is therefore inhibition of FLJ13215 (Accession NM_025004). Accordingly, utilities of VGAM1090 include diagnosis, prevention and treatment of diseases and clinical conditions associated with FLJ13215. KIAA1430 (Accession XM_087593) is another VGAM1090 host target gene. KIAA1430 BINDING SITE is HOST TARGET binding site found in the 3' untranslated region of mRNA encoded by KIAA1430, corresponding to a HOST TARGET binding site such as BINDING SITE I, BINDING SITE II or BINDING SITE III. Table 2 illustrates the complementarity of the nucleotide sequences of KIAA1430 BINDING SITE, designated SEQ ID:39357, to the nucleotide sequence of VGAM1090 RNA, herein designated VGAM RNA, also designated SEQ ID:3801.

Another function of VGAM1090 is therefore inhibition of KIAA1430 (Accession XM_087593). Accordingly, utilities of VGAM1090 include diagnosis, prevention and treatment of diseases and clinical conditions associated with KIAA1430. PRO2955 (Accession NM_018545) is another VGAM1090 host target gene. PRO2955 BINDING SITE is HOST TARGET binding site found in the 3' untranslated region of mRNA encoded by PRO2955, corresponding to a HOST TARGET binding site such as BINDING SITE I, BINDING SITE II or BINDING SITE III. Table 2 illustrates the complementarity of the nucleotide sequences of PRO2955 BINDING SITE, designated SEQ ID:20620, to the nucleotide sequence of VGAM1090 RNA, herein designated VGAM RNA, also designated SEQ ID:3801.

Another function of VGAM1090 is therefore inhibition of PRO2955 (Accession NM_018545). Accordingly, utilities of VGAM1090 include diagnosis, prevention and treatment of diseases and clinical conditions associated with PRO2955. LOC148014 (Accession XM_085999) is another VGAM1090 host target gene. LOC148014 BINDING SITE is HOST TARGET binding site found in the 3' untranslated region of mRNA encoded by LOC148014, corresponding to a HOST TARGET binding site such as BINDING SITE I, BINDING SITE II or BINDING SITE III. Table 2 illustrates the complementarity of the nucleotide sequences of LOC148014 BINDING SITE, designated SEQ ID:38442, to the nucleotide sequence of VGAM1090 RNA, herein designated VGAM RNA, also designated SEQ ID:3801.

Another function of VGAM1090 is therefore inhibition of LOC148014 (Accession XM_085999). Accordingly, utilities of VGAM1090 include diagnosis, prevention and treatment of diseases and clinical conditions associated with LOC148014. LOC90917 (Accession XM_034861) is another VGAM1090 host target gene. LOC90917 BINDING SITE is HOST TARGET binding site found in the 3' untranslated region of mRNA encoded by LOC90917, corresponding to a HOST TARGET binding site such as BINDING SITE I, BINDING SITE II or BINDING SITE III. Table 2 illustrates the complementarity of the nucleotide sequences of LOC90917 BINDING SITE, designated SEQ ID:32165, to the nucleotide sequence of VGAM1090 RNA, herein designated VGAM RNA, also designated SEQ ID:3801.

Another function of VGAM1090 is therefore inhibition of LOC90917 (Accession XM_034861). Accordingly, utilities of VGAM1090 include diagnosis, prevention and treatment of diseases and clinical conditions associated with LOC90917. FIG. 1 further provides a conceptual description of a novel bioinformatically detected viral gene of the present invention, referred to here as Viral Genomic Address Messenger 1091 (VGAM1091) viral gene, which modulates expression of respective host target genes thereof, the function and utility of which host target genes is known in the art.

VGAM1091 is a novel bioinformatically detected regulatory, non protein coding, viral micro RNA (miRNA) gene. The method by which VGAM1091 was detected is described hereinabove with reference to FIGS. 1-8.

VGAM1091 gene, herein designated VGAM GENE, is a viral gene contained in the genome of Poinsettia Mosaic Virus. VGAM1091 host target gene, herein designated VGAM HOST TARGET GENE, is a human gene contained in the human genome.

VGAM1091 gene encodes a VGAM1091 precursor RNA, herein designated VGAM PRECURSOR RNA. Similar to other miRNA genes, and unlike most ordinary genes, VGAM1091 precursor RNA does not encode a protein. A nucleotide sequence identical or highly similar to the nucleotide sequence of VGAM1091 precursor RNA is designated SEQ ID:1077, and is provided hereinbelow with reference to the sequence listing part. Nucleotide sequence SEQ ID:1077 is located at position 854 relative to the genome of Poinsettia Mosaic Virus.

VGAM1091 precursor RNA folds onto itself, forming VGAM1091 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1091 folded precursor RNA into VGAM1091 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 65%) nucleotide sequence of VGAM1091 RNA is designated SEQ ID:3802, and is provided hereinbelow with reference to the sequence listing part.

VGAM1091 host target gene, herein designated VGAM HOST TARGET GENE, encodes a corresponding messenger RNA, VGAM1091 host target RNA, herein designated VGAM HOST TARGET RNA. VGAM1091 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1091 RNA, herein designated VGAM RNA, binds complementarily to one or more host target binding sites located in untranslated regions of VGAM1091 host target RNA, herein designated VGAM HOST TARGET RNA. This complementary binding is due to the fact that the nucleotide sequence of VGAM1091 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1091 RNA, herein designated VGAM RNA, may have a different number of host target binding sites in untranslated regions of a VGAM1091 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1091 RNA, herein designated VGAM RNA, to host target binding sites on VGAM1091 host target RNA, herein designated VGAM HOST TARGET RNA, such as BINDING SITE I, BINDING SITE II and BINDING SITE III, inhibits translation of VGAM1091 host target RNA into VGAM1091 host target protein, herein designated VGAM HOST TARGET PROTEIN. VGAM host target protein is therefore outlined by a broken line.

It is appreciated that VGAM1091 host target gene, herein designated VGAM HOST TARGET GENE, in fact represents a plurality of VGAM1091 host target genes. The mRNA of each one of this plurality of VGAM1091 host target genes comprises one or more host target binding sites, each having a nucleotide sequence which is at least partly complementary to VGAM1091 RNA, herein designated VGAM RNA, and which when bound by VGAM1091 RNA causes inhibition of translation of respective one or more VGAM1091 host target proteins.

It is further appreciated by one skilled in the art that the mode of translational inhibition illustrated by FIG. 1 with specific reference to translational inhibition exerted by VGAM1091 gene, herein designated VGAM GENE, on one or more VGAM1091 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1091 is inhibition of expression of host target genes, as part of a novel viral mechanism of attacking a host. Accordingly, utilities of VGAM1091 include diagnosis, prevention and treatment of viral infection by Poinsettia Mosaic Virus. Specific functions, and accordingly utilities, of VGAM1091 correlate with, and may be deduced from, the identity of the host target genes which VGAM1091 binds and inhibits, and the function of these host target genes, as elaborated hereinbelow.

Nucleotide sequences of the VGAM1091 precursor RNA, herein designated VGAM PRECURSOR RNA, and of the 'diced' VGAM1091 RNA, herein designated VGAM RNA, and a schematic representation of the secondary folding of VGAM1091 folded precursor RNA, herein designated VGAM FOLDED PRECURSOR RNA, of VGAM1091 are further described hereinbelow with reference to Table 1.

Nucleotide sequences of host target binding sites, such as BINDING SITE-I, BINDING SITE-II and BINDING SITE-III of FIG. 1, found on VGAM1091 host target RNA, and schematic representation of the complementarity of each of these host target binding sites to VGAM1091 RNA, herein designated VGAM RNA, are described hereinbelow with reference to Table 2.

As mentioned hereinabove with reference to FIG. 1, a function of VGAM1091 gene, herein designated VGAM is inhibition of expression of VGAM1091 target genes. It is appreciated that specific functions, and accordingly utilities, of VGAM1091 correlate with, and may be deduced from, the identity of the target genes which VGAM1091 binds and inhibits, and the function of these target genes, as elaborated hereinbelow.

MGC13057 (Accession NM_032321) is a VGAM1091 host target gene. MGC13057 BINDING SITE is HOST TARGET binding site found in the 5' untranslated region of mRNA encoded by MGC13057, corresponding to a HOST TARGET binding site such as BINDING SITE I, BINDING SITE II or BINDING SITE III. Table 2 illustrates the complementarity of the nucleotide sequences of MGC13057 BINDING SITE, designated SEQ ID:26125, to the nucleotide sequence of VGAM1091 RNA, herein designated VGAM RNA, also designated SEQ ID:3802.

A function of VGAM1091 is therefore inhibition of MGC13057 (Accession NM_032321). Accordingly, utilities of VGAM1091 include diagnosis, prevention and treatment of diseases and clinical conditions associated with MGC13057. FIG. 1 further provides a conceptual description of a novel bioinformatically detected viral gene of the present invention, referred to here as Viral Genomic Address Messenger 1092 (VGAM1092) viral gene, which modulates expression of respective host target genes thereof, the function and utility of which host target genes is known in the art.

VGAM1092 is a novel bioinformatically detected regulatory, non protein coding, viral micro RNA (miRNA) gene. The method by which VGAM1092 was detected is described hereinabove with reference to FIGS. 1-8.

VGAM1092 gene, herein designated VGAM GENE, is a viral gene contained in the genome of Poinsettia Mosaic Virus. VGAM1092 host target gene, herein designated VGAM HOST TARGET GENE, is a human gene contained in the human genome.

VGAM1092 gene encodes a VGAM1092 precursor RNA, herein designated VGAM PRECURSOR RNA. Similar to other miRNA genes, and unlike most ordinary genes, VGAM1092 precursor RNA does not encode a protein. A nucleotide sequence identical or highly similar to the nucleotide sequence of VGAM1092 precursor RNA is designated SEQ ID:1078, and is provided hereinbelow with reference to the sequence listing part. Nucleotide sequence SEQ ID:1078 is located at position 92 relative to the genome of Poinsettia Mosaic Virus.

VGAM1092 precursor RNA folds onto itself, forming VGAM1092 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1092 folded precursor RNA into VGAM1092 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM1092 RNA is designated SEQ ID:3803, and is provided hereinbelow with reference to the sequence listing part.

VGAM1092 host target gene, herein designated VGAM HOST TARGET GENE, encodes a corresponding messenger RNA, VGAM1092 host target RNA, herein designated VGAM HOST TARGET RNA. VGAM1092 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1092 RNA, herein designated VGAM RNA, binds complementarily to one or more host target binding sites located in untranslated regions of VGAM1092 host target RNA, herein designated VGAM HOST TARGET RNA. This complementary binding is due to the fact that the nucleotide sequence of VGAM1092 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1092 RNA, herein designated VGAM RNA, may have a different number of host target binding sites in untranslated regions of a VGAM1092 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1092 RNA, herein designated VGAM RNA, to host target binding sites on VGAM1092 host target RNA, herein designated VGAM HOST TARGET RNA, such as BINDING SITE I, BINDING SITE II and BINDING SITE III, inhibits translation of VGAM1092 host target RNA into VGAM1092 host target protein, herein designated VGAM HOST TARGET PROTEIN. VGAM host target protein is therefore outlined by a broken line.

It is appreciated that VGAM1092 host target gene, herein designated VGAM HOST TARGET GENE, in fact represents a plurality of VGAM1092 host target genes. The mRNA of each one of this plurality of VGAM1092 host target genes comprises one or more host target binding sites, each having a nucleotide sequence which is at least partly complementary to VGAM1092 RNA, herein designated VGAM RNA, and which when bound by VGAM1092 RNA causes inhibition of translation of respective one or more VGAM1092 host target proteins.

It is further appreciated by one skilled in the art that the mode of translational inhibition illustrated by FIG. 1 with specific reference to translational inhibition exerted by VGAM1092 gene, herein designated VGAM GENE, on one or more VGAM1092 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1092 is inhibition of expression of host target genes, as part of a novel viral mechanism of attacking a host. Accordingly, utilities of VGAM1092 include diagnosis, prevention and treatment of viral infection by Poinsettia Mosaic Virus. Specific functions, and accordingly utilities, of VGAM1092 correlate with, and may be deduced from, the identity of the host target genes which VGAM1092 binds and inhibits, and the function of these host target genes, as elaborated hereinbelow.

Nucleotide sequences of the VGAM1092 precursor RNA, herein designated VGAM PRECURSOR RNA, and of the 'diced' VGAM1092 RNA, herein designated VGAM RNA, and a schematic representation of the secondary folding of VGAM1092 folded precursor RNA, herein designated VGAM FOLDED PRECURSOR RNA, of VGAM1092 are further described hereinbelow with reference to Table 1.

Nucleotide sequences of host target binding sites, such as BINDING SITE-I, BINDING SITE-II and BINDING SITE-III of FIG. 1, found on VGAM1092 host target RNA, and schematic representation of the complementarity of each of these host target binding sites to VGAM1092 RNA, herein designated VGAM RNA, are described hereinbelow with reference to Table 2.

As mentioned hereinabove with reference to FIG. 1, a function of VGAM1092 gene, herein designated VGAM is inhibition of expression of VGAM1092 target genes. It is appreciated that specific functions, and accordingly utilities, of VGAM1092 correlate with, and may be deduced from, the identity of the target genes which VGAM1092 binds and inhibits, and the function of these target genes, as elaborated hereinbelow.

GRB2-associated Binding Protein 3 (GAB3, Accession NM_080612) is a VGAM1092 host target gene. GAB3 BINDING SITE is HOST TARGET binding site found in the 3' untranslated region of mRNA encoded by GAB3, corresponding to a HOST TARGET binding site such as BINDING SITE I, BINDING SITE II or BINDING SITE III. Table 2 illustrates the complementarity of the nucleotide sequences of GAB3 BINDING SITE, designated SEQ ID:27926, to the nucleotide sequence of VGAM1092 RNA, herein designated VGAM RNA, also designated SEQ ID:3803.

A function of VGAM1092 is therefore inhibition of GRB2-associated Binding Protein 3 (GAB3, Accession NM_080612). Accordingly, utilities of VGAM1092 include diagnosis, prevention and treatment of diseases and clinical conditions associated with GAB3. LOC147093 (Accession XM_097184) is another VGAM1092 host target gene. LOC147093 BINDING SITE is HOST TARGET binding site found in the 3' untranslated region of mRNA encoded by LOC147093, corresponding to a HOST TARGET binding site such as BINDING SITE I, BINDING SITE II or BINDING SITE III. Table 2 illustrates the complementarity of the nucleotide sequences of LOC147093 BINDING SITE, designated SEQ ID:40802, to the nucleotide sequence of VGAM1092 RNA, herein designated VGAM RNA, also designated SEQ ID:3803.

Another function of VGAM1092 is therefore inhibition of LOC147093 (Accession XM_097184). Accordingly, utilities of VGAM1092 include diagnosis, prevention and treatment of diseases and clinical conditions associated with LOC147093. LOC169943 (Accession XM_104687) is another VGAM1092 host target gene. LOC169943 BINDING SITE is HOST TARGET binding site found in the 5' untranslated region of mRNA encoded by LOC169943, corresponding to a HOST TARGET binding site such as BINDING SITE I, BINDING SITE II or BINDING SITE III. Table 2 illustrates the complementarity of the nucleotide sequences of LOC169943 BINDING SITE, designated SEQ ID:42184, to the nucleotide sequence of VGAM1092 RNA, herein designated VGAM RNA, also designated SEQ ID:3803.

Another function of VGAM1092 is therefore inhibition of LOC169943 (Accession XM_104687). Accordingly, utilities of VGAM1092 include diagnosis, prevention and treatment of diseases and clinical conditions associated with LOC169943. LOC222128 (Accession XM_166560) is another VGAM1092 host target gene. LOC222128 BINDING SITE is HOST TARGET binding site found in the 5' untranslated region of mRNA encoded by LOC222128, corresponding to a HOST TARGET binding site such as BINDING SITE I, BINDING SITE II or BINDING SITE III. Table 2 illustrates the complementarity of the nucleotide sequences of LOC222128 BINDING SITE, designated SEQ ID:44538, to the nucleotide sequence of VGAM1092 RNA, herein designated VGAM RNA, also designated SEQ ID:3803.

Another function of VGAM1092 is therefore inhibition of LOC222128 (Accession XM_166560). Accordingly, utilities of VGAM1092 include diagnosis, prevention and treatment of diseases and clinical conditions associated with LOC222128. FIG. 1 further provides a conceptual description of a novel bioinformatically detected viral gene of the present invention, referred to here as Viral Genomic Address Messenger 1093 (VGAM1093) viral gene, which modulates expression of respective host target genes thereof, the function and utility of which host target genes is known in the art.

VGAM1093 is a novel bioinformatically detected regulatory, non protein coding, viral micro RNA (miRNA) gene. The method by which VGAM1093 was detected is described hereinabove with reference to FIGS. 1-8.

VGAM1093 gene, herein designated VGAM GENE, is a viral gene contained in the genome of Poinsettia Mosaic Virus. VGAM1093 host target gene, herein designated VGAM HOST TARGET GENE, is a human gene contained in the human genome.

VGAM1093 gene encodes a VGAM1093 precursor RNA, herein designated VGAM PRECURSOR RNA. Similar to other miRNA genes, and unlike most ordinary genes, VGAM1093 precursor RNA does not encode a protein. A nucleotide sequence identical or highly similar to the nucleotide sequence of VGAM1093 precursor RNA is designated SEQ ID:1079, and is provided hereinbelow with reference to the sequence listing part. Nucleotide sequence SEQ ID:1079 is located at position 3299 relative to the genome of Poinsettia Mosaic Virus.

VGAM1093 precursor RNA folds onto itself, forming VGAM1093 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1093 folded precursor RNA into VGAM1093 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1093 RNA is designated SEQ ID:3804, and is provided hereinbelow with reference to the sequence listing part.

VGAM1093 host target gene, herein designated VGAM HOST TARGET GENE, encodes a corresponding messenger RNA, VGAM1093 host target RNA, herein designated VGAM HOST TARGET RNA. VGAM1093 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1093 RNA, herein designated VGAM RNA, binds complementarily to one or more host target binding sites located in untranslated regions of VGAM1093 host target RNA, herein designated VGAM HOST TARGET RNA. This complementary binding is due to the fact that the nucleotide sequence of VGAM1093 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1093 RNA, herein designated VGAM RNA, may have a different number of host target binding sites in untranslated regions of a VGAM1093 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1093 RNA, herein designated VGAM RNA, to host target binding sites on VGAM1093 host target RNA, herein designated VGAM HOST TARGET RNA, such as BINDING SITE I, BINDING SITE II and BINDING SITE III, inhibits translation of VGAM1093 host target RNA into VGAM1093 host target protein, herein designated VGAM HOST TARGET PROTEIN. VGAM host target protein is therefore outlined by a broken line.

It is appreciated that VGAM1093 host target gene, herein designated VGAM HOST TARGET GENE, in fact represents a plurality of VGAM1093 host target genes. The mRNA of each one of this plurality of VGAM1093 host target genes comprises one or more host target binding sites, each having a nucleotide sequence which is at least partly complementary to VGAM1093 RNA, herein designated VGAM RNA, and which when bound by VGAM1093 RNA causes inhibition of translation of respective one or more VGAM1093 host target proteins.

It is further appreciated by one skilled in the art that the mode of translational inhibition illustrated by FIG. 1 with specific reference to translational inhibition exerted by VGAM1093 gene, herein designated VGAM GENE, on one or more VGAM1093 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1093 is inhibition of expression of host target genes, as part of a novel viral mechanism of attacking a host. Accordingly, utilities of VGAM1093 include diagnosis, prevention and treatment of viral infection by Poinsettia Mosaic Virus. Specific functions, and accordingly utilities, of VGAM1093 correlate with, and may be deduced from, the identity of the host target genes which VGAM1093 binds and inhibits, and the function of these host target genes, as elaborated hereinbelow.

Nucleotide sequences of the VGAM1093 precursor RNA, herein designated VGAM PRECURSOR RNA, and of the 'diced' VGAM1093 RNA, herein designated VGAM RNA, and a schematic representation of the secondary folding of VGAM1093 folded precursor RNA, herein designated VGAM FOLDED PRECURSOR RNA, of VGAM1093 are further described hereinbelow with reference to Table 1.

Nucleotide sequences of host target binding sites, such as BINDING SITE-I, BINDING SITE-II and BINDING SITE-III of FIG. 1, found on VGAM1093 host target RNA, and schematic representation of the complementarity of each of these host target binding sites to VGAM1093 RNA, herein designated VGAM RNA, are described hereinbelow with reference to Table 2.

As mentioned hereinabove with reference to FIG. 1, a function of VGAM1093 gene, herein designated VGAM is inhibition of expression of VGAM1093 target genes. It is appreciated that specific functions, and accordingly utilities, of VGAM1093 correlate with, and may be deduced from, the identity of the target genes which VGAM1093 binds and inhibits, and the function of these target genes, as elaborated hereinbelow.

AF9Q34 (Accession NM_032552) is a VGAM1093 host target gene. AF9Q34 BINDING SITE is HOST TARGET binding site found in the 3' untranslated region of mRNA encoded by AF9Q34, corresponding to a HOST TARGET binding site such as BINDING SITE I, BINDING SITE II or BINDING SITE III. Table 2 illustrates the complementarity of the nucleotide sequences of AF9Q34 BINDING SITE, designated SEQ ID:26274, to the nucleotide sequence of VGAM1093 RNA, herein designated VGAM RNA, also designated SEQ ID:3804.

A function of VGAM1093 is therefore inhibition of AF9Q34 (Accession NM_032552). Accordingly, utilities of VGAM1093 include diagnosis, prevention and treatment of diseases and clinical conditions associated with AF9Q34. Chromosome 20 Open Reading Frame 54 (C20orf54, Accession NM_033409) is another VGAM1093 host target gene. C20orf54 BINDING SITE is HOST TARGET binding site found in the 5' untranslated region of mRNA encoded by C20orf54, corresponding to a HOST TARGET binding site such as BINDING SITE I, BINDING SITE II or BINDING SITE III. Table 2 illustrates the complementarity of the nucleotide sequences of C20orf54 BINDING SITE, designated SEQ ID:27228, to the nucleotide sequence of VGAM1093 RNA, herein designated VGAM RNA, also designated SEQ ID:3804.

Another function of VGAM1093 is therefore inhibition of Chromosome 20 Open Reading Frame 54 (C20orf54, Accession NM_033409). Accordingly, utilities of VGAM1093 include diagnosis, prevention and treatment of diseases and clinical conditions associated with C20orf54. FLJ20034 (Accession NM_017630) is another VGAM1093 host target gene. FLJ20034 BINDING SITE is HOST TARGET binding site found in the 3' untranslated region of mRNA encoded by FLJ20034, corresponding to a HOST TARGET binding site such as BINDING SITE I, BINDING SITE II or BINDING SITE III. Table 2 illustrates the complementarity of the nucleotide sequences of FLJ20034 BINDING SITE, designated SEQ ID:19134, to the nucleotide sequence of VGAM1093 RNA, herein designated VGAM RNA, also designated SEQ ID:3804.

Another function of VGAM1093 is therefore inhibition of FLJ20034 (Accession NM_017630). Accordingly, utilities of VGAM1093 include diagnosis, prevention and treatment of diseases and clinical conditions associated with FLJ20034. KIAA0853 (Accession NM_015070) is another VGAM1093 host target gene. KIAA0853 BINDING SITE is HOST TARGET binding site found in the 5' untranslated region of mRNA encoded by KIAA0853, corresponding to a HOST TARGET binding site such as BINDING SITE I, BINDING SITE II or BINDING SITE III. Table 2 illustrates the complementarity of the nucleotide sequences of KIAA0853 BINDING SITE, designated SEQ ID:17438, to the nucleotide sequence of VGAM1093 RNA, herein designated VGAM RNA, also designated SEQ ID:3804.

Another function of VGAM1093 is therefore inhibition of KIAA0853 (Accession NM_015070). Accordingly, utilities of VGAM1093 include diagnosis, prevention and treatment of diseases and clinical conditions associated with KIAA0853. MGC13071 (Accession NM_032689) is another VGAM1093 host target gene. MGC13071 BINDING SITE is HOST TARGET binding site found in the 3' untranslated region of mRNA encoded by MGC13071, corresponding to a HOST TARGET binding site such as BINDING SITE I, BINDING SITE II or BINDING SITE III. Table 2 illustrates the complementarity of the nucleotide sequences of MGC13071 BINDING SITE, designated SEQ ID:26408, to the nucleotide sequence of VGAM1093 RNA, herein designated VGAM RNA, also designated SEQ ID:3804.

Another function of VGAM1093 is therefore inhibition of MGC13071 (Accession NM_032689). Accordingly, utilities of VGAM1093 include diagnosis, prevention and treatment of diseases and clinical conditions associated with MGC13071. Neuronal Guanine Nucleotide Exchange Factor (NGEF, Accession XM_044799) is another VGAM1093 host target gene. NGEF BINDING SITE is HOST TARGET binding site found in the 5' untranslated region of mRNA encoded by NGEF, corresponding to a HOST TARGET binding site such as BINDING SITE I, BINDING SITE II or BINDING SITE III. Table 2 illustrates the complementarity of the nucleotide sequences of NGEF BINDING SITE, designated SEQ ID:34278, to the nucleotide sequence of VGAM1093 RNA, herein designated VGAM RNA, also designated SEQ ID:3804.

Another function of VGAM1093 is therefore inhibition of Neuronal Guanine Nucleotide Exchange Factor (NGEF, Accession XM_044799). Accordingly, utilities of VGAM1093 include diagnosis, prevention and treatment of diseases and clinical conditions associated with NGEF. Polymerase (RNA) II (DNA directed) Polypeptide D (POLR2D, Accession NM_004805) is another VGAM1093 host target gene. POLR2D BINDING SITE is HOST TARGET binding site found in the 3' untranslated region of mRNA encoded by POLR2D, corresponding to a HOST TARGET binding site such as BINDING SITE I, BINDING SITE II or BINDING SITE III. Table 2 illustrates the complementarity of the nucleotide sequences of POLR2D BINDING SITE, designated SEQ ID:11227, to the nucleotide sequence of VGAM1093 RNA, herein designated VGAM RNA, also designated SEQ ID:3804.

Another function of VGAM1093 is therefore inhibition of Polymerase (RNA) II (DNA directed) Polypeptide D (POLR2D, Accession NM_004805). Accordingly, utilities of VGAM1093 include diagnosis, prevention and treatment of diseases and clinical conditions associated with POLR2D. Wiskott-Aldrich Syndrome-like (WASL, Accession NM_003941) is another VGAM1093 host target gene. WASL BINDING SITE is HOST TARGET binding site found in the 5" untranslated region of mRNA encoded by WASL, corresponding to a HOST TARGET binding site such as BINDING SITE I, BINDING SITE II or BINDING SITE III. Table 2 illustrates the complementarity of the nucleotide sequences of WASL BINDING SITE, designated SEQ ID:10051, to the nucleotide sequence of VGAM1093 RNA, herein designated VGAM RNA, also designated SEQ ID:3804.

Another function of VGAM1093 is therefore inhibition of Wiskott-Aldrich Syndrome-like (WASL, Accession NM_003941). Accordingly, utilities of VGAM1093 include diagnosis, prevention and treatment of diseases and clinical conditions associated with WASL. LOC151512 (Accession XM_098072) is another VGAM1093 host target gene. LOC151512 BINDING SITE is HOST TARGET binding site found in the 5' untranslated region of mRNA encoded by LOC151512, corresponding to a HOST TARGET binding site such as BINDING SITE I, BINDING SITE II or BINDING SITE III. Table 2 illustrates the complementarity of the nucleotide sequences of LOC151512 BINDING SITE, designated SEQ ID:41362, to the nucleotide sequence of VGAM1093 RNA, herein designated VGAM RNA, also designated SEQ ID:3804.

Another function of VGAM1093 is therefore inhibition of LOC151512 (Accession XM_098072). Accordingly, utilities of VGAM1093 include diagnosis, prevention and treatment of diseases and clinical conditions associated with LOC151512. LOC153277 (Accession XM_098346) is another VGAM1093 host target gene. LOC153277 BINDING SITE is HOST TARGET binding site found in the 3' untranslated region of mRNA encoded by LOC153277, corresponding to a HOST TARGET binding site such as BINDING SITE I, BINDING SITE II or BINDING SITE III. Table 2 illustrates the complementarity of the nucleotide sequences of LOC153277 BINDING SITE, designated SEQ ID:41605, to the nucleotide sequence of VGAM1093 RNA, herein designated VGAM RNA, also designated SEQ ID:3804.

Another function of VGAM1093 is therefore inhibition of LOC153277 (Accession XM_098346). Accordingly, utilities of VGAM1093 include diagnosis, prevention and treatment of diseases and clinical conditions associated with LOC153277. FIG. 1 further provides a conceptual description of a novel bioinformatically detected viral gene of the present invention, referred to here as Viral Genomic Address Messenger 1094 (VGAM1094) viral gene, which modulates expression of respective host target genes thereof, the function and utility of which host target genes is known in the art.

VGAM1094 is a novel bioinformatically detected regulatory, non protein coding, viral micro RNA (miRNA) gene. The method by which VGAM1094 was detected is described hereinabove with reference to FIGS. 1-8.

VGAM1094 gene, herein designated VGAM GENE, is a viral gene contained in the genome of Poinsettia Mosaic Virus. VGAM1094 host target gene, herein designated VGAM HOST TARGET GENE, is a human gene contained in the human genome.

VGAM1094 gene encodes a VGAM1094 precursor RNA, herein designated VGAM PRECURSOR RNA. Similar to other miRNA genes, and unlike most ordinary genes, VGAM1094 precursor RNA does not encode a protein. A nucleotide sequence identical or highly similar to the nucleotide sequence of VGAM1094 precursor RNA is designated SEQ ID:1080, and is provided hereinbelow with reference to the sequence listing part. Nucleotide sequence SEQ ID:1080 is located at position 5436 relative to the genome of Poinsettia Mosaic Virus.

VGAM1094 precursor RNA folds onto itself, forming VGAM1094 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1094 folded precursor RNA into VGAM1094 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1094 RNA is designated SEQ ID:3805, and is provided hereinbelow with reference to the sequence listing part.

VGAM1094 host target gene, herein designated VGAM HOST TARGET GENE, encodes a corresponding messenger RNA, VGAM1094 host target RNA, herein designated VGAM HOST TARGET RNA. VGAM1094 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1094 RNA, herein designated VGAM RNA, binds complementarily to one or more host target binding sites located in untranslated regions of VGAM1094 host target RNA, herein designated VGAM HOST TARGET RNA. This complementary binding is due to the fact that the nucleotide sequence of VGAM1094 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1094 RNA, herein designated VGAM RNA, may have a different number of host target binding sites in untranslated regions of a VGAM1094 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1094 RNA, herein designated VGAM RNA, to host target binding sites on VGAM1094 host target RNA, herein designated VGAM HOST TARGET RNA, such as BINDING SITE I, BINDING SITE II and BINDING SITE III, inhibits translation of VGAM1094 host target RNA into VGAM1094 host target protein, herein designated VGAM HOST TARGET PROTEIN. VGAM host target protein is therefore outlined by a broken line.

It is appreciated that VGAM1094 host target gene, herein designated VGAM HOST TARGET GENE, in fact represents a plurality of VGAM1094 host target genes. The mRNA of each one of this plurality of VGAM1094 host target genes comprises one or more host target binding sites, each having a nucleotide sequence which is at least partly complementary to VGAM1094 RNA, herein designated VGAM RNA, and which when bound by VGAM1094 RNA causes inhibition of translation of respective one or more VGAM1094 host target proteins.

It is further appreciated by one skilled in the art that the mode of translational inhibition illustrated by FIG. 1 with specific reference to translational inhibition exerted by VGAM1094 gene, herein designated VGAM GENE, on one or more VGAM1094 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1094 is inhibition of expression of host target genes, as part of a novel viral mechanism of attacking a host. Accordingly, utilities of VGAM1094 include diagnosis, prevention and treatment of viral infection by Poinsettia Mosaic Virus. Specific functions, and accordingly utilities, of VGAM1094 correlate with, and may be deduced from, the identity of the host target genes which VGAM1094 binds and inhibits, and the function of these host target genes, as elaborated hereinbelow.

Nucleotide sequences of the VGAM1094 precursor RNA, herein designated VGAM PRECURSOR RNA, and of the 'diced' VGAM1094 RNA, herein designated VGAM RNA, and a schematic representation of the secondary folding of VGAM1094 folded precursor RNA, herein designated VGAM FOLDED PRECURSOR RNA, of VGAM1094 are further described hereinbelow with reference to Table 1.

Nucleotide sequences of host target binding sites, such as BINDING SITE-I, BINDING SITE-II and BINDING SITE-III of FIG. 1, found on VGAM1094 host target RNA, and schematic representation of the complementarity of each of these host target binding sites to VGAM1094 RNA, herein designated VGAM RNA, are described hereinbelow with reference to Table 2.

As mentioned hereinabove with reference to FIG. 1, a function of VGAM1094 gene, herein designated VGAM is inhibition of expression of VGAM1094 target genes. It is appreciated that specific functions, and accordingly utilities, of VGAM1094 correlate with, and may be deduced from, the identity of the target genes which VGAM1094 binds and inhibits, and the function of these target genes, as elaborated hereinbelow.

LOC153937 (Accession XM_087813) is a VGAM1094 host target gene. LOC153937 BINDING SITE is HOST TARGET binding site found in the 5' untranslated region of mRNA encoded by LOC153937, corresponding to a HOST TARGET binding site such as BINDING SITE I, BINDING SITE II or BINDING SITE III. Table 2 illustrates the complementarity of the nucleotide sequences of LOC153937 BINDING SITE, designated SEQ ID:39443, to the nucleotide sequence of VGAM1094 RNA, herein designated VGAM RNA, also designated SEQ ID:3805.

A function of VGAM1094 is therefore inhibition of LOC153937 (Accession XM_087813). Accordingly, utilities of VGAM1094 include diagnosis, prevention and treatment of diseases and clinical conditions associated with LOC153937. FIG. 1 further provides a conceptual description of a novel bioinformatically detected viral gene of the present invention, referred to here as Viral Genomic Address Messenger 1095 (VGAM1095) viral gene, which modulates expression of respective host target genes thereof, the function and utility of which host target genes is known in the art.

VGAM1095 is a novel bioinformatically detected regulatory, non protein coding, viral micro RNA (miRNA) gene. The method by which VGAM1095 was detected is described hereinabove with reference to FIGS. 1-8.

VGAM1095 gene, herein designated VGAM GENE, is a viral gene contained in the genome of Poinsettia Mosaic Virus. VGAM1095 host target gene, herein designated VGAM HOST TARGET GENE, is a human gene contained in the human genome.

VGAM1095 gene encodes a VGAM1095 precursor RNA, herein designated VGAM PRECURSOR RNA. Similar to other miRNA genes, and unlike most ordinary genes, VGAM1095 precursor RNA does not encode a protein. A nucleotide sequence identical or highly similar to the nucleotide sequence of VGAM1095 precursor RNA is designated SEQ ID:1081, and is provided hereinbelow with reference to the sequence listing part. Nucleotide sequence SEQ ID:1081 is located at position 973 relative to the genome of Poinsettia Mosaic Virus.

VGAM1095 precursor RNA folds onto itself, forming VGAM1095 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1095 folded precursor RNA into VGAM1095 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM1095 RNA is designated SEQ ID:3806, and is provided hereinbelow with reference to the sequence listing part.

VGAM1095 host target gene, herein designated VGAM HOST TARGET GENE, encodes a corresponding messenger RNA, VGAM1095 host target RNA, herein designated VGAM HOST TARGET RNA. VGAM1095 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1095 RNA, herein designated VGAM RNA, binds complementarily to one or more host target binding sites located in untranslated regions of VGAM1095 host target RNA, herein designated VGAM HOST TARGET RNA. This complementary binding is due to the fact that the nucleotide sequence of VGAM1095 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1095 RNA, herein designated VGAM RNA, may have a different number of host target binding sites in untranslated regions of a VGAM1095 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1095 RNA, herein designated VGAM RNA, to host target binding sites on VGAM1095 host target RNA, herein designated VGAM HOST TARGET RNA, such as BINDING SITE I, BINDING SITE II and BINDING SITE III, inhibits translation of VGAM1095 host target RNA into VGAM1095 host target protein, herein designated VGAM HOST TARGET PROTEIN. VGAM host target protein is therefore outlined by a broken line.

It is appreciated that VGAM1095 host target gene, herein designated VGAM HOST TARGET GENE, in fact represents a plurality of VGAM1095 host target genes. The mRNA of each one of this plurality of VGAM1095 host target genes comprises one or more host target binding sites, each having a nucleotide sequence which is at least partly complementary to VGAM1095 RNA, herein designated VGAM RNA, and which when bound by VGAM1095 RNA causes inhibition of translation of respective one or more VGAM1095 host target proteins.

It is further appreciated by one skilled in the art that the mode of translational inhibition illustrated by FIG. 1 with specific reference to translational inhibition exerted by VGAM1095 gene, herein designated VGAM GENE, on one or more VGAM1095 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1095 is inhibition of expression of host target genes, as part of a novel viral mechanism of attacking a host. Accordingly, utilities of VGAM1095 include diagnosis, prevention and treatment of viral infection by Poinsettia Mosaic Virus. Specific functions, and accordingly utilities, of VGAM1095 correlate with, and may be deduced from, the identity of the host target genes which VGAM1095 binds and inhibits, and the function of these host target genes, as elaborated hereinbelow.

Nucleotide sequences of the VGAM1095 precursor RNA, herein designated VGAM PRECURSOR RNA, and of the 'diced' VGAM1095 RNA, herein designated VGAM RNA, and a schematic representation of the secondary folding of VGAM1095 folded precursor RNA, herein designated VGAM FOLDED PRECURSOR RNA, of VGAM1095 are further described hereinbelow with reference to Table 1.

Nucleotide sequences of host target binding sites, such as BINDING SITE-I, BINDING SITE-II and BINDING SITE-III of FIG. 1, found on VGAM1095 host target RNA, and schematic representation of the complementarity of each of these host target binding sites to VGAM1095 RNA, herein designated VGAM RNA, are described hereinbelow with reference to Table 2.

As mentioned hereinabove with reference to FIG. 1, a function of VGAM1095 gene, herein designated VGAM is inhibition of expression of VGAM1095 target genes. It is appreciated that specific functions, and accordingly utilities, of VGAM1095 correlate with, and may be deduced from, the identity of the target genes which VGAM1095 binds and inhibits, and the function of these target genes, as elaborated hereinbelow.

Amiloride-sensitive Cation Channel 1, Neuronal (degenerin) (ACCN1, Accession NM_001094) is a VGAM1095 host target gene. ACCN1 BINDING SITE is HOST TARGET binding site found in the 3' untranslated region of mRNA encoded by ACCN1, corresponding to a HOST TARGET binding site such as BINDING SITE I, BINDING SITE II or BINDING SITE III. Table 2 illustrates the complementarity of the nucleotide sequences of ACCN1 BINDING SITE, designated SEQ ID:6753, to the nucleotide sequence of VGAM1095 RNA, herein designated VGAM RNA, also designated SEQ ID:3806.

A function of VGAM1095 is therefore inhibition of Amiloride-sensitive Cation Channel 1, Neuronal (degenerin) (ACCN1, Accession NM_001094), a gene which non-voltage-gated amiloride-sensitive cation channel permeable for sodium, potassium and lithium. Accordingly, utilities of VGAM1095 include diagnosis, prevention and treatment of diseases and clinical conditions associated with ACCN1. The function of ACCN1 has been established by previous studies. Price et al. (1996) cloned a novel cDNA encoding a nonvoltage-dependent sodium channel from human brain, which they termed BNC1 for 'brain Na+ channel 1.' BNC1 has some sequence similarity to members of a family of amiloride-sensitive sodium channels that includes the mammalian epithelial Na+ channel (OMIM Ref. No. 600228). However, among other dissimilarities, BNC1 channel activity does not increase when it is coexpressed with other cloned subunits of the family. Thus, Price et al. (1996) considered BNC1 to be the first cloned member of a new subfamily of mammalian Na+ channels. Northern blot analysis revealed that the gene is expressed as 2.7- and 3.7-kb transcripts in brain and spinal cord tissues only. Price et al. (1996) suggested that BNC1 may play a novel role in neurotransmission. Animal model experiments lend further support to the function of ACCN1. Price et al. (2000) generated mice deficient in Bnc1 by targeted disruption. Bnc1 -/- mice had markedly reduced sensitivity of a specific component of mechanosensation: low-threshold rapidly adapting mechanoreceptors.

It is appreciated that the abovementioned animal model for ACCN1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Price, M. P.; Snyder, P. M.; Welsh, M. J.: Cloning and expression of a novel human brain Na+ channel. J. Biol. Chem. 271:7879-7882, 1996; and Price, M. P.; Lewin, G. R.; Mcllwrath, S. L.; Cheng, C.; Xie, J.; Heppenstall, P. A.; Stucky, C. L.; Mannsfeldt, A. G.; Brennan, T. J.; Drummond, H. A.; Qiao, J.; Benson, C. J.; Tarr, D.

Further studies establishing the function and utilities of ACCN1 are found in John Hopkins OMIM database record ID 601784, and in sited publications numbered 1251-1255 listed in the bibliography section hereinbelow, which are also hereby incorporated by reference. Dystroglycan 1 (dystrophin-associated glycoprotein 1) (DAG1, Accession NM_004393) is another VGAM1095 host target gene. DAG1 BINDING SITE is HOST TARGET binding site found in the 3' untranslated region of mRNA encoded by DAG1, corresponding to a HOST TARGET binding site such as BINDING SITE I, BINDING SITE II or BINDING SITE III. Table 2 illustrates the complementarity of the nucleotide sequences of DAG1 BINDING SITE, designated SEQ ID:10636, to the nucleotide sequence of VGAM1095 RNA, herein designated VGAM RNA, also designated SEQ ID:3806.

Another function of VGAM1095 is therefore inhibition of Dystroglycan 1 (dystrophin-associated glycoprotein 1) (DAG1, Accession NM_004393), a gene which may provide linkage between the sarcolemma and extracellular matrix (ECM). Accordingly, utilities of VGAM1095 include diagnosis, prevention and treatment of diseases and clinical conditions associated with DAG1. The function of DAG1 has been established by previous studies. Ibraghimov-Beskrovnaya et al. (1992) demonstrated that the transmembrane 43-kD and extracellular 156-kD dystrophin (OMIM Ref. No. 300377)-associated glycoproteins are encoded by a single messenger RNA and that the extracellular 156-kD DAG binds laminin. Thus, the 156-kD DAG is a laminin-binding glycoprotein that may provide linkage between the sarcolemma and extracellular matrix (ECM). The dramatic reduction in the 156K DAG in Duchenne muscular dystrophy (OMIM Ref. No. 310200) led to a loss of linkage between the sarcolemma and extracellular matrix, rendering muscle fibers more susceptible to necrosis. Ibraghimov-Beskrovnaya et al. (1992, 1992, 1993) mapped the DAG gene to chromosome 3 by Southern blot analysis of human/Chinese hamster somatic cell hybrid DNAs. One hybrid cell line with an isochromosome 3q was negative, suggesting location of the gene on 3p. The regional assignment was confirmed and further refined by fluorescence in situ hybridization, the localization being 3p21. The coding sequence of the DAG1 gene is organized into 2 exons, separated by a large intron (Ibraghimov-Beskrovnaya et al., 1993). The predicted amino acid sequence of human and rabbit dystroglycan are 93% identical, with predicted glycosylation sites being conserved. Human dystroglycan is expressed in a variety of fetal and adult tissues. The muscle and nonmuscle isoforms of dystroglycan differ by carbohydrate moieties but not protein sequence. Using PCR, immunohistochemistry, and immunoblotting to analyze samples from patients with Fukuyama congenital muscular dystrophy (FCMD; 253800), Hayashi et al. (2001) confirmed a deficiency of fukutin and found marked deficiency of highly glycosylated DAG1 in skeletal and cardiac muscle and reduced amounts of DAG1 in brain tissue. Beta-dystroglycan was normal in all tissues examined. These findings supported the suggestion that fukutin deficiency affects the modification of glycosylation of DAG1, which then cannot localize or function properly and may be degraded or eluted from the extracellular surface membrane of the muscle fiber. Hayashi et al. (2001) concluded that this disruption underlies the developmental, structural, and functional damage to muscles in patients with FCMD. Animal model experiments lend further support to the function of DAG1. Cohn et al. (2002) found that striated muscle-specific disruption of the Dag1 gene in mice resulted in loss of the dystrophin-glycoprotein complex in differentiated muscle and a remarkably mild muscular dystrophy with hypertrophy and without tissue fibrosis. They found that satellite cells, expressing dystroglycan, supported continued efficient regeneration of skeletal muscle along with transient expression of dystroglycan in regenerating muscle fibers. Cohn et al. (2002) demonstrated a similar phenomenon of reexpression of functional dystroglycan in regenerating muscle fibers in a mild form of human muscular dystrophy caused by disruption of posttranslational dystroglycan processing. They concluded that maintenance of regenerative capacity by satellite cells expressing dystroglycan is likely responsible for mild disease progression in mice and possibly human S. Cohn et al. (2002) suggested that inadequate repair of skeletal muscle by satellite cells represents an important mechanism affecting the pathogenesis of muscular dystrophy.

It is appreciated that the abovementioned animal model for DAG1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ibraghimov-Beskrovnaya, O.; Ervasti, J. M.; Leveille, C. J.; Slaughter, C. A.; Sernett, S. W.; Campbell, K. P.: Primary structure of dystrophin-associated glycoproteins linking dystrophin to the extracellular matrix. Nature 355:696-702, 1992; and Hayashi, Y. K.; Ogawa, M.; Tagawa, K.; Noguchi, S.; Ishihara, T.; Nonaka, I.; Arahata, K.: Selective deficiency of alpha-dystroglycan in Fukuyama-type congenital muscular dystrophy. N.

Further studies establishing the function and utilities of DAG1 are found in John Hopkins OMIM database record ID 128239, and in sited publications numbered 4568-4570, 4604, 4615-4628, 4612-4613, 4608-461 and 4614 listed in the bibliography section hereinbelow, which are also hereby incorporated by reference. FYVE and Coiled-coil Domain Containing 1 (FYCO1, Accession NM_024513) is another VGAM1095 host target gene. FYCO1 BINDING SITE is HOST TARGET binding site found in the 3' untranslated region of mRNA encoded by FYCO1, corresponding to a HOST TARGET binding site such as BINDING SITE I, BINDING SITE II or BINDING SITE III. Table 2 illustrates the complementarity of the nucleotide sequences of FYCO1 BINDING SITE, designated SEQ ID:23714, to the nucleotide sequence of VGAM1095 RNA, herein designated VGAM RNA, also designated SEQ ID:3806.

Another function of VGAM1095 is therefore inhibition of FYVE and Coiled-coil Domain Containing 1 (FYCO1, Accession NM_024513). Accordingly, utilities of VGAM1095 include diagnosis, prevention and treatment of diseases and clinical conditions associated with FYCO1. SEPT6 (Accession NM_015129) is another VGAM1095 host target gene. SEPT6 BINDING SITE is HOST TARGET binding site found in the 3' untranslated region of mRNA encoded by SEPT6, corresponding to a HOST TARGET binding site such as BINDING SITE I, BINDING SITE II or BINDING SITE III. Table 2 illustrates the complementarity of the nucleotide sequences of SEPT6 BINDING SITE, designated SEQ ID:17494, to the nucleotide sequence of VGAM1095 RNA, herein designated VGAM RNA, also designated SEQ ID:3806.

Another function of VGAM1095 is therefore inhibition of SEPT6 (Accession NM_015129). Accordingly, utilities of VGAM1095 include diagnosis, prevention and treatment of diseases and clinical conditions associated with SEPT6. LOC91445 (Accession XM_018516) is another VGAM1095 host target gene. LOC91445 BINDING SITE is HOST TARGET binding site found in the 3' untranslated region of mRNA encoded by LOC91445, corresponding to a HOST TARGET binding site such as BINDING SITE I, BINDING SITE II or BINDING SITE III. Table 2 illustrates the complementarity of the nucleotide sequences of LOC91445 BINDING SITE, designated SEQ ID:30371, to the nucleotide sequence of VGAM1095 RNA, herein designated VGAM RNA, also designated SEQ ID:3806.

Another function of VGAM1095 is therefore inhibition of LOC91445 (Accession XM_018516). Accordingly, utilities of VGAM1095 include diagnosis, prevention and treatment of diseases and clinical conditions associated with LOC91445. FIG. 1 further provides a conceptual description of a novel bioinformatically detected viral gene of the present invention, referred to here as Viral Genomic Address Messenger 1096 (VGAM1096) viral gene, which modulates expression of respective host target genes thereof, the function and utility of which host target genes is known in the art.

VGAM1096 is a novel bioinformatically detected regulatory, non protein coding, viral micro RNA (miRNA) gene. The method by which VGAM1096 was detected is described hereinabove with reference to FIGS. 1-8.

VGAM1096 gene, herein designated VGAM GENE, is a viral gene contained in the genome of Strawberry Mottle Virus. VGAM1096 host target gene, herein designated VGAM HOST TARGET GENE, is a human gene contained in the human genome.

VGAM1096 gene encodes a VGAM1096 precursor RNA, herein designated VGAM PRECURSOR RNA. Similar to other miRNA genes, and unlike most ordinary genes, VGAM1096 precursor RNA does not encode a protein. A nucleotide sequence identical or highly similar to the nucleotide sequence of VGAM1096 precursor RNA is designated SEQ ID:1082, and is provided hereinbelow with reference to the sequence listing part. Nucleotide sequence SEQ ID:1082 is located at position 4444 relative to the genome of Strawberry Mottle Virus.

VGAM1096 precursor RNA folds onto itself, forming VGAM1096 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1096 folded precursor RNA into VGAM1096 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 42%) nucleotide sequence of VGAM1096 RNA is designated SEQ ID:3807, and is provided hereinbelow with reference to the sequence listing part.

VGAM1096 host target gene, herein designated VGAM HOST TARGET GENE, encodes a corresponding messenger RNA, VGAM1096 host target RNA, herein designated VGAM HOST TARGET RNA. VGAM1096 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1096 RNA, herein designated VGAM RNA, binds complementarily to one or more host target binding sites located in untranslated regions of VGAM1096 host target RNA, herein designated VGAM HOST TARGET RNA. This complementary binding is due to the fact that the nucleotide sequence of VGAM1096 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1096 RNA, herein designated VGAM RNA, may have a different number of host target binding sites in untranslated regions of a VGAM1096 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1096 RNA, herein designated VGAM RNA, to host target binding sites on VGAM1096 host target RNA, herein designated VGAM HOST TARGET RNA, such as BINDING SITE I, BINDING SITE II and BINDING SITE III, inhibits translation of VGAM1096 host target RNA into VGAM1096 host target protein, herein designated VGAM HOST TARGET PROTEIN. VGAM host target protein is therefore outlined by a broken line.

It is appreciated that VGAM1096 host target gene, herein designated VGAM HOST TARGET GENE, in fact represents a plurality of VGAM1096 host target genes. The mRNA of each one of this plurality of VGAM1096 host target genes comprises one or more host target binding sites, each having a nucleotide sequence which is at least partly complementary to VGAM1096 RNA, herein designated VGAM RNA, and which when bound by VGAM1096 RNA causes inhibition of translation of respective one or more VGAM1096 host target proteins.

It is further appreciated by one skilled in the art that the mode of translational inhibition illustrated by FIG. 1 with specific reference to translational inhibition exerted by VGAM1096 gene, herein designated VGAM GENE, on one or more VGAM1096 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1096 is inhibition of expression of host target genes, as part of a novel viral mechanism of attacking a host. Accordingly, utilities of VGAM1096 include diagnosis, prevention and treatment of viral infection by Strawberry Mottle Virus. Specific functions, and accordingly utilities, of VGAM1096 correlate with, and may be deduced from, the identity of the host target genes which VGAM1096 binds and inhibits, and the function of these host target genes, as elaborated hereinbelow.

Nucleotide sequences of the VGAM1096 precursor RNA, herein designated VGAM PRECURSOR RNA, and of the 'diced' VGAM1096 RNA, herein designated VGAM RNA, and a schematic representation of the secondary folding of VGAM1096 folded precursor RNA, herein designated VGAM FOLDED PRECURSOR RNA, of VGAM1096 are further described hereinbelow with reference to Table 1.

Nucleotide sequences of host target binding sites, such as BINDING SITE-I, BINDING SITE-II and BINDING SITE-III of FIG. 1, found on VGAM1096 host target RNA, and schematic representation of the complementarity of each of these host target binding sites to VGAM1096 RNA, herein designated VGAM RNA, are described hereinbelow with reference to Table 2.

As mentioned hereinabove with reference to FIG. 1, a function of VGAM1096 gene, herein designated VGAM is inhibition of expression of VGAM1096 target genes. It is appreciated that specific functions, and accordingly utilities, of VGAM1096 correlate with, and may be deduced from, the identity of the target genes which VGAM1096 binds and inhibits, and the function of these target genes, as elaborated hereinbelow.

ADP-ribosylation Factor 1 (ARF1, Accession XM_047545) is a VGAM1096 host target gene. ARF1 BINDING SITE is HOST TARGET binding site found in the 3' untranslated region of mRNA encoded by ARF1, corresponding to a HOST TARGET binding site such as BINDING SITE I, BINDING SITE II or BINDING SITE III. Table 2 illustrates the complementarity of the nucleotide sequences of ARF1 BINDING SITE, designated SEQ ID:34994, to the nucleotide sequence of VGAM1096 RNA, herein designated VGAM RNA, also designated SEQ ID:3807.

A function of VGAM1096 is therefore inhibition of ADP-ribosylation Factor 1 (ARF1, Accession XM_047545). Accordingly, utilities of VGAM1096 include diagnosis, prevention and treatment of diseases and clinical conditions associated with ARF1. Chromodomain Helicase DNA Binding Protein 2 (CHD2, Accession NM_001271) is another VGAM1096 host target gene. CHD2 BINDING SITE is HOST TARGET binding site found in the 3' untranslated region of mRNA encoded by CHD2, corresponding to a HOST TARGET binding site such as BINDING SITE I, BINDING SITE II or BINDING SITE III. Table 2 illustrates the complementarity of the nucleotide sequences of CHD2 BINDING SITE, designated SEQ ID:6934, to the nucleotide sequence of VGAM1096 RNA, herein designated VGAM RNA, also designated SEQ ID:3807.

Another function of VGAM1096 is therefore inhibition of Chromodomain Helicase DNA Binding Protein 2 (CHD2, Accession NM_001271). Accordingly, utilities of VGAM1096 include diagnosis, prevention and treatment of diseases and clinical conditions associated with CHD2. Integrin, Alpha 4 (antigen CD49D, alpha 4 subunit of VLA-4 receptor) (ITGA4, Accession NM_000885) is another VGAM1096 host target gene. ITGA4 BINDING SITE is HOST TARGET binding site found in the 3' untranslated region of mRNA encoded by ITGA4, corresponding to a HOST TARGET binding site such as BINDING SITE I, BINDING SITE II or BINDING SITE III. Table 2 illustrates the complementarity of the nucleotide sequences of ITGA4 BINDING SITE, designated SEQ ID:6584, to the nucleotide sequence of VGAM1096 RNA, herein designated VGAM RNA, also designated SEQ ID:3807.

Another function of VGAM1096 is therefore inhibition of Integrin, Alpha 4 (antigen CD49D, alpha 4 subunit of VLA-4 receptor) (ITGA4, Accession NM_000885), a gene which recognizes one or more domains within the alternatively spliced cs-1 and cs-5 regions of fibronectin. Accordingly, utilities of VGAM1096 include diagnosis, prevention and treatment of diseases and clinical conditions associated with ITGA4. The function of ITGA4 has been established by previous studies. integrin family includes cell surface receptors for extracellular matrix components as well as receptors involved in various aspects of leukocyte adhesion. The integrins generally consist of alpha-beta heterodimeric transmembrane glycoproteins in which the alpha subunit is noncovalently associated with the beta subunit. Three major subfamilies of integrins have been defined, each containing a common beta subunit that can be associated with multiple alpha subunits. Two sets of integrins have been reported on lymphoid and myeloid cells. The first set, including LFA-1 (see OMIM Ref. No. 153370), Mac-1 (OMIM Ref. No. 120980), and p150,95 (OMIM Ref. No. 151510), represents the molecules that are exclusively expressed on leukocytes. The second set, the VLA antigens, are not restricted to leukocytes because nearly all of the cell types, except granulocytes and red blood cells, express them. They consist of at least 6 different chains that can associate with the same beta-1 subunit. These complexes are mainly involved in cell-matrix adhesive interactions. Within the VLA family, VLA4 is atypical because it participates not only in extracellular matrix adhesion as receptor for fibronectin but also as cell-cell adhesion receptor. Lu and Cyster (2002) studied the mechanisms that control localization of marginal zone B cells. They demonstrated that marginal zone B cells express elevated levels of the integrins LFA1 and alpha-4-beta-1 (see OMIM Ref. No. 135630), and that the marginal zone B cells bind to the ligands ICAM1 (OMIM Ref. No. 147840) and VCAM1 (OMIM Ref. No. 192225). These ligands are expressed within the marginal zone in a lymphotoxin-dependent manner. Combined inhibition of LFA1 and alpha-4-beta-1 causes a rapid and selective release of B cells from the marginal zone. Furthermore, lipopolysaccharide-triggered marginal zone B cell relocalization involves down regulation of integrin-mediated adhesion. Lu and Cyster (2002) concluded that their studies identified key requirements for marginal zone B cell localization and established a role for integrins in peripheral lymphoid tissue compartmentalization.

Full details of the abovementioned studies are described in the following publications, the disclosure of which are hereby incorporated by reference:

Lu, T. T.; Cyster, J. G.: Integrin-mediated long-term B cell retention in the splenic marginal zone. Science 297:409-412, 2002; and Cunningham, S. A.; Rodriguez, J. M.; Arrate, M. P.; Tran, T. M.; Brock, T. A.: JAM2 interacts with alpha-4/beta-1: facilitation by JAM3. J. Biol. Chem. 277:27589-27592, 2002.

Further studies establishing the function and utilities of ITGA4 are found in John Hopkins OMIM database record ID 192975, and in sited publications numbered 1001 and 10017-10018 listed in the bibliography section hereinbelow, which are also hereby incorporated by reference. KIAA1319 (Accession NM_020770) is another VGAM1096 host target gene. KIAA1319 BINDING SITE is HOST TARGET binding site found in the 3' untranslated region of mRNA encoded by KIAA1319, corresponding to a HOST TARGET binding site such as BINDING SITE I, BINDING SITE II or BINDING SITE III. Table 2 illustrates the complementarity of the nucleotide sequences of KIAA1319 BINDING SITE, designated SEQ ID:21869, to the nucleotide sequence of VGAM1096 RNA, herein designated VGAM RNA, also designated SEQ ID:3807.

Another function of VGAM1096 is therefore inhibition of KIAA1319 (Accession NM_020770). Accordingly, utilities of VGAM1096 include diagnosis, prevention and treatment of diseases and clinical conditions associated with KIAA1319. KIAA1361 (Accession XM_030845) is another VGAM1096 host target gene. KIAA1361 BINDING SITE is HOST TARGET binding site found in the 5' untranslated region of mRNA encoded by KIAA1361, corresponding to a HOST TARGET binding site such as BINDING SITE I, BINDING SITE II or BINDING SITE III. Table 2 illustrates the complementarity of the nucleotide sequences of KIAA1361 BINDING SITE, designated SEQ ID:31171, to the nucleotide sequence of VGAM1096 RNA, herein designated VGAM RNA, also designated SEQ ID:3807.

Another function of VGAM1096 is therefore inhibition of KIAA1361 (Accession XM_030845). Accordingly, utilities of VGAM1096 include diagnosis, prevention and treatment of diseases and clinical conditions associated with KIAA1361. SH3 Domain Binding Glutamic Acid-rich Protein Like 2 (SH3BGRL2, Accession NM_031469) is another VGAM1096 host target gene. SH3BGRL2 BINDING SITE is HOST TARGET binding site found in the 3' untranslated region of mRNA encoded by SH3BGRL2, corresponding to a HOST TARGET binding site such as BINDING SITE I, BINDING SITE II or BINDING SITE III. Table 2 illustrates the complementarity of the nucleotide sequences of SH3BGRL2 BINDING SITE, designated SEQ ID:25533, to the nucleotide sequence of VGAM1096 RNA, herein designated VGAM RNA, also designated SEQ ID:3807.

Another function of VGAM1096 is therefore inhibition of SH3 Domain Binding Glutamic Acid-rich Protein Like 2 (SH3BGRL2, Accession NM_031469). Accordingly, utilities of VGAM1096 include diagnosis, prevention and treatment of diseases and clinical conditions associated with SH3BGRL2. LOC152008 (Accession XM_087363) is another VGAM1096 host target gene. LOC152008 BINDING SITE is HOST TARGET binding site found in the 3' untranslated region of mRNA encoded by LOC152008, corresponding to a HOST TARGET binding site such as BINDING SITE I, BINDING SITE II or BINDING SITE III. Table 2 illustrates the complementarity of the nucleotide sequences of LOC152008 BINDING SITE, designated SEQ ID:39197, to the nucleotide sequence of VGAM1096 RNA, herein designated VGAM RNA, also designated SEQ ID:3807.

Another function of VGAM1096 is therefore inhibition of LOC152008 (Accession XM_087363). Accordingly, utilities of VGAM1096 include diagnosis, prevention and treatment of diseases and clinical conditions associated with LOC152008. LOC57826 (Accession NM_021183) is another VGAM1096 host target gene. LOC57826 BINDING SITE is HOST TARGET binding site found in the 3' untranslated region of mRNA encoded by LOC57826, corresponding to a HOST TARGET binding site such as BINDING SITE I, BINDING SITE II or BINDING SITE III. Table 2 illustrates the complementarity of the nucleotide sequences of LOC57826 BINDING SITE, designated SEQ ID:22159, to the nucleotide sequence of VGAM1096 RNA, herein designated VGAM RNA, also designated SEQ ID:3807.

Another function of VGAM1096 is therefore inhibition of LOC57826 (Accession NM_021183). Accordingly, utilities of VGAM1096 include diagnosis, prevention and treatment of diseases and clinical conditions associated with LOC57826. LOC90333 (Accession XM_030958) is another VGAM1096 host target gene. LOC90333 BINDING SITE is HOST TARGET binding site found in the 3' untranslated region of mRNA encoded by LOC90333, corresponding to a HOST TARGET binding site such as BINDING SITE I, BINDING SITE II or BINDING SITE III. Table 2 illustrates the complementarity of the nucleotide sequences of LOC90333 BINDING SITE, designated SEQ ID:31220, to the nucleotide sequence of VGAM1096 RNA, herein designated VGAM RNA, also designated SEQ ID:3807.

Another function of VGAM1096 is therefore inhibition of LOC90333 (Accession XM_030958). Accordingly, utilities of VGAM1096 include diagnosis, prevention and treatment of diseases and clinical conditions associated with LOC90333. LOC90982 (Accession XM_035332) is another VGAM1096 host target gene. LOC90982 BINDING SITE is HOST TARGET binding site found in the 5' untranslated region of mRNA encoded by LOC90982, corresponding to a HOST TARGET binding site such as BINDING SITE I, BINDING SITE II or BINDING SITE III. Table 2 illustrates the complementarity of the nucleotide sequences of LOC90982 BINDING SITE, designated SEQ ID:32234, to the nucleotide sequence of VGAM1096 RNA, herein designated VGAM RNA, also designated SEQ ID:3807.

Another function of VGAM1096 is therefore inhibition of LOC90982 (Accession XM_035332). Accordingly, utilities of VGAM1096 include diagnosis, prevention and treatment of diseases and clinical conditions associated with LOC90982. FIG. 1 further provides a conceptual description of a novel bioinformatically detected viral gene of the present invention, referred to here as Viral Genomic Address Messenger 1097 (VGAM1097) viral gene, which modulates expression of respective host target genes thereof, the function and utility of which host target genes is known in the art.

VGAM1097 is a novel bioinformatically detected regulatory, non protein coding, viral micro RNA (miRNA) gene. The method by which VGAM1097 was detected is described hereinabove with reference to FIGS. 1-8.

VGAM1097 gene, herein designated VGAM GENE, is a viral gene contained in the genome of Strawberry Mottle Virus. VGAM1097 host target gene, herein designated VGAM HOST TARGET GENE, is a human gene contained in the human genome.

VGAM1097 gene encodes a VGAM1097 precursor RNA, herein designated VGAM PRECURSOR RNA. Similar to other miRNA genes, and unlike most ordinary genes, VGAM1097 precursor RNA does not encode a protein. A nucleotide sequence identical or highly similar to the nucleotide sequence of VGAM1097 precursor RNA is designated SEQ ID:1083, and is provided hereinbelow with reference to the sequence listing part. Nucleotide sequence SEQ ID:1083 is located at position 5799 relative to the genome of Strawberry Mottle Virus.

VGAM1097 precursor RNA folds onto itself, forming VGAM1097 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1097 folded precursor RNA into VGAM1097 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1097 RNA is designated SEQ ID:3808, and is provided hereinbelow with reference to the sequence listing part.

VGAM1097 host target gene, herein designated VGAM HOST TARGET GENE, encodes a corresponding messenger RNA, VGAM1097 host target RNA, herein designated VGAM HOST TARGET RNA. VGAM1097 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1097 RNA, herein designated VGAM RNA, binds complementarily to one or more host target binding sites located in untranslated regions of VGAM1097 host target RNA, herein designated VGAM HOST TARGET RNA. This complementary binding is due to the fact that the nucleotide sequence of VGAM1097 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1097 RNA, herein designated VGAM RNA, may have a different number of host target binding sites in untranslated regions of a VGAM1097 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1097 RNA, herein designated VGAM RNA, to host target binding sites on VGAM1097 host target RNA, herein designated VGAM HOST TARGET RNA, such as BINDING SITE I, BINDING SITE II and BINDING SITE III, inhibits translation of VGAM1097 host target RNA into VGAM1097 host target protein, herein designated VGAM HOST TARGET PROTEIN. VGAM host target protein is therefore outlined by a broken line.

It is appreciated that VGAM1097 host target gene, herein designated VGAM HOST TARGET GENE, in fact represents a plurality of VGAM1097 host target genes. The mRNA of each one of this plurality of VGAM1097 host target genes comprises one or more host target binding sites, each having a nucleotide sequence which is at least partly complementary to VGAM1097 RNA, herein designated VGAM RNA, and which when bound by VGAM1097 RNA causes inhibition of translation of respective one or more VGAM1097 host target proteins.

It is further appreciated by one skilled in the art that the mode of translational inhibition illustrated by FIG. 1 with specific reference to translational inhibition exerted by VGAM1097 gene, herein designated VGAM GENE, on one or more VGAM1097 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1097 is inhibition of expression of host target genes, as part of a novel viral mechanism of attacking a host. Accordingly, utilities of VGAM1097 include diagnosis, prevention and treatment of viral infection by Strawberry Mottle Virus. Specific functions, and accordingly utilities, of VGAM1097 correlate with, and may be deduced from, the identity of the host target genes which VGAM1097 binds and inhibits, and the function of these host target genes, as elaborated hereinbelow.

Nucleotide sequences of the VGAM1097 precursor RNA, herein designated VGAM PRECURSOR RNA, and of the 'diced' VGAM1097 RNA, herein designated VGAM RNA, and a schematic representation of the secondary folding of VGAM1097 folded precursor RNA, herein designated VGAM FOLDED PRECURSOR RNA, of VGAM1097 are further described hereinbelow with reference to Table 1.

Nucleotide sequences of host target binding sites, such as BINDING SITE-I, BINDING SITE-II and BINDING SITE-III of FIG. 1, found on VGAM1097 host target RNA, and schematic representation of the complementarity of each of these host target binding sites to VGAM1097 RNA, herein designated VGAM RNA, are described hereinbelow with reference to Table 2.

As mentioned hereinabove with reference to FIG. 1, a function of VGAM1097 gene, herein designated VGAM is inhibition of expression of VGAM1097 target genes. It is appreciated that specific functions, and accordingly utilities, of VGAM1097 correlate with, and may be deduced from, the identity of the target genes which VGAM1097 binds and inhibits, and the function of these target genes, as elaborated hereinbelow.

AAT1 (Accession XM_087415) is a VGAM1097 host target gene. AAT1 BINDING SITE is HOST TARGET binding site found in the 3' untranslated region of mRNA encoded by AAT1, corresponding to a HOST TARGET binding site such as BINDING SITE I, BINDING SITE II or BINDING SITE III. Table 2 illustrates the complementarity of the nucleotide sequences of AAT1 BINDING SITE, designated SEQ ID:39228, to the nucleotide sequence of VGAM1097 RNA, herein designated VGAM RNA, also designated SEQ ID:3808.

A function of VGAM1097 is therefore inhibition of AAT1 (Accession XM_087415), a gene which linkage between A1BG and Lutheran blood group . Accordingly, utilities of VGAM1097 include diagnosis, prevention and treatment of diseases and clinical conditions associated with AAT1. The function of AAT1 and its association with various diseases and clinical conditions, has been established by previous studies, as described hereinabove with reference to VGAM357. ACP33 (Accession NM_016630) is another VGAM1097 host target gene. ACP33 BINDING SITE is HOST TARGET binding site found in the 3' untranslated region of mRNA encoded by ACP33, corresponding to a HOST TARGET binding site such as BINDING SITE I, BINDING SITE II or BINDING SITE III. Table 2 illustrates the complementarity of the nucleotide sequences of ACP33 BINDING SITE, designated SEQ ID:18745, to the nucleotide sequence of VGAM1097 RNA, herein designated VGAM RNA, also designated SEQ ID:3808.

Another function of VGAM1097 is therefore inhibition of ACP33 (Accession NM_016630). Accordingly, utilities of VGAM1097 include diagnosis, prevention and treatment of diseases and clinical conditions associated with ACP33. FIG. 1 further provides a conceptual description of a novel bioinformatically detected viral gene of the present invention, referred to here as Viral Genomic Address Messenger 1098 (VGAM1098) viral gene, which modulates expression of respective host target genes thereof, the function and utility of which host target genes is known in the art.

VGAM1098 is a novel bioinformatically detected regulatory, non protein coding, viral micro RNA (miRNA) gene. The method by which VGAM1098 was detected is described hereinabove with reference to FIGS. 1-8.

VGAM1098 gene, herein designated VGAM GENE, is a viral gene contained in the genome of Strawberry Mottle Virus. VGAM1098 host target gene, herein designated VGAM HOST TARGET GENE, is a human gene contained in the human genome.

VGAM1098 gene encodes a VGAM1098 precursor RNA, herein designated VGAM PRECURSOR RNA. Similar to other miRNA genes, and unlike most ordinary genes, VGAM1098 precursor RNA does not encode a protein. A nucleotide sequence identical or highly similar to the nucleotide sequence of VGAM1098 precursor RNA is designated SEQ ID:1084, and is provided hereinbelow with reference to the sequence listing part. Nucleotide sequence SEQ ID:1084 is located at position 4573 relative to the genome of Strawberry Mottle Virus.

VGAM1098 precursor RNA folds onto itself, forming VGAM1098 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1098 folded precursor RNA into VGAM1098 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM1098 RNA is designated SEQ ID:3809, and is provided hereinbelow with reference to the sequence listing part.

VGAM1098 host target gene, herein designated VGAM HOST TARGET GENE, encodes a corresponding messenger RNA, VGAM1098 host target RNA, herein designated VGAM HOST TARGET RNA. VGAM1098 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1098 RNA, herein designated VGAM RNA, binds complementarily to one or more host target binding sites located in untranslated regions of VGAM1098 host target RNA, herein designated VGAM HOST TARGET RNA. This complementary binding is due to the fact that the nucleotide sequence of VGAM1098 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1098 RNA, herein designated VGAM RNA, may have a different number of host target binding sites in untranslated regions of a VGAM1098 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1098 RNA, herein designated VGAM RNA, to host target binding sites on VGAM1098 host target RNA, herein designated VGAM HOST TARGET RNA, such as BINDING SITE I, BINDING SITE II and BINDING SITE III, inhibits translation of VGAM1098 host target RNA into VGAM1098 host target protein, herein designated VGAM HOST TARGET PROTEIN. VGAM host target protein is therefore outlined by a broken line.

It is appreciated that VGAM1098 host target gene, herein designated VGAM HOST TARGET GENE, in fact represents a plurality of VGAM1098 host target genes. The mRNA of each one of this plurality of VGAM1098 host target genes comprises one or more host target binding sites, each having a nucleotide sequence which is at least partly complementary to VGAM1098 RNA, herein designated VGAM RNA, and which when bound by VGAM1098 RNA causes inhibition of translation of respective one or more VGAM1098 host target proteins.

It is further appreciated by one skilled in the art that the mode of translational inhibition illustrated by FIG. 1 with specific reference to translational inhibition exerted by VGAM1098 gene, herein designated VGAM GENE, on one or more VGAM1098 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1098 is inhibition of expression of host target genes, as part of a novel viral mechanism of attacking a host. Accordingly, utilities of VGAM1098 include diagnosis, prevention and treatment of viral infection by Strawberry Mottle Virus. Specific functions, and accordingly utilities, of VGAM1098 correlate with, and may be deduced from, the identity of the host target genes which VGAM1098 binds and inhibits, and the function of these host target genes, as elaborated hereinbelow.

Nucleotide sequences of the VGAM1098 precursor RNA, herein designated VGAM PRECURSOR RNA, and of the 'diced' VGAM1098 RNA, herein designated VGAM RNA, and a schematic representation of the secondary folding of VGAM1098 folded precursor RNA, herein designated VGAM FOLDED PRECURSOR RNA, of VGAM1098 are further described hereinbelow with reference to Table 1.

Nucleotide sequences of host target binding sites, such as BINDING SITE-I, BINDING SITE-II and BINDING SITE-III of FIG. 1, found on VGAM1098 host target RNA, and schematic representation of the complementarity of each of these host target binding sites to VGAM1098 RNA, herein designated VGAM RNA, are described hereinbelow with reference to Table 2.

As mentioned hereinabove with reference to FIG. 1, a function of VGAM1098 gene, herein designated VGAM is inhibition of expression of VGAM1098 target genes. It is appreciated that specific functions, and accordingly utilities, of VGAM1098 correlate with, and may be deduced from, the identity of the target genes which VGAM1098 binds and inhibits, and the function of these target genes, as elaborated hereinbelow.

Aryl-hydrocarbon Receptor Nuclear Translocator 2 (ARNT2, Accession NM_014862) is a VGAM1098 host target gene. ARNT2 BINDING SITE is HOST TARGET binding site found in the 3' untranslated region of mRNA encoded by ARNT2, corresponding to a HOST TARGET binding site such as BINDING SITE I, BINDING SITE II or BINDING SITE III. Table 2 illustrates the complementarity of the nucleotide sequences of ARNT2 BINDING SITE, designated SEQ ID:16938, to the nucleotide sequence of VGAM1098 RNA, herein designated VGAM RNA, also designated SEQ ID:3809.

A function of VGAM1098 is therefore inhibition of Aryl-hydrocarbon Receptor Nuclear Translocator 2 (ARNT2, Accession NM_014862), a gene which specifically recognizes the xenobiotic response element (xre). Accordingly, utilities of VGAM1098 include diagnosis, prevention and treatment of diseases and clinical conditions associated with ARNT2. The function of ARNT2 and its association with various diseases and clinical conditions, has been established by previous studies, as described hereinabove with reference to VGAM345. Solute Carrier Family 14 (urea transporter), Member 2 (SLC14A2, Accession NM_007163) is another VGAM1098 host target gene. SLC14A2 BINDING SITE is HOST TARGET binding site found in the 5' untranslated region of mRNA encoded by SLC14A2, corresponding to a HOST TARGET binding site such as BINDING SITE I, BINDING SITE II or BINDING SITE III. Table 2 illustrates the complementarity of the nucleotide sequences of SLC14A2 BINDING SITE, designated SEQ ID:14010, to the nucleotide sequence of VGAM1098 RNA, herein designated VGAM RNA, also designated SEQ ID:3809.

Another function of VGAM1098 is therefore inhibition of Solute Carrier Family 14 (urea transporter), Member 2 (SLC14A2, Accession NM_007163), a gene which is a renal urea transporter 2. Accordingly, utilities of VGAM1098 include diagnosis, prevention and treatment of diseases and clinical conditions associated with SLC14A2. The function of SLC14A2 and its association with various diseases and clinical conditions, has been established by previous studies, as described hereinabove with reference to VGAM74. Solute Carrier Family 6 (neurotransmitter transporter, creatine), Member 8 (SLC6A8, Accession NM_005629) is another VGAM1098 host target gene. SLC6A8 BINDING SITE is HOST TARGET binding site found in the 3' untranslated region of mRNA encoded by SLC6A8, corresponding to a HOST TARGET binding site such as BINDING SITE I, BINDING SITE II or BINDING SITE III. Table 2 illustrates the complementarity of the nucleotide sequences of SLC6A8 BINDING SITE, designated SEQ ID:12149, to the nucleotide sequence of VGAM1098 RNA, herein designated VGAM RNA, also designated SEQ ID:3809.

Another function of VGAM1098 is therefore inhibition of Solute Carrier Family 6 (neurotransmitter transporter, creatine), Member 8 (SLC6A8, Accession NM_005629). Accordingly, utilities of VGAM1098 include diagnosis, prevention and treatment of diseases and clinical conditions associated with SLC6A8. T-cell Lymphoma Invasion and Metastasis 1 (TIAM1, Accession NM_003253) is another VGAM1098 host target gene. TIAM1 BINDING SITE is HOST TARGET binding site found in the 5' untranslated region of mRNA encoded by TIAM1, corresponding to a HOST TARGET binding site such as BINDING SITE I, BINDING SITE II or BINDING SITE III. Table 2 illustrates the complementarity of the nucleotide sequences of TIAM1 BINDING SITE, designated SEQ ID:9260, to the nucleotide sequence of VGAM1098 RNA, herein designated VGAM RNA, also designated SEQ ID:3809.

Another function of VGAM1098 is therefore inhibition of T-cell Lymphoma Invasion and Metastasis 1 (TIAM1, Accession NM_003253), a gene which modulates the activity of Rho-like proteins and connects extracellular signals to cytoskeletal activities. Accordingly, utilities of VGAM1098 include diagnosis, prevention and treatment of diseases and clinical conditions associated with TIAM1. The function of TIAM1 has been established by previous studies. To identify genes involved in metastasis by insertional mutagenesis, Habets et al. (1994) infected mouse BW5147 T-lymphoma cells with Moloney murine leukemia virus, resulting in 5 to 20 proviral insertions per cell. By this 'proviral tagging' method, invasive variants were selected on monolayers of fibroblasts. Disrupting proviral insertions were found in these cells within the coding exons of a gene designated Tiam1 (T-cell lymphoma invasion and metastasis-1). Selected clones were also metastatic in nude mice, and transfection of a truncated Tiam1 cDNA into noninvasive cells transmitted the invasive phenotype. Northern blot analysis demonstrated highest expression in the brain and testis. The mouse cDNA was isolated from a brain library and shown to encode a 1,591-amino acid protein which is serine rich and has regions of similarity to the Dbl-homologous (DH) domain found in GDP-GTP exchangers. The protein sequence also contains a pleckstrin-homologous (PH) domain thought to be involved in protein-protein interactions. Habets et al. (1995) cloned the human TIAM1 cDNA from a brain library using the mouse cDNA as a probe. The human protein is 95% identical to the mouse homolog. The authors speculated that TIAM1 may function in cellular signaling by activation of a Rho-like GTPase that regulates the cytoskeletal organization. Animal model experiments lend further support to the function of TIAM1. Malliri et al. (2002) generated mice lacking Tiam1 and demonstrated that Tiam1 -/- mice are resistant to the development of RAS-induced skin tumors initiated with 7,12-dimethylbenzanthracene and promoted with 12-O-tetradecanoylphorbol-13-acetate. Moreover, the few tumors produced in Tiam1 -/- mice grew much slower than did tumors in wildtype mice. Tiam1-deficient primary embryonic fibroblasts were also resistant to Ras (V12)-induced focus formation. Analysis of Tiam1 heterozygotes indicated that both tumor initiation and promotion were dependent on the TIAM1 gene dose. Tiam1 deficiency was associated with increased apoptosis during initiation and with impeded proliferation during promotion. Although the number of tumors in Tiam1 -/- mice was small, a greater proportion progressed to malignancy, suggesting that Tiam1 deficiency promotes malignant conversion. Malliri et al. (2002) concluded that their studies identified RAC activator TIAM1 as a critical regulator of different aspects of Ras-induced tumor formation.

It is appreciated that the abovementioned animal model for TIAM1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Habets, G. G. M.; Scholtes, E. H. M.; Zuydgeest, D.; van der Kammen, R. A.; Stam, J. C.; Berns, A.; Collard, J. G.: Identification of an invasion-inducing gene, Tiam-1, that encodes a protein with homology to GDP-GTP exchangers for Rho-like proteins. Cell 77:537-549, 1994; and Malliri, A.; van der Kammen, R. A.; Clark, K.; van der Valk, M.; Michiels, F.; Collard, J. G.: Mice deficient in the Rac activator Tiam1 are resistant to Ras-induced skin tumours. Natur.

Further studies establishing the function and utilities of TIAM1 are found in John Hopkins OMIM database record ID 600687, and in sited publications numbered 9976-9980 listed in the bibliography section hereinbelow, which are also hereby incorporated by reference. ESDN (Accession NM_080927) is another VGAM1098 host target gene. ESDN BINDING SITE is HOST TARGET binding site found in the 3' untranslated region of mRNA encoded by ESDN, corresponding to a HOST TARGET binding site such as BINDING SITE I, BINDING SITE II or BINDING SITE III. Table 2 illustrates the complementarity of the nucleotide sequences of ESDN BINDING SITE, designated SEQ ID:28155, to the nucleotide sequence of VGAM1098 RNA, herein designated VGAM RNA, also designated SEQ ID:3809.

Another function of VGAM1098 is therefore inhibition of ESDN (Accession NM_080927). Accordingly, utilities of VGAM1098 include diagnosis, prevention and treatment of diseases and clinical conditions associated with ESDN. LIN-28 (Accession NM_024674) is another VGAM1098 host target gene. LIN-28 BINDING SITE is HOST TARGET binding site found in the 3' untranslated region of mRNA encoded by LIN-28, corresponding to a HOST TARGET binding site such as BINDING SITE I, BINDING SITE II or BINDING SITE III. Table 2 illustrates the complementarity of the nucleotide sequences of LIN-28 BINDING SITE, designated SEQ ID:23980, to the nucleotide sequence of VGAM1098 RNA, herein designated VGAM RNA, also designated SEQ ID:3809.

Another function of VGAM1098 is therefore inhibition of LIN-28 (Accession NM_024674). Accordingly, utilities of VGAM1098 include diagnosis, prevention and treatment of diseases and clinical conditions associated with LIN-28. Syntaphilin (SNPH, Accession NM_014723) is another VGAM1098 host target gene. SNPH BINDING SITE is HOST TARGET binding site found in the 3' untranslated region of mRNA encoded by SNPH, corresponding to a HOST TARGET binding site such as BINDING SITE I, BINDING SITE II or BINDING SITE III. Table 2 illustrates the complementarity of the nucleotide sequences of SNPH BINDING SITE, designated SEQ ID:16303, to the nucleotide sequence of VGAM1098 RNA, herein designated VGAM RNA, also designated SEQ ID:3809.

Another function of VGAM1098 is therefore inhibition of Syntaphilin (SNPH, Accession NM_014723). Accordingly, utilities of VGAM1098 include diagnosis, prevention and treatment of diseases and clinical conditions associated with SNPH. LOC146488 (Accession XM_047748) is another VGAM1098 host target gene. LOC146488 BINDING SITE is HOST TARGET binding site found in the 3' untranslated region of mRNA encoded by LOC146488, corresponding to a HOST TARGET binding site such as BINDING SITE I, BINDING SITE II or BINDING SITE III. Table 2 illustrates the complementarity of the nucleotide sequences of LOC146488 BINDING SITE, designated SEQ ID:35045, to the nucleotide sequence of VGAM1098 RNA, herein designated VGAM RNA, also designated SEQ ID:3809.

Another function of VGAM1098 is therefore inhibition of LOC146488 (Accession XM_047748). Accordingly, utilities of VGAM1098 include diagnosis, prevention and treatment of diseases and clinical conditions associated with LOC146488. LOC147229 (Accession XM_085742) is another VGAM1098 host target gene. LOC147229 BINDING SITE is HOST TARGET binding site found in the 5' untranslated region of mRNA encoded by LOC147229, corresponding to a HOST TARGET binding site such as BIND- ING SITE I, BINDING SITE II or BINDING SITE III. Table 2 illustrates the complementarity of the nucleotide sequences of LOC147229 BINDING SITE, designated SEQ ID:38318, to the nucleotide sequence of VGAM1098 RNA, herein designated VGAM RNA, also designated SEQ ID:3809.

Another function of VGAM1098 is therefore inhibition of LOC147229 (Accession XM_085742). Accordingly, utilities of VGAM1098 include diagnosis, prevention and treatment of diseases and clinical conditions associated with LOC147229. LOC200942 (Accession XM_114323) is another VGAM1098 host target gene. LOC200942 BINDING SITE is HOST TARGET binding site found in the 3' untranslated region of mRNA encoded by LOC200942, corresponding to a HOST TARGET binding site such as BINDING SITE I, BINDING SITE II or BINDING SITE III. Table 2 illustrates the complementarity of the nucleotide sequences of LOC200942 BINDING SITE, designated SEQ ID:42871, to the nucleotide sequence of VGAM1098 RNA, herein designated VGAM RNA, also designated SEQ ID:3809.

Another function of VGAM1098 is therefore inhibition of LOC200942 (Accession XM_114323). Accordingly, utilities of VGAM1098 include diagnosis, prevention and treatment of diseases and clinical conditions associated with LOC200942. FIG. 1 further provides a conceptual description of a novel bioinformatically detected viral gene of the present invention, referred to here as Viral Genomic Address Messenger 1099 (VGAM1099) viral gene, which modulates expression of respective host target genes thereof, the function and utility of which host target genes is known in the art.

VGAM1099 is a novel bioinformatically detected regulatory, non protein coding, viral micro RNA (miRNA) gene. The method by which VGAM1099 was detected is described hereinabove with reference to FIGS. 1-8.

VGAM1099 gene, herein designated VGAM GENE, is a viral gene contained in the genome of African Swine Fever Virus. VGAM1099 host target gene, herein designated VGAM HOST TARGET GENE, is a human gene contained in the human genome.

VGAM1099 gene encodes a VGAM1099 precursor RNA, herein designated VGAM PRECURSOR RNA. Similar to other miRNA genes, and unlike most ordinary genes, VGAM1099 precursor RNA does not encode a protein. A nucleotide sequence identical or highly similar to the nucleotide sequence of VGAM1099 precursor RNA is designated SEQ ID:1085, and is provided hereinbelow with reference to the sequence listing part. Nucleotide sequence SEQ ID:1085 is located at position 122281 relative to the genome of African Swine Fever Virus.

VGAM1099 precursor RNA folds onto itself, forming VGAM1099 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1099 folded precursor RNA into VGAM1099 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1099 RNA is designated SEQ ID:3810, and is provided hereinbelow with reference to the sequence listing part.

VGAM1099 host target gene, herein designated VGAM HOST TARGET GENE, encodes a corresponding messenger RNA, VGAM1099 host target RNA, herein designated VGAM HOST TARGET RNA. VGAM1099 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1099 RNA, herein designated VGAM RNA, binds complementarily to one or more host target binding sites located in untranslated regions of VGAM1099 host target RNA, herein designated VGAM HOST TARGET RNA. This complementary binding is due to the fact that the nucleotide sequence of VGAM1099 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1099 RNA, herein designated VGAM RNA, may have a different number of host target binding sites in untranslated regions of a VGAM1099 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1099 RNA, herein designated VGAM RNA, to host target binding sites on VGAM1099 host target RNA, herein designated VGAM HOST TARGET RNA, such as BINDING SITE I, BINDING SITE II and BINDING SITE III, inhibits translation of VGAM1099 host target RNA into VGAM1099 host target protein, herein designated VGAM HOST TARGET PROTEIN. VGAM host target protein is therefore outlined by a broken line.

It is appreciated that VGAM1099 host target gene, herein designated VGAM HOST TARGET GENE, in fact represents a plurality of VGAM1099 host target genes. The mRNA of each one of this plurality of VGAM1099 host target genes comprises one or more host target binding sites, each having a nucleotide sequence which is at least partly complementary to VGAM1099 RNA, herein designated VGAM RNA, and which when bound by VGAM1099 RNA causes inhibition of translation of respective one or more VGAM1099 host target proteins.

It is further appreciated by one skilled in the art that the mode of translational inhibition illustrated by FIG. 1 with specific reference to translational inhibition exerted by VGAM1099 gene, herein designated VGAM GENE, on one or more VGAM1099 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1099 is inhibition of expression of host target genes, as part of a novel viral mechanism of attacking a host. Accordingly, utilities of VGAM1099 include diagnosis, prevention and treatment of viral infection by African Swine Fever Virus. Specific functions, and accordingly utilities, of VGAM1099 correlate with, and may be deduced from, the identity of the host target genes which VGAM1099 binds and inhibits, and the function of these host target genes, as elaborated hereinbelow.

Nucleotide sequences of the VGAM1099 precursor RNA, herein designated VGAM PRECURSOR RNA, and of the 'diced' VGAM1099 RNA, herein designated VGAM RNA, and a schematic representation of the secondary folding of VGAM1099 folded precursor RNA, herein designated VGAM FOLDED PRECURSOR RNA, of VGAM1099 are further described hereinbelow with reference to Table 1.

Nucleotide sequences of host target binding sites, such as BINDING SITE-I, BINDING SITE-II and BINDING SITE-III of FIG. 1, found on VGAM1099 host target RNA, and schematic representation of the complementarity of each of these host target binding sites to VGAM1099 RNA, herein designated VGAM RNA, are described hereinbelow with reference to Table 2.

As mentioned hereinabove with reference to FIG. 1, a function of VGAM1099 gene, herein designated VGAM is inhibition of expression of VGAM1099 target genes. It is appreciated that specific functions, and accordingly utilities, of VGAM1099 correlate with, and may be deduced from, the identity of the target genes which VGAM1099 binds and inhibits, and the function of these target genes, as elaborated hereinbelow.

Eukaryotic Translation Initiation Factor 1A (EIF1A, Accession XM_114147) is a VGAM1099 host target gene. EIF1A BINDING SITE is HOST TARGET binding site found in the 3' untranslated region of mRNA encoded by EIF1A, corresponding to a HOST TARGET binding site such as BINDING SITE I, BINDING SITE II or BINDING SITE III. Table 2 illustrates the complementarity of the nucleotide sequences of EIF1A BINDING SITE, designated SEQ ID:42722, to the nucleotide sequence of VGAM1099 RNA, herein designated VGAM RNA, also designated SEQ ID:3810.

A function of VGAM1099 is therefore inhibition of Eukaryotic Translation Initiation Factor 1A (EIF1A, Accession XM_114147), a gene which seems to be required for maximal rate of protein biosynthesis. Accordingly, utilities of VGAM1099 include diagnosis, prevention and treatment of diseases and clinical conditions associated with EIF1A. The function of EIF1A and its association with various diseases and clinical conditions, has been established by previous studies, as described hereinabove with reference to VGAM120. V-myb Myeloblastosis Viral Oncogene Homolog (avian) (MYB, Accession XM_004256) is another VGAM1099 host target gene. MYB BINDING SITE is HOST TARGET binding site found in the 3' untranslated region of mRNA encoded by MYB, corresponding to a HOST TARGET binding site such as BINDING SITE I, BINDING SITE II or BINDING SITE III. Table 2 illustrates the complementarity of the nucleotide sequences of MYB BINDING SITE, designated SEQ ID:29943, to the nucleotide sequence of VGAM1099 RNA, herein designated VGAM RNA, also designated SEQ ID:3810.

Another function of VGAM1099 is therefore inhibition of V-myb Myeloblastosis Viral Oncogene Homolog (avian) (MYB, Accession XM_004256). Accordingly, utilities of VGAM1099 include diagnosis, prevention and treatment of diseases and clinical conditions associated with MYB. MGC20253 (Accession NM_144583) is another VGAM1099 host target gene. MGC20253 BINDING SITE is HOST TARGET binding site found in the 3' untranslated region of mRNA encoded by MGC20253, corresponding to a HOST TARGET binding site such as BINDING SITE I, BINDING SITE II or BINDING SITE III. Table 2 illustrates the complementarity of the nucleotide sequences of MGC20253 BINDING SITE, designated SEQ ID:29395, to the nucleotide sequence of VGAM1099 RNA, herein designated VGAM RNA, also designated SEQ ID:3810.

Another function of VGAM1099 is therefore inhibition of MGC20253 (Accession NM_144583). Accordingly, utilities of VGAM1099 include diagnosis, prevention and treatment of diseases and clinical conditions associated with MGC20253. Serine/threonine Kinase 38 Like (STK38L, Accession XM_044823) is another VGAM1099 host target gene. STK38L BINDING SITE is HOST TARGET binding site found in the 3' untranslated region of mRNA encoded by STK38L, corresponding to a HOST TARGET binding site such as BINDING SITE I, BINDING SITE II or BINDING SITE III. Table 2 illustrates the complementarity of the nucleotide sequences of STK38L BINDING SITE, designated SEQ ID:34289, to the nucleotide sequence of VGAM1099 RNA, herein designated VGAM RNA, also designated SEQ ID:3810.

Another function of VGAM1099 is therefore inhibition of Serine/threonine Kinase 38 Like (STK38L, Accession XM_044823). Accordingly, utilities of VGAM1099 include diagnosis, prevention and treatment of diseases and clinical conditions associated with STK38L. FIG. 1 further provides a conceptual description of a novel bioinformatically detected viral gene of the present invention, referred to here as Viral Genomic Address Messenger 1100 (VGAM1100) viral gene, which modulates expression of respective host target genes thereof, the function and utility of which host target genes is known in the art.

VGAM1100 is a novel bioinformatically detected regulatory, non protein coding, viral micro RNA (miRNA) gene. The method by which VGAM1100 was detected is described hereinabove with reference to FIGS. 1-8.

VGAM1100 gene, herein designated VGAM GENE, is a viral gene contained in the genome of Strawberry Mottle Virus. VGAM1100 host target gene, herein designated VGAM HOST TARGET GENE, is a human gene contained in the human genome.

VGAM1100 gene encodes a VGAM1100 precursor RNA, herein designated VGAM PRECURSOR RNA. Similar to other miRNA genes, and unlike most ordinary genes, VGAM1100 precursor RNA does not encode a protein. A nucleotide sequence identical or highly similar to the nucleotide sequence of VGAM1100 precursor RNA is designated SEQ ID:1086, and is provided hereinbelow with reference to the sequence listing part. Nucleotide sequence SEQ ID:1086 is located at position 5104 relative to the genome of Strawberry Mottle Virus.

VGAM1100 precursor RNA folds onto itself, forming VGAM1100 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1100 folded precursor RNA into VGAM1100 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM1100 RNA is designated SEQ ID:3811, and is provided hereinbelow with reference to the sequence listing part.

VGAM1100 host target gene, herein designated VGAM HOST TARGET GENE, encodes a corresponding messenger RNA, VGAM1100 host target RNA, herein designated VGAM HOST TARGET RNA. VGAM1100 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1100 RNA, herein designated VGAM RNA, binds complementarily to one or more host target binding sites located in untranslated regions of VGAM1100 host target RNA, herein designated VGAM HOST TARGET RNA. This complementary binding is due to the fact that the nucleotide sequence of VGAM1100 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1100 RNA, herein designated VGAM RNA, may have a different number of host target binding sites in untranslated regions of a VGAM1100 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1100 RNA, herein designated VGAM RNA, to host target binding sites on VGAM1100 host target RNA, herein designated VGAM HOST TARGET RNA, such as BINDING SITE I, BINDING SITE II and BINDING SITE III, inhibits translation of VGAM1100 host target RNA into VGAM1100 host target protein, herein designated VGAM HOST TARGET PROTEIN. VGAM host target protein is therefore outlined by a broken line.

It is appreciated that VGAM1100 host target gene, herein designated VGAM HOST TARGET GENE, in fact represents a plurality of VGAM1100 host target genes. The mRNA of each one of this plurality of VGAM1100 host target genes comprises one or more host target binding sites, each having a nucleotide sequence which is at least partly complementary to VGAM1100 RNA, herein designated VGAM RNA, and which when bound by VGAM1100 RNA causes inhibition of translation of respective one or more VGAM1100 host target proteins.

It is further appreciated by one skilled in the art that the mode of translational inhibition illustrated by FIG. 1 with specific reference to translational inhibition exerted by VGAM1100 gene, herein designated VGAM GENE, on one or more VGAM1100 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1100 is inhibition of expression of host target genes, as part of a novel viral mechanism of attacking a host. Accordingly, utilities of VGAM1100 include diagnosis, prevention and treatment of viral infection by Strawberry Mottle Virus. Specific functions, and accordingly utilities, of VGAM1100 correlate with, and may be deduced from, the identity of the host target genes which VGAM1100 binds and inhibits, and the function of these host target genes, as elaborated hereinbelow.

Nucleotide sequences of the VGAM1100 precursor RNA, herein designated VGAM PRECURSOR RNA, and of the 'diced' VGAM1100 RNA, herein designated VGAM RNA, and a schematic representation of the secondary folding of VGAM1100 folded precursor RNA, herein designated VGAM FOLDED PRECURSOR RNA, of VGAM1100 are further described hereinbelow with reference to Table 1.

Nucleotide sequences of host target binding sites, such as BINDING SITE-I, BINDING SITE-II and BINDING SITE-III of FIG. 1, found on VGAM1100 host target RNA, and schematic representation of the complementarity of each of these host target binding sites to VGAM1100 RNA, herein designated VGAM RNA, are described hereinbelow with reference to Table 2.

As mentioned hereinabove with reference to FIG. 1, a function of VGAM1100 gene, herein designated VGAM is inhibition of expression of VGAM1100 target genes. It is appreciated that specific functions, and accordingly utilities, of VGAM1100 correlate with, and may be deduced from, the identity of the target genes which VGAM1100 binds and inhibits, and the function of these target genes, as elaborated hereinbelow.

Engrailed Homolog 2 (EN2, Accession NM_001427) is a VGAM1100 host target gene. EN2 BINDING SITE is HOST TARGET binding site found in the 3' untranslated region of mRNA encoded by EN2, corresponding to a HOST TARGET binding site such as BINDING SITE I, BINDING SITE II or BINDING SITE III. Table 2 illustrates the complementarity of the nucleotide sequences of EN2 BINDING SITE, designated SEQ ID:7143, to the nucleotide sequence of VGAM1100 RNA, herein designated VGAM RNA, also designated SEQ ID:3811.

A function of VGAM1100 is therefore inhibition of Engrailed Homolog 2 (EN2, Accession NM_001427), a gene which may be required for normal cerebellar development; a homeobox protein, very strongly similar to murine En2. Accordingly, utilities of VGAM1100 include diagnosis, prevention and treatment of diseases and clinical conditions associated with EN2. The function of EN2 and its association with various diseases and clinical conditions, has been established by previous studies, as described hereinabove with reference to VGAM232. SMG1 (Accession NM_015092) is another VGAM1100 host target gene. SMG1 BINDING SITE is HOST TARGET binding site found in the 3' untranslated region of mRNA encoded by SMG1, corresponding to a HOST TARGET binding site such as BINDING SITE I, BINDING SITE II or BINDING SITE III. Table 2 illustrates the complementarity of the nucleotide sequences of SMG1 BINDING SITE, designated SEQ ID:17482, to the nucleotide sequence of VGAM1100 RNA, herein designated VGAM RNA, also designated SEQ ID:3811.

Another function of VGAM1100 is therefore inhibition of SMG1 (Accession NM_015092), a gene which acts as the target for the cell-cycle arrest and immunosuppressive effects. Accordingly, utilities of VGAM1100 include diagnosis, prevention and treatment of diseases and clinical conditions associated with SMG1. The function of SMG1 and its association with various diseases and clinical conditions, has been established by previous studies, as described hereinabove with reference to VGAM419. FKSG42 (Accession NM_032032) is another VGAM1100 host target gene. FKSG42 BINDING SITE is HOST TARGET binding site found in the 3' untranslated region of mRNA encoded by FKSG42, corresponding to a HOST TARGET binding site such as BINDING SITE I, BINDING SITE II or BINDING SITE III. Table 2 illustrates the complementarity of the nucleotide sequences of FKSG42 BINDING SITE, designated SEQ ID:25732, to the nucleotide sequence of VGAM1100 RNA, herein designated VGAM RNA, also designated SEQ ID:3811.

Another function of VGAM1100 is therefore inhibition of FKSG42 (Accession NM_032032). Accordingly, utilities of VGAM1100 include diagnosis, prevention and treatment of diseases and clinical conditions associated with FKSG42. KIAA0940 (Accession NM_014912) is another VGAM1100 host target gene. KIAA0940 BINDING SITE is HOST TARGET binding site found in the 3' untranslated region of mRNA encoded by KIAA0940, corresponding to a HOST TARGET binding site such as BINDING SITE I, BINDING SITE II or BINDING SITE III. Table 2 illustrates the complementarity of the nucleotide sequences of KIAA0940 BINDING SITE, designated SEQ ID:17147, to the nucleotide sequence of VGAM1100 RNA, herein designated VGAM RNA, also designated SEQ ID:3811.

Another function of VGAM1100 is therefore inhibition of KIAA0940 (Accession NM_014912). Accordingly, utilities of VGAM1100 include diagnosis, prevention and treatment of diseases and clinical conditions associated with KIAA0940. Polymerase (DNA directed), Mu (POLM, Accession XM_165867) is another VGAM1100 host target gene. POLM BINDING SITE is HOST TARGET binding site found in the 3' untranslated region of mRNA encoded by POLM, corresponding to a HOST TARGET binding site such as BINDING SITE I, BINDING SITE II or BINDING SITE III. Table 2 illustrates the complementarity of the nucleotide sequences of POLM BINDING SITE, designated SEQ ID:43784, to the nucleotide sequence of VGAM1100 RNA, herein designated VGAM RNA, also designated SEQ ID:3811.

Another function of VGAM1100 is therefore inhibition of Polymerase (DNA directed), Mu (POLM, Accession XM_165867). Accordingly, utilities of VGAM1100 include diagnosis, prevention and treatment of diseases and clinical conditions associated with POLM. Rac GTPase Activating Protein 1 (RACGAP1, Accession NM_013277) is another VGAM1100 host target gene. RACGAP1 BINDING SITE is HOST TARGET binding site found in the 3' untranslated region of mRNA encoded by RACGAP1, corresponding to a HOST TARGET binding site such as BINDING SITE I, BINDING SITE II or BINDING SITE III. Table 2 illustrates the complementarity of the nucleotide sequences of RACGAP1 BINDING SITE, designated SEQ ID:14942, to the nucleotide sequence of VGAM1100 RNA, herein designated VGAM RNA, also designated SEQ ID:3811.

Another function of VGAM1100 is therefore inhibition of Rac GTPase Activating Protein 1 (RACGAP1, Accession NM_013277). Accordingly, utilities of VGAM1100 include diagnosis, prevention and treatment of diseases and clinical conditions associated with RACGAP1. LOC201626 (Accession XM_114349) is another VGAM1100 host target gene. LOC201626 BINDING SITE is HOST TARGET binding site found in the 5' untranslated region of mRNA encoded by LOC201626, corresponding to a HOST TARGET binding site such as BINDING SITE I, BINDING SITE II or BINDING SITE III. Table 2 illustrates the complementarity of the nucleotide sequences of LOC201626 BINDING SITE, designated SEQ ID:42887, to the nucleotide sequence of VGAM1100 RNA, herein designated VGAM RNA, also designated SEQ ID:3811.

Another function of VGAM1100 is therefore inhibition of LOC201626 (Accession XM_114349). Accordingly, utilities of VGAM1100 include diagnosis, prevention and treatment of diseases and clinical conditions associated with LOC201626. LOC91522 (Accession XM_038953) is another VGAM1100 host target gene. LOC91522 BINDING SITE is HOST TARGET binding site found in the 3' untranslated region of mRNA encoded by LOC91522, corresponding to a HOST TARGET binding site such as BINDING SITE I, BINDING SITE II or BINDING SITE III. Table 2 illustrates the complementarity of the nucleotide sequences of LOC91522 BINDING SITE, designated SEQ ID:32962, to the nucleotide sequence of VGAM1100 RNA, herein designated VGAM RNA, also designated SEQ ID:3811.

Another function of VGAM1100 is therefore inhibition of LOC91522 (Accession XM_038953). Accordingly, utilities of VGAM1100 include diagnosis, prevention and treatment of diseases and clinical conditions associated with LOC91522. FIG. 1 further provides a conceptual description of a novel bioinformatically detected viral gene of the present invention, referred to here as Viral Genomic Address Messenger 1101 (VGAM1101) viral gene, which modulates expression of respective host target genes thereof, the function and utility of which host target genes is known in the art.

VGAM1101 is a novel bioinformatically detected regulatory, non protein coding, viral micro RNA (miRNA) gene. The method by which VGAM1101 was detected is described hereinabove with reference to FIGS. 1-8.

VGAM1101 gene, herein designated VGAM GENE, is a viral gene contained in the genome of African Swine Fever Virus. VGAM1101 host target gene, herein designated VGAM HOST TARGET GENE, is a human gene contained in the human genome.

VGAM1101 gene encodes a VGAM1101 precursor RNA, herein designated VGAM PRECURSOR RNA. Similar to other miRNA genes, and unlike most ordinary genes, VGAM1101 precursor RNA does not encode a protein. A nucleotide sequence identical or highly similar to the nucleotide sequence of VGAM1101 precursor RNA is designated SEQ ID:1087, and is provided hereinbelow with reference to the sequence listing part. Nucleotide sequence SEQ ID:1087 is located at position 126143 relative to the genome of African Swine Fever Virus.

VGAM1101 precursor RNA folds onto itself, forming VGAM1101 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1101 folded precursor RNA into VGAM1101 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM1101 RNA is designated SEQ ID:3812, and is provided hereinbelow with reference to the sequence listing part.

VGAM1101 host target gene, herein designated VGAM HOST TARGET GENE, encodes a corresponding messenger RNA, VGAM1101 host target RNA, herein designated VGAM HOST TARGET RNA. VGAM1101 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1101 RNA, herein designated VGAM RNA, binds complementarily to one or more host target binding sites located in untranslated regions of VGAM1101 host target RNA, herein designated VGAM HOST TARGET RNA. This complementary binding is due to the fact that the nucleotide sequence of VGAM1101 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1101 RNA, herein designated VGAM RNA, may have a different number of host target binding sites in untranslated regions of a VGAM1101 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1101 RNA, herein designated VGAM RNA, to host target binding sites on VGAM1101 host target RNA, herein designated VGAM HOST TARGET RNA, such as BINDING SITE I, BINDING SITE II and BINDING SITE III, inhibits translation of VGAM1101 host target RNA into VGAM1101 host target protein, herein designated VGAM HOST TARGET PROTEIN. VGAM host target protein is therefore outlined by a broken line.

It is appreciated that VGAM1101 host target gene, herein designated VGAM HOST TARGET GENE, in fact represents a plurality of VGAM1101 host target genes. The mRNA of each one of this plurality of VGAM1101 host target genes comprises one or more host target binding sites, each having a nucleotide sequence which is at least partly complementary to VGAM1101 RNA, herein designated VGAM RNA, and which when bound by VGAM1101 RNA causes inhibition of translation of respective one or more VGAM1101 host target proteins.

It is further appreciated by one skilled in the art that the mode of translational inhibition illustrated by FIG. 1 with specific reference to translational inhibition exerted by VGAM1101 gene, herein designated VGAM GENE, on one or more VGAM1101 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1101 is inhibition of expression of host target genes, as part of a novel viral mechanism of attacking a host. Accordingly, utilities of VGAM1101 include diagnosis, prevention and treatment of viral infection by African Swine Fever Virus. Specific functions, and accordingly utilities, of VGAM1101 correlate with, and may be deduced from, the identity of the host target genes which VGAM1101 binds and inhibits, and the function of these host target genes, as elaborated hereinbelow.

Nucleotide sequences of the VGAM1101 precursor RNA, herein designated VGAM PRECURSOR RNA, and of the 'diced' VGAM1101 RNA, herein designated VGAM RNA, and a schematic representation of the secondary folding of VGAM1101 folded precursor RNA, herein designated VGAM FOLDED PRECURSOR RNA, of VGAM1101 are further described hereinbelow with reference to Table 1.

Nucleotide sequences of host target binding sites, such as BINDING SITE-I, BINDING SITE-II and BINDING SITE-III of FIG. 1, found on VGAM1101 host target RNA, and schematic representation of the complementarity of each of these host target binding sites to VGAM1101 RNA, herein designated VGAM RNA, are described hereinbelow with reference to Table 2.

As mentioned hereinabove with reference to FIG. 1, a function of VGAM1101 gene, herein designated VGAM is inhibition of expression of VGAM1101 target genes. It is appreciated that specific functions, and accordingly utilities, of VGAM1101 correlate with, and may be deduced from, the identity of the target genes which VGAM1101 binds and inhibits, and the function of these target genes, as elaborated hereinbelow.

HRAS-like Suppressor (HRASLS, Accession NM_020386) is a VGAM1101 host target gene. HRASLS BINDING SITE is HOST TARGET binding site found in the 5' untranslated region of mRNA encoded by HRASLS, corresponding to a HOST TARGET binding site such as BINDING SITE I, BINDING SITE II or BINDING SITE III. Table 2 illustrates the complementarity of the nucleotide sequences of HRASLS BINDING SITE, designated SEQ ID:21658, to the nucleotide sequence of VGAM1101 RNA, herein designated VGAM RNA, also designated SEQ ID:3812.

A function of VGAM1101 is therefore inhibition of HRAS-like Suppressor (HRASLS, Accession NM_020386), a gene which may regulate the Ha-ras-mediated signaling pathway. Accordingly, utilities of VGAM1101 include diagnosis, prevention and treatment of diseases and clinical conditions associated with HRASLS. The function of HRASLS has been established by previous studies. By differential display between 2 mouse cell lines, Akiyama et al. (1999) cloned a cDNA encoding a novel mouse protein, called A-C1, and showed that it modulates an HRAS (OMIM Ref. No. 190020)-mediated signaling pathway in vitro. Ito et al. (2001) isolated a partial cDNA encoding the human homolog, designated HRASLS, by RT-PCR with mRNA extracted from renal cell carcinoma cells. They used 5-prime and 3-prime RACE to obtain a full-length HRASLS cDNA encoding a 168-amino acid protein that shares 83% sequence identity with the mouse protein. HRASLS contains 2 consensus sequence motifs, DXXG and NKXD, suggesting involvement in a ras-signaling pathway. DXXG is involved in binding to Mg (2+) and gamma-phosphate when GTP is bound, and NKXD is important for binding to the guanine ring. Northern blot analysis detected expression of a 1.1-kb transcript in skeletal muscles, testis, heart, brain, and thyroid.

Expression was also detected at low levels in normal bone, but at high levels in osteosarcoma cells.

Full details of the abovementioned studies are described in the following publications, the disclosure of which are hereby incorporated by reference:

Akiyama, H.; Hiraki, Y.; Noda, M.; Shigeno, C.; Ito, H.; Nakamura, T.: Molecular cloning and biological activity of a novel Ha-Ras suppressor gene predominantly expressed in skeletal muscle, heart, brain, and bone marrow by differential display using clonal mouse EC cells, ATDC5. J. Biol. Chem. 274:32192-32197, 1999; and Ito, H.; Akiyama, H.; Shigeno, C.; Nakamura, T.: Isolation, characterization, and chromosome mapping of a human A-C1 Ha-Ras suppressor gene (HRASLS). Cytogenet. Cell Genet. 93:36-39.

Further studies establishing the function and utilities of HRASLS are found in John Hopkins OMIM database record ID 606487, and in sited publications numbered 5552-5553 listed in the bibliography section hereinbelow, which are also hereby incorporated by reference. Solute Carrier Family 7 (cationic amino acid transporter, y+ system), Member 5 (SLC7A5, Accession NM_003486) is another VGAM1101 host target gene. SLC7A5 BINDING SITE is HOST TARGET binding site found in the 3' untranslated region of mRNA encoded by SLC7A5, corresponding to a HOST TARGET binding site such as BINDING SITE I, BINDING SITE II or BINDING SITE III. Table 2 illustrates the complementarity of the nucleotide sequences of SLC7A5 BINDING SITE, designated SEQ ID:9576, to the nucleotide sequence of VGAM1101 RNA, herein designated VGAM RNA, also designated SEQ ID:3812.

Another function of VGAM1101 is therefore inhibition of Solute Carrier Family 7 (cationic amino acid transporter, y+ system), Member 5 (SLC7A5, Accession NM_003486), a gene which mediates transport of large and small neutral amino acids. Accordingly, utilities of VGAM1101 include diagnosis, prevention and treatment of diseases and clinical conditions associated with SLC7A5. The function of SLC7A5 and its association with various diseases and clinical conditions, has been established by previous studies, as described hereinabove with reference to VGAM430. Wolf-Hirschhorn Syndrome Candidate 1 (WHSC1, Accession NM_133333) is another VGAM1101 host target gene. WHSC1 BINDING SITE1 through WHSC1 BINDING SITE4 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE4, designated SEQ ID:28465, SEQ ID:28476, SEQ ID:17184 and SEQ ID:28448 respectively, to the nucleotide sequence of VGAM1101 RNA, herein designated VGAM RNA, also designated SEQ ID:3812.

Another function of VGAM1101 is therefore inhibition of Wolf-Hirschhorn Syndrome Candidate 1 (WHSC1, Accession NM_133333), a gene which binds covalently to and repairs g/t mismatches. Accordingly, utilities of VGAM1101 include diagnosis, prevention and treatment of diseases and clinical conditions associated with WHSC1. The function of WHSC1 and its association with various diseases and clinical conditions, has been established by previous studies, as described hereinabove with reference to VGAM200. Chloride Intracellular Channel 5 (CLIC5, Accession NM_016929) is another VGAM1101 host target gene. CLIC5 BINDING SITE is HOST TARGET binding site found in the 3' untranslated region of mRNA encoded by CLIC5, corresponding to a HOST TARGET binding site such as BINDING SITE I, BINDING SITE II or BINDING SITE III. Table 2 illustrates the complementarity of the nucleotide sequences of CLIC5 BINDING SITE, designated SEQ ID:18845, to the nucleotide sequence of VGAM1101 RNA, herein designated VGAM RNA, also designated SEQ ID:3812.

Another function of VGAM1101 is therefore inhibition of Chloride Intracellular Channel 5 (CLIC5, Accession NM_016929). Accordingly, utilities of VGAM1101 include diagnosis, prevention and treatment of diseases and clinical conditions associated with CLIC5. 1 (3) mbt-like (Drosophila) (L3MBTL, Accession XM_045421) is another VGAM1101 host target gene. L3MBTL BINDING SITE is HOST TARGET binding site found in the 3' untranslated region of mRNA encoded by L3MBTL, corresponding to a HOST TARGET binding site such as BINDING SITE I, BINDING SITE II or BINDING SITE III. Table 2 illustrates the complementarity of the nucleotide sequences of L3MBTL BINDING SITE, designated SEQ ID:34457, to the nucleotide sequence of VGAM1101 RNA, herein designated VGAM RNA, also designated SEQ ID:3812.

Another function of VGAM1101 is therefore inhibition of 1 (3) mbt-like (Drosophila) (L3MBTL, Accession XM_045421). Accordingly, utilities of VGAM1101 include diagnosis, prevention and treatment of diseases and clinical conditions associated with L3MBTL. LOC149576 (Accession XM_086580) is another VGAM1101 host target gene. LOC149576 BINDING SITE is HOST TARGET binding site found in the 5' untranslated region of mRNA encoded by LOC149576, corresponding to a HOST TARGET binding site such as BINDING SITE I, BINDING SITE II or BINDING SITE III. Table 2 illustrates the complementarity of the nucleotide sequences of LOC149576 BINDING SITE, designated SEQ ID:38776, to the nucleotide sequence of VGAM1101 RNA, herein designated VGAM RNA, also designated SEQ ID:3812.

Another function of VGAM1101 is therefore inhibition of LOC149576 (Accession XM_086580). Accordingly, utilities of VGAM1101 include diagnosis, prevention and treatment of diseases and clinical conditions associated with LOC149576. LOC149668 (Accession XM_097692) is another VGAM1101 host target gene. LOC149668 BINDING SITE is HOST TARGET binding site found in the 5' untranslated region of mRNA encoded by LOC149668, corresponding to a HOST TARGET binding site such as BINDING SITE I, BINDING SITE II or BINDING SITE III. Table 2 illustrates the complementarity of the nucleotide sequences of LOC149668 BINDING SITE, designated SEQ ID:41029, to the nucleotide sequence of VGAM1101 RNA, herein designated VGAM RNA, also designated SEQ ID:3812.

Another function of VGAM1101 is therefore inhibition of LOC149668 (Accession XM_097692). Accordingly, utilities of VGAM1101 include diagnosis, prevention and treatment of diseases and clinical conditions associated with LOC149668. LOC221489 (Accession XM_168066) is another VGAM1101 host target gene. LOC221489 BINDING SITE is HOST TARGET binding site found in the 5' untranslated region of mRNA encoded by LOC221489, corresponding to a HOST TARGET binding site such as BINDING SITE I, BINDING SITE II or BINDING SITE III. Table 2 illustrates the complementarity of the nucleotide sequences of LOC221489 BINDING SITE, designated SEQ ID:44983, to the nucleotide sequence of VGAM1101 RNA, herein designated VGAM RNA, also designated SEQ ID:3812.

Another function of VGAM1101 is therefore inhibition of LOC221489 (Accession XM_168066). Accordingly, utilities of VGAM1101 include diagnosis, prevention and treatment of diseases and clinical conditions associated with LOC221489. LOC84570 (Accession NM_032518) is another VGAM1101 host target gene. LOC84570 BINDING SITE is HOST TARGET binding site found in the 5' untranslated region of mRNA encoded by LOC84570, corresponding to a HOST TARGET binding site such as BINDING SITE I, BINDING SITE II or BINDING SITE III. Table 2 illustrates the complementarity of the nucleotide sequences of LOC84570 BINDING SITE, designated SEQ ID:26266, to the nucleotide sequence of VGAM1101 RNA, herein designated VGAM RNA, also designated SEQ ID:3812.

Another function of VGAM1101 is therefore inhibition of LOC84570 (Accession NM_032518). Accordingly, utilities of VGAM1101 include diagnosis, prevention and treatment of diseases and clinical conditions associated with LOC84570. FIG. 1 further provides a conceptual description of a novel bioinformatically detected viral gene of the present invention, referred to here as Viral Genomic Address Messenger 1102 (VGAM1102) viral gene, which modulates expression of respective host target genes thereof, the function and utility of which host target genes is known in the art.

VGAM1102 is a novel bioinformatically detected regulatory, non protein coding, viral micro RNA (miRNA) gene. The method by which VGAM1102 was detected is described hereinabove with reference to FIGS. 1-8.

VGAM1102 gene, herein designated VGAM GENE, is a viral gene contained in the genome of African Swine Fever Virus. VGAM1102 host target gene, herein designated VGAM HOST TARGET GENE, is a human gene contained in the human genome.

VGAM1102 gene encodes a VGAM1102 precursor RNA, herein designated VGAM PRECURSOR RNA. Similar to other miRNA genes, and unlike most ordinary genes, VGAM1102 precursor RNA does not encode a protein. A nucleotide sequence identical or highly similar to the nucleotide sequence of VGAM1102 precursor RNA is designated SEQ ID:1088, and is provided hereinbelow with reference to the sequence listing part. Nucleotide sequence SEQ ID:1088 is located at position 123478 relative to the genome of African Swine Fever Virus.

VGAM1102 precursor RNA folds onto itself, forming VGAM1102 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1102 folded precursor RNA into VGAM1102 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM1102 RNA is designated SEQ ID:3813, and is provided hereinbelow with reference to the sequence listing part.

VGAM1102 host target gene, herein designated VGAM HOST TARGET GENE, encodes a corresponding messenger RNA, VGAM1102 host target RNA, herein designated VGAM HOST TARGET RNA. VGAM1102 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1102 RNA, herein designated VGAM RNA, binds complementarily to one or more host target binding sites located in untranslated regions of VGAM1102 host target RNA, herein designated VGAM HOST TARGET RNA. This complementary binding is due to the fact that the nucleotide sequence of VGAM1102 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1102 RNA, herein designated VGAM RNA, may have a different number of host target binding sites in untranslated regions of a VGAM1102 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1102 RNA, herein designated VGAM RNA, to host target binding sites on VGAM1102 host target RNA, herein designated VGAM HOST TARGET RNA, such as BINDING SITE I, BINDING SITE II and BINDING SITE III, inhibits translation of VGAM1102 host target RNA into VGAM1102 host target protein, herein designated VGAM HOST TARGET PROTEIN. VGAM host target protein is therefore outlined by a broken line.

It is appreciated that VGAM1102 host target gene, herein designated VGAM HOST TARGET GENE, in fact represents a plurality of VGAM1102 host target genes. The mRNA of each one of this plurality of VGAM1102 host target genes comprises one or more host target binding sites, each having a nucleotide sequence which is at least partly complementary to VGAM1102 RNA, herein designated VGAM RNA, and which when bound by VGAM1102 RNA causes inhibition of translation of respective one or more VGAM1102 host target proteins.

It is further appreciated by one skilled in the art that the mode of translational inhibition illustrated by FIG. 1 with specific reference to translational inhibition exerted by VGAM1102 gene, herein designated VGAM GENE, on one or more VGAM1102 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1102 is inhibition of expression of host target genes, as part of a novel viral mechanism of attacking a host. Accordingly, utilities of VGAM1102 include diagnosis, prevention and treatment of viral infection by African Swine Fever Virus. Specific functions, and accordingly utilities, of VGAM1102 correlate with, and may be deduced from, the identity of the host target genes which VGAM1102 binds and inhibits, and the function of these host target genes, as elaborated hereinbelow.

Nucleotide sequences of the VGAM1102 precursor RNA, herein designated VGAM PRECURSOR RNA, and of the 'diced' VGAM1102 RNA, herein designated VGAM RNA, and a schematic representation of the secondary folding of VGAM1102 folded precursor RNA, herein designated VGAM FOLDED PRECURSOR RNA, of VGAM1102 are further described hereinbelow with reference to Table 1.

Nucleotide sequences of host target binding sites, such as BINDING SITE-I, BINDING SITE-II and BINDING SITE-III of FIG. 1, found on VGAM1102 host target RNA, and schematic representation of the complementarity of each of these host target binding sites to VGAM1102 RNA, herein designated VGAM RNA, are described hereinbelow with reference to Table 2.

As mentioned hereinabove with reference to FIG. 1, a function of VGAM1102 gene, herein designated VGAM is inhibition of expression of VGAM1102 target genes. It is appreciated that specific functions, and accordingly utilities, of VGAM1102 correlate with, and may be deduced from, the identity of the target genes which VGAM1102 binds and inhibits, and the function of these target genes, as elaborated hereinbelow.

Polypyrimidine Tract Binding Protein 2 (PTBP2, Accession NM_021190) is a VGAM1102 host target gene. PTBP2 BINDING SITE is HOST TARGET binding site found in the 3' untranslated region of mRNA encoded by PTBP2, corresponding to a HOST TARGET binding site such as BINDING SITE I, BINDING SITE II or BINDING SITE III. Table 2 illustrates the complementarity of the nucleotide sequences of PTBP2 BINDING SITE, designated SEQ ID:22168, to the nucleotide sequence of VGAM1102 RNA, herein designated VGAM RNA, also designated SEQ ID:3813.

A function of VGAM1102 is therefore inhibition of Polypyrimidine Tract Binding Protein 2 (PTBP2, Accession NM_021190). Accordingly, utilities of VGAM1102 include diagnosis, prevention and treatment of diseases and clinical conditions associated with PTBP2. Zinc Finger Protein 36, C3H Type-like 2 (ZFP36L2, Accession NM_006887) is another VGAM1102 host target gene. ZFP36L2 BINDING SITE is HOST TARGET binding site found in the 3' untranslated region of mRNA encoded by ZFP36L2, corresponding to a HOST TARGET binding site such as BINDING SITE I, BINDING SITE II or BINDING SITE III. Table 2 illustrates the complementarity of the nucleotide sequences of ZFP36L2 BINDING SITE, designated SEQ ID:13753, to the nucleotide sequence of VGAM1102 RNA, herein designated VGAM RNA, also designated SEQ ID:3813.

Another function of VGAM1102 is therefore inhibition of Zinc Finger Protein 36, C3H Type-like 2 (ZFP36L2, Accession NM_006887). Accordingly, utilities of VGAM1102 include diagnosis, prevention and treatment of diseases and clinical conditions associated with ZFP36L2. FIG. 1 further provides a conceptual description of a novel bioinformatically detected viral gene of the present invention, referred to here as Viral Genomic Address Messenger 1103 (VGAM1103) viral gene, which modulates expression of respective host target genes thereof, the function and utility of which host target genes is known in the art.

VGAM1103 is a novel bioinformatically detected regulatory, non protein coding, viral micro RNA (miRNA) gene. The method by which VGAM1103 was detected is described hereinabove with reference to FIGS. 1-8.

VGAM1103 gene, herein designated VGAM GENE, is a viral gene contained in the genome of Strawberry Mottle Virus. VGAM1103 host target gene, herein designated VGAM HOST TARGET GENE, is a human gene contained in the human genome.

VGAM1103 gene encodes a VGAM1103 precursor RNA, herein designated VGAM PRECURSOR RNA. Similar to other miRNA genes, and unlike most ordinary genes, VGAM1103 precursor RNA does not encode a protein. A nucleotide sequence identical or highly similar to the nucleotide sequence of VGAM1103 precursor RNA is designated SEQ ID:1089, and is provided hereinbelow with reference to the sequence listing part. Nucleotide sequence SEQ ID:1089 is located at position 1299 relative to the genome of Strawberry Mottle Virus.

VGAM1103 precursor RNA folds onto itself, forming VGAM1103 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1103 folded precursor RNA into VGAM1103 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM1103 RNA is designated SEQ ID:3814, and is provided hereinbelow with reference to the sequence listing part.

VGAM1103 host target gene, herein designated VGAM HOST TARGET GENE, encodes a corresponding messenger RNA, VGAM1103 host target RNA, herein designated VGAM HOST TARGET RNA. VGAM1103 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1103 RNA, herein designated VGAM RNA, binds complementarily to one or more host target binding sites located in untranslated regions of VGAM1103 host target RNA, herein designated VGAM HOST TARGET RNA. This complementary binding is due to the fact that the nucleotide sequence of VGAM1103 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1103 RNA, herein designated VGAM RNA, may have a different number of host target binding sites in untranslated regions of a VGAM1103 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1103 RNA, herein designated VGAM RNA, to host target binding sites on VGAM1103 host target RNA, herein designated VGAM HOST TARGET RNA, such as BINDING SITE I, BINDING SITE II and BINDING SITE III, inhibits translation of VGAM1103 host target RNA into VGAM1103 host target protein, herein designated VGAM HOST TARGET PRO- TEIN. VGAM host target protein is therefore outlined by a broken line.

It is appreciated that VGAM1103 host target gene, herein designated VGAM HOST TARGET GENE, in fact represents a plurality of VGAM1103 host target genes. The mRNA of each one of this plurality of VGAM1103 host target genes comprises one or more host target binding sites, each having a nucleotide sequence which is at least partly complementary to VGAM1103 RNA, herein designated VGAM RNA, and which when bound by VGAM1103 RNA causes inhibition of translation of respective one or more VGAM1103 host target proteins.

It is further appreciated by one skilled in the art that the mode of translational inhibition illustrated by FIG. 1 with specific reference to translational inhibition exerted by VGAM1103 gene, herein designated VGAM GENE, on one or more VGAM1103 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1103 is inhibition of expression of host target genes, as part of a novel viral mechanism of attacking a host. Accordingly, utilities of VGAM1103 include diagnosis, prevention and treatment of viral infection by Strawberry Mottle Virus. Specific functions, and accordingly utilities, of VGAM1103 correlate with, and may be deduced from, the identity of the host target genes which VGAM1103 binds and inhibits, and the function of these host target genes, as elaborated hereinbelow.

Nucleotide sequences of the VGAM1103 precursor RNA, herein designated VGAM PRECURSOR RNA, and of the 'diced' VGAM1103 RNA, herein designated VGAM RNA, and a schematic representation of the secondary folding of VGAM1103 folded precursor RNA, herein designated VGAM FOLDED PRECURSOR RNA, of VGAM1103 are further described hereinbelow with reference to Table 1.

Nucleotide sequences of host target binding sites, such as BINDING SITE-I, BINDING SITE-II and BINDING SITE-III of FIG. 1, found on VGAM1103 host target RNA, and schematic representation of the complementarity of each of these host target binding sites to VGAM1103 RNA, herein designated VGAM RNA, are described hereinbelow with reference to Table 2.

As mentioned hereinabove with reference to FIG. 1, a function of VGAM1103 gene, herein designated VGAM is inhibition of expression of VGAM1103 target genes. It is appreciated that specific functions, and accordingly utilities, of VGAM1103 correlate with, and may be deduced from, the identity of the target genes which VGAM1103 binds and inhibits, and the function of these target genes, as elaborated hereinbelow.

Glial Fibrillary Acidic Protein (GFAP, Accession NM_002055) is a VGAM1103 host target gene. GFAP BINDING SITE is HOST TARGET binding site found in the 3' untranslated region of mRNA encoded by GFAP, corresponding to a HOST TARGET binding site such as BINDING SITE I, BINDING SITE II or BINDING SITE III. Table 2 illustrates the complementarity of the nucleotide sequences of GFAP BINDING SITE, designated SEQ ID:7813, to the nucleotide sequence of VGAM1103 RNA, herein designated VGAM RNA, also designated SEQ ID:3814.

A function of VGAM1103 is therefore inhibition of Glial Fibrillary Acidic Protein (GFAP, Accession NM_002055). Accordingly, utilities of VGAM1103 include diagnosis, prevention and treatment of diseases and clinical conditions associated with GFAP. Huntingtin Interacting Protein 2 (HIP2, Accession NM_005339) is another VGAM1103 host target gene. HIP2 BINDING SITE is HOST TARGET binding site found in the 3' untranslated region of mRNA encoded by HIP2, corresponding to a HOST TARGET binding site such as BINDING SITE I, BINDING SITE II or BINDING SITE III. Table 2 illustrates the complementarity of the nucleotide sequences of HIP2 BINDING SITE, designated SEQ ID:11814, to the nucleotide sequence of VGAM1103 RNA, herein designated VGAM RNA, also designated SEQ ID:3814.

Another function of VGAM1103 is therefore inhibition of Huntingtin Interacting Protein 2 (HIP2, Accession NM_005339). Accordingly, utilities of VGAM1103 include diagnosis, prevention and treatment of diseases and clinical conditions associated with HIP2. Interleukin 15 Receptor, Alpha (IL15RA, Accession NM_002189) is another VGAM1103 host target gene. IL15RA BINDING SITE is HOST TARGET binding site found in the 3' untranslated region of mRNA encoded by IL15RA, corresponding to a HOST TARGET binding site such as BINDING SITE I, BINDING SITE II or BINDING SITE III. Table 2 illustrates the complementarity of the nucleotide sequences of IL15RA BINDING SITE, designated SEQ ID:7946, to the nucleotide sequence of VGAM1103 RNA, herein designated VGAM RNA, also designated SEQ ID:3814.

Another function of VGAM1103 is therefore inhibition of Interleukin 15 Receptor, Alpha (IL15RA, Accession NM_002189), a gene which is essential for signal transduction. Accordingly, utilities of VGAM1103 include diagnosis, prevention and treatment of diseases and clinical conditions associated with IL15RA. The function of IL15RA has been established by previous studies. Interleukin 2 (OMIM Ref. No. 147680) and interleukin 15 (OMIM Ref. No. 600554) are cytokines with overlapping but distinct biologic effects. Their receptors share 2 subunits, the IL2R beta (OMIM Ref. No. 146710) and gamma (OMIM Ref. No. 308380) chains, which are essential for signal transduction. The IL2 receptor requires an additional IL2-specific alpha subunit for high affinity IL2 binding (OMIM Ref. No. 147730). Giri et al. (1995) identified and cloned a murine IL15-specific alpha subunit and showed that it is structurally related to IL2R-alpha. However, the murine IL15R-alpha alone bound IL15 with a 1,000-fold higher affinity than that seen with IL2R-alpha and IL2. Anderson et al. (1995) extended these studies into the human system with the isolation of 3 differentially spliced human IL15R-alpha variants that are all capable of high affinity binding of IL15. The cytoplasmic domain of IL15R-alpha, like that of IL2R-alpha is dispensable for mitogenic signaling, suggesting that the primary role of the alpha chains is to confer high affinity binding. At high concentrations, IL-15, like IL-2, is able to signal through a complex of IL2R-beta and -gamma in the absence of the alpha subunit. Furthermore, the IL15RA and IL2RA genes have a similar intron/exon organization and are closely linked in both human and murine genomes. The IL2RA gene (OMIM Ref. No. 147730) had been previously mapped to 10p15-p14 and its homolog to mouse chromosome 2. The human gene IL15RA was mapped to 10p15-p14 by fluorescence in situ hybridization and the mouse Il15ra gene was mapped to chromosome 2 by interspecific backcross mapping.

Full details of the abovementioned studies are described in the following publications, the disclosure of which are hereby incorporated by reference:

Anderson, D. M.; Kumaki, S.; Ahdieh, M.; Bertles, J.; Tometsko, M.; Loomis, A.; Giri, J.; Copeland, N. G.; Gilbert, D. J.; Jenkins, N. A.; Valentine, V.; Shapiro, D. N.; Morris, S. W.; Park, L. S.; Cosman, D.: Functional characterization of the human interleukin-15 receptor alpha chain and close linkage of IL15RA and IL2RA genes. J. Biol. Chem. 270:29862-29869, 1995; and Giri, J. G.; Kumaki, S.; Ahdieh, M.; Friend, D. J.; Loomis, A.; Shanebeck, K.; DuBose, R.; Cosman, D.; Park, L. S.; Anderson, D. M.: Identification and cloning of a novel IL-15 binding.

Further studies establishing the function and utilities of IL15RA are found in John Hopkins OMIM database record ID 601070, and in sited publications numbered 7860-7861 listed in the bibliography section hereinbelow, which are also hereby incorporated by reference. LIM Domain Kinase 1 (LIMK1, Accession NM_016735) is another VGAM1103 host target gene. LIMK1 BINDING SITE is HOST TARGET binding site found in the 3' untranslated region of mRNA encoded by LIMK1, corresponding to a HOST TARGET binding site such as BINDING SITE I, BINDING SITE II or BINDING SITE III. Table 2 illustrates the complementarity of the nucleotide sequences of LIMK1 BINDING SITE, designated SEQ ID:18795, to the nucleotide sequence of VGAM1103 RNA, herein designated VGAM RNA, also designated SEQ ID:3814.

Another function of VGAM1103 is therefore inhibition of LIM Domain Kinase 1 (LIMK1, Accession NM_016735). Accordingly, utilities of VGAM1103 include diagnosis, prevention and treatment of diseases and clinical conditions associated with LIMK1. Podocalyxin-like (PODXL, Accession NM_005397) is another VGAM1103 host target gene. PODXL BINDING SITE is HOST TARGET binding site found in the 3' untranslated region of mRNA encoded by PODXL, corresponding to a HOST TARGET binding site such as BINDING SITE I, BINDING SITE II or BINDING SITE III. Table 2 illustrates the complementarity of the nucleotide sequences of PODXL BINDING SITE, designated SEQ ID:11871, to the nucleotide sequence of VGAM1103 RNA, herein designated VGAM RNA, also designated SEQ ID:3814.

Another function of VGAM1103 is therefore inhibition of Podocalyxin-like (PODXL, Accession NM_005397), a gene which is an antiadhesin. Accordingly, utilities of VGAM1103 include diagnosis, prevention and treatment of diseases and clinical conditions associated with PODXL. The function of PODXL and its association with various diseases and clinical conditions, has been established by previous studies, as described hereinabove with reference to VGAM247. COE2 (Accession XM_034639) is another VGAM1103 host target gene. COE2 BINDING SITE is HOST TARGET binding site found in the 3' untranslated region of mRNA encoded by COE2, corresponding to a HOST TARGET binding site such as BINDING SITE I, BINDING SITE II or BINDING SITE III. Table 2 illustrates the complementarity of the nucleotide sequences of COE2 BINDING SITE, designated SEQ ID:32126, to the nucleotide sequence of VGAM1103 RNA, herein designated VGAM RNA, also designated SEQ ID:3814.

Another function of VGAM1103 is therefore inhibition of COE2 (Accession XM_034639). Accordingly, utilities of VGAM1103 include diagnosis, prevention and treatment of diseases and clinical conditions associated with COE2. DKFZp547H236 (Accession XM_085929) is another VGAM1103 host target gene. DKFZp547H236 BINDING SITE is HOST TARGET binding site found in the 5' untranslated region of mRNA encoded by DKFZp547H236, corresponding to a HOST TARGET binding site such as BINDING SITE I, BINDING SITE II or BINDING SITE III. Table 2 illustrates the complementarity of the nucleotide sequences of DKFZp547H236 BINDING SITE, designated SEQ ID:38405, to the nucleotide sequence of VGAM1103 RNA, herein designated VGAM RNA, also designated SEQ ID:3814.

Another function of VGAM1103 is therefore inhibition of DKFZp547H236 (Accession XM_085929). Accordingly, utilities of VGAM1103 include diagnosis, prevention and treatment of diseases and clinical conditions associated with DKFZp547H236. Epididymal Sperm Binding Protein 1 (ELSPBP1, Accession NM_022142) is another VGAM1103 host target gene. ELSPBP1 BINDING SITE is HOST TARGET binding site found in the 5' untranslated region of mRNA encoded by ELSPBP1, corresponding to a HOST TARGET binding site such as BINDING SITE I, BINDING SITE II or BINDING SITE III. Table 2 illustrates the complementarity of the nucleotide sequences of ELSPBP1 BINDING SITE, designated SEQ ID:22704, to the nucleotide sequence of VGAM1103 RNA, herein designated VGAM RNA, also designated SEQ ID:3814.

Another function of VGAM1103 is therefore inhibition of Epididymal Sperm Binding Protein 1 (ELSPBP1, Accession NM_022142). Accordingly, utilities of VGAM1103 include diagnosis, prevention and treatment of diseases and clinical conditions associated with ELSPBP1. Ecotropic Viral Integration Site 5 (EVI5, Accession NM_005665) is another VGAM1103 host target gene. EVI5 BINDING SITE is HOST TARGET binding site found in the 3' untranslated region of mRNA encoded by EVI5, corresponding to a HOST TARGET binding site such as BINDING SITE I, BINDING SITE II or BINDING SITE III. Table 2 illustrates the complementarity of the nucleotide sequences of EVI5 BINDING SITE, designated SEQ ID:12210, to the nucleotide sequence of VGAM1103 RNA, herein designated VGAM RNA, also designated SEQ ID:3814.

Another function of VGAM1103 is therefore inhibition of Ecotropic Viral Integration Site 5 (EVI5, Accession NM_005665). Accordingly, utilities of VGAM1103 include diagnosis, prevention and treatment of diseases and clinical conditions associated with EVI5. FLJ10853 (Accession NM_018246) is another VGAM1103 host target gene. FLJ10853 BINDING SITE is HOST TARGET binding site found in the 3' untranslated region of mRNA encoded by FLJ10853, corresponding to a HOST TARGET binding site such as BINDING SITE I, BINDING SITE II or BINDING SITE III. Table 2 illustrates the complementarity of the nucleotide sequences of FLJ10853 BINDING SITE, designated SEQ ID:20214, to the nucleotide sequence of VGAM1103 RNA, herein designated VGAM RNA, also designated SEQ ID:3814.

Another function of VGAM1103 is therefore inhibition of FLJ10853 (Accession NM_018246). Accordingly, utilities of VGAM1103 include diagnosis, prevention and treatment of diseases and clinical conditions associated with FLJ10853. FLJ12770 (Accession NM_032174) is another VGAM1103 host target gene. FLJ12770 BINDING SITE is HOST TARGET binding site found in the 3' untranslated region of mRNA encoded by FLJ12770, corresponding to a HOST TARGET binding site such as BINDING SITE I, BINDING SITE II or BINDING SITE III. Table 2 illustrates the complementarity of the nucleotide sequences of FLJ12770 BINDING SITE, designated SEQ ID:25885, to the nucleotide sequence of VGAM1103 RNA, herein designated VGAM RNA, also designated SEQ ID:3814.

Another function of VGAM1103 is therefore inhibition of FLJ12770 (Accession NM_032174). Accordingly, utilities of VGAM1103 include diagnosis, prevention and treatment of diseases and clinical conditions associated with FLJ12770. FLJ13491 (Accession NM_024623) is another VGAM1103 host target gene. FLJ13491 BINDING SITE is HOST TARGET binding site found in the 5' untranslated region of mRNA encoded by FLJ13491, corresponding to a HOST TARGET binding site such as BINDING SITE I, BINDING SITE II or BINDING SITE III. Table 2 illustrates the complementarity of the nucleotide sequences of FLJ13491 BINDING SITE, designated SEQ ID:23887, to the nucleotide sequence of VGAM1103 RNA, herein designated VGAM RNA, also designated SEQ ID:3814.

Another function of VGAM1103 is therefore inhibition of FLJ13491 (Accession NM_024623). Accordingly, utilities of VGAM1103 include diagnosis, prevention and treatment of diseases and clinical conditions associated with FLJ13491. FLJ14166 (Accession NM_024565) is another VGAM1103 host target gene. FLJ14166 BINDING SITE is HOST TARGET binding site found in the 3' untranslated region of mRNA encoded by FLJ14166, corresponding to a HOST TARGET binding site such as BINDING SITE I, BINDING SITE II or BINDING SITE III. Table 2 illustrates the complementarity of the nucleotide sequences of FLJ14166 BINDING SITE, designated SEQ ID:23791, to the nucleotide sequence of VGAM1103 RNA, herein designated VGAM RNA, also designated SEQ ID:3814.

Another function of VGAM1103 is therefore inhibition of FLJ14166 (Accession NM_024565). Accordingly, utilities of VGAM1103 include diagnosis, prevention and treatment of diseases and clinical conditions associated with FLJ14166. FLJ14564 (Accession XM_084459) is another VGAM1103 host target gene. FLJ14564 BINDING SITE is HOST TARGET binding site found in the 3' untranslated region of mRNA encoded by FLJ14564, corresponding to a HOST TARGET binding site such as BINDING SITE I, BINDING SITE II or BINDING SITE III. Table 2 illustrates the complementarity of the nucleotide sequences of FLJ14564 BINDING SITE, designated SEQ ID:37595, to the nucleotide sequence of VGAM1103 RNA, herein designated VGAM RNA, also designated SEQ ID:3814.

Another function of VGAM1103 is therefore inhibition of FLJ14564 (Accession XM_084459). Accordingly, utilities of VGAM1103 include diagnosis, prevention and treatment of diseases and clinical conditions associated with FLJ14564. FLJ20315 (Accession NM_017763) is another VGAM1103 host target gene. FLJ20315 BINDING SITE is HOST TARGET binding site found in the 3' untranslated region of mRNA encoded by FLJ20315, corresponding to a HOST TARGET binding site such as BINDING SITE I, BINDING SITE II or BINDING SITE III. Table 2 illustrates the complementarity of the nucleotide sequences of FLJ20315 BINDING SITE, designated SEQ ID:19378, to the nucleotide sequence of VGAM1103 RNA, herein designated VGAM RNA, also designated SEQ ID:3814.

Another function of VGAM1103 is therefore inhibition of FLJ20315 (Accession NM_017763). Accordingly, utilities of VGAM1103 include diagnosis, prevention and treatment of diseases and clinical conditions associated with FLJ20315. HTCD37 (Accession XM_041884) is another VGAM1103 host target gene. HTCD37 BINDING SITE is HOST TARGET binding site found in the 3' untranslated region of mRNA encoded by HTCD37, corresponding to a HOST TARGET binding site such as BINDING SITE I, BINDING SITE II or BINDING SITE III. Table 2 illustrates the complementarity of the nucleotide sequences of HTCD37 BINDING SITE, designated SEQ ID:33617, to the nucleotide sequence of VGAM1103 RNA, herein designated VGAM RNA, also designated SEQ ID:3814.

Another function of VGAM1103 is therefore inhibition of HTCD37 (Accession XM_041884). Accordingly, utilities of VGAM1103 include diagnosis, prevention and treatment of diseases and clinical conditions associated with HTCD37. KIAA0040 (Accession NM_014656) is another VGAM1103 host target gene. KIAA0040 BINDING SITE is HOST TARGET binding site found in the 3' untranslated region of mRNA encoded by KIAA0040, corresponding to a HOST TARGET binding site such as BINDING SITE I, BINDING SITE II or BINDING SITE III. Table 2 illustrates the complementarity of the nucleotide sequences of KIAA0040 BINDING SITE, designated SEQ ID:16096, to the nucleotide sequence of VGAM1103 RNA, herein designated VGAM RNA, also designated SEQ ID:3814.

Another function of VGAM1103 is therefore inhibition of KIAA0040 (Accession NM_014656). Accordingly, utilities of VGAM1103 include diagnosis, prevention and treatment of diseases and clinical conditions associated with KIAA0040. KIAA0682 (Accession NM_016196) is another VGAM1103 host target gene. KIAA0682 BINDING SITE is HOST TARGET binding site found in the 3' untranslated region of mRNA encoded by KIAA0682, corresponding to a HOST TARGET binding site such as BINDING SITE I, BINDING SITE II or BINDING SITE III. Table 2 illustrates the complementarity of the nucleotide sequences of KIAA0682 BINDING SITE, designated SEQ ID:18289, to the nucleotide sequence of VGAM1103 RNA, herein designated VGAM RNA, also designated SEQ ID:3814.

Another function of VGAM1103 is therefore inhibition of KIAA0682 (Accession NM_016196). Accordingly, utilities of VGAM1103 include diagnosis, prevention and treatment of diseases and clinical conditions associated with KIAA0682. KIAA1297 (Accession XM_051005) is another VGAM1103 host target gene. KIAA1297 BINDING SITE is HOST TARGET binding site found in the 5' untranslated region of mRNA encoded by KIAA1297, corresponding to a HOST TARGET binding site such as BINDING SITE I, BINDING SITE II or BINDING SITE III. Table 2 illustrates the complementarity of the nucleotide sequences of KIAA1297 BINDING SITE, designated SEQ ID:35712, to the nucleotide sequence of VGAM1103 RNA, herein designated VGAM RNA, also designated SEQ ID:3814.

Another function of VGAM1103 is therefore inhibition of KIAA1297 (Accession XM_051005). Accordingly, utilities of VGAM1103 include diagnosis, prevention and treatment of diseases and clinical conditions associated with KIAA1297. KIAA1854 (Accession XM_049884) is another VGAM1103 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35525, to the nucleotide sequence of VGAM1103 RNA, herein designated VGAM RNA, also designated SEQ ID:3814.

Another function of VGAM1103 is therefore inhibition of KIAA1854 (Accession XM_049884). Accordingly, utilities of VGAM1103 include diagnosis, prevention and treatment of diseases and clinical conditions associated with KIAA1854. My015 (Accession XM_039512) is another VGAM1103 host target gene. My015 BINDING SITE is HOST TARGET binding site found in the 3' untranslated region of mRNA encoded by My015, corresponding to a HOST TARGET binding site such as BINDING SITE I, BINDING SITE II or BINDING SITE III. Table 2 illustrates the complementarity of the nucleotide sequences of My015 BINDING SITE, designated SEQ ID:33105, to the nucleotide sequence of VGAM1103 RNA, herein designated VGAM RNA, also designated SEQ ID:3814.

Another function of VGAM1103 is therefore inhibition of My015 (Accession XM_039512). Accordingly, utilities of VGAM1103 include diagnosis, prevention and treatment of diseases and clinical conditions associated with My015. LOC122553 (Accession XM_058630) is another VGAM1103 host target gene. LOC122553 BINDING SITE is HOST TARGET binding site found in the 3' untranslated region of mRNA encoded by LOC122553, corresponding to a HOST TARGET binding site such as BINDING SITE I, BINDING SITE II or BINDING SITE III. Table 2 illustrates the complementarity of the nucleotide sequences of LOC122553 BINDING SITE, designated SEQ ID:36689, to the nucleotide sequence of VGAM1103 RNA, herein designated VGAM RNA, also designated SEQ ID:3814.

Another function of VGAM1103 is therefore inhibition of LOC122553 (Accession XM_058630). Accordingly, utilities of VGAM1103 include diagnosis, prevention and treatment of diseases and clinical conditions associated with LOC122553. LOC149146 (Accession XM_086441) is another VGAM1103 host target gene. LOC149146 BINDING SITE is HOST TARGET binding site found in the 5' untranslated region of mRNA encoded by LOC149146, corresponding to a HOST TARGET binding site such as BINDING SITE I, BINDING SITE II or BINDING SITE III. Table 2 illustrates the complementarity of the nucleotide sequences of LOC149146 BINDING SITE, designated SEQ ID:38654, to the nucleotide sequence of VGAM1103 RNA, herein designated VGAM RNA, also designated SEQ ID:3814.

Another function of VGAM1103 is therefore inhibition of LOC149146 (Accession XM_086441). Accordingly, utilities of VGAM1103 include diagnosis, prevention and treatment of diseases and clinical conditions associated with LOC149146. LOC150279 (Accession XM_086820) is another VGAM1103 host target gene. LOC150279 BINDING SITE is HOST TARGET binding site found in the 3' untranslated region of mRNA encoded by LOC150279, corresponding to a HOST TARGET binding site such as BINDING SITE I, BINDING SITE II or BINDING SITE III. Table 2 illustrates the complementarity of the nucleotide sequences of LOC150279 BINDING SITE, designated SEQ ID:38899, to the nucleotide sequence of VGAM1103 RNA, herein designated VGAM RNA, also designated SEQ ID:3814.

Another function of VGAM1103 is therefore inhibition of LOC150279 (Accession XM_086820). Accordingly, utilities of VGAM1103 include diagnosis, prevention and treatment of diseases and clinical conditions associated with LOC150279. LOC150951 (Accession XM_097975) is another VGAM1103 host target gene. LOC150951 BINDING SITE is HOST TARGET binding site found in the 5' untranslated region of mRNA encoded by LOC150951, corresponding to a HOST TARGET binding site such as BINDING SITE I, BINDING SITE II or BINDING SITE III. Table 2 illustrates the complementarity of the nucleotide sequences of LOC150951 BINDING SITE, designated SEQ ID:41278, to the nucleotide sequence of VGAM1103 RNA, herein designated VGAM RNA, also designated SEQ ID:3814.

Another function of VGAM1103 is therefore inhibition of LOC150951 (Accession XM_097975). Accordingly, utilities of VGAM1103 include diagnosis, prevention and treatment of diseases and clinical conditions associated with LOC150951. LOC158549 (Accession XM_098963) is another VGAM1103 host target gene. LOC158549 BINDING SITE is HOST TARGET binding site found in the 5' untranslated region of mRNA encoded by LOC158549, corresponding to a HOST TARGET binding site such as BINDING SITE I, BINDING SITE II or BINDING SITE III. Table 2 illustrates the complementarity of the nucleotide sequences of LOC158549 BINDING SITE, designated SEQ ID:42005, to the nucleotide sequence of VGAM1103 RNA, herein designated VGAM RNA, also designated SEQ ID:3814.

Another function of VGAM1103 is therefore inhibition of LOC158549 (Accession XM_098963). Accordingly, utilities of VGAM1103 include diagnosis, prevention and treatment of diseases and clinical conditions associated with LOC158549. LOC255252 (Accession XM_170779) is another VGAM1103 host target gene. LOC255252 BINDING SITE is HOST TARGET binding site found in the 3' untranslated region of mRNA encoded by LOC255252, corresponding to a HOST TARGET binding site such as BINDING SITE I, BINDING SITE II or BINDING SITE III. Table 2 illustrates the complementarity of the nucleotide sequences of LOC255252 BINDING SITE, designated SEQ ID:45545, to the nucleotide sequence of VGAM1103 RNA, herein designated VGAM RNA, also designated SEQ ID:3814.

Another function of VGAM1103 is therefore inhibition of LOC255252 (Accession XM_170779). Accordingly, utilities of VGAM1103 include diagnosis, prevention and treatment of diseases and clinical conditions associated with LOC255252. LOC255452 (Accession XM_174088) is another VGAM1103 host target gene. LOC255452 BINDING SITE is HOST TARGET binding site found in the 3' untranslated region of mRNA encoded by LOC255452, corresponding to a HOST TARGET binding site such as BINDING SITE I, BINDING SITE II or BINDING SITE III. Table 2 illustrates the complementarity of the nucleotide sequences of LOC255452 BINDING SITE, designated SEQ ID:46573, to the nucleotide sequence of VGAM1103 RNA, herein designated VGAM RNA, also designated SEQ ID:3814.

Another function of VGAM1103 is therefore inhibition of LOC255452 (Accession XM_174088). Accordingly, utilities of VGAM1103 include diagnosis, prevention and treatment of diseases and clinical conditions associated with LOC255452. LOC257428 (Accession XM_168584) is another VGAM1103 host target gene. LOC257428 BINDING SITE is HOST TARGET binding site found in the 5' untranslated region of mRNA encoded by LOC257428, corresponding to a HOST TARGET binding site such as BINDING SITE I, BINDING SITE II or BINDING SITE III. Table 2 illustrates the complementarity of the nucleotide sequences of LOC257428 BINDING SITE, designated SEQ ID:45260, to the nucleotide sequence of VGAM1103 RNA, herein designated VGAM RNA, also designated SEQ ID:3814.

Another function of VGAM1103 is therefore inhibition of LOC257428 (Accession XM_168584). Accordingly, utilities of VGAM1103 include diagnosis, prevention and treatment of diseases and clinical conditions associated with LOC257428. LOC55831 (Accession NM_018447) is another VGAM1103 host target gene. LOC55831 BINDING SITE is HOST TARGET binding site found in the 5' untranslated region of mRNA encoded by LOC55831, corresponding to a HOST TARGET binding site such as BINDING SITE I, BINDING SITE II or BINDING SITE III. Table 2 illustrates the complementarity of the nucleotide sequences of LOC55831 BINDING SITE, designated SEQ ID:20516, to the nucleotide sequence of VGAM1103 RNA, herein designated VGAM RNA, also designated SEQ ID:3814.

Another function of VGAM1103 is therefore inhibition of LOC55831 (Accession NM_018447). Accordingly, utilities of VGAM1103 include diagnosis, prevention and treatment of diseases and clinical conditions associated with LOC55831. LOC91050 (Accession XM_035703) is another VGAM1103 host target gene. LOC91050 BINDING SITE is HOST TARGET binding site found in the 3' untranslated region of mRNA encoded by LOC91050, corresponding to a HOST TARGET binding site such as BINDING SITE I, BINDING SITE II or BINDING SITE III. Table 2 illustrates the complementarity of the nucleotide sequences of LOC91050 BINDING SITE, designated SEQ ID:32334, to the nucleotide sequence of VGAM1103 RNA, herein designated VGAM RNA, also designated SEQ ID:3814.

Another function of VGAM1103 is therefore inhibition of LOC91050 (Accession XM_035703). Accordingly, utilities of VGAM1103 include diagnosis, prevention and treatment of diseases and clinical conditions associated with LOC91050. LOC91149 (Accession XM_036480) is another VGAM1103 host target gene. LOC91149 BINDING SITE is HOST TARGET binding site found in the 5' untranslated region of mRNA encoded by LOC91149, corresponding to a HOST TARGET binding site such as BINDING SITE I, BINDING SITE II or BINDING SITE III. Table 2 illustrates the complementarity of the nucleotide sequences of LOC91149 BINDING SITE, designated SEQ ID:32456, to the nucleotide sequence of VGAM1103 RNA, herein designated VGAM RNA, also designated SEQ ID:3814.

Another function of VGAM1103 is therefore inhibition of LOC91149 (Accession XM_036480). Accordingly, utilities of VGAM1103 include diagnosis, prevention and treatment of diseases and clinical conditions associated with LOC91149. LOC91748 (Accession XM_040343) is another VGAM1103 host target gene. LOC91748 BINDING SITE is HOST TARGET binding site found in the 3' untranslated region of mRNA encoded by LOC91748, corresponding to a HOST TARGET binding site such as BINDING SITE I, BINDING SITE II or BINDING SITE III. Table 2 illustrates the complementarity of the nucleotide sequences of LOC91748 BINDING SITE, designated SEQ ID:33286, to the nucleotide sequence of VGAM1103 RNA, herein designated VGAM RNA, also designated SEQ ID:3814.

Another function of VGAM1103 is therefore inhibition of LOC91748 (Accession XM_040343). Accordingly, utilities of VGAM1103 include diagnosis, prevention and treatment of diseases and clinical conditions associated with LOC91748. LOC91759 (Accession XM_040467) is another VGAM1103 host target gene. LOC91759 BINDING SITE is HOST TARGET binding site found in the 3' untranslated region of mRNA encoded by LOC91759, corresponding to a HOST TARGET binding site such as BINDING SITE I, BINDING SITE II or BINDING SITE III. Table 2 illustrates the complementarity of the nucleotide sequences of LOC91759 BINDING SITE, designated SEQ ID:33303, to the nucleotide sequence of VGAM1103 RNA, herein designated VGAM RNA, also designated SEQ ID:3814.

Another function of VGAM1103 is therefore inhibition of LOC91759 (Accession XM_040467). Accordingly, utilities of VGAM1103 include diagnosis, prevention and treatment of diseases and clinical conditions associated with LOC91759. FIG. 1 further provides a conceptual description of a novel bioinformatically detected viral gene of the present invention, referred to here as Viral Genomic Address Messenger 1104 (VGAM1104) viral gene, which modulates expression of respective host target genes thereof, the function and utility of which host target genes is known in the art.

VGAM1104 is a novel bioinformatically detected regulatory, non protein coding, viral micro RNA (miRNA) gene. The method by which VGAM1104 was detected is described hereinabove with reference to FIGS. 1-8.

VGAM1104 gene, herein designated VGAM GENE, is a viral gene contained in the genome of Human Herpesvirus 2. VGAM1104 host target gene, herein designated VGAM HOST TARGET GENE, is a human gene contained in the human genome.

VGAM1104 gene encodes a VGAM1104 precursor RNA, herein designated VGAM PRECURSOR RNA. Similar to other miRNA genes, and unlike most ordinary genes, VGAM1104 precursor RNA does not encode a protein. A nucleotide sequence identical or highly similar to the nucleotide sequence of VGAM1104 precursor RNA is designated SEQ ID:1090, and is provided hereinbelow with reference to the sequence listing part. Nucleotide sequence SEQ ID:1090 is located at position 94244 relative to the genome of Human Herpesvirus 2.

VGAM1104 precursor RNA folds onto itself, forming VGAM1104 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1104 folded precursor RNA into VGAM1104 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1104 RNA is designated SEQ ID:3815, and is provided hereinbelow with reference to the sequence listing part.

VGAM1104 host target gene, herein designated VGAM HOST TARGET GENE, encodes a corresponding messenger RNA, VGAM1104 host target RNA, herein designated VGAM HOST TARGET RNA. VGAM1104 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1104 RNA, herein designated VGAM RNA, binds complementarily to one or more host target binding sites located in untranslated regions of VGAM1104 host target RNA, herein designated VGAM HOST TARGET RNA. This complementary binding is due to the fact that the nucleotide sequence of VGAM1104 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1104 RNA, herein designated VGAM RNA, may have a different number of host target binding sites in untranslated regions of a VGAM1104 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1104 RNA, herein designated VGAM RNA, to host target binding sites on VGAM1104 host target RNA, herein designated VGAM HOST TARGET RNA, such as BINDING SITE I, BINDING SITE II and BINDING SITE III, inhibits translation of VGAM1104 host target RNA into VGAM1104 host target protein, herein designated VGAM HOST TARGET PROTEIN. VGAM host target protein is therefore outlined by a broken line.

It is appreciated that VGAM1104 host target gene, herein designated VGAM HOST TARGET GENE, in fact represents a plurality of VGAM1104 host target genes. The mRNA of each one of this plurality of VGAM1104 host target genes comprises one or more host target binding sites, each having a nucleotide sequence which is at least partly complementary to VGAM1104 RNA, herein designated VGAM RNA, and which when bound by VGAM1104 RNA causes inhibition of translation of respective one or more VGAM1104 host target proteins.

It is further appreciated by one skilled in the art that the mode of translational inhibition illustrated by FIG. 1 with specific reference to translational inhibition exerted by VGAM1104 gene, herein designated VGAM GENE, on one or more VGAM1104 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1104 is inhibition of expression of host target genes, as part of a novel viral mechanism of attacking a host. Accordingly, utilities of VGAM1104 include diagnosis, prevention and treatment of viral infection by Human Herpesvirus 2. Specific functions, and accordingly utilities, of VGAM1104 correlate with, and may be deduced from, the identity of the host target genes which VGAM1104 binds and inhibits, and the function of these host target genes, as elaborated hereinbelow.

Nucleotide sequences of the VGAM1104 precursor RNA, herein designated VGAM PRECURSOR RNA, and of the 'diced' VGAM1104 RNA, herein designated VGAM RNA, and a schematic representation of the secondary folding of VGAM1104 folded precursor RNA, herein designated VGAM FOLDED PRECURSOR RNA, of VGAM1104 are further described hereinbelow with reference to Table 1.

Nucleotide sequences of host target binding sites, such as BINDING SITE-I, BINDING SITE-II and BINDING SITE-III of FIG. 1, found on VGAM1104 host target RNA, and schematic representation of the complementarity of each of these host target binding sites to VGAM1104 RNA, herein designated VGAM RNA, are described hereinbelow with reference to Table 2.

As mentioned hereinabove with reference to FIG. 1, a function of VGAM1104 gene, herein designated VGAM is inhibition of expression of VGAM1104 target genes. It is appreciated that specific functions, and accordingly utilities, of VGAM1104 correlate with, and may be deduced from, the identity of the target genes which VGAM1104 binds and inhibits, and the function of these target genes, as elaborated hereinbelow.

MGC15854 (Accession NM_145029) is a VGAM1104 host target gene. MGC15854 BINDING SITE is HOST TARGET binding site found in the 5' untranslated region of mRNA encoded by MGC15854, corresponding to a HOST TARGET binding site such as BINDING SITE I, BINDING SITE II or BINDING SITE III. Table 2 illustrates the complementarity of the nucleotide sequences of MGC15854 BINDING SITE, designated SEQ ID:29642, to the nucleotide sequence of VGAM1104 RNA, herein designated VGAM RNA, also designated SEQ ID:3815.

A function of VGAM1104 is therefore inhibition of MGC15854 (Accession NM_145029). Accordingly, utilities of VGAM1104 include diagnosis, prevention and treatment of diseases and clinical conditions associated with MGC15854. FIG. 1 further provides a conceptual description of a novel bioinformatically detected viral gene of the present invention, referred to here as Viral Genomic Address Messenger 1105 (VGAM1105) viral gene, which modulates expression of respective host target genes thereof, the function and utility of which host target genes is known in the art.

VGAM1105 is a novel bioinformatically detected regulatory, non protein coding, viral micro RNA (miRNA) gene. The method by which VGAM1105 was detected is described hereinabove with reference to FIGS. 1-8.

VGAM1105 gene, herein designated VGAM GENE, is a viral gene contained in the genome of Human Herpesvirus 2. VGAM1105 host target gene, herein designated VGAM HOST TARGET GENE, is a human gene contained in the human genome.

VGAM1105 gene encodes a VGAM1105 precursor RNA, herein designated VGAM PRECURSOR RNA. Similar to other miRNA genes, and unlike most ordinary genes, VGAM1105 precursor RNA does not encode a protein. A nucleotide sequence identical or highly similar to the nucleotide sequence of VGAM1105 precursor RNA is designated SEQ ID:1091, and is provided hereinbelow with reference to the sequence listing part. Nucleotide sequence SEQ ID:1091 is located at position 97913 relative to the genome of Human Herpesvirus 2.

VGAM1105 precursor RNA folds onto itself, forming VGAM1105 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1105 folded precursor RNA into VGAM1105 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1105 RNA is designated SEQ ID:3816, and is provided hereinbelow with reference to the sequence listing part.

VGAM1105 host target gene, herein designated VGAM HOST TARGET GENE, encodes a corresponding messenger RNA, VGAM1105 host target RNA, herein designated VGAM HOST TARGET RNA. VGAM1105 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1105 RNA, herein designated VGAM RNA, binds complementarily to one or more host target binding sites located in untranslated regions of VGAM1105 host target RNA, herein designated VGAM HOST TARGET RNA. This complementary binding is due to the fact that the nucleotide sequence of VGAM1105 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1105 RNA, herein designated VGAM RNA, may have a different number of host target binding sites in untranslated regions of a VGAM1105 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1105 RNA, herein designated VGAM RNA, to host target binding sites on VGAM1105 host target RNA, herein designated VGAM HOST TARGET RNA, such as BINDING SITE I, BINDING SITE II and BINDING SITE III, inhibits translation of VGAM1105 host target RNA into VGAM1105 host target protein, herein designated VGAM HOST TARGET PROTEIN. VGAM host target protein is therefore outlined by a broken line.

It is appreciated that VGAM1105 host target gene, herein designated VGAM HOST TARGET GENE, in fact represents a plurality of VGAM1105 host target genes. The mRNA of each one of this plurality of VGAM1105 host target genes comprises one or more host target binding sites, each having a nucleotide sequence which is at least partly complementary to VGAM1105 RNA, herein designated VGAM RNA, and which when bound by VGAM1105 RNA causes inhibition of translation of respective one or more VGAM1105 host target proteins.

It is further appreciated by one skilled in the art that the mode of translational inhibition illustrated by FIG. 1 with specific reference to translational inhibition exerted by VGAM1105 gene, herein designated VGAM GENE, on one or more VGAM1105 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1105 is inhibition of expression of host target genes, as part of a novel viral mechanism of attacking a host. Accordingly, utilities of VGAM1105 include diagnosis, prevention and treatment of viral infection by Human Herpesvirus 2. Specific functions, and accordingly utilities, of VGAM1105 correlate with, and may be deduced from, the identity of the host target genes which VGAM1105 binds and inhibits, and the function of these host target genes, as elaborated hereinbelow.

Nucleotide sequences of the VGAM1105 precursor RNA, herein designated VGAM PRECURSOR RNA, and of the 'diced' VGAM1105 RNA, herein designated VGAM RNA, and a schematic representation of the secondary folding of VGAM1105 folded precursor RNA, herein designated VGAM FOLDED PRECURSOR RNA, of VGAM1105 are further described hereinbelow with reference to Table 1.

Nucleotide sequences of host target binding sites, such as BINDING SITE-I, BINDING SITE-II and BINDING SITE-III of FIG. 1, found on VGAM1105 host target RNA, and schematic representation of the complementarity of each of these host target binding sites to VGAM1105 RNA, herein designated VGAM RNA, are described hereinbelow with reference to Table 2.

As mentioned hereinabove with reference to FIG. 1, a function of VGAM1105 gene, herein designated VGAM is inhibition of expression of VGAM1105 target genes. It is appreciated that specific functions, and accordingly utilities, of VGAM1105 correlate with, and may be deduced from, the identity of the target genes which VGAM1105 binds and inhibits, and the function of these target genes, as elaborated hereinbelow.

Coatomer Protein Complex, Subunit Alpha (COPA, Accession NM_004371) is a VGAM1105 host target gene. COPA BINDING SITE is HOST TARGET binding site found in the 5' untranslated region of mRNA encoded by COPA, corresponding to a HOST TARGET binding site such as BINDING SITE I, BINDING SITE II or BINDING SITE III. Table 2 illustrates the complementarity of the nucleotide sequences of COPA BINDING SITE, designated SEQ ID:10591, to the nucleotide sequence of VGAM1105 RNA, herein designated VGAM RNA, also designated SEQ ID:3816.

A function of VGAM1105 is therefore inhibition of Coatomer Protein Complex, Subunit Alpha (COPA, Accession NM_004371), a gene which is invovled protein transport between the endoplasmic reticulum (ER) and Golgi compartments. Accordingly, utilities of VGAM1105 include diagnosis, prevention and treatment of diseases and clinical conditions associated with COPA. The function of COPA has been established by previous studies. In eukaryotic cells, protein transport between the endoplasmic reticulum (ER) and Golgi compartments is mediated in part by non-clathrin-coated vesicular coat proteins (COPs). Seven COP subunits have been recognized, and represent components of a complex known as coatomer, or COPI. The subunits are designated alpha-COP, beta-COP (OMIM Ref. No. 600959), beta-prime-COP, gamma-COP, delta-COP (OMIM Ref. No. 600820), epsilon-COP (OMIM Ref. No. 606942), and zeta-COP COPI is a heptameric protein recruited to membranes by ARF1 (OMIM Ref. No. 103180), a GTP-binding protein. Coat assembly helps in the transport of budding off membrane between the ER and Golgi apparatus. Using fluorescence microscopy, Presley et al. (2002) showed that guanine nucleotide exchange-activated ARF1 at the Golgi membrane recruits and binds cytoplasmic COPI to the membranes. Photobleaching experiments demonstrated that COPI remains at the membranes after ARF1 has been hydrolysed by GTPase-activating protein (GAP; 139150). COPI binds to membrane cargo, soluble-cargo receptors, or other Golgi proteins. Uncoating, or the release of COPI from Golgi membranes to the cytoplasm, then occurs, which is inhibited by AIF (PDCD8; 300169). Presley et al. (2002) concluded from their kinetic and biochemical analyses that COPI and ARF1 continuously bind and release from Golgi membranes, allowing the membrane at these sites to recruit cargo, alter their phospholipid composition, and become larger, phase-separated domains Chow (1997) reported the genomic organization of the COPA gene. It contains 33 exons ranging in size from 67 to 611 bp. All exon-intron junctions conform with the GT-AG rule. The 32 introns range from about 80 bp to 4 kb, with the genomic DNA of COPA estimated to span approximately 37 kb. The untranscribed and noncoding portions of the 5-prime end of the gene lacked TATA and CAAT boxes but displayed a high GC content, consistent with its being a housekeeping gene Full details of the abovementioned studies are described in the following publications, the disclosure of which are hereby incorporated by reference:

Presley, J. F.; Ward, T. H.; Pfeifer, A. C.; Siggia, E. D.; Phair, R. D.; Lippincott-Schwartz, J.: Dissection of COPI and Arf1 dynamics in vivo and role in Golgi membrane transport. Nature 417:187-193, 2002; and Quek, H. H.; Chow, V. T. K.: Genomic organization and mapping of the human HEP-COP gene (COPA) to 1q. Cytogenet. Cell Genet. 76:139-143, 1997.

Further studies establishing the function and utilities of COPA are found in John Hopkins OMIM database record ID 601924, and in sited publications numbered 581 and 5812-5813 listed in the bibliography section hereinbelow, which are also hereby incorporated by reference. Forkhead Box D1 (FOXD1, Accession NM_004472) is another VGAM1105 host target gene. FOXD1 BINDING SITE is HOST TARGET binding site found in the 5' untranslated region of mRNA encoded by FOXD1, corresponding to a HOST TARGET binding site such as BINDING SITE I, BINDING SITE II or BINDING SITE III. Table 2 illustrates the complementarity of the nucleotide sequences of FOXD1 BINDING SITE, designated SEQ ID:10779, to the nucleotide sequence of VGAM1105 RNA, herein designated VGAM RNA, also designated SEQ ID:3816.

Another function of VGAM1105 is therefore inhibition of Forkhead Box D1 (FOXD1, Accession NM_004472), a gene which has regulatory role in embryonic development. Accordingly, utilities of VGAM1105 include diagnosis, prevention and treatment of diseases and clinical conditions associated with FOXD1. The function of FOXD1 and its association with various diseases and clinical conditions, has been established by previous studies, as described hereinabove with reference to VGAM615. Glycogenin (GYG, Accession NM_004130) is another VGAM1105 host target gene. GYG BINDING SITE is HOST TARGET binding site found in the 3' untranslated region of mRNA encoded by GYG, corresponding to a HOST TARGET binding site such as BINDING SITE I, BINDING SITE II or BINDING SITE III. Table 2 illustrates the complementarity of the nucleotide sequences of GYG BINDING SITE, designated SEQ ID:10340, to the nucleotide sequence of VGAM1105 RNA, herein designated VGAM RNA, also designated SEQ ID:3816.

Another function of VGAM1105 is therefore inhibition of Glycogenin (GYG, Accession NM_004130), a gene which primes de novo glycogen synthesis. Accordingly, utilities of VGAM1105 include diagnosis, prevention and treatment of diseases and clinical conditions associated with GYG. The function of GYG and its association with various diseases and clinical conditions, has been established by previous studies, as described hereinabove with reference to VGAM777. Protein Tyrosine Phosphatase, Receptor Type, F (PTPRF, Accession NM_002840) is another VGAM1105 host target gene. PTPRF BINDING SITE1 and PTPRF BINDING SITE2 are HOST TARGET binding sites found in untranslated regions of mRNA encoded by PTPRF, corresponding to HOST TARGET binding sites such as BINDING SITE I, BINDING SITE II or BINDING SITE III. Table 2 illustrates the complementarity of the nucleotide sequences of PTPRF BINDING SITE1 and PTPRF BINDING SITE2, designated SEQ ID:8724 and SEQ ID:28198 respectively, to the nucleotide sequence of VGAM1105 RNA, herein designated VGAM RNA, also designated SEQ ID:3816.

Another function of VGAM1105 is therefore inhibition of Protein Tyrosine Phosphatase, Receptor Type, F (PTPRF, Accession NM_002840), a gene which negatively regulates the insulin signaling pathway. Accordingly, utilities of VGAM1105 include diagnosis, prevention and treatment of diseases and clinical conditions associated with PTPRF. The function of PTPRF has been established by previous studies. The LAR gene (symbolized PTPRF) encodes a membrane protein that has a cytoplasmic domain with homology to protein-tyrosine phosphatase 1B (OMIM Ref. No. 176885) and an extracellular domain homologous to the neural cellular adhesion molecule NCAM (OMIM Ref. No. 116930). The human LAR molecule closely resembles cell adhesion molecules, which suggests that it may be involved in the regulation of phosphotyrosine levels through cell-cell or cell-matrix interactions. As a first step toward site-directed mutagenesis studies of LAR function, Schaapveld et al. (1995) characterized the mouse Ptprf gene. They found that its cytoplasmic region is encoded by 11 exons that span only 4.5 kb of genomic DNA. Compared to the known exon-intron structures of other mammalian receptor-like protein tyrosine phosphatase genes such as Ptpra (encoding LRP; 176884) and Ptprc (coding for Ly-5; 151460), the portion of the Ptprf gene encoding the cytoplasmic region of murine LAR contained not only smaller, but also fewer introns. O'Grady et al. (1994) demonstrated that the human LAR gene is composed of 33 exons spanning over 85 kb. Exon 2 encodes the signal sequence and the first 4 amino acids in the mature LAR protein. The 3 immunoglobulin-like domains are encoded by exons 3 to 7, and the 8 fibronectin type III (OMIM Ref. No. FN-III) domains by exons 8 to 17. Exons 18 to 22 encode the juxtamembrane and transmembrane domains, and exons 23 to 33 encode the 2 conserved tyrosine phosphatase domains and the entire 3-prime untranslated region. Alternative splicing of LAR mRNA was revealed by RT-PCR analysis.

Full details of the abovementioned studies are described in the following publications, the disclosure of which are hereby incorporated by reference:

Schaapveld, R. Q. J.; van den Maagdenberg, A. M. J. M.; Schepens, J. T. G.; Olde Weghuis, D.; Geurts van Kessel, A.; Wieringa, B.; Hendriks, W. J. A. J.: The mouse gene Ptprf encoding the leukocyte common antigen-related molecule LAR: cloning, characterization, and chromosomal localization. Genomics 27:124-130, 1995; and O'Grady, P.; Krueger, N. X.; Streuli, M.; Saito, H.: Genomic organization of the human LAR protein tyrosine phosphatase gene and alternative splicing in the extracellular fibronectin ty.

Further studies establishing the function and utilities of PTPRF are found in John Hopkins OMIM database record ID 179590, and in sited publications numbered 12382-12390 listed in the bibliography section hereinbelow, which are also hereby incorporated by reference. Serum/glucocorticoid Regulated Kinase (SGK, Accession NM_005627) is another VGAM1105 host target gene. SGK BINDING SITE is HOST TARGET binding site found in the 3' untranslated region of mRNA encoded by SGK, corresponding to a HOST TARGET binding site such as BINDING SITE I, BINDING SITE II or BINDING SITE III. Table 2 illustrates the complementarity of the nucleotide sequences of SGK BINDING SITE, designated SEQ ID:12138, to the nucleotide sequence of VGAM1105 RNA, herein designated VGAM RNA, also designated SEQ ID:3816.

Another function of VGAM1105 is therefore inhibition of Serum/glucocorticoid Regulated Kinase (SGK, Accession NM_005627), a gene which Serine/threonine kinase. Accordingly, utilities of VGAM1105 include diagnosis, prevention and treatment of diseases and clinical conditions associated with SGK. The function of SGK and its association with various diseases and clinical conditions, has been established by previous studies, as described hereinabove with reference to VGAM543. ATPase, Class II, Type 9A (ATP9A, Accession XM_030577) is another VGAM1105 host target gene. ATP9A BINDING SITE is HOST TARGET binding site found in the 3' untranslated region of mRNA encoded by ATP9A, corresponding to a HOST TARGET binding site such as BINDING SITE I, BINDING SITE II or BINDING SITE III. Table 2 illustrates the complementarity of the nucleotide sequences of ATP9A BINDING SITE, designated SEQ ID:31081, to the nucleotide sequence of VGAM1105 RNA, herein designated VGAM RNA, also designated SEQ ID:3816.

Another function of VGAM1105 is therefore inhibition of ATPase, Class II, Type 9A (ATP9A, Accession XM_030577). Accordingly, utilities of VGAM1105 include diagnosis, prevention and treatment of diseases and clinical conditions associated with ATP9A. Chromosome 20 Open Reading Frame 59 (C20orf59, Accession NM_022082) is another VGAM1105 host target gene. C20orf59 BINDING SITE is HOST TARGET binding site found in the 3' untranslated region of mRNA encoded by C20orf59, corresponding to a HOST TARGET binding site such as BINDING SITE I, BINDING SITE II or BINDING SITE III. Table 2 illustrates the complementarity of the nucleotide sequences of C20orf59 BINDING SITE, designated SEQ ID:22623, to the nucleotide sequence of VGAM1105 RNA, herein designated VGAM RNA, also designated SEQ ID:3816.

Another function of VGAM1105 is therefore inhibition of Chromosome 20 Open Reading Frame 59 (C20orf59, Accession NM_022082). Accordingly, utilities of VGAM1105 include diagnosis, prevention and treatment of diseases and clinical conditions associated with C20orf59. FLJ31300 (Accession NM_144639) is another VGAM1105 host target gene. FLJ31300 BINDING SITE is HOST TARGET binding site found in the 3' untranslated region of mRNA encoded by FLJ31300, corresponding to a HOST TARGET binding site such as BINDING SITE I, BINDING SITE II or BINDING SITE III. Table 2 illustrates the complementarity of the nucleotide sequences of FLJ31300 BINDING SITE, designated SEQ ID:29463, to the nucleotide sequence of VGAM1105 RNA, herein designated VGAM RNA, also designated SEQ ID:3816.

Another function of VGAM1105 is therefore inhibition of FLJ31300 (Accession NM_144639). Accordingly, utilities of VGAM1105 include diagnosis, prevention and treatment of diseases and clinical conditions associated with FLJ31300. Golgi Associated, Gamma Adaptin Ear Containing, ARF Binding Protein 2 (GGA2, Accession NM_138640) is another VGAM1105 host target gene. GGA2 BINDING SITE1 and GGA2 BINDING SITE2 are HOST TARGET binding sites found in untranslated regions of mRNA encoded by GGA2, corresponding to HOST TARGET binding sites such as BINDING SITE I, BINDING SITE II or BINDING SITE III. Table 2 illustrates the complementarity of the nucleotide sequences of GGA2 BINDING SITE1 and GGA2 BINDING SITE2, designated SEQ ID:28920 and SEQ ID:17399 respectively, to the nucleotide sequence of VGAM1105 RNA, herein designated VGAM RNA, also designated SEQ ID:3816.

Another function of VGAM1105 is therefore inhibition of Golgi Associated, Gamma Adaptin Ear Containing, ARF Binding Protein 2 (GGA2, Accession NM_138640). Accordingly, utilities of VGAM1105 include diagnosis, prevention and treatment of diseases and clinical conditions associated with GGA2. KIAA1061 (Accession XM_048786) is another VGAM1105 host target gene. KIAA1061 BINDING SITE is HOST TARGET binding site found in the 3' untranslated region of mRNA encoded by KIAA1061, corresponding to a HOST TARGET binding site such as BINDING SITE I, BINDING SITE II or BINDING SITE III. Table 2 illustrates the complementarity of the nucleotide sequences of KIAA1061 BINDING SITE, designated SEQ ID:35266, to the nucleotide sequence of VGAM1105 RNA, herein designated VGAM RNA, also designated SEQ ID:3816.

Another function of VGAM1105 is therefore inhibition of KIAA1061 (Accession XM_048786). Accordingly, utilities of VGAM1105 include diagnosis, prevention and treatment of diseases and clinical conditions associated with KIAA1061. MGC16386 (Accession NM_080668) is another VGAM1105 host target gene. MGC16386 BINDING SITE is HOST TARGET binding site found in the 3' untranslated region of mRNA encoded by MGC16386, corresponding to a HOST TARGET binding site such as BINDING SITE I, BINDING SITE II or BINDING SITE III. Table 2 illustrates the complementarity of the nucleotide sequences of MGC16386 BINDING SITE, designated SEQ ID:27960, to the nucleotide sequence of VGAM1105 RNA, herein designated VGAM RNA, also designated SEQ ID:3816.

Another function of VGAM1105 is therefore inhibition of MGC16386 (Accession NM_080668). Accordingly, utilities of VGAM1105 include diagnosis, prevention and treatment of diseases and clinical conditions associated with MGC16386. MGC2835 (Accession NM_024072) is another VGAM1105 host target gene. MGC2835 BINDING SITE is HOST TARGET binding site found in the 3' untranslated region of mRNA encoded by MGC2835, corresponding to a HOST TARGET binding site such as BINDING SITE I, BINDING SITE II or BINDING SITE III. Table 2 illustrates the complementarity of the nucleotide sequences of MGC2835 BINDING SITE, designated SEQ ID:23501, to the nucleotide sequence of VGAM1105 RNA, herein designated VGAM RNA, also designated SEQ ID:3816.

Another function of VGAM1105 is therefore inhibition of MGC2835 (Accession NM_024072). Accordingly, utilities of VGAM1105 include diagnosis, prevention and treatment of diseases and clinical conditions associated with MGC2835. Paralemmin (PALM, Accession NM_002579) is another VGAM1105 host target gene. PALM BINDING SITE is HOST TARGET binding site found in the 3' untranslated region of mRNA encoded by PALM, corresponding to a HOST TARGET binding site such as BINDING SITE I, BINDING SITE II or BINDING SITE III. Table 2 illustrates the complementarity of the nucleotide sequences of PALM BINDING SITE, designated SEQ ID:8436, to the nucleotide sequence of VGAM1105 RNA, herein designated VGAM RNA, also designated SEQ ID:3816.

Another function of VGAM1105 is therefore inhibition of Paralemmin (PALM, Accession NM_002579). Accordingly, utilities of VGAM1105 include diagnosis, prevention and treatment of diseases and clinical conditions associated with PALM. VMP1 (Accession NM_030938) is another VGAM1105 host target gene. VMP1 BINDING SITE is HOST TARGET binding site found in the 3' untranslated region of mRNA encoded by VMP1, corresponding to a HOST TARGET binding site such as BINDING SITE I, BINDING SITE II or BINDING SITE III. Table 2 illustrates the complementarity of the nucleotide sequences of VMP1 BINDING SITE, designated SEQ ID:25206, to the nucleotide sequence of VGAM1105 RNA, herein designated VGAM RNA, also designated SEQ ID:3816.

Another function of VGAM1105 is therefore inhibition of VMP1 (Accession NM_030938). Accordingly, utilities of VGAM1105 include diagnosis, prevention and treatment of diseases and clinical conditions associated with VMP1. LOC147299 (Accession XM_085763) is another VGAM1105 host target gene. LOC147299 BINDING SITE is HOST TARGET binding site found in the 3' untranslated region of mRNA encoded by LOC147299, corresponding to a HOST TARGET binding site such as BINDING SITE I, BINDING SITE II or BINDING SITE III. Table 2 illustrates the complementarity of the nucleotide sequences of LOC147299 BINDING SITE, designated SEQ ID:38333, to the nucleotide sequence of VGAM1105 RNA, herein designated VGAM RNA, also designated SEQ ID:3816.

Another function of VGAM1105 is therefore inhibition of LOC147299 (Accession XM_085763). Accordingly, utilities of VGAM1105 include diagnosis, prevention and treatment of diseases and clinical conditions associated with LOC147299. LOC147429 (Accession XM_085793) is another VGAM1105 host target gene. LOC147429 BINDING SITE is HOST TARGET binding site found in the 3' untranslated region of mRNA encoded by LOC147429, corresponding to a HOST TARGET binding site such as BINDING SITE I, BINDING SITE II or BINDING SITE III. Table 2 illustrates the complementarity of the nucleotide sequences of LOC147429 BINDING SITE, designated SEQ ID:38339, to the nucleotide sequence of VGAM1105 RNA, herein designated VGAM RNA, also designated SEQ ID:3816.

Another function of VGAM1105 is therefore inhibition of LOC147429 (Accession XM_085793). Accordingly, utilities of VGAM1105 include diagnosis, prevention and treatment of diseases and clinical conditions associated with LOC147429. LOC151512 (Accession XM_098072) is another VGAM1105 host target gene. LOC151512 BINDING SITE is HOST TARGET binding site found in the 5' untranslated region of mRNA encoded by LOC151512, corresponding to a HOST TARGET binding site such as BINDING SITE I, BINDING SITE II or BINDING SITE III. Table 2 illustrates the complementarity of the nucleotide sequences of LOC151512 BINDING SITE, designated SEQ ID:41364, to the nucleotide sequence of VGAM1105 RNA, herein designated VGAM RNA, also designated SEQ ID:3816.

Another function of VGAM1105 is therefore inhibition of LOC151512 (Accession XM_098072). Accordingly, utilities of VGAM1105 include diagnosis, prevention and treatment of diseases and clinical conditions associated with LOC151512. LOC151525 (Accession XM_087231) is another VGAM1105 host target gene. LOC151525 BINDING SITE is HOST TARGET binding site found in the 5' untranslated region of mRNA encoded by LOC151525, corresponding to a HOST TARGET binding site such as BINDING SITE I, BINDING SITE II or BINDING SITE III. Table 2 illustrates the complementarity of the nucleotide sequences of LOC151525 BINDING SITE, designated SEQ ID:39131, to the nucleotide sequence of VGAM1105 RNA, herein designated VGAM RNA, also designated SEQ ID:3816.

Another function of VGAM1105 is therefore inhibition of LOC151525 (Accession XM_087231). Accordingly, utilities of VGAM1105 include diagnosis, prevention and treatment of diseases and clinical conditions associated with LOC151525. LOC158055 (Accession XM_088453) is another VGAM1105 host target gene. LOC158055 BINDING SITE is HOST TARGET binding site found in the 3' untranslated region of mRNA encoded by LOC158055, corresponding to a HOST TARGET binding site such as BINDING SITE I, BINDING SITE II or BINDING SITE III. Table 2 illustrates the complementarity of the nucleotide sequences of LOC158055 BINDING SITE, designated SEQ ID:39703, to the nucleotide sequence of VGAM1105 RNA, herein designated VGAM RNA, also designated SEQ ID:3816.

Another function of VGAM1105 is therefore inhibition of LOC158055 (Accession XM_088453). Accordingly, utilities of VGAM1105 include diagnosis, prevention and treatment of diseases and clinical conditions associated with LOC158055. LOC255104 (Accession XM_170911) is another VGAM1105 host target gene. LOC255104 BINDING SITE is HOST TARGET binding site found in the 3' untranslated region of mRNA encoded by LOC255104, corresponding to a HOST TARGET binding site such as BINDING SITE I, BINDING SITE II or BINDING SITE III. Table 2 illustrates the complementarity of the nucleotide sequences of LOC255104 BINDING SITE, designated SEQ ID:45683, to the nucleotide sequence of VGAM1105 RNA, herein designated VGAM RNA, also designated SEQ ID:3816.

Another function of VGAM1105 is therefore inhibition of LOC255104 (Accession XM_170911). Accordingly, utilities of VGAM1105 include diagnosis, prevention and treatment of diseases and clinical conditions associated with LOC255104. LOC256364 (Accession XM_170672) is another VGAM1105 host target gene. LOC256364 BINDING SITE is HOST TARGET binding site found in the 5' untranslated region of mRNA encoded by LOC256364, corresponding to a HOST TARGET binding site such as BINDING SITE I, BINDING SITE II or BINDING SITE III. Table 2 illustrates the complementarity of the nucleotide sequences of LOC256364 BINDING SITE, designated SEQ ID:45445, to the nucleotide sequence of VGAM1105 RNA, herein designated VGAM RNA, also designated SEQ ID:3816.

Another function of VGAM1105 is therefore inhibition of LOC256364 (Accession XM_170672). Accordingly, utilities of VGAM1105 include diagnosis, prevention and treatment of diseases and clinical conditions associated with LOC256364. LOC51236 (Accession NM_016458) is another VGAM1105 host target gene. LOC51236 BINDING SITE is HOST TARGET binding site found in the 3' untranslated region of mRNA encoded by LOC51236, corresponding to a HOST TARGET binding site such as BINDING SITE I, BINDING SITE II or BINDING SITE III. Table 2 illustrates the complementarity of the nucleotide sequences of LOC51236 BINDING SITE, designated SEQ ID:18573, to the nucleotide sequence of VGAM1105 RNA, herein designated VGAM RNA, also designated SEQ ID:3816.

Another function of VGAM1105 is therefore inhibition of LOC51236 (Accession NM_016458). Accordingly, utilities of VGAM1105 include diagnosis, prevention and treatment of diseases and clinical conditions associated with LOC51236. FIG. 1 further provides a conceptual description of a novel bioinformatically detected viral gene of the present invention, referred to here as Viral Genomic Address Messenger 1106 (VGAM1106) viral gene, which modulates expression of respective host target genes thereof, the function and utility of which host target genes is known in the art.

VGAM1106 is a novel bioinformatically detected regulatory, non protein coding, viral micro RNA (miRNA) gene. The method by which VGAM1106 was detected is described hereinabove with reference to FIGS. 1-8.

VGAM1106 gene, herein designated VGAM GENE, is a viral gene contained in the genome of Human Herpesvirus 2.

VGAM1106 host target gene, herein designated VGAM HOST TARGET GENE, is a human gene contained in the human genome.

VGAM1106 gene encodes a VGAM1106 precursor RNA, herein designated VGAM PRECURSOR RNA. Similar to other miRNA genes, and unlike most ordinary genes, VGAM1106 precursor RNA does not encode a protein. A nucleotide sequence identical or highly similar to the nucleotide sequence of VGAM1106 precursor RNA is designated SEQ ID:1092, and is provided hereinbelow with reference to the sequence listing part. Nucleotide sequence SEQ ID:1092 is located at position 97030 relative to the genome of Human Herpesvirus 2.

VGAM1106 precursor RNA folds onto itself, forming VGAM1106 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1106 folded precursor RNA into VGAM1106 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1106 RNA is designated SEQ ID:3817, and is provided hereinbelow with reference to the sequence listing part.

VGAM1106 host target gene, herein designated VGAM HOST TARGET GENE, encodes a corresponding messenger RNA, VGAM1106 host target RNA, herein designated VGAM HOST TARGET RNA. VGAM1106 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1106 RNA, herein designated VGAM RNA, binds complementarily to one or more host target binding sites located in untranslated regions of VGAM1106 host target RNA, herein designated VGAM HOST TARGET RNA. This complementary binding is due to the fact that the nucleotide sequence of VGAM1106 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1106 RNA, herein designated VGAM RNA, may have a different number of host target binding sites in untranslated regions of a VGAM1106 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1106 RNA, herein designated VGAM RNA, to host target binding sites on VGAM1106 host target RNA, herein designated VGAM HOST TARGET RNA, such as BINDING SITE I, BINDING SITE II and BINDING SITE III, inhibits translation of VGAM1106 host target RNA into VGAM1106 host target protein, herein designated VGAM HOST TARGET PROTEIN. VGAM host target protein is therefore outlined by a broken line.

It is appreciated that VGAM1106 host target gene, herein designated VGAM HOST TARGET GENE, in fact represents a plurality of VGAM1106 host target genes. The mRNA of each one of this plurality of VGAM1106 host target genes comprises one or more host target binding sites, each having a nucleotide sequence which is at least partly complementary to VGAM1106 RNA, herein designated VGAM RNA, and which when bound by VGAM1106 RNA causes inhibition of translation of respective one or more VGAM1106 host target proteins.

It is further appreciated by one skilled in the art that the mode of translational inhibition illustrated by FIG. 1 with specific reference to translational inhibition exerted by VGAM1106 gene, herein designated VGAM GENE, on one or more VGAM1106 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1106 is inhibition of expression of host target genes, as part of a novel viral mechanism of attacking a host. Accordingly, utilities of VGAM1106 include diagnosis, prevention and treatment of viral infection by Human Herpesvirus 2. Specific functions, and accordingly utilities, of VGAM1106 correlate with, and may be deduced from, the identity of the host target genes which VGAM1106 binds and inhibits, and the function of these host target genes, as elaborated hereinbelow.

Nucleotide sequences of the VGAM1106 precursor RNA, herein designated VGAM PRECURSOR RNA, and of the 'diced' VGAM1106 RNA, herein designated VGAM RNA, and a schematic representation of the secondary folding of VGAM1106 folded precursor RNA, herein designated VGAM FOLDED PRECURSOR RNA, of VGAM1106 are further described hereinbelow with reference to Table 1.

Nucleotide sequences of host target binding sites, such as BINDING SITE-I, BINDING SITE-II and BINDING SITE-III of FIG. 1, found on VGAM1106 host target RNA, and schematic representation of the complementarity of each of these host target binding sites to VGAM1106 RNA, herein designated VGAM RNA, are described hereinbelow with reference to Table 2.

As mentioned hereinabove with reference to FIG. 1, a function of VGAM1106 gene, herein designated VGAM is inhibition of expression of VGAM1106 target genes. It is appreciated that specific functions, and accordingly utilities, of VGAM1106 correlate with, and may be deduced from, the identity of the target genes which VGAM1106 binds and inhibits, and the function of these target genes, as elaborated hereinbelow.

Paralemmin (PALM, Accession NM_002579) is a VGAM1106 host target gene. PALM BINDING SITE is HOST TARGET binding site found in the 3' untranslated region of mRNA encoded by PALM, corresponding to a HOST TARGET binding site such as BINDING SITE I, BINDING SITE II or BINDING SITE III. Table 2 illustrates the complementarity of the nucleotide sequences of PALM BINDING SITE, designated SEQ ID:8437, to the nucleotide sequence of VGAM1106 RNA, herein designated VGAM RNA, also designated SEQ ID:3817.

A function of VGAM1106 is therefore inhibition of Paralemmin (PALM, Accession NM_002579). Accordingly, utilities of VGAM1106 include diagnosis, prevention and treatment of diseases and clinical conditions associated with PALM. FIG. 1 further provides a conceptual description of a novel bioinformatically detected viral gene of the present invention, referred to here as Viral Genomic Address Messenger 1107 (VGAM1107) viral gene, which modulates expression of respective host target genes thereof, the function and utility of which host target genes is known in the art.

VGAM1107 is a novel bioinformatically detected regulatory, non protein coding, viral micro RNA (miRNA) gene. The method by which VGAM1107 was detected is described hereinabove with reference to FIGS. 1-8.

VGAM1107 gene, herein designated VGAM GENE, is a viral gene contained in the genome of Porcine Adenovirus C. VGAM1107 host target gene, herein designated VGAM HOST TARGET GENE, is a human gene contained in the human genome.

VGAM1107 gene encodes a VGAM1107 precursor RNA, herein designated VGAM PRECURSOR RNA. Similar to other miRNA genes, and unlike most ordinary genes, VGAM1107 precursor RNA does not encode a protein. A nucleotide sequence identical or highly similar to the nucleotide sequence of VGAM1107 precursor RNA is designated SEQ ID:1093, and is provided hereinbelow with reference to the sequence listing part. Nucleotide sequence SEQ ID:1093 is located at position 3553 relative to the genome of Porcine Adenovirus C.

VGAM1107 precursor RNA folds onto itself, forming VGAM1107 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1107 folded precursor RNA into VGAM1107 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1107 RNA is designated SEQ ID:3818, and is provided hereinbelow with reference to the sequence listing part.

VGAM1107 host target gene, herein designated VGAM HOST TARGET GENE, encodes a corresponding messenger RNA, VGAM1107 host target RNA, herein designated VGAM HOST TARGET RNA. VGAM1107 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1107 RNA, herein designated VGAM RNA, binds complementarily to one or more host target binding sites located in untranslated regions of VGAM1107 host target RNA, herein designated VGAM HOST TARGET RNA. This complementary binding is due to the fact that the nucleotide sequence of VGAM1107 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1107 RNA, herein designated VGAM RNA, may have a different number of host target binding sites in untranslated regions of a VGAM1107 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1107 RNA, herein designated VGAM RNA, to host target binding sites on VGAM1107 host target RNA, herein designated VGAM HOST TARGET RNA, such as BINDING SITE I, BINDING SITE II and BINDING SITE III, inhibits translation of VGAM1107 host target RNA into VGAM1107 host target protein, herein designated VGAM HOST TARGET PROTEIN. VGAM host target protein is therefore outlined by a broken line.

It is appreciated that VGAM1107 host target gene, herein designated VGAM HOST TARGET GENE, in fact represents a plurality of VGAM1107 host target genes. The mRNA of each one of this plurality of VGAM1107 host target genes comprises one or more host target binding sites, each having a nucleotide sequence which is at least partly complementary to VGAM1107 RNA, herein designated VGAM RNA, and which when bound by VGAM1107 RNA causes inhibition of translation of respective one or more VGAM1107 host target proteins.

It is further appreciated by one skilled in the art that the mode of translational inhibition illustrated by FIG. 1 with specific reference to translational inhibition exerted by VGAM1107 gene, herein designated VGAM GENE, on one or more VGAM1107 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1107 is inhibition of expression of host target genes, as part of a novel viral mechanism of attacking a host. Accordingly, utilities of VGAM1107 include diagnosis, prevention and treatment of viral infection by Porcine Adenovirus C. Specific functions, and accordingly utilities, of VGAM1107 correlate with, and may be deduced from, the identity of the host target genes which VGAM1107 binds and inhibits, and the function of these host target genes, as elaborated hereinbelow.

Nucleotide sequences of the VGAM1107 precursor RNA, herein designated VGAM PRECURSOR RNA, and of the 'diced' VGAM1107 RNA, herein designated VGAM RNA, and a schematic representation of the secondary folding of VGAM1107 folded precursor RNA, herein designated VGAM FOLDED PRECURSOR RNA, of VGAM1107 are further described hereinbelow with reference to Table 1.

Nucleotide sequences of host target binding sites, such as BINDING SITE-I, BINDING SITE-II and BINDING SITE-III of FIG. 1, found on VGAM1107 host target RNA, and schematic representation of the complementarity of each of these host target binding sites to VGAM1107 RNA, herein designated VGAM RNA, are described hereinbelow with reference to Table 2.

As mentioned hereinabove with reference to FIG. 1, a function of VGAM1107 gene, herein designated VGAM is inhibition of expression of VGAM1107 target genes. It is appreciated that specific functions, and accordingly utilities, of VGAM1107 correlate with, and may be deduced from, the identity of the target genes which VGAM1107 binds and inhibits, and the function of these target genes, as elaborated hereinbelow.

APM1 (Accession NM_004797) is a VGAM1107 host target gene. APM1 BINDING SITE is HOST TARGET binding site found in the 3' untranslated region of mRNA encoded by APM1, corresponding to a HOST TARGET binding site such as BINDING SITE I, BINDING SITE II or BINDING SITE III. Table 2 illustrates the complementarity of the nucleotide sequences of APM1 BINDING SITE, designated SEQ ID:11207, to the nucleotide sequence of VGAM1107 RNA, herein designated VGAM RNA, also designated SEQ ID:3818.

A function of VGAM1107 is therefore inhibition of APM1 (Accession NM_004797). Accordingly, utilities of VGAM1107 include diagnosis, prevention and treatment of diseases and clinical conditions associated with APM1. BAI1-associated Protein 3 (BAIAP3, Accession NM_003933) is another VGAM1107 host target gene. BAIAP3 BINDING SITE is HOST TARGET binding site found in the 3' untranslated region of mRNA encoded by BAIAP3, corresponding to a HOST TARGET binding site such as BINDING SITE I, BINDING SITE II or BINDING SITE III. Table 2 illustrates the complementarity of the nucleotide sequences of BAIAP3 BINDING SITE, designated SEQ ID:10036, to the nucleotide sequence of VGAM1107 RNA, herein designated VGAM RNA, also designated SEQ ID:3818.

Another function of VGAM1107 is therefore inhibition of BAI1-associated Protein 3 (BAIAP3, Accession NM_003933). Accordingly, utilities of VGAM1107 include diagnosis, prevention and treatment of diseases and clinical conditions associated with BAIAP3. CD1D Antigen, D Polypeptide (CD1D, Accession XM_086610) is another VGAM1107 host target gene. CD1D BINDING SITE is HOST TARGET binding site found in the 3" untranslated region of mRNA encoded by CD1D, corresponding to a HOST TARGET binding site such as BINDING SITE I, BINDING SITE II or BINDING SITE III. Table 2 illustrates the complementarity of the nucleotide sequences of CD1D BINDING SITE, designated SEQ ID:38790, to the nucleotide sequence of VGAM1107 RNA, herein designated VGAM RNA, also designated SEQ ID:3818.

Another function of VGAM1107 is therefore inhibition of CD1D Antigen, D Polypeptide (CD1D, Accession XM_086610), a gene which is a member D of the CD1 family; involved in antigen presentation. Accordingly, utilities of VGAM1107 include diagnosis, prevention and treatment of diseases and clinical conditions associated with CD1D. The function of CD1D has been established by previous studies. Alpha-galactosylceramide (alpha-GalCer), a marine sponge glycosphingolipid (GSL), and some disaccharide GSLs can be presented by CD1D in vitro without antigen-presenting cells (APCs) to NK T cells, which respond by producing interleukin-2 (IL2; 147680). Prigozy et al. (2001), however, found that sugars linked at the 2-prime or 3-prime position of the galactose must be removed by APCs in order to stimulate NK T cells. Immunofluorescence microscopy, supported by functional assays, showed that intact CD1D, but not cytoplasmic tail-deleted mutants lacking the endosomal-targeting motif, localized to lysosomes as well as to the plasma membrane, and could present 2-prime-linked alpha-GalGalCer to NK T cells. Such 2-prime-linked alpha-GalGalCer antigen presentation could be blocked by lysosomotropic inhibitors and specifically by an inhibitor of alpha-galactosidase A (GLA; 301500). Alternatively, alpha-galactosidase A-mediated removal of the terminal galactose permitted the presentation of the 2-prime-linked alpha-GalGalCer to NK T cells in the absence APCs. Prigozy et al. (2001) also found that splenic APCs from alpha-galactosidase A-deficient mice, a model of Fabry disease (OMIM Ref. No. 301500), could present alpha-GalCer or 6-prime-linked alpha-GalGalCer but not 2-prime-linked alpha-GalGalCer to NK T-cell lines. Prigozy et al. (2001) concluded that the demonstration of a carbohydrate antigen-processing pathway could extend the range of antigens that are presented by CD1 molecules. Animal model experiments lend further support to the function of CD1D. Quantitative and qualitative defects in CD1-restricted natural killer T cells are found in autoimmune-prone strains of mice, including the nonobese diabetic (NOD) mouse. These defects appear to be associated with the emergence of spontaneous autoimmunity. Shi et al. (2001) demonstrated that CD1d-null NOD transgenic mice have accelerated onset and increased incidence of diabetes when compared with CD1d +/- and CD1d +/+ littermates. The pancreata of CD1d-null mice harbored significantly higher numbers of activated memory T cells expressing the chemokine receptor CCR4 (OMIM Ref. No. 604836). Notably, the presence of these T cells was associated with immunohistochemical evidence of increased destructive insulitis. Thus, CD1d-restricted T cells are critically important for regulation of the spontaneous disease process in NOD mice.

It is appreciated that the abovementioned animal model for CD1D is acknowledged by those skilled in the art as a scientifically valid animal model, as can be further appreciated from the publications sited hereinbelow.

Full details of the abovementioned studies are described in the following publications, the disclosure of which are hereby incorporated by reference:

Riese, R. J.; Shi, G.-P.; Villadangos, J.; Stetson, D.; Driessen, C.; Lennon-Dumenil, A.-M.; Chu, C.-L.; Naumov, Y.; Behar, S. M.; Ploegh, H.; Locksley, R.; Chapman, H. A.: Regulation of CD1 function and NK1.1+ T cell selection and maturation by cathepsin S. Immunity 15:909-919, 2001; and Prigozy, T. I.; Naidenko, O.; Qasba, P.; Elewaut, D.; Brossay, L.; Khurana, A.; Natori, T.; Koezuka, Y.; Kulkarni, A.; Kronenberg, M.: Glycolipid antigen processing for presentation b.

Further studies establishing the function and utilities of CD1D are found in John Hopkins OMIM database record ID 188410, and in sited publications numbered 9779-9781, 4748, 9782, 9783, 10279-9785, 219 and 9786 listed in the bibliography section hereinbelow, which are also hereby incorporated by reference. CDP-diacylglycerol Synthase (phosphatidate cytidylyltransferase) 2 (CDS2, Accession NM_003818) is another VGAM1107 host target gene. CDS2 BINDING SITE is HOST TARGET binding site found in the 3' untranslated region of mRNA encoded by CDS2, corresponding to a HOST TARGET binding site such as BINDING SITE I, BINDING SITE II or BINDING SITE III. Table 2 illustrates the complementarity of the nucleotide sequences of CDS2 BINDING SITE, designated SEQ ID:9910, to the nucleotide sequence of VGAM1107 RNA, herein designated VGAM RNA, also designated SEQ ID:3818.

Another function of VGAM1107 is therefore inhibition of CDP-diacylglycerol Synthase (phosphatidate cytidylyltransferase) 2 (CDS2, Accession NM_003818), a gene which is a key regulator of the amount of PIP2 available for signaling. Accordingly, utilities of VGAM1107 include diagnosis, prevention and treatment of diseases and clinical conditions associated with CDS2. The function of CDS2 and its association with various diseases and clinical conditions, has been established by previous studies, as described hereinabove with reference to VGAM900. Diacylglycerol Kinase, Iota (DGKI, Accession NM_004717) is another VGAM1107 host target gene. DGKI BINDING SITE is HOST TARGET binding site found in the 3' untranslated region of mRNA encoded by DGKI, corresponding to a HOST TARGET binding site such as BINDING SITE I, BINDING SITE II or BINDING SITE III. Table 2 illustrates the complementarity of the nucleotide sequences of DGKI BINDING SITE, designated SEQ ID:11081, to the nucleotide sequence of VGAM1107 RNA, herein designated VGAM RNA, also designated SEQ ID:3818.

Another function of VGAM1107 is therefore inhibition of Diacylglycerol Kinase, Iota (DGKI, Accession NM_004717), a gene which regulates the intracellular concentration of the second messenger diacylglycerol (DAG). Accordingly, utilities of VGAM1107 include diagnosis, prevention and treatment of diseases and clinical conditions associated with DGKI. The function of DGKI has been established by previous studies. Diacylglycerol kinase (DGK) plays a key role in cellular processes by regulating the intracellular concentration of the second messenger diacylglycerol (DAG). For background information on the DGKs, see 125855. Type IV DGKs, such as DGK-zeta (OMIM Ref. No. 601441), contain 4 C-terminal ankyrin repeats and a MARCKS (OMIM Ref. No. 177061) homology domain. Mutations in the Drosophila rdgA (retinal degeneration A) gene, a type IV DGK also referred to as DGK2, lead to degeneration of photoreceptor cells and blindness (Masai et al., 1993). By searching an EST database for sequences related to DGK-zeta, Ding et al. (1998) identified a cDNA encoding a novel DGK that they designated DGK-iota. The predicted 1,065-amino acid DGK-iota protein is a type IV DGK that shares 63% and 40% amino acid identity with DGK-zeta and rdgA, respectively. When expressed in mammalian cells, the DGK-iota protein had an apparent molecular weight of 130 kD and exhibited DGK activity. DGK-iota was found in both the nucleus and the cytoplasm, but expression of protein kinase C-alpha (OMIM Ref. No. 176960) or -gamma (OMIM Ref. No. 176980) attenuated the nuclear localization. Ding et al. (1998) concluded that the nuclear localization of DGK-iota is regulated by phosphorylation in much the same manner as that of DGK-zeta. Northern blot and RT-PCR analyses revealed that the DGK-iota gene was expressed specifically in brain and retina as a predominant transcript of more than 12 kb, including a very long 3-prime untranslated region. Additional low abundance transcripts of 9.5 and 7.5 kb were also detected. By FISH, Ding et al. (1998) mapped the DGK-iota gene to 7q32.3-q33. They suggested that DGK-iota is a candidate gene for a dominant form of retinitis pigmentosa (RP10; 180105) that maps to a locus in the same region.

Full details of the abovementioned studies are described in the following publications, the disclosure of which are hereby incorporated by reference:

Ding, L.; Traer, E.; McIntyre, T. M.; Zimmerman, G. A.; Prescott, S. M.: The cloning and characterization of a novel human diacylglycerol kinase, DGK-iota. J. Biol. Chem. 273: 32746-32752, 1998; and Masai, I.; Okazaki, A.; Hosoya, T.; Hotta, Y.: Drosophila retinal degeneration A gene encodes an eye-specific diacylglycerol kinase with cysteine-rich zinc-finger motifs and ankyrin re.

Further studies establishing the function and utilities of DGKI are found in John Hopkins OMIM database record ID 604072, and in sited publications numbered 63 and 1267 listed in the bibliography section hereinbelow, which are also hereby incorporated by reference. Fibronectin Leucine Rich Transmembrane Protein 2 (FLRT2, Accession NM_013231) is another VGAM1107 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14878, to the nucleotide sequence of VGAM1107 RNA, herein designated VGAM RNA, also designated SEQ ID:3818.

Another function of VGAM1107 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM1107 include diagnosis, prevention and treatment of diseases and clinical conditions associated with FLRT2. The function of FLRT2 and its association with various diseases and clinical conditions, has been established by previous studies, as described hereinabove with reference to VGAM247. Forkhead Box I1 (FOXI1, Accession NM_012188) is another VGAM1107 host target gene. FOXI1 BINDING SITE is HOST TARGET binding site found in the 3' untranslated region of mRNA encoded by FOXI1, corresponding to a HOST TARGET binding site such as BINDING SITE I, BINDING SITE II or BINDING SITE III. Table 2 illustrates the complementarity of the nucleotide sequences of FOXI1 BINDING SITE, designated SEQ ID:14475, to the nucleotide sequence of VGAM1107 RNA, herein designated VGAM RNA, also designated SEQ ID:3818.

Another function of VGAM1107 is therefore inhibition of Forkhead Box I1 (FOXI1, Accession NM_012188), a gene which plays an important role in the development of the cochlea and vestibulum, as well as embryogenesis. Accordingly, utilities of VGAM1107 include diagnosis, prevention and treatment of diseases and clinical conditions associated with FOXI1. The function of FOXI1 has been established by previous studies. FKH10 is a member of the forkhead family of winged helix transcription regulators. The forkhead family is distinguished by a characteristic 100-amino acid motif that was originally identified in Drosophila (see OMIM Ref. No. 164874). Pierrou et al. (1994) identified 7 human genes containing a forkhead domain and designated them forkhead related activators (FREAC) 1 through 7. Northern blot analysis revealed that the FREAC6, or FKHL10, gene is expressed as a 2.3-kb mRNA only in kidney. Genes encoding forkhead proteins are instrumental during embryogenesis in mammals, in particular during development of the nervous system. Hulander et al. (1998) reported that mice with a targeted disruption of the Fkh10 locus exhibit circling behavior, poor swimming ability, and abnormal reaching response, all common findings in mice with vestibular dysfunction. These animals also failed to elicit a Preyer reflex in response to a suprathreshold auditory stimulation, as seen in mice with profound hearing impairment. Histologic examination of the inner ear revealed a gross structural malformation of the vestibulum as well as of the cochlea. These structures were replaced by a single irregular cavity in which neither proper semicircular ducts nor cochlea could be identified. Hulander et al. (1998) also showed that at 9.5 days postcoitum (DPC), Fkh10 was exclusively expressed in the otic vesicle. Larsson et al. (1995) showed that FKHL10 is expressed in the adult and fetal kidney, whereas 15 other tissues (which did not include any inner ear-derived samples) were negative. Kidney-specific expression had been observed also in the mouse. Although Fkh10 may play a role in the kidney during later stages of development, it may be a minor, or perhaps redundant, role, as no kidney dysfunction was observed in homozygous knockout mice. On the contrary, Fkh10 appears to be unique in the sense that it is an early otic vesicle-specific gene necessary for the development of both cochlea and vestibulum. These findings implicated Fkh10 as an early regulator necessary for development of both cochlea and vestibulum and identified its human homolog FKHL10 as a previously unknown candidate deafness gene at 5q34. The phenotype described by Hulander et al. (1998) resembles a group of human congenital inner ear malformations called 'common cavity.' Hulander et al. (1998) proposed that mutations in FKH10 may cause a 'common cavity' phenotype in human S.

Full details of the abovementioned studies are described in the following publications, the disclosure of which are hereby incorporated by reference:

Hulander, M.; Wurst, W.; Carlsson, P.; Enerback, S.: The winged helix transcription factor Fkh10 is required for normal development of the inner ear. Nature Genet. 20:374-376, 1998; and Larsson, C.; Hellqvist, M.; Pierrou, S.; White, I.; Enerback, S.; Carlsson, P.: Chromosomal localization of six human forkhead genes, freac-1 (FKHL5), -3 (FKHL7), -4 (FKHL8), -5 (FKHL9.

Further studies establishing the function and utilities of FOXI1 are found in John Hopkins OMIM database record ID 601093, and in sited publications numbered 9462-9460 listed in the bibliography section hereinbelow, which are also hereby incorporated by reference. Glycoprotein A Repetitions Predominant (GARP, Accession NM_005512) is another VGAM1107 host target gene. GARP BINDING SITE is HOST TARGET binding site found in the 3' untranslated region of mRNA encoded by GARP, corresponding to a HOST TARGET binding site such as BINDING SITE I, BINDING SITE II or BINDING SITE III. Table 2 illustrates the complementarity of the nucleotide sequences of GARP BINDING SITE, designated SEQ ID:12031, to the nucleotide sequence of VGAM1107 RNA, herein designated VGAM RNA, also designated SEQ ID:3818.

Another function of VGAM1107 is therefore inhibition of Glycoprotein A Repetitions Predominant (GARP, Accession NM_005512). Accordingly, utilities of VGAM1107 include diagnosis, prevention and treatment of diseases and clinical conditions associated with GARP. RNA (guanine-7-) Methyltransferase (RNMT, Accession NM_003799) is another VGAM1107 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9883, to the nucleotide sequence of VGAM1107 RNA, herein designated VGAM RNA, also designated SEQ ID:3818.

Another function of VGAM1107 is therefore inhibition of RNA (guanine-7-) Methyltransferase (RNMT, Accession NM_003799), a gene which catalyzes the methylation of GpppN- at the guanine N7 position. Accordingly, utilities of VGAM1107 include diagnosis, prevention and treatment of diseases and clinical conditions associated with RNMT. The function of RNMT and its association with various diseases and clinical conditions, has been established by previous studies, as described hereinabove with reference to VGAM178. Sphingosine Kinase 2 (SPHK2, Accession NM_020126) is another VGAM1107 host target gene. SPHK2 BINDING SITE is HOST TARGET binding site found in the 3' untranslated region of mRNA encoded by SPHK2, corresponding to a HOST TARGET binding site such as BINDING SITE I, BINDING SITE II or BINDING SITE III. Table 2 illustrates the complementarity of the nucleotide sequences of SPHK2 BINDING SITE, designated SEQ ID:21314, to the nucleotide sequence of VGAM1107 RNA, herein designated VGAM RNA, also designated SEQ ID:3818.

Another function of VGAM1107 is therefore inhibition of Sphingosine Kinase 2 (SPHK2, Accession NM_020126). Accordingly, utilities of VGAM1107 include diagnosis, prevention and treatment of diseases and clinical conditions associated with SPHK2. Chromosome 20 Open Reading Frame 20 (C20orf20, Accession NM_018270) is another VGAM1107 host target gene. C20orf20 BINDING SITE is HOST TARGET binding site found in the 3' untranslated region of mRNA encoded by C20orf20, corresponding to a HOST TARGET binding site such as BINDING SITE I, BINDING SITE II or BINDING SITE III. Table 2 illustrates the complementarity of the nucleotide sequences of C20orf20 BINDING SITE, designated SEQ ID:20247, to the nucleotide sequence of VGAM1107 RNA, herein designated VGAM RNA, also designated SEQ ID:3818.

Another function of VGAM1107 is therefore inhibition of Chromosome 20 Open Reading Frame 20 (C20orf20, Accession NM_018270). Accordingly, utilities of VGAM1107 include diagnosis, prevention and treatment of diseases and clinical conditions associated with C20orf20. Chromosome 5 Open Reading Frame 6 (C5orf6, Accession NM_016605) is another VGAM1107 host target gene. C5orf6 BINDING SITE is HOST TARGET binding site found in the 3' untranslated region of mRNA encoded by C5orf6, corresponding to a HOST TARGET binding site such as BINDING SITE I, BINDING SITE II or BINDING SITE III. Table 2 illustrates the complementarity of the nucleotide sequences of C5orf6 BINDING SITE, designated SEQ ID:18706, to the nucleotide sequence of VGAM1107 RNA, herein designated VGAM RNA, also designated SEQ ID:3818.

Another function of VGAM1107 is therefore inhibition of Chromosome 5 Open Reading Frame 6 (C5orf6, Accession NM_016605). Accordingly, utilities of VGAM1107 include diagnosis, prevention and treatment of diseases and clinical conditions associated with C5orf6. CAP350 (Accession NM_014810) is another VGAM1107 host target gene. CAP350 BINDING SITE is HOST TARGET binding site found in the 3' untranslated region of mRNA encoded by CAP350, corresponding to a HOST TARGET binding site such as BINDING SITE I, BINDING SITE II or BINDING SITE III. Table 2 illustrates the complementarity of the nucleotide sequences of CAP350 BINDING SITE, designated SEQ ID:16772, to the nucleotide sequence of VGAM1107 RNA, herein designated VGAM RNA, also designated SEQ ID:3818.

Another function of VGAM1107 is therefore inhibition of CAP350 (Accession NM_014810). Accordingly, utilities of VGAM1107 include diagnosis, prevention and treatment of diseases and clinical conditions associated with CAP350. Coactosin-like 1 (Dictyostelium) (COTL1, Accession XM_113840) is another VGAM1107 host target gene. COTL1 BINDING SITE is HOST TARGET binding site found in the 3' untranslated region of mRNA encoded by COTL1, corresponding to a HOST TARGET binding site such as BINDING SITE I, BINDING SITE II or BINDING SITE III. Table 2 illustrates the complementarity of the nucleotide sequences of COTL1 BINDING SITE, designated SEQ ID:42468, to the nucleotide sequence of VGAM1107 RNA, herein designated VGAM RNA, also designated SEQ ID:3818.

Another function of VGAM1107 is therefore inhibition of Coactosin-like 1 (Dictyostelium) (COTL1, Accession XM_113840). Accordingly, utilities of VGAM1107 include diagnosis, prevention and treatment of diseases and clinical conditions associated with COTL1. FEM-2 (Accession NM_014634) is another VGAM1107 host target gene. FEM-2 BINDING SITE is HOST TARGET binding site found in the 3' untranslated region of mRNA encoded by FEM-2, corresponding to a HOST TARGET binding site such as BINDING SITE I, BINDING SITE II or BINDING SITE III. Table 2 illustrates the complementarity of the nucleotide sequences of FEM-2 BINDING SITE, designated SEQ ID:16007, to the nucleotide sequence of VGAM1107 RNA, herein designated VGAM RNA, also designated SEQ ID:3818.

Another function of VGAM1107 is therefore inhibition of FEM-2 (Accession NM_014634). Accordingly, utilities of VGAM1107 include diagnosis, prevention and treatment of diseases and clinical conditions associated with FEM-2. FLJ10815 (Accession NM_018231) is another VGAM1107 host target gene. FLJ10815 BINDING SITE is HOST TARGET binding site found in the 3' untranslated region of mRNA encoded by FLJ10815, corresponding to a HOST TARGET binding site such as BINDING SITE I, BINDING SITE II or BINDING SITE III. Table 2 illustrates the complementarity of the nucleotide sequences of FLJ10815 BINDING SITE, designated SEQ ID:20169, to the nucleotide sequence of VGAM1107 RNA, herein designated VGAM RNA, also designated SEQ ID:3818.

Another function of VGAM1107 is therefore inhibition of FLJ10815 (Accession NM_018231). Accordingly, utilities of VGAM1107 include diagnosis, prevention and treatment of diseases and clinical conditions associated with FLJ10815. FLJ11783 (Accession NM_024891) is another VGAM1107 host target gene. FLJ11783 BINDING SITE is HOST TARGET binding site found in the 3' untranslated region of mRNA encoded by FLJ11783, corresponding to a HOST TARGET binding site such as BINDING SITE I, BINDING SITE II or BINDING SITE III. Table 2 illustrates the complementarity of the nucleotide sequences of FLJ11783 BINDING SITE, designated SEQ ID:24366, to the nucleotide sequence of VGAM1107 RNA, herein designated VGAM RNA, also designated SEQ ID:3818.

Another function of VGAM1107 is therefore inhibition of FLJ11783 (Accession NM_024891). Accordingly, utilities of VGAM1107 include diagnosis, prevention and treatment of diseases and clinical conditions associated with FLJ11783. FLJ20105 (Accession NM_017669) is another VGAM1107 host target gene. FLJ20105 BINDING SITE is HOST TARGET binding site found in the 5' untranslated region of mRNA encoded by FLJ20105, corresponding to a HOST TARGET binding site such as BINDING SITE I, BINDING SITE II or BINDING SITE III. Table 2 illustrates the complementarity of the nucleotide sequences of FLJ20105 BINDING SITE, designated SEQ ID:19210, to the nucleotide sequence of VGAM1107 RNA, herein designated VGAM RNA, also designated SEQ ID:3818.

Another function of VGAM1107 is therefore inhibition of FLJ20105 (Accession NM_017669). Accordingly, utilities of VGAM1107 include diagnosis, prevention and treatment of diseases and clinical conditions associated with FLJ20105. FLJ20477 (Accession NM_017837) is another VGAM1107 host target gene. FLJ20477 BINDING SITE is HOST TARGET binding site found in the 5' untranslated region of mRNA encoded by FLJ20477, corresponding to a HOST TARGET binding site such as BINDING SITE I, BINDING SITE II or BINDING SITE III. Table 2 illustrates the complementarity of the nucleotide sequences of FLJ20477 BINDING SITE, designated SEQ ID:19504, to the nucleotide sequence of VGAM1107 RNA, herein designated VGAM RNA, also designated SEQ ID:3818.

Another function of VGAM1107 is therefore inhibition of FLJ20477 (Accession NM_017837). Accordingly, utilities of VGAM1107 include diagnosis, prevention and treatment of diseases and clinical conditions associated with FLJ20477. FLJ21736 (Accession NM_024922) is another VGAM1107 host target gene. FLJ21736 BINDING SITE is HOST TARGET binding site found in the 3' untranslated region of mRNA encoded by FLJ21736, corresponding to a HOST TARGET binding site such as BINDING SITE I, BINDING SITE II or BINDING SITE III. Table 2 illustrates the complementarity of the nucleotide sequences of FLJ21736 BINDING SITE, designated SEQ ID:24458, to the nucleotide sequence of VGAM1107 RNA, herein designated VGAM RNA, also designated SEQ ID:3818.

Another function of VGAM1107 is therefore inhibition of FLJ21736 (Accession NM_024922). Accordingly, utilities of VGAM1107 include diagnosis, prevention and treatment of diseases and clinical conditions associated with FLJ21736. FLJ22009 (Accession XM_015700) is another VGAM1107 host target gene. FLJ22009 BINDING SITE is HOST TARGET binding site found in the 3' untranslated region of mRNA encoded by FLJ22009, corresponding to a HOST TARGET binding site such as BINDING SITE I, BINDING SITE II or BINDING SITE III. Table 2 illustrates the complementarity of the nucleotide sequences of FLJ22009 BINDING SITE, designated SEQ ID:30245, to the nucleotide sequence of VGAM1107 RNA, herein designated VGAM RNA, also designated SEQ ID:3818.

Another function of VGAM1107 is therefore inhibition of FLJ22009 (Accession XM_015700). Accordingly, utilities of VGAM1107 include diagnosis, prevention and treatment of diseases and clinical conditions associated with FLJ22009. FLJ22419 (Accession NM_024697) is another VGAM1107 host target gene. FLJ22419 BINDING SITE is HOST TARGET binding site found in the 5' untranslated region of mRNA encoded by FLJ22419, corresponding to a HOST TARGET binding site such as BINDING SITE I, BINDING SITE II or BINDING SITE III. Table 2 illustrates the complementarity of the nucleotide sequences of FLJ22419 BINDING SITE, designated SEQ ID:24007, to the nucleotide sequence of VGAM1107 RNA, herein designated VGAM RNA, also designated SEQ ID:3818.

Another function of VGAM1107 is therefore inhibition of FLJ22419 (Accession NM_024697). Accordingly, utilities of VGAM1107 include diagnosis, prevention and treatment of diseases and clinical conditions associated with FLJ22419. H11 (Accession NM_014365) is another VGAM1107 host target gene. H11 BINDING SITE is HOST TARGET binding site found in the 3' untranslated region of mRNA encoded by H11, corresponding to a HOST TARGET binding site such as BINDING SITE I, BINDING SITE II or BINDING SITE III. Table 2 illustrates the complementarity of the nucleotide sequences of H11 BINDING SITE, designated SEQ ID:15693, to the nucleotide sequence of VGAM1107 RNA, herein designated VGAM RNA, also designated SEQ ID:3818.

Another function of VGAM1107 is therefore inhibition of H11 (Accession NM_014365). Accordingly, utilities of VGAM1107 include diagnosis, prevention and treatment of diseases and clinical conditions associated with H11. Hairy/enhancer-of-split Related with YRPW Motif-like (HEYL, Accession NM_014571) is another VGAM1107 host target gene. HEYL BINDING SITE is HOST TARGET binding site found in the 3' untranslated region of mRNA encoded by HEYL, corresponding to a HOST TARGET binding site such as BINDING SITE I, BINDING SITE II or BINDING SITE III. Table 2 illustrates the complementarity of the nucleotide sequences of HEYL BINDING SITE, designated SEQ ID:15928, to the nucleotide sequence of VGAM1107 RNA, herein designated VGAM RNA, also designated SEQ ID:3818.

Another function of VGAM1107 is therefore inhibition of Hairy/enhancer-of-split Related with YRPW Motif-like (HEYL, Accession NM_014571). Accordingly, utilities of VGAM1107 include diagnosis, prevention and treatment of diseases and clinical conditions associated with HEYL. KIAA0016 (Accession NM_014765) is another VGAM1107 host target gene. KIAA0016 BINDING SITE is HOST TARGET binding site found in the 3' untranslated region of mRNA encoded by KIAA0016, corresponding to a HOST TARGET binding site such as BINDING SITE I, BINDING SITE II or BINDING SITE III. Table 2 illustrates the complementarity of the nucleotide sequences of KIAA0016 BINDING SITE, designated SEQ ID:16530, to the nucleotide sequence of VGAM1107 RNA, herein designated VGAM RNA, also designated SEQ ID:3818.

Another function of VGAM1107 is therefore inhibition of KIAA0016 (Accession NM_014765). Accordingly, utilities of VGAM1107 include diagnosis, prevention and treatment of diseases and clinical conditions associated with KIAA0016. PRO1048 (Accession NM_018497) is another VGAM1107 host target gene. PRO1048 BINDING SITE is HOST TARGET binding site found in the 3' untranslated region of mRNA encoded by PRO1048, corresponding to a HOST TARGET binding site such as BINDING SITE I, BINDING SITE II or BINDING SITE III. Table 2 illustrates the complementarity of the nucleotide sequences of PRO1048 BINDING SITE, designated SEQ ID:20561, to the nucleotide sequence of VGAM1107 RNA, herein designated VGAM RNA, also designated SEQ ID:3818.

Another function of VGAM1107 is therefore inhibition of PRO1048 (Accession NM_018497). Accordingly, utilities of VGAM1107 include diagnosis, prevention and treatment of diseases and clinical conditions associated with PRO1048. Three Prime Repair Exonuclease 1 (TREX1, Accession NM_033627) is another VGAM1107 host target gene. TREX1 BINDING SITE1 and TREX1 BINDING SITE2 are HOST TARGET binding sites found in untranslated regions of mRNA encoded by TREX1, corresponding to HOST TARGET binding sites such as BINDING SITE I, BINDING SITE II or BINDING SITE III. Table 2 illustrates the complementarity of the nucleotide sequences of TREX1 BINDING SITE1 and TREX1 BINDING SITE2, designated SEQ ID:27340 and SEQ ID:27347 respectively, to the nucleotide sequence of VGAM1107 RNA, herein designated VGAM RNA, also designated SEQ ID:3818.

Another function of VGAM1107 is therefore inhibition of Three Prime Repair Exonuclease 1 (TREX1, Accession NM_033627). Accordingly, utilities of VGAM1107 include diagnosis, prevention and treatment of diseases and clinical conditions associated with TREX1. LOC143785 (Accession XM_084635) is another VGAM1107 host target gene. LOC143785 BINDING SITE is HOST TARGET binding site found in the 3' untranslated region of mRNA encoded by LOC143785, corresponding to a HOST TARGET binding site such as BINDING SITE I, BINDING SITE II or BINDING SITE III. Table 2 illustrates the complementarity of the nucleotide sequences of LOC143785 BINDING SITE, designated SEQ ID:37632, to the nucleotide sequence of VGAM1107 RNA, herein designated VGAM RNA, also designated SEQ ID:3818.

Another function of VGAM1107 is therefore inhibition of LOC143785 (Accession XM_084635). Accordingly, utilities of VGAM1107 include diagnosis, prevention and treatment of diseases and clinical conditions associated with LOC143785. LOC146714 (Accession XM_097072) is another VGAM1107 host target gene. LOC146714 BINDING SITE is HOST TARGET binding site found in the 5' untranslated region of mRNA encoded by LOC146714, corresponding to a HOST TARGET binding site such as BINDING SITE I, BINDING SITE II or BINDING SITE III. Table 2 illustrates the complementarity of the nucleotide sequences of LOC146714 BINDING SITE, designated SEQ ID:40719, to the nucleotide sequence of VGAM1107 RNA, herein designated VGAM RNA, also designated SEQ ID:3818.

Another function of VGAM1107 is therefore inhibition of LOC146714 (Accession XM_097072). Accordingly, utilities of VGAM1107 include diagnosis, prevention and treatment of diseases and clinical conditions associated with LOC146714. LOC149301 (Accession XM_086480) is another VGAM1107 host target gene. LOC149301 BINDING SITE is HOST TARGET binding site found in the 3' untranslated region of mRNA encoded by LOC149301, corresponding to a HOST TARGET binding site such as BINDING SITE I, BINDING SITE II or BINDING SITE III. Table 2 illustrates the complementarity of the nucleotide sequences of LOC149301 BINDING SITE, designated SEQ ID:38692, to the nucleotide sequence of VGAM1107 RNA, herein designated VGAM RNA, also designated SEQ ID:3818.

Another function of VGAM1107 is therefore inhibition of LOC149301 (Accession XM_086480). Accordingly, utilities of VGAM1107 include diagnosis, prevention and treatment of diseases and clinical conditions associated with LOC149301. LOC151277 (Accession XM_087155) is another VGAM1107 host target gene. LOC151277 BINDING SITE is HOST TARGET binding site found in the 5' untranslated region of mRNA encoded by LOC151277, corresponding to a HOST TARGET binding site such as BINDING SITE I, BINDING SITE II or BINDING SITE III. Table 2 illustrates the complementarity of the nucleotide sequences of LOC151277 BINDING SITE, designated SEQ ID:39094, to the nucleotide sequence of VGAM1107 RNA, herein designated VGAM RNA, also designated SEQ ID:3818.

Another function of VGAM1107 is therefore inhibition of LOC151277 (Accession XM_087155). Accordingly, utilities of VGAM1107 include diagnosis, prevention and treatment of diseases and clinical conditions associated with LOC151277. LOC221486 (Accession XM_165760) is another VGAM1107 host target gene. LOC221486 BINDING SITE is HOST TARGET binding site found in the 5' untranslated region of mRNA encoded by LOC221486, corresponding to a HOST TARGET binding site such as BINDING SITE I, BINDING SITE II or BINDING SITE III. Table 2 illustrates the complementarity of the nucleotide sequences of LOC221486 BINDING SITE, designated SEQ ID:43742, to the nucleotide sequence of VGAM1107 RNA, herein designated VGAM RNA, also designated SEQ ID:3818.

Another function of VGAM1107 is therefore inhibition of LOC221486 (Accession XM_165760). Accordingly, utilities of VGAM1107 include diagnosis, prevention and treatment of diseases and clinical conditions associated with LOC221486. LOC254205 (Accession XM_172962) is another VGAM1107 host target gene. LOC254205 BINDING SITE is HOST TARGET binding site found in the 5' untranslated region of mRNA encoded by LOC254205, corresponding to a HOST TARGET binding site such as BINDING SITE I, BINDING SITE II or BINDING SITE III. Table 2 illustrates the complementarity of the nucleotide sequences of LOC254205 BINDING SITE, designated SEQ ID:46219, to the nucleotide sequence of VGAM1107 RNA, herein designated VGAM RNA, also designated SEQ ID:3818.

Another function of VGAM1107 is therefore inhibition of LOC254205 (Accession XM_172962). Accordingly, utilities of VGAM1107 include diagnosis, prevention and treatment of diseases and clinical conditions associated with LOC254205. FIG. 1 further provides a conceptual description of a novel bioinformatically detected viral gene of the present invention, referred to here as Viral Genomic Address Messenger 1108 (VGAM1108) viral gene, which modulates expression of respective host target genes thereof, the function and utility of which host target genes is known in the art.

VGAM1108 is a novel bioinformatically detected regulatory, non protein coding, viral micro RNA (miRNA) gene. The method by which VGAM1108 was detected is described hereinabove with reference to FIGS. 1-8.

VGAM1108 gene, herein designated VGAM GENE, is a viral gene contained in the genome of Chimpanzee Cytomegalovirus. VGAM1108 host target gene, herein designated VGAM HOST TARGET GENE, is a human gene contained in the human genome.

VGAM1108 gene encodes a VGAM1108 precursor RNA, herein designated VGAM PRECURSOR RNA. Similar to other miRNA genes, and unlike most ordinary genes, VGAM1108 precursor RNA does not encode a protein. A nucleotide sequence identical or highly similar to the nucleotide sequence of VGAM1108 precursor RNA is designated SEQ ID:1094, and is provided hereinbelow with reference to the sequence listing part. Nucleotide sequence SEQ ID:1094 is located at position 30191 relative to the genome of Chimpanzee Cytomegalovirus.

VGAM1108 precursor RNA folds onto itself, forming VGAM1108 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1108 folded precursor RNA into VGAM1108 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM1108 RNA is designated SEQ ID:3819, and is provided hereinbelow with reference to the sequence listing part.

VGAM1108 host target gene, herein designated VGAM HOST TARGET GENE, encodes a corresponding messenger RNA, VGAM1108 host target RNA, herein designated VGAM HOST TARGET RNA. VGAM1108 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1108 RNA, herein designated VGAM RNA, binds complementarily to one or more host target binding sites located in untranslated regions of VGAM1108 host target RNA, herein designated VGAM HOST TARGET RNA. This complementary binding is due to the fact that the nucleotide sequence of VGAM1108 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1108 RNA, herein designated VGAM RNA, may have a different number of host target binding sites in untranslated regions of a VGAM1108 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1108 RNA, herein designated VGAM RNA, to host target binding sites on VGAM1108 host target RNA, herein designated VGAM HOST TARGET RNA, such as BINDING SITE I, BINDING SITE II and BINDING SITE III, inhibits translation of VGAM1108 host target RNA into VGAM1108 host target protein, herein designated VGAM HOST TARGET PROTEIN. VGAM host target protein is therefore outlined by a broken line.

It is appreciated that VGAM1108 host target gene, herein designated VGAM HOST TARGET GENE, in fact represents a plurality of VGAM1108 host target genes. The mRNA of each one of this plurality of VGAM1108 host target genes comprises one or more host target binding sites, each having a nucleotide sequence which is at least partly complementary to VGAM1108 RNA, herein designated VGAM RNA, and which when bound by VGAM1108 RNA causes inhibition of translation of respective one or more VGAM1108 host target proteins.

It is further appreciated by one skilled in the art that the mode of translational inhibition illustrated by FIG. 1 with specific reference to translational inhibition exerted by VGAM1108 gene, herein designated VGAM GENE, on one or more VGAM1108 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1108 is inhibition of expression of host target genes, as part of a novel viral mechanism of attacking a host. Accordingly, utilities of VGAM1108 include diagnosis, prevention and treatment of viral infection by Chimpanzee Cytomegalovirus. Specific functions, and accordingly utilities, of VGAM1108 correlate with, and may be deduced from, the identity of the host target genes which VGAM1108 binds and inhibits, and the function of these host target genes, as elaborated hereinbelow.

Nucleotide sequences of the VGAM1108 precursor RNA, herein designated VGAM PRECURSOR RNA, and of the 'diced' VGAM1108 RNA, herein designated VGAM RNA, and a schematic representation of the secondary folding of VGAM1108 folded precursor RNA, herein designated VGAM FOLDED PRECURSOR RNA, of VGAM1108 are further described hereinbelow with reference to Table 1.

Nucleotide sequences of host target binding sites, such as BINDING SITE-I, BINDING SITE-II and BINDING SITE-III of FIG. 1, found on VGAM1108 host target RNA, and schematic representation of the complementarity of each of these host target binding sites to VGAM1108 RNA, herein designated VGAM RNA, are described hereinbelow with reference to Table 2.

As mentioned hereinabove with reference to FIG. 1, a function of VGAM1108 gene, herein designated VGAM is inhibition of expression of VGAM1108 target genes. It is appreciated that specific functions, and accordingly utilities, of VGAM1108 correlate with, and may be deduced from, the identity of the target genes which VGAM1108 binds and inhibits, and the function of these target genes, as elaborated hereinbelow.

Potassium Inwardly-rectifying Channel, Subfamily J, Member 5 (KCNJ5, Accession NM_000890) is a VGAM1108 host target gene. KCNJ5 BINDING SITE is HOST TARGET binding site found in the 3' untranslated region of mRNA encoded by KCNJ5, corresponding to a HOST TARGET binding site such as BINDING SITE I, BINDING SITE II or BINDING SITE III. Table 2 illustrates the complementarity of the nucleotide sequences of KCNJ5 BINDING SITE, designated SEQ ID:6587, to the nucleotide sequence of VGAM1108 RNA, herein designated VGAM RNA, also designated SEQ ID:3819.

A function of VGAM1108 is therefore inhibition of Potassium Inwardly-rectifying Channel, Subfamily J, Member 5 (KCNJ5, Accession NM_000890), a gene which is a potassium inwardly-rectifying channel. Accordingly, utilities of VGAM1108 include diagnosis, prevention and treatment of diseases and clinical conditions associated with KCNJ5. The function of KCNJ5 and its association with various diseases and clinical conditions, has been established by previous studies, as described hereinabove with reference to VGAM766. FLJ10352 (Accession NM_032142) is another VGAM1108 host target gene. FLJ10352 BINDING SITE is HOST TARGET binding site found in the 3' untranslated region of mRNA encoded by FLJ10352, corresponding to a HOST TARGET binding site such as BINDING SITE I, BINDING SITE II or BINDING SITE III. Table 2 illustrates the complementarity of the nucleotide sequences of FLJ10352 BINDING SITE, designated SEQ ID:25826, to the nucleotide sequence of VGAM1108 RNA, herein designated VGAM RNA, also designated SEQ ID:3819.

Another function of VGAM1108 is therefore inhibition of FLJ10352 (Accession NM_032142). Accordingly, utilities of VGAM1108 include diagnosis, prevention and treatment of diseases and clinical conditions associated with FLJ10352. KIAA0254 (Accession NM_014758) is another VGAM1108 host target gene. KIAA0254 BINDING SITE is HOST TARGET binding site found in the 3' untranslated region of mRNA encoded by KIAA0254, corresponding to a HOST TARGET binding site such as BINDING SITE I, BINDING SITE II or BINDING SITE III. Table 2 illustrates the complementarity of the nucleotide sequences of KIAA0254 BINDING SITE, designated SEQ ID:16506, to the nucleotide sequence of VGAM1108 RNA, herein designated VGAM RNA, also designated SEQ ID:3819.

Another function of VGAM1108 is therefore inhibition of KIAA0254 (Accession NM_014758). Accordingly, utilities of VGAM1108 include diagnosis, prevention and treatment of diseases and clinical conditions associated with KIAA0254. N4BP3 (Accession XM_038920) is another VGAM1108 host target gene. N4BP3 BINDING SITE is HOST TARGET binding site found in the 3' untranslated region of mRNA encoded by N4BP3, corresponding to a HOST TARGET binding site such as BINDING SITE I, BINDING SITE II or BINDING SITE III. Table 2 illustrates the complementarity of the nucleotide sequences of N4BP3 BINDING SITE, designated SEQ ID:32938, to the nucleotide sequence of VGAM1108 RNA, herein designated VGAM RNA, also designated SEQ ID:3819.

Another function of VGAM1108 is therefore inhibition of N4BP3 (Accession XM_038920). Accordingly, utilities of VGAM1108 include diagnosis, prevention and treatment of diseases and clinical conditions associated with N4BP3. FIG. 1 further provides a conceptual description of a novel bioinformatically detected viral gene of the present invention, referred to here as Viral Genomic Address Messenger 1109 (VGAM1109) viral gene, which modulates expression of respective host target genes thereof, the function and utility of which host target genes is known in the art.

VGAM1109 is a novel bioinformatically detected regulatory, non protein coding, viral micro RNA (miRNA) gene. The method by which VGAM1109 was detected is described hereinabove with reference to FIGS. 1-8.

VGAM1109 gene, herein designated VGAM GENE, is a viral gene contained in the genome of Chimpanzee Cytomegalovirus. VGAM1109 host target gene, herein designated VGAM HOST TARGET GENE, is a human gene contained in the human genome.

VGAM1109 gene encodes a VGAM1109 precursor RNA, herein designated VGAM PRECURSOR RNA. Similar to other miRNA genes, and unlike most ordinary genes, VGAM1109 precursor RNA does not encode a protein. A nucleotide sequence identical or highly similar to the nucleotide sequence of VGAM1109 precursor RNA is designated SEQ ID:1095, and is provided hereinbelow with reference to the sequence listing part. Nucleotide sequence SEQ ID:1095 is located at position 33182 relative to the genome of Chimpanzee Cytomegalovirus.

VGAM1109 precursor RNA folds onto itself, forming VGAM1109 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1109 folded precursor RNA into VGAM1109 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1109 RNA is designated SEQ ID:3820, and is provided hereinbelow with reference to the sequence listing part.

VGAM1109 host target gene, herein designated VGAM HOST TARGET GENE, encodes a corresponding messenger RNA, VGAM1109 host target RNA, herein designated VGAM HOST TARGET RNA. VGAM1109 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1109 RNA, herein designated VGAM RNA, binds complementarily to one or more host target binding sites located in untranslated regions of VGAM1109 host target RNA, herein designated VGAM HOST TARGET RNA. This complementary binding is due to the fact that the nucleotide sequence of VGAM1109 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1109 RNA, herein designated VGAM RNA, may have a different number of host target binding sites in untranslated regions of a VGAM1109 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1109 RNA, herein designated VGAM RNA, to host target binding sites on VGAM1109 host target RNA, herein designated VGAM HOST TARGET RNA, such as BINDING SITE I, BINDING SITE II and BINDING SITE III, inhibits translation of VGAM1109 host target RNA into VGAM1109 host target protein, herein designated VGAM HOST TARGET PROTEIN. VGAM host target protein is therefore outlined by a broken line.

It is appreciated that VGAM1109 host target gene, herein designated VGAM HOST TARGET GENE, in fact represents a plurality of VGAM1109 host target genes. The mRNA of each one of this plurality of VGAM1109 host target genes comprises one or more host target binding sites, each having a nucleotide sequence which is at least partly complementary to VGAM1109 RNA, herein designated VGAM RNA, and which when bound by VGAM1109 RNA causes inhibition of translation of respective one or more VGAM1109 host target proteins.

It is further appreciated by one skilled in the art that the mode of translational inhibition illustrated by FIG. 1 with specific reference to translational inhibition exerted by VGAM1109 gene, herein designated VGAM GENE, on one or more VGAM1109 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1109 is inhibition of expression of host target genes, as part of a novel viral mechanism of attacking a host. Accordingly, utilities of VGAM1109 include diagnosis, prevention and treatment of viral infection by Chimpanzee Cytomegalovirus. Specific functions, and accordingly utilities, of VGAM1109 correlate with, and may be deduced from, the identity of the host target genes which VGAM1109 binds and inhibits, and the function of these host target genes, as elaborated hereinbelow.

Nucleotide sequences of the VGAM1109 precursor RNA, herein designated VGAM PRECURSOR RNA, and of the 'diced' VGAM1109 RNA, herein designated VGAM RNA, and a schematic representation of the secondary folding of VGAM1109 folded precursor RNA, herein designated VGAM FOLDED PRECURSOR RNA, of VGAM1109 are further described hereinbelow with reference to Table 1.

Nucleotide sequences of host target binding sites, such as BINDING SITE-I, BINDING SITE-II and BINDING SITE-III of FIG. 1, found on VGAM1109 host target RNA, and schematic representation of the complementarity of each of these host target binding sites to VGAM1109 RNA, herein designated VGAM RNA, are described hereinbelow with reference to Table 2.

As mentioned hereinabove with reference to FIG. 1, a function of VGAM1109 gene, herein designated VGAM is inhibition of expression of VGAM1109 target genes. It is appreciated that specific functions, and accordingly utilities, of VGAM1109 correlate with, and may be deduced from, the identity of the target genes which VGAM1109 binds and inhibits, and the function of these target genes, as elaborated hereinbelow.

Laminin, Beta 1 (LAMB1, Accession NM_002291) is a VGAM1109 host target gene. LAMB1 BINDING SITE is HOST TARGET binding site found in the 5' untranslated region of mRNA encoded by LAMB1, corresponding to a HOST TARGET binding site such as BINDING SITE I, BINDING SITE II or BINDING SITE III. Table 2 illustrates the complementarity of the nucleotide sequences of LAMB1 BINDING SITE, designated SEQ ID:8072, to the nucleotide sequence of VGAM1109 RNA, herein designated VGAM RNA, also designated SEQ ID:3820.

A function of VGAM1109 is therefore inhibition of Laminin, Beta 1 (LAMB1, Accession NM_002291), a gene which mediates the attachment, migration, and organization of cells into tissues. Accordingly, utilities of VGAM1109 include diagnosis, prevention and treatment of diseases and clinical conditions associated with LAMB1. The function of LAMB1 has been established by previous studies. The major components of basal laminae are the glycoproteins laminin and collagen IV, both of which are heterotrimers. Laminin is a cruciform protein trimer of chains that when originally isolated from the extracellular matrix of tumor cells, were named A, B1, and B2, but were renamed alpha-1, beta-1, and gamma-1, respectively (Burgeson et al., 1994). The laminin and collagen IV isoforms vary from one basal lamina to another and are members of multigene families. These gene families (like others, such as the globins and myosins) may provide a means of generating functional diversity within a common structural framework. Modi et al. (1987) mapped the LAMB1 locus to 7q31.1-q31.3 by Southern blot analysis of somatic cell hybrids and by in situ hybridization. On the other hand, by the same methods, Pikkarainen et al. (1987) placed LAMB1 in the 7q22 band. Jaye et al. (1987) regionalized LAMB1 to band 7q31 by somatic cell hybridization and in situ hybridization. Bonneau et al. (1991) described an infant with cutis laxa, emphysema, striking cardiac abnormalities and a diaphragmatic hernia leading to death at the age of 22 weeks. The infant had mild contractures at the elbows, hips, and knees, with bilateral hip dislocation. Arachnodactyly was striking. Chromosome studies showed a chromatid break at the junction of 7q31.3 and 7q32. Among 17 previously reported cases with the same syndrome, 1 was found to have a translocation involving 7q31 (Huret et al., 1991). Bonneau et al. (1991) called the condition neonatal cutis laxa with marfanoid phenotype. The clinical features and the location of the chromosomal change prompted Bonneau et al. (1991) to study laminin, which, by use of anti-human laminin antiserum, was found to be absent from the basement membranes of capillaries and the dermal-epidermal junction. Fibronectin was also not detected in the skin sample. Laminin B1 (OMIM Ref. No. 150240) maps to the same region of 7q. Bonneau et al. (1991) pointed to reports of some 12 cases of neonatal 'Marfan syndrome' which might represent this same syndrome. These included the cases of Neimann et al. (1968), Hohn and Webb (1971), Lababidi and Monzon (1981), Buchanan and Wyatt (1985), Day and Burke (1986), and Gross et al. (1989). In a note added in proof, Bonneau et al. (1991) stated that studies of the case published by Neimann et al. (1968) showed deficiency of laminin in the basement membranes. Burgeson et al. (1994), a group of 14 leading researchers in the field of connective tissue proteins, adopted a new nomenclature for the laminins. They were numbered with arabic numerals in the order discovered. The previous A, B1, and B2 chains, and their isoforms, are alpha, beta, and gamma, respectively, followed by an arabic numeral to identify the isoform. For example, the first laminin identified from the Engelbreth-Holm-Swarm tumor (EHS) was designated laminin-1 with the chain composition alpha-1/beta-1/gamma-1. The genes for these 3 chains are LAMA1 (OMIM Ref. No. 150320), LAMB1, and LAMC1 (OMIM Ref. No. 150290).

Full details of the abovementioned studies are described in the following publications, the disclosure of which are hereby incorporated by reference:

Burgeson, R. E.; Chiquet, M.; Deutzmann, R.; Ekblom, P.; Engel, J.; Kleinman, H.; Martin, G. R.; Meneguzzi, G.; Paulsson, M.; Sanes, J.; Timpl, R.; Tryggvason, K.; Yamada, Y.; Yurchenco, P. D.: A new nomenclature for the laminins. Matrix Biol. 14: 209-211, 1994; and Bonneau, D.; Huret, J. L.; Godeau, G.; Couet, D.; Putterman, M.; Tanzer, J.; Babin, P.; Larregue, M.: Recurrent ctb (7)(q31.3) and possible laminin involvement in a neonatal cutis laxa w.

Further studies establishing the function and utilities of LAMB1 are found in John Hopkins OMIM database record ID 150240, and in sited publications numbered 11980-11998 listed in the bibliography section hereinbelow, which are also hereby incorporated by reference. LOC90719 (Accession XM_033704) is another VGAM1109 host target gene. LOC90719 BINDING SITE is HOST TARGET binding site found in the 5' untranslated region of mRNA encoded by LOC90719, corresponding to a HOST TARGET binding site such as BINDING SITE I, BINDING SITE II or BINDING SITE III. Table 2 illustrates the complementarity of the nucleotide sequences of LOC90719 BINDING SITE, designated SEQ ID:31947, to the nucleotide sequence of VGAM1109 RNA, herein designated VGAM RNA, also designated SEQ ID:3820.

Another function of VGAM1109 is therefore inhibition of LOC90719 (Accession XM_033704). Accordingly, utilities of VGAM1109 include diagnosis, prevention and treatment of diseases and clinical conditions associated with LOC90719. FIG. 1 further provides a conceptual description of a novel bioinformatically detected viral gene of the present invention, referred to here as Viral Genomic Address Messenger 1110 (VGAM1110) viral gene, which modulates expression of respective host target genes thereof, the function and utility of which host target genes is known in the art.

VGAM1110 is a novel bioinformatically detected regulatory, non protein coding, viral micro RNA (miRNA) gene. The method by which VGAM1110 was detected is described hereinabove with reference to FIGS. 1-8.

VGAM1110 gene, herein designated VGAM GENE, is a viral gene contained in the genome of Duck Adenovirus 1. VGAM1110 host target gene, herein designated VGAM HOST TARGET GENE, is a human gene contained in the human genome.

VGAM1110 gene encodes a VGAM1110 precursor RNA, herein designated VGAM PRECURSOR RNA. Similar to other miRNA genes, and unlike most ordinary genes, VGAM1110 precursor RNA does not encode a protein. A nucleotide sequence identical or highly similar to the nucleotide sequence of VGAM1110 precursor RNA is designated SEQ ID:1096, and is provided hereinbelow with reference to the sequence listing part. Nucleotide sequence SEQ ID:1096 is located at position 8004 relative to the genome of Duck Adenovirus 1.

VGAM1110 precursor RNA folds onto itself, forming VGAM1110 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1110 folded precursor RNA into VGAM1110 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1110 RNA is designated SEQ ID:3821, and is provided hereinbelow with reference to the sequence listing part.

VGAM1110 host target gene, herein designated VGAM HOST TARGET GENE, encodes a corresponding messenger RNA, VGAM1110 host target RNA, herein designated VGAM HOST TARGET RNA. VGAM1110 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1110 RNA, herein designated VGAM RNA, binds complementarily to one or more host target binding sites located in untranslated regions of VGAM1110 host target RNA, herein designated VGAM HOST TARGET RNA. This complementary binding is due to the fact that the nucleotide sequence of VGAM1110 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1110 RNA, herein designated VGAM RNA, may have a different number of host target binding sites in untranslated regions of a VGAM1110 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1110 RNA, herein designated VGAM RNA, to host target binding sites on VGAM1110 host target RNA, herein designated VGAM HOST TARGET RNA, such as BINDING SITE I, BINDING SITE II and BINDING SITE III, inhibits translation of VGAM1110 host target RNA into VGAM1110 host target protein, herein designated VGAM HOST TARGET PROTEIN. VGAM host target protein is therefore outlined by a broken line.

It is appreciated that VGAM1110 host target gene, herein designated VGAM HOST TARGET GENE, in fact represents a plurality of VGAM1110 host target genes. The mRNA of each one of this plurality of VGAM1110 host target genes comprises one or more host target binding sites, each having a nucleotide sequence which is at least partly complementary to VGAM1110 RNA, herein designated VGAM RNA, and which when bound by VGAM1110 RNA causes inhibition of translation of respective one or more VGAM1110 host target proteins.

It is further appreciated by one skilled in the art that the mode of translational inhibition illustrated by FIG. 1 with specific reference to translational inhibition exerted by VGAM1110 gene, herein designated VGAM GENE, on one or more VGAM1110 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1110 is inhibition of expression of host target genes, as part of a novel viral mechanism of attacking a host. Accordingly, utilities of VGAM1110 include diagnosis, prevention and treatment of viral infection by Duck Adenovirus 1. Specific functions, and accordingly utilities, of VGAM1110 correlate with, and may be deduced from, the identity of the host target genes which VGAM1110 binds and inhibits, and the function of these host target genes, as elaborated hereinbelow.

Nucleotide sequences of the VGAM1110 precursor RNA, herein designated VGAM PRECURSOR RNA, and of the 'diced' VGAM1110 RNA, herein designated VGAM RNA, and a schematic representation of the secondary folding of VGAM1110 folded precursor RNA, herein designated VGAM FOLDED PRECURSOR RNA, of VGAM1110 are further described hereinbelow with reference to Table 1.

Nucleotide sequences of host target binding sites, such as BINDING SITE-I, BINDING SITE-II and BINDING SITE-III of FIG. 1, found on VGAM1110 host target RNA, and schematic representation of the complementarity of each of these host target binding sites to VGAM1110 RNA, herein designated VGAM RNA, are described hereinbelow with reference to Table 2.

As mentioned hereinabove with reference to FIG. 1, a function of VGAM1110 gene, herein designated VGAM is inhibition of expression of VGAM1110 target genes. It is appreciated that specific functions, and accordingly utilities, of VGAM1110 correlate with, and may be deduced from, the identity of the target genes which VGAM1110 binds and inhibits, and the function of these target genes, as elaborated hereinbelow.

Cytoplasmic FMR1 Interacting Protein 2 (CYFIP2, Accession XM_056963) is a VGAM1110 host target gene. CYFIP2 BINDING SITE is HOST TARGET binding site found in the 5' untranslated region of mRNA encoded by CYFIP2, corresponding to a HOST TARGET binding site such as BINDING SITE I, BINDING SITE II or BINDING SITE III. Table 2 illustrates the complementarity of the nucleotide sequences of CYFIP2 BINDING SITE, designated SEQ ID:36439, to the nucleotide sequence of VGAM1110 RNA, herein designated VGAM RNA, also designated SEQ ID:3821.

A function of VGAM1110 is therefore inhibition of Cytoplasmic FMR1 Interacting Protein 2 (CYFIP2, Accession XM_056963). Accordingly, utilities of VGAM1110 include diagnosis, prevention and treatment of diseases and clinical conditions associated with CYFIP2. Retinoic Acid Induced 14 (RAI14, Accession NM_015577) is another VGAM1110 host target gene. RAI14 BINDING SITE is HOST TARGET binding site found in the 3' untranslated region of mRNA encoded by RAI14, corresponding to a HOST TARGET binding site such as BINDING SITE I, BINDING SITE II or BINDING SITE III. Table 2 illustrates the complementarity of the nucleotide sequences of RAI14 BINDING SITE, designated SEQ ID:17846, to the nucleotide sequence of VGAM1110 RNA, herein designated VGAM RNA, also designated SEQ ID:3821.

Another function of VGAM1110 is therefore inhibition of Retinoic Acid Induced 14 (RAI14, Accession NM_015577), a gene which is required for protein transport from the er to the golgi complex. Accordingly, utilities of VGAM1110 include diagnosis, prevention and treatment of diseases and clinical conditions associated with RAI14. The function of RAI14 and its association with various diseases and clinical conditions, has been established by previous studies, as described hereinabove with reference to VGAM1036. Tumor Protein P63 (TP63, Accession NM_003722) is another VGAM1110 host target gene. TP63 BINDING SITE is HOST TARGET binding site found in the 3' untranslated region of mRNA encoded by TP63, corresponding to a HOST TARGET binding site such as BINDING SITE I, BINDING SITE II or BINDING SITE III. Table 2 illustrates the complementarity of the nucleotide sequences of TP63 BINDING SITE, designated SEQ ID:9816, to the nucleotide sequence of VGAM1110 RNA, herein designated VGAM RNA, also designated SEQ ID:3821.

Another function of VGAM1110 is therefore inhibition of Tumor Protein P63 (TP63, Accession NM_003722). Accordingly, utilities of VGAM1110 include diagnosis, prevention and treatment of diseases and clinical conditions associated with TP63. WW Domain Containing Oxidoreductase (WWOX, Accession NM_016373) is another VGAM1110 host target gene. WWOX BINDING SITE is HOST TARGET binding site found in the 3' untranslated region of mRNA encoded by WWOX, corresponding to a HOST TARGET binding site such as BINDING SITE I, BINDING SITE II or BINDING SITE III. Table 2 illustrates the complementarity of the nucleotide sequences of WWOX BINDING SITE, designated SEQ ID:18504, to the nucleotide sequence of VGAM1110 RNA, herein designated VGAM RNA, also designated SEQ ID:3821.

Another function of VGAM1110 is therefore inhibition of WW Domain Containing Oxidoreductase (WWOX, Accession NM_016373), a gene which involves in in protein-protein interactions and may contribute to the biologic consequences of DNA instability. Accordingly, utilities of VGAM1110 include diagnosis, prevention and treatment of diseases and clinical conditions associated with WWOX. The function of WWOX and its association with various diseases and clinical conditions, has been established by previous studies, as described hereinabove with reference to VGAM644. DKFZP434N1511 (Accession XM_166138) is another VGAM1110 host target gene. DKFZP434N1511 BINDING SITE is HOST TARGET binding site found in the 5' untranslated region of mRNA encoded by DKFZP434N1511, corresponding to a HOST TARGET binding site such as BINDING SITE I, BINDING SITE II or BINDING SITE III. Table 2 illustrates the complementarity of the nucleotide sequences of DKFZP434N1511 BINDING SITE, designated SEQ ID:43938, to the nucleotide sequence of VGAM1110 RNA, herein designated VGAM RNA, also designated SEQ ID:3821.

Another function of VGAM1110 is therefore inhibition of DKFZP434N1511 (Accession XM_166138). Accordingly, utilities of VGAM1110 include diagnosis, prevention and treatment of diseases and clinical conditions associated with DKFZP434N1511. FIG. 1 further provides a conceptual description of a novel bioinformatically detected viral gene of the present invention, referred to here as Viral Genomic Address Messenger 1111 (VGAM1111) viral gene, which modulates expression of respective host target genes thereof, the function and utility of which host target genes is known in the art.

VGAM1111 is a novel bioinformatically detected regulatory, non protein coding, viral micro RNA (miRNA) gene. The method by which VGAM1111 was detected is described hereinabove with reference to FIGS. 1-8.

VGAM1111 gene, herein designated VGAM GENE, is a viral gene contained in the genome of Camelpox Virus. VGAM1111 host target gene, herein designated VGAM HOST TARGET GENE, is a human gene contained in the human genome.

VGAM1111 gene encodes a VGAM1111 precursor RNA, herein designated VGAM PRECURSOR RNA. Similar to other miRNA genes, and unlike most ordinary genes, VGAM1111 precursor RNA does not encode a protein. A nucleotide sequence identical or highly similar to the nucleotide sequence of VGAM1111 precursor RNA is designated SEQ ID:1097, and is provided hereinbelow with reference to the sequence listing part. Nucleotide sequence SEQ ID:1097 is located at position 103122 relative to the genome of Camelpox Virus.

VGAM1111 precursor RNA folds onto itself, forming VGAM1111 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1111 folded precursor RNA into VGAM1111 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM1111 RNA is designated SEQ ID:3822, and is provided hereinbelow with reference to the sequence listing part.

VGAM1111 host target gene, herein designated VGAM HOST TARGET GENE, encodes a corresponding messenger RNA, VGAM1111 host target RNA, herein designated VGAM HOST TARGET RNA. VGAM1111 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1111 RNA, herein designated VGAM RNA, binds complementarily to one or more host target binding sites located in untranslated regions of VGAM1111 host target RNA, herein designated VGAM HOST TARGET RNA. This complementary binding is due to the fact that the nucleotide sequence of VGAM1111 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1111 RNA, herein designated VGAM RNA, may have a different number of host target binding sites in untranslated regions of a VGAM1111 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1111 RNA, herein designated VGAM RNA, to host target binding sites on VGAM1111 host target RNA, herein designated VGAM HOST TARGET RNA, such as BINDING SITE I, BINDING SITE II and BINDING SITE III, inhibits translation of VGAM1111 host target RNA into VGAM1111 host target protein, herein designated VGAM HOST TARGET PROTEIN. VGAM host target protein is therefore outlined by a broken line.

It is appreciated that VGAM1111 host target gene, herein designated VGAM HOST TARGET GENE, in fact represents a plurality of VGAM1111 host target genes. The mRNA of each one of this plurality of VGAM1111 host target genes comprises one or more host target binding sites, each having a nucleotide sequence which is at least partly complementary to VGAM1111 RNA, herein designated VGAM RNA, and which when bound by VGAM1111 RNA causes inhibition of translation of respective one or more VGAM1111 host target proteins.

It is further appreciated by one skilled in the art that the mode of translational inhibition illustrated by FIG. 1 with specific reference to translational inhibition exerted by VGAM1111 gene, herein designated VGAM GENE, on one or more VGAM1111 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1111 is inhibition of expression of host target genes, as part of a novel viral mechanism of attacking a host. Accordingly, utilities of VGAM1111 include diagnosis, prevention and treatment of viral infection by Camelpox Virus. Specific functions, and accordingly utilities, of VGAM1111 correlate with, and may be deduced from, the identity of the host target genes which VGAM1111 binds and inhibits, and the function of these host target genes, as elaborated hereinbelow.

Nucleotide sequences of the VGAM1111 precursor RNA, herein designated VGAM PRECURSOR RNA, and of the 'diced' VGAM1111 RNA, herein designated VGAM RNA, and a schematic representation of the secondary folding of VGAM1111 folded precursor RNA, herein designated VGAM FOLDED PRECURSOR RNA, of VGAM1111 are further described hereinbelow with reference to Table 1.

Nucleotide sequences of host target binding sites, such as BINDING SITE-I, BINDING SITE-II and BINDING SITE-III of FIG. 1, found on VGAM1111 host target RNA, and schematic representation of the complementarity of each of these host target binding sites to VGAM1111 RNA, herein designated VGAM RNA, are described hereinbelow with reference to Table 2.

As mentioned hereinabove with reference to FIG. 1, a function of VGAM1111 gene, herein designated VGAM is inhibition of expression of VGAM1111 target genes. It is appreciated that specific functions, and accordingly utilities, of VGAM1111 correlate with, and may be deduced from, the identity of the target genes which VGAM1111 binds and inhibits, and the function of these target genes, as elaborated hereinbelow.

ATPase, Ca++ Transporting, Type 2C, Member 1 (ATP2C1, Accession NM_014382) is a VGAM1111 host target gene. ATP2C1 BINDING SITE is HOST TARGET binding site found in the 3' untranslated region of mRNA encoded by ATP2C1, corresponding to a HOST TARGET binding site such as BINDING SITE I, BINDING SITE II or BINDING SITE III. Table 2 illustrates the complementarity of the nucleotide sequences of ATP2C1 BINDING SITE, designated SEQ ID:15717, to the nucleotide sequence of VGAM1111 RNA, herein designated VGAM RNA, also designated SEQ ID:3822.

A function of VGAM1111 is therefore inhibition of ATPase, Ca++ Transporting, Type 2C, Member 1 (ATP2C1, Accession NM_014382). Accordingly, utilities of VGAM1111 include diagnosis, prevention and treatment of diseases and clinical conditions associated with ATP2C1. Gonadotropin-releasing Hormone Receptor (GNRHR, Accession NM_000406) is another VGAM1111 host target gene. GNRHR BINDING SITE is HOST TARGET binding site found in the 5' untranslated region of mRNA encoded by GNRHR, corresponding to a HOST TARGET binding site such as BINDING SITE I, BINDING SITE II or BINDING SITE III. Table 2 illustrates the complementarity of the nucleotide sequences of GNRHR BINDING SITE, designated SEQ ID:5982, to the nucleotide sequence of VGAM1111 RNA, herein designated VGAM RNA, also designated SEQ ID:3822.

Another function of VGAM1111 is therefore inhibition of Gonadotropin-releasing Hormone Receptor (GNRHR, Accession NM_000406), a gene which stimulates the secretionstimulates phosphoinositide turnover and membrane depolarization. Accordingly, utilities of VGAM1111 include diagnosis, prevention and treatment of diseases and clinical conditions associated with GNRHR. The function of GNRHR and its association with various diseases and clinical conditions, has been established by previous studies, as described hereinabove with reference to VGAM638. Mucin 3B (MUC3B, Accession XM_168578) is another VGAM1111 host target gene. MUC3B BINDING SITE is HOST TARGET binding site found in the 5' untranslated region of mRNA encoded by MUC3B, corresponding to a HOST TARGET binding site such as BINDING SITE I, BINDING SITE II or BINDING SITE III. Table 2 illustrates the complementarity of the nucleotide sequences of MUC3B BINDING SITE, designated SEQ ID:45256, to the nucleotide sequence of VGAM1111 RNA, herein designated VGAM RNA, also designated SEQ ID:3822.

Another function of VGAM1111 is therefore inhibition of Mucin 3B (MUC3B, Accession XM_168578), a gene which provides a protective, lubricating barrier against particles and infectious agents at mucosal surfaces. Accordingly, utilities of VGAM1111 include diagnosis, prevention and treatment of diseases and clinical conditions associated with MUC3B. The function of MUC3B and its association with various diseases and clinical conditions, has been established by previous studies, as described hereinabove with reference to VGAM55. Polymerase (DNA directed) Sigma (POLS, Accession NM_006999) is another VGAM1111 host target gene. POLS BINDING SITE is HOST TARGET binding site found in the 3' untranslated region of mRNA encoded by POLS, corresponding to a HOST TARGET binding site such as BINDING SITE I, BINDING SITE II or BINDING SITE III. Table 2 illustrates the complementarity of the nucleotide sequences of POLS BINDING SITE, designated SEQ ID:13863, to the nucleotide sequence of VGAM1111 RNA, herein designated VGAM RNA, also designated SEQ ID:3822.

Another function of VGAM1111 is therefore inhibition of Polymerase (DNA directed) Sigma (POLS, Accession NM_006999), a gene which is necessary for chromosome segregation. Accordingly, utilities of VGAM1111 include diagnosis, prevention and treatment of diseases and clinical conditions associated with POLS. The function of POLS and its association with various diseases and clinical conditions, has been established by previous studies, as described hereinabove with reference to VGAM106. KIAA1161 (Accession XM_088501) is another VGAM1111 host target gene. KIAA1161 BINDING SITE is HOST TARGET binding site found in the 5' untranslated region of mRNA encoded by KIAA1161, corresponding to a HOST TARGET binding site such as BINDING SITE I, BINDING SITE II or BINDING SITE III. Table 2 illustrates the complementarity of the nucleotide sequences of KIAA1161 BINDING SITE, designated SEQ ID:39745, to the nucleotide sequence of VGAM1111 RNA, herein designated VGAM RNA, also designated SEQ ID:3822.

Another function of VGAM1111 is therefore inhibition of KIAA1161 (Accession XM_088501). Accordingly, utilities of VGAM1111 include diagnosis, prevention and treatment of diseases and clinical conditions associated with KIAA1161. Kelch-like 6 (Drosophila) (KLHL6, Accession NM_130446) is another VGAM1111 host target gene. KLHL6 BINDING SITE is HOST TARGET binding site found in the 3' untranslated region of mRNA encoded by KLHL6, corresponding to a HOST TARGET binding site such as BINDING SITE I, BINDING SITE II or BINDING SITE III. Table 2 illustrates the complementarity of the nucleotide sequences of KLHL6 BINDING SITE, designated SEQ ID:28213, to the nucleotide sequence of VGAM1111 RNA, herein designated VGAM RNA, also designated SEQ ID:3822.

Another function of VGAM1111 is therefore inhibition of Kelch-like 6 (Drosophila) (KLHL6, Accession NM_130446). Accordingly, utilities of VGAM1111 include diagnosis, prevention and treatment of diseases and clinical conditions associated with KLHL6. RAS Protein Activator Like 2 (RASAL2, Accession NM_004841) is another VGAM1111 host target gene. RASAL2 BINDING SITE is HOST TARGET binding site found in the 3' untranslated region of mRNA encoded by RASAL2, corresponding to a HOST TARGET binding site such as BINDING SITE I, BINDING SITE II or BINDING SITE III. Table 2 illustrates the complementarity of the nucleotide sequences of RASAL2 BINDING SITE, designated SEQ ID:11251, to the nucleotide sequence of VGAM1111 RNA, herein designated VGAM RNA, also designated SEQ ID:3822.

Another function of VGAM1111 is therefore inhibition of RAS Protein Activator Like 2 (RASAL2, Accession NM_004841). Accordingly, utilities of VGAM1111 include diagnosis, prevention and treatment of diseases and clinical conditions associated with RASAL2. Small Nuclear RNA Activating Complex, Polypeptide 1, 43 kDa (SNAPC1, Accession NM_003082) is another VGAM1111 host target gene. SNAPC1 BINDING SITE is HOST TARGET binding site found in the 3' untranslated region of mRNA encoded by SNAPC1, corresponding to a HOST TARGET binding site such as BINDING SITE I, BINDING SITE II or BINDING SITE III. Table 2 illustrates the complementarity of the nucleotide sequences of SNAPC1 BINDING SITE, designated SEQ ID:9056, to the nucleotide sequence of VGAM1111 RNA, herein designated VGAM RNA, also designated SEQ ID:3822.

Another function of VGAM1111 is therefore inhibition of Small Nuclear RNA Activating Complex, Polypeptide 1, 43 kDa (SNAPC1, Accession NM_003082). Accordingly, utilities of VGAM1111 include diagnosis, prevention and treatment of diseases and clinical conditions associated with SNAPC1. LOC149483 (Accession XM_086537) is another VGAM1111 host target gene. LOC149483 BINDING SITE is HOST TARGET binding site found in the 3' untranslated region of mRNA encoded by LOC149483, corresponding to a HOST TARGET binding site such as BINDING SITE I, BINDING SITE II or BINDING SITE III. Table 2 illustrates the complementarity of the nucleotide sequences of LOC149483 BINDING SITE, designated SEQ ID:38757, to the nucleotide sequence of VGAM1111 RNA, herein designated VGAM RNA, also designated SEQ ID:3822.

Another function of VGAM1111 is therefore inhibition of LOC149483 (Accession XM_086537). Accordingly, utilities of VGAM1111 include diagnosis, prevention and treatment of diseases and clinical conditions associated with LOC149483. LOC150397 (Accession XM_086907) is another VGAM1111 host target gene. LOC150397 BINDING SITE is HOST TARGET binding site found in the 3' untranslated region of mRNA encoded by LOC150397, corresponding to a HOST TARGET binding site such as BINDING SITE I, BINDING SITE II or BINDING SITE III. Table 2 illustrates the complementarity of the nucleotide sequences of LOC150397 BINDING SITE, designated SEQ ID:38957, to the nucleotide sequence of VGAM1111 RNA, herein designated VGAM RNA, also designated SEQ ID:3822.

Another function of VGAM1111 is therefore inhibition of LOC150397 (Accession XM_086907). Accordingly, utilities of VGAM1111 include diagnosis, prevention and treatment of diseases and clinical conditions associated with LOC150397. LOC152627 (Accession XM_087495) is another VGAM1111 host target gene. LOC152627 BINDING SITE is HOST TARGET binding site found in the 5' untranslated region of mRNA encoded by LOC152627, corresponding to a HOST TARGET binding site such as BINDING SITE I, BINDING SITE II or BINDING SITE III. Table 2 illustrates the complementarity of the nucleotide sequences of LOC152627 BINDING SITE, designated SEQ ID:39291, to the nucleotide sequence of VGAM1111 RNA, herein designated VGAM RNA, also designated SEQ ID:3822.

Another function of VGAM1111 is therefore inhibition of LOC152627 (Accession XM_087495). Accordingly, utilities of VGAM1111 include diagnosis, prevention and treatment of diseases and clinical conditions associated with LOC152627. LOC219529 (Accession XM_167563) is another VGAM1111 host target gene. LOC219529 BINDING SITE is HOST TARGET binding site found in the 3' untranslated region of mRNA encoded by LOC219529, corresponding to a HOST TARGET binding site such as BINDING SITE I, BINDING SITE II or BINDING SITE III. Table 2 illustrates the complementarity of the nucleotide sequences of LOC219529 BINDING SITE, designated SEQ ID:44672, to the nucleotide sequence of VGAM1111 RNA, herein designated VGAM RNA, also designated SEQ ID:3822.

Another function of VGAM1111 is therefore inhibition of LOC219529 (Accession XM_167563). Accordingly, utilities of VGAM1111 include diagnosis, prevention and treatment of diseases and clinical conditions associated with LOC219529. FIG. 1 further provides a conceptual description of a novel bioinformatically detected viral gene of the present invention, referred to here as Viral Genomic Address Messenger 1112 (VGAM1112) viral gene, which modulates expression of respective host target genes thereof, the function and utility of which host target genes is known in the art.

VGAM1112 is a novel bioinformatically detected regulatory, non protein coding, viral micro RNA (miRNA) gene. The method by which VGAM1112 was detected is described hereinabove with reference to FIGS. 1-8.

VGAM1112 gene, herein designated VGAM GENE, is a viral gene contained in the genome of Camelpox Virus. VGAM1112 host target gene, herein designated VGAM HOST TARGET GENE, is a human gene contained in the human genome.

VGAM1112 gene encodes a VGAM1112 precursor RNA, herein designated VGAM PRECURSOR RNA. Similar to other miRNA genes, and unlike most ordinary genes, VGAM1112 precursor RNA does not encode a protein. A nucleotide sequence identical or highly similar to the nucleotide sequence of VGAM1112 precursor RNA is designated SEQ ID:1098, and is provided hereinbelow with reference to the sequence listing part. Nucleotide sequence SEQ ID:1098 is located at position 103458 relative to the genome of Camelpox Virus.

VGAM1112 precursor RNA folds onto itself, forming VGAM1112 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1112 folded precursor RNA into VGAM1112 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 46%) nucleotide sequence of VGAM1112 RNA is designated SEQ ID:3823, and is provided hereinbelow with reference to the sequence listing part.

VGAM1112 host target gene, herein designated VGAM HOST TARGET GENE, encodes a corresponding messenger RNA, VGAM1112 host target RNA, herein designated VGAM HOST TARGET RNA. VGAM1112 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1112 RNA, herein designated VGAM RNA, binds complementarily to one or more host target binding sites located in untranslated regions of VGAM1112 host target RNA, herein designated VGAM HOST TARGET RNA. This complementary binding is due to the fact that the nucleotide sequence of VGAM1112 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1112 RNA, herein designated VGAM RNA, may have a different number of host target binding sites in untranslated regions of a VGAM1112 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1112 RNA, herein designated VGAM RNA, to host target binding sites on VGAM1112 host target RNA, herein designated VGAM HOST TARGET RNA, such as BINDING SITE I, BINDING SITE II and BINDING SITE III, inhibits translation of VGAM1112 host target RNA into VGAM1112 host target protein, herein designated VGAM HOST TARGET PROTEIN. VGAM host target protein is therefore outlined by a broken line.

It is appreciated that VGAM1112 host target gene, herein designated VGAM HOST TARGET GENE, in fact represents a plurality of VGAM1112 host target genes. The mRNA of each one of this plurality of VGAM1112 host target genes comprises one or more host target binding sites, each having a nucleotide sequence which is at least partly complementary to VGAM1112 RNA, herein designated VGAM RNA, and which when bound by VGAM1112 RNA causes inhibition of translation of respective one or more VGAM1112 host target proteins.

It is further appreciated by one skilled in the art that the mode of translational inhibition illustrated by FIG. 1 with specific reference to translational inhibition exerted by VGAM1112 gene, herein designated VGAM GENE, on one or more VGAM1112 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1112 is inhibition of expression of host target genes, as part of a novel viral mechanism of attacking a host. Accordingly, utilities of VGAM1112 include diagnosis, prevention and treatment of viral infection by Camelpox Virus. Specific functions, and accordingly utilities, of VGAM1112 correlate with, and may be deduced from, the identity of the host target genes which VGAM1112 binds and inhibits, and the function of these host target genes, as elaborated hereinbelow.

Nucleotide sequences of the VGAM1112 precursor RNA, herein designated VGAM PRECURSOR RNA, and of the 'diced' VGAM1112 RNA, herein designated VGAM RNA, and a schematic representation of the secondary folding of VGAM1112 folded precursor RNA, herein designated VGAM FOLDED PRECURSOR RNA, of VGAM1112 are further described hereinbelow with reference to Table 1.

Nucleotide sequences of host target binding sites, such as BINDING SITE-I, BINDING SITE-II and BINDING SITE-III of FIG. 1, found on VGAM1112 host target RNA, and schematic representation of the complementarity of each of these host target binding sites to VGAM1112 RNA, herein designated VGAM RNA, are described hereinbelow with reference to Table 2.

As mentioned hereinabove with reference to FIG. 1, a function of VGAM1112 gene, herein designated VGAM is inhibition of expression of VGAM1112 target genes. It is appreciated that specific functions, and accordingly utilities, of VGAM1112 correlate with, and may be deduced from, the identity of the target genes which VGAM1112 binds and inhibits, and the function of these target genes, as elaborated hereinbelow.

DKFZP434J193 (Accession XM_048452) is a VGAM1112 host target gene. DKFZP434J193 BINDING SITE is HOST TARGET binding site found in the 3' untranslated region of mRNA encoded by DKFZP434J193, corresponding to a HOST TARGET binding site such as BINDING SITE I, BINDING SITE II or BINDING SITE III. Table 2 illustrates the complementarity of the nucleotide sequences of DKFZP434J193 BINDING SITE, designated SEQ ID:35161, to the nucleotide sequence of VGAM1112 RNA, herein designated VGAM RNA, also designated SEQ ID:3823.

A function of VGAM1112 is therefore inhibition of DKFZP434J193 (Accession XM_048452). Accordingly, utilities of VGAM1112 include diagnosis, prevention and treatment of diseases and clinical conditions associated with DKFZP434J193. KIAA1548 (Accession NM_020909) is another VGAM1112 host target gene. KIAA1548 BINDING SITE is HOST TARGET binding site found in the 3' untranslated region of mRNA encoded by KIAA1548, corresponding to a HOST TARGET binding site such as BINDING SITE I, BINDING SITE II or BINDING SITE III. Table 2 illustrates the complementarity of the nucleotide sequences of KIAA1548 BINDING SITE, designated SEQ ID:21927, to the nucleotide sequence of VGAM1112 RNA, herein designated VGAM RNA, also designated SEQ ID:3823.

Another function of VGAM1112 is therefore inhibition of KIAA1548 (Accession NM_020909). Accordingly, utilities of VGAM1112 include diagnosis, prevention and treatment of diseases and clinical conditions associated with KIAA1548. LOC150998 (Accession XM_097990) is another VGAM1112 host target gene. LOC150998 BINDING SITE is HOST TARGET binding site found in the 3' untranslated region of mRNA encoded by LOC150998, corresponding to a HOST TARGET binding site such as BINDING SITE I, BINDING SITE II or BINDING SITE III. Table 2 illustrates the complementarity of the nucleotide sequences of LOC150998 BINDING SITE, designated SEQ ID:41287, to the nucleotide sequence of VGAM1112 RNA, herein designated VGAM RNA, also designated SEQ ID:3823.

Another function of VGAM1112 is therefore inhibition of LOC150998 (Accession XM_097990). Accordingly, utilities of VGAM1112 include diagnosis, prevention and treatment of diseases and clinical conditions associated with LOC150998. FIG. 1 further provides a conceptual description of a novel bioinformatically detected viral gene of the present invention, referred to here as Viral Genomic Address Messenger 1113 (VGAM1113) viral gene, which modulates expression of respective host target genes thereof, the function and utility of which host target genes is known in the art.

VGAM1113 is a novel bioinformatically detected regulatory, non protein coding, viral micro RNA (miRNA) gene. The method by which VGAM1113 was detected is described hereinabove with reference to FIGS. 1-8.

VGAM1113 gene, herein designated VGAM GENE, is a viral gene contained in the genome of Camelpox Virus. VGAM1113 host target gene, herein designated VGAM HOST TARGET GENE, is a human gene contained in the human genome.

VGAM1113 gene encodes a VGAM1113 precursor RNA, herein designated VGAM PRECURSOR RNA. Similar to other miRNA genes, and unlike most ordinary genes, VGAM1113 precursor RNA does not encode a protein. A nucleotide sequence identical or highly similar to the nucleotide sequence of VGAM1113 precursor RNA is designated SEQ ID:1099, and is provided hereinbelow with reference to the sequence listing part. Nucleotide sequence SEQ ID:1099 is located at position 103649 relative to the genome of Camelpox Virus.

VGAM1113 precursor RNA folds onto itself, forming VGAM1113 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1113 folded precursor RNA into VGAM1113 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1113 RNA is designated SEQ ID:3824, and is provided hereinbelow with reference to the sequence listing part.

VGAM1113 host target gene, herein designated VGAM HOST TARGET GENE, encodes a corresponding messenger RNA, VGAM1113 host target RNA, herein designated VGAM HOST TARGET RNA. VGAM1113 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1113 RNA, herein designated VGAM RNA, binds complementarily to one or more host target binding sites located in untranslated regions of VGAM1113 host target RNA, herein designated VGAM HOST TARGET RNA. This complementary binding is due to the fact that the nucleotide sequence of VGAM1113 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1113 RNA, herein designated VGAM RNA, may have a different number of host target binding sites in untranslated regions of a VGAM1113 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1113 RNA, herein designated VGAM RNA, to host target binding sites on VGAM1113 host target RNA, herein designated VGAM HOST TARGET RNA, such as BINDING SITE I, BINDING SITE II and BINDING SITE III, inhibits translation of VGAM1113 host target RNA into VGAM1113 host target protein, herein designated VGAM HOST TARGET PROTEIN. VGAM host target protein is therefore outlined by a broken line.

It is appreciated that VGAM1113 host target gene, herein designated VGAM HOST TARGET GENE, in fact represents a plurality of VGAM1113 host target genes. The mRNA of each one of this plurality of VGAM1113 host target genes comprises one or more host target binding sites, each having a nucleotide sequence which is at least partly complementary to VGAM1113 RNA, herein designated VGAM RNA, and which when bound by VGAM1113 RNA causes inhibition of translation of respective one or more VGAM1113 host target proteins.

It is further appreciated by one skilled in the art that the mode of translational inhibition illustrated by FIG. 1 with specific reference to translational inhibition exerted by VGAM1113 gene, herein designated VGAM GENE, on one or more VGAM1113 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1113 is inhibition of expression of host target genes, as part of a novel viral mechanism of attacking a host. Accordingly, utilities of VGAM1113 include diagnosis, prevention and treatment of viral infection by Camelpox Virus. Specific functions, and accordingly utilities, of VGAM1113 correlate with, and may be deduced from, the identity of the host target genes which VGAM1113 binds and inhibits, and the function of these host target genes, as elaborated hereinbelow.

Nucleotide sequences of the VGAM1113 precursor RNA, herein designated VGAM PRECURSOR RNA, and of the 'diced' VGAM1113 RNA, herein designated VGAM RNA, and a schematic representation of the secondary folding of VGAM1113 folded precursor RNA, herein designated VGAM FOLDED PRECURSOR RNA, of VGAM1113 are further described hereinbelow with reference to Table 1.

Nucleotide sequences of host target binding sites, such as BINDING SITE-I, BINDING SITE-II and BINDING SITE-III of FIG. 1, found on VGAM1113 host target RNA, and schematic representation of the complementarity of each of these host target binding sites to VGAM1113 RNA, herein designated VGAM RNA, are described hereinbelow with reference to Table 2.

As mentioned hereinabove with reference to FIG. 1, a function of VGAM1113 gene, herein designated VGAM is inhibition of expression of VGAM1113 target genes. It is appreciated that specific functions, and accordingly utilities, of VGAM1113 correlate with, and may be deduced from, the identity of the target genes which VGAM1113 binds and inhibits, and the function of these target genes, as elaborated hereinbelow.

Adenylate Kinase 2 (AK2, Accession NM_013411) is a VGAM1113 host target gene. AK2 BINDING SITE is HOST TARGET binding site found in the 3' untranslated region of mRNA encoded by AK2, corresponding to a HOST TARGET binding site such as BINDING SITE I, BINDING SITE II or BINDING SITE III. Table 2 illustrates the complementarity of the nucleotide sequences of AK2 BINDING SITE, designated SEQ ID:15075, to the nucleotide sequence of VGAM1113 RNA, herein designated VGAM RNA, also designated SEQ ID:3824.

A function of VGAM1113 is therefore inhibition of Adenylate Kinase 2 (AK2, Accession NM_013411), a gene which essential for maintenance and cell growth. Accordingly, utilities of VGAM1113 include diagnosis, prevention and treatment of diseases and clinical conditions associated with AK2. The function of AK2 has been established by previous studies. The existence of a second adenylate kinase (EC 2.7.4.3) locus linked to PGM1 and peptidase C, i.e., on chromosome 1, was suggested by cell hybridization studies by Van Cong et al. (1972). The Goss-Harris method of mapping combines features of recombinational study in families and synteny tests in hybrid cells. As applied to chromosome 1, the method shows that AK2 and UMPK are distal to PGM1 and that the order of the loci is PGM1: UMPK: (AK2, alpha-FUC): ENO1 (Goss and Harris, 1977). Carritt et al. (1982) presented evidence that AK2 is in 1p34.

Full details of the abovementioned studies are described in the following publications, the disclosure of which are hereby incorporated by reference:

Goss, S. J.; Harris, H.: Gene transfer by means of cell fusion. II. The mapping of 8 loci on human chromosome 1 by statistical analysis of gene assortment in somatic cell hybrids. J. Cell Sci. 25:39-57, 1977; and Carritt, B.; King, J.; Welch, H. M.: Gene order and localization of enzyme loci on the short arm of chromosome 1. Ann. Hum. Genet. 46:329-335, 1982.

Further studies establishing the function and utilities of AK2 are found in John Hopkins OMIM database record ID 103020, and in sited publications numbered 798-801 listed in the bibliography section hereinbelow, which are also hereby incorporated by reference. Calmodulin 2 (phosphorylase kinase, delta) (CALM2, Accession NM_001743) is another VGAM1113 host target gene. CALM2 BINDING SITE is HOST TARGET binding site found in the 3' untranslated region of mRNA encoded by CALM2, corresponding to a HOST TARGET binding site such as BINDING SITE I, BINDING SITE II or BINDING SITE III. Table 2 illustrates the complementarity of the nucleotide sequences of CALM2 BINDING SITE, designated SEQ ID:7480, to the nucleotide sequence of VGAM1113 RNA, herein designated VGAM RNA, also designated SEQ ID:3824.

Another function of VGAM1113 is therefore inhibition of Calmodulin 2 (phosphorylase kinase, delta) (CALM2, Accession NM_001743), a gene which mediates the control of a large number of enzymes by ca (++). Accordingly, utilities of VGAM1113 include diagnosis, prevention and treatment of diseases and clinical conditions associated with CALM2. The function of CALM2 has been established by previous studies. McPherson et al. (1991) tentatively assigned the CALM2 gene to chromosome 10 by study of somatic cell hybrids. However, by PCR-based amplification of CALM2-specific sequences using DNA from human/hamster cell hybrids as template, Berchtold et al. (1993) found that the CALM2 gene is located on chromosome 2. They regionalized the gene to 2p21.3-p21.1 by in situ hybridization.

Full details of the abovementioned studies are described in the following publications, the disclosure of which are hereby incorporated by reference:

Berchtold, M. W.; Egli, R.; Rhyner, J. A.; Hameister, H.; Strehler, E. E.: Localization of the human bona fide calmodulin genes CALM1, CALM2, and CALM3 to chromosomes 14q24-q31, 2p21.1-p21.3, and 19q13.2-q13.3. Genomics 16:461-465, 1993. ; and McPherson, J. D.; Hickie, R. A.; Wasmuth, J. J.; Meyskens, F. L.; Perham, R. N.; Strehler, E. E.; Graham, M. T.: Chromosomal localization of multiple genes encoding calmodulin. (Abstra.

Further studies establishing the function and utilities of CALM2 are found in John Hopkins OMIM database record ID 114182, and in sited publications numbered 1257 and 12578 listed in the bibliography section hereinbelow, which are also hereby incorporated by reference. Hyaluronan-mediated Motility Receptor (RHAMM) (HMMR, Accession NM_012485) is another VGAM1113 host target gene. HMMR BINDING SITE1 and HMMR BINDING SITE2 are HOST TARGET binding sites found in untranslated regions of mRNA encoded by HMMR, corresponding to HOST TARGET binding sites such as BINDING SITE I, BINDING SITE II or BINDING SITE III. Table 2 illustrates the complementarity of the nucleotide sequences of HMMR BINDING SITE1 and HMMR BINDING SITE2, designated SEQ ID:14862 and SEQ ID:14860 respectively, to the nucleotide sequence of VGAM1113 RNA, herein designated VGAM RNA, also designated SEQ ID:3824.

Another function of VGAM1113 is therefore inhibition of Hyaluronan-mediated Motility Receptor (RHAMM) (HMMR, Accession NM_012485). Accordingly, utilities of VGAM1113 include diagnosis, prevention and treatment of diseases and clinical conditions associated with HMMR. Myotubularin Related Protein 8 (MTMR8, Accession NM_015458) is another VGAM1113 host target gene. MTMR8 BINDING SITE is HOST TARGET binding site found in the 3' untranslated region of mRNA encoded by MTMR8, corresponding to a HOST TARGET binding site such as BINDING SITE I, BINDING SITE II or BINDING SITE III. Table 2 illustrates the complementarity of the nucleotide sequences of MTMR8 BINDING SITE, designated SEQ ID:17741, to the nucleotide sequence of VGAM1113 RNA, herein designated VGAM RNA, also designated SEQ ID:3824.

Another function of VGAM1113 is therefore inhibition of Myotubularin Related Protein 8 (MTMR8, Accession NM_015458), a gene which could be a tyrosine-phosphatase. Accordingly, utilities of VGAM1113 include diagnosis, prevention and treatment of diseases and clinical conditions associated with MTMR8. The function of MTMR8 and its association with various diseases and clinical conditions, has been established by previous studies, as described hereinabove with reference to VGAM379. Pentaxin-related Gene, Rapidly Induced By IL-1 Beta (PTX3, Accession NM_002852) is another VGAM1113 host target gene. PTX3 BINDING SITE is HOST TARGET binding site found in the 3' untranslated region of mRNA encoded by PTX3, corresponding to a HOST TARGET binding site such as BINDING SITE I, BINDING SITE II or BINDING SITE III. Table 2 illustrates the complementarity of the nucleotide sequences of PTX3 BINDING SITE, designated SEQ ID:8747, to the nucleotide sequence of VGAM1113 RNA, herein designated VGAM RNA, also designated SEQ ID:3824.

Another function of VGAM1113 is therefore inhibition of Pentaxin-related Gene, Rapidly Induced By IL-1 Beta (PTX3, Accession NM_002852), a gene which is similar to the pentaxin subclass of inflammatory acute-phase proteins. Accordingly, utilities of VGAM1113 include diagnosis, prevention and treatment of diseases and clinical conditions associated with PTX3. The function of PTX3 and its association with various diseases and clinical conditions, has been established by previous studies, as described hereinabove with reference to VGAM779. Chemokine (C-C motif) Receptor 7 (CCR7, Accession NM_001838) is another VGAM1113 host target gene. CCR7 BINDING SITE is HOST TARGET binding site found in the 3' untranslated region of mRNA encoded by CCR7, corresponding to a HOST TARGET binding site such as BINDING SITE I, BINDING SITE II or BINDING SITE III. Table 2 illustrates the complementarity of the nucleotide sequences of CCR7 BINDING SITE, designated SEQ ID:7576, to the nucleotide sequence of VGAM1113 RNA, herein designated VGAM RNA, also designated SEQ ID:3824.

Another function of VGAM1113 is therefore inhibition of Chemokine (C-C motif) Receptor 7 (CCR7, Accession NM_001838). Accordingly, utilities of VGAM1113 include diagnosis, prevention and treatment of diseases and clinical conditions associated with CCR7. CCR4-NOT Transcription Complex, Subunit 7 (CNOT7, Accession NM_013354) is another VGAM1113 host target gene. CNOT7 BINDING SITE is HOST TARGET binding site found in the 3' untranslated region of mRNA encoded by CNOT7, corresponding to a HOST TARGET binding site such as BINDING SITE I, BINDING SITE II or BINDING SITE III. Table 2 illustrates the complementarity of the nucleotide sequences of CNOT7 BINDING SITE, designated SEQ ID:14998, to the nucleotide sequence of VGAM1113 RNA, herein designated VGAM RNA, also designated SEQ ID:3824.

Another function of VGAM1113 is therefore inhibition of CCR4-NOT Transcription Complex, Subunit 7 (CNOT7, Accession NM_013354). Accordingly, utilities of VGAM1113 include diagnosis, prevention and treatment of diseases and clinical conditions associated with CNOT7. FLJ12363 (Accession NM_032167) is another VGAM1113 host target gene. FLJ12363 BINDING SITE is HOST TARGET binding site found in the 3' untranslated region of mRNA encoded by FLJ12363, corresponding to a HOST TARGET binding site such as BINDING SITE I, BINDING SITE II or BINDING SITE III. Table 2 illustrates the complementarity of the nucleotide sequences of FLJ12363 BINDING SITE, designated SEQ ID:25868, to the nucleotide sequence of VGAM1113 RNA, herein designated VGAM RNA, also designated SEQ ID:3824.

Another function of VGAM1113 is therefore inhibition of FLJ12363 (Accession NM_032167). Accordingly, utilities of VGAM1113 include diagnosis, prevention and treatment of diseases and clinical conditions associated with FLJ12363. FLJ13912 (Accession NM_022770) is another VGAM1113 host target gene. FLJ13912 BINDING SITE is HOST TARGET binding site found in the 3' untranslated region of mRNA encoded by FLJ13912, corresponding to a HOST TARGET binding site such as BINDING SITE I, BINDING SITE II or BINDING SITE III. Table 2 illustrates the complementarity of the nucleotide sequences of FLJ13912 BINDING SITE, designated SEQ ID:23025, to the nucleotide sequence of VGAM1113 RNA, herein designated VGAM RNA, also designated SEQ ID:3824.

Another function of VGAM1113 is therefore inhibition of FLJ13912 (Accession NM_022770). Accordingly, utilities of VGAM1113 include diagnosis, prevention and treatment of diseases and clinical conditions associated with FLJ13912. FLJ20340 (Accession NM_017773) is another VGAM1113 host target gene. FLJ20340 BINDING SITE is HOST TARGET binding site found in the 3' untranslated region of mRNA encoded by FLJ20340, corresponding to a HOST TARGET binding site such as BINDING SITE I, BINDING SITE II or BINDING SITE III. Table 2 illustrates the complementarity of the nucleotide sequences of FLJ20340 BINDING SITE, designated SEQ ID:19396, to the nucleotide sequence of VGAM1113 RNA, herein designated VGAM RNA, also designated SEQ ID:3824.

Another function of VGAM1113 is therefore inhibition of FLJ20340 (Accession NM_017773). Accordingly, utilities of VGAM1113 include diagnosis, prevention and treatment of diseases and clinical conditions associated with FLJ20340. FLJ21240 (Accession NM_024847) is another VGAM1113 host target gene. FLJ21240 BINDING SITE is HOST TARGET binding site found in the 3' untranslated region of mRNA encoded by FLJ21240, corresponding to a HOST TARGET binding site such as BINDING SITE I, BINDING SITE II or BINDING SITE III. Table 2 illustrates the complementarity of the nucleotide sequences of FLJ21240 BINDING SITE, designated SEQ ID:24279, to the nucleotide sequence of VGAM1113 RNA, herein designated VGAM RNA, also designated SEQ ID:3824.

Another function of VGAM1113 is therefore inhibition of FLJ21240 (Accession NM_024847). Accordingly, utilities of VGAM1113 include diagnosis, prevention and treatment of diseases and clinical conditions associated with FLJ21240. FLJ23022 (Accession NM_025051) is another VGAM1113 host target gene. FLJ23022 BINDING SITE is HOST TARGET binding site found in the 3' untranslated region of mRNA encoded by FLJ23022, corresponding to a HOST TARGET binding site such as BINDING SITE I, BINDING SITE II or BINDING SITE III. Table 2 illustrates the complementarity of the nucleotide sequences of FLJ23022 BINDING SITE, designated SEQ ID:24647, to the nucleotide sequence of VGAM1113 RNA, herein designated VGAM RNA, also designated SEQ ID:3824.

Another function of VGAM1113 is therefore inhibition of FLJ23022 (Accession NM_025051). Accordingly, utilities of VGAM1113 include diagnosis, prevention and treatment of diseases and clinical conditions associated with FLJ23022. KIAA0748 (Accession NM_014796) is another VGAM1113 host target gene. KIAA0748 BINDING SITE is HOST TARGET binding site found in the 3' untranslated region of mRNA encoded by KIAA0748, corresponding to a HOST TARGET binding site such as BINDING SITE I, BINDING SITE II or BINDING SITE III. Table 2 illustrates the complementarity of the nucleotide sequences of KIAA0748 BINDING SITE, designated SEQ ID:16698, to the nucleotide sequence of VGAM1113 RNA, herein designated VGAM RNA, also designated SEQ ID:3824.

Another function of VGAM1113 is therefore inhibition of KIAA0748 (Accession NM_014796). Accordingly, utilities of VGAM1113 include diagnosis, prevention and treatment of diseases and clinical conditions associated with KIAA0748. MCM10 Minichromosome Maintenance Deficient 10 (S. cerevisiae) (MCM10, Accession NM_018518) is another VGAM1113 host target gene. MCM10 BINDING SITE is HOST TARGET binding site found in the 3' untranslated region of mRNA encoded by MCM10, corresponding to a HOST TARGET binding site such as BINDING SITE I, BINDING SITE II or BINDING SITE III. Table 2 illustrates the complementarity of the nucleotide sequences of MCM10 BINDING SITE, designated SEQ ID:20594, to the nucleotide sequence of VGAM1113 RNA, herein designated VGAM RNA, also designated SEQ ID:3824.

Another function of VGAM1113 is therefore inhibition of MCM10 Minichromosome Maintenance Deficient 10 (S. cerevisiae) (MCM10, Accession NM_018518). Accordingly, utilities of VGAM1113 include diagnosis, prevention and treatment of diseases and clinical conditions associated with MCM10. MGC15438 (Accession NM_032874) is another VGAM1113 host target gene. MGC15438 BINDING SITE is HOST TARGET binding site found in the 3' untranslated region of mRNA encoded by MGC15438, corresponding to a HOST TARGET binding site such as BINDING SITE I, BINDING SITE II or BINDING SITE III. Table 2 illustrates the complementarity of the nucleotide sequences of MGC15438 BINDING SITE, designated SEQ ID:26693, to the nucleotide sequence of VGAM1113 RNA, herein designated VGAM RNA, also designated SEQ ID:3824.

Another function of VGAM1113 is therefore inhibition of MGC15438 (Accession NM_032874). Accordingly, utilities of VGAM1113 include diagnosis, prevention and treatment of diseases and clinical conditions associated with MGC15438. MGC22014 (Accession XM_035307) is another VGAM1113 host target gene. MGC22014 BINDING SITE is HOST TARGET binding site found in the 3' untranslated region of mRNA encoded by MGC22014, corresponding to a HOST TARGET binding site such as BINDING SITE I, BINDING SITE II or BINDING SITE III. Table 2 illustrates the complementarity of the nucleotide sequences of MGC22014 BINDING SITE, designated SEQ ID:32213, to the nucleotide sequence of VGAM1113 RNA, herein designated VGAM RNA, also designated SEQ ID:3824.

Another function of VGAM1113 is therefore inhibition of MGC22014 (Accession XM_035307). Accordingly, utilities of VGAM1113 include diagnosis, prevention and treatment of diseases and clinical conditions associated with MGC22014. Phorbol-12-myristate-13-acetate-induced Protein 1 (PMAIP1, Accession NM_021127) is another VGAM1113 host target gene. PMAIP1 BINDING SITE is HOST TARGET binding site found in the 3' untranslated region of mRNA encoded by PMAIP1, corresponding to a HOST TARGET binding site such as BINDING SITE I, BINDING SITE II or BINDING SITE III. Table 2 illustrates the complementarity of the nucleotide sequences of PMAIP1 BINDING SITE, designated SEQ ID:22098, to the nucleotide sequence of VGAM1113 RNA, herein designated VGAM RNA, also designated SEQ ID:3824.

Another function of VGAM1113 is therefore inhibition of Phorbol-12-myristate-13-acetate-induced Protein 1 (PMAIP1, Accession NM_021127). Accordingly, utilities of VGAM1113 include diagnosis, prevention and treatment of diseases and clinical conditions associated with PMAIP1. Signal Sequence Receptor, Gamma (translocon-associated protein gamma) (SSR3, Accession NM_007107) is another VGAM1113 host target gene. SSR3 BINDING SITE is HOST TARGET binding site found in the 3' untranslated region of mRNA encoded by SSR3, corresponding to a HOST TARGET binding site such as BINDING SITE I, BINDING SITE II or BINDING SITE III. Table 2 illustrates the complementarity of the nucleotide sequences of SSR3 BINDING SITE, designated SEQ ID:13971, to the nucleotide sequence of VGAM1113 RNA, herein designated VGAM RNA, also designated SEQ ID:3824.

Another function of VGAM1113 is therefore inhibition of Signal Sequence Receptor, Gamma (translocon-associated protein gamma) (SSR3, Accession NM_007107). Accordingly, utilities of VGAM1113 include diagnosis, prevention and treatment of diseases and clinical conditions associated with SSR3. T-box 21 (TBX21, Accession NM_013351) is another VGAM1113 host target gene. TBX21 BINDING SITE is HOST TARGET binding site found in the 3' untranslated region of mRNA encoded by TBX21, corresponding to a HOST TARGET binding site such as BINDING SITE I, BINDING SITE II or BINDING SITE III. Table 2 illustrates the complementarity of the nucleotide sequences of TBX21 BINDING SITE, designated SEQ ID:14996, to the nucleotide sequence of VGAM1113 RNA, herein designated VGAM RNA, also designated SEQ ID:3824.

Another function of VGAM1113 is therefore inhibition of T-box 21 (TBX21, Accession NM_013351). Accordingly, utilities of VGAM1113 include diagnosis, prevention and treatment of diseases and clinical conditions associated with TBX21. LOC58489 (Accession XM_051862) is another VGAM1113 host target gene. LOC58489 BINDING SITE is HOST TARGET binding site found in the 3' untranslated region of mRNA encoded by LOC58489, corresponding to a HOST TARGET binding site such as BINDING SITE I, BINDING SITE II or BINDING SITE III. Table 2 illustrates the complementarity of the nucleotide sequences of LOC58489 BINDING SITE, designated SEQ ID:35902, to the nucleotide sequence of VGAM1113 RNA, herein designated VGAM RNA, also designated SEQ ID:3824.

Another function of VGAM1113 is therefore inhibition of LOC58489 (Accession XM_051862). Accordingly, utilities of VGAM1113 include diagnosis, prevention and treatment of diseases and clinical conditions associated with LOC58489. LOC92267 (Accession XM_043979) is another VGAM1113 host target gene. LOC92267 BINDING SITE is HOST TARGET binding site found in the 3' untranslated region of mRNA encoded by LOC92267, corresponding to a HOST TARGET binding site such as BINDING SITE I, BINDING SITE II or BINDING SITE III. Table 2 illustrates the complementarity of the nucleotide sequences of LOC92267 BINDING SITE, designated SEQ ID:34055, to the nucleotide sequence of VGAM1113 RNA, herein designated VGAM RNA, also designated SEQ ID:3824.

Another function of VGAM1113 is therefore inhibition of LOC92267 (Accession XM_043979). Accordingly, utilities of VGAM1113 include diagnosis, prevention and treatment of diseases and clinical conditions associated with LOC92267. LOC92482 (Accession XM_045310) is another VGAM1113 host target gene. LOC92482 BINDING SITE is HOST TARGET binding site found in the 5' untranslated region of mRNA encoded by LOC92482, corresponding to a HOST TARGET binding site such as BINDING SITE I, BINDING SITE II or BINDING SITE III. Table 2 illustrates the complementarity of the nucleotide sequences of LOC92482 BINDING SITE, designated SEQ ID:34432, to the nucleotide sequence of VGAM1113 RNA, herein designated VGAM RNA, also designated SEQ ID:3824.

Another function of VGAM1113 is therefore inhibition of LOC92482 (Accession XM_045310). Accordingly, utilities of VGAM1113 include diagnosis, prevention and treatment of diseases and clinical conditions associated with LOC92482. FIG. 1 further provides a conceptual description of a novel bioinformatically detected viral gene of the present invention, referred to here as Viral Genomic Address Messenger 1114 (VGAM1114) viral gene, which modulates expression of respective host target genes thereof, the function and utility of which host target genes is known in the art.

VGAM1114 is a novel bioinformatically detected regulatory, non protein coding, viral micro RNA (miRNA) gene.

The method by which VGAM1114 was detected is described hereinabove with reference to FIGS. 1-8.

VGAM1114 gene, herein designated VGAM GENE, is a viral gene contained in the genome of Camelpox Virus. VGAM1114 host target gene, herein designated VGAM HOST TARGET GENE, is a human gene contained in the human genome.

VGAM1114 gene encodes a VGAM1114 precursor RNA, herein designated VGAM PRECURSOR RNA. Similar to other miRNA genes, and unlike most ordinary genes, VGAM1114 precursor RNA does not encode a protein. A nucleotide sequence identical or highly similar to the nucleotide sequence of VGAM1114 precursor RNA is designated SEQ ID:1100, and is provided hereinbelow with reference to the sequence listing part. Nucleotide sequence SEQ ID:1100 is located at position 101465 relative to the genome of Camelpox Virus.

VGAM1114 precursor RNA folds onto itself, forming VGAM1114 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1114 folded precursor RNA into VGAM1114 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM1114 RNA is designated SEQ ID:3825, and is provided hereinbelow with reference to the sequence listing part.

VGAM1114 host target gene, herein designated VGAM HOST TARGET GENE, encodes a corresponding messenger RNA, VGAM1114 host target RNA, herein designated VGAM HOST TARGET RNA. VGAM1114 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1114 RNA, herein designated VGAM RNA, binds complementarily to one or more host target binding sites located in untranslated regions of VGAM1114 host target RNA, herein designated VGAM HOST TARGET RNA. This complementary binding is due to the fact that the nucleotide sequence of VGAM1114 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1114 RNA, herein designated VGAM RNA, may have a different number of host target binding sites in untranslated regions of a VGAM1114 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1114 RNA, herein designated VGAM RNA, to host target binding sites on VGAM1114 host target RNA, herein designated VGAM HOST TARGET RNA, such as BINDING SITE I, BINDING SITE II and BINDING SITE III, inhibits translation of VGAM1114 host target RNA into VGAM1114 host target protein, herein designated VGAM HOST TARGET PROTEIN. VGAM host target protein is therefore outlined by a broken line.

It is appreciated that VGAM1114 host target gene, herein designated VGAM HOST TARGET GENE, in fact represents a plurality of VGAM1114 host target genes. The mRNA of each one of this plurality of VGAM1114 host target genes comprises one or more host target binding sites, each having a nucleotide sequence which is at least partly complementary to VGAM1114 RNA, herein designated VGAM RNA, and which when bound by VGAM1114 RNA causes inhibition of translation of respective one or more VGAM1114 host target proteins.

It is further appreciated by one skilled in the art that the mode of translational inhibition illustrated by FIG. 1 with specific reference to translational inhibition exerted by VGAM1114 gene, herein designated VGAM GENE, on one or more VGAM1114 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1114 is inhibition of expression of host target genes, as part of a novel viral mechanism of attacking a host. Accordingly, utilities of VGAM1114 include diagnosis, prevention and treatment of viral infection by Camelpox Virus. Specific functions, and accordingly utilities, of VGAM1114 correlate with, and may be deduced from, the identity of the host target genes which VGAM1114 binds and inhibits, and the function of these host target genes, as elaborated hereinbelow.

Nucleotide sequences of the VGAM1114 precursor RNA, herein designated VGAM PRECURSOR RNA, and of the 'diced' VGAM1114 RNA, herein designated VGAM RNA, and a schematic representation of the secondary folding of VGAM1114 folded precursor RNA, herein designated VGAM FOLDED PRECURSOR RNA, of VGAM1114 are further described hereinbelow with reference to Table 1.

Nucleotide sequences of host target binding sites, such as BINDING SITE-I, BINDING SITE-II and BINDING SITE-III of FIG. 1, found on VGAM1114 host target RNA, and schematic representation of the complementarity of each of these host target binding sites to VGAM1114 RNA, herein designated VGAM RNA, are described hereinbelow with reference to Table 2.

As mentioned hereinabove with reference to FIG. 1, a function of VGAM1114 gene, herein designated VGAM is inhibition of expression of VGAM1114 target genes. It is appreciated that specific functions, and accordingly utilities, of VGAM1114 correlate with, and may be deduced from, the identity of the target genes which VGAM1114 binds and inhibits, and the function of these target genes, as elaborated hereinbelow.

G Protein-coupled Receptor Kinase 7 (GPRK7, Accession NM_139209) is a VGAM1114 host target gene. GPRK7 BINDING SITE is HOST TARGET binding site found in the 3' untranslated region of mRNA encoded by GPRK7, corresponding to a HOST TARGET binding site such as BINDING SITE I, BINDING SITE II or BINDING SITE III. Table 2 illustrates the complementarity of the nucleotide sequences of GPRK7 BINDING SITE, designated SEQ ID:29226, to the nucleotide sequence of VGAM1114 RNA, herein designated VGAM RNA, also designated SEQ ID:3825.

A function of VGAM1114 is therefore inhibition of G Protein-coupled Receptor Kinase 7 (GPRK7, Accession NM_139209), a gene which may play a role in signal transduction pathways that involve calcium as a second messenger. Accordingly, utilities of VGAM1114 include diagnosis, prevention and treatment of diseases and clinical conditions associated with GPRK7. The function of GPRK7 and its association with various diseases and clinical conditions, has been established by previous studies, as described hereinabove with reference to VGAM640. Solute Carrier Family 12 (potassium/chloride transporters), Member 7 (SLC12A7, Accession NM_006598) is another VGAM1114 host target gene. SLC12A7 BINDING SITE is HOST TARGET binding site found in the 3' untranslated region of mRNA encoded by SLC12A7, corresponding to a HOST TARGET binding site such as BINDING SITE I, BINDING SITE II or BINDING SITE III. Table 2 illustrates the complementarity of the nucleotide sequences of SLC12A7 BINDING SITE, designated SEQ ID:13372, to the nucleotide sequence of VGAM1114 RNA, herein designated VGAM RNA, also designated SEQ ID:3825.

Another function of VGAM1114 is therefore inhibition of Solute Carrier Family 12 (potassium/chloride transporters), Member 7 (SLC12A7, Accession NM_006598), a gene which is a potassium/chloride-cotransporter. Accordingly, utilities of VGAM1114 include diagnosis, prevention and treatment of diseases and clinical conditions associated with SLC12A7. The function of SLC12A7 and its association with various diseases and clinical conditions, has been established by previous studies, as described hereinabove with reference to VGAM200. Solute Carrier Family 4, Sodium Bicarbonate Cotransporter, Member 7 (SLC4A7, Accession NM_003615) is another VGAM1114 host target gene. SLC4A7 BINDING SITE is HOST TARGET binding site found in the 3' untranslated region of mRNA encoded by SLC4A7, corresponding to a HOST TARGET binding site such as BINDING SITE I, BINDING SITE II or BINDING SITE III. Table 2 illustrates the complementarity of the nucleotide sequences of SLC4A7 BINDING SITE, designated SEQ ID:9667, to the nucleotide sequence of VGAM1114 RNA, herein designated VGAM RNA, also designated SEQ ID:3825.

Another function of VGAM1114 is therefore inhibition of Solute Carrier Family 4, Sodium Bicarbonate Cotransporter, Member 7 (SLC4A7, Accession NM_003615), a gene which mediates the coupled movement of sodium and bicarbonate ions across the plasma membrane. Accordingly, utilities of VGAM1114 include diagnosis, prevention and treatment of diseases and clinical conditions associated with SLC4A7. The function of SLC4A7 and its association with various diseases and clinical conditions, has been established by previous studies, as described hereinabove with reference to VGAM66. KIAA0391 (Accession NM_014672) is another VGAM1114 host target gene. KIAA0391 BINDING SITE is HOST TARGET binding site found in the 3" untranslated region of mRNA encoded by KIAA0391, corresponding to a HOST TARGET binding site such as BINDING SITE I, BINDING SITE II or BINDING SITE III. Table 2 illustrates the complementarity of the nucleotide sequences of KIAA0391 BINDING SITE, designated SEQ ID:16134, to the nucleotide sequence of VGAM1114 RNA, herein designated VGAM RNA, also designated SEQ ID:3825.

Another function of VGAM1114 is therefore inhibition of KIAA0391 (Accession NM_014672). Accordingly, utilities of VGAM1114 include diagnosis, prevention and treatment of diseases and clinical conditions associated with KIAA0391. KIAA1884 (Accession XM_055539) is another VGAM1114 host target gene. KIAA1884 BINDING SITE is HOST TARGET binding site found in the 3' untranslated region of mRNA encoded by KIAA1884, corresponding to a HOST TARGET binding site such as BINDING SITE I, BINDING SITE II or BINDING SITE III. Table 2 illustrates the complementarity of the nucleotide sequences of KIAA1884 BINDING SITE, designated SEQ ID:36289, to the nucleotide sequence of VGAM1114 RNA, herein designated VGAM RNA, also designated SEQ ID:3825.

Another function of VGAM1114 is therefore inhibition of KIAA1884 (Accession XM_055539). Accordingly, utilities of VGAM1114 include diagnosis, prevention and treatment of diseases and clinical conditions associated with KIAA1884. PP1201 (Accession NM_022152) is another VGAM1114 host target gene. PP1201 BINDING SITE is HOST TARGET binding site found in the 3' untranslated region of mRNA encoded by PP1201, corresponding to a HOST TARGET binding site such as BINDING SITE I, BINDING SITE II or BINDING SITE III. Table 2 illustrates the complementarity of the nucleotide sequences of PP1201 BINDING SITE, designated SEQ ID:22709, to the nucleotide sequence of VGAM1114 RNA, herein designated VGAM RNA, also designated SEQ ID:3825.

Another function of VGAM1114 is therefore inhibition of PP1201 (Accession NM_022152). Accordingly, utilities of VGAM1114 include diagnosis, prevention and treatment of diseases and clinical conditions associated with PP1201. PRO0659 (Accession NM_014138) is another VGAM1114 host target gene. PRO0659 BINDING SITE is HOST TARGET binding site found in the 3' untranslated region of mRNA encoded by PRO0659, corresponding to a HOST TARGET binding site such as BINDING SITE I, BINDING SITE II or BINDING SITE III. Table 2 illustrates the complementarity of the nucleotide sequences of PRO0659 BINDING SITE, designated SEQ ID:15404, to the nucleotide sequence of VGAM1114 RNA, herein designated VGAM RNA, also designated SEQ ID:3825.

Another function of VGAM1114 is therefore inhibition of PRO0659 (Accession NM_014138). Accordingly, utilities of VGAM1114 include diagnosis, prevention and treatment of diseases and clinical conditions associated with PRO0659. LOC148824 (Accession XM_097527) is another VGAM1114 host target gene. LOC148824 BINDING SITE is HOST TARGET binding site found in the 3' untranslated region of mRNA encoded by LOC148824, corresponding to a HOST TARGET binding site such as BINDING SITE I, BINDING SITE II or BINDING SITE III. Table 2 illustrates the complementarity of the nucleotide sequences of LOC148824 BINDING SITE, designated SEQ ID:40905, to the nucleotide sequence of VGAM1114 RNA, herein designated VGAM RNA, also designated SEQ ID:3825.

Another function of VGAM1114 is therefore inhibition of LOC148824 (Accession XM_097527). Accordingly, utilities of VGAM1114 include diagnosis, prevention and treatment of diseases and clinical conditions associated with LOC148824. LOC203286 (Accession XM_117526) is another VGAM1114 host target gene. LOC203286 BINDING SITE is HOST TARGET binding site found in the 5' untranslated region of mRNA encoded by LOC203286, corresponding to a HOST TARGET binding site such as BINDING SITE I, BINDING SITE II or BINDING SITE III. Table 2 illustrates the complementarity of the nucleotide sequences of LOC203286 BINDING SITE, designated SEQ ID:43492, to the nucleotide sequence of VGAM1114 RNA, herein designated VGAM RNA, also designated SEQ ID:3825.

Another function of VGAM1114 is therefore inhibition of LOC203286 (Accession XM_117526). Accordingly, utilities of VGAM1114 include diagnosis, prevention and treatment of diseases and clinical conditions associated with LOC203286. LOC221543 (Accession XM_168091) is another VGAM1114 host target gene. LOC221543 BINDING SITE is HOST TARGET binding site found in the 3' untranslated region of mRNA encoded by LOC221543, corresponding to a HOST TARGET binding site such as BINDING SITE I, BINDING SITE II or BINDING SITE III. Table 2 illustrates the complementarity of the nucleotide sequences of LOC221543 BINDING SITE, designated SEQ ID:45014, to the nucleotide sequence of VGAM1114 RNA, herein designated VGAM RNA, also designated SEQ ID:3825.

Another function of VGAM1114 is therefore inhibition of LOC221543 (Accession XM_168091). Accordingly, utilities of VGAM1114 include diagnosis, prevention and treatment of diseases and clinical conditions associated with LOC221543. LOC257596 (Accession XM_175296) is another VGAM1114 host target gene. LOC257596 BINDING SITE is HOST TARGET binding site found in the 3' untranslated region of mRNA encoded by LOC257596, corresponding to a HOST TARGET binding site such as BINDING SITE I, BINDING SITE II or BINDING SITE III. Table 2 illustrates the complementarity of the nucleotide sequences of LOC257596 BINDING SITE, designated SEQ ID:46754, to the nucleotide sequence of VGAM1114 RNA, herein designated VGAM RNA, also designated SEQ ID:3825.

Another function of VGAM1114 is therefore inhibition of LOC257596 (Accession XM_175296). Accordingly, utilities of VGAM1114 include diagnosis, prevention and treatment of diseases and clinical conditions associated with LOC257596. FIG. 1 further provides a conceptual description of a novel bioinformatically detected viral gene of the present invention, referred to here as Viral Genomic Address Messenger 1115 (VGAM1115) viral gene, which modulates expression of respective host target genes thereof, the function and utility of which host target genes is known in the art.

VGAM1115 is a novel bioinformatically detected regulatory, non protein coding, viral micro RNA (miRNA) gene. The method by which VGAM1115 was detected is described hereinabove with reference to FIGS. 1-8.

VGAM1115 gene, herein designated VGAM GENE, is a viral gene contained in the genome of Camelpox Virus. VGAM1115 host target gene, herein designated VGAM HOST TARGET GENE, is a human gene contained in the human genome.

VGAM1115 gene encodes a VGAM1115 precursor RNA, herein designated VGAM PRECURSOR RNA. Similar to other miRNA genes, and unlike most ordinary genes, VGAM1115 precursor RNA does not encode a protein. A nucleotide sequence identical or highly similar to the nucleotide sequence of VGAM1115 precursor RNA is designated SEQ ID:1101, and is provided hereinbelow with reference to the sequence listing part. Nucleotide sequence SEQ ID:1101 is located at position 100938 relative to the genome of Camelpox Virus.

VGAM1115 precursor RNA folds onto itself, forming VGAM1115 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1115 folded precursor RNA into VGAM1115 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM1115 RNA is designated SEQ ID:3826, and is provided hereinbelow with reference to the sequence listing part.

VGAM1115 host target gene, herein designated VGAM HOST TARGET GENE, encodes a corresponding messenger RNA, VGAM1115 host target RNA, herein designated VGAM HOST TARGET RNA. VGAM1115 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1115 RNA, herein designated VGAM RNA, binds complementarily to one or more host target binding sites located in untranslated regions of VGAM1115 host target RNA, herein designated VGAM HOST TARGET RNA. This complementary binding is due to the fact that the nucleotide sequence of VGAM1115 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1115 RNA, herein designated VGAM RNA, may have a different number of host target binding sites in untranslated regions of a VGAM1115 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1115 RNA, herein designated VGAM RNA, to host target binding sites on VGAM1115 host target RNA, herein designated VGAM HOST TARGET RNA, such as BINDING SITE I, BINDING SITE II and BINDING SITE III, inhibits translation of VGAM1115 host target RNA into VGAM1115 host target protein, herein designated VGAM HOST TARGET PROTEIN. VGAM host target protein is therefore outlined by a broken line.

It is appreciated that VGAM1115 host target gene, herein designated VGAM HOST TARGET GENE, in fact represents a plurality of VGAM1115 host target genes. The mRNA of each one of this plurality of VGAM1115 host target genes comprises one or more host target binding sites, each having a nucleotide sequence which is at least partly complementary to VGAM1115 RNA, herein designated VGAM RNA, and which when bound by VGAM1115 RNA causes inhibition of translation of respective one or more VGAM1115 host target proteins.

It is further appreciated by one skilled in the art that the mode of translational inhibition illustrated by FIG. 1 with specific reference to translational inhibition exerted by VGAM1115 gene, herein designated VGAM GENE, on one or more VGAM1115 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1115 is inhibition of expression of host target genes, as part of a novel viral mechanism of attacking a host. Accordingly, utilities of VGAM1115 include diagnosis, prevention and treatment of viral infection by Camelpox Virus. Specific functions, and accordingly utilities, of VGAM1115 correlate with, and may be deduced from, the identity of the host target genes which VGAM1115 binds and inhibits, and the function of these host target genes, as elaborated hereinbelow.

Nucleotide sequences of the VGAM1115 precursor RNA, herein designated VGAM PRECURSOR RNA, and of the 'diced' VGAM1115 RNA, herein designated VGAM RNA, and a schematic representation of the secondary folding of VGAM1115 folded precursor RNA, herein designated VGAM FOLDED PRECURSOR RNA, of VGAM1115 are further described hereinbelow with reference to Table 1.

Nucleotide sequences of host target binding sites, such as BINDING SITE-I, BINDING SITE-II and BINDING SITE-III of FIG. 1, found on VGAM1115 host target RNA, and schematic representation of the complementarity of each of these host target binding sites to VGAM1115 RNA, herein designated VGAM RNA, are described hereinbelow with reference to Table 2.

As mentioned hereinabove with reference to FIG. 1, a function of VGAM1115 gene, herein designated VGAM is inhibition of expression of VGAM1115 target genes. It is appreciated that specific functions, and accordingly utilities, of VGAM1115 correlate with, and may be deduced from, the identity of the target genes which VGAM1115 binds and inhibits, and the function of these target genes, as elaborated hereinbelow.

Integrin, Alpha 3 (antigen CD49C, alpha 3 subunit of VLA-3 receptor) (ITGA3, Accession NM_002204) is a VGAM1115 host target gene. ITGA3 BINDING SITE1 and ITGA3 BINDING SITE2 are HOST TARGET binding sites found in untranslated regions of mRNA encoded by ITGA3, corresponding to HOST TARGET binding sites such as BINDING SITE I, BINDING SITE II or BINDING SITE III. Table 2 illustrates the complementarity of the nucleotide sequences of ITGA3 BINDING SITE1 and ITGA3 BINDING SITE2, designated SEQ ID:7964 and SEQ ID:12007 respectively, to the nucleotide sequence of VGAM1115 RNA, herein designated VGAM RNA, also designated SEQ ID:3826.

A function of VGAM1115 is therefore inhibition of Integrin, Alpha 3 (antigen CD49C, alpha 3 subunit of VLA-3 receptor) (ITGA3, Accession NM_002204), a gene which is a receptor for fibronectin, laminin, collagen, epiligrin and thrombospondin. Accordingly, utilities of VGAM1115 include diagnosis, prevention and treatment of diseases and clinical conditions associated with ITGA3. The function of ITGA3 and its association with various diseases and clinical conditions, has been established by previous studies, as described hereinabove with reference to VGAM1020. BSPECV (Accession NM_016642) is another VGAM1115 host target gene. BSPECV BINDING SITE is HOST TARGET binding site found in the 5' untranslated region of mRNA encoded by BSPECV, corresponding to a HOST TARGET binding site such as BINDING SITE I, BINDING SITE II or BINDING SITE III. Table 2 illustrates the complementarity of the nucleotide sequences of BSPECV BINDING SITE, designated SEQ ID:18748, to the nucleotide sequence of VGAM1115 RNA, herein designated VGAM RNA, also designated SEQ ID:3826.

Another function of VGAM1115 is therefore inhibition of BSPECV (Accession NM_016642). Accordingly, utilities of VGAM1115 include diagnosis, prevention and treatment of diseases and clinical conditions associated with BSPECV. Calpain 6 (CAPN6, Accession NM_014289) is another VGAM1115 host target gene. CAPN6 BINDING SITE is HOST TARGET binding site found in the 3' untranslated region of mRNA encoded by CAPN6, corresponding to a HOST TARGET binding site such as BINDING SITE I, BINDING SITE II or BINDING SITE III. Table 2 illustrates the complementarity of the nucleotide sequences of CAPN6 BINDING SITE, designated SEQ ID:15571, to the nucleotide sequence of VGAM1115 RNA, herein designated VGAM RNA, also designated SEQ ID:3826.

Another function of VGAM1115 is therefore inhibition of Calpain 6 (CAPN6, Accession NM_014289). Accordingly, utilities of VGAM1115 include diagnosis, prevention and treatment of diseases and clinical conditions associated with CAPN6. HRD1 (Accession XM_045498) is another VGAM1115 host target gene. HRD1 BINDING SITE is HOST TARGET binding site found in the 3' untranslated region of mRNA encoded by HRD1, corresponding to a HOST TARGET binding site such as BINDING SITE I, BINDING SITE II or BINDING SITE III. Table 2 illustrates the complementarity of the nucleotide sequences of HRD1 BINDING SITE, designated SEQ ID:34474, to the nucleotide sequence of VGAM1115 RNA, herein designated VGAM RNA, also designated SEQ ID:3826.

Another function of VGAM1115 is therefore inhibition of HRD1 (Accession XM_045498). Accordingly, utilities of VGAM1115 include diagnosis, prevention and treatment of diseases and clinical conditions associated with HRD1. KIAA0293 (Accession XM_027045) is another VGAM1115 host target gene. KIAA0293 BINDING SITE is HOST TARGET binding site found in the 3' untranslated region of mRNA encoded by KIAA0293, corresponding to a HOST TARGET binding site such as BINDING SITE I, BINDING SITE II or BINDING SITE III. Table 2 illustrates the complementarity of the nucleotide sequences of KIAA0293 BINDING SITE, designated SEQ ID:30394, to the nucleotide sequence of VGAM1115 RNA, herein designated VGAM RNA, also designated SEQ ID:3826.

Another function of VGAM1115 is therefore inhibition of KIAA0293 (Accession XM_027045). Accordingly, utilities of VGAM1115 include diagnosis, prevention and treatment of diseases and clinical conditions associated with KIAA0293. KIAA0712 (Accession NM_014715) is another VGAM1115 host target gene. KIAA0712 BINDING SITE is HOST TARGET binding site found in the 5' untranslated region of mRNA encoded by KIAA0712, corresponding to a HOST TARGET binding site such as BINDING SITE I, BINDING SITE II or BINDING SITE III. Table 2 illustrates the complementarity of the nucleotide sequences of KIAA0712 BINDING SITE, designated SEQ ID:16266, to the nucleotide sequence of VGAM1115 RNA, herein designated VGAM RNA, also designated SEQ ID:3826.

Another function of VGAM1115 is therefore inhibition of KIAA0712 (Accession NM_014715). Accordingly, utilities of VGAM1115 include diagnosis, prevention and treatment of diseases and clinical conditions associated with KIAA0712. KIAA0889 (Accession NM_015377) is another VGAM1115 host target gene. KIAA0889 BINDING SITE is HOST TARGET binding site found in the 3' untranslated region of mRNA encoded by KIAA0889, corresponding to a HOST TARGET binding site such as BINDING SITE I, BINDING SITE II or BINDING SITE III. Table 2 illustrates the complementarity of the nucleotide sequences of KIAA0889 BINDING SITE, designated SEQ ID:17675, to the nucleotide sequence of VGAM1115 RNA, herein designated VGAM RNA, also designated SEQ ID:3826.

Another function of VGAM1115 is therefore inhibition of KIAA0889 (Accession NM_015377). Accordingly, utilities of VGAM1115 include diagnosis, prevention and treatment of diseases and clinical conditions associated with KIAA0889. KIAA1853 (Accession XM_045184) is another VGAM1115 host target gene. KIAA1853 BINDING SITE is HOST TARGET binding site found in the 3' untranslated region of mRNA encoded by KIAA1853, corresponding to a HOST TARGET binding site such as BINDING SITE I, BINDING SITE II or BINDING SITE III. Table 2 illustrates the complementarity of the nucleotide sequences of KIAA1853 BINDING SITE, designated SEQ ID:34384, to the nucleotide sequence of VGAM1115 RNA, herein designated VGAM RNA, also designated SEQ ID:3826.

Another function of VGAM1115 is therefore inhibition of KIAA1853 (Accession XM_045184). Accordingly, utilities of VGAM1115 include diagnosis, prevention and treatment of diseases and clinical conditions associated with KIAA1853. MGC1842 (Accession XM_037797) is another VGAM1115 host target gene. MGC1842 BINDING SITE is HOST TARGET binding site found in the 5' untranslated region of mRNA encoded by MGC1842, corresponding to a HOST TARGET binding site such as BINDING SITE I, BINDING SITE II or BINDING SITE III. Table 2 illustrates the complementarity of the nucleotide sequences of MGC1842 BINDING SITE, designated SEQ ID:32686, to the nucleotide sequence of VGAM1115 RNA, herein designated VGAM RNA, also designated SEQ ID:3826.

Another function of VGAM1115 is therefore inhibition of MGC1842 (Accession XM_037797). Accordingly, utilities of VGAM1115 include diagnosis, prevention and treatment of diseases and clinical conditions associated with MGC1842. MGC20460 (Accession NM_053043) is another VGAM1115 host target gene. MGC20460 BINDING SITE is HOST TARGET binding site found in the 5' untranslated region of mRNA encoded by MGC20460, corresponding to a HOST TARGET binding site such as BINDING SITE I, BINDING SITE II or BINDING SITE III. Table 2 illustrates the complementarity of the nucleotide sequences of MGC20460 BINDING SITE, designated SEQ ID:27588, to the nucleotide sequence of VGAM1115 RNA, herein designated VGAM RNA, also designated SEQ ID:3826.

Another function of VGAM1115 is therefore inhibition of MGC20460 (Accession NM_053043). Accordingly, utilities of VGAM1115 include diagnosis, prevention and treatment of diseases and clinical conditions associated with MGC20460. MIDORI (Accession XM_057651) is another VGAM1115 host target gene. MIDORI BINDING SITE is HOST TARGET binding site found in the 3' untranslated region of mRNA encoded by MIDORI, corresponding to a HOST TARGET binding site such as BINDING SITE I, BINDING SITE II or BINDING SITE III. Table 2 illustrates the complementarity of the nucleotide sequences of MIDORI BINDING SITE, designated SEQ ID:36527, to the nucleotide sequence of VGAM1115 RNA, herein designated VGAM RNA, also designated SEQ ID:3826.

Another function of VGAM1115 is therefore inhibition of MIDORI (Accession XM_057651). Accordingly, utilities of VGAM1115 include diagnosis, prevention and treatment of diseases and clinical conditions associated with MIDORI. PRO2533 (Accession NM_018629) is another VGAM1115 host target gene. PRO2533 BINDING SITE is HOST TARGET binding site found in the 3' untranslated region of mRNA encoded by PRO2533, corresponding to a HOST TARGET binding site such as BINDING SITE I, BINDING SITE II or BINDING SITE III. Table 2 illustrates the complementarity of the nucleotide sequences of PRO2533 BINDING SITE, designated SEQ ID:20701, to the nucleotide sequence of VGAM1115 RNA, herein designated VGAM RNA, also designated SEQ ID:3826.

Another function of VGAM1115 is therefore inhibition of PRO2533 (Accession NM_018629). Accordingly, utilities of VGAM1115 include diagnosis, prevention and treatment of diseases and clinical conditions associated with PRO2533. Zinc Finger Protein 384 (ZNF384, Accession NM_133476) is another VGAM1115 host target gene. ZNF384 BINDING SITE is HOST TARGET binding site found in the 3' untranslated region of mRNA encoded by ZNF384, corresponding to a HOST TARGET binding site such as BINDING SITE I, BINDING SITE II or BINDING SITE III. Table 2 illustrates the complementarity of the nucleotide sequences of ZNF384 BINDING SITE, designated SEQ ID:28546, to the nucleotide sequence of VGAM1115 RNA, herein designated VGAM RNA, also designated SEQ ID:3826.

Another function of VGAM1115 is therefore inhibition of Zinc Finger Protein 384 (ZNF384, Accession NM_133476). Accordingly, utilities of VGAM1115 include diagnosis, prevention and treatment of diseases and clinical conditions associated with ZNF384. LOC147976 (Accession XM_085980) is another VGAM1115 host target gene. LOC147976 BINDING SITE is HOST TARGET binding site found in the 5' untranslated region of mRNA encoded by LOC147976, corresponding to a HOST TARGET binding site such as BINDING SITE I, BINDING SITE II or BINDING SITE III. Table 2 illustrates the complementarity of the nucleotide sequences of LOC147976 BINDING SITE, designated SEQ ID:38428, to the nucleotide sequence of VGAM1115 RNA, herein designated VGAM RNA, also designated SEQ ID:3826.

Another function of VGAM1115 is therefore inhibition of LOC147976 (Accession XM_085980). Accordingly, utilities of VGAM1115 include diagnosis, prevention and treatment of diseases and clinical conditions associated with LOC147976. LOC153565 (Accession XM_087713) is another VGAM1115 host target gene. LOC153565 BINDING SITE is HOST TARGET binding site found in the 5' untranslated region of mRNA encoded by LOC153565, corresponding to a HOST TARGET binding site such as BINDING SITE I, BINDING SITE II or BINDING SITE III. Table 2 illustrates the complementarity of the nucleotide sequences of LOC153565 BINDING SITE, designated SEQ ID:39402, to the nucleotide sequence of VGAM1115 RNA, herein designated VGAM RNA, also designated SEQ ID:3826.

Another function of VGAM1115 is therefore inhibition of LOC153565 (Accession XM_087713). Accordingly, utilities of VGAM1115 include diagnosis, prevention and treatment of diseases and clinical conditions associated with LOC153565. LOC202908 (Accession XM_114602) is another VGAM1115 host target gene. LOC202908 BINDING SITE is HOST TARGET binding site found in the 5' untranslated region of mRNA encoded by LOC202908, corresponding to a HOST TARGET binding site such as BINDING SITE I, BINDING SITE II or BINDING SITE III. Table 2 illustrates the complementarity of the nucleotide sequences of LOC202908 BINDING SITE, designated SEQ ID:42995, to the nucleotide sequence of VGAM1115 RNA, herein designated VGAM RNA, also designated SEQ ID:3826.

Another function of VGAM1115 is therefore inhibition of LOC202908 (Accession XM_114602). Accordingly, utilities of VGAM1115 include diagnosis, prevention and treatment of diseases and clinical conditions associated with LOC202908. LOC222057 (Accession XM_166594) is another VGAM1115 host target gene. LOC222057 BINDING SITE is HOST TARGET binding site found in the 5' untranslated region of mRNA encoded by LOC222057, corresponding to a HOST TARGET binding site such as BINDING SITE I, BINDING SITE II or BINDING SITE III. Table 2 illustrates the complementarity of the nucleotide sequences of LOC222057 BINDING SITE, designated SEQ ID:44571, to the nucleotide sequence of VGAM1115 RNA, herein designated VGAM RNA, also designated SEQ ID:3826.

Another function of VGAM1115 is therefore inhibition of LOC222057 (Accession XM_166594). Accordingly, utilities of VGAM1115 include diagnosis, prevention and treatment of diseases and clinical conditions associated with LOC222057. LOC255975 (Accession XM_171083) is another VGAM1115 host target gene. LOC255975 BINDING SITE is HOST TARGET binding site found in the 5' untranslated region of mRNA encoded by LOC255975, corresponding to a HOST TARGET binding site such as BINDING SITE I, BINDING SITE II or BINDING SITE III. Table 2 illustrates the complementarity of the nucleotide sequences of LOC255975 BINDING SITE, designated SEQ ID:45888, to the nucleotide sequence of VGAM1115 RNA, herein designated VGAM RNA, also designated SEQ ID:3826.

Another function of VGAM1115 is therefore inhibition of LOC255975 (Accession XM_171083). Accordingly, utilities of VGAM1115 include diagnosis, prevention and treatment of diseases and clinical conditions associated with LOC255975. LOC256878 (Accession XM_173042) is another VGAM1115 host target gene. LOC256878 BINDING SITE is HOST TARGET binding site found in the 5' untranslated region of mRNA encoded by LOC256878, corresponding to a HOST TARGET binding site such as BINDING SITE I, BINDING SITE II or BINDING SITE III. Table 2 illustrates the complementarity of the nucleotide sequences of LOC256878 BINDING SITE, designated SEQ ID:46306, to the nucleotide sequence of VGAM1115 RNA, herein designated VGAM RNA, also designated SEQ ID:3826.

Another function of VGAM1115 is therefore inhibition of LOC256878 (Accession XM_173042). Accordingly, utilities of VGAM1115 include diagnosis, prevention and treatment of diseases and clinical conditions associated with LOC256878. FIG. 1 further provides a conceptual description of a novel bioinformatically detected viral gene of the present invention, referred to here as Viral Genomic Address Messenger 1116 (VGAM1116) viral gene, which modulates expression of respective host target genes thereof, the function and utility of which host target genes is known in the art.

VGAM1116 is a novel bioinformatically detected regulatory, non protein coding, viral micro RNA (miRNA) gene. The method by which VGAM1116 was detected is described hereinabove with reference to FIGS. 1-8.

VGAM1116 gene, herein designated VGAM GENE, is a viral gene contained in the genome of Monkeypox Virus. VGAM1116 host target gene, herein designated VGAM HOST TARGET GENE, is a human gene contained in the human genome.

VGAM1116 gene encodes a VGAM1116 precursor RNA, herein designated VGAM PRECURSOR RNA. Similar to other miRNA genes, and unlike most ordinary genes, VGAM1116 precursor RNA does not encode a protein. A nucleotide sequence identical or highly similar to the nucleotide sequence of VGAM1116 precursor RNA is designated SEQ ID:1102, and is provided hereinbelow with reference to the sequence listing part. Nucleotide sequence SEQ ID:1102 is located at position 49513 relative to the genome of Monkeypox Virus.

VGAM1116 precursor RNA folds onto itself, forming VGAM1116 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1116 folded precursor RNA into VGAM1116 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM1116 RNA is designated SEQ ID:3827, and is provided hereinbelow with reference to the sequence listing part.

VGAM1116 host target gene, herein designated VGAM HOST TARGET GENE, encodes a corresponding messenger RNA, VGAM1116 host target RNA, herein designated VGAM HOST TARGET RNA. VGAM1116 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1116 RNA, herein designated VGAM RNA, binds complementarily to one or more host target binding sites located in untranslated regions of VGAM1116 host target RNA, herein designated VGAM HOST TARGET RNA. This complementary binding is due to the fact that the nucleotide sequence of VGAM1116 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1116 RNA, herein designated VGAM RNA, may have a different number of host target binding sites in untranslated regions of a VGAM1116 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1116 RNA, herein designated VGAM RNA, to host target binding sites on VGAM1116 host target RNA, herein designated VGAM HOST TARGET RNA, such as BINDING SITE I, BINDING SITE II and BINDING SITE III, inhibits translation of VGAM1116 host target RNA into VGAM1116 host target protein, herein designated VGAM HOST TARGET PROTEIN. VGAM host target protein is therefore outlined by a broken line.

It is appreciated that VGAM1116 host target gene, herein designated VGAM HOST TARGET GENE, in fact represents a plurality of VGAM1116 host target genes. The mRNA of each one of this plurality of VGAM1116 host target genes comprises one or more host target binding sites, each having a nucleotide sequence which is at least partly complementary to VGAM1116 RNA, herein designated VGAM RNA, and which when bound by VGAM1116 RNA causes inhibition of translation of respective one or more VGAM1116 host target proteins.

It is further appreciated by one skilled in the art that the mode of translational inhibition illustrated by FIG. 1 with specific reference to translational inhibition exerted by VGAM1116 gene, herein designated VGAM GENE, on one or more VGAM1116 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1116 is inhibition of expression of host target genes, as part of a novel viral mechanism of attacking a host. Accordingly, utilities of VGAM1116 include diagnosis, prevention and treatment of viral infection by Monkeypox Virus. Specific functions, and accordingly utilities, of VGAM1116 correlate with, and may be deduced from, the identity of the host target genes which VGAM1116 binds and inhibits, and the function of these host target genes, as elaborated hereinbelow.

Nucleotide sequences of the VGAM1116 precursor RNA, herein designated VGAM PRECURSOR RNA, and of the 'diced' VGAM1116 RNA, herein designated VGAM RNA, and a schematic representation of the secondary folding of VGAM1116 folded precursor RNA, herein designated VGAM FOLDED PRECURSOR RNA, of VGAM1116 are further described hereinbelow with reference to Table 1.

Nucleotide sequences of host target binding sites, such as BINDING SITE-I, BINDING SITE-II and BINDING SITE-III of FIG. 1, found on VGAM1116 host target RNA, and schematic representation of the complementarity of each of these host target binding sites to VGAM1116 RNA, herein designated VGAM RNA, are described hereinbelow with reference to Table 2.

As mentioned hereinabove with reference to FIG. 1, a function of VGAM1116 gene, herein designated VGAM is inhibition of expression of VGAM1116 target genes. It is appreciated that specific functions, and accordingly utilities, of VGAM1116 correlate with, and may be deduced from, the identity of the target genes which VGAM1116 binds and inhibits, and the function of these target genes, as elaborated hereinbelow.

HBP1 (Accession NM_012257) is a VGAM1116 host target gene. HBP1 BINDING SITE is HOST TARGET binding site found in the 3' untranslated region of mRNA encoded by HBP1, corresponding to a HOST TARGET binding site such as BINDING SITE I, BINDING SITE II or BINDING SITE III. Table 2 illustrates the complementarity of the nucleotide sequences of HBP1 BINDING SITE, designated SEQ ID:14564, to the nucleotide sequence of VGAM1116 RNA, herein designated VGAM RNA, also designated SEQ ID:3827.

A function of VGAM1116 is therefore inhibition of HBP1 (Accession NM_012257). Accordingly, utilities of VGAM1116 include diagnosis, prevention and treatment of diseases and clinical conditions associated with HBP1. PSR (Accession XM_036784) is another VGAM1116 host target gene. PSR BINDING SITE is HOST TARGET binding site found in the 3' untranslated region of mRNA encoded by PSR, corresponding to a HOST TARGET binding site such as BINDING SITE I, BINDING SITE II or BINDING SITE III. Table 2 illustrates the complementarity of the nucleotide sequences of PSR BINDING SITE, designated SEQ ID:32500, to the nucleotide sequence of VGAM1116 RNA, herein designated VGAM RNA, also designated SEQ ID:3827.

Another function of VGAM1116 is therefore inhibition of PSR (Accession XM_036784). Accordingly, utilities of VGAM1116 include diagnosis, prevention and treatment of diseases and clinical conditions associated with PSR. FIG. 1 further provides a conceptual description of a novel bioinformatically detected viral gene of the present invention, referred to here as Viral Genomic Address Messenger 1117 (VGAM1117) viral gene, which modulates expression of respective host target genes thereof, the function and utility of which host target genes is known in the art.

VGAM1117 is a novel bioinformatically detected regulatory, non protein coding, viral micro RNA (miRNA) gene. The method by which VGAM1117 was detected is described hereinabove with reference to FIGS. 1-8.

VGAM1117 gene, herein designated VGAM GENE, is a viral gene contained in the genome of Monkeypox Virus. VGAM1117 host target gene, herein designated VGAM HOST TARGET GENE, is a human gene contained in the human genome.

VGAM1117 gene encodes a VGAM1117 precursor RNA, herein designated VGAM PRECURSOR RNA. Similar to other miRNA genes, and unlike most ordinary genes, VGAM1117 precursor RNA does not encode a protein. A nucleotide sequence identical or highly similar to the nucleotide sequence of VGAM1117 precursor RNA is designated SEQ ID:1103, and is provided hereinbelow with reference to the sequence listing part. Nucleotide sequence SEQ ID:1103 is located at position 45352 relative to the genome of Monkeypox Virus.

VGAM1117 precursor RNA folds onto itself, forming VGAM1117 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1117 folded precursor RNA into VGAM1117 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM1117 RNA is designated SEQ ID:3828, and is provided hereinbelow with reference to the sequence listing part.

VGAM1117 host target gene, herein designated VGAM HOST TARGET GENE, encodes a corresponding messenger RNA, VGAM1117 host target RNA, herein designated VGAM HOST TARGET RNA. VGAM1117 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1117 RNA, herein designated VGAM RNA, binds complementarily to one or more host target binding sites located in untranslated regions of VGAM1117 host target RNA, herein designated VGAM HOST TARGET RNA. This complementary binding is due to the fact that the nucleotide sequence of VGAM1117 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1117 RNA, herein designated VGAM RNA, may have a different number of host target binding sites in untranslated regions of a VGAM1117 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1117 RNA, herein designated VGAM RNA, to host target binding sites on VGAM1117 host target RNA, herein designated VGAM HOST TARGET RNA, such as BINDING SITE I, BINDING SITE II and BINDING SITE III, inhibits translation of VGAM1117 host target RNA into VGAM1117 host target protein, herein designated VGAM HOST TARGET PROTEIN. VGAM host target protein is therefore outlined by a broken line.

It is appreciated that VGAM1117 host target gene, herein designated VGAM HOST TARGET GENE, in fact represents a plurality of VGAM1117 host target genes. The mRNA of each one of this plurality of VGAM1117 host target genes comprises one or more host target binding sites, each having a nucleotide sequence which is at least partly complementary to VGAM1117 RNA, herein designated VGAM RNA, and which when bound by VGAM1117 RNA causes inhibition of translation of respective one or more VGAM1117 host target proteins.

It is further appreciated by one skilled in the art that the mode of translational inhibition illustrated by FIG. 1 with specific reference to translational inhibition exerted by VGAM1117 gene, herein designated VGAM GENE, on one or more VGAM1117 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1117 is inhibition of expression of host target genes, as part of a novel viral mechanism of attacking a host. Accordingly, utilities of VGAM1117 include diagnosis, prevention and treatment of viral infection by Monkeypox Virus. Specific functions, and accordingly utilities, of VGAM1117 correlate with, and may be deduced from, the identity of the host target genes which VGAM1117 binds and inhibits, and the function of these host target genes, as elaborated hereinbelow.

Nucleotide sequences of the VGAM1117 precursor RNA, herein designated VGAM PRECURSOR RNA, and of the 'diced' VGAM1117 RNA, herein designated VGAM RNA, and a schematic representation of the secondary folding of VGAM1117 folded precursor RNA, herein designated VGAM FOLDED PRECURSOR RNA, of VGAM1117 are further described hereinbelow with reference to Table 1.

Nucleotide sequences of host target binding sites, such as BINDING SITE-I, BINDING SITE-II and BINDING SITE-III of FIG. 1, found on VGAM1117 host target RNA, and schematic representation of the complementarity of each of these host target binding sites to VGAM1117 RNA, herein designated VGAM RNA, are described hereinbelow with reference to Table 2.

As mentioned hereinabove with reference to FIG. 1, a function of VGAM1117 gene, herein designated VGAM is inhibition of expression of VGAM1117 target genes. It is appreciated that specific functions, and accordingly utilities, of VGAM1117 correlate with, and may be deduced from, the identity of the target genes which VGAM1117 binds and inhibits, and the function of these target genes, as elaborated hereinbelow.

KIAA1841 (Accession XM_087056) is a VGAM1117 host target gene. KIAA1841 BINDING SITE is HOST TARGET binding site found in the 3' untranslated region of mRNA encoded by KIAA1841, corresponding to a HOST TARGET binding site such as BINDING SITE I, BINDING SITE II or BINDING SITE III. Table 2 illustrates the complementarity of the nucleotide sequences of KIAA1841 BINDING SITE, designated SEQ ID:39025, to the nucleotide sequence of VGAM1117 RNA, herein designated VGAM RNA, also designated SEQ ID:3828.

A function of VGAM1117 is therefore inhibition of KIAA1841 (Accession XM_087056). Accordingly, utilities of VGAM1117 include diagnosis, prevention and treatment of diseases and clinical conditions associated with KIAA1841. LOC150468 (Accession XM_086926) is another VGAM1117 host target gene. LOC150468 BINDING SITE is HOST TARGET binding site found in the 5' untranslated region of mRNA encoded by LOC150468, corresponding to a HOST TARGET binding site such as BINDING SITE I, BINDING SITE II or BINDING SITE III. Table 2 illustrates the complementarity of the nucleotide sequences of LOC150468 BINDING SITE, designated SEQ ID:38974, to the nucleotide sequence of VGAM1117 RNA, herein designated VGAM RNA, also designated SEQ ID:3828.

Another function of VGAM1117 is therefore inhibition of LOC150468 (Accession XM_086926). Accordingly, utilities of VGAM1117 include diagnosis, prevention and treatment of diseases and clinical conditions associated with LOC150468. LOC54557 (Accession XM_052961) is another VGAM1117 host target gene. LOC54557 BINDING SITE is HOST TARGET binding site found in the 3' untranslated region of mRNA encoded by LOC54557, corresponding to a HOST TARGET binding site such as BINDING SITE I, BINDING SITE II or BINDING SITE III. Table 2 illustrates the complementarity of the nucleotide sequences of LOC54557 BINDING SITE, designated SEQ ID:36054, to the nucleotide sequence of VGAM1117 RNA, herein designated VGAM RNA, also designated SEQ ID:3828.

Another function of VGAM1117 is therefore inhibition of LOC54557 (Accession XM_052961). Accordingly, utilities of VGAM1117 include diagnosis, prevention and treatment of diseases and clinical conditions associated with LOC54557. FIG. 1 further provides a conceptual description of a novel bioinformatically detected viral gene of the present invention, referred to here as Viral Genomic Address Messenger 1118 (VGAM1118) viral gene, which modulates expression of respective host target genes thereof, the function and utility of which host target genes is known in the art.

VGAM1118 is a novel bioinformatically detected regulatory, non protein coding, viral micro RNA (miRNA) gene. The method by which VGAM1118 was detected is described hereinabove with reference to FIGS. 1-8.

VGAM1118 gene, herein designated VGAM GENE, is a viral gene contained in the genome of Monkeypox Virus. VGAM1118 host target gene, herein designated VGAM HOST TARGET GENE, is a human gene contained in the human genome.

VGAM1118 gene encodes a VGAM1118 precursor RNA, herein designated VGAM PRECURSOR RNA. Similar to other miRNA genes, and unlike most ordinary genes, VGAM1118 precursor RNA does not encode a protein. A nucleotide sequence identical or highly similar to the nucleotide sequence of VGAM1118 precursor RNA is designated SEQ ID:1104, and is provided hereinbelow with reference to the sequence listing part. Nucleotide sequence SEQ ID:1104 is located at position 45554 relative to the genome of Monkeypox Virus.

VGAM1118 precursor RNA folds onto itself, forming VGAM1118 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1118 folded precursor RNA into VGAM1118 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1118 RNA is designated SEQ ID:3829, and is provided hereinbelow with reference to the sequence listing part.

VGAM1118 host target gene, herein designated VGAM HOST TARGET GENE, encodes a corresponding messenger RNA, VGAM1118 host target RNA, herein designated VGAM HOST TARGET RNA. VGAM1118 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1118 RNA, herein designated VGAM RNA, binds complementarily to one or more host target binding sites located in untranslated regions of VGAM1118 host target RNA, herein designated VGAM HOST TARGET RNA. This complementary binding is due to the fact that the nucleotide sequence of VGAM1118 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1118 RNA, herein designated VGAM RNA, may have a different number of host target binding sites in untranslated regions of a VGAM1118 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1118 RNA, herein designated VGAM RNA, to host target binding sites on VGAM1118 host target RNA, herein designated VGAM HOST TARGET RNA, such as BINDING SITE I, BINDING SITE II and BINDING SITE III, inhibits translation of VGAM1118 host target RNA into VGAM1118 host target protein, herein designated VGAM HOST TARGET PROTEIN. VGAM host target protein is therefore outlined by a broken line.

It is appreciated that VGAM1118 host target gene, herein designated VGAM HOST TARGET GENE, in fact represents a plurality of VGAM1118 host target genes. The mRNA of each one of this plurality of VGAM1118 host target genes comprises one or more host target binding sites, each having a nucleotide sequence which is at least partly complementary to VGAM1118 RNA, herein designated VGAM RNA, and which when bound by VGAM1118 RNA causes inhibition of translation of respective one or more VGAM1118 host target proteins.

It is further appreciated by one skilled in the art that the mode of translational inhibition illustrated by FIG. 1 with specific reference to translational inhibition exerted by VGAM1118 gene, herein designated VGAM GENE, on one or more VGAM1118 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1118 is inhibition of expression of host target genes, as part of a novel viral mechanism of attacking a host. Accordingly, utilities of VGAM1118 include diagnosis, prevention and treatment of viral infection by Monkeypox Virus. Specific functions, and accordingly utilities, of VGAM1118 correlate with, and may be deduced from, the identity of the host target genes which VGAM1118 binds and inhibits, and the function of these host target genes, as elaborated hereinbelow.

Nucleotide sequences of the VGAM1118 precursor RNA, herein designated VGAM PRECURSOR RNA, and of the 'diced' VGAM1118 RNA, herein designated VGAM RNA, and a schematic representation of the secondary folding of VGAM1118 folded precursor RNA, herein designated VGAM FOLDED PRECURSOR RNA, of VGAM1118 are further described hereinbelow with reference to Table 1.

Nucleotide sequences of host target binding sites, such as BINDING SITE-I, BINDING SITE-II and BINDING SITE-III of FIG. 1, found on VGAM1118 host target RNA, and schematic representation of the complementarity of each of these host target binding sites to VGAM1118 RNA, herein designated VGAM RNA, are described hereinbelow with reference to Table 2.

As mentioned hereinabove with reference to FIG. 1, a function of VGAM1118 gene, herein designated VGAM is inhibition of expression of VGAM1118 target genes. It is appreciated that specific functions, and accordingly utilities, of VGAM1118 correlate with, and may be deduced from, the identity of the target genes which VGAM1118 binds and inhibits, and the function of these target genes, as elaborated hereinbelow.

Sulfotransferase Family, Cytosolic, 1C, Member 1 (SULT1C1, Accession NM_001056) is a VGAM1118 host target gene. SULT1C1 BINDING SITE is HOST TARGET binding site found in the 3' untranslated region of mRNA encoded by SULT1C1, corresponding to a HOST TARGET binding site such as BINDING SITE I, BINDING SITE II or BINDING SITE III. Table 2 illustrates the complementarity of the nucleotide sequences of SULT1C1 BINDING SITE, designated SEQ ID:6718, to the nucleotide sequence of VGAM1118 RNA, herein designated VGAM RNA, also designated SEQ ID:3829.

A function of VGAM1118 is therefore inhibition of Sulfotransferase Family, Cytosolic, 1C, Member 1 (SULT1C1, Accession NM_001056). Accordingly, utilities of VGAM1118 include diagnosis, prevention and treatment of diseases and clinical conditions associated with SULT1C1. Chromosome X Open Reading Frame 1 (CXorf1, Accession NM_004709) is another VGAM1118 host target gene. CXorf1 BINDING SITE is HOST TARGET binding site found in the 3' untranslated region of mRNA encoded by CXorf1, corresponding to a HOST TARGET binding site such as BINDING SITE I, BINDING SITE II or BINDING SITE III. Table 2 illustrates the complementarity of the nucleotide sequences of CXorf1 BINDING SITE, designated SEQ ID:11052, to the nucleotide sequence of VGAM1118 RNA, herein designated VGAM RNA, also designated SEQ ID:3829.

Another function of VGAM1118 is therefore inhibition of Chromosome X Open Reading Frame 1 (CXorf1, Accession NM_004709). Accordingly, utilities of VGAM1118 include diagnosis, prevention and treatment of diseases and clinical conditions associated with CXorf1. KIAA1211 (Accession XM_044178) is another VGAM1118 host target gene. KIAA1211 BINDING SITE is HOST TARGET binding site found in the 3' untranslated region of mRNA encoded by KIAA1211, corresponding to a HOST TARGET binding site such as BINDING SITE I, BINDING SITE II or BINDING SITE III. Table 2 illustrates the complementarity of the nucleotide sequences of KIAA1211 BINDING SITE, designated SEQ ID:34164, to the nucleotide sequence of VGAM1118 RNA, herein designated VGAM RNA, also designated SEQ ID:3829.

Another function of VGAM1118 is therefore inhibition of KIAA1211 (Accession XM_044178). Accordingly, utilities of VGAM1118 include diagnosis, prevention and treatment of diseases and clinical conditions associated with KIAA1211. SH3 Domain Binding Glutamic Acid-rich Protein Like (SH3BGRL, Accession XM_030373) is another VGAM1118 host target gene. SH3BGRL BINDING SITE is HOST TARGET binding site found in the 3' untranslated region of mRNA encoded by SH3BGRL, corresponding to a HOST TARGET binding site such as BINDING SITE I, BINDING SITE II or BINDING SITE III. Table 2 illustrates the complementarity of the nucleotide sequences of SH3BGRL BINDING SITE, designated SEQ ID:31022, to the nucleotide sequence of VGAM1118 RNA, herein designated VGAM RNA, also designated SEQ ID:3829.

Another function of VGAM1118 is therefore inhibition of SH3 Domain Binding Glutamic Acid-rich Protein Like (SH3BGRL, Accession XM_030373). Accordingly, utilities of VGAM1118 include diagnosis, prevention and treatment of diseases and clinical conditions associated with SH3BGRL. LOC221143 (Accession XM_167986) is another VGAM1118 host target gene. LOC221143 BINDING SITE is HOST TARGET binding site found in the 3' untranslated region of mRNA encoded by LOC221143, corresponding to a HOST TARGET binding site such as BINDING SITE I, BINDING SITE II or BINDING SITE III. Table 2 illustrates the complementarity of the nucleotide sequences of LOC221143 BINDING SITE, designated SEQ ID:44940, to the nucleotide sequence of VGAM1118 RNA, herein designated VGAM RNA, also designated SEQ ID:3829.

Another function of VGAM1118 is therefore inhibition of LOC221143 (Accession XM_167986). Accordingly, utilities of VGAM1118 include diagnosis, prevention and treatment of diseases and clinical conditions associated with LOC221143. FIG. 1 further provides a conceptual description of a novel bioinformatically detected viral gene of the present invention, referred to here as Viral Genomic Address Messenger 1119 (VGAM1119) viral gene, which modulates expression of respective host target genes thereof, the function and utility of which host target genes is known in the art.

VGAM1119 is a novel bioinformatically detected regulatory, non protein coding, viral micro RNA (miRNA) gene. The method by which VGAM1119 was detected is described hereinabove with reference to FIGS. 1-8.

VGAM1119 gene, herein designated VGAM GENE, is a viral gene contained in the genome of Camelpox Virus. VGAM1119 host target gene, herein designated VGAM HOST TARGET GENE, is a human gene contained in the human genome.

VGAM1119 gene encodes a VGAM1119 precursor RNA, herein designated VGAM PRECURSOR RNA. Similar to other miRNA genes, and unlike most ordinary genes, VGAM1119 precursor RNA does not encode a protein. A nucleotide sequence identical or highly similar to the nucleotide sequence of VGAM1119 precursor RNA is designated SEQ ID:1105, and is provided hereinbelow with reference to the sequence listing part. Nucleotide sequence SEQ ID:1105 is located at position 49470 relative to the genome of Camelpox Virus.

VGAM1119 precursor RNA folds onto itself, forming VGAM1119 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1119 folded precursor RNA into VGAM1119 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1119 RNA is designated SEQ ID:3830, and is provided hereinbelow with reference to the sequence listing part.

VGAM1119 host target gene, herein designated VGAM HOST TARGET GENE, encodes a corresponding messenger RNA, VGAM1119 host target RNA, herein designated VGAM HOST TARGET RNA. VGAM1119 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1119 RNA, herein designated VGAM RNA, binds complementarily to one or more host target binding sites located in untranslated regions of VGAM1119 host target RNA, herein designated VGAM HOST TARGET RNA. This complementary binding is due to the fact that the nucleotide sequence of VGAM1119 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1119 RNA, herein designated VGAM RNA, may have a different number of host target binding sites in untranslated regions of a VGAM1119 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1119 RNA, herein designated VGAM RNA, to host target binding sites on VGAM1119 host target RNA, herein designated VGAM HOST TARGET RNA, such as BINDING SITE I, BINDING SITE II and BINDING SITE III, inhibits translation of VGAM1119 host target RNA into VGAM1119 host target protein, herein designated VGAM HOST TARGET PROTEIN. VGAM host target protein is therefore outlined by a broken line.

It is appreciated that VGAM1119 host target gene, herein designated VGAM HOST TARGET GENE, in fact represents a plurality of VGAM1119 host target genes. The mRNA of each one of this plurality of VGAM1119 host target genes comprises one or more host target binding sites, each having a nucleotide sequence which is at least partly complementary to VGAM1119 RNA, herein designated VGAM RNA, and which when bound by VGAM1119 RNA causes inhibition of translation of respective one or more VGAM1119 host target proteins.

It is further appreciated by one skilled in the art that the mode of translational inhibition illustrated by FIG. 1 with specific reference to translational inhibition exerted by VGAM1119 gene, herein designated VGAM GENE, on one or more VGAM1119 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1119 is inhibition of expression of host target genes, as part of a novel viral mechanism of attacking a host. Accordingly, utilities of VGAM1119 include diagnosis, prevention and treatment of viral infection by Camelpox Virus. Specific functions, and accordingly utilities, of VGAM1119 correlate with, and may be deduced from, the identity of the host target genes which VGAM1119 binds and inhibits, and the function of these host target genes, as elaborated hereinbelow.

Nucleotide sequences of the VGAM1119 precursor RNA, herein designated VGAM PRECURSOR RNA, and of the 'diced' VGAM1119 RNA, herein designated VGAM RNA, and a schematic representation of the secondary folding of VGAM1119 folded precursor RNA, herein designated VGAM FOLDED PRECURSOR RNA, of VGAM1119 are further described hereinbelow with reference to Table 1.

Nucleotide sequences of host target binding sites, such as BINDING SITE-I, BINDING SITE-II and BINDING SITE-III of FIG. 1, found on VGAM1119 host target RNA, and schematic representation of the complementarity of each of these host target binding sites to VGAM1119 RNA, herein designated VGAM RNA, are described hereinbelow with reference to Table 2.

As mentioned hereinabove with reference to FIG. 1, a function of VGAM1119 gene, herein designated VGAM is inhibition of expression of VGAM1119 target genes. It is appreciated that specific functions, and accordingly utilities, of VGAM1119 correlate with, and may be deduced from, the identity of the target genes which VGAM1119 binds and inhibits, and the function of these target genes, as elaborated hereinbelow.

Collagen, Type VI, Alpha 1 (COL6A1, Accession NM_001848) is a VGAM1119 host target gene. COL6A1 BINDING SITE is HOST TARGET binding site found in the 3' untranslated region of mRNA encoded by COL6A1, corresponding to a HOST TARGET binding site such as BINDING SITE I, BINDING SITE II or BINDING SITE III. Table 2 illustrates the complementarity of the nucleotide sequences of COL6A1 BINDING SITE, designated SEQ ID:7583, to the nucleotide sequence of VGAM1119 RNA, herein designated VGAM RNA, also designated SEQ ID:3830.

A function of VGAM1119 is therefore inhibition of Collagen, Type VI, Alpha 1 (COL6A1, Accession NM_001848). Accordingly, utilities of VGAM1119 include diagnosis, prevention and treatment of diseases and clinical conditions associated with COL6A1. Interleukin 15 Receptor, Alpha (IL15RA, Accession NM_002189) is another VGAM1119 host target gene. IL15RA BINDING SITE is HOST TARGET binding site found in the 3' untranslated region of mRNA encoded by IL15RA, corresponding to a HOST TARGET binding site such as BINDING SITE I, BINDING SITE II or BINDING SITE III. Table 2 illustrates the complementarity of the nucleotide sequences of IL15RA BINDING SITE, designated SEQ ID:7945, to the nucleotide sequence of VGAM1119 RNA, herein designated VGAM RNA, also designated SEQ ID:3830.

Another function of VGAM1119 is therefore inhibition of Interleukin 15 Receptor, Alpha (IL15RA, Accession NM_002189), a gene which is essential for signal transduction. Accordingly, utilities of VGAM1119 include diagnosis, prevention and treatment of diseases and clinical conditions associated with IL15RA. The function of IL15RA and its association with various diseases and clinical conditions, has been established by previous studies, as described hereinabove with reference to VGAM1103. Calcium/calmodulin-dependent Protein Kinase Kinase 1, Alpha (CAMKK1, Accession NM_032294) is another VGAM1119 host target gene. CAMKK1 BINDING SITE is HOST TARGET binding site found in the 3' untranslated region of mRNA encoded by CAMKK1, corresponding to a HOST TARGET binding site such as BINDING SITE I, BINDING SITE II or BINDING SITE III. Table 2 illustrates the complementarity of the nucleotide sequences of CAMKK1 BINDING SITE, designated SEQ ID:26062, to the nucleotide sequence of VGAM1119 RNA, herein designated VGAM RNA, also designated SEQ ID:3830.

Another function of VGAM1119 is therefore inhibition of Calcium/calmodulin-dependent Protein Kinase Kinase 1, Alpha (CAMKK1, Accession NM_032294). Accordingly, utilities of VGAM1119 include diagnosis, prevention and treatment of diseases and clinical conditions associated with CAMKK1. KIAA1399 (Accession XM_046685) is another VGAM1119 host target gene. KIAA1399 BINDING SITE is HOST TARGET binding site found in the 3' untranslated region of mRNA encoded by KIAA1399, corresponding to a HOST TARGET binding site such as BINDING SITE I, BINDING SITE II or BINDING SITE III. Table 2 illustrates the complementarity of the nucleotide sequences of KIAA1399 BINDING SITE, designated SEQ ID:34795, to the nucleotide sequence of VGAM1119 RNA, herein designated VGAM RNA, also designated SEQ ID:3830.

Another function of VGAM1119 is therefore inhibition of KIAA1399 (Accession XM_046685). Accordingly, utilities of VGAM1119 include diagnosis, prevention and treatment of diseases and clinical conditions associated with KIAA1399. LOC153937 (Accession XM_087813) is another VGAM1119 host target gene. LOC153937 BINDING SITE is HOST TARGET binding site found in the 5' untranslated region of mRNA encoded by LOC153937, corresponding to a HOST TARGET binding site such as BINDING SITE I, BINDING SITE II or BINDING SITE III. Table 2 illustrates the complementarity of the nucleotide sequences of LOC153937 BINDING SITE, designated SEQ ID:39442, to the nucleotide sequence of VGAM1119 RNA, herein designated VGAM RNA, also designated SEQ ID:3830.

Another function of VGAM1119 is therefore inhibition of LOC153937 (Accession XM_087813). Accordingly, utilities of VGAM1119 include diagnosis, prevention and treatment of diseases and clinical conditions associated with LOC153937. LOC222234 (Accession XM_168558) is another VGAM1119 host target gene. LOC222234 BINDING SITE is HOST TARGET binding site found in the 5' untranslated region of mRNA encoded by LOC222234, corresponding to a HOST TARGET binding site such as BINDING SITE I, BINDING SITE II or BINDING SITE III. Table 2 illustrates the complementarity of the nucleotide sequences of LOC222234 BINDING SITE, designated SEQ ID:45238, to the nucleotide sequence of VGAM1119 RNA, herein designated VGAM RNA, also designated SEQ ID:3830.

Another function of VGAM1119 is therefore inhibition of LOC222234 (Accession XM_168558). Accordingly, utilities of VGAM1119 include diagnosis, prevention and treatment of diseases and clinical conditions associated with LOC222234. LOC255565 (Accession XM_170811) is another VGAM1119 host target gene. LOC255565 BINDING SITE is HOST TARGET binding site found in the 3' untranslated region of mRNA encoded by LOC255565, corresponding to a HOST TARGET binding site such as BINDING SITE I, BINDING SITE II or BINDING SITE III. Table 2 illustrates the complementarity of the nucleotide sequences of LOC255565 BINDING SITE, designated SEQ ID:45586, to the nucleotide sequence of VGAM1119 RNA, herein designated VGAM RNA, also designated SEQ ID:3830.

Another function of VGAM1119 is therefore inhibition of LOC255565 (Accession XM_170811). Accordingly, utilities of VGAM1119 include diagnosis, prevention and treatment of diseases and clinical conditions associated with LOC255565. FIG. 1 further provides a conceptual description of a novel bioinformatically detected viral gene of the present invention, referred to here as Viral Genomic Address Messenger 1120 (VGAM1120) viral gene, which modulates expression of respective host target genes thereof, the function and utility of which host target genes is known in the art.

VGAM1120 is a novel bioinformatically detected regulatory, non protein coding, viral micro RNA (miRNA) gene. The method by which VGAM1120 was detected is described hereinabove with reference to FIGS. 1-8.

VGAM1120 gene, herein designated VGAM GENE, is a viral gene contained in the genome of Monkeypox Virus. VGAM1120 host target gene, herein designated VGAM HOST TARGET GENE, is a human gene contained in the human genome.

VGAM1120 gene encodes a VGAM1120 precursor RNA, herein designated VGAM PRECURSOR RNA. Similar to other miRNA genes, and unlike most ordinary genes, VGAM1120 precursor RNA does not encode a protein. A nucleotide sequence identical or highly similar to the nucleotide sequence of VGAM1120 precursor RNA is designated SEQ ID:1106, and is provided hereinbelow with reference to the sequence listing part. Nucleotide sequence SEQ ID:1106 is located at position 44913 relative to the genome of Monkeypox Virus.

VGAM1120 precursor RNA folds onto itself, forming VGAM1120 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1120 folded precursor RNA into VGAM1120 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1120 RNA is designated SEQ ID:3831, and is provided hereinbelow with reference to the sequence listing part.

VGAM1120 host target gene, herein designated VGAM HOST TARGET GENE, encodes a corresponding messenger RNA, VGAM1120 host target RNA, herein designated VGAM HOST TARGET RNA. VGAM1120 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1120 RNA, herein designated VGAM RNA, binds complementarily to one or more host target binding sites located in untranslated regions of VGAM1120 host target RNA, herein designated VGAM HOST TARGET RNA. This complementary binding is due to the fact that the nucleotide sequence of VGAM1120 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1120 RNA, herein designated VGAM RNA, may have a different number of host target binding sites in untranslated regions of a VGAM1120 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1120 RNA, herein designated VGAM RNA, to host target binding sites on VGAM1120 host target RNA, herein designated VGAM HOST TARGET RNA, such as BINDING SITE I, BINDING SITE II and BINDING SITE III, inhibits translation of VGAM1120 host target RNA into VGAM1120 host target protein, herein designated VGAM HOST TARGET PROTEIN. VGAM host target protein is therefore outlined by a broken line.

It is appreciated that VGAM1120 host target gene, herein designated VGAM HOST TARGET GENE, in fact represents a plurality of VGAM1120 host target genes. The mRNA of each one of this plurality of VGAM1120 host target genes comprises one or more host target binding sites, each having a nucleotide sequence which is at least partly complementary to VGAM1120 RNA, herein designated VGAM RNA, and which when bound by VGAM1120 RNA causes inhibition of translation of respective one or more VGAM1120 host target proteins.

It is further appreciated by one skilled in the art that the mode of translational inhibition illustrated by FIG. 1 with specific reference to translational inhibition exerted by VGAM1120 gene, herein designated VGAM GENE, on one or more VGAM1120 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1120 is inhibition of expression of host target genes, as part of a novel viral mechanism of attacking a host. Accordingly, utilities of VGAM1120 include diagnosis, prevention and treatment of viral infection by Monkeypox Virus. Specific functions, and accordingly utilities, of VGAM1120 correlate with, and may be deduced from, the identity of the host target genes which VGAM1120 binds and inhibits, and the function of these host target genes, as elaborated hereinbelow.

Nucleotide sequences of the VGAM1120 precursor RNA, herein designated VGAM PRECURSOR RNA, and of the 'diced' VGAM1120 RNA, herein designated VGAM RNA, and a schematic representation of the secondary folding of VGAM1120 folded precursor RNA, herein designated VGAM FOLDED PRECURSOR RNA, of VGAM1120 are further described hereinbelow with reference to Table 1.

Nucleotide sequences of host target binding sites, such as BINDING SITE-I, BINDING SITE-II and BINDING SITE-III of FIG. 1, found on VGAM1120 host target RNA, and schematic representation of the complementarity of each of these host target binding sites to VGAM1120 RNA, herein designated VGAM RNA, are described hereinbelow with reference to Table 2.

As mentioned hereinabove with reference to FIG. 1, a function of VGAM1120 gene, herein designated VGAM is inhibition of expression of VGAM1120 target genes. It is appreciated that specific functions, and accordingly utilities, of VGAM1120 correlate with, and may be deduced from, the identity of the target genes which VGAM1120 binds and inhibits, and the function of these target genes, as elaborated hereinbelow.

Fibroblast Growth Factor 5 (FGF5, Accession NM_004464) is a VGAM1120 host target gene. FGF5 BINDING SITE1 and FGF5 BINDING SITE2 are HOST TARGET binding sites found in untranslated regions of mRNA encoded by FGF5, corresponding to HOST TARGET binding sites such as BINDING SITE I, BINDING SITE II or BINDING SITE III. Table 2 illustrates the complementarity of the nucleotide sequences of FGF5 BINDING SITE1 and FGF5 BINDING SITE2, designated SEQ ID:10769 and SEQ ID:26996 respectively, to the nucleotide sequence of VGAM1120 RNA, herein designated VGAM RNA, also designated SEQ ID:3831.

A function of VGAM1120 is therefore inhibition of Fibroblast Growth Factor 5 (FGF5, Accession NM_004464), a gene which induces transformation and may regulate neuronal differentiation. Accordingly, utilities of VGAM1120 include diagnosis, prevention and treatment of diseases and clinical conditions associated with FGF5. The function of FGF5 and its association with various diseases and clinical conditions, has been established by previous studies, as described hereinabove with reference to VGAM276. Platelet-derived Growth Factor Receptor, Alpha Polypeptide (PDGFRA, Accession NM_006206) is another VGAM1120 host target gene. PDGFRA BINDING SITE is HOST TARGET binding site found in the 3' untranslated region of mRNA encoded by PDGFRA, corresponding to a HOST TARGET binding site such as BINDING SITE I, BINDING SITE II or BINDING SITE III. Table 2 illustrates the complementarity of the nucleotide sequences of PDGFRA BINDING SITE, designated SEQ ID:12884, to the nucleotide sequence of VGAM1120 RNA, herein designated VGAM RNA, also designated SEQ ID:3831.

Another function of VGAM1120 is therefore inhibition of Platelet-derived Growth Factor Receptor, Alpha Polypeptide (PDGFRA, Accession NM_006206), a gene which this receptor binds platelet-derived growth factor and has a tyrosine-protein kinase activity. Accordingly, utilities of VGAM1120 include diagnosis, prevention and treatment of diseases and clinical conditions associated with PDGFRA. The function of PDGFRA and its association with various diseases and clinical conditions, has been established by previous studies, as described hereinabove with reference to VGAM117. FLJ10996 (Accession NM_019044) is another VGAM1120 host target gene. FLJ10996 BINDING SITE is HOST TARGET binding site found in the 3' untranslated region of mRNA encoded by FLJ10996, corresponding to a HOST TARGET binding site such as BINDING SITE I, BINDING SITE II or BINDING SITE III. Table 2 illustrates the complementarity of the nucleotide sequences of FLJ10996 BINDING SITE, designated SEQ ID:21127, to the nucleotide sequence of VGAM1120 RNA, herein designated VGAM RNA, also designated SEQ ID:3831.

Another function of VGAM1120 is therefore inhibition of FLJ10996 (Accession NM_019044). Accordingly, utilities of VGAM1120 include diagnosis, prevention and treatment of diseases and clinical conditions associated with FLJ10996. LOC146713 (Accession XM_097071) is another VGAM1120 host target gene. LOC146713 BINDING SITE is HOST TARGET binding site found in the 3' untranslated region of mRNA encoded by LOC146713, corresponding to a HOST TARGET binding site such as BINDING SITE I, BINDING SITE II or BINDING SITE III. Table 2 illustrates the complementarity of the nucleotide sequences of LOC146713 BINDING SITE, designated SEQ ID:40715, to the nucleotide sequence of VGAM1120 RNA, herein designated VGAM RNA, also designated SEQ ID:3831.

Another function of VGAM1120 is therefore inhibition of LOC146713 (Accession XM_097071). Accordingly, utilities of VGAM1120 include diagnosis, prevention and treatment of diseases and clinical conditions associated with LOC146713. LOC150271 (Accession XM_097859) is another VGAM1120 host target gene. LOC150271 BINDING SITE is HOST TARGET binding site found in the 3' untranslated region of mRNA encoded by LOC150271, corresponding to a HOST TARGET binding site such as BINDING SITE I, BINDING SITE II or BINDING SITE III. Table 2 illustrates the complementarity of the nucleotide sequences of LOC150271 BINDING SITE, designated SEQ ID:41170, to the nucleotide sequence of VGAM1120 RNA, herein designated VGAM RNA, also designated SEQ ID:3831.

Another function of VGAM1120 is therefore inhibition of LOC150271 (Accession XM_097859). Accordingly, utilities of VGAM1120 include diagnosis, prevention and treatment of diseases and clinical conditions associated with LOC150271. LOC199926 (Accession XM_117157) is another VGAM1120 host target gene. LOC199926 BINDING SITE is HOST TARGET binding site found in the 3' untranslated region of mRNA encoded by LOC199926, corresponding to a HOST TARGET binding site such as BINDING SITE I, BINDING SITE II or BINDING SITE III. Table 2 illustrates the complementarity of the nucleotide sequences of LOC199926 BINDING SITE, designated SEQ ID:43260, to the nucleotide sequence of VGAM1120 RNA, herein designated VGAM RNA, also designated SEQ ID:3831.

Another function of VGAM1120 is therefore inhibition of LOC199926 (Accession XM_117157). Accordingly, utilities of VGAM1120 include diagnosis, prevention and treatment of diseases and clinical conditions associated with LOC199926. LOC202316 (Accession XM_117380) is another VGAM1120 host target gene. LOC202316 BINDING SITE is HOST TARGET binding site found in the 3' untranslated region of mRNA encoded by LOC202316, corresponding to a HOST TARGET binding site such as BINDING SITE I, BINDING SITE II or BINDING SITE III. Table 2 illustrates the complementarity of the nucleotide sequences of LOC202316 BINDING SITE, designated SEQ ID:43425, to the nucleotide sequence of VGAM1120 RNA, herein designated VGAM RNA, also designated SEQ ID:3831.

Another function of VGAM1120 is therefore inhibition of LOC202316 (Accession XM_117380). Accordingly, utilities of VGAM1120 include diagnosis, prevention and treatment of diseases and clinical conditions associated with LOC202316. FIG. 1 further provides a conceptual description of a novel bioinformatically detected viral gene of the present invention, referred to here as Viral Genomic Address Messenger 1121 (VGAM1121) viral gene, which modulates expression of respective host target genes thereof, the function and utility of which host target genes is known in the art.

VGAM1121 is a novel bioinformatically detected regulatory, non protein coding, viral micro RNA (miRNA) gene. The method by which VGAM1121 was detected is described hereinabove with reference to FIGS. 1-8.

VGAM1121 gene, herein designated VGAM GENE, is a viral gene contained in the genome of Saimiriine Herpesvirus 2. VGAM1121 host target gene, herein designated VGAM HOST TARGET GENE, is a human gene contained in the human genome.

VGAM1121 gene encodes a VGAM1121 precursor RNA, herein designated VGAM PRECURSOR RNA. Similar to other miRNA genes, and unlike most ordinary genes, VGAM1121 precursor RNA does not encode a protein. A nucleotide sequence identical or highly similar to the nucleotide sequence of VGAM1121 precursor RNA is designated SEQ ID:1107, and is provided hereinbelow with reference to the sequence listing part. Nucleotide sequence SEQ ID:1107 is located at position 47689 relative to the genome of Saimiriine Herpesvirus 2.

VGAM1121 precursor RNA folds onto itself, forming VGAM1121 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1121 folded precursor RNA into VGAM1121 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1121 RNA is designated SEQ ID:3832, and is provided hereinbelow with reference to the sequence listing part.

VGAM1121 host target gene, herein designated VGAM HOST TARGET GENE, encodes a corresponding messenger RNA, VGAM1121 host target RNA, herein designated VGAM HOST TARGET RNA. VGAM1121 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1121 RNA, herein designated VGAM RNA, binds complementarily to one or more host target binding sites located in untranslated regions of VGAM1121 host target RNA, herein designated VGAM HOST TARGET RNA. This complementary binding is due to the fact that the nucleotide sequence of VGAM1121 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1121 RNA, herein designated VGAM RNA, may have a different number of host target binding sites in untranslated regions of a VGAM1121 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1121 RNA, herein designated VGAM RNA, to host target binding sites on VGAM1121 host target RNA, herein designated VGAM HOST TARGET RNA, such as BINDING SITE I, BINDING SITE II and BINDING SITE III, inhibits translation of VGAM1121 host target RNA into VGAM1121 host target protein, herein designated VGAM HOST TARGET PROTEIN. VGAM host target protein is therefore outlined by a broken line.

It is appreciated that VGAM1121 host target gene, herein designated VGAM HOST TARGET GENE, in fact represents a plurality of VGAM1121 host target genes. The mRNA of each one of this plurality of VGAM1121 host target genes comprises one or more host target binding sites, each having a nucleotide sequence which is at least partly complementary to VGAM1121 RNA, herein designated VGAM RNA, and which when bound by VGAM1121 RNA causes inhibition of translation of respective one or more VGAM1121 host target proteins.

It is further appreciated by one skilled in the art that the mode of translational inhibition illustrated by FIG. 1 with specific reference to translational inhibition exerted by VGAM1121 gene, herein designated VGAM GENE, on one or more VGAM1121 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1121 is inhibition of expression of host target genes, as part of a novel viral mechanism of attacking a host. Accordingly, utilities of VGAM1121 include diagnosis, prevention and treatment of viral infection by Saimiriine Herpesvirus 2. Specific functions, and accordingly utilities, of VGAM1121 correlate with, and may be deduced from, the identity of the host target genes which VGAM1121 binds and inhibits, and the function of these host target genes, as elaborated hereinbelow.

Nucleotide sequences of the VGAM1121 precursor RNA, herein designated VGAM PRECURSOR RNA, and of the 'diced' VGAM1121 RNA, herein designated VGAM RNA, and a schematic representation of the secondary folding of VGAM1121 folded precursor RNA, herein designated VGAM FOLDED PRECURSOR RNA, of VGAM1121 are further described hereinbelow with reference to Table 1.

Nucleotide sequences of host target binding sites, such as BINDING SITE-I, BINDING SITE-II and BINDING SITE-III of FIG. 1, found on VGAM1121 host target RNA, and schematic representation of the complementarity of each of these host target binding sites to VGAM1121 RNA, herein designated VGAM RNA, are described hereinbelow with reference to Table 2.

As mentioned hereinabove with reference to FIG. 1, a function of VGAM1121 gene, herein designated VGAM is inhibition of expression of VGAM1121 target genes. It is appreciated that specific functions, and accordingly utilities, of VGAM1121 correlate with, and may be deduced from, the identity of the target genes which VGAM1121 binds and inhibits, and the function of these target genes, as elaborated hereinbelow.

A Disintegrin-like and Metalloprotease (reprolysin type) with Thrombospondin Type 1 Motif, 1 (ADAMTS1, Accession NM_006988) is a VGAM1121 host target gene. ADAMTS1 BINDING SITE is HOST TARGET binding site found in the 3' untranslated region of mRNA encoded by ADAMTS1, corresponding to a HOST TARGET binding site such as BINDING SITE I, BINDING SITE II or BINDING SITE III. Table 2 illustrates the complementarity of the nucleotide sequences of ADAMTS1 BINDING SITE, designated SEQ ID:13850, to the nucleotide sequence of VGAM1121 RNA, herein designated VGAM RNA, also designated SEQ ID:3832.

A function of VGAM1121 is therefore inhibition of A Disintegrin-like and Metalloprotease (reprolysin type) with Thrombospondin Type 1 Motif, 1 (ADAMTS1, Accession NM_006988). Accordingly, utilities of VGAM1121 include diagnosis, prevention and treatment of diseases and clinical conditions associated with ADAMTS1. ATPase, Cu++ Transporting, Beta Polypeptide (Wilson disease) (ATP7B, Accession NM_000053) is another VGAM1121 host target gene. ATP7B BINDING SITE is HOST TARGET binding site found in the 3' untranslated region of mRNA encoded by ATP7B, corresponding to a HOST TARGET binding site such as BINDING SITE I, BINDING SITE II or BINDING SITE III. Table 2 illustrates the complementarity of the nucleotide sequences of ATP7B BINDING SITE, designated SEQ ID:5508, to the nucleotide sequence of VGAM1121 RNA, herein designated VGAM RNA, also designated SEQ ID:3832.

Another function of VGAM1121 is therefore inhibition of ATPase, Cu++ Transporting, Beta Polypeptide (Wilson disease) (ATP7B, Accession NM_000053). Accordingly, utilities of VGAM1121 include diagnosis, prevention and treatment of diseases and clinical conditions associated with ATP7B. BANK (Accession NM_017935) is another VGAM1121 host target gene. BANK BINDING SITE is HOST TARGET binding site found in the 3' untranslated region of mRNA encoded by BANK, corresponding to a HOST TARGET binding site such as BINDING SITE I, BINDING SITE II or BINDING SITE III. Table 2 illustrates the complementarity of the nucleotide sequences of BANK BINDING SITE, designated SEQ ID:19623, to the nucleotide sequence of VGAM1121 RNA, herein designated VGAM RNA, also designated SEQ ID:3832.

Another function of VGAM1121 is therefore inhibition of BANK (Accession NM_017935). Accordingly, utilities of VGAM1121 include diagnosis, prevention and treatment of diseases and clinical conditions associated with BANK. Kelch-like 4 (Drosophila) (KLHL4, Accession NM_019117) is another VGAM1121 host target gene. KLHL4 BINDING SITE is HOST TARGET binding site found in the 3' untranslated region of mRNA encoded by KLHL4, corresponding to a HOST TARGET binding site such as BINDING SITE I, BINDING SITE II or BINDING SITE III. Table 2 illustrates the complementarity of the nucleotide sequences of KLHL4 BINDING SITE, designated SEQ ID:21197, to the nucleotide sequence of VGAM1121 RNA, herein designated VGAM RNA, also designated SEQ ID:3832.

Another function of VGAM1121 is therefore inhibition of Kelch-like 4 (Drosophila) (KLHL4, Accession NM_019117). Accordingly, utilities of VGAM1121 include diagnosis, prevention and treatment of diseases and clinical conditions associated with KLHL4. TEB4 (Accession XM_027156) is another VGAM1121 host target gene. TEB4 BINDING SITE is HOST TARGET binding site found in the 3' untranslated region of mRNA encoded by TEB4, corresponding to a HOST TARGET binding site such as BINDING SITE I, BINDING SITE II or BINDING SITE III. Table 2 illustrates the complementarity of the nucleotide sequences of TEB4 BINDING SITE, designated SEQ ID:30428, to the nucleotide sequence of VGAM1121 RNA, herein designated VGAM RNA, also designated SEQ ID:3832.

Another function of VGAM1121 is therefore inhibition of TEB4 (Accession XM_027156). Accordingly, utilities of VGAM1121 include diagnosis, prevention and treatment of diseases and clinical conditions associated with TEB4. FIG. 1 further provides a conceptual description of a novel bioinformatically detected viral gene of the present invention, referred to here as Viral Genomic Address Messenger 1122

(VGAM1122) viral gene, which modulates expression of respective host target genes thereof, the function and utility of which host target genes is known in the art.

VGAM1122 is a novel bioinformatically detected regulatory, non protein coding, viral micro RNA (miRNA) gene. The method by which VGAM1122 was detected is described hereinabove with reference to FIGS. 1-8.

VGAM1122 gene, herein designated VGAM GENE, is a viral gene contained in the genome of Saimiriine Herpesvirus 2. VGAM1122 host target gene, herein designated VGAM HOST TARGET GENE, is a human gene contained in the human genome.

VGAM1122 gene encodes a VGAM1122 precursor RNA, herein designated VGAM PRECURSOR RNA. Similar to other miRNA genes, and unlike most ordinary genes, VGAM1122 precursor RNA does not encode a protein. A nucleotide sequence identical or highly similar to the nucleotide sequence of VGAM1122 precursor RNA is designated SEQ ID:1108, and is provided hereinbelow with reference to the sequence listing part. Nucleotide sequence SEQ ID:1108 is located at position 43628 relative to the genome of Saimiriine Herpesvirus 2.

VGAM1122 precursor RNA folds onto itself, forming VGAM1122 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1122 folded precursor RNA into VGAM1122 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1122 RNA is designated SEQ ID:3833, and is provided hereinbelow with reference to the sequence listing part.

VGAM1122 host target gene, herein designated VGAM HOST TARGET GENE, encodes a corresponding messenger RNA, VGAM1122 host target RNA, herein designated VGAM HOST TARGET RNA. VGAM1122 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1122 RNA, herein designated VGAM RNA, binds complementarily to one or more host target binding sites located in untranslated regions of VGAM1122 host target RNA, herein designated VGAM HOST TARGET RNA. This complementary binding is due to the fact that the nucleotide sequence of VGAM1122 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1122 RNA, herein designated VGAM RNA, may have a different number of host target binding sites in untranslated regions of a VGAM1122 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1122 RNA, herein designated VGAM RNA, to host target binding sites on VGAM1122 host target RNA, herein designated VGAM HOST TARGET RNA, such as BINDING SITE I, BINDING SITE II and BINDING SITE III, inhibits translation of VGAM1122 host target RNA into VGAM1122 host target protein, herein designated VGAM HOST TARGET PROTEIN. VGAM host target protein is therefore outlined by a broken line.

It is appreciated that VGAM1122 host target gene, herein designated VGAM HOST TARGET GENE, in fact represents a plurality of VGAM1122 host target genes. The mRNA of each one of this plurality of VGAM1122 host target genes comprises one or more host target binding sites, each having a nucleotide sequence which is at least partly complementary to VGAM1122 RNA, herein designated VGAM RNA, and which when bound by VGAM1122 RNA causes inhibition of translation of respective one or more VGAM1122 host target proteins.

It is further appreciated by one skilled in the art that the mode of translational inhibition illustrated by FIG. 1 with specific reference to translational inhibition exerted by VGAM1122 gene, herein designated VGAM GENE, on one or more VGAM1122 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1122 is inhibition of expression of host target genes, as part of a novel viral mechanism of attacking a host. Accordingly, utilities of VGAM1122 include diagnosis, prevention and treatment of viral infection by Saimiriine Herpesvirus 2. Specific functions, and accordingly utilities, of VGAM1122 correlate with, and may be deduced from, the identity of the host target genes which VGAM1122 binds and inhibits, and the function of these host target genes, as elaborated hereinbelow.

Nucleotide sequences of the VGAM1122 precursor RNA, herein designated VGAM PRECURSOR RNA, and of the 'diced' VGAM1122 RNA, herein designated VGAM RNA, and a schematic representation of the secondary folding of VGAM1122 folded precursor RNA, herein designated VGAM FOLDED PRECURSOR RNA, of VGAM1122 are further described hereinbelow with reference to Table 1.

Nucleotide sequences of host target binding sites, such as BINDING SITE-I, BINDING SITE-II and BINDING SITE-III of FIG. 1, found on VGAM1122 host target RNA, and schematic representation of the complementarity of each of these host target binding sites to VGAM1122 RNA, herein designated VGAM RNA, are described hereinbelow with reference to Table 2.

As mentioned hereinabove with reference to FIG. 1, a function of VGAM1122 gene, herein designated VGAM is inhibition of expression of VGAM1122 target genes. It is appreciated that specific functions, and accordingly utilities, of VGAM1122 correlate with, and may be deduced from, the identity of the target genes which VGAM1122 binds and inhibits, and the function of these target genes, as elaborated hereinbelow.

Calumenin (CALU, Accession NM_001219) is a VGAM1122 host target gene. CALU BINDING SITE is HOST TARGET binding site found in the 3' untranslated region of mRNA encoded by CALU, corresponding to a HOST TARGET binding site such as BINDING SITE I, BINDING SITE II or BINDING SITE III. Table 2 illustrates the complementarity of the nucleotide sequences of CALU BINDING SITE, designated SEQ ID:6882, to the nucleotide sequence of VGAM1122 RNA, herein designated VGAM RNA, also designated SEQ ID:3833.

A function of VGAM1122 is therefore inhibition of Calumenin (CALU, Accession NM_001219), a gene which binds 7 calcium ions with a low affinity with unidtified function. Accordingly, utilities of VGAM1122 include diagnosis, prevention and treatment of diseases and clinical conditions associated with CALU. The function of CALU and its association with various diseases and clinical conditions, has been established by previous studies, as described hereinabove with reference to VGAM253. V-raf-1 Murine Leukemia Viral Oncogene Homolog 1 (RAF1, Accession XM_087425) is another VGAM1122 host target gene. RAF1 BINDING SITE is HOST TARGET binding site found in the 3' untranslated region of mRNA encoded by RAF1, corresponding to a HOST TARGET binding site such as BINDING SITE I, BINDING SITE II or BINDING SITE III. Table 2 illustrates the complementarity of the nucleotide sequences of RAF1 BINDING SITE, designated SEQ ID:39245, to the nucleotide sequence of VGAM1122 RNA, herein designated VGAM RNA, also designated SEQ ID:3833.

Another function of VGAM1122 is therefore inhibition of V-raf-1 Murine Leukemia Viral Oncogene Homolog 1 (RAF1, Accession XM_087425). Accordingly, utilities of VGAM1122 include diagnosis, prevention and treatment of diseases and clinical conditions associated with RAF1. DKFZp761P1010 (Accession NM_018423) is another VGAM1122 host target gene. DKFZp761P1010 BINDING SITE is HOST TARGET binding site found in the 3' untranslated region of mRNA encoded by DKFZp761P1010, corresponding to a HOST TARGET binding site such as BINDING SITE I, BINDING SITE II or BINDING SITE III. Table 2 illustrates the complementarity of the nucleotide sequences of DKFZp761P1010 BINDING SITE, designated SEQ ID:20477, to the nucleotide sequence of VGAM1122 RNA, herein designated VGAM RNA, also designated SEQ ID:3833.

Another function of VGAM1122 is therefore inhibition of DKFZp761P1010 (Accession NM_018423). Accordingly, utilities of VGAM1122 include diagnosis, prevention and treatment of diseases and clinical conditions associated with DKFZp761P1010. HTMP10 (Accession NM_033207) is another VGAM1122 host target gene. HTMP10 BINDING SITE is HOST TARGET binding site found in the 3' untranslated region of mRNA encoded by HTMP10, corresponding to a HOST TARGET binding site such as BINDING SITE I, BINDING SITE II or BINDING SITE III. Table 2 illustrates the complementarity of the nucleotide sequences of HTMP10 BINDING SITE, designated SEQ ID:27049, to the nucleotide sequence of VGAM1122 RNA, herein designated VGAM RNA, also designated SEQ ID:3833.

Another function of VGAM1122 is therefore inhibition of HTMP10 (Accession NM_033207). Accordingly, utilities of VGAM1122 include diagnosis, prevention and treatment of diseases and clinical conditions associated with HTMP10. KIAA0471 (Accession NM_014857) is another VGAM1122 host target gene. KIAA0471 BINDING SITE is HOST TARGET binding site found in the 3' untranslated region of mRNA encoded by KIAA0471, corresponding to a HOST TARGET binding site such as BINDING SITE I, BINDING SITE II or BINDING SITE III. Table 2 illustrates the complementarity of the nucleotide sequences of KIAA0471 BINDING SITE, designated SEQ ID:16907, to the nucleotide sequence of VGAM1122 RNA, herein designated VGAM RNA, also designated SEQ ID:3833.

Another function of VGAM1122 is therefore inhibition of KIAA0471 (Accession NM_014857). Accordingly, utilities of VGAM1122 include diagnosis, prevention and treatment of diseases and clinical conditions associated with KIAA0471. KIAA1676 (Accession XM_167612) is another VGAM1122 host target gene. KIAA1676 BINDING SITE is HOST TARGET binding site found in the 3' untranslated region of mRNA encoded by KIAA1676, corresponding to a HOST TARGET binding site such as BINDING SITE I, BINDING SITE II or BINDING SITE III. Table 2 illustrates the complementarity of the nucleotide sequences of KIAA1676 BINDING SITE, designated SEQ ID:44726, to the nucleotide sequence of VGAM1122 RNA, herein designated VGAM RNA, also designated SEQ ID:3833.

Another function of VGAM1122 is therefore inhibition of KIAA1676 (Accession XM_167612). Accordingly, utilities of VGAM1122 include diagnosis, prevention and treatment of diseases and clinical conditions associated with KIAA1676. LOC115294 (Accession XM_054302) is another VGAM1122 host target gene. LOC115294 BINDING SITE is HOST TARGET binding site found in the 3' untranslated region of mRNA encoded by LOC115294, corresponding to a HOST TARGET binding site such as BINDING SITE I, BINDING SITE II or BINDING SITE III. Table 2 illustrates the complementarity of the nucleotide sequences of LOC115294 BINDING SITE, designated SEQ ID:36143, to the nucleotide sequence of VGAM1122 RNA, herein designated VGAM RNA, also designated SEQ ID:3833.

Another function of VGAM1122 is therefore inhibition of LOC115294 (Accession XM_054302). Accordingly, utilities of VGAM1122 include diagnosis, prevention and treatment of diseases and clinical conditions associated with LOC115294. LOC121536 (Accession XM_058567) is another VGAM1122 host target gene. LOC121536 BINDING SITE is HOST TARGET binding site found in the 3' untranslated region of mRNA encoded by LOC121536, corresponding to a HOST TARGET binding site such as BINDING SITE I, BINDING SITE II or BINDING SITE III. Table 2 illustrates the complementarity of the nucleotide sequences of LOC121536 BINDING SITE, designated SEQ ID:36664, to the nucleotide sequence of VGAM1122 RNA, herein designated VGAM RNA, also designated SEQ ID:3833.

Another function of VGAM1122 is therefore inhibition of LOC121536 (Accession XM_058567). Accordingly, utilities of VGAM1122 include diagnosis, prevention and treatment of diseases and clinical conditions associated with LOC121536. LOC148936 (Accession XM_097556) is another VGAM1122 host target gene. LOC148936 BINDING SITE is HOST TARGET binding site found in the 3' untranslated region of mRNA encoded by LOC148936, corresponding to a HOST TARGET binding site such as BINDING SITE I, BINDING SITE II or BINDING SITE III. Table 2 illustrates the complementarity of the nucleotide sequences of LOC148936 BINDING SITE, designated SEQ ID:40929, to the nucleotide sequence of VGAM1122 RNA, herein designated VGAM RNA, also designated SEQ ID:3833.

Another function of VGAM1122 is therefore inhibition of LOC148936 (Accession XM_097556). Accordingly, utilities of VGAM1122 include diagnosis, prevention and treatment of diseases and clinical conditions associated with LOC148936. LOC148938 (Accession XM_097555) is another VGAM1122 host target gene. LOC148938 BINDING SITE is HOST TARGET binding site found in the 3' untranslated region of mRNA encoded by LOC148938, corresponding to a HOST TARGET binding site such as BINDING SITE I, BINDING SITE II or BINDING SITE III. Table 2 illustrates the complementarity of the nucleotide sequences of LOC148938 BINDING SITE, designated SEQ ID:40922, to the nucleotide sequence of VGAM1122 RNA, herein designated VGAM RNA, also designated SEQ ID:3833.

Another function of VGAM1122 is therefore inhibition of LOC148938 (Accession XM_097555). Accordingly, utilities of VGAM1122 include diagnosis, prevention and treatment of diseases and clinical conditions associated with LOC148938. LOC152674 (Accession XM_098251) is another VGAM1122 host target gene. LOC152674 BINDING SITE is HOST TARGET binding site found in the 5' untranslated region of mRNA encoded by LOC152674, corresponding to a HOST TARGET binding site such as BINDING SITE I, BINDING SITE II or BINDING SITE III. Table 2 illustrates the complementarity of the nucleotide sequences of LOC152674 BINDING SITE, designated SEQ ID:41536, to the nucleotide sequence of VGAM1122 RNA, herein designated VGAM RNA, also designated SEQ ID:3833.

Another function of VGAM1122 is therefore inhibition of LOC152674 (Accession XM_098251). Accordingly, utilities of VGAM1122 include diagnosis, prevention and treatment of diseases and clinical conditions associated with LOC152674. LOC254100 (Accession XM_172851) is another VGAM1122 host target gene. LOC254100 BINDING SITE is HOST TARGET binding site found in the 3' untranslated region of mRNA encoded by LOC254100, corresponding to a HOST TARGET binding site such as BINDING SITE I, BINDING SITE II or BINDING SITE III. Table 2 illustrates the complementarity of the nucleotide sequences of LOC254100 BINDING SITE, designated SEQ ID:46127, to the nucleotide sequence of VGAM1122 RNA, herein designated VGAM RNA, also designated SEQ ID:3833.

Another function of VGAM1122 is therefore inhibition of LOC254100 (Accession XM_172851). Accordingly, utilities of VGAM1122 include diagnosis, prevention and treatment of diseases and clinical conditions associated with LOC254100. LOC92249 (Accession XM_043814) is another VGAM1122 host target gene. LOC92249 BINDING SITE is HOST TARGET binding site found in the 5' untranslated region of mRNA encoded by LOC92249, corresponding to a HOST TARGET binding site such as BINDING SITE I, BINDING SITE II or BINDING SITE III. Table 2 illustrates the complementarity of the nucleotide sequences of LOC92249 BINDING SITE, designated SEQ ID:34024, to the nucleotide sequence of VGAM1122 RNA, herein designated VGAM RNA, also designated SEQ ID:3833.

Another function of VGAM1122 is therefore inhibition of LOC92249 (Accession XM_043814). Accordingly, utilities of VGAM1122 include diagnosis, prevention and treatment of diseases and clinical conditions associated with LOC92249. FIG. 1 further provides a conceptual description of a novel bioinformatically detected viral gene of the present invention, referred to here as Viral Genomic Address Messenger 1123 (VGAM1123) viral gene, which modulates expression of respective host target genes thereof, the function and utility of which host target genes is known in the art.

VGAM1123 is a novel bioinformatically detected regulatory, non protein coding, viral micro RNA (miRNA) gene. The method by which VGAM1123 was detected is described hereinabove with reference to FIGS. 1-8.

VGAM1123 gene, herein designated VGAM GENE, is a viral gene contained in the genome of Saimiriine Herpesvirus 2. VGAM1123 host target gene, herein designated VGAM HOST TARGET GENE, is a human gene contained in the human genome.

VGAM1123 gene encodes a VGAM1123 precursor RNA, herein designated VGAM PRECURSOR RNA. Similar to other miRNA genes, and unlike most ordinary genes, VGAM1123 precursor RNA does not encode a protein. A nucleotide sequence identical or highly similar to the nucleotide sequence of VGAM1123 precursor RNA is designated SEQ ID:1109, and is provided hereinbelow with reference to the sequence listing part. Nucleotide sequence SEQ ID:1109 is located at position 45011 relative to the genome of Saimiriine Herpesvirus 2.

VGAM1123 precursor RNA folds onto itself, forming VGAM1123 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1123 folded precursor RNA into VGAM1123 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1123 RNA is designated SEQ ID:3834, and is provided hereinbelow with reference to the sequence listing part.

VGAM1123 host target gene, herein designated VGAM HOST TARGET GENE, encodes a corresponding messenger RNA, VGAM1123 host target RNA, herein designated VGAM HOST TARGET RNA. VGAM1123 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1123 RNA, herein designated VGAM RNA, binds complementarily to one or more host target binding sites located in untranslated regions of VGAM1123 host target RNA, herein designated VGAM HOST TARGET RNA. This complementary binding is due to the fact that the nucleotide sequence of VGAM1123 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1123 RNA, herein designated VGAM RNA, may have a different number of host target binding sites in untranslated regions of a VGAM1123 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1123 RNA, herein designated VGAM RNA, to host target binding sites on VGAM1123 host target RNA, herein designated VGAM HOST TARGET RNA, such as BINDING SITE I, BINDING SITE II and BINDING SITE III, inhibits translation of VGAM1123 host target RNA into VGAM1123 host target protein, herein designated VGAM HOST TARGET PROTEIN. VGAM host target protein is therefore outlined by a broken line.

It is appreciated that VGAM1123 host target gene, herein designated VGAM HOST TARGET GENE, in fact represents a plurality of VGAM1123 host target genes. The mRNA of each one of this plurality of VGAM1123 host target genes comprises one or more host target binding sites, each having a nucleotide sequence which is at least partly complementary to VGAM1123 RNA, herein designated VGAM RNA, and which when bound by VGAM1123 RNA causes inhibition of translation of respective one or more VGAM1123 host target proteins.

It is further appreciated by one skilled in the art that the mode of translational inhibition illustrated by FIG. 1 with specific reference to translational inhibition exerted by VGAM1123 gene, herein designated VGAM GENE, on one or more VGAM1123 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1123 is inhibition of expression of host target genes, as part of a novel viral mechanism of attacking a host. Accordingly, utilities of VGAM1123 include diagnosis, prevention and treatment of viral infection by Saimiriine Herpesvirus 2. Specific functions, and accordingly utilities, of VGAM1123 correlate with, and may be deduced from, the identity of the host target genes which VGAM1123 binds and inhibits, and the function of these host target genes, as elaborated hereinbelow.

Nucleotide sequences of the VGAM1123 precursor RNA, herein designated VGAM PRECURSOR RNA, and of the 'diced' VGAM1123 RNA, herein designated VGAM RNA, and a schematic representation of the secondary folding of VGAM1123 folded precursor RNA, herein designated VGAM FOLDED PRECURSOR RNA, of VGAM1123 are further described hereinbelow with reference to Table 1.

Nucleotide sequences of host target binding sites, such as BINDING SITE-I, BINDING SITE-II and BINDING SITE-III of FIG. 1, found on VGAM1123 host target RNA, and schematic representation of the complementarity of each of these host target binding sites to VGAM1123 RNA, herein designated VGAM RNA, are described hereinbelow with reference to Table 2.

As mentioned hereinabove with reference to FIG. 1, a function of VGAM1123 gene, herein designated VGAM is inhibition of expression of VGAM1123 target genes. It is appreciated that specific functions, and accordingly utilities, of VGAM1123 correlate with, and may be deduced from, the identity of the target genes which VGAM1123 binds and inhibits, and the function of these target genes, as elaborated hereinbelow.

Caspase 2, Apoptosis-related Cysteine Protease (neural precursor cell expressed, developmentally down-regulated 2) (CASP2, Accession NM_001224) is a VGAM1123 host target gene. CASP2 BINDING SITE1 through CASP2 BINDING SITE4 are HOST TARGET binding sites found in untranslated regions of mRNA encoded by CASP2, corresponding to HOST TARGET binding sites such as BINDING SITE I, BINDING SITE II or BINDING SITE III. Table 2 illustrates the complementarity of the nucleotide sequences of CASP2 BINDING SITE1 through CASP2 BINDING SITE4, designated SEQ ID:6890, SEQ ID:26853, SEQ ID:26858 and SEQ ID:26863 respectively, to the nucleotide sequence of VGAM1123 RNA, herein designated VGAM RNA, also designated SEQ ID:3834.

A function of VGAM1123 is therefore inhibition of Caspase 2, Apoptosis-related Cysteine Protease (neural precursor cell expressed, developmentally down-regulated 2) (CASP2, Accession NM_001224), a gene which involves in the activation cascade of caspases responsible for apoptosis execution. Accordingly, utilities of VGAM1123 include diagnosis, prevention and treatment of diseases and clinical conditions associated with CASP2. The function of CASP2 and its association with various diseases and clinical conditions, has been established by previous studies, as described hereinabove with reference to VGAM148. Eukaryotic Translation Initiation Factor 1A (EIF1A, Accession XM_114147) is another VGAM1123 host target gene. EIF1A BINDING SITE is HOST TARGET binding site found in the 3' untranslated region of mRNA encoded by EIF1A, corresponding to a HOST TARGET binding site such as BINDING SITE I, BINDING SITE II or BINDING SITE III. Table 2 illustrates the complementarity of the nucleotide sequences of EIF1A BINDING SITE, designated SEQ ID:42720, to the nucleotide sequence of VGAM1123 RNA, herein designated VGAM RNA, also designated SEQ ID:3834.

Another function of VGAM1123 is therefore inhibition of Eukaryotic Translation Initiation Factor 1A (EIF1A, Accession XM_114147), a gene which seems to be required for maximal rate of protein biosynthesis. Accordingly, utilities of VGAM1123 include diagnosis, prevention and treatment of diseases and clinical conditions associated with EIF1A. The function of EIF1A and its association with various diseases and clinical conditions, has been established by previous studies, as described hereinabove with reference to VGAM120. FK506 Binding Protein 12-rapamycin Associated Protein 1 (FRAP1, Accession NM_004958) is another VGAM1123 host target gene. FRAP1 BINDING SITE is HOST TARGET binding site found in the 3' untranslated region of mRNA encoded by FRAP1, corresponding to a HOST TARGET binding site such as BINDING SITE I, BINDING SITE II or BINDING SITE III. Table 2 illustrates the complementarity of the nucleotide sequences of FRAP1 BINDING SITE, designated SEQ ID:11403, to the nucleotide sequence of VGAM1123 RNA, herein designated VGAM RNA, also designated SEQ ID:3834.

Another function of VGAM1123 is therefore inhibition of FK506 Binding Protein 12-rapamycin Associated Protein 1 (FRAP1, Accession NM_004958), a gene which acts as the target for the cell-cycle arrest and immunosuppressive effects of the fkbp12-rapamycin complex. Accordingly, utilities of VGAM1123 include diagnosis, prevention and treatment of diseases and clinical conditions associated with FRAP1. The function of FRAP1 and its association with various diseases and clinical conditions, has been established by previous studies, as described hereinabove with reference to VGAM496. High-mobility Group 20A (HMG20A, Accession NM_018200) is another VGAM1123 host target gene.

HMG20A BINDING SITE is HOST TARGET binding site found in the 3' untranslated region of mRNA encoded by HMG20A, corresponding to a HOST TARGET binding site such as BINDING SITE I, BINDING SITE II or BINDING SITE III. Table 2 illustrates the complementarity of the nucleotide sequences of HMG20A BINDING SITE, designated SEQ ID:20073, to the nucleotide sequence of VGAM1123 RNA, herein designated VGAM RNA, also designated SEQ ID:3834.

Another function of VGAM1123 is therefore inhibition of High-mobility Group 20A (HMG20A, Accession NM_018200). Accordingly, utilities of VGAM1123 include diagnosis, prevention and treatment of diseases and clinical conditions associated with HMG20A. Reelin (RELN, Accession XM_168628) is another VGAM1123 host target gene. RELN BINDING SITE is HOST TARGET binding site found in the 3' untranslated region of mRNA encoded by RELN, corresponding to a HOST TARGET binding site such as BINDING SITE I, BINDING SITE II or BINDING SITE III. Table 2 illustrates the complementarity of the nucleotide sequences of RELN BINDING SITE, designated SEQ ID:45280, to the nucleotide sequence of VGAM1123 RNA, herein designated VGAM RNA, also designated SEQ ID:3834.

Another function of VGAM1123 is therefore inhibition of Reelin (RELN, Accession XM_168628), a gene which regulates microtubule function in neurons and neuronal migration. Accordingly, utilities of VGAM1123 include diagnosis, prevention and treatment of diseases and clinical conditions associated with RELN. The function of RELN and its association with various diseases and clinical conditions, has been established by previous studies, as described hereinabove with reference to VGAM35. DCOHM (Accession NM_032151) is another VGAM1123 host target gene. DCOHM BINDING SITE is HOST TARGET binding site found in the 3' untranslated region of mRNA encoded by DCOHM, corresponding to a HOST TARGET binding site such as BINDING SITE I, BINDING SITE II or BINDING SITE III. Table 2 illustrates the complementarity of the nucleotide sequences of DCOHM BINDING SITE, designated SEQ ID:25842, to the nucleotide sequence of VGAM1123 RNA, herein designated VGAM RNA, also designated SEQ ID:3834.

Another function of VGAM1123 is therefore inhibition of DCOHM (Accession NM_032151). Accordingly, utilities of VGAM1123 include diagnosis, prevention and treatment of diseases and clinical conditions associated with DCOHM. HTGN29 (Accession NM_020199) is another VGAM1123 host target gene. HTGN29 BINDING SITE is HOST TARGET binding site found in the 3' untranslated region of mRNA encoded by HTGN29, corresponding to a HOST TARGET binding site such as BINDING SITE I, BINDING SITE II or BINDING SITE III. Table 2 illustrates the complementarity of the nucleotide sequences of HTGN29 BINDING SITE, designated SEQ ID:21432, to the nucleotide sequence of VGAM1123 RNA, herein designated VGAM RNA, also designated SEQ ID:3834.

Another function of VGAM1123 is therefore inhibition of HTGN29 (Accession NM_020199). Accordingly, utilities of VGAM1123 include diagnosis, prevention and treatment of diseases and clinical conditions associated with HTGN29. KIAA1728 (Accession XM_043492) is another VGAM1123 host target gene. KIAA1728 BINDING SITE is HOST TARGET binding site found in the 3' untranslated region of mRNA encoded by KIAA1728, corresponding to a HOST TARGET binding site such as BINDING SITE I, BINDING SITE II or BINDING SITE III. Table 2 illustrates the complementarity of the nucleotide sequences of KIAA1728 BINDING SITE, designated SEQ ID:33949, to the nucleotide sequence of VGAM1123 RNA, herein designated VGAM RNA, also designated SEQ ID:3834.

Another function of VGAM1123 is therefore inhibition of KIAA1728 (Accession XM_043492). Accordingly, utilities of VGAM1123 include diagnosis, prevention and treatment of diseases and clinical conditions associated with KIAA1728. LOC145483 (Accession XM_085156) is another VGAM1123 host target gene. LOC145483 BINDING SITE is HOST TARGET binding site found in the 3' untranslated region of mRNA encoded by LOC145483, corresponding to a HOST TARGET binding site such as BINDING SITE I, BINDING SITE II or BINDING SITE III. Table 2 illustrates the complementarity of the nucleotide sequences of LOC145483 BINDING SITE, designated SEQ ID:37879, to the nucleotide sequence of VGAM1123 RNA, herein designated VGAM RNA, also designated SEQ ID:3834.

Another function of VGAM1123 is therefore inhibition of LOC145483 (Accession XM_085156). Accordingly, utilities of VGAM1123 include diagnosis, prevention and treatment of diseases and clinical conditions associated with LOC145483. LOC145757 (Accession XM_085227) is another VGAM1123 host target gene. LOC145757 BINDING SITE is HOST TARGET binding site found in the 5' untranslated region of mRNA encoded by LOC145757, corresponding to a HOST TARGET binding site such as BINDING SITE I, BINDING SITE II or BINDING SITE III. Table 2 illustrates the complementarity of the nucleotide sequences of LOC145757 BINDING SITE, designated SEQ ID:37967, to the nucleotide sequence of VGAM1123 RNA, herein designated VGAM RNA, also designated SEQ ID:3834.

Another function of VGAM1123 is therefore inhibition of LOC145757 (Accession XM_085227). Accordingly, utilities of VGAM1123 include diagnosis, prevention and treatment of diseases and clinical conditions associated with LOC145757. LOC153883 (Accession XM_087798) is another VGAM1123 host target gene. LOC153883 BINDING SITE is HOST TARGET binding site found in the 3' untranslated region of mRNA encoded by LOC153883, corresponding to a HOST TARGET binding site such as BINDING SITE I, BINDING SITE II or BINDING SITE III. Table 2 illustrates the complementarity of the nucleotide sequences of LOC153883 BINDING SITE, designated SEQ ID:39429, to the nucleotide sequence of VGAM1123 RNA, herein designated VGAM RNA, also designated SEQ ID:3834.

Another function of VGAM1123 is therefore inhibition of LOC153883 (Accession XM_087798). Accordingly, utilities of VGAM1123 include diagnosis, prevention and treatment of diseases and clinical conditions associated with LOC153883. LOC166793 (Accession NM_145291) is another VGAM1123 host target gene. LOC166793 BINDING SITE is HOST TARGET binding site found in the 5' untranslated region of mRNA encoded by LOC166793, corresponding to a HOST TARGET binding site such as BINDING SITE I, BINDING SITE II or BINDING SITE III. Table 2 illustrates the complementarity of the nucleotide sequences of LOC166793 BINDING SITE, designated SEQ ID:29804, to the nucleotide sequence of VGAM1123 RNA, herein designated VGAM RNA, also designated SEQ ID:3834.

Another function of VGAM1123 is therefore inhibition of LOC166793 (Accession NM_145291). Accordingly, utilities of VGAM1123 include diagnosis, prevention and treatment of diseases and clinical conditions associated with LOC166793. LOC219699 (Accession XM_172822) is another VGAM1123 host target gene. LOC219699 BINDING SITE is HOST TARGET binding site found in the 5' untranslated region of mRNA encoded by LOC219699, corresponding to a HOST TARGET binding site such as BINDING SITE I, BINDING SITE II or BINDING SITE III. Table 2 illustrates the complementarity of the nucleotide sequences of LOC219699 BINDING SITE, designated SEQ ID:46100, to the nucleotide sequence of VGAM1123 RNA, herein designated VGAM RNA, also designated SEQ ID:3834.

Another function of VGAM1123 is therefore inhibition of LOC219699 (Accession XM_172822). Accordingly, utilities of VGAM1123 include diagnosis, prevention and treatment of diseases and clinical conditions associated with LOC219699. LOC51054 (Accession NM_015899) is another VGAM1123 host target gene. LOC51054 BINDING SITE is HOST TARGET binding site found in the 5' untranslated region of mRNA encoded by LOC51054, corresponding to a HOST TARGET binding site such as BINDING SITE I, BINDING SITE II or BINDING SITE III. Table 2 illustrates the complementarity of the nucleotide sequences of LOC51054 BINDING SITE, designated SEQ ID:18043, to the nucleotide sequence of VGAM1123 RNA, herein designated VGAM RNA, also designated SEQ ID:3834.

Another function of VGAM1123 is therefore inhibition of LOC51054 (Accession NM_015899). Accordingly, utilities of VGAM1123 include diagnosis, prevention and treatment of diseases and clinical conditions associated with LOC51054. LOC51691 (Accession NM_016200) is another VGAM1123 host target gene. LOC51691 BINDING SITE is HOST TARGET binding site found in the 3' untranslated region of mRNA encoded by LOC51691, corresponding to a HOST TARGET binding site such as BINDING SITE I, BINDING SITE II or BINDING SITE III. Table 2 illustrates the complementarity of the nucleotide sequences of LOC51691 BINDING SITE, designated SEQ ID:18291, to the nucleotide sequence of VGAM1123 RNA, herein designated VGAM RNA, also designated SEQ ID:3834.

Another function of VGAM1123 is therefore inhibition of LOC51691 (Accession NM_016200). Accordingly, utilities of VGAM1123 include diagnosis, prevention and treatment of diseases and clinical conditions associated with LOC51691. LOC90786 (Accession XM_034127) is another VGAM1123 host target gene. LOC90786 BINDING SITE is HOST TARGET binding site found in the 5' untranslated region of mRNA encoded by LOC90786, corresponding to a HOST TARGET binding site such as BINDING SITE I, BINDING SITE II or BINDING SITE III. Table 2 illustrates the complementarity of the nucleotide sequences of LOC90786 BINDING SITE, designated SEQ ID:32015, to the nucleotide sequence of VGAM1123 RNA, herein designated VGAM RNA, also designated SEQ ID:3834.

Another function of VGAM1123 is therefore inhibition of LOC90786 (Accession XM_034127). Accordingly, utilities of VGAM1123 include diagnosis, prevention and treatment of diseases and clinical conditions associated with LOC90786. LOC92465 (Accession XM_045250) is another VGAM1123 host target gene. LOC92465 BINDING SITE is HOST TARGET binding site found in the 5' untranslated region of mRNA encoded by LOC92465, corresponding to a HOST TARGET binding site such as BINDING SITE I, BINDING SITE II or BINDING SITE III. Table 2 illustrates the complementarity of the nucleotide sequences of LOC92465 BINDING SITE, designated SEQ ID:34393, to the nucleotide sequence of VGAM1123 RNA, herein designated VGAM RNA, also designated SEQ ID:3834.

Another function of VGAM1123 is therefore inhibition of LOC92465 (Accession XM_045250). Accordingly, utilities of VGAM1123 include diagnosis, prevention and treatment of diseases and clinical conditions associated with LOC92465. FIG. 1 further provides a conceptual description of a novel bioinformatically detected viral gene of the present invention, referred to here as Viral Genomic Address Messenger 1124 (VGAM1124) viral gene, which modulates expression of respective host target genes thereof, the function and utility of which host target genes is known in the art.

VGAM1124 is a novel bioinformatically detected regulatory, non protein coding, viral micro RNA (miRNA) gene. The method by which VGAM1124 was detected is described hereinabove with reference to FIGS. 1-8.

VGAM1124 gene, herein designated VGAM GENE, is a viral gene contained in the genome of Saimiriine Herpesvirus 2. VGAM1124 host target gene, herein designated VGAM HOST TARGET GENE, is a human gene contained in the human genome.

VGAM1124 gene encodes a VGAM1124 precursor RNA, herein designated VGAM PRECURSOR RNA. Similar to other miRNA genes, and unlike most ordinary genes, VGAM1124 precursor RNA does not encode a protein. A nucleotide sequence identical or highly similar to the nucleotide sequence of VGAM1124 precursor RNA is designated SEQ ID:1110, and is provided hereinbelow with reference to the sequence listing part. Nucleotide sequence SEQ ID:1110 is located at position 43302 relative to the genome of Saimiriine Herpesvirus 2.

VGAM1124 precursor RNA folds onto itself, forming VGAM1124 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1124 folded precursor RNA into VGAM1124 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1124 RNA is designated SEQ ID:3835, and is provided hereinbelow with reference to the sequence listing part.

VGAM1124 host target gene, herein designated VGAM HOST TARGET GENE, encodes a corresponding messenger RNA, VGAM1124 host target RNA, herein designated VGAM HOST TARGET RNA. VGAM1124 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1124 RNA, herein designated VGAM RNA, binds complementarily to one or more host target binding sites located in untranslated regions of VGAM1124 host target RNA, herein designated VGAM HOST TARGET RNA. This complementary binding is due to the fact that the nucleotide sequence of VGAM1124 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1124 RNA, herein designated VGAM RNA, may have a different number of host target binding sites in untranslated regions of a VGAM1124 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1124 RNA, herein designated VGAM RNA, to host target binding sites on VGAM1124 host target RNA, herein designated VGAM HOST TARGET RNA, such as BINDING SITE I, BINDING SITE II and BINDING SITE III, inhibits translation of VGAM1124 host target RNA into VGAM1124 host target protein, herein designated VGAM HOST TARGET PROTEIN. VGAM host target protein is therefore outlined by a broken line.

It is appreciated that VGAM1124 host target gene, herein designated VGAM HOST TARGET GENE, in fact represents a plurality of VGAM1124 host target genes. The mRNA of each one of this plurality of VGAM1124 host target genes comprises one or more host target binding sites, each having a nucleotide sequence which is at least partly complementary to VGAM1124 RNA, herein designated VGAM RNA, and which when bound by VGAM1124 RNA causes inhibition of translation of respective one or more VGAM1124 host target proteins.

It is further appreciated by one skilled in the art that the mode of translational inhibition illustrated by FIG. 1 with specific reference to translational inhibition exerted by VGAM1124 gene, herein designated VGAM GENE, on one or more VGAM1124 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1124 is inhibition of expression of host target genes, as part of a novel viral mechanism of attacking a host. Accordingly, utilities of VGAM1124 include diagnosis, prevention and treatment of viral infection by Saimiriine Herpesvirus 2. Specific functions, and accordingly utilities, of VGAM1124 correlate with, and may be deduced from, the identity of the host target genes which VGAM1124 binds and inhibits, and the function of these host target genes, as elaborated hereinbelow.

Nucleotide sequences of the VGAM1124 precursor RNA, herein designated VGAM PRECURSOR RNA, and of the 'diced' VGAM1124 RNA, herein designated VGAM RNA, and a schematic representation of the secondary folding of VGAM1124 folded precursor RNA, herein designated VGAM FOLDED PRECURSOR RNA, of VGAM1124 are further described hereinbelow with reference to Table 1.

Nucleotide sequences of host target binding sites, such as BINDING SITE-I, BINDING SITE-II and BINDING SITE-III of FIG. 1, found on VGAM1124 host target RNA, and schematic representation of the complementarity of each of these host target binding sites to VGAM1124 RNA, herein designated VGAM RNA, are described hereinbelow with reference to Table 2.

As mentioned hereinabove with reference to FIG. 1, a function of VGAM1124 gene, herein designated VGAM is inhibition of expression of VGAM1124 target genes. It is appreciated that specific functions, and accordingly utilities, of VGAM1124 correlate with, and may be deduced from, the identity of the target genes which VGAM1124 binds and inhibits, and the function of these target genes, as elaborated hereinbelow.

DEAD/H (Asp-Glu-Ala-Asp/His) Box Polypeptide 34 (DDX34, Accession NM_014681) is a VGAM1124 host target gene. DDX34 BINDING SITE is HOST TARGET binding site found in the 3' untranslated region of mRNA encoded by DDX34, corresponding to a HOST TARGET binding site such as BINDING SITE I, BINDING SITE II or BINDING SITE III. Table 2 illustrates the complementarity of the nucleotide sequences of DDX34 BINDING SITE, designated SEQ ID:16158, to the nucleotide sequence of VGAM1124 RNA, herein designated VGAM RNA, also designated SEQ ID:3835.

A function of VGAM1124 is therefore inhibition of DEAD/H (Asp-Glu-Ala-Asp/His) Box Polypeptide 34 (DDX34, Accession NM_014681). Accordingly, utilities of VGAM1124 include diagnosis, prevention and treatment of diseases and clinical conditions associated with DDX34. Endothelial Differentiation, Lysophosphatidic Acid G-protein-coupled Receptor, 2 (EDG2, Accession NM_057159) is another VGAM1124 host target gene. EDG2 BINDING SITE is HOST TARGET binding site found in the 5' untranslated region of mRNA encoded by EDG2, corresponding to a HOST TARGET binding site such as BINDING SITE I, BINDING SITE II or BINDING SITE III. Table 2 illustrates the complementarity of the nucleotide sequences of EDG2 BINDING SITE, designated SEQ ID:27669, to the nucleotide sequence of VGAM1124 RNA, herein designated VGAM RNA, also designated SEQ ID:3835.

Another function of VGAM1124 is therefore inhibition of Endothelial Differentiation, Lysophosphatidic Acid G-protein-coupled Receptor, 2 (EDG2, Accession NM_057159). Accordingly, utilities of VGAM1124 include diagnosis, prevention and treatment of diseases and clinical conditions associated with EDG2. ICK (Accession NM_014920) is another VGAM1124 host target gene. ICK BINDING SITE is HOST TARGET binding site found in the 3' untranslated region of mRNA encoded by ICK, corresponding to a HOST TARGET binding site such as BINDING SITE I, BINDING SITE II or BINDING SITE III. Table 2 illustrates the complementarity of the nucleotide sequences of ICK BINDING SITE, designated SEQ ID:17191, to the nucleotide sequence of VGAM1124 RNA, herein designated VGAM RNA, also designated SEQ ID:3835.

Another function of VGAM1124 is therefore inhibition of ICK (Accession NM_014920). Accordingly, utilities of VGAM1124 include diagnosis, prevention and treatment of diseases and clinical conditions associated with ICK. LOC112687 (Accession XM_053145) is another VGAM1124 host target gene. LOC112687 BINDING SITE is HOST TARGET binding site found in the 3' untranslated region of mRNA encoded by LOC112687, corresponding to a HOST TARGET binding site such as BINDING SITE I, BINDING SITE II or BINDING SITE III. Table 2 illustrates the complementarity of the nucleotide sequences of LOC112687 BINDING SITE, designated SEQ ID:36064, to the nucleotide sequence of VGAM1124 RNA, herein designated VGAM RNA, also designated SEQ ID:3835.

Another function of VGAM1124 is therefore inhibition of LOC112687 (Accession XM_053145). Accordingly, utilities of VGAM1124 include diagnosis, prevention and treatment of diseases and clinical conditions associated with LOC112687. LOC220692 (Accession XM_165991) is another VGAM1124 host target gene. LOC220692 BINDING SITE is HOST TARGET binding site found in the 5' untranslated region of mRNA encoded by LOC220692, corresponding to a HOST TARGET binding site such as BINDING SITE I, BINDING SITE II or BINDING SITE III. Table 2 illustrates the complementarity of the nucleotide sequences of LOC220692 BINDING SITE, designated SEQ ID:43831, to the nucleotide sequence of VGAM1124 RNA, herein designated VGAM RNA, also designated SEQ ID:3835.

Another function of VGAM1124 is therefore inhibition of LOC220692 (Accession XM_165991). Accordingly, utilities of VGAM1124 include diagnosis, prevention and treatment of diseases and clinical conditions associated with LOC220692. FIG. 1 further provides a conceptual description of a novel bioinformatically detected viral gene of the present invention, referred to here as Viral Genomic Address Messenger 1125 (VGAM1125) viral gene, which modulates expression of respective host target genes thereof, the function and utility of which host target genes is known in the art.

VGAM1125 is a novel bioinformatically detected regulatory, non protein coding, viral micro RNA (miRNA) gene. The method by which VGAM1125 was detected is described hereinabove with reference to FIGS. 1-8.

VGAM1125 gene, herein designated VGAM GENE, is a viral gene contained in the genome of Saimiriine Herpesvirus 2. VGAM1125 host target gene, herein designated VGAM HOST TARGET GENE, is a human gene contained in the human genome.

VGAM1125 gene encodes a VGAM1125 precursor RNA, herein designated VGAM PRECURSOR RNA. Similar to other miRNA genes, and unlike most ordinary genes, VGAM1125 precursor RNA does not encode a protein. A nucleotide sequence identical or highly similar to the nucleotide sequence of VGAM1125 precursor RNA is designated SEQ ID:1111, and is provided hereinbelow with reference to the sequence listing part. Nucleotide sequence SEQ ID:1111 is located at position 42164 relative to the genome of Saimiriine Herpesvirus 2.

VGAM1125 precursor RNA folds onto itself, forming VGAM1125 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1125 folded precursor RNA into VGAM1125 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM1125 RNA is designated SEQ ID:3836, and is provided hereinbelow with reference to the sequence listing part.

VGAM1125 host target gene, herein designated VGAM HOST TARGET GENE, encodes a corresponding messenger RNA, VGAM1125 host target RNA, herein designated VGAM HOST TARGET RNA. VGAM1125 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1125 RNA, herein designated VGAM RNA, binds complementarily to one or more host target binding sites located in untranslated regions of VGAM1125 host target RNA, herein designated VGAM HOST TARGET RNA. This complementary binding is due to the fact that the nucleotide sequence of VGAM1125 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1125 RNA, herein designated VGAM RNA, may have a different number of host target binding sites in untranslated regions of a VGAM1125 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1125 RNA, herein designated VGAM RNA, to host target binding sites on VGAM1125 host target RNA, herein designated VGAM HOST TARGET RNA, such as BINDING SITE I, BINDING SITE II and BINDING SITE III, inhibits translation of VGAM1125 host target RNA into VGAM1125 host target protein, herein designated VGAM HOST TARGET PROTEIN. VGAM host target protein is therefore outlined by a broken line.

It is appreciated that VGAM1125 host target gene, herein designated VGAM HOST TARGET GENE, in fact represents a plurality of VGAM1125 host target genes. The mRNA of each one of this plurality of VGAM1125 host target genes comprises one or more host target binding sites, each having a nucleotide sequence which is at least partly complementary to VGAM1125 RNA, herein designated VGAM RNA, and which when bound by VGAM1125 RNA causes inhibition of translation of respective one or more VGAM1125 host target proteins.

It is further appreciated by one skilled in the art that the mode of translational inhibition illustrated by FIG. 1 with specific reference to translational inhibition exerted by VGAM1125 gene, herein designated VGAM GENE, on one or more VGAM1125 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1125 is inhibition of expression of host target genes, as part of a novel viral mechanism of attacking a host. Accordingly, utilities of VGAM1125 include diagnosis, prevention and treatment of viral infection by Saimiriine Herpesvirus 2. Specific functions, and accordingly utilities, of VGAM1125 correlate with, and may be deduced from, the identity of the host target genes which VGAM1125 binds and inhibits, and the function of these host target genes, as elaborated hereinbelow.

Nucleotide sequences of the VGAM1125 precursor RNA, herein designated VGAM PRECURSOR RNA, and of the 'diced' VGAM1125 RNA, herein designated VGAM RNA, and a schematic representation of the secondary folding of VGAM1125 folded precursor RNA, herein designated VGAM FOLDED PRECURSOR RNA, of VGAM1125 are further described hereinbelow with reference to Table 1.

Nucleotide sequences of host target binding sites, such as BINDING SITE-I, BINDING SITE-II and BINDING SITE-III of FIG. 1, found on VGAM1125 host target RNA, and schematic representation of the complementarity of each of these host target binding sites to VGAM1125 RNA, herein designated VGAM RNA, are described hereinbelow with reference to Table 2.

As mentioned hereinabove with reference to FIG. 1, a function of VGAM1125 gene, herein designated VGAM is inhibition of expression of VGAM1125 target genes. It is appreciated that specific functions, and accordingly utilities, of VGAM1125 correlate with, and may be deduced from, the identity of the target genes which VGAM1125 binds and inhibits, and the function of these target genes, as elaborated hereinbelow.

B-cell CLL/lymphoma 11B (zinc finger protein) (BCL11B, Accession NM_022898) is a VGAM1125 host target gene. BCL11B BINDING SITE is HOST TARGET binding site found in the 3' untranslated region of mRNA encoded by BCL11B, corresponding to a HOST TARGET binding site such as BINDING SITE I, BINDING SITE II or BINDING SITE III. Table 2 illustrates the complementarity of the nucleotide sequences of BCL11B BINDING SITE, designated SEQ ID:23165, to the nucleotide sequence of VGAM1125 RNA, herein designated VGAM RNA, also designated SEQ ID:3836.

A function of VGAM1125 is therefore inhibition of B-cell CLL/lymphoma 11B (zinc finger protein) (BCL11B, Accession NM_022898). Accordingly, utilities of VGAM1125 include diagnosis, prevention and treatment of diseases and clinical conditions associated with BCL11B. Collagen, Type IV, Alpha 4 (COL4A4, Accession NM_000092) is another VGAM1125 host target gene. COL4A4 BINDING SITE is HOST TARGET binding site found in the 3' untranslated region of mRNA encoded by COL4A4, corresponding to a HOST TARGET binding site such as BINDING SITE I, BINDING SITE II or BINDING SITE III. Table 2 illustrates the complementarity of the nucleotide sequences of COL4A4 BINDING SITE, designated SEQ ID:5550, to the nucleotide sequence of VGAM1125 RNA, herein designated VGAM RNA, also designated SEQ ID:3836.

Another function of VGAM1125 is therefore inhibition of Collagen, Type IV, Alpha 4 (COL4A4, Accession NM_000092). Accordingly, utilities of VGAM1125 include diagnosis, prevention and treatment of diseases and clinical conditions associated with COL4A4. Ectodermal-neural Cortex (with BTB-like domain) (ENC1, Accession NM_003633) is another VGAM1125 host target gene. ENC1 BINDING SITE is HOST TARGET binding site found in the 3' untranslated region of mRNA encoded by ENC1, corresponding to a HOST TARGET binding site such as BINDING SITE I, BINDING SITE II or BINDING SITE III. Table 2 illustrates the complementarity of the nucleotide sequences of ENC1 BINDING SITE, designated SEQ ID:9699, to the nucleotide sequence of VGAM1125 RNA, herein designated VGAM RNA, also designated SEQ ID:3836.

Another function of VGAM1125 is therefore inhibition of Ectodermal-neural Cortex (with BTB-like domain) (ENC1, Accession NM_003633), a gene which is an actin-binding protein involved in the regulation of neuronal process formation and in differentiation of neural crest cells. Accordingly, utilities of VGAM1125 include diagnosis, prevention and treatment of diseases and clinical conditions associated with ENC1. The function of ENC1 and its association with various diseases and clinical conditions, has been established by previous studies, as described hereinabove with reference to VGAM233. G Protein-coupled Receptor 23 (GPR23, Accession XM_018505) is another VGAM1125 host target gene. GPR23 BINDING SITE is HOST TARGET binding site found in the 3' untranslated region of mRNA encoded by GPR23, corresponding to a HOST TARGET binding site such as BINDING SITE I, BINDING SITE II or BINDING SITE III. Table 2 illustrates the complementarity of the nucleotide sequences of GPR23 BINDING SITE, designated SEQ ID:30363, to the nucleotide sequence of VGAM1125 RNA, herein designated VGAM RNA, also designated SEQ ID:3836.

Another function of VGAM1125 is therefore inhibition of G Protein-coupled Receptor 23 (GPR23, Accession XM_018505), a gene which is a member of the G protein-coupled receptor family. Accordingly, utilities of VGAM1125 include diagnosis, prevention and treatment of diseases and clinical conditions associated with GPR23. The function of GPR23 has been established by previous studies. By searching the expressed sequence tag database, Janssens et al. (1997) found an EST bearing 63% amino-acid identity with the chicken P2Y(5) receptor. By high-stringency PCR using primers based on this EST, Janssens et al. (1997) isolated a complete clone from human genomic DNA. The sequence was 61% identical to the chicken P2Y(5) receptor and 30-33% identical to other P2Y subtypes. O'Dowd et al. (1997) mapped the GPR23 gene to Xq13-q21.1 by fluorescence in situ hybridization.

Full details of the abovementioned studies are described in the following publications, the disclosure of which are hereby incorporated by reference:

Janssens, R.; Boeynaems, J.-M.; Godart, M.; Communi, D.: Cloning of a human heptahelical receptor closely related to the P2Y(5) receptor. Biochem. Biophys. Res. Commun. 236:106-112, 1997; and O'Dowd, B. F.; Nguyen, T.; Jung, B. P.; Marchese, A.; Cheng, R.; Heng, H. H. Q.; Kolakowski, L. F., Jr.; Lynch, K. R.; George, S. R.: Cloning and chromosomal mapping of four putative n.

Further studies establishing the function and utilities of GPR23 are found in John Hopkins OMIM database record ID 300086, and in sited publications numbered 10977-10978 listed in the bibliography section hereinbelow, which are also hereby incorporated by reference. Src-like-adaptor 2 (SLA2, Accession NM_032214) is another VGAM1125 host target gene. SLA2 BINDING SITE is HOST TARGET binding site found in the 3' untranslated region of mRNA encoded by SLA2, corresponding to a HOST TARGET binding site such as BINDING SITE I, BINDING SITE II or BINDING SITE III. Table 2 illustrates the complementarity of the nucleotide sequences of SLA2 BINDING SITE, designated SEQ ID:25942, to the nucleotide sequence of VGAM1125 RNA, herein designated VGAM RNA, also designated SEQ ID:3836.

Another function of VGAM1125 is therefore inhibition of Src-like-adaptor 2 (SLA2, Accession NM_032214). Accordingly, utilities of VGAM1125 include diagnosis, prevention and treatment of diseases and clinical conditions associated with SLA2. Serine Racemase (SRR, Accession NM_021947) is another VGAM1125 host target gene. SRR BINDING SITE is HOST TARGET binding site found in the 3' untranslated region of mRNA encoded by SRR, corresponding to a HOST TARGET binding site such as BINDING SITE I, BINDING SITE II or BINDING SITE III. Table 2 illustrates the complementarity of the nucleotide sequences of SRR BINDING SITE, designated SEQ ID:22476, to the nucleotide sequence of VGAM1125 RNA, herein designated VGAM RNA, also designated SEQ ID:3836.

Another function of VGAM1125 is therefore inhibition of Serine Racemase (SRR, Accession NM_021947). Accordingly, utilities of VGAM1125 include diagnosis, prevention and treatment of diseases and clinical conditions associated with SRR. WSX1 (Accession NM_004843) is another VGAM1125 host target gene. WSX1 BINDING SITE is HOST TARGET binding site found in the 3' untranslated region of mRNA encoded by WSX1, corresponding to a HOST TARGET binding site such as BINDING SITE I, BINDING SITE II or BINDING SITE III. Table 2 illustrates the complementarity of the nucleotide sequences of WSX1 BINDING SITE, designated SEQ ID:11255, to the nucleotide sequence of VGAM1125 RNA, herein designated VGAM RNA, also designated SEQ ID:3836.

Another function of VGAM1125 is therefore inhibition of WSX1 (Accession NM_004843), a gene which is a member of the class I cytokine receptor family and involved in the modulation of the immune response. Accordingly, utilities of VGAM1125 include diagnosis, prevention and treatment of diseases and clinical conditions associated with WSX1. The function of WSX1 has been established by previous studies. CD4+ helper T cells differentiate into type 1 (Th1) cells, critical for cell-mediated immunity, predominantly under the influence of IL12 (OMIM Ref. No. 161560). IL4 (OMIM Ref. No. 147780) influences their differentiation into type 2 (Th2) cells, critical for most antibody responses. Mice deficient in these cytokines, their receptors, or associated transcription factors have impaired, but not absent, Th1 or Th2 immune responses. Sprecher et al. (1998) searched an EST database for sequences similar to the class I cytokine receptor gp130 (OMIM Ref. No. 600694). They identified a cDNA encoding a class I cytokine receptor, which they designated WSX1, from an infant brain cDNA library. Using a homology screen, Chen et al. (2000) identified TCCR (T-cell cytokine receptor), a type I cytokine receptor family member identical to WSX1 and most homologous (26% identity, 37% similarity) to IL12RB2 (OMIM Ref. No. 601642). By screening a peripheral blood leukocyte (PBL) library, Chen et al. (2000) isolated a full-length cDNA encoding a deduced 636-amino acid TCCR protein. Sequence analysis predicted a single transmembrane domain, a WSX signature motif, and 7 potential N-glycosylation sites in its extracellular domain, and a box1 motif in its intracellular region. Mouse Tccr, isolated from a spleen library, is 62% identical to the human sequence. Northern blot analysis revealed expression of a 3.5-kb transcript in human PBL, thymus, and spleen as well as in adult and fetal lung. Real-time PCR analysis of mouse splenocytes revealed highest expression in CD4+ T cells and in natural killer cells. Among CD4+ T cells, expression was highest in undifferentiated (Th0) cells, with reduced expression in Th1 and Th2 cells. Animal model experiments lend further support to the function of WSX1. Yoshida et al. (2001) generated mice deficient in Wsx1 by homologous recombination. Wsx1-deficient mice were apparently normal and healthy. In vitro immunologic analysis showed that the Wsx1 -/- mice had weak IFNG primary responses but normal secondary responses to mitogen compared with wildtype mice. In response to Leishmania infection, mice lacking Wsx1 were more susceptible than wildtype mice and had weak early IFNG responses. The footpads were enlarged with severe ulceration. The phenotype was not as severe as that of Balb-c mice. RT-PCR analysis indicated that high early IL4 levels were maintained in the knockout mice. Infection with the avirulent Mycobacterium bovis BCG resulted in numerous enlarged and poorly differentiated liver granulomas in Wsx1 -/- mice compared with wildtype. However, there was no significant difference in bacterial numbers or in liver damage as assessed by transaminase levels. Yoshida et al. (2001) concluded that the impact of lack of Wsx1 early in response to infectious agents is significant, but the impact is mitigated by the presence of other cytokines, such as IFNG and IL12, and their receptors in later phases of the infection.

It is appreciated that the abovementioned animal model for WSX1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sprecher, C. A.; Grant, F. J.; Baumgartner, J. W.; Presnell, S. R.; Schrader, S. K.; Yamagiwa, T.; Whitmore, T. E.; O'Hara, P. J.; Foster, D. F.: Cloning and characterization of a novel class I cytokine receptor. Biochem. Biophys. Res. Comm. 246:82-90, 1998; and Yoshida, H.; Hamano, S.; Senaldi, G.; Covey, T.; Faggioni, R.; Mu, S.; Xia, M.; Wakeham, A. C.; Nishina, H.; Potter, J.; Saris, C. J. M.; Mak, T. W.: WSX-1 is required for the initiatio.

Further studies establishing the function and utilities of WSX1 are found in John Hopkins OMIM database record ID 605350, and in sited publications numbered 6180-6182 listed in the bibliography section hereinbelow, which are also hereby incorporated by reference. Betaine-homocysteine Methyltransferase (BHMT, Accession NM_001713) is another VGAM1125 host target gene. BHMT BINDING SITE is HOST TARGET binding site found in the 3' untranslated region of mRNA encoded by BHMT, corresponding to a HOST TARGET binding site such as BINDING SITE I, BINDING SITE II or BINDING SITE III. Table 2 illustrates the complementarity of the nucleotide sequences of BHMT BINDING SITE, designated SEQ ID:7444, to the nucleotide sequence of VGAM1125 RNA, herein designated VGAM RNA, also designated SEQ ID:3836.

Another function of VGAM1125 is therefore inhibition of Betaine-homocysteine Methyltransferase (BHMT, Accession NM_001713). Accordingly, utilities of VGAM1125 include diagnosis, prevention and treatment of diseases and clinical conditions associated with BHMT. Chemokine (C-C motif) Receptor 5 (CCR5, Accession NM_000579) is another VGAM1125 host target gene. CCR5 BINDING SITE is HOST TARGET binding site found in the 3' untranslated region of mRNA encoded by CCR5, corresponding to a HOST TARGET binding site such as BINDING SITE I, BINDING SITE II or BINDING SITE III. Table 2 illustrates the complementarity of the nucleotide sequences of CCR5 BINDING SITE, designated SEQ ID:6184, to the nucleotide sequence of VGAM1125 RNA, herein designated VGAM RNA, also designated SEQ ID:3836.

Another function of VGAM1125 is therefore inhibition of Chemokine (C-C motif) Receptor 5 (CCR5, Accession NM_000579). Accordingly, utilities of VGAM1125 include diagnosis, prevention and treatment of diseases and clinical conditions associated with CCR5. CEP3 (Accession NM_006449) is another VGAM1125 host target gene. CEP3 BINDING SITE is HOST TARGET binding site found in the 3' untranslated region of mRNA encoded by CEP3, corresponding to a HOST TARGET binding site such as BINDING SITE I, BINDING SITE II or BINDING SITE III. Table 2 illustrates the complementarity of the nucleotide sequences of CEP3 BINDING SITE, designated SEQ ID:13159, to the nucleotide sequence of VGAM1125 RNA, herein designated VGAM RNA, also designated SEQ ID:3836.

Another function of VGAM1125 is therefore inhibition of CEP3 (Accession NM_006449). Accordingly, utilities of VGAM1125 include diagnosis, prevention and treatment of diseases and clinical conditions associated with CEP3. KIAA1948 (Accession XM_091984) is another VGAM1125 host target gene. KIAA1948 BINDING SITE is HOST TARGET binding site found in the 3' untranslated region of mRNA encoded by KIAA1948, corresponding to a HOST TARGET binding site such as BINDING SITE I, BINDING SITE II or BINDING SITE III. Table 2 illustrates the complementarity of the nucleotide sequences of KIAA1948 BINDING SITE, designated SEQ ID:40080, to the nucleotide sequence of VGAM1125 RNA, herein designated VGAM RNA, also designated SEQ ID:3836.

Another function of VGAM1125 is therefore inhibition of KIAA1948 (Accession XM_091984). Accordingly, utilities of VGAM1125 include diagnosis, prevention and treatment of diseases and clinical conditions associated with KIAA1948. Zinc Finger Protein 185 (LIM domain) (ZNF185, Accession NM_007150) is another VGAM1125 host target gene. ZNF185 BINDING SITE is HOST TARGET binding site found in the 3' untranslated region of mRNA encoded by ZNF185, corresponding to a HOST TARGET binding site such as BINDING SITE I, BINDING SITE II or BINDING SITE III. Table 2 illustrates the complementarity of the nucleotide sequences of ZNF185 BINDING SITE, designated SEQ ID:14001, to the nucleotide sequence of VGAM1125 RNA, herein designated VGAM RNA, also designated SEQ ID:3836.

Another function of VGAM1125 is therefore inhibition of Zinc Finger Protein 185 (LIM domain) (ZNF185, Accession NM_007150). Accordingly, utilities of VGAM1125 include diagnosis, prevention and treatment of diseases and clinical conditions associated with ZNF185. LOC126964 (Accession XM_059100) is another VGAM1125 host target gene. LOC126964 BINDING SITE is HOST TARGET binding site found in the 3' untranslated region of mRNA encoded by LOC126964, corresponding to a HOST TARGET binding site such as BINDING SITE I, BINDING SITE II or BINDING SITE III. Table 2 illustrates the complementarity of the nucleotide sequences of LOC126964 BINDING SITE, designated SEQ ID:36883, to the nucleotide sequence of VGAM1125 RNA, herein designated VGAM RNA, also designated SEQ ID:3836.

Another function of VGAM1125 is therefore inhibition of LOC126964 (Accession XM_059100). Accordingly, utilities of VGAM1125 include diagnosis, prevention and treatment of diseases and clinical conditions associated with LOC126964. LOC150848 (Accession XM_097959) is another VGAM1125 host target gene. LOC150848 BINDING SITE is HOST TARGET binding site found in the 5' untranslated region of mRNA encoded by LOC150848, corresponding to a HOST TARGET binding site such as BINDING SITE I, BINDING SITE II or BINDING SITE III. Table 2 illustrates the complementarity of the nucleotide sequences of LOC150848 BINDING SITE, designated SEQ ID:41250, to the nucleotide sequence of VGAM1125 RNA, herein designated VGAM RNA, also designated SEQ ID:3836.

Another function of VGAM1125 is therefore inhibition of LOC150848 (Accession XM_097959). Accordingly, utilities of VGAM1125 include diagnosis, prevention and treatment of diseases and clinical conditions associated with LOC150848. LOC151248 (Accession XM_087143) is another VGAM1125 host target gene. LOC151248 BINDING SITE is HOST TARGET binding site found in the 3' untranslated region of mRNA encoded by LOC151248, corresponding to a HOST TARGET binding site such as BINDING SITE I, BINDING SITE II or BINDING SITE III. Table 2 illustrates the complementarity of the nucleotide sequences of LOC151248 BINDING SITE, designated SEQ ID:39083, to the nucleotide sequence of VGAM1125 RNA, herein designated VGAM RNA, also designated SEQ ID:3836.

Another function of VGAM1125 is therefore inhibition of LOC151248 (Accession XM_087143). Accordingly, utilities of VGAM1125 include diagnosis, prevention and treatment of diseases and clinical conditions associated with LOC151248. LOC153222 (Accession XM_087631) is another VGAM1125 host target gene. LOC153222 BINDING SITE is HOST TARGET binding site found in the 3' untranslated region of mRNA encoded by LOC153222, corresponding to a HOST TARGET binding site such as BINDING SITE I, BINDING SITE II or BINDING SITE III. Table 2 illustrates the complementarity of the nucleotide sequences of LOC153222 BINDING SITE, designated SEQ ID:39367, to the nucleotide sequence of VGAM1125 RNA, herein designated VGAM RNA, also designated SEQ ID:3836.

Another function of VGAM1125 is therefore inhibition of LOC153222 (Accession XM_087631). Accordingly, utilities of VGAM1125 include diagnosis, prevention and treatment of diseases and clinical conditions associated with LOC153222. FIG. 1 further provides a conceptual description of a novel bioinformatically detected viral gene of the present invention, referred to here as Viral Genomic Address Messenger 1126 (VGAM1126) viral gene, which modulates expression of respective host target genes thereof, the function and utility of which host target genes is known in the art.

VGAM1126 is a novel bioinformatically detected regulatory, non protein coding, viral micro RNA (miRNA) gene. The method by which VGAM1126 was detected is described hereinabove with reference to FIGS. 1-8.

VGAM1126 gene, herein designated VGAM GENE, is a viral gene contained in the genome of Ononis Yellow Mosaic Virus. VGAM1126 host target gene, herein designated VGAM HOST TARGET GENE, is a human gene contained in the human genome.

VGAM1126 gene encodes a VGAM1126 precursor RNA, herein designated VGAM PRECURSOR RNA. Similar to other miRNA genes, and unlike most ordinary genes, VGAM1126 precursor RNA does not encode a protein. A nucleotide sequence identical or highly similar to the nucleotide sequence of VGAM1126 precursor RNA is designated SEQ ID:1112, and is provided hereinbelow with reference to the sequence listing part. Nucleotide sequence SEQ ID:1112 is located at position 5517 relative to the genome of Ononis Yellow Mosaic Virus.

VGAM1126 precursor RNA folds onto itself, forming VGAM1126 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1126 folded precursor RNA into VGAM1126 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1126 RNA is designated SEQ ID:3837, and is provided hereinbelow with reference to the sequence listing part.

VGAM1126 host target gene, herein designated VGAM HOST TARGET GENE, encodes a corresponding messenger RNA, VGAM1126 host target RNA, herein designated VGAM HOST TARGET RNA. VGAM1126 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1126 RNA, herein designated VGAM RNA, binds complementarily to one or more host target binding sites located in untranslated regions of VGAM1126 host target RNA, herein designated VGAM HOST TARGET RNA. This complementary binding is due to the fact that the nucleotide sequence of VGAM1126 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1126 RNA, herein designated VGAM RNA, may have a different number of host target binding sites in untranslated regions of a VGAM1126 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1126 RNA, herein designated VGAM RNA, to host target binding sites on VGAM1126 host target RNA, herein designated VGAM HOST TARGET RNA, such as BINDING SITE I, BINDING SITE II and BINDING SITE III, inhibits translation of VGAM1126 host target RNA into VGAM1126 host target protein, herein designated VGAM HOST TARGET PROTEIN. VGAM host target protein is therefore outlined by a broken line.

It is appreciated that VGAM1126 host target gene, herein designated VGAM HOST TARGET GENE, in fact represents a plurality of VGAM1126 host target genes. The mRNA of each one of this plurality of VGAM1126 host target genes comprises one or more host target binding sites, each having a nucleotide sequence which is at least partly complementary to VGAM1126 RNA, herein designated VGAM RNA, and which when bound by VGAM1126 RNA causes inhibition of translation of respective one or more VGAM1126 host target proteins.

It is further appreciated by one skilled in the art that the mode of translational inhibition illustrated by FIG. 1 with specific reference to translational inhibition exerted by VGAM1126 gene, herein designated VGAM GENE, on one or more VGAM1126 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1126 is inhibition of expression of host target genes, as part of a novel viral mechanism of attacking a host. Accordingly, utilities of VGAM1126 include diagnosis, prevention and treatment of viral infection by Ononis Yellow Mosaic Virus. Specific functions, and accordingly utilities, of VGAM1126 correlate with, and may be deduced from, the identity of the host target genes which VGAM1126 binds and inhibits, and the function of these host target genes, as elaborated hereinbelow.

Nucleotide sequences of the VGAM1126 precursor RNA, herein designated VGAM PRECURSOR RNA, and of the 'diced' VGAM1126 RNA, herein designated VGAM RNA, and a schematic representation of the secondary folding of VGAM1126 folded precursor RNA, herein designated VGAM FOLDED PRECURSOR RNA, of VGAM1126 are further described hereinbelow with reference to Table 1.

Nucleotide sequences of host target binding sites, such as BINDING SITE-I, BINDING SITE-II and BINDING SITE-III of FIG. 1, found on VGAM1126 host target RNA, and schematic representation of the complementarity of each of these host target binding sites to VGAM1126 RNA, herein designated VGAM RNA, are described hereinbelow with reference to Table 2.

As mentioned hereinabove with reference to FIG. 1, a function of VGAM1126 gene, herein designated VGAM is inhibition of expression of VGAM1126 target genes. It is appreciated that specific functions, and accordingly utilities, of VGAM1126 correlate with, and may be deduced from, the identity of the target genes which VGAM1126 binds and inhibits, and the function of these target genes, as elaborated hereinbelow.

Adenylate Kinase 1 (AK1, Accession NM_000476) is a VGAM1126 host target gene. AK1 BINDING SITE is HOST TARGET binding site found in the 3' untranslated region of mRNA encoded by AK1, corresponding to a HOST TARGET binding site such as BINDING SITE I, BINDING SITE II or BINDING SITE III. Table 2 illustrates the complementarity of the nucleotide sequences of AK1 BINDING SITE, designated SEQ ID:6086, to the nucleotide sequence of VGAM1126 RNA, herein designated VGAM RNA, also designated SEQ ID:3837.

A function of VGAM1126 is therefore inhibition of Adenylate Kinase 1 (AK1, Accession NM_000476). Accordingly, utilities of VGAM1126 include diagnosis, prevention and treatment of diseases and clinical conditions associated with AK1. Alkaline Phosphatase, Intestinal (ALPI, Accession NM_001631) is another VGAM1126 host target gene. ALPI BINDING SITE is HOST TARGET binding site found in the 3' untranslated region of mRNA encoded by ALPI, corresponding to a HOST TARGET binding site such as BINDING SITE I, BINDING SITE II or BINDING SITE III. Table 2 illustrates the complementarity of the nucleotide sequences of ALPI BINDING SITE, designated SEQ ID:7342, to the nucleotide sequence of VGAM1126 RNA, herein designated VGAM RNA, also designated SEQ ID:3837.

Another function of VGAM1126 is therefore inhibition of Alkaline Phosphatase, Intestinal (ALPI, Accession NM_001631), a gene which is a glycoprotein phosphatase. Accordingly, utilities of VGAM1126 include diagnosis, prevention and treatment of diseases and clinical conditions associated with ALPI. The function of ALPI and its association with various diseases and clinical conditions, has been established by previous studies, as described hereinabove with reference to VGAM885. Adaptor-related Protein Complex 2, Beta 1 Subunit (AP2B1, Accession NM_001282) is another VGAM1126 host target gene. AP2B1 BINDING SITE is HOST TARGET binding site found in the 3' untranslated region of mRNA encoded by AP2B1, corresponding to a HOST TARGET binding site such as BINDING SITE I, BINDING SITE II or BINDING SITE III. Table 2 illustrates the complementarity of the nucleotide sequences of AP2B1 BINDING SITE, designated SEQ ID:6950, to the nucleotide sequence of VGAM1126 RNA, herein designated VGAM RNA, also designated SEQ ID:3837.

Another function of VGAM1126 is therefore inhibition of Adaptor-related Protein Complex 2, Beta 1 Subunit (AP2B1, Accession NM_001282), a gene which links clathrin to receptors in coated vesicles. Accordingly, utilities of VGAM1126 include diagnosis, prevention and treatment of diseases and clinical conditions associated with AP2B1. The function of AP2B1 has been established by previous studies. The beta adaptin subunit of the clathrin coat assembly complex, also referred to as AP2-beta, was cloned from human, rat and bovine cDNA libraries by Ponnambalam et al. (1990) who found that the predicted 937-amino acid proteins are totally conserved between species. The protein is part of the AP2 coat assembly protein complex (see OMIM Ref. No. 601024) and links clathrin (OMIM Ref. No. 118960) to receptors in the coated vesicles. Druck et al. (1995) used a probe from the 3-prime UTR of the human cDNA to map the gene to chromosome 17. Hybrids with portions of chromosome 17 were then used to localize CLAPB1 to 17q11.2-q12.

Full details of the abovementioned studies are described in the following publications, the disclosure of which are hereby incorporated by reference:

Druck, T.; Gu, Y.; Prabhala. G.; Cannizzaro, L. A.; Park, S.-H.; Huebner, K.; Keen, J. H.: Chromosome localization of human genes for clathrin adaptor polypeptides AP2-beta and AP50 and the clathrin-binding protein, VCP. Genomics 30: 94-97, 1995; and Ponnambalam, S.; Robinson, M. S.; Jackson, A. P.; Peiperl, L.; Parham, P.: Conservation and diversity in families of coated vesicle adaptins. J. Biol. Chem. 265:4814-4820, 1990.

Further studies establishing the function and utilities of AP2B1 are found in John Hopkins OMIM database record ID 601025, and in sited publications numbered 9964-9965 listed in the bibliography section hereinbelow, which are also hereby incorporated by reference. ATPase, Aminophospholipid Transporter-like, Class I, Type 8A, Member 2 (ATP8A2, Accession XM_167916) is another VGAM1126 host target gene. ATP8A2 BINDING SITE is HOST TARGET binding site found in the 3' untranslated region of mRNA encoded by ATP8A2, corresponding to a HOST TARGET binding site such as BINDING SITE I, BINDING SITE II or BINDING SITE III. Table 2 illustrates the complementarity of the nucleotide sequences of ATP8A2 BINDING SITE, designated SEQ ID:44917, to the nucleotide sequence of VGAM1126 RNA, herein designated VGAM RNA, also designated SEQ ID:3837.

Another function of VGAM1126 is therefore inhibition of ATPase, Aminophospholipid Transporter-like, Class I, Type 8A, Member 2 (ATP8A2, Accession XM_167916). Accordingly, utilities of VGAM1126 include diagnosis, prevention and treatment of diseases and clinical conditions associated with ATP8A2. AXL Receptor Tyrosine Kinase (AXL, Accession NM_021913) is another VGAM1126 host target gene. AXL BINDING SITE1 and AXL BINDING SITE2 are HOST TARGET binding sites found in untranslated regions of mRNA encoded by AXL, corresponding to HOST TARGET binding sites such as BINDING SITE I, BINDING SITE II or BINDING SITE III. Table 2 illustrates the complementarity of the nucleotide sequences of AXL BINDING SITE1 and AXL BINDING SITE2, designated SEQ ID:22441 and SEQ ID:7420 respectively, to the nucleotide sequence of VGAM1126 RNA, herein designated VGAM RNA, also designated SEQ ID:3837.

Another function of VGAM1126 is therefore inhibition of AXL Receptor Tyrosine Kinase (AXL, Accession NM_021913). Accordingly, utilities of VGAM1126 include diagnosis, prevention and treatment of diseases and clinical conditions associated with AXL. Bone Morphogenetic Protein 3 (osteogenic) (BMP3, Accession NM_001201) is another VGAM1126 host target gene. BMP3 BINDING SITE is HOST TARGET binding site found in the 5' untranslated region of mRNA encoded by BMP3, corresponding to a HOST TARGET binding site such as BINDING SITE I, BINDING SITE II or BINDING SITE III. Table 2 illustrates the complementarity of the nucleotide sequences of BMP3 BINDING SITE, designated SEQ ID:6865, to the nucleotide sequence of VGAM1126 RNA, herein designated VGAM RNA, also designated SEQ ID:3837.

Another function of VGAM1126 is therefore inhibition of Bone Morphogenetic Protein 3 (osteogenic) (BMP3, Accession NM_001201), a gene which induces cartilage and bone formation. Accordingly, utilities of VGAM1126 include diagnosis, prevention and treatment of diseases and clinical conditions associated with BMP3. The function of BMP3 has been established by previous studies. Dickinson et al. (1990) showed that in the mouse the Bmp-3 gene is located on chromosome 5. Arguing from homology of synteny, they suggested that the cognate gene in man is located on either chromosome 4 or chromosome 7. Indeed, using cDNA probes for the analysis of somatic cell hybrid lines, Tabas et al. (1991) assigned the BMP3 gene to 4p14-q21. BMP2A (OMIM Ref. No. 112261) and BMP3 are members of the transforming growth factor-beta supergene family; BMP1 (OMIM Ref. No. 112264) is a novel regulatory protein.

Full details of the abovementioned studies are described in the following publications, the disclosure of which are hereby incorporated by reference:

Dickinson, M. E.; Kobrin, M. S.; Silan, C. M.; Kingsley, D. M.; Justice, M. J.; Miller, D. A.; Ceci, J. D.; Lock, L. F.; Lee, A.; Buchberg, A. M.; Siracusa, L. D.; Lyons, K. M.; Derynck, R.; Hogan, B. L. M.; Copeland, N. G.; Jenkins, N. A.: Chromosomal localization of seven members of the murine TGF-beta superfamily suggests close linkage to several morphogenetic mutant loci. Genomics 6:505-520, 1990; and Tabas, J. A.; Zasloff, M.; Wasmuth, J. J.; Emanuel, B. S.; Altherr, M. R.; McPherson, J. D.; Wozney, J. M.; Kaplan, F. S.: Bone morphogenetic protein: chromosomal localization of human.

Further studies establishing the function and utilities of BMP3 are found in John Hopkins OMIM database record ID 112263, and in sited publications numbered 271 and 11629 listed in the bibliography section hereinbelow, which are also hereby incorporated by reference. Corticotropin Releasing Hormone Receptor 1 (CRHR1, Accession NM_004382) is another VGAM1126 host target gene. CRHR1 BINDING SITE is HOST TARGET binding site found in the 3' untranslated region of mRNA encoded by CRHR1, corresponding to a HOST TARGET binding site such as BINDING SITE I, BINDING SITE II or BINDING SITE III. Table 2 illustrates the complementarity of the nucleotide sequences of CRHR1 BINDING SITE, designated SEQ ID:10606, to the nucleotide sequence of VGAM1126 RNA, herein designated VGAM RNA, also designated SEQ ID:3837.

Another function of VGAM1126 is therefore inhibition of Corticotropin Releasing Hormone Receptor 1 (CRHR1, Accession NM_004382), a gene which likely mediates physiological and behavioral response to stress. Accordingly, utilities of VGAM1126 include diagnosis, prevention and treatment of diseases and clinical conditions associated with CRHR1. The function of CRHR1 and its association with various diseases and clinical conditions, has been established by previous studies, as described hereinabove with reference to VGAM435. Chemokine (C-X3-C motif) Receptor 1 (CX3CR1, Accession XM_047502) is another VGAM1126 host target gene. CX3CR1 BINDING SITE is HOST TARGET binding site found in the 3' untranslated region of mRNA encoded by CX3CR1, corresponding to a HOST TARGET binding site such as BINDING SITE I, BINDING SITE II or BINDING SITE III. Table 2 illustrates the complementarity of the nucleotide sequences of CX3CR1 BINDING SITE, designated SEQ ID:34975, to the nucleotide sequence of VGAM1126 RNA, herein designated VGAM RNA, also designated SEQ ID:3837.

Another function of VGAM1126 is therefore inhibition of Chemokine (C-X3-C motif) Receptor 1 (CX3CR1, Accession XM_047502), a gene which mediates both the adhesive and migratory functions of fractalkine. Accordingly, utilities of VGAM1126 include diagnosis, prevention and treatment of diseases and clinical conditions associated with CX3CR1. The function of CX3CR1 and its association with various diseases and clinical conditions, has been established by previous studies, as described hereinabove with reference to VGAM25. Disabled Homolog 2, Mitogen-responsive Phosphoprotein (Drosophila) (DAB2, Accession NM_001343) is another VGAM1126 host target gene. DAB2 BINDING SITE is HOST TARGET binding site found in the 3' untranslated region of mRNA encoded by DAB2, corresponding to a HOST TARGET binding site such as BINDING SITE I, BINDING SITE II or BINDING SITE III. Table 2 illustrates the complementarity of the nucleotide sequences of DAB2 BINDING SITE, designated SEQ ID:7022, to the nucleotide sequence of VGAM1126 RNA, herein designated VGAM RNA, also designated SEQ ID:3837.

Another function of VGAM1126 is therefore inhibition of Disabled Homolog 2, Mitogen-responsive Phosphoprotein (Drosophila) (DAB2, Accession NM_001343), a gene which may be a component of the csf-1 signal transduction pathway. Accordingly, utilities of VGAM1126 include diagnosis, prevention and treatment of diseases and clinical conditions associated with DAB2. The function of DAB2 and its association with various diseases and clinical conditions, has been established by previous studies, as described hereinabove with reference to VGAM659. EGF-like-domain, Multiple 4 (EGFL4, Accession XM_029883) is another VGAM1126 host target gene. EGFL4 BINDING SITE is HOST TARGET binding site found in the 5' untranslated region of mRNA encoded by EGFL4, corresponding to a HOST TARGET binding site such as BINDING SITE I, BINDING SITE II or BINDING SITE III. Table 2 illustrates the complementarity of the nucleotide sequences of EGFL4 BINDING SITE, designated SEQ ID:30960, to the nucleotide sequence of VGAM1126 RNA, herein designated VGAM RNA, also designated SEQ ID:3837.

Another function of VGAM1126 is therefore inhibition of EGF-like-domain, Multiple 4 (EGFL4, Accession XM_029883). Accordingly, utilities of VGAM1126 include diagnosis, prevention and treatment of diseases and clinical conditions associated with EGFL4. F-box and Leucine-rich Repeat Protein 11 (FBXL11, Accession NM_012308) is another VGAM1126 host target gene. FBXL11 BINDING SITE is HOST TARGET binding site found in the 3' untranslated region of mRNA encoded by FBXL11, corresponding to a HOST TARGET binding site such as BINDING SITE I, BINDING SITE II or BINDING SITE III. Table 2 illustrates the complementarity of the nucleotide sequences of FBXL11 BINDING SITE, designated SEQ ID:14679, to the nucleotide sequence of VGAM1126 RNA, herein designated VGAM RNA, also designated SEQ ID:3837.

Another function of VGAM1126 is therefore inhibition of F-box and Leucine-rich Repeat Protein 11 (FBXL11, Accession NM_012308), a gene which are BTB/POZ domain-containing zinc finger proteins implicated in oncogenesis. Accordingly, utilities of VGAM1126 include diagnosis, prevention and treatment of diseases and clinical conditions associated with FBXL11. The function of FBXL11 and its association with various diseases and clinical conditions, has been established by previous studies, as described hereinabove with reference to VGAM404. Flotillin 2 (FLOT2, Accession NM_004475) is another VGAM1126 host target gene. FLOT2 BINDING SITE is HOST TARGET binding site found in the 3' untranslated region of mRNA encoded by FLOT2, corresponding to a HOST TARGET binding site such as BINDING SITE I, BINDING SITE II or BINDING SITE III. Table 2 illustrates the complementarity of the nucleotide sequences of FLOT2 BINDING SITE, designated SEQ ID:10792, to the nucleotide sequence of VGAM1126 RNA, herein designated VGAM RNA, also designated SEQ ID:3837.

Another function of VGAM1126 is therefore inhibition of Flotillin 2 (FLOT2, Accession NM_004475), a gene which Epidermal surface antigen (flotillin 2). Accordingly, utilities of VGAM1126 include diagnosis, prevention and treatment of diseases and clinical conditions associated with FLOT2. The function of FLOT2 has been established by previous studies. Human epidermal surface antigen-1 was identified as a 35-kD antigen by means of a mouse monoclonal antibody raised against human keratinocytes. The monoclonal antibody was found to cause keratinocyte dissociation in vitro; hence, the conclusion that the native protein is involved in cell adhesion. Cho et al. (1995) found that mouse Esa cDNA encodes a 379-amino acid protein that is 99.2% identical to the human, differing at only 3 amino acids. Cho et al. (1995) found that both ‘nude’ and control mice have a second Esa mRNA transcript that conserves amino acid sequence and molecular mass. The mouse and human 5-prime- and 3-prime untranslated sequences are conserved. Similar RNA folding patterns of the 5-prime untranslated region are predicted despite a 91-bp insertion in the mouse. Bickel et al. (1997) found that mouse Flot2 consistently copurifies with Flot1 (OMIM Ref. No. 606998) and with caveolin-1 (OMIM Ref. No. 601047) in the purification of caveolin-rich membranes. Baumann et al. (2000) screened a yeast 2-hybrid library using the N-terminal region of CAP (OMIM Ref. No. 605264) and identified the caveolar protein flotillin. Flotillin forms a ternary complex with CAP and the CBL proto-oncogene product (OMIM Ref. No. 165360), directing the localization of the CAP-CBL complex to a lipid raft subdomain of the plasma membrane. Localization of the CBL-CAP complex to lipid rafts generates a pathway that is crucial in the regulation of glucose uptake. Schroeder et al. (1991) isolated a cDNA for an epidermal surface antigen believed to be involved in epidermal cell adhesion. By analysis of a somatic cell hybrid panel and in situ hybridization using the ESA cDNA, the gene was mapped to 17q11-q12 in the region containing the NF1 gene (OMIM Ref. No. 162200). Using a RFLP within the ESA1 gene, they showed tight linkage of ESA1 with NF1; maximal lod=6.92 at theta=0.0. By studying somatic cell hybrids carrying the 2 chromosome 17 translocations with breakpoints within the NF1 gene, t (1;17) and t (17;22), Schroeder et al. (1991) showed that the ESA1 gene is located centromeric to the t (1;17) breakpoint. It remained to be determined whether this represented another of the genes located within the NF1 gene and transcribed in the opposite direction. Kayes et al. (1992) made that determination; physical mapping of an M17S1 cDNA on somatic cell hybrids, yeast artificial chromosomes, and DNA from an NF1 patient with a deletion involving an entire NF1 allele showed that M17S1 is located at least 180 kb centromeric to the NF1 gene. The distance between the genes suggested that M17S1 is unlikely to contribute to the NF1 phenotype. Cho et al. (1995) mapped the mouse Esa gene to chromosome 11. Although the mouse Esa gene and the 'nude' locus map to the same region of chromosome 11, Cho et al. (1995) detected no abnormalities in protein, mRNA, cDNA or genomic Esa sequences in nude mice.

Full details of the abovementioned studies are described in the following publications, the disclosure of which are hereby incorporated by reference:

Cho, Y.-J.; Chema, D.; Moskow, J. J.; Cho, M.; Schroeder, W. T.; Overbeek, P.; Buchberg, A. M.; Duvic, M.: Epidermal surface antigen (MS17S1) is highly conserved between mouse and human. Genomics 27:251-258, 1995; and Schroeder, W. T.; Siciliano, M. J.; Stewart-Galetka, S. L.; Duvic, M.: The human gene for an epidermal surface antigen (M17S1) is located at 17q11-12. Genomics 11:481-482, 1991.

Further studies establishing the function and utilities of FLOT2 are found in John Hopkins OMIM database record ID 131560, and in sited publications numbered 4598-4603 listed in the bibliography section hereinbelow, which are also hereby incorporated by reference. FXYD Domain Containing Ion Transport Regulator 6 (FXYD6, Accession NM_022003) is another VGAM1126 host target gene. FXYD6 BINDING SITE is HOST TARGET binding site found in the 3' untranslated region of mRNA encoded by FXYD6, corresponding to a HOST TARGET binding site such as BINDING SITE I, BINDING SITE II or BINDING SITE III. Table 2 illustrates the complementarity of the nucleotide sequences of FXYD6 BINDING SITE, designated SEQ ID:22546, to the nucleotide sequence of VGAM1126 RNA, herein designated VGAM RNA, also designated SEQ ID:3837.

Another function of VGAM1126 is therefore inhibition of FXYD Domain Containing Ion Transport Regulator 6 (FXYD6, Accession NM_022003). Accordingly, utilities of VGAM1126 include diagnosis, prevention and treatment of diseases and clinical conditions associated with FXYD6. Growth Factor Independent 1 (GFI1, Accession NM_005263) is another VGAM1126 host target gene. GFI1 BINDING SITE is HOST TARGET binding site found in the 3' untranslated region of mRNA encoded by GFI1, corresponding to a HOST TARGET binding site such as BINDING SITE I, BINDING SITE II or BINDING SITE III. Table 2 illustrates the complementarity of the nucleotide sequences of GFI1 BINDING SITE, designated SEQ ID:11768, to the nucleotide sequence of VGAM1126 RNA, herein designated VGAM RNA, also designated SEQ ID:3837.

Another function of VGAM1126 is therefore inhibition of Growth Factor Independent 1 (GFI1, Accession NM_005263). Accordingly, utilities of VGAM1126 include diagnosis, prevention and treatment of diseases and clinical conditions associated with GFI1. Insulin-like Growth Factor 2 (somatomedin A) (IGF2, Accession NM_000612) is another VGAM1126 host target gene. IGF2 BINDING SITE is HOST TARGET binding site found in the 5' untranslated region of mRNA encoded by IGF2, corresponding to a HOST TARGET binding site such as BINDING SITE I, BINDING SITE II or BINDING SITE III. Table 2 illustrates the complementarity of the nucleotide sequences of IGF2 BINDING SITE, designated SEQ ID:6214, to the nucleotide sequence of VGAM1126 RNA, herein designated VGAM RNA, also designated SEQ ID:3837.

Another function of VGAM1126 is therefore inhibition of Insulin-like Growth Factor 2 (somatomedin A) (IGF2, Accession NM_000612). Accordingly, utilities of VGAM1126 include diagnosis, prevention and treatment of diseases and clinical conditions associated with IGF2. Inositol Polyphosphate-1-phosphatase (INPP1, Accession NM_002194) is another VGAM1126 host target gene. INPP1 BINDING SITE is HOST TARGET binding site found in the 5' untranslated region of mRNA encoded by INPP1, corresponding to a HOST TARGET binding site such as BINDING SITE I, BINDING SITE II or BINDING SITE III. Table 2 illustrates the complementarity of the nucleotide sequences of INPP1 BINDING SITE, designated SEQ ID:7950, to the nucleotide sequence of VGAM1126 RNA, herein designated VGAM RNA, also designated SEQ ID:3837.

Another function of VGAM1126 is therefore inhibition of Inositol Polyphosphate-1-phosphatase (INPP1, Accession NM_002194), a gene which hydrolyzes inositol 1,3,4-trisphosphate to inositol 1,4-bisphosphate. Accordingly, utilities of VGAM1126 include diagnosis, prevention and treatment of diseases and clinical conditions associated with INPP1. The function of INPP1 has been established by previous studies. Cells respond to extracellular stimuli through complicated networks. Phosphatidylinositol turnover plays a key role in intracellular signaling. Inositol polyphosphate 1-phosphatase, an enzyme in the phosphatidylinositol signaling pathway, catalyzes the hydrolysis of the 1 position phosphate from inositol 1,3,4-trisphosphate (Ins (1,3,4)P3) and inositol 1,4-bisphosphate (Ins (1,4)P2). York et al. (1993) isolated a cDNA for the human counterpart by low stringency hybridization using a cDNA encoding the bovine enzyme. The 1.74-kb human cDNA predicted a protein of 399 amino acids. The human and bovine enzymes show 84% amino acid sequence identity. Northern blot analysis of a variety of human tissues demonstrated that a 1.9-kb mRNA is ubiquitously expressed, with highest levels in pancreas and kidney. York et al. (1993) suggested INPP1 as a candidate gene for inherited psychiatric disorders that respond to lithium ions, an inhibitor of the enzyme. Woodcock et al. (2002) studied the role of inositol polyphosphates in cardiac hypertrophy, using primary cultures of neonatal rat ventricular cardiomyocytes as a model. Hypertrophy was induced by stimulating alpha-adrenergic receptors (see OMIM Ref. No. ADRA1B; 104220) or by the spontaneous contraction of dense cultures. Both hypertrophy models showed increased levels of Ins (1,4)P2 as well as the characteristic increased expression of several marker genes and increased ribosome synthesis. Transfection and overexpression of INPP1 reduced expression of hypertrophy markers and reduced the increase in ribosomal DNA transcription. Ins (1,4)P2 levels were also increased in mouse hearts hypertrophied by pressure overload. Woodcock et al. (2002) concluded that reduced INPP1 activity may have a role in cardiac hypertrophy.

Full details of the abovementioned studies are described in the following publications, the disclosure of which are hereby incorporated by reference:

Okabe, I.; Nussbaum, R. L.: Identification and chromosomal mapping of the mouse inositol polyphosphate 1-phosphatase gene. Genomics 30:358-360, 1995; and Woodcock, E. A.; Wang, B. H.; Arthur, J. F.; Lennard, A.; Matkovich, S. J.; Du, X.-J.; Brown, J. H.; Hannan, R. D.: Inositol polyphosphate 1-phosphatase is a novel antihypertrophic fact.

Further studies establishing the function and utilities of INPP1 are found in John Hopkins OMIM database record ID 147263, and in sited publications numbered 4970-4972 listed in the bibliography section hereinbelow, which are also hereby incorporated by reference. L1 Cell Adhesion Molecule (hydrocephalus, stenosis of aqueduct of Sylvius 1, MASA (mental retardation, aphasia, shuffling gait and adducted thumbs) Syndrome, Spastic Paraplegia 1) (L1CAM, Accession NM_024003) is another VGAM1126 host target gene. L1CAM BINDING SITE1 and L1CAM BINDING SITE2 are HOST TARGET binding sites found in untranslated regions of mRNA encoded by L1CAM, corresponding to HOST TARGET binding sites such as BINDING SITE I, BINDING SITE II or BINDING SITE III. Table 2 illustrates the complementarity of the nucleotide sequences of L1CAM BINDING SITE1 and L1CAM BINDING SITE2, designated SEQ ID:23430 and SEQ ID:6002 respectively, to the nucleotide sequence of VGAM1126 RNA, herein designated VGAM RNA, also designated SEQ ID:3837.

Another function of VGAM1126 is therefore inhibition of L1 Cell Adhesion Molecule (hydrocephalus, stenosis of aqueduct of Sylvius 1, MASA (mental retardation, aphasia, shuffling gait and adducted thumbs) Syndrome, Spastic Paraplegia 1) (L1CAM, Accession NM_024003). Accordingly, utilities of VGAM1126 include diagnosis, prevention and treatment of diseases and clinical conditions associated with L1CAM. Nerve Growth Factor Receptor (TNFR superfamily, member 16) (NGFR, Accession NM_002507) is another VGAM1126 host target gene. NGFR BINDING SITE1 and NGFR BINDING SITE2 are HOST TARGET binding sites found in untranslated regions of mRNA encoded by NGFR, corresponding to HOST TARGET binding sites such as BINDING SITE I, BINDING SITE II or BINDING SITE III. Table 2 illustrates the complementarity of the nucleotide sequences of NGFR BINDING SITE1 and NGFR BINDING SITE2, designated SEQ ID:8330 and SEQ ID:8331 respectively, to the nucleotide sequence of VGAM1126 RNA, herein designated VGAM RNA, also designated SEQ ID:3837.

Another function of VGAM1126 is therefore inhibition of Nerve Growth Factor Receptor (TNFR superfamily, member 16) (NGFR, Accession NM_002507), a gene which can mediate cell survival as well as cell death of neural cells. Accordingly, utilities of VGAM1126 include diagnosis, prevention and treatment of diseases and clinical conditions associated with NGFR. The function of NGFR and its association with various diseases and clinical conditions, has been established by previous studies, as described hereinabove with reference to VGAM212. Neurexin 1 (NRXN1, Accession NM_004801) is another VGAM1126 host target gene. NRXN1 BINDING SITE1 and NRXN1 BINDING SITE2 are HOST TARGET binding sites found in untranslated regions of mRNA encoded by NRXN1, corresponding to HOST TARGET binding sites such as BINDING SITE I, BINDING SITE II or BINDING SITE III. Table 2 illustrates the complementarity of the nucleotide sequences of NRXN1 BINDING SITE1 and NRXN1 BINDING SITE2, designated SEQ ID:11222 and SEQ ID:26788 respectively, to the nucleotide sequence of VGAM1126 RNA, herein designated VGAM RNA, also designated SEQ ID:3837.

Another function of VGAM1126 is therefore inhibition of Neurexin 1 (NRXN1, Accession NM_004801), a gene which may be involved in cell recognition, cell adhesion, and mediate intracellular signaling. Accordingly, utilities of VGAM1126 include diagnosis, prevention and treatment of diseases and clinical conditions associated with NRXN1. The function of NRXN1 and its association with various diseases and clinical conditions, has been established by previous studies, as described hereinabove with reference to VGAM191. Protocadherin 11 Y-linked (PCDH11Y, Accession NM_032973) is another VGAM1126 host target gene. PCDH11Y BINDING SITE is HOST TARGET binding site found in the 3' untranslated region of mRNA encoded by PCDH11Y, corresponding to a HOST TARGET binding site such as BINDING SITE I, BINDING SITE II or BINDING SITE III. Table 2 illustrates the complementarity of the nucleotide sequences of PCDH11Y BINDING SITE, designated SEQ ID:26822, to the nucleotide sequence of VGAM1126 RNA, herein designated VGAM RNA, also designated SEQ ID:3837.

Another function of VGAM1126 is therefore inhibition of Protocadherin 11 Y-linked (PCDH11Y, Accession NM_032973). Accordingly, utilities of VGAM1126 include diagnosis, prevention and treatment of diseases and clinical conditions associated with PCDH11Y. PCTAIRE Protein Kinase 3 (PCTK3, Accession XM_053746) is another VGAM1126 host target gene. PCTK3 BINDING SITE is HOST TARGET binding site found in the 3' untranslated region of mRNA encoded by PCTK3, corresponding to a HOST TARGET binding site such as BINDING SITE I, BINDING SITE II or BINDING SITE III. Table 2 illustrates the complementarity of the nucleotide sequences of PCTK3 BINDING SITE, designated SEQ ID:36126, to the nucleotide sequence of VGAM1126 RNA, herein designated VGAM RNA, also designated SEQ ID:3837.

Another function of VGAM1126 is therefore inhibition of PCTAIRE Protein Kinase 3 (PCTK3, Accession XM_053746), a gene which may play a role in signal transduction cascades in terminally differentiated cells. Accordingly, utilities of VGAM1126 include diagnosis, prevention and treatment of diseases and clinical conditions associated with PCTK3. The function of PCTK3 and its association with various diseases and clinical conditions, has been established by previous studies, as described hereinabove with reference to VGAM132. Protein Phosphatase 2, Regulatory Subunit B (B56), Beta Isoform (PPP2R5B, Accession NM_006244) is another VGAM1126 host target gene. PPP2R5B BINDING SITE is HOST TARGET binding site found in the 3" untranslated region of mRNA encoded by PPP2R5B, corresponding to a HOST TARGET binding site such as BINDING SITE I, BINDING SITE II or BINDING SITE III. Table 2 illustrates the complementarity of the nucleotide sequences of PPP2R5B BINDING SITE, designated SEQ ID:12913, to the nucleotide sequence of VGAM1126 RNA, herein designated VGAM RNA, also designated SEQ ID:3837.

Another function of VGAM1126 is therefore inhibition of Protein Phosphatase 2, Regulatory Subunit B (B56), Beta Isoform (PPP2R5B, Accession NM_006244), a gene which is a regulatory subunit of protein phosphatase 2A. Accordingly, utilities of VGAM1126 include diagnosis, prevention and treatment of diseases and clinical conditions associated with PPP2R5B. The function of PPP2R5B and its association with various diseases and clinical conditions, has been established by previous studies, as described hereinabove with reference to VGAM264. Pleckstrin Homology, Sec7 and Coiled/coil Domains 4 (PSCD4, Accession NM_013385) is another VGAM1126 host target gene. PSCD4 BINDING SITE is HOST TARGET binding site found in the 3' untranslated region of mRNA encoded by PSCD4, corresponding to a HOST TARGET binding site such as BINDING SITE I, BINDING SITE II or BINDING SITE III. Table 2 illustrates the complementarity of the nucleotide sequences of PSCD4 BINDING SITE, designated SEQ ID:15036, to the nucleotide sequence of VGAM1126 RNA, herein designated VGAM RNA, also designated SEQ ID:3837.

Another function of VGAM1126 is therefore inhibition of Pleckstrin Homology, Sec7 and Coiled/coil Domains 4 (PSCD4, Accession NM_013385), a gene which promotes guanine-nucleotide exchange on arf1 and arf5. Accordingly, utilities of VGAM1126 include diagnosis, prevention and treatment of diseases and clinical conditions associated with PSCD4. The function of PSCD4 and its association with various diseases and clinical conditions, has been established by previous studies, as described hereinabove with reference to VGAM615. Pyrroline-5-carboxylate Reductase 1 (PYCR1, Accession XM_046472) is another VGAM1126 host target gene. PYCR1 BINDING SITE is HOST TARGET binding site found in the 3' untranslated region of mRNA encoded by PYCR1, corresponding to a HOST TARGET binding site such as BINDING SITE I, BINDING SITE II or BINDING SITE III. Table 2 illustrates the complementarity of the nucleotide sequences of PYCR1 BINDING SITE, designated SEQ ID:34728, to the nucleotide sequence of VGAM1126 RNA, herein designated VGAM RNA, also designated SEQ ID:3837.

Another function of VGAM1126 is therefore inhibition of Pyrroline-5-carboxylate Reductase 1 (PYCR1, Accession XM_046472), a gene which catalyzes the NAD(P)H-dependent conversion of pyrroline-5-carboxylate to proline. Accordingly, utilities of VGAM1126 include diagnosis, prevention and treatment of diseases and clinical conditions associated with PYCR1. The function of PYCR1 and its association with various diseases and clinical conditions, has been established by previous studies, as described hereinabove with reference to VGAM178. Solute Carrier Family 2 (facilitated glucose transporter), Member 3 (SLC2A3, Accession NM_006931) is another VGAM1126 host target gene. SLC2A3 BINDING SITE is HOST TARGET binding site found in the 3' untranslated region of mRNA encoded by SLC2A3, corresponding to a HOST TARGET binding site such as BINDING SITE I, BINDING SITE II or BINDING SITE III. Table 2 illustrates the complementarity of the nucleotide sequences of SLC2A3 BINDING SITE, designated SEQ ID:13816, to the nucleotide sequence of VGAM1126 RNA, herein designated VGAM RNA, also designated SEQ ID:3837.

Another function of VGAM1126 is therefore inhibition of Solute Carrier Family 2 (facilitated glucose transporter), Member 3 (SLC2A3, Accession NM_006931), a gene which probably is a neuronal glucose transporter. Accordingly, utilities of VGAM1126 include diagnosis, prevention and treatment of diseases and clinical conditions associated with SLC2A3. The function of SLC2A3 and its association with various diseases and clinical conditions, has been established by previous studies, as described hereinabove with reference to VGAM247. SNL (Accession NM_003088) is another VGAM1126 host target gene. SNL BINDING SITE is HOST TARGET binding site found in the 3' untranslated region of mRNA encoded by SNL, corresponding to a HOST TARGET binding site such as BINDING SITE I, BINDING SITE II or BINDING SITE III. Table 2 illustrates the complementarity of the nucleotide sequences of SNL BINDING SITE, designated SEQ ID:9059, to the nucleotide sequence of VGAM1126 RNA, herein designated VGAM RNA, also designated SEQ ID:3837.

Another function of VGAM1126 is therefore inhibition of SNL (Accession NM_003088), a gene which organizes filamentous actin into bundles with a minimum of 4.1:1 actin/fascin ratio. Accordingly, utilities of VGAM1126 include diagnosis, prevention and treatment of diseases and clinical conditions associated with SNL. The function of SNL and its association with various diseases and clinical conditions, has been established by previous studies, as described hereinabove with reference to VGAM675. Transforming Growth Factor, Beta 3 (TGFB3, Accession NM_003239) is another VGAM1126 host target gene. TGFB3 BINDING SITE is HOST TARGET binding site found in the 3' untranslated region of mRNA encoded by TGFB3, corresponding to a HOST TARGET binding site such as BINDING SITE I, BINDING SITE II or BINDING SITE III. Table 2 illustrates the complementarity of the nucleotide sequences of TGFB3 BINDING SITE, designated SEQ ID:9233, to the nucleotide sequence of VGAM1126 RNA, herein designated VGAM RNA, also designated SEQ ID:3837.

Another function of VGAM1126 is therefore inhibition of Transforming Growth Factor, Beta 3 (TGFB3, Accession NM_003239), a gene which is involved in embryogenesis and cell differentiation. Accordingly, utilities of VGAM1126 include diagnosis, prevention and treatment of diseases and clinical conditions associated with TGFB3. The function of TGFB3 has been established by previous studies. Type beta transforming growth factors are polypeptides that act hormonally to control the proliferation and differentiation of multiple cell types. A cDNA clone for a third form of TGFB was isolated by ten Dijke et al. (1988). The C-terminal 112 amino acids of TGF-beta-3 share approximately 80% sequence identity with beta-1 (OMIM Ref. No. 190180) and beta-2 (OMIM Ref. No. 190220). By Southern analysis of DNA prepared from somatic cell hybrids and by in situ hybridization, ten Dijke et al. (1988) assigned the TGFB3 gene to 14q23-q24. Barton et al. (1988) likewise assigned the TGFB3 gene to chromosome 14 and regionalized it to 14q24 by Southern blot analysis of hybrid cell DNAs and by in situ hybridization. The homologous gene in the mouse, Tsfb-3, was mapped to chromosome 12 (Barton et al., 1988; Dickinson et al., 1990). Graycar et al. (1989) purified to apparent homogeneity human TGFB3 and evaluated its activities in comparison to TGFB1 and TGFB2. Lee and Nowak (2001) compared expression of the TGFB isoforms in normal myometrium and benign leiomyoma tumors of the uterus (OMIM Ref. No. 150699) and examined the effects of TGFBs on cell proliferation and collagen production by these cells in vitro. Northern blot analysis showed that the levels of TGFB1 mRNA were similar between leiomyoma and myometrium, whereas leiomyoma showed 5-fold higher levels of expression of TGFB3 mRNA than autologous myometrium. Expression of TGFB3 protein detected by immunohistochemistry was much more intense in leiomyoma tissues than in corresponding myometrium. The authors concluded that their results support the hypothesis that alterations in the TGFB system produce loss of sensitivity to the antiproliferative effects of TGFB, and increased expression of TGFB3 may contribute to the growth of these tumors. Animal model experiments lend further support to the function of TGFB3. Proetzel et al. (1995) produced Tgfb3-null mice in which exon 6 of the Tgfb3 gene was replaced by the neomycin-resistance gene. Whereas heterozygotes had no apparent phenotypic change, homozygotes had an incompletely penetrant failure of the palatal shelves to fuse, leading to cleft palate. The defect appeared to result from impaired adhesion of the apposing medial edge epithelial of the palatal shelves and subsequent elimination of the midline epithelial seam. No craniofacial abnormalities were observed. Defective palatogenesis was also found in homozygous Tgfb3-null mutant mice by Kaartinen et al. (1995) who also found a consistent delay in pulmonary development. They suggested that the study demonstrates an essential function for TGF-beta-3 in normal palate and lung morphogenesis and implicates this cytokine in epithelial-mesenchymal interaction.

It is appreciated that the abovementioned animal model for TGFB3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Graycar, J. L.; Miller, D. A.; Arrick, B. A.; Lyons, R. M.; Moses, H. L.; Derynck, R.: Human transforming growth factor-beta-3: recombinant expression, purification, and biological activities in comparison with transforming growth factors-beta-1 and beta-2. Molec. Endocr. 3:1977-1986, 1989; and Proetzel, G.; Pawlowski, S. A.; Wiles, M. V.; Yin, M.; Boivin, G. P.; Howles, P. N.; Ding, J.; Ferguson, M. W. J.; Doetschman, T.: Transforming growth factor-beta-3 is required for seco.

Further studies establishing the function and utilities of TGFB3 are found in John Hopkins OMIM database record ID 190230, and in sited publications numbered 1235 and 5953-5959 listed in the bibliography section hereinbelow, which are also hereby incorporated by reference. Toll-like Receptor 5 (TLR5, Accession NM_003268) is another VGAM1126 host target gene. TLR5 BINDING SITE is HOST TARGET binding site found in the 5' untranslated region of mRNA encoded by TLR5, corresponding to a HOST TARGET binding site such as BINDING SITE I, BINDING SITE II or BINDING SITE III. Table 2 illustrates the complementarity of the nucleotide sequences of TLR5 BINDING SITE, designated SEQ ID:9276, to the nucleotide sequence of VGAM1126 RNA, herein designated VGAM RNA, also designated SEQ ID:3837.

Another function of VGAM1126 is therefore inhibition of Toll-like Receptor 5 (TLR5, Accession NM_003268), a gene which participates in the innate immune response to bacterial flagellins. Accordingly, utilities of VGAM1126 include diagnosis, prevention and treatment of diseases and clinical conditions associated with TLR5. The function of TLR5 has been established by previous studies. By searching an EST database for human Toll homologs, Chaudhary et al. (1998) identified cDNA sequences from 2 genes that they called TIL3 and TIL4 (TLR2; 603028). Muzio et al. (2000) determined the differential expression pattern of the TLRs in leukocytes. Like TLR2 and TLR4, TLR5 was expressed in myelomonocytic cells, but at lower levels. Hayashi et al. (2001) showed that expression of TLR5 induces NF-kappa-B activation and TNFA (OMIM Ref. No. 191160) production. Pathogen-associated molecular patterns (PAMPs) known to stimulate other TLR family members failed to stimulate TLR5; however, luciferase reporter assays indicated TLR5 activation in gram-positive and -negative bacterial culture supernatants. By fractionation of Listeria culture supernatants followed by SDS-PAGE, Hayashi et al. (2001) identified flagellin as the TLR5 ligand. Flagellin, a principal component of bacterial flagella, is a virulence factor recognized by the innate immune system in plants, insects, and mammals. Expression of flagellin in nonflagellated bacteria resulted in TLR5 activation, and deletion of flagellin from flagellated bacteria abrogated TLR5 activation. Hayashi et al. (2001) demonstrated that injection of flagellin induces the production of IL6 (OMIM Ref. No. 147620) in wildtype mice, but not in those lacking the MyD88 (OMIM Ref. No. 602170) adaptor protein, required for TLR signaling. Hayashi et al. (2001) concluded that TLR5 is a pattern-recognition receptor and that its PAMP is flagellin, a protein with conserved N and C termini in a broad group of motile pathogens.

Full details of the abovementioned studies are described in the following publications, the disclosure of which are hereby incorporated by reference:

Chaudhary, P. M.; Ferguson, C.; Nguyen, V.; Nguyen, O.; Massa, H. F.; Eby, M.; Jasmin, A.; Trask, B. J.; Hood, L.; Nelson, P. S.: Cloning and characterization of two Toll/interleukin-1 receptor-like genes TIL3 and TIL4: evidence for a multi-gene receptor family in human S. Blood 91:4020-4027, 1998; and Hayashi, F.; Smith, K. D.; Ozinsky, A.,; Hawn, T. R.; Yi, E. C.; Goodlett, D. R.; Eng, J. K.; Akira, S.; Underhill, D. M.; Aderem, A.: The innate immune response to bacterial flagellin.

Further studies establishing the function and utilities of TLR5 are found in John Hopkins OMIM database record ID 603031, and in sited publications numbered 7953, 673 and 9837-9838 listed in the bibliography section hereinbelow, which are also hereby incorporated by reference. Ubiquitination Factor E4A (UFD2 homolog, yeast) (UBE4A, Accession NM_004788) is another VGAM1126 host target gene. UBE4A BINDING SITE is HOST TARGET binding site found in the 3' untranslated region of mRNA encoded by UBE4A, corresponding to a HOST TARGET binding site such as BINDING SITE I, BINDING SITE II or BINDING SITE III. Table 2 illustrates the complementarity of the nucleotide sequences of UBE4A BINDING SITE, designated SEQ ID:11195, to the nucleotide sequence of VGAM1126 RNA, herein designated VGAM RNA, also designated SEQ ID:3837.

Another function of VGAM1126 is therefore inhibition of Ubiquitination Factor E4A (UFD2 homolog, yeast) (UBE4A, Accession NM_004788), a gene which binds to the ubiquitin moieties of preformed conjugates and catalyzes ubiquitin chain assembly in conjunction with E1, E2, and E3. Accordingly, utilities of VGAM1126 include diagnosis, prevention and treatment of diseases and clinical conditions associated with UBE4A. The function of UBE4A and its association with various diseases and clinical conditions, has been established by previous studies, as described hereinabove with reference to VGAM60. ABLIM (Accession NM_002313) is another VGAM1126 host target gene. ABLIM BINDING SITE1 and ABLIM BINDING SITE2 are HOST TARGET binding sites found in untranslated regions of mRNA encoded by ABLIM, corresponding to HOST TARGET binding sites such as BINDING SITE I, BINDING SITE II or BINDING SITE III. Table 2 illustrates the complementarity of the nucleotide sequences of ABLIM BINDING SITE1 and ABLIM BINDING SITE2, designated SEQ ID:8110 and SEQ ID:13543 respectively, to the nucleotide sequence of VGAM1126 RNA, herein designated VGAM RNA, also designated SEQ ID:3837.

Another function of VGAM1126 is therefore inhibition of ABLIM (Accession NM_002313). Accordingly, utilities of VGAM1126 include diagnosis, prevention and treatment of diseases and clinical conditions associated with ABLIM. Calneuron 1 (CALN1, Accession NM_031468) is another VGAM1126 host target gene. CALN1 BINDING SITE is HOST TARGET binding site found in the 3' untranslated region of mRNA encoded by CALN1, corresponding to a HOST TARGET binding site such as BINDING SITE I, BINDING SITE II or BINDING SITE III. Table 2 illustrates the complementarity of the nucleotide sequences of CALN1 BINDING SITE, designated SEQ ID:25512, to the nucleotide sequence of VGAM1126 RNA, herein designated VGAM RNA, also designated SEQ ID:3837.

Another function of VGAM1126 is therefore inhibition of Calneuron 1 (CALN1, Accession NM_031468). Accordingly, utilities of VGAM1126 include diagnosis, prevention and treatment of diseases and clinical conditions associated with CALN1. Chloride Intracellular Channel 2 (CLIC2, Accession NM_001289) is another VGAM1126 host target gene. CLIC2 BINDING SITE is HOST TARGET binding site found in the 3' untranslated region of mRNA encoded by CLIC2, corresponding to a HOST TARGET binding site such as BINDING SITE I, BINDING SITE II or BINDING SITE III. Table 2 illustrates the complementarity of the nucleotide sequences of CLIC2 BINDING SITE, designated SEQ ID:6966, to the nucleotide sequence of VGAM1126 RNA, herein designated VGAM RNA, also designated SEQ ID:3837.

Another function of VGAM1126 is therefore inhibition of Chloride Intracellular Channel 2 (CLIC2, Accession NM_001289). Accordingly, utilities of VGAM1126 include diagnosis, prevention and treatment of diseases and clinical conditions associated with CLIC2. Calsyntenin 2 (CLSTN2, Accession NM_022131) is another VGAM1126 host target gene. CLSTN2 BINDING SITE is HOST TARGET binding site found in the 3' untranslated region of mRNA encoded by CLSTN2, corresponding to a HOST TARGET binding site such as BINDING SITE I, BINDING SITE II or BINDING SITE III. Table 2 illustrates the complementarity of the nucleotide sequences of CLSTN2 BINDING SITE, designated SEQ ID:22695, to the nucleotide sequence of VGAM1126 RNA, herein designated VGAM RNA, also designated SEQ ID:3837.

Another function of VGAM1126 is therefore inhibition of Calsyntenin 2 (CLSTN2, Accession NM_022131). Accordingly, utilities of VGAM1126 include diagnosis, prevention and treatment of diseases and clinical conditions associated with CLSTN2. D15Wsu75e (Accession XM_039495) is another VGAM1126 host target gene. D15Wsu75e BINDING SITE is HOST TARGET binding site found in the 3' untranslated region of mRNA encoded by D15Wsu75e, corresponding to a HOST TARGET binding site such as BINDING SITE I, BINDING SITE II or BINDING SITE III. Table 2 illustrates the complementarity of the nucleotide sequences of D15Wsu75e BINDING SITE, designated SEQ ID:33100, to the nucleotide sequence of VGAM1126 RNA, herein designated VGAM RNA, also designated SEQ ID:3837.

Another function of VGAM1126 is therefore inhibition of D15Wsu75e (Accession XM_039495). Accordingly, utilities of VGAM1126 include diagnosis, prevention and treatment of diseases and clinical conditions associated with D15Wsu75e. DKFZP564L2423 (Accession XM_031015) is another VGAM1126 host target gene. DKFZP564L2423 BINDING SITE is HOST TARGET binding site found in the 3' untranslated region of mRNA encoded by DKFZP564L2423, corresponding to a HOST TARGET binding site such as BINDING SITE I, BINDING SITE II or BINDING SITE III. Table 2 illustrates the complementarity of the nucleotide sequences of DKFZP564L2423 BINDING SITE, designated SEQ ID:31258, to the nucleotide sequence of VGAM1126 RNA, herein designated VGAM RNA, also designated SEQ ID:3837.

Another function of VGAM1126 is therefore inhibition of DKFZP564L2423 (Accession XM_031015). Accordingly, utilities of VGAM1126 include diagnosis, prevention and treatment of diseases and clinical conditions associated with DKFZP564L2423. DKFZp761G0313 (Accession XM_038026) is another VGAM1126 host target gene. DKFZp761G0313 BINDING SITE is HOST TARGET binding site found in the 3' untranslated region of mRNA encoded by DKFZp761G0313, corresponding to a HOST TARGET binding site such as BINDING SITE I, BINDING SITE II or BINDING SITE III. Table 2 illustrates the complementarity of the nucleotide sequences of DKFZp761G0313 BINDING SITE, designated SEQ ID:32739, to the nucleotide sequence of VGAM1126 RNA, herein designated VGAM RNA, also designated SEQ ID:3837.

Another function of VGAM1126 is therefore inhibition of DKFZp761G0313 (Accession XM_038026). Accordingly, utilities of VGAM1126 include diagnosis, prevention and treatment of diseases and clinical conditions associated with DKFZp761G0313. Fer-1-like 4 (C. elegans) (FER1L4, Accession NM_025206) is another VGAM1126 host target gene. FER1L4 BINDING SITE is HOST TARGET binding site found in the 3' untranslated region of mRNA encoded by FER1L4, corresponding to a HOST TARGET binding site such as BINDING SITE I, BINDING SITE II or BINDING SITE III. Table 2 illustrates the complementarity of the nucleotide sequences of FER1L4 BINDING SITE, designated SEQ ID:24872, to the nucleotide sequence of VGAM1126 RNA, herein designated VGAM RNA, also designated SEQ ID:3837.

Another function of VGAM1126 is therefore inhibition of Fer-1-like 4 (C. elegans) (FER1L4, Accession NM_025206). Accordingly, utilities of VGAM1126 include diagnosis, prevention and treatment of diseases and clinical conditions associated with FER1L4. FLJ11000 (Accession NM_018295) is another VGAM1126 host target gene. FLJ11000 BINDING SITE is HOST TARGET binding site found in the 5' untranslated region of mRNA encoded by FLJ11000, corresponding to a HOST TARGET binding site such as BINDING SITE I, BINDING SITE II or BINDING SITE III. Table 2 illustrates the complementarity of the nucleotide sequences of FLJ11000 BINDING SITE, designated SEQ ID:20284, to the nucleotide sequence of VGAM1126 RNA, herein designated VGAM RNA, also designated SEQ ID:3837.

Another function of VGAM1126 is therefore inhibition of FLJ11000 (Accession NM_018295). Accordingly, utilities of VGAM1126 include diagnosis, prevention and treatment of diseases and clinical conditions associated with FLJ11000. FLJ12294 (Accession NM_025100) is another VGAM1126 host target gene. FLJ12294 BINDING SITE is HOST TARGET binding site found in the 5' untranslated region of mRNA encoded by FLJ12294, corresponding to a HOST TARGET binding site such as BINDING SITE I, BINDING SITE II or BINDING SITE III. Table 2 illustrates the complementarity of the nucleotide sequences of FLJ12294 BINDING SITE, designated SEQ ID:24742, to the nucleotide sequence of VGAM1126 RNA, herein designated VGAM RNA, also designated SEQ ID:3837.

Another function of VGAM1126 is therefore inhibition of FLJ12294 (Accession NM_025100). Accordingly, utilities of VGAM1126 include diagnosis, prevention and treatment of diseases and clinical conditions associated with FLJ12294. FLJ12595 (Accession NM_024994) is another VGAM1126 host target gene. FLJ12595 BINDING SITE is HOST TARGET binding site found in the 5' untranslated region of mRNA encoded by FLJ12595, corresponding to a HOST TARGET binding site such as BINDING SITE I, BINDING SITE II or BINDING SITE III. Table 2 illustrates the complementarity of the nucleotide sequences of FLJ12595 BINDING SITE, designated SEQ ID:24557, to the nucleotide sequence of VGAM1126 RNA, herein designated VGAM RNA, also designated SEQ ID:3837.

Another function of VGAM1126 is therefore inhibition of FLJ12595 (Accession NM_024994). Accordingly, utilities of VGAM1126 include diagnosis, prevention and treatment of diseases and clinical conditions associated with FLJ12595. FLJ13204 (Accession NM_024761) is another VGAM1126 host target gene. FLJ13204 BINDING SITE is HOST TARGET binding site found in the 3' untranslated region of mRNA encoded by FLJ13204, corresponding to a HOST TARGET binding site such as BINDING SITE I, BINDING SITE II or BINDING SITE III. Table 2 illustrates the complementarity of the nucleotide sequences of FLJ13204 BINDING SITE, designated SEQ ID:24113, to the nucleotide sequence of VGAM1126 RNA, herein designated VGAM RNA, also designated SEQ ID:3837.

Another function of VGAM1126 is therefore inhibition of FLJ13204 (Accession NM_024761). Accordingly, utilities of VGAM1126 include diagnosis, prevention and treatment of diseases and clinical conditions associated with FLJ13204. FLJ13391 (Accession NM_032181) is another VGAM1126 host target gene. FLJ13391 BINDING SITE is HOST TARGET binding site found in the 5' untranslated region of mRNA encoded by FLJ13391, corresponding to a HOST TARGET binding site such as BINDING SITE I, BINDING SITE II or BINDING SITE III. Table 2 illustrates the complementarity of the nucleotide sequences of FLJ13391 BINDING SITE, designated SEQ ID:25894, to the nucleotide sequence of VGAM1126 RNA, herein designated VGAM RNA, also designated SEQ ID:3837.

Another function of VGAM1126 is therefore inhibition of FLJ13391 (Accession NM_032181). Accordingly, utilities of VGAM1126 include diagnosis, prevention and treatment of diseases and clinical conditions associated with FLJ13391. FLJ13881 (Accession NM_024729) is another VGAM1126 host target gene. FLJ13881 BINDING SITE is HOST TARGET binding site found in the 3' untranslated region of mRNA encoded by FLJ13881, corresponding to a HOST TARGET binding site such as BINDING SITE I, BINDING SITE II or BINDING SITE III. Table 2 illustrates the complementarity of the nucleotide sequences of FLJ13881 BINDING SITE, designated SEQ ID:24065, to the nucleotide sequence of VGAM1126 RNA, herein designated VGAM RNA, also designated SEQ ID:3837.

Another function of VGAM1126 is therefore inhibition of FLJ13881 (Accession NM_024729). Accordingly, utilities of VGAM1126 include diagnosis, prevention and treatment of diseases and clinical conditions associated with FLJ13881. FLJ20128 (Accession NM_017679) is another VGAM1126 host target gene. FLJ20128 BINDING SITE is HOST TARGET binding site found in the 5' untranslated region of mRNA encoded by FLJ20128, corresponding to a HOST TARGET binding site such as BINDING SITE I, BINDING SITE II or BINDING SITE III. Table 2 illustrates the complementarity of the nucleotide sequences of FLJ20128 BINDING SITE, designated SEQ ID:19222, to the nucleotide sequence of VGAM1126 RNA, herein designated VGAM RNA, also designated SEQ ID:3837.

Another function of VGAM1126 is therefore inhibition of FLJ20128 (Accession NM_017679). Accordingly, utilities of VGAM1126 include diagnosis, prevention and treatment of diseases and clinical conditions associated with FLJ20128. FLJ20489 (Accession NM_017842) is another VGAM1126 host target gene. FLJ20489 BINDING SITE is HOST TARGET binding site found in the 3' untranslated region of mRNA encoded by FLJ20489, corresponding to a HOST TARGET binding site such as BINDING SITE I, BINDING SITE II or BINDING SITE III. Table 2 illustrates the complementarity of the nucleotide sequences of FLJ20489 BINDING SITE, designated SEQ ID:19506, to the nucleotide sequence of VGAM1126 RNA, herein designated VGAM RNA, also designated SEQ ID:3837.

Another function of VGAM1126 is therefore inhibition of FLJ20489 (Accession NM_017842). Accordingly, utilities of VGAM1126 include diagnosis, prevention and treatment of diseases and clinical conditions associated with FLJ20489. FLJ22169 (Accession NM_024085) is another VGAM1126 host target gene. FLJ22169 BINDING SITE is HOST TARGET binding site found in the 3' untranslated region of mRNA encoded by FLJ22169, corresponding to a HOST TARGET binding site such as BINDING SITE I, BINDING SITE II or BINDING SITE III. Table 2 illustrates the complementarity of the nucleotide sequences of FLJ22169 BINDING SITE, designated SEQ ID:23520, to the nucleotide sequence of VGAM1126 RNA, herein designated VGAM RNA, also designated SEQ ID:3837.

Another function of VGAM1126 is therefore inhibition of FLJ22169 (Accession NM_024085). Accordingly, utilities of VGAM1126 include diagnosis, prevention and treatment of diseases and clinical conditions associated with FLJ22169. FLJ30663 (Accession XM_086046) is another VGAM1126 host target gene. FLJ30663 BINDING SITE is HOST TARGET binding site found in the 3' untranslated region of mRNA encoded by FLJ30663, corresponding to a HOST TARGET binding site such as BINDING SITE I, BINDING SITE II or BINDING SITE III. Table 2 illustrates the complementarity of the nucleotide sequences of FLJ30663 BINDING SITE, designated SEQ ID:38461, to the nucleotide sequence of VGAM1126 RNA, herein designated VGAM RNA, also designated SEQ ID:3837.

Another function of VGAM1126 is therefore inhibition of FLJ30663 (Accession XM_086046). Accordingly, utilities of VGAM1126 include diagnosis, prevention and treatment of diseases and clinical conditions associated with FLJ30663. Glycoprotein V (platelet) (GP5, Accession NM_004488) is another VGAM1126 host target gene. GP5 BINDING SITE is HOST TARGET binding site found in the 3' untranslated region of mRNA encoded by GP5, corresponding to a HOST TARGET binding site such as BINDING SITE I, BINDING SITE II or BINDING SITE III. Table 2 illustrates the complementarity of the nucleotide sequences of GP5 BINDING SITE, designated SEQ ID:10816, to the nucleotide sequence of VGAM1126 RNA, herein designated VGAM RNA, also designated SEQ ID:3837.

Another function of VGAM1126 is therefore inhibition of Glycoprotein V (platelet) (GP5, Accession NM_004488). Accordingly, utilities of VGAM1126 include diagnosis, prevention and treatment of diseases and clinical conditions associated with GP5. HCCA2 (Accession XM_039894) is another VGAM1126 host target gene. HCCA2 BINDING SITE is HOST TARGET binding site found in the 5' untranslated region of mRNA encoded by HCCA2, corresponding to a HOST TARGET binding site such as BINDING SITE I, BINDING SITE II or BINDING SITE III. Table 2 illustrates the complementarity of the nucleotide sequences of HCCA2 BINDING SITE, designated SEQ ID:33202, to the nucleotide sequence of VGAM1126 RNA, herein designated VGAM RNA, also designated SEQ ID:3837.

Another function of VGAM1126 is therefore inhibition of HCCA2 (Accession XM_039894). Accordingly, utilities of VGAM1126 include diagnosis, prevention and treatment of diseases and clinical conditions associated with HCCA2. KIAA0237 (Accession NM_014747) is another VGAM1126 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16439, to the nucleotide sequence of VGAM1126 RNA, herein designated VGAM RNA, also designated SEQ ID:3837.

Another function of VGAM1126 is therefore inhibition of KIAA0237 (Accession NM_014747). Accordingly, utilities of VGAM1126 include diagnosis, prevention and treatment of diseases and clinical conditions associated with KIAA0237. KIAA0285 (Accession NM_014807) is another VGAM1126 host target gene. KIAA0285 BINDING SITE is HOST TARGET binding site found in the 3' untranslated region of mRNA encoded by KIAA0285, corresponding to a HOST TARGET binding site such as BINDING SITE I, BINDING SITE II or BINDING SITE III. Table 2 illustrates the complementarity of the nucleotide sequences of KIAA0285 BINDING SITE, designated SEQ ID:16749, to the nucleotide sequence of VGAM1126 RNA, herein designated VGAM RNA, also designated SEQ ID:3837.

Another function of VGAM1126 is therefore inhibition of KIAA0285 (Accession NM_014807). Accordingly, utilities of VGAM1126 include diagnosis, prevention and treatment of diseases and clinical conditions associated with KIAA0285. KIAA0397 (Accession XM_029438) is another VGAM1126 host target gene. KIAA0397 BINDING SITE is HOST TARGET binding site found in the 3' untranslated region of mRNA encoded by KIAA0397, corresponding to a HOST TARGET binding site such as BINDING SITE I, BINDING SITE II or BINDING SITE III. Table 2 illustrates the complementarity of the nucleotide sequences of KIAA0397 BINDING SITE, designated SEQ ID:30894, to the nucleotide sequence of VGAM1126 RNA, herein designated VGAM RNA, also designated SEQ ID:3837.

Another function of VGAM1126 is therefore inhibition of KIAA0397 (Accession XM_029438). Accordingly, utilities of VGAM1126 include diagnosis, prevention and treatment of diseases and clinical conditions associated with KIAA0397. KIAA0427 (Accession NM_014772) is another VGAM1126 host target gene. KIAA0427 BINDING SITE is HOST TARGET binding site found in the 3' untranslated region of mRNA encoded by KIAA0427, corresponding to a HOST TARGET binding site such as BINDING SITE I, BINDING SITE II or BINDING SITE III. Table 2 illustrates the complementarity of the nucleotide sequences of KIAA0427 BINDING SITE, designated SEQ ID:16572, to the nucleotide sequence of VGAM1126 RNA, herein designated VGAM RNA, also designated SEQ ID:3837.

Another function of VGAM1126 is therefore inhibition of KIAA0427 (Accession NM_014772). Accordingly, utilities of VGAM1126 include diagnosis, prevention and treatment of diseases and clinical conditions associated with KIAA0427. KIAA0471 (Accession NM_014857) is another VGAM1126 host target gene. KIAA0471 BINDING SITE is HOST TARGET binding site found in the 3' untranslated region of mRNA encoded by KIAA0471, corresponding to a HOST TARGET binding site such as BINDING SITE I, BINDING SITE II or BINDING SITE III. Table 2 illustrates the complementarity of the nucleotide sequences of KIAA0471 BINDING SITE, designated SEQ ID:16908, to the nucleotide sequence of VGAM1126 RNA, herein designated VGAM RNA, also designated SEQ ID:3837.

Another function of VGAM1126 is therefore inhibition of KIAA0471 (Accession NM_014857). Accordingly, utilities of VGAM1126 include diagnosis, prevention and treatment of diseases and clinical conditions associated with KIAA0471. KIAA0481 (Accession XM_050144) is another VGAM1126 host target gene. KIAA0481 BINDING SITE is HOST TARGET binding site found in the 3' untranslated region of mRNA encoded by KIAA0481, corresponding to a HOST TARGET binding site such as BINDING SITE I, BINDING SITE II or BINDING SITE III. Table 2 illustrates the complementarity of the nucleotide sequences of KIAA0481 BINDING SITE, designated SEQ ID:35567, to the nucleotide sequence of VGAM1126 RNA, herein designated VGAM RNA, also designated SEQ ID:3837.

Another function of VGAM1126 is therefore inhibition of KIAA0481 (Accession XM_050144). Accordingly, utilities of VGAM1126 include diagnosis, prevention and treatment of diseases and clinical conditions associated with KIAA0481. KIAA0563 (Accession NM_014834) is another VGAM1126 host target gene. KIAA0563 BINDING SITE is HOST TARGET binding site found in the 3' untranslated region of mRNA encoded by KIAA0563, corresponding to a HOST TARGET binding site such as BINDING SITE I, BINDING SITE II or BINDING SITE III. Table 2 illustrates the complementarity of the nucleotide sequences of KIAA0563 BINDING SITE, designated SEQ ID:16839, to the nucleotide sequence of VGAM1126 RNA, herein designated VGAM RNA, also designated SEQ ID:3837.

Another function of VGAM1126 is therefore inhibition of KIAA0563 (Accession NM_014834). Accordingly, utilities of VGAM1126 include diagnosis, prevention and treatment of diseases and clinical conditions associated with KIAA0563. KIAA0978 (Accession XM_047013) is another VGAM1126 host target gene. KIAA0978 BINDING SITE is HOST TARGET binding site found in the 3' untranslated region of mRNA encoded by KIAA0978, corresponding to a HOST TARGET binding site such as BINDING SITE I, BINDING SITE II or BINDING SITE III. Table 2 illustrates the complementarity of the nucleotide sequences of KIAA0978 BINDING SITE, designated SEQ ID:34886, to the nucleotide sequence of VGAM1126 RNA, herein designated VGAM RNA, also designated SEQ ID:3837.

Another function of VGAM1126 is therefore inhibition of KIAA0978 (Accession XM_047013). Accordingly, utilities of VGAM1126 include diagnosis, prevention and treatment of diseases and clinical conditions associated with KIAA0978. KIAA1465 (Accession XM_027396) is another VGAM1126 host target gene. KIAA1465 BINDING SITE is HOST TARGET binding site found in the 3' untranslated region of mRNA encoded by KIAA1465, corresponding to a HOST TARGET binding site such as BINDING SITE I, BINDING SITE II or BINDING SITE III. Table 2 illustrates the complementarity of the nucleotide sequences of KIAA1465 BINDING SITE, designated SEQ ID:30500, to the nucleotide sequence of VGAM1126 RNA, herein designated VGAM RNA, also designated SEQ ID:3837.

Another function of VGAM1126 is therefore inhibition of KIAA1465 (Accession XM_027396). Accordingly, utilities of VGAM1126 include diagnosis, prevention and treatment of diseases and clinical conditions associated with KIAA1465. KIAA1554 (Accession XM_170834) is another VGAM1126 host target gene. KIAA1554 BINDING SITE is HOST TARGET binding site found in the 3' untranslated region of mRNA encoded by KIAA1554, corresponding to a HOST TARGET binding site such as BINDING SITE I, BINDING SITE II or BINDING SITE III. Table 2 illustrates the complementarity of the nucleotide sequences of KIAA1554 BINDING SITE, designated SEQ ID:45608, to the nucleotide sequence of VGAM1126 RNA, herein designated VGAM RNA, also designated SEQ ID:3837.

Another function of VGAM1126 is therefore inhibition of KIAA1554 (Accession XM_170834). Accordingly, utilities of VGAM1126 include diagnosis, prevention and treatment of diseases and clinical conditions associated with KIAA1554. KIAA1727 (Accession XM_034262) is another VGAM1126 host target gene. KIAA1727 BINDING SITE is HOST TARGET binding site found in the 3' untranslated region of mRNA encoded by KIAA1727, corresponding to a HOST TARGET binding site such as BINDING SITE I, BINDING SITE II or BINDING SITE III. Table 2 illustrates the complementarity of the nucleotide sequences of KIAA1727 BINDING SITE, designated SEQ ID:32032, to the nucleotide sequence of VGAM1126 RNA, herein designated VGAM RNA, also designated SEQ ID:3837.

Another function of VGAM1126 is therefore inhibition of KIAA1727 (Accession XM_034262). Accordingly, utilities of VGAM1126 include diagnosis, prevention and treatment of diseases and clinical conditions associated with KIAA1727. KIAA1909 (Accession XM_057996) is another VGAM1126 host target gene. KIAA1909 BINDING SITE is HOST TARGET binding site found in the 5' untranslated region of mRNA encoded by KIAA1909, corresponding to a HOST TARGET binding site such as BINDING SITE I, BINDING SITE II or BINDING SITE III. Table 2 illustrates the complementarity of the nucleotide sequences of KIAA1909 BINDING SITE, designated SEQ ID:36557, to the nucleotide sequence of VGAM1126 RNA, herein designated VGAM RNA, also designated SEQ ID:3837.

Another function of VGAM1126 is therefore inhibition of KIAA1909 (Accession XM_057996). Accordingly, utilities of VGAM1126 include diagnosis, prevention and treatment of diseases and clinical conditions associated with KIAA1909. KIAA1944 (Accession XM_062545) is another VGAM1126 host target gene. KIAA1944 BINDING SITE is HOST TARGET binding site found in the 3' untranslated region of mRNA encoded by KIAA1944, corresponding to a HOST TARGET binding site such as BINDING SITE I, BINDING SITE II or BINDING SITE III. Table 2 illustrates the complementarity of the nucleotide sequences of KIAA1944 BINDING SITE, designated SEQ ID:37226, to the nucleotide sequence of VGAM1126 RNA, herein designated VGAM RNA, also designated SEQ ID:3837.

Another function of VGAM1126 is therefore inhibition of KIAA1944 (Accession XM_062545). Accordingly, utilities of VGAM1126 include diagnosis, prevention and treatment of diseases and clinical conditions associated with KIAA1944. MGC1136 (Accession NM_024025) is another VGAM1126 host target gene. MGC1136 BINDING SITE is HOST TARGET binding site found in the 3' untranslated region of mRNA encoded by MGC1136, corresponding to a HOST TARGET binding site such as BINDING SITE I, BINDING SITE II or BINDING SITE III. Table 2 illustrates the complementarity of the nucleotide sequences of MGC1136 BINDING SITE, designated SEQ ID:23452, to the nucleotide sequence of VGAM1126 RNA, herein designated VGAM RNA, also designated SEQ ID:3837.

Another function of VGAM1126 is therefore inhibition of MGC1136 (Accession NM_024025). Accordingly, utilities of VGAM1126 include diagnosis, prevention and treatment of diseases and clinical conditions associated with MGC1136. MGC13170 (Accession NM_032712) is another VGAM1126 host target gene. MGC13170 BINDING SITE is HOST TARGET binding site found in the 5' untranslated region of mRNA encoded by MGC13170, corresponding to a HOST TARGET binding site such as BINDING SITE I, BINDING SITE II or BINDING SITE III. Table 2 illustrates the complementarity of the nucleotide sequences of MGC13170 BINDING SITE, designated SEQ ID:26430, to the nucleotide sequence of VGAM1126 RNA, herein designated VGAM RNA, also designated SEQ ID:3837.

Another function of VGAM1126 is therefore inhibition of MGC13170 (Accession NM_032712). Accordingly, utilities of VGAM1126 include diagnosis, prevention and treatment of diseases and clinical conditions associated with MGC13170. MGC17998 (Accession NM_144997) is another VGAM1126 host target gene. MGC17998 BINDING SITE is HOST TARGET binding site found in the 3' untranslated region of mRNA encoded by MGC17998, corresponding to a HOST TARGET binding site such as BINDING SITE I, BINDING SITE II or BINDING SITE III. Table 2 illustrates the complementarity of the nucleotide sequences of MGC17998 BINDING SITE, designated SEQ ID:29602, to the nucleotide sequence of VGAM1126 RNA, herein designated VGAM RNA, also designated SEQ ID:3837.

Another function of VGAM1126 is therefore inhibition of MGC17998 (Accession NM_144997). Accordingly, utilities of VGAM1126 include diagnosis, prevention and treatment of diseases and clinical conditions associated with MGC17998. Mitochondrial Ribosomal Protein L20 (MRPL20, Accession NM_017971) is another VGAM1126 host target gene. MRPL20 BINDING SITE is HOST TARGET binding site found in the 3' untranslated region of mRNA encoded by MRPL20, corresponding to a HOST TARGET binding site such as BINDING SITE I, BINDING SITE II or BINDING SITE III. Table 2 illustrates the complementarity of the nucleotide sequences of MRPL20 BINDING SITE, designated SEQ ID:19695, to the nucleotide sequence of VGAM1126 RNA, herein designated VGAM RNA, also designated SEQ ID:3837.

Another function of VGAM1126 is therefore inhibition of Mitochondrial Ribosomal Protein L20 (MRPL20, Accession NM_017971). Accordingly, utilities of VGAM1126 include diagnosis, prevention and treatment of diseases and clinical conditions associated with MRPL20. Opiate Receptor-like 1 (OPRL1, Accession NM_000913) is another VGAM1126 host target gene. OPRL1 BINDING SITE is HOST TARGET binding site found in the 3' untranslated region of mRNA encoded by OPRL1, corresponding to a HOST TARGET binding site such as BINDING SITE I, BINDING SITE II or BINDING SITE III. Table 2 illustrates the complementarity of the nucleotide sequences of OPRL1 BINDING SITE, designated SEQ ID:6614, to the nucleotide sequence of VGAM1126 RNA, herein designated VGAM RNA, also designated SEQ ID:3837.

Another function of VGAM1126 is therefore inhibition of Opiate Receptor-like 1 (OPRL1, Accession NM_000913). Accordingly, utilities of VGAM1126 include diagnosis, prevention and treatment of diseases and clinical conditions associated with OPRL1. PDZ Domain Containing 2 (PDZD2, Accession XM_087705) is another VGAM1126 host target gene. PDZD2 BINDING SITE is HOST TARGET binding site found in the 5' untranslated region of mRNA encoded by PDZD2, corresponding to a HOST TARGET binding site such as BINDING SITE I, BINDING SITE II or BINDING SITE III. Table 2 illustrates the complementarity of the nucleotide sequences of PDZD2 BINDING SITE, designated SEQ ID:39389, to the nucleotide sequence of VGAM1126 RNA, herein designated VGAM RNA, also designated SEQ ID:3837.

Another function of VGAM1126 is therefore inhibition of PDZ Domain Containing 2 (PDZD2, Accession XM_087705). Accordingly, utilities of VGAM1126 include diagnosis, prevention and treatment of diseases and clinical conditions associated with PDZD2. PME-1 (Accession NM_016147) is another VGAM1126 host target gene. PME-1 BINDING SITE is HOST TARGET binding site found in the 3' untranslated region of mRNA encoded by PME-1, corresponding to a HOST TARGET binding site such as BINDING SITE I, BINDING SITE II or BINDING SITE III. Table 2 illustrates the complementarity of the nucleotide sequences of PME-1 BINDING SITE, designated SEQ ID:18232, to the nucleotide sequence of VGAM1126 RNA, herein designated VGAM RNA, also designated SEQ ID:3837.

Another function of VGAM1126 is therefore inhibition of PME-1 (Accession NM_016147). Accordingly, utilities of VGAM1126 include diagnosis, prevention and treatment of diseases and clinical conditions associated with PME-1. PRO0132 (Accession NM_014116) is another VGAM1126 host target gene. PRO0132 BINDING SITE is HOST TARGET binding site found in the 5' untranslated region of mRNA encoded by PRO0132, corresponding to a HOST TARGET binding site such as BINDING SITE I, BINDING SITE II or BINDING SITE III. Table 2 illustrates the complementarity of the nucleotide sequences of PRO0132 BINDING SITE, designated SEQ ID:15368, to the nucleotide sequence of VGAM1126 RNA, herein designated VGAM RNA, also designated SEQ ID:3837.

Another function of VGAM1126 is therefore inhibition of PRO0132 (Accession NM_014116). Accordingly, utilities of VGAM1126 include diagnosis, prevention and treatment of diseases and clinical conditions associated with PRO0132. Syndecan 3 (N-syndecan) (SDC3, Accession NM_014654) is another VGAM1126 host target gene. SDC3 BINDING SITE is HOST TARGET binding site found in the 3' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16088, to the nucleotide sequence of VGAM1126 RNA, herein designated VGAM RNA, also designated SEQ ID:3837.

Another function of VGAM1126 is therefore inhibition of Syndecan 3 (N-syndecan) (SDC3, Accession NM_014654). Accordingly, utilities of VGAM1126 include diagnosis, prevention and treatment of diseases and clinical conditions associated with SDC3. SEP15 (Accession NM_004261) is another VGAM1126 host target gene. SEP15 BINDING SITE is HOST TARGET binding site found in the 3' untranslated region of mRNA encoded by SEP15, corresponding to a HOST TARGET binding site such as BINDING SITE I, BINDING SITE II or BINDING SITE III. Table 2 illustrates the complementarity of the nucleotide sequences of SEP15 BINDING SITE, designated SEQ ID:10453, to the nucleotide sequence of VGAM1126 RNA, herein designated VGAM RNA, also designated SEQ ID:3837.

Another function of VGAM1126 is therefore inhibition of SEP15 (Accession NM_004261). Accordingly, utilities of VGAM1126 include diagnosis, prevention and treatment of diseases and clinical conditions associated with SEP15. Sideroflexin 5 (SFXN5, Accession NM_144579) is another VGAM1126 host target gene. SFXN5 BINDING SITE is HOST TARGET binding site found in the 3' untranslated region of mRNA encoded by SFXN5, corresponding to a HOST TARGET binding site such as BINDING SITE I, BINDING SITE II or BINDING SITE III. Table 2 illustrates the complementarity of the nucleotide sequences of SFXN5 BINDING SITE, designated SEQ ID:29384, to the nucleotide sequence of VGAM1126 RNA, herein designated VGAM RNA, also designated SEQ ID:3837.

Another function of VGAM1126 is therefore inhibition of Sideroflexin 5 (SFXN5, Accession NM_144579). Accordingly, utilities of VGAM1126 include diagnosis, prevention and treatment of diseases and clinical conditions associated with SFXN5. SKIP (Accession NM_130766) is another VGAM1126 host target gene. SKIP BINDING SITE1 and SKIP BINDING SITE2 are HOST TARGET binding sites found in untranslated regions of mRNA encoded by SKIP, corresponding to HOST TARGET binding sites such as BINDING SITE I, BINDING SITE II or BINDING SITE III. Table 2 illustrates the complementarity of the nucleotide sequences of SKIP BINDING SITE1 and SKIP BINDING SITE2, designated SEQ ID:28260 and SEQ ID:18597 respectively, to the nucleotide sequence of VGAM1126 RNA, herein designated VGAM RNA, also designated SEQ ID:3837.

Another function of VGAM1126 is therefore inhibition of SKIP (Accession NM_130766). Accordingly, utilities of VGAM1126 include diagnosis, prevention and treatment of diseases and clinical conditions associated with SKIP. SMC1 Structural Maintenance of Chromosomes 1-like 1 (yeast) (SMC1L1, Accession XM_050403) is another VGAM1126 host target gene. SMC1L1 BINDING SITE is HOST TARGET binding site found in the 3' untranslated region of mRNA encoded by SMC1L1, corresponding to a HOST TARGET binding site such as BINDING SITE I, BINDING SITE II or BINDING SITE III. Table 2 illustrates the complementarity of the nucleotide sequences of SMC1L1 BINDING SITE, designated SEQ ID:35617, to the nucleotide sequence of VGAM1126 RNA, herein designated VGAM RNA, also designated SEQ ID:3837.

Another function of VGAM1126 is therefore inhibition of SMC1 Structural Maintenance of Chromosomes 1-like 1 (yeast) (SMC1L1, Accession XM_050403). Accordingly, utilities of VGAM1126 include diagnosis, prevention and treatment of diseases and clinical conditions associated with SMC1L1. Smith-Magenis Syndrome Chromosome Region, Candidate 5 (SMCR5, Accession NM_144774) is another VGAM1126 host target gene. SMCR5 BINDING SITE is HOST TARGET binding site found in the 3' untranslated region of mRNA encoded by SMCR5, corresponding to a HOST TARGET binding site such as BINDING SITE I, BINDING SITE II or BINDING SITE III. Table 2 illustrates the complementarity of the nucleotide sequences of SMCR5 BINDING SITE, designated SEQ ID:29561, to the nucleotide sequence of VGAM1126 RNA, herein designated VGAM RNA, also designated SEQ ID:3837.

Another function of VGAM1126 is therefore inhibition of Smith-Magenis Syndrome Chromosome Region, Candidate 5 (SMCR5, Accession NM_144774). Accordingly, utilities of VGAM1126 include diagnosis, prevention and treatment of diseases and clinical conditions associated with SMCR5. Syntaphilin (SNPH, Accession NM_014723) is another VGAM1126 host target gene. SNPH BINDING SITE is HOST TARGET binding site found in the 3" untranslated region of mRNA encoded by SNPH, corresponding to a HOST TARGET binding site such as BINDING SITE I, BINDING SITE II or BINDING SITE III. Table 2 illustrates the complementarity of the nucleotide sequences of SNPH BINDING SITE, designated SEQ ID:16289, to the nucleotide sequence of VGAM1126 RNA, herein designated VGAM RNA, also designated SEQ ID:3837.

Another function of VGAM1126 is therefore inhibition of Syntaphilin (SNPH, Accession NM_014723). Accordingly, utilities of VGAM1126 include diagnosis, prevention and treatment of diseases and clinical conditions associated with SNPH. Signal Transducer and Activator of Transcription 5A (STAT5A, Accession NM_003152) is another VGAM1126 host target gene. STAT5A BINDING SITE is HOST TARGET binding site found in the 5' untranslated region of mRNA encoded by STAT5A, corresponding to a HOST TAR- GET binding site such as BINDING SITE I, BINDING SITE II or BINDING SITE III. Table 2 illustrates the complementarity of the nucleotide sequences of STAT5A BINDING SITE, designated SEQ ID:9126, to the nucleotide sequence of VGAM1126 RNA, herein designated VGAM RNA, also designated SEQ ID:3837.

Another function of VGAM1126 is therefore inhibition of Signal Transducer and Activator of Transcription 5A (STAT5A, Accession NM_003152). Accordingly, utilities of VGAM1126 include diagnosis, prevention and treatment of diseases and clinical conditions associated with STAT5A. Synaptotagmin XII (SYT12, Accession XM_170657) is another VGAM1126 host target gene. SYT12 BINDING SITE is HOST TARGET binding site found in the 5' untranslated region of mRNA encoded by SYT12, corresponding to a HOST TARGET binding site such as BINDING SITE I, BINDING SITE II or BINDING SITE III. Table 2 illustrates the complementarity of the nucleotide sequences of SYT12 BINDING SITE, designated SEQ ID:45429, to the nucleotide sequence of VGAM1126 RNA, herein designated VGAM RNA, also designated SEQ ID:3837.

Another function of VGAM1126 is therefore inhibition of Synaptotagmin XII (SYT12, Accession XM_170657). Accordingly, utilities of VGAM1126 include diagnosis, prevention and treatment of diseases and clinical conditions associated with SYT12. Zinc Finger Protein 91 Homolog (mouse) (ZFP91, Accession NM_053023) is another VGAM1126 host target gene. ZFP91 BINDING SITE is HOST TARGET binding site found in the 3' untranslated region of mRNA encoded by ZFP91, corresponding to a HOST TARGET binding site such as BINDING SITE I, BINDING SITE II or BINDING SITE III. Table 2 illustrates the complementarity of the nucleotide sequences of ZFP91 BINDING SITE, designated SEQ ID:27572, to the nucleotide sequence of VGAM1126 RNA, herein designated VGAM RNA, also designated SEQ ID:3837.

Another function of VGAM1126 is therefore inhibition of Zinc Finger Protein 91 Homolog (mouse) (ZFP91, Accession NM_053023). Accordingly, utilities of VGAM1126 include diagnosis, prevention and treatment of diseases and clinical conditions associated with ZFP91. LOC116071 (Accession NM_138456) is another VGAM1126 host target gene. LOC116071 BINDING SITE is HOST TARGET binding site found in the 3' untranslated region of mRNA encoded by LOC116071, corresponding to a HOST TARGET binding site such as BINDING SITE I, BINDING SITE II or BINDING SITE III. Table 2 illustrates the complementarity of the nucleotide sequences of LOC116071 BINDING SITE, designated SEQ ID:28815, to the nucleotide sequence of VGAM1126 RNA, herein designated VGAM RNA, also designated SEQ ID:3837.

Another function of VGAM1126 is therefore inhibition of LOC116071 (Accession NM_138456). Accordingly, utilities of VGAM1126 include diagnosis, prevention and treatment of diseases and clinical conditions associated with LOC116071. LOC118738 (Accession XM_061125) is another VGAM1126 host target gene. LOC118738 BINDING SITE is HOST TARGET binding site found in the 3' untranslated region of mRNA encoded by LOC118738, corresponding to a HOST TARGET binding site such as BINDING SITE I, BINDING SITE II or BINDING SITE III. Table 2 illustrates the complementarity of the nucleotide sequences of LOC118738 BINDING SITE, designated SEQ ID:37194, to the nucleotide sequence of VGAM1126 RNA, herein designated VGAM RNA, also designated SEQ ID:3837.

Another function of VGAM1126 is therefore inhibition of LOC118738 (Accession XM_061125). Accordingly, utilities of VGAM1126 include diagnosis, prevention and treatment of diseases and clinical conditions associated with LOC118738. LOC127702 (Accession XM_060619) is another VGAM1126 host target gene. LOC127702 BINDING SITE is HOST TARGET binding site found in the 3' untranslated region of mRNA encoded by LOC127702, corresponding to a HOST TARGET binding site such as BINDING SITE I, BINDING SITE II or BINDING SITE III. Table 2 illustrates the complementarity of the nucleotide sequences of LOC127702 BINDING SITE, designated SEQ ID:37179, to the nucleotide sequence of VGAM1126 RNA, herein designated VGAM RNA, also designated SEQ ID:3837.

Another function of VGAM1126 is therefore inhibition of LOC127702 (Accession XM_060619). Accordingly, utilities of VGAM1126 include diagnosis, prevention and treatment of diseases and clinical conditions associated with LOC127702. LOC130644 (Accession XM_065813) is another VGAM1126 host target gene. LOC130644 BINDING SITE is HOST TARGET binding site found in the 3' untranslated region of mRNA encoded by LOC130644, corresponding to a HOST TARGET binding site such as BINDING SITE I, BINDING SITE II or BINDING SITE III. Table 2 illustrates the complementarity of the nucleotide sequences of LOC130644 BINDING SITE, designated SEQ ID:37304, to the nucleotide sequence of VGAM1126 RNA, herein designated VGAM RNA, also designated SEQ ID:3837.

Another function of VGAM1126 is therefore inhibition of LOC130644 (Accession XM_065813). Accordingly, utilities of VGAM1126 include diagnosis, prevention and treatment of diseases and clinical conditions associated with LOC130644. LOC132166 (Accession XM_059574) is another VGAM1126 host target gene. LOC132166 BINDING SITE is HOST TARGET binding site found in the 3' untranslated region of mRNA encoded by LOC132166, corresponding to a HOST TARGET binding site such as BINDING SITE I, BINDING SITE II or BINDING SITE III. Table 2 illustrates the complementarity of the nucleotide sequences of LOC132166 BINDING SITE, designated SEQ ID:37020, to the nucleotide sequence of VGAM1126 RNA, herein designated VGAM RNA, also designated SEQ ID:3837.

Another function of VGAM1126 is therefore inhibition of LOC132166 (Accession XM_059574). Accordingly, utilities of VGAM1126 include diagnosis, prevention and treatment of diseases and clinical conditions associated with LOC132166. LOC145761 (Accession XM_096855) is another VGAM1126 host target gene. LOC145761 BINDING SITE is HOST TARGET binding site found in the 5' untranslated region of mRNA encoded by LOC145761, corresponding to a HOST TARGET binding site such as BINDING SITE I, BINDING SITE II or BINDING SITE III. Table 2 illustrates the complementarity of the nucleotide sequences of LOC145761 BINDING SITE, designated SEQ ID:40582, to the nucleotide sequence of VGAM1126 RNA, herein designated VGAM RNA, also designated SEQ ID:3837.

Another function of VGAM1126 is therefore inhibition of LOC145761 (Accession XM_096855). Accordingly, utilities of VGAM1126 include diagnosis, prevention and treatment of diseases and clinical conditions associated with LOC145761. LOC145989 (Accession XM_004815) is another VGAM1126 host target gene. LOC145989 BINDING SITE is HOST TARGET binding site found in the 3' untranslated region of mRNA encoded by LOC145989, corresponding to a HOST TARGET binding site such as BINDING SITE I, BINDING SITE II or BINDING SITE III. Table 2 illustrates the complementarity of the nucleotide sequences of LOC145989 BINDING SITE, designated SEQ ID:29947, to the nucleotide sequence of VGAM1126 RNA, herein designated VGAM RNA, also designated SEQ ID:3837.

Another function of VGAM1126 is therefore inhibition of LOC145989 (Accession XM_004815). Accordingly, utilities of VGAM1126 include diagnosis, prevention and treatment of diseases and clinical conditions associated with LOC145989. LOC147071 (Accession XM_054031) is another VGAM1126 host target gene. LOC147071 BINDING SITE is HOST TARGET binding site found in the 3' untranslated region of mRNA encoded by LOC147071, corresponding to a HOST TARGET binding site such as BINDING SITE I, BINDING SITE II or BINDING SITE III. Table 2 illustrates the complementarity of the nucleotide sequences of LOC147071 BINDING SITE, designated SEQ ID:36132, to the nucleotide sequence of VGAM1126 RNA, herein designated VGAM RNA, also designated SEQ ID:3837.

Another function of VGAM1126 is therefore inhibition of LOC147071 (Accession XM_054031). Accordingly, utilities of VGAM1126 include diagnosis, prevention and treatment of diseases and clinical conditions associated with LOC147071. LOC148894 (Accession XM_097542) is another VGAM1126 host target gene. LOC148894 BINDING SITE is HOST TARGET binding site found in the 5' untranslated region of mRNA encoded by LOC148894, corresponding to a HOST TARGET binding site such as BINDING SITE I, BINDING SITE II or BINDING SITE III. Table 2 illustrates the complementarity of the nucleotide sequences of LOC148894 BINDING SITE, designated SEQ ID:40917, to the nucleotide sequence of VGAM1126 RNA, herein designated VGAM RNA, also designated SEQ ID:3837.

Another function of VGAM1126 is therefore inhibition of LOC148894 (Accession XM_097542). Accordingly, utilities of VGAM1126 include diagnosis, prevention and treatment of diseases and clinical conditions associated with LOC148894. LOC151068 (Accession XM_098000) is another VGAM1126 host target gene. LOC151068 BINDING SITE is HOST TARGET binding site found in the 5' untranslated region of mRNA encoded by LOC151068, corresponding to a HOST TARGET binding site such as BINDING SITE I, BINDING SITE II or BINDING SITE III. Table 2 illustrates the complementarity of the nucleotide sequences of LOC151068 BINDING SITE, designated SEQ ID:41296, to the nucleotide sequence of VGAM1126 RNA, herein designated VGAM RNA, also designated SEQ ID:3837.

Another function of VGAM1126 is therefore inhibition of LOC151068 (Accession XM_098000). Accordingly, utilities of VGAM1126 include diagnosis, prevention and treatment of diseases and clinical conditions associated with LOC151068. LOC152286 (Accession XM_098188) is another VGAM1126 host target gene. LOC152286 BINDING SITE is HOST TARGET binding site found in the 3' untranslated region of mRNA encoded by LOC152286, corresponding to a HOST TARGET binding site such as BINDING SITE I, BINDING SITE II or BINDING SITE III. Table 2 illustrates the complementarity of the nucleotide sequences of LOC152286 BINDING SITE, designated SEQ ID:41461, to the nucleotide sequence of VGAM1126 RNA, herein designated VGAM RNA, also designated SEQ ID:3837.

Another function of VGAM1126 is therefore inhibition of LOC152286 (Accession XM_098188). Accordingly, utilities of VGAM1126 include diagnosis, prevention and treatment of diseases and clinical conditions associated with LOC152286. LOC152915 (Accession XM_040172) is another VGAM1126 host target gene. LOC152915 BINDING SITE is HOST TARGET binding site found in the 5' untranslated region of mRNA encoded by LOC152915, corresponding to a HOST TARGET binding site such as BINDING SITE I, BINDING SITE II or BINDING SITE III. Table 2 illustrates the complementarity of the nucleotide sequences of LOC152915 BINDING SITE, designated SEQ ID:33268, to the nucleotide sequence of VGAM1126 RNA, herein designated VGAM RNA, also designated SEQ ID:3837.

Another function of VGAM1126 is therefore inhibition of LOC152915 (Accession XM_040172). Accordingly, utilities of VGAM1126 include diagnosis, prevention and treatment of diseases and clinical conditions associated with LOC152915. LOC153338 (Accession XM_098361) is another VGAM1126 host target gene. LOC153338 BINDING SITE is HOST TARGET binding site found in the 3' untranslated region of mRNA encoded by LOC153338, corresponding to a HOST TARGET binding site such as BINDING SITE I, BINDING SITE II or BINDING SITE III. Table 2 illustrates the complementarity of the nucleotide sequences of LOC153338 BINDING SITE, designated SEQ ID:41608, to the nucleotide sequence of VGAM1126 RNA, herein designated VGAM RNA, also designated SEQ ID:3837.

Another function of VGAM1126 is therefore inhibition of LOC153338 (Accession XM_098361). Accordingly, utilities of VGAM1126 include diagnosis, prevention and treatment of diseases and clinical conditions associated with LOC153338. LOC158230 (Accession XM_088517) is another VGAM1126 host target gene. LOC158230 BINDING SITE is HOST TARGET binding site found in the 3' untranslated region of mRNA encoded by LOC158230, corresponding to a HOST TARGET binding site such as BINDING SITE I, BINDING SITE II or BINDING SITE III. Table 2 illustrates the complementarity of the nucleotide sequences of LOC158230 BINDING SITE, designated SEQ ID:39766, to the nucleotide sequence of VGAM1126 RNA, herein designated VGAM RNA, also designated SEQ ID:3837.

Another function of VGAM1126 is therefore inhibition of LOC158230 (Accession XM_088517). Accordingly, utilities of VGAM1126 include diagnosis, prevention and treatment of diseases and clinical conditions associated with LOC158230. LOC158969 (Accession XM_088728) is another VGAM1126 host target gene. LOC158969 BINDING SITE is HOST TARGET binding site found in the 3' untranslated region of mRNA encoded by LOC158969, corresponding to a HOST TARGET binding site such as BINDING SITE I, BINDING SITE II or BINDING SITE III. Table 2 illustrates the complementarity of the nucleotide sequences of LOC158969 BINDING SITE, designated SEQ ID:39919, to the nucleotide sequence of VGAM1126 RNA, herein designated VGAM RNA, also designated SEQ ID:3837.

Another function of VGAM1126 is therefore inhibition of LOC158969 (Accession XM_088728). Accordingly, utilities of VGAM1126 include diagnosis, prevention and treatment of diseases and clinical conditions associated with LOC158969. LOC200982 (Accession XM_117305) is another VGAM1126 host target gene. LOC200982 BINDING SITE is HOST TARGET binding site found in the 3' untranslated region of mRNA encoded by LOC200982, corresponding to a HOST TARGET binding site such as BINDING SITE I, BINDING SITE II or BINDING SITE III. Table 2 illustrates the complementarity of the nucleotide sequences of LOC200982 BINDING SITE, designated SEQ ID:43372, to the nucleotide sequence of VGAM1126 RNA, herein designated VGAM RNA, also designated SEQ ID:3837.

Another function of VGAM1126 is therefore inhibition of LOC200982 (Accession XM_117305). Accordingly, utilities of VGAM1126 include diagnosis, prevention and treatment of diseases and clinical conditions associated with LOC200982. LOC201173 (Accession XM_113312) is another VGAM1126 host target gene. LOC201173 BIND- ING SITE is HOST TARGET binding site found in the 3' untranslated region of mRNA encoded by LOC201173, corresponding to a HOST TARGET binding site such as BINDING SITE I, BINDING SITE II or BINDING SITE III. Table 2 illustrates the complementarity of the nucleotide sequences of LOC201173 BINDING SITE, designated SEQ ID:42211, to the nucleotide sequence of VGAM1126 RNA, herein designated VGAM RNA, also designated SEQ ID:3837.

Another function of VGAM1126 is therefore inhibition of LOC201173 (Accession XM_113312). Accordingly, utilities of VGAM1126 include diagnosis, prevention and treatment of diseases and clinical conditions associated with LOC201173. LOC201220 (Accession XM_113321) is another VGAM1126 host target gene. LOC201220 BINDING SITE is HOST TARGET binding site found in the 3' untranslated region of mRNA encoded by LOC201220, corresponding to a HOST TARGET binding site such as BINDING SITE I, BINDING SITE II or BINDING SITE III. Table 2 illustrates the complementarity of the nucleotide sequences of LOC201220 BINDING SITE, designated SEQ ID:42219, to the nucleotide sequence of VGAM1126 RNA, herein designated VGAM RNA, also designated SEQ ID:3837.

Another function of VGAM1126 is therefore inhibition of LOC201220 (Accession XM_113321). Accordingly, utilities of VGAM1126 include diagnosis, prevention and treatment of diseases and clinical conditions associated with LOC201220. LOC201229 (Accession XM_113925) is another VGAM1126 host target gene. LOC201229 BINDING SITE is HOST TARGET binding site found in the 3' untranslated region of mRNA encoded by LOC201229, corresponding to a HOST TARGET binding site such as BINDING SITE I, BINDING SITE II or BINDING SITE III. Table 2 illustrates the complementarity of the nucleotide sequences of LOC201229 BINDING SITE, designated SEQ ID:42542, to the nucleotide sequence of VGAM1126 RNA, herein designated VGAM RNA, also designated SEQ ID:3837.

Another function of VGAM1126 is therefore inhibition of LOC201229 (Accession XM_113925). Accordingly, utilities of VGAM1126 include diagnosis, prevention and treatment of diseases and clinical conditions associated with LOC201229. LOC203197 (Accession XM_114645) is another VGAM1126 host target gene. LOC203197 BINDING SITE is HOST TARGET binding site found in the 3' untranslated region of mRNA encoded by LOC203197, corresponding to a HOST TARGET binding site such as BINDING SITE I, BINDING SITE II or BINDING SITE III. Table 2 illustrates the complementarity of the nucleotide sequences of LOC203197 BINDING SITE, designated SEQ ID:43009, to the nucleotide sequence of VGAM1126 RNA, herein designated VGAM RNA, also designated SEQ ID:3837.

Another function of VGAM1126 is therefore inhibition of LOC203197 (Accession XM_114645). Accordingly, utilities of VGAM1126 include diagnosis, prevention and treatment of diseases and clinical conditions associated with LOC203197. LOC205693 (Accession XM_120345) is another VGAM1126 host target gene. LOC205693 BINDING SITE is HOST TARGET binding site found in the 5' untranslated region of mRNA encoded by LOC205693, corresponding to a HOST TARGET binding site such as BINDING SITE I, BINDING SITE II or BINDING SITE III. Table 2 illustrates the complementarity of the nucleotide sequences of LOC205693 BINDING SITE, designated SEQ ID:43608, to the nucleotide sequence of VGAM1126 RNA, herein designated VGAM RNA, also designated SEQ ID:3837.

Another function of VGAM1126 is therefore inhibition of LOC205693 (Accession XM_120345). Accordingly, utilities of VGAM1126 include diagnosis, prevention and treatment of diseases and clinical conditions associated with LOC205693. LOC220766 (Accession XM_165471) is another VGAM1126 host target gene. LOC220766 BINDING SITE is HOST TARGET binding site found in the 5' untranslated region of mRNA encoded by LOC220766, corresponding to a HOST TARGET binding site such as BINDING SITE I, BINDING SITE II or BINDING SITE III. Table 2 illustrates the complementarity of the nucleotide sequences of LOC220766 BINDING SITE, designated SEQ ID:43647, to the nucleotide sequence of VGAM1126 RNA, herein designated VGAM RNA, also designated SEQ ID:3837.

Another function of VGAM1126 is therefore inhibition of LOC220766 (Accession XM_165471). Accordingly, utilities of VGAM1126 include diagnosis, prevention and treatment of diseases and clinical conditions associated with LOC220766. LOC221463 (Accession XM_166374) is another VGAM1126 host target gene. LOC221463 BINDING SITE is HOST TARGET binding site found in the 3' untranslated region of mRNA encoded by LOC221463, corresponding to a HOST TARGET binding site such as BINDING SITE I, BINDING SITE II or BINDING SITE III. Table 2 illustrates the complementarity of the nucleotide sequences of LOC221463 BINDING SITE, designated SEQ ID:44200, to the nucleotide sequence of VGAM1126 RNA, herein designated VGAM RNA, also designated SEQ ID:3837.

Another function of VGAM1126 is therefore inhibition of LOC221463 (Accession XM_166374). Accordingly, utilities of VGAM1126 include diagnosis, prevention and treatment of diseases and clinical conditions associated with LOC221463. LOC223073 (Accession XM_170293) is another VGAM1126 host target gene. LOC223073 BINDING SITE is HOST TARGET binding site found in the 5' untranslated region of mRNA encoded by LOC223073, corresponding to a HOST TARGET binding site such as BINDING SITE I, BINDING SITE II or BINDING SITE III. Table 2 illustrates the complementarity of the nucleotide sequences of LOC223073 BINDING SITE, designated SEQ ID:45316, to the nucleotide sequence of VGAM1126 RNA, herein designated VGAM RNA, also designated SEQ ID:3837.

Another function of VGAM1126 is therefore inhibition of LOC223073 (Accession XM_170293). Accordingly, utilities of VGAM1126 include diagnosis, prevention and treatment of diseases and clinical conditions associated with LOC223073. LOC257054 (Accession XM_171010) is another VGAM1126 host target gene. LOC257054 BINDING SITE is HOST TARGET binding site found in the 5' untranslated region of mRNA encoded by LOC257054, corresponding to a HOST TARGET binding site such as BINDING SITE I, BINDING SITE II or BINDING SITE III. Table 2 illustrates the complementarity of the nucleotide sequences of LOC257054 BINDING SITE, designated SEQ ID:45780, to the nucleotide sequence of VGAM1126 RNA, herein designated VGAM RNA, also designated SEQ ID:3837.

Another function of VGAM1126 is therefore inhibition of LOC257054 (Accession XM_171010). Accordingly, utilities of VGAM1126 include diagnosis, prevention and treatment of diseases and clinical conditions associated with LOC257054. LOC51236 (Accession NM_016458) is another VGAM1126 host target gene. LOC51236 BINDING SITE is HOST TARGET binding site found in the 3' untranslated region of mRNA encoded by LOC51236, corresponding to a HOST TARGET binding site such as BINDING SITE I, BINDING SITE II or BINDING SITE III. Table 2 illustrates the complementarity of the nucleotide sequences of LOC51236 BINDING SITE, designated SEQ ID:18570, to the nucleotide sequence of VGAM1126 RNA, herein designated VGAM RNA, also designated SEQ ID:3837.

Another function of VGAM1126 is therefore inhibition of LOC51236 (Accession NM_016458). Accordingly, utilities of VGAM1126 include diagnosis, prevention and treatment of diseases and clinical conditions associated with LOC51236. LOC51308 (Accession NM_016606) is another VGAM1126 host target gene. LOC51308 BINDING SITE is HOST TARGET binding site found in the 3' untranslated region of mRNA encoded by LOC51308, corresponding to a HOST TARGET binding site such as BINDING SITE I, BINDING SITE II or BINDING SITE III. Table 2 illustrates the complementarity of the nucleotide sequences of LOC51308 BINDING SITE, designated SEQ ID:18707, to the nucleotide sequence of VGAM1126 RNA, herein designated VGAM RNA, also designated SEQ ID:3837.

Another function of VGAM1126 is therefore inhibition of LOC51308 (Accession NM_016606). Accordingly, utilities of VGAM1126 include diagnosis, prevention and treatment of diseases and clinical conditions associated with LOC51308. LOC56961 (Accession XM_031857) is another VGAM1126 host target gene. LOC56961 BINDING SITE is HOST TARGET binding site found in the 5' untranslated region of mRNA encoded by LOC56961, corresponding to a HOST TARGET binding site such as BINDING SITE I, BINDING SITE II or BINDING SITE III. Table 2 illustrates the complementarity of the nucleotide sequences of LOC56961 BINDING SITE, designated SEQ ID:31505, to the nucleotide sequence of VGAM1126 RNA, herein designated VGAM RNA, also designated SEQ ID:3837.

Another function of VGAM1126 is therefore inhibition of LOC56961 (Accession XM_031857). Accordingly, utilities of VGAM1126 include diagnosis, prevention and treatment of diseases and clinical conditions associated with LOC56961. LOC91373 (Accession XM_038063) is another VGAM1126 host target gene. LOC91373 BINDING SITE is HOST TARGET binding site found in the 3' untranslated region of mRNA encoded by LOC91373, corresponding to a HOST TARGET binding site such as BINDING SITE I, BINDING SITE II or BINDING SITE III. Table 2 illustrates the complementarity of the nucleotide sequences of LOC91373 BINDING SITE, designated SEQ ID:32751, to the nucleotide sequence of VGAM1126 RNA, herein designated VGAM RNA, also designated SEQ ID:3837.

Another function of VGAM1126 is therefore inhibition of LOC91373 (Accession XM_038063). Accordingly, utilities of VGAM1126 include diagnosis, prevention and treatment of diseases and clinical conditions associated with LOC91373. FIG. 1 further provides a conceptual description of a novel bioinformatically detected viral gene of the present invention, referred to here as Viral Genomic Address Messenger 1127 (VGAM1127) viral gene, which modulates expression of respective host target genes thereof, the function and utility of which host target genes is known in the art.

VGAM1127 is a novel bioinformatically detected regulatory, non protein coding, viral micro RNA (miRNA) gene. The method by which VGAM1127 was detected is described hereinabove with reference to FIGS. 1-8.

VGAM1127 gene, herein designated VGAM GENE, is a viral gene contained in the genome of Barley Stripe Mosaic Virus. VGAM1127 host target gene, herein designated VGAM HOST TARGET GENE, is a human gene contained in the human genome.

VGAM1127 gene encodes a VGAM1127 precursor RNA, herein designated VGAM PRECURSOR RNA. Similar to other miRNA genes, and unlike most ordinary genes, VGAM1127 precursor RNA does not encode a protein. A nucleotide sequence identical or highly similar to the nucleotide sequence of VGAM1127 precursor RNA is designated SEQ ID:1113, and is provided hereinbelow with reference to the sequence listing part. Nucleotide sequence SEQ ID:1113 is located at position 1512 relative to the genome of Barley Stripe Mosaic Virus.

VGAM1127 precursor RNA folds onto itself, forming VGAM1127 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1127 folded precursor RNA into VGAM1127 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM1127 RNA is designated SEQ ID:3838, and is provided hereinbelow with reference to the sequence listing part.

VGAM1127 host target gene, herein designated VGAM HOST TARGET GENE, encodes a corresponding messenger RNA, VGAM1127 host target RNA, herein designated VGAM HOST TARGET RNA. VGAM1127 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1127 RNA, herein designated VGAM RNA, binds complementarily to one or more host target binding sites located in untranslated regions of VGAM1127 host target RNA, herein designated VGAM HOST TARGET RNA. This complementary binding is due to the fact that the nucleotide sequence of VGAM1127 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1127 RNA, herein designated VGAM RNA, may have a different number of host target binding sites in untranslated regions of a VGAM1127 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1127 RNA, herein designated VGAM RNA, to host target binding sites on VGAM1127 host target RNA, herein designated VGAM HOST TARGET RNA, such as BINDING SITE I, BINDING SITE II and BINDING SITE III, inhibits translation of VGAM1127 host target RNA into VGAM1127 host target protein, herein designated VGAM HOST TARGET PROTEIN. VGAM host target protein is therefore outlined by a broken line.

It is appreciated that VGAM1127 host target gene, herein designated VGAM HOST TARGET GENE, in fact represents a plurality of VGAM1127 host target genes. The mRNA of each one of this plurality of VGAM1127 host target genes comprises one or more host target binding sites, each having a nucleotide sequence which is at least partly complementary to VGAM1127 RNA, herein designated VGAM RNA, and which when bound by VGAM1127 RNA causes inhibition of translation of respective one or more VGAM1127 host target proteins.

It is further appreciated by one skilled in the art that the mode of translational inhibition illustrated by FIG. 1 with specific reference to translational inhibition exerted by VGAM1127 gene, herein designated VGAM GENE, on one or more VGAM1127 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1127 is inhibition of expression of host target genes, as part of a novel viral mechanism of attacking a host. Accordingly, utilities of VGAM1127 include diagnosis, prevention and treatment of viral infection by Barley Stripe Mosaic Virus. Specific functions, and accordingly utilities, of VGAM1127 correlate with, and may be deduced from, the identity of the host target genes which VGAM1127 binds and inhibits, and the function of these host target genes, as elaborated hereinbelow.

Nucleotide sequences of the VGAM1127 precursor RNA, herein designated VGAM PRECURSOR RNA, and of the 'diced' VGAM1127 RNA, herein designated VGAM RNA, and a schematic representation of the secondary folding of VGAM1127 folded precursor RNA, herein designated VGAM FOLDED PRECURSOR RNA, of VGAM1127 are further described hereinbelow with reference to Table 1.

Nucleotide sequences of host target binding sites, such as BINDING SITE-I, BINDING SITE-II and BINDING SITE-III of FIG. 1, found on VGAM1127 host target RNA, and schematic representation of the complementarity of each of these host target binding sites to VGAM1127 RNA, herein designated VGAM RNA, are described hereinbelow with reference to Table 2.

As mentioned hereinabove with reference to FIG. 1, a function of VGAM1127 gene, herein designated VGAM is inhibition of expression of VGAM1127 target genes. It is appreciated that specific functions, and accordingly utilities, of VGAM1127 correlate with, and may be deduced from, the identity of the target genes which VGAM1127 binds and inhibits, and the function of these target genes, as elaborated hereinbelow.

Coronin, Actin Binding Protein, 2A (CORO2A, Accession NM_052820) is a VGAM1127 host target gene. CORO2A BINDING SITE is HOST TARGET binding site found in the 3' untranslated region of mRNA encoded by CORO2A, corresponding to a HOST TARGET binding site such as BINDING SITE I, BINDING SITE II or BINDING SITE III. Table 2 illustrates the complementarity of the nucleotide sequences of CORO2A BINDING SITE, designated SEQ ID:27408, to the nucleotide sequence of VGAM1127 RNA, herein designated VGAM RNA, also designated SEQ ID:3838.

A function of VGAM1127 is therefore inhibition of Coronin, Actin Binding Protein, 2A (CORO2A, Accession NM_052820). Accordingly, utilities of VGAM1127 include diagnosis, prevention and treatment of diseases and clinical conditions associated with CORO2A. Fibulin 5 (FBLN5, Accession NM_006329) is another VGAM1127 host target gene. FBLN5 BINDING SITE is HOST TARGET binding site found in the 3' untranslated region of mRNA encoded by FBLN5, corresponding to a HOST TARGET binding site such as BINDING SITE I, BINDING SITE II or BINDING SITE III. Table 2 illustrates the complementarity of the nucleotide sequences of FBLN5 BINDING SITE, designated SEQ ID:13021, to the nucleotide sequence of VGAM1127 RNA, herein designated VGAM RNA, also designated SEQ ID:3838.

Another function of VGAM1127 is therefore inhibition of Fibulin 5 (FBLN5, Accession NM_006329), a gene which promotes adhesion of endothelial cells through interaction of integrins and the rgd motif. Accordingly, utilities of VGAM1127 include diagnosis, prevention and treatment of diseases and clinical conditions associated with FBLN5. The function of FBLN5 has been established by previous studies. In sequence analysis of mouse fibulin-1 (FBLN1; 135820), Pan et al. (1993) obtained several similar cDNA clones that suggested the existence of a second isoform. Detailed study of the sequence predicted a novel and longer protein, fibulin-2. The protein predicted from the cDNA obtained from a mouse fibroblast library consisted of a 1,195-residue polypeptide preceded by a 26-residue signal peptide. Except for 2 additional EGF-like repeats, the COOH-terminal region showed 43% sequence identity with fibulin-1. The NH2-terminal 408 residues, unique to fibulin-2, showed no sequence homology to other known proteins and presumably formed 2 additional domains that differ in their cysteine content. Recombinant fibulin-2 was produced and secreted by human cell clones as a disulfide-bonded trimer. No significant immunologic cross-reactivity could be detected between fibulin-1 and fibulin-2. Production of fibulin-2 was demonstrated by Northern blots and radioimmunoassay in fibroblasts but not in several tumor cell lines. Together with the observation that the serum level of fibulin-2 is 1,000-fold lower than that of fibulin-1, the data indicated that the 2 isoforms are not always coordinately expressed. Zhang et al. (1994) isolated and sequenced a 4.1-kb human fibulin-2 cDNA, which encoded a mature protein of 1,157 amino acids preceded by a 27-residue signal sequence. The predicted polypeptide was found to contain 3 consecutive anaphylatoxin-related segments (domain I) in its central region followed by 10 EGF-like repeats (domain II), 9 of which had a consensus sequence for calcium binding. The amino acid sequences of human and mouse fibulin-2 shared approximately 90% identity in 3 domains but only 62% in another. Northern blot analysis of mRNA from various human tissues revealed an abundant 4.5-kb transcript in heart, placenta, and ovary tissue. The expression pattern differed from that of fibulin-1. By isotopic in situ hybridization, Zhang et al. (1994) mapped the FBLN2 gene to 3p25-p24 in the human and to chromosome 6 in the D-E region in the mouse. Using 2 polymorphisms in the FBLN2 gene, Collod et al. (1996) excluded FBLN2 as the site of the mutation causing type II Marfan syndrome (OMIM Ref. No. 154705), which maps to the same region of 3p. Using conformation-sensitive gel electrophoresis and direct sequencing of PCR products to screen for mutations in the cDNA for FBLN2, Kuivaniemi et al. (1998) studied 11 patients with abdominal aortic aneurysms and 2 controls. They found a total of 14 single-base sequence variations but these did not segregate with abdominal aortic aneurysms in families.

Full details of the abovementioned studies are described in the following publications, the disclosure of which are hereby incorporated by reference:

Collod, G.; Chu, M.-L.; Sasaki, T.; Coulon, M.; Timpl, R.; Renkart, L.; Weissenbach, J.; Jondeau, G.; Bourdarias, J. P.; Junien, C.; Boileau, C.: Fibulin-2: genetic mapping and exclusion as a candidate gene in Marfan syndrome type 2. Europ. J. Hum. Genet. 4:292-295, 1996; and Kuivaniemi, H.; Marshall, A.; Ganguly, A.; Chu, M.-L.; Abbott, W. M.; Tromp, G.: Fibulin-2 exhibits high degree of variability, but no structural changes concordant with abdominal aort.

Further studies establishing the function and utilities of FBLN5 are found in John Hopkins OMIM database record ID 604580, and in sited publications numbered 4937-4940 listed in the bibliography section hereinbelow, which are also hereby incorporated by reference. Phosphatidylinositol Glycan, Class A (paroxysmal nocturnal hemoglobinuria) (PIGA, Accession NM_020472) is another VGAM1127 host target gene. PIGA BINDING SITE1 through PIGA BINDING SITE3 are HOST TARGET binding sites found in untranslated regions of mRNA encoded by PIGA, corresponding to HOST TARGET binding sites such as BINDING SITE I, BINDING SITE II or BINDING SITE III. Table 2 illustrates the complementarity of the nucleotide sequences of PIGA BINDING SITE1 through PIGA BINDING SITE3, designated SEQ ID:21708, SEQ ID:8497 and SEQ ID:21715 respectively, to the nucleotide sequence of VGAM1127 RNA, herein designated VGAM RNA, also designated SEQ ID:3838.

Another function of VGAM1127 is therefore inhibition of Phosphatidylinositol Glycan, Class A (paroxysmal nocturnal hemoglobinuria) (PIGA, Accession NM_020472). Accordingly, utilities of VGAM1127 include diagnosis, prevention and treatment of diseases and clinical conditions associated with PIGA. Apolipoprotein L, 2 (APOL2, Accession NM_030882) is another VGAM1127 host target gene. APOL2 BINDING SITE is HOST TARGET binding site found in the 3' untranslated region of mRNA encoded by APOL2, corresponding to a HOST TARGET binding site such as BINDING SITE I, BINDING SITE II or BINDING SITE III. Table 2 illustrates the complementarity of the nucleotide sequences of APOL2 BINDING SITE, designated SEQ ID:25159, to the nucleotide sequence of VGAM1127 RNA, herein designated VGAM RNA, also designated SEQ ID:3838.

Another function of VGAM1127 is therefore inhibition of Apolipoprotein L, 2 (APOL2, Accession NM_030882). Accordingly, utilities of VGAM1127 include diagnosis, prevention and treatment of diseases and clinical conditions associated with APOL2. JDD1 (Accession XM_032515) is another VGAM1127 host target gene. JDD1 BINDING SITE is HOST TARGET binding site found in the 3' untranslated region of mRNA encoded by JDD1, corresponding to a HOST TARGET binding site such as BINDING SITE I, BINDING SITE II or BINDING SITE III. Table 2 illustrates the complementarity of the nucleotide sequences of JDD1 BINDING SITE, designated SEQ ID:31668, to the nucleotide sequence of VGAM1127 RNA, herein designated VGAM RNA, also designated SEQ ID:3838.

Another function of VGAM1127 is therefore inhibition of JDD1 (Accession XM_032515). Accordingly, utilities of VGAM1127 include diagnosis, prevention and treatment of diseases and clinical conditions associated with JDD1. Mab-21-like 2 (C. elegans) (MAB21L2, Accession NM_006439) is another VGAM1127 host target gene. MAB21L2 BINDING SITE is HOST TARGET binding site found in the 3" untranslated region of mRNA encoded by MAB21L2, corresponding to a HOST TARGET binding site such as BINDING SITE I, BINDING SITE II or BINDING SITE III. Table 2 illustrates the complementarity of the nucleotide sequences of MAB21L2 BINDING SITE, designated SEQ ID:13152, to the nucleotide sequence of VGAM1127 RNA, herein designated VGAM RNA, also designated SEQ ID:3838.

Another function of VGAM1127 is therefore inhibition of Mab-21-like 2 (C. elegans) (MAB21L2, Accession NM_006439). Accordingly, utilities of VGAM1127 include diagnosis, prevention and treatment of diseases and clinical conditions associated with MAB21L2. LOC254413 (Accession XM_173141) is another VGAM1127 host target gene. LOC254413 BINDING SITE is HOST TARGET binding site found in the 5' untranslated region of mRNA encoded by LOC254413, corresponding to a HOST TARGET binding site such as BINDING SITE I, BINDING SITE II or BINDING SITE III. Table 2 illustrates the complementarity of the nucleotide sequences of LOC254413 BINDING SITE, designated SEQ ID:46398, to the nucleotide sequence of VGAM1127 RNA, herein designated VGAM RNA, also designated SEQ ID:3838.

Another function of VGAM1127 is therefore inhibition of LOC254413 (Accession XM_173141). Accordingly, utilities of VGAM1127 include diagnosis, prevention and treatment of diseases and clinical conditions associated with LOC254413. FIG. 1 further provides a conceptual description of a novel bioinformatically detected viral gene of the present invention, referred to here as Viral Genomic Address Messenger 1128 (VGAM1128) viral gene, which modulates expression of respective host target genes thereof, the function and utility of which host target genes is known in the art.

VGAM1128 is a novel bioinformatically detected regulatory, non protein coding, viral micro RNA (miRNA) gene. The method by which VGAM1128 was detected is described hereinabove with reference to FIGS. 1-8.

VGAM1128 gene, herein designated VGAM GENE, is a viral gene contained in the genome of Barley Stripe Mosaic Virus. VGAM1128 host target gene, herein designated VGAM HOST TARGET GENE, is a human gene contained in the human genome.

VGAM1128 gene encodes a VGAM1128 precursor RNA, herein designated VGAM PRECURSOR RNA. Similar to other miRNA genes, and unlike most ordinary genes, VGAM1128 precursor RNA does not encode a protein. A nucleotide sequence identical or highly similar to the nucleotide sequence of VGAM1128 precursor RNA is designated SEQ ID:1114, and is provided hereinbelow with reference to the sequence listing part. Nucleotide sequence SEQ ID:1114 is located at position 2166 relative to the genome of Barley Stripe Mosaic Virus.

VGAM1128 precursor RNA folds onto itself, forming VGAM1128 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1128 folded precursor RNA into VGAM1128 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM1128 RNA is designated SEQ ID:3839, and is provided hereinbelow with reference to the sequence listing part.

VGAM1128 host target gene, herein designated VGAM HOST TARGET GENE, encodes a corresponding messenger RNA, VGAM1128 host target RNA, herein designated VGAM HOST TARGET RNA. VGAM1128 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1128 RNA, herein designated VGAM RNA, binds complementarily to one or more host target binding sites located in untranslated regions of VGAM1128 host target RNA, herein designated VGAM HOST TARGET RNA. This complementary binding is due to the fact that the nucleotide sequence of VGAM1128 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1128 RNA, herein designated VGAM RNA, may have a different number of host target binding sites in untranslated regions of a VGAM1128 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1128 RNA, herein designated VGAM RNA, to host target binding sites on VGAM1128 host target RNA, herein designated VGAM HOST TARGET RNA, such as BINDING SITE I, BINDING SITE II and BINDING SITE III, inhibits translation of VGAM1128 host target RNA into VGAM1128 host target protein, herein designated VGAM HOST TARGET PROTEIN. VGAM host target protein is therefore outlined by a broken line.

It is appreciated that VGAM1128 host target gene, herein designated VGAM HOST TARGET GENE, in fact represents a plurality of VGAM1128 host target genes. The mRNA of each one of this plurality of VGAM1128 host target genes comprises one or more host target binding sites, each having a nucleotide sequence which is at least partly complementary to VGAM1128 RNA, herein designated VGAM RNA, and which when bound by VGAM1128 RNA causes inhibition of translation of respective one or more VGAM1128 host target proteins.

It is further appreciated by one skilled in the art that the mode of translational inhibition illustrated by FIG. 1 with specific reference to translational inhibition exerted by VGAM1128 gene, herein designated VGAM GENE, on one or more VGAM1128 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1128 is inhibition of expression of host target genes, as part of a novel viral mechanism of attacking a host. Accordingly, utilities of VGAM1128 include diagnosis, prevention and treatment of viral infection by Barley Stripe Mosaic Virus. Specific functions, and accordingly utilities, of VGAM1128 correlate with, and may be deduced from, the identity of the host target genes which VGAM1128 binds and inhibits, and the function of these host target genes, as elaborated hereinbelow.

Nucleotide sequences of the VGAM1128 precursor RNA, herein designated VGAM PRECURSOR RNA, and of the 'diced' VGAM1128 RNA, herein designated VGAM RNA, and a schematic representation of the secondary folding of VGAM1128 folded precursor RNA, herein designated VGAM FOLDED PRECURSOR RNA, of VGAM1128 are further described hereinbelow with reference to Table 1.

Nucleotide sequences of host target binding sites, such as BINDING SITE-I, BINDING SITE-II and BINDING SITE-III of FIG. 1, found on VGAM1128 host target RNA, and schematic representation of the complementarity of each of these host target binding sites to VGAM1128 RNA, herein designated VGAM RNA, are described hereinbelow with reference to Table 2.

As mentioned hereinabove with reference to FIG. 1, a function of VGAM1128 gene, herein designated VGAM is inhibition of expression of VGAM1128 target genes. It is appreciated that specific functions, and accordingly utilities, of VGAM1128 correlate with, and may be deduced from, the identity of the target genes which VGAM1128 binds and inhibits, and the function of these target genes, as elaborated hereinbelow.

Cadherin, EGF LAG Seven-pass G-type Receptor 2 (flamingo homolog, Drosophila) (CELSR2, Accession NM_001408) is a VGAM1128 host target gene. CELSR2 BINDING SITE is HOST TARGET binding site found in the 3' untranslated region of mRNA encoded by CELSR2, corresponding to a HOST TARGET binding site such as BINDING SITE I, BINDING SITE II or BINDING SITE III. Table 2 illustrates the complementarity of the nucleotide sequences of CELSR2 BINDING SITE, designated SEQ ID:7105, to the nucleotide sequence of VGAM1128 RNA, herein designated VGAM RNA, also designated SEQ ID:3839.

A function of VGAM1128 is therefore inhibition of Cadherin, EGF LAG Seven-pass G-type Receptor 2 (flamingo homolog, Drosophila) (CELSR2, Accession NM_001408), a gene which is a calcium dependent cell adhesion protein. Accordingly, utilities of VGAM1128 include diagnosis, prevention and treatment of diseases and clinical conditions associated with CELSR2. The function of CELSR2 and its association with various diseases and clinical conditions, has been established by previous studies, as described hereinabove with reference to VGAM432. Leptin (obesity homolog, mouse) (LEP, Accession NM_000230) is another VGAM1128 host target gene. LEP BINDING SITE is HOST TARGET binding site found in the 3' untranslated region of mRNA encoded by LEP, corresponding to a HOST TARGET binding site such as BINDING SITE I, BINDING SITE II or BINDING SITE III. Table 2 illustrates the complementarity of the nucleotide sequences of LEP BINDING SITE, designated SEQ ID:5736, to the nucleotide sequence of VGAM1128 RNA, herein designated VGAM RNA, also designated SEQ ID:3839.

Another function of VGAM1128 is therefore inhibition of Leptin (obesity homolog, mouse) (LEP, Accession NM_000230). Accordingly, utilities of VGAM1128 include diagnosis, prevention and treatment of diseases and clinical conditions associated with LEP. Transcription Factor 3 (E2A immunoglobulin enhancer binding factors E12/E47) (TCF3, Accession XM_047600) is another VGAM1128 host target gene. TCF3 BINDING SITE is HOST TARGET binding site found in the 3' untranslated region of mRNA encoded by TCF3, corresponding to a HOST TARGET binding site such as BINDING SITE I, BINDING SITE II or BINDING SITE III. Table 2 illustrates the complementarity of the nucleotide sequences of TCF3 BINDING SITE, designated SEQ ID:35008, to the nucleotide sequence of VGAM1128 RNA, herein designated VGAM RNA, also designated SEQ ID:3839.

Another function of VGAM1128 is therefore inhibition of Transcription Factor 3 (E2A immunoglobulin enhancer binding factors E12/E47) (TCF3, Accession XM_047600), a gene which plays major roles in determining tissue-specific cell fate during embryogenesis. Accordingly, utilities of VGAM1128 include diagnosis, prevention and treatment of diseases and clinical conditions associated with TCF3. The function of TCF3 and its association with various diseases and clinical conditions, has been established by previous studies, as described hereinabove with reference to VGAM144. Chromosome 20 Open Reading Frame 162 (C20orf162, Accession NM_080603) is another VGAM1128 host target gene. C20orf162 BINDING SITE is HOST TARGET binding site found in the 5' untranslated region of mRNA encoded by C20orf162, corresponding to a HOST TARGET binding site such as BINDING SITE I, BINDING SITE II or BINDING SITE III. Table 2 illustrates the complementarity of the nucleotide sequences of C20orf162 BINDING SITE, designated SEQ ID:27921, to the nucleotide sequence of VGAM1128 RNA, herein designated VGAM RNA, also designated SEQ ID:3839.

Another function of VGAM1128 is therefore inhibition of Chromosome 20 Open Reading Frame 162 (C20orf162, Accession NM_080603). Accordingly, utilities of VGAM1128 include diagnosis, prevention and treatment of diseases and clinical conditions associated with C20orf162. DKFZp434K1210 (Accession NM_017606) is another VGAM1128 host target gene. DKFZp434K1210 BINDING SITE is HOST TARGET binding site found in the 3' untranslated region of mRNA encoded by DKFZp434K1210, corresponding to a HOST TARGET binding site such as BINDING SITE I, BINDING SITE II or BINDING SITE III. Table 2 illustrates the complementarity of the nucleotide sequences of DKFZp434K1210 BINDING SITE, designated SEQ ID:19100, to the nucleotide sequence of VGAM1128 RNA, herein designated VGAM RNA, also designated SEQ ID:3839.

Another function of VGAM1128 is therefore inhibition of DKFZp434K1210 (Accession NM_017606). Accordingly, utilities of VGAM1128 include diagnosis, prevention and treatment of diseases and clinical conditions associated with DKFZp434K1210. FLJ10737 (Accession NM_018198) is another VGAM1128 host target gene. FLJ10737 BINDING SITE is HOST TARGET binding site found in the 3' untranslated region of mRNA encoded by FLJ10737, corresponding to a HOST TARGET binding site such as BINDING SITE I, BINDING SITE II or BINDING SITE III. Table 2 illustrates the complementarity of the nucleotide sequences of FLJ10737 BINDING SITE, designated SEQ ID:20063, to the nucleotide sequence of VGAM1128 RNA, herein designated VGAM RNA, also designated SEQ ID:3839.

Another function of VGAM1128 is therefore inhibition of FLJ10737 (Accession NM_018198). Accordingly, utilities of VGAM1128 include diagnosis, prevention and treatment of diseases and clinical conditions associated with FLJ10737. FLJ10956 (Accession NM_018283) is another VGAM1128 host target gene. FLJ10956 BINDING SITE is HOST TARGET binding site found in the 3' untranslated region of mRNA encoded by FLJ10956, corresponding to a HOST TARGET binding site such as BINDING SITE I, BINDING SITE II or BINDING SITE III. Table 2 illustrates the complementarity of the nucleotide sequences of FLJ10956 BINDING SITE, designated SEQ ID:20277, to the nucleotide sequence of VGAM1128 RNA, herein designated VGAM RNA, also designated SEQ ID:3839.

Another function of VGAM1128 is therefore inhibition of FLJ10956 (Accession NM_018283). Accordingly, utilities of VGAM1128 include diagnosis, prevention and treatment of diseases and clinical conditions associated with FLJ10956. Glutamine-fructose-6-phosphate Transaminase 1 (GFPT1, Accession NM_002056) is another VGAM1128 host target gene. GFPT1 BINDING SITE is HOST TARGET binding site found in the 3' untranslated region of mRNA encoded by GFPT1, corresponding to a HOST TARGET binding site such as BINDING SITE I, BINDING SITE II or BINDING SITE III. Table 2 illustrates the complementarity of the nucleotide sequences of GFPT1 BINDING SITE, designated SEQ ID:7819, to the nucleotide sequence of VGAM1128 RNA, herein designated VGAM RNA, also designated SEQ ID:3839.

Another function of VGAM1128 is therefore inhibition of Glutamine-fructose-6-phosphate Transaminase 1 (GFPT1, Accession NM_002056). Accordingly, utilities of VGAM1128 include diagnosis, prevention and treatment of diseases and clinical conditions associated with GFPT1. G Protein-coupled Receptor Kinase-interactor 2 (GIT2, Accession NM_014776) is another VGAM1128 host target gene. GIT2 BINDING SITE1 through GIT2 BINDING SITE3 are HOST TARGET binding sites found in untranslated regions of mRNA encoded by GIT2, corresponding to HOST TARGET binding sites such as BINDING SITE I, BINDING SITE II or BINDING SITE III. Table 2 illustrates the complementarity of the nucleotide sequences of GIT2 BINDING SITE1 through GIT2 BINDING SITE3, designated SEQ ID:16597, SEQ ID:27692 and SEQ ID:27679 respectively, to the nucleotide sequence of VGAM1128 RNA, herein designated VGAM RNA, also designated SEQ ID:3839.

Another function of VGAM1128 is therefore inhibition of G Protein-coupled Receptor Kinase-interactor 2 (GIT2, Accession NM_014776). Accordingly, utilities of VGAM1128 include diagnosis, prevention and treatment of diseases and clinical conditions associated with GIT2. MGC13198 (Accession NM_032690) is another VGAM1128 host target gene. MGC13198 BINDING SITE is HOST TARGET binding site found in the 5' untranslated region of mRNA encoded by MGC13198, corresponding to a HOST TARGET binding site such as BINDING SITE I, BINDING SITE II or BINDING SITE III. Table 2 illustrates the complementarity of the nucleotide sequences of MGC13198 BINDING SITE, designated SEQ ID:26410, to the nucleotide sequence of VGAM1128 RNA, herein designated VGAM RNA, also designated SEQ ID:3839.

Another function of VGAM1128 is therefore inhibition of MGC13198 (Accession NM_032690). Accordingly, utilities of VGAM1128 include diagnosis, prevention and treatment of diseases and clinical conditions associated with MGC13198. SPEC1 (Accession NM_020239) is another VGAM1128 host target gene. SPEC1 BINDING SITE is HOST TARGET binding site found in the 3' untranslated region of mRNA encoded by SPEC1, corresponding to a HOST TARGET binding site such as BINDING SITE I, BINDING SITE II or BINDING SITE III. Table 2 illustrates the complementarity of the nucleotide sequences of SPEC1 BINDING SITE, designated SEQ ID:21507, to the nucleotide sequence of VGAM1128 RNA, herein designated VGAM RNA, also designated SEQ ID:3839.

Another function of VGAM1128 is therefore inhibition of SPEC1 (Accession NM_020239). Accordingly, utilities of VGAM1128 include diagnosis, prevention and treatment of diseases and clinical conditions associated with SPEC1. LOC146819 (Accession XM_085605) is another VGAM1128 host target gene. LOC146819 BINDING SITE is HOST TARGET binding site found in the 3' untranslated region of mRNA encoded by LOC146819, corresponding to a HOST TARGET binding site such as BINDING SITE I, BINDING SITE II or BINDING SITE III. Table 2 illustrates the complementarity of the nucleotide sequences of LOC146819 BINDING SITE, designated SEQ ID:38253, to the nucleotide sequence of VGAM1128 RNA, herein designated VGAM RNA, also designated SEQ ID:3839.

Another function of VGAM1128 is therefore inhibition of LOC146819 (Accession XM_085605). Accordingly, utilities of VGAM1128 include diagnosis, prevention and treatment of diseases and clinical conditions associated with LOC146819. LOC146821 (Accession XM_085597) is another VGAM1128 host target gene. LOC146821 BINDING SITE is HOST TARGET binding site found in the 3' untranslated region of mRNA encoded by LOC146821, corresponding to a HOST TARGET binding site such as BINDING SITE I, BINDING SITE II or BINDING SITE III. Table 2 illustrates the complementarity of the nucleotide sequences of LOC146821 BINDING SITE, designated SEQ ID:38251, to the nucleotide sequence of VGAM1128 RNA, herein designated VGAM RNA, also designated SEQ ID:3839.

Another function of VGAM1128 is therefore inhibition of LOC146821 (Accession XM_085597). Accordingly, utilities of VGAM1128 include diagnosis, prevention and treatment of diseases and clinical conditions associated with LOC146821. LOC153218 (Accession XM_087628) is another VGAM1128 host target gene. LOC153218 BINDING SITE is HOST TARGET binding site found in the 5' untranslated region of mRNA encoded by LOC153218, corresponding to a HOST TARGET binding site such as BINDING SITE I, BINDING SITE II or BINDING SITE III. Table 2 illustrates the complementarity of the nucleotide sequences of LOC153218 BINDING SITE, designated SEQ ID:39364, to the nucleotide sequence of VGAM1128 RNA, herein designated VGAM RNA, also designated SEQ ID:3839.

Another function of VGAM1128 is therefore inhibition of LOC153218 (Accession XM_087628). Accordingly, utilities of VGAM1128 include diagnosis, prevention and treatment of diseases and clinical conditions associated with LOC153218. LOC253187 (Accession XM_173139) is another VGAM1128 host target gene. LOC253187 BINDING SITE is HOST TARGET binding site found in the 5' untranslated region of mRNA encoded by LOC253187, corresponding to a HOST TARGET binding site such as BINDING SITE I, BINDING SITE II or BINDING SITE III. Table 2 illustrates the complementarity of the nucleotide sequences of LOC253187 BINDING SITE, designated SEQ ID:46393, to the nucleotide sequence of VGAM1128 RNA, herein designated VGAM RNA, also designated SEQ ID:3839.

Another function of VGAM1128 is therefore inhibition of LOC253187 (Accession XM_173139). Accordingly, utilities of VGAM1128 include diagnosis, prevention and treatment of diseases and clinical conditions associated with LOC253187. LOC253613 (Accession XM_171225) is another VGAM1128 host target gene. LOC253613 BINDING SITE is HOST TARGET binding site found in the 3' untranslated region of mRNA encoded by LOC253613, corresponding to a HOST TARGET binding site such as BINDING SITE I, BINDING SITE II or BINDING SITE III. Table 2 illustrates the complementarity of the nucleotide sequences of LOC253613 BINDING SITE, designated SEQ ID:46006, to the nucleotide sequence of VGAM1128 RNA, herein designated VGAM RNA, also designated SEQ ID:3839.

Another function of VGAM1128 is therefore inhibition of LOC253613 (Accession XM_171225). Accordingly, utilities of VGAM1128 include diagnosis, prevention and treatment of diseases and clinical conditions associated with LOC253613. LOC54466 (Accession NM_019003) is another VGAM1128 host target gene. LOC54466 BINDING SITE is HOST TARGET binding site found in the 3' untranslated region of mRNA encoded by LOC54466, corresponding to a HOST TARGET binding site such as BINDING SITE I, BINDING SITE II or BINDING SITE III. Table 2 illustrates the complementarity of the nucleotide sequences of LOC54466 BINDING SITE, designated SEQ ID:21075, to the nucleotide sequence of VGAM1128 RNA, herein designated VGAM RNA, also designated SEQ ID:3839.

Another function of VGAM1128 is therefore inhibition of LOC54466 (Accession NM_019003). Accordingly, utilities of VGAM1128 include diagnosis, prevention and treatment of diseases and clinical conditions associated with LOC54466. LOC91963 (Accession XM_041902) is another VGAM1128 host target gene. LOC91963 BINDING SITE is HOST TARGET binding site found in the 5' untranslated region of mRNA encoded by LOC91963, corresponding to a HOST TARGET binding site such as BINDING SITE I, BINDING SITE II or BINDING SITE III. Table 2 illustrates the complementarity of the nucleotide sequences of LOC91963 BINDING SITE, designated SEQ ID:33628, to the nucleotide sequence of VGAM1128 RNA, herein designated VGAM RNA, also designated SEQ ID:3839.

Another function of VGAM1128 is therefore inhibition of LOC91963 (Accession XM_041902). Accordingly, utilities of VGAM1128 include diagnosis, prevention and treatment of diseases and clinical conditions associated with LOC91963. FIG. 1 further provides a conceptual description of a novel bioinformatically detected viral gene of the present invention, referred to here as Viral Genomic Address Messenger 1129 (VGAM1129) viral gene, which modulates expression of respective host target genes thereof, the function and utility of which host target genes is known in the art.

VGAM1129 is a novel bioinformatically detected regulatory, non protein coding, viral micro RNA (miRNA) gene. The method by which VGAM1129 was detected is described hereinabove with reference to FIGS. 1-8.

VGAM1129 gene, herein designated VGAM GENE, is a viral gene contained in the genome of Barley Stripe Mosaic Virus. VGAM1129 host target gene, herein designated VGAM HOST TARGET GENE, is a human gene contained in the human genome.

VGAM1129 gene encodes a VGAM1129 precursor RNA, herein designated VGAM PRECURSOR RNA. Similar to other miRNA genes, and unlike most ordinary genes, VGAM1129 precursor RNA does not encode a protein. A nucleotide sequence identical or highly similar to the nucleotide sequence of VGAM1129 precursor RNA is designated SEQ ID:1115, and is provided hereinbelow with reference to the sequence listing part. Nucleotide sequence SEQ ID:1115 is located at position 2771 relative to the genome of Barley Stripe Mosaic Virus.

VGAM1129 precursor RNA folds onto itself, forming VGAM1129 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1129 folded precursor RNA into VGAM1129 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1129 RNA is designated SEQ ID:3840, and is provided hereinbelow with reference to the sequence listing part.

VGAM1129 host target gene, herein designated VGAM HOST TARGET GENE, encodes a corresponding messenger RNA, VGAM1129 host target RNA, herein designated VGAM HOST TARGET RNA. VGAM1129 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1129 RNA, herein designated VGAM RNA, binds complementarily to one or more host target binding sites located in untranslated regions of VGAM1129 host target RNA, herein designated VGAM HOST TARGET RNA. This complementary binding is due to the fact that the nucleotide sequence of VGAM1129 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1129 RNA, herein designated VGAM RNA, may have a different number of host target binding sites in untranslated regions of a VGAM1129 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1129 RNA, herein designated VGAM RNA, to host target binding sites on VGAM1129 host target RNA, herein designated VGAM HOST TARGET RNA, such as BINDING SITE I, BINDING SITE II and BINDING SITE III, inhibits translation of VGAM1129 host target RNA into VGAM1129 host target protein, herein designated VGAM HOST TARGET PROTEIN. VGAM host target protein is therefore outlined by a broken line.

It is appreciated that VGAM1129 host target gene, herein designated VGAM HOST TARGET GENE, in fact represents a plurality of VGAM1129 host target genes. The mRNA of each one of this plurality of VGAM1129 host target genes comprises one or more host target binding sites, each having a nucleotide sequence which is at least partly complementary to VGAM1129 RNA, herein designated VGAM RNA, and which when bound by VGAM1129 RNA causes inhibition of translation of respective one or more VGAM1129 host target proteins.

It is further appreciated by one skilled in the art that the mode of translational inhibition illustrated by FIG. 1 with specific reference to translational inhibition exerted by VGAM1129 gene, herein designated VGAM GENE, on one or more VGAM1129 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1129 is inhibition of expression of host target genes, as part of a novel viral mechanism of attacking a host. Accordingly, utilities of VGAM1129 include diagnosis, prevention and treatment of viral infection by Barley Stripe Mosaic Virus. Specific functions, and accordingly utilities, of VGAM1129 correlate with, and may be deduced from, the identity of the host target genes which VGAM1129 binds and inhibits, and the function of these host target genes, as elaborated hereinbelow.

Nucleotide sequences of the VGAM1129 precursor RNA, herein designated VGAM PRECURSOR RNA, and of the 'diced' VGAM1129 RNA, herein designated VGAM RNA, and a schematic representation of the secondary folding of VGAM1129 folded precursor RNA, herein designated VGAM FOLDED PRECURSOR RNA, of VGAM1129 are further described hereinbelow with reference to Table 1.

Nucleotide sequences of host target binding sites, such as BINDING SITE-I, BINDING SITE-II and BINDING SITE-III of FIG. 1, found on VGAM1129 host target RNA, and schematic representation of the complementarity of each of these host target binding sites to VGAM1129 RNA, herein designated VGAM RNA, are described hereinbelow with reference to Table 2.

As mentioned hereinabove with reference to FIG. 1, a function of VGAM1129 gene, herein designated VGAM is inhibition of expression of VGAM1129 target genes. It is appreciated that specific functions, and accordingly utilities, of VGAM1129 correlate with, and may be deduced from, the identity of the target genes which VGAM1129 binds and inhibits, and the function of these target genes, as elaborated hereinbelow.

Dystroglycan 1 (dystrophin-associated glycoprotein 1) (DAG1, Accession NM_004393) is a VGAM1129 host target gene. DAG1 BINDING SITE is HOST TARGET binding site found in the 3' untranslated region of mRNA encoded by DAG1, corresponding to a HOST TARGET binding site such as BINDING SITE I, BINDING SITE II or BINDING SITE III. Table 2 illustrates the complementarity of the nucleotide sequences of DAG1 BINDING SITE, designated SEQ ID:10633, to the nucleotide sequence of VGAM1129 RNA, herein designated VGAM RNA, also designated SEQ ID:3840.

A function of VGAM1129 is therefore inhibition of Dystroglycan 1 (dystrophin-associated glycoprotein 1) (DAG1, Accession NM_004393), a gene which may provide linkage between the sarcolemma and extracellular matrix (ECM). Accordingly, utilities of VGAM1129 include diagnosis, prevention and treatment of diseases and clinical conditions associated with DAG1. The function of DAG1 and its association with various diseases and clinical conditions, has been established by previous studies, as described hereinabove with reference to VGAM1095. ATPase, (Na+)/K+ Transporting, Beta 4 Polypeptide (ATP1B4, Accession NM_012069) is another VGAM1129 host target gene. ATP1B4 BINDING SITE is HOST TARGET binding site found in the 3' untranslated region of mRNA encoded by ATP1B4, corresponding to a HOST TARGET binding site such as BINDING SITE I, BINDING SITE II or BINDING SITE III. Table 2 illustrates the complementarity of the nucleotide sequences of ATP1B4 BINDING SITE, designated SEQ ID:14327, to the nucleotide sequence of VGAM1129 RNA, herein designated VGAM RNA, also designated SEQ ID:3840.

Another function of VGAM1129 is therefore inhibition of ATPase, (Na+)/K+ Transporting, Beta 4 Polypeptide (ATP1B4, Accession NM_012069). Accordingly, utilities of VGAM1129 include diagnosis, prevention and treatment of diseases and clinical conditions associated with ATP1B4. DKFZP564C196 (Accession XM_046405) is another VGAM1129 host target gene. DKFZP564C196 BINDING SITE is HOST TARGET binding site found in the 3' untranslated region of mRNA encoded by DKFZP564C196, corresponding to a HOST TARGET binding site such as BINDING SITE I, BINDING SITE II or BINDING SITE III. Table 2 illustrates the complementarity of the nucleotide sequences of DKFZP564C196 BINDING SITE, designated SEQ ID:34712, to the nucleotide sequence of VGAM1129 RNA, herein designated VGAM RNA, also designated SEQ ID:3840.

Another function of VGAM1129 is therefore inhibition of DKFZP564C196 (Accession XM_046405). Accordingly, utilities of VGAM1129 include diagnosis, prevention and treatment of diseases and clinical conditions associated with DKFZP564C196. PP1057 (Accession NM_031285) is another VGAM1129 host target gene. PP1057 BINDING SITE is HOST TARGET binding site found in the 3' untranslated region of mRNA encoded by PP1057, corresponding to a HOST TARGET binding site such as BINDING SITE I, BINDING SITE II or BINDING SITE III. Table 2 illustrates the complementarity of the nucleotide sequences of PP1057 BINDING SITE, designated SEQ ID:25311, to the nucleotide sequence of VGAM1129 RNA, herein designated VGAM RNA, also designated SEQ ID:3840.

Another function of VGAM1129 is therefore inhibition of PP1057 (Accession NM_031285). Accordingly, utilities of VGAM1129 include diagnosis, prevention and treatment of diseases and clinical conditions associated with PP1057. LOC143920 (Accession XM_084658) is another VGAM1129 host target gene. LOC143920 BINDING SITE is HOST TARGET binding site found in the 3' untranslated region of mRNA encoded by LOC143920, corresponding to a HOST TARGET binding site such as BINDING SITE I, BINDING SITE II or BINDING SITE III. Table 2 illustrates the complementarity of the nucleotide sequences of LOC143920 BINDING SITE, designated SEQ ID:37642, to the nucleotide sequence of VGAM1129 RNA, herein designated VGAM RNA, also designated SEQ ID:3840.

Another function of VGAM1129 is therefore inhibition of LOC143920 (Accession XM_084658). Accordingly, utilities of VGAM1129 include diagnosis, prevention and treatment of diseases and clinical conditions associated with LOC143920. LOC154881 (Accession XM_088063) is another VGAM1129 host target gene. LOC154881 BINDING SITE is HOST TARGET binding site found in the 3' untranslated region of mRNA encoded by LOC154881, corresponding to a HOST TARGET binding site such as BINDING SITE I, BINDING SITE II or BINDING SITE III. Table 2 illustrates the complementarity of the nucleotide sequences of LOC154881 BINDING SITE, designated SEQ ID:39499, to the nucleotide sequence of VGAM1129 RNA, herein designated VGAM RNA, also designated SEQ ID:3840.

Another function of VGAM1129 is therefore inhibition of LOC154881 (Accession XM_088063). Accordingly, utilities of VGAM1129 include diagnosis, prevention and treatment of diseases and clinical conditions associated with LOC154881. LOC255152 (Accession XM_173310) is another VGAM1129 host target gene. LOC255152 BINDING SITE is HOST TARGET binding site found in the 5' untranslated region of mRNA encoded by LOC255152, corresponding to a HOST TARGET binding site such as BINDING SITE I, BINDING SITE II or BINDING SITE III. Table 2 illustrates the complementarity of the nucleotide sequences of LOC255152 BINDING SITE, designated SEQ ID:46534, to the nucleotide sequence of VGAM1129 RNA, herein designated VGAM RNA, also designated SEQ ID:3840.

Another function of VGAM1129 is therefore inhibition of LOC255152 (Accession XM_173310). Accordingly, utilities of VGAM1129 include diagnosis, prevention and treatment of diseases and clinical conditions associated with LOC255152. LOC255481 (Accession XM_170489) is another VGAM1129 host target gene. LOC255481 BINDING SITE is HOST TARGET binding site found in the 3' untranslated region of mRNA encoded by LOC255481, corresponding to a HOST TARGET binding site such as BINDING SITE I, BINDING SITE II or BINDING SITE III. Table 2 illustrates the complementarity of the nucleotide sequences of LOC255481 BINDING SITE, designated SEQ ID:45330, to the nucleotide sequence of VGAM1129 RNA, herein designated VGAM RNA, also designated SEQ ID:3840.

Another function of VGAM1129 is therefore inhibition of LOC255481 (Accession XM_170489). Accordingly, utilities of VGAM1129 include diagnosis, prevention and treatment of diseases and clinical conditions associated with LOC255481. LOC91301 (Accession XM_037564) is another VGAM1129 host target gene. LOC91301 BINDING SITE is HOST TARGET binding site found in the 5' untranslated region of mRNA encoded by LOC91301, corresponding to a HOST TARGET binding site such as BINDING SITE I, BINDING SITE II or BINDING SITE III. Table 2 illustrates the complementarity of the nucleotide sequences of LOC91301 BINDING SITE, designated SEQ ID:32648, to the nucleotide sequence of VGAM1129 RNA, herein designated VGAM RNA, also designated SEQ ID:3840.

Another function of VGAM1129 is therefore inhibition of LOC91301 (Accession XM_037564). Accordingly, utilities of VGAM1129 include diagnosis, prevention and treatment of diseases and clinical conditions associated with LOC91301. FIG. 1 further provides a conceptual description of a novel bioinformatically detected viral gene of the present invention, referred to here as Viral Genomic Address Messenger 1130 (VGAM1130) viral gene, which modulates expression of respective host target genes thereof, the function and utility of which host target genes is known in the art.

VGAM1130 is a novel bioinformatically detected regulatory, non protein coding, viral micro RNA (miRNA) gene. The method by which VGAM1130 was detected is described hereinabove with reference to FIGS. 1-8.

VGAM1130 gene, herein designated VGAM GENE, is a viral gene contained in the genome of Barley Stripe Mosaic Virus. VGAM1130 host target gene, herein designated VGAM HOST TARGET GENE, is a human gene contained in the human genome.

VGAM1130 gene encodes a VGAM1130 precursor RNA, herein designated VGAM PRECURSOR RNA. Similar to other miRNA genes, and unlike most ordinary genes, VGAM1130 precursor RNA does not encode a protein. A nucleotide sequence identical or highly similar to the nucleotide sequence of VGAM1130 precursor RNA is designated SEQ ID:1116, and is provided hereinbelow with reference to the sequence listing part. Nucleotide sequence SEQ ID:1116 is located at position 3018 relative to the genome of Barley Stripe Mosaic Virus.

VGAM1130 precursor RNA folds onto itself, forming VGAM1130 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1130 folded precursor RNA into VGAM1130 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1130 RNA is designated SEQ ID:3841, and is provided hereinbelow with reference to the sequence listing part.

VGAM1130 host target gene, herein designated VGAM HOST TARGET GENE, encodes a corresponding messenger RNA, VGAM1130 host target RNA, herein designated VGAM HOST TARGET RNA. VGAM1130 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1130 RNA, herein designated VGAM RNA, binds complementarily to one or more host target binding sites located in untranslated regions of VGAM1130 host target RNA, herein designated VGAM HOST TARGET RNA. This complementary binding is due to the fact that the nucleotide sequence of VGAM1130 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1130 RNA, herein designated VGAM RNA, may have a different number of host target binding sites in untranslated regions of a VGAM1130 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1130 RNA, herein designated VGAM RNA, to host target binding sites on VGAM1130 host target RNA, herein designated VGAM HOST TARGET RNA, such as BINDING SITE I, BINDING SITE II and BINDING SITE III, inhibits translation of VGAM1130 host target RNA into VGAM1130 host target protein, herein designated VGAM HOST TARGET PROTEIN. VGAM host target protein is therefore outlined by a broken line.

It is appreciated that VGAM1130 host target gene, herein designated VGAM HOST TARGET GENE, in fact represents a plurality of VGAM1130 host target genes. The mRNA of each one of this plurality of VGAM1130 host target genes comprises one or more host target binding sites, each having a nucleotide sequence which is at least partly complementary to VGAM1130 RNA, herein designated VGAM RNA, and which when bound by VGAM1130 RNA causes inhibition of translation of respective one or more VGAM1130 host target proteins.

It is further appreciated by one skilled in the art that the mode of translational inhibition illustrated by FIG. 1 with specific reference to translational inhibition exerted by VGAM1130 gene, herein designated VGAM GENE, on one or more VGAM1130 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1130 is inhibition of expression of host target genes, as part of a novel viral mechanism of attacking a host. Accordingly, utilities of VGAM1130 include diagnosis, prevention and treatment of viral infection by Barley Stripe Mosaic Virus. Specific functions, and accordingly utilities, of VGAM1130 correlate with, and may be deduced from, the identity of the host target genes which VGAM1130 binds and inhibits, and the function of these host target genes, as elaborated hereinbelow.

Nucleotide sequences of the VGAM1130 precursor RNA, herein designated VGAM PRECURSOR RNA, and of the 'diced' VGAM1130 RNA, herein designated VGAM RNA, and a schematic representation of the secondary folding of VGAM1130 folded precursor RNA, herein designated VGAM FOLDED PRECURSOR RNA, of VGAM1130 are further described hereinbelow with reference to Table 1.

Nucleotide sequences of host target binding sites, such as BINDING SITE-I, BINDING SITE-II and BINDING SITE-III of FIG. 1, found on VGAM1130 host target RNA, and schematic representation of the complementarity of each of these host target binding sites to VGAM1130 RNA, herein designated VGAM RNA, are described hereinbelow with reference to Table 2.

As mentioned hereinabove with reference to FIG. 1, a function of VGAM1130 gene, herein designated VGAM is inhibition of expression of VGAM1130 target genes. It is appreciated that specific functions, and accordingly utilities, of VGAM1130 correlate with, and may be deduced from, the identity of the target genes which VGAM1130 binds and inhibits, and the function of these target genes, as elaborated hereinbelow.

NDRG Family Member 2 (NDRG2, Accession NM_016250) is a VGAM1130 host target gene. NDRG2 BINDING SITE is HOST TARGET binding site found in the 3' untranslated region of mRNA encoded by NDRG2, corresponding to a HOST TARGET binding site such as BINDING SITE I, BINDING SITE II or BINDING SITE III. Table 2 illustrates the complementarity of the nucleotide sequences of NDRG2 BINDING SITE, designated SEQ ID:18378, to the nucleotide sequence of VGAM1130 RNA, herein designated VGAM RNA, also designated SEQ ID:3841.

A function of VGAM1130 is therefore inhibition of NDRG Family Member 2 (NDRG2, Accession NM_016250), a gene which belongs to the ndrg family. Accordingly, utilities of VGAM1130 include diagnosis, prevention and treatment of diseases and clinical conditions associated with NDRG2. The function of NDRG2 has been established by previous studies. Van Belzen et al. (1997) and Piquemal et al. (1999) demonstrated the existence of an Ndr gene family in mouse and human. Using the novel mouse sequences of Ndr2 and Ndr3 to search the human genome databases, Kalaydjieva et al. (2000) identified the homologous human genes, which they referred as NDRG2 and NDRG3 (OMIM Ref. No. 605273). Kalaydjieva et al. (2000) stated that the 3 known human NDRG proteins show considerable homology:54% amino acid sequence identity between NDRG1 (OMIM Ref. No. 605262) and NDRG2, 67% between NDRG1 and NDRG3, and 58% between NDRG2 and NDRG3. By radiation hybrid analysis, Kalaydjieva et al. (2000) mapped the NDRG2 gene to chromosome 14q11.2.

Full details of the abovementioned studies are described in the following publications, the disclosure of which are hereby incorporated by reference:

Kalaydjieva, L.; Gresham, D.; Gooding, R.; Heather, L.; Baas, F.; de Jonge, R.; Blechschmidt, K.; Angelicheva, D.; Chandler, D.; Worsley, P.; Rosenthal, A.; King, R. H. M.; Thomas, P. K.: N-myc downstream-regulated gene 1 is mutated in hereditary motor and sensory neuropathy-Lom. Am. J. Hum. Genet. 67:47-58, 2000; and Piquemal, D.; Joulia, D.; Balaguer, P.; Basset, A.; Marti, J.; Commes, T.: Differential expression of the RTP/Drg1/Ndr1 gene product in proliferating and growth arrested cells. Biochi.

Further studies establishing the function and utilities of NDRG2 are found in John Hopkins OMIM database record ID 605272, and in sited publications numbered 135 and 6612 listed in the bibliography section hereinbelow, which are also hereby incorporated by reference. AD022 (Accession XM_165725) is another VGAM1130 host target gene. AD022 BINDING SITE is HOST TARGET binding site found in the 3' untranslated region of mRNA encoded by AD022, corresponding to a HOST TARGET binding site such as BINDING SITE I, BINDING SITE II or BINDING SITE III. Table 2 illustrates the complementarity of the nucleotide sequences of AD022 BINDING SITE, designated SEQ ID:43737, to the nucleotide sequence of VGAM1130 RNA, herein designated VGAM RNA, also designated SEQ ID:3841.

Another function of VGAM1130 is therefore inhibition of AD022 (Accession XM_165725). Accordingly, utilities of VGAM1130 include diagnosis, prevention and treatment of diseases and clinical conditions associated with AD022. KIAA0534 (Accession XM_049349) is another VGAM1130 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35384, to the nucleotide sequence of VGAM1130 RNA, herein designated VGAM RNA, also designated SEQ ID:3841.

Another function of VGAM1130 is therefore inhibition of KIAA0534 (Accession XM_049349). Accordingly, utilities of VGAM1130 include diagnosis, prevention and treatment of diseases and clinical conditions associated with KIAA0534. Oxysterol Binding Protein-like 2 (OSBPL2, Accession NM_014835) is another VGAM1130 host target gene. OSBPL2 BINDING SITE1 and OSBPL2 BINDING SITE2 are HOST TARGET binding sites found in untranslated regions of mRNA encoded by OSBPL2, corresponding to HOST TARGET binding sites such as BINDING SITE I, BINDING SITE II or BINDING SITE III. Table 2 illustrates the complementarity of the nucleotide sequences of OSBPL2 BINDING SITE1 and OSBPL2 BINDING SITE2, designated SEQ ID:16848 and SEQ ID:29316 respectively, to the nucleotide sequence of VGAM1130 RNA, herein designated VGAM RNA, also designated SEQ ID:3841.

Another function of VGAM1130 is therefore inhibition of Oxysterol Binding Protein-like 2 (OSBPL2, Accession NM_014835). Accordingly, utilities of VGAM1130 include diagnosis, prevention and treatment of diseases and clinical conditions associated with OSBPL2. TUBB5 (Accession NM_006087) is another VGAM1130 host target gene. TUBB5 BINDING SITE is HOST TARGET binding site found in the 3' untranslated region of mRNA encoded by TUBB5, corresponding to a HOST TARGET binding site such as BINDING SITE I, BINDING SITE II or BINDING SITE III. Table 2 illustrates the complementarity of the nucleotide sequences of TUBB5 BINDING SITE, designated SEQ ID:12729, to the nucleotide sequence of VGAM1130 RNA, herein designated VGAM RNA, also designated SEQ ID:3841.

Another function of VGAM1130 is therefore inhibition of TUBB5 (Accession NM_006087). Accordingly, utilities of VGAM1130 include diagnosis, prevention and treatment of diseases and clinical conditions associated with TUBB5. LOC157657 (Accession XM_088352) is another VGAM1130 host target gene. LOC157657 BINDING SITE is HOST TARGET binding site found in the 3' untranslated region of mRNA encoded by LOC157657, corresponding to a HOST TARGET binding site such as BINDING SITE I, BINDING SITE II or BINDING SITE III. Table 2 illustrates the complementarity of the nucleotide sequences of LOC157657 BINDING SITE, designated SEQ ID:39625, to the nucleotide sequence of VGAM1130 RNA, herein designated VGAM RNA, also designated SEQ ID:3841.

Another function of VGAM1130 is therefore inhibition of LOC157657 (Accession XM_088352). Accordingly, utilities of VGAM1130 include diagnosis, prevention and treatment of diseases and clinical conditions associated with LOC157657. FIG. 1 further provides a conceptual description of a novel bioinformatically detected viral gene of the present invention, referred to here as Viral Genomic Address Messenger 1131 (VGAM1131) viral gene, which modulates expression of respective host target genes thereof, the function and utility of which host target genes is known in the art.

VGAM1131 is a novel bioinformatically detected regulatory, non protein coding, viral micro RNA (miRNA) gene. The method by which VGAM1131 was detected is described hereinabove with reference to FIGS. 1-8.

VGAM1131 gene, herein designated VGAM GENE, is a viral gene contained in the genome of Barley Stripe Mosaic Virus. VGAM1131 host target gene, herein designated VGAM HOST TARGET GENE, is a human gene contained in the human genome.

VGAM1131 gene encodes a VGAM1131 precursor RNA, herein designated VGAM PRECURSOR RNA. Similar to other miRNA genes, and unlike most ordinary genes, VGAM1131 precursor RNA does not encode a protein. A nucleotide sequence identical or highly similar to the nucleotide sequence of VGAM1131 precursor RNA is designated SEQ ID:1117, and is provided hereinbelow with reference to the sequence listing part. Nucleotide sequence SEQ ID:1117 is located at position 1786 relative to the genome of Barley Stripe Mosaic Virus.

VGAM1131 precursor RNA folds onto itself, forming VGAM1131 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1131 folded precursor RNA into VGAM1131 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1131 RNA is designated SEQ ID:3842, and is provided hereinbelow with reference to the sequence listing part.

VGAM1131 host target gene, herein designated VGAM HOST TARGET GENE, encodes a corresponding messenger RNA, VGAM1131 host target RNA, herein designated VGAM HOST TARGET RNA. VGAM1131 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1131 RNA, herein designated VGAM RNA, binds complementarily to one or more host target binding sites located in untranslated regions of VGAM1131 host target RNA, herein designated VGAM HOST TARGET RNA. This complementary binding is due to the fact that the nucleotide sequence of VGAM1131 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1131 RNA, herein designated VGAM RNA, may have a different number of host target binding sites in untranslated regions of a VGAM1131 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1131 RNA, herein designated VGAM RNA, to host target binding sites on VGAM1131 host target RNA, herein designated VGAM HOST TARGET RNA, such as BINDING SITE I, BINDING SITE II and BINDING SITE III, inhibits translation of VGAM1131 host target RNA into VGAM1131 host target protein, herein designated VGAM HOST TARGET PROTEIN. VGAM host target protein is therefore outlined by a broken line.

It is appreciated that VGAM1131 host target gene, herein designated VGAM HOST TARGET GENE, in fact represents a plurality of VGAM1131 host target genes. The mRNA of each one of this plurality of VGAM1131 host target genes comprises one or more host target binding sites, each having a nucleotide sequence which is at least partly complementary to VGAM1131 RNA, herein designated VGAM RNA, and which when bound by VGAM1131 RNA causes inhibition of translation of respective one or more VGAM1131 host target proteins.

It is further appreciated by one skilled in the art that the mode of translational inhibition illustrated by FIG. 1 with specific reference to translational inhibition exerted by VGAM1131 gene, herein designated VGAM GENE, on one or more VGAM1131 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1131 is inhibition of expression of host target genes, as part of a novel viral mechanism of attacking a host. Accordingly, utilities of VGAM1131 include diagnosis, prevention and treatment of viral infection by Barley Stripe Mosaic Virus. Specific functions, and accordingly utilities, of VGAM1131 correlate with, and may be deduced from, the identity of the host target genes which VGAM1131 binds and inhibits, and the function of these host target genes, as elaborated hereinbelow.

Nucleotide sequences of the VGAM1131 precursor RNA, herein designated VGAM PRECURSOR RNA, and of the 'diced' VGAM1131 RNA, herein designated VGAM RNA, and a schematic representation of the secondary folding of VGAM1131 folded precursor RNA, herein designated VGAM FOLDED PRECURSOR RNA, of VGAM1131 are further described hereinbelow with reference to Table 1.

Nucleotide sequences of host target binding sites, such as BINDING SITE-I, BINDING SITE-II and BINDING SITE-III of FIG. 1, found on VGAM1131 host target RNA, and schematic representation of the complementarity of each of these host target binding sites to VGAM1131 RNA, herein designated VGAM RNA, are described hereinbelow with reference to Table 2.

As mentioned hereinabove with reference to FIG. 1, a function of VGAM1131 gene, herein designated VGAM is inhibition of expression of VGAM1131 target genes. It is appreciated that specific functions, and accordingly utilities, of VGAM1131 correlate with, and may be deduced from, the identity of the target genes which VGAM1131 binds and inhibits, and the function of these target genes, as elaborated hereinbelow.

Myotubularin Related Protein 8 (MTMR8, Accession NM_015458) is a VGAM1131 host target gene. MTMR8 BINDING SITE is HOST TARGET binding site found in the 3' untranslated region of mRNA encoded by MTMR8, corresponding to a HOST TARGET binding site such as BINDING SITE I, BINDING SITE II or BINDING SITE III. Table 2 illustrates the complementarity of the nucleotide sequences of MTMR8 BINDING SITE, designated SEQ ID:17751, to the nucleotide sequence of VGAM1131 RNA, herein designated VGAM RNA, also designated SEQ ID:3842.

A function of VGAM1131 is therefore inhibition of Myotubularin Related Protein 8 (MTMR8, Accession NM_015458), a gene which could be a tyrosine-phosphatase. Accordingly, utilities of VGAM1131 include diagnosis, prevention and treatment of diseases and clinical conditions associated with MTMR8. The function of MTMR8 and its association with various diseases and clinical conditions, has been established by previous studies, as described hereinabove with reference to VGAM379. FLJ10520 (Accession NM_018124) is another VGAM1131 host target gene. FLJ10520 BINDING SITE is HOST TARGET binding site found in the 3' untranslated region of mRNA encoded by FLJ10520, corresponding to a HOST TARGET binding site such as BINDING SITE I, BINDING SITE II or BINDING SITE III. Table 2 illustrates the complementarity of the nucleotide sequences of FLJ10520 BINDING SITE, designated SEQ ID:19909, to the nucleotide sequence of VGAM1131 RNA, herein designated VGAM RNA, also designated SEQ ID:3842.

Another function of VGAM1131 is therefore inhibition of FLJ10520 (Accession NM_018124). Accordingly, utilities of VGAM1131 include diagnosis, prevention and treatment of diseases and clinical conditions associated with FLJ10520. FLJ31564 (Accession NM_144720) is another VGAM1131 host target gene. FLJ31564 BINDING SITE is HOST TARGET binding site found in the 5' untranslated region of mRNA encoded by FLJ31564, corresponding to a HOST TARGET binding site such as BINDING SITE I, BINDING SITE II or BINDING SITE III. Table 2 illustrates the complementarity of the nucleotide sequences of FLJ31564 BINDING SITE, designated SEQ ID:29541, to the nucleotide sequence of VGAM1131 RNA, herein designated VGAM RNA, also designated SEQ ID:3842.

Another function of VGAM1131 is therefore inhibition of FLJ31564 (Accession NM_144720). Accordingly, utilities of VGAM1131 include diagnosis, prevention and treatment of diseases and clinical conditions associated with FLJ31564. MGC13114 (Accession NM_032366) is another VGAM1131 host target gene. MGC13114 BINDING SITE is HOST TARGET binding site found in the 3' untranslated region of mRNA encoded by MGC13114, corresponding to a HOST TARGET binding site such as BINDING SITE I, BINDING SITE II or BINDING SITE III. Table 2 illustrates the complementarity of the nucleotide sequences of MGC13114 BINDING SITE, designated SEQ ID:26153, to the nucleotide sequence of VGAM1131 RNA, herein designated VGAM RNA, also designated SEQ ID:3842.

Another function of VGAM1131 is therefore inhibition of MGC13114 (Accession NM_032366). Accordingly, utilities of VGAM1131 include diagnosis, prevention and treatment of diseases and clinical conditions associated with MGC13114. LOC145836 (Accession XM_096881) is another VGAM1131 host target gene. LOC145836 BINDING SITE is HOST TARGET binding site found in the 5' untranslated region of mRNA encoded by LOC145836, corresponding to a HOST TARGET binding site such as BINDING SITE I, BINDING SITE II or BINDING SITE III. Table 2 illustrates the complementarity of the nucleotide sequences of LOC145836 BINDING SITE, designated SEQ ID:40614, to the nucleotide sequence of VGAM1131 RNA, herein designated VGAM RNA, also designated SEQ ID:3842.

Another function of VGAM1131 is therefore inhibition of LOC145836 (Accession XM_096881). Accordingly, utilities of VGAM1131 include diagnosis, prevention and treatment of diseases and clinical conditions associated with LOC145836. LOC221466 (Accession XM_168087) is another VGAM1131 host target gene. LOC221466 BINDING SITE is HOST TARGET binding site found in the 3' untranslated region of mRNA encoded by LOC221466, corresponding to a HOST TARGET binding site such as BINDING SITE I, BINDING SITE II or BINDING SITE III. Table 2 illustrates the complementarity of the nucleotide sequences of LOC221466 BINDING SITE, designated SEQ ID:44996, to the nucleotide sequence of VGAM1131 RNA, herein designated VGAM RNA, also designated SEQ ID:3842.

Another function of VGAM1131 is therefore inhibition of LOC221466 (Accession XM_168087). Accordingly, utilities of VGAM1131 include diagnosis, prevention and treatment of diseases and clinical conditions associated with LOC221466. LOC57086 (Accession NM_020351) is another VGAM1131 host target gene. LOC57086 BINDING SITE is HOST TARGET binding site found in the 5' untranslated region of mRNA encoded by LOC57086, corresponding to a HOST TARGET binding site such as BINDING SITE I, BINDING SITE II or BINDING SITE III. Table 2 illustrates the complementarity of the nucleotide sequences of LOC57086 BINDING SITE, designated SEQ ID:21617, to the nucleotide sequence of VGAM1131 RNA, herein designated VGAM RNA, also designated SEQ ID:3842.

Another function of VGAM1131 is therefore inhibition of LOC57086 (Accession NM_020351). Accordingly, utilities of VGAM1131 include diagnosis, prevention and treatment of diseases and clinical conditions associated with LOC57086. FIG. 1 further provides a conceptual description of a novel bioinformatically detected viral gene of the present invention, referred to here as Viral Genomic Address Messenger 1132 (VGAM1132) viral gene, which modulates expression of respective host target genes thereof, the function and utility of which host target genes is known in the art.

VGAM1132 is a novel bioinformatically detected regulatory, non protein coding, viral micro RNA (miRNA) gene. The method by which VGAM1132 was detected is described hereinabove with reference to FIGS. 1-8.

VGAM1132 gene, herein designated VGAM GENE, is a viral gene contained in the genome of Barley Stripe Mosaic Virus. VGAM1132 host target gene, herein designated VGAM HOST TARGET GENE, is a human gene contained in the human genome.

VGAM1132 gene encodes a VGAM1132 precursor RNA, herein designated VGAM PRECURSOR RNA. Similar to other miRNA genes, and unlike most ordinary genes, VGAM1132 precursor RNA does not encode a protein. A nucleotide sequence identical or highly similar to the nucleotide sequence of VGAM1132 precursor RNA is designated SEQ ID:1118, and is provided hereinbelow with reference to the sequence listing part. Nucleotide sequence SEQ ID:1118 is located at position 849 relative to the genome of Barley Stripe Mosaic Virus.

VGAM1132 precursor RNA folds onto itself, forming VGAM1132 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1132 folded precursor RNA into VGAM1132 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1132 RNA is designated SEQ ID:3843, and is provided hereinbelow with reference to the sequence listing part.

VGAM1132 host target gene, herein designated VGAM HOST TARGET GENE, encodes a corresponding messenger RNA, VGAM1132 host target RNA, herein designated VGAM HOST TARGET RNA. VGAM1132 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1132 RNA, herein designated VGAM RNA, binds complementarily to one or more host target binding sites located in untranslated regions of VGAM1132 host target RNA, herein designated VGAM HOST TARGET RNA. This complementary binding is due to the fact that the nucleotide sequence of VGAM1132 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1132 RNA, herein designated VGAM RNA, may have a different number of host target binding sites in untranslated regions of a VGAM1132 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1132 RNA, herein designated VGAM RNA, to host target binding sites on VGAM1132 host target RNA, herein designated VGAM HOST TARGET RNA, such as BINDING SITE I, BINDING SITE II and BINDING SITE III, inhibits translation of VGAM1132 host target RNA into VGAM1132 host target protein, herein designated VGAM HOST TARGET PROTEIN. VGAM host target protein is therefore outlined by a broken line.

It is appreciated that VGAM1132 host target gene, herein designated VGAM HOST TARGET GENE, in fact represents a plurality of VGAM1132 host target genes. The mRNA of each one of this plurality of VGAM1132 host target genes comprises one or more host target binding sites, each having a nucleotide sequence which is at least partly complementary to VGAM1132 RNA, herein designated VGAM RNA, and which when bound by VGAM1132 RNA causes inhibition of translation of respective one or more VGAM1132 host target proteins.

It is further appreciated by one skilled in the art that the mode of translational inhibition illustrated by FIG. 1 with specific reference to translational inhibition exerted by VGAM1132 gene, herein designated VGAM GENE, on one or more VGAM1132 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1132 is inhibition of expression of host target genes, as part of a novel viral mechanism of attacking a host. Accordingly, utilities of VGAM1132 include diagnosis, prevention and treatment of viral infection by Barley Stripe Mosaic Virus. Specific functions, and accordingly utilities, of VGAM1132 correlate with, and may be deduced from, the identity of the host target genes which VGAM1132 binds and inhibits, and the function of these host target genes, as elaborated hereinbelow.

Nucleotide sequences of the VGAM1132 precursor RNA, herein designated VGAM PRECURSOR RNA, and of the 'diced' VGAM1132 RNA, herein designated VGAM RNA, and a schematic representation of the secondary folding of VGAM1132 folded precursor RNA, herein designated VGAM FOLDED PRECURSOR RNA, of VGAM1132 are further described hereinbelow with reference to Table 1.

Nucleotide sequences of host target binding sites, such as BINDING SITE-I, BINDING SITE-II and BINDING SITE-III of FIG. 1, found on VGAM1132 host target RNA, and schematic representation of the complementarity of each of these host target binding sites to VGAM1132 RNA, herein designated VGAM RNA, are described hereinbelow with reference to Table 2.

As mentioned hereinabove with reference to FIG. 1, a function of VGAM1132 gene, herein designated VGAM is inhibition of expression of VGAM1132 target genes. It is appreciated that specific functions, and accordingly utilities, of VGAM1132 correlate with, and may be deduced from, the identity of the target genes which VGAM1132 binds and inhibits, and the function of these target genes, as elaborated hereinbelow.

Fibroblast Growth Factor 2 (basic) (FGF2, Accession NM_002006) is a VGAM1132 host target gene. FGF2 BINDING SITE is HOST TARGET binding site found in the 3' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7736, to the nucleotide sequence of VGAM1132 RNA, herein designated VGAM RNA, also designated SEQ ID:3843.

A function of VGAM1132 is therefore inhibition of Fibroblast Growth Factor 2 (basic) (FGF2, Accession NM_002006), a gene which probably involved in nervous system development and function. Accordingly, utilities of VGAM1132 include diagnosis, prevention and treatment of diseases and clinical conditions associated with FGF2. The function of FGF2 and its association with various diseases and clinical conditions, has been established by previous studies, as described hereinabove with reference to VGAM51. Lactate Dehydrogenase B (LDHB, Accession NM_002300) is another VGAM1132 host target gene. LDHB BINDING SITE is HOST TARGET binding site found in the 5' untranslated region of mRNA encoded by LDHB, corresponding to a HOST TARGET binding site such as BINDING SITE I, BINDING SITE II or BINDING SITE III. Table 2 illustrates the complementarity of the nucleotide sequences of LDHB BINDING SITE, designated SEQ ID:8089, to the nucleotide sequence of VGAM1132 RNA, herein designated VGAM RNA, also designated SEQ ID:3843.

Another function of VGAM1132 is therefore inhibition of Lactate Dehydrogenase B (LDHB, Accession NM_002300), a gene which causes dehydrogenation of lactate. Accordingly, utilities of VGAM1132 include diagnosis, prevention and treatment of diseases and clinical conditions associated with LDHB. The function of LDHB and its association with various diseases and clinical conditions, has been established by previous studies, as described hereinabove with reference to VGAM273. Protocadherin 11 X-linked (PCDH11X, Accession NM_032968) is another VGAM1132 host target gene. PCDH11X BINDING SITE1 and PCDH11X BINDING SITE2 are HOST TARGET binding sites found in untranslated regions of mRNA encoded by PCDH11X, corresponding to HOST TARGET binding sites such as BINDING SITE I, BINDING SITE II or BINDING SITE III. Table 2 illustrates the complementarity of the nucleotide sequences of PCDH11X BINDING SITE1 and PCDH11X BINDING SITE2, designated SEQ ID:26794 and SEQ ID:26809 respectively, to the nucleotide sequence of VGAM1132 RNA, herein designated VGAM RNA, also designated SEQ ID:3843.

Another function of VGAM1132 is therefore inhibition of Protocadherin 11 X-linked (PCDH11X, Accession NM_032968), a gene which is thought to play a fundamental role in cell-cell recognition essential for the segmental development and function of the central nervous system. Accordingly, utilities of VGAM1132 include diagnosis, prevention and treatment of diseases and clinical conditions associated with PCDH11X. The function of PCDH11X and its association with various diseases and clinical conditions, has been established by previous studies, as described hereinabove with reference to VGAM433. AFAP (Accession NM_021638) is another VGAM1132 host target gene. AFAP BINDING SITE is HOST TARGET binding site found in the 3' untranslated region of mRNA encoded by AFAP, corresponding to a HOST TARGET binding site such as BINDING SITE I, BINDING SITE II or BINDING SITE III. Table 2 illustrates the complementarity of the nucleotide sequences of AFAP BINDING SITE, designated SEQ ID:22294, to the nucleotide sequence of VGAM1132 RNA, herein designated VGAM RNA, also designated SEQ ID:3843.

Another function of VGAM1132 is therefore inhibition of AFAP (Accession NM_021638). Accordingly, utilities of VGAM1132 include diagnosis, prevention and treatment of diseases and clinical conditions associated with AFAP. FLJ12484 (Accession NM_022767) is another VGAM1132 host target gene. FLJ12484 BINDING SITE1 and FLJ12484 BINDING SITE2 are HOST TARGET binding sites found in untranslated regions of mRNA encoded by FLJ12484, corresponding to HOST TARGET binding sites such as BINDING SITE I, BINDING SITE II or BINDING SITE III. Table 2 illustrates the complementarity of the nucleotide sequences of FLJ12484 BINDING SITE1 and FLJ12484 BINDING SITE2, designated SEQ ID:23017 and SEQ ID:34515 respectively, to the nucleotide sequence of VGAM1132 RNA, herein designated VGAM RNA, also designated SEQ ID:3843.

Another function of VGAM1132 is therefore inhibition of FLJ12484 (Accession NM_022767). Accordingly, utilities of VGAM1132 include diagnosis, prevention and treatment of diseases and clinical conditions associated with FLJ12484. KIAA0040 (Accession NM_014656) is another VGAM1132 host target gene. KIAA0040 BINDING SITE is HOST TARGET binding site found in the 5' untranslated region of mRNA encoded by KIAA0040, corresponding to a HOST TARGET binding site such as BINDING SITE I, BINDING SITE II or BINDING SITE III. Table 2 illustrates the complementarity of the nucleotide sequences of KIAA0040 BINDING SITE, designated SEQ ID:16098, to the nucleotide sequence of VGAM1132 RNA, herein designated VGAM RNA, also designated SEQ ID:3843.

Another function of VGAM1132 is therefore inhibition of KIAA0040 (Accession NM_014656). Accordingly, utilities of VGAM1132 include diagnosis, prevention and treatment of diseases and clinical conditions associated with KIAA0040. PRO1048 (Accession NM_018497) is another VGAM1132 host target gene. PRO1048 BINDING SITE is HOST TARGET binding site found in the 3' untranslated region of mRNA encoded by PRO1048, corresponding to a HOST TARGET binding site such as BINDING SITE I, BINDING SITE II or BINDING SITE III. Table 2 illustrates the complementarity of the nucleotide sequences of PRO1048 BINDING SITE, designated SEQ ID:20562, to the nucleotide sequence of VGAM1132 RNA, herein designated VGAM RNA, also designated SEQ ID:3843.

Another function of VGAM1132 is therefore inhibition of PRO1048 (Accession NM_018497). Accordingly, utilities of VGAM1132 include diagnosis, prevention and treatment of diseases and clinical conditions associated with PRO1048. LOC149117 (Accession XM_097587) is another VGAM1132 host target gene. LOC149117 BINDING SITE is HOST TARGET binding site found in the 3' untranslated region of mRNA encoded by LOC149117, corresponding to a HOST TARGET binding site such as BINDING SITE I, BINDING SITE II or BINDING SITE III. Table 2 illustrates the complementarity of the nucleotide sequences of LOC149117 BINDING SITE, designated SEQ ID:40955, to the nucleotide sequence of VGAM1132 RNA, herein designated VGAM RNA, also designated SEQ ID:3843.

Another function of VGAM1132 is therefore inhibition of LOC149117 (Accession XM_097587). Accordingly, utilities of VGAM1132 include diagnosis, prevention and treatment of diseases and clinical conditions associated with LOC149117. LOC220929 (Accession XM_166134) is another VGAM1132 host target gene. LOC220929 BINDING SITE is HOST TARGET binding site found in the 5' untranslated region of mRNA encoded by LOC220929, corresponding to a HOST TARGET binding site such as BINDING SITE I, BINDING SITE II or BINDING SITE III. Table 2 illustrates the complementarity of the nucleotide sequences of LOC220929 BINDING SITE, designated SEQ ID:43929, to the nucleotide sequence of VGAM1132 RNA, herein designated VGAM RNA, also designated SEQ ID:3843.

Another function of VGAM1132 is therefore inhibition of LOC220929 (Accession XM_166134). Accordingly, utilities of VGAM1132 include diagnosis, prevention and treatment of diseases and clinical conditions associated with LOC220929. FIG. 1 further provides a conceptual description of a novel bioinformatically detected viral gene of the present invention, referred to here as Viral Genomic Address Messenger 1133 (VGAM1133) viral gene, which modulates expression of respective host target genes thereof, the function and utility of which host target genes is known in the art.

VGAM1133 is a novel bioinformatically detected regulatory, non protein coding, viral micro RNA (miRNA) gene. The method by which VGAM1133 was detected is described hereinabove with reference to FIGS. 1-8.

VGAM1133 gene, herein designated VGAM GENE, is a viral gene contained in the genome of Maize Rayado Fino Virus. VGAM1133 host target gene, herein designated VGAM HOST TARGET GENE, is a human gene contained in the human genome.

VGAM1133 gene encodes a VGAM1133 precursor RNA, herein designated VGAM PRECURSOR RNA. Similar to other miRNA genes, and unlike most ordinary genes, VGAM1133 precursor RNA does not encode a protein. A nucleotide sequence identical or highly similar to the nucleotide sequence of VGAM1133 precursor RNA is designated SEQ ID:1119, and is provided hereinbelow with reference to the sequence listing part. Nucleotide sequence SEQ ID:1119 is located at position 5936 relative to the genome of Maize Rayado Fino Virus.

VGAM1133 precursor RNA folds onto itself, forming VGAM1133 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1133 folded precursor RNA into VGAM1133 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1133 RNA is designated SEQ ID:3844, and is provided hereinbelow with reference to the sequence listing part.

VGAM1133 host target gene, herein designated VGAM HOST TARGET GENE, encodes a corresponding messenger RNA, VGAM1133 host target RNA, herein designated VGAM HOST TARGET RNA. VGAM1133 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1133 RNA, herein designated VGAM RNA, binds complementarily to one or more host target binding sites located in untranslated regions of VGAM1133 host target RNA, herein designated VGAM HOST TARGET RNA. This complementary binding is due to the fact that the nucleotide sequence of VGAM1133 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1133 RNA, herein designated VGAM RNA, may have a different number of host target binding sites in untranslated regions of a VGAM1133 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1133 RNA, herein designated VGAM RNA, to host target binding sites on VGAM1133 host target RNA, herein designated VGAM HOST TARGET RNA, such as BINDING SITE I, BINDING SITE II and BINDING SITE III, inhibits translation of VGAM1133 host target RNA into VGAM1133 host target protein, herein designated VGAM HOST TARGET PROTEIN. VGAM host target protein is therefore outlined by a broken line.

It is appreciated that VGAM1133 host target gene, herein designated VGAM HOST TARGET GENE, in fact represents a plurality of VGAM1133 host target genes. The mRNA of each one of this plurality of VGAM1133 host target genes comprises one or more host target binding sites, each having a nucleotide sequence which is at least partly complementary to VGAM1133 RNA, herein designated VGAM RNA, and which when bound by VGAM1133 RNA causes inhibition of translation of respective one or more VGAM1133 host target proteins.

It is further appreciated by one skilled in the art that the mode of translational inhibition illustrated by FIG. 1 with specific reference to translational inhibition exerted by VGAM1133 gene, herein designated VGAM GENE, on one or more VGAM1133 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1133 is inhibition of expression of host target genes, as part of a novel viral mechanism of attacking a host. Accordingly, utilities of VGAM1133 include diagnosis, prevention and treatment of viral infection by Maize Rayado Fino Virus. Specific functions, and accordingly utilities, of VGAM1133 correlate with, and may be deduced from, the identity of the host target genes which VGAM1133 binds and inhibits, and the function of these host target genes, as elaborated hereinbelow.

Nucleotide sequences of the VGAM1133 precursor RNA, herein designated VGAM PRECURSOR RNA, and of the 'diced' VGAM1133 RNA, herein designated VGAM RNA, and a schematic representation of the secondary folding of VGAM1133 folded precursor RNA, herein designated VGAM FOLDED PRECURSOR RNA, of VGAM1133 are further described hereinbelow with reference to Table 1.

Nucleotide sequences of host target binding sites, such as BINDING SITE-I, BINDING SITE-II and BINDING SITE-III of FIG. 1, found on VGAM1133 host target RNA, and schematic representation of the complementarity of each of these host target binding sites to VGAM1133 RNA, herein designated VGAM RNA, are described hereinbelow with reference to Table 2.

As mentioned hereinabove with reference to FIG. 1, a function of VGAM1133 gene, herein designated VGAM is inhibition of expression of VGAM1133 target genes. It is appreciated that specific functions, and accordingly utilities, of VGAM1133 correlate with, and may be deduced from, the identity of the target genes which VGAM1133 binds and inhibits, and the function of these target genes, as elaborated hereinbelow.

Solute Carrier Family 2 (facilitated glucose transporter), Member 1 (SLC2A1, Accession NM_006516) is a VGAM1133 host target gene. SLC2A1 BINDING SITE is HOST TARGET binding site found in the 3' untranslated region of mRNA encoded by SLC2A1, corresponding to a HOST TARGET binding site such as BINDING SITE I, BINDING SITE II or BINDING SITE III. Table 2 illustrates the complementarity of the nucleotide sequences of SLC2A1 BINDING SITE, designated SEQ ID:13264, to the nucleotide sequence of VGAM1133 RNA, herein designated VGAM RNA, also designated SEQ ID:3844.

A function of VGAM1133 is therefore inhibition of Solute Carrier Family 2 (facilitated glucose transporter), Member 1 (SLC2A1, Accession NM_006516). Accordingly, utilities of VGAM1133 include diagnosis, prevention and treatment of diseases and clinical conditions associated with SLC2A1. Chromosome 21 Open Reading Frame 25 (C21orf25, Accession XM_032945) is another VGAM1133 host target gene. C21orf25 BINDING SITE is HOST TARGET binding site found in the 3' untranslated region of mRNA encoded by C21orf25, corresponding to a HOST TARGET binding site such as BINDING SITE I, BINDING SITE II or BINDING SITE III. Table 2 illustrates the complementarity of the nucleotide sequences of C21orf25 BINDING SITE, designated SEQ ID:31800, to the nucleotide sequence of VGAM1133 RNA, herein designated VGAM RNA, also designated SEQ ID:3844.

Another function of VGAM1133 is therefore inhibition of Chromosome 21 Open Reading Frame 25 (C21orf25, Accession XM_032945). Accordingly, utilities of VGAM1133 include diagnosis, prevention and treatment of diseases and clinical conditions associated with C21orf25. FLJ10849 (Accession NM_018243) is another VGAM1133 host target gene. FLJ10849 BINDING SITE is HOST TARGET binding site found in the 3' untranslated region of mRNA encoded by FLJ10849, corresponding to a HOST TARGET binding site such as BINDING SITE I, BINDING SITE II or BINDING SITE III. Table 2 illustrates the complementarity of the nucleotide sequences of FLJ10849 BINDING SITE, designated SEQ ID:20204, to the nucleotide sequence of VGAM1133 RNA, herein designated VGAM RNA, also designated SEQ ID:3844.

Another function of VGAM1133 is therefore inhibition of FLJ10849 (Accession NM_018243). Accordingly, utilities of VGAM1133 include diagnosis, prevention and treatment of diseases and clinical conditions associated with FLJ10849. Musculin (activated B-cell factor-1) (MSC, Accession XM_084266) is another VGAM1133 host target gene. MSC BINDING SITE is HOST TARGET binding site found in the 3' untranslated region of mRNA encoded by MSC, corresponding to a HOST TARGET binding site such as BINDING SITE I, BINDING SITE II or BINDING SITE III. Table 2 illustrates the complementarity of the nucleotide sequences of MSC BINDING SITE, designated SEQ ID:37533, to the nucleotide sequence of VGAM1133 RNA, herein designated VGAM RNA, also designated SEQ ID:3844.

Another function of VGAM1133 is therefore inhibition of Musculin (activated B-cell factor-1) (MSC, Accession XM_084266). Accordingly, utilities of VGAM1133 include diagnosis, prevention and treatment of diseases and clinical conditions associated with MSC. Ras Association (RalGDS/AF-6) Domain Family 2 (RASSF2, Accession NM_014737) is another VGAM1133 host target gene. RASSF2 BINDING SITE is HOST TARGET binding site found in the 3' untranslated region of mRNA encoded by RASSF2, corresponding to a HOST TARGET binding site such as BINDING SITE I, BINDING SITE II or BINDING SITE III. Table 2 illustrates the complementarity of the nucleotide sequences of RASSF2 BINDING SITE, designated SEQ ID:16389, to the nucleotide sequence of VGAM1133 RNA, herein designated VGAM RNA, also designated SEQ ID:3844.

Another function of VGAM1133 is therefore inhibition of Ras Association (RalGDS/AF-6) Domain Family 2 (RASSF2, Accession NM_014737). Accordingly, utilities of VGAM1133 include diagnosis, prevention and treatment of diseases and clinical conditions associated with RASSF2. Zinc Finger Protein 337 (ZNF337, Accession XM_042807) is another VGAM1133 host target gene. ZNF337 BINDING SITE is HOST TARGET binding site found in the 3' untranslated region of mRNA encoded by ZNF337, corresponding to a HOST TARGET binding site such as BINDING SITE I, BINDING SITE II or BINDING SITE III. Table 2 illustrates the complementarity of the nucleotide sequences of ZNF337 BINDING SITE, designated SEQ ID:33770, to the nucleotide sequence of VGAM1133 RNA, herein designated VGAM RNA, also designated SEQ ID:3844.

Another function of VGAM1133 is therefore inhibition of Zinc Finger Protein 337 (ZNF337, Accession XM_042807). Accordingly, utilities of VGAM1133 include diagnosis, prevention and treatment of diseases and clinical conditions associated with ZNF337. LOC154834 (Accession XM_098621) is another VGAM1133 host target gene. LOC154834 BINDING SITE is HOST TARGET binding site found in the 3' untranslated region of mRNA encoded by LOC154834, corresponding to a HOST TARGET binding site such as BINDING SITE I, BINDING SITE II or BINDING SITE III. Table 2 illustrates the complementarity of the nucleotide sequences of LOC154834 BINDING SITE, designated SEQ ID:41730, to the nucleotide sequence of VGAM1133 RNA, herein designated VGAM RNA, also designated SEQ ID:3844.

Another function of VGAM1133 is therefore inhibition of LOC154834 (Accession XM_098621). Accordingly, utilities of VGAM1133 include diagnosis, prevention and treatment of diseases and clinical conditions associated with LOC154834. LOC200720 (Accession XM_117264) is another VGAM1133 host target gene. LOC200720 BINDING SITE is HOST TARGET binding site found in the 5' untranslated region of mRNA encoded by LOC200720, corresponding to a HOST TARGET binding site such as BINDING SITE I, BINDING SITE II or BINDING SITE III. Table 2 illustrates the complementarity of the nucleotide sequences of LOC200720 BINDING SITE, designated SEQ ID:43342, to the nucleotide sequence of VGAM1133 RNA, herein designated VGAM RNA, also designated SEQ ID:3844.

Another function of VGAM1133 is therefore inhibition of LOC200720 (Accession XM_117264). Accordingly, utilities of VGAM1133 include diagnosis, prevention and treatment of diseases and clinical conditions associated with LOC200720. LOC91461 (Accession XM_038576) is another VGAM1133 host target gene. LOC91461 BINDING SITE is HOST TARGET binding site found in the 3' untranslated region of mRNA encoded by LOC91461, corresponding to a HOST TARGET binding site such as BINDING SITE I, BINDING SITE II or BINDING SITE III. Table 2 illustrates the complementarity of the nucleotide sequences of LOC91461 BINDING SITE, designated SEQ ID:32869, to the nucleotide sequence of VGAM1133 RNA, herein designated VGAM RNA, also designated SEQ ID:3844.

Another function of VGAM1133 is therefore inhibition of LOC91461 (Accession XM_038576). Accordingly, utilities of VGAM1133 include diagnosis, prevention and treatment of diseases and clinical conditions associated with LOC91461. FIG. 1 further provides a conceptual description of a novel bioinformatically detected viral gene of the present invention, referred to here as Viral Genomic Address Messenger 1134 (VGAM1134) viral gene, which modulates expression of respective host target genes thereof, the function and utility of which host target genes is known in the art.

VGAM1134 is a novel bioinformatically detected regulatory, non protein coding, viral micro RNA (miRNA) gene. The method by which VGAM1134 was detected is described hereinabove with reference to FIGS. 1-8.

VGAM1134 gene, herein designated VGAM GENE, is a viral gene contained in the genome of Maize Rayado Fino Virus. VGAM1134 host target gene, herein designated VGAM HOST TARGET GENE, is a human gene contained in the human genome.

VGAM1134 gene encodes a VGAM1134 precursor RNA, herein designated VGAM PRECURSOR RNA. Similar to other miRNA genes, and unlike most ordinary genes, VGAM1134 precursor RNA does not encode a protein. A nucleotide sequence identical or highly similar to the nucleotide sequence of VGAM1134 precursor RNA is designated SEQ ID:1120, and is provided hereinbelow with reference to the sequence listing part. Nucleotide sequence SEQ ID:1120 is located at position 4286 relative to the genome of Maize Rayado Fino Virus.

VGAM1134 precursor RNA folds onto itself, forming VGAM1134 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1134 folded precursor RNA into VGAM1134 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1134 RNA is designated SEQ ID:3845, and is provided hereinbelow with reference to the sequence listing part.

VGAM1134 host target gene, herein designated VGAM HOST TARGET GENE, encodes a corresponding messenger RNA, VGAM1134 host target RNA, herein designated VGAM HOST TARGET RNA. VGAM1134 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1134 RNA, herein designated VGAM RNA, binds complementarily to one or more host target binding sites located in untranslated regions of VGAM1134 host target RNA, herein designated VGAM HOST TARGET RNA. This complementary binding is due to the fact that the nucleotide sequence of VGAM1134 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1134 RNA, herein designated VGAM RNA, may have a different number of host target binding sites in untranslated regions of a VGAM1134 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1134 RNA, herein designated VGAM RNA, to host target binding sites on VGAM1134 host target RNA, herein designated VGAM HOST TARGET RNA, such as BINDING SITE I, BINDING SITE II and BINDING SITE III, inhibits translation of VGAM1134 host target RNA into VGAM1134 host target protein, herein designated VGAM HOST TARGET PROTEIN. VGAM host target protein is therefore outlined by a broken line.

It is appreciated that VGAM1134 host target gene, herein designated VGAM HOST TARGET GENE, in fact represents a plurality of VGAM1134 host target genes. The mRNA of each one of this plurality of VGAM1134 host target genes comprises one or more host target binding sites, each having a nucleotide sequence which is at least partly complementary to VGAM1134 RNA, herein designated VGAM RNA, and which when bound by VGAM1134 RNA causes inhibition of translation of respective one or more VGAM1134 host target proteins.

It is further appreciated by one skilled in the art that the mode of translational inhibition illustrated by FIG. 1 with specific reference to translational inhibition exerted by VGAM1134 gene, herein designated VGAM GENE, on one or more VGAM1134 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1134 is inhibition of expression of host target genes, as part of a novel viral mechanism of attacking a host. Accordingly, utilities of VGAM1134 include diagnosis, prevention and treatment of viral infection by Maize Rayado Fino Virus. Specific functions, and accordingly utilities, of VGAM1134 correlate with, and may be deduced from, the identity of the host target genes which VGAM1134 binds and inhibits, and the function of these host target genes, as elaborated hereinbelow.

Nucleotide sequences of the VGAM1134 precursor RNA, herein designated VGAM PRECURSOR RNA, and of the 'diced' VGAM1134 RNA, herein designated VGAM RNA, and a schematic representation of the secondary folding of VGAM1134 folded precursor RNA, herein designated VGAM FOLDED PRECURSOR RNA, of VGAM1134 are further described hereinbelow with reference to Table 1.

Nucleotide sequences of host target binding sites, such as BINDING SITE-I, BINDING SITE-II and BINDING SITE-III of FIG. 1, found on VGAM1134 host target RNA, and schematic representation of the complementarity of each of these host target binding sites to VGAM1134 RNA, herein designated VGAM RNA, are described hereinbelow with reference to Table 2.

As mentioned hereinabove with reference to FIG. 1, a function of VGAM1134 gene, herein designated VGAM is inhibition of expression of VGAM1134 target genes. It is appreciated that specific functions, and accordingly utilities, of VGAM1134 correlate with, and may be deduced from, the identity of the target genes which VGAM1134 binds and inhibits, and the function of these target genes, as elaborated hereinbelow.

AWP1 (Accession NM_019006) is a VGAM1134 host target gene. AWP1 BINDING SITE is HOST TARGET binding site found in the 5' untranslated region of mRNA encoded by AWP1, corresponding to a HOST TARGET binding site such as BINDING SITE I, BINDING SITE II or BINDING SITE III. Table 2 illustrates the complementarity of the nucleotide sequences of AWP1 BINDING SITE, designated SEQ ID:21077, to the nucleotide sequence of VGAM1134 RNA, herein designated VGAM RNA, also designated SEQ ID:3845.

A function of VGAM1134 is therefore inhibition of AWP1 (Accession NM_019006). Accordingly, utilities of VGAM1134 include diagnosis, prevention and treatment of diseases and clinical conditions associated with AWP1. LOC199796 (Accession XM_058994) is another VGAM1134 host target gene. LOC199796 BINDING SITE is HOST TARGET binding site found in the 5' untranslated region of mRNA encoded by LOC199796, corresponding to a HOST TARGET binding site such as BINDING SITE I, BINDING SITE II or BINDING SITE III. Table 2 illustrates the complementarity of the nucleotide sequences of LOC199796 BINDING SITE, designated SEQ ID:36806, to the nucleotide sequence of VGAM1134 RNA, herein designated VGAM RNA, also designated SEQ ID:3845.

Another function of VGAM1134 is therefore inhibition of LOC199796 (Accession XM_058994). Accordingly, utilities of VGAM1134 include diagnosis, prevention and treatment of diseases and clinical conditions associated with LOC199796. LOC257464 (Accession XM_116972) is another VGAM1134 host target gene. LOC257464 BINDING SITE is HOST TARGET binding site found in the 3' untranslated region of mRNA encoded by LOC257464, corresponding to a HOST TARGET binding site such as BINDING SITE I, BINDING SITE II or BINDING SITE III. Table 2 illustrates the complementarity of the nucleotide sequences of LOC257464 BINDING SITE, designated SEQ ID:43163, to the nucleotide sequence of VGAM1134 RNA, herein designated VGAM RNA, also designated SEQ ID:3845.

Another function of VGAM1134 is therefore inhibition of LOC257464 (Accession XM_116972). Accordingly, utilities of VGAM1134 include diagnosis, prevention and treatment of diseases and clinical conditions associated with LOC257464. LOC51313 (Accession NM_016613) is another VGAM1134 host target gene. LOC51313 BINDING SITE is HOST TARGET binding site found in the 3' untranslated region of mRNA encoded by LOC51313, corresponding to a HOST TARGET binding site such as BINDING SITE I, BINDING SITE II or BINDING SITE III. Table 2 illustrates the complementarity of the nucleotide sequences of LOC51313 BINDING SITE, designated SEQ ID:18718, to the nucleotide sequence of VGAM1134 RNA, herein designated VGAM RNA, also designated SEQ ID:3845.

Another function of VGAM1134 is therefore inhibition of LOC51313 (Accession NM_016613). Accordingly, utilities of VGAM1134 include diagnosis, prevention and treatment of diseases and clinical conditions associated with LOC51313. FIG. 1 further provides a conceptual description of a novel bioinformatically detected viral gene of the present invention, referred to here as Viral Genomic Address Messenger 1135 (VGAM1135) viral gene, which modulates expression of respective host target genes thereof, the function and utility of which host target genes is known in the art.

VGAM1135 is a novel bioinformatically detected regulatory, non protein coding, viral micro RNA (miRNA) gene. The method by which VGAM1135 was detected is described hereinabove with reference to FIGS. 1-8.

VGAM1135 gene, herein designated VGAM GENE, is a viral gene contained in the genome of Maize Rayado Fino Virus. VGAM1135 host target gene, herein designated VGAM HOST TARGET GENE, is a human gene contained in the human genome.

VGAM1135 gene encodes a VGAM1135 precursor RNA, herein designated VGAM PRECURSOR RNA. Similar to other miRNA genes, and unlike most ordinary genes, VGAM1135 precursor RNA does not encode a protein. A nucleotide sequence identical or highly similar to the nucleotide sequence of VGAM1135 precursor RNA is designated SEQ ID:1121, and is provided hereinbelow with reference to the sequence listing part. Nucleotide sequence SEQ ID:1121 is located at position 1316 relative to the genome of Maize Rayado Fino Virus.

VGAM1135 precursor RNA folds onto itself, forming VGAM1135 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1135 folded precursor RNA into VGAM1135 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM1135 RNA is designated SEQ ID:3846, and is provided hereinbelow with reference to the sequence listing part.

VGAM1135 host target gene, herein designated VGAM HOST TARGET GENE, encodes a corresponding messenger RNA, VGAM1135 host target RNA, herein designated VGAM HOST TARGET RNA. VGAM1135 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1135 RNA, herein designated VGAM RNA, binds complementarily to one or more host target binding sites located in untranslated regions of VGAM1135 host target RNA, herein designated VGAM HOST TARGET RNA. This complementary binding is due to the fact that the nucleotide sequence of VGAM1135 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1135 RNA, herein designated VGAM RNA, may have a different number of host target binding sites in untranslated regions of a VGAM1135 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1135 RNA, herein designated VGAM RNA, to host target binding sites on VGAM1135 host target RNA, herein designated VGAM HOST TARGET RNA, such as BINDING SITE I, BINDING SITE II and BINDING SITE III, inhibits translation of VGAM1135 host target RNA into VGAM1135 host target protein, herein designated VGAM HOST TARGET PROTEIN. VGAM host target protein is therefore outlined by a broken line.

It is appreciated that VGAM1135 host target gene, herein designated VGAM HOST TARGET GENE, in fact represents a plurality of VGAM1135 host target genes. The mRNA of each one of this plurality of VGAM1135 host target genes comprises one or more host target binding sites, each having a nucleotide sequence which is at least partly complementary to VGAM1135 RNA, herein designated VGAM RNA, and which when bound by VGAM1135 RNA causes inhibition of translation of respective one or more VGAM1135 host target proteins.

It is further appreciated by one skilled in the art that the mode of translational inhibition illustrated by FIG. 1 with specific reference to translational inhibition exerted by VGAM1135 gene, herein designated VGAM GENE, on one or more VGAM1135 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1135 is inhibition of expression of host target genes, as part of a novel viral mechanism of attacking a host. Accordingly, utilities of VGAM1135 include diagnosis, prevention and treatment of viral infection by Maize Rayado Fino Virus. Specific functions, and accordingly utilities, of VGAM1135 correlate with, and may be deduced from, the identity of the host target genes which VGAM1135 binds and inhibits, and the function of these host target genes, as elaborated hereinbelow.

Nucleotide sequences of the VGAM1135 precursor RNA, herein designated VGAM PRECURSOR RNA, and of the 'diced' VGAM1135 RNA, herein designated VGAM RNA, and a schematic representation of the secondary folding of VGAM1135 folded precursor RNA, herein designated VGAM FOLDED PRECURSOR RNA, of VGAM1135 are further described hereinbelow with reference to Table 1.

Nucleotide sequences of host target binding sites, such as BINDING SITE-I, BINDING SITE-II and BINDING SITE-III of FIG. 1, found on VGAM1135 host target RNA, and schematic representation of the complementarity of each of these host target binding sites to VGAM1135 RNA, herein designated VGAM RNA, are described hereinbelow with reference to Table 2.

As mentioned hereinabove with reference to FIG. 1, a function of VGAM1135 gene, herein designated VGAM is inhibition of expression of VGAM1135 target genes. It is appreciated that specific functions, and accordingly utilities, of VGAM1135 correlate with, and may be deduced from, the identity of the target genes which VGAM1135 binds and inhibits, and the function of these target genes, as elaborated hereinbelow.

ATP-binding Cassette, Sub-family C (CFTR/MRP), Member 3 (ABCC3, Accession NM_020038) is a VGAM1135 host target gene. ABCC3 BINDING SITE is HOST TARGET binding site found in the 3' untranslated region of mRNA encoded by ABCC3, corresponding to a HOST TARGET binding site such as BINDING SITE I, BINDING SITE II or BINDING SITE III. Table 2 illustrates the complementarity of the nucleotide sequences of ABCC3 BINDING SITE, designated SEQ ID:21294, to the nucleotide sequence of VGAM1135 RNA, herein designated VGAM RNA, also designated SEQ ID:3846.

A function of VGAM1135 is therefore inhibition of ATP-binding Cassette, Sub-family C (CFTR/MRP), Member 3 (ABCC3, Accession NM_020038), a gene which may act as an inducible transporter in the biliary and intestinal excretion of organic anions. Accordingly, utilities of VGAM1135 include diagnosis, prevention and treatment of diseases and clinical conditions associated with ABCC3. The function of ABCC3 and its association with various diseases and clinical conditions, has been established by previous studies, as described hereinabove with reference to VGAM505. ATP-binding Cassette, Sub-family D (ALD), Member 1 (ABCD1, Accession NM_000033) is another VGAM1135 host target gene. ABCD1 BINDING SITE is HOST TARGET binding site found in the 3' untranslated region of mRNA encoded by ABCD1, corresponding to a HOST TARGET binding site such as BINDING SITE I, BINDING SITE II or BINDING SITE III. Table 2 illustrates the complementarity of the nucleotide sequences of ABCD1 BINDING SITE, designated SEQ ID:5472, to the nucleotide sequence of VGAM1135 RNA, herein designated VGAM RNA, also designated SEQ ID:3846.

Another function of VGAM1135 is therefore inhibition of ATP-binding Cassette, Sub-family D (ALD), Member 1 (ABCD1, Accession NM_000033). Accordingly, utilities of VGAM1135 include diagnosis, prevention and treatment of diseases and clinical conditions associated with ABCD1. Adrenergic, Alpha-2A-, Receptor (ADRA2A, Accession NM_000681) is another VGAM1135 host target gene. ADRA2A BINDING SITE is HOST TARGET binding site found in the 3' untranslated region of mRNA encoded by ADRA2A, corresponding to a HOST TARGET binding site such as BINDING SITE I, BINDING SITE II or BINDING SITE III. Table 2 illustrates the complementarity of the nucleotide sequences of ADRA2A BINDING SITE, designated SEQ ID:6337, to the nucleotide sequence of VGAM1135 RNA, herein designated VGAM RNA, also designated SEQ ID:3846.

Another function of VGAM1135 is therefore inhibition of Adrenergic, Alpha-2A-, Receptor (ADRA2A, Accession NM_000681), a gene which mediates the effects of epinephrine and norepinephrine. Accordingly, utilities of VGAM1135 include diagnosis, prevention and treatment of diseases and clinical conditions associated with ADRA2A. The function of ADRA2A and its association with various diseases and clinical conditions, has been established by previous studies, as described hereinabove with reference to VGAM602. UDP-Gal:betaGlcNAc Beta 1,4- Galactosyltransferase, Polypeptide 6 (B4GALT6, Accession XM_008799) is another VGAM1135 host target gene. B4GALT6 BINDING SITE is HOST TARGET binding site found in the 5' untranslated region of mRNA encoded by B4GALT6, corresponding to a HOST TARGET binding site such as BINDING SITE I, BINDING SITE II or BINDING SITE III. Table 2 illustrates the complementarity of the nucleotide sequences of B4GALT6 BINDING SITE, designated SEQ ID:30096, to the nucleotide sequence of VGAM1135 RNA, herein designated VGAM RNA, also designated SEQ ID:3846.

Another function of VGAM1135 is therefore inhibition of UDP-Gal:betaGlcNAc Beta 1,4-Galactosyltransferase, Polypeptide 6 (B4GALT6, Accession XM_008799). Accordingly, utilities of VGAM1135 include diagnosis, prevention and treatment of diseases and clinical conditions associated with B4GALT6. Caspase Recruitment Domain Family, Member 10 (CARD10, Accession NM_014550) is another VGAM1135 host target gene. CARD10 BINDING SITE is HOST TARGET binding site found in the 3' untranslated region of mRNA encoded by CARD10, corresponding to a HOST TARGET binding site such as BINDING SITE I, BINDING SITE II or BINDING SITE III. Table 2 illustrates the complementarity of the nucleotide sequences of CARD10 BINDING SITE, designated SEQ ID:15872, to the nucleotide sequence of VGAM1135 RNA, herein designated VGAM RNA, also designated SEQ ID:3846.

Another function of VGAM1135 is therefore inhibition of Caspase Recruitment Domain Family, Member 10 (CARD10, Accession NM_014550), a gene which functions to couple cell surface receptor stimulation and protein kinase C (see 176982) activation to the induction of NFKB through its interaction with BCL10. Accordingly, utilities of VGAM1135 include diagnosis, prevention and treatment of diseases and clinical conditions associated with CARD10. The function of CARD10 has been established by previous studies. The caspase recruitment domain (CARD) is a protein module that consists of 6 or 7 antiparallel alpha helices. It participates in apoptosis signaling through highly specific protein-protein homophilic interactions. CARDs induce nuclear factor kappa-B (NFKB; 164011) activity through the IKK (e.g., IKBKB; 603258) complex. CARD9 (OMIM Ref. No. 607212), CARD10, CARD11 (OMIM Ref. No. 607210), and CARD14 (OMIM Ref. No. 607211) interact with BCL10 (OMIM Ref. No. 603517) and are involved in NFKB signaling complexes. Except for CARD9, these CARD proteins are members of the membrane-associated guanylate kinase (MAGUK) family. By coprecipitation analysis, McAllister-Lucas et al. (2001) showed that BIMP1, in the presence of BCL10, interacts with MALT1 (OMIM Ref. No. 604860) and cooperates in a signaling pathway through a CARD-mediated mechanism. Analysis of stimulated T cells suggested that BIMP1, through its interaction with BCL10, functions to couple cell surface receptor stimulation and protein kinase C (see OMIM Ref. No. 176982) activation to the induction of NFKB.

Full details of the abovementioned studies are described in the following publications, the disclosure of which are hereby incorporated by reference:

Gaide, O.; Martinon, F.; Micheau, O.; Bonnet, D.; Thome, M.; Tschopp, J.: Carma1, a CARD-containing binding partner of Bcl10, induces Bcl10 phosphorylation and NF-kappa-B activation. FEBS Lett. 496:121-127, 2001; and McAllister-Lucas, L. M.; Inohara, N.; Lucas, P. C.; Ruland, J.; Benito, A.; Li, Q.; Chen, S.; Chen, F. F.; Yamaoka, S.; Verma, I. M.; Mak, T. W.; Nunez, G.: Bimp1, a MAGUK family membe.

Further studies establishing the function and utilities of CARD10 are found in John Hopkins OMIM database record ID 607209, and in sited publications numbered 5565-5567 listed in the bibliography section hereinbelow, which are also hereby incorporated by reference. Dishevelled Associated Activator of Morphogenesis 2 (DAAM2, Accession XM_166434) is another VGAM1135 host target gene. DAAM2 BINDING SITE is HOST TARGET binding site found in the 3' untranslated region of mRNA encoded by DAAM2, corresponding to a HOST TARGET binding site such as BINDING SITE I, BINDING SITE II or BINDING SITE III. Table 2 illustrates the complementarity of the nucleotide sequences of DAAM2 BINDING SITE, designated SEQ ID:44329, to the nucleotide sequence of VGAM1135 RNA, herein designated VGAM RNA, also designated SEQ ID:3846.

Another function of VGAM1135 is therefore inhibition of Dishevelled Associated Activator of Morphogenesis 2 (DAAM2, Accession XM_166434), a gene which controls cell polarity and movement during development. Accordingly, utilities of VGAM1135 include diagnosis, prevention and treatment of diseases and clinical conditions associated with DAAM2. The function of DAAM2 and its association with various diseases and clinical conditions, has been established by previous studies, as described hereinabove with reference to VGAM247. Engrailed Homolog 2 (EN2, Accession NM_001427) is another VGAM1135 host target gene. EN2 BINDING SITE is HOST TARGET binding site found in the 5' untranslated region of mRNA encoded by EN2, corresponding to a HOST TARGET binding site such as BINDING SITE I, BINDING SITE II or BINDING SITE III. Table 2 illustrates the complementarity of the nucleotide sequences of EN2 BINDING SITE, designated SEQ ID:7144, to the nucleotide sequence of VGAM1135 RNA, herein designated VGAM RNA, also designated SEQ ID:3846.

Another function of VGAM1135 is therefore inhibition of Engrailed Homolog 2 (EN2, Accession NM_001427), a gene which may be required for normal cerebellar development; a homeobox protein, very strongly similar to murine En2. Accordingly, utilities of VGAM1135 include diagnosis, prevention and treatment of diseases and clinical conditions associated with EN2. The function of EN2 and its association with various diseases and clinical conditions, has been established by previous studies, as described hereinabove with reference to VGAM232. Exostoses (multiple)-like 1 (EXTL1, Accession NM_004455) is another VGAM1135 host target gene. EXTL1 BINDING SITE is HOST TARGET binding site found in the 5' untranslated region of mRNA encoded by EXTL1, corresponding to a HOST TARGET binding site such as BINDING SITE I, BINDING SITE II or BINDING SITE III. Table 2 illustrates the complementarity of the nucleotide sequences of EXTL1 BINDING SITE, designated SEQ ID:10757, to the nucleotide sequence of VGAM1135 RNA, herein designated VGAM RNA, also designated SEQ ID:3846.

Another function of VGAM1135 is therefore inhibition of Exostoses (multiple)-like 1 (EXTL1, Accession NM_004455), a gene which probably contribute to the synthesis of heparan sulfate and heparin. Accordingly, utilities of VGAM1135 include diagnosis, prevention and treatment of diseases and clinical conditions associated with EXTL1. The function of EXTL1 and its association with various diseases and clinical conditions, has been established by previous studies, as described hereinabove with reference to VGAM806. Histone Deacetylase 7A (HDAC7A, Accession NM_015401) is another VGAM1135 host target gene. HDAC7A BINDING SITE1 and HDAC7A BINDING SITE2 are HOST TARGET binding sites found in untranslated regions of mRNA encoded by HDAC7A, corresponding to HOST TARGET binding sites such as BINDING SITE I, BINDING SITE II or BINDING SITE III. Table 2 illustrates the complementarity of the nucleotide sequences of HDAC7A BINDING SITE1 and HDAC7A BINDING SITE2, designated SEQ ID:17712 and SEQ ID:18682 respectively, to the nucleotide sequence of VGAM1135 RNA, herein designated VGAM RNA, also designated SEQ ID:3846.

Another function of VGAM1135 is therefore inhibition of Histone Deacetylase 7A (HDAC7A, Accession NM_015401). Accordingly, utilities of VGAM1135 include diagnosis, prevention and treatment of diseases and clinical conditions associated with HDAC7A. Peptidylprolyl Isomerase (cyclophilin)-like 1 (PPIL1, Accession NM_016059) is another VGAM1135 host target gene. PPIL1 BINDING SITE is HOST TARGET binding site found in the 5' untranslated region of mRNA encoded by PPIL1, corresponding to a HOST TARGET binding site such as BINDING SITE I, BINDING SITE II or BINDING SITE III. Table 2 illustrates the complementarity of the nucleotide sequences of PPIL1 BINDING SITE, designated SEQ ID:18135, to the nucleotide sequence of VGAM1135 RNA, herein designated VGAM RNA, also designated SEQ ID:3846.

Another function of VGAM1135 is therefore inhibition of Peptidylprolyl Isomerase (cyclophilin)-like 1 (PPIL1, Accession NM_016059), a gene which catalyzes the cis-trans isomerization of proline imidic peptide bonds in oligopeptides. Accordingly, utilities of VGAM1135 include diagnosis, prevention and treatment of diseases and clinical conditions associated with PPIL1. The function of PPIL1 has been established by previous studies. Cyclophilin (see OMIM Ref. No. 123840), first identified as a protein with high binding affinity for the immunosuppressive agent cyclosporin A, is one of the most effective therapeutic agents for prevention of graft rejection after organ transplantation. Ozaki et al. (1996) isolated a human cDNA clone encoding a protein homologous to cyclophilins and showed that it is conserved in species ranging from human to prokaryotes. This cDNA contained an open reading frame of 498 nucleotides encoding a polypeptide of 166 amino acids. The predicted amino acid sequence had 41.6% homology to the human cyclophilins. Northern blot analysis indicated ubiquitous expression in adult human tissues, with the most abundant expression in heart and skeletal muscle. Ozaki et al. (1996) localized the PPIL1 gene to 2p23.3-p23.1 by FISH. However, Mann et al. (1998) assigned the PPIL1 gene to 6p21.1 by FISH and radiation hybrid mapping.

Full details of the abovementioned studies are described in the following publications, the disclosure of which are hereby incorporated by reference:

Mann, S. S.; Pettenati, M. J.; von Kap-herr, C.; Hart, T. C.: Reassignment of peptidyl prolyl isomerase-like 1 gene (PPIL1) to human chromosome region 6p21.1 by radiation hybrid mapping and fluorescence in situ hybridization. Cytogenet. Cell Genet. 83:228-229, 1998; and Ozaki, K.; Fujiwara, T.; Kawai, A.; Shimizu, F.; Takami, S.; Okuno, S.; Takeda, S.; Shimada, Y.; Nagata, M.; Watanabe, T.; Takaichi, A.; Takahashi, E.; Nakamura, Y.; Shin, S.: Cloning.

Further studies establishing the function and utilities of PPIL1 are found in John Hopkins OMIM database record ID 601301, and in sited publications numbered 6505-6506 listed in the bibliography section hereinbelow, which are also hereby incorporated by reference. Pregnancy Specific Beta-1-glycoprotein 4 (PSG4, Accession NM_002780) is another VGAM1135 host target gene. PSG4 BINDING SITE is HOST TARGET binding site found in the 3' untranslated region of mRNA encoded by PSG4, corresponding to a HOST TARGET binding site such as BINDING SITE I, BINDING SITE II or BINDING SITE III. Table 2 illustrates the complementarity of the nucleotide sequences of PSG4 BINDING SITE, designated SEQ ID:8671, to the nucleotide sequence of VGAM1135 RNA, herein designated VGAM RNA, also designated SEQ ID:3846.

Another function of VGAM1135 is therefore inhibition of Pregnancy Specific Beta-1-glycoprotein 4 (PSG4, Accession NM_002780), a gene which is a member of the pregnancy-specific glycoprotein (PSG) and CEA families. Accordingly, utilities of VGAM1135 include diagnosis, prevention and treatment of diseases and clinical conditions associated with PSG4. The function of PSG4 has been established by previous studies. The human pregnancy-specific glycoproteins (PSGs) are a group of molecules that are mainly produced by the placental syncytiotrophoblasts during pregnancy. PSGs comprise a subgroup of the carcinoembryonic antigen (CEA) family, which belongs to the immunoglobulin superfamily. See PSG3 (OMIM Ref. No. 176392) for additional information about PSGs. Teglund et al. (1994) found that the PSG4 gene contains 6 exons. They noted that PSG9, which had been thought to be a novel gene, is in fact an allelic variant of PSG4 that differs by 6 bp in the coding region. (The OMIM Ref. No. 176398.) Studies by several groups resulted in the mapping of the CEA gene family to 19q13.1-q13.2 (Thompson et al., 1990; Thompson et al., 1992; Tynan et al., 1992; Trask et al., 1993). The PSG subgroup is located telomeric of the CEA subgroup, and together they span approximately 1.1 to 1.2 Mb (Brandriff et al., 1992; Tynan et al., 1992). Using a high-resolution restriction fragment fingerprinting technique, Olsen et al. (1994) assembled 256 cosmids spanning the PSG region on 19q13.2 into a single 700-kb contig. FISH to sperm pronuclei and cosmid walking experiments indicated that this PSG contig is telomeric of CGM8 at the telomeric end of the CEA subgroup gene cluster. Detailed restriction mapping and hybridization with gene-specific probes indicated that the order of the 11 PSG genes in the contig is cen--PSG3--PSG8 (OMIM Ref. No. 176397)--PSG12 (PSG10; 176399)--PSG1 (OMIM Ref. No. 176390)--PSG6 (OMIM Ref. No. 176395)--PSG7 (OMIM Ref. No. 176396)--PSG13 (PSG11; 176401)--PSG2 (OMIM Ref. No. 176391)--PSG5 (OMIM Ref. No. 176394)--PSG4--PSG11 (PSG9; 176398)--tel. The PSG genes are tandemly oriented in a 5-prime to 3-prime direction from telomere to centromere. The CEA subgroup gene CGM11 is located at the telomeric end of the PSG gene cluster, and 6 genes belonging to a third CEA family subgroup, namely CGM13 through CGM18 (later OMIM Ref. No. 109770), are interspersed among the PSG genes. Nomenclature: Beauchemin et al. (1999) provided a revised nomenclature for the CEA gene family. Based on this nomenclature, the CEA family is composed of the PSG subfamily, the CEACAM subfamily (see OMIM Ref. No. 109770), and the CEACAM pseudogene (CEACAMP) subfamily (see OMIM Ref. No. 109770). PSG11, PSG12, and PSG13 were renamed PSG9, PSG10, and PSG11, respectively Full details of the abovementioned studies are described in the following publications, the disclosure of which are hereby incorporated by reference:

Beauchemin, N.; Draber, P.; Dveksler, G.; Gold, P.; Gray-Owen, S.; Grunert, F.; Hammarstrom, S.; Holmes, K. V.; Karlsson, A.; Kuroki, M.; Lin, S.-H.; Lucka, L.; and 13 others: Redefined nomenclature for members of the carcinoembryonic antigen family. Exp. Cell Res. 252:243-249, 1999; and Brandriff, B. F.; Gordon, L. A.; Tynan, K. T.; Olsen, A. S.; Mohrenweiser, H. W.; Fertitta, A.; Carrano, A. V.; Trask, B. J.: Order and genomic distances among members of the carcinoem.

Further studies establishing the function and utilities of PSG4 are found in John Hopkins OMIM database record ID 176393, and in sited publications numbered 2240, 10731, 10742-10740, 1074 and 10744 listed in the bibliography section hereinbelow, which are also hereby incorporated by reference. Pregnancy Specific Beta-1-glycoprotein 7 (PSG7, Accession NM_002783) is another VGAM1135 host target gene. PSG7 BINDING SITE is HOST TARGET binding site found in the 3' untranslated region of mRNA encoded by PSG7, corresponding to a HOST TARGET binding site such as BINDING SITE I, BINDING SITE II or BINDING SITE III. Table 2 illustrates the complementarity of the nucleotide sequences of PSG7 BINDING SITE, designated SEQ ID:8672, to the nucleotide sequence of VGAM1135 RNA, herein designated VGAM RNA, also designated SEQ ID:3846.

Another function of VGAM1135 is therefore inhibition of Pregnancy Specific Beta-1-glycoprotein 7 (PSG7, Accession NM_002783), a gene which function still unknown. Accordingly, utilities of VGAM1135 include diagnosis, prevention and treatment of diseases and clinical conditions associated with PSG7. The function of PSG7 has been established by previous studies. The human pregnancy-specific glycoproteins (PSGs) are a group of molecules that are mainly produced by the placental syncytiotrophoblasts during pregnancy. PSGs comprise a subgroup of the carcinoembryonic antigen (CEA) family, which belongs to the immunoglobulin superfamily. See PSG3 (OMIM Ref. No. 176392) for additional information about PSGs. Teglund et al. (1994) found that the PSG7 gene contains 6 exons. Studies by several groups resulted in the mapping of the CEA gene family to 19q13.1-q13.2 (Thompson et al., 1990; Thompson et al., 1992; Tynan et al., 1992; Trask et al., 1993). The PSG subgroup is located telomeric of the CEA subgroup, and together they span approximately 1.1 to 1.2 Mb (Brandriff et al., 1992; Tynan et al., 1992). Using a high-resolution restriction fragment fingerprinting technique, Olsen et al. (1994) assembled 256 cosmids spanning the PSG region on 19q13.2 into a single 700-kb contig. FISH to sperm pronuclei and cosmid walking experiments indicated that this PSG contig is telomeric of CGM8 at the telomeric end of the CEA subgroup gene cluster. Detailed restriction mapping and hybridization with gene-specific probes indicated that the order of the 11 PSG genes in the contig is cen--PSG3--PSG8 (OMIM Ref. No. 176397)--PSG12 (PSG10; 176399)--PSG1 (OMIM Ref. No. 176390)--PSG6 (OMIM Ref. No. 176395)--PSG7--PSG13 (PSG11; 176401)--PSG2 (OMIM Ref. No. 176391)--PSG5 (OMIM Ref. No. 176394)--PSG4 (OMIM Ref. No. 176393)--PSG11 (PSG9; 176398)--tel. The PSG genes are tandemly oriented in a 5-prime to 3-prime direction from telomere to centromere. The CEA subgroup gene CGM11 is located at the telomeric end of the PSG gene cluster, and 6 genes belonging to a third CEA family subgroup, namely CGM13 through CGM18 (later OMIM Ref. No. 109770), are interspersed among the PSG genes. Nomenclature: Beauchemin et al. (1999) provided a revised nomenclature for the CEA gene family. Based on this nomenclature, the CEA family is composed of the PSG subfamily, the CEACAM subfamily (see OMIM Ref. No. 109770), and the CEACAM pseudogene (CEACAMP) subfamily (see OMIM Ref. No. 109770). PSG11, PSG12, and PSG13 were renamed PSG9, PSG10, and PSG11, respectively.

Full details of the abovementioned studies are described in the following publications, the disclosure of which are hereby incorporated by reference:

Beauchemin, N.; Draber, P.; Dveksler, G.; Gold, P.; Gray-Owen, S.; Grunert, F.; Hammarstrom, S.; Holmes, K. V.; Karlsson, A.; Kuroki, M.; Lin, S.-H.; Lucka, L.; and 13 others. Redefined nomenclature for members of the carcinoembryonic antigen family. Exp. Cell Res. 252:243-249, 1999; and Brandriff, B. F.; Gordon, L. A.; Tynan, K. T.; Olsen, A. S.; Mohrenweiser, H. W.; Fertitta, A.; Carrano, A. V.; Trask, B. J.: Order and genomic distances among members of the carcinoem.

Further studies establishing the function and utilities of PSG7 are found in John Hopkins OMIM database record ID 176396, and in sited publications numbered 2240, 10731, 10742-10740, 1074 and 10744 listed in the bibliography section hereinbelow, which are also hereby incorporated by reference. Protein Tyrosine Phosphatase Type IVA, Member 2 (PTP4A2, Accession NM_003479) is another VGAM1135 host target gene. PTP4A2 BINDING SITE is HOST TARGET binding site found in the 3' untranslated region of mRNA encoded by PTP4A2, corresponding to a HOST TARGET binding site such as BINDING SITE I, BINDING SITE II or BINDING SITE III. Table 2 illustrates the complementarity of the nucleotide sequences of PTP4A2 BINDING SITE, designated SEQ ID:9557, to the nucleotide sequence of VGAM1135 RNA, herein designated VGAM RNA, also designated SEQ ID:3846.

Another function of VGAM1135 is therefore inhibition of Protein Tyrosine Phosphatase Type IVA, Member 2 (PTP4A2, Accession NM_003479), a gene which is a protein tyrosine phosphatase which has a C-terminal prenylation site. Accordingly, utilities of VGAM1135 include diagnosis, prevention and treatment of diseases and clinical conditions associated with PTP4A2. The function of PTP4A2 and its association with various diseases and clinical conditions, has been established by previous studies, as described hereinabove with reference to VGAM217. SMURF1 (Accession XM_166483) is another VGAM1135 host target gene. SMURF1 BINDING SITE is HOST TARGET binding site found in the 3' untranslated region of mRNA encoded by SMURF1, corresponding to a HOST TARGET binding site such as BINDING SITE I, BINDING SITE II or BINDING SITE III. Table 2 illustrates the complementarity of the nucleotide sequences of SMURF1 BINDING SITE, designated SEQ ID:44415, to the nucleotide sequence of VGAM1135 RNA, herein designated VGAM RNA, also designated SEQ ID:3846.

Another function of VGAM1135 is therefore inhibition of SMURF1 (Accession XM_166483). Accordingly, utilities of VGAM1135 include diagnosis, prevention and treatment of diseases and clinical conditions associated with SMURF1. Syntaxin Binding Protein 1 (STXBP1, Accession NM_003165) is another VGAM1135 host target gene. STXBP1 BINDING SITE is HOST TARGET binding site found in the 3' untranslated region of mRNA encoded by STXBP1, corresponding to a HOST TARGET binding site such as BINDING SITE I, BINDING SITE II or BINDING SITE III. Table 2 illustrates the complementarity of the nucleotide sequences of STXBP1 BINDING SITE, designated SEQ ID:9141, to the nucleotide sequence of VGAM1135 RNA, herein designated VGAM RNA, also designated SEQ ID:3846.

Another function of VGAM1135 is therefore inhibition of Syntaxin Binding Protein 1 (STXBP1, Accession NM_003165), a gene which may play a role in determining the specificity of intracellular fusion reactions. Accordingly, utilities of VGAM1135 include diagnosis, prevention and treatment of diseases and clinical conditions associated with STXBP1. The function of STXBP1 and its association with various diseases and clinical conditions, has been established by previous studies, as described hereinabove with reference to VGAM708. SWAP70 (Accession XM_049197) is another VGAM1135 host target gene. SWAP70 BINDING SITE is HOST TARGET binding site found in the 3' untranslated region of mRNA encoded by SWAP70, corresponding to a HOST TARGET binding site such as BINDING SITE I, BINDING SITE II or BINDING SITE III. Table 2 illustrates the complementarity of the nucleotide sequences of SWAP70 BINDING SITE, designated SEQ ID:35348, to the nucleotide sequence of VGAM1135 RNA, herein designated VGAM RNA, also designated SEQ ID:3846.

Another function of VGAM1135 is therefore inhibition of SWAP70 (Accession XM_049197), a gene which is involved not only in nuclear events but also in signaling in B-cell activation. Accordingly, utilities of VGAM1135 include diagnosis, prevention and treatment of diseases and clinical conditions associated with SWAP70. The function of SWAP70 and its association with various diseases and clinical conditions, has been established by previous studies, as described hereinabove with reference to VGAM1090. Transcription Factor AP-4 (activating enhancer binding protein 4) (TFAP4, Accession NM_003223) is another VGAM1135 host target gene. TFAP4 BINDING SITE is HOST TARGET binding site found in the 3' untranslated region of mRNA encoded by TFAP4, corresponding to a HOST TARGET binding site such as BINDING SITE I, BINDING SITE II or BINDING SITE III. Table 2 illustrates the complementarity of the nucleotide sequences of TFAP4 BINDING SITE, designated SEQ ID:9225, to the nucleotide sequence of VGAM1135 RNA, herein designated VGAM RNA, also designated SEQ ID:3846.

Another function of VGAM1135 is therefore inhibition of Transcription Factor AP-4 (activating enhancer binding protein 4) (TFAP4, Accession NM_003223), a gene which activates both viral and cellular genes by binding to the symmetrical dna sequence 5'-cagctg-3'. Accordingly, utilities of VGAM1135 include diagnosis, prevention and treatment of diseases and clinical conditions associated with TFAP4. The function of TFAP4 and its association with various diseases and clinical conditions, has been established by previous studies, as described hereinabove with reference to VGAM175. Uncoupling Protein 2 (mitochondrial, proton carrier) (UCP2, Accession NM_003355) is another VGAM1135 host target gene. UCP2 BINDING SITE is HOST TARGET binding site found in the 5' untranslated region of mRNA encoded by UCP2, corresponding to a HOST TARGET binding site such as BINDING SITE I, BINDING SITE II or BINDING SITE III. Table 2 illustrates the complementarity of the nucleotide sequences of UCP2 BINDING SITE, designated SEQ ID:9382, to the nucleotide sequence of VGAM1135 RNA, herein designated VGAM RNA, also designated SEQ ID:3846.

Another function of VGAM1135 is therefore inhibition of Uncoupling Protein 2 (mitochondrial, proton carrier) (UCP2, Accession NM_003355), a gene which is an inner mitochondrial membrane transporter and uncouples electron transport from oxidative phosphorylation. Accordingly, utilities of VGAM1135 include diagnosis, prevention and treatment of diseases and clinical conditions associated with UCP2. The function of UCP2 has been established by previous studies. Esterbauer et al. (2001) showed that a common G/A polymorphism in the UCP2 promoter region is associated with enhanced adipose tissue mRNA expression in vivo and results in increased transcription of a reporter gene in the human adipocyte cell line PAZ-6. In analyzing 340 obese and 256 never-obese middle-aged subjects, they found a modest but significant reduction in obesity prevalence associated with the less-common allele. They confirmed this association in a population-based sample of 791 middle-aged subjects from the same geographic area (Salzburg, Austria). Despite its modest effect, but because of its high frequency (approximately 63%), the more-common risk allele conferred a relatively large population-attributable risk accounting for 15% of the obesity in the population studied. Animal model experiments lend further support to the function of UCP2. Zhang et al. (2001) assessed the role of UCP2 in regulating insulin secretion. Ucp2-deficient mice had higher islet ATP levels and increased glucose-stimulated insulin secretion, establishing that UCP2 negatively regulates insulin secretion. Of pathophysiologic significance, Ucp2 was markedly upregulated in islets of ob/ob mice, a model of obesity-induced diabetes. Ob/ob mice lacking Ucp2 had restored first-phase insulin secretion, increased serum insulin levels, and greatly decreased levels of glycemia. These results established UCP2 as a key component of beta-cell glucose sensing and as a critical link between obesity, beta-cell dysfunction, and type II diabetes.

It is appreciated that the abovementioned animal model for UCP2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Esterbauer, H.; Schneitler, C.; Oberkofler, H.; Ebenbichler, C.; Paulweber, B.; Sandhofer, F.; Ladurner, G.; Hell, E.; Strosberg, A. D.; Patsch, J. R.; Krempler, F.; Patsch, W.: A common polymorphism in the promoter of UCP2 is associated with decreased risk of obesity in middle-aged human S. Nature Genet. 28:178-183, 2001; and Zhang, C.-Y.; Baffy, G.; Perret, P.; Krauss, S.; Peroni, O.; Grujic, D.; Hagen, T.; Vidal-Puig, A.; Boss, O.; Kim, Y.-B.; Zheng, X. X.; Wheeler, M. B.; Shulman, G. I.; Chan, C. B.; Lo.

Further studies establishing the function and utilities of UCP2 are found in John Hopkins OMIM database record ID 601693, and in sited publications numbered 6483-6485, 3700-3701, 6486-6489, 279 and 6707 listed in the bibliography section hereinbelow, which are also hereby incorporated by reference. AP1 Gamma Subunit Binding Protein 1 (AP1GBP1, Accession NM_007247) is another VGAM1135 host target gene. AP1GBP1 BINDING SITE1 through AP1GBP1 BINDING SITE3 are HOST TARGET binding sites found in untranslated regions of mRNA encoded by AP1GBP1, corresponding to HOST TARGET binding sites such as BINDING SITE I, BINDING SITE II or BINDING SITE III. Table 2 illustrates the complementarity of the nucleotide sequences of AP1GBP1 BINDING SITE1 through AP1GBP1 BINDING SITE3, designated SEQ ID:14116, SEQ ID:27871 and SEQ ID:27879 respectively, to the nucleotide sequence of VGAM1135 RNA, herein designated VGAM RNA, also designated SEQ ID:3846.

Another function of VGAM1135 is therefore inhibition of AP1 Gamma Subunit Binding Protein 1 (AP1GBP1, Accession NM_007247). Accordingly, utilities of VGAM1135 include diagnosis, prevention and treatment of diseases and clinical conditions associated with AP1GBP1. Chromosome 20 Open Reading Frame 173 (C20orf173, Accession NM_080828) is another VGAM1135 host target gene. C20orf173 BINDING SITE is HOST TARGET binding site found in the 5" untranslated region of mRNA encoded by C20orf173, corresponding to a HOST TARGET binding site such as BINDING SITE I, BINDING SITE II or BINDING SITE III. Table 2 illustrates the complementarity of the nucleotide sequences of C20orf173 BINDING SITE, designated SEQ ID:28093, to the nucleotide sequence of VGAM1135 RNA, herein designated VGAM RNA, also designated SEQ ID:3846.

Another function of VGAM1135 is therefore inhibition of Chromosome 20 Open Reading Frame 173 (C20orf173, Accession NM_080828). Accordingly, utilities of VGAM1135 include diagnosis, prevention and treatment of diseases and clinical conditions associated with C20orf173. Calneuron 1 (CALN1, Accession NM_031468) is another VGAM1135 host target gene. CALN1 BINDING SITE is HOST TARGET binding site found in the 3' untranslated region of mRNA encoded by CALN1, corresponding to a HOST TARGET binding site such as BINDING SITE I, BINDING SITE II or BINDING SITE III. Table 2 illustrates the complementarity of the nucleotide sequences of CALN1 BINDING SITE, designated SEQ ID:25513, to the nucleotide sequence of VGAM1135 RNA, herein designated VGAM RNA, also designated SEQ ID:3846.

Another function of VGAM1135 is therefore inhibition of Calneuron 1 (CALN1, Accession NM_031468). Accordingly, utilities of VGAM1135 include diagnosis, prevention and treatment of diseases and clinical conditions associated with CALN1. Cerebellin 1 Precursor (CBLN1, Accession NM_004352) is another VGAM1135 host target gene. CBLN1 BINDING SITE is HOST TARGET binding site found in the 3' untranslated region of mRNA encoded by CBLN1, corresponding to a HOST TARGET binding site such as BINDING SITE I, BINDING SITE II or BINDING SITE III. Table 2 illustrates the complementarity of the nucleotide sequences of CBLN1 BINDING SITE, designated SEQ ID:10555, to the nucleotide sequence of VGAM1135 RNA, herein designated VGAM RNA, also designated SEQ ID:3846.

Another function of VGAM1135 is therefore inhibition of Cerebellin 1 Precursor (CBLN1, Accession NM_004352). Accordingly, utilities of VGAM1135 include diagnosis, prevention and treatment of diseases and clinical conditions associated with CBLN1. Calcium Homeostasis Endoplasmic Reticulum Protein (CHERP, Accession NM_006387) is another VGAM1135 host target gene. CHERP BINDING SITE is HOST TARGET binding site found in the 3' untranslated region of mRNA encoded by CHERP, corresponding to a HOST TARGET binding site such as BINDING SITE I, BINDING SITE II or BINDING SITE III. Table 2 illustrates the complementarity of the nucleotide sequences of CHERP BINDING SITE, designated SEQ ID:13091, to the nucleotide sequence of VGAM1135 RNA, herein designated VGAM RNA, also designated SEQ ID:3846.

Another function of VGAM1135 is therefore inhibition of Calcium Homeostasis Endoplasmic Reticulum Protein (CHERP, Accession NM_006387). Accordingly, utilities of VGAM1135 include diagnosis, prevention and treatment of diseases and clinical conditions associated with CHERP. DEAD/H (Asp-Glu-Ala-Asp/His) Box Polypeptide 37 (DDX37, Accession NM_032656) is another VGAM1135 host target gene. DDX37 BINDING SITE is HOST TARGET binding site found in the 3' untranslated region of mRNA encoded by DDX37, corresponding to a HOST TARGET binding site such as BINDING SITE I, BINDING SITE II or BINDING SITE III. Table 2 illustrates the complementarity of the nucleotide sequences of DDX37 BINDING SITE, designated SEQ ID:26389, to the nucleotide sequence of VGAM1135 RNA, herein designated VGAM RNA, also designated SEQ ID:3846.

Another function of VGAM1135 is therefore inhibition of DEAD/H (Asp-Glu-Ala-Asp/His) Box Polypeptide 37 (DDX37, Accession NM_032656). Accordingly, utilities of VGAM1135 include diagnosis, prevention and treatment of diseases and clinical conditions associated with DDX37. Dedicator of Cyto-kinesis 3 (DOCK3, Accession XM_039259) is another VGAM1135 host target gene. DOCK3 BINDING SITE is HOST TARGET binding site found in the 3' untranslated region of mRNA encoded by DOCK3, corresponding to a HOST TARGET binding site such as BINDING SITE I, BINDING SITE II or BINDING SITE III. Table 2 illustrates the complementarity of the nucleotide sequences of DOCK3 BINDING SITE, designated SEQ ID:33035, to the nucleotide sequence of VGAM1135 RNA, herein designated VGAM RNA, also designated SEQ ID:3846.

Another function of VGAM1135 is therefore inhibition of Dedicator of Cyto-kinesis 3 (DOCK3, Accession XM_039259). Accordingly, utilities of VGAM1135 include diagnosis, prevention and treatment of diseases and clinical conditions associated with DOCK3. EDR2 (Accession XM_018136) is another VGAM1135 host target gene. EDR2 BINDING SITE is HOST TARGET binding site found in the 3' untranslated region of mRNA encoded by EDR2, corresponding to a HOST TARGET binding site such as BINDING SITE I, BINDING SITE II or BINDING SITE III. Table 2 illustrates the complementarity of the nucleotide sequences of EDR2 BINDING SITE, designated SEQ ID:30341, to the nucleotide sequence of VGAM1135 RNA, herein designated VGAM RNA, also designated SEQ ID:3846.

Another function of VGAM1135 is therefore inhibition of EDR2 (Accession XM_018136). Accordingly, utilities of VGAM1135 include diagnosis, prevention and treatment of diseases and clinical conditions associated with EDR2. Erythroblast Membrane-associated Protein (ERMAP, Accession NM_018538) is another VGAM1135 host target gene. ERMAP BINDING SITE is HOST TARGET binding site found in the 3' untranslated region of mRNA encoded by ERMAP, corresponding to a HOST TARGET binding site such as BINDING SITE I, BINDING SITE II or BINDING SITE III. Table 2 illustrates the complementarity of the nucleotide sequences of ERMAP BINDING SITE, designated SEQ ID:20609, to the nucleotide sequence of VGAM1135 RNA, herein designated VGAM RNA, also designated SEQ ID:3846.

Another function of VGAM1135 is therefore inhibition of Erythroblast Membrane-associated Protein (ERMAP, Accession NM_018538). Accordingly, utilities of VGAM1135 include diagnosis, prevention and treatment of diseases and clinical conditions associated with ERMAP. FLJ12681 (Accession NM_022773) is another VGAM1135 host target gene. FLJ12681 BINDING SITE is HOST TARGET binding site found in the 3' untranslated region of mRNA encoded by FLJ12681, corresponding to a HOST TARGET binding site such as BINDING SITE I, BINDING SITE II or BINDING SITE III. Table 2 illustrates the complementarity of the nucleotide sequences of FLJ12681 BINDING SITE, designated SEQ ID:23037, to the nucleotide sequence of VGAM1135 RNA, herein designated VGAM RNA, also designated SEQ ID:3846.

Another function of VGAM1135 is therefore inhibition of FLJ12681 (Accession NM_022773). Accordingly, utilities of VGAM1135 include diagnosis, prevention and treatment of diseases and clinical conditions associated with FLJ12681. FLJ12704 (Accession NM_024998) is another VGAM1135 host target gene. FLJ12704 BINDING SITE is HOST TARGET binding site found in the 3' untranslated region of mRNA encoded by FLJ12704, corresponding to a HOST TARGET binding site such as BINDING SITE I, BINDING SITE II or BINDING SITE III. Table 2 illustrates the complementarity of the nucleotide sequences of FLJ12704 BINDING SITE, designated SEQ ID:24567, to the nucleotide sequence of VGAM1135 RNA, herein designated VGAM RNA, also designated SEQ ID:3846.

Another function of VGAM1135 is therefore inhibition of FLJ12704 (Accession NM_024998). Accordingly, utilities of VGAM1135 include diagnosis, prevention and treatment of diseases and clinical conditions associated with FLJ12704. FLJ22501 (Accession NM_024747) is another VGAM1135 host target gene. FLJ22501 BINDING SITE is HOST TARGET binding site found in the 5' untranslated region of mRNA encoded by FLJ22501, corresponding to a HOST TARGET binding site such as BINDING SITE I, BINDING SITE II or BINDING SITE III. Table 2 illustrates the complementarity of the nucleotide sequences of FLJ22501 BINDING SITE, designated SEQ ID:24083, to the nucleotide sequence of VGAM1135 RNA, herein designated VGAM RNA, also designated SEQ ID:3846.

Another function of VGAM1135 is therefore inhibition of FLJ22501 (Accession NM_024747). Accordingly, utilities of VGAM1135 include diagnosis, prevention and treatment of diseases and clinical conditions associated with FLJ22501. FRAG1 (Accession NM_014489) is another VGAM1135 host target gene. FRAG1 BINDING SITE is HOST TARGET binding site found in the 3' untranslated region of mRNA encoded by FRAG1, corresponding to a HOST TARGET binding site such as BINDING SITE I, BINDING SITE II or BINDING SITE III. Table 2 illustrates the complementarity of the nucleotide sequences of FRAG1 BINDING SITE, designated SEQ ID:15834, to the nucleotide sequence of VGAM1135 RNA, herein designated VGAM RNA, also designated SEQ ID:3846.

Another function of VGAM1135 is therefore inhibition of FRAG1 (Accession NM_014489). Accordingly, utilities of VGAM1135 include diagnosis, prevention and treatment of diseases and clinical conditions associated with FRAG1. HIP-55 (Accession NM_014063) is another VGAM1135 host target gene. HIP-55 BINDING SITE is HOST TARGET binding site found in the 3' untranslated region of mRNA encoded by HIP-55, corresponding to a HOST TARGET binding site such as BINDING SITE I, BINDING SITE II or BINDING SITE III. Table 2 illustrates the complementarity of the nucleotide sequences of HIP-55 BINDING SITE, designated SEQ ID:15277, to the nucleotide sequence of VGAM1135 RNA, herein designated VGAM RNA, also designated SEQ ID:3846.

Another function of VGAM1135 is therefore inhibition of HIP-55 (Accession NM_014063). Accordingly, utilities of VGAM1135 include diagnosis, prevention and treatment of diseases and clinical conditions associated with HIP-55. KIAA0552 (Accession NM_014731) is another VGAM1135 host target gene. KIAA0552 BINDING SITE is HOST TARGET binding site found in the 3' untranslated region of mRNA encoded by KIAA0552, corresponding to a HOST TARGET binding site such as BINDING SITE I, BINDING SITE II or BINDING SITE III. Table 2 illustrates the complementarity of the nucleotide sequences of KIAA0552 BINDING SITE, designated SEQ ID:16345, to the nucleotide sequence of VGAM1135 RNA, herein designated VGAM RNA, also designated SEQ ID:3846.

Another function of VGAM1135 is therefore inhibition of KIAA0552 (Accession NM_014731). Accordingly, utilities of VGAM1135 include diagnosis, prevention and treatment of diseases and clinical conditions associated with KIAA0552. KIAA1193 (Accession XM_041843) is another VGAM1135 host target gene. KIAA1193 BINDING SITE is HOST TARGET binding site found in the 3' untranslated region of mRNA encoded by KIAA1193, corresponding to a HOST TARGET binding site such as BINDING SITE I, BINDING SITE II or BINDING SITE III. Table 2 illustrates the complementarity of the nucleotide sequences of KIAA1193 BINDING SITE, designated SEQ ID:33583, to the nucleotide sequence of VGAM1135 RNA, herein designated VGAM RNA, also designated SEQ ID:3846.

Another function of VGAM1135 is therefore inhibition of KIAA1193 (Accession XM_041843). Accordingly, utilities of VGAM1135 include diagnosis, prevention and treatment of diseases and clinical conditions associated with KIAA1193. KIAA1196 (Accession XM_028968) is another VGAM1135 host target gene. KIAA1196 BINDING SITE is HOST TARGET binding site found in the 3' untranslated region of mRNA encoded by KIAA1196, corresponding to a HOST TARGET binding site such as BINDING SITE I, BINDING SITE II or BINDING SITE III. Table 2 illustrates the complementarity of the nucleotide sequences of KIAA1196 BINDING SITE, designated SEQ ID:30822, to the nucleotide sequence of VGAM1135 RNA, herein designated VGAM RNA, also designated SEQ ID:3846.

Another function of VGAM1135 is therefore inhibition of KIAA1196 (Accession XM_028968). Accordingly, utilities of VGAM1135 include diagnosis, prevention and treatment of diseases and clinical conditions associated with KIAA1196. KIAA1434 (Accession XM_045585) is another VGAM1135 host target gene. KIAA1434 BINDING SITE is HOST TARGET binding site found in the 3' untranslated region of mRNA encoded by KIAA1434, corresponding to a HOST TARGET binding site such as BINDING SITE I, BINDING SITE II or BINDING SITE III. Table 2 illustrates the complementarity of the nucleotide sequences of KIAA1434 BINDING SITE, designated SEQ ID:34491, to the nucleotide sequence of VGAM1135 RNA, herein designated VGAM RNA, also designated SEQ ID:3846.

Another function of VGAM1135 is therefore inhibition of KIAA1434 (Accession XM_045585). Accordingly, utilities of VGAM1135 include diagnosis, prevention and treatment of diseases and clinical conditions associated with KIAA1434. KIAA1485 (Accession XM_114619) is another VGAM1135 host target gene. KIAA1485 BINDING SITE is HOST TARGET binding site found in the 3' untranslated region of mRNA encoded by KIAA1485, corresponding to a HOST TARGET binding site such as BINDING SITE I, BINDING SITE II or BINDING SITE III. Table 2 illustrates the complementarity of the nucleotide sequences of KIAA1485 BINDING SITE, designated SEQ ID:43002, to the nucleotide sequence of VGAM1135 RNA, herein designated VGAM RNA, also designated SEQ ID:3846.

Another function of VGAM1135 is therefore inhibition of KIAA1485 (Accession XM_114619). Accordingly, utilities of VGAM1135 include diagnosis, prevention and treatment of diseases and clinical conditions associated with KIAA1485. LIM and SH3 Protein 1 (LASP1, Accession NM_006148) is another VGAM1135 host target gene. LASP1 BINDING SITE1 and LASP1 BINDING SITE2 are HOST TARGET binding sites found in untranslated regions of mRNA encoded by LASP1, corresponding to HOST TARGET binding sites such as BINDING SITE I, BINDING SITE II or BINDING SITE III. Table 2 illustrates the complementarity of the nucleotide sequences of LASP1 BINDING SITE1 and LASP1 BINDING SITE2, designated SEQ ID:12796 and SEQ ID:12803 respectively, to the nucleotide sequence of VGAM1135 RNA, herein designated VGAM RNA, also designated SEQ ID:3846.

Another function of VGAM1135 is therefore inhibition of LIM and SH3 Protein 1 (LASP1, Accession NM_006148). Accordingly, utilities of VGAM1135 include diagnosis, prevention and treatment of diseases and clinical conditions associated with LASP1. Sema Domain, Immunoglobulin Domain (Ig), Transmembrane Domain (TM) and Short Cytoplasmic Domain, (semaphorin) 4G (SEMA4G, Accession NM_017893) is another VGAM1135 host target gene. SEMA4G BINDING SITE1 and SEMA4G BINDING SITE2 are HOST TARGET binding sites found in untranslated regions of mRNA encoded by SEMA4G, corresponding to HOST TARGET binding sites such as BINDING SITE I, BINDING SITE II or BINDING SITE III. Table 2 illustrates the complementarity of the nucleotide sequences of SEMA4G BINDING SITE1 and SEMA4G BINDING SITE2, designated SEQ ID:19565 and SEQ ID:45416 respectively, to the nucleotide sequence of VGAM1135 RNA, herein designated VGAM RNA, also designated SEQ ID:3846.

Another function of VGAM1135 is therefore inhibition of Sema Domain, Immunoglobulin Domain (Ig), Transmembrane Domain (TM) and Short Cytoplasmic Domain, (semaphorin) 4G (SEMA4G, Accession NM_017893). Accordingly, utilities of VGAM1135 include diagnosis, prevention and treatment of diseases and clinical conditions associated with SEMA4G. Tumor Protein P53 Inducible Nuclear Protein 1 (TP53INP1, Accession NM_033285) is another VGAM1135 host target gene. TP53INP1 BINDING SITE1 and TP53INP1 BINDING SITE2 are HOST TARGET binding sites found in untranslated regions of mRNA encoded by TP53INP1, corresponding to HOST TARGET binding sites such as BINDING SITE I, BINDING SITE II or BINDING SITE III. Table 2 illustrates the complementarity of the nucleotide sequences of TP53INP1 BINDING SITE1 and TP53INP1 BINDING SITE2, designated SEQ ID:27110 and SEQ ID:32960 respectively, to the nucleotide sequence of VGAM1135 RNA, herein designated VGAM RNA, also designated SEQ ID:3846.

Another function of VGAM1135 is therefore inhibition of Tumor Protein P53 Inducible Nuclear Protein 1 (TP53INP1, Accession NM_033285). Accordingly, utilities of VGAM1135 include diagnosis, prevention and treatment of diseases and clinical conditions associated with TP53INP1. LOC113444 (Accession NM_138428) is another VGAM1135 host target gene. LOC113444 BINDING SITE is HOST TARGET binding site found in the 3' untranslated region of mRNA encoded by LOC113444, corresponding to a HOST TARGET binding site such as BINDING SITE I, BINDING SITE II or BINDING SITE III. Table 2 illustrates the complementarity of the nucleotide sequences of LOC113444 BINDING SITE, designated SEQ ID:28790, to the nucleotide sequence of VGAM1135 RNA, herein designated VGAM RNA, also designated SEQ ID:3846.

Another function of VGAM1135 is therefore inhibition of LOC113444 (Accession NM_138428). Accordingly, utilities of VGAM1135 include diagnosis, prevention and treatment of diseases and clinical conditions associated with LOC113444. LOC146733 (Accession XM_097076) is another VGAM1135 host target gene. LOC146733 BINDING SITE is HOST TARGET binding site found in the 5' untranslated region of mRNA encoded by LOC146733, corresponding to a HOST TARGET binding site such as BINDING SITE I, BINDING SITE II or BINDING SITE III. Table 2 illustrates the complementarity of the nucleotide sequences of LOC146733 BINDING SITE, designated SEQ ID:40732, to the nucleotide sequence of VGAM1135 RNA, herein designated VGAM RNA, also designated SEQ ID:3846.

Another function of VGAM1135 is therefore inhibition of LOC146733 (Accession XM_097076). Accordingly, utilities of VGAM1135 include diagnosis, prevention and treatment of diseases and clinical conditions associated with LOC146733. LOC146784 (Accession XM_085588) is another VGAM1135 host target gene. LOC146784 BINDING SITE is HOST TARGET binding site found in the 5' untranslated region of mRNA encoded by LOC146784, corresponding to a HOST TARGET binding site such as BINDING SITE I, BINDING SITE II or BINDING SITE III. Table 2 illustrates the complementarity of the nucleotide sequences of LOC146784 BINDING SITE, designated SEQ ID:38241, to the nucleotide sequence of VGAM1135 RNA, herein designated VGAM RNA, also designated SEQ ID:3846.

Another function of VGAM1135 is therefore inhibition of LOC146784 (Accession XM_085588). Accordingly, utilities of VGAM1135 include diagnosis, prevention and treatment of diseases and clinical conditions associated with LOC146784. LOC148932 (Accession XM_086372) is another VGAM1135 host target gene. LOC148932 BINDING SITE is HOST TARGET binding site found in the 3' untranslated region of mRNA encoded by LOC148932, corresponding to a HOST TARGET binding site such as BINDING SITE I, BINDING SITE II or BINDING SITE III. Table 2 illustrates the complementarity of the nucleotide sequences of LOC148932 BINDING SITE, designated SEQ ID:38624, to the nucleotide sequence of VGAM1135 RNA, herein designated VGAM RNA, also designated SEQ ID:3846.

Another function of VGAM1135 is therefore inhibition of LOC148932 (Accession XM_086372). Accordingly, utilities of VGAM1135 include diagnosis, prevention and treatment of diseases and clinical conditions associated with LOC148932. LOC158263 (Accession XM_088530) is another VGAM1135 host target gene. LOC158263 BINDING SITE is HOST TARGET binding site found in the 3' untranslated region of mRNA encoded by LOC158263, corresponding to a HOST TARGET binding site such as BINDING SITE I, BINDING SITE II or BINDING SITE III. Table 2 illustrates the complementarity of the nucleotide sequences of LOC158263 BINDING SITE, designated SEQ ID:39801, to the nucleotide sequence of VGAM1135 RNA, herein designated VGAM RNA, also designated SEQ ID:3846.

Another function of VGAM1135 is therefore inhibition of LOC158263 (Accession XM_088530). Accordingly, utilities of VGAM1135 include diagnosis, prevention and treatment of diseases and clinical conditions associated with LOC158263. LOC162333 (Accession XM_102591) is another VGAM1135 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42133, to the nucleotide sequence of VGAM1135 RNA, herein designated VGAM RNA, also designated SEQ ID:3846.

Another function of VGAM1135 is therefore inhibition of LOC162333 (Accession XM_102591). Accordingly, utilities of VGAM1135 include diagnosis, prevention and treatment of diseases and clinical conditions associated with LOC162333. LOC200830 (Accession XM_117287) is another VGAM1135 host target gene. LOC200830 BINDING SITE is HOST TARGET binding site found in the 3' untranslated region of mRNA encoded by LOC200830, corresponding to a HOST TARGET binding site such as BINDING SITE I, BINDING SITE II or BINDING SITE III. Table 2 illustrates the complementarity of the nucleotide sequences of LOC200830 BINDING SITE, designated SEQ ID:43351, to the nucleotide sequence of VGAM1135 RNA, herein designated VGAM RNA, also designated SEQ ID:3846.

Another function of VGAM1135 is therefore inhibition of LOC200830 (Accession XM_117287). Accordingly, utilities of VGAM1135 include diagnosis, prevention and treatment of diseases and clinical conditions associated with LOC200830. LOC219621 (Accession XM_166148) is another VGAM1135 host target gene. LOC219621 BINDING SITE is HOST TARGET binding site found in the 3' untranslated region of mRNA encoded by LOC219621, corresponding to a HOST TARGET binding site such as BINDING SITE I, BINDING SITE II or BINDING SITE III. Table 2 illustrates the complementarity of the nucleotide sequences of LOC219621 BINDING SITE, designated SEQ ID:43969, to the nucleotide sequence of VGAM1135 RNA, herein designated VGAM RNA, also designated SEQ ID:3846.

Another function of VGAM1135 is therefore inhibition of LOC219621 (Accession XM_166148). Accordingly, utilities of VGAM1135 include diagnosis, prevention and treatment of diseases and clinical conditions associated with LOC219621. LOC221466 (Accession XM_168087) is another VGAM1135 host target gene. LOC221466 BINDING SITE is HOST TARGET binding site found in the 5' untranslated region of mRNA encoded by LOC221466, corresponding to a HOST TARGET binding site such as BINDING SITE I, BINDING SITE II or BINDING SITE III. Table 2 illustrates the complementarity of the nucleotide sequences of LOC221466 BINDING SITE, designated SEQ ID:44998, to the nucleotide sequence of VGAM1135 RNA, herein designated VGAM RNA, also designated SEQ ID:3846.

Another function of VGAM1135 is therefore inhibition of LOC221466 (Accession XM_168087). Accordingly, utilities of VGAM1135 include diagnosis, prevention and treatment of diseases and clinical conditions associated with LOC221466. LOC221833 (Accession XM_166519) is another VGAM1135 host target gene. LOC221833 BINDING SITE is HOST TARGET binding site found in the 3' untranslated region of mRNA encoded by LOC221833, corresponding to a HOST TARGET binding site such as BINDING SITE I, BINDING SITE II or BINDING SITE III. Table 2 illustrates the complementarity of the nucleotide sequences of LOC221833 BINDING SITE, designated SEQ ID:44456, to the nucleotide sequence of VGAM1135 RNA, herein designated VGAM RNA, also designated SEQ ID:3846.

Another function of VGAM1135 is therefore inhibition of LOC221833 (Accession XM_166519). Accordingly, utilities of VGAM1135 include diagnosis, prevention and treatment of diseases and clinical conditions associated with LOC221833. LOC254428 (Accession XM_170932) is another VGAM1135 host target gene. LOC254428 BINDING SITE is HOST TARGET binding site found in the 3' untranslated region of mRNA encoded by LOC254428, corresponding to a HOST TARGET binding site such as BINDING SITE I, BINDING SITE II or BINDING SITE III. Table 2 illustrates the complementarity of the nucleotide sequences of LOC254428 BINDING SITE, designated SEQ ID:45719, to the nucleotide sequence of VGAM1135 RNA, herein designated VGAM RNA, also designated SEQ ID:3846.

Another function of VGAM1135 is therefore inhibition of LOC254428 (Accession XM_170932). Accordingly, utilities of VGAM1135 include diagnosis, prevention and treatment of diseases and clinical conditions associated with LOC254428. LOC256997 (Accession XM_170900) is another VGAM1135 host target gene. LOC256997 BINDING SITE is HOST TARGET binding site found in the 5' untranslated region of mRNA encoded by LOC256997, corresponding to a HOST TARGET binding site such as BINDING SITE I, BINDING SITE II or BINDING SITE III. Table 2 illustrates the complementarity of the nucleotide sequences of LOC256997 BINDING SITE, designated SEQ ID:45652, to the nucleotide sequence of VGAM1135 RNA, herein designated VGAM RNA, also designated SEQ ID:3846.

Another function of VGAM1135 is therefore inhibition of LOC256997 (Accession XM_170900). Accordingly, utilities of VGAM1135 include diagnosis, prevention and treatment of diseases and clinical conditions associated with LOC256997. LOC51267 (Accession NM_016511) is another VGAM1135 host target gene. LOC51267 BINDING SITE is HOST TARGET binding site found in the 3' untranslated region of mRNA encoded by LOC51267, corresponding to a HOST TARGET binding site such as BINDING SITE I, BINDING SITE II or BINDING SITE III. Table 2 illustrates the complementarity of the nucleotide sequences of LOC51267 BINDING SITE, designated SEQ ID:18591, to the nucleotide sequence of VGAM1135 RNA, herein designated VGAM RNA, also designated SEQ ID:3846.

Another function of VGAM1135 is therefore inhibition of LOC51267 (Accession NM_016511). Accordingly, utilities of VGAM1135 include diagnosis, prevention and treatment of diseases and clinical conditions associated with LOC51267. LOC59346 (Accession NM_021630) is another VGAM1135 host target gene. LOC59346 BINDING SITE is HOST TARGET binding site found in the 5' untranslated region of mRNA encoded by LOC59346, corresponding to a HOST TARGET binding site such as BINDING SITE I, BINDING SITE II or BINDING SITE III. Table 2 illustrates the complementarity of the nucleotide sequences of LOC59346 BINDING SITE, designated SEQ ID:22272, to the nucleotide sequence of VGAM1135 RNA, herein designated VGAM RNA, also designated SEQ ID:3846.

Another function of VGAM1135 is therefore inhibition of LOC59346 (Accession NM_021630). Accordingly, utilities of VGAM1135 include diagnosis, prevention and treatment of diseases and clinical conditions associated with LOC59346. FIG. 1 further provides a conceptual description of a novel bioinformatically detected viral gene of the present invention, referred to here as Viral Genomic Address Messenger 1136 (VGAM1136) viral gene, which modulates expression of respective host target genes thereof, the function and utility of which host target genes is known in the art.

VGAM1136 is a novel bioinformatically detected regulatory, non protein coding, viral micro RNA (miRNA) gene. The method by which VGAM1136 was detected is described hereinabove with reference to FIGS. 1-8.

VGAM1136 gene, herein designated VGAM GENE, is a viral gene contained in the genome of Beet Mild Yellowing Virus. VGAM1136 host target gene, herein designated VGAM HOST TARGET GENE, is a human gene contained in the human genome.

VGAM1136 gene encodes a VGAM1136 precursor RNA, herein designated VGAM PRECURSOR RNA. Similar to other miRNA genes, and unlike most ordinary genes, VGAM1136 precursor RNA does not encode a protein. A nucleotide sequence identical or highly similar to the nucleotide sequence of VGAM1136 precursor RNA is designated SEQ ID:1122, and is provided hereinbelow with reference to the sequence listing part. Nucleotide sequence SEQ ID:1122 is located at position 1677 relative to the genome of Beet Mild Yellowing Virus.

VGAM1136 precursor RNA folds onto itself, forming VGAM1136 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1136 folded precursor RNA into VGAM1136 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1136 RNA is designated SEQ ID:3847, and is provided hereinbelow with reference to the sequence listing part.

VGAM1136 host target gene, herein designated VGAM HOST TARGET GENE, encodes a corresponding messenger RNA, VGAM1136 host target RNA, herein designated VGAM HOST TARGET RNA. VGAM1136 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1136 RNA, herein designated VGAM RNA, binds complementarily to one or more host target binding sites located in untranslated regions of VGAM1136 host target RNA, herein designated VGAM HOST TARGET RNA. This complementary binding is due to the fact that the nucleotide sequence of VGAM1136 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1136 RNA, herein designated VGAM RNA, may have a different number of host target binding sites in untranslated regions of a VGAM1136 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1136 RNA, herein designated VGAM RNA, to host target binding sites on VGAM1136 host target RNA, herein designated VGAM HOST TARGET RNA, such as BINDING SITE I, BINDING SITE II and BINDING SITE III, inhibits translation of VGAM1136 host target RNA into VGAM1136 host target protein, herein designated VGAM HOST TARGET PROTEIN. VGAM host target protein is therefore outlined by a broken line.

It is appreciated that VGAM1136 host target gene, herein designated VGAM HOST TARGET GENE, in fact represents a plurality of VGAM1136 host target genes. The mRNA of each one of this plurality of VGAM1136 host target genes comprises one or more host target binding sites, each having a nucleotide sequence which is at least partly complementary to VGAM1136 RNA, herein designated VGAM RNA, and which when bound by VGAM1136 RNA causes inhibition of translation of respective one or more VGAM1136 host target proteins.

It is further appreciated by one skilled in the art that the mode of translational inhibition illustrated by FIG. 1 with specific reference to translational inhibition exerted by VGAM1136 gene, herein designated VGAM GENE, on one or more VGAM1136 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1136 is inhibition of expression of host target genes, as part of a novel viral mechanism of attacking a host. Accordingly, utilities of VGAM1136 include diagnosis, prevention and treatment of viral infection by Beet Mild Yellowing Virus. Specific functions, and accordingly utilities, of VGAM1136 correlate with, and may be deduced from, the identity of the host target genes which VGAM1136 binds and inhibits, and the function of these host target genes, as elaborated hereinbelow.

Nucleotide sequences of the VGAM1136 precursor RNA, herein designated VGAM PRECURSOR RNA, and of the 'diced' VGAM1136 RNA, herein designated VGAM RNA, and a schematic representation of the secondary folding of VGAM1136 folded precursor RNA, herein designated VGAM FOLDED PRECURSOR RNA, of VGAM1136 are further described hereinbelow with reference to Table 1.

Nucleotide sequences of host target binding sites, such as BINDING SITE-I, BINDING SITE-II and BINDING SITE-III of FIG. 1, found on VGAM1136 host target RNA, and schematic representation of the complementarity of each of these host target binding sites to VGAM1136 RNA, herein designated VGAM RNA, are described hereinbelow with reference to Table 2.

As mentioned hereinabove with reference to FIG. 1, a function of VGAM1136 gene, herein designated VGAM is inhibition of expression of VGAM1136 target genes. It is appreciated that specific functions, and accordingly utilities, of VGAM1136 correlate with, and may be deduced from, the identity of the target genes which VGAM1136 binds and inhibits, and the function of these target genes, as elaborated hereinbelow.

SORCS2 (Accession NM_020777) is a VGAM1136 host target gene. SORCS2 BINDING SITE is HOST TARGET binding site found in the 3' untranslated region of mRNA encoded by SORCS2, corresponding to a HOST TARGET binding site such as BINDING SITE I, BINDING SITE II or BINDING SITE III. Table 2 illustrates the complementarity of the nucleotide sequences of SORCS2 BINDING SITE, designated SEQ ID:21873, to the nucleotide sequence of VGAM1136 RNA, herein designated VGAM RNA, also designated SEQ ID:3847.

A function of VGAM1136 is therefore inhibition of SORCS2 (Accession NM_020777). Accordingly, utilities of VGAM1136 include diagnosis, prevention and treatment of diseases and clinical conditions associated with SORCS2. Transporter 2, ATP-binding Cassette, Sub-family B (MDR/TAP) (TAP2, Accession NM_000544) is another VGAM1136 host target gene. TAP2 BINDING SITE is HOST TARGET binding site found in the 3' untranslated region of mRNA encoded by TAP2, corresponding to a HOST TARGET binding site such as BINDING SITE I, BINDING SITE II or BINDING SITE III. Table 2 illustrates the complementarity of the nucleotide sequences of TAP2 BINDING SITE, designated SEQ ID:6140, to the nucleotide sequence of VGAM1136 RNA, herein designated VGAM RNA, also designated SEQ ID:3847.

Another function of VGAM1136 is therefore inhibition of Transporter 2, ATP-binding Cassette, Sub-family B (MDR/TAP) (TAP2, Accession NM_000544), a gene which is involved in the transport of antigens from the cytoplasm to a membrane-bound compartment for association with mhc class i molecules. Accordingly, utilities of VGAM1136 include diagnosis, prevention and treatment of diseases and clinical conditions associated with TAP2. The function of TAP2 and its association with various diseases and clinical conditions, has been established by previous studies, as described hereinabove with reference to VGAM55. Ras and Rab Interactor 3 (RIN3, Accession NM_024832) is another VGAM1136 host target gene. RIN3 BINDING SITE is HOST TARGET binding site found in the 3' untranslated region of mRNA encoded by RIN3, corresponding to a HOST TARGET binding site such as BINDING SITE I, BINDING SITE II or BINDING SITE III. Table 2 illustrates the complementarity of the nucleotide sequences of RIN3 BINDING SITE, designated SEQ ID:24230, to the nucleotide sequence of VGAM1136 RNA, herein designated VGAM RNA, also designated SEQ ID:3847.

Another function of VGAM1136 is therefore inhibition of Ras and Rab Interactor 3 (RIN3, Accession NM_024832). Accordingly, utilities of VGAM1136 include diagnosis, prevention and treatment of diseases and clinical conditions associated with RIN3. LOC145623 (Accession XM_096822) is another VGAM1136 host target gene. LOC145623 BINDING SITE is HOST TARGET binding site found in the 3' untranslated region of mRNA encoded by LOC145623, corresponding to a HOST TARGET binding site such as BINDING SITE I, BINDING SITE II or BINDING SITE III. Table 2 illustrates the complementarity of the nucleotide sequences of LOC145623 BINDING SITE, designated SEQ ID:40544, to the nucleotide sequence of VGAM1136 RNA, herein designated VGAM RNA, also designated SEQ ID:3847.

Another function of VGAM1136 is therefore inhibition of LOC145623 (Accession XM_096822). Accordingly, utilities of VGAM1136 include diagnosis, prevention and treatment of diseases and clinical conditions associated with LOC145623. LOC197335 (Accession XM_113866) is another VGAM1136 host target gene. LOC197335 BINDING SITE is HOST TARGET binding site found in the 5' untranslated region of mRNA encoded by LOC197335, corresponding to a HOST TARGET binding site such as BINDING SITE I, BINDING SITE II or BINDING SITE III. Table 2 illustrates the complementarity of the nucleotide sequences of LOC197335 BINDING SITE, designated SEQ ID:42479, to the nucleotide sequence of VGAM1136 RNA, herein designated VGAM RNA, also designated SEQ ID:3847.

Another function of VGAM1136 is therefore inhibition of LOC197335 (Accession XM_113866). Accordingly, utilities of VGAM1136 include diagnosis, prevention and treatment of diseases and clinical conditions associated with LOC197335. FIG. 1 further provides a conceptual description of a novel bioinformatically detected viral gene of the present invention, referred to here as Viral Genomic Address Messenger 1137 (VGAM1137) viral gene, which modulates expression of respective host target genes thereof, the function and utility of which host target genes is known in the art.

VGAM1137 is a novel bioinformatically detected regulatory, non protein coding, viral micro RNA (miRNA) gene. The method by which VGAM1137 was detected is described hereinabove with reference to FIGS. 1-8.

VGAM1137 gene, herein designated VGAM GENE, is a viral gene contained in the genome of Beet Mild Yellowing Virus. VGAM1137 host target gene, herein designated VGAM HOST TARGET GENE, is a human gene contained in the human genome.

VGAM1137 gene encodes a VGAM1137 precursor RNA, herein designated VGAM PRECURSOR RNA. Similar to other miRNA genes, and unlike most ordinary genes, VGAM1137 precursor RNA does not encode a protein. A nucleotide sequence identical or highly similar to the nucleotide sequence of VGAM1137 precursor RNA is designated SEQ ID:1123, and is provided hereinbelow with reference to the sequence listing part. Nucleotide sequence SEQ ID:1123 is located at position 3269 relative to the genome of Beet Mild Yellowing Virus.

VGAM1137 precursor RNA folds onto itself, forming VGAM1137 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1137 folded precursor RNA into VGAM1137 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 89%) nucleotide sequence of VGAM1137 RNA is designated SEQ ID:3848, and is provided hereinbelow with reference to the sequence listing part.

VGAM1137 host target gene, herein designated VGAM HOST TARGET GENE, encodes a corresponding messenger RNA, VGAM1137 host target RNA, herein designated VGAM HOST TARGET RNA. VGAM1137 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1137 RNA, herein designated VGAM RNA, binds complementarily to one or more host target binding sites located in untranslated regions of VGAM1137 host target RNA, herein designated VGAM HOST TARGET RNA. This complementary binding is due to the fact that the nucleotide sequence of VGAM1137 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1137 RNA, herein designated VGAM RNA, may have a different number of host target binding sites in untranslated regions of a VGAM1137 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1137 RNA, herein designated VGAM RNA, to host target binding sites on VGAM1137 host target RNA, herein designated VGAM HOST TARGET RNA, such as BINDING SITE I, BINDING SITE II and BINDING SITE III, inhibits translation of VGAM1137 host target RNA into VGAM1137 host target protein, herein designated VGAM HOST TARGET PROTEIN. VGAM host target protein is therefore outlined by a broken line.

It is appreciated that VGAM1137 host target gene, herein designated VGAM HOST TARGET GENE, in fact represents a plurality of VGAM1137 host target genes. The mRNA of each one of this plurality of VGAM1137 host target genes comprises one or more host target binding sites, each having a nucleotide sequence which is at least partly complementary to VGAM1137 RNA, herein designated VGAM RNA, and which when bound by VGAM1137 RNA causes inhibition of translation of respective one or more VGAM1137 host target proteins.

It is further appreciated by one skilled in the art that the mode of translational inhibition illustrated by FIG. 1 with specific reference to translational inhibition exerted by VGAM1137 gene, herein designated VGAM GENE, on one or more VGAM1137 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1137 is inhibition of expression of host target genes, as part of a novel viral mechanism of attacking a host. Accordingly, utilities of VGAM1137 include diagnosis, prevention and treatment of viral infection by Beet Mild Yellowing Virus. Specific functions, and accordingly utilities, of VGAM1137 correlate with, and may be deduced from, the identity of the host target genes which VGAM1137 binds and inhibits, and the function of these host target genes, as elaborated hereinbelow.

Nucleotide sequences of the VGAM1137 precursor RNA, herein designated VGAM PRECURSOR RNA, and of the 'diced' VGAM1137 RNA, herein designated VGAM RNA, and a schematic representation of the secondary folding of VGAM1137 folded precursor RNA, herein designated VGAM FOLDED PRECURSOR RNA, of VGAM1137 are further described hereinbelow with reference to Table 1.

Nucleotide sequences of host target binding sites, such as BINDING SITE-I, BINDING SITE-II and BINDING SITE-III of FIG. 1, found on VGAM1137 host target RNA, and schematic representation of the complementarity of each of these host target binding sites to VGAM1137 RNA, herein designated VGAM RNA, are described hereinbelow with reference to Table 2.

As mentioned hereinabove with reference to FIG. 1, a function of VGAM1137 gene, herein designated VGAM is inhibition of expression of VGAM1137 target genes. It is appreciated that specific functions, and accordingly utilities, of VGAM1137 correlate with, and may be deduced from, the identity of the target genes which VGAM1137 binds and inhibits, and the function of these target genes, as elaborated hereinbelow.

A2BP1 (Accession NM_018723) is a VGAM1137 host target gene. A2BP1 BINDING SITE is HOST TARGET binding site found in the 5' untranslated region of mRNA encoded by A2BP1, corresponding to a HOST TARGET binding site such as BINDING SITE I, BINDING SITE II or BINDING SITE III. Table 2 illustrates the complementarity of the nucleotide sequences of A2BP1 BINDING SITE, designated SEQ ID:20804, to the nucleotide sequence of VGAM1137 RNA, herein designated VGAM RNA, also designated SEQ ID:3848.

A function of VGAM1137 is therefore inhibition of A2BP1 (Accession NM_018723). Accordingly, utilities of VGAM1137 include diagnosis, prevention and treatment of diseases and clinical conditions associated with A2BP1. NPD009 (Accession XM_170795) is another VGAM1137 host target gene. NPD009 BINDING SITE is HOST TARGET binding site found in the 3' untranslated region of mRNA encoded by NPD009, corresponding to a HOST TARGET binding site such as BINDING SITE I, BINDING SITE II or BINDING SITE III. Table 2 illustrates the complementarity of the nucleotide sequences of NPD009 BINDING SITE, designated SEQ ID:45561, to the nucleotide sequence of VGAM1137 RNA, herein designated VGAM RNA, also designated SEQ ID:3848.

Another function of VGAM1137 is therefore inhibition of NPD009 (Accession XM_170795). Accordingly, utilities of VGAM1137 include diagnosis, prevention and treatment of diseases and clinical conditions associated with NPD009.

FIG. 1 further provides a conceptual description of a novel bioinformatically detected viral gene of the present invention, referred to here as Viral Genomic Address Messenger 1138 (VGAM1138) viral gene, which modulates expression of respective host target genes thereof, the function and utility of which host target genes is known in the art.

VGAM1138 is a novel bioinformatically detected regulatory, non protein coding, viral micro RNA (miRNA) gene. The method by which VGAM1138 was detected is described hereinabove with reference to FIGS. 1-8.

VGAM1138 gene, herein designated VGAM GENE, is a viral gene contained in the genome of Beet Mild Yellowing Virus. VGAM1138 host target gene, herein designated VGAM HOST TARGET GENE, is a human gene contained in the human genome.

VGAM1138 gene encodes a VGAM1138 precursor RNA, herein designated VGAM PRECURSOR RNA. Similar to other miRNA genes, and unlike most ordinary genes, VGAM1138 precursor RNA does not encode a protein. A nucleotide sequence identical or highly similar to the nucleotide sequence of VGAM1138 precursor RNA is designated SEQ ID:1124, and is provided hereinbelow with reference to the sequence listing part. Nucleotide sequence SEQ ID:1124 is located at position 1988 relative to the genome of Beet Mild Yellowing Virus.

VGAM1138 precursor RNA folds onto itself, forming VGAM1138 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1138 folded precursor RNA into VGAM1138 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM1138 RNA is designated SEQ ID:3849, and is provided hereinbelow with reference to the sequence listing part.

VGAM1138 host target gene, herein designated VGAM HOST TARGET GENE, encodes a corresponding messenger RNA, VGAM1138 host target RNA, herein designated VGAM HOST TARGET RNA. VGAM1138 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1138 RNA, herein designated VGAM RNA, binds complementarily to one or more host target binding sites located in untranslated regions of VGAM1138 host target RNA, herein designated VGAM HOST TARGET RNA. This complementary binding is due to the fact that the nucleotide sequence of VGAM1138 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1138 RNA, herein designated VGAM RNA, may have a different number of host target binding sites in untranslated regions of a VGAM1138 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1138 RNA, herein designated VGAM RNA, to host target binding sites on VGAM1138 host target RNA, herein designated VGAM HOST TARGET RNA, such as BINDING SITE I, BINDING SITE II and BINDING SITE III, inhibits translation of VGAM1138 host target RNA into VGAM1138 host target protein, herein designated VGAM HOST TARGET PROTEIN. VGAM host target protein is therefore outlined by a broken line.

It is appreciated that VGAM1138 host target gene, herein designated VGAM HOST TARGET GENE, in fact represents a plurality of VGAM1138 host target genes. The mRNA of each one of this plurality of VGAM1138 host target genes comprises one or more host target binding sites, each having a nucleotide sequence which is at least partly complementary to VGAM1138 RNA, herein designated VGAM RNA, and which when bound by VGAM1138 RNA causes inhibition of translation of respective one or more VGAM1138 host target proteins.

It is further appreciated by one skilled in the art that the mode of translational inhibition illustrated by FIG. 1 with specific reference to translational inhibition exerted by VGAM1138 gene, herein designated VGAM GENE, on one or more VGAM1138 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1138 is inhibition of expression of host target genes, as part of a novel viral mechanism of attacking a host. Accordingly, utilities of VGAM1138 include diagnosis, prevention and treatment of viral infection by Beet Mild Yellowing Virus. Specific functions, and accordingly utilities, of VGAM1138 correlate with, and may be deduced from, the identity of the host target genes which VGAM1138 binds and inhibits, and the function of these host target genes, as elaborated hereinbelow.

Nucleotide sequences of the VGAM1138 precursor RNA, herein designated VGAM PRECURSOR RNA, and of the 'diced' VGAM1138 RNA, herein designated VGAM RNA, and a schematic representation of the secondary folding of VGAM1138 folded precursor RNA, herein designated VGAM FOLDED PRECURSOR RNA, of VGAM1138 are further described hereinbelow with reference to Table 1.

Nucleotide sequences of host target binding sites, such as BINDING SITE-I, BINDING SITE-II and BINDING SITE-III of FIG. 1, found on VGAM1138 host target RNA, and schematic representation of the complementarity of each of these host target binding sites to VGAM1138 RNA, herein designated VGAM RNA, are described hereinbelow with reference to Table 2.

As mentioned hereinabove with reference to FIG. 1, a function of VGAM1138 gene, herein designated VGAM is inhibition of expression of VGAM1138 target genes. It is appreciated that specific functions, and accordingly utilities, of VGAM1138 correlate with, and may be deduced from, the identity of the target genes which VGAM1138 binds and inhibits, and the function of these target genes, as elaborated hereinbelow.

Adenylate Kinase 1 (AK1, Accession NM_000476) is a VGAM1138 host target gene. AK1 BINDING SITE is HOST TARGET binding site found in the 3' untranslated region of mRNA encoded by AK1, corresponding to a HOST TARGET binding site such as BINDING SITE I, BINDING SITE II or BINDING SITE III. Table 2 illustrates the complementarity of the nucleotide sequences of AK1 BINDING SITE, designated SEQ ID:6085, to the nucleotide sequence of VGAM1138 RNA, herein designated VGAM RNA, also designated SEQ ID:3849.

A function of VGAM1138 is therefore inhibition of Adenylate Kinase 1 (AK1, Accession NM_000476). Accordingly, utilities of VGAM1138 include diagnosis, prevention and treatment of diseases and clinical conditions associated with AK1. Homeo Box D4 (HOXD4, Accession NM_014621) is another VGAM1138 host target gene. HOXD4 BINDING SITE is HOST TARGET binding site found in the 5' untranslated region of mRNA encoded by HOXD4, corresponding to a HOST TARGET binding site such as BINDING SITE I, BINDING SITE II or BINDING SITE III. Table 2 illustrates the complementarity of the nucleotide sequences of HOXD4 BINDING SITE, designated SEQ ID:15978, to the nucleotide sequence of VGAM1138 RNA, herein designated VGAM RNA, also designated SEQ ID:3849.

Another function of VGAM1138 is therefore inhibition of Homeo Box D4 (HOXD4, Accession NM_014621), a gene which is part of a developmental regulatory system. Accordingly, utilities of VGAM1138 include diagnosis, prevention and treatment of diseases and clinical conditions associated with HOXD4. The function of HOXD4 and its association with various diseases and clinical conditions, has been established by previous studies, as described hereinabove with reference to VGAM330. Kinase Insert Domain Receptor (a type III receptor tyrosine kinase) (KDR, Accession NM_002253) is another VGAM1138 host target gene. KDR BINDING SITE is HOST TARGET binding site found in the 3' untranslated region of mRNA encoded by KDR, corresponding to a HOST TARGET binding site such as BINDING SITE I, BINDING SITE II or BINDING SITE III. Table 2 illustrates the complementarity of the nucleotide sequences of KDR BINDING SITE, designated SEQ ID:8052, to the nucleotide sequence of VGAM1138 RNA, herein designated VGAM RNA, also designated SEQ ID:3849.

Another function of VGAM1138 is therefore inhibition of Kinase Insert Domain Receptor (a type III receptor tyrosine kinase) (KDR, Accession NM_002253). Accordingly, utilities of VGAM1138 include diagnosis, prevention and treatment of diseases and clinical conditions associated with KDR. Kruppel-like Factor 8 (KLF8, Accession NM_007250) is another VGAM1138 host target gene. KLF8 BINDING SITE is HOST TARGET binding site found in the 5' untranslated region of mRNA encoded by KLF8, corresponding to a HOST TARGET binding site such as BINDING SITE I, BINDING SITE II or BINDING SITE III. Table 2 illustrates the complementarity of the nucleotide sequences of KLF8 BINDING SITE, designated SEQ ID:14124, to the nucleotide sequence of VGAM1138 RNA, herein designated VGAM RNA, also designated SEQ ID:3849.

Another function of VGAM1138 is therefore inhibition of Kruppel-like Factor 8 (KLF8, Accession NM_007250).

Accordingly, utilities of VGAM1138 include diagnosis, prevention and treatment of diseases and clinical conditions associated with KLF8. MIPOL1 (Accession XM_085077) is another VGAM1138 host target gene. MIPOL1 BINDING SITE is HOST TARGET binding site found in the 5' untranslated region of mRNA encoded by MIPOL1, corresponding to a HOST TARGET binding site such as BINDING SITE I, BINDING SITE II or BINDING SITE III. Table 2 illustrates the complementarity of the nucleotide sequences of MIPOL1 BINDING SITE, designated SEQ ID:37813, to the nucleotide sequence of VGAM1138 RNA, herein designated VGAM RNA, also designated SEQ ID:3849.

Another function of VGAM1138 is therefore inhibition of MIPOL1 (Accession XM_085077). Accordingly, utilities of VGAM1138 include diagnosis, prevention and treatment of diseases and clinical conditions associated with MIPOL1. Protein Phosphatase 1, Regulatory (inhibitor) Subunit 8 (PPP1R8, Accession NM_138558) is another VGAM1138 host target gene. PPP1R8 BINDING SITE1 and PPP1R8 BINDING SITE2 are HOST TARGET binding sites found in untranslated regions of mRNA encoded by PPP1R8, corresponding to HOST TARGET binding sites such as BINDING SITE I, BINDING SITE II or BINDING SITE III. Table 2 illustrates the complementarity of the nucleotide sequences of PPP1R8 BINDING SITE1 and PPP1R8 BINDING SITE2, designated SEQ ID:28853 and SEQ ID:8567 respectively, to the nucleotide sequence of VGAM1138 RNA, herein designated VGAM RNA, also designated SEQ ID:3849.

Another function of VGAM1138 is therefore inhibition of Protein Phosphatase 1, Regulatory (inhibitor) Subunit 8 (PPP1R8, Accession NM_138558), a gene which is an inhibitor subunit of the major nuclear protein phosphatase-1 (pp-1). Accordingly, utilities of VGAM1138 include diagnosis, prevention and treatment of diseases and clinical conditions associated with PPP1R8. The function of PPP1R8 and its association with various diseases and clinical conditions, has been established by previous studies, as described hereinabove with reference to VGAM101. Periaxin (PRX, Accession NM_020956) is another VGAM1138 host target gene. PRX BINDING SITE is HOST TARGET binding site found in the 3' untranslated region of mRNA encoded by PRX, corresponding to a HOST TARGET binding site such as BINDING SITE I, BINDING SITE II or BINDING SITE III. Table 2 illustrates the complementarity of the nucleotide sequences of PRX BINDING SITE, designated SEQ ID:21937, to the nucleotide sequence of VGAM1138 RNA, herein designated VGAM RNA, also designated SEQ ID:3849.

Another function of VGAM1138 is therefore inhibition of Periaxin (PRX, Accession NM_020956), a gene which seems to be required for maintenance of peripheral nerve myelin sheath. may have a role in axon-glial interactions, possibly by interacting with the cytoplasmic domains of integral membrane proteins such as myelin-associated glycoprotein in the periaxonal regions of the schwann cell plasma membrane. may have a role in the early phases of myelin deposition. Accordingly, utilities of VGAM1138 include diagnosis, prevention and treatment of diseases and clinical conditions associated with PRX. The function of PRX and its association with various diseases and clinical conditions, has been established by previous studies, as described hereinabove with reference to VGAM476. SAR1 (Accession NM_020150) is another VGAM1138 host target gene. SAR1 BINDING SITE is HOST TARGET binding site found in the 3' untranslated region of mRNA encoded by SAR1, corresponding to a HOST TARGET binding site such as BINDING SITE I, BINDING SITE II or BINDING SITE III. Table 2 illustrates the complementarity of the nucleotide sequences of SAR1 BINDING SITE, designated SEQ ID:21351, to the nucleotide sequence of VGAM1138 RNA, herein designated VGAM RNA, also designated SEQ ID:3849.

Another function of VGAM1138 is therefore inhibition of SAR1 (Accession NM_020150), a gene which is involved in transport from the endoplasmic reticulum to the golgi apparatus (by similarity). Accordingly, utilities of VGAM1138 include diagnosis, prevention and treatment of diseases and clinical conditions associated with SAR1. The function of SAR1 and its association with various diseases and clinical conditions, has been established by previous studies, as described hereinabove with reference to VGAM222. Wolf-Hirschhorn Syndrome Candidate 1 (WHSC1, Accession NM_133332) is another VGAM1138 host target gene. WHSC1 BINDING SITE1 through WHSC1 BINDING SITE3 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE3, designated SEQ ID:28439, SEQ ID:28456 and SEQ ID:17175 respectively, to the nucleotide sequence of VGAM1138 RNA, herein designated VGAM RNA, also designated SEQ ID:3849.

Another function of VGAM1138 is therefore inhibition of Wolf-Hirschhorn Syndrome Candidate 1 (WHSC1, Accession NM_133332), a gene which binds covalently to and repairs g/t mismatches. Accordingly, utilities of VGAM1138 include diagnosis, prevention and treatment of diseases and clinical conditions associated with WHSC1. The function of WHSC1 and its association with various diseases and clinical conditions, has been established by previous studies, as described hereinabove with reference to VGAM200. C6.1A (Accession NM_024332) is another VGAM1138 host target gene. C6.1A BINDING SITE is HOST TARGET binding site found in the 3' untranslated region of mRNA encoded by C6.1A, corresponding to a HOST TARGET binding site such as BINDING SITE I, BINDING SITE II or BINDING SITE III. Table 2 illustrates the complementarity of the nucleotide sequences of C6.1A BINDING SITE, designated SEQ ID:23638, to the nucleotide sequence of VGAM1138 RNA, herein designated VGAM RNA, also designated SEQ ID:3849.

Another function of VGAM1138 is therefore inhibition of C6.1A (Accession NM_024332). Accordingly, utilities of VGAM1138 include diagnosis, prevention and treatment of diseases and clinical conditions associated with C6.1A. CDC14 Cell Division Cycle 14 Homolog A (S. cerevisiae) (CDC14A, Accession NM_003672) is another VGAM1138 host target gene. CDC14A BINDING SITE is HOST TARGET binding site found in the 3' untranslated region of mRNA encoded by CDC14A, corresponding to a HOST TARGET binding site such as BINDING SITE I, BINDING SITE II or BINDING SITE III. Table 2 illustrates the complementarity of the nucleotide sequences of CDC14A BINDING SITE, designated SEQ ID:9765, to the nucleotide sequence of VGAM1138 RNA, herein designated VGAM RNA, also designated SEQ ID:3849.

Another function of VGAM1138 is therefore inhibition of CDC14 Cell Division Cycle 14 Homolog A (S. cerevisiae) (CDC14A, Accession NM_003672). Accordingly, utilities of VGAM1138 include diagnosis, prevention and treatment of diseases and clinical conditions associated with CDC14A. CCR4-NOT Transcription Complex, Subunit 7 (CNOT7, Accession NM_013354) is another VGAM1138 host target gene. CNOT7 BINDING SITE is HOST TARGET binding site found in the 3' untranslated region of mRNA encoded by CNOT7, corresponding to a HOST TARGET binding site such as BINDING SITE I, BINDING SITE II or BINDING SITE III. Table 2 illustrates the complementarity of the nucleotide sequences of CNOT7 BINDING SITE, designated SEQ ID:15002, to the nucleotide sequence of VGAM1138 RNA, herein designated VGAM RNA, also designated SEQ ID:3849.

Another function of VGAM1138 is therefore inhibition of CCR4-NOT Transcription Complex, Subunit 7 (CNOT7, Accession NM_013354). Accordingly, utilities of VGAM1138 include diagnosis, prevention and treatment of diseases and clinical conditions associated with CNOT7. DKFZP434J193 (Accession XM_048452) is another VGAM1138 host target gene. DKFZP434J193 BINDING SITE is HOST TARGET binding site found in the 3' untranslated region of mRNA encoded by DKFZP434J193, corresponding to a HOST TARGET binding site such as BINDING SITE I, BINDING SITE II or BINDING SITE III. Table 2 illustrates the complementarity of the nucleotide sequences of DKFZP434J193 BINDING SITE, designated SEQ ID:35166, to the nucleotide sequence of VGAM1138 RNA, herein designated VGAM RNA, also designated SEQ ID:3849.

Another function of VGAM1138 is therefore inhibition of DKFZP434J193 (Accession XM_048452). Accordingly, utilities of VGAM1138 include diagnosis, prevention and treatment of diseases and clinical conditions associated with DKFZP434J193. DKFZp761H2121 (Accession NM_138339) is another VGAM1138 host target gene. DKFZp761H2121 BINDING SITE is HOST TARGET binding site found in the 5' untranslated region of mRNA encoded by DKFZp761H2121, corresponding to a HOST TARGET binding site such as BINDING SITE I, BINDING SITE II or BINDING SITE III. Table 2 illustrates the complementarity of the nucleotide sequences of DKFZp761H2121 BINDING SITE, designated SEQ ID:28738, to the nucleotide sequence of VGAM1138 RNA, herein designated VGAM RNA, also designated SEQ ID:3849.

Another function of VGAM1138 is therefore inhibition of DKFZp761H2121 (Accession NM_138339). Accordingly, utilities of VGAM1138 include diagnosis, prevention and treatment of diseases and clinical conditions associated with DKFZp761H2121. FLJ10716 (Accession NM_018191) is another VGAM1138 host target gene. FLJ10716 BINDING SITE is HOST TARGET binding site found in the 3' untranslated region of mRNA encoded by FLJ10716, corresponding to a HOST TARGET binding site such as BINDING SITE I, BINDING SITE II or BINDING SITE III. Table 2 illustrates the complementarity of the nucleotide sequences of FLJ10716 BINDING SITE, designated SEQ ID:20044, to the nucleotide sequence of VGAM1138 RNA, herein designated VGAM RNA, also designated SEQ ID:3849.

Another function of VGAM1138 is therefore inhibition of FLJ10716 (Accession NM_018191). Accordingly, utilities of VGAM1138 include diagnosis, prevention and treatment of diseases and clinical conditions associated with FLJ10716. FLJ10738 (Accession NM_018199) is another VGAM1138 host target gene. FLJ10738 BINDING SITE is HOST TARGET binding site found in the 3' untranslated region of mRNA encoded by FLJ10738, corresponding to a HOST TARGET binding site such as BINDING SITE I, BINDING SITE II or BINDING SITE III. Table 2 illustrates the complementarity of the nucleotide sequences of FLJ10738 BINDING SITE, designated SEQ ID:20068, to the nucleotide sequence of VGAM1138 RNA, herein designated VGAM RNA, also designated SEQ ID:3849.

Another function of VGAM1138 is therefore inhibition of FLJ10738 (Accession NM_018199). Accordingly, utilities of VGAM1138 include diagnosis, prevention and treatment of diseases and clinical conditions associated with FLJ10738. FLJ22301 (Accession NM_024836) is another VGAM1138 host target gene. FLJ22301 BINDING SITE is HOST TARGET binding site found in the 5' untranslated region of mRNA encoded by FLJ22301, corresponding to a HOST TARGET binding site such as BINDING SITE I, BINDING SITE II or BINDING SITE III. Table 2 illustrates the complementarity of the nucleotide sequences of FLJ22301 BINDING SITE, designated SEQ ID:24241, to the nucleotide sequence of VGAM1138 RNA, herein designated VGAM RNA, also designated SEQ ID:3849.

Another function of VGAM1138 is therefore inhibition of FLJ22301 (Accession NM_024836). Accordingly, utilities of VGAM1138 include diagnosis, prevention and treatment of diseases and clinical conditions associated with FLJ22301. KIAA0182 (Accession XM_050495) is another VGAM1138 host target gene. KIAA0182 BINDING SITE is HOST TARGET binding site found in the 3' untranslated region of mRNA encoded by KIAA0182, corresponding to a HOST TARGET binding site such as BINDING SITE I, BINDING SITE II or BINDING SITE III. Table 2 illustrates the complementarity of the nucleotide sequences of KIAA0182 BINDING SITE, designated SEQ ID:35642, to the nucleotide sequence of VGAM1138 RNA, herein designated VGAM RNA, also designated SEQ ID:3849.

Another function of VGAM1138 is therefore inhibition of KIAA0182 (Accession XM_050495). Accordingly, utilities of VGAM1138 include diagnosis, prevention and treatment of diseases and clinical conditions associated with KIAA0182. KIAA0494 (Accession NM_014774) is another VGAM1138 host target gene. KIAA0494 BINDING SITE is HOST TARGET binding site found in the 3' untranslated region of mRNA encoded by KIAA0494, corresponding to a HOST TARGET binding site such as BINDING SITE I, BINDING SITE II or BINDING SITE III. Table 2 illustrates the complementarity of the nucleotide sequences of KIAA0494 BINDING SITE, designated SEQ ID:16586, to the nucleotide sequence of VGAM1138 RNA, herein designated VGAM RNA, also designated SEQ ID:3849.

Another function of VGAM1138 is therefore inhibition of KIAA0494 (Accession NM_014774). Accordingly, utilities of VGAM1138 include diagnosis, prevention and treatment of diseases and clinical conditions associated with KIAA0494. KIAA0660 (Accession NM_012297) is another VGAM1138 host target gene. KIAA0660 BINDING SITE is HOST TARGET binding site found in the 3' untranslated region of mRNA encoded by KIAA0660, corresponding to a HOST TARGET binding site such as BINDING SITE I, BINDING SITE II or BINDING SITE III. Table 2 illustrates the complementarity of the nucleotide sequences of KIAA0660 BINDING SITE, designated SEQ ID:14656, to the nucleotide sequence of VGAM1138 RNA, herein designated VGAM RNA, also designated SEQ ID:3849.

Another function of VGAM1138 is therefore inhibition of KIAA0660 (Accession NM_012297). Accordingly, utilities of VGAM1138 include diagnosis, prevention and treatment of diseases and clinical conditions associated with KIAA0660. RNF9 (Accession NM_052828) is another VGAM1138 host target gene. RNF9 BINDING SITE is HOST TARGET binding site found in the 3' untranslated region of mRNA encoded by RNF9, corresponding to a HOST TARGET binding site such as BINDING SITE I, BINDING SITE II or BINDING SITE III. Table 2 illustrates the complementarity of the nucleotide sequences of RNF9 BINDING SITE, designated SEQ ID:27410, to the nucleotide sequence of VGAM1138 RNA, herein designated VGAM RNA, also designated SEQ ID:3849.

Another function of VGAM1138 is therefore inhibition of RNF9 (Accession NM_052828). Accordingly, utilities of VGAM1138 include diagnosis, prevention and treatment of diseases and clinical conditions associated with RNF9. LOC124222 (Accession XM_058784) is another VGAM1138 host target gene. LOC124222 BINDING SITE is HOST TARGET binding site found in the 3' untranslated region of mRNA encoded by LOC124222, corresponding to a HOST TARGET binding site such as BINDING SITE I, BINDING SITE II or BINDING SITE III. Table 2 illustrates the complementarity of the nucleotide sequences of LOC124222 BINDING SITE, designated SEQ ID:36741, to the nucleotide sequence of VGAM1138 RNA, herein designated VGAM RNA, also designated SEQ ID:3849.

Another function of VGAM1138 is therefore inhibition of LOC124222 (Accession XM_058784). Accordingly, utilities of VGAM1138 include diagnosis, prevention and treatment of diseases and clinical conditions associated with LOC124222. LOC131870 (Accession XM_059544) is another VGAM1138 host target gene. LOC131870 BINDING SITE is HOST TARGET binding site found in the 3' untranslated region of mRNA encoded by LOC131870, corresponding to a HOST TARGET binding site such as BINDING SITE I, BINDING SITE II or BINDING SITE III. Table 2 illustrates the complementarity of the nucleotide sequences of LOC131870 BINDING SITE, designated SEQ ID:37017, to the nucleotide sequence of VGAM1138 RNA, herein designated VGAM RNA, also designated SEQ ID:3849.

Another function of VGAM1138 is therefore inhibition of LOC131870 (Accession XM_059544). Accordingly, utilities of VGAM1138 include diagnosis, prevention and treatment of diseases and clinical conditions associated with LOC131870. LOC150213 (Accession XM_059324) is another VGAM1138 host target gene. LOC150213 BINDING SITE is HOST TARGET binding site found in the 3' untranslated region of mRNA encoded by LOC150213, corresponding to a HOST TARGET binding site such as BINDING SITE I, BINDING SITE II or BINDING SITE III. Table 2 illustrates the complementarity of the nucleotide sequences of LOC150213 BINDING SITE, designated SEQ ID:36959, to the nucleotide sequence of VGAM1138 RNA, herein designated VGAM RNA, also designated SEQ ID:3849.

Another function of VGAM1138 is therefore inhibition of LOC150213 (Accession XM_059324). Accordingly, utilities of VGAM1138 include diagnosis, prevention and treatment of diseases and clinical conditions associated with LOC150213. LOC150236 (Accession XM_086824) is another VGAM1138 host target gene. LOC150236 BINDING SITE is HOST TARGET binding site found in the 5' untranslated region of mRNA encoded by LOC150236, corresponding to a HOST TARGET binding site such as BINDING SITE I, BINDING SITE II or BINDING SITE III. Table 2 illustrates the complementarity of the nucleotide sequences of LOC150236 BINDING SITE, designated SEQ ID:38905, to the nucleotide sequence of VGAM1138 RNA, herein designated VGAM RNA, also designated SEQ ID:3849.

Another function of VGAM1138 is therefore inhibition of LOC150236 (Accession XM_086824). Accordingly, utilities of VGAM1138 include diagnosis, prevention and treatment of diseases and clinical conditions associated with LOC150236. LOC220840 (Accession XM_165514) is another VGAM1138 host target gene. LOC220840 BINDING SITE is HOST TARGET binding site found in the 3' untranslated region of mRNA encoded by LOC220840, corresponding to a HOST TARGET binding site such as BINDING SITE I, BINDING SITE II or BINDING SITE III. Table 2 illustrates the complementarity of the nucleotide sequences of LOC220840 BINDING SITE, designated SEQ ID:43658, to the nucleotide sequence of VGAM1138 RNA, herein designated VGAM RNA, also designated SEQ ID:3849.

Another function of VGAM1138 is therefore inhibition of LOC220840 (Accession XM_165514). Accordingly, utilities of VGAM1138 include diagnosis, prevention and treatment of diseases and clinical conditions associated with LOC220840. LOC221914 (Accession XM_168232) is another VGAM1138 host target gene. LOC221914 BINDING SITE is HOST TARGET binding site found in the 3' untranslated region of mRNA encoded by LOC221914, corresponding to a HOST TARGET binding site such as BINDING SITE I, BINDING SITE II or BINDING SITE III. Table 2 illustrates the complementarity of the nucleotide sequences of LOC221914 BINDING SITE, designated SEQ ID:45099, to the nucleotide sequence of VGAM1138 RNA, herein designated VGAM RNA, also designated SEQ ID:3849.

Another function of VGAM1138 is therefore inhibition of LOC221914 (Accession XM_168232). Accordingly, utilities of VGAM1138 include diagnosis, prevention and treatment of diseases and clinical conditions associated with LOC221914. LOC257277 (Accession XM_170867) is another VGAM1138 host target gene. LOC257277 BINDING SITE is HOST TARGET binding site found in the 5' untranslated region of mRNA encoded by LOC257277, corresponding to a HOST TARGET binding site such as BINDING SITE I, BINDING SITE II or BINDING SITE III. Table 2 illustrates the complementarity of the nucleotide sequences of LOC257277 BINDING SITE, designated SEQ ID:45640, to the nucleotide sequence of VGAM1138 RNA, herein designated VGAM RNA, also designated SEQ ID:3849.

Another function of VGAM1138 is therefore inhibition of LOC257277 (Accession XM_170867). Accordingly, utilities of VGAM1138 include diagnosis, prevention and treatment of diseases and clinical conditions associated with LOC257277. LOC91464 (Accession XM_038589) is another VGAM1138 host target gene. LOC91464 BINDING SITE is HOST TARGET binding site found in the 3' untranslated region of mRNA encoded by LOC91464, corresponding to a HOST TARGET binding site such as BINDING SITE I, BINDING SITE II or BINDING SITE III. Table 2 illustrates the complementarity of the nucleotide sequences of LOC91464 BINDING SITE, designated SEQ ID:32872, to the nucleotide sequence of VGAM1138 RNA, herein designated VGAM RNA, also designated SEQ ID:3849.

Another function of VGAM1138 is therefore inhibition of LOC91464 (Accession XM_038589). Accordingly, utilities of VGAM1138 include diagnosis, prevention and treatment of diseases and clinical conditions associated with LOC91464. FIG. 1 further provides a conceptual description of a novel bioinformatically detected viral gene of the present invention, referred to here as Viral Genomic Address Messenger 1139 (VGAM1139) viral gene, which modulates expression of respective host target genes thereof, the function and utility of which host target genes is known in the art.

VGAM1139 is a novel bioinformatically detected regulatory, non protein coding, viral micro RNA (miRNA) gene. The method by which VGAM1139 was detected is described hereinabove with reference to FIGS. 1-8.

VGAM1139 gene, herein designated VGAM GENE, is a viral gene contained in the genome of Chayote Mosaic Tymovirus. VGAM1139 host target gene, herein designated VGAM HOST TARGET GENE, is a human gene contained in the human genome.

VGAM1139 gene encodes a VGAM1139 precursor RNA, herein designated VGAM PRECURSOR RNA. Similar to other miRNA genes, and unlike most ordinary genes, VGAM1139 precursor RNA does not encode a protein. A nucleotide sequence identical or highly similar to the nucleotide sequence of VGAM1139 precursor RNA is designated SEQ ID:1125, and is provided hereinbelow with reference to the sequence listing part. Nucleotide sequence SEQ ID:1125 is located at position 4987 relative to the genome of Chayote Mosaic Tymovirus.

VGAM1139 precursor RNA folds onto itself, forming VGAM1139 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1139 folded precursor RNA into VGAM1139 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 88%) nucleotide sequence of VGAM1139 RNA is designated SEQ ID:3850, and is provided hereinbelow with reference to the sequence listing part.

VGAM1139 host target gene, herein designated VGAM HOST TARGET GENE, encodes a corresponding messenger RNA, VGAM1139 host target RNA, herein designated VGAM HOST TARGET RNA. VGAM1139 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1139 RNA, herein designated VGAM RNA, binds complementarily to one or more host target binding sites located in untranslated regions of VGAM1139 host target RNA, herein designated VGAM HOST TARGET RNA. This complementary binding is due to the fact that the nucleotide sequence of VGAM1139 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1139 RNA, herein designated VGAM RNA, may have a different number of host target binding sites in untranslated regions of a VGAM1139 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1139 RNA, herein designated VGAM RNA, to host target binding sites on VGAM1139 host target RNA, herein designated VGAM HOST TARGET RNA, such as BINDING SITE I, BINDING SITE II and BINDING SITE III, inhibits translation of VGAM1139 host target RNA into VGAM1139 host target protein, herein designated VGAM HOST TARGET PROTEIN. VGAM host target protein is therefore outlined by a broken line.

It is appreciated that VGAM1139 host target gene, herein designated VGAM HOST TARGET GENE, in fact represents a plurality of VGAM1139 host target genes. The mRNA of each one of this plurality of VGAM1139 host target genes comprises one or more host target binding sites, each having a nucleotide sequence which is at least partly complementary to VGAM1139 RNA, herein designated VGAM RNA, and which when bound by VGAM1139 RNA causes inhibition of translation of respective one or more VGAM1139 host target proteins.

It is further appreciated by one skilled in the art that the mode of translational inhibition illustrated by FIG. 1 with specific reference to translational inhibition exerted by VGAM1139 gene, herein designated VGAM GENE, on one or more VGAM1139 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1139 is inhibition of expression of host target genes, as part of a novel viral mechanism of attacking a host. Accordingly, utilities of VGAM1139 include diagnosis, prevention and treatment of viral infection by Chayote Mosaic Tymovirus. Specific functions, and accordingly utilities, of VGAM1139 correlate with, and may be deduced from, the identity of the host target genes which VGAM1139 binds and inhibits, and the function of these host target genes, as elaborated hereinbelow.

Nucleotide sequences of the VGAM1139 precursor RNA, herein designated VGAM PRECURSOR RNA, and of the 'diced' VGAM1139 RNA, herein designated VGAM RNA, and a schematic representation of the secondary folding of VGAM1139 folded precursor RNA, herein designated VGAM FOLDED PRECURSOR RNA, of VGAM1139 are further described hereinbelow with reference to Table 1.

Nucleotide sequences of host target binding sites, such as BINDING SITE-I, BINDING SITE-II and BINDING SITE-III of FIG. 1, found on VGAM1139 host target RNA, and schematic representation of the complementarity of each of these host target binding sites to VGAM1139 RNA, herein designated VGAM RNA, are described hereinbelow with reference to Table 2.

As mentioned hereinabove with reference to FIG. 1, a function of VGAM1139 gene, herein designated VGAM is inhibition of expression of VGAM1139 target genes. It is appreciated that specific functions, and accordingly utilities, of VGAM1139 correlate with, and may be deduced from, the identity of the target genes which VGAM1139 binds and inhibits, and the function of these target genes, as elaborated hereinbelow.

Chromosome 20 Open Reading Frame 36 (C20orf36, Accession NM_018257) is a VGAM1139 host target gene. C20orf36 BINDING SITE is HOST TARGET binding site found in the 3' untranslated region of mRNA encoded by C20orf36, corresponding to a HOST TARGET binding site such as BINDING SITE I, BINDING SITE II or BINDING SITE III. Table 2 illustrates the complementarity of the nucleotide sequences of C20orf36 BINDING SITE, designated SEQ ID:20221, to the nucleotide sequence of VGAM1139 RNA, herein designated VGAM RNA, also designated SEQ ID:3850.

A function of VGAM1139 is therefore inhibition of Chromosome 20 Open Reading Frame 36 (C20orf36, Accession NM_018257). Accordingly, utilities of VGAM1139 include diagnosis, prevention and treatment of diseases and clinical conditions associated with C20orf36. DKFZp586I021 (Accession NM_032271) is another VGAM1139 host target gene. DKFZp586I021 BINDING SITE is HOST TARGET binding site found in the 5' untranslated region of mRNA encoded by DKFZp586I021, corresponding to a HOST TARGET binding site such as BINDING SITE I, BINDING SITE II or BINDING SITE III. Table 2 illustrates the complementarity of the nucleotide sequences of DKFZp586I021 BINDING SITE, designated SEQ ID:26027, to the nucleotide sequence of VGAM1139 RNA, herein designated VGAM RNA, also designated SEQ ID:3850.

Another function of VGAM1139 is therefore inhibition of DKFZp586I021 (Accession NM_032271). Accordingly, utilities of VGAM1139 include diagnosis, prevention and treatment of diseases and clinical conditions associated with DKFZp586I021. LOC154834 (Accession XM_098621) is another VGAM1139 host target gene. LOC154834 BINDING SITE is HOST TARGET binding site found in the 3' untranslated region of mRNA encoded by LOC154834, corresponding to a HOST TARGET binding site such as BINDING SITE I, BINDING SITE II or BINDING SITE III. Table 2 illustrates the complementarity of the nucleotide sequences of LOC154834 BINDING SITE, designated SEQ ID:41732, to the nucleotide sequence of VGAM1139 RNA, herein designated VGAM RNA, also designated SEQ ID:3850.

Another function of VGAM1139 is therefore inhibition of LOC154834 (Accession XM_098621). Accordingly, utilities of VGAM1139 include diagnosis, prevention and treatment of diseases and clinical conditions associated with LOC154834. LOC169026 (Accession XM_095471) is another VGAM1139 host target gene. LOC169026 BINDING SITE is HOST TARGET binding site found in the 5' untranslated region of mRNA encoded by LOC169026, corresponding to a HOST TARGET binding site such as BINDING SITE I, BINDING SITE II or BINDING SITE III. Table 2 illustrates the complementarity of the nucleotide sequences of LOC169026 BINDING SITE, designated SEQ ID:40261, to the nucleotide sequence of VGAM1139 RNA, herein designated VGAM RNA, also designated SEQ ID:3850.

Another function of VGAM1139 is therefore inhibition of LOC169026 (Accession XM_095471). Accordingly, utilities of VGAM1139 include diagnosis, prevention and treatment of diseases and clinical conditions associated with LOC169026. LOC201292 (Accession XM_113949) is another VGAM1139 host target gene. LOC201292 BINDING SITE is HOST TARGET binding site found in the 5' untranslated region of mRNA encoded by LOC201292, corresponding to a HOST TARGET binding site such as BINDING SITE I, BINDING SITE II or BINDING SITE III. Table 2 illustrates the complementarity of the nucleotide sequences of LOC201292 BINDING SITE, designated SEQ ID:42563, to the nucleotide sequence of VGAM1139 RNA, herein designated VGAM RNA, also designated SEQ ID:3850.

Another function of VGAM1139 is therefore inhibition of LOC201292 (Accession XM_113949). Accordingly, utilities of VGAM1139 include diagnosis, prevention and treatment of diseases and clinical conditions associated with LOC201292. FIG. 1 further provides a conceptual description of a novel bioinformatically detected viral gene of the present invention, referred to here as Viral Genomic Address Messenger 1140 (VGAM1140) viral gene, which modulates expression of respective host target genes thereof, the function and utility of which host target genes is known in the art.

VGAM1140 is a novel bioinformatically detected regulatory, non protein coding, viral micro RNA (miRNA) gene. The method by which VGAM1140 was detected is described hereinabove with reference to FIGS. 1-8.

VGAM1140 gene, herein designated VGAM GENE, is a viral gene contained in the genome of Chayote Mosaic Tymovirus. VGAM1140 host target gene, herein designated VGAM HOST TARGET GENE, is a human gene contained in the human genome.

VGAM1140 gene encodes a VGAM1140 precursor RNA, herein designated VGAM PRECURSOR RNA. Similar to other miRNA genes, and unlike most ordinary genes, VGAM1140 precursor RNA does not encode a protein. A nucleotide sequence identical or highly similar to the nucleotide sequence of VGAM1140 precursor RNA is designated SEQ ID:1126, and is provided hereinbelow with reference to the sequence listing part. Nucleotide sequence SEQ ID:1126 is located at position 709 relative to the genome of Chayote Mosaic Tymovirus.

VGAM1140 precursor RNA folds onto itself, forming VGAM1140 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1140 folded precursor RNA into VGAM1140 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1140 RNA is designated SEQ ID:3851, and is provided hereinbelow with reference to the sequence listing part.

VGAM1140 host target gene, herein designated VGAM HOST TARGET GENE, encodes a corresponding messenger RNA, VGAM1140 host target RNA, herein designated VGAM HOST TARGET RNA. VGAM1140 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1140 RNA, herein designated VGAM RNA, binds complementarily to one or more host target binding sites located in untranslated regions of VGAM1140 host target RNA, herein designated VGAM HOST TARGET RNA. This complementary binding is due to the fact that the nucleotide sequence of VGAM1140 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1140 RNA, herein designated VGAM RNA, may have a different number of host target binding sites in untranslated regions of a VGAM1140 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1140 RNA, herein designated VGAM RNA, to host target binding sites on VGAM1140 host target RNA, herein designated VGAM HOST TARGET RNA, such as BINDING SITE I, BINDING SITE II and BINDING SITE III, inhibits translation of VGAM1140 host target RNA into VGAM1140 host target protein, herein designated VGAM HOST TARGET PROTEIN. VGAM host target protein is therefore outlined by a broken line.

It is appreciated that VGAM1140 host target gene, herein designated VGAM HOST TARGET GENE, in fact represents a plurality of VGAM1140 host target genes. The mRNA of each one of this plurality of VGAM1140 host target genes comprises one or more host target binding sites, each having a nucleotide sequence which is at least partly complementary to VGAM1140 RNA, herein designated VGAM RNA, and which when bound by VGAM1140 RNA causes inhibition of translation of respective one or more VGAM1140 host target proteins.

It is further appreciated by one skilled in the art that the mode of translational inhibition illustrated by FIG. 1 with specific reference to translational inhibition exerted by VGAM1140 gene, herein designated VGAM GENE, on one or more VGAM1140 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1140 is inhibition of expression of host target genes, as part of a novel viral mechanism of attacking a host. Accordingly, utilities of VGAM1140 include diagnosis, prevention and treatment of viral infection by Chayote Mosaic Tymovirus. Specific functions, and accordingly utilities, of VGAM1140 correlate with, and may be deduced from, the identity of the host target genes which VGAM1140 binds and inhibits, and the function of these host target genes, as elaborated hereinbelow.

Nucleotide sequences of the VGAM1140 precursor RNA, herein designated VGAM PRECURSOR RNA, and of the 'diced' VGAM1140 RNA, herein designated VGAM RNA, and a schematic representation of the secondary folding of VGAM1140 folded precursor RNA, herein designated VGAM FOLDED PRECURSOR RNA, of VGAM1140 are further described hereinbelow with reference to Table 1.

Nucleotide sequences of host target binding sites, such as BINDING SITE-I, BINDING SITE-II and BINDING SITE-III of FIG. 1, found on VGAM1140 host target RNA, and schematic representation of the complementarity of each of these host target binding sites to VGAM1140 RNA, herein designated VGAM RNA, are described hereinbelow with reference to Table 2.

As mentioned hereinabove with reference to FIG. 1, a function of VGAM1140 gene, herein designated VGAM is inhibition of expression of VGAM1140 target genes. It is appreciated that specific functions, and accordingly utilities, of VGAM1140 correlate with, and may be deduced from, the identity of the target genes which VGAM1140 binds and inhibits, and the function of these target genes, as elaborated hereinbelow.

ATPase, Class VI, Type 11A (ATP11A, Accession XM_085028) is a VGAM1140 host target gene. ATP11A BINDING SITE is HOST TARGET binding site found in the 3' untranslated region of mRNA encoded by ATP11A, corresponding to a HOST TARGET binding site such as BINDING SITE I, BINDING SITE II or BINDING SITE III. Table 2 illustrates the complementarity of the nucleotide sequences of ATP11A BINDING SITE, designated SEQ ID:37800, to the nucleotide sequence of VGAM1140 RNA, herein designated VGAM RNA, also designated SEQ ID:3851.

A function of VGAM1140 is therefore inhibition of ATPase, Class VI, Type 11A (ATP11A, Accession XM_085028). Accordingly, utilities of VGAM1140 include diagnosis, prevention and treatment of diseases and clinical conditions associated with ATP11A. FLJ22056 (Accession NM_022489) is another VGAM1140 host target gene. FLJ22056 BINDING SITE is HOST TARGET binding site found in the 5' untranslated region of mRNA encoded by FLJ22056, corresponding to a HOST TARGET binding site such as BINDING SITE I, BINDING SITE II or BINDING SITE III. Table 2 illustrates the complementarity of the nucleotide sequences of FLJ22056 BINDING SITE, designated SEQ ID:22868, to the nucleotide sequence of VGAM1140 RNA, herein designated VGAM RNA, also designated SEQ ID:3851.

Another function of VGAM1140 is therefore inhibition of FLJ22056 (Accession NM_022489). Accordingly, utilities of VGAM1140 include diagnosis, prevention and treatment of diseases and clinical conditions associated with FLJ22056. LOC253461 (Accession XM_172341) is another VGAM1140 host target gene. LOC253461 BINDING SITE is HOST TARGET binding site found in the 3' untranslated region of mRNA encoded by LOC253461, corresponding to a HOST TARGET binding site such as BINDING SITE I, BINDING SITE II or BINDING SITE III. Table 2 illustrates the complementarity of the nucleotide sequences of LOC253461 BINDING SITE, designated SEQ ID:46073, to the nucleotide sequence of VGAM1140 RNA, herein designated VGAM RNA, also designated SEQ ID:3851.

Another function of VGAM1140 is therefore inhibition of LOC253461 (Accession XM_172341). Accordingly, utilities of VGAM1140 include diagnosis, prevention and treatment of diseases and clinical conditions associated with LOC253461. FIG. 1 further provides a conceptual description of a novel bioinformatically detected viral gene of the present invention, referred to here as Viral Genomic Address Messenger 1141 (VGAM1141) viral gene, which modulates expression of respective host target genes thereof, the function and utility of which host target genes is known in the art.

VGAM1141 is a novel bioinformatically detected regulatory, non protein coding, viral micro RNA (miRNA) gene. The method by which VGAM1141 was detected is described hereinabove with reference to FIGS. 1-8.

VGAM1141 gene, herein designated VGAM GENE, is a viral gene contained in the genome of Chayote Mosaic Tymovirus. VGAM1141 host target gene, herein designated VGAM HOST TARGET GENE, is a human gene contained in the human genome.

VGAM1141 gene encodes a VGAM1141 precursor RNA, herein designated VGAM PRECURSOR RNA. Similar to other miRNA genes, and unlike most ordinary genes, VGAM1141 precursor RNA does not encode a protein. A nucleotide sequence identical or highly similar to the nucleotide sequence of VGAM1141 precursor RNA is designated SEQ ID:1127, and is provided hereinbelow with reference to the sequence listing part. Nucleotide sequence SEQ ID:1127 is located at position 1116 relative to the genome of Chayote Mosaic Tymovirus.

VGAM1141 precursor RNA folds onto itself, forming VGAM1141 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1141 folded precursor RNA into VGAM1141 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1141 RNA is designated SEQ ID:3852, and is provided hereinbelow with reference to the sequence listing part.

VGAM1141 host target gene, herein designated VGAM HOST TARGET GENE, encodes a corresponding messenger RNA, VGAM1141 host target RNA, herein designated VGAM HOST TARGET RNA. VGAM1141 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1141 RNA, herein designated VGAM RNA, binds complementarily to one or more host target binding sites located in untranslated regions of VGAM1141 host target RNA, herein designated VGAM HOST TARGET RNA. This complementary binding is due to the fact that the nucleotide sequence of VGAM1141 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1141 RNA, herein designated VGAM RNA, may have a different number of host target binding sites in untranslated regions of a VGAM1141 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1141 RNA, herein designated VGAM RNA, to host target binding sites on VGAM1141 host target RNA, herein designated VGAM HOST TARGET RNA, such as BINDING SITE I, BINDING SITE II and BINDING SITE III, inhibits translation of VGAM1141 host target RNA into VGAM1141 host target protein, herein designated VGAM HOST TARGET PROTEIN. VGAM host target protein is therefore outlined by a broken line.

It is appreciated that VGAM1141 host target gene, herein designated VGAM HOST TARGET GENE, in fact represents a plurality of VGAM1141 host target genes. The mRNA of each one of this plurality of VGAM1141 host target genes comprises one or more host target binding sites, each having a nucleotide sequence which is at least partly complementary to VGAM1141 RNA, herein designated VGAM RNA, and which when bound by VGAM1141 RNA causes inhibition of translation of respective one or more VGAM1141 host target proteins.

It is further appreciated by one skilled in the art that the mode of translational inhibition illustrated by FIG. 1 with specific reference to translational inhibition exerted by VGAM1141 gene, herein designated VGAM GENE, on one or more VGAM1141 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1141 is inhibition of expression of host target genes, as part of a novel viral mechanism of attacking a host. Accordingly, utilities of VGAM1141 include diagnosis, prevention and treatment of viral infection by Chayote Mosaic Tymovirus. Specific functions, and accordingly utilities, of VGAM1141 correlate with, and may be deduced from, the identity of the host target genes which VGAM1141 binds and inhibits, and the function of these host target genes, as elaborated hereinbelow.

Nucleotide sequences of the VGAM1141 precursor RNA, herein designated VGAM PRECURSOR RNA, and of the 'diced' VGAM1141 RNA, herein designated VGAM RNA, and a schematic representation of the secondary folding of VGAM1141 folded precursor RNA, herein designated VGAM FOLDED PRECURSOR RNA, of VGAM1141 are further described hereinbelow with reference to Table 1.

Nucleotide sequences of host target binding sites, such as BINDING SITE-I, BINDING SITE-II and BINDING SITE-III of FIG. 1, found on VGAM1141 host target RNA, and schematic representation of the complementarity of each of these host target binding sites to VGAM1141 RNA, herein designated VGAM RNA, are described hereinbelow with reference to Table 2.

As mentioned hereinabove with reference to FIG. 1, a function of VGAM1141 gene, herein designated VGAM is inhibition of expression of VGAM1141 target genes. It is appreciated that specific functions, and accordingly utilities, of VGAM1141 correlate with, and may be deduced from, the identity of the target genes which VGAM1141 binds and inhibits, and the function of these target genes, as elaborated hereinbelow.

Transient Receptor Potential Cation Channel, Subfamily C, Member 6 (TRPC6, Accession NM_004621) is a VGAM1141 host target gene. TRPC6 BINDING SITE is HOST TARGET binding site found in the 5' untranslated region of mRNA encoded by TRPC6, corresponding to a HOST TARGET binding site such as BINDING SITE I, BINDING SITE II or BINDING SITE III. Table 2 illustrates the complementarity of the nucleotide sequences of TRPC6 BINDING SITE, designated SEQ ID:10975, to the nucleotide sequence of VGAM1141 RNA, herein designated VGAM RNA, also designated SEQ ID:3852.

A function of VGAM1141 is therefore inhibition of Transient Receptor Potential Cation Channel, Subfamily C, Member 6 (TRPC6, Accession NM_004621), a gene which has calcium channel activity. Accordingly, utilities of VGAM1141 include diagnosis, prevention and treatment of diseases and clinical conditions associated with TRPC6. The function of TRPC6 and its association with various diseases and clinical conditions, has been established by previous studies, as described hereinabove with reference to VGAM25. NTT73 (Accession NM_018057) is another VGAM1141 host target gene. NTT73 BINDING SITE is HOST TARGET binding site found in the 5' untranslated region of mRNA encoded by NTT73, corresponding to a HOST TARGET binding site such as BINDING SITE I, BINDING SITE II or BINDING SITE III. Table 2 illustrates the complementarity of the nucleotide sequences of NTT73 BINDING SITE, designated SEQ ID:19820, to the nucleotide sequence of VGAM1141 RNA, herein designated VGAM RNA, also designated SEQ ID:3852.

Another function of VGAM1141 is therefore inhibition of NTT73 (Accession NM_018057). Accordingly, utilities of VGAM1141 include diagnosis, prevention and treatment of diseases and clinical conditions associated with NTT73. FIG. 1 further provides a conceptual description of a novel bioinformatically detected viral gene of the present invention, referred to here as Viral Genomic Address Messenger 1142 (VGAM1142) viral gene, which modulates expression of respective host target genes thereof, the function and utility of which host target genes is known in the art.

VGAM1142 is a novel bioinformatically detected regulatory, non protein coding, viral micro RNA (miRNA) gene. The method by which VGAM1142 was detected is described hereinabove with reference to FIGS. 1-8.

VGAM1142 gene, herein designated VGAM GENE, is a viral gene contained in the genome of Bamboo Mosaic Virus. VGAM1142 host target gene, herein designated VGAM HOST TARGET GENE, is a human gene contained in the human genome.

VGAM1142 gene encodes a VGAM1142 precursor RNA, herein designated VGAM PRECURSOR RNA. Similar to other miRNA genes, and unlike most ordinary genes, VGAM1142 precursor RNA does not encode a protein. A nucleotide sequence identical or highly similar to the nucleotide sequence of VGAM1142 precursor RNA is designated SEQ ID:1128, and is provided hereinbelow with reference to the sequence listing part. Nucleotide sequence SEQ ID:1128 is located at position 5891 relative to the genome of Bamboo Mosaic Virus.

VGAM1142 precursor RNA folds onto itself, forming VGAM1142 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1142 folded precursor RNA into VGAM1142 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1142 RNA is designated SEQ ID:3853, and is provided hereinbelow with reference to the sequence listing part.

VGAM1142 host target gene, herein designated VGAM HOST TARGET GENE, encodes a corresponding messenger RNA, VGAM1142 host target RNA, herein designated VGAM HOST TARGET RNA. VGAM1142 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1142 RNA, herein designated VGAM RNA, binds complementarily to one or more host target binding sites located in untranslated regions of VGAM1142 host target RNA, herein designated VGAM HOST TARGET RNA. This complementary binding is due to the fact that the nucleotide sequence of VGAM1142 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1142 RNA, herein designated VGAM RNA, may have a different number of host target binding sites in untranslated regions of a VGAM1142 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1142 RNA, herein designated VGAM RNA, to host target binding sites on VGAM1142 host target RNA, herein designated VGAM HOST TARGET RNA, such as BINDING SITE I, BINDING SITE II and BINDING SITE III, inhibits translation of VGAM1142 host target RNA into VGAM1142 host target protein, herein designated VGAM HOST TARGET PROTEIN. VGAM host target protein is therefore outlined by a broken line.

It is appreciated that VGAM1142 host target gene, herein designated VGAM HOST TARGET GENE, in fact represents a plurality of VGAM1142 host target genes. The mRNA of each one of this plurality of VGAM1142 host target genes comprises one or more host target binding sites, each having a nucleotide sequence which is at least partly complementary to VGAM1142 RNA, herein designated VGAM RNA, and which when bound by VGAM1142 RNA causes inhibition of translation of respective one or more VGAM1142 host target proteins.

It is further appreciated by one skilled in the art that the mode of translational inhibition illustrated by FIG. 1 with specific reference to translational inhibition exerted by VGAM1142 gene, herein designated VGAM GENE, on one or more VGAM1142 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1142 is inhibition of expression of host target genes, as part of a novel viral mechanism of attacking a host. Accordingly, utilities of VGAM1142 include diagnosis, prevention and treatment of viral infection by Bamboo Mosaic Virus. Specific functions, and accordingly utilities, of VGAM1142 correlate with, and may be deduced from, the identity of the host target genes which VGAM1142 binds and inhibits, and the function of these host target genes, as elaborated hereinbelow.

Nucleotide sequences of the VGAM1142 precursor RNA, herein designated VGAM PRECURSOR RNA, and of the 'diced' VGAM1142 RNA, herein designated VGAM RNA, and a schematic representation of the secondary folding of VGAM1142 folded precursor RNA, herein designated VGAM FOLDED PRECURSOR RNA, of VGAM1142 are further described hereinbelow with reference to Table 1.

Nucleotide sequences of host target binding sites, such as BINDING SITE-I, BINDING SITE-II and BINDING SITE-III of FIG. 1, found on VGAM1142 host target RNA, and schematic representation of the complementarity of each of these host target binding sites to VGAM1142 RNA, herein designated VGAM RNA, are described hereinbelow with reference to Table 2.

As mentioned hereinabove with reference to FIG. 1, a function of VGAM1142 gene, herein designated VGAM is inhibition of expression of VGAM1142 target genes. It is appreciated that specific functions, and accordingly utilities, of VGAM1142 correlate with, and may be deduced from, the identity of the target genes which VGAM1142 binds and inhibits, and the function of these target genes, as elaborated hereinbelow.

LanC Lantibiotic Synthetase Component C-like 1 (bacterial) (LANCL1, Accession NM_006055) is a VGAM1142 host target gene. LANCL1 BINDING SITE is HOST TARGET binding site found in the 3' untranslated region of mRNA encoded by LANCL1, corresponding to a HOST TARGET binding site such as BINDING SITE I, BINDING SITE II or BINDING SITE III. Table 2 illustrates the complementarity of the nucleotide sequences of LANCL1 BINDING SITE, designated SEQ ID:12692, to the nucleotide sequence of VGAM1142 RNA, herein designated VGAM RNA, also designated SEQ ID:3853.

A function of VGAM1142 is therefore inhibition of LanC Lantibiotic Synthetase Component C-like 1 (bacterial) (LANCL1, Accession NM_006055), a gene which binds the C-terminus of stomatin. Accordingly, utilities of VGAM1142 include diagnosis, prevention and treatment of diseases and clinical conditions associated with LANCL1. The function of LANCL1 and its association with various diseases and clinical conditions, has been established by previous studies, as described hereinabove with reference to VGAM656. Protocadherin 9 (PCDH9, Accession XM_096054) is another VGAM1142 host target gene. PCDH9 BINDING SITE is HOST TARGET binding site found in the 5' untranslated region of mRNA encoded by PCDH9, corresponding to a HOST TARGET binding site such as BINDING SITE I, BINDING SITE II or BINDING SITE III. Table 2 illustrates the complementarity of the nucleotide sequences of PCDH9 BINDING SITE, designated SEQ ID:40294, to the nucleotide sequence of VGAM1142 RNA, herein designated VGAM RNA, also designated SEQ ID:3853.

Another function of VGAM1142 is therefore inhibition of Protocadherin 9 (PCDH9, Accession XM_096054). Accordingly, utilities of VGAM1142 include diagnosis, prevention and treatment of diseases and clinical conditions associated with PCDH9. Regulatory Factor X, 5 (influences HLA class II expression) (RFX5, Accession NM_000449) is another VGAM1142 host target gene. RFX5 BINDING SITE is HOST TARGET binding site found in the 3' untranslated region of mRNA encoded by RFX5, corresponding to a HOST TARGET binding site such as BINDING SITE I, BINDING SITE II or BINDING SITE III. Table 2 illustrates the complementarity of the nucleotide sequences of RFX5 BINDING SITE, designated SEQ ID:6048, to the nucleotide sequence of VGAM1142 RNA, herein designated VGAM RNA, also designated SEQ ID:3853.

Another function of VGAM1142 is therefore inhibition of Regulatory Factor X, 5 (influences HLA class II expression) (RFX5, Accession NM_000449), a gene which activates transcription from class ii mhc promoters. Accordingly, utilities of VGAM1142 include diagnosis, prevention and treatment of diseases and clinical conditions associated with RFX5. The function of RFX5 and its association with various diseases and clinical conditions, has been established by previous studies, as described hereinabove with reference to VGAM55. Chromosome 17 Open Reading Frame 26 (C17orf26, Accession NM_139177) is another VGAM1142 host target gene. C17orf26 BINDING SITE is HOST TARGET binding site found in the 3' untranslated region of mRNA encoded by C17orf26, corresponding to a HOST TARGET binding site such as BINDING SITE I, BINDING SITE II or BINDING SITE III. Table 2 illustrates the complementarity of the nucleotide sequences of C17orf26 BINDING SITE, designated SEQ ID:29183, to the nucleotide sequence of VGAM1142 RNA, herein designated VGAM RNA, also designated SEQ ID:3853.

Another function of VGAM1142 is therefore inhibition of Chromosome 17 Open Reading Frame 26 (C17orf26, Accession NM_139177). Accordingly, utilities of VGAM1142 include diagnosis, prevention and treatment of diseases and clinical conditions associated with C17orf26. Calcium-binding tyrosine-(Y)-phosphorylation Regulated (fibrousheathin 2) (CABYR, Accession NM_012189) is another VGAM1142 host target gene. CABYR BINDING SITE is HOST TARGET binding site found in the 3' untranslated region of mRNA encoded by CABYR, corresponding to a HOST TARGET binding site such as BINDING SITE I, BINDING SITE II or BINDING SITE III. Table 2 illustrates the complementarity of the nucleotide sequences of CABYR BINDING SITE, designated SEQ ID:14476, to the nucleotide sequence of VGAM1142 RNA, herein designated VGAM RNA, also designated SEQ ID:3853.

Another function of VGAM1142 is therefore inhibition of Calcium-binding tyrosine-(Y)-phosphorylation Regulated (fibrousheathin 2) (CABYR, Accession NM_012189). Accordingly, utilities of VGAM1142 include diagnosis, prevention and treatment of diseases and clinical conditions associated with CABYR. FLJ10579 (Accession NM_018145) is another VGAM1142 host target gene. FLJ10579 BINDING SITE is HOST TARGET binding site found in the 3' untranslated region of mRNA encoded by FLJ10579, corresponding to a HOST TARGET binding site such as BINDING SITE I, BINDING SITE II or BINDING SITE III. Table 2 illustrates the complementarity of the nucleotide sequences of FLJ10579 BINDING SITE, designated SEQ ID:19944, to the nucleotide sequence of VGAM1142 RNA, herein designated VGAM RNA, also designated SEQ ID:3853.

Another function of VGAM1142 is therefore inhibition of FLJ10579 (Accession NM_018145). Accordingly, utilities of VGAM1142 include diagnosis, prevention and treatment of diseases and clinical conditions associated with FLJ10579. FLJ11618 (Accession NM_022452) is another VGAM1142 host target gene. FLJ11618 BINDING SITE is HOST TAR- GET binding site found in the 3' untranslated region of mRNA encoded by FLJ11618, corresponding to a HOST TARGET binding site such as BINDING SITE I, BINDING SITE II or BINDING SITE III. Table 2 illustrates the complementarity of the nucleotide sequences of FLJ11618 BINDING SITE, designated SEQ ID:22790, to the nucleotide sequence of VGAM1142 RNA, herein designated VGAM RNA, also designated SEQ ID:3853.

Another function of VGAM1142 is therefore inhibition of FLJ11618 (Accession NM_022452). Accordingly, utilities of VGAM1142 include diagnosis, prevention and treatment of diseases and clinical conditions associated with FLJ11618. Huntingtin-associated Protein Interacting Protein (duo) (HAPIP, Accession NM_003947) is another VGAM1142 host target gene. HAPIP BINDING SITE is HOST TARGET binding site found in the 3' untranslated region of mRNA encoded by HAPIP, corresponding to a HOST TARGET binding site such as BINDING SITE I, BINDING SITE II or BINDING SITE III. Table 2 illustrates the complementarity of the nucleotide sequences of HAPIP BINDING SITE, designated SEQ ID:10066, to the nucleotide sequence of VGAM1142 RNA, herein designated VGAM RNA, also designated SEQ ID:3853.

Another function of VGAM1142 is therefore inhibition of Huntingtin-associated Protein Interacting Protein (duo) (HAPIP, Accession NM_003947). Accordingly, utilities of VGAM1142 include diagnosis, prevention and treatment of diseases and clinical conditions associated with HAPIP. KIAA0515 (Accession XM_033380) is another VGAM1142 host target gene. KIAA0515 BINDING SITE is HOST TARGET binding site found in the 3' untranslated region of mRNA encoded by KIAA0515, corresponding to a HOST TARGET binding site such as BINDING SITE I, BINDING SITE II or BINDING SITE III. Table 2 illustrates the complementarity of the nucleotide sequences of KIAA0515 BINDING SITE, designated SEQ ID:31915, to the nucleotide sequence of VGAM1142 RNA, herein designated VGAM RNA, also designated SEQ ID:3853.

Another function of VGAM1142 is therefore inhibition of KIAA0515 (Accession XM_033380). Accordingly, utilities of VGAM1142 include diagnosis, prevention and treatment of diseases and clinical conditions associated with KIAA0515. NPD009 (Accession XM_170795) is another VGAM1142 host target gene. NPD009 BINDING SITE is HOST TARGET binding site found in the 5' untranslated region of mRNA encoded by NPD009, corresponding to a HOST TARGET binding site such as BINDING SITE I, BINDING SITE II or BINDING SITE III. Table 2 illustrates the complementarity of the nucleotide sequences of NPD009 BINDING SITE, designated SEQ ID:45559, to the nucleotide sequence of VGAM1142 RNA, herein designated VGAM RNA, also designated SEQ ID:3853.

Another function of VGAM1142 is therefore inhibition of NPD009 (Accession XM_170795). Accordingly, utilities of VGAM1142 include diagnosis, prevention and treatment of diseases and clinical conditions associated with NPD009. Pellino Homolog 2 (Drosophila) (PELI2, Accession NM_021255) is another VGAM1142 host target gene. PELI2 BINDING SITE is HOST TARGET binding site found in the 3' untranslated region of mRNA encoded by PELI2, corresponding to a HOST TARGET binding site such as BINDING SITE I, BINDING SITE II or BINDING SITE III. Table 2 illustrates the complementarity of the nucleotide sequences of PELI2 BINDING SITE, designated SEQ ID:22227, to the nucleotide sequence of VGAM1142 RNA, herein designated VGAM RNA, also designated SEQ ID:3853.

Another function of VGAM1142 is therefore inhibition of Pellino Homolog 2 (Drosophila) (PELI2, Accession NM_021255). Accordingly, utilities of VGAM1142 include diagnosis, prevention and treatment of diseases and clinical conditions associated with PELI2. LOC116411 (Accession XM_058095) is another VGAM1142 host target gene. LOC116411 BINDING SITE is HOST TARGET binding site found in the 5' untranslated region of mRNA encoded by LOC116411, corresponding to a HOST TARGET binding site such as BINDING SITE I, BINDING SITE II or BINDING SITE III. Table 2 illustrates the complementarity of the nucleotide sequences of LOC116411 BINDING SITE, designated SEQ ID:36563, to the nucleotide sequence of VGAM1142 RNA, herein designated VGAM RNA, also designated SEQ ID:3853.

Another function of VGAM1142 is therefore inhibition of LOC116411 (Accession XM_058095). Accordingly, utilities of VGAM1142 include diagnosis, prevention and treatment of diseases and clinical conditions associated with LOC116411. LOC51094 (Accession NM_015999) is another VGAM1142 host target gene. LOC51094 BINDING SITE is HOST TARGET binding site found in the 3' untranslated region of mRNA encoded by LOC51094, corresponding to a HOST TARGET binding site such as BINDING SITE I, BINDING SITE II or BINDING SITE III. Table 2 illustrates the complementarity of the nucleotide sequences of LOC51094 BINDING SITE, designated SEQ ID:18088, to the nucleotide sequence of VGAM1142 RNA, herein designated VGAM RNA, also designated SEQ ID:3853.

Another function of VGAM1142 is therefore inhibition of LOC51094 (Accession NM_015999). Accordingly, utilities of VGAM1142 include diagnosis, prevention and treatment of diseases and clinical conditions associated with LOC51094. FIG. 1 further provides a conceptual description of a novel bioinformatically detected viral gene of the present invention, referred to here as Viral Genomic Address Messenger 1143 (VGAM1143) viral gene, which modulates expression of respective host target genes thereof, the function and utility of which host target genes is known in the art.

VGAM1143 is a novel bioinformatically detected regulatory, non protein coding, viral micro RNA (miRNA) gene. The method by which VGAM1143 was detected is described hereinabove with reference to FIGS. 1-8.

VGAM1143 gene, herein designated VGAM GENE, is a viral gene contained in the genome of Bamboo Mosaic Virus. VGAM1143 host target gene, herein designated VGAM HOST TARGET GENE, is a human gene contained in the human genome.

VGAM1143 gene encodes a VGAM1143 precursor RNA, herein designated VGAM PRECURSOR RNA. Similar to other miRNA genes, and unlike most ordinary genes, VGAM1143 precursor RNA does not encode a protein. A nucleotide sequence identical or highly similar to the nucleotide sequence of VGAM1143 precursor RNA is designated SEQ ID:1129, and is provided hereinbelow with reference to the sequence listing part. Nucleotide sequence SEQ ID:1129 is located at position 1369 relative to the genome of Bamboo Mosaic Virus.

VGAM1143 precursor RNA folds onto itself, forming VGAM1143 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1143 folded precursor RNA into VGAM1143 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1143 RNA is designated SEQ ID:3854, and is provided hereinbelow with reference to the sequence listing part.

VGAM1143 host target gene, herein designated VGAM HOST TARGET GENE, encodes a corresponding messenger RNA, VGAM1143 host target RNA, herein designated VGAM HOST TARGET RNA. VGAM1143 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1143 RNA, herein designated VGAM RNA, binds complementarily to one or more host target binding sites located in untranslated regions of VGAM1143 host target RNA, herein designated VGAM HOST TARGET RNA. This complementary binding is due to the fact that the nucleotide sequence of VGAM1143 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1143 RNA, herein designated VGAM RNA, may have a different number of host target binding sites in untranslated regions of a VGAM1143 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1143 RNA, herein designated VGAM RNA, to host target binding sites on VGAM1143 host target RNA, herein designated VGAM HOST TARGET RNA, such as BINDING SITE I, BINDING SITE II and BINDING SITE III, inhibits translation of VGAM1143 host target RNA into VGAM1143 host target protein, herein designated VGAM HOST TARGET PROTEIN. VGAM host target protein is therefore outlined by a broken line.

It is appreciated that VGAM1143 host target gene, herein designated VGAM HOST TARGET GENE, in fact represents a plurality of VGAM1143 host target genes. The mRNA of each one of this plurality of VGAM1143 host target genes comprises one or more host target binding sites, each having a nucleotide sequence which is at least partly complementary to VGAM1143 RNA, herein designated VGAM RNA, and which when bound by VGAM1143 RNA causes inhibition of translation of respective one or more VGAM1143 host target proteins.

It is further appreciated by one skilled in the art that the mode of translational inhibition illustrated by FIG. 1 with specific reference to translational inhibition exerted by VGAM1143 gene, herein designated VGAM GENE, on one or more VGAM1143 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1143 is inhibition of expression of host target genes, as part of a novel viral mechanism of attacking a host. Accordingly, utilities of VGAM1143 include diagnosis, prevention and treatment of viral infection by Bamboo Mosaic Virus. Specific functions, and accordingly utilities, of VGAM1143 correlate with, and may be deduced from, the identity of the host target genes which VGAM1143 binds and inhibits, and the function of these host target genes, as elaborated hereinbelow.

Nucleotide sequences of the VGAM1143 precursor RNA, herein designated VGAM PRECURSOR RNA, and of the 'diced' VGAM1143 RNA, herein designated VGAM RNA, and a schematic representation of the secondary folding of VGAM1143 folded precursor RNA, herein designated VGAM FOLDED PRECURSOR RNA, of VGAM1143 are further described hereinbelow with reference to Table 1.

Nucleotide sequences of host target binding sites, such as BINDING SITE-I, BINDING SITE-II and BINDING SITE-III of FIG. 1, found on VGAM1143 host target RNA, and schematic representation of the complementarity of each of these host target binding sites to VGAM1143 RNA, herein designated VGAM RNA, are described hereinbelow with reference to Table 2.

As mentioned hereinabove with reference to FIG. 1, a function of VGAM1143 gene, herein designated VGAM is inhibition of expression of VGAM1143 target genes. It is appreciated that specific functions, and accordingly utilities, of VGAM1143 correlate with, and may be deduced from, the identity of the target genes which VGAM1143 binds and inhibits, and the function of these target genes, as elaborated hereinbelow.

Extracellular Matrix Protein 2, Female Organ and Adipocyte Specific (ECM2, Accession NM_001393) is a VGAM1143 host target gene. ECM2 BINDING SITE is HOST TARGET binding site found in the 3' untranslated region of mRNA encoded by ECM2, corresponding to a HOST TARGET binding site such as BINDING SITE I, BINDING SITE II or BINDING SITE III. Table 2 illustrates the complementarity of the nucleotide sequences of ECM2 BINDING SITE, designated SEQ ID:7085, to the nucleotide sequence of VGAM1143 RNA, herein designated VGAM RNA, also designated SEQ ID:3854.

A function of VGAM1143 is therefore inhibition of Extracellular Matrix Protein 2, Female Organ and Adipocyte Specific (ECM2, Accession NM_001393). Accordingly, utilities of VGAM1143 include diagnosis, prevention and treatment of diseases and clinical conditions associated with ECM2. G Protein-coupled Receptor, Family C, Group 5, Member B (GPRC5B, Accession NM_016235) is another VGAM1143 host target gene. GPRC5B BINDING SITE is HOST TARGET binding site found in the 3' untranslated region of mRNA encoded by GPRC5B, corresponding to a HOST TARGET binding site such as BINDING SITE I, BINDING SITE II or BINDING SITE III. Table 2 illustrates the complementarity of the nucleotide sequences of GPRC5B BINDING SITE, designated SEQ ID:18348, to the nucleotide sequence of VGAM1143 RNA, herein designated VGAM RNA, also designated SEQ ID:3854.

Another function of VGAM1143 is therefore inhibition of G Protein-coupled Receptor, Family C, Group 5, Member B (GPRC5B, Accession NM_016235), a gene which belongs to G protein-coupled receptor. Accordingly, utilities of VGAM1143 include diagnosis, prevention and treatment of diseases and clinical conditions associated with GPRC5B. The function of GPRC5B and its association with various diseases and clinical conditions, has been established by previous studies, as described hereinabove with reference to VGAM131. Leukocyte Immunoglobulin-like Receptor, Subfamily B (with TM and ITIM domains), Member 4 (LILRB4, Accession NM_006847) is another VGAM1143 host target gene. LILRB4 BINDING SITE is HOST TARGET binding site found in the 3' untranslated region of mRNA encoded by LILRB4, corresponding to a HOST TARGET binding site such as BINDING SITE I, BINDING SITE II or BINDING SITE III. Table 2 illustrates the complementarity of the nucleotide sequences of LILRB4 BINDING SITE, designated SEQ ID:13716, to the nucleotide sequence of VGAM1143 RNA, herein designated VGAM RNA, also designated SEQ ID:3854.

Another function of VGAM1143 is therefore inhibition of Leukocyte Immunoglobulin-like Receptor, Subfamily B (with TM and ITIM domains), Member 4 (LILRB4, Accession NM_006847). Accordingly, utilities of VGAM1143 include diagnosis, prevention and treatment of diseases and clinical conditions associated with LILRB4. KIAA1161 (Accession XM_088501) is another VGAM1143 host target gene. KIAA1161 BINDING SITE is HOST TARGET binding site found in the 5' untranslated region of mRNA encoded by KIAA1161, corresponding to a HOST TARGET binding site such as BINDING SITE I, BINDING SITE II or BINDING SITE III. Table 2 illustrates the complementarity of the nucleotide sequences of KIAA1161 BINDING SITE, designated SEQ ID:39749, to the nucleotide sequence of VGAM1143 RNA, herein designated VGAM RNA, also designated SEQ ID:3854.

Another function of VGAM1143 is therefore inhibition of KIAA1161 (Accession XM_088501). Accordingly, utilities of VGAM1143 include diagnosis, prevention and treatment of diseases and clinical conditions associated with KIAA1161. FIG. 1 further provides a conceptual description of a novel bioinformatically detected viral gene of the present invention, referred to here as Viral Genomic Address Messenger 1144 (VGAM1144) viral gene, which modulates expression of respective host target genes thereof, the function and utility of which host target genes is known in the art.

VGAM1144 is a novel bioinformatically detected regulatory, non protein coding, viral micro RNA (miRNA) gene. The method by which VGAM1144 was detected is described hereinabove with reference to FIGS. 1-8.

VGAM1144 gene, herein designated VGAM GENE, is a viral gene contained in the genome of Bamboo Mosaic Virus. VGAM1144 host target gene, herein designated VGAM HOST TARGET GENE, is a human gene contained in the human genome.

VGAM1144 gene encodes a VGAM1144 precursor RNA, herein designated VGAM PRECURSOR RNA. Similar to other miRNA genes, and unlike most ordinary genes, VGAM1144 precursor RNA does not encode a protein. A nucleotide sequence identical or highly similar to the nucleotide sequence of VGAM1144 precursor RNA is designated SEQ ID:1130, and is provided hereinbelow with reference to the sequence listing part. Nucleotide sequence SEQ ID:1130 is located at position 502 relative to the genome of Bamboo Mosaic Virus.

VGAM1144 precursor RNA folds onto itself, forming VGAM1144 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1144 folded precursor RNA into VGAM1144 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1144 RNA is designated SEQ ID:3855, and is provided hereinbelow with reference to the sequence listing part.

VGAM1144 host target gene, herein designated VGAM HOST TARGET GENE, encodes a corresponding messenger RNA, VGAM1144 host target RNA, herein designated VGAM HOST TARGET RNA. VGAM1144 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1144 RNA, herein designated VGAM RNA, binds complementarily to one or more host target binding sites located in untranslated regions of VGAM1144 host target RNA, herein designated VGAM HOST TARGET RNA. This complementary binding is due to the fact that the nucleotide sequence of VGAM1144 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1144 RNA, herein designated VGAM RNA, may have a different number of host target binding sites in untranslated regions of a VGAM1144 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1144 RNA, herein designated VGAM RNA, to host target binding sites on VGAM1144 host target RNA, herein designated VGAM HOST TARGET RNA, such as BINDING SITE I, BINDING SITE II and BINDING SITE III, inhibits translation of VGAM1144 host target RNA into VGAM1144 host target protein, herein designated VGAM HOST TARGET PROTEIN. VGAM host target protein is therefore outlined by a broken line.

It is appreciated that VGAM1144 host target gene, herein designated VGAM HOST TARGET GENE, in fact represents a plurality of VGAM1144 host target genes. The mRNA of each one of this plurality of VGAM1144 host target genes comprises one or more host target binding sites, each having a nucleotide sequence which is at least partly complementary to VGAM1144 RNA, herein designated VGAM RNA, and which when bound by VGAM1144 RNA causes inhibition of translation of respective one or more VGAM1144 host target proteins.

It is further appreciated by one skilled in the art that the mode of translational inhibition illustrated by FIG. 1 with specific reference to translational inhibition exerted by VGAM1144 gene, herein designated VGAM GENE, on one or more VGAM1144 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1144 is inhibition of expression of host target genes, as part of a novel viral mechanism of attacking a host. Accordingly, utilities of VGAM1144 include diagnosis, prevention and treatment of viral infection by Bamboo Mosaic Virus. Specific functions, and accordingly utilities, of VGAM1144 correlate with, and may be deduced from, the identity of the host target genes which VGAM1144 binds and inhibits, and the function of these host target genes, as elaborated hereinbelow.

Nucleotide sequences of the VGAM1144 precursor RNA, herein designated VGAM PRECURSOR RNA, and of the 'diced' VGAM1144 RNA, herein designated VGAM RNA, and a schematic representation of the secondary folding of VGAM1144 folded precursor RNA, herein designated VGAM FOLDED PRECURSOR RNA, of VGAM1144 are further described hereinbelow with reference to Table 1.

Nucleotide sequences of host target binding sites, such as BINDING SITE-I, BINDING SITE-II and BINDING SITE-III of FIG. 1, found on VGAM1144 host target RNA, and schematic representation of the complementarity of each of these host target binding sites to VGAM1144 RNA, herein designated VGAM RNA, are described hereinbelow with reference to Table 2.

As mentioned hereinabove with reference to FIG. 1, a function of VGAM1144 gene, herein designated VGAM is inhibition of expression of VGAM1144 target genes. It is appreciated that specific functions, and accordingly utilities, of VGAM1144 correlate with, and may be deduced from, the identity of the target genes which VGAM1144 binds and inhibits, and the function of these target genes, as elaborated hereinbelow.

Cyclin F (CCNF, Accession NM_001761) is a VGAM1144 host target gene. CCNF BINDING SITE is HOST TARGET binding site found in the 3' untranslated region of mRNA encoded by CCNF, corresponding to a HOST TARGET binding site such as BINDING SITE I, BINDING SITE II or BINDING SITE III. Table 2 illustrates the complementarity of the nucleotide sequences of CCNF BINDING SITE, designated SEQ ID:7522, to the nucleotide sequence of VGAM1144 RNA, herein designated VGAM RNA, also designated SEQ ID:3855.

A function of VGAM1144 is therefore inhibition of Cyclin F (CCNF, Accession NM_001761), a gene which likely to be involved in the control of the cell cycle during s phase and g2. Accordingly, utilities of VGAM1144 include diagnosis, prevention and treatment of diseases and clinical conditions associated with CCNF. The function of CCNF and its association with various diseases and clinical conditions, has been established by previous studies, as described hereinabove with reference to VGAM367. TAF7-like RNA Polymerase II, TATA Box Binding Protein (TBP)-associated Factor, 50 kDa (TAF7L, Accession NM_024885) is another VGAM1144 host target gene. TAF7L BINDING SITE is HOST TARGET binding site found in the 3' untranslated region of mRNA encoded by TAF7L, corresponding to a HOST TARGET binding site such as BINDING SITE I, BINDING SITE II or BINDING SITE III. Table 2 illustrates the complementarity of the nucleotide sequences of TAF7L BINDING SITE, designated SEQ ID:24339, to the nucleotide sequence of VGAM1144 RNA, herein designated VGAM RNA, also designated SEQ ID:3855.

Another function of VGAM1144 is therefore inhibition of TAF7-like RNA Polymerase II, TATA Box Binding Protein (TBP)-associated Factor, 50 kDa (TAF7L, Accession NM_024885). Accordingly, utilities of VGAM1144 include diagnosis, prevention and treatment of diseases and clinical conditions associated with TAF7L. Fer-1-like 4 (C. elegans) (FER1L4, Accession NM_025206) is another VGAM1144 host target gene. FER1L4 BINDING SITE is HOST TARGET binding site found in the 3' untranslated region of mRNA encoded by FER1L4, corresponding to a HOST TARGET binding site such as BINDING SITE I, BINDING SITE II or BINDING SITE III. Table 2 illustrates the complementarity of the nucleotide sequences of FER1L4 BINDING SITE, designated SEQ ID:24871, to the nucleotide sequence of VGAM1144 RNA, herein designated VGAM RNA, also designated SEQ ID:3855.

Another function of VGAM1144 is therefore inhibition of Fer-1-like 4 (C. elegans) (FER1L4, Accession NM_025206). Accordingly, utilities of VGAM1144 include diagnosis, prevention and treatment of diseases and clinical conditions associated with FER1L4. KIAA0040 (Accession NM_014656) is another VGAM1144 host target gene. KIAA0040 BINDING SITE is HOST TARGET binding site found in the 3' untranslated region of mRNA encoded by KIAA0040, corresponding to a HOST TARGET binding site such as BINDING SITE I, BINDING SITE II or BINDING SITE III. Table 2 illustrates the complementarity of the nucleotide sequences of KIAA0040 BINDING SITE, designated SEQ ID:16094, to the nucleotide sequence of VGAM1144 RNA, herein designated VGAM RNA, also designated SEQ ID:3855.

Another function of VGAM1144 is therefore inhibition of KIAA0040 (Accession NM_014656). Accordingly, utilities of VGAM1144 include diagnosis, prevention and treatment of diseases and clinical conditions associated with KIAA0040. LHX6 (Accession NM_014368) is another VGAM1144 host target gene. LHX6 BINDING SITE is HOST TARGET binding site found in the 3' untranslated region of mRNA encoded by LHX6, corresponding to a HOST TARGET binding site such as BINDING SITE I, BINDING SITE II or BINDING SITE III. Table 2 illustrates the complementarity of the nucleotide sequences of LHX6 BINDING SITE, designated SEQ ID:15697, to the nucleotide sequence of VGAM1144 RNA, herein designated VGAM RNA, also designated SEQ ID:3855.

Another function of VGAM1144 is therefore inhibition of LHX6 (Accession NM_014368). Accordingly, utilities of VGAM1144 include diagnosis, prevention and treatment of diseases and clinical conditions associated with LHX6. LOC160414 (Accession XM_100898) is another VGAM1144 host target gene. LOC160414 BINDING SITE is HOST TARGET binding site found in the 3' untranslated region of mRNA encoded by LOC160414, corresponding to a HOST TARGET binding site such as BINDING SITE I, BINDING SITE II or BINDING SITE III. Table 2 illustrates the complementarity of the nucleotide sequences of LOC160414 BINDING SITE, designated SEQ ID:42106, to the nucleotide sequence of VGAM1144 RNA, herein designated VGAM RNA, also designated SEQ ID:3855.

Another function of VGAM1144 is therefore inhibition of LOC160414 (Accession XM_100898). Accordingly, utilities of VGAM1144 include diagnosis, prevention and treatment of diseases and clinical conditions associated with LOC160414. LOC51716 (Accession NM_016280) is another VGAM1144 host target gene. LOC51716 BINDING SITE is HOST TARGET binding site found in the 3' untranslated region of mRNA encoded by LOC51716, corresponding to a HOST TARGET binding site such as BINDING SITE I, BINDING SITE II or BINDING SITE III. Table 2 illustrates the complementarity of the nucleotide sequences of LOC51716 BINDING SITE, designated SEQ ID:18403, to the nucleotide sequence of VGAM1144 RNA, herein designated VGAM RNA, also designated SEQ ID:3855.

Another function of VGAM1144 is therefore inhibition of LOC51716 (Accession NM_016280). Accordingly, utilities of VGAM1144 include diagnosis, prevention and treatment of diseases and clinical conditions associated with LOC51716. FIG. 1 further provides a conceptual description of a novel bioinformatically detected viral gene of the present invention, referred to here as Viral Genomic Address Messenger 1145 (VGAM1145) viral gene, which modulates expression of respective host target genes thereof, the function and utility of which host target genes is known in the art.

VGAM1145 is a novel bioinformatically detected regulatory, non protein coding, viral micro RNA (miRNA) gene. The method by which VGAM1145 was detected is described hereinabove with reference to FIGS. 1-8.

VGAM1145 gene, herein designated VGAM GENE, is a viral gene contained in the genome of Bamboo Mosaic Virus. VGAM1145 host target gene, herein designated VGAM HOST TARGET GENE, is a human gene contained in the human genome.

VGAM1145 gene encodes a VGAM1145 precursor RNA, herein designated VGAM PRECURSOR RNA. Similar to other miRNA genes, and unlike most ordinary genes, VGAM1145 precursor RNA does not encode a protein. A nucleotide sequence identical or highly similar to the nucleotide sequence of VGAM1145 precursor RNA is designated SEQ ID:1131, and is provided hereinbelow with reference to the sequence listing part. Nucleotide sequence SEQ ID:1131 is located at position 5368 relative to the genome of Bamboo Mosaic Virus.

VGAM1145 precursor RNA folds onto itself, forming VGAM1145 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1145 folded precursor RNA into VGAM1145 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1145 RNA is designated SEQ ID:3856, and is provided hereinbelow with reference to the sequence listing part.

VGAM1145 host target gene, herein designated VGAM HOST TARGET GENE, encodes a corresponding messenger RNA, VGAM1145 host target RNA, herein designated VGAM HOST TARGET RNA. VGAM1145 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1145 RNA, herein designated VGAM RNA, binds complementarily to one or more host target binding sites located in untranslated regions of VGAM1145 host target RNA, herein designated VGAM HOST TARGET RNA. This complementary binding is due to the fact that the nucleotide sequence of VGAM1145 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1145 RNA, herein designated VGAM RNA, may have a different number of host target binding sites in untranslated regions of a VGAM1145 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1145 RNA, herein designated VGAM RNA, to host target binding sites on VGAM1145 host target RNA, herein designated VGAM HOST TARGET RNA, such as BINDING SITE I, BINDING SITE II and BINDING SITE III, inhibits translation of VGAM1145 host target RNA into VGAM1145 host target protein, herein designated VGAM HOST TARGET PROTEIN. VGAM host target protein is therefore outlined by a broken line.

It is appreciated that VGAM1145 host target gene, herein designated VGAM HOST TARGET GENE, in fact represents a plurality of VGAM1145 host target genes. The mRNA of each one of this plurality of VGAM1145 host target genes comprises one or more host target binding sites, each having a nucleotide sequence which is at least partly complementary to VGAM1145 RNA, herein designated VGAM RNA, and which when bound by VGAM1145 RNA causes inhibition of translation of respective one or more VGAM1145 host target proteins.

It is further appreciated by one skilled in the art that the mode of translational inhibition illustrated by FIG. 1 with specific reference to translational inhibition exerted by VGAM1145 gene, herein designated VGAM GENE, on one or more VGAM1145 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1145 is inhibition of expression of host target genes, as part of a novel viral mechanism of attacking a host. Accordingly, utilities of VGAM1145 include diagnosis, prevention and treatment of viral infection by Bamboo Mosaic Virus. Specific functions, and accordingly utilities, of VGAM1145 correlate with, and may be deduced from, the identity of the host target genes which VGAM1145 binds and inhibits, and the function of these host target genes, as elaborated hereinbelow.

Nucleotide sequences of the VGAM1145 precursor RNA, herein designated VGAM PRECURSOR RNA, and of the 'diced' VGAM1145 RNA, herein designated VGAM RNA, and a schematic representation of the secondary folding of VGAM1145 folded precursor RNA, herein designated VGAM FOLDED PRECURSOR RNA, of VGAM1145 are further described hereinbelow with reference to Table 1.

Nucleotide sequences of host target binding sites, such as BINDING SITE-I, BINDING SITE-II and BINDING SITE-III of FIG. 1, found on VGAM1145 host target RNA, and schematic representation of the complementarity of each of these host target binding sites to VGAM1145 RNA, herein designated VGAM RNA, are described hereinbelow with reference to Table 2.

As mentioned hereinabove with reference to FIG. 1, a function of VGAM1145 gene, herein designated VGAM is inhibition of expression of VGAM1145 target genes. It is appreciated that specific functions, and accordingly utilities, of VGAM1145 correlate with, and may be deduced from, the identity of the target genes which VGAM1145 binds and inhibits, and the function of these target genes, as elaborated hereinbelow.

UDP-GlcNAc:betaGal Beta-1,3-N-acetylglucosaminyltransferase 7 (B3GNT7, Accession XM_048735) is a VGAM1145 host target gene. B3GNT7 BINDING SITE is HOST TARGET binding site found in the 3' untranslated region of mRNA encoded by B3GNT7, corresponding to a HOST TARGET binding site such as BINDING SITE I, BINDING SITE II or BINDING SITE III. Table 2 illustrates the complementarity of the nucleotide sequences of B3GNT7 BINDING SITE, designated SEQ ID:35238, to the nucleotide sequence of VGAM1145 RNA, herein designated VGAM RNA, also designated SEQ ID:3856.

A function of VGAM1145 is therefore inhibition of UDP-GlcNAc:betaGal Beta-1,3-N-acetylglucosaminyltransferase 7 (B3GNT7, Accession XM_048735). Accordingly, utilities of VGAM1145 include diagnosis, prevention and treatment of diseases and clinical conditions associated with B3GNT7. Carbohydrate (N-acetylglucosamine 6-O) Sulfotransferase 4 (CHST4, Accession NM_005769) is another VGAM1145 host target gene. CHST4 BINDING SITE is HOST TARGET binding site found in the 3' untranslated region of mRNA encoded by CHST4, corresponding to a HOST TARGET binding site such as BINDING SITE I, BINDING SITE II or BINDING SITE III. Table 2 illustrates the complementarity of the nucleotide sequences of CHST4 BINDING SITE, designated SEQ ID:12338, to the nucleotide sequence of VGAM1145 RNA, herein designated VGAM RNA, also designated SEQ ID:3856.

Another function of VGAM1145 is therefore inhibition of Carbohydrate (N-acetylglucosamine 6-O) Sulfotransferase 4 (CHST4, Accession NM_005769). Accordingly, utilities of VGAM1145 include diagnosis, prevention and treatment of diseases and clinical conditions associated with CHST4. Chloride Intracellular Channel 4 (CLIC4, Accession NM_013943) is another VGAM1145 host target gene. CLIC4 BINDING SITE is HOST TARGET binding site found in the 3' untranslated region of mRNA encoded by CLIC4, corresponding to a HOST TARGET binding site such as BINDING SITE I, BINDING SITE II or BINDING SITE III. Table 2 illustrates the complementarity of the nucleotide sequences of CLIC4 BINDING SITE, designated SEQ ID:15128, to the nucleotide sequence of VGAM1145 RNA, herein designated VGAM RNA, also designated SEQ ID:3856.

Another function of VGAM1145 is therefore inhibition of Chloride Intracellular Channel 4 (CLIC4, Accession NM_013943). Accordingly, utilities of VGAM1145 include diagnosis, prevention and treatment of diseases and clinical conditions associated with CLIC4. FLJ11274 (Accession NM_018375) is another VGAM1145 host target gene. FLJ11274 BINDING SITE is HOST TARGET binding site found in the 3' untranslated region of mRNA encoded by FLJ11274, corresponding to a HOST TARGET binding site such as BINDING SITE I, BINDING SITE II or BINDING SITE III. Table 2 illustrates the complementarity of the nucleotide sequences of FLJ11274 BINDING SITE, designated SEQ ID:20398, to the nucleotide sequence of VGAM1145 RNA, herein designated VGAM RNA, also designated SEQ ID:3856.

Another function of VGAM1145 is therefore inhibition of FLJ11274 (Accession NM_018375). Accordingly, utilities of VGAM1145 include diagnosis, prevention and treatment of diseases and clinical conditions associated with FLJ11274. FLJ12903 (Accession NM_022753) is another VGAM1145 host target gene. FLJ12903 BINDING SITE is HOST TARGET binding site found in the 3' untranslated region of mRNA encoded by FLJ12903, corresponding to a HOST TARGET binding site such as BINDING SITE I, BINDING SITE II or BINDING SITE III. Table 2 illustrates the complementarity of the nucleotide sequences of FLJ12903 BINDING SITE, designated SEQ ID:22976, to the nucleotide sequence of VGAM1145 RNA, herein designated VGAM RNA, also designated SEQ ID:3856.

Another function of VGAM1145 is therefore inhibition of FLJ12903 (Accession NM_022753). Accordingly, utilities of VGAM1145 include diagnosis, prevention and treatment of diseases and clinical conditions associated with FLJ12903. FIG. 1 further provides a conceptual description of a novel bioinformatically detected viral gene of the present invention, referred to here as Viral Genomic Address Messenger 1146 (VGAM1146) viral gene, which modulates expression of respective host target genes thereof, the function and utility of which host target genes is known in the art.

VGAM1146 is a novel bioinformatically detected regulatory, non protein coding, viral micro RNA (miRNA) gene. The method by which VGAM1146 was detected is described hereinabove with reference to FIGS. 1-8.

VGAM1146 gene, herein designated VGAM GENE, is a viral gene contained in the genome of Fowlpox Virus. VGAM1146 host target gene, herein designated VGAM HOST TARGET GENE, is a human gene contained in the human genome.

VGAM1146 gene encodes a VGAM1146 precursor RNA, herein designated VGAM PRECURSOR RNA. Similar to other miRNA genes, and unlike most ordinary genes, VGAM1146 precursor RNA does not encode a protein. A nucleotide sequence identical or highly similar to the nucleotide sequence of VGAM1146 precursor RNA is designated SEQ ID:1132, and is provided hereinbelow with reference to the sequence listing part. Nucleotide sequence SEQ ID:1132 is located at position 218150 relative to the genome of Fowlpox Virus.

VGAM1146 precursor RNA folds onto itself, forming VGAM1146 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1146 folded precursor RNA into VGAM1146 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1146 RNA is designated SEQ ID:3857, and is provided hereinbelow with reference to the sequence listing part.

VGAM1146 host target gene, herein designated VGAM HOST TARGET GENE, encodes a corresponding messenger RNA, VGAM1146 host target RNA, herein designated VGAM HOST TARGET RNA. VGAM1146 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1146 RNA, herein designated VGAM RNA, binds complementarily to one or more host target binding sites located in untranslated regions of VGAM1146 host target RNA, herein designated VGAM HOST TARGET RNA. This complementary binding is due to the fact that the nucleotide sequence of VGAM1146 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1146 RNA, herein designated VGAM RNA, may have a different number of host target binding sites in untranslated regions of a VGAM1146 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1146 RNA, herein designated VGAM RNA, to host target binding sites on VGAM1146 host target RNA, herein designated VGAM HOST TARGET RNA, such as BINDING SITE I, BINDING SITE II and BINDING SITE III, inhibits translation of VGAM1146 host target RNA into VGAM1146 host target protein, herein designated VGAM HOST TARGET PROTEIN. VGAM host target protein is therefore outlined by a broken line.

It is appreciated that VGAM1146 host target gene, herein designated VGAM HOST TARGET GENE, in fact represents a plurality of VGAM1146 host target genes. The mRNA of each one of this plurality of VGAM1146 host target genes comprises one or more host target binding sites, each having a nucleotide sequence which is at least partly complementary to VGAM1146 RNA, herein designated VGAM RNA, and which when bound by VGAM1146 RNA causes inhibition of translation of respective one or more VGAM1146 host target proteins.

It is further appreciated by one skilled in the art that the mode of translational inhibition illustrated by FIG. 1 with specific reference to translational inhibition exerted by VGAM1146 gene, herein designated VGAM GENE, on one or more VGAM1146 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1146 is inhibition of expression of host target genes, as part of a novel viral mechanism of attacking a host. Accordingly, utilities of VGAM1146 include diagnosis, prevention and treatment of viral infection by Fowlpox Virus. Specific functions, and accordingly utilities, of VGAM1146 correlate with, and may be deduced from, the identity of the host target genes which VGAM1146 binds and inhibits, and the function of these host target genes, as elaborated hereinbelow.

Nucleotide sequences of the VGAM1146 precursor RNA, herein designated VGAM PRECURSOR RNA, and of the 'diced' VGAM1146 RNA, herein designated VGAM RNA, and a schematic representation of the secondary folding of VGAM1146 folded precursor RNA, herein designated VGAM FOLDED PRECURSOR RNA, of VGAM1146 are further described hereinbelow with reference to Table 1.

Nucleotide sequences of host target binding sites, such as BINDING SITE-I, BINDING SITE-II and BINDING SITE-III of FIG. 1, found on VGAM1146 host target RNA, and schematic representation of the complementarity of each of these host target binding sites to VGAM1146 RNA, herein designated VGAM RNA, are described hereinbelow with reference to Table 2.

As mentioned hereinabove with reference to FIG. 1, a function of VGAM1146 gene, herein designated VGAM is inhibition of expression of VGAM1146 target genes. It is appreciated that specific functions, and accordingly utilities, of VGAM1146 correlate with, and may be deduced from, the identity of the target genes which VGAM1146 binds and inhibits, and the function of these target genes, as elaborated hereinbelow.

ACT (Accession NM_020482) is a VGAM1146 host target gene. ACT BINDING SITE is HOST TARGET binding site found in the 3' untranslated region of mRNA encoded by ACT, corresponding to a HOST TARGET binding site such as BINDING SITE I, BINDING SITE II or BINDING SITE III. Table 2 illustrates the complementarity of the nucleotide sequences of ACT BINDING SITE, designated SEQ ID:21735, to the nucleotide sequence of VGAM1146 RNA, herein designated VGAM RNA, also designated SEQ ID:3857.

A function of VGAM1146 is therefore inhibition of ACT (Accession NM_020482), a gene which a plasma protease inhibitor synthesized in the liver. Accordingly, utilities of VGAM1146 include diagnosis, prevention and treatment of diseases and clinical conditions associated with ACT. The function of ACT has been established by previous studies. Alpha-1-antichymotrypsin is a plasma protease inhibitor synthesized in the liver. It is a single glycopeptide chain of about 68,000 daltons and belongs to the class of serine protease inhibitors. In man, the normal serum level is about one-tenth that of alpha-1-antitrypsin (PI; 107400), with which it shares nucleic acid and protein sequence homology (Chandra et al., 1983). Both are major acute phase reactants; their concentrations in plasma increase in response to trauma, surgery, and infection. Antithrombin III, which also is structurally similar to alpha-1-antitrypsin, shows less sequence homology to antichymotrypsin and is not an acute phase reactant. Sefton et al. (1990) concluded that the PI-PIL gene cluster is only 220 kb away from the AACT gene and that it is oriented in the opposite direction. (PIL refers to 'PI-like' and is also referred to as 'antitrypsin-related,' or ATR (OMIM Ref. No. 107410).) The comparatively short interval between the genes came as a surprise given previous estimates of the level of genetic recombination between them. By PCR-single strand conformation polymorphism (SSCP) analysis, Tsuda et al. (1992) identified a point mutation in exon 5 of the AACT gene resulting in substitution of met by val at codon 389. The mutation, an A-to-G transition at basepair 1252, was found in heterozygous state in 6 patients; 4 of the 6 (aged 38, 43, 69, and 80 years) had occlusive cerebrovascular disease.

Full details of the abovementioned studies are described in the following publications, the disclosure of which are hereby incorporated by reference:

Chandra, T.; Stackhouse, R.; Kidd, V. J.; Robson, K. J. H.; Woo, S. L. C.: Sequence homology between human alpha-1-antichymotrypsin, alpha-1-antitrypsin, and antithrombin III. Biochemistry 22:5055-5061, 1983; and Tsuda, M.; Sei, Y.; Yamamura, M.; Yamamoto, M.; Shinohara, Y.: Detection of a new mutant alpha-1-antichymotrypsin in patients with occlusive-cerebrovascular disease. FEBS Lett. 304:66.

Further studies establishing the function and utilities of ACT are found in John Hopkins OMIM database record ID 107280, and in sited publications numbered 12428-12442, 78 and 833-839 listed in the bibliography section hereinbelow, which are also hereby incorporated by reference. Breast Cancer 1, Early Onset (BRCA1, Accession NM_007294) is another VGAM1146 host target gene. BRCA1 BINDING SITE1 through BRCA1 BINDING SITE10 are HOST TARGET binding sites found in untranslated regions of mRNA encoded by BRCA1, corresponding to HOST TARGET binding sites such as BINDING SITE I, BINDING SITE II or BINDING SITE III. Table 2 illustrates the complementarity of the nucleotide sequences of BRCA1 BINDING SITE1 through BRCA1 BINDING SITE10, designated SEQ ID:14161, SEQ ID:14167, SEQ ID:14173, SEQ ID:14179, SEQ ID:14186, SEQ ID:14192, SEQ ID:14198, SEQ ID:14206, SEQ ID:14212 and SEQ ID:14218 respectively, to the nucleotide sequence of VGAM1146 RNA, herein designated VGAM RNA, also designated SEQ ID:3857.

Another function of VGAM1146 is therefore inhibition of Breast Cancer 1, Early Onset (BRCA1, Accession NM_007294). Accordingly, utilities of VGAM1146 include diagnosis, prevention and treatment of diseases and clinical conditions associated with BRCA1. Caspase 2, Apoptosis-related Cysteine Protease (neural precursor cell expressed, developmentally down-regulated 2) (CASP2, Accession NM_032983) is another VGAM1146 host target gene. CASP2 BINDING SITE1 through CASP2 BINDING SITE4 are HOST TARGET binding sites found in untranslated regions of mRNA encoded by CASP2, corresponding to HOST TARGET binding sites such as BINDING SITE I, BINDING SITE II or BINDING SITE III. Table 2 illustrates the complementarity of the nucleotide sequences of CASP2 BINDING SITE1 through CASP2 BINDING SITE4, designated SEQ ID:26857, SEQ ID:26862, SEQ ID:6889 and SEQ ID:6998 respectively, to the nucleotide sequence of VGAM1146 RNA, herein designated VGAM RNA, also designated SEQ ID:3857.

Another function of VGAM1146 is therefore inhibition of Caspase 2, Apoptosis-related Cysteine Protease (neural precursor cell expressed, developmentally down-regulated 2) (CASP2, Accession NM_032983), a gene which involves in the activation cascade of caspases responsible for apoptosis execution. Accordingly, utilities of VGAM1146 include diagnosis, prevention and treatment of diseases and clinical conditions associated with CASP2. The function of CASP2 and its association with various diseases and clinical conditions, has been established by previous studies, as described hereinabove with reference to VGAM148. Homeo Box A7 (HOXA7, Accession NM_006896) is another VGAM1146 host target gene. HOXA7 BINDING SITE is HOST TARGET binding site found in the 3' untranslated region of mRNA encoded by HOXA7, corresponding to a HOST TARGET binding site such as BINDING SITE I, BINDING SITE II or BINDING SITE III. Table 2 illustrates the complementarity of the nucleotide sequences of HOXA7 BINDING SITE, designated SEQ ID:13770, to the nucleotide sequence of VGAM1146 RNA, herein designated VGAM RNA, also designated SEQ ID:3857.

Another function of VGAM1146 is therefore inhibition of Homeo Box A7 (HOXA7, Accession NM_006896), a gene which provides cells with specific positional identities on the anterior-posterior axis. Accordingly, utilities of VGAM1146 include diagnosis, prevention and treatment of diseases and clinical conditions associated with HOXA7. The function of HOXA7 and its association with various diseases and clinical conditions, has been established by previous studies, as described hereinabove with reference to VGAM206. Interleukin 12B (natural killer cell stimulatory factor 2, cytotoxic lymphocyte maturation factor 2, p40) (IL12B, Accession NM_002187) is another VGAM1146 host target gene. IL12B BINDING SITE is HOST TARGET binding site found in the 3' untranslated region of mRNA encoded by IL12B, corresponding to a HOST TARGET binding site such as BINDING SITE I, BINDING SITE II or BINDING SITE III. Table 2 illustrates the complementarity of the nucleotide sequences of IL12B BINDING SITE, designated SEQ ID:7942, to the nucleotide sequence of VGAM1146 RNA, herein designated VGAM RNA, also designated SEQ ID:3857.

Another function of VGAM1146 is therefore inhibition of Interleukin 12B (natural killer cell stimulatory factor 2, cytotoxic lymphocyte maturation factor 2, p40) (IL12B, Accession NM_002187). Accordingly, utilities of VGAM1146 include diagnosis, prevention and treatment of diseases and clinical conditions associated with IL12B. Myeloid/lymphoid Or Mixed-lineage Leukemia (trithorax homolog, Drosophila); Translocated To, 3 (MLLT3, Accession NM_004529) is another VGAM1146 host target gene. MLLT3 BINDING SITE is HOST TARGET binding site found in the 3' untranslated region of mRNA encoded by MLLT3, corresponding to a HOST TARGET binding site such as BINDING SITE I, BINDING SITE II or BINDING SITE III. Table 2 illustrates the complementarity of the nucleotide sequences of MLLT3 BINDING SITE, designated SEQ ID:10871, to the nucleotide sequence of VGAM1146 RNA, herein designated VGAM RNA, also designated SEQ ID:3857.

Another function of VGAM1146 is therefore inhibition of Myeloid/lymphoid Or Mixed-lineage Leukemia (trithorax homolog, Drosophila); Translocated To, 3 (MLLT3, Accession NM_004529), a gene which is Serine and proline rich protein. Accordingly, utilities of VGAM1146 include diagnosis, prevention and treatment of diseases and clinical conditions associated with MLLT3. The function of MLLT3 and its association with various diseases and clinical conditions, has been established by previous studies, as described hereinabove with reference to VGAM67. Nephroblastoma Overexpressed Gene (NOV, Accession NM_002514) is another VGAM1146 host target gene. NOV BINDING SITE is HOST TARGET binding site found in the 3' untranslated region of mRNA encoded by NOV, corresponding to a HOST TARGET binding site such as BINDING SITE I, BINDING SITE II or BINDING SITE III. Table 2 illustrates the complementarity of the nucleotide sequences of NOV BINDING SITE, designated SEQ ID:8346, to the nucleotide sequence of VGAM1146 RNA, herein designated VGAM RNA, also designated SEQ ID:3857.

Another function of VGAM1146 is therefore inhibition of Nephroblastoma Overexpressed Gene (NOV, Accession NM_002514), a gene which is likely to play a role in cell growth regulation. Accordingly, utilities of VGAM1146 include diagnosis, prevention and treatment of diseases and clinical conditions associated with NOV. The function of NOV has been established by previous studies. The avian nephroblastoma induced by myeloblastosis-associated virus (MAV) is a good model of Wilms tumor because of histologic similarities. Soret et al. (1989) and Joliot et al. (1992) identified in MAV-1-induced avian nephroblastoma a new proto-oncogene they called nov for nephroblastoma overexpressed gene. Martinerie and Perbal (1991) found that human sequences homologous to nov were expressed in normal hematopoietic cells and in 1 nephroblastoma. By a combination of study of somatic cell hybrids and in situ hybridization, Martinerie et al. (1992) showed that the human homolog maps to 8q24.1, proximal to MYC (OMIM Ref. No. 190080). Snaith et al. (1996) stated that the NOV gene encodes a cysteine-rich protein that is overexpressed in avian nephroblastomas. It is a member of the CCN family of proteins that includes connective tissue growth factor (OMIM Ref. No. 121009). These proteins are encoded by a group of genes known as immediate-early genes, so named because they are expressed after induction by growth factors or certain oncogenes. The proteins share several common structural motifs: a consensus sequence present in IGF (insulin-like growth factor)-binding proteins (the IGFBP motif), an oligomeric complex-forming domain first identified in von Willebrand factor (VWF; 193400), a binding domain to soluble and matrix molecules, and a dimerization (CT) domain (Bork, 1993). All CCN family members are thought to be involved in the control of cell proliferation. Snaith et al. (1996) isolated and characterized genomic and cDNA clones encompassing the mouse nov gene. It is highly conserved with the human and chick nov genes at the level of nucleotide sequence and genomic organization. The exon structure reflected the modular organization of NOV protein in a number of structural domains. These are highly conserved with other members of the CCN family, as is the distribution of 38 of its 40 cysteine residues. Snaith et al. (1996) mapped the nov gene to mouse chromosome 15 in a region of conserved synteny with human chromosome 8.

Full details of the abovementioned studies are described in the following publications, the disclosure of which are hereby incorporated by reference:

Martinerie, C.; Perbal, B.: Expression of a gene encoding a novel potential IGF binding protein in human tissues. C. R. Acad. Sci. (Paris) 313 (ser. 3):345-351, 1991; and Snaith, M. R.; Natarajan, D.; Taylor, L. B.; Choi, C.-P.; Martinerie, C.; Perbal, B.; Schofield, P. N.; Boulter, C. A.: Genomic structure and chromosomal mapping of the mouse nov gene.

Further studies establishing the function and utilities of NOV are found in John Hopkins OMIM database record ID 164958, and in sited publications numbered 10803, 10805-1080 and 11959-10809 listed in the bibliography section hereinbelow, which are also hereby incorporated by reference. Profilin 2 (PFN2, Accession NM_053024) is another VGAM1146 host target gene. PFN2 BINDING SITE is HOST TARGET binding site found in the 3' untranslated region of mRNA encoded by PFN2, corresponding to a HOST TARGET binding site such as BINDING SITE I, BINDING SITE II or BINDING SITE III. Table 2 illustrates the complementarity of the nucleotide sequences of PFN2 BINDING SITE, designated SEQ ID:27582, to the nucleotide sequence of VGAM1146 RNA, herein designated VGAM RNA, also designated SEQ ID:3857.

Another function of VGAM1146 is therefore inhibition of Profilin 2 (PFN2, Accession NM_053024). Accordingly, utilities of VGAM1146 include diagnosis, prevention and treatment of diseases and clinical conditions associated with PFN2. Phosphatidylinositol Glycan, Class A (paroxysmal nocturnal hemoglobinuria) (PIGA, Accession NM_020472) is another VGAM1146 host target gene. PIGA BINDING SITE1 through PIGA BINDING SITE3 are HOST TARGET binding sites found in untranslated regions of mRNA encoded by PIGA, corresponding to HOST TARGET binding sites such as BINDING SITE I, BINDING SITE II or BINDING SITE III. Table 2 illustrates the complementarity of the nucleotide sequences of PIGA BINDING SITE1 through PIGA BINDING SITE3, designated SEQ ID:21712, SEQ ID:21719 and SEQ ID:8499 respectively, to the nucleotide sequence of VGAM1146 RNA, herein designated VGAM RNA, also designated SEQ ID:3857.

Another function of VGAM1146 is therefore inhibition of Phosphatidylinositol Glycan, Class A (paroxysmal nocturnal hemoglobinuria) (PIGA, Accession NM_020472). Accordingly, utilities of VGAM1146 include diagnosis, prevention and treatment of diseases and clinical conditions associated with PIGA. Chemokine (C-C motif) Receptor 5 (CCR5, Accession NM_000579) is another VGAM1146 host target gene. CCR5 BINDING SITE is HOST TARGET binding site found in the 3' untranslated region of mRNA encoded by CCR5, corresponding to a HOST TARGET binding site such as BINDING SITE I, BINDING SITE II or BINDING SITE III. Table 2 illustrates the complementarity of the nucleotide sequences of CCR5 BINDING SITE, designated SEQ ID:6183, to the nucleotide sequence of VGAM1146 RNA, herein designated VGAM RNA, also designated SEQ ID:3857.

Another function of VGAM1146 is therefore inhibition of Chemokine (C-C motif) Receptor 5 (CCR5, Accession NM_000579). Accordingly, utilities of VGAM1146 include diagnosis, prevention and treatment of diseases and clinical conditions associated with CCR5. Calsyntenin 2 (CLSTN2, Accession NM_022131) is another VGAM1146 host target gene. CLSTN2 BINDING SITE is HOST TARGET binding site found in the 3' untranslated region of mRNA encoded by CLSTN2, corresponding to a HOST TARGET binding site such as BINDING SITE I, BINDING SITE II or BINDING SITE III. Table 2 illustrates the complementarity of the nucleotide sequences of CLSTN2 BINDING SITE, designated SEQ ID:22693, to the nucleotide sequence of VGAM1146 RNA, herein designated VGAM RNA, also designated SEQ ID:3857.

Another function of VGAM1146 is therefore inhibition of Calsyntenin 2 (CLSTN2, Accession NM_022131). Accordingly, utilities of VGAM1146 include diagnosis, prevention and treatment of diseases and clinical conditions associated with CLSTN2. CPR2 (Accession NM_030900) is another VGAM1146 host target gene. CPR2 BINDING SITE is HOST TARGET binding site found in the 3' untranslated region of mRNA encoded by CPR2, corresponding to a HOST TARGET binding site such as BINDING SITE I, BINDING SITE II or BINDING SITE III. Table 2 illustrates the complementarity of the nucleotide sequences of CPR2 BINDING SITE, designated SEQ ID:25176, to the nucleotide sequence of VGAM1146 RNA, herein designated VGAM RNA, also designated SEQ ID:3857.

Another function of VGAM1146 is therefore inhibition of CPR2 (Accession NM_030900). Accordingly, utilities of VGAM1146 include diagnosis, prevention and treatment of diseases and clinical conditions associated with CPR2. MGC4730 (Accession XM_034644) is another VGAM1146 host target gene. MGC4730 BINDING SITE is HOST TARGET binding site found in the 3' untranslated region of mRNA encoded by MGC4730, corresponding to a HOST TARGET binding site such as BINDING SITE I, BINDING SITE II or BINDING SITE III. Table 2 illustrates the complementarity of the nucleotide sequences of MGC4730 BINDING SITE, designated SEQ ID:32133, to the nucleotide sequence of VGAM1146 RNA, herein designated VGAM RNA, also designated SEQ ID:3857.

Another function of VGAM1146 is therefore inhibition of MGC4730 (Accession XM_034644). Accordingly, utilities of VGAM1146 include diagnosis, prevention and treatment of diseases and clinical conditions associated with MGC4730. ODZ2 (Accession XM_047995) is another VGAM1146 host target gene. ODZ2 BINDING SITE is HOST TARGET binding site found in the 3' untranslated region of mRNA encoded by ODZ2, corresponding to a HOST TARGET binding site such as BINDING SITE I, BINDING SITE II or BINDING SITE III. Table 2 illustrates the complementarity of the nucleotide sequences of ODZ2 BINDING SITE, designated SEQ ID:35097, to the nucleotide sequence of VGAM1146 RNA, herein designated VGAM RNA, also designated SEQ ID:3857.

Another function of VGAM1146 is therefore inhibition of ODZ2 (Accession XM_047995). Accordingly, utilities of VGAM1146 include diagnosis, prevention and treatment of diseases and clinical conditions associated with ODZ2. TA-KRP (Accession NM_032505) is another VGAM1146 host target gene. TA-KRP BINDING SITE is HOST TARGET binding site found in the 3' untranslated region of mRNA encoded by TA-KRP, corresponding to a HOST TARGET binding site such as BINDING SITE I, BINDING SITE II or BINDING SITE III. Table 2 illustrates the complementarity of the nucleotide sequences of TA-KRP BINDING SITE, designated SEQ ID:26254, to the nucleotide sequence of VGAM1146 RNA, herein designated VGAM RNA, also designated SEQ ID:3857.

Another function of VGAM1146 is therefore inhibition of TA-KRP (Accession NM_032505). Accordingly, utilities of VGAM1146 include diagnosis, prevention and treatment of diseases and clinical conditions associated with TA-KRP. WD Repeat Domain 7 (WDR7, Accession NM_015285) is another VGAM1146 host target gene. WDR7 BINDING SITE is HOST TARGET binding site found in the 3' untranslated region of mRNA encoded by WDR7, corresponding to a HOST TARGET binding site such as BINDING SITE I, BINDING SITE II or BINDING SITE III. Table 2 illustrates the complementarity of the nucleotide sequences of WDR7 BINDING SITE, designated SEQ ID:17611, to the nucleotide sequence of VGAM1146 RNA, herein designated VGAM RNA, also designated SEQ ID:3857.

Another function of VGAM1146 is therefore inhibition of WD Repeat Domain 7 (WDR7, Accession NM_015285). Accordingly, utilities of VGAM1146 include diagnosis, prevention and treatment of diseases and clinical conditions associated with WDR7. LOC154739 (Accession XM_098602) is another VGAM1146 host target gene. LOC154739 BINDING SITE is HOST TARGET binding site found in the 5' untranslated region of mRNA encoded by LOC154739, corresponding to a HOST TARGET binding site such as BINDING SITE I, BINDING SITE II or BINDING SITE III. Table 2 illustrates the complementarity of the nucleotide sequences of LOC154739 BINDING SITE, designated SEQ ID:41721, to the nucleotide sequence of VGAM1146 RNA, herein designated VGAM RNA, also designated SEQ ID:3857.

Another function of VGAM1146 is therefore inhibition of LOC154739 (Accession XM_098602). Accordingly, utilities of VGAM1146 include diagnosis, prevention and treatment of diseases and clinical conditions associated with LOC154739. LOC158401 (Accession XM_088568) is another VGAM1146 host target gene. LOC158401 BINDING SITE is HOST TARGET binding site found in the 5' untranslated region of mRNA encoded by LOC158401, corresponding to a HOST TARGET binding site such as BINDING SITE I, BINDING SITE II or BINDING SITE III. Table 2 illustrates the complementarity of the nucleotide sequences of LOC158401 BINDING SITE, designated SEQ ID:39837, to the nucleotide sequence of VGAM1146 RNA, herein designated VGAM RNA, also designated SEQ ID:3857.

Another function of VGAM1146 is therefore inhibition of LOC158401 (Accession XM_088568). Accordingly, utilities of VGAM1146 include diagnosis, prevention and treatment of diseases and clinical conditions associated with LOC158401. LOC90488 (Accession XM_032129) is another VGAM1146 host target gene. LOC90488 BINDING SITE is HOST TARGET binding site found in the 3' untranslated region of mRNA encoded by LOC90488, corresponding to a HOST TARGET binding site such as BINDING SITE I, BINDING SITE II or BINDING SITE III. Table 2 illustrates the complementarity of the nucleotide sequences of LOC90488 BINDING SITE, designated SEQ ID:31559, to the nucleotide sequence of VGAM1146 RNA, herein designated VGAM RNA, also designated SEQ ID:3857.

Another function of VGAM1146 is therefore inhibition of LOC90488 (Accession XM_032129). Accordingly, utilities of VGAM1146 include diagnosis, prevention and treatment of diseases and clinical conditions associated with LOC90488. LOC91115 (Accession XM_036218) is another VGAM1146 host target gene. LOC91115 BINDING SITE is HOST TARGET binding site found in the 3' untranslated region of mRNA encoded by LOC91115, corresponding to a HOST TARGET binding site such as BINDING SITE I, BINDING SITE II or BINDING SITE III. Table 2 illustrates the complementarity of the nucleotide sequences of LOC91115 BINDING SITE, designated SEQ ID:32403, to the nucleotide sequence of VGAM1146 RNA, herein designated VGAM RNA, also designated SEQ ID:3857.

Another function of VGAM1146 is therefore inhibition of LOC91115 (Accession XM_036218). Accordingly, utilities of VGAM1146 include diagnosis, prevention and treatment of diseases and clinical conditions associated with LOC91115. FIG. 1 further provides a conceptual description of a novel bioinformatically detected viral gene of the present invention, referred to here as Viral Genomic Address Messenger 1147 (VGAM1147) viral gene, which modulates expression of respective host target genes thereof, the function and utility of which host target genes is known in the art.

VGAM1147 is a novel bioinformatically detected regulatory, non protein coding, viral micro RNA (miRNA) gene. The method by which VGAM1147 was detected is described hereinabove with reference to FIGS. 1-8.

VGAM1147 gene, herein designated VGAM GENE, is a viral gene contained in the genome of Fowlpox Virus.

VGAM1147 host target gene, herein designated VGAM HOST TARGET GENE, is a human gene contained in the human genome.

VGAM1147 gene encodes a VGAM1147 precursor RNA, herein designated VGAM PRECURSOR RNA. Similar to other miRNA genes, and unlike most ordinary genes, VGAM1147 precursor RNA does not encode a protein. A nucleotide sequence identical or highly similar to the nucleotide sequence of VGAM1147 precursor RNA is designated SEQ ID:1133, and is provided hereinbelow with reference to the sequence listing part. Nucleotide sequence SEQ ID:1133 is located at position 216748 relative to the genome of Fowlpox Virus.

VGAM1147 precursor RNA folds onto itself, forming VGAM1147 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1147 folded precursor RNA into VGAM1147 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM1147 RNA is designated SEQ ID:3858, and is provided hereinbelow with reference to the sequence listing part.

VGAM1147 host target gene, herein designated VGAM HOST TARGET GENE, encodes a corresponding messenger RNA, VGAM1147 host target RNA, herein designated VGAM HOST TARGET RNA. VGAM1147 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1147 RNA, herein designated VGAM RNA, binds complementarily to one or more host target binding sites located in untranslated regions of VGAM1147 host target RNA, herein designated VGAM HOST TARGET RNA. This complementary binding is due to the fact that the nucleotide sequence of VGAM1147 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1147 RNA, herein designated VGAM RNA, may have a different number of host target binding sites in untranslated regions of a VGAM1147 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1147 RNA, herein designated VGAM RNA, to host target binding sites on VGAM1147 host target RNA, herein designated VGAM HOST TARGET RNA, such as BINDING SITE I, BINDING SITE II and BINDING SITE III, inhibits translation of VGAM1147 host target RNA into VGAM1147 host target protein, herein designated VGAM HOST TARGET PROTEIN. VGAM host target protein is therefore outlined by a broken line.

It is appreciated that VGAM1147 host target gene, herein designated VGAM HOST TARGET GENE, in fact represents a plurality of VGAM1147 host target genes. The mRNA of each one of this plurality of VGAM1147 host target genes comprises one or more host target binding sites, each having a nucleotide sequence which is at least partly complementary to VGAM1147 RNA, herein designated VGAM RNA, and which when bound by VGAM1147 RNA causes inhibition of translation of respective one or more VGAM1147 host target proteins.

It is further appreciated by one skilled in the art that the mode of translational inhibition illustrated by FIG. 1 with specific reference to translational inhibition exerted by VGAM1147 gene, herein designated VGAM GENE, on one or more VGAM1147 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1147 is inhibition of expression of host target genes, as part of a novel viral mechanism of attacking a host. Accordingly, utilities of VGAM1147 include diagnosis, prevention and treatment of viral infection by Fowlpox Virus. Specific functions, and accordingly utilities, of VGAM1147 correlate with, and may be deduced from, the identity of the host target genes which VGAM1147 binds and inhibits, and the function of these host target genes, as elaborated hereinbelow.

Nucleotide sequences of the VGAM1147 precursor RNA, herein designated VGAM PRECURSOR RNA, and of the 'diced' VGAM1147 RNA, herein designated VGAM RNA, and a schematic representation of the secondary folding of VGAM1147 folded precursor RNA, herein designated VGAM FOLDED PRECURSOR RNA, of VGAM1147 are further described hereinbelow with reference to Table 1.

Nucleotide sequences of host target binding sites, such as BINDING SITE-I, BINDING SITE-II and BINDING SITE-III of FIG. 1, found on VGAM1147 host target RNA, and schematic representation of the complementarity of each of these host target binding sites to VGAM1147 RNA, herein designated VGAM RNA, are described hereinbelow with reference to Table 2.

As mentioned hereinabove with reference to FIG. 1, a function of VGAM1147 gene, herein designated VGAM is inhibition of expression of VGAM1147 target genes. It is appreciated that specific functions, and accordingly utilities, of VGAM1147 correlate with, and may be deduced from, the identity of the target genes which VGAM1147 binds and inhibits, and the function of these target genes, as elaborated hereinbelow.

Holocarboxylase Synthetase (biotin-[proprionyl-Coenzyme A-carboxylase (ATP-hydrolysing)] Ligase) (HLCS, Accession NM_000411) is a VGAM1147 host target gene. HLCS BINDING SITE is HOST TARGET binding site found in the 3' untranslated region of mRNA encoded by HLCS, corresponding to a HOST TARGET binding site such as BINDING SITE I, BINDING SITE II or BINDING SITE III. Table 2 illustrates the complementarity of the nucleotide sequences of HLCS BINDING SITE, designated SEQ ID:5988, to the nucleotide sequence of VGAM1147 RNA, herein designated VGAM RNA, also designated SEQ ID:3858.

A function of VGAM1147 is therefore inhibition of Holo-carboxylase Synthetase (biotin-[proprionyl-Coenzyme A-carboxylase (ATP-hydrolysing)] Ligase) (HLCS, Accession NM_000411). Accordingly, utilities of VGAM1147 include diagnosis, prevention and treatment of diseases and clinical conditions associated with HLCS. Tumor Necrosis Factor (ligand) Superfamily, Member 4 (tax-transcriptionally activated glycoprotein 1, 34 kDa) (TNFSF4, Accession NM_003326) is another VGAM1147 host target gene. TNFSF4 BINDING SITE is HOST TARGET binding site found in the 3' untranslated region of mRNA encoded by TNFSF4, corresponding to a HOST TARGET binding site such as BINDING SITE I, BINDING SITE II or BINDING SITE III. Table 2 illustrates the complementarity of the nucleotide sequences of TNFSF4 BINDING SITE, designated SEQ ID:9327, to the nucleotide sequence of VGAM1147 RNA, herein designated VGAM RNA, also designated SEQ ID:3858.

Another function of VGAM1147 is therefore inhibition of Tumor Necrosis Factor (ligand) Superfamily, Member 4 (tax-transcriptionally activated glycoprotein 1, 34 kDa) (TNFSF4, Accession NM_003326), a gene which co-stimulates t cell proliferation and cytokine production. Accordingly, utilities of VGAM1147 include diagnosis, prevention and treatment of diseases and clinical conditions associated with TNFSF4. The function of TNFSF4 and its association with various diseases and clinical conditions, has been established by previous studies, as described hereinabove with reference to VGAM463. FLJ23511 (Accession NM_032239) is another VGAM1147 host target gene. FLJ23511 BINDING SITE is HOST TARGET binding site found in the 3' untranslated region of mRNA encoded by FLJ23511, corresponding to a HOST TARGET binding site such as BINDING SITE I, BINDING SITE II or BINDING SITE III. Table 2 illustrates the complementarity of the nucleotide sequences of FLJ23511 BINDING SITE, designated SEQ ID:25969, to the nucleotide sequence of VGAM1147 RNA, herein designated VGAM RNA, also designated SEQ ID:3858.

Another function of VGAM1147 is therefore inhibition of FLJ23511 (Accession NM_032239). Accordingly, utilities of VGAM1147 include diagnosis, prevention and treatment of diseases and clinical conditions associated with FLJ23511. LOC120196 (Accession XM_061916) is another VGAM1147 host target gene. LOC120196 BINDING SITE is HOST TARGET binding site found in the 3' untranslated region of mRNA encoded by LOC120196, corresponding to a HOST TARGET binding site such as BINDING SITE I, BINDING SITE II or BINDING SITE III. Table 2 illustrates the complementarity of the nucleotide sequences of LOC120196 BINDING SITE, designated SEQ ID:37218, to the nucleotide sequence of VGAM1147 RNA, herein designated VGAM RNA, also designated SEQ ID:3858.

Another function of VGAM1147 is therefore inhibition of LOC120196 (Accession XM_061916). Accordingly, utilities of VGAM1147 include diagnosis, prevention and treatment of diseases and clinical conditions associated with LOC120196. FIG. 1 further provides a conceptual description of a novel bioinformatically detected viral gene of the present invention, referred to here as Viral Genomic Address Messenger 1148 (VGAM1148) viral gene, which modulates expression of respective host target genes thereof, the function and utility of which host target genes is known in the art.

VGAM1148 is a novel bioinformatically detected regulatory, non protein coding, viral micro RNA (miRNA) gene. The method by which VGAM1148 was detected is described hereinabove with reference to FIGS. 1-8.

VGAM1148 gene, herein designated VGAM GENE, is a viral gene contained in the genome of Cercopithecine Herpesvirus 7. VGAM1148 host target gene, herein designated VGAM HOST TARGET GENE, is a human gene contained in the human genome.

VGAM1148 gene encodes a VGAM1148 precursor RNA, herein designated VGAM PRECURSOR RNA. Similar to other miRNA genes, and unlike most ordinary genes, VGAM1148 precursor RNA does not encode a protein. A nucleotide sequence identical or highly similar to the nucleotide sequence of VGAM1148 precursor RNA is designated SEQ ID:1134, and is provided hereinbelow with reference to the sequence listing part. Nucleotide sequence SEQ ID:1134 is located at position 73086 relative to the genome of Cercopithecine Herpesvirus 7.

VGAM1148 precursor RNA folds onto itself, forming VGAM1148 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1148 folded precursor RNA into VGAM1148 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM1148 RNA is designated SEQ ID:3859, and is provided hereinbelow with reference to the sequence listing part.

VGAM1148 host target gene, herein designated VGAM HOST TARGET GENE, encodes a corresponding messenger RNA, VGAM1148 host target RNA, herein designated VGAM HOST TARGET RNA. VGAM1148 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1148 RNA, herein designated VGAM RNA, binds complementarily to one or more host target binding sites located in untranslated regions of VGAM1148 host target RNA, herein designated VGAM HOST TARGET RNA. This complementary binding is due to the fact that the nucleotide sequence of VGAM1148 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1148 RNA, herein designated VGAM RNA, may have a different number of host target binding sites in untranslated regions of a VGAM1148 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1148 RNA, herein designated VGAM RNA, to host target binding sites on VGAM1148 host target RNA, herein designated VGAM HOST TARGET RNA, such as BINDING SITE I, BINDING SITE II and BINDING SITE III, inhibits translation of VGAM1148 host target RNA into VGAM1148 host target protein, herein designated VGAM HOST TARGET PROTEIN. VGAM host target protein is therefore outlined by a broken line.

It is appreciated that VGAM1148 host target gene, herein designated VGAM HOST TARGET GENE, in fact represents a plurality of VGAM1148 host target genes. The mRNA of each one of this plurality of VGAM1148 host target genes comprises one or more host target binding sites, each having a nucleotide sequence which is at least partly complementary to VGAM1148 RNA, herein designated VGAM RNA, and which when bound by VGAM1148 RNA causes inhibition of translation of respective one or more VGAM1148 host target proteins.

It is further appreciated by one skilled in the art that the mode of translational inhibition illustrated by FIG. 1 with specific reference to translational inhibition exerted by VGAM1148 gene, herein designated VGAM GENE, on one or more VGAM1148 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1148 is inhibition of expression of host target genes, as part of a novel viral mechanism of attacking a host. Accordingly, utilities of VGAM1148 include diagnosis, prevention and treatment of viral infection by Cercopithecine Herpesvirus 7. Specific functions, and accordingly utilities, of VGAM1148 correlate with, and may be deduced from, the identity of the host target genes which VGAM1148 binds and inhibits, and the function of these host target genes, as elaborated hereinbelow.

Nucleotide sequences of the VGAM1148 precursor RNA, herein designated VGAM PRECURSOR RNA, and of the 'diced' VGAM1148 RNA, herein designated VGAM RNA, and a schematic representation of the secondary folding of VGAM1148 folded precursor RNA, herein designated VGAM FOLDED PRECURSOR RNA, of VGAM1148 are further described hereinbelow with reference to Table 1.

Nucleotide sequences of host target binding sites, such as BINDING SITE-I, BINDING SITE-II and BINDING SITE-III of FIG. 1, found on VGAM1148 host target RNA, and schematic representation of the complementarity of each of these host target binding sites to VGAM1148 RNA, herein designated VGAM RNA, are described hereinbelow with reference to Table 2.

As mentioned hereinabove with reference to FIG. 1, a function of VGAM1148 gene, herein designated VGAM is inhibition of expression of VGAM1148 target genes. It is appreciated that specific functions, and accordingly utilities, of VGAM1148 correlate with, and may be deduced from, the identity of the target genes which VGAM1148 binds and inhibits, and the function of these target genes, as elaborated hereinbelow.

Disabled Homolog 2, Mitogen-responsive Phosphoprotein (Drosophila) (DAB2, Accession NM_001343) is a VGAM1148 host target gene. DAB2 BINDING SITE is HOST TARGET binding site found in the 3' untranslated region of mRNA encoded by DAB2, corresponding to a HOST TARGET binding site such as BINDING SITE I, BINDING SITE II or BINDING SITE III. Table 2 illustrates the complementarity of the nucleotide sequences of DAB2 BINDING SITE, designated SEQ ID:7023, to the nucleotide sequence of VGAM1148 RNA, herein designated VGAM RNA, also designated SEQ ID:3859.

A function of VGAM1148 is therefore inhibition of Disabled Homolog 2, Mitogen-responsive Phosphoprotein (Drosophila) (DAB2, Accession NM_001343), a gene which may be a component of the csf-1 signal transduction pathway. Accordingly, utilities of VGAM1148 include diagnosis, prevention and treatment of diseases and clinical conditions associated with DAB2. The function of DAB2 and its association with various diseases and clinical conditions, has been established by previous studies, as described hereinabove with reference to VGAM659. FLJ11269 (Accession XM_052193) is another VGAM1148 host target gene. FLJ11269 BINDING SITE is HOST TARGET binding site found in the 3' untranslated region of mRNA encoded by FLJ11269, corresponding to a HOST TARGET binding site such as BINDING SITE I, BINDING SITE II or BINDING SITE III. Table 2 illustrates the complementarity of the nucleotide sequences of FLJ11269 BINDING SITE, designated SEQ ID:35955, to the nucleotide sequence of VGAM1148 RNA, herein designated VGAM RNA, also designated SEQ ID:3859.

Another function of VGAM1148 is therefore inhibition of FLJ11269 (Accession XM_052193). Accordingly, utilities of VGAM1148 include diagnosis, prevention and treatment of diseases and clinical conditions associated with FLJ11269. KIAA0016 (Accession NM_014765) is another VGAM1148 host target gene. KIAA0016 BINDING SITE is HOST TARGET binding site found in the 3' untranslated region of mRNA encoded by KIAA0016, corresponding to a HOST TARGET binding site such as BINDING SITE I, BINDING SITE II or BINDING SITE III. Table 2 illustrates the complementarity of the nucleotide sequences of KIAA0016 BINDING SITE, designated SEQ ID:16536, to the nucleotide sequence of VGAM1148 RNA, herein designated VGAM RNA, also designated SEQ ID:3859.

Another function of VGAM1148 is therefore inhibition of KIAA0016 (Accession NM_014765). Accordingly, utilities of VGAM1148 include diagnosis, prevention and treatment of diseases and clinical conditions associated with KIAA0016. KIAA1431 (Accession XM_032055) is another VGAM1148 host target gene. KIAA1431 BINDING SITE is HOST TARGET binding site found in the 3' untranslated region of mRNA encoded by KIAA1431, corresponding to a HOST TARGET binding site such as BINDING SITE I, BINDING SITE II or BINDING SITE III. Table 2 illustrates the complementarity of the nucleotide sequences of KIAA1431 BINDING SITE, designated SEQ ID:31551, to the nucleotide sequence of VGAM1148 RNA, herein designated VGAM RNA, also designated SEQ ID:3859.

Another function of VGAM1148 is therefore inhibition of KIAA1431 (Accession XM_032055). Accordingly, utilities of VGAM1148 include diagnosis, prevention and treatment of diseases and clinical conditions associated with KIAA1431. Protocadherin 19 (PCDH19, Accession XM_033173) is another VGAM1148 host target gene. PCDH19 BINDING SITE is HOST TARGET binding site found in the 3' untranslated region of mRNA encoded by PCDH19, corresponding to a HOST TARGET binding site such as BINDING SITE I, BINDING SITE II or BINDING SITE III. Table 2 illustrates the complementarity of the nucleotide sequences of PCDH19 BINDING SITE, designated SEQ ID:31866, to the nucleotide sequence of VGAM1148 RNA, herein designated VGAM RNA, also designated SEQ ID:3859.

Another function of VGAM1148 is therefore inhibition of Protocadherin 19 (PCDH19, Accession XM_033173). Accordingly, utilities of VGAM1148 include diagnosis, prevention and treatment of diseases and clinical conditions associated with PCDH19. LOC221300 (Accession XM_166322) is another VGAM1148 host target gene. LOC221300 BINDING SITE is HOST TARGET binding site found in the 3' untranslated region of mRNA encoded by LOC221300, corresponding to a HOST TARGET binding site such as BINDING SITE I, BINDING SITE II or BINDING SITE III. Table 2 illustrates the complementarity of the nucleotide sequences of LOC221300 BINDING SITE, designated SEQ ID:44150, to the nucleotide sequence of VGAM1148 RNA, herein designated VGAM RNA, also designated SEQ ID:3859.

Another function of VGAM1148 is therefore inhibition of LOC221300 (Accession XM_166322). Accordingly, utilities of VGAM1148 include diagnosis, prevention and treatment of diseases and clinical conditions associated with LOC221300. LOC222499 (Accession XM_169457) is another VGAM1148 host target gene. LOC222499 BINDING SITE is HOST TARGET binding site found in the 5' untranslated region of mRNA encoded by LOC222499, corresponding to a HOST TARGET binding site such as BINDING SITE I, BINDING SITE II or BINDING SITE III. Table 2 illustrates the complementarity of the nucleotide sequences of LOC222499 BINDING SITE, designated SEQ ID:45303, to the nucleotide sequence of VGAM1148 RNA, herein designated VGAM RNA, also designated SEQ ID:3859.

Another function of VGAM1148 is therefore inhibition of LOC222499 (Accession XM_169457). Accordingly, utilities of VGAM1148 include diagnosis, prevention and treatment of diseases and clinical conditions associated with LOC222499. LOC90321 (Accession XM_030896) is another VGAM1148 host target gene. LOC90321 BINDING SITE is HOST TARGET binding site found in the 3' untranslated region of mRNA encoded by LOC90321, corresponding to a HOST TARGET binding site such as BINDING SITE I, BINDING SITE II or BINDING SITE III. Table 2 illustrates the complementarity of the nucleotide sequences of LOC90321 BINDING SITE, designated SEQ ID:31210, to the nucleotide sequence of VGAM1148 RNA, herein designated VGAM RNA, also designated SEQ ID:3859.

Another function of VGAM1148 is therefore inhibition of LOC90321 (Accession XM_030896). Accordingly, utilities of VGAM1148 include diagnosis, prevention and treatment of diseases and clinical conditions associated with LOC90321. FIG. 1 further provides a conceptual description of a novel bioinformatically detected viral gene of the present invention, referred to here as Viral Genomic Address Messenger 1149 (VGAM1149) viral gene, which modulates expression of respective host target genes thereof, the function and utility of which host target genes is known in the art.

VGAM1149 is a novel bioinformatically detected regulatory, non protein coding, viral micro RNA (miRNA) gene. The method by which VGAM1149 was detected is described hereinabove with reference to FIGS. 1-8.

VGAM1149 gene, herein designated VGAM GENE, is a viral gene contained in the genome of Cercopithecine Herpesvirus 7. VGAM1149 host target gene, herein designated VGAM HOST TARGET GENE, is a human gene contained in the human genome.

VGAM1149 gene encodes a VGAM1149 precursor RNA, herein designated VGAM PRECURSOR RNA. Similar to other miRNA genes, and unlike most ordinary genes, VGAM1149 precursor RNA does not encode a protein. A nucleotide sequence identical or highly similar to the nucleotide sequence of VGAM1149 precursor RNA is designated SEQ ID:1135, and is provided hereinbelow with reference to the sequence listing part. Nucleotide sequence SEQ ID:1135 is located at position 75465 relative to the genome of Cercopithecine Herpesvirus 7.

VGAM1149 precursor RNA folds onto itself, forming VGAM1149 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1149 folded precursor RNA into VGAM1149 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1149 RNA is designated SEQ ID:3860, and is provided hereinbelow with reference to the sequence listing part.

VGAM1149 host target gene, herein designated VGAM HOST TARGET GENE, encodes a corresponding messenger RNA, VGAM1149 host target RNA, herein designated VGAM HOST TARGET RNA. VGAM1149 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1149 RNA, herein designated VGAM RNA, binds complementarily to one or more host target binding sites located in untranslated regions of VGAM1149 host target RNA, herein designated VGAM HOST TARGET RNA. This complementary binding is due to the fact that the nucleotide sequence of VGAM1149 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1149 RNA, herein designated VGAM RNA, may have a different number of host target binding sites in untranslated regions of a VGAM1149 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1149 RNA, herein designated VGAM RNA, to host target binding sites on VGAM1149 host target RNA, herein designated VGAM HOST TARGET RNA, such as BINDING SITE I, BINDING SITE II and BINDING SITE III, inhibits translation of VGAM1149 host target RNA into VGAM1149 host target protein, herein designated VGAM HOST TARGET PROTEIN. VGAM host target protein is therefore outlined by a broken line.

It is appreciated that VGAM1149 host target gene, herein designated VGAM HOST TARGET GENE, in fact represents a plurality of VGAM1149 host target genes. The mRNA of each one of this plurality of VGAM1149 host target genes comprises one or more host target binding sites, each having a nucleotide sequence which is at least partly complementary to VGAM1149 RNA, herein designated VGAM RNA, and which when bound by VGAM1149 RNA causes inhibition of translation of respective one or more VGAM1149 host target proteins.

It is further appreciated by one skilled in the art that the mode of translational inhibition illustrated by FIG. 1 with specific reference to translational inhibition exerted by VGAM1149 gene, herein designated VGAM GENE, on one or more VGAM1149 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1149 is inhibition of expression of host target genes, as part of a novel viral mechanism of attacking a host. Accordingly, utilities of VGAM1149 include diagnosis, prevention and treatment of viral infection by Cercopithecine Herpesvirus 7. Specific functions, and accordingly utilities, of VGAM1149 correlate with, and may be deduced from, the identity of the host target genes which VGAM1149 binds and inhibits, and the function of these host target genes, as elaborated hereinbelow.

Nucleotide sequences of the VGAM1149 precursor RNA, herein designated VGAM PRECURSOR RNA, and of the 'diced' VGAM1149 RNA, herein designated VGAM RNA, and a schematic representation of the secondary folding of VGAM1149 folded precursor RNA, herein designated VGAM FOLDED PRECURSOR RNA, of VGAM1149 are further described hereinbelow with reference to Table 1.

Nucleotide sequences of host target binding sites, such as BINDING SITE-I, BINDING SITE-II and BINDING SITE-III of FIG. 1, found on VGAM1149 host target RNA, and schematic representation of the complementarity of each of these host target binding sites to VGAM1149 RNA, herein designated VGAM RNA, are described hereinbelow with reference to Table 2.

As mentioned hereinabove with reference to FIG. 1, a function of VGAM1149 gene, herein designated VGAM is inhibition of expression of VGAM1149 target genes. It is appreciated that specific functions, and accordingly utilities, of VGAM1149 correlate with, and may be deduced from, the identity of the target genes which VGAM1149 binds and inhibits, and the function of these target genes, as elaborated hereinbelow.

Lipoprotein Lipase (LPL, Accession NM_000237) is a VGAM1149 host target gene. LPL BINDING SITE is HOST TARGET binding site found in the 3" untranslated region of mRNA encoded by LPL, corresponding to a HOST TARGET binding site such as BINDING SITE I, BINDING SITE II or BINDING SITE III. Table 2 illustrates the complementarity of the nucleotide sequences of LPL BINDING SITE, designated SEQ ID:5747, to the nucleotide sequence of VGAM1149 RNA, herein designated VGAM RNA, also designated SEQ ID:3860.

A function of VGAM1149 is therefore inhibition of Lipoprotein Lipase (LPL, Accession NM_000237), a gene which is the hydrolysis of triglycerides of circulating chylomicrons and very low density lipoproteins (vldl). the enzyme functions in the presence of apolipoprotein c-2 on the luminal surface of vascular. Accordingly, utilities of VGAM1149 include diagnosis, prevention and treatment of diseases and clinical conditions associated with LPL. The function of LPL and its association with various diseases and clinical conditions, has been established by previous studies, as described hereinabove with reference to VGAM55. Dicer1, Dcr-1 Homolog (Drosophila) (DICER1, Accession NM_030621) is another VGAM1149 host target gene. DICER1 BINDING SITE is HOST TARGET binding site found in the 5' untranslated region of mRNA encoded by DICER1, corresponding to a HOST TARGET binding site such as BINDING SITE I, BINDING SITE II or BINDING SITE III. Table 2 illustrates the complementarity of the nucleotide sequences of DICER1 BINDING SITE, designated SEQ ID:24963, to the nucleotide sequence of VGAM1149 RNA, herein designated VGAM RNA, also designated SEQ ID:3860.

Another function of VGAM1149 is therefore inhibition of Dicer1, Dcr-1 Homolog (Drosophila) (DICER1, Accession NM_030621). Accordingly, utilities of VGAM1149 include diagnosis, prevention and treatment of diseases and clinical conditions associated with DICER1. FLJ11040 (Accession NM_018307) is another VGAM1149 host target gene. FLJ11040 BINDING SITE is HOST TARGET binding site found in the 3' untranslated region of mRNA encoded by FLJ11040, corresponding to a HOST TARGET binding site such as BINDING SITE I, BINDING SITE II or BINDING SITE III. Table 2 illustrates the complementarity of the nucleotide sequences of FLJ11040 BINDING SITE, designated SEQ ID:20294, to the nucleotide sequence of VGAM1149 RNA, herein designated VGAM RNA, also designated SEQ ID:3860.

Another function of VGAM1149 is therefore inhibition of FLJ11040 (Accession NM_018307). Accordingly, utilities of VGAM1149 include diagnosis, prevention and treatment of diseases and clinical conditions associated with FLJ11040. T-cell Leukemia/lymphoma 6 (TCL6, Accession NM_020552) is another VGAM1149 host target gene. TCL6 BINDING SITE1 through TCL6 BINDING SITE4 are HOST TARGET binding sites found in untranslated regions of mRNA encoded by TCL6, corresponding to HOST TARGET binding sites such as BINDING SITE I, BINDING SITE II or BINDING SITE III. Table 2 illustrates the complementarity of the nucleotide sequences of TCL6 BINDING SITE1 through TCL6 BINDING SITE4, designated SEQ ID:21770, SEQ ID:21761, SEQ ID:14843 and SEQ ID:15767 respectively, to the nucleotide sequence of VGAM1149 RNA, herein designated VGAM RNA, also designated SEQ ID:3860.

Another function of VGAM1149 is therefore inhibition of T-cell Leukemia/lymphoma 6 (TCL6, Accession NM_020552). Accordingly, utilities of VGAM1149 include diagnosis, prevention and treatment of diseases and clinical conditions associated with TCL6. LOC253747 (Accession XM_173619) is another VGAM1149 host target gene. LOC253747 BINDING SITE is HOST TARGET binding site found in the 5' untranslated region of mRNA encoded by LOC253747, corresponding to a HOST TARGET binding site such as BINDING SITE I, BINDING SITE II or BINDING SITE III. Table 2 illustrates the complementarity of the nucleotide sequences of LOC253747 BINDING SITE, designated SEQ ID:46551, to the nucleotide sequence of VGAM1149 RNA, herein designated VGAM RNA, also designated SEQ ID:3860.

Another function of VGAM1149 is therefore inhibition of LOC253747 (Accession XM_173619). Accordingly, utilities of VGAM1149 include diagnosis, prevention and treatment of diseases and clinical conditions associated with LOC253747. FIG. 1 further provides a conceptual description of a novel bioinformatically detected viral gene of the present invention, referred to here as Viral Genomic Address Messenger 1150 (VGAM1150) viral gene, which modulates expression of respective host target genes thereof, the function and utility of which host target genes is known in the art.

VGAM1150 is a novel bioinformatically detected regulatory, non protein coding, viral micro RNA (miRNA) gene. The method by which VGAM1150 was detected is described hereinabove with reference to FIGS. 1-8.

VGAM1150 gene, herein designated VGAM GENE, is a viral gene contained in the genome of Cercopithecine Herpesvirus 7. VGAM1150 host target gene, herein designated VGAM HOST TARGET GENE, is a human gene contained in the human genome.

VGAM1150 gene encodes a VGAM1150 precursor RNA, herein designated VGAM PRECURSOR RNA. Similar to other miRNA genes, and unlike most ordinary genes, VGAM1150 precursor RNA does not encode a protein. A nucleotide sequence identical or highly similar to the nucleotide sequence of VGAM1150 precursor RNA is designated SEQ ID:1136, and is provided hereinbelow with reference to the sequence listing part. Nucleotide sequence SEQ ID:1136 is located at position 76231 relative to the genome of Cercopithecine Herpesvirus 7.

VGAM1150 precursor RNA folds onto itself, forming VGAM1150 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1150 folded precursor RNA into VGAM1150 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1150 RNA is designated SEQ ID:3861, and is provided hereinbelow with reference to the sequence listing part.

VGAM1150 host target gene, herein designated VGAM HOST TARGET GENE, encodes a corresponding messenger RNA, VGAM1150 host target RNA, herein designated VGAM HOST TARGET RNA. VGAM1150 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1150 RNA, herein designated VGAM RNA, binds complementarily to one or more host target binding sites located in untranslated regions of VGAM1150 host target RNA, herein designated VGAM HOST TARGET RNA. This complementary binding is due to the fact that the nucleotide sequence of VGAM1150 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1150 RNA, herein designated VGAM RNA, may have a different number of host target binding sites in untranslated regions of a VGAM1150 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1150 RNA, herein designated VGAM RNA, to host target binding sites on VGAM1150 host target RNA, herein designated VGAM HOST TARGET RNA, such as BINDING SITE I, BINDING SITE II and BINDING SITE III, inhibits translation of VGAM1150 host target RNA into VGAM1150 host target protein, herein designated VGAM HOST TARGET PROTEIN. VGAM host target protein is therefore outlined by a broken line.

It is appreciated that VGAM1150 host target gene, herein designated VGAM HOST TARGET GENE, in fact represents a plurality of VGAM1150 host target genes. The mRNA of each one of this plurality of VGAM1150 host target genes comprises one or more host target binding sites, each having a nucleotide sequence which is at least partly complementary to VGAM1150 RNA, herein designated VGAM RNA, and which when bound by VGAM1150 RNA causes inhibition of translation of respective one or more VGAM1150 host target proteins.

It is further appreciated by one skilled in the art that the mode of translational inhibition illustrated by FIG. 1 with specific reference to translational inhibition exerted by VGAM1150 gene, herein designated VGAM GENE, on one or more VGAM1150 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1150 is inhibition of expression of host target genes, as part of a novel viral mechanism of attacking a host. Accordingly, utilities of VGAM1150 include diagnosis, prevention and treatment of viral infection by Cercopithecine Herpesvirus 7. Specific functions, and accordingly utilities, of VGAM1150 correlate with, and may be deduced from, the identity of the host target genes which VGAM1150 binds and inhibits, and the function of these host target genes, as elaborated hereinbelow.

Nucleotide sequences of the VGAM1150 precursor RNA, herein designated VGAM PRECURSOR RNA, and of the 'diced' VGAM1150 RNA, herein designated VGAM RNA, and a schematic representation of the secondary folding of VGAM1150 folded precursor RNA, herein designated VGAM FOLDED PRECURSOR RNA, of VGAM1150 are further described hereinbelow with reference to Table 1.

Nucleotide sequences of host target binding sites, such as BINDING SITE-I, BINDING SITE-II and BINDING SITE-III of FIG. 1, found on VGAM1150 host target RNA, and schematic representation of the complementarity of each of these host target binding sites to VGAM1150 RNA, herein designated VGAM RNA, are described hereinbelow with reference to Table 2.

As mentioned hereinabove with reference to FIG. 1, a function of VGAM1150 gene, herein designated VGAM is inhibition of expression of VGAM1150 target genes. It is appreciated that specific functions, and accordingly utilities, of VGAM1150 correlate with, and may be deduced from, the identity of the target genes which VGAM1150 binds and inhibits, and the function of these target genes, as elaborated hereinbelow.

Integrin, Beta 1 (fibronectin receptor, beta polypeptide, antigen CD29 includes MDF2, MSK12) (ITGB1, Accession NM_002211) is a VGAM1150 host target gene. ITGB1 BINDING SITE is HOST TARGET binding site found in the 3' untranslated region of mRNA encoded by ITGB1, corresponding to a HOST TARGET binding site such as BINDING SITE I, BINDING SITE II or BINDING SITE III. Table 2 illustrates the complementarity of the nucleotide sequences of ITGB1 BINDING SITE, designated SEQ ID:7977, to the nucleotide sequence of VGAM1150 RNA, herein designated VGAM RNA, also designated SEQ ID:3861.

A function of VGAM1150 is therefore inhibition of Integrin, Beta 1 (fibronectin receptor, beta polypeptide, antigen CD29 includes MDF2, MSK12) (ITGB1, Accession NM_002211), a gene which acts as a fibronectin receptor. Accordingly, utilities of VGAM1150 include diagnosis, prevention and treatment of diseases and clinical conditions associated with ITGB1. The function of ITGB1 and its association with various diseases and clinical conditions, has been established by previous studies, as described hereinabove with reference to VGAM427. Lecithin Retinol Acyltransferase (phosphatidylcholine--retinol O-acyltransferase) (LRAT, Accession XM_011181) is another VGAM1150 host target gene. LRAT BINDING SITE is HOST TARGET binding site found in the 3' untranslated region of mRNA encoded by LRAT, corresponding to a HOST TARGET binding site such as BINDING SITE I, BINDING SITE II or BINDING SITE III. Table 2 illustrates the complementarity of the nucleotide sequences of LRAT BINDING SITE, designated SEQ ID:30182, to the nucleotide sequence of VGAM1150 RNA, herein designated VGAM RNA, also designated SEQ ID:3861.

Another function of VGAM1150 is therefore inhibition of Lecithin Retinol Acyltransferase (phosphatidylcholine--retinol O-acyltransferase) (LRAT, Accession XM_011181). Accordingly, utilities of VGAM1150 include diagnosis, prevention and treatment of diseases and clinical conditions associated with LRAT. FLJ20281 (Accession XM_165663) is another VGAM1150 host target gene. FLJ20281 BINDING SITE is HOST TARGET binding site found in the 5' untranslated region of mRNA encoded by FLJ20281, corresponding to a HOST TARGET binding site such as BINDING SITE I, BINDING SITE II or BINDING SITE III. Table 2 illustrates the complementarity of the nucleotide sequences of FLJ20281 BINDING SITE, designated SEQ ID:43728, to the nucleotide sequence of VGAM1150 RNA, herein designated VGAM RNA, also designated SEQ ID:3861.

Another function of VGAM1150 is therefore inhibition of FLJ20281 (Accession XM_165663). Accordingly, utilities of VGAM1150 include diagnosis, prevention and treatment of diseases and clinical conditions associated with FLJ20281. RP4-622L5 (Accession NM_019118) is another VGAM1150 host target gene. RP4-622L5 BINDING SITE is HOST TARGET binding site found in the 3' untranslated region of mRNA encoded by RP4-622L5, corresponding to a HOST TARGET binding site such as BINDING SITE I, BINDING SITE II or BINDING SITE III. Table 2 illustrates the complementarity of the nucleotide sequences of RP4-622L5 BINDING SITE, designated SEQ ID:21200, to the nucleotide sequence of VGAM1150 RNA, herein designated VGAM RNA, also designated SEQ ID:3861.

Another function of VGAM1150 is therefore inhibition of RP4-622L5 (Accession NM_019118). Accordingly, utilities of VGAM1150 include diagnosis, prevention and treatment of diseases and clinical conditions associated with RP4-622L5. LOC129566 (Accession XM_065294) is another VGAM1150 host target gene. LOC129566 BINDING SITE is HOST TARGET binding site found in the 5' untranslated region of mRNA encoded by LOC129566, corresponding to a HOST TARGET binding site such as BINDING SITE I, BINDING SITE II or BINDING SITE III. Table 2 illustrates the complementarity of the nucleotide sequences of LOC129566 BINDING SITE, designated SEQ ID:37280, to the nucleotide sequence of VGAM1150 RNA, herein designated VGAM RNA, also designated SEQ ID:3861.

Another function of VGAM1150 is therefore inhibition of LOC129566 (Accession XM_065294). Accordingly, utilities of VGAM1150 include diagnosis, prevention and treatment of diseases and clinical conditions associated with LOC129566. LOC154386 (Accession XM_087920) is another VGAM1150 host target gene. LOC154386 BINDING SITE is HOST TARGET binding site found in the 5' untranslated region of mRNA encoded by LOC154386, corresponding to a HOST TARGET binding site such as BINDING SITE I, BINDING SITE II or BINDING SITE III. Table 2 illustrates the complementarity of the nucleotide sequences of LOC154386 BINDING SITE, designated SEQ ID:39472, to the nucleotide sequence of VGAM1150 RNA, herein designated VGAM RNA, also designated SEQ ID:3861.

Another function of VGAM1150 is therefore inhibition of LOC154386 (Accession XM_087920). Accordingly, utilities of VGAM1150 include diagnosis, prevention and treatment of diseases and clinical conditions associated with LOC154386. FIG. 1 further provides a conceptual description of a novel bioinformatically detected viral gene of the present invention, referred to here as Viral Genomic Address Messenger 1151 (VGAM1151) viral gene, which modulates expression of respective host target genes thereof, the function and utility of which host target genes is known in the art.

VGAM1151 is a novel bioinformatically detected regulatory, non protein coding, viral micro RNA (miRNA) gene. The method by which VGAM1151 was detected is described hereinabove with reference to FIGS. 1-8.

VGAM1151 gene, herein designated VGAM GENE, is a viral gene contained in the genome of Cowpox Virus. VGAM1151 host target gene, herein designated VGAM HOST TARGET GENE, is a human gene contained in the human genome.

VGAM1151 gene encodes a VGAM1151 precursor RNA, herein designated VGAM PRECURSOR RNA. Similar to other miRNA genes, and unlike most ordinary genes, VGAM1151 precursor RNA does not encode a protein. A nucleotide sequence identical or highly similar to the nucleotide sequence of VGAM1151 precursor RNA is designated SEQ ID:1137, and is provided hereinbelow with reference to the sequence listing part. Nucleotide sequence SEQ ID:1137 is located at position 2018 relative to the genome of Cowpox Virus.

VGAM1151 precursor RNA folds onto itself, forming VGAM1151 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1151 folded precursor RNA into VGAM1151 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM1151 RNA is designated SEQ ID:3862, and is provided hereinbelow with reference to the sequence listing part.

VGAM1151 host target gene, herein designated VGAM HOST TARGET GENE, encodes a corresponding messenger RNA, VGAM1151 host target RNA, herein designated VGAM HOST TARGET RNA. VGAM1151 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1151 RNA, herein designated VGAM RNA, binds complementarily to one or more host target binding sites located in untranslated regions of VGAM1151 host target RNA, herein designated VGAM HOST TARGET RNA. This complementary binding is due to the fact that the nucleotide sequence of VGAM1151 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1151 RNA, herein designated VGAM RNA, may have a different number of host target binding sites in untranslated regions of a VGAM1151 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1151 RNA, herein designated VGAM RNA, to host target binding sites on VGAM1151 host target RNA, herein designated VGAM HOST TARGET RNA, such as BINDING SITE I, BINDING SITE II and BINDING SITE III, inhibits translation of VGAM1151 host target RNA into VGAM1151 host target protein, herein designated VGAM HOST TARGET PROTEIN. VGAM host target protein is therefore outlined by a broken line.

It is appreciated that VGAM1151 host target gene, herein designated VGAM HOST TARGET GENE, in fact represents a plurality of VGAM1151 host target genes. The mRNA of each one of this plurality of VGAM1151 host target genes comprises one or more host target binding sites, each having a nucleotide sequence which is at least partly complementary to VGAM1151 RNA, herein designated VGAM RNA, and which when bound by VGAM1151 RNA causes inhibition of translation of respective one or more VGAM1151 host target proteins.

It is further appreciated by one skilled in the art that the mode of translational inhibition illustrated by FIG. 1 with specific reference to translational inhibition exerted by VGAM1151 gene, herein designated VGAM GENE, on one or more VGAM1151 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1151 is inhibition of expression of host target genes, as part of a novel viral mechanism of attacking a host. Accordingly, utilities of VGAM1151 include diagnosis, prevention and treatment of viral infection by Cowpox Virus. Specific functions, and accordingly utilities, of VGAM1151 correlate with, and may be deduced from, the identity of the host target genes which VGAM1151 binds and inhibits, and the function of these host target genes, as elaborated hereinbelow.

Nucleotide sequences of the VGAM1151 precursor RNA, herein designated VGAM PRECURSOR RNA, and of the 'diced' VGAM1151 RNA, herein designated VGAM RNA, and a schematic representation of the secondary folding of VGAM1151 folded precursor RNA, herein designated VGAM FOLDED PRECURSOR RNA, of VGAM1151 are further described hereinbelow with reference to Table 1.

Nucleotide sequences of host target binding sites, such as BINDING SITE-I, BINDING SITE-II and BINDING SITE-III of FIG. 1, found on VGAM1151 host target RNA, and schematic representation of the complementarity of each of these host target binding sites to VGAM1151 RNA, herein designated VGAM RNA, are described hereinbelow with reference to Table 2.

As mentioned hereinabove with reference to FIG. 1, a function of VGAM1151 gene, herein designated VGAM is inhibition of expression of VGAM1151 target genes. It is appreciated that specific functions, and accordingly utilities, of VGAM1151 correlate with, and may be deduced from, the identity of the target genes which VGAM1151 binds and inhibits, and the function of these target genes, as elaborated hereinbelow.

1-acylglycerol-3-phosphate O-acyltransferase 2 (lysophosphatidic acid acyltransferase, beta) (AGPAT2, Accession NM_006412) is a VGAM1151 host target gene. AGPAT2 BINDING SITE is HOST TARGET binding site found in the 3' untranslated region of mRNA encoded by AGPAT2, corresponding to a HOST TARGET binding site such as BINDING SITE I, BINDING SITE II or BINDING SITE III. Table 2 illustrates the complementarity of the nucleotide sequences of AGPAT2 BINDING SITE, designated SEQ ID:13120, to the nucleotide sequence of VGAM1151 RNA, herein designated VGAM RNA, also designated SEQ ID:3862.

A function of VGAM1151 is therefore inhibition of 1-acylglycerol-3-phosphate O-acyltransferase 2 (lysophosphatidic acid acyltransferase, beta) (AGPAT2, Accession NM_006412). Accordingly, utilities of VGAM1151 include diagnosis, prevention and treatment of diseases and clinical conditions associated with AGPAT2. Rac/Cdc42 Guanine Nucleotide Exchange Factor (GEF) 6 (ARHGEF6, Accession XM_042963) is another VGAM1151 host target gene. ARHGEF6 BINDING SITE1 and ARHGEF6 BINDING SITE2 are HOST TARGET binding sites found in untranslated regions of mRNA encoded by ARHGEF6, corresponding to HOST TARGET binding sites such as BINDING SITE I, BINDING SITE II or BINDING SITE III. Table 2 illustrates the complementarity of the nucleotide sequences of ARHGEF6 BINDING SITE1 and ARHGEF6 BINDING SITE2, designated SEQ ID:33846 and SEQ ID:33847 respectively, to the nucleotide sequence of VGAM1151 RNA, herein designated VGAM RNA, also designated SEQ ID:3862.

Another function of VGAM1151 is therefore inhibition of Rac/Cdc42 Guanine Nucleotide Exchange Factor (GEF) 6 (ARHGEF6, Accession XM_042963). Accordingly, utilities of VGAM1151 include diagnosis, prevention and treatment of diseases and clinical conditions associated with ARHGEF6. Bassoon (presynaptic cytomatrix protein) (BSN, Accession NM_003458) is another VGAM1151 host target gene. BSN BINDING SITE is HOST TARGET binding site found in the 3' untranslated region of mRNA encoded by BSN, corresponding to a HOST TARGET binding site such as BINDING SITE I, BINDING SITE II or BINDING SITE III. Table 2 illustrates the complementarity of the nucleotide sequences of BSN BINDING SITE, designated SEQ ID:9517, to the nucleotide sequence of VGAM1151 RNA, herein designated VGAM RNA, also designated SEQ ID:3862.

Another function of VGAM1151 is therefore inhibition of Bassoon (presynaptic cytomatrix protein) (BSN, Accession NM_003458), a gene which may be involved in cytomatrix organization at the site of neurotransmitter release. Accordingly, utilities of VGAM1151 include diagnosis, prevention and treatment of diseases and clinical conditions associated with BSN. The function of BSN and its association with various diseases and clinical conditions, has been established by previous studies, as described hereinabove with reference to VGAM638. Dihydropyrimidinase-like 2 (DPYSL2, Accession NM_001386) is another VGAM1151 host target gene. DPYSL2 BINDING SITE is HOST TARGET binding site found in the 5' untranslated region of mRNA encoded by DPYSL2, corresponding to a HOST TARGET binding site such as BINDING SITE I, BINDING SITE II or BINDING SITE III. Table 2 illustrates the complementarity of the nucleotide sequences of DPYSL2 BINDING SITE, designated SEQ ID:7063, to the nucleotide sequence of VGAM1151 RNA, herein designated VGAM RNA, also designated SEQ ID:3862.

Another function of VGAM1151 is therefore inhibition of Dihydropyrimidinase-like 2 (DPYSL2, Accession NM_001386), a gene which is a member of the dihydropyrimidinase family. Accordingly, utilities of VGAM1151 include diagnosis, prevention and treatment of diseases and clinical conditions associated with DPYSL2. The function of DPYSL2 and its association with various diseases and clinical conditions, has been established by previous studies, as described hereinabove with reference to VGAM217. Enolase 2, (gamma, neuronal) (ENO2, Accession NM_001975) is another VGAM1151 host target gene. ENO2 BINDING SITE is HOST TARGET binding site found in the 3' untranslated region of mRNA encoded by ENO2, corresponding to a HOST TARGET binding site such as BINDING SITE I, BINDING SITE II or BINDING SITE III. Table 2 illustrates the complementarity of the nucleotide sequences of ENO2 BINDING SITE, designated SEQ ID:7706, to the nucleotide sequence of VGAM1151 RNA, herein designated VGAM RNA, also designated SEQ ID:3862.

Another function of VGAM1151 is therefore inhibition of Enolase 2, (gamma, neuronal) (ENO2, Accession NM_001975), a gene which converts 2-phospho-D-glycerate to phosphoenolpyruvate in glycolysis. Accordingly, utilities of VGAM1151 include diagnosis, prevention and treatment of diseases and clinical conditions associated with ENO2. The function of ENO2 has been established by previous studies. The enolases (phosphopyruvate hydratase; EC 4.2.1.11) catalyze the interconversion of 2-phosphoglycerate to phosphoenolpyruvate in the glycolytic pathway. The functional enzyme is a dimer made up of subunits referred to as alpha, beta, and gamma. In mammals there are at least 3 isoforms of enolase characterized by different tissue distributions as well as by distinct biochemical and immunologic properties. The alpha-, or nonneuronal, enolase (ENO1; 172430) is a nearly ubiquitous form, found in almost all tissues, and its expression precedes that of the other isoforms in the early stage of embryonic development. The beta-, or muscle-specific, enolase (ENO3; 131370) is present in adult skeletal muscle, and the gamma-, or neuron-specific, enolase (ENO2) is the major form found in mature neurons and in cells of neuronal origin. Enolase-2 is determined by a gene on chromosome 12 (Grzeschik, 1976). Herbschleb-Voogt et al. (1978) confirmed assignment to chromosome 12 by showing synteny with LDHB and PEPB in man-mouse hybrids. Mattei et al. (1982) assigned ENO2 to 12p11-qter by study of cells trisomic for 12pter-p11. Law and Kao (1982) also assigned the gene to chromosome 12. By in situ hybridization, Craig et al. (1989, 1990) localized ENO2 to 12p13. Oliva et al. (1991) demonstrated that the ENO2 gene contains 12 exons distributed over 9,213 nucleotides. The putative promoter region lacks canonical TATA and CAAT boxes, is very G+C-rich, and contains several potential regulatory sequences.

Full details of the abovementioned studies are described in the following publications, the disclosure of which are hereby incorporated by reference:

Oliva, D.; Cali, L.; Feo, S.; Giallongo, A.: Complete structure of the human gene encoding neuron-specific enolase. Genomics 10:157-165, 1991.; and Hinks, L. J.; Day, I. N. M.: Further studies of enolase loci. (Abstract) Cytogenet. Cell Genet. 58:1854 only, 1991.

Further studies establishing the function and utilities of ENO2 are found in John Hopkins OMIM database record ID 131360, and in sited publications numbered 4575-4583 listed in the bibliography section hereinbelow, which are also hereby incorporated by reference. FtsJ Homolog 2 (E. coli) (FTSJ2, Accession NM_013393) is another VGAM1151 host target gene. FTSJ2 BINDING SITE is HOST TARGET binding site found in the 3' untranslated region of mRNA encoded by FTSJ2, corresponding to a HOST TARGET binding site such as BINDING SITE I, BINDING SITE II or BINDING SITE III. Table 2 illustrates the complementarity of the nucleotide sequences of FTSJ2 BINDING SITE, designated SEQ ID:15044, to the nucleotide sequence of VGAM1151 RNA, herein designated VGAM RNA, also designated SEQ ID:3862.

Another function of VGAM1151 is therefore inhibition of FtsJ Homolog 2 (E. coli) (FTSJ2, Accession NM_013393). Accordingly, utilities of VGAM1151 include diagnosis, prevention and treatment of diseases and clinical conditions associated with FTSJ2. GAC1 (Accession NM_006338) is another VGAM1151 host target gene. GAC1 BINDING SITE is HOST TARGET binding site found in the 3' untranslated region of mRNA encoded by GAC1, corresponding to a HOST TARGET binding site such as BINDING SITE I, BINDING SITE II or BINDING SITE III. Table 2 illustrates the complementarity of the nucleotide sequences of GAC1 BINDING SITE, designated SEQ ID:13037, to the nucleotide sequence of VGAM1151 RNA, herein designated VGAM RNA, also designated SEQ ID:3862.

Another function of VGAM1151 is therefore inhibition of GAC1 (Accession NM_006338). Accordingly, utilities of VGAM1151 include diagnosis, prevention and treatment of diseases and clinical conditions associated with GAC1. Glutamate Dehydrogenase 1 (GLUD1, Accession NM_005271) is another VGAM1151 host target gene. GLUD1 BINDING SITE is HOST TARGET binding site found in the 3' untranslated region of mRNA encoded by GLUD1, corresponding to a HOST TARGET binding site such as BINDING SITE I, BINDING SITE II or BINDING SITE III. Table 2 illustrates the complementarity of the nucleotide sequences of GLUD1 BINDING SITE, designated SEQ ID:11774, to the nucleotide sequence of VGAM1151 RNA, herein designated VGAM RNA, also designated SEQ ID:3862.

Another function of VGAM1151 is therefore inhibition of Glutamate Dehydrogenase 1 (GLUD1, Accession NM_005271). Accordingly, utilities of VGAM1151 include diagnosis, prevention and treatment of diseases and clinical conditions associated with GLUD1. Hyperpolarization Activated Cyclic Nucleotide-gated Potassium Channel 4 (HCN4, Accession NM_005477) is another VGAM1151 host target gene. HCN4 BINDING SITE is HOST TARGET binding site found in the 3' untranslated region of mRNA encoded by HCN4, corresponding to a HOST TARGET binding site such as BINDING SITE I, BINDING SITE II or BINDING SITE III. Table 2 illustrates the complementarity of the nucleotide sequences of HCN4 BINDING SITE, designated SEQ ID:11979, to the nucleotide sequence of VGAM1151 RNA, herein designated VGAM RNA, also designated SEQ ID:3862.

Another function of VGAM1151 is therefore inhibition of Hyperpolarization Activated Cyclic Nucleotide-gated Potassium Channel 4 (HCN4, Accession NM_005477), a gene which is hyperpolarization activated cyclic nucleotide-gated cation channel 4 and may act as a pacemaker channel in the heart. Accordingly, utilities of VGAM1151 include diagnosis, prevention and treatment of diseases and clinical conditions associated with HCN4. The function of HCN4 and its association with various diseases and clinical conditions, has been established by previous studies, as described hereinabove with reference to VGAM430. High Mobility Group AT-hook 2 (HMGA2, Accession NM_003483) is another VGAM1151 host target gene. HMGA2 BINDING SITE1 and HMGA2 BINDING SITE2 are HOST TARGET binding sites found in untranslated regions of mRNA encoded by HMGA2, corresponding to HOST TARGET binding sites such as BINDING SITE I, BINDING SITE II or BINDING SITE III. Table 2 illustrates the complementarity of the nucleotide sequences of HMGA2 BINDING SITE1 and HMGA2 BINDING SITE2, designated SEQ ID:9566 and SEQ ID:9567 respectively, to the nucleotide sequence of VGAM1151 RNA, herein designated VGAM RNA, also designated SEQ ID:3862.

Another function of VGAM1151 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM1151 include diagnosis, prevention and treatment of diseases and clinical conditions associated with HMGA2. The function of HMGA2 and its association with various diseases and clinical conditions, has been established by previous studies, as described hereinabove with reference to VGAM552. Kinesin Family Member 3B (KIF3B, Accession NM_004798) is another VGAM1151 host target gene. KIF3B BINDING SITE is HOST TARGET binding site found in the 3' untranslated region of mRNA encoded by KIF3B, corresponding to a HOST TARGET binding site such as BINDING SITE I, BINDING SITE II or BINDING SITE III. Table 2 illustrates the complementarity of the nucleotide sequences of KIF3B BINDING SITE, designated SEQ ID:11216, to the nucleotide sequence of VGAM1151 RNA, herein designated VGAM RNA, also designated SEQ ID:3862.

Another function of VGAM1151 is therefore inhibition of Kinesin Family Member 3B (KIF3B, Accession NM_004798), a gene which is a microtubule-based anterograde translocator for membranous organelles. Accordingly, utilities of VGAM1151 include diagnosis, prevention and treatment of diseases and clinical conditions associated with KIF3B. The function of KIF3B and its association with various diseases and clinical conditions, has been established by previous studies, as described hereinabove with reference to VGAM1017. Lipoprotein Lipase (LPL, Accession NM_000237) is another VGAM1151 host target gene. LPL BINDING SITE is HOST TARGET binding site found in the 3' untranslated region of mRNA encoded by LPL, corresponding to a HOST TARGET binding site such as BINDING SITE I, BINDING SITE II or BINDING SITE III. Table 2 illustrates the complementarity of the nucleotide sequences of LPL BINDING SITE, designated SEQ ID:5754, to the nucleotide sequence of VGAM1151 RNA, herein designated VGAM RNA, also designated SEQ ID:3862.

Another function of VGAM1151 is therefore inhibition of Lipoprotein Lipase (LPL, Accession NM_000237), a gene which is the hydrolysis of triglycerides of circulating chylomicrons and very low density lipoproteins (vldl). the enzyme functions in the presence of apolipoprotein c-2 on the luminal surface of vascular. Accordingly, utilities of VGAM1151 include diagnosis, prevention and treatment of diseases and clinical conditions associated with LPL. The function of LPL and its association with various diseases and clinical conditions, has been established by previous studies, as described hereinabove with reference to VGAM55. Meis1, Myeloid Ecotropic Viral Integration Site 1 Homolog (mouse) (MEIS1, Accession NM_002398) is another VGAM1151 host target gene. MEIS1 BINDING SITE is HOST TARGET binding site found in the 3' untranslated region of mRNA encoded by MEIS1, corresponding to a HOST TARGET binding site such as BINDING SITE I, BINDING SITE II or BINDING SITE III. Table 2 illustrates the complementarity of the nucleotide sequences of MEIS1 BINDING SITE, designated SEQ ID:8218, to the nucleotide sequence of VGAM1151 RNA, herein designated VGAM RNA, also designated SEQ ID:3862.

Another function of VGAM1151 is therefore inhibition of Meis1, Myeloid Ecotropic Viral Integration Site 1 Homolog (mouse) (MEIS1, Accession NM_002398), a gene which may regulate gene expression and control cell differentiation. Accordingly, utilities of VGAM1151 include diagnosis, prevention and treatment of diseases and clinical conditions associated with MEIS1. The function of MEIS1 and its association with various diseases and clinical conditions, has been established by previous studies, as described hereinabove with reference to VGAM894. Nuclear Factor I/A (NFIA, Accession XM_046827) is another VGAM1151 host target gene. NFIA BINDING SITE1 and NFIA BINDING SITE2 are HOST TARGET binding sites found in untranslated regions of mRNA encoded by NFIA, corresponding to HOST TARGET binding sites such as BINDING SITE I, BINDING SITE II or BINDING SITE III. Table 2 illustrates the complementarity of the nucleotide sequences of NFIA BINDING SITE1 and NFIA BINDING SITE2, designated SEQ ID:34841 and SEQ ID:34840 respectively, to the nucleotide sequence of VGAM1151 RNA, herein designated VGAM RNA, also designated SEQ ID:3862.

Another function of VGAM1151 is therefore inhibition of Nuclear Factor I/A (NFIA, Accession XM_046827). Accordingly, utilities of VGAM1151 include diagnosis, prevention and treatment of diseases and clinical conditions associated with NFIA. Neurotrophic Tyrosine Kinase, Receptor, Type 2 (NTRK2, Accession NM_006180) is another VGAM1151 host target gene. NTRK2 BINDING SITE is HOST TARGET binding site found in the 3' untranslated region of mRNA encoded by NTRK2, corresponding to a HOST TARGET binding site such as BINDING SITE I, BINDING SITE II or BINDING SITE III. Table 2 illustrates the complementarity of the nucleotide sequences of NTRK2 BINDING SITE, designated SEQ ID:12843, to the nucleotide sequence of VGAM1151 RNA, herein designated VGAM RNA, also designated SEQ ID:3862.

Another function of VGAM1151 is therefore inhibition of Neurotrophic Tyrosine Kinase, Receptor, Type 2 (NTRK2, Accession NM_006180), a gene which is involved in the development and/or maintenance of the nervous system. Accordingly, utilities of VGAM1151 include diagnosis, prevention and treatment of diseases and clinical conditions associated with NTRK2. The function of NTRK2 and its association with various diseases and clinical conditions, has been established by previous studies, as described hereinabove with reference to VGAM341. Paired Box Gene 5 (B-cell lineage specific activator protein) (PAX5, Accession NM_016734) is another VGAM1151 host target gene. PAX5 BINDING SITE is HOST TARGET binding site found in the 3' untranslated region of mRNA encoded by PAX5, corresponding to a HOST TARGET binding site such as BINDING SITE I, BINDING SITE II or BINDING SITE III. Table 2 illustrates the complementarity of the nucleotide sequences of PAX5 BINDING SITE, designated SEQ ID:18792, to the nucleotide sequence of VGAM1151 RNA, herein designated VGAM RNA, also designated SEQ ID:3862.

Another function of VGAM1151 is therefore inhibition of Paired Box Gene 5 (B-cell lineage specific activator protein) (PAX5, Accession NM_016734), a gene which plays a role in B-cell differentiation, neural development and spermatogenesis. Accordingly, utilities of VGAM1151 include diagnosis, prevention and treatment of diseases and clinical conditions associated with PAX5. The function of PAX5 has been established by previous studies. The PAX5 gene is located in the 9p13 region, which is involved in t (9;14)(p13; q32) translocations recurring in small lymphocytic lymphomas of the plasmacytoid subtype and in derived large cell lymphomas. Ohno et al. (1990) showed that in a diffuse large cell lymphoma (KIS-1) with a translocation, the immunoglobulin heavy-chain (IgH) locus on 14q32 is juxtaposed to 9p13 sequences of unknown function. Busslinger et al. (1996) showed that the KIS-1 translocation breakpoint is located 1,807 bp upstream of exon 1A of PAX5, thus bringing the potent E-mu enhancer of the IgH gene into close proximity with the PAX5 promoters. The data suggested to them that deregulation of PAX5 gene transcription by the t (9;14) translocation contributes to the pathogenesis of small lymphocytic lymphomas with plasmacytoid differentiation. In addition to immunoglobulin V genes, the 5-prime sequences of BCL6 (OMIM Ref. No. 109565) and FAS (TNFRSF6; 134637) are mutated in normal germinal center B lymphocytes. Genomic instability promotes tumorigenesis through defective chromosome segregation and DNA mismatch repair inactivation. By screening 18 loci for mutations, Pasqualucci et al. (2001) identified changes in the germline sequences of PIM1 (OMIM Ref. No. 164960), MYC (OMIM Ref. No. 190080), ARHH (OMIM Ref. No. 602037), and/or PAX5, in addition to BCL6, in a majority of diffuse large cell lymphomas (DLCLs; OMIM Ref. No. 601889). No mutations in PIM1, MYC, ARHH, and PAX5 were detected in germinal-center lymphocytes, naive B cells, or B-cell malignancies other than DLCLs. PAX5 mutations, which were observed in 57% of DLCLs, were identified downstream of both transcription sites, predominantly in noncoding sequences around exon 1B. FISH analysis indicated that hypermutation in these genes is not due to chromosomal translocation, as seen in Burkitt lymphoma (OMIM Ref. No. 113970). Chromosomal translocation, however, may be an outcome of hypermutation. Specific features of the hypermutation process, including the predominance of single nucleotide substitutions with occasional deletions or duplications, a preference for transitions over transversions, and a specific motif targeting RGYW, were recognizable in each of the hypermutated loci. Pasqualucci et al. (2001) proposed that aberrant hypermutation of regulatory and coding sequences of genes that do not represent physiologic targets may provide the basis for DLCL pathogenesis and explain its phenotypic and clinical heterogeneity. This hypermutation malfunction is unlikely to be due to defective DNA mismatch repair and does not appear to involve activation-induced deaminase (AICDA; 605257) Animal model experiments lend further support to the function of PAX5. Nutt et al. (1999) demonstrated that pro-B cells lacking Pax5 are incapable of in vitro B-cell differentiation unless Pax5 expression is restored by retroviral transduction. Pax5 -/- pro-B cells are not restricted in their lineage fate, as stimulation with appropriate cytokines induces them to differentiate into functional macrophages, osteoclasts, dendritic cells, granulocytes, and natural killer cells. As expected for a clonogenic hematopoietic progenitor with lymphomyeloid developmental potential, the Pax5 -/- pro-B cell expresses genes of different lineage-affiliated programs, and restoration of Pax5 activity represses this lineage-promiscuous transcription. Pax5 therefore plays an essential role in B-lineage commitment by suppressing alternative lineage choices. Differentiation of the hematopoietic stem cell into distinct blood cell types was thought to progress through intermediate progenitor cells with restricted developmental potential. This view of hematopoiesis was challenged by the findings of Nutt et al. (1999) that the Pax5 -/- pro-B cell possesses, at least under in vitro conditions, a broad, developmental potential similar to that of the hematopoietic stem cell itself. However, Pax5 -/- pro-B cells are unable to differentiate along the erythroid and megakaryocytic lineages, and cannot reconstitute the entire hematopoietic system under transplantation experiments. Therefore, Nutt et al. (1999) concluded that the Pax5 -/- pro-B cell must be classified as a hematopoietic progenitor cell with broad lymphoid and myeloid differentiation potential. Nutt et al. (1999) also concluded that their data supported the notion that B-lineage commitment is a stochastic rather than a deterministic process.

It is appreciated that the abovementioned animal model for PAX5 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pasqualucci, L.; Neumeister, P.; Goossens, T.; Nanjangud, G.; Chaganti, R. S. K.; Kuppers, R.; Dalla-Favera, R.: Hypermutation of multiple proto-oncogenes in B-cell diffuse large-cell lymphomas. Nature 412:341-346, 2001; and Nutt, S. L.; Heavey, B.; Rolink, A. G.; Busslinger, M.: Commitment to the B-lymphoid lineage depends on the transcription factor Pax5. Nature 401:556-562, 1999.

Further studies establishing the function and utilities of PAX5 are found in John Hopkins OMIM database record ID 167414, and in sited publications numbered 10765-10770, 11110, 1077 and 10772-10773 listed in the bibliography section hereinbelow, which are also hereby incorporated by reference. Protocadherin Alpha 1 (PCDHA1, Accession NM_018900) is another VGAM1151 host target gene. PCDHA1 BINDING SITE1 through PCDHA1 BINDING SITE4 are HOST TARGET binding sites found in untranslated regions of mRNA encoded by PCDHA1, corresponding to HOST TARGET binding sites such as BINDING SITE I, BINDING SITE II or BINDING SITE III. Table 2 illustrates the complementarity of the nucleotide sequences of PCDHA1 BINDING SITE1 through PCDHA1 BINDING SITE4, designated SEQ ID:20866, SEQ ID:20869, SEQ ID:25385 and SEQ ID:25388 respectively, to the nucleotide sequence of VGAM1151 RNA, herein designated VGAM RNA, also designated SEQ ID:3862.

Another function of VGAM1151 is therefore inhibition of Protocadherin Alpha 1 (PCDHA1, Accession NM_018900). Accordingly, utilities of VGAM1151 include diagnosis, prevention and treatment of diseases and clinical conditions associated with PCDHA1. Protocadherin Alpha 10 (PCDHA10, Accession NM_031860) is another VGAM1151 host target gene. PCDHA10 BINDING SITE1 through PCDHA10 BINDING SITE4 are HOST TARGET binding sites found in untranslated regions of mRNA encoded by PCDHA10, corresponding to HOST TARGET binding sites such as BINDING SITE I, BINDING SITE II or BINDING SITE III. Table 2 illustrates the complementarity of the nucleotide sequences of PCDHA10 BINDING SITE1 through PCDHA10 BINDING SITE4, designated SEQ ID:25620, SEQ ID:20876, SEQ ID:20879 and SEQ ID:20886 respectively, to the nucleotide sequence of VGAM1151 RNA, herein designated VGAM RNA, also designated SEQ ID:3862.

Another function of VGAM1151 is therefore inhibition of Protocadherin Alpha 10 (PCDHA10, Accession NM_031860). Accordingly, utilities of VGAM1151 include diagnosis, prevention and treatment of diseases and clinical conditions associated with PCDHA10. Protocadherin Alpha 12 (PCDHA12, Accession NM_018903) is another VGAM1151 host target gene. PCDHA12 BINDING SITE1 and PCDHA12 BINDING SITE2 are HOST TARGET binding sites found in untranslated regions of mRNA encoded by PCDHA12, corresponding to HOST TARGET binding sites such as BINDING SITE I, BINDING SITE II or BINDING SITE III. Table 2 illustrates the complementarity of the nucleotide sequences of PCDHA12 BINDING SITE1 and PCDHA12 BINDING SITE2, designated SEQ ID:20897 and SEQ ID:20900 respectively, to the nucleotide sequence of VGAM1151 RNA, herein designated VGAM RNA, also designated SEQ ID:3862.

Another function of VGAM1151 is therefore inhibition of Protocadherin Alpha 12 (PCDHA12, Accession NM_018903). Accordingly, utilities of VGAM1151 include diagnosis, prevention and treatment of diseases and clinical conditions associated with PCDHA12. Protocadherin Alpha 13 (PCDHA13, Accession NM_018904) is another VGAM1151 host target gene. PCDHA13 BINDING SITE1 and PCDHA13 BINDING SITE2 are HOST TARGET binding sites found in untranslated regions of mRNA encoded by PCDHA13, corresponding to HOST TARGET binding sites such as BINDING SITE I, BINDING SITE II or BINDING SITE III. Table 2 illustrates the complementarity of the nucleotide sequences of PCDHA13 BINDING SITE1 and PCDHA13 BINDING SITE2, designated SEQ ID:20910 and SEQ ID:20917 respectively, to the nucleotide sequence of VGAM1151 RNA, herein designated VGAM RNA, also designated SEQ ID:3862.

Another function of VGAM1151 is therefore inhibition of Protocadherin Alpha 13 (PCDHA13, Accession NM_018904). Accordingly, utilities of VGAM1151 include diagnosis, prevention and treatment of diseases and clinical conditions associated with PCDHA13. Protocadherin Alpha 3 (PCDHA3, Accession NM_018906) is another VGAM1151 host target gene. PCDHA3 BINDING SITE1 and PCDHA3 BINDING SITE2 are HOST TARGET binding sites found in untranslated regions of mRNA encoded by PCDHA3, corresponding to HOST TARGET binding sites such as BINDING SITE I, BINDING SITE II or BINDING SITE III. Table 2 illustrates the complementarity of the nucleotide sequences of PCDHA3 BINDING SITE1 and PCDHA3 BINDING SITE2, designated SEQ ID:20927 and SEQ ID:20930 respectively, to the nucleotide sequence of VGAM1151 RNA, herein designated VGAM RNA, also designated SEQ ID:3862.

Another function of VGAM1151 is therefore inhibition of Protocadherin Alpha 3 (PCDHA3, Accession NM_018906). Accordingly, utilities of VGAM1151 include diagnosis, prevention and treatment of diseases and clinical conditions associated with PCDHA3. Protocadherin Alpha 4 (PCDHA4, Accession NM_018907) is another VGAM1151 host target gene. PCDHA4 BINDING SITE1 and PCDHA4 BINDING SITE2 are HOST TARGET binding sites found in untranslated regions of mRNA encoded by PCDHA4, corresponding to HOST TARGET binding sites such as BINDING SITE I, BINDING SITE II or BINDING SITE III. Table 2 illustrates the complementarity of the nucleotide sequences of PCDHA4 BINDING SITE1 and PCDHA4 BINDING SITE2, designated SEQ ID:20940 and SEQ ID:20947 respectively, to the nucleotide sequence of VGAM1151 RNA, herein designated VGAM RNA, also designated SEQ ID:3862.

Another function of VGAM1151 is therefore inhibition of Protocadherin Alpha 4 (PCDHA4, Accession NM_018907). Accordingly, utilities of VGAM1151 include diagnosis, prevention and treatment of diseases and clinical conditions associated with PCDHA4. Protocadherin Alpha 6 (PCDHA6, Accession NM_018909) is another VGAM1151 host target gene. PCDHA6 BINDING SITE1 through PCDHA6 BINDING SITE4 are HOST TARGET binding sites found in untranslated regions of mRNA encoded by PCDHA6, corresponding to HOST TARGET binding sites such as BINDING SITE I, BINDING SITE II or BINDING SITE III. Table 2 illustrates the complementarity of the nucleotide sequences of PCDHA6 BINDING SITE1 through PCDHA6 BINDING SITE4, designated SEQ ID:20957, SEQ ID:20960, SEQ ID:25589 and SEQ ID:25592 respectively, to the nucleotide sequence of VGAM1151 RNA, herein designated VGAM RNA, also designated SEQ ID:3862.

Another function of VGAM1151 is therefore inhibition of Protocadherin Alpha 6 (PCDHA6, Accession NM_018909). Accordingly, utilities of VGAM1151 include diagnosis, prevention and treatment of diseases and clinical conditions associated with PCDHA6. Protocadherin Alpha 7 (PCDHA7, Accession NM_018910) is another VGAM1151 host target gene. PCDHA7 BINDING SITE1 and PCDHA7 BINDING SITE2 are HOST TARGET binding sites found in untranslated regions of mRNA encoded by PCDHA7, corresponding to HOST TARGET binding sites such as BINDING SITE I, BINDING SITE II or BINDING SITE III. Table 2 illustrates the complementarity of the nucleotide sequences of PCDHA7 BINDING SITE1 and PCDHA7 BINDING SITE2, designated SEQ ID:20970 and SEQ ID:20977 respectively, to the nucleotide sequence of VGAM1151 RNA, herein designated VGAM RNA, also designated SEQ ID:3862.

Another function of VGAM1151 is therefore inhibition of Protocadherin Alpha 7 (PCDHA7, Accession NM_018910). Accordingly, utilities of VGAM1151 include diagnosis, prevention and treatment of diseases and clinical conditions associated with PCDHA7. Protocadherin Alpha 9 (PCDHA9, Accession NM_031857) is another VGAM1151 host target gene. PCDHA9 BINDING SITE1 and PCDHA9 BINDING SITE2 are HOST TARGET binding sites found in untranslated regions of mRNA encoded by PCDHA9, corresponding to HOST TARGET binding sites such as BINDING SITE I, BINDING SITE II or BINDING SITE III. Table 2 illustrates the complementarity of the nucleotide sequences of PCDHA9 BINDING SITE1 and PCDHA9 BINDING SITE2, designated SEQ ID:25603 and SEQ ID:25606 respectively, to the nucleotide sequence of VGAM1151 RNA, herein designated VGAM RNA, also designated SEQ ID:3862.

Another function of VGAM1151 is therefore inhibition of Protocadherin Alpha 9 (PCDHA9, Accession NM_031857), a gene which is a calcium-dependent cell-adhesion protein. Accordingly, utilities of VGAM1151 include diagnosis, prevention and treatment of diseases and clinical conditions associated with PCDHA9. The function of PCDHA9 and its association with various diseases and clinical conditions, has been established by previous studies, as described hereinabove with reference to VGAM71. Protocadherin Alpha Subfamily C, 1 (PCDHAC1, Accession NM_018898) is another VGAM1151 host target gene. PCDHAC1 BINDING SITE1 and PCDHAC1 BINDING SITE2 are HOST TARGET binding sites found in untranslated regions of mRNA encoded by PCDHAC1, corresponding to HOST TARGET binding sites such as BINDING SITE I, BINDING SITE II or BINDING SITE III. Table 2 illustrates the complementarity of the nucleotide sequences of PCDHAC1 BINDING SITE1 and PCDHAC1 BINDING SITE2, designated SEQ ID:20849 and SEQ ID:20856 respectively, to the nucleotide sequence of VGAM1151 RNA, herein designated VGAM RNA, also designated SEQ ID:3862.

Another function of VGAM1151 is therefore inhibition of Protocadherin Alpha Subfamily C, 1 (PCDHAC1, Accession NM_018898). Accordingly, utilities of VGAM1151 include diagnosis, prevention and treatment of diseases and clinical conditions associated with PCDHAC1. PCTAIRE Protein Kinase 1 (PCTK1, Accession NM_006201) is another VGAM1151 host target gene. PCTK1 BINDING SITE1 through PCTK1 BINDING SITE3 are HOST TARGET binding sites found in untranslated regions of mRNA encoded by PCTK1, corresponding to HOST TARGET binding sites such as BINDING SITE I, BINDING SITE II or BINDING SITE III. Table 2 illustrates the complementarity of the nucleotide sequences of PCTK1 BINDING SITE1 through PCTK1 BINDING SITE3, designated SEQ ID:12872, SEQ ID:26907 and SEQ ID:26913 respectively, to the nucleotide sequence of VGAM1151 RNA, herein designated VGAM RNA, also designated SEQ ID:3862.

Another function of VGAM1151 is therefore inhibition of PCTAIRE Protein Kinase 1 (PCTK1, Accession NM_006201), a gene which may play a role in signal transduction cascades in terminally differentiated cells. Accordingly, utilities of VGAM1151 include diagnosis, prevention and treatment of diseases and clinical conditions associated with PCTK1. The function of PCTK1 and its association with various diseases and clinical conditions, has been established by previous studies, as described hereinabove with reference to VGAM75. Palmitoyl-protein Thioesterase 2 (PPT2, Accession NM_138934) is another VGAM1151 host target gene. PPT2 BINDING SITE is HOST TARGET binding site found in the 3' untranslated region of mRNA encoded by PPT2, corresponding to a HOST TARGET binding site such as BINDING SITE I, BINDING SITE II or BINDING SITE III. Table 2 illustrates the complementarity of the nucleotide sequences of PPT2 BINDING SITE, designated SEQ ID:29061, to the nucleotide sequence of VGAM1151 RNA, herein designated VGAM RNA, also designated SEQ ID:3862.

Another function of VGAM1151 is therefore inhibition of Palmitoyl-protein Thioesterase 2 (PPT2, Accession NM_138934), a gene which is a palmitoyl-protein thioesterase 2 which possesses a different substrate specificity than PPT1. Accordingly, utilities of VGAM1151 include diagnosis, prevention and treatment of diseases and clinical conditions associated with PPT2. The function of PPT2 and its association with various diseases and clinical conditions, has been established by previous studies, as described hereinabove with reference to VGAM120. Protein Tyrosine Kinase 2 Beta (PTK2B, Accession NM_004103) is another VGAM1151 host target gene. PTK2B BINDING SITE is HOST TARGET binding site found in the 3' untranslated region of mRNA encoded by PTK2B, corresponding to a HOST TARGET binding site such as BINDING SITE I, BINDING SITE II or BINDING SITE III. Table 2 illustrates the complementarity of the nucleotide sequences of PTK2B BINDING SITE, designated SEQ ID:10313, to the nucleotide sequence of VGAM1151 RNA, herein designated VGAM RNA, also designated SEQ ID:3862.

Another function of VGAM1151 is therefore inhibition of Protein Tyrosine Kinase 2 Beta (PTK2B, Accession NM_004103), a gene which is involved in calcium induced regulation of ion channel and activation of the map kinase signaling pathway. Accordingly, utilities of VGAM1151 include diagnosis, prevention and treatment of diseases and clinical conditions associated with PTK2B. The function of PTK2B and its association with various diseases and clinical conditions, has been established by previous studies, as described hereinabove with reference to VGAM555. Runt-related Transcription Factor 3 (RUNX3, Accession NM_004350) is another VGAM1151 host target gene. RUNX3 BINDING SITE is HOST TARGET binding site found in the 3' untranslated region of mRNA encoded by RUNX3, corresponding to a HOST TARGET binding site such as BINDING SITE I, BINDING SITE II or BINDING SITE III. Table 2 illustrates the complementarity of the nucleotide sequences of RUNX3 BINDING SITE, designated SEQ ID:10550, to the nucleotide sequence of VGAM1151 RNA, herein designated VGAM RNA, also designated SEQ ID:3862.

Another function of VGAM1151 is therefore inhibition of Runt-related Transcription Factor 3 (RUNX3, Accession NM_004350), a gene which binds to the core site, 5'-pyg-pyggt-3', of a number of enhancers and promoters. Accordingly, utilities of VGAM1151 include diagnosis, prevention and treatment of diseases and clinical conditions associated with RUNX3. The function of RUNX3 has been established by previous studies. Levanon et al. (1994) isolated and characterized cDNAs corresponding to 3 human 'runt domain'-containing genes: AML1 (RUNX1; 151385), CBFA3, and CBFA1 (RUNX2; 600211). In addition to homology in the highly conserved runt domain, extensive sequence similarities were also observed in other parts of the deduced proteins. All 3 genes carried an identical putative ATP-binding site, -GRSGRGKS-, and their C-terminal halves were particularly rich in proline and serine residues. AML1 cDNAs had been cloned by others, whereas CBFA3 represented a new member of the runt domain gene family, and CBFA1 was identified as the human homolog of the mouse PEBP2A gene. Bae et al. (1995) also cloned and characterized RUNX3, which they termed PEBP2-alpha-C. By genomic sequence analysis, Bae et al. (1995) determined that the RUNX3 gene contains at least 5 exons. By fluorescence in situ hybridization, Levanon et al. (1994) mapped the CBFA3 gene to 1p36. By FISH, Bae et al. (1995) mapped the RUNX3 gene to 1p36.13-p36.11. Avraham et al. (1995) mapped the homologous gene to mouse chromosome 4. By Southern blot analysis of hybrid cell lines containing different parts of human chromosome 1 and by fluorescence in situ hybridization, Wijmenga et al. (1995) assigned the CBFA3 gene to 1p35-pter. Li et al. (2002) showed that between 45 and 60% of human gastric cancer (OMIM Ref. No. 137215) cells do not significantly express RUNX3 due to hemizygous deletion and hypermethylation of the RUNX3 promoter region. Tumorigenicity of human gastric cancer cell lines in nude mice was inversely related to their level of RUNX3 expression. The authors identified a heterozygous C-to-T transition in the RUNX3 gene, resulting in an arg122-to-cys (R122C) change within the conserved Runt domain of the protein, in 1 gastric carcinoma tissue of 119 examined. Arginine at position 122 is conserved in both nematodes and human S. A tumorigenesis assay in nude mice showed that the R122C change abolished the tumor-suppressive effect of RUNX3, suggesting that a lack of RUNX3 function is causally related to the genesis and progression of human gastric cancer. However, matching normal tissue was not available in this case and therefore it was not possible to establish whether the observed R122C change was a single-nucleotide polymorphism or a true mutation. Animal model experiments lend further support to the function of RUNX3. Li et al. (2002) generated mice with a targeted disruption of the Runx3 gene. The gastric mucosa of these mice exhibited hyperplasias due to stimulated proliferation and suppressed apoptosis in epithelial cells, and the cells were resistant to growth-inhibitory and apoptosis-inducing actions of transforming growth factor-beta (OMIM Ref. No. 190180), indicating that Runx3 is a major growth regulator of gastric epithelial cells. Inoue et al. (2002) generated Runx3-deficient mice and showed that proprioceptive afferent axons failed to project to their targets in the spinal cord as well as those in the muscle. In contrast, the afferent projections that convey nociception, thermoreception, and mechanoreception signals appeared normal. The mutant mice displayed severe limb ataxia and motor discoordination similar to that of Etv1 (OMIM Ref. No. 600541) mutant mice. Inoue et al. (2002) concluded that Runx3 is critical in regulating a subpopulation of dorsal root ganglion neurons.

It is appreciated that the abovementioned animal model for RUNX3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Li, Q.-L.; Ito, K.; Sakakura, C.; Fukamachi, H.; Inoue, K.; Chi, X.-Z.; Lee, K.-Y.; Nomura, S.; Lee, C.-W.; Han, S.-B.; Kim, H.-M.; Kim, W.-J.; and 15 others: Causal relationship between the loss of RUNX3 expression and gastric cancer. Cell 109:113-124, 2002; and Wijmenga, C.; Speck, N. A.; Dracopoli, N. C.; Hofker, M. H.; Liu, P.; Collins, F. S.: Identification of a new murine runt domain-containing gene, Cbfa3, and localization of the human h.

Further studies establishing the function and utilities of RUNX3 are found in John Hopkins OMIM database record ID 600210, and in sited publications numbered 1622-162 and 1630-1626 listed in the bibliography section hereinbelow, which are also hereby incorporated by reference. SH3-domain Binding Protein 5 (BTK-associated) (SH3BP5, Accession NM_004844) is another VGAM1151 host target gene. SH3BP5 BINDING SITE is HOST TARGET binding site found in the 3' untranslated region of mRNA encoded by SH3BP5, corresponding to a HOST TARGET binding site such as BINDING SITE I, BINDING SITE II or BINDING SITE III. Table 2 illustrates the complementarity of the nucleotide sequences of SH3BP5 BINDING SITE, designated SEQ ID:11257, to the nucleotide sequence of VGAM1151 RNA, herein designated VGAM RNA, also designated SEQ ID:3862.

Another function of VGAM1151 is therefore inhibition of SH3-domain Binding Protein 5 (BTK-associated) (SH3BP5, Accession NM_004844), a gene which plays a negative regulatory role in btk-related cytoplasmic signaling in b cells. Accordingly, utilities of VGAM1151 include diagnosis, prevention and treatment of diseases and clinical conditions associated with SH3BP5. The function of SH3BP5 has been established by previous studies. Bruton tyrosine kinase (BTK; 300300) is a cytoplasmic tyrosine kinase crucial for the maturation of B-lineage cells. BTK deficiency is involved in the pathogenesis of X-linked immunodeficiency. By Far Western expression cloning using a human placenta cDNA library for molecules associated with the SH3 domain of BTK, followed by screening brain and B-cell cDNA libraries, Matsushita et al. (1998) obtained a cDNA encoding SH3BP5, which they termed SAB (SH3 domain-binding protein that preferentially associates with BTK). SH3BP5 encodes a deduced 425-amino acid protein. Northern blot analysis revealed wide expression of a 3.0-kb transcript, with especially prominent expression in testis and ovary. Immunoblot analysis showed that SH3BP5 is expressed as a 70-kD protein. Immunoprecipitation analysis suggested that SH3BP5 interacts with BTK in cells. Mutational and immunoblot analyses showed that amino acids 163 to 193 of SH3BP5 bind most strongly to the SH3 domain of BTK and not with the SH3 domains of a number of other cytoplasmic tyrosine kinases. Using immunoprecipitation and functional analysis, Yamadori et al. (1999) demonstrated that SH3BP5 inhibits BTK activity by binding to the enzyme.

Full details of the abovementioned studies are described in the following publications, the disclosure of which are hereby incorporated by reference:

Matsushita, M.; Yamadori, T.; Kato, S.; Takemoto, Y.; Inazawa, J.; Baba, Y.; Hashimoto, S.; Sekine, S.; Arai, S.; Kunikata, T.; Kurimoto, M.; Kishimoto, T.; Tsukada, S.: Identification and characterization of a novel SH3-domain binding protein, Sab, which preferentially associates with Bruton's tyrosine kinase (Btk). Biochem. Biophys. Res. Commun. 245:337-343, 1998; and Yamadori, T.; Baba, Y.; Matsushita, M.; Hashimoto, S.; Kurosaki, M.; Kurosaki, T.; Kishimoto, T.; Tsukada, S.: Bruton's tyrosine kinase activity is negatively regulated by Sab, the Btk-SH.

Further studies establishing the function and utilities of SH3BP5 are found in John Hopkins OMIM database record ID 605612, and in sited publications numbered 6772-677 and 6770 listed in the bibliography section hereinbelow, which are also hereby incorporated by reference. Sine Oculis Homeobox Homolog 2 (Drosophila) (SIX2, Accession NM_016932) is another VGAM1151 host target gene. SIX2 BINDING SITE is HOST TARGET binding site found in the 3' untranslated region of mRNA encoded by SIX2, corresponding to a HOST TARGET binding site such as BINDING SITE I, BINDING SITE II or BINDING SITE III. Table 2 illustrates the complementarity of the nucleotide sequences of SIX2 BINDING SITE, designated SEQ ID:18850, to the nucleotide sequence of VGAM1151 RNA, herein designated VGAM RNA, also designated SEQ ID:3862.

Another function of VGAM1151 is therefore inhibition of Sine Oculis Homeobox Homolog 2 (Drosophila) (SIX2, Accession NM_016932), a gene which may be involved in limb tendon and ligament development (by similarity). Accordingly, utilities of VGAM1151 include diagnosis, prevention and treatment of diseases and clinical conditions associated with SIX2. The function of SIX2 has been established by previous studies. By screening a human genomic library with a human SIX1 cDNA (OMIM Ref. No. 601205), Boucher et al. (2000) identified the SIX2 gene. Using the SIX2 genomic sequence, they isolated a human fetus SIX2 cDNA. The predicted 291-amino acid SIX2 protein contains a SIX domain and a homeodomain. The human SIX2 protein is almost identical to the mouse Six2 protein. Northern blot analysis of human tissues detected strong expression of a major 2.2-kb SIX2 transcript in skeletal muscle, with weaker expression in pancreas. RT-PCR showed SIX2 expression in all human fetal tissues tested except lung. In adult tissues, RT-PCR revealed SIX2 expression in skeletal muscle, pancreas, ovary, and sclera; SIX2 expression was not detected in other regions of the adult eye and optic nerve or in adult heart, lung, kidney, liver, or breast. Boucher et al. (2000) determined that the human SIX2 gene contains 2 exons.

Full details of the abovementioned studies are described in the following publications, the disclosure of which are hereby incorporated by reference:

Boucher, C. A.; Winchester, C. L.; Hamilton, G. M.; Winter, A. D.; Johnson, K. J.; Bailey, M. E. S.: Structure, mapping and expression of the human gene encoding the homeodomain protein, SIX2. Gene 247:145-151, 2000; and Oliver, G.; Wehr, R.; Jenkins, N. A.; Copeland, N. G.; Cheyette, B. N. R.; Hartenstein, V.; Zipursky, S. L.; Gruss, P.: Homeobox genes and connective tissue patterning. Development 12.

Further studies establishing the function and utilities of SIX2 are found in John Hopkins OMIM database record ID 604994, and in sited publications numbered 7101 listed in the bibliography section hereinbelow, which are also hereby incorporated by reference. Solute Carrier Family 7 (cationic amino acid transporter, y+ system), Member 6 (SLC7A6, Accession NM_003983) is another VGAM1151 host target gene. SLC7A6 BINDING SITE is HOST TARGET binding site found in the 3' untranslated region of mRNA encoded by SLC7A6, corresponding to a HOST TARGET binding site such as BINDING SITE I, BINDING SITE II or BINDING SITE III. Table 2 illustrates the complementarity of the nucleotide sequences of SLC7A6 BINDING SITE, designated SEQ ID:10129, to the nucleotide sequence of VGAM1151 RNA, herein designated VGAM RNA, also designated SEQ ID:3862.

Another function of VGAM1151 is therefore inhibition of Solute Carrier Family 7 (cationic amino acid transporter, y+ system), Member 6 (SLC7A6, Accession NM_003983), a gene which is involved in mediating amino acid transport. Accordingly, utilities of VGAM1151 include diagnosis, prevention and treatment of diseases and clinical conditions associated with SLC7A6. The function of SLC7A6 and its association with various diseases and clinical conditions, has been established by previous studies, as described hereinabove with reference to VGAM87. Transducin (beta)-like 1X-linked (TBL1X, Accession NM_005647) is another VGAM1151 host target gene. TBL1X BINDING SITE is HOST TARGET binding site found in the 3' untranslated region of mRNA encoded by TBL1X, corresponding to a HOST TARGET binding site such as BINDING SITE I, BINDING SITE II or BINDING SITE III. Table 2 illustrates the complementarity of the nucleotide sequences of TBL1X BINDING SITE, designated SEQ ID:12183, to the nucleotide sequence of VGAM1151 RNA, herein designated VGAM RNA, also designated SEQ ID:3862.

Another function of VGAM1151 is therefore inhibition of Transducin (beta)-like 1X-linked (TBL1X, Accession NM_005647), a gene which activates latent HDAC3 activity. Accordingly, utilities of VGAM1151 include diagnosis, prevention and treatment of diseases and clinical conditions associated with TBL1X. The function of TBL1X has been established by previous studies. In the course of constructing a deletion map of the distal portion of the short arm of the X chromosome and the identification of the OA1 gene (OMIM Ref. No. 300500), Bassi et al. (1999) performed cDNA selection experiments that resulted in the isolation of a novel gene, TBL1, located outside the OA1 critical region on the telomeric side. The TBL1 gene maps to the Xp22.3 region and shares significant homology with members of the WD40 repeat-containing protein family. The open reading frame encodes a 526-amino acid protein containing 6 beta-transducin repeats (WD40 motif) in the C-terminal domain. The homology with known beta-subunits of G proteins and other WD40 repeat-containing proteins is restricted to the WD40 motif. Northern blot analysis indicated that the TBL1 gene is ubiquitously expressed as 2 transcripts of approximately 2.1 and 6.0 kb. Matsuzawa and Reed (2001) elucidated a network of protein interactions in which SIAH1 (OMIM Ref. No. 602212), SIP (OMIM Ref. No. 606186), SKP1 (OMIM Ref. No. 601434), and EBI collaborate in a pathway controlling beta-catenin (OMIM Ref. No. 116806) levels, affecting activity of beta-catenin-dependent TCF (e.g., TCF1; 142410) and LEF (e.g., LEF1; 153245) transcription factors. This pathway is inducible by p53 (OMIM Ref. No. 191170), revealing a link between genotoxic injury responses and beta-catenin degradation. SIAH1 is physically linked to EBI by association with SIP, which binds SKP1.

Full details of the abovementioned studies are described in the following publications, the disclosure of which are hereby incorporated by reference:

Bassi, M. T.; Ramesar, R. S.; Caciotti, B.; Winship, I. M.; De Grandi, A.; Riboni, M.; Townes, P. L.; Beighton, P.; Ballabio, A.; Borsani, G.: X-linked late-onset sensorineural deafness caused by a deletion involving OA1 and a novel gene containing WD-40 repeats. Am. J. Hum. Genet. 64:1604-1616, 1999; and Matsuzawa, S.; Reed, J. C.: Siah-1, SIP, and Ebi collaborate in a novel pathway for beta-catenin degradation linked to p53 responses. Molec. Cell 7:915-926, 2001.

Further studies establishing the function and utilities of TBL1X are found in John Hopkins OMIM database record ID 300196, and in sited publications numbered 11395-11398, 725 and 11399-11400 listed in the bibliography section hereinbelow, which are also hereby incorporated by reference. Transforming Growth Factor, Beta Receptor II (70/80 kDa) (TGFBR2, Accession NM_003242) is another VGAM1151 host target gene. TGFBR2 BINDING SITE is HOST TARGET binding site found in the 3' untranslated region of mRNA encoded by TGFBR2, corresponding to a HOST TARGET binding site such as BINDING SITE I, BINDING SITE II or BINDING SITE III. Table 2 illustrates the complementarity of the nucleotide sequences of TGFBR2 BINDING SITE, designated SEQ ID:9239, to the nucleotide sequence of VGAM1151 RNA, herein designated VGAM RNA, also designated SEQ ID:3862.

Another function of VGAM1151 is therefore inhibition of Transforming Growth Factor, Beta Receptor II (70/80 kDa) (TGFBR2, Accession NM_003242). Accordingly, utilities of VGAM1151 include diagnosis, prevention and treatment of diseases and clinical conditions associated with TGFBR2. Tumor Necrosis Factor (ligand) Superfamily, Member 5 (hyper-IgM syndrome) (TNFSF5, Accession NM_000074) is another VGAM1151 host target gene. TNFSF5 BINDING SITE is HOST TARGET binding site found in the 3' untranslated region of mRNA encoded by TNFSF5, corresponding to a HOST TARGET binding site such as BINDING SITE I, BINDING SITE II or BINDING SITE III. Table 2 illustrates the complementarity of the nucleotide sequences of TNFSF5 BINDING SITE, designated SEQ ID:5519, to the nucleotide sequence of VGAM1151 RNA, herein designated VGAM RNA, also designated SEQ ID:3862.

Another function of VGAM1151 is therefore inhibition of Tumor Necrosis Factor (ligand) Superfamily, Member 5 (hyper-IgM syndrome) (TNFSF5, Accession NM_000074). Accordingly, utilities of VGAM1151 include diagnosis, prevention and treatment of diseases and clinical conditions associated with TNFSF5. Trichorhinophalangeal Syndrome I (TRPS1, Accession NM_014112) is another VGAM1151 host target gene. TRPS1 BINDING SITE is HOST TARGET binding site found in the 5' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15352, to the nucleotide sequence of VGAM1151 RNA, herein designated VGAM RNA, also designated SEQ ID:3862.

Another function of VGAM1151 is therefore inhibition of Trichorhinophalangeal Syndrome I (TRPS1, Accession NM_014112), a gene which may function as a transcriptional activator protein. Accordingly, utilities of VGAM1151 include diagnosis, prevention and treatment of diseases and clinical conditions associated with TRPS1. The function of TRPS1 and its association with various diseases and clinical conditions, has been established by previous studies, as described hereinabove with reference to VGAM172. ARP1 Actin-related Protein 1 Homolog A, Centractin Alpha (yeast) (ACTR1A, Accession XM_031949) is another VGAM1151 host target gene. ACTR1A BINDING SITE is HOST TARGET binding site found in the 3' untranslated region of mRNA encoded by ACTR1A, corresponding to a HOST TARGET binding site such as BINDING SITE I, BINDING SITE II or BINDING SITE III. Table 2 illustrates the complementarity of the nucleotide sequences of ACTR1A BINDING SITE, designated SEQ ID:31535, to the nucleotide sequence of VGAM1151 RNA, herein designated VGAM RNA, also designated SEQ ID:3862.

Another function of VGAM1151 is therefore inhibition of ARP1 Actin-related Protein 1 Homolog A, Centractin Alpha (yeast) (ACTR1A, Accession XM_031949). Accordingly, utilities of VGAM1151 include diagnosis, prevention and treatment of diseases and clinical conditions associated with ACTR1A. BCL2-like 1 (BCL2L1, Accession NM_138578) is another VGAM1151 host target gene. BCL2L1 BINDING SITE is HOST TARGET binding site found in the 3' untranslated region of mRNA encoded by BCL2L1, corresponding to a HOST TARGET binding site such as BINDING SITE I, BINDING SITE II or BINDING SITE III. Table 2 illustrates the complementarity of the nucleotide sequences of BCL2L1 BINDING SITE, designated SEQ ID:28893, to the nucleotide sequence of VGAM1151 RNA, herein designated VGAM RNA, also designated SEQ ID:3862.

Another function of VGAM1151 is therefore inhibition of BCL2-like 1 (BCL2L1, Accession NM_138578). Accordingly, utilities of VGAM1151 include diagnosis, prevention and treatment of diseases and clinical conditions associated with BCL2L1. Baculoviral IAP Repeat-containing 5 (survivin) (BIRC5, Accession NM_001168) is another VGAM1151 host target gene. BIRC5 BINDING SITE is HOST TARGET binding site found in the 3' untranslated region of mRNA encoded by BIRC5, corresponding to a HOST TARGET binding site such as BINDING SITE I, BINDING SITE II or BINDING SITE III. Table 2 illustrates the complementarity of the nucleotide sequences of BIRC5 BINDING SITE, designated SEQ ID:6836, to the nucleotide sequence of VGAM1151 RNA, herein designated VGAM RNA, also designated SEQ ID:3862.

Another function of VGAM1151 is therefore inhibition of Baculoviral IAP Repeat-containing 5 (survivin) (BIRC5, Accession NM_001168). Accordingly, utilities of VGAM1151 include diagnosis, prevention and treatment of diseases and clinical conditions associated with BIRC5. Complement Component 1, Q Subcomponent, Receptor 1 (C1QR1, Accession NM_012072) is another VGAM1151 host target gene. C1QR1 BINDING SITE is HOST TARGET binding site found in the 3' untranslated region of mRNA encoded by C1QR1, corresponding to a HOST TARGET binding site such as BINDING SITE I, BINDING SITE II or BINDING SITE III. Table 2 illustrates the complementarity of the nucleotide sequences of C1QR1 BINDING SITE, designated SEQ ID:14333, to the nucleotide sequence of VGAM1151 RNA, herein designated VGAM RNA, also designated SEQ ID:3862.

Another function of VGAM1151 is therefore inhibition of Complement Component 1, Q Subcomponent, Receptor 1 (C1QR1, Accession NM_012072). Accordingly, utilities of VGAM1151 include diagnosis, prevention and treatment of diseases and clinical conditions associated with C1QR1. Chromosome 20 Open Reading Frame 139 (C20orf139, Accession XM_097749) is another VGAM1151 host target gene. C20orf139 BINDING SITE is HOST TARGET binding site found in the 3" untranslated region of mRNA encoded by C20orf139, corresponding to a HOST TARGET binding site such as BINDING SITE I, BINDING SITE II or BINDING SITE III. Table 2 illustrates the complementarity of the nucleotide sequences of C20orf139 BINDING SITE, designated SEQ ID:41105, to the nucleotide sequence of VGAM1151 RNA, herein designated VGAM RNA, also designated SEQ ID:3862.

Another function of VGAM1151 is therefore inhibition of Chromosome 20 Open Reading Frame 139 (C20orf139, Accession XM_097749). Accordingly, utilities of VGAM1151 include diagnosis, prevention and treatment of diseases and clinical conditions associated with C20orf139. Chromosome 6 Open Reading Frame 9 (C6orf9, Accession NM_022107) is another VGAM1151 host target gene.

C6orf9 BINDING SITE is HOST TARGET binding site found in the 3' untranslated region of mRNA encoded by C6orf9, corresponding to a HOST TARGET binding site such as BINDING SITE I, BINDING SITE II or BINDING SITE III. Table 2 illustrates the complementarity of the nucleotide sequences of C6orf9 BINDING SITE, designated SEQ ID:22656, to the nucleotide sequence of VGAM1151 RNA, herein designated VGAM RNA, also designated SEQ ID:3862.

Another function of VGAM1151 is therefore inhibition of Chromosome 6 Open Reading Frame 9 (C6orf9, Accession NM_022107). Accordingly, utilities of VGAM1151 include diagnosis, prevention and treatment of diseases and clinical conditions associated with C6orf9. CRK7 (Accession NM_016507) is another VGAM1151 host target gene. CRK7 BINDING SITE1 and CRK7 BINDING SITE2 are HOST TARGET binding sites found in untranslated regions of mRNA encoded by CRK7, corresponding to HOST TARGET binding sites such as BINDING SITE I, BINDING SITE II or BINDING SITE III. Table 2 illustrates the complementarity of the nucleotide sequences of CRK7 BINDING SITE1 and CRK7 BINDING SITE2, designated SEQ ID:18586 and SEQ ID:18585 respectively, to the nucleotide sequence of VGAM1151 RNA, herein designated VGAM RNA, also designated SEQ ID:3862.

Another function of VGAM1151 is therefore inhibition of CRK7 (Accession NM_016507). Accordingly, utilities of VGAM1151 include diagnosis, prevention and treatment of diseases and clinical conditions associated with CRK7. DCMP Deaminase (DCTD, Accession NM_001921) is another VGAM1151 host target gene. DCTD BINDING SITE is HOST TARGET binding site found in the 3' untranslated region of mRNA encoded by DCTD, corresponding to a HOST TARGET binding site such as BINDING SITE I, BINDING SITE II or BINDING SITE III. Table 2 illustrates the complementarity of the nucleotide sequences of DCTD BINDING SITE, designated SEQ ID:7637, to the nucleotide sequence of VGAM1151 RNA, herein designated VGAM RNA, also designated SEQ ID:3862.

Another function of VGAM1151 is therefore inhibition of DCMP Deaminase (DCTD, Accession NM_001921). Accordingly, utilities of VGAM1151 include diagnosis, prevention and treatment of diseases and clinical conditions associated with DCTD. FLJ12572 (Accession NM_022905) is another VGAM1151 host target gene. FLJ12572 BINDING SITE is HOST TARGET binding site found in the 3' untranslated region of mRNA encoded by FLJ12572, corresponding to a HOST TARGET binding site such as BINDING SITE I, BINDING SITE II or BINDING SITE III. Table 2 illustrates the complementarity of the nucleotide sequences of FLJ12572 BINDING SITE, designated SEQ ID:23202, to the nucleotide sequence of VGAM1151 RNA, herein designated VGAM RNA, also designated SEQ ID:3862.

Another function of VGAM1151 is therefore inhibition of FLJ12572 (Accession NM_022905). Accordingly, utilities of VGAM1151 include diagnosis, prevention and treatment of diseases and clinical conditions associated with FLJ12572. FLJ13154 (Accession NM_024598) is another VGAM1151 host target gene. FLJ13154 BINDING SITE1 through FLJ13154 BINDING SITE9 are HOST TARGET binding sites found in untranslated regions of mRNA encoded by FLJ13154, corresponding to HOST TARGET binding sites such as BINDING SITE I, BINDING SITE II or BINDING SITE III. Table 2 illustrates the complementarity of the nucleotide sequences of FLJ13154 BINDING SITE1 through FLJ13154 BINDING SITE9, designated SEQ ID:23837, SEQ ID:23838, SEQ ID:23839, SEQ ID:23840, SEQ ID:23841, SEQ ID:23842, SEQ ID:23843, SEQ ID:23845 and SEQ ID:23846 respectively, to the nucleotide sequence of VGAM1151 RNA, herein designated VGAM RNA, also designated SEQ ID:3862.

Another function of VGAM1151 is therefore inhibition of FLJ13154 (Accession NM_024598). Accordingly, utilities of VGAM1151 include diagnosis, prevention and treatment of diseases and clinical conditions associated with FLJ13154. FLJ22671 (Accession NM_024861) is another VGAM1151 host target gene. FLJ22671 BINDING SITE is HOST TARGET binding site found in the 3' untranslated region of mRNA encoded by FLJ22671, corresponding to a HOST TARGET binding site such as BINDING SITE I, BINDING SITE II or BINDING SITE III. Table 2 illustrates the complementarity of the nucleotide sequences of FLJ22671 BINDING SITE, designated SEQ ID:24295, to the nucleotide sequence of VGAM1151 RNA, herein designated VGAM RNA, also designated SEQ ID:3862.

Another function of VGAM1151 is therefore inhibition of FLJ22671 (Accession NM_024861). Accordingly, utilities of VGAM1151 include diagnosis, prevention and treatment of diseases and clinical conditions associated with FLJ22671. FLJ22679 (Accession NM_017698) is another VGAM1151 host target gene. FLJ22679 BINDING SITE is HOST TARGET binding site found in the 3' untranslated region of mRNA encoded by FLJ22679, corresponding to a HOST TARGET binding site such as BINDING SITE I, BINDING SITE II or BINDING SITE III. Table 2 illustrates the complementarity of the nucleotide sequences of FLJ22679 BINDING SITE, designated SEQ ID:19262, to the nucleotide sequence of VGAM1151 RNA, herein designated VGAM RNA, also designated SEQ ID:3862.

Another function of VGAM1151 is therefore inhibition of FLJ22679 (Accession NM_017698). Accordingly, utilities of VGAM1151 include diagnosis, prevention and treatment of diseases and clinical conditions associated with FLJ22679. FLJ23263 (Accession NM_025115) is another VGAM1151 host target gene. FLJ23263 BINDING SITE is HOST TARGET binding site found in the 5' untranslated region of mRNA encoded by FLJ23263, corresponding to a HOST TARGET binding site such as BINDING SITE I, BINDING SITE II or BINDING SITE III. Table 2 illustrates the complementarity of the nucleotide sequences of FLJ23263 BINDING SITE, designated SEQ ID:24766, to the nucleotide sequence of VGAM1151 RNA, herein designated VGAM RNA, also designated SEQ ID:3862.

Another function of VGAM1151 is therefore inhibition of FLJ23263 (Accession NM_025115). Accordingly, utilities of VGAM1151 include diagnosis, prevention and treatment of diseases and clinical conditions associated with FLJ23263. FLJ30574 (Accession NM_144629) is another VGAM1151 host target gene. FLJ30574 BINDING SITE is HOST TARGET binding site found in the 3' untranslated region of mRNA encoded by FLJ30574, corresponding to a HOST TARGET binding site such as BINDING SITE I, BINDING SITE II or BINDING SITE III. Table 2 illustrates the complementarity of the nucleotide sequences of FLJ30574 BINDING SITE, designated SEQ ID:29448, to the nucleotide sequence of VGAM1151 RNA, herein designated VGAM RNA, also designated SEQ ID:3862.

Another function of VGAM1151 is therefore inhibition of FLJ30574 (Accession NM_144629). Accordingly, utilities of VGAM1151 include diagnosis, prevention and treatment of diseases and clinical conditions associated with FLJ30574. HSPC065 (Accession NM_014157) is another VGAM1151 host target gene. HSPC065 BINDING SITE is HOST TARGET binding site found in the 3' untranslated region of mRNA encoded by HSPC065, corresponding to a HOST TARGET binding site such as BINDING SITE I, BINDING SITE II or BINDING SITE III. Table 2 illustrates the complementarity of the nucleotide sequences of HSPC065 BINDING SITE, designated SEQ ID:15452, to the nucleotide sequence of VGAM1151 RNA, herein designated VGAM RNA, also designated SEQ ID:3862.

Another function of VGAM1151 is therefore inhibition of HSPC065 (Accession NM_014157). Accordingly, utilities of VGAM1151 include diagnosis, prevention and treatment of diseases and clinical conditions associated with HSPC065. HIV TAT Specific Factor 1 (HTATSF1, Accession NM_014500) is another VGAM1151 host target gene. HTATSF1 BINDING SITE is HOST TARGET binding site found in the 5' untranslated region of mRNA encoded by HTATSF1, corresponding to a HOST TARGET binding site such as BINDING SITE I, BINDING SITE II or BINDING SITE III. Table 2 illustrates the complementarity of the nucleotide sequences of HTATSF1 BINDING SITE, designated SEQ ID:15837, to the nucleotide sequence of VGAM1151 RNA, herein designated VGAM RNA, also designated SEQ ID:3862.

Another function of VGAM1151 is therefore inhibition of HIV TAT Specific Factor 1 (HTATSF1, Accession NM_014500). Accordingly, utilities of VGAM1151 include diagnosis, prevention and treatment of diseases and clinical conditions associated with HTATSF1. JIK (Accession NM_016281) is another VGAM1151 host target gene. JIK BINDING SITE is HOST TARGET binding site found in the 3' untranslated region of mRNA encoded by JIK, corresponding to a HOST TARGET binding site such as BINDING SITE I, BINDING SITE II or BINDING SITE III. Table 2 illustrates the complementarity of the nucleotide sequences of JIK BINDING SITE, designated SEQ ID:18408, to the nucleotide sequence of VGAM1151 RNA, herein designated VGAM RNA, also designated SEQ ID:3862.

Another function of VGAM1151 is therefore inhibition of JIK (Accession NM_016281). Accordingly, utilities of VGAM1151 include diagnosis, prevention and treatment of diseases and clinical conditions associated with JIK. KIAA0210 (Accession NM_014744) is another VGAM1151 host target gene. KIAA0210 BINDING SITE is HOST TARGET binding site found in the 5" untranslated region of mRNA encoded by KIAA0210, corresponding to a HOST TARGET binding site such as BINDING SITE I, BINDING SITE II or BINDING SITE III. Table 2 illustrates the complementarity of the nucleotide sequences of KIAA0210 BINDING SITE, designated SEQ ID:16423, to the nucleotide sequence of VGAM1151 RNA, herein designated VGAM RNA, also designated SEQ ID:3862.

Another function of VGAM1151 is therefore inhibition of KIAA0210 (Accession NM_014744). Accordingly, utilities of VGAM1151 include diagnosis, prevention and treatment of diseases and clinical conditions associated with KIAA0210. KIAA0450 (Accession NM_014638) is another VGAM1151 host target gene. KIAA0450 BINDING SITE is HOST TARGET binding site found in the 3' untranslated region of mRNA encoded by KIAA0450, corresponding to a HOST TARGET binding site such as BINDING SITE I, BINDING SITE II or BINDING SITE III. Table 2 illustrates the complementarity of the nucleotide sequences of KIAA0450 BINDING SITE, designated SEQ ID:16032, to the nucleotide sequence of VGAM1151 RNA, herein designated VGAM RNA, also designated SEQ ID:3862.

Another function of VGAM1151 is therefore inhibition of KIAA0450 (Accession NM_014638). Accordingly, utilities of VGAM1151 include diagnosis, prevention and treatment of diseases and clinical conditions associated with KIAA0450. KIAA0721 (Accession NM_021648) is another VGAM1151 host target gene. KIAA0721 BINDING SITE1 and KIAA0721 BINDING SITE2 are HOST TARGET binding sites found in untranslated regions of mRNA encoded by KIAA0721, corresponding to HOST TARGET binding sites such as BINDING SITE I, BINDING SITE II or BINDING SITE III. Table 2 illustrates the complementarity of the nucleotide sequences of KIAA0721 BINDING SITE1 and KIAA0721 BINDING SITE2, designated SEQ ID:22319 and SEQ ID:45926 respectively, to the nucleotide sequence of VGAM1151 RNA, herein designated VGAM RNA, also designated SEQ ID:3862.

Another function of VGAM1151 is therefore inhibition of KIAA0721 (Accession NM_021648). Accordingly, utilities of VGAM1151 include diagnosis, prevention and treatment of diseases and clinical conditions associated with KIAA0721. KIAA1029 (Accession NM_007286) is another VGAM1151 host target gene. KIAA1029 BINDING SITE1 and KIAA1029 BINDING SITE2 are HOST TARGET binding sites found in untranslated regions of mRNA encoded by KIAA1029, corresponding to HOST TARGET binding sites such as BINDING SITE I, BINDING SITE II or BINDING SITE III. Table 2 illustrates the complementarity of the nucleotide sequences of KIAA1029 BINDING SITE1 and KIAA1029 BINDING SITE2, designated SEQ ID:14145 and SEQ ID:32639 respectively, to the nucleotide sequence of VGAM1151 RNA, herein designated VGAM RNA, also designated SEQ ID:3862.

Another function of VGAM1151 is therefore inhibition of KIAA1029 (Accession NM_007286). Accordingly, utilities of VGAM1151 include diagnosis, prevention and treatment of diseases and clinical conditions associated with KIAA1029. KIAA1384 (Accession XM_035405) is another VGAM1151 host target gene. KIAA1384 BINDING SITE is HOST TARGET binding site found in the 5' untranslated region of mRNA encoded by KIAA1384, corresponding to a HOST TARGET binding site such as BINDING SITE I, BINDING SITE II or BINDING SITE III. Table 2 illustrates the complementarity of the nucleotide sequences of KIAA1384 BINDING SITE, designated SEQ ID:32259, to the nucleotide sequence of VGAM1151 RNA, herein designated VGAM RNA, also designated SEQ ID:3862.

Another function of VGAM1151 is therefore inhibition of KIAA1384 (Accession XM_035405). Accordingly, utilities of VGAM1151 include diagnosis, prevention and treatment of diseases and clinical conditions associated with KIAA1384. MGC10765 (Accession NM_024345) is another VGAM1151 host target gene. MGC10765 BINDING SITE is HOST TARGET binding site found in the 3' untranslated region of mRNA encoded by MGC10765, corresponding to a HOST TARGET binding site such as BINDING SITE I, BINDING SITE II or BINDING SITE III. Table 2 illustrates the complementarity of the nucleotide sequences of MGC10765 BINDING SITE, designated SEQ ID:23644, to the nucleotide sequence of VGAM1151 RNA, herein designated VGAM RNA, also designated SEQ ID:3862.

Another function of VGAM1151 is therefore inhibition of MGC10765 (Accession NM_024345). Accordingly, utilities of VGAM1151 include diagnosis, prevention and treatment of diseases and clinical conditions associated with MGC10765. MGC10812 (Accession NM_031425) is another VGAM1151 host target gene. MGC10812 BINDING SITE is HOST TARGET binding site found in the 3' untranslated region of mRNA encoded by MGC10812, corresponding to a HOST TARGET binding site such as BINDING SITE I, BINDING SITE II or BINDING SITE III. Table 2 illustrates the complementarity of the nucleotide sequences of MGC10812 BINDING SITE, designated SEQ ID:25410, to the nucleotide sequence of VGAM1151 RNA, herein designated VGAM RNA, also designated SEQ ID:3862.

Another function of VGAM1151 is therefore inhibition of MGC10812 (Accession NM_031425). Accordingly, utilities of VGAM1151 include diagnosis, prevention and treatment of diseases and clinical conditions associated with MGC10812. MGC11115 (Accession NM_032310) is another VGAM1151 host target gene. MGC11115 BINDING SITE1 and MGC11115 BINDING SITE2 are HOST TARGET binding sites found in untranslated regions of mRNA encoded by MGC11115, corresponding to HOST TARGET binding sites such as BINDING SITE I, BINDING SITE II or BINDING SITE III. Table 2 illustrates the complementarity of the nucleotide sequences of MGC11115 BINDING SITE1 and MGC11115 BINDING SITE2, designated SEQ ID:26094 and SEQ ID:26095 respectively, to the nucleotide sequence of VGAM1151 RNA, herein designated VGAM RNA, also designated SEQ ID:3862.

Another function of VGAM1151 is therefore inhibition of MGC11115 (Accession NM_032310). Accordingly, utilities of VGAM1151 include diagnosis, prevention and treatment of diseases and clinical conditions associated with MGC11115. MGC13053 (Accession NM_032710) is another VGAM1151 host target gene. MGC13053 BINDING SITE1 and MGC13053 BINDING SITE2 are HOST TARGET binding sites found in untranslated regions of mRNA encoded by MGC13053, corresponding to HOST TARGET binding sites such as BINDING SITE I, BINDING SITE II or BINDING SITE III. Table 2 illustrates the complementarity of the nucleotide sequences of MGC13053 BINDING SITE1 and MGC13053 BINDING SITE2, designated SEQ ID:26424 and SEQ ID:27938 respectively, to the nucleotide sequence of VGAM1151 RNA, herein designated VGAM RNA, also designated SEQ ID:3862.

Another function of VGAM1151 is therefore inhibition of MGC13053 (Accession NM_032710). Accordingly, utilities of VGAM1151 include diagnosis, prevention and treatment of diseases and clinical conditions associated with MGC13053. MGC4796 (Accession XM_029031) is another VGAM1151 host target gene. MGC4796 BINDING SITE is HOST TARGET binding site found in the 3' untranslated region of mRNA encoded by MGC4796, corresponding to a HOST TARGET binding site such as BINDING SITE I, BINDING SITE II or BINDING SITE III. Table 2 illustrates the complementarity of the nucleotide sequences of MGC4796 BINDING SITE, designated SEQ ID:30835, to the nucleotide sequence of VGAM1151 RNA, herein designated VGAM RNA, also designated SEQ ID:3862.

Another function of VGAM1151 is therefore inhibition of MGC4796 (Accession XM_029031). Accordingly, utilities of VGAM1151 include diagnosis, prevention and treatment of diseases and clinical conditions associated with MGC4796. MOST2 (Accession NM_020250) is another VGAM1151 host target gene. MOST2 BINDING SITE is HOST TARGET binding site found in the 5' untranslated region of mRNA encoded by MOST2, corresponding to a HOST TARGET binding site such as BINDING SITE I, BINDING SITE II or BINDING SITE III. Table 2 illustrates the complementarity of the nucleotide sequences of MOST2 BINDING SITE, designated SEQ ID:21552, to the nucleotide sequence of VGAM1151 RNA, herein designated VGAM RNA, also designated SEQ ID:3862.

Another function of VGAM1151 is therefore inhibition of MOST2 (Accession NM_020250). Accordingly, utilities of VGAM1151 include diagnosis, prevention and treatment of diseases and clinical conditions associated with MOST2. NPD009 (Accession XM_170795) is another VGAM1151 host target gene. NPD009 BINDING SITE is HOST TARGET binding site found in the 5' untranslated region of mRNA encoded by NPD009, corresponding to a HOST TARGET binding site such as BINDING SITE I, BINDING SITE II or BINDING SITE III. Table 2 illustrates the complementarity of the nucleotide sequences of NPD009 BINDING SITE, designated SEQ ID:45564, to the nucleotide sequence of VGAM1151 RNA, herein designated VGAM RNA, also designated SEQ ID:3862.

Another function of VGAM1151 is therefore inhibition of NPD009 (Accession XM_170795). Accordingly, utilities of VGAM1151 include diagnosis, prevention and treatment of diseases and clinical conditions associated with NPD009. Neuritin 1 (NRN1, Accession NM_016588) is another VGAM1151 host target gene. NRN1 BINDING SITE is HOST TARGET binding site found in the 5' untranslated region of mRNA encoded by NRN1, corresponding to a HOST TARGET binding site such as BINDING SITE I, BINDING SITE II or BINDING SITE III. Table 2 illustrates the complementarity of the nucleotide sequences of NRN1 BINDING SITE, designated SEQ ID:18664, to the nucleotide sequence of VGAM1151 RNA, herein designated VGAM RNA, also designated SEQ ID:3862.

Another function of VGAM1151 is therefore inhibition of Neuritin 1 (NRN1, Accession NM_016588). Accordingly, utilities of VGAM1151 include diagnosis, prevention and treatment of diseases and clinical conditions associated with NRN1. Olfactory Receptor, Family 7, Subfamily C, Member 1 (OR7C1, Accession NM_017506) is another VGAM1151 host target gene. OR7C1 BINDING SITE is HOST TARGET binding site found in the 5' untranslated region of mRNA encoded by OR7C1, corresponding to a HOST TARGET binding site such as BINDING SITE I, BINDING SITE II or BINDING SITE III. Table 2 illustrates the complementarity of the nucleotide sequences of OR7C1 BINDING SITE, designated SEQ ID:18962, to the nucleotide sequence of VGAM1151 RNA, herein designated VGAM RNA, also designated SEQ ID:3862.

Another function of VGAM1151 is therefore inhibition of Olfactory Receptor, Family 7, Subfamily C, Member 1 (OR7C1, Accession NM_017506). Accordingly, utilities of VGAM1151 include diagnosis, prevention and treatment of diseases and clinical conditions associated with OR7C1. PFTAIRE Protein Kinase 1 (PFTK1, Accession NM_012395) is another VGAM1151 host target gene. PFTK1 BINDING SITE1 and PFTK1 BINDING SITE2 are HOST TARGET binding sites found in untranslated regions of mRNA encoded by PFTK1, corresponding to HOST TARGET binding sites such as BINDING SITE I, BINDING SITE II or BINDING SITE III. Table 2 illustrates the complementarity of the nucleotide sequences of PFTK1 BINDING SITE1 and PFTK1 BINDING SITE2, designated SEQ ID:14752 and SEQ ID:14753 respectively, to the nucleotide sequence of VGAM1151 RNA, herein designated VGAM RNA, also designated SEQ ID:3862.

Another function of VGAM1151 is therefore inhibition of PFTAIRE Protein Kinase 1 (PFTK1, Accession NM_012395). Accordingly, utilities of VGAM1151 include diagnosis, prevention and treatment of diseases and clinical conditions associated with PFTK1. Regulatory Factor X, 3 (influences HLA class II expression) (RFX3, Accession NM_134428) is another VGAM1151 host target gene. RFX3 BINDING SITE1 and RFX3 BINDING SITE2 are HOST TARGET binding sites found in untranslated regions of mRNA encoded by RFX3, corresponding to HOST TARGET binding sites such as BINDING SITE I, BINDING SITE II or BINDING SITE III. Table 2 illustrates the complementarity of the nucleotide sequences of RFX3 BINDING SITE1 and RFX3 BINDING SITE2, designated SEQ ID:28670 and SEQ ID:8828 respectively, to the nucleotide sequence of VGAM1151 RNA, herein designated VGAM RNA, also designated SEQ ID:3862.

Another function of VGAM1151 is therefore inhibition of Regulatory Factor X, 3 (influences HLA class II expression) (RFX3, Accession NM_134428). Accordingly, utilities of VGAM1151 include diagnosis, prevention and treatment of diseases and clinical conditions associated with RFX3. Tripartite Motif-containing 15 (TRIM15, Accession NM_033229) is another VGAM1151 host target gene. TRIM15 BINDING SITE1 and TRIM15 BINDING SITE2 are HOST TARGET binding sites found in untranslated regions of mRNA encoded by TRIM15, corresponding to HOST TARGET binding sites such as BINDING SITE I, BINDING SITE II or BINDING SITE III. Table 2 illustrates the complementarity of the nucleotide sequences of TRIM15 BINDING SITE1 and TRIM15 BINDING SITE2, designated SEQ ID:27074 and SEQ ID:27075 respectively, to the nucleotide sequence of VGAM1151 RNA, herein designated VGAM RNA, also designated SEQ ID:3862.

Another function of VGAM1151 is therefore inhibition of Tripartite Motif-containing 15 (TRIM15, Accession NM_033229). Accordingly, utilities of VGAM1151 include diagnosis, prevention and treatment of diseases and clinical conditions associated with TRIM15. LOC112868 (Accession XM_053402) is another VGAM1151 host target gene. LOC112868 BINDING SITE1 through LOC112868 BINDING SITE4 are HOST TARGET binding sites found in untranslated regions of mRNA encoded by LOC112868, corresponding to HOST TARGET binding sites such as BINDING SITE I, BINDING SITE II or BINDING SITE III. Table 2 illustrates the complementarity of the nucleotide sequences of LOC112868 BINDING SITE1 through LOC112868 BINDING SITE4, designated SEQ ID:36080, SEQ ID:36081, SEQ ID:36086 and SEQ ID:36087 respectively, to the nucleotide sequence of VGAM1151 RNA, herein designated VGAM RNA, also designated SEQ ID:3862.

Another function of VGAM1151 is therefore inhibition of LOC112868 (Accession XM_053402). Accordingly, utilities of VGAM1151 include diagnosis, prevention and treatment of diseases and clinical conditions associated with LOC112868. LOC113612 (Accession XM_054492) is another VGAM1151 host target gene. LOC113612 BINDING SITE1 and LOC113612 BINDING SITE2 are HOST TARGET binding sites found in untranslated regions of mRNA encoded by LOC113612, corresponding to HOST TARGET binding sites such as BINDING SITE I, BINDING SITE II or BINDING SITE III. Table 2 illustrates the complementarity of the nucleotide sequences of LOC113612 BINDING SITE1 and LOC113612 BINDING SITE2, designated SEQ ID:36170 and SEQ ID:36570 respectively, to the nucleotide sequence of VGAM1151 RNA, herein designated VGAM RNA, also designated SEQ ID:3862.

Another function of VGAM1151 is therefore inhibition of LOC113612 (Accession XM_054492). Accordingly, utilities of VGAM1151 include diagnosis, prevention and treatment of diseases and clinical conditions associated with LOC113612. LOC131034 (Accession NM_130808) is another VGAM1151 host target gene. LOC131034 BINDING SITE is HOST TARGET binding site found in the 5' untranslated region of mRNA encoded by LOC131034, corresponding to a HOST TARGET binding site such as BINDING SITE I, BINDING SITE II or BINDING SITE III. Table 2 illustrates the complementarity of the nucleotide sequences of LOC131034 BINDING SITE, designated SEQ ID:28316, to the nucleotide sequence of VGAM1151 RNA, herein designated VGAM RNA, also designated SEQ ID:3862.

Another function of VGAM1151 is therefore inhibition of LOC131034 (Accession NM_130808). Accordingly, utilities of VGAM1151 include diagnosis, prevention and treatment of diseases and clinical conditions associated with LOC131034. LOC144231 (Accession XM_096561) is another VGAM1151 host target gene. LOC144231 BINDING SITE is HOST TARGET binding site found in the 5' untranslated region of mRNA encoded by LOC144231, corresponding to a HOST TARGET binding site such as BINDING SITE I, BINDING SITE II or BINDING SITE III. Table 2 illustrates the complementarity of the nucleotide sequences of LOC144231 BINDING SITE, designated SEQ ID:40392, to the nucleotide sequence of VGAM1151 RNA, herein designated VGAM RNA, also designated SEQ ID:3862.

Another function of VGAM1151 is therefore inhibition of LOC144231 (Accession XM_096561). Accordingly, utilities of VGAM1151 include diagnosis, prevention and treatment of diseases and clinical conditions associated with LOC144231. LOC144262 (Accession XM_084793) is another VGAM1151 host target gene. LOC144262 BINDING SITE is HOST TARGET binding site found in the 5' untranslated region of mRNA encoded by LOC144262, corresponding to a HOST TARGET binding site such as BINDING SITE I, BINDING SITE II or BINDING SITE III. Table 2 illustrates the complementarity of the nucleotide sequences of LOC144262 BINDING SITE, designated SEQ ID:37704, to the nucleotide sequence of VGAM1151 RNA, herein designated VGAM RNA, also designated SEQ ID:3862.

Another function of VGAM1151 is therefore inhibition of LOC144262 (Accession XM_084793). Accordingly, utilities of VGAM1151 include diagnosis, prevention and treatment of diseases and clinical conditions associated with LOC144262. LOC146839 (Accession XM_097107) is another VGAM1151 host target gene. LOC146839 BINDING SITE is HOST TARGET binding site found in the 5' untranslated region of mRNA encoded by LOC146839, corresponding to a HOST TARGET binding site such as BINDING SITE I, BINDING SITE II or BINDING SITE III. Table 2 illustrates the complementarity of the nucleotide sequences of LOC146839 BINDING SITE, designated SEQ ID:40754, to the nucleotide sequence of VGAM1151 RNA, herein designated VGAM RNA, also designated SEQ ID:3862.

Another function of VGAM1151 is therefore inhibition of LOC146839 (Accession XM_097107). Accordingly, utilities of VGAM1151 include diagnosis, prevention and treatment of diseases and clinical conditions associated with LOC146839. LOC150577 (Accession XM_097918) is another VGAM1151 host target gene. LOC150577 BINDING SITE is HOST TARGET binding site found in the 3' untranslated region of mRNA encoded by LOC150577, corresponding to a HOST TARGET binding site such as BINDING SITE I, BINDING SITE II or BINDING SITE III. Table 2 illustrates the complementarity of the nucleotide sequences of LOC150577 BINDING SITE, designated SEQ ID:41221, to the nucleotide sequence of VGAM1151 RNA, herein designated VGAM RNA, also designated SEQ ID:3862.

Another function of VGAM1151 is therefore inhibition of LOC150577 (Accession XM_097918). Accordingly, utilities of VGAM1151 include diagnosis, prevention and treatment of diseases and clinical conditions associated with LOC150577. LOC151742 (Accession NM_139245) is another VGAM1151 host target gene. LOC151742 BINDING SITE is HOST TARGET binding site found in the 3' untranslated region of mRNA encoded by LOC151742, corresponding to a HOST TARGET binding site such as BINDING SITE I, BINDING SITE II or BINDING SITE III. Table 2 illustrates the complementarity of the nucleotide sequences of LOC151742 BINDING SITE, designated SEQ ID:29243, to the nucleotide sequence of VGAM1151 RNA, herein designated VGAM RNA, also designated SEQ ID:3862.

Another function of VGAM1151 is therefore inhibition of LOC151742 (Accession NM_139245). Accordingly, utilities of VGAM1151 include diagnosis, prevention and treatment of diseases and clinical conditions associated with LOC151742. LOC154761 (Accession XM_088038) is another VGAM1151 host target gene. LOC154761 BINDING SITE is HOST TARGET binding site found in the 3' untranslated region of mRNA encoded by LOC154761, corresponding to a HOST TARGET binding site such as BINDING SITE I, BINDING SITE II or BINDING SITE III. Table 2 illustrates the complementarity of the nucleotide sequences of LOC154761 BINDING SITE, designated SEQ ID:39484, to the nucleotide sequence of VGAM1151 RNA, herein designated VGAM RNA, also designated SEQ ID:3862.

Another function of VGAM1151 is therefore inhibition of LOC154761 (Accession XM_088038). Accordingly, utilities of VGAM1151 include diagnosis, prevention and treatment of diseases and clinical conditions associated with LOC154761. LOC201617 (Accession XM_117315) is another VGAM1151 host target gene. LOC201617 BINDING SITE is HOST TARGET binding site found in the 5' untranslated region of mRNA encoded by LOC201617, corresponding to a HOST TARGET binding site such as BINDING SITE I, BINDING SITE II or BINDING SITE III. Table 2 illustrates the complementarity of the nucleotide sequences of LOC201617 BINDING SITE, designated SEQ ID:43381, to the nucleotide sequence of VGAM1151 RNA, herein designated VGAM RNA, also designated SEQ ID:3862.

Another function of VGAM1151 is therefore inhibition of LOC201617 (Accession XM_117315). Accordingly, utilities of VGAM1151 include diagnosis, prevention and treatment of diseases and clinical conditions associated with LOC201617. LOC201799 (Accession XM_114380) is another VGAM1151 host target gene. LOC201799 BINDING SITE is HOST TARGET binding site found in the 3' untranslated region of mRNA encoded by LOC201799, corresponding to a HOST TARGET binding site such as BINDING SITE I, BINDING SITE II or BINDING SITE III. Table 2 illustrates the complementarity of the nucleotide sequences of LOC201799 BINDING SITE, designated SEQ ID:42917, to the nucleotide sequence of VGAM1151 RNA, herein designated VGAM RNA, also designated SEQ ID:3862.

Another function of VGAM1151 is therefore inhibition of LOC201799 (Accession XM_114380). Accordingly, utilities of VGAM1151 include diagnosis, prevention and treatment of diseases and clinical conditions associated with LOC201799. LOC221477 (Accession XM_166397) is another VGAM1151 host target gene. LOC221477 BINDING SITE is HOST TARGET binding site found in the 3' untranslated region of mRNA encoded by LOC221477, corresponding to a HOST TARGET binding site such as BINDING SITE I, BINDING SITE II or BINDING SITE III. Table 2 illustrates the complementarity of the nucleotide sequences of LOC221477 BINDING SITE, designated SEQ ID:44261, to the nucleotide sequence of VGAM1151 RNA, herein designated VGAM RNA, also designated SEQ ID:3862.

Another function of VGAM1151 is therefore inhibition of LOC221477 (Accession XM_166397). Accordingly, utilities of VGAM1151 include diagnosis, prevention and treatment of diseases and clinical conditions associated with LOC221477. LOC221662 (Accession XM_166466) is another VGAM1151 host target gene. LOC221662 BINDING SITE is HOST TARGET binding site found in the 3' untranslated region of mRNA encoded by LOC221662, corresponding to a HOST TARGET binding site such as BINDING SITE I, BINDING SITE II or BINDING SITE III. Table 2 illustrates the complementarity of the nucleotide sequences of LOC221662 BINDING SITE, designated SEQ ID:44388, to the nucleotide sequence of VGAM1151 RNA, herein designated VGAM RNA, also designated SEQ ID:3862.

Another function of VGAM1151 is therefore inhibition of LOC221662 (Accession XM_166466). Accordingly, utilities of VGAM1151 include diagnosis, prevention and treatment of diseases and clinical conditions associated with LOC221662. LOC253847 (Accession XM_171145) is another VGAM1151 host target gene. LOC253847 BINDING SITE is HOST TARGET binding site found in the 5' untranslated region of mRNA encoded by LOC253847, corresponding to a HOST TARGET binding site such as BINDING SITE I, BINDING SITE II or BINDING SITE III. Table 2 illustrates the complementarity of the nucleotide sequences of LOC253847 BINDING SITE, designated SEQ ID:45940, to the nucleotide sequence of VGAM1151 RNA, herein designated VGAM RNA, also designated SEQ ID:3862.

Another function of VGAM1151 is therefore inhibition of LOC253847 (Accession XM_171145). Accordingly, utilities of VGAM1151 include diagnosis, prevention and treatment of diseases and clinical conditions associated with LOC253847. LOC254945 (Accession XM_173038) is another VGAM1151 host target gene. LOC254945 BINDING SITE is HOST TARGET binding site found in the 5' untranslated region of mRNA encoded by LOC254945, corresponding to a HOST TARGET binding site such as BINDING SITE I, BINDING SITE II or BINDING SITE III. Table 2 illustrates the complementarity of the nucleotide sequences of LOC254945 BINDING SITE, designated SEQ ID:46305, to the nucleotide sequence of VGAM1151 RNA, herein designated VGAM RNA, also designated SEQ ID:3862.

Another function of VGAM1151 is therefore inhibition of LOC254945 (Accession XM_173038). Accordingly, utilities of VGAM1151 include diagnosis, prevention and treatment of diseases and clinical conditions associated with LOC254945. LOC51008 (Accession NM_015947) is another VGAM1151 host target gene. LOC51008 BINDING SITE is HOST TARGET binding site found in the 5' untranslated region of mRNA encoded by LOC51008, corresponding to a HOST TARGET binding site such as BINDING SITE I, BINDING SITE II or BINDING SITE III. Table 2 illustrates the complementarity of the nucleotide sequences of LOC51008 BINDING SITE, designated SEQ ID:18063, to the nucleotide sequence of VGAM1151 RNA, herein designated VGAM RNA, also designated SEQ ID:3862.

Another function of VGAM1151 is therefore inhibition of LOC51008 (Accession NM_015947). Accordingly, utilities of VGAM1151 include diagnosis, prevention and treatment of diseases and clinical conditions associated with LOC51008. LOC56930 (Accession XM_030603) is another VGAM1151 host target gene. LOC56930 BINDING SITE is HOST TARGET binding site found in the 5' untranslated region of mRNA encoded by LOC56930, corresponding to a HOST TARGET binding site such as BINDING SITE I, BINDING SITE II or BINDING SITE III. Table 2 illustrates the complementarity of the nucleotide sequences of LOC56930 BINDING SITE, designated SEQ ID:31092, to the nucleotide sequence of VGAM1151 RNA, herein designated VGAM RNA, also designated SEQ ID:3862.

Another function of VGAM1151 is therefore inhibition of LOC56930 (Accession XM_030603). Accordingly, utilities of VGAM1151 include diagnosis, prevention and treatment of diseases and clinical conditions associated with LOC56930. LOC91812 (Accession XM_040857) is another VGAM1151 host target gene. LOC91812 BINDING SITE is HOST TARGET binding site found in the 5' untranslated region of mRNA encoded by LOC91812, corresponding to a HOST TARGET binding site such as BINDING SITE I, BINDING SITE II or BINDING SITE III. Table 2 illustrates the complementarity of the nucleotide sequences of LOC91812 BINDING SITE, designated SEQ ID:33392, to the nucleotide sequence of VGAM1151 RNA, herein designated VGAM RNA, also designated SEQ ID:3862.

Another function of VGAM1151 is therefore inhibition of LOC91812 (Accession XM_040857). Accordingly, utilities of VGAM1151 include diagnosis, prevention and treatment of diseases and clinical conditions associated with LOC91812. LOC91813 (Accession XM_040862) is another VGAM1151 host target gene. LOC91813 BINDING SITE is HOST TARGET binding site found in the 5' untranslated region of mRNA encoded by LOC91813, corresponding to a HOST TARGET binding site such as BINDING SITE I, BINDING SITE II or BINDING SITE III. Table 2 illustrates the complementarity of the nucleotide sequences of LOC91813 BINDING SITE, designated SEQ ID:33400, to the nucleotide sequence of VGAM1151 RNA, herein designated VGAM RNA, also designated SEQ ID:3862.

Another function of VGAM1151 is therefore inhibition of LOC91813 (Accession XM_040862). Accordingly, utilities of VGAM1151 include diagnosis, prevention and treatment of diseases and clinical conditions associated with LOC91813. FIG. 1 further provides a conceptual description of a novel bioinformatically detected viral gene of the present invention, referred to here as Viral Genomic Address Messenger 1152 (VGAM1152) viral gene, which modulates expression of respective host target genes thereof, the function and utility of which host target genes is known in the art.

VGAM1152 is a novel bioinformatically detected regulatory, non protein coding, viral micro RNA (miRNA) gene. The method by which VGAM1152 was detected is described hereinabove with reference to FIGS. 1-8.

VGAM1152 gene, herein designated VGAM GENE, is a viral gene contained in the genome of Cowpox Virus. VGAM1152 host target gene, herein designated VGAM HOST TARGET GENE, is a human gene contained in the human genome.

VGAM1152 gene encodes a VGAM1152 precursor RNA, herein designated VGAM PRECURSOR RNA. Similar to other miRNA genes, and unlike most ordinary genes, VGAM1152 precursor RNA does not encode a protein. A nucleotide sequence identical or highly similar to the nucleotide sequence of VGAM1152 precursor RNA is designated SEQ ID:1138, and is provided hereinbelow with reference to the sequence listing part. Nucleotide sequence SEQ ID:1138 is located at position 4584 relative to the genome of Cowpox Virus.

VGAM1152 precursor RNA folds onto itself, forming VGAM1152 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1152 folded precursor RNA into VGAM1152 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1152 RNA is designated SEQ ID:3863, and is provided hereinbelow with reference to the sequence listing part.

VGAM1152 host target gene, herein designated VGAM HOST TARGET GENE, encodes a corresponding messenger RNA, VGAM1152 host target RNA, herein designated VGAM HOST TARGET RNA. VGAM1152 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1152 RNA, herein designated VGAM RNA, binds complementarily to one or more host target binding sites located in untranslated regions of VGAM1152 host target RNA, herein designated VGAM HOST TARGET RNA. This complementary binding is due to the fact that the nucleotide sequence of VGAM1152 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1152 RNA, herein designated VGAM RNA, may have a different number of host target binding sites in untranslated regions of a VGAM1152 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1152 RNA, herein designated VGAM RNA, to host target binding sites on VGAM1152 host target RNA, herein designated VGAM HOST TARGET RNA, such as BINDING SITE I, BINDING SITE II and BINDING SITE III, inhibits translation of VGAM1152 host target RNA into VGAM1152 host target protein, herein designated VGAM HOST TARGET PROTEIN. VGAM host target protein is therefore outlined by a broken line.

It is appreciated that VGAM1152 host target gene, herein designated VGAM HOST TARGET GENE, in fact represents a plurality of VGAM1152 host target genes. The mRNA of each one of this plurality of VGAM1152 host target genes comprises one or more host target binding sites, each having a nucleotide sequence which is at least partly complementary to VGAM1152 RNA, herein designated VGAM RNA, and which when bound by VGAM1152 RNA causes inhibition of translation of respective one or more VGAM1152 host target proteins.

It is further appreciated by one skilled in the art that the mode of translational inhibition illustrated by FIG. 1 with specific reference to translational inhibition exerted by VGAM1152 gene, herein designated VGAM GENE, on one or more VGAM1152 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1152 is inhibition of expression of host target genes, as part of a novel viral mechanism of attacking a host. Accordingly, utilities of VGAM1152 include diagnosis, prevention and treatment of viral infection by Cowpox Virus. Specific functions, and accordingly utilities, of VGAM1152 correlate with, and may be deduced from, the identity of the host target genes which VGAM1152 binds and inhibits, and the function of these host target genes, as elaborated hereinbelow.

Nucleotide sequences of the VGAM1152 precursor RNA, herein designated VGAM PRECURSOR RNA, and of the 'diced' VGAM1152 RNA, herein designated VGAM RNA, and a schematic representation of the secondary folding of VGAM1152 folded precursor RNA, herein designated VGAM FOLDED PRECURSOR RNA, of VGAM1152 are further described hereinbelow with reference to Table 1.

Nucleotide sequences of host target binding sites, such as BINDING SITE-I, BINDING SITE-II and BINDING SITE-III of FIG. 1, found on VGAM1152 host target RNA, and schematic representation of the complementarity of each of these host target binding sites to VGAM1152 RNA, herein designated VGAM RNA, are described hereinbelow with reference to Table 2.

As mentioned hereinabove with reference to FIG. 1, a function of VGAM1152 gene, herein designated VGAM is inhibition of expression of VGAM1152 target genes. It is appreciated that specific functions, and accordingly utilities, of VGAM1152 correlate with, and may be deduced from, the identity of the target genes which VGAM1152 binds and inhibits, and the function of these target genes, as elaborated hereinbelow.

EphA3 (EPHA3, Accession NM_005233) is a VGAM1152 host target gene. EPHA3 BINDING SITE is HOST TARGET binding site found in the 3' untranslated region of mRNA encoded by EPHA3, corresponding to a HOST TARGET binding site such as BINDING SITE I, BINDING SITE II or BINDING SITE III. Table 2 illustrates the complementarity of the nucleotide sequences of EPHA3 BINDING SITE, designated SEQ ID:11743, to the nucleotide sequence of VGAM1152 RNA, herein designated VGAM RNA, also designated SEQ ID:3863.

A function of VGAM1152 is therefore inhibition of EphA3 (EPHA3, Accession NM_005233), a gene which binds to ephrin-a2, -a3, -a4 and -a5. could play a role in lymphoid function. Accordingly, utilities of VGAM1152 include diagnosis, prevention and treatment of diseases and clinical conditions associated with EPHA3. The function of EPHA3 and its association with various diseases and clinical conditions, has been established by previous studies, as described hereinabove with reference to VGAM164. Gamma-aminobutyric Acid (GABA) A Receptor, Pi (GABRP, Accession NM_014211) is another VGAM1152 host target gene. GABRP BINDING SITE is HOST TARGET binding site found in the 3' untranslated region of mRNA encoded by GABRP, corresponding to a HOST TARGET binding site such as BINDING SITE I, BINDING SITE II or BINDING SITE III. Table 2 illustrates the complementarity of the nucleotide sequences of GABRP BINDING SITE, designated SEQ ID:15479, to the nucleotide sequence of VGAM1152 RNA, herein designated VGAM RNA, also designated SEQ ID:3863.

Another function of VGAM1152 is therefore inhibition of Gamma-aminobutyric Acid (GABA) A Receptor, Pi (GABRP, Accession NM_014211), a gene which mediates neuronal inhibition by binding to the gaba/benzodiazepine receptor and opening an integral chloride channel. Accordingly, utilities of VGAM1152 include diagnosis, prevention and treatment of diseases and clinical conditions associated with GABRP. The function of GABRP and its association with various diseases and clinical conditions, has been established by previous studies, as described hereinabove with reference to VGAM795. Tuftelin 1 (TUFT1, Accession NM_020127) is another VGAM1152 host target gene. TUFT1 BINDING SITE is HOST TARGET binding site found in the 3' untranslated region of mRNA encoded by TUFT1, corresponding to a HOST TARGET binding site such as BINDING SITE I, BINDING SITE II or BINDING SITE III. Table 2 illustrates the complementarity of the nucleotide sequences of TUFT1 BINDING SITE, designated SEQ ID:21318, to the nucleotide sequence of VGAM1152 RNA, herein designated VGAM RNA, also designated SEQ ID:3863.

Another function of VGAM1152 is therefore inhibition of Tuftelin 1 (TUFT1, Accession NM_020127), a gene which appears to play a role in cytokinesis, cell shape, and specialized functions such as secretion and capping. Accordingly, utilities of VGAM1152 include diagnosis, prevention and treatment of diseases and clinical conditions associated with TUFT1. The function of TUFT1 has been established by previous studies. Tuftelin is an acidic protein found in developing and mature extracellular enamel, the unique and highly mineralized ectodermal tissue covering vertebrate teeth (Deutsch, 1989; Deutsch et al., 1991). It is thought to play a major role in mineralization and structural organization of enamel. By fluorescence in situ hybridization, Deutsch et al. (1994) mapped the TUFT1 gene to 1q21-q31. They raised the possibility that an autosomal dominant form of amelogenesis imperfecta (104500, 104530) is due to a mutation in this gene. By FISH, Bashir et al. (1998) localized the TUFT1 gene to 1q21.

Full details of the abovementioned studies are described in the following publications, the disclosure of which are hereby incorporated by reference:

Deutsch, D.; Palmon, A.; Fisher, L. W.; Kolodny, N.; Termine, J. D.; Young, M. F.: Sequencing of bovine enamelin (tuftelin), a novel acidic enamel protein. J. Biol. Chem. 266: 16021-16028, 1991; and Deutsch, D.; Palmon, A.; Young, M. F.; Selig, S.; Kearns, W. G.; Fisher, L. W.: Mapping of the human tuftelin (TUFT1) gene to chromosome 1 by fluorescence in situ hybridization. (Abstrac.

Further studies establishing the function and utilities of TUFT1 are found in John Hopkins OMIM database record ID 600087, and in sited publications numbered 7900-7901, 821 and 8224-8226 listed in the bibliography section hereinbelow, which are also hereby incorporated by reference. ABLIM (Accession NM_006720) is another VGAM1152 host target gene. ABLIM BINDING SITE1 and ABLIM BINDING SITE2 are HOST TARGET binding sites found in untranslated regions of mRNA encoded by ABLIM, corresponding to HOST TARGET binding sites such as BINDING SITE I, BINDING SITE II or BINDING SITE III. Table 2 illustrates the complementarity of the nucleotide sequences of ABLIM BINDING SITE1 and ABLIM BINDING SITE2, designated SEQ ID:13550 and SEQ ID:8117 respectively, to the nucleotide sequence of VGAM1152 RNA, herein designated VGAM RNA, also designated SEQ ID:3863.

Another function of VGAM1152 is therefore inhibition of ABLIM (Accession NM_006720). Accordingly, utilities of VGAM1152 include diagnosis, prevention and treatment of diseases and clinical conditions associated with ABLIM. KIAA0565 (Accession XM_039912) is another VGAM1152 host target gene. KIAA0565 BINDING SITE is HOST TARGET binding site found in the 3' untranslated region of mRNA encoded by KIAA0565, corresponding to a HOST TARGET binding site such as BINDING SITE I, BINDING SITE II or BINDING SITE III. Table 2 illustrates the complementarity of the nucleotide sequences of KIAA0565 BINDING SITE, designated SEQ ID:33220, to the nucleotide sequence of VGAM1152 RNA, herein designated VGAM RNA, also designated SEQ ID:3863.

Another function of VGAM1152 is therefore inhibition of KIAA0565 (Accession XM_039912). Accordingly, utilities of VGAM1152 include diagnosis, prevention and treatment of diseases and clinical conditions associated with KIAA0565. KIAA0635 (Accession NM_014645) is another VGAM1152 host target gene. KIAA0635 BINDING SITE is HOST TARGET binding site found in the 3' untranslated region of mRNA encoded by KIAA0635, corresponding to a HOST TARGET binding site such as BINDING SITE I, BINDING SITE II or BINDING SITE III. Table 2 illustrates the complementarity of the nucleotide sequences of KIAA0635 BINDING SITE, designated SEQ ID:16054, to the nucleotide sequence of VGAM1152 RNA, herein designated VGAM RNA, also designated SEQ ID:3863.

Another function of VGAM1152 is therefore inhibition of KIAA0635 (Accession NM_014645). Accordingly, utilities of VGAM1152 include diagnosis, prevention and treatment of diseases and clinical conditions associated with KIAA0635. MacGAP (Accession NM_033515) is another VGAM1152 host target gene. MacGAP BINDING SITE is HOST TARGET binding site found in the 3' untranslated region of mRNA encoded by MacGAP, corresponding to a HOST TARGET binding site such as BINDING SITE I, BINDING SITE II or BINDING SITE III. Table 2 illustrates the complementarity of the nucleotide sequences of MacGAP BINDING SITE, designated SEQ ID:27289, to the nucleotide sequence of VGAM1152 RNA, herein designated VGAM RNA, also designated SEQ ID:3863.

Another function of VGAM1152 is therefore inhibition of MacGAP (Accession NM_033515). Accordingly, utilities of VGAM1152 include diagnosis, prevention and treatment of diseases and clinical conditions associated with MacGAP. MGC13130 (Accession NM_032890) is another VGAM1152 host target gene. MGC13130 BINDING SITE is HOST TARGET binding site found in the 5' untranslated region of mRNA encoded by MGC13130, corresponding to a HOST TARGET binding site such as BINDING SITE I, BINDING SITE II or BINDING SITE III. Table 2 illustrates the complementarity of the nucleotide sequences of MGC13130 BINDING SITE, designated SEQ ID:26713, to the nucleotide sequence of VGAM1152 RNA, herein designated VGAM RNA, also designated SEQ ID:3863.

Another function of VGAM1152 is therefore inhibition of MGC13130 (Accession NM_032890). Accordingly, utilities of VGAM1152 include diagnosis, prevention and treatment of diseases and clinical conditions associated with MGC13130. LOC131368 (Accession XM_067347) is another VGAM1152 host target gene. LOC131368 BINDING SITE is HOST TARGET binding site found in the 3' untranslated region of mRNA encoded by LOC131368, corresponding to a HOST TARGET binding site such as BINDING SITE I, BINDING SITE II or BINDING SITE III. Table 2 illustrates the complementarity of the nucleotide sequences of LOC131368 BINDING SITE, designated SEQ ID:37355, to the nucleotide sequence of VGAM1152 RNA, herein designated VGAM RNA, also designated SEQ ID:3863.

Another function of VGAM1152 is therefore inhibition of LOC131368 (Accession XM_067347). Accordingly, utilities of VGAM1152 include diagnosis, prevention and treatment of diseases and clinical conditions associated with LOC131368. LOC153077 (Accession XM_098307) is another VGAM1152 host target gene. LOC153077 BINDING SITE is HOST TARGET binding site found in the 3' untranslated region of mRNA encoded by LOC153077, corresponding to a HOST TARGET binding site such as BINDING SITE I, BINDING SITE II or BINDING SITE III. Table 2 illustrates the complementarity of the nucleotide sequences of LOC153077 BINDING SITE, designated SEQ ID:41569, to the nucleotide sequence of VGAM1152 RNA, herein designated VGAM RNA, also designated SEQ ID:3863.

Another function of VGAM1152 is therefore inhibition of LOC153077 (Accession XM_098307). Accordingly, utilities of VGAM1152 include diagnosis, prevention and treatment of diseases and clinical conditions associated with LOC153077. LOC256207 (Accession XM_170837) is another VGAM1152 host target gene. LOC256207 BINDING SITE is HOST TARGET binding site found in the 3' untranslated region of mRNA encoded by LOC256207, corresponding to a HOST TARGET binding site such as BINDING SITE I, BINDING SITE II or BINDING SITE III. Table 2 illustrates the complementarity of the nucleotide sequences of LOC256207 BINDING SITE, designated SEQ ID:45621, to the nucleotide sequence of VGAM1152 RNA, herein designated VGAM RNA, also designated SEQ ID:3863.

Another function of VGAM1152 is therefore inhibition of LOC256207 (Accession XM_170837). Accordingly, utilities of VGAM1152 include diagnosis, prevention and treatment of diseases and clinical conditions associated with LOC256207. LOC90288 (Accession XM_030669) is another VGAM1152 host target gene. LOC90288 BINDING SITE is HOST TARGET binding site found in the 3' untranslated region of mRNA encoded by LOC90288, corresponding to a HOST TARGET binding site such as BINDING SITE I, BINDING SITE II or BINDING SITE III. Table 2 illustrates the complementarity of the nucleotide sequences of LOC90288 BINDING SITE, designated SEQ ID:31112, to the nucleotide sequence of VGAM1152 RNA, herein designated VGAM RNA, also designated SEQ ID:3863.

Another function of VGAM1152 is therefore inhibition of LOC90288 (Accession XM_030669). Accordingly, utilities of VGAM1152 include diagnosis, prevention and treatment of diseases and clinical conditions associated with LOC90288. FIG. 1 further provides a conceptual description of a novel bioinformatically detected viral gene of the present invention, referred to here as Viral Genomic Address Messenger 1153 (VGAM1153) viral gene, which modulates expression of respective host target genes thereof, the function and utility of which host target genes is known in the art.

VGAM1153 is a novel bioinformatically detected regulatory, non protein coding, viral micro RNA (miRNA) gene. The method by which VGAM1153 was detected is described hereinabove with reference to FIGS. 1-8.

VGAM1153 gene, herein designated VGAM GENE, is a viral gene contained in the genome of Cowpox Virus. VGAM1153 host target gene, herein designated VGAM HOST TARGET GENE, is a human gene contained in the human genome.

VGAM1153 gene encodes a VGAM1153 precursor RNA, herein designated VGAM PRECURSOR RNA. Similar to other miRNA genes, and unlike most ordinary genes, VGAM1153 precursor RNA does not encode a protein. A nucleotide sequence identical or highly similar to the nucleotide sequence of VGAM1153 precursor RNA is designated SEQ ID:1139, and is provided hereinbelow with reference to the sequence listing part. Nucleotide sequence SEQ ID:1139 is located at position 2676 relative to the genome of Cowpox Virus.

VGAM1153 precursor RNA folds onto itself, forming VGAM1153 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1153 folded precursor RNA into VGAM1153 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1153 RNA is designated SEQ ID:3864, and is provided hereinbelow with reference to the sequence listing part.

VGAM1153 host target gene, herein designated VGAM HOST TARGET GENE, encodes a corresponding messenger RNA, VGAM1153 host target RNA, herein designated VGAM HOST TARGET RNA. VGAM1153 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1153 RNA, herein designated VGAM RNA, binds complementarily to one or more host target binding sites located in untranslated regions of VGAM1153 host target RNA, herein designated VGAM HOST TARGET RNA. This complementary binding is due to the fact that the nucleotide sequence of VGAM1153 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1153 RNA, herein designated VGAM RNA, may have a different number of host target binding sites in untranslated regions of a VGAM1153 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1153 RNA, herein designated VGAM RNA, to host target binding sites on VGAM1153 host target RNA, herein designated VGAM HOST TARGET RNA, such as BINDING SITE I, BINDING SITE II and BINDING SITE III, inhibits translation of VGAM1153 host target RNA into VGAM1153 host target protein, herein designated VGAM HOST TARGET PROTEIN. VGAM host target protein is therefore outlined by a broken line.

It is appreciated that VGAM1153 host target gene, herein designated VGAM HOST TARGET GENE, in fact represents a plurality of VGAM1153 host target genes. The mRNA of each one of this plurality of VGAM1153 host target genes comprises one or more host target binding sites, each having a nucleotide sequence which is at least partly complementary to VGAM1153 RNA, herein designated VGAM RNA, and which when bound by VGAM1153 RNA causes inhibition of translation of respective one or more VGAM1153 host target proteins.

It is further appreciated by one skilled in the art that the mode of translational inhibition illustrated by FIG. 1 with specific reference to translational inhibition exerted by VGAM1153 gene, herein designated VGAM GENE, on one or more VGAM1153 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1153 is inhibition of expression of host target genes, as part of a novel viral mechanism of attacking a host. Accordingly, utilities of VGAM1153 include diagnosis, prevention and treatment of viral infection by Cowpox Virus. Specific functions, and accordingly utilities, of VGAM1153 correlate with, and may be deduced from, the identity of the host target genes which VGAM1153 binds and inhibits, and the function of these host target genes, as elaborated hereinbelow.

Nucleotide sequences of the VGAM1153 precursor RNA, herein designated VGAM PRECURSOR RNA, and of the 'diced' VGAM1153 RNA, herein designated VGAM RNA, and a schematic representation of the secondary folding of VGAM1153 folded precursor RNA, herein designated VGAM FOLDED PRECURSOR RNA, of VGAM1153 are further described hereinbelow with reference to Table 1.

Nucleotide sequences of host target binding sites, such as BINDING SITE-I, BINDING SITE-II and BINDING SITE-III of FIG. 1, found on VGAM1153 host target RNA, and schematic representation of the complementarity of each of these host target binding sites to VGAM1153 RNA, herein designated VGAM RNA, are described hereinbelow with reference to Table 2.

As mentioned hereinabove with reference to FIG. 1, a function of VGAM1153 gene, herein designated VGAM is inhibition of expression of VGAM1153 target genes. It is appreciated that specific functions, and accordingly utilities, of VGAM1153 correlate with, and may be deduced from, the identity of the target genes which VGAM1153 binds and inhibits, and the function of these target genes, as elaborated hereinbelow.

Ac-like Transposable Element (ALTE, Accession NM_004729) is a VGAM1153 host target gene. ALTE BINDING SITE is HOST TARGET binding site found in the 3' untranslated region of mRNA encoded by ALTE, corresponding to a HOST TARGET binding site such as BINDING SITE I, BINDING SITE II or BINDING SITE III. Table 2 illustrates the complementarity of the nucleotide sequences of ALTE BINDING SITE, designated SEQ ID:11107, to the nucleotide sequence of VGAM1153 RNA, herein designated VGAM RNA, also designated SEQ ID:3864.

A function of VGAM1153 is therefore inhibition of Ac-like Transposable Element (ALTE, Accession NM_004729). Accordingly, utilities of VGAM1153 include diagnosis, prevention and treatment of diseases and clinical conditions associated with ALTE. FLJ23598 (Accession NM_024783) is another VGAM1153 host target gene. FLJ23598 BINDING SITE is HOST TARGET binding site found in the 5' untranslated region of mRNA encoded by FLJ23598, corresponding to a HOST TARGET binding site such as BINDING SITE I, BINDING SITE II or BINDING SITE III. Table 2 illustrates the complementarity of the nucleotide sequences of FLJ23598 BINDING SITE, designated SEQ ID:24158, to the nucleotide sequence of VGAM1153 RNA, herein designated VGAM RNA, also designated SEQ ID:3864.

Another function of VGAM1153 is therefore inhibition of FLJ23598 (Accession NM_024783). Accordingly, utilities of VGAM1153 include diagnosis, prevention and treatment of diseases and clinical conditions associated with FLJ23598. HMP19 (Accession XM_113455) is another VGAM1153 host target gene. HMP19 BINDING SITE is HOST TARGET binding site found in the 3' untranslated region of mRNA encoded by HMP19, corresponding to a HOST TARGET binding site such as BINDING SITE I, BINDING SITE II or BINDING SITE III. Table 2 illustrates the complementarity of the nucleotide sequences of HMP19 BINDING SITE, designated SEQ ID:42273, to the nucleotide sequence of VGAM1153 RNA, herein designated VGAM RNA, also designated SEQ ID:3864.

Another function of VGAM1153 is therefore inhibition of HMP19 (Accession XM_113455). Accordingly, utilities of VGAM1153 include diagnosis, prevention and treatment of diseases and clinical conditions associated with HMP19. KIAA1710 (Accession XM_031283) is another VGAM1153 host target gene. KIAA1710 BINDING SITE is HOST TARGET binding site found in the 3' untranslated region of mRNA encoded by KIAA1710, corresponding to a HOST TARGET binding site such as BINDING SITE I, BINDING SITE II or BINDING SITE III. Table 2 illustrates the complementarity of the nucleotide sequences of KIAA1710 BINDING SITE, designated SEQ ID:31332, to the nucleotide sequence of VGAM1153 RNA, herein designated VGAM RNA, also designated SEQ ID:3864.

Another function of VGAM1153 is therefore inhibition of KIAA1710 (Accession XM_031283). Accordingly, utilities of VGAM1153 include diagnosis, prevention and treatment of diseases and clinical conditions associated with KIAA1710. LOC143943 (Accession XM_096504) is another VGAM1153 host target gene. LOC143943 BINDING SITE is HOST TARGET binding site found in the 3' untranslated region of mRNA encoded by LOC143943, corresponding to a HOST TARGET binding site such as BINDING SITE I, BINDING SITE II or BINDING SITE III. Table 2 illustrates the complementarity of the nucleotide sequences of LOC143943 BINDING SITE, designated SEQ ID:40384, to the nucleotide sequence of VGAM1153 RNA, herein designated VGAM RNA, also designated SEQ ID:3864.

Another function of VGAM1153 is therefore inhibition of LOC143943 (Accession XM_096504). Accordingly, utilities of VGAM1153 include diagnosis, prevention and treatment of diseases and clinical conditions associated with LOC143943. LOC58489 (Accession XM_051862) is another VGAM1153 host target gene. LOC58489 BINDING SITE is HOST TARGET binding site found in the 3' untranslated region of mRNA encoded by LOC58489, corresponding to a HOST TARGET binding site such as BINDING SITE I, BINDING SITE II or BINDING SITE III. Table 2 illustrates the complementarity of the nucleotide sequences of LOC58489 BINDING SITE, designated SEQ ID:35905, to the nucleotide sequence of VGAM1153 RNA, herein designated VGAM RNA, also designated SEQ ID:3864.

Another function of VGAM1153 is therefore inhibition of LOC58489 (Accession XM_051862). Accordingly, utilities of VGAM1153 include diagnosis, prevention and treatment of diseases and clinical conditions associated with LOC58489. FIG. 1 further provides a conceptual description of a novel bioinformatically detected viral gene of the present invention, referred to here as Viral Genomic Address Messenger 1154 (VGAM1154) viral gene, which modulates expression of respective host target genes thereof, the function and utility of which host target genes is known in the art.

VGAM1154 is a novel bioinformatically detected regulatory, non protein coding, viral micro RNA (miRNA) gene. The method by which VGAM1154 was detected is described hereinabove with reference to FIGS. 1-8.

VGAM1154 gene, herein designated VGAM GENE, is a viral gene contained in the genome of Cowpox Virus. VGAM1154 host target gene, herein designated VGAM HOST TARGET GENE, is a human gene contained in the human genome.

VGAM1154 gene encodes a VGAM1154 precursor RNA, herein designated VGAM PRECURSOR RNA. Similar to other miRNA genes, and unlike most ordinary genes, VGAM1154 precursor RNA does not encode a protein. A nucleotide sequence identical or highly similar to the nucleotide sequence of VGAM1154 precursor RNA is designated SEQ ID:1140, and is provided hereinbelow with reference to the sequence listing part. Nucleotide sequence SEQ ID:1140 is located at position 1704 relative to the genome of Cowpox Virus.

VGAM1154 precursor RNA folds onto itself, forming VGAM1154 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1154 folded precursor RNA into VGAM1154 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1154 RNA is designated SEQ ID:3865, and is provided hereinbelow with reference to the sequence listing part.

VGAM1154 host target gene, herein designated VGAM HOST TARGET GENE, encodes a corresponding messenger RNA, VGAM1154 host target RNA, herein designated VGAM HOST TARGET RNA. VGAM1154 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1154 RNA, herein designated VGAM RNA, binds complementarily to one or more host target binding sites located in untranslated regions of VGAM1154 host target RNA, herein designated VGAM HOST TARGET RNA. This complementary binding is due to the fact that the nucleotide sequence of VGAM1154 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1154 RNA, herein designated VGAM RNA, may have a different number of host target binding sites in untranslated regions of a VGAM1154 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1154 RNA, herein designated VGAM RNA, to host target binding sites on VGAM1154 host target RNA, herein designated VGAM HOST TARGET RNA, such as BINDING SITE I, BINDING SITE II and BINDING SITE III, inhibits translation of VGAM1154 host target RNA into VGAM1154 host target protein, herein designated VGAM HOST TARGET PROTEIN. VGAM host target protein is therefore outlined by a broken line.

It is appreciated that VGAM1154 host target gene, herein designated VGAM HOST TARGET GENE, in fact represents a plurality of VGAM1154 host target genes. The mRNA of each one of this plurality of VGAM1154 host target genes comprises one or more host target binding sites, each having a nucleotide sequence which is at least partly complementary to VGAM1154 RNA, herein designated VGAM RNA, and which when bound by VGAM1154 RNA causes inhibition of translation of respective one or more VGAM1154 host target proteins.

It is further appreciated by one skilled in the art that the mode of translational inhibition illustrated by FIG. 1 with specific reference to translational inhibition exerted by VGAM1154 gene, herein designated VGAM GENE, on one or more VGAM1154 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1154 is inhibition of expression of host target genes, as part of a novel viral mechanism of attacking a host. Accordingly, utilities of VGAM1154 include diagnosis, prevention and treatment of viral infection by Cowpox Virus. Specific functions, and accordingly utilities, of VGAM1154 correlate with, and may be deduced from, the identity of the host target genes which VGAM1154 binds and inhibits, and the function of these host target genes, as elaborated hereinbelow.

Nucleotide sequences of the VGAM1154 precursor RNA, herein designated VGAM PRECURSOR RNA, and of the 'diced' VGAM1154 RNA, herein designated VGAM RNA, and a schematic representation of the secondary folding of VGAM1154 folded precursor RNA, herein designated VGAM FOLDED PRECURSOR RNA, of VGAM1154 are further described hereinbelow with reference to Table 1.

Nucleotide sequences of host target binding sites, such as BINDING SITE-I, BINDING SITE-II and BINDING SITE-III of FIG. 1, found on VGAM1154 host target RNA, and schematic representation of the complementarity of each of these host target binding sites to VGAM1154 RNA, herein designated VGAM RNA, are described hereinbelow with reference to Table 2.

As mentioned hereinabove with reference to FIG. 1, a function of VGAM1154 gene, herein designated VGAM is inhibition of expression of VGAM1154 target genes. It is appreciated that specific functions, and accordingly utilities, of VGAM1154 correlate with, and may be deduced from, the identity of the target genes which VGAM1154 binds and inhibits, and the function of these target genes, as elaborated hereinbelow.

Cyclic Nucleotide Gated Channel Beta 3 (CNGB3, Accession NM_019098) is a VGAM1154 host target gene. CNGB3 BINDING SITE is HOST TARGET binding site found in the 3' untranslated region of mRNA encoded by CNGB3, corresponding to a HOST TARGET binding site such as BINDING SITE I, BINDING SITE II or BINDING SITE III. Table 2 illustrates the complementarity of the nucleotide sequences of CNGB3 BINDING SITE, designated SEQ ID:21175, to the nucleotide sequence of VGAM1154 RNA, herein designated VGAM RNA, also designated SEQ ID:3865.

A function of VGAM1154 is therefore inhibition of Cyclic Nucleotide Gated Channel Beta 3 (CNGB3, Accession NM_019098). Accordingly, utilities of VGAM1154 include diagnosis, prevention and treatment of diseases and clinical conditions associated with CNGB3. Calneuron 1 (CALN1, Accession NM_031468) is another VGAM1154 host target gene. CALN1 BINDING SITE is HOST TARGET binding site found in the 3' untranslated region of mRNA encoded by CALN1, corresponding to a HOST TARGET binding site such as BINDING SITE I, BINDING SITE II or BINDING SITE III. Table 2 illustrates the complementarity of the nucleotide sequences of CALN1 BINDING SITE, designated SEQ ID:25517, to the nucleotide sequence of VGAM1154 RNA, herein designated VGAM RNA, also designated SEQ ID:3865.

Another function of VGAM1154 is therefore inhibition of Calneuron 1 (CALN1, Accession NM_031468). Accordingly, utilities of VGAM1154 include diagnosis, prevention and treatment of diseases and clinical conditions associated with CALN1. FIG. 1 further provides a conceptual description of a novel bioinformatically detected viral gene of the present invention, referred to here as Viral Genomic Address Messenger 1155 (VGAM1155) viral gene, which modulates expression of respective host target genes thereof, the function and utility of which host target genes is known in the art.

VGAM1155 is a novel bioinformatically detected regulatory, non protein coding, viral micro RNA (miRNA) gene. The method by which VGAM1155 was detected is described hereinabove with reference to FIGS. 1-8.

VGAM1155 gene, herein designated VGAM GENE, is a viral gene contained in the genome of Cowpox Virus. VGAM1155 host target gene, herein designated VGAM HOST TARGET GENE, is a human gene contained in the human genome.

VGAM1155 gene encodes a VGAM1155 precursor RNA, herein designated VGAM PRECURSOR RNA. Similar to other miRNA genes, and unlike most ordinary genes, VGAM1155 precursor RNA does not encode a protein. A nucleotide sequence identical or highly similar to the nucleotide sequence of VGAM1155 precursor RNA is designated SEQ ID:1141, and is provided hereinbelow with reference to the sequence listing part. Nucleotide sequence SEQ ID:1141 is located at position 147349 relative to the genome of Cowpox Virus.

VGAM1155 precursor RNA folds onto itself, forming VGAM1155 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1155 folded precursor RNA into VGAM1155 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1155 RNA is designated SEQ ID:3866, and is provided hereinbelow with reference to the sequence listing part.

VGAM1155 host target gene, herein designated VGAM HOST TARGET GENE, encodes a corresponding messenger RNA, VGAM1155 host target RNA, herein designated VGAM HOST TARGET RNA. VGAM1155 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1155 RNA, herein designated VGAM RNA, binds complementarily to one or more host target binding sites located in untranslated regions of VGAM1155 host target RNA, herein designated VGAM HOST TARGET RNA. This complementary binding is due to the fact that the nucleotide sequence of VGAM1155 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1155 RNA, herein designated VGAM RNA, may have a different number of host target binding sites in untranslated regions of a VGAM1155 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1155 RNA, herein designated VGAM RNA, to host target binding sites on VGAM1155 host target RNA, herein designated VGAM HOST TARGET RNA, such as BINDING SITE I, BINDING SITE II and BINDING SITE III, inhibits translation of VGAM1155 host target RNA into VGAM1155 host target protein, herein designated VGAM HOST TARGET PROTEIN. VGAM host target protein is therefore outlined by a broken line.

It is appreciated that VGAM1155 host target gene, herein designated VGAM HOST TARGET GENE, in fact represents a plurality of VGAM1155 host target genes. The mRNA of each one of this plurality of VGAM1155 host target genes comprises one or more host target binding sites, each having a nucleotide sequence which is at least partly complementary to VGAM1155 RNA, herein designated VGAM RNA, and which when bound by VGAM1155 RNA causes inhibition of translation of respective one or more VGAM1155 host target proteins.

It is further appreciated by one skilled in the art that the mode of translational inhibition illustrated by FIG. 1 with specific reference to translational inhibition exerted by VGAM1155 gene, herein designated VGAM GENE, on one or more VGAM1155 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1155 is inhibition of expression of host target genes, as part of a novel viral mechanism of attacking a host. Accordingly, utilities of VGAM1155 include diagnosis, prevention and treatment of viral infection by Cowpox Virus. Specific functions, and accordingly utilities, of VGAM1155 correlate with, and may be deduced from, the identity of the host target genes which VGAM1155 binds and inhibits, and the function of these host target genes, as elaborated hereinbelow.

Nucleotide sequences of the VGAM1155 precursor RNA, herein designated VGAM PRECURSOR RNA, and of the 'diced' VGAM1155 RNA, herein designated VGAM RNA, and a schematic representation of the secondary folding of VGAM1155 folded precursor RNA, herein designated VGAM FOLDED PRECURSOR RNA, of VGAM1155 are further described hereinbelow with reference to Table 1.

Nucleotide sequences of host target binding sites, such as BINDING SITE-I, BINDING SITE-II and BINDING SITE-III of FIG. 1, found on VGAM1155 host target RNA, and schematic representation of the complementarity of each of these host target binding sites to VGAM1155 RNA, herein designated VGAM RNA, are described hereinbelow with reference to Table 2.

As mentioned hereinabove with reference to FIG. 1, a function of VGAM1155 gene, herein designated VGAM is inhibition of expression of VGAM1155 target genes. It is appreciated that specific functions, and accordingly utilities, of VGAM1155 correlate with, and may be deduced from, the identity of the target genes which VGAM1155 binds and inhibits, and the function of these target genes, as elaborated hereinbelow.

Collagen, Type XIX, Alpha 1 (COL19A1, Accession NM_001858) is a VGAM1155 host target gene. COL19A1 BINDING SITE is HOST TARGET binding site found in the 3' untranslated region of mRNA encoded by COL19A1, corresponding to a HOST TARGET binding site such as BINDING SITE I, BINDING SITE II or BINDING SITE III. Table 2 illustrates the complementarity of the nucleotide sequences of COL19A1 BINDING SITE, designated SEQ ID:7594, to the nucleotide sequence of VGAM1155 RNA, herein designated VGAM RNA, also designated SEQ ID:3866.

A function of VGAM1155 is therefore inhibition of Collagen, Type XIX, Alpha 1 (COL19A1, Accession NM_001858), a gene which may act as a cross-bridge between fibrils and other extracellular matrix molecules. Accordingly, utilities of VGAM1155 include diagnosis, prevention and treatment of diseases and clinical conditions associated with COL19A1. The function of COL19A1 and its association with various diseases and clinical conditions, has been established by previous studies, as described hereinabove with reference to VGAM19. Erbb2 Interacting Protein (ERBB2IP, Accession NM_018695) is another VGAM1155 host target gene. ERBB2IP BINDING SITE is HOST TARGET binding site found in the 5' untranslated region of mRNA encoded by ERBB2IP, corresponding to a HOST TARGET binding site such as BINDING SITE I, BINDING SITE II or BINDING SITE III. Table 2 illustrates the complementarity of the nucleotide sequences of ERBB2IP BINDING SITE, designated SEQ ID:20774, to the nucleotide sequence of VGAM1155 RNA, herein designated VGAM RNA, also designated SEQ ID:3866.

Another function of VGAM1155 is therefore inhibition of Erbb2 Interacting Protein (ERBB2IP, Accession NM_018695), a gene which ERBB2 interacting protein; acts as an adaptor for the receptor ERBB2/HER2. Accordingly, utilities of VGAM1155 include diagnosis, prevention and treatment of diseases and clinical conditions associated with ERBB2IP. The function of ERBB2IP and its association with various diseases and clinical conditions, has been established by previous studies, as described hereinabove with reference to VGAM1019. Mannosyl (alpha-1,6-)-glycoprotein Beta-1, 6-N-acetyl-glucosaminyltransferase (MGAT5, Accession NM_002410) is another VGAM1155 host target gene. MGAT5 BINDING SITE is HOST TARGET binding site found in the 5' untranslated region of mRNA encoded by MGAT5, corresponding to a HOST TARGET binding site such as BINDING SITE I, BINDING SITE II or BINDING SITE III. Table 2 illustrates the complementarity of the nucleotide sequences of MGAT5 BINDING SITE, designated SEQ ID:8239, to the nucleotide sequence of VGAM1155 RNA, herein designated VGAM RNA, also designated SEQ ID:3866.

Another function of VGAM1155 is therefore inhibition of Mannosyl (alpha-1,6-)-glycoprotein Beta-1,6-N-acetyl-glucosaminyltransferase (MGAT5, Accession NM_002410). Accordingly, utilities of VGAM1155 include diagnosis, prevention and treatment of diseases and clinical conditions associated with MGAT5. Retinoid X Receptor, Beta (RXRB, Accession NM_021976) is another VGAM1155 host target gene. RXRB BINDING SITE is HOST TARGET binding site found in the 3' untranslated region of mRNA encoded by RXRB, corresponding to a HOST TARGET binding site such as BINDING SITE I, BINDING SITE II or BINDING SITE III. Table 2 illustrates the complementarity of the nucleotide sequences of RXRB BINDING SITE, designated SEQ ID:22501, to the nucleotide sequence of VGAM1155 RNA, herein designated VGAM RNA, also designated SEQ ID:3866.

Another function of VGAM1155 is therefore inhibition of Retinoid X Receptor, Beta (RXRB, Accession NM_021976), a gene which binds to and serves as transcriptional coactivator for retinoic acid. Accordingly, utilities of VGAM1155 include diagnosis, prevention and treatment of diseases and clinical conditions associated with RXRB. The function of RXRB has been established by previous studies. The retinoic acid receptors, alpha (RARA; 180240), beta (RARB; 180220), and gamma (RARG; 180190), require coregulators to bind effectively to response elements and target genes. By a strategy of sequential screening of expression libraries with a retinoic acid response element and RAR, Yu et al. (1991) identified a cDNA encoding a coregulator highly related to RXR-alpha (OMIM Ref. No. 180245). This protein, termed RXR-beta, formed heterodimers with RAR, preferentially increasing its DNA binding and transcriptional activity on promoters containing retinoic acid, but not thyroid hormone or vitamin D, response elements. Remarkably, RXR-beta also heterodimerized with thyroid hormone and vitamin D receptors, increasing both DNA binding and transcriptional function on their respective response elements. RXR-alpha also formed heterodimers with these receptors. These observations suggested that retinoid X receptors meet the criteria for biochemically characterized cellular coregulators and serve to target selectively the high affinity binding of retinoic acid, thyroid hormone, and vitamin D receptors to their cognate DNA response elements In an elegant series of experiments designed to understand the effect of RXR activation on cholesterol balance, Repa et al. (2000) treated animals with the rexinoid LG268. Animals treated with rexinoid exhibited marked changes in cholesterol balance, including inhibition of cholesterol absorption and repressed bile acid synthesis. Studies with receptor-selective agonists revealed that oxysterol receptors (LXRs, OMIM Ref. No. 602423 and 600380) and the bile acid receptor, FXR (OMIM Ref. No. 603826), are the RXR heterodimeric partners that mediate these effects by regulating expression of the reverse-cholesterol transporter, ABC1 (OMIM Ref. No. 600046), and the rate-limiting enzyme of bile acid synthesis, CYP7A1 (OMIM Ref. No. 118455), respectively. These RXR heterodimers serve as key regulators in cholesterol homeostasis by governing reverse cholesterol transport from peripheral tissues, bile acid synthesis in liver, and cholesterol absorption in intestine. Activation of RXR/LXR heterodimers inhibits cholesterol absorption by upregulation of ABC1 expression in the small intestine. Activation of RXR/FXR heterodimers represses CYP7A1 expression and bile acid production, leading to a failure to solubilize and absorb cholesterol. Studies have shown that RXR/FXR-mediated repression of CYP7A1 is dominant over RXR/LXR-mediated induction of CYP7A1, which explains why the rexinoid represses rather than activates CYP7A1 (Lu et al., 2000). Activation of the LXR signaling pathway results in the upregulation of ABC1 in peripheral cells, including macrophages, to efflux free cholesterol for transport back to the liver through high density lipoprotein, where it is converted to bile acids by the LXR-mediated increase in CYP7A1 expression. Secretion of biliary cholesterol in the presence of increased bile acid pools normally results in enhanced reabsorption of cholesterol; however, with the increased expression of ABC1 and efflux of cholesterol back into the lumen, there is a reduction in cholesterol absorption and net excretion of cholesterol and bile acid. Rexinoids therefore offer a novel class of agents for treating elevated cholesterol Full details of the abovementioned studies are described in the following publications, the disclosure of which are hereby incorporated by reference:

Lu, T. T.; Makishima, M.; Repa, J. J.; Schoonjans, K.; Kerr, T. A.; Auwerx, J.; Mangelsdorf, D. J.: Molecular basis for feedback regulation of bile acid synthesis by nuclear receptors. Molec. Cell 6:507-515, 2000; and Repa, J. J.; Turley, S. D.; Lobaccaro, J.-M. A.; Medina, J.; Li, L.; Lustig, K.; Shan, B.; Heyman, R. A.; Dletschy, J. M.; Mangelsdorf, D. J.: Regulation of absorption and ABC1-mediate.

Further studies establishing the function and utilities of RXRB are found in John Hopkins OMIM database record ID 180246, and in sited publications numbered 2726, 5949-5950, 5938, 5941, 595 and 5952 listed in the bibliography section hereinbelow, which are also hereby incorporated by reference. FLJ23598 (Accession NM_024783) is another VGAM1155 host target gene. FLJ23598 BINDING SITE is HOST TARGET binding site found in the 5' untranslated region of mRNA encoded by FLJ23598, corresponding to a HOST TARGET binding site such as BINDING SITE I, BINDING SITE II or BINDING SITE III. Table 2 illustrates the complementarity of the nucleotide sequences of FLJ23598 BINDING SITE, designated SEQ ID:24153, to the nucleotide sequence of VGAM1155 RNA, herein designated VGAM RNA, also designated SEQ ID:3866.

Another function of VGAM1155 is therefore inhibition of FLJ23598 (Accession NM_024783). Accordingly, utilities of VGAM1155 include diagnosis, prevention and treatment of diseases and clinical conditions associated with FLJ23598. KIAA1128 (Accession XM_043596) is another VGAM1155 host target gene. KIAA1128 BINDING SITE is HOST TARGET binding site found in the 3' untranslated region of mRNA encoded by KIAA1128, corresponding to a HOST TARGET binding site such as BINDING SITE I, BINDING SITE II or BINDING SITE III. Table 2 illustrates the complementarity of the nucleotide sequences of KIAA1128 BINDING SITE, designated SEQ ID:33965, to the nucleotide sequence of VGAM1155 RNA, herein designated VGAM RNA, also designated SEQ ID:3866.

Another function of VGAM1155 is therefore inhibition of KIAA1128 (Accession XM_043596). Accordingly, utilities of VGAM1155 include diagnosis, prevention and treatment of diseases and clinical conditions associated with KIAA1128. Kelch-like 6 (Drosophila) (KLHL6, Accession NM_130446) is another VGAM1155 host target gene. KLHL6 BINDING SITE is HOST TARGET binding site found in the 3' untranslated region of mRNA encoded by KLHL6, corresponding to a HOST TARGET binding site such as BINDING SITE I, BINDING SITE II or BINDING SITE III. Table 2 illustrates the complementarity of the nucleotide sequences of KLHL6 BINDING SITE, designated SEQ ID:28209, to the nucleotide sequence of VGAM1155 RNA, herein designated VGAM RNA, also designated SEQ ID:3866.

Another function of VGAM1155 is therefore inhibition of Kelch-like 6 (Drosophila) (KLHL6, Accession NM_130446). Accordingly, utilities of VGAM1155 include diagnosis, prevention and treatment of diseases and clinical conditions associated with KLHL6. MGC10966 (Accession NM_031471) is another VGAM1155 host target gene. MGC10966 BINDING SITE is HOST TARGET binding site found in the 5' untranslated region of mRNA encoded by MGC10966, corresponding to a HOST TARGET binding site such as BINDING SITE I, BINDING SITE II or BINDING SITE III. Table 2 illustrates the complementarity of the nucleotide sequences of MGC10966 BINDING SITE, designated SEQ ID:25535, to the nucleotide sequence of VGAM1155 RNA, herein designated VGAM RNA, also designated SEQ ID:3866.

Another function of VGAM1155 is therefore inhibition of MGC10966 (Accession NM_031471). Accordingly, utilities of VGAM1155 include diagnosis, prevention and treatment of diseases and clinical conditions associated with MGC10966. MGC15873 (Accession NM_032920) is another VGAM1155 host target gene. MGC15873 BINDING SITE is HOST TARGET binding site found in the 3' untranslated region of mRNA encoded by MGC15873, corresponding to a HOST TARGET binding site such as BINDING SITE I, BINDING SITE II or BINDING SITE III. Table 2 illustrates the complementarity of the nucleotide sequences of MGC15873 BINDING SITE, designated SEQ ID:26742, to the nucleotide sequence of VGAM1155 RNA, herein designated VGAM RNA, also designated SEQ ID:3866.

Another function of VGAM1155 is therefore inhibition of MGC15873 (Accession NM_032920). Accordingly, utilities of VGAM1155 include diagnosis, prevention and treatment of diseases and clinical conditions associated with MGC15873. Platelet Derived Growth Factor C (PDGFC, Accession NM_016205) is another VGAM1155 host target gene. PDGFC BINDING SITE is HOST TARGET binding site found in the 3' untranslated region of mRNA encoded by PDGFC, corresponding to a HOST TARGET binding site such as BINDING SITE I, BINDING SITE II or BINDING SITE III. Table 2 illustrates the complementarity of the nucleotide sequences of PDGFC BINDING SITE, designated SEQ ID:18301, to the nucleotide sequence of VGAM1155 RNA, herein designated VGAM RNA, also designated SEQ ID:3866.

Another function of VGAM1155 is therefore inhibition of Platelet Derived Growth Factor C (PDGFC, Accession NM_016205). Accordingly, utilities of VGAM1155 include diagnosis, prevention and treatment of diseases and clinical conditions associated with PDGFC. POPX1 (Accession NM_014906) is another VGAM1155 host target gene. POPX1 BINDING SITE is HOST TARGET binding site found in the 3' untranslated region of mRNA encoded by POPX1, corresponding to a HOST TARGET binding site such as BINDING SITE I, BINDING SITE II or BINDING SITE III. Table 2 illustrates the complementarity of the nucleotide sequences of POPX1 BINDING SITE, designated SEQ ID:17121, to the nucleotide sequence of VGAM1155 RNA, herein designated VGAM RNA, also designated SEQ ID:3866.

Another function of VGAM1155 is therefore inhibition of POPX1 (Accession NM_014906). Accordingly, utilities of VGAM1155 include diagnosis, prevention and treatment of diseases and clinical conditions associated with POPX1. SAM Domain and HD Domain 1 (SAMHD1, Accession XM_028704) is another VGAM1155 host target gene. SAMHD1 BINDING SITE is HOST TARGET binding site found in the 3' untranslated region of mRNA encoded by SAMHD1, corresponding to a HOST TARGET binding site such as BINDING SITE I, BINDING SITE II or BINDING SITE III. Table 2 illustrates the complementarity of the nucleotide sequences of SAMHD1 BINDING SITE, designated SEQ ID:30733, to the nucleotide sequence of VGAM1155 RNA, herein designated VGAM RNA, also designated SEQ ID:3866.

Another function of VGAM1155 is therefore inhibition of SAM Domain and HD Domain 1 (SAMHD1, Accession XM_028704). Accordingly, utilities of VGAM1155 include diagnosis, prevention and treatment of diseases and clinical conditions associated with SAMHD1. SCYD1 (Accession XM_165650) is another VGAM1155 host target gene. SCYD1 BINDING SITE is HOST TARGET binding site found in the 3' untranslated region of mRNA encoded by SCYD1, corresponding to a HOST TARGET binding site such as BINDING SITE I, BINDING SITE II or BINDING SITE III. Table 2 illustrates the complementarity of the nucleotide sequences of SCYD1 BINDING SITE, designated SEQ ID:43711, to the nucleotide sequence of VGAM1155 RNA, herein designated VGAM RNA, also designated SEQ ID:3866.

Another function of VGAM1155 is therefore inhibition of SCYD1 (Accession XM_165650). Accordingly, utilities of VGAM1155 include diagnosis, prevention and treatment of diseases and clinical conditions associated with SCYD1. Sialyltransferase 9 (CMP-NeuAc:lactosylceramide alpha-2,3-sialyl transferase; GM3 synthase) (SIAT9, Accession NM_003896) is another VGAM1155 host target gene. SIAT9 BINDING SITE is HOST TARGET binding site found in the 3' untranslated region of mRNA encoded by SIAT9, corresponding to a HOST TARGET binding site such as BIND- ING SITE I, BINDING SITE II or BINDING SITE III. Table 2 illustrates the complementarity of the nucleotide sequences of SIAT9 BINDING SITE, designated SEQ ID:9976, to the nucleotide sequence of VGAM1155 RNA, herein designated VGAM RNA, also designated SEQ ID:3866.

Another function of VGAM1155 is therefore inhibition of Sialyltransferase 9 (CMP-NeuAc:lactosylceramide alpha-2, 3-sialyl transferase; GM3 synthase) (SIAT9, Accession NM_003896). Accordingly, utilities of VGAM1155 include diagnosis, prevention and treatment of diseases and clinical conditions associated with SIAT9. LOC127534 (Accession XM_060532) is another VGAM1155 host target gene. LOC127534 BINDING SITE is HOST TARGET binding site found in the 3' untranslated region of mRNA encoded by LOC127534, corresponding to a HOST TARGET binding site such as BINDING SITE I, BINDING SITE II or BINDING SITE III. Table 2 illustrates the complementarity of the nucleotide sequences of LOC127534 BINDING SITE, designated SEQ ID:37171, to the nucleotide sequence of VGAM1155 RNA, herein designated VGAM RNA, also designated SEQ ID:3866.

Another function of VGAM1155 is therefore inhibition of LOC127534 (Accession XM_060532). Accordingly, utilities of VGAM1155 include diagnosis, prevention and treatment of diseases and clinical conditions associated with LOC127534. LOC130535 (Accession XM_072244) is another VGAM1155 host target gene. LOC130535 BINDING SITE is HOST TARGET binding site found in the 3' untranslated region of mRNA encoded by LOC130535, corresponding to a HOST TARGET binding site such as BINDING SITE I, BINDING SITE II or BINDING SITE III. Table 2 illustrates the complementarity of the nucleotide sequences of LOC130535 BINDING SITE, designated SEQ ID:37475, to the nucleotide sequence of VGAM1155 RNA, herein designated VGAM RNA, also designated SEQ ID:3866.

Another function of VGAM1155 is therefore inhibition of LOC130535 (Accession XM_072244). Accordingly, utilities of VGAM1155 include diagnosis, prevention and treatment of diseases and clinical conditions associated with LOC130535. LOC221395 (Accession XM_166354) is another VGAM1155 host target gene. LOC221395 BINDING SITE is HOST TARGET binding site found in the 3' untranslated region of mRNA encoded by LOC221395, corresponding to a HOST TARGET binding site such as BINDING SITE I, BINDING SITE II or BINDING SITE III. Table 2 illustrates the complementarity of the nucleotide sequences of LOC221395 BINDING SITE, designated SEQ ID:44185, to the nucleotide sequence of VGAM1155 RNA, herein designated VGAM RNA, also designated SEQ ID:3866.

Another function of VGAM1155 is therefore inhibition of LOC221395 (Accession XM_166354). Accordingly, utilities of VGAM1155 include diagnosis, prevention and treatment of diseases and clinical conditions associated with LOC221395. LOC91947 (Accession XM_041721) is another VGAM1155 host target gene. LOC91947 BINDING SITE is HOST TARGET binding site found in the 3' untranslated region of mRNA encoded by LOC91947, corresponding to a HOST TARGET binding site such as BINDING SITE I, BINDING SITE II or BINDING SITE III. Table 2 illustrates the complementarity of the nucleotide sequences of LOC91947 BINDING SITE, designated SEQ ID:33569, to the nucleotide sequence of VGAM1155 RNA, herein designated VGAM RNA, also designated SEQ ID:3866.

Another function of VGAM1155 is therefore inhibition of LOC91947 (Accession XM_041721). Accordingly, utilities of VGAM1155 include diagnosis, prevention and treatment of diseases and clinical conditions associated with LOC91947. FIG. 1 further provides a conceptual description of a novel bioinformatically detected viral gene of the present invention, referred to here as Viral Genomic Address Messenger 1156 (VGAM1156) viral gene, which modulates expression of respective host target genes thereof, the function and utility of which host target genes is known in the art.

VGAM1156 is a novel bioinformatically detected regulatory, non protein coding, viral micro RNA (miRNA) gene. The method by which VGAM1156 was detected is described hereinabove with reference to FIGS. 1-8.

VGAM1156 gene, herein designated VGAM GENE, is a viral gene contained in the genome of Camelpox Virus. VGAM1156 host target gene, herein designated VGAM HOST TARGET GENE, is a human gene contained in the human genome.

VGAM1156 gene encodes a VGAM1156 precursor RNA, herein designated VGAM PRECURSOR RNA. Similar to other miRNA genes, and unlike most ordinary genes, VGAM1156 precursor RNA does not encode a protein. A nucleotide sequence identical or highly similar to the nucleotide sequence of VGAM1156 precursor RNA is designated SEQ ID:1142, and is provided hereinbelow with reference to the sequence listing part. Nucleotide sequence SEQ ID:1142 is located at position 134779 relative to the genome of Camelpox Virus.

VGAM1156 precursor RNA folds onto itself, forming VGAM1156 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1156 folded precursor RNA into VGAM1156 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM1156 RNA is designated SEQ ID:3867, and is provided hereinbelow with reference to the sequence listing part.

VGAM1156 host target gene, herein designated VGAM HOST TARGET GENE, encodes a corresponding messenger RNA, VGAM1156 host target RNA, herein designated VGAM HOST TARGET RNA. VGAM1156 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1156 RNA, herein designated VGAM RNA, binds complementarily to one or more host target binding sites located in untranslated regions of VGAM1156 host target RNA, herein designated VGAM HOST TARGET RNA. This complementary binding is due to the fact that the nucleotide sequence of VGAM1156 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1156 RNA, herein designated VGAM RNA, may have a different number of host target binding sites in untranslated regions of a VGAM1156 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1156 RNA, herein designated VGAM RNA, to host target binding sites on VGAM1156 host target RNA, herein designated VGAM HOST TARGET RNA, such as BINDING SITE I, BINDING SITE II and BINDING SITE III, inhibits translation of VGAM1156 host target RNA into VGAM1156 host target protein, herein designated VGAM HOST TARGET PROTEIN. VGAM host target protein is therefore outlined by a broken line.

It is appreciated that VGAM1156 host target gene, herein designated VGAM HOST TARGET GENE, in fact represents a plurality of VGAM1156 host target genes. The mRNA of each one of this plurality of VGAM1156 host target genes comprises one or more host target binding sites, each having a nucleotide sequence which is at least partly complementary to VGAM1156 RNA, herein designated VGAM RNA, and which when bound by VGAM1156 RNA causes inhibition of translation of respective one or more VGAM1156 host target proteins.

It is further appreciated by one skilled in the art that the mode of translational inhibition illustrated by FIG. 1 with specific reference to translational inhibition exerted by VGAM1156 gene, herein designated VGAM GENE, on one or more VGAM1156 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1156 is inhibition of expression of host target genes, as part of a novel viral mechanism of attacking a host. Accordingly, utilities of VGAM1156 include diagnosis, prevention and treatment of viral infection by Camelpox Virus. Specific functions, and accordingly utilities, of VGAM1156 correlate with, and may be deduced from, the identity of the host target genes which VGAM1156 binds and inhibits, and the function of these host target genes, as elaborated hereinbelow.

Nucleotide sequences of the VGAM1156 precursor RNA, herein designated VGAM PRECURSOR RNA, and of the 'diced' VGAM1156 RNA, herein designated VGAM RNA, and a schematic representation of the secondary folding of VGAM1156 folded precursor RNA, herein designated VGAM FOLDED PRECURSOR RNA, of VGAM1156 are further described hereinbelow with reference to Table 1.

Nucleotide sequences of host target binding sites, such as BINDING SITE-I, BINDING SITE-II and BINDING SITE-III of FIG. 1, found on VGAM1156 host target RNA, and schematic representation of the complementarity of each of these host target binding sites to VGAM1156 RNA, herein designated VGAM RNA, are described hereinbelow with reference to Table 2.

As mentioned hereinabove with reference to FIG. 1, a function of VGAM1156 gene, herein designated VGAM is inhibition of expression of VGAM1156 target genes. It is appreciated that specific functions, and accordingly utilities, of VGAM1156 correlate with, and may be deduced from, the identity of the target genes which VGAM1156 binds and inhibits, and the function of these target genes, as elaborated hereinbelow.

BDG-29 (Accession XM_051343) is a VGAM1156 host target gene. BDG-29 BINDING SITE is HOST TARGET binding site found in the 3' untranslated region of mRNA encoded by BDG-29, corresponding to a HOST TARGET binding site such as BINDING SITE I, BINDING SITE II or BINDING SITE III. Table 2 illustrates the complementarity of the nucleotide sequences of BDG-29 BINDING SITE, designated SEQ ID:35816, to the nucleotide sequence of VGAM1156 RNA, herein designated VGAM RNA, also designated SEQ ID:3867.

A function of VGAM1156 is therefore inhibition of BDG-29 (Accession XM_051343). Accordingly, utilities of VGAM1156 include diagnosis, prevention and treatment of diseases and clinical conditions associated with BDG-29. Chromosome 21 Open Reading Frame 6 (C21orf6, Accession NM_016940) is another VGAM1156 host target gene. C21orf6 BINDING SITE is HOST TARGET binding site found in the 3" untranslated region of mRNA encoded by C21orf6, corresponding to a HOST TARGET binding site such as BINDING SITE I, BINDING SITE II or BINDING SITE III. Table 2 illustrates the complementarity of the nucleotide sequences of C21orf6 BINDING SITE, designated SEQ ID:18855, to the nucleotide sequence of VGAM1156 RNA, herein designated VGAM RNA, also designated SEQ ID:3867.

Another function of VGAM1156 is therefore inhibition of Chromosome 21 Open Reading Frame 6 (C21orf6, Accession NM_016940). Accordingly, utilities of VGAM1156 include diagnosis, prevention and treatment of diseases and clinical conditions associated with C21orf6. DKFZp434D177 (Accession NM_032264) is another VGAM1156 host target gene. DKFZp434D177 BINDING SITE is HOST TARGET binding site found in the 3' untranslated region of mRNA encoded by DKFZp434D177, corresponding to a HOST TARGET binding site such as BINDING SITE I, BINDING SITE II or BINDING SITE III. Table 2 illustrates the complementarity of the nucleotide sequences of DKFZp434D177 BINDING SITE, designated SEQ ID:26007, to the nucleotide sequence of VGAM1156 RNA, herein designated VGAM RNA, also designated SEQ ID:3867.

Another function of VGAM1156 is therefore inhibition of DKFZp434D177 (Accession NM_032264). Accordingly, utilities of VGAM1156 include diagnosis, prevention and treatment of diseases and clinical conditions associated with DKFZp434D177. HSA249128 (Accession NM_017583) is another VGAM1156 host target gene. HSA249128 BINDING SITE is HOST TARGET binding site found in the 3' untranslated region of mRNA encoded by HSA249128, corresponding to a HOST TARGET binding site such as BINDING SITE I, BINDING SITE II or BINDING SITE III. Table 2 illustrates the complementarity of the nucleotide sequences of HSA249128 BINDING SITE, designated SEQ ID:19027, to the nucleotide sequence of VGAM1156 RNA, herein designated VGAM RNA, also designated SEQ ID:3867.

Another function of VGAM1156 is therefore inhibition of HSA249128 (Accession NM_017583). Accordingly, utilities of VGAM1156 include diagnosis, prevention and treatment of diseases and clinical conditions associated with HSA249128. KIAA1634 (Accession XM_032749) is another VGAM1156 host target gene. KIAA1634 BINDING SITE is HOST TARGET binding site found in the 3' untranslated region of mRNA encoded by KIAA1634, corresponding to a HOST TARGET binding site such as BINDING SITE I, BINDING SITE II or BINDING SITE III. Table 2 illustrates the complementarity of the nucleotide sequences of KIAA1634 BINDING SITE, designated SEQ ID:31751, to the nucleotide sequence of VGAM1156 RNA, herein designated VGAM RNA, also designated SEQ ID:3867.

Another function of VGAM1156 is therefore inhibition of KIAA1634 (Accession XM_032749). Accordingly, utilities of VGAM1156 include diagnosis, prevention and treatment of diseases and clinical conditions associated with KIAA1634. KIAA1941 (Accession XM_059318) is another VGAM1156 host target gene. KIAA1941 BINDING SITE is HOST TARGET binding site found in the 3' untranslated region of mRNA encoded by KIAA1941, corresponding to a HOST TARGET binding site such as BINDING SITE I, BINDING SITE II or BINDING SITE III. Table 2 illustrates the complementarity of the nucleotide sequences of KIAA1941 BINDING SITE, designated SEQ ID:36951, to the nucleotide sequence of VGAM1156 RNA, herein designated VGAM RNA, also designated SEQ ID:3867.

Another function of VGAM1156 is therefore inhibition of KIAA1941 (Accession XM_059318). Accordingly, utilities of VGAM1156 include diagnosis, prevention and treatment of diseases and clinical conditions associated with KIAA1941. PRO2533 (Accession NM_018629) is another VGAM1156 host target gene. PRO2533 BINDING SITE is HOST TARGET binding site found in the 3' untranslated region of mRNA encoded by PRO2533, corresponding to a HOST TARGET binding site such as BINDING SITE I, BINDING SITE II or BINDING SITE III. Table 2 illustrates the complementarity of the nucleotide sequences of PRO2533 BINDING SITE, designated SEQ ID:20702, to the nucleotide sequence of VGAM1156 RNA, herein designated VGAM RNA, also designated SEQ ID:3867.

Another function of VGAM1156 is therefore inhibition of PRO2533 (Accession NM_018629). Accordingly, utilities of VGAM1156 include diagnosis, prevention and treatment of diseases and clinical conditions associated with PRO2533. LOC151201 (Accession XM_098021) is another VGAM1156 host target gene. LOC151201 BINDING SITE is HOST TARGET binding site found in the 3' untranslated region of mRNA encoded by LOC151201, corresponding to a HOST TARGET binding site such as BINDING SITE I, BINDING SITE II or BINDING SITE III. Table 2 illustrates the complementarity of the nucleotide sequences of LOC151201 BINDING SITE, designated SEQ ID:41323, to the nucleotide sequence of VGAM1156 RNA, herein designated VGAM RNA, also designated SEQ ID:3867.

Another function of VGAM1156 is therefore inhibition of LOC151201 (Accession XM_098021). Accordingly, utilities of VGAM1156 include diagnosis, prevention and treatment of diseases and clinical conditions associated with LOC151201. FIG. 1 further provides a conceptual description of a novel bioinformatically detected viral gene of the present invention, referred to here as Viral Genomic Address Messenger 1157 (VGAM1157) viral gene, which modulates expression of respective host target genes thereof, the function and utility of which host target genes is known in the art.

VGAM1157 is a novel bioinformatically detected regulatory, non protein coding, viral micro RNA (miRNA) gene. The method by which VGAM1157 was detected is described hereinabove with reference to FIGS. 1-8.

VGAM1157 gene, herein designated VGAM GENE, is a viral gene contained in the genome of Camelpox Virus. VGAM1157 host target gene, herein designated VGAM HOST TARGET GENE, is a human gene contained in the human genome.

VGAM1157 gene encodes a VGAM1157 precursor RNA, herein designated VGAM PRECURSOR RNA. Similar to other miRNA genes, and unlike most ordinary genes, VGAM1157 precursor RNA does not encode a protein. A nucleotide sequence identical or highly similar to the nucleotide sequence of VGAM1157 precursor RNA is designated SEQ ID:1143, and is provided hereinbelow with reference to the sequence listing part. Nucleotide sequence SEQ ID:1143 is located at position 135685 relative to the genome of Camelpox Virus.

VGAM1157 precursor RNA folds onto itself, forming VGAM1157 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1157 folded precursor RNA into VGAM1157 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1157 RNA is designated SEQ ID:3868, and is provided hereinbelow with reference to the sequence listing part.

VGAM1157 host target gene, herein designated VGAM HOST TARGET GENE, encodes a corresponding messenger RNA, VGAM1157 host target RNA, herein designated VGAM HOST TARGET RNA. VGAM1157 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1157 RNA, herein designated VGAM RNA, binds complementarily to one or more host target binding sites located in untranslated regions of VGAM1157 host target RNA, herein designated VGAM HOST TARGET RNA. This complementary binding is due to the fact that the nucleotide sequence of VGAM1157 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1157 RNA, herein designated VGAM RNA, may have a different number of host target binding sites in untranslated regions of a VGAM1157 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1157 RNA, herein designated VGAM RNA, to host target binding sites on VGAM1157 host target RNA, herein designated VGAM HOST TARGET RNA, such as BINDING SITE I, BINDING SITE II and BINDING SITE III, inhibits translation of VGAM1157 host target RNA into VGAM1157 host target protein, herein designated VGAM HOST TARGET PROTEIN. VGAM host target protein is therefore outlined by a broken line.

It is appreciated that VGAM1157 host target gene, herein designated VGAM HOST TARGET GENE, in fact represents a plurality of VGAM1157 host target genes. The mRNA of each one of this plurality of VGAM1157 host target genes comprises one or more host target binding sites, each having a nucleotide sequence which is at least partly complementary to VGAM1157 RNA, herein designated VGAM RNA, and which when bound by VGAM1157 RNA causes inhibition of translation of respective one or more VGAM1157 host target proteins.

It is further appreciated by one skilled in the art that the mode of translational inhibition illustrated by FIG. 1 with specific reference to translational inhibition exerted by VGAM1157 gene, herein designated VGAM GENE, on one or more VGAM1157 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1157 is inhibition of expression of host target genes, as part of a novel viral mechanism of attacking a host. Accordingly, utilities of VGAM1157 include diagnosis, prevention and treatment of viral infection by Camelpox Virus. Specific functions, and accordingly utilities, of VGAM1157 correlate with, and may be deduced from, the identity of the host target genes which VGAM1157 binds and inhibits, and the function of these host target genes, as elaborated hereinbelow.

Nucleotide sequences of the VGAM1157 precursor RNA, herein designated VGAM PRECURSOR RNA, and of the 'diced' VGAM1157 RNA, herein designated VGAM RNA, and a schematic representation of the secondary folding of VGAM1157 folded precursor RNA, herein designated VGAM FOLDED PRECURSOR RNA, of VGAM1157 are further described hereinbelow with reference to Table 1.

Nucleotide sequences of host target binding sites, such as BINDING SITE-I, BINDING SITE-II and BINDING SITE-III of FIG. 1, found on VGAM1157 host target RNA, and schematic representation of the complementarity of each of these host target binding sites to VGAM1157 RNA, herein designated VGAM RNA, are described hereinbelow with reference to Table 2.

As mentioned hereinabove with reference to FIG. 1, a function of VGAM1157 gene, herein designated VGAM is inhibition of expression of VGAM1157 target genes. It is appreciated that specific functions, and accordingly utilities, of VGAM1157 correlate with, and may be deduced from, the identity of the target genes which VGAM1157 binds and inhibits, and the function of these target genes, as elaborated hereinbelow.

Neurotrophic Tyrosine Kinase, Receptor, Type 2 (NTRK2, Accession NM_006180) is a VGAM1157 host target gene. NTRK2 BINDING SITE is HOST TARGET binding site found in the 3' untranslated region of mRNA encoded by NTRK2, corresponding to a HOST TARGET binding site such as BINDING SITE I, BINDING SITE II or BINDING SITE III. Table 2 illustrates the complementarity of the nucleotide sequences of NTRK2 BINDING SITE, designated SEQ ID:12841, to the nucleotide sequence of VGAM1157 RNA, herein designated VGAM RNA, also designated SEQ ID:3868.

A function of VGAM1157 is therefore inhibition of Neurotrophic Tyrosine Kinase, Receptor, Type 2 (NTRK2, Accession NM_006180), a gene which is involved in the development and/or maintenance of the nervous system. Accordingly, utilities of VGAM1157 include diagnosis, prevention and treatment of diseases and clinical conditions associated with NTRK2. The function of NTRK2 and its association with various diseases and clinical conditions, has been established by previous studies, as described hereinabove with reference to VGAM341. LOC116143 (Accession XM_057465) is another VGAM1157 host target gene. LOC116143 BINDING SITE is HOST TARGET binding site found in the 3' untranslated region of mRNA encoded by LOC116143, corresponding to a HOST TARGET binding site such as BINDING SITE I, BINDING SITE II or BINDING SITE III. Table 2 illustrates the complementarity of the nucleotide sequences of LOC116143 BINDING SITE, designated SEQ ID:36516, to the nucleotide sequence of VGAM1157 RNA, herein designated VGAM RNA, also designated SEQ ID:3868.

Another function of VGAM1157 is therefore inhibition of LOC116143 (Accession XM_057465). Accordingly, utilities of VGAM1157 include diagnosis, prevention and treatment of diseases and clinical conditions associated with LOC116143. LOC151121 (Accession XM_087102) is another VGAM1157 host target gene. LOC151121 BINDING SITE is HOST TARGET binding site found in the 5' untranslated region of mRNA encoded by LOC151121, corresponding to a HOST TARGET binding site such as BINDING SITE I, BINDING SITE II or BINDING SITE III. Table 2 illustrates the complementarity of the nucleotide sequences of LOC151121 BINDING SITE, designated SEQ ID:39050, to the nucleotide sequence of VGAM1157 RNA, herein designated VGAM RNA, also designated SEQ ID:3868.

Another function of VGAM1157 is therefore inhibition of LOC151121 (Accession XM_087102). Accordingly, utilities of VGAM1157 include diagnosis, prevention and treatment of diseases and clinical conditions associated with LOC151121. LOC203429 (Accession XM_114701) is another VGAM1157 host target gene. LOC203429 BINDING SITE is HOST TARGET binding site found in the 3' untranslated region of mRNA encoded by LOC203429, corresponding to a HOST TARGET binding site such as BINDING SITE I, BINDING SITE II or BINDING SITE III. Table 2 illustrates the complementarity of the nucleotide sequences of LOC203429 BINDING SITE, designated SEQ ID:43046, to the nucleotide sequence of VGAM1157 RNA, herein designated VGAM RNA, also designated SEQ ID:3868.

Another function of VGAM1157 is therefore inhibition of LOC203429 (Accession XM_114701). Accordingly, utilities of VGAM1157 include diagnosis, prevention and treatment of diseases and clinical conditions associated with LOC203429. FIG. 1 further provides a conceptual description of a novel bioinformatically detected viral gene of the present invention, referred to here as Viral Genomic Address Messenger 1158 (VGAM1158) viral gene, which modulates expression of respective host target genes thereof, the function and utility of which host target genes is known in the art.

VGAM1158 is a novel bioinformatically detected regulatory, non protein coding, viral micro RNA (miRNA) gene. The method by which VGAM1158 was detected is described hereinabove with reference to FIGS. 1-8.

VGAM1158 gene, herein designated VGAM GENE, is a viral gene contained in the genome of Swinepox Virus. VGAM1158 host target gene, herein designated VGAM HOST TARGET GENE, is a human gene contained in the human genome.

VGAM1158 gene encodes a VGAM1158 precursor RNA, herein designated VGAM PRECURSOR RNA. Similar to other miRNA genes, and unlike most ordinary genes, VGAM1158 precursor RNA does not encode a protein. A nucleotide sequence identical or highly similar to the nucleotide sequence of VGAM1158 precursor RNA is designated SEQ ID:1144, and is provided hereinbelow with reference to the sequence listing part. Nucleotide sequence SEQ ID:1144 is located at position 104200 relative to the genome of Swinepox Virus.

VGAM1158 precursor RNA folds onto itself, forming VGAM1158 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1158 folded precursor RNA into VGAM1158 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1158 RNA is designated SEQ ID:3869, and is provided hereinbelow with reference to the sequence listing part.

VGAM1158 host target gene, herein designated VGAM HOST TARGET GENE, encodes a corresponding messenger RNA, VGAM1158 host target RNA, herein designated VGAM HOST TARGET RNA. VGAM1158 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1158 RNA, herein designated VGAM RNA, binds complementarily to one or more host target binding sites located in untranslated regions of VGAM1158 host target RNA, herein designated VGAM HOST TARGET RNA. This complementary binding is due to the fact that the nucleotide sequence of VGAM1158 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1158 RNA, herein designated VGAM RNA, may have a different number of host target binding sites in untranslated regions of a VGAM1158 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1158 RNA, herein designated VGAM RNA, to host target binding sites on VGAM1158 host target RNA, herein designated VGAM HOST TARGET RNA, such as BINDING SITE I, BINDING SITE II and BINDING SITE III, inhibits translation of VGAM1158 host target RNA into VGAM1158 host target protein, herein designated VGAM HOST TARGET PROTEIN. VGAM host target protein is therefore outlined by a broken line.

It is appreciated that VGAM1158 host target gene, herein designated VGAM HOST TARGET GENE, in fact represents a plurality of VGAM1158 host target genes. The mRNA of each one of this plurality of VGAM1158 host target genes comprises one or more host target binding sites, each having a nucleotide sequence which is at least partly complementary to VGAM1158 RNA, herein designated VGAM RNA, and which when bound by VGAM1158 RNA causes inhibition of translation of respective one or more VGAM1158 host target proteins.

It is further appreciated by one skilled in the art that the mode of translational inhibition illustrated by FIG. 1 with specific reference to translational inhibition exerted by VGAM1158 gene, herein designated VGAM GENE, on one or more VGAM1158 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1158 is inhibition of expression of host target genes, as part of a novel viral mechanism of attacking a host. Accordingly, utilities of VGAM1158 include diagnosis, prevention and treatment of viral infection by Swinepox Virus. Specific functions, and accordingly utilities, of VGAM1158 correlate with, and may be deduced from, the identity of the host target genes which VGAM1158 binds and inhibits, and the function of these host target genes, as elaborated hereinbelow.

Nucleotide sequences of the VGAM1158 precursor RNA, herein designated VGAM PRECURSOR RNA, and of the 'diced' VGAM1158 RNA, herein designated VGAM RNA, and a schematic representation of the secondary folding of VGAM1158 folded precursor RNA, herein designated VGAM FOLDED PRECURSOR RNA, of VGAM1158 are further described hereinbelow with reference to Table 1.

Nucleotide sequences of host target binding sites, such as BINDING SITE-I, BINDING SITE-II and BINDING SITE-III of FIG. 1, found on VGAM1158 host target RNA, and schematic representation of the complementarity of each of these host target binding sites to VGAM1158 RNA, herein designated VGAM RNA, are described hereinbelow with reference to Table 2.

As mentioned hereinabove with reference to FIG. 1, a function of VGAM1158 gene, herein designated VGAM is inhibition of expression of VGAM1158 target genes. It is appreciated that specific functions, and accordingly utilities, of VGAM1158 correlate with, and may be deduced from, the identity of the target genes which VGAM1158 binds and inhibits, and the function of these target genes, as elaborated hereinbelow.

AS3 (Accession NM_015928) is a VGAM1158 host target gene. AS3 BINDING SITE is HOST TARGET binding site found in the 3' untranslated region of mRNA encoded by AS3, corresponding to a HOST TARGET binding site such as BINDING SITE I, BINDING SITE II or BINDING SITE III. Table 2 illustrates the complementarity of the nucleotide sequences of AS3 BINDING SITE, designated SEQ ID:18051, to the nucleotide sequence of VGAM1158 RNA, herein designated VGAM RNA, also designated SEQ ID:3869.

A function of VGAM1158 is therefore inhibition of AS3 (Accession NM_015928), a gene which inhibits cell proloferation. Accordingly, utilities of VGAM1158 include diagnosis, prevention and treatment of diseases and clinical conditions associated with AS3. The function of AS3 and its association with various diseases and clinical conditions, has been established by previous studies, as described hereinabove with reference to VGAM393. Mannosidase, Alpha, Class 1A, Member 1 (MAN1A1, Accession XM_166312) is another VGAM1158 host target gene. MAN1A1 BINDING SITE is HOST TARGET binding site found in the 3' untranslated region of mRNA encoded by MAN1A1, corresponding to a HOST TARGET binding site such as BINDING SITE I, BINDING SITE II or BINDING SITE III. Table 2 illustrates the complementarity of the nucleotide sequences of MAN1A1 BINDING SITE, designated SEQ ID:44136, to the nucleotide sequence of VGAM1158 RNA, herein designated VGAM RNA, also designated SEQ ID:3869.

Another function of VGAM1158 is therefore inhibition of Mannosidase, Alpha, Class 1A, Member 1 (MAN1A1, Accession XM_166312), a gene which removes 3 distinct mannose residues from peptide-bound Man (9)-GlcNAc (2) oligosaccharides. Accordingly, utilities of VGAM1158 include diagnosis, prevention and treatment of diseases and clinical conditions associated with MAN1A1. The function of MAN1A1 and its association with various diseases and clinical conditions, has been established by previous studies, as described hereinabove with reference to VGAM172. Nitric Oxide Synthase 1 (neuronal) (NOS1, Accession NM_000620) is another VGAM1158 host target gene. NOS1 BINDING SITE is HOST TARGET binding site found in the 3' untranslated region of mRNA encoded by NOS1, corresponding to a HOST TARGET binding site such as BINDING SITE I, BINDING SITE II or BINDING SITE III. Table 2 illustrates the complementarity of the nucleotide sequences of NOS1 BINDING SITE, designated SEQ ID:6234, to the nucleotide sequence of VGAM1158 RNA, herein designated VGAM RNA, also designated SEQ ID:3869.

Another function of VGAM1158 is therefore inhibition of Nitric Oxide Synthase 1 (neuronal) (NOS1, Accession NM_000620), a gene which produces nitric oxide (no) which is a messenger molecule with diverse functions throughout the body. Accordingly, utilities of VGAM1158 include diagnosis, prevention and treatment of diseases and clinical conditions associated with NOS1. The function of NOS1 and its association with various diseases and clinical conditions, has been established by previous studies, as described hereinabove with reference to VGAM323. UDP-GlcNAc:betaGal Beta-1,3-N-acetylglucosaminyltransferase 1 (B3GNT1, Accession NM_006577) is another VGAM1158 host target gene. B3GNT1 BINDING SITE1 and B3GNT1 BINDING SITE2 are HOST TARGET binding sites found in untranslated regions of mRNA encoded by B3GNT1, corresponding to HOST TARGET binding sites such as BINDING SITE I, BINDING SITE II or BINDING SITE III. Table 2 illustrates the complementarity of the nucleotide sequences of B3GNT1 BINDING SITE1 and B3GNT1 BINDING SITE2, designated SEQ ID:13344 and SEQ ID:27087 respectively, to the nucleotide sequence of VGAM1158 RNA, herein designated VGAM RNA, also designated SEQ ID:3869.

Another function of VGAM1158 is therefore inhibition of UDP-GlcNAc:betaGal Beta-1,3-N-acetylglucosaminyltransferase 1 (B3GNT1, Accession NM_006577). Accordingly, utilities of VGAM1158 include diagnosis, prevention and treatment of diseases and clinical conditions associated with B3GNT1. GTPBG3 (Accession NM_032620) is another VGAM1158 host target gene. GTPBG3 BINDING SITE is HOST TARGET binding site found in the 3' untranslated region of mRNA encoded by GTPBG3, corresponding to a HOST TARGET binding site such as BINDING SITE I, BINDING SITE II or BINDING SITE III. Table 2 illustrates the complementarity of the nucleotide sequences of GTPBG3 BINDING SITE, designated SEQ ID:26336, to the nucleotide sequence of VGAM1158 RNA, herein designated VGAM RNA, also designated SEQ ID:3869.

Another function of VGAM1158 is therefore inhibition of GTPBG3 (Accession NM_032620). Accordingly, utilities of VGAM1158 include diagnosis, prevention and treatment of diseases and clinical conditions associated with GTPBG3. KIAA0792 (Accession NM_014698) is another VGAM1158 host target gene. KIAA0792 BINDING SITE is HOST TARGET binding site found in the 3' untranslated region of mRNA encoded by KIAA0792, corresponding to a HOST TARGET binding site such as BINDING SITE I, BINDING SITE II or BINDING SITE III. Table 2 illustrates the complementarity of the nucleotide sequences of KIAA0792 BINDING SITE, designated SEQ ID:16213, to the nucleotide sequence of VGAM1158 RNA, herein designated VGAM RNA, also designated SEQ ID:3869.

Another function of VGAM1158 is therefore inhibition of KIAA0792 (Accession NM_014698). Accordingly, utilities of VGAM1158 include diagnosis, prevention and treatment of diseases and clinical conditions associated with KIAA0792. KIAA0979 (Accession NM_015032) is another VGAM1158 host target gene. KIAA0979 BINDING SITE is HOST TARGET binding site found in the 3' untranslated region of mRNA encoded by KIAA0979, corresponding to a HOST TARGET binding site such as BINDING SITE I, BINDING SITE II or BINDING SITE III. Table 2 illustrates the complementarity of the nucleotide sequences of KIAA0979 BINDING SITE, designated SEQ ID:17389, to the nucleotide sequence of VGAM1158 RNA, herein designated VGAM RNA, also designated SEQ ID:3869.

Another function of VGAM1158 is therefore inhibition of KIAA0979 (Accession NM_015032). Accordingly, utilities of VGAM1158 include diagnosis, prevention and treatment of diseases and clinical conditions associated with KIAA0979. KIAA0981 (Accession XM_028867) is another VGAM1158 host target gene. KIAA0981 BINDING SITE is HOST TARGET binding site found in the 3' untranslated region of mRNA encoded by KIAA0981, corresponding to a HOST TARGET binding site such as BINDING SITE I, BINDING SITE II or BINDING SITE III. Table 2 illustrates the complementarity of the nucleotide sequences of KIAA0981 BINDING SITE, designated SEQ ID:30796, to the nucleotide sequence of VGAM1158 RNA, herein designated VGAM RNA, also designated SEQ ID:3869.

Another function of VGAM1158 is therefore inhibition of KIAA0981 (Accession XM_028867). Accordingly, utilities of VGAM1158 include diagnosis, prevention and treatment of diseases and clinical conditions associated with KIAA0981. KIAA1462 (Accession XM_166132) is another VGAM1158 host target gene. KIAA1462 BINDING SITE is HOST TARGET binding site found in the 3' untranslated region of mRNA encoded by KIAA1462, corresponding to a HOST TARGET binding site such as BINDING SITE I, BINDING SITE II or BINDING SITE III. Table 2 illustrates the complementarity of the nucleotide sequences of KIAA1462 BINDING SITE, designated SEQ ID:43919, to the nucleotide sequence of VGAM1158 RNA, herein designated VGAM RNA, also designated SEQ ID:3869.

Another function of VGAM1158 is therefore inhibition of KIAA1462 (Accession XM_166132). Accordingly, utilities of VGAM1158 include diagnosis, prevention and treatment of diseases and clinical conditions associated with KIAA1462. ZAK (Accession NM_016653) is another VGAM1158 host target gene. ZAK BINDING SITE is HOST TARGET binding site found in the 3' untranslated region of mRNA encoded by ZAK, corresponding to a HOST TARGET binding site such as BINDING SITE I, BINDING SITE II or BINDING SITE III. Table 2 illustrates the complementarity of the nucleotide sequences of ZAK BINDING SITE, designated SEQ ID:18779, to the nucleotide sequence of VGAM1158 RNA, herein designated VGAM RNA, also designated SEQ ID:3869.

Another function of VGAM1158 is therefore inhibition of ZAK (Accession NM_016653). Accordingly, utilities of VGAM1158 include diagnosis, prevention and treatment of diseases and clinical conditions associated with ZAK. LOC138515 (Accession XM_070943) is another VGAM1158 host target gene. LOC138515 BINDING SITE is HOST TARGET binding site found in the 5' untranslated region of mRNA encoded by LOC138515, corresponding to a HOST TARGET binding site such as BINDING SITE I, BINDING SITE II or BINDING SITE III. Table 2 illustrates the complementarity of the nucleotide sequences of LOC138515 BINDING SITE, designated SEQ ID:37395, to the nucleotide sequence of VGAM1158 RNA, herein designated VGAM RNA, also designated SEQ ID:3869.

Another function of VGAM1158 is therefore inhibition of LOC138515 (Accession XM_070943). Accordingly, utilities of VGAM1158 include diagnosis, prevention and treatment of diseases and clinical conditions associated with LOC138515. LOC254249 (Accession XM_170931) is another VGAM1158 host target gene. LOC254249 BINDING SITE is HOST TARGET binding site found in the 5' untranslated region of mRNA encoded by LOC254249, corresponding to a HOST TARGET binding site such as BINDING SITE I, BINDING SITE II or BINDING SITE III. Table 2 illustrates the complementarity of the nucleotide sequences of LOC254249 BINDING SITE, designated SEQ ID:45713, to the nucleotide sequence of VGAM1158 RNA, herein designated VGAM RNA, also designated SEQ ID:3869.

Another function of VGAM1158 is therefore inhibition of LOC254249 (Accession XM_170931). Accordingly, utilities of VGAM1158 include diagnosis, prevention and treatment of diseases and clinical conditions associated with LOC254249. FIG. 1 further provides a conceptual description of a novel bioinformatically detected viral gene of the present invention, referred to here as Viral Genomic Address Messenger 1159 (VGAM1159) viral gene, which modulates expression of respective host target genes thereof, the function and utility of which host target genes is known in the art.

VGAM1159 is a novel bioinformatically detected regulatory, non protein coding, viral micro RNA (miRNA) gene. The method by which VGAM1159 was detected is described hereinabove with reference to FIGS. 1-8.

VGAM1159 gene, herein designated VGAM GENE, is a viral gene contained in the genome of Meleagrid Herpesvirus 1. VGAM1159 host target gene, herein designated VGAM HOST TARGET GENE, is a human gene contained in the human genome.

VGAM1159 gene encodes a VGAM1159 precursor RNA, herein designated VGAM PRECURSOR RNA. Similar to other miRNA genes, and unlike most ordinary genes, VGAM1159 precursor RNA does not encode a protein. A nucleotide sequence identical or highly similar to the nucleotide sequence of VGAM1159 precursor RNA is designated SEQ ID:1145, and is provided hereinbelow with reference to the sequence listing part. Nucleotide sequence SEQ ID:1145 is located at position 38413 relative to the genome of Meleagrid Herpesvirus 1.

VGAM1159 precursor RNA folds onto itself, forming VGAM1159 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1159 folded precursor RNA into VGAM1159 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM1159 RNA is designated SEQ ID:3870, and is provided hereinbelow with reference to the sequence listing part.

VGAM1159 host target gene, herein designated VGAM HOST TARGET GENE, encodes a corresponding messenger RNA, VGAM1159 host target RNA, herein designated VGAM HOST TARGET RNA. VGAM1159 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1159 RNA, herein designated VGAM RNA, binds complementarily to one or more host target binding sites located in untranslated regions of VGAM1159 host target RNA, herein designated VGAM HOST TARGET RNA. This complementary binding is due to the fact that the nucleotide sequence of VGAM1159 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1159 RNA, herein designated VGAM RNA, may have a different number of host target binding sites in untranslated regions of a VGAM1159 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1159 RNA, herein designated VGAM RNA, to host target binding sites on VGAM1159 host target RNA, herein designated VGAM HOST TARGET RNA, such as BINDING SITE I, BINDING SITE II and BINDING SITE III, inhibits translation of VGAM1159 host target RNA into VGAM1159 host target protein, herein designated VGAM HOST TARGET PROTEIN. VGAM host target protein is therefore outlined by a broken line.

It is appreciated that VGAM1159 host target gene, herein designated VGAM HOST TARGET GENE, in fact represents a plurality of VGAM1159 host target genes. The mRNA of each one of this plurality of VGAM1159 host target genes comprises one or more host target binding sites, each having a nucleotide sequence which is at least partly complementary to VGAM1159 RNA, herein designated VGAM RNA, and which when bound by VGAM1159 RNA causes inhibition of translation of respective one or more VGAM1159 host target proteins.

It is further appreciated by one skilled in the art that the mode of translational inhibition illustrated by FIG. 1 with specific reference to translational inhibition exerted by VGAM1159 gene, herein designated VGAM GENE, on one or more VGAM1159 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1159 is inhibition of expression of host target genes, as part of a novel viral mechanism of attacking a host. Accordingly, utilities of VGAM1159 include diagnosis, prevention and treatment of viral infection by Meleagrid Herpesvirus 1. Specific functions, and accordingly utilities, of VGAM1159 correlate with, and may be deduced from, the identity of the host target genes which VGAM1159 binds and inhibits, and the function of these host target genes, as elaborated hereinbelow.

Nucleotide sequences of the VGAM1159 precursor RNA, herein designated VGAM PRECURSOR RNA, and of the 'diced' VGAM1159 RNA, herein designated VGAM RNA, and a schematic representation of the secondary folding of VGAM1159 folded precursor RNA, herein designated VGAM FOLDED PRECURSOR RNA, of VGAM1159 are further described hereinbelow with reference to Table 1.

Nucleotide sequences of host target binding sites, such as BINDING SITE-I, BINDING SITE-II and BINDING SITE-III of FIG. 1, found on VGAM1159 host target RNA, and schematic representation of the complementarity of each of these host target binding sites to VGAM1159 RNA, herein designated VGAM RNA, are described hereinbelow with reference to Table 2.

As mentioned hereinabove with reference to FIG. 1, a function of VGAM1159 gene, herein designated VGAM is inhibition of expression of VGAM1159 target genes. It is appreciated that specific functions, and accordingly utilities, of VGAM1159 correlate with, and may be deduced from, the identity of the target genes which VGAM1159 binds and inhibits, and the function of these target genes, as elaborated hereinbelow.

Complement Component 7 (C7, Accession NM_000587) is a VGAM1159 host target gene. C7 BINDING SITE is HOST TARGET binding site found in the 3' untranslated region of mRNA encoded by C7, corresponding to a HOST TARGET binding site such as BINDING SITE I, BINDING SITE II or BINDING SITE III. Table 2 illustrates the complementarity of the nucleotide sequences of C7 BINDING SITE, designated SEQ ID:6191, to the nucleotide sequence of VGAM1159 RNA, herein designated VGAM RNA, also designated SEQ ID:3870.

A function of VGAM1159 is therefore inhibition of Complement Component 7 (C7, Accession NM_000587). Accordingly, utilities of VGAM1159 include diagnosis, prevention and treatment of diseases and clinical conditions associated with C7. FK506 Binding Protein 1A, 12kDa (FKBP1A, Accession NM_000801) is another VGAM1159 host target gene. FKBP1A BINDING SITE is HOST TARGET binding site found in the 3' untranslated region of mRNA encoded by FKBP1A, corresponding to a HOST TARGET binding site such as BINDING SITE I, BINDING SITE II or BINDING SITE III. Table 2 illustrates the complementarity of the nucleotide sequences of FKBP1A BINDING SITE, designated SEQ ID:6475, to the nucleotide sequence of VGAM1159 RNA, herein designated VGAM RNA, also designated SEQ ID:3870.

Another function of VGAM1159 is therefore inhibition of FK506 Binding Protein 1A, 12 kDa (FKBP1A, Accession NM_000801), a gene which FK506-binding protein 1A. Accordingly, utilities of VGAM1159 include diagnosis, prevention and treatment of diseases and clinical conditions associated with FKBP1A. The function of FKBP1A and its association with various diseases and clinical conditions, has been established by previous studies, as described hereinabove with reference to VGAM57. Polycystic Kidney and Hepatic Disease 1 (autosomal recessive) (PKHD1, Accession NM_138694) is another VGAM1159 host target gene. PKHD1 BINDING SITE is HOST TARGET binding site found in the 3' untranslated region of mRNA encoded by PKHD1, corresponding to a HOST TARGET binding site such as BINDING SITE I, BINDING SITE II or BINDING SITE III. Table 2 illustrates the complementarity of the nucleotide sequences of PKHD1 BINDING SITE, designated SEQ ID:28941, to the nucleotide sequence of VGAM1159 RNA, herein designated VGAM RNA, also designated SEQ ID:3870.

Another function of VGAM1159 is therefore inhibition of Polycystic Kidney and Hepatic Disease 1 (autosomal recessive) (PKHD1, Accession NM_138694). Accordingly, utilities of VGAM1159 include diagnosis, prevention and treatment of diseases and clinical conditions associated with PKHD1. FENS-1 (Accession NM_020830) is another VGAM1159 host target gene. FENS-1 BINDING SITE is HOST TARGET binding site found in the 3' untranslated region of mRNA encoded by FENS-1, corresponding to a HOST TARGET binding site such as BINDING SITE I, BINDING SITE II or BINDING SITE III. Table 2 illustrates the complementarity of the nucleotide sequences of FENS-1 BINDING SITE, designated SEQ ID:21896, to the nucleotide sequence of VGAM1159 RNA, herein designated VGAM RNA, also designated SEQ ID:3870.

Another function of VGAM1159 is therefore inhibition of FENS-1 (Accession NM_020830). Accordingly, utilities of VGAM1159 include diagnosis, prevention and treatment of diseases and clinical conditions associated with FENS-1. FLJ12592 (Accession NM_032169) is another VGAM1159 host target gene. FLJ12592 BINDING SITE is HOST TARGET binding site found in the 5' untranslated region of mRNA encoded by FLJ12592, corresponding to a HOST TARGET binding site such as BINDING SITE I, BINDING SITE II or BINDING SITE III. Table 2 illustrates the complementarity of the nucleotide sequences of FLJ12592 BINDING SITE, designated SEQ ID:25874, to the nucleotide sequence of VGAM1159 RNA, herein designated VGAM RNA, also designated SEQ ID:3870.

Another function of VGAM1159 is therefore inhibition of FLJ12592 (Accession NM_032169). Accordingly, utilities of VGAM1159 include diagnosis, prevention and treatment of diseases and clinical conditions associated with FLJ12592. FLJ20079 (Accession NM_017656) is another VGAM1159 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19179, to the nucleotide sequence of VGAM1159 RNA, herein designated VGAM RNA, also designated SEQ ID:3870.

Another function of VGAM1159 is therefore inhibition of FLJ20079 (Accession NM_017656). Accordingly, utilities of VGAM1159 include diagnosis, prevention and treatment of diseases and clinical conditions associated with FLJ20079. KIAA0143 (Accession XM_035825) is another VGAM1159 host target gene. KIAA0143 BINDING SITE is HOST TARGET binding site found in the 3' untranslated region of mRNA encoded by KIAA0143, corresponding to a HOST TARGET binding site such as BINDING SITE I, BINDING SITE II or BINDING SITE III. Table 2 illustrates the complementarity of the nucleotide sequences of KIAA0143 BINDING SITE, designated SEQ ID:32352, to the nucleotide sequence of VGAM1159 RNA, herein designated VGAM RNA, also designated SEQ ID:3870.

Another function of VGAM1159 is therefore inhibition of KIAA0143 (Accession XM_035825). Accordingly, utilities of VGAM1159 include diagnosis, prevention and treatment of diseases and clinical conditions associated with KIAA0143. KIAA0420 (Accession XM_032693) is another VGAM1159 host target gene. KIAA0420 BINDING SITE is HOST TARGET binding site found in the 3' untranslated region of mRNA encoded by KIAA0420, corresponding to a HOST TARGET binding site such as BINDING SITE I, BINDING SITE II or BINDING SITE III. Table 2 illustrates the complementarity of the nucleotide sequences of KIAA0420 BINDING SITE, designated SEQ ID:31726, to the nucleotide sequence of VGAM1159 RNA, herein designated VGAM RNA, also designated SEQ ID:3870.

Another function of VGAM1159 is therefore inhibition of KIAA0420 (Accession XM_032693). Accordingly, utilities of VGAM1159 include diagnosis, prevention and treatment of diseases and clinical conditions associated with KIAA0420. PRO2266 (Accession NM_018519) is another VGAM1159 host target gene. PRO2266 BINDING SITE is HOST TARGET binding site found in the 3' untranslated region of mRNA encoded by PRO2266, corresponding to a HOST TARGET binding site such as BINDING SITE I, BINDING SITE II or BINDING SITE III. Table 2 illustrates the complementarity of the nucleotide sequences of PRO2266 BINDING SITE, designated SEQ ID:20597, to the nucleotide sequence of VGAM1159 RNA, herein designated VGAM RNA, also designated SEQ ID:3870.

Another function of VGAM1159 is therefore inhibition of PRO2266 (Accession NM_018519). Accordingly, utilities of VGAM1159 include diagnosis, prevention and treatment of diseases and clinical conditions associated with PRO2266. SCYD1 (Accession XM_165650) is another VGAM1159 host target gene. SCYD1 BINDING SITE is HOST TARGET binding site found in the 3' untranslated region of mRNA encoded by SCYD1, corresponding to a HOST TARGET binding site such as BINDING SITE I, BINDING SITE II or BINDING SITE III. Table 2 illustrates the complementarity of the nucleotide sequences of SCYD1 BINDING SITE, designated SEQ ID:43713, to the nucleotide sequence of VGAM1159 RNA, herein designated VGAM RNA, also designated SEQ ID:3870.

Another function of VGAM1159 is therefore inhibition of SCYD1 (Accession XM_165650). Accordingly, utilities of VGAM1159 include diagnosis, prevention and treatment of diseases and clinical conditions associated with SCYD1. LOC115265 (Accession XM_055596) is another VGAM1159 host target gene. LOC115265 BINDING SITE is HOST TARGET binding site found in the 3' untranslated region of mRNA encoded by LOC115265, corresponding to a HOST TARGET binding site such as BINDING SITE I, BINDING SITE II or BINDING SITE III. Table 2 illustrates the complementarity of the nucleotide sequences of LOC115265 BINDING SITE, designated SEQ ID:36310, to the nucleotide sequence of VGAM1159 RNA, herein designated VGAM RNA, also designated SEQ ID:3870.

Another function of VGAM1159 is therefore inhibition of LOC115265 (Accession XM_055596). Accordingly, utilities of VGAM1159 include diagnosis, prevention and treatment of diseases and clinical conditions associated with LOC115265. LOC164375 (Accession XM_104379) is another VGAM1159 host target gene. LOC164375 BINDING SITE is HOST TARGET binding site found in the 5' untranslated region of mRNA encoded by LOC164375, corresponding to a HOST TARGET binding site such as BINDING SITE I, BINDING SITE II or BINDING SITE III. Table 2 illustrates the complementarity of the nucleotide sequences of LOC164375 BINDING SITE, designated SEQ ID:42158, to the nucleotide sequence of VGAM1159 RNA, herein designated VGAM RNA, also designated SEQ ID:3870.

Another function of VGAM1159 is therefore inhibition of LOC164375 (Accession XM_104379). Accordingly, utilities of VGAM1159 include diagnosis, prevention and treatment of diseases and clinical conditions associated with LOC164375. LOC253776 (Accession XM_173240) is another VGAM1159 host target gene. LOC253776 BINDING SITE is HOST TARGET binding site found in the 3' untranslated region of mRNA encoded by LOC253776, corresponding to a HOST TARGET binding site such as BINDING SITE I, BINDING SITE II or BINDING SITE III. Table 2 illustrates the complementarity of the nucleotide sequences of LOC253776 BINDING SITE, designated SEQ ID:46526, to the nucleotide sequence of VGAM1159 RNA, herein designated VGAM RNA, also designated SEQ ID:3870.

Another function of VGAM1159 is therefore inhibition of LOC253776 (Accession XM_173240). Accordingly, utilities of VGAM1159 include diagnosis, prevention and treatment of diseases and clinical conditions associated with LOC253776. LOC255696 (Accession XM_173933) is another VGAM1159 host target gene. LOC255696 BINDING SITE is HOST TARGET binding site found in the 5' untranslated region of mRNA encoded by LOC255696, corresponding to a HOST TARGET binding site such as BINDING SITE I, BINDING SITE II or BINDING SITE III. Table 2 illustrates the complementarity of the nucleotide sequences of LOC255696 BINDING SITE, designated SEQ ID:46568, to the nucleotide sequence of VGAM1159 RNA, herein designated VGAM RNA, also designated SEQ ID:3870.

Another function of VGAM1159 is therefore inhibition of LOC255696 (Accession XM_173933). Accordingly, utilities of VGAM1159 include diagnosis, prevention and treatment of diseases and clinical conditions associated with LOC255696. LOC257354 (Accession XM_170810) is another VGAM1159 host target gene. LOC257354 BINDING SITE is HOST TARGET binding site found in the 3' untranslated region of mRNA encoded by LOC257354, corresponding to a HOST TARGET binding site such as BINDING SITE I, BINDING SITE II or BINDING SITE III. Table 2 illustrates the complementarity of the nucleotide sequences of LOC257354 BINDING SITE, designated SEQ ID:45579, to the nucleotide sequence of VGAM1159 RNA, herein designated VGAM RNA, also designated SEQ ID:3870.

Another function of VGAM1159 is therefore inhibition of LOC257354 (Accession XM_170810). Accordingly, utilities of VGAM1159 include diagnosis, prevention and treatment of diseases and clinical conditions associated with LOC257354. FIG. 1 further provides a conceptual description of a novel bioinformatically detected viral gene of the present invention, referred to here as Viral Genomic Address Messenger 1160 (VGAM1160) viral gene, which modulates expression of respective host target genes thereof, the function and utility of which host target genes is known in the art.

VGAM1160 is a novel bioinformatically detected regulatory, non protein coding, viral micro RNA (miRNA) gene. The method by which VGAM1160 was detected is described hereinabove with reference to FIGS. 1-8.

VGAM1160 gene, herein designated VGAM GENE, is a viral gene contained in the genome of Meleagrid Herpesvirus 1. VGAM1160 host target gene, herein designated VGAM HOST TARGET GENE, is a human gene contained in the human genome.

VGAM1160 gene encodes a VGAM1160 precursor RNA, herein designated VGAM PRECURSOR RNA. Similar to other miRNA genes, and unlike most ordinary genes, VGAM1160 precursor RNA does not encode a protein. A nucleotide sequence identical or highly similar to the nucleotide sequence of VGAM1160 precursor RNA is designated SEQ ID:1146, and is provided hereinbelow with reference to the sequence listing part. Nucleotide sequence SEQ ID:1146 is located at position 39108 relative to the genome of Meleagrid Herpesvirus 1.

VGAM1160 precursor RNA folds onto itself, forming VGAM1160 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1160 folded precursor RNA into VGAM1160 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 87%) nucleotide sequence of VGAM1160 RNA is designated SEQ ID:3871, and is provided hereinbelow with reference to the sequence listing part.

VGAM1160 host target gene, herein designated VGAM HOST TARGET GENE, encodes a corresponding messenger RNA, VGAM1160 host target RNA, herein designated VGAM HOST TARGET RNA. VGAM1160 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1160 RNA, herein designated VGAM RNA, binds complementarily to one or more host target binding sites located in untranslated regions of VGAM1160 host target RNA, herein designated VGAM HOST TARGET RNA. This complementary binding is due to the fact that the nucleotide sequence of VGAM1160 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1160 RNA, herein designated VGAM RNA, may have a different number of host target binding sites in untranslated regions of a VGAM1160 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1160 RNA, herein designated VGAM RNA, to host target binding sites on VGAM1160 host target RNA, herein designated VGAM HOST TARGET RNA, such as BINDING SITE I, BINDING SITE II and BINDING SITE III, inhibits translation of VGAM1160 host target RNA into VGAM1160 host target protein, herein designated VGAM HOST TARGET PROTEIN. VGAM host target protein is therefore outlined by a broken line.

It is appreciated that VGAM1160 host target gene, herein designated VGAM HOST TARGET GENE, in fact represents a plurality of VGAM1160 host target genes. The mRNA of each one of this plurality of VGAM1160 host target genes comprises one or more host target binding sites, each having a nucleotide sequence which is at least partly complementary to VGAM1160 RNA, herein designated VGAM RNA, and which when bound by VGAM1160 RNA causes inhibition of translation of respective one or more VGAM1160 host target proteins.

It is further appreciated by one skilled in the art that the mode of translational inhibition illustrated by FIG. 1 with specific reference to translational inhibition exerted by VGAM1160 gene, herein designated VGAM GENE, on one or more VGAM1160 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1160 is inhibition of expression of host target genes, as part of a novel viral mechanism of attacking a host. Accordingly, utilities of VGAM1160 include diagnosis, prevention and treatment of viral infection by Meleagrid Herpesvirus 1. Specific functions, and accordingly utilities, of VGAM1160 correlate with, and may be deduced from, the identity of the host target genes which VGAM1160 binds and inhibits, and the function of these host target genes, as elaborated hereinbelow.

Nucleotide sequences of the VGAM1160 precursor RNA, herein designated VGAM PRECURSOR RNA, and of the 'diced' VGAM1160 RNA, herein designated VGAM RNA, and a schematic representation of the secondary folding of VGAM1160 folded precursor RNA, herein designated VGAM FOLDED PRECURSOR RNA, of VGAM1160 are further described hereinbelow with reference to Table 1.

Nucleotide sequences of host target binding sites, such as BINDING SITE-I, BINDING SITE-II and BINDING SITE- III of FIG. 1, found on VGAM1160 host target RNA, and schematic representation of the complementarity of each of these host target binding sites to VGAM1160 RNA, herein designated VGAM RNA, are described hereinbelow with reference to Table 2.

As mentioned hereinabove with reference to FIG. 1, a function of VGAM1160 gene, herein designated VGAM is inhibition of expression of VGAM1160 target genes. It is appreciated that specific functions, and accordingly utilities, of VGAM1160 correlate with, and may be deduced from, the identity of the target genes which VGAM1160 binds and inhibits, and the function of these target genes, as elaborated hereinbelow.

Basic Transcription Element Binding Protein 1 (BTEB1, Accession NM_001206) is a VGAM1160 host target gene. BTEB1 BINDING SITE is HOST TARGET binding site found in the 5' untranslated region of mRNA encoded by BTEB1, corresponding to a HOST TARGET binding site such as BINDING SITE I, BINDING SITE II or BINDING SITE III. Table 2 illustrates the complementarity of the nucleotide sequences of BTEB1 BINDING SITE, designated SEQ ID:6870, to the nucleotide sequence of VGAM1160 RNA, herein designated VGAM RNA, also designated SEQ ID:3871.

A function of VGAM1160 is therefore inhibition of Basic Transcription Element Binding Protein 1 (BTEB1, Accession NM_001206). Accordingly, utilities of VGAM1160 include diagnosis, prevention and treatment of diseases and clinical conditions associated with BTEB1. DKFZP434I1735 (Accession XM_113763) is another VGAM1160 host target gene. DKFZP434I1735 BINDING SITE is HOST TARGET binding site found in the 3' untranslated region of mRNA encoded by DKFZP434I1735, corresponding to a HOST TARGET binding site such as BINDING SITE I, BINDING SITE II or BINDING SITE III. Table 2 illustrates the complementarity of the nucleotide sequences of DKFZP434I1735 BINDING SITE, designated SEQ ID:42420, to the nucleotide sequence of VGAM1160 RNA, herein designated VGAM RNA, also designated SEQ ID:3871.

Another function of VGAM1160 is therefore inhibition of DKFZP434I1735 (Accession XM_113763). Accordingly, utilities of VGAM1160 include diagnosis, prevention and treatment of diseases and clinical conditions associated with DKFZP434I1735. FLJ23598 (Accession NM_024783) is another VGAM1160 host target gene. FLJ23598 BINDING SITE is HOST TARGET binding site found in the 3' untranslated region of mRNA encoded by FLJ23598, corresponding to a HOST TARGET binding site such as BINDING SITE I, BINDING SITE II or BINDING SITE III. Table 2 illustrates the complementarity of the nucleotide sequences of FLJ23598 BINDING SITE, designated SEQ ID:24154, to the nucleotide sequence of VGAM1160 RNA, herein designated VGAM RNA, also designated SEQ ID:3871.

Another function of VGAM1160 is therefore inhibition of FLJ23598 (Accession NM_024783). Accordingly, utilities of VGAM1160 include diagnosis, prevention and treatment of diseases and clinical conditions associated with FLJ23598. LOC149711 (Accession XM_097720) is another VGAM1160 host target gene. LOC149711 BINDING SITE is HOST TARGET binding site found in the 3' untranslated region of mRNA encoded by LOC149711, corresponding to a HOST TARGET binding site such as BINDING SITE I, BINDING SITE II or BINDING SITE III. Table 2 illustrates the complementarity of the nucleotide sequences of LOC149711 BINDING SITE, designated SEQ ID:41074, to the nucleotide sequence of VGAM1160 RNA, herein designated VGAM RNA, also designated SEQ ID:3871.

Another function of VGAM1160 is therefore inhibition of LOC149711 (Accession XM_097720). Accordingly, utilities of VGAM1160 include diagnosis, prevention and treatment of diseases and clinical conditions associated with LOC149711. LOC199988 (Accession XM_117166) is another VGAM1160 host target gene. LOC199988 BINDING SITE is HOST TARGET binding site found in the 5' untranslated region of mRNA encoded by LOC199988, corresponding to a HOST TARGET binding site such as BINDING SITE I, BINDING SITE II or BINDING SITE III. Table 2 illustrates the complementarity of the nucleotide sequences of LOC199988 BINDING SITE, designated SEQ ID:43268, to the nucleotide sequence of VGAM1160 RNA, herein designated VGAM RNA, also designated SEQ ID:3871.

Another function of VGAM1160 is therefore inhibition of LOC199988 (Accession XM_117166). Accordingly, utilities of VGAM1160 include diagnosis, prevention and treatment of diseases and clinical conditions associated with LOC199988. FIG. 1 further provides a conceptual description of a novel bioinformatically detected viral gene of the present invention, referred to here as Viral Genomic Address Messenger 1161 (VGAM1161) viral gene, which modulates expression of respective host target genes thereof, the function and utility of which host target genes is known in the art.

VGAM1161 is a novel bioinformatically detected regulatory, non protein coding, viral micro RNA (miRNA) gene. The method by which VGAM1161 was detected is described hereinabove with reference to FIGS. 1-8.

VGAM1161 gene, herein designated VGAM GENE, is a viral gene contained in the genome of Meleagrid Herpesvirus 1. VGAM1161 host target gene, herein designated VGAM HOST TARGET GENE, is a human gene contained in the human genome.

VGAM1161 gene encodes a VGAM1161 precursor RNA, herein designated VGAM PRECURSOR RNA. Similar to other miRNA genes, and unlike most ordinary genes, VGAM1161 precursor RNA does not encode a protein. A nucleotide sequence identical or highly similar to the nucleotide sequence of VGAM1161 precursor RNA is designated SEQ ID:1147, and is provided hereinbelow with reference to the sequence listing part. Nucleotide sequence SEQ ID:1147 is located at position 38258 relative to the genome of Meleagrid Herpesvirus 1.

VGAM1161 precursor RNA folds onto itself, forming VGAM1161 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1161 folded precursor RNA into VGAM1161 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1161 RNA is designated SEQ ID:3872, and is provided hereinbelow with reference to the sequence listing part.

VGAM1161 host target gene, herein designated VGAM HOST TARGET GENE, encodes a corresponding messenger RNA, VGAM1161 host target RNA, herein designated VGAM HOST TARGET RNA. VGAM1161 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1161 RNA, herein designated VGAM RNA, binds complementarily to one or more host target binding sites located in untranslated regions of VGAM1161 host target RNA, herein designated VGAM HOST TARGET RNA. This complementary binding is due to the fact that the nucleotide sequence of VGAM1161 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1161 RNA, herein designated VGAM RNA, may have a different number of host target binding sites in untranslated regions of a VGAM1161 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1161 RNA, herein designated VGAM RNA, to host target binding sites on VGAM1161 host target RNA, herein designated VGAM HOST TARGET RNA, such as BINDING SITE I, BINDING SITE II and BINDING SITE III, inhibits translation of VGAM1161 host target RNA into VGAM1161 host target protein, herein designated VGAM HOST TARGET PROTEIN. VGAM host target protein is therefore outlined by a broken line.

It is appreciated that VGAM1161 host target gene, herein designated VGAM HOST TARGET GENE, in fact represents a plurality of VGAM1161 host target genes. The mRNA of each one of this plurality of VGAM1161 host target genes comprises one or more host target binding sites, each having a nucleotide sequence which is at least partly complementary to VGAM1161 RNA, herein designated VGAM RNA, and which when bound by VGAM1161 RNA causes inhibition of translation of respective one or more VGAM1161 host target proteins.

It is further appreciated by one skilled in the art that the mode of translational inhibition illustrated by FIG. 1 with specific reference to translational inhibition exerted by VGAM1161 gene, herein designated VGAM GENE, on one or more VGAM1161 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1161 is inhibition of expression of host target genes, as part of a novel viral mechanism of attacking a host. Accordingly, utilities of VGAM1161 include diagnosis, prevention and treatment of viral infection by Meleagrid Herpesvirus 1. Specific functions, and accordingly utilities, of VGAM1161 correlate with, and may be deduced from, the identity of the host target genes which VGAM1161 binds and inhibits, and the function of these host target genes, as elaborated hereinbelow.

Nucleotide sequences of the VGAM1161 precursor RNA, herein designated VGAM PRECURSOR RNA, and of the 'diced' VGAM1161 RNA, herein designated VGAM RNA, and a schematic representation of the secondary folding of VGAM1161 folded precursor RNA, herein designated VGAM FOLDED PRECURSOR RNA, of VGAM1161 are further described hereinbelow with reference to Table 1.

Nucleotide sequences of host target binding sites, such as BINDING SITE-I, BINDING SITE-II and BINDING SITE-III of FIG. 1, found on VGAM1161 host target RNA, and schematic representation of the complementarity of each of these host target binding sites to VGAM1161 RNA, herein designated VGAM RNA, are described hereinbelow with reference to Table 2.

As mentioned hereinabove with reference to FIG. 1, a function of VGAM1161 gene, herein designated VGAM is inhibition of expression of VGAM1161 target genes. It is appreciated that specific functions, and accordingly utilities, of VGAM1161 correlate with, and may be deduced from, the identity of the target genes which VGAM1161 binds and inhibits, and the function of these target genes, as elaborated hereinbelow.

LOC203276 (Accession XM_117523) is a VGAM1161 host target gene. LOC203276 BINDING SITE is HOST TARGET binding site found in the 3' untranslated region of mRNA encoded by LOC203276, corresponding to a HOST TARGET binding site such as BINDING SITE I, BINDING SITE II or BINDING SITE III. Table 2 illustrates the complementarity of the nucleotide sequences of LOC203276 BINDING SITE, designated SEQ ID:43486, to the nucleotide sequence of VGAM1161 RNA, herein designated VGAM RNA, also designated SEQ ID:3872.

A function of VGAM1161 is therefore inhibition of LOC203276 (Accession XM_117523). Accordingly, utilities of VGAM1161 include diagnosis, prevention and treatment of diseases and clinical conditions associated with LOC203276. LOC203305 (Accession XM_117529) is another VGAM1161 host target gene. LOC203305 BINDING SITE is HOST TARGET binding site found in the 3' untranslated region of mRNA encoded by LOC203305, corresponding to a HOST TARGET binding site such as BINDING SITE I, BINDING SITE II or BINDING SITE III. Table 2 illustrates the complementarity of the nucleotide sequences of LOC203305 BINDING SITE, designated SEQ ID:43510, to the nucleotide sequence of VGAM1161 RNA, herein designated VGAM RNA, also designated SEQ ID:3872.

Another function of VGAM1161 is therefore inhibition of LOC203305 (Accession XM_117529). Accordingly, utilities of VGAM1161 include diagnosis, prevention and treatment of diseases and clinical conditions associated with LOC203305. LOC254243 (Accession XM_173233) is another VGAM1161 host target gene. LOC254243 BINDING SITE is HOST TARGET binding site found in the 3' untranslated region of mRNA encoded by LOC254243, corresponding to a HOST TARGET binding site such as BINDING SITE I, BINDING SITE II or BINDING SITE III. Table 2 illustrates the complementarity of the nucleotide sequences of LOC254243 BINDING SITE, designated SEQ ID:46512, to the nucleotide sequence of VGAM1161 RNA, herein designated VGAM RNA, also designated SEQ ID:3872.

Another function of VGAM1161 is therefore inhibition of LOC254243 (Accession XM_173233). Accordingly, utilities of VGAM1161 include diagnosis, prevention and treatment of diseases and clinical conditions associated with LOC254243. LOC90038 (Accession XM_028305) is another VGAM1161 host target gene. LOC90038 BINDING SITE is HOST TARGET binding site found in the 3' untranslated region of mRNA encoded by LOC90038, corresponding to a HOST TARGET binding site such as BINDING SITE I, BINDING SITE II or BINDING SITE III. Table 2 illustrates the complementarity of the nucleotide sequences of LOC90038 BINDING SITE, designated SEQ ID:30649, to the nucleotide sequence of VGAM1161 RNA, herein designated VGAM RNA, also designated SEQ ID:3872.

Another function of VGAM1161 is therefore inhibition of LOC90038 (Accession XM_028305). Accordingly, utilities of VGAM1161 include diagnosis, prevention and treatment of diseases and clinical conditions associated with LOC90038. FIG. 1 further provides a conceptual description of a novel bioinformatically detected viral gene of the present invention, referred to here as Viral Genomic Address Messenger 1162 (VGAM1162) viral gene, which modulates expression of respective host target genes thereof, the function and utility of which host target genes is known in the art.

VGAM1162 is a novel bioinformatically detected regulatory, non protein coding, viral micro RNA (miRNA) gene. The method by which VGAM1162 was detected is described hereinabove with reference to FIGS. 1-8.

VGAM1162 gene, herein designated VGAM GENE, is a viral gene contained in the genome of Ectromelia Virus. VGAM1162 host target gene, herein designated VGAM HOST TARGET GENE, is a human gene contained in the human genome.

VGAM1162 gene encodes a VGAM1162 precursor RNA, herein designated VGAM PRECURSOR RNA. Similar to other miRNA genes, and unlike most ordinary genes, VGAM1162 precursor RNA does not encode a protein. A nucleotide sequence identical or highly similar to the nucleotide sequence of VGAM1162 precursor RNA is designated SEQ ID:1148, and is provided hereinbelow with reference to the sequence listing part. Nucleotide sequence SEQ ID:1148 is located at position 139277 relative to the genome of Ectromelia Virus.

VGAM1162 precursor RNA folds onto itself, forming VGAM1162 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1162 folded precursor RNA into VGAM1162 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM1162 RNA is designated SEQ ID:3873, and is provided hereinbelow with reference to the sequence listing part.

VGAM1162 host target gene, herein designated VGAM HOST TARGET GENE, encodes a corresponding messenger RNA, VGAM1162 host target RNA, herein designated VGAM HOST TARGET RNA. VGAM1162 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1162 RNA, herein designated VGAM RNA, binds complementarily to one or more host target binding sites located in untranslated regions of VGAM1162 host target RNA, herein designated VGAM HOST TARGET RNA. This complementary binding is due to the fact that the nucleotide sequence of VGAM1162 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1162 RNA, herein designated VGAM RNA, may have a different number of host target binding sites in untranslated regions of a VGAM1162 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1162 RNA, herein designated VGAM RNA, to host target binding sites on VGAM1162 host target RNA, herein designated VGAM HOST TARGET RNA, such as BINDING SITE I, BINDING SITE II and BINDING SITE III, inhibits translation of VGAM1162 host target RNA into VGAM1162 host target protein, herein designated VGAM HOST TARGET PROTEIN. VGAM host target protein is therefore outlined by a broken line.

It is appreciated that VGAM1162 host target gene, herein designated VGAM HOST TARGET GENE, in fact represents a plurality of VGAM1162 host target genes. The mRNA of each one of this plurality of VGAM1162 host target genes comprises one or more host target binding sites, each having a nucleotide sequence which is at least partly complementary to VGAM1162 RNA, herein designated VGAM RNA, and which when bound by VGAM1162 RNA causes inhibition of translation of respective one or more VGAM1162 host target proteins.

It is further appreciated by one skilled in the art that the mode of translational inhibition illustrated by FIG. 1 with specific reference to translational inhibition exerted by VGAM1162 gene, herein designated VGAM GENE, on one or more VGAM1162 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1162 is inhibition of expression of host target genes, as part of a novel viral mechanism of attacking a host. Accordingly, utilities of VGAM1162 include diagnosis, prevention and treatment of viral infection by Ectromelia Virus. Specific functions, and accordingly utilities, of VGAM1162 correlate with, and may be deduced from, the identity of the host target genes which VGAM1162 binds and inhibits, and the function of these host target genes, as elaborated hereinbelow.

Nucleotide sequences of the VGAM1162 precursor RNA, herein designated VGAM PRECURSOR RNA, and of the 'diced' VGAM1162 RNA, herein designated VGAM RNA, and a schematic representation of the secondary folding of VGAM1162 folded precursor RNA, herein designated VGAM FOLDED PRECURSOR RNA, of VGAM1162 are further described hereinbelow with reference to Table 1.

Nucleotide sequences of host target binding sites, such as BINDING SITE-I, BINDING SITE-II and BINDING SITE-III of FIG. 1, found on VGAM1162 host target RNA, and schematic representation of the complementarity of each of these host target binding sites to VGAM1162 RNA, herein designated VGAM RNA, are described hereinbelow with reference to Table 2.

As mentioned hereinabove with reference to FIG. 1, a function of VGAM1162 gene, herein designated VGAM is inhibition of expression of VGAM1162 target genes. It is appreciated that specific functions, and accordingly utilities, of VGAM1162 correlate with, and may be deduced from, the identity of the target genes which VGAM1162 binds and inhibits, and the function of these target genes, as elaborated hereinbelow.

Bullous Pemphigoid Antigen 1, 230/240 kDa (BPAG1, Accession NM_015548) is a VGAM1162 host target gene. BPAG1 BINDING SITE is HOST TARGET binding site found in the 3' untranslated region of mRNA encoded by BPAG1, corresponding to a HOST TARGET binding site such as BINDING SITE I, BINDING SITE II or BINDING SITE III. Table 2 illustrates the complementarity of the nucleotide sequences of BPAG1 BINDING SITE, designated SEQ ID:17811, to the nucleotide sequence of VGAM1162 RNA, herein designated VGAM RNA, also designated SEQ ID:3873.

A function of VGAM1162 is therefore inhibition of Bullous Pemphigoid Antigen 1, 230/240 kDa (BPAG1, Accession NM_015548), a gene which plays a role in cross-linking actin to other cytoskeletal proteins, binds to microtubules. Accordingly, utilities of VGAM1162 include diagnosis, prevention and treatment of diseases and clinical conditions associated with BPAG1. The function of BPAG1 and its association with various diseases and clinical conditions, has been established by previous studies, as described hereinabove with reference to VGAM494. CUB and Sushi Multiple Domains 1 (CSMD1, Accession XM_054838) is another VGAM1162 host target gene. CSMD1 BINDING SITE is HOST TARGET binding site found in the 3' untranslated region of mRNA encoded by CSMD1, corresponding to a HOST TARGET binding site such as BINDING SITE I, BINDING SITE II or BINDING SITE III. Table 2 illustrates the complementarity of the nucleotide sequences of CSMD1 BINDING SITE, designated SEQ ID:36189, to the nucleotide sequence of VGAM1162 RNA, herein designated VGAM RNA, also designated SEQ ID:3873.

Another function of VGAM1162 is therefore inhibition of CUB and Sushi Multiple Domains 1 (CSMD1, Accession XM_054838). Accordingly, utilities of VGAM1162 include diagnosis, prevention and treatment of diseases and clinical conditions associated with CSMD1. KIAA1987 (Accession XM_113870) is another VGAM1162 host target gene. KIAA1987 BINDING SITE is HOST TARGET binding site found in the 3' untranslated region of mRNA encoded by KIAA1987, corresponding to a HOST TARGET binding site such as BINDING SITE I, BINDING SITE II or BINDING SITE III. Table 2 illustrates the complementarity of the nucleotide sequences of KIAA1987 BINDING SITE, designated SEQ ID:42501, to the nucleotide sequence of VGAM1162 RNA, herein designated VGAM RNA, also designated SEQ ID:3873.

Another function of VGAM1162 is therefore inhibition of KIAA1987 (Accession XM_113870). Accordingly, utilities of VGAM1162 include diagnosis, prevention and treatment of diseases and clinical conditions associated with KIAA1987. Leucine-rich Repeat LGI Family, Member 2 (LGI2, Accession NM_018176) is another VGAM1162 host target gene. LGI2 BINDING SITE is HOST TARGET binding site found in the 3' untranslated region of mRNA encoded by LGI2, corresponding to a HOST TARGET binding site such as BINDING SITE I, BINDING SITE II or BINDING SITE III. Table 2 illustrates the complementarity of the nucleotide sequences of LGI2 BINDING SITE, designated SEQ ID:20002, to the nucleotide sequence of VGAM1162 RNA, herein designated VGAM RNA, also designated SEQ ID:3873.

Another function of VGAM1162 is therefore inhibition of Leucine-rich Repeat LGI Family, Member 2 (LGI2, Accession NM_018176). Accordingly, utilities of VGAM1162 include diagnosis, prevention and treatment of diseases and clinical conditions associated with LGI2. VEST1 (Accession NM_052958) is another VGAM1162 host target gene. VEST1 BINDING SITE is HOST TARGET binding site found in the 5' untranslated region of mRNA encoded by VEST1, corresponding to a HOST TARGET binding site such as BINDING SITE I, BINDING SITE II or BINDING SITE III. Table 2 illustrates the complementarity of the nucleotide sequences of VEST1 BINDING SITE, designated SEQ ID:27519, to the nucleotide sequence of VGAM1162 RNA, herein designated VGAM RNA, also designated SEQ ID:3873.

Another function of VGAM1162 is therefore inhibition of VEST1 (Accession NM_052958). Accordingly, utilities of VGAM1162 include diagnosis, prevention and treatment of diseases and clinical conditions associated with VEST1. LOC145945 (Accession XM_096908) is another VGAM1162 host target gene. LOC145945 BINDING SITE is HOST TARGET binding site found in the 5' untranslated region of mRNA encoded by LOC145945, corresponding to a HOST TARGET binding site such as BINDING SITE I, BINDING SITE II or BINDING SITE III. Table 2 illustrates the complementarity of the nucleotide sequences of LOC145945 BINDING SITE, designated SEQ ID:40638, to the nucleotide sequence of VGAM1162 RNA, herein designated VGAM RNA, also designated SEQ ID:3873.

Another function of VGAM1162 is therefore inhibition of LOC145945 (Accession XM_096908). Accordingly, utilities of VGAM1162 include diagnosis, prevention and treatment of diseases and clinical conditions associated with LOC145945. LOC149013 (Accession XM_086398) is another VGAM1162 host target gene. LOC149013 BINDING SITE is HOST TARGET binding site found in the 3' untranslated region of mRNA encoded by LOC149013, corresponding to a HOST TARGET binding site such as BINDING SITE I, BINDING SITE II or BINDING SITE III. Table 2 illustrates the complementarity of the nucleotide sequences of LOC149013 BINDING SITE, designated SEQ ID:38632, to the nucleotide sequence of VGAM1162 RNA, herein designated VGAM RNA, also designated SEQ ID:3873.

Another function of VGAM1162 is therefore inhibition of LOC149013 (Accession XM_086398). Accordingly, utilities of VGAM1162 include diagnosis, prevention and treatment of diseases and clinical conditions associated with LOC149013. FIG. 1 further provides a conceptual description of a novel bioinformatically detected viral gene of the present invention, referred to here as Viral Genomic Address Messenger 1163 (VGAM1163) viral gene, which modulates expression of respective host target genes thereof, the function and utility of which host target genes is known in the art.

VGAM1163 is a novel bioinformatically detected regulatory, non protein coding, viral micro RNA (miRNA) gene. The method by which VGAM1163 was detected is described hereinabove with reference to FIGS. 1-8.

VGAM1163 gene, herein designated VGAM GENE, is a viral gene contained in the genome of Ectromelia Virus. VGAM1163 host target gene, herein designated VGAM HOST TARGET GENE, is a human gene contained in the human genome.

VGAM1163 gene encodes a VGAM1163 precursor RNA, herein designated VGAM PRECURSOR RNA. Similar to other miRNA genes, and unlike most ordinary genes, VGAM1163 precursor RNA does not encode a protein. A nucleotide sequence identical or highly similar to the nucleotide sequence of VGAM1163 precursor RNA is designated SEQ ID:1149, and is provided hereinbelow with reference to the sequence listing part. Nucleotide sequence SEQ ID:1149 is located at position 140623 relative to the genome of Ectromelia Virus.

VGAM1163 precursor RNA folds onto itself, forming VGAM1163 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1163 folded precursor RNA into VGAM1163 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM1163 RNA is designated SEQ ID:3874, and is provided hereinbelow with reference to the sequence listing part.

VGAM1163 host target gene, herein designated VGAM HOST TARGET GENE, encodes a corresponding messenger RNA, VGAM1163 host target RNA, herein designated VGAM HOST TARGET RNA. VGAM1163 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1163 RNA, herein designated VGAM RNA, binds complementarily to one or more host target binding sites located in untranslated regions of VGAM1163 host target RNA, herein designated VGAM HOST TARGET RNA. This complementary binding is due to the fact that the nucleotide sequence of VGAM1163 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1163 RNA, herein designated VGAM RNA, may have a different number of host target binding sites in untranslated regions of a VGAM1163 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1163 RNA, herein designated VGAM RNA, to host target binding sites on VGAM1163 host target RNA, herein designated VGAM HOST TARGET RNA, such as BINDING SITE I, BINDING SITE II and BINDING SITE III, inhibits translation of VGAM1163 host target RNA into VGAM1163 host target protein, herein designated VGAM HOST TARGET PROTEIN. VGAM host target protein is therefore outlined by a broken line.

It is appreciated that VGAM1163 host target gene, herein designated VGAM HOST TARGET GENE, in fact represents a plurality of VGAM1163 host target genes. The mRNA of each one of this plurality of VGAM1163 host target genes comprises one or more host target binding sites, each having a nucleotide sequence which is at least partly complementary to VGAM1163 RNA, herein designated VGAM RNA, and which when bound by VGAM1163 RNA causes inhibition of translation of respective one or more VGAM1163 host target proteins.

It is further appreciated by one skilled in the art that the mode of translational inhibition illustrated by FIG. 1 with specific reference to translational inhibition exerted by VGAM1163 gene, herein designated VGAM GENE, on one or more VGAM1163 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1163 is inhibition of expression of host target genes, as part of a novel viral mechanism of attacking a host. Accordingly, utilities of VGAM1163 include diagnosis, prevention and treatment of viral infection by Ectromelia Virus. Specific functions, and accordingly utilities, of VGAM1163 correlate with, and may be deduced from, the identity of the host target genes which VGAM1163 binds and inhibits, and the function of these host target genes, as elaborated hereinbelow.

Nucleotide sequences of the VGAM1163 precursor RNA, herein designated VGAM PRECURSOR RNA, and of the 'diced' VGAM1163 RNA, herein designated VGAM RNA, and a schematic representation of the secondary folding of VGAM1163 folded precursor RNA, herein designated VGAM FOLDED PRECURSOR RNA, of VGAM1163 are further described hereinbelow with reference to Table 1.

Nucleotide sequences of host target binding sites, such as BINDING SITE-I, BINDING SITE-II and BINDING SITE-III of FIG. 1, found on VGAM1163 host target RNA, and schematic representation of the complementarity of each of these host target binding sites to VGAM1163 RNA, herein designated VGAM RNA, are described hereinbelow with reference to Table 2.

As mentioned hereinabove with reference to FIG. 1, a function of VGAM1163 gene, herein designated VGAM is inhibition of expression of VGAM1163 target genes. It is appreciated that specific functions, and accordingly utilities, of VGAM1163 correlate with, and may be deduced from, the identity of the target genes which VGAM1163 binds and inhibits, and the function of these target genes, as elaborated hereinbelow.

ATPase, Class V, Type 10B (ATP10B, Accession XM_032721) is a VGAM1163 host target gene. ATP10B BINDING SITE is HOST TARGET binding site found in the 3' untranslated region of mRNA encoded by ATP10B, corresponding to a HOST TARGET binding site such as BINDING SITE I, BINDING SITE II or BINDING SITE III. Table 2 illustrates the complementarity of the nucleotide sequences of ATP10B BINDING SITE, designated SEQ ID:31735, to the nucleotide sequence of VGAM1163 RNA, herein designated VGAM RNA, also designated SEQ ID:3874.

A function of VGAM1163 is therefore inhibition of ATPase, Class V, Type 10B (ATP10B, Accession XM_032721). Accordingly, utilities of VGAM1163 include diagnosis, prevention and treatment of diseases and clinical conditions associated with ATP10B. BDG-29 (Accession XM_051343) is another VGAM1163 host target gene. BDG-29 BINDING SITE is HOST TARGET binding site found in the 3' untranslated region of mRNA encoded by BDG-29, corresponding to a HOST TARGET binding site such as BINDING SITE I, BINDING SITE II or BINDING SITE III. Table 2 illustrates the complementarity of the nucleotide sequences of BDG-29 BINDING SITE, designated SEQ ID:35815, to the nucleotide sequence of VGAM1163 RNA, herein designated VGAM RNA, also designated SEQ ID:3874.

Another function of VGAM1163 is therefore inhibition of BDG-29 (Accession XM_051343). Accordingly, utilities of VGAM1163 include diagnosis, prevention and treatment of diseases and clinical conditions associated with BDG-29. GW112 (Accession NM_006418) is another VGAM1163 host target gene. GW112 BINDING SITE is HOST TARGET binding site found in the 3' untranslated region of mRNA encoded by GW112, corresponding to a HOST TARGET binding site such as BINDING SITE I, BINDING SITE II or BINDING SITE III. Table 2 illustrates the complementarity of the nucleotide sequences of GW112 BINDING SITE, designated SEQ ID:13131, to the nucleotide sequence of VGAM1163 RNA, herein designated VGAM RNA, also designated SEQ ID:3874.

Another function of VGAM1163 is therefore inhibition of GW112 (Accession NM_006418). Accordingly, utilities of VGAM1163 include diagnosis, prevention and treatment of diseases and clinical conditions associated with GW112. Heat Shock 27 kDa Protein Family, Member 7 (cardiovascular) (HSPB7, Accession NM_014424) is another VGAM1163 host target gene. HSPB7 BINDING SITE is HOST TARGET binding site found in the 3' untranslated region of mRNA encoded by HSPB7, corresponding to a HOST TARGET binding site such as BINDING SITE I, BINDING SITE II or BINDING SITE III. Table 2 illustrates the complementarity of the nucleotide sequences of HSPB7 BINDING SITE, designated SEQ ID:15780, to the nucleotide sequence of VGAM1163 RNA, herein designated VGAM RNA, also designated SEQ ID:3874.

Another function of VGAM1163 is therefore inhibition of Heat Shock 27kDa Protein Family, Member 7 (cardiovascular) (HSPB7, Accession NM_014424). Accordingly, utilities of VGAM1163 include diagnosis, prevention and treatment of diseases and clinical conditions associated with HSPB7. KIAA1464 (Accession XM_043069) is another VGAM1163 host target gene. KIAA1464 BINDING SITE is HOST TARGET binding site found in the 3' untranslated region of mRNA encoded by KIAA1464, corresponding to a HOST TARGET binding site such as BINDING SITE I, BINDING SITE II or BINDING SITE III. Table 2 illustrates the complementarity of the nucleotide sequences of KIAA1464 BINDING SITE, designated SEQ ID:33882, to the nucleotide sequence of VGAM1163 RNA, herein designated VGAM RNA, also designated SEQ ID:3874.

Another function of VGAM1163 is therefore inhibition of KIAA1464 (Accession XM_043069). Accordingly, utilities of VGAM1163 include diagnosis, prevention and treatment of diseases and clinical conditions associated with KIAA1464. KIAA1634 (Accession XM_032749) is another VGAM1163 host target gene. KIAA1634 BINDING SITE is HOST TARGET binding site found in the 3' untranslated region of mRNA encoded by KIAA1634, corresponding to a HOST TARGET binding site such as BINDING SITE I, BINDING SITE II or BINDING SITE III. Table 2 illustrates the complementarity of the nucleotide sequences of KIAA1634 BINDING SITE, designated SEQ ID:31752, to the nucleotide sequence of VGAM1163 RNA, herein designated VGAM RNA, also designated SEQ ID:3874.

Another function of VGAM1163 is therefore inhibition of KIAA1634 (Accession XM_032749). Accordingly, utilities of VGAM1163 include diagnosis, prevention and treatment of diseases and clinical conditions associated with KIAA1634. Neuropilin (NRP) and Tolloid (TLL)-like 1 (NETO1, Accession NM_138999) is another VGAM1163 host target gene. NETO1 BINDING SITE is HOST TARGET binding site found in the 3' untranslated region of mRNA encoded by NETO1, corresponding to a HOST TARGET binding site such as BINDING SITE I, BINDING SITE II or BINDING SITE III. Table 2 illustrates the complementarity of the nucleotide sequences of NETO1 BINDING SITE, designated SEQ ID:29097, to the nucleotide sequence of VGAM1163 RNA, herein designated VGAM RNA, also designated SEQ ID:3874.

Another function of VGAM1163 is therefore inhibition of Neuropilin (NRP) and Tolloid (TLL)-like 1 (NETO1, Accession NM_138999). Accordingly, utilities of VGAM1163 include diagnosis, prevention and treatment of diseases and clinical conditions associated with NETO1. PRO2533 (Accession NM_018629) is another VGAM1163 host target gene. PRO2533 BINDING SITE is HOST TARGET binding site found in the 3' untranslated region of mRNA encoded by PRO2533, corresponding to a HOST TARGET binding site such as BINDING SITE I, BINDING SITE II or BINDING SITE III. Table 2 illustrates the complementarity of the nucleotide sequences of PRO2533 BINDING SITE, designated SEQ ID:20703, to the nucleotide sequence of VGAM1163 RNA, herein designated VGAM RNA, also designated SEQ ID:3874.

Another function of VGAM1163 is therefore inhibition of PRO2533 (Accession NM_018629). Accordingly, utilities of VGAM1163 include diagnosis, prevention and treatment of diseases and clinical conditions associated with PRO2533. LOC151201 (Accession XM_098021) is another VGAM1163 host target gene. LOC151201 BINDING SITE is HOST TARGET binding site found in the 3' untranslated region of mRNA encoded by LOC151201, corresponding to a HOST TARGET binding site such as BINDING SITE I, BINDING SITE II or BINDING SITE III. Table 2 illustrates the complementarity of the nucleotide sequences of LOC151201 BINDING SITE, designated SEQ ID:41324, to the nucleotide sequence of VGAM1163 RNA, herein designated VGAM RNA, also designated SEQ ID:3874.

Another function of VGAM1163 is therefore inhibition of LOC151201 (Accession XM_098021). Accordingly, utilities of VGAM1163 include diagnosis, prevention and treatment of diseases and clinical conditions associated with LOC151201. FIG. 1 further provides a conceptual description of a novel bioinformatically detected viral gene of the present invention, referred to here as Viral Genomic Address Messenger 1164 (VGAM1164) viral gene, which modulates expression of respective host target genes thereof, the function and utility of which host target genes is known in the art.

VGAM1164 is a novel bioinformatically detected regulatory, non protein coding, viral micro RNA (miRNA) gene. The method by which VGAM1164 was detected is described hereinabove with reference to FIGS. 1-8.

VGAM1164 gene, herein designated VGAM GENE, is a viral gene contained in the genome of Camelpox Virus. VGAM1164 host target gene, herein designated VGAM HOST TARGET GENE, is a human gene contained in the human genome.

VGAM1164 gene encodes a VGAM1164 precursor RNA, herein designated VGAM PRECURSOR RNA. Similar to other miRNA genes, and unlike most ordinary genes, VGAM1164 precursor RNA does not encode a protein. A nucleotide sequence identical or highly similar to the nucleotide sequence of VGAM1164 precursor RNA is designated SEQ ID:1150, and is provided hereinbelow with reference to the sequence listing part. Nucleotide sequence SEQ ID:1150 is located at position 135687 relative to the genome of Camelpox Virus.

VGAM1164 precursor RNA folds onto itself, forming VGAM1164 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1164 folded precursor RNA into VGAM1164 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1164 RNA is designated SEQ ID:3875, and is provided hereinbelow with reference to the sequence listing part.

VGAM1164 host target gene, herein designated VGAM HOST TARGET GENE, encodes a corresponding messenger RNA, VGAM1164 host target RNA, herein designated VGAM HOST TARGET RNA. VGAM1164 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1164 RNA, herein designated VGAM RNA, binds complementarily to one or more host target binding sites located in untranslated regions of VGAM1164 host target RNA, herein designated VGAM HOST TARGET RNA. This complementary binding is due to the fact that the nucleotide sequence of VGAM1164 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1164 RNA, herein designated VGAM RNA, may have a different number of host target binding sites in untranslated regions of a VGAM1164 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1164 RNA, herein designated VGAM RNA, to host target binding sites on VGAM1164 host target RNA, herein designated VGAM HOST TARGET RNA, such as BINDING SITE I, BINDING SITE II and BINDING SITE III, inhibits translation of VGAM1164 host target RNA into VGAM1164 host target protein, herein designated VGAM HOST TARGET PROTEIN. VGAM host target protein is therefore outlined by a broken line.

It is appreciated that VGAM1164 host target gene, herein designated VGAM HOST TARGET GENE, in fact represents a plurality of VGAM1164 host target genes. The mRNA of each one of this plurality of VGAM1164 host target genes comprises one or more host target binding sites, each having a nucleotide sequence which is at least partly complementary to VGAM1164 RNA, herein designated VGAM RNA, and which when bound by VGAM1164 RNA causes inhibition of translation of respective one or more VGAM1164 host target proteins.

It is further appreciated by one skilled in the art that the mode of translational inhibition illustrated by FIG. 1 with specific reference to translational inhibition exerted by VGAM1164 gene, herein designated VGAM GENE, on one or more VGAM1164 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1164 is inhibition of expression of host target genes, as part of a novel viral mechanism of attacking a host. Accordingly, utilities of VGAM1164 include diagnosis, prevention and treatment of viral infection by Camelpox Virus. Specific functions, and accordingly utilities, of VGAM1164 correlate with, and may be deduced from, the identity of the host target genes which VGAM1164 binds and inhibits, and the function of these host target genes, as elaborated hereinbelow.

Nucleotide sequences of the VGAM1164 precursor RNA, herein designated VGAM PRECURSOR RNA, and of the 'diced' VGAM1164 RNA, herein designated VGAM RNA, and a schematic representation of the secondary folding of VGAM1164 folded precursor RNA, herein designated VGAM FOLDED PRECURSOR RNA, of VGAM1164 are further described hereinbelow with reference to Table 1.

Nucleotide sequences of host target binding sites, such as BINDING SITE-I, BINDING SITE-II and BINDING SITE-III of FIG. 1, found on VGAM1164 host target RNA, and schematic representation of the complementarity of each of these host target binding sites to VGAM1164 RNA, herein designated VGAM RNA, are described hereinbelow with reference to Table 2.

As mentioned hereinabove with reference to FIG. 1, a function of VGAM1164 gene, herein designated VGAM is inhibition of expression of VGAM1164 target genes. It is appreciated that specific functions, and accordingly utilities, of VGAM1164 correlate with, and may be deduced from, the identity of the target genes which VGAM1164 binds and inhibits, and the function of these target genes, as elaborated hereinbelow.

Neurotrophic Tyrosine Kinase, Receptor, Type 2 (NTRK2, Accession NM_006180) is a VGAM1164 host target gene. NTRK2 BINDING SITE is HOST TARGET binding site found in the 3' untranslated region of mRNA encoded by NTRK2, corresponding to a HOST TARGET binding site such as BINDING SITE I, BINDING SITE II or BINDING SITE III. Table 2 illustrates the complementarity of the nucleotide sequences of NTRK2 BINDING SITE, designated SEQ ID:12841, to the nucleotide sequence of VGAM1164 RNA, herein designated VGAM RNA, also designated SEQ ID:3875.

A function of VGAM1164 is therefore inhibition of Neurotrophic Tyrosine Kinase, Receptor, Type 2 (NTRK2, Accession NM_006180), a gene which is involved in the development and/or maintenance of the nervous system. Accordingly, utilities of VGAM1164 include diagnosis, prevention and treatment of diseases and clinical conditions associated with NTRK2. The function of NTRK2 and its association with various diseases and clinical conditions, has been established by previous studies, as described hereinabove with reference to VGAM341. LOC116143 (Accession XM_057465) is another VGAM1164 host target gene. LOC116143 BINDING SITE is HOST TARGET binding site found in the 3' untranslated region of mRNA encoded by LOC116143, corresponding to a HOST TARGET binding site such as BINDING SITE I, BINDING SITE II or BINDING SITE III. Table 2 illustrates the complementarity of the nucleotide sequences of LOC116143 BINDING SITE, designated SEQ ID:36516, to the nucleotide sequence of VGAM1164 RNA, herein designated VGAM RNA, also designated SEQ ID:3875.

Another function of VGAM1164 is therefore inhibition of LOC116143 (Accession XM_057465). Accordingly, utilities of VGAM1164 include diagnosis, prevention and treatment of diseases and clinical conditions associated with LOC116143. LOC151121 (Accession XM_087102) is another VGAM1164 host target gene. LOC151121 BINDING SITE is HOST TARGET binding site found in the 5' untranslated region of mRNA encoded by LOC151121, corresponding to a HOST TARGET binding site such as BINDING SITE I, BINDING SITE II or BINDING SITE III. Table 2 illustrates the complementarity of the nucleotide sequences of LOC151121 BINDING SITE, designated SEQ ID:39050, to the nucleotide sequence of VGAM1164 RNA, herein designated VGAM RNA, also designated SEQ ID:3875.

Another function of VGAM1164 is therefore inhibition of LOC151121 (Accession XM_087102). Accordingly, utilities of VGAM1164 include diagnosis, prevention and treatment of diseases and clinical conditions associated with LOC151121. LOC203429 (Accession XM_114701) is another VGAM1164 host target gene. LOC203429 BINDING SITE is HOST TARGET binding site found in the 3' untranslated region of mRNA encoded by LOC203429, corresponding to a HOST TARGET binding site such as BINDING SITE I, BINDING SITE II or BINDING SITE III. Table 2 illustrates the complementarity of the nucleotide sequences of LOC203429 BINDING SITE, designated SEQ ID:43046, to the nucleotide sequence of VGAM1164 RNA, herein designated VGAM RNA, also designated SEQ ID:3875.

Another function of VGAM1164 is therefore inhibition of LOC203429 (Accession XM_114701). Accordingly, utilities of VGAM1164 include diagnosis, prevention and treatment of diseases and clinical conditions associated with LOC203429. FIG. 1 further provides a conceptual description of a novel bioinformatically detected viral gene of the present invention, referred to here as Viral Genomic Address Messenger 1165 (VGAM1165) viral gene, which modulates expression of respective host target genes thereof, the function and utility of which host target genes is known in the art.

VGAM1165 is a novel bioinformatically detected regulatory, non protein coding, viral micro RNA (miRNA) gene. The method by which VGAM1165 was detected is described hereinabove with reference to FIGS. 1-8.

VGAM1165 gene, herein designated VGAM GENE, is a viral gene contained in the genome of Ectromelia Virus. VGAM1165 host target gene, herein designated VGAM HOST TARGET GENE, is a human gene contained in the human genome.

VGAM1165 gene encodes a VGAM1165 precursor RNA, herein designated VGAM PRECURSOR RNA. Similar to other miRNA genes, and unlike most ordinary genes, VGAM1165 precursor RNA does not encode a protein. A nucleotide sequence identical or highly similar to the nucleotide sequence of VGAM1165 precursor RNA is designated SEQ ID:1151, and is provided hereinbelow with reference to the sequence listing part. Nucleotide sequence SEQ ID:1151 is located at position 141338 relative to the genome of Ectromelia Virus.

VGAM1165 precursor RNA folds onto itself, forming VGAM1165 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1165 folded precursor RNA into VGAM1165 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1165 RNA is designated SEQ ID:3876, and is provided hereinbelow with reference to the sequence listing part.

VGAM1165 host target gene, herein designated VGAM HOST TARGET GENE, encodes a corresponding messenger RNA, VGAM1165 host target RNA, herein designated VGAM HOST TARGET RNA. VGAM1165 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1165 RNA, herein designated VGAM RNA, binds complementarily to one or more host target binding sites located in untranslated regions of VGAM1165 host target RNA, herein designated VGAM HOST TARGET RNA. This complementary binding is due to the fact that the nucleotide sequence of VGAM1165 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1165 RNA, herein designated VGAM RNA, may have a different number of host target binding sites in untranslated regions of a VGAM1165 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1165 RNA, herein designated VGAM RNA, to host target binding sites on VGAM1165 host target RNA, herein designated VGAM HOST TARGET RNA, such as BINDING SITE I, BINDING SITE II and BINDING SITE III, inhibits translation of VGAM1165 host target RNA into VGAM1165 host target protein, herein designated VGAM HOST TARGET PROTEIN. VGAM host target protein is therefore outlined by a broken line.

It is appreciated that VGAM1165 host target gene, herein designated VGAM HOST TARGET GENE, in fact represents a plurality of VGAM1165 host target genes. The mRNA of each one of this plurality of VGAM1165 host target genes comprises one or more host target binding sites, each having a nucleotide sequence which is at least partly complementary to VGAM1165 RNA, herein designated VGAM RNA, and which when bound by VGAM1165 RNA causes inhibition of translation of respective one or more VGAM1165 host target proteins.

It is further appreciated by one skilled in the art that the mode of translational inhibition illustrated by FIG. 1 with specific reference to translational inhibition exerted by VGAM1165 gene, herein designated VGAM GENE, on one or more VGAM1165 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1165 is inhibition of expression of host target genes, as part of a novel viral mechanism of attacking a host. Accordingly, utilities of VGAM1165 include diagnosis, prevention and treatment of viral infection by Ectromelia Virus. Specific functions, and accordingly utilities, of VGAM1165 correlate with, and may be deduced from, the identity of the host target genes which VGAM1165 binds and inhibits, and the function of these host target genes, as elaborated hereinbelow.

Nucleotide sequences of the VGAM1165 precursor RNA, herein designated VGAM PRECURSOR RNA, and of the 'diced' VGAM1165 RNA, herein designated VGAM RNA, and a schematic representation of the secondary folding of VGAM1165 folded precursor RNA, herein designated VGAM FOLDED PRECURSOR RNA, of VGAM1165 are further described hereinbelow with reference to Table 1.

Nucleotide sequences of host target binding sites, such as BINDING SITE-I, BINDING SITE-II and BINDING SITE-III of FIG. 1, found on VGAM1165 host target RNA, and schematic representation of the complementarity of each of these host target binding sites to VGAM1165 RNA, herein designated VGAM RNA, are described hereinbelow with reference to Table 2.

As mentioned hereinabove with reference to FIG. 1, a function of VGAM1165 gene, herein designated VGAM is inhibition of expression of VGAM1165 target genes. It is appreciated that specific functions, and accordingly utilities, of VGAM1165 correlate with, and may be deduced from, the identity of the target genes which VGAM1165 binds and inhibits, and the function of these target genes, as elaborated hereinbelow.

Apolipoprotein B MRNA Editing Enzyme, Catalytic Polypeptide 1 (APOBEC1, Accession NM_005889) is a VGAM1165 host target gene. APOBEC1 BINDING SITE is HOST TARGET binding site found in the 3' untranslated region of mRNA encoded by APOBEC1, corresponding to a HOST TARGET binding site such as BINDING SITE I, BINDING SITE II or BINDING SITE III. Table 2 illustrates the complementarity of the nucleotide sequences of APOBEC1 BINDING SITE, designated SEQ ID:12508, to the nucleotide sequence of VGAM1165 RNA, herein designated VGAM RNA, also designated SEQ ID:3876.

A function of VGAM1165 is therefore inhibition of Apolipoprotein B MRNA Editing Enzyme, Catalytic Polypeptide 1 (APOBEC1, Accession NM_005889). Accordingly, utilities of VGAM1165 include diagnosis, prevention and treatment of diseases and clinical conditions associated with APOBEC1. Bridging Integrator 3 (BIN3, Accession NM_018688) is another VGAM1165 host target gene. BIN3 BINDING SITE is HOST TARGET binding site found in the 3' untranslated region of mRNA encoded by BIN3, corresponding to a HOST TARGET binding site such as BINDING SITE I, BINDING SITE II or BINDING SITE III. Table 2 illustrates the complementarity of the nucleotide sequences of BIN3 BINDING SITE, designated SEQ ID:20762, to the nucleotide sequence of VGAM1165 RNA, herein designated VGAM RNA, also designated SEQ ID:3876.

Another function of VGAM1165 is therefore inhibition of Bridging Integrator 3 (BIN3, Accession NM_018688). Accordingly, utilities of VGAM1165 include diagnosis, prevention and treatment of diseases and clinical conditions associated with BIN3. DEAD/H (Asp-Glu-Ala-Asp/His) Box Polypeptide 6 (RNA helicase, 54 kDa) (DDX6, Accession NM_004397) is another VGAM1165 host target gene. DDX6 BINDING SITE is HOST TARGET binding site found in the 3' untranslated region of mRNA encoded by DDX6, corresponding to a HOST TARGET binding site such as BINDING SITE I, BINDING SITE II or BINDING SITE III. Table 2 illustrates the complementarity of the nucleotide sequences of DDX6 BINDING SITE, designated SEQ ID:10642, to the nucleotide sequence of VGAM1165 RNA, herein designated VGAM RNA, also designated SEQ ID:3876.

Another function of VGAM1165 is therefore inhibition of DEAD/H (Asp-Glu-Ala-Asp/His) Box Polypeptide 6 (RNA helicase, 54 kDa) (DDX6, Accession NM_004397), a gene which is putative RNA helicases. Accordingly, utilities of VGAM1165 include diagnosis, prevention and treatment of diseases and clinical conditions associated with DDX6. The function of DDX6 and its association with various diseases and clinical conditions, has been established by previous studies, as described hereinabove with reference to VGAM179. Coagulation Factor VIII, Procoagulant Component (hemophilia A) (F8, Accession NM_000132) is another VGAM1165 host target gene. F8 BINDING SITE is HOST TARGET binding site found in the 3' untranslated region of mRNA encoded by F8, corresponding to a HOST TARGET binding site such as BINDING SITE I, BINDING SITE II or BINDING SITE III. Table 2 illustrates the complementarity of the nucleotide sequences of F8 BINDING SITE, designated SEQ ID:5617, to the nucleotide sequence of VGAM1165 RNA, herein designated VGAM RNA, also designated SEQ ID:3876.

Another function of VGAM1165 is therefore inhibition of Coagulation Factor VIII, Procoagulant Component (hemophilia A) (F8, Accession NM_000132). Accordingly, utilities of VGAM1165 include diagnosis, prevention and treatment of diseases and clinical conditions associated with F8. Fibroblast Growth Factor 2 (basic) (FGF2, Accession NM_002006) is another VGAM1165 host target gene. FGF2 BINDING SITE is HOST TARGET binding site found in the 3' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7735, to the nucleotide sequence of VGAM1165 RNA, herein designated VGAM RNA, also designated SEQ ID:3876.

Another function of VGAM1165 is therefore inhibition of Fibroblast Growth Factor 2 (basic) (FGF2, Accession NM_002006), a gene which probably involved in nervous system development and function. Accordingly, utilities of VGAM1165 include diagnosis, prevention and treatment of diseases and clinical conditions associated with FGF2. The function of FGF2 and its association with various diseases and clinical conditions, has been established by previous studies, as described hereinabove with reference to VGAM51. Protein Phosphatase 3 (formerly 2B), Catalytic Subunit, Alpha Isoform (calcineurin A alpha) (PPP3CA, Accession NM_000944) is another VGAM1165 host target gene. PPP3CA BINDING SITE is HOST TARGET binding site found in the 3' untranslated region of mRNA encoded by PPP3CA, corresponding to a HOST TARGET binding site such as BINDING SITE I, BINDING SITE II or BINDING SITE III. Table 2 illustrates the complementarity of the nucleotide sequences of PPP3CA BINDING SITE, designated SEQ ID:6645, to the nucleotide sequence of VGAM1165 RNA, herein designated VGAM RNA, also designated SEQ ID:3876.

Another function of VGAM1165 is therefore inhibition of Protein Phosphatase 3 (formerly 2B), Catalytic Subunit, Alpha Isoform (calcineurin A alpha) (PPP3CA, Accession NM_000944), a gene which is the catalytic subunit of calcium-dependent, calmodulin-stimulated protein phosphatase. Accordingly, utilities of VGAM1165 include diagnosis, prevention and treatment of diseases and clinical conditions associated with PPP3CA. The function of PPP3CA and its association with various diseases and clinical conditions, has been established by previous studies, as described hereinabove with reference to VGAM497. RAD50 Homolog (S. cerevisiae) (RAD50, Accession NM_005732) is another VGAM1165 host target gene. RAD50 BINDING SITE1 and RAD50 BINDING SITE2 are HOST TARGET binding sites found in untranslated regions of mRNA encoded by RAD50, corresponding to HOST TARGET binding sites such as BINDING SITE I, BINDING SITE II or BINDING SITE III. Table 2 illustrates the complementarity of the nucleotide sequences of RAD50 BINDING SITE1 and RAD50 BINDING SITE2, designated SEQ ID:12297 and SEQ ID:28555 respectively, to the nucleotide sequence of VGAM1165 RNA, herein designated VGAM RNA, also designated SEQ ID:3876.

Another function of VGAM1165 is therefore inhibition of RAD50 Homolog (S. cerevisiae) (RAD50, Accession NM_005732), a gene which is involved in dna double-strand break repair (dsbr). Accordingly, utilities of VGAM1165 include diagnosis, prevention and treatment of diseases and clinical conditions associated with RAD50. The function of RAD50 and its association with various diseases and clinical conditions, has been established by previous studies, as described hereinabove with reference to VGAM132. KIAA0268 (Accession XM_046126) is another VGAM1165 host target gene. KIAA0268 BINDING SITE is HOST TARGET binding site found in the 3' untranslated region of mRNA encoded by KIAA0268, corresponding to a HOST TARGET binding site such as BINDING SITE I, BINDING SITE II or BINDING SITE III. Table 2 illustrates the complementarity of the nucleotide sequences of KIAA0268 BINDING SITE, designated SEQ ID:34688, to the nucleotide sequence of VGAM1165 RNA, herein designated VGAM RNA, also designated SEQ ID:3876.

Another function of VGAM1165 is therefore inhibition of KIAA0268 (Accession XM_046126). Accordingly, utilities of VGAM1165 include diagnosis, prevention and treatment of diseases and clinical conditions associated with KIAA0268. MGC22014 (Accession XM_035307) is another VGAM1165 host target gene. MGC22014 BINDING SITE is HOST TARGET binding site found in the 3' untranslated region of mRNA encoded by MGC22014, corresponding to a HOST TARGET binding site such as BINDING SITE I, BINDING SITE II or BINDING SITE III. Table 2 illustrates the complementarity of the nucleotide sequences of MGC22014 BINDING SITE, designated SEQ ID:32222, to the nucleotide sequence of VGAM1165 RNA, herein designated VGAM RNA, also designated SEQ ID:3876.

Another function of VGAM1165 is therefore inhibition of MGC22014 (Accession XM_035307). Accordingly, utilities of VGAM1165 include diagnosis, prevention and treatment of diseases and clinical conditions associated with MGC22014. FIG. 1 further provides a conceptual description of a novel bioinformatically detected viral gene of the present invention, referred to here as Viral Genomic Address Messenger 1166 (VGAM1166) viral gene, which modulates expression of respective host target genes thereof, the function and utility of which host target genes is known in the art.

VGAM1166 is a novel bioinformatically detected regulatory, non protein coding, viral micro RNA (miRNA) gene. The method by which VGAM1166 was detected is described hereinabove with reference to FIGS. 1-8.

VGAM1166 gene, herein designated VGAM GENE, is a viral gene contained in the genome of Cucumber Green Mottle Mosaic Virus. VGAM1166 host target gene, herein designated VGAM HOST TARGET GENE, is a human gene contained in the human genome.

VGAM1166 gene encodes a VGAM1166 precursor RNA, herein designated VGAM PRECURSOR RNA. Similar to other miRNA genes, and unlike most ordinary genes, VGAM1166 precursor RNA does not encode a protein. A nucleotide sequence identical or highly similar to the nucleotide sequence of VGAM1166 precursor RNA is designated SEQ ID:1152, and is provided hereinbelow with reference to the sequence listing part. Nucleotide sequence SEQ ID:1152 is located at position 2881 relative to the genome of Cucumber Green Mottle Mosaic Virus.

VGAM1166 precursor RNA folds onto itself, forming VGAM1166 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1166 folded precursor RNA into VGAM1166 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1166 RNA is designated SEQ ID:3877, and is provided hereinbelow with reference to the sequence listing part.

VGAM1166 host target gene, herein designated VGAM HOST TARGET GENE, encodes a corresponding messenger RNA, VGAM1166 host target RNA, herein designated VGAM HOST TARGET RNA. VGAM1166 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1166 RNA, herein designated VGAM RNA, binds complementarily to one or more host target binding sites located in untranslated regions of VGAM1166 host target RNA, herein designated VGAM HOST TARGET RNA. This complementary binding is due to the fact that the nucleotide sequence of VGAM1166 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1166 RNA, herein designated VGAM RNA, may have a different number of host target binding sites in untranslated regions of a VGAM1166 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1166 RNA, herein designated VGAM RNA, to host target binding sites on VGAM1166 host target RNA, herein designated VGAM HOST TARGET RNA, such as BINDING SITE I, BINDING SITE II and BINDING SITE III, inhibits translation of VGAM1166 host target RNA into VGAM1166 host target protein, herein designated VGAM HOST TARGET PROTEIN. VGAM host target protein is therefore outlined by a broken line.

It is appreciated that VGAM1166 host target gene, herein designated VGAM HOST TARGET GENE, in fact represents a plurality of VGAM1166 host target genes. The mRNA of each one of this plurality of VGAM1166 host target genes comprises one or more host target binding sites, each having a nucleotide sequence which is at least partly complementary to VGAM1166 RNA, herein designated VGAM RNA, and which when bound by VGAM1166 RNA causes inhibition of translation of respective one or more VGAM1166 host target proteins.

It is further appreciated by one skilled in the art that the mode of translational inhibition illustrated by FIG. 1 with specific reference to translational inhibition exerted by VGAM1166 gene, herein designated VGAM GENE, on one or more VGAM1166 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1166 is inhibition of expression of host target genes, as part of a novel viral mechanism of attacking a host. Accordingly, utilities of VGAM1166 include diagnosis, prevention and treatment of viral infection by Cucumber Green Mottle Mosaic Virus. Specific functions, and accordingly utilities, of VGAM1166 correlate with, and may be deduced from, the identity of the host target genes which VGAM1166 binds and inhibits, and the function of these host target genes, as elaborated hereinbelow.

Nucleotide sequences of the VGAM1166 precursor RNA, herein designated VGAM PRECURSOR RNA, and of the 'diced' VGAM1166 RNA, herein designated VGAM RNA, and a schematic representation of the secondary folding of VGAM1166 folded precursor RNA, herein designated VGAM FOLDED PRECURSOR RNA, of VGAM1166 are further described hereinbelow with reference to Table 1.

Nucleotide sequences of host target binding sites, such as BINDING SITE-I, BINDING SITE-II and BINDING SITE-III of FIG. 1, found on VGAM1166 host target RNA, and schematic representation of the complementarity of each of these host target binding sites to VGAM1166 RNA, herein designated VGAM RNA, are described hereinbelow with reference to Table 2.

As mentioned hereinabove with reference to FIG. 1, a function of VGAM1166 gene, herein designated VGAM is inhibition of expression of VGAM1166 target genes. It is appreciated that specific functions, and accordingly utilities, of VGAM1166 correlate with, and may be deduced from, the identity of the target genes which VGAM1166 binds and inhibits, and the function of these target genes, as elaborated hereinbelow.

RAD54B (Accession NM_134434) is a VGAM1166 host target gene. RAD54B BINDING SITE is HOST TARGET binding site found in the 3' untranslated region of mRNA encoded by RAD54B, corresponding to a HOST TARGET binding site such as BINDING SITE I, BINDING SITE II or BINDING SITE III. Table 2 illustrates the complementarity of the nucleotide sequences of RAD54B BINDING SITE, designated SEQ ID:28675, to the nucleotide sequence of VGAM1166 RNA, herein designated VGAM RNA, also designated SEQ ID:3877.

A function of VGAM1166 is therefore inhibition of RAD54B (Accession NM_134434), a gene which is involved in dna repair and mitotic recombination. Accordingly, utilities of VGAM1166 include diagnosis, prevention and treatment of diseases and clinical conditions associated with RAD54B. The function of RAD54B and its association with various diseases and clinical conditions, has been established by previous studies, as described hereinabove with reference to VGAM595. Single-minded Homolog 2 (Drosophila) (SIM2, Accession NM_005069) is another VGAM1166 host target gene. SIM2 BINDING SITE is HOST TARGET binding site found in the 3' untranslated region of mRNA encoded by SIM2, corresponding to a HOST TARGET binding site such as BINDING SITE I, BINDING SITE II or BINDING SITE III. Table 2 illustrates the complementarity of the nucleotide sequences of SIM2 BINDING SITE, designated SEQ ID:11519, to the nucleotide sequence of VGAM1166 RNA, herein designated VGAM RNA, also designated SEQ ID:3877.

Another function of VGAM1166 is therefore inhibition of Single-minded Homolog 2 (Drosophila) (SIM2, Accession NM_005069), a gene which may be a master gene of cns development. Accordingly, utilities of VGAM1166 include diagnosis, prevention and treatment of diseases and clinical conditions associated with SIM2. The function of SIM2 and its association with various diseases and clinical conditions, has been established by previous studies, as described hereinabove with reference to VGAM369. TAP Binding Protein (tapasin) (TAPBP, Accession NM_003190) is another VGAM1166 host target gene. TAPBP BINDING SITE is HOST TARGET binding site found in the 3' untranslated region of mRNA encoded by TAPBP, corresponding to a HOST TARGET binding site such as BINDING SITE I, BINDING SITE II or BINDING SITE III. Table 2 illustrates the complementarity of the nucleotide sequences of TAPBP BINDING SITE, designated SEQ ID:9180, to the nucleotide sequence of VGAM1166 RNA, herein designated VGAM RNA, also designated SEQ ID:3877.

Another function of VGAM1166 is therefore inhibition of TAP Binding Protein (tapasin) (TAPBP, Accession NM_003190), a gene which is involved in MHC class I-restricted antigen processing. Accordingly, utilities of VGAM1166 include diagnosis, prevention and treatment of diseases and clinical conditions associated with TAPBP. The function of TAPBP and its association with various diseases and clinical conditions, has been established by previous studies, as described hereinabove with reference to VGAM122. FHR5 (Accession NM_030787) is another VGAM1166 host target gene. FHR5 BINDING SITE is HOST TARGET binding site found in the 3' untranslated region of mRNA encoded by FHR5, corresponding to a HOST TARGET binding site such as BINDING SITE I, BINDING SITE II or BINDING SITE III. Table 2 illustrates the complementarity of the nucleotide sequences of FHR5 BINDING SITE, designated SEQ ID:25084, to the nucleotide sequence of VGAM1166 RNA, herein designated VGAM RNA, also designated SEQ ID:3877.

Another function of VGAM1166 is therefore inhibition of FHR5 (Accession NM_030787). Accordingly, utilities of VGAM1166 include diagnosis, prevention and treatment of diseases and clinical conditions associated with FHR5. LOC145739 (Accession XM_085222) is another VGAM1166 host target gene. LOC145739 BINDING SITE is HOST TARGET binding site found in the 3' untranslated region of mRNA encoded by LOC145739, corresponding to a HOST TARGET binding site such as BINDING SITE I, BINDING SITE II or BINDING SITE III. Table 2 illustrates the complementarity of the nucleotide sequences of LOC145739 BINDING SITE, designated SEQ ID:37963, to the nucleotide sequence of VGAM1166 RNA, herein designated VGAM RNA, also designated SEQ ID:3877.

Another function of VGAM1166 is therefore inhibition of LOC145739 (Accession XM_085222). Accordingly, utilities of VGAM1166 include diagnosis, prevention and treatment of diseases and clinical conditions associated with LOC145739. FIG. 1 further provides a conceptual description of a novel bioinformatically detected viral gene of the present invention, referred to here as Viral Genomic Address Messenger 1167 (VGAM1167) viral gene, which modulates expression of respective host target genes thereof, the function and utility of which host target genes is known in the art.

VGAM1167 is a novel bioinformatically detected regulatory, non protein coding, viral micro RNA (miRNA) gene. The method by which VGAM1167 was detected is described hereinabove with reference to FIGS. 1-8.

VGAM1167 gene, herein designated VGAM GENE, is a viral gene contained in the genome of Cucumber Green Mottle Mosaic Virus. VGAM1167 host target gene, herein designated VGAM HOST TARGET GENE, is a human gene contained in the human genome.

VGAM1167 gene encodes a VGAM1167 precursor RNA, herein designated VGAM PRECURSOR RNA. Similar to other miRNA genes, and unlike most ordinary genes, VGAM1167 precursor RNA does not encode a protein. A nucleotide sequence identical or highly similar to the nucleotide sequence of VGAM1167 precursor RNA is designated SEQ ID:1153, and is provided hereinbelow with reference to the sequence listing part. Nucleotide sequence SEQ ID:1153 is located at position 2385 relative to the genome of Cucumber Green Mottle Mosaic Virus.

VGAM1167 precursor RNA folds onto itself, forming VGAM1167 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1167 folded precursor RNA into VGAM1167 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM1167 RNA is designated SEQ ID:3878, and is provided hereinbelow with reference to the sequence listing part.

VGAM1167 host target gene, herein designated VGAM HOST TARGET GENE, encodes a corresponding messenger RNA, VGAM1167 host target RNA, herein designated VGAM HOST TARGET RNA. VGAM1167 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1167 RNA, herein designated VGAM RNA, binds complementarily to one or more host target binding sites located in untranslated regions of VGAM1167 host target RNA, herein designated VGAM HOST TARGET RNA. This complementary binding is due to the fact that the nucleotide sequence of VGAM1167 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1167 RNA, herein designated VGAM RNA, may have a different number of host target binding sites in untranslated regions of a VGAM1167 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1167 RNA, herein designated VGAM RNA, to host target binding sites on VGAM1167 host target RNA, herein designated VGAM HOST TARGET RNA, such as BINDING SITE I, BINDING SITE II and BINDING SITE III, inhibits translation of VGAM1167 host target RNA into VGAM1167 host target protein, herein designated VGAM HOST TARGET PROTEIN. VGAM host target protein is therefore outlined by a broken line.

It is appreciated that VGAM1167 host target gene, herein designated VGAM HOST TARGET GENE, in fact represents a plurality of VGAM1167 host target genes. The mRNA of each one of this plurality of VGAM1167 host target genes comprises one or more host target binding sites, each having a nucleotide sequence which is at least partly complementary to VGAM1167 RNA, herein designated VGAM RNA, and which when bound by VGAM1167 RNA causes inhibition of translation of respective one or more VGAM1167 host target proteins.

It is further appreciated by one skilled in the art that the mode of translational inhibition illustrated by FIG. 1 with specific reference to translational inhibition exerted by VGAM1167 gene, herein designated VGAM GENE, on one or more VGAM1167 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1167 is inhibition of expression of host target genes, as part of a novel viral mechanism of attacking a host. Accordingly, utilities of VGAM1167 include diagnosis, prevention and treatment of viral infection by Cucumber Green Mottle Mosaic Virus. Specific functions, and accordingly utilities, of VGAM1167 correlate with, and may be deduced from, the identity of the host target genes which VGAM1167 binds and inhibits, and the function of these host target genes, as elaborated hereinbelow.

Nucleotide sequences of the VGAM1167 precursor RNA, herein designated VGAM PRECURSOR RNA, and of the 'diced' VGAM1167 RNA, herein designated VGAM RNA, and a schematic representation of the secondary folding of VGAM1167 folded precursor RNA, herein designated VGAM FOLDED PRECURSOR RNA, of VGAM1167 are further described hereinbelow with reference to Table 1.

Nucleotide sequences of host target binding sites, such as BINDING SITE-I, BINDING SITE-II and BINDING SITE-III of FIG. 1, found on VGAM1167 host target RNA, and schematic representation of the complementarity of each of these host target binding sites to VGAM1167 RNA, herein designated VGAM RNA, are described hereinbelow with reference to Table 2.

As mentioned hereinabove with reference to FIG. 1, a function of VGAM1167 gene, herein designated VGAM is inhibition of expression of VGAM1167 target genes. It is appreciated that specific functions, and accordingly utilities, of VGAM1167 correlate with, and may be deduced from, the identity of the target genes which VGAM1167 binds and inhibits, and the function of these target genes, as elaborated hereinbelow.

Discs, Large (Drosophila) Homolog 5 (DLG5, Accession XM_096398) is a VGAM1167 host target gene. DLG5 BINDING SITE is HOST TARGET binding site found in the 3' untranslated region of mRNA encoded by DLG5, corresponding to a HOST TARGET binding site such as BINDING SITE I, BINDING SITE II or BINDING SITE III. Table 2 illustrates the complementarity of the nucleotide sequences of DLG5 BINDING SITE, designated SEQ ID:40337, to the nucleotide sequence of VGAM1167 RNA, herein designated VGAM RNA, also designated SEQ ID:3878.

A function of VGAM1167 is therefore inhibition of Discs, Large (Drosophila) Homolog 5 (DLG5, Accession XM_096398), a gene which may transmit extracellular signals to inhibit cell proliferation. Accordingly, utilities of VGAM1167 include diagnosis, prevention and treatment of diseases and clinical conditions associated with DLG5. The function of DLG5 and its association with various diseases and clinical conditions, has been established by previous studies, as described hereinabove with reference to VGAM444.5-hydroxytryptamine (serotonin) Receptor 4 (HTR4, Accession NM_000870) is another VGAM1167 host target gene. HTR4 BINDING SITE is HOST TARGET binding site found in the 3' untranslated region of mRNA encoded by HTR4, corresponding to a HOST TARGET binding site such as BINDING SITE I, BINDING SITE II or BINDING SITE III. Table 2 illustrates the complementarity of the nucleotide sequences of HTR4 BINDING SITE, designated SEQ ID:6539, to the nucleotide sequence of VGAM1167 RNA, herein designated VGAM RNA, also designated SEQ ID:3878.

Another function of VGAM1167 is therefore inhibition of 5-hydroxytryptamine (serotonin) Receptor 4 (HTR4, Accession NM_000870), a gene which mediates calcium channel currents. Accordingly, utilities of VGAM1167 include diagnosis, prevention and treatment of diseases and clinical conditions associated with HTR4. The function of HTR4 and its association with various diseases and clinical conditions, has been established by previous studies, as described hereinabove with reference to VGAM65. Growth Hormone Inducible Transmembrane Protein (GHITM, Accession NM_014394) is another VGAM1167 host target gene. GHITM BINDING SITE is HOST TARGET binding site found in the 3' untranslated region of mRNA encoded by GHITM, corresponding to a HOST TARGET binding site such as BINDING SITE I, BINDING SITE II or BINDING SITE III. Table 2 illustrates the complementarity of the nucleotide sequences of GHITM BINDING SITE, designated SEQ ID:15725, to the nucleotide sequence of VGAM1167 RNA, herein designated VGAM RNA, also designated SEQ ID:3878.

Another function of VGAM1167 is therefore inhibition of Growth Hormone Inducible Transmembrane Protein (GHITM, Accession NM_014394). Accordingly, utilities of VGAM1167 include diagnosis, prevention and treatment of diseases and clinical conditions associated with GHITM. Makorin, Ring Finger Protein, 2 (MKRN2, Accession XM_051580) is another VGAM1167 host target gene. MKRN2 BINDING SITE is HOST TARGET binding site found in the 3' untranslated region of mRNA encoded by MKRN2, corresponding to a HOST TARGET binding site such as BINDING SITE I, BINDING SITE II or BINDING SITE III. Table 2 illustrates the complementarity of the nucleotide sequences of MKRN2 BINDING SITE, designated SEQ ID:35857, to the nucleotide sequence of VGAM1167 RNA, herein designated VGAM RNA, also designated SEQ ID:3878.

Another function of VGAM1167 is therefore inhibition of Makorin, Ring Finger Protein, 2 (MKRN2, Accession XM_051580). Accordingly, utilities of VGAM1167 include diagnosis, prevention and treatment of diseases and clinical conditions associated with MKRN2. Neuropilin (NRP) and Tolloid (TLL)-like 2 (NETO2, Accession NM_018092) is another VGAM1167 host target gene. NETO2 BINDING SITE is HOST TARGET binding site found in the 3' untranslated region of mRNA encoded by NETO2, corresponding to a HOST TARGET binding site such as BINDING SITE I, BINDING SITE II or BINDING SITE III. Table 2 illustrates the complementarity of the nucleotide sequences of NETO2 BINDING SITE, designated SEQ ID:19860, to the nucleotide sequence of VGAM1167 RNA, herein designated VGAM RNA, also designated SEQ ID:3878.

Another function of VGAM1167 is therefore inhibition of Neuropilin (NRP) and Tolloid (TLL)-like 2 (NETO2, Accession NM_018092). Accordingly, utilities of VGAM1167 include diagnosis, prevention and treatment of diseases and clinical conditions associated with NETO2. FIG. 1 further provides a conceptual description of a novel bioinformatically detected viral gene of the present invention, referred to here as Viral Genomic Address Messenger 1168 (VGAM1168) viral gene, which modulates expression of respective host target genes thereof, the function and utility of which host target genes is known in the art.

VGAM1168 is a novel bioinformatically detected regulatory, non protein coding, viral micro RNA (miRNA) gene. The method by which VGAM1168 was detected is described hereinabove with reference to FIGS. 1-8.

VGAM1168 gene, herein designated VGAM GENE, is a viral gene contained in the genome of Rana Tigrina Ranavirus. VGAM1168 host target gene, herein designated VGAM HOST TARGET GENE, is a human gene contained in the human genome.

VGAM1168 gene encodes a VGAM1168 precursor RNA, herein designated VGAM PRECURSOR RNA. Similar to other miRNA genes, and unlike most ordinary genes, VGAM1168 precursor RNA does not encode a protein. A nucleotide sequence identical or highly similar to the nucleotide sequence of VGAM1168 precursor RNA is designated SEQ ID:1154, and is provided hereinbelow with reference to the sequence listing part. Nucleotide sequence SEQ ID:1154 is located at position 92139 relative to the genome of Rana Tigrina Ranavirus.

VGAM1168 precursor RNA folds onto itself, forming VGAM1168 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1168 folded precursor RNA into VGAM1168 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1168 RNA is designated SEQ ID:3879, and is provided hereinbelow with reference to the sequence listing part.

VGAM1168 host target gene, herein designated VGAM HOST TARGET GENE, encodes a corresponding messenger RNA, VGAM1168 host target RNA, herein designated VGAM HOST TARGET RNA. VGAM1168 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1168 RNA, herein designated VGAM RNA, binds complementarily to one or more host target binding sites located in untranslated regions of VGAM1168 host target RNA, herein designated VGAM HOST TARGET RNA. This complementary binding is due to the fact that the nucleotide sequence of VGAM1168 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1168 RNA, herein designated VGAM RNA, may have a different number of host target binding sites in untranslated regions of a VGAM1168 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1168 RNA, herein designated VGAM RNA, to host target binding sites on VGAM1168 host target RNA, herein designated VGAM HOST TARGET RNA, such as BINDING SITE I, BINDING SITE II and BINDING SITE III, inhibits translation of VGAM1168 host target RNA into VGAM1168 host target protein, herein designated VGAM HOST TARGET PROTEIN. VGAM host target protein is therefore outlined by a broken line.

It is appreciated that VGAM1168 host target gene, herein designated VGAM HOST TARGET GENE, in fact represents a plurality of VGAM1168 host target genes. The mRNA of each one of this plurality of VGAM1168 host target genes comprises one or more host target binding sites, each having a nucleotide sequence which is at least partly complementary to VGAM1168 RNA, herein designated VGAM RNA, and which when bound by VGAM1168 RNA causes inhibition of translation of respective one or more VGAM1168 host target proteins.

It is further appreciated by one skilled in the art that the mode of translational inhibition illustrated by FIG. 1 with specific reference to translational inhibition exerted by VGAM1168 gene, herein designated VGAM GENE, on one or more VGAM1168 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1168 is inhibition of expression of host target genes, as part of a novel viral mechanism of attacking a host. Accordingly, utilities of VGAM1168 include diagnosis, prevention and treatment of viral infection by Rana Tigrina Ranavirus. Specific functions, and accordingly utilities, of VGAM1168 correlate with, and may be deduced from, the identity of the host target genes which VGAM1168 binds and inhibits, and the function of these host target genes, as elaborated hereinbelow.

Nucleotide sequences of the VGAM1168 precursor RNA, herein designated VGAM PRECURSOR RNA, and of the 'diced' VGAM1168 RNA, herein designated VGAM RNA, and a schematic representation of the secondary folding of VGAM1168 folded precursor RNA, herein designated VGAM FOLDED PRECURSOR RNA, of VGAM1168 are further described hereinbelow with reference to Table 1.

Nucleotide sequences of host target binding sites, such as BINDING SITE-I, BINDING SITE-II and BINDING SITE-III of FIG. 1, found on VGAM1168 host target RNA, and schematic representation of the complementarity of each of these host target binding sites to VGAM1168 RNA, herein designated VGAM RNA, are described hereinbelow with reference to Table 2.

As mentioned hereinabove with reference to FIG. 1, a function of VGAM1168 gene, herein designated VGAM is inhibition of expression of VGAM1168 target genes. It is appreciated that specific functions, and accordingly utilities, of VGAM1168 correlate with, and may be deduced from, the identity of the target genes which VGAM1168 binds and inhibits, and the function of these target genes, as elaborated hereinbelow.

Interleukin 2 Receptor, Alpha (IL2RA, Accession NM_000417) is a VGAM1168 host target gene. IL2RA BINDING SITE is HOST TARGET binding site found in the 3' untranslated region of mRNA encoded by IL2RA, corresponding to a HOST TARGET binding site such as BINDING SITE I, BINDING SITE II or BINDING SITE III. Table 2 illustrates the complementarity of the nucleotide sequences of IL2RA BINDING SITE, designated SEQ ID:5998, to the nucleotide sequence of VGAM1168 RNA, herein designated VGAM RNA, also designated SEQ ID:3879.

A function of VGAM1168 is therefore inhibition of Interleukin 2 Receptor, Alpha (IL2RA, Accession NM_000417), a gene which plays a role in T cell mediated immune response. Accordingly, utilities of VGAM1168 include diagnosis, prevention and treatment of diseases and clinical conditions associated with IL2RA. The function of IL2RA has been established by previous studies. The action of the T-cell growth factor interleukin-2 (IL2; 147680) requires the presence of a cell surface receptor. As most peripheral as well as thymic T cells do not carry the receptor in vivo, the regulated expression of IL2R appears to be a safeguard against a catastrophic spread of T-cell proliferation by an immunogenic stimulus. The receptor is a heterodimer, consisting of 1 alpha and 1 beta chain; the beta chain (OMIM Ref. No. 146710) was not characterized until 1989. The receptor molecule, a glycoprotein, has a relative mass of about 55,000. Its intracellular precursor is smaller. Leonard et al. (1983) used a monoclonal antibody for T-cell growth factor to characterize the receptor. Yang et al. (2001) analyzed T-cell subsets and levels of cytokine IL2 and soluble IL2 receptor in the peripheral blood of patients with normal pressure glaucoma (NPG; 606657) and primary open angle glaucoma (POAG; 137760) and compared them to values in age-matched controls. They found an increased frequency of CD8+/HLA-DR+ lymphocytes in patients with NPG and increased CD3+/CD8+ lymphocytes in both NPG and POAG patients. CD5+ lymphocytes were higher only in POAG patients. The mean concentration of soluble IL2R was higher in NPG and POAG patients than in controls although the IL2 concentration was similar in patients and controls. The authors concluded that the immune system might play an important role in initiation or progression of glaucomatous optic neuropathy in some patients.

Full details of the abovementioned studies are described in the following publications, the disclosure of which are hereby incorporated by reference:

Leonard, W. J.; Donlon, T. A.; Lebo, R. V.; Greene, W. C.: Localization of the gene encoding the human interleukin-2 receptor on chromosome 10. Science 228:1547-1549, 1985; and Yang, J.; Patil, R. V.; Yu, H.; Gordon, M.; Wax, M. B.: T cell subsets and sIL-2R/IL-2 levels in patients with glaucoma. Am. J. Ophthal. 131:421-426, 2001.

Further studies establishing the function and utilities of IL2RA are found in John Hopkins OMIM database record ID 147730, and in sited publications numbered 11193-11201, 12009, 11264-11265, 680, 11266-1127 and 681 listed in the bibliography section hereinbelow, which are also hereby incorporated by reference. Spondin 1, (f-spondin) Extracellular Matrix Protein (SPON1, Accession XM_031184) is another VGAM1168 host target gene. SPON1 BINDING SITE is HOST TARGET binding site found in the 3' untranslated region of mRNA encoded by SPON1, corresponding to a HOST TARGET binding site such as BINDING SITE I, BINDING SITE II or BINDING SITE III. Table 2 illustrates the complementarity of the nucleotide sequences of SPON1 BINDING SITE, designated SEQ ID:31304, to the nucleotide sequence of VGAM1168 RNA, herein designated VGAM RNA, also designated SEQ ID:3879.

Another function of VGAM1168 is therefore inhibition of Spondin 1, (f-spondin) Extracellular Matrix Protein (SPON1, Accession XM_031184). Accordingly, utilities of VGAM1168 include diagnosis, prevention and treatment of diseases and clinical conditions associated with SPON1. Tripartite Motif-containing 34 (TRIM34, Accession NM_021616) is another VGAM1168 host target gene. TRIM34 BINDING SITE1 and TRIM34 BINDING SITE2 are HOST TARGET binding sites found in untranslated regions of mRNA encoded by TRIM34, corresponding to HOST TARGET binding sites such as BINDING SITE I, BINDING SITE II or BINDING SITE III. Table 2 illustrates the complementarity of the nucleotide sequences of TRIM34 BINDING SITE1 and TRIM34 BINDING SITE2, designated SEQ ID:22252 and SEQ ID:28176 respectively, to the nucleotide sequence of VGAM1168 RNA, herein designated VGAM RNA, also designated SEQ ID:3879.

Another function of VGAM1168 is therefore inhibition of Tripartite Motif-containing 34 (TRIM34, Accession NM_021616). Accordingly, utilities of VGAM1168 include diagnosis, prevention and treatment of diseases and clinical conditions associated with TRIM34. Solute Carrier Family 5 (choline transporter), Member 7 (SLC5A7, Accession NM_021815) is another VGAM1168 host target gene. SLC5A7 BINDING SITE is HOST TARGET binding site found in the 3' untranslated region of mRNA encoded by SLC5A7, corresponding to a HOST TARGET binding site such as BINDING SITE I, BINDING SITE II or BINDING SITE III. Table 2 illustrates the complementarity of the nucleotide sequences of SLC5A7 BINDING SITE, designated SEQ ID:22386, to the nucleotide sequence of VGAM1168 RNA, herein designated VGAM RNA, also designated SEQ ID:3879.

Another function of VGAM1168 is therefore inhibition of Solute Carrier Family 5 (choline transporter), Member 7 (SLC5A7, Accession NM_021815). Accordingly, utilities of VGAM1168 include diagnosis, prevention and treatment of diseases and clinical conditions associated with SLC5A7. LOC56959 (Accession XM_088578) is another VGAM1168 host target gene. LOC56959 BINDING SITE is HOST TARGET binding site found in the 5' untranslated region of mRNA encoded by LOC56959, corresponding to a HOST TARGET binding site such as BINDING SITE I, BINDING SITE II or BINDING SITE III. Table 2 illustrates the complementarity of the nucleotide sequences of LOC56959 BINDING SITE, designated SEQ ID:39840, to the nucleotide sequence of VGAM1168 RNA, herein designated VGAM RNA, also designated SEQ ID:3879.

Another function of VGAM1168 is therefore inhibition of LOC56959 (Accession XM_088578). Accordingly, utilities of VGAM1168 include diagnosis, prevention and treatment of diseases and clinical conditions associated with LOC56959. FIG. 1 further provides a conceptual description of a novel bioinformatically detected viral gene of the present invention, referred to here as Viral Genomic Address Messenger 1169 (VGAM1169) viral gene, which modulates expression of respective host target genes thereof, the function and utility of which host target genes is known in the art.

VGAM1169 is a novel bioinformatically detected regulatory, non protein coding, viral micro RNA (miRNA) gene. The method by which VGAM1169 was detected is described hereinabove with reference to FIGS. 1-8.

VGAM1169 gene, herein designated VGAM GENE, is a viral gene contained in the genome of Rana Tigrina Ranavirus. VGAM1169 host target gene, herein designated VGAM HOST TARGET GENE, is a human gene contained in the human genome.

VGAM1169 gene encodes a VGAM1169 precursor RNA, herein designated VGAM PRECURSOR RNA. Similar to other miRNA genes, and unlike most ordinary genes, VGAM1169 precursor RNA does not encode a protein. A nucleotide sequence identical or highly similar to the nucleotide sequence of VGAM1169 precursor RNA is designated SEQ ID:1155, and is provided hereinbelow with reference to the sequence listing part. Nucleotide sequence SEQ ID:1155 is located at position 92520 relative to the genome of Rana Tigrina Ranavirus.

VGAM1169 precursor RNA folds onto itself, forming VGAM1169 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1169 folded precursor RNA into VGAM1169 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM1169 RNA is designated SEQ ID:3880, and is provided hereinbelow with reference to the sequence listing part.

VGAM1169 host target gene, herein designated VGAM HOST TARGET GENE, encodes a corresponding messenger RNA, VGAM1169 host target RNA, herein designated VGAM HOST TARGET RNA. VGAM1169 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1169 RNA, herein designated VGAM RNA, binds complementarily to one or more host target binding sites located in untranslated regions of VGAM1169 host target RNA, herein designated VGAM HOST TARGET RNA. This complementary binding is due to the fact that the nucleotide sequence of VGAM1169 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1169 RNA, herein designated VGAM RNA, may have a different number of host target binding sites in untranslated regions of a VGAM1169 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1169 RNA, herein designated VGAM RNA, to host target binding sites on VGAM1169 host target RNA, herein designated VGAM HOST TARGET RNA, such as BINDING SITE I, BINDING SITE II and BINDING SITE III, inhibits translation of VGAM1169 host target RNA into VGAM1169 host target protein, herein designated VGAM HOST TARGET PROTEIN. VGAM host target protein is therefore outlined by a broken line.

It is appreciated that VGAM1169 host target gene, herein designated VGAM HOST TARGET GENE, in fact represents a plurality of VGAM1169 host target genes. The mRNA of each one of this plurality of VGAM1169 host target genes comprises one or more host target binding sites, each having a nucleotide sequence which is at least partly complementary to VGAM1169 RNA, herein designated VGAM RNA, and which when bound by VGAM1169 RNA causes inhibition of translation of respective one or more VGAM1169 host target proteins.

It is further appreciated by one skilled in the art that the mode of translational inhibition illustrated by FIG. 1 with specific reference to translational inhibition exerted by VGAM1169 gene, herein designated VGAM GENE, on one or more VGAM1169 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1169 is inhibition of expression of host target genes, as part of a novel viral mechanism of attacking a host. Accordingly, utilities of VGAM1169 include diagnosis, prevention and treatment of viral infection by Rana Tigrina Ranavirus. Specific functions, and accordingly utilities, of VGAM1169 correlate with, and may be deduced from, the identity of the host target genes which VGAM1169 binds and inhibits, and the function of these host target genes, as elaborated hereinbelow.

Nucleotide sequences of the VGAM1169 precursor RNA, herein designated VGAM PRECURSOR RNA, and of the 'diced' VGAM1169 RNA, herein designated VGAM RNA, and a schematic representation of the secondary folding of VGAM1169 folded precursor RNA, herein designated VGAM FOLDED PRECURSOR RNA, of VGAM1169 are further described hereinbelow with reference to Table 1.

Nucleotide sequences of host target binding sites, such as BINDING SITE-I, BINDING SITE-II and BINDING SITE-III of FIG. 1, found on VGAM1169 host target RNA, and schematic representation of the complementarity of each of these host target binding sites to VGAM1169 RNA, herein designated VGAM RNA, are described hereinbelow with reference to Table 2.

As mentioned hereinabove with reference to FIG. 1, a function of VGAM1169 gene, herein designated VGAM is inhibition of expression of VGAM1169 target genes. It is appreciated that specific functions, and accordingly utilities, of VGAM1169 correlate with, and may be deduced from, the identity of the target genes which VGAM1169 binds and inhibits, and the function of these target genes, as elaborated hereinbelow.

ACK1 (Accession NM_005781) is a VGAM1169 host target gene. ACK1 BINDING SITE is HOST TARGET binding site found in the 5' untranslated region of mRNA encoded by ACK1, corresponding to a HOST TARGET binding site such as BINDING SITE I, BINDING SITE II or BINDING SITE III. Table 2 illustrates the complementarity of the nucleotide sequences of ACK1 BINDING SITE, designated SEQ ID:12361, to the nucleotide sequence of VGAM1169 RNA, herein designated VGAM RNA, also designated SEQ ID:3880.

A function of VGAM1169 is therefore inhibition of ACK1 (Accession NM_005781). Accordingly, utilities of VGAM1169 include diagnosis, prevention and treatment of diseases and clinical conditions associated with ACK1. A Disintegrin-like and Metalloprotease (reprolysin type) with Thrombospondin Type 1 Motif, 13 (ADAMTS13, Accession NM_139028) is another VGAM1169 host target gene. ADAMTS13 BINDING SITE is HOST TARGET binding site found in the 3' untranslated region of mRNA encoded by ADAMTS13, corresponding to a HOST TARGET binding site such as BINDING SITE I, BINDING SITE II or BINDING SITE III. Table 2 illustrates the complementarity of the nucleotide sequences of ADAMTS13 BINDING SITE, designated SEQ ID:29130, to the nucleotide sequence of VGAM1169 RNA, herein designated VGAM RNA, also designated SEQ ID:3880.

Another function of VGAM1169 is therefore inhibition of A Disintegrin-like and Metalloprotease (reprolysin type) with Thrombospondin Type 1 Motif, 13 (ADAMTS13, Accession NM_139028), a gene which cleaves aggrecan, a cartilage proteoglycan, and may be involved in its turnover. Accordingly, utilities of VGAM1169 include diagnosis, prevention and treatment of diseases and clinical conditions associated with ADAMTS13. The function of ADAMTS13 and its association with various diseases and clinical conditions, has been established by previous studies, as described hereinabove with reference to VGAM131. Adenylate Cyclase 8 (brain) (ADCY8, Accession NM_001115) is another VGAM1169 host target gene. ADCY8 BINDING SITE is HOST TARGET binding site found in the 5' untranslated region of mRNA encoded by ADCY8, corresponding to a HOST TARGET binding site such as BINDING SITE I, BINDING SITE II or BINDING SITE III. Table 2 illustrates the complementarity of the nucleotide sequences of ADCY8 BINDING SITE, designated SEQ ID:6789, to the nucleotide sequence of VGAM1169 RNA, herein designated VGAM RNA, also designated SEQ ID:3880.

Another function of VGAM1169 is therefore inhibition of Adenylate Cyclase 8 (brain) (ADCY8, Accession NM_001115), a gene which this a membrane-bound, ca(2+)-inhibitable adenylyl cyclase. Accordingly, utilities of VGAM1169 include diagnosis, prevention and treatment of diseases and clinical conditions associated with ADCY8. The function of ADCY8 has been established by previous studies. Adenylyl cyclase (EC 4.6.1.1) catalyzes the transformation of ATP into cyclic AMP. The enzymatic activity is under the control of several hormones, and different polypeptides participate in the transduction of the signal from the receptor to the catalytic moiety. Stimulatory or inhibitory receptors (Rs and Ri) interact with G proteins (Gs and Gi) that exhibit GTPase activity and they modulate the activity of the catalytic subunit of the adenylyl cyclase. Parma et al. (1991) cloned a cDNA corresponding to human brain adenylyl cyclase, symbolized by them as HBAC1. By in situ hybridization to metaphase chromosomal spreads using the human brain cDNA probe, Stengel et al. (1992) showed that the gene is located on 8q24.2. A highly homologous gene, ADCY2 (OMIM Ref. No. 103071), was assigned to 5p15.3 by the same method.

Full details of the abovementioned studies are described in the following publications, the disclosure of which are hereby incorporated by reference:

Parma, J.; Stengel, D.; Gannage, M.-H.; Poyard, M.; Barouki, R.; Hanoune, J.: Sequence of a human brain adenylyl cyclase partial cDNA: evidence for a consensus cyclase domain. Biochem. Biophys. Res. Commun. 179:455-462, 1991; and Stengel, D.; Parma, J.; Gannage, M.-H.; Roeckel, N.; Mattei, M.-G.; Barouki, R.; Hanoune, J.: Different chromosomal localization of two adenylyl cyclase genes expressed in human brain.

Further studies establishing the function and utilities of ADCY8 are found in John Hopkins OMIM database record ID 103070, and in sited publications numbered 492-493 listed in the bibliography section hereinbelow, which are also hereby incorporated by reference. Cell Division Cycle 2-like 2 (CDC2L2, Accession NM_033532) is another VGAM1169 host target gene. CDC2L2 BINDING SITE is HOST TARGET binding site found in the 5' untranslated region of mRNA encoded by CDC2L2, corresponding to a HOST TARGET binding site such as BINDING SITE I, BINDING SITE II or BINDING SITE III. Table 2 illustrates the complementarity of the nucleotide sequences of CDC2L2 BINDING SITE, designated SEQ ID:27300, to the nucleotide sequence of VGAM1169 RNA, herein designated VGAM RNA, also designated SEQ ID:3880.

Another function of VGAM1169 is therefore inhibition of Cell Division Cycle 2-like 2 (CDC2L2, Accession NM_033532). Accordingly, utilities of VGAM1169 include diagnosis, prevention and treatment of diseases and clinical conditions associated with CDC2L2. Cysteine Knot Superfamily 1, BMP Antagonist 1 (CKTSF1B1, Accession NM_013372) is another VGAM1169 host target gene. CKTSF1B1 BINDING SITE is HOST TARGET binding site found in the 3' untranslated region of mRNA encoded by CKTSF1B1, corresponding to a HOST TARGET binding site such as BINDING SITE I, BINDING SITE II or BINDING SITE III. Table 2 illustrates the complementarity of the nucleotide sequences of CKTSF1B1 BINDING SITE, designated SEQ ID:15025, to the nucleotide sequence of VGAM1169 RNA, herein designated VGAM RNA, also designated SEQ ID:3880.

Another function of VGAM1169 is therefore inhibition of Cysteine Knot Superfamily 1, BMP Antagonist 1

(CKTSF1B1, Accession NM_013372), a gene which blocks signaling of bone morphogenetic protein (BMP). Accordingly, utilities of VGAM1169 include diagnosis, prevention and treatment of diseases and clinical conditions associated with CKTSF1B1. The function of CKTSF1B1 and its association with various diseases and clinical conditions, has been established by previous studies, as described hereinabove with reference to VGAM28. CAMP Responsive Element Binding Protein 1 (CREB1, Accession NM_004379) is another VGAM1169 host target gene. CREB1 BINDING SITE is HOST TARGET binding site found in the 3' untranslated region of mRNA encoded by CREB1, corresponding to a HOST TARGET binding site such as BINDING SITE I, BINDING SITE II or BINDING SITE III. Table 2 illustrates the complementarity of the nucleotide sequences of CREB1 BINDING SITE, designated SEQ ID:10601, to the nucleotide sequence of VGAM1169 RNA, herein designated VGAM RNA, also designated SEQ ID:3880.

Another function of VGAM1169 is therefore inhibition of CAMP Responsive Element Binding Protein 1 (CREB1, Accession NM_004379), a gene which regulates expression of cAMP-inducible genes. Accordingly, utilities of VGAM1169 include diagnosis, prevention and treatment of diseases and clinical conditions associated with CREB1. The function of CREB1 and its association with various diseases and clinical conditions, has been established by previous studies, as described hereinabove with reference to VGAM497. D Site of Albumin Promoter (albumin D-box) Binding Protein (DBP, Accession NM_001352) is another VGAM1169 host target gene. DBP BINDING SITE is HOST TARGET binding site found in the 5' untranslated region of mRNA encoded by DBP, corresponding to a HOST TARGET binding site such as BINDING SITE I, BINDING SITE II or BINDING SITE III. Table 2 illustrates the complementarity of the nucleotide sequences of DBP BINDING SITE, designated SEQ ID:7031, to the nucleotide sequence of VGAM1169 RNA, herein designated VGAM RNA, also designated SEQ ID:3880.

Another function of VGAM1169 is therefore inhibition of D Site of Albumin Promoter (albumin D-box) Binding Protein (DBP, Accession NM_001352), a gene which generates macrophage-activating factor and enhances ingestion activity of macrophages. Accordingly, utilities of VGAM1169 include diagnosis, prevention and treatment of diseases and clinical conditions associated with DBP. The function of DBP has been established by previous studies. Yamamoto and Homma (1991) presented evidence from studies in mice that vitamin D-3 binding protein is a precursor for the macrophage-activating factor, that it is converted by the membrane glycosidases of B and T cells to the macrophage-activating factor, and that enzymatic conversion of Gc protein to the macrophage-activating factor can occur in vitro. In vitro treatment of mouse peritoneal adherent cells (macrophages) alone with lysophosphatidylcholine or dodecylglycerol results in no enhanced ingestion activity of macrophages. However, incubation of peritoneal cells with these agents in serum-supplemented medium results in greatly enhanced phagocytic activity. Gc is the serum factor responsible for this. The role of Gc in this function suggests possible mechanisms for maintenance of the Gc polymorphism. Along with gelsolin (OMIM Ref. No. 137350), the Gc protein binds actin, which is released into the circulation with cell necrosis. This is the so-called extracellular actin-scavenger system which prevents toxic effects of actin. By immunoelectrophoresis, Hirschfeld (1959) discovered polymorphism of the serum alpha-2-globulin called Gc for group-specific component. Gc1-1, Gc2-2, and Gc2-1 phenotypes can be distinguished also by starch or agar electrophoresis (Bearn et al., 1964). In the same year that Gc proteins were reported, another human plasma protein, vitamin D-binding alpha-globulin (VDBG), was described. Daiger et al. (1975) demonstrated that Gc and VDBG are identical. The worldwide polymorphism of Gc is now not surprising. Mourant et al. (1976) concluded that high frequency of the Gc (2) allele corresponds, with some exceptions, to low levels of sunlight. Within Ireland, the correlation did not hold. By a novel method of labeling Gc protein with radioactive vitamin D, followed with electrophoresis and autoradiography, Daiger and Cavalli-Sforza (1977) detected new Gc variants. The gene frequency of some of the variants was as high as 15%. They were testing a physiologically relevant property of the Gc protein. In Iceland, Karlsson et al. (1980) used immunofixation electrophoresis for Gc typing according to the method of Johnson et al. (1975). They found a new variant first thought to be identical to Gc Norway but later shown to be distinct.

Full details of the abovementioned studies are described in the following publications, the disclosure of which are hereby incorporated by reference:

Kofler, A.; Braun, A.; Jenkins, T.; Serjeantson, S. W.; Cleve, H.: Characterization of mutants of the vitamin-D-binding protein/group specific component: GC Aborigine (1A1) from Australian Aborigines and South African blacks, and 2A9 from South Germany. Vox Sang. 68:50-54, 1995; and Yamamoto, N.; Homma, S.: Vitamin D-3 binding protein (group-specific component) is a precursor for the macrophage-activating signal factor from lysophosphatidylcholine-treated lymphocy.

Further studies establishing the function and utilities of DBP are found in John Hopkins OMIM database record ID 139200, and in sited publications numbered 1563-1564, 3785-1567, 3063-3087, 3652-3094, 3362, 378 and 3363-3379 listed in the bibliography section hereinbelow, which are also hereby incorporated by reference. Deleted In Lung and Esophageal Cancer 1 (DLEC1, Accession NM_007336) is another VGAM1169 host target gene. DLEC1 BINDING SITE1 and DLEC1 BINDING SITE2 are HOST TARGET binding sites found in untranslated regions of mRNA encoded by DLEC1, corresponding to HOST TARGET binding sites such as BINDING SITE I, BINDING SITE II or BINDING SITE III. Table 2 illustrates the complementarity of the nucleotide sequences of DLEC1 BINDING SITE1 and DLEC1 BINDING SITE2, designated SEQ ID:14266 and SEQ ID:14273 respectively, to the nucleotide sequence of VGAM1169 RNA, herein designated VGAM RNA, also designated SEQ ID:3880.

Another function of VGAM1169 is therefore inhibition of Deleted In Lung and Esophageal Cancer 1 (DLEC1, Accession NM_007336). Accordingly, utilities of VGAM1169 include diagnosis, prevention and treatment of diseases and clinical conditions associated with DLEC1. Dishevelled, Dsh Homolog 1 (Drosophila) (DVL1, Accession XM_001589) is another VGAM1169 host target gene. DVL1 BINDING SITE is HOST TARGET binding site found in the 3' untranslated region of mRNA encoded by DVL1, corresponding to a HOST TARGET binding site such as BINDING SITE I, BINDING SITE II or BINDING SITE III. Table 2 illustrates the complementarity of the nucleotide sequences of DVL1 BINDING SITE, designated SEQ ID:29844, to the nucleotide sequence of VGAM1169 RNA, herein designated VGAM RNA, also designated SEQ ID:3880.

Another function of VGAM1169 is therefore inhibition of Dishevelled, Dsh Homolog 1 (Drosophila) (DVL1, Accession XM_001589), a gene which may play a role in the signal transduction pathway. Accordingly, utilities of VGAM1169 include diagnosis, prevention and treatment of diseases and clinical conditions associated with DVL1. The function of DVL1 and its association with various diseases and clinical conditions, has been established by previous studies, as described hereinabove with reference to VGAM232. Frizzled-related Protein (FRZB, Accession NM_001463) is another VGAM1169 host target gene. FRZB BINDING SITE is HOST TARGET binding site found in the 5' untranslated region of mRNA encoded by FRZB, corresponding to a HOST TARGET binding site such as BINDING SITE I, BINDING SITE II or BINDING SITE III. Table 2 illustrates the complementarity of the nucleotide sequences of FRZB BINDING SITE, designated SEQ ID:7198, to the nucleotide sequence of VGAM1169 RNA, herein designated VGAM RNA, also designated SEQ ID:3880.

Another function of VGAM1169 is therefore inhibition of Frizzled-related Protein (FRZB, Accession NM_001463), a gene which may be involved in morphogenesis of skeleton. Accordingly, utilities of VGAM1169 include diagnosis, prevention and treatment of diseases and clinical conditions associated with FRZB. The function of FRZB has been established by previous studies. Transplantation experiments by Spemann and Mangold (1924) established the presence of an anatomically discrete region, the Spemann organizer, or dorsal lip, that controls patterning of the developing body axis in vertebrate embryos. Diffusible factors emanating from this region, such as 'goosecoid' (GSC; 138890) and 'noggin' (NOG; 602991), regulate skeletal morphogenesis. Drosophila cuticle hairs are arranged in a defined polarity that is genetically controlled by 'frizzled' (see OMIM Ref. No. FZD1; 603408), a 7-transmembrane receptor with a large extracellular cysteine-rich domain (CRD).

Full details of the abovementioned studies are described in the following publications, the disclosure of which are hereby incorporated by reference:

Leyns, L.; Bouwmeester, T.; Kim, S.-H.; Piccolo, S.; De Robertis, E. M.: Frzb-1 is a secreted antagonist of Wnt signaling expressed in the Spemann organizer. Cell 88:747-756, 1997; and Spemann, H.; Mangold, H.: Ueber induktion von embryonalanlagen durch implantation artfremder organisatoren. Arch. Mikroskopische Anat. Entwicklungsmechanik 100: 599-638, 1924.

Further studies establishing the function and utilities of FRZB are found in John Hopkins OMIM database record ID 605083, and in sited publications numbered 6601-6603, 42 and 6604 listed in the bibliography section hereinbelow, which are also hereby incorporated by reference. Frizzled Homolog 8 (Drosophila) (FZD8, Accession NM_031866) is another VGAM1169 host target gene. FZD8 BINDING SITE is HOST TARGET binding site found in the 3' untranslated region of mRNA encoded by FZD8, corresponding to a HOST TARGET binding site such as BINDING SITE I, BINDING SITE II or BINDING SITE III. Table 2 illustrates the complementarity of the nucleotide sequences of FZD8 BINDING SITE, designated SEQ ID:25625, to the nucleotide sequence of VGAM1169 RNA, herein designated VGAM RNA, also designated SEQ ID:3880.

Another function of VGAM1169 is therefore inhibition of Frizzled Homolog 8 (Drosophila) (FZD8, Accession NM_031866), a gene which may be involved in transduction and intercellular transmission of polarity information during tissue morphogenesis and/or in differentiated tissues. Accordingly, utilities of VGAM1169 include diagnosis, prevention and treatment of diseases and clinical conditions associated with FZD8. The function of FZD8 and its association with various diseases and clinical conditions, has been established by previous studies, as described hereinabove with reference to VGAM503. Growth Arrest-specific 7 (GAS7, Accession NM_003644) is another VGAM1169 host target gene. GAS7 BINDING SITE is HOST TARGET binding site found in the 3' untranslated region of mRNA encoded by GAS7, corresponding to a HOST TARGET binding site such as BINDING SITE I, BINDING SITE II or BINDING SITE III. Table 2 illustrates the complementarity of the nucleotide sequences of GAS7 BINDING SITE, designated SEQ ID:9717, to the nucleotide sequence of VGAM1169 RNA, herein designated VGAM RNA, also designated SEQ ID:3880.

Another function of VGAM1169 is therefore inhibition of Growth Arrest-specific 7 (GAS7, Accession NM_003644), a gene which may play a role in promoting maturation and morphological differentiation of cerebellar neurons. Accordingly, utilities of VGAM1169 include diagnosis, prevention and treatment of diseases and clinical conditions associated with GAS7. The function of GAS7 and its association with various diseases and clinical conditions, has been established by previous studies, as described hereinabove with reference to VGAM232. Gap Junction Protein, Beta 3, 31 kDa (connexin 31) (GJB3, Accession NM_024009) is another VGAM1169 host target gene. GJB3 BINDING SITE is HOST TARGET binding site found in the 3' untranslated region of mRNA encoded by GJB3, corresponding to a HOST TARGET binding site such as BINDING SITE I, BINDING SITE II or BINDING SITE III. Table 2 illustrates the complementarity of the nucleotide sequences of GJB3 BINDING SITE, designated SEQ ID:23440, to the nucleotide sequence of VGAM1169 RNA, herein designated VGAM RNA, also designated SEQ ID:3880.

Another function of VGAM1169 is therefore inhibition of Gap Junction Protein, Beta 3, 31 kDa (connexin 31) (GJB3, Accession NM_024009). Accordingly, utilities of VGAM1169 include diagnosis, prevention and treatment of diseases and clinical conditions associated with GJB3. Golgi Reassembly Stacking Protein 1, 65 kDa (GORASP1, Accession NM_031899) is another VGAM1169 host target gene. GORASP1 BINDING SITE is HOST TARGET binding site found in the 3' untranslated region of mRNA encoded by GORASP1, corresponding to a HOST TARGET binding site such as BINDING SITE I, BINDING SITE II or BINDING SITE III. Table 2 illustrates the complementarity of the nucleotide sequences of GORASP1 BINDING SITE, designated SEQ ID:25647, to the nucleotide sequence of VGAM1169 RNA, herein designated VGAM RNA, also designated SEQ ID:3880.

Another function of VGAM1169 is therefore inhibition of Golgi Reassembly Stacking Protein 1, 65 kDa (GORASP1, Accession NM_031899), a gene which has some funtion with the Golgi apparatus. Accordingly, utilities of VGAM1169 include diagnosis, prevention and treatment of diseases and clinical conditions associated with GORASP1. The function of GORASP1 and its association with various diseases and clinical conditions, has been established by previous studies, as described hereinabove with reference to VGAM630. Leucine Zipper Protein 1 (LUZP1, Accession NM_033631) is another VGAM1169 host target gene. LUZP1 BINDING SITE is HOST TARGET binding site found in the 5' untranslated region of mRNA encoded by LUZP1, corresponding to a HOST TARGET binding site such as BINDING SITE I, BINDING SITE II or BINDING SITE III. Table 2 illustrates the complementarity of the nucleotide sequences of LUZP1 BINDING SITE, designated SEQ ID:27350, to the nucleotide sequence of VGAM1169 RNA, herein designated VGAM RNA, also designated SEQ ID:3880.

Another function of VGAM1169 is therefore inhibition of Leucine Zipper Protein 1 (LUZP1, Accession NM_033631). Accordingly, utilities of VGAM1169 include diagnosis, prevention and treatment of diseases and clinical conditions associated with LUZP1. Matrix Metalloproteinase 8 (neutrophil collagenase) (MMP8, Accession NM_002424) is another VGAM1169 host target gene. MMP8 BINDING SITE is HOST TARGET binding site found in the 3' untranslated region of mRNA encoded by MMP8, corresponding to a HOST TARGET binding site such as BINDING SITE I, BINDING SITE II or BINDING SITE III. Table 2 illustrates the complementarity of the nucleotide sequences of MMP8 BINDING SITE, designated SEQ ID:8259, to the nucleotide sequence of VGAM1169 RNA, herein designated VGAM RNA, also designated SEQ ID:3880.

Another function of VGAM1169 is therefore inhibition of Matrix Metalloproteinase 8 (neutrophil collagenase) (MMP8, Accession NM_002424). Accordingly, utilities of VGAM1169 include diagnosis, prevention and treatment of diseases and clinical conditions associated with MMP8. Myelin Protein Zero (Charcot-Marie-Tooth neuropathy 1B) (MPZ, Accession NM_000530) is another VGAM1169 host target gene. MPZ BINDING SITE is HOST TARGET binding site found in the 3' untranslated region of mRNA encoded by MPZ, corresponding to a HOST TARGET binding site such as BINDING SITE I, BINDING SITE II or BINDING SITE III. Table 2 illustrates the complementarity of the nucleotide sequences of MPZ BINDING SITE, designated SEQ ID:6131, to the nucleotide sequence of VGAM1169 RNA, herein designated VGAM RNA, also designated SEQ ID:3880.

Another function of VGAM1169 is therefore inhibition of Myelin Protein Zero (Charcot-Marie-Tooth neuropathy 1B) (MPZ, Accession NM_000530). Accordingly, utilities of VGAM1169 include diagnosis, prevention and treatment of diseases and clinical conditions associated with MPZ. Procollagen-proline, 2-oxoglutarate 4-dioxygenase (proline 4-hydroxylase), Beta Polypeptide (protein disulfide isomerase; thyroid hormone binding protein p55) (P4HB, Accession NM_000918) is another VGAM1169 host target gene. P4HB BINDING SITE is HOST TARGET binding site found in the 3' untranslated region of mRNA encoded by P4HB, corresponding to a HOST TARGET binding site such as BINDING SITE I, BINDING SITE II or BINDING SITE III. Table 2 illustrates the complementarity of the nucleotide sequences of P4HB BINDING SITE, designated SEQ ID:6629, to the nucleotide sequence of VGAM1169 RNA, herein designated VGAM RNA, also designated SEQ ID:3880.

Another function of VGAM1169 is therefore inhibition of Procollagen-proline, 2-oxoglutarate 4-dioxygenase (proline 4-hydroxylase), Beta Polypeptide (protein disulfide isomerase; thyroid hormone binding protein p55) (P4HB, Accession NM_000918), a gene which catalyzes formation of 4-hydroxyproline in collagens. Accordingly, utilities of VGAM1169 include diagnosis, prevention and treatment of diseases and clinical conditions associated with P4HB. The function of P4HB and its association with various diseases and clinical conditions, has been established by previous studies, as described hereinabove with reference to VGAM589. RAD54B (Accession NM_134434) is another VGAM1169 host target gene. RAD54B BINDING SITE is HOST TARGET binding site found in the 3' untranslated region of mRNA encoded by RAD54B, corresponding to a HOST TARGET binding site such as BINDING SITE I, BINDING SITE II or BINDING SITE III. Table 2 illustrates the complementarity of the nucleotide sequences of RAD54B BINDING SITE, designated SEQ ID:28677, to the nucleotide sequence of VGAM1169 RNA, herein designated VGAM RNA, also designated SEQ ID:3880.

Another function of VGAM1169 is therefore inhibition of RAD54B (Accession NM_134434), a gene which is involved in dna repair and mitotic recombination. Accordingly, utilities of VGAM1169 include diagnosis, prevention and treatment of diseases and clinical conditions associated with RAD54B. The function of RAD54B and its association with various diseases and clinical conditions, has been established by previous studies, as described hereinabove with reference to VGAM595. RB1-inducible Coiled-coil 1 (RB1CC1, Accession NM_014781) is another VGAM1169 host target gene. RB1CC1 BINDING SITE is HOST TARGET binding site found in the 5' untranslated region of mRNA encoded by RB1CC1, corresponding to a HOST TARGET binding site such as BINDING SITE I, BINDING SITE II or BINDING SITE III. Table 2 illustrates the complementarity of the nucleotide sequences of RB1CC1 BINDING SITE, designated SEQ ID:16631, to the nucleotide sequence of VGAM1169 RNA, herein designated VGAM RNA, also designated SEQ ID:3880.

Another function of VGAM1169 is therefore inhibition of RB1-inducible Coiled-coil 1 (RB1CC1, Accession NM_014781), a gene which is likely to participate in nuclear architecture by connecting chromatin with the nuclear matrix or envelope. Accordingly, utilities of VGAM1169 include diagnosis, prevention and treatment of diseases and clinical conditions associated with RB1CC1. The function of RB1CC1 and its association with various diseases and clinical conditions, has been established by previous studies, as described hereinabove with reference to VGAM18. Reelin (RELN, Accession XM_168628) is another VGAM1169 host target gene. RELN BINDING SITE is HOST TARGET binding site found in the 3' untranslated region of mRNA encoded by RELN, corresponding to a HOST TARGET binding site such as BINDING SITE I, BINDING SITE II or BINDING SITE III. Table 2 illustrates the complementarity of the nucleotide sequences of RELN BINDING SITE, designated SEQ ID:45278, to the nucleotide sequence of VGAM1169 RNA, herein designated VGAM RNA, also designated SEQ ID:3880.

Another function of VGAM1169 is therefore inhibition of Reelin (RELN, Accession XM_168628), a gene which regulates microtubule function in neurons and neuronal migration. Accordingly, utilities of VGAM1169 include diagnosis, prevention and treatment of diseases and clinical conditions associated with RELN. The function of RELN and its association with various diseases and clinical conditions, has been established by previous studies, as described hereinabove with reference to VGAM35. SRY (sex determining region Y)-box 4 (SOX4, Accession NM_003107) is another VGAM1169 host target gene. SOX4 BINDING SITE is HOST TARGET binding site found in the 3' untranslated region of mRNA encoded by SOX4, corresponding to a HOST TARGET binding site such as BINDING SITE I, BINDING SITE II or BINDING SITE III. Table 2 illustrates the complementarity of the nucleotide sequences of SOX4 BINDING SITE, designated SEQ ID:9075, to the nucleotide sequence of VGAM1169 RNA, herein designated VGAM RNA, also designated SEQ ID:3880.

Another function of VGAM1169 is therefore inhibition of SRY (sex determining region Y)-box 4 (SOX4, Accession NM_003107), a gene which binds with high affinity to the t-cell enhancer motif 5'-aacaaag-3' motif. Accordingly, utilities of VGAM1169 include diagnosis, prevention and treatment of diseases and clinical conditions associated with SOX4. The function of SOX4 and its association with various diseases and clinical conditions, has been established by previous studies, as described hereinabove with reference to VGAM409. Stanniocalcin 1 (STC1, Accession NM_003155) is another VGAM1169 host target gene. STC1 BINDING SITE is HOST TARGET binding site found in the 3' untranslated region of mRNA encoded by STC1, corresponding to a HOST TARGET binding site such as BINDING SITE I, BINDING SITE II or BINDING SITE III. Table 2 illustrates the complementarity of the nucleotide sequences of STC1 BINDING SITE, designated SEQ ID:9136, to the nucleotide sequence of VGAM1169 RNA, herein designated VGAM RNA, also designated SEQ ID:3880.

Another function of VGAM1169 is therefore inhibition of Stanniocalcin 1 (STC1, Accession NM_003155), a gene which stimulates renal phosphate reabsorption, and could therefore prevent hypercalcemia. Accordingly, utilities of VGAM1169 include diagnosis, prevention and treatment of diseases and clinical conditions associated with STC1. The function of STC1 and its association with various diseases and clinical conditions, has been established by previous studies, as described hereinabove with reference to VGAM623. Transforming Growth Factor, Alpha (TGFA, Accession NM_003236) is another VGAM1169 host target gene. TGFA BINDING SITE is HOST TARGET binding site found in the 3' untranslated region of mRNA encoded by TGFA, corresponding to a HOST TARGET binding site such as BINDING SITE I, BINDING SITE II or BINDING SITE III. Table 2 illustrates the complementarity of the nucleotide sequences of TGFA BINDING SITE, designated SEQ ID:9231, to the nucleotide sequence of VGAM1169 RNA, herein designated VGAM RNA, also designated SEQ ID:3880.

Another function of VGAM1169 is therefore inhibition of Transforming Growth Factor, Alpha (TGFA, Accession NM_003236), a gene which is able to bind to the egf receptor and to act synergistically with tgf beta to promote anchorage-independent cell proliferation in soft agar. Accordingly, utilities of VGAM1169 include diagnosis, prevention and treatment of diseases and clinical conditions associated with TGFA. The function of TGFA and its association with various diseases and clinical conditions, has been established by previous studies, as described hereinabove with reference to VGAM328. T-cell Lymphoma Invasion and Metastasis 1 (TIAM1, Accession NM_003253) is another VGAM1169 host target gene. TIAM1 BINDING SITE is HOST TARGET binding site found in the 5' untranslated region of mRNA encoded by TIAM1, corresponding to a HOST TARGET binding site such as BINDING SITE I, BINDING SITE II or BINDING SITE III. Table 2 illustrates the complementarity of the nucleotide sequences of TIAM1 BINDING SITE, designated SEQ ID:9261, to the nucleotide sequence of VGAM1169 RNA, herein designated VGAM RNA, also designated SEQ ID:3880.

Another function of VGAM1169 is therefore inhibition of T-cell Lymphoma Invasion and Metastasis 1 (TIAM1, Accession NM_003253), a gene which modulates the activity of Rho-like proteins and connects extracellular signals to cytoskeletal activities. Accordingly, utilities of VGAM1169 include diagnosis, prevention and treatment of diseases and clinical conditions associated with TIAM1. The function of TIAM1 and its association with various diseases and clinical conditions, has been established by previous studies, as described hereinabove with reference to VGAM1098. Tight Junction Protein 1 (zona occludens 1) (TJP1, Accession NM_003257) is another VGAM1169 host target gene. TJP1 BINDING SITE is HOST TARGET binding site found in the 5' untranslated region of mRNA encoded by TJP1, corresponding to a HOST TARGET binding site such as BINDING SITE I, BINDING SITE II or BINDING SITE III. Table 2 illustrates the complementarity of the nucleotide sequences of TJP1 BINDING SITE, designated SEQ ID:9265, to the nucleotide sequence of VGAM1169 RNA, herein designated VGAM RNA, also designated SEQ ID:3880.

Another function of VGAM1169 is therefore inhibition of Tight Junction Protein 1 (zona occludens 1) (TJP1, Accession NM_003257), a gene which colocalizes and interacts with cadherins in cells lacking tight junctions. Accordingly, utilities of VGAM1169 include diagnosis, prevention and treatment of diseases and clinical conditions associated with TJP1. The function of TJP1 and its association with various diseases and clinical conditions, has been established by previous studies, as described hereinabove with reference to VGAM95. A Kinase (PRKA) Anchor Protein 8 (AKAP8, Accession NM_005858) is another VGAM1169 host target gene. AKAP8 BINDING SITE is HOST TARGET binding site found in the 3' untranslated region of mRNA encoded by AKAP8, corresponding to a HOST TARGET binding site such as BINDING SITE I, BINDING SITE II or BINDING SITE III. Table 2 illustrates the complementarity of the nucleotide sequences of AKAP8 BINDING SITE, designated SEQ ID:12465, to the nucleotide sequence of VGAM1169 RNA, herein designated VGAM RNA, also designated SEQ ID:3880.

Another function of VGAM1169 is therefore inhibition of A Kinase (PRKA) Anchor Protein 8 (AKAP8, Accession NM_005858). Accordingly, utilities of VGAM1169 include diagnosis, prevention and treatment of diseases and clinical conditions associated with AKAP8. Burkitt Lymphoma Receptor 1, GTP Binding Protein (chemokine (C-X-C motif) Receptor 5) (BLR1, Accession NM_001716) is another VGAM1169 host target gene. BLR1 BINDING SITE1 and BLR1 BINDING SITE2 are HOST TARGET binding sites found in untranslated regions of mRNA encoded by BLR1, corresponding to HOST TARGET binding sites such as BINDING SITE I, BINDING SITE II or BINDING SITE III. Table 2 illustrates the complementarity of the nucleotide sequences of BLR1 BINDING SITE1 and BLR1 BINDING SITE2, designated SEQ ID:7447 and SEQ ID:26777 respectively, to the nucleotide sequence of VGAM1169 RNA, herein designated VGAM RNA, also designated SEQ ID:3880.

Another function of VGAM1169 is therefore inhibition of Burkitt Lymphoma Receptor 1, GTP Binding Protein (chemokine (C-X-C motif) Receptor 5) (BLR1, Accession NM_001716). Accordingly, utilities of VGAM1169 include diagnosis, prevention and treatment of diseases and clinical conditions associated with BLR1. Chloride Intracellular Channel 2 (CLIC2, Accession NM_001289) is another VGAM1169 host target gene. CLIC2 BINDING SITE is HOST TARGET binding site found in the 5' untranslated region of mRNA encoded by CLIC2, corresponding to a HOST TARGET binding site such as BINDING SITE I, BINDING SITE II or BINDING SITE III. Table 2 illustrates the complementarity of the nucleotide sequences of CLIC2 BINDING SITE, designated SEQ ID:6967, to the nucleotide sequence of VGAM1169 RNA, herein designated VGAM RNA, also designated SEQ ID:3880.

Another function of VGAM1169 is therefore inhibition of Chloride Intracellular Channel 2 (CLIC2, Accession NM_001289). Accordingly, utilities of VGAM1169 include diagnosis, prevention and treatment of diseases and clinical conditions associated with CLIC2. Cyclin M2 (CNNM2, Accession NM_017649) is another VGAM1169 host target gene. CNNM2 BINDING SITE is HOST TARGET binding site found in the 3' untranslated region of mRNA encoded by CNNM2, corresponding to a HOST TARGET binding site such as BINDING SITE I, BINDING SITE II or BINDING SITE III. Table 2 illustrates the complementarity of the nucleotide sequences of CNNM2 BINDING SITE, designated SEQ ID:19155, to the nucleotide sequence of VGAM1169 RNA, herein designated VGAM RNA, also designated SEQ ID:3880.

Another function of VGAM1169 is therefore inhibition of Cyclin M2 (CNNM2, Accession NM_017649). Accordingly, utilities of VGAM1169 include diagnosis, prevention and treatment of diseases and clinical conditions associated with CNNM2. DEAD/H (Asp-Glu-Ala-Asp/His) Box Polypeptide 34 (DDX34, Accession NM_014681) is another VGAM1169 host target gene. DDX34 BINDING SITE is HOST TARGET binding site found in the 3' untranslated region of mRNA encoded by DDX34, corresponding to a HOST TARGET binding site such as BINDING SITE I, BINDING SITE II or BINDING SITE III. Table 2 illustrates the complementarity of the nucleotide sequences of DDX34 BINDING SITE, designated SEQ ID:16165, to the nucleotide sequence of VGAM1169 RNA, herein designated VGAM RNA, also designated SEQ ID:3880.

Another function of VGAM1169 is therefore inhibition of DEAD/H (Asp-Glu-Ala-Asp/His) Box Polypeptide 34 (DDX34, Accession NM_014681). Accordingly, utilities of VGAM1169 include diagnosis, prevention and treatment of diseases and clinical conditions associated with DDX34. DEAD/H (Asp-Glu-Ala-Asp/His) Box Polypeptide 35 (DDX35, Accession NM_021931) is another VGAM1169 host target gene. DDX35 BINDING SITE is HOST TARGET binding site found in the 3' untranslated region of mRNA encoded by DDX35, corresponding to a HOST TARGET binding site such as BINDING SITE I, BINDING SITE II or BINDING SITE III. Table 2 illustrates the complementarity of the nucleotide sequences of DDX35 BINDING SITE, designated SEQ ID:22454, to the nucleotide sequence of VGAM1169 RNA, herein designated VGAM RNA, also designated SEQ ID:3880.

Another function of VGAM1169 is therefore inhibition of DEAD/H (Asp-Glu-Ala-Asp/His) Box Polypeptide 35 (DDX35, Accession NM_021931). Accordingly, utilities of VGAM1169 include diagnosis, prevention and treatment of diseases and clinical conditions associated with DDX35. DKFZP434L187 (Accession XM_044070) is another VGAM1169 host target gene. DKFZP434L187 BINDING SITE is HOST TARGET binding site found in the 3' untranslated region of mRNA encoded by DKFZP434L187, corresponding to a HOST TARGET binding site such as BINDING SITE I, BINDING SITE II or BINDING SITE III. Table 2 illustrates the complementarity of the nucleotide sequences of DKFZP434L187 BINDING SITE, designated SEQ ID:34121, to the nucleotide sequence of VGAM1169 RNA, herein designated VGAM RNA, also designated SEQ ID:3880.

Another function of VGAM1169 is therefore inhibition of DKFZP434L187 (Accession XM_044070). Accordingly, utilities of VGAM1169 include diagnosis, prevention and treatment of diseases and clinical conditions associated with DKFZP434L187. DKFZP434N178 (Accession XM_050278) is another VGAM1169 host target gene. DKFZP434N178 BINDING SITE is HOST TARGET binding site found in the 5' untranslated region of mRNA encoded by DKFZP434N178, corresponding to a HOST TARGET binding site such as BINDING SITE I, BINDING SITE II or BINDING SITE III. Table 2 illustrates the complementarity of the nucleotide sequences of DKFZP434N178 BINDING SITE, designated SEQ ID:35598, to the nucleotide sequence of VGAM1169 RNA, herein designated VGAM RNA, also designated SEQ ID:3880.

Another function of VGAM1169 is therefore inhibition of DKFZP434N178 (Accession XM_050278). Accordingly, utilities of VGAM1169 include diagnosis, prevention and treatment of diseases and clinical conditions associated with DKFZP434N178. DKFZP586I2223 (Accession NM_015438) is another VGAM1169 host target gene. DKFZP586I2223 BINDING SITE is HOST TARGET binding site found in the 3' untranslated region of mRNA encoded by DKFZP586I2223, corresponding to a HOST TARGET binding site such as BINDING SITE I, BINDING SITE II or BINDING SITE III. Table 2 illustrates the complementarity of the nucleotide sequences of DKFZP586I2223 BINDING SITE, designated SEQ ID:17732, to the nucleotide sequence of VGAM1169 RNA, herein designated VGAM RNA, also designated SEQ ID:3880.

Another function of VGAM1169 is therefore inhibition of DKFZP586I2223 (Accession NM_015438). Accordingly, utilities of VGAM1169 include diagnosis, prevention and treatment of diseases and clinical conditions associated with DKFZP586I2223. FLJ13710 (Accession NM_024817) is another VGAM1169 host target gene. FLJ13710 BINDING SITE is HOST TARGET binding site found in the 3' untranslated region of mRNA encoded by FLJ13710, corresponding to a HOST TARGET binding site such as BINDING SITE I, BINDING SITE II or BINDING SITE III. Table 2 illustrates the complementarity of the nucleotide sequences of FLJ13710 BINDING SITE, designated SEQ ID:24206, to the nucleotide sequence of VGAM1169 RNA, herein designated VGAM RNA, also designated SEQ ID:3880.

Another function of VGAM1169 is therefore inhibition of FLJ13710 (Accession NM_024817). Accordingly, utilities of VGAM1169 include diagnosis, prevention and treatment of diseases and clinical conditions associated with FLJ13710. FLJ20154 (Accession XM_053688) is another VGAM1169 host target gene. FLJ20154 BINDING SITE is HOST TARGET binding site found in the 3' untranslated region of mRNA encoded by FLJ20154, corresponding to a HOST TARGET binding site such as BINDING SITE I, BINDING SITE II or BINDING SITE III. Table 2 illustrates the complementarity of the nucleotide sequences of FLJ20154 BINDING SITE, designated SEQ ID:36106, to the nucleotide sequence of VGAM1169 RNA, herein designated VGAM RNA, also designated SEQ ID:3880.

Another function of VGAM1169 is therefore inhibition of FLJ20154 (Accession XM_053688). Accordingly, utilities of VGAM1169 include diagnosis, prevention and treatment of diseases and clinical conditions associated with FLJ20154. GS3955 (Accession NM_021643) is another VGAM1169 host target gene. GS3955 BINDING SITE is HOST TARGET binding site found in the 5' untranslated region of mRNA encoded by GS3955, corresponding to a HOST TARGET binding site such as BINDING SITE I, BINDING SITE II or BINDING SITE III. Table 2 illustrates the complementarity of the nucleotide sequences of GS3955 BINDING SITE, designated SEQ ID:22305, to the nucleotide sequence of VGAM1169 RNA, herein designated VGAM RNA, also designated SEQ ID:3880.

Another function of VGAM1169 is therefore inhibition of GS3955 (Accession NM_021643). Accordingly, utilities of VGAM1169 include diagnosis, prevention and treatment of diseases and clinical conditions associated with GS3955.

KIAA0296 (Accession NM_014699) is another VGAM1169 host target gene. KIAA0296 BINDING SITE is HOST TARGET binding site found in the 3' untranslated region of mRNA encoded by KIAA0296, corresponding to a HOST TARGET binding site such as BINDING SITE I, BINDING SITE II or BINDING SITE III. Table 2 illustrates the complementarity of the nucleotide sequences of KIAA0296 BINDING SITE, designated SEQ ID:16222, to the nucleotide sequence of VGAM1169 RNA, herein designated VGAM RNA, also designated SEQ ID:3880.

Another function of VGAM1169 is therefore inhibition of KIAA0296 (Accession NM_014699). Accordingly, utilities of VGAM1169 include diagnosis, prevention and treatment of diseases and clinical conditions associated with KIAA0296. KIAA0337 (Accession NM_014786) is another VGAM1169 host target gene. KIAA0337 BINDING SITE is HOST TARGET binding site found in the 3' untranslated region of mRNA encoded by KIAA0337, corresponding to a HOST TARGET binding site such as BINDING SITE I, BINDING SITE II or BINDING SITE III. Table 2 illustrates the complementarity of the nucleotide sequences of KIAA0337 BINDING SITE, designated SEQ ID:16655, to the nucleotide sequence of VGAM1169 RNA, herein designated VGAM RNA, also designated SEQ ID:3880.

Another function of VGAM1169 is therefore inhibition of KIAA0337 (Accession NM_014786). Accordingly, utilities of VGAM1169 include diagnosis, prevention and treatment of diseases and clinical conditions associated with KIAA0337. KIAA0415 (Accession XM_166527) is another VGAM1169 host target gene. KIAA0415 BINDING SITE is HOST TARGET binding site found in the 3' untranslated region of mRNA encoded by KIAA0415, corresponding to a HOST TARGET binding site such as BINDING SITE I, BINDING SITE II or BINDING SITE III. Table 2 illustrates the complementarity of the nucleotide sequences of KIAA0415 BINDING SITE, designated SEQ ID:44477, to the nucleotide sequence of VGAM1169 RNA, herein designated VGAM RNA, also designated SEQ ID:3880.

Another function of VGAM1169 is therefore inhibition of KIAA0415 (Accession XM_166527). Accordingly, utilities of VGAM1169 include diagnosis, prevention and treatment of diseases and clinical conditions associated with KIAA0415. KIAA0472 (Accession XM_050147) is another VGAM1169 host target gene. KIAA0472 BINDING SITE is HOST TARGET binding site found in the 3' untranslated region of mRNA encoded by KIAA0472, corresponding to a HOST TARGET binding site such as BINDING SITE I, BINDING SITE II or BINDING SITE III. Table 2 illustrates the complementarity of the nucleotide sequences of KIAA0472 BINDING SITE, designated SEQ ID:35580, to the nucleotide sequence of VGAM1169 RNA, herein designated VGAM RNA, also designated SEQ ID:3880.

Another function of VGAM1169 is therefore inhibition of KIAA0472 (Accession XM_050147). Accordingly, utilities of VGAM1169 include diagnosis, prevention and treatment of diseases and clinical conditions associated with KIAA0472. KIAA0668 (Accession XM_039332) is another VGAM1169 host target gene. KIAA0668 BINDING SITE is HOST TARGET binding site found in the 3' untranslated region of mRNA encoded by KIAA0668, corresponding to a HOST TARGET binding site such as BINDING SITE I, BINDING SITE II or BINDING SITE III. Table 2 illustrates the complementarity of the nucleotide sequences of KIAA0668 BINDING SITE, designated SEQ ID:33053, to the nucleotide sequence of VGAM1169 RNA, herein designated VGAM RNA, also designated SEQ ID:3880.

Another function of VGAM1169 is therefore inhibition of KIAA0668 (Accession XM_039332). Accordingly, utilities of VGAM1169 include diagnosis, prevention and treatment of diseases and clinical conditions associated with KIAA0668. KIAA1023 (Accession NM_017604) is another VGAM1169 host target gene. KIAA1023 BINDING SITE is HOST TARGET binding site found in the 3' untranslated region of mRNA encoded by KIAA1023, corresponding to a HOST TARGET binding site such as BINDING SITE I, BINDING SITE II or BINDING SITE III. Table 2 illustrates the complementarity of the nucleotide sequences of KIAA1023 BINDING SITE, designated SEQ ID:19090, to the nucleotide sequence of VGAM1169 RNA, herein designated VGAM RNA, also designated SEQ ID:3880.

Another function of VGAM1169 is therefore inhibition of KIAA1023 (Accession NM_017604). Accordingly, utilities of VGAM1169 include diagnosis, prevention and treatment of diseases and clinical conditions associated with KIAA1023. KIAA1184 (Accession NM_022572) is another VGAM1169 host target gene. KIAA1184 BINDING SITE is HOST TARGET binding site found in the 3' untranslated region of mRNA encoded by KIAA1184, corresponding to a HOST TARGET binding site such as BINDING SITE I, BINDING SITE II or BINDING SITE III. Table 2 illustrates the complementarity of the nucleotide sequences of KIAA1184 BINDING SITE, designated SEQ ID:22893, to the nucleotide sequence of VGAM1169 RNA, herein designated VGAM RNA, also designated SEQ ID:3880.

Another function of VGAM1169 is therefore inhibition of KIAA1184 (Accession NM_022572). Accordingly, utilities of VGAM1169 include diagnosis, prevention and treatment of diseases and clinical conditions associated with KIAA1184. KIAA1374 (Accession XM_028413) is another VGAM1169 host target gene. KIAA1374 BINDING SITE is HOST TARGET binding site found in the 3' untranslated region of mRNA encoded by KIAA1374, corresponding to a HOST TARGET binding site such as BINDING SITE I, BINDING SITE II or BINDING SITE III. Table 2 illustrates the complementarity of the nucleotide sequences of KIAA1374 BINDING SITE, designated SEQ ID:30709, to the nucleotide sequence of VGAM1169 RNA, herein designated VGAM RNA, also designated SEQ ID:3880.

Another function of VGAM1169 is therefore inhibition of KIAA1374 (Accession XM_028413). Accordingly, utilities of VGAM1169 include diagnosis, prevention and treatment of diseases and clinical conditions associated with KIAA1374. KIAA1464 (Accession XM_043069) is another VGAM1169 host target gene. KIAA1464 BINDING SITE is HOST TARGET binding site found in the 3' untranslated region of mRNA encoded by KIAA1464, corresponding to a HOST TARGET binding site such as BINDING SITE I, BINDING SITE II or BINDING SITE III. Table 2 illustrates the complementarity of the nucleotide sequences of KIAA1464 BINDING SITE, designated SEQ ID:33884, to the nucleotide sequence of VGAM1169 RNA, herein designated VGAM RNA, also designated SEQ ID:3880.

Another function of VGAM1169 is therefore inhibition of KIAA1464 (Accession XM_043069). Accordingly, utilities of VGAM1169 include diagnosis, prevention and treatment of diseases and clinical conditions associated with KIAA1464. KIAA1674 (Accession XM_044065) is another VGAM1169 host target gene. KIAA1674 BINDING SITE is HOST TARGET binding site found in the 3' untranslated region of mRNA encoded by KIAA1674, corresponding to a HOST TARGET binding site such as BINDING SITE I, BINDING SITE II or BINDING SITE III. Table 2 illustrates the complementarity of the nucleotide sequences of KIAA1674 BINDING SITE, designated SEQ ID:34113, to the nucleotide sequence of VGAM1169 RNA, herein designated VGAM RNA, also designated SEQ ID:3880.

Another function of VGAM1169 is therefore inhibition of KIAA1674 (Accession XM_044065). Accordingly, utilities of VGAM1169 include diagnosis, prevention and treatment of diseases and clinical conditions associated with KIAA1674. LPS-responsive Vesicle Trafficking, Beach and Anchor Containing (LRBA, Accession NM_006726) is another VGAM1169 host target gene. LRBA BINDING SITE is HOST TARGET binding site found in the 5' untranslated region of mRNA encoded by LRBA, corresponding to a HOST TARGET binding site such as BINDING SITE I, BINDING SITE II or BINDING SITE III. Table 2 illustrates the complementarity of the nucleotide sequences of LRBA BINDING SITE, designated SEQ ID:13557, to the nucleotide sequence of VGAM1169 RNA, herein designated VGAM RNA, also designated SEQ ID:3880.

Another function of VGAM1169 is therefore inhibition of LPS-responsive Vesicle Trafficking, Beach and Anchor Containing (LRBA, Accession NM_006726). Accordingly, utilities of VGAM1169 include diagnosis, prevention and treatment of diseases and clinical conditions associated with LRBA. MAGE-E1 (Accession NM_030801) is another VGAM1169 host target gene. MAGE-E1 BINDING SITE is HOST TARGET binding site found in the 3' untranslated region of mRNA encoded by MAGE-E1, corresponding to a HOST TARGET binding site such as BINDING SITE I, BINDING SITE II or BINDING SITE III. Table 2 illustrates the complementarity of the nucleotide sequences of MAGE-E1 BINDING SITE, designated SEQ ID:25108, to the nucleotide sequence of VGAM1169 RNA, herein designated VGAM RNA, also designated SEQ ID:3880.

Another function of VGAM1169 is therefore inhibition of MAGE-E1 (Accession NM_030801). Accordingly, utilities of VGAM1169 include diagnosis, prevention and treatment of diseases and clinical conditions associated with MAGE-E1. MDS006 (Accession NM_020233) is another VGAM1169 host target gene. MDS006 BINDING SITE is HOST TARGET binding site found in the 3' untranslated region of mRNA encoded by MDS006, corresponding to a HOST TARGET binding site such as BINDING SITE I, BINDING SITE II or BINDING SITE III. Table 2 illustrates the complementarity of the nucleotide sequences of MDS006 BINDING SITE, designated SEQ ID:21502, to the nucleotide sequence of VGAM1169 RNA, herein designated VGAM RNA, also designated SEQ ID:3880.

Another function of VGAM1169 is therefore inhibition of MDS006 (Accession NM_020233). Accordingly, utilities of VGAM1169 include diagnosis, prevention and treatment of diseases and clinical conditions associated with MDS006. MGC2663 (Accession NM_024106) is another VGAM1169 host target gene. MGC2663 BINDING SITE is HOST TARGET binding site found in the 5' untranslated region of mRNA encoded by MGC2663, corresponding to a HOST TARGET binding site such as BINDING SITE I, BINDING SITE II or BINDING SITE III. Table 2 illustrates the complementarity of the nucleotide sequences of MGC2663 BINDING SITE, designated SEQ ID:23551, to the nucleotide sequence of VGAM1169 RNA, herein designated VGAM RNA, also designated SEQ ID:3880.

Another function of VGAM1169 is therefore inhibition of MGC2663 (Accession NM_024106). Accordingly, utilities of VGAM1169 include diagnosis, prevention and treatment of diseases and clinical conditions associated with MGC2663. MGC33371 (Accession NM_144664) is another VGAM1169 host target gene. MGC33371 BINDING SITE is HOST TARGET binding site found in the 5' untranslated region of mRNA encoded by MGC33371, corresponding to a HOST TARGET binding site such as BINDING SITE I, BINDING SITE II or BINDING SITE III. Table 2 illustrates the complementarity of the nucleotide sequences of MGC33371 BINDING SITE, designated SEQ ID:29480, to the nucleotide sequence of VGAM1169 RNA, herein designated VGAM RNA, also designated SEQ ID:3880.

Another function of VGAM1169 is therefore inhibition of MGC33371 (Accession NM_144664). Accordingly, utilities of VGAM1169 include diagnosis, prevention and treatment of diseases and clinical conditions associated with MGC33371. MAP Kinase-interacting Serine/threonine Kinase 1 (MKNK1, Accession NM_003684) is another VGAM1169 host target gene. MKNK1 BINDING SITE is HOST TARGET binding site found in the 5' untranslated region of mRNA encoded by MKNK1, corresponding to a HOST TARGET binding site such as BINDING SITE I, BINDING SITE II or BINDING SITE III. Table 2 illustrates the complementarity of the nucleotide sequences of MKNK1 BINDING SITE, designated SEQ ID:9794, to the nucleotide sequence of VGAM1169 RNA, herein designated VGAM RNA, also designated SEQ ID:3880.

Another function of VGAM1169 is therefore inhibition of MAP Kinase-interacting Serine/threonine Kinase 1 (MKNK1, Accession NM_003684). Accordingly, utilities of VGAM1169 include diagnosis, prevention and treatment of diseases and clinical conditions associated with MKNK1. Matrix Metalloproteinase-like 1 (MMPL1, Accession NM_004142) is another VGAM1169 host target gene. MMPL1 BINDING SITE is HOST TARGET binding site found in the 3' untranslated region of mRNA encoded by MMPL1, corresponding to a HOST TARGET binding site such as BINDING SITE I, BINDING SITE II or BINDING SITE III. Table 2 illustrates the complementarity of the nucleotide sequences of MMPL1 BINDING SITE, designated SEQ ID:10348, to the nucleotide sequence of VGAM1169 RNA, herein designated VGAM RNA, also designated SEQ ID:3880.

Another function of VGAM1169 is therefore inhibition of Matrix Metalloproteinase-like 1 (MMPL1, Accession NM_004142). Accordingly, utilities of VGAM1169 include diagnosis, prevention and treatment of diseases and clinical conditions associated with MMPL1. N4BP3 (Accession XM_038920) is another VGAM1169 host target gene. N4BP3 BINDING SITE is HOST TARGET binding site found in the 3' untranslated region of mRNA encoded by N4BP3, corresponding to a HOST TARGET binding site such as BINDING SITE I, BINDING SITE II or BINDING SITE III. Table 2 illustrates the complementarity of the nucleotide sequences of N4BP3 BINDING SITE, designated SEQ ID:32930, to the nucleotide sequence of VGAM1169 RNA, herein designated VGAM RNA, also designated SEQ ID:3880.

Another function of VGAM1169 is therefore inhibition of N4BP3 (Accession XM_038920). Accordingly, utilities of VGAM1169 include diagnosis, prevention and treatment of diseases and clinical conditions associated with N4BP3. NAG14 (Accession NM_022143) is another VGAM1169 host target gene. NAG14 BINDING SITE is HOST TARGET binding site found in the 3' untranslated region of mRNA encoded by NAG14, corresponding to a HOST TARGET binding site such as BINDING SITE I, BINDING SITE II or BINDING SITE III. Table 2 illustrates the complementarity of the nucleotide sequences of NAG14 BINDING SITE, designated SEQ ID:22705, to the nucleotide sequence of VGAM1169 RNA, herein designated VGAM RNA, also designated SEQ ID:3880.

Another function of VGAM1169 is therefore inhibition of NAG14 (Accession NM_022143). Accordingly, utilities of VGAM1169 include diagnosis, prevention and treatment of diseases and clinical conditions associated with NAG14. PIP3-E (Accession XM_039749) is another VGAM1169 host target gene. PIP3-E BINDING SITE is HOST TARGET binding site found in the 3' untranslated region of mRNA encoded by PIP3-E, corresponding to a HOST TARGET binding site such as BINDING SITE I, BINDING SITE II or BINDING SITE III. Table 2 illustrates the complementarity of the nucleotide sequences of PIP3-E BINDING SITE, designated SEQ ID:33180, to the nucleotide sequence of VGAM1169 RNA, herein designated VGAM RNA, also designated SEQ ID:3880.

Another function of VGAM1169 is therefore inhibition of PIP3-E (Accession XM_039749). Accordingly, utilities of VGAM1169 include diagnosis, prevention and treatment of diseases and clinical conditions associated with PIP3-E. Protein Tyrosine Phosphatase, Non-receptor Type Substrate 1 (PTPNS1, Accession NM_080792) is another VGAM1169 host target gene. PTPNS1 BINDING SITE is HOST TARGET binding site found in the 3' untranslated region of mRNA encoded by PTPNS1, corresponding to a HOST TARGET binding site such as BINDING SITE I, BINDING SITE II or BINDING SITE III. Table 2 illustrates the complementarity of the nucleotide sequences of PTPNS1 BINDING SITE, designated SEQ ID:28055, to the nucleotide sequence of VGAM1169 RNA, herein designated VGAM RNA, also designated SEQ ID:3880.

Another function of VGAM1169 is therefore inhibition of Protein Tyrosine Phosphatase, Non-receptor Type Substrate 1 (PTPNS1, Accession NM_080792). Accordingly, utilities of VGAM1169 include diagnosis, prevention and treatment of diseases and clinical conditions associated with PTPNS1. RAN Binding Protein 8 (RANBP8, Accession NM_006390) is another VGAM1169 host target gene. RANBP8 BINDING SITE is HOST TARGET binding site found in the 5' untranslated region of mRNA encoded by RANBP8, corresponding to a HOST TARGET binding site such as BINDING SITE I, BINDING SITE II or BINDING SITE III. Table 2 illustrates the complementarity of the nucleotide sequences of RANBP8 BINDING SITE, designated SEQ ID:13094, to the nucleotide sequence of VGAM1169 RNA, herein designated VGAM RNA, also designated SEQ ID:3880.

Another function of VGAM1169 is therefore inhibition of RAN Binding Protein 8 (RANBP8, Accession NM_006390). Accordingly, utilities of VGAM1169 include diagnosis, prevention and treatment of diseases and clinical conditions associated with RANBP8. Small Nuclear Ribonucleoprotein D1 Polypeptide 16 kDa (SNRPD1, Accession NM_006938) is another VGAM1169 host target gene. SNRPD1 BINDING SITE is HOST TARGET binding site found in the 3' untranslated region of mRNA encoded by SNRPD1, corresponding to a HOST TARGET binding site such as BINDING SITE I, BINDING SITE II or BINDING SITE III. Table 2 illustrates the complementarity of the nucleotide sequences of SNRPD1 BINDING SITE, designated SEQ ID:13821, to the nucleotide sequence of VGAM1169 RNA, herein designated VGAM RNA, also designated SEQ ID:3880.

Another function of VGAM1169 is therefore inhibition of Small Nuclear Ribonucleoprotein D1 Polypeptide 16 kDa (SNRPD1, Accession NM_006938). Accordingly, utilities of VGAM1169 include diagnosis, prevention and treatment of diseases and clinical conditions associated with SNRPD1. TED (Accession NM_015686) is another VGAM1169 host target gene. TED BINDING SITE is HOST TARGET binding site found in the 3' untranslated region of mRNA encoded by TED, corresponding to a HOST TARGET binding site such as BINDING SITE I, BINDING SITE II or BINDING SITE III. Table 2 illustrates the complementarity of the nucleotide sequences of TED BINDING SITE, designated SEQ ID:17920, to the nucleotide sequence of VGAM1169 RNA, herein designated VGAM RNA, also designated SEQ ID:3880.

Another function of VGAM1169 is therefore inhibition of TED (Accession NM_015686). Accordingly, utilities of VGAM1169 include diagnosis, prevention and treatment of diseases and clinical conditions associated with TED. TU12B1-TY (Accession NM_016575) is another VGAM1169 host target gene. TU12B1-TY BINDING SITE is HOST TARGET binding site found in the 3' untranslated region of mRNA encoded by TU12B1-TY, corresponding to a HOST TARGET binding site such as BINDING SITE I, BINDING SITE II or BINDING SITE III. Table 2 illustrates the complementarity of the nucleotide sequences of TU12B1-TY BINDING SITE, designated SEQ ID:18648, to the nucleotide sequence of VGAM1169 RNA, herein designated VGAM RNA, also designated SEQ ID:3880.

Another function of VGAM1169 is therefore inhibition of TU12B1-TY (Accession NM_016575). Accordingly, utilities of VGAM1169 include diagnosis, prevention and treatment of diseases and clinical conditions associated with TU12B1-TY. UBCE7IP5 (Accession NM_014948) is another VGAM1169 host target gene. UBCE7IP5 BINDING SITE is HOST TARGET binding site found in the 3' untranslated region of mRNA encoded by UBCE7IP5, corresponding to a HOST TARGET binding site such as BINDING SITE I, BINDING SITE II or BINDING SITE III. Table 2 illustrates the complementarity of the nucleotide sequences of UBCE7IP5 BINDING SITE, designated SEQ ID:17273, to the nucleotide sequence of VGAM1169 RNA, herein designated VGAM RNA, also designated SEQ ID:3880.

Another function of VGAM1169 is therefore inhibition of UBCE7IP5 (Accession NM_014948). Accordingly, utilities of VGAM1169 include diagnosis, prevention and treatment of diseases and clinical conditions associated with UBCE7IP5. LOC127294 (Accession XM_059131) is another VGAM1169 host target gene. LOC127294 BINDING SITE is HOST TARGET binding site found in the 3' untranslated region of mRNA encoded by LOC127294, corresponding to a HOST TARGET binding site such as BINDING SITE I, BINDING SITE II or BINDING SITE III. Table 2 illustrates the complementarity of the nucleotide sequences of LOC127294 BINDING SITE, designated SEQ ID:36894, to the nucleotide sequence of VGAM1169 RNA, herein designated VGAM RNA, also designated SEQ ID:3880.

Another function of VGAM1169 is therefore inhibition of LOC127294 (Accession XM_059131). Accordingly, utilities of VGAM1169 include diagnosis, prevention and treatment of diseases and clinical conditions associated with LOC127294. LOC129676 (Accession XM_065341) is another VGAM1169 host target gene. LOC129676 BINDING SITE is HOST TARGET binding site found in the 5' untranslated region of mRNA encoded by LOC129676, corresponding to a HOST TARGET binding site such as BINDING SITE I, BINDING SITE II or BINDING SITE III. Table 2 illustrates the complementarity of the nucleotide sequences of LOC129676 BINDING SITE, designated SEQ ID:37285, to the nucleotide sequence of VGAM1169 RNA, herein designated VGAM RNA, also designated SEQ ID:3880.

Another function of VGAM1169 is therefore inhibition of LOC129676 (Accession XM_065341). Accordingly, utilities of VGAM1169 include diagnosis, prevention and treatment of diseases and clinical conditions associated with LOC129676. LOC138389 (Accession XM_072534) is another VGAM1169 host target gene. LOC138389 BINDING SITE is HOST TARGET binding site found in the 3' untranslated region of mRNA encoded by LOC138389, corresponding to a HOST TARGET binding site such as BINDING SITE I, BINDING SITE II or BINDING SITE III. Table 2 illustrates the complementarity of the nucleotide sequences of LOC138389 BINDING SITE, designated SEQ ID:37507, to the nucleotide sequence of VGAM1169 RNA, herein designated VGAM RNA, also designated SEQ ID:3880.

Another function of VGAM1169 is therefore inhibition of LOC138389 (Accession XM_072534). Accordingly, utilities of VGAM1169 include diagnosis, prevention and treatment of diseases and clinical conditions associated with LOC138389. LOC144970 (Accession XM_084998) is another VGAM1169 host target gene. LOC144970 BINDING SITE is HOST TARGET binding site found in the 5' untranslated region of mRNA encoded by LOC144970, corresponding to a HOST TARGET binding site such as BINDING SITE I, BINDING SITE II or BINDING SITE III. Table 2 illustrates the complementarity of the nucleotide sequences of LOC144970 BINDING SITE, designated SEQ ID:37793, to the nucleotide sequence of VGAM1169 RNA, herein designated VGAM RNA, also designated SEQ ID:3880.

Another function of VGAM1169 is therefore inhibition of LOC144970 (Accession XM_084998). Accordingly, utilities of VGAM1169 include diagnosis, prevention and treatment of diseases and clinical conditions associated with LOC144970. LOC145623 (Accession XM_096822) is another VGAM1169 host target gene. LOC145623 BINDING SITE is HOST TARGET binding site found in the 3' untranslated region of mRNA encoded by LOC145623, corresponding to a HOST TARGET binding site such as BINDING SITE I, BINDING SITE II or BINDING SITE III. Table 2 illustrates the complementarity of the nucleotide sequences of LOC145623 BINDING SITE, designated SEQ ID:40545, to the nucleotide sequence of VGAM1169 RNA, herein designated VGAM RNA, also designated SEQ ID:3880.

Another function of VGAM1169 is therefore inhibition of LOC145623 (Accession XM_096822). Accordingly, utilities of VGAM1169 include diagnosis, prevention and treatment of diseases and clinical conditions associated with LOC145623. LOC146520 (Accession XM_085492) is another VGAM1169 host target gene. LOC146520 BINDING SITE is HOST TARGET binding site found in the 5' untranslated region of mRNA encoded by LOC146520, corresponding to a HOST TARGET binding site such as BINDING SITE I, BINDING SITE II or BINDING SITE III. Table 2 illustrates the complementarity of the nucleotide sequences of LOC146520 BINDING SITE, designated SEQ ID:38186, to the nucleotide sequence of VGAM1169 RNA, herein designated VGAM RNA, also designated SEQ ID:3880.

Another function of VGAM1169 is therefore inhibition of LOC146520 (Accession XM_085492). Accordingly, utilities of VGAM1169 include diagnosis, prevention and treatment of diseases and clinical conditions associated with LOC146520. LOC147912 (Accession XM_085952) is another VGAM1169 host target gene. LOC147912 BINDING SITE is HOST TARGET binding site found in the 5' untranslated region of mRNA encoded by LOC147912, corresponding to a HOST TARGET binding site such as BINDING SITE I, BINDING SITE II or BINDING SITE III. Table 2 illustrates the complementarity of the nucleotide sequences of LOC147912 BINDING SITE, designated SEQ ID:38418, to the nucleotide sequence of VGAM1169 RNA, herein designated VGAM RNA, also designated SEQ ID:3880.

Another function of VGAM1169 is therefore inhibition of LOC147912 (Accession XM_085952). Accordingly, utilities of VGAM1169 include diagnosis, prevention and treatment of diseases and clinical conditions associated with LOC147912. LOC148946 (Accession XM_097557) is another VGAM1169 host target gene. LOC148946 BINDING SITE is HOST TARGET binding site found in the 5' untranslated region of mRNA encoded by LOC148946, corresponding to a HOST TARGET binding site such as BINDING SITE I, BINDING SITE II or BINDING SITE III. Table 2 illustrates the complementarity of the nucleotide sequences of LOC148946 BINDING SITE, designated SEQ ID:40940, to the nucleotide sequence of VGAM1169 RNA, herein designated VGAM RNA, also designated SEQ ID:3880.

Another function of VGAM1169 is therefore inhibition of LOC148946 (Accession XM_097557). Accordingly, utilities of VGAM1169 include diagnosis, prevention and treatment of diseases and clinical conditions associated with LOC148946. LOC151009 (Accession XM_097992) is another VGAM1169 host target gene. LOC151009 BINDING SITE is HOST TARGET binding site found in the 5' untranslated region of mRNA encoded by LOC151009, corresponding to a HOST TARGET binding site such as BINDING SITE I, BINDING SITE II or BINDING SITE III. Table 2 illustrates the complementarity of the nucleotide sequences of LOC151009 BINDING SITE, designated SEQ ID:41289, to the nucleotide sequence of VGAM1169 RNA, herein designated VGAM RNA, also designated SEQ ID:3880.

Another function of VGAM1169 is therefore inhibition of LOC151009 (Accession XM_097992). Accordingly, utilities of VGAM1169 include diagnosis, prevention and treatment of diseases and clinical conditions associated with LOC151009. LOC152283 (Accession XM_098196) is another VGAM1169 host target gene. LOC152283 BINDING SITE is HOST TARGET binding site found in the 3' untranslated region of mRNA encoded by LOC152283, corresponding to a HOST TARGET binding site such as BINDING SITE I, BINDING SITE II or BINDING SITE III. Table 2 illustrates the complementarity of the nucleotide sequences of LOC152283 BINDING SITE, designated SEQ ID:41487, to the nucleotide sequence of VGAM1169 RNA, herein designated VGAM RNA, also designated SEQ ID:3880.

Another function of VGAM1169 is therefore inhibition of LOC152283 (Accession XM_098196). Accordingly, utilities of VGAM1169 include diagnosis, prevention and treatment of diseases and clinical conditions associated with LOC152283. LOC155179 (Accession XM_088169) is another VGAM1169 host target gene. LOC155179 BINDING SITE is HOST TARGET binding site found in the 3' untranslated region of mRNA encoded by LOC155179, corresponding to a HOST TARGET binding site such as BINDING SITE I, BINDING SITE II or BINDING SITE III. Table 2 illustrates the complementarity of the nucleotide sequences of LOC155179 BINDING SITE, designated SEQ ID:39557, to the nucleotide sequence of VGAM1169 RNA, herein designated VGAM RNA, also designated SEQ ID:3880.

Another function of VGAM1169 is therefore inhibition of LOC155179 (Accession XM_088169). Accordingly, utilities of VGAM1169 include diagnosis, prevention and treatment of diseases and clinical conditions associated with LOC155179. LOC164714 (Accession XM_104657) is another VGAM1169 host target gene. LOC164714 BINDING SITE is HOST TARGET binding site found in the 5' untranslated region of mRNA encoded by LOC164714, corresponding to a HOST TARGET binding site such as BIND- ING SITE I, BINDING SITE II or BINDING SITE III. Table 2 illustrates the complementarity of the nucleotide sequences of LOC164714 BINDING SITE, designated SEQ ID:42182, to the nucleotide sequence of VGAM1169 RNA, herein designated VGAM RNA, also designated SEQ ID:3880.

Another function of VGAM1169 is therefore inhibition of LOC164714 (Accession XM_104657). Accordingly, utilities of VGAM1169 include diagnosis, prevention and treatment of diseases and clinical conditions associated with LOC164714. LOC196047 (Accession XM_116883) is another VGAM1169 host target gene. LOC196047 BINDING SITE is HOST TARGET binding site found in the 5' untranslated region of mRNA encoded by LOC196047, corresponding to a HOST TARGET binding site such as BINDING SITE I, BINDING SITE II or BINDING SITE III. Table 2 illustrates the complementarity of the nucleotide sequences of LOC196047 BINDING SITE, designated SEQ ID:43143, to the nucleotide sequence of VGAM1169 RNA, herein designated VGAM RNA, also designated SEQ ID:3880.

Another function of VGAM1169 is therefore inhibition of LOC196047 (Accession XM_116883). Accordingly, utilities of VGAM1169 include diagnosis, prevention and treatment of diseases and clinical conditions associated with LOC196047. LOC196472 (Accession XM_113727) is another VGAM1169 host target gene. LOC196472 BINDING SITE is HOST TARGET binding site found in the 5' untranslated region of mRNA encoded by LOC196472, corresponding to a HOST TARGET binding site such as BINDING SITE I, BINDING SITE II or BINDING SITE III. Table 2 illustrates the complementarity of the nucleotide sequences of LOC196472 BINDING SITE, designated SEQ ID:42375, to the nucleotide sequence of VGAM1169 RNA, herein designated VGAM RNA, also designated SEQ ID:3880.

Another function of VGAM1169 is therefore inhibition of LOC196472 (Accession XM_113727). Accordingly, utilities of VGAM1169 include diagnosis, prevention and treatment of diseases and clinical conditions associated with LOC196472. LOC199858 (Accession XM_114040) is another VGAM1169 host target gene. LOC199858 BINDING SITE is HOST TARGET binding site found in the 3' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42639, to the nucleotide sequence of VGAM1169 RNA, herein designated VGAM RNA, also designated SEQ ID:3880.

Another function of VGAM1169 is therefore inhibition of LOC199858 (Accession XM_114040). Accordingly, utilities of VGAM1169 include diagnosis, prevention and treatment of diseases and clinical conditions associated with LOC199858. LOC200597 (Accession XM_114266) is another VGAM1169 host target gene. LOC200597 BINDING SITE is HOST TARGET binding site found in the 5' untranslated region of mRNA encoded by LOC200597, corresponding to a HOST TARGET binding site such as BINDING SITE I, BINDING SITE II or BINDING SITE III. Table 2 illustrates the complementarity of the nucleotide sequences of LOC200597 BINDING SITE, designated SEQ ID:42825, to the nucleotide sequence of VGAM1169 RNA, herein designated VGAM RNA, also designated SEQ ID:3880.

Another function of VGAM1169 is therefore inhibition of LOC200597 (Accession XM_114266). Accordingly, utilities of VGAM1169 include diagnosis, prevention and treatment of diseases and clinical conditions associated with LOC200597. LOC203636 (Accession XM_114868) is another VGAM1169 host target gene. LOC203636 BINDING SITE is HOST TARGET binding site found in the 3' untranslated region of mRNA encoded by LOC203636, corresponding to a HOST TARGET binding site such as BINDING SITE I, BINDING SITE II or BINDING SITE III. Table 2 illustrates the complementarity of the nucleotide sequences of LOC203636 BINDING SITE, designated SEQ ID:43077, to the nucleotide sequence of VGAM1169 RNA, herein designated VGAM RNA, also designated SEQ ID:3880.

Another function of VGAM1169 is therefore inhibition of LOC203636 (Accession XM_114868). Accordingly, utilities of VGAM1169 include diagnosis, prevention and treatment of diseases and clinical conditions associated with LOC203636. LOC219686 (Accession XM_165544) is another VGAM1169 host target gene. LOC219686 BINDING SITE is HOST TARGET binding site found in the 5' untranslated region of mRNA encoded by LOC219686, corresponding to a HOST TARGET binding site such as BINDING SITE I, BINDING SITE II or BINDING SITE III. Table 2 illustrates the complementarity of the nucleotide sequences of LOC219686 BINDING SITE, designated SEQ ID:43674, to the nucleotide sequence of VGAM1169 RNA, herein designated VGAM RNA, also designated SEQ ID:3880.

Another function of VGAM1169 is therefore inhibition of LOC219686 (Accession XM_165544). Accordingly, utilities of VGAM1169 include diagnosis, prevention and treatment of diseases and clinical conditions associated with LOC219686. LOC219899 (Accession XM_166173) is another VGAM1169 host target gene. LOC219899 BINDING SITE is HOST TARGET binding site found in the 3' untranslated region of mRNA encoded by LOC219899, corresponding to a HOST TARGET binding site such as BINDING SITE I, BINDING SITE II or BINDING SITE III. Table 2 illustrates the complementarity of the nucleotide sequences of LOC219899 BINDING SITE, designated SEQ ID:43989, to the nucleotide sequence of VGAM1169 RNA, herein designated VGAM RNA, also designated SEQ ID:3880.

Another function of VGAM1169 is therefore inhibition of LOC219899 (Accession XM_166173). Accordingly, utilities of VGAM1169 include diagnosis, prevention and treatment of diseases and clinical conditions associated with LOC219899. LOC220018 (Accession XM_167816) is another VGAM1169 host target gene. LOC220018 BINDING SITE is HOST TARGET binding site found in the 5' untranslated region of mRNA encoded by LOC220018, corresponding to a HOST TARGET binding site such as BINDING SITE I, BINDING SITE II or BINDING SITE III. Table 2 illustrates the complementarity of the nucleotide sequences of LOC220018 BINDING SITE, designated SEQ ID:44856, to the nucleotide sequence of VGAM1169 RNA, herein designated VGAM RNA, also designated SEQ ID:3880.

Another function of VGAM1169 is therefore inhibition of LOC220018 (Accession XM_167816). Accordingly, utilities of VGAM1169 include diagnosis, prevention and treatment of diseases and clinical conditions associated with LOC220018. LOC220906 (Accession XM_166133) is another VGAM1169 host target gene. LOC220906 BINDING SITE is HOST TARGET binding site found in the 5' untranslated region of mRNA encoded by LOC220906, corresponding to a HOST TARGET binding site such as BINDING SITE I, BINDING SITE II or BINDING SITE III. Table 2 illustrates the complementarity of the nucleotide sequences of LOC220906 BINDING SITE, designated SEQ ID:43926, to the nucleotide sequence of VGAM1169 RNA, herein designated VGAM RNA, also designated SEQ ID:3880.

Another function of VGAM1169 is therefore inhibition of LOC220906 (Accession XM_166133). Accordingly, utilities of VGAM1169 include diagnosis, prevention and treatment of diseases and clinical conditions associated with LOC220906. LOC222486 (Accession XM_169432) is another VGAM1169 host target gene. LOC222486 BINDING SITE is HOST TARGET binding site found in the 5' untranslated region of mRNA encoded by LOC222486, corresponding to a HOST TARGET binding site such as BINDING SITE I, BINDING SITE II or BINDING SITE III. Table 2 illustrates the complementarity of the nucleotide sequences of LOC222486 BINDING SITE, designated SEQ ID:45300, to the nucleotide sequence of VGAM1169 RNA, herein designated VGAM RNA, also designated SEQ ID:3880.

Another function of VGAM1169 is therefore inhibition of LOC222486 (Accession XM_169432). Accordingly, utilities of VGAM1169 include diagnosis, prevention and treatment of diseases and clinical conditions associated with LOC222486. LOC254532 (Accession XM_172961) is another VGAM1169 host target gene. LOC254532 BINDING SITE is HOST TARGET binding site found in the 5' untranslated region of mRNA encoded by LOC254532, corresponding to a HOST TARGET binding site such as BINDING SITE I, BINDING SITE II or BINDING SITE III. Table 2 illustrates the complementarity of the nucleotide sequences of LOC254532 BINDING SITE, designated SEQ ID:46212, to the nucleotide sequence of VGAM1169 RNA, herein designated VGAM RNA, also designated SEQ ID:3880.

Another function of VGAM1169 is therefore inhibition of LOC254532 (Accession XM_172961). Accordingly, utilities of VGAM1169 include diagnosis, prevention and treatment of diseases and clinical conditions associated with LOC254532. LOC256950 (Accession XM_170922) is another VGAM1169 host target gene. LOC256950 BINDING SITE is HOST TARGET binding site found in the 5' untranslated region of mRNA encoded by LOC256950, corresponding to a HOST TARGET binding site such as BINDING SITE I, BINDING SITE II or BINDING SITE III. Table 2 illustrates the complementarity of the nucleotide sequences of LOC256950 BINDING SITE, designated SEQ ID:45701, to the nucleotide sequence of VGAM1169 RNA, herein designated VGAM RNA, also designated SEQ ID:3880.

Another function of VGAM1169 is therefore inhibition of LOC256950 (Accession XM_170922). Accordingly, utilities of VGAM1169 include diagnosis, prevention and treatment of diseases and clinical conditions associated with LOC256950. LOC92299 (Accession XM_044075) is another VGAM1169 host target gene. LOC92299 BINDING SITE is HOST TARGET binding site found in the 5' untranslated region of mRNA encoded by LOC92299, corresponding to a HOST TARGET binding site such as BINDING SITE I, BINDING SITE II or BINDING SITE III. Table 2 illustrates the complementarity of the nucleotide sequences of LOC92299 BINDING SITE, designated SEQ ID:34131, to the nucleotide sequence of VGAM1169 RNA, herein designated VGAM RNA, also designated SEQ ID:3880.

Another function of VGAM1169 is therefore inhibition of LOC92299 (Accession XM_044075). Accordingly, utilities of VGAM1169 include diagnosis, prevention and treatment of diseases and clinical conditions associated with LOC92299. LOC92973 (Accession XM_048529) is another VGAM1169 host target gene. LOC92973 BINDING SITE is HOST TARGET binding site found in the 5' untranslated region of mRNA encoded by LOC92973, corresponding to a HOST TARGET binding site such as BINDING SITE I, BINDING SITE II or BINDING SITE III. Table 2 illustrates the complementarity of the nucleotide sequences of LOC92973 BINDING SITE, designated SEQ ID:35185, to the nucleotide sequence of VGAM1169 RNA, herein designated VGAM RNA, also designated SEQ ID:3880.

Another function of VGAM1169 is therefore inhibition of LOC92973 (Accession XM_048529). Accordingly, utilities of VGAM1169 include diagnosis, prevention and treatment of diseases and clinical conditions associated with LOC92973. FIG. 1 further provides a conceptual description of a novel bioinformatically detected viral gene of the present invention, referred to here as Viral Genomic Address Messenger 1170 (VGAM1170) viral gene, which modulates expression of respective host target genes thereof, the function and utility of which host target genes is known in the art.

VGAM1170 is a novel bioinformatically detected regulatory, non protein coding, viral micro RNA (miRNA) gene. The method by which VGAM1170 was detected is described hereinabove with reference to FIGS. 1-8.

VGAM1170 gene, herein designated VGAM GENE, is a viral gene contained in the genome of Melanoplus Sanguinipes Entomopoxvirus. VGAM1170 host target gene, herein designated VGAM HOST TARGET GENE, is a human gene contained in the human genome.

VGAM1170 gene encodes a VGAM1170 precursor RNA, herein designated VGAM PRECURSOR RNA. Similar to other miRNA genes, and unlike most ordinary genes, VGAM1170 precursor RNA does not encode a protein. A nucleotide sequence identical or highly similar to the nucleotide sequence of VGAM1170 precursor RNA is designated SEQ ID:1156, and is provided hereinbelow with reference to the sequence listing part. Nucleotide sequence SEQ ID:1156 is located at position 35824 relative to the genome of Melanoplus Sanguinipes Entomopoxvirus.

VGAM1170 precursor RNA folds onto itself, forming VGAM1170 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1170 folded precursor RNA into VGAM1170 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1170 RNA is designated SEQ ID:3881, and is provided hereinbelow with reference to the sequence listing part.

VGAM1170 host target gene, herein designated VGAM HOST TARGET GENE, encodes a corresponding messenger RNA, VGAM1170 host target RNA, herein designated VGAM HOST TARGET RNA. VGAM1170 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1170 RNA, herein designated VGAM RNA, binds complementarily to one or more host target binding sites located in untranslated regions of VGAM1170 host target RNA, herein designated VGAM HOST TARGET RNA. This complementary binding is due to the fact that the nucleotide sequence of VGAM1170 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1170 RNA, herein designated VGAM RNA, may have a different number of host target binding sites in untranslated regions of a VGAM1170 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1170 RNA, herein designated VGAM RNA, to host target binding sites on VGAM1170 host target RNA, herein designated VGAM HOST TARGET RNA, such as BINDING SITE I, BINDING SITE II and BINDING SITE III, inhibits translation of VGAM1170 host target RNA into VGAM1170 host target protein, herein designated VGAM HOST TARGET PROTEIN. VGAM host target protein is therefore outlined by a broken line.

It is appreciated that VGAM1170 host target gene, herein designated VGAM HOST TARGET GENE, in fact represents a plurality of VGAM1170 host target genes. The mRNA of each one of this plurality of VGAM1170 host target genes comprises one or more host target binding sites, each having a nucleotide sequence which is at least partly complementary to VGAM1170 RNA, herein designated VGAM RNA, and which when bound by VGAM1170 RNA causes inhibition of translation of respective one or more VGAM1170 host target proteins.

It is further appreciated by one skilled in the art that the mode of translational inhibition illustrated by FIG. 1 with specific reference to translational inhibition exerted by VGAM1170 gene, herein designated VGAM GENE, on one or more VGAM1170 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1170 is inhibition of expression of host target genes, as part of a novel viral mechanism of attacking a host. Accordingly, utilities of VGAM1170 include diagnosis, prevention and treatment of viral infection by Melanoplus Sanguinipes Entomopoxvirus. Specific functions, and accordingly utilities, of VGAM1170 correlate with, and may be deduced from, the identity of the host target genes which VGAM1170 binds and inhibits, and the function of these host target genes, as elaborated hereinbelow.

Nucleotide sequences of the VGAM1170 precursor RNA, herein designated VGAM PRECURSOR RNA, and of the 'diced' VGAM1170 RNA, herein designated VGAM RNA, and a schematic representation of the secondary folding of VGAM1170 folded precursor RNA, herein designated VGAM FOLDED PRECURSOR RNA, of VGAM1170 are further described hereinbelow with reference to Table 1.

Nucleotide sequences of host target binding sites, such as BINDING SITE-I, BINDING SITE-II and BINDING SITE-III of FIG. 1, found on VGAM1170 host target RNA, and schematic representation of the complementarity of each of these host target binding sites to VGAM1170 RNA, herein designated VGAM RNA, are described hereinbelow with reference to Table 2.

As mentioned hereinabove with reference to FIG. 1, a function of VGAM1170 gene, herein designated VGAM is inhibition of expression of VGAM1170 target genes. It is appreciated that specific functions, and accordingly utilities, of VGAM1170 correlate with, and may be deduced from, the identity of the target genes which VGAM1170 binds and inhibits, and the function of these target genes, as elaborated hereinbelow.

UDP-Gal:betaGlcNAc Beta 1,3-galactosyltransferase, Polypeptide 5 (B3GALT5, Accession NM_033173) is a VGAM1170 host target gene. B3GALT5 BINDING SITE1 through B3GALT5 BINDING SITE5 are HOST TARGET binding sites found in untranslated regions of mRNA encoded by B3GALT5, corresponding to HOST TARGET binding sites such as BINDING SITE I, BINDING SITE II or BINDING SITE III. Table 2 illustrates the complementarity of the nucleotide sequences of B3GALT5 BINDING SITE1 through B3GALT5 BINDING SITE5, designated SEQ ID:27037, SEQ ID:12699, SEQ ID:27022, SEQ ID:27027 and SEQ ID:27032 respectively, to the nucleotide sequence of VGAM1170 RNA, herein designated VGAM RNA, also designated SEQ ID:3881.

A function of VGAM1170 is therefore inhibition of UDP-Gal:betaGlcNAc Beta 1,3-galactosyltransferase, Polypeptide 5 (B3GALT5, Accession NM_033173). Accordingly, utilities of VGAM1170 include diagnosis, prevention and treatment of diseases and clinical conditions associated with B3GALT5. DKFZP434L187 (Accession XM_044070) is another VGAM1170 host target gene. DKFZP434L187 BINDING SITE is HOST TARGET binding site found in the 5' untranslated region of mRNA encoded by DKFZP434L187, corresponding to a HOST TARGET binding site such as BINDING SITE I, BINDING SITE II or BINDING SITE III. Table 2 illustrates the complementarity of the nucleotide sequences of DKFZP434L187 BINDING SITE, designated SEQ ID:34118, to the nucleotide sequence of VGAM1170 RNA, herein designated VGAM RNA, also designated SEQ ID:3881.

Another function of VGAM1170 is therefore inhibition of DKFZP434L187 (Accession XM_044070). Accordingly, utilities of VGAM1170 include diagnosis, prevention and treatment of diseases and clinical conditions associated with DKFZP434L187. NCUBE1 (Accession NM_016021) is another VGAM1170 host target gene. NCUBE1 BINDING SITE is HOST TARGET binding site found in the 3' untranslated region of mRNA encoded by NCUBE1, corresponding to a HOST TARGET binding site such as BINDING SITE I, BINDING SITE II or BINDING SITE III. Table 2 illustrates the complementarity of the nucleotide sequences of NCUBE1 BINDING SITE, designated SEQ ID:18092, to the nucleotide sequence of VGAM1170 RNA, herein designated VGAM RNA, also designated SEQ ID:3881.

Another function of VGAM1170 is therefore inhibition of NCUBE1 (Accession NM_016021). Accordingly, utilities of VGAM1170 include diagnosis, prevention and treatment of diseases and clinical conditions associated with NCUBE1. LOC145773 (Accession XM_085237) is another VGAM1170 host target gene. LOC145773 BINDING SITE is HOST TARGET binding site found in the 3' untranslated region of mRNA encoded by LOC145773, corresponding to a HOST TARGET binding site such as BINDING SITE I, BINDING SITE II or BINDING SITE III. Table 2 illustrates the complementarity of the nucleotide sequences of LOC145773 BINDING SITE, designated SEQ ID:37983, to the nucleotide sequence of VGAM1170 RNA, herein designated VGAM RNA, also designated SEQ ID:3881.

Another function of VGAM1170 is therefore inhibition of LOC145773 (Accession XM_085237). Accordingly, utilities of VGAM1170 include diagnosis, prevention and treatment of diseases and clinical conditions associated with LOC145773. LOC145899 (Accession XM_096899) is another VGAM1170 host target gene. LOC145899 BINDING SITE is HOST TARGET binding site found in the 5' untranslated region of mRNA encoded by LOC145899, corresponding to a HOST TARGET binding site such as BINDING SITE I, BINDING SITE II or BINDING SITE III. Table 2 illustrates the complementarity of the nucleotide sequences of LOC145899 BINDING SITE, designated SEQ ID:40623, to the nucleotide sequence of VGAM1170 RNA, herein designated VGAM RNA, also designated SEQ ID:3881.

Another function of VGAM1170 is therefore inhibition of LOC145899 (Accession XM_096899). Accordingly, utilities of VGAM1170 include diagnosis, prevention and treatment of diseases and clinical conditions associated with LOC145899. FIG. 1 further provides a conceptual description of a novel bioinformatically detected viral gene of the present invention, referred to here as Viral Genomic Address Messenger 1171 (VGAM1171) viral gene, which modulates expression of respective host target genes thereof, the function and utility of which host target genes is known in the art.

VGAM1171 is a novel bioinformatically detected regulatory, non protein coding, viral micro RNA (miRNA) gene. The method by which VGAM1171 was detected is described hereinabove with reference to FIGS. 1-8.

VGAM1171 gene, herein designated VGAM GENE, is a viral gene contained in the genome of Cucumber Fruit Mottle Mosaic Virus. VGAM1171 host target gene, herein designated VGAM HOST TARGET GENE, is a human gene contained in the human genome.

VGAM1171 gene encodes a VGAM1171 precursor RNA, herein designated VGAM PRECURSOR RNA. Similar to other miRNA genes, and unlike most ordinary genes, VGAM1171 precursor RNA does not encode a protein. A nucleotide sequence identical or highly similar to the nucleotide sequence of VGAM1171 precursor RNA is designated SEQ ID:1157, and is provided hereinbelow with reference to the sequence listing part. Nucleotide sequence SEQ ID:1157 is located at position 4341 relative to the genome of Cucumber Fruit Mottle Mosaic Virus.

VGAM1171 precursor RNA folds onto itself, forming VGAM1171 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1171 folded precursor RNA into VGAM1171 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1171 RNA is designated SEQ ID:3882, and is provided hereinbelow with reference to the sequence listing part.

VGAM1171 host target gene, herein designated VGAM HOST TARGET GENE, encodes a corresponding messenger RNA, VGAM1171 host target RNA, herein designated VGAM HOST TARGET RNA. VGAM1171 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1171 RNA, herein designated VGAM RNA, binds complementarily to one or more host target binding sites located in untranslated regions of VGAM1171 host target RNA, herein designated VGAM HOST TARGET RNA. This complementary binding is due to the fact that the nucleotide sequence of VGAM1171 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1171 RNA, herein designated VGAM RNA, may have a different number of host target binding sites in untranslated regions of a VGAM1171 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1171 RNA, herein designated VGAM RNA, to host target binding sites on VGAM1171 host target RNA, herein designated VGAM HOST TARGET RNA, such as BINDING SITE I, BINDING SITE II and BINDING SITE III, inhibits translation of VGAM1171 host target RNA into VGAM1171 host target protein, herein designated VGAM HOST TARGET PROTEIN. VGAM host target protein is therefore outlined by a broken line.

It is appreciated that VGAM1171 host target gene, herein designated VGAM HOST TARGET GENE, in fact represents a plurality of VGAM1171 host target genes. The mRNA of each one of this plurality of VGAM1171 host target genes comprises one or more host target binding sites, each having a nucleotide sequence which is at least partly complementary to VGAM1171 RNA, herein designated VGAM RNA, and which when bound by VGAM1171 RNA causes inhibition of translation of respective one or more VGAM1171 host target proteins.

It is further appreciated by one skilled in the art that the mode of translational inhibition illustrated by FIG. 1 with specific reference to translational inhibition exerted by VGAM1171 gene, herein designated VGAM GENE, on one or more VGAM1171 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1171 is inhibition of expression of host target genes, as part of a novel viral mechanism of attacking a host. Accordingly, utilities of VGAM1171 include diagnosis, prevention and treatment of viral infection by Cucumber Fruit Mottle Mosaic Virus. Specific functions, and accordingly utilities, of VGAM1171 correlate with, and may be deduced from, the identity of the host target genes which VGAM1171 binds and inhibits, and the function of these host target genes, as elaborated hereinbelow.

Nucleotide sequences of the VGAM1171 precursor RNA, herein designated VGAM PRECURSOR RNA, and of the 'diced' VGAM1171 RNA, herein designated VGAM RNA, and a schematic representation of the secondary folding of VGAM1171 folded precursor RNA, herein designated VGAM FOLDED PRECURSOR RNA, of VGAM1171 are further described hereinbelow with reference to Table 1.

Nucleotide sequences of host target binding sites, such as BINDING SITE-I, BINDING SITE-II and BINDING SITE-III of FIG. 1, found on VGAM1171 host target RNA, and schematic representation of the complementarity of each of these host target binding sites to VGAM1171 RNA, herein designated VGAM RNA, are described hereinbelow with reference to Table 2.

As mentioned hereinabove with reference to FIG. 1, a function of VGAM1171 gene, herein designated VGAM is inhibition of expression of VGAM1171 target genes. It is appreciated that specific functions, and accordingly utilities, of VGAM1171 correlate with, and may be deduced from, the identity of the target genes which VGAM1171 binds and inhibits, and the function of these target genes, as elaborated hereinbelow.

AXL Receptor Tyrosine Kinase (AXL, Accession NM_001699) is a VGAM1171 host target gene. AXL BINDING SITE1 and AXL BINDING SITE2 are HOST TARGET binding sites found in untranslated regions of mRNA encoded by AXL, corresponding to HOST TARGET binding sites such as BINDING SITE I, BINDING SITE II or BINDING SITE III. Table 2 illustrates the complementarity of the nucleotide sequences of AXL BINDING SITE1 and AXL BINDING SITE2, designated SEQ ID:7418 and SEQ ID:22439 respectively, to the nucleotide sequence of VGAM1171 RNA, herein designated VGAM RNA, also designated SEQ ID:3882.

A function of VGAM1171 is therefore inhibition of AXL Receptor Tyrosine Kinase (AXL, Accession NM_001699). Accordingly, utilities of VGAM1171 include diagnosis, prevention and treatment of diseases and clinical conditions associated with AXL. Regulator of G-protein Signalling 5 (RGS5, Accession NM_003617) is another VGAM1171 host target gene. RGS5 BINDING SITE is HOST TARGET binding site found in the 3' untranslated region of mRNA encoded by RGS5, corresponding to a HOST TARGET binding site such as BINDING SITE I, BINDING SITE II or BINDING SITE III. Table 2 illustrates the complementarity of the nucleotide sequences of RGS5 BINDING SITE, designated SEQ ID:9677, to the nucleotide sequence of VGAM1171 RNA, herein designated VGAM RNA, also designated SEQ ID:3882.

Another function of VGAM1171 is therefore inhibition of Regulator of G-protein Signalling 5 (RGS5, Accession NM_003617). Accordingly, utilities of VGAM1171 include diagnosis, prevention and treatment of diseases and clinical conditions associated with RGS5. KIAA0298 (Accession XM_084529) is another VGAM1171 host target gene. KIAA0298 BINDING SITE is HOST TARGET binding site found in the 3' untranslated region of mRNA encoded by KIAA0298, corresponding to a HOST TARGET binding site such as BINDING SITE I, BINDING SITE II or BINDING SITE III. Table 2 illustrates the complementarity of the nucleotide sequences of KIAA0298 BINDING SITE, designated SEQ ID:37624, to the nucleotide sequence of VGAM1171 RNA, herein designated VGAM RNA, also designated SEQ ID:3882.

Another function of VGAM1171 is therefore inhibition of KIAA0298 (Accession XM_084529). Accordingly, utilities of VGAM1171 include diagnosis, prevention and treatment of diseases and clinical conditions associated with KIAA0298. KIAA1229 (Accession XM_030665) is another VGAM1171 host target gene. KIAA1229 BINDING SITE is HOST TARGET binding site found in the 3' untranslated region of mRNA encoded by KIAA1229, corresponding to a HOST TARGET binding site such as BINDING SITE I, BINDING SITE II or BINDING SITE III. Table 2 illustrates the complementarity of the nucleotide sequences of KIAA1229 BINDING SITE, designated SEQ ID:31094, to the nucleotide sequence of VGAM1171 RNA, herein designated VGAM RNA, also designated SEQ ID:3882.

Another function of VGAM1171 is therefore inhibition of KIAA1229 (Accession XM_030665). Accordingly, utilities of VGAM1171 include diagnosis, prevention and treatment of diseases and clinical conditions associated with KIAA1229. LOC129607 (Accession XM_059368) is another VGAM1171 host target gene. LOC129607 BINDING SITE is HOST TARGET binding site found in the 3' untranslated region of mRNA encoded by LOC129607, corresponding to a HOST TARGET binding site such as BINDING SITE I, BINDING SITE II or BINDING SITE III. Table 2 illustrates the complementarity of the nucleotide sequences of LOC129607 BINDING SITE, designated SEQ ID:36972, to the nucleotide sequence of VGAM1171 RNA, herein designated VGAM RNA, also designated SEQ ID:3882.

Another function of VGAM1171 is therefore inhibition of LOC129607 (Accession XM_059368). Accordingly, utilities of VGAM1171 include diagnosis, prevention and treatment of diseases and clinical conditions associated with LOC129607. LOC130639 (Accession XM_059464) is another VGAM1171 host target gene. LOC130639 BINDING SITE is HOST TARGET binding site found in the 5' untranslated region of mRNA encoded by LOC130639, corresponding to a HOST TARGET binding site such as BINDING SITE I, BINDING SITE II or BINDING SITE III. Table 2 illustrates the complementarity of the nucleotide sequences of LOC130639 BINDING SITE, designated SEQ ID:37001, to the nucleotide sequence of VGAM1171 RNA, herein designated VGAM RNA, also designated SEQ ID:3882.

Another function of VGAM1171 is therefore inhibition of LOC130639 (Accession XM_059464). Accordingly, utilities of VGAM1171 include diagnosis, prevention and treatment of diseases and clinical conditions associated with LOC130639. LOC200339 (Accession XM_117226) is another VGAM1171 host target gene. LOC200339 BINDING SITE is HOST TARGET binding site found in the 3' untranslated region of mRNA encoded by LOC200339, corresponding to a HOST TARGET binding site such as BINDING SITE I, BINDING SITE II or BINDING SITE III. Table 2 illustrates the complementarity of the nucleotide sequences of LOC200339 BINDING SITE, designated SEQ ID:43297, to the nucleotide sequence of VGAM1171 RNA, herein designated VGAM RNA, also designated SEQ ID:3882.

Another function of VGAM1171 is therefore inhibition of LOC200339 (Accession XM_117226). Accordingly, utilities of VGAM1171 include diagnosis, prevention and treatment of diseases and clinical conditions associated with LOC200339. LOC257465 (Accession XM_088384) is another VGAM1171 host target gene. LOC257465 BINDING SITE is HOST TARGET binding site found in the 3' untranslated region of mRNA encoded by LOC257465, corresponding to a HOST TARGET binding site such as BIND- ING SITE I, BINDING SITE II or BINDING SITE III. Table 2 illustrates the complementarity of the nucleotide sequences of LOC257465 BINDING SITE, designated SEQ ID:39664, to the nucleotide sequence of VGAM1171 RNA, herein designated VGAM RNA, also designated SEQ ID:3882.

Another function of VGAM1171 is therefore inhibition of LOC257465 (Accession XM_088384). Accordingly, utilities of VGAM1171 include diagnosis, prevention and treatment of diseases and clinical conditions associated with LOC257465. FIG. 1 further provides a conceptual description of a novel bioinformatically detected viral gene of the present invention, referred to here as Viral Genomic Address Messenger 1172 (VGAM1172) viral gene, which modulates expression of respective host target genes thereof, the function and utility of which host target genes is known in the art.

VGAM1172 is a novel bioinformatically detected regulatory, non protein coding, viral micro RNA (miRNA) gene. The method by which VGAM1172 was detected is described hereinabove with reference to FIGS. 1-8.

VGAM1172 gene, herein designated VGAM GENE, is a viral gene contained in the genome of Cucumber Fruit Mottle Mosaic Virus. VGAM1172 host target gene, herein designated VGAM HOST TARGET GENE, is a human gene contained in the human genome.

VGAM1172 gene encodes a VGAM1172 precursor RNA, herein designated VGAM PRECURSOR RNA. Similar to other miRNA genes, and unlike most ordinary genes, VGAM1172 precursor RNA does not encode a protein. A nucleotide sequence identical or highly similar to the nucleotide sequence of VGAM1172 precursor RNA is designated SEQ ID:1158, and is provided hereinbelow with reference to the sequence listing part. Nucleotide sequence SEQ ID:1158 is located at position 5778 relative to the genome of Cucumber Fruit Mottle Mosaic Virus.

VGAM1172 precursor RNA folds onto itself, forming VGAM1172 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1172 folded precursor RNA into VGAM1172 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1172 RNA is designated SEQ ID:3883, and is provided hereinbelow with reference to the sequence listing part.

VGAM1172 host target gene, herein designated VGAM HOST TARGET GENE, encodes a corresponding messenger RNA, VGAM1172 host target RNA, herein designated VGAM HOST TARGET RNA. VGAM1172 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1172 RNA, herein designated VGAM RNA, binds complementarily to one or more host target binding sites located in untranslated regions of VGAM1172 host target RNA, herein designated VGAM HOST TARGET RNA. This complementary binding is due to the fact that the nucleotide sequence of VGAM1172 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1172 RNA, herein designated VGAM RNA, may have a different number of host target binding sites in untranslated regions of a VGAM1172 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1172 RNA, herein designated VGAM RNA, to host target binding sites on VGAM1172 host target RNA, herein designated VGAM HOST TARGET RNA, such as BINDING SITE I, BINDING SITE II and BINDING SITE III, inhibits translation of VGAM1172 host target RNA into VGAM1172 host target protein, herein designated VGAM HOST TARGET PROTEIN. VGAM host target protein is therefore outlined by a broken line.

It is appreciated that VGAM1172 host target gene, herein designated VGAM HOST TARGET GENE, in fact represents a plurality of VGAM1172 host target genes. The mRNA of each one of this plurality of VGAM1172 host target genes comprises one or more host target binding sites, each having a nucleotide sequence which is at least partly complementary to VGAM1172 RNA, herein designated VGAM RNA, and which when bound by VGAM1172 RNA causes inhibition of translation of respective one or more VGAM1172 host target proteins.

It is further appreciated by one skilled in the art that the mode of translational inhibition illustrated by FIG. 1 with specific reference to translational inhibition exerted by VGAM1172 gene, herein designated VGAM GENE, on one or more VGAM1172 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1172 is inhibition of expression of host target genes, as part of a novel viral mechanism of attacking a host. Accordingly, utilities of VGAM1172 include diagnosis, prevention and treatment of viral infection by Cucumber Fruit Mottle Mosaic Virus. Specific functions, and accordingly utilities, of VGAM1172 correlate with, and may be deduced from, the identity of the host target genes which VGAM1172 binds and inhibits, and the function of these host target genes, as elaborated hereinbelow.

Nucleotide sequences of the VGAM1172 precursor RNA, herein designated VGAM PRECURSOR RNA, and of the 'diced' VGAM1172 RNA, herein designated VGAM RNA, and a schematic representation of the secondary folding of VGAM1172 folded precursor RNA, herein designated VGAM FOLDED PRECURSOR RNA, of VGAM1172 are further described hereinbelow with reference to Table 1.

Nucleotide sequences of host target binding sites, such as BINDING SITE-I, BINDING SITE-II and BINDING SITE-III of FIG. 1, found on VGAM1172 host target RNA, and schematic representation of the complementarity of each of these host target binding sites to VGAM1172 RNA, herein designated VGAM RNA, are described hereinbelow with reference to Table 2.

As mentioned hereinabove with reference to FIG. 1, a function of VGAM1172 gene, herein designated VGAM is inhibition of expression of VGAM1172 target genes. It is appreciated that specific functions, and accordingly utilities, of VGAM1172 correlate with, and may be deduced from, the identity of the target genes which VGAM1172 binds and inhibits, and the function of these target genes, as elaborated hereinbelow.

F-box and Leucine-rich Repeat Protein 3A (FBXL3A, Accession NM_012158) is a VGAM1172 host target gene. FBXL3A BINDING SITE is HOST TARGET binding site found in the 3' untranslated region of mRNA encoded by FBXL3A, corresponding to a HOST TARGET binding site such as BINDING SITE I, BINDING SITE II or BINDING SITE III. Table 2 illustrates the complementarity of the nucleotide sequences of FBXL3A BINDING SITE, designated SEQ ID:14456, to the nucleotide sequence of VGAM1172 RNA, herein designated VGAM RNA, also designated SEQ ID:3883.

A function of VGAM1172 is therefore inhibition of F-box and Leucine-rich Repeat Protein 3A (FBXL3A, Accession NM_012158), a gene which is a putative SCF ubiquitin ligase subunit involved in protein degradation. Accordingly, utilities of VGAM1172 include diagnosis, prevention and treatment of diseases and clinical conditions associated with FBXL3A. The function of FBXL3A has been established by previous studies. The F box, named after cyclin F (CCNF; 600227), in which it was originally observed, is an approximately 40-amino acid motif that binds SKP1 (OMIM Ref. No. 601434). F-box proteins are components of modular E3 ubiquitin protein ligases called SCFs (SKP1, OMIM Ref. No. 603134), F-box proteins), which function in phosphorylation-dependent ubiquitination. Using a yeast 2-hybrid screen with SKP1 as bait, followed by searching sequence databases, Winston et al. (1999) and Cenciarelli et al. (1999) identified 33 mammalian and 26 human F-box proteins, respectively. These contained C termini with leucine-rich repeats (FBXLs, e.g., SKP2 (OMIM Ref. No. 601436)), WD40 domains (FBXWs, e.g., BTRCP (OMIM Ref. No. 603482)), or no recognizable motifs (FBXOs, e.g., CCNF). By Northern blot analysis, Cenciarelli et al. (1999) found ubiquitous expression of an approximately 4.4-kb FBXL3A transcript. Immunofluorescence microscopy demonstrated nuclear localization for both wildtype FBXL3A and mutant FBXL3A lacking the F box.

Full details of the abovementioned studies are described in the following publications, the disclosure of which are hereby incorporated by reference:

Cenciarelli, C.; Chiaur, D. S.; Guardavaccaro, D.; Parks, W.; Vidal, M.; Pagano, M.: Identification of a family of human F-box proteins. Curr. Biol. 9:1177-1179, 1999; and Chiaur, D. S.; Murthy, S.; Cenciarelli, C.; Parks, W.; Loda, M.; Inghirami, G.; Demetrick, D.; Pagano, M.: Five human genes encoding F-box proteins: chromosome mapping and analysis in.

Further studies establishing the function and utilities of FBXL3A are found in John Hopkins OMIM database record ID 605653, and in sited publications numbered 40 and 416 listed in the bibliography section hereinbelow, which are also hereby incorporated by reference. Cat Eye Syndrome Chromosome Region, Candidate 1 (CECR1, Accession NM_017424) is another VGAM1172 host target gene. CECR1 BINDING SITE is HOST TARGET binding site found in the 3' untranslated region of mRNA encoded by CECR1, corresponding to a HOST TARGET binding site such as BINDING SITE I, BINDING SITE II or BINDING SITE III. Table 2 illustrates the complementarity of the nucleotide sequences of CECR1 BINDING SITE, designated SEQ ID:18881, to the nucleotide sequence of VGAM1172 RNA, herein designated VGAM RNA, also designated SEQ ID:3883.

Another function of VGAM1172 is therefore inhibition of Cat Eye Syndrome Chromosome Region, Candidate 1 (CECR1, Accession NM_017424). Accordingly, utilities of VGAM1172 include diagnosis, prevention and treatment of diseases and clinical conditions associated with CECR1. Cortactin Binding Protein 2 (CORTBP2, Accession NM_033427) is another VGAM1172 host target gene. CORTBP2 BINDING SITE is HOST TARGET binding site found in the 3' untranslated region of mRNA encoded by CORTBP2, corresponding to a HOST TARGET binding site such as BINDING SITE I, BINDING SITE II or BINDING SITE III. Table 2 illustrates the complementarity of the nucleotide sequences of CORTBP2 BINDING SITE, designated SEQ ID:27250, to the nucleotide sequence of VGAM1172 RNA, herein designated VGAM RNA, also designated SEQ ID:3883.

Another function of VGAM1172 is therefore inhibition of Cortactin Binding Protein 2 (CORTBP2, Accession NM_033427). Accordingly, utilities of VGAM1172 include diagnosis, prevention and treatment of diseases and clinical conditions associated with CORTBP2. KIAA1900 (Accession XM_055299) is another VGAM1172 host target gene. KIAA1900 BINDING SITE is HOST TARGET binding site found in the 3' untranslated region of mRNA encoded by KIAA1900, corresponding to a HOST TARGET binding site such as BINDING SITE I, BINDING SITE II or BINDING SITE III. Table 2 illustrates the complementarity of the nucleotide sequences of KIAA1900 BINDING SITE, designated SEQ ID:36257, to the nucleotide sequence of VGAM1172 RNA, herein designated VGAM RNA, also designated SEQ ID:3883.

Another function of VGAM1172 is therefore inhibition of KIAA1900 (Accession XM_055299). Accordingly, utilities of VGAM1172 include diagnosis, prevention and treatment of diseases and clinical conditions associated with KIAA1900. Makorin, Ring Finger Protein, 2 (MKRN2, Accession XM_051580) is another VGAM1172 host target gene. MKRN2 BINDING SITE is HOST TARGET binding site found in the 3' untranslated region of mRNA encoded by MKRN2, corresponding to a HOST TARGET binding site such as BINDING SITE I, BINDING SITE II or BINDING SITE III. Table 2 illustrates the complementarity of the nucleotide sequences of MKRN2 BINDING SITE, designated SEQ ID:35856, to the nucleotide sequence of VGAM1172 RNA, herein designated VGAM RNA, also designated SEQ ID:3883.

Another function of VGAM1172 is therefore inhibition of Makorin, Ring Finger Protein, 2 (MKRN2, Accession XM_051580). Accordingly, utilities of VGAM1172 include diagnosis, prevention and treatment of diseases and clinical conditions associated with MKRN2. LOC144182 (Accession NM_139136) is another VGAM1172 host target gene. LOC144182 BINDING SITE is HOST TARGET binding site found in the 3' untranslated region of mRNA encoded by LOC144182, corresponding to a HOST TARGET binding site such as BINDING SITE I, BINDING SITE II or BINDING SITE III. Table 2 illustrates the complementarity of the nucleotide sequences of LOC144182 BINDING SITE, designated SEQ ID:29168, to the nucleotide sequence of VGAM1172 RNA, herein designated VGAM RNA, also designated SEQ ID:3883.

Another function of VGAM1172 is therefore inhibition of LOC144182 (Accession NM_139136). Accordingly, utilities of VGAM1172 include diagnosis, prevention and treatment of diseases and clinical conditions associated with LOC144182. LOC151878 (Accession XM_087329) is another VGAM1172 host target gene. LOC151878 BINDING SITE is HOST TARGET binding site found in the 5' untranslated region of mRNA encoded by LOC151878, corresponding to a HOST TARGET binding site such as BINDING SITE I, BINDING SITE II or BINDING SITE III. Table 2 illustrates the complementarity of the nucleotide sequences of LOC151878 BINDING SITE, designated SEQ ID:39171, to the nucleotide sequence of VGAM1172 RNA, herein designated VGAM RNA, also designated SEQ ID:3883.

Another function of VGAM1172 is therefore inhibition of LOC151878 (Accession XM_087329). Accordingly, utilities of VGAM1172 include diagnosis, prevention and treatment of diseases and clinical conditions associated with LOC151878. FIG. 1 further provides a conceptual description of a novel bioinformatically detected viral gene of the present invention, referred to here as Viral Genomic Address Messenger 1173 (VGAM1173) viral gene, which modulates expression of respective host target genes thereof, the function and utility of which host target genes is known in the art.

VGAM1173 is a novel bioinformatically detected regulatory, non protein coding, viral micro RNA (miRNA) gene. The method by which VGAM1173 was detected is described hereinabove with reference to FIGS. 1-8.

VGAM1173 gene, herein designated VGAM GENE, is a viral gene contained in the genome of Cucumber Fruit Mottle Mosaic Virus. VGAM1173 host target gene, herein designated VGAM HOST TARGET GENE, is a human gene contained in the human genome.

VGAM1173 gene encodes a VGAM1173 precursor RNA, herein designated VGAM PRECURSOR RNA. Similar to other miRNA genes, and unlike most ordinary genes, VGAM1173 precursor RNA does not encode a protein. A nucleotide sequence identical or highly similar to the nucleotide sequence of VGAM1173 precursor RNA is designated SEQ ID:1159, and is provided hereinbelow with reference to the sequence listing part. Nucleotide sequence SEQ ID:1159 is located at position 5471 relative to the genome of Cucumber Fruit Mottle Mosaic Virus.

VGAM1173 precursor RNA folds onto itself, forming VGAM1173 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1173 folded precursor RNA into VGAM1173 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM1173 RNA is designated SEQ ID:3884, and is provided hereinbelow with reference to the sequence listing part.

VGAM1173 host target gene, herein designated VGAM HOST TARGET GENE, encodes a corresponding messenger RNA, VGAM1173 host target RNA, herein designated VGAM HOST TARGET RNA. VGAM1173 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1173 RNA, herein designated VGAM RNA, binds complementarily to one or more host target binding sites located in untranslated regions of VGAM1173 host target RNA, herein designated VGAM HOST TARGET RNA. This complementary binding is due to the fact that the nucleotide sequence of VGAM1173 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1173 RNA, herein designated VGAM RNA, may have a different number of host target binding sites in untranslated regions of a VGAM1173 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1173 RNA, herein designated VGAM RNA, to host target binding sites on VGAM1173 host target RNA, herein designated VGAM HOST TARGET RNA, such as BINDING SITE I, BINDING SITE II and BINDING SITE III, inhibits translation of VGAM1173 host target RNA into VGAM1173 host target protein, herein designated VGAM HOST TARGET PROTEIN. VGAM host target protein is therefore outlined by a broken line.

It is appreciated that VGAM1173 host target gene, herein designated VGAM HOST TARGET GENE, in fact represents a plurality of VGAM1173 host target genes. The mRNA of each one of this plurality of VGAM1173 host target genes comprises one or more host target binding sites, each having a nucleotide sequence which is at least partly complementary to VGAM1173 RNA, herein designated VGAM RNA, and which when bound by VGAM1173 RNA causes inhibition of translation of respective one or more VGAM1173 host target proteins.

It is further appreciated by one skilled in the art that the mode of translational inhibition illustrated by FIG. 1 with specific reference to translational inhibition exerted by VGAM1173 gene, herein designated VGAM GENE, on one or more VGAM1173 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1173 is inhibition of expression of host target genes, as part of a novel viral mechanism of attacking a host. Accordingly, utilities of VGAM1173 include diagnosis, prevention and treatment of viral infection by Cucumber Fruit Mottle Mosaic Virus. Specific functions, and accordingly utilities, of VGAM1173 correlate with, and may be deduced from, the identity of the host target genes which VGAM1173 binds and inhibits, and the function of these host target genes, as elaborated hereinbelow.

Nucleotide sequences of the VGAM1173 precursor RNA, herein designated VGAM PRECURSOR RNA, and of the 'diced' VGAM1173 RNA, herein designated VGAM RNA, and a schematic representation of the secondary folding of VGAM1173 folded precursor RNA, herein designated VGAM FOLDED PRECURSOR RNA, of VGAM1173 are further described hereinbelow with reference to Table 1.

Nucleotide sequences of host target binding sites, such as BINDING SITE-I, BINDING SITE-II and BINDING SITE-III of FIG. 1, found on VGAM1173 host target RNA, and schematic representation of the complementarity of each of these host target binding sites to VGAM1173 RNA, herein designated VGAM RNA, are described hereinbelow with reference to Table 2.

As mentioned hereinabove with reference to FIG. 1, a function of VGAM1173 gene, herein designated VGAM is inhibition of expression of VGAM1173 target genes. It is appreciated that specific functions, and accordingly utilities, of VGAM1173 correlate with, and may be deduced from, the identity of the target genes which VGAM1173 binds and inhibits, and the function of these target genes, as elaborated hereinbelow.

A Disintegrin-like and Metalloprotease (reprolysin type) with Thrombospondin Type 1 Motif, 13 (ADAMTS13, Accession NM_139025) is a VGAM1173 host target gene. ADAMTS13 BINDING SITE1 through ADAMTS13 BINDING SITE3 are HOST TARGET binding sites found in untranslated regions of mRNA encoded by ADAMTS13, corresponding to HOST TARGET binding sites such as BINDING SITE I, BINDING SITE II or BINDING SITE III. Table 2 illustrates the complementarity of the nucleotide sequences of ADAMTS13 BINDING SITE1 through ADAMTS13 BINDING SITE3, designated SEQ ID:29125, SEQ ID:29127 and SEQ ID:29131 respectively, to the nucleotide sequence of VGAM1173 RNA, herein designated VGAM RNA, also designated SEQ ID:3884.

A function of VGAM1173 is therefore inhibition of A Disintegrin-like and Metalloprotease (reprolysin type) with Thrombospondin Type 1 Motif, 13 (ADAMTS13, Accession NM_139025), a gene which cleaves aggrecan, a cartilage proteoglycan, and may be involved in its turnover. Accordingly, utilities of VGAM1173 include diagnosis, prevention and treatment of diseases and clinical conditions associated with ADAMTS13. The function of ADAMTS13 and its association with various diseases and clinical conditions, has been established by previous studies, as described hereinabove with reference to VGAM131. CCAAT/enhancer Binding Protein (C/EBP), Alpha (CEBPA, Accession NM_004364) is another VGAM1173 host target gene. CEBPA BINDING SITE is HOST TARGET binding site found in the 3' untranslated region of mRNA encoded by CEBPA, corresponding to a HOST TARGET binding site such as BINDING SITE I, BINDING SITE II or BINDING SITE III. Table 2 illustrates the complementarity of the nucleotide sequences of CEBPA BINDING SITE, designated SEQ ID:10573, to the nucleotide sequence of VGAM1173 RNA, herein designated VGAM RNA, also designated SEQ ID:3884.

Another function of VGAM1173 is therefore inhibition of CCAAT/enhancer Binding Protein (C/EBP), Alpha (CEBPA, Accession NM_004364). Accordingly, utilities of VGAM1173 include diagnosis, prevention and treatment of diseases and clinical conditions associated with CEBPA. Heat Shock 70 kDa Protein 4 (HSPA4, Accession XM_114482) is another VGAM1173 host target gene. HSPA4 BINDING SITE is HOST TARGET binding site found in the 3' untranslated region of mRNA encoded by HSPA4, corresponding to a HOST TARGET binding site such as BINDING SITE I, BINDING SITE II or BINDING SITE III. Table 2 illustrates the complementarity of the nucleotide sequences of HSPA4 BINDING SITE, designated SEQ ID:42977, to the nucleotide sequence of VGAM1173 RNA, herein designated VGAM RNA, also designated SEQ ID:3884.

Another function of VGAM1173 is therefore inhibition of Heat Shock 70kDa Protein 4 (HSPA4, Accession XM_114482). Accordingly, utilities of VGAM1173 include diagnosis, prevention and treatment of diseases and clinical conditions associated with HSPA4. Heat Shock 60 kDa Protein 1 (chaperonin) (HSPD1, Accession XM_012182) is another VGAM1173 host target gene. HSPD1 BINDING SITE is HOST TARGET binding site found in the 3' untranslated region of mRNA encoded by HSPD1, corresponding to a HOST TARGET binding site such as BINDING SITE I, BINDING SITE II or BINDING SITE III. Table 2 illustrates the complementarity of the nucleotide sequences of HSPD1 BINDING SITE, designated SEQ ID:30208, to the nucleotide sequence of VGAM1173 RNA, herein designated VGAM RNA, also designated SEQ ID:3884.

Another function of VGAM1173 is therefore inhibition of Heat Shock 60kDa Protein 1 (chaperonin) (HSPD1, Accession XM_012182), a gene which is implicated in mitochondrial protein import and macromolecular assembly. may facilitate the correct folding of imported proteins. may also prevent misfolding and promote the refolding and proper assembly of unfolded polypeptides generated under stress conditions in the mitochondrial matrix. Accordingly, utilities of VGAM1173 include diagnosis, prevention and treatment of diseases and clinical conditions associated with HSPD1. The function of HSPD1 has been established by previous studies. Hereditary spastic paraplegia (HSP) represents a clinically and genetically heterogeneous group of neurodegenerative disorders that are characterized by progressive spasticity and weakness of the lower limbs. Seventeen different loci had been mapped, and the corresponding genes for 5 of these had been cloned and identified. Two of the 5 gene products--paraplegin (SPG7; 602783) and spastin (SPG4; 182601)--feature AAA+ domains and are predicted to possess chaperone activity. Paraplegin is the human homolog of a yeast protease/chaperone that is involved in mitochondrial protein quality control. The HSP60 gene maps to the same region, namely 2q33.1, as does spastic paraplegia-13 (SPG13; 605280), as determined by Fontaine et al. (2000). Speculating that the mitochondrial chaperonin HSP60 or its co-chaperonin HSP10 (OMIM Ref. No. 600141), which maps to the same region, might be the site of mutation (s) causing SPG13, Hansen et al. (2002) sequenced HSP60 in 2 affected members of the family with SPG13. They found that both were heterozygous for a G-to-A variation at position 292 of the HSP60 cDNA, resulting in the substitution of a valine at position 72 in the mature HSP60 by isoleucine (V72I). Studies in E. coli indicated that the V72I mutant protein is functionally incapacitated. The authors suggested that SPG4, SPG7, and SPG13 can be referred to as chaperonopathies. Azem et al. (1994) performed chemical cross-linking and electron microscopy studies on bacterial chaperonins GroEL and GroES to determine how they interact with unfolded proteins. GroEL is an oligomer of 14 identical 57.3-kD subunits, with a structure of 2 stacked heptameric rings arranged around a 2-fold axis of symmetry (Saibil et al., 1991). It appears as a hollow cylinder. In the presence of ATP, 2 GroES (see OMIM Ref. No. 600141) rings (each made of 7 identical 10.4-kD subunits) can successively bind a single GroEL core to make a functional symmetric heterodimer. Although the central core of GroEL is obstructed by the 2 GroES rings at each end, this heterodimer can stably bind and assist the refolding of the RuBisCo enzyme. While binding was thought to occur in the central cavity, these data indicate that unfolded proteins may bind and fold on the external envelope of some chaperonins (Azem et al., 1994). Schmidt et al. (1994) suggested that the symmetric chaperonin complex is functionally significant because complete folding of a non-native substrate protein in the presence of GroEL and GroES occurs only in the presence of ATP, and not with ADP. Chaperonin-assisted folding occurs by a catalytic cycle in which one ATP is hydrolyzed by one ring of GroEL in a quantized manner with each turnover. Todd et al. (1994) proposed a unifying model for chaperonin-facilitated protein folding based on successive rounds of binding and release, and partitioning between committed and kinetically trapped intermediates.

Full details of the abovementioned studies are described in the following publications, the disclosure of which are hereby incorporated by reference:

Fontaine, B.; Davoine, C.-S.; Durr, A.; Paternotte, C.; Feki, I.; Weissenbach, J.; Hazan, J.; Brice, A.: A new locus for autosomal dominant pure spastic paraplegia, on chromosome 2q24-q34. Am. J. Hum. Genet. 66:702-707, 2000; and Hansen, J. J.; Durr, A.; Cournu-Rebeix, I.; Georgopoulos, C.; Ang, D.; Nielsen, M. N.; Davoine, C.-S.; Brice, A.; Fontaine, B.; Gregersen, N.; Bross, P.: Hereditary spastic paraplegia SPG.

Further studies establishing the function and utilities of HSPD1 are found in John Hopkins OMIM database record ID 118190, and in sited publications numbered 840-843, 10688-84 and 10689 listed in the bibliography section hereinbelow, which are also hereby incorporated by reference. Kynurenine 3-monooxygenase (kynurenine 3-hydroxylase) (KMO, Accession NM_003679) is another VGAM1173 host target gene. KMO BINDING SITE is HOST TARGET binding site found in the 3' untranslated region of mRNA encoded by KMO, corresponding to a HOST TARGET binding site such as BINDING SITE I, BINDING SITE II or BINDING SITE III. Table 2 illustrates the complementarity of the nucleotide sequences of KMO BINDING SITE, designated SEQ ID:9783, to the nucleotide sequence of VGAM1173 RNA, herein designated VGAM RNA, also designated SEQ ID:3884.

Another function of VGAM1173 is therefore inhibition of Kynurenine 3-monooxygenase (kynurenine 3-hydroxylase) (KMO, Accession NM_003679), a gene which may play a role in encephalic photoreception. Accordingly, utilities of VGAM1173 include diagnosis, prevention and treatment of diseases and clinical conditions associated with KMO. The function of KMO and its association with various diseases and clinical conditions, has been established by previous studies, as described hereinabove with reference to VGAM162. Nuclear Receptor Subfamily 3, Group C, Member 2 (NR3C2, Accession NM_000901) is another VGAM1173 host target gene. NR3C2 BINDING SITE is HOST TARGET binding site found in the 3' untranslated region of mRNA encoded by NR3C2, corresponding to a HOST TARGET binding site such as BINDING SITE I, BINDING SITE II or BINDING SITE III. Table 2 illustrates the complementarity of the nucleotide sequences of NR3C2 BINDING SITE, designated SEQ ID:6599, to the nucleotide sequence of VGAM1173 RNA, herein designated VGAM RNA, also designated SEQ ID:3884.

Another function of VGAM1173 is therefore inhibition of Nuclear Receptor Subfamily 3, Group C, Member 2 (NR3C2, Accession NM_000901), a gene which is to increase ion and water transport and thus raise extracellular fluid volume and blood pressure and lower potassium levels. Accordingly, utilities of VGAM1173 include diagnosis, prevention and treatment of diseases and clinical conditions associated with NR3C2. The function of NR3C2 and its association with various diseases and clinical conditions, has been established by previous studies, as described hereinabove with reference to VGAM186. Origin Recognition Complex, Subunit 2-like (yeast) (ORC2L, Accession NM_006190) is another VGAM1173 host target gene. ORC2L BINDING SITE is HOST TARGET binding site found in the 3' untranslated region of mRNA encoded by ORC2L, corresponding to a HOST TARGET binding site such as BINDING SITE I, BINDING SITE II or BINDING SITE III. Table 2 illustrates the complementarity of the nucleotide sequences of ORC2L BINDING SITE, designated SEQ ID:12864, to the nucleotide sequence of VGAM1173 RNA, herein designated VGAM RNA, also designated SEQ ID:3884.

Another function of VGAM1173 is therefore inhibition of Origin Recognition Complex, Subunit 2-like (yeast) (ORC2L, Accession NM_006190), a gene which is a subunit of the origin recognition complex and may be required for initiation of DNA replication. Accordingly, utilities of VGAM1173 include diagnosis, prevention and treatment of diseases and clinical conditions associated with ORC2L. The function of ORC2L has been established by previous studies. The origin recognition complex (ORC) is a multiprotein assemblage identified in S. cerevisiae that binds to the ARS (autonomously replicating sequence) consensus, a DNA motif that is an essential part of yeast origins of replication. ORC binding has also been implicated in transcriptional silencing at certain yeast loci. One component of the ORC is a 72-kD protein designated ORC2, mutations of which disrupt silencing at the HMR-E silencer and cause cell cycle arrest between late G1 and the initiation of DNA replication. Takahara et al. (1996) isolated a cDNA from a mouse embryonic stem cell library and a human placenta library whose predicted 577-amino acid protein resembles the yeast sequence. The mouse and human sequences of the ORC2L (ORC2-like) proteins are 47.9% and 46.3% similar to yeast ORC2, respectively. Northern blots showed highest levels of ORC2L expression in testes. Dhar et al. (2001) used homologous recombination to replace the third exon encoding the initiator ATG of the ORC2 gene with a neomycin phosphotransferase gene in a colon carcinoma cell line. This hypomorphic mutation decreased ORC2 protein levels by 90%. The G1 phase of the cell cycle was prolonged, but there was no effect on the utilization of either the MYC (OMIM Ref. No. 190080) or beta-globin (OMIM Ref. No. 141900) cellular origins of replication. Cells carrying the ORC2 mutation failed to support the replication of a plasmid bearing the oriP replicator of Epstein-Barr virus (EBV), and this defect could be rescued by reintroduction of ORC2. ORC2 specifically associated with oriP in cells, most likely through its interaction with EBV nuclear antigen-1. Geminin (OMIM Ref. No. 602842), an inhibitor of the mammalian replication initiation complex, inhibited replication from oriP. Therefore, ORC and the human replication initiation apparatus is required for replication from a viral origin of replication.

Full details of the abovementioned studies are described in the following publications, the disclosure of which are hereby incorporated by reference:

Dhar, S. K.; Yoshida, K.; Machida, Y.; Khaira, P.; Chaudhuri, B.; Wohlschlegel, J. A.; Leffak, M.; Yates, J.; Dutta, A.: Replication from oriP of Epstein-Barr virus requires human ORC and is inhibited by geminin. Cell 106: 287-296, 2001; and Takahara, K.; Bong, M.; Brevard, R.; Eddy, R. L.; Haley, L. L.; Sait, S. J.; Shows, T. B.; Hoffman, G. G.; Greenspan, D. S.: Mouse and human homologues of the yeast origin of replica.

Further studies establishing the function and utilities of ORC2L are found in John Hopkins OMIM database record ID 601182, and in sited publications numbered 9505-9508 listed in the bibliography section hereinbelow, which are also hereby incorporated by reference. PACE (Accession NM_002569) is another VGAM1173 host target gene. PACE BINDING SITE is HOST TARGET binding site found in the 3' untranslated region of mRNA encoded by PACE, corresponding to a HOST TARGET binding site such as BINDING SITE I, BINDING SITE II or BINDING SITE III. Table 2 illustrates the complementarity of the nucleotide sequences of PACE BINDING SITE, designated SEQ ID:8428, to the nucleotide sequence of VGAM1173 RNA, herein designated VGAM RNA, also designated SEQ ID:3884.

Another function of VGAM1173 is therefore inhibition of PACE (Accession NM_002569), a gene which processes proparathyroid hormone, pro-transforming growth factor beta. Accordingly, utilities of VGAM1173 include diagnosis, prevention and treatment of diseases and clinical conditions associated with PACE. The function of PACE and its association with various diseases and clinical conditions, has been established by previous studies, as described hereinabove with reference to VGAM151. Protocadherin 11 X-linked (PCDH11X, Accession NM_032968) is another VGAM1173 host target gene. PCDH11X BINDING SITE1 and PCDH11X BINDING SITE2 are HOST TARGET binding sites found in untranslated regions of mRNA encoded by PCDH11X, corresponding to HOST TARGET binding sites such as BINDING SITE I, BINDING SITE II or BINDING SITE III. Table 2 illustrates the complementarity of the nucleotide sequences of PCDH11X BINDING SITE1 and PCDH11X BINDING SITE2, designated SEQ ID:26796 and SEQ ID:26811 respectively, to the nucleotide sequence of VGAM1173 RNA, herein designated VGAM RNA, also designated SEQ ID:3884.

Another function of VGAM1173 is therefore inhibition of Protocadherin 11 X-linked (PCDH11X, Accession NM_032968), a gene which is thought to play a fundamental role in cell-cell recognition essential for the segmental development and function of the central nervous system. Accordingly, utilities of VGAM1173 include diagnosis, prevention and treatment of diseases and clinical conditions associated with PCDH11X. The function of PCDH11X and its association with various diseases and clinical conditions, has been established by previous studies, as described hereinabove with reference to VGAM433. Protein Phosphatase 1, Regulatory (inhibitor) Subunit 11 (PPP1R11, Accession NM_021959) is another VGAM1173 host target gene. PPP1R11 BINDING SITE is HOST TARGET binding site found in the 3' untranslated region of mRNA encoded by PPP1R11, corresponding to a HOST TARGET binding site such as BINDING SITE I, BINDING SITE II or BINDING SITE III. Table 2 illustrates the complementarity of the nucleotide sequences of PPP1R11 BINDING SITE, designated SEQ ID:22485, to the nucleotide sequence of VGAM1173 RNA, herein designated VGAM RNA, also designated SEQ ID:3884.

Another function of VGAM1173 is therefore inhibition of Protein Phosphatase 1, Regulatory (inhibitor) Subunit 11 (PPP1R11, Accession NM_021959), a gene which inhibits rabbit muscle protein phosphatase-1 in vitro . Accordingly, utilities of VGAM1173 include diagnosis, prevention and treatment of diseases and clinical conditions associated with PPP1R11. The function of PPP1R11 has been established by previous studies. Using a cDNA selection technique to identify genes in the hemochromatosis (OMIM Ref. No. 235200) gene region on 6p21.3, El Kahloun et al. (1993) cloned PPP1R11, which they called HCGV (hemochromatosis candidate gene V). By screening cDNA libraries and using PCR techniques, Giffon et al. (1996) obtained a full-length cDNA encoding PPP1R11. The predicted 126-amino acid PPP1R11 protein contains 8 potential phosphorylation sites and a C-terminal PEST pattern that is characteristic of proteins with short half-lives. PPP1R11 shares 89.7% amino acid identity with its mouse homolog, Tctex5. Northern blot analysis detected a 1.8-kb PPP1R11 transcript in all fetal and adult tissues tested. The PPP1R11 gene appeared to be widely preserved throughout animal evolution, and Giffon et al. (1996) detected fragments on the DNAs of primates, rat, dog, cow, and rabbit. By screening sequence databases, Lepourcelet et al. (1996) identified a cDNA clone that suggested the existence of at least 1 spliced isoform of PPP1R11. Using a yeast 2-hybrid screen to identify putative protein phosphatase-1 (PP1; OMIM Ref. No. 176875)-binding proteins, Zhang et al. (1998) obtained a cDNA encoding PPP1R11, which they called inhibitor-3. They reported that PPP1R11 is hydrophilic, heat stable, and behaves anomalously on SDS-PAGE, with an apparent molecular mass of 23 kD compared with its calculated molecular mass of 14 kD, and on gel filtration, with a relative molecular weight of 55,000. Zhang et al. (1998) showed that PPP1R11 is a specific inhibitor of PP1 with a differential sensitivity toward the metal-independent and metal-dependent forms of PP1. They hypothesized that the PP1-binding ability of PPP1R11 is due at least in part to the possession of a VxW motif. PPP1R11 is well conserved in evolution, with related genes in S. cerevisiae, S. pombe, and C. elegans.

Full details of the abovementioned studies are described in the following publications, the disclosure of which are hereby incorporated by reference:

Lepourcelet, M.; Andrieux, N.; Giffon, T.; Pichon, L.; Hampe, A.; Galibert, F.; Mosser, J.: Systematic sequencing of the human HLA-A/HLA-F region: establishment of a cosmid contig and identification of a new gene cluster within 37 kb of sequence. Genomics 37:316-326, 1996; and Zhang, J.; Zhang, L.; Zhao, S.; Lee, E. Y. C.: Identification and characterization of the human HCG V gene product as a novel inhibitor of protein phosphatase-1. Biochemistry 37:16728.

Further studies establishing the function and utilities of PPP1R11 are found in John Hopkins OMIM database record ID 606670, and in sited publications numbered 910 and 9568-6456 listed in the bibliography section hereinbelow, which are also hereby incorporated by reference. Ubiquitin-conjugating Enzyme E2G 2 (UBC7 homolog, yeast) (UBE2G2, Accession XM_036087) is another VGAM1173 host target gene. UBE2G2 BINDING SITE is HOST TARGET binding site found in the 3' untranslated region of mRNA encoded by UBE2G2, corresponding to a HOST TARGET binding site such as BINDING SITE I, BINDING SITE II or BINDING SITE III. Table 2 illustrates the complementarity of the nucleotide sequences of UBE2G2 BINDING SITE, designated SEQ ID:32378, to the nucleotide sequence of VGAM1173 RNA, herein designated VGAM RNA, also designated SEQ ID:3884.

Another function of VGAM1173 is therefore inhibition of Ubiquitin-conjugating Enzyme E2G 2 (UBC7 homolog, yeast) (UBE2G2, Accession XM_036087), a gene which catalyzes the covalent attachment of ubiquitin to other proteins. Accordingly, utilities of VGAM1173 include diagnosis, prevention and treatment of diseases and clinical conditions associated with UBE2G2. The function of UBE2G2 and its association with various diseases and clinical conditions, has been established by previous studies, as described hereinabove with reference to VGAM164. Angiotensin II Receptor-like 2 (AGTRL2, Accession NM_005162) is another VGAM1173 host target gene. AGTRL2 BINDING SITE is HOST TARGET binding site found in the 5' untranslated region of mRNA encoded by AGTRL2, corresponding to a HOST TARGET binding site such as BINDING SITE I, BINDING SITE II or BINDING SITE III. Table 2 illustrates the complementarity of the nucleotide sequences of AGTRL2 BINDING SITE, designated SEQ ID:11648, to the nucleotide sequence of VGAM1173 RNA, herein designated VGAM RNA, also designated SEQ ID:3884.

Another function of VGAM1173 is therefore inhibition of Angiotensin II Receptor-like 2 (AGTRL2, Accession NM_005162). Accordingly, utilities of VGAM1173 include diagnosis, prevention and treatment of diseases and clinical conditions associated with AGTRL2. ARP3BETA (Accession NM_020445) is another VGAM1173 host target gene. ARP3BETA BINDING SITE is HOST TARGET binding site found in the 3' untranslated region of mRNA encoded by ARP3BETA, corresponding to a HOST TARGET binding site such as BINDING SITE I, BINDING SITE II or BINDING SITE III. Table 2 illustrates the complementarity of the nucleotide sequences of ARP3BETA BINDING SITE, designated SEQ ID:21687, to the nucleotide sequence of VGAM1173 RNA, herein designated VGAM RNA, also designated SEQ ID:3884.

Another function of VGAM1173 is therefore inhibition of ARP3BETA (Accession NM_020445). Accordingly, utilities of VGAM1173 include diagnosis, prevention and treatment of diseases and clinical conditions associated with ARP3BETA. DCOHM (Accession NM_032151) is another VGAM1173 host target gene. DCOHM BINDING SITE is HOST TARGET binding site found in the 3' untranslated region of mRNA encoded by DCOHM, corresponding to a HOST TARGET binding site such as BINDING SITE I, BINDING SITE II or BINDING SITE III. Table 2 illustrates the complementarity of the nucleotide sequences of DCOHM BINDING SITE, designated SEQ ID:25852, to the nucleotide sequence of VGAM1173 RNA, herein designated VGAM RNA, also designated SEQ ID:3884.

Another function of VGAM1173 is therefore inhibition of DCOHM (Accession NM_032151). Accordingly, utilities of VGAM1173 include diagnosis, prevention and treatment of diseases and clinical conditions associated with DCOHM. DKFZp566H0824 (Accession NM_017535) is another VGAM1173 host target gene. DKFZp566H0824 BINDING SITE is HOST TARGET binding site found in the 5' untranslated region of mRNA encoded by DKFZp566H0824, corresponding to a HOST TARGET binding site such as BINDING SITE I, BINDING SITE II or BINDING SITE III. Table 2 illustrates the complementarity of the nucleotide sequences of DKFZp566H0824 BINDING SITE, designated SEQ ID:18981, to the nucleotide sequence of VGAM1173 RNA, herein designated VGAM RNA, also designated SEQ ID:3884.

Another function of VGAM1173 is therefore inhibition of DKFZp566H0824 (Accession NM_017535). Accordingly, utilities of VGAM1173 include diagnosis, prevention and treatment of diseases and clinical conditions associated with DKFZp566H0824. EFA6R (Accession NM_015310) is another VGAM1173 host target gene. EFA6R BINDING SITE is HOST TARGET binding site found in the 3' untranslated region of mRNA encoded by EFA6R, corresponding to a HOST TARGET binding site such as BINDING SITE I, BINDING SITE II or BINDING SITE III. Table 2 illustrates the complementarity of the nucleotide sequences of EFA6R BINDING SITE, designated SEQ ID:17628, to the nucleotide sequence of VGAM1173 RNA, herein designated VGAM RNA, also designated SEQ ID:3884.

Another function of VGAM1173 is therefore inhibition of EFA6R (Accession NM_015310). Accordingly, utilities of VGAM1173 include diagnosis, prevention and treatment of diseases and clinical conditions associated with EFA6R. Epiregulin (EREG, Accession NM_001432) is another VGAM1173 host target gene. EREG BINDING SITE is HOST TARGET binding site found in the 3' untranslated region of mRNA encoded by EREG, corresponding to a HOST TARGET binding site such as BINDING SITE I, BINDING SITE II or BINDING SITE III. Table 2 illustrates the complementarity of the nucleotide sequences of EREG BINDING SITE, designated SEQ ID:7158, to the nucleotide sequence of VGAM1173 RNA, herein designated VGAM RNA, also designated SEQ ID:3884.

Another function of VGAM1173 is therefore inhibition of Epiregulin (EREG, Accession NM_001432). Accordingly, utilities of VGAM1173 include diagnosis, prevention and treatment of diseases and clinical conditions associated with EREG. FLJ10656 (Accession NM_018170) is another VGAM1173 host target gene. FLJ10656 BINDING SITE is HOST TARGET binding site found in the 3' untranslated region of mRNA encoded by FLJ10656, corresponding to a HOST TARGET binding site such as BINDING SITE I, BINDING SITE II or BINDING SITE III. Table 2 illustrates the complementarity of the nucleotide sequences of FLJ10656 BINDING SITE, designated SEQ ID:19992, to the nucleotide sequence of VGAM1173 RNA, herein designated VGAM RNA, also designated SEQ ID:3884.

Another function of VGAM1173 is therefore inhibition of FLJ10656 (Accession NM_018170). Accordingly, utilities of VGAM1173 include diagnosis, prevention and treatment of diseases and clinical conditions associated with FLJ10656. FLJ10891 (Accession NM_018260) is another VGAM1173 host target gene. FLJ10891 BINDING SITE is HOST TARGET binding site found in the 3' untranslated region of mRNA encoded by FLJ10891, corresponding to a HOST TARGET binding site such as BINDING SITE I, BINDING SITE II or BINDING SITE III. Table 2 illustrates the complementarity of the nucleotide sequences of FLJ10891 BINDING SITE, designated SEQ ID:20227, to the nucleotide sequence of VGAM1173 RNA, herein designated VGAM RNA, also designated SEQ ID:3884.

Another function of VGAM1173 is therefore inhibition of FLJ10891 (Accession NM_018260). Accordingly, utilities of VGAM1173 include diagnosis, prevention and treatment of diseases and clinical conditions associated with FLJ10891. FLJ21106 (Accession NM_025097) is another VGAM1173 host target gene. FLJ21106 BINDING SITE is HOST TARGET binding site found in the 3' untranslated region of mRNA encoded by FLJ21106, corresponding to a HOST TARGET binding site such as BINDING SITE I, BINDING SITE II or BINDING SITE III. Table 2 illustrates the complementarity of the nucleotide sequences of FLJ21106 BINDING SITE, designated SEQ ID:24739, to the nucleotide sequence of VGAM1173 RNA, herein designated VGAM RNA, also designated SEQ ID:3884.

Another function of VGAM1173 is therefore inhibition of FLJ21106 (Accession NM_025097). Accordingly, utilities of VGAM1173 include diagnosis, prevention and treatment of diseases and clinical conditions associated with FLJ21106. FLJ23511 (Accession NM_032239) is another VGAM1173 host target gene. FLJ23511 BINDING SITE is HOST TARGET binding site found in the 3' untranslated region of mRNA encoded by FLJ23511, corresponding to a HOST TARGET binding site such as BINDING SITE I, BINDING SITE II or BINDING SITE III. Table 2 illustrates the complementarity of the nucleotide sequences of FLJ23511 BINDING SITE, designated SEQ ID:25970, to the nucleotide sequence of VGAM1173 RNA, herein designated VGAM RNA, also designated SEQ ID:3884.

Another function of VGAM1173 is therefore inhibition of FLJ23511 (Accession NM_032239). Accordingly, utilities of VGAM1173 include diagnosis, prevention and treatment of diseases and clinical conditions associated with FLJ23511. KIAA0152 (Accession NM_014730) is another VGAM1173 host target gene. KIAA0152 BINDING SITE is HOST TARGET binding site found in the 3' untranslated region of mRNA encoded by KIAA0152, corresponding to a HOST TARGET binding site such as BINDING SITE I, BINDING SITE II or BINDING SITE III. Table 2 illustrates the complementarity of the nucleotide sequences of KIAA0152 BINDING SITE, designated SEQ ID:16343, to the nucleotide sequence of VGAM1173 RNA, herein designated VGAM RNA, also designated SEQ ID:3884.

Another function of VGAM1173 is therefore inhibition of KIAA0152 (Accession NM_014730). Accordingly, utilities of VGAM1173 include diagnosis, prevention and treatment of diseases and clinical conditions associated with KIAA0152. KIAA0940 (Accession NM_014912) is another VGAM1173 host target gene. KIAA0940 BINDING SITE1 and KIAA0940 BINDING SITE2 are HOST TARGET binding sites found in untranslated regions of mRNA encoded by KIAA0940, corresponding to HOST TARGET binding sites such as BINDING SITE I, BINDING SITE II or BINDING SITE III. Table 2 illustrates the complementarity of the nucleotide sequences of KIAA0940 BINDING SITE1 and KIAA0940 BINDING SITE2, designated SEQ ID:17150 and SEQ ID:17151 respectively, to the nucleotide sequence of VGAM1173 RNA, herein designated VGAM RNA, also designated SEQ ID:3884.

Another function of VGAM1173 is therefore inhibition of KIAA0940 (Accession NM_014912). Accordingly, utilities of VGAM1173 include diagnosis, prevention and treatment of diseases and clinical conditions associated with KIAA0940. Mitochondrial Ribosomal Protein S10 (MRPS10, Accession NM_018141) is another VGAM1173 host target gene. MRPS10 BINDING SITE is HOST TARGET binding site found in the 3' untranslated region of mRNA encoded by MRPS10, corresponding to a HOST TARGET binding site such as BINDING SITE I, BINDING SITE II or BINDING SITE III. Table 2 illustrates the complementarity of the nucleotide sequences of MRPS10 BINDING SITE, designated SEQ ID:19941, to the nucleotide sequence of VGAM1173 RNA, herein designated VGAM RNA, also designated SEQ ID:3884.

Another function of VGAM1173 is therefore inhibition of Mitochondrial Ribosomal Protein S10 (MRPS10, Accession NM_018141). Accordingly, utilities of VGAM1173 include diagnosis, prevention and treatment of diseases and clinical conditions associated with MRPS10. SDS3 (Accession XM_045014) is another VGAM1173 host target gene. SDS3 BINDING SITE is HOST TARGET binding site found in the 3' untranslated region of mRNA encoded by SDS3, corresponding to a HOST TARGET binding site such as BINDING SITE I, BINDING SITE II or BINDING SITE III. Table 2 illustrates the complementarity of the nucleotide sequences of SDS3 BINDING SITE, designated SEQ ID:34322, to the nucleotide sequence of VGAM1173 RNA, herein designated VGAM RNA, also designated SEQ ID:3884.

Another function of VGAM1173 is therefore inhibition of SDS3 (Accession XM_045014). Accordingly, utilities of VGAM1173 include diagnosis, prevention and treatment of diseases and clinical conditions associated with SDS3. Serine/threonine Kinase 3 (STE20 homolog, yeast) (STK3, Accession XM_057232) is another VGAM1173 host target gene. STK3 BINDING SITE is HOST TARGET binding site found in the 3' untranslated region of mRNA encoded by STK3, corresponding to a HOST TARGET binding site such as BINDING SITE I, BINDING SITE II or BINDING SITE III. Table 2 illustrates the complementarity of the nucleotide sequences of STK3 BINDING SITE, designated SEQ ID:36495, to the nucleotide sequence of VGAM1173 RNA, herein designated VGAM RNA, also designated SEQ ID:3884.

Another function of VGAM1173 is therefore inhibition of Serine/threonine Kinase 3 (STE20 homolog, yeast) (STK3, Accession XM_057232). Accordingly, utilities of VGAM1173 include diagnosis, prevention and treatment of diseases and clinical conditions associated with STK3. TUCAN (Accession NM_014959) is another VGAM1173 host target gene. TUCAN BINDING SITE is HOST TARGET binding site found in the 3' untranslated region of mRNA encoded by TUCAN, corresponding to a HOST TARGET binding site such as BINDING SITE I, BINDING SITE II or BINDING SITE III. Table 2 illustrates the complementarity of the nucleotide sequences of TUCAN BINDING SITE, designated SEQ ID:17322, to the nucleotide sequence of VGAM1173 RNA, herein designated VGAM RNA, also designated SEQ ID:3884.

Another function of VGAM1173 is therefore inhibition of TUCAN (Accession NM_014959). Accordingly, utilities of VGAM1173 include diagnosis, prevention and treatment of diseases and clinical conditions associated with TUCAN. ZNF340 (Accession XM_097701) is another VGAM1173 host target gene. ZNF340 BINDING SITE is HOST TARGET binding site found in the 3' untranslated region of mRNA encoded by ZNF340, corresponding to a HOST TARGET binding site such as BINDING SITE I, BINDING SITE II or BINDING SITE III. Table 2 illustrates the complementarity of the nucleotide sequences of ZNF340 BINDING SITE, designated SEQ ID:41036, to the nucleotide sequence of VGAM1173 RNA, herein designated VGAM RNA, also designated SEQ ID:3884.

Another function of VGAM1173 is therefore inhibition of ZNF340 (Accession XM_097701). Accordingly, utilities of VGAM1173 include diagnosis, prevention and treatment of diseases and clinical conditions associated with ZNF340. LOC143785 (Accession XM_084635) is another VGAM1173 host target gene. LOC143785 BINDING SITE is HOST TARGET binding site found in the 3' untranslated region of mRNA encoded by LOC143785, corresponding to a HOST TARGET binding site such as BINDING SITE I, BINDING SITE II or BINDING SITE III. Table 2 illustrates the complementarity of the nucleotide sequences of LOC143785 BINDING SITE, designated SEQ ID:37633, to the nucleotide sequence of VGAM1173 RNA, herein designated VGAM RNA, also designated SEQ ID:3884.

Another function of VGAM1173 is therefore inhibition of LOC143785 (Accession XM_084635). Accordingly, utilities of VGAM1173 include diagnosis, prevention and treatment of diseases and clinical conditions associated with LOC143785. LOC144453 (Accession XM_084869) is another VGAM1173 host target gene. LOC144453 BINDING SITE is HOST TARGET binding site found in the 3' untranslated region of mRNA encoded by LOC144453, corresponding to a HOST TARGET binding site such as BINDING SITE I, BINDING SITE II or BINDING SITE III. Table 2 illustrates the complementarity of the nucleotide sequences of LOC144453 BINDING SITE, designated SEQ ID:37749, to the nucleotide sequence of VGAM1173 RNA, herein designated VGAM RNA, also designated SEQ ID:3884.

Another function of VGAM1173 is therefore inhibition of LOC144453 (Accession XM_084869). Accordingly, utilities of VGAM1173 include diagnosis, prevention and treatment of diseases and clinical conditions associated with LOC144453. LOC148824 (Accession XM_097527) is another VGAM1173 host target gene. LOC148824 BINDING SITE is HOST TARGET binding site found in the 3' untranslated region of mRNA encoded by LOC148824, corresponding to a HOST TARGET binding site such as BINDING SITE I, BINDING SITE II or BINDING SITE III. Table 2 illustrates the complementarity of the nucleotide sequences of LOC148824 BINDING SITE, designated SEQ ID:40910, to the nucleotide sequence of VGAM1173 RNA, herein designated VGAM RNA, also designated SEQ ID:3884.

Another function of VGAM1173 is therefore inhibition of LOC148824 (Accession XM_097527). Accordingly, utilities of VGAM1173 include diagnosis, prevention and treatment of diseases and clinical conditions associated with LOC148824. LOC200471 (Accession XM_117234) is another VGAM1173 host target gene. LOC200471 BINDING SITE is HOST TARGET binding site found in the 5' untranslated region of mRNA encoded by LOC200471, corresponding to a HOST TARGET binding site such as BINDING SITE I, BINDING SITE II or BINDING SITE III. Table 2 illustrates the complementarity of the nucleotide sequences of LOC200471 BINDING SITE, designated SEQ ID:43305, to the nucleotide sequence of VGAM1173 RNA, herein designated VGAM RNA, also designated SEQ ID:3884.

Another function of VGAM1173 is therefore inhibition of LOC200471 (Accession XM_117234). Accordingly, utilities of VGAM1173 include diagnosis, prevention and treatment of diseases and clinical conditions associated with LOC200471. LOC201696 (Accession XM_032269) is another VGAM1173 host target gene. LOC201696 BINDING SITE is HOST TARGET binding site found in the 3' untranslated region of mRNA encoded by LOC201696, corresponding to a HOST TARGET binding site such as BINDING SITE I, BINDING SITE II or BINDING SITE III. Table 2 illustrates the complementarity of the nucleotide sequences of LOC201696 BINDING SITE, designated SEQ ID:31628, to the nucleotide sequence of VGAM1173 RNA, herein designated VGAM RNA, also designated SEQ ID:3884.

Another function of VGAM1173 is therefore inhibition of LOC201696 (Accession XM_032269). Accordingly, utilities of VGAM1173 include diagnosis, prevention and treatment of diseases and clinical conditions associated with LOC201696. LOC257465 (Accession XM_088384) is another VGAM1173 host target gene. LOC257465 BINDING SITE is HOST TARGET binding site found in the 3' untranslated region of mRNA encoded by LOC257465, corresponding to a HOST TARGET binding site such as BINDING SITE I, BINDING SITE II or BINDING SITE III. Table 2 illustrates the complementarity of the nucleotide sequences of LOC257465 BINDING SITE, designated SEQ ID:39668, to the nucleotide sequence of VGAM1173 RNA, herein designated VGAM RNA, also designated SEQ ID:3884.

Another function of VGAM1173 is therefore inhibition of LOC257465 (Accession XM_088384). Accordingly, utilities of VGAM1173 include diagnosis, prevention and treatment of diseases and clinical conditions associated with LOC257465. LOC91408 (Accession XM_038290) is another VGAM1173 host target gene. LOC91408 BINDING SITE is HOST TARGET binding site found in the 3' untranslated region of mRNA encoded by LOC91408, corresponding to a HOST TARGET binding site such as BINDING SITE I, BINDING SITE II or BINDING SITE III. Table 2 illustrates the complementarity of the nucleotide sequences of LOC91408 BINDING SITE, designated SEQ ID:32794, to the nucleotide sequence of VGAM1173 RNA, herein designated VGAM RNA, also designated SEQ ID:3884.

Another function of VGAM1173 is therefore inhibition of LOC91408 (Accession XM_038290). Accordingly, utilities of VGAM1173 include diagnosis, prevention and treatment of diseases and clinical conditions associated with LOC91408. FIG. 1 further provides a conceptual description of a novel bioinformatically detected viral gene of the present invention, referred to here as Viral Genomic Address Messenger 1174 (VGAM1174) viral gene, which modulates expression of respective host target genes thereof, the function and utility of which host target genes is known in the art.

VGAM1174 is a novel bioinformatically detected regulatory, non protein coding, viral micro RNA (miRNA) gene. The method by which VGAM1174 was detected is described hereinabove with reference to FIGS. 1-8.

VGAM1174 gene, herein designated VGAM GENE, is a viral gene contained in the genome of Rift Valley Fever Virus. VGAM1174 host target gene, herein designated VGAM HOST TARGET GENE, is a human gene contained in the human genome.

VGAM1174 gene encodes a VGAM1174 precursor RNA, herein designated VGAM PRECURSOR RNA. Similar to other miRNA genes, and unlike most ordinary genes, VGAM1174 precursor RNA does not encode a protein. A nucleotide sequence identical or highly similar to the nucleotide sequence of VGAM1174 precursor RNA is designated SEQ ID:1160, and is provided hereinbelow with reference to the sequence listing part. Nucleotide sequence SEQ ID:1160 is located at position 4915 relative to the genome of Rift Valley Fever Virus.

VGAM1174 precursor RNA folds onto itself, forming VGAM1174 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1174 folded precursor RNA into VGAM1174 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1174 RNA is designated SEQ ID:3885, and is provided hereinbelow with reference to the sequence listing part.

VGAM1174 host target gene, herein designated VGAM HOST TARGET GENE, encodes a corresponding messenger RNA, VGAM1174 host target RNA, herein designated VGAM HOST TARGET RNA. VGAM1174 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1174 RNA, herein designated VGAM RNA, binds complementarily to one or more host target binding sites located in untranslated regions of VGAM1174 host target RNA, herein designated VGAM HOST TARGET RNA. This complementary binding is due to the fact that the nucleotide sequence of VGAM1174 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1174 RNA, herein designated VGAM RNA, may have a different number of host target binding sites in untranslated regions of a VGAM1174 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1174 RNA, herein designated VGAM RNA, to host target binding sites on VGAM1174 host target RNA, herein designated VGAM HOST TARGET RNA, such as BINDING SITE I, BINDING SITE II and BINDING SITE III, inhibits translation of VGAM1174 host target RNA into VGAM1174 host target protein, herein designated VGAM HOST TARGET PROTEIN. VGAM host target protein is therefore outlined by a broken line.

It is appreciated that VGAM1174 host target gene, herein designated VGAM HOST TARGET GENE, in fact represents a plurality of VGAM1174 host target genes. The mRNA of each one of this plurality of VGAM1174 host target genes comprises one or more host target binding sites, each having a nucleotide sequence which is at least partly complementary to VGAM1174 RNA, herein designated VGAM RNA, and which when bound by VGAM1174 RNA causes inhibition of translation of respective one or more VGAM1174 host target proteins.

It is further appreciated by one skilled in the art that the mode of translational inhibition illustrated by FIG. 1 with specific reference to translational inhibition exerted by VGAM1174 gene, herein designated VGAM GENE, on one or more VGAM1174 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1174 is inhibition of expression of host target genes, as part of a novel viral mechanism of attacking a host. Accordingly, utilities of VGAM1174 include diagnosis, prevention and treatment of viral infection by Rift Valley Fever Virus. Specific functions, and accordingly utilities, of VGAM1174 correlate with, and may be deduced from, the identity of the host target genes which VGAM1174 binds and inhibits, and the function of these host target genes, as elaborated hereinbelow.

Nucleotide sequences of the VGAM1174 precursor RNA, herein designated VGAM PRECURSOR RNA, and of the 'diced' VGAM1174 RNA, herein designated VGAM RNA, and a schematic representation of the secondary folding of VGAM1174 folded precursor RNA, herein designated VGAM FOLDED PRECURSOR RNA, of VGAM1174 are further described hereinbelow with reference to Table 1.

Nucleotide sequences of host target binding sites, such as BINDING SITE-I, BINDING SITE-II and BINDING SITE-III of FIG. 1, found on VGAM1174 host target RNA, and schematic representation of the complementarity of each of these host target binding sites to VGAM1174 RNA, herein designated VGAM RNA, are described hereinbelow with reference to Table 2.

As mentioned hereinabove with reference to FIG. 1, a function of VGAM1174 gene, herein designated VGAM is inhibition of expression of VGAM1174 target genes. It is appreciated that specific functions, and accordingly utilities, of VGAM1174 correlate with, and may be deduced from, the identity of the target genes which VGAM1174 binds and inhibits, and the function of these target genes, as elaborated hereinbelow.

LHPP (Accession NM_022126) is a VGAM1174 host target gene. LHPP BINDING SITE is HOST TARGET binding site found in the 3' untranslated region of mRNA encoded by LHPP, corresponding to a HOST TARGET binding site such as BINDING SITE I, BINDING SITE II or BINDING SITE III. Table 2 illustrates the complementarity of the nucleotide sequences of LHPP BINDING SITE, designated SEQ ID:22674, to the nucleotide sequence of VGAM1174 RNA, herein designated VGAM RNA, also designated SEQ ID:3885.

A function of VGAM1174 is therefore inhibition of LHPP (Accession NM_022126). Accordingly, utilities of VGAM1174 include diagnosis, prevention and treatment of diseases and clinical conditions associated with LHPP. LOC151584 (Accession XM_098089) is another VGAM1174 host target gene. LOC151584 BINDING SITE is HOST TARGET binding site found in the 3' untranslated region of mRNA encoded by LOC151584, corresponding to a HOST TARGET binding site such as BINDING SITE I, BINDING SITE II or BINDING SITE III. Table 2 illustrates the complementarity of the nucleotide sequences of LOC151584 BINDING SITE, designated SEQ ID:41376, to the nucleotide sequence of VGAM1174 RNA, herein designated VGAM RNA, also designated SEQ ID:3885.

Another function of VGAM1174 is therefore inhibition of LOC151584 (Accession XM_098089). Accordingly, utilities of VGAM1174 include diagnosis, prevention and treatment of diseases and clinical conditions associated with LOC151584. LOC201799 (Accession XM_114380) is another VGAM1174 host target gene. LOC201799 BINDING SITE is HOST TARGET binding site found in the 3' untranslated region of mRNA encoded by LOC201799, corresponding to a HOST TARGET binding site such as BINDING SITE I, BINDING SITE II or BINDING SITE III. Table 2 illustrates the complementarity of the nucleotide sequences of LOC201799 BINDING SITE, designated SEQ ID:42914, to the nucleotide sequence of VGAM1174 RNA, herein designated VGAM RNA, also designated SEQ ID:3885.

Another function of VGAM1174 is therefore inhibition of LOC201799 (Accession XM_114380). Accordingly, utilities of VGAM1174 include diagnosis, prevention and treatment of diseases and clinical conditions associated with LOC201799. FIG. 1 further provides a conceptual description of a novel bioinformatically detected viral gene of the present invention, referred to here as Viral Genomic Address Messenger 1175 (VGAM1175) viral gene, which modulates expression of respective host target genes thereof, the function and utility of which host target genes is known in the art.

VGAM1175 is a novel bioinformatically detected regulatory, non protein coding, viral micro RNA (miRNA) gene. The method by which VGAM1175 was detected is described hereinabove with reference to FIGS. 1-8.

VGAM1175 gene, herein designated VGAM GENE, is a viral gene contained in the genome of Rift Valley Fever Virus. VGAM1175 host target gene, herein designated VGAM HOST TARGET GENE, is a human gene contained in the human genome.

VGAM1175 gene encodes a VGAM1175 precursor RNA, herein designated VGAM PRECURSOR RNA. Similar to other miRNA genes, and unlike most ordinary genes, VGAM1175 precursor RNA does not encode a protein. A nucleotide sequence identical or highly similar to the nucleotide sequence of VGAM1175 precursor RNA is designated SEQ ID:1161, and is provided hereinbelow with reference to the sequence listing part. Nucleotide sequence SEQ ID:1161 is located at position 5974 relative to the genome of Rift Valley Fever Virus.

VGAM1175 precursor RNA folds onto itself, forming VGAM1175 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1175 folded precursor RNA into VGAM1175 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1175 RNA is designated SEQ ID:3886, and is provided hereinbelow with reference to the sequence listing part.

VGAM1175 host target gene, herein designated VGAM HOST TARGET GENE, encodes a corresponding messenger RNA, VGAM1175 host target RNA, herein designated VGAM HOST TARGET RNA. VGAM1175 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1175 RNA, herein designated VGAM RNA, binds complementarily to one or more host target binding sites located in untranslated regions of VGAM1175 host target RNA, herein designated VGAM HOST TARGET RNA. This complementary binding is due to the fact that the nucleotide sequence of VGAM1175 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1175 RNA, herein designated VGAM RNA, may have a different number of host target binding sites in untranslated regions of a VGAM1175 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1175 RNA, herein designated VGAM RNA, to host target binding sites on VGAM1175 host target RNA, herein designated VGAM HOST TARGET RNA, such as BINDING SITE I, BINDING SITE II and BINDING SITE III, inhibits translation of VGAM1175 host target RNA into VGAM1175 host target protein, herein designated VGAM HOST TARGET PROTEIN. VGAM host target protein is therefore outlined by a broken line.

It is appreciated that VGAM1175 host target gene, herein designated VGAM HOST TARGET GENE, in fact represents a plurality of VGAM1175 host target genes. The mRNA of each one of this plurality of VGAM1175 host target genes comprises one or more host target binding sites, each having a nucleotide sequence which is at least partly complementary to VGAM1175 RNA, herein designated VGAM RNA, and which when bound by VGAM1175 RNA causes inhibition of translation of respective one or more VGAM1175 host target proteins.

It is further appreciated by one skilled in the art that the mode of translational inhibition illustrated by FIG. 1 with specific reference to translational inhibition exerted by VGAM1175 gene, herein designated VGAM GENE, on one or more VGAM1175 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1175 is inhibition of expression of host target genes, as part of a novel viral mechanism of attacking a host. Accordingly, utilities of VGAM1175 include diagnosis, prevention and treatment of viral infection by Rift Valley Fever Virus. Specific functions, and accordingly utilities, of VGAM1175 correlate with, and may be deduced from, the identity of the host target genes which VGAM1175 binds and inhibits, and the function of these host target genes, as elaborated hereinbelow.

Nucleotide sequences of the VGAM1175 precursor RNA, herein designated VGAM PRECURSOR RNA, and of the 'diced' VGAM1175 RNA, herein designated VGAM RNA, and a schematic representation of the secondary folding of VGAM1175 folded precursor RNA, herein designated VGAM FOLDED PRECURSOR RNA, of VGAM1175 are further described hereinbelow with reference to Table 1.

Nucleotide sequences of host target binding sites, such as BINDING SITE-I, BINDING SITE-II and BINDING SITE-III of FIG. 1, found on VGAM1175 host target RNA, and schematic representation of the complementarity of each of these host target binding sites to VGAM1175 RNA, herein designated VGAM RNA, are described hereinbelow with reference to Table 2.

As mentioned hereinabove with reference to FIG. 1, a function of VGAM1175 gene, herein designated VGAM is inhibition of expression of VGAM1175 target genes. It is appreciated that specific functions, and accordingly utilities, of VGAM1175 correlate with, and may be deduced from, the identity of the target genes which VGAM1175 binds and inhibits, and the function of these target genes, as elaborated hereinbelow.

Lunatic Fringe Homolog (Drosophila) (LFNG, Accession XM_166539) is a VGAM1175 host target gene. LFNG BINDING SITE is HOST TARGET binding site found in the 3' untranslated region of mRNA encoded by LFNG, corresponding to a HOST TARGET binding site such as BINDING SITE I, BINDING SITE II or BINDING SITE III. Table 2 illustrates the complementarity of the nucleotide sequences of LFNG BINDING SITE, designated SEQ ID:44510, to the nucleotide sequence of VGAM1175 RNA, herein designated VGAM RNA, also designated SEQ ID:3886.

A function of VGAM1175 is therefore inhibition of Lunatic Fringe Homolog (Drosophila) (LFNG, Accession XM_166539). Accordingly, utilities of VGAM1175 include diagnosis, prevention and treatment of diseases and clinical conditions associated with LFNG. MGC3178 (Accession NM_030810) is another VGAM1175 host target gene. MGC3178 BINDING SITE is HOST TARGET binding site found in the 3' untranslated region of mRNA encoded by MGC3178, corresponding to a HOST TARGET binding site such as BINDING SITE I, BINDING SITE II or BINDING SITE III. Table 2 illustrates the complementarity of the nucleotide sequences of MGC3178 BINDING SITE, designated SEQ ID:25132, to the nucleotide sequence of VGAM1175 RNA, herein designated VGAM RNA, also designated SEQ ID:3886.

Another function of VGAM1175 is therefore inhibition of MGC3178 (Accession NM_030810). Accordingly, utilities of VGAM1175 include diagnosis, prevention and treatment of diseases and clinical conditions associated with MGC3178. Transducer of ERBB2, 2 (TOB2, Accession XM_170995) is another VGAM1175 host target gene. TOB2 BINDING SITE is HOST TARGET binding site found in the 3' untranslated region of mRNA encoded by TOB2, corresponding to a HOST TARGET binding site such as BINDING SITE I, BINDING SITE II or BINDING SITE III. Table 2 illustrates the complementarity of the nucleotide sequences of TOB2 BINDING SITE, designated SEQ ID:45772, to the nucleotide sequence of VGAM1175 RNA, herein designated VGAM RNA, also designated SEQ ID:3886.

Another function of VGAM1175 is therefore inhibition of Transducer of ERBB2, 2 (TOB2, Accession XM_170995). Accordingly, utilities of VGAM1175 include diagnosis, prevention and treatment of diseases and clinical conditions associated with TOB2. LOC145501 (Accession XM_085157) is another VGAM1175 host target gene. LOC145501 BINDING SITE is HOST TARGET binding site found in the 3' untranslated region of mRNA encoded by LOC145501, corresponding to a HOST TARGET binding site such as BINDING SITE I, BINDING SITE II or BINDING SITE III. Table 2 illustrates the complementarity of the nucleotide sequences of LOC145501 BINDING SITE, designated SEQ ID:37883, to the nucleotide sequence of VGAM1175 RNA, herein designated VGAM RNA, also designated SEQ ID:3886.

Another function of VGAM1175 is therefore inhibition of LOC145501 (Accession XM_085157). Accordingly, utilities of VGAM1175 include diagnosis, prevention and treatment of diseases and clinical conditions associated with LOC145501. LOC147671 (Accession XM_085844) is another VGAM1175 host target gene. LOC147671 BINDING SITE is HOST TARGET binding site found in the 3' untranslated region of mRNA encoded by LOC147671, corresponding to a HOST TARGET binding site such as BINDING SITE I, BINDING SITE II or BINDING SITE III. Table 2 illustrates the complementarity of the nucleotide sequences of LOC147671 BINDING SITE, designated SEQ ID:38379, to the nucleotide sequence of VGAM1175 RNA, herein designated VGAM RNA, also designated SEQ ID:3886.

Another function of VGAM1175 is therefore inhibition of LOC147671 (Accession XM_085844). Accordingly, utilities of VGAM1175 include diagnosis, prevention and treatment of diseases and clinical conditions associated with LOC147671. LOC157273 (Accession XM_098743) is another VGAM1175 host target gene. LOC157273 BINDING SITE is HOST TARGET binding site found in the 3' untranslated region of mRNA encoded by LOC157273, corresponding to a HOST TARGET binding site such as BINDING SITE I, BINDING SITE II or BINDING SITE III. Table 2 illustrates the complementarity of the nucleotide sequences of LOC157273 BINDING SITE, designated SEQ ID:41788, to the nucleotide sequence of VGAM1175 RNA, herein designated VGAM RNA, also designated SEQ ID:3886.

Another function of VGAM1175 is therefore inhibition of LOC157273 (Accession XM_098743). Accordingly, utilities of VGAM1175 include diagnosis, prevention and treatment of diseases and clinical conditions associated with LOC157273. LOC91380 (Accession XM_038134) is another VGAM1175 host target gene. LOC91380 BINDING SITE is HOST TARGET binding site found in the 5' untranslated region of mRNA encoded by LOC91380, corresponding to a HOST TARGET binding site such as BINDING SITE I, BINDING SITE II or BINDING SITE III. Table 2 illustrates the complementarity of the nucleotide sequences of LOC91380 BINDING SITE, designated SEQ ID:32759, to the nucleotide sequence of VGAM1175 RNA, herein designated VGAM RNA, also designated SEQ ID:3886.

Another function of VGAM1175 is therefore inhibition of LOC91380 (Accession XM_038134). Accordingly, utilities of VGAM1175 include diagnosis, prevention and treatment of diseases and clinical conditions associated with LOC91380. FIG. 1 further provides a conceptual description of a novel bioinformatically detected viral gene of the present invention, referred to here as Viral Genomic Address Messenger 1176 (VGAM1176) viral gene, which modulates expression of respective host target genes thereof, the function and utility of which host target genes is known in the art.

VGAM1176 is a novel bioinformatically detected regulatory, non protein coding, viral micro RNA (miRNA) gene. The method by which VGAM1176 was detected is described hereinabove with reference to FIGS. 1-8.

VGAM1176 gene, herein designated VGAM GENE, is a viral gene contained in the genome of Rift Valley Fever Virus. VGAM1176 host target gene, herein designated VGAM HOST TARGET GENE, is a human gene contained in the human genome.

VGAM1176 gene encodes a VGAM1176 precursor RNA, herein designated VGAM PRECURSOR RNA. Similar to other miRNA genes, and unlike most ordinary genes, VGAM1176 precursor RNA does not encode a protein. A nucleotide sequence identical or highly similar to the nucleotide sequence of VGAM1176 precursor RNA is designated SEQ ID:1162, and is provided hereinbelow with reference to the sequence listing part. Nucleotide sequence SEQ ID:1162 is located at position 2112 relative to the genome of Rift Valley Fever Virus.

VGAM1176 precursor RNA folds onto itself, forming VGAM1176 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1176 folded precursor RNA into VGAM1176 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1176 RNA is designated SEQ ID:3887, and is provided hereinbelow with reference to the sequence listing part.

VGAM1176 host target gene, herein designated VGAM HOST TARGET GENE, encodes a corresponding messenger RNA, VGAM1176 host target RNA, herein designated VGAM HOST TARGET RNA. VGAM1176 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1176 RNA, herein designated VGAM RNA, binds complementarily to one or more host target binding sites located in untranslated regions of VGAM1176 host target RNA, herein designated VGAM HOST TARGET RNA. This complementary binding is due to the fact that the nucleotide sequence of VGAM1176 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1176 RNA, herein designated VGAM RNA, may have a different number of host target binding sites in untranslated regions of a VGAM1176 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1176 RNA, herein designated VGAM RNA, to host target binding sites on VGAM1176 host target RNA, herein designated VGAM HOST TARGET RNA, such as BINDING SITE I, BINDING SITE II and BINDING SITE III, inhibits translation of VGAM1176 host target RNA into VGAM1176 host target protein, herein designated VGAM HOST TARGET PROTEIN. VGAM host target protein is therefore outlined by a broken line.

It is appreciated that VGAM1176 host target gene, herein designated VGAM HOST TARGET GENE, in fact represents a plurality of VGAM1176 host target genes. The mRNA of each one of this plurality of VGAM1176 host target genes comprises one or more host target binding sites, each having a nucleotide sequence which is at least partly complementary to VGAM1176 RNA, herein designated VGAM RNA, and which when bound by VGAM1176 RNA causes inhibition of translation of respective one or more VGAM1176 host target proteins.

It is further appreciated by one skilled in the art that the mode of translational inhibition illustrated by FIG. 1 with specific reference to translational inhibition exerted by VGAM1176 gene, herein designated VGAM GENE, on one or more VGAM1176 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1176 is inhibition of expression of host target genes, as part of a novel viral mechanism of attacking a host. Accordingly, utilities of VGAM1176 include diagnosis, prevention and treatment of viral infection by Rift Valley Fever Virus. Specific functions, and accordingly utilities, of VGAM1176 correlate with, and may be deduced from, the identity of the host target genes which VGAM1176 binds and inhibits, and the function of these host target genes, as elaborated hereinbelow.

Nucleotide sequences of the VGAM1176 precursor RNA, herein designated VGAM PRECURSOR RNA, and of the 'diced' VGAM1176 RNA, herein designated VGAM RNA, and a schematic representation of the secondary folding of VGAM1176 folded precursor RNA, herein designated VGAM FOLDED PRECURSOR RNA, of VGAM1176 are further described hereinbelow with reference to Table 1.

Nucleotide sequences of host target binding sites, such as BINDING SITE-I, BINDING SITE-II and BINDING SITE-III of FIG. 1, found on VGAM1176 host target RNA, and schematic representation of the complementarity of each of these host target binding sites to VGAM1176 RNA, herein designated VGAM RNA, are described hereinbelow with reference to Table 2.

As mentioned hereinabove with reference to FIG. 1, a function of VGAM1176 gene, herein designated VGAM is inhibition of expression of VGAM1176 target genes. It is appreciated that specific functions, and accordingly utilities, of VGAM1176 correlate with, and may be deduced from, the identity of the target genes which VGAM1176 binds and inhibits, and the function of these target genes, as elaborated hereinbelow.

Adaptor-related Protein Complex 2, Beta 1 Subunit (AP2B1, Accession NM_001282) is a VGAM1176 host target gene. AP2B1 BINDING SITE is HOST TARGET binding site found in the 3' untranslated region of mRNA encoded by AP2B1, corresponding to a HOST TARGET binding site such as BINDING SITE I, BINDING SITE II or BINDING SITE III. Table 2 illustrates the complementarity of the nucleotide sequences of AP2B1 BINDING SITE, designated SEQ ID:6955, to the nucleotide sequence of VGAM1176 RNA, herein designated VGAM RNA, also designated SEQ ID:3887.

A function of VGAM1176 is therefore inhibition of Adaptor-related Protein Complex 2, Beta 1 Subunit (AP2B1, Accession NM_001282), a gene which links clathrin to receptors in coated vesicles. Accordingly, utilities of VGAM1176 include diagnosis, prevention and treatment of diseases and clinical conditions associated with AP2B1. The function of AP2B1 and its association with various diseases and clinical conditions, has been established by previous studies, as described hereinabove with reference to VGAM1126. Core-binding Factor, Runt Domain, Alpha Subunit 2; Translocated To, 2 (CBFA2T2, Accession NM_005093) is another VGAM1176 host target gene. CBFA2T2 BINDING SITE is HOST TARGET binding site found in the 3' untranslated region of mRNA encoded by CBFA2T2, corresponding to a HOST TARGET binding site such as BINDING SITE I, BINDING SITE II or BINDING SITE III. Table 2 illustrates the complementarity of the nucleotide sequences of CBFA2T2 BINDING SITE, designated SEQ ID:11552, to the nucleotide sequence of VGAM1176 RNA, herein designated VGAM RNA, also designated SEQ ID:3887.

Another function of VGAM1176 is therefore inhibition of Core-binding Factor, Runt Domain, Alpha Subunit 2; Translocated To, 2 (CBFA2T2, Accession NM_005093), a gene which is a putative transcription factor. Accordingly, utilities of VGAM1176 include diagnosis, prevention and treatment of diseases and clinical conditions associated with CBFA2T2. The function of CBFA2T2 and its association with various diseases and clinical conditions, has been established by previous studies, as described hereinabove with reference to VGAM152. Collagen, Type IV, Alpha 6 (COL4A6, Accession NM_033641) is another VGAM1176 host target gene. COL4A6 BINDING SITE is HOST TARGET binding site found in the 5' untranslated region of mRNA encoded by COL4A6, corresponding to a HOST TARGET binding site such as BINDING SITE I, BINDING SITE II or BINDING SITE III. Table 2 illustrates the complementarity of the nucleotide sequences of COL4A6 BINDING SITE, designated SEQ ID:27360, to the nucleotide sequence of VGAM1176 RNA, herein designated VGAM RNA, also designated SEQ ID:3887.

Another function of VGAM1176 is therefore inhibition of Collagen, Type IV, Alpha 6 (COL4A6, Accession NM_033641). Accordingly, utilities of VGAM1176 include diagnosis, prevention and treatment of diseases and clinical conditions associated with COL4A6. EphB1 (EPHB1, Accession NM_004441) is another VGAM1176 host target gene. EPHB1 BINDING SITE is HOST TARGET binding site found in the 3' untranslated region of mRNA encoded by EPHB1, corresponding to a HOST TARGET binding site such as BINDING SITE I, BINDING SITE II or BINDING SITE III. Table 2 illustrates the complementarity of the nucleotide sequences of EPHB1 BINDING SITE, designated SEQ ID:10728, to the nucleotide sequence of VGAM1176 RNA, herein designated VGAM RNA, also designated SEQ ID:3887.

Another function of VGAM1176 is therefore inhibition of EphB1 (EPHB1, Accession NM_004441), a gene which receptor for members of the ephrin-b family. binds to ephrin-b1, -b2 and -b3. Accordingly, utilities of VGAM1176 include diagnosis, prevention and treatment of diseases and clinical conditions associated with EPHB1. The function of EPHB1 and its association with various diseases and clinical conditions, has been established by previous studies, as described hereinabove with reference to VGAM1000. Guanine Nucleotide Binding Protein (G protein), Beta Polypeptide 3 (GNB3, Accession NM_002075) is another VGAM1176 host target gene. GNB3 BINDING SITE is HOST TARGET binding site found in the 5' untranslated region of mRNA encoded by GNB3, corresponding to a HOST TARGET binding site such as BINDING SITE I, BINDING SITE II or BINDING SITE III. Table 2 illustrates the complementarity of the nucleotide sequences of GNB3 BINDING SITE, designated SEQ ID:7854, to the nucleotide sequence of VGAM1176 RNA, herein designated VGAM RNA, also designated SEQ ID:3887.

Another function of VGAM1176 is therefore inhibition of Guanine Nucleotide Binding Protein (G protein), Beta Polypeptide 3 (GNB3, Accession NM_002075), a gene which transduces signals from G protein-coupled receptors to intracellular effectors. Accordingly, utilities of VGAM1176 include diagnosis, prevention and treatment of diseases and clinical conditions associated with GNB3. The function of GNB3 and its association with various diseases and clinical conditions, has been established by previous studies, as described hereinabove with reference to VGAM152. Glypican 1 (GPC1, Accession NM_002081) is another VGAM1176 host target gene. GPC1 BINDING SITE is HOST TARGET binding site found in the 3' untranslated region of mRNA encoded by GPC1, corresponding to a HOST TARGET binding site such as BINDING SITE I, BINDING SITE II or BINDING SITE III. Table 2 illustrates the complementarity of the nucleotide sequences of GPC1 BINDING SITE, designated SEQ ID:7871, to the nucleotide sequence of VGAM1176 RNA, herein designated VGAM RNA, also designated SEQ ID:3887.

Another function of VGAM1176 is therefore inhibition of Glypican 1 (GPC1, Accession NM_002081), a gene which may play a role in growth control and differentation. Accordingly, utilities of VGAM1176 include diagnosis, prevention and treatment of diseases and clinical conditions associated with GPC1. The function of GPC1 and its association with various diseases and clinical conditions, has been established by previous studies, as described hereinabove with reference to VGAM125. Interleukin 1 Family, Member 5 (delta) (IL1F5, Accession NM_012275) is another VGAM1176 host target gene. IL1F5 BINDING SITE is HOST TARGET binding site found in the 5' untranslated region of mRNA encoded by IL1F5, corresponding to a HOST TARGET binding site such as BINDING SITE I, BINDING SITE II or BINDING SITE III. Table 2 illustrates the complementarity of the nucleotide sequences of IL1F5 BINDING SITE, designated SEQ ID:14600, to the nucleotide sequence of VGAM1176 RNA, herein designated VGAM RNA, also designated SEQ ID:3887.

Another function of VGAM1176 is therefore inhibition of Interleukin 1 Family, Member 5 (delta) (IL1F5, Accession NM_012275), a gene which is a novel interleukin-1 receptor antagonist gene. Accordingly, utilities of VGAM1176 include diagnosis, prevention and treatment of diseases and clinical conditions associated with IL1F5. The function of IL1F5 and its association with various diseases and clinical conditions, has been established by previous studies, as described hereinabove with reference to VGAM263. Matrix Metalloproteinase 19 (MMP19, Accession NM_022791) is another VGAM1176 host target gene. MMP19 BINDING SITE is HOST TARGET binding site found in the 5' untranslated region of mRNA encoded by MMP19, corresponding to a HOST TARGET binding site such as BINDING SITE I, BINDING SITE II or BINDING SITE III. Table 2 illustrates the complementarity of the nucleotide sequences of MMP19 BINDING SITE, designated SEQ ID:23080, to the nucleotide sequence of VGAM1176 RNA, herein designated VGAM RNA, also designated SEQ ID:3887.

Another function of VGAM1176 is therefore inhibition of Matrix Metalloproteinase 19 (MMP19, Accession NM_022791). Accordingly, utilities of VGAM1176 include diagnosis, prevention and treatment of diseases and clinical conditions associated with MMP19. Nuclear RNA Export Factor 2 (NXF2, Accession NM_022053) is another VGAM1176 host target gene. NXF2 BINDING SITE is HOST TARGET binding site found in the 5' untranslated region of mRNA encoded by NXF2, corresponding to a HOST TARGET binding site such as BINDING SITE I, BINDING SITE II or BINDING SITE III. Table 2 illustrates the complementarity of the nucleotide sequences of NXF2 BINDING SITE, designated SEQ ID:22591, to the nucleotide sequence of VGAM1176 RNA, herein designated VGAM RNA, also designated SEQ ID:3887.

Another function of VGAM1176 is therefore inhibition of Nuclear RNA Export Factor 2 (NXF2, Accession NM_022053), a gene which is involved in the export of mrna from the nucleus to the cytoplasm. Accordingly, utilities of VGAM1176 include diagnosis, prevention and treatment of diseases and clinical conditions associated with NXF2. The function of NXF2 and its association with various diseases and clinical conditions, has been established by previous studies, as described hereinabove with reference to VGAM595. Oligophrenin 1 (OPHN1, Accession NM_002547) is another VGAM1176 host target gene. OPHN1 BINDING SITE is HOST TARGET binding site found in the 3' untranslated region of mRNA encoded by OPHN1, corresponding to a HOST TARGET binding site such as BINDING SITE I, BINDING SITE II or BINDING SITE III. Table 2 illustrates the complementarity of the nucleotide sequences of OPHN1 BINDING SITE, designated SEQ ID:8406, to the nucleotide sequence of VGAM1176 RNA, herein designated VGAM RNA, also designated SEQ ID:3887.

Another function of VGAM1176 is therefore inhibition of Oligophrenin 1 (OPHN1, Accession NM_002547). Accordingly, utilities of VGAM1176 include diagnosis, prevention and treatment of diseases and clinical conditions associated with OPHN1. Podocalyxin-like (PODXL, Accession NM_005397) is another VGAM1176 host target gene. PODXL BINDING SITE is HOST TARGET binding site found in the 3' untranslated region of mRNA encoded by PODXL, corresponding to a HOST TARGET binding site such as BINDING SITE I, BINDING SITE II or BINDING SITE III. Table 2 illustrates the complementarity of the nucleotide sequences of PODXL BINDING SITE, designated SEQ ID:11873, to the nucleotide sequence of VGAM1176 RNA, herein designated VGAM RNA, also designated SEQ ID:3887.

Another function of VGAM1176 is therefore inhibition of Podocalyxin-like (PODXL, Accession NM_005397), a gene which is an antiadhesin. Accordingly, utilities of VGAM1176 include diagnosis, prevention and treatment of diseases and clinical conditions associated with PODXL. The function of PODXL and its association with various diseases and clinical conditions, has been established by previous studies, as described hereinabove with reference to VGAM247. Ribonuclease, RNase A Family, 1 (pancreatic) (RNASE1, Accession NM_002933) is another VGAM1176 host target gene. RNASE1 BINDING SITE is HOST TARGET binding site found in the 5' untranslated region of mRNA encoded by RNASE1, corresponding to a HOST TARGET binding site such as BINDING SITE I, BINDING SITE II or BINDING SITE III. Table 2 illustrates the complementarity of the nucleotide sequences of RNASE1 BINDING SITE, designated SEQ ID:8837, to the nucleotide sequence of VGAM1176 RNA, herein designated VGAM RNA, also designated SEQ ID:3887.

Another function of VGAM1176 is therefore inhibition of Ribonuclease, RNase A Family, 1 (pancreatic) (RNASE1, Accession NM_002933), a gene which is a Pancreatic ribonuclease; a pyrimidine-specific endonuclease that generates 2',3'-cyclic phosphate products. Accordingly, utilities of VGAM1176 include diagnosis, prevention and treatment of diseases and clinical conditions associated with RNASE1. The function of RNASE1 and its association with various diseases and clinical conditions, has been established by previous studies, as described hereinabove with reference to VGAM210. Caspase Recruitment Domain Family, Member 14 (CARD14, Accession NM_052819) is another VGAM1176 host target gene. CARD14 BINDING SITE is HOST TARGET binding site found in the 5' untranslated region of mRNA encoded by CARD14, corresponding to a HOST TARGET binding site such as BINDING SITE I, BINDING SITE II or BINDING SITE III. Table 2 illustrates the complementarity of the nucleotide sequences of CARD14 BINDING SITE, designated SEQ ID:27407, to the nucleotide sequence of VGAM1176 RNA, herein designated VGAM RNA, also designated SEQ ID:3887.

Another function of VGAM1176 is therefore inhibition of Caspase Recruitment Domain Family, Member 14 (CARD14, Accession NM_052819). Accordingly, utilities of VGAM1176 include diagnosis, prevention and treatment of diseases and clinical conditions associated with CARD14. Carbohydrate (chondroitin 6) Sulfotransferase 3 (CHST3, Accession NM_004273) is another VGAM1176 host target gene. CHST3 BINDING SITE is HOST TARGET binding site found in the 3' untranslated region of mRNA encoded by CHST3, corresponding to a HOST TARGET binding site such as BINDING SITE I, BINDING SITE II or BINDING SITE III. Table 2 illustrates the complementarity of the nucleotide sequences of CHST3 BINDING SITE, designated SEQ ID:10482, to the nucleotide sequence of VGAM1176 RNA, herein designated VGAM RNA, also designated SEQ ID:3887.

Another function of VGAM1176 is therefore inhibition of Carbohydrate (chondroitin 6) Sulfotransferase 3 (CHST3, Accession NM_004273). Accordingly, utilities of VGAM1176 include diagnosis, prevention and treatment of diseases and clinical conditions associated with CHST3. DKFZP586B2420 (Accession XM_059482) is another VGAM1176 host target gene. DKFZP586B2420 BINDING SITE is HOST TARGET binding site found in the 3' untranslated region of mRNA encoded by DKFZP586B2420, corresponding to a HOST TARGET binding site such as BINDING SITE I, BINDING SITE II or BINDING SITE III. Table 2 illustrates the complementarity of the nucleotide sequences of DKFZP586B2420 BINDING SITE, designated SEQ ID:37010, to the nucleotide sequence of VGAM1176 RNA, herein designated VGAM RNA, also designated SEQ ID:3887.

Another function of VGAM1176 is therefore inhibition of DKFZP586B2420 (Accession XM_059482). Accordingly, utilities of VGAM1176 include diagnosis, prevention and treatment of diseases and clinical conditions associated with DKFZP586B2420. DKFZp586I021 (Accession NM_032271) is another VGAM1176 host target gene. DKFZp586I021 BINDING SITE is HOST TARGET binding site found in the 3' untranslated region of mRNA encoded by DKFZp586I021, corresponding to a HOST TARGET binding site such as BINDING SITE I, BINDING SITE II or BINDING SITE III. Table 2 illustrates the complementarity of the nucleotide sequences of DKFZp586I021 BINDING SITE, designated SEQ ID:26023, to the nucleotide sequence of VGAM1176 RNA, herein designated VGAM RNA, also designated SEQ ID:3887.

Another function of VGAM1176 is therefore inhibition of DKFZp586I021 (Accession NM_032271). Accordingly, utilities of VGAM1176 include diagnosis, prevention and treatment of diseases and clinical conditions associated with DKFZp586I021. DRIL2 (Accession NM_006465) is another VGAM1176 host target gene. DRIL2 BINDING SITE is HOST TARGET binding site found in the 3' untranslated region of mRNA encoded by DRIL2, corresponding to a HOST TARGET binding site such as BINDING SITE I, BINDING SITE II or BINDING SITE III. Table 2 illustrates the complementarity of the nucleotide sequences of DRIL2 BINDING SITE, designated SEQ ID:13186, to the nucleotide sequence of VGAM1176 RNA, herein designated VGAM RNA, also designated SEQ ID:3887.

Another function of VGAM1176 is therefore inhibition of DRIL2 (Accession NM_006465). Accordingly, utilities of VGAM1176 include diagnosis, prevention and treatment of diseases and clinical conditions associated with DRIL2. FLB6421 (Accession NM_020119) is another VGAM1176 host target gene. FLB6421 BINDING SITE is HOST TARGET binding site found in the 5' untranslated region of mRNA encoded by FLB6421, corresponding to a HOST TARGET binding site such as BINDING SITE I, BINDING SITE II or BINDING SITE III. Table 2 illustrates the complementarity of the nucleotide sequences of FLB6421 BINDING SITE, designated SEQ ID:21301, to the nucleotide sequence of VGAM1176 RNA, herein designated VGAM RNA, also designated SEQ ID:3887.

Another function of VGAM1176 is therefore inhibition of FLB6421 (Accession NM_020119). Accordingly, utilities of VGAM1176 include diagnosis, prevention and treatment of diseases and clinical conditions associated with FLB6421. FLJ10521 (Accession NM_018125) is another VGAM1176 host target gene. FLJ10521 BINDING SITE is HOST TARGET binding site found in the 3' untranslated region of mRNA encoded by FLJ10521, corresponding to a HOST TARGET binding site such as BINDING SITE I, BINDING SITE II or BINDING SITE III. Table 2 illustrates the complementarity of the nucleotide sequences of FLJ10521 BINDING SITE, designated SEQ ID:19910, to the nucleotide sequence of VGAM1176 RNA, herein designated VGAM RNA, also designated SEQ ID:3887.

Another function of VGAM1176 is therefore inhibition of FLJ10521 (Accession NM_018125). Accordingly, utilities of VGAM1176 include diagnosis, prevention and treatment of diseases and clinical conditions associated with FLJ10521. FLJ10620 (Accession NM_018157) is another VGAM1176 host target gene. FLJ10620 BINDING SITE is HOST TARGET binding site found in the 3' untranslated region of mRNA encoded by FLJ10620, corresponding to a HOST TARGET binding site such as BINDING SITE I, BINDING SITE II or BINDING SITE III. Table 2 illustrates the complementarity of the nucleotide sequences of FLJ10620 BINDING SITE, designated SEQ ID:19975, to the nucleotide sequence of VGAM1176 RNA, herein designated VGAM RNA, also designated SEQ ID:3887.

Another function of VGAM1176 is therefore inhibition of FLJ10620 (Accession NM_018157). Accordingly, utilities of VGAM1176 include diagnosis, prevention and treatment of diseases and clinical conditions associated with FLJ10620. FLJ10751 (Accession NM_018205) is another VGAM1176 host target gene. FLJ10751 BINDING SITE1 and FLJ10751 BINDING SITE2 are HOST TARGET binding sites found in untranslated regions of mRNA encoded by FLJ10751, corresponding to HOST TARGET binding sites such as BINDING SITE I, BINDING SITE II or BINDING SITE III. Table 2 illustrates the complementarity of the nucleotide sequences of FLJ10751 BINDING SITE1 and FLJ10751 BINDING SITE2, designated SEQ ID:20090 and SEQ ID:20189 respectively, to the nucleotide sequence of VGAM1176 RNA, herein designated VGAM RNA, also designated SEQ ID:3887.

Another function of VGAM1176 is therefore inhibition of FLJ10751 (Accession NM_018205). Accordingly, utilities of VGAM1176 include diagnosis, prevention and treatment of diseases and clinical conditions associated with FLJ10751. FLJ12547 (Accession NM_024992) is another VGAM1176 host target gene. FLJ12547 BINDING SITE is HOST TARGET binding site found in the 3' untranslated region of mRNA encoded by FLJ12547, corresponding to a HOST TARGET binding site such as BINDING SITE I, BINDING SITE II or BINDING SITE III. Table 2 illustrates the complementarity of the nucleotide sequences of FLJ12547 BINDING SITE, designated SEQ ID:24547, to the nucleotide sequence of VGAM1176 RNA, herein designated VGAM RNA, also designated SEQ ID:3887.

Another function of VGAM1176 is therefore inhibition of FLJ12547 (Accession NM_024992). Accordingly, utilities of VGAM1176 include diagnosis, prevention and treatment of diseases and clinical conditions associated with FLJ12547. FLJ31709 (Accession NM_144636) is another VGAM1176 host target gene. FLJ31709 BINDING SITE is HOST TARGET binding site found in the 5' untranslated region of mRNA encoded by FLJ31709, corresponding to a HOST TARGET binding site such as BINDING SITE I, BINDING SITE II or BINDING SITE III. Table 2 illustrates the complementarity of the nucleotide sequences of FLJ31709 BINDING SITE, designated SEQ ID:29459, to the nucleotide sequence of VGAM1176 RNA, herein designated VGAM RNA, also designated SEQ ID:3887.

Another function of VGAM1176 is therefore inhibition of FLJ31709 (Accession NM_144636). Accordingly, utilities of VGAM1176 include diagnosis, prevention and treatment of diseases and clinical conditions associated with FLJ31709. Hypermethylated In Cancer 2 (HIC2, Accession XM_036937) is another VGAM1176 host target gene. HIC2 BINDING SITE is HOST TARGET binding site found in the 3' untranslated region of mRNA encoded by HIC2, corresponding to a HOST TARGET binding site such as BINDING SITE I, BINDING SITE II or BINDING SITE III. Table 2 illustrates the complementarity of the nucleotide sequences of HIC2 BINDING SITE, designated SEQ ID:32533, to the nucleotide sequence of VGAM1176 RNA, herein designated VGAM RNA, also designated SEQ ID:3887.

Another function of VGAM1176 is therefore inhibition of Hypermethylated In Cancer 2 (HIC2, Accession XM_036937). Accordingly, utilities of VGAM1176 include diagnosis, prevention and treatment of diseases and clinical conditions associated with HIC2. KIAA0317 (Accession NM_014821) is another VGAM1176 host target gene. KIAA0317 BINDING SITE is HOST TARGET binding site found in the 5' untranslated region of mRNA encoded by KIAA0317, corresponding to a HOST TARGET binding site such as BINDING SITE I, BINDING SITE II or BINDING SITE III. Table 2 illustrates the complementarity of the nucleotide sequences of KIAA0317 BINDING SITE, designated SEQ ID:16794, to the nucleotide sequence of VGAM1176 RNA, herein designated VGAM RNA, also designated SEQ ID:3887.

Another function of VGAM1176 is therefore inhibition of KIAA0317 (Accession NM_014821). Accordingly, utilities of VGAM1176 include diagnosis, prevention and treatment of diseases and clinical conditions associated with KIAA0317. KIAA0417 (Accession XM_048898) is another VGAM1176 host target gene. KIAA0417 BINDING SITE is HOST TARGET binding site found in the 3' untranslated region of mRNA encoded by KIAA0417, corresponding to a HOST TARGET binding site such as BINDING SITE I, BINDING SITE II or BINDING SITE III. Table 2 illustrates the complementarity of the nucleotide sequences of KIAA0417 BINDING SITE, designated SEQ ID:35292, to the nucleotide sequence of VGAM1176 RNA, herein designated VGAM RNA, also designated SEQ ID:3887.

Another function of VGAM1176 is therefore inhibition of KIAA0417 (Accession XM_048898). Accordingly, utilities of VGAM1176 include diagnosis, prevention and treatment of diseases and clinical conditions associated with KIAA0417. KIAA0574 (Accession XM_045076) is another VGAM1176 host target gene. KIAA0574 BINDING SITE is HOST TARGET binding site found in the 3' untranslated region of mRNA encoded by KIAA0574, corresponding to a HOST TARGET binding site such as BINDING SITE I, BINDING SITE II or BINDING SITE III. Table 2 illustrates the complementarity of the nucleotide sequences of KIAA0574 BINDING SITE, designated SEQ ID:34344, to the nucleotide sequence of VGAM1176 RNA, herein designated VGAM RNA, also designated SEQ ID:3887.

Another function of VGAM1176 is therefore inhibition of KIAA0574 (Accession XM_045076). Accordingly, utilities of VGAM1176 include diagnosis, prevention and treatment of diseases and clinical conditions associated with KIAA0574. KIAA0939 (Accession XM_030524) is another VGAM1176 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31066, to the nucleotide sequence of VGAM1176 RNA, herein designated VGAM RNA, also designated SEQ ID:3887.

Another function of VGAM1176 is therefore inhibition of KIAA0939 (Accession XM_030524). Accordingly, utilities of VGAM1176 include diagnosis, prevention and treatment of diseases and clinical conditions associated with KIAA0939. KIAA1211 (Accession XM_044178) is another VGAM1176 host target gene. KIAA1211 BINDING SITE is HOST TARGET binding site found in the 3' untranslated region of mRNA encoded by KIAA1211, corresponding to a HOST TARGET binding site such as BINDING SITE I, BINDING SITE II or BINDING SITE III. Table 2 illustrates the complementarity of the nucleotide sequences of KIAA1211 BINDING SITE, designated SEQ ID:34166, to the nucleotide sequence of VGAM1176 RNA, herein designated VGAM RNA, also designated SEQ ID:3887.

Another function of VGAM1176 is therefore inhibition of KIAA1211 (Accession XM_044178). Accordingly, utilities of VGAM1176 include diagnosis, prevention and treatment of diseases and clinical conditions associated with KIAA1211. KIAA1580 (Accession XM_045271) is another VGAM1176 host target gene. KIAA1580 BINDING SITE is HOST TARGET binding site found in the 5' untranslated region of mRNA encoded by KIAA1580, corresponding to a HOST TARGET binding site such as BINDING SITE I, BINDING SITE II or BINDING SITE III. Table 2 illustrates the complementarity of the nucleotide sequences of KIAA1580 BINDING SITE, designated SEQ ID:34407, to the nucleotide sequence of VGAM1176 RNA, herein designated VGAM RNA, also designated SEQ ID:3887.

Another function of VGAM1176 is therefore inhibition of KIAA1580 (Accession XM_045271). Accordingly, utilities of VGAM1176 include diagnosis, prevention and treatment of diseases and clinical conditions associated with KIAA1580. KIAA1879 (Accession XM_056635) is another VGAM1176 host target gene. KIAA1879 BINDING SITE is HOST TARGET binding site found in the 3' untranslated region of mRNA encoded by KIAA1879, corresponding to a HOST TARGET binding site such as BINDING SITE I, BINDING SITE II or BINDING SITE III. Table 2 illustrates the complementarity of the nucleotide sequences of KIAA1879 BINDING SITE, designated SEQ ID:36415, to the nucleotide sequence of VGAM1176 RNA, herein designated VGAM RNA, also designated SEQ ID:3887.

Another function of VGAM1176 is therefore inhibition of KIAA1879 (Accession XM_056635). Accordingly, utilities of VGAM1176 include diagnosis, prevention and treatment of diseases and clinical conditions associated with KIAA1879. LanC Lantibiotic Synthetase Component C-like 2 (bacterial) (LANCL2, Accession NM_018697) is another VGAM1176 host target gene. LANCL2 BINDING SITE is HOST TARGET binding site found in the 3' untranslated region of mRNA encoded by LANCL2, corresponding to a HOST TARGET binding site such as BINDING SITE I, BINDING SITE II or BINDING SITE III. Table 2 illustrates the complementarity of the nucleotide sequences of LANCL2 BINDING SITE, designated SEQ ID:20776, to the nucleotide sequence of VGAM1176 RNA, herein designated VGAM RNA, also designated SEQ ID:3887.

Another function of VGAM1176 is therefore inhibition of LanC Lantibiotic Synthetase Component C-like 2 (bacterial) (LANCL2, Accession NM_018697). Accordingly, utilities of VGAM1176 include diagnosis, prevention and treatment of diseases and clinical conditions associated with LANCL2. MAC30 (Accession XM_031536) is another VGAM1176 host target gene. MAC30 BINDING SITE is HOST TARGET binding site found in the 5' untranslated region of mRNA encoded by MAC30, corresponding to a HOST TARGET binding site such as BINDING SITE I, BINDING SITE II or BINDING SITE III. Table 2 illustrates the complementarity of the nucleotide sequences of MAC30 BINDING SITE, designated SEQ ID:31405, to the nucleotide sequence of VGAM1176 RNA, herein designated VGAM RNA, also designated SEQ ID:3887.

Another function of VGAM1176 is therefore inhibition of MAC30 (Accession XM_031536). Accordingly, utilities of VGAM1176 include diagnosis, prevention and treatment of diseases and clinical conditions associated with MAC30. Mitogen-activated Protein Kinase Kinase Kinase 3 (MAP3K3, Accession NM_002401) is another VGAM1176 host target gene. MAP3K3 BINDING SITE is HOST TARGET binding site found in the 3' untranslated region of mRNA encoded by MAP3K3, corresponding to a HOST TARGET binding site such as BINDING SITE I, BINDING SITE II or BINDING SITE III. Table 2 illustrates the complementarity of the nucleotide sequences of MAP3K3 BINDING SITE, designated SEQ ID:8224, to the nucleotide sequence of VGAM1176 RNA, herein designated VGAM RNA, also designated SEQ ID:3887.

Another function of VGAM1176 is therefore inhibition of Mitogen-activated Protein Kinase Kinase Kinase 3 (MAP3K3, Accession NM_002401). Accordingly, utilities of VGAM1176 include diagnosis, prevention and treatment of diseases and clinical conditions associated with MAP3K3. MGC4368 (Accession NM_024510) is another VGAM1176 host target gene. MGC4368 BINDING SITE is HOST TARGET binding site found in the 3' untranslated region of mRNA encoded by MGC4368, corresponding to a HOST TARGET binding site such as BINDING SITE I, BINDING SITE II or BINDING SITE III. Table 2 illustrates the complementarity of the nucleotide sequences of MGC4368 BINDING SITE, designated SEQ ID:23699, to the nucleotide sequence of VGAM1176 RNA, herein designated VGAM RNA, also designated SEQ ID:3887.

Another function of VGAM1176 is therefore inhibition of MGC4368 (Accession NM_024510). Accordingly, utilities of VGAM1176 include diagnosis, prevention and treatment of diseases and clinical conditions associated with MGC4368. NIFU (Accession XM_041081) is another VGAM1176 host target gene. NIFU BINDING SITE is HOST TARGET binding site found in the 5' untranslated region of mRNA encoded by NIFU, corresponding to a HOST TARGET binding site such as BINDING SITE I, BINDING SITE II or BINDING SITE III. Table 2 illustrates the complementarity of the nucleotide sequences of NIFU BINDING SITE, designated SEQ ID:33437, to the nucleotide sequence of VGAM1176 RNA, herein designated VGAM RNA, also designated SEQ ID:3887.

Another function of VGAM1176 is therefore inhibition of NIFU (Accession XM_041081). Accordingly, utilities of VGAM1176 include diagnosis, prevention and treatment of diseases and clinical conditions associated with NIFU. RALGPS1A (Accession NM_014636) is another VGAM1176 host target gene. RALGPS1A BINDING SITE is HOST TARGET binding site found in the 3' untranslated region of mRNA encoded by RALGPS1A, corresponding to a HOST TARGET binding site such as BINDING SITE I, BINDING SITE II or BINDING SITE III. Table 2 illustrates the complementarity of the nucleotide sequences of RALGPS1A BINDING SITE, designated SEQ ID:16017, to the nucleotide sequence of VGAM1176 RNA, herein designated VGAM RNA, also designated SEQ ID:3887.

Another function of VGAM1176 is therefore inhibition of RALGPS1A (Accession NM_014636). Accordingly, utilities of VGAM1176 include diagnosis, prevention and treatment of diseases and clinical conditions associated with RALGPS1A. TED (Accession NM_015686) is another VGAM1176 host target gene. TED BINDING SITE is HOST TARGET binding site found in the 3' untranslated region of mRNA encoded by TED, corresponding to a HOST TARGET binding site such as BINDING SITE I, BINDING SITE II or BINDING SITE III. Table 2 illustrates the complementarity of the nucleotide sequences of TED BINDING SITE, designated SEQ ID:17916, to the nucleotide sequence of VGAM1176 RNA, herein designated VGAM RNA, also designated SEQ ID:3887.

Another function of VGAM1176 is therefore inhibition of TED (Accession NM_015686). Accordingly, utilities of VGAM1176 include diagnosis, prevention and treatment of diseases and clinical conditions associated with TED. LOC115129 (Accession XM_055292) is another VGAM1176 host target gene. LOC115129 BINDING SITE is HOST TARGET binding site found in the 3' untranslated region of mRNA encoded by LOC115129, corresponding to a HOST TARGET binding site such as BINDING SITE I, BINDING SITE II or BINDING SITE III. Table 2 illustrates the complementarity of the nucleotide sequences of LOC115129 BINDING SITE, designated SEQ ID:36254, to the nucleotide sequence of VGAM1176 RNA, herein designated VGAM RNA, also designated SEQ ID:3887.

Another function of VGAM1176 is therefore inhibition of LOC115129 (Accession XM_055292). Accordingly, utilities of VGAM1176 include diagnosis, prevention and treatment of diseases and clinical conditions associated with LOC115129. LOC124977 (Accession XM_071942) is another VGAM1176 host target gene. LOC124977 BINDING SITE is HOST TARGET binding site found in the 5' untranslated region of mRNA encoded by LOC124977, corresponding to a HOST TARGET binding site such as BINDING SITE I, BINDING SITE II or BINDING SITE III. Table 2 illustrates the complementarity of the nucleotide sequences of LOC124977 BINDING SITE, designated SEQ ID:37448, to the nucleotide sequence of VGAM1176 RNA, herein designated VGAM RNA, also designated SEQ ID:3887.

Another function of VGAM1176 is therefore inhibition of LOC124977 (Accession XM_071942). Accordingly, utilities of VGAM1176 include diagnosis, prevention and treatment of diseases and clinical conditions associated with LOC124977. LOC138399 (Accession XM_059971) is another VGAM1176 host target gene. LOC138399 BINDING SITE is HOST TARGET binding site found in the 5' untranslated region of mRNA encoded by LOC138399, corresponding to a HOST TARGET binding site such as BINDING SITE I, BINDING SITE II or BINDING SITE III. Table 2 illustrates the complementarity of the nucleotide sequences of LOC138399 BINDING SITE, designated SEQ ID:37132, to the nucleotide sequence of VGAM1176 RNA, herein designated VGAM RNA, also designated SEQ ID:3887.

Another function of VGAM1176 is therefore inhibition of LOC138399 (Accession XM_059971). Accordingly, utilities of VGAM1176 include diagnosis, prevention and treatment of diseases and clinical conditions associated with LOC138399. LOC142941 (Accession XM_096363) is another VGAM1176 host target gene. LOC142941 BINDING SITE is HOST TARGET binding site found in the 5' untranslated region of mRNA encoded by LOC142941, corresponding to a HOST TARGET binding site such as BINDING SITE I, BINDING SITE II or BINDING SITE III. Table 2 illustrates the complementarity of the nucleotide sequences of LOC142941 BINDING SITE, designated SEQ ID:40323, to the nucleotide sequence of VGAM1176 RNA, herein designated VGAM RNA, also designated SEQ ID:3887.

Another function of VGAM1176 is therefore inhibition of LOC142941 (Accession XM_096363). Accordingly, utilities of VGAM1176 include diagnosis, prevention and treatment of diseases and clinical conditions associated with LOC142941. LOC144481 (Accession XM_096611) is another VGAM1176 host target gene. LOC144481 BINDING SITE is HOST TARGET binding site found in the 3' untranslated region of mRNA encoded by LOC144481, corresponding to a HOST TARGET binding site such as BINDING SITE I, BINDING SITE II or BINDING SITE III. Table 2 illustrates the complementarity of the nucleotide sequences of LOC144481 BINDING SITE, designated SEQ ID:40420, to the nucleotide sequence of VGAM1176 RNA, herein designated VGAM RNA, also designated SEQ ID:3887.

Another function of VGAM1176 is therefore inhibition of LOC144481 (Accession XM_096611). Accordingly, utilities of VGAM1176 include diagnosis, prevention and treatment of diseases and clinical conditions associated with LOC144481. LOC146138 (Accession XM_096938) is another VGAM1176 host target gene. LOC146138 BINDING SITE is HOST TARGET binding site found in the 3' untranslated region of mRNA encoded by LOC146138, corresponding to a HOST TARGET binding site such as BINDING SITE I, BINDING SITE II or BINDING SITE III. Table 2 illustrates the complementarity of the nucleotide sequences of LOC146138 BINDING SITE, designated SEQ ID:40657, to the nucleotide sequence of VGAM1176 RNA, herein designated VGAM RNA, also designated SEQ ID:3887.

Another function of VGAM1176 is therefore inhibition of LOC146138 (Accession XM_096938). Accordingly, utilities of VGAM1176 include diagnosis, prevention and treatment of diseases and clinical conditions associated with LOC146138. LOC146333 (Accession XM_091306) is another VGAM1176 host target gene. LOC146333 BINDING SITE is HOST TARGET binding site found in the 5' untranslated region of mRNA encoded by LOC146333, corresponding to a HOST TARGET binding site such as BINDING SITE I, BINDING SITE II or BINDING SITE III. Table 2 illustrates the complementarity of the nucleotide sequences of LOC146333 BINDING SITE, designated SEQ ID:40045, to the nucleotide sequence of VGAM1176 RNA, herein designated VGAM RNA, also designated SEQ ID:3887.

Another function of VGAM1176 is therefore inhibition of LOC146333 (Accession XM_091306). Accordingly, utilities of VGAM1176 include diagnosis, prevention and treatment of diseases and clinical conditions associated with LOC146333. LOC149175 (Accession XM_086445) is another VGAM1176 host target gene. LOC149175 BINDING SITE is HOST TARGET binding site found in the 3' untranslated region of mRNA encoded by LOC149175, corresponding to a HOST TARGET binding site such as BINDING SITE I, BINDING SITE II or BINDING SITE III. Table 2 illustrates the complementarity of the nucleotide sequences of LOC149175 BINDING SITE, designated SEQ ID:38663, to the nucleotide sequence of VGAM1176 RNA, herein designated VGAM RNA, also designated SEQ ID:3887.

Another function of VGAM1176 is therefore inhibition of LOC149175 (Accession XM_086445). Accordingly, utilities of VGAM1176 include diagnosis, prevention and treatment of diseases and clinical conditions associated with LOC149175. LOC153883 (Accession XM_087798) is another VGAM1176 host target gene. LOC153883 BINDING SITE is HOST TARGET binding site found in the 5' untranslated region of mRNA encoded by LOC153883, corresponding to a HOST TARGET binding site such as BINDING SITE I, BINDING SITE II or BINDING SITE III. Table 2 illustrates the complementarity of the nucleotide sequences of LOC153883 BINDING SITE, designated SEQ ID:39432, to the nucleotide sequence of VGAM1176 RNA, herein designated VGAM RNA, also designated SEQ ID:3887.

Another function of VGAM1176 is therefore inhibition of LOC153883 (Accession XM_087798). Accordingly, utilities of VGAM1176 include diagnosis, prevention and treatment of diseases and clinical conditions associated with LOC153883. LOC157931 (Accession XM_098845) is another VGAM1176 host target gene. LOC157931 BINDING SITE is HOST TARGET binding site found in the 3' untranslated region of mRNA encoded by LOC157931, corresponding to a HOST TARGET binding site such as BINDING SITE I, BINDING SITE II or BINDING SITE III. Table 2 illustrates the complementarity of the nucleotide sequences of LOC157931 BINDING SITE, designated SEQ ID:41905, to the nucleotide sequence of VGAM1176 RNA, herein designated VGAM RNA, also designated SEQ ID:3887.

Another function of VGAM1176 is therefore inhibition of LOC157931 (Accession XM_098845). Accordingly, utilities of VGAM1176 include diagnosis, prevention and treatment of diseases and clinical conditions associated with LOC157931. LOC196759 (Accession XM_113601) is another VGAM1176 host target gene. LOC196759 BINDING SITE is HOST TARGET binding site found in the 5' untranslated region of mRNA encoded by LOC196759, corresponding to a HOST TARGET binding site such as BINDING SITE I, BINDING SITE II or BINDING SITE III. Table 2 illustrates the complementarity of the nucleotide sequences of LOC196759 BINDING SITE, designated SEQ ID:42296, to the nucleotide sequence of VGAM1176 RNA, herein designated VGAM RNA, also designated SEQ ID:3887.

Another function of VGAM1176 is therefore inhibition of LOC196759 (Accession XM_113601). Accordingly, utilities of VGAM1176 include diagnosis, prevention and treatment of diseases and clinical conditions associated with LOC196759. LOC199864 (Accession XM_117146) is another VGAM1176 host target gene. LOC199864 BINDING SITE is HOST TARGET binding site found in the 5' untranslated region of mRNA encoded by LOC199864, corresponding to a HOST TARGET binding site such as BINDING SITE I, BINDING SITE II or BINDING SITE III. Table 2 illustrates the complementarity of the nucleotide sequences of LOC199864 BINDING SITE, designated SEQ ID:43252, to the nucleotide sequence of VGAM1176 RNA, herein designated VGAM RNA, also designated SEQ ID:3887.

Another function of VGAM1176 is therefore inhibition of LOC199864 (Accession XM_117146). Accordingly, utilities of VGAM1176 include diagnosis, prevention and treatment of diseases and clinical conditions associated with LOC199864. LOC200734 (Accession XM_114286) is another VGAM1176 host target gene. LOC200734 BINDING SITE is HOST TARGET binding site found in the 3' untranslated region of mRNA encoded by LOC200734, corresponding to a HOST TARGET binding site such as BINDING SITE I, BINDING SITE II or BINDING SITE III. Table 2 illustrates the complementarity of the nucleotide sequences of LOC200734 BINDING SITE, designated SEQ ID:42842, to the nucleotide sequence of VGAM1176 RNA, herein designated VGAM RNA, also designated SEQ ID:3887.

Another function of VGAM1176 is therefore inhibition of LOC200734 (Accession XM_114286). Accordingly, utilities of VGAM1176 include diagnosis, prevention and treatment of diseases and clinical conditions associated with LOC200734. LOC202934 (Accession XM_117486) is another VGAM1176 host target gene. LOC202934 BINDING SITE is HOST TARGET binding site found in the 5' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43454, to the nucleotide sequence of VGAM1176 RNA, herein designated VGAM RNA, also designated SEQ ID:3887.

Another function of VGAM1176 is therefore inhibition of LOC202934 (Accession XM_117486). Accordingly, utilities of VGAM1176 include diagnosis, prevention and treatment of diseases and clinical conditions associated with LOC202934. LOC220776 (Accession XM_043388) is another VGAM1176 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33937, to the nucleotide sequence of VGAM1176 RNA, herein designated VGAM RNA, also designated SEQ ID:3887.

Another function of VGAM1176 is therefore inhibition of LOC220776 (Accession XM_043388). Accordingly, utilities of VGAM1176 include diagnosis, prevention and treatment of diseases and clinical conditions associated with LOC220776. LOC253868 (Accession XM_170975) is another VGAM1176 host target gene. LOC253868 BINDING SITE is HOST TARGET binding site found in the 5' untranslated region of mRNA encoded by LOC253868, corresponding to a HOST TARGET binding site such as BINDING SITE I, BINDING SITE II or BINDING SITE III. Table 2 illustrates the complementarity of the nucleotide sequences of LOC253868 BINDING SITE, designated SEQ ID:45749, to the nucleotide sequence of VGAM1176 RNA, herein designated VGAM RNA, also designated SEQ ID:3887.

Another function of VGAM1176 is therefore inhibition of LOC253868 (Accession XM_170975). Accordingly, utilities of VGAM1176 include diagnosis, prevention and treatment of diseases and clinical conditions associated with LOC253868. LOC254045 (Accession XM_172882) is another VGAM1176 host target gene. LOC254045 BINDING SITE is HOST TARGET binding site found in the 3' untranslated region of mRNA encoded by LOC254045, corresponding to a HOST TARGET binding site such as BINDING SITE I, BINDING SITE II or BINDING SITE III. Table 2 illustrates the complementarity of the nucleotide sequences of LOC254045 BINDING SITE, designated SEQ ID:46162, to the nucleotide sequence of VGAM1176 RNA, herein designated VGAM RNA, also designated SEQ ID:3887.

Another function of VGAM1176 is therefore inhibition of LOC254045 (Accession XM_172882). Accordingly, utilities of VGAM1176 include diagnosis, prevention and treatment of diseases and clinical conditions associated with LOC254045. LOC255465 (Accession XM_173206) is another VGAM1176 host target gene. LOC255465 BINDING SITE is HOST TARGET binding site found in the 5' untranslated region of mRNA encoded by LOC255465, corresponding to a HOST TARGET binding site such as BINDING SITE I, BINDING SITE II or BINDING SITE III. Table 2 illustrates the complementarity of the nucleotide sequences of LOC255465 BINDING SITE, designated SEQ ID:46448, to the nucleotide sequence of VGAM1176 RNA, herein designated VGAM RNA, also designated SEQ ID:3887.

Another function of VGAM1176 is therefore inhibition of LOC255465 (Accession XM_173206). Accordingly, utilities of VGAM1176 include diagnosis, prevention and treatment of diseases and clinical conditions associated with LOC255465. LOC91351 (Accession XM_037817) is another VGAM1176 host target gene. LOC91351 BINDING SITE is HOST TARGET binding site found in the 3' untranslated region of mRNA encoded by LOC91351, corresponding to a HOST TARGET binding site such as BINDING SITE I, BINDING SITE II or BINDING SITE III. Table 2 illustrates the complementarity of the nucleotide sequences of LOC91351 BINDING SITE, designated SEQ ID:32699, to the nucleotide sequence of VGAM1176 RNA, herein designated VGAM RNA, also designated SEQ ID:3887.

Another function of VGAM1176 is therefore inhibition of LOC91351 (Accession XM_037817). Accordingly, utilities of VGAM1176 include diagnosis, prevention and treatment of diseases and clinical conditions associated with LOC91351. FIG. 1 further provides a conceptual description of a novel bioinformatically detected viral gene of the present invention, referred to here as Viral Genomic Address Messenger 1177 (VGAM1177) viral gene, which modulates expression of respective host target genes thereof, the function and utility of which host target genes is known in the art.

VGAM1177 is a novel bioinformatically detected regulatory, non protein coding, viral micro RNA (miRNA) gene. The method by which VGAM1177 was detected is described hereinabove with reference to FIGS. 1-8.

VGAM1177 gene, herein designated VGAM GENE, is a viral gene contained in the genome of Odontoglossum Ringspot Virus. VGAM1177 host target gene, herein designated VGAM HOST TARGET GENE, is a human gene contained in the human genome.

VGAM1177 gene encodes a VGAM1177 precursor RNA, herein designated VGAM PRECURSOR RNA. Similar to other miRNA genes, and unlike most ordinary genes, VGAM1177 precursor RNA does not encode a protein. A nucleotide sequence identical or highly similar to the nucleotide sequence of VGAM1177 precursor RNA is designated SEQ ID:1163, and is provided hereinbelow with reference to the sequence listing part. Nucleotide sequence SEQ ID:1163 is located at position 4157 relative to the genome of Odontoglossum Ringspot Virus.

VGAM1177 precursor RNA folds onto itself, forming VGAM1177 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1177 folded precursor RNA into VGAM1177 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1177 RNA is designated SEQ ID:3888, and is provided hereinbelow with reference to the sequence listing part.

VGAM1177 host target gene, herein designated VGAM HOST TARGET GENE, encodes a corresponding messenger RNA, VGAM1177 host target RNA, herein designated VGAM HOST TARGET RNA. VGAM1177 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1177 RNA, herein designated VGAM RNA, binds complementarily to one or more host target binding sites located in untranslated regions of VGAM1177 host target RNA, herein designated VGAM HOST TARGET RNA. This complementary binding is due to the fact that the nucleotide sequence of VGAM1177 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1177 RNA, herein designated VGAM RNA, may have a different number of host target binding sites in untranslated regions of a VGAM1177 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1177 RNA, herein designated VGAM RNA, to host target binding sites on VGAM1177 host target RNA, herein designated VGAM HOST TARGET RNA, such as BINDING SITE I, BINDING SITE II and BINDING SITE III, inhibits translation of VGAM1177 host target RNA into VGAM1177 host target protein, herein designated VGAM HOST TARGET PROTEIN. VGAM host target protein is therefore outlined by a broken line.

It is appreciated that VGAM1177 host target gene, herein designated VGAM HOST TARGET GENE, in fact represents a plurality of VGAM1177 host target genes. The mRNA of each one of this plurality of VGAM1177 host target genes comprises one or more host target binding sites, each having a nucleotide sequence which is at least partly complementary to VGAM1177 RNA, herein designated VGAM RNA, and which when bound by VGAM1177 RNA causes inhibition of translation of respective one or more VGAM1177 host target proteins.

It is further appreciated by one skilled in the art that the mode of translational inhibition illustrated by FIG. 1 with specific reference to translational inhibition exerted by VGAM1177 gene, herein designated VGAM GENE, on one or more VGAM1177 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1177 is inhibition of expression of host target genes, as part of a novel viral mechanism of attacking a host. Accordingly, utilities of VGAM1177 include diagnosis, prevention and treatment of viral infection by Odontoglossum Ringspot Virus. Specific functions, and accordingly utilities, of VGAM1177 correlate with, and may be deduced from, the identity of the host target genes which VGAM1177 binds and inhibits, and the function of these host target genes, as elaborated hereinbelow.

Nucleotide sequences of the VGAM1177 precursor RNA, herein designated VGAM PRECURSOR RNA, and of the 'diced' VGAM1177 RNA, herein designated VGAM RNA, and a schematic representation of the secondary folding of VGAM1177 folded precursor RNA, herein designated VGAM FOLDED PRECURSOR RNA, of VGAM1177 are further described hereinbelow with reference to Table 1.

Nucleotide sequences of host target binding sites, such as BINDING SITE-I, BINDING SITE-II and BINDING SITE-III of FIG. 1, found on VGAM1177 host target RNA, and a schematic representation of the complementarity of each of these host target binding sites to VGAM1177 RNA, herein designated VGAM RNA, are described hereinbelow with reference to Table 2.

As mentioned hereinabove with reference to FIG. 1, a function of VGAM1177 gene, herein designated VGAM is inhibition of expression of VGAM1177 target genes. It is appreciated that specific functions, and accordingly utilities, of VGAM1177 correlate with, and may be deduced from, the identity of the target genes which VGAM1177 binds and inhibits, and the function of these target genes, as elaborated hereinbelow.

Moesin (MSN, Accession XM_013042) is a VGAM1177 host target gene. MSN BINDING SITE is HOST TARGET binding site found in the 3' untranslated region of mRNA encoded by MSN, corresponding to a HOST TARGET binding site such as BINDING SITE I, BINDING SITE II or BINDING SITE III. Table 2 illustrates the complementarity of the nucleotide sequences of MSN BINDING SITE, designated SEQ ID:30226, to the nucleotide sequence of VGAM1177 RNA, herein designated VGAM RNA, also designated SEQ ID:3888.

A function of VGAM1177 is therefore inhibition of Moesin (MSN, Accession XM_013042), a gene which may have a role linking the cytoskeleton to the plasma membrane. Accordingly, utilities of VGAM1177 include diagnosis, prevention and treatment of diseases and clinical conditions associated with MSN. The function of MSN and its association with various diseases and clinical conditions, has been established by previous studies, as described hereinabove with reference to VGAM248. RAD52 Homolog (S. cerevisiae) (RAD52, Accession NM_134422) is another VGAM1177 host target gene. RAD52 BINDING SITE1 through RAD52 BINDING SITE3 are HOST TARGET binding sites found in untranslated regions of mRNA encoded by RAD52, corresponding to HOST TARGET binding sites such as BINDING SITE I, BINDING SITE II or BINDING SITE III. Table 2 illustrates the complementarity of the nucleotide sequences of RAD52 BINDING SITE1 through RAD52 BINDING SITE3, designated SEQ ID:28642, SEQ ID:28652 and SEQ ID:28661 respectively, to the nucleotide sequence of VGAM1177 RNA, herein designated VGAM RNA, also designated SEQ ID:3888.

Another function of VGAM1177 is therefore inhibition of RAD52 Homolog (S. cerevisiae) (RAD52, Accession NM_134422). Accordingly, utilities of VGAM1177 include diagnosis, prevention and treatment of diseases and clinical conditions associated with RAD52. LOC136288 (Accession XM_059832) is another VGAM1178 host target gene. LOC136288 BINDING SITE is HOST TARGET binding site found in the 3' untranslated region of mRNA encoded by LOC136288, corresponding to a HOST TARGET binding site such as BINDING SITE I, BINDING SITE II or BINDING SITE III. Table 2 illustrates the complementarity of the nucleotide sequences of LOC136288 BINDING SITE, designated SEQ ID:37098, to the nucleotide sequence of VGAM1178 RNA, herein designated VGAM RNA, also designated SEQ ID:3889.

Another function of VGAM1178 is therefore inhibition of LOC136288 (Accession XM_059832). Accordingly, utilities of VGAM1178 include diagnosis, prevention and treatment of diseases and clinical conditions associated with LOC136288. LOC51333 (Accession NM_016643) is another VGAM1178 host target gene. LOC51333 BINDING SITE is HOST TARGET binding site found in the 3' untranslated region of mRNA encoded by LOC51333, corresponding to a HOST TARGET binding site such as BINDING SITE I, BINDING SITE II or BINDING SITE III. Table 2 illustrates the complementarity of the nucleotide sequences of LOC51333 BINDING SITE, designated SEQ ID:18749, to the nucleotide sequence of VGAM1178 RNA, herein designated VGAM RNA, also designated SEQ ID:3889.

Another function of VGAM1178 is therefore inhibition of LOC51333 (Accession NM_016643). Accordingly, utilities of VGAM1178 include diagnosis, prevention and treatment of diseases and clinical conditions associated with LOC51333. FIG. 1 further provides a conceptual description of a novel bioinformatically detected viral gene of the present invention, referred to here as Viral Genomic Address Messenger 1179 (VGAM1179) viral gene, which modulates expression of respective host target genes thereof, the function and utility of which host target genes is known in the art.

VGAM1179 is a novel bioinformatically detected regulatory, non protein coding, viral micro RNA (miRNA) gene. The method by which VGAM1179 was detected is described hereinabove with reference to FIGS. 1-8.

VGAM1179 gene, herein designated VGAM GENE, is a viral gene contained in the genome of Odontoglossum Ringspot Virus. VGAM1179 host target gene, herein designated VGAM HOST TARGET GENE, is a human gene contained in the human genome.

VGAM1179 gene encodes a VGAM1179 precursor RNA, herein designated VGAM PRECURSOR RNA. Similar to other miRNA genes, and unlike most ordinary genes, VGAM1179 precursor RNA does not encode a protein. A nucleotide sequence identical or highly similar to the nucleotide sequence of VGAM1179 precursor RNA is designated SEQ ID:1165, and is provided hereinbelow with reference to the sequence listing part. Nucleotide sequence SEQ ID:1165 is located at position 5650 relative to the genome of Odontoglossum Ringspot Virus.

VGAM1179 precursor RNA folds onto itself, forming VGAM1179 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1179 folded precursor RNA into VGAM1179 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM1179 RNA is designated SEQ ID:3890, and is provided hereinbelow with reference to the sequence listing part.

VGAM1179 host target gene, herein designated VGAM HOST TARGET GENE, encodes a corresponding messenger RNA, VGAM1179 host target RNA, herein designated VGAM HOST TARGET RNA. VGAM1179 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1179 RNA, herein designated VGAM RNA, binds complementarily to one or more host target binding sites located in untranslated regions of VGAM1179 host target RNA, herein designated VGAM HOST TARGET RNA. This complementary binding is due to the fact that the nucleotide sequence of VGAM1179 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1179 RNA, herein designated VGAM RNA, may have a different number of host target binding sites in untranslated regions of a VGAM1179 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1179 RNA, herein designated VGAM RNA, to host target binding sites on VGAM1179 host target RNA, herein designated VGAM HOST TARGET RNA, such as BINDING SITE I, BINDING SITE II and BINDING SITE III, inhibits translation of VGAM1179 host target RNA into VGAM1179 host target protein, herein designated VGAM HOST TARGET PROTEIN. VGAM host target protein is therefore outlined by a broken line.

It is appreciated that VGAM1179 host target gene, herein designated VGAM HOST TARGET GENE, in fact represents a plurality of VGAM1179 host target genes. The mRNA of each one of this plurality of VGAM1179 host target genes comprises one or more host target binding sites, each having a nucleotide sequence which is at least partly complementary to VGAM1179 RNA, herein designated VGAM RNA, and which when bound by VGAM1179 RNA causes inhibition of translation of respective one or more VGAM1179 host target proteins.

It is further appreciated by one skilled in the art that the mode of translational inhibition illustrated by FIG. 1 with specific reference to translational inhibition exerted by VGAM1179 gene, herein designated VGAM GENE, on one or more VGAM1179 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1179 is inhibition of expression of host target genes, as part of a novel viral mechanism of attacking a host. Accordingly, utilities of VGAM1179 include diagnosis, prevention and treatment of viral infection by Odontoglossum Ringspot Virus. Specific functions, and accordingly utilities, of VGAM1179 correlate with, and may be deduced from, the identity of the host target genes which VGAM1179 binds and inhibits, and the function of these host target genes, as elaborated hereinbelow.

Nucleotide sequences of the VGAM1179 precursor RNA, herein designated VGAM PRECURSOR RNA, and of the 'diced' VGAM1179 RNA, herein designated VGAM RNA, and a schematic representation of the secondary folding of VGAM1179 folded precursor RNA, herein designated VGAM FOLDED PRECURSOR RNA, of VGAM1179 are further described hereinbelow with reference to Table 1.

Nucleotide sequences of host target binding sites, such as BINDING SITE-I, BINDING SITE-II and BINDING SITE-III of FIG. 1, found on VGAM1179 host target RNA, and schematic representation of the complementarity of each of these host target binding sites to VGAM1179 RNA, herein designated VGAM RNA, are described hereinbelow with reference to Table 2.

As mentioned hereinabove with reference to FIG. 1, a function of VGAM1179 gene, herein designated VGAM is inhibition of expression of VGAM1179 target genes. It is appreciated that specific functions, and accordingly utilities, of VGAM1179 correlate with, and may be deduced from, the identity of the target genes which VGAM1179 binds and inhibits, and the function of these target genes, as elaborated hereinbelow.

ARPP-19 (Accession NM_006628) is a VGAM1179 host target gene. ARPP-19 BINDING SITE is HOST TARGET binding site found in the 3' untranslated region of mRNA encoded by ARPP-19, corresponding to a HOST TARGET binding site such as BINDING SITE I, BINDING SITE II or BINDING SITE III. Table 2 illustrates the complementarity of the nucleotide sequences of ARPP-19 BINDING SITE, designated SEQ ID:13417, to the nucleotide sequence of VGAM1179 RNA, herein designated VGAM RNA, also designated SEQ ID:3890.

A function of VGAM1179 is therefore inhibition of ARPP-19 (Accession NM_006628). Accordingly, utilities of VGAM1179 include diagnosis, prevention and treatment of diseases and clinical conditions associated with ARPP-19. LOC51141 (Accession XM_043953) is another VGAM1179 host target gene. LOC51141 BINDING SITE is HOST TARGET binding site found in the 3' untranslated region of mRNA encoded by LOC51141, corresponding to a HOST TARGET binding site such as BINDING SITE I, BINDING SITE II or BINDING SITE III. Table 2 illustrates the complementarity of the nucleotide sequences of LOC51141 BINDING SITE, designated SEQ ID:34051, to the nucleotide sequence of VGAM1179 RNA, herein designated VGAM RNA, also designated SEQ ID:3890.

Another function of VGAM1179 is therefore inhibition of LOC51141 (Accession XM_043953). Accordingly, utilities of VGAM1179 include diagnosis, prevention and treatment of diseases and clinical conditions associated with LOC51141. LOC91050 (Accession XM_035703) is another VGAM1179 host target gene. LOC91050 BINDING SITE is HOST TARGET binding site found in the 3' untranslated region of mRNA encoded by LOC91050, corresponding to a HOST TARGET binding site such as BINDING SITE I, BINDING SITE II or BINDING SITE III. Table 2 illustrates the complementarity of the nucleotide sequences of LOC91050 BINDING SITE, designated SEQ ID:32332, to the nucleotide sequence of VGAM1179 RNA, herein designated VGAM RNA, also designated SEQ ID:3890.

Another function of VGAM1179 is therefore inhibition of LOC91050 (Accession XM_035703). Accordingly, utilities of VGAM1179 include diagnosis, prevention and treatment of diseases and clinical conditions associated with LOC91050. FIG. 1 further provides a conceptual description of a novel bioinformatically detected viral gene of the present invention, referred to here as Viral Genomic Address Messenger 1180 (VGAM1180) viral gene, which modulates expression of respective host target genes thereof, the function and utility of which host target genes is known in the art.

VGAM1180 is a novel bioinformatically detected regulatory, non protein coding, viral micro RNA (miRNA) gene. The method by which VGAM1180 was detected is described hereinabove with reference to FIGS. 1-8.

VGAM1180 gene, herein designated VGAM GENE, is a viral gene contained in the genome of Odontoglossum Ringspot Virus. VGAM1180 host target gene, herein designated VGAM HOST TARGET GENE, is a human gene contained in the human genome.

VGAM1180 gene encodes a VGAM1180 precursor RNA, herein designated VGAM PRECURSOR RNA. Similar to other miRNA genes, and unlike most ordinary genes, VGAM1180 precursor RNA does not encode a protein. A nucleotide sequence identical or highly similar to the nucleotide sequence of VGAM1180 precursor RNA is designated SEQ ID:1166, and is provided hereinbelow with reference to the sequence listing part. Nucleotide sequence SEQ ID:1166 is located at position 2834 relative to the genome of Odontoglossum Ringspot Virus.

VGAM1180 precursor RNA folds onto itself, forming VGAM1180 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1180 folded precursor RNA into VGAM1180 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1180 RNA is designated SEQ ID:3891, and is provided hereinbelow with reference to the sequence listing part.

VGAM1180 host target gene, herein designated VGAM HOST TARGET GENE, encodes a corresponding messenger RNA, VGAM1180 host target RNA, herein designated VGAM HOST TARGET RNA. VGAM1180 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1180 RNA, herein designated VGAM RNA, binds complementarily to one or more host target binding sites located in untranslated regions of VGAM1180 host target RNA, herein designated VGAM HOST TARGET RNA. This complementary binding is due to the fact that the nucleotide sequence of VGAM1180 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1180 RNA, herein designated VGAM RNA, may have a different number of host target binding sites in untranslated regions of a VGAM1180 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1180 RNA, herein designated VGAM RNA, to host target binding sites on VGAM1180 host target RNA, herein designated VGAM HOST TARGET RNA, such as BINDING SITE I, BINDING SITE II and BINDING SITE III, inhibits translation of VGAM1180 host target RNA into VGAM1180 host target protein, herein designated VGAM HOST TARGET PROTEIN. VGAM host target protein is therefore outlined by a broken line.

It is appreciated that VGAM1180 host target gene, herein designated VGAM HOST TARGET GENE, in fact represents a plurality of VGAM1180 host target genes. The mRNA of each one of this plurality of VGAM1180 host target genes comprises one or more host target binding sites, each having a nucleotide sequence which is at least partly complementary to VGAM1180 RNA, herein designated VGAM RNA, and which when bound by VGAM1180 RNA causes inhibition of translation of respective one or more VGAM1180 host target proteins.

It is further appreciated by one skilled in the art that the mode of translational inhibition illustrated by FIG. 1 with specific reference to translational inhibition exerted by VGAM1180 gene, herein designated VGAM GENE, on one or more VGAM1180 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1180 is inhibition of expression of host target genes, as part of a novel viral mechanism of attacking a host. Accordingly, utilities of VGAM1180 include diagnosis, prevention and treatment of viral infection by Odontoglossum Ringspot Virus. Specific functions, and accordingly utilities, of VGAM1180 correlate with, and may be deduced from, the identity of the host target genes which VGAM1180 binds and inhibits, and the function of these host target genes, as elaborated hereinbelow.

Nucleotide sequences of the VGAM1180 precursor RNA, herein designated VGAM PRECURSOR RNA, and of the 'diced' VGAM1180 RNA, herein designated VGAM RNA, and a schematic representation of the secondary folding of VGAM1180 folded precursor RNA, herein designated VGAM FOLDED PRECURSOR RNA, of VGAM1180 are further described hereinbelow with reference to Table 1.

Nucleotide sequences of host target binding sites, such as BINDING SITE-I, BINDING SITE-II and BINDING SITE-III of FIG. 1, found on VGAM1180 host target RNA, and schematic representation of the complementarity of each of these host target binding sites to VGAM1180 RNA, herein designated VGAM RNA, are described hereinbelow with reference to Table 2.

As mentioned hereinabove with reference to FIG. 1, a function of VGAM1180 gene, herein designated VGAM is inhibition of expression of VGAM1180 target genes. It is appreciated that specific functions, and accordingly utilities, of VGAM1180 correlate with, and may be deduced from, the identity of the target genes which VGAM1180 binds and inhibits, and the function of these target genes, as elaborated hereinbelow.

ATPase, H+ Transporting, Lysosomal 13 kDa, V1 Subunit G Isoform 2 (ATP6V1G2, Accession NM_130463) is a VGAM1180 host target gene. ATP6V1G2 BINDING SITE1 and ATP6V1G2 BINDING SITE2 are HOST TARGET binding sites found in untranslated regions of mRNA encoded by ATP6V1G2, corresponding to HOST TARGET binding sites such as BINDING SITE I, BINDING SITE II or BINDING SITE III. Table 2 illustrates the complementarity of the nucleotide sequences of ATP6V1G2 BINDING SITE1 and ATP6V1G2 BINDING SITE2, designated SEQ ID:28225 and SEQ ID:28698 respectively, to the nucleotide sequence of VGAM1180 RNA, herein designated VGAM RNA, also designated SEQ ID:3891.

A function of VGAM1180 is therefore inhibition of ATPase, H+ Transporting, Lysosomal 13 kDa, V1 Subunit G Isoform 2 (ATP6V1G2, Accession NM_130463). Accordingly, utilities of VGAM1180 include diagnosis, prevention and treatment of diseases and clinical conditions associated with ATP6V1G2. Major Histocompatibility Complex, Class II, DQ Alpha 1 (HLA-DQA1, Accession XM_175260) is another VGAM1180 host target gene. HLA-DQA1 BINDING SITE is HOST TARGET binding site found in the 3' untranslated region of mRNA encoded by HLA-DQA1, corresponding to a HOST TARGET binding site such as BINDING SITE I, BINDING SITE II or BINDING SITE III. Table 2 illustrates the complementarity of the nucleotide sequences of HLA-DQA1 BINDING SITE, designated SEQ ID:46726, to the nucleotide sequence of VGAM1180 RNA, herein designated VGAM RNA, also designated SEQ ID:3891.

Another function of VGAM1180 is therefore inhibition of Major Histocompatibility Complex, Class II, DQ Alpha 1 (HLA-DQA1, Accession XM_175260), a gene which is alpha 1 chain of HLA-DQ1 class II molecule (Ia antigen) which binds peptides and presents them to CD4+ T lymphocytes. Accordingly, utilities of VGAM1180 include diagnosis, prevention and treatment of diseases and clinical conditions associated with HLA-DQA1. The function of HLA-DQA1 and its association with various diseases and clinical conditions, has been established by previous studies, as described hereinabove with reference to VGAM132. CG018 (Accession NM_052818) is another VGAM1180 host target gene. CG018 BINDING SITE is HOST TARGET binding site found in the 3' untranslated region of mRNA encoded by CG018, corresponding to a HOST TARGET binding site such as BINDING SITE I, BINDING SITE II or BINDING SITE III. Table 2 illustrates the complementarity of the nucleotide sequences of CG018 BINDING SITE, designated SEQ ID:27405, to the nucleotide sequence of VGAM1180 RNA, herein designated VGAM RNA, also designated SEQ ID:3891.

Another function of VGAM1180 is therefore inhibition of CG018 (Accession NM_052818). Accordingly, utilities of VGAM1180 include diagnosis, prevention and treatment of diseases and clinical conditions associated with CG018. E2F Transcription Factor 6 (E2F6, Accession NM_001952) is another VGAM1180 host target gene. E2F6 BINDING SITE is HOST TARGET binding site found in the 3' untranslated region of mRNA encoded by E2F6, corresponding to a HOST TARGET binding site such as BINDING SITE I, BINDING SITE II or BINDING SITE III. Table 2 illustrates the complementarity of the nucleotide sequences of E2F6 BINDING SITE, designated SEQ ID:7676, to the nucleotide sequence of VGAM1180 RNA, herein designated VGAM RNA, also designated SEQ ID:3891.

Another function of VGAM1180 is therefore inhibition of E2F Transcription Factor 6 (E2F6, Accession NM_001952). Accordingly, utilities of VGAM1180 include diagnosis, prevention and treatment of diseases and clinical conditions associated with E2F6. FLJ10261 (Accession NM_018043) is another VGAM1180 host target gene. FLJ10261 BINDING SITE is HOST TARGET binding site found in the 3' untranslated region of mRNA encoded by FLJ10261, corresponding to a HOST TARGET binding site such as BINDING SITE I, BINDING SITE II or BINDING SITE III. Table 2 illustrates the complementarity of the nucleotide sequences of FLJ10261 BINDING SITE, designated SEQ ID:19789, to the nucleotide sequence of VGAM1180 RNA, herein designated VGAM RNA, also designated SEQ ID:3891.

Another function of VGAM1180 is therefore inhibition of FLJ10261 (Accession NM_018043). Accordingly, utilities of VGAM1180 include diagnosis, prevention and treatment of diseases and clinical conditions associated with FLJ10261. LOC92573 (Accession XM_045884) is another VGAM1180 host target gene. LOC92573 BINDING SITE is HOST TARGET binding site found in the 5' untranslated region of mRNA encoded by LOC92573, corresponding to a HOST TARGET binding site such as BINDING SITE I, BINDING SITE II or BINDING SITE III. Table 2 illustrates the complementarity of the nucleotide sequences of LOC92573 BINDING SITE, designated SEQ ID:34600, to the nucleotide sequence of VGAM1180 RNA, herein designated VGAM RNA, also designated SEQ ID:3891.

Another function of VGAM1180 is therefore inhibition of LOC92573 (Accession XM_045884). Accordingly, utilities of VGAM1180 include diagnosis, prevention and treatment of diseases and clinical conditions associated with LOC92573. FIG. 1 further provides a conceptual description of a novel bioinformatically detected viral gene of the present invention, referred to here as Viral Genomic Address Messenger 1181 (VGAM1181) viral gene, which modulates expression of respective host target genes thereof, the function and utility of which host target genes is known in the art.

VGAM1181 is a novel bioinformatically detected regulatory, non protein coding, viral micro RNA (miRNA) gene. The method by which VGAM1181 was detected is described hereinabove with reference to FIGS. 1-8.

VGAM1181 gene, herein designated VGAM GENE, is a viral gene contained in the genome of Odontoglossum Ringspot Virus. VGAM1181 host target gene, herein designated VGAM HOST TARGET GENE, is a human gene contained in the human genome.

VGAM1181 gene encodes a VGAM1181 precursor RNA, herein designated VGAM PRECURSOR RNA. Similar to other miRNA genes, and unlike most ordinary genes, VGAM1181 precursor RNA does not encode a protein. A nucleotide sequence identical or highly similar to the nucleotide sequence of VGAM1181 precursor RNA is designated SEQ ID:1167, and is provided hereinbelow with reference to the sequence listing part. Nucleotide sequence SEQ ID:1167 is located at position 4926 relative to the genome of Odontoglossum Ringspot Virus.

VGAM1181 precursor RNA folds onto itself, forming VGAM1181 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1181 folded precursor RNA into VGAM1181 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1181 RNA is designated SEQ ID:3892, and is provided hereinbelow with reference to the sequence listing part.

VGAM1181 host target gene, herein designated VGAM HOST TARGET GENE, encodes a corresponding messenger RNA, VGAM1181 host target RNA, herein designated VGAM HOST TARGET RNA. VGAM1181 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1181 RNA, herein designated VGAM RNA, binds complementarily to one or more host target binding sites located in untranslated regions of VGAM1181 host target RNA, herein designated VGAM HOST TARGET RNA. This complementary binding is due to the fact that the nucleotide sequence of VGAM1181 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1181 RNA, herein designated VGAM RNA, may have a different number of host target binding sites in untranslated regions of a VGAM1181 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1181 RNA, herein designated VGAM RNA, to host target binding sites on VGAM1181 host target RNA, herein designated VGAM HOST TARGET RNA, such as BINDING SITE I, BINDING SITE II and BINDING SITE III, inhibits translation of VGAM1181 host target RNA into VGAM1181 host target protein, herein designated VGAM HOST TARGET PROTEIN. VGAM host target protein is therefore outlined by a broken line.

It is appreciated that VGAM1181 host target gene, herein designated VGAM HOST TARGET GENE, in fact represents a plurality of VGAM1181 host target genes. The mRNA of each one of this plurality of VGAM1181 host target genes comprises one or more host target binding sites, each having a nucleotide sequence which is at least partly complementary to VGAM1181 RNA, herein designated VGAM RNA, and which when bound by VGAM1181 RNA causes inhibition of translation of respective one or more VGAM1181 host target proteins.

It is further appreciated by one skilled in the art that the mode of translational inhibition illustrated by FIG. 1 with specific reference to translational inhibition exerted by VGAM1181 gene, herein designated VGAM GENE, on one or more VGAM1181 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1181 is inhibition of expression of host target genes, as part of a novel viral mechanism of attacking a host. Accordingly, utilities of VGAM1181 include diagnosis, prevention and treatment of viral infection by Odontoglossum Ringspot Virus. Specific functions, and accordingly utilities, of VGAM1181 correlate with, and may be deduced from, the identity of the host target genes which VGAM1181 binds and inhibits, and the function of these host target genes, as elaborated hereinbelow.

Nucleotide sequences of the VGAM1181 precursor RNA, herein designated VGAM PRECURSOR RNA, and of the 'diced' VGAM1181 RNA, herein designated VGAM RNA, and a schematic representation of the secondary folding of VGAM1181 folded precursor RNA, herein designated VGAM FOLDED PRECURSOR RNA, of VGAM1181 are further described hereinbelow with reference to Table 1.

Nucleotide sequences of host target binding sites, such as BINDING SITE-I, BINDING SITE-II and BINDING SITE- III of FIG. 1, found on VGAM1181 host target RNA, and schematic representation of the complementarity of each of these host target binding sites to VGAM1181 RNA, herein designated VGAM RNA, are described hereinbelow with reference to Table 2.

As mentioned hereinabove with reference to FIG. 1, a function of VGAM1181 gene, herein designated VGAM is inhibition of expression of VGAM1181 target genes. It is appreciated that specific functions, and accordingly utilities, of VGAM1181 correlate with, and may be deduced from, the identity of the target genes which VGAM1181 binds and inhibits, and the function of these target genes, as elaborated hereinbelow.

FLJ14600 (Accession NM_032810) is a VGAM1181 host target gene. FLJ14600 BINDING SITE is HOST TARGET binding site found in the 5' untranslated region of mRNA encoded by FLJ14600, corresponding to a HOST TARGET binding site such as BINDING SITE I, BINDING SITE II or BINDING SITE III. Table 2 illustrates the complementarity of the nucleotide sequences of FLJ14600 BINDING SITE, designated SEQ ID:26576, to the nucleotide sequence of VGAM1181 RNA, herein designated VGAM RNA, also designated SEQ ID:3892.

A function of VGAM1181 is therefore inhibition of FLJ14600 (Accession NM_032810). Accordingly, utilities of VGAM1181 include diagnosis, prevention and treatment of diseases and clinical conditions associated with FLJ14600. KIAA0596 (Accession XM_031706) is another VGAM1181 host target gene. KIAA0596 BINDING SITE is HOST TARGET binding site found in the 3' untranslated region of mRNA encoded by KIAA0596, corresponding to a HOST TARGET binding site such as BINDING SITE I, BINDING SITE II or BINDING SITE III. Table 2 illustrates the complementarity of the nucleotide sequences of KIAA0596 BINDING SITE, designated SEQ ID:31465, to the nucleotide sequence of VGAM1181 RNA, herein designated VGAM RNA, also designated SEQ ID:3892.

Another function of VGAM1181 is therefore inhibition of KIAA0596 (Accession XM_031706). Accordingly, utilities of VGAM1181 include diagnosis, prevention and treatment of diseases and clinical conditions associated with KIAA0596. KIAA1373 (Accession XM_048195) is another VGAM1181 host target gene. KIAA1373 BINDING SITE is HOST TARGET binding site found in the 3' untranslated region of mRNA encoded by KIAA1373, corresponding to a HOST TARGET binding site such as BINDING SITE I, BINDING SITE II or BINDING SITE III. Table 2 illustrates the complementarity of the nucleotide sequences of KIAA1373 BINDING SITE, designated SEQ ID:35123, to the nucleotide sequence of VGAM1181 RNA, herein designated VGAM RNA, also designated SEQ ID:3892.

Another function of VGAM1181 is therefore inhibition of KIAA1373 (Accession XM_048195). Accordingly, utilities of VGAM1181 include diagnosis, prevention and treatment of diseases and clinical conditions associated with KIAA1373. Serine Palmitoyltransferase, Long Chain Base Subunit 2 (SPTLC2, Accession NM_004863) is another VGAM1181 host target gene. SPTLC2 BINDING SITE is HOST TARGET binding site found in the 3' untranslated region of mRNA encoded by SPTLC2, corresponding to a HOST TARGET binding site such as BINDING SITE I, BINDING SITE II or BINDING SITE III. Table 2 illustrates the complementarity of the nucleotide sequences of SPTLC2 BINDING SITE, designated SEQ ID:11288, to the nucleotide sequence of VGAM1181 RNA, herein designated VGAM RNA, also designated SEQ ID:3892.

Another function of VGAM1181 is therefore inhibition of Serine Palmitoyltransferase, Long Chain Base Subunit 2 (SPTLC2, Accession NM_004863). Accordingly, utilities of VGAM1181 include diagnosis, prevention and treatment of diseases and clinical conditions associated with SPTLC2. FIG. 1 further provides a conceptual description of a novel bioinformatically detected viral gene of the present invention, referred to here as Viral Genomic Address Messenger 1182 (VGAM1182) viral gene, which modulates expression of respective host target genes thereof, the function and utility of which host target genes is known in the art.

VGAM1182 is a novel bioinformatically detected regulatory, non protein coding, viral micro RNA (miRNA) gene. The method by which VGAM1182 was detected is described hereinabove with reference to FIGS. 1-8.

VGAM1182 gene, herein designated VGAM GENE, is a viral gene contained in the genome of Human Herpesvirus 4. VGAM1182 host target gene, herein designated VGAM HOST TARGET GENE, is a human gene contained in the human genome.

VGAM1182 gene encodes a VGAM1182 precursor RNA, herein designated VGAM PRECURSOR RNA. Similar to other miRNA genes, and unlike most ordinary genes, VGAM1182 precursor RNA does not encode a protein. A nucleotide sequence identical or highly similar to the nucleotide sequence of VGAM1182 precursor RNA is designated SEQ ID:1168, and is provided hereinbelow with reference to the sequence listing part. Nucleotide sequence SEQ ID:1168 is located at position 110159 relative to the genome of Human Herpesvirus 4.

VGAM1182 precursor RNA folds onto itself, forming VGAM1182 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1182 folded precursor RNA into VGAM1182 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1182 RNA is designated SEQ ID:3893, and is provided hereinbelow with reference to the sequence listing part.

VGAM1182 host target gene, herein designated VGAM HOST TARGET GENE, encodes a corresponding messenger RNA, VGAM1182 host target RNA, herein designated VGAM HOST TARGET RNA. VGAM1182 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1182 RNA, herein designated VGAM RNA, binds complementarily to one or more host target binding sites located in untranslated regions of VGAM1182 host target RNA, herein designated VGAM HOST TARGET RNA. This complementary binding is due to the fact that the nucleotide sequence of VGAM1182 RNA is an accurate or a partial inversed-reversed sequence of the nucleotide sequence of each of the host target binding sites. As an illustration, FIG. 1 shows three such host target binding sites, designated BIND- ING SITE I, BINDING SITE II and BINDING SITE III respectively. It is appreciated that the number of host target binding sites shown in FIG. 1 is meant as an illustration only, and is not meant to be limiting - VGAM1182 RNA, herein designated VGAM RNA, may have a different number of host target binding sites in untranslated regions of a VGAM1182 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1182 RNA, herein designated VGAM RNA, to host target binding sites on VGAM1182 host target RNA, herein designated VGAM HOST TARGET RNA, such as BINDING SITE I, BINDING SITE II and BINDING SITE III, inhibits translation of VGAM1182 host target RNA into VGAM1182 host target protein, herein designated VGAM HOST TARGET PROTEIN. VGAM host target protein is therefore outlined by a broken line.

It is appreciated that VGAM1182 host target gene, herein designated VGAM HOST TARGET GENE, in fact represents a plurality of VGAM1182 host target genes. The mRNA of each one of this plurality of VGAM1182 host target genes comprises one or more host target binding sites, each having a nucleotide sequence which is at least partly complementary to VGAM1182 RNA, herein designated VGAM RNA, and which when bound by VGAM1182 RNA causes inhibition of translation of respective one or more VGAM1182 host target proteins.

It is further appreciated by one skilled in the art that the mode of translational inhibition illustrated by FIG. 1 with specific reference to translational inhibition exerted by VGAM1182 gene, herein designated VGAM GENE, on one or more VGAM1182 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1182 is inhibition of expression of host target genes, as part of a novel viral mechanism of attacking a host. Accordingly, utilities of VGAM1182 include diagnosis, prevention and treatment of viral infection by Human Herpesvirus 4. Specific functions, and accordingly utilities, of VGAM1182 correlate with, and may be deduced from, the identity of the host target genes which VGAM1182 binds and inhibits, and the function of these host target genes, as elaborated hereinbelow.

Nucleotide sequences of the VGAM1182 precursor RNA, herein designated VGAM PRECURSOR RNA, and of the 'diced' VGAM1182 RNA, herein designated VGAM RNA, and a schematic representation of the secondary folding of VGAM1182 folded precursor RNA, herein designated VGAM FOLDED PRECURSOR RNA, of VGAM1182 are further described hereinbelow with reference to Table 1.

Nucleotide sequences of host target binding sites, such as BINDING SITE-I, BINDING SITE-II and BINDING SITE-III of FIG. 1, found on VGAM1182 host target RNA, and schematic representation of the complementarity of each of these host target binding sites to VGAM1182 RNA, herein designated VGAM RNA, are described hereinbelow with reference to Table 2.

As mentioned hereinabove with reference to FIG. 1, a function of VGAM1182 gene, herein designated VGAM is inhibition of expression of VGAM1182 target genes. It is appreciated that specific functions, and accordingly utilities, of VGAM1182 correlate with, and may be deduced from, the identity of the target genes which VGAM1182 binds and inhibits, and the function of these target genes, as elaborated hereinbelow.

High Mobility Group AT-hook 2 (HMGA2, Accession NM_003483) is a VGAM1182 host target gene. HMGA2 BINDING SITE is HOST TARGET binding site found in the 3' untranslated region of mRNA encoded by HMGA2, corresponding to a HOST TARGET binding site such as BINDING SITE I, BINDING SITE II or BINDING SITE III. Table 2 illustrates the complementarity of the nucleotide sequences of HMGA2 BINDING SITE, designated SEQ ID:9559, to the nucleotide sequence of VGAM1182 RNA, herein designated VGAM RNA, also designated SEQ ID:3893.

A function of VGAM1182 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM1182 include diagnosis, prevention and treatment of diseases and clinical conditions associated with HMGA2. The function of HMGA2 and its association with various diseases and clinical conditions, has been established by previous studies, as described hereinabove with reference to VGAM552. Interferon, Gamma-inducible Protein 16 (IFI16, Accession XM_048826) is another VGAM1182 host target gene. IFI16 BINDING SITE is HOST TARGET binding site found in the 5' untranslated region of mRNA encoded by IFI16, corresponding to a HOST TARGET binding site such as BINDING SITE I, BINDING SITE II or BINDING SITE III. Table 2 illustrates the complementarity of the nucleotide sequences of IFI16 BINDING SITE, designated SEQ ID:35281, to the nucleotide sequence of VGAM1182 RNA, herein designated VGAM RNA, also designated SEQ ID:3893.

Another function of VGAM1182 is therefore inhibition of Interferon, Gamma-inducible Protein 16 (IFI16, Accession XM_048826), a gene which could have a role in the regulation of hematopoeitic differentiation and controls cellular proliferation. Accordingly, utilities of VGAM1182 include diagnosis, prevention and treatment of diseases and clinical conditions associated with IFI16. The function of IFI16 has been established by previous studies. The interferons are a family of vertebrate cytokines with pleiotropic activities including antiviral effects, the regulation of cell growth and differentiation, and modulation of immune function. Interferon-gamma (IFNG; 147570) causes an increase in the expression of major histocompatibility complex (MHC) class I and class II proteins on a variety of cells, serving to enhance antigen presentation and recognition of foreign cell surface antigens by MHC-restricted cytotoxic T lymphocytes. At least 6 interferon-gamma-inducible genes located on mouse chromosome 1 were described by Choubey et al. (1989), Kingsmore et al. (1989), and others. In the mouse, the genes mapped to a 150-kb segment of DNA, and the serum amyloid P component gene (Sap; OMIM Ref. No. 104770) mapped within approximately 450 kb of the IFN-inducible gene cluster. The erythrocyte alpha-spectrin gene (see OMIM Ref. No. 182860) was also closely linked. Trapani et al. (1992) described a human IFN-gamma-inducible gene, IFI16, which has nucleotide sequence similarity with portions of 2 of the mouse genes. A full-length cDNA clone contained a single open reading frame of 2,187 bp which encoded a putative polypeptide of 729 amino acids. IFI16 mRNA was found to be constitutively expressed in lymphoid cells and in cell lines of both the T and B lineages. By contrast, the mRNA was not expressed in cell lines that represent early stages of myeloid development, although it was inducible in 2 of these lines with interferon-gamma. Using a panel of interspecies somatic cell hybrid cell lines, Trapani et al. (1992) localized the IFI16 gene to human 1q12-qter. DNA blotting indicated that, in contrast to the mouse, IFI16 is present as a single-copy gene in the human genome.

Full details of the abovementioned studies are described in the following publications, the disclosure of which are hereby incorporated by reference:

Kingsmore, S. F.; Snoddy, J.; Choubey, D.; Lengyel, P.; Seldin, M. F.: Physical mapping of a family of interferon-activated genes, serum amyloid P-component, and alpha-spectrin on mouse chromosome 1. Immunogenetics 30:169-174, 1989; and Trapani, J. A.; Browne, K. A.; Dawson, M. J.; Ramsay, R. G.; Eddy, R. L.; Shows, T. B.; White, P. C.; Dupont, B.: A novel gene constitutively expressed in human lymphoid cells is induc.

Further studies establishing the function and utilities of IFI16 are found in John Hopkins OMIM database record ID 147586, and in sited publications numbered 3688, 420 and 11161 listed in the bibliography section hereinbelow, which are also hereby incorporated by reference. Neogenin Homolog 1 (chicken) (NEO1, Accession NM_002499) is another VGAM1182 host target gene. NEO1 BINDING SITE is HOST TARGET binding site found in the 3' untranslated region of mRNA encoded by NEO1, corresponding to a HOST TARGET binding site such as BINDING SITE I, BINDING SITE II or BINDING SITE III. Table 2 illustrates the complementarity of the nucleotide sequences of NEO1 BINDING SITE, designated SEQ ID:8314, to the nucleotide sequence of VGAM1182 RNA, herein designated VGAM RNA, also designated SEQ ID:3893.

Another function of VGAM1182 is therefore inhibition of Neogenin Homolog 1 (chicken) (NEO1, Accession NM_002499), a gene which regulates the transition of undifferentiated proliferating cells to their differentiated state. Accordingly, utilities of VGAM1182 include diagnosis, prevention and treatment of diseases and clinical conditions associated with NEO1. The function of NEO1 and its association with various diseases and clinical conditions, has been established by previous studies, as described hereinabove with reference to VGAM329. TIRAP (Accession NM_052887) is another VGAM1182 host target gene. TIRAP BINDING SITE is HOST TARGET binding site found in the 5' untranslated region of mRNA encoded by TIRAP, corresponding to a HOST TARGET binding site such as BINDING SITE I, BINDING SITE II or BINDING SITE III. Table 2 illustrates the complementarity of the nucleotide sequences of TIRAP BINDING SITE, designated SEQ ID:27473, to the nucleotide sequence of VGAM1182 RNA, herein designated VGAM RNA, also designated SEQ ID:3893.

Another function of VGAM1182 is therefore inhibition of TIRAP (Accession NM_052887), a gene which is a adapter involved in the TLR4 signaling pathway in the innate immune response. Accordingly, utilities of VGAM1182 include diagnosis, prevention and treatment of diseases and clinical conditions associated with TIRAP. The function of TIRAP and its association with various diseases and clinical conditions, has been established by previous studies, as described hereinabove with reference to VGAM189. BTB (POZ) Domain Containing 2 (BTBD2, Accession NM_017797) is another VGAM1182 host target gene. BTBD2 BINDING SITE is HOST TARGET binding site found in the 3' untranslated region of mRNA encoded by BTBD2, corresponding to a HOST TARGET binding site such as BINDING SITE I, BINDING SITE II or BINDING SITE III. Table 2 illustrates the complementarity of the nucleotide sequences of BTBD2 BINDING SITE, designated SEQ ID:19438, to the nucleotide sequence of VGAM1182 RNA, herein designated VGAM RNA, also designated SEQ ID:3893.

Another function of VGAM1182 is therefore inhibition of BTB (POZ) Domain Containing 2 (BTBD2, Accession NM_017797). Accordingly, utilities of VGAM1182 include diagnosis, prevention and treatment of diseases and clinical conditions associated with BTBD2. FGD1 Family, Member 3 (FGD3, Accession XM_053487) is another VGAM1182 host target gene. FGD3 BINDING SITE is HOST TARGET binding site found in the 3' untranslated region of mRNA encoded by FGD3, corresponding to a HOST TARGET binding site such as BINDING SITE I, BINDING SITE II or BINDING SITE III. Table 2 illustrates the complementarity of the nucleotide sequences of FGD3 BINDING SITE, designated SEQ ID:36092, to the nucleotide sequence of VGAM1182 RNA, herein designated VGAM RNA, also designated SEQ ID:3893.

Another function of VGAM1182 is therefore inhibition of FGD1 Family, Member 3 (FGD3, Accession XM_053487). Accordingly, utilities of VGAM1182 include diagnosis, prevention and treatment of diseases and clinical conditions associated with FGD3. FLJ21791 (Accession XM_028958) is another VGAM1182 host target gene. FLJ21791 BINDING SITE is HOST TARGET binding site found in the 3' untranslated region of mRNA encoded by FLJ21791, corresponding to a HOST TARGET binding site such as BINDING SITE I, BINDING SITE II or BINDING SITE III. Table 2 illustrates the complementarity of the nucleotide sequences of FLJ21791 BINDING SITE, designated SEQ ID:30808, to the nucleotide sequence of VGAM1182 RNA, herein designated VGAM RNA, also designated SEQ ID:3893.

Another function of VGAM1182 is therefore inhibition of FLJ21791 (Accession XM_028958). Accordingly, utilities of VGAM1182 include diagnosis, prevention and treatment of diseases and clinical conditions associated with FLJ21791. GBTS1 (Accession NM_145173) is another VGAM1182 host target gene. GBTS1 BINDING SITE is HOST TARGET binding site found in the 3' untranslated region of mRNA encoded by GBTS1, corresponding to a HOST TARGET binding site such as BINDING SITE I, BINDING SITE II or BINDING SITE III. Table 2 illustrates the complementarity of the nucleotide sequences of GBTS1 BINDING SITE, designated SEQ ID:29726, to the nucleotide sequence of VGAM1182 RNA, herein designated VGAM RNA, also designated SEQ ID:3893.

Another function of VGAM1182 is therefore inhibition of GBTS1 (Accession NM_145173). Accordingly, utilities of VGAM1182 include diagnosis, prevention and treatment of diseases and clinical conditions associated with GBTS1. KIAA1257 (Accession XM_031577) is another VGAM1182 host target gene. KIAA1257 BINDING SITE is HOST TARGET binding site found in the 3' untranslated region of mRNA encoded by KIAA1257, corresponding to a HOST TARGET binding site such as BINDING SITE I, BINDING SITE II or BINDING SITE III. Table 2 illustrates the complementarity of the nucleotide sequences of KIAA1257 BINDING SITE, designated SEQ ID:31428, to the nucleotide sequence of VGAM1182 RNA, herein designated VGAM RNA, also designated SEQ ID:3893.

Another function of VGAM1182 is therefore inhibition of KIAA1257 (Accession XM_031577). Accordingly, utilities of VGAM1182 include diagnosis, prevention and treatment of diseases and clinical conditions associated with KIAA1257. SBBI26 (Accession NM_018846) is another VGAM1182 host target gene. SBBI26 BINDING SITE is HOST TARGET binding site found in the 3' untranslated region of mRNA encoded by SBBI26, corresponding to a HOST TARGET binding site such as BINDING SITE I, BINDING SITE II or BINDING SITE III. Table 2 illustrates the complementarity of the nucleotide sequences of SBBI26 BINDING SITE, designated SEQ ID:20829, to the nucleotide sequence of VGAM1182 RNA, herein designated VGAM RNA, also designated SEQ ID:3893.

Another function of VGAM1182 is therefore inhibition of SBBI26 (Accession NM_018846). Accordingly, utilities of VGAM1182 include diagnosis, prevention and treatment of diseases and clinical conditions associated with SBBI26. LOC124602 (Accession XM_058829) is another VGAM1182 host target gene. LOC124602 BINDING SITE is HOST TARGET binding site found in the 3' untranslated region of mRNA encoded by LOC124602, corresponding to a HOST TARGET binding site such as BINDING SITE I, BINDING SITE II or BINDING SITE III. Table 2 illustrates the complementarity of the nucleotide sequences of LOC124602 BINDING SITE, designated SEQ ID:36756, to the nucleotide sequence of VGAM1182 RNA, herein designated VGAM RNA, also designated SEQ ID:3893.

Another function of VGAM1182 is therefore inhibition of LOC124602 (Accession XM_058829). Accordingly, utilities of VGAM1182 include diagnosis, prevention and treatment of diseases and clinical conditions associated with LOC124602. LOC132235 (Accession XM_072302) is another VGAM1182 host target gene. LOC132235 BINDING SITE is HOST TARGET binding site found in the 5' untranslated region of mRNA encoded by LOC132235, corresponding to a HOST TARGET binding site such as BINDING SITE I, BINDING SITE II or BINDING SITE III. Table 2 illustrates the complementarity of the nucleotide sequences of LOC132235 BINDING SITE, designated SEQ ID:37479, to the nucleotide sequence of VGAM1182 RNA, herein designated VGAM RNA, also designated SEQ ID:3893.

Another function of VGAM1182 is therefore inhibition of LOC132235 (Accession XM_072302). Accordingly, utilities of VGAM1182 include diagnosis, prevention and treatment of diseases and clinical conditions associated with LOC132235. LOC158295 (Accession XM_098915) is another VGAM1182 host target gene. LOC158295 BINDING SITE is HOST TARGET binding site found in the 5' untranslated region of mRNA encoded by LOC158295, corresponding to a HOST TARGET binding site such as BINDING SITE I, BINDING SITE II or BINDING SITE III. Table 2 illustrates the complementarity of the nucleotide sequences of LOC158295 BINDING SITE, designated SEQ ID:41936, to the nucleotide sequence of VGAM1182 RNA, herein designated VGAM RNA, also designated SEQ ID:3893.

Another function of VGAM1182 is therefore inhibition of LOC158295 (Accession XM_098915). Accordingly, utilities of VGAM1182 include diagnosis, prevention and treatment of diseases and clinical conditions associated with LOC158295. LOC200940 (Accession XM_114324) is another VGAM1182 host target gene. LOC200940 BINDING SITE is HOST TARGET binding site found in the 3' untranslated region of mRNA encoded by LOC200940, corresponding to a HOST TARGET binding site such as BINDING SITE I, BINDING SITE II or BINDING SITE III. Table 2 illustrates the complementarity of the nucleotide sequences of LOC200940 BINDING SITE, designated SEQ ID:42874, to the nucleotide sequence of VGAM1182 RNA, herein designated VGAM RNA, also designated SEQ ID:3893.

Another function of VGAM1182 is therefore inhibition of LOC200940 (Accession XM_114324). Accordingly, utilities of VGAM1182 include diagnosis, prevention and treatment of diseases and clinical conditions associated with LOC200940. LOC201685 (Accession XM_117325) is another VGAM1182 host target gene. LOC201685 BINDING SITE is HOST TARGET binding site found in the 5' untranslated region of mRNA encoded by LOC201685, corresponding to a HOST TARGET binding site such as BINDING SITE I, BINDING SITE II or BINDING SITE III. Table 2 illustrates the complementarity of the nucleotide sequences of LOC201685 BINDING SITE, designated SEQ ID:43383, to the nucleotide sequence of VGAM1182 RNA, herein designated VGAM RNA, also designated SEQ ID:3893.

Another function of VGAM1182 is therefore inhibition of LOC201685 (Accession XM_117325). Accordingly, utilities of VGAM1182 include diagnosis, prevention and treatment of diseases and clinical conditions associated with LOC201685. LOC203397 (Accession XM_114695) is another VGAM1182 host target gene. LOC203397 BINDING SITE is HOST TARGET binding site found in the 3' untranslated region of mRNA encoded by LOC203397, corresponding to a HOST TARGET binding site such as BINDING SITE I, BINDING SITE II or BINDING SITE III. Table 2 illustrates the complementarity of the nucleotide sequences of LOC203397 BINDING SITE, designated SEQ ID:43036, to the nucleotide sequence of VGAM1182 RNA, herein designated VGAM RNA, also designated SEQ ID:3893.

Another function of VGAM1182 is therefore inhibition of LOC203397 (Accession XM_114695). Accordingly, utilities of VGAM1182 include diagnosis, prevention and treatment of diseases and clinical conditions associated with LOC203397. LOC254413 (Accession XM_173141) is another VGAM1182 host target gene. LOC254413 BINDING SITE is HOST TARGET binding site found in the 5' untranslated region of mRNA encoded by LOC254413, corresponding to a HOST TARGET binding site such as BINDING SITE I, BINDING SITE II or BINDING SITE III. Table 2 illustrates the complementarity of the nucleotide sequences of LOC254413 BINDING SITE, designated SEQ ID:46397, to the nucleotide sequence of VGAM1182 RNA, herein designated VGAM RNA, also designated SEQ ID:3893.

Another function of VGAM1182 is therefore inhibition of LOC254413 (Accession XM_173141). Accordingly, utilities of VGAM1182 include diagnosis, prevention and treatment of diseases and clinical conditions associated with LOC254413. LOC57228 (Accession NM_020467) is another VGAM1182 host target gene. LOC57228 BINDING SITE is HOST TARGET binding site found in the 5' untranslated region of mRNA encoded by LOC57228, corresponding to a HOST TARGET binding site such as BINDING SITE I, BINDING SITE II or BINDING SITE III. Table 2 illustrates the complementarity of the nucleotide sequences of LOC57228 BINDING SITE, designated SEQ ID:21705, to the nucleotide sequence of VGAM1182 RNA, herein designated VGAM RNA, also designated SEQ ID:3893.

Another function of VGAM1182 is therefore inhibition of LOC57228 (Accession NM_020467). Accordingly, utilities of VGAM1182 include diagnosis, prevention and treatment of diseases and clinical conditions associated with LOC57228. FIG. 1 further provides a conceptual description of a novel bioinformatically detected viral gene of the present invention, referred to here as Viral Genomic Address Messenger 1183 (VGAM1183) viral gene, which modulates expression of respective host target genes thereof, the function and utility of which host target genes is known in the art.

VGAM1183 is a novel bioinformatically detected regulatory, non protein coding, viral micro RNA (miRNA) gene. The method by which VGAM1183 was detected is described hereinabove with reference to FIGS. 1-8.

VGAM1183 gene, herein designated VGAM GENE, is a viral gene contained in the genome of Cactus Virus X. VGAM1183 host target gene, herein designated VGAM HOST TARGET GENE, is a human gene contained in the human genome.

VGAM1183 gene encodes a VGAM1183 precursor RNA, herein designated VGAM PRECURSOR RNA. Similar to other miRNA genes, and unlike most ordinary genes, VGAM1183 precursor RNA does not encode a protein. A nucleotide sequence identical or highly similar to the nucleotide sequence of VGAM1183 precursor RNA is designated SEQ ID:1169, and is provided hereinbelow with reference to the sequence listing part. Nucleotide sequence SEQ ID:1169 is located at position 6096 relative to the genome of Cactus Virus X.

VGAM1183 precursor RNA folds onto itself, forming VGAM1183 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1183 folded precursor RNA into VGAM1183 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1183 RNA is designated SEQ ID:3894, and is provided hereinbelow with reference to the sequence listing part.

VGAM1183 host target gene, herein designated VGAM HOST TARGET GENE, encodes a corresponding messenger RNA, VGAM1183 host target RNA, herein designated VGAM HOST TARGET RNA. VGAM1183 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1183 RNA, herein designated VGAM RNA, binds complementarily to one or more host target binding sites located in untranslated regions of VGAM1183 host target RNA, herein designated VGAM HOST TARGET RNA. This complementary binding is due to the fact that the nucleotide sequence of VGAM1183 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1183 RNA, herein designated VGAM RNA, may have a different number of host target binding sites in untranslated regions of a VGAM1183 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1183 RNA, herein designated VGAM RNA, to host target binding sites on VGAM1183 host target RNA, herein designated VGAM HOST TARGET RNA, such as BINDING SITE I, BINDING SITE II and BINDING SITE III, inhibits translation of VGAM1183 host target RNA into VGAM1183 host target protein, herein designated VGAM HOST TARGET PROTEIN. VGAM host target protein is therefore outlined by a broken line.

It is appreciated that VGAM1183 host target gene, herein designated VGAM HOST TARGET GENE, in fact represents a plurality of VGAM1183 host target genes. The mRNA of each one of this plurality of VGAM1183 host target genes comprises one or more host target binding sites, each having a nucleotide sequence which is at least partly complementary to VGAM1183 RNA, herein designated VGAM RNA, and which when bound by VGAM1183 RNA causes inhibition of translation of respective one or more VGAM1183 host target proteins.

It is further appreciated by one skilled in the art that the mode of translational inhibition illustrated by FIG. 1 with specific reference to translational inhibition exerted by VGAM1183 gene, herein designated VGAM GENE, on one or more VGAM1183 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1183 is inhibition of expression of host target genes, as part of a novel viral mechanism of attacking a host. Accordingly, utilities of VGAM1183 include diagnosis, prevention and treatment of viral infection by Cactus Virus X. Specific functions, and accordingly utilities, of VGAM1183 correlate with, and may be deduced from, the identity of the host target genes which VGAM1183 binds and inhibits, and the function of these host target genes, as elaborated hereinbelow.

Nucleotide sequences of the VGAM1183 precursor RNA, herein designated VGAM PRECURSOR RNA, and of the 'diced' VGAM1183 RNA, herein designated VGAM RNA, and a schematic representation of the secondary folding of VGAM1183 folded precursor RNA, herein designated VGAM FOLDED PRECURSOR RNA, of VGAM1183 are further described hereinbelow with reference to Table 1.

Nucleotide sequences of host target binding sites, such as BINDING SITE-I, BINDING SITE-II and BINDING SITE-III of FIG. 1, found on VGAM1183 host target RNA, and schematic representation of the complementarity of each of these host target binding sites to VGAM1183 RNA, herein designated VGAM RNA, are described hereinbelow with reference to Table 2.

As mentioned hereinabove with reference to FIG. 1, a function of VGAM1183 gene, herein designated VGAM is inhibition of expression of VGAM1183 target genes. It is appreciated that specific functions, and accordingly utilities, of VGAM1183 correlate with, and may be deduced from, the identity of the target genes which VGAM1183 binds and inhibits, and the function of these target genes, as elaborated hereinbelow.

Fibroblast Growth Factor 2 (basic) (FGF2, Accession NM_002006) is a VGAM1183 host target gene. FGF2 BINDING SITE is HOST TARGET binding site found in the 3' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7732, to the nucleotide sequence of VGAM1183 RNA, herein designated VGAM RNA, also designated SEQ ID:3894.

A function of VGAM1183 is therefore inhibition of Fibroblast Growth Factor 2 (basic) (FGF2, Accession NM_002006), a gene which probably involved in nervous system development and function. Accordingly, utilities of VGAM1183 include diagnosis, prevention and treatment of diseases and clinical conditions associated with FGF2. The function of FGF2 and its association with various diseases and clinical conditions, has been established by previous studies, as described hereinabove with reference to VGAM51. Phosphodiesterase 4D, CAMP-specific (phosphodiesterase E3 dunce homolog, Drosophila) (PDE4D, Accession XM_056815) is another VGAM1183 host target gene. PDE4D BINDING SITE is HOST TARGET binding site found in the 3' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36431, to the nucleotide sequence of VGAM1183 RNA, herein designated VGAM RNA, also designated SEQ ID:3894.

Another function of VGAM1183 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM1183 include diagnosis, prevention and treatment of diseases and clinical conditions associated with PDE4D. The function of PDE4D and its association with various diseases and clinical conditions, has been established by previous studies, as described hereinabove with reference to VGAM180. Prostaglandin-endoperoxide Synthase 2 (prostaglandin G/H synthase and cyclooxygenase) (PTGS2, Accession NM_000963) is another VGAM1183 host target gene. PTGS2 BINDING SITE is HOST TARGET binding site found in the 3' untranslated region of mRNA encoded by PTGS2, corresponding to a HOST TARGET binding site such as BINDING SITE I, BINDING SITE II or BINDING SITE III. Table 2 illustrates the complementarity of the nucleotide sequences of PTGS2 BINDING SITE, designated SEQ ID:6682, to the nucleotide sequence of VGAM1183 RNA, herein designated VGAM RNA, also designated SEQ ID:3894.

Another function of VGAM1183 is therefore inhibition of Prostaglandin-endoperoxide Synthase 2 (prostaglandin G/H synthase and cyclooxygenase) (PTGS2, Accession NM_000963), a gene which may have a role as a major mediator of inflammation and/or a role for prostanoid signaling in activity-dependent plasticity. Accordingly, utilities of VGAM1183 include diagnosis, prevention and treatment of diseases and clinical conditions associated with PTGS2. The function of PTGS2 and its association with various diseases and clinical conditions, has been established by previous studies, as described hereinabove with reference to VGAM292. RAD50 Homolog (S. cerevisiae) (RAD50, Accession NM_005732) is another VGAM1183 host target gene. RAD50 BINDING SITE1 and RAD50 BINDING SITE2 are HOST TARGET binding sites found in untranslated regions of mRNA encoded by RAD50, corresponding to HOST TARGET binding sites such as BINDING SITE I, BINDING SITE II or BINDING SITE III. Table 2 illustrates the complementarity of the nucleotide sequences of RAD50 BINDING SITE1 and RAD50 BINDING SITE2, designated SEQ ID:12292 and SEQ ID:28549 respectively, to the nucleotide sequence of VGAM1183 RNA, herein designated VGAM RNA, also designated SEQ ID:3894.

Another function of VGAM1183 is therefore inhibition of RAD50 Homolog (S. cerevisiae) (RAD50, Accession NM_005732), a gene which is involved in dna double-strand break repair (dsbr). Accordingly, utilities of VGAM1183 include diagnosis, prevention and treatment of diseases and clinical conditions associated with RAD50. The function of RAD50 and its association with various diseases and clinical conditions, has been established by previous studies, as described hereinabove with reference to VGAM132. Serine/arginine Repetitive Matrix 1 (SRRM1, Accession NM_005839) is another VGAM1183 host target gene. SRRM1 BINDING SITE is HOST TARGET binding site found in the 3' untranslated region of mRNA encoded by SRRM1, corresponding to a HOST TARGET binding site such as BINDING SITE I, BINDING SITE II or BINDING SITE III. Table 2 illustrates the complementarity of the nucleotide sequences of SRRM1 BINDING SITE, designated SEQ ID:12448, to the nucleotide sequence of VGAM1183 RNA, herein designated VGAM RNA, also designated SEQ ID:3894.

Another function of VGAM1183 is therefore inhibition of Serine/arginine Repetitive Matrix 1 (SRRM1, Accession NM_005839). Accordingly, utilities of VGAM1183 include diagnosis, prevention and treatment of diseases and clinical conditions associated with SRRM1. SUV39H2 (Accession NM_024670) is another VGAM1183 host target gene. SUV39H2 BINDING SITE is HOST TARGET binding site found in the 3" untranslated region of mRNA encoded by SUV39H2, corresponding to a HOST TARGET binding site such as BINDING SITE I, BINDING SITE II or BINDING SITE III. Table 2 illustrates the complementarity of the nucleotide sequences of SUV39H2 BINDING SITE, designated SEQ ID:23973, to the nucleotide sequence of VGAM1183 RNA, herein designated VGAM RNA, also designated SEQ ID:3894.

Another function of VGAM1183 is therefore inhibition of SUV39H2 (Accession NM_024670), a gene which is involved in gene repression and the modification of position-effect- variegation. Accordingly, utilities of VGAM1183 include diagnosis, prevention and treatment of diseases and clinical conditions associated with SUV39H2. The function of SUV39H2 and its association with various diseases and clinical conditions, has been established by previous studies, as described hereinabove with reference to VGAM424. Ubiquitination Factor E4A (UFD2 homolog, yeast) (UBE4A, Accession NM_004788) is another VGAM1183 host target gene. UBE4A BINDING SITE is HOST TARGET binding site found in the 3' untranslated region of mRNA encoded by UBE4A, corresponding to a HOST TARGET binding site such as BINDING SITE I, BINDING SITE II or BINDING SITE III. Table 2 illustrates the complementarity of the nucleotide sequences of UBE4A BINDING SITE, designated SEQ ID:11194, to the nucleotide sequence of VGAM1183 RNA, herein designated VGAM RNA, also designated SEQ ID:3894.

Another function of VGAM1183 is therefore inhibition of Ubiquitination Factor E4A (UFD2 homolog, yeast) (UBE4A, Accession NM_004788), a gene which binds to the ubiquitin moieties of preformed conjugates and catalyzes ubiquitin chain assembly in conjunction with E1, E2, and E3. Accordingly, utilities of VGAM1183 include diagnosis, prevention and treatment of diseases and clinical conditions associated with UBE4A. The function of UBE4A and its association with various diseases and clinical conditions, has been established by previous studies, as described hereinabove with reference to VGAM60. FLJ25422 (Accession NM_145000) is another VGAM1183 host target gene. FLJ25422 BINDING SITE is HOST TARGET binding site found in the 5' untranslated region of mRNA encoded by FLJ25422, corresponding to a HOST TARGET binding site such as BINDING SITE I, BINDING SITE II or BINDING SITE III. Table 2 illustrates the complementarity of the nucleotide sequences of FLJ25422 BINDING SITE, designated SEQ ID:29603, to the nucleotide sequence of VGAM1183 RNA, herein designated VGAM RNA, also designated SEQ ID:3894.

Another function of VGAM1183 is therefore inhibition of FLJ25422 (Accession NM_145000). Accordingly, utilities of VGAM1183 include diagnosis, prevention and treatment of diseases and clinical conditions associated with FLJ25422. KIAA1254 (Accession XM_046132) is another VGAM1183 host target gene. KIAA1254 BINDING SITE is HOST TARGET binding site found in the 3' untranslated region of mRNA encoded by KIAA1254, corresponding to a HOST TARGET binding site such as BINDING SITE I, BINDING SITE II or BINDING SITE III. Table 2 illustrates the complementarity of the nucleotide sequences of KIAA1254 BINDING SITE, designated SEQ ID:34695, to the nucleotide sequence of VGAM1183 RNA, herein designated VGAM RNA, also designated SEQ ID:3894.

Another function of VGAM1183 is therefore inhibition of KIAA1254 (Accession XM_046132). Accordingly, utilities of VGAM1183 include diagnosis, prevention and treatment of diseases and clinical conditions associated with KIAA1254. MGC3040 (Accession XM_039805) is another VGAM1183 host target gene. MGC3040 BINDING SITE is HOST TARGET binding site found in the 3' untranslated region of mRNA encoded by MGC3040, corresponding to a HOST TARGET binding site such as BINDING SITE I, BINDING SITE II or BINDING SITE III. Table 2 illustrates the complementarity of the nucleotide sequences of MGC3040 BINDING SITE, designated SEQ ID:33195, to the nucleotide sequence of VGAM1183 RNA, herein designated VGAM RNA, also designated SEQ ID:3894.

Another function of VGAM1183 is therefore inhibition of MGC3040 (Accession XM_039805). Accordingly, utilities of VGAM1183 include diagnosis, prevention and treatment of diseases and clinical conditions associated with MGC3040. MGC32043 (Accession NM_144582) is another VGAM1183 host target gene. MGC32043 BINDING SITE is HOST TARGET binding site found in the 3' untranslated region of mRNA encoded by MGC32043, corresponding to a HOST TARGET binding site such as BINDING SITE I, BINDING SITE II or BINDING SITE III. Table 2 illustrates the complementarity of the nucleotide sequences of MGC32043 BINDING SITE, designated SEQ ID:29390, to the nucleotide sequence of VGAM1183 RNA, herein designated VGAM RNA, also designated SEQ ID:3894.

Another function of VGAM1183 is therefore inhibition of MGC32043 (Accession NM_144582). Accordingly, utilities of VGAM1183 include diagnosis, prevention and treatment of diseases and clinical conditions associated with MGC32043. OBTP (Accession NM_017601) is another VGAM1183 host target gene. OBTP BINDING SITE is HOST TARGET binding site found in the 3' untranslated region of mRNA encoded by OBTP, corresponding to a HOST TARGET binding site such as BINDING SITE I, BINDING SITE II or BINDING SITE III. Table 2 illustrates the complementarity of the nucleotide sequences of OBTP BINDING SITE, designated SEQ ID:19076, to the nucleotide sequence of VGAM1183 RNA, herein designated VGAM RNA, also designated SEQ ID:3894.

Another function of VGAM1183 is therefore inhibition of OBTP (Accession NM_017601). Accordingly, utilities of VGAM1183 include diagnosis, prevention and treatment of diseases and clinical conditions associated with OBTP. Protein Tyrosine Phosphatase Type IVA, Member 1 (PTP4A1, Accession NM_003463) is another VGAM1183 host target gene. PTP4A1 BINDING SITE is HOST TARGET binding site found in the 5' untranslated region of mRNA encoded by PTP4A1, corresponding to a HOST TARGET binding site such as BINDING SITE I, BINDING SITE II or BINDING SITE III. Table 2 illustrates the complementarity of the nucleotide sequences of PTP4A1 BINDING SITE, designated SEQ ID:9530, to the nucleotide sequence of VGAM1183 RNA, herein designated VGAM RNA, also designated SEQ ID:3894.

Another function of VGAM1183 is therefore inhibition of Protein Tyrosine Phosphatase Type IVA, Member 1 (PTP4A1, Accession NM_003463). Accordingly, utilities of VGAM1183 include diagnosis, prevention and treatment of diseases and clinical conditions associated with PTP4A1. RRN3 (Accession NM_018427) is another VGAM1183 host target gene. RRN3 BINDING SITE is HOST TARGET binding site found in the 3' untranslated region of mRNA encoded by RRN3, corresponding to a HOST TARGET binding site such as BINDING SITE I, BINDING SITE II or BINDING SITE III. Table 2 illustrates the complementarity of the nucleotide sequences of RRN3 BINDING SITE, designated SEQ ID:20487, to the nucleotide sequence of VGAM1183 RNA, herein designated VGAM RNA, also designated SEQ ID:3894.

Another function of VGAM1183 is therefore inhibition of RRN3 (Accession NM_018427). Accordingly, utilities of VGAM1183 include diagnosis, prevention and treatment of diseases and clinical conditions associated with RRN3. LOC150848 (Accession XM_097959) is another VGAM1183 host target gene. LOC150848 BINDING SITE is HOST TARGET binding site found in the 5' untranslated region of mRNA encoded by LOC150848, corresponding to a HOST TARGET binding site such as BINDING SITE I, BINDING SITE II or BINDING SITE III. Table 2 illustrates the complementarity of the nucleotide sequences of LOC150848 BINDING SITE, designated SEQ ID:41256, to the nucleotide sequence of VGAM1183 RNA, herein designated VGAM RNA, also designated SEQ ID:3894.

Another function of VGAM1183 is therefore inhibition of LOC150848 (Accession XM_097959). Accordingly, utilities of VGAM1183 include diagnosis, prevention and treatment of diseases and clinical conditions associated with LOC150848. LOC161734 (Accession XM_102109) is another VGAM1183 host target gene. LOC161734 BINDING SITE is HOST TARGET binding site found in the 3' untranslated region of mRNA encoded by LOC161734, corresponding to a HOST TARGET binding site such as BINDING SITE I, BINDING SITE II or BINDING SITE III. Table 2 illustrates the complementarity of the nucleotide sequences of LOC161734 BINDING SITE, designated SEQ ID:42110, to the nucleotide sequence of VGAM1183 RNA, herein designated VGAM RNA, also designated SEQ ID:3894.

Another function of VGAM1183 is therefore inhibition of LOC161734 (Accession XM_102109). Accordingly, utilities of VGAM1183 include diagnosis, prevention and treatment of diseases and clinical conditions associated with LOC161734. LOC220930 (Accession XM_167624) is another VGAM1183 host target gene. LOC220930 BINDING SITE is HOST TARGET binding site found in the 3' untranslated region of mRNA encoded by LOC220930, corresponding to a HOST TARGET binding site such as BINDING SITE I, BINDING SITE II or BINDING SITE III. Table 2 illustrates the complementarity of the nucleotide sequences of LOC220930 BINDING SITE, designated SEQ ID:44734, to the nucleotide sequence of VGAM1183 RNA, herein designated VGAM RNA, also designated SEQ ID:3894.

Another function of VGAM1183 is therefore inhibition of LOC220930 (Accession XM_167624). Accordingly, utilities of VGAM1183 include diagnosis, prevention and treatment of diseases and clinical conditions associated with LOC220930. LOC221663 (Accession XM_168131) is another VGAM1183 host target gene. LOC221663 BINDING SITE is HOST TARGET binding site found in the 5' untranslated region of mRNA encoded by LOC221663, corresponding to a HOST TARGET binding site such as BINDING SITE I, BINDING SITE II or BINDING SITE III. Table 2 illustrates the complementarity of the nucleotide sequences of LOC221663 BINDING SITE, designated SEQ ID:45038, to the nucleotide sequence of VGAM1183 RNA, herein designated VGAM RNA, also designated SEQ ID:3894.

Another function of VGAM1183 is therefore inhibition of LOC221663 (Accession XM_168131). Accordingly, utilities of VGAM1183 include diagnosis, prevention and treatment of diseases and clinical conditions associated with LOC221663. FIG. 1 further provides a conceptual description of a novel bioinformatically detected viral gene of the present invention, referred to here as Viral Genomic Address Messenger 1184 (VGAM1184) viral gene, which modulates expression of respective host target genes thereof, the function and utility of which host target genes is known in the art.

VGAM1184 is a novel bioinformatically detected regulatory, non protein coding, viral micro RNA (miRNA) gene. The method by which VGAM1184 was detected is described hereinabove with reference to FIGS. 1-8.

VGAM1184 gene, herein designated VGAM GENE, is a viral gene contained in the genome of Cactus Virus X. VGAM1184 host target gene, herein designated VGAM HOST TARGET GENE, is a human gene contained in the human genome.

VGAM1184 gene encodes a VGAM1184 precursor RNA, herein designated VGAM PRECURSOR RNA. Similar to other miRNA genes, and unlike most ordinary genes, VGAM1184 precursor RNA does not encode a protein. A nucleotide sequence identical or highly similar to the nucleotide sequence of VGAM1184 precursor RNA is designated SEQ ID:1170, and is provided hereinbelow with reference to the sequence listing part. Nucleotide sequence SEQ ID:1170 is located at position 5274 relative to the genome of Cactus Virus X.

VGAM1184 precursor RNA folds onto itself, forming VGAM1184 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1184 folded precursor RNA into VGAM1184 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1184 RNA is designated SEQ ID:3895, and is provided hereinbelow with reference to the sequence listing part.

VGAM1184 host target gene, herein designated VGAM HOST TARGET GENE, encodes a corresponding messenger RNA, VGAM1184 host target RNA, herein designated VGAM HOST TARGET RNA. VGAM1184 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1184 RNA, herein designated VGAM RNA, binds complementarily to one or more host target binding sites located in untranslated regions of VGAM1184 host target RNA, herein designated VGAM HOST TARGET RNA. This complementary binding is due to the fact that the nucleotide sequence of VGAM1184 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1184 RNA, herein designated VGAM RNA, may have a different number of host target binding sites in untranslated regions of a VGAM1184 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1184 RNA, herein designated VGAM RNA, to host target binding sites on VGAM1184 host target RNA, herein designated VGAM HOST TARGET RNA, such as BINDING SITE I, BINDING SITE II and BINDING SITE III, inhibits translation of VGAM1184 host target RNA into VGAM1184 host target protein, herein designated VGAM HOST TARGET PROTEIN. VGAM host target protein is therefore outlined by a broken line.

It is appreciated that VGAM1184 host target gene, herein designated VGAM HOST TARGET GENE, in fact represents a plurality of VGAM1184 host target genes. The mRNA of each one of this plurality of VGAM1184 host target genes comprises one or more host target binding sites, each having a nucleotide sequence which is at least partly complementary to VGAM1184 RNA, herein designated VGAM RNA, and which when bound by VGAM1184 RNA causes inhibition of translation of respective one or more VGAM1184 host target proteins.

It is further appreciated by one skilled in the art that the mode of translational inhibition illustrated by FIG. 1 with specific reference to translational inhibition exerted by VGAM1184 gene, herein designated VGAM GENE, on one or more VGAM1184 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1184 is inhibition of expression of host target genes, as part of a novel viral mechanism of attacking a host. Accordingly, utilities of VGAM1184 include diagnosis, prevention and treatment of viral infection by Cactus Virus X. Specific functions, and accordingly utilities, of VGAM1184 correlate with, and may be deduced from, the identity of the host target genes which VGAM1184 binds and inhibits, and the function of these host target genes, as elaborated hereinbelow.

Nucleotide sequences of the VGAM1184 precursor RNA, herein designated VGAM PRECURSOR RNA, and of the 'diced' VGAM1184 RNA, herein designated VGAM RNA, and a schematic representation of the secondary folding of VGAM1184 folded precursor RNA, herein designated VGAM FOLDED PRECURSOR RNA, of VGAM1184 are further described hereinbelow with reference to Table 1.

Nucleotide sequences of host target binding sites, such as BINDING SITE-I, BINDING SITE-II and BINDING SITE-III of FIG. 1, found on VGAM1184 host target RNA, and schematic representation of the complementarity of each of these host target binding sites to VGAM1184 RNA, herein designated VGAM RNA, are described hereinbelow with reference to Table 2.

As mentioned hereinabove with reference to FIG. 1, a function of VGAM1184 gene, herein designated VGAM is inhibition of expression of VGAM1184 target genes. It is appreciated that specific functions, and accordingly utilities, of VGAM1184 correlate with, and may be deduced from, the identity of the target genes which VGAM1184 binds and inhibits, and the function of these target genes, as elaborated hereinbelow.

Fibroblast Growth Factor Receptor 2 (bacteria-expressed kinase, keratinocyte growth factor receptor, craniofacial dysostosis 1, Crouzon syndrome, Pfeiffer syndrome, Jackson-Weiss syndrome) (FGFR2, Accession NM_022973) is a VGAM1184 host target gene. FGFR2 BINDING SITE1 through FGFR2 BINDING SITE11 are HOST TARGET binding sites found in untranslated regions of mRNA encoded by FGFR2, corresponding to HOST TARGET binding sites such as BINDING SITE I, BINDING SITE II or BINDING SITE III. Table 2 illustrates the complementarity of the nucleotide sequences of FGFR2 BINDING SITE1 through FGFR2 BINDING SITE11, designated SEQ ID:23246, SEQ ID:23248, SEQ ID:23239, SEQ ID:23249, SEQ ID:23295, SEQ ID:5639, SEQ ID:23235, SEQ ID:23242, SEQ ID:23247, SEQ ID:23289 and SEQ ID:23301 respectively, to the nucleotide sequence of VGAM1184 RNA, herein designated VGAM RNA, also designated SEQ ID:3895.

A function of VGAM1184 is therefore inhibition of Fibroblast Growth Factor Receptor 2 (bacteria-expressed kinase, keratinocyte growth factor receptor, craniofacial dysostosis 1, Crouzon syndrome, Pfeiffer syndrome, Jackson-Weiss syndrome) (FGFR2, Accession NM_022973). Accordingly, utilities of VGAM1184 include diagnosis, prevention and treatment of diseases and clinical conditions associated with FGFR2. HSJ1 (Accession NM_006736) is another VGAM1184 host target gene. HSJ1 BINDING SITE is HOST TARGET binding site found in the 3' untranslated region of mRNA encoded by HSJ1, corresponding to a HOST TARGET binding site such as BINDING SITE I, BINDING SITE II or BINDING SITE III. Table 2 illustrates the complementarity of the nucleotide sequences of HSJ1 BINDING SITE, designated SEQ ID:13587, to the nucleotide sequence of VGAM1184 RNA, herein designated VGAM RNA, also designated SEQ ID:3895.

Another function of VGAM1184 is therefore inhibition of HSJ1 (Accession NM_006736). Accordingly, utilities of VGAM1184 include diagnosis, prevention and treatment of diseases and clinical conditions associated with HSJ1. KIAA0802 (Accession XM_031357) is another VGAM1184 host target gene. KIAA0802 BINDING SITE is HOST TARGET binding site found in the 5' untranslated region of mRNA encoded by KIAA0802, corresponding to a HOST TARGET binding site such as BINDING SITE I, BINDING SITE II or BINDING SITE III. Table 2 illustrates the complementarity of the nucleotide sequences of KIAA0802 BINDING SITE, designated SEQ ID:31349, to the nucleotide sequence of VGAM1184 RNA, herein designated VGAM RNA, also designated SEQ ID:3895.

Another function of VGAM1184 is therefore inhibition of KIAA0802 (Accession XM_031357). Accordingly, utilities of VGAM1184 include diagnosis, prevention and treatment of diseases and clinical conditions associated with KIAA0802. 1(3) mbt-like 2 (Drosophila) (L3MBTL2, Accession XM_114201) is another VGAM1184 host target gene. L3MBTL2 BINDING SITE is HOST TARGET binding site found in the 5' untranslated region of mRNA encoded by L3MBTL2, corresponding to a HOST TARGET binding site such as BINDING SITE I, BINDING SITE II or BINDING SITE III. Table 2 illustrates the complementarity of the nucleotide sequences of L3MBTL2 BINDING SITE, designated SEQ ID:42789, to the nucleotide sequence of VGAM1184 RNA, herein designated VGAM RNA, also designated SEQ ID:3895.

Another function of VGAM1184 is therefore inhibition of 1 (3) mbt-like 2 (Drosophila) (L3MBTL2, Accession XM_114201). Accordingly, utilities of VGAM1184 include diagnosis, prevention and treatment of diseases and clinical conditions associated with L3MBTL2. LAP1B (Accession XM_035429) is another VGAM1184 host target gene. LAP1B BINDING SITE is HOST TARGET binding site found in the 5' untranslated region of mRNA encoded by LAP1B, corresponding to a HOST TARGET binding site such as BINDING SITE I, BINDING SITE II or BINDING SITE III. Table 2 illustrates the complementarity of the nucleotide sequences of LAP1B BINDING SITE, designated SEQ ID:32261, to the nucleotide sequence of VGAM1184 RNA, herein designated VGAM RNA, also designated SEQ ID:3895.

Another function of VGAM1184 is therefore inhibition of LAP1B (Accession XM_035429). Accordingly, utilities of VGAM1184 include diagnosis, prevention and treatment of diseases and clinical conditions associated with LAP1B. Serine/threonine Kinase 38 Like (STK38L, Accession XM_044823) is another VGAM1184 host target gene. STK38L BINDING SITE is HOST TARGET binding site found in the 3' untranslated region of mRNA encoded by STK38L, corresponding to a HOST TARGET binding site such as BINDING SITE I, BINDING SITE II or BINDING SITE III. Table 2 illustrates the complementarity of the nucleotide sequences of STK38L BINDING SITE, designated SEQ ID:34285, to the nucleotide sequence of VGAM1184 RNA, herein designated VGAM RNA, also designated SEQ ID:3895.

Another function of VGAM1184 is therefore inhibition of Serine/threonine Kinase 38 Like (STK38L, Accession XM_044823). Accordingly, utilities of VGAM1184 include diagnosis, prevention and treatment of diseases and clinical conditions associated with STK38L. LOC149182 (Accession XM_097605) is another VGAM1184 host target gene. LOC149182 BINDING SITE is HOST TARGET binding site found in the 5' untranslated region of mRNA encoded by LOC149182, corresponding to a HOST TARGET binding site such as BINDING SITE I, BINDING SITE II or BINDING SITE III. Table 2 illustrates the complementarity of the nucleotide sequences of LOC149182 BINDING SITE, designated SEQ ID:40967, to the nucleotide sequence of VGAM1184 RNA, herein designated VGAM RNA, also designated SEQ ID:3895.

Another function of VGAM1184 is therefore inhibition of LOC149182 (Accession XM_097605). Accordingly, utilities of VGAM1184 include diagnosis, prevention and treatment of diseases and clinical conditions associated with LOC149182. FIG. 1 further provides a conceptual description of a novel bioinformatically detected viral gene of the present invention, referred to here as Viral Genomic Address Messenger 1185 (VGAM1185) viral gene, which modulates expression of respective host target genes thereof, the function and utility of which host target genes is known in the art.

VGAM1185 is a novel bioinformatically detected regulatory, non protein coding, viral micro RNA (miRNA) gene. The method by which VGAM1185 was detected is described hereinabove with reference to FIGS. 1-8.

VGAM1185 gene, herein designated VGAM GENE, is a viral gene contained in the genome of Cactus Virus X. VGAM1185 host target gene, herein designated VGAM HOST TARGET GENE, is a human gene contained in the human genome.

VGAM1185 gene encodes a VGAM1185 precursor RNA, herein designated VGAM PRECURSOR RNA. Similar to other miRNA genes, and unlike most ordinary genes, VGAM1185 precursor RNA does not encode a protein. A nucleotide sequence identical or highly similar to the nucleotide sequence of VGAM1185 precursor RNA is designated SEQ ID:1171, and is provided hereinbelow with reference to the sequence listing part. Nucleotide sequence SEQ ID:1171 is located at position 4689 relative to the genome of Cactus Virus X.

VGAM1185 precursor RNA folds onto itself, forming VGAM1185 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1185 folded precursor RNA into VGAM1185 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 40%) nucleotide sequence of VGAM1185 RNA is designated SEQ ID:3896, and is provided hereinbelow with reference to the sequence listing part.

VGAM1185 host target gene, herein designated VGAM HOST TARGET GENE, encodes a corresponding messenger RNA, VGAM1185 host target RNA, herein designated VGAM HOST TARGET RNA. VGAM1185 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1185 RNA, herein designated VGAM RNA, binds complementarily to one or more host target binding sites located in untranslated regions of VGAM1185 host target RNA, herein designated VGAM HOST TARGET RNA. This complementary binding is due to the fact that the nucleotide sequence of VGAM1185 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1185 RNA, herein designated VGAM RNA, may have a different number of host target binding sites in untranslated regions of a VGAM1185 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1185 RNA, herein designated VGAM RNA, to host target binding sites on VGAM1185 host target RNA, herein designated VGAM HOST TARGET RNA, such as BINDING SITE I, BINDING SITE II and BINDING SITE III, inhibits translation of VGAM1185 host target RNA into VGAM1185 host target protein, herein designated VGAM HOST TARGET PROTEIN. VGAM host target protein is therefore outlined by a broken line.

It is appreciated that VGAM1185 host target gene, herein designated VGAM HOST TARGET GENE, in fact represents a plurality of VGAM1185 host target genes. The mRNA of each one of this plurality of VGAM1185 host target genes comprises one or more host target binding sites, each having a nucleotide sequence which is at least partly complementary to VGAM1185 RNA, herein designated VGAM RNA, and which when bound by VGAM1185 RNA causes inhibition of translation of respective one or more VGAM1185 host target proteins.

It is further appreciated by one skilled in the art that the mode of translational inhibition illustrated by FIG. 1 with specific reference to translational inhibition exerted by VGAM1185 gene, herein designated VGAM GENE, on one or more VGAM1185 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1185 is inhibition of expression of host target genes, as part of a novel viral mechanism of attacking a host. Accordingly, utilities of VGAM1185 include diagnosis, prevention and treatment of viral infection by Cactus Virus X. Specific functions, and accordingly utilities, of VGAM1185 correlate with, and may be deduced from, the identity of the host target genes which VGAM1185 binds and inhibits, and the function of these host target genes, as elaborated hereinbelow.

Nucleotide sequences of the VGAM1185 precursor RNA, herein designated VGAM PRECURSOR RNA, and of the 'diced' VGAM1185 RNA, herein designated VGAM RNA, and a schematic representation of the secondary folding of VGAM1185 folded precursor RNA, herein designated VGAM FOLDED PRECURSOR RNA, of VGAM1185 are further described hereinbelow with reference to Table 1.

Nucleotide sequences of host target binding sites, such as BINDING SITE-I, BINDING SITE-II and BINDING SITE-III of FIG. 1, found on VGAM1185 host target RNA, and schematic representation of the complementarity of each of these host target binding sites to VGAM1185 RNA, herein designated VGAM RNA, are described hereinbelow with reference to Table 2.

As mentioned hereinabove with reference to FIG. 1, a function of VGAM1185 gene, herein designated VGAM is inhibition of expression of VGAM1185 target genes. It is appreciated that specific functions, and accordingly utilities, of VGAM1185 correlate with, and may be deduced from, the identity of the target genes which VGAM1185 binds and inhibits, and the function of these target genes, as elaborated hereinbelow.

Adducin 2 (beta) (ADD2, Accession NM_017482) is a VGAM1185 host target gene. ADD2 BINDING SITE1 through ADD2 BINDING SITE3 are HOST TARGET binding sites found in untranslated regions of mRNA encoded by ADD2, corresponding to HOST TARGET binding sites such as BINDING SITE I, BINDING SITE II or BINDING SITE III. Table 2 illustrates the complementarity of the nucleotide sequences of ADD2 BINDING SITE1 through ADD2 BINDING SITE3, designated SEQ ID:18933, SEQ ID:18938 and SEQ ID:18946 respectively, to the nucleotide sequence of VGAM1185 RNA, herein designated VGAM RNA, also designated SEQ ID:3896.

A function of VGAM1185 is therefore inhibition of Adducin 2 (beta) (ADD2, Accession NM_017482), a gene which membrane-cytoskeleton- protein that promotes the assembly of the spectrin-actin network. Accordingly, utilities of VGAM1185 include diagnosis, prevention and treatment of diseases and clinical conditions associated with ADD2. The function of ADD2 has been established by previous studies. See alpha-adducin (ADD1; 102680). Adducin is a heterodimeric calmodulin (OMIM Ref. No. 114180)-binding protein of the cell-membrane skeleton, which is thought to play a role in assembly of the spectrin-actin lattice that underlies the plasma membrane (see OMIM Ref. No. also 182860 and 102560). Missense mutations in both the alpha- and beta-adducin genes that alter amino acids that are normally phosphorylated have been associated with the regulation of blood pressure in the Milan hypertensive strain (MHS) of rats (Bianchi et al., 1994). Muro et al. (2000) showed that in Add2 -/- mice, targeted disruption of the beta-adducin gene resulted in an 80% decrease of alpha-adducin and a 4-fold upregulation of gamma-adducin in erythrocytes. Elliptocytes, ovalocytes, and occasionally spherocytes were found in the blood smears of -/- mice. Mild hematologic findings were thought to be related to the amount of adducin remaining in the mutant animals (presumably alpha-gamma adducin).

Full details of the abovementioned studies are described in the following publications, the disclosure of which are hereby incorporated by reference:

Bianchi, G.; Tripodi, G.; Casari, G.; Salardi, S.; Barber, B. R.; Garcia, R.; Leoni, P.; Torielli, L.; Cusi, D.; Ferrandi, M.; Pinna, L. A.; Baralle, F. E.; Ferrari, P.: Two point mutations within the adducin genes are involved in blood pressure variation. Proc. Nat. Acad. Sci. 91:3999-4003, 1994; and Muro, A. F.; Marro, M. L.; Gajovic, S.; Porro, F.; Luzzatto, L.; Baralle, F. E.: Mild spherocytic hereditary elliptocytosis and altered levels of alpha- and gamma-adducins in beta-adduc.

Further studies establishing the function and utilities of ADD2 are found in John Hopkins OMIM database record ID 102681, and in sited publications numbered 79 and 2791-488 listed in the bibliography section hereinbelow, which are also hereby incorporated by reference.7-dehydrocholesterol Reductase (DHCR7, Accession NM_001360) is another VGAM1185 host target gene. DHCR7 BINDING SITE is HOST TARGET binding site found in the 3' untranslated region of mRNA encoded by DHCR7, corresponding to a HOST TARGET binding site such as BINDING SITE I, BINDING SITE II or BINDING SITE III. Table 2 illustrates the complementarity of the nucleotide sequences of DHCR7 BINDING SITE, designated SEQ ID:7040, to the nucleotide sequence of VGAM1185 RNA, herein designated VGAM RNA, also designated SEQ ID:3896.

Another function of VGAM1185 is therefore inhibition of 7-dehydrocholesterol Reductase (DHCR7, Accession NM_001360). Accordingly, utilities of VGAM1185 include diagnosis, prevention and treatment of diseases and clinical conditions associated with DHCR7. Lysophospholipase I (LYPLA1, Accession NM_006330) is another VGAM1185 host target gene. LYPLA1 BINDING SITE is HOST TARGET binding site found in the 3' untranslated region of mRNA encoded by LYPLA1, corresponding to a HOST TARGET binding site such as BINDING SITE I, BINDING SITE II or BINDING SITE III. Table 2 illustrates the complementarity of the nucleotide sequences of LYPLA1 BINDING SITE, designated SEQ ID:13028, to the nucleotide sequence of VGAM1185 RNA, herein designated VGAM RNA, also designated SEQ ID:3896.

Another function of VGAM1185 is therefore inhibition of Lysophospholipase I (LYPLA1, Accession NM_006330). Accordingly, utilities of VGAM1185 include diagnosis, prevention and treatment of diseases and clinical conditions associated with LYPLA1. Matrix Metalloproteinase 19 (MMP19, Accession NM_002429) is another VGAM1185 host target gene. MMP19 BINDING SITE1 and MMP19 BINDING SITE2 are HOST TARGET binding sites found in untranslated regions of mRNA encoded by MMP19, corresponding to HOST TARGET binding sites such as BINDING SITE I, BINDING SITE II or BINDING SITE III. Table 2 illustrates the complementarity of the nucleotide sequences of MMP19 BINDING SITE1 and MMP19 BINDING SITE2, designated SEQ ID:8268 and SEQ ID:23076 respectively, to the nucleotide sequence of VGAM1185 RNA, herein designated VGAM RNA, also designated SEQ ID:3896.

Another function of VGAM1185 is therefore inhibition of Matrix Metalloproteinase 19 (MMP19, Accession NM_002429). Accordingly, utilities of VGAM1185 include diagnosis, prevention and treatment of diseases and clinical conditions associated with MMP19. Phosphoribosyl Pyrophosphate Amidotransferase (PPAT, Accession NM_002703) is another VGAM1185 host target gene. PPAT BINDING SITE is HOST TARGET binding site found in the 3' untranslated region of mRNA encoded by PPAT, corresponding to a HOST TARGET binding site such as BINDING SITE I, BINDING SITE II or BINDING SITE III. Table 2 illustrates the complementarity of the nucleotide sequences of PPAT BINDING SITE, designated SEQ ID:8550, to the nucleotide sequence of VGAM1185 RNA, herein designated VGAM RNA, also designated SEQ ID:3896.

Another function of VGAM1185 is therefore inhibition of Phosphoribosyl Pyrophosphate Amidotransferase (PPAT, Accession NM_002703). Accordingly, utilities of VGAM1185 include diagnosis, prevention and treatment of diseases and clinical conditions associated with PPAT. Stathmin 1/oncoprotein 18 (STMN1, Accession NM_005563) is another VGAM1185 host target gene. STMN1 BINDING SITE is HOST TARGET binding site found in the 3' untranslated region of mRNA encoded by STMN1, corresponding to a HOST TARGET binding site such as BINDING SITE I, BINDING SITE II or BINDING SITE III. Table 2 illustrates the complementarity of the nucleotide sequences of STMN1 BINDING SITE, designated SEQ ID:12091, to the nucleotide sequence of VGAM1185 RNA, herein designated VGAM RNA, also designated SEQ ID:3896.

Another function of VGAM1185 is therefore inhibition of Stathmin 1/oncoprotein 18 (STMN1, Accession NM_005563), a gene which prevents assembly and promotes disassembly of microtubules. Accordingly, utilities of VGAM1185 include diagnosis, prevention and treatment of diseases and clinical conditions associated with STMN1. The function of STMN1 and its association with various diseases and clinical conditions, has been established by previous studies, as described hereinabove with reference to VGAM281. Butyrophilin, Subfamily 2, Member A1 (BTN2A1, Accession NM_078476) is another VGAM1185 host target gene. BTN2A1 BINDING SITE is HOST TARGET binding site found in the 3' untranslated region of mRNA encoded by BTN2A1, corresponding to a HOST TARGET binding site such as BINDING SITE I, BINDING SITE II or BINDING SITE III. Table 2 illustrates the complementarity of the nucleotide sequences of BTN2A1 BINDING SITE, designated SEQ ID:27803, to the nucleotide sequence of VGAM1185 RNA, herein designated VGAM RNA, also designated SEQ ID:3896.

Another function of VGAM1185 is therefore inhibition of Butyrophilin, Subfamily 2, Member A1 (BTN2A1, Accession NM_078476). Accordingly, utilities of VGAM1185 include diagnosis, prevention and treatment of diseases and clinical conditions associated with BTN2A1. Chloride Intracellular Channel 4 (CLIC4, Accession NM_013943) is another VGAM1185 host target gene. CLIC4 BINDING SITE is HOST TARGET binding site found in the 3' untranslated region of mRNA encoded by CLIC4, corresponding to a HOST TARGET binding site such as BINDING SITE I, BINDING SITE II or BINDING SITE III. Table 2 illustrates the complementarity of the nucleotide sequences of CLIC4 BINDING SITE, designated SEQ ID:15127, to the nucleotide sequence of VGAM1185 RNA, herein designated VGAM RNA, also designated SEQ ID:3896.

Another function of VGAM1185 is therefore inhibition of Chloride Intracellular Channel 4 (CLIC4, Accession NM_013943). Accordingly, utilities of VGAM1185 include diagnosis, prevention and treatment of diseases and clinical conditions associated with CLIC4. FLJ12875 (Accession NM_024544) is another VGAM1185 host target gene. FLJ12875 BINDING SITE is HOST TARGET binding site found in the 3' untranslated region of mRNA encoded by FLJ12875, corresponding to a HOST TARGET binding site such as BINDING SITE I, BINDING SITE II or BINDING SITE III. Table 2 illustrates the complementarity of the nucleotide sequences of FLJ12875 BINDING SITE, designated SEQ ID:23755, to the nucleotide sequence of VGAM1185 RNA, herein designated VGAM RNA, also designated SEQ ID:3896.

Another function of VGAM1185 is therefore inhibition of FLJ12875 (Accession NM_024544). Accordingly, utilities of VGAM1185 include diagnosis, prevention and treatment of diseases and clinical conditions associated with FLJ12875. KIAA1052 (Accession NM_014956) is another VGAM1185 host target gene. KIAA1052 BINDING SITE is HOST TARGET binding site found in the 3' untranslated region of mRNA encoded by KIAA1052, corresponding to a HOST TARGET binding site such as BINDING SITE I, BINDING SITE II or BINDING SITE III. Table 2 illustrates the complementarity of the nucleotide sequences of KIAA1052 BINDING SITE, designated SEQ ID:17312, to the nucleotide sequence of VGAM1185 RNA, herein designated VGAM RNA, also designated SEQ ID:3896.

Another function of VGAM1185 is therefore inhibition of KIAA1052 (Accession NM_014956). Accordingly, utilities of VGAM1185 include diagnosis, prevention and treatment of diseases and clinical conditions associated with KIAA1052. Trans-golgi Network Protein 2 (TGOLN2, Accession XM_034215) is another VGAM1185 host target gene. TGOLN2 BINDING SITE is HOST TARGET binding site found in the 3' untranslated region of mRNA encoded by TGOLN2, corresponding to a HOST TARGET binding site such as BINDING SITE I, BINDING SITE II or BINDING SITE III. Table 2 illustrates the complementarity of the nucleotide sequences of TGOLN2 BINDING SITE, designated SEQ ID:32026, to the nucleotide sequence of VGAM1185 RNA, herein designated VGAM RNA, also designated SEQ ID:3896.

Another function of VGAM1185 is therefore inhibition of Trans-golgi Network Protein 2 (TGOLN2, Accession XM_034215). Accordingly, utilities of VGAM1185 include diagnosis, prevention and treatment of diseases and clinical conditions associated with TGOLN2. LOC113763 (Accession NM_138434) is another VGAM1185 host target gene. LOC113763 BINDING SITE is HOST TARGET binding site found in the 3' untranslated region of mRNA encoded by LOC113763, corresponding to a HOST TARGET binding site such as BINDING SITE I, BINDING SITE II or BINDING SITE III. Table 2 illustrates the complementarity of the nucleotide sequences of LOC113763 BINDING SITE, designated SEQ ID:28801, to the nucleotide sequence of VGAM1185 RNA, herein designated VGAM RNA, also designated SEQ ID:3896.

Another function of VGAM1185 is therefore inhibition of LOC113763 (Accession NM_138434). Accordingly, utilities of VGAM1185 include diagnosis, prevention and treatment of diseases and clinical conditions associated with LOC113763. LOC116113 (Accession XM_166413) is another VGAM1185 host target gene. LOC116113 BINDING SITE is HOST TARGET binding site found in the 3' untranslated region of mRNA encoded by LOC116113, corresponding to a HOST TARGET binding site such as BINDING SITE I, BINDING SITE II or BINDING SITE III. Table 2 illustrates the complementarity of the nucleotide sequences of LOC116113 BINDING SITE, designated SEQ ID:44286, to the nucleotide sequence of VGAM1185 RNA, herein designated VGAM RNA, also designated SEQ ID:3896.

Another function of VGAM1185 is therefore inhibition of LOC116113 (Accession XM_166413). Accordingly, utilities of VGAM1185 include diagnosis, prevention and treatment of diseases and clinical conditions associated with LOC116113. LOC124842 (Accession XM_064333) is another VGAM1185 host target gene. LOC124842 BINDING SITE is HOST TARGET binding site found in the 3' untranslated region of mRNA encoded by LOC124842, corresponding to a HOST TARGET binding site such as BINDING SITE I, BINDING SITE II or BINDING SITE III. Table 2 illustrates the complementarity of the nucleotide sequences of LOC124842 BINDING SITE, designated SEQ ID:37262, to the nucleotide sequence of VGAM1185 RNA, herein designated VGAM RNA, also designated SEQ ID:3896.

Another function of VGAM1185 is therefore inhibition of LOC124842 (Accession XM_064333). Accordingly, utilities of VGAM1185 include diagnosis, prevention and treatment of diseases and clinical conditions associated with LOC124842. LOC149271 (Accession XM_086475) is another VGAM1185 host target gene. LOC149271 BINDING SITE is HOST TARGET binding site found in the 5' untranslated region of mRNA encoded by LOC149271, corresponding to a HOST TARGET binding site such as BINDING SITE I, BINDING SITE II or BINDING SITE III. Table 2 illustrates the complementarity of the nucleotide sequences of LOC149271 BINDING SITE, designated SEQ ID:38679, to the nucleotide sequence of VGAM1185 RNA, herein designated VGAM RNA, also designated SEQ ID:3896.

Another function of VGAM1185 is therefore inhibition of LOC149271 (Accession XM_086475). Accordingly, utilities of VGAM1185 include diagnosis, prevention and treatment of diseases and clinical conditions associated with LOC149271. LOC150271 (Accession XM_097859) is another VGAM1185 host target gene. LOC150271 BINDING SITE is HOST TARGET binding site found in the 3' untranslated region of mRNA encoded by LOC150271, corresponding to a HOST TARGET binding site such as BINDING SITE I, BINDING SITE II or BINDING SITE III. Table 2 illustrates the complementarity of the nucleotide sequences of LOC150271 BINDING SITE, designated SEQ ID:41167, to the nucleotide sequence of VGAM1185 RNA, herein designated VGAM RNA, also designated SEQ ID:3896.

Another function of VGAM1185 is therefore inhibition of LOC150271 (Accession XM_097859). Accordingly, utilities of VGAM1185 include diagnosis, prevention and treatment of diseases and clinical conditions associated with LOC150271. LOC152573 (Accession XM_087488) is another VGAM1185 host target gene. LOC152573 BINDING SITE is HOST TARGET binding site found in the 3' untranslated region of mRNA encoded by LOC152573, corresponding to a HOST TARGET binding site such as BINDING SITE I, BINDING SITE II or BINDING SITE III. Table 2 illustrates the complementarity of the nucleotide sequences of LOC152573 BINDING SITE, designated SEQ ID:39287, to the nucleotide sequence of VGAM1185 RNA, herein designated VGAM RNA, also designated SEQ ID:3896.

Another function of VGAM1185 is therefore inhibition of LOC152573 (Accession XM_087488). Accordingly, utilities of VGAM1185 include diagnosis, prevention and treatment of diseases and clinical conditions associated with LOC152573. LOC158158 (Accession XM_088494) is another VGAM1185 host target gene. LOC158158 BINDING SITE is HOST TARGET binding site found in the 5' untranslated region of mRNA encoded by LOC158158, corresponding to a HOST TARGET binding site such as BINDING SITE I, BINDING SITE II or BINDING SITE III. Table 2 illustrates the complementarity of the nucleotide sequences of LOC158158 BINDING SITE, designated SEQ ID:39734, to the nucleotide sequence of VGAM1185 RNA, herein designated VGAM RNA, also designated SEQ ID:3896.

Another function of VGAM1185 is therefore inhibition of LOC158158 (Accession XM_088494). Accordingly, utilities of VGAM1185 include diagnosis, prevention and treatment of diseases and clinical conditions associated with LOC158158. LOC200860 (Accession XM_117289) is another VGAM1185 host target gene. LOC200860 BINDING SITE is HOST TARGET binding site found in the 3' untranslated region of mRNA encoded by LOC200860, corresponding to a HOST TARGET binding site such as BINDING SITE I, BINDING SITE II or BINDING SITE III. Table 2 illustrates the complementarity of the nucleotide sequences of LOC200860 BINDING SITE, designated SEQ ID:43355, to the nucleotide sequence of VGAM1185 RNA, herein designated VGAM RNA, also designated SEQ ID:3896.

Another function of VGAM1185 is therefore inhibition of LOC200860 (Accession XM_117289). Accordingly, utilities of VGAM1185 include diagnosis, prevention and treatment of diseases and clinical conditions associated with LOC200860. FIG. 1 further provides a conceptual description of a novel bioinformatically detected viral gene of the present invention, referred to here as Viral Genomic Address Messenger 1186 (VGAM1186) viral gene, which modulates expression of respective host target genes thereof, the function and utility of which host target genes is known in the art.

VGAM1186 is a novel bioinformatically detected regulatory, non protein coding, viral micro RNA (miRNA) gene. The method by which VGAM1186 was detected is described hereinabove with reference to FIGS. 1-8.

VGAM1186 gene, herein designated VGAM GENE, is a viral gene contained in the genome of Human Adenovirus C. VGAM1186 host target gene, herein designated VGAM HOST TARGET GENE, is a human gene contained in the human genome.

VGAM1186 gene encodes a VGAM1186 precursor RNA, herein designated VGAM PRECURSOR RNA. Similar to other miRNA genes, and unlike most ordinary genes, VGAM1186 precursor RNA does not encode a protein. A nucleotide sequence identical or highly similar to the nucleotide sequence of VGAM1186 precursor RNA is designated SEQ ID:1172, and is provided hereinbelow with reference to the sequence listing part. Nucleotide sequence SEQ ID:1172 is located at position 30647 relative to the genome of Human Adenovirus C.

VGAM1186 precursor RNA folds onto itself, forming VGAM1186 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1186 folded precursor RNA into VGAM1186 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM1186 RNA is designated SEQ ID:3897, and is provided hereinbelow with reference to the sequence listing part.

VGAM1186 host target gene, herein designated VGAM HOST TARGET GENE, encodes a corresponding messenger RNA, VGAM1186 host target RNA, herein designated VGAM HOST TARGET RNA. VGAM1186 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1186 RNA, herein designated VGAM RNA, binds complementarily to one or more host target binding sites located in untranslated regions of VGAM1186 host target RNA, herein designated VGAM HOST TARGET RNA. This complementary binding is due to the fact that the nucleotide sequence of VGAM1186 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1186 RNA, herein designated VGAM RNA, may have a different number of host target binding sites in untranslated regions of a VGAM1186 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1186 RNA, herein designated VGAM RNA, to host target binding sites on VGAM1186 host target RNA, herein designated VGAM HOST TARGET RNA, such as BINDING SITE I, BINDING SITE II and BINDING SITE III, inhibits translation of VGAM1186 host target RNA into VGAM1186 host target protein, herein designated VGAM HOST TARGET PROTEIN. VGAM host target protein is therefore outlined by a broken line.

It is appreciated that VGAM1186 host target gene, herein designated VGAM HOST TARGET GENE, in fact represents a plurality of VGAM1186 host target genes. The mRNA of each one of this plurality of VGAM1186 host target genes comprises one or more host target binding sites, each having a nucleotide sequence which is at least partly complementary to VGAM1186 RNA, herein designated VGAM RNA, and which when bound by VGAM1186 RNA causes inhibition of translation of respective one or more VGAM1186 host target proteins.

It is further appreciated by one skilled in the art that the mode of translational inhibition illustrated by FIG. 1 with specific reference to translational inhibition exerted by VGAM1186 gene, herein designated VGAM GENE, on one or more VGAM1186 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1186 is inhibition of expression of host target genes, as part of a novel viral mechanism of attacking a host. Accordingly, utilities of VGAM1186 include diagnosis, prevention and treatment of viral infection by Human Adenovirus C. Specific functions, and accordingly utilities, of VGAM1186 correlate with, and may be deduced from, the identity of the host target genes which VGAM1186 binds and inhibits, and the function of these host target genes, as elaborated hereinbelow.

Nucleotide sequences of the VGAM1186 precursor RNA, herein designated VGAM PRECURSOR RNA, and of the 'diced' VGAM1186 RNA, herein designated VGAM RNA, and a schematic representation of the secondary folding of VGAM1186 folded precursor RNA, herein designated VGAM FOLDED PRECURSOR RNA, of VGAM1186 are further described hereinbelow with reference to Table 1.

Nucleotide sequences of host target binding sites, such as BINDING SITE-I, BINDING SITE-II and BINDING SITE-III of FIG. 1, found on VGAM1186 host target RNA, and schematic representation of the complementarity of each of these host target binding sites to VGAM1186 RNA, herein designated VGAM RNA, are described hereinbelow with reference to Table 2.

As mentioned hereinabove with reference to FIG. 1, a function of VGAM1186 gene, herein designated VGAM is inhibition of expression of VGAM1186 target genes. It is appreciated that specific functions, and accordingly utilities, of VGAM1186 correlate with, and may be deduced from, the identity of the target genes which VGAM1186 binds and inhibits, and the function of these target genes, as elaborated hereinbelow.

Inositol Polyphosphate-5-phosphatase, 145 kDa (INPP5D, Accession XM_096169) is a VGAM1186 host target gene. INPP5D BINDING SITE is HOST TARGET binding site found in the 3' untranslated region of mRNA encoded by INPP5D, corresponding to a HOST TARGET binding site such as BINDING SITE I, BINDING SITE II or BINDING SITE III. Table 2 illustrates the complementarity of the nucleotide sequences of INPP5D BINDING SITE, designated SEQ ID:40307, to the nucleotide sequence of VGAM1186 RNA, herein designated VGAM RNA, also designated SEQ ID:3897.

A function of VGAM1186 is therefore inhibition of Inositol Polyphosphate-5-phosphatase, 145 kDa (INPP5D, Accession XM_096169), a gene which hydrolyzes Ins (1,3,4,5)P4 and PtdIns (3,4,5)P3; contains an SH2-domain. Accordingly, utilities of VGAM1186 include diagnosis, prevention and treatment of diseases and clinical conditions associated with INPP5D. The function of INPP5D and its association with various diseases and clinical conditions, has been established by previous studies, as described hereinabove with reference to VGAM64. Mastermind-like 1 (Drosophila) (MAML1, Accession NM_014757) is another VGAM1186 host target gene. MAML1 BINDING SITE is HOST TARGET binding site found in the 3' untranslated region of mRNA encoded by MAML1, corresponding to a HOST TARGET binding site such as BINDING SITE I, BINDING SITE II or BINDING SITE III. Table 2 illustrates the complementarity of the nucleotide sequences of MAML1 BINDING SITE, designated SEQ ID:16500, to the nucleotide sequence of VGAM1186 RNA, herein designated VGAM RNA, also designated SEQ ID:3897.

Another function of VGAM1186 is therefore inhibition of Mastermind-like 1 (Drosophila) (MAML1, Accession NM_014757), a gene which MAML1 functions as a transcriptional coactivator for Notch signaling. Accordingly, utilities of VGAM1186 include diagnosis, prevention and treatment of diseases and clinical conditions associated with MAML1. The function of MAML1 and its association with various diseases and clinical conditions, has been established by previous studies, as described hereinabove with reference to VGAM556. Transcription Factor Dp-1 (TFDP1, Accession NM_007111) is another VGAM1186 host target gene. TFDP1 BINDING SITE is HOST TARGET binding site found in the 3' untranslated region of mRNA encoded by TFDP1, corresponding to a HOST TARGET binding site such as BINDING SITE I, BINDING SITE II or BINDING SITE III. Table 2 illustrates the complementarity of the nucleotide sequences of TFDP1 BINDING SITE, designated SEQ ID:13978, to the nucleotide sequence of VGAM1186 RNA, herein designated VGAM RNA, also designated SEQ ID:3897.

Another function of VGAM1186 is therefore inhibition of Transcription Factor Dp-1 (TFDP1, Accession NM_007111). Accordingly, utilities of VGAM1186 include diagnosis, prevention and treatment of diseases and clinical conditions associated with TFDP1. BRAG (Accession NM_014863) is another VGAM1186 host target gene. BRAG BINDING SITE is HOST TARGET binding site found in the 3' untranslated region of mRNA encoded by BRAG, corresponding to a HOST TARGET binding site such as BINDING SITE I, BINDING SITE II or BINDING SITE III. Table 2 illustrates the complementarity of the nucleotide sequences of BRAG BINDING SITE, designated SEQ ID:16941, to the nucleotide sequence of VGAM1186 RNA, herein designated VGAM RNA, also designated SEQ ID:3897.

Another function of VGAM1186 is therefore inhibition of BRAG (Accession NM_014863). Accordingly, utilities of VGAM1186 include diagnosis, prevention and treatment of diseases and clinical conditions associated with BRAG. KIAA0820 (Accession XM_044463) is another VGAM1186 host target gene. KIAA0820 BINDING SITE is HOST TARGET binding site found in the 3" untranslated region of mRNA encoded by KIAA0820, corresponding to a HOST TARGET binding site such as BINDING SITE I, BINDING SITE II or BINDING SITE III. Table 2 illustrates the complementarity of the nucleotide sequences of KIAA0820 BINDING SITE, designated SEQ ID:34221, to the nucleotide sequence of VGAM1186 RNA, herein designated VGAM RNA, also designated SEQ ID:3897.

Another function of VGAM1186 is therefore inhibition of KIAA0820 (Accession XM_044463). Accordingly, utilities of VGAM1186 include diagnosis, prevention and treatment of diseases and clinical conditions associated with KIAA0820. KIAA0984 (Accession XM_037557) is another VGAM1186 host target gene. KIAA0984 BINDING SITE is HOST TARGET binding site found in the 3' untranslated region of mRNA encoded by KIAA0984, corresponding to a HOST TARGET binding site such as BINDING SITE I, BINDING SITE II or BINDING SITE III. Table 2 illustrates the complementarity of the nucleotide sequences of KIAA0984 BINDING SITE, designated SEQ ID:32646, to the nucleotide sequence of VGAM1186 RNA, herein designated VGAM RNA, also designated SEQ ID:3897.

Another function of VGAM1186 is therefore inhibition of KIAA0984 (Accession XM_037557). Accordingly, utilities of VGAM1186 include diagnosis, prevention and treatment of diseases and clinical conditions associated with KIAA0984. KIAA1858 (Accession XM_040592) is another VGAM1186 host target gene. KIAA1858 BINDING SITE is HOST TARGET binding site found in the 3' untranslated region of mRNA encoded by KIAA1858, corresponding to a HOST TARGET binding site such as BINDING SITE I, BINDING SITE II or BINDING SITE III. Table 2 illustrates the complementarity of the nucleotide sequences of KIAA1858 BINDING SITE, designated SEQ ID:33331, to the nucleotide sequence of VGAM1186 RNA, herein designated VGAM RNA, also designated SEQ ID:3897.

Another function of VGAM1186 is therefore inhibition of KIAA1858 (Accession XM_040592). Accordingly, utilities of VGAM1186 include diagnosis, prevention and treatment of diseases and clinical conditions associated with KIAA1858. Proteasome (prosome, macropain) Inhibitor Subunit 1 (PI31) (PSMF1, Accession NM_006814) is another VGAM1186 host target gene. PSMF1 BINDING SITE is HOST TARGET binding site found in the 3' untranslated region of mRNA encoded by PSMF1, corresponding to a HOST TARGET binding site such as BINDING SITE I, BINDING SITE II or BINDING SITE III. Table 2 illustrates the complementarity of the nucleotide sequences of PSMF1 BINDING SITE, designated SEQ ID:13688, to the nucleotide sequence of VGAM1186 RNA, herein designated VGAM RNA, also designated SEQ ID:3897.

Another function of VGAM1186 is therefore inhibition of Proteasome (prosome, macropain) Inhibitor Subunit 1 (PI31) (PSMF1, Accession NM_006814). Accordingly, utilities of VGAM1186 include diagnosis, prevention and treatment of diseases and clinical conditions associated with PSMF1. LOC115129 (Accession XM_055292) is another VGAM1186 host target gene. LOC115129 BINDING SITE is HOST TARGET binding site found in the 5' untranslated region of mRNA encoded by LOC115129, corresponding to a HOST TARGET binding site such as BINDING SITE I, BINDING SITE II or BINDING SITE III. Table 2 illustrates the complementarity of the nucleotide sequences of LOC115129 BINDING SITE, designated SEQ ID:36256, to the nucleotide sequence of VGAM1186 RNA, herein designated VGAM RNA, also designated SEQ ID:3897.

Another function of VGAM1186 is therefore inhibition of LOC115129 (Accession XM_055292). Accordingly, utilities of VGAM1186 include diagnosis, prevention and treatment of diseases and clinical conditions associated with LOC115129. LOC255045 (Accession XM_171243) is another VGAM1186 host target gene. LOC255045 BINDING SITE is HOST TARGET binding site found in the 3' untranslated region of mRNA encoded by LOC255045, corresponding to a HOST TARGET binding site such as BINDING SITE I, BINDING SITE II or BINDING SITE III. Table 2 illustrates the complementarity of the nucleotide sequences of LOC255045 BINDING SITE, designated SEQ ID:46032, to the nucleotide sequence of VGAM1186 RNA, herein designated VGAM RNA, also designated SEQ ID:3897.

Another function of VGAM1186 is therefore inhibition of LOC255045 (Accession XM_171243). Accordingly, utilities of VGAM1186 include diagnosis, prevention and treatment of diseases and clinical conditions associated with LOC255045. FIG. 1 further provides a conceptual description of a novel bioinformatically detected viral gene of the present invention, referred to here as Viral Genomic Address Messenger 1187 (VGAM1187) viral gene, which modulates expression of respective host target genes thereof, the function and utility of which host target genes is known in the art.

VGAM1187 is a novel bioinformatically detected regulatory, non protein coding, viral micro RNA (miRNA) gene. The method by which VGAM1187 was detected is described hereinabove with reference to FIGS. 1-8.

VGAM1187 gene, herein designated VGAM GENE, is a viral gene contained in the genome of Human Adenovirus C. VGAM1187 host target gene, herein designated VGAM HOST TARGET GENE, is a human gene contained in the human genome.

VGAM1187 gene encodes a VGAM1187 precursor RNA, herein designated VGAM PRECURSOR RNA. Similar to other miRNA genes, and unlike most ordinary genes, VGAM1187 precursor RNA does not encode a protein. A nucleotide sequence identical or highly similar to the nucleotide sequence of VGAM1187 precursor RNA is designated SEQ ID:1173, and is provided hereinbelow with reference to the sequence listing part. Nucleotide sequence SEQ ID:1173 is located at position 26479 relative to the genome of Human Adenovirus C.

VGAM1187 precursor RNA folds onto itself, forming VGAM1187 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1187 folded precursor RNA into VGAM1187 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1187 RNA is designated SEQ ID:3898, and is provided hereinbelow with reference to the sequence listing part.

VGAM1187 host target gene, herein designated VGAM HOST TARGET GENE, encodes a corresponding messenger RNA, VGAM1187 host target RNA, herein designated VGAM HOST TARGET RNA. VGAM1187 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1187 RNA, herein designated VGAM RNA, binds complementarily to one or more host target binding sites located in untranslated regions of VGAM1187 host target RNA, herein designated VGAM HOST TARGET RNA. This complementary binding is due to the fact that the nucleotide sequence of VGAM1187 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1187 RNA, herein designated VGAM RNA, may have a different number of host target binding sites in untranslated regions of a VGAM1187 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1187 RNA, herein designated VGAM RNA, to host target binding sites on VGAM1187 host target RNA, herein designated VGAM HOST TARGET RNA, such as BINDING SITE I, BINDING SITE II and BINDING SITE III, inhibits translation of VGAM1187 host target RNA into VGAM1187 host target protein, herein designated VGAM HOST TARGET PROTEIN. VGAM host target protein is therefore outlined by a broken line.

It is appreciated that VGAM1187 host target gene, herein designated VGAM HOST TARGET GENE, in fact represents a plurality of VGAM1187 host target genes. The mRNA of each one of this plurality of VGAM1187 host target genes comprises one or more host target binding sites, each having a nucleotide sequence which is at least partly complementary to VGAM1187 RNA, herein designated VGAM RNA, and which when bound by VGAM1187 RNA causes inhibition of translation of respective one or more VGAM1187 host target proteins.

It is further appreciated by one skilled in the art that the mode of translational inhibition illustrated by FIG. 1 with specific reference to translational inhibition exerted by VGAM1187 gene, herein designated VGAM GENE, on one or more VGAM1187 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1187 is inhibition of expression of host target genes, as part of a novel viral mechanism of attacking a host. Accordingly, utilities of VGAM1187 include diagnosis, prevention and treatment of viral infection by Human Adenovirus C. Specific functions, and accordingly utilities, of VGAM1187 correlate with, and may be deduced from, the identity of the host target genes which VGAM1187 binds and inhibits, and the function of these host target genes, as elaborated hereinbelow.

Nucleotide sequences of the VGAM1187 precursor RNA, herein designated VGAM PRECURSOR RNA, and of the 'diced' VGAM1187 RNA, herein designated VGAM RNA, and a schematic representation of the secondary folding of VGAM1187 folded precursor RNA, herein designated VGAM FOLDED PRECURSOR RNA, of VGAM1187 are further described hereinbelow with reference to Table 1.

Nucleotide sequences of host target binding sites, such as BINDING SITE-I, BINDING SITE-II and BINDING SITE-III of FIG. 1, found on VGAM1187 host target RNA, and schematic representation of the complementarity of each of these host target binding sites to VGAM1187 RNA, herein designated VGAM RNA, are described hereinbelow with reference to Table 2.

As mentioned hereinabove with reference to FIG. 1, a function of VGAM1187 gene, herein designated VGAM is inhibition of expression of VGAM1187 target genes. It is appreciated that specific functions, and accordingly utilities, of VGAM1187 correlate with, and may be deduced from, the identity of the target genes which VGAM1187 binds and inhibits, and the function of these target genes, as elaborated hereinbelow.

Calcium Channel, Voltage-dependent, L Type, Alpha 1C Subunit (CACNA1C, Accession NM_000719) is a VGAM1187 host target gene. CACNA1C BINDING SITE is HOST TARGET binding site found in the 3' untranslated region of mRNA encoded by CACNA1C, corresponding to a HOST TARGET binding site such as BINDING SITE I, BINDING SITE II or BINDING SITE III. Table 2 illustrates the complementarity of the nucleotide sequences of CACNA1C BINDING SITE, designated SEQ ID:6380, to the nucleotide sequence of VGAM1187 RNA, herein designated VGAM RNA, also designated SEQ ID:3898.

A function of VGAM1187 is therefore inhibition of Calcium Channel, Voltage-dependent, L Type, Alpha 1C Subunit (CACNA1C, Accession NM_000719), a gene which is alpha-1 subunit of DHP-sensitive calcium channels from cardiac muscle and the brain. Accordingly, utilities of VGAM1187 include diagnosis, prevention and treatment of diseases and clinical conditions associated with CACNA1C. The function of CACNA1C and its association with various diseases and clinical conditions, has been established by previous studies, as described hereinabove with reference to VGAM182. Calcium Channel, Voltage-dependent, Gamma Subunit 8 (CACNG8, Accession XM_050231) is another VGAM1187 host target gene. CACNG8 BINDING SITE is HOST TARGET binding site found in the 5' untranslated region of mRNA encoded by CACNG8, corresponding to a HOST TARGET binding site such as BINDING SITE I, BINDING SITE II or BINDING SITE III. Table 2 illustrates the complementarity of the nucleotide sequences of CACNG8 BINDING SITE, designated SEQ ID:35595, to the nucleotide sequence of VGAM1187 RNA, herein designated VGAM RNA, also designated SEQ ID:3898.

Another function of VGAM1187 is therefore inhibition of Calcium Channel, Voltage-dependent, Gamma Subunit 8 (CACNG8, Accession XM_050231), a gene which may stabilize the calcium channel in an inactivated (closed) state. Accordingly, utilities of VGAM1187 include diagnosis, prevention and treatment of diseases and clinical conditions associated with CACNG8. The function of CACNG8 has been established by previous studies. Voltage-dependent calcium channels couple membrane depolarization in a number of cellular processes. These activities are regulated by distinct channels composed of the pore-forming alpha-1 subunit (e.g., CACNA1D; 114206) and the modulatory beta (e.g., CACNB1; 114207), alpha-2/delta (e.g., CACNA2D1; 114204), and gamma (e.g., CACNG1; 114209) subunits. By database searching and analysis of BAC clones from chromosome 19 near the PRKCG gene (OMIM Ref. No. 176980), Burgess et al. (2001) identified cDNAs encoding CACNG6 (OMIM Ref. No. 606898), CACNG7 (OMIM Ref. No. 606899), and CACNG8. The deduced 414-amino acid CACNG8 protein contains 4 transmembrane segments, a highly conserved N-glycosylation site in the first extracellular loop, and, in its C terminus, conserved phosphorylation sites and a consensus target for binding by PDZ domain proteins. Burgess et al. (2001) noted that CACNG8 may contain additional N-terminal amino acids. RT-PCR analysis of 24 adult and fetal tissues detected highest expression of CACNG8 in adult and fetal brain, followed by testis, spinal cord, and mammary.

Full details of the abovementioned studies are described in the following publications, the disclosure of which are hereby incorporated by reference:

Burgess, D. L.; Gefrides, L. A.; Foreman, P. J.; Noebels, J. L.: A cluster of three novel Ca (2+) channel gamma subunit genes on chromosome 19q13.4: evolution and expression profile of the gamma subunit gene family. Genomics 71: 339-350, 2001; and Chu, P.-J.; Robertson, H. M.; Best, P. M.: Calcium channel gamma subunits provide insights into the evolution of this gene family. Gene 280:37-48, 2001.

Further studies establishing the function and utilities of CACNG8 are found in John Hopkins OMIM database record ID 606900, and in sited publications numbered 4526-4527 listed in the bibliography section hereinbelow, which are also hereby incorporated by reference. EGF-like-domain, Multiple 3 (EGFL3, Accession XM_031401) is another VGAM1187 host target gene. EGFL3 BINDING SITE is HOST TARGET binding site found in the 5' untranslated region of mRNA encoded by EGFL3, corresponding to a HOST TARGET binding site such as BINDING SITE I, BINDING SITE II or BINDING SITE III. Table 2 illustrates the complementarity of the nucleotide sequences of EGFL3 BINDING SITE, designated SEQ ID:31374, to the nucleotide sequence of VGAM1187 RNA, herein designated VGAM RNA, also designated SEQ ID:3898.

Another function of VGAM1187 is therefore inhibition of EGF-like-domain, Multiple 3 (EGFL3, Accession XM_031401). Accordingly, utilities of VGAM1187 include diagnosis, prevention and treatment of diseases and clinical conditions associated with EGFL3. Fibroblast Growth Factor Receptor 1 (fms-related tyrosine kinase 2, Pfeiffer syndrome) (FGFR1, Accession NM_015850) is another VGAM1187 host target gene. FGFR1 BINDING SITE1 through FGFR1 BINDING SITE3 are HOST TARGET binding sites found in untranslated regions of mRNA encoded by FGFR1, corresponding to HOST TARGET binding sites such as BINDING SITE I, BINDING SITE II or BINDING SITE III. Table 2 illustrates the complementarity of the nucleotide sequences of FGFR1 BINDING SITE1 through FGFR1 BINDING SITE3, designated SEQ ID:17976, SEQ ID:23370 and SEQ ID:6205 respectively, to the nucleotide sequence of VGAM1187 RNA, herein designated VGAM RNA, also designated SEQ ID:3898.

Another function of VGAM1187 is therefore inhibition of Fibroblast Growth Factor Receptor 1 (fms-related tyrosine kinase 2, Pfeiffer syndrome) (FGFR1, Accession NM_015850). Accordingly, utilities of VGAM1187 include diagnosis, prevention and treatment of diseases and clinical conditions associated with FGFR1. Glutamate Receptor, Metabotropic 7 (GRM7, Accession NM_000844) is another VGAM1187 host target gene. GRM7 BINDING SITE is HOST TARGET binding site found in the 5' untranslated region of mRNA encoded by GRM7, corresponding to a HOST TARGET binding site such as BINDING SITE I, BINDING SITE II or BINDING SITE III. Table 2 illustrates the complementarity of the nucleotide sequences of GRM7 BINDING SITE, designated SEQ ID:6517, to the nucleotide sequence of VGAM1187 RNA, herein designated VGAM RNA, also designated SEQ ID:3898.

Another function of VGAM1187 is therefore inhibition of Glutamate Receptor, Metabotropic 7 (GRM7, Accession NM_000844), a gene which is mediated by a g-protein that inhibits adenylate cyclase activity. Accordingly, utilities of VGAM1187 include diagnosis, prevention and treatment of diseases and clinical conditions associated with GRM7. The function of GRM7 and its association with various diseases and clinical conditions, has been established by previous studies, as described hereinabove with reference to VGAM746. Microtubule-associated Protein, RP/EB Family, Member 3 (MAPRE3, Accession NM_012326) is another VGAM1187 host target gene. MAPRE3 BINDING SITE is HOST TARGET binding site found in the 3' untranslated region of mRNA encoded by MAPRE3, corresponding to a HOST TARGET binding site such as BINDING SITE I, BINDING SITE II or BINDING SITE III. Table 2 illustrates the complementarity of the nucleotide sequences of MAPRE3 BINDING SITE, designated SEQ ID:14711, to the nucleotide sequence of VGAM1187 RNA, herein designated VGAM RNA, also designated SEQ ID:3898.

Another function of VGAM1187 is therefore inhibition of Microtubule-associated Protein, RP/EB Family, Member 3 (MAPRE3, Accession NM_012326), a gene which interact with cytoplasmic microtubules, and with the adenomatous polyposis coli. Accordingly, utilities of VGAM1187 include diagnosis, prevention and treatment of diseases and clinical conditions associated with MAPRE3. The function of MAPRE3 and its association with various diseases and clinical conditions, has been established by previous studies, as described hereinabove with reference to VGAM340. Mannose-P-dolichol Utilization Defect 1 (MPDU1, Accession NM_004870) is another VGAM1187 host target gene. MPDU1 BINDING SITE is HOST TARGET binding site found in the 3' untranslated region of mRNA encoded by MPDU1, corresponding to a HOST TARGET binding site such as BINDING SITE I, BINDING SITE II or BINDING SITE III. Table 2 illustrates the complementarity of the nucleotide sequences of MPDU1 BINDING SITE, designated SEQ ID:11297, to the nucleotide sequence of VGAM1187 RNA, herein designated VGAM RNA, also designated SEQ ID:3898.

Another function of VGAM1187 is therefore inhibition of Mannose-P-dolichol Utilization Defect 1 (MPDU1, Accession NM_004870), a gene which corrects the Lec15 mutant phenotype. Accordingly, utilities of VGAM1187 include diagnosis, prevention and treatment of diseases and clinical conditions associated with MPDU1. The function of MPDU1 has been established by previous studies. MPD synthase (DPM1; 603503) catalyzes the synthesis of mannose-P-dolichol (MPD), an essential sugar donor for glycoconjugates and an essential substrate for synthesis of glycosylphosphatidylinositols (GPIs). The Chinese hamster ovary (CHO) Lec15 and Lec35 mutant cells are defective in synthesis and utilization, respectively, of MPD. Using an expression cloning strategy, Ware and Lehrman (1996) isolated SL15 (suppressor of Lec15), a CHO cDNA that efficiently corrected the Lec15 phenotype. The SL15 cDNA also suppressed the Lec35 mutation. Sequence analysis indicated that SL15 encodes a transmembrane protein with cytosolic C and N termini. There was no significant sequence similarity between SL15 and the S. cerevisiae MPD synthase, leading the authors to suggest that SL15 plays a distinct role in MPD synthesis. See also DPM2 (OMIM Ref. No. 603564). Mao et al. (1998) identified an umbilical cord blood CD34-positive cell cDNA encoding the human homolog of SL15. The predicted human protein contains 247 amino acids Full details of the abovementioned studies are described in the following publications, the disclosure of which are hereby incorporated by reference:

Mao, M.; Fu, G.; Wu, J.-S.; Zhang, Q.-H.; Zhou, J.; Kan, L.-X.; Huang, Q.-H.; He, K.-L.; Gu, B.-W.; Han, Z.-G.; Shen, Y.; Gu, J.; Yu, Y.-P.; Xu, S.-H.; Wang, Y.-X.; Chen, S.-J.; Chen, Z.: Identification of genes expressed in human CD34+ hematopoietic stem/progenitor cells by expressed sequence tags and efficient full-length cDNA cloning. Proc. Nat. Acad. Sci. 95:8175-8180, 1998; and Ware, F. E.; Lehrman, M. A.: Expression cloning of a novel suppressor of the Lec15 and Lec35 glycosylation mutations of Chinese hamster ovary cells. J. Biol. Chem. 271:13935-13938, 1996.

Further studies establishing the function and utilities of MPDU1 are found in John Hopkins OMIM database record ID 604041, and in sited publications numbered 8801 listed in the bibliography section hereinbelow, which are also hereby incorporated by reference. Neurexin 1 (NRXN1, Accession NM_138735) is another VGAM1187 host target gene. NRXN1 BINDING SITE is HOST TARGET binding site found in the 5' untranslated region of mRNA encoded by NRXN1, corresponding to a HOST TARGET binding site such as BINDING SITE I, BINDING SITE II or BINDING SITE III. Table 2 illustrates the complementarity of the nucleotide sequences of NRXN1 BINDING SITE, designated SEQ ID:28994, to the nucleotide sequence of VGAM1187 RNA, herein designated VGAM RNA, also designated SEQ ID:3898.

Another function of VGAM1187 is therefore inhibition of Neurexin 1 (NRXN1, Accession NM_138735), a gene which may be involved in cell recognition, cell adhesion, and mediate intracellular signaling. Accordingly, utilities of VGAM1187 include diagnosis, prevention and treatment of diseases and clinical conditions associated with NRXN1. The function of NRXN1 and its association with various diseases and clinical conditions, has been established by previous studies, as described hereinabove with reference to VGAM191. Plexin B2 (PLXNB2, Accession NM_012401) is another VGAM1187 host target gene. PLXNB2 BINDING SITE is HOST TARGET binding site found in the 3' untranslated region of mRNA encoded by PLXNB2, corresponding to a HOST TARGET binding site such as BINDING SITE I, BINDING SITE II or BINDING SITE III. Table 2 illustrates the complementarity of the nucleotide sequences of PLXNB2 BINDING SITE, designated SEQ ID:14776, to the nucleotide sequence of VGAM1187 RNA, herein designated VGAM RNA, also designated SEQ ID:3898.

Another function of VGAM1187 is therefore inhibition of Plexin B2 (PLXNB2, Accession NM_012401), a gene which is a novel member of the plexin family. Accordingly, utilities of VGAM1187 include diagnosis, prevention and treatment of diseases and clinical conditions associated with PLXNB2. The function of PLXNB2 and its association with various diseases and clinical conditions, has been established by previous studies, as described hereinabove with reference to VGAM87. Parathymosin (PTMS, Accession NM_002824) is another VGAM1187 host target gene. PTMS BINDING SITE is HOST TARGET binding site found in the 5' untranslated region of mRNA encoded by PTMS, corresponding to a HOST TARGET binding site such as BINDING SITE I, BINDING SITE II or BINDING SITE III. Table 2 illustrates the complementarity of the nucleotide sequences of PTMS BINDING SITE, designated SEQ ID:8695, to the nucleotide sequence of VGAM1187 RNA, herein designated VGAM RNA, also designated SEQ ID:3898.

Another function of VGAM1187 is therefore inhibition of Parathymosin (PTMS, Accession NM_002824), a gene which is involved in the regulation of cellular immunity. Accordingly, utilities of VGAM1187 include diagnosis, prevention and treatment of diseases and clinical conditions associated with PTMS. The function of PTMS and its association with various diseases and clinical conditions, has been established by previous studies, as described hereinabove with reference to VGAM200. V-ski Sarcoma Viral Oncogene Homolog (avian) (SKI, Accession NM_003036) is another VGAM1187 host target gene. SKI BINDING SITE is HOST TARGET binding site found in the 3' untranslated region of mRNA encoded by SKI, corresponding to a HOST TARGET binding site such as BINDING SITE I, BINDING SITE II or BINDING SITE III. Table 2 illustrates the complementarity of the nucleotide sequences of SKI BINDING SITE, designated SEQ ID:8987, to the nucleotide sequence of VGAM1187 RNA, herein designated VGAM RNA, also designated SEQ ID:3898.

Another function of VGAM1187 is therefore inhibition of V-ski Sarcoma Viral Oncogene Homolog (avian) (SKI, Accession NM_003036). Accordingly, utilities of VGAM1187 include diagnosis, prevention and treatment of diseases and clinical conditions associated with SKI. Sequestosome 1 (SQSTM1, Accession NM_003900) is another VGAM1187 host target gene. SQSTM1 BINDING SITE is HOST TARGET binding site found in the 3' untranslated region of mRNA encoded by SQSTM1, corresponding to a HOST TARGET binding site such as BINDING SITE I, BINDING SITE II or BINDING SITE III. Table 2 illustrates the complementarity of the nucleotide sequences of SQSTM1 BINDING SITE, designated SEQ ID:9989, to the nucleotide sequence of VGAM1187 RNA, herein designated VGAM RNA, also designated SEQ ID:3898.

Another function of VGAM1187 is therefore inhibition of Sequestosome 1 (SQSTM1, Accession NM_003900), a gene which binds SH2 domain of p56lck and ubiquitin, and it is associated with a serine/threonine kinase activity. Accordingly, utilities of VGAM1187 include diagnosis, prevention and treatment of diseases and clinical conditions associated with SQSTM1. The function of SQSTM1 and its association with various diseases and clinical conditions, has been established by previous studies, as described hereinabove with reference to VGAM824. TR2 (Accession XM_051264) is another VGAM1187 host target gene. TR2 BINDING SITE is HOST TARGET binding site found in the 5' untranslated region of mRNA encoded by TR2, corresponding to a HOST TARGET binding site such as BINDING SITE I, BINDING SITE II or BINDING SITE III. Table 2 illustrates the complementarity of the nucleotide sequences of TR2 BINDING SITE, designated SEQ ID:35794, to the nucleotide sequence of VGAM1187 RNA, herein designated VGAM RNA, also designated SEQ ID:3898.

Another function of VGAM1187 is therefore inhibition of TR2 (Accession XM_051264), a gene which maintains high levels of reduced glutathione in the cytosol (by similarity). Accordingly, utilities of VGAM1187 include diagnosis, prevention and treatment of diseases and clinical conditions associated with TR2. The function of TR2 and its association with various diseases and clinical conditions, has been established by previous studies, as described hereinabove with reference to VGAM125. Tyrosine 3-monooxygenase/tryptophan 5-monooxygenase Activation Protein, Gamma Polypeptide (YWHAG, Accession NM_012479) is another VGAM1187 host target gene. YWHAG BINDING SITE is HOST TARGET binding site found in the 3' untranslated region of mRNA encoded by YWHAG, corresponding to a HOST TARGET binding site such as BINDING SITE I, BINDING SITE II or BINDING SITE III. Table 2 illustrates the complementarity of the nucleotide sequences of YWHAG BINDING SITE, designated SEQ ID:14858, to the nucleotide sequence of VGAM1187 RNA, herein designated VGAM RNA, also designated SEQ ID:3898.

Another function of VGAM1187 is therefore inhibition of Tyrosine 3-monooxygenase/tryptophan 5-monooxygenase Activation Protein, Gamma Polypeptide (YWHAG, Accession NM_012479), a gene which mediates mitogenic signals of PDGF in vascular smooth muscle cells. Accordingly, utilities of VGAM1187 include diagnosis, prevention and treatment of diseases and clinical conditions associated with YWHAG. The function of YWHAG and its association with various diseases and clinical conditions, has been established by previous studies, as described hereinabove with reference to VGAM180. Cyclin E1 (CCNE1, Accession NM_001238) is another VGAM1187 host target gene. CCNE1 BINDING SITE is HOST TARGET binding site found in the 5' untranslated region of mRNA encoded by CCNE1, corresponding to a HOST TARGET binding site such as BINDING SITE I, BINDING SITE II or BINDING SITE III. Table 2 illustrates the complementarity of the nucleotide sequences of CCNE1 BINDING SITE, designated SEQ ID:6906, to the nucleotide sequence of VGAM1187 RNA, herein designated VGAM RNA, also designated SEQ ID:3898.

Another function of VGAM1187 is therefore inhibition of Cyclin E1 (CCNE1, Accession NM_001238). Accordingly, utilities of VGAM1187 include diagnosis, prevention and treatment of diseases and clinical conditions associated with CCNE1. CEP3 (Accession NM_006449) is another VGAM1187 host target gene. CEP3 BINDING SITE is HOST TARGET binding site found in the 5' untranslated region of mRNA encoded by CEP3, corresponding to a HOST TARGET binding site such as BINDING SITE I, BINDING SITE II or BINDING SITE III. Table 2 illustrates the complementarity of the nucleotide sequences of CEP3 BINDING SITE, designated SEQ ID:13156, to the nucleotide sequence of VGAM1187 RNA, herein designated VGAM RNA, also designated SEQ ID:3898.

Another function of VGAM1187 is therefore inhibition of CEP3 (Accession NM_006449). Accordingly, utilities of VGAM1187 include diagnosis, prevention and treatment of diseases and clinical conditions associated with CEP3. FLJ14525 (Accession NM_032800) is another VGAM1187 host target gene. FLJ14525 BINDING SITE is HOST TARGET binding site found in the 3' untranslated region of mRNA encoded by FLJ14525, corresponding to a HOST TARGET binding site such as BINDING SITE I, BINDING SITE II or BINDING SITE III. Table 2 illustrates the complementarity of the nucleotide sequences of FLJ14525 BINDING SITE, designated SEQ ID:26549, to the nucleotide sequence of VGAM1187 RNA, herein designated VGAM RNA, also designated SEQ ID:3898.

Another function of VGAM1187 is therefore inhibition of FLJ14525 (Accession NM_032800). Accordingly, utilities of VGAM1187 include diagnosis, prevention and treatment of diseases and clinical conditions associated with FLJ14525. FLJ20507 (Accession NM_017849) is another VGAM1187 host target gene. FLJ20507 BINDING SITE1 and FLJ20507 BINDING SITE2 are HOST TARGET binding sites found in untranslated regions of mRNA encoded by FLJ20507, corresponding to HOST TARGET binding sites such as BINDING SITE I, BINDING SITE II or BINDING SITE III. Table 2 illustrates the complementarity of the nucleotide sequences of FLJ20507 BINDING SITE1 and FLJ20507 BINDING SITE2, designated SEQ ID:19512 and SEQ ID:30220 respectively, to the nucleotide sequence of VGAM1187 RNA, herein designated VGAM RNA, also designated SEQ ID:3898.

Another function of VGAM1187 is therefore inhibition of FLJ20507 (Accession NM_017849). Accordingly, utilities of VGAM1187 include diagnosis, prevention and treatment of diseases and clinical conditions associated with FLJ20507. KIAA0669 (Accession NM_014779) is another VGAM1187 host target gene. KIAA0669 BINDING SITE is HOST TARGET binding site found in the 5' untranslated region of mRNA encoded by KIAA0669, corresponding to a HOST TARGET binding site such as BINDING SITE I, BINDING SITE II or BINDING SITE III. Table 2 illustrates the complementarity of the nucleotide sequences of KIAA0669 BINDING SITE, designated SEQ ID:16625, to the nucleotide sequence of VGAM1187 RNA, herein designated VGAM RNA, also designated SEQ ID:3898.

Another function of VGAM1187 is therefore inhibition of KIAA0669 (Accession NM_014779). Accordingly, utilities of VGAM1187 include diagnosis, prevention and treatment of diseases and clinical conditions associated with KIAA0669. KIAA0997 (Accession NM_014950) is another VGAM1187 host target gene. KIAA0997 BINDING SITE is HOST TARGET binding site found in the 5' untranslated region of mRNA encoded by KIAA0997, corresponding to a HOST TARGET binding site such as BINDING SITE I, BINDING SITE II or BINDING SITE III. Table 2 illustrates the complementarity of the nucleotide sequences of KIAA0997 BINDING SITE, designated SEQ ID:17279, to the nucleotide sequence of VGAM1187 RNA, herein designated VGAM RNA, also designated SEQ ID:3898.

Another function of VGAM1187 is therefore inhibition of KIAA0997 (Accession NM_014950). Accordingly, utilities of VGAM1187 include diagnosis, prevention and treatment of diseases and clinical conditions associated with KIAA0997. MACMARCKS (Accession NM_023009) is another VGAM1187 host target gene. MACMARCKS BINDING SITE is HOST TARGET binding site found in the 5' untranslated region of mRNA encoded by MACMARCKS, corresponding to a HOST TARGET binding site such as BINDING SITE I, BINDING SITE II or BINDING SITE III. Table 2 illustrates the complementarity of the nucleotide sequences of MACMARCKS BINDING SITE, designated SEQ ID:23271, to the nucleotide sequence of VGAM1187 RNA, herein designated VGAM RNA, also designated SEQ ID:3898.

Another function of VGAM1187 is therefore inhibition of MACMARCKS (Accession NM_023009). Accordingly, utilities of VGAM1187 include diagnosis, prevention and treatment of diseases and clinical conditions associated with MACMARCKS. MGC10966 (Accession NM_031471) is another VGAM1187 host target gene. MGC10966 BINDING SITE is HOST TARGET binding site found in the 5' untranslated region of mRNA encoded by MGC10966, corresponding to a HOST TARGET binding site such as BINDING SITE I, BINDING SITE II or BINDING SITE III. Table 2 illustrates the complementarity of the nucleotide sequences of MGC10966 BINDING SITE, designated SEQ ID:25537, to the nucleotide sequence of VGAM1187 RNA, herein designated VGAM RNA, also designated SEQ ID:3898.

Another function of VGAM1187 is therefore inhibition of MGC10966 (Accession NM_031471). Accordingly, utilities of VGAM1187 include diagnosis, prevention and treatment of diseases and clinical conditions associated with MGC10966. Ornithine Decarboxylase Antizyme Inhibitor (OAZIN, Accession NM_015878) is another VGAM1187 host target gene. OAZIN BINDING SITE is HOST TARGET binding site found in the 5' untranslated region of mRNA encoded by OAZIN, corresponding to a HOST TARGET binding site such as BINDING SITE I, BINDING SITE II or BINDING SITE III. Table 2 illustrates the complementarity of the nucleotide sequences of OAZIN BINDING SITE, designated SEQ ID:18020, to the nucleotide sequence of VGAM1187 RNA, herein designated VGAM RNA, also designated SEQ ID:3898.

Another function of VGAM1187 is therefore inhibition of Ornithine Decarboxylase Antizyme Inhibitor (OAZIN, Accession NM_015878). Accordingly, utilities of VGAM1187 include diagnosis, prevention and treatment of diseases and clinical conditions associated with OAZIN. Polymerase (RNA) III (DNA directed) Polypeptide F, 39 KDa (POLR3F, Accession XM_009639) is another VGAM1187 host target gene. POLR3F BINDING SITE is HOST TARGET binding site found in the 5' untranslated region of mRNA encoded by POLR3F, corresponding to a HOST TARGET binding site such as BINDING SITE I, BINDING SITE II or BINDING SITE III. Table 2 illustrates the complementarity of the nucleotide sequences of POLR3F BINDING SITE, designated SEQ ID:30115, to the nucleotide sequence of VGAM1187 RNA, herein designated VGAM RNA, also designated SEQ ID:3898.

Another function of VGAM1187 is therefore inhibition of Polymerase (RNA) III (DNA directed) Polypeptide F, 39 KDa (POLR3F, Accession XM_009639). Accordingly, utilities of VGAM1187 include diagnosis, prevention and treatment of diseases and clinical conditions associated with POLR3F. Ring Finger Protein 10 (RNF10, Accession NM_014868) is another VGAM1187 host target gene. RNF10 BINDING SITE is HOST TARGET binding site found in the 5' untranslated region of mRNA encoded by RNF10, corresponding to a HOST TARGET binding site such as BINDING SITE I, BINDING SITE II or BINDING SITE III. Table 2 illustrates the complementarity of the nucleotide sequences of RNF10 BINDING SITE, designated SEQ ID:16962, to the nucleotide sequence of VGAM1187 RNA, herein designated VGAM RNA, also designated SEQ ID:3898.

Another function of VGAM1187 is therefore inhibition of Ring Finger Protein 10 (RNF10, Accession NM_014868). Accordingly, utilities of VGAM1187 include diagnosis, prevention and treatment of diseases and clinical conditions associated with RNF10. Serine (or cysteine) Proteinase Inhibitor, Clade A (alpha-1 antiproteinase, antitrypsin), Member 1 (SERPINA1, Accession NM_000295) is another VGAM1187 host target gene. SERPINA1 BINDING SITE is HOST TARGET binding site found in the 5' untranslated region of mRNA encoded by SERPINA1, corresponding to a HOST TARGET binding site such as BINDING SITE I, BINDING SITE II or BINDING SITE III. Table 2 illustrates the complementarity of the nucleotide sequences of SERPINA1 BINDING SITE, designated SEQ ID:5839, to the nucleotide sequence of VGAM1187 RNA, herein designated VGAM RNA, also designated SEQ ID:3898.

Another function of VGAM1187 is therefore inhibition of Serine (or cysteine) Proteinase Inhibitor, Clade A (alpha-1 antiproteinase, antitrypsin), Member 1 (SERPINA1, Accession NM_000295). Accordingly, utilities of VGAM1187 include diagnosis, prevention and treatment of diseases and clinical conditions associated with SERPINA1. Torsin Family 2, Member A (TOR2A, Accession NM_130459) is another VGAM1187 host target gene. TOR2A BINDING SITE is HOST TARGET binding site found in the 3' untranslated region of mRNA encoded by TOR2A, corresponding to a HOST TARGET binding site such as BINDING SITE I, BINDING SITE II or BINDING SITE III. Table 2 illustrates the complementarity of the nucleotide sequences of TOR2A BINDING SITE, designated SEQ ID:28220, to the nucleotide sequence of VGAM1187 RNA, herein designated VGAM RNA, also designated SEQ ID:3898.

Another function of VGAM1187 is therefore inhibition of Torsin Family 2, Member A (TOR2A, Accession NM_130459). Accordingly, utilities of VGAM1187 include diagnosis, prevention and treatment of diseases and clinical conditions associated with TOR2A. LOC157226 (Accession XM_033876) is another VGAM1187 host target gene. LOC157226 BINDING SITE is HOST TARGET binding site found in the 5' untranslated region of mRNA encoded by LOC157226, corresponding to a HOST TARGET binding site such as BINDING SITE I, BINDING SITE II or BINDING SITE III. Table 2 illustrates the complementarity of the nucleotide sequences of LOC157226 BINDING SITE, designated SEQ ID:31976, to the nucleotide sequence of VGAM1187 RNA, herein designated VGAM RNA, also designated SEQ ID:3898.

Another function of VGAM1187 is therefore inhibition of LOC157226 (Accession XM_033876). Accordingly, utilities of VGAM1187 include diagnosis, prevention and treatment of diseases and clinical conditions associated with LOC157226. LOC158373 (Accession XM_048539) is another VGAM1187 host target gene. LOC158373 BINDING SITE is HOST TARGET binding site found in the 5' untranslated region of mRNA encoded by LOC158373, corresponding to a HOST TARGET binding site such as BINDING SITE I, BINDING SITE II or BINDING SITE III. Table 2 illustrates the complementarity of the nucleotide sequences of LOC158373 BINDING SITE, designated SEQ ID:35190, to the nucleotide sequence of VGAM1187 RNA, herein designated VGAM RNA, also designated SEQ ID:3898.

Another function of VGAM1187 is therefore inhibition of LOC158373 (Accession XM_048539). Accordingly, utilities of VGAM1187 include diagnosis, prevention and treatment of diseases and clinical conditions associated with LOC158373. FIG. 1 further provides a conceptual description of a novel bioinformatically detected viral gene of the present invention, referred to here as Viral Genomic Address Messenger 1188 (VGAM1188) viral gene, which modulates expression of respective host target genes thereof, the function and utility of which host target genes is known in the art.

VGAM1188 is a novel bioinformatically detected regulatory, non protein coding, viral micro RNA (miRNA) gene. The method by which VGAM1188 was detected is described hereinabove with reference to FIGS. 1-8.

VGAM1188 gene, herein designated VGAM GENE, is a viral gene contained in the genome of Human Adenovirus C. VGAM1188 host target gene, herein designated VGAM HOST TARGET GENE, is a human gene contained in the human genome.

VGAM1188 gene encodes a VGAM1188 precursor RNA, herein designated VGAM PRECURSOR RNA. Similar to other miRNA genes, and unlike most ordinary genes, VGAM1188 precursor RNA does not encode a protein. A nucleotide sequence identical or highly similar to the nucleotide sequence of VGAM1188 precursor RNA is designated SEQ ID:1174, and is provided hereinbelow with reference to the sequence listing part. Nucleotide sequence SEQ ID:1174 is located at position 27647 relative to the genome of Human Adenovirus C.

VGAM1188 precursor RNA folds onto itself, forming VGAM1188 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1188 folded precursor RNA into VGAM1188 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1188 RNA is designated SEQ ID:3899, and is provided hereinbelow with reference to the sequence listing part.

VGAM1188 host target gene, herein designated VGAM HOST TARGET GENE, encodes a corresponding messenger RNA, VGAM1188 host target RNA, herein designated VGAM HOST TARGET RNA. VGAM1188 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1188 RNA, herein designated VGAM RNA, binds complementarily to one or more host target binding sites located in untranslated regions of VGAM1188 host target RNA, herein designated VGAM HOST TARGET RNA. This complementary binding is due to the fact that the nucleotide sequence of VGAM1188 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1188 RNA, herein designated VGAM RNA, may have a different number of host target binding sites in untranslated regions of a VGAM1188 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1188 RNA, herein designated VGAM RNA, to host target binding sites on VGAM1188 host target RNA, herein designated VGAM HOST TARGET RNA, such as BINDING SITE I, BINDING SITE II and BINDING SITE III, inhibits translation of VGAM1188 host target RNA into VGAM1188 host target protein, herein designated VGAM HOST TARGET PROTEIN. VGAM host target protein is therefore outlined by a broken line.

It is appreciated that VGAM1188 host target gene, herein designated VGAM HOST TARGET GENE, in fact represents a plurality of VGAM1188 host target genes. The mRNA of each one of this plurality of VGAM1188 host target genes comprises one or more host target binding sites, each having a nucleotide sequence which is at least partly complementary to VGAM1188 RNA, herein designated VGAM RNA, and which when bound by VGAM1188 RNA causes inhibition of translation of respective one or more VGAM1188 host target proteins.

It is further appreciated by one skilled in the art that the mode of translational inhibition illustrated by FIG. 1 with specific reference to translational inhibition exerted by VGAM1188 gene, herein designated VGAM GENE, on one or more VGAM1188 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1188 is inhibition of expression of host target genes, as part of a novel viral mechanism of attacking a host. Accordingly, utilities of VGAM1188 include diagnosis, prevention and treatment of viral infection by Human Adenovirus C. Specific functions, and accordingly utilities, of VGAM1188 correlate with, and may be deduced from, the identity of the host target genes which VGAM1188 binds and inhibits, and the function of these host target genes, as elaborated hereinbelow.

Nucleotide sequences of the VGAM1188 precursor RNA, herein designated VGAM PRECURSOR RNA, and of the 'diced' VGAM1188 RNA, herein designated VGAM RNA, and a schematic representation of the secondary folding of VGAM1188 folded precursor RNA, herein designated VGAM FOLDED PRECURSOR RNA, of VGAM1188 are further described hereinbelow with reference to Table 1.

Nucleotide sequences of host target binding sites, such as BINDING SITE-I, BINDING SITE-II and BINDING SITE-III of FIG. 1, found on VGAM1188 host target RNA, and schematic representation of the complementarity of each of these host target binding sites to VGAM1188 RNA, herein designated VGAM RNA, are described hereinbelow with reference to Table 2.

As mentioned hereinabove with reference to FIG. 1, a function of VGAM1188 gene, herein designated VGAM is inhibition of expression of VGAM1188 target genes. It is appreciated that specific functions, and accordingly utilities, of VGAM1188 correlate with, and may be deduced from, the identity of the target genes which VGAM1188 binds and inhibits, and the function of these target genes, as elaborated hereinbelow.

Dual Oxidase 1 (DUOX1, Accession NM_017434) is a VGAM1188 host target gene. DUOX1 BINDING SITE is HOST TARGET binding site found in the 5' untranslated region of mRNA encoded by DUOX1, corresponding to a HOST TARGET binding site such as BINDING SITE I, BINDING SITE II or BINDING SITE III. Table 2 illustrates the complementarity of the nucleotide sequences of DUOX1 BINDING SITE, designated SEQ ID:18889, to the nucleotide sequence of VGAM1188 RNA, herein designated VGAM RNA, also designated SEQ ID:3899.

A function of VGAM1188 is therefore inhibition of Dual Oxidase 1 (DUOX1, Accession NM_017434), a gene which is a component of the thyroid hydrogen peroxide generating system. Accordingly, utilities of VGAM1188 include diagnosis, prevention and treatment of diseases and clinical conditions associated with DUOX1. The function of DUOX1 has been established by previous studies. Using a probe for a leukocyte NADPH oxidase, De Deken et al. (2000) cloned a full-length DUOX1 cDNA from a primary human thyroid cell cDNA library. The deduced 1,551-amino acid protein has a calculated molecular mass of 177 kD. It contains several domains characteristic of flavoproteins including NADPH- and FAD-binding domains, and 4 specific histidines and a conserved arginine predicted to bind a heme prosthetic group. DUOX2 also contains 2 EF-hand motifs, 4 putative N-glycosylation sites, and 7 hydrophobic stretches. It shares 83% and 53% sequence similarity with DUOX2 and gp91-phox (OMIM Ref. No. 306400), respectively, and significant similarity to other NADPH oxidases. DUOX1 and DUOX2 share 53% and 61% sequence similarity, respectively, with a predicted protein in C. elegans. Northern blot analysis detected expression of a 5.7-kb DUOX1 transcript in cultured human thymocytes. Immunolocalization studies demonstrated that DUOX1 colocalizes with thyroperoxidase at the supranuclear apical pole of all thyroid cells. De Deken et al. (2000) detected upregulated expression of DUOX1 and DUOX2 mRNA in cultured human thymocytes stimulated with cAMP agonists. In a study of thyroid carcinomas, Lacroix et al. (2001) showed that levels of DUOX1 and DUOX2 were maintained in parallel and were more frequently seen in neoplastic tissues expressing other thyroid differentiation markers.

Full details of the abovementioned studies are described in the following publications, the disclosure of which are hereby incorporated by reference:

De Deken, X.; Wang, D.; Many, M.-C.; Costagliola, S.; Libert, F.; Vassart, G.; Dumont, J. E.; Miot, F.: Cloning of two human thyroid cDNAs encoding new members of the NADPH oxidase family. J. Biol. Chem. 275:23227-23233, 2000; and Lacroix, L.; Nocera, M.; Mian, C.; Caillou, B.; Virion, A.; Dupuy, C.; Filetti, S.; Bidart, J. M.; Schlumberger, M.: Expression of nicotinamide adenine dinucleotide phosphate oxidase.

Further studies establishing the function and utilities of DUOX1 are found in John Hopkins OMIM database record ID 606758, and in sited publications numbered 5570-5571 listed in the bibliography section hereinbelow, which are also hereby incorporated by reference. Phospholipase C, Beta 2 (PLCB2, Accession NM_004573) is another VGAM1188 host target gene. PLCB2 BINDING SITE is HOST TARGET binding site found in the 3' untranslated region of mRNA encoded by PLCB2, corresponding to a HOST TARGET binding site such as BINDING SITE I, BINDING SITE II or BINDING SITE III. Table 2 illustrates the complementarity of the nucleotide sequences of PLCB2 BINDING SITE, designated SEQ ID:10917, to the nucleotide sequence of VGAM1188 RNA, herein designated VGAM RNA, also designated SEQ ID:3899.

Another function of VGAM1188 is therefore inhibition of Phospholipase C, Beta 2 (PLCB2, Accession NM_004573), a gene which is the beta 2 subunit of phospholipase C. Accordingly, utilities of VGAM1188 include diagnosis, prevention and treatment of diseases and clinical conditions associated with PLCB2. The function of PLCB2 has been established by previous studies. Phosphoinositide-specific phospholipase C (PLC) plays a major role in transmembrane signaling by catalyzing the hydrolysis of phosphatidylinositol 4,5-bisphosphate (PIP2) and thereby generating the second messenger molecules inositol 1,4,5-trisphosphate (IP3) and diacylglycerol. Several distinct PLC enzymes have been identified in a variety of mammalian tissues. Park et al. (1992) isolated cDNAs encoding a previously uncharacterized PLC by screening a human cDNA library derived from the promyelocytic cell line HL-60 with a bovine PLC-beta-1 (PLCB1) cDNA. The 1,181-amino acid protein predicted from the human cDNAs shares 48% amino acid identity with rat Plcb1 and is similar in overall structure to Plcb1; thus, it was named PLC-beta-2 (PLCB2). PLCB2 and Plcb1 show the least sequence similarity in their C-terminal 450 amino acids. PLCB2 contains the X and Y regions conserved among PLCs, and 1 PEST sequence, a motif suggesting sensitivity of PLCB2 to proteases. Recombinant PLCB2 expressed in mammalian cells migrated as a 140-kD protein in SDS-polyacrylamide gels. Characterization of recombinant PLCB2 revealed that the catalytic activity of PLCB2 is dependent on calcium and that PLCB2 prefers phosphatidylinositol 4,5-bisphosphate to phosphatidylinositol as a substrate. Reconstitution experiments showed that alpha-q (OMIM Ref. No. 600998), which is the alpha subunit of the pertussis toxin-insensitive G protein, activates Plcb1 but not PLCB2, suggesting that receptor-dependent stimulation of these 2 PLCBs may require different G protein alpha subunits. By Southern blot analysis of a human/rodent somatic cell hybrid panel, Park et al. (1998) mapped the PLCB2 gene to chromosome 15. They localized the PLCB2 gene to 15q15 using FISH. Animal model experiments lend further support to the function of PLCB2. Li et al. (2000) described the phenotype of mice lacking Plcb2 and Plcb3 (OMIM Ref. No. 600230). The mice developed spontaneous multifocal skin ulcers usually starting at the age of 6 months or older. The lesions were localized mainly behind ears or on the neck, but sometimes also appeared on the face. The phenotype was similar to that of mice lacking Plcb3 alone.

It is appreciated that the abovementioned animal model for PLCB2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Park, D.; Jhon, D.-Y.; Kriz, R.; Knopf, J.; Rhee, S. G.: Cloning, sequencing, expression, and Gq-independent activation of phospholipase C-beta-2. J. Biol. Chem. 267:16048-16055, 1992; and Li, Z.; Jiang, H.; Xie, W.; Zhang, Z.; Smrcka, A. V.; Wu, D.: Roles of PLC-beta-2 and -beta-3 and PI3K-gamma in chemoattractant-mediated signal transduction. Science 287: 1046-1049, 200.

Further studies establishing the function and utilities of PLCB2 are found in John Hopkins OMIM database record ID 604114, and in sited publications numbered 7429, 7864-7433, 283 and 7434 listed in the bibliography section hereinbelow, which are also hereby incorporated by reference. DNA Cross-link Repair 1A (PSO2 homolog, S. cerevisiae) (DCLRE1A, Accession XM_044815) is another VGAM1188 host target gene. DCLRE1A BINDING SITE is HOST TARGET binding site found in the 3' untranslated region of mRNA encoded by DCLRE1A, corresponding to a HOST TARGET binding site such as BINDING SITE I, BINDING SITE II or BINDING SITE III. Table 2 illustrates the complementarity of the nucleotide sequences of DCLRE1A BINDING SITE, designated SEQ ID:34281, to the nucleotide sequence of VGAM1188 RNA, herein designated VGAM RNA, also designated SEQ ID:3899.

Another function of VGAM1188 is therefore inhibition of DNA Cross-link Repair 1A (PSO2 homolog, S. cerevisiae) (DCLRE1A, Accession XM_044815). Accordingly, utilities of VGAM1188 include diagnosis, prevention and treatment of diseases and clinical conditions associated with DCLRE1A. FLJ22419 (Accession NM_024697) is another VGAM1188 host target gene. FLJ22419 BINDING SITE is HOST TARGET binding site found in the 5' untranslated region of mRNA encoded by FLJ22419, corresponding to a HOST TARGET binding site such as BINDING SITE I, BINDING SITE II or BINDING SITE III. Table 2 illustrates the complementarity of the nucleotide sequences of FLJ22419 BINDING SITE, designated SEQ ID:24008, to the nucleotide sequence of VGAM1188 RNA, herein designated VGAM RNA, also designated SEQ ID:3899.

Another function of VGAM1188 is therefore inhibition of FLJ22419 (Accession NM_024697). Accordingly, utilities of VGAM1188 include diagnosis, prevention and treatment of diseases and clinical conditions associated with FLJ22419. KIAA0930 (Accession XM_047214) is another VGAM1188 host target gene. KIAA0930 BINDING SITE is HOST TARGET binding site found in the 3' untranslated region of mRNA encoded by KIAA0930, corresponding to a HOST TARGET binding site such as BINDING SITE I, BINDING SITE II or BINDING SITE III. Table 2 illustrates the complementarity of the nucleotide sequences of KIAA0930 BINDING SITE, designated SEQ ID:34915, to the nucleotide sequence of VGAM1188 RNA, herein designated VGAM RNA, also designated SEQ ID:3899.

Another function of VGAM1188 is therefore inhibition of KIAA0930 (Accession XM_047214). Accordingly, utilities of VGAM1188 include diagnosis, prevention and treatment of diseases and clinical conditions associated with KIAA0930. MGC35558 (Accession NM_145013) is another VGAM1188 host target gene. MGC35558 BINDING SITE is HOST TARGET binding site found in the 3' untranslated region of mRNA encoded by MGC35558, corresponding to a HOST TARGET binding site such as BINDING SITE I, BINDING SITE II or BINDING SITE III. Table 2 illustrates the complementarity of the nucleotide sequences of MGC35558 BINDING SITE, designated SEQ ID:29619, to the nucleotide sequence of VGAM1188 RNA, herein designated VGAM RNA, also designated SEQ ID:3899.

Another function of VGAM1188 is therefore inhibition of MGC35558 (Accession NM_145013). Accordingly, utilities of VGAM1188 include diagnosis, prevention and treatment of diseases and clinical conditions associated with MGC35558. PHRET1 (Accession NM_021200) is another VGAM1188 host target gene. PHRET1 BINDING SITE is HOST TARGET binding site found in the 3' untranslated region of mRNA encoded by PHRET1, corresponding to a HOST TARGET binding site such as BINDING SITE I, BINDING SITE II or BINDING SITE III. Table 2 illustrates the complementarity of the nucleotide sequences of PHRET1 BINDING SITE, designated SEQ ID:22175, to the nucleotide sequence of VGAM1188 RNA, herein designated VGAM RNA, also designated SEQ ID:3899.

Another function of VGAM1188 is therefore inhibition of PHRET1 (Accession NM_021200). Accordingly, utilities of VGAM1188 include diagnosis, prevention and treatment of diseases and clinical conditions associated with PHRET1. RIG-I (Accession NM_014314) is another VGAM1188 host target gene. RIG-I BINDING SITE is HOST TARGET binding site found in the 5' untranslated region of mRNA encoded by RIG-I, corresponding to a HOST TARGET binding site such as BINDING SITE I, BINDING SITE II or BINDING SITE III. Table 2 illustrates the complementarity of the nucleotide sequences of RIG-I BINDING SITE, designated SEQ ID:15614, to the nucleotide sequence of VGAM1188 RNA, herein designated VGAM RNA, also designated SEQ ID:3899.

Another function of VGAM1188 is therefore inhibition of RIG-I (Accession NM_014314). Accordingly, utilities of VGAM1188 include diagnosis, prevention and treatment of diseases and clinical conditions associated with RIG-I. Williams Beuren Syndrome Chromosome Region 20A (WBSCR20A, Accession NM_032158) is another VGAM1188 host target gene. WBSCR20A BINDING SITE is HOST TARGET binding site found in the 5' untranslated region of mRNA encoded by WBSCR20A, corresponding to a HOST TARGET binding site such as BINDING SITE I, BINDING SITE II or BINDING SITE III. Table 2 illustrates the complementarity of the nucleotide sequences of WBSCR20A BINDING SITE, designated SEQ ID:25860, to the nucleotide sequence of VGAM1188 RNA, herein designated VGAM RNA, also designated SEQ ID:3899.

Another function of VGAM1188 is therefore inhibition of Williams Beuren Syndrome Chromosome Region 20A (WBSCR20A, Accession NM_032158). Accordingly, utilities of VGAM1188 include diagnosis, prevention and treatment of diseases and clinical conditions associated with WBSCR20A. LOC144600 (Accession XM_096639) is another VGAM1188 host target gene. LOC144600 BINDING SITE is HOST TARGET binding site found in the 3' untranslated region of mRNA encoded by LOC144600, corresponding to a HOST TARGET binding site such as BINDING SITE I, BINDING SITE II or BINDING SITE III. Table 2 illustrates the complementarity of the nucleotide sequences of LOC144600 BINDING SITE, designated SEQ ID:40447, to the nucleotide sequence of VGAM1188 RNA, herein designated VGAM RNA, also designated SEQ ID:3899.

Another function of VGAM1188 is therefore inhibition of LOC144600 (Accession XM_096639). Accordingly, utilities of VGAM1188 include diagnosis, prevention and treatment of diseases and clinical conditions associated with LOC144600. LOC150622 (Accession XM_086960) is another VGAM1188 host target gene. LOC150622 BINDING SITE is HOST TARGET binding site found in the 5' untranslated region of mRNA encoded by LOC150622, corresponding to a HOST TARGET binding site such as BINDING SITE I, BINDING SITE II or BINDING SITE III. Table 2 illustrates the complementarity of the nucleotide sequences of LOC150622 BINDING SITE, designated SEQ ID:38997, to the nucleotide sequence of VGAM1188 RNA, herein designated VGAM RNA, also designated SEQ ID:3899.

Another function of VGAM1188 is therefore inhibition of LOC150622 (Accession XM_086960). Accordingly, utilities of VGAM1188 include diagnosis, prevention and treatment of diseases and clinical conditions associated with LOC150622. LOC204285 (Accession XM_115292) is another VGAM1188 host target gene. LOC204285 BINDING SITE is HOST TARGET binding site found in the 3' untranslated region of mRNA encoded by LOC204285, corresponding to a HOST TARGET binding site such as BINDING SITE I, BINDING SITE II or BINDING SITE III. Table 2 illustrates the complementarity of the nucleotide sequences of LOC204285 BINDING SITE, designated SEQ ID:43090, to the nucleotide sequence of VGAM1188 RNA, herein designated VGAM RNA, also designated SEQ ID:3899.

Another function of VGAM1188 is therefore inhibition of LOC204285 (Accession XM_115292). Accordingly, utilities of VGAM1188 include diagnosis, prevention and treatment of diseases and clinical conditions associated with LOC204285. FIG. 1 further provides a conceptual description of a novel bioinformatically detected viral gene of the present invention, referred to here as Viral Genomic Address Messenger 1189 (VGAM1189) viral gene, which modulates expression of respective host target genes thereof, the function and utility of which host target genes is known in the art.

VGAM1189 is a novel bioinformatically detected regulatory, non protein coding, viral micro RNA (miRNA) gene. The method by which VGAM1189 was detected is described hereinabove with reference to FIGS. 1-8.

VGAM1189 gene, herein designated VGAM GENE, is a viral gene contained in the genome of Botrytis Virus F. VGAM1189 host target gene, herein designated VGAM HOST TARGET GENE, is a human gene contained in the human genome.

VGAM1189 gene encodes a VGAM1189 precursor RNA, herein designated VGAM PRECURSOR RNA. Similar to other miRNA genes, and unlike most ordinary genes, VGAM1189 precursor RNA does not encode a protein. A nucleotide sequence identical or highly similar to the nucleotide sequence of VGAM1189 precursor RNA is designated SEQ ID:1175, and is provided hereinbelow with reference to the sequence listing part. Nucleotide sequence SEQ ID:1175 is located at position 2597 relative to the genome of Botrytis Virus F.

VGAM1189 precursor RNA folds onto itself, forming VGAM1189 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1189 folded precursor RNA into VGAM1189 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1189 RNA is designated SEQ ID:3900, and is provided hereinbelow with reference to the sequence listing part.

VGAM1189 host target gene, herein designated VGAM HOST TARGET GENE, encodes a corresponding messenger RNA, VGAM1189 host target RNA, herein designated VGAM HOST TARGET RNA. VGAM1189 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1189 RNA, herein designated VGAM RNA, binds complementarily to one or more host target binding sites located in untranslated regions of VGAM1189 host target RNA, herein designated VGAM HOST TARGET RNA. This complementary binding is due to the fact that the nucleotide sequence of VGAM1189 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1189 RNA, herein designated VGAM RNA, may have a different number of host target binding sites in untranslated regions of a VGAM1189 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1189 RNA, herein designated VGAM RNA, to host target binding sites on VGAM1189 host target RNA, herein designated VGAM HOST TARGET RNA, such as BINDING SITE I, BINDING SITE II and BINDING SITE III, inhibits translation of VGAM1189 host target RNA into VGAM1189 host target protein, herein designated VGAM HOST TARGET PROTEIN. VGAM host target protein is therefore outlined by a broken line.

It is appreciated that VGAM1189 host target gene, herein designated VGAM HOST TARGET GENE, in fact represents a plurality of VGAM1189 host target genes. The mRNA of each one of this plurality of VGAM1189 host target genes comprises one or more host target binding sites, each having a nucleotide sequence which is at least partly complementary to VGAM1189 RNA, herein designated VGAM RNA, and which when bound by VGAM1189 RNA causes inhibition of translation of respective one or more VGAM1189 host target proteins.

It is further appreciated by one skilled in the art that the mode of translational inhibition illustrated by FIG. 1 with specific reference to translational inhibition exerted by VGAM1189 gene, herein designated VGAM GENE, on one or more VGAM1189 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1189 is inhibition of expression of host target genes, as part of a novel viral mechanism of attacking a host. Accordingly, utilities of VGAM1189 include diagnosis, prevention and treatment of viral infection by Botrytis Virus F. Specific functions, and accordingly utilities, of VGAM1189 correlate with, and may be deduced from, the identity of the host target genes which VGAM1189 binds and inhibits, and the function of these host target genes, as elaborated hereinbelow.

Nucleotide sequences of the VGAM1189 precursor RNA, herein designated VGAM PRECURSOR RNA, and of the 'diced' VGAM1189 RNA, herein designated VGAM RNA, and a schematic representation of the secondary folding of VGAM1189 folded precursor RNA, herein designated VGAM FOLDED PRECURSOR RNA, of VGAM1189 are further described hereinbelow with reference to Table 1.

Nucleotide sequences of host target binding sites, such as BINDING SITE-I, BINDING SITE-II and BINDING SITE-III of FIG. 1, found on VGAM1189 host target RNA, and schematic representation of the complementarity of each of these host target binding sites to VGAM1189 RNA, herein designated VGAM RNA, are described hereinbelow with reference to Table 2.

As mentioned hereinabove with reference to FIG. 1, a function of VGAM1189 gene, herein designated VGAM is inhibition of expression of VGAM1189 target genes. It is appreciated that specific functions, and accordingly utilities, of VGAM1189 correlate with, and may be deduced from, the identity of the target genes which VGAM1189 binds and inhibits, and the function of these target genes, as elaborated hereinbelow.

Acid Phosphatase 1, Soluble (ACP1, Accession NM_004300) is a VGAM1189 host target gene. ACP1 BINDING SITE1 and ACP1 BINDING SITE2 are HOST TARGET binding sites found in untranslated regions of mRNA encoded by ACP1, corresponding to HOST TARGET binding sites such as BINDING SITE I, BINDING SITE II or BINDING SITE III. Table 2 illustrates the complementarity of the nucleotide sequences of ACP1 BINDING SITE1 and ACP1 BINDING SITE2, designated SEQ ID:10508 and SEQ ID:13958 respectively, to the nucleotide sequence of VGAM1189 RNA, herein designated VGAM RNA, also designated SEQ ID:3900.

A function of VGAM1189 is therefore inhibition of Acid Phosphatase 1, Soluble (ACP1, Accession NM_004300), a gene which as demonstrated in starch-gel electrophoresis. Accordingly, utilities of VGAM1189 include diagnosis, prevention and treatment of diseases and clinical conditions associated with ACP1. The function of ACP1 and its association with various diseases and clinical conditions, has been established by previous studies, as described hereinabove with reference to VGAM179. A Disintegrin and Metalloproteinase Domain 11 (ADAM11, Accession NM_002390) is another VGAM1189 host target gene. ADAM11 BINDING SITE1 and ADAM11 BINDING SITE2 are HOST TARGET binding sites found in untranslated regions of mRNA encoded by ADAM11, corresponding to HOST TARGET binding sites such as BINDING SITE I, BINDING SITE II or BINDING SITE III. Table 2 illustrates the complementarity of the nucleotide sequences of ADAM11 BINDING SITE1 and ADAM11 BINDING SITE2, designated SEQ ID:8207 and SEQ ID:38533 respectively, to the nucleotide sequence of VGAM1189 RNA, herein designated VGAM RNA, also designated SEQ ID:3900.

Another function of VGAM1189 is therefore inhibition of A Disintegrin and Metalloproteinase Domain 11 (ADAM11, Accession NM_002390), a gene which Member of the ADAM family of zinc metalloproteases. Accordingly, utilities of VGAM1189 include diagnosis, prevention and treatment of diseases and clinical conditions associated with ADAM11. The function of ADAM11 and its association with various diseases and clinical conditions, has been established by previous studies, as described hereinabove with reference to VGAM387. B-cell CLL/lymphoma 7B (BCL7B, Accession NM_001707) is another VGAM1189 host target gene. BCL7B BINDING SITE is HOST TARGET binding site found in the 3' untranslated region of mRNA encoded by BCL7B, corresponding to a HOST TARGET binding site such as BINDING SITE I, BINDING SITE II or BINDING SITE III. Table 2 illustrates the complementarity of the nucleotide sequences of BCL7B BINDING SITE, designated SEQ ID:7435, to the nucleotide sequence of VGAM1189 RNA, herein designated VGAM RNA, also designated SEQ ID:3900.

Another function of VGAM1189 is therefore inhibition of B-cell CLL/lymphoma 7B (BCL7B, Accession NM_001707), a gene which is of yet unknown fanction. Accordingly, utilities of VGAM1189 include diagnosis, prevention and treatment of diseases and clinical conditions associated with BCL7B. The function of BCL7B has been established by previous studies. Meng et al. (1998) constructed a physical map encompassing the 1.5-Mb region of chromosome 7q11.23 that is commonly deleted in Williams-Beuren syndrome (WBS; 194050). They identified 3 genes within this region, including BCL7B, which contains 6 exons. By EST database searching, screening of a liver cDNA library, and sequencing, they cloned a BCL7B cDNA encoding a deduced 202-amino acid protein that shows high homology to the BCL7A gene (OMIM Ref. No. 601406), which was cloned from a complex chromosomal translocation in Burkitt lymphoma cell lines. BCL7B is highly conserved from C. elegans to human, suggesting that it has been conserved through evolution.

Full details of the abovementioned studies are described in the following publications, the disclosure of which are hereby incorporated by reference:

Jadayel, D. M.; Osborne, L. R.; Coignet, L. J. A.; Zani, V. J.; Tsui, L.-C.; Scherer, S. W.; Dyer, M. J. S.: The BCL7 gene family: deletion of BCL7B in Williams syndrome. Gene 224: 35-44, 1998; and Meng, X.; Lu, X.; Li, Z.; Green, E. D.; Massa, H.; Trask, B. J.; Morris, C. A.; Keating, M. T.: Complete physical map of the common deletion region in Williams syndrome and identificat.

Further studies establishing the function and utilities of BCL7B are found in John Hopkins OMIM database record ID 605846, and in sited publications numbered 7187 listed in the bibliography section hereinbelow, which are also hereby incorporated by reference. Bone Morphogenetic Protein 1 (BMP1, Accession NM_006131) is another VGAM1189 host target gene. BMP1 BINDING SITE1 and BMP1 BINDING SITE2 are HOST TARGET binding sites found in untranslated regions of mRNA encoded by BMP1, corresponding to HOST TARGET binding sites such as BINDING SITE I, BINDING SITE II or BINDING SITE III. Table 2 illustrates the complementarity of the nucleotide sequences of BMP1 BINDING SITE1 and BMP1 BINDING SITE2, designated SEQ ID:12769 and SEQ ID:12772 respectively, to the nucleotide sequence of VGAM1189 RNA, herein designated VGAM RNA, also designated SEQ ID:3900.

Another function of VGAM1189 is therefore inhibition of Bone Morphogenetic Protein 1 (BMP1, Accession NM_006131), a gene which cleaves procollagens leading to formation of extracellular matrix. Accordingly, utilities of VGAM1189 include diagnosis, prevention and treatment of diseases and clinical conditions associated with BMP1. The function of BMP1 and its association with various diseases and clinical conditions, has been established by previous studies, as described hereinabove with reference to VGAM247. Carnitine Acetyltransferase (CRAT, Accession NM_000755) is another VGAM1189 host target gene. CRAT BINDING SITE is HOST TARGET binding site found in the 5' untranslated region of mRNA encoded by CRAT, corresponding to a HOST TARGET binding site such as BINDING SITE I, BINDING SITE II or BINDING SITE III. Table 2 illustrates the complementarity of the nucleotide sequences of CRAT BINDING SITE, designated SEQ ID:6406, to the nucleotide sequence of VGAM1189 RNA, herein designated VGAM RNA, also designated SEQ ID:3900.

Another function of VGAM1189 is therefore inhibition of Carnitine Acetyltransferase (CRAT, Accession NM_000755), a gene which catalyzes the reversible transfer of acyl groups from an acyl-CoA thioester to carnitine. Accordingly, utilities of VGAM1189 include diagnosis, prevention and treatment of diseases and clinical conditions associated with CRAT. The function of CRAT has been established by previous studies. Carnitine acyltransferases are a group of enzymes that catalyze the reversible transfer of acyl groups from an acyl-CoA thioester to carnitine, thus forming the corresponding acylcarnitine. These enzymes can be distinguished according to their substrate specificity in carnitine palmitoyltransferase (see OMIM Ref. No. CPT1, 600528 and CPT2, 600650), carnitine octanoyltransferase (CROT; 606090), and carnitine acetyltransferase (EC 2.3.1.7). CRAT is a key enzyme for metabolic pathways involved with the control of the acyl-CoA/CoA ratio in mitochondria, peroxisomes, and endoplasmic reticulum Acetylcarnitine, which can be a precursor for acetylcholine synthesis catalyzed by choline acetyltransferase, is thought to slow the rate of mental deterioration in Alzheimer patients, and Kalaria and Harik (1992) found decreased function of CRAT in the brain of Alzheimer patients Full details of the abovementioned studies are described in the following publications, the disclosure of which are hereby incorporated by reference:

Kalaria, R. N.; Harik, S. I.: Carnitine acetyltransferase activity in the human brain and its microvessels is decreased in Alzheimer's disease. Ann. Neurol. 32:583-586, 1992; and van der Leij, F. R.; Huijkman, N. C. A.; Boomsma, C.; Kuipers, J. R. G.; Bartelds, B.: Genomics of the human carnitine acyltransferase genes. Molec. Genet. Metab. 71:139-153, 2000.

Further studies establishing the function and utilities of CRAT are found in John Hopkins OMIM database record ID 600184, and in sited publications numbered 7744-7746 listed in the bibliography section hereinbelow, which are also hereby incorporated by reference. Cytoplasmic Linker 2 (CYLN2, Accession NM_003388) is another VGAM1189 host target gene. CYLN2 BINDING SITE is HOST TARGET binding site found in the 3' untranslated region of mRNA encoded by CYLN2, corresponding to a HOST TARGET binding site such as BINDING SITE I, BINDING SITE II or BINDING SITE III. Table 2 illustrates the complementarity of the nucleotide sequences of CYLN2 BINDING SITE, designated SEQ ID:9422, to the nucleotide sequence of VGAM1189 RNA, herein designated VGAM RNA, also designated SEQ ID:3900.

Another function of VGAM1189 is therefore inhibition of Cytoplasmic Linker 2 (CYLN2, Accession NM_003388), a gene which associates with microtubules and dendritic lamellar bodies. Accordingly, utilities of VGAM1189 include diagnosis, prevention and treatment of diseases and clinical conditions associated with CYLN2. The function of CYLN2 and its association with various diseases and clinical conditions, has been established by previous studies, as described hereinabove with reference to VGAM94. Dopamine Beta-hydroxylase (dopamine beta-monooxygenase) (DBH, Accession NM_000787) is another VGAM1189 host target gene.

DBH BINDING SITE is HOST TARGET binding site found in the 3" untranslated region of mRNA encoded by DBH, corresponding to a HOST TARGET binding site such as BINDING SITE I, BINDING SITE II or BINDING SITE III. Table 2 illustrates the complementarity of the nucleotide sequences of DBH BINDING SITE, designated SEQ ID:6439, to the nucleotide sequence of VGAM1189 RNA, herein designated VGAM RNA, also designated SEQ ID:3900.

Another function of VGAM1189 is therefore inhibition of Dopamine Beta-hydroxylase (dopamine beta-monooxygenase) (DBH, Accession NM_000787), a gene which converts dopamine to norepinephrine. Accordingly, utilities of VGAM1189 include diagnosis, prevention and treatment of diseases and clinical conditions associated with DBH. The function of DBH has been established by previous studies. Dopamine beta-hydroxylase (DBH; EC 1.14.17.1), the enzyme that converts dopamine to norepinephrine, is present in the synaptic vesicles of postganglionic sympathetic neurons. Release of norepinephrine is accompanied by the simultaneous release of DBH. For this reason, it has been proposed that plasma DBH may serve as an index of sympathetic activity. Schanberg et al. (1974) found that subjects showed a wide range of values with a 'low' group and a 'high' group. The high group tended to show higher and less stable levels of blood pressure. In a twin study, Ross et al. (1973) found a higher concordance for level of DBH activity in monozygotic twins than in dizygotic twins. Ogihara et al. (1975) did not find a bimodal distribution for serum DBH in the population. However, highly significant correlations were found for the serum DBH of sib-sib pairs and mean parent-child pairs. No significant correlation was found for father-mother pairs. Weinshilboum et al. (1975) concluded that low serum dopamine beta-hydroxylase is recessive. Gershon and Goldin (1981) concluded that the family data are consistent with codominant inheritance. Possible linkage of DBH to ABO on chromosome 9 was indicated by a maximum lod score of 1.82 at 0.0 and 10% recombination fractions for males and females, respectively (Goldin et al., 1982). Elston et al. (1979) found a lod score of 2.32 at 0% recombination, giving a combined score of 2.32. Asamoah et al. (1987) studied DBH levels and polymorphic markers in 178 members of a family ascertained through 6 members who had myocardial infarction. The persons with infarction had lower levels of DBH than did others, 'but this difference was partly confounded with age differences.' Segregation analysis suggested that a codominant gene for DBH was segregating in the family. The largest lod score yielded by linkage analysis was 0.53 with ABO at 20% recombination. Adding this to the lod scores obtained by Elston et al. (1979) and Goldin et al. (1982), they obtained combined lod scores of 2.49 and 2.50 at 0.0 and 10% recombination, respectively. Wilson et al. (1987, 1988) arrived at a lod score of 5.88 at a recombination fraction of 0.0 for the linkage of DBH and ABO. The DBH gene was not polymorphic in a black family. In studies using RFLPs of the DBH gene, Perry et al. (1991) found no recombination with argininosuccinate synthetase (OMIM Ref. No. 603470) and ABO blood group loci, with lod scores of 7.37 and 4.5, respectively, at theta=0.0. Using the full-length cDNA clone isolated by Lamouroux et al. (1987) from a human pheochromocytoma lambda library, Craig et al. (1988) showed by in situ hybridization that the DBH gene is located on 9q34. Pilz et al. (1992) used interspecies backcrosses to map the Dbh gene to mouse chromosome 2. Robertson et al. (1986) described a patient who appeared to have an isolated defect in the beta-hydroxylation of dopamine in peripheral nerves; see 146500. Man in't Veld et al. (1987) described a similar case in a 21-year-old woman with severe orthostatic hypotension. Ptosis, skeletal muscle hypotonia, and recurrent hypoglycemia had been noticed from early childhood. There was virtually complete loss of noradrenergic innervation but intact cholinergic function. Noradrenaline and adrenaline were not detectable in plasma, urine, and cerebrospinal fluid, but dopamine was 7- to 12-fold normal in plasma, 4-fold normal in urine, and 20-fold normal in CSF. Measurements of catecholamine metabolites showed further evidence for impairment of noradrenaline and adrenaline biosynthesis due to deficient dopamine beta-hydroxylation. Dopamine beta-hydroxylase was undetectable in plasma and CSF. Physiologic and pharmacologic stimuli of sympathetic neurotransmitter release caused increases in plasma dopamine rather than in plasma noradrenaline. The syndrome seemed to be caused by congenital dopamine beta-hydroxylase deficiency. There were no other affected individuals in the family, the parents were unrelated, and 2 sibs were in good health. As useful controls, 12 other patients with orthostatic hypotension, either idiopathic or due to other causes such as hereditary amyloidosis, primary amyloidosis, diabetic neuropathy, Shy-Drager syndrome, amyloidosis with multiple myeloma, were studied and found to have normal levels of dopamine in the plasma. Biaggioni and Robertson (1987) found remarkable improvement from administration of DL-dihydroxyphenylserine by mouth in 2 patients with lifelong orthostatic hypotension due to DBH deficiency. Both patients also had ptosis and nasal stuffiness all their lives. The agent bypasses the DBH deficiency since it is readily converted to noradrenaline by decarboxylation of the terminal carboxyl group. Mathias et al. (1990) described a brother and sister with long-standing symptoms of postural hypotension. In the male, erection was unaffected but ejaculation was prolonged or absent. Autonomic function tests confirmed sympathetic adrenergic failure with spared sympathetic cholinergic and intact parasympathetic function. There were no other neurologic abnormalities. Plasma dopamine was elevated, but noradrenaline and adrenaline were undetectable in the plasma, as was dopamine beta-hydroxylase activity. In perivascular cutaneous tissue, DBH immunoreactivity was absent. The parents were clinically and biochemically normal. Treatment with dihydroxyphenylserine reduced symptoms and signs of postural hypotension, increased plasma levels of noradrenaline, and, in the male, made ejaculation possible. Animal model experiments lend further support to the function of DBH. Thomas et al. (1995) used gene targeting to produce mice that lack Dbh and are therefore unable to synthesize noradrenaline or adrenaline. They found that in heterozygous mothers, most homozygous embryos died in utero and only about 5% reached adulthood. Survival probably depended on catecholamine transfer across the placenta, because in homozygous mothers all embryos died in utero. Mortality was due to lack of noradrenaline in utero because it could be prevented by treatment with dihydroxyphenylserine (DOPS), a precursor that can be converted to noradrenaline in the absence of DBH. Mutant embryos had a histologic phenotype similar to that of embryos deficient in tyrosine hydroxylase suggesting that death might be due to cardiovascular failure, as was probably the case with TH-deficient embryos. Thomas and Palmiter (1997) found impaired maternal behavior in these mice with targeted disruption of the Dbh gene. Most heterozygous pups born to Dbh-/- females died within several days of birth and were often found scattered within the bedding. Potential causes, including deficits in olfaction and lactation, were not apparent. A deficit in maternal behavior was confirmed by the lack of pup retrieval exhibited by Dbh-/- virgin females. Restoration of norepinephrine shortly before but not after birth induced females that had previously abandoned their litters to act maternally. These results suggested to the authors that norepinephrine is responsible for long-lasting changes that promote maternal behavior during both development and parturition in mice.

It is appreciated that the abovementioned animal model for DBH is acknowledged by those skilled in the art as a scientifically valid animal model, as can be further appreciated from the publications sited hereinbelow.

Full details of the abovementioned studies are described in the following publications, the disclosure of which are hereby incorporated by reference:

Weinshilboum, R. M.; Schrott, H. G.; Raymond, F. A.; Weidman, W. H.; Elveback, L. R.: Inheritance of very low serum dopamine-beta-hydroxylase activity. Am. J. Hum. Genet. 27:573-585, 1975; and Mathias, C. J.; Bannister, R. B.; Cortelli, P.; Heslop, K.; Polak, J. M.; Raimbach, S.; Springall, D. R.; Watson, L.: Clinical, autonomic and therapeutic observations in two siblings.

Further studies establishing the function and utilities of DBH are found in John Hopkins OMIM database record ID 223360, and in sited publications numbered 9541-9555, 5226, 9556-9560, 3653, 5227, 9561-956 and 4567-1874 listed in the bibliography section hereinbelow, which are also hereby incorporated by reference. Death Effector Domain Containing (DEDD, Accession NM_032998) is another VGAM1189 host target gene. DEDD BINDING SITE is HOST TARGET binding site found in the 3' untranslated region of mRNA encoded by DEDD, corresponding to a HOST TARGET binding site such as BINDING SITE I, BINDING SITE II or BINDING SITE III. Table 2 illustrates the complementarity of the nucleotide sequences of DEDD BINDING SITE, designated SEQ ID:26879, to the nucleotide sequence of VGAM1189 RNA, herein designated VGAM RNA, also designated SEQ ID:3900.

Another function of VGAM1189 is therefore inhibition of Death Effector Domain Containing (DEDD, Accession NM_032998), a gene which intervenes in apoptosis. Accordingly, utilities of VGAM1189 include diagnosis, prevention and treatment of diseases and clinical conditions associated with DEDD. The function of DEDD has been established by previous studies. By EST database searching with sequences of DED-containing proteins, Leo et al. (1998) and Stegh et al. (1998) independently identified and cloned the human DEDD cDNA. The DEDD cDNA encodes a deduced 318-amino acid protein with an N-terminal DED domain and a calculated molecular mass of about 37 kD. Leo et al. (1998) and Stegh et al. (1998) also cloned the rat and mouse homologs, respectively, which share approximately 98% sequence identity with the human protein. Northern blot analysis detected ubiquitous expression of DEDD mRNA, but particularly abundant expression in testis. In human tissues, Leo et al. (1998) detected a 2.1-kb transcript, whereas Stegh et al. (1998) detected a 2.3-kb transcript in all tissues as well as a 4.2-kb transcript in some tissues. By in situ hybridization, Leo et al. (1998) found that rat DEDD mRNA was specifically expressed in male germ cells but not in Sertoli cells. An increase in DEDD mRNA was detected following induction of germ cell apoptosis using a GnRH (OMIM Ref. No. 152760) antagonist. By immunolocalization experiments, Stegh et al. (1998) found that human DEDD localized to the cytoplasm in a nonapoptotic human leukemic cell line, but translocated to the nucleus upon induction of apoptosis, where it colocalized with the nucleolar transcription factor UBTF (OMIM Ref. No. 600673). Through mutation analysis and transient transfection of human kidney cells, Stegh et al.

(1998) found that the N terminus of DEDD induces apoptosis and the C terminus has antiapoptotic activity. Further, FADD (OMIM Ref. No. 602457), one of several DED-containing proteins with which DEDD directly interacts in coimmunoprecipitation experiments, enhances DEDD-mediated apoptosis. Translocation of DEDD to the nuclear compartment requires caspase activation. Stegh et al. (1998) found that recombinant DEDD binds to both DNA and reconstituted mononucleosomes and inhibits rDNA transcription in a reconstituted in vitro system.

Full details of the abovementioned studies are described in the following publications, the disclosure of which are hereby incorporated by reference:

Leo, C. P.; Hsu, S. Y.; McGee, E. A.; Salanova, M.; Hsueh, A. J. W.: DEFT, a novel death effector domain-containing molecule predominantly expressed in testicular germ cells. Endocrinology 139:4839-4848, 1998; and Stegh, A. H.; Schickling, O.; Ehret, A.; Scaffidi, C.; Peterhansel, C.; Hofmann, T. G.; Grummt, I.; Krammer, P. H.; Peter, M. E.: DEDD, a novel death effector domain-containing protein.

Further studies establishing the function and utilities of DEDD are found in John Hopkins OMIM database record ID 606841, and in sited publications numbered 6142-6143 listed in the bibliography section hereinbelow, which are also hereby incorporated by reference. DNA (cytosine-5-)-methyltransferase 3-like (DNMT3L, Accession NM_013369) is another VGAM1189 host target gene. DNMT3L BINDING SITE is HOST TARGET binding site found in the 5" untranslated region of mRNA encoded by DNMT3L, corresponding to a HOST TARGET binding site such as BINDING SITE I, BINDING SITE II or BINDING SITE III. Table 2 illustrates the complementarity of the nucleotide sequences of DNMT3L BINDING SITE, designated SEQ ID:15018, to the nucleotide sequence of VGAM1189 RNA, herein designated VGAM RNA, also designated SEQ ID:3900.

Another function of VGAM1189 is therefore inhibition of DNA (cytosine-5-)-methyltransferase 3-like (DNMT3L, Accession NM_013369), a gene which plays a role in de novo methylation of CpG islands. Accordingly, utilities of VGAM1189 include diagnosis, prevention and treatment of diseases and clinical conditions associated with DNMT3L. The function of DNMT3L and its association with various diseases and clinical conditions, has been established by previous studies, as described hereinabove with reference to VGAM447. Dishevelled, Dsh Homolog 3 (Drosophila) (DVL3, Accession NM_004423) is another VGAM1189 host target gene. DVL3 BINDING SITE is HOST TARGET binding site found in the 3' untranslated region of mRNA encoded by DVL3, corresponding to a HOST TARGET binding site such as BINDING SITE I, BINDING SITE II or BINDING SITE III. Table 2 illustrates the complementarity of the nucleotide sequences of DVL3 BINDING SITE, designated SEQ ID:10693, to the nucleotide sequence of VGAM1189 RNA, herein designated VGAM RNA, also designated SEQ ID:3900.

Another function of VGAM1189 is therefore inhibition of Dishevelled, Dsh Homolog 3 (Drosophila) (DVL3, Accession NM_004423), a gene which regulates cell proliferation. Accordingly, utilities of VGAM1189 include diagnosis, prevention and treatment of diseases and clinical conditions associated with DVL3. The function of DVL3 and its association with various diseases and clinical conditions, has been established by previous studies, as described hereinabove with reference to VGAM57. Ephrin-B1 (EFNB1, Accession NM_004429) is another VGAM1189 host target gene. EFNB1 BINDING SITE is HOST TARGET binding site found in the 3' untranslated region of mRNA encoded by EFNB1, corresponding to a HOST TARGET binding site such as BINDING SITE I, BINDING SITE II or BINDING SITE III. Table 2 illustrates the complementarity of the nucleotide sequences of EFNB1 BINDING SITE, designated SEQ ID:10706, to the nucleotide sequence of VGAM1189 RNA, herein designated VGAM RNA, also designated SEQ ID:3900.

Another function of VGAM1189 is therefore inhibition of Ephrin-B1 (EFNB1, Accession NM_004429), a gene which is a transmembrane ligand of Eph-related receptor tyrosine kinases, has a role in cell adhesion. Accordingly, utilities of VGAM1189 include diagnosis, prevention and treatment of diseases and clinical conditions associated with EFNB1. The function of EFNB1 and its association with various diseases and clinical conditions, has been established by previous studies, as described hereinabove with reference to VGAM390. Ems1 Sequence (mammary tumor and squamous cell carcinoma-associated (p80/85 src substrate) (EMS1, Accession NM_005231) is another VGAM1189 host target gene. EMS1 BINDING SITE1 and EMS1 BINDING SITE2 are HOST TARGET binding sites found in untranslated regions of mRNA encoded by EMS1, corresponding to HOST TARGET binding sites such as BINDING SITE I, BINDING SITE II or BINDING SITE III. Table 2 illustrates the complementarity of the nucleotide sequences of EMS1 BINDING SITE1 and EMS1 BINDING SITE2, designated SEQ ID:11736 and SEQ ID:28867 respectively, to the nucleotide sequence of VGAM1189 RNA, herein designated VGAM RNA, also designated SEQ ID:3900.

Another function of VGAM1189 is therefore inhibition of Ems1 Sequence (mammary tumor and squamous cell carcinoma-associated (p80/85 src substrate) (EMS1, Accession NM_005231), a gene which may contribute to the organization of cell structure. in transformed cells may contribute to cellular growth regulation and transformation. Accordingly, utilities of VGAM1189 include diagnosis, prevention and treatment of diseases and clinical conditions associated with EMS1. The function of EMS1 and its association with various diseases and clinical conditions, has been established by previous studies, as described hereinabove with reference to VGAM497. Endoglin (Osler-Rendu-Weber syndrome 1) (ENG, Accession NM_000118) is another VGAM1189 host target gene. ENG BINDING SITE1 and ENG BINDING SITE2 are HOST TARGET binding sites found in untranslated regions of mRNA encoded by ENG, corresponding to HOST TARGET binding sites such as BINDING SITE I, BINDING SITE II or BINDING SITE III. Table 2 illustrates the complementarity of the nucleotide sequences of ENG BINDING SITE1 and ENG BINDING SITE2, designated SEQ ID:5593 and SEQ ID:21745 respectively, to the nucleotide sequence of VGAM1189 RNA, herein designated VGAM RNA, also designated SEQ ID:3900.

Another function of VGAM1189 is therefore inhibition of Endoglin (Osler-Rendu-Weber syndrome 1) (ENG, Accession NM_000118). Accordingly, utilities of VGAM1189 include diagnosis, prevention and treatment of diseases and clinical conditions associated with ENG. Fatty Acid Amide Hydrolase (FAAH, Accession NM_024306) is another VGAM1189 host target gene. FAAH BINDING SITE is HOST TARGET binding site found in the 5' untranslated region of mRNA encoded by FAAH, corresponding to a HOST TARGET binding site such as BINDING SITE I, BINDING SITE II or BINDING SITE III. Table 2 illustrates the complementarity of the nucleotide sequences of FAAH BINDING SITE, designated SEQ ID:23597, to the nucleotide sequence of VGAM1189 RNA, herein designated VGAM RNA, also designated SEQ ID:3900.

Another function of VGAM1189 is therefore inhibition of Fatty Acid Amide Hydrolase (FAAH, Accession NM_024306), a gene which function as an electron carrier for several membrane bound oxygenases (by similarity). Accordingly, utilities of VGAM1189 include diagnosis, prevention and treatment of diseases and clinical conditions associated with FAAH. The function of FAAH and its association with various diseases and clinical conditions, has been established by previous studies, as described hereinabove with reference to VGAM711. Formin-like (FMNL, Accession NM_005892) is another VGAM1189 host target gene. FMNL BINDING SITE is HOST TARGET binding site found in the 5' untranslated region of mRNA encoded by FMNL, corresponding to a HOST TARGET binding site such as BINDING SITE I, BINDING SITE II or BINDING SITE III. Table 2 illustrates the complementarity of the nucleotide sequences of FMNL BINDING SITE, designated SEQ ID:12511, to the nucleotide sequence of VGAM1189 RNA, herein designated VGAM RNA, also designated SEQ ID:3900.

Another function of VGAM1189 is therefore inhibition of Formin-like (FMNL, Accession NM_005892), a gene which controls the reorganization of the actin cytoskeleton in association with Rac. Accordingly, utilities of VGAM1189 include diagnosis, prevention and treatment of diseases and clinical conditions associated with FMNL. The function of FMNL and its association with various diseases and clinical conditions, has been established by previous studies, as described hereinabove with reference to VGAM615. FBJ Murine Osteosarcoma Viral Oncogene Homolog B (FOSB, Accession NM_006732) is another VGAM1189 host target gene. FOSB BINDING SITE is HOST TARGET binding site found in the 3' untranslated region of mRNA encoded by FOSB, corresponding to a HOST TARGET binding site such as BINDING SITE I, BINDING SITE II or BINDING SITE III. Table 2 illustrates the complementarity of the nucleotide sequences of FOSB BINDING SITE, designated SEQ ID:13582, to the nucleotide sequence of VGAM1189 RNA, herein designated VGAM RNA, also designated SEQ ID:3900.

Another function of VGAM1189 is therefore inhibition of FBJ Murine Osteosarcoma Viral Oncogene Homolog B (FOSB, Accession NM_006732), a gene which interacts with jun proteins enhancing their dna binding activity. Accordingly, utilities of VGAM1189 include diagnosis, prevention and treatment of diseases and clinical conditions associated with FOSB. The function of FOSB and its association with various diseases and clinical conditions, has been established by previous studies, as described hereinabove with reference to VGAM747. Guanine Nucleotide Binding Protein (G protein), Beta Polypeptide 1 (GNB1, Accession NM_002074) is another VGAM1189 host target gene. GNB1 BINDING SITE is HOST TARGET binding site found in the 3' untranslated region of mRNA encoded by GNB1, corresponding to a HOST TARGET binding site such as BINDING SITE I, BINDING SITE II or BINDING SITE III. Table 2 illustrates the complementarity of the nucleotide sequences of GNB1 BINDING SITE, designated SEQ ID:7849, to the nucleotide sequence of VGAM1189 RNA, herein designated VGAM RNA, also designated SEQ ID:3900.

Another function of VGAM1189 is therefore inhibition of Guanine Nucleotide Binding Protein (G protein), Beta Polypeptide 1 (GNB1, Accession NM_002074). Accordingly, utilities of VGAM1189 include diagnosis, prevention and treatment of diseases and clinical conditions associated with GNB1. Glutamate Receptor, Metabotropic 6 (GRM6, Accession NM_000843) is another VGAM1189 host target gene. GRM6 BINDING SITE is HOST TARGET binding site found in the 5' untranslated region of mRNA encoded by GRM6, corresponding to a HOST TARGET binding site such as BINDING SITE I, BINDING SITE II or BINDING SITE III. Table 2 illustrates the complementarity of the nucleotide sequences of GRM6 BINDING SITE, designated SEQ ID:6506, to the nucleotide sequence of VGAM1189 RNA, herein designated VGAM RNA, also designated SEQ ID:3900.

Another function of VGAM1189 is therefore inhibition of Glutamate Receptor, Metabotropic 6 (GRM6, Accession NM_000843). Accordingly, utilities of VGAM1189 include diagnosis, prevention and treatment of diseases and clinical conditions associated with GRM6. GTF2I Repeat Domain Containing 1 (GTF2IRD1, Accession NM_016328) is another VGAM1189 host target gene. GTF2IRD1 BINDING SITE is HOST TARGET binding site found in the 5' untranslated region of mRNA encoded by GTF2IRD1, corresponding to a HOST TARGET binding site such as BINDING SITE I, BINDING SITE II or BINDING SITE III. Table 2 illustrates the complementarity of the nucleotide sequences of GTF2IRD1 BINDING SITE, designated SEQ ID:18451, to the nucleotide sequence of VGAM1189 RNA, herein designated VGAM RNA, also designated SEQ ID:3900.

Another function of VGAM1189 is therefore inhibition of GTF2I Repeat Domain Containing 1 (GTF2IRD1, Accession NM_016328). Accordingly, utilities of VGAM1189 include diagnosis, prevention and treatment of diseases and clinical conditions associated with GTF2IRD1. Hyperpolarization Activated Cyclic Nucleotide-gated Potassium Channel 2 (HCN2, Accession NM_001194) is another VGAM1189 host target gene. HCN2 BINDING SITE is HOST TARGET binding site found in the 3' untranslated region of mRNA encoded by HCN2, corresponding to a HOST TARGET binding site such as BINDING SITE I, BINDING SITE II or BINDING SITE III. Table 2 illustrates the complementarity of the nucleotide sequences of HCN2 BINDING SITE, designated SEQ ID:6864, to the nucleotide sequence of VGAM1189 RNA, herein designated VGAM RNA, also designated SEQ ID:3900.

Another function of VGAM1189 is therefore inhibition of Hyperpolarization Activated Cyclic Nucleotide-gated Potassium Channel 2 (HCN2, Accession NM_001194), a gene which is hyperpolarization-activated cyclic nucleotide-gated cation channel 2 and may act as a pacemaker channel in the brain and the heart. Accordingly, utilities of VGAM1189 include diagnosis, prevention and treatment of diseases and clinical conditions associated with HCN2. The function of HCN2 has been established by previous studies. Ludwig et al. (1999) observed that when expressed in HEK293 cells, HCN2 gives rise to hyperpolarization-activated cation currents with the hallmark features of the native cation current. HCN2 has fast activation kinetics, and Ludwig et al. (1999) concluded that HCN2 may underlie the fast component of the cardiac hyperpolarization-activated cation current. By constructing truncation mutants, Wainger et al. (2001) demonstrated that the CNBD inhibits activation of the core transmembrane domain of HCN family members. Cyclic AMP binding relieves this inhibition. Differences in activation gating and extent of cAMP modulation between the HCN1 and HCN2 isoforms result largely from differences in the efficacy of CNBD inhibition.

Full details of the abovementioned studies are described in the following publications, the disclosure of which are hereby incorporated by reference:

Ludwig, A.; Zong, X.; Stieber, J.; Hullin, R.; Hofmann, F.; Biel, M.: Two pacemaker channels from human heart with profoundly different activation kinetics. EMBO J. 18:2323-2329, 1999; and Santoro, B.; Grant, S. G. N.; Bartsch, D.; Kandel, E. R.: Interactive cloning with the SH3 domain of N-src identifies a new brain specific ion channel protein, with homology to Eag and.

Further studies establishing the function and utilities of HCN2 are found in John Hopkins OMIM database record ID 602781, and in sited publications numbered 7659-765 and 7658 listed in the bibliography section hereinbelow, which are also hereby incorporated by reference. Interleukin 2 Receptor, Beta (IL2RB, Accession NM_000878) is another VGAM1189 host target gene. IL2RB BINDING SITE is HOST TARGET binding site found in the 3" untranslated region of mRNA encoded by IL2RB, corresponding to a HOST TARGET binding site such as BINDING SITE I, BINDING SITE II or BINDING SITE III. Table 2 illustrates the complementarity of the nucleotide sequences of IL2RB BINDING SITE, designated SEQ ID:6570, to the nucleotide sequence of VGAM1189 RNA, herein designated VGAM RNA, also designated SEQ ID:3900.

Another function of VGAM1189 is therefore inhibition of Interleukin 2 Receptor, Beta (IL2RB, Accession NM_000878), a gene which is involved in receptor mediated endocytosis and transduces the mitogenic signals of il-2. Accordingly, utilities of VGAM1189 include diagnosis, prevention and treatment of diseases and clinical conditions associated with IL2RB. The function of IL2RB and its association with various diseases and clinical conditions, has been established by previous studies, as described hereinabove with reference to VGAM450. Interleukin 6 Receptor (IL6R, Accession NM_000565) is another VGAM1189 host target gene. IL6R BINDING SITE is HOST TARGET binding site found in the 5' untranslated region of mRNA encoded by IL6R, corresponding to a HOST TARGET binding site such as BINDING SITE I, BINDING SITE II or BINDING SITE III. Table 2 illustrates the complementarity of the nucleotide sequences of IL6R BINDING SITE, designated SEQ ID:6172, to the nucleotide sequence of VGAM1189 RNA, herein designated VGAM RNA, also designated SEQ ID:3900.

Another function of VGAM1189 is therefore inhibition of Interleukin 6 Receptor (IL6R, Accession NM_000565), a gene which is essential to the regulation of the immune response, hematopoiesis, and acute-phase reactions. Accordingly, utilities of VGAM1189 include diagnosis, prevention and treatment of diseases and clinical conditions associated with IL6R. The function of IL6R has been established by previous studies. Whereas the 0.9-kb IFN-beta-1 mRNA is transcribed from an intron-free IFNB1 gene located on 9p (OMIM Ref. No. 147640), IFN-beta-2 is the translation product of a 1.3-kb mRNA derived from an intron-containing IFNB2 gene not located on chromosome 9. The IFN-beta-2 mRNA does not cross-hybridize with IFN-beta-1 cDNA probes and vice-versa. Sehgal et al. (1986) mapped IFNB2 to chromosome 7 by means of a cDNA clone in blot-hybridization experiments on DNA from a panel of human-rodent somatic cell hybrids. Zilberstein et al. (1986) cloned cDNA for the 1.3-kb RNA designated IFNB2. Expression studies showed that the IFN-beta-2 secreted by DNA-transformed rodent cells is a processed 21-kD protein whose activity is cross-neutralized by antibodies to human IFN-beta-1 but not to alpha or gamma interferon. The biologic significance of IFN-beta-2 lies in the fact that it is induced under conditions in which IFN-beta-1 is not induced, as in metabolically stressed cells. Its induction by IL1 (OMIM Ref. No. 147720) and TNF (OMIM Ref. No. 191160) suggests that it may play a role as an autocrine mediator of some effects of these cytokines in inflammation and acute phase responses, as well as regulate cell proliferation. As discussed by Sehgal et al. (1987), IFNB2 is identical to B-cell differentiation factor (BSF2) and enhances proliferation in hybridoma/plasmacytoma cells. Hirano et al. (1986) reported the molecular cloning, structural analysis, and functional expression of cDNA encoding human BSF2. The primary sequence of BSF2 deduced from the cDNA shows that it has 184 amino acids and is distinct from other interleukins. In addition to its antiviral activity, beta-2 interferon elicits acute phase response in liver cells and is identical to hepatocyte stimulatory factor. It also is identical to hybridoma growth factor. A subset of plasmacytoma (PCT), designated extramedullary PCT, is distinguished from multiple myeloma and solitary PCT of bone by its distribution among various tissue sites but not bone marrow. Extramedullary (extraosseus) PCTs are rare spontaneous neoplasms of mice but are readily induced in a susceptible strain, BALB/c, by treatment with pristane. The tumors develop in peritoneal granulomas and are characterized by Myc-activating t (12;15) chromosomal translocations and, most frequently, by secretion of IgA. To test directly the contribution of IL6 to PCT development, Kovalchuk et al. (2002) generated BALB/c mice carrying a widely expressed IL6 transgene. All mice exhibited lymphoproliferation and plasmacytosis. By 18 months of age, more than half developed readily transplantable PCTs in lymph nodes, Peyer patches, and sometimes spleen. These neoplasms also had the t (12;15) translocations, but remarkably, none expressed IgA. Approximately 30% of the mice developed follicular and diffuse large cell B-cell lymphomas that often coexisted with PCTs. These findings provided a unique model of extramedullary PCT for studies on pathogenesis and treatment and suggested a role for IL6 in the genesis of germinal center-derived lymphomas Full details of the abovementioned studies are described in the following publications, the disclosure of which are hereby incorporated by reference:

Hirano, T.; Yasukawa, K.; Harada, H.; Taga, T.; Watanabe, Y.; Matsuda, T.; Kashiwamura, S.; Nakajima, K.; Koyama, K.; Iwamatsu, A.; Tsunasawa, S.; Sakiyama, F.; Matsui, H.; Takahara, Y.; Taniguchi, T.; Kishimoto, T.: Complementary DNA for a novel human interleukin (BSF-2) that induces B lymphocytes to produce immunoglobulin. Nature 324:73-76, 1986; and Kovalchuk, A. L.; Kim, J. S.; Park, S. S.; Coleman, A. E.; Ward, J. M.; Morse, H. C, III; Kishimoto, T.; Potter, M.; Janz, S.: IL-6 transgenic mouse model for extraosseous plasmacytoma.

Further studies establishing the function and utilities of IL6R are found in John Hopkins OMIM database record ID 147880, and in sited publications numbered 397 and 3976 listed in the bibliography section hereinbelow, which are also hereby incorporated by reference. Integrin, Alpha 4 (antigen CD49D, alpha 4 subunit of VLA-4 receptor) (ITGA4, Accession NM_000885) is another VGAM1189 host target gene. ITGA4 BINDING SITE is HOST TARGET binding site found in the 5' untranslated region of mRNA encoded by ITGA4, corresponding to a HOST TARGET binding site such as BINDING SITE I, BINDING SITE II or BINDING SITE III. Table 2 illustrates the complementarity of the nucleotide sequences of ITGA4 BINDING SITE, designated SEQ ID:6580, to the nucleotide sequence of VGAM1189 RNA, herein designated VGAM RNA, also designated SEQ ID:3900.

Another function of VGAM1189 is therefore inhibition of Integrin, Alpha 4 (antigen CD49D, alpha 4 subunit of VLA-4 receptor) (ITGA4, Accession NM_000885), a gene which recognizes one or more domains within the alternatively spliced cs-1 and cs-5 regions of fibronectin. Accordingly, utilities of VGAM1189 include diagnosis, prevention and treatment of diseases and clinical conditions associated with ITGA4. The function of ITGA4 and its association with various diseases and clinical conditions, has been established by previous studies, as described hereinabove with reference to VGAM1096. Integrin, Beta 4 (ITGB4, Accession NM_000213) is another VGAM1189 host target gene. ITGB4 BINDING SITE is HOST TARGET binding site found in the 5' untranslated region of mRNA encoded by ITGB4, corresponding to a HOST TARGET binding site such as BINDING SITE I, BINDING SITE II or BINDING SITE III. Table 2 illustrates the complementarity of the nucleotide sequences of ITGB4 BINDING SITE, designated SEQ ID:5710, to the nucleotide sequence of VGAM1189 RNA, herein designated VGAM RNA, also designated SEQ ID:3900.

Another function of VGAM1189 is therefore inhibition of Integrin, Beta 4 (ITGB4, Accession NM_000213), a gene which plays a critical structural role in the hemidesmosome of epithelial cells. Accordingly, utilities of VGAM1189 include diagnosis, prevention and treatment of diseases and clinical conditions associated with ITGB4. The function of ITGB4 has been established by previous studies. Integrins are transmembrane glycoprotein receptors that mediate cell-matrix or cell-cell adhesion, and transduced signals that regulate gene expression and cell growth (Vidal et al., 1995). These heterodimeric molecules consist of noncovalently linked alpha and beta subunits. Different combinations of alpha and beta polypeptides form complexes that vary in their ligand-binding specificities. Both alpha and beta subunits display a cytoplasmic domain that interacts with the cytoskeleton (and possibly signaling molecules), a transmembrane region, and a large extracellular domain that interacts with the extracellular matrix. Leukocyte adhesion deficiency is due to a defect in the integrin beta-2 chain (OMIM Ref. No. 600065) and Glanzmann thrombasthenia (OMIM Ref. No. 273800) is also due to mutation in an integrin gene. In the human epidermis, basal keratinocytes express integrins alpha-2/beta-1, alpha-3/beta-1, and alpha-6/beta-4. The first 2 of these are located primarily at the lateral surface of these cells, suggesting a role in cell-cell interaction, whereas the third, alpha-6/beta-4, is restricted to the ventral surface opposed to the basal membrane zone, suggestive of its role in cell-matrix adhesion. Consistent with this possibility, alpha-6/beta-4 is found to be associated with the hemidesmosomes in stratified and transitional epithelia. Hemidesmosomes are dense cytoplasmic plaques that mediate the attachment of stratified squamous epithelium to the underlying dermis by connecting with the extracellular anchoring filaments of the basement membrane. Epidermolysis bullosa of the junctional Herlitz type has been related to mutations in each of the 3 genes encoding laminin 5: LAMC2 (OMIM Ref. No. 150292), LAMB3 (OMIM Ref. No. 150310), and a third component. In a case of junctional epidermolysis bullosa associated with pyloric atresia (OMIM Ref. No. 226730), Vidal et al. (1995) found no mutation in any of these genes but identified a mutation in the ITGB4 gene; indeed, they found 2 mutations in the compound heterozygous patient (147557.0001 and 147557.0002). Nakano et al. (2001) identified 11 novel mutations in ITGB4 in patients with epidermolysis bullosa with congenital pyloric atresia. Four mutations predicted a premature termination codon and 7 were missense mutations. Of the 33 mutations reported to that time, those causing premature termination codons were associated with the lethal variant, whereas missense mutations were more prevalent in nonlethal forms. In general, indirect immunofluorescent studies of affected skin revealed negative staining for beta-4 integrin in lethal cases and positive, but attenuated, staining in nonlethal cases and correlated with clinical phenotype Full details of the abovementioned studies are described in the following publications, the disclosure of which are hereby incorporated by reference:

Vidal, F.; Aberdam, D.; Miquel, C.; Christiano, A. M.; Pulkkinen, L.; Uitto, J.; Ortonne, J.-P.; Meneguzzi, G.: Integrin beta-4 mutations associated with junctional epidermolysis bullosa with pyloric atresia. Nature Genet. 10:229-234, 1995; and Nakano, A.; Pulkkinen, L.; Murrell, D.; Rico, J.; Lucky, A. W.; Garzon, M.; Stevens, C. A.; Robertson, S.; Pfendner, E.; Uitto, J.: Epidermolysis bullosa with congenital pyloric atresia.

Further studies establishing the function and utilities of ITGB4 are found in John Hopkins OMIM database record ID 147557, and in sited publications numbered 4477, 4478-4479, 3 and 12517-12522 listed in the bibliography section hereinbelow, which are also hereby incorporated by reference. Ladinin 1 (LAD1, Accession NM_005558) is another VGAM1189 host target gene. LAD1 BINDING SITE is HOST TARGET binding site found in the 3' untranslated region of mRNA encoded by LAD1, corresponding to a HOST TARGET binding site such as BINDING SITE I, BINDING SITE II or BINDING SITE III. Table 2 illustrates the complementarity of the nucleotide sequences of LAD1 BINDING SITE, designated SEQ ID:12085, to the nucleotide sequence of VGAM1189 RNA, herein designated VGAM RNA, also designated SEQ ID:3900.

Another function of VGAM1189 is therefore inhibition of Ladinin 1 (LAD1, Accession NM_005558). Accordingly, utilities of VGAM1189 include diagnosis, prevention and treatment of diseases and clinical conditions associated with LAD1. LIM Domain Kinase 1 (LIMK1, Accession NM_016735) is another VGAM1189 host target gene. LIMK1 BINDING SITE is HOST TARGET binding site found in the 3' untranslated region of mRNA encoded by LIMK1, corresponding to a HOST TARGET binding site such as BINDING SITE I, BINDING SITE II or BINDING SITE III. Table 2 illustrates the complementarity of the nucleotide sequences of LIMK1 BINDING SITE, designated SEQ ID:18796, to the nucleotide sequence of VGAM1189 RNA, herein designated VGAM RNA, also designated SEQ ID:3900.

Another function of VGAM1189 is therefore inhibition of LIM Domain Kinase 1 (LIMK1, Accession NM_016735). Accordingly, utilities of VGAM1189 include diagnosis, prevention and treatment of diseases and clinical conditions associated with LIMK1. Lipin 2 (LPIN2, Accession NM_014646) is another VGAM1189 host target gene. LPIN2 BINDING SITE is HOST TARGET binding site found in the 3' untranslated region of mRNA encoded by LPIN2, corresponding to a HOST TARGET binding site such as BINDING SITE I, BINDING SITE II or BINDING SITE III. Table 2 illustrates the complementarity of the nucleotide sequences of LPIN2 BINDING SITE, designated SEQ ID:16061, to the nucleotide sequence of VGAM1189 RNA, herein designated VGAM RNA, also designated SEQ ID:3900.

Another function of VGAM1189 is therefore inhibition of Lipin 2 (LPIN2, Accession NM_014646). Accordingly, utilities of VGAM1189 include diagnosis, prevention and treatment of diseases and clinical conditions associated with LPIN2. Megalencephalic Leukoencephalopathy with Subcortical Cysts 1 (MLC1, Accession NM_015166) is another VGAM1189 host target gene. MLC1 BINDING SITE1 and MLC1 BINDING SITE2 are HOST TARGET binding sites found in untranslated regions of mRNA encoded by MLC1, corresponding to HOST TARGET binding sites such as BINDING SITE I, BINDING SITE II or BINDING SITE III. Table 2 illustrates the complementarity of the nucleotide sequences of MLC1 BINDING SITE1 and MLC1 BINDING SITE2, designated SEQ ID:17522 and SEQ ID:29216 respectively, to the nucleotide sequence of VGAM1189 RNA, herein designated VGAM RNA, also designated SEQ ID:3900.

Another function of VGAM1189 is therefore inhibition of Megalencephalic Leukoencephalopathy with Subcortical Cysts 1 (MLC1, Accession NM_015166). Accordingly, utilities of VGAM1189 include diagnosis, prevention and treatment of diseases and clinical conditions associated with MLC1. Pleckstrin and Sec7 Domain Protein (PSD, Accession NM_002779) is another VGAM1189 host target gene. PSD BINDING SITE is HOST TARGET binding site found in the 5' untranslated region of mRNA encoded by PSD, corresponding to a HOST TARGET binding site such as BINDING SITE I, BINDING SITE II or BINDING SITE III. Table 2 illustrates the complementarity of the nucleotide sequences of PSD BINDING SITE, designated SEQ ID:8669, to the nucleotide sequence of VGAM1189 RNA, herein designated VGAM RNA, also designated SEQ ID:3900.

Another function of VGAM1189 is therefore inhibition of Pleckstrin and Sec7 Domain Protein (PSD, Accession NM_002779), a gene which promotes guanine-nucleotide exchange on arf6. Accordingly, utilities of VGAM1189 include diagnosis, prevention and treatment of diseases and clinical conditions associated with PSD. The function of PSD and its association with various diseases and clinical conditions, has been established by previous studies, as described hereinabove with reference to VGAM261. Parathymosin (PTMS, Accession NM_002824) is another VGAM1189 host target gene. PTMS BINDING SITE is HOST TARGET binding site found in the 5' untranslated region of mRNA encoded by PTMS, corresponding to a HOST TARGET binding site such as BINDING SITE I, BINDING SITE II or BINDING SITE III. Table 2 illustrates the complementarity of the nucleotide sequences of PTMS BINDING SITE, designated SEQ ID:8694, to the nucleotide sequence of VGAM1189 RNA, herein designated VGAM RNA, also designated SEQ ID:3900.

Another function of VGAM1189 is therefore inhibition of Parathymosin (PTMS, Accession NM_002824), a gene which is involved in the regulation of cellular immunity. Accordingly, utilities of VGAM1189 include diagnosis, prevention and treatment of diseases and clinical conditions associated with PTMS. The function of PTMS and its association with various diseases and clinical conditions, has been established by previous studies, as described hereinabove with reference to VGAM200. Pvt1 Oncogene Homolog, MYC Activator (mouse) (PVT1, Accession XM_037656) is another VGAM1189 host target gene. PVT1 BINDING SITE is HOST TARGET binding site found in the 3' untranslated region of mRNA encoded by PVT1, corresponding to a HOST TARGET binding site such as BINDING SITE I, BINDING SITE II or BINDING SITE III. Table 2 illustrates the complementarity of the nucleotide sequences of PVT1 BINDING SITE, designated SEQ ID:32661, to the nucleotide sequence of VGAM1189 RNA, herein designated VGAM RNA, also designated SEQ ID:3900.

Another function of VGAM1189 is therefore inhibition of Pvt1 Oncogene Homolog, MYC Activator (mouse) (PVT1, Accession XM_037656). Accordingly, utilities of VGAM1189 include diagnosis, prevention and treatment of diseases and clinical conditions associated with PVT1. PYGO2 (Accession XM_034083) is another VGAM1189 host target gene. PYGO2 BINDING SITE is HOST TARGET binding site found in the 3' untranslated region of mRNA encoded by PYGO2, corresponding to a HOST TARGET binding site such as BINDING SITE I, BINDING SITE II or BINDING SITE III. Table 2 illustrates the complementarity of the nucleotide sequences of PYGO2 BINDING SITE, designated SEQ ID:31998, to the nucleotide sequence of VGAM1189 RNA, herein designated VGAM RNA, also designated SEQ ID:3900.

Another function of VGAM1189 is therefore inhibition of PYGO2 (Accession XM_034083). Accordingly, utilities of VGAM1189 include diagnosis, prevention and treatment of diseases and clinical conditions associated with PYGO2. Scratch Homolog 1, Zinc Finger Protein (Drosophila) (SCRT1, Accession NM_031309) is another VGAM1189 host target gene. SCRT1 BINDING SITE is HOST TARGET binding site found in the 3' untranslated region of mRNA encoded by SCRT1, corresponding to a HOST TARGET binding site such as BINDING SITE I, BINDING SITE II or BINDING SITE III. Table 2 illustrates the complementarity of the nucleotide sequences of SCRT1 BINDING SITE, designated SEQ ID:25345, to the nucleotide sequence of VGAM1189 RNA, herein designated VGAM RNA, also designated SEQ ID:3900.

Another function of VGAM1189 is therefore inhibition of Scratch Homolog 1, Zinc Finger Protein (Drosophila) (SCRT1, Accession NM_031309), a gene which is involved in the generation and migration of neural crest cells. Accordingly, utilities of VGAM1189 include diagnosis, prevention and treatment of diseases and clinical conditions associated with SCRT1. The function of SCRT1 has been established by previous studies. Nakakura et al. (2001) isolated human SCRT from an adult brain cDNA library. The SCRT cDNA encodes a protein of 348 amino acids. Human SCRT shares 81% and 69% identity to Drosophila Scrt and Caenorhabditis elegans neuronal antiapoptotic protein, CES-1, respectively, across the 5-zinc finger domain, and 92% overall amino acid identity with mouse Scrt. Northern blot analysis detected SCRT expression in adult brain, but not in other tissues. In situ hybridization of mouse tissues demonstrated expression of Scrt predominantly confined to the brain and spinal cord, appearing in newly differentiating, postmitotic neurons and persisting into postnatal life. Additional expression was seen in the retina and, significantly, in neuroendocrine cells of the lung. In a parallel fashion, Nakakura et al. (2001) detected SCRT expression by RT-PCR in lung cancers with neuroendocrine features, especially small cell lung cancer. SCRT shares the capacity of other Snail family members to bind to E-box enhancer motifs, which are targets of basic helix-loop-helix (bHLH) transcription factors. Nakakura et al. (2001) showed that SCRT directly antagonizes the function of heterodimers of the proneural bHLH protein achaete-scute homolog-1 (ASCL1; 100790) and E12 (see OMIM Ref. No. 147141), leading to active transcriptional repression at E-box motifs. Nakakura et al. (2001) concluded that SCRT has the potential to function in newly differentiating, postmitotic neurons and in cancers with neuroendocrine features by modulating the action of bHLH transcription factors critical for neuronal differentiation.

Full details of the abovementioned studies are described in the following publications, the disclosure of which are hereby incorporated by reference:

Nakakura, E. K.; Watkins, D. N.; Schuebel, K. E.; Sriuranpong, V.; Borges, M. W.; Nelkin, B. D.; Ball, D. W.: Mammalian Scratch: a neural-specific Snail family transcriptional repressor. Proc. Nat. Acad. Sci. 98:4010-4015, 2001; and Scott, A. F.: Personal Communication. Baltimore, Md., Jun. 21, 2001.

Further studies establishing the function and utilities of SCRT1 are found in John Hopkins OMIM database record ID 605858, and in sited publications numbered 6780-6781 listed in the bibliography section hereinbelow, which are also hereby incorporated by reference. Solute Carrier Family 12 (potassium/chloride transporters), Member 7 (SLC12A7, Accession NM_006598) is another VGAM1189 host target gene. SLC12A7 BINDING SITE is HOST TARGET binding site found in the 3' untranslated region of mRNA encoded by SLC12A7, corresponding to a HOST TARGET binding site such as BINDING SITE I, BINDING SITE II or BINDING SITE III. Table 2 illustrates the complementarity of the nucleotide sequences of SLC12A7 BINDING SITE, designated SEQ ID:13373, to the nucleotide sequence of VGAM1189 RNA, herein designated VGAM RNA, also designated SEQ ID:3900.

Another function of VGAM1189 is therefore inhibition of Solute Carrier Family 12 (potassium/chloride transporters), Member 7 (SLC12A7, Accession NM_006598), a gene which is a potassium/chloride-cotransporter. Accordingly, utilities of VGAM1189 include diagnosis, prevention and treatment of diseases and clinical conditions associated with SLC12A7. The function of SLC12A7 and its association with various diseases and clinical conditions, has been established by previous studies, as described hereinabove with reference to VGAM200. Solute Carrier Family 6 (neurotransmitter transporter, creatine), Member 8 (SLC6A8, Accession NM_005629) is another VGAM1189 host target gene. SLC6A8 BINDING SITE is HOST TARGET binding site found in the 3' untranslated region of mRNA encoded by SLC6A8, corresponding to a HOST TARGET binding site such as BINDING SITE I, BINDING SITE II or BINDING SITE III. Table 2 illustrates the complementarity of the nucleotide sequences of SLC6A8 BINDING SITE, designated SEQ ID:12146, to the nucleotide sequence of VGAM1189 RNA, herein designated VGAM RNA, also designated SEQ ID:3900.

Another function of VGAM1189 is therefore inhibition of Solute Carrier Family 6 (neurotransmitter transporter, creatine), Member 8 (SLC6A8, Accession NM_005629). Accordingly, utilities of VGAM1189 include diagnosis, prevention and treatment of diseases and clinical conditions associated with SLC6A8. Synaptogyrin 1 (SYNGR1, Accession NM_004711) is another VGAM1189 host target gene. SYNGR1 BINDING SITE is HOST TARGET binding site found in the 3' untranslated region of mRNA encoded by SYNGR1, corresponding to a HOST TARGET binding site such as BINDING SITE I, BINDING SITE II or BINDING SITE III. Table 2 illustrates the complementarity of the nucleotide sequences of SYNGR1 BINDING SITE, designated SEQ ID:11063, to the nucleotide sequence of VGAM1189 RNA, herein designated VGAM RNA, also designated SEQ ID:3900.

Another function of VGAM1189 is therefore inhibition of Synaptogyrin 1 (SYNGR1, Accession NM_004711), a gene which belongs to transmembrane synaptic vesicle protein and may function in membrane recycling. Accordingly, utilities of VGAM1189 include diagnosis, prevention and treatment of diseases and clinical conditions associated with SYNGR1. The function of SYNGR1 and its association with various diseases and clinical conditions, has been established by previous studies, as described hereinabove with reference to VGAM107. Transcription Factor 1, Hepatic; LF-B1, Hepatic Nuclear Factor (HNF1), Albumin Proximal Factor (TCF1, Accession NM_000545) is another VGAM1189 host target gene. TCF1 BINDING SITE is HOST TARGET binding site found in the 3' untranslated region of mRNA encoded by TCF1, corresponding to a HOST TARGET binding site such as BINDING SITE I, BINDING SITE II or BINDING SITE III. Table 2 illustrates the complementarity of the nucleotide sequences of TCF1 BINDING SITE, designated SEQ ID:6145, to the nucleotide sequence of VGAM1189 RNA, herein designated VGAM RNA, also designated SEQ ID:3900.

Another function of VGAM1189 is therefore inhibition of Transcription Factor 1, Hepatic; LF-B1, Hepatic Nuclear Factor (HNF1), Albumin Proximal Factor (TCF1, Accession NM_000545), a gene which is required for the expression of several liver specific genes. binds to the inverted palindrome 5'-gttaatnattaac-3'. Accordingly, utilities of VGAM1189 include diagnosis, prevention and treatment of diseases and clinical conditions associated with TCF1. The function of TCF1 has been established by previous studies. The orderly and sequential activation of genes during development is thought to be related to the selective expression of groups of regulatory proteins acting primarily at the level of transcription. Courtois et al. (1987) found a nuclear protein in hepatocytes, but not in other cell types, that binds to a sequence required for hepatocyte-specific transcription of the genes for the alpha and beta chains of fibrinogen (134820, 134830) and alpha-1-antitrypsin (OMIM Ref. No. 107400). This protein, called hepatocyte nuclear factor-1 (HNF1) by them, interacts with sequences required for optimal promoter function of the genes mentioned. The promoter or enhancer regions for several viral and cellular genes not expressed in the liver did not compete for binding to these sequences. HNF1 is predominantly expressed in liver and kidney. The restricted expression of HNF1 and its selective interaction with the control regions of several liver-specific genes suggested to Courtois et al. (1987) that it is involved in developmentally regulated gene expression in the liver. HNF1 binds to the promoters of a variety of genes that are expressed exclusively in the liver, e.g., fibrinogen-alpha and -beta, albumin (OMIM Ref. No. 103600), alpha-fetoprotein (OMIM Ref. No. 104150), alpha-1-antitrypsin, liver-type pyruvate kinase (OMIM Ref. No. 266200), transthyretin (OMIM Ref. No. 176300), aldolase B (OMIM Ref. No. 229600), and hepatitis B virus large surface protein. The amino acid sequence of HNF1 displays distant sequence homology to the homeodomains of homeotic genes (see OMIM Ref. No. 142950). Animal model experiments lend further support to the function of TCF1. Gonzalez et al. (1990) found that newborn mice homozygous for a 1.2-cM deletion of chromosome 7 do not show the increased activity of CYP2E (OMIM Ref. No. 124040), which is regulated by the transcription factor Hnf1. They suggested that the deleted region of chromosome 7 contains a gene encoding a transacting factor that is epistatic in a regulatory cascade that includes Hnf1 gene expression.

It is appreciated that the abovementioned animal model for TCF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Courtois, G.; Morgan, J. G.; Campbell, L. A.; Fourel, G.; Crabtree, G. R.: Interaction of a liver-specific nuclear factor with the fibrinogen and alpha-1-antitrypsin promoters. Science 238:688-692, 1987; and Gonzalez, F. J.; Liu, S.-Y.; Kozak, C. A.; Nebert, D. W.: Decreased Hnf-1 gene expression in mice homozygous for a 1.2-centimorgan deletion on chromosome 7. DNA Cell Biol. 9:771-776.

Further studies establishing the function and utilities of TCF1 are found in John Hopkins OMIM database record ID 142410, and in sited publications numbered 4979, 5201-435, 12032-448, 4365-450, 11556-1155 and 12288-11564 listed in the bibliography section hereinbelow, which are also hereby incorporated by reference. Transcription Factor 7 (T-cell specific, HMG-box) (TCF7, Accession NM_003202) is another VGAM1189 host target gene. TCF7 BINDING SITE is HOST TARGET binding site found in the 3' untranslated region of mRNA encoded by TCF7, corresponding to a HOST TARGET binding site such as BINDING SITE I, BINDING SITE II or BINDING SITE III. Table 2 illustrates the complementarity of the nucleotide sequences of TCF7 BINDING SITE, designated SEQ ID:9192, to the nucleotide sequence of VGAM1189 RNA, herein designated VGAM RNA, also designated SEQ ID:3900.

Another function of VGAM1189 is therefore inhibition of Transcription Factor 7 (T-cell specific, HMG-box) (TCF7, Accession NM_003202). Accordingly, utilities of VGAM1189 include diagnosis, prevention and treatment of diseases and clinical conditions associated with TCF7. Transforming Growth Factor, Beta 1 (Camurati-Engelmann disease) (TGFB1, Accession NM_000660) is another VGAM1189 host target gene. TGFB1 BINDING SITE is HOST TARGET binding site found in the 3' untranslated region of mRNA encoded by TGFB1, corresponding to a HOST TARGET binding site such as BINDING SITE I, BINDING SITE II or BINDING SITE III. Table 2 illustrates the complementarity of the nucleotide sequences of TGFB1 BINDING SITE, designated SEQ ID:6319, to the nucleotide sequence of VGAM1189 RNA, herein designated VGAM RNA, also designated SEQ ID:3900.

Another function of VGAM1189 is therefore inhibition of Transforming Growth Factor, Beta 1 (Camurati-Engelmann disease) (TGFB1, Accession NM_000660). Accordingly, utilities of VGAM1189 include diagnosis, prevention and treatment of diseases and clinical conditions associated with TGFB1. Tumor Necrosis Factor, Alpha-induced Protein 2 (TNFAIP2, Accession NM_006291) is another VGAM1189 host target gene. TNFAIP2 BINDING SITE is HOST TARGET binding site found in the 3' untranslated region of mRNA encoded by TNFAIP2, corresponding to a HOST TARGET binding site such as BINDING SITE I, BINDING SITE II or BINDING SITE III. Table 2 illustrates the complementarity of the nucleotide sequences of TNFAIP2 BINDING SITE, designated SEQ ID:12981, to the nucleotide sequence of VGAM1189 RNA, herein designated VGAM RNA, also designated SEQ ID:3900.

Another function of VGAM1189 is therefore inhibition of Tumor Necrosis Factor, Alpha-induced Protein 2 (TNFAIP2, Accession NM_006291). Accordingly, utilities of VGAM1189 include diagnosis, prevention and treatment of diseases and clinical conditions associated with TNFAIP2. Upstream Binding Transcription Factor, RNA Polymerase I (UBTF, Accession NM_014233) is another VGAM1189 host target gene. UBTF BINDING SITE is HOST TARGET binding site found in the 3' untranslated region of mRNA encoded by UBTF, corresponding to a HOST TARGET binding site such as BINDING SITE I, BINDING SITE II or BINDING SITE III. Table 2 illustrates the complementarity of the nucleotide sequences of UBTF BINDING SITE, designated SEQ ID:15496, to the nucleotide sequence of VGAM1189 RNA, herein designated VGAM RNA, also designated SEQ ID:3900.

Another function of VGAM1189 is therefore inhibition of Upstream Binding Transcription Factor, RNA Polymerase I (UBTF, Accession NM_014233), a gene which recognizes the ribosomal rna gene promoter and activates transcription. Accordingly, utilities of VGAM1189 include diagnosis, prevention and treatment of diseases and clinical conditions associated with UBTF. The function of UBTF and its association with various diseases and clinical conditions, has been established by previous studies, as described hereinabove with reference to VGAM626. Zinc Finger Protein 42 (myeloid-specific retinoic acid- responsive) (ZNF42, Accession NM_003422) is another VGAM1189 host target gene. ZNF42 BINDING SITE is HOST TARGET binding site found in the 5' untranslated region of mRNA encoded by ZNF42, corresponding to a HOST TARGET binding site such as BINDING SITE I, BINDING SITE II or BINDING SITE III. Table 2 illustrates the complementarity of the nucleotide sequences of ZNF42 BINDING SITE, designated SEQ ID:9466, to the nucleotide sequence of VGAM1189 RNA, herein designated VGAM RNA, also designated SEQ ID:3900.

Another function of VGAM1189 is therefore inhibition of Zinc Finger Protein 42 (myeloid-specific retinoic acid- responsive) (ZNF42, Accession NM_003422), a gene which may be one regulator of transcriptional events during hemopoietic development. Accordingly, utilities of VGAM1189 include diagnosis, prevention and treatment of diseases and clinical conditions associated with ZNF42. The function of ZNF42 and its association with various diseases and clinical conditions, has been established by previous studies, as described hereinabove with reference to VGAM173.1-acylglycerol-3-phosphate O-acyltransferase 1 (lysophosphatidic acid acyltransferase, alpha) (AGPAT1, Accession NM_006411) is another VGAM1189 host target gene. AGPAT1 BINDING SITE1 and AGPAT1 BINDING SITE2 are HOST TARGET binding sites found in untranslated regions of mRNA encoded by AGPAT1, corresponding to HOST TARGET binding sites such as BINDING SITE I, BINDING SITE II or BINDING SITE III. Table 2 illustrates the complementarity of the nucleotide sequences of AGPAT1 BINDING SITE1 and AGPAT1 BINDING SITE2, designated SEQ ID:13116 and SEQ ID:26472 respectively, to the nucleotide sequence of VGAM1189 RNA, herein designated VGAM RNA, also designated SEQ ID:3900.

Another function of VGAM1189 is therefore inhibition of 1-acylglycerol-3-phosphate O-acyltransferase 1 (lysophosphatidic acid acyltransferase, alpha) (AGPAT1, Accession NM_006411). Accordingly, utilities of VGAM1189 include diagnosis, prevention and treatment of diseases and clinical conditions associated with AGPAT1. Chromosome 5 Open Reading Frame 6 (C5orf6, Accession NM_016605) is another VGAM1189 host target gene. C5orf6 BINDING SITE is HOST TARGET binding site found in the 3' untranslated region of mRNA encoded by C5orf6, corresponding to a HOST TARGET binding site such as BINDING SITE I, BINDING SITE II or BINDING SITE III. Table 2 illustrates the complementarity of the nucleotide sequences of C5orf6 BINDING SITE, designated SEQ ID:18700, to the nucleotide sequence of VGAM1189 RNA, herein designated VGAM RNA, also designated SEQ ID:3900.

Another function of VGAM1189 is therefore inhibition of Chromosome 5 Open Reading Frame 6 (C5orf6, Accession NM_016605). Accordingly, utilities of VGAM1189 include diagnosis, prevention and treatment of diseases and clinical conditions associated with C5orf6. Chromosome 8 Open Reading Frame 2 (C8orf2, Accession NM_007175) is another VGAM1189 host target gene. C8orf2 BINDING SITE is HOST TARGET binding site found in the 3' untranslated region of mRNA encoded by C8orf2, corresponding to a HOST TARGET binding site such as BINDING SITE I, BINDING SITE II or BINDING SITE III. Table 2 illustrates the complementarity of the nucleotide sequences of C8orf2 BINDING SITE, designated SEQ ID:14021, to the nucleotide sequence of VGAM1189 RNA, herein designated VGAM RNA, also designated SEQ ID:3900.

Another function of VGAM1189 is therefore inhibition of Chromosome 8 Open Reading Frame 2 (C8orf2, Accession NM_007175). Accordingly, utilities of VGAM1189 include diagnosis, prevention and treatment of diseases and clinical conditions associated with C8orf2. Cab45 (Accession NM_016176) is another VGAM1189 host target gene. Cab45 BINDING SITE is HOST TARGET binding site found in the 3' untranslated region of mRNA encoded by Cab45, corresponding to a HOST TARGET binding site such as BINDING SITE I, BINDING SITE II or BINDING SITE III. Table 2 illustrates the complementarity of the nucleotide sequences of Cab45 BINDING SITE, designated SEQ ID:18277, to the nucleotide sequence of VGAM1189 RNA, herein designated VGAM RNA, also designated SEQ ID:3900.

Another function of VGAM1189 is therefore inhibition of Cab45 (Accession NM_016176). Accordingly, utilities of VGAM1189 include diagnosis, prevention and treatment of diseases and clinical conditions associated with Cab45. Chromobox Homolog 6 (CBX6, Accession NM_014292) is another VGAM1189 host target gene. CBX6 BINDING SITE is HOST TARGET binding site found in the 3' untranslated region of mRNA encoded by CBX6, corresponding to a HOST TARGET binding site such as BINDING SITE I, BINDING SITE II or BINDING SITE III. Table 2 illustrates the complementarity of the nucleotide sequences of CBX6 BINDING SITE, designated SEQ ID:15574, to the nucleotide sequence of VGAM1189 RNA, herein designated VGAM RNA, also designated SEQ ID:3900.

Another function of VGAM1189 is therefore inhibition of Chromobox Homolog 6 (CBX6, Accession NM_014292). Accordingly, utilities of VGAM1189 include diagnosis, prevention and treatment of diseases and clinical conditions associated with CBX6. Cell Division Cycle Associated 4 (CDCA4, Accession NM_017955) is another VGAM1189 host target gene. CDCA4 BINDING SITE is HOST TARGET binding site found in the 3' untranslated region of mRNA encoded by CDCA4, corresponding to a HOST TARGET binding site such as BINDING SITE I, BINDING SITE II or BINDING SITE III. Table 2 illustrates the complementarity of the nucleotide sequences of CDCA4 BINDING SITE, designated SEQ ID:19661, to the nucleotide sequence of VGAM1189 RNA, herein designated VGAM RNA, also designated SEQ ID:3900.

Another function of VGAM1189 is therefore inhibition of Cell Division Cycle Associated 4 (CDCA4, Accession NM_017955). Accordingly, utilities of VGAM1189 include diagnosis, prevention and treatment of diseases and clinical conditions associated with CDCA4. Complexin 1 (CPLX1, Accession NM_006651) is another VGAM1189 host target gene. CPLX1 BINDING SITE is HOST TARGET binding site found in the 3' untranslated region of mRNA encoded by CPLX1, corresponding to a HOST TARGET binding site such as BINDING SITE I, BINDING SITE II or BINDING SITE III. Table 2 illustrates the complementarity of the nucleotide sequences of CPLX1 BINDING SITE, designated SEQ ID:13447, to the nucleotide sequence of VGAM1189 RNA, herein designated VGAM RNA, also designated SEQ ID:3900.

Another function of VGAM1189 is therefore inhibition of Complexin 1 (CPLX1, Accession NM_006651). Accordingly, utilities of VGAM1189 include diagnosis, prevention and treatment of diseases and clinical conditions associated with CPLX1. Cysteine-rich with EGF-like Domains 1 (CRELD1, Accession NM_015513) is another VGAM1189 host target gene. CRELD1 BINDING SITE is HOST TARGET binding site found in the 5' untranslated region of mRNA encoded by CRELD1, corresponding to a HOST TARGET binding site such as BINDING SITE I, BINDING SITE II or BINDING SITE III. Table 2 illustrates the complementarity of the nucleotide sequences of CRELD1 BINDING SITE, designated SEQ ID:17774, to the nucleotide sequence of VGAM1189 RNA, herein designated VGAM RNA, also designated SEQ ID:3900.

Another function of VGAM1189 is therefore inhibition of Cysteine-rich with EGF-like Domains 1 (CRELD1, Accession NM_015513). Accordingly, utilities of VGAM1189 include diagnosis, prevention and treatment of diseases and clinical conditions associated with CRELD1. CXYorf1 (Accession XM_088704) is another VGAM1189 host target gene. CXYorf1 BINDING SITE is HOST TARGET binding site found in the 3' untranslated region of mRNA encoded by CXYorf1, corresponding to a HOST TARGET binding site such as BINDING SITE I, BINDING SITE II or BINDING SITE III. Table 2 illustrates the complementarity of the nucleotide sequences of CXYorf1 BINDING SITE, designated SEQ ID:39905, to the nucleotide sequence of VGAM1189 RNA, herein designated VGAM RNA, also designated SEQ ID:3900.

Another function of VGAM1189 is therefore inhibition of CXYorf1 (Accession XM_088704). Accordingly, utilities of VGAM1189 include diagnosis, prevention and treatment of diseases and clinical conditions associated with CXYorf1. Doublecortin and CaM Kinase-like 1 (DCAMKL1, Accession NM_004734) is another VGAM1189 host target gene. DCAMKL1 BINDING SITE is HOST TARGET binding site found in the 5' untranslated region of mRNA encoded by DCAMKL1, corresponding to a HOST TARGET binding site such as BINDING SITE I, BINDING SITE II or BINDING SITE III. Table 2 illustrates the complementarity of the nucleotide sequences of DCAMKL1 BINDING SITE, designated SEQ ID:11114, to the nucleotide sequence of VGAM1189 RNA, herein designated VGAM RNA, also designated SEQ ID:3900.

Another function of VGAM1189 is therefore inhibition of Doublecortin and CaM Kinase-like 1 (DCAMKL1, Accession NM_004734). Accordingly, utilities of VGAM1189 include diagnosis, prevention and treatment of diseases and clinical conditions associated with DCAMKL1. DKFZp434C0328 (Accession NM_017577) is another VGAM1189 host target gene. DKFZp434C0328 BINDING SITE is HOST TARGET binding site found in the 5' untranslated region of mRNA encoded by DKFZp434C0328, corresponding to a HOST TARGET binding site such as BINDING SITE I, BINDING SITE II or BINDING SITE III. Table 2 illustrates the complementarity of the nucleotide sequences of DKFZp434C0328 BINDING SITE, designated SEQ ID:19010, to the nucleotide sequence of VGAM1189 RNA, herein designated VGAM RNA, also designated SEQ ID:3900.

Another function of VGAM1189 is therefore inhibition of DKFZp434C0328 (Accession NM_017577). Accordingly, utilities of VGAM1189 include diagnosis, prevention and treatment of diseases and clinical conditions associated with DKFZp434C0328. Ephrin-A5 (EFNA5, Accession NM_001962) is another VGAM1189 host target gene. EFNA5 BINDING SITE is HOST TARGET binding site found in the 3' untranslated region of mRNA encoded by EFNA5, corresponding to a HOST TARGET binding site such as BINDING SITE I, BINDING SITE II or BINDING SITE III. Table 2 illustrates the complementarity of the nucleotide sequences of EFNA5 BINDING SITE, designated SEQ ID:7685, to the nucleotide sequence of VGAM1189 RNA, herein designated VGAM RNA, also designated SEQ ID:3900.

Another function of VGAM1189 is therefore inhibition of Ephrin-A5 (EFNA5, Accession NM_001962). Accordingly, utilities of VGAM1189 include diagnosis, prevention and treatment of diseases and clinical conditions associated with EFNA5. FLJ10637 (Accession XM_043919) is another VGAM1189 host target gene. FLJ10637 BINDING SITE is HOST TARGET binding site found in the 5' untranslated region of mRNA encoded by FLJ10637, corresponding to a HOST TARGET binding site such as BINDING SITE I, BINDING SITE II or BINDING SITE III. Table 2 illustrates the complementarity of the nucleotide sequences of FLJ10637 BINDING SITE, designated SEQ ID:34042, to the nucleotide sequence of VGAM1189 RNA, herein designated VGAM RNA, also designated SEQ ID:3900.

Another function of VGAM1189 is therefore inhibition of FLJ10637 (Accession XM_043919). Accordingly, utilities of VGAM1189 include diagnosis, prevention and treatment of diseases and clinical conditions associated with FLJ10637. FLJ10700 (Accession NM_018182) is another VGAM1189 host target gene. FLJ10700 BINDING SITE is HOST TARGET binding site found in the 3' untranslated region of mRNA encoded by FLJ10700, corresponding to a HOST TARGET binding site such as BINDING SITE I, BINDING SITE II or BINDING SITE III. Table 2 illustrates the complementarity of the nucleotide sequences of FLJ10700 BINDING SITE, designated SEQ ID:20019, to the nucleotide sequence of VGAM1189 RNA, herein designated VGAM RNA, also designated SEQ ID:3900.

Another function of VGAM1189 is therefore inhibition of FLJ10700 (Accession NM_018182). Accordingly, utilities of VGAM1189 include diagnosis, prevention and treatment of diseases and clinical conditions associated with FLJ10700. FLJ10743 (Accession NM_018201) is another VGAM1189 host target gene. FLJ10743 BINDING SITE is HOST TARGET binding site found in the 3' untranslated region of mRNA encoded by FLJ10743, corresponding to a HOST TARGET binding site such as BINDING SITE I, BINDING SITE II or BINDING SITE III. Table 2 illustrates the complementarity of the nucleotide sequences of FLJ10743 BINDING SITE, designated SEQ ID:20076, to the nucleotide sequence of VGAM1189 RNA, herein designated VGAM RNA, also designated SEQ ID:3900.

Another function of VGAM1189 is therefore inhibition of FLJ10743 (Accession NM_018201). Accordingly, utilities of VGAM1189 include diagnosis, prevention and treatment of diseases and clinical conditions associated with FLJ10743. FLJ13204 (Accession NM_024761) is another VGAM1189 host target gene. FLJ13204 BINDING SITE is HOST TARGET binding site found in the 5' untranslated region of mRNA encoded by FLJ13204, corresponding to a HOST TARGET binding site such as BINDING SITE I, BINDING SITE II or BINDING SITE III. Table 2 illustrates the complementarity of the nucleotide sequences of FLJ13204 BINDING SITE, designated SEQ ID:24114, to the nucleotide sequence of VGAM1189 RNA, herein designated VGAM RNA, also designated SEQ ID:3900.

Another function of VGAM1189 is therefore inhibition of FLJ13204 (Accession NM_024761). Accordingly, utilities of VGAM1189 include diagnosis, prevention and treatment of diseases and clinical conditions associated with FLJ13204. FLJ13322 (Accession NM_024722) is another VGAM1189 host target gene. FLJ13322 BINDING SITE is HOST TARGET binding site found in the 3' untranslated region of mRNA encoded by FLJ13322, corresponding to a HOST TARGET binding site such as BINDING SITE I, BINDING SITE II or BINDING SITE III. Table 2 illustrates the complementarity of the nucleotide sequences of FLJ13322 BINDING SITE, designated SEQ ID:24058, to the nucleotide sequence of VGAM1189 RNA, herein designated VGAM RNA, also designated SEQ ID:3900.

Another function of VGAM1189 is therefore inhibition of FLJ13322 (Accession NM_024722). Accordingly, utilities of VGAM1189 include diagnosis, prevention and treatment of diseases and clinical conditions associated with FLJ13322. FLJ13881 (Accession NM_024729) is another VGAM1189 host target gene. FLJ13881 BINDING SITE is HOST TARGET binding site found in the 3' untranslated region of mRNA encoded by FLJ13881, corresponding to a HOST TARGET binding site such as BINDING SITE I, BINDING SITE II or BINDING SITE III. Table 2 illustrates the complementarity of the nucleotide sequences of FLJ13881 BINDING SITE, designated SEQ ID:24066, to the nucleotide sequence of VGAM1189 RNA, herein designated VGAM RNA, also designated SEQ ID:3900.

Another function of VGAM1189 is therefore inhibition of FLJ13881 (Accession NM_024729). Accordingly, utilities of VGAM1189 include diagnosis, prevention and treatment of diseases and clinical conditions associated with FLJ13881. FLJ14100 (Accession NM_025025) is another VGAM1189 host target gene. FLJ14100 BINDING SITE is HOST TARGET binding site found in the 3' untranslated region of mRNA encoded by FLJ14100, corresponding to a HOST TARGET binding site such as BINDING SITE I, BINDING SITE II or BINDING SITE III. Table 2 illustrates the complementarity of the nucleotide sequences of FLJ14100 BINDING SITE, designated SEQ ID:24614, to the nucleotide sequence of VGAM1189 RNA, herein designated VGAM RNA, also designated SEQ ID:3900.

Another function of VGAM1189 is therefore inhibition of FLJ14100 (Accession NM_025025). Accordingly, utilities of VGAM1189 include diagnosis, prevention and treatment of diseases and clinical conditions associated with FLJ14100. FLJ14327 (Accession NM_024912) is another VGAM1189 host target gene. FLJ14327 BINDING SITE is HOST TARGET binding site found in the 3' untranslated region of mRNA encoded by FLJ14327, corresponding to a HOST TARGET binding site such as BINDING SITE I, BINDING SITE II or BINDING SITE III. Table 2 illustrates the complementarity of the nucleotide sequences of FLJ14327 BINDING SITE, designated SEQ ID:24424, to the nucleotide sequence of VGAM1189 RNA, herein designated VGAM RNA, also designated SEQ ID:3900.

Another function of VGAM1189 is therefore inhibition of FLJ14327 (Accession NM_024912). Accordingly, utilities of VGAM1189 include diagnosis, prevention and treatment of diseases and clinical conditions associated with FLJ14327. FLJ20257 (Accession NM_019606) is another VGAM1189 host target gene. FLJ20257 BINDING SITE is HOST TARGET binding site found in the 5' untranslated region of mRNA encoded by FLJ20257, corresponding to a HOST TARGET binding site such as BINDING SITE I, BINDING SITE II or BINDING SITE III. Table 2 illustrates the complementarity of the nucleotide sequences of FLJ20257 BINDING SITE, designated SEQ ID:21222, to the nucleotide sequence of VGAM1189 RNA, herein designated VGAM RNA, also designated SEQ ID:3900.

Another function of VGAM1189 is therefore inhibition of FLJ20257 (Accession NM_019606). Accordingly, utilities of VGAM1189 include diagnosis, prevention and treatment of diseases and clinical conditions associated with FLJ20257. FLJ22301 (Accession NM_024836) is another VGAM1189 host target gene. FLJ22301 BINDING SITE is HOST TARGET binding site found in the 5' untranslated region of mRNA encoded by FLJ22301, corresponding to a HOST TARGET binding site such as BINDING SITE I, BINDING SITE II or BINDING SITE III. Table 2 illustrates the complementarity of the nucleotide sequences of FLJ22301 BINDING SITE, designated SEQ ID:24240, to the nucleotide sequence of VGAM1189 RNA, herein designated VGAM RNA, also designated SEQ ID:3900.

Another function of VGAM1189 is therefore inhibition of FLJ22301 (Accession NM_024836). Accordingly, utilities of VGAM1189 include diagnosis, prevention and treatment of diseases and clinical conditions associated with FLJ22301. FLJ31300 (Accession NM_144639) is another VGAM1189 host target gene. FLJ31300 BINDING SITE is HOST TARGET binding site found in the 3' untranslated region of mRNA encoded by FLJ31300, corresponding to a HOST TARGET binding site such as BINDING SITE I, BINDING SITE II or BINDING SITE III. Table 2 illustrates the complementarity of the nucleotide sequences of FLJ31300 BINDING SITE, designated SEQ ID:29462, to the nucleotide sequence of VGAM1189 RNA, herein designated VGAM RNA, also designated SEQ ID:3900.

Another function of VGAM1189 is therefore inhibition of FLJ31300 (Accession NM_144639). Accordingly, utilities of VGAM1189 include diagnosis, prevention and treatment of diseases and clinical conditions associated with FLJ31300. GABA(A) Receptor-associated Protein Like 1 (GABARAPL1, Accession NM_031412) is another VGAM1189 host target gene. GABARAPL1 BINDING SITE is HOST TARGET binding site found in the 5' untranslated region of mRNA encoded by GABARAPL1, corresponding to a HOST TARGET binding site such as BINDING SITE I, BINDING SITE II or BINDING SITE III. Table 2 illustrates the complementarity of the nucleotide sequences of GABARAPL1 BINDING SITE, designated SEQ ID:25390, to the nucleotide sequence of VGAM1189 RNA, herein designated VGAM RNA, also designated SEQ ID:3900.

Another function of VGAM1189 is therefore inhibition of GABA(A) Receptor-associated Protein Like 1 (GABARAPL1, Accession NM_031412). Accordingly, utilities of VGAM1189 include diagnosis, prevention and treatment of diseases and clinical conditions associated with GABARAPL1. GBTS1 (Accession NM_145173) is another VGAM1189 host target gene. GBTS1 BINDING SITE is HOST TARGET binding site found in the 3' untranslated region of mRNA encoded by GBTS1, corresponding to a HOST TARGET binding site such as BINDING SITE I, BINDING SITE II or BINDING SITE III. Table 2 illustrates the complementarity of the nucleotide sequences of GBTS1 BINDING SITE, designated SEQ ID:29727, to the nucleotide sequence of VGAM1189 RNA, herein designated VGAM RNA, also designated SEQ ID:3900.

Another function of VGAM1189 is therefore inhibition of GBTS1 (Accession NM_145173). Accordingly, utilities of VGAM1189 include diagnosis, prevention and treatment of diseases and clinical conditions associated with GBTS1. HS6ST (Accession XM_030529) is another VGAM1189 host target gene. HS6ST BINDING SITE is HOST TARGET binding site found in the 3' untranslated region of mRNA encoded by HS6ST, corresponding to a HOST TARGET binding site such as BINDING SITE I, BINDING SITE II or BINDING SITE III. Table 2 illustrates the complementarity of the nucleotide sequences of HS6ST BINDING SITE, designated SEQ ID:31071, to the nucleotide sequence of VGAM1189 RNA, herein designated VGAM RNA, also designated SEQ ID:3900.

Another function of VGAM1189 is therefore inhibition of HS6ST (Accession XM_030529). Accordingly, utilities of VGAM1189 include diagnosis, prevention and treatment of diseases and clinical conditions associated with HS6ST. Heparan Sulfate 6-O-sulfotransferase 1 (HS6ST1, Accession NM_004807) is another VGAM1189 host target gene. HS6ST1 BINDING SITE is HOST TARGET binding site found in the 3' untranslated region of mRNA encoded by HS6ST1, corresponding to a HOST TARGET binding site such as BINDING SITE I, BINDING SITE II or BINDING SITE III. Table 2 illustrates the complementarity of the nucleotide sequences of HS6ST1 BINDING SITE, designated SEQ ID:11229, to the nucleotide sequence of VGAM1189 RNA, herein designated VGAM RNA, also designated SEQ ID:3900.

Another function of VGAM1189 is therefore inhibition of Heparan Sulfate 6-O-sulfotransferase 1 (HS6ST1, Accession NM_004807). Accordingly, utilities of VGAM1189 include diagnosis, prevention and treatment of diseases and clinical conditions associated with HS6ST1. HSPC195 (Accession XM_087785) is another VGAM1189 host target gene. HSPC195 BINDING SITE is HOST TARGET binding site found in the 3' untranslated region of mRNA encoded by HSPC195, corresponding to a HOST TARGET binding site such as BINDING SITE I, BINDING SITE II or BINDING SITE III. Table 2 illustrates the complementarity of the nucleotide sequences of HSPC195 BINDING SITE, designated SEQ ID:39421, to the nucleotide sequence of VGAM1189 RNA, herein designated VGAM RNA, also designated SEQ ID:3900.

Another function of VGAM1189 is therefore inhibition of HSPC195 (Accession XM_087785). Accordingly, utilities of VGAM1189 include diagnosis, prevention and treatment of diseases and clinical conditions associated with HSPC195. HYPC (Accession XM_035487) is another VGAM1189 host target gene. HYPC BINDING SITE is HOST TARGET binding site found in the 5' untranslated region of mRNA encoded by HYPC, corresponding to a HOST TARGET binding site such as BINDING SITE I, BINDING SITE II or BINDING SITE III. Table 2 illustrates the complementarity of the nucleotide sequences of HYPC BINDING SITE, designated SEQ ID:32272, to the nucleotide sequence of VGAM1189 RNA, herein designated VGAM RNA, also designated SEQ ID:3900.

Another function of VGAM1189 is therefore inhibition of HYPC (Accession XM_035487). Accordingly, utilities of VGAM1189 include diagnosis, prevention and treatment of diseases and clinical conditions associated with HYPC. ISL2 Transcription Factor, LIM/homeodomain, (islet-2) (ISL2, Accession XM_047951) is another VGAM1189 host target gene. ISL2 BINDING SITE is HOST TARGET binding site found in the 3' untranslated region of mRNA encoded by ISL2, corresponding to a HOST TARGET binding site such as BINDING SITE I, BINDING SITE II or BINDING SITE III. Table 2 illustrates the complementarity of the nucleotide sequences of ISL2 BINDING SITE, designated SEQ ID:35080, to the nucleotide sequence of VGAM1189 RNA, herein designated VGAM RNA, also designated SEQ ID:3900.

Another function of VGAM1189 is therefore inhibition of ISL2 Transcription Factor, LIM/homeodomain, (islet-2) (ISL2, Accession XM_047951). Accordingly, utilities of VGAM1189 include diagnosis, prevention and treatment of diseases and clinical conditions associated with ISL2. KIAA0140 (Accession NM_014661) is another VGAM1189 host target gene. KIAA0140 BINDING SITE is HOST TARGET binding site found in the 3' untranslated region of mRNA encoded by KIAA0140, corresponding to a HOST TARGET binding site such as BINDING SITE I, BINDING SITE II or BINDING SITE III. Table 2 illustrates the complementarity of the nucleotide sequences of KIAA0140 BINDING SITE, designated SEQ ID:16107, to the nucleotide sequence of VGAM1189 RNA, herein designated VGAM RNA, also designated SEQ ID:3900.

Another function of VGAM1189 is therefore inhibition of KIAA0140 (Accession NM_014661). Accordingly, utilities of VGAM1189 include diagnosis, prevention and treatment of diseases and clinical conditions associated with KIAA0140. KIAA0227 (Accession XM_027236) is another VGAM1189 host target gene. KIAA0227 BINDING SITE is HOST TARGET binding site found in the 3' untranslated region of mRNA encoded by KIAA0227, corresponding to a HOST TARGET binding site such as BINDING SITE I, BINDING SITE II or BINDING SITE III. Table 2 illustrates the complementarity of the nucleotide sequences of KIAA0227 BINDING SITE, designated SEQ ID:30451, to the nucleotide sequence of VGAM1189 RNA, herein designated VGAM RNA, also designated SEQ ID:3900.

Another function of VGAM1189 is therefore inhibition of KIAA0227 (Accession XM_027236). Accordingly, utilities of VGAM1189 include diagnosis, prevention and treatment of diseases and clinical conditions associated with KIAA0227. KIAA0415 (Accession XM_166527) is another VGAM1189 host target gene. KIAA0415 BINDING SITE is HOST TARGET binding site found in the 3' untranslated region of mRNA encoded by KIAA0415, corresponding to a HOST TARGET binding site such as BINDING SITE I, BINDING SITE II or BINDING SITE III. Table 2 illustrates the complementarity of the nucleotide sequences of KIAA0415 BINDING SITE, designated SEQ ID:44474, to the nucleotide sequence of VGAM1189 RNA, herein designated VGAM RNA, also designated SEQ ID:3900.

Another function of VGAM1189 is therefore inhibition of KIAA0415 (Accession XM_166527). Accordingly, utilities of VGAM1189 include diagnosis, prevention and treatment of diseases and clinical conditions associated with KIAA0415. KIAA0446 (Accession XM_044155) is another VGAM1189 host target gene. KIAA0446 BINDING SITE is HOST TARGET binding site found in the 3' untranslated region of mRNA encoded by KIAA0446, corresponding to a HOST TARGET binding site such as BINDING SITE I, BINDING SITE II or BINDING SITE III. Table 2 illustrates the complementarity of the nucleotide sequences of KIAA0446 BINDING SITE, designated SEQ ID:34148, to the nucleotide sequence of VGAM1189 RNA, herein designated VGAM RNA, also designated SEQ ID:3900.

Another function of VGAM1189 is therefore inhibition of KIAA0446 (Accession XM_044155). Accordingly, utilities of VGAM1189 include diagnosis, prevention and treatment of diseases and clinical conditions associated with KIAA0446. KIAA0481 (Accession XM_050144) is another VGAM1189 host target gene. KIAA0481 BINDING SITE is HOST TARGET binding site found in the 3' untranslated region of mRNA encoded by KIAA0481, corresponding to a HOST TARGET binding site such as BINDING SITE I, BINDING SITE II or BINDING SITE III. Table 2 illustrates the complementarity of the nucleotide sequences of KIAA0481 BINDING SITE, designated SEQ ID:35569, to the nucleotide sequence of VGAM1189 RNA, herein designated VGAM RNA, also designated SEQ ID:3900.

Another function of VGAM1189 is therefore inhibition of KIAA0481 (Accession XM_050144). Accordingly, utilities of VGAM1189 include diagnosis, prevention and treatment of diseases and clinical conditions associated with KIAA0481. KIAA0841 (Accession XM_049237) is another VGAM1189 host target gene. KIAA0841 BINDING SITE is HOST TARGET binding site found in the 3' untranslated region of mRNA encoded by KIAA0841, corresponding to a HOST TARGET binding site such as BINDING SITE I, BINDING SITE II or BINDING SITE III. Table 2 illustrates the complementarity of the nucleotide sequences of KIAA0841 BINDING SITE, designated SEQ ID:35360, to the nucleotide sequence of VGAM1189 RNA, herein designated VGAM RNA, also designated SEQ ID:3900.

Another function of VGAM1189 is therefore inhibition of KIAA0841 (Accession XM_049237). Accordingly, utilities of VGAM1189 include diagnosis, prevention and treatment of diseases and clinical conditions associated with KIAA0841. KIAA0939 (Accession XM_030524) is another VGAM1189 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31060, to the nucleotide sequence of VGAM1189 RNA, herein designated VGAM RNA, also designated SEQ ID:3900.

Another function of VGAM1189 is therefore inhibition of KIAA0939 (Accession XM_030524). Accordingly, utilities of VGAM1189 include diagnosis, prevention and treatment of diseases and clinical conditions associated with KIAA0939. KIAA0963 (Accession NM_014963) is another VGAM1189 host target gene. KIAA0963 BINDING SITE is HOST TARGET binding site found in the 5' untranslated region of mRNA encoded by KIAA0963, corresponding to a HOST TARGET binding site such as BINDING SITE I, BINDING SITE II or BINDING SITE III. Table 2 illustrates the complementarity of the nucleotide sequences of KIAA0963 BINDING SITE, designated SEQ ID:17342, to the nucleotide sequence of VGAM1189 RNA, herein designated VGAM RNA, also designated SEQ ID:3900.

Another function of VGAM1189 is therefore inhibition of KIAA0963 (Accession NM_014963). Accordingly, utilities of VGAM1189 include diagnosis, prevention and treatment of diseases and clinical conditions associated with KIAA0963. KIAA1138 (Accession XM_030721) is another VGAM1189 host target gene. KIAA1138 BINDING SITE1 and KIAA1138 BINDING SITE2 are HOST TARGET binding sites found in untranslated regions of mRNA encoded by KIAA1138, corresponding to HOST TARGET binding sites such as BINDING SITE I, BINDING SITE II or BINDING SITE III. Table 2 illustrates the complementarity of the nucleotide sequences of KIAA1138 BINDING SITE1 and KIAA1138 BINDING SITE2, designated SEQ ID:31125 and SEQ ID:31126 respectively, to the nucleotide sequence of VGAM1189 RNA, herein designated VGAM RNA, also designated SEQ ID:3900.

Another function of VGAM1189 is therefore inhibition of KIAA1138 (Accession XM_030721). Accordingly, utilities of VGAM1189 include diagnosis, prevention and treatment of diseases and clinical conditions associated with KIAA1138. KIAA1441 (Accession XM_114036) is another VGAM1189 host target gene. KIAA1441 BINDING SITE is HOST TARGET binding site found in the 3' untranslated region of mRNA encoded by KIAA1441, corresponding to a HOST TARGET binding site such as BINDING SITE I, BINDING SITE II or BINDING SITE III. Table 2 illustrates the complementarity of the nucleotide sequences of KIAA1441 BINDING SITE, designated SEQ ID:42627, to the nucleotide sequence of VGAM1189 RNA, herein designated VGAM RNA, also designated SEQ ID:3900.

Another function of VGAM1189 is therefore inhibition of KIAA1441 (Accession XM_114036). Accordingly, utilities of VGAM1189 include diagnosis, prevention and treatment of diseases and clinical conditions associated with KIAA1441. KIAA1453 (Accession NM_025090) is another VGAM1189 host target gene. KIAA1453 BINDING SITE is HOST TARGET binding site found in the 3' untranslated region of mRNA encoded by KIAA1453, corresponding to a HOST TARGET binding site such as BINDING SITE I, BINDING SITE II or BINDING SITE III. Table 2 illustrates the complementarity of the nucleotide sequences of KIAA1453 BINDING SITE, designated SEQ ID:24713, to the nucleotide sequence of VGAM1189 RNA, herein designated VGAM RNA, also designated SEQ ID:3900.

Another function of VGAM1189 is therefore inhibition of KIAA1453 (Accession NM_025090). Accordingly, utilities of VGAM1189 include diagnosis, prevention and treatment of diseases and clinical conditions associated with KIAA1453. KIAA1553 (Accession XM_166320) is another VGAM1189 host target gene. KIAA1553 BINDING SITE is HOST TARGET binding site found in the 3' untranslated region of mRNA encoded by KIAA1553, corresponding to a HOST TARGET binding site such as BINDING SITE I, BINDING SITE II or BINDING SITE III. Table 2 illustrates the complementarity of the nucleotide sequences of KIAA1553 BINDING SITE, designated SEQ ID:44142, to the nucleotide sequence of VGAM1189 RNA, herein designated VGAM RNA, also designated SEQ ID:3900.

Another function of VGAM1189 is therefore inhibition of KIAA1553 (Accession XM_166320). Accordingly, utilities of VGAM1189 include diagnosis, prevention and treatment of diseases and clinical conditions associated with KIAA1553. KIAA1580 (Accession XM_045271) is another VGAM1189 host target gene. KIAA1580 BINDING SITE is HOST TARGET binding site found in the 5' untranslated region of mRNA encoded by KIAA1580, corresponding to a HOST TARGET binding site such as BINDING SITE I, BINDING SITE II or BINDING SITE III. Table 2 illustrates the complementarity of the nucleotide sequences of KIAA1580 BINDING SITE, designated SEQ ID:34411, to the nucleotide sequence of VGAM1189 RNA, herein designated VGAM RNA, also designated SEQ ID:3900.

Another function of VGAM1189 is therefore inhibition of KIAA1580 (Accession XM_045271). Accordingly, utilities of VGAM1189 include diagnosis, prevention and treatment of diseases and clinical conditions associated with KIAA1580. KIAA1813 (Accession XM_046743) is another VGAM1189 host target gene. KIAA1813 BINDING SITE is HOST TARGET binding site found in the 5' untranslated region of mRNA encoded by KIAA1813, corresponding to a HOST TARGET binding site such as BINDING SITE I, BINDING SITE II or BINDING SITE III. Table 2 illustrates the complementarity of the nucleotide sequences of KIAA1813 BINDING SITE, designated SEQ ID:34808, to the nucleotide sequence of VGAM1189 RNA, herein designated VGAM RNA, also designated SEQ ID:3900.

Another function of VGAM1189 is therefore inhibition of KIAA1813 (Accession XM_046743). Accordingly, utilities of VGAM1189 include diagnosis, prevention and treatment of diseases and clinical conditions associated with KIAA1813. KIAA1893 (Accession XM_055226) is another VGAM1189 host target gene. KIAA1893 BINDING SITE is HOST TARGET binding site found in the 3' untranslated region of mRNA encoded by KIAA1893, corresponding to a HOST TARGET binding site such as BINDING SITE I, BINDING SITE II or BINDING SITE III. Table 2 illustrates the complementarity of the nucleotide sequences of KIAA1893 BINDING SITE, designated SEQ ID:36245, to the nucleotide sequence of VGAM1189 RNA, herein designated VGAM RNA, also designated SEQ ID:3900.

Another function of VGAM1189 is therefore inhibition of KIAA1893 (Accession XM_055226). Accordingly, utilities of VGAM1189 include diagnosis, prevention and treatment of diseases and clinical conditions associated with KIAA1893. KIAA1904 (Accession XM_056282) is another VGAM1189 host target gene. KIAA1904 BINDING SITE is HOST TARGET binding site found in the 3' untranslated region of mRNA encoded by KIAA1904, corresponding to a HOST TARGET binding site such as BINDING SITE I, BINDING SITE II or BINDING SITE III. Table 2 illustrates the complementarity of the nucleotide sequences of KIAA1904 BINDING SITE, designated SEQ ID:36373, to the nucleotide sequence of VGAM1189 RNA, herein designated VGAM RNA, also designated SEQ ID:3900.

Another function of VGAM1189 is therefore inhibition of KIAA1904 (Accession XM_056282). Accordingly, utilities of VGAM1189 include diagnosis, prevention and treatment of diseases and clinical conditions associated with KIAA1904. KIAA1924 (Accession XM_057091) is another VGAM1189 host target gene. KIAA1924 BINDING SITE is HOST TARGET binding site found in the 3' untranslated region of mRNA encoded by KIAA1924, corresponding to a HOST TARGET binding site such as BINDING SITE I, BINDING SITE II or BINDING SITE III. Table 2 illustrates the complementarity of the nucleotide sequences of KIAA1924 BINDING SITE, designated SEQ ID:36473, to the nucleotide sequence of VGAM1189 RNA, herein designated VGAM RNA, also designated SEQ ID:3900.

Another function of VGAM1189 is therefore inhibition of KIAA1924 (Accession XM_057091). Accordingly, utilities of VGAM1189 include diagnosis, prevention and treatment of diseases and clinical conditions associated with KIAA1924. Lectin, Galactoside-binding, Soluble, 12 (galectin 12) (LGALS12, Accession NM_033101) is another VGAM1189 host target gene. LGALS12 BINDING SITE is HOST TARGET binding site found in the 5' untranslated region of mRNA encoded by LGALS12, corresponding to a HOST TARGET binding site such as BINDING SITE I, BINDING SITE II or BINDING SITE III. Table 2 illustrates the complementarity of the nucleotide sequences of LGALS12 BINDING SITE, designated SEQ ID:26947, to the nucleotide sequence of VGAM1189 RNA, herein designated VGAM RNA, also designated SEQ ID:3900.

Another function of VGAM1189 is therefore inhibition of Lectin, Galactoside-binding, Soluble, 12 (galectin 12) (LGALS12, Accession NM_033101). Accordingly, utilities of VGAM1189 include diagnosis, prevention and treatment of diseases and clinical conditions associated with LGALS12. MGC10966 (Accession NM_031471) is another VGAM1189 host target gene. MGC10966 BINDING SITE is HOST TARGET binding site found in the 5' untranslated region of mRNA encoded by MGC10966, corresponding to a HOST TARGET binding site such as BINDING SITE I, BINDING SITE II or BINDING SITE III. Table 2 illustrates the complementarity of the nucleotide sequences of MGC10966 BINDING SITE, designated SEQ ID:25536, to the nucleotide sequence of VGAM1189 RNA, herein designated VGAM RNA, also designated SEQ ID:3900.

Another function of VGAM1189 is therefore inhibition of MGC10966 (Accession NM_031471). Accordingly, utilities of VGAM1189 include diagnosis, prevention and treatment of diseases and clinical conditions associated with MGC10966. MGC2705 (Accession NM_032701) is another VGAM1189 host target gene. MGC2705 BINDING SITE is HOST TARGET binding site found in the 3' untranslated region of mRNA encoded by MGC2705, corresponding to a HOST TARGET binding site such as BINDING SITE I, BINDING SITE II or BINDING SITE III. Table 2 illustrates the complementarity of the nucleotide sequences of MGC2705 BINDING SITE, designated SEQ ID:26415, to the nucleotide sequence of VGAM1189 RNA, herein designated VGAM RNA, also designated SEQ ID:3900.

Another function of VGAM1189 is therefore inhibition of MGC2705 (Accession NM_032701). Accordingly, utilities of VGAM1189 include diagnosis, prevention and treatment of diseases and clinical conditions associated with MGC2705. MGC2827 (Accession NM_023940) is another VGAM1189 host target gene. MGC2827 BINDING SITE is HOST TARGET binding site found in the 5' untranslated region of mRNA encoded by MGC2827, corresponding to a HOST TARGET binding site such as BINDING SITE I, BINDING SITE II or BINDING SITE III. Table 2 illustrates the complementarity of the nucleotide sequences of MGC2827 BINDING SITE, designated SEQ ID:23425, to the nucleotide sequence of VGAM1189 RNA, herein designated VGAM RNA, also designated SEQ ID:3900.

Another function of VGAM1189 is therefore inhibition of MGC2827 (Accession NM_023940). Accordingly, utilities of VGAM1189 include diagnosis, prevention and treatment of diseases and clinical conditions associated with MGC2827. Meningioma Expressed Antigen 6 (coiled-coil proline-rich) (MGEA6, Accession NM_005930) is another VGAM1189 host target gene. MGEA6 BINDING SITE is HOST TARGET binding site found in the 5' untranslated region of mRNA encoded by MGEA6, corresponding to a HOST TARGET binding site such as BINDING SITE I, BINDING SITE II or BINDING SITE III. Table 2 illustrates the complementarity of the nucleotide sequences of MGEA6 BINDING SITE, designated SEQ ID:12559, to the nucleotide sequence of VGAM1189 RNA, herein designated VGAM RNA, also designated SEQ ID:3900.

Another function of VGAM1189 is therefore inhibition of Meningioma Expressed Antigen 6 (coiled-coil proline-rich) (MGEA6, Accession NM_005930). Accordingly, utilities of VGAM1189 include diagnosis, prevention and treatment of diseases and clinical conditions associated with MGEA6. N4BP3 (Accession XM_038920) is another VGAM1189 host target gene. N4BP3 BINDING SITE is HOST TARGET binding site found in the 3' untranslated region of mRNA encoded by N4BP3, corresponding to a HOST TARGET binding site such as BINDING SITE I, BINDING SITE II or BINDING SITE III. Table 2 illustrates the complementarity of the nucleotide sequences of N4BP3 BINDING SITE, designated SEQ ID:32932, to the nucleotide sequence of VGAM1189 RNA, herein designated VGAM RNA, also designated SEQ ID:3900.

Another function of VGAM1189 is therefore inhibition of N4BP3 (Accession XM_038920). Accordingly, utilities of VGAM1189 include diagnosis, prevention and treatment of diseases and clinical conditions associated with N4BP3. NFASC (Accession XM_046808) is another VGAM1189 host target gene. NFASC BINDING SITE is HOST TARGET binding site found in the 3' untranslated region of mRNA encoded by NFASC, corresponding to a HOST TARGET binding site such as BINDING SITE I, BINDING SITE II or BINDING SITE III. Table 2 illustrates the complementarity of the nucleotide sequences of NFASC BINDING SITE, designated SEQ ID:34828, to the nucleotide sequence of VGAM1189 RNA, herein designated VGAM RNA, also designated SEQ ID:3900.

Another function of VGAM1189 is therefore inhibition of NFASC (Accession XM_046808). Accordingly, utilities of VGAM1189 include diagnosis, prevention and treatment of diseases and clinical conditions associated with NFASC. NOPAR (Accession NM_053002) is another VGAM1189 host target gene. NOPAR BINDING SITE is HOST TARGET binding site found in the 5' untranslated region of mRNA encoded by NOPAR, corresponding to a HOST TARGET binding site such as BINDING SITE I, BINDING SITE II or BINDING SITE III. Table 2 illustrates the complementarity of the nucleotide sequences of NOPAR BINDING SITE, designated SEQ ID:27570, to the nucleotide sequence of VGAM1189 RNA, herein designated VGAM RNA, also designated SEQ ID:3900.

Another function of VGAM1189 is therefore inhibition of NOPAR (Accession NM_053002). Accordingly, utilities of VGAM1189 include diagnosis, prevention and treatment of diseases and clinical conditions associated with NOPAR. OS4 (Accession NM_005730) is another VGAM1189 host target gene. OS4 BINDING SITE is HOST TARGET binding site found in the 5' untranslated region of mRNA encoded by OS4, corresponding to a HOST TARGET binding site such as BINDING SITE I, BINDING SITE II or BINDING SITE III. Table 2 illustrates the complementarity of the nucleotide sequences of OS4 BINDING SITE, designated SEQ ID:12287, to the nucleotide sequence of VGAM1189 RNA, herein designated VGAM RNA, also designated SEQ ID:3900.

Another function of VGAM1189 is therefore inhibition of OS4 (Accession NM_005730). Accordingly, utilities of VGAM1189 include diagnosis, prevention and treatment of diseases and clinical conditions associated with OS4. P17.3 (Accession NM_019056) is another VGAM1189 host target gene. P17.3 BINDING SITE is HOST TARGET binding site found in the 5' untranslated region of mRNA encoded by P17.3, corresponding to a HOST TARGET binding site such as BINDING SITE I, BINDING SITE II or BINDING SITE III. Table 2 illustrates the complementarity of the nucleotide sequences of P17.3 BINDING SITE, designated SEQ ID:21138, to the nucleotide sequence of VGAM1189 RNA, herein designated VGAM RNA, also designated SEQ ID:3900.

Another function of VGAM1189 is therefore inhibition of P17.3 (Accession NM_019056). Accordingly, utilities of VGAM1189 include diagnosis, prevention and treatment of diseases and clinical conditions associated with P17.3. p21 (CDKN1A)-activated Kinase 6 (PAK6, Accession NM_020168) is another VGAM1189 host target gene. PAK6 BINDING SITE is HOST TARGET binding site found in the 3' untranslated region of mRNA encoded by PAK6, corresponding to a HOST TARGET binding site such as BINDING SITE I, BINDING SITE II or BINDING SITE III. Table 2 illustrates the complementarity of the nucleotide sequences of PAK6 BINDING SITE, designated SEQ ID:21389, to the nucleotide sequence of VGAM1189 RNA, herein designated VGAM RNA, also designated SEQ ID:3900.

Another function of VGAM1189 is therefore inhibition of p21(CDKN1A)-activated Kinase 6 (PAK6, Accession NM_020168). Accordingly, utilities of VGAM1189 include diagnosis, prevention and treatment of diseases and clinical conditions associated with PAK6. Phospholipase A2, Group VI (cytosolic, calcium-independent) (PLA2G6, Accession XM_039248) is another VGAM1189 host target gene. PLA2G6 BINDING SITE is HOST TARGET binding site found in the 3' untranslated region of mRNA encoded by PLA2G6, corresponding to a HOST TARGET binding site such as BINDING SITE I, BINDING SITE II or BINDING SITE III. Table 2 illustrates the complementarity of the nucleotide sequences of PLA2G6 BINDING SITE, designated SEQ ID:33030, to the nucleotide sequence of VGAM1189 RNA, herein designated VGAM RNA, also designated SEQ ID:3900.

Another function of VGAM1189 is therefore inhibition of Phospholipase A2, Group VI (cytosolic, calcium-independent) (PLA2G6, Accession XM_039248). Accordingly, utilities of VGAM1189 include diagnosis, prevention and treatment of diseases and clinical conditions associated with PLA2G6. Protein Kinase, Lysine Deficient 2 (PRKWNK2, Accession XM_117531) is another VGAM1189 host target gene. PRKWNK2 BINDING SITE is HOST TARGET binding site found in the 5' untranslated region of mRNA encoded by PRKWNK2, corresponding to a HOST TARGET binding site such as BINDING SITE I, BINDING SITE II or BINDING SITE III. Table 2 illustrates the complementarity of the nucleotide sequences of PRKWNK2 BINDING SITE, designated SEQ ID:43519, to the nucleotide sequence of VGAM1189 RNA, herein designated VGAM RNA, also designated SEQ ID:3900.

Another function of VGAM1189 is therefore inhibition of Protein Kinase, Lysine Deficient 2 (PRKWNK2, Accession XM_117531). Accordingly, utilities of VGAM1189 include diagnosis, prevention and treatment of diseases and clinical conditions associated with PRKWNK2. Protein Tyrosine Phosphatase, Receptor Type, U (PTPRU, Accession NM_133177) is another VGAM1189 host target gene. PTPRU BINDING SITE1 through PTPRU BINDING SITE3 are HOST TARGET binding sites found in untranslated regions of mRNA encoded by PTPRU, corresponding to HOST TARGET binding sites such as BINDING SITE I, BINDING SITE II or BINDING SITE III. Table 2 illustrates the complementarity of the nucleotide sequences of PTPRU BINDING SITE1 through PTPRU BINDING SITE3, designated SEQ ID:28399, SEQ ID:28404 and SEQ ID:12254 respectively, to the nucleotide sequence of VGAM1189 RNA, herein designated VGAM RNA, also designated SEQ ID:3900.

Another function of VGAM1189 is therefore inhibition of Protein Tyrosine Phosphatase, Receptor Type, U (PTPRU, Accession NM_133177). Accordingly, utilities of VGAM1189 include diagnosis, prevention and treatment of diseases and clinical conditions associated with PTPRU. SEC61A1 (Accession NM_013336) is another VGAM1189 host target gene. SEC61A1 BINDING SITE is HOST TARGET binding site found in the 3' untranslated region of mRNA encoded by SEC61A1, corresponding to a HOST TARGET binding site such as BINDING SITE I, BINDING SITE II or BINDING SITE III. Table 2 illustrates the complementarity of the nucleotide sequences of SEC61A1 BINDING SITE, designated SEQ ID:14983, to the nucleotide sequence of VGAM1189 RNA, herein designated VGAM RNA, also designated SEQ ID:3900.

Another function of VGAM1189 is therefore inhibition of SEC61A1 (Accession NM_013336). Accordingly, utilities of VGAM1189 include diagnosis, prevention and treatment of diseases and clinical conditions associated with SEC61A1. Sema Domain, Immunoglobulin Domain (Ig), Short Basic Domain, Secreted, (semaphorin) 3C (SEMA3C, Accession NM_006379) is another VGAM1189 host target gene. SEMA3C BINDING SITE is HOST TARGET binding site found in the 5' untranslated region of mRNA encoded by SEMA3C, corresponding to a HOST TARGET binding site such as BINDING SITE I, BINDING SITE II or BINDING SITE III. Table 2 illustrates the complementarity of the nucleotide sequences of SEMA3C BINDING SITE, designated SEQ ID:13072, to the nucleotide sequence of VGAM1189 RNA, herein designated VGAM RNA, also designated SEQ ID:3900.

Another function of VGAM1189 is therefore inhibition of Sema Domain, Immunoglobulin Domain (Ig), Short Basic Domain, Secreted, (semaphorin) 3C (SEMA3C, Accession NM_006379). Accordingly, utilities of VGAM1189 include diagnosis, prevention and treatment of diseases and clinical conditions associated with SEMA3C. Stathmin-like 3 (STMN3, Accession NM_015894) is another VGAM1189 host target gene. STMN3 BINDING SITE is HOST TARGET binding site found in the 3' untranslated region of mRNA encoded by STMN3, corresponding to a HOST TARGET binding site such as BINDING SITE I, BINDING SITE II or BINDING SITE III. Table 2 illustrates the complementarity of the nucleotide sequences of STMN3 BINDING SITE, designated SEQ ID:18037, to the nucleotide sequence of VGAM1189 RNA, herein designated VGAM RNA, also designated SEQ ID:3900.

Another function of VGAM1189 is therefore inhibition of Stathmin-like 3 (STMN3, Accession NM_015894). Accordingly, utilities of VGAM1189 include diagnosis, prevention and treatment of diseases and clinical conditions associated with STMN3. LOC115051 (Accession XM_010647) is another VGAM1189 host target gene. LOC115051 BINDING SITE is HOST TARGET binding site found in the 3' untranslated region of mRNA encoded by LOC115051, corresponding to a HOST TARGET binding site such as BINDING SITE I, BINDING SITE II or BINDING SITE III. Table 2 illustrates the complementarity of the nucleotide sequences of LOC115051 BINDING SITE, designated SEQ ID:30158, to the nucleotide sequence of VGAM1189 RNA, herein designated VGAM RNA, also designated SEQ ID:3900.

Another function of VGAM1189 is therefore inhibition of LOC115051 (Accession XM_010647). Accordingly, utilities of VGAM1189 include diagnosis, prevention and treatment of diseases and clinical conditions associated with LOC115051. LOC144114 (Accession XM_090198) is another VGAM1189 host target gene. LOC144114 BINDING SITE is HOST TARGET binding site found in the 5' untranslated region of mRNA encoded by LOC144114, corresponding to a HOST TARGET binding site such as BINDING SITE I, BINDING SITE II or BINDING SITE III. Table 2 illustrates the complementarity of the nucleotide sequences of LOC144114 BINDING SITE, designated SEQ ID:39994, to the nucleotide sequence of VGAM1189 RNA, herein designated VGAM RNA, also designated SEQ ID:3900.

Another function of VGAM1189 is therefore inhibition of LOC144114 (Accession XM_090198). Accordingly, utilities of VGAM1189 include diagnosis, prevention and treatment of diseases and clinical conditions associated with LOC144114. LOC146268 (Accession XM_085397) is another VGAM1189 host target gene. LOC146268 BINDING SITE is HOST TARGET binding site found in the 3' untranslated region of mRNA encoded by LOC146268, corresponding to a HOST TARGET binding site such as BINDING SITE I, BINDING SITE II or BINDING SITE III. Table 2 illustrates the complementarity of the nucleotide sequences of LOC146268 BINDING SITE, designated SEQ ID:38120, to the nucleotide sequence of VGAM1189 RNA, herein designated VGAM RNA, also designated SEQ ID:3900.

Another function of VGAM1189 is therefore inhibition of LOC146268 (Accession XM_085397). Accordingly, utilities of VGAM1189 include diagnosis, prevention and treatment of diseases and clinical conditions associated with LOC146268. LOC146488 (Accession XM_047748) is another VGAM1189 host target gene. LOC146488 BINDING SITE is HOST TARGET binding site found in the 3' untranslated region of mRNA encoded by LOC146488, corresponding to a HOST TARGET binding site such as BINDING SITE I, BINDING SITE II or BINDING SITE III. Table 2 illustrates the complementarity of the nucleotide sequences of LOC146488 BINDING SITE, designated SEQ ID:35042, to the nucleotide sequence of VGAM1189 RNA, herein designated VGAM RNA, also designated SEQ ID:3900.

Another function of VGAM1189 is therefore inhibition of LOC146488 (Accession XM_047748). Accordingly, utilities of VGAM1189 include diagnosis, prevention and treatment of diseases and clinical conditions associated with LOC146488. LOC146895 (Accession XM_097120) is another VGAM1189 host target gene. LOC146895 BINDING SITE is HOST TARGET binding site found in the 5' untranslated region of mRNA encoded by LOC146895, corresponding to a HOST TARGET binding site such as BINDING SITE I, BINDING SITE II or BINDING SITE III. Table 2 illustrates the complementarity of the nucleotide sequences of LOC146895 BINDING SITE, designated SEQ ID:40759, to the nucleotide sequence of VGAM1189 RNA, herein designated VGAM RNA, also designated SEQ ID:3900.

Another function of VGAM1189 is therefore inhibition of LOC146895 (Accession XM_097120). Accordingly, utilities of VGAM1189 include diagnosis, prevention and treatment of diseases and clinical conditions associated with LOC146895. LOC157349 (Accession XM_088298) is another VGAM1189 host target gene. LOC157349 BINDING SITE is HOST TARGET binding site found in the 5' untranslated region of mRNA encoded by LOC157349, corresponding to a HOST TARGET binding site such as BINDING SITE I, BINDING SITE II or BINDING SITE III. Table 2 illustrates the complementarity of the nucleotide sequences of LOC157349 BINDING SITE, designated SEQ ID:39589, to the nucleotide sequence of VGAM1189 RNA, herein designated VGAM RNA, also designated SEQ ID:3900.

Another function of VGAM1189 is therefore inhibition of LOC157349 (Accession XM_088298). Accordingly, utilities of VGAM1189 include diagnosis, prevention and treatment of diseases and clinical conditions associated with LOC157349. LOC159090 (Accession XM_088749) is another VGAM1189 host target gene. LOC159090 BINDING SITE is HOST TARGET binding site found in the 5' untranslated region of mRNA encoded by LOC159090, corresponding to a HOST TARGET binding site such as BINDING SITE I, BINDING SITE II or BINDING SITE III. Table 2 illustrates the complementarity of the nucleotide sequences of LOC159090 BINDING SITE, designated SEQ ID:39939, to the nucleotide sequence of VGAM1189 RNA, herein designated VGAM RNA, also designated SEQ ID:3900.

Another function of VGAM1189 is therefore inhibition of LOC159090 (Accession XM_088749). Accordingly, utilities of VGAM1189 include diagnosis, prevention and treatment of diseases and clinical conditions associated with LOC159090. LOC196500 (Accession XM_113734) is another VGAM1189 host target gene. LOC196500 BINDING SITE is HOST TARGET binding site found in the 5' untranslated region of mRNA encoded by LOC196500, corresponding to a HOST TARGET binding site such as BINDING SITE I, BINDING SITE II or BINDING SITE III. Table 2 illustrates the complementarity of the nucleotide sequences of LOC196500 BINDING SITE, designated SEQ ID:42388, to the nucleotide sequence of VGAM1189 RNA, herein designated VGAM RNA, also designated SEQ ID:3900.

Another function of VGAM1189 is therefore inhibition of LOC196500 (Accession XM_113734). Accordingly, utilities of VGAM1189 include diagnosis, prevention and treatment of diseases and clinical conditions associated with LOC196500. LOC199786 (Accession XM_114021) is another VGAM1189 host target gene. LOC199786 BINDING SITE is HOST TARGET binding site found in the 3' untranslated region of mRNA encoded by LOC199786, corresponding to a HOST TARGET binding site such as BINDING SITE I, BINDING SITE II or BINDING SITE III. Table 2 illustrates the complementarity of the nucleotide sequences of LOC199786 BINDING SITE, designated SEQ ID:42617, to the nucleotide sequence of VGAM1189 RNA, herein designated VGAM RNA, also designated SEQ ID:3900.

Another function of VGAM1189 is therefore inhibition of LOC199786 (Accession XM_114021). Accordingly, utilities of VGAM1189 include diagnosis, prevention and treatment of diseases and clinical conditions associated with LOC199786. LOC199800 (Accession XM_117134) is another VGAM1189 host target gene. LOC199800 BINDING SITE is HOST TARGET binding site found in the 5' untranslated region of mRNA encoded by LOC199800, corresponding to a HOST TARGET binding site such as BINDING SITE I, BINDING SITE II or BINDING SITE III. Table 2 illustrates the complementarity of the nucleotide sequences of LOC199800 BINDING SITE, designated SEQ ID:43249, to the nucleotide sequence of VGAM1189 RNA, herein designated VGAM RNA, also designated SEQ ID:3900.

Another function of VGAM1189 is therefore inhibition of LOC199800 (Accession XM_117134). Accordingly, utilities of VGAM1189 include diagnosis, prevention and treatment of diseases and clinical conditions associated with LOC199800. LOC200093 (Accession XM_032184) is another VGAM1189 host target gene. LOC200093 BINDING SITE is HOST TARGET binding site found in the 3' untranslated region of mRNA encoded by LOC200093, corresponding to a HOST TARGET binding site such as BINDING SITE I, BINDING SITE II or BINDING SITE III. Table 2 illustrates the complementarity of the nucleotide sequences of LOC200093 BINDING SITE, designated SEQ ID:31597, to the nucleotide sequence of VGAM1189 RNA, herein designated VGAM RNA, also designated SEQ ID:3900.

Another function of VGAM1189 is therefore inhibition of LOC200093 (Accession XM_032184). Accordingly, utilities of VGAM1189 include diagnosis, prevention and treatment of diseases and clinical conditions associated with LOC200093. LOC201245 (Accession XM_113326) is another VGAM1189 host target gene. LOC201245 BINDING SITE is HOST TARGET binding site found in the 5' untranslated region of mRNA encoded by LOC201245, corresponding to a HOST TARGET binding site such as BINDING SITE I, BINDING SITE II or BINDING SITE III. Table 2 illustrates the complementarity of the nucleotide sequences of LOC201245 BINDING SITE, designated SEQ ID:42229, to the nucleotide sequence of VGAM1189 RNA, herein designated VGAM RNA, also designated SEQ ID:3900.

Another function of VGAM1189 is therefore inhibition of LOC201245 (Accession XM_113326). Accordingly, utilities of VGAM1189 include diagnosis, prevention and treatment of diseases and clinical conditions associated with LOC201245. LOC205095 (Accession XM_119820) is another VGAM1189 host target gene. LOC205095 BINDING SITE is HOST TARGET binding site found in the 3' untranslated region of mRNA encoded by LOC205095, corresponding to a HOST TARGET binding site such as BINDING SITE I, BINDING SITE II or BINDING SITE III. Table 2 illustrates the complementarity of the nucleotide sequences of LOC205095 BINDING SITE, designated SEQ ID:43603, to the nucleotide sequence of VGAM1189 RNA, herein designated VGAM RNA, also designated SEQ ID:3900.

Another function of VGAM1189 is therefore inhibition of LOC205095 (Accession XM_119820). Accordingly, utilities of VGAM1189 include diagnosis, prevention and treatment of diseases and clinical conditions associated with LOC205095. LOC219513 (Accession XM_169166) is another VGAM1189 host target gene. LOC219513 BINDING SITE is HOST TARGET binding site found in the 5' untranslated region of mRNA encoded by LOC219513, corresponding to a HOST TARGET binding site such as BINDING SITE I, BINDING SITE II or BINDING SITE III. Table 2 illustrates the complementarity of the nucleotide sequences of LOC219513 BINDING SITE, designated SEQ ID:45291, to the nucleotide sequence of VGAM1189 RNA, herein designated VGAM RNA, also designated SEQ ID:3900.

Another function of VGAM1189 is therefore inhibition of LOC219513 (Accession XM_169166). Accordingly, utilities of VGAM1189 include diagnosis, prevention and treatment of diseases and clinical conditions associated with LOC219513. LOC221424 (Accession XM_168060) is another VGAM1189 host target gene. LOC221424 BINDING SITE is HOST TARGET binding site found in the 5' untranslated region of mRNA encoded by LOC221424, corresponding to a HOST TARGET binding site such as BINDING SITE I, BINDING SITE II or BINDING SITE III. Table 2 illustrates the complementarity of the nucleotide sequences of LOC221424 BINDING SITE, designated SEQ ID:44977, to the nucleotide sequence of VGAM1189 RNA, herein designated VGAM RNA, also designated SEQ ID:3900.

Another function of VGAM1189 is therefore inhibition of LOC221424 (Accession XM_168060). Accordingly, utilities of VGAM1189 include diagnosis, prevention and treatment of diseases and clinical conditions associated with LOC221424. LOC222183 (Accession XM_168436) is another VGAM1189 host target gene. LOC222183 BINDING SITE is HOST TARGET binding site found in the 3' untranslated region of mRNA encoded by LOC222183, corresponding to a HOST TARGET binding site such as BINDING SITE I, BINDING SITE II or BINDING SITE III. Table 2 illustrates the complementarity of the nucleotide sequences of LOC222183 BINDING SITE, designated SEQ ID:45183, to the nucleotide sequence of VGAM1189 RNA, herein designated VGAM RNA, also designated SEQ ID:3900.

Another function of VGAM1189 is therefore inhibition of LOC222183 (Accession XM_168436). Accordingly, utilities of VGAM1189 include diagnosis, prevention and treatment of diseases and clinical conditions associated with LOC222183. LOC256867 (Accession XM_170694) is another VGAM1189 host target gene. LOC256867 BINDING SITE is HOST TARGET binding site found in the 5' untranslated region of mRNA encoded by LOC256867, corresponding to a HOST TARGET binding site such as BINDING SITE I, BINDING SITE II or BINDING SITE III. Table 2 illustrates the complementarity of the nucleotide sequences of LOC256867 BINDING SITE, designated SEQ ID:45471, to the nucleotide sequence of VGAM1189 RNA, herein designated VGAM RNA, also designated SEQ ID:3900.

Another function of VGAM1189 is therefore inhibition of LOC256867 (Accession XM_170694). Accordingly, utilities of VGAM1189 include diagnosis, prevention and treatment of diseases and clinical conditions associated with LOC256867. LOC257451 (Accession XM_170960) is another VGAM1189 host target gene. LOC257451 BINDING SITE is HOST TARGET binding site found in the 3' untranslated region of mRNA encoded by LOC257451, corresponding to a HOST TARGET binding site such as BINDING SITE I, BINDING SITE II or BINDING SITE III. Table 2 illustrates the complementarity of the nucleotide sequences of LOC257451 BINDING SITE, designated SEQ ID:45741, to the nucleotide sequence of VGAM1189 RNA, herein designated VGAM RNA, also designated SEQ ID:3900.

Another function of VGAM1189 is therefore inhibition of LOC257451 (Accession XM_170960). Accordingly, utilities of VGAM1189 include diagnosis, prevention and treatment of diseases and clinical conditions associated with LOC257451. LOC90768 (Accession XM_033986) is another VGAM1189 host target gene. LOC90768 BINDING SITE is HOST TARGET binding site found in the 5' untranslated region of mRNA encoded by LOC90768, corresponding to a HOST TARGET binding site such as BINDING SITE I, BINDING SITE II or BINDING SITE III. Table 2 illustrates the complementarity of the nucleotide sequences of LOC90768 BINDING SITE, designated SEQ ID:31986, to the nucleotide sequence of VGAM1189 RNA, herein designated VGAM RNA, also designated SEQ ID:3900.

Another function of VGAM1189 is therefore inhibition of LOC90768 (Accession XM_033986). Accordingly, utilities of VGAM1189 include diagnosis, prevention and treatment of diseases and clinical conditions associated with LOC90768. LOC91040 (Accession XM_035641) is another VGAM1189 host target gene. LOC91040 BINDING SITE is HOST TARGET binding site found in the 3' untranslated region of mRNA encoded by LOC91040, corresponding to a HOST TARGET binding site such as BINDING SITE I, BINDING SITE II or BINDING SITE III. Table 2 illustrates the complementarity of the nucleotide sequences of LOC91040 BINDING SITE, designated SEQ ID:32315, to the nucleotide sequence of VGAM1189 RNA, herein designated VGAM RNA, also designated SEQ ID:3900.

Another function of VGAM1189 is therefore inhibition of LOC91040 (Accession XM_035641). Accordingly, utilities of VGAM1189 include diagnosis, prevention and treatment of diseases and clinical conditions associated with LOC91040. LOC91149 (Accession XM_036480) is another VGAM1189 host target gene. LOC91149 BINDING SITE is HOST TARGET binding site found in the 5' untranslated region of mRNA encoded by LOC91149, corresponding to a HOST TARGET binding site such as BINDING SITE I, BINDING SITE II or BINDING SITE III. Table 2 illustrates the complementarity of the nucleotide sequences of LOC91149 BINDING SITE, designated SEQ ID:32455, to the nucleotide sequence of VGAM1189 RNA, herein designated VGAM RNA, also designated SEQ ID:3900.

Another function of VGAM1189 is therefore inhibition of LOC91149 (Accession XM_036480). Accordingly, utilities of VGAM1189 include diagnosis, prevention and treatment of diseases and clinical conditions associated with LOC91149. FIG. 1 further provides a conceptual description of a novel bioinformatically detected viral gene of the present invention, referred to here as Viral Genomic Address Messenger 1190 (VGAM1190) viral gene, which modulates expression of respective host target genes thereof, the function and utility of which host target genes is known in the art.

VGAM1190 is a novel bioinformatically detected regulatory, non protein coding, viral micro RNA (miRNA) gene. The method by which VGAM1190 was detected is described hereinabove with reference to FIGS. 1-8.

VGAM1190 gene, herein designated VGAM GENE, is a viral gene contained in the genome of Botrytis Virus F. VGAM1190 host target gene, herein designated VGAM HOST TARGET GENE, is a human gene contained in the human genome.

VGAM1190 gene encodes a VGAM1190 precursor RNA, herein designated VGAM PRECURSOR RNA. Similar to other miRNA genes, and unlike most ordinary genes, VGAM1190 precursor RNA does not encode a protein. A nucleotide sequence identical or highly similar to the nucleotide sequence of VGAM1190 precursor RNA is designated SEQ ID:1176, and is provided hereinbelow with reference to the sequence listing part. Nucleotide sequence SEQ ID:1176 is located at position 2147 relative to the genome of Botrytis Virus F.

VGAM1190 precursor RNA folds onto itself, forming VGAM1190 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1190 folded precursor RNA into VGAM1190 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 62%) nucleotide sequence of VGAM1190 RNA is designated SEQ ID:3901, and is provided hereinbelow with reference to the sequence listing part.

VGAM1190 host target gene, herein designated VGAM HOST TARGET GENE, encodes a corresponding messenger RNA, VGAM1190 host target RNA, herein designated VGAM HOST TARGET RNA. VGAM1190 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1190 RNA, herein designated VGAM RNA, binds complementarily to one or more host target binding sites located in untranslated regions of VGAM1190 host target RNA, herein designated VGAM HOST TARGET RNA. This complementary binding is due to the fact that the nucleotide sequence of VGAM1190 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1190 RNA, herein designated VGAM RNA, may have a different number of host target binding sites in untranslated regions of a VGAM1190 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1190 RNA, herein designated VGAM RNA, to host target binding sites on VGAM1190 host target RNA, herein designated VGAM HOST TARGET RNA, such as BINDING SITE I, BINDING SITE II and BINDING SITE III, inhibits translation of VGAM1190 host target RNA into VGAM1190 host target protein, herein designated VGAM HOST TARGET PROTEIN. VGAM host target protein is therefore outlined by a broken line.

It is appreciated that VGAM1190 host target gene, herein designated VGAM HOST TARGET GENE, in fact represents a plurality of VGAM1190 host target genes. The mRNA of each one of this plurality of VGAM1190 host target genes comprises one or more host target binding sites, each having a nucleotide sequence which is at least partly complementary to VGAM1190 RNA, herein designated VGAM RNA, and which when bound by VGAM1190 RNA causes inhibition of translation of respective one or more VGAM1190 host target proteins.

It is further appreciated by one skilled in the art that the mode of translational inhibition illustrated by FIG. 1 with specific reference to translational inhibition exerted by VGAM1190 gene, herein designated VGAM GENE, on one or more VGAM1190 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1190 is inhibition of expression of host target genes, as part of a novel viral mechanism of attacking a host. Accordingly, utilities of VGAM1190 include diagnosis, prevention and treatment of viral infection by Botrytis Virus F. Specific functions, and accordingly utilities, of VGAM1190 correlate with, and may be deduced from, the identity of the host target genes which VGAM1190 binds and inhibits, and the function of these host target genes, as elaborated hereinbelow.

Nucleotide sequences of the VGAM1190 precursor RNA, herein designated VGAM PRECURSOR RNA, and of the 'diced' VGAM1190 RNA, herein designated VGAM RNA, and a schematic representation of the secondary folding of VGAM1190 folded precursor RNA, herein designated VGAM FOLDED PRECURSOR RNA, of VGAM1190 are further described hereinbelow with reference to Table 1.

Nucleotide sequences of host target binding sites, such as BINDING SITE-I, BINDING SITE-II and BINDING SITE-III of FIG. 1, found on VGAM1190 host target RNA, and schematic representation of the complementarity of each of these host target binding sites to VGAM1190 RNA, herein designated VGAM RNA, are described hereinbelow with reference to Table 2.

As mentioned hereinabove with reference to FIG. 1, a function of VGAM1190 gene, herein designated VGAM is inhibition of expression of VGAM1190 target genes. It is appreciated that specific functions, and accordingly utilities, of VGAM1190 correlate with, and may be deduced from, the identity of the target genes which VGAM1190 binds and inhibits, and the function of these target genes, as elaborated hereinbelow.

BIG1 (Accession NM_006421) is a VGAM1190 host target gene. BIG1 BINDING SITE is HOST TARGET binding site found in the 3' untranslated region of mRNA encoded by BIG1, corresponding to a HOST TARGET binding site such as BINDING SITE I, BINDING SITE II or BINDING SITE III. Table 2 illustrates the complementarity of the nucleotide sequences of BIG1 BINDING SITE, designated SEQ ID:13136, to the nucleotide sequence of VGAM1190 RNA, herein designated VGAM RNA, also designated SEQ ID:3901.

A function of VGAM1190 is therefore inhibition of BIG1 (Accession NM_006421), a gene which is a guanine nucleotide-exchange protein, has a role in vesicular transport. Accordingly, utilities of VGAM1190 include diagnosis, prevention and treatment of diseases and clinical conditions associated with BIG1. The function of BIG1 has been established by previous studies. After peptide sequencing of purified bovine p200, Togawa et al. (1999) used PCR generated probes to screen a human frontal cortex cDNA library and isolated BIG1 and BIG2 (OMIM Ref. No. 605371) cDNAs. The assembled full-length BIG1 cDNA encodes a protein of 1,849 amino acids containing a Sec7 domain characteristic of ARF guanine nucleotide-exchange proteins. BIG1 shares 74% overall amino acid identity with BIG2 and 90% identity in the Sec7 domain. Using Northern blot analysis, Togawa et al. (1999) detected a 7.5-kb BIG1 transcript in placenta and lung. Weaker expression was detected in heart, brain, kidney, and pancreas. Mansour et al. (1999) studied the ubiquitously expressed ARFGEP1 protein and proposed that accumulation of an abortive p200-ARF complex in the presence of BFA likely leads to disruption of Golgi morphology. Database searches revealed the presence of putative isoforms whose inhibition may account for the effects of BFA on various organelles.

Full details of the abovementioned studies are described in the following publications, the disclosure of which are hereby incorporated by reference:

Togawa, A.; Morinaga, N.; Ogasawara, M.; Moss, J.; Vaughan, M.: Purification and cloning of a brefeldin A-inhibited guanine nucleotide-exchange protein for ADP-ribosylation factors. J. Biol. Chem. 274:12308-12315, 1999; and Mansour, S. J.; Skaug, J.; Zhao, X.-H.; Giordano, J.; Scherer, S. W.; Melancon, P.: p200 ARF-GEP1: a Golgi-localized guanine nucleotide exchange protein whose Sec7 domain is targeted b.

Further studies establishing the function and utilities of BIG1 are found in John Hopkins OMIM database record ID 604141, and in sited publications numbered 4443-4446 listed in the bibliography section hereinbelow, which are also hereby incorporated by reference. Potassium Channel, Subfamily K, Member 6 (KCNK6, Accession NM_004823) is another VGAM1190 host target gene. KCNK6 BINDING SITE is HOST TARGET binding site found in the 3' untranslated region of mRNA encoded by KCNK6, corresponding to a HOST TARGET binding site such as BINDING SITE I, BINDING SITE II or BINDING SITE III. Table 2 illustrates the complementarity of the nucleotide sequences of KCNK6 BINDING SITE, designated SEQ ID:11238, to the nucleotide sequence of VGAM1190 RNA, herein designated VGAM RNA, also designated SEQ ID:3901.

Another function of VGAM1190 is therefore inhibition of Potassium Channel, Subfamily K, Member 6 (KCNK6, Accession NM_004823), a gene which is an inward rectifying potassium channel protein. Accordingly, utilities of VGAM1190 include diagnosis, prevention and treatment of diseases and clinical conditions associated with KCNK6. The function of KCNK6 has been established by previous studies. Potassium channels perform many distinct functions in both excitable and nonexcitable cells. Members of the tandem pore domain potassium (K2P) channel family, such as TWIK1 (OMIM Ref. No. 601745) and TREK (OMIM Ref. No. 603219), contain 4 transmembrane domains and 2 pore-forming (P) domains. The K2P channels all produce quasi-instantaneous and noninactivating currents but exhibit different types of regulation, indicating that these potassium channels are probably involved in a great diversity of physiologic and pathophysiologic roles (Salinas et al., 1999). Both Chavez et al. (1999) and Pountney et al. (1999) identified cDNAs encoding human KCNK6, which they referred to as TWIK2 and TOSS (TWIK-originated similarity sequence), respectively. Chavez et al. (1999) reported that the predicted 313-amino acid TWIK2 protein shares 54% sequence similarity with TWIK1. Pountney et al. (1999) stated that since TOSS lacks a signal sequence, the N terminus is predicted to be intracellular. They noted that the P2 domain of TOSS contains an unusual GLG motif in a position corresponding to that found in TWIK1. While Chavez et al. (1999) found by Northern blot analysis that the 6.8-, 2.6-, and 1.35-kb TWIK2 mRNAs were expressed in many human tissues, Pountney et al. (1999) reported a more restricted expression pattern. In Xenopus oocytes expressing TWIK2, Chavez et al. (1999) detected noninactivating, weak inward rectification, while Pountney et al. (1999) failed to detect any currents above background. By radiation hybrid analysis, Gray et al. (1999) mapped the KCNK6 gene to chromosome 19q13.1.

Full details of the abovementioned studies are described in the following publications, the disclosure of which are hereby incorporated by reference:

Chavez, R. A.; Gray, A. T.; Zhao, B. B.; Kindler, C. H.; Mazurek, M. J.; Mehta, Y.; Forsayeth, J. R.; Yost, C. S.: TWIK-2, a new weak inward rectifying member of the tandem pore domain potassium channel family. J. Biol. Chem. 274:7887-7892, 1999; and Gray, A. T.; Kindler, C. H.; Sampson, E. R.; Yost, C. S.: Assignment of KCNK6 encoding the human weak inward rectifier potassium channel TWIK-2 to chromosome band 19q13.1 by radiation.

Further studies establishing the function and utilities of KCNK6 are found in John Hopkins OMIM database record ID 603939, and in sited publications numbered 5039-5042 listed in the bibliography section hereinbelow, which are also hereby incorporated by reference. Leucine Zipper, Down-regulated In Cancer 1 (LDOC1, Accession NM_012317) is another VGAM1190 host target gene. LDOC1 BINDING SITE is HOST TARGET binding site found in the 3' untranslated region of mRNA encoded by LDOC1, corresponding to a HOST TARGET binding site such as BINDING SITE I, BINDING SITE II or BINDING SITE III. Table 2 illustrates the complementarity of the nucleotide sequences of LDOC1 BINDING SITE, designated SEQ ID:14691, to the nucleotide sequence of VGAM1190 RNA, herein designated VGAM RNA, also designated SEQ ID:3901.

Another function of VGAM1190 is therefore inhibition of Leucine Zipper, Down-regulated In Cancer 1 (LDOC1, Accession NM_012317). Accordingly, utilities of VGAM1190 include diagnosis, prevention and treatment of diseases and clinical conditions associated with LDOC1. MGC27382 (Accession NM_144700) is another VGAM1190 host target gene. MGC27382 BINDING SITE is HOST TARGET binding site found in the 3' untranslated region of mRNA encoded by MGC27382, corresponding to a HOST TARGET binding site such as BINDING SITE I, BINDING SITE II or BINDING SITE III. Table 2 illustrates the complementarity of the nucleotide sequences of MGC27382 BINDING SITE, designated SEQ ID:29524, to the nucleotide sequence of VGAM1190 RNA, herein designated VGAM RNA, also designated SEQ ID:3901.

Another function of VGAM1190 is therefore inhibition of MGC27382 (Accession NM_144700). Accordingly, utilities of VGAM1190 include diagnosis, prevention and treatment of diseases and clinical conditions associated with MGC27382. MIG (Accession NM_002416) is another VGAM1190 host target gene. MIG BINDING SITE is HOST TARGET binding site found in the 3' untranslated region of mRNA encoded by MIG, corresponding to a HOST TARGET binding site such as BINDING SITE I, BINDING SITE II or BINDING SITE III. Table 2 illustrates the complementarity of the nucleotide sequences of MIG BINDING SITE, designated SEQ ID:8244, to the nucleotide sequence of VGAM1190 RNA, herein designated VGAM RNA, also designated SEQ ID:3901.

Another function of VGAM1190 is therefore inhibition of MIG (Accession NM_002416). Accordingly, utilities of VGAM1190 include diagnosis, prevention and treatment of diseases and clinical conditions associated with MIG. Stromal Cell Derived Factor Receptor 1 (SDFR1, Accession NM_012428) is another VGAM1190 host target gene. SDFR1 BINDING SITE1 and SDFR1 BINDING SITE2 are HOST TARGET binding sites found in untranslated regions of mRNA encoded by SDFR1, corresponding to HOST TARGET binding sites such as BINDING SITE I, BINDING SITE II or BINDING SITE III. Table 2 illustrates the complementarity of the nucleotide sequences of SDFR1 BINDING SITE1 and SDFR1 BINDING SITE2, designated SEQ ID:14802 and SEQ ID:18929 respectively, to the nucleotide sequence of VGAM1190 RNA, herein designated VGAM RNA, also designated SEQ ID:3901.

Another function of VGAM1190 is therefore inhibition of Stromal Cell Derived Factor Receptor 1 (SDFR1, Accession NM_012428). Accordingly, utilities of VGAM1190 include diagnosis, prevention and treatment of diseases and clinical conditions associated with SDFR1. FIG. 1 further provides a conceptual description of a novel bioinformatically detected viral gene of the present invention, referred to here as Viral Genomic Address Messenger 1191 (VGAM1191) viral gene, which modulates expression of respective host target genes thereof, the function and utility of which host target genes is known in the art.

VGAM1191 is a novel bioinformatically detected regulatory, non protein coding, viral micro RNA (miRNA) gene. The method by which VGAM1191 was detected is described hereinabove with reference to FIGS. 1-8.

VGAM1191 gene, herein designated VGAM GENE, is a viral gene contained in the genome of Botrytis Virus F. VGAM1191 host target gene, herein designated VGAM HOST TARGET GENE, is a human gene contained in the human genome.

VGAM1191 gene encodes a VGAM1191 precursor RNA, herein designated VGAM PRECURSOR RNA. Similar to other miRNA genes, and unlike most ordinary genes, VGAM1191 precursor RNA does not encode a protein. A nucleotide sequence identical or highly similar to the nucleotide sequence of VGAM1191 precursor RNA is designated SEQ ID:1177, and is provided hereinbelow with reference to the sequence listing part. Nucleotide sequence SEQ ID:1177 is located at position 5016 relative to the genome of Botrytis Virus F.

VGAM1191 precursor RNA folds onto itself, forming VGAM1191 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1191 folded precursor RNA into VGAM1191 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM1191 RNA is designated SEQ ID:3902, and is provided hereinbelow with reference to the sequence listing part.

VGAM1191 host target gene, herein designated VGAM HOST TARGET GENE, encodes a corresponding messenger RNA, VGAM1191 host target RNA, herein designated VGAM HOST TARGET RNA. VGAM1191 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1191 RNA, herein designated VGAM RNA, binds complementarily to one or more host target binding sites located in untranslated regions of VGAM1191 host target RNA, herein designated VGAM HOST TARGET RNA. This complementary binding is due to the fact that the nucleotide sequence of VGAM1191 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1191 RNA, herein designated VGAM RNA, may have a different number of host target binding sites in untranslated regions of a VGAM1191 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1191 RNA, herein designated VGAM RNA, to host target binding sites on VGAM1191 host target RNA, herein designated VGAM HOST TARGET RNA, such as BINDING SITE I, BINDING SITE II and BINDING SITE III, inhibits translation of VGAM1191 host target RNA into VGAM1191 host target protein, herein designated VGAM HOST TARGET PROTEIN. VGAM host target protein is therefore outlined by a broken line.

It is appreciated that VGAM1191 host target gene, herein designated VGAM HOST TARGET GENE, in fact represents a plurality of VGAM1191 host target genes. The mRNA of each one of this plurality of VGAM1191 host target genes comprises one or more host target binding sites, each having a nucleotide sequence which is at least partly complementary to VGAM1191 RNA, herein designated VGAM RNA, and which when bound by VGAM1191 RNA causes inhibition of translation of respective one or more VGAM1191 host target proteins.

It is further appreciated by one skilled in the art that the mode of translational inhibition illustrated by FIG. 1 with specific reference to translational inhibition exerted by VGAM1191 gene, herein designated VGAM GENE, on one or more VGAM1191 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1191 is inhibition of expression of host target genes, as part of a novel viral mechanism of attacking a host. Accordingly, utilities of VGAM1191 include diagnosis, prevention and treatment of viral infection by Botrytis Virus F. Specific functions, and accordingly utilities, of VGAM1191 correlate with, and may be deduced from, the identity of the host target genes which VGAM1191 binds and inhibits, and the function of these host target genes, as elaborated hereinbelow.

Nucleotide sequences of the VGAM1191 precursor RNA, herein designated VGAM PRECURSOR RNA, and of the 'diced' VGAM1191 RNA, herein designated VGAM RNA, and a schematic representation of the secondary folding of VGAM1191 folded precursor RNA, herein designated VGAM FOLDED PRECURSOR RNA, of VGAM1191 are further described hereinbelow with reference to Table 1.

Nucleotide sequences of host target binding sites, such as BINDING SITE-I, BINDING SITE-II and BINDING SITE-III of FIG. 1, found on VGAM1191 host target RNA, and a schematic representation of the complementarity of each of these host target binding sites to VGAM1191 RNA, herein designated VGAM RNA, are described hereinbelow with reference to Table 2.

As mentioned hereinabove with reference to FIG. 1, a function of VGAM1191 gene, herein designated VGAM is inhibition of expression of VGAM1191 target genes. It is appreciated that specific functions, and accordingly utilities, of VGAM1191 correlate with, and may be deduced from, the identity of the target genes which VGAM1191 binds and inhibits, and the function of these target genes, as elaborated hereinbelow.

Caspase Recruitment Domain Family, Member 15 (CARD15, Accession NM_022162) is a VGAM1191 host target gene. CARD15 BINDING SITE is HOST TARGET binding site found in the 3' untranslated region of mRNA encoded by CARD15, corresponding to a HOST TARGET binding site such as BINDING SITE I, BINDING SITE II or BINDING SITE III. Table 2 illustrates the complementarity of the nucleotide sequences of CARD15 BINDING SITE, designated SEQ ID:22715, to the nucleotide sequence of VGAM1191 RNA, herein designated VGAM RNA, also designated SEQ ID:3902.

A function of VGAM1191 is therefore inhibition of Caspase Recruitment Domain Family, Member 15 (CARD15, Accession NM_022162), a gene which serves as an intracellular receptor for bacterial products in monocytes and transduces signals leading to NFKB activation. Accordingly, utilities of VGAM1191 include diagnosis, prevention and treatment of diseases and clinical conditions associated with CARD15. The function of CARD15 and its association with various diseases and clinical conditions, has been established by previous studies, as described hereinabove with reference to VGAM126. Huntingtin (Huntington disease) (HD, Accession NM_002111) is another VGAM1191 host target gene. HD BINDING SITE is HOST TARGET binding site found in the 3' untranslated region of mRNA encoded by HD, corresponding to a HOST TARGET binding site such as BINDING SITE I, BINDING SITE II or BINDING SITE III. Table 2 illustrates the complementarity of the nucleotide sequences of HD BINDING SITE, designated SEQ ID:7899, to the nucleotide sequence of VGAM1191 RNA, herein designated VGAM RNA, also designated SEQ ID:3902.

Another function of VGAM1191 is therefore inhibition of Huntingtin (Huntington disease) (HD, Accession NM_002111). Accordingly, utilities of VGAM1191 include diagnosis, prevention and treatment of diseases and clinical conditions associated with HD. LIM Domain Kinase 1 (LIMK1, Accession NM_016735) is another VGAM1191 host target gene. LIMK1 BINDING SITE is HOST TARGET binding site found in the 3' untranslated region of mRNA encoded by LIMK1, corresponding to a HOST TARGET binding site such as BINDING SITE I, BINDING SITE II or BINDING SITE III. Table 2 illustrates the complementarity of the nucleotide sequences of LIMK1 BINDING SITE, designated SEQ ID:18802, to the nucleotide sequence of VGAM1191 RNA, herein designated VGAM RNA, also designated SEQ ID:3902.

Another function of VGAM1191 is therefore inhibition of LIM Domain Kinase 1 (LIMK1, Accession NM_016735). Accordingly, utilities of VGAM1191 include diagnosis, prevention and treatment of diseases and clinical conditions associated with LIMK1. Src Homology Three (SH3) and Cysteine Rich Domain (STAC, Accession NM_003149) is another VGAM1191 host target gene. STAC BINDING SITE is HOST TARGET binding site found in the 3' untranslated region of mRNA encoded by STAC, corresponding to a HOST TARGET binding site such as BINDING SITE I, BINDING SITE II or BINDING SITE III. Table 2 illustrates the complementarity of the nucleotide sequences of STAC BINDING SITE, designated SEQ ID:9117, to the nucleotide sequence of VGAM1191 RNA, herein designated VGAM RNA, also designated SEQ ID:3902.

Another function of VGAM1191 is therefore inhibition of Src Homology Three (SH3) and Cysteine Rich Domain (STAC, Accession NM_003149), a gene which is probably involved in a neuron-specific signal transduction. Accordingly, utilities of VGAM1191 include diagnosis, prevention and treatment of diseases and clinical conditions associated with STAC. The function of STAC and its association with various diseases and clinical conditions, has been established by previous studies, as described hereinabove with reference to VGAM331. Stromal Interaction Molecule 1 (STIM1, Accession XM_011967) is another VGAM1191 host target gene. STIM1 BINDING SITE is HOST TARGET binding site found in the 3' untranslated region of mRNA encoded by STIM1, corresponding to a HOST TARGET binding site such as BINDING SITE I, BINDING SITE II or BINDING SITE III. Table 2 illustrates the complementarity of the nucleotide sequences of STIM1 BINDING SITE, designated SEQ ID:30201, to the nucleotide sequence of VGAM1191 RNA, herein designated VGAM RNA, also designated SEQ ID:3902.

Another function of VGAM1191 is therefore inhibition of Stromal Interaction Molecule 1 (STIM1, Accession XM_011967), a gene which is very strongly similar to murine Stim1 and may be a transmembrane stromal cell protein. Accordingly, utilities of VGAM1191 include diagnosis, prevention and treatment of diseases and clinical conditions associated with STIM1. The function of STIM1 has been established by previous studies. Using sequences identified by database searching with a transcript from human chromosome 11p15.5, Parker et al. (1996) screened placental and fetal liver cDNA libraries and cloned a novel cDNA, STIM1, which they called GOK. The deduced 746-amino acid protein contains a predicted signal peptide and transmembrane helix. Parker et al. (1996) also cloned a partial mouse Stim1 genomic clone and found that the human and mouse proteins share 90% sequence identity. Restriction mapping by pulsed field electrophoresis placed the STIM1 gene 1.7 kb telomeric of the RRM1 gene (OMIM Ref. No. 180410) on 11p15.5 (Parker et al., 1996). Sabbioni et al. (1999) determined that the STIM1 gene contains 12 exons that span more than 250 kb between the RRM1 and NUP98 (OMIM Ref. No. 601021) genes.

Full details of the abovementioned studies are described in the following publications, the disclosure of which are hereby incorporated by reference:

Parker, N. J.; Begley, C. G.; Smith, P. J.; Fox, R. M.: Molecular cloning of a novel human gene (D11S4896E) at chromosomal region 11p15.5. Genomics 37:253-256, 1996; and Sabbioni, S.; Veronese, A.; Trubia, M.; Taramelli, R.; Barbanti-Brodano, G.; Croce, C. M.; Negrini, M.: Exon structure and promoter identification of STIM1 (alias GOK), a human gene ca.

Further studies establishing the function and utilities of STIM1 are found in John Hopkins OMIM database record ID 605921, and in sited publications numbered 6438-6439 listed in the bibliography section hereinbelow, which are also hereby incorporated by reference. BMF (Accession NM_033503) is another VGAM1191 host target gene. BMF BINDING SITE is HOST TARGET binding site found in the 3' untranslated region of mRNA encoded by BMF, corresponding to a HOST TARGET binding site such as BINDING SITE I, BINDING SITE II or BINDING SITE III. Table 2 illustrates the complementarity of the nucleotide sequences of BMF BINDING SITE, designated SEQ ID:27283, to the nucleotide sequence of VGAM1191 RNA, herein designated VGAM RNA, also designated SEQ ID:3902.

Another function of VGAM1191 is therefore inhibition of BMF (Accession NM_033503). Accordingly, utilities of VGAM1191 include diagnosis, prevention and treatment of diseases and clinical conditions associated with BMF. CDC14 Cell Division Cycle 14 Homolog B (S. cerevisiae) (CDC14B, Accession NM_003671) is another VGAM1191 host target gene. CDC14B BINDING SITE1 and CDC14B BINDING SITE2 are HOST TARGET binding sites found in untranslated regions of mRNA encoded by CDC14B, corresponding to HOST TARGET binding sites such as BINDING SITE I, BINDING SITE II or BINDING SITE III. Table 2 illustrates the complementarity of the nucleotide sequences of CDC14B BINDING SITE1 and CDC14B BINDING SITE2, designated SEQ ID:9760 and SEQ ID:27164 respectively, to the nucleotide sequence of VGAM1191 RNA, herein designated VGAM RNA, also designated SEQ ID:3902.

Another function of VGAM1191 is therefore inhibition of CDC14 Cell Division Cycle 14 Homolog B (S. cerevisiae) (CDC14B, Accession NM_003671). Accordingly, utilities of VGAM1191 include diagnosis, prevention and treatment of diseases and clinical conditions associated with CDC14B. MGC12992 (Accession NM_032342) is another VGAM1191 host target gene. MGC12992 BINDING SITE is HOST TARGET binding site found in the 5' untranslated region of mRNA encoded by MGC12992, corresponding to a HOST TARGET binding site such as BINDING SITE I, BINDING SITE II or BINDING SITE III. Table 2 illustrates the complementarity of the nucleotide sequences of MGC12992 BINDING SITE, designated SEQ ID:26136, to the nucleotide sequence of VGAM1191 RNA, herein designated VGAM RNA, also designated SEQ ID:3902.

Another function of VGAM1191 is therefore inhibition of MGC12992 (Accession NM_032342). Accordingly, utilities of VGAM1191 include diagnosis, prevention and treatment of diseases and clinical conditions associated with MGC12992. Tripartite Motif-containing 2 (TRIM2, Accession NM_015271) is another VGAM1191 host target gene. TRIM2 BINDING SITE is HOST TARGET binding site found in the 3' untranslated region of mRNA encoded by TRIM2, corresponding to a HOST TARGET binding site such as BINDING SITE I, BINDING SITE II or BINDING SITE III. Table 2 illustrates the complementarity of the nucleotide sequences of TRIM2 BINDING SITE, designated SEQ ID:17603, to the nucleotide sequence of VGAM1191 RNA, herein designated VGAM RNA, also designated SEQ ID:3902.

Another function of VGAM1191 is therefore inhibition of Tripartite Motif-containing 2 (TRIM2, Accession NM_015271). Accordingly, utilities of VGAM1191 include diagnosis, prevention and treatment of diseases and clinical conditions associated with TRIM2. LOC92080 (Accession XM_042704) is another VGAM1191 host target gene. LOC92080 BINDING SITE is HOST TARGET binding site found in the 5' untranslated region of mRNA encoded by LOC92080, corresponding to a HOST TARGET binding site such as BINDING SITE I, BINDING SITE II or BINDING SITE III. Table 2 illustrates the complementarity of the nucleotide sequences of LOC92080 BINDING SITE, designated SEQ ID:33757, to the nucleotide sequence of VGAM1191 RNA, herein designated VGAM RNA, also designated SEQ ID:3902.

Another function of VGAM1191 is therefore inhibition of LOC92080 (Accession XM_042704). Accordingly, utilities of VGAM1191 include diagnosis, prevention and treatment of diseases and clinical conditions associated with LOC92080. FIG. 1 further provides a conceptual description of a novel bioinformatically detected viral gene of the present invention, referred to here as Viral Genomic Address Messenger 1192 (VGAM1192) viral gene, which modulates expression of respective host target genes thereof, the function and utility of which host target genes is known in the art.

VGAM1192 is a novel bioinformatically detected regulatory, non protein coding, viral micro RNA (miRNA) gene. The method by which VGAM1192 was detected is described hereinabove with reference to FIGS. 1-8.

VGAM1192 gene, herein designated VGAM GENE, is a viral gene contained in the genome of Cowpox Virus. VGAM1192 host target gene, herein designated VGAM HOST TARGET GENE, is a human gene contained in the human genome.

VGAM1192 gene encodes a VGAM1192 precursor RNA, herein designated VGAM PRECURSOR RNA. Similar to other miRNA genes, and unlike most ordinary genes, VGAM1192 precursor RNA does not encode a protein. A nucleotide sequence identical or highly similar to the nucleotide sequence of VGAM1192 precursor RNA is designated SEQ ID:1178, and is provided hereinbelow with reference to the sequence listing part. Nucleotide sequence SEQ ID:1178 is located at position 37365 relative to the genome of Cowpox Virus.

VGAM1192 precursor RNA folds onto itself, forming VGAM1192 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1192 folded precursor RNA into VGAM1192 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1192 RNA is designated SEQ ID:3903, and is provided hereinbelow with reference to the sequence listing part.

VGAM1192 host target gene, herein designated VGAM HOST TARGET GENE, encodes a corresponding messenger RNA, VGAM1192 host target RNA, herein designated VGAM HOST TARGET RNA. VGAM1192 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1192 RNA, herein designated VGAM RNA, binds complementarily to one or more host target binding sites located in untranslated regions of VGAM1192 host target RNA, herein designated VGAM HOST TARGET RNA. This complementary binding is due to the fact that the nucleotide sequence of VGAM1192 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1192 RNA, herein designated VGAM RNA, may have a different number of host target binding sites in untranslated regions of a VGAM1192 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1192 RNA, herein designated VGAM RNA, to host target binding sites on VGAM1192 host target RNA, herein designated VGAM HOST TARGET RNA, such as BINDING SITE I, BINDING SITE II and BINDING SITE III, inhibits translation of VGAM1192 host target RNA into VGAM1192 host target protein, herein designated VGAM HOST TARGET PROTEIN. VGAM host target protein is therefore outlined by a broken line.

It is appreciated that VGAM1192 host target gene, herein designated VGAM HOST TARGET GENE, in fact represents a plurality of VGAM1192 host target genes. The mRNA of each one of this plurality of VGAM1192 host target genes comprises one or more host target binding sites, each having a nucleotide sequence which is at least partly complementary to VGAM1192 RNA, herein designated VGAM RNA, and which when bound by VGAM1192 RNA causes inhibition of translation of respective one or more VGAM1192 host target proteins.

It is further appreciated by one skilled in the art that the mode of translational inhibition illustrated by FIG. 1 with specific reference to translational inhibition exerted by VGAM1192 gene, herein designated VGAM GENE, on one or more VGAM1192 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1192 is inhibition of expression of host target genes, as part of a novel viral mechanism of attacking a host. Accordingly, utilities of VGAM1192 include diagnosis, prevention and treatment of viral infection by Cowpox Virus. Specific functions, and accordingly utilities, of VGAM1192 correlate with, and may be deduced from, the identity of the host target genes which VGAM1192 binds and inhibits, and the function of these host target genes, as elaborated hereinbelow.

Nucleotide sequences of the VGAM1192 precursor RNA, herein designated VGAM PRECURSOR RNA, and of the 'diced' VGAM1192 RNA, herein designated VGAM RNA, and a schematic representation of the secondary folding of VGAM1192 folded precursor RNA, herein designated VGAM FOLDED PRECURSOR RNA, of VGAM1192 are further described hereinbelow with reference to Table 1.

Nucleotide sequences of host target binding sites, such as BINDING SITE-I, BINDING SITE-II and BINDING SITE-III of FIG. 1, found on VGAM1192 host target RNA, and schematic representation of the complementarity of each of these host target binding sites to VGAM1192 RNA, herein designated VGAM RNA, are described hereinbelow with reference to Table 2.

As mentioned hereinabove with reference to FIG. 1, a function of VGAM1192 gene, herein designated VGAM is inhibition of expression of VGAM1192 target genes. It is appreciated that specific functions, and accordingly utilities, of VGAM1192 correlate with, and may be deduced from, the identity of the target genes which VGAM1192 binds and inhibits, and the function of these target genes, as elaborated hereinbelow.

FLJ12888 (Accession NM_024945) is a VGAM1192 host target gene. FLJ12888 BINDING SITE is HOST TARGET binding site found in the 3' untranslated region of mRNA encoded by FLJ12888, corresponding to a HOST TARGET binding site such as BINDING SITE I, BINDING SITE II or BINDING SITE III. Table 2 illustrates the complementarity of the nucleotide sequences of FLJ12888 BINDING SITE, designated SEQ ID:24495, to the nucleotide sequence of VGAM1192 RNA, herein designated VGAM RNA, also designated SEQ ID:3903.

A function of VGAM1192 is therefore inhibition of FLJ12888 (Accession NM_024945). Accordingly, utilities of VGAM1192 include diagnosis, prevention and treatment of diseases and clinical conditions associated with FLJ12888. FLJ22794 (Accession XM_166220) is another VGAM1192 host target gene. FLJ22794 BINDING SITE is HOST TARGET binding site found in the 5' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44032, to the nucleotide sequence of VGAM1192 RNA, herein designated VGAM RNA, also designated SEQ ID:3903.

Another function of VGAM1192 is therefore inhibition of FLJ22794 (Accession XM_166220). Accordingly, utilities of VGAM1192 include diagnosis, prevention and treatment of diseases and clinical conditions associated with FLJ22794. MEP50 (Accession NM_024102) is another VGAM1192 host target gene. MEP50 BINDING SITE is HOST TARGET binding site found in the 3' untranslated region of mRNA encoded by MEP50, corresponding to a HOST TARGET binding site such as BINDING SITE I, BINDING SITE II or BINDING SITE III. Table 2 illustrates the complementarity of the nucleotide sequences of MEP50 BINDING SITE, designated SEQ ID:23547, to the nucleotide sequence of VGAM1192 RNA, herein designated VGAM RNA, also designated SEQ ID:3903.

Another function of VGAM1192 is therefore inhibition of MEP50 (Accession NM_024102). Accordingly, utilities of VGAM1192 include diagnosis, prevention and treatment of diseases and clinical conditions associated with MEP50. LOC256846 (Accession XM_170921) is another VGAM1192 host target gene. LOC256846 BINDING SITE is HOST TARGET binding site found in the 5' untranslated region of mRNA encoded by LOC256846, corresponding to a HOST TARGET binding site such as BINDING SITE I, BINDING SITE II or BINDING SITE III. Table 2 illustrates the complementarity of the nucleotide sequences of LOC256846 BINDING SITE, designated SEQ ID:45698, to the nucleotide sequence of VGAM1192 RNA, herein designated VGAM RNA, also designated SEQ ID:3903.

Another function of VGAM1192 is therefore inhibition of LOC256846 (Accession XM_170921). Accordingly, utilities of VGAM1192 include diagnosis, prevention and treatment of diseases and clinical conditions associated with LOC256846. LOC90355 (Accession NM_033211) is another VGAM1192 host target gene. LOC90355 BINDING SITE is HOST TARGET binding site found in the 3' untranslated region of mRNA encoded by LOC90355, corresponding to a HOST TARGET binding site such as BINDING SITE I, BINDING SITE II or BINDING SITE III. Table 2 illustrates the complementarity of the nucleotide sequences of LOC90355 BINDING SITE, designated SEQ ID:27062, to the nucleotide sequence of VGAM1192 RNA, herein designated VGAM RNA, also designated SEQ ID:3903.

Another function of VGAM1192 is therefore inhibition of LOC90355 (Accession NM_033211). Accordingly, utilities of VGAM1192 include diagnosis, prevention and treatment of diseases and clinical conditions associated with LOC90355. FIG. 1 further provides a conceptual description of a novel bioinformatically detected viral gene of the present invention, referred to here as Viral Genomic Address Messenger 1193 (VGAM1193) viral gene, which modulates expression of respective host target genes thereof, the function and utility of which host target genes is known in the art.

VGAM1193 is a novel bioinformatically detected regulatory, non protein coding, viral micro RNA (miRNA) gene. The method by which VGAM1193 was detected is described hereinabove with reference to FIGS. 1-8.

VGAM1193 gene, herein designated VGAM GENE, is a viral gene contained in the genome of Vaccinia Virus. VGAM1193 host target gene, herein designated VGAM HOST TARGET GENE, is a human gene contained in the human genome.

VGAM1193 gene encodes a VGAM1193 precursor RNA, herein designated VGAM PRECURSOR RNA. Similar to other miRNA genes, and unlike most ordinary genes, VGAM1193 precursor RNA does not encode a protein. A nucleotide sequence identical or highly similar to the nucleotide sequence of VGAM1193 precursor RNA is designated SEQ ID:1179, and is provided hereinbelow with reference to the sequence listing part. Nucleotide sequence SEQ ID:1179 is located at position 26098 relative to the genome of Vaccinia Virus.

VGAM1193 precursor RNA folds onto itself, forming VGAM1193 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1193 folded precursor RNA into VGAM1193 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1193 RNA is designated SEQ ID:3904, and is provided hereinbelow with reference to the sequence listing part.

VGAM1193 host target gene, herein designated VGAM HOST TARGET GENE, encodes a corresponding messenger RNA, VGAM1193 host target RNA, herein designated VGAM HOST TARGET RNA. VGAM1193 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1193 RNA, herein designated VGAM RNA, binds complementarily to one or more host target binding sites located in untranslated regions of VGAM1193 host target RNA, herein designated VGAM HOST TARGET RNA. This complementary binding is due to the fact that the nucleotide sequence of VGAM1193 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1193 RNA, herein designated VGAM RNA, may have a different number of host target binding sites in untranslated regions of a VGAM1193 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1193 RNA, herein designated VGAM RNA, to host target binding sites on VGAM1193 host target RNA, herein designated VGAM HOST TARGET RNA, such as BINDING SITE I, BINDING SITE II and BINDING SITE III, inhibits translation of VGAM1193 host target RNA into VGAM1193 host target protein, herein designated VGAM HOST TARGET PROTEIN. VGAM host target protein is therefore outlined by a broken line.

It is appreciated that VGAM1193 host target gene, herein designated VGAM HOST TARGET GENE, in fact represents a plurality of VGAM1193 host target genes. The mRNA of each one of this plurality of VGAM1193 host target genes comprises one or more host target binding sites, each having a nucleotide sequence which is at least partly complementary to VGAM1193 RNA, herein designated VGAM RNA, and which when bound by VGAM1193 RNA causes inhibition of translation of respective one or more VGAM1193 host target proteins.

It is further appreciated by one skilled in the art that the mode of translational inhibition illustrated by FIG. 1 with specific reference to translational inhibition exerted by VGAM1193 gene, herein designated VGAM GENE, on one or more VGAM1193 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1193 is inhibition of expression of host target genes, as part of a novel viral mechanism of attacking a host. Accordingly, utilities of VGAM1193 include diagnosis, prevention and treatment of viral infection by Vaccinia Virus. Specific functions, and accordingly utilities, of VGAM1193 correlate with, and may be deduced from, the identity of the host target genes which VGAM1193 binds and inhibits, and the function of these host target genes, as elaborated hereinbelow.

Nucleotide sequences of the VGAM1193 precursor RNA, herein designated VGAM PRECURSOR RNA, and of the 'diced' VGAM1193 RNA, herein designated VGAM RNA, and a schematic representation of the secondary folding of VGAM1193 folded precursor RNA, herein designated VGAM FOLDED PRECURSOR RNA, of VGAM1193 are further described hereinbelow with reference to Table 1.

Nucleotide sequences of host target binding sites, such as BINDING SITE-I, BINDING SITE-II and BINDING SITE-III of FIG. 1, found on VGAM1193 host target RNA, and schematic representation of the complementarity of each of these host target binding sites to VGAM1193 RNA, herein designated VGAM RNA, are described hereinbelow with reference to Table 2.

As mentioned hereinabove with reference to FIG. 1, a function of VGAM1193 gene, herein designated VGAM is inhibition of expression of VGAM1193 target genes. It is appreciated that specific functions, and accordingly utilities, of VGAM1193 correlate with, and may be deduced from, the identity of the target genes which VGAM1193 binds and inhibits, and the function of these target genes, as elaborated hereinbelow.

Solute Carrier Family 1 (glutamate/neutral amino acid transporter), Member 4 (SLC1A4, Accession NM_003038) is a VGAM1193 host target gene. SLC1A4 BINDING SITE is HOST TARGET binding site found in the 3' untranslated region of mRNA encoded by SLC1A4, corresponding to a HOST TARGET binding site such as BINDING SITE I, BINDING SITE II or BINDING SITE III. Table 2 illustrates the complementarity of the nucleotide sequences of SLC1A4 BINDING SITE, designated SEQ ID:8997, to the nucleotide sequence of VGAM1193 RNA, herein designated VGAM RNA, also designated SEQ ID:3904.

A function of VGAM1193 is therefore inhibition of Solute Carrier Family 1 (glutamate/neutral amino acid transporter), Member 4 (SLC1A4, Accession NM_003038), a gene which transports alanine, serine, cysteine, and threonine. exhibits sodium dependence. Accordingly, utilities of VGAM1193 include diagnosis, prevention and treatment of diseases and clinical conditions associated with SLC1A4. The function of SLC1A4 and its association with various diseases and clinical conditions, has been established by previous studies, as described hereinabove with reference to VGAM859. BC008967 (Accession XM_027309) is another VGAM1193 host target gene. BC008967 BINDING SITE is HOST TARGET binding site found in the 5' untranslated region of mRNA encoded by BC008967, corresponding to a HOST TARGET binding site such as BINDING SITE I, BINDING SITE II or BINDING SITE III. Table 2 illustrates the complementarity of the nucleotide sequences of BC008967 BINDING SITE, designated SEQ ID:30476, to the nucleotide sequence of VGAM1193 RNA, herein designated VGAM RNA, also designated SEQ ID:3904.

Another function of VGAM1193 is therefore inhibition of BC008967 (Accession XM_027309). Accordingly, utilities of VGAM1193 include diagnosis, prevention and treatment of diseases and clinical conditions associated with BC008967. LOC158722 (Accession XM_088653) is another VGAM1193 host target gene. LOC158722 BINDING SITE is HOST TARGET binding site found in the 3' untranslated region of mRNA encoded by LOC158722, corresponding to a HOST TARGET binding site such as BINDING SITE I, BINDING SITE II or BINDING SITE III. Table 2 illustrates the complementarity of the nucleotide sequences of LOC158722 BINDING SITE, designated SEQ ID:39889, to the nucleotide sequence of VGAM1193 RNA, herein designated VGAM RNA, also designated SEQ ID:3904.

Another function of VGAM1193 is therefore inhibition of LOC158722 (Accession XM_088653). Accordingly, utilities of VGAM1193 include diagnosis, prevention and treatment of diseases and clinical conditions associated with LOC158722. LOC91650 (Accession XM_039853) is another VGAM1193 host target gene. LOC91650 BINDING SITE is HOST TARGET binding site found in the 5' untranslated region of mRNA encoded by LOC91650, corresponding to a HOST TARGET binding site such as BINDING SITE I, BINDING SITE II or BINDING SITE III. Table 2 illustrates the complementarity of the nucleotide sequences of LOC91650 BINDING SITE, designated SEQ ID:33200, to the nucleotide sequence of VGAM1193 RNA, herein designated VGAM RNA, also designated SEQ ID:3904.

Another function of VGAM1193 is therefore inhibition of LOC91650 (Accession XM_039853). Accordingly, utilities of VGAM1193 include diagnosis, prevention and treatment of diseases and clinical conditions associated with LOC91650. FIG. 1 further provides a conceptual description of a novel bioinformatically detected viral gene of the present invention, referred to here as Viral Genomic Address Messenger 1194 (VGAM1194) viral gene, which modulates expression of respective host target genes thereof, the function and utility of which host target genes is known in the art.

VGAM1194 is a novel bioinformatically detected regulatory, non protein coding, viral micro RNA (miRNA) gene. The method by which VGAM1194 was detected is described hereinabove with reference to FIGS. 1-8.

VGAM1194 gene, herein designated VGAM GENE, is a viral gene contained in the genome of Camelpox Virus. VGAM1194 host target gene, herein designated VGAM HOST TARGET GENE, is a human gene contained in the human genome.

VGAM1194 gene encodes a VGAM1194 precursor RNA, herein designated VGAM PRECURSOR RNA. Similar to other miRNA genes, and unlike most ordinary genes, VGAM1194 precursor RNA does not encode a protein. A nucleotide sequence identical or highly similar to the nucleotide sequence of VGAM1194 precursor RNA is designated SEQ ID:1180, and is provided hereinbelow with reference to the sequence listing part. Nucleotide sequence SEQ ID:1180 is located at position 25686 relative to the genome of Camelpox Virus.

VGAM1194 precursor RNA folds onto itself, forming VGAM1194 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1194 folded precursor RNA into VGAM1194 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1194 RNA is designated SEQ ID:3905, and is provided hereinbelow with reference to the sequence listing part.

VGAM1194 host target gene, herein designated VGAM HOST TARGET GENE, encodes a corresponding messenger RNA, VGAM1194 host target RNA, herein designated VGAM HOST TARGET RNA. VGAM1194 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1194 RNA, herein designated VGAM RNA, binds complementarily to one or more host target binding sites located in untranslated regions of VGAM1194 host target RNA, herein designated VGAM HOST TARGET RNA. This complementary binding is due to the fact that the nucleotide sequence of VGAM1194 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1194 RNA, herein designated VGAM RNA, may have a different number of host target binding sites in untranslated regions of a VGAM1194 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1194 RNA, herein designated VGAM RNA, to host target binding sites on VGAM1194 host target RNA, herein designated VGAM HOST TARGET RNA, such as BINDING SITE I, BINDING SITE II and BINDING SITE III, inhibits translation of VGAM1194 host target RNA into VGAM1194 host target protein, herein designated VGAM HOST TARGET PROTEIN. VGAM host target protein is therefore outlined by a broken line.

It is appreciated that VGAM1194 host target gene, herein designated VGAM HOST TARGET GENE, in fact represents a plurality of VGAM1194 host target genes. The mRNA of each one of this plurality of VGAM1194 host target genes comprises one or more host target binding sites, each having a nucleotide sequence which is at least partly complementary to VGAM1194 RNA, herein designated VGAM RNA, and which when bound by VGAM1194 RNA causes inhibition of translation of respective one or more VGAM1194 host target proteins.

It is further appreciated by one skilled in the art that the mode of translational inhibition illustrated by FIG. 1 with specific reference to translational inhibition exerted by VGAM1194 gene, herein designated VGAM GENE, on one or more VGAM1194 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1194 is inhibition of expression of host target genes, as part of a novel viral mechanism of attacking a host. Accordingly, utilities of VGAM1194 include diagnosis, prevention and treatment of viral infection by Camelpox Virus. Specific functions, and accordingly utilities, of VGAM1194 correlate with, and may be deduced from, the identity of the host target genes which VGAM1194 binds and inhibits, and the function of these host target genes, as elaborated hereinbelow.

Nucleotide sequences of the VGAM1194 precursor RNA, herein designated VGAM PRECURSOR RNA, and of the 'diced' VGAM1194 RNA, herein designated VGAM RNA, and a schematic representation of the secondary folding of VGAM1194 folded precursor RNA, herein designated VGAM FOLDED PRECURSOR RNA, of VGAM1194 are further described hereinbelow with reference to Table 1.

Nucleotide sequences of host target binding sites, such as BINDING SITE-I, BINDING SITE-II and BINDING SITE-III of FIG. 1, found on VGAM1194 host target RNA, and schematic representation of the complementarity of each of these host target binding sites to VGAM1194 RNA, herein designated VGAM RNA, are described hereinbelow with reference to Table 2.

As mentioned hereinabove with reference to FIG. 1, a function of VGAM1194 gene, herein designated VGAM is inhibition of expression of VGAM1194 target genes. It is appreciated that specific functions, and accordingly utilities, of VGAM1194 correlate with, and may be deduced from, the identity of the target genes which VGAM1194 binds and inhibits, and the function of these target genes, as elaborated hereinbelow.

Ectodermal Dysplasia 1, Anhidrotic (ED1, Accession NM_001399) is a VGAM1194 host target gene. ED1 BINDING SITE is HOST TARGET binding site found in the 3' untranslated region of mRNA encoded by ED1, corresponding to a HOST TARGET binding site such as BINDING SITE I, BINDING SITE II or BINDING SITE III. Table 2 illustrates the complementarity of the nucleotide sequences of ED1 BINDING SITE, designated SEQ ID:7101, to the nucleotide sequence of VGAM1194 RNA, herein designated VGAM RNA, also designated SEQ ID:3905.

A function of VGAM1194 is therefore inhibition of Ectodermal Dysplasia 1, Anhidrotic (ED1, Accession NM_001399). Accordingly, utilities of VGAM1194 include diagnosis, prevention and treatment of diseases and clinical conditions associated with ED1. Oxidative-stress Responsive 1 (OSR1, Accession NM_005109) is another VGAM1194 host target gene. OSR1 BINDING SITE is HOST TARGET binding site found in the 3' untranslated region of mRNA encoded by OSR1, corresponding to a HOST TARGET binding site such as BINDING SITE I, BINDING SITE II or BINDING SITE III. Table 2 illustrates the complementarity of the nucleotide sequences of OSR1 BINDING SITE, designated SEQ ID:11590, to the nucleotide sequence of VGAM1194 RNA, herein designated VGAM RNA, also designated SEQ ID:3905.

Another function of VGAM1194 is therefore inhibition of Oxidative-stress Responsive 1 (OSR1, Accession NM_005109), a gene which mediats stress-activated signals. Accordingly, utilities of VGAM1194 include diagnosis, prevention and treatment of diseases and clinical conditions associated with OSR1. The function of OSR1 and its association with various diseases and clinical conditions, has been established by previous studies, as described hereinabove with reference to VGAM538. Paired Basic Amino Acid Cleaving System 4 (PACE4, Accession NM_138325) is another VGAM1194 host target gene. PACE4 BINDING SITE is HOST TARGET binding site found in the 5' untranslated region of mRNA encoded by PACE4, corresponding to a HOST TARGET binding site such as BINDING SITE I, BINDING SITE II or BINDING SITE III. Table 2 illustrates the complementarity of the nucleotide sequences of PACE4 BINDING SITE, designated SEQ ID:28726, to the nucleotide sequence of VGAM1194 RNA, herein designated VGAM RNA, also designated SEQ ID:3905.

Another function of VGAM1194 is therefore inhibition of Paired Basic Amino Acid Cleaving System 4 (PACE4, Accession NM_138325), a gene which processes hormone precursors by cleaving paired basic amino acids. Accordingly, utilities of VGAM1194 include diagnosis, prevention and treatment of diseases and clinical conditions associated with PACE4. The function of PACE4 has been established by previous studies. Using PCR methods, Kiefer et al. (1991) identified a second human subtilisin-like protease gene on chromosome 15. PCR primers were designed to be specific for the subfamily of eukaryotic subtilisin-like proteases with specificity for paired basic amino acid residue processing motifs. The gene encoding this protease, designated PACE4, also encoded a smaller subtilisin-related polypeptide derived by alternative mRNA splicing. As with the product of the PACE gene (OMIM Ref. No. 136950), the tissue distribution of PACE4 was widespread, with comparatively higher levels in the liver. By in situ hybridization using isolated cosmid clones, Kiefer et al. (1991) mapped the PACE4 gene to chromosome 15 in close proximity to the PACE gene at 15q25-q26. Double labeling in situ hybridization suggested that the 2 genes are within 5 megabases of each other. Mbikay et al. (1995) mapped the gene for PACE4 (Pcsk6) to mouse chromosome 7 by RFLP analysis of a DNA panel from an interspecific backcross. It was located at a distance of 13 cM from the Pcsk3 locus, which specifies furin (OMIM Ref. No. 136950), another member of this family of enzymes previously mapped to mouse chromosome 7. This is in concordance with the known close proximity of these 2 loci in the homologous region on human 15q25-qter. Pcsk3 and Pcsk6 map to a region of mouse chromosome 7 that has been associated cytogenetically with postnatal lethality in maternal disomy, suggesting that these genes may be imprinted.

Full details of the abovementioned studies are described in the following publications, the disclosure of which are hereby incorporated by reference:

Kiefer, M. C.; Tucker, J. E.; Joh, R.; Landsberg, K. E.; Saltman, D.; Barr, P. J. : Identification of a second human subtilisin-like protease gene in the fes/fps region of chromosome 15. DNA Cell Biol. 10:757-769, 1991; and Mbikay, M.; Seidah, N. G.; Chretien, M.; Simpson, E. M.: Chromosomal assignment of the genes for proprotein convertases PC4, PC5, and PACE 4 in mouse and human. Genomics 26:123-129, 19.

Further studies establishing the function and utilities of PACE4 are found in John Hopkins OMIM database record ID 167405, and in sited publications numbered 10330 listed in the bibliography section hereinbelow, which are also hereby incorporated by reference. KIAA1462 (Accession XM_166132) is another VGAM1194 host target gene. KIAA1462 BINDING SITE is HOST TARGET binding site found in the 3' untranslated region of mRNA encoded by KIAA1462, corresponding to a HOST TARGET binding site such as BINDING SITE I, BINDING SITE II or BINDING SITE III. Table 2 illustrates the complementarity of the nucleotide sequences of KIAA1462 BINDING SITE, designated SEQ ID:43921, to the nucleotide sequence of VGAM1194 RNA, herein designated VGAM RNA, also designated SEQ ID:3905.

Another function of VGAM1194 is therefore inhibition of KIAA1462 (Accession XM_166132). Accordingly, utilities of VGAM1194 include diagnosis, prevention and treatment of diseases and clinical conditions associated with KIAA1462. LOC145945 (Accession XM_096908) is another VGAM1194 host target gene. LOC145945 BINDING SITE is HOST TARGET binding site found in the 3' untranslated region of mRNA encoded by LOC145945, corresponding to a HOST TARGET binding site such as BINDING SITE I, BINDING SITE II or BINDING SITE III. Table 2 illustrates the complementarity of the nucleotide sequences of LOC145945 BINDING SITE, designated SEQ ID:40636, to the nucleotide sequence of VGAM1194 RNA, herein designated VGAM RNA, also designated SEQ ID:3905.

Another function of VGAM1194 is therefore inhibition of LOC145945 (Accession XM_096908). Accordingly, utilities of VGAM1194 include diagnosis, prevention and treatment of diseases and clinical conditions associated with LOC145945. LOC219401 (Accession XM_166706) is another VGAM1194 host target gene. LOC219401 BINDING SITE is HOST TARGET binding site found in the 5' untranslated region of mRNA encoded by LOC219401, corresponding to a HOST TARGET binding site such as BINDING SITE I, BINDING SITE II or BINDING SITE III. Table 2 illustrates the complementarity of the nucleotide sequences of LOC219401 BINDING SITE, designated SEQ ID:44595, to the nucleotide sequence of VGAM1194 RNA, herein designated VGAM RNA, also designated SEQ ID:3905.

Another function of VGAM1194 is therefore inhibition of LOC219401 (Accession XM_166706). Accordingly, utilities of VGAM1194 include diagnosis, prevention and treatment of diseases and clinical conditions associated with LOC219401. FIG. 1 further provides a conceptual description of a novel bioinformatically detected viral gene of the present invention, referred to here as Viral Genomic Address Messenger 1195 (VGAM1195) viral gene, which modulates expression of respective host target genes thereof, the function and utility of which host target genes is known in the art.

VGAM1195 is a novel bioinformatically detected regulatory, non protein coding, viral micro RNA (miRNA) gene. The method by which VGAM1195 was detected is described hereinabove with reference to FIGS. 1-8.

VGAM1195 gene, herein designated VGAM GENE, is a viral gene contained in the genome of Equine Herpesvirus 1. VGAM1195 host target gene, herein designated VGAM HOST TARGET GENE, is a human gene contained in the human genome.

VGAM1195 gene encodes a VGAM1195 precursor RNA, herein designated VGAM PRECURSOR RNA. Similar to other miRNA genes, and unlike most ordinary genes, VGAM1195 precursor RNA does not encode a protein. A nucleotide sequence identical or highly similar to the nucleotide sequence of VGAM1195 precursor RNA is designated SEQ ID:1181, and is provided hereinbelow with reference to the sequence listing part. Nucleotide sequence SEQ ID:1181 is located at position 79725 relative to the genome of Equine Herpesvirus 1.

VGAM1195 precursor RNA folds onto itself, forming VGAM1195 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1195 folded precursor RNA into VGAM1195 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1195 RNA is designated SEQ ID:3906, and is provided hereinbelow with reference to the sequence listing part.

VGAM1195 host target gene, herein designated VGAM HOST TARGET GENE, encodes a corresponding messenger RNA, VGAM1195 host target RNA, herein designated VGAM HOST TARGET RNA. VGAM1195 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1195 RNA, herein designated VGAM RNA, binds complementarily to one or more host target binding sites located in untranslated regions of VGAM1195 host target RNA, herein designated VGAM HOST TARGET RNA. This complementary binding is due to the fact that the nucleotide sequence of VGAM1195 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1195 RNA, herein designated VGAM RNA, may have a different number of host target binding sites in untranslated regions of a VGAM1195 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1195 RNA, herein designated VGAM RNA, to host target binding sites on VGAM1195 host target RNA, herein designated VGAM HOST TARGET RNA, such as BINDING SITE I, BINDING SITE II and BINDING SITE III, inhibits translation of VGAM1195 host target RNA into VGAM1195 host target protein, herein designated VGAM HOST TARGET PROTEIN. VGAM host target protein is therefore outlined by a broken line.

It is appreciated that VGAM1195 host target gene, herein designated VGAM HOST TARGET GENE, in fact represents a plurality of VGAM1195 host target genes. The mRNA of each one of this plurality of VGAM1195 host target genes comprises one or more host target binding sites, each having a nucleotide sequence which is at least partly complementary to VGAM1195 RNA, herein designated VGAM RNA, and which when bound by VGAM1195 RNA causes inhibition of translation of respective one or more VGAM1195 host target proteins.

It is further appreciated by one skilled in the art that the mode of translational inhibition illustrated by FIG. 1 with specific reference to translational inhibition exerted by VGAM1195 gene, herein designated VGAM GENE, on one or more VGAM1195 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1195 is inhibition of expression of host target genes, as part of a novel viral mechanism of attacking a host. Accordingly, utilities of VGAM1195 include diagnosis, prevention and treatment of viral infection by Equine Herpesvirus 1. Specific functions, and accordingly utilities, of VGAM1195 correlate with, and may be deduced from, the identity of the host target genes which VGAM1195 binds and inhibits, and the function of these host target genes, as elaborated hereinbelow.

Nucleotide sequences of the VGAM1195 precursor RNA, herein designated VGAM PRECURSOR RNA, and of the 'diced' VGAM1195 RNA, herein designated VGAM RNA, and a schematic representation of the secondary folding of VGAM1195 folded precursor RNA, herein designated VGAM FOLDED PRECURSOR RNA, of VGAM1195 are further described hereinbelow with reference to Table 1.

Nucleotide sequences of host target binding sites, such as BINDING SITE-I, BINDING SITE-II and BINDING SITE-III of FIG. 1, found on VGAM1195 host target RNA, and schematic representation of the complementarity of each of these host target binding sites to VGAM1195 RNA, herein designated VGAM RNA, are described hereinbelow with reference to Table 2.

As mentioned hereinabove with reference to FIG. 1, a function of VGAM1195 gene, herein designated VGAM is inhibition of expression of VGAM1195 target genes. It is appreciated that specific functions, and accordingly utilities, of VGAM1195 correlate with, and may be deduced from, the identity of the target genes which VGAM1195 binds and inhibits, and the function of these target genes, as elaborated hereinbelow.

Dihydrofolate Reductase (DHFR, Accession NM_000791) is a VGAM1195 host target gene. DHFR BINDING SITE is HOST TARGET binding site found in the 3' untranslated region of mRNA encoded by DHFR, corresponding to a HOST TARGET binding site such as BINDING SITE I, BINDING SITE II or BINDING SITE III. Table 2 illustrates the complementarity of the nucleotide sequences of DHFR BINDING SITE, designated SEQ ID:6445, to the nucleotide sequence of VGAM1195 RNA, herein designated VGAM RNA, also designated SEQ ID:3906.

A function of VGAM1195 is therefore inhibition of Dihydrofolate Reductase (DHFR, Accession NM_000791), a gene which converts dihydrofolate into tetrahydrofolate. Accordingly, utilities of VGAM1195 include diagnosis, prevention and treatment of diseases and clinical conditions associated with DHFR. The function of DHFR and its association with various diseases and clinical conditions, has been established by previous studies, as described hereinabove with reference to VGAM826. Ems1 Sequence (mammary tumor and squamous cell carcinoma-associated (p80/85 src substrate) (EMS1, Accession NM_005231) is another VGAM1195 host target gene. EMS1 BINDING SITE1 and EMS1 BINDING SITE2 are HOST TARGET binding sites found in untranslated regions of mRNA encoded by EMS1, corresponding to HOST TARGET binding sites such as BINDING SITE I, BINDING SITE II or BINDING SITE III. Table 2 illustrates the complementarity of the nucleotide sequences of EMS1 BINDING SITE1 and EMS1 BINDING SITE2, designated SEQ ID:11734 and SEQ ID:28865 respectively, to the nucleotide sequence of VGAM1195 RNA, herein designated VGAM RNA, also designated SEQ ID:3906.

Another function of VGAM1195 is therefore inhibition of Ems1 Sequence (mammary tumor and squamous cell carcinoma-associated (p80/85 src substrate) (EMS1, Accession NM_005231), a gene which may contribute to the organization of cell structure. in transformed cells may contribute to cellular growth regulation and transformation. Accordingly, utilities of VGAM1195 include diagnosis, prevention and treatment of diseases and clinical conditions associated with EMS1. The function of EMS1 and its association with various diseases and clinical conditions, has been established by previous studies, as described hereinabove with reference to VGAM497. Transcription Factor CP2 (TFCP2, Accession NM_005653) is another VGAM1195 host target gene. TFCP2 BINDING SITE is HOST TARGET binding site found in the 5' untranslated region of mRNA encoded by TFCP2, corresponding to a HOST TARGET binding site such as BINDING SITE I, BINDING SITE II or BINDING SITE III. Table 2 illustrates the complementarity of the nucleotide sequences of TFCP2 BINDING SITE, designated SEQ ID:12192, to the nucleotide sequence of VGAM1195 RNA, herein designated VGAM RNA, also designated SEQ ID:3906.

Another function of VGAM1195 is therefore inhibition of Transcription Factor CP2 (TFCP2, Accession NM_005653), a gene which is a transcription factor CP2 and recognizes sites within the alpha-globin gene and SV40 late promoters. Accordingly, utilities of VGAM1195 include diagnosis, prevention and treatment of diseases and clinical conditions associated with TFCP2. The function of TFCP2 has been established by previous studies. Lambert et al. (2000) reported an association between a noncoding polymorphism (G-A) in the 3-prime untranslated region of TFCP2 and sporadic Alzheimer disease (AD5; 602096) in French and British populations and a similar trend in a North American population. The combined analysis of the 3 independent populations suggested a protective effect of the A allele (OR=0.58, 95% CI 0.44-0.75). The A allele demonstrated reduced binding to nuclear protein (s) from a neuroblastoma cell line, and absence of the A allele was associated with lower gene expression in lymphocytes from AD cases compared with controls. The authors suggested that polymorphic variation in TFCP2 may be important for the pathogenesis of AD, particularly since the gene product interacts with proteins such as GSK3B (OMIM Ref. No. 605004), Fe65 (OMIM Ref. No. 602709), and certain factors involved in the inflammatory response. Swendeman et al. (1994) characterized the genomic structure, chromosome location, promoter, and expression pattern of CP2, a 66-kD cellular transcription factor that interacts with the alpha-globin (OMIM Ref. No. 141800) promoter as well as with additional cellular and viral promoter elements. Homodimers of CP2, together with a 45-kD partner protein, form the so-called stage selector protein complex (Jane et al., 1995) that binds to a proximal gamma-globin gene promoter regulatory sequence, termed the stage selector element (SSE). The SSE is thought to be involved in silencing beta globin gene (OMIM Ref. No. 141900) transcription during fetal erythropoiesis (Cunningham et al., 1995).

Full details of the abovementioned studies are described in the following publications, the disclosure of which are hereby incorporated by reference:

Swendeman, S. L.; Spielholz, C.; Jenkins, N. A.; Gilbert, D. J.; Copeland, N. G.; Sheffery, M.: Characterization of the genomic structure, chromosomal location, promoter, and developmental expression of the alpha-globin transcription factor CP2. J. Biol. Chem. 269:11663-11671, 1994; and Lambert, J.-C.; Goumidi, L.; Wavrant-De Vrieze, F.; Frigard, B.; Harris, J. M.; Cummings, A.; Coates, J.; Pasquier, F.; Cottel, D.; Gaillac, M.; St. Clair, D.; Mann, D. M. A.; Hardy, J.

Further studies establishing the function and utilities of TFCP2 are found in John Hopkins OMIM database record ID 189889, and in sited publications numbered 12343-1234 and 12346-12348 listed in the bibliography section hereinbelow, which are also hereby incorporated by reference. Wolf-Hirschhorn Syndrome Candidate 1-like 1 (WHSC1L1, Accession NM_017778) is another VGAM1195 host target gene. WHSC1L1 BINDING SITE1 and WHSC1L1 BINDING SITE2 are HOST TARGET binding sites found in untranslated regions of mRNA encoded by WHSC1L1, corresponding to HOST TARGET binding sites such as BINDING SITE I, BINDING SITE II or BINDING SITE III. Table 2 illustrates the complementarity of the nucleotide sequences of WHSC1L1 BINDING SITE1 and WHSC1L1 BINDING SITE2, designated SEQ ID:19408 and SEQ ID:23315 respectively, to the nucleotide sequence of VGAM1195 RNA, herein designated VGAM RNA, also designated SEQ ID:3906.

Another function of VGAM1195 is therefore inhibition of Wolf-Hirschhorn Syndrome Candidate 1-like 1 (WHSC1L1, Accession NM_017778), a gene which restores repair of base-base and single- nucleotide insertion-deletion mismatches, and increases the proficiency to process heteroduplexes with insertion-deletion mismatches. Accordingly, utilities of VGAM1195 include diagnosis, prevention and treatment of diseases and clinical conditions associated with WHSC1L1. The function of WHSC1L1 and its association with various diseases and clinical conditions, has been established by previous studies, as described hereinabove with reference to VGAM475. KIAA1922 (Accession XM_057040) is another VGAM1195 host target gene.

KIAA1922 BINDING SITE is HOST TARGET binding site found in the 3' untranslated region of mRNA encoded by KIAA1922, corresponding to a HOST TARGET binding site such as BINDING SITE I, BINDING SITE II or BINDING SITE III. Table 2 illustrates the complementarity of the nucleotide sequences of KIAA1922 BINDING SITE, designated SEQ ID:36458, to the nucleotide sequence of VGAM1195 RNA, herein designated VGAM RNA, also designated SEQ ID:3906.

Another function of VGAM1195 is therefore inhibition of KIAA1922 (Accession XM_057040). Accordingly, utilities of VGAM1195 include diagnosis, prevention and treatment of diseases and clinical conditions associated with KIAA1922. Ring Finger Protein 24 (RNF24, Accession NM_007219) is another VGAM1195 host target gene. RNF24 BINDING SITE is HOST TARGET binding site found in the 3' untranslated region of mRNA encoded by RNF24, corresponding to a HOST TARGET binding site such as BINDING SITE I, BINDING SITE II or BINDING SITE III. Table 2 illustrates the complementarity of the nucleotide sequences of RNF24 BINDING SITE, designated SEQ ID:14089, to the nucleotide sequence of VGAM1195 RNA, herein designated VGAM RNA, also designated SEQ ID:3906.

Another function of VGAM1195 is therefore inhibition of Ring Finger Protein 24 (RNF24, Accession NM_007219). Accordingly, utilities of VGAM1195 include diagnosis, prevention and treatment of diseases and clinical conditions associated with RNF24. SEC14-like 1 (S. cerevisiae) (SEC14L1, Accession NM_003003) is another VGAM1195 host target gene. SEC14L1 BINDING SITE is HOST TARGET binding site found in the 3' untranslated region of mRNA encoded by SEC14L1, corresponding to a HOST TARGET binding site such as BINDING SITE I, BINDING SITE II or BINDING SITE III. Table 2 illustrates the complementarity of the nucleotide sequences of SEC14L1 BINDING SITE, designated SEQ ID:8899, to the nucleotide sequence of VGAM1195 RNA, herein designated VGAM RNA, also designated SEQ ID:3906.

Another function of VGAM1195 is therefore inhibition of SEC14-like 1 (S. cerevisiae) (SEC14L1, Accession NM_003003). Accordingly, utilities of VGAM1195 include diagnosis, prevention and treatment of diseases and clinical conditions associated with SEC14L1. Seizure Related 6 Homolog (mouse) (SEZ6, Accession XM_058869) is another VGAM1195 host target gene. SEZ6 BINDING SITE is HOST TARGET binding site found in the 3' untranslated region of mRNA encoded by SEZ6, corresponding to a HOST TARGET binding site such as BINDING SITE I, BINDING SITE II or BINDING SITE III. Table 2 illustrates the complementarity of the nucleotide sequences of SEZ6 BINDING SITE, designated SEQ ID:36770, to the nucleotide sequence of VGAM1195 RNA, herein designated VGAM RNA, also designated SEQ ID:3906.

Another function of VGAM1195 is therefore inhibition of Seizure Related 6 Homolog (mouse) (SEZ6, Accession XM_058869). Accordingly, utilities of VGAM1195 include diagnosis, prevention and treatment of diseases and clinical conditions associated with SEZ6. WSB1 (Accession NM_134264) is another VGAM1195 host target gene. WSB1 BINDING SITE is HOST TARGET binding site found in the 3' untranslated region of mRNA encoded by WSB1, corresponding to a HOST TARGET binding site such as BINDING SITE I, BINDING SITE II or BINDING SITE III. Table 2 illustrates the complementarity of the nucleotide sequences of WSB1 BINDING SITE, designated SEQ ID:28613, to the nucleotide sequence of VGAM1195 RNA, herein designated VGAM RNA, also designated SEQ ID:3906.

Another function of VGAM1195 is therefore inhibition of WSB1 (Accession NM_134264). Accordingly, utilities of VGAM1195 include diagnosis, prevention and treatment of diseases and clinical conditions associated with WSB1. LOC150183 (Accession XM_097839) is another VGAM1195 host target gene. LOC150183 BINDING SITE is HOST TARGET binding site found in the 5' untranslated region of mRNA encoded by LOC150183, corresponding to a HOST TARGET binding site such as BINDING SITE I, BINDING SITE II or BINDING SITE III. Table 2 illustrates the complementarity of the nucleotide sequences of LOC150183 BINDING SITE, designated SEQ ID:41153, to the nucleotide sequence of VGAM1195 RNA, herein designated VGAM RNA, also designated SEQ ID:3906.

Another function of VGAM1195 is therefore inhibition of LOC150183 (Accession XM_097839). Accordingly, utilities of VGAM1195 include diagnosis, prevention and treatment of diseases and clinical conditions associated with LOC150183. LOC150184 (Accession XM_097840) is another VGAM1195 host target gene. LOC150184 BINDING SITE is HOST TARGET binding site found in the 5' untranslated region of mRNA encoded by LOC150184, corresponding to a HOST TARGET binding site such as BINDING SITE I, BINDING SITE II or BINDING SITE III. Table 2 illustrates the complementarity of the nucleotide sequences of LOC150184 BINDING SITE, designated SEQ ID:41154, to the nucleotide sequence of VGAM1195 RNA, herein designated VGAM RNA, also designated SEQ ID:3906.

Another function of VGAM1195 is therefore inhibition of LOC150184 (Accession XM_097840). Accordingly, utilities of VGAM1195 include diagnosis, prevention and treatment of diseases and clinical conditions associated with LOC150184. LOC150185 (Accession XM_097834) is another VGAM1195 host target gene. LOC150185 BINDING SITE is HOST TARGET binding site found in the 5' untranslated region of mRNA encoded by LOC150185, corresponding to a HOST TARGET binding site such as BINDING SITE I, BINDING SITE II or BINDING SITE III. Table 2 illustrates the complementarity of the nucleotide sequences of LOC150185 BINDING SITE, designated SEQ ID:41150, to the nucleotide sequence of VGAM1195 RNA, herein designated VGAM RNA, also designated SEQ ID:3906.

Another function of VGAM1195 is therefore inhibition of LOC150185 (Accession XM_097834). Accordingly, utilities of VGAM1195 include diagnosis, prevention and treatment of diseases and clinical conditions associated with LOC150185. LOC255654 (Accession XM_173036) is another VGAM1195 host target gene. LOC255654 BINDING SITE is HOST TARGET binding site found in the 5' untranslated region of mRNA encoded by LOC255654, corresponding to a HOST TARGET binding site such as BINDING SITE I, BINDING SITE II or BINDING SITE III. Table 2 illustrates the complementarity of the nucleotide sequences of LOC255654 BINDING SITE, designated SEQ ID:46300, to the nucleotide sequence of VGAM1195 RNA, herein designated VGAM RNA, also designated SEQ ID:3906.

Another function of VGAM1195 is therefore inhibition of LOC255654 (Accession XM_173036). Accordingly, utilities of VGAM1195 include diagnosis, prevention and treatment of diseases and clinical conditions associated with LOC255654. LOC91069 (Accession XM_035824) is another VGAM1195 host target gene. LOC91069 BINDING SITE is HOST TARGET binding site found in the 3' untranslated region of mRNA encoded by LOC91069, corresponding to a HOST TARGET binding site such as BINDING SITE I, BINDING SITE II or BINDING SITE III. Table 2 illustrates the complementarity of the nucleotide sequences of LOC91069 BINDING SITE, designated SEQ ID:32343, to the nucleotide sequence of VGAM1195 RNA, herein designated VGAM RNA, also designated SEQ ID:3906.

Another function of VGAM1195 is therefore inhibition of LOC91069 (Accession XM_035824). Accordingly, utilities of VGAM1195 include diagnosis, prevention and treatment of diseases and clinical conditions associated with LOC91069. FIG. 1 further provides a conceptual description of a novel bioinformatically detected viral gene of the present invention, referred to here as Viral Genomic Address Messenger 1196 (VGAM1196) viral gene, which modulates expression of respective host target genes thereof, the function and utility of which host target genes is known in the art.

VGAM1196 is a novel bioinformatically detected regulatory, non protein coding, viral micro RNA (miRNA) gene. The method by which VGAM1196 was detected is described hereinabove with reference to FIGS. 1-8.

VGAM1196 gene, herein designated VGAM GENE, is a viral gene contained in the genome of Equine Herpesvirus 1. VGAM1196 host target gene, herein designated VGAM HOST TARGET GENE, is a human gene contained in the human genome.

VGAM1196 gene encodes a VGAM1196 precursor RNA, herein designated VGAM PRECURSOR RNA. Similar to other miRNA genes, and unlike most ordinary genes, VGAM1196 precursor RNA does not encode a protein. A nucleotide sequence identical or highly similar to the nucleotide sequence of VGAM1196 precursor RNA is designated SEQ ID:1182, and is provided hereinbelow with reference to the sequence listing part. Nucleotide sequence SEQ ID:1182 is located at position 82687 relative to the genome of Equine Herpesvirus 1.

VGAM1196 precursor RNA folds onto itself, forming VGAM1196 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1196 folded precursor RNA into VGAM1196 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1196 RNA is designated SEQ ID:3907, and is provided hereinbelow with reference to the sequence listing part.

VGAM1196 host target gene, herein designated VGAM HOST TARGET GENE, encodes a corresponding messenger RNA, VGAM1196 host target RNA, herein designated VGAM HOST TARGET RNA. VGAM1196 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1196 RNA, herein designated VGAM RNA, binds complementarily to one or more host target binding sites located in untranslated regions of VGAM1196 host target RNA, herein designated VGAM HOST TARGET RNA. This complementary binding is due to the fact that the nucleotide sequence of VGAM1196 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1196 RNA, herein designated VGAM RNA, may have a different number of host target binding sites in untranslated regions of a VGAM1196 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1196 RNA, herein designated VGAM RNA, to host target binding sites on VGAM1196 host target RNA, herein designated VGAM HOST TARGET RNA, such as BINDING SITE I, BINDING SITE II and BINDING SITE III, inhibits translation of VGAM1196 host target RNA into VGAM1196 host target protein, herein designated VGAM HOST TARGET PROTEIN. VGAM host target protein is therefore outlined by a broken line.

It is appreciated that VGAM1196 host target gene, herein designated VGAM HOST TARGET GENE, in fact represents a plurality of VGAM1196 host target genes. The mRNA of each one of this plurality of VGAM1196 host target genes comprises one or more host target binding sites, each having a nucleotide sequence which is at least partly complementary to VGAM1196 RNA, herein designated VGAM RNA, and which when bound by VGAM1196 RNA causes inhibition of translation of respective one or more VGAM1196 host target proteins.

It is further appreciated by one skilled in the art that the mode of translational inhibition illustrated by FIG. 1 with specific reference to translational inhibition exerted by VGAM1196 gene, herein designated VGAM GENE, on one or more VGAM1196 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1196 is inhibition of expression of host target genes, as part of a novel viral mechanism of attacking a host. Accordingly, utilities of VGAM1196 include diagnosis, prevention and treatment of viral infection by Equine Herpesvirus 1. Specific functions, and accordingly utilities, of VGAM1196 correlate with, and may be deduced from, the identity of the host target genes which VGAM1196 binds and inhibits, and the function of these host target genes, as elaborated hereinbelow.

Nucleotide sequences of the VGAM1196 precursor RNA, herein designated VGAM PRECURSOR RNA, and of the 'diced' VGAM1196 RNA, herein designated VGAM RNA, and a schematic representation of the secondary folding of VGAM1196 folded precursor RNA, herein designated VGAM FOLDED PRECURSOR RNA, of VGAM1196 are further described hereinbelow with reference to Table 1.

Nucleotide sequences of host target binding sites, such as BINDING SITE-I, BINDING SITE-II and BINDING SITE-III of FIG. 1, found on VGAM1196 host target RNA, and schematic representation of the complementarity of each of these host target binding sites to VGAM1196 RNA, herein designated VGAM RNA, are described hereinbelow with reference to Table 2.

As mentioned hereinabove with reference to FIG. 1, a function of VGAM1196 gene, herein designated VGAM is inhibition of expression of VGAM1196 target genes. It is appreciated that specific functions, and accordingly utilities, of VGAM1196 correlate with, and may be deduced from, the identity of the target genes which VGAM1196 binds and inhibits, and the function of these target genes, as elaborated hereinbelow.

Bone Morphogenetic Protein 6 (BMP6, Accession NM_001718) is a VGAM1196 host target gene. BMP6 BINDING SITE is HOST TARGET binding site found in the 3' untranslated region of mRNA encoded by BMP6, corresponding to a HOST TARGET binding site such as BINDING SITE I, BINDING SITE II or BINDING SITE III. Table 2 illustrates the complementarity of the nucleotide sequences of BMP6 BINDING SITE, designated SEQ ID:7455, to the nucleotide sequence of VGAM1196 RNA, herein designated VGAM RNA, also designated SEQ ID:3907.

A function of VGAM1196 is therefore inhibition of Bone Morphogenetic Protein 6 (BMP6, Accession NM_001718), a gene which induces cartilage and bone formation. Accordingly, utilities of VGAM1196 include diagnosis, prevention and treatment of diseases and clinical conditions associated with BMP6. The function of BMP6 and its association with various diseases and clinical conditions, has been established by previous studies, as described hereinabove with reference to VGAM233. Chromosome 20 Open Reading Frame 18 (C20orf18, Accession NM_031228) is another VGAM1196 host target gene. C20orf18 BINDING SITE is HOST TARGET binding site found in the 3' untranslated region of mRNA encoded by C20orf18, corresponding to a HOST TARGET binding site such as BINDING SITE I, BINDING SITE II or BINDING SITE III. Table 2 illustrates the complementarity of the nucleotide sequences of C20orf18 BINDING SITE, designated SEQ ID:25277, to the nucleotide sequence of VGAM1196 RNA, herein designated VGAM RNA, also designated SEQ ID:3907.

Another function of VGAM1196 is therefore inhibition of Chromosome 20 Open Reading Frame 18 (C20orf18, Accession NM_031228). Accordingly, utilities of VGAM1196 include diagnosis, prevention and treatment of diseases and clinical conditions associated with C20orf18. FLJ10921 (Accession NM_018272) is another VGAM1196 host target gene. FLJ10921 BINDING SITE is HOST TARGET binding site found in the 3' untranslated region of mRNA encoded by FLJ10921, corresponding to a HOST TARGET binding site such as BINDING SITE I, BINDING SITE II or BINDING SITE III. Table 2 illustrates the complementarity of the nucleotide sequences of FLJ10921 BINDING SITE, designated SEQ ID:20250, to the nucleotide sequence of VGAM1196 RNA, herein designated VGAM RNA, also designated SEQ ID:3907.

Another function of VGAM1196 is therefore inhibition of FLJ10921 (Accession NM_018272). Accordingly, utilities of VGAM1196 include diagnosis, prevention and treatment of diseases and clinical conditions associated with FLJ10921. LOC220038 (Accession XM_166257) is another VGAM1196 host target gene. LOC220038 BINDING SITE is HOST TARGET binding site found in the 5' untranslated region of mRNA encoded by LOC220038, corresponding to a HOST TARGET binding site such as BINDING SITE I, BINDING SITE II or BINDING SITE III. Table 2 illustrates the complementarity of the nucleotide sequences of LOC220038 BINDING SITE, designated SEQ ID:44082, to the nucleotide sequence of VGAM1196 RNA, herein designated VGAM RNA, also designated SEQ ID:3907.

Another function of VGAM1196 is therefore inhibition of LOC220038 (Accession XM_166257). Accordingly, utilities of VGAM1196 include diagnosis, prevention and treatment of diseases and clinical conditions associated with LOC220038. FIG. 1 further provides a conceptual description of a novel bioinformatically detected viral gene of the present invention, referred to here as Viral Genomic Address Messenger 1197 (VGAM1197) viral gene, which modulates expression of respective host target genes thereof, the function and utility of which host target genes is known in the art.

VGAM1197 is a novel bioinformatically detected regulatory, non protein coding, viral micro RNA (miRNA) gene. The method by which VGAM1197 was detected is described hereinabove with reference to FIGS. 1-8.

VGAM1197 gene, herein designated VGAM GENE, is a viral gene contained in the genome of Equine Herpesvirus 1. VGAM1197 host target gene, herein designated VGAM HOST TARGET GENE, is a human gene contained in the human genome.

VGAM1197 gene encodes a VGAM1197 precursor RNA, herein designated VGAM PRECURSOR RNA. Similar to other miRNA genes, and unlike most ordinary genes, VGAM1197 precursor RNA does not encode a protein. A nucleotide sequence identical or highly similar to the nucleotide sequence of VGAM1197 precursor RNA is designated SEQ ID:1183, and is provided hereinbelow with reference to the sequence listing part. Nucleotide sequence SEQ ID:1183 is located at position 80050 relative to the genome of Equine Herpesvirus 1.

VGAM1197 precursor RNA folds onto itself, forming VGAM1197 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1197 folded precursor RNA into VGAM1197 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1197 RNA is designated SEQ ID:3908, and is provided hereinbelow with reference to the sequence listing part.

VGAM1197 host target gene, herein designated VGAM HOST TARGET GENE, encodes a corresponding messenger RNA, VGAM1197 host target RNA, herein designated VGAM HOST TARGET RNA. VGAM1197 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1197 RNA, herein designated VGAM RNA, binds complementarily to one or more host target binding sites located in untranslated regions of VGAM1197 host target RNA, herein designated VGAM HOST TARGET RNA. This complementary binding is due to the fact that the nucleotide sequence of VGAM1197 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1197 RNA, herein designated VGAM RNA, may have a different number of host target binding sites in untranslated regions of a VGAM1197 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1197 RNA, herein designated VGAM RNA, to host target binding sites on VGAM1197 host target RNA, herein designated VGAM HOST TARGET RNA, such as BINDING SITE I, BINDING SITE II and BINDING SITE III, inhibits translation of VGAM1197 host target RNA into VGAM1197 host target protein, herein designated VGAM HOST TARGET PROTEIN. VGAM host target protein is therefore outlined by a broken line.

It is appreciated that VGAM1197 host target gene, herein designated VGAM HOST TARGET GENE, in fact represents a plurality of VGAM1197 host target genes. The mRNA of each one of this plurality of VGAM1197 host target genes comprises one or more host target binding sites, each having a nucleotide sequence which is at least partly complementary to VGAM1197 RNA, herein designated VGAM RNA, and which when bound by VGAM1197 RNA causes inhibition of translation of respective one or more VGAM1197 host target proteins.

It is further appreciated by one skilled in the art that the mode of translational inhibition illustrated by FIG. 1 with specific reference to translational inhibition exerted by VGAM1197 gene, herein designated VGAM GENE, on one or more VGAM1197 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1197 is inhibition of expression of host target genes, as part of a novel viral mechanism of attacking a host. Accordingly, utilities of VGAM1197 include diagnosis, prevention and treatment of viral infection by Equine Herpesvirus 1. Specific functions, and accordingly utilities, of VGAM1197 correlate with, and may be deduced from, the identity of the host target genes which VGAM1197 binds and inhibits, and the function of these host target genes, as elaborated hereinbelow.

Nucleotide sequences of the VGAM1197 precursor RNA, herein designated VGAM PRECURSOR RNA, and of the 'diced' VGAM1197 RNA, herein designated VGAM RNA, and a schematic representation of the secondary folding of VGAM1197 folded precursor RNA, herein designated VGAM FOLDED PRECURSOR RNA, of VGAM1197 are further described hereinbelow with reference to Table 1.

Nucleotide sequences of host target binding sites, such as BINDING SITE-I, BINDING SITE-II and BINDING SITE-III of FIG. 1, found on VGAM1197 host target RNA, and schematic representation of the complementarity of each of these host target binding sites to VGAM1197 RNA, herein designated VGAM RNA, are described hereinbelow with reference to Table 2.

As mentioned hereinabove with reference to FIG. 1, a function of VGAM1197 gene, herein designated VGAM is inhibition of expression of VGAM1197 target genes. It is appreciated that specific functions, and accordingly utilities, of VGAM1197 correlate with, and may be deduced from, the identity of the target genes which VGAM1197 binds and inhibits, and the function of these target genes, as elaborated hereinbelow.

Deleted In Azoospermia-like (DAZL, Accession XM_042839) is a VGAM1197 host target gene. DAZL BINDING SITE is HOST TARGET binding site found in the 3' untranslated region of mRNA encoded by DAZL, corresponding to a HOST TARGET binding site such as BINDING SITE I, BINDING SITE II or BINDING SITE III. Table 2 illustrates the complementarity of the nucleotide sequences of DAZL BINDING SITE, designated SEQ ID:33799, to the nucleotide sequence of VGAM1197 RNA, herein designated VGAM RNA, also designated SEQ ID:3908.

A function of VGAM1197 is therefore inhibition of Deleted In Azoospermia-like (DAZL, Accession XM_042839), a gene which may be essential for gametogenesis. Accordingly, utilities of VGAM1197 include diagnosis, prevention and treatment of diseases and clinical conditions associated with DAZL. The function of DAZL and its association with various diseases and clinical conditions, has been established by previous studies, as described hereinabove with reference to VGAM206. Fanconi Anemia, Complementation Group G (FANCG, Accession NM_004629) is another VGAM1197 host target gene. FANCG BINDING SITE is HOST TARGET binding site found in the 5' untranslated region of mRNA encoded by FANCG, corresponding to a HOST TARGET binding site such as BINDING SITE I, BINDING SITE II or BINDING SITE III. Table 2 illustrates the complementarity of the nucleotide sequences of FANCG BINDING SITE, designated SEQ ID:11000, to the nucleotide sequence of VGAM1197 RNA, herein designated VGAM RNA, also designated SEQ ID:3908.

Another function of VGAM1197 is therefore inhibition of Fanconi Anemia, Complementation Group G (FANCG, Accession NM_004629). Accordingly, utilities of VGAM1197 include diagnosis, prevention and treatment of diseases and clinical conditions associated with FANCG. Regenerating Islet-derived 1 Alpha (pancreatic stone protein, pancreatic thread protein) (REG1A, Accession XM_114278) is another VGAM1197 host target gene. REG1A BINDING SITE is HOST TARGET binding site found in the 5' untranslated region of mRNA encoded by REG1A, corresponding to a HOST TARGET binding site such as BINDING SITE I, BINDING SITE II or BINDING SITE III. Table 2 illustrates the complementarity of the nucleotide sequences of REG1A BINDING SITE, designated SEQ ID:42827, to the nucleotide sequence of VGAM1197 RNA, herein designated VGAM RNA, also designated SEQ ID:3908.

Another function of VGAM1197 is therefore inhibition of Regenerating Islet-derived 1 Alpha (pancreatic stone protein, pancreatic thread protein) (REG1A, Accession XM_114278), a gene which plays an important role in exocrine pancreatic function, and inhibits CaCO(3) crystal growth. Accordingly, utilities of VGAM1197 include diagnosis, prevention and treatment of diseases and clinical conditions associated with REG1A. The function of REG1A has been established by previous studies. Pancreatic stone protein is the major component of the protein matrix of calculi in patients suffering from chronic calcifying pancreatitis. Secretory pancreatic stone protein is a glycoprotein in the pancreatic secretion. This protein, called PSPS, occurs in multiple molecular forms due to posttranslational processing. The abundance of PSPS in pancreatic juice (10 to 14% of total protein) suggests that it plays an important role in exocrine pancreatic function. In vitro experiments show that PSPS inhibits CaCO(3) crystal growth. Since in all the pancreatic secretions are supersaturated in calcium carbonate, the physiologic role of PSPS may be related to its inhibitory properties. Demonstration of diminished PSPS in the pancreatic juice of patients with chronic calcifying pancreatitis supported that hypothesis. Giorgi et al. (1989) isolated a cDNA encoding pre-PSPS from a human pancreatic cDNA library. They found that PSPS mRNA was 3 times lower in chronic calcifying pancreatitis than in controls; the message for trypsinogen, chymotrypsinogen, and colipase were not altered. Giorgi et al. (1989) concluded that PSPS gene expression is specifically reduced in CCP patients. Is a defect in this gene the basis for some cases of hereditary pancreatitis (OMIM Ref. No. 167800)? Terazono et al. (1988) cloned and sequenced a cDNA derived from pancreatic islets following partial pancreatectomy. On the basis of its induction during regrowth of the pancreas and its apparent origin from islets, the corresponding gene was termed REG (for regeneration) with the implication that the gene was involved in islet regeneration. Stewart (1989) found that the sequence was identical to that of pancreatic stone protein. Verdier et al. (1992), who referred to pancreatic stone protein as lithostathine (Sarles et al., 1990), presented evidence that the kidney produces a protein immunologically similar to lithostathine. They suggested that it is responsible for preventing the formation of renal stones since the urine in the thin descending limb of the Henle loop is supersaturated in CaCO(3) as is pancreatic juice. Akiyama et al. (2001) studied the mechanism by which the REG gene is activated in beta cells. They found that the combined addition of interleukin-6 (OMIM Ref. No. 147620) and dexamethasone induced the expression of the REG gene in beta cells and that inhibitors of poly (ADP-ribose) polymerase (PARP; 173870) enhanced the expression. PARP inhibitors enhanced the DNA-protein complex formation for REG gene transcription and stabilized the complex by inhibiting the autopoly (ADP-ribosyl)ation of PARP.

Full details of the abovementioned studies are described in the following publications, the disclosure of which are hereby incorporated by reference:

Sarles, H.; Dagorn, J. C.; Giorgi, D.; Bernard, J. P.: Renaming pancreatic stone protein as 'lithostathine'. (Letter) Gastroenterology 99:900-901, 1990; and Akiyama, T.; Takasawa, S.; Nata, K.; Kobayashi, S.; Abe, M.; Shervani, N. J.; Ikeda, T.; Nakagawa, K.; Unno, M.; Matsuno, S.; Okamoto, H.: Activation of Reg gene, a gene for insulin-pr.

Further studies establishing the function and utilities of REG1A are found in John Hopkins OMIM database record ID 167770, and in sited publications numbered 10918-1091 and 10919-10924 listed in the bibliography section hereinbelow, which are also hereby incorporated by reference. Sex Comb On Midleg-like 1 (Drosophila) (SCML1, Accession NM_006746) is another VGAM1197 host target gene. SCML1 BINDING SITE is HOST TARGET binding site found in the 3' untranslated region of mRNA encoded by SCML1, corresponding to a HOST TARGET binding site such as BINDING SITE I, BINDING SITE II or BINDING SITE III. Table 2 illustrates the complementarity of the nucleotide sequences of SCML1 BINDING SITE, designated SEQ ID:13592, to the nucleotide sequence of VGAM1197 RNA, herein designated VGAM RNA, also designated SEQ ID:3908.

Another function of VGAM1197 is therefore inhibition of Sex Comb On Midleg-like 1 (Drosophila) (SCML1, Accession NM_006746). Accordingly, utilities of VGAM1197 include diagnosis, prevention and treatment of diseases and clinical conditions associated with SCML1. BANK (Accession NM_017935) is another VGAM1197 host target gene. BANK BINDING SITE is HOST TARGET binding site found in the 3' untranslated region of mRNA encoded by BANK, corresponding to a HOST TARGET binding site such as BINDING SITE I, BINDING SITE II or BINDING SITE III. Table 2 illustrates the complementarity of the nucleotide sequences of BANK BINDING SITE, designated SEQ ID:19625, to the nucleotide sequence of VGAM1197 RNA, herein designated VGAM RNA, also designated SEQ ID:3908.

Another function of VGAM1197 is therefore inhibition of BANK (Accession NM_017935). Accordingly, utilities of VGAM1197 include diagnosis, prevention and treatment of diseases and clinical conditions associated with BANK. KIAA0553 (Accession XM_045981) is another VGAM1197 host target gene. KIAA0553 BINDING SITE is HOST TARGET binding site found in the 3" untranslated region of mRNA encoded by KIAA0553, corresponding to a HOST TARGET binding site such as BINDING SITE I, BINDING SITE II or BINDING SITE III. Table 2 illustrates the complementarity of the nucleotide sequences of KIAA0553 BINDING SITE, designated SEQ ID:34632, to the nucleotide sequence of VGAM1197 RNA, herein designated VGAM RNA, also designated SEQ ID:3908.

Another function of VGAM1197 is therefore inhibition of KIAA0553 (Accession XM_045981). Accordingly, utilities of VGAM1197 include diagnosis, prevention and treatment of diseases and clinical conditions associated with KIAA0553. PRO0097 (Accession NM_014114) is another VGAM1197 host target gene. PRO0097 BINDING SITE is HOST TARGET binding site found in the 5' untranslated region of mRNA encoded by PRO0097, corresponding to a HOST TARGET binding site such as BINDING SITE I, BINDING SITE II or BINDING SITE III. Table 2 illustrates the complementarity of the nucleotide sequences of PRO0097 BINDING SITE, designated SEQ ID:15363, to the nucleotide sequence of VGAM1197 RNA, herein designated VGAM RNA, also designated SEQ ID:3908.

Another function of VGAM1197 is therefore inhibition of PRO0097 (Accession NM_014114). Accordingly, utilities of VGAM1197 include diagnosis, prevention and treatment of diseases and clinical conditions associated with PRO0097. FIG. 1 further provides a conceptual description of a novel bioinformatically detected viral gene of the present invention, referred to here as Viral Genomic Address Messenger 1198 (VGAM1198) viral gene, which modulates expression of respective host target genes thereof, the function and utility of which host target genes is known in the art.

VGAM1198 is a novel bioinformatically detected regulatory, non protein coding, viral micro RNA (miRNA) gene. The method by which VGAM1198 was detected is described hereinabove with reference to FIGS. 1-8.

VGAM1198 gene, herein designated VGAM GENE, is a viral gene contained in the genome of Equine Herpesvirus 1.

VGAM1198 host target gene, herein designated VGAM HOST TARGET GENE, is a human gene contained in the human genome.

VGAM1198 gene encodes a VGAM1198 precursor RNA, herein designated VGAM PRECURSOR RNA. Similar to other miRNA genes, and unlike most ordinary genes, VGAM1198 precursor RNA does not encode a protein. A nucleotide sequence identical or highly similar to the nucleotide sequence of VGAM1198 precursor RNA is designated SEQ ID:1184, and is provided hereinbelow with reference to the sequence listing part. Nucleotide sequence SEQ ID:1184 is located at position 80155 relative to the genome of Equine Herpesvirus 1.

VGAM1198 precursor RNA folds onto itself, forming VGAM1198 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1198 folded precursor RNA into VGAM1198 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM1198 RNA is designated SEQ ID:3909, and is provided hereinbelow with reference to the sequence listing part.

VGAM1198 host target gene, herein designated VGAM HOST TARGET GENE, encodes a corresponding messenger RNA, VGAM1198 host target RNA, herein designated VGAM HOST TARGET RNA. VGAM1198 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1198 RNA, herein designated VGAM RNA, binds complementarily to one or more host target binding sites located in untranslated regions of VGAM1198 host target RNA, herein designated VGAM HOST TARGET RNA. This complementary binding is due to the fact that the nucleotide sequence of VGAM1198 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1198 RNA, herein designated VGAM RNA, may have a different number of host target binding sites in untranslated regions of a VGAM1198 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1198 RNA, herein designated VGAM RNA, to host target binding sites on VGAM1198 host target RNA, herein designated VGAM HOST TARGET RNA, such as BINDING SITE I, BINDING SITE II and BINDING SITE III, inhibits translation of VGAM1198 host target RNA into VGAM1198 host target protein, herein designated VGAM HOST TARGET PROTEIN. VGAM host target protein is therefore outlined by a broken line.

It is appreciated that VGAM1198 host target gene, herein designated VGAM HOST TARGET GENE, in fact represents a plurality of VGAM1198 host target genes. The mRNA of each one of this plurality of VGAM1198 host target genes comprises one or more host target binding sites, each having a nucleotide sequence which is at least partly complementary to VGAM1198 RNA, herein designated VGAM RNA, and which when bound by VGAM1198 RNA causes inhibition of translation of respective one or more VGAM1198 host target proteins.

It is further appreciated by one skilled in the art that the mode of translational inhibition illustrated by FIG. 1 with specific reference to translational inhibition exerted by VGAM1198 gene, herein designated VGAM GENE, on one or more VGAM1198 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1198 is inhibition of expression of host target genes, as part of a novel viral mechanism of attacking a host. Accordingly, utilities of VGAM1198 include diagnosis, prevention and treatment of viral infection by Equine Herpesvirus 1. Specific functions, and accordingly utilities, of VGAM1198 correlate with, and may be deduced from, the identity of the host target genes which VGAM1198 binds and inhibits, and the function of these host target genes, as elaborated hereinbelow.

Nucleotide sequences of the VGAM1198 precursor RNA, herein designated VGAM PRECURSOR RNA, and of the 'diced' VGAM1198 RNA, herein designated VGAM RNA, and a schematic representation of the secondary folding of VGAM1198 folded precursor RNA, herein designated VGAM FOLDED PRECURSOR RNA, of VGAM1198 are further described hereinbelow with reference to Table 1.

Nucleotide sequences of host target binding sites, such as BINDING SITE-I, BINDING SITE-II and BINDING SITE-III of FIG. 1, found on VGAM1198 host target RNA, and schematic representation of the complementarity of each of these host target binding sites to VGAM1198 RNA, herein designated VGAM RNA, are described hereinbelow with reference to Table 2.

As mentioned hereinabove with reference to FIG. 1, a function of VGAM1198 gene, herein designated VGAM is inhibition of expression of VGAM1198 target genes. It is appreciated that specific functions, and accordingly utilities, of VGAM1198 correlate with, and may be deduced from, the identity of the target genes which VGAM1198 binds and inhibits, and the function of these target genes, as elaborated hereinbelow.

Polymerase (DNA directed), Eta (POLH, Accession NM_006502) is a VGAM1198 host target gene. POLH BINDING SITE is HOST TARGET binding site found in the 5' untranslated region of mRNA encoded by POLH, corresponding to a HOST TARGET binding site such as BINDING SITE I, BINDING SITE II or BINDING SITE III. Table 2 illustrates the complementarity of the nucleotide sequences of POLH BINDING SITE, designated SEQ ID:13248, to the nucleotide sequence of VGAM1198 RNA, herein designated VGAM RNA, also designated SEQ ID:3909.

A function of VGAM1198 is therefore inhibition of Polymerase (DNA directed), Eta (POLH, Accession NM_006502). Accordingly, utilities of VGAM1198 include diagnosis, prevention and treatment of diseases and clinical conditions associated with POLH. N-myristoyltransferase 1 (NMT1, Accession NM_021079) is another VGAM1198 host target gene. NMT1 BINDING SITE is HOST TARGET binding site found in the 3' untranslated region of mRNA encoded by NMT1, corresponding to a HOST TARGET binding site such as BINDING SITE I, BINDING SITE II or BINDING SITE III. Table 2 illustrates the complementarity of the nucleotide sequences of NMT1 BINDING SITE, designated SEQ ID:22047, to the nucleotide sequence of VGAM1198 RNA, herein designated VGAM RNA, also designated SEQ ID:3909.

Another function of VGAM1198 is therefore inhibition of N-myristoyltransferase 1 (NMT1, Accession NM_021079). Accordingly, utilities of VGAM1198 include diagnosis, prevention and treatment of diseases and clinical conditions associated with NMT1. LOC150208 (Accession XM_097841) is another VGAM1198 host target gene. LOC150208 BINDING SITE is HOST TARGET binding site found in the 5' untranslated region of mRNA encoded by LOC150208, corresponding to a HOST TARGET binding site such as BINDING SITE I, BINDING SITE II or BINDING SITE III. Table 2 illustrates the complementarity of the nucleotide sequences of LOC150208 BINDING SITE, designated SEQ ID:41157, to the nucleotide sequence of VGAM1198 RNA, herein designated VGAM RNA, also designated SEQ ID:3909.

Another function of VGAM1198 is therefore inhibition of LOC150208 (Accession XM_097841). Accordingly, utilities of VGAM1198 include diagnosis, prevention and treatment of diseases and clinical conditions associated with LOC150208. LOC255631 (Accession XM_171267) is another VGAM1198 host target gene. LOC255631 BINDING SITE is HOST TARGET binding site found in the 5' untranslated region of mRNA encoded by LOC255631, corresponding to a HOST TARGET binding site such as BINDING SITE I, BINDING SITE II or BINDING SITE III. Table 2 illustrates the complementarity of the nucleotide sequences of LOC255631 BINDING SITE, designated SEQ ID:46039, to the nucleotide sequence of VGAM1198 RNA, herein designated VGAM RNA, also designated SEQ ID:3909.

Another function of VGAM1198 is therefore inhibition of LOC255631 (Accession XM_171267). Accordingly, utilities of VGAM1198 include diagnosis, prevention and treatment of diseases and clinical conditions associated with LOC255631. FIG. 1 further provides a conceptual description of a novel bioinformatically detected viral gene of the present invention, referred to here as Viral Genomic Address Messenger 1199 (VGAM1199) viral gene, which modulates expression of respective host target genes thereof, the function and utility of which host target genes is known in the art.

VGAM1199 is a novel bioinformatically detected regulatory, non protein coding, viral micro RNA (miRNA) gene. The method by which VGAM1199 was detected is described hereinabove with reference to FIGS. 1-8.

VGAM1199 gene, herein designated VGAM GENE, is a viral gene contained in the genome of Avian Nephritis Virus. VGAM1199 host target gene, herein designated VGAM HOST TARGET GENE, is a human gene contained in the human genome.

VGAM1199 gene encodes a VGAM1199 precursor RNA, herein designated VGAM PRECURSOR RNA. Similar to other miRNA genes, and unlike most ordinary genes, VGAM1199 precursor RNA does not encode a protein. A nucleotide sequence identical or highly similar to the nucleotide sequence of VGAM1199 precursor RNA is designated SEQ ID:1185, and is provided hereinbelow with reference to the sequence listing part. Nucleotide sequence SEQ ID:1185 is located at position 6153 relative to the genome of Avian Nephritis Virus.

VGAM1199 precursor RNA folds onto itself, forming VGAM1199 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1199 folded precursor RNA into VGAM1199 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1199 RNA is designated SEQ ID:3910, and is provided hereinbelow with reference to the sequence listing part.

VGAM1199 host target gene, herein designated VGAM HOST TARGET GENE, encodes a corresponding messenger RNA, VGAM1199 host target RNA, herein designated VGAM HOST TARGET RNA. VGAM1199 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1199 RNA, herein designated VGAM RNA, binds complementarily to one or more host target binding sites located in untranslated regions of VGAM1199 host target RNA, herein designated VGAM HOST TARGET RNA. This complementary binding is due to the fact that the nucleotide sequence of VGAM1199 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1199 RNA, herein designated VGAM RNA, may have a different number of host target binding sites in untranslated regions of a VGAM1199 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1199 RNA, herein designated VGAM RNA, to host target binding sites on VGAM1199 host target RNA, herein designated VGAM HOST TARGET RNA, such as BINDING SITE I, BINDING SITE II and BINDING SITE III, inhibits translation of VGAM1199 host target RNA into VGAM1199 host target protein, herein designated VGAM HOST TARGET PRO- TEIN. VGAM host target protein is therefore outlined by a broken line.

It is appreciated that VGAM1199 host target gene, herein designated VGAM HOST TARGET GENE, in fact represents a plurality of VGAM1199 host target genes. The mRNA of each one of this plurality of VGAM1199 host target genes comprises one or more host target binding sites, each having a nucleotide sequence which is at least partly complementary to VGAM1199 RNA, herein designated VGAM RNA, and which when bound by VGAM1199 RNA causes inhibition of translation of respective one or more VGAM1199 host target proteins.

It is further appreciated by one skilled in the art that the mode of translational inhibition illustrated by FIG. 1 with specific reference to translational inhibition exerted by VGAM1199 gene, herein designated VGAM GENE, on one or more VGAM1199 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1199 is inhibition of expression of host target genes, as part of a novel viral mechanism of attacking a host. Accordingly, utilities of VGAM1199 include diagnosis, prevention and treatment of viral infection by Avian Nephritis Virus. Specific functions, and accordingly utilities, of VGAM1199 correlate with, and may be deduced from, the identity of the host target genes which VGAM1199 binds and inhibits, and the function of these host target genes, as elaborated hereinbelow.

Nucleotide sequences of the VGAM1199 precursor RNA, herein designated VGAM PRECURSOR RNA, and of the 'diced' VGAM1199 RNA, herein designated VGAM RNA, and a schematic representation of the secondary folding of VGAM1199 folded precursor RNA, herein designated VGAM FOLDED PRECURSOR RNA, of VGAM1199 are further described hereinbelow with reference to Table 1.

Nucleotide sequences of host target binding sites, such as BINDING SITE-I, BINDING SITE-II and BINDING SITE-III of FIG. 1, found on VGAM1199 host target RNA, and schematic representation of the complementarity of each of these host target binding sites to VGAM1199 RNA, herein designated VGAM RNA, are described hereinbelow with reference to Table 2.

As mentioned hereinabove with reference to FIG. 1, a function of VGAM1199 gene, herein designated VGAM is inhibition of expression of VGAM1199 target genes. It is appreciated that specific functions, and accordingly utilities, of VGAM1199 correlate with, and may be deduced from, the identity of the target genes which VGAM1199 binds and inhibits, and the function of these target genes, as elaborated hereinbelow.

CD164 Antigen, Sialomucin (CD164, Accession NM_006016) is a VGAM1199 host target gene. CD164 BINDING SITE is HOST TARGET binding site found in the 3' untranslated region of mRNA encoded by CD164, corresponding to a HOST TARGET binding site such as BINDING SITE I, BINDING SITE II or BINDING SITE III. Table 2 illustrates the complementarity of the nucleotide sequences of CD164 BINDING SITE, designated SEQ ID:12628, to the nucleotide sequence of VGAM1199 RNA, herein designated VGAM RNA, also designated SEQ ID:3910.

A function of VGAM1199 is therefore inhibition of CD164 Antigen, Sialomucin (CD164, Accession NM_006016), a gene which plays a role in hematopoiesis by facilitating the adhesion of CD34+ cells to bone marrow stroma and negatively regulates CD34+ hematopoietic progenitor cell growth. Accordingly, utilities of VGAM1199 include diagnosis, prevention and treatment of diseases and clinical conditions associated with CD164. The function of CD164 and its association with various diseases and clinical conditions, has been established by previous studies, as described hereinabove with reference to VGAM75. LOC157226 (Accession XM_033876) is another VGAM1199 host target gene. LOC157226 BINDING SITE is HOST TARGET binding site found in the 5' untranslated region of mRNA encoded by LOC157226, corresponding to a HOST TARGET binding site such as BINDING SITE I, BINDING SITE II or BINDING SITE III. Table 2 illustrates the complementarity of the nucleotide sequences of LOC157226 BINDING SITE, designated SEQ ID:31974, to the nucleotide sequence of VGAM1199 RNA, herein designated VGAM RNA, also designated SEQ ID:3910.

Another function of VGAM1199 is therefore inhibition of LOC157226 (Accession XM_033876). Accordingly, utilities of VGAM1199 include diagnosis, prevention and treatment of diseases and clinical conditions associated with LOC157226. LOC91974 (Accession XM_041974) is another VGAM1199 host target gene. LOC91974 BINDING SITE is HOST TARGET binding site found in the 5' untranslated region of mRNA encoded by LOC91974, corresponding to a HOST TARGET binding site such as BINDING SITE I, BINDING SITE II or BINDING SITE III. Table 2 illustrates the complementarity of the nucleotide sequences of LOC91974 BINDING SITE, designated SEQ ID:33650, to the nucleotide sequence of VGAM1199 RNA, herein designated VGAM RNA, also designated SEQ ID:3910.

Another function of VGAM1199 is therefore inhibition of LOC91974 (Accession XM_041974). Accordingly, utilities of VGAM1199 include diagnosis, prevention and treatment of diseases and clinical conditions associated with LOC91974. FIG. 1 further provides a conceptual description of a novel bioinformatically detected viral gene of the present invention, referred to here as Viral Genomic Address Messenger 1200 (VGAM1200) viral gene, which modulates expression of respective host target genes thereof, the function and utility of which host target genes is known in the art.

VGAM1200 is a novel bioinformatically detected regulatory, non protein coding, viral micro RNA (miRNA) gene. The method by which VGAM1200 was detected is described hereinabove with reference to FIGS. 1-8.

VGAM1200 gene, herein designated VGAM GENE, is a viral gene contained in the genome of Avian Nephritis Virus. VGAM1200 host target gene, herein designated VGAM HOST TARGET GENE, is a human gene contained in the human genome.

VGAM1200 gene encodes a VGAM1200 precursor RNA, herein designated VGAM PRECURSOR RNA. Similar to other miRNA genes, and unlike most ordinary genes, VGAM1200 precursor RNA does not encode a protein. A nucleotide sequence identical or highly similar to the nucleotide sequence of VGAM1200 precursor RNA is designated SEQ ID:1186, and is provided hereinbelow with reference to the sequence listing part. Nucleotide sequence SEQ ID:1186 is located at position 5356 relative to the genome of Avian Nephritis Virus.

VGAM1200 precursor RNA folds onto itself, forming VGAM1200 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1200 folded precursor RNA into VGAM1200 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1200 RNA is designated SEQ ID:3911, and is provided hereinbelow with reference to the sequence listing part.

VGAM1200 host target gene, herein designated VGAM HOST TARGET GENE, encodes a corresponding messenger RNA, VGAM1200 host target RNA, herein designated VGAM HOST TARGET RNA. VGAM1200 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1200 RNA, herein designated VGAM RNA, binds complementarily to one or more host target binding sites located in untranslated regions of VGAM1200 host target RNA, herein designated VGAM HOST TARGET RNA. This complementary binding is due to the fact that the nucleotide sequence of VGAM1200 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1200 RNA, herein designated VGAM RNA, may have a different number of host target binding sites in untranslated regions of a VGAM1200 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1200 RNA, herein designated VGAM RNA, to host target binding sites on VGAM1200 host target RNA, herein designated VGAM HOST TARGET RNA, such as BINDING SITE I, BINDING SITE II and BINDING SITE III, inhibits translation of VGAM1200 host target RNA into VGAM1200 host target protein, herein designated VGAM HOST TARGET PROTEIN. VGAM host target protein is therefore outlined by a broken line.

It is appreciated that VGAM1200 host target gene, herein designated VGAM HOST TARGET GENE, in fact represents a plurality of VGAM1200 host target genes. The mRNA of each one of this plurality of VGAM1200 host target genes comprises one or more host target binding sites, each having a nucleotide sequence which is at least partly complementary to VGAM1200 RNA, herein designated VGAM RNA, and which when bound by VGAM1200 RNA causes inhibition of translation of respective one or more VGAM1200 host target proteins.

It is further appreciated by one skilled in the art that the mode of translational inhibition illustrated by FIG. 1 with specific reference to translational inhibition exerted by VGAM1200 gene, herein designated VGAM GENE, on one or more VGAM1200 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1200 is inhibition of expression of host target genes, as part of a novel viral mechanism of attacking a host. Accordingly, utilities of VGAM1200 include diagnosis, prevention and treatment of viral infection by Avian Nephritis Virus. Specific functions, and accordingly utilities, of VGAM1200 correlate with, and may be deduced from, the identity of the host target genes which VGAM1200 binds and inhibits, and the function of these host target genes, as elaborated hereinbelow.

Nucleotide sequences of the VGAM1200 precursor RNA, herein designated VGAM PRECURSOR RNA, and of the 'diced' VGAM1200 RNA, herein designated VGAM RNA, and a schematic representation of the secondary folding of VGAM1200 folded precursor RNA, herein designated VGAM FOLDED PRECURSOR RNA, of VGAM1200 are further described hereinbelow with reference to Table 1.

Nucleotide sequences of host target binding sites, such as BINDING SITE-I, BINDING SITE-II and BINDING SITE-III of FIG. 1, found on VGAM1200 host target RNA, and schematic representation of the complementarity of each of these host target binding sites to VGAM1200 RNA, herein designated VGAM RNA, are described hereinbelow with reference to Table 2.

As mentioned hereinabove with reference to FIG. 1, a function of VGAM1200 gene, herein designated VGAM is inhibition of expression of VGAM1200 target genes. It is appreciated that specific functions, and accordingly utilities, of VGAM1200 correlate with, and may be deduced from, the identity of the target genes which VGAM1200 binds and inhibits, and the function of these target genes, as elaborated hereinbelow.

Adenylate Cyclase 6 (ADCY6, Accession NM_015270) is a VGAM1200 host target gene. ADCY6 BINDING SITE is HOST TARGET binding site found in the 5' untranslated region of mRNA encoded by ADCY6, corresponding to a HOST TARGET binding site such as BINDING SITE I, BINDING SITE II or BINDING SITE III. Table 2 illustrates the complementarity of the nucleotide sequences of ADCY6 BINDING SITE, designated SEQ ID:17590, to the nucleotide sequence of VGAM1200 RNA, herein designated VGAM RNA, also designated SEQ ID:3911.

A function of VGAM1200 is therefore inhibition of Adenylate Cyclase 6 (ADCY6, Accession NM_015270), a gene which this a membrane-bound, ca (2+)-inhibitable adenylyl cyclase (by similarity). Accordingly, utilities of VGAM1200 include diagnosis, prevention and treatment of diseases and clinical conditions associated with ADCY6. The function of ADCY6 and its association with various diseases and clinical conditions, has been established by previous studies, as described hereinabove with reference to VGAM22. Aldehyde Dehydrogenase 1 Family, Member B1 (ALDH1B1, Accession NM_000692) is another VGAM1200 host target gene. ALDH1B1 BINDING SITE is HOST TARGET binding site found in the 3' untranslated region of mRNA encoded by ALDH1B1, corresponding to a HOST TARGET binding site such as BINDING SITE I, BINDING SITE II or BINDING SITE III. Table 2 illustrates the complementarity of the nucleotide sequences of ALDH1B1 BINDING SITE, designated SEQ ID:6349, to the nucleotide sequence of VGAM1200 RNA, herein designated VGAM RNA, also designated SEQ ID:3911.

Another function of VGAM1200 is therefore inhibition of Aldehyde Dehydrogenase 1 Family, Member B1 (ALDH1B1, Accession NM_000692). Accordingly, utilities of VGAM1200 include diagnosis, prevention and treatment of diseases and clinical conditions associated with ALDH1B1. Dishevelled Associated Activator of Morphogenesis 2 (DAAM2, Accession XM_166434) is another VGAM1200 host target gene. DAAM2 BINDING SITE is HOST TARGET binding site found in the 3' untranslated region of mRNA encoded by DAAM2, corresponding to a HOST TARGET binding site such as BINDING SITE I, BINDING SITE II or BINDING SITE III. Table 2 illustrates the complementarity of the nucleotide sequences of DAAM2 BINDING SITE, designated SEQ ID:44327, to the nucleotide sequence of VGAM1200 RNA, herein designated VGAM RNA, also designated SEQ ID:3911.

Another function of VGAM1200 is therefore inhibition of Dishevelled Associated Activator of Morphogenesis 2 (DAAM2, Accession XM_166434), a gene which controls cell polarity and movement during development. Accordingly, utilities of VGAM1200 include diagnosis, prevention and treatment of diseases and clinical conditions associated with DAAM2. The function of DAAM2 and its association with various diseases and clinical conditions, has been established by previous studies, as described hereinabove with reference to VGAM247. Fibroblast Growth Factor 2 (basic) (FGF2, Accession NM_002006) is another VGAM1200 host target gene. FGF2 BINDING SITE is HOST TARGET binding site found in the 3' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7742, to the nucleotide sequence of VGAM1200 RNA, herein designated VGAM RNA, also designated SEQ ID:3911.

Another function of VGAM1200 is therefore inhibition of Fibroblast Growth Factor 2 (basic) (FGF2, Accession NM_002006), a gene which probably involved in nervous system development and function. Accordingly, utilities of VGAM1200 include diagnosis, prevention and treatment of diseases and clinical conditions associated with FGF2. The function of FGF2 and its association with various diseases and clinical conditions, has been established by previous studies, as described hereinabove with reference to VGAM51. Growth Arrest-specific 7 (GAS7, Accession NM_003644) is another VGAM1200 host target gene. GAS7 BINDING SITE is HOST TARGET binding site found in the 3' untranslated region of mRNA encoded by GAS7, corresponding to a HOST TARGET binding site such as BINDING SITE I, BINDING SITE II or BINDING SITE III. Table 2 illustrates the complementarity of the nucleotide sequences of GAS7 BINDING SITE, designated SEQ ID:9713, to the nucleotide sequence of VGAM1200 RNA, herein designated VGAM RNA, also designated SEQ ID:3911.

Another function of VGAM1200 is therefore inhibition of Growth Arrest-specific 7 (GAS7, Accession NM_003644), a gene which may play a role in promoting maturation and morphological differentiation of cerebellar neurons. Accordingly, utilities of VGAM1200 include diagnosis, prevention and treatment of diseases and clinical conditions associated with GAS7. The function of GAS7 and its association with various diseases and clinical conditions, has been established by previous studies, as described hereinabove with reference to VGAM232. Keratocan (KERA, Accession NM_007035) is another VGAM1200 host target gene. KERA BINDING SITE is HOST TARGET binding site found in the 5' untranslated region of mRNA encoded by KERA, corresponding to a HOST TARGET binding site such as BINDING SITE I, BINDING SITE II or BINDING SITE III. Table 2 illustrates the complementarity of the nucleotide sequences of KERA BINDING SITE, designated SEQ ID:13909, to the nucleotide sequence of VGAM1200 RNA, herein designated VGAM RNA, also designated SEQ ID:3911.

Another function of VGAM1200 is therefore inhibition of Keratocan (KERA, Accession NM_007035), a gene which may be important in developing and maintaining corneal transparency and for the structure of the stromal matrix. Accordingly, utilities of VGAM1200 include diagnosis, prevention and treatment of diseases and clinical conditions associated with KERA. The function of KERA and its association with various diseases and clinical conditions, has been established by previous studies, as described hereinabove with reference to VGAM723. Matrix Metalloproteinase 25 (MMP25, Accession NM_022468) is another VGAM1200 host target gene. MMP25 BINDING SITE is HOST TARGET binding site found in the 3' untranslated region of mRNA encoded by MMP25, corresponding to a HOST TARGET binding site such as BINDING SITE I, BINDING SITE II or BINDING SITE III. Table 2 illustrates the complementarity of the nucleotide sequences of MMP25 BINDING SITE, designated SEQ ID:22820, to the nucleotide sequence of VGAM1200 RNA, herein designated VGAM RNA, also designated SEQ ID:3911.

Another function of VGAM1200 is therefore inhibition of Matrix Metalloproteinase 25 (MMP25, Accession NM_022468). Accordingly, utilities of VGAM1200 include diagnosis, prevention and treatment of diseases and clinical conditions associated with MMP25. Periplakin (PPL, Accession NM_002705) is another VGAM1200 host target gene. PPL BINDING SITE is HOST TARGET binding site found in the 3' untranslated region of mRNA encoded by PPL, corresponding to a HOST TARGET binding site such as BINDING SITE I, BINDING SITE II or BINDING SITE III. Table 2 illustrates the complementarity of the nucleotide sequences of PPL BINDING SITE, designated SEQ ID:8553, to the nucleotide sequence of VGAM1200 RNA, herein designated VGAM RNA, also designated SEQ ID:3911.

Another function of VGAM1200 is therefore inhibition of Periplakin (PPL, Accession NM_002705). Accordingly, utilities of VGAM1200 include diagnosis, prevention and treatment of diseases and clinical conditions associated with PPL. Transcription Factor 19 (SC1) (TCF19, Accession XM_175251) is another VGAM1200 host target gene. TCF19 BINDING SITE1 and TCF19 BINDING SITE2 are HOST TARGET binding sites found in untranslated regions of mRNA encoded by TCF19, corresponding to HOST TARGET binding sites such as BINDING SITE I, BINDING SITE II or BINDING SITE III. Table 2 illustrates the complementarity of the nucleotide sequences of TCF19 BINDING SITE1 and TCF19 BINDING SITE2, designated SEQ ID:46711 and SEQ ID:46662 respectively, to the nucleotide sequence of VGAM1200 RNA, herein designated VGAM RNA, also designated SEQ ID:3911.

Another function of VGAM1200 is therefore inhibition of Transcription Factor 19 (SC1) (TCF19, Accession XM_175251), a gene which plays an important role in the transcription of genes required for the later stages of cell cycle progression. Accordingly, utilities of VGAM1200 include diagnosis, prevention and treatment of diseases and clinical conditions associated with TCF19. The function of TCF19 and its association with various diseases and clinical conditions, has been established by previous studies, as described hereinabove with reference to VGAM299. Chromosome 11 Open Reading Frame 23 (C11orf23, Accession NM_018312) is another VGAM1200 host target gene. C11orf23 BINDING SITE is HOST TARGET binding site found in the 3' untranslated region of mRNA encoded by C11orf23, corresponding to a HOST TARGET binding site such as BINDING SITE I, BINDING SITE II or BINDING SITE III. Table 2 illustrates the complementarity of the nucleotide sequences of C11orf23 BINDING SITE, designated SEQ ID:20299, to the nucleotide sequence of VGAM1200 RNA, herein designated VGAM RNA, also designated SEQ ID:3911.

Another function of VGAM1200 is therefore inhibition of Chromosome 11 Open Reading Frame 23 (C11orf23, Accession NM_018312). Accordingly, utilities of VGAM1200 include diagnosis, prevention and treatment of diseases and clinical conditions associated with C11orf23. DC-TM4F2 (Accession NM_030927) is another VGAM1200 host target gene. DC-TM4F2 BINDING SITE is HOST TARGET binding site found in the 3' untranslated region of mRNA encoded by DC-TM4F2, corresponding to a HOST TARGET binding site such as BINDING SITE I, BINDING SITE II or BINDING SITE III. Table 2 illustrates the complementarity of the nucleotide sequences of DC-TM4F2 BINDING SITE, designated SEQ ID:25198, to the nucleotide sequence of VGAM1200 RNA, herein designated VGAM RNA, also designated SEQ ID:3911.

Another function of VGAM1200 is therefore inhibition of DC-TM4F2 (Accession NM_030927). Accordingly, utilities of VGAM1200 include diagnosis, prevention and treatment of diseases and clinical conditions associated with DC-TM4F2. Di-Ras2 (Accession NM_017594) is another VGAM1200 host target gene. Di-Ras2 BINDING SITE is HOST TARGET binding site found in the 3' untranslated region of mRNA encoded by Di-Ras2, corresponding to a HOST TARGET binding site such as BINDING SITE I, BINDING SITE II or BINDING SITE III. Table 2 illustrates the complementarity of the nucleotide sequences of Di-Ras2 BINDING SITE, designated SEQ ID:19044, to the nucleotide sequence of VGAM1200 RNA, herein designated VGAM RNA, also designated SEQ ID:3911.

Another function of VGAM1200 is therefore inhibition of Di-Ras2 (Accession NM_017594). Accordingly, utilities of VGAM1200 include diagnosis, prevention and treatment of diseases and clinical conditions associated with Di-Ras2. Echinoderm Microtubule Associated Protein Like 4 (EML4, Accession NM_019063) is another VGAM1200 host target gene. EML4 BINDING SITE is HOST TARGET binding site found in the 3' untranslated region of mRNA encoded by EML4, corresponding to a HOST TARGET binding site such as BINDING SITE I, BINDING SITE II or BINDING SITE III. Table 2 illustrates the complementarity of the nucleotide sequences of EML4 BINDING SITE, designated SEQ ID:21145, to the nucleotide sequence of VGAM1200 RNA, herein designated VGAM RNA, also designated SEQ ID:3911.

Another function of VGAM1200 is therefore inhibition of Echinoderm Microtubule Associated Protein Like 4 (EML4, Accession NM_019063). Accordingly, utilities of VGAM1200 include diagnosis, prevention and treatment of diseases and clinical conditions associated with EML4. FLJ12542 (Accession NM_024899) is another VGAM1200 host target gene. FLJ12542 BINDING SITE is HOST TARGET binding site found in the 3' untranslated region of mRNA encoded by FLJ12542, corresponding to a HOST TARGET binding site such as BINDING SITE I, BINDING SITE II or BINDING SITE III. Table 2 illustrates the complementarity of the nucleotide sequences of FLJ12542 BINDING SITE, designated SEQ ID:24382, to the nucleotide sequence of VGAM1200 RNA, herein designated VGAM RNA, also designated SEQ ID:3911.

Another function of VGAM1200 is therefore inhibition of FLJ12542 (Accession NM_024899). Accordingly, utilities of VGAM1200 include diagnosis, prevention and treatment of diseases and clinical conditions associated with FLJ12542. FLJ12800 (Accession NM_022903) is another VGAM1200 host target gene. FLJ12800 BINDING SITE is HOST TARGET binding site found in the 3' untranslated region of mRNA encoded by FLJ12800, corresponding to a HOST TARGET binding site such as BINDING SITE I, BINDING SITE II or BINDING SITE III. Table 2 illustrates the complementarity of the nucleotide sequences of FLJ12800 BINDING SITE, designated SEQ ID:23193, to the nucleotide sequence of VGAM1200 RNA, herein designated VGAM RNA, also designated SEQ ID:3911.

Another function of VGAM1200 is therefore inhibition of FLJ12800 (Accession NM_022903). Accordingly, utilities of VGAM1200 include diagnosis, prevention and treatment of diseases and clinical conditions associated with FLJ12800. FLJ13693 (Accession NM_024807) is another VGAM1200 host target gene. FLJ13693 BINDING SITE is HOST TARGET binding site found in the 3' untranslated region of mRNA encoded by FLJ13693, corresponding to a HOST TARGET binding site such as BINDING SITE I, BINDING SITE II or BINDING SITE III. Table 2 illustrates the complementarity of the nucleotide sequences of FLJ13693 BINDING SITE, designated SEQ ID:24186, to the nucleotide sequence of VGAM1200 RNA, herein designated VGAM RNA, also designated SEQ ID:3911.

Another function of VGAM1200 is therefore inhibition of FLJ13693 (Accession NM_024807). Accordingly, utilities of VGAM1200 include diagnosis, prevention and treatment of diseases and clinical conditions associated with FLJ13693. FLJ20730 (Accession NM_017945) is another VGAM1200 host target gene. FLJ20730 BINDING SITE is HOST TARGET binding site found in the 3' untranslated region of mRNA encoded by FLJ20730, corresponding to a HOST TARGET binding site such as BINDING SITE I, BINDING SITE II or BINDING SITE III. Table 2 illustrates the complementarity of the nucleotide sequences of FLJ20730 BINDING SITE, designated SEQ ID:19641, to the nucleotide sequence of VGAM1200 RNA, herein designated VGAM RNA, also designated SEQ ID:3911.

Another function of VGAM1200 is therefore inhibition of FLJ20730 (Accession NM_017945). Accordingly, utilities of VGAM1200 include diagnosis, prevention and treatment of diseases and clinical conditions associated with FLJ20730. FLJ22127 (Accession NM_022775) is another VGAM1200 host target gene. FLJ22127 BINDING SITE is HOST TARGET binding site found in the 3' untranslated region of mRNA encoded by FLJ22127, corresponding to a HOST TARGET binding site such as BINDING SITE I, BINDING SITE II or BINDING SITE III. Table 2 illustrates the complementarity of the nucleotide sequences of FLJ22127 BINDING SITE, designated SEQ ID:23040, to the nucleotide sequence of VGAM1200 RNA, herein designated VGAM RNA, also designated SEQ ID:3911.

Another function of VGAM1200 is therefore inhibition of FLJ22127 (Accession NM_022775). Accordingly, utilities of VGAM1200 include diagnosis, prevention and treatment of diseases and clinical conditions associated with FLJ22127. FLJ23191 (Accession NM_024574) is another VGAM1200 host target gene. FLJ23191 BINDING SITE is HOST TARGET binding site found in the 5' untranslated region of mRNA encoded by FLJ23191, corresponding to a HOST TARGET binding site such as BINDING SITE I, BINDING SITE II or BINDING SITE III. Table 2 illustrates the complementarity of the nucleotide sequences of FLJ23191 BINDING SITE, designated SEQ ID:23801, to the nucleotide sequence of VGAM1200 RNA, herein designated VGAM RNA, also designated SEQ ID:3911.

Another function of VGAM1200 is therefore inhibition of FLJ23191 (Accession NM_024574). Accordingly, utilities of VGAM1200 include diagnosis, prevention and treatment of diseases and clinical conditions associated with FLJ23191. GMPPB (Accession XM_171044) is another VGAM1200 host target gene. GMPPB BINDING SITE is HOST TARGET binding site found in the 3' untranslated region of mRNA encoded by GMPPB, corresponding to a HOST TARGET binding site such as BINDING SITE I, BINDING SITE II or BINDING SITE III. Table 2 illustrates the complementarity of the nucleotide sequences of GMPPB BINDING SITE, designated SEQ ID:45818, to the nucleotide sequence of VGAM1200 RNA, herein designated VGAM RNA, also designated SEQ ID:3911.

Another function of VGAM1200 is therefore inhibition of GMPPB (Accession XM_171044). Accordingly, utilities of VGAM1200 include diagnosis, prevention and treatment of diseases and clinical conditions associated with GMPPB. KIAA1854 (Accession XM_049884) is another VGAM1200 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35536, to the nucleotide sequence of VGAM1200 RNA, herein designated VGAM RNA, also designated SEQ ID:3911.

Another function of VGAM1200 is therefore inhibition of KIAA1854 (Accession XM_049884). Accordingly, utilities of VGAM1200 include diagnosis, prevention and treatment of diseases and clinical conditions associated with KIAA1854. KIAA1912 (Accession XM_055636) is another VGAM1200 host target gene. KIAA1912 BINDING SITE is HOST TARGET binding site found in the 3' untranslated region of mRNA encoded by KIAA1912, corresponding to a HOST TARGET binding site such as BINDING SITE I, BINDING SITE II or BINDING SITE III. Table 2 illustrates the complementarity of the nucleotide sequences of KIAA1912 BINDING SITE, designated SEQ ID:36311, to the nucleotide sequence of VGAM1200 RNA, herein designated VGAM RNA, also designated SEQ ID:3911.

Another function of VGAM1200 is therefore inhibition of KIAA1912 (Accession XM_055636). Accordingly, utilities of VGAM1200 include diagnosis, prevention and treatment of diseases and clinical conditions associated with KIAA1912. Kelch-like 4 (Drosophila) (KLHL4, Accession NM_019117) is another VGAM1200 host target gene. KLHL4 BINDING SITE is HOST TARGET binding site found in the 3' untranslated region of mRNA encoded by KLHL4, corresponding to a HOST TARGET binding site such as BINDING SITE I, BINDING SITE II or BINDING SITE III. Table 2 illustrates the complementarity of the nucleotide sequences of KLHL4 BINDING SITE, designated SEQ ID:21198, to the nucleotide sequence of VGAM1200 RNA, herein designated VGAM RNA, also designated SEQ ID:3911.

Another function of VGAM1200 is therefore inhibition of Kelch-like 4 (Drosophila) (KLHL4, Accession NM_019117). Accordingly, utilities of VGAM1200 include diagnosis, prevention and treatment of diseases and clinical conditions associated with KLHL4. MR (Accession NM_031212) is another VGAM1200 host target gene. MR BINDING SITE is HOST TARGET binding site found in the 5' untranslated region of mRNA encoded by MR, corresponding to a HOST TARGET binding site such as BINDING SITE I, BINDING SITE II or BINDING SITE III. Table 2 illustrates the complementarity of the nucleotide sequences of MR BINDING SITE, designated SEQ ID:25254, to the nucleotide sequence of VGAM1200 RNA, herein designated VGAM RNA, also designated SEQ ID:3911.

Another function of VGAM1200 is therefore inhibition of MR (Accession NM_031212). Accordingly, utilities of VGAM1200 include diagnosis, prevention and treatment of diseases and clinical conditions associated with MR. LOC129831 (Accession XM_059376) is another VGAM1200 host target gene. LOC129831 BINDING SITE is HOST TARGET binding site found in the 3' untranslated region of mRNA encoded by LOC129831, corresponding to a HOST TARGET binding site such as BINDING SITE I, BINDING SITE II or BINDING SITE III. Table 2 illustrates the complementarity of the nucleotide sequences of LOC129831 BINDING SITE, designated SEQ ID:36980, to the nucleotide sequence of VGAM1200 RNA, herein designated VGAM RNA, also designated SEQ ID:3911.

Another function of VGAM1200 is therefore inhibition of LOC129831 (Accession XM_059376). Accordingly, utilities of VGAM1200 include diagnosis, prevention and treatment of diseases and clinical conditions associated with LOC129831. LOC130644 (Accession XM_065813) is another VGAM1200 host target gene. LOC130644 BINDING SITE is HOST TARGET binding site found in the 5' untranslated region of mRNA encoded by LOC130644, corresponding to a HOST TARGET binding site such as BINDING SITE I, BINDING SITE II or BINDING SITE III. Table 2 illustrates the complementarity of the nucleotide sequences of LOC130644 BINDING SITE, designated SEQ ID:37301, to the nucleotide sequence of VGAM1200 RNA, herein designated VGAM RNA, also designated SEQ ID:3911.

Another function of VGAM1200 is therefore inhibition of LOC130644 (Accession XM_065813). Accordingly, utilities of VGAM1200 include diagnosis, prevention and treatment of diseases and clinical conditions associated with LOC130644. LOC151121 (Accession XM_087102) is another VGAM1200 host target gene. LOC151121 BINDING SITE is HOST TARGET binding site found in the 5' untranslated region of mRNA encoded by LOC151121, corresponding to a HOST TARGET binding site such as BINDING SITE I, BINDING SITE II or BINDING SITE III. Table 2 illustrates the complementarity of the nucleotide sequences of LOC151121 BINDING SITE, designated SEQ ID:39051, to the nucleotide sequence of VGAM1200 RNA, herein designated VGAM RNA, also designated SEQ ID:3911.

Another function of VGAM1200 is therefore inhibition of LOC151121 (Accession XM_087102). Accordingly, utilities of VGAM1200 include diagnosis, prevention and treatment of diseases and clinical conditions associated with LOC151121. LOC151778 (Accession XM_049352) is another VGAM1200 host target gene. LOC151778 BINDING SITE is HOST TARGET binding site found in the 5' untranslated region of mRNA encoded by LOC151778, corresponding to a HOST TARGET binding site such as BINDING SITE I, BINDING SITE II or BINDING SITE III. Table 2 illustrates the complementarity of the nucleotide sequences of LOC151778 BINDING SITE, designated SEQ ID:35397, to the nucleotide sequence of VGAM1200 RNA, herein designated VGAM RNA, also designated SEQ ID:3911.

Another function of VGAM1200 is therefore inhibition of LOC151778 (Accession XM_049352). Accordingly, utilities of VGAM1200 include diagnosis, prevention and treatment of diseases and clinical conditions associated with LOC151778. LOC153396 (Accession XM_087662) is another VGAM1200 host target gene. LOC153396 BINDING SITE is HOST TARGET binding site found in the 3' untranslated region of mRNA encoded by LOC153396, corresponding to a HOST TARGET binding site such as BINDING SITE I, BINDING SITE II or BINDING SITE III. Table 2 illustrates the complementarity of the nucleotide sequences of LOC153396 BINDING SITE, designated SEQ ID:39371, to the nucleotide sequence of VGAM1200 RNA, herein designated VGAM RNA, also designated SEQ ID:3911.

Another function of VGAM1200 is therefore inhibition of LOC153396 (Accession XM_087662). Accordingly, utilities of VGAM1200 include diagnosis, prevention and treatment of diseases and clinical conditions associated with LOC153396. LOC155340 (Accession XM_055725) is another VGAM1200 host target gene. LOC155340 BINDING SITE is HOST TARGET binding site found in the 5' untranslated region of mRNA encoded by LOC155340, corresponding to a HOST TARGET binding site such as BINDING SITE I, BINDING SITE II or BINDING SITE III. Table 2 illustrates the complementarity of the nucleotide sequences of LOC155340 BINDING SITE, designated SEQ ID:36316, to the nucleotide sequence of VGAM1200 RNA, herein designated VGAM RNA, also designated SEQ ID:3911.

Another function of VGAM1200 is therefore inhibition of LOC155340 (Accession XM_055725). Accordingly, utilities of VGAM1200 include diagnosis, prevention and treatment of diseases and clinical conditions associated with LOC155340. LOC157867 (Accession XM_098831) is another VGAM1200 host target gene. LOC157867 BINDING SITE is HOST TARGET binding site found in the 5' untranslated region of mRNA encoded by LOC157867, corresponding to a HOST TARGET binding site such as BINDING SITE I, BINDING SITE II or BINDING SITE III. Table 2 illustrates the complementarity of the nucleotide sequences of LOC157867 BINDING SITE, designated SEQ ID:41856, to the nucleotide sequence of VGAM1200 RNA, herein designated VGAM RNA, also designated SEQ ID:3911.

Another function of VGAM1200 is therefore inhibition of LOC157867 (Accession XM_098831). Accordingly, utilities of VGAM1200 include diagnosis, prevention and treatment of diseases and clinical conditions associated with LOC157867. LOC158345 (Accession XM_034640) is another VGAM1200 host target gene. LOC158345 BINDING SITE is HOST TARGET binding site found in the 5' untranslated region of mRNA encoded by LOC158345, corresponding to a HOST TARGET binding site such as BINDING SITE I, BINDING SITE II or BINDING SITE III. Table 2 illustrates the complementarity of the nucleotide sequences of LOC158345 BINDING SITE, designated SEQ ID:32132, to the nucleotide sequence of VGAM1200 RNA, herein designated VGAM RNA, also designated SEQ ID:3911.

Another function of VGAM1200 is therefore inhibition of LOC158345 (Accession XM_034640). Accordingly, utilities of VGAM1200 include diagnosis, prevention and treatment of diseases and clinical conditions associated with LOC158345. LOC159193 (Accession XM_089436) is another VGAM1200 host target gene. LOC159193 BINDING SITE is HOST TARGET binding site found in the 5' untranslated region of mRNA encoded by LOC159193, corresponding to a HOST TARGET binding site such as BINDING SITE I, BINDING SITE II or BINDING SITE III. Table 2 illustrates the complementarity of the nucleotide sequences of LOC159193 BINDING SITE, designated SEQ ID:39976, to the nucleotide sequence of VGAM1200 RNA, herein designated VGAM RNA, also designated SEQ ID:3911.

Another function of VGAM1200 is therefore inhibition of LOC159193 (Accession XM_089436). Accordingly, utilities of VGAM1200 include diagnosis, prevention and treatment of diseases and clinical conditions associated with LOC159193. LOC255620 (Accession XM_173132) is another VGAM1200 host target gene. LOC255620 BINDING SITE is HOST TARGET binding site found in the 5' untranslated region of mRNA encoded by LOC255620, corresponding to a HOST TARGET binding site such as BINDING SITE I, BINDING SITE II or BINDING SITE III. Table 2 illustrates the complementarity of the nucleotide sequences of LOC255620 BINDING SITE, designated SEQ ID:46378, to the nucleotide sequence of VGAM1200 RNA, herein designated VGAM RNA, also designated SEQ ID:3911.

Another function of VGAM1200 is therefore inhibition of LOC255620 (Accession XM_173132). Accordingly, utilities of VGAM1200 include diagnosis, prevention and treatment of diseases and clinical conditions associated with LOC255620. LOC256598 (Accession XM_172816) is another VGAM1200 host target gene. LOC256598 BINDING SITE is HOST TARGET binding site found in the 5' untranslated region of mRNA encoded by LOC256598, corresponding to a HOST TARGET binding site such as BINDING SITE I, BINDING SITE II or BINDING SITE III. Table 2 illustrates the complementarity of the nucleotide sequences of LOC256598 BINDING SITE, designated SEQ ID:46097, to the nucleotide sequence of VGAM1200 RNA, herein designated VGAM RNA, also designated SEQ ID:3911.

Another function of VGAM1200 is therefore inhibition of LOC256598 (Accession XM_172816). Accordingly, utilities of VGAM1200 include diagnosis, prevention and treatment of diseases and clinical conditions associated with LOC256598. LOC91759 (Accession XM_040467) is another VGAM1200 host target gene. LOC91759 BINDING SITE is HOST TARGET binding site found in the 5' untranslated region of mRNA encoded by LOC91759, corresponding to a HOST TARGET binding site such as BINDING SITE I, BINDING SITE II or BINDING SITE III. Table 2 illustrates the complementarity of the nucleotide sequences of LOC91759 BINDING SITE, designated SEQ ID:33301, to the nucleotide sequence of VGAM1200 RNA, herein designated VGAM RNA, also designated SEQ ID:3911.

Another function of VGAM1200 is therefore inhibition of LOC91759 (Accession XM_040467). Accordingly, utilities of VGAM1200 include diagnosis, prevention and treatment of diseases and clinical conditions associated with LOC91759. FIG. 1 further provides a conceptual description of a novel bioinformatically detected viral gene of the present invention, referred to here as Viral Genomic Address Messenger 1201 (VGAM1201) viral gene, which modulates expression of respective host target genes thereof, the function and utility of which host target genes is known in the art.

VGAM1201 is a novel bioinformatically detected regulatory, non protein coding, viral micro RNA (miRNA) gene. The method by which VGAM1201 was detected is described hereinabove with reference to FIGS. 1-8.

VGAM1201 gene, herein designated VGAM GENE, is a viral gene contained in the genome of Avian Nephritis Virus. VGAM1201 host target gene, herein designated VGAM HOST TARGET GENE, is a human gene contained in the human genome.

VGAM1201 gene encodes a VGAM1201 precursor RNA, herein designated VGAM PRECURSOR RNA. Similar to other miRNA genes, and unlike most ordinary genes, VGAM1201 precursor RNA does not encode a protein. A nucleotide sequence identical or highly similar to the nucleotide sequence of VGAM1201 precursor RNA is designated SEQ ID:1187, and is provided hereinbelow with reference to the sequence listing part. Nucleotide sequence SEQ ID:1187 is located at position 5950 relative to the genome of Avian Nephritis Virus.

VGAM1201 precursor RNA folds onto itself, forming VGAM1201 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1201 folded precursor RNA into VGAM1201 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1201 RNA is designated SEQ ID:3912, and is provided hereinbelow with reference to the sequence listing part.

VGAM1201 host target gene, herein designated VGAM HOST TARGET GENE, encodes a corresponding messenger RNA, VGAM1201 host target RNA, herein designated VGAM HOST TARGET RNA. VGAM1201 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1201 RNA, herein designated VGAM RNA, binds complementarily to one or more host target binding sites located in untranslated regions of VGAM1201 host target RNA, herein designated VGAM HOST TARGET RNA. This complementary binding is due to the fact that the nucleotide sequence of VGAM1201 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1201 RNA, herein designated VGAM RNA, may have a different number of host target binding sites in untranslated regions of a VGAM1201 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1201 RNA, herein designated VGAM RNA, to host target binding sites on VGAM1201 host target RNA, herein designated VGAM HOST TARGET RNA, such as BINDING SITE I, BINDING SITE II and BINDING SITE III, inhibits translation of VGAM1201 host target RNA into VGAM1201 host target protein, herein designated VGAM HOST TARGET PROTEIN. VGAM host target protein is therefore outlined by a broken line.

It is appreciated that VGAM1201 host target gene, herein designated VGAM HOST TARGET GENE, in fact represents a plurality of VGAM1201 host target genes. The mRNA of each one of this plurality of VGAM1201 host target genes comprises one or more host target binding sites, each having a nucleotide sequence which is at least partly complementary to VGAM1201 RNA, herein designated VGAM RNA, and which when bound by VGAM1201 RNA causes inhibition of translation of respective one or more VGAM1201 host target proteins.

It is further appreciated by one skilled in the art that the mode of translational inhibition illustrated by FIG. 1 with specific reference to translational inhibition exerted by VGAM1201 gene, herein designated VGAM GENE, on one or more VGAM1201 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1201 is inhibition of expression of host target genes, as part of a novel viral mechanism of attacking a host. Accordingly, utilities of VGAM1201 include diagnosis, prevention and treatment of viral infection by Avian Nephritis Virus. Specific functions, and accordingly utilities, of VGAM1201 correlate with, and may be deduced from, the identity of the host target genes which VGAM1201 binds and inhibits, and the function of these host target genes, as elaborated hereinbelow.

Nucleotide sequences of the VGAM1201 precursor RNA, herein designated VGAM PRECURSOR RNA, and of the 'diced' VGAM1201 RNA, herein designated VGAM RNA, and a schematic representation of the secondary folding of VGAM1201 folded precursor RNA, herein designated VGAM FOLDED PRECURSOR RNA, of VGAM1201 are further described hereinbelow with reference to Table 1.

Nucleotide sequences of host target binding sites, such as BINDING SITE-I, BINDING SITE-II and BINDING SITE-III of FIG. 1, found on VGAM1201 host target RNA, and schematic representation of the complementarity of each of these host target binding sites to VGAM1201 RNA, herein designated VGAM RNA, are described hereinbelow with reference to Table 2.

As mentioned hereinabove with reference to FIG. 1, a function of VGAM1201 gene, herein designated VGAM is inhibition of expression of VGAM1201 target genes. It is appreciated that specific functions, and accordingly utilities, of VGAM1201 correlate with, and may be deduced from, the identity of the target genes which VGAM1201 binds and inhibits, and the function of these target genes, as elaborated hereinbelow.

Exostoses (multiple)-like 2 (EXTL2, Accession NM_001439) is a VGAM1201 host target gene. EXTL2 BINDING SITE is HOST TARGET binding site found in the 5' untranslated region of mRNA encoded by EXTL2, corresponding to a HOST TARGET binding site such as BINDING SITE I, BINDING SITE II or BINDING SITE III. Table 2 illustrates the complementarity of the nucleotide sequences of EXTL2 BINDING SITE, designated SEQ ID:7164, to the nucleotide sequence of VGAM1201 RNA, herein designated VGAM RNA, also designated SEQ ID:3912.

A function of VGAM1201 is therefore inhibition of Exostoses (multiple)-like 2 (EXTL2, Accession NM_001439), a gene which is homologous to the EXT and EXTL genes. Accordingly, utilities of VGAM1201 include diagnosis, prevention and treatment of diseases and clinical conditions associated with EXTL2. The function of EXTL2 and its association with various diseases and clinical conditions, has been established by previous studies, as described hereinabove with reference to VGAM743. KIAA1580 (Accession XM_045271) is another VGAM1201 host target gene. KIAA1580 BINDING SITE is HOST TARGET binding site found in the 5' untranslated region of mRNA encoded by KIAA1580, corresponding to a HOST TARGET binding site such as BINDING SITE I, BINDING SITE II or BINDING SITE III. Table 2 illustrates the complementarity of the nucleotide sequences of KIAA1580 BINDING SITE, designated SEQ ID:34409, to the nucleotide sequence of VGAM1201 RNA, herein designated VGAM RNA, also designated SEQ ID:3912.

Another function of VGAM1201 is therefore inhibition of KIAA1580 (Accession XM_045271). Accordingly, utilities of VGAM1201 include diagnosis, prevention and treatment of diseases and clinical conditions associated with KIAA1580. KIAA1879 (Accession XM_056635) is another VGAM1201 host target gene. KIAA1879 BINDING SITE is HOST TARGET binding site found in the 3' untranslated region of mRNA encoded by KIAA1879, corresponding to a HOST TARGET binding site such as BINDING SITE I, BINDING SITE II or BINDING SITE III. Table 2 illustrates the complementarity of the nucleotide sequences of KIAA1879 BINDING SITE, designated SEQ ID:36410, to the nucleotide sequence of VGAM1201 RNA, herein designated VGAM RNA, also designated SEQ ID:3912.

Another function of VGAM1201 is therefore inhibition of KIAA1879 (Accession XM_056635). Accordingly, utilities of VGAM1201 include diagnosis, prevention and treatment of diseases and clinical conditions associated with KIAA1879. Sema Domain, Immunoglobulin Domain (Ig), Transmembrane Domain (TM) and Short Cytoplasmic Domain, (semaphorin) 4F (SEMA4F, Accession NM_004263) is another VGAM1201 host target gene. SEMA4F BINDING SITE is HOST TARGET binding site found in the 3' untranslated region of mRNA encoded by SEMA4F, corresponding to a HOST TARGET binding site such as BINDING SITE I, BINDING SITE II or BINDING SITE III. Table 2 illustrates the complementarity of the nucleotide sequences of SEMA4F BINDING SITE, designated SEQ ID:10455, to the nucleotide sequence of VGAM1201 RNA, herein designated VGAM RNA, also designated SEQ ID:3912.

Another function of VGAM1201 is therefore inhibition of Sema Domain, Immunoglobulin Domain (Ig), Transmembrane Domain (TM) and Short Cytoplasmic Domain, (semaphorin) 4F (SEMA4F, Accession NM_004263). Accordingly, utilities of VGAM1201 include diagnosis, prevention and treatment of diseases and clinical conditions associated with SEMA4F. LOC127534 (Accession XM_060532) is another VGAM1201 host target gene. LOC127534 BINDING SITE is HOST TARGET binding site found in the 5' untranslated region of mRNA encoded by LOC127534, corresponding to a HOST TARGET binding site such as BINDING SITE I, BINDING SITE II or BINDING SITE III. Table 2 illustrates the complementarity of the nucleotide sequences of LOC127534 BINDING SITE, designated SEQ ID:37163, to the nucleotide sequence of VGAM1201 RNA, herein designated VGAM RNA, also designated SEQ ID:3912.

Another function of VGAM1201 is therefore inhibition of LOC127534 (Accession XM_060532). Accordingly, utilities of VGAM1201 include diagnosis, prevention and treatment of diseases and clinical conditions associated with LOC127534. LOC151178 (Accession XM_087117) is another VGAM1201 host target gene. LOC151178 BINDING SITE is HOST TARGET binding site found in the 5' untranslated region of mRNA encoded by LOC151178, corresponding to a HOST TARGET binding site such as BINDING SITE I, BINDING SITE II or BINDING SITE III. Table 2 illustrates the complementarity of the nucleotide sequences of LOC151178 BINDING SITE, designated SEQ ID:39067, to the nucleotide sequence of VGAM1201 RNA, herein designated VGAM RNA, also designated SEQ ID:3912.

Another function of VGAM1201 is therefore inhibition of LOC151178 (Accession XM_087117). Accordingly, utilities of VGAM1201 include diagnosis, prevention and treatment of diseases and clinical conditions associated with LOC151178. LOC158987 (Accession XM_099015) is another VGAM1201 host target gene. LOC158987 BINDING SITE is HOST TARGET binding site found in the 3' untranslated region of mRNA encoded by LOC158987, corresponding to a HOST TARGET binding site such as BINDING SITE I, BINDING SITE II or BINDING SITE III. Table 2 illustrates the complementarity of the nucleotide sequences of LOC158987 BINDING SITE, designated SEQ ID:42045, to the nucleotide sequence of VGAM1201 RNA, herein designated VGAM RNA, also designated SEQ ID:3912.

Another function of VGAM1201 is therefore inhibition of LOC158987 (Accession XM_099015). Accordingly, utilities of VGAM1201 include diagnosis, prevention and treatment of diseases and clinical conditions associated with LOC158987. LOC221833 (Accession XM_166519) is another VGAM1201 host target gene. LOC221833 BINDING SITE is HOST TARGET binding site found in the 3' untranslated region of mRNA encoded by LOC221833, corresponding to a HOST TARGET binding site such as BINDING SITE I, BINDING SITE II or BINDING SITE III. Table 2 illustrates the complementarity of the nucleotide sequences of LOC221833 BINDING SITE, designated SEQ ID:44454, to the nucleotide sequence of VGAM1201 RNA, herein designated VGAM RNA, also designated SEQ ID:3912.

Another function of VGAM1201 is therefore inhibition of LOC221833 (Accession XM_166519). Accordingly, utilities of VGAM1201 include diagnosis, prevention and treatment of diseases and clinical conditions associated with LOC221833. LOC91661 (Accession NM_138372) is another VGAM1201 host target gene. LOC91661 BINDING SITE is HOST TARGET binding site found in the 3' untranslated region of mRNA encoded by LOC91661, corresponding to a HOST TARGET binding site such as BINDING SITE I, BINDING SITE II or BINDING SITE III. Table 2 illustrates the complementarity of the nucleotide sequences of LOC91661 BINDING SITE, designated SEQ ID:28750, to the nucleotide sequence of VGAM1201 RNA, herein designated VGAM RNA, also designated SEQ ID:3912.

Another function of VGAM1201 is therefore inhibition of LOC91661 (Accession NM_138372). Accordingly, utilities of VGAM1201 include diagnosis, prevention and treatment of diseases and clinical conditions associated with LOC91661. FIG. 1 further provides a conceptual description of a novel bioinformatically detected viral gene of the present invention, referred to here as Viral Genomic Address Messenger 1202 (VGAM1202) viral gene, which modulates expression of respective host target genes thereof, the function and utility of which host target genes is known in the art.

VGAM1202 is a novel bioinformatically detected regulatory, non protein coding, viral micro RNA (miRNA) gene. The method by which VGAM1202 was detected is described hereinabove with reference to FIGS. 1-8.

VGAM1202 gene, herein designated VGAM GENE, is a viral gene contained in the genome of Avian Nephritis Virus. VGAM1202 host target gene, herein designated VGAM HOST TARGET GENE, is a human gene contained in the human genome.

VGAM1202 gene encodes a VGAM1202 precursor RNA, herein designated VGAM PRECURSOR RNA. Similar to other miRNA genes, and unlike most ordinary genes, VGAM1202 precursor RNA does not encode a protein. A nucleotide sequence identical or highly similar to the nucleotide sequence of VGAM1202 precursor RNA is designated SEQ ID:1188, and is provided hereinbelow with reference to the sequence listing part. Nucleotide sequence SEQ ID:1188 is located at position 3947 relative to the genome of Avian Nephritis Virus.

VGAM1202 precursor RNA folds onto itself, forming VGAM1202 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1202 folded precursor RNA into VGAM1202 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1202 RNA is designated SEQ ID:3913, and is provided hereinbelow with reference to the sequence listing part.

VGAM1202 host target gene, herein designated VGAM HOST TARGET GENE, encodes a corresponding messenger RNA, VGAM1202 host target RNA, herein designated VGAM HOST TARGET RNA. VGAM1202 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1202 RNA, herein designated VGAM RNA, binds complementarily to one or more host target binding sites located in untranslated regions of VGAM1202 host target RNA, herein designated VGAM HOST TARGET RNA. This complementary binding is due to the fact that the nucleotide sequence of VGAM1202 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1202 RNA, herein designated VGAM RNA, may have a different number of host target binding sites in untranslated regions of a VGAM1202 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1202 RNA, herein designated VGAM RNA, to host target binding sites on VGAM1202 host target RNA, herein designated VGAM HOST TARGET RNA, such as BINDING SITE I, BINDING SITE II and BINDING SITE III, inhibits translation of VGAM1202 host target RNA into VGAM1202 host target protein, herein designated VGAM HOST TARGET PROTEIN. VGAM host target protein is therefore outlined by a broken line.

It is appreciated that VGAM1202 host target gene, herein designated VGAM HOST TARGET GENE, in fact represents a plurality of VGAM1202 host target genes. The mRNA of each one of this plurality of VGAM1202 host target genes comprises one or more host target binding sites, each having a nucleotide sequence which is at least partly complementary to VGAM1202 RNA, herein designated VGAM RNA, and which when bound by VGAM1202 RNA causes inhibition of translation of respective one or more VGAM1202 host target proteins.

It is further appreciated by one skilled in the art that the mode of translational inhibition illustrated by FIG. 1 with specific reference to translational inhibition exerted by VGAM1202 gene, herein designated VGAM GENE, on one or more VGAM1202 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1202 is inhibition of expression of host target genes, as part of a novel viral mechanism of attacking a host. Accordingly, utilities of VGAM1202 include diagnosis, prevention and treatment of viral infection by Avian Nephritis Virus. Specific functions, and accordingly utilities, of VGAM1202 correlate with, and may be deduced from, the identity of the host target genes which VGAM1202 binds and inhibits, and the function of these host target genes, as elaborated hereinbelow.

Nucleotide sequences of the VGAM1202 precursor RNA, herein designated VGAM PRECURSOR RNA, and of the 'diced' VGAM1202 RNA, herein designated VGAM RNA, and a schematic representation of the secondary folding of VGAM1202 folded precursor RNA, herein designated VGAM FOLDED PRECURSOR RNA, of VGAM1202 are further described hereinbelow with reference to Table 1.

Nucleotide sequences of host target binding sites, such as BINDING SITE-I, BINDING SITE-II and BINDING SITE-III of FIG. 1, found on VGAM1202 host target RNA, and schematic representation of the complementarity of each of these host target binding sites to VGAM1202 RNA, herein designated VGAM RNA, are described hereinbelow with reference to Table 2.

As mentioned hereinabove with reference to FIG. 1, a function of VGAM1202 gene, herein designated VGAM is inhibition of expression of VGAM1202 target genes. It is appreciated that specific functions, and accordingly utilities, of VGAM1202 correlate with, and may be deduced from, the identity of the target genes which VGAM1202 binds and inhibits, and the function of these target genes, as elaborated hereinbelow.

Phosphoribosyl Pyrophosphate Synthetase 1 (PRPS1, Accession NM_002764) is a VGAM1202 host target gene. PRPS1 BINDING SITE is HOST TARGET binding site found in the 3' untranslated region of mRNA encoded by PRPS1, corresponding to a HOST TARGET binding site such as BINDING SITE I, BINDING SITE II or BINDING SITE III. Table 2 illustrates the complementarity of the nucleotide sequences of PRPS1 BINDING SITE, designated SEQ ID:8653, to the nucleotide sequence of VGAM1202 RNA, herein designated VGAM RNA, also designated SEQ ID:3913.

A function of VGAM1202 is therefore inhibition of Phosphoribosyl Pyrophosphate Synthetase 1 (PRPS1, Accession NM_002764). Accordingly, utilities of VGAM1202 include diagnosis, prevention and treatment of diseases and clinical conditions associated with PRPS1. KIAA0237 (Accession NM_014747) is another VGAM1202 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16450, to the nucleotide sequence of VGAM1202 RNA, herein designated VGAM RNA, also designated SEQ ID:3913.

Another function of VGAM1202 is therefore inhibition of KIAA0237 (Accession NM_014747). Accordingly, utilities of VGAM1202 include diagnosis, prevention and treatment of diseases and clinical conditions associated with KIAA0237. FIG. 1 further provides a conceptual description of a novel bioinformatically detected viral gene of the present invention, referred to here as Viral Genomic Address Messenger 1203 (VGAM1203) viral gene, which modulates expression of respective viral target genes thereof, the function and utility of which host target genes is known in the art.

VGAM1203 is a novel bioinformatically detected regulatory, non protein coding, viral micro RNA (miRNA) gene. The method by which VGAM1203 was detected is described hereinabove with reference to FIGS. 1-8.

VGAM1203 gene, herein designated VGAM GENE, is a viral gene contained in the genome of Scallion Virus X. VGAM1203 host target gene, herein designated VGAM HOST TARGET GENE, is a human gene contained in the human genome.

VGAM1203 gene encodes a VGAM1203 precursor RNA, herein designated VGAM PRECURSOR RNA. Similar to other miRNA genes, and unlike most ordinary genes, VGAM1203 precursor RNA does not encode a protein. A nucleotide sequence identical or highly similar to the nucleotide sequence of VGAM1203 precursor RNA is designated SEQ ID:1189, and is provided hereinbelow with reference to the sequence listing part. Nucleotide sequence SEQ ID:1189 is located at position 2316 relative to the genome of Scallion Virus X.

VGAM1203 precursor RNA folds onto itself, forming VGAM1203 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1203 folded precursor RNA into VGAM1203 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1203 RNA is designated SEQ ID:3914, and is provided hereinbelow with reference to the sequence listing part.

VGAM1203 host target gene, herein designated VGAM HOST TARGET GENE, encodes a corresponding messenger RNA, VGAM1203 host target RNA, herein designated VGAM HOST TARGET RNA. VGAM1203 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1203 RNA, herein designated VGAM RNA, binds complementarily to one or more host target binding sites located in untranslated regions of VGAM1203 host target RNA, herein designated VGAM HOST TARGET RNA. This complementary binding is due to the fact that the nucleotide sequence of VGAM1203 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1203 RNA, herein designated VGAM RNA, may have a different number of host target binding sites in untranslated regions of a VGAM1203 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1203 RNA, herein designated VGAM RNA, to host target binding sites on VGAM1203 host target RNA, herein designated VGAM HOST TARGET RNA, such as BINDING SITE I, BINDING SITE II and BINDING SITE III, inhibits translation of VGAM1203 host target RNA into VGAM1203 host target protein, herein designated VGAM HOST TARGET PROTEIN. VGAM host target protein is therefore outlined by a broken line.

It is appreciated that VGAM1203 host target gene, herein designated VGAM HOST TARGET GENE, in fact represents a plurality of VGAM1203 host target genes. The mRNA of each one of this plurality of VGAM1203 host target genes comprises one or more host target binding sites, each having a nucleotide sequence which is at least partly complementary to VGAM1203 RNA, herein designated VGAM RNA, and which when bound by VGAM1203 RNA causes inhibition of translation of respective one or more VGAM1203 host target proteins.

It is further appreciated by one skilled in the art that the mode of translational inhibition illustrated by FIG. 1 with specific reference to translational inhibition exerted by VGAM1203 gene, herein designated VGAM GENE, on one or more VGAM1203 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1203 is inhibition of expression of host target genes, as part of a novel viral mechanism of attacking a host. Accordingly, utilities of VGAM1203 include diagnosis, prevention and treatment of viral infection by Scallion Virus X. Specific functions, and accordingly utilities, of VGAM1203 correlate with, and may be deduced from, the identity of the host target genes which VGAM1203 binds and inhibits, and the function of these host target genes, as elaborated hereinbelow.

Nucleotide sequences of the VGAM1203 precursor RNA, herein designated VGAM PRECURSOR RNA, and of the 'diced' VGAM1203 RNA, herein designated VGAM RNA, and a schematic representation of the secondary folding of VGAM1203 folded precursor RNA, herein designated VGAM FOLDED PRECURSOR RNA, of VGAM1203 are further described hereinbelow with reference to Table 1.

Nucleotide sequences of host target binding sites, such as BINDING SITE-I, BINDING SITE-II and BINDING SITE-III of FIG. 1, found on VGAM1203 host target RNA, and schematic representation of the complementarity of each of these host target binding sites to VGAM1203 RNA, herein designated VGAM RNA, are described hereinbelow with reference to Table 2.

As mentioned hereinabove with reference to FIG. 1, a function of VGAM1203 gene, herein designated VGAM is inhibition of expression of VGAM1203 target genes. It is appreciated that specific functions, and accordingly utilities, of VGAM1203 correlate with, and may be deduced from, the identity of the target genes which VGAM1203 binds and inhibits, and the function of these target genes, as elaborated hereinbelow.

LOC149296 (Accession XM_086481) is a VGAM1203 host target gene. LOC149296 BINDING SITE is HOST TARGET binding site found in the 5' untranslated region of mRNA encoded by LOC149296, corresponding to a HOST TARGET binding site such as BINDING SITE I, BINDING SITE II or BINDING SITE III. Table 2 illustrates the complementarity of the nucleotide sequences of LOC149296 BINDING SITE, designated SEQ ID:38694, to the nucleotide sequence of VGAM1203 RNA, herein designated VGAM RNA, also designated SEQ ID:3914.

A function of VGAM1203 is therefore inhibition of LOC149296 (Accession XM_086481). Accordingly, utilities of VGAM1203 include diagnosis, prevention and treatment of diseases and clinical conditions associated with LOC149296. LOC149721 (Accession XM_086649) is another VGAM1203 host target gene. LOC149721 BINDING SITE is HOST TARGET binding site found in the 3' untranslated region of mRNA encoded by LOC149721, corresponding to a HOST TARGET binding site such as BINDING SITE I, BINDING SITE II or BINDING SITE III. Table 2 illustrates the complementarity of the nucleotide sequences of LOC149721 BINDING SITE, designated SEQ ID:38810, to the nucleotide sequence of VGAM1203 RNA, herein designated VGAM RNA, also designated SEQ ID:3914.

Another function of VGAM1203 is therefore inhibition of LOC149721 (Accession XM_086649). Accordingly, utilities of VGAM1203 include diagnosis, prevention and treatment of diseases and clinical conditions associated with LOC149721. LOC153338 (Accession XM_098361) is another VGAM1203 host target gene. LOC153338 BINDING SITE is HOST TARGET binding site found in the 5' untranslated region of mRNA encoded by LOC153338, corresponding to a HOST TARGET binding site such as BINDING SITE I, BINDING SITE II or BINDING SITE III. Table 2 illustrates the complementarity of the nucleotide sequences of LOC153338 BINDING SITE, designated SEQ ID:41611, to the nucleotide sequence of VGAM1203 RNA, herein designated VGAM RNA, also designated SEQ ID:3914.

Another function of VGAM1203 is therefore inhibition of LOC153338 (Accession XM_098361). Accordingly, utilities of VGAM1203 include diagnosis, prevention and treatment of diseases and clinical conditions associated with LOC153338. LOC254413 (Accession XM_173141) is another VGAM1203 host target gene. LOC254413 BINDING SITE is HOST TARGET binding site found in the 5' untranslated region of mRNA encoded by LOC254413, corresponding to a HOST TARGET binding site such as BINDING SITE I, BINDING SITE II or BINDING SITE III. Table 2 illustrates the complementarity of the nucleotide sequences of LOC254413 BINDING SITE, designated SEQ ID:46400, to the nucleotide sequence of VGAM1203 RNA, herein designated VGAM RNA, also designated SEQ ID:3914.

Another function of VGAM1203 is therefore inhibition of LOC254413 (Accession XM_173141). Accordingly, utilities of VGAM1203 include diagnosis, prevention and treatment of diseases and clinical conditions associated with LOC254413. LOC254755 (Accession XM_173224) is another VGAM1203 host target gene. LOC254755 BINDING SITE is HOST TARGET binding site found in the 3' untranslated region of mRNA encoded by LOC254755, corresponding to a HOST TARGET binding site such as BINDING SITE I, BINDING SITE II or BINDING SITE III. Table 2 illustrates the complementarity of the nucleotide sequences of LOC254755 BINDING SITE, designated SEQ ID:46487, to the nucleotide sequence of VGAM1203 RNA, herein designated VGAM RNA, also designated SEQ ID:3914.

Another function of VGAM1203 is therefore inhibition of LOC254755 (Accession XM_173224). Accordingly, utilities of VGAM1203 include diagnosis, prevention and treatment of diseases and clinical conditions associated with LOC254755. FIG. 1 further provides a conceptual description of a novel bioinformatically detected viral gene of the present invention, referred to here as Viral Genomic Address Messenger 1204 (VGAM1204) viral gene, which modulates expression of respective host target genes thereof, the function and utility of which host target genes is known in the art.

VGAM1204 is a novel bioinformatically detected regulatory, non protein coding, viral micro RNA (miRNA) gene. The method by which VGAM1204 was detected is described hereinabove with reference to FIGS. 1-8.

VGAM1204 gene, herein designated VGAM GENE, is a viral gene contained in the genome of Scallion Virus X. VGAM1204 host target gene, herein designated VGAM HOST TARGET GENE, is a human gene contained in the human genome.

VGAM1204 gene encodes a VGAM1204 precursor RNA, herein designated VGAM PRECURSOR RNA. Similar to other miRNA genes, and unlike most ordinary genes, VGAM1204 precursor RNA does not encode a protein. A nucleotide sequence identical or highly similar to the nucleotide sequence of VGAM1204 precursor RNA is designated SEQ ID:1190, and is provided hereinbelow with reference to the sequence listing part. Nucleotide sequence SEQ ID:1190 is located at position 3095 relative to the genome of Scallion Virus X.

VGAM1204 precursor RNA folds onto itself, forming VGAM1204 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1204 folded precursor RNA into VGAM1204 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1204 RNA is designated SEQ ID:3915, and is provided hereinbelow with reference to the sequence listing part.

VGAM1204 host target gene, herein designated VGAM HOST TARGET GENE, encodes a corresponding messenger RNA, VGAM1204 host target RNA, herein designated VGAM HOST TARGET RNA. VGAM1204 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1204 RNA, herein designated VGAM RNA, binds complementarily to one or more host target binding sites located in untranslated regions of VGAM1204 host target RNA, herein designated VGAM HOST TARGET RNA. This complementary binding is due to the fact that the nucleotide sequence of VGAM1204 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1204 RNA, herein designated VGAM RNA, may have a different number of host target binding sites in untranslated regions of a VGAM1204 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1204 RNA, herein designated VGAM RNA, to host target binding sites on VGAM1204 host target RNA, herein designated VGAM HOST TARGET RNA, such as BINDING SITE I, BINDING SITE II and BINDING SITE III, inhibits translation of VGAM1204 host target RNA into VGAM1204 host target protein, herein designated VGAM HOST TARGET PROTEIN. VGAM host target protein is therefore outlined by a broken line.

It is appreciated that VGAM1204 host target gene, herein designated VGAM HOST TARGET GENE, in fact represents a plurality of VGAM1204 host target genes. The mRNA of each one of this plurality of VGAM1204 host target genes comprises one or more host target binding sites, each having a nucleotide sequence which is at least partly complementary to VGAM1204 RNA, herein designated VGAM RNA, and which when bound by VGAM1204 RNA causes inhibition of translation of respective one or more VGAM1204 host target proteins.

It is further appreciated by one skilled in the art that the mode of translational inhibition illustrated by FIG. 1 with specific reference to translational inhibition exerted by VGAM1204 gene, herein designated VGAM GENE, on one or more VGAM1204 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1204 is inhibition of expression of host target genes, as part of a novel viral mechanism of attacking a host. Accordingly, utilities of VGAM1204 include diagnosis, prevention and treatment of viral infection by Scallion Virus X. Specific functions, and accordingly utilities, of VGAM1204 correlate with, and may be deduced from, the identity of the host target genes which VGAM1204 binds and inhibits, and the function of these host target genes, as elaborated hereinbelow.

Nucleotide sequences of the VGAM1204 precursor RNA, herein designated VGAM PRECURSOR RNA, and of the 'diced' VGAM1204 RNA, herein designated VGAM RNA, and a schematic representation of the secondary folding of VGAM1204 folded precursor RNA, herein designated VGAM FOLDED PRECURSOR RNA, of VGAM1204 are further described hereinbelow with reference to Table 1.

Nucleotide sequences of host target binding sites, such as BINDING SITE-I, BINDING SITE-II and BINDING SITE-III of FIG. 1, found on VGAM1204 host target RNA, and schematic representation of the complementarity of each of these host target binding sites to VGAM1204 RNA, herein designated VGAM RNA, are described hereinbelow with reference to Table 2.

As mentioned hereinabove with reference to FIG. 1, a function of VGAM1204 gene, herein designated VGAM is inhibition of expression of VGAM1204 target genes. It is appreciated that specific functions, and accordingly utilities, of VGAM1204 correlate with, and may be deduced from, the identity of the target genes which VGAM1204 binds and inhibits, and the function of these target genes, as elaborated hereinbelow.

Cytochrome P450, Subfamily XXIV (vitamin D 24-hydroxylase) (CYP24, Accession NM_000782) is a VGAM1204 host target gene. CYP24 BINDING SITE is HOST TARGET binding site found in the 5' untranslated region of mRNA encoded by CYP24, corresponding to a HOST TARGET binding site such as BINDING SITE I, BINDING SITE II or BINDING SITE III. Table 2 illustrates the complementarity of the nucleotide sequences of CYP24 BINDING SITE, designated SEQ ID:6424, to the nucleotide sequence of VGAM1204 RNA, herein designated VGAM RNA, also designated SEQ ID:3915.

A function of VGAM1204 is therefore inhibition of Cytochrome P450, Subfamily XXIV (vitamin D 24-hydroxylase) (CYP24, Accession NM_000782), a gene which induces the differentiation of promyelocytes into monocytes/macrophages. Accordingly, utilities of VGAM1204 include diagnosis, prevention and treatment of diseases and clinical conditions associated with CYP24. The function of CYP24 has been established by previous studies. 1,25-Dihydroxyvitamin D3, the physiologically active form of vitamin D3, exerts its functions through a receptor-mediated mechanism (OMIM Ref. No. 277440). In addition to its fundamental role in calcium metabolism, 1,25-(OH)2D3 acts on a variety of tissues. One of its most important functions is its differentiating activity. The best-characterized incidence of this activity is induction of differentiation of promyelocytes into monocytes/macrophages. 1,25-(OH)2D3 is biologically inactivated through a series of reactions beginning with 24-hydroxylation. 1,25-(OH)2D3 induces the 24-hydroxylase, whereas hypocalcemia, through increased parathyroid hormone, suppresses this enzyme. Chen et al. (1993) isolated the cDNA encoding the human 24-hydroxylase, sequenced it, and demonstrated that it is active when expressed in genetic expression systems. Using array comparative genomic hybridization (CGH), Albertson et al. (2000) resolved 2 regions of amplification within an approximately 2-Mb region of recurrent aberration at 20q13.2 in breast cancer (OMIM Ref. No. 114480). The putative oncogene ZNF217 (OMIM Ref. No. 602967) mapped to one peak, and CYP24, whose overexpression is likely to lead to abrogation of growth control mediated by vitamin D, mapped to the other. Fine mapping demonstrated that ZNF217 lies proximal to CYP24. As transcription of CYP24 is closely coupled to the level and activity of the vitamin D receptor (VDR; 601769), Albertson et al. (2000) measured both CYP24 and VDR transcript levels using quantitative PCR in breast tumors. Expression of CYP24, normalized with respect to VDR, correlated with copy number of CYP24 in the tumors, further supporting an oncogenic role for CYP24.

Full details of the abovementioned studies are described in the following publications, the disclosure of which are hereby incorporated by reference:

Chen, K.-S.; Prahl, J. M.; DeLuca, H. F.: Isolation and expression of human 1,25-dihydroxyvitamin D3 24-hydroxylase cDNA. Proc. Nat. Acad. Sci. 90:4543-4547, 1993; and Albertson, D. G.; Ylstra, B.; Segraves, R.; Collins, C.; Dairkee, S. H.; Kowbel, D.; Kuo, W.-L.; Gray, J. W.; Pinkel, D.: Quantitative mapping of amplicon structure by array CGH identi.

Further studies establishing the function and utilities of CYP24 are found in John Hopkins OMIM database record ID 126065, and in sited publications numbered 4359-4364 listed in the bibliography section hereinbelow, which are also hereby incorporated by reference. Eukaryotic Translation Initiation Factor 2C, 1 (EIF2C1, Accession NM_012199) is another VGAM1204 host target gene. EIF2C1 BINDING SITE is HOST TARGET binding site found in the 3' untranslated region of mRNA encoded by EIF2C1, corresponding to a HOST TARGET binding site such as BINDING SITE I, BINDING SITE II or BINDING SITE III. Table 2 illustrates the complementarity of the nucleotide sequences of EIF2C1 BINDING SITE, designated SEQ ID:14504, to the nucleotide sequence of VGAM1204 RNA, herein designated VGAM RNA, also designated SEQ ID:3915.

Another function of VGAM1204 is therefore inhibition of Eukaryotic Translation Initiation Factor 2C, 1 (EIF2C1, Accession NM_012199), a gene which plays an important role in the eukaryotic peptide chain initiation process. Accordingly, utilities of VGAM1204 include diagnosis, prevention and treatment of diseases and clinical conditions associated with EIF2C1. The function of EIF2C1 and its association with various diseases and clinical conditions, has been established by previous studies, as described hereinabove with reference to VGAM118. Enhancer of Zeste Homolog 1 (Drosophila) (EZH1, Accession NM_001991) is another VGAM1204 host target gene. EZH1 BINDING SITE is HOST TARGET binding site found in the 3' untranslated region of mRNA encoded by EZH1, corresponding to a HOST TARGET binding site such as BINDING SITE I, BINDING SITE II or BINDING SITE III. Table 2 illustrates the complementarity of the nucleotide sequences of EZH1 BINDING SITE, designated SEQ ID:7717, to the nucleotide sequence of VGAM1204 RNA, herein designated VGAM RNA, also designated SEQ ID:3915.

Another function of VGAM1204 is therefore inhibition of Enhancer of Zeste Homolog 1 (Drosophila) (EZH1, Accession NM_001991), a gene which may act in transcriptional regulation and heterochromatin maintenance. Accordingly, utilities of VGAM1204 include diagnosis, prevention and treatment of diseases and clinical conditions associated with EZH1. The function of EZH1 and its association with various diseases and clinical conditions, has been established by previous studies, as described hereinabove with reference to VGAM251. Glutaredoxin (thioltransferase) (GLRX, Accession NM_002064) is another VGAM1204 host target gene. GLRX BINDING SITE is HOST TARGET binding site found in the 3' untranslated region of mRNA encoded by GLRX, corresponding to a HOST TARGET binding site such as BINDING SITE I, BINDING SITE II or BINDING SITE III. Table 2 illustrates the complementarity of the nucleotide sequences of GLRX BINDING SITE, designated SEQ ID:7831, to the nucleotide sequence of VGAM1204 RNA, herein designated VGAM RNA, also designated SEQ ID:3915.

Another function of VGAM1204 is therefore inhibition of Glutaredoxin (thioltransferase) (GLRX, Accession NM_002064), a gene which has a glutathione-disulfide oxidoreductase activity and reduces low molecular weight disulfides and proteins. Accordingly, utilities of VGAM1204 include diagnosis, prevention and treatment of diseases and clinical conditions associated with GLRX. The function of GLRX has been established by previous studies. Glutaredoxin is a glutathione (GSH)-dependent hydrogen donor for ribonucleotide reductase and also catalyzes glutathione-disulfide oxidoreduction reactions in the presence of NADPH and glutathione reductase. Padilla et al. (1995) purified a human placental glutaredoxin to homogeneity and showed that its amino acid sequence was similar to that of other known mammalian glutaredoxins (about 80% identity), with some important differences. A cDNA that encodes the entire GRX open reading frame (ORF) and flanking sequences was isolated from a human spleen cDNA library. Glutaredoxin is a small protein of 12 kD. Raghavachari et al. (2001) investigated how the expression of thioltransferase (TTase), a critical thiol repair and dethiolating enzyme, is regulated in human lens epithelial cells under oxidative stress. They also examined whether depleting the primary cellular antioxidant glutathione in these cells has any influence on TTase expression under the same conditions. They found a transient increase in TTase mRNA after 5 minutes of H(2)O(2) treatment. Upregulation reached a maximum of 80% above normal by 10 minutes and gradually decreased as the cells detoxified the oxidant. They found that manipulation of cellular GSH resulted in minimal changes in TTase expression. When cells depleted of GSH were subjected to oxidative stress, TTase expression was also strongly upregulated. Raghavachari et al. (2001) concluded that the upregulation of TTase expression in lens epithelial cells could be an adaptive response of the cells to combat oxidative stress and restore the vital functions of lens proteins and enzymes. They found that such regulation was independent of cellular GSH concentration.

Full details of the abovementioned studies are described in the following publications, the disclosure of which are hereby incorporated by reference:

Padilla, C. A.; Martinez-Galisteo, E.; Barcena, J. A.; Spyrou, G.; Holmgren, A.: Purification from placenta, amino acid sequence, structure comparisons and cDNA cloning of human glutaredoxin. Europ. J. Biochem. 227:27-34, 1995; and Raghavachari, N.; Krysan, K.; Xing K.; Lou, M. F.: Regulation of thioltransferase expression in human lens epithelial cells. Invest. Ophthal. Vis. Sci. 42:1002-1008, 2001.

Further studies establishing the function and utilities of GLRX are found in John Hopkins OMIM database record ID 600443, and in sited publications numbered 10219-10221 listed in the bibliography section hereinbelow, which are also hereby incorporated by reference. Lectin, Galactoside-binding, Soluble, 3 Binding Protein (LGALS3BP, Accession XM_045104) is another VGAM1204 host target gene. LGALS3BP BINDING SITE is HOST TARGET binding site found in the 3' untranslated region of mRNA encoded by LGALS3BP, corresponding to a HOST TARGET binding site such as BINDING SITE I, BINDING SITE II or BINDING SITE III. Table 2 illustrates the complementarity of the nucleotide sequences of LGALS3BP BINDING SITE, designated SEQ ID:34357, to the nucleotide sequence of VGAM1204 RNA, herein designated VGAM RNA, also designated SEQ ID:3915.

Another function of VGAM1204 is therefore inhibition of Lectin, Galactoside-binding, Soluble, 3 Binding Protein (LGALS3BP, Accession XM_045104). Accordingly, utilities of VGAM1204 include diagnosis, prevention and treatment of diseases and clinical conditions associated with LGALS3BP. Nuclear Receptor Subfamily 4, Group A, Member 1 (NR4A1, Accession NM_002135) is another VGAM1204 host target gene. NR4A1 BINDING SITE is HOST TARGET binding site found in the 5' untranslated region of mRNA encoded by NR4A1, corresponding to a HOST TARGET binding site such as BINDING SITE I, BINDING SITE II or BINDING SITE III. Table 2 illustrates the complementarity of the nucleotide sequences of NR4A1 BINDING SITE, designated SEQ ID:7912, to the nucleotide sequence of VGAM1204 RNA, herein designated VGAM RNA, also designated SEQ ID:3915.

Another function of VGAM1204 is therefore inhibition of Nuclear Receptor Subfamily 4, Group A, Member 1 (NR4A1, Accession NM_002135), a gene which is a member of steroid receptor family and binds DNA. Accordingly, utilities of VGAM1204 include diagnosis, prevention and treatment of diseases and clinical conditions associated with NR4A1. The function of NR4A1 and its association with various diseases and clinical conditions, has been established by previous studies, as described hereinabove with reference to VGAM897. Proprotein Convertase Subtilisin/kexin Type 2 (PCSK2, Accession NM_002594) is another VGAM1204 host target gene. PCSK2 BINDING SITE is HOST TARGET binding site found in the 3' untranslated region of mRNA encoded by PCSK2, corresponding to a HOST TARGET binding site such as BINDING SITE I, BINDING SITE II or BINDING SITE III. Table 2 illustrates the complementarity of the nucleotide sequences of PCSK2 BINDING SITE, designated SEQ ID:8459, to the nucleotide sequence of VGAM1204 RNA, herein designated VGAM RNA, also designated SEQ ID:3915.

Another function of VGAM1204 is therefore inhibition of Proprotein Convertase Subtilisin/kexin Type 2 (PCSK2, Accession NM_002594), a gene which is involved in the processing of hormone and other protein precursors at sites comprised of pairs of basic amino acid residues. Accordingly, utilities of VGAM1204 include diagnosis, prevention and treatment of diseases and clinical conditions associated with PCSK2. The function of PCSK2 and its association with various diseases and clinical conditions, has been established by previous studies, as described hereinabove with reference to VGAM1120. Regulatory Factor X, 1 (influences HLA class II expression) (RFX1, Accession NM_002918) is another VGAM1204 host target gene. RFX1 BINDING SITE is HOST TARGET binding site found in the 3' untranslated region of mRNA encoded by RFX1, corresponding to a HOST TARGET binding site such as BINDING SITE I, BINDING SITE II or BINDING SITE III. Table 2 illustrates the complementarity of the nucleotide sequences of RFX1 BINDING SITE, designated SEQ ID:8822, to the nucleotide sequence of VGAM1204 RNA, herein designated VGAM RNA, also designated SEQ ID:3915.

Another function of VGAM1204 is therefore inhibition of Regulatory Factor X, 1 (influences HLA class II expression) (RFX1, Accession NM_002918), a gene which regulates mhc class ii gene expression and also binds to an inverted repeat (enh1) required for hepatitis b virus genes expression. Accordingly, utilities of VGAM1204 include diagnosis, prevention and treatment of diseases and clinical conditions associated with RFX1. The function of RFX1 has been established by previous studies. The RFX1 gene product is a transactivator of the human hepatitis B viral enhancer I. Reith et al. (1994) commented that the RFX family members, particularly RFX1 and RFX3 (OMIM Ref. No. 601337), constitute the nuclear complexes referred to previously as enhancer factor C (EF-C), EP, and methylation-dependent DNA-binding protein (MDBP), or rpL30-alpha. Reith et al. (1994) identified and cloned 3 members of this gene family from both human and mouse using lambda gt11 cDNA libraries. Homology between the 3 RFX proteins is restricted largely to 5 conserved regions, including the 2 domains required for DNA binding and dimerization. Reith et al. (1994) found that RFX1, RFX2 (OMIM Ref. No. 142765), and RFX3 have similar DNA-binding specificities. The RFX monomers can heterodimerize both in vivo and in vitro, but all 3 are capable of binding DNA as monomers. They showed that the RFX1 transcript is expressed in many mouse tissues. Emery et al. (1996) reviewed RFX1, RFX5, and other members of the RFX family of DNA binding proteins.

Full details of the abovementioned studies are described in the following publications, the disclosure of which are hereby incorporated by reference:

Reith, W.; Ucla, C.; Barras, E.; Gaud, A.; Durand, B.; Herrero-Sanchez, C.; Kobr, M.; Mach, B.: RFX1, a transactivator of hepatitis B virus enhancer I, belongs to a novel family of homodimeric and heterodimeric DNA-binding proteins. Molec. Cell. Biol. 14:1230-1244, 1994; and Emery, P.; Durand, B.; Mach, B.; Reith, W.: RFX proteins, a novel family of DNA binding proteins conserved in the eukaryotic kingdom. Nucleic Acids Res. 24: 803-807, 1996.

Further studies establishing the function and utilities of RFX1 are found in John Hopkins OMIM database record ID 600006, and in sited publications numbered 4745, 8320, 977 and 8318 listed in the bibliography section hereinbelow, which are also hereby incorporated by reference. Sarcosine Dehydrogenase (SARDH, Accession NM_007101) is another VGAM1204 host target gene. SARDH BINDING SITE is HOST TARGET binding site found in the 5' untranslated region of mRNA encoded by SARDH, corresponding to a HOST TARGET binding site such as BINDING SITE I, BINDING SITE II or BINDING SITE III. Table 2 illustrates the complementarity of the nucleotide sequences of SARDH BINDING SITE, designated SEQ ID:13961, to the nucleotide sequence of VGAM1204 RNA, herein designated VGAM RNA, also designated SEQ ID:3915.

Another function of VGAM1204 is therefore inhibition of Sarcosine Dehydrogenase (SARDH, Accession NM_007101), a gene which oxidatively degrades choline to glycine. Accordingly, utilities of VGAM1204 include diagnosis, prevention and treatment of diseases and clinical conditions associated with SARDH. The function of SARDH has been established by previous studies. Sarcosine dehydrogenase (SARDH; EC 1.5.99.1) is a liver mitochondrial matrix flavoenzyme that catalyzes the oxidative demethylation of sarcosine. SARDH is defective in patients with sarcosinemia (OMIM Ref. No. 268900). By homology searching, Eschenbrenner and Jorns (1999) identified a partial human infant brain SARDH cDNA. Using this partial cDNA, they isolated a full-length human liver cDNA. The predicted 918-amino acid SARDH protein contains a putative 22-amino acid mitochondrial targeting sequence, an ADP-binding site, and a stretch of 12 amino acids that matches the covalent flavin-containing peptide from rat liver Sardh. Human SARDH shares 89% amino acid sequence identity with rat liver Sardh and 34% identity with rat liver dimethylglycine dehydrogenase. Northern blot analysis of various human adult and fetal tissues detected a 4-kb SARDH transcript at high levels in adult and fetal liver and at lower levels in adult pancreas and kidney and fetal kidney. The SARDH gene spans at least 75.3 kb and contains 21 exons. The authors identified cDNAs corresponding to alternatively spliced and polyadenylated SARDH transcripts. Eschenbrenner and Jorns (1999) identified 3 genomic sequences from 9q34 that contain the SARDH gene. The localization of the human SARDH gene to 9q34 is consistent with genetic studies using a mouse model for sarcosinemia that mapped the mouse Sardh gene to a region of chromosome 2 that shows homology of synteny with human 9q33-q34 (Harding et al., 1992; Brunialti et al., 1996).

Full details of the abovementioned studies are described in the following publications, the disclosure of which are hereby incorporated by reference:

Brunialti, A. L. B.; Harding, C. O.; Wolff, J. A.; Guenet, J.-L.: The mouse mutation sarcosinemia (sar) maps to chromosome 2 in a region homologous to human 9q33-q34. Genomics 36:182-184, 1996; and Eschenbrenner, M.; Jorns, M. S.: Cloning and mapping of the cDNA for human sarcosine dehydrogenase, a flavoenzyme defective in patients with sarcosinemia. Genomics 59:300-308, 1999.

Further studies establishing the function and utilities of SARDH are found in John Hopkins OMIM database record ID 604455, and in sited publications numbered 9177-4765 listed in the bibliography section hereinbelow, which are also hereby incorporated by reference. TOX (Accession NM_014729) is another VGAM1204 host target gene. TOX BINDING SITE is HOST TARGET binding site found in the 3' untranslated region of mRNA encoded by TOX, corresponding to a HOST TARGET binding site such as BINDING SITE I, BINDING SITE II or BINDING SITE III. Table 2 illustrates the complementarity of the nucleotide sequences of TOX BINDING SITE, designated SEQ ID:16327, to the nucleotide sequence of VGAM1204 RNA, herein designated VGAM RNA, also designated SEQ ID:3915.

Another function of VGAM1204 is therefore inhibition of TOX (Accession NM_014729). Accordingly, utilities of VGAM1204 include diagnosis, prevention and treatment of diseases and clinical conditions associated with TOX. Zinc Finger Protein 278 (ZNF278, Accession NM_032050) is another VGAM1204 host target gene. ZNF278 BINDING SITE1 through ZNF278 BINDING SITE3 are HOST TARGET binding sites found in untranslated regions of mRNA encoded by ZNF278, corresponding to HOST TARGET binding sites such as BINDING SITE I, BINDING SITE II or BINDING SITE III. Table 2 illustrates the complementarity of the nucleotide sequences of ZNF278 BINDING SITE1 through ZNF278 BINDING SITE3, designated SEQ ID:25776, SEQ ID:25786 and SEQ ID:15627 respectively, to the nucleotide sequence of VGAM1204 RNA, herein designated VGAM RNA, also designated SEQ ID:3915.

Another function of VGAM1204 is therefore inhibition of Zinc Finger Protein 278 (ZNF278, Accession NM_032050), a gene which represses basal transcription as well as RNF4-mediated activation. Accordingly, utilities of VGAM1204 include diagnosis, prevention and treatment of diseases and clinical conditions associated with ZNF278. The function of ZNF278 and its association with various diseases and clinical conditions, has been established by previous studies, as described hereinabove with reference to VGAM414. Chromosome 11 Open Reading Frame 21 (C11orf21, Accession NM_014144) is another VGAM1204 host target gene. C11orf21 BINDING SITE is HOST TARGET binding site found in the 5' untranslated region of mRNA encoded by C11orf21, corresponding to a HOST TARGET binding site such as BINDING SITE I, BINDING SITE II or BINDING SITE III. Table 2 illustrates the complementarity of the nucleotide sequences of C11orf21 BINDING SITE, designated SEQ ID:15427, to the nucleotide sequence of VGAM1204 RNA, herein designated VGAM RNA, also designated SEQ ID:3915.

Another function of VGAM1204 is therefore inhibition of Chromosome 11 Open Reading Frame 21 (C11orf21, Accession NM_014144). Accordingly, utilities of VGAM1204 include diagnosis, prevention and treatment of diseases and clinical conditions associated with C11orf21. Chromosome 11 Open Reading Frame 25 (C11orf25, Accession NM_031418) is another VGAM1204 host target gene. C11orf25 BINDING SITE is HOST TARGET binding site found in the 5' untranslated region of mRNA encoded by C11orf25, corresponding to a HOST TARGET binding site such as BINDING SITE I, BINDING SITE II or BINDING SITE III. Table 2 illustrates the complementarity of the nucleotide sequences of C11orf25 BINDING SITE, designated SEQ ID:25399, to the nucleotide sequence of VGAM1204 RNA, herein designated VGAM RNA, also designated SEQ ID:3915.

Another function of VGAM1204 is therefore inhibition of Chromosome 11 Open Reading Frame 25 (C11orf25, Accession NM_031418). Accordingly, utilities of VGAM1204 include diagnosis, prevention and treatment of diseases and clinical conditions associated with C11orf25. DKFZp434J0226 (Accession XM_051327) is another VGAM1204 host target gene. DKFZp434J0226 BINDING SITE is HOST TARGET binding site found in the 5' untranslated region of mRNA encoded by DKFZp434J0226, corresponding to a HOST TARGET binding site such as BINDING SITE I, BINDING SITE II or BINDING SITE III. Table 2 illustrates the complementarity of the nucleotide sequences of DKFZp434J0226 BINDING SITE, designated SEQ ID:35806, to the nucleotide sequence of VGAM1204 RNA, herein designated VGAM RNA, also designated SEQ ID:3915.

Another function of VGAM1204 is therefore inhibition of DKFZp434J0226 (Accession XM_051327). Accordingly, utilities of VGAM1204 include diagnosis, prevention and treatment of diseases and clinical conditions associated with DKFZp434J0226. FLJ11753 (Accession NM_024659) is another VGAM1204 host target gene. FLJ11753 BINDING SITE is HOST TARGET binding site found in the 3' untranslated region of mRNA encoded by FLJ11753, corresponding to a HOST TARGET binding site such as BINDING SITE I, BINDING SITE II or BINDING SITE III. Table 2 illustrates the complementarity of the nucleotide sequences of FLJ11753 BINDING SITE, designated SEQ ID:23963, to the nucleotide sequence of VGAM1204 RNA, herein designated VGAM RNA, also designated SEQ ID:3915.

Another function of VGAM1204 is therefore inhibition of FLJ11753 (Accession NM_024659). Accordingly, utilities of VGAM1204 include diagnosis, prevention and treatment of diseases and clinical conditions associated with FLJ11753. GW112 (Accession NM_006418) is another VGAM1204 host target gene. GW112 BINDING SITE is HOST TARGET binding site found in the 3' untranslated region of mRNA encoded by GW112, corresponding to a HOST TARGET binding site such as BINDING SITE I, BINDING SITE II or BINDING SITE III. Table 2 illustrates the complementarity of the nucleotide sequences of GW112 BINDING SITE, designated SEQ ID:13129, to the nucleotide sequence of VGAM1204 RNA, herein designated VGAM RNA, also designated SEQ ID:3915.

Another function of VGAM1204 is therefore inhibition of GW112 (Accession NM_006418). Accordingly, utilities of VGAM1204 include diagnosis, prevention and treatment of diseases and clinical conditions associated with GW112. KIAA1644 (Accession XM_097892) is another VGAM1204 host target gene. KIAA1644 BINDING SITE is HOST TARGET binding site found in the 3' untranslated region of mRNA encoded by KIAA1644, corresponding to a HOST TARGET binding site such as BINDING SITE I, BINDING SITE II or BINDING SITE III. Table 2 illustrates the complementarity of the nucleotide sequences of KIAA1644 BINDING SITE, designated SEQ ID:41203, to the nucleotide sequence of VGAM1204 RNA, herein designated VGAM RNA, also designated SEQ ID:3915.

Another function of VGAM1204 is therefore inhibition of KIAA1644 (Accession XM_097892). Accordingly, utilities of VGAM1204 include diagnosis, prevention and treatment of diseases and clinical conditions associated with KIAA1644. MGC20235 (Accession NM_145041) is another VGAM1204 host target gene. MGC20235 BINDING SITE is HOST TARGET binding site found in the 3' untranslated region of mRNA encoded by MGC20235, corresponding to a HOST TARGET binding site such as BINDING SITE I, BINDING SITE II or BINDING SITE III. Table 2 illustrates the complementarity of the nucleotide sequences of MGC20235 BINDING SITE, designated SEQ ID:29671, to the nucleotide sequence of VGAM1204 RNA, herein designated VGAM RNA, also designated SEQ ID:3915.

Another function of VGAM1204 is therefore inhibition of MGC20235 (Accession NM_145041). Accordingly, utilities of VGAM1204 include diagnosis, prevention and treatment of diseases and clinical conditions associated with MGC20235. Serine Threonine Kinase 39 (STE20/SPS1 homolog, yeast) (STK39, Accession NM_013233) is another VGAM1204 host target gene. STK39 BINDING SITE is HOST TARGET binding site found in the 3' untranslated region of mRNA encoded by STK39, corresponding to a HOST TARGET binding site such as BINDING SITE I, BINDING SITE II or BINDING SITE III. Table 2 illustrates the complementarity of the nucleotide sequences of STK39 BINDING SITE, designated SEQ ID:14895, to the nucleotide sequence of VGAM1204 RNA, herein designated VGAM RNA, also designated SEQ ID:3915.

Another function of VGAM1204 is therefore inhibition of Serine Threonine Kinase 39 (STE20/SPS1 homolog, yeast) (STK39, Accession NM_013233). Accordingly, utilities of VGAM1204 include diagnosis, prevention and treatment of diseases and clinical conditions associated with STK39. LOC146146 (Accession XM_085343) is another VGAM1204 host target gene. LOC146146 BINDING SITE is HOST TARGET binding site found in the 5' untranslated region of mRNA encoded by LOC146146, corresponding to a HOST TARGET binding site such as BINDING SITE I, BINDING SITE II or BINDING SITE III. Table 2 illustrates the complementarity of the nucleotide sequences of LOC146146 BINDING SITE, designated SEQ ID:38074, to the nucleotide sequence of VGAM1204 RNA, herein designated VGAM RNA, also designated SEQ ID:3915.

Another function of VGAM1204 is therefore inhibition of LOC146146 (Accession XM_085343). Accordingly, utilities of VGAM1204 include diagnosis, prevention and treatment of diseases and clinical conditions associated with LOC146146. LOC149448 (Accession XM_097642) is another VGAM1204 host target gene. LOC149448 BINDING SITE is HOST TARGET binding site found in the 3' untranslated region of mRNA encoded by LOC149448, corresponding to a HOST TARGET binding site such as BINDING SITE I, BINDING SITE II or BINDING SITE III. Table 2 illustrates the complementarity of the nucleotide sequences of LOC149448 BINDING SITE, designated SEQ ID:40990, to the nucleotide sequence of VGAM1204 RNA, herein designated VGAM RNA, also designated SEQ ID:3915.

Another function of VGAM1204 is therefore inhibition of LOC149448 (Accession XM_097642). Accordingly, utilities of VGAM1204 include diagnosis, prevention and treatment of diseases and clinical conditions associated with LOC149448. LOC169693 (Accession XM_108998) is another VGAM1204 host target gene. LOC169693 BINDING SITE is HOST TARGET binding site found in the 3' untranslated region of mRNA encoded by LOC169693, corresponding to a HOST TARGET binding site such as BINDING SITE I, BINDING SITE II or BINDING SITE III. Table 2 illustrates the complementarity of the nucleotide sequences of LOC169693 BINDING SITE, designated SEQ ID:42207, to the nucleotide sequence of VGAM1204 RNA, herein designated VGAM RNA, also designated SEQ ID:3915.

Another function of VGAM1204 is therefore inhibition of LOC169693 (Accession XM_108998). Accordingly, utilities of VGAM1204 include diagnosis, prevention and treatment of diseases and clinical conditions associated with LOC169693. FIG. 1 further provides a conceptual description of a novel bioinformatically detected viral gene of the present invention, referred to here as Viral Genomic Address Messenger 1205 (VGAM1205) viral gene, which modulates expression of respective host target genes thereof, the function and utility of which host target genes is known in the art.

VGAM1205 is a novel bioinformatically detected regulatory, non protein coding, viral micro RNA (miRNA) gene.

The method by which VGAM1205 was detected is described hereinabove with reference to FIGS. 1-8.

VGAM1205 gene, herein designated VGAM GENE, is a viral gene contained in the genome of Scallion Virus X. VGAM1205 host target gene, herein designated VGAM HOST TARGET GENE, is a human gene contained in the human genome.

VGAM1205 gene encodes a VGAM1205 precursor RNA, herein designated VGAM PRECURSOR RNA. Similar to other miRNA genes, and unlike most ordinary genes, VGAM1205 precursor RNA does not encode a protein. A nucleotide sequence identical or highly similar to the nucleotide sequence of VGAM1205 precursor RNA is designated SEQ ID:1191, and is provided hereinbelow with reference to the sequence listing part. Nucleotide sequence SEQ ID:1191 is located at position 2547 relative to the genome of Scallion Virus X.

VGAM1205 precursor RNA folds onto itself, forming VGAM1205 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1205 folded precursor RNA into VGAM1205 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM1205 RNA is designated SEQ ID:3916, and is provided hereinbelow with reference to the sequence listing part.

VGAM1205 host target gene, herein designated VGAM HOST TARGET GENE, encodes a corresponding messenger RNA, VGAM1205 host target RNA, herein designated VGAM HOST TARGET RNA. VGAM1205 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1205 RNA, herein designated VGAM RNA, binds complementarily to one or more host target binding sites located in untranslated regions of VGAM1205 host target RNA, herein designated VGAM HOST TARGET RNA. This complementary binding is due to the fact that the nucleotide sequence of VGAM1205 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1205 RNA, herein designated VGAM RNA, may have a different number of host target binding sites in untranslated regions of a VGAM1205 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1205 RNA, herein designated VGAM RNA, to host target binding sites on VGAM1205 host target RNA, herein designated VGAM HOST TARGET RNA, such as BINDING SITE I, BINDING SITE II and BINDING SITE III, inhibits translation of VGAM1205 host target RNA into VGAM1205 host target protein, herein designated VGAM HOST TARGET PROTEIN. VGAM host target protein is therefore outlined by a broken line.

It is appreciated that VGAM1205 host target gene, herein designated VGAM HOST TARGET GENE, in fact represents a plurality of VGAM1205 host target genes. The mRNA of each one of this plurality of VGAM1205 host target genes comprises one or more host target binding sites, each having a nucleotide sequence which is at least partly complementary to VGAM1205 RNA, herein designated VGAM RNA, and which when bound by VGAM1205 RNA causes inhibition of translation of respective one or more VGAM1205 host target proteins.

It is further appreciated by one skilled in the art that the mode of translational inhibition illustrated by FIG. 1 with specific reference to translational inhibition exerted by VGAM1205 gene, herein designated VGAM GENE, on one or more VGAM1205 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1205 is inhibition of expression of host target genes, as part of a novel viral mechanism of attacking a host. Accordingly, utilities of VGAM1205 include diagnosis, prevention and treatment of viral infection by Scallion Virus X. Specific functions, and accordingly utilities, of VGAM1205 correlate with, and may be deduced from, the identity of the host target genes which VGAM1205 binds and inhibits, and the function of these host target genes, as elaborated hereinbelow.

Nucleotide sequences of the VGAM1205 precursor RNA, herein designated VGAM PRECURSOR RNA, and of the 'diced' VGAM1205 RNA, herein designated VGAM RNA, and a schematic representation of the secondary folding of VGAM1205 folded precursor RNA, herein designated VGAM FOLDED PRECURSOR RNA, of VGAM1205 are further described hereinbelow with reference to Table 1.

Nucleotide sequences of host target binding sites, such as BINDING SITE-I, BINDING SITE-II and BINDING SITE-III of FIG. 1, found on VGAM1205 host target RNA, and schematic representation of the complementarity of each of these host target binding sites to VGAM1205 RNA, herein designated VGAM RNA, are described hereinbelow with reference to Table 2.

As mentioned hereinabove with reference to FIG. 1, a function of VGAM1205 gene, herein designated VGAM is inhibition of expression of VGAM1205 target genes. It is appreciated that specific functions, and accordingly utilities, of VGAM1205 correlate with, and may be deduced from, the identity of the target genes which VGAM1205 binds and inhibits, and the function of these target genes, as elaborated hereinbelow.

Aminomethyltransferase (glycine cleavage system protein T) (AMT, Accession NM_000481) is a VGAM1205 host target gene. AMT BINDING SITE is HOST TARGET binding site found in the 3' untranslated region of mRNA encoded by AMT, corresponding to a HOST TARGET binding site such as BINDING SITE I, BINDING SITE II or BINDING SITE III. Table 2 illustrates the complementarity of the nucleotide sequences of AMT BINDING SITE, designated SEQ ID:6090, to the nucleotide sequence of VGAM1205 RNA, herein designated VGAM RNA, also designated SEQ ID:3916.

A function of VGAM1205 is therefore inhibition of Aminomethyltransferase (glycine cleavage system protein T) (AMT, Accession NM_000481). Accordingly, utilities of VGAM1205 include diagnosis, prevention and treatment of diseases and clinical conditions associated with AMT. Development and Differentiation Enhancing Factor 2 (DDEF2, Accession NM_003887) is another VGAM1205 host target gene. DDEF2 BINDING SITE is HOST TARGET binding site found in the 3' untranslated region of mRNA encoded by DDEF2, corresponding to a HOST TARGET binding site such as BINDING SITE I, BINDING SITE II or BINDING SITE III. Table 2 illustrates the complementarity of the nucleotide sequences of DDEF2 BINDING SITE, designated SEQ ID:9969, to the nucleotide sequence of VGAM1205 RNA, herein designated VGAM RNA, also designated SEQ ID:3916.

Another function of VGAM1205 is therefore inhibition of Development and Differentiation Enhancing Factor 2 (DDEF2, Accession NM_003887), a gene which interacts with members of the Arf and Src family. Accordingly, utilities of VGAM1205 include diagnosis, prevention and treatment of diseases and clinical conditions associated with DDEF2. The function of DDEF2 and its association with various diseases and clinical conditions, has been established by previous studies, as described hereinabove with reference to VGAM464. GNAS Complex Locus (GNAS, Accession NM_016592) is another VGAM1205 host target gene. GNAS BINDING SITE is HOST TARGET binding site found in the 3' untranslated region of mRNA encoded by GNAS, corresponding to a HOST TARGET binding site such as BINDING SITE I, BINDING SITE II or BINDING SITE III. Table 2 illustrates the complementarity of the nucleotide sequences of GNAS BINDING SITE, designated SEQ ID:18677, to the nucleotide sequence of VGAM1205 RNA, herein designated VGAM RNA, also designated SEQ ID:3916.

Another function of VGAM1205 is therefore inhibition of GNAS Complex Locus (GNAS, Accession NM_016592), a gene which transduces signals from G protein-coupled receptors and activates adenylyl cyclase. Accordingly, utilities of VGAM1205 include diagnosis, prevention and treatment of diseases and clinical conditions associated with GNAS. The function of GNAS has been established by previous studies. Because obesity is frequently associated with GS deficiency and GS is part of the pathway transducing the lipolytic signal through beta-adrenergic receptors, Carel et al. (1999) tested whether epinephrine resistance was part of the spectrum of hormonal resistance in patients with GS deficiency. Carel et al. (1999) measured glycerol flux, using a nonradioactive tracer dilution approach, to analyze the lipolytic response to epinephrine in 6 patients with GS deficiency and PTH resistance and compared it in 6 age-matched normal controls and 9 massively obese children. Basal glycerol production was reduced by 50%, and lipolytic response to epinephrine was reduced by 67% in GS-deficient children, as compared with controls. The degree of impairment of lipolysis was similar in GS-deficient children who were only moderately overweight and in morbidly obese children. Animal model experiments lend further support to the function of GNAS. Yu et al. (1998) generated mice with a null allele of the Gnas gene. Homozygous Gs deficiency was embryonically lethal. Heterozygotes with maternal (m-/+) and paternal (+/p-) inheritance of the Gnas null allele had distinct phenotypes, suggesting that Gnas is an imprinted gene. Parathyroid hormone (PTH) resistance is present in m-/+ but not +/p- mice. Expression of the alpha subunit in the renal cortex (the site of PTH action) was markedly reduced in m-/+ but not in +/p- mice, demonstrating that the Gnas paternal allele is imprinted in this tissue. Gnas was also imprinted in brown and white adipose tissue. The maximal physiologic response to vasopressin (urinary concentrating ability) was normal in both m-/+ and +/p- mice and Gnas was not imprinted in the renal inner medulla, the site of vasopressin action. Tissue-specific imprinting of Gnas was likely the mechanism for variable and tissue-specific hormone resistance in the knockout mice and a similar mechanism might explain the variable phenotype in AHO.

It is appreciated that the abovementioned animal model for GNAS is acknowledged by those skilled in the art as a scientifically valid animal model, as can be further appreciated from the publications sited hereinbelow.

Full details of the abovementioned studies are described in the following publications, the disclosure of which are hereby incorporated by reference:

Carel, J. C.; Le Stunff, C.; Condamine, L.; Mallet, E.; Chaussain, J. L.; Adnot, P.; Garabedian, M.; Bougneres, P.: Resistance to the lipolytic action of epinephrine: a new feature of protein GS deficiency. J. Clin. Endocr. Metab. 84:4127-4131, 1999; and Yu, S.; Yu, D.; Lee, E.; Eckhaus, M.; Lee, R.; Corria, Z.; Accili, D.; Westphal, H.; Weinstein, L. S.: Variable and tissue-specific hormone resistance in heterotrimeric Gs protein a.

Further studies establishing the function and utilities of GNAS are found in John Hopkins OMIM database record ID 139320, and in sited publications numbered 11941-11951, 4744, 11952-11957, 12197-12200, 11463, 1394-1393, 1395-1402, 1407-1406, 1408-1415, 1466-1469, 27, 1470-1490, 2301-10 and 28 listed in the bibliography section hereinbelow, which are also hereby incorporated by reference. Hairless Homolog (mouse) (HR, Accession NM_005144) is another VGAM1205 host target gene. HR BINDING SITE is HOST TARGET binding site found in the 3' untranslated region of mRNA encoded by HR, corresponding to a HOST TARGET binding site such as BINDING SITE I, BINDING SITE II or BINDING SITE III. Table 2 illustrates the complementarity of the nucleotide sequences of HR BINDING SITE, designated SEQ ID:11615, to the nucleotide sequence of VGAM1205 RNA, herein designated VGAM RNA, also designated SEQ ID:3916.

Another function of VGAM1205 is therefore inhibition of Hairless Homolog (mouse) (HR, Accession NM_005144). Accordingly, utilities of VGAM1205 include diagnosis, prevention and treatment of diseases and clinical conditions associated with HR. Piccolo (presynaptic cytomatrix protein) (PCLO, Accession XM_168530) is another VGAM1205 host target gene. PCLO BINDING SITE is HOST TARGET binding site found in the 3' untranslated region of mRNA encoded by PCLO, corresponding to a HOST TARGET binding site such as BINDING SITE I, BINDING SITE II or BINDING SITE III. Table 2 illustrates the complementarity of the nucleotide sequences of PCLO BINDING SITE, designated SEQ ID:45211, to the nucleotide sequence of VGAM1205 RNA, herein designated VGAM RNA, also designated SEQ ID:3916.

Another function of VGAM1205 is therefore inhibition of Piccolo (presynaptic cytomatrix protein) (PCLO, Accession XM_168530), a gene which involves in the cycling of synaptic vesicles. Accordingly, utilities of VGAM1205 include diagnosis, prevention and treatment of diseases and clinical conditions associated with PCLO. The function of PCLO and its association with various diseases and clinical conditions, has been established by previous studies, as described hereinabove with reference to VGAM71. Protein Tyrosine Phosphatase, Receptor Type, A (PTPRA, Accession NM_002836) is another VGAM1205 host target gene. PTPRA BINDING SITE is HOST TARGET binding site found in the 5' untranslated region of mRNA encoded by PTPRA, corresponding to a HOST TARGET binding site such as BINDING SITE I, BINDING SITE II or BINDING SITE III. Table 2 illustrates the complementarity of the nucleotide sequences of PTPRA BINDING SITE, designated SEQ ID:8716, to the nucleotide sequence of VGAM1205 RNA, herein designated VGAM RNA, also designated SEQ ID:3916.

Another function of VGAM1205 is therefore inhibition of Protein Tyrosine Phosphatase, Receptor Type, A (PTPRA, Accession NM_002836), a gene which is the human homolog of the murine PTPase. Accordingly, utilities of VGAM1205 include diagnosis, prevention and treatment of diseases and clinical conditions associated with PTPRA. The function of PTPRA has been established by previous studies. Vital cellular functions such as cell proliferation and signal transduction are regulated in part by the balance between the activities of protein-tyrosine kinases (PTK) and protein-tyrosine phosphatases (OMIM Ref. No. PTPase). Oncogenesis can result from an imbalance. There are 2 classes of PTPase molecules: low molecular weight proteins with a single conserved phosphatase domain such as T-cell protein-tyrosine phosphatase (PTPT; 176887), and high molecular weight receptor-linked PTPases with 2 tandemly repeated conserved domains separated by 56 to 57 amino acids. Examples of the latter group include leukocyte-common antigen (PTPRC; 151460) and leukocyte antigen related tyrosine phosphatase (PTPRF; 179590). Matthews et al. (1990) cloned the human homolog of the murine PTPase termed LRP by them. Its cDNA sequence predicted a protein of 793 amino acids with an unglycosylated molecular mass of 87,500 kD Matthews et al. (1990). The protein contains a 121-residue extracellular domain, a single transmembrane segment, and 2 tandem intracytoplasmic catalytic domains. By study of rodent-human somatic cell hybrids, Jirik et al. (1990) localized PTPA/LRP to chromosome 20p13. Other family members located on chromosome 20 include SRC (OMIM Ref. No. 190090), HCK (OMIM Ref. No. 142370), and PTP1B (OMIM Ref. No. 176885). The LRP protein is ubiquitously expressed and thus likely plays a fundamental role in the physiology of all cells. With a leukocyte common antigen (LCA) probe, Kaplan et al. (1990) sequenced cDNA encoding the alpha enzyme isolated from a human brain stem cDNA library under conditions of reduced hybridization stringency. LRP encodes an 802-amino acid polypeptide. Kaplan et al. (1990) localized the RPTPase-alpha gene to human chromosome 20pter-20q12 by analysis of its segregation pattern in rodent-human somatic cell hybrids. Rao et al. (1992) regionalized the assignment of PTPA to the distal portion of 20p (20pter-p12) by both radioactive and fluorescence in situ hybridization. By in situ hybridization, Jirik et al. (1992) localized the PTPA gene to 20p13. With the mapping of PAX1 167411 to mouse chromosome 2, Schnittger et al. (1992) found that the homolog of PTPA is also located on mouse chromosome 2, which confirms the exceptional homology between human chromosome 20 and the distal segment of mouse chromosome 2.

Full details of the abovementioned studies are described in the following publications, the disclosure of which are hereby incorporated by reference:

Matthews, R. J.; Cahir, E. D.; Thomas, M. L.: Identification of an additional member of the protein-tyrosine-phosphatase family: evidence for alternative splicing in the tyrosine phosphatase domain. Proc. Nat. Acad. Sci. 87:4444-4448, 1990; and Schnittger, S.; Rao, V. V. N. G.; Deutsch, U.; Gruss, P.; Balling, R.; Hansmann, I.: PAX1, a member of the paired box-containing class of developmental control genes, is mapped to human ch.

Further studies establishing the function and utilities of PTPRA are found in John Hopkins OMIM database record ID 176884, and in sited publications numbered 10891-10892, 1089 and 10893-10895 listed in the bibliography section hereinbelow, which are also hereby incorporated by reference. Transforming Growth Factor, Beta Receptor III (betaglycan, 300 kDa) (TGFBR3, Accession NM_003243) is another VGAM1205 host target gene. TGFBR3 BINDING SITE is HOST TARGET binding site found in the 3' untranslated region of mRNA encoded by TGFBR3, corresponding to a HOST TARGET binding site such as BINDING SITE I, BINDING SITE II or BINDING SITE III. Table 2 illustrates the complementarity of the nucleotide sequences of TGFBR3 BINDING SITE, designated SEQ ID:9247, to the nucleotide sequence of VGAM1205 RNA, herein designated VGAM RNA, also designated SEQ ID:3916.

Another function of VGAM1205 is therefore inhibition of Transforming Growth Factor, Beta Receptor III (betaglycan, 300 kDa) (TGFBR3, Accession NM_003243), a gene which involves in capturing and retaining TGF-beta for presentation to the signaling receptors. Accordingly, utilities of VGAM1205 include diagnosis, prevention and treatment of diseases and clinical conditions associated with TGFBR3. The function of TGFBR3 and its association with various diseases and clinical conditions, has been established by previous studies, as described hereinabove with reference to VGAM139. Tumor Necrosis Factor Receptor Superfamily, Member 8 (TNFRSF8, Accession NM_001243) is another VGAM1205 host target gene. TNFRSF8 BINDING SITE is HOST TARGET binding site found in the 3' untranslated region of mRNA encoded by TNFRSF8, corresponding to a HOST TARGET binding site such as BINDING SITE I, BINDING SITE II or BINDING SITE III. Table 2 illustrates the complementarity of the nucleotide sequences of TNFRSF8 BINDING SITE, designated SEQ ID:6908, to the nucleotide sequence of VGAM1205 RNA, herein designated VGAM RNA, also designated SEQ ID:3916.

Another function of VGAM1205 is therefore inhibition of Tumor Necrosis Factor Receptor Superfamily, Member 8 (TNFRSF8, Accession NM_001243), a gene which regulates gene expression through activation of nf-kappab. Accordingly, utilities of VGAM1205 include diagnosis, prevention and treatment of diseases and clinical conditions associated with TNFRSF8. The function of TNFRSF8 and its association with various diseases and clinical conditions, has been established by previous studies, as described hereinabove with reference to VGAM154. Wolf-Hirschhorn Syndrome Candidate 1 (WHSC1, Accession NM_014919) is another VGAM1205 host target gene. WHSC1 BINDING SITE1 through WHSC1 BINDING SITE4 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE4, designated SEQ ID:17188, SEQ ID:28469, SEQ ID:28477 and SEQ ID:28452 respectively, to the nucleotide sequence of VGAM1205 RNA, herein designated VGAM RNA, also designated SEQ ID:3916.

Another function of VGAM1205 is therefore inhibition of Wolf-Hirschhorn Syndrome Candidate 1 (WHSC1, Accession NM_014919), a gene which binds covalently to and repairs g/t mismatches. Accordingly, utilities of VGAM1205 include diagnosis, prevention and treatment of diseases and clinical conditions associated with WHSC1. The function of WHSC1 and its association with various diseases and clinical conditions, has been established by previous studies, as described hereinabove with reference to VGAM200. CLIPR-59 (Accession NM_015526) is another VGAM1205 host target gene. CLIPR-59 BINDING SITE is HOST TARGET binding site found in the 3' untranslated region of mRNA encoded by CLIPR-59, corresponding to a HOST TARGET binding site such as BINDING SITE I, BINDING SITE II or BINDING SITE III. Table 2 illustrates the complementarity of the nucleotide sequences of CLIPR-59 BINDING SITE, designated SEQ ID:17789, to the nucleotide sequence of VGAM1205 RNA, herein designated VGAM RNA, also designated SEQ ID:3916.

Another function of VGAM1205 is therefore inhibition of CLIPR-59 (Accession NM_015526). Accordingly, utilities of VGAM1205 include diagnosis, prevention and treatment of diseases and clinical conditions associated with CLIPR-59. DEAD/H (Asp-Glu-Ala-Asp/His) Box Polypeptide 17, 72 kDa (DDX17, Accession NM_030881) is another VGAM1205 host target gene. DDX17 BINDING SITE is HOST TARGET binding site found in the 5' untranslated region of mRNA encoded by DDX17, corresponding to a HOST TARGET binding site such as BINDING SITE I, BINDING SITE II or BINDING SITE III. Table 2 illustrates the complementarity of the nucleotide sequences of DDX17 BINDING SITE, designated SEQ ID:25157, to the nucleotide sequence of VGAM1205 RNA, herein designated VGAM RNA, also designated SEQ ID:3916.

Another function of VGAM1205 is therefore inhibition of DEAD/H (Asp-Glu-Ala-Asp/His) Box Polypeptide 17, 72 kDa (DDX17, Accession NM_030881). Accordingly, utilities of VGAM1205 include diagnosis, prevention and treatment of diseases and clinical conditions associated with DDX17. FLJ20452 (Accession NM_017828) is another VGAM1205 host target gene. FLJ20452 BINDING SITE is HOST TARGET binding site found in the 3' untranslated region of mRNA encoded by FLJ20452, corresponding to a HOST TARGET binding site such as BINDING SITE I, BINDING SITE II or BINDING SITE III. Table 2 illustrates the complementarity of the nucleotide sequences of FLJ20452 BINDING SITE, designated SEQ ID:19491, to the nucleotide sequence of VGAM1205 RNA, herein designated VGAM RNA, also designated SEQ ID:3916.

Another function of VGAM1205 is therefore inhibition of FLJ20452 (Accession NM_017828). Accordingly, utilities of VGAM1205 include diagnosis, prevention and treatment of diseases and clinical conditions associated with FLJ20452. FLJ32865 (Accession NM_144613) is another VGAM1205 host target gene. FLJ32865 BINDING SITE is HOST TARGET binding site found in the 3' untranslated region of mRNA encoded by FLJ32865, corresponding to a HOST TARGET binding site such as BINDING SITE I, BINDING SITE II or BINDING SITE III. Table 2 illustrates the complementarity of the nucleotide sequences of FLJ32865 BINDING SITE, designated SEQ ID:29432, to the nucleotide sequence of VGAM1205 RNA, herein designated VGAM RNA, also designated SEQ ID:3916.

Another function of VGAM1205 is therefore inhibition of FLJ32865 (Accession NM_144613). Accordingly, utilities of VGAM1205 include diagnosis, prevention and treatment of diseases and clinical conditions associated with FLJ32865. KIAA0630 (Accession XM_114729) is another VGAM1205 host target gene. KIAA0630 BINDING SITE is HOST TARGET binding site found in the 3' untranslated region of mRNA encoded by KIAA0630, corresponding to a HOST TARGET binding site such as BINDING SITE I, BINDING SITE II or BINDING SITE III. Table 2 illustrates the complementarity of the nucleotide sequences of KIAA0630 BINDING SITE, designated SEQ ID:43063, to the nucleotide sequence of VGAM1205 RNA, herein designated VGAM RNA, also designated SEQ ID:3916.

Another function of VGAM1205 is therefore inhibition of KIAA0630 (Accession XM_114729). Accordingly, utilities of VGAM1205 include diagnosis, prevention and treatment of diseases and clinical conditions associated with KIAA0630. KIAA1029 (Accession NM_007286) is another VGAM1205 host target gene. KIAA1029 BINDING SITE is HOST TARGET binding site found in the 5' untranslated region of mRNA encoded by KIAA1029, corresponding to a HOST TARGET binding site such as BINDING SITE I, BINDING SITE II or BINDING SITE III. Table 2 illustrates the complementarity of the nucleotide sequences of KIAA1029 BINDING SITE, designated SEQ ID:14146, to the nucleotide sequence of VGAM1205 RNA, herein designated VGAM RNA, also designated SEQ ID:3916.

Another function of VGAM1205 is therefore inhibition of KIAA1029 (Accession NM_007286). Accordingly, utilities of VGAM1205 include diagnosis, prevention and treatment of diseases and clinical conditions associated with KIAA1029. MGC10870 (Accession NM_032301) is another VGAM1205 host target gene. MGC10870 BINDING SITE is HOST TARGET binding site found in the 5' untranslated region of mRNA encoded by MGC10870, corresponding to a HOST TARGET binding site such as BINDING SITE I, BINDING SITE II or BINDING SITE III. Table 2 illustrates the complementarity of the nucleotide sequences of MGC10870 BINDING SITE, designated SEQ ID:26081, to the nucleotide sequence of VGAM1205 RNA, herein designated VGAM RNA, also designated SEQ ID:3916.

Another function of VGAM1205 is therefore inhibition of MGC10870 (Accession NM_032301). Accordingly, utilities of VGAM1205 include diagnosis, prevention and treatment of diseases and clinical conditions associated with MGC10870. MGC26954 (Accession NM_145025) is another VGAM1205 host target gene. MGC26954 BINDING SITE is HOST TARGET binding site found in the 3' untranslated region of mRNA encoded by MGC26954, corresponding to a HOST TARGET binding site such as BINDING SITE I, BINDING SITE II or BINDING SITE III. Table 2 illustrates the complementarity of the nucleotide sequences of MGC26954 BINDING SITE, designated SEQ ID:29637, to the nucleotide sequence of VGAM1205 RNA, herein designated VGAM RNA, also designated SEQ ID:3916.

Another function of VGAM1205 is therefore inhibition of MGC26954 (Accession NM_145025). Accordingly, utilities of VGAM1205 include diagnosis, prevention and treatment of diseases and clinical conditions associated with MGC26954. MGC4643 (Accession NM_032715) is another VGAM1205 host target gene. MGC4643 BINDING SITE is HOST TARGET binding site found in the 3' untranslated region of mRNA encoded by MGC4643, corresponding to a HOST TARGET binding site such as BINDING SITE I, BINDING SITE II or BINDING SITE III. Table 2 illustrates the complementarity of the nucleotide sequences of MGC4643 BINDING SITE, designated SEQ ID:26443, to the nucleotide sequence of VGAM1205 RNA, herein designated VGAM RNA, also designated SEQ ID:3916.

Another function of VGAM1205 is therefore inhibition of MGC4643 (Accession NM_032715). Accordingly, utilities of VGAM1205 include diagnosis, prevention and treatment of diseases and clinical conditions associated with MGC4643. Nucleoporin 160 kDa (NUP160, Accession XM_113678) is another VGAM1205 host target gene. NUP160 BINDING SITE is HOST TARGET binding site found in the 3' untranslated region of mRNA encoded by NUP160, corresponding to a HOST TARGET binding site such as BINDING SITE I, BINDING SITE II or BINDING SITE III. Table 2 illustrates the complementarity of the nucleotide sequences of NUP160 BINDING SITE, designated SEQ ID:42329, to the nucleotide sequence of VGAM1205 RNA, herein designated VGAM RNA, also designated SEQ ID:3916.

Another function of VGAM1205 is therefore inhibition of Nucleoporin 160kDa (NUP160, Accession XM_113678). Accordingly, utilities of VGAM1205 include diagnosis, prevention and treatment of diseases and clinical conditions associated with NUP160. Protein Tyrosine Phosphatase, Non-receptor Type Substrate 1 (PTPNS1, Accession NM_080792) is another VGAM1205 host target gene. PTPNS1 BINDING SITE is HOST TARGET binding site found in the 3' untranslated region of mRNA encoded by PTPNS1, corresponding to a HOST TARGET binding site such as BINDING SITE I, BINDING SITE II or BINDING SITE III. Table 2 illustrates the complementarity of the nucleotide sequences of PTPNS1 BINDING SITE, designated SEQ ID:28058, to the nucleotide sequence of VGAM1205 RNA, herein designated VGAM RNA, also designated SEQ ID:3916.

Another function of VGAM1205 is therefore inhibition of Protein Tyrosine Phosphatase, Non-receptor Type Substrate 1 (PTPNS1, Accession NM_080792). Accordingly, utilities of VGAM1205 include diagnosis, prevention and treatment of diseases and clinical conditions associated with PTPNS1. RA-GEF-2 (Accession NM_016340) is another VGAM1205 host target gene. RA-GEF-2 BINDING SITE is HOST TARGET binding site found in the 3' untranslated region of mRNA encoded by RA-GEF-2, corresponding to a HOST TARGET binding site such as BINDING SITE I, BINDING SITE II or BINDING SITE III. Table 2 illustrates the complementarity of the nucleotide sequences of RA-GEF-2 BINDING SITE, designated SEQ ID:18467, to the nucleotide sequence of VGAM1205 RNA, herein designated VGAM RNA, also designated SEQ ID:3916.

Another function of VGAM1205 is therefore inhibition of RA-GEF-2 (Accession NM_016340). Accordingly, utilities of VGAM1205 include diagnosis, prevention and treatment of diseases and clinical conditions associated with RA-GEF-2. URG4 (Accession NM_017920) is another VGAM1205 host target gene. URG4 BINDING SITE is HOST TARGET binding site found in the 3' untranslated region of mRNA encoded by URG4, corresponding to a HOST TARGET binding site such as BINDING SITE I, BINDING SITE II or BINDING SITE III. Table 2 illustrates the complementarity of the nucleotide sequences of URG4 BINDING SITE, designated SEQ ID:19579, to the nucleotide sequence of VGAM1205 RNA, herein designated VGAM RNA, also designated SEQ ID:3916.

Another function of VGAM1205 is therefore inhibition of URG4 (Accession NM_017920). Accordingly, utilities of VGAM1205 include diagnosis, prevention and treatment of diseases and clinical conditions associated with URG4. LOC115110 (Accession XM_049825) is another VGAM1205 host target gene. LOC115110 BINDING SITE is HOST TARGET binding site found in the 3' untranslated region of mRNA encoded by LOC115110, corresponding to a HOST TARGET binding site such as BINDING SITE I, BINDING SITE II or BINDING SITE III. Table 2 illustrates the complementarity of the nucleotide sequences of LOC115110 BINDING SITE, designated SEQ ID:35505, to the nucleotide sequence of VGAM1205 RNA, herein designated VGAM RNA, also designated SEQ ID:3916.

Another function of VGAM1205 is therefore inhibition of LOC115110 (Accession XM_049825). Accordingly, utilities of VGAM1205 include diagnosis, prevention and treatment of diseases and clinical conditions associated with LOC115110. LOC147174 (Accession XM_035807) is another VGAM1205 host target gene. LOC147174 BINDING SITE is HOST TARGET binding site found in the 5' untranslated region of mRNA encoded by LOC147174, corresponding to a HOST TARGET binding site such as BINDING SITE I, BINDING SITE II or BINDING SITE III. Table 2 illustrates the complementarity of the nucleotide sequences of LOC147174 BINDING SITE, designated SEQ ID:32342, to the nucleotide sequence of VGAM1205 RNA, herein designated VGAM RNA, also designated SEQ ID:3916.

Another function of VGAM1205 is therefore inhibition of LOC147174 (Accession XM_035807). Accordingly, utilities of VGAM1205 include diagnosis, prevention and treatment of diseases and clinical conditions associated with LOC147174. LOC157376 (Accession XM_088301) is another VGAM1205 host target gene. LOC157376 BINDING SITE is HOST TARGET binding site found in the 3' untranslated region of mRNA encoded by LOC157376, corresponding to a HOST TARGET binding site such as BINDING SITE I, BINDING SITE II or BINDING SITE III. Table 2 illustrates the complementarity of the nucleotide sequences of LOC157376 BINDING SITE, designated SEQ ID:39600, to the nucleotide sequence of VGAM1205 RNA, herein designated VGAM RNA, also designated SEQ ID:3916.

Another function of VGAM1205 is therefore inhibition of LOC157376 (Accession XM_088301). Accordingly, utilities of VGAM1205 include diagnosis, prevention and treatment of diseases and clinical conditions associated with LOC157376. LOC164397 (Accession XM_092780) is another VGAM1205 host target gene. LOC164397 BINDING SITE is HOST TARGET binding site found in the 3' untranslated region of mRNA encoded by LOC164397, corresponding to a HOST TARGET binding site such as BINDING SITE I, BINDING SITE II or BINDING SITE III. Table 2 illustrates the complementarity of the nucleotide sequences of LOC164397 BINDING SITE, designated SEQ ID:40148, to the nucleotide sequence of VGAM1205 RNA, herein designated VGAM RNA, also designated SEQ ID:3916.

Another function of VGAM1205 is therefore inhibition of LOC164397 (Accession XM_092780). Accordingly, utilities of VGAM1205 include diagnosis, prevention and treatment of diseases and clinical conditions associated with LOC164397. LOC202451 (Accession XM_117401) is another VGAM1205 host target gene. LOC202451 BINDING SITE is HOST TARGET binding site found in the 5' untranslated region of mRNA encoded by LOC202451, corresponding to a HOST TARGET binding site such as BINDING SITE I, BINDING SITE II or BINDING SITE III. Table 2 illustrates the complementarity of the nucleotide sequences of LOC202451 BINDING SITE, designated SEQ ID:43435, to the nucleotide sequence of VGAM1205 RNA, herein designated VGAM RNA, also designated SEQ ID:3916.

Another function of VGAM1205 is therefore inhibition of LOC202451 (Accession XM_117401). Accordingly, utilities of VGAM1205 include diagnosis, prevention and treatment of diseases and clinical conditions associated with LOC202451. LOC220002 (Accession XM_166224) is another VGAM1205 host target gene. LOC220002 BINDING SITE is HOST TARGET binding site found in the 3' untranslated region of mRNA encoded by LOC220002, corresponding to a HOST TARGET binding site such as BINDING SITE I, BINDING SITE II or BINDING SITE III. Table 2 illustrates the complementarity of the nucleotide sequences of LOC220002 BINDING SITE, designated SEQ ID:44049, to the nucleotide sequence of VGAM1205 RNA, herein designated VGAM RNA, also designated SEQ ID:3916.

Another function of VGAM1205 is therefore inhibition of LOC220002 (Accession XM_166224). Accordingly, utilities of VGAM1205 include diagnosis, prevention and treatment of diseases and clinical conditions associated with LOC220002. LOC253292 (Accession XM_173082) is another VGAM1205 host target gene. LOC253292 BINDING SITE is HOST TARGET binding site found in the 5' untranslated region of mRNA encoded by LOC253292, corresponding to a HOST TARGET binding site such as BINDING SITE I, BINDING SITE II or BINDING SITE III. Table 2 illustrates the complementarity of the nucleotide sequences of LOC253292 BINDING SITE, designated SEQ ID:46340, to the nucleotide sequence of VGAM1205 RNA, herein designated VGAM RNA, also designated SEQ ID:3916.

Another function of VGAM1205 is therefore inhibition of LOC253292 (Accession XM_173082). Accordingly, utilities of VGAM1205 include diagnosis, prevention and treatment of diseases and clinical conditions associated with LOC253292. LOC255294 (Accession XM_170500) is another VGAM1205 host target gene. LOC255294 BINDING SITE is HOST TARGET binding site found in the 5' untranslated region of mRNA encoded by LOC255294, corresponding to a HOST TARGET binding site such as BINDING SITE I, BINDING SITE II or BINDING SITE III. Table 2 illustrates the complementarity of the nucleotide sequences of LOC255294 BINDING SITE, designated SEQ ID:45337, to the nucleotide sequence of VGAM1205 RNA, herein designated VGAM RNA, also designated SEQ ID:3916.

Another function of VGAM1205 is therefore inhibition of LOC255294 (Accession XM_170500). Accordingly, utilities of VGAM1205 include diagnosis, prevention and treatment of diseases and clinical conditions associated with LOC255294. LOC90784 (Accession XM_034109) is another VGAM1205 host target gene. LOC90784 BINDING SITE is HOST TARGET binding site found in the 5' untranslated region of mRNA encoded by LOC90784, corresponding to a HOST TARGET binding site such as BINDING SITE I, BINDING SITE II or BINDING SITE III. Table 2 illustrates the complementarity of the nucleotide sequences of LOC90784 BINDING SITE, designated SEQ ID:32001, to the nucleotide sequence of VGAM1205 RNA, herein designated VGAM RNA, also designated SEQ ID:3916.

Another function of VGAM1205 is therefore inhibition of LOC90784 (Accession XM_034109). Accordingly, utilities of VGAM1205 include diagnosis, prevention and treatment of diseases and clinical conditions associated with LOC90784. FIG. 1 further provides a conceptual description of a novel bioinformatically detected viral gene of the present invention, referred to here as Viral Genomic Address Messenger 1206 (VGAM1206) viral gene, which modulates expression of respective host target genes thereof, the function and utility of which host target genes is known in the art.

VGAM1206 is a novel bioinformatically detected regulatory, non protein coding, viral micro RNA (miRNA) gene. The method by which VGAM1206 was detected is described hereinabove with reference to FIGS. 1-8.

VGAM1206 gene, herein designated VGAM GENE, is a viral gene contained in the genome of Clover Yellow Mosaic Virus. VGAM1206 host target gene, herein designated VGAM HOST TARGET GENE, is a human gene contained in the human genome.

VGAM1206 gene encodes a VGAM1206 precursor RNA, herein designated VGAM PRECURSOR RNA. Similar to other miRNA genes, and unlike most ordinary genes, VGAM1206 precursor RNA does not encode a protein. A nucleotide sequence identical or highly similar to the nucleotide sequence of VGAM1206 precursor RNA is designated SEQ ID:1192, and is provided hereinbelow with reference to the sequence listing part. Nucleotide sequence SEQ ID:1192 is located at position 961 relative to the genome of Clover Yellow Mosaic Virus.

VGAM1206 precursor RNA folds onto itself, forming VGAM1206 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1206 folded precursor RNA into VGAM1206 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1206 RNA is designated SEQ ID:3917, and is provided hereinbelow with reference to the sequence listing part.

VGAM1206 host target gene, herein designated VGAM HOST TARGET GENE, encodes a corresponding messenger RNA, VGAM1206 host target RNA, herein designated VGAM HOST TARGET RNA. VGAM1206 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1206 RNA, herein designated VGAM RNA, binds complementarily to one or more host target binding sites located in untranslated regions of VGAM1206 host target RNA, herein designated VGAM HOST TARGET RNA. This complementary binding is due to the fact that the nucleotide sequence of VGAM1206 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1206 RNA, herein designated VGAM RNA, may have a different number of host target binding sites in untranslated regions of a VGAM1206 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1206 RNA, herein designated VGAM RNA, to host target binding sites on VGAM1206 host target RNA, herein designated VGAM HOST TARGET RNA, such as BINDING SITE I, BINDING SITE II and BINDING SITE III, inhibits translation of VGAM1206 host target RNA into VGAM1206 host target protein, herein designated VGAM HOST TARGET PROTEIN. VGAM host target protein is therefore outlined by a broken line.

It is appreciated that VGAM1206 host target gene, herein designated VGAM HOST TARGET GENE, in fact represents a plurality of VGAM1206 host target genes. The mRNA of each one of this plurality of VGAM1206 host target genes comprises one or more host target binding sites, each having a nucleotide sequence which is at least partly complementary to VGAM1206 RNA, herein designated VGAM RNA, and which when bound by VGAM1206 RNA causes inhibition of translation of respective one or more VGAM1206 host target proteins.

It is further appreciated by one skilled in the art that the mode of translational inhibition illustrated by FIG. 1 with specific reference to translational inhibition exerted by VGAM1206 gene, herein designated VGAM GENE, on one or more VGAM1206 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1206 is inhibition of expression of host target genes, as part of a novel viral mechanism of attacking a host. Accordingly, utilities of VGAM1206 include diagnosis, prevention and treatment of viral infection by Clover Yellow Mosaic Virus. Specific functions, and accordingly utilities, of VGAM1206 correlate with, and may be deduced from, the identity of the host target genes which VGAM1206 binds and inhibits, and the function of these host target genes, as elaborated hereinbelow.

Nucleotide sequences of the VGAM1206 precursor RNA, herein designated VGAM PRECURSOR RNA, and of the ‘diced’ VGAM1206 RNA, herein designated VGAM RNA, and a schematic representation of the secondary folding of VGAM1206 folded precursor RNA, herein designated VGAM FOLDED PRECURSOR RNA, of VGAM1206 are further described hereinbelow with reference to Table 1.

Nucleotide sequences of host target binding sites, such as BINDING SITE-I, BINDING SITE-II and BINDING SITE-III of FIG. 1, found on VGAM1206 host target RNA, and schematic representation of the complementarity of each of these host target binding sites to VGAM1206 RNA, herein designated VGAM RNA, are described hereinbelow with reference to Table 2.

As mentioned hereinabove with reference to FIG. 1, a function of VGAM1206 gene, herein designated VGAM is inhibition of expression of VGAM1206 target genes. It is appreciated that specific functions, and accordingly utilities, of VGAM1206 correlate with, and may be deduced from, the identity of the target genes which VGAM1206 binds and inhibits, and the function of these target genes, as elaborated hereinbelow.

Kell Blood Group Precursor (McLeod phenotype) (XK, Accession NM_021083) is a VGAM1206 host target gene. XK BINDING SITE is HOST TARGET binding site found in the 3' untranslated region of mRNA encoded by XK, corresponding to a HOST TARGET binding site such as BINDING SITE I, BINDING SITE II or BINDING SITE III. Table 2 illustrates the complementarity of the nucleotide sequences of XK BINDING SITE, designated SEQ ID:22056, to the nucleotide sequence of VGAM1206 RNA, herein designated VGAM RNA, also designated SEQ ID:3917.

A function of VGAM1206 is therefore inhibition of Kell Blood Group Precursor (McLeod phenotype) (XK, Accession NM_021083). Accordingly, utilities of VGAM1206 include diagnosis, prevention and treatment of diseases and clinical conditions associated with XK. Programmed Cell Death 7 (PDCD7, Accession XM_050977) is another VGAM1206 host target gene. PDCD7 BINDING SITE is HOST TARGET binding site found in the 3' untranslated region of mRNA encoded by PDCD7, corresponding to a HOST TARGET binding site such as BINDING SITE I, BINDING SITE II or BINDING SITE III. Table 2 illustrates the complementarity of the nucleotide sequences of PDCD7 BINDING SITE, designated SEQ ID:35695, to the nucleotide sequence of VGAM1206 RNA, herein designated VGAM RNA, also designated SEQ ID:3917.

Another function of VGAM1206 is therefore inhibition of Programmed Cell Death 7 (PDCD7, Accession XM_050977). Accordingly, utilities of VGAM1206 include diagnosis, prevention and treatment of diseases and clinical conditions associated with PDCD7. LOC255104 (Accession XM_170911) is another VGAM1206 host target gene. LOC255104 BINDING SITE is HOST TARGET binding site found in the 3' untranslated region of mRNA encoded by LOC255104, corresponding to a HOST TARGET binding site such as BINDING SITE I, BINDING SITE II or BINDING SITE III. Table 2 illustrates the complementarity of the nucleotide sequences of LOC255104 BINDING SITE, designated SEQ ID:45686, to the nucleotide sequence of VGAM1206 RNA, herein designated VGAM RNA, also designated SEQ ID:3917.

Another function of VGAM1206 is therefore inhibition of LOC255104 (Accession XM_170911). Accordingly, utilities of VGAM1206 include diagnosis, prevention and treatment of diseases and clinical conditions associated with LOC255104. FIG. 1 further provides a conceptual description of a novel bioinformatically detected viral gene of the present invention, referred to here as Viral Genomic Address Messenger 1207 (VGAM1207) viral gene, which modulates expression of respective host target genes thereof, the function and utility of which host target genes is known in the art.

VGAM1207 is a novel bioinformatically detected regulatory, non protein coding, viral micro RNA (miRNA) gene. The method by which VGAM1207 was detected is described hereinabove with reference to FIGS. 1-8.

VGAM1207 gene, herein designated VGAM GENE, is a viral gene contained in the genome of Clover Yellow Mosaic Virus. VGAM1207 host target gene, herein designated VGAM HOST TARGET GENE, is a human gene contained in the human genome.

VGAM1207 gene encodes a VGAM1207 precursor RNA, herein designated VGAM PRECURSOR RNA. Similar to other miRNA genes, and unlike most ordinary genes, VGAM1207 precursor RNA does not encode a protein. A nucleotide sequence identical or highly similar to the nucleotide sequence of VGAM1207 precursor RNA is designated SEQ ID:1193, and is provided hereinbelow with reference to the sequence listing part. Nucleotide sequence SEQ ID:1193 is located at position 3847 relative to the genome of Clover Yellow Mosaic Virus.

VGAM1207 precursor RNA folds onto itself, forming VGAM1207 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1207 folded precursor RNA into VGAM1207 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM1207 RNA is designated SEQ ID:3918, and is provided hereinbelow with reference to the sequence listing part.

VGAM1207 host target gene, herein designated VGAM HOST TARGET GENE, encodes a corresponding messenger RNA, VGAM1207 host target RNA, herein designated VGAM HOST TARGET RNA. VGAM1207 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1207 RNA, herein designated VGAM RNA, binds complementarily to one or more host target binding sites located in untranslated regions of VGAM1207 host target RNA, herein designated VGAM HOST TARGET RNA. This complementary binding is due to the fact that the nucleotide sequence of VGAM1207 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1207 RNA, herein designated VGAM RNA, may have a different number of host target binding sites in untranslated regions of a VGAM1207 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1207 RNA, herein designated VGAM RNA, to host target binding sites on VGAM1207 host target RNA, herein designated VGAM HOST TARGET RNA, such as BINDING SITE I, BINDING SITE II and BINDING SITE III, inhibits translation of VGAM1207 host target RNA into VGAM1207 host target protein, herein designated VGAM HOST TARGET PROTEIN. VGAM host target protein is therefore outlined by a broken line.

It is appreciated that VGAM1207 host target gene, herein designated VGAM HOST TARGET GENE, in fact represents a plurality of VGAM1207 host target genes. The mRNA of each one of this plurality of VGAM1207 host target genes comprises one or more host target binding sites, each having a nucleotide sequence which is at least partly complementary to VGAM1207 RNA, herein designated VGAM RNA, and which when bound by VGAM1207 RNA causes inhibition of translation of respective one or more VGAM1207 host target proteins.

It is further appreciated by one skilled in the art that the mode of translational inhibition illustrated by FIG. 1 with specific reference to translational inhibition exerted by VGAM1207 gene, herein designated VGAM GENE, on one or more VGAM1207 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1207 is inhibition of expression of host target genes, as part of a novel viral mechanism of attacking a host. Accordingly, utilities of VGAM1207 include diagnosis, prevention and treatment of viral infection by Clover Yellow Mosaic Virus. Specific functions, and accordingly utilities, of VGAM1207 correlate with, and may be deduced from, the identity of the host target genes which VGAM1207 binds and inhibits, and the function of these host target genes, as elaborated hereinbelow.

Nucleotide sequences of the VGAM1207 precursor RNA, herein designated VGAM PRECURSOR RNA, and of the 'diced' VGAM1207 RNA, herein designated VGAM RNA, and a schematic representation of the secondary folding of VGAM1207 folded precursor RNA, herein designated VGAM FOLDED PRECURSOR RNA, of VGAM1207 are further described hereinbelow with reference to Table 1.

Nucleotide sequences of host target binding sites, such as BINDING SITE-I, BINDING SITE-II and BINDING SITE-III of FIG. 1, found on VGAM1207 host target RNA, and schematic representation of the complementarity of each of these host target binding sites to VGAM1207 RNA, herein designated VGAM RNA, are described hereinbelow with reference to Table 2.

As mentioned hereinabove with reference to FIG. 1, a function of VGAM1207 gene, herein designated VGAM is inhibition of expression of VGAM1207 target genes. It is appreciated that specific functions, and accordingly utilities, of VGAM1207 correlate with, and may be deduced from, the identity of the target genes which VGAM1207 binds and inhibits, and the function of these target genes, as elaborated hereinbelow.

V-ski Sarcoma Viral Oncogene Homolog (avian) (SKI, Accession NM_003036) is a VGAM1207 host target gene. SKI BINDING SITE is HOST TARGET binding site found in the 3' untranslated region of mRNA encoded by SKI, corresponding to a HOST TARGET binding site such as BINDING SITE I, BINDING SITE II or BINDING SITE III. Table 2 illustrates the complementarity of the nucleotide sequences of SKI BINDING SITE, designated SEQ ID:8986, to the nucleotide sequence of VGAM1207 RNA, herein designated VGAM RNA, also designated SEQ ID:3918.

A function of VGAM1207 is therefore inhibition of V-ski Sarcoma Viral Oncogene Homolog (avian) (SKI, Accession NM_003036). Accordingly, utilities of VGAM1207 include diagnosis, prevention and treatment of diseases and clinical conditions associated with SKI. DKFZP434O047 (Accession NM_015594) is another VGAM1207 host target gene. DKFZP434O047 BINDING SITE is HOST TARGET binding site found in the 5' untranslated region of mRNA encoded by DKFZP434O047, corresponding to a HOST TARGET binding site such as BINDING SITE I, BINDING SITE II or BINDING SITE III. Table 2 illustrates the complementarity of the nucleotide sequences of DKFZP434O047 BINDING SITE, designated SEQ ID:17863, to the nucleotide sequence of VGAM1207 RNA, herein designated VGAM RNA, also designated SEQ ID:3918.

Another function of VGAM1207 is therefore inhibition of DKFZP434O047 (Accession NM_015594). Accordingly, utilities of VGAM1207 include diagnosis, prevention and treatment of diseases and clinical conditions associated with DKFZP434O047. DKFZP761E2110 (Accession NM_030953) is another VGAM1207 host target gene. DKFZP761E2110 BINDING SITE is HOST TARGET binding site found in the 3' untranslated region of mRNA encoded by DKFZP761E2110, corresponding to a HOST TARGET binding site such as BINDING SITE I, BINDING SITE II or BINDING SITE III. Table 2 illustrates the complementarity of the nucleotide sequences of DKFZP761E2110 BINDING SITE, designated SEQ ID:25222, to the nucleotide sequence of VGAM1207 RNA, herein designated VGAM RNA, also designated SEQ ID:3918.

Another function of VGAM1207 is therefore inhibition of DKFZP761E2110 (Accession NM_030953). Accordingly, utilities of VGAM1207 include diagnosis, prevention and treatment of diseases and clinical conditions associated with DKFZP761E2110. PRO2266 (Accession NM_018519) is another VGAM1207 host target gene. PRO2266 BINDING SITE is HOST TARGET binding site found in the 3' untranslated region of mRNA encoded by PRO2266, corresponding to a HOST TARGET binding site such as BINDING SITE I, BINDING SITE II or BINDING SITE III. Table 2 illustrates the complementarity of the nucleotide sequences of PRO2266 BINDING SITE, designated SEQ ID:20596, to the nucleotide sequence of VGAM1207 RNA, herein designated VGAM RNA, also designated SEQ ID:3918.

Another function of VGAM1207 is therefore inhibition of PRO2266 (Accession NM_018519). Accordingly, utilities of VGAM1207 include diagnosis, prevention and treatment of diseases and clinical conditions associated with PRO2266. ZAK (Accession NM_133646) is another VGAM1207 host target gene. ZAK BINDING SITE is HOST TARGET binding site found in the 3' untranslated region of mRNA encoded by ZAK, corresponding to a HOST TARGET binding site such as BINDING SITE I, BINDING SITE II or BINDING SITE III. Table 2 illustrates the complementarity of the nucleotide sequences of ZAK BINDING SITE, designated SEQ ID:28608, to the nucleotide sequence of VGAM1207 RNA, herein designated VGAM RNA, also designated SEQ ID:3918.

Another function of VGAM1207 is therefore inhibition of ZAK (Accession NM_133646). Accordingly, utilities of VGAM1207 include diagnosis, prevention and treatment of diseases and clinical conditions associated with ZAK. LOC147463 (Accession XM_085799) is another VGAM1207 host target gene. LOC147463 BINDING SITE is HOST TARGET binding site found in the 3' untranslated region of mRNA encoded by LOC147463, corresponding to a HOST TARGET binding site such as BINDING SITE I, BINDING SITE II or BINDING SITE III. Table 2 illustrates the complementarity of the nucleotide sequences of LOC147463 BINDING SITE, designated SEQ ID:38341, to the nucleotide sequence of VGAM1207 RNA, herein designated VGAM RNA, also designated SEQ ID:3918.

Another function of VGAM1207 is therefore inhibition of LOC147463 (Accession XM_085799). Accordingly, utilities of VGAM1207 include diagnosis, prevention and treatment of diseases and clinical conditions associated with LOC147463. FIG. 1 further provides a conceptual description of a novel bioinformatically detected viral gene of the present invention, referred to here as Viral Genomic Address Messenger 1208 (VGAM1208) viral gene, which modulates expression of respective host target genes thereof, the function and utility of which host target genes is known in the art.

VGAM1208 is a novel bioinformatically detected regulatory, non protein coding, viral micro RNA (miRNA) gene. The method by which VGAM1208 was detected is described hereinabove with reference to FIGS. 1-8.

VGAM1208 gene, herein designated VGAM GENE, is a viral gene contained in the genome of Clover Yellow Mosaic Virus. VGAM1208 host target gene, herein designated VGAM HOST TARGET GENE, is a human gene contained in the human genome.

VGAM1208 gene encodes a VGAM1208 precursor RNA, herein designated VGAM PRECURSOR RNA. Similar to other miRNA genes, and unlike most ordinary genes, VGAM1208 precursor RNA does not encode a protein. A nucleotide sequence identical or highly similar to the nucleotide sequence of VGAM1208 precursor RNA is designated SEQ ID:1194, and is provided hereinbelow with reference to the sequence listing part. Nucleotide sequence SEQ ID:1194 is located at position 2694 relative to the genome of Clover Yellow Mosaic Virus.

VGAM1208 precursor RNA folds onto itself, forming VGAM1208 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1208 folded precursor RNA into VGAM1208 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1208 RNA is designated SEQ ID:3919, and is provided hereinbelow with reference to the sequence listing part.

VGAM1208 host target gene, herein designated VGAM HOST TARGET GENE, encodes a corresponding messenger RNA, VGAM1208 host target RNA, herein designated VGAM HOST TARGET RNA. VGAM1208 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1208 RNA, herein designated VGAM RNA, binds complementarily to one or more host target binding sites located in untranslated regions of VGAM1208 host target RNA, herein designated VGAM HOST TARGET RNA. This complementary binding is due to the fact that the nucleotide sequence of VGAM1208 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1208 RNA, herein designated VGAM RNA, may have a different number of host target binding sites in untranslated regions of a VGAM1208 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1208 RNA, herein designated VGAM RNA, to host target binding sites on VGAM1208 host target RNA, herein designated VGAM HOST TARGET RNA, such as BINDING SITE I, BINDING SITE II and BINDING SITE III, inhibits translation of VGAM1208 host target RNA into VGAM1208 host target protein, herein designated VGAM HOST TARGET PROTEIN. VGAM host target protein is therefore outlined by a broken line.

It is appreciated that VGAM1208 host target gene, herein designated VGAM HOST TARGET GENE, in fact represents a plurality of VGAM1208 host target genes. The mRNA of each one of this plurality of VGAM1208 host target genes comprises one or more host target binding sites, each having a nucleotide sequence which is at least partly complementary to VGAM1208 RNA, herein designated VGAM RNA, and which when bound by VGAM1208 RNA causes inhibition of translation of respective one or more VGAM1208 host target proteins.

It is further appreciated by one skilled in the art that the mode of translational inhibition illustrated by FIG. 1 with specific reference to translational inhibition exerted by VGAM1208 gene, herein designated VGAM GENE, on one or more VGAM1208 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1208 is inhibition of expression of host target genes, as part of a novel viral mechanism of attacking a host. Accordingly, utilities of VGAM1208 include diagnosis, prevention and treatment of viral infection by Clover Yellow Mosaic Virus. Specific functions, and accordingly utilities, of VGAM1208 correlate with, and may be deduced from, the identity of the host target genes which VGAM1208 binds and inhibits, and the function of these host target genes, as elaborated hereinbelow.

Nucleotide sequences of the VGAM1208 precursor RNA, herein designated VGAM PRECURSOR RNA, and of the 'diced' VGAM1208 RNA, herein designated VGAM RNA, and a schematic representation of the secondary folding of VGAM1208 folded precursor RNA, herein designated VGAM FOLDED PRECURSOR RNA, of VGAM1208 are further described hereinbelow with reference to Table 1.

Nucleotide sequences of host target binding sites, such as BINDING SITE-I, BINDING SITE-II and BINDING SITE-III of FIG. 1, found on VGAM1208 host target RNA, and schematic representation of the complementarity of each of these host target binding sites to VGAM1208 RNA, herein designated VGAM RNA, are described hereinbelow with reference to Table 2.

As mentioned hereinabove with reference to FIG. 1, a function of VGAM1208 gene, herein designated VGAM is inhibition of expression of VGAM1208 target genes. It is appreciated that specific functions, and accordingly utilities, of VGAM1208 correlate with, and may be deduced from, the identity of the target genes which VGAM1208 binds and inhibits, and the function of these target genes, as elaborated hereinbelow.

BN51 (BHK21) Temperature Sensitivity Complementing (BN51T, Accession XM_113557) is a VGAM1208 host target gene. BN51T BINDING SITE is HOST TARGET binding site found in the 3' untranslated region of mRNA encoded by BN51T, corresponding to a HOST TARGET binding site such as BINDING SITE I, BINDING SITE II or BINDING SITE III. Table 2 illustrates the complementarity of the nucleotide sequences of BN51T BINDING SITE, designated SEQ ID:42282, to the nucleotide sequence of VGAM1208 RNA, herein designated VGAM RNA, also designated SEQ ID:3919.

A function of VGAM1208 is therefore inhibition of BN51 (BHK21) Temperature Sensitivity Complementing (BN51T, Accession XM_113557), a gene which complements a temperature-sensitive cell cycle mutation in BHK cells. Accordingly, utilities of VGAM1208 include diagnosis, prevention and treatment of diseases and clinical conditions associated with BN51T. The function of BN51T and its association with various diseases and clinical conditions, has been established by previous studies, as described hereinabove with reference to VGAM592. Cytoplasmic Linker Associated Protein 1 (CLASP1, Accession XM_037105) is another VGAM1208 host target gene. CLASP1 BINDING SITE is HOST TARGET binding site found in the 3' untranslated region of mRNA encoded by CLASP1, corresponding to a HOST TARGET binding site such as BINDING SITE I, BINDING SITE II or BINDING SITE III. Table 2 illustrates the complementarity of the nucleotide sequences of CLASP1 BINDING SITE, designated SEQ ID:32538, to the nucleotide sequence of VGAM1208 RNA, herein designated VGAM RNA, also designated SEQ ID:3919.

Another function of VGAM1208 is therefore inhibition of Cytoplasmic Linker Associated Protein 1 (CLASP1, Accession XM_037105), a gene which plays a role in the local regulation of microtubule dynamics. Accordingly, utilities of VGAM1208 include diagnosis, prevention and treatment of diseases and clinical conditions associated with CLASP1. The function of CLASP1 and its association with various diseases and clinical conditions, has been established by previous studies, as described hereinabove with reference to VGAM298. Integrin, Alpha 6 (ITGA6, Accession NM_000210) is another VGAM1208 host target gene. ITGA6 BINDING SITE is HOST TARGET binding site found in the 3' untranslated region of mRNA encoded by ITGA6, corresponding to a HOST TARGET binding site such as BINDING SITE I, BINDING SITE II or BINDING SITE III. Table 2 illustrates the complementarity of the nucleotide sequences of ITGA6 BINDING SITE, designated SEQ ID:5699, to the nucleotide sequence of VGAM1208 RNA, herein designated VGAM RNA, also designated SEQ ID:3919.

Another function of VGAM1208 is therefore inhibition of Integrin, Alpha 6 (ITGA6, Accession NM_000210). Accordingly, utilities of VGAM1208 include diagnosis, prevention and treatment of diseases and clinical conditions associated with ITGA6. FLJ20695 (Accession NM_017929) is another VGAM1208 host target gene. FLJ20695 BINDING SITE is HOST TARGET binding site found in the 3' untranslated region of mRNA encoded by FLJ20695, corresponding to a HOST TARGET binding site such as BINDING SITE I, BINDING SITE II or BINDING SITE III. Table 2 illustrates the complementarity of the nucleotide sequences of FLJ20695 BINDING SITE, designated SEQ ID:19611, to the nucleotide sequence of VGAM1208 RNA, herein designated VGAM RNA, also designated SEQ ID:3919.

Another function of VGAM1208 is therefore inhibition of FLJ20695 (Accession NM_017929). Accordingly, utilities of VGAM1208 include diagnosis, prevention and treatment of diseases and clinical conditions associated with FLJ20695. KIAA1023 (Accession NM_017604) is another VGAM1208 host target gene. KIAA1023 BINDING SITE is HOST TARGET binding site found in the 3' untranslated region of mRNA encoded by KIAA1023, corresponding to a HOST TARGET binding site such as BINDING SITE I, BINDING SITE II or BINDING SITE III. Table 2 illustrates the complementarity of the nucleotide sequences of KIAA1023 BINDING SITE, designated SEQ ID:19083, to the nucleotide sequence of VGAM1208 RNA, herein designated VGAM RNA, also designated SEQ ID:3919.

Another function of VGAM1208 is therefore inhibition of KIAA1023 (Accession NM_017604). Accordingly, utilities of VGAM1208 include diagnosis, prevention and treatment of diseases and clinical conditions associated with KIAA1023. LOC114971 (Accession XM_054936) is another VGAM1208 host target gene. LOC114971 BINDING SITE is HOST TARGET binding site found in the 3' untranslated region of mRNA encoded by LOC114971, corresponding to a HOST TARGET binding site such as BINDING SITE I, BINDING SITE II or BINDING SITE III. Table 2 illustrates the complementarity of the nucleotide sequences of LOC114971 BINDING SITE, designated SEQ ID:36207, to the nucleotide sequence of VGAM1208 RNA, herein designated VGAM RNA, also designated SEQ ID:3919.

Another function of VGAM1208 is therefore inhibition of LOC114971 (Accession XM_054936). Accordingly, utilities of VGAM1208 include diagnosis, prevention and treatment of diseases and clinical conditions associated with LOC114971. LOC155179 (Accession XM_088169) is another VGAM1208 host target gene. LOC155179 BINDING SITE is HOST TARGET binding site found in the 3' untranslated region of mRNA encoded by LOC155179, corresponding to a HOST TARGET binding site such as BINDING SITE I, BINDING SITE II or BINDING SITE III. Table 2 illustrates the complementarity of the nucleotide sequences of LOC155179 BINDING SITE, designated SEQ ID:39551, to the nucleotide sequence of VGAM1208 RNA, herein designated VGAM RNA, also designated SEQ ID:3919.

Another function of VGAM1208 is therefore inhibition of LOC155179 (Accession XM_088169). Accordingly, utilities of VGAM1208 include diagnosis, prevention and treatment of diseases and clinical conditions associated with LOC155179. LOC201516 (Accession XM_113974) is another VGAM1208 host target gene. LOC201516 BINDING SITE is HOST TARGET binding site found in the 5' untranslated region of mRNA encoded by LOC201516, corresponding to a HOST TARGET binding site such as BINDING SITE I, BINDING SITE II or BINDING SITE III. Table 2 illustrates the complementarity of the nucleotide sequences of LOC201516 BINDING SITE, designated SEQ ID:42580, to the nucleotide sequence of VGAM1208 RNA, herein designated VGAM RNA, also designated SEQ ID:3919.

Another function of VGAM1208 is therefore inhibition of LOC201516 (Accession XM_113974). Accordingly, utilities of VGAM1208 include diagnosis, prevention and treatment of diseases and clinical conditions associated with LOC201516. LOC222865 (Accession XM_167242) is another VGAM1208 host target gene. LOC222865 BINDING SITE is HOST TARGET binding site found in the 3' untranslated region of mRNA encoded by LOC222865, corresponding to a HOST TARGET binding site such as BINDING SITE I, BINDING SITE II or BINDING SITE III. Table 2 illustrates the complementarity of the nucleotide sequences of LOC222865 BINDING SITE, designated SEQ ID:44620, to the nucleotide sequence of VGAM1208 RNA, herein designated VGAM RNA, also designated SEQ ID:3919.

Another function of VGAM1208 is therefore inhibition of LOC222865 (Accession XM_167242). Accordingly, utilities of VGAM1208 include diagnosis, prevention and treatment of diseases and clinical conditions associated with LOC222865. LOC257464 (Accession XM_116972) is another VGAM1208 host target gene. LOC257464 BINDING SITE is HOST TARGET binding site found in the 3' untranslated region of mRNA encoded by LOC257464, corresponding to a HOST TARGET binding site such as BINDING SITE I, BINDING SITE II or BINDING SITE III. Table 2 illustrates the complementarity of the nucleotide sequences of LOC257464 BINDING SITE, designated SEQ ID:43161, to the nucleotide sequence of VGAM1208 RNA, herein designated VGAM RNA, also designated SEQ ID:3919.

Another function of VGAM1208 is therefore inhibition of LOC257464 (Accession XM_116972). Accordingly, utilities of VGAM1208 include diagnosis, prevention and treatment of diseases and clinical conditions associated with LOC257464. FIG. 1 further provides a conceptual description of a novel bioinformatically detected viral gene of the present invention, referred to here as Viral Genomic Address Messenger 1209 (VGAM1209) viral gene, which modulates expression of respective host target genes thereof, the function and utility of which host target genes is known in the art.

VGAM1209 is a novel bioinformatically detected regulatory, non protein coding, viral micro RNA (miRNA) gene. The method by which VGAM1209 was detected is described hereinabove with reference to FIGS. 1-8.

VGAM1209 gene, herein designated VGAM GENE, is a viral gene contained in the genome of Clover Yellow Mosaic Virus. VGAM1209 host target gene, herein designated VGAM HOST TARGET GENE, is a human gene contained in the human genome.

VGAM1209 gene encodes a VGAM1209 precursor RNA, herein designated VGAM PRECURSOR RNA. Similar to other miRNA genes, and unlike most ordinary genes, VGAM1209 precursor RNA does not encode a protein. A nucleotide sequence identical or highly similar to the nucleotide sequence of VGAM1209 precursor RNA is designated SEQ ID:1195, and is provided hereinbelow with reference to the sequence listing part. Nucleotide sequence SEQ ID:1195 is located at position 5426 relative to the genome of Clover Yellow Mosaic Virus.

VGAM1209 precursor RNA folds onto itself, forming VGAM1209 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1209 folded precursor RNA into VGAM1209 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM1209 RNA is designated SEQ ID:3920, and is provided hereinbelow with reference to the sequence listing part.

VGAM1209 host target gene, herein designated VGAM HOST TARGET GENE, encodes a corresponding messenger RNA, VGAM1209 host target RNA, herein designated VGAM HOST TARGET RNA. VGAM1209 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1209 RNA, herein designated VGAM RNA, binds complementarily to one or more host target binding sites located in untranslated regions of VGAM1209 host target RNA, herein designated VGAM HOST TARGET RNA. This complementary binding is due to the fact that the nucleotide sequence of VGAM1209 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1209 RNA, herein designated VGAM RNA, may have a different number of host target binding sites in untranslated regions of a VGAM1209 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1209 RNA, herein designated VGAM RNA, to host target binding sites on VGAM1209 host target RNA, herein designated VGAM HOST TARGET RNA, such as BINDING SITE I, BINDING SITE II and BINDING SITE III, inhibits translation of VGAM1209 host target RNA into VGAM1209 host target protein, herein designated VGAM HOST TARGET PROTEIN. VGAM host target protein is therefore outlined by a broken line.

It is appreciated that VGAM1209 host target gene, herein designated VGAM HOST TARGET GENE, in fact represents a plurality of VGAM1209 host target genes. The mRNA of each one of this plurality of VGAM1209 host target genes comprises one or more host target binding sites, each having a nucleotide sequence which is at least partly complementary to VGAM1209 RNA, herein designated VGAM RNA, and which when bound by VGAM1209 RNA causes inhibition of translation of respective one or more VGAM1209 host target proteins.

It is further appreciated by one skilled in the art that the mode of translational inhibition illustrated by FIG. 1 with specific reference to translational inhibition exerted by VGAM1209 gene, herein designated VGAM GENE, on one or more VGAM1209 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1209 is inhibition of expression of host target genes, as part of a novel viral mechanism of attacking a host. Accordingly, utilities of VGAM1209 include diagnosis, prevention and treatment of viral infection by Clover Yellow Mosaic Virus. Specific functions, and accordingly utilities, of VGAM1209 correlate with, and may be deduced from, the identity of the host target genes which VGAM1209 binds and inhibits, and the function of these host target genes, as elaborated hereinbelow.

Nucleotide sequences of the VGAM1209 precursor RNA, herein designated VGAM PRECURSOR RNA, and of the 'diced' VGAM1209 RNA, herein designated VGAM RNA, and a schematic representation of the secondary folding of VGAM1209 folded precursor RNA, herein designated VGAM FOLDED PRECURSOR RNA, of VGAM1209 are further described hereinbelow with reference to Table 1.

Nucleotide sequences of host target binding sites, such as BINDING SITE-I, BINDING SITE-II and BINDING SITE-III of FIG. 1, found on VGAM1209 host target RNA, and schematic representation of the complementarity of each of these host target binding sites to VGAM1209 RNA, herein designated VGAM RNA, are described hereinbelow with reference to Table 2.

As mentioned hereinabove with reference to FIG. 1, a function of VGAM1209 gene, herein designated VGAM is inhibition of expression of VGAM1209 target genes. It is appreciated that specific functions, and accordingly utilities, of VGAM1209 correlate with, and may be deduced from, the identity of the target genes which VGAM1209 binds and inhibits, and the function of these target genes, as elaborated hereinbelow.

Glutamate Receptor, Ionotropic, N-methyl D-aspartate 2A (GRIN2A, Accession NM_000833) is a VGAM1209 host target gene. GRIN2A BINDING SITE is HOST TARGET binding site found in the 3' untranslated region of mRNA encoded by GRIN2A, corresponding to a HOST TARGET binding site such as BINDING SITE I, BINDING SITE II or BINDING SITE III. Table 2 illustrates the complementarity of the nucleotide sequences of GRIN2A BINDING SITE, designated SEQ ID:6489, to the nucleotide sequence of VGAM1209 RNA, herein designated VGAM RNA, also designated SEQ ID:3920.

A function of VGAM1209 is therefore inhibition of Glutamate Receptor, Ionotropic, N-methyl D-aspartate 2A (GRIN2A, Accession NM_000833), a gene which modulates the efficiency of synaptic plasticity. Accordingly, utilities of VGAM1209 include diagnosis, prevention and treatment of diseases and clinical conditions associated with GRIN2A. The function of GRIN2A and its association with various diseases and clinical conditions, has been established by previous studies, as described hereinabove with reference to VGAM125. Transcription Factor 2, Hepatic; LF-B3; Variant Hepatic Nuclear Factor (TCF2, Accession NM_006481) is another VGAM1209 host target gene. TCF2 BINDING SITE is HOST TARGET binding site found in the 3' untranslated region of mRNA encoded by TCF2, corresponding to a HOST TARGET binding site such as BINDING SITE I, BINDING SITE II or BINDING SITE III. Table 2 illustrates the complementarity of the nucleotide sequences of TCF2 BINDING SITE, designated SEQ ID:13201, to the nucleotide sequence of VGAM1209 RNA, herein designated VGAM RNA, also designated SEQ ID:3920.

Another function of VGAM1209 is therefore inhibition of Transcription Factor 2, Hepatic; LF-B3; Variant Hepatic Nuclear Factor (TCF2, Accession NM_006481), a gene which probably binds to the inverted palindrome 5'-gttaatnattaac-3'. Accordingly, utilities of VGAM1209 include diagnosis, prevention and treatment of diseases and clinical conditions associated with TCF2. The function of TCF2 and its association with various diseases and clinical conditions, has been established by previous studies, as described hereinabove with reference to VGAM118. Tumor Protein P53 (Li-Fraumeni syndrome) (TP53, Accession NM_000546) is another VGAM1209 host target gene. TP53 BINDING SITE is HOST TARGET binding site found in the 3' untranslated region of mRNA encoded by TP53, corresponding to a HOST TARGET binding site such as BINDING SITE I, BINDING SITE II or BINDING SITE III. Table 2 illustrates the complementarity of the nucleotide sequences of TP53 BINDING SITE, designated SEQ ID:6151, to the nucleotide sequence of VGAM1209 RNA, herein designated VGAM RNA, also designated SEQ ID:3920.

Another function of VGAM1209 is therefore inhibition of Tumor Protein P53 (Li-Fraumeni syndrome) (TP53, Accession NM_000546). Accordingly, utilities of VGAM1209 include diagnosis, prevention and treatment of diseases and clinical conditions associated with TP53. Tripartite Motif-containing 34 (TRIM34, Accession NM_021616) is another VGAM1209 host target gene. TRIM34 BINDING SITE1 and TRIM34 BINDING SITE2 are HOST TARGET binding sites found in untranslated regions of mRNA encoded by TRIM34, corresponding to HOST TARGET binding sites such as BINDING SITE I, BINDING SITE II or BINDING SITE III. Table 2 illustrates the complementarity of the nucleotide sequences of TRIM34 BINDING SITE1 and TRIM34 BINDING SITE2, designated SEQ ID:22249 and SEQ ID:28173 respectively, to the nucleotide sequence of VGAM1209 RNA, herein designated VGAM RNA, also designated SEQ ID:3920.

Another function of VGAM1209 is therefore inhibition of Tripartite Motif-containing 34 (TRIM34, Accession NM_021616). Accordingly, utilities of VGAM1209 include diagnosis, prevention and treatment of diseases and clinical conditions associated with TRIM34. KIAA1016 (Accession XM_166260) is another VGAM1209 host target gene. KIAA1016 BINDING SITE is HOST TARGET binding site found in the 5' untranslated region of mRNA encoded by KIAA1016, corresponding to a HOST TARGET binding site such as BINDING SITE I, BINDING SITE II or BINDING SITE III. Table 2 illustrates the complementarity of the nucleotide sequences of KIAA1016 BINDING SITE, designated SEQ ID:44085, to the nucleotide sequence of VGAM1209 RNA, herein designated VGAM RNA, also designated SEQ ID:3920.

Another function of VGAM1209 is therefore inhibition of KIAA1016 (Accession XM_166260). Accordingly, utilities of VGAM1209 include diagnosis, prevention and treatment of diseases and clinical conditions associated with KIAA1016. LEC3 (Accession NM_015236) is another VGAM1209 host target gene. LEC3 BINDING SITE is HOST TARGET binding site found in the 3' untranslated region of mRNA encoded by LEC3, corresponding to a HOST TARGET binding site such as BINDING SITE I, BINDING SITE II or BINDING SITE III. Table 2 illustrates the complementarity of the nucleotide sequences of LEC3 BINDING SITE, designated SEQ ID:17566, to the nucleotide sequence of VGAM1209 RNA, herein designated VGAM RNA, also designated SEQ ID:3920.

Another function of VGAM1209 is therefore inhibition of LEC3 (Accession NM_015236). Accordingly, utilities of VGAM1209 include diagnosis, prevention and treatment of diseases and clinical conditions associated with LEC3. MGC22014 (Accession XM_035307) is another VGAM1209 host target gene. MGC22014 BINDING SITE is HOST TARGET binding site found in the 5' untranslated region of mRNA encoded by MGC22014, corresponding to a HOST TARGET binding site such as BINDING SITE I, BINDING SITE II or BINDING SITE III. Table 2 illustrates the complementarity of the nucleotide sequences of MGC22014 BINDING SITE, designated SEQ ID:32217, to the nucleotide sequence of VGAM1209 RNA, herein designated VGAM RNA, also designated SEQ ID:3920.

Another function of VGAM1209 is therefore inhibition of MGC22014 (Accession XM_035307). Accordingly, utilities of VGAM1209 include diagnosis, prevention and treatment of diseases and clinical conditions associated with MGC22014. Protein-O-mannosyltransferase 1 (POMT1, Accession NM_007171) is another VGAM1209 host target gene. POMT1 BINDING SITE is HOST TARGET binding site found in the 3' untranslated region of mRNA encoded by POMT1, corresponding to a HOST TARGET binding site such as BINDING SITE I, BINDING SITE II or BINDING SITE III. Table 2 illustrates the complementarity of the nucleotide sequences of POMT1 BINDING SITE, designated SEQ ID:14016, to the nucleotide sequence of VGAM1209 RNA, herein designated VGAM RNA, also designated SEQ ID:3920.

Another function of VGAM1209 is therefore inhibition of Protein-O-mannosyltransferase 1 (POMT1, Accession NM_007171). Accordingly, utilities of VGAM1209 include diagnosis, prevention and treatment of diseases and clinical conditions associated with POMT1. LOC143173 (Accession XM_016685) is another VGAM1209 host target gene. LOC143173 BINDING SITE is HOST TARGET binding site found in the 5' untranslated region of mRNA encoded by LOC143173, corresponding to a HOST TARGET binding site such as BINDING SITE I, BINDING SITE II or BINDING SITE III. Table 2 illustrates the complementarity of the nucleotide sequences of LOC143173 BINDING SITE, designated SEQ ID:30269, to the nucleotide sequence of VGAM1209 RNA, herein designated VGAM RNA, also designated SEQ ID:3920.

Another function of VGAM1209 is therefore inhibition of LOC143173 (Accession XM_016685). Accordingly, utilities of VGAM1209 include diagnosis, prevention and treatment of diseases and clinical conditions associated with LOC143173. LOC202451 (Accession XM_117401) is another VGAM1209 host target gene. LOC202451 BINDING SITE is HOST TARGET binding site found in the 5' untranslated region of mRNA encoded by LOC202451, corresponding to a HOST TARGET binding site such as BINDING SITE I, BINDING SITE II or BINDING SITE III. Table 2 illustrates the complementarity of the nucleotide sequences of LOC202451 BINDING SITE, designated SEQ ID:43437, to the nucleotide sequence of VGAM1209 RNA, herein designated VGAM RNA, also designated SEQ ID:3920.

Another function of VGAM1209 is therefore inhibition of LOC202451 (Accession XM_117401). Accordingly, utilities of VGAM1209 include diagnosis, prevention and treatment of diseases and clinical conditions associated with LOC202451. FIG. 1 further provides a conceptual description of a novel bioinformatically detected viral gene of the present invention, referred to here as Viral Genomic Address Messenger 1210 (VGAM1210) viral gene, which modulates expression of respective host target genes thereof, the function and utility of which host target genes is known in the art.

VGAM1210 is a novel bioinformatically detected regulatory, non protein coding, viral micro RNA (miRNA) gene. The method by which VGAM1210 was detected is described hereinabove with reference to FIGS. 1-8.

VGAM1210 gene, herein designated VGAM GENE, is a viral gene contained in the genome of Camelpox Virus. VGAM1210 host target gene, herein designated VGAM HOST TARGET GENE, is a human gene contained in the human genome.

VGAM1210 gene encodes a VGAM1210 precursor RNA, herein designated VGAM PRECURSOR RNA. Similar to other miRNA genes, and unlike most ordinary genes, VGAM1210 precursor RNA does not encode a protein. A nucleotide sequence identical or highly similar to the nucleotide sequence of VGAM1210 precursor RNA is designated SEQ ID:1196, and is provided hereinbelow with reference to the sequence listing part. Nucleotide sequence SEQ ID:1196 is located at position 134784 relative to the genome of Camelpox Virus.

VGAM1210 precursor RNA folds onto itself, forming VGAM1210 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1210 folded precursor RNA into VGAM1210 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM1210 RNA is designated SEQ ID:3921, and is provided hereinbelow with reference to the sequence listing part.

VGAM1210 host target gene, herein designated VGAM HOST TARGET GENE, encodes a corresponding messenger RNA, VGAM1210 host target RNA, herein designated VGAM HOST TARGET RNA. VGAM1210 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1210 RNA, herein designated VGAM RNA, binds complementarily to one or more host target binding sites located in untranslated regions of VGAM1210 host target RNA, herein designated VGAM HOST TARGET RNA. This complementary binding is due to the fact that the nucleotide sequence of VGAM1210 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1210 RNA, herein designated VGAM RNA, may have a different number of host target binding sites in untranslated regions of a VGAM1210 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1210 RNA, herein designated VGAM RNA, to host target binding sites on VGAM1210 host target RNA, herein designated VGAM HOST TARGET RNA, such as BINDING SITE I, BINDING SITE II and BINDING SITE III, inhibits translation of VGAM1210 host target RNA into VGAM1210 host target protein, herein designated VGAM HOST TARGET PROTEIN. VGAM host target protein is therefore outlined by a broken line.

It is appreciated that VGAM1210 host target gene, herein designated VGAM HOST TARGET GENE, in fact represents a plurality of VGAM1210 host target genes. The mRNA of each one of this plurality of VGAM1210 host target genes comprises one or more host target binding sites, each having a nucleotide sequence which is at least partly complementary to VGAM1210 RNA, herein designated VGAM RNA, and which when bound by VGAM1210 RNA causes inhibition of translation of respective one or more VGAM1210 host target proteins.

It is further appreciated by one skilled in the art that the mode of translational inhibition illustrated by FIG. 1 with specific reference to translational inhibition exerted by VGAM1210 gene, herein designated VGAM GENE, on one or more VGAM1210 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1210 is inhibition of expression of host target genes, as part of a novel viral mechanism of attacking a host. Accordingly, utilities of VGAM1210 include diagnosis, prevention and treatment of viral infection by Camelpox Virus. Specific functions, and accordingly utilities, of VGAM1210 correlate with, and may be deduced from, the identity of the host target genes which VGAM1210 binds and inhibits, and the function of these host target genes, as elaborated hereinbelow.

Nucleotide sequences of the VGAM1210 precursor RNA, herein designated VGAM PRECURSOR RNA, and of the 'diced' VGAM1210 RNA, herein designated VGAM RNA, and a schematic representation of the secondary folding of VGAM1210 folded precursor RNA, herein designated VGAM FOLDED PRECURSOR RNA, of VGAM1210 are further described hereinbelow with reference to Table 1.

Nucleotide sequences of host target binding sites, such as BINDING SITE-I, BINDING SITE-II and BINDING SITE-III of FIG. 1, found on VGAM1210 host target RNA, and schematic representation of the complementarity of each of these host target binding sites to VGAM1210 RNA, herein designated VGAM RNA, are described hereinbelow with reference to Table 2.

As mentioned hereinabove with reference to FIG. 1, a function of VGAM1210 gene, herein designated VGAM is inhibition of expression of VGAM1210 target genes. It is appreciated that specific functions, and accordingly utilities, of VGAM1210 correlate with, and may be deduced from, the identity of the target genes which VGAM1210 binds and inhibits, and the function of these target genes, as elaborated hereinbelow.

BDG-29 (Accession XM_051343) is a VGAM1210 host target gene. BDG-29 BINDING SITE is HOST TARGET binding site found in the 3' untranslated region of mRNA encoded by BDG-29, corresponding to a HOST TARGET binding site such as BINDING SITE I, BINDING SITE II or BINDING SITE III. Table 2 illustrates the complementarity of the nucleotide sequences of BDG-29 BINDING SITE, designated SEQ ID:35816, to the nucleotide sequence of VGAM1210 RNA, herein designated VGAM RNA, also designated SEQ ID:3921.

A function of VGAM1210 is therefore inhibition of BDG-29 (Accession XM_051343). Accordingly, utilities of VGAM1210 include diagnosis, prevention and treatment of diseases and clinical conditions associated with BDG-29. Chromosome 21 Open Reading Frame 6 (C21orf6, Accession NM_016940) is another VGAM1210 host target gene. C21orf6 BINDING SITE is HOST TARGET binding site found in the 3" untranslated region of mRNA encoded by C21orf6, corresponding to a HOST TARGET binding site such as BINDING SITE I, BINDING SITE II or BINDING SITE III. Table 2 illustrates the complementarity of the nucleotide sequences of C21orf6 BINDING SITE, designated SEQ ID:18855, to the nucleotide sequence of VGAM1210 RNA, herein designated VGAM RNA, also designated SEQ ID:3921.

Another function of VGAM1210 is therefore inhibition of Chromosome 21 Open Reading Frame 6 (C21orf6, Accession NM_016940). Accordingly, utilities of VGAM1210 include diagnosis, prevention and treatment of diseases and clinical conditions associated with C21orf6. DKFZp434D177 (Accession NM_032264) is another VGAM1210 host target gene. DKFZp434D177 BINDING SITE is HOST TARGET binding site found in the 3' untranslated region of mRNA encoded by DKFZp434D177, corresponding to a HOST TARGET binding site such as BINDING SITE I, BINDING SITE II or BINDING SITE III. Table 2 illustrates the complementarity of the nucleotide sequences of DKFZp434D177 BINDING SITE, designated SEQ ID:26007, to the nucleotide sequence of VGAM1210 RNA, herein designated VGAM RNA, also designated SEQ ID:3921.

Another function of VGAM1210 is therefore inhibition of DKFZp434D177 (Accession NM_032264). Accordingly, utilities of VGAM1210 include diagnosis, prevention and treatment of diseases and clinical conditions associated with DKFZp434D177. HSA249128 (Accession NM_017583) is another VGAM1210 host target gene. HSA249128 BINDING SITE is HOST TARGET binding site found in the 3' untranslated region of mRNA encoded by HSA249128, corresponding to a HOST TARGET binding site such as BINDING SITE I, BINDING SITE II or BINDING SITE III. Table 2 illustrates the complementarity of the nucleotide sequences of HSA249128 BINDING SITE, designated SEQ ID:19027, to the nucleotide sequence of VGAM1210 RNA, herein designated VGAM RNA, also designated SEQ ID:3921.

Another function of VGAM1210 is therefore inhibition of HSA249128 (Accession NM_017583). Accordingly, utilities of VGAM1210 include diagnosis, prevention and treatment of diseases and clinical conditions associated with HSA249128. KIAA1634 (Accession XM_032749) is another VGAM1210 host target gene. KIAA1634 BINDING SITE is HOST TARGET binding site found in the 3' untranslated region of mRNA encoded by KIAA1634, corresponding to a HOST TARGET binding site such as BINDING SITE I, BINDING SITE II or BINDING SITE III. Table 2 illustrates the complementarity of the nucleotide sequences of KIAA1634 BINDING SITE, designated SEQ ID:31751, to the nucleotide sequence of VGAM1210 RNA, herein designated VGAM RNA, also designated SEQ ID:3921.

Another function of VGAM1210 is therefore inhibition of KIAA1634 (Accession XM_032749). Accordingly, utilities of VGAM1210 include diagnosis, prevention and treatment of diseases and clinical conditions associated with KIAA1634. KIAA1941 (Accession XM_059318) is another VGAM1210 host target gene. KIAA1941 BINDING SITE is HOST TARGET binding site found in the 3' untranslated region of mRNA encoded by KIAA1941, corresponding to a HOST TARGET binding site such as BINDING SITE I, BINDING SITE II or BINDING SITE III. Table 2 illustrates the complementarity of the nucleotide sequences of KIAA1941 BINDING SITE, designated SEQ ID:36951, to the nucleotide sequence of VGAM1210 RNA, herein designated VGAM RNA, also designated SEQ ID:3921.

Another function of VGAM1210 is therefore inhibition of KIAA1941 (Accession XM_059318). Accordingly, utilities of VGAM1210 include diagnosis, prevention and treatment of diseases and clinical conditions associated with KIAA1941. PRO2533 (Accession NM_018629) is another VGAM1210 host target gene. PRO2533 BINDING SITE is HOST TARGET binding site found in the 3' untranslated region of mRNA encoded by PRO2533, corresponding to a HOST TARGET binding site such as BINDING SITE I, BINDING SITE II or BINDING SITE III. Table 2 illustrates the complementarity of the nucleotide sequences of PRO2533 BINDING SITE, designated SEQ ID:20702, to the nucleotide sequence of VGAM1210 RNA, herein designated VGAM RNA, also designated SEQ ID:3921.

Another function of VGAM1210 is therefore inhibition of PRO2533 (Accession NM_018629). Accordingly, utilities of VGAM1210 include diagnosis, prevention and treatment of diseases and clinical conditions associated with PRO2533. LOC151201 (Accession XM_098021) is another VGAM1210 host target gene. LOC151201 BINDING SITE is HOST TARGET binding site found in the 3' untranslated region of mRNA encoded by LOC151201, corresponding to a HOST TARGET binding site such as BINDING SITE I, BINDING SITE II or BINDING SITE III. Table 2 illustrates the complementarity of the nucleotide sequences of LOC151201 BINDING SITE, designated SEQ ID:41323, to the nucleotide sequence of VGAM1210 RNA, herein designated VGAM RNA, also designated SEQ ID:3921.

Another function of VGAM1210 is therefore inhibition of LOC151201 (Accession XM_098021). Accordingly, utilities of VGAM1210 include diagnosis, prevention and treatment of diseases and clinical conditions associated with LOC151201. FIG. 1 further provides a conceptual description of a novel bioinformatically detected viral gene of the present invention, referred to here as Viral Genomic Address Messenger 1211 (VGAM1211) viral gene, which modulates expression of respective host target genes thereof, the function and utility of which host target genes is known in the art.

VGAM1211 is a novel bioinformatically detected regulatory, non protein coding, viral micro RNA (miRNA) gene. The method by which VGAM1211 was detected is described hereinabove with reference to FIGS. 1-8.

VGAM1211 gene, herein designated VGAM GENE, is a viral gene contained in the genome of Camelpox Virus. VGAM1211 host target gene, herein designated VGAM HOST TARGET GENE, is a human gene contained in the human genome.

VGAM1211 gene encodes a VGAM1211 precursor RNA, herein designated VGAM PRECURSOR RNA. Similar to other miRNA genes, and unlike most ordinary genes, VGAM1211 precursor RNA does not encode a protein. A nucleotide sequence identical or highly similar to the nucleotide sequence of VGAM1211 precursor RNA is designated SEQ ID:1197, and is provided hereinbelow with reference to the sequence listing part. Nucleotide sequence SEQ ID:1197 is located at position 138029 relative to the genome of Camelpox Virus.

VGAM1211 precursor RNA folds onto itself, forming VGAM1211 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1211 folded precursor RNA into VGAM1211 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM1211 RNA is designated SEQ ID:3922, and is provided hereinbelow with reference to the sequence listing part.

VGAM1211 host target gene, herein designated VGAM HOST TARGET GENE, encodes a corresponding messenger RNA, VGAM1211 host target RNA, herein designated VGAM HOST TARGET RNA. VGAM1211 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1211 RNA, herein designated VGAM RNA, binds complementarily to one or more host target binding sites located in untranslated regions of VGAM1211 host target RNA, herein designated VGAM HOST TARGET RNA. This complementary binding is due to the fact that the nucleotide sequence of VGAM1211 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1211 RNA, herein designated VGAM RNA, may have a different number of host target binding sites in untranslated regions of a VGAM1211 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1211 RNA, herein designated VGAM RNA, to host target binding sites on VGAM1211 host target RNA, herein designated VGAM HOST TARGET RNA, such as BINDING SITE I, BINDING SITE II and BINDING SITE III, inhibits translation of VGAM1211 host target RNA into VGAM1211 host target protein, herein designated VGAM HOST TARGET PROTEIN. VGAM host target protein is therefore outlined by a broken line.

It is appreciated that VGAM1211 host target gene, herein designated VGAM HOST TARGET GENE, in fact represents a plurality of VGAM1211 host target genes. The mRNA of each one of this plurality of VGAM1211 host target genes comprises one or more host target binding sites, each having a nucleotide sequence which is at least partly complementary to VGAM1211 RNA, herein designated VGAM RNA, and which when bound by VGAM1211 RNA causes inhibition of translation of respective one or more VGAM1211 host target proteins.

It is further appreciated by one skilled in the art that the mode of translational inhibition illustrated by FIG. 1 with specific reference to translational inhibition exerted by VGAM1211 gene, herein designated VGAM GENE, on one or more VGAM1211 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1211 is inhibition of expression of host target genes, as part of a novel viral mechanism of attacking a host. Accordingly, utilities of VGAM1211 include diagnosis, prevention and treatment of viral infection by Camelpox Virus. Specific functions, and accordingly utilities, of VGAM1211 correlate with, and may be deduced from, the identity of the host target genes which VGAM1211 binds and inhibits, and the function of these host target genes, as elaborated hereinbelow.

Nucleotide sequences of the VGAM1211 precursor RNA, herein designated VGAM PRECURSOR RNA, and of the 'diced' VGAM1211 RNA, herein designated VGAM RNA, and a schematic representation of the secondary folding of VGAM1211 folded precursor RNA, herein designated VGAM FOLDED PRECURSOR RNA, of VGAM1211 are further described hereinbelow with reference to Table 1.

Nucleotide sequences of host target binding sites, such as BINDING SITE-I, BINDING SITE-II and BINDING SITE-III of FIG. 1, found on VGAM1211 host target RNA, and schematic representation of the complementarity of each of these host target binding sites to VGAM1211 RNA, herein designated VGAM RNA, are described hereinbelow with reference to Table 2.

As mentioned hereinabove with reference to FIG. 1, a function of VGAM1211 gene, herein designated VGAM is inhibition of expression of VGAM1211 target genes. It is appreciated that specific functions, and accordingly utilities, of VGAM1211 correlate with, and may be deduced from, the identity of the target genes which VGAM1211 binds and inhibits, and the function of these target genes, as elaborated hereinbelow.

NDRG Family Member 3 (NDRG3, Accession NM_022477) is a VGAM1211 host target gene. NDRG3 BINDING SITE1 and NDRG3 BINDING SITE2 are HOST TARGET binding sites found in untranslated regions of mRNA encoded by NDRG3, corresponding to HOST TARGET binding sites such as BINDING SITE I, BINDING SITE II or BINDING SITE III. Table 2 illustrates the complementarity of the nucleotide sequences of NDRG3 BINDING SITE1 and NDRG3 BINDING SITE2, designated SEQ ID:22845 and SEQ ID:25720 respectively, to the nucleotide sequence of VGAM1211 RNA, herein designated VGAM RNA, also designated SEQ ID:3922.

A function of VGAM1211 is therefore inhibition of NDRG Family Member 3 (NDRG3, Accession NM_022477). Accordingly, utilities of VGAM1211 include diagnosis, prevention and treatment of diseases and clinical conditions associated with NDRG3. FIG. 1 further provides a conceptual description of a novel bioinformatically detected viral gene of the present invention, referred to here as Viral Genomic Address Messenger 1212 (VGAM1212) viral gene, which modulates expression of respective host target genes thereof, the function and utility of which host target genes is known in the art.

VGAM1212 is a novel bioinformatically detected regulatory, non protein coding, viral micro RNA (miRNA) gene. The method by which VGAM1212 was detected is described hereinabove with reference to FIGS. 1-8.

VGAM1212 gene, herein designated VGAM GENE, is a viral gene contained in the genome of Camelpox Virus. VGAM1212 host target gene, herein designated VGAM HOST TARGET GENE, is a human gene contained in the human genome.

VGAM1212 gene encodes a VGAM1212 precursor RNA, herein designated VGAM PRECURSOR RNA. Similar to other miRNA genes, and unlike most ordinary genes, VGAM1212 precursor RNA does not encode a protein. A nucleotide sequence identical or highly similar to the nucleotide sequence of VGAM1212 precursor RNA is designated SEQ ID:1198, and is provided hereinbelow with reference to the sequence listing part. Nucleotide sequence SEQ ID:1198 is located at position 133579 relative to the genome of Camelpox Virus.

VGAM1212 precursor RNA folds onto itself, forming VGAM1212 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1212 folded precursor RNA into VGAM1212 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1212 RNA is designated SEQ ID:3923, and is provided hereinbelow with reference to the sequence listing part.

VGAM1212 host target gene, herein designated VGAM HOST TARGET GENE, encodes a corresponding messenger RNA, VGAM1212 host target RNA, herein designated VGAM HOST TARGET RNA. VGAM1212 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1212 RNA, herein designated VGAM RNA, binds complementarily to one or more host target binding sites located in untranslated regions of VGAM1212 host target RNA, herein designated VGAM HOST TARGET RNA. This complementary binding is due to the fact that the nucleotide sequence of VGAM1212 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1212 RNA, herein designated VGAM RNA, may have a different number of host target binding sites in untranslated regions of a VGAM1212 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1212 RNA, herein designated VGAM RNA, to host target binding sites on VGAM1212 host target RNA, herein designated VGAM HOST TARGET RNA, such as BINDING SITE I, BINDING SITE II and BINDING SITE III, inhibits translation of VGAM1212 host target RNA into VGAM1212 host target protein, herein designated VGAM HOST TARGET PROTEIN. VGAM host target protein is therefore outlined by a broken line.

It is appreciated that VGAM1212 host target gene, herein designated VGAM HOST TARGET GENE, in fact represents a plurality of VGAM1212 host target genes. The mRNA of each one of this plurality of VGAM1212 host target genes comprises one or more host target binding sites, each having a nucleotide sequence which is at least partly complementary to VGAM1212 RNA, herein designated VGAM RNA, and which when bound by VGAM1212 RNA causes inhibition of translation of respective one or more VGAM1212 host target proteins.

It is further appreciated by one skilled in the art that the mode of translational inhibition illustrated by FIG. 1 with specific reference to translational inhibition exerted by VGAM1212 gene, herein designated VGAM GENE, on one or more VGAM1212 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1212 is inhibition of expression of host target genes, as part of a novel viral mechanism of attacking a host. Accordingly, utilities of VGAM1212 include diagnosis, prevention and treatment of viral infection by Camelpox Virus. Specific functions, and accordingly utilities, of VGAM1212 correlate with, and may be deduced from, the identity of the host target genes which VGAM1212 binds and inhibits, and the function of these host target genes, as elaborated hereinbelow.

Nucleotide sequences of the VGAM1212 precursor RNA, herein designated VGAM PRECURSOR RNA, and of the 'diced' VGAM1212 RNA, herein designated VGAM RNA, and a schematic representation of the secondary folding of VGAM1212 folded precursor RNA, herein designated VGAM FOLDED PRECURSOR RNA, of VGAM1212 are further described hereinbelow with reference to Table 1.

Nucleotide sequences of host target binding sites, such as BINDING SITE-I, BINDING SITE-II and BINDING SITE-III of FIG. 1, found on VGAM1212 host target RNA, and schematic representation of the complementarity of each of these host target binding sites to VGAM1212 RNA, herein designated VGAM RNA, are described hereinbelow with reference to Table 2.

As mentioned hereinabove with reference to FIG. 1, a function of VGAM1212 gene, herein designated VGAM is inhibition of expression of VGAM1212 target genes. It is appreciated that specific functions, and accordingly utilities, of VGAM1212 correlate with, and may be deduced from, the identity of the target genes which VGAM1212 binds and inhibits, and the function of these target genes, as elaborated hereinbelow.

Coagulation Factor III (thromboplastin, tissue factor) (F3, Accession XM_040465) is a VGAM1212 host target gene. F3 BINDING SITE is HOST TARGET binding site found in the 3' untranslated region of mRNA encoded by F3, corresponding to a HOST TARGET binding site such as BINDING SITE I, BINDING SITE II or BINDING SITE III. Table 2 illustrates the complementarity of the nucleotide sequences of F3 BINDING SITE, designated SEQ ID:33296, to the nucleotide sequence of VGAM1212 RNA, herein designated VGAM RNA, also designated SEQ ID:3923.

A function of VGAM1212 is therefore inhibition of Coagulation Factor III (thromboplastin, tissue factor) (F3, Accession XM_040465), a gene which functions in normal hemostasis. Accordingly, utilities of VGAM1212 include diagnosis, prevention and treatment of diseases and clinical conditions associated with F3. The function of F3 and its association with various diseases and clinical conditions, has been established by previous studies, as described hereinabove with reference to VGAM817. Serine/threonine Kinase 6 (STK6, Accession NM_003600) is another VGAM1212 host target gene. STK6 BINDING SITE is HOST TARGET binding site found in the 3' untranslated region of mRNA encoded by STK6, corresponding to a HOST TARGET binding site such as BINDING SITE I, BINDING SITE II or BINDING SITE III. Table 2 illustrates the complementarity of the nucleotide sequences of STK6 BINDING SITE, designated SEQ ID:9654, to the nucleotide sequence of VGAM1212 RNA, herein designated VGAM RNA, also designated SEQ ID:3923.

Another function of VGAM1212 is therefore inhibition of Serine/threonine Kinase 6 (STK6, Accession NM_003600), a gene which is serine/threonine kinase 6 which is most highly expressed during mitosis. Accordingly, utilities of VGAM1212 include diagnosis, prevention and treatment of diseases and clinical conditions associated with STK6. The function of STK6 has been established by previous studies. Kimura et al. (1997) cloned a cDNA encoding a novel human serine/threonine kinase, STK6, which has high homology with Aurora and Ipl1 kinases. Mutations in these yeast kinases are known to cause abnormal spindle formation and missegregation of chromosomes. Northern and Western blotting analyses revealed a high level of STK6 expression product in testis and proliferating culture cells such as HeLa cells. The endogenous levels of STK6 protein and protein kinase activity were tightly regulated during cell cycle progression in HeLa cells. The protein was upregulated during G2/M and rapidly reduced after mitosis. Immunofluorescence studies revealed specific localization of STK6 protein to the spindle pole region during mitosis. The results suggested that STK6, like Aurora and Ipl1, is involved in cell growth and/or chromosome segregation. By fluorescence in situ hybridization, Kimura et al. (1997) showed that this mitotic centrosomal protein kinase, also referred to as AIK, is represented by 2 signals in chromosome bands 20q13.2-q13.3 and 1q41-q42. Somatic cell hybrid panel analyses showed that the functional gene is on chromosome 20 and a processed pseudogene (STK6P) on chromosome 1.

Full details of the abovementioned studies are described in the following publications, the disclosure of which are hereby incorporated by reference:

Kimura, M.; Kotani, S.; Hattori, T.; Sumi, N.; Yoshioka, T.; Todokoro, T.; Okano, Y.: Cell cycle-dependent expression and spindle pole localization of a novel human protein kinase Aik, related to Aurora of Drosophila and yeast Ipl1. J. Biol. Chem. 272:13766-13771, 1997; and Kimura, M.; Matsuda, Y.; Eki, T.; Yoshioka, T.; Okumura, K.; Hanaoka, F.; Okano, Y.: Assignment of STK6 to human chromosome 20q13.2-q13.3 and a pseudogene STK6P to 1q41-q42. Cytogenet.

Further studies establishing the function and utilities of STK6 are found in John Hopkins OMIM database record ID 602687, and in sited publications numbered 6225 listed in the bibliography section hereinbelow, which are also hereby incorporated by reference. FLJ10719 (Accession XM_031328) is another VGAM1212 host target gene. FLJ10719 BINDING SITE is HOST TARGET binding site found in the 3' untranslated region of mRNA encoded by FLJ10719, corresponding to a HOST TARGET binding site such as BINDING SITE I, BINDING SITE II or BINDING SITE III. Table 2 illustrates the complementarity of the nucleotide sequences of FLJ10719 BINDING SITE, designated SEQ ID:31339, to the nucleotide sequence of VGAM1212 RNA, herein designated VGAM RNA, also designated SEQ ID:3923.

Another function of VGAM1212 is therefore inhibition of FLJ10719 (Accession XM_031328). Accordingly, utilities of VGAM1212 include diagnosis, prevention and treatment of diseases and clinical conditions associated with FLJ10719. FLJ23323 (Accession NM_024654) is another VGAM1212 host target gene. FLJ23323 BINDING SITE is HOST TARGET binding site found in the 3' untranslated region of mRNA encoded by FLJ23323, corresponding to a HOST TARGET binding site such as BINDING SITE I, BINDING SITE II or BINDING SITE III. Table 2 illustrates the complementarity of the nucleotide sequences of FLJ23323 BINDING SITE, designated SEQ ID:23953, to the nucleotide sequence of VGAM1212 RNA, herein designated VGAM RNA, also designated SEQ ID:3923.

Another function of VGAM1212 is therefore inhibition of FLJ23323 (Accession NM_024654). Accordingly, utilities of VGAM1212 include diagnosis, prevention and treatment of diseases and clinical conditions associated with FLJ23323. LOC149721 (Accession XM_086649) is another VGAM1212 host target gene. LOC149721 BINDING SITE is HOST TARGET binding site found in the 3' untranslated region of mRNA encoded by LOC149721, corresponding to a HOST TARGET binding site such as BINDING SITE I, BINDING SITE II or BINDING SITE III. Table 2 illustrates the complementarity of the nucleotide sequences of LOC149721 BINDING SITE, designated SEQ ID:38808, to the nucleotide sequence of VGAM1212 RNA, herein designated VGAM RNA, also designated SEQ ID:3923.

Another function of VGAM1212 is therefore inhibition of LOC149721 (Accession XM_086649). Accordingly, utilities of VGAM1212 include diagnosis, prevention and treatment of diseases and clinical conditions associated with LOC149721. LOC202459 (Accession NM_145303) is another VGAM1212 host target gene. LOC202459 BINDING SITE is HOST TARGET binding site found in the 3' untranslated region of mRNA encoded by LOC202459, corresponding to a HOST TARGET binding site such as BINDING SITE I, BINDING SITE II or BINDING SITE III. Table 2 illustrates the complementarity of the nucleotide sequences of LOC202459 BINDING SITE, designated SEQ ID:29814, to the nucleotide sequence of VGAM1212 RNA, herein designated VGAM RNA, also designated SEQ ID:3923.

Another function of VGAM1212 is therefore inhibition of LOC202459 (Accession NM_145303). Accordingly, utilities of VGAM1212 include diagnosis, prevention and treatment of diseases and clinical conditions associated with LOC202459. LOC254735 (Accession XM_171051) is another VGAM1212 host target gene. LOC254735 BINDING SITE is HOST TARGET binding site found in the 5' untranslated region of mRNA encoded by LOC254735, corresponding to a HOST TARGET binding site such as BINDING SITE I, BINDING SITE II or BINDING SITE III. Table 2 illustrates the complementarity of the nucleotide sequences of LOC254735 BINDING SITE, designated SEQ ID:45837, to the nucleotide sequence of VGAM1212 RNA, herein designated VGAM RNA, also designated SEQ ID:3923.

Another function of VGAM1212 is therefore inhibition of LOC254735 (Accession XM_171051). Accordingly, utilities of VGAM1212 include diagnosis, prevention and treatment of diseases and clinical conditions associated with LOC254735. FIG. 1 further provides a conceptual description of a novel bioinformatically detected viral gene of the present invention, referred to here as Viral Genomic Address Messenger 1213 (VGAM1213) viral gene, which modulates expression of respective host target genes thereof, the function and utility of which host target genes is known in the art.

VGAM1213 is a novel bioinformatically detected regulatory, non protein coding, viral micro RNA (miRNA) gene. The method by which VGAM1213 was detected is described hereinabove with reference to FIGS. 1-8.

VGAM1213 gene, herein designated VGAM GENE, is a viral gene contained in the genome of Strawberry Mottle Virus. VGAM1213 host target gene, herein designated VGAM HOST TARGET GENE, is a human gene contained in the human genome.

VGAM1213 gene encodes a VGAM1213 precursor RNA, herein designated VGAM PRECURSOR RNA. Similar to other miRNA genes, and unlike most ordinary genes, VGAM1213 precursor RNA does not encode a protein. A nucleotide sequence identical or highly similar to the nucleotide sequence of VGAM1213 precursor RNA is designated SEQ ID:1199, and is provided hereinbelow with reference to the sequence listing part. Nucleotide sequence SEQ ID:1199 is located at position 4590 relative to the genome of Strawberry Mottle Virus.

VGAM1213 precursor RNA folds onto itself, forming VGAM1213 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1213 folded precursor RNA into VGAM1213 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1213 RNA is designated SEQ ID:3924, and is provided hereinbelow with reference to the sequence listing part.

VGAM1213 host target gene, herein designated VGAM HOST TARGET GENE, encodes a corresponding messenger RNA, VGAM1213 host target RNA, herein designated VGAM HOST TARGET RNA. VGAM1213 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1213 RNA, herein designated VGAM RNA, binds complementarily to one or more host target binding sites located in untranslated regions of VGAM1213 host target RNA, herein designated VGAM HOST TARGET RNA. This complementary binding is due to the fact that the nucleotide sequence of VGAM1213 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1213 RNA, herein designated VGAM RNA, may have a different number of host target binding sites in untranslated regions of a VGAM1213 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1213 RNA, herein designated VGAM RNA, to host target binding sites on VGAM1213 host target RNA, herein designated VGAM HOST TARGET RNA, such as BINDING SITE I, BINDING SITE II and BINDING SITE III, inhibits translation of VGAM1213 host target RNA into VGAM1213 host target protein, herein designated VGAM HOST TARGET PROTEIN. VGAM host target protein is therefore outlined by a broken line.

It is appreciated that VGAM1213 host target gene, herein designated VGAM HOST TARGET GENE, in fact represents a plurality of VGAM1213 host target genes. The mRNA of each one of this plurality of VGAM1213 host target genes comprises one or more host target binding sites, each having a nucleotide sequence which is at least partly complementary to VGAM1213 RNA, herein designated VGAM RNA, and which when bound by VGAM1213 RNA causes inhibition of translation of respective one or more VGAM1213 host target proteins.

It is further appreciated by one skilled in the art that the mode of translational inhibition illustrated by FIG. 1 with specific reference to translational inhibition exerted by VGAM1213 gene, herein designated VGAM GENE, on one or more VGAM1213 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1213 is inhibition of expression of host target genes, as part of a novel viral mechanism of attacking a host. Accordingly, utilities of VGAM1213 include diagnosis, prevention and treatment of viral infection by Strawberry Mottle Virus. Specific functions, and accordingly utilities, of VGAM1213 correlate with, and may be deduced from, the identity of the host target genes which VGAM1213 binds and inhibits, and the function of these host target genes, as elaborated hereinbelow.

Nucleotide sequences of the VGAM1213 precursor RNA, herein designated VGAM PRECURSOR RNA, and of the 'diced' VGAM1213 RNA, herein designated VGAM RNA, and a schematic representation of the secondary folding of VGAM1213 folded precursor RNA, herein designated VGAM FOLDED PRECURSOR RNA, of VGAM1213 are further described hereinbelow with reference to Table 1.

Nucleotide sequences of host target binding sites, such as BINDING SITE-I, BINDING SITE-II and BINDING SITE-III of FIG. 1, found on VGAM1213 host target RNA, and schematic representation of the complementarity of each of these host target binding sites to VGAM1213 RNA, herein designated VGAM RNA, are described hereinbelow with reference to Table 2.

As mentioned hereinabove with reference to FIG. 1, a function of VGAM1213 gene, herein designated VGAM is inhibition of expression of VGAM1213 target genes. It is appreciated that specific functions, and accordingly utilities, of VGAM1213 correlate with, and may be deduced from, the identity of the target genes which VGAM1213 binds and inhibits, and the function of these target genes, as elaborated hereinbelow.

Phosphatidylinositol-4-phosphate 5-kinase, Type I, Beta (PIP5K1B, Accession NM_003558) is a VGAM1213 host target gene. PIP5K1B BINDING SITE is HOST TARGET binding site found in the 3' untranslated region of mRNA encoded by PIP5K1B, corresponding to a HOST TARGET binding site such as BINDING SITE I, BINDING SITE II or BINDING SITE III. Table 2 illustrates the complementarity of the nucleotide sequences of PIP5K1B BINDING SITE, designated SEQ ID:9605, to the nucleotide sequence of VGAM1213 RNA, herein designated VGAM RNA, also designated SEQ ID:3924.

A function of VGAM1213 is therefore inhibition of Phosphatidylinositol-4-phosphate 5-kinase, Type I, Beta (PIP5K1B, Accession NM_003558), a gene which catalyses the phosphorylation of phosphatidylinositol-4- phosphate to form phosphatidylinositol-4,5-biphosphate. Accordingly, utilities of VGAM1213 include diagnosis, prevention and treatment of diseases and clinical conditions associated with PIP5K1B. The function of PIP5K1B has been established by previous studies. Carvajal et al. (1995) reported the isolation of a gene from the region of the genome associated with Friedreich ataxia (FRDA; 229300). Expression was found to be complex, with multiple transcripts detected in a variety of tissues and evidence of alternative splicing and developmental control. The predicted amino acid sequence for the 2.7-kb transcript showed a marked homology to the deduced amino acid sequence of the MSS4 protein of Saccharomyces cerevisiae, which had been proposed to function in the phosphoinositide cycle, thus suggesting a potential role for the human homolog in signal transduction. Although no evidence of mutation was detected in the transcript, the sequence (which they designated STM7. I) represented only one of the shorter alternatively spliced species identified by Northern analysis and direct sequencing. Carvajal et al. (1996) reported that the X25 (frataxin-encoding) gene described by Campuzano et al. (1996) and shown to be associated with mutations in FRDA patients comprises part of a gene that they had previously identified and named STM7. They reported that the transcription of both STM7 and X25 occurs from the centromere toward the telomere, that the reported sequences of STM7 and X25 did not represent a full-length transcript, that multiple transcripts for each of these genes are present in Northern blots, and that several of these transcripts are of similar size. Carvajal et al. (1996) also reported that less than 10 kb separates the CpG island identified in the X25/exon 1 from the 3-prime end of STM7/exon 16. They further demonstrated that the recombinant protein corresponding to the STM7.1 transcript has phosphatidylinositol-4-phosphate 5-kinase activity. See 606829 for further discussion of the relationship between STM7 and FRDA.

Full details of the abovementioned studies are described in the following publications, the disclosure of which are hereby incorporated by reference:

Campuzano, V.; Montermini, L.; Molto, M. D.; Pianese, L.; Cossee, M.; Cavalcanti, F.; Monros, E.; Rodius, F.; Duclos, F.; Monticelli, A.; Zara, F.; Canizares, J.; Koutnikova, H.; Bidichandani, S. I.; Gellera, C.; Brice, A.; Trouillas, P.; De Michele, G.; Filla, A.; De Frutos, R.; Palau, F.; Patel, P. I.; Di Donato, S.; Mandel, J. -L.; Cocozza, S.; Koenig, M.; Pandolfo, M.: Friedreich's ataxia: autosomal recessive disease caused by an intronic GAA triplet repeat expansion. Science 271:1423-1427, 1996; and Carvajal, J. J.; Pook, M. A.; dos Santos, M.; Doudney, K.; Hillermann, R.; Minogue, S.; Williamson, R.; Hsuan, J. J.; Chamberlain, S.: The Friedreich's ataxia gene encodes a novel phos.

Further studies establishing the function and utilities of PIP5K1B are found in John Hopkins OMIM database record ID 602745, and in sited publications numbered 8277-2401 listed in the bibliography section hereinbelow, which are also hereby incorporated by reference. KIAA1463 (Accession XM_051160) is another VGAM1213 host target gene. KIAA1463 BINDING SITE is HOST TARGET binding site found in the 3' untranslated region of mRNA encoded by KIAA1463, corresponding to a HOST TARGET binding site such as BINDING SITE I, BINDING SITE II or BINDING SITE III. Table 2 illustrates the complementarity of the nucleotide sequences of KIAA1463 BINDING SITE, designated SEQ ID:35767, to the nucleotide sequence of VGAM1213 RNA, herein designated VGAM RNA, also designated SEQ ID:3924.

Another function of VGAM1213 is therefore inhibition of KIAA1463 (Accession XM_051160). Accordingly, utilities of VGAM1213 include diagnosis, prevention and treatment of diseases and clinical conditions associated with KIAA1463. RAS-like, Estrogen-regulated, Growth-inhibitor (RERG, Accession NM_032918) is another VGAM1213 host target gene. RERG BINDING SITE is HOST TARGET binding site found in the 3' untranslated region of mRNA encoded by RERG, corresponding to a HOST TARGET binding site such as BINDING SITE I, BINDING SITE II or BINDING SITE III. Table 2 illustrates the complementarity of the nucleotide sequences of RERG BINDING SITE, designated SEQ ID:26737, to the nucleotide sequence of VGAM1213 RNA, herein designated VGAM RNA, also designated SEQ ID:3924.

Another function of VGAM1213 is therefore inhibition of RAS-like, Estrogen-regulated, Growth-inhibitor (RERG, Accession NM_032918). Accordingly, utilities of VGAM1213 include diagnosis, prevention and treatment of diseases and clinical conditions associated with RERG. LOC221474 (Accession XM_166464) is another VGAM1213 host target gene. LOC221474 BINDING SITE is HOST TARGET binding site found in the 5' untranslated region of mRNA encoded by LOC221474, corresponding to a HOST TARGET binding site such as BINDING SITE I, BINDING SITE II or BINDING SITE III. Table 2 illustrates the complementarity of the nucleotide sequences of LOC221474 BINDING SITE, designated SEQ ID:44378, to the nucleotide sequence of VGAM1213 RNA, herein designated VGAM RNA, also designated SEQ ID:3924.

Another function of VGAM1213 is therefore inhibition of LOC221474 (Accession XM_166464). Accordingly, utilities of VGAM1213 include diagnosis, prevention and treatment of diseases and clinical conditions associated with LOC221474. FIG. 1 further provides a conceptual description of a novel bioinformatically detected viral gene of the present invention, referred to here as Viral Genomic Address Messenger 1214 (VGAM1214) viral gene, which modulates expression of respective host target genes thereof, the function and utility of which host target genes is known in the art.

VGAM1214 is a novel bioinformatically detected regulatory, non protein coding, viral micro RNA (miRNA) gene. The method by which VGAM1214 was detected is described hereinabove with reference to FIGS. 1-8.

VGAM1214 gene, herein designated VGAM GENE, is a viral gene contained in the genome of Tupaia Herpesvirus. VGAM1214 host target gene, herein designated VGAM HOST TARGET GENE, is a human gene contained in the human genome.

VGAM1214 gene encodes a VGAM1214 precursor RNA, herein designated VGAM PRECURSOR RNA. Similar to other miRNA genes, and unlike most ordinary genes, VGAM1214 precursor RNA does not encode a protein. A nucleotide sequence identical or highly similar to the nucleotide sequence of VGAM1214 precursor RNA is designated SEQ ID:1200, and is provided hereinbelow with reference to the sequence listing part. Nucleotide sequence SEQ ID:1200 is located at position 190571 relative to the genome of Tupaia Herpesvirus.

VGAM1214 precursor RNA folds onto itself, forming VGAM1214 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1214 folded precursor RNA into VGAM1214 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM1214 RNA is designated SEQ ID:3925, and is provided hereinbelow with reference to the sequence listing part.

VGAM1214 host target gene, herein designated VGAM HOST TARGET GENE, encodes a corresponding messenger RNA, VGAM1214 host target RNA, herein designated VGAM HOST TARGET RNA. VGAM1214 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1214 RNA, herein designated VGAM RNA, binds complementarily to one or more host target binding sites located in untranslated regions of VGAM1214 host target RNA, herein designated VGAM HOST TARGET RNA. This complementary binding is due to the fact that the nucleotide sequence of VGAM1214 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1214 RNA, herein designated VGAM RNA, may have a different number of host target binding sites in untranslated regions of a VGAM1214 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1214 RNA, herein designated VGAM RNA, to host target binding sites on VGAM1214 host target RNA, herein designated VGAM HOST TARGET RNA, such as BINDING SITE I, BINDING SITE II and BINDING SITE III, inhibits translation of VGAM1214 host target RNA into VGAM1214 host target protein, herein designated VGAM HOST TARGET PROTEIN. VGAM host target protein is therefore outlined by a broken line.

It is appreciated that VGAM1214 host target gene, herein designated VGAM HOST TARGET GENE, in fact represents a plurality of VGAM1214 host target genes. The mRNA of each one of this plurality of VGAM1214 host target genes comprises one or more host target binding sites, each having a nucleotide sequence which is at least partly complementary to VGAM1214 RNA, herein designated VGAM RNA, and which when bound by VGAM1214 RNA causes inhibition of translation of respective one or more VGAM1214 host target proteins.

It is further appreciated by one skilled in the art that the mode of translational inhibition illustrated by FIG. 1 with specific reference to translational inhibition exerted by VGAM1214 gene, herein designated VGAM GENE, on one or more VGAM1214 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1214 is inhibition of expression of host target genes, as part of a novel viral mechanism of attacking a host. Accordingly, utilities of VGAM1214 include diagnosis, prevention and treatment of viral infection by Tupaia Herpesvirus. Specific functions, and accordingly utilities, of VGAM1214 correlate with, and may be deduced from, the identity of the host target genes which VGAM1214 binds and inhibits, and the function of these host target genes, as elaborated hereinbelow.

Nucleotide sequences of the VGAM1214 precursor RNA, herein designated VGAM PRECURSOR RNA, and of the 'diced' VGAM1214 RNA, herein designated VGAM RNA, and a schematic representation of the secondary folding of VGAM1214 folded precursor RNA, herein designated VGAM FOLDED PRECURSOR RNA, of VGAM1214 are further described hereinbelow with reference to Table 1.

Nucleotide sequences of host target binding sites, such as BINDING SITE-I, BINDING SITE-II and BINDING SITE-III of FIG. 1, found on VGAM1214 host target RNA, and schematic representation of the complementarity of each of these host target binding sites to VGAM1214 RNA, herein designated VGAM RNA, are described hereinbelow with reference to Table 2.

As mentioned hereinabove with reference to FIG. 1, a function of VGAM1214 gene, herein designated VGAM is inhibition of expression of VGAM1214 target genes. It is appreciated that specific functions, and accordingly utilities, of VGAM1214 correlate with, and may be deduced from, the identity of the target genes which VGAM1214 binds and inhibits, and the function of these target genes, as elaborated hereinbelow.

Dystrophia Myotonica-protein Kinase (DMPK, Accession NM_004409) is a VGAM1214 host target gene. DMPK BINDING SITE is HOST TARGET binding site found in the 3' untranslated region of mRNA encoded by DMPK, corresponding to a HOST TARGET binding site such as BINDING SITE I, BINDING SITE II or BINDING SITE III. Table 2 illustrates the complementarity of the nucleotide sequences of DMPK BINDING SITE, designated SEQ ID:10667, to the nucleotide sequence of VGAM1214 RNA, herein designated VGAM RNA, also designated SEQ ID:3925.

A function of VGAM1214 is therefore inhibition of Dystrophia Myotonica-protein Kinase (DMPK, Accession NM_004409). Accordingly, utilities of VGAM1214 include diagnosis, prevention and treatment of diseases and clinical conditions associated with DMPK. EphA8 (EPHA8, Accession NM_020526) is another VGAM1214 host target gene. EPHA8 BINDING SITE is HOST TARGET binding site found in the 3' untranslated region of mRNA encoded by EPHA8, corresponding to a HOST TARGET binding site such as BINDING SITE I, BINDING SITE II or BINDING SITE III. Table 2 illustrates the complementarity of the nucleotide sequences of EPHA8 BINDING SITE, designated SEQ ID:21744, to the nucleotide sequence of VGAM1214 RNA, herein designated VGAM RNA, also designated SEQ ID:3925.

Another function of VGAM1214 is therefore inhibition of EphA8 (EPHA8, Accession NM_020526), a gene which Eph-related receptor tyrosine kinase A8. Accordingly, utilities of VGAM1214 include diagnosis, prevention and treatment of diseases and clinical conditions associated with EPHA8. The function of EPHA8 and its association with various diseases and clinical conditions, has been established by previous studies, as described hereinabove with reference to VGAM494. Fanconi Anemia, Complementation Group A (FANCA, Accession NM_000135) is another VGAM1214 host target gene. FANCA BINDING SITE is HOST TARGET binding site found in the 3' untranslated region of mRNA encoded by FANCA, corresponding to a HOST TARGET binding site such as BINDING SITE I, BINDING SITE II or BINDING SITE III. Table 2 illustrates the complementarity of the nucleotide sequences of FANCA BINDING SITE, designated SEQ ID:5630, to the nucleotide sequence of VGAM1214 RNA, herein designated VGAM RNA, also designated SEQ ID:3925.

Another function of VGAM1214 is therefore inhibition of Fanconi Anemia, Complementation Group A (FANCA, Accession NM_000135). Accordingly, utilities of VGAM1214 include diagnosis, prevention and treatment of diseases and clinical conditions associated with FANCA. GLI-Kruppel Family Member GLI2 (GLI2, Accession NM_030379) is another VGAM1214 host target gene. GLI2 BINDING SITE is HOST TARGET binding site found in the 5' untranslated region of mRNA encoded by GLI2, corresponding to a HOST TARGET binding site such as BINDING SITE I, BINDING SITE II or BINDING SITE III. Table 2 illustrates the complementarity of the nucleotide sequences of GLI2 BINDING SITE, designated SEQ ID:24936, to the nucleotide sequence of VGAM1214 RNA, herein designated VGAM RNA, also designated SEQ ID:3925.

Another function of VGAM1214 is therefore inhibition of GLI-Kruppel Family Member GLI2 (GLI2, Accession NM_030379), a gene which may promote tax-dependent transcription of T-cell leukemia virus type 1 genes. Accordingly, utilities of VGAM1214 include diagnosis, prevention and treatment of diseases and clinical conditions associated with GLI2. The function of GLI2 and its association with various diseases and clinical conditions, has been established by previous studies, as described hereinabove with reference to VGAM465. Homeo Box D1 (HOXD1, Accession NM_024501) is another VGAM1214 host target gene. HOXD1 BINDING SITE is HOST TARGET binding site found in the 3' untranslated region of mRNA encoded by HOXD1, corresponding to a HOST TARGET binding site such as BINDING SITE I, BINDING SITE II or BINDING SITE III. Table 2 illustrates the complementarity of the nucleotide sequences of HOXD1 BINDING SITE, designated SEQ ID:23696, to the nucleotide sequence of VGAM1214 RNA, herein designated VGAM RNA, also designated SEQ ID:3925.

Another function of VGAM1214 is therefore inhibition of Homeo Box D1 (HOXD1, Accession NM_024501), a gene which is part of a developmental regulatory system . Accordingly, utilities of VGAM1214 include diagnosis, prevention and treatment of diseases and clinical conditions associated with HOXD1. The function of HOXD1 has been established by previous studies. Both children studied by Del Campo et al. (1999) were heterozygous for a deletion that eliminated at least 8 (HOXD3-HOXD13) of the 9 genes in the HOXD cluster. Del Campo et al. (1999) suspected that the entire cluster was deleted and that the deletion included the proximally adjacent HOXD-complex gene EVX2 (OMIM Ref. No. 142991). The hypothesis that haploinsufficiency for HOXD-cluster genes was responsible in part for the malformations was supported by the expression patterns of these genes in early vertebrate embryos. However, the involvement of additional genes in the region could explain the discordance, in severity, between the 2 patients and the milder, nonpolarized phenotypes present in mice hemizygous for HoxD cluster genes. Del Campo et al. (1999) noted that mutations in HOXD13 (OMIM Ref. No. 142989) are responsible for type II syndactyly (OMIM Ref. No. 186000). Zakany et al. (2001) showed that Hoxd1 and other Hox genes in the mouse display dynamic stripes of expression within presomitic mesoderm. They stated that the underlying transcriptional bursts may reflect the mechanism that coordinates Hox gene activation with somitogenesis. This mechanism appeared to depend upon Notch signaling, as mice deficient for Rbpjk (OMIM Ref. No. 147183), the effector of the Notch pathway, showed severely reduced Hoxd gene expression in presomitic mesoderm. These results suggested a molecular link between Hox gene activation and the segmentation clock. Such a linkage would efficiently keep in phase the production of novel segments with their morphologic specification.

Full details of the abovementioned studies are described in the following publications, the disclosure of which are hereby incorporated by reference:

Del Campo, M.; Jones, M. C.; Veraksa, A. N.; Curry, C. J.; Jones, K. L.; Mascarello, J. T.; Ali-Kahn-Catts, Z.; Drumheller, T.; McGinnis, W.: Monodactylous limbs and abnormal genitalia are associated with hemizygosity for the human 2q31 region that includes the HOXD cluster. Am. J. Hum. Genet. 65:104-110, 1999; and Zakany, J.; Kmita, M.; Alarcon, P.; de la Pompa, J.-L.; Duboule, D.: Localized and transient transcription of Hox genes suggests a link between patterning and the segmentation clock.

Further studies establishing the function and utilities of HOXD1 are found in John Hopkins OMIM database record ID 142987, and in sited publications numbered 11321-11322 listed in the bibliography section hereinbelow, which are also hereby incorporated by reference. Kruppel-like Factor 8 (KLF8, Accession NM_007250) is another VGAM1214 host target gene. KLF8 BINDING SITE is HOST TARGET binding site found in the 5' untranslated region of mRNA encoded by KLF8, corresponding to a HOST TARGET binding site such as BINDING SITE I, BINDING SITE II or BINDING SITE III. Table 2 illustrates the complementarity of the nucleotide sequences of KLF8 BINDING SITE, designated SEQ ID:14123, to the nucleotide sequence of VGAM1214 RNA, herein designated VGAM RNA, also designated SEQ ID:3925.

Another function of VGAM1214 is therefore inhibition of Kruppel-like Factor 8 (KLF8, Accession NM_007250). Accordingly, utilities of VGAM1214 include diagnosis, prevention and treatment of diseases and clinical conditions associated with KLF8. LENG4 (Accession NM_024298) is another VGAM1214 host target gene. LENG4 BINDING SITE is HOST TARGET binding site found in the 5' untranslated region of mRNA encoded by LENG4, corresponding to a HOST TARGET binding site such as BINDING SITE I, BINDING SITE II or BINDING SITE III. Table 2 illustrates the complementarity of the nucleotide sequences of LENG4 BINDING SITE, designated SEQ ID:23581, to the nucleotide sequence of VGAM1214 RNA, herein designated VGAM RNA, also designated SEQ ID:3925.

Another function of VGAM1214 is therefore inhibition of LENG4 (Accession NM_024298), a gene which may be a transmembrane protein. Accordingly, utilities of VGAM1214 include diagnosis, prevention and treatment of diseases and clinical conditions associated with LENG4. The function of LENG4 and its association with various diseases and clinical conditions, has been established by previous studies, as described hereinabove with reference to VGAM259. Neurofibromin 1 (neurofibromatosis, von Recklinghausen disease, Watson disease) (NF1, Accession NM_000267) is another VGAM1214 host target gene. NF1 BINDING SITE is HOST TARGET binding site found in the 5' untranslated region of mRNA encoded by NF1, corresponding to a HOST TARGET binding site such as BINDING SITE I, BINDING SITE II or BINDING SITE III. Table 2 illustrates the complementarity of the nucleotide sequences of NF1 BINDING SITE, designated SEQ ID:5812, to the nucleotide sequence of VGAM1214 RNA, herein designated VGAM RNA, also designated SEQ ID:3925.

Another function of VGAM1214 is therefore inhibition of Neurofibromin 1 (neurofibromatosis, von Recklinghausen disease, Watson disease) (NF1, Accession NM_000267). Accordingly, utilities of VGAM1214 include diagnosis, prevention and treatment of diseases and clinical conditions associated with NF1. 2'-5'-oligoadenylate Synthetase 3, 100 kDa (OAS3, Accession NM_006187) is another VGAM1214 host target gene. OAS3 BINDING SITE is HOST TARGET binding site found in the 3' untranslated region of mRNA encoded by OAS3, corresponding to a HOST TARGET binding site such as BINDING SITE I, BINDING SITE II or BINDING SITE III. Table 2 illustrates the complementarity of the nucleotide sequences of OAS3 BINDING SITE, designated SEQ ID:12859, to the nucleotide sequence of VGAM1214 RNA, herein designated VGAM RNA, also designated SEQ ID:3925.

Another function of VGAM1214 is therefore inhibition of 2'-5'-oligoadenylate Synthetase 3, 100 kDa (OAS3, Accession NM_006187), a gene which may play a role in mediating resistance to virus infection, control of cell growth, differentiation, and apoptosis. Accordingly, utilities of VGAM1214 include diagnosis, prevention and treatment of diseases and clinical conditions associated with OAS3. The function of OAS3 and its association with various diseases and clinical conditions, has been established by previous studies, as described hereinabove with reference to VGAM309. Phosphodiesterase 4A, CAMP-specific (phosphodiesterase E2 dunce homolog, Drosophila) (PDE4A, Accession NM_006202) is another VGAM1214 host target gene. PDE4A BINDING SITE is HOST TARGET binding site found in the 3' untranslated region of mRNA encoded by PDE4A, corresponding to a HOST TARGET binding site such as BINDING SITE I, BINDING SITE II or BINDING SITE III. Table 2 illustrates the complementarity of the nucleotide sequences of PDE4A BINDING SITE, designated SEQ ID:12876, to the nucleotide sequence of VGAM1214 RNA, herein designated VGAM RNA, also designated SEQ ID:3925.

Another function of VGAM1214 is therefore inhibition of Phosphodiesterase 4A, CAMP-specific (phosphodiesterase E2 dunce homolog, Drosophila) (PDE4A, Accession NM_006202), a gene which is a CAMP-specific phosphodiesterase. Accordingly, utilities of VGAM1214 include diagnosis, prevention and treatment of diseases and clinical conditions associated with PDE4A. The function of PDE4A has been established by previous studies. See 600128. Livi et al. (1990) isolated a cDNA for a cyclic AMP phosphodiesterase from human monocytes. Obernolte et al. (1993) identified the monocyte clone as the homolog of rat Pde4a. Milatovich et al. (1994) assigned the PDE4A gene to human chromosome 19 by Southern analysis of somatic cell hybrid lines and to mouse chromosome 9 by Southern analysis of recombinant inbred (RI) mouse strains. Horton et al. (1995) confirmed the localization of PDE4A to chromosome 19 by analysis of a human/hamster somatic cell hybrid panel and using fluorescence in situ hybridization, regionalized the gene to 19p13.2-q12. The full-length clone for PDE4A was reported by Bolger et al. (1993). The difference in sequence within the 5-prime region of the open reading frame reported by Bolger et al. (1993) and Livi et al. (1990) was examined by Sullivan et al. (1994), who confirmed the Bolger sequence. Wilson et al. (1994) characterized the enzyme.

Full details of the abovementioned studies are described in the following publications, the disclosure of which are hereby incorporated by reference:

Milatovich, A.; Bolger, G.; Michaeli, T.; Francke, U.: Chromosome localizations of genes for five cAMP-specific phosphodiesterases in man and mouse. Somat. Cell Molec. Genet. 20:75-86, 1994; and Bolger, G.; Michaeli, T.; Martins, T.; St. John, T.; Steiner, B.; Rodgers, L.; Riggs, M.; Wigler, M.; Ferguson, K.: A family of human phosphodiesterases homologous to the dunce learning.

Further studies establishing the function and utilities of PDE4A are found in John Hopkins OMIM database record ID 600126, and in sited publications numbered 4888-134 and 12445-1344 listed in the bibliography section hereinbelow, which are also hereby incorporated by reference. Solute Carrier Family 24 (sodium/potassium/calcium exchanger), Member 1 (SLC24A1, Accession NM_004727) is another VGAM1214 host target gene. SLC24A1 BINDING SITE is HOST TARGET binding site found in the 5" untranslated region of mRNA encoded by SLC24A1, corresponding to a HOST TARGET binding site such as BINDING SITE I, BINDING SITE II or BINDING SITE III. Table 2 illustrates the complementarity of the nucleotide sequences of SLC24A1 BINDING SITE, designated SEQ ID:11102, to the nucleotide sequence of VGAM1214 RNA, herein designated VGAM RNA, also designated SEQ ID:3925.

Another function of VGAM1214 is therefore inhibition of Solute Carrier Family 24 (sodium/potassium/calcium exchanger), Member 1 (SLC24A1, Accession NM_004727), a gene which is a critical component of the visual transduction cascade, controlling the calcium concentration of outer segments during light and darkness. Accordingly, utilities of VGAM1214 include diagnosis, prevention and treatment of diseases and clinical conditions associated with SLC24A1. The function of SLC24A1 and its association with various diseases and clinical conditions, has been established by previous studies, as described hereinabove with reference to VGAM142. Angiotensin II Receptor-like 2 (AGTRL2, Accession NM_005162) is another VGAM1214 host target gene. AGTRL2 BINDING SITE is HOST TARGET binding site found in the 5' untranslated region of mRNA encoded by AGTRL2, corresponding to a HOST TARGET binding site such as BINDING SITE I, BINDING SITE II or BINDING SITE III. Table 2 illustrates the complementarity of the nucleotide sequences of AGTRL2 BINDING SITE, designated SEQ ID:11645, to the nucleotide sequence of VGAM1214 RNA, herein designated VGAM RNA, also designated SEQ ID:3925.

Another function of VGAM1214 is therefore inhibition of Angiotensin II Receptor-like 2 (AGTRL2, Accession NM_005162). Accordingly, utilities of VGAM1214 include diagnosis, prevention and treatment of diseases and clinical conditions associated with AGTRL2. Chromosome 1 Open Reading Frame 16 (C1orf16, Accession NM_014837) is another VGAM1214 host target gene. C1orf16 BINDING SITE is HOST TARGET binding site found in the 3' untranslated region of mRNA encoded by C1orf16, corresponding to a HOST TARGET binding site such as BINDING SITE I, BINDING SITE II or BINDING SITE III. Table 2 illustrates the complementarity of the nucleotide sequences of C1orf16 BINDING SITE, designated SEQ ID:16854, to the nucleotide sequence of VGAM1214 RNA, herein designated VGAM RNA, also designated SEQ ID:3925.

Another function of VGAM1214 is therefore inhibition of Chromosome 1 Open Reading Frame 16 (C1orf16, Accession NM_014837). Accordingly, utilities of VGAM1214 include diagnosis, prevention and treatment of diseases and clinical conditions associated with C1orf16. Chromosome 21 Open Reading Frame 93 (C21orf93, Accession NM_145179) is another VGAM1214 host target gene. C21orf93 BINDING SITE is HOST TARGET binding site found in the 3' untranslated region of mRNA encoded by C21orf93, corresponding to a HOST TARGET binding site such as BINDING SITE I, BINDING SITE II or BINDING SITE III. Table 2 illustrates the complementarity of the nucleotide sequences of C21orf93 BINDING SITE, designated SEQ ID:29740, to the nucleotide sequence of VGAM1214 RNA, herein designated VGAM RNA, also designated SEQ ID:3925.

Another function of VGAM1214 is therefore inhibition of Chromosome 21 Open Reading Frame 93 (C21orf93, Accession NM_145179). Accordingly, utilities of VGAM1214 include diagnosis, prevention and treatment of diseases and clinical conditions associated with C21orf93. Cyclin M1 (CNNM1, Accession NM_020348) is another VGAM1214 host target gene. CNNM1 BINDING SITE is HOST TARGET binding site found in the 3' untranslated region of mRNA encoded by CNNM1, corresponding to a HOST TARGET binding site such as BINDING SITE I, BINDING SITE II or BINDING SITE III. Table 2 illustrates the complementarity of the nucleotide sequences of CNNM1 BINDING SITE, designated SEQ ID:21607, to the nucleotide sequence of VGAM1214 RNA, herein designated VGAM RNA, also designated SEQ ID:3925.

Another function of VGAM1214 is therefore inhibition of Cyclin M1 (CNNM1, Accession NM_020348). Accordingly, utilities of VGAM1214 include diagnosis, prevention and treatment of diseases and clinical conditions associated with CNNM1. DKFZP434H132 (Accession XM_057020) is another VGAM1214 host target gene. DKFZP434H132 BINDING SITE is HOST TARGET binding site found in the 5' untranslated region of mRNA encoded by DKFZP434H132, corresponding to a HOST TARGET binding site such as BINDING SITE I, BINDING SITE II or BINDING SITE III. Table 2 illustrates the complementarity of the nucleotide sequences of DKFZP434H132 BINDING SITE, designated SEQ ID:36447, to the nucleotide sequence of VGAM1214 RNA, herein designated VGAM RNA, also designated SEQ ID:3925.

Another function of VGAM1214 is therefore inhibition of DKFZP434H132 (Accession XM_057020). Accordingly, utilities of VGAM1214 include diagnosis, prevention and treatment of diseases and clinical conditions associated with DKFZP434H132. DKFZP434I216 (Accession XM_085381) is another VGAM1214 host target gene. DKFZP434I216 BINDING SITE is HOST TARGET binding site found in the 5' untranslated region of mRNA encoded by DKFZP434I216, corresponding to a HOST TARGET binding site such as BINDING SITE I, BINDING SITE II or BINDING SITE III. Table 2 illustrates the complementarity of the nucleotide sequences of DKFZP434I216 BINDING SITE, designated SEQ ID:38100, to the nucleotide sequence of VGAM1214 RNA, herein designated VGAM RNA, also designated SEQ ID:3925.

Another function of VGAM1214 is therefore inhibition of DKFZP434I216 (Accession XM_085381). Accordingly, utilities of VGAM1214 include diagnosis, prevention and treatment of diseases and clinical conditions associated with DKFZP434I216. DKFZP586G1122 (Accession XM_028643) is another VGAM1214 host target gene. DKFZP586G1122 BINDING SITE is HOST TARGET binding site found in the 3' untranslated region of mRNA encoded by DKFZP586G1122, corresponding to a HOST TARGET binding site such as BINDING SITE I, BINDING SITE II or BINDING SITE III. Table 2 illustrates the complementarity of the nucleotide sequences of DKFZP586G1122 BINDING SITE, designated SEQ ID:30726, to the nucleotide sequence of VGAM1214 RNA, herein designated VGAM RNA, also designated SEQ ID:3925.

Another function of VGAM1214 is therefore inhibition of DKFZP586G1122 (Accession XM_028643). Accordingly, utilities of VGAM1214 include diagnosis, prevention and treatment of diseases and clinical conditions associated with DKFZP586G1122. DKFZP761E2110 (Accession NM_030953) is another VGAM1214 host target gene. DKFZP761E2110 BINDING SITE is HOST TARGET binding site found in the 3' untranslated region of mRNA encoded by DKFZP761E2110, corresponding to a HOST TARGET binding site such as BINDING SITE I, BINDING SITE II or BINDING SITE III. Table 2 illustrates the complementarity of the nucleotide sequences of DKFZP761E2110 BINDING SITE, designated SEQ ID:25224, to the nucleotide sequence of VGAM1214 RNA, herein designated VGAM RNA, also designated SEQ ID:3925.

Another function of VGAM1214 is therefore inhibition of DKFZP761E2110 (Accession NM_030953). Accordingly, utilities of VGAM1214 include diagnosis, prevention and treatment of diseases and clinical conditions associated with DKFZP761E2110. FLJ22746 (Accession NM_024785) is another VGAM1214 host target gene. FLJ22746 BINDING SITE is HOST TARGET binding site found in the 3' untranslated region of mRNA encoded by FLJ22746, corresponding to a HOST TARGET binding site such as BINDING SITE I, BINDING SITE II or BINDING SITE III. Table 2 illustrates the complementarity of the nucleotide sequences of FLJ22746 BINDING SITE, designated SEQ ID:24164, to the nucleotide sequence of VGAM1214 RNA, herein designated VGAM RNA, also designated SEQ ID:3925.

Another function of VGAM1214 is therefore inhibition of FLJ22746 (Accession NM_024785). Accordingly, utilities of VGAM1214 include diagnosis, prevention and treatment of diseases and clinical conditions associated with FLJ22746. FLJ23022 (Accession NM_025051) is another VGAM1214 host target gene. FLJ23022 BINDING SITE is HOST TARGET binding site found in the 3' untranslated region of mRNA encoded by FLJ23022, corresponding to a HOST TARGET binding site such as BINDING SITE I, BINDING SITE II or BINDING SITE III. Table 2 illustrates the complementarity of the nucleotide sequences of FLJ23022 BINDING SITE, designated SEQ ID:24646, to the nucleotide sequence of VGAM1214 RNA, herein designated VGAM RNA, also designated SEQ ID:3925.

Another function of VGAM1214 is therefore inhibition of FLJ23022 (Accession NM_025051). Accordingly, utilities of VGAM1214 include diagnosis, prevention and treatment of diseases and clinical conditions associated with FLJ23022. FLJ23420 (Accession NM_025061) is another VGAM1214 host target gene. FLJ23420 BINDING SITE is HOST TARGET binding site found in the 5' untranslated region of mRNA encoded by FLJ23420, corresponding to a HOST TARGET binding site such as BINDING SITE I, BINDING SITE II or BINDING SITE III. Table 2 illustrates the complementarity of the nucleotide sequences of FLJ23420 BINDING SITE, designated SEQ ID:24660, to the nucleotide sequence of VGAM1214 RNA, herein designated VGAM RNA, also designated SEQ ID:3925.

Another function of VGAM1214 is therefore inhibition of FLJ23420 (Accession NM_025061). Accordingly, utilities of VGAM1214 include diagnosis, prevention and treatment of diseases and clinical conditions associated with FLJ23420. FUS Interacting Protein (serine-arginine rich) 1 (FUSIP1, Accession NM_006625) is another VGAM1214 host target gene. FUSIP1 BINDING SITE is HOST TARGET binding site found in the 3' untranslated region of mRNA encoded by FUSIP1, corresponding to a HOST TARGET binding site such as BINDING SITE I, BINDING SITE II or BINDING SITE III. Table 2 illustrates the complementarity of the nucleotide sequences of FUSIP1 BINDING SITE, designated SEQ ID:13410, to the nucleotide sequence of VGAM1214 RNA, herein designated VGAM RNA, also designated SEQ ID:3925.

Another function of VGAM1214 is therefore inhibition of FUS Interacting Protein (serine-arginine rich) 1 (FUSIP1, Accession NM_006625). Accordingly, utilities of VGAM1214 include diagnosis, prevention and treatment of diseases and clinical conditions associated with FUSIP1. KIAA0152 (Accession NM_014730) is another VGAM1214 host target gene. KIAA0152 BINDING SITE is HOST TARGET binding site found in the 3" untranslated region of mRNA encoded by KIAA0152, corresponding to a HOST TARGET binding site such as BINDING SITE I, BINDING SITE II or BINDING SITE III. Table 2 illustrates the complementarity of the nucleotide sequences of KIAA0152 BINDING SITE, designated SEQ ID:16340, to the nucleotide sequence of VGAM1214 RNA, herein designated VGAM RNA, also designated SEQ ID:3925.

Another function of VGAM1214 is therefore inhibition of KIAA0152 (Accession NM_014730). Accordingly, utilities of VGAM1214 include diagnosis, prevention and treatment of diseases and clinical conditions associated with KIAA0152. KIAA0930 (Accession XM_047214) is another VGAM1214 host target gene. KIAA0930 BINDING SITE is HOST TARGET binding site found in the 3' untranslated region of mRNA encoded by KIAA0930, corresponding to a HOST TARGET binding site such as BINDING SITE I, BINDING SITE II or BINDING SITE III. Table 2 illustrates the complementarity of the nucleotide sequences of KIAA0930 BINDING SITE, designated SEQ ID:34916, to the nucleotide sequence of VGAM1214 RNA, herein designated VGAM RNA, also designated SEQ ID:3925.

Another function of VGAM1214 is therefore inhibition of KIAA0930 (Accession XM_047214). Accordingly, utilities of VGAM1214 include diagnosis, prevention and treatment of diseases and clinical conditions associated with KIAA0930. KIAA1029 (Accession NM_007286) is another VGAM1214 host target gene. KIAA1029 BINDING SITE is HOST TARGET binding site found in the 5' untranslated region of mRNA encoded by KIAA1029, corresponding to a HOST TARGET binding site such as BINDING SITE I, BINDING SITE II or BINDING SITE III. Table 2 illustrates the complementarity of the nucleotide sequences of KIAA1029 BINDING SITE, designated SEQ ID:14143, to the nucleotide sequence of VGAM1214 RNA, herein designated VGAM RNA, also designated SEQ ID:3925.

Another function of VGAM1214 is therefore inhibition of KIAA1029 (Accession NM_007286). Accordingly, utilities of VGAM1214 include diagnosis, prevention and treatment of diseases and clinical conditions associated with KIAA1029. KIAA1157 (Accession XM_051093) is another VGAM1214 host target gene. KIAA1157 BINDING SITE is HOST TARGET binding site found in the 3' untranslated region of mRNA encoded by KIAA1157, corresponding to a HOST TARGET binding site such as BINDING SITE I, BINDING SITE II or BINDING SITE III. Table 2 illustrates the complementarity of the nucleotide sequences of KIAA1157 BINDING SITE, designated SEQ ID:35749, to the nucleotide sequence of VGAM1214 RNA, herein designated VGAM RNA, also designated SEQ ID:3925.

Another function of VGAM1214 is therefore inhibition of KIAA1157 (Accession XM_051093). Accordingly, utilities of VGAM1214 include diagnosis, prevention and treatment of diseases and clinical conditions associated with KIAA1157. KIAA1602 (Accession XM_035497) is another VGAM1214 host target gene. KIAA1602 BINDING SITE is HOST TARGET binding site found in the 3' untranslated region of mRNA encoded by KIAA1602, corresponding to a HOST TARGET binding site such as BINDING SITE I, BINDING SITE II or BINDING SITE III. Table 2 illustrates the complementarity of the nucleotide sequences of KIAA1602 BINDING SITE, designated SEQ ID:32277, to the nucleotide sequence of VGAM1214 RNA, herein designated VGAM RNA, also designated SEQ ID:3925.

Another function of VGAM1214 is therefore inhibition of KIAA1602 (Accession XM_035497). Accordingly, utilities of VGAM1214 include diagnosis, prevention and treatment of diseases and clinical conditions associated with KIAA1602. KIAA1656 (Accession XM_038022) is another VGAM1214 host target gene. KIAA1656 BINDING SITE is HOST TARGET binding site found in the 3' untranslated region of mRNA encoded by KIAA1656, corresponding to a HOST TARGET binding site such as BINDING SITE I, BINDING SITE II or BINDING SITE III. Table 2 illustrates the complementarity of the nucleotide sequences of KIAA1656 BINDING SITE, designated SEQ ID:32736, to the nucleotide sequence of VGAM1214 RNA, herein designated VGAM RNA, also designated SEQ ID:3925.

Another function of VGAM1214 is therefore inhibition of KIAA1656 (Accession XM_038022). Accordingly, utilities of VGAM1214 include diagnosis, prevention and treatment of diseases and clinical conditions associated with KIAA1656. KIAA1854 (Accession XM_049884) is another VGAM1214 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35526, to the nucleotide sequence of VGAM1214 RNA, herein designated VGAM RNA, also designated SEQ ID:3925.

Another function of VGAM1214 is therefore inhibition of KIAA1854 (Accession XM_049884). Accordingly, utilities of VGAM1214 include diagnosis, prevention and treatment of diseases and clinical conditions associated with KIAA1854. Mitogen-activated Protein Kinase 8 Interacting Protein 3 (MAPK8IP3, Accession NM_033392) is another VGAM1214 host target gene. MAPK8IP3 BINDING SITE is HOST TARGET binding site found in the 3' untranslated region of mRNA encoded by MAPK8IP3, corresponding to a HOST TARGET binding site such as BINDING SITE I, BINDING SITE II or BINDING SITE III. Table 2 illustrates the complementarity of the nucleotide sequences of MAPK8IP3 BINDING SITE, designated SEQ ID:27218, to the nucleotide sequence of VGAM1214 RNA, herein designated VGAM RNA, also designated SEQ ID:3925.

Another function of VGAM1214 is therefore inhibition of Mitogen-activated Protein Kinase 8 Interacting Protein 3 (MAPK8IP3, Accession NM_033392). Accordingly, utilities of VGAM1214 include diagnosis, prevention and treatment of diseases and clinical conditions associated with MAPK8IP3. Mesoderm Development Candidate 2 (MESDC2, Accession XM_051854) is another VGAM1214 host target gene. MESDC2 BINDING SITE is HOST TARGET binding site found in the 3' untranslated region of mRNA encoded by MESDC2, corresponding to a HOST TARGET binding site such as BINDING SITE I, BINDING SITE II or BINDING SITE III. Table 2 illustrates the complementarity of the nucleotide sequences of MESDC2 BINDING SITE, designated SEQ ID:35891, to the nucleotide sequence of VGAM1214 RNA, herein designated VGAM RNA, also designated SEQ ID:3925.

Another function of VGAM1214 is therefore inhibition of Mesoderm Development Candidate 2 (MESDC2, Accession XM_051854). Accordingly, utilities of VGAM1214 include diagnosis, prevention and treatment of diseases and clinical conditions associated with MESDC2. MSE55 (Accession NM_007061) is another VGAM1214 host target gene. MSE55 BINDING SITE is HOST TARGET binding site found in the 5' untranslated region of mRNA encoded by MSE55, corresponding to a HOST TARGET binding site such as BINDING SITE I, BINDING SITE II or BINDING SITE III. Table 2 illustrates the complementarity of the nucleotide sequences of MSE55 BINDING SITE, designated SEQ ID:13924, to the nucleotide sequence of VGAM1214 RNA, herein designated VGAM RNA, also designated SEQ ID:3925.

Another function of VGAM1214 is therefore inhibition of MSE55 (Accession NM_007061). Accordingly, utilities of VGAM1214 include diagnosis, prevention and treatment of diseases and clinical conditions associated with MSE55. N4BP3 (Accession XM_038920) is another VGAM1214 host target gene. N4BP3 BINDING SITE is HOST TARGET binding site found in the 3' untranslated region of mRNA encoded by N4BP3, corresponding to a HOST TARGET binding site such as BINDING SITE I, BINDING SITE II or BINDING SITE III. Table 2 illustrates the complementarity of the nucleotide sequences of N4BP3 BINDING SITE, designated SEQ ID:32931, to the nucleotide sequence of VGAM1214 RNA, herein designated VGAM RNA, also designated SEQ ID:3925.

Another function of VGAM1214 is therefore inhibition of N4BP3 (Accession XM_038920). Accordingly, utilities of VGAM1214 include diagnosis, prevention and treatment of diseases and clinical conditions associated with N4BP3. PRIC285 (Accession XM_028918) is another VGAM1214 host target gene. PRIC285 BINDING SITE is HOST TARGET binding site found in the 3' untranslated region of mRNA encoded by PRIC285, corresponding to a HOST TARGET binding site such as BINDING SITE I, BINDING SITE II or BINDING SITE III. Table 2 illustrates the complementarity of the nucleotide sequences of PRIC285 BINDING SITE, designated SEQ ID:30802, to the nucleotide sequence of VGAM1214 RNA, herein designated VGAM RNA, also designated SEQ ID:3925.

Another function of VGAM1214 is therefore inhibition of PRIC285 (Accession XM_028918). Accordingly, utilities of VGAM1214 include diagnosis, prevention and treatment of diseases and clinical conditions associated with PRIC285. RASD Family, Member 2 (RASD2, Accession NM_014310) is another VGAM1214 host target gene. RASD2 BINDING SITE is HOST TARGET binding site found in the 3' untranslated region of mRNA encoded by RASD2, corresponding to a HOST TARGET binding site such as BINDING SITE I, BINDING SITE II or BINDING SITE III. Table 2 illustrates the complementarity of the nucleotide sequences of RASD2 BINDING SITE, designated SEQ ID:15601, to the nucleotide sequence of VGAM1214 RNA, herein designated VGAM RNA, also designated SEQ ID:3925.

Another function of VGAM1214 is therefore inhibition of RASD Family, Member 2 (RASD2, Accession NM_014310). Accordingly, utilities of VGAM1214 include diagnosis, prevention and treatment of diseases and clinical conditions associated with RASD2. Transmembrane 4 Superfamily Member 11 (plasmolipin) (TM4SF11, Accession NM_015993) is another VGAM1214 host target gene. TM4SF11 BINDING SITE is HOST TARGET binding site found in the 3' untranslated region of mRNA encoded by TM4SF11, corresponding to a HOST TARGET binding site such as BINDING SITE I, BINDING SITE II or BINDING SITE III. Table 2 illustrates the complementarity of the nucleotide sequences of TM4SF11 BINDING SITE, designated SEQ ID:18085, to the nucleotide sequence of VGAM1214 RNA, herein designated VGAM RNA, also designated SEQ ID:3925.

Another function of VGAM1214 is therefore inhibition of Transmembrane 4 Superfamily Member 11 (plasmolipin)

(TM4SF11, Accession NM_015993). Accordingly, utilities of VGAM1214 include diagnosis, prevention and treatment of diseases and clinical conditions associated with TM4SF11. Trinucleotide Repeat Containing 9 (TNRC9, Accession XM_049037) is another VGAM1214 host target gene. TNRC9 BINDING SITE is HOST TARGET binding site found in the 5' untranslated region of mRNA encoded by TNRC9, corresponding to a HOST TARGET binding site such as BINDING SITE I, BINDING SITE II or BINDING SITE III. Table 2 illustrates the complementarity of the nucleotide sequences of TNRC9 BINDING SITE, designated SEQ ID:35321, to the nucleotide sequence of VGAM1214 RNA, herein designated VGAM RNA, also designated SEQ ID:3925.

Another function of VGAM1214 is therefore inhibition of Trinucleotide Repeat Containing 9 (TNRC9, Accession XM_049037). Accordingly, utilities of VGAM1214 include diagnosis, prevention and treatment of diseases and clinical conditions associated with TNRC9. ZNF340 (Accession XM_097701) is another VGAM1214 host target gene. ZNF340 BINDING SITE is HOST TARGET binding site found in the 3' untranslated region of mRNA encoded by ZNF340, corresponding to a HOST TARGET binding site such as BINDING SITE I, BINDING SITE II or BINDING SITE III. Table 2 illustrates the complementarity of the nucleotide sequences of ZNF340 BINDING SITE, designated SEQ ID:41032, to the nucleotide sequence of VGAM1214 RNA, herein designated VGAM RNA, also designated SEQ ID:3925.

Another function of VGAM1214 is therefore inhibition of ZNF340 (Accession XM_097701). Accordingly, utilities of VGAM1214 include diagnosis, prevention and treatment of diseases and clinical conditions associated with ZNF340. LOC127281 (Accession XM_059128) is another VGAM1214 host target gene. LOC127281 BINDING SITE is HOST TARGET binding site found in the 3' untranslated region of mRNA encoded by LOC127281, corresponding to a HOST TARGET binding site such as BINDING SITE I, BINDING SITE II or BINDING SITE III. Table 2 illustrates the complementarity of the nucleotide sequences of LOC127281 BINDING SITE, designated SEQ ID:36890, to the nucleotide sequence of VGAM1214 RNA, herein designated VGAM RNA, also designated SEQ ID:3925.

Another function of VGAM1214 is therefore inhibition of LOC127281 (Accession XM_059128). Accordingly, utilities of VGAM1214 include diagnosis, prevention and treatment of diseases and clinical conditions associated with LOC127281. LOC143153 (Accession XM_084440) is another VGAM1214 host target gene. LOC143153 BINDING SITE is HOST TARGET binding site found in the 3' untranslated region of mRNA encoded by LOC143153, corresponding to a HOST TARGET binding site such as BINDING SITE I, BINDING SITE II or BINDING SITE III. Table 2 illustrates the complementarity of the nucleotide sequences of LOC143153 BINDING SITE, designated SEQ ID:37581, to the nucleotide sequence of VGAM1214 RNA, herein designated VGAM RNA, also designated SEQ ID:3925.

Another function of VGAM1214 is therefore inhibition of LOC143153 (Accession XM_084440). Accordingly, utilities of VGAM1214 include diagnosis, prevention and treatment of diseases and clinical conditions associated with LOC143153. LOC143196 (Accession XM_096389) is another VGAM1214 host target gene. LOC143196 BINDING SITE is HOST TARGET binding site found in the 3' untranslated region of mRNA encoded by LOC143196, corresponding to a HOST TARGET binding site such as BINDING SITE I, BINDING SITE II or BINDING SITE III. Table 2 illustrates the complementarity of the nucleotide sequences of LOC143196 BINDING SITE, designated SEQ ID:40330, to the nucleotide sequence of VGAM1214 RNA, herein designated VGAM RNA, also designated SEQ ID:3925.

Another function of VGAM1214 is therefore inhibition of LOC143196 (Accession XM_096389). Accordingly, utilities of VGAM1214 include diagnosis, prevention and treatment of diseases and clinical conditions associated with LOC143196. LOC144600 (Accession XM_096639) is another VGAM1214 host target gene. LOC144600 BINDING SITE is HOST TARGET binding site found in the 5' untranslated region of mRNA encoded by LOC144600, corresponding to a HOST TARGET binding site such as BINDING SITE I, BINDING SITE II or BINDING SITE III. Table 2 illustrates the complementarity of the nucleotide sequences of LOC144600 BINDING SITE, designated SEQ ID:40448, to the nucleotide sequence of VGAM1214 RNA, herein designated VGAM RNA, also designated SEQ ID:3925.

Another function of VGAM1214 is therefore inhibition of LOC144600 (Accession XM_096639). Accordingly, utilities of VGAM1214 include diagnosis, prevention and treatment of diseases and clinical conditions associated with LOC144600. LOC147093 (Accession XM_097184) is another VGAM1214 host target gene. LOC147093 BINDING SITE is HOST TARGET binding site found in the 3' untranslated region of mRNA encoded by LOC147093, corresponding to a HOST TARGET binding site such as BINDING SITE I, BINDING SITE II or BINDING SITE III. Table 2 illustrates the complementarity of the nucleotide sequences of LOC147093 BINDING SITE, designated SEQ ID:40800, to the nucleotide sequence of VGAM1214 RNA, herein designated VGAM RNA, also designated SEQ ID:3925.

Another function of VGAM1214 is therefore inhibition of LOC147093 (Accession XM_097184). Accordingly, utilities of VGAM1214 include diagnosis, prevention and treatment of diseases and clinical conditions associated with LOC147093. LOC149566 (Accession XM_097670) is another VGAM1214 host target gene. LOC149566 BINDING SITE is HOST TARGET binding site found in the 3' untranslated region of mRNA encoded by LOC149566, corresponding to a HOST TARGET binding site such as BINDING SITE I, BINDING SITE II or BINDING SITE III. Table 2 illustrates the complementarity of the nucleotide sequences of LOC149566 BINDING SITE, designated SEQ ID:41015, to the nucleotide sequence of VGAM1214 RNA, herein designated VGAM RNA, also designated SEQ ID:3925.

Another function of VGAM1214 is therefore inhibition of LOC149566 (Accession XM_097670). Accordingly, utilities of VGAM1214 include diagnosis, prevention and treatment of diseases and clinical conditions associated with LOC149566. LOC151171 (Accession XM_087116) is another VGAM1214 host target gene. LOC151171 BINDING SITE is HOST TARGET binding site found in the 5' untranslated region of mRNA encoded by LOC151171, corresponding to a HOST TARGET binding site such as BINDING SITE I, BINDING SITE II or BINDING SITE III. Table 2 illustrates the complementarity of the nucleotide sequences of LOC151171 BINDING SITE, designated SEQ ID:39066, to the nucleotide sequence of VGAM1214 RNA, herein designated VGAM RNA, also designated SEQ ID:3925.

Another function of VGAM1214 is therefore inhibition of LOC151171 (Accession XM_087116). Accordingly, utilities of VGAM1214 include diagnosis, prevention and treatment of diseases and clinical conditions associated with LOC151171. LOC163682 (Accession XM_099402) is another VGAM1214 host target gene. LOC163682 BINDING SITE is HOST TARGET binding site found in the 3' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42098, to the nucleotide sequence of VGAM1214 RNA, herein designated VGAM RNA, also designated SEQ ID:3925.

Another function of VGAM1214 is therefore inhibition of LOC163682 (Accession XM_099402). Accordingly, utilities of VGAM1214 include diagnosis, prevention and treatment of diseases and clinical conditions associated with LOC163682. LOC164714 (Accession XM_104657) is another VGAM1214 host target gene. LOC164714 BINDING SITE is HOST TARGET binding site found in the 3' untranslated region of mRNA encoded by LOC164714, corresponding to a HOST TARGET binding site such as BINDING SITE I, BINDING SITE II or BINDING SITE III. Table 2 illustrates the complementarity of the nucleotide sequences of LOC164714 BINDING SITE, designated SEQ ID:42183, to the nucleotide sequence of VGAM1214 RNA, herein designated VGAM RNA, also designated SEQ ID:3925.

Another function of VGAM1214 is therefore inhibition of LOC164714 (Accession XM_104657). Accordingly, utilities of VGAM1214 include diagnosis, prevention and treatment of diseases and clinical conditions associated with LOC164714. LOC203260 (Accession XM_114661) is another VGAM1214 host target gene. LOC203260 BINDING SITE is HOST TARGET binding site found in the 3' untranslated region of mRNA encoded by LOC203260, corresponding to a HOST TARGET binding site such as BINDING SITE I, BINDING SITE II or BINDING SITE III. Table 2 illustrates the complementarity of the nucleotide sequences of LOC203260 BINDING SITE, designated SEQ ID:43023, to the nucleotide sequence of VGAM1214 RNA, herein designated VGAM RNA, also designated SEQ ID:3925.

Another function of VGAM1214 is therefore inhibition of LOC203260 (Accession XM_114661). Accordingly, utilities of VGAM1214 include diagnosis, prevention and treatment of diseases and clinical conditions associated with LOC203260. LOC204254 (Accession XM_118581) is another VGAM1214 host target gene. LOC204254 BINDING SITE is HOST TARGET binding site found in the 5' untranslated region of mRNA encoded by LOC204254, corresponding to a HOST TARGET binding site such as BINDING SITE I, BINDING SITE II or BINDING SITE III. Table 2 illustrates the complementarity of the nucleotide sequences of LOC204254 BINDING SITE, designated SEQ ID:43582, to the nucleotide sequence of VGAM1214 RNA, herein designated VGAM RNA, also designated SEQ ID:3925.

Another function of VGAM1214 is therefore inhibition of LOC204254 (Accession XM_118581). Accordingly, utilities of VGAM1214 include diagnosis, prevention and treatment of diseases and clinical conditions associated with LOC204254. LOC205095 (Accession XM_119820) is another VGAM1214 host target gene. LOC205095 BINDING SITE is HOST TARGET binding site found in the 3' untranslated region of mRNA encoded by LOC205095, corresponding to a HOST TARGET binding site such as BINDING SITE I, BINDING SITE II or BINDING SITE III. Table 2 illustrates the complementarity of the nucleotide sequences of LOC205095 BINDING SITE, designated SEQ ID:43602, to the nucleotide sequence of VGAM1214 RNA, herein designated VGAM RNA, also designated SEQ ID:3925.

Another function of VGAM1214 is therefore inhibition of LOC205095 (Accession XM_119820). Accordingly, utilities of VGAM1214 include diagnosis, prevention and treatment of diseases and clinical conditions associated with LOC205095. LOC254617 (Accession XM_173236) is another VGAM1214 host target gene. LOC254617 BINDING SITE is HOST TARGET binding site found in the 5' untranslated region of mRNA encoded by LOC254617, corresponding to a HOST TARGET binding site such as BINDING SITE I, BINDING SITE II or BINDING SITE III. Table 2 illustrates the complementarity of the nucleotide sequences of LOC254617 BINDING SITE, designated SEQ ID:46518, to the nucleotide sequence of VGAM1214 RNA, herein designated VGAM RNA, also designated SEQ ID:3925.

Another function of VGAM1214 is therefore inhibition of LOC254617 (Accession XM_173236). Accordingly, utilities of VGAM1214 include diagnosis, prevention and treatment of diseases and clinical conditions associated with LOC254617. LOC255299 (Accession XM_173564) is another VGAM1214 host target gene. LOC255299 BINDING SITE is HOST TARGET binding site found in the 5' untranslated region of mRNA encoded by LOC255299, corresponding to a HOST TARGET binding site such as BINDING SITE I, BINDING SITE II or BINDING SITE III. Table 2 illustrates the complementarity of the nucleotide sequences of LOC255299 BINDING SITE, designated SEQ ID:46547, to the nucleotide sequence of VGAM1214 RNA, herein designated VGAM RNA, also designated SEQ ID:3925.

Another function of VGAM1214 is therefore inhibition of LOC255299 (Accession XM_173564). Accordingly, utilities of VGAM1214 include diagnosis, prevention and treatment of diseases and clinical conditions associated with LOC255299. LOC256946 (Accession XM_170543) is another VGAM1214 host target gene. LOC256946 BINDING SITE is HOST TARGET binding site found in the 3' untranslated region of mRNA encoded by LOC256946, corresponding to a HOST TARGET binding site such as BINDING SITE I, BINDING SITE II or BINDING SITE III. Table 2 illustrates the complementarity of the nucleotide sequences of LOC256946 BINDING SITE, designated SEQ ID:45360, to the nucleotide sequence of VGAM1214 RNA, herein designated VGAM RNA, also designated SEQ ID:3925.

Another function of VGAM1214 is therefore inhibition of LOC256946 (Accession XM_170543). Accordingly, utilities of VGAM1214 include diagnosis, prevention and treatment of diseases and clinical conditions associated with LOC256946. LOC51152 (Accession NM_016181) is another VGAM1214 host target gene. LOC51152 BINDING SITE is HOST TARGET binding site found in the 3' untranslated region of mRNA encoded by LOC51152, corresponding to a HOST TARGET binding site such as BINDING SITE I, BINDING SITE II or BINDING SITE III. Table 2 illustrates the complementarity of the nucleotide sequences of LOC51152 BINDING SITE, designated SEQ ID:18283, to the nucleotide sequence of VGAM1214 RNA, herein designated VGAM RNA, also designated SEQ ID:3925.

Another function of VGAM1214 is therefore inhibition of LOC51152 (Accession NM_016181). Accordingly, utilities of VGAM1214 include diagnosis, prevention and treatment of diseases and clinical conditions associated with LOC51152. LOC91963 (Accession XM_041902) is another VGAM1214 host target gene. LOC91963 BINDING SITE is HOST TARGET binding site found in the 3' untranslated region of mRNA encoded by LOC91963, corresponding to a HOST TARGET binding site such as BINDING SITE I, BINDING SITE II or BINDING SITE III. Table 2 illustrates the complementarity of the nucleotide sequences of LOC91963 BINDING SITE, designated SEQ ID:33626, to the nucleotide sequence of VGAM1214 RNA, herein designated VGAM RNA, also designated SEQ ID:3925.

Another function of VGAM1214 is therefore inhibition of LOC91963 (Accession XM_041902). Accordingly, utilities of VGAM1214 include diagnosis, prevention and treatment of diseases and clinical conditions associated with LOC91963. LOC92230 (Accession XM_043733) is another VGAM1214 host target gene. LOC92230 BINDING SITE is HOST TARGET binding site found in the 5' untranslated region of mRNA encoded by LOC92230, corresponding to a HOST TARGET binding site such as BINDING SITE I, BINDING SITE II or BINDING SITE III. Table 2 illustrates the complementarity of the nucleotide sequences of LOC92230 BINDING SITE, designated SEQ ID:34006, to the nucleotide sequence of VGAM1214 RNA, herein designated VGAM RNA, also designated SEQ ID:3925.

Another function of VGAM1214 is therefore inhibition of LOC92230 (Accession XM_043733). Accordingly, utilities of VGAM1214 include diagnosis, prevention and treatment of diseases and clinical conditions associated with LOC92230. LOC93259 (Accession XM_050105) is another VGAM1214 host target gene. LOC93259 BINDING SITE is HOST TARGET binding site found in the 5' untranslated region of mRNA encoded by LOC93259, corresponding to a HOST TARGET binding site such as BINDING SITE I, BINDING SITE II or BINDING SITE III. Table 2 illustrates the complementarity of the nucleotide sequences of LOC93259 BINDING SITE, designated SEQ ID:35560, to the nucleotide sequence of VGAM1214 RNA, herein designated VGAM RNA, also designated SEQ ID:3925.

Another function of VGAM1214 is therefore inhibition of LOC93259 (Accession XM_050105). Accordingly, utilities of VGAM1214 include diagnosis, prevention and treatment of diseases and clinical conditions associated with LOC93259. FIG. 1 further provides a conceptual description of a novel bioinformatically detected viral gene of the present invention, referred to here as Viral Genomic Address Messenger 1215 (VGAM1215) viral gene, which modulates expression of respective host target genes thereof, the function and utility of which host target genes is known in the art.

VGAM1215 is a novel bioinformatically detected regulatory, non protein coding, viral micro RNA (miRNA) gene. The method by which VGAM1215 was detected is described hereinabove with reference to FIGS. 1-8.

VGAM1215 gene, herein designated VGAM GENE, is a viral gene contained in the genome of Tupaia Herpesvirus. VGAM1215 host target gene, herein designated VGAM HOST TARGET GENE, is a human gene contained in the human genome.

VGAM1215 gene encodes a VGAM1215 precursor RNA, herein designated VGAM PRECURSOR RNA. Similar to other miRNA genes, and unlike most ordinary genes, VGAM1215 precursor RNA does not encode a protein. A nucleotide sequence identical or highly similar to the nucleotide sequence of VGAM1215 precursor RNA is designated SEQ ID:1201, and is provided hereinbelow with reference to the sequence listing part. Nucleotide sequence SEQ ID:1201 is located at position 188394 relative to the genome of Tupaia Herpesvirus.

VGAM1215 precursor RNA folds onto itself, forming VGAM1215 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1215 folded precursor RNA into VGAM1215 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 68%) nucleotide sequence of VGAM1215 RNA is designated SEQ ID:3926, and is provided hereinbelow with reference to the sequence listing part.

VGAM1215 host target gene, herein designated VGAM HOST TARGET GENE, encodes a corresponding messenger RNA, VGAM1215 host target RNA, herein designated VGAM HOST TARGET RNA. VGAM1215 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1215 RNA, herein designated VGAM RNA, binds complementarily to one or more host target binding sites located in untranslated regions of VGAM1215 host target RNA, herein designated VGAM HOST TARGET RNA. This complementary binding is due to the fact that the nucleotide sequence of VGAM1215 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1215 RNA, herein designated VGAM RNA, may have a different number of host target binding sites in untranslated regions of a VGAM1215 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1215 RNA, herein designated VGAM RNA, to host target binding sites on VGAM1215 host target RNA, herein designated VGAM HOST TARGET RNA, such as BINDING SITE I, BINDING SITE II and BINDING SITE III, inhibits translation of VGAM1215 host target RNA into VGAM1215 host target protein, herein designated VGAM HOST TARGET PROTEIN. VGAM host target protein is therefore outlined by a broken line.

It is appreciated that VGAM1215 host target gene, herein designated VGAM HOST TARGET GENE, in fact represents a plurality of VGAM1215 host target genes. The mRNA of each one of this plurality of VGAM1215 host target genes comprises one or more host target binding sites, each having a nucleotide sequence which is at least partly complementary to VGAM1215 RNA, herein designated VGAM RNA, and which when bound by VGAM1215 RNA causes inhibition of translation of respective one or more VGAM1215 host target proteins.

It is further appreciated by one skilled in the art that the mode of translational inhibition illustrated by FIG. 1 with specific reference to translational inhibition exerted by VGAM1215 gene, herein designated VGAM GENE, on one or more VGAM1215 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1215 is inhibition of expression of host target genes, as part of a novel viral mechanism of attacking a host. Accordingly, utilities of VGAM1215 include diagnosis, prevention and treatment of viral infection by Tupaia Herpesvirus. Specific functions, and accordingly utilities, of VGAM1215 correlate with, and may be deduced from, the identity of the host target genes which VGAM1215 binds and inhibits, and the function of these host target genes, as elaborated hereinbelow.

Nucleotide sequences of the VGAM1215 precursor RNA, herein designated VGAM PRECURSOR RNA, and of the 'diced' VGAM1215 RNA, herein designated VGAM RNA, and a schematic representation of the secondary folding of VGAM1215 folded precursor RNA, herein designated VGAM FOLDED PRECURSOR RNA, of VGAM1215 are further described hereinbelow with reference to Table 1.

Nucleotide sequences of host target binding sites, such as BINDING SITE-I, BINDING SITE-II and BINDING SITE-III of FIG. 1, found on VGAM1215 host target RNA, and schematic representation of the complementarity of each of these host target binding sites to VGAM1215 RNA, herein designated VGAM RNA, are described hereinbelow with reference to Table 2.

As mentioned hereinabove with reference to FIG. 1, a function of VGAM1215 gene, herein designated VGAM is inhibition of expression of VGAM1215 target genes. It is appreciated that specific functions, and accordingly utilities, of VGAM1215 correlate with, and may be deduced from, the identity of the target genes which VGAM1215 binds and inhibits, and the function of these target genes, as elaborated hereinbelow.

Fibromodulin (FMOD, Accession NM_002023) is a VGAM1215 host target gene. FMOD BINDING SITE is HOST TARGET binding site found in the 3' untranslated region of mRNA encoded by FMOD, corresponding to a HOST TARGET binding site such as BINDING SITE I, BINDING SITE II or BINDING SITE III. Table 2 illustrates the complementarity of the nucleotide sequences of FMOD BINDING SITE, designated SEQ ID:7771, to the nucleotide sequence of VGAM1215 RNA, herein designated VGAM RNA, also designated SEQ ID:3926.

A function of VGAM1215 is therefore inhibition of Fibromodulin (FMOD, Accession NM_002023), a gene which affects the rate of fibrils formation. Accordingly, utilities of VGAM1215 include diagnosis, prevention and treatment of diseases and clinical conditions associated with FMOD. The function of FMOD and its association with various diseases and clinical conditions, has been established by previous studies, as described hereinabove with reference to VGAM39. NDRG Family Member 3 (NDRG3, Accession NM_022477) is another VGAM1215 host target gene. NDRG3 BINDING SITE1 and NDRG3 BINDING SITE2 are HOST TARGET binding sites found in untranslated regions of mRNA encoded by NDRG3, corresponding to HOST TARGET binding sites such as BINDING SITE I, BINDING SITE II or BINDING SITE III. Table 2 illustrates the complementarity of the nucleotide sequences of NDRG3 BINDING SITE1 and NDRG3 BINDING SITE2, designated SEQ ID:22846 and SEQ ID:25722 respectively, to the nucleotide sequence of VGAM1215 RNA, herein designated VGAM RNA, also designated SEQ ID:3926.

Another function of VGAM1215 is therefore inhibition of NDRG Family Member 3 (NDRG3, Accession NM_022477). Accordingly, utilities of VGAM1215 include diagnosis, prevention and treatment of diseases and clinical conditions associated with NDRG3. RAB40A, Member RAS Oncogene Family (RAB40A, Accession XM_088733) is another VGAM1215 host target gene. RAB40A BINDING SITE is HOST TARGET binding site found in the 5' untranslated region of mRNA encoded by RAB40A, corresponding to a HOST TARGET binding site such as BINDING SITE I, BINDING SITE II or BINDING SITE III. Table 2 illustrates the complementarity of the nucleotide sequences of RAB40A BINDING SITE, designated SEQ ID:39931, to the nucleotide sequence of VGAM1215 RNA, herein designated VGAM RNA, also designated SEQ ID:3926.

Another function of VGAM1215 is therefore inhibition of RAB40A, Member RAS Oncogene Family (RAB40A, Accession XM_088733). Accordingly, utilities of VGAM1215 include diagnosis, prevention and treatment of diseases and clinical conditions associated with RAB40A. LOC150150 (Accession XM_097820) is another VGAM1215 host target gene. LOC150150 BINDING SITE is HOST TARGET binding site found in the 5' untranslated region of mRNA encoded by LOC150150, corresponding to a HOST TARGET binding site such as BINDING SITE I, BINDING SITE II or BINDING SITE III. Table 2 illustrates the complementarity of the nucleotide sequences of LOC150150 BINDING SITE, designated SEQ ID:41134, to the nucleotide sequence of VGAM1215 RNA, herein designated VGAM RNA, also designated SEQ ID:3926.

Another function of VGAM1215 is therefore inhibition of LOC150150 (Accession XM_097820). Accordingly, utilities of VGAM1215 include diagnosis, prevention and treatment of diseases and clinical conditions associated with LOC150150. FIG. 1 further provides a conceptual description of a novel bioinformatically detected viral gene of the present invention, referred to here as Viral Genomic Address Messenger 1216 (VGAM1216) viral gene, which modulates expression of respective host target genes thereof, the function and utility of which host target genes is known in the art.

VGAM1216 is a novel bioinformatically detected regulatory, non protein coding, viral micro RNA (miRNA) gene. The method by which VGAM1216 was detected is described hereinabove with reference to FIGS. 1-8.

VGAM1216 gene, herein designated VGAM GENE, is a viral gene contained in the genome of Tupaia Herpesvirus. VGAM1216 host target gene, herein designated VGAM HOST TARGET GENE, is a human gene contained in the human genome.

VGAM1216 gene encodes a VGAM1216 precursor RNA, herein designated VGAM PRECURSOR RNA. Similar to other miRNA genes, and unlike most ordinary genes, VGAM1216 precursor RNA does not encode a protein. A nucleotide sequence identical or highly similar to the nucleotide sequence of VGAM1216 precursor RNA is designated SEQ ID:1202, and is provided hereinbelow with reference to the sequence listing part. Nucleotide sequence SEQ ID:1202 is located at position 190154 relative to the genome of Tupaia Herpesvirus.

VGAM1216 precursor RNA folds onto itself, forming VGAM1216 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1216 folded precursor RNA into VGAM1216 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM1216 RNA is designated SEQ ID:3927, and is provided hereinbelow with reference to the sequence listing part.

VGAM1216 host target gene, herein designated VGAM HOST TARGET GENE, encodes a corresponding messenger RNA, VGAM1216 host target RNA, herein designated VGAM HOST TARGET RNA. VGAM1216 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1216 RNA, herein designated VGAM RNA, binds complementarily to one or more host target binding sites located in untranslated regions of VGAM1216 host target RNA, herein designated VGAM HOST TARGET RNA. This complementary binding is due to the fact that the nucleotide sequence of VGAM1216 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1216 RNA, herein designated VGAM RNA, may have a different number of host target binding sites in untranslated regions of a VGAM1216 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1216 RNA, herein designated VGAM RNA, to host target binding sites on VGAM1216 host target RNA, herein designated VGAM HOST TARGET RNA, such as BINDING SITE I, BINDING SITE II and BINDING SITE III, inhibits translation of VGAM1216 host target RNA into VGAM1216 host target protein, herein designated VGAM HOST TARGET PROTEIN. VGAM host target protein is therefore outlined by a broken line.

It is appreciated that VGAM1216 host target gene, herein designated VGAM HOST TARGET GENE, in fact represents a plurality of VGAM1216 host target genes. The mRNA of each one of this plurality of VGAM1216 host target genes comprises one or more host target binding sites, each having a nucleotide sequence which is at least partly complementary to VGAM1216 RNA, herein designated VGAM RNA, and which when bound by VGAM1216 RNA causes inhibition of translation of respective one or more VGAM1216 host target proteins.

It is further appreciated by one skilled in the art that the mode of translational inhibition illustrated by FIG. 1 with specific reference to translational inhibition exerted by VGAM1216 gene, herein designated VGAM GENE, on one or more VGAM1216 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1216 is inhibition of expression of host target genes, as part of a novel viral mechanism of attacking a host. Accordingly, utilities of VGAM1216 include diagnosis, prevention and treatment of viral infection by Tupaia Herpesvirus. Specific functions, and accordingly utilities, of VGAM1216 correlate with, and may be deduced from, the identity of the host target genes which VGAM1216 binds and inhibits, and the function of these host target genes, as elaborated hereinbelow.

Nucleotide sequences of the VGAM1216 precursor RNA, herein designated VGAM PRECURSOR RNA, and of the 'diced' VGAM1216 RNA, herein designated VGAM RNA, and a schematic representation of the secondary folding of VGAM1216 folded precursor RNA, herein designated VGAM FOLDED PRECURSOR RNA, of VGAM1216 are further described hereinbelow with reference to Table 1.

Nucleotide sequences of host target binding sites, such as BINDING SITE-I, BINDING SITE-II and BINDING SITE-III of FIG. 1, found on VGAM1216 host target RNA, and schematic representation of the complementarity of each of these host target binding sites to VGAM1216 RNA, herein designated VGAM RNA, are described hereinbelow with reference to Table 2.

As mentioned hereinabove with reference to FIG. 1, a function of VGAM1216 gene, herein designated VGAM is inhibition of expression of VGAM1216 target genes. It is appreciated that specific functions, and accordingly utilities, of VGAM1216 correlate with, and may be deduced from, the identity of the target genes which VGAM1216 binds and inhibits, and the function of these target genes, as elaborated hereinbelow.

Attractin (ATRN, Accession NM_139321) is a VGAM1216 host target gene. ATRN BINDING SITE is HOST TARGET binding site found in the 3' untranslated region of mRNA encoded by ATRN, corresponding to a HOST TARGET binding site such as BINDING SITE I, BINDING SITE II or BINDING SITE III. Table 2 illustrates the complementarity of the nucleotide sequences of ATRN BINDING SITE, designated SEQ ID:29302, to the nucleotide sequence of VGAM1216 RNA, herein designated VGAM RNA, also designated SEQ ID:3927.

A function of VGAM1216 is therefore inhibition of Attractin (ATRN, Accession NM_139321), a gene which is involved in the initial immune cell clustering during inflammatory response. Accordingly, utilities of VGAM1216 include diagnosis, prevention and treatment of diseases and clinical conditions associated with ATRN. The function of ATRN and its association with various diseases and clinical conditions, has been established by previous studies, as described hereinabove with reference to VGAM53. UDP-Gal:betaGlcNAc Beta 1,3-galactosyltransferase, Polypeptide 5 (B3GALT5, Accession NM_033173) is another VGAM1216 host target gene. B3GALT5 BINDING SITE1 through B3GALT5 BINDING SITE5 are HOST TARGET binding sites found in untranslated regions of mRNA encoded by B3GALT5, corresponding to HOST TARGET binding sites such as BINDING SITE I, BINDING SITE II or BINDING SITE III. Table 2 illustrates the complementarity of the nucleotide sequences of B3GALT5 BINDING SITE1 through B3GALT5 BINDING SITE5, designated SEQ ID:27038, SEQ ID:27023, SEQ ID:27028, SEQ ID:27033 and SEQ ID:12700 respectively, to the nucleotide sequence of VGAM1216 RNA, herein designated VGAM RNA, also designated SEQ ID:3927.

Another function of VGAM1216 is therefore inhibition of UDP-Gal:betaGlcNAc Beta 1,3-galactosyltransferase, Polypeptide 5 (B3GALT5, Accession NM_033173). Accordingly, utilities of VGAM1216 include diagnosis, prevention and treatment of diseases and clinical conditions associated with B3GALT5. Chromosome Condensation 1-like (CHC1L, Accession NM_001268) is another VGAM1216 host target gene. CHC1L BINDING SITE is HOST TARGET binding site found in the 3' untranslated region of mRNA encoded by CHC1L, corresponding to a HOST TARGET binding site such as BINDING SITE I, BINDING SITE II or BINDING SITE III. Table 2 illustrates the complementarity of the nucleotide sequences of CHC1L BINDING SITE, designated SEQ ID:6929, to the nucleotide sequence of VGAM1216 RNA, herein designated VGAM RNA, also designated SEQ ID:3927.

Another function of VGAM1216 is therefore inhibition of Chromosome Condensation 1-like (CHC1L, Accession NM_001268). Accordingly, utilities of VGAM1216 include diagnosis, prevention and treatment of diseases and clinical conditions associated with CHC1L. Cystinosis, Nephropathic (CTNS, Accession NM_004937) is another VGAM1216 host target gene. CTNS BINDING SITE is HOST TARGET binding site found in the 3' untranslated region of mRNA encoded by CTNS, corresponding to a HOST TARGET binding site such as BINDING SITE I, BINDING SITE II or BINDING SITE III. Table 2 illustrates the complementarity of the nucleotide sequences of CTNS BINDING SITE, designated SEQ ID:11385, to the nucleotide sequence of VGAM1216 RNA, herein designated VGAM RNA, also designated SEQ ID:3927.

Another function of VGAM1216 is therefore inhibition of Cystinosis, Nephropathic (CTNS, Accession NM_004937). Accordingly, utilities of VGAM1216 include diagnosis, prevention and treatment of diseases and clinical conditions associated with CTNS. Cytochrome P450, Subfamily IIIA, Polypeptide 43 (CYP3A43, Accession NM_057096) is another VGAM1216 host target gene. CYP3A43 BINDING SITE is HOST TARGET binding site found in the 3' untranslated region of mRNA encoded by CYP3A43, corresponding to a HOST TARGET binding site such as BINDING SITE I, BINDING SITE II or BINDING SITE III. Table 2 illustrates the complementarity of the nucleotide sequences of CYP3A43 BINDING SITE, designated SEQ ID:27663, to the nucleotide sequence of VGAM1216 RNA, herein designated VGAM RNA, also designated SEQ ID:3927.

Another function of VGAM1216 is therefore inhibition of Cytochrome P450, Subfamily IIIA, Polypeptide 43 (CYP3A43, Accession NM_057096), a gene which may be involved in the metabolism of insect hormones and in the breakdown of synthetic insecticides. Accordingly, utilities of VGAM1216 include diagnosis, prevention and treatment of diseases and clinical conditions associated with CYP3A43. The function of CYP3A43 has been established by previous studies. By use of PCR on liver cDNA and 3-prime RACE, Domanski et al. (2001) isolated a cDNA encoding CYP3A43, a novel cytochrome P450 IIIA isoform. Sequence analysis predicted that the 503-amino acid protein differs from the other forms at the N terminus as well as at 2 C-terminal conserved sites and 4 sites that are important for the regioselectivity of steroid hydroxylation. RNA dot-blot analysis detected only weak expression in liver, whereas PCR of cDNA panels found expression in liver, kidney, pancreas, and prostate as well as fetal liver and fetal skeletal muscle. SDS-PAGE and Western blot analysis showed expression of an approximately 55-kD protein. Functional analysis indicated that, under appropriate conditions, CYP3A43 exhibits low but reproducible testosterone 6-beta-hydroxylase activity. Gellner et al. (2001) found the highest expression level of CYP3A43 mRNA in prostate, an organ with extensive steroid metabolism. It was also expressed in several other tissues including liver, where it could be induced by rifampicin. By EST database searching and 5-prime RACE, Westlind et al. (2001) also obtained a cDNA encoding CYP3A43. The deduced protein is 76%, 76%, and 72% identical to CYP3A4, CYP3A5, and CYP3A7, respectively. Real-time PCR in 10 different livers revealed that CYP3A43 is expressed at 0.1% and 2% of the levels of CYP3A4 and CYP3A5.

Full details of the abovementioned studies are described in the following publications, the disclosure of which are hereby incorporated by reference:

Gellner, K.; Eiselt, R.; Hustert, E.; Arnold, H.; Koch, I.; Haberl, M.; Deglmann, C. J.; Burk, O.; Buntefuss, D.; Escher, S.; Bishop, C.; Koebe, H.-G.; Brinkmann, U.; Klenk, H.-P.; Kleine, K.; Meyer, U. A.; Wojnowski, L.: Genomic organization of the human CYP3A locus: identification of a new, inducible CYP3A gene. Pharmacogenetics 11:111-121, 2001; and Westlind, A.; Malmebo, S.; Johansson, I.; Otter, C.; Andersson, T. B.; Ingelman-Sundberg, M.; Oscarson, M.: Cloning and tissue distribution of a novel human cytochrome P450 of the CYP3.

Further studies establishing the function and utilities of CYP3A43 are found in John Hopkins OMIM database record ID 606534, and in sited publications numbered 6463-6465 listed in the bibliography section hereinbelow, which are also hereby incorporated by reference. Dystrobrevin, Alpha (DTNA, Accession NM_001391) is another VGAM1216 host target gene. DTNA BINDING SITE1 through DTNA BINDING SITE4 are HOST TARGET binding sites found in untranslated regions of mRNA encoded by DTNA, corresponding to HOST TARGET binding sites such as BINDING SITE I, BINDING SITE II or BINDING SITE III. Table 2 illustrates the complementarity of the nucleotide sequences of DTNA BINDING SITE1 through DTNA BINDING SITE4, designated SEQ ID:7084, SEQ ID:26841, SEQ ID:26851 and SEQ ID:26846 respectively, to the nucleotide sequence of VGAM1216 RNA, herein designated VGAM RNA, also designated SEQ ID:3927.

Another function of VGAM1216 is therefore inhibition of Dystrobrevin, Alpha (DTNA, Accession NM_001391), a gene which may be involved in the formation and stability of synapses. Accordingly, utilities of VGAM1216 include diagnosis, prevention and treatment of diseases and clinical conditions associated with DTNA. The function of DTNA and its association with various diseases and clinical conditions, has been established by previous studies, as described hereinabove with reference to VGAM1021. Fibroblast Growth Factor 2 (basic) (FGF2, Accession NM_002006) is another VGAM1216 host target gene. FGF2 BINDING SITE is HOST TARGET binding site found in the 3' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7738, to the nucleotide sequence of VGAM1216 RNA, herein designated VGAM RNA, also designated SEQ ID:3927.

Another function of VGAM1216 is therefore inhibition of Fibroblast Growth Factor 2 (basic) (FGF2, Accession NM_002006), a gene which probably involved in nervous system development and function. Accordingly, utilities of VGAM1216 include diagnosis, prevention and treatment of diseases and clinical conditions associated with FGF2. The function of FGF2 and its association with various diseases and clinical conditions, has been established by previous studies, as described hereinabove with reference to VGAM51. Gamma-aminobutyric Acid (GABA) A Receptor, Epsilon (GABRE, Accession NM_021990) is another VGAM1216 host target gene. GABRE BINDING SITE1 through GABRE BINDING SITE4 are HOST TARGET binding sites found in untranslated regions of mRNA encoded by GABRE, corresponding to HOST TARGET binding sites such as BINDING SITE I, BINDING SITE II or BINDING SITE III. Table 2 illustrates the complementarity of the nucleotide sequences of GABRE BINDING SITE1 through GABRE BINDING SITE4, designated SEQ ID:22533, SEQ ID:22511, SEQ ID:22515 and SEQ ID:11409 respectively, to the nucleotide sequence of VGAM1216 RNA, herein designated VGAM RNA, also designated SEQ ID:3927.

Another function of VGAM1216 is therefore inhibition of Gamma-aminobutyric Acid (GABA) A Receptor, Epsilon (GABRE, Accession NM_021990), a gene which mediates neuronal inhibition by binding to the gaba/benzodiazepine receptor and opening an integral chloride channel. Accordingly, utilities of VGAM1216 include diagnosis, prevention and treatment of diseases and clinical conditions associated with GABRE. The function of GABRE and its association with various diseases and clinical conditions, has been established by previous studies, as described hereinabove with reference to VGAM259. Transforming Growth Factor, Beta Receptor III (betaglycan, 300 kDa) (TGFBR3, Accession NM_003243) is another VGAM1216 host target gene. TGFBR3 BINDING SITE is HOST TARGET binding site found in the 3' untranslated region of mRNA encoded by TGFBR3, corresponding to a HOST TARGET binding site such as BINDING SITE I, BINDING SITE II or BINDING SITE III. Table 2 illustrates the complementarity of the nucleotide sequences of TGFBR3 BINDING SITE, designated SEQ ID:9249, to the nucleotide sequence of VGAM1216 RNA, herein designated VGAM RNA, also designated SEQ ID:3927.

Another function of VGAM1216 is therefore inhibition of Transforming Growth Factor, Beta Receptor III (betaglycan, 300 kDa) (TGFBR3, Accession NM_003243), a gene which involves in capturing and retaining TGF-beta for presentation to the signaling receptors. Accordingly, utilities of VGAM1216 include diagnosis, prevention and treatment of diseases and clinical conditions associated with TGFBR3. The function of TGFBR3 and its association with various diseases and clinical conditions, has been established by previous studies, as described hereinabove with reference to VGAM139. Adenylate Kinase 5 (AK5, Accession NM_012093) is another VGAM1216 host target gene. AK5 BINDING SITE is HOST TARGET binding site found in the 3' untranslated region of mRNA encoded by AK5, corresponding to a HOST TARGET binding site such as BINDING SITE I, BINDING SITE II or BINDING SITE III. Table 2 illustrates the complementarity of the nucleotide sequences of AK5 BINDING SITE, designated SEQ ID:14395, to the nucleotide sequence of VGAM1216 RNA, herein designated VGAM RNA, also designated SEQ ID:3927.

Another function of VGAM1216 is therefore inhibition of Adenylate Kinase 5 (AK5, Accession NM_012093). Accordingly, utilities of VGAM1216 include diagnosis, prevention and treatment of diseases and clinical conditions associated with AK5. Basic Helix-loop-helix Domain Containing, Class B, 2 (BHLHB2, Accession NM_003670) is another VGAM1216 host target gene. BHLHB2 BINDING SITE is HOST TARGET binding site found in the 3' untranslated region of mRNA encoded by BHLHB2, corresponding to a HOST TARGET binding site such as BINDING SITE I, BINDING SITE II or BINDING SITE III. Table 2 illustrates the complementarity of the nucleotide sequences of BHLHB2 BINDING SITE, designated SEQ ID:9755, to the nucleotide sequence of VGAM1216 RNA, herein designated VGAM RNA, also designated SEQ ID:3927.

Another function of VGAM1216 is therefore inhibition of Basic Helix-loop-helix Domain Containing, Class B, 2 (BHLHB2, Accession NM_003670). Accordingly, utilities of VGAM1216 include diagnosis, prevention and treatment of diseases and clinical conditions associated with BHLHB2. Chromosome 20 Open Reading Frame 139 (C20orf139, Accession XM_097749) is another VGAM1216 host target gene. C20orf139 BINDING SITE is HOST TARGET binding site found in the 3" untranslated region of mRNA encoded by C20orf139, corresponding to a HOST TARGET binding site such as BINDING SITE I, BINDING SITE II or BINDING SITE III. Table 2 illustrates the complementarity of the nucleotide sequences of C20orf139 BINDING SITE, designated SEQ ID:41108, to the nucleotide sequence of VGAM1216 RNA, herein designated VGAM RNA, also designated SEQ ID:3927.

Another function of VGAM1216 is therefore inhibition of Chromosome 20 Open Reading Frame 139 (C20orf139, Accession XM_097749). Accordingly, utilities of VGAM1216 include diagnosis, prevention and treatment of diseases and clinical conditions associated with C20orf139. FLJ13782 (Accession NM_024915) is another VGAM1216 host target gene. FLJ13782 BINDING SITE is HOST TARGET binding site found in the 3' untranslated region of mRNA encoded by FLJ13782, corresponding to a HOST TARGET binding site such as BINDING SITE I, BINDING SITE II or BINDING SITE III. Table 2 illustrates the complementarity of the nucleotide sequences of FLJ13782 BINDING SITE, designated SEQ ID:24435, to the nucleotide sequence of VGAM1216 RNA, herein designated VGAM RNA, also designated SEQ ID:3927.

Another function of VGAM1216 is therefore inhibition of FLJ13782 (Accession NM_024915). Accordingly, utilities of VGAM1216 include diagnosis, prevention and treatment of diseases and clinical conditions associated with FLJ13782. FLJ20151 (Accession NM_017689) is another VGAM1216 host target gene. FLJ20151 BINDING SITE is HOST TARGET binding site found in the 3' untranslated region of mRNA encoded by FLJ20151, corresponding to a HOST TARGET binding site such as BINDING SITE I, BINDING SITE II or BINDING SITE III. Table 2 illustrates the complementarity of the nucleotide sequences of FLJ20151 BINDING SITE, designated SEQ ID:19245, to the nucleotide sequence of VGAM1216 RNA, herein designated VGAM RNA, also designated SEQ ID:3927.

Another function of VGAM1216 is therefore inhibition of FLJ20151 (Accession NM_017689). Accordingly, utilities of VGAM1216 include diagnosis, prevention and treatment of diseases and clinical conditions associated with FLJ20151. FLJ22329 (Accession NM_024656) is another VGAM1216 host target gene. FLJ22329 BINDING SITE is HOST TARGET binding site found in the 3' untranslated region of mRNA encoded by FLJ22329, corresponding to a HOST TARGET binding site such as BINDING SITE I, BINDING SITE II or BINDING SITE III. Table 2 illustrates the complementarity of the nucleotide sequences of FLJ22329 BINDING SITE, designated SEQ ID:23959, to the nucleotide sequence of VGAM1216 RNA, herein designated VGAM RNA, also designated SEQ ID:3927.

Another function of VGAM1216 is therefore inhibition of FLJ22329 (Accession NM_024656). Accordingly, utilities of VGAM1216 include diagnosis, prevention and treatment of diseases and clinical conditions associated with FLJ22329. HTCD37 (Accession XM_041884) is another VGAM1216 host target gene. HTCD37 BINDING SITE is HOST TARGET binding site found in the 3' untranslated region of mRNA encoded by HTCD37, corresponding to a HOST TARGET binding site such as BINDING SITE I, BINDING SITE II or BINDING SITE III. Table 2 illustrates the complementarity of the nucleotide sequences of HTCD37 BINDING SITE, designated SEQ ID:33619, to the nucleotide sequence of VGAM1216 RNA, herein designated VGAM RNA, also designated SEQ ID:3927.

Another function of VGAM1216 is therefore inhibition of HTCD37 (Accession XM_041884). Accordingly, utilities of VGAM1216 include diagnosis, prevention and treatment of diseases and clinical conditions associated with HTCD37. KIAA0295 (Accession XM_042833) is another VGAM1216 host target gene. KIAA0295 BINDING SITE is HOST TARGET binding site found in the 3' untranslated region of mRNA encoded by KIAA0295, corresponding to a HOST TARGET binding site such as BINDING SITE I, BINDING SITE II or BINDING SITE III. Table 2 illustrates the complementarity of the nucleotide sequences of KIAA0295 BINDING SITE, designated SEQ ID:33784, to the nucleotide sequence of VGAM1216 RNA, herein designated VGAM RNA, also designated SEQ ID:3927.

Another function of VGAM1216 is therefore inhibition of KIAA0295 (Accession XM_042833). Accordingly, utilities of VGAM1216 include diagnosis, prevention and treatment of diseases and clinical conditions associated with KIAA0295. KIAA0483 (Accession NM_015176) is another VGAM1216 host target gene. KIAA0483 BINDING SITE1 and KIAA0483 BINDING SITE2 are HOST TARGET binding sites found in untranslated regions of mRNA encoded by KIAA0483, corresponding to HOST TARGET binding sites such as BINDING SITE I, BINDING SITE II or BINDING SITE III. Table 2 illustrates the complementarity of the nucleotide sequences of KIAA0483 BINDING SITE1 and KIAA0483 BINDING SITE2, designated SEQ ID:17529 and SEQ ID:17527 respectively, to the nucleotide sequence of VGAM1216 RNA, herein designated VGAM RNA, also designated SEQ ID:3927.

Another function of VGAM1216 is therefore inhibition of KIAA0483 (Accession NM_015176). Accordingly, utilities of VGAM1216 include diagnosis, prevention and treatment of diseases and clinical conditions associated with KIAA0483. KIAA0934 (Accession XM_034536) is another VGAM1216 host target gene. KIAA0934 BINDING SITE is HOST TARGET binding site found in the 3' untranslated region of mRNA encoded by KIAA0934, corresponding to a HOST TARGET binding site such as BINDING SITE I, BINDING SITE II or BINDING SITE III. Table 2 illustrates the complementarity of the nucleotide sequences of KIAA0934 BINDING SITE, designated SEQ ID:32120, to the nucleotide sequence of VGAM1216 RNA, herein designated VGAM RNA, also designated SEQ ID:3927.

Another function of VGAM1216 is therefore inhibition of KIAA0934 (Accession XM_034536). Accordingly, utilities of VGAM1216 include diagnosis, prevention and treatment of diseases and clinical conditions associated with KIAA0934. KIAA1522 (Accession XM_036299) is another VGAM1216 host target gene. KIAA1522 BINDING SITE is HOST TARGET binding site found in the 3' untranslated region of mRNA encoded by KIAA1522, corresponding to a HOST TARGET binding site such as BINDING SITE I, BINDING SITE II or BINDING SITE III. Table 2 illustrates the complementarity of the nucleotide sequences of KIAA1522 BINDING SITE, designated SEQ ID:32416, to the nucleotide sequence of VGAM1216 RNA, herein designated VGAM RNA, also designated SEQ ID:3927.

Another function of VGAM1216 is therefore inhibition of KIAA1522 (Accession XM_036299). Accordingly, utilities of VGAM1216 include diagnosis, prevention and treatment of diseases and clinical conditions associated with KIAA1522. KIAA1530 (Accession XM_042661) is another VGAM1216 host target gene. KIAA1530 BINDING SITE is HOST TARGET binding site found in the 3' untranslated region of mRNA encoded by KIAA1530, corresponding to a HOST TARGET binding site such as BINDING SITE I, BINDING SITE II or BINDING SITE III. Table 2 illustrates the complementarity of the nucleotide sequences of KIAA1530 BINDING SITE, designated SEQ ID:33731, to the nucleotide sequence of VGAM1216 RNA, herein designated VGAM RNA, also designated SEQ ID:3927.

Another function of VGAM1216 is therefore inhibition of KIAA1530 (Accession XM_042661). Accordingly, utilities of VGAM1216 include diagnosis, prevention and treatment of diseases and clinical conditions associated with KIAA1530. KIAA1908 (Accession XM_055834) is another VGAM1216 host target gene. KIAA1908 BINDING SITE is HOST TARGET binding site found in the 5' untranslated region of mRNA encoded by KIAA1908, corresponding to a HOST TARGET binding site such as BINDING SITE I, BINDING SITE II or BINDING SITE III. Table 2 illustrates the complementarity of the nucleotide sequences of KIAA1908 BINDING SITE, designated SEQ ID:36332, to the nucleotide sequence of VGAM1216 RNA, herein designated VGAM RNA, also designated SEQ ID:3927.

Another function of VGAM1216 is therefore inhibition of KIAA1908 (Accession XM_055834). Accordingly, utilities of VGAM1216 include diagnosis, prevention and treatment of diseases and clinical conditions associated with KIAA1908. MKP-7 (Accession XM_039106) is another VGAM1216 host target gene. MKP-7 BINDING SITE is HOST TARGET binding site found in the 3' untranslated region of mRNA encoded by MKP-7, corresponding to a HOST TARGET binding site such as BINDING SITE I, BINDING SITE II or BINDING SITE III. Table 2 illustrates the complementarity of the nucleotide sequences of MKP-7 BINDING SITE, designated SEQ ID:33005, to the nucleotide sequence of VGAM1216 RNA, herein designated VGAM RNA, also designated SEQ ID:3927.

Another function of VGAM1216 is therefore inhibition of MKP-7 (Accession XM_039106). Accordingly, utilities of VGAM1216 include diagnosis, prevention and treatment of diseases and clinical conditions associated with MKP-7. Nuclear Receptor Coactivator 2 (NCOA2, Accession NM_006540) is another VGAM1216 host target gene. NCOA2 BINDING SITE is HOST TARGET binding site found in the 3' untranslated region of mRNA encoded by NCOA2, corresponding to a HOST TARGET binding site such as BINDING SITE I, BINDING SITE II or BINDING SITE III. Table 2 illustrates the complementarity of the nucleotide sequences of NCOA2 BINDING SITE, designated SEQ ID:13296, to the nucleotide sequence of VGAM1216 RNA, herein designated VGAM RNA, also designated SEQ ID:3927.

Another function of VGAM1216 is therefore inhibition of Nuclear Receptor Coactivator 2 (NCOA2, Accession NM_006540). Accordingly, utilities of VGAM1216 include diagnosis, prevention and treatment of diseases and clinical conditions associated with NCOA2. Protein Kinase C and Casein Kinase Substrate In Neurons 2 (PACSIN2, Accession NM_007229) is another VGAM1216 host target gene. PACSIN2 BINDING SITE is HOST TARGET binding site found in the 3' untranslated region of mRNA encoded by PACSIN2, corresponding to a HOST TARGET binding site such as BINDING SITE I, BINDING SITE II or BINDING SITE III. Table 2 illustrates the complementarity of the nucleotide sequences of PACSIN2 BINDING SITE, designated SEQ ID:14098, to the nucleotide sequence of VGAM1216 RNA, herein designated VGAM RNA, also designated SEQ ID:3927.

Another function of VGAM1216 is therefore inhibition of Protein Kinase C and Casein Kinase Substrate In Neurons 2 (PACSIN2, Accession NM_007229). Accordingly, utilities of VGAM1216 include diagnosis, prevention and treatment of diseases and clinical conditions associated with PACSIN2. Phosphodiesterase 4D Interacting Protein (myomegalin) (PDE4DIP, Accession XM_170929) is another VGAM1216 host target gene. PDE4DIP BINDING SITE is HOST TARGET binding site found in the 3' untranslated region of mRNA encoded by PDE4DIP, corresponding to a HOST TARGET binding site such as BINDING SITE I, BINDING SITE II or BINDING SITE III. Table 2 illustrates the complementarity of the nucleotide sequences of PDE4DIP BINDING SITE, designated SEQ ID:45709, to the nucleotide sequence of VGAM1216 RNA, herein designated VGAM RNA, also designated SEQ ID:3927.

Another function of VGAM1216 is therefore inhibition of Phosphodiesterase 4D Interacting Protein (myomegalin) (PDE4DIP, Accession XM_170929). Accordingly, utilities of VGAM1216 include diagnosis, prevention and treatment of diseases and clinical conditions associated with PDE4DIP. Serine Hydrolase-like (SERHL, Accession XM_170987) is another VGAM1216 host target gene. SERHL BINDING SITE is HOST TARGET binding site found in the 3' untranslated region of mRNA encoded by SERHL, corresponding to a HOST TARGET binding site such as BINDING SITE I, BINDING SITE II or BINDING SITE III. Table 2 illustrates the complementarity of the nucleotide sequences of SERHL BINDING SITE, designated SEQ ID:45758, to the nucleotide sequence of VGAM1216 RNA, herein designated VGAM RNA, also designated SEQ ID:3927.

Another function of VGAM1216 is therefore inhibition of Serine Hydrolase-like (SERHL, Accession XM_170987). Accordingly, utilities of VGAM1216 include diagnosis, prevention and treatment of diseases and clinical conditions associated with SERHL. UMP-CMPK (Accession NM_016308) is another VGAM1216 host target gene. UMP-CMPK BINDING SITE is HOST TARGET binding site found in the 3' untranslated region of mRNA encoded by UMP-CMPK, corresponding to a HOST TARGET binding site such as BINDING SITE I, BINDING SITE II or BINDING SITE III. Table 2 illustrates the complementarity of the nucleotide sequences of UMP-CMPK BINDING SITE, designated SEQ ID:18428, to the nucleotide sequence of VGAM1216 RNA, herein designated VGAM RNA, also designated SEQ ID:3927.

Another function of VGAM1216 is therefore inhibition of UMP-CMPK (Accession NM_016308). Accordingly, utilities of VGAM1216 include diagnosis, prevention and treatment of diseases and clinical conditions associated with UMP-CMPK. Ubiquitin Specific Protease 22 (USP22, Accession XM_042698) is another VGAM1216 host target gene. USP22 BINDING SITE is HOST TARGET binding site found in the 3' untranslated region of mRNA encoded by USP22, corresponding to a HOST TARGET binding site such as BINDING SITE I, BINDING SITE II or BINDING SITE III. Table 2 illustrates the complementarity of the nucleotide sequences of USP22 BINDING SITE, designated SEQ ID:33753, to the nucleotide sequence of VGAM1216 RNA, herein designated VGAM RNA, also designated SEQ ID:3927.

Another function of VGAM1216 is therefore inhibition of Ubiquitin Specific Protease 22 (USP22, Accession XM_042698). Accordingly, utilities of VGAM1216 include diagnosis, prevention and treatment of diseases and clinical conditions associated with USP22. LOC128954 (Accession XM_066252) is another VGAM1216 host target gene. LOC128954 BINDING SITE is HOST TARGET binding site found in the 5' untranslated region of mRNA encoded by LOC128954, corresponding to a HOST TARGET binding site such as BINDING SITE I, BINDING SITE II or BINDING SITE III. Table 2 illustrates the complementarity of the nucleotide sequences of LOC128954 BINDING SITE, designated SEQ ID:37321, to the nucleotide sequence of VGAM1216 RNA, herein designated VGAM RNA, also designated SEQ ID:3927.

Another function of VGAM1216 is therefore inhibition of LOC128954 (Accession XM_066252). Accordingly, utilities of VGAM1216 include diagnosis, prevention and treatment of diseases and clinical conditions associated with LOC128954. LOC133926 (Accession XM_059674) is another VGAM1216 host target gene. LOC133926 BINDING SITE is HOST TARGET binding site found in the 3' untranslated region of mRNA encoded by LOC133926, corresponding to a HOST TARGET binding site such as BINDING SITE I, BINDING SITE II or BINDING SITE III. Table 2 illustrates the complementarity of the nucleotide sequences of LOC133926 BINDING SITE, designated SEQ ID:37060, to the nucleotide sequence of VGAM1216 RNA, herein designated VGAM RNA, also designated SEQ ID:3927.

Another function of VGAM1216 is therefore inhibition of LOC133926 (Accession XM_059674). Accordingly, utilities of VGAM1216 include diagnosis, prevention and treatment of diseases and clinical conditions associated with LOC133926. LOC146756 (Accession XM_097085) is another VGAM1216 host target gene. LOC146756 BINDING SITE is HOST TARGET binding site found in the 3' untranslated region of mRNA encoded by LOC146756, corresponding to a HOST TARGET binding site such as BINDING SITE I, BINDING SITE II or BINDING SITE III. Table 2 illustrates the complementarity of the nucleotide sequences of LOC146756 BINDING SITE, designated SEQ ID:40734, to the nucleotide sequence of VGAM1216 RNA, herein designated VGAM RNA, also designated SEQ ID:3927.

Another function of VGAM1216 is therefore inhibition of LOC146756 (Accession XM_097085). Accordingly, utilities of VGAM1216 include diagnosis, prevention and treatment of diseases and clinical conditions associated with LOC146756. LOC147632 (Accession NM_138478) is another VGAM1216 host target gene. LOC147632 BINDING SITE is HOST TARGET binding site found in the 5' untranslated region of mRNA encoded by LOC147632, corresponding to a HOST TARGET binding site such as BINDING SITE I, BINDING SITE II or BINDING SITE III. Table 2 illustrates the complementarity of the nucleotide sequences of LOC147632 BINDING SITE, designated SEQ ID:28827, to the nucleotide sequence of VGAM1216 RNA, herein designated VGAM RNA, also designated SEQ ID:3927.

Another function of VGAM1216 is therefore inhibition of LOC147632 (Accession NM_138478). Accordingly, utilities of VGAM1216 include diagnosis, prevention and treatment of diseases and clinical conditions associated with LOC147632. LOC152343 (Accession XM_087441) is another VGAM1216 host target gene. LOC152343 BINDING SITE is HOST TARGET binding site found in the 3' untranslated region of mRNA encoded by LOC152343, corresponding to a HOST TARGET binding site such as BINDING SITE I, BINDING SITE II or BINDING SITE III. Table 2 illustrates the complementarity of the nucleotide sequences of LOC152343 BINDING SITE, designated SEQ ID:39263, to the nucleotide sequence of VGAM1216 RNA, herein designated VGAM RNA, also designated SEQ ID:3927.

Another function of VGAM1216 is therefore inhibition of LOC152343 (Accession XM_087441). Accordingly, utilities of VGAM1216 include diagnosis, prevention and treatment of diseases and clinical conditions associated with LOC152343. LOC220514 (Accession XM_017498) is another VGAM1216 host target gene. LOC220514 BINDING SITE is HOST TARGET binding site found in the 3' untranslated region of mRNA encoded by LOC220514, corresponding to a HOST TARGET binding site such as BINDING SITE I, BINDING SITE II or BINDING SITE III. Table 2 illustrates the complementarity of the nucleotide sequences of LOC220514 BINDING SITE, designated SEQ ID:30322, to the nucleotide sequence of VGAM1216 RNA, herein designated VGAM RNA, also designated SEQ ID:3927.

Another function of VGAM1216 is therefore inhibition of LOC220514 (Accession XM_017498). Accordingly, utilities of VGAM1216 include diagnosis, prevention and treatment of diseases and clinical conditions associated with LOC220514. LOC254015 (Accession XM_172977) is another VGAM1216 host target gene. LOC254015 BINDING SITE is HOST TARGET binding site found in the 3' untranslated region of mRNA encoded by LOC254015, corresponding to a HOST TARGET binding site such as BINDING SITE I, BINDING SITE II or BINDING SITE III. Table 2 illustrates the complementarity of the nucleotide sequences of LOC254015 BINDING SITE, designated SEQ ID:46242, to the nucleotide sequence of VGAM1216 RNA, herein designated VGAM RNA, also designated SEQ ID:3927.

Another function of VGAM1216 is therefore inhibition of LOC254015 (Accession XM_172977). Accordingly, utilities of VGAM1216 include diagnosis, prevention and treatment of diseases and clinical conditions associated with LOC254015. LOC257464 (Accession XM_116972) is another VGAM1216 host target gene. LOC257464 BINDING SITE is HOST TARGET binding site found in the 3' untranslated region of mRNA encoded by LOC257464, corresponding to a HOST TARGET binding site such as BINDING SITE I, BINDING SITE II or BINDING SITE III. Table 2 illustrates the complementarity of the nucleotide sequences of LOC257464 BINDING SITE, designated SEQ ID:43169, to the nucleotide sequence of VGAM1216 RNA, herein designated VGAM RNA, also designated SEQ ID:3927.

Another function of VGAM1216 is therefore inhibition of LOC257464 (Accession XM_116972). Accordingly, utilities of VGAM1216 include diagnosis, prevention and treatment of diseases and clinical conditions associated with LOC257464. LOC91813 (Accession XM_040862) is another VGAM1216 host target gene. LOC91813 BINDING SITE is HOST TARGET binding site found in the 5' untranslated region of mRNA encoded by LOC91813, corresponding to a HOST TARGET binding site such as BINDING SITE I, BINDING SITE II or BINDING SITE III. Table 2 illustrates the complementarity of the nucleotide sequences of LOC91813 BINDING SITE, designated SEQ ID:33398, to the nucleotide sequence of VGAM1216 RNA, herein designated VGAM RNA, also designated SEQ ID:3927.

Another function of VGAM1216 is therefore inhibition of LOC91813 (Accession XM_040862). Accordingly, utilities of VGAM1216 include diagnosis, prevention and treatment of diseases and clinical conditions associated with LOC91813. LOC92181 (Accession XM_043394) is another VGAM1216 host target gene. LOC92181 BINDING SITE is HOST TARGET binding site found in the 3' untranslated region of mRNA encoded by LOC92181, corresponding to a HOST TARGET binding site such as BINDING SITE I, BINDING SITE II or BINDING SITE III. Table 2 illustrates the complementarity of the nucleotide sequences of LOC92181 BINDING SITE, designated SEQ ID:33944, to the nucleotide sequence of VGAM1216 RNA, herein designated VGAM RNA, also designated SEQ ID:3927.

Another function of VGAM1216 is therefore inhibition of LOC92181 (Accession XM_043394). Accordingly, utilities of VGAM1216 include diagnosis, prevention and treatment of diseases and clinical conditions associated with LOC92181. FIG. 1 further provides a conceptual description of a novel bioinformatically detected viral gene of the present invention, referred to here as Viral Genomic Address Messenger 1217 (VGAM1217) viral gene, which modulates expression of respective host target genes thereof, the function and utility of which host target genes is known in the art.

VGAM1217 is a novel bioinformatically detected regulatory, non protein coding, viral micro RNA (miRNA) gene. The method by which VGAM1217 was detected is described hereinabove with reference to FIGS. 1-8.

VGAM1217 gene, herein designated VGAM GENE, is a viral gene contained in the genome of Tupaia Herpesvirus. VGAM1217 host target gene, herein designated VGAM HOST TARGET GENE, is a human gene contained in the human genome.

VGAM1217 gene encodes a VGAM1217 precursor RNA, herein designated VGAM PRECURSOR RNA. Similar to other miRNA genes, and unlike most ordinary genes, VGAM1217 precursor RNA does not encode a protein. A nucleotide sequence identical or highly similar to the nucleotide sequence of VGAM1217 precursor RNA is designated SEQ ID:1203, and is provided hereinbelow with reference to the sequence listing part. Nucleotide sequence SEQ ID:1203 is located at position 190840 relative to the genome of Tupaia Herpesvirus.

VGAM1217 precursor RNA folds onto itself, forming VGAM1217 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1217 folded precursor RNA into VGAM1217 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1217 RNA is designated SEQ ID:3928, and is provided hereinbelow with reference to the sequence listing part.

VGAM1217 host target gene, herein designated VGAM HOST TARGET GENE, encodes a corresponding messenger RNA, VGAM1217 host target RNA, herein designated VGAM HOST TARGET RNA. VGAM1217 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1217 RNA, herein designated VGAM RNA, binds complementarily to one or more host target binding sites located in untranslated regions of VGAM1217 host target RNA, herein designated VGAM HOST TARGET RNA. This complementary binding is due to the fact that the nucleotide sequence of VGAM1217 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1217 RNA, herein designated VGAM RNA, may have a different number of host target binding sites in untranslated regions of a VGAM1217 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1217 RNA, herein designated VGAM RNA, to host target binding sites on VGAM1217 host target RNA, herein designated VGAM HOST TARGET RNA, such as BINDING SITE I, BINDING SITE II and BINDING SITE III, inhibits translation of VGAM1217 host target RNA into VGAM1217 host target protein, herein designated VGAM HOST TARGET PROTEIN. VGAM host target protein is therefore outlined by a broken line.

It is appreciated that VGAM1217 host target gene, herein designated VGAM HOST TARGET GENE, in fact represents a plurality of VGAM1217 host target genes. The mRNA of each one of this plurality of VGAM1217 host target genes comprises one or more host target binding sites, each having a nucleotide sequence which is at least partly complementary to VGAM1217 RNA, herein designated VGAM RNA, and which when bound by VGAM1217 RNA causes inhibition of translation of respective one or more VGAM1217 host target proteins.

It is further appreciated by one skilled in the art that the mode of translational inhibition illustrated by FIG. 1 with specific reference to translational inhibition exerted by VGAM1217 gene, herein designated VGAM GENE, on one or more VGAM1217 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1217 is inhibition of expression of host target genes, as part of a novel viral mechanism of attacking a host. Accordingly, utilities of VGAM1217 include diagnosis, prevention and treatment of viral infection by Tupaia Herpesvirus. Specific functions, and accordingly utilities, of VGAM1217 correlate with, and may be deduced from, the identity of the host target genes which VGAM1217 binds and inhibits, and the function of these host target genes, as elaborated hereinbelow.

Nucleotide sequences of the VGAM1217 precursor RNA, herein designated VGAM PRECURSOR RNA, and of the 'diced' VGAM1217 RNA, herein designated VGAM RNA, and a schematic representation of the secondary folding of VGAM1217 folded precursor RNA, herein designated VGAM FOLDED PRECURSOR RNA, of VGAM1217 are further described hereinbelow with reference to Table 1.

Nucleotide sequences of host target binding sites, such as BINDING SITE-I, BINDING SITE-II and BINDING SITE-III of FIG. 1, found on VGAM1217 host target RNA, and schematic representation of the complementarity of each of these host target binding sites to VGAM1217 RNA, herein designated VGAM RNA, are described hereinbelow with reference to Table 2.

As mentioned hereinabove with reference to FIG. 1, a function of VGAM1217 gene, herein designated VGAM is inhibition of expression of VGAM1217 target genes. It is appreciated that specific functions, and accordingly utilities, of VGAM1217 correlate with, and may be deduced from, the identity of the target genes which VGAM1217 binds and inhibits, and the function of these target genes, as elaborated hereinbelow.

V-abl Abelson Murine Leukemia Viral Oncogene Homolog 1 (ABL1, Accession NM_005157) is a VGAM1217 host target gene. ABL1 BINDING SITE1 and ABL1 BINDING SITE2 are HOST TARGET binding sites found in untranslated regions of mRNA encoded by ABL1, corresponding to HOST TARGET binding sites such as BINDING SITE I, BINDING SITE II or BINDING SITE III. Table 2 illustrates the complementarity of the nucleotide sequences of ABL1 BINDING SITE1 and ABL1 BINDING SITE2, designated SEQ ID:11637 and SEQ ID:14226 respectively, to the nucleotide sequence of VGAM1217 RNA, herein designated VGAM RNA, also designated SEQ ID:3928.

A function of VGAM1217 is therefore inhibition of V-abl Abelson Murine Leukemia Viral Oncogene Homolog 1 (ABL1, Accession NM_005157). Accordingly, utilities of VGAM1217 include diagnosis, prevention and treatment of diseases and clinical conditions associated with ABL1. Hormonally Upregulated Neu-associated Kinase (HUNK, Accession NM_014586) is another VGAM1217 host target gene. HUNK BINDING SITE is HOST TARGET binding site found in the 3' untranslated region of mRNA encoded by HUNK, corresponding to a HOST TARGET binding site such as BINDING SITE I, BINDING SITE II or BINDING SITE III. Table 2 illustrates the complementarity of the nucleotide sequences of HUNK BINDING SITE, designated SEQ ID:15951, to the nucleotide sequence of VGAM1217 RNA, herein designated VGAM RNA, also designated SEQ ID:3928.

Another function of VGAM1217 is therefore inhibition of Hormonally Upregulated Neu-associated Kinase (HUNK, Accession NM_014586). Accordingly, utilities of VGAM1217 include diagnosis, prevention and treatment of diseases and clinical conditions associated with HUNK. Insulin-like Growth Factor Binding Protein 3 (IGFBP3, Accession NM_000598) is another VGAM1217 host target gene.

IGFBP3 BINDING SITE is HOST TARGET binding site found in the 3' untranslated region of mRNA encoded by IGFBP3, corresponding to a HOST TARGET binding site such as BINDING SITE I, BINDING SITE II or BINDING SITE III. Table 2 illustrates the complementarity of the nucleotide sequences of IGFBP3 BINDING SITE, designated SEQ ID:6197, to the nucleotide sequence of VGAM1217 RNA, herein designated VGAM RNA, also designated SEQ ID:3928.

Another function of VGAM1217 is therefore inhibition of Insulin-like Growth Factor Binding Protein 3 (IGFBP3, Accession NM_000598). Accordingly, utilities of VGAM1217 include diagnosis, prevention and treatment of diseases and clinical conditions associated with IGFBP3. Interleukin 10 Receptor, Alpha (IL10RA, Accession XM_006447) is another VGAM1217 host target gene. IL10RA BINDING SITE is HOST TARGET binding site found in the 3' untranslated region of mRNA encoded by IL10RA, corresponding to a HOST TARGET binding site such as BINDING SITE I, BINDING SITE II or BINDING SITE III. Table 2 illustrates the complementarity of the nucleotide sequences of IL10RA BINDING SITE, designated SEQ ID:29999, to the nucleotide sequence of VGAM1217 RNA, herein designated VGAM RNA, also designated SEQ ID:3928.

Another function of VGAM1217 is therefore inhibition of Interleukin 10 Receptor, Alpha (IL10RA, Accession XM_006447), a gene which is a receptor for il-10. Accordingly, utilities of VGAM1217 include diagnosis, prevention and treatment of diseases and clinical conditions associated with IL10RA. The function of IL10RA and its association with various diseases and clinical conditions, has been established by previous studies, as described hereinabove with reference to VGAM134. Insulin Receptor Substrate 2 (IRS2, Accession XM_007095) is another VGAM1217 host target gene. IRS2 BINDING SITE is HOST TARGET binding site found in the 5' untranslated region of mRNA encoded by IRS2, corresponding to a HOST TARGET binding site such as BINDING SITE I, BINDING SITE II or BINDING SITE III. Table 2 illustrates the complementarity of the nucleotide sequences of IRS2 BINDING SITE, designated SEQ ID:30033, to the nucleotide sequence of VGAM1217 RNA, herein designated VGAM RNA, also designated SEQ ID:3928.

Another function of VGAM1217 is therefore inhibition of Insulin Receptor Substrate 2 (IRS2, Accession XM_007095), a gene which may mediate the control of various cellular processes by insulin. Accordingly, utilities of VGAM1217 include diagnosis, prevention and treatment of diseases and clinical conditions associated with IRS2. The function of IRS2 has been established by previous studies. The protein IRS1 (OMIM Ref. No. 147545) acts as an interface between signaling proteins with Src homology-2 domains (SH2 proteins) and the receptors for insulin (INS; 176730), IGF2 (OMIM Ref. No. 147470), growth hormone (GH1; 139250), several interleukins (IL4, 147780; IL9, 146931; IL13, 147683), and other cytokines. It regulates gene expression and stimulates mitogenesis and appears to mediate insulin/IGF1-stimulated glucose transport. Thus, the finding that survival of the homozygous Irs1 knockout mouse with only mild resistance to hypertension was surprising. This dilemma was provisionally resolved by the discovery by Sun et al. (1995) of a second IRS signaling protein in mouse. They purified and cloned a likely candidate from mouse myeloid progenitor cells and, because of its resemblance to IRS1, they designated it IRS2. Alignment of the sequences of IRS2 and IRS1 demonstrated a highly conserved N terminus containing a pleckstrin-homology domain and a phosphotyrosine-binding (PTB) domain, and a poorly conserved C terminus containing several tyrosine phosphorylation motifs. IRS2 is expressed in many cells, including tissues from the homozygous IRS1 knockout mouse. Sun et al. (1995) suggested that IRS2 may be essential for signaling by several receptor systems. Mammarella et al. (2000) genotyped 193 Italian patients with type II diabetes (OMIM Ref. No. 125853) and 206 control subjects for the IRS2 G1057D polymorphism (600797.0001). They found evidence for a strong association between type II diabetes and the polymorphism, which appears to be protective against type II diabetes in a codominant fashion Animal model experiments lend further support to the function of IRS2. Tobe et al. (2001) observed that Irs2-deficient mice (Kubota et al. (2000)) showed increased adiposity with increased serum leptin level, suggesting leptin resistance before the mice developed diabetes. Using oligonucleotide microarray and Northern blot analyses to analyze gene expression, Tobe et al. (2001) detected increased expression of SREBP1, a downstream target of insulin, in Irs2-deficient mouse liver. Using high dose leptin administration, They provided evidence that leptin resistance in Irs2-deficient mice is causally related to SREBP1 gene induction. The authors concluded that Irs2 gene disruption results in leptin resistance, causing SREBP1 gene induction, obesity, fatty liver, and diabetes It is appreciated that the abovementioned animal model for IRS2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sun, X. J.; Wang, L.-M.; Zhang, Y.; Yenush, L.; Myers, M. G., Jr.; Glasheen, E.; Lane, W. S.; Pierce, J. H.; White, M. F.: Role of IRS-2 in insulin and cytokine signalling. Nature 377: 173-177, 1995; and Tobe, K.; Suzuki, R.; Aoyama, M.; Yamauchi, T.; Kamon, J.; Kubota, N.; Terauchi, Y.; Matsui, J.; Akanuma, Y.; Kimura, S.; Tanaka, J.; Abe, M.; Ohsumi, J.; Nagai, R.; Kadowaki, T.: Incre.

Further studies establishing the function and utilities of IRS2 are found in John Hopkins OMIM database record ID 600797, and in sited publications numbered 135, 1615-1617, 12223, 1085 and 12640-1620 listed in the bibliography section hereinbelow, which are also hereby incorporated by reference. Leucine Zipper Protein 1 (LUZP1, Accession NM_033631) is another VGAM1217 host target gene. LUZP1 BINDING SITE is HOST TARGET binding site found in the 3' untranslated region of mRNA encoded by LUZP1, corresponding to a HOST TARGET binding site such as BINDING SITE I, BINDING SITE II or BINDING SITE III. Table 2 illustrates the complementarity of the nucleotide sequences of LUZP1 BINDING SITE, designated SEQ ID:27352, to the nucleotide sequence of VGAM1217 RNA, herein designated VGAM RNA, also designated SEQ ID:3928.

Another function of VGAM1217 is therefore inhibition of Leucine Zipper Protein 1 (LUZP1, Accession NM_033631). Accordingly, utilities of VGAM1217 include diagnosis, prevention and treatment of diseases and clinical conditions associated with LUZP1. Mannose Receptor, C Type 1 (MRC1, Accession NM_002438) is another VGAM1217 host target gene. MRC1 BINDING SITE is HOST TARGET binding site found in the 3' untranslated region of mRNA encoded by MRC1, corresponding to a HOST TARGET binding site such as BINDING SITE I, BINDING SITE II or BINDING SITE III. Table 2 illustrates the complementarity of the nucleotide sequences of MRC1 BINDING SITE, designated SEQ ID:8281, to the nucleotide sequence of VGAM1217 RNA, herein designated VGAM RNA, also designated SEQ ID:3928.

Another function of VGAM1217 is therefore inhibition of Mannose Receptor, C Type 1 (MRC1, Accession NM_002438), a gene which mediates the endocytosis of glycoproteins. Accordingly, utilities of VGAM1217 include diagnosis, prevention and treatment of diseases and clinical conditions associated with MRC1. The function of MRC1 has been established by previous studies. Recognition of complex carbohydrate structures plays an important role in a number of biologic processes, including cell-cell recognition, serum glycoprotein turnover, and neutralization of pathogens (Kim et al., 1992). Many of the endogenous animal lectins which mediate these recognition events share a common Ca (2+)-dependent structural motif, which has been designated a C-type carbohydrate-recognition domain (CRD). The mannose receptor found on macrophages and on endothelial cells of the liver is the only known example of a C-type lectin that contains multiple C-type CRDs. One function of the receptor is to bind high-mannose structures on the surface of potentially pathogenic viruses, bacteria, and fungi, so that they can be neutralized by phagocytic engulfment. Animal model experiments lend further support to the function of MRC1. Lee et al. (2002) generated mice genetically deficient in mannose receptor. MR -/- mice were defective in clearing proteins bearing accessible mannose and N-acetylglucosamine residues and had elevated levels of 8 different lysosomal hydrolases. Proteomic analysis of MR -/- and control mouse sera showed that an additional 4 out of 52 proteins identified were elevated in MR -/- serum. Each of these proteins is upregulated during inflammation and wound healing. Thus, Lee et al. (2002) concluded that MR appears to operate as an essential regulator of serum glycoprotein homeostasis. The proteins upregulated during inflammation included C-terminal propeptide domains of the pro-alpha-1 and -2 chains of type I procollagen (120150 and 120160, respectively) and the pro-alpha-1 chain of type III procollagen (OMIM Ref. No. 120180), as well as fetuin-B (OMIM Ref. No. 605954). Lee et al. (2002) demonstrated that the mannose receptor is required for rapid clearance of a subset of mannose-bearing serum glycoproteins that are normally elevated during inflammation, but it does not appear to regulate the initiation of inflammation.

It is appreciated that the abovementioned animal model for MRC1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kim, S. J.; Ruiz, N.; Bezouska, K.; Drickamer, K.: Organization of the gene encoding the human macrophage mannose receptor (MRC1). Genomics 14:721-727, 1992; and Lee, S. J.; Evers, S.; Roeder, D.; Parlow, A. F.; Risteli, J.; Risteli, L.; Lee, Y. C.; Feizi, T.; Langen, H.; Nussenzweig, M. C.: Mannose receptor-mediated regulation of serum glycopr.

Further studies establishing the function and utilities of MRC1 are found in John Hopkins OMIM database record ID 153618, and in sited publications numbered 11538-11541 listed in the bibliography section hereinbelow, which are also hereby incorporated by reference. Zinc Finger Protein 38 (ZNF38, Accession XM_170135) is another VGAM1217 host target gene. ZNF38 BINDING SITE is HOST TARGET binding site found in the 5' untranslated region of mRNA encoded by ZNF38, corresponding to a HOST TARGET binding site such as BINDING SITE I, BINDING SITE II or BINDING SITE III. Table 2 illustrates the complementarity of the nucleotide sequences of ZNF38 BINDING SITE, designated SEQ ID:45311, to the nucleotide sequence of VGAM1217 RNA, herein designated VGAM RNA, also designated SEQ ID:3928.

Another function of VGAM1217 is therefore inhibition of Zinc Finger Protein 38 (ZNF38, Accession XM_170135). Accordingly, utilities of VGAM1217 include diagnosis, prevention and treatment of diseases and clinical conditions associated with ZNF38. Aminoadipate-semialdehyde Dehydrogenase-phosphopantetheinyl Transferase (AASDHPPT, Accession NM_015423) is another VGAM1217 host target gene. AASDHPPT BINDING SITE is HOST TARGET binding site found in the 3' untranslated region of mRNA encoded by AASDHPPT, corresponding to a HOST TARGET binding site such as BINDING SITE I, BINDING SITE II or BINDING SITE III. Table 2 illustrates the complementarity of the nucleotide sequences of AASDHPPT BINDING SITE, designated SEQ ID:17725, to the nucleotide sequence of VGAM1217 RNA, herein designated VGAM RNA, also designated SEQ ID:3928.

Another function of VGAM1217 is therefore inhibition of Aminoadipate-semialdehyde Dehydrogenase-phosphopantetheinyl Transferase (AASDHPPT, Accession NM_015423). Accordingly, utilities of VGAM1217 include diagnosis, prevention and treatment of diseases and clinical conditions associated with AASDHPPT. Chromosome 20 Open Reading Frame 81 (C20orf81, Accession NM_022760) is another VGAM1217 host target gene. C20orf81 BINDING SITE is HOST TARGET binding site found in the 5" untranslated region of mRNA encoded by C20orf81, corresponding to a HOST TARGET binding site such as BINDING SITE I, BINDING SITE II or BINDING SITE III. Table 2 illustrates the complementarity of the nucleotide sequences of C20orf81 BINDING SITE, designated SEQ ID:23003, to the nucleotide sequence of VGAM1217 RNA, herein designated VGAM RNA, also designated SEQ ID:3928.

Another function of VGAM1217 is therefore inhibition of Chromosome 20 Open Reading Frame 81 (C20orf81, Accession NM_022760). Accordingly, utilities of VGAM1217 include diagnosis, prevention and treatment of diseases and clinical conditions associated with C20orf81. CDT1 (Accession XM_085327) is another VGAM1217 host target gene. CDT1 BINDING SITE is HOST TARGET binding site found in the 3' untranslated region of mRNA encoded by CDT1, corresponding to a HOST TARGET binding site such as BINDING SITE I, BINDING SITE II or BINDING SITE III. Table 2 illustrates the complementarity of the nucleotide sequences of CDT1 BINDING SITE, designated SEQ ID:38065, to the nucleotide sequence of VGAM1217 RNA, herein designated VGAM RNA, also designated SEQ ID:3928.

Another function of VGAM1217 is therefore inhibition of CDT1 (Accession XM_085327). Accordingly, utilities of VGAM1217 include diagnosis, prevention and treatment of diseases and clinical conditions associated with CDT1. DKFZP586A0522 (Accession NM_014033) is another VGAM1217 host target gene. DKFZP586A0522 BINDING SITE is HOST TARGET binding site found in the 3' untranslated region of mRNA encoded by DKFZP586A0522, corresponding to a HOST TARGET binding site such as BINDING SITE I, BINDING SITE II or BINDING SITE III. Table 2 illustrates the complementarity of the nucleotide sequences of DKFZP586A0522 BINDING SITE, designated SEQ ID:15263, to the nucleotide sequence of VGAM1217 RNA, herein designated VGAM RNA, also designated SEQ ID:3928.

Another function of VGAM1217 is therefore inhibition of DKFZP586A0522 (Accession NM_014033). Accordingly, utilities of VGAM1217 include diagnosis, prevention and treatment of diseases and clinical conditions associated with DKFZP586A0522. DKFZp586I021 (Accession NM_032271) is another VGAM1217 host target gene. DKFZp586I021 BINDING SITE is HOST TARGET binding site found in the 3' untranslated region of mRNA encoded by DKFZp586I021, corresponding to a HOST TARGET binding site such as BINDING SITE I, BINDING SITE II or BINDING SITE III. Table 2 illustrates the complementarity of the nucleotide sequences of DKFZp586I021 BINDING SITE, designated SEQ ID:26029, to the nucleotide sequence of VGAM1217 RNA, herein designated VGAM RNA, also designated SEQ ID:3928.

Another function of VGAM1217 is therefore inhibition of DKFZp586I021 (Accession NM_032271). Accordingly, utilities of VGAM1217 include diagnosis, prevention and treatment of diseases and clinical conditions associated with DKFZp586I021. FLJ10261 (Accession NM_018043) is another VGAM1217 host target gene. FLJ10261 BINDING SITE is HOST TARGET binding site found in the 3' untranslated region of mRNA encoded by FLJ10261, corresponding to a HOST TARGET binding site such as BINDING SITE I, BINDING SITE II or BINDING SITE III. Table 2 illustrates the complementarity of the nucleotide sequences of FLJ10261 BINDING SITE, designated SEQ ID:19788, to the nucleotide sequence of VGAM1217 RNA, herein designated VGAM RNA, also designated SEQ ID:3928.

Another function of VGAM1217 is therefore inhibition of FLJ10261 (Accession NM_018043). Accordingly, utilities of VGAM1217 include diagnosis, prevention and treatment of diseases and clinical conditions associated with FLJ10261. FLJ13855 (Accession NM_023079) is another VGAM1217 host target gene. FLJ13855 BINDING SITE is HOST TARGET binding site found in the 3' untranslated region of mRNA encoded by FLJ13855, corresponding to a HOST TARGET binding site such as BINDING SITE I, BINDING SITE II or BINDING SITE III. Table 2 illustrates the complementarity of the nucleotide sequences of FLJ13855 BINDING SITE, designated SEQ ID:23344, to the nucleotide sequence of VGAM1217 RNA, herein designated VGAM RNA, also designated SEQ ID:3928.

Another function of VGAM1217 is therefore inhibition of FLJ13855 (Accession NM_023079). Accordingly, utilities of VGAM1217 include diagnosis, prevention and treatment of diseases and clinical conditions associated with FLJ13855. FLJ14451 (Accession NM_032786) is another VGAM1217 host target gene. FLJ14451 BINDING SITE is HOST TARGET binding site found in the 5' untranslated region of mRNA encoded by FLJ14451, corresponding to a HOST TARGET binding site such as BINDING SITE I, BINDING SITE II or BINDING SITE III. Table 2 illustrates the complementarity of the nucleotide sequences of FLJ14451 BINDING SITE, designated SEQ ID:26540, to the nucleotide sequence of VGAM1217 RNA, herein designated VGAM RNA, also designated SEQ ID:3928.

Another function of VGAM1217 is therefore inhibition of FLJ14451 (Accession NM_032786). Accordingly, utilities of VGAM1217 include diagnosis, prevention and treatment of diseases and clinical conditions associated with FLJ14451. Heat Shock 27 kDa Protein Family, Member 7 (cardiovascular) (HSPB7, Accession NM_014424) is another VGAM1217 host target gene. HSPB7 BINDING SITE is HOST TARGET binding site found in the 5' untranslated region of mRNA encoded by HSPB7, corresponding to a HOST TARGET binding site such as BINDING SITE I, BINDING SITE II or BINDING SITE III. Table 2 illustrates the complementarity of the nucleotide sequences of HSPB7 BINDING SITE, designated SEQ ID:15783, to the nucleotide sequence of VGAM1217 RNA, herein designated VGAM RNA, also designated SEQ ID:3928.

Another function of VGAM1217 is therefore inhibition of Heat Shock 27kDa Protein Family, Member 7 (cardiovascular) (HSPB7, Accession NM_014424). Accordingly, utilities of VGAM1217 include diagnosis, prevention and treatment of diseases and clinical conditions associated with HSPB7. KIAA0211 (Accession NM_014630) is another VGAM1217 host target gene. KIAA0211 BINDING SITE is HOST TARGET binding site found in the 3' untranslated region of mRNA encoded by KIAA0211, corresponding to a HOST TARGET binding site such as BINDING SITE I, BINDING SITE II or BINDING SITE III. Table 2 illustrates the complementarity of the nucleotide sequences of KIAA0211 BINDING SITE, designated SEQ ID:15993, to the nucleotide sequence of VGAM1217 RNA, herein designated VGAM RNA, also designated SEQ ID:3928.

Another function of VGAM1217 is therefore inhibition of KIAA0211 (Accession NM_014630). Accordingly, utilities of VGAM1217 include diagnosis, prevention and treatment of diseases and clinical conditions associated with KIAA0211. KIAA0546 (Accession XM_049055) is another VGAM1217 host target gene. KIAA0546 BINDING SITE is HOST TARGET binding site found in the 3' untranslated region of mRNA encoded by KIAA0546, corresponding to a HOST TARGET binding site such as BINDING SITE I, BINDING SITE II or BINDING SITE III. Table 2 illustrates the complementarity of the nucleotide sequences of KIAA0546 BINDING SITE, designated SEQ ID:35333, to the nucleotide sequence of VGAM1217 RNA, herein designated VGAM RNA, also designated SEQ ID:3928.

Another function of VGAM1217 is therefore inhibition of KIAA0546 (Accession XM_049055). Accordingly, utilities of VGAM1217 include diagnosis, prevention and treatment of diseases and clinical conditions associated with KIAA0546. KIAA0710 (Accession NM_014871) is another VGAM1217 host target gene. KIAA0710 BINDING SITE is HOST TARGET binding site found in the 3' untranslated region of mRNA encoded by KIAA0710, corresponding to a HOST TARGET binding site such as BINDING SITE I, BINDING SITE II or BINDING SITE III. Table 2 illustrates the complementarity of the nucleotide sequences of KIAA0710 BINDING SITE, designated SEQ ID:16993, to the nucleotide sequence of VGAM1217 RNA, herein designated VGAM RNA, also designated SEQ ID:3928.

Another function of VGAM1217 is therefore inhibition of KIAA0710 (Accession NM_014871). Accordingly, utilities of VGAM1217 include diagnosis, prevention and treatment of diseases and clinical conditions associated with KIAA0710. KIAA1045 (Accession XM_048592) is another VGAM1217 host target gene. KIAA1045 BINDING SITE is HOST TARGET binding site found in the 3' untranslated region of mRNA encoded by KIAA1045, corresponding to a HOST TARGET binding site such as BINDING SITE I, BINDING SITE II or BINDING SITE III. Table 2 illustrates the complementarity of the nucleotide sequences of KIAA1045 BINDING SITE, designated SEQ ID:35205, to the nucleotide sequence of VGAM1217 RNA, herein designated VGAM RNA, also designated SEQ ID:3928.

Another function of VGAM1217 is therefore inhibition of KIAA1045 (Accession XM_048592). Accordingly, utilities of VGAM1217 include diagnosis, prevention and treatment of diseases and clinical conditions associated with KIAA1045. KIAA1423 (Accession XM_029703) is another VGAM1217 host target gene. KIAA1423 BINDING SITE is HOST TARGET binding site found in the 3' untranslated region of mRNA encoded by KIAA1423, corresponding to a HOST TARGET binding site such as BINDING SITE I, BINDING SITE II or BINDING SITE III. Table 2 illustrates the complementarity of the nucleotide sequences of KIAA1423 BINDING SITE, designated SEQ ID:30922, to the nucleotide sequence of VGAM1217 RNA, herein designated VGAM RNA, also designated SEQ ID:3928.

Another function of VGAM1217 is therefore inhibition of KIAA1423 (Accession XM_029703). Accordingly, utilities of VGAM1217 include diagnosis, prevention and treatment of diseases and clinical conditions associated with KIAA1423. MGC2628 (Accession NM_024076) is another VGAM1217 host target gene. MGC2628 BINDING SITE is HOST TARGET binding site found in the 3' untranslated region of mRNA encoded by MGC2628, corresponding to a HOST TARGET binding site such as BINDING SITE I, BINDING SITE II or BINDING SITE III. Table 2 illustrates the complementarity of the nucleotide sequences of MGC2628 BINDING SITE, designated SEQ ID:23507, to the nucleotide sequence of VGAM1217 RNA, herein designated VGAM RNA, also designated SEQ ID:3928.

Another function of VGAM1217 is therefore inhibition of MGC2628 (Accession NM_024076). Accordingly, utilities of VGAM1217 include diagnosis, prevention and treatment of diseases and clinical conditions associated with MGC2628. MGC3020 (Accession NM_024048) is another VGAM1217 host target gene. MGC3020 BINDING SITE is HOST TARGET binding site found in the 3' untranslated region of mRNA encoded by MGC3020, corresponding to a HOST TARGET binding site such as BINDING SITE I, BINDING SITE II or BINDING SITE III. Table 2 illustrates the complementarity of the nucleotide sequences of MGC3020 BINDING SITE, designated SEQ ID:23484, to the nucleotide sequence of VGAM1217 RNA, herein designated VGAM RNA, also designated SEQ ID:3928.

Another function of VGAM1217 is therefore inhibition of MGC3020 (Accession NM_024048). Accordingly, utilities of VGAM1217 include diagnosis, prevention and treatment of diseases and clinical conditions associated with MGC3020. MSP (Accession NM_032046) is another VGAM1217 host target gene. MSP BINDING SITE is HOST TARGET binding site found in the 3' untranslated region of mRNA encoded by MSP, corresponding to a HOST TARGET binding site such as BINDING SITE I, BINDING SITE II or BINDING SITE III. Table 2 illustrates the complementarity of the nucleotide sequences of MSP BINDING SITE, designated SEQ ID:25761, to the nucleotide sequence of VGAM1217 RNA, herein designated VGAM RNA, also designated SEQ ID:3928.

Another function of VGAM1217 is therefore inhibition of MSP (Accession NM_032046). Accordingly, utilities of VGAM1217 include diagnosis, prevention and treatment of diseases and clinical conditions associated with MSP. Ubiquitin Specific Protease 3 (USP3, Accession XM_116973) is another VGAM1217 host target gene. USP3 BINDING SITE is HOST TARGET binding site found in the 5' untranslated region of mRNA encoded by USP3, corresponding to a HOST TARGET binding site such as BINDING SITE I, BINDING SITE II or BINDING SITE III. Table 2 illustrates the complementarity of the nucleotide sequences of USP3 BINDING SITE, designated SEQ ID:43171, to the nucleotide sequence of VGAM1217 RNA, herein designated VGAM RNA, also designated SEQ ID:3928.

Another function of VGAM1217 is therefore inhibition of Ubiquitin Specific Protease 3 (USP3, Accession XM_116973). Accordingly, utilities of VGAM1217 include diagnosis, prevention and treatment of diseases and clinical conditions associated with USP3. LOC131873 (Accession XM_067585) is another VGAM1217 host target gene. LOC131873 BINDING SITE is HOST TARGET binding site found in the 5' untranslated region of mRNA encoded by LOC131873, corresponding to a HOST TARGET binding site such as BINDING SITE I, BINDING SITE II or BINDING SITE III. Table 2 illustrates the complementarity of the nucleotide sequences of LOC131873 BINDING SITE, designated SEQ ID:37363, to the nucleotide sequence of VGAM1217 RNA, herein designated VGAM RNA, also designated SEQ ID:3928.

Another function of VGAM1217 is therefore inhibition of LOC131873 (Accession XM_067585). Accordingly, utilities of VGAM1217 include diagnosis, prevention and treatment of diseases and clinical conditions associated with LOC131873. LOC145231 (Accession XM_096740) is another VGAM1217 host target gene. LOC145231 BINDING SITE is HOST TARGET binding site found in the 3' untranslated region of mRNA encoded by LOC145231, corresponding to a HOST TARGET binding site such as BINDING SITE I, BINDING SITE II or BINDING SITE III. Table 2 illustrates the complementarity of the nucleotide sequences of LOC145231 BINDING SITE, designated SEQ ID:40521, to the nucleotide sequence of VGAM1217 RNA, herein designated VGAM RNA, also designated SEQ ID:3928.

Another function of VGAM1217 is therefore inhibition of LOC145231 (Accession XM_096740). Accordingly, utilities of VGAM1217 include diagnosis, prevention and treatment of diseases and clinical conditions associated with LOC145231. LOC146237 (Accession XM_096954) is another VGAM1217 host target gene. LOC146237 BINDING SITE is HOST TARGET binding site found in the 3' untranslated region of mRNA encoded by LOC146237, corresponding to a HOST TARGET binding site such as BINDING SITE I, BINDING SITE II or BINDING SITE III. Table 2 illustrates the complementarity of the nucleotide sequences of LOC146237 BINDING SITE, designated SEQ ID:40670, to the nucleotide sequence of VGAM1217 RNA, herein designated VGAM RNA, also designated SEQ ID:3928.

Another function of VGAM1217 is therefore inhibition of LOC146237 (Accession XM_096954). Accordingly, utilities of VGAM1217 include diagnosis, prevention and treatment of diseases and clinical conditions associated with LOC146237. LOC146713 (Accession XM_097071) is another VGAM1217 host target gene. LOC146713 BINDING SITE is HOST TARGET binding site found in the 3' untranslated region of mRNA encoded by LOC146713, corresponding to a HOST TARGET binding site such as BINDING SITE I, BINDING SITE II or BINDING SITE III. Table 2 illustrates the complementarity of the nucleotide sequences of LOC146713 BINDING SITE, designated SEQ ID:40717, to the nucleotide sequence of VGAM1217 RNA, herein designated VGAM RNA, also designated SEQ ID:3928.

Another function of VGAM1217 is therefore inhibition of LOC146713 (Accession XM_097071). Accordingly, utilities of VGAM1217 include diagnosis, prevention and treatment of diseases and clinical conditions associated with LOC146713. LOC147664 (Accession XM_085826) is another VGAM1217 host target gene. LOC147664 BINDING SITE is HOST TARGET binding site found in the 3' untranslated region of mRNA encoded by LOC147664, corresponding to a HOST TARGET binding site such as BINDING SITE I, BINDING SITE II or BINDING SITE III. Table 2 illustrates the complementarity of the nucleotide sequences of LOC147664 BINDING SITE, designated SEQ ID:38351, to the nucleotide sequence of VGAM1217 RNA, herein designated VGAM RNA, also designated SEQ ID:3928.

Another function of VGAM1217 is therefore inhibition of LOC147664 (Accession XM_085826). Accordingly, utilities of VGAM1217 include diagnosis, prevention and treatment of diseases and clinical conditions associated with LOC147664. LOC151031 (Accession XM_103784) is another VGAM1217 host target gene. LOC151031 BINDING SITE is HOST TARGET binding site found in the 5' untranslated region of mRNA encoded by LOC151031, corresponding to a HOST TARGET binding site such as BINDING SITE I, BINDING SITE II or BINDING SITE III. Table 2 illustrates the complementarity of the nucleotide sequences of LOC151031 BINDING SITE, designated SEQ ID:42156, to the nucleotide sequence of VGAM1217 RNA, herein designated VGAM RNA, also designated SEQ ID:3928.

Another function of VGAM1217 is therefore inhibition of LOC151031 (Accession XM_103784). Accordingly, utilities of VGAM1217 include diagnosis, prevention and treatment of diseases and clinical conditions associated with LOC151031. LOC166341 (Accession XM_093804) is another VGAM1217 host target gene. LOC166341 BINDING SITE is HOST TARGET binding site found in the 3' untranslated region of mRNA encoded by LOC166341, corresponding to a HOST TARGET binding site such as BINDING SITE I, BINDING SITE II or BINDING SITE III. Table 2 illustrates the complementarity of the nucleotide sequences of LOC166341 BINDING SITE, designated SEQ ID:40211, to the nucleotide sequence of VGAM1217 RNA, herein designated VGAM RNA, also designated SEQ ID:3928.

Another function of VGAM1217 is therefore inhibition of LOC166341 (Accession XM_093804). Accordingly, utilities of VGAM1217 include diagnosis, prevention and treatment of diseases and clinical conditions associated with LOC166341. LOC196529 (Accession XM_113746) is another VGAM1217 host target gene. LOC196529 BINDING SITE is HOST TARGET binding site found in the 3' untranslated region of mRNA encoded by LOC196529, corresponding to a HOST TARGET binding site such as BINDING SITE I, BINDING SITE II or BINDING SITE III. Table 2 illustrates the complementarity of the nucleotide sequences of LOC196529 BINDING SITE, designated SEQ ID:42410, to the nucleotide sequence of VGAM1217 RNA, herein designated VGAM RNA, also designated SEQ ID:3928.

Another function of VGAM1217 is therefore inhibition of LOC196529 (Accession XM_113746). Accordingly, utilities of VGAM1217 include diagnosis, prevention and treatment of diseases and clinical conditions associated with LOC196529. LOC205313 (Accession XM_119628) is another VGAM1217 host target gene. LOC205313 BINDING SITE is HOST TARGET binding site found in the 5' untranslated region of mRNA encoded by LOC205313, corresponding to a HOST TARGET binding site such as BINDING SITE I, BINDING SITE II or BINDING SITE III. Table 2 illustrates the complementarity of the nucleotide sequences of LOC205313 BINDING SITE, designated SEQ ID:43593, to the nucleotide sequence of VGAM1217 RNA, herein designated VGAM RNA, also designated SEQ ID:3928.

Another function of VGAM1217 is therefore inhibition of LOC205313 (Accession XM_119628). Accordingly, utilities of VGAM1217 include diagnosis, prevention and treatment of diseases and clinical conditions associated with LOC205313. LOC253612 (Accession XM_172985) is another VGAM1217 host target gene. LOC253612 BINDING SITE is HOST TARGET binding site found in the 3' untranslated region of mRNA encoded by LOC253612, corresponding to a HOST TARGET binding site such as BINDING SITE I, BINDING SITE II or BINDING SITE III. Table 2 illustrates the complementarity of the nucleotide sequences of LOC253612 BINDING SITE, designated SEQ ID:46256, to the nucleotide sequence of VGAM1217 RNA, herein designated VGAM RNA, also designated SEQ ID:3928.

Another function of VGAM1217 is therefore inhibition of LOC253612 (Accession XM_172985). Accordingly, utilities of VGAM1217 include diagnosis, prevention and treatment of diseases and clinical conditions associated with LOC253612. LOC256683 (Accession XM_172321) is another VGAM1217 host target gene. LOC256683 BINDING SITE is HOST TARGET binding site found in the 5' untranslated region of mRNA encoded by LOC256683, corresponding to a HOST TARGET binding site such as BINDING SITE I, BINDING SITE II or BINDING SITE III. Table 2 illustrates the complementarity of the nucleotide sequences of LOC256683 BINDING SITE, designated SEQ ID:46070, to the nucleotide sequence of VGAM1217 RNA, herein designated VGAM RNA, also designated SEQ ID:3928.

Another function of VGAM1217 is therefore inhibition of LOC256683 (Accession XM_172321). Accordingly, utilities of VGAM1217 include diagnosis, prevention and treatment of diseases and clinical conditions associated with LOC256683. LOC90288 (Accession XM_030669) is another VGAM1217 host target gene. LOC90288 BINDING SITE is HOST TARGET binding site found in the 3' untranslated region of mRNA encoded by LOC90288, corresponding to a HOST TARGET binding site such as BINDING SITE I, BINDING SITE II or BINDING SITE III. Table 2 illustrates the complementarity of the nucleotide sequences of LOC90288 BINDING SITE, designated SEQ ID:31111, to the nucleotide sequence of VGAM1217 RNA, herein designated VGAM RNA, also designated SEQ ID:3928.

Another function of VGAM1217 is therefore inhibition of LOC90288 (Accession XM_030669). Accordingly, utilities of VGAM1217 include diagnosis, prevention and treatment of diseases and clinical conditions associated with LOC90288. FIG. 1 further provides a conceptual description of a novel bioinformatically detected viral gene of the present invention, referred to here as Viral Genomic Address Messenger 1218 (VGAM1218) viral gene, which modulates expression of respective host target genes thereof, the function and utility of which host target genes is known in the art.

VGAM1218 is a novel bioinformatically detected regulatory, non protein coding, viral micro RNA (miRNA) gene. The method by which VGAM1218 was detected is described hereinabove with reference to FIGS. 1-8.

VGAM1218 gene, herein designated VGAM GENE, is a viral gene contained in the genome of Fowlpox Virus. VGAM1218 host target gene, herein designated VGAM HOST TARGET GENE, is a human gene contained in the human genome.

VGAM1218 gene encodes a VGAM1218 precursor RNA, herein designated VGAM PRECURSOR RNA. Similar to other miRNA genes, and unlike most ordinary genes, VGAM1218 precursor RNA does not encode a protein. A nucleotide sequence identical or highly similar to the nucleotide sequence of VGAM1218 precursor RNA is designated SEQ ID:1204, and is provided hereinbelow with reference to the sequence listing part. Nucleotide sequence SEQ ID:1204 is located at position 161690 relative to the genome of Fowlpox Virus.

VGAM1218 precursor RNA folds onto itself, forming VGAM1218 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1218 folded precursor RNA into VGAM1218 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM1218 RNA is designated SEQ ID:3929, and is provided hereinbelow with reference to the sequence listing part.

VGAM1218 host target gene, herein designated VGAM HOST TARGET GENE, encodes a corresponding messenger RNA, VGAM1218 host target RNA, herein designated VGAM HOST TARGET RNA. VGAM1218 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1218 RNA, herein designated VGAM RNA, binds complementarily to one or more host target binding sites located in untranslated regions of VGAM1218 host target RNA, herein designated VGAM HOST TARGET RNA. This complementary binding is due to the fact that the nucleotide sequence of VGAM1218 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1218 RNA, herein designated VGAM RNA, may have a different number of host target binding sites in untranslated regions of a VGAM1218 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1218 RNA, herein designated VGAM RNA, to host target binding sites on VGAM1218 host target RNA, herein designated VGAM HOST TARGET RNA, such as BINDING SITE I, BINDING SITE II and BINDING SITE III, inhibits translation of VGAM1218 host target RNA into VGAM1218 host target protein, herein designated VGAM HOST TARGET PROTEIN. VGAM host target protein is therefore outlined by a broken line.

It is appreciated that VGAM1218 host target gene, herein designated VGAM HOST TARGET GENE, in fact represents a plurality of VGAM1218 host target genes. The mRNA of each one of this plurality of VGAM1218 host target genes comprises one or more host target binding sites, each having a nucleotide sequence which is at least partly complementary to VGAM1218 RNA, herein designated VGAM RNA, and which when bound by VGAM1218 RNA causes inhibition of translation of respective one or more VGAM1218 host target proteins.

It is further appreciated by one skilled in the art that the mode of translational inhibition illustrated by FIG. 1 with specific reference to translational inhibition exerted by VGAM1218 gene, herein designated VGAM GENE, on one or more VGAM1218 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1218 is inhibition of expression of host target genes, as part of a novel viral mechanism of attacking a host. Accordingly, utilities of VGAM1218 include diagnosis, prevention and treatment of viral infection by Fowlpox Virus. Specific functions, and accordingly utilities, of VGAM1218 correlate with, and may be deduced from, the identity of the host target genes which VGAM1218 binds and inhibits, and the function of these host target genes, as elaborated hereinbelow.

Nucleotide sequences of the VGAM1218 precursor RNA, herein designated VGAM PRECURSOR RNA, and of the 'diced' VGAM1218 RNA, herein designated VGAM RNA, and a schematic representation of the secondary folding of VGAM1218 folded precursor RNA, herein designated VGAM FOLDED PRECURSOR RNA, of VGAM1218 are further described hereinbelow with reference to Table 1.

Nucleotide sequences of host target binding sites, such as BINDING SITE-I, BINDING SITE-II and BINDING SITE-III of FIG. 1, found on VGAM1218 host target RNA, and schematic representation of the complementarity of each of these host target binding sites to VGAM1218 RNA, herein designated VGAM RNA, are described hereinbelow with reference to Table 2.

As mentioned hereinabove with reference to FIG. 1, a function of VGAM1218 gene, herein designated VGAM is inhibition of expression of VGAM1218 target genes. It is appreciated that specific functions, and accordingly utilities, of VGAM1218 correlate with, and may be deduced from, the identity of the target genes which VGAM1218 binds and inhibits, and the function of these target genes, as elaborated hereinbelow.

LOC124976 (Accession XM_058879) is a VGAM1218 host target gene. LOC124976 BINDING SITE is HOST TARGET binding site found in the 3' untranslated region of mRNA encoded by LOC124976, corresponding to a HOST TARGET binding site such as BINDING SITE I, BINDING SITE II or BINDING SITE III. Table 2 illustrates the complementarity of the nucleotide sequences of LOC124976 BINDING SITE, designated SEQ ID:36780, to the nucleotide sequence of VGAM1218 RNA, herein designated VGAM RNA, also designated SEQ ID:3929.

A function of VGAM1218 is therefore inhibition of LOC124976 (Accession XM_058879). Accordingly, utilities of VGAM1218 include diagnosis, prevention and treatment of diseases and clinical conditions associated with LOC124976. FIG. 1 further provides a conceptual description of a novel bioinformatically detected viral gene of the present invention, referred to here as Viral Genomic Address Messenger 1219 (VGAM1219) viral gene, which modulates expression of respective host target genes thereof, the function and utility of which host target genes is known in the art.

VGAM1219 is a novel bioinformatically detected regulatory, non protein coding, viral micro RNA (miRNA) gene.

The method by which VGAM1219 was detected is described hereinabove with reference to FIGS. 1-8.

VGAM1219 gene, herein designated VGAM GENE, is a viral gene contained in the genome of Fowlpox Virus. VGAM1219 host target gene, herein designated VGAM HOST TARGET GENE, is a human gene contained in the human genome.

VGAM1219 gene encodes a VGAM1219 precursor RNA, herein designated VGAM PRECURSOR RNA. Similar to other miRNA genes, and unlike most ordinary genes, VGAM1219 precursor RNA does not encode a protein. A nucleotide sequence identical or highly similar to the nucleotide sequence of VGAM1219 precursor RNA is designated SEQ ID:1205, and is provided hereinbelow with reference to the sequence listing part. Nucleotide sequence SEQ ID:1205 is located at position 157189 relative to the genome of Fowlpox Virus.

VGAM1219 precursor RNA folds onto itself, forming VGAM1219 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1219 folded precursor RNA into VGAM1219 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1219 RNA is designated SEQ ID:3930, and is provided hereinbelow with reference to the sequence listing part.

VGAM1219 host target gene, herein designated VGAM HOST TARGET GENE, encodes a corresponding messenger RNA, VGAM1219 host target RNA, herein designated VGAM HOST TARGET RNA. VGAM1219 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1219 RNA, herein designated VGAM RNA, binds complementarily to one or more host target binding sites located in untranslated regions of VGAM1219 host target RNA, herein designated VGAM HOST TARGET RNA. This complementary binding is due to the fact that the nucleotide sequence of VGAM1219 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1219 RNA, herein designated VGAM RNA, may have a different number of host target binding sites in untranslated regions of a VGAM1219 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1219 RNA, herein designated VGAM RNA, to host target binding sites on VGAM1219 host target RNA, herein designated VGAM HOST TARGET RNA, such as BINDING SITE I, BINDING SITE II and BINDING SITE III, inhibits translation of VGAM1219 host target RNA into VGAM1219 host target protein, herein designated VGAM HOST TARGET PROTEIN. VGAM host target protein is therefore outlined by a broken line.

It is appreciated that VGAM1219 host target gene, herein designated VGAM HOST TARGET GENE, in fact represents a plurality of VGAM1219 host target genes. The mRNA of each one of this plurality of VGAM1219 host target genes comprises one or more host target binding sites, each having a nucleotide sequence which is at least partly complementary to VGAM1219 RNA, herein designated VGAM RNA, and which when bound by VGAM1219 RNA causes inhibition of translation of respective one or more VGAM1219 host target proteins.

It is further appreciated by one skilled in the art that the mode of translational inhibition illustrated by FIG. 1 with specific reference to translational inhibition exerted by VGAM1219 gene, herein designated VGAM GENE, on one or more VGAM1219 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1219 is inhibition of expression of host target genes, as part of a novel viral mechanism of attacking a host. Accordingly, utilities of VGAM1219 include diagnosis, prevention and treatment of viral infection by Fowlpox Virus. Specific functions, and accordingly utilities, of VGAM1219 correlate with, and may be deduced from, the identity of the host target genes which VGAM1219 binds and inhibits, and the function of these host target genes, as elaborated hereinbelow.

Nucleotide sequences of the VGAM1219 precursor RNA, herein designated VGAM PRECURSOR RNA, and of the 'diced' VGAM1219 RNA, herein designated VGAM RNA, and a schematic representation of the secondary folding of VGAM1219 folded precursor RNA, herein designated VGAM FOLDED PRECURSOR RNA, of VGAM1219 are further described hereinbelow with reference to Table 1.

Nucleotide sequences of host target binding sites, such as BINDING SITE-I, BINDING SITE-II and BINDING SITE-III of FIG. 1, found on VGAM1219 host target RNA, and schematic representation of the complementarity of each of these host target binding sites to VGAM1219 RNA, herein designated VGAM RNA, are described hereinbelow with reference to Table 2.

As mentioned hereinabove with reference to FIG. 1, a function of VGAM1219 gene, herein designated VGAM is inhibition of expression of VGAM1219 target genes. It is appreciated that specific functions, and accordingly utilities, of VGAM1219 correlate with, and may be deduced from, the identity of the target genes which VGAM1219 binds and inhibits, and the function of these target genes, as elaborated hereinbelow.

COX15 Homolog, Cytochrome C Oxidase Assembly Protein (yeast) (COX15, Accession NM_078470) is a VGAM1219 host target gene. COX15 BINDING SITE is HOST TARGET binding site found in the 3' untranslated region of mRNA encoded by COX15, corresponding to a HOST TARGET binding site such as BINDING SITE I, BINDING SITE II or BINDING SITE III. Table 2 illustrates the complementarity of the nucleotide sequences of COX15 BINDING SITE, designated SEQ ID:27791, to the nucleotide sequence of VGAM1219 RNA, herein designated VGAM RNA, also designated SEQ ID:3930.

A function of VGAM1219 is therefore inhibition of COX15 Homolog, Cytochrome C Oxidase Assembly Protein (yeast) (COX15, Accession NM_078470). Accordingly, utilities of VGAM1219 include diagnosis, prevention and treatment of diseases and clinical conditions associated with COX15. Cytochrome P450, Subfamily XXXIX (oxysterol 7 alpha-hydroxylase), Polypeptide 1 (CYP39A1, Accession NM_016593) is another VGAM1219 host target gene. CYP39A1 BINDING SITE is HOST TARGET binding site found in the 3' untranslated region of mRNA encoded by CYP39A1, corresponding to a HOST TARGET binding site such as BINDING SITE I, BINDING SITE II or BINDING SITE III. Table 2 illustrates the complementarity of the nucleotide sequences of CYP39A1 BINDING SITE, designated SEQ ID:18681, to the nucleotide sequence of VGAM1219 RNA, herein designated VGAM RNA, also designated SEQ ID:3930.

Another function of VGAM1219 is therefore inhibition of Cytochrome P450, Subfamily XXXIX (oxysterol 7 alpha-hydroxylase), Polypeptide 1 (CYP39A1, Accession NM_016593). Accordingly, utilities of VGAM1219 include diagnosis, prevention and treatment of diseases and clinical conditions associated with CYP39A1. FIG. 1 further provides a conceptual description of a novel bioinformatically detected viral gene of the present invention, referred to here as Viral Genomic Address Messenger 1220 (VGAM1220) viral gene, which modulates expression of respective host target genes thereof, the function and utility of which host target genes is known in the art.

VGAM1220 is a novel bioinformatically detected regulatory, non protein coding, viral micro RNA (miRNA) gene. The method by which VGAM1220 was detected is described hereinabove with reference to FIGS. 1-8.

VGAM1220 gene, herein designated VGAM GENE, is a viral gene contained in the genome of Fowl Adenovirus D. VGAM1220 host target gene, herein designated VGAM HOST TARGET GENE, is a human gene contained in the human genome.

VGAM1220 gene encodes a VGAM1220 precursor RNA, herein designated VGAM PRECURSOR RNA. Similar to other miRNA genes, and unlike most ordinary genes, VGAM1220 precursor RNA does not encode a protein. A nucleotide sequence identical or highly similar to the nucleotide sequence of VGAM1220 precursor RNA is designated SEQ ID:1206, and is provided hereinbelow with reference to the sequence listing part. Nucleotide sequence SEQ ID:1206 is located at position 28289 relative to the genome of Fowl Adenovirus D.

VGAM1220 precursor RNA folds onto itself, forming VGAM1220 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1220 folded precursor RNA into VGAM1220 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 85%) nucleotide sequence of VGAM1220 RNA is designated SEQ ID:3931, and is provided hereinbelow with reference to the sequence listing part.

VGAM1220 host target gene, herein designated VGAM HOST TARGET GENE, encodes a corresponding messenger RNA, VGAM1220 host target RNA, herein designated VGAM HOST TARGET RNA. VGAM1220 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1220 RNA, herein designated VGAM RNA, binds complementarily to one or more host target binding sites located in untranslated regions of VGAM1220 host target RNA, herein designated VGAM HOST TARGET RNA. This complementary binding is due to the fact that the nucleotide sequence of VGAM1220 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1220 RNA, herein designated VGAM RNA, may have a different number of host target binding sites in untranslated regions of a VGAM1220 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1220 RNA, herein designated VGAM RNA, to host target binding sites on VGAM1220 host target RNA, herein designated VGAM HOST TARGET RNA, such as BINDING SITE I, BINDING SITE II and BINDING SITE III, inhibits translation of VGAM1220 host target RNA into VGAM1220 host target protein, herein designated VGAM HOST TARGET PROTEIN. VGAM host target protein is therefore outlined by a broken line.

It is appreciated that VGAM1220 host target gene, herein designated VGAM HOST TARGET GENE, in fact represents a plurality of VGAM1220 host target genes. The mRNA of each one of this plurality of VGAM1220 host target genes comprises one or more host target binding sites, each having a nucleotide sequence which is at least partly complementary to VGAM1220 RNA, herein designated VGAM RNA, and which when bound by VGAM1220 RNA causes inhibition of translation of respective one or more VGAM1220 host target proteins.

It is further appreciated by one skilled in the art that the mode of translational inhibition illustrated by FIG. 1 with specific reference to translational inhibition exerted by VGAM1220 gene, herein designated VGAM GENE, on one or more VGAM1220 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1220 is inhibition of expression of host target genes, as part of a novel viral mechanism of attacking a host. Accordingly, utilities of VGAM1220 include diagnosis, prevention and treatment of viral infection by Fowl Adenovirus D. Specific functions, and accordingly utilities, of VGAM1220 correlate with, and may be deduced from, the identity of the host target genes which VGAM1220 binds and inhibits, and the function of these host target genes, as elaborated hereinbelow.

Nucleotide sequences of the VGAM1220 precursor RNA, herein designated VGAM PRECURSOR RNA, and of the 'diced' VGAM1220 RNA, herein designated VGAM RNA, and a schematic representation of the secondary folding of VGAM1220 folded precursor RNA, herein designated VGAM FOLDED PRECURSOR RNA, of VGAM1220 are further described hereinbelow with reference to Table 1.

Nucleotide sequences of host target binding sites, such as BINDING SITE-I, BINDING SITE-II and BINDING SITE-III of FIG. 1, found on VGAM1220 host target RNA, and schematic representation of the complementarity of each of these host target binding sites to VGAM1220 RNA, herein designated VGAM RNA, are described hereinbelow with reference to Table 2.

As mentioned hereinabove with reference to FIG. 1, a function of VGAM1220 gene, herein designated VGAM is inhibition of expression of VGAM1220 target genes. It is appreciated that specific functions, and accordingly utilities, of VGAM1220 correlate with, and may be deduced from, the identity of the target genes which VGAM1220 binds and inhibits, and the function of these target genes, as elaborated hereinbelow.

Chromosome 1 Open Reading Frame 1 (C1orf1, Accession NM_001213) is a VGAM1220 host target gene. C1orf1 BINDING SITE is HOST TARGET binding site found in the 3' untranslated region of mRNA encoded by C1orf1, corresponding to a HOST TARGET binding site such as BINDING SITE I, BINDING SITE II or BINDING SITE III. Table 2 illustrates the complementarity of the nucleotide sequences of C1orf1 BINDING SITE, designated SEQ ID:6873, to the nucleotide sequence of VGAM1220 RNA, herein designated VGAM RNA, also designated SEQ ID:3931.

A function of VGAM1220 is therefore inhibition of Chromosome 1 Open Reading Frame 1 (C1orf1, Accession NM_001213). Accordingly, utilities of VGAM1220 include diagnosis, prevention and treatment of diseases and clinical conditions associated with C1orf1. Cyclic Nucleotide Gated Channel Alpha 3 (CNGA3, Accession NM_001298) is another VGAM1220 host target gene. CNGA3 BINDING SITE is HOST TARGET binding site found in the 3' untranslated region of mRNA encoded by CNGA3, corresponding to a HOST TARGET binding site such as BINDING SITE I, BINDING SITE II or BINDING SITE III. Table 2 illustrates the complementarity of the nucleotide sequences of CNGA3 BINDING SITE, designated SEQ ID:6978, to the nucleotide sequence of VGAM1220 RNA, herein designated VGAM RNA, also designated SEQ ID:3931.

Another function of VGAM1220 is therefore inhibition of Cyclic Nucleotide Gated Channel Alpha 3 (CNGA3, Accession NM_001298). Accordingly, utilities of VGAM1220 include diagnosis, prevention and treatment of diseases and clinical conditions associated with CNGA3. Cut-like 1, CCAAT Displacement Protein (Drosophila) (CUTL1, Accession NM_001913) is another VGAM1220 host target gene. CUTL1 BINDING SITE is HOST TARGET binding site found in the 3' untranslated region of mRNA encoded by CUTL1, corresponding to a HOST TARGET binding site such as BINDING SITE I, BINDING SITE II or BINDING SITE III. Table 2 illustrates the complementarity of the nucleotide sequences of CUTL1 BINDING SITE, designated SEQ ID:7629, to the nucleotide sequence of VGAM1220 RNA, herein designated VGAM RNA, also designated SEQ ID:3931.

Another function of VGAM1220 is therefore inhibition of Cut-like 1, CCAAT Displacement Protein (Drosophila) (CUTL1, Accession NM_001913), a gene which may regulate gene expression, morphogenesis, and differentiation. Accordingly, utilities of VGAM1220 include diagnosis, prevention and treatment of diseases and clinical conditions associated with CUTL1. The function of CUTL1 has been established by previous studies. The activity of CDP, CCAAT displacement protein, was first identified in sea urchin as a possible repressor of a sperm-specific histone H2b gene. As implied by its name, CDP is thought to act by preventing binding of positively-acting CCAAT factors to promoters, although there is little experimental evidence for this (Neufeld, 1995). The wide distribution of CDP in mammalian cell lines and its postulated mechanism of action made it a potential candidate for a general repressor of developmentally regulated genes. Neufeld et al. (1992) purified CDP from HeLa cells by DNA binding-site affinity chromatography. The cDNA encoding CDP was obtained by immunoscreening a lambda-gt11 library with antibody raised against purified protein. The deduced primary amino acid sequence of CDP showed remarkable homology to the Drosophila homeoprotein cut with respect to the presence of a unique homeodomain and 'cut repeats.' As cut participates in determination of cell fate in several tissues in Drosophila, the similarity predicts a broad role for CDP in mammalian development. Neufeld et al. (1992) studied CDP because of its likely role in regulation of the gene encoding the protein deficient in X-linked chronic granulomatous disease (OMIM Ref. No. 306400). Zeng et al. (1997) identified polymorphic markers within and directly adjacent to CUTL1 at 7q22 and demonstrated that these markers are present in a commonly deleted region in 7 of 50 uterine leiomyomas examined. Furthermore, Northern blot analysis revealed that CUTL1 mRNA levels were reduced in 8 of 13 tumors. Zeng et al. (1997) concluded that CUTL1 may act as a tumor suppressor gene whose inactivation could be of pathologic importance in the etiology of uterine leiomyomas.

Full details of the abovementioned studies are described in the following publications, the disclosure of which are hereby incorporated by reference:

Neufeld, E. J.; Skalnik, D. G.; Lievens, P. M.-J.; Orkin, S. H.: Human CCAAT displacement protein is homologous to the Drosophila homeoprotein, cut. Nature Genet. 1:50-55, 1992; and Snyder, S. R.; Wang, J.; Waring, J. F.; Ginder, G. D.: Identification of CCAAT displacement protein (CDP/cut) as a locus-specific repressor of major histocompatibility complex gene expr.

Further studies establishing the function and utilities of CUTL1 are found in John Hopkins OMIM database record ID 116896, and in sited publications numbered 4094-4099 listed in the bibliography section hereinbelow, which are also hereby incorporated by reference. Integrin, Alpha 5 (fibronectin receptor, alpha polypeptide) (ITGA5, Accession XM_028642) is another VGAM1220 host target gene. ITGA5 BINDING SITE is HOST TARGET binding site found in the 3' untranslated region of mRNA encoded by ITGA5, corresponding to a HOST TARGET binding site such as BINDING SITE I, BINDING SITE II or BINDING SITE III. Table 2 illustrates the complementarity of the nucleotide sequences of ITGA5 BINDING SITE, designated SEQ ID:30723, to the nucleotide sequence of VGAM1220 RNA, herein designated VGAM RNA, also designated SEQ ID:3931.

Another function of VGAM1220 is therefore inhibition of Integrin, Alpha 5 (fibronectin receptor, alpha polypeptide) (ITGA5, Accession XM_028642), a gene which is receptor for fibronectin and fibrinogen and recognizes the sequence r-g-d in its ligands. Accordingly, utilities of VGAM1220 include diagnosis, prevention and treatment of diseases and clinical conditions associated with ITGA5. The function of ITGA5 has been established by previous studies. The fibronectin receptor, a member of the integrin family of heterodimeric glycopeptides, mediates the binding of cells to fibronectin substrata. To study the structure of the receptor, Argraves et al. (1986) isolated cDNA clones coding for the alpha subunit from a placental cDNA library. The cDNAs code for 229 amino acids from the C-terminus of the alpha subunit. The deduced sequence had a hydrophobic region with properties characteristic of a membrane-spanning domain. Argraves et al. (1987) deduced the amino acid sequence from cDNA. The alpha subunit, which is processed into 2 polypeptides disulfide-bonded to one another, has 1,008 amino acids; the beta subunit has 778 amino acids. Fitzgerald et al. (1987) presented comparisons of the cDNA-derived protein sequences of fibronectin receptor, vitronectin receptor (OMIM Ref. No. 193210), and platelet glycoprotein IIb (OMIM Ref. No. 273800). Sosnoski et al. (1988) assigned the FNRA gene to 12q11-q13 by Southern analysis of somatic cell hybrid DNA. Location on chromosome 12 was confirmed by Spurr and Rooke (1991) by study of human/rodent somatic cell hybrids. Krissansen et al. (1992) pointed out the possible significance of the fact that a related gene coding for integrin beta-7 subunit (ITGB7; 147559) is also located on chromosome 12. Adkison et al. (1994) mapped the murine homolog, Itga5, to chromosome 15, distal to D15Mit16, by analysis of DNA from an interspecific backcross Full details of the abovementioned studies are described in the following publications, the disclosure of which are hereby incorporated by reference:

Adkison, L. R.; White, R. A.; Haney, D. M.; Lee, J. C.; Pusey, K. T.; Gardner, J. : The fibronectin receptor, alpha subunit (Itga5) maps to murine chromosome 15, distal to D15Mit16. Mammalian Genome 5:456-457, 1994; and Argraves, W. S.; Pytela, R.; Suzuki, S.; Millan, J. L.; Pierschbacher, M. D.; Ruoslahti, E.: cDNA sequences from the alpha subunit of the fibronectin receptor predict a transmembrane d.

Further studies establishing the function and utilities of ITGA5 are found in John Hopkins OMIM database record ID 135620, and in sited publications numbered 3333-3339 listed in the bibliography section hereinbelow, which are also hereby incorporated by reference. Nucleosome Assembly Protein 1-like 4 (NAP1L4, Accession NM_005969) is another VGAM1220 host target gene. NAP1L4 BINDING SITE is HOST TARGET binding site found in the 3' untranslated region of mRNA encoded by NAP1L4, corresponding to a HOST TARGET binding site such as BINDING SITE I, BINDING SITE II or BINDING SITE III. Table 2 illustrates the complementarity of the nucleotide sequences of NAP1L4 BINDING SITE, designated SEQ ID:12590, to the nucleotide sequence of VGAM1220 RNA, herein designated VGAM RNA, also designated SEQ ID:3931.

Another function of VGAM1220 is therefore inhibition of Nucleosome Assembly Protein 1-like 4 (NAP1L4, Accession NM_005969), a gene which may have a role as a histone chaperone. Accordingly, utilities of VGAM1220 include diagnosis, prevention and treatment of diseases and clinical conditions associated with NAP1L4. The function of NAP1L4 and its association with various diseases and clinical conditions, has been established by previous studies, as described hereinabove with reference to VGAM949. Thrombomodulin (THBD, Accession NM_000361) is another VGAM1220 host target gene. THBD BINDING SITE is HOST TARGET binding site found in the 3' untranslated region of mRNA encoded by THBD, corresponding to a HOST TARGET binding site such as BINDING SITE I, BINDING SITE II or BINDING SITE III. Table 2 illustrates the complementarity of the nucleotide sequences of THBD BINDING SITE, designated SEQ ID:5919, to the nucleotide sequence of VGAM1220 RNA, herein designated VGAM RNA, also designated SEQ ID:3931.

Another function of VGAM1220 is therefore inhibition of Thrombomodulin (THBD, Accession NM_000361). Accordingly, utilities of VGAM1220 include diagnosis, prevention and treatment of diseases and clinical conditions associated with THBD. IMPACT (Accession NM_018439) is another VGAM1220 host target gene. IMPACT BINDING SITE is HOST TARGET binding site found in the 3' untranslated region of mRNA encoded by IMPACT, corresponding to a HOST TARGET binding site such as BINDING SITE I, BINDING SITE II or BINDING SITE III. Table 2 illustrates the complementarity of the nucleotide sequences of IMPACT BINDING SITE, designated SEQ ID:20500, to the nucleotide sequence of VGAM1220 RNA, herein designated VGAM RNA, also designated SEQ ID:3931.

Another function of VGAM1220 is therefore inhibition of IMPACT (Accession NM_018439). Accordingly, utilities of VGAM1220 include diagnosis, prevention and treatment of diseases and clinical conditions associated with IMPACT. KIAA0193 (Accession NM_014766) is another VGAM1220 host target gene. KIAA0193 BINDING SITE is HOST TARGET binding site found in the 3' untranslated region of mRNA encoded by KIAA0193, corresponding to a HOST TARGET binding site such as BINDING SITE I, BINDING SITE II or BINDING SITE III. Table 2 illustrates the complementarity of the nucleotide sequences of KIAA0193 BINDING SITE, designated SEQ ID:16544, to the nucleotide sequence of VGAM1220 RNA, herein designated VGAM RNA, also designated SEQ ID:3931.

Another function of VGAM1220 is therefore inhibition of KIAA0193 (Accession NM_014766). Accordingly, utilities of VGAM1220 include diagnosis, prevention and treatment of diseases and clinical conditions associated with KIAA0193. KIAA0476 (Accession NM_014856) is another VGAM1220 host target gene. KIAA0476 BINDING SITE is HOST TARGET binding site found in the 3' untranslated region of mRNA encoded by KIAA0476, corresponding to a HOST TARGET binding site such as BINDING SITE I, BINDING SITE II or BINDING SITE III. Table 2 illustrates the complementarity of the nucleotide sequences of KIAA0476 BINDING SITE, designated SEQ ID:16905, to the nucleotide sequence of VGAM1220 RNA, herein designated VGAM RNA, also designated SEQ ID:3931.

Another function of VGAM1220 is therefore inhibition of KIAA0476 (Accession NM_014856). Accordingly, utilities of VGAM1220 include diagnosis, prevention and treatment of diseases and clinical conditions associated with KIAA0476. KIAA1337 (Accession XM_052561) is another VGAM1220 host target gene. KIAA1337 BINDING SITE is HOST TARGET binding site found in the 3' untranslated region of mRNA encoded by KIAA1337, corresponding to a HOST TARGET binding site such as BINDING SITE I, BINDING SITE II or BINDING SITE III. Table 2 illustrates the complementarity of the nucleotide sequences of KIAA1337 BINDING SITE, designated SEQ ID:35984, to the nucleotide sequence of VGAM1220 RNA, herein designated VGAM RNA, also designated SEQ ID:3931.

Another function of VGAM1220 is therefore inhibition of KIAA1337 (Accession XM_052561). Accordingly, utilities of VGAM1220 include diagnosis, prevention and treatment of diseases and clinical conditions associated with KIAA1337. MGC4415 (Accession NM_031484) is another VGAM1220 host target gene. MGC4415 BINDING SITE is HOST TARGET binding site found in the 3' untranslated region of mRNA encoded by MGC4415, corresponding to a HOST TARGET binding site such as BINDING SITE I, BINDING SITE II or BINDING SITE III. Table 2 illustrates the complementarity of the nucleotide sequences of MGC4415 BINDING SITE, designated SEQ ID:25569, to the nucleotide sequence of VGAM1220 RNA, herein designated VGAM RNA, also designated SEQ ID:3931.

Another function of VGAM1220 is therefore inhibition of MGC4415 (Accession NM_031484). Accordingly, utilities of VGAM1220 include diagnosis, prevention and treatment of diseases and clinical conditions associated with MGC4415. PI4KII (Accession NM_018425) is another VGAM1220 host target gene. PI4KII BINDING SITE is HOST TARGET binding site found in the 3' untranslated region of mRNA encoded by PI4KII, corresponding to a HOST TARGET binding site such as BINDING SITE I, BINDING SITE II or BINDING SITE III. Table 2 illustrates the complementarity of the nucleotide sequences of PI4KII BINDING SITE, designated SEQ ID:20481, to the nucleotide sequence of VGAM1220 RNA, herein designated VGAM RNA, also designated SEQ ID:3931.

Another function of VGAM1220 is therefore inhibition of PI4KII (Accession NM_018425). Accordingly, utilities of VGAM1220 include diagnosis, prevention and treatment of diseases and clinical conditions associated with PI4KII. Trans-golgi Network Protein 2 (TGOLN2, Accession XM_034215) is another VGAM1220 host target gene. TGOLN2 BINDING SITE is HOST TARGET binding site found in the 5' untranslated region of mRNA encoded by TGOLN2, corresponding to a HOST TARGET binding site such as BINDING SITE I, BINDING SITE II or BINDING SITE III. Table 2 illustrates the complementarity of the nucleotide sequences of TGOLN2 BINDING SITE, designated SEQ ID:32025, to the nucleotide sequence of VGAM1220 RNA, herein designated VGAM RNA, also designated SEQ ID:3931.

Another function of VGAM1220 is therefore inhibition of Trans-golgi Network Protein 2 (TGOLN2, Accession XM_034215). Accordingly, utilities of VGAM1220 include diagnosis, prevention and treatment of diseases and clinical conditions associated with TGOLN2. LOC126353 (Accession XM_059034) is another VGAM1220 host target gene. LOC126353 BINDING SITE is HOST TARGET binding site found in the 3' untranslated region of mRNA encoded by LOC126353, corresponding to a HOST TARGET binding site such as BINDING SITE I, BINDING SITE II or BINDING SITE III. Table 2 illustrates the complementarity of the nucleotide sequences of LOC126353 BINDING SITE, designated SEQ ID:36828, to the nucleotide sequence of VGAM1220 RNA, herein designated VGAM RNA, also designated SEQ ID:3931.

Another function of VGAM1220 is therefore inhibition of LOC126353 (Accession XM_059034). Accordingly, utilities of VGAM1220 include diagnosis, prevention and treatment of diseases and clinical conditions associated with LOC126353. LOC151475 (Accession XM_098063) is another VGAM1220 host target gene. LOC151475 BINDING SITE is HOST TARGET binding site found in the 5' untranslated region of mRNA encoded by LOC151475, corresponding to a HOST TARGET binding site such as BINDING SITE I, BINDING SITE II or BINDING SITE III. Table 2 illustrates the complementarity of the nucleotide sequences of LOC151475 BINDING SITE, designated SEQ ID:41353, to the nucleotide sequence of VGAM1220 RNA, herein designated VGAM RNA, also designated SEQ ID:3931.

Another function of VGAM1220 is therefore inhibition of LOC151475 (Accession XM_098063). Accordingly, utilities of VGAM1220 include diagnosis, prevention and treatment of diseases and clinical conditions associated with LOC151475. LOC197423 (Accession XM_085436) is another VGAM1220 host target gene. LOC197423 BINDING SITE is HOST TARGET binding site found in the 5' untranslated region of mRNA encoded by LOC197423, corresponding to a HOST TARGET binding site such as BINDING SITE I, BINDING SITE II or BINDING SITE III. Table 2 illustrates the complementarity of the nucleotide sequences of LOC197423 BINDING SITE, designated SEQ ID:38143, to the nucleotide sequence of VGAM1220 RNA, herein designated VGAM RNA, also designated SEQ ID:3931.

Another function of VGAM1220 is therefore inhibition of LOC197423 (Accession XM_085436). Accordingly, utilities of VGAM1220 include diagnosis, prevention and treatment of diseases and clinical conditions associated with LOC197423. LOC200138 (Accession XM_117194) is another VGAM1220 host target gene. LOC200138 BINDING SITE is HOST TARGET binding site found in the 5' untranslated region of mRNA encoded by LOC200138, corresponding to a HOST TARGET binding site such as BINDING SITE I, BINDING SITE II or BINDING SITE III. Table 2 illustrates the complementarity of the nucleotide sequences of LOC200138 BINDING SITE, designated SEQ ID:43279, to the nucleotide sequence of VGAM1220 RNA, herein designated VGAM RNA, also designated SEQ ID:3931.

Another function of VGAM1220 is therefore inhibition of LOC200138 (Accession XM_117194). Accordingly, utilities of VGAM1220 include diagnosis, prevention and treatment of diseases and clinical conditions associated with LOC200138. LOC220753 (Accession XM_167549) is another VGAM1220 host target gene. LOC220753 BINDING SITE is HOST TARGET binding site found in the 5' untranslated region of mRNA encoded by LOC220753, corresponding to a HOST TARGET binding site such as BINDING SITE I, BINDING SITE II or BINDING SITE III. Table 2 illustrates the complementarity of the nucleotide sequences of LOC220753 BINDING SITE, designated SEQ ID:44663, to the nucleotide sequence of VGAM1220 RNA, herein designated VGAM RNA, also designated SEQ ID:3931.

Another function of VGAM1220 is therefore inhibition of LOC220753 (Accession XM_167549). Accordingly, utilities of VGAM1220 include diagnosis, prevention and treatment of diseases and clinical conditions associated with LOC220753. LOC254559 (Accession XM_172931) is another VGAM1220 host target gene. LOC254559 BINDING SITE is HOST TARGET binding site found in the 5' untranslated region of mRNA encoded by LOC254559, corresponding to a HOST TARGET binding site such as BINDING SITE I, BINDING SITE II or BINDING SITE III. Table 2 illustrates the complementarity of the nucleotide sequences of LOC254559 BINDING SITE, designated SEQ ID:46195, to the nucleotide sequence of VGAM1220 RNA, herein designated VGAM RNA, also designated SEQ ID:3931.

Another function of VGAM1220 is therefore inhibition of LOC254559 (Accession XM_172931). Accordingly, utilities of VGAM1220 include diagnosis, prevention and treatment of diseases and clinical conditions associated with LOC254559. LOC57795 (Accession XM_045110) is another VGAM1220 host target gene. LOC57795 BINDING SITE is HOST TARGET binding site found in the 5' untranslated region of mRNA encoded by LOC57795, corresponding to a HOST TARGET binding site such as BINDING SITE I, BINDING SITE II or BINDING SITE III. Table 2 illustrates the complementarity of the nucleotide sequences of LOC57795 BINDING SITE, designated SEQ ID:34358, to the nucleotide sequence of VGAM1220 RNA, herein designated VGAM RNA, also designated SEQ ID:3931.

Another function of VGAM1220 is therefore inhibition of LOC57795 (Accession XM_045110). Accordingly, utilities of VGAM1220 include diagnosis, prevention and treatment of diseases and clinical conditions associated with LOC57795. LOC90120 (Accession XM_029168) is another VGAM1220 host target gene. LOC90120 BINDING SITE is HOST TARGET binding site found in the 5' untranslated region of mRNA encoded by LOC90120, corresponding to a HOST TARGET binding site such as BINDING SITE I, BINDING SITE II or BINDING SITE III. Table 2 illustrates the complementarity of the nucleotide sequences of LOC90120 BINDING SITE, designated SEQ ID:30853, to the nucleotide sequence of VGAM1220 RNA, herein designated VGAM RNA, also designated SEQ ID:3931.

Another function of VGAM1220 is therefore inhibition of LOC90120 (Accession XM_029168). Accordingly, utilities of VGAM1220 include diagnosis, prevention and treatment of diseases and clinical conditions associated with LOC90120. LOC93613 (Accession XM_052568) is another VGAM1220 host target gene. LOC93613 BINDING SITE is HOST TARGET binding site found in the 5' untranslated region of mRNA encoded by LOC93613, corresponding to a HOST TARGET binding site such as BINDING SITE I, BINDING SITE II or BINDING SITE III. Table 2 illustrates the complementarity of the nucleotide sequences of LOC93613 BINDING SITE, designated SEQ ID:35994, to the nucleotide sequence of VGAM1220 RNA, herein designated VGAM RNA, also designated SEQ ID:3931.

Another function of VGAM1220 is therefore inhibition of LOC93613 (Accession XM_052568). Accordingly, utilities of VGAM1220 include diagnosis, prevention and treatment of diseases and clinical conditions associated with LOC93613. FIG. 1 further provides a conceptual description of a novel bioinformatically detected viral gene of the present invention, referred to here as Viral Genomic Address Messenger 1221 (VGAM1221) viral gene, which modulates expression of respective host target genes thereof, the function and utility of which host target genes is known in the art.

VGAM1221 is a novel bioinformatically detected regulatory, non protein coding, viral micro RNA (miRNA) gene. The method by which VGAM1221 was detected is described hereinabove with reference to FIGS. 1-8.

VGAM1221 gene, herein designated VGAM GENE, is a viral gene contained in the genome of Fowl Adenovirus D. VGAM1221 host target gene, herein designated VGAM HOST TARGET GENE, is a human gene contained in the human genome.

VGAM1221 gene encodes a VGAM1221 precursor RNA, herein designated VGAM PRECURSOR RNA. Similar to other miRNA genes, and unlike most ordinary genes, VGAM1221 precursor RNA does not encode a protein. A nucleotide sequence identical or highly similar to the nucleotide sequence of VGAM1221 precursor RNA is designated SEQ ID:1207, and is provided hereinbelow with reference to the sequence listing part. Nucleotide sequence SEQ ID:1207 is located at position 26938 relative to the genome of Fowl Adenovirus D.

VGAM1221 precursor RNA folds onto itself, forming VGAM1221 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1221 folded precursor RNA into VGAM1221 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1221 RNA is designated SEQ ID:3932, and is provided hereinbelow with reference to the sequence listing part.

VGAM1221 host target gene, herein designated VGAM HOST TARGET GENE, encodes a corresponding messenger RNA, VGAM1221 host target RNA, herein designated VGAM HOST TARGET RNA. VGAM1221 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1221 RNA, herein designated VGAM RNA, binds complementarily to one or more host target binding sites located in untranslated regions of VGAM1221 host target RNA, herein designated VGAM HOST TARGET RNA. This complementary binding is due to the fact that the nucleotide sequence of VGAM1221 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1221 RNA, herein designated VGAM RNA, may have a different number of host target binding sites in untranslated regions of a VGAM1221 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1221 RNA, herein designated VGAM RNA, to host target binding sites on VGAM1221 host target RNA, herein designated VGAM HOST TARGET RNA, such as BINDING SITE I, BINDING SITE II and BINDING SITE III, inhibits translation of VGAM1221 host target RNA into VGAM1221 host target protein, herein designated VGAM HOST TARGET PROTEIN. VGAM host target protein is therefore outlined by a broken line.

It is appreciated that VGAM1221 host target gene, herein designated VGAM HOST TARGET GENE, in fact represents a plurality of VGAM1221 host target genes. The mRNA of each one of this plurality of VGAM1221 host target genes comprises one or more host target binding sites, each having a nucleotide sequence which is at least partly complementary to VGAM1221 RNA, herein designated VGAM RNA, and which when bound by VGAM1221 RNA causes inhibition of translation of respective one or more VGAM1221 host target proteins.

It is further appreciated by one skilled in the art that the mode of translational inhibition illustrated by FIG. 1 with specific reference to translational inhibition exerted by VGAM1221 gene, herein designated VGAM GENE, on one or more VGAM1221 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1221 is inhibition of expression of host target genes, as part of a novel viral mechanism of attacking a host. Accordingly, utilities of VGAM1221 include diagnosis, prevention and treatment of viral infection by Fowl Adenovirus D. Specific functions, and accordingly utilities, of VGAM1221 correlate with, and may be deduced from, the identity of the host target genes which VGAM1221 binds and inhibits, and the function of these host target genes, as elaborated hereinbelow.

Nucleotide sequences of the VGAM1221 precursor RNA, herein designated VGAM PRECURSOR RNA, and of the 'diced' VGAM1221 RNA, herein designated VGAM RNA, and a schematic representation of the secondary folding of VGAM1221 folded precursor RNA, herein designated VGAM FOLDED PRECURSOR RNA, of VGAM1221 are further described hereinbelow with reference to Table 1.

Nucleotide sequences of host target binding sites, such as BINDING SITE-I, BINDING SITE-II and BINDING SITE-III of FIG. 1, found on VGAM1221 host target RNA, and schematic representation of the complementarity of each of these host target binding sites to VGAM1221 RNA, herein designated VGAM RNA, are described hereinbelow with reference to Table 2.

As mentioned hereinabove with reference to FIG. 1, a function of VGAM1221 gene, herein designated VGAM is inhibition of expression of VGAM1221 target genes. It is appreciated that specific functions, and accordingly utilities, of VGAM1221 correlate with, and may be deduced from, the identity of the target genes which VGAM1221 binds and inhibits, and the function of these target genes, as elaborated hereinbelow.

Diptheria Toxin Resistance Protein Required For Diphthamide Biosynthesis-like 2 (S. cerevisiae) (DPH2L2, Accession NM_001384) is a VGAM1221 host target gene. DPH2L2 BINDING SITE is HOST TARGET binding site found in the 3' untranslated region of mRNA encoded by DPH2L2, corresponding to a HOST TARGET binding site such as BINDING SITE I, BINDING SITE II or BINDING SITE III. Table 2 illustrates the complementarity of the nucleotide sequences of DPH2L2 BINDING SITE, designated SEQ ID:7059, to the nucleotide sequence of VGAM1221 RNA, herein designated VGAM RNA, also designated SEQ ID:3932.

A function of VGAM1221 is therefore inhibition of Diptheria Toxin Resistance Protein Required For Diphthamide Biosynthesis-like 2 (S. cerevisiae) (DPH2L2, Accession NM_001384), a gene which is required for diphthamide biosynthesis. Accordingly, utilities of VGAM1221 include diagnosis, prevention and treatment of diseases and clinical conditions associated with DPH2L2. The function of DPH2L2 has been established by previous studies. Diphtheria toxin inhibits eukaryotic protein synthesis by ADP-ribosylating diphthamide, a posttranslationally modified histidine residue present in EF2 (OMIM Ref. No. 130610)(Foley et al., 1995). Mattheakis et al. (1993) found that dph2, a S. cerevisiae diphtheria resistance gene, encodes a protein involved in diphthamide biosynthesis. By searching an EST database, Schultz et al. (1998) identified a human cDNA with 63% identity to the corresponding nucleotide sequence of human DPH2-like 1 (DPH2L1/OVCA1; 603527). Using a PCR strategy, they recovered cDNAs corresponding to the entire coding region of the gene, which they called DPH2L2. The predicted 489-amino acid protein shared 24% and 28% sequence identity with DPH2L1 and yeast dph2, respectively. Northern blot analysis revealed that DPH2L2 was expressed ubiquitously as a 2.5-kb mRNA. An additional 3-kb transcript was found in several tissues. By fluorescence in situ hybridization, Schultz et al. (1998) mapped the DPH2L2 gene to 1p34.

Full details of the abovementioned studies are described in the following publications, the disclosure of which are hereby incorporated by reference:

Foley, B. T.; Moehring, J. M.; Moehring, T. J.: Mutations in the elongation factor 2 gene which confer resistance to diphtheria toxin and Pseudomonas exotoxin A: genetic and biochemical analyses. J. Biol. Chem. 270:23218-23225, 1995; and Schultz, D. C.; Balasara, B. R.; Testa, J. R.; Godwin, A. K.: Cloning and localization of a human diphthamide biosynthesis-like protein-2 gene, DPH2L2. Genomics 52:186-191, 1998.

Further studies establishing the function and utilities of DPH2L2 are found in John Hopkins OMIM database record ID 603456, and in sited publications numbered 5983-5985 listed in the bibliography section hereinbelow, which are also hereby incorporated by reference. Dual-specificity tyrosine-(Y)-phosphorylation Regulated Kinase 1A (DYRK1A, Accession NM_101395) is another VGAM1221 host target gene. DYRK1A BINDING SITE is HOST TARGET binding site found in the 3' untranslated region of mRNA encoded by DYRK1A, corresponding to a HOST TARGET binding site such as BINDING SITE I, BINDING SITE II or BINDING SITE III. Table 2 illustrates the complementarity of the nucleotide sequences of DYRK1A BINDING SITE, designated SEQ ID:28166, to the nucleotide sequence of VGAM1221 RNA, herein designated VGAM RNA, also designated SEQ ID:3932.

Another function of VGAM1221 is therefore inhibition of Dual-specificity tyrosine-(Y)-phosphorylation Regulated Kinase 1A (DYRK1A, Accession NM_101395), a gene which regulates cell proliferation and may be involved in brain development. Accordingly, utilities of VGAM1221 include diagnosis, prevention and treatment of diseases and clinical conditions associated with DYRK1A. The function of DYRK1A and its association with various diseases and clinical conditions, has been established by previous studies, as described hereinabove with reference to VGAM42. Interleukin 2 Receptor, Beta (IL2RB, Accession NM_000878) is another VGAM1221 host target gene. IL2RB BINDING SITE is HOST TARGET binding site found in the 3' untranslated region of mRNA encoded by IL2RB, corresponding to a HOST TARGET binding site such as BINDING SITE I, BINDING SITE II or BINDING SITE III. Table 2 illustrates the complementarity of the nucleotide sequences of IL2RB BINDING SITE, designated SEQ ID:6568, to the nucleotide sequence of VGAM1221 RNA, herein designated VGAM RNA, also designated SEQ ID:3932.

Another function of VGAM1221 is therefore inhibition of Interleukin 2 Receptor, Beta (IL2RB, Accession NM_000878), a gene which is involved in receptor mediated endocytosis and transduces the mitogenic signals of il-2. Accordingly, utilities of VGAM1221 include diagnosis, prevention and treatment of diseases and clinical conditions associated with IL2RB. The function of IL2RB and its association with various diseases and clinical conditions, has been established by previous studies, as described hereinabove with reference to VGAM450. Vacuolar Protein Sorting 26 (yeast) (VPS26, Accession NM_004896) is another VGAM1221 host target gene. VPS26 BINDING SITE is HOST TARGET binding site found in the 3' untranslated region of mRNA encoded by VPS26, corresponding to a HOST TARGET binding site such as BINDING SITE I, BINDING SITE II or BINDING SITE III. Table 2 illustrates the complementarity of the nucleotide sequences of VPS26 BINDING SITE, designated SEQ ID:11324, to the nucleotide sequence of VGAM1221 RNA, herein designated VGAM RNA, also designated SEQ ID:3932.

Another function of VGAM1221 is therefore inhibition of Vacuolar Protein Sorting 26 (yeast) (VPS26, Accession NM_004896), a gene which is a sorting protein- ensures the proper delivery of organelle-specific proteins. Accordingly, utilities of VGAM1221 include diagnosis, prevention and treatment of diseases and clinical conditions associated with VPS26. The function of VPS26 and its association with various diseases and clinical conditions, has been established by previous studies, as described hereinabove with reference to VGAM315. Cystatin F (leukocystatin) (CST7, Accession NM_003650) is another VGAM1221 host target gene. CST7 BINDING SITE is HOST TARGET binding site found in the 5' untranslated region of mRNA encoded by CST7, corresponding to a HOST TARGET binding site such as BINDING SITE I, BINDING SITE II or BINDING SITE III. Table 2 illustrates the complementarity of the nucleotide sequences of CST7 BINDING SITE, designated SEQ ID:9725, to the nucleotide sequence of VGAM1221 RNA, herein designated VGAM RNA, also designated SEQ ID:3932.

Another function of VGAM1221 is therefore inhibition of Cystatin F (leukocystatin) (CST7, Accession NM_003650). Accordingly, utilities of VGAM1221 include diagnosis, prevention and treatment of diseases and clinical conditions associated with CST7. Forkhead Box D4 (FOXD4, Accession XM_095746) is another VGAM1221 host target gene. FOXD4 BINDING SITE is HOST TARGET binding site found in the 5' untranslated region of mRNA encoded by FOXD4, corresponding to a HOST TARGET binding site such as BINDING SITE I, BINDING SITE II or BINDING SITE III. Table 2 illustrates the complementarity of the nucleotide sequences of FOXD4 BINDING SITE, designated SEQ ID:40281, to the nucleotide sequence of VGAM1221 RNA, herein designated VGAM RNA, also designated SEQ ID:3932.

Another function of VGAM1221 is therefore inhibition of Forkhead Box D4 (FOXD4, Accession XM_095746). Accordingly, utilities of VGAM1221 include diagnosis, prevention and treatment of diseases and clinical conditions associated with FOXD4. KIAA0427 (Accession NM_014772) is another VGAM1221 host target gene. KIAA0427 BINDING SITE is HOST TARGET binding site found in the 3' untranslated region of mRNA encoded by KIAA0427, corresponding to a HOST TARGET binding site such as BINDING SITE I, BINDING SITE II or BINDING SITE III. Table 2 illustrates the complementarity of the nucleotide sequences of KIAA0427 BINDING SITE, designated SEQ ID:16570, to the nucleotide sequence of VGAM1221 RNA, herein designated VGAM RNA, also designated SEQ ID:3932.

Another function of VGAM1221 is therefore inhibition of KIAA0427 (Accession NM_014772). Accordingly, utilities of VGAM1221 include diagnosis, prevention and treatment of diseases and clinical conditions associated with KIAA0427. KIAA0794 (Accession XM_087353) is another VGAM1221 host target gene. KIAA0794 BINDING SITE is HOST TARGET binding site found in the 3' untranslated region of mRNA encoded by KIAA0794, corresponding to a HOST TARGET binding site such as BINDING SITE I, BINDING SITE II or BINDING SITE III. Table 2 illustrates the complementarity of the nucleotide sequences of KIAA0794 BINDING SITE, designated SEQ ID:39182, to the nucleotide sequence of VGAM1221 RNA, herein designated VGAM RNA, also designated SEQ ID:3932.

Another function of VGAM1221 is therefore inhibition of KIAA0794 (Accession XM_087353). Accordingly, utilities of VGAM1221 include diagnosis, prevention and treatment of diseases and clinical conditions associated with KIAA0794. KIAA0820 (Accession XM_044463) is another VGAM1221 host target gene. KIAA0820 BINDING SITE is HOST TARGET binding site found in the 3' untranslated region of mRNA encoded by KIAA0820, corresponding to a HOST TARGET binding site such as BINDING SITE I, BINDING SITE II or BINDING SITE III. Table 2 illustrates the complementarity of the nucleotide sequences of KIAA0820 BINDING SITE, designated SEQ ID:34216, to the nucleotide sequence of VGAM1221 RNA, herein designated VGAM RNA, also designated SEQ ID:3932.

Another function of VGAM1221 is therefore inhibition of KIAA0820 (Accession XM_044463). Accordingly, utilities of VGAM1221 include diagnosis, prevention and treatment of diseases and clinical conditions associated with KIAA0820. KIAA1024 (Accession XM_044580) is another VGAM1221 host target gene. KIAA1024 BINDING SITE is HOST TARGET binding site found in the 3' untranslated region of mRNA encoded by KIAA1024, corresponding to a HOST TARGET binding site such as BINDING SITE I, BINDING SITE II or BINDING SITE III. Table 2 illustrates the complementarity of the nucleotide sequences of KIAA1024 BINDING SITE, designated SEQ ID:34233, to the nucleotide sequence of VGAM1221 RNA, herein designated VGAM RNA, also designated SEQ ID:3932.

Another function of VGAM1221 is therefore inhibition of KIAA1024 (Accession XM_044580). Accordingly, utilities of VGAM1221 include diagnosis, prevention and treatment of diseases and clinical conditions associated with KIAA1024. KIAA1265 (Accession XM_047707) is another VGAM1221 host target gene. KIAA1265 BINDING SITE is HOST TARGET binding site found in the 3' untranslated region of mRNA encoded by KIAA1265, corresponding to a HOST TARGET binding site such as BINDING SITE I, BINDING SITE II or BINDING SITE III. Table 2 illustrates the complementarity of the nucleotide sequences of KIAA1265 BINDING SITE, designated SEQ ID:35030, to the nucleotide sequence of VGAM1221 RNA, herein designated VGAM RNA, also designated SEQ ID:3932.

Another function of VGAM1221 is therefore inhibition of KIAA1265 (Accession XM_047707). Accordingly, utilities of VGAM1221 include diagnosis, prevention and treatment of diseases and clinical conditions associated with KIAA1265. MGC2487 (Accession NM_023932) is another VGAM1221 host target gene. MGC2487 BINDING SITE is HOST TARGET binding site found in the 5' untranslated region of mRNA encoded by MGC2487, corresponding to a HOST TARGET binding site such as BINDING SITE I, BINDING SITE II or BINDING SITE III. Table 2 illustrates the complementarity of the nucleotide sequences of MGC2487 BINDING SITE, designated SEQ ID:23422, to the nucleotide sequence of VGAM1221 RNA, herein designated VGAM RNA, also designated SEQ ID:3932.

Another function of VGAM1221 is therefore inhibition of MGC2487 (Accession NM_023932). Accordingly, utilities of VGAM1221 include diagnosis, prevention and treatment of diseases and clinical conditions associated with MGC2487. Mitochondrial Ribosomal Protein S11 (MRPS11, Accession NM_022839) is another VGAM1221 host target gene. MRPS11 BINDING SITE1 and MRPS11 BINDING SITE2 are HOST TARGET binding sites found in untranslated regions of mRNA encoded by MRPS11, corresponding to HOST TARGET binding sites such as BINDING SITE I, BINDING SITE II or BINDING SITE III. Table 2 illustrates the complementarity of the nucleotide sequences of MRPS11 BINDING SITE1 and MRPS11 BINDING SITE2, designated SEQ ID:23126 and SEQ ID:45376 respectively, to the nucleotide sequence of VGAM1221 RNA, herein designated VGAM RNA, also designated SEQ ID:3932.

Another function of VGAM1221 is therefore inhibition of Mitochondrial Ribosomal Protein S11 (MRPS11, Accession NM_022839). Accordingly, utilities of VGAM1221 include diagnosis, prevention and treatment of diseases and clinical conditions associated with MRPS11. T-cell Leukemia/lymphoma 6 (TCL6, Accession NM_020550) is another VGAM1221 host target gene. TCL6 BINDING SITE1 through TCL6 BINDING SITE4 are HOST TARGET binding sites found in untranslated regions of mRNA encoded by TCL6, corresponding to HOST TARGET binding sites such as BINDING SITE I, BINDING SITE II or BINDING SITE III. Table 2 illustrates the complementarity of the nucleotide sequences of TCL6 BINDING SITE1 through TCL6 BINDING SITE4, designated SEQ ID:21758, SEQ ID:21766, SEQ ID:14841 and SEQ ID:15764 respectively, to the nucleotide sequence of VGAM1221 RNA, herein designated VGAM RNA, also designated SEQ ID:3932.

Another function of VGAM1221 is therefore inhibition of T-cell Leukemia/lymphoma 6 (TCL6, Accession NM_020550). Accordingly, utilities of VGAM1221 include diagnosis, prevention and treatment of diseases and clinical conditions associated with TCL6. LOC152674 (Accession XM_098251) is another VGAM1221 host target gene. LOC152674 BINDING SITE is HOST TARGET binding site found in the 5' untranslated region of mRNA encoded by LOC152674, corresponding to a HOST TARGET binding site such as BINDING SITE I, BINDING SITE II or BINDING SITE III. Table 2 illustrates the complementarity of the nucleotide sequences of LOC152674 BINDING SITE, designated SEQ ID:41537, to the nucleotide sequence of VGAM1221 RNA, herein designated VGAM RNA, also designated SEQ ID:3932.

Another function of VGAM1221 is therefore inhibition of LOC152674 (Accession XM_098251). Accordingly, utilities of VGAM1221 include diagnosis, prevention and treatment of diseases and clinical conditions associated with LOC152674. LOC163782 (Accession XM_089138) is another VGAM1221 host target gene. LOC163782 BINDING SITE is HOST TARGET binding site found in the 3' untranslated region of mRNA encoded by LOC163782, corresponding to a HOST TARGET binding site such as BINDING SITE I, BINDING SITE II or BINDING SITE III. Table 2 illustrates the complementarity of the nucleotide sequences of LOC163782 BINDING SITE, designated SEQ ID:39966, to the nucleotide sequence of VGAM1221 RNA, herein designated VGAM RNA, also designated SEQ ID:3932.

Another function of VGAM1221 is therefore inhibition of LOC163782 (Accession XM_089138). Accordingly, utilities of VGAM1221 include diagnosis, prevention and treatment of diseases and clinical conditions associated with LOC163782. LOC56965 (Accession NM_020214) is another VGAM1221 host target gene. LOC56965 BINDING SITE is HOST TARGET binding site found in the 5' untranslated region of mRNA encoded by LOC56965, corresponding to a HOST TARGET binding site such as BINDING SITE I, BINDING SITE II or BINDING SITE III. Table 2 illustrates the complementarity of the nucleotide sequences of LOC56965 BINDING SITE, designated SEQ ID:21456, to the nucleotide sequence of VGAM1221 RNA, herein designated VGAM RNA, also designated SEQ ID:3932.

Another function of VGAM1221 is therefore inhibition of LOC56965 (Accession NM_020214). Accordingly, utilities of VGAM1221 include diagnosis, prevention and treatment of diseases and clinical conditions associated with LOC56965. FIG. 1 further provides a conceptual description of a novel bioinformatically detected viral gene of the present invention, referred to here as Viral Genomic Address Messenger 1222 (VGAM1222) viral gene, which modulates expression of respective host target genes thereof, the function and utility of which host target genes is known in the art.

VGAM1222 is a novel bioinformatically detected regulatory, non protein coding, viral micro RNA (miRNA) gene. The method by which VGAM1222 was detected is described hereinabove with reference to FIGS. 1-8.

VGAM1222 gene, herein designated VGAM GENE, is a viral gene contained in the genome of Fowl Adenovirus D. VGAM1222 host target gene, herein designated VGAM HOST TARGET GENE, is a human gene contained in the human genome.

VGAM1222 gene encodes a VGAM1222 precursor RNA, herein designated VGAM PRECURSOR RNA. Similar to other miRNA genes, and unlike most ordinary genes, VGAM1222 precursor RNA does not encode a protein. A nucleotide sequence identical or highly similar to the nucleotide sequence of VGAM1222 precursor RNA is designated SEQ ID:1208, and is provided hereinbelow with reference to the sequence listing part. Nucleotide sequence SEQ ID:1208 is located at position 25411 relative to the genome of Fowl Adenovirus D.

VGAM1222 precursor RNA folds onto itself, forming VGAM1222 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1222 folded precursor RNA into VGAM1222 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1222 RNA is designated SEQ ID:3933, and is provided hereinbelow with reference to the sequence listing part.

VGAM1222 host target gene, herein designated VGAM HOST TARGET GENE, encodes a corresponding messenger RNA, VGAM1222 host target RNA, herein designated VGAM HOST TARGET RNA. VGAM1222 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1222 RNA, herein designated VGAM RNA, binds complementarily to one or more host target binding sites located in untranslated regions of VGAM1222 host target RNA, herein designated VGAM HOST TARGET RNA. This complementary binding is due to the fact that the nucleotide sequence of VGAM1222 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1222 RNA, herein designated VGAM RNA, may have a different number of host target binding sites in untranslated regions of a VGAM1222 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1222 RNA, herein designated VGAM RNA, to host target binding sites on VGAM1222 host target RNA, herein designated VGAM HOST TARGET RNA, such as BINDING SITE I, BINDING SITE II and BINDING SITE III, inhibits translation of VGAM1222 host target RNA into VGAM1222 host target protein, herein designated VGAM HOST TARGET PROTEIN. VGAM host target protein is therefore outlined by a broken line.

It is appreciated that VGAM1222 host target gene, herein designated VGAM HOST TARGET GENE, in fact represents a plurality of VGAM1222 host target genes. The mRNA of each one of this plurality of VGAM1222 host target genes comprises one or more host target binding sites, each having a nucleotide sequence which is at least partly complementary to VGAM1222 RNA, herein designated VGAM RNA, and which when bound by VGAM1222 RNA causes inhibition of translation of respective one or more VGAM1222 host target proteins.

It is further appreciated by one skilled in the art that the mode of translational inhibition illustrated by FIG. 1 with specific reference to translational inhibition exerted by VGAM1222 gene, herein designated VGAM GENE, on one or more VGAM1222 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1222 is inhibition of expression of host target genes, as part of a novel viral mechanism of attacking a host. Accordingly, utilities of VGAM1222 include diagnosis, prevention and treatment of viral infection by Fowl Adenovirus D. Specific functions, and accordingly utilities, of VGAM1222 correlate with, and may be deduced from, the identity of the host target genes which VGAM1222 binds and inhibits, and the function of these host target genes, as elaborated hereinbelow.

Nucleotide sequences of the VGAM1222 precursor RNA, herein designated VGAM PRECURSOR RNA, and of the 'diced' VGAM1222 RNA, herein designated VGAM RNA, and a schematic representation of the secondary folding of VGAM1222 folded precursor RNA, herein designated VGAM FOLDED PRECURSOR RNA, of VGAM1222 are further described hereinbelow with reference to Table 1.

Nucleotide sequences of host target binding sites, such as BINDING SITE-I, BINDING SITE-II and BINDING SITE-III of FIG. 1, found on VGAM1222 host target RNA, and schematic representation of the complementarity of each of these host target binding sites to VGAM1222 RNA, herein designated VGAM RNA, are described hereinbelow with reference to Table 2.

As mentioned hereinabove with reference to FIG. 1, a function of VGAM1222 gene, herein designated VGAM is inhibition of expression of VGAM1222 target genes. It is appreciated that specific functions, and accordingly utilities, of VGAM1222 correlate with, and may be deduced from, the identity of the target genes which VGAM1222 binds and inhibits, and the function of these target genes, as elaborated hereinbelow.

RAD52 Homolog (S. cerevisiae) (RAD52, Accession NM_002879) is a VGAM1222 host target gene. RAD52 BINDING SITE1 through RAD52 BINDING SITE4 are HOST TARGET binding sites found in untranslated regions of mRNA encoded by RAD52, corresponding to HOST TARGET binding sites such as BINDING SITE I, BINDING SITE II or BINDING SITE III. Table 2 illustrates the complementarity of the nucleotide sequences of RAD52 BINDING SITE1 through RAD52 BINDING SITE4, designated SEQ ID:8790, SEQ ID:28647, SEQ ID:28655 and SEQ ID:28664 respectively, to the nucleotide sequence of VGAM1222 RNA, herein designated VGAM RNA, also designated SEQ ID:3933.

A function of VGAM1222 is therefore inhibition of RAD52 Homolog (S. cerevisiae) (RAD52, Accession NM_002879). Accordingly, utilities of VGAM1222 include diagnosis, prevention and treatment of diseases and clinical conditions associated with RAD52. KIAA0286 (Accession XM_043118) is another VGAM1222 host target gene. KIAA0286 BINDING SITE is HOST TARGET binding site found in the 3' untranslated region of mRNA encoded by KIAA0286, corresponding to a HOST TARGET binding site such as BINDING SITE I, BINDING SITE II or BINDING SITE III. Table 2 illustrates the complementarity of the nucleotide sequences of KIAA0286 BINDING SITE, designated SEQ ID:33907, to the nucleotide sequence of VGAM1222

RNA, herein designated VGAM RNA, also designated SEQ ID:3933.

Another function of VGAM1222 is therefore inhibition of KIAA0286 (Accession XM_043118). Accordingly, utilities of VGAM1222 include diagnosis, prevention and treatment of diseases and clinical conditions associated with KIAA0286. Lysyl Oxidase-like 4 (LOXL4, Accession NM_032211) is another VGAM1222 host target gene. LOXL4 BINDING SITE is HOST TARGET binding site found in the 3' untranslated region of mRNA encoded by LOXL4, corresponding to a HOST TARGET binding site such as BINDING SITE I, BINDING SITE II or BINDING SITE III. Table 2 illustrates the complementarity of the nucleotide sequences of LOXL4 BINDING SITE, designated SEQ ID:25929, to the nucleotide sequence of VGAM1222 RNA, herein designated VGAM RNA, also designated SEQ ID:3933.

Another function of VGAM1222 is therefore inhibition of Lysyl Oxidase-like 4 (LOXL4, Accession NM_032211). Accordingly, utilities of VGAM1222 include diagnosis, prevention and treatment of diseases and clinical conditions associated with LOXL4. LOC201696 (Accession XM_032269) is another VGAM1222 host target gene. LOC201696 BINDING SITE is HOST TARGET binding site found in the 3' untranslated region of mRNA encoded by LOC201696, corresponding to a HOST TARGET binding site such as BINDING SITE I, BINDING SITE II or BINDING SITE III. Table 2 illustrates the complementarity of the nucleotide sequences of LOC201696 BINDING SITE, designated SEQ ID:31622, to the nucleotide sequence of VGAM1222 RNA, herein designated VGAM RNA, also designated SEQ ID:3933.

Another function of VGAM1222 is therefore inhibition of LOC201696 (Accession XM_032269). Accordingly, utilities of VGAM1222 include diagnosis, prevention and treatment of diseases and clinical conditions associated with LOC201696. FIG. 1 further provides a conceptual description of a novel bioinformatically detected viral gene of the present invention, referred to here as Viral Genomic Address Messenger 1223 (VGAM1223) viral gene, which modulates expression of respective host target genes thereof, the function and utility of which host target genes is known in the art.

VGAM1223 is a novel bioinformatically detected regulatory, non protein coding, viral micro RNA (miRNA) gene. The method by which VGAM1223 was detected is described hereinabove with reference to FIGS. 1-8.

VGAM1223 gene, herein designated VGAM GENE, is a viral gene contained in the genome of Equine Herpesvirus 2. VGAM1223 host target gene, herein designated VGAM HOST TARGET GENE, is a human gene contained in the human genome.

VGAM1223 gene encodes a VGAM1223 precursor RNA, herein designated VGAM PRECURSOR RNA. Similar to other miRNA genes, and unlike most ordinary genes, VGAM1223 precursor RNA does not encode a protein. A nucleotide sequence identical or highly similar to the nucleotide sequence of VGAM1223 precursor RNA is designated SEQ ID:1209, and is provided hereinbelow with reference to the sequence listing part. Nucleotide sequence SEQ ID:1209 is located at position 143093 relative to the genome of Equine Herpesvirus 2.

VGAM1223 precursor RNA folds onto itself, forming VGAM1223 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1223 folded precursor RNA into VGAM1223 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1223 RNA is designated SEQ ID:3934, and is provided hereinbelow with reference to the sequence listing part.

VGAM1223 host target gene, herein designated VGAM HOST TARGET GENE, encodes a corresponding messenger RNA, VGAM1223 host target RNA, herein designated VGAM HOST TARGET RNA. VGAM1223 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1223 RNA, herein designated VGAM RNA, binds complementarily to one or more host target binding sites located in untranslated regions of VGAM1223 host target RNA, herein designated VGAM HOST TARGET RNA. This complementary binding is due to the fact that the nucleotide sequence of VGAM1223 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1223 RNA, herein designated VGAM RNA, may have a different number of host target binding sites in untranslated regions of a VGAM1223 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1223 RNA, herein designated VGAM RNA, to host target binding sites on VGAM1223 host target RNA, herein designated VGAM HOST TARGET RNA, such as BINDING SITE I, BINDING SITE II and BINDING SITE III, inhibits translation of VGAM1223 host target RNA into VGAM1223 host target protein, herein designated VGAM HOST TARGET PROTEIN. VGAM host target protein is therefore outlined by a broken line.

It is appreciated that VGAM1223 host target gene, herein designated VGAM HOST TARGET GENE, in fact represents a plurality of VGAM1223 host target genes. The mRNA of each one of this plurality of VGAM1223 host target genes comprises one or more host target binding sites, each having a nucleotide sequence which is at least partly complementary to VGAM1223 RNA, herein designated VGAM RNA, and which when bound by VGAM1223 RNA causes inhibition of translation of respective one or more VGAM1223 host target proteins.

It is further appreciated by one skilled in the art that the mode of translational inhibition illustrated by FIG. 1 with specific reference to translational inhibition exerted by VGAM1223 gene, herein designated VGAM GENE, on one or more VGAM1223 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1223 is inhibition of expression of host target genes, as part of a novel viral mechanism of attacking a host. Accordingly, utilities of VGAM1223 include diagnosis, prevention and treatment of viral infection by Equine Herpesvirus 2. Specific functions, and accordingly utilities, of VGAM1223 correlate with, and may be deduced from, the identity of the host target genes which VGAM1223 binds and inhibits, and the function of these host target genes, as elaborated hereinbelow.

Nucleotide sequences of the VGAM1223 precursor RNA, herein designated VGAM PRECURSOR RNA, and of the 'diced' VGAM1223 RNA, herein designated VGAM RNA, and a schematic representation of the secondary folding of VGAM1223 folded precursor RNA, herein designated VGAM FOLDED PRECURSOR RNA, of VGAM1223 are further described hereinbelow with reference to Table 1.

Nucleotide sequences of host target binding sites, such as BINDING SITE-I, BINDING SITE-II and BINDING SITE-III of FIG. 1, found on VGAM1223 host target RNA, and schematic representation of the complementarity of each of these host target binding sites to VGAM1223 RNA, herein designated VGAM RNA, are described hereinbelow with reference to Table 2.

As mentioned hereinabove with reference to FIG. 1, a function of VGAM1223 gene, herein designated VGAM is inhibition of expression of VGAM1223 target genes. It is appreciated that specific functions, and accordingly utilities, of VGAM1223 correlate with, and may be deduced from, the identity of the target genes which VGAM1223 binds and inhibits, and the function of these target genes, as elaborated hereinbelow.

UDP-GlcNAc:betaGal Beta-1,3-N-acetylglucosaminyl-transferase 3 (B3GNT3, Accession NM_014256) is a VGAM1223 host target gene. B3GNT3 BINDING SITE is HOST TARGET binding site found in the 3' untranslated region of mRNA encoded by B3GNT3, corresponding to a HOST TARGET binding site such as BINDING SITE I, BINDING SITE II or BINDING SITE III. Table 2 illustrates the complementarity of the nucleotide sequences of B3GNT3 BINDING SITE, designated SEQ ID:15531, to the nucleotide sequence of VGAM1223 RNA, herein designated VGAM RNA, also designated SEQ ID:3934.

A function of VGAM1223 is therefore inhibition of UDP-GlcNAc:betaGal Beta-1,3-N-acetylglucosaminyltransferase 3 (B3GNT3, Accession NM_014256). Accordingly, utilities of VGAM1223 include diagnosis, prevention and treatment of diseases and clinical conditions associated with B3GNT3. CERD4 (Accession NM_012074) is another VGAM1223 host target gene. CERD4 BINDING SITE is HOST TARGET binding site found in the 3' untranslated region of mRNA encoded by CERD4, corresponding to a HOST TARGET binding site such as BINDING SITE I, BINDING SITE II or BINDING SITE III. Table 2 illustrates the complementarity of the nucleotide sequences of CERD4 BINDING SITE, designated SEQ ID:14348, to the nucleotide sequence of VGAM1223 RNA, herein designated VGAM RNA, also designated SEQ ID:3934.

Another function of VGAM1223 is therefore inhibition of CERD4 (Accession NM_012074). Accordingly, utilities of VGAM1223 include diagnosis, prevention and treatment of diseases and clinical conditions associated with CERD4. Cryptochrome 2 (photolyase-like) (CRY2, Accession XM_051030) is another VGAM1223 host target gene. CRY2 BINDING SITE is HOST TARGET binding site found in the 3' untranslated region of mRNA encoded by CRY2, corresponding to a HOST TARGET binding site such as BINDING SITE I, BINDING SITE II or BINDING SITE III. Table 2 illustrates the complementarity of the nucleotide sequences of CRY2 BINDING SITE, designated SEQ ID:35730, to the nucleotide sequence of VGAM1223 RNA, herein designated VGAM RNA, also designated SEQ ID:3934.

Another function of VGAM1223 is therefore inhibition of Cryptochrome 2 (photolyase-like) (CRY2, Accession XM_051030), a gene which has a role in circadian photoreception in mammals. Accordingly, utilities of VGAM1223 include diagnosis, prevention and treatment of diseases and clinical conditions associated with CRY2. The function of CRY2 has been established by previous studies. Hsu et al. (1996) identified a human gene, CRY2, whose product had 73% amino acid identity to the human (6-4) photolyase (CRY1; 601933). The CRY2 protein shares 51% amino acid sequence identity to Drosophila (6-4) photolyase. Hsu et al. (1996) purified the human CRY1 and CRY2 proteins and characterized them as maltose-binding fusion proteins that contain FAD and a pterin cofactor. Both CRY1 and CRY2 proteins lacked photolyase activity. Hsu et al. (1996) concluded that these proteins are not photolyases, but may function as blue-light photoreceptors in human S. As part of a search for human brain cDNA clones with the potential to encode large proteins in vitro, Ishikawa et al. (1998) independently identified CRY2. The CRY2 open reading frame encodes a protein of 589 amino acids with an apparent molecular mass of 67 kD Animal model experiments lend further support to the function of CRY2. Yagita et al. (2001) used wildtype and Cry1 -/- and Cry2 -/- deficient cell lines derived from Cry mutant mice to demonstrate that the peripheral oscillator in cultured fibroblasts is identical to the oscillator in the suprachiasmatic nucleus in (1) temporal expression profiles of all known clock genes; (2) the phase of the various mRNA rhythms (i.e., antiphase oscillation of Bmal1 (OMIM Ref. No. 602550) and Per); (3) the delay between maximum mRNA levels and appearance of nuclear Per1 and Per2 protein; (4) the inability to produce oscillations in the absence of functional Cry genes; and (5) the control of period length by Cry proteins It is appreciated that the abovementioned animal model for CRY2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hsu, D. S.; Zhao, X.; Zhao, S.; Kazantsev, A.; Wang, R.-P.; Todo, T.; Wei, Y.-F.; Sancar, A.: Putative human blue-light photoreceptors hCRY1 and hCRY2 are flavoproteins. Biochemistry 35:13871-13877, 1996; and Yagita, K.; Tamanini, F.; van der Horst, G. T. J.; Okamura, H.: Molecular mechanisms of the biological clock in cultured fibroblasts. Science 292:278-281, 2001.

Further studies establishing the function and utilities of CRY2 are found in John Hopkins OMIM database record ID 603732, and in sited publications numbered 6258-6260, 9440-6264, 1256, 584 and 6266-6267 listed in the bibliography section hereinbelow, which are also hereby incorporated by reference. Nucleoporin 98 kDa (NUP98, Accession NM_016320) is another VGAM1223 host target gene. NUP98 BINDING SITE is HOST TARGET binding site found in the 3' untranslated region of mRNA encoded by NUP98, corresponding to a HOST TARGET binding site such as BINDING SITE I, BINDING SITE II or BINDING SITE III. Table 2 illustrates the complementarity of the nucleotide sequences of NUP98 BINDING SITE, designated SEQ ID:18439, to the nucleotide sequence of VGAM1223 RNA, herein designated VGAM RNA, also designated SEQ ID:3934.

Another function of VGAM1223 is therefore inhibition of Nucleoporin 98kDa (NUP98, Accession NM_016320), a gene which functions in the nuclear transport of protein and RNA. Accordingly, utilities of VGAM1223 include diagnosis, prevention and treatment of diseases and clinical conditions associated with NUP98. The function of NUP98 and its association with various diseases and clinical conditions, has been established by previous studies, as described hereinabove with reference to VGAM55. Chromosome 20 Open Reading Frame 103 (C20orf103, Accession NM_012261) is another VGAM1223 host target gene. C20orf103 BINDING SITE is HOST TARGET binding site found in the 3' untranslated region of mRNA encoded by C20orf103, corresponding to a HOST TARGET binding site such as BINDING SITE I, BINDING SITE II or BINDING SITE III. Table 2 illustrates the complementarity of the nucleotide sequences of C20orf103 BINDING SITE, designated SEQ ID:14568, to the nucleotide sequence of VGAM1223 RNA, herein designated VGAM RNA, also designated SEQ ID:3934.

Another function of VGAM1223 is therefore inhibition of Chromosome 20 Open Reading Frame 103 (C20orf103, Accession NM_012261). Accordingly, utilities of VGAM1223 include diagnosis, prevention and treatment of diseases and clinical conditions associated with C20orf103. CAMP-GEFII (Accession NM_007023) is another VGAM1223 host target gene. CAMP-GEFII BINDING SITE is HOST TARGET binding site found in the 3" untranslated region of mRNA encoded by CAMP-GEFII, corresponding to a HOST TARGET binding site such as BINDING SITE I, BINDING SITE II or BINDING SITE III. Table 2 illustrates the complementarity of the nucleotide sequences of CAMP-GEFII BINDING SITE, designated SEQ ID:13879, to the nucleotide sequence of VGAM1223 RNA, herein designated VGAM RNA, also designated SEQ ID:3934.

Another function of VGAM1223 is therefore inhibition of CAMP-GEFII (Accession NM_007023). Accordingly, utilities of VGAM1223 include diagnosis, prevention and treatment of diseases and clinical conditions associated with CAMP-GEFII. Fidgetin (FIGN, Accession XM_171005) is another VGAM1223 host target gene. FIGN BINDING SITE is HOST TARGET binding site found in the 3' untranslated region of mRNA encoded by FIGN, corresponding to a HOST TARGET binding site such as BINDING SITE I, BINDING SITE II or BINDING SITE III. Table 2 illustrates the complementarity of the nucleotide sequences of FIGN BINDING SITE, designated SEQ ID:45775, to the nucleotide sequence of VGAM1223 RNA, herein designated VGAM RNA, also designated SEQ ID:3934.

Another function of VGAM1223 is therefore inhibition of Fidgetin (FIGN, Accession XM_171005). Accordingly, utilities of VGAM1223 include diagnosis, prevention and treatment of diseases and clinical conditions associated with FIGN. FLJ10044 (Accession NM_017980) is another VGAM1223 host target gene. FLJ10044 BINDING SITE is HOST TARGET binding site found in the 3' untranslated region of mRNA encoded by FLJ10044, corresponding to a HOST TARGET binding site such as BINDING SITE I, BINDING SITE II or BINDING SITE III. Table 2 illustrates the complementarity of the nucleotide sequences of FLJ10044 BINDING SITE, designated SEQ ID:19709, to the nucleotide sequence of VGAM1223 RNA, herein designated VGAM RNA, also designated SEQ ID:3934.

Another function of VGAM1223 is therefore inhibition of FLJ10044 (Accession NM_017980). Accordingly, utilities of VGAM1223 include diagnosis, prevention and treatment of diseases and clinical conditions associated with FLJ10044. FLJ22283 (Accession NM_032220) is another VGAM1223 host target gene. FLJ22283 BINDING SITE is HOST TARGET binding site found in the 5' untranslated region of mRNA encoded by FLJ22283, corresponding to a HOST TARGET binding site such as BINDING SITE I, BINDING SITE II or BINDING SITE III. Table 2 illustrates the complementarity of the nucleotide sequences of FLJ22283 BINDING SITE, designated SEQ ID:25946, to the nucleotide sequence of VGAM1223 RNA, herein designated VGAM RNA, also designated SEQ ID:3934.

Another function of VGAM1223 is therefore inhibition of FLJ22283 (Accession NM_032220). Accordingly, utilities of VGAM1223 include diagnosis, prevention and treatment of diseases and clinical conditions associated with FLJ22283. KIAA0939 (Accession XM_030524) is another VGAM1223 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31056, to the nucleotide sequence of VGAM1223 RNA, herein designated VGAM RNA, also designated SEQ ID:3934.

Another function of VGAM1223 is therefore inhibition of KIAA0939 (Accession XM_030524). Accordingly, utilities of VGAM1223 include diagnosis, prevention and treatment of diseases and clinical conditions associated with KIAA0939. KIAA1111 (Accession XM_171233) is another VGAM1223 host target gene. KIAA1111 BINDING SITE is HOST TARGET binding site found in the 3' untranslated region of mRNA encoded by KIAA1111, corresponding to a HOST TARGET binding site such as BINDING SITE I, BINDING SITE II or BINDING SITE III. Table 2 illustrates the complementarity of the nucleotide sequences of KIAA1111 BINDING SITE, designated SEQ ID:46017, to the nucleotide sequence of VGAM1223 RNA, herein designated VGAM RNA, also designated SEQ ID:3934.

Another function of VGAM1223 is therefore inhibition of KIAA1111 (Accession XM_171233). Accordingly, utilities of VGAM1223 include diagnosis, prevention and treatment of diseases and clinical conditions associated with KIAA1111. Protein Tyrosine Phosphatase, Receptor Type, N Polypeptide 2 (PTPRN2, Accession NM_130843) is another VGAM1223 host target gene. PTPRN2 BINDING SITE1 and PTPRN2 BINDING SITE2 are HOST TARGET binding sites found in untranslated regions of mRNA encoded by PTPRN2, corresponding to HOST TARGET binding sites such as BINDING SITE I, BINDING SITE II or BINDING SITE III. Table 2 illustrates the complementarity of the nucleotide sequences of PTPRN2 BINDING SITE1 and PTPRN2 BINDING SITE2, designated SEQ ID:28373 and SEQ ID:28368 respectively, to the nucleotide sequence of VGAM1223 RNA, herein designated VGAM RNA, also designated SEQ ID:3934.

Another function of VGAM1223 is therefore inhibition of Protein Tyrosine Phosphatase, Receptor Type, N Polypeptide 2 (PTPRN2, Accession NM_130843). Accordingly, utilities of VGAM1223 include diagnosis, prevention and treatment of diseases and clinical conditions associated with PTPRN2. LOC146880 (Accession XM_085627) is another VGAM1223 host target gene. LOC146880 BINDING SITE is HOST TARGET binding site found in the 3' untranslated region of mRNA encoded by LOC146880, corresponding to a HOST TARGET binding site such as BINDING SITE I, BINDING SITE II or BINDING SITE III. Table 2 illustrates the complementarity of the nucleotide sequences of LOC146880 BINDING SITE, designated SEQ ID:38256, to the nucleotide sequence of VGAM1223 RNA, herein designated VGAM RNA, also designated SEQ ID:3934.

Another function of VGAM1223 is therefore inhibition of LOC146880 (Accession XM_085627). Accordingly, utilities of VGAM1223 include diagnosis, prevention and treatment of diseases and clinical conditions associated with LOC146880. LOC151507 (Accession XM_087225) is another VGAM1223 host target gene. LOC151507 BINDING SITE is HOST TARGET binding site found in the 3' untranslated region of mRNA encoded by LOC151507, corresponding to a HOST TARGET binding site such as BINDING SITE I, BINDING SITE II or BINDING SITE III. Table 2 illustrates the complementarity of the nucleotide sequences of LOC151507 BINDING SITE, designated SEQ ID:39125, to the nucleotide sequence of VGAM1223 RNA, herein designated VGAM RNA, also designated SEQ ID:3934.

Another function of VGAM1223 is therefore inhibition of LOC151507 (Accession XM_087225). Accordingly, utilities of VGAM1223 include diagnosis, prevention and treatment of diseases and clinical conditions associated with LOC151507. LOC168576 (Accession XM_095191) is another VGAM1223 host target gene. LOC168576 BINDING SITE is HOST TARGET binding site found in the 5' untranslated region of mRNA encoded by LOC168576, corresponding to a HOST TARGET binding site such as BINDING SITE I, BINDING SITE II or BINDING SITE III. Table 2 illustrates the complementarity of the nucleotide sequences of LOC168576 BINDING SITE, designated SEQ ID:40254, to the nucleotide sequence of VGAM1223 RNA, herein designated VGAM RNA, also designated SEQ ID:3934.

Another function of VGAM1223 is therefore inhibition of LOC168576 (Accession XM_095191). Accordingly, utilities of VGAM1223 include diagnosis, prevention and treatment of diseases and clinical conditions associated with LOC168576. LOC196955 (Accession XM_085210) is another VGAM1223 host target gene. LOC196955 BINDING SITE is HOST TARGET binding site found in the 3' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37935, to the nucleotide sequence of VGAM1223 RNA, herein designated VGAM RNA, also designated SEQ ID:3934.

Another function of VGAM1223 is therefore inhibition of LOC196955 (Accession XM_085210). Accordingly, utilities of VGAM1223 include diagnosis, prevention and treatment of diseases and clinical conditions associated with LOC196955. FIG. 1 further provides a conceptual description of a novel bioinformatically detected viral gene of the present invention, referred to here as Viral Genomic Address Messenger 1224 (VGAM1224) viral gene, which modulates expression of respective host target genes thereof, the function and utility of which host target genes is known in the art.

VGAM1224 is a novel bioinformatically detected regulatory, non protein coding, viral micro RNA (miRNA) gene. The method by which VGAM1224 was detected is described hereinabove with reference to FIGS. 1-8.

VGAM1224 gene, herein designated VGAM GENE, is a viral gene contained in the genome of Equine Herpesvirus 2. VGAM1224 host target gene, herein designated VGAM HOST TARGET GENE, is a human gene contained in the human genome.

VGAM1224 gene encodes a VGAM1224 precursor RNA, herein designated VGAM PRECURSOR RNA. Similar to other miRNA genes, and unlike most ordinary genes, VGAM1224 precursor RNA does not encode a protein. A nucleotide sequence identical or highly similar to the nucleotide sequence of VGAM1224 precursor RNA is designated SEQ ID:1210, and is provided hereinbelow with reference to the sequence listing part. Nucleotide sequence SEQ ID:1210 is located at position 141418 relative to the genome of Equine Herpesvirus 2.

VGAM1224 precursor RNA folds onto itself, forming VGAM1224 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1224 folded precursor RNA into VGAM1224 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM1224 RNA is designated SEQ ID:3935, and is provided hereinbelow with reference to the sequence listing part.

VGAM1224 host target gene, herein designated VGAM HOST TARGET GENE, encodes a corresponding messenger RNA, VGAM1224 host target RNA, herein designated VGAM HOST TARGET RNA. VGAM1224 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1224 RNA, herein designated VGAM RNA, binds complementarily to one or more host target binding sites located in untranslated regions of VGAM1224 host target RNA, herein designated VGAM HOST TARGET RNA. This complementary binding is due to the fact that the nucleotide sequence of VGAM1224 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1224 RNA, herein designated VGAM RNA, may have a different number of host target binding sites in untranslated regions of a VGAM1224 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1224 RNA, herein designated VGAM RNA, to host target binding sites on VGAM1224 host target RNA, herein designated VGAM HOST TARGET RNA, such as BINDING SITE I, BINDING SITE II and BINDING SITE III, inhibits translation of VGAM1224 host target RNA into VGAM1224 host target protein, herein designated VGAM HOST TARGET PROTEIN. VGAM host target protein is therefore outlined by a broken line.

It is appreciated that VGAM1224 host target gene, herein designated VGAM HOST TARGET GENE, in fact represents a plurality of VGAM1224 host target genes. The mRNA of each one of this plurality of VGAM1224 host target genes comprises one or more host target binding sites, each having a nucleotide sequence which is at least partly complementary to VGAM1224 RNA, herein designated VGAM RNA, and which when bound by VGAM1224 RNA causes inhibition of translation of respective one or more VGAM1224 host target proteins.

It is further appreciated by one skilled in the art that the mode of translational inhibition illustrated by FIG. 1 with specific reference to translational inhibition exerted by VGAM1224 gene, herein designated VGAM GENE, on one or more VGAM1224 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1224 is inhibition of expression of host target genes, as part of a novel viral mechanism of attacking a host. Accordingly, utilities of VGAM1224 include diagnosis, prevention and treatment of viral infection by Equine Herpesvirus 2. Specific functions, and accordingly utilities, of VGAM1224 correlate with, and may be deduced from, the identity of the host target genes which VGAM1224 binds and inhibits, and the function of these host target genes, as elaborated hereinbelow.

Nucleotide sequences of the VGAM1224 precursor RNA, herein designated VGAM PRECURSOR RNA, and of the 'diced' VGAM1224 RNA, herein designated VGAM RNA, and a schematic representation of the secondary folding of VGAM1224 folded precursor RNA, herein designated VGAM FOLDED PRECURSOR RNA, of VGAM1224 are further described hereinbelow with reference to Table 1.

Nucleotide sequences of host target binding sites, such as BINDING SITE-I, BINDING SITE-II and BINDING SITE-III of FIG. 1, found on VGAM1224 host target RNA, and schematic representation of the complementarity of each of these host target binding sites to VGAM1224 RNA, herein designated VGAM RNA, are described hereinbelow with reference to Table 2.

As mentioned hereinabove with reference to FIG. 1, a function of VGAM1224 gene, herein designated VGAM is inhibition of expression of VGAM1224 target genes. It is appreciated that specific functions, and accordingly utilities, of VGAM1224 correlate with, and may be deduced from, the identity of the target genes which VGAM1224 binds and inhibits, and the function of these target genes, as elaborated hereinbelow.

A Kinase (PRKA) Anchor Protein 13 (AKAP13, Accession XM_116974) is a VGAM1224 host target gene. AKAP13 BINDING SITE is HOST TARGET binding site found in the 3' untranslated region of mRNA encoded by AKAP13, corresponding to a HOST TARGET binding site such as BINDING SITE I, BINDING SITE II or BINDING SITE III. Table 2 illustrates the complementarity of the nucleotide sequences of AKAP13 BINDING SITE, designated SEQ ID:43181, to the nucleotide sequence of VGAM1224 RNA, herein designated VGAM RNA, also designated SEQ ID:3935.

A function of VGAM1224 is therefore inhibition of A Kinase (PRKA) Anchor Protein 13 (AKAP13, Accession XM_116974), a gene which regulates subcellular localization of type II cAMP-dependent PKA. Accordingly, utilities of VGAM1224 include diagnosis, prevention and treatment of diseases and clinical conditions associated with AKAP13. The function of AKAP13 and its association with various diseases and clinical conditions, has been established by previous studies, as described hereinabove with reference to VGAM17. BCL2-like 2 (BCL2L2, Accession NM_004050) is another VGAM1224 host target gene. BCL2L2 BINDING SITE is HOST TARGET binding site found in the 3' untranslated region of mRNA encoded by BCL2L2, corresponding to a HOST TARGET binding site such as BINDING SITE I, BINDING SITE II or BINDING SITE III. Table 2 illustrates the complementarity of the nucleotide sequences of BCL2L2 BINDING SITE, designated SEQ ID:10260, to the nucleotide sequence of VGAM1224 RNA, herein designated VGAM RNA, also designated SEQ ID:3935.

Another function of VGAM1224 is therefore inhibition of BCL2-like 2 (BCL2L2, Accession NM_004050), a gene which promotes cell survival. Accordingly, utilities of VGAM1224 include diagnosis, prevention and treatment of diseases and clinical conditions associated with BCL2L2. The function of BCL2L2 and its association with various diseases and clinical conditions, has been established by previous studies, as described hereinabove with reference to VGAM431. CD244 (Accession NM_016382) is another VGAM1224 host target gene. CD244 BINDING SITE is HOST TARGET binding site found in the 3' untranslated region of mRNA encoded by CD244, corresponding to a HOST TARGET binding site such as BINDING SITE I, BINDING SITE II or BINDING SITE III. Table 2 illustrates the complementarity of the nucleotide sequences of CD244 BINDING SITE, designated SEQ ID:18525, to the nucleotide sequence of VGAM1224 RNA, herein designated VGAM RNA, also designated SEQ ID:3935.

Another function of VGAM1224 is therefore inhibition of CD244 (Accession NM_016382), a gene which can interfere with a step as proximal as phosphorylation of an activation receptor. Accordingly, utilities of VGAM1224 include diagnosis, prevention and treatment of diseases and clinical conditions associated with CD244. The function of CD244 has been established by previous studies. By screening a genomic DNA library and probing with mouse 2b4, followed by screening a human NK-cell cDNA library, Boles et al. (1999) isolated a cDNA encoding human 2B4. Sequence analysis predicted that the 365-amino acid protein, which is 70% similar to the mouse sequence and approximately 45% similar to other members of the CD2 family, has an 18-amino acid leader sequence; an extracellular region of 204 amino acids with 2 Ig-like motifs and 8 potential N-linked glycosylation sites; a 24-amino acid transmembrane domain; and a 120-amino acid cytoplasmic tail with 6 tyrosine residues. Northern blot analysis detected 3- and 5-kb transcripts in T- and NK-cell lines; however, peripheral blood leukocytes, spleen, and lymph node expressed only the 3-kb transcript. Southern blot analysis determined that the 2B4 gene spans approximately 25 kb. Functional analysis demonstrated that engagement of 2B4 with specific antibody activates NK cytolytic activity. By studying NK-cell function in patients with X-linked lymphoproliferative disease (XLPD; 308240) and a defect in the SAP gene, Parolini et al. (2000) found that a number of triggering receptors displayed normal function. However, upon 2B4 interaction with CD48, NK-cell function against Epstein Barr virus (EBV)-infected cells, which is primarily mediated via NKp46 (LY94; 604530), was inhibited. Disruption of 2B4-CD48 and/or NK receptor-HLA interaction restored NK cytolytic activity. RT-PCR analysis detected the full-length 2B4 cDNA as well as a 2B4 molecule lacking the Ig C2 domain in both patients and normal individuals. Molecular analysis failed to reveal any differences between normal and patient 2B4 sequences. Immunoblot analysis showed that treatment of normal but not XLPD NK cells with pervanadate led to the association of 2B4 with SAP. Parolini et al. (2000) suggested that anti-2B4 treatment might be of use in XLPD patients awaiting bone marrow transplantation.

Full details of the abovementioned studies are described in the following publications, the disclosure of which are hereby incorporated by reference:

Parolini, S.; Bottino, C.; Falco, M.; Augugliaro, R.; Giliani, S.; Franceschini, R.; Ochs, H. D.; Wolf, H.; Bonnefoy, J.-Y.; Biassoni, R.; Moretta, L.; Notarangelo, L. D.; Moretta, A.: X-linked lymphoproliferative disease:2B4 molecules displaying inhibitory rather than activating function are responsible for the inability of natural killer cells to kill Epstein-Barr virus-infected cells. J. Exp. Med. 192:337-346, 2000; and Boles, K. S.; Nakajima, H.; Colonna, M.; Chuang, S. S.; Stepp, S. E.; Bennett, M.; Kumar, V.; Mathew, P. A.: Molecular characterization of a novel human natural killer cell receptor ho.

Further studies establishing the function and utilities of CD244 are found in John Hopkins OMIM database record ID 605554, and in sited publications numbered 8597, 972, 4213, 877 and 973 listed in the bibliography section hereinbelow, which are also hereby incorporated by reference. CDC5 Cell Division Cycle 5-like (S. pombe) (CDC5L, Accession NM_001253) is another VGAM1224 host target gene. CDC5L BINDING SITE is HOST TARGET binding site found in the 5' untranslated region of mRNA encoded by CDC5L, corresponding to a HOST TARGET binding site such as BINDING SITE I, BINDING SITE II or BINDING SITE III. Table 2 illustrates the complementarity of the nucleotide sequences of CDC5L BINDING SITE, designated SEQ ID:6923, to the nucleotide sequence of VGAM1224 RNA, herein designated VGAM RNA, also designated SEQ ID:3935.

Another function of VGAM1224 is therefore inhibition of CDC5 Cell Division Cycle 5-like (S. pombe) (CDC5L, Accession NM_001253). Accordingly, utilities of VGAM1224 include diagnosis, prevention and treatment of diseases and clinical conditions associated with CDC5L. Dachshund Homolog (Drosophila) (DACH, Accession NM_080759) is another VGAM1224 host target gene. DACH BINDING SITE1 and DACH BINDING SITE2 are HOST TARGET binding sites found in untranslated regions of mRNA encoded by DACH, corresponding to HOST TARGET binding sites such as BINDING SITE I, BINDING SITE II or BINDING SITE III. Table 2 illustrates the complementarity of the nucleotide sequences of DACH BINDING SITE1 and DACH BINDING SITE2, designated SEQ ID:28037 and SEQ ID:28041 respectively, to the nucleotide sequence of VGAM1224 RNA, herein designated VGAM RNA, also designated SEQ ID:3935.

Another function of VGAM1224 is therefore inhibition of Dachshund Homolog (Drosophila) (DACH, Accession NM_080759), a gene which regulates early progenitor cell proliferation during retinogenesis and pituitary development. Accordingly, utilities of VGAM1224 include diagnosis, prevention and treatment of diseases and clinical conditions associated with DACH. The function of DACH and its association with various diseases and clinical conditions, has been established by previous studies, as described hereinabove with reference to VGAM260. Eukaryotic Translation Initiation Factor 4 Gamma, 2 (EIF4G2, Accession NM_001418) is another VGAM1224 host target gene. EIF4G2 BINDING SITE is HOST TARGET binding site found in the 5' untranslated region of mRNA encoded by EIF4G2, corresponding to a HOST TARGET binding site such as BINDING SITE I, BINDING SITE II or BINDING SITE III. Table 2 illustrates the complementarity of the nucleotide sequences of EIF4G2 BINDING SITE, designated SEQ ID:7116, to the nucleotide sequence of VGAM1224 RNA, herein designated VGAM RNA, also designated SEQ ID:3935.

Another function of VGAM1224 is therefore inhibition of Eukaryotic Translation Initiation Factor 4 Gamma, 2 (EIF4G2, Accession NM_001418), a gene which is a repressor of translation. Accordingly, utilities of VGAM1224 include diagnosis, prevention and treatment of diseases and clinical conditions associated with EIF4G2. The function of EIF4G2 and its association with various diseases and clinical conditions, has been established by previous studies, as described hereinabove with reference to VGAM1065. Engulfment and Cell Motility 1 (ced-12 homolog, C. elegans) (ELMO1, Accession NM_130442) is another VGAM1224 host target gene. ELMO1 BINDING SITE is HOST TARGET binding site found in the 3' untranslated region of mRNA encoded by ELMO1, corresponding to a HOST TARGET binding site such as BINDING SITE I, BINDING SITE II or BINDING SITE III. Table 2 illustrates the complementarity of the nucleotide sequences of ELMO1 BINDING SITE, designated SEQ ID:28205, to the nucleotide sequence of VGAM1224 RNA, herein designated VGAM RNA, also designated SEQ ID:3935.

Another function of VGAM1224 is therefore inhibition of Engulfment and Cell Motility 1 (ced-12 homolog, C. elegans) (ELMO1, Accession NM_130442). Accordingly, utilities of VGAM1224 include diagnosis, prevention and treatment of diseases and clinical conditions associated with ELMO1. FK506 Binding Protein 1A, 12 kDa (FKBP1A, Accession NM_000801) is another VGAM1224 host target gene. FKBP1A BINDING SITE is HOST TARGET binding site found in the 3' untranslated region of mRNA encoded by FKBP1A, corresponding to a HOST TARGET binding site such as BINDING SITE I, BINDING SITE II or BINDING SITE III. Table 2 illustrates the complementarity of the nucleotide sequences of FKBP1A BINDING SITE, designated SEQ ID:6476, to the nucleotide sequence of VGAM1224 RNA, herein designated VGAM RNA, also designated SEQ ID:3935.

Another function of VGAM1224 is therefore inhibition of FK506 Binding Protein 1A, 12 kDa (FKBP1A, Accession NM_000801), a gene which FK506-binding protein 1A. Accordingly, utilities of VGAM1224 include diagnosis, prevention and treatment of diseases and clinical conditions associated with FKBP1A. The function of FKBP1A and its association with various diseases and clinical conditions, has been established by previous studies, as described hereinabove with reference to VGAM57. GDNF Family Receptor Alpha 2 (GFRA2, Accession NM_001495) is another VGAM1224 host target gene. GFRA2 BINDING SITE is HOST TARGET binding site found in the 3' untranslated region of mRNA encoded by GFRA2, corresponding to a HOST TARGET binding site such as BINDING SITE I, BINDING SITE II or BINDING SITE III. Table 2 illustrates the complementarity of the nucleotide sequences of GFRA2 BINDING SITE, designated SEQ ID:7242, to the nucleotide sequence of VGAM1224 RNA, herein designated VGAM RNA, also designated SEQ ID:3935.

Another function of VGAM1224 is therefore inhibition of GDNF Family Receptor Alpha 2 (GFRA2, Accession NM_001495), a gene which mediates the nrtn-induced autophosphorylation and activation of the ret receptor. Accordingly, utilities of VGAM1224 include diagnosis, prevention and treatment of diseases and clinical conditions associated with GFRA2. The function of GFRA2 has been established by previous studies. Glial cell line-derived neurotrophic factor (GDNF; 600837) is a potent survival factor for central dopaminergic neurons, motor neurons, and several other populations of neurons in the central and peripheral nervous systems. The GDNF signal is mediated by a complex of the receptor tyrosine kinase RET (OMIM Ref. No. 164761) and a glycosylphosphatidylinositol (GPI)-linked protein, GDNF receptor-alpha (GDNFRA; 601496). Suvanto et al. (1997) cloned the human and rat cDNA sequences of GDNFR-beta, a gene encoding a 464-amino acid homolog of GDNFR-alpha. By fluorescence in situ hybridization, they assigned the GDNFRB gene to 8p22-p21. In addition, the mouse Gdnfrb gene was assigned to 14D3-E1. Similarly to GDNFR-alpha, GDNFR-beta mediates GDNF-induced RET autophosphorylation in transfected cells. By Northern hybridization, Suvanto et al. (1997) showed that the transcript level of human GDNFR-beta mRNA is high in the adult brain, intestine, and placenta, and in fetal brain, lung, and kidney. By in situ hybridization, they demonstrated that GDNFRB mRNA shows in the rat embryo a different distribution to that of GDNFRA mRNA, especially in adrenal gland, kidney, and gut. In the developing nervous system, GDNFRB mRNA expression was restricted to certain neuronal populations, while GDNFRA mRNA was widely expressed also in non-neuronal cells. Distinct tissue distribution of GDNFRB mRNA and its ability to mediate GDNF signal in transfected cells suggested a role in signal transduction of GDNF and, possibly, related neurotrophic factors in vivo. Baloh et al. (1997) independently described the cloning and initial characterization of a second coreceptor for both neurturin (NRTN; 602018) and GDNF signaling. To name the receptors appropriately for their ability to function in both GDNF and NRTN signaling, the authors referred to them as TGF-beta-related neurotrophic factor receptors 1 and 2 (TrnR1 and TmR2), where TmR1 corresponds to GDNFR-alpha. By fluorescence in situ hybridization, they mapped the gene to 8p21-p12; 8p21 is a consensus assignment. See also the reports by Klein et al. (1997) and Sanicola et al. (1997). Various nomenclature systems have been used to describe this gene.

Full details of the abovementioned studies are described in the following publications, the disclosure of which are hereby incorporated by reference:

Baloh, R. H.; Tansey, M. G.; Golden, J. P.; Creedon, D. J.; Heuckeroth, R. O.; Keck, C. L.; Zimonjic, D. B.; Popescu, N. C.; Johnson, E. M., Jr.; Milbrandt, J.: TrnR2, a novel receptor that mediates neurturin and GDNF signaling through Ret. Neuron 18:793-802, 1997; and Klein, R. D.; Sherman, D.; Ho, W.-H.; Stone, D.; Bennett, G. L.; Moffat, B.; Vandlen, R.; Simmons, L.; Gu, Q.; Hongo, J.-A.; Devaux, B.; Poulsen, K.; Armanini, M.; Nozaki, C.; Asai, N.

Further studies establishing the function and utilities of GFRA2 are found in John Hopkins OMIM database record ID 601956, and in sited publications numbered 634 and 5816-5818 listed in the bibliography section hereinbelow, which are also hereby incorporated by reference. Glutamate Receptor, Metabotropic 6 (GRM6, Accession NM_000843) is another VGAM1224 host target gene. GRM6 BINDING SITE is HOST TARGET binding site found in the 3' untranslated region of mRNA encoded by GRM6, corresponding to a HOST TARGET binding site such as BINDING SITE I, BINDING SITE II or BINDING SITE III. Table 2 illustrates the complementarity of the nucleotide sequences of GRM6 BINDING SITE, designated SEQ ID:6510, to the nucleotide sequence of VGAM1224 RNA, herein designated VGAM RNA, also designated SEQ ID:3935.

Another function of VGAM1224 is therefore inhibition of Glutamate Receptor, Metabotropic 6 (GRM6, Accession NM_000843). Accordingly, utilities of VGAM1224 include diagnosis, prevention and treatment of diseases and clinical conditions associated with GRM6. Immunoglobulin Mu Binding Protein 2 (IGHMBP2, Accession NM_002180) is another VGAM1224 host target gene. IGHMBP2 BINDING SITE is HOST TARGET binding site found in the 3' untranslated region of mRNA encoded by IGHMBP2, corresponding to a HOST TARGET binding site such as BINDING SITE I, BINDING SITE II or BINDING SITE III. Table 2 illustrates the complementarity of the nucleotide sequences of IGHMBP2 BINDING SITE, designated SEQ ID:7938, to the nucleotide sequence of VGAM1224 RNA, herein designated VGAM RNA, also designated SEQ ID:3935.

Another function of VGAM1224 is therefore inhibition of Immunoglobulin Mu Binding Protein 2 (IGHMBP2, Accession NM_002180). Accordingly, utilities of VGAM1224 include diagnosis, prevention and treatment of diseases and clinical conditions associated with IGHMBP2. LFG (Accession XM_084780) is another VGAM1224 host target gene. LFG BINDING SITE is HOST TARGET binding site found in the 3' untranslated region of mRNA encoded by LFG, corresponding to a HOST TARGET binding site such as BINDING SITE I, BINDING SITE II or BINDING SITE III. Table 2 illustrates the complementarity of the nucleotide sequences of LFG BINDING SITE, designated SEQ ID:37697, to the nucleotide sequence of VGAM1224 RNA, herein designated VGAM RNA, also designated SEQ ID:3935.

Another function of VGAM1224 is therefore inhibition of LFG (Accession XM_084780). Accordingly, utilities of VGAM1224 include diagnosis, prevention and treatment of diseases and clinical conditions associated with LFG. LIM Domain Only 1 (rhombotin 1) (LMO1, Accession NM_002315) is another VGAM1224 host target gene. LMO1 BINDING SITE is HOST TARGET binding site found in the 5' untranslated region of mRNA encoded by LMO1, corresponding to a HOST TARGET binding site such as BINDING SITE I, BINDING SITE II or BINDING SITE III. Table 2 illustrates the complementarity of the nucleotide sequences of LMO1 BINDING SITE, designated SEQ ID:8129, to the nucleotide sequence of VGAM1224 RNA, herein designated VGAM RNA, also designated SEQ ID:3935.

Another function of VGAM1224 is therefore inhibition of LIM Domain Only 1 (rhombotin 1) (LMO1, Accession NM_002315). Accordingly, utilities of VGAM1224 include diagnosis, prevention and treatment of diseases and clinical conditions associated with LMO1. Phosphogluconate Dehydrogenase (PGD, Accession XM_086151) is another VGAM1224 host target gene. PGD BINDING SITE is HOST TARGET binding site found in the 3" untranslated region of mRNA encoded by PGD, corresponding to a HOST TARGET binding site such as BINDING SITE I, BINDING SITE II or BINDING SITE III. Table 2 illustrates the complementarity of the nucleotide sequences of PGD BINDING SITE, designated SEQ ID:38524, to the nucleotide sequence of VGAM1224 RNA, herein designated VGAM RNA, also designated SEQ ID:3935.

Another function of VGAM1224 is therefore inhibition of Phosphogluconate Dehydrogenase (PGD, Accession XM_086151), a gene which catalyzes a step in the pentose phosphate pathway, oxidates glucose-6-phosphate into 6-phosphoglucono-lactone. Accordingly, utilities of VGAM1224 include diagnosis, prevention and treatment of diseases and clinical conditions associated with PGD. The function of PGD has been established by previous studies. Brewer and Dern (1964) reported deficiency of 6-phosphogluconate dehydrogenase (6PGD), the second dehydrogenase in the pentose phosphate shunt, in 10 members of 4 generations of an American black family. They concluded that the inheritance is autosomal dominant, all 6PGD-deficient persons observed being heterozygotes. However, no male-to-male transmission was observed; indeed, no offspring of affected males were tested. Against X-linkage is the fact that the average enzyme level in 3 6PGD-deficient males was somewhat higher than that in seven 6PGD-deficient females. The opposite would be expected of an X-linked trait. The authors commented on the autosomal control of an enzyme that is closely related metabolically to G6PD, an enzyme determined by an X-linked gene. In a survey of unrelated persons, Dern et al. (1966) found in 3 of 873 American blacks and 2 of 275 Caucasians a reduction in erythrocyte 6-phosphogluconate dehydrogenase to the range of 42 to 65% of normal. Leukocyte enzyme was also reduced. No correlation was found between electrophoretic phenotype and the quantitative variation. The inheritance was clearly autosomal dominant. Using starch-gel electrophoresis, Fildes and Parr (1963) detected 2 distinct types of human red cell 6-phosphogluconate dehydrogenase. Ten of 150 random blood samples showed 2 broad, less distinct bands in contrast to the single narrow, sharp band in the remainder. Inheritance appears to be autosomal, a point of particular note. Since the G6PD locus is X-linked, these 2 functionally related genes do not show clustering. Heterozygotes and homozygotes showed no quantitative difference in red blood cell 6PGD activity. Deficiency of this enzyme, with or without electrophoretic abnormality, has been observed (Parr, 1966). Nevo (1989) identified a rare PGD variant called PGD Mediterranean. Severe deficiency of 6PGD, although well-documented (Brewer and Dern, 1964; Dern et al., 1966; Parr and Fitch, 1967), has never been incriminated as the cause of hemolytic anemia. In fact, persons with less than 5% of normal activity in red cell enzymes, who were found in population surveys by Parr and Fitch (1967), were entirely asymptomatic. Beutler et al. (1985) found hemolysis in a subject in whom partial deficiency of 6PGD coexisted with G6PD deficiency, whereas no hemolysis was found in persons with the G6PD variant alone. A synergism of the 2 enzymopathies is possible Full details of the abovementioned studies are described in the following publications, the disclosure of which are hereby incorporated by reference:

Beutler, E.; Kuhl, W.; Gelbart, T.:6-Phosphogluconolactonase deficiency, a hereditary erythrocyte enzyme deficiency: possible interaction with glucose-6-phosphate dehydrogenase deficiency. Proc. Nat. Acad. Sci. 82:3876-3878, 1985; and Nevo, S.: A new rare PGD variant, PGD Mediterranean. Hum. Genet. 81:199 only, 1989.

Further studies establishing the function and utilities of PGD are found in John Hopkins OMIM database record ID 172200, and in sited publications numbered 2104, 2105-2108, 557, 2109-2116, 346 and 3780-2122 listed in the bibliography section hereinbelow, which are also hereby incorporated by reference. Paired Mesoderm Homeo Box 1 (PMX1, Accession NM_022716) is another VGAM1224 host target gene. PMX1 BINDING SITE1 and PMX1 BINDING SITE2 are HOST TARGET binding sites found in untranslated regions of mRNA encoded by PMX1, corresponding to HOST TARGET binding sites such as BINDING SITE I, BINDING SITE II or BINDING SITE III. Table 2 illustrates the complementarity of the nucleotide sequences of PMX1 BINDING SITE1 and PMX1 BINDING SITE2, designated SEQ ID:22918 and SEQ ID:13783 respectively, to the nucleotide sequence of VGAM1224 RNA, herein designated VGAM RNA, also designated SEQ ID:3935.

Another function of VGAM1224 is therefore inhibition of Paired Mesoderm Homeo Box 1 (PMX1, Accession NM_022716), a gene which acts as a transcriptional regulator of muscle creatine kinase. Accordingly, utilities of VGAM1224 include diagnosis, prevention and treatment of diseases and clinical conditions associated with PMX1. The function of PMX1 and its association with various diseases and clinical conditions, has been established by previous studies, as described hereinabove with reference to VGAM381. Prostaglandin-endoperoxide Synthase 1 (prostaglandin G/H synthase and cyclooxygenase) (PTGS1, Accession NM_080591) is another VGAM1224 host target gene. PTGS1 BINDING SITE1 and PTGS1 BINDING SITE2 are HOST TARGET binding sites found in untranslated regions of mRNA encoded by PTGS1, corresponding to HOST TARGET binding sites such as BINDING SITE I, BINDING SITE II or BINDING SITE III. Table 2 illustrates the complementarity of the nucleotide sequences of PTGS1 BINDING SITE1 and PTGS1 BINDING SITE2, designated SEQ ID:27899 and SEQ ID:12129 respectively, to the nucleotide sequence of VGAM1224 RNA, herein designated VGAM RNA, also designated SEQ ID:3935.

Another function of VGAM1224 is therefore inhibition of Prostaglandin-endoperoxide Synthase 1 (prostaglandin G/H synthase and cyclooxygenase) (PTGS1, Accession NM_080591), a gene which may play an important role in regulating or promoting cell proliferation in some normal and neoplastically transformed cells. Accordingly, utilities of VGAM1224 include diagnosis, prevention and treatment of diseases and clinical conditions associated with PTGS1. The function of PTGS1 has been established by previous studies. Prostaglandin H2 synthase is known to pharmacologists (Vane et al., 1994) as cyclooxygenase (COX), and its 2 isoforms are known as COX1 and COX2. Vane et al. (1994) outlined the actions of the 2 isoforms of COX. Stemming from this outline was a hypothesis that the therapeutic effects of drugs such as aspirin are due to inhibition of COX2, whereas the unwanted side-effects (and the action on platelets) result from inhibition of COX1. Prostaglandin-endoperoxide synthase (PTGS; EC 1.14.99.1; fatty acid cyclooxygenase; PGH synthase) is the key enzyme in prostaglandin biosynthesis. The cyclooxygenase activity of the enzyme is inhibited by nonsteroidal antiinflammatory drugs such as aspirin and endomethacin. Animal model experiments lend further support to the function of PTGS1. To study the separate roles of the 2 isoforms of cyclooxygenase, Langenbach et al. (1995) used homologous recombination to disrupt the mouse Ptgs1 gene encoding COX1. Homozygous Ptgs1 mutant mice survived well, had no gastric pathology, and showed less indomethacin-induced gastric ulceration than wildtype mice, even though their gastric prostaglandin E2 levels were about 1% of wildtype. Homozygous mutant mice had reduced platelet aggregation and a decreased inflammatory response to arachidonic acid, but not to tetradecanoyl phorbol acetate. Ptgs1 homozygous mutant females mated to homozygous mutant males produced few live offspring. Langenbach et al. (1995) stated that COX1-deficient mice provided a useful model for distinguishing the physiologic roles of the 2 cyclooxygenases, COX1 and COX2.

It is appreciated that the abovementioned animal model for PTGS1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Vane, J. R.; Mitchell, J. A.; Appleton, I.; Tomlinson, A.; Bishop-Bailey, D.; Croxtall, J.; Willoughby, D. A.: Inducible isoforms of cyclooxygenase and nitric-oxide synthase in inflammation. Proc. Nat. Acad. Sci. 91:2046-2050, 1994; and Langenbach, R.; Morham, S. G.; Tiano, H. F.; Loftin, C. D.; Ghanayem, B. I.; Chulada, P. C.; Mahler, J. F.; Lee, C. A.; Goulding, E. H.; Kluckman, K. D.; Kim, H. S.; Smithies, O.: Prost.

Further studies establishing the function and utilities of PTGS1 are found in John Hopkins OMIM database record ID 176805, and in sited publications numbered 10845-1085 and 10887-10889 listed in the bibliography section hereinbelow, which are also hereby incorporated by reference. Requiem, Apoptosis Response Zinc Finger Gene (REQ, Accession NM_006268) is another VGAM1224 host target gene. REQ BINDING SITE is HOST TARGET binding site found in the 3' untranslated region of mRNA encoded by REQ, corresponding to a HOST TARGET binding site such as BINDING SITE I, BINDING SITE II or BINDING SITE III. Table 2 illustrates the complementarity of the nucleotide sequences of REQ BINDING SITE, designated SEQ ID:12950, to the nucleotide sequence of VGAM1224 RNA, herein designated VGAM RNA, also designated SEQ ID:3935.

Another function of VGAM1224 is therefore inhibition of Requiem, Apoptosis Response Zinc Finger Gene (REQ, Accession NM_006268), a gene which is a putative zinc finger that is required for apoptosis in murine myeloid cell lines. Accordingly, utilities of VGAM1224 include diagnosis, prevention and treatment of diseases and clinical conditions associated with REQ. The function of REQ has been established by previous studies. Chestkov et al. (1996) described a conserved human gene homologous to neuro-d4 (OMIM Ref. No. 601670) which they designated ubi-d4. They mapped the gene to 11q13 by fluorescence in situ hybridization. The human protein is the apparent homolog of the mouse ubi-d4 or requiem protein (Gabig et al., 1994). Expression of ubi-d4/requiem appears to be required for apoptosis (Chestkov et al., 1996; Gabig et al., 1994). Apoptosis in murine myeloid cell lines requires the expression of the Requiem gene, which encodes a putative zinc finger protein. A large consortium (Gabig et al., 1998) consisting of 3 groups detected the protein in both cytoplasmic and nuclear subcellular fractions of murine myeloid cells and human K562 leukemia cells, which suggested that the protein may have a function distinct from that of a transcription factor. The distribution did not alter upon apoptosis induction by IL3 deprivation. They showed, further, that the gene was expressed in various tissues in early gestational ages; however, expression was confined to testes, spleen, thymus, and part of the hippocampus in the adult mouse. The expression profile was considered consistent with a functional role during rapid growth and cell turnover, and again suggested a regulatory function for hematopoietic cells. The nucleotide sequence of the human cDNA was 73% identical overall to that of the murine cDNA. The human sequence encodes a 391-amino acid protein. By cohybridization fluorescence in situ hybridization on extended DNA fibers, the REQ gene was localized between MLK3 (OMIM Ref. No. 600050) and FAU (OMIM Ref. No. 134690), which had been mapped to 11q13, telomeric to PYGM (OMIM Ref. No. 232600). The physical distance between MLK3 and REQ was estimated to be 150 kb.

Full details of the abovementioned studies are described in the following publications, the disclosure of which are hereby incorporated by reference:

Gabig, T. G.; Mantel, P. L.; Rosli, R.; Crean, C. D.: Requiem: a novel zinc finger gene essential for apoptosis in myeloid cells. J. Biol. Chem. 269:29515-29519, 1994; and Gabig, T. G.; Crean, C. D.; Klenk, A.; Long, H.; Copeland, N. G.; Gilbert, D. J.; Jenkins, N. A.; Quincey, D.; Parente, F.; Lespinasse, F.; Carle, G. F.; Gaudray, P.; and 13 others: Ex.

Further studies establishing the function and utilities of REQ are found in John Hopkins OMIM database record ID 601671, and in sited publications numbered 9402-9404 listed in the bibliography section hereinbelow, which are also hereby incorporated by reference. RAR-related Orphan Receptor B (RORB, Accession NM_006914) is another VGAM1224 host target gene. RORB BINDING SITE is HOST TARGET binding site found in the 5' untranslated region of mRNA encoded by RORB, corresponding to a HOST TARGET binding site such as BINDING SITE I, BINDING SITE II or BINDING SITE III. Table 2 illustrates the complementarity of the nucleotide sequences of RORB BINDING SITE, designated SEQ ID:13787, to the nucleotide sequence of VGAM1224 RNA, herein designated VGAM RNA, also designated SEQ ID:3935.

Another function of VGAM1224 is therefore inhibition of RAR-related Orphan Receptor B (RORB, Accession NM_006914), a gene which is an orphan nuclear receptor. Accordingly, utilities of VGAM1224 include diagnosis, prevention and treatment of diseases and clinical conditions associated with RORB. The function of RORB and its association with various diseases and clinical conditions, has been established by previous studies, as described hereinabove with reference to VGAM178. Runt-related Transcription Factor 1 (acute myeloid leukemia 1; aml1 oncogene) (RUNX1, Accession NM_001754) is another VGAM1224 host target gene. RUNX1 BINDING SITE is HOST TARGET binding site found in the 3' untranslated region of mRNA encoded by RUNX1, corresponding to a HOST TARGET binding site such as BINDING SITE I, BINDING SITE II or BINDING SITE III. Table 2 illustrates the complementarity of the nucleotide sequences of RUNX1 BINDING SITE, designated SEQ ID:7496, to the nucleotide sequence of VGAM1224 RNA, herein designated VGAM RNA, also designated SEQ ID:3935.

Another function of VGAM1224 is therefore inhibition of Runt-related Transcription Factor 1 (acute myeloid leukemia 1; aml1 oncogene) (RUNX1, Accession NM_001754). Accordingly, utilities of VGAM1224 include diagnosis, prevention and treatment of diseases and clinical conditions associated with RUNX1. Sterol-C5-desaturase (ERG3 delta-5-desaturase homolog, fungal)-like (SC5DL, Accession XM_165583) is another VGAM1224 host target gene. SC5DL BINDING SITE is HOST TARGET binding site found in the 3' untranslated region of mRNA encoded by SC5DL, corresponding to a HOST TARGET binding site such as BINDING SITE I, BINDING SITE II or BINDING SITE III. Table 2 illustrates the complementarity of the nucleotide sequences of SC5DL BINDING SITE, designated SEQ ID:43696, to the nucleotide sequence of VGAM1224 RNA, herein designated VGAM RNA, also designated SEQ ID:3935.

Another function of VGAM1224 is therefore inhibition of Sterol-C5-desaturase (ERG3 delta-5-desaturase homolog, fungal)-like (SC5DL, Accession XM_165583). Accordingly, utilities of VGAM1224 include diagnosis, prevention and treatment of diseases and clinical conditions associated with SC5DL. Sialyltransferase 1 (beta-galactoside alpha-2,6-sialytransferase) (SIAT1, Accession NM_003032) is another VGAM1224 host target gene. SIAT1 BINDING SITE is HOST TARGET binding site found in the 5' untranslated region of mRNA encoded by SIAT1, corresponding to a HOST TARGET binding site such as BINDING SITE I, BINDING SITE II or BINDING SITE III. Table 2 illustrates the complementarity of the nucleotide sequences of SIAT1 BINDING SITE, designated SEQ ID:8974, to the nucleotide sequence of VGAM1224 RNA, herein designated VGAM RNA, also designated SEQ ID:3935.

Another function of VGAM1224 is therefore inhibition of Sialyltransferase 1 (beta-galactoside alpha-2,6-sialytransferase) (SIAT1, Accession NM_003032), a gene which transfers sialic acid from the donor of substrate cmp- sialic acid to galactose containing acceptor substrates. Accordingly, utilities of VGAM1224 include diagnosis, prevention and treatment of diseases and clinical conditions associated with SIAT1. The function of SIAT1 has been established by previous studies. Much interest in the role and regulation of beta-galactoside alpha-2,6-sialyl transferase (EC 2.4.99.1) in B lymphocytes stemmed from its relation to CDw75, a human leukocyte cell-surface antigen expressed in mature and activated B cells but not in B cells at earlier stages of development or in plasma cells. SiaT-1 is required for the elaboration of the CDw75 cell-surface epitope. Grundmann et al. (1990) reported the complete cDNA sequence corresponding to the SIAT1 gene on the basis of cDNA isolated from a human placental lambda-gt10 library. By Southern analysis of somatic cell hybrids and by in situ hybridization, Wang et al. (1993) demonstrated that the SIAT1 gene is located on 3q21-q28. Comparative analysis of the human and rat sequences demonstrated precise conservation of the intron/exon boundaries throughout the coding domains. Furthermore, there was extensive interspecies sequence similarity in some of the exons that contained information only for the 5-prime leader regions.

Full details of the abovementioned studies are described in the following publications, the disclosure of which are hereby incorporated by reference:

Grundmann, U.; Nerlich, C.; Rein, T.; Zettlmeissl, G.: Complete cDNA sequence encoding human beta-galactoside alpha-2,6-sialyl transferase. Nucleic Acids Res. 18:667 only, 1990; and Wang, X.; Vertino, A.; Eddy, R. L.; Byers, M. G.; Jani-Sait, S. N.; Shows, T. B.; Lau, J. T. Y.: Chromosome mapping and organization of the human beta-galactoside alpha-2,6-sialyltrans.

Further studies establishing the function and utilities of SIAT1 are found in John Hopkins OMIM database record ID 109675, and in sited publications numbered 3697-3698 listed in the bibliography section hereinbelow, which are also hereby incorporated by reference. SRY (sex determining region Y)-box 4 (SOX4, Accession NM_003107) is another VGAM1224 host target gene. SOX4 BINDING SITE is HOST TARGET binding site found in the 3' untranslated region of mRNA encoded by SOX4, corresponding to a HOST TARGET binding site such as BINDING SITE I, BINDING SITE II or BINDING SITE III. Table 2 illustrates the complementarity of the nucleotide sequences of SOX4 BINDING SITE, designated SEQ ID:9074, to the nucleotide sequence of VGAM1224 RNA, herein designated VGAM RNA, also designated SEQ ID:3935.

Another function of VGAM1224 is therefore inhibition of SRY (sex determining region Y)-box 4 (SOX4, Accession NM_003107), a gene which binds with high affinity to the t-cell enhancer motif 5'-aacaaag-3' motif. Accordingly, utilities of VGAM1224 include diagnosis, prevention and treatment of diseases and clinical conditions associated with SOX4. The function of SOX4 and its association with various diseases and clinical conditions, has been established by previous studies, as described hereinabove with reference to VGAM409. Transducin (beta)-like 1X-linked (TBL1X, Accession NM_005647) is another VGAM1224 host target gene. TBL1X BINDING SITE is HOST TARGET binding site found in the 3' untranslated region of mRNA encoded by TBL1X, corresponding to a HOST TARGET binding site such as BINDING SITE I, BINDING SITE II or BINDING SITE III. Table 2 illustrates the complementarity of the nucleotide sequences of TBL1X BINDING SITE, designated SEQ ID:12181, to the nucleotide sequence of VGAM1224 RNA, herein designated VGAM RNA, also designated SEQ ID:3935.

Another function of VGAM1224 is therefore inhibition of Transducin (beta)-like 1X-linked (TBL1X, Accession NM_005647), a gene which activates latent HDAC3 activity. Accordingly, utilities of VGAM1224 include diagnosis, prevention and treatment of diseases and clinical conditions associated with TBL1X. The function of TBL1X and its association with various diseases and clinical conditions, has been established by previous studies, as described hereinabove with reference to VGAM1151. TIA1 Cytotoxic Granule-associated RNA Binding Protein-like 1 (TIAL1, Accession NM_022333) is another VGAM1224 host target gene. TIAL1 BINDING SITE is HOST TARGET binding site found in the 3' untranslated region of mRNA encoded by TIAL1, corresponding to a HOST TARGET binding site such as BINDING SITE I, BINDING SITE II or BINDING SITE III. Table 2 illustrates the complementarity of the nucleotide sequences of TIAL1 BINDING SITE, designated SEQ ID:22742, to the nucleotide sequence of VGAM1224 RNA, herein designated VGAM RNA, also designated SEQ ID:3935.

Another function of VGAM1224 is therefore inhibition of TIA1 Cytotoxic Granule-associated RNA Binding Protein-like 1 (TIAL1, Accession NM_022333), a gene which possesses nucleolytic activity against cytotoxic lymphocyte target cells. Accordingly, utilities of VGAM1224 include diagnosis, prevention and treatment of diseases and clinical conditions associated with TIAL1. The function of TIAL1 and its association with various diseases and clinical conditions, has been established by previous studies, as described hereinabove with reference to VGAM350. Rho/rac Guanine Nucleotide Exchange Factor (GEF) 2 (ARHGEF2, Accession NM_004723) is another VGAM1224 host target gene. ARHGEF2 BINDING SITE is HOST TARGET binding site found in the 3' untranslated region of mRNA encoded by ARHGEF2, corresponding to a HOST TARGET binding site such as BINDING SITE I, BINDING SITE II or BINDING SITE III. Table 2 illustrates the complementarity of the nucleotide sequences of ARHGEF2 BINDING SITE, designated SEQ ID:11090, to the nucleotide sequence of VGAM1224 RNA, herein designated VGAM RNA, also designated SEQ ID:3935.

Another function of VGAM1224 is therefore inhibition of Rho/rac Guanine Nucleotide Exchange Factor (GEF) 2 (ARHGEF2, Accession NM_004723). Accordingly, utilities of VGAM1224 include diagnosis, prevention and treatment of diseases and clinical conditions associated with ARHGEF2. Cat Eye Syndrome Chromosome Region, Candidate 1 (CECR1, Accession NM_017424) is another VGAM1224 host target gene. CECR1 BINDING SITE is HOST TARGET binding site found in the 3' untranslated region of mRNA encoded by CECR1, corresponding to a HOST TARGET binding site such as BINDING SITE I, BINDING SITE II or BINDING SITE III. Table 2 illustrates the complementarity of the nucleotide sequences of CECR1 BINDING SITE, designated SEQ ID:18885, to the nucleotide sequence of VGAM1224 RNA, herein designated VGAM RNA, also designated SEQ ID:3935.

Another function of VGAM1224 is therefore inhibition of Cat Eye Syndrome Chromosome Region, Candidate 1 (CECR1, Accession NM_017424). Accordingly, utilities of VGAM1224 include diagnosis, prevention and treatment of diseases and clinical conditions associated with CECR1. DKFZp761K1824 (Accession NM_017597) is another VGAM1224 host target gene. DKFZp761K1824 BINDING SITE is HOST TARGET binding site found in the 3' untranslated region of mRNA encoded by DKFZp761K1824, corresponding to a HOST TARGET binding site such as BINDING SITE I, BINDING SITE II or BINDING SITE III. Table 2 illustrates the complementarity of the nucleotide sequences of DKFZp761K1824 BINDING SITE, designated SEQ ID:19059, to the nucleotide sequence of VGAM1224 RNA, herein designated VGAM RNA, also designated SEQ ID:3935.

Another function of VGAM1224 is therefore inhibition of DKFZp761K1824 (Accession NM_017597). Accordingly, utilities of VGAM1224 include diagnosis, prevention and treatment of diseases and clinical conditions associated with DKFZp761K1824. Eukaryotic Translation Initiation Factor 4B (EIF4B, Accession XM_071605) is another VGAM1224 host target gene. EIF4B BINDING SITE is HOST TARGET binding site found in the 3' untranslated region of mRNA encoded by EIF4B, corresponding to a HOST TARGET binding site such as BINDING SITE I, BINDING SITE II or BINDING SITE III. Table 2 illustrates the complementarity of the nucleotide sequences of EIF4B BINDING SITE, designated SEQ ID:37401, to the nucleotide sequence of VGAM1224 RNA, herein designated VGAM RNA, also designated SEQ ID:3935.

Another function of VGAM1224 is therefore inhibition of Eukaryotic Translation Initiation Factor 4B (EIF4B, Accession XM_071605). Accordingly, utilities of VGAM1224 include diagnosis, prevention and treatment of diseases and clinical conditions associated with EIF4B. F-box Only Protein 21 (FBXO21, Accession NM_033624) is another VGAM1224 host target gene. FBXO21 BINDING SITE is HOST TARGET binding site found in the 3' untranslated region of mRNA encoded by FBXO21, corresponding to a HOST TARGET binding site such as BINDING SITE I, BINDING SITE II or BINDING SITE III. Table 2 illustrates the complementarity of the nucleotide sequences of FBXO21 BINDING SITE, designated SEQ ID:27326, to the nucleotide sequence of VGAM1224 RNA, herein designated VGAM RNA, also designated SEQ ID:3935.

Another function of VGAM1224 is therefore inhibition of F-box Only Protein 21 (FBXO21, Accession NM_033624). Accordingly, utilities of VGAM1224 include diagnosis, prevention and treatment of diseases and clinical conditions associated with FBXO21. FLJ11715 (Accession NM_024564) is another VGAM1224 host target gene. FLJ11715 BINDING SITE is HOST TARGET binding site found in the 5' untranslated region of mRNA encoded by FLJ11715, corresponding to a HOST TARGET binding site such as BINDING SITE I, BINDING SITE II or BINDING SITE III. Table 2 illustrates the complementarity of the nucleotide sequences of FLJ11715 BINDING SITE, designated SEQ ID:23789, to the nucleotide sequence of VGAM1224 RNA, herein designated VGAM RNA, also designated SEQ ID:3935.

Another function of VGAM1224 is therefore inhibition of FLJ11715 (Accession NM_024564). Accordingly, utilities of VGAM1224 include diagnosis, prevention and treatment of diseases and clinical conditions associated with FLJ11715. FLJ11939 (Accession NM_024679) is another VGAM1224 host target gene. FLJ11939 BINDING SITE is HOST TARGET binding site found in the 3' untranslated region of mRNA encoded by FLJ11939, corresponding to a HOST TARGET binding site such as BINDING SITE I, BINDING SITE II or BINDING SITE III. Table 2 illustrates the complementarity of the nucleotide sequences of FLJ11939 BINDING SITE, designated SEQ ID:23990, to the nucleotide sequence of VGAM1224 RNA, herein designated VGAM RNA, also designated SEQ ID:3935.

Another function of VGAM1224 is therefore inhibition of FLJ11939 (Accession NM_024679). Accordingly, utilities of VGAM1224 include diagnosis, prevention and treatment of diseases and clinical conditions associated with FLJ11939. FLJ12619 (Accession NM_030939) is another VGAM1224 host target gene. FLJ12619 BINDING SITE is HOST TARGET binding site found in the 5' untranslated region of mRNA encoded by FLJ12619, corresponding to a HOST TARGET binding site such as BINDING SITE I, BINDING SITE II or BINDING SITE III. Table 2 illustrates the complementarity of the nucleotide sequences of FLJ12619 BINDING SITE, designated SEQ ID:25211, to the nucleotide sequence of VGAM1224 RNA, herein designated VGAM RNA, also designated SEQ ID:3935.

Another function of VGAM1224 is therefore inhibition of FLJ12619 (Accession NM_030939). Accordingly, utilities of VGAM1224 include diagnosis, prevention and treatment of diseases and clinical conditions associated with FLJ12619. FLJ12700 (Accession NM_024910) is another VGAM1224 host target gene. FLJ12700 BINDING SITE is HOST TARGET binding site found in the 3' untranslated region of mRNA encoded by FLJ12700, corresponding to a HOST TARGET binding site such as BINDING SITE I, BINDING SITE II or BINDING SITE III. Table 2 illustrates the complementarity of the nucleotide sequences of FLJ12700 BINDING SITE, designated SEQ ID:24416, to the nucleotide sequence of VGAM1224 RNA, herein designated VGAM RNA, also designated SEQ ID:3935.

Another function of VGAM1224 is therefore inhibition of FLJ12700 (Accession NM_024910). Accordingly, utilities of VGAM1224 include diagnosis, prevention and treatment of diseases and clinical conditions associated with FLJ12700. FLJ20739 (Accession XM_042197) is another VGAM1224 host target gene. FLJ20739 BINDING SITE is HOST TARGET binding site found in the 3' untranslated region of mRNA encoded by FLJ20739, corresponding to a HOST TARGET binding site such as BINDING SITE I, BINDING SITE II or BINDING SITE III. Table 2 illustrates the complementarity of the nucleotide sequences of FLJ20739 BINDING SITE, designated SEQ ID:33704, to the nucleotide sequence of VGAM1224 RNA, herein designated VGAM RNA, also designated SEQ ID:3935.

Another function of VGAM1224 is therefore inhibition of FLJ20739 (Accession XM_042197). Accordingly, utilities of VGAM1224 include diagnosis, prevention and treatment of diseases and clinical conditions associated with FLJ20739. FLJ21945 (Accession NM_025203) is another VGAM1224 host target gene. FLJ21945 BINDING SITE is HOST TARGET binding site found in the 3' untranslated region of mRNA encoded by FLJ21945, corresponding to a HOST TARGET binding site such as BINDING SITE I, BINDING SITE II or BINDING SITE III. Table 2 illustrates the complementarity of the nucleotide sequences of FLJ21945 BINDING SITE, designated SEQ ID:24868, to the nucleotide sequence of VGAM1224 RNA, herein designated VGAM RNA, also designated SEQ ID:3935.

Another function of VGAM1224 is therefore inhibition of FLJ21945 (Accession NM_025203). Accordingly, utilities of VGAM1224 include diagnosis, prevention and treatment of diseases and clinical conditions associated with FLJ21945. FLJ30567 (Accession NM_145022) is another VGAM1224 host target gene. FLJ30567 BINDING SITE is HOST TARGET binding site found in the 3' untranslated region of mRNA encoded by FLJ30567, corresponding to a HOST TARGET binding site such as BINDING SITE I, BINDING SITE II or BINDING SITE III. Table 2 illustrates the complementarity of the nucleotide sequences of FLJ30567 BINDING SITE, designated SEQ ID:29629, to the nucleotide sequence of VGAM1224 RNA, herein designated VGAM RNA, also designated SEQ ID:3935.

Another function of VGAM1224 is therefore inhibition of FLJ30567 (Accession NM_145022). Accordingly, utilities of VGAM1224 include diagnosis, prevention and treatment of diseases and clinical conditions associated with FLJ30567. KIAA0010 (Accession NM_014671) is another VGAM1224 host target gene. KIAA0010 BINDING SITE is HOST TARGET binding site found in the 3' untranslated region of mRNA encoded by KIAA0010, corresponding to a HOST TARGET binding site such as BINDING SITE I, BINDING SITE II or BINDING SITE III. Table 2 illustrates the complementarity of the nucleotide sequences of KIAA0010 BINDING SITE, designated SEQ ID:16130, to the nucleotide sequence of VGAM1224 RNA, herein designated VGAM RNA, also designated SEQ ID:3935.

Another function of VGAM1224 is therefore inhibition of KIAA0010 (Accession NM_014671). Accordingly, utilities of VGAM1224 include diagnosis, prevention and treatment of diseases and clinical conditions associated with KIAA0010. KIAA0237 (Accession NM_014747) is another VGAM1224 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16454, to the nucleotide sequence of VGAM1224 RNA, herein designated VGAM RNA, also designated SEQ ID:3935.

Another function of VGAM1224 is therefore inhibition of KIAA0237 (Accession NM_014747). Accordingly, utilities of VGAM1224 include diagnosis, prevention and treatment of diseases and clinical conditions associated with KIAA0237. KIAA0426 (Accession NM_014724) is another VGAM1224 host target gene. KIAA0426 BINDING SITE is HOST TARGET binding site found in the 3' untranslated region of mRNA encoded by KIAA0426, corresponding to a HOST TARGET binding site such as BINDING SITE I, BINDING SITE II or BINDING SITE III. Table 2 illustrates the complementarity of the nucleotide sequences of KIAA0426 BINDING SITE, designated SEQ ID:16309, to the nucleotide sequence of VGAM1224 RNA, herein designated VGAM RNA, also designated SEQ ID:3935.

Another function of VGAM1224 is therefore inhibition of KIAA0426 (Accession NM_014724). Accordingly, utilities of VGAM1224 include diagnosis, prevention and treatment of diseases and clinical conditions associated with KIAA0426. KIAA0427 (Accession NM_014772) is another VGAM1224 host target gene. KIAA0427 BINDING SITE is HOST TARGET binding site found in the 5' untranslated region of mRNA encoded by KIAA0427, corresponding to a HOST TARGET binding site such as BINDING SITE I, BINDING SITE II or BINDING SITE III. Table 2 illustrates the complementarity of the nucleotide sequences of KIAA0427 BINDING SITE, designated SEQ ID:16573, to the nucleotide sequence of VGAM1224 RNA, herein designated VGAM RNA, also designated SEQ ID:3935.

Another function of VGAM1224 is therefore inhibition of KIAA0427 (Accession NM_014772). Accordingly, utilities of VGAM1224 include diagnosis, prevention and treatment of diseases and clinical conditions associated with KIAA0427. KIAA0792 (Accession NM_014698) is another VGAM1224 host target gene. KIAA0792 BINDING SITE is HOST TARGET binding site found in the 5' untranslated region of mRNA encoded by KIAA0792, corresponding to a HOST TARGET binding site such as BINDING SITE I, BINDING SITE II or BINDING SITE III. Table 2 illustrates the complementarity of the nucleotide sequences of KIAA0792 BINDING SITE, designated SEQ ID:16215, to the nucleotide sequence of VGAM1224 RNA, herein designated VGAM RNA, also designated SEQ ID:3935.

Another function of VGAM1224 is therefore inhibition of KIAA0792 (Accession NM_014698). Accordingly, utilities of VGAM1224 include diagnosis, prevention and treatment of diseases and clinical conditions associated with KIAA0792. KIAA1052 (Accession NM_014956) is another VGAM1224 host target gene. KIAA1052 BINDING SITE is HOST TARGET binding site found in the 3' untranslated region of mRNA encoded by KIAA1052, corresponding to a HOST TARGET binding site such as BINDING SITE I, BINDING SITE II or BINDING SITE III. Table 2 illustrates the complementarity of the nucleotide sequences of KIAA1052 BINDING SITE, designated SEQ ID:17310, to the nucleotide sequence of VGAM1224 RNA, herein designated VGAM RNA, also designated SEQ ID:3935.

Another function of VGAM1224 is therefore inhibition of KIAA1052 (Accession NM_014956). Accordingly, utilities of VGAM1224 include diagnosis, prevention and treatment of diseases and clinical conditions associated with KIAA1052. KIAA1205 (Accession XM_046305) is another VGAM1224 host target gene. KIAA1205 BINDING SITE is HOST TARGET binding site found in the 3' untranslated region of mRNA encoded by KIAA1205, corresponding to a HOST TARGET binding site such as BINDING SITE I, BINDING SITE II or BINDING SITE III. Table 2 illustrates the complementarity of the nucleotide sequences of KIAA1205 BINDING SITE, designated SEQ ID:34705, to the nucleotide sequence of VGAM1224 RNA, herein designated VGAM RNA, also designated SEQ ID:3935.

Another function of VGAM1224 is therefore inhibition of KIAA1205 (Accession XM_046305). Accordingly, utilities of VGAM1224 include diagnosis, prevention and treatment of diseases and clinical conditions associated with KIAA1205. KIAA1322 (Accession XM_052626) is another VGAM1224 host target gene. KIAA1322 BINDING SITE is HOST TARGET binding site found in the 3' untranslated region of mRNA encoded by KIAA1322, corresponding to a HOST TARGET binding site such as BINDING SITE I, BINDING SITE II or BINDING SITE III. Table 2 illustrates the complementarity of the nucleotide sequences of KIAA1322 BINDING SITE, designated SEQ ID:36021, to the nucleotide sequence of VGAM1224 RNA, herein designated VGAM RNA, also designated SEQ ID:3935.

Another function of VGAM1224 is therefore inhibition of KIAA1322 (Accession XM_052626). Accordingly, utilities of VGAM1224 include diagnosis, prevention and treatment of diseases and clinical conditions associated with KIAA1322. KIAA1467 (Accession XM_049605) is another VGAM1224 host target gene. KIAA1467 BINDING SITE is HOST TARGET binding site found in the 3' untranslated region of mRNA encoded by KIAA1467, corresponding to a HOST TARGET binding site such as BINDING SITE I, BINDING SITE II or BINDING SITE III. Table 2 illustrates the complementarity of the nucleotide sequences of KIAA1467 BINDING SITE, designated SEQ ID:35452, to the nucleotide sequence of VGAM1224 RNA, herein designated VGAM RNA, also designated SEQ ID:3935.

Another function of VGAM1224 is therefore inhibition of KIAA1467 (Accession XM_049605). Accordingly, utilities of VGAM1224 include diagnosis, prevention and treatment of diseases and clinical conditions associated with KIAA1467. KIAA1674 (Accession XM_044065) is another VGAM1224 host target gene. KIAA1674 BINDING SITE is HOST TARGET binding site found in the 3' untranslated region of mRNA encoded by KIAA1674, corresponding to a HOST TARGET binding site such as BINDING SITE I, BINDING SITE II or BINDING SITE III. Table 2 illustrates the complementarity of the nucleotide sequences of KIAA1674 BINDING SITE, designated SEQ ID:34110, to the nucleotide sequence of VGAM1224 RNA, herein designated VGAM RNA, also designated SEQ ID:3935.

Another function of VGAM1224 is therefore inhibition of KIAA1674 (Accession XM_044065). Accordingly, utilities of VGAM1224 include diagnosis, prevention and treatment of diseases and clinical conditions associated with KIAA1674. KIAA1819 (Accession XM_045716) is another VGAM1224 host target gene. KIAA1819 BINDING SITE is HOST TARGET binding site found in the 5' untranslated region of mRNA encoded by KIAA1819, corresponding to a HOST TARGET binding site such as BINDING SITE I, BINDING SITE II or BINDING SITE III. Table 2 illustrates the complementarity of the nucleotide sequences of KIAA1819 BINDING SITE, designated SEQ ID:34536, to the nucleotide sequence of VGAM1224 RNA, herein designated VGAM RNA, also designated SEQ ID:3935.

Another function of VGAM1224 is therefore inhibition of KIAA1819 (Accession XM_045716). Accordingly, utilities of VGAM1224 include diagnosis, prevention and treatment of diseases and clinical conditions associated with KIAA1819. KIAA1918 (Accession XM_054951) is another VGAM1224 host target gene. KIAA1918 BINDING SITE is HOST TARGET binding site found in the 3' untranslated region of mRNA encoded by KIAA1918, corresponding to a HOST TARGET binding site such as BINDING SITE I, BINDING SITE II or BINDING SITE III. Table 2 illustrates the complementarity of the nucleotide sequences of KIAA1918 BINDING SITE, designated SEQ ID:36218, to the nucleotide sequence of VGAM1224 RNA, herein designated VGAM RNA, also designated SEQ ID:3935.

Another function of VGAM1224 is therefore inhibition of KIAA1918 (Accession XM_054951). Accordingly, utilities of VGAM1224 include diagnosis, prevention and treatment of diseases and clinical conditions associated with KIAA1918. KIAA1949 (Accession XM_166376) is another VGAM1224 host target gene. KIAA1949 BINDING SITE1 through KIAA1949 BINDING SITE3 are HOST TARGET binding sites found in untranslated regions of mRNA encoded by KIAA1949, corresponding to HOST TARGET binding sites such as BINDING SITE I, BINDING SITE II or BINDING SITE III. Table 2 illustrates the complementarity of the nucleotide sequences of KIAA1949 BINDING SITE1 through KIAA1949 BINDING SITE3, designated SEQ ID:44209, SEQ ID:46668 and SEQ ID:46713 respectively, to the nucleotide sequence of VGAM1224 RNA, herein designated VGAM RNA, also designated SEQ ID:3935.

Another function of VGAM1224 is therefore inhibition of KIAA1949 (Accession XM_166376). Accordingly, utilities of VGAM1224 include diagnosis, prevention and treatment of diseases and clinical conditions associated with KIAA1949. MGC16491 (Accession NM_052943) is another VGAM1224 host target gene. MGC16491 BINDING SITE is HOST TARGET binding site found in the 5' untranslated region of mRNA encoded by MGC16491, corresponding to a HOST TARGET binding site such as BINDING SITE I, BINDING SITE II or BINDING SITE III. Table 2 illustrates the complementarity of the nucleotide sequences of MGC16491 BINDING SITE, designated SEQ ID:27502, to the nucleotide sequence of VGAM1224 RNA, herein designated VGAM RNA, also designated SEQ ID:3935.

Another function of VGAM1224 is therefore inhibition of MGC16491 (Accession NM_052943). Accordingly, utilities of VGAM1224 include diagnosis, prevention and treatment of diseases and clinical conditions associated with MGC16491. Myosin XVIIIB (MYO18B, Accession NM_032608) is another VGAM1224 host target gene. MYO18B BINDING SITE is HOST TARGET binding site found in the 3' untranslated region of mRNA encoded by MYO18B, corresponding to a HOST TARGET binding site such as BINDING SITE I, BINDING SITE II or BINDING SITE III. Table 2 illustrates the complementarity of the nucleotide sequences of MYO18B BINDING SITE, designated SEQ ID:26332, to the nucleotide sequence of VGAM1224 RNA, herein designated VGAM RNA, also designated SEQ ID:3935.

Another function of VGAM1224 is therefore inhibition of Myosin XVIIIB (MYO18B, Accession NM_032608). Accordingly, utilities of VGAM1224 include diagnosis, prevention and treatment of diseases and clinical conditions associated with MYO18B. Oxysterol Binding Protein-like 2 (OSBPL2, Accession NM_144498) is another VGAM1224 host target gene. OSBPL2 BINDING SITE1 and OSBPL2 BINDING SITE2 are HOST TARGET binding sites found in untranslated regions of mRNA encoded by OSBPL2, corresponding to HOST TARGET binding sites such as BINDING SITE I, BINDING SITE II or BINDING SITE III. Table 2 illustrates the complementarity of the nucleotide sequences of OSBPL2 BINDING SITE1 and OSBPL2 BINDING SITE2, designated SEQ ID:29319 and SEQ ID:16851 respectively, to the nucleotide sequence of VGAM1224 RNA, herein designated VGAM RNA, also designated SEQ ID:3935.

Another function of VGAM1224 is therefore inhibition of Oxysterol Binding Protein-like 2 (OSBPL2, Accession NM_144498). Accordingly, utilities of VGAM1224 include diagnosis, prevention and treatment of diseases and clinical conditions associated with OSBPL2. Phosphatase, Orphan 1 (phospho1, Accession XM_091572) is another VGAM1224 host target gene. phospho1 BINDING SITE is HOST TARGET binding site found in the 5' untranslated region of mRNA encoded by phospho1, corresponding to a HOST TARGET binding site such as BINDING SITE I, BINDING SITE II or BINDING SITE III. Table 2 illustrates the complementarity of the nucleotide sequences of phospho1 BINDING SITE, designated SEQ ID:40062, to the nucleotide sequence of VGAM1224 RNA, herein designated VGAM RNA, also designated SEQ ID:3935.

Another function of VGAM1224 is therefore inhibition of Phosphatase, Orphan 1 (phospho1, Accession XM_091572). Accordingly, utilities of VGAM1224 include diagnosis, prevention and treatment of diseases and clinical conditions associated with phospho1. SDS3 (Accession XM_045014) is another VGAM1224 host target gene. SDS3 BINDING SITE is HOST TARGET binding site found in the 3' untranslated region of mRNA encoded by SDS3, corresponding to a HOST TARGET binding site such as BINDING SITE I, BINDING SITE II or BINDING SITE III. Table 2 illustrates the complementarity of the nucleotide sequences of SDS3 BINDING SITE, designated SEQ ID:34319, to the nucleotide sequence of VGAM1224 RNA, herein designated VGAM RNA, also designated SEQ ID:3935.

Another function of VGAM1224 is therefore inhibition of SDS3 (Accession XM_045014). Accordingly, utilities of VGAM1224 include diagnosis, prevention and treatment of diseases and clinical conditions associated with SDS3. SIMRP7 (Accession XM_166462) is another VGAM1224 host target gene. SIMRP7 BINDING SITE is HOST TARGET binding site found in the 3' untranslated region of mRNA encoded by SIMRP7, corresponding to a HOST TARGET binding site such as BINDING SITE I, BINDING SITE II or BINDING SITE III. Table 2 illustrates the complementarity of the nucleotide sequences of SIMRP7 BINDING SITE, designated SEQ ID:44373, to the nucleotide sequence of VGAM1224 RNA, herein designated VGAM RNA, also designated SEQ ID:3935.

Another function of VGAM1224 is therefore inhibition of SIMRP7 (Accession XM_166462). Accordingly, utilities of VGAM1224 include diagnosis, prevention and treatment of diseases and clinical conditions associated with SIMRP7. SP192 (Accession NM_021639) is another VGAM1224 host target gene. SP192 BINDING SITE is HOST TARGET binding site found in the 5' untranslated region of mRNA encoded by SP192, corresponding to a HOST TARGET binding site such as BINDING SITE I, BINDING SITE II or BINDING SITE III. Table 2 illustrates the complementarity of the nucleotide sequences of SP192 BINDING SITE, designated SEQ ID:22299, to the nucleotide sequence of VGAM1224 RNA, herein designated VGAM RNA, also designated SEQ ID:3935.

Another function of VGAM1224 is therefore inhibition of SP192 (Accession NM_021639). Accordingly, utilities of VGAM1224 include diagnosis, prevention and treatment of diseases and clinical conditions associated with SP192. Stathmin-like 3 (STMN3, Accession NM_015894) is another VGAM1224 host target gene. STMN3 BINDING SITE is HOST TARGET binding site found in the 3' untranslated region of mRNA encoded by STMN3, corresponding to a HOST TARGET binding site such as BINDING SITE I, BINDING SITE II or BINDING SITE III. Table 2 illustrates the complementarity of the nucleotide sequences of STMN3 BINDING SITE, designated SEQ ID:18039, to the nucleotide sequence of VGAM1224 RNA, herein designated VGAM RNA, also designated SEQ ID:3935.

Another function of VGAM1224 is therefore inhibition of Stathmin-like 3 (STMN3, Accession NM_015894). Accordingly, utilities of VGAM1224 include diagnosis, prevention and treatment of diseases and clinical conditions associated with STMN3. LOC126917 (Accession XM_059091) is another VGAM1224 host target gene. LOC126917 BINDING SITE is HOST TARGET binding site found in the 3' untranslated region of mRNA encoded by LOC126917, corresponding to a HOST TARGET binding site such as BINDING SITE I, BINDING SITE II or BINDING SITE III. Table 2 illustrates the complementarity of the nucleotide sequences of LOC126917 BINDING SITE, designated SEQ ID:36868, to the nucleotide sequence of VGAM1224 RNA, herein designated VGAM RNA, also designated SEQ ID:3935.

Another function of VGAM1224 is therefore inhibition of LOC126917 (Accession XM_059091). Accordingly, utilities of VGAM1224 include diagnosis, prevention and treatment of diseases and clinical conditions associated with LOC126917. LOC144114 (Accession XM_090198) is another VGAM1224 host target gene. LOC144114 BINDING SITE is HOST TARGET binding site found in the 5' untranslated region of mRNA encoded by LOC144114, corresponding to a HOST TARGET binding site such as BINDING SITE I, BINDING SITE II or BINDING SITE III. Table 2 illustrates the complementarity of the nucleotide sequences of LOC144114 BINDING SITE, designated SEQ ID:39995, to the nucleotide sequence of VGAM1224 RNA, herein designated VGAM RNA, also designated SEQ ID:3935.

Another function of VGAM1224 is therefore inhibition of LOC144114 (Accession XM_090198). Accordingly, utilities of VGAM1224 include diagnosis, prevention and treatment of diseases and clinical conditions associated with LOC144114. LOC144473 (Accession XM_096606) is another VGAM1224 host target gene. LOC144473 BINDING SITE is HOST TARGET binding site found in the 3' untranslated region of mRNA encoded by LOC144473, corresponding to a HOST TARGET binding site such as BINDING SITE I, BINDING SITE II or BINDING SITE III. Table 2 illustrates the complementarity of the nucleotide sequences of LOC144473 BINDING SITE, designated SEQ ID:40415, to the nucleotide sequence of VGAM1224 RNA, herein designated VGAM RNA, also designated SEQ ID:3935.

Another function of VGAM1224 is therefore inhibition of LOC144473 (Accession XM_096606). Accordingly, utilities of VGAM1224 include diagnosis, prevention and treatment of diseases and clinical conditions associated with LOC144473. LOC144866 (Accession XM_096699) is another VGAM1224 host target gene. LOC144866 BINDING SITE is HOST TARGET binding site found in the 5' untranslated region of mRNA encoded by LOC144866, corresponding to a HOST TARGET binding site such as BINDING SITE I, BINDING SITE II or BINDING SITE III. Table 2 illustrates the complementarity of the nucleotide sequences of LOC144866 BINDING SITE, designated SEQ ID:40478, to the nucleotide sequence of VGAM1224 RNA, herein designated VGAM RNA, also designated SEQ ID:3935.

Another function of VGAM1224 is therefore inhibition of LOC144866 (Accession XM_096699). Accordingly, utilities of VGAM1224 include diagnosis, prevention and treatment of diseases and clinical conditions associated with LOC144866. LOC145815 (Accession XM_096874) is another VGAM1224 host target gene. LOC145815 BINDING SITE is HOST TARGET binding site found in the 5' untranslated region of mRNA encoded by LOC145815, corresponding to a HOST TARGET binding site such as BINDING SITE I, BINDING SITE II or BINDING SITE III. Table 2 illustrates the complementarity of the nucleotide sequences of LOC145815 BINDING SITE, designated SEQ ID:40603, to the nucleotide sequence of VGAM1224 RNA, herein designated VGAM RNA, also designated SEQ ID:3935.

Another function of VGAM1224 is therefore inhibition of LOC145815 (Accession XM_096874). Accordingly, utilities of VGAM1224 include diagnosis, prevention and treatment of diseases and clinical conditions associated with LOC145815. LOC146823 (Accession XM_097105) is another VGAM1224 host target gene. LOC146823 BINDING SITE is HOST TARGET binding site found in the 3' untranslated region of mRNA encoded by LOC146823, corresponding to a HOST TARGET binding site such as BINDING SITE I, BINDING SITE II or BINDING SITE III. Table 2 illustrates the complementarity of the nucleotide sequences of LOC146823 BINDING SITE, designated SEQ ID:40750, to the nucleotide sequence of VGAM1224 RNA, herein designated VGAM RNA, also designated SEQ ID:3935.

Another function of VGAM1224 is therefore inhibition of LOC146823 (Accession XM_097105). Accordingly, utilities of VGAM1224 include diagnosis, prevention and treatment of diseases and clinical conditions associated with LOC146823. LOC153146 (Accession XM_098319) is another VGAM1224 host target gene. LOC153146 BINDING SITE is HOST TARGET binding site found in the 5' untranslated region of mRNA encoded by LOC153146, corresponding to a HOST TARGET binding site such as BINDING SITE I, BINDING SITE II or BINDING SITE III. Table 2 illustrates the complementarity of the nucleotide sequences of LOC153146 BINDING SITE, designated SEQ ID:41577, to the nucleotide sequence of VGAM1224 RNA, herein designated VGAM RNA, also designated SEQ ID:3935.

Another function of VGAM1224 is therefore inhibition of LOC153146 (Accession XM_098319). Accordingly, utilities of VGAM1224 include diagnosis, prevention and treatment of diseases and clinical conditions associated with LOC153146. LOC155072 (Accession XM_098661) is another VGAM1224 host target gene. LOC155072 BINDING SITE1 and LOC155072 BINDING SITE2 are HOST TARGET binding sites found in untranslated regions of mRNA encoded by LOC155072, corresponding to HOST TARGET binding sites such as BINDING SITE I, BINDING SITE II or BINDING SITE III. Table 2 illustrates the complementarity of the nucleotide sequences of LOC155072 BINDING SITE1 and LOC155072 BINDING SITE2, designated SEQ ID:41759 and SEQ ID:41762 respectively, to the nucleotide sequence of VGAM1224 RNA, herein designated VGAM RNA, also designated SEQ ID:3935.

Another function of VGAM1224 is therefore inhibition of LOC155072 (Accession XM_098661). Accordingly, utilities of VGAM1224 include diagnosis, prevention and treatment of diseases and clinical conditions associated with LOC155072. LOC202868 (Accession XM_117477) is another VGAM1224 host target gene. LOC202868 BINDING SITE1 and LOC202868 BINDING SITE2 are HOST TARGET binding sites found in untranslated regions of mRNA encoded by LOC202868, corresponding to HOST TARGET binding sites such as BINDING SITE I, BINDING SITE II or BINDING SITE III. Table 2 illustrates the complementarity of the nucleotide sequences of LOC202868 BINDING SITE1 and LOC202868 BINDING SITE2, designated SEQ ID:43450 and SEQ ID:43024 respectively, to the nucleotide sequence of VGAM1224 RNA, herein designated VGAM RNA, also designated SEQ ID:3935.

Another function of VGAM1224 is therefore inhibition of LOC202868 (Accession XM_117477). Accordingly, utilities of VGAM1224 include diagnosis, prevention and treatment of diseases and clinical conditions associated with LOC202868. LOC221814 (Accession XM_168226) is another VGAM1224 host target gene. LOC221814 BINDING SITE is HOST TARGET binding site found in the 5' untranslated region of mRNA encoded by LOC221814, corresponding to a HOST TARGET binding site such as BINDING SITE I, BINDING SITE II or BINDING SITE III. Table 2 illustrates the complementarity of the nucleotide sequences of LOC221814 BINDING SITE, designated SEQ ID:45097, to the nucleotide sequence of VGAM1224 RNA, herein designated VGAM RNA, also designated SEQ ID:3935.

Another function of VGAM1224 is therefore inhibition of LOC221814 (Accession XM_168226). Accordingly, utilities of VGAM1224 include diagnosis, prevention and treatment of diseases and clinical conditions associated with LOC221814. LOC254532 (Accession XM_172961) is another VGAM1224 host target gene. LOC254532 BINDING SITE is HOST TARGET binding site found in the 5' untranslated region of mRNA encoded by LOC254532, corresponding to a HOST TARGET binding site such as BINDING SITE I, BINDING SITE II or BINDING SITE III. Table 2 illustrates the complementarity of the nucleotide sequences of LOC254532 BINDING SITE, designated SEQ ID:46214, to the nucleotide sequence of VGAM1224 RNA, herein designated VGAM RNA, also designated SEQ ID:3935.

Another function of VGAM1224 is therefore inhibition of LOC254532 (Accession XM_172961). Accordingly, utilities of VGAM1224 include diagnosis, prevention and treatment of diseases and clinical conditions associated with LOC254532. LOC89944 (Accession XM_166198) is another VGAM1224 host target gene. LOC89944 BINDING SITE is HOST TARGET binding site found in the 3' untranslated region of mRNA encoded by LOC89944, corresponding to a HOST TARGET binding site such as BINDING SITE I, BINDING SITE II or BINDING SITE III. Table 2 illustrates the complementarity of the nucleotide sequences of LOC89944 BINDING SITE, designated SEQ ID:44004, to the nucleotide sequence of VGAM1224 RNA, herein designated VGAM RNA, also designated SEQ ID:3935.

Another function of VGAM1224 is therefore inhibition of LOC89944 (Accession XM_166198). Accordingly, utilities of VGAM1224 include diagnosis, prevention and treatment of diseases and clinical conditions associated with LOC89944. FIG. 1 further provides a conceptual description of a novel bioinformatically detected viral gene of the present invention, referred to here as Viral Genomic Address Messenger 1225 (VGAM1225) viral gene, which modulates expression of respective host target genes thereof, the function and utility of which host target genes is known in the art.

VGAM1225 is a novel bioinformatically detected regulatory, non protein coding, viral micro RNA (miRNA) gene. The method by which VGAM1225 was detected is described hereinabove with reference to FIGS. 1-8.

VGAM1225 gene, herein designated VGAM GENE, is a viral gene contained in the genome of Human Herpesvirus 1. VGAM1225 host target gene, herein designated VGAM HOST TARGET GENE, is a human gene contained in the human genome.

VGAM1225 gene encodes a VGAM1225 precursor RNA, herein designated VGAM PRECURSOR RNA. Similar to other miRNA genes, and unlike most ordinary genes, VGAM1225 precursor RNA does not encode a protein. A nucleotide sequence identical or highly similar to the nucleotide sequence of VGAM1225 precursor RNA is designated SEQ ID:1211, and is provided hereinbelow with reference to the sequence listing part. Nucleotide sequence SEQ ID:1211 is located at position 88490 relative to the genome of Human Herpesvirus 1.

VGAM1225 precursor RNA folds onto itself, forming VGAM1225 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1225 folded precursor RNA into VGAM1225 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1225 RNA is designated SEQ ID:3936, and is provided hereinbelow with reference to the sequence listing part.

VGAM1225 host target gene, herein designated VGAM HOST TARGET GENE, encodes a corresponding messenger RNA, VGAM1225 host target RNA, herein designated VGAM HOST TARGET RNA. VGAM1225 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1225 RNA, herein designated VGAM RNA, binds complementarily to one or more host target binding sites located in untranslated regions of VGAM1225 host target RNA, herein designated VGAM HOST TARGET RNA. This complementary binding is due to the fact that the nucleotide sequence of VGAM1225 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1225 RNA, herein designated VGAM RNA, may have a different number of host target binding sites in untranslated regions of a VGAM1225 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1225 RNA, herein designated VGAM RNA, to host target binding sites on VGAM1225 host target RNA, herein designated VGAM HOST TARGET RNA, such as BINDING SITE I, BINDING SITE II and BINDING SITE III, inhibits translation of VGAM1225 host target RNA into VGAM1225 host target protein, herein designated VGAM HOST TARGET PROTEIN. VGAM host target protein is therefore outlined by a broken line.

It is appreciated that VGAM1225 host target gene, herein designated VGAM HOST TARGET GENE, in fact represents a plurality of VGAM1225 host target genes. The mRNA of each one of this plurality of VGAM1225 host target genes comprises one or more host target binding sites, each having a nucleotide sequence which is at least partly complementary to VGAM1225 RNA, herein designated VGAM RNA, and which when bound by VGAM1225 RNA causes inhibition of translation of respective one or more VGAM1225 host target proteins.

It is further appreciated by one skilled in the art that the mode of translational inhibition illustrated by FIG. 1 with specific reference to translational inhibition exerted by VGAM1225 gene, herein designated VGAM GENE, on one or more VGAM1225 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1225 is inhibition of expression of host target genes, as part of a novel viral mechanism of attacking a host. Accordingly, utilities of VGAM1225 include diagnosis, prevention and treatment of viral infection by Human Herpesvirus 1. Specific functions, and accordingly utilities, of VGAM1225 correlate with, and may be deduced from, the identity of the host target genes which VGAM1225 binds and inhibits, and the function of these host target genes, as elaborated hereinbelow.

Nucleotide sequences of the VGAM1225 precursor RNA, herein designated VGAM PRECURSOR RNA, and of the 'diced' VGAM1225 RNA, herein designated VGAM RNA, and a schematic representation of the secondary folding of VGAM1225 folded precursor RNA, herein designated VGAM FOLDED PRECURSOR RNA, of VGAM1225 are further described hereinbelow with reference to Table 1.

Nucleotide sequences of host target binding sites, such as BINDING SITE-I, BINDING SITE-II and BINDING SITE-III of FIG. 1, found on VGAM1225 host target RNA, and schematic representation of the complementarity of each of these host target binding sites to VGAM1225 RNA, herein designated VGAM RNA, are described hereinbelow with reference to Table 2.

As mentioned hereinabove with reference to FIG. 1, a function of VGAM1225 gene, herein designated VGAM is inhibition of expression of VGAM1225 target genes. It is appreciated that specific functions, and accordingly utilities, of VGAM1225 correlate with, and may be deduced from, the identity of the target genes which VGAM1225 binds and inhibits, and the function of these target genes, as elaborated hereinbelow.

Potassium Voltage-gated Channel, Shaker-related Subfamily, Member 6 (KCNA6, Accession NM_002235) is a VGAM1225 host target gene. KCNA6 BINDING SITE is HOST TARGET binding site found in the 5' untranslated region of mRNA encoded by KCNA6, corresponding to a HOST TARGET binding site such as BINDING SITE I, BINDING SITE II or BINDING SITE III. Table 2 illustrates the complementarity of the nucleotide sequences of KCNA6 BINDING SITE, designated SEQ ID:8016, to the nucleotide sequence of VGAM1225 RNA, herein designated VGAM RNA, also designated SEQ ID:3936.

A function of VGAM1225 is therefore inhibition of Potassium Voltage-gated Channel, Shaker-related Subfamily, Member 6 (KCNA6, Accession NM_002235), a gene which mediates the voltage-dependent potassium ion permeability of excitable membranes. Accordingly, utilities of VGAM1225 include diagnosis, prevention and treatment of diseases and clinical conditions associated with KCNA6. The function of KCNA6 and its association with various diseases and clinical conditions, has been established by previous studies, as described hereinabove with reference to VGAM893. Maltase-glucoamylase (alpha-glucosidase)

(MGAM, Accession XM_051351) is another VGAM1225 host target gene. MGAM BINDING SITE is HOST TARGET binding site found in the 3' untranslated region of mRNA encoded by MGAM, corresponding to a HOST TARGET binding site such as BINDING SITE I, BINDING SITE II or BINDING SITE III. Table 2 illustrates the complementarity of the nucleotide sequences of MGAM BINDING SITE, designated SEQ ID:35823, to the nucleotide sequence of VGAM1225 RNA, herein designated VGAM RNA, also designated SEQ ID:3936.

Another function of VGAM1225 is therefore inhibition of Maltase-glucoamylase (alpha-glucosidase) (MGAM, Accession XM_051351), a gene which plays a role in the final steps of digestion of starch. Accordingly, utilities of VGAM1225 include diagnosis, prevention and treatment of diseases and clinical conditions associated with MGAM. The function of MGAM and its association with various diseases and clinical conditions, has been established by previous studies, as described hereinabove with reference to VGAM791. C16orf5 (Accession NM_013399) is another VGAM1225 host target gene. C16orf5 BINDING SITE is HOST TARGET binding site found in the 3' untranslated region of mRNA encoded by C16orf5, corresponding to a HOST TARGET binding site such as BINDING SITE I, BINDING SITE II or BINDING SITE III. Table 2 illustrates the complementarity of the nucleotide sequences of C16orf5 BINDING SITE, designated SEQ ID:15056, to the nucleotide sequence of VGAM1225 RNA, herein designated VGAM RNA, also designated SEQ ID:3936.

Another function of VGAM1225 is therefore inhibition of C16orf5 (Accession NM_013399). Accordingly, utilities of VGAM1225 include diagnosis, prevention and treatment of diseases and clinical conditions associated with C16orf5. KIAA1303 (Accession XM_038376) is another VGAM1225 host target gene. KIAA1303 BINDING SITE is HOST TARGET binding site found in the 3' untranslated region of mRNA encoded by KIAA1303, corresponding to a HOST TARGET binding site such as BINDING SITE I, BINDING SITE II or BINDING SITE III. Table 2 illustrates the complementarity of the nucleotide sequences of KIAA1303 BINDING SITE, designated SEQ ID:32833, to the nucleotide sequence of VGAM1225 RNA, herein designated VGAM RNA, also designated SEQ ID:3936.

Another function of VGAM1225 is therefore inhibition of KIAA1303 (Accession XM_038376). Accordingly, utilities of VGAM1225 include diagnosis, prevention and treatment of diseases and clinical conditions associated with KIAA1303. NFASC (Accession XM_046808) is another VGAM1225 host target gene. NFASC BINDING SITE is HOST TARGET binding site found in the 3' untranslated region of mRNA encoded by NFASC, corresponding to a HOST TARGET binding site such as BINDING SITE I, BINDING SITE II or BINDING SITE III. Table 2 illustrates the complementarity of the nucleotide sequences of NFASC BINDING SITE, designated SEQ ID:34829, to the nucleotide sequence of VGAM1225 RNA, herein designated VGAM RNA, also designated SEQ ID:3936.

Another function of VGAM1225 is therefore inhibition of NFASC (Accession XM_046808). Accordingly, utilities of VGAM1225 include diagnosis, prevention and treatment of diseases and clinical conditions associated with NFASC. NIR3 (Accession XM_038799) is another VGAM1225 host target gene. NIR3 BINDING SITE is HOST TARGET binding site found in the 3' untranslated region of mRNA encoded by NIR3, corresponding to a HOST TARGET binding site such as BINDING SITE I, BINDING SITE II or BINDING SITE III. Table 2 illustrates the complementarity of the nucleotide sequences of NIR3 BINDING SITE, designated SEQ ID:32925, to the nucleotide sequence of VGAM1225 RNA, herein designated VGAM RNA, also designated SEQ ID:3936.

Another function of VGAM1225 is therefore inhibition of NIR3 (Accession XM_038799). Accordingly, utilities of VGAM1225 include diagnosis, prevention and treatment of diseases and clinical conditions associated with NIR3. NYD-SP25 (Accession NM_033516) is another VGAM1225 host target gene. NYD-SP25 BINDING SITE is HOST TARGET binding site found in the 3' untranslated region of mRNA encoded by NYD-SP25, corresponding to a HOST TARGET binding site such as BINDING SITE I, BINDING SITE II or BINDING SITE III. Table 2 illustrates the complementarity of the nucleotide sequences of NYD-SP25 BINDING SITE, designated SEQ ID:27294, to the nucleotide sequence of VGAM1225 RNA, herein designated VGAM RNA, also designated SEQ ID:3936.

Another function of VGAM1225 is therefore inhibition of NYD-SP25 (Accession NM_033516). Accordingly, utilities of VGAM1225 include diagnosis, prevention and treatment of diseases and clinical conditions associated with NYD-SP25. LOC132422 (Accession XM_067839) is another VGAM1225 host target gene. LOC132422 BINDING SITE is HOST TARGET binding site found in the 5' untranslated region of mRNA encoded by LOC132422, corresponding to a HOST TARGET binding site such as BINDING SITE I, BINDING SITE II or BINDING SITE III. Table 2 illustrates the complementarity of the nucleotide sequences of LOC132422 BINDING SITE, designated SEQ ID:37369, to the nucleotide sequence of VGAM1225 RNA, herein designated VGAM RNA, also designated SEQ ID:3936.

Another function of VGAM1225 is therefore inhibition of LOC132422 (Accession XM_067839). Accordingly, utilities of VGAM1225 include diagnosis, prevention and treatment of diseases and clinical conditions associated with LOC132422. LOC143915 (Accession XM_096502) is another VGAM1225 host target gene. LOC143915 BINDING SITE is HOST TARGET binding site found in the 3' untranslated region of mRNA encoded by LOC143915, corresponding to a HOST TARGET binding site such as BINDING SITE I, BINDING SITE II or BINDING SITE III. Table 2 illustrates the complementarity of the nucleotide sequences of LOC143915 BINDING SITE, designated SEQ ID:40376, to the nucleotide sequence of VGAM1225 RNA, herein designated VGAM RNA, also designated SEQ ID:3936.

Another function of VGAM1225 is therefore inhibition of LOC143915 (Accession XM_096502). Accordingly, utilities of VGAM1225 include diagnosis, prevention and treatment of diseases and clinical conditions associated with LOC143915. LOC151178 (Accession XM_087117) is another VGAM1225 host target gene. LOC151178 BINDING SITE is HOST TARGET binding site found in the 5' untranslated region of mRNA encoded by LOC151178, corresponding to a HOST TARGET binding site such as BINDING SITE I, BINDING SITE II or BINDING SITE III. Table 2 illustrates the complementarity of the nucleotide sequences of LOC151178 BINDING SITE, designated SEQ ID:39070, to the nucleotide sequence of VGAM1225 RNA, herein designated VGAM RNA, also designated SEQ ID:3936.

Another function of VGAM1225 is therefore inhibition of LOC151178 (Accession XM_087117). Accordingly, utilities of VGAM1225 include diagnosis, prevention and treatment of diseases and clinical conditions associated with LOC151178. LOC166042 (Accession XM_093623) is another VGAM1225 host target gene. LOC166042 BINDING SITE is HOST TARGET binding site found in the 5' untranslated region of mRNA encoded by LOC166042, corresponding to a HOST TARGET binding site such as BINDING SITE I, BINDING SITE II or BINDING SITE III. Table 2 illustrates the complementarity of the nucleotide sequences of LOC166042 BINDING SITE, designated SEQ ID:40197, to the nucleotide sequence of VGAM1225 RNA, herein designated VGAM RNA, also designated SEQ ID:3936.

Another function of VGAM1225 is therefore inhibition of LOC166042 (Accession XM_093623). Accordingly, utilities of VGAM1225 include diagnosis, prevention and treatment of diseases and clinical conditions associated with LOC166042. LOC196759 (Accession XM_113601) is another VGAM1225 host target gene. LOC196759 BINDING SITE is HOST TARGET binding site found in the 3' untranslated region of mRNA encoded by LOC196759, corresponding to a HOST TARGET binding site such as BINDING SITE I, BINDING SITE II or BINDING SITE III. Table 2 illustrates the complementarity of the nucleotide sequences of LOC196759 BINDING SITE, designated SEQ ID:42293, to the nucleotide sequence of VGAM1225 RNA, herein designated VGAM RNA, also designated SEQ ID:3936.

Another function of VGAM1225 is therefore inhibition of LOC196759 (Accession XM_113601). Accordingly, utilities of VGAM1225 include diagnosis, prevention and treatment of diseases and clinical conditions associated with LOC196759. LOC197201 (Accession XM_113839) is another VGAM1225 host target gene. LOC197201 BINDING SITE is HOST TARGET binding site found in the 3' untranslated region of mRNA encoded by LOC197201, corresponding to a HOST TARGET binding site such as BINDING SITE I, BINDING SITE II or BINDING SITE III. Table 2 illustrates the complementarity of the nucleotide sequences of LOC197201 BINDING SITE, designated SEQ ID:42460, to the nucleotide sequence of VGAM1225 RNA, herein designated VGAM RNA, also designated SEQ ID:3936.

Another function of VGAM1225 is therefore inhibition of LOC197201 (Accession XM_113839). Accordingly, utilities of VGAM1225 include diagnosis, prevention and treatment of diseases and clinical conditions associated with LOC197201. LOC254755 (Accession XM_173224) is another VGAM1225 host target gene. LOC254755 BINDING SITE is HOST TARGET binding site found in the 3' untranslated region of mRNA encoded by LOC254755, corresponding to a HOST TARGET binding site such as BINDING SITE I, BINDING SITE II or BINDING SITE III. Table 2 illustrates the complementarity of the nucleotide sequences of LOC254755 BINDING SITE, designated SEQ ID:46486, to the nucleotide sequence of VGAM1225 RNA, herein designated VGAM RNA, also designated SEQ ID:3936.

Another function of VGAM1225 is therefore inhibition of LOC254755 (Accession XM_173224). Accordingly, utilities of VGAM1225 include diagnosis, prevention and treatment of diseases and clinical conditions associated with LOC254755. FIG. 1 further provides a conceptual description of a novel bioinformatically detected viral gene of the present invention, referred to here as Viral Genomic Address Messenger 1226 (VGAM1226) viral gene, which modulates expression of respective host target genes thereof, the function and utility of which host target genes is known in the art.

VGAM1226 is a novel bioinformatically detected regulatory, non protein coding, viral micro RNA (miRNA) gene. The method by which VGAM1226 was detected is described hereinabove with reference to FIGS. 1-8.

VGAM1226 gene, herein designated VGAM GENE, is a viral gene contained in the genome of Tacaribe Virus. VGAM1226 host target gene, herein designated VGAM HOST TARGET GENE, is a human gene contained in the human genome.

VGAM1226 gene encodes a VGAM1226 precursor RNA, herein designated VGAM PRECURSOR RNA. Similar to other miRNA genes, and unlike most ordinary genes, VGAM1226 precursor RNA does not encode a protein. A nucleotide sequence identical or highly similar to the nucleotide sequence of VGAM1226 precursor RNA is designated SEQ ID:1212, and is provided hereinbelow with reference to the sequence listing part. Nucleotide sequence SEQ ID:1212 is located at position 6654 relative to the genome of Tacaribe Virus.

VGAM1226 precursor RNA folds onto itself, forming VGAM1226 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1226 folded precursor RNA into VGAM1226 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM1226 RNA is designated SEQ ID:3937, and is provided hereinbelow with reference to the sequence listing part.

VGAM1226 host target gene, herein designated VGAM HOST TARGET GENE, encodes a corresponding messenger RNA, VGAM1226 host target RNA, herein designated VGAM HOST TARGET RNA. VGAM1226 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1226 RNA, herein designated VGAM RNA, binds complementarily to one or more host target binding sites located in untranslated regions of VGAM1226 host target RNA, herein designated VGAM HOST TARGET RNA. This complementary binding is due to the fact that the nucleotide sequence of VGAM1226 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1226 RNA, herein designated VGAM RNA, may have a different number of host target binding sites in untranslated regions of a VGAM1226 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1226 RNA, herein designated VGAM RNA, to host target binding sites on VGAM1226 host target RNA, herein designated VGAM HOST TARGET RNA, such as BINDING SITE I, BINDING SITE II and BINDING SITE III, inhibits translation of VGAM1226 host target RNA into VGAM1226 host target protein, herein designated VGAM HOST TARGET PROTEIN. VGAM host target protein is therefore outlined by a broken line.

It is appreciated that VGAM1226 host target gene, herein designated VGAM HOST TARGET GENE, in fact represents a plurality of VGAM1226 host target genes. The mRNA of each one of this plurality of VGAM1226 host target genes comprises one or more host target binding sites, each having a nucleotide sequence which is at least partly complementary to VGAM1226 RNA, herein designated VGAM RNA, and which when bound by VGAM1226 RNA causes inhibition of translation of respective one or more VGAM1226 host target proteins.

It is further appreciated by one skilled in the art that the mode of translational inhibition illustrated by FIG. 1 with specific reference to translational inhibition exerted by VGAM1226 gene, herein designated VGAM GENE, on one or more VGAM1226 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1226 is inhibition of expression of host target genes, as part of a novel viral mechanism of attacking a host. Accordingly, utilities of VGAM1226 include diagnosis, prevention and treatment of viral infection by Tacaribe Virus. Specific functions, and accordingly utilities, of VGAM1226 correlate with, and may be deduced from, the identity of the host target genes which VGAM1226 binds and inhibits, and the function of these host target genes, as elaborated hereinbelow.

Nucleotide sequences of the VGAM1226 precursor RNA, herein designated VGAM PRECURSOR RNA, and of the 'diced' VGAM1226 RNA, herein designated VGAM RNA, and a schematic representation of the secondary folding of VGAM1226 folded precursor RNA, herein designated VGAM FOLDED PRECURSOR RNA, of VGAM1226 are further described hereinbelow with reference to Table 1.

Nucleotide sequences of host target binding sites, such as BINDING SITE-I, BINDING SITE-II and BINDING SITE-III of FIG. 1, found on VGAM1226 host target RNA, and schematic representation of the complementarity of each of these host target binding sites to VGAM1226 RNA, herein designated VGAM RNA, are described hereinbelow with reference to Table 2.

As mentioned hereinabove with reference to FIG. 1, a function of VGAM1226 gene, herein designated VGAM is inhibition of expression of VGAM1226 target genes. It is appreciated that specific functions, and accordingly utilities, of VGAM1226 correlate with, and may be deduced from, the identity of the target genes which VGAM1226 binds and inhibits, and the function of these target genes, as elaborated hereinbelow.

Archain 1 (ARCN1, Accession NM_001655) is a VGAM1226 host target gene. ARCN1 BINDING SITE is HOST TARGET binding site found in the 3' untranslated region of mRNA encoded by ARCN1, corresponding to a HOST TARGET binding site such as BINDING SITE I, BINDING SITE II or BINDING SITE III. Table 2 illustrates the complementarity of the nucleotide sequences of ARCN1 BINDING SITE, designated SEQ ID:7364, to the nucleotide sequence of VGAM1226 RNA, herein designated VGAM RNA, also designated SEQ ID:3937.

A function of VGAM1226 is therefore inhibition of Archain 1 (ARCN1, Accession NM_001655), a gene which plays a fundamental role in eukaryotic cell biology. Accordingly, utilities of VGAM1226 include diagnosis, prevention and treatment of diseases and clinical conditions associated with ARCN1. The function of ARCN1 has been established by previous studies. Radice et al. (1995) identified a gene that maps approximately 50-kb telomeric to MLL (OMIM Ref. No. 159555) in band 11q23.3, a locus disrupted in certain leukemia-associated translocation chromosomes. A 200-kb genomic fragment from a YAC that includes MLL was used to screen a cDNA library of the R54;11 cell line which carries a translocation chromosome t (4;11)(q21; q23). The cDNA sequence predicts a 511-amino acid protein which shares similarity with predicted proteins of unknown function from rice (Oryza sativa) and Drosophila. Because of this ancient conservation the authors proposed the name archain (ARCN1). Radice et al. (1995) detected 4-kb ARCN1 transcripts by Northern blot analysis in all tissues examined. The protein encoded by the ARCN1 gene, the coatomer protein delta-COP, probably plays a fundamental role in eukaryotic cell biology. Tunnacliffe at al. (1996) demonstrated that it is conserved across diverse eukaryotes. Very close or identical matches were seen in rat and cow; highly significant matches were seen with 2 plant species, A. thaliana (cress) and S. tuberosum (OMIM Ref. No. potato). Of particular biologic significance was the match with a sequence on yeast chromosome VI, from which Tunnacliffe et al. (1996) were able to determine the yeast archain gene and protein sequence. Unpublished data indicated that in situ hybridizations on mouse embryo sections showed archain transcripts throughout the whole animal.

Full details of the abovementioned studies are described in the following publications, the disclosure of which are hereby incorporated by reference:

Radice, P.; Pensotti, V.; Jones, C.; Perry, H.; Pierotti, M. A.; Tunnacliffe, A.: The human archain gene, ARCN1, has highly conserved homologs in rice and Drosophila. Genomics 26:101-106, 1995; and Tunnacliffe, A.; van de Vrugt, H.; Pensotti, V.; Radice, P.: The coatomer protein delta-COP, encoded by the archain gene, is conserved across diverse eukaryotes. Mammalian Genome 7:78.

Further studies establishing the function and utilities of ARCN1 are found in John Hopkins OMIM database record ID 600820, and in sited publications numbered 7529-7530 listed in the bibliography section hereinbelow, which are also hereby incorporated by reference. Cyclin D2 (CCND2, Accession NM_001759) is another VGAM1226 host target gene. CCND2 BINDING SITE is HOST TARGET binding site found in the 3' untranslated region of mRNA encoded by CCND2, corresponding to a HOST TARGET binding site such as BINDING SITE I, BINDING SITE II or BINDING SITE III. Table 2 illustrates the complementarity of the nucleotide sequences of CCND2 BINDING SITE, designated SEQ ID:7510, to the nucleotide sequence of VGAM1226 RNA, herein designated VGAM RNA, also designated SEQ ID:3937.

Another function of VGAM1226 is therefore inhibition of Cyclin D2 (CCND2, Accession NM_001759), a gene which is essential for the control of the cell cycle at the g1/s (start) transition. Accordingly, utilities of VGAM1226 include diagnosis, prevention and treatment of diseases and clinical conditions associated with CCND2. The function of CCND2 and its association with various diseases and clinical conditions, has been established by previous studies, as described hereinabove with reference to VGAM128. Leukemia Inhibitory Factor Receptor (LIFR, Accession NM_002310) is another VGAM1226 host target gene. LIFR BINDING SITE is HOST TARGET binding site found in the 3' untranslated region of mRNA encoded by LIFR, corresponding to a HOST TARGET binding site such as BINDING SITE I, BINDING SITE II or BINDING SITE III. Table 2 illustrates the complementarity of the nucleotide sequences of LIFR BINDING SITE, designated SEQ ID:8098, to the nucleotide sequence of VGAM1226 RNA, herein designated VGAM RNA, also designated SEQ ID:3937.

Another function of VGAM1226 is therefore inhibition of Leukemia Inhibitory Factor Receptor (LIFR, Accession NM_002310). Accordingly, utilities of VGAM1226 include diagnosis, prevention and treatment of diseases and clinical conditions associated with LIFR. C-myc Binding Protein (MYCBP, Accession NM_012333) is another VGAM1226 host target gene. MYCBP BINDING SITE is HOST TARGET binding site found in the 3' untranslated region of mRNA encoded by MYCBP, corresponding to a HOST TARGET binding site such as BINDING SITE I, BINDING SITE II or BINDING SITE III. Table 2 illustrates the complementarity of the nucleotide sequences of MYCBP BINDING SITE, designated SEQ ID:14724, to the nucleotide sequence of VGAM1226 RNA, herein designated VGAM RNA, also designated SEQ ID:3937.

Another function of VGAM1226 is therefore inhibition of C-myc Binding Protein (MYCBP, Accession NM_012333), a gene which binds c-Myc stimulating the activation of E-box-dependent transcription. Accordingly, utilities of VGAM1226 include diagnosis, prevention and treatment of diseases and clinical conditions associated with MYCBP. The function of MYCBP and its association with various diseases and clinical conditions, has been established by previous studies, as described hereinabove with reference to VGAM435. Tryptophanyl-tRNA Synthetase (WARS, Accession XM_041014) is another VGAM1226 host target gene. WARS BINDING SITE is HOST TARGET binding site found in the 5' untranslated region of mRNA encoded by WARS, corresponding to a HOST TARGET binding site such as BINDING SITE I, BINDING SITE II or BINDING SITE III. Table 2 illustrates the complementarity of the nucleotide sequences of WARS BINDING SITE, designated SEQ ID:33412, to the nucleotide sequence of VGAM1226 RNA, herein designated VGAM RNA, also designated SEQ ID:3937.

Another function of VGAM1226 is therefore inhibition of Tryptophanyl-tRNA Synthetase (WARS, Accession XM_041014), a gene which is a tryptophanyl-tRNA synthetase. Accordingly, utilities of VGAM1226 include diagnosis, prevention and treatment of diseases and clinical conditions associated with WARS. The function of WARS and its association with various diseases and clinical conditions, has been established by previous studies, as described hereinabove with reference to VGAM68. KLK15 (Accession NM_023006) is another VGAM1226 host target gene. KLK15 BINDING SITE1 and KLK15 BINDING SITE2 are HOST TARGET binding sites found in untranslated regions of mRNA encoded by KLK15, corresponding to HOST TARGET binding sites such as BINDING SITE I, BINDING SITE II or BINDING SITE III. Table 2 illustrates the complementarity of the nucleotide sequences of KLK15 BINDING SITE1 and KLK15 BINDING SITE2, designated SEQ ID:23262 and SEQ ID:28860 respectively, to the nucleotide sequence of VGAM1226 RNA, herein designated VGAM RNA, also designated SEQ ID:3937.

Another function of VGAM1226 is therefore inhibition of KLK15 (Accession NM_023006). Accordingly, utilities of VGAM1226 include diagnosis, prevention and treatment of diseases and clinical conditions associated with KLK15. LOC132241 (Accession XM_059583) is another VGAM1226 host target gene. LOC132241 BINDING SITE is HOST TARGET binding site found in the 5' untranslated region of mRNA encoded by LOC132241, corresponding to a HOST TARGET binding site such as BINDING SITE I, BINDING SITE II or BINDING SITE III. Table 2 illustrates the complementarity of the nucleotide sequences of LOC132241 BINDING SITE, designated SEQ ID:37022, to the nucleotide sequence of VGAM1226 RNA, herein designated VGAM RNA, also designated SEQ ID:3937.

Another function of VGAM1226 is therefore inhibition of LOC132241 (Accession XM_059583). Accordingly, utilities of VGAM1226 include diagnosis, prevention and treatment of diseases and clinical conditions associated with LOC132241. LOC158434 (Accession XM_098939) is another VGAM1226 host target gene. LOC158434 BINDING SITE is HOST TARGET binding site found in the 3' untranslated region of mRNA encoded by LOC158434, corresponding to a HOST TARGET binding site such as BINDING SITE I, BINDING SITE II or BINDING SITE III. Table 2 illustrates the complementarity of the nucleotide sequences of LOC158434 BINDING SITE, designated SEQ ID:41984, to the nucleotide sequence of VGAM1226 RNA, herein designated VGAM RNA, also designated SEQ ID:3937.

Another function of VGAM1226 is therefore inhibition of LOC158434 (Accession XM_098939). Accordingly, utilities of VGAM1226 include diagnosis, prevention and treatment of diseases and clinical conditions associated with LOC158434. LOC158549 (Accession XM_098963) is another VGAM1226 host target gene. LOC158549 BINDING SITE is HOST TARGET binding site found in the 5' untranslated region of mRNA encoded by LOC158549, corresponding to a HOST TARGET binding site such as BINDING SITE I, BINDING SITE II or BINDING SITE III. Table 2 illustrates the complementarity of the nucleotide sequences of LOC158549 BINDING SITE, designated SEQ ID:42008, to the nucleotide sequence of VGAM1226 RNA, herein designated VGAM RNA, also designated SEQ ID:3937.

Another function of VGAM1226 is therefore inhibition of LOC158549 (Accession XM_098963). Accordingly, utilities of VGAM1226 include diagnosis, prevention and treatment of diseases and clinical conditions associated with LOC158549. FIG. 1 further provides a conceptual description of a novel bioinformatically detected viral gene of the present invention, referred to here as Viral Genomic Address Messenger 1227 (VGAM1227) viral gene, which modulates expression of respective host target genes thereof, the function and utility of which host target genes is known in the art.

VGAM1227 is a novel bioinformatically detected regulatory, non protein coding, viral micro RNA (miRNA) gene. The method by which VGAM1227 was detected is described hereinabove with reference to FIGS. 1-8.

VGAM1227 gene, herein designated VGAM GENE, is a viral gene contained in the genome of Tacaribe Virus. VGAM1227 host target gene, herein designated VGAM HOST TARGET GENE, is a human gene contained in the human genome.

VGAM1227 gene encodes a VGAM1227 precursor RNA, herein designated VGAM PRECURSOR RNA. Similar to other miRNA genes, and unlike most ordinary genes, VGAM1227 precursor RNA does not encode a protein. A nucleotide sequence identical or highly similar to the nucleotide sequence of VGAM1227 precursor RNA is designated SEQ ID:1213, and is provided hereinbelow with reference to the sequence listing part. Nucleotide sequence SEQ ID:1213 is located at position 1706 relative to the genome of Tacaribe Virus.

VGAM1227 precursor RNA folds onto itself, forming VGAM1227 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1227 folded precursor RNA into VGAM1227 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1227 RNA is designated SEQ ID:3938, and is provided hereinbelow with reference to the sequence listing part.

VGAM1227 host target gene, herein designated VGAM HOST TARGET GENE, encodes a corresponding messenger RNA, VGAM1227 host target RNA, herein designated VGAM HOST TARGET RNA. VGAM1227 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1227 RNA, herein designated VGAM RNA, binds complementarily to one or more host target binding sites located in untranslated regions of VGAM1227 host target RNA, herein designated VGAM HOST TARGET RNA. This complementary binding is due to the fact that the nucleotide sequence of VGAM1227 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1227 RNA, herein designated VGAM RNA, may have a different number of host target binding sites in untranslated regions of a VGAM1227 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1227 RNA, herein designated VGAM RNA, to host target binding sites on VGAM1227 host target RNA, herein designated VGAM HOST TARGET RNA, such as BINDING SITE I, BINDING SITE II and BINDING SITE III, inhibits translation of VGAM1227 host target RNA into VGAM1227 host target protein, herein designated VGAM HOST TARGET PROTEIN. VGAM host target protein is therefore outlined by a broken line.

It is appreciated that VGAM1227 host target gene, herein designated VGAM HOST TARGET GENE, in fact represents a plurality of VGAM1227 host target genes. The mRNA of each one of this plurality of VGAM1227 host target genes comprises one or more host target binding sites, each having a nucleotide sequence which is at least partly complementary to VGAM1227 RNA, herein designated VGAM RNA, and which when bound by VGAM1227 RNA causes inhibition of translation of respective one or more VGAM1227 host target proteins.

It is further appreciated by one skilled in the art that the mode of translational inhibition illustrated by FIG. 1 with specific reference to translational inhibition exerted by VGAM1227 gene, herein designated VGAM GENE, on one or more VGAM1227 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1227 is inhibition of expression of host target genes, as part of a novel viral mechanism of attacking a host. Accordingly, utilities of VGAM1227 include diagnosis, prevention and treatment of viral infection by Tacaribe Virus. Specific functions, and accordingly utilities, of VGAM1227 correlate with, and may be deduced from, the identity of the host target genes which VGAM1227 binds and inhibits, and the function of these host target genes, as elaborated hereinbelow.

Nucleotide sequences of the VGAM1227 precursor RNA, herein designated VGAM PRECURSOR RNA, and of the 'diced' VGAM1227 RNA, herein designated VGAM RNA, and a schematic representation of the secondary folding of VGAM1227 folded precursor RNA, herein designated VGAM FOLDED PRECURSOR RNA, of VGAM1227 are further described hereinbelow with reference to Table 1.

Nucleotide sequences of host target binding sites, such as BINDING SITE-I, BINDING SITE-II and BINDING SITE-III of FIG. 1, found on VGAM1227 host target RNA, and schematic representation of the complementarity of each of these host target binding sites to VGAM1227 RNA, herein designated VGAM RNA, are described hereinbelow with reference to Table 2.

As mentioned hereinabove with reference to FIG. 1, a function of VGAM1227 gene, herein designated VGAM is inhibition of expression of VGAM1227 target genes. It is appreciated that specific functions, and accordingly utilities, of VGAM1227 correlate with, and may be deduced from, the identity of the target genes which VGAM1227 binds and inhibits, and the function of these target genes, as elaborated hereinbelow.

Hexokinase 1 (HK1, Accession NM_033497) is a VGAM1227 host target gene. HK1 BINDING SITE1 through HK1 BINDING SITE3 are HOST TARGET binding sites found in untranslated regions of mRNA encoded by HK1, corresponding to HOST TARGET binding sites such as BINDING SITE I, BINDING SITE II or BINDING SITE III. Table 2 illustrates the complementarity of the nucleotide sequences of HK1 BINDING SITE1 through HK1 BINDING SITE3, designated SEQ ID:27268, SEQ ID:27274 and SEQ ID:27271 respectively, to the nucleotide sequence of VGAM1227 RNA, herein designated VGAM RNA, also designated SEQ ID:3938.

A function of VGAM1227 is therefore inhibition of Hexokinase 1 (HK1, Accession NM_033497). Accordingly, utilities of VGAM1227 include diagnosis, prevention and treatment of diseases and clinical conditions associated with HK1.

FIG. 1 further provides a conceptual description of a novel bioinformatically detected viral gene of the present invention, referred to here as Viral Genomic Address Messenger 1228 (VGAM1228) viral gene, which modulates expression of respective host target genes thereof, the function and utility of which host target genes is known in the art.

VGAM1228 is a novel bioinformatically detected regulatory, non protein coding, viral micro RNA (miRNA) gene. The method by which VGAM1228 was detected is described hereinabove with reference to FIGS. 1-8.

VGAM1228 gene, herein designated VGAM GENE, is a viral gene contained in the genome of Tacaribe Virus. VGAM1228 host target gene, herein designated VGAM HOST TARGET GENE, is a human gene contained in the human genome.

VGAM1228 gene encodes a VGAM1228 precursor RNA, herein designated VGAM PRECURSOR RNA. Similar to other miRNA genes, and unlike most ordinary genes, VGAM1228 precursor RNA does not encode a protein. A nucleotide sequence identical or highly similar to the nucleotide sequence of VGAM1228 precursor RNA is designated SEQ ID:1214, and is provided hereinbelow with reference to the sequence listing part. Nucleotide sequence SEQ ID:1214 is located at position 2505 relative to the genome of Tacaribe Virus.

VGAM1228 precursor RNA folds onto itself, forming VGAM1228 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1228 folded precursor RNA into VGAM1228 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1228 RNA is designated SEQ ID:3939, and is provided hereinbelow with reference to the sequence listing part.

VGAM1228 host target gene, herein designated VGAM HOST TARGET GENE, encodes a corresponding messenger RNA, VGAM1228 host target RNA, herein designated VGAM HOST TARGET RNA. VGAM1228 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1228 RNA, herein designated VGAM RNA, binds complementarily to one or more host target binding sites located in untranslated regions of VGAM1228 host target RNA, herein designated VGAM HOST TARGET RNA. This complementary binding is due to the fact that the nucleotide sequence of VGAM1228 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1228 RNA, herein designated VGAM RNA, may have a different number of host target binding sites in untranslated regions of a VGAM1228 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1228 RNA, herein designated VGAM RNA, to host target binding sites on VGAM1228 host target RNA, herein designated VGAM HOST TARGET RNA, such as BINDING SITE I, BINDING SITE II and BINDING SITE III, inhibits translation of VGAM1228 host target RNA into VGAM1228 host target protein, herein designated VGAM HOST TARGET PROTEIN. VGAM host target protein is therefore outlined by a broken line.

It is appreciated that VGAM1228 host target gene, herein designated VGAM HOST TARGET GENE, in fact represents a plurality of VGAM1228 host target genes. The mRNA of each one of this plurality of VGAM1228 host target genes comprises one or more host target binding sites, each having a nucleotide sequence which is at least partly complementary to VGAM1228 RNA, herein designated VGAM RNA, and which when bound by VGAM1228 RNA causes inhibition of translation of respective one or more VGAM1228 host target proteins.

It is further appreciated by one skilled in the art that the mode of translational inhibition illustrated by FIG. 1 with specific reference to translational inhibition exerted by VGAM1228 gene, herein designated VGAM GENE, on one or more VGAM1228 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1228 is inhibition of expression of host target genes, as part of a novel viral mechanism of attacking a host. Accordingly, utilities of VGAM1228 include diagnosis, prevention and treatment of viral infection by Tacaribe Virus. Specific functions, and accordingly utilities, of VGAM1228 correlate with, and may be deduced from, the identity of the host target genes which VGAM1228 binds and inhibits, and the function of these host target genes, as elaborated hereinbelow.

Nucleotide sequences of the VGAM1228 precursor RNA, herein designated VGAM PRECURSOR RNA, and of the 'diced' VGAM1228 RNA, herein designated VGAM RNA, and a schematic representation of the secondary folding of VGAM1228 folded precursor RNA, herein designated VGAM FOLDED PRECURSOR RNA, of VGAM1228 are further described hereinbelow with reference to Table 1.

Nucleotide sequences of host target binding sites, such as BINDING SITE-I, BINDING SITE-II and BINDING SITE-III of FIG. 1, found on VGAM1228 host target RNA, and schematic representation of the complementarity of each of these host target binding sites to VGAM1228 RNA, herein designated VGAM RNA, are described hereinbelow with reference to Table 2.

As mentioned hereinabove with reference to FIG. 1, a function of VGAM1228 gene, herein designated VGAM is inhibition of expression of VGAM1228 target genes. It is appreciated that specific functions, and accordingly utilities, of VGAM1228 correlate with, and may be deduced from, the identity of the target genes which VGAM1228 binds and inhibits, and the function of these target genes, as elaborated hereinbelow.

Cadherin, EGF LAG Seven-pass G-type Receptor 2 (flamingo homolog, Drosophila) (CELSR2, Accession NM_001408) is a VGAM1228 host target gene. CELSR2 BINDING SITE is HOST TARGET binding site found in the 3' untranslated region of mRNA encoded by CELSR2, corresponding to a HOST TARGET binding site such as BINDING SITE I, BINDING SITE II or BINDING SITE III. Table 2 illustrates the complementarity of the nucleotide sequences of CELSR2 BINDING SITE, designated SEQ ID:7106, to the nucleotide sequence of VGAM1228 RNA, herein designated VGAM RNA, also designated SEQ ID:3939.

A function of VGAM1228 is therefore inhibition of Cadherin, EGF LAG Seven-pass G-type Receptor 2 (flamingo homolog, Drosophila) (CELSR2, Accession NM_001408), a gene which is a calcium dependent cell adhesion protein. Accordingly, utilities of VGAM1228 include diagnosis, prevention and treatment of diseases and clinical conditions associated with CELSR2. The function of CELSR2 and its association with various diseases and clinical conditions, has been established by previous studies, as described hereinabove with reference to VGAM432. ERAP140 (Accession XM_059748) is another VGAM1228 host target gene. ERAP140 BINDING SITE is HOST TARGET binding site found in the 3' untranslated region of mRNA encoded by ERAP140, corresponding to a HOST TARGET binding site such as BINDING SITE I, BINDING SITE II or BINDING SITE III. Table 2 illustrates the complementarity of the nucleotide sequences of ERAP140 BINDING SITE, designated SEQ ID:37085, to the nucleotide sequence of VGAM1228 RNA, herein designated VGAM RNA, also designated SEQ ID:3939.

Another function of VGAM1228 is therefore inhibition of ERAP140 (Accession XM_059748). Accordingly, utilities of VGAM1228 include diagnosis, prevention and treatment of diseases and clinical conditions associated with ERAP140. FLJ13910 (Accession NM_022780) is another VGAM1228 host target gene. FLJ13910 BINDING SITE is HOST TARGET binding site found in the 3' untranslated region of mRNA encoded by FLJ13910, corresponding to a HOST TARGET binding site such as BINDING SITE I, BINDING SITE II or BINDING SITE III. Table 2 illustrates the complementarity of the nucleotide sequences of FLJ13910 BINDING SITE, designated SEQ ID:23055, to the nucleotide sequence of VGAM1228 RNA, herein designated VGAM RNA, also designated SEQ ID:3939.

Another function of VGAM1228 is therefore inhibition of FLJ13910 (Accession NM_022780). Accordingly, utilities of VGAM1228 include diagnosis, prevention and treatment of diseases and clinical conditions associated with FLJ13910. HCA127 (Accession NM_018684) is another VGAM1228 host target gene. HCA127 BINDING SITE is HOST TARGET binding site found in the 3' untranslated region of mRNA encoded by HCA127, corresponding to a HOST TARGET binding site such as BINDING SITE I, BINDING SITE II or BINDING SITE III. Table 2 illustrates the complementarity of the nucleotide sequences of HCA127 BINDING SITE, designated SEQ ID:20759, to the nucleotide sequence of VGAM1228 RNA, herein designated VGAM RNA, also designated SEQ ID:3939.

Another function of VGAM1228 is therefore inhibition of HCA127 (Accession NM_018684). Accordingly, utilities of VGAM1228 include diagnosis, prevention and treatment of diseases and clinical conditions associated with HCA127. KIAA1009 (Accession NM_014895) is another VGAM1228 host target gene. KIAA1009 BINDING SITE is HOST TARGET binding site found in the 3' untranslated region of mRNA encoded by KIAA1009, corresponding to a HOST TARGET binding site such as BINDING SITE I, BINDING SITE II or BINDING SITE III. Table 2 illustrates the complementarity of the nucleotide sequences of KIAA1009 BINDING SITE, designated SEQ ID:17052, to the nucleotide sequence of VGAM1228 RNA, herein designated VGAM RNA, also designated SEQ ID:3939.

Another function of VGAM1228 is therefore inhibition of KIAA1009 (Accession NM_014895). Accordingly, utilities of VGAM1228 include diagnosis, prevention and treatment of diseases and clinical conditions associated with KIAA1009. Kv6.3 (Accession NM_133490) is another VGAM1228 host target gene. Kv6.3 BINDING SITE is HOST TARGET binding site found in the 3' untranslated region of mRNA encoded by Kv6.3, corresponding to a HOST TARGET binding site such as BINDING SITE I, BINDING SITE II or BINDING SITE III. Table 2 illustrates the complementarity of the nucleotide sequences of Kv6.3 BINDING SITE, designated SEQ ID:28566, to the nucleotide sequence of VGAM1228 RNA, herein designated VGAM RNA, also designated SEQ ID:3939.

Another function of VGAM1228 is therefore inhibition of Kv6.3 (Accession NM_133490). Accordingly, utilities of VGAM1228 include diagnosis, prevention and treatment of diseases and clinical conditions associated with Kv6.3. PRO0365 (Accession NM_014126) is another VGAM1228 host target gene. PRO0365 BINDING SITE is HOST TARGET binding site found in the 5' untranslated region of mRNA encoded by PRO0365, corresponding to a HOST TARGET binding site such as BINDING SITE I, BINDING SITE II or BINDING SITE III. Table 2 illustrates the complementarity of the nucleotide sequences of PRO0365 BINDING SITE, designated SEQ ID:15389, to the nucleotide sequence of VGAM1228 RNA, herein designated VGAM RNA, also designated SEQ ID:3939.

Another function of VGAM1228 is therefore inhibition of PRO0365 (Accession NM_014126). Accordingly, utilities of VGAM1228 include diagnosis, prevention and treatment of diseases and clinical conditions associated with PRO0365. LOC152742 (Accession XM_098259) is another VGAM1228 host target gene. LOC152742 BINDING SITE is HOST TARGET binding site found in the 3' untranslated region of mRNA encoded by LOC152742, corresponding to a HOST TARGET binding site such as BINDING SITE I, BINDING SITE II or BINDING SITE III. Table 2 illustrates the complementarity of the nucleotide sequences of LOC152742 BINDING SITE, designated SEQ ID:41544, to the nucleotide sequence of VGAM1228 RNA, herein designated VGAM RNA, also designated SEQ ID:3939.

Another function of VGAM1228 is therefore inhibition of LOC152742 (Accession XM_098259). Accordingly, utilities of VGAM1228 include diagnosis, prevention and treatment of diseases and clinical conditions associated with LOC152742. FIG. 1 further provides a conceptual description of a novel bioinformatically detected viral gene of the present invention, referred to here as Viral Genomic Address Messenger 1229 (VGAM1229) viral gene, which modulates expression of respective host target genes thereof, the function and utility of which host target genes is known in the art.

VGAM1229 is a novel bioinformatically detected regulatory, non protein coding, viral micro RNA (miRNA) gene. The method by which VGAM1229 was detected is described hereinabove with reference to FIGS. 1-8.

VGAM1229 gene, herein designated VGAM GENE, is a viral gene contained in the genome of Tacaribe Virus. VGAM1229 host target gene, herein designated VGAM HOST TARGET GENE, is a human gene contained in the human genome.

VGAM1229 gene encodes a VGAM1229 precursor RNA, herein designated VGAM PRECURSOR RNA. Similar to other miRNA genes, and unlike most ordinary genes, VGAM1229 precursor RNA does not encode a protein. A nucleotide sequence identical or highly similar to the nucleotide sequence of VGAM1229 precursor RNA is designated SEQ ID:1215, and is provided hereinbelow with reference to the sequence listing part. Nucleotide sequence SEQ ID:1215 is located at position 2314 relative to the genome of Tacaribe Virus.

VGAM1229 precursor RNA folds onto itself, forming VGAM1229 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1229 folded precursor RNA into VGAM1229 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM1229 RNA is designated SEQ ID:3940, and is provided hereinbelow with reference to the sequence listing part.

VGAM1229 host target gene, herein designated VGAM HOST TARGET GENE, encodes a corresponding messenger RNA, VGAM1229 host target RNA, herein designated VGAM HOST TARGET RNA. VGAM1229 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1229 RNA, herein designated VGAM RNA, binds complementarily to one or more host target binding sites located in untranslated regions of VGAM1229 host target RNA, herein designated VGAM HOST TARGET RNA. This complementary binding is due to the fact that the nucleotide sequence of VGAM1229 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1229 RNA, herein designated VGAM RNA, may have a different number of host target binding sites in untranslated regions of a VGAM1229 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1229 RNA, herein designated VGAM RNA, to host target binding sites on VGAM1229 host target RNA, herein designated VGAM HOST TARGET RNA, such as BINDING SITE I, BINDING SITE II and BINDING SITE III, inhibits translation of VGAM1229 host target RNA into VGAM1229 host target protein, herein designated VGAM HOST TARGET PROTEIN. VGAM host target protein is therefore outlined by a broken line.

It is appreciated that VGAM1229 host target gene, herein designated VGAM HOST TARGET GENE, in fact represents a plurality of VGAM1229 host target genes. The mRNA of each one of this plurality of VGAM1229 host target genes comprises one or more host target binding sites, each having a nucleotide sequence which is at least partly complementary to VGAM1229 RNA, herein designated VGAM RNA, and which when bound by VGAM1229 RNA causes inhibition of translation of respective one or more VGAM1229 host target proteins.

It is further appreciated by one skilled in the art that the mode of translational inhibition illustrated by FIG. 1 with specific reference to translational inhibition exerted by VGAM1229 gene, herein designated VGAM GENE, on one or more VGAM1229 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1229 is inhibition of expression of host target genes, as part of a novel viral mechanism of attacking a host. Accordingly, utilities of VGAM1229 include diagnosis, prevention and treatment of viral infection by Tacaribe Virus. Specific functions, and accordingly utilities, of VGAM1229 correlate with, and may be deduced from, the identity of the host target genes which VGAM1229 binds and inhibits, and the function of these host target genes, as elaborated hereinbelow.

Nucleotide sequences of the VGAM1229 precursor RNA, herein designated VGAM PRECURSOR RNA, and of the 'diced' VGAM1229 RNA, herein designated VGAM RNA, and a schematic representation of the secondary folding of VGAM1229 folded precursor RNA, herein designated VGAM FOLDED PRECURSOR RNA, of VGAM1229 are further described hereinbelow with reference to Table 1.

Nucleotide sequences of host target binding sites, such as BINDING SITE-I, BINDING SITE-II and BINDING SITE-III of FIG. 1, found on VGAM1229 host target RNA, and schematic representation of the complementarity of each of these host target binding sites to VGAM1229 RNA, herein designated VGAM RNA, are described hereinbelow with reference to Table 2.

As mentioned hereinabove with reference to FIG. 1, a function of VGAM1229 gene, herein designated VGAM is inhibition of expression of VGAM1229 target genes. It is appreciated that specific functions, and accordingly utilities, of VGAM1229 correlate with, and may be deduced from, the identity of the target genes which VGAM1229 binds and inhibits, and the function of these target genes, as elaborated hereinbelow.

Cysteine-rich, Angiogenic Inducer, 61 (CYR61, Accession NM_001554) is a VGAM1229 host target gene. CYR61 BINDING SITE is HOST TARGET binding site found in the 3' untranslated region of mRNA encoded by CYR61, corresponding to a HOST TARGET binding site such as BINDING SITE I, BINDING SITE II or BINDING SITE III. Table 2 illustrates the complementarity of the nucleotide sequences of CYR61 BINDING SITE, designated SEQ ID:7276, to the nucleotide sequence of VGAM1229 RNA, herein designated VGAM RNA, also designated SEQ ID:3940.

A function of VGAM1229 is therefore inhibition of Cysteine-rich, Angiogenic Inducer, 61 (CYR61, Accession NM_001554), a gene which promotes the adhesion of endothelial cells. Accordingly, utilities of VGAM1229 include diagnosis, prevention and treatment of diseases and clinical conditions associated with CYR61. The function of CYR61 has been established by previous studies. CYR61 is a secreted, cysteine-rich, heparin-binding protein encoded by a growth factor-inducible immediate-early gene. Acting as an extracellular, matrix-associated signaling molecule, CYR61 promotes the adhesion of endothelial cells through interaction with integrin and augments growth factor-induced DNA synthesis in the same cell type. Babic et al. (1998) showed that purified CYR61 stimulates directed migration of human microvascular endothelial cells in culture through the alpha (V) beta (3)-dependent pathway and induces neovascularization in rat corneas. Both the chemotactic and angiogenic activities of CYR61 can be blocked by specific anti-CYR61 antibodies. Whereas most human tumor-derived cell lines tested expressed CRY61, a gastric adenocarcinoma cell line did not. Expression of the CYR61 cDNA under the regulation of a constitutive promoter from this gastric cancer cell line significantly enhanced the tumorigenicity of these cells as measured by growth in immunodeficient mice, resulting in tumors that were larger and more vascularized than those produced by control cells. Taken together, these results identified CYR61 as an angiogenic inducer that can promote tumor growth and vascularization; the results also suggested to Babic et al. (1998) potential roles for CYR61 in physiologic and pathologic neovascularization. Sampath et al. (2001) used rapid analysis of differential expression (RADE) to identify genes that are abnormally expressed in leiomyomas. Of the several genes identified, CYR61, a member of the CCN family of growth and angiogenic regulators, was shown to be markedly downregulated at the mRNA and protein levels in leiomyoma tumors compared with the 38 matched uterine myometrial controls. In addition, in situ hybridization experiments corroborated the lack of CYR61 expression in leiomyoma cells, whereas abundant transcript levels were identified in adjacent myometrial smooth muscle cells. To elucidate the mechanisms of CYR61 gene regulation in leiomyomas, they determined the effects of ovarian steroids, basic fibroblast growth factor (FGFB; 134920), and serum on CYR61 expression using an ex vivo culture system. Treatment of human myometrial explants with 17-beta-estradiol and FGFB upregulated CYR61 transcripts. Paradoxically, neither 17-beta-estradiol nor FGFB was capable of upregulating CYR61 mRNA in leiomyoma explants despite elevated levels of ESRA (OMIM Ref. No. 133430) mRNA. The authors concluded that dysregulation of CYR61 by estrogen and FGFB may contribute to down regulation of CYR61 in leiomyomas which, in turn, may predispose uterine smooth muscle cells toward sustained growth.

Full details of the abovementioned studies are described in the following publications, the disclosure of which are hereby incorporated by reference:

Babic, A. M.; Kireeva, M. L.; Kolesnikova, T. V.; Lau, L. F.: CYR61, a product of a growth factor-inducible immediate early gene, promotes angiogenesis and tumor growth. Proc. Nat. Acad. Sci. 95:6355-6360, 1998; and Sampath, D.; Zhu, Y.; Winneker, R. C.; Zhang, Z.: Aberrant expression of Cyr61, a member of the CCN (CTGF/Cyr61/Cef10/NOVH) family, and dysregulation by 17-beta-estradiol and basic fibr.

Further studies establishing the function and utilities of CYR61 are found in John Hopkins OMIM database record ID 602369, and in sited publications numbered 8934-893 and 11958-8938 listed in the bibliography section hereinbelow, which are also hereby incorporated by reference. Low Density Lipoprotein Receptor-related Protein 4 (LRP4, Accession XM_035037) is another VGAM1229 host target gene. LRP4 BINDING SITE is HOST TARGET binding site found in the 5' untranslated region of mRNA encoded by LRP4, corresponding to a HOST TARGET binding site such as BINDING SITE I, BINDING SITE II or BINDING SITE III. Table 2 illustrates the complementarity of the nucleotide sequences of LRP4 BINDING SITE, designated SEQ ID:32195, to the nucleotide sequence of VGAM1229 RNA, herein designated VGAM RNA, also designated SEQ ID:3940.

Another function of VGAM1229 is therefore inhibition of Low Density Lipoprotein Receptor-related Protein 4 (LRP4, Accession XM_035037). Accordingly, utilities of VGAM1229 include diagnosis, prevention and treatment of diseases and clinical conditions associated with LRP4. Nuclear Factor (erythroid-derived 2)-like 1 (NFE2L1, Accession NM_003204) is another VGAM1229 host target gene. NFE2L1 BINDING SITE is HOST TARGET binding site found in the 3' untranslated region of mRNA encoded by NFE2L1, corresponding to a HOST TARGET binding site such as BINDING SITE I, BINDING SITE II or BINDING SITE III. Table 2 illustrates the complementarity of the nucleotide sequences of NFE2L1 BINDING SITE, designated SEQ ID:9198, to the nucleotide sequence of VGAM1229 RNA, herein designated VGAM RNA, also designated SEQ ID:3940.

Another function of VGAM1229 is therefore inhibition of Nuclear Factor (erythroid-derived 2)-like 1 (NFE2L1, Accession NM_003204), a gene which may regulate expression of ferritin genes. Accordingly, utilities of VGAM1229 include diagnosis, prevention and treatment of diseases and clinical conditions associated with NFE2L1. The function of NFE2L1 and its association with various diseases and clinical conditions, has been established by previous studies, as described hereinabove with reference to VGAM369. Tropomodulin 2 (neuronal) (TMOD2, Accession NM_014548) is another VGAM1229 host target gene. TMOD2 BINDING SITE is HOST TARGET binding site found in the 3' untranslated region of mRNA encoded by TMOD2, corresponding to a HOST TARGET binding site such as BINDING SITE I, BINDING SITE II or BINDING SITE III. Table 2 illustrates the complementarity of the nucleotide sequences of TMOD2 BINDING SITE, designated SEQ ID:15859, to the nucleotide sequence of VGAM1229 RNA, herein designated VGAM RNA, also designated SEQ ID:3940.

Another function of VGAM1229 is therefore inhibition of Tropomodulin 2 (neuronal) (TMOD2, Accession NM_014548), a gene which is an actin-capping protein for the slow-growing end of filamentous actin. Accordingly, utilities of VGAM1229 include diagnosis, prevention and treatment of diseases and clinical conditions associated with TMOD2. The function of TMOD2 and its association with various diseases and clinical conditions, has been established by previous studies, as described hereinabove with reference to VGAM791. ARP1 Actin-related Protein 1 Homolog A, Centractin Alpha (yeast) (ACTR1A, Accession XM_031949) is another VGAM1229 host target gene. ACTR1A BINDING SITE is HOST TARGET binding site found in the 3' untranslated region of mRNA encoded by ACTR1A, corresponding to a HOST TARGET binding site such as BINDING SITE I, BINDING SITE II or BINDING SITE III. Table 2 illustrates the complementarity of the nucleotide sequences of ACTR1A BINDING SITE, designated SEQ ID:31533, to the nucleotide sequence of VGAM1229 RNA, herein designated VGAM RNA, also designated SEQ ID:3940.

Another function of VGAM1229 is therefore inhibition of ARP1 Actin-related Protein 1 Homolog A, Centractin Alpha (yeast) (ACTR1A, Accession XM_031949). Accordingly, utilities of VGAM1229 include diagnosis, prevention and treatment of diseases and clinical conditions associated with ACTR1A. Chromosome 20 Open Reading Frame 130 (C20orf130, Accession XM_029741) is another VGAM1229 host target gene. C20orf130 BINDING SITE is HOST TARGET binding site found in the 3' untranslated region of mRNA encoded by C20orf130, corresponding to a HOST TARGET binding site such as BINDING SITE I, BINDING SITE II or BINDING SITE III. Table 2 illustrates the complementarity of the nucleotide sequences of C20orf130 BINDING SITE, designated SEQ ID:30934, to the nucleotide sequence of VGAM1229 RNA, herein designated VGAM RNA, also designated SEQ ID:3940.

Another function of VGAM1229 is therefore inhibition of Chromosome 20 Open Reading Frame 130 (C20orf130, Accession XM_029741). Accordingly, utilities of VGAM1229 include diagnosis, prevention and treatment of diseases and clinical conditions associated with C20orf130. FLJ22087 (Accession NM_022070) is another VGAM1229 host target gene. FLJ22087 BINDING SITE is HOST TARGET binding site found in the 5' untranslated region of mRNA encoded by FLJ22087, corresponding to a HOST TARGET binding site such as BINDING SITE I, BINDING SITE II or BINDING SITE III. Table 2 illustrates the complementarity of the nucleotide sequences of FLJ22087 BINDING SITE, designated SEQ ID:22613, to the nucleotide sequence of VGAM1229 RNA, herein designated VGAM RNA, also designated SEQ ID:3940.

Another function of VGAM1229 is therefore inhibition of FLJ22087 (Accession NM_022070). Accordingly, utilities of VGAM1229 include diagnosis, prevention and treatment of diseases and clinical conditions associated with FLJ22087. KIAA0940 (Accession NM_014912) is another VGAM1229 host target gene. KIAA0940 BINDING SITE is HOST TARGET binding site found in the 3' untranslated region of mRNA encoded by KIAA0940, corresponding to a HOST TARGET binding site such as BINDING SITE I, BINDING SITE II or BINDING SITE III. Table 2 illustrates the complementarity of the nucleotide sequences of KIAA0940 BINDING SITE, designated SEQ ID:17148, to the nucleotide sequence of VGAM1229 RNA, herein designated VGAM RNA, also designated SEQ ID:3940.

Another function of VGAM1229 is therefore inhibition of KIAA0940 (Accession NM_014912). Accordingly, utilities of VGAM1229 include diagnosis, prevention and treatment of diseases and clinical conditions associated with KIAA0940. KIAA1463 (Accession XM_051160) is another VGAM1229 host target gene. KIAA1463 BINDING SITE is HOST TARGET binding site found in the 3' untranslated region of mRNA encoded by KIAA1463, corresponding to a HOST TARGET binding site such as BINDING SITE I, BINDING SITE II or BINDING SITE III. Table 2 illustrates the complementarity of the nucleotide sequences of KIAA1463 BINDING SITE, designated SEQ ID:35771, to the nucleotide sequence of VGAM1229 RNA, herein designated VGAM RNA, also designated SEQ ID:3940.

Another function of VGAM1229 is therefore inhibition of KIAA1463 (Accession XM_051160). Accordingly, utilities of VGAM1229 include diagnosis, prevention and treatment of diseases and clinical conditions associated with KIAA1463. MGC2541 (Accession NM_080670) is another VGAM1229 host target gene. MGC2541 BINDING SITE is HOST TARGET binding site found in the 3' untranslated region of mRNA encoded by MGC2541, corresponding to a HOST TARGET binding site such as BINDING SITE I, BINDING SITE II or BINDING SITE III. Table 2 illustrates the complementarity of the nucleotide sequences of MGC2541 BINDING SITE, designated SEQ ID:27963, to the nucleotide sequence of VGAM1229 RNA, herein designated VGAM RNA, also designated SEQ ID:3940.

Another function of VGAM1229 is therefore inhibition of MGC2541 (Accession NM_080670). Accordingly, utilities of VGAM1229 include diagnosis, prevention and treatment of diseases and clinical conditions associated with MGC2541. MIL1 (Accession NM_015367) is another VGAM1229 host target gene. MIL1 BINDING SITE is HOST TARGET binding site found in the 3' untranslated region of mRNA encoded by MIL1, corresponding to a HOST TARGET binding site such as BINDING SITE I, BINDING SITE II or BINDING SITE III. Table 2 illustrates the complementarity of the nucleotide sequences of MIL1 BINDING SITE, designated SEQ ID:17665, to the nucleotide sequence of VGAM1229 RNA, herein designated VGAM RNA, also designated SEQ ID:3940.

Another function of VGAM1229 is therefore inhibition of MIL1 (Accession NM_015367). Accordingly, utilities of VGAM1229 include diagnosis, prevention and treatment of diseases and clinical conditions associated with MIL1. Mucin 17 (MUC17, Accession XM_168583) is another VGAM1229 host target gene. MUC17 BINDING SITE is HOST TARGET binding site found in the 3' untranslated region of mRNA encoded by MUC17, corresponding to a HOST TARGET binding site such as BINDING SITE I, BINDING SITE II or BINDING SITE III. Table 2 illustrates the complementarity of the nucleotide sequences of MUC17 BINDING SITE, designated SEQ ID:45259, to the nucleotide sequence of VGAM1229 RNA, herein designated VGAM RNA, also designated SEQ ID:3940.

Another function of VGAM1229 is therefore inhibition of Mucin 17 (MUC17, Accession XM_168583). Accordingly, utilities of VGAM1229 include diagnosis, prevention and treatment of diseases and clinical conditions associated with MUC17. PRO1257 (Accession NM_018578) is another VGAM1229 host target gene. PRO1257 BINDING SITE is HOST TARGET binding site found in the 3' untranslated region of mRNA encoded by PRO1257, corresponding to a HOST TARGET binding site such as BINDING SITE I, BINDING SITE II or BINDING SITE III. Table 2 illustrates the complementarity of the nucleotide sequences of PRO1257 BINDING SITE, designated SEQ ID:20656, to the nucleotide sequence of VGAM1229 RNA, herein designated VGAM RNA, also designated SEQ ID:3940.

Another function of VGAM1229 is therefore inhibition of PRO1257 (Accession NM_018578). Accordingly, utilities of VGAM1229 include diagnosis, prevention and treatment of diseases and clinical conditions associated with PRO1257.

Ring Finger Protein 2 (RNF2, Accession NM_007212) is another VGAM1229 host target gene. RNF2 BINDING SITE is HOST TARGET binding site found in the 3' untranslated region of mRNA encoded by RNF2, corresponding to a HOST TARGET binding site such as BINDING SITE I, BINDING SITE II or BINDING SITE III. Table 2 illustrates the complementarity of the nucleotide sequences of RNF2 BINDING SITE, designated SEQ ID:14074, to the nucleotide sequence of VGAM1229 RNA, herein designated VGAM RNA, also designated SEQ ID:3940.

Another function of VGAM1229 is therefore inhibition of Ring Finger Protein 2 (RNF2, Accession NM_007212). Accordingly, utilities of VGAM1229 include diagnosis, prevention and treatment of diseases and clinical conditions associated with RNF2. LOC164397 (Accession XM_092780) is another VGAM1229 host target gene. LOC164397 BINDING SITE is HOST TARGET binding site found in the 5' untranslated region of mRNA encoded by LOC164397, corresponding to a HOST TARGET binding site such as BINDING SITE I, BINDING SITE II or BINDING SITE III. Table 2 illustrates the complementarity of the nucleotide sequences of LOC164397 BINDING SITE, designated SEQ ID:40147, to the nucleotide sequence of VGAM1229 RNA, herein designated VGAM RNA, also designated SEQ ID:3940.

Another function of VGAM1229 is therefore inhibition of LOC164397 (Accession XM_092780). Accordingly, utilities of VGAM1229 include diagnosis, prevention and treatment of diseases and clinical conditions associated with LOC164397. FIG. 1 further provides a conceptual description of a novel bioinformatically detected viral gene of the present invention, referred to here as Viral Genomic Address Messenger 1230 (VGAM1230) viral gene, which modulates expression of respective host target genes thereof, the function and utility of which host target genes is known in the art.

VGAM1230 is a novel bioinformatically detected regulatory, non protein coding, viral micro RNA (miRNA) gene. The method by which VGAM1230 was detected is described hereinabove with reference to FIGS. 1-8.

VGAM1230 gene, herein designated VGAM GENE, is a viral gene contained in the genome of Equine Herpesvirus 2. VGAM1230 host target gene, herein designated VGAM HOST TARGET GENE, is a human gene contained in the human genome.

VGAM1230 gene encodes a VGAM1230 precursor RNA, herein designated VGAM PRECURSOR RNA. Similar to other miRNA genes, and unlike most ordinary genes, VGAM1230 precursor RNA does not encode a protein. A nucleotide sequence identical or highly similar to the nucleotide sequence of VGAM1230 precursor RNA is designated SEQ ID:1216, and is provided hereinbelow with reference to the sequence listing part. Nucleotide sequence SEQ ID:1216 is located at position 12219 relative to the genome of Equine Herpesvirus 2.

VGAM1230 precursor RNA folds onto itself, forming VGAM1230 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1230 folded precursor RNA into VGAM1230 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1230 RNA is designated SEQ ID:3941, and is provided hereinbelow with reference to the sequence listing part.

VGAM1230 host target gene, herein designated VGAM HOST TARGET GENE, encodes a corresponding messenger RNA, VGAM1230 host target RNA, herein designated VGAM HOST TARGET RNA. VGAM1230 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1230 RNA, herein designated VGAM RNA, binds complementarily to one or more host target binding sites located in untranslated regions of VGAM1230 host target RNA, herein designated VGAM HOST TARGET RNA. This complementary binding is due to the fact that the nucleotide sequence of VGAM1230 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1230 RNA, herein designated VGAM RNA, may have a different number of host target binding sites in untranslated regions of a VGAM1230 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1230 RNA, herein designated VGAM RNA, to host target binding sites on VGAM1230 host target RNA, herein designated VGAM HOST TARGET RNA, such as BINDING SITE I, BINDING SITE II and BINDING SITE III, inhibits translation of VGAM1230 host target RNA into VGAM1230 host target protein, herein designated VGAM HOST TARGET PROTEIN. VGAM host target protein is therefore outlined by a broken line.

It is appreciated that VGAM1230 host target gene, herein designated VGAM HOST TARGET GENE, in fact represents a plurality of VGAM1230 host target genes. The mRNA of each one of this plurality of VGAM1230 host target genes comprises one or more host target binding sites, each having a nucleotide sequence which is at least partly complementary to VGAM1230 RNA, herein designated VGAM RNA, and which when bound by VGAM1230 RNA causes inhibition of translation of respective one or more VGAM1230 host target proteins.

It is further appreciated by one skilled in the art that the mode of translational inhibition illustrated by FIG. 1 with specific reference to translational inhibition exerted by VGAM1230 gene, herein designated VGAM GENE, on one or more VGAM1230 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1230 is inhibition of expression of host target genes, as part of a novel viral mechanism of attacking a host. Accordingly, utilities of VGAM1230 include diagnosis, prevention and treatment of viral infection by Equine Herpesvirus 2. Specific functions, and accordingly utilities, of VGAM1230 correlate with, and may be deduced from, the identity of the host target genes which VGAM1230 binds and inhibits, and the function of these host target genes, as elaborated hereinbelow.

Nucleotide sequences of the VGAM1230 precursor RNA, herein designated VGAM PRECURSOR RNA, and of the 'diced' VGAM1230 RNA, herein designated VGAM RNA, and a schematic representation of the secondary folding of VGAM1230 folded precursor RNA, herein designated VGAM FOLDED PRECURSOR RNA, of VGAM1230 are further described hereinbelow with reference to Table 1.

Nucleotide sequences of host target binding sites, such as BINDING SITE-I, BINDING SITE-II and BINDING SITE-III of FIG. 1, found on VGAM1230 host target RNA, and schematic representation of the complementarity of each of these host target binding sites to VGAM1230 RNA, herein designated VGAM RNA, are described hereinbelow with reference to Table 2.

As mentioned hereinabove with reference to FIG. 1, a function of VGAM1230 gene, herein designated VGAM is inhibition of expression of VGAM1230 target genes. It is appreciated that specific functions, and accordingly utilities, of VGAM1230 correlate with, and may be deduced from, the identity of the target genes which VGAM1230 binds and inhibits, and the function of these target genes, as elaborated hereinbelow.

Acid Phosphatase 2, Lysosomal (ACP2, Accession NM_001610) is a VGAM1230 host target gene. ACP2 BINDING SITE is HOST TARGET binding site found in the 3' untranslated region of mRNA encoded by ACP2, corresponding to a HOST TARGET binding site such as BINDING SITE I, BINDING SITE II or BINDING SITE III. Table 2 illustrates the complementarity of the nucleotide sequences of ACP2 BINDING SITE, designated SEQ ID:7318, to the nucleotide sequence of VGAM1230 RNA, herein designated VGAM RNA, also designated SEQ ID:3941.

A function of VGAM1230 is therefore inhibition of Acid Phosphatase 2, Lysosomal (ACP2, Accession NM_001610). Accordingly, utilities of VGAM1230 include diagnosis, prevention and treatment of diseases and clinical conditions associated with ACP2. Agrin (AGRN, Accession XM_086178) is another VGAM1230 host target gene. AGRN BINDING SITE is HOST TARGET binding site found in the 3' untranslated region of mRNA encoded by AGRN, corresponding to a HOST TARGET binding site such as BINDING SITE I, BINDING SITE II or BINDING SITE III. Table 2 illustrates the complementarity of the nucleotide sequences of AGRN BINDING SITE, designated SEQ ID:38536, to the nucleotide sequence of VGAM1230 RNA, herein designated VGAM RNA, also designated SEQ ID:3941.

Another function of VGAM1230 is therefore inhibition of Agrin (AGRN, Accession XM_086178), a gene which a neuronal aggregating factor that induces the aggregation of acetylcholine receptors. Accordingly, utilities of VGAM1230 include diagnosis, prevention and treatment of diseases and clinical conditions associated with AGRN. The function of AGRN and its association with various diseases and clinical conditions, has been established by previous studies, as described hereinabove with reference to VGAM1063. E2F Transcription Factor 3 (E2F3, Accession NM_001949) is another VGAM1230 host target gene. E2F3 BINDING SITE is HOST TARGET binding site found in the 3' untranslated region of mRNA encoded by E2F3, corresponding to a HOST TARGET binding site such as BINDING SITE I, BINDING SITE II or BINDING SITE III. Table 2 illustrates the complementarity of the nucleotide sequences of E2F3 BINDING SITE, designated SEQ ID:7664, to the nucleotide sequence of VGAM1230 RNA, herein designated VGAM RNA, also designated SEQ ID:3941.

Another function of VGAM1230 is therefore inhibition of E2F Transcription Factor 3 (E2F3, Accession NM_001949), a gene which binds dna and controls cell-cycle progression from g1 to s phase. Accordingly, utilities of VGAM1230 include diagnosis, prevention and treatment of diseases and clinical conditions associated with E2F3. The function of E2F3 and its association with various diseases and clinical conditions, has been established by previous studies, as described hereinabove with reference to VGAM475. LIM Domains Containing 1 (LIMD1, Accession NM_014240) is another VGAM1230 host target gene. LIMD1 BINDING SITE is HOST TARGET binding site found in the 3' untranslated region of mRNA encoded by LIMD1, corresponding to a HOST TARGET binding site such as BINDING SITE I, BINDING SITE II or BINDING SITE III. Table 2 illustrates the complementarity of the nucleotide sequences of LIMD1 BINDING SITE, designated SEQ ID:15502, to the nucleotide sequence of VGAM1230 RNA, herein designated VGAM RNA, also designated SEQ ID:3941.

Another function of VGAM1230 is therefore inhibition of LIM Domains Containing 1 (LIMD1, Accession NM_014240). Accordingly, utilities of VGAM1230 include diagnosis, prevention and treatment of diseases and clinical conditions associated with LIMD1. Neurocalcin Delta (NCALD, Accession NM_032041) is another VGAM1230 host target gene. NCALD BINDING SITE is HOST TARGET binding site found in the 3' untranslated region of mRNA encoded by NCALD, corresponding to a HOST TARGET binding site such as BINDING SITE I, BINDING SITE II or BINDING SITE III. Table 2 illustrates the complementarity of the nucleotide sequences of NCALD BINDING SITE, designated SEQ ID:25745, to the nucleotide sequence of VGAM1230 RNA, herein designated VGAM RNA, also designated SEQ ID:3941.

Another function of VGAM1230 is therefore inhibition of Neurocalcin Delta (NCALD, Accession NM_032041). Accordingly, utilities of VGAM1230 include diagnosis, prevention and treatment of diseases and clinical conditions associated with NCALD. SH3 and Multiple Ankyrin Repeat Domains 2 (SHANK2, Accession NM_012309) is another VGAM1230 host target gene. SHANK2 BINDING SITE is HOST TARGET binding site found in the 3' untranslated region of mRNA encoded by SHANK2, corresponding to a HOST TARGET binding site such as BINDING SITE I, BINDING SITE II or BINDING SITE III. Table 2 illustrates the complementarity of the nucleotide sequences of SHANK2 BINDING SITE, designated SEQ ID:14684, to the nucleotide sequence of VGAM1230 RNA, herein designated VGAM RNA, also designated SEQ ID:3941.

Another function of VGAM1230 is therefore inhibition of SH3 and Multiple Ankyrin Repeat Domains 2 (SHANK2, Accession NM_012309). Accordingly, utilities of VGAM1230 include diagnosis, prevention and treatment of diseases and clinical conditions associated with SHANK2. Single-minded Homolog 2 (Drosophila) (SIM2, Accession NM_005069) is another VGAM1230 host target gene. SIM2

BINDING SITE is HOST TARGET binding site found in the 3' untranslated region of mRNA encoded by SIM2, corresponding to a HOST TARGET binding site such as BINDING SITE I, BINDING SITE II or BINDING SITE III. Table 2 illustrates the complementarity of the nucleotide sequences of SIM2 BINDING SITE, designated SEQ ID:11516, to the nucleotide sequence of VGAM1230 RNA, herein designated VGAM RNA, also designated SEQ ID:3941.

Another function of VGAM1230 is therefore inhibition of Single-minded Homolog 2 (Drosophila) (SIM2, Accession NM_005069), a gene which may be a master gene of cns development. Accordingly, utilities of VGAM1230 include diagnosis, prevention and treatment of diseases and clinical conditions associated with SIM2. The function of SIM2 and its association with various diseases and clinical conditions, has been established by previous studies, as described hereinabove with reference to VGAM369. Spondin 1, (f-spondin) Extracellular Matrix Protein (SPON1, Accession XM_031184) is another VGAM1230 host target gene. SPON1 BINDING SITE is HOST TARGET binding site found in the 3' untranslated region of mRNA encoded by SPON1, corresponding to a HOST TARGET binding site such as BINDING SITE I, BINDING SITE II or BINDING SITE III. Table 2 illustrates the complementarity of the nucleotide sequences of SPON1 BINDING SITE, designated SEQ ID:31303, to the nucleotide sequence of VGAM1230 RNA, herein designated VGAM RNA, also designated SEQ ID:3941.

Another function of VGAM1230 is therefore inhibition of Spondin 1, (f-spondin) Extracellular Matrix Protein (SPON1, Accession XM_031184). Accordingly, utilities of VGAM1230 include diagnosis, prevention and treatment of diseases and clinical conditions associated with SPON1. DKFZP564L0864 (Accession XM_051905) is another VGAM1230 host target gene. DKFZP564L0864 BINDING SITE is HOST TARGET binding site found in the 3' untranslated region of mRNA encoded by DKFZP564L0864, corresponding to a HOST TARGET binding site such as BINDING SITE I, BINDING SITE II or BINDING SITE III. Table 2 illustrates the complementarity of the nucleotide sequences of DKFZP564L0864 BINDING SITE, designated SEQ ID:35919, to the nucleotide sequence of VGAM1230 RNA, herein designated VGAM RNA, also designated SEQ ID:3941.

Another function of VGAM1230 is therefore inhibition of DKFZP564L0864 (Accession XM_051905). Accordingly, utilities of VGAM1230 include diagnosis, prevention and treatment of diseases and clinical conditions associated with DKFZP564L0864. DKFZp761B1514 (Accession NM_032288) is another VGAM1230 host target gene. DKFZp761B1514 BINDING SITE is HOST TARGET binding site found in the 3' untranslated region of mRNA encoded by DKFZp761B1514, corresponding to a HOST TARGET binding site such as BINDING SITE I, BINDING SITE II or BINDING SITE III. Table 2 illustrates the complementarity of the nucleotide sequences of DKFZp761B1514 BINDING SITE, designated SEQ ID:26047, to the nucleotide sequence of VGAM1230 RNA, herein designated VGAM RNA, also designated SEQ ID:3941.

Another function of VGAM1230 is therefore inhibition of DKFZp761B1514 (Accession NM_032288). Accordingly, utilities of VGAM1230 include diagnosis, prevention and treatment of diseases and clinical conditions associated with DKFZp761B1514. F-box Only Protein 9 (FBXO9, Accession NM_033480) is another VGAM1230 host target gene. FBXO9 BINDING SITE is HOST TARGET binding site found in the 3' untranslated region of mRNA encoded by FBXO9, corresponding to a HOST TARGET binding site such as BINDING SITE I, BINDING SITE II or BINDING SITE III. Table 2 illustrates the complementarity of the nucleotide sequences of FBXO9 BINDING SITE, designated SEQ ID:27258, to the nucleotide sequence of VGAM1230 RNA, herein designated VGAM RNA, also designated SEQ ID:3941.

Another function of VGAM1230 is therefore inhibition of F-box Only Protein 9 (FBXO9, Accession NM_033480). Accordingly, utilities of VGAM1230 include diagnosis, prevention and treatment of diseases and clinical conditions associated with FBXO9. KDEL (Lys-Asp-Glu-Leu) Endoplasmic Reticulum Protein Retention Receptor 3 (KDELR3, Accession NM_006855) is another VGAM1230 host target gene. KDELR3 BINDING SITE is HOST TARGET binding site found in the 3' untranslated region of mRNA encoded by KDELR3, corresponding to a HOST TARGET binding site such as BINDING SITE I, BINDING SITE II or BINDING SITE III. Table 2 illustrates the complementarity of the nucleotide sequences of KDELR3 BINDING SITE, designated SEQ ID:13724, to the nucleotide sequence of VGAM1230 RNA, herein designated VGAM RNA, also designated SEQ ID:3941.

Another function of VGAM1230 is therefore inhibition of KDEL (Lys-Asp-Glu-Leu) Endoplasmic Reticulum Protein Retention Receptor 3 (KDELR3, Accession NM_006855). Accordingly, utilities of VGAM1230 include diagnosis, prevention and treatment of diseases and clinical conditions associated with KDELR3. KIAA0914 (Accession NM_014883) is another VGAM1230 host target gene. KIAA0914 BINDING SITE is HOST TARGET binding site found in the 3' untranslated region of mRNA encoded by KIAA0914, corresponding to a HOST TARGET binding site such as BINDING SITE I, BINDING SITE II or BINDING SITE III. Table 2 illustrates the complementarity of the nucleotide sequences of KIAA0914 BINDING SITE, designated SEQ ID:17034, to the nucleotide sequence of VGAM1230 RNA, herein designated VGAM RNA, also designated SEQ ID:3941.

Another function of VGAM1230 is therefore inhibition of KIAA0914 (Accession NM_014883). Accordingly, utilities of VGAM1230 include diagnosis, prevention and treatment of diseases and clinical conditions associated with KIAA0914. SKIP (Accession NM_130766) is another VGAM1230 host target gene. SKIP BINDING SITE1 and SKIP BINDING SITE2 are HOST TARGET binding sites found in untranslated regions of mRNA encoded by SKIP, corresponding to HOST TARGET binding sites such as BINDING SITE I, BINDING SITE II or BINDING SITE III. Table 2 illustrates the complementarity of the nucleotide sequences of SKIP BINDING SITE1 and SKIP BINDING SITE2, designated SEQ ID:28264 and SEQ ID:18600 respectively, to the nucleotide sequence of VGAM1230 RNA, herein designated VGAM RNA, also designated SEQ ID:3941.

Another function of VGAM1230 is therefore inhibition of SKIP (Accession NM_130766). Accordingly, utilities of VGAM1230 include diagnosis, prevention and treatment of diseases and clinical conditions associated with SKIP. LOC146856 (Accession XM_096086) is another VGAM1230 host target gene. LOC146856 BINDING SITE is HOST TARGET binding site found in the 3' untranslated region of mRNA encoded by LOC146856, corresponding to a HOST TARGET binding site such as BINDING SITE I, BINDING SITE II or BINDING SITE III. Table 2 illustrates the complementarity of the nucleotide sequences of LOC146856 BINDING SITE, designated SEQ ID:40297, to the nucleotide sequence of VGAM1230 RNA, herein designated VGAM RNA, also designated SEQ ID:3941.

Another function of VGAM1230 is therefore inhibition of LOC146856 (Accession XM_096086). Accordingly, utilities of VGAM1230 include diagnosis, prevention and treatment of diseases and clinical conditions associated with LOC146856. LOC200609 (Accession XM_117256) is another VGAM1230 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43321, to the nucleotide sequence of VGAM1230 RNA, herein designated VGAM RNA, also designated SEQ ID:3941.

Another function of VGAM1230 is therefore inhibition of LOC200609 (Accession XM_117256). Accordingly, utilities of VGAM1230 include diagnosis, prevention and treatment of diseases and clinical conditions associated with LOC200609. FIG. 1 further provides a conceptual description of a novel bioinformatically detected viral gene of the present invention, referred to here as Viral Genomic Address Messenger 1231 (VGAM1231) viral gene, which modulates expression of respective host target genes thereof, the function and utility of which host target genes is known in the art.

VGAM1231 is a novel bioinformatically detected regulatory, non protein coding, viral micro RNA (miRNA) gene. The method by which VGAM1231 was detected is described hereinabove with reference to FIGS. 1-8.

VGAM1231 gene, herein designated VGAM GENE, is a viral gene contained in the genome of Equine Herpesvirus 2. VGAM1231 host target gene, herein designated VGAM HOST TARGET GENE, is a human gene contained in the human genome.

VGAM1231 gene encodes a VGAM1231 precursor RNA, herein designated VGAM PRECURSOR RNA. Similar to other miRNA genes, and unlike most ordinary genes, VGAM1231 precursor RNA does not encode a protein. A nucleotide sequence identical or highly similar to the nucleotide sequence of VGAM1231 precursor RNA is designated SEQ ID:1217, and is provided hereinbelow with reference to the sequence listing part. Nucleotide sequence SEQ ID:1217 is located at position 10445 relative to the genome of Equine Herpesvirus 2.

VGAM1231 precursor RNA folds onto itself, forming VGAM1231 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1231 folded precursor RNA into VGAM1231 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 43%) nucleotide sequence of VGAM1231 RNA is designated SEQ ID:3942, and is provided hereinbelow with reference to the sequence listing part.

VGAM1231 host target gene, herein designated VGAM HOST TARGET GENE, encodes a corresponding messenger RNA, VGAM1231 host target RNA, herein designated VGAM HOST TARGET RNA. VGAM1231 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1231 RNA, herein designated VGAM RNA, binds complementarily to one or more host target binding sites located in untranslated regions of VGAM1231 host target RNA, herein designated VGAM HOST TARGET RNA. This complementary binding is due to the fact that the nucleotide sequence of VGAM1231 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1231 RNA, herein designated VGAM RNA, may have a different number of host target binding sites in untranslated regions of a VGAM1231 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1231 RNA, herein designated VGAM RNA, to host target binding sites on VGAM1231 host target RNA, herein designated VGAM HOST TARGET RNA, such as BINDING SITE I, BINDING SITE II and BINDING SITE III, inhibits translation of VGAM1231 host target RNA into VGAM1231 host target protein, herein designated VGAM HOST TARGET PROTEIN. VGAM host target protein is therefore outlined by a broken line.

It is appreciated that VGAM1231 host target gene, herein designated VGAM HOST TARGET GENE, in fact represents a plurality of VGAM1231 host target genes. The mRNA of each one of this plurality of VGAM1231 host target genes comprises one or more host target binding sites, each having a nucleotide sequence which is at least partly complementary to VGAM1231 RNA, herein designated VGAM RNA, and which when bound by VGAM1231 RNA causes inhibition of translation of respective one or more VGAM1231 host target proteins.

It is further appreciated by one skilled in the art that the mode of translational inhibition illustrated by FIG. 1 with specific reference to translational inhibition exerted by VGAM1231 gene, herein designated VGAM GENE, on one or more VGAM1231 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1231 is inhibition of expression of host target genes, as part of a novel viral mechanism of attacking a host. Accordingly, utilities of VGAM1231 include diagnosis, prevention and treatment of viral infection by Equine Herpesvirus 2. Specific functions, and accordingly utilities, of VGAM1231 correlate with, and may be deduced from, the identity of the host target genes which VGAM1231 binds and inhibits, and the function of these host target genes, as elaborated hereinbelow.

Nucleotide sequences of the VGAM1231 precursor RNA, herein designated VGAM PRECURSOR RNA, and of the 'diced' VGAM1231 RNA, herein designated VGAM RNA, and a schematic representation of the secondary folding of VGAM1231 folded precursor RNA, herein designated VGAM FOLDED PRECURSOR RNA, of VGAM1231 are further described hereinbelow with reference to Table 1.

Nucleotide sequences of host target binding sites, such as BINDING SITE-I, BINDING SITE-II and BINDING SITE-III of FIG. 1, found on VGAM1231 host target RNA, and schematic representation of the complementarity of each of these host target binding sites to VGAM1231 RNA, herein designated VGAM RNA, are described hereinbelow with reference to Table 2.

As mentioned hereinabove with reference to FIG. 1, a function of VGAM1231 gene, herein designated VGAM is inhibition of expression of VGAM1231 target genes. It is appreciated that specific functions, and accordingly utilities, of VGAM1231 correlate with, and may be deduced from, the identity of the target genes which VGAM1231 binds and inhibits, and the function of these target genes, as elaborated hereinbelow.

Extracellular Matrix Protein 2, Female Organ and Adipocyte Specific (ECM2, Accession NM_001393) is a VGAM1231 host target gene. ECM2 BINDING SITE is HOST TARGET binding site found in the 3' untranslated region of mRNA encoded by ECM2, corresponding to a HOST TARGET binding site such as BINDING SITE I, BINDING SITE II or BINDING SITE III. Table 2 illustrates the complementarity of the nucleotide sequences of ECM2 BINDING SITE, designated SEQ ID:7087, to the nucleotide sequence of VGAM1231 RNA, herein designated VGAM RNA, also designated SEQ ID:3942.

A function of VGAM1231 is therefore inhibition of Extracellular Matrix Protein 2, Female Organ and Adipocyte Specific (ECM2, Accession NM_001393). Accordingly, utilities of VGAM1231 include diagnosis, prevention and treatment of diseases and clinical conditions associated with ECM2. Muscleblind-like (Drosophila) (MBNL, Accession NM_021038) is another VGAM1231 host target gene. MBNL BINDING SITE is HOST TARGET binding site found in the 3' untranslated region of mRNA encoded by MBNL, corresponding to a HOST TARGET binding site such as BINDING SITE I, BINDING SITE II or BINDING SITE III. Table 2 illustrates the complementarity of the nucleotide sequences of MBNL BINDING SITE, designated SEQ ID:22031, to the nucleotide sequence of VGAM1231 RNA, herein designated VGAM RNA, also designated SEQ ID:3942.

Another function of VGAM1231 is therefore inhibition of Muscleblind-like (Drosophila) (MBNL, Accession NM_021038), a gene which binds to cug triplet repeat expansion dsrna (by similarity). Accordingly, utilities of VGAM1231 include diagnosis, prevention and treatment of diseases and clinical conditions associated with MBNL. The function of MBNL and its association with various diseases and clinical conditions, has been established by previous studies, as described hereinabove with reference to VGAM95. Parkinson Disease (autosomal recessive, juvenile) 2, Parkin (PARK2, Accession NM_013988) is another VGAM1231 host target gene. PARK2 BINDING SITE1 through PARK2 BINDING SITE3 are HOST TARGET binding sites found in untranslated regions of mRNA encoded by PARK2, corresponding to HOST TARGET binding sites such as BINDING SITE I, BINDING SITE II or BINDING SITE III. Table 2 illustrates the complementarity of the nucleotide sequences of PARK2 BINDING SITE1 through PARK2 BINDING SITE3, designated SEQ ID:15161, SEQ ID:10907 and SEQ ID:15154 respectively, to the nucleotide sequence of VGAM1231 RNA, herein designated VGAM RNA, also designated SEQ ID:3942.

Another function of VGAM1231 is therefore inhibition of Parkinson Disease (autosomal recessive, juvenile) 2, Parkin (PARK2, Accession NM_013988). Accordingly, utilities of VGAM1231 include diagnosis, prevention and treatment of diseases and clinical conditions associated with PARK2. DKFZP434L187 (Accession XM_044070) is another VGAM1231 host target gene. DKFZP434L187 BINDING SITE is HOST TARGET binding site found in the 5' untranslated region of mRNA encoded by DKFZP434L187, corresponding to a HOST TARGET binding site such as BINDING SITE I, BINDING SITE II or BINDING SITE III. Table 2 illustrates the complementarity of the nucleotide sequences of DKFZP434L187 BINDING SITE, designated SEQ ID:34127, to the nucleotide sequence of VGAM1231 RNA, herein designated VGAM RNA, also designated SEQ ID:3942.

Another function of VGAM1231 is therefore inhibition of DKFZP434L187 (Accession XM_044070). Accordingly, utilities of VGAM1231 include diagnosis, prevention and treatment of diseases and clinical conditions associated with DKFZP434L187. FLJ11004 (Accession NM_018296) is another VGAM1231 host target gene. FLJ11004 BINDING SITE is HOST TARGET binding site found in the 5' untranslated region of mRNA encoded by FLJ11004, corresponding to a HOST TARGET binding site such as BINDING SITE I, BINDING SITE II or BINDING SITE III. Table 2 illustrates the complementarity of the nucleotide sequences of FLJ11004 BINDING SITE, designated SEQ ID:20288, to the nucleotide sequence of VGAM1231 RNA, herein designated VGAM RNA, also designated SEQ ID:3942.

Another function of VGAM1231 is therefore inhibition of FLJ11004 (Accession NM_018296). Accordingly, utilities of VGAM1231 include diagnosis, prevention and treatment of diseases and clinical conditions associated with FLJ11004. KIAA0495 (Accession XM_031397) is another VGAM1231 host target gene. KIAA0495 BINDING SITE is HOST TARGET binding site found in the 5' untranslated region of mRNA encoded by KIAA0495, corresponding to a HOST TARGET binding site such as BINDING SITE I, BINDING SITE II or BINDING SITE III. Table 2 illustrates the complementarity of the nucleotide sequences of KIAA0495 BINDING SITE, designated SEQ ID:31360, to the nucleotide sequence of VGAM1231 RNA, herein designated VGAM RNA, also designated SEQ ID:3942.

Another function of VGAM1231 is therefore inhibition of KIAA0495 (Accession XM_031397). Accordingly, utilities of VGAM1231 include diagnosis, prevention and treatment of diseases and clinical conditions associated with KIAA0495. KIAA1600 (Accession XM_049351) is another VGAM1231 host target gene. KIAA1600 BINDING SITE is HOST TARGET binding site found in the 3' untranslated region of mRNA encoded by KIAA1600, corresponding to a HOST TARGET binding site such as BINDING SITE I, BINDING SITE II or BINDING SITE III. Table 2 illustrates the complementarity of the nucleotide sequences of KIAA1600 BINDING SITE, designated SEQ ID:35395, to the nucleotide sequence of VGAM1231 RNA, herein designated VGAM RNA, also designated SEQ ID:3942.

Another function of VGAM1231 is therefore inhibition of KIAA1600 (Accession XM_049351). Accordingly, utilities of VGAM1231 include diagnosis, prevention and treatment of diseases and clinical conditions associated with KIAA1600. Leptin Receptor Overlapping Transcript-like 1 (LEPROTL1, Accession NM_015344) is another VGAM1231 host target gene. LEPROTL1 BINDING SITE is HOST TARGET binding site found in the 3' untranslated region of mRNA encoded by LEPROTL1, corresponding to a HOST TARGET binding site such as BINDING SITE I, BINDING SITE II or BINDING SITE III. Table 2 illustrates the complementarity of the nucleotide sequences of LEPROTL1 BINDING SITE, designated SEQ ID:17649, to the nucleotide sequence of VGAM1231 RNA, herein designated VGAM RNA, also designated SEQ ID:3942.

Another function of VGAM1231 is therefore inhibition of Leptin Receptor Overlapping Transcript-like 1 (LEPROTL1, Accession NM_015344). Accordingly, utilities of VGAM1231 include diagnosis, prevention and treatment of diseases and clinical conditions associated with LEPROTL1. LOC142955 (Accession XM_084389) is another VGAM1231 host target gene. LOC142955 BINDING SITE is HOST TARGET binding site found in the 3' untranslated region of mRNA encoded by LOC142955, corresponding to a HOST TARGET binding site such as BINDING SITE I, BINDING SITE II or BINDING SITE III. Table 2 illustrates the complementarity of the nucleotide sequences of LOC142955 BINDING SITE, designated SEQ ID:37570, to the nucleotide sequence of VGAM1231 RNA, herein designated VGAM RNA, also designated SEQ ID:3942.

Another function of VGAM1231 is therefore inhibition of LOC142955 (Accession XM_084389). Accordingly, utilities of VGAM1231 include diagnosis, prevention and treatment of diseases and clinical conditions associated with LOC142955. LOC257103 (Accession XM_170982) is another VGAM1231 host target gene. LOC257103 BINDING SITE is HOST TARGET binding site found in the 5' untranslated region of mRNA encoded by LOC257103, corresponding to a HOST TARGET binding site such as BINDING SITE I, BINDING SITE II or BINDING SITE III. Table 2 illustrates the complementarity of the nucleotide sequences of LOC257103 BINDING SITE, designated SEQ ID:45754, to the nucleotide sequence of VGAM1231 RNA, herein designated VGAM RNA, also designated SEQ ID:3942.

Another function of VGAM1231 is therefore inhibition of LOC257103 (Accession XM_170982). Accordingly, utilities of VGAM1231 include diagnosis, prevention and treatment of diseases and clinical conditions associated with LOC257103. LOC90148 (Accession XM_029430) is another VGAM1231 host target gene. LOC90148 BINDING SITE is HOST TARGET binding site found in the 3' untranslated region of mRNA encoded by LOC90148, corresponding to a HOST TARGET binding site such as BINDING SITE I, BINDING SITE II or BINDING SITE III. Table 2 illustrates the complementarity of the nucleotide sequences of LOC90148 BINDING SITE, designated SEQ ID:30892, to the nucleotide sequence of VGAM1231 RNA, herein designated VGAM RNA, also designated SEQ ID:3942.

Another function of VGAM1231 is therefore inhibition of LOC90148 (Accession XM_029430). Accordingly, utilities of VGAM1231 include diagnosis, prevention and treatment of diseases and clinical conditions associated with LOC90148. FIG. 1 further provides a conceptual description of a novel bioinformatically detected viral gene of the present invention, referred to here as Viral Genomic Address Messenger 1232 (VGAM1232) viral gene, which modulates expression of respective host target genes thereof, the function and utility of which host target genes is known in the art.

VGAM1232 is a novel bioinformatically detected regulatory, non protein coding, viral micro RNA (miRNA) gene. The method by which VGAM1232 was detected is described hereinabove with reference to FIGS. 1-8.

VGAM1232 gene, herein designated VGAM GENE, is a viral gene contained in the genome of Equine Herpesvirus 2. VGAM1232 host target gene, herein designated VGAM HOST TARGET GENE, is a human gene contained in the human genome.

VGAM1232 gene encodes a VGAM1232 precursor RNA, herein designated VGAM PRECURSOR RNA. Similar to other miRNA genes, and unlike most ordinary genes, VGAM1232 precursor RNA does not encode a protein. A nucleotide sequence identical or highly similar to the nucleotide sequence of VGAM1232 precursor RNA is designated SEQ ID:1218, and is provided hereinbelow with reference to the sequence listing part. Nucleotide sequence SEQ ID:1218 is located at position 14553 relative to the genome of Equine Herpesvirus 2.

VGAM1232 precursor RNA folds onto itself, forming VGAM1232 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1232 folded precursor RNA into VGAM1232 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1232 RNA is designated SEQ ID:3943, and is provided hereinbelow with reference to the sequence listing part.

VGAM1232 host target gene, herein designated VGAM HOST TARGET GENE, encodes a corresponding messenger RNA, VGAM1232 host target RNA, herein designated VGAM HOST TARGET RNA. VGAM1232 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1232 RNA, herein designated VGAM RNA, binds complementarily to one or more host target binding sites located in untranslated regions of VGAM1232 host target RNA, herein designated VGAM HOST TARGET RNA. This complementary binding is due to the fact that the nucleotide sequence of VGAM1232 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1232 RNA, herein designated VGAM RNA, may have a different number of host target binding sites in untranslated regions of a VGAM1232 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1232 RNA, herein designated VGAM RNA, to host target binding sites on VGAM1232 host target RNA, herein designated VGAM HOST TARGET RNA, such as BINDING SITE I, BINDING SITE II and BINDING SITE III, inhibits translation of VGAM1232 host target RNA into VGAM1232 host target protein, herein designated VGAM HOST TARGET PROTEIN. VGAM host target protein is therefore outlined by a broken line.

It is appreciated that VGAM1232 host target gene, herein designated VGAM HOST TARGET GENE, in fact represents a plurality of VGAM1232 host target genes. The mRNA of each one of this plurality of VGAM1232 host target genes comprises one or more host target binding sites, each having a nucleotide sequence which is at least partly complementary to VGAM1232 RNA, herein designated VGAM RNA, and which when bound by VGAM1232 RNA causes inhibition of translation of respective one or more VGAM1232 host target proteins.

It is further appreciated by one skilled in the art that the mode of translational inhibition illustrated by FIG. 1 with specific reference to translational inhibition exerted by VGAM1232 gene, herein designated VGAM GENE, on one or more VGAM1232 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1232 is inhibition of expression of host target genes, as part of a novel viral mechanism of attacking a host. Accordingly, utilities of VGAM1232 include diagnosis, prevention and treatment of viral infection by Equine Herpesvirus 2. Specific functions, and accordingly utilities, of VGAM1232 correlate with, and may be deduced from, the identity of the host target genes which VGAM1232 binds and inhibits, and the function of these host target genes, as elaborated hereinbelow.

Nucleotide sequences of the VGAM1232 precursor RNA, herein designated VGAM PRECURSOR RNA, and of the 'diced' VGAM1232 RNA, herein designated VGAM RNA, and a schematic representation of the secondary folding of VGAM1232 folded precursor RNA, herein designated VGAM FOLDED PRECURSOR RNA, of VGAM1232 are further described hereinbelow with reference to Table 1.

Nucleotide sequences of host target binding sites, such as BINDING SITE-I, BINDING SITE-II and BINDING SITE-III of FIG. 1, found on VGAM1232 host target RNA, and schematic representation of the complementarity of each of these host target binding sites to VGAM1232 RNA, herein designated VGAM RNA, are described hereinbelow with reference to Table 2.

As mentioned hereinabove with reference to FIG. 1, a function of VGAM1232 gene, herein designated VGAM is inhibition of expression of VGAM1232 target genes. It is appreciated that specific functions, and accordingly utilities, of VGAM1232 correlate with, and may be deduced from, the identity of the target genes which VGAM1232 binds and inhibits, and the function of these target genes, as elaborated hereinbelow.

Glutamate Receptor, Ionotropic, N-methyl D-aspartate 2B (GRIN2B, Accession NM_000834) is a VGAM1232 host target gene. GRIN2B BINDING SITE is HOST TARGET binding site found in the 5' untranslated region of mRNA encoded by GRIN2B, corresponding to a HOST TARGET binding site such as BINDING SITE I, BINDING SITE II or BINDING SITE III. Table 2 illustrates the complementarity of the nucleotide sequences of GRIN2B BINDING SITE, designated SEQ ID:6491, to the nucleotide sequence of VGAM1232 RNA, herein designated VGAM RNA, also designated SEQ ID:3943.

A function of VGAM1232 is therefore inhibition of Glutamate Receptor, Ionotropic, N-methyl D-aspartate 2B (GRIN2B, Accession NM_000834). Accordingly, utilities of VGAM1232 include diagnosis, prevention and treatment of diseases and clinical conditions associated with GRIN2B. LAPTM5 (Accession NM_006762) is another VGAM1232 host target gene. LAPTM5 BINDING SITE is HOST TARGET binding site found in the 3' untranslated region of mRNA encoded by LAPTM5, corresponding to a HOST TARGET binding site such as BINDING SITE I, BINDING SITE II or BINDING SITE III. Table 2 illustrates the complementarity of the nucleotide sequences of LAPTM5 BINDING SITE, designated SEQ ID:13615, to the nucleotide sequence of VGAM1232 RNA, herein designated VGAM RNA, also designated SEQ ID:3943.

Another function of VGAM1232 is therefore inhibition of LAPTM5 (Accession NM_006762). Accordingly, utilities of VGAM1232 include diagnosis, prevention and treatment of diseases and clinical conditions associated with LAPTM5. D15Wsu75e (Accession XM_039495) is another VGAM1232 host target gene. D15Wsu75e BINDING SITE is HOST TARGET binding site found in the 3' untranslated region of mRNA encoded by D15Wsu75e, corresponding to a HOST TARGET binding site such as BINDING SITE I, BINDING SITE II or BINDING SITE III. Table 2 illustrates the complementarity of the nucleotide sequences of D15Wsu75e BINDING SITE, designated SEQ ID:33101, to the nucleotide sequence of VGAM1232 RNA, herein designated VGAM RNA, also designated SEQ ID:3943.

Another function of VGAM1232 is therefore inhibition of D15Wsu75e (Accession XM_039495). Accordingly, utilities of VGAM1232 include diagnosis, prevention and treatment of diseases and clinical conditions associated with D15Wsu75e. LOC146452 (Accession XM_085473) is another VGAM1232 host target gene. LOC146452 BINDING SITE is HOST TARGET binding site found in the 3' untranslated region of mRNA encoded by LOC146452, corresponding to a HOST TARGET binding site such as BINDING SITE I, BINDING SITE II or BINDING SITE III. Table 2 illustrates the complementarity of the nucleotide sequences of LOC146452 BINDING SITE, designated SEQ ID:38161, to the nucleotide sequence of VGAM1232 RNA, herein designated VGAM RNA, also designated SEQ ID:3943.

Another function of VGAM1232 is therefore inhibition of LOC146452 (Accession XM_085473). Accordingly, utilities of VGAM1232 include diagnosis, prevention and treatment of diseases and clinical conditions associated with LOC146452. LOC149461 (Accession XM_086547) is another VGAM1232 host target gene. LOC149461 BINDING SITE is HOST TARGET binding site found in the 3' untranslated region of mRNA encoded by LOC149461, corresponding to a HOST TARGET binding site such as BINDING SITE I, BINDING SITE II or BINDING SITE III. Table 2 illustrates the complementarity of the nucleotide sequences of LOC149461 BINDING SITE, designated SEQ ID:38761, to the nucleotide sequence of VGAM1232 RNA, herein designated VGAM RNA, also designated SEQ ID:3943.

Another function of VGAM1232 is therefore inhibition of LOC149461 (Accession XM_086547). Accordingly, utilities of VGAM1232 include diagnosis, prevention and treatment of diseases and clinical conditions associated with LOC149461. LOC222057 (Accession XM_166594) is another VGAM1232 host target gene. LOC222057 BINDING SITE is HOST TARGET binding site found in the 3' untranslated region of mRNA encoded by LOC222057, corresponding to a HOST TARGET binding site such as BINDING SITE I, BINDING SITE II or BINDING SITE III. Table 2 illustrates the complementarity of the nucleotide sequences of LOC222057 BINDING SITE, designated SEQ ID:44573, to the nucleotide sequence of VGAM1232 RNA, herein designated VGAM RNA, also designated SEQ ID:3943.

Another function of VGAM1232 is therefore inhibition of LOC222057 (Accession XM_166594). Accordingly, utilities of VGAM1232 include diagnosis, prevention and treatment of diseases and clinical conditions associated with LOC222057. FIG. 1 further provides a conceptual description of a novel bioinformatically detected viral gene of the present invention, referred to here as Viral Genomic Address Messenger 1233 (VGAM1233) viral gene, which modulates expression of respective host target genes thereof, the function and utility of which host target genes is known in the art.

VGAM1233 is a novel bioinformatically detected regulatory, non protein coding, viral micro RNA (miRNA) gene. The method by which VGAM1233 was detected is described hereinabove with reference to FIGS. 1-8.

VGAM1233 gene, herein designated VGAM GENE, is a viral gene contained in the genome of Equine Herpesvirus 2. VGAM1233 host target gene, herein designated VGAM HOST TARGET GENE, is a human gene contained in the human genome.

VGAM1233 gene encodes a VGAM1233 precursor RNA, herein designated VGAM PRECURSOR RNA. Similar to other miRNA genes, and unlike most ordinary genes, VGAM1233 precursor RNA does not encode a protein. A nucleotide sequence identical or highly similar to the nucleotide sequence of VGAM1233 precursor RNA is designated SEQ ID:1219, and is provided hereinbelow with reference to the sequence listing part. Nucleotide sequence SEQ ID:1219 is located at position 11297 relative to the genome of Equine Herpesvirus 2.

VGAM1233 precursor RNA folds onto itself, forming VGAM1233 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1233 folded precursor RNA into VGAM1233 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1233 RNA is designated SEQ ID:3944, and is provided hereinbelow with reference to the sequence listing part.

VGAM1233 host target gene, herein designated VGAM HOST TARGET GENE, encodes a corresponding messenger RNA, VGAM1233 host target RNA, herein designated VGAM HOST TARGET RNA. VGAM1233 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1233 RNA, herein designated VGAM RNA, binds complementarily to one or more host target binding sites located in untranslated regions of VGAM1233 host target RNA, herein designated VGAM HOST TARGET RNA. This complementary binding is due to the fact that the nucleotide sequence of VGAM1233 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1233 RNA, herein designated VGAM RNA, may have a different number of host target binding sites in untranslated regions of a VGAM1233 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1233 RNA, herein designated VGAM RNA, to host target binding sites on VGAM1233 host target RNA, herein designated VGAM HOST TARGET RNA, such as BINDING SITE I, BINDING SITE II and BINDING SITE III, inhibits translation of VGAM1233 host target RNA into VGAM1233 host target protein, herein designated VGAM HOST TARGET PROTEIN. VGAM host target protein is therefore outlined by a broken line.

It is appreciated that VGAM1233 host target gene, herein designated VGAM HOST TARGET GENE, in fact represents a plurality of VGAM1233 host target genes. The mRNA of each one of this plurality of VGAM1233 host target genes comprises one or more host target binding sites, each having a nucleotide sequence which is at least partly complementary to VGAM1233 RNA, herein designated VGAM RNA, and which when bound by VGAM1233 RNA causes inhibition of translation of respective one or more VGAM1233 host target proteins.

It is further appreciated by one skilled in the art that the mode of translational inhibition illustrated by FIG. 1 with specific reference to translational inhibition exerted by VGAM1233 gene, herein designated VGAM GENE, on one or more VGAM1233 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1233 is inhibition of expression of host target genes, as part of a novel viral mechanism of attacking a host. Accordingly, utilities of VGAM1233 include diagnosis, prevention and treatment of viral infection by Equine Herpesvirus 2. Specific functions, and accordingly utilities, of VGAM1233 correlate with, and may be deduced from, the identity of the host target genes which VGAM1233 binds and inhibits, and the function of these host target genes, as elaborated hereinbelow.

Nucleotide sequences of the VGAM1233 precursor RNA, herein designated VGAM PRECURSOR RNA, and of the 'diced' VGAM1233 RNA, herein designated VGAM RNA, and a schematic representation of the secondary folding of VGAM1233 folded precursor RNA, herein designated VGAM FOLDED PRECURSOR RNA, of VGAM1233 are further described hereinbelow with reference to Table 1.

Nucleotide sequences of host target binding sites, such as BINDING SITE-I, BINDING SITE-II and BINDING SITE-III of FIG. 1, found on VGAM1233 host target RNA, and schematic representation of the complementarity of each of these host target binding sites to VGAM1233 RNA, herein designated VGAM RNA, are described hereinbelow with reference to Table 2.

As mentioned hereinabove with reference to FIG. 1, a function of VGAM1233 gene, herein designated VGAM is inhibition of expression of VGAM1233 target genes. It is appreciated that specific functions, and accordingly utilities, of VGAM1233 correlate with, and may be deduced from, the identity of the target genes which VGAM1233 binds and inhibits, and the function of these target genes, as elaborated hereinbelow.

DNA Fragmentation Factor, 40 kDa, Beta Polypeptide (caspase-activated DNase) (DFFB, Accession XM_113366) is a VGAM1233 host target gene. DFFB BINDING SITE is HOST TARGET binding site found in the 3' untranslated region of mRNA encoded by DFFB, corresponding to a HOST TARGET binding site such as BINDING SITE I, BINDING SITE II or BINDING SITE III. Table 2 illustrates the complementarity of the nucleotide sequences of DFFB BINDING SITE, designated SEQ ID:42238, to the nucleotide sequence of VGAM1233 RNA, herein designated VGAM RNA, also designated SEQ ID:3944.

A function of VGAM1233 is therefore inhibition of DNA Fragmentation Factor, 40 kDa, Beta Polypeptide (caspase-activated DNase) (DFFB, Accession XM_113366), a gene which induces DNA fragmentation and chromatin condensation during apoptosis. Accordingly, utilities of VGAM1233 include diagnosis, prevention and treatment of diseases and clinical conditions associated with DFFB. The function of DFFB and its association with various diseases and clinical conditions, has been established by previous studies, as described hereinabove with reference to VGAM74. Deiodinase, Iodothyronine, Type III (DIO3, Accession NM_001362) is another VGAM1233 host target gene. DIO3 BINDING SITE is HOST TARGET binding site found in the 3' untranslated region of mRNA encoded by DIO3, corresponding to a HOST TARGET binding site such as BINDING SITE I, BINDING SITE II or BINDING SITE III. Table 2 illustrates the complementarity of the nucleotide sequences of DIO3 BINDING SITE, designated SEQ ID:7041, to the nucleotide sequence of VGAM1233 RNA, herein designated VGAM RNA, also designated SEQ ID:3944.

Another function of VGAM1233 is therefore inhibition of Deiodinase, Iodothyronine, Type III (DIO3, Accession NM_001362), a gene which regulates circulating fetal thyroid hormone concentrations. Accordingly, utilities of VGAM1233 include diagnosis, prevention and treatment of diseases and clinical conditions associated with DIO3. The function of DIO3 and its association with various diseases and clinical conditions, has been established by previous studies, as described hereinabove with reference to VGAM638. Ectodysplasin 1, Anhidrotic Receptor (EDAR, Accession NM_022336) is another VGAM1233 host target gene. EDAR BINDING SITE is HOST TARGET binding site found in the 5' untranslated region of mRNA encoded by EDAR, corresponding to a HOST TARGET binding site such as BINDING SITE I, BINDING SITE II or BINDING SITE III. Table 2 illustrates the complementarity of the nucleotide sequences of EDAR BINDING SITE, designated SEQ ID:22744, to the nucleotide sequence of VGAM1233 RNA, herein designated VGAM RNA, also designated SEQ ID:3944.

Another function of VGAM1233 is therefore inhibition of Ectodysplasin 1, Anhidrotic Receptor (EDAR, Accession NM_022336). Accordingly, utilities of VGAM1233 include diagnosis, prevention and treatment of diseases and clinical conditions associated with EDAR. Insulin-like Growth Factor Binding Protein 5 (IGFBP5, Accession NM_000599) is another VGAM1233 host target gene. IGFBP5 BINDING SITE is HOST TARGET binding site found in the 5' untranslated region of mRNA encoded by IGFBP5, corresponding to a HOST TARGET binding site such as BINDING SITE I, BINDING SITE II or BINDING SITE III. Table 2 illustrates the complementarity of the nucleotide sequences of IGFBP5 BINDING SITE, designated SEQ ID:6201, to the nucleotide sequence of VGAM1233 RNA, herein designated VGAM RNA, also designated SEQ ID:3944.

Another function of VGAM1233 is therefore inhibition of Insulin-like Growth Factor Binding Protein 5 (IGFBP5, Accession NM_000599), a gene which either inhibits or stimulates the growth promoting effects of the igfs on cell culture. Accordingly, utilities of VGAM1233 include diagnosis, prevention and treatment of diseases and clinical conditions associated with IGFBP5. The function of IGFBP5 has been established by previous studies. See 146733. Allander et al. (1994) cloned the IGFBP5 gene from a human genomic library and showed that it is divided into 4 exons which, primarily due to a first intron of approximately 25 kb, span about 33 kb of DNA. Southern analysis identified a single copy of the IGFBP5 gene in the haploid human genome. By PCR amplification of DNA from somatic human/rodent cell hybrids, by fluorescence in situ hybridization, and by hybridization to pulsed field gel electrophoresis fragments, they showed that the gene is located on 2q33-q34. The IGFBP2 gene (OMIM Ref. No. 146731) and the IGFBP5 gene are transcribed convergently and are separated by approximately 20 to 40 kb of DNA. Primer extension studies identified the IGFBP5 mRNA cap site 772 bp 5-prime to the first nucleotide of the translation start codon. A potential TATA element beginning 33 bp 5-prime to the mRNA cap site was identified. When a DNA fragment containing this cap site and 461 bp of upstream sequence was placed 5-prime to the chloramphenicol acetyltransferase (CAT) reporter gene and transfected into human breast cancer cells, it directed CAT expression in an orientation-specific manner, suggesting that this region contains elements essential for IGFBP5 promoter activity. Kou et al. (1994) demonstrated that, in the mouse, Igfbp2 and Igfbp5 colocalize to a proximal region of chromosome 1 that is syntenic with human chromosome 2q33-q36 and that the 2 genes are 5 kb apart in a tail-to-tail orientation. This suggests that the human IGFBP5 gene is located on 2q33-q36. Kou et al. (1994) also used interspecific backcross mapping and gene cloning to demonstrate that the Igfbp1 and Igfbp3 are located in the proximal part of chromosome 11. In the human genome, these 2 loci map within 20 kb of one another on 7p14-p12, and the genes are organized in a tail-to-tail configuration. The results suggested to Kou et al. (1994) an evolutionary scheme in which a primordial IGFBP gene duplicated to form a cluster that was later replicated to create a second linkage group.

Full details of the abovementioned studies are described in the following publications, the disclosure of which are hereby incorporated by reference:

Allander, S. V.; Larsson, C.; Ehrenborg, E.; Suwanichkul, A.; Weber, G.; Morris, S. L.; Bajalica, S.; Kiefer, M. C.; Luthman, H.; Powell, D. R.: Characterization of the chromosomal gene and promoter for human insulin-like growth factor binding protein-5. J. Biol. Chem. 269:10891-10898, 1994; and Kou, K.; James, P. L.; Clemmons, D. R.; Copeland, N. G.; Gilbert, D. J.; Jenkins, N. A.; Rotwein, P.: Identification of two clusters of mouse insulin-like growth factor binding protein.

Further studies establishing the function and utilities of IGFBP5 are found in John Hopkins OMIM database record ID 146734, and in sited publications numbered 12013 listed in the bibliography section hereinbelow, which are also hereby incorporated by reference. Intersectin 1 (SH3 domain protein) (ITSN1, Accession NM_003024) is another VGAM1233 host target gene. ITSN1 BINDING SITE is HOST TARGET binding site found in the 3' untranslated region of mRNA encoded by ITSN1, corresponding to a HOST TARGET binding site such as BINDING SITE I, BINDING SITE II or BINDING SITE III. Table 2 illustrates the complementarity of the nucleotide sequences of ITSN1 BINDING SITE, designated SEQ ID:8957, to the nucleotide sequence of VGAM1233 RNA, herein designated VGAM RNA, also designated SEQ ID:3944.

Another function of VGAM1233 is therefore inhibition of Intersectin 1 (SH3 domain protein) (ITSN1, Accession NM_003024), a gene which may be involved in endocytosis and synaptic vesicle recycling. Accordingly, utilities of VGAM1233 include diagnosis, prevention and treatment of diseases and clinical conditions associated with ITSN1. The function of ITSN1 has been established by previous studies. See 147265. Ozcelik et al. (1991) found that a cDNA probe for ITPR3 hybridized to DNA from hybrid cells containing human chromosome 6. In one hybrid that carried 6pter-p21, in the absence of an intact copy of this chromosome, hybridization was observed, thus mapping the gene to 6pter-p21. ITPR3 transduces many hormonal signals that regulate Ca (2+)-dependent processes in the intestinal epithelium. Maranto (1994) described complete sequence of the ITPR3 polypeptide (2,671 amino acids). Primary structure analysis indicated a pattern of conserved and variable regions, characteristic of the particular gene family. Immunocytochemical localization in the intestine was determined. Yamamoto-Hino et al. (1994) likewise mapped the ITPR3 gene to chromosome 6, specifically to 6p21, by isotopic in situ hybridization. They showed that the type 3 receptor was present in all hematopoietic and lymphoma cell lines tested Full details of the abovementioned studies are described in the following publications, the disclosure of which are hereby incorporated by reference:

Maranto, A. R.: Primary structure, ligand binding, and localization of the human type 3 inositol 1,4,5-trisphosphate receptor expressed in intestinal epithelium. J. Biol. Chem. 269:1222-1230, 1994; and Ozcelik, T.; Suedhof, T. C.; Francke, U.: The genes for inositol 1,4,5-triphosphate receptors 1 (ITPR1) and 3 (ITPR3) are localized on human chromosomes 3p and 6pter-p21, respectively.

Further studies establishing the function and utilities of ITSN1 are found in John Hopkins OMIM database record ID 602442, and in sited publications numbered 5612-5613, 586 and 5868 listed in the bibliography section hereinbelow, which are also hereby incorporated by reference. RNA Binding Motif Protein 3 (RBM3, Accession XM_047024) is another VGAM1233 host target gene. RBM3 BINDING SITE is HOST TARGET binding site found in the 5' untranslated region of mRNA encoded by RBM3, corresponding to a HOST TARGET binding site such as BINDING SITE I, BINDING SITE II or BINDING SITE III. Table 2 illustrates the complementarity of the nucleotide sequences of RBM3 BINDING SITE, designated SEQ ID:34892, to the nucleotide sequence of VGAM1233 RNA, herein designated VGAM RNA, also designated SEQ ID:3944.

Another function of VGAM1233 is therefore inhibition of RNA Binding Motif Protein 3 (RBM3, Accession XM_047024). Accordingly, utilities of VGAM1233 include diagnosis, prevention and treatment of diseases and clinical conditions associated with RBM3. Regulator of G-protein Signalling 3 (RGS3, Accession NM_017790) is another VGAM1233 host target gene. RGS3 BINDING SITE1 through RGS3 BINDING SITE6 are HOST TARGET binding sites found in untranslated regions of mRNA encoded by RGS3, corresponding to HOST TARGET binding sites such as BINDING SITE I, BINDING SITE II or BINDING SITE III. Table 2 illustrates the complementarity of the nucleotide sequences of RGS3 BINDING SITE1 through RGS3 BINDING SITE6, designated SEQ ID:19422, SEQ ID:22086, SEQ ID:29307, SEQ ID:28281, SEQ ID:28667 and SEQ ID:29305 respectively, to the nucleotide sequence of VGAM1233 RNA, herein designated VGAM RNA, also designated SEQ ID:3944.

Another function of VGAM1233 is therefore inhibition of Regulator of G-protein Signalling 3 (RGS3, Accession NM_017790), a gene which negatively regulates G protein-coupled receptor signalling. Accordingly, utilities of VGAM1233 include diagnosis, prevention and treatment of diseases and clinical conditions associated with RGS3. The function of RGS3 and its association with various diseases and clinical conditions, has been established by previous studies, as described hereinabove with reference to VGAM404. Transcription Factor Binding to IGHM Enhancer 3 (TFE3, Accession NM_006521) is another VGAM1233 host target gene. TFE3 BINDING SITE is HOST TARGET binding site found in the 3' untranslated region of mRNA encoded by TFE3, corresponding to a HOST TARGET binding site such as BINDING SITE I, BINDING SITE II or BINDING SITE III. Table 2 illustrates the complementarity of the nucleotide sequences of TFE3 BINDING SITE, designated SEQ ID:13275, to the nucleotide sequence of VGAM1233 RNA, herein designated VGAM RNA, also designated SEQ ID:3944.

Another function of VGAM1233 is therefore inhibition of Transcription Factor Binding to IGHM Enhancer 3 (TFE3, Accession NM_006521), a gene which is a positive-acting transcription factor that binds to the immunoglobulin enchancer mue3 motif. Accordingly, utilities of VGAM1233 include diagnosis, prevention and treatment of diseases and clinical conditions associated with TFE3. The function of TFE3 and its association with various diseases and clinical conditions, has been established by previous studies, as described hereinabove with reference to VGAM443. Tumor Suppressing Subtransferable Candidate 4 (TSSC4, Accession NM_005706) is another VGAM1233 host target gene. TSSC4 BINDING SITE is HOST TARGET binding site found in the 5' untranslated region of mRNA encoded by TSSC4, corresponding to a HOST TARGET binding site such as BINDING SITE I, BINDING SITE II or BINDING SITE III. Table 2 illustrates the complementarity of the nucleotide sequences of TSSC4 BINDING SITE, designated SEQ ID:12258, to the nucleotide sequence of VGAM1233 RNA, herein designated VGAM RNA, also designated SEQ ID:3944.

Another function of VGAM1233 is therefore inhibition of Tumor Suppressing Subtransferable Candidate 4 (TSSC4, Accession NM_005706), a gene which is of unknown function. Accordingly, utilities of VGAM1233 include diagnosis, prevention and treatment of diseases and clinical conditions associated with TSSC4. The function of TSSC4 has been established by previous studies. Lee et al. (1999) noted that 7 imprinted genes had been identified on 11p15: IGF2 (OMIM Ref. No. 147470), which encodes an important autocrine growth factor in cancer; H19 (OMIM Ref. No. 103280), an untranslated RNA whose imprinting regulates IGF2; ASCL2 (OMIM Ref. No. 601886), a homolog of Drosophila achaete-scute that is expressed in the trophoblast; KCNQ1 (OMIM Ref. No. 192500), which encodes a voltage-gated potassium channel; p57(KIP2) (CDKN1C; 600856), which encodes a cyclin-dependent kinase inhibitor; TSSC5 (IMPT1; 602631), which encodes a predicted transmembrane transporter; and TSSC3 (OMIM Ref. No. 602131), also known as IPL, a homolog of a mouse apoptosis-inducing gene. With the exception of IGF2, all of these genes are expressed from the maternal allele. Because of the large number of imprinted genes on 11p15, spanning approximately 1 Mb, this region appears to represent 1 of 2 known large imprinted domains in the human genome, the other being the Prader-Willi/Angelman syndrome domain of 15q11-q13 (see OMIM Ref. No. 105830). Koi et al. (1993) isolated a subchromosomal transferable fragment (STF) that suppresses in vitro growth of the rhabdomyosarcoma cell line RD, confirming the existence of 1 or more tumor suppressor genes within this region. Hu et al. (1997) found that the STF spans approximately 2.5 Mb, with D11S12 at its proximal end and D11S1318 at its distal end. Within a cluster of imprinted genes in this STF, Lee et al. (1999) identified 2 novel genes, designated TSSC4 and TSSC6 (OMIM Ref. No. 603853), that were not imprinted in any of the fetal or extraembryonic tissues examined. The TSSC4 cDNA encodes a predicted protein of 349 amino acids that shows no close similarity to previously reported proteins. Northern blot analysis revealed that the TSSC4 gene was expressed as an approximately 1.6-kb transcript in fetal brain, lung, liver, and kidney. The TSSC4 and TSSC6 genes are both located in the center of the 1-Mb imprinted domain on 11p15 that contains the 7 imprinted genes. Thus, the imprinted gene domain of 11p15 appears to contain at least 2 imprinted subdomains, between which the TSSC4 and TSSC6 genes substantially escape imprinting, due either to a lack of initial silencing or to an early developmental relaxation of imprinting.

Full details of the abovementioned studies are described in the following publications, the disclosure of which are hereby incorporated by reference:

Lee, M. P.; Brandenburg, S.; Landes, G. M.; Adams, M.; Miller, G.; Feinberg, A. P. : Two novel genes in the center of the 11p15 imprinted domain escape genomic imprinting. Hum. Molec. Genet. 8:683-690, 1999; and Lee, M. P.; Brandenburg, S.; Landes, G. M.; Adams, M.; Miller, G.; Feinberg, A. P.: Two novel genes in the center of the 11p15 imprinted domain escape genomic imprinting. Hum. Molec. Gene.

Further studies establishing the function and utilities of TSSC4 are found in John Hopkins OMIM database record ID 603852, and in sited publications numbered 491 and 7419 listed in the bibliography section hereinbelow, which are also hereby incorporated by reference. ATP-binding Cassette, Sub-family C (CFTR/MRP), Member 13 (ABCC13, Accession NM_138726) is another VGAM1233 host target gene. ABCC13 BINDING SITE is HOST TARGET binding site found in the 3' untranslated region of mRNA encoded by ABCC13, corresponding to a HOST TARGET binding site such as BINDING SITE I, BINDING SITE II or BINDING SITE III. Table 2 illustrates the complementarity of the nucleotide sequences of ABCC13 BINDING SITE, designated SEQ ID:28969, to the nucleotide sequence of VGAM1233 RNA, herein designated VGAM RNA, also designated SEQ ID:3944.

Another function of VGAM1233 is therefore inhibition of ATP-binding Cassette, Sub-family C (CFTR/MRP), Member 13 (ABCC13, Accession NM_138726). Accordingly, utilities of VGAM1233 include diagnosis, prevention and treatment of diseases and clinical conditions associated with ABCC13. Endothelial Differentiation, Sphingolipid G-protein-coupled Receptor, 1 (EDG1, Accession XM_001499) is another VGAM1233 host target gene. EDG1 BINDING SITE is HOST TARGET binding site found in the 3' untranslated region of mRNA encoded by EDG1, corresponding to a HOST TARGET binding site such as BINDING SITE I, BINDING SITE II or BINDING SITE III. Table 2 illustrates the complementarity of the nucleotide sequences of EDG1 BINDING SITE, designated SEQ ID:29841, to the nucleotide sequence of VGAM1233 RNA, herein designated VGAM RNA, also designated SEQ ID:3944.

Another function of VGAM1233 is therefore inhibition of Endothelial Differentiation, Sphingolipid G-protein-coupled Receptor, 1 (EDG1, Accession XM_001499). Accordingly, utilities of VGAM1233 include diagnosis, prevention and treatment of diseases and clinical conditions associated with EDG1. FLJ12568 (Accession NM_024993) is another VGAM1233 host target gene. FLJ12568 BINDING SITE is HOST TARGET binding site found in the 3' untranslated region of mRNA encoded by FLJ12568, corresponding to a HOST TARGET binding site such as BINDING SITE I, BINDING SITE II or BINDING SITE III. Table 2 illustrates the complementarity of the nucleotide sequences of FLJ12568 BINDING SITE, designated SEQ ID:24551, to the nucleotide sequence of VGAM1233 RNA, herein designated VGAM RNA, also designated SEQ ID:3944.

Another function of VGAM1233 is therefore inhibition of FLJ12568 (Accession NM_024993). Accordingly, utilities of VGAM1233 include diagnosis, prevention and treatment of diseases and clinical conditions associated with FLJ12568. LENG1 (Accession XM_097304) is another VGAM1233 host target gene. LENG1 BINDING SITE is HOST TARGET binding site found in the 5' untranslated region of mRNA encoded by LENG1, corresponding to a HOST TARGET binding site such as BINDING SITE I, BINDING SITE II or BINDING SITE III. Table 2 illustrates the complementarity of the nucleotide sequences of LENG1 BINDING SITE, designated SEQ ID:40860, to the nucleotide sequence of VGAM1233 RNA, herein designated VGAM RNA, also designated SEQ ID:3944.

Another function of VGAM1233 is therefore inhibition of LENG1 (Accession XM_097304). Accordingly, utilities of VGAM1233 include diagnosis, prevention and treatment of diseases and clinical conditions associated with LENG1. LIG-1 (Accession XM_033712) is another VGAM1233 host target gene. LIG-1 BINDING SITE is HOST TARGET binding site found in the 3' untranslated region of mRNA encoded by LIG-1, corresponding to a HOST TARGET binding site such as BINDING SITE I, BINDING SITE II or BINDING SITE III. Table 2 illustrates the complementarity of the nucleotide sequences of LIG-1 BINDING SITE, designated SEQ ID:31949, to the nucleotide sequence of VGAM1233 RNA, herein designated VGAM RNA, also designated SEQ ID:3944.

Another function of VGAM1233 is therefore inhibition of LIG-1 (Accession XM_033712). Accordingly, utilities of VGAM1233 include diagnosis, prevention and treatment of diseases and clinical conditions associated with LIG-1. MGC10999 (Accession NM_032307) is another VGAM1233 host target gene. MGC10999 BINDING SITE is HOST TARGET binding site found in the 5' untranslated region of mRNA encoded by MGC10999, corresponding to a HOST TARGET binding site such as BINDING SITE I, BINDING SITE II or BINDING SITE III. Table 2 illustrates the complementarity of the nucleotide sequences of MGC10999 BINDING SITE, designated SEQ ID:26087, to the nucleotide sequence of VGAM1233 RNA, herein designated VGAM RNA, also designated SEQ ID:3944.

Another function of VGAM1233 is therefore inhibition of MGC10999 (Accession NM_032307). Accordingly, utilities of VGAM1233 include diagnosis, prevention and treatment of diseases and clinical conditions associated with MGC10999. MGC2603 (Accession NM_024037) is another VGAM1233 host target gene. MGC2603 BINDING SITE is HOST TARGET binding site found in the 3' untranslated region of mRNA encoded by MGC2603, corresponding to a HOST TARGET binding site such as BINDING SITE I, BINDING SITE II or BINDING SITE III. Table 2 illustrates the complementarity of the nucleotide sequences of MGC2603 BINDING SITE, designated SEQ ID:23470, to the nucleotide sequence of VGAM1233 RNA, herein designated VGAM RNA, also designated SEQ ID:3944.

Another function of VGAM1233 is therefore inhibition of MGC2603 (Accession NM_024037). Accordingly, utilities of VGAM1233 include diagnosis, prevention and treatment of diseases and clinical conditions associated with MGC2603. MGC3113 (Accession NM_024035) is another VGAM1233 host target gene. MGC3113 BINDING SITE is HOST TARGET binding site found in the 3' untranslated region of mRNA encoded by MGC3113, corresponding to a HOST TARGET binding site such as BINDING SITE I, BINDING SITE II or BINDING SITE III. Table 2 illustrates the complementarity of the nucleotide sequences of MGC3113 BINDING SITE, designated SEQ ID:23467, to the nucleotide sequence of VGAM1233 RNA, herein designated VGAM RNA, also designated SEQ ID:3944.

Another function of VGAM1233 is therefore inhibition of MGC3113 (Accession NM_024035). Accordingly, utilities of VGAM1233 include diagnosis, prevention and treatment of diseases and clinical conditions associated with MGC3113. SIMRP7 (Accession XM_166462) is another VGAM1233 host target gene. SIMRP7 BINDING SITE is HOST TARGET binding site found in the 3' untranslated region of mRNA encoded by SIMRP7, corresponding to a HOST TARGET binding site such as BINDING SITE I, BINDING SITE II or BINDING SITE III. Table 2 illustrates the complementarity of the nucleotide sequences of SIMRP7 BINDING SITE, designated SEQ ID:44367, to the nucleotide sequence of VGAM1233 RNA, herein designated VGAM RNA, also designated SEQ ID:3944.

Another function of VGAM1233 is therefore inhibition of SIMRP7 (Accession XM_166462). Accordingly, utilities of VGAM1233 include diagnosis, prevention and treatment of diseases and clinical conditions associated with SIMRP7. Testis Specific, 14 (TSGA14, Accession NM_018718) is another VGAM1233 host target gene. TSGA14 BINDING SITE is HOST TARGET binding site found in the 3' untranslated region of mRNA encoded by TSGA14, corresponding to a HOST TARGET binding site such as BINDING SITE I, BINDING SITE II or BINDING SITE III. Table 2 illustrates the complementarity of the nucleotide sequences of TSGA14 BINDING SITE, designated SEQ ID:20792, to the nucleotide sequence of VGAM1233 RNA, herein designated VGAM RNA, also designated SEQ ID:3944.

Another function of VGAM1233 is therefore inhibition of Testis Specific, 14 (TSGA14, Accession NM_018718). Accordingly, utilities of VGAM1233 include diagnosis, prevention and treatment of diseases and clinical conditions associated with TSGA14. LOC122416 (Accession XM_058615) is another VGAM1233 host target gene. LOC122416 BINDING SITE is HOST TARGET binding site found in the 5' untranslated region of mRNA encoded by LOC122416, corresponding to a HOST TARGET binding site such as BINDING SITE I, BINDING SITE II or BINDING SITE III. Table 2 illustrates the complementarity of the nucleotide sequences of LOC122416 BINDING SITE, designated SEQ ID:36683, to the nucleotide sequence of VGAM1233 RNA, herein designated VGAM RNA, also designated SEQ ID:3944.

Another function of VGAM1233 is therefore inhibition of LOC122416 (Accession XM_058615). Accordingly, utilities of VGAM1233 include diagnosis, prevention and treatment of diseases and clinical conditions associated with LOC122416. LOC145439 (Accession XM_085144) is another VGAM1233 host target gene. LOC145439 BINDING SITE is HOST TARGET binding site found in the 5' untranslated region of mRNA encoded by LOC145439, corresponding to a HOST TARGET binding site such as BINDING SITE I, BINDING SITE II or BINDING SITE III. Table 2 illustrates the complementarity of the nucleotide sequences of LOC145439 BINDING SITE, designated SEQ ID:37863, to the nucleotide sequence of VGAM1233 RNA, herein designated VGAM RNA, also designated SEQ ID:3944.

Another function of VGAM1233 is therefore inhibition of LOC145439 (Accession XM_085144). Accordingly, utilities of VGAM1233 include diagnosis, prevention and treatment of diseases and clinical conditions associated with LOC145439. LOC149842 (Accession XM_097745) is another VGAM1233 host target gene. LOC149842 BINDING SITE is HOST TARGET binding site found in the 3' untranslated region of mRNA encoded by LOC149842, corresponding to a HOST TARGET binding site such as BINDING SITE I, BINDING SITE II or BINDING SITE III. Table 2 illustrates the complementarity of the nucleotide sequences of LOC149842 BINDING SITE, designated SEQ ID:41088, to the nucleotide sequence of VGAM1233 RNA, herein designated VGAM RNA, also designated SEQ ID:3944.

Another function of VGAM1233 is therefore inhibition of LOC149842 (Accession XM_097745). Accordingly, utilities of VGAM1233 include diagnosis, prevention and treatment of diseases and clinical conditions associated with LOC149842. LOC153338 (Accession XM_098361) is another VGAM1233 host target gene. LOC153338 BINDING SITE is HOST TARGET binding site found in the 5' untranslated region of mRNA encoded by LOC153338, corresponding to a HOST TARGET binding site such as BINDING SITE I, BINDING SITE II or BINDING SITE III. Table 2 illustrates the complementarity of the nucleotide sequences of LOC153338 BINDING SITE, designated SEQ ID:41606, to the nucleotide sequence of VGAM1233 RNA, herein designated VGAM RNA, also designated SEQ ID:3944.

Another function of VGAM1233 is therefore inhibition of LOC153338 (Accession XM_098361). Accordingly, utilities of VGAM1233 include diagnosis, prevention and treatment of diseases and clinical conditions associated with LOC153338. LOC158654 (Accession XM_088632) is another VGAM1233 host target gene. LOC158654 BINDING SITE is HOST TARGET binding site found in the 3' untranslated region of mRNA encoded by LOC158654, corresponding to a HOST TARGET binding site such as BINDING SITE I, BINDING SITE II or BINDING SITE III. Table 2 illustrates the complementarity of the nucleotide sequences of LOC158654 BINDING SITE, designated SEQ ID:39874, to the nucleotide sequence of VGAM1233 RNA, herein designated VGAM RNA, also designated SEQ ID:3944.

Another function of VGAM1233 is therefore inhibition of LOC158654 (Accession XM_088632). Accordingly, utilities of VGAM1233 include diagnosis, prevention and treatment of diseases and clinical conditions associated with LOC158654. LOC162333 (Accession XM_102591) is another VGAM1233 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42119, to the nucleotide sequence of VGAM1233 RNA, herein designated VGAM RNA, also designated SEQ ID:3944.

Another function of VGAM1233 is therefore inhibition of LOC162333 (Accession XM_102591). Accordingly, utilities of VGAM1233 include diagnosis, prevention and treatment of diseases and clinical conditions associated with LOC162333. LOC254659 (Accession XM_170822) is another VGAM1233 host target gene. LOC254659 BINDING SITE is HOST TARGET binding site found in the 5' untranslated region of mRNA encoded by LOC254659, corresponding to a HOST TARGET binding site such as BINDING SITE I, BINDING SITE II or BINDING SITE III. Table 2 illustrates the complementarity of the nucleotide sequences of LOC254659 BINDING SITE, designated SEQ ID:45599, to the nucleotide sequence of VGAM1233 RNA, herein designated VGAM RNA, also designated SEQ ID:3944.

Another function of VGAM1233 is therefore inhibition of LOC254659 (Accession XM_170822). Accordingly, utilities of VGAM1233 include diagnosis, prevention and treatment of diseases and clinical conditions associated with LOC254659. FIG. 1 further provides a conceptual description of a novel bioinformatically detected viral gene of the present invention, referred to here as Viral Genomic Address Messenger 1234 (VGAM1234) viral gene, which modulates expression of respective host target genes thereof, the function and utility of which host target genes is known in the art.

VGAM1234 is a novel bioinformatically detected regulatory, non protein coding, viral micro RNA (miRNA) gene. The method by which VGAM1234 was detected is described hereinabove with reference to FIGS. 1-8.

VGAM1234 gene, herein designated VGAM GENE, is a viral gene contained in the genome of Equine Herpesvirus 2. VGAM1234 host target gene, herein designated VGAM HOST TARGET GENE, is a human gene contained in the human genome.

VGAM1234 gene encodes a VGAM1234 precursor RNA, herein designated VGAM PRECURSOR RNA. Similar to other miRNA genes, and unlike most ordinary genes, VGAM1234 precursor RNA does not encode a protein. A nucleotide sequence identical or highly similar to the nucleotide sequence of VGAM1234 precursor RNA is designated SEQ ID:1220, and is provided hereinbelow with reference to the sequence listing part. Nucleotide sequence SEQ ID:1220 is located at position 11113 relative to the genome of Equine Herpesvirus 2.

VGAM1234 precursor RNA folds onto itself, forming VGAM1234 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1234 folded precursor RNA into VGAM1234 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM1234 RNA is designated SEQ ID:3945, and is provided hereinbelow with reference to the sequence listing part.

VGAM1234 host target gene, herein designated VGAM HOST TARGET GENE, encodes a corresponding messenger RNA, VGAM1234 host target RNA, herein designated VGAM HOST TARGET RNA. VGAM1234 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1234 RNA, herein designated VGAM RNA, binds complementarily to one or more host target binding sites located in untranslated regions of VGAM1234 host target RNA, herein designated VGAM HOST TARGET RNA. This complementary binding is due to the fact that the nucleotide sequence of VGAM1234 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1234 RNA, herein designated VGAM RNA, may have a different number of host target binding sites in untranslated regions of a VGAM1234 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1234 RNA, herein designated VGAM RNA, to host target binding sites on VGAM1234 host target RNA, herein designated VGAM HOST TARGET RNA, such as BINDING SITE I, BINDING SITE II and BINDING SITE III, inhibits translation of VGAM1234 host target RNA into VGAM1234 host target protein, herein designated VGAM HOST TARGET PROTEIN. VGAM host target protein is therefore outlined by a broken line.

It is appreciated that VGAM1234 host target gene, herein designated VGAM HOST TARGET GENE, in fact represents a plurality of VGAM1234 host target genes. The mRNA of each one of this plurality of VGAM1234 host target genes comprises one or more host target binding sites, each having a nucleotide sequence which is at least partly complementary to VGAM1234 RNA, herein designated VGAM RNA, and which when bound by VGAM1234 RNA causes inhibition of translation of respective one or more VGAM1234 host target proteins.

It is further appreciated by one skilled in the art that the mode of translational inhibition illustrated by FIG. 1 with specific reference to translational inhibition exerted by VGAM1234 gene, herein designated VGAM GENE, on one or more VGAM1234 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1234 is inhibition of expression of host target genes, as part of a novel viral mechanism of attacking a host. Accordingly, utilities of VGAM1234 include diagnosis, prevention and treatment of viral infection by Equine Herpesvirus 2. Specific functions, and accordingly utilities, of VGAM1234 correlate with, and may be deduced from, the identity of the host target genes which VGAM1234 binds and inhibits, and the function of these host target genes, as elaborated hereinbelow.

Nucleotide sequences of the VGAM1234 precursor RNA, herein designated VGAM PRECURSOR RNA, and of the 'diced' VGAM1234 RNA, herein designated VGAM RNA, and a schematic representation of the secondary folding of VGAM1234 folded precursor RNA, herein designated VGAM FOLDED PRECURSOR RNA, of VGAM1234 are further described hereinbelow with reference to Table 1.

Nucleotide sequences of host target binding sites, such as BINDING SITE-I, BINDING SITE-II and BINDING SITE-III of FIG. 1, found on VGAM1234 host target RNA, and schematic representation of the complementarity of each of these host target binding sites to VGAM1234 RNA, herein designated VGAM RNA, are described hereinbelow with reference to Table 2.

As mentioned hereinabove with reference to FIG. 1, a function of VGAM1234 gene, herein designated VGAM is inhibition of expression of VGAM1234 target genes. It is appreciated that specific functions, and accordingly utilities, of VGAM1234 correlate with, and may be deduced from, the identity of the target genes which VGAM1234 binds and inhibits, and the function of these target genes, as elaborated hereinbelow.

Requiem, Apoptosis Response Zinc Finger Gene (REQ, Accession NM_006268) is a VGAM1234 host target gene. REQ BINDING SITE is HOST TARGET binding site found in the 3' untranslated region of mRNA encoded by REQ, corresponding to a HOST TARGET binding site such as BINDING SITE I, BINDING SITE II or BINDING SITE III. Table 2 illustrates the complementarity of the nucleotide sequences of REQ BINDING SITE, designated SEQ ID:12952, to the nucleotide sequence of VGAM1234 RNA, herein designated VGAM RNA, also designated SEQ ID:3945.

A function of VGAM1234 is therefore inhibition of Requiem, Apoptosis Response Zinc Finger Gene (REQ, Accession NM_006268), a gene which is a putative zinc finger that is required for apoptosis in murine myeloid cell lines. Accordingly, utilities of VGAM1234 include diagnosis, prevention and treatment of diseases and clinical conditions associated with REQ. The function of REQ and its association with various diseases and clinical conditions, has been established by previous studies, as described hereinabove with reference to VGAM1224. CD109 (Accession NM_133493) is another VGAM1234 host target gene. CD109 BINDING SITE is HOST TARGET binding site found in the 3' untranslated region of mRNA encoded by CD109, corresponding to a HOST TARGET binding site such as BINDING SITE I, BINDING SITE II or BINDING SITE III. Table 2 illustrates the complementarity of the nucleotide sequences of CD109 BINDING SITE, designated SEQ ID:28570, to the nucleotide sequence of VGAM1234 RNA, herein designated VGAM RNA, also designated SEQ ID:3945.

Another function of VGAM1234 is therefore inhibition of CD109 (Accession NM_133493). Accordingly, utilities of VGAM1234 include diagnosis, prevention and treatment of diseases and clinical conditions associated with CD109. Ras and Rab Interactor 3 (RIN3, Accession NM_024832) is another VGAM1234 host target gene. RIN3 BINDING SITE is HOST TARGET binding site found in the 3' untranslated region of mRNA encoded by RIN3, corresponding to a HOST TARGET binding site such as BINDING SITE I, BINDING SITE II or BINDING SITE III. Table 2 illustrates the complementarity of the nucleotide sequences of RIN3 BINDING SITE, designated SEQ ID:24235, to the nucleotide sequence of VGAM1234 RNA, herein designated VGAM RNA, also designated SEQ ID:3945.

Another function of VGAM1234 is therefore inhibition of Ras and Rab Interactor 3 (RIN3, Accession NM_024832). Accordingly, utilities of VGAM1234 include diagnosis, prevention and treatment of diseases and clinical conditions associated with RIN3. LOC113655 (Accession NM_138431) is another VGAM1234 host target gene. LOC113655 BINDING SITE is HOST TARGET binding site found in the 5' untranslated region of mRNA encoded by LOC113655, corresponding to a HOST TARGET binding site such as BINDING SITE I, BINDING SITE II or BINDING SITE III. Table 2 illustrates the complementarity of the nucleotide sequences of LOC113655 BINDING SITE, designated SEQ ID:28795, to the nucleotide sequence of VGAM1234 RNA, herein designated VGAM RNA, also designated SEQ ID:3945.

Another function of VGAM1234 is therefore inhibition of LOC113655 (Accession NM_138431). Accordingly, utilities of VGAM1234 include diagnosis, prevention and treatment of diseases and clinical conditions associated with LOC113655. LOC145501 (Accession XM_085157) is another VGAM1234 host target gene. LOC145501 BINDING SITE is HOST TARGET binding site found in the 3' untranslated region of mRNA encoded by LOC145501, corresponding to a HOST TARGET binding site such as BINDING SITE I, BINDING SITE II or BINDING SITE III. Table 2 illustrates the complementarity of the nucleotide sequences of LOC145501 BINDING SITE, designated SEQ ID:37882, to the nucleotide sequence of VGAM1234 RNA, herein designated VGAM RNA, also designated SEQ ID:3945.

Another function of VGAM1234 is therefore inhibition of LOC145501 (Accession XM_085157). Accordingly, utilities of VGAM1234 include diagnosis, prevention and treatment of diseases and clinical conditions associated with LOC145501. LOC148046 (Accession XM_097375) is another VGAM1234 host target gene. LOC148046 BINDING SITE is HOST TARGET binding site found in the 3' untranslated region of mRNA encoded by LOC148046, corresponding to a HOST TARGET binding site such as BINDING SITE I, BINDING SITE II or BINDING SITE III. Table 2 illustrates the complementarity of the nucleotide sequences of LOC148046 BINDING SITE, designated SEQ ID:40866, to the nucleotide sequence of VGAM1234 RNA, herein designated VGAM RNA, also designated SEQ ID:3945.

Another function of VGAM1234 is therefore inhibition of LOC148046 (Accession XM_097375). Accordingly, utilities of VGAM1234 include diagnosis, prevention and treatment of diseases and clinical conditions associated with LOC148046. LOC196985 (Accession XM_116968) is another VGAM1234 host target gene. LOC196985 BINDING SITE is HOST TARGET binding site found in the 5' untranslated region of mRNA encoded by LOC196985, corresponding to a HOST TARGET binding site such as BINDING SITE I, BINDING SITE II or BINDING SITE III. Table 2 illustrates the complementarity of the nucleotide sequences of LOC196985 BINDING SITE, designated SEQ ID:43158, to the nucleotide sequence of VGAM1234 RNA, herein designated VGAM RNA, also designated SEQ ID:3945.

Another function of VGAM1234 is therefore inhibition of LOC196985 (Accession XM_116968). Accordingly, utilities of VGAM1234 include diagnosis, prevention and treatment of diseases and clinical conditions associated with LOC196985. LOC89919 (Accession XM_027244) is another VGAM1234 host target gene. LOC89919 BINDING SITE is HOST TARGET binding site found in the 5' untranslated region of mRNA encoded by LOC89919, corresponding to a HOST TARGET binding site such as BINDING SITE I, BINDING SITE II or BINDING SITE III. Table 2 illustrates the complementarity of the nucleotide sequences of LOC89919 BINDING SITE, designated SEQ ID:30464, to the nucleotide sequence of VGAM1234 RNA, herein designated VGAM RNA, also designated SEQ ID:3945.

Another function of VGAM1234 is therefore inhibition of LOC89919 (Accession XM_027244). Accordingly, utilities of VGAM1234 include diagnosis, prevention and treatment of diseases and clinical conditions associated with LOC89919. FIG. 1 further provides a conceptual description of a novel bioinformatically detected viral gene of the present invention, referred to here as Viral Genomic Address Messenger 1235 (VGAM1235) viral gene, which modulates expression of respective host target genes thereof, the function and utility of which host target genes is known in the art.

VGAM1235 is a novel bioinformatically detected regulatory, non protein coding, viral micro RNA (miRNA) gene. The method by which VGAM1235 was detected is described hereinabove with reference to FIGS. 1-8.

VGAM1235 gene, herein designated VGAM GENE, is a viral gene contained in the genome of Bovine Herpesvirus 4. VGAM1235 host target gene, herein designated VGAM HOST TARGET GENE, is a human gene contained in the human genome.

VGAM1235 gene encodes a VGAM1235 precursor RNA, herein designated VGAM PRECURSOR RNA. Similar to other miRNA genes, and unlike most ordinary genes, VGAM1235 precursor RNA does not encode a protein. A nucleotide sequence identical or highly similar to the nucleotide sequence of VGAM1235 precursor RNA is designated SEQ ID:1221, and is provided hereinbelow with reference to the sequence listing part. Nucleotide sequence SEQ ID:1221 is located at position 102206 relative to the genome of Bovine Herpesvirus 4.

VGAM1235 precursor RNA folds onto itself, forming VGAM1235 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1235 folded precursor RNA into VGAM1235 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1235 RNA is designated SEQ ID:3946, and is provided hereinbelow with reference to the sequence listing part.

VGAM1235 host target gene, herein designated VGAM HOST TARGET GENE, encodes a corresponding messenger RNA, VGAM1235 host target RNA, herein designated VGAM HOST TARGET RNA. VGAM1235 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1235 RNA, herein designated VGAM RNA, binds complementarily to one or more host target binding sites located in untranslated regions of VGAM1235 host target RNA, herein designated VGAM HOST TARGET RNA. This complementary binding is due to the fact that the nucleotide sequence of VGAM1235 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1235 RNA, herein designated VGAM RNA, may have a different number of host target binding sites in untranslated regions of a VGAM1235 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1235 RNA, herein designated VGAM RNA, to host target binding sites on VGAM1235 host target RNA, herein designated VGAM HOST TARGET RNA, such as BINDING SITE I, BINDING SITE II and BINDING SITE III, inhibits translation of VGAM1235 host target RNA into VGAM1235 host target protein, herein designated VGAM HOST TARGET PROTEIN. VGAM host target protein is therefore outlined by a broken line.

It is appreciated that VGAM1235 host target gene, herein designated VGAM HOST TARGET GENE, in fact represents a plurality of VGAM1235 host target genes. The mRNA of each one of this plurality of VGAM1235 host target genes comprises one or more host target binding sites, each having a nucleotide sequence which is at least partly complementary to VGAM1235 RNA, herein designated VGAM RNA, and which when bound by VGAM1235 RNA causes inhibition of translation of respective one or more VGAM1235 host target proteins.

It is further appreciated by one skilled in the art that the mode of translational inhibition illustrated by FIG. 1 with specific reference to translational inhibition exerted by VGAM1235 gene, herein designated VGAM GENE, on one or more VGAM1235 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1235 is inhibition of expression of host target genes, as part of a novel viral mechanism of attacking a host. Accordingly, utilities of VGAM1235 include diagnosis, prevention and treatment of viral infection by Bovine Herpesvirus 4. Specific functions, and accordingly utilities, of VGAM1235 correlate with, and may be deduced from, the identity of the host target genes which VGAM1235 binds and inhibits, and the function of these host target genes, as elaborated hereinbelow.

Nucleotide sequences of the VGAM1235 precursor RNA, herein designated VGAM PRECURSOR RNA, and of the 'diced' VGAM1235 RNA, herein designated VGAM RNA, and a schematic representation of the secondary folding of VGAM1235 folded precursor RNA, herein designated VGAM FOLDED PRECURSOR RNA, of VGAM1235 are further described hereinbelow with reference to Table 1.

Nucleotide sequences of host target binding sites, such as BINDING SITE-I, BINDING SITE-II and BINDING SITE-III of FIG. 1, found on VGAM1235 host target RNA, and schematic representation of the complementarity of each of these host target binding sites to VGAM1235 RNA, herein designated VGAM RNA, are described hereinbelow with reference to Table 2.

As mentioned hereinabove with reference to FIG. 1, a function of VGAM1235 gene, herein designated VGAM is inhibition of expression of VGAM1235 target genes. It is appreciated that specific functions, and accordingly utilities, of VGAM1235 correlate with, and may be deduced from, the identity of the target genes which VGAM1235 binds and inhibits, and the function of these target genes, as elaborated hereinbelow.

Adducin 2 (beta) (ADD2, Accession NM_017483) is a VGAM1235 host target gene. ADD2 BINDING SITE1 through ADD2 BINDING SITE4 are HOST TARGET binding sites found in untranslated regions of mRNA encoded by ADD2, corresponding to HOST TARGET binding sites such as BINDING SITE I, BINDING SITE II or BINDING SITE III. Table 2 illustrates the complementarity of the nucleotide sequences of ADD2 BINDING SITE1 through ADD2 BINDING SITE4, designated SEQ ID:18935, SEQ ID:18940, SEQ ID:18943 and SEQ ID:18948 respectively, to the nucleotide sequence of VGAM1235 RNA, herein designated VGAM RNA, also designated SEQ ID:3946.

A function of VGAM1235 is therefore inhibition of Adducin 2 (beta) (ADD2, Accession NM_017483), a gene which membrane-cytoskeleton- protein that promotes the assembly of the spectrin-actin network. Accordingly, utilities of VGAM1235 include diagnosis, prevention and treatment of diseases and clinical conditions associated with ADD2. The function of ADD2 and its association with various diseases and clinical conditions, has been established by previous studies, as described hereinabove with reference to VGAM1185. Procollagen (type III) N-endopeptidase (PCOLN3, Accession NM_002768) is another VGAM1235 host target gene. PCOLN3 BINDING SITE is HOST TARGET binding site found in the 3' untranslated region of mRNA encoded by PCOLN3, corresponding to a HOST TARGET binding site such as BINDING SITE I, BINDING SITE II or BINDING SITE III. Table 2 illustrates the complementarity of the nucleotide sequences of PCOLN3 BINDING SITE, designated SEQ ID:8662, to the nucleotide sequence of VGAM1235 RNA, herein designated VGAM RNA, also designated SEQ ID:3946.

Another function of VGAM1235 is therefore inhibition of Procollagen (type III) N-endopeptidase (PCOLN3, Accession NM_002768), a gene which is a member of the zincin superfamily of zinc-dependent metalloproteases. Accordingly, utilities of VGAM1235 include diagnosis, prevention and treatment of diseases and clinical conditions associated with PCOLN3. The function of PCOLN3 and its association with various diseases and clinical conditions, has been established by previous studies, as described hereinabove with reference to VGAM947. Transcription Factor 3 (E2A immunoglobulin enhancer binding factors E12/E47) (TCF3, Accession XM_047600) is another VGAM1235 host target gene. TCF3 BINDING SITE is HOST TARGET binding site found in the 3' untranslated region of mRNA encoded by TCF3, corresponding to a HOST TARGET binding site such as BINDING SITE I, BINDING SITE II or BINDING SITE III. Table 2 illustrates the complementarity of the nucleotide sequences of TCF3 BINDING SITE, designated SEQ ID:35009, to the nucleotide sequence of VGAM1235 RNA, herein designated VGAM RNA, also designated SEQ ID:3946.

Another function of VGAM1235 is therefore inhibition of Transcription Factor 3 (E2A immunoglobulin enhancer binding factors E12/E47) (TCF3, Accession XM_047600), a gene which plays major roles in determining tissue-specific cell fate during embryogenesis. Accordingly, utilities of VGAM1235 include diagnosis, prevention and treatment of diseases and clinical conditions associated with TCF3. The function of TCF3 and its association with various diseases and clinical conditions, has been established by previous studies, as described hereinabove with reference to VGAM144. DKFZp547I224 (Accession NM_020221) is another VGAM1235 host target gene. DKFZp547I224 BINDING SITE is HOST TARGET binding site found in the 5' untranslated region of mRNA encoded by DKFZp547I224, corresponding to a HOST TARGET binding site such as BINDING SITE I, BINDING SITE II or BINDING SITE III. Table 2 illustrates the complementarity of the nucleotide sequences of DKFZp547I224 BINDING SITE, designated SEQ ID:21473, to the nucleotide sequence of VGAM1235 RNA, herein designated VGAM RNA, also designated SEQ ID:3946.

Another function of VGAM1235 is therefore inhibition of DKFZp547I224 (Accession NM_020221). Accordingly, utilities of VGAM1235 include diagnosis, prevention and treatment of diseases and clinical conditions associated with DKFZp547I224. Fidgetin (FIGN, Accession NM_018086) is another VGAM1235 host target gene. FIGN BINDING SITE is HOST TARGET binding site found in the 5' untranslated region of mRNA encoded by FIGN, corresponding to a HOST TARGET binding site such as BINDING SITE I, BINDING SITE II or BINDING SITE III. Table 2 illustrates the complementarity of the nucleotide sequences of FIGN BINDING SITE, designated SEQ ID:19848, to the nucleotide sequence of VGAM1235 RNA, herein designated VGAM RNA, also designated SEQ ID:3946.

Another function of VGAM1235 is therefore inhibition of Fidgetin (FIGN, Accession NM_018086). Accordingly, utilities of VGAM1235 include diagnosis, prevention and treatment of diseases and clinical conditions associated with FIGN. FLJ12891 (Accession NM_024950) is another VGAM1235 host target gene. FLJ12891 BINDING SITE is HOST TARGET binding site found in the 3' untranslated region of mRNA encoded by FLJ12891, corresponding to a HOST TARGET binding site such as BINDING SITE I, BINDING SITE II or BINDING SITE III. Table 2 illustrates the complementarity of the nucleotide sequences of FLJ12891 BINDING SITE, designated SEQ ID:24510, to the nucleotide sequence of VGAM1235 RNA, herein designated VGAM RNA, also designated SEQ ID:3946.

Another function of VGAM1235 is therefore inhibition of FLJ12891 (Accession NM_024950). Accordingly, utilities of VGAM1235 include diagnosis, prevention and treatment of diseases and clinical conditions associated with FLJ12891. FLJ22865 (Accession NM_025109) is another VGAM1235 host target gene. FLJ22865 BINDING SITE is HOST TARGET binding site found in the 5' untranslated region of mRNA encoded by FLJ22865, corresponding to a HOST TARGET binding site such as BINDING SITE I, BINDING SITE II or BINDING SITE III. Table 2 illustrates the complementarity of the nucleotide sequences of FLJ22865 BINDING SITE, designated SEQ ID:24758, to the nucleotide sequence of VGAM1235 RNA, herein designated VGAM RNA, also designated SEQ ID:3946.

Another function of VGAM1235 is therefore inhibition of FLJ22865 (Accession NM_025109). Accordingly, utilities of VGAM1235 include diagnosis, prevention and treatment of diseases and clinical conditions associated with FLJ22865. KIAA0295 (Accession XM_042833) is another VGAM1235 host target gene. KIAA0295 BINDING SITE is HOST TARGET binding site found in the 3' untranslated region of mRNA encoded by KIAA0295, corresponding to a HOST TARGET binding site such as BINDING SITE I, BINDING SITE II or BINDING SITE III. Table 2 illustrates the complementarity of the nucleotide sequences of KIAA0295 BINDING SITE, designated SEQ ID:33782, to the nucleotide sequence of VGAM1235 RNA, herein designated VGAM RNA, also designated SEQ ID:3946.

Another function of VGAM1235 is therefore inhibition of KIAA0295 (Accession XM_042833). Accordingly, utilities of VGAM1235 include diagnosis, prevention and treatment of diseases and clinical conditions associated with KIAA0295. KIAA1280 (Accession XM_045766) is another VGAM1235 host target gene. KIAA1280 BINDING SITE is HOST TARGET binding site found in the 5' untranslated region of mRNA encoded by KIAA1280, corresponding to a HOST TARGET binding site such as BINDING SITE I, BINDING SITE II or BINDING SITE III. Table 2 illustrates the complementarity of the nucleotide sequences of KIAA1280 BINDING SITE, designated SEQ ID:34554, to the nucleotide sequence of VGAM1235 RNA, herein designated VGAM RNA, also designated SEQ ID:3946.

Another function of VGAM1235 is therefore inhibition of KIAA1280 (Accession XM_045766). Accordingly, utilities of VGAM1235 include diagnosis, prevention and treatment of diseases and clinical conditions associated with KIAA1280. KIAA1987 (Accession XM_113870) is another VGAM1235 host target gene. KIAA1987 BINDING SITE is HOST TARGET binding site found in the 3' untranslated region of mRNA encoded by KIAA1987, corresponding to a HOST TARGET binding site such as BINDING SITE I, BINDING SITE II or BINDING SITE III. Table 2 illustrates the complementarity of the nucleotide sequences of KIAA1987 BINDING SITE, designated SEQ ID:42493, to the nucleotide sequence of VGAM1235 RNA, herein designated VGAM RNA, also designated SEQ ID:3946.

Another function of VGAM1235 is therefore inhibition of KIAA1987 (Accession XM_113870). Accordingly, utilities of VGAM1235 include diagnosis, prevention and treatment of diseases and clinical conditions associated with KIAA1987. LIM and SH3 Protein 1 (LASP1, Accession NM_006148) is another VGAM1235 host target gene. LASP1 BINDING SITE is HOST TARGET binding site found in the 3' untranslated region of mRNA encoded by LASP1, corresponding to a HOST TARGET binding site such as BINDING SITE I, BINDING SITE II or BINDING SITE III. Table 2 illustrates the complementarity of the nucleotide sequences of LASP1 BINDING SITE, designated SEQ ID:12794, to the nucleotide sequence of VGAM1235 RNA, herein designated VGAM RNA, also designated SEQ ID:3946.

Another function of VGAM1235 is therefore inhibition of LIM and SH3 Protein 1 (LASP1, Accession NM_006148). Accordingly, utilities of VGAM1235 include diagnosis, prevention and treatment of diseases and clinical conditions associated with LASP1. Phosphodiesterase 4D Interacting Protein (myomegalin) (PDE4DIP, Accession XM_170929) is another VGAM1235 host target gene. PDE4DIP BINDING SITE is HOST TARGET binding site found in the 3' untranslated region of mRNA encoded by PDE4DIP, corresponding to a HOST TARGET binding site such as BINDING SITE I, BINDING SITE II or BINDING SITE III. Table 2 illustrates the complementarity of the nucleotide sequences of PDE4DIP BINDING SITE, designated SEQ ID:45708, to the nucleotide sequence of VGAM1235 RNA, herein designated VGAM RNA, also designated SEQ ID:3946.

Another function of VGAM1235 is therefore inhibition of Phosphodiesterase 4D Interacting Protein (myomegalin) (PDE4DIP, Accession XM_170929). Accordingly, utilities of VGAM1235 include diagnosis, prevention and treatment of diseases and clinical conditions associated with PDE4DIP. PRO1496 (Accession NM_018603) is another VGAM1235 host target gene. PRO1496 BINDING SITE is HOST TARGET binding site found in the 3" untranslated region of mRNA encoded by PRO1496, corresponding to a HOST TARGET binding site such as BINDING SITE I, BINDING SITE II or BINDING SITE III. Table 2 illustrates the complementarity of the nucleotide sequences of PRO1496 BINDING SITE, designated SEQ ID:20680, to the nucleotide sequence of VGAM1235 RNA, herein designated VGAM RNA, also designated SEQ ID:3946.

Another function of VGAM1235 is therefore inhibition of PRO1496 (Accession NM_018603). Accordingly, utilities of VGAM1235 include diagnosis, prevention and treatment of diseases and clinical conditions associated with PRO1496. LOC219920 (Accession XM_167787) is another VGAM1235 host target gene. LOC219920 BINDING SITE is HOST TARGET binding site found in the 5' untranslated region of mRNA encoded by LOC219920, corresponding to a HOST TARGET binding site such as BINDING SITE I, BINDING SITE II or BINDING SITE III. Table 2 illustrates the complementarity of the nucleotide sequences of LOC219920 BINDING SITE, designated SEQ ID:44807, to the nucleotide sequence of VGAM1235 RNA, herein designated VGAM RNA, also designated SEQ ID:3946.

Another function of VGAM1235 is therefore inhibition of LOC219920 (Accession XM_167787). Accordingly, utilities of VGAM1235 include diagnosis, prevention and treatment of diseases and clinical conditions associated with LOC219920. LOC92568 (Accession XM_045852) is another VGAM1235 host target gene. LOC92568 BINDING SITE is HOST TARGET binding site found in the 3' untranslated region of mRNA encoded by LOC92568, corresponding to a HOST TARGET binding site such as BINDING SITE I, BINDING SITE II or BINDING SITE III. Table 2 illustrates the complementarity of the nucleotide sequences of LOC92568 BINDING SITE, designated SEQ ID:34578, to the nucleotide sequence of VGAM1235 RNA, herein designated VGAM RNA, also designated SEQ ID:3946.

Another function of VGAM1235 is therefore inhibition of LOC92568 (Accession XM_045852). Accordingly, utilities of VGAM1235 include diagnosis, prevention and treatment of diseases and clinical conditions associated with LOC92568. FIG. 1 further provides a conceptual description of a novel bioinformatically detected viral gene of the present invention, referred to here as Viral Genomic Address Messenger 1236 (VGAM1236) viral gene, which modulates expression of respective host target genes thereof, the function and utility of which host target genes is known in the art.

VGAM1236 is a novel bioinformatically detected regulatory, non protein coding, viral micro RNA (miRNA) gene. The method by which VGAM1236 was detected is described hereinabove with reference to FIGS. 1-8.

VGAM1236 gene, herein designated VGAM GENE, is a viral gene contained in the genome of Bovine Herpesvirus 4. VGAM1236 host target gene, herein designated VGAM HOST TARGET GENE, is a human gene contained in the human genome.

VGAM1236 gene encodes a VGAM1236 precursor RNA, herein designated VGAM PRECURSOR RNA. Similar to other miRNA genes, and unlike most ordinary genes, VGAM1236 precursor RNA does not encode a protein. A nucleotide sequence identical or highly similar to the nucleotide sequence of VGAM1236 precursor RNA is designated SEQ ID:1222, and is provided hereinbelow with reference to the sequence listing part. Nucleotide sequence SEQ ID:1222 is located at position 104518 relative to the genome of Bovine Herpesvirus 4.

VGAM1236 precursor RNA folds onto itself, forming VGAM1236 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1236 folded precursor RNA into VGAM1236 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1236 RNA is designated SEQ ID:3947, and is provided hereinbelow with reference to the sequence listing part.

VGAM1236 host target gene, herein designated VGAM HOST TARGET GENE, encodes a corresponding messenger RNA, VGAM1236 host target RNA, herein designated VGAM HOST TARGET RNA. VGAM1236 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1236 RNA, herein designated VGAM RNA, binds complementarily to one or more host target binding sites located in untranslated regions of VGAM1236 host target RNA, herein designated VGAM HOST TARGET RNA. This complementary binding is due to the fact that the nucleotide sequence of VGAM1236 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1236 RNA, herein designated VGAM RNA, may have a different number of host target binding sites in untranslated regions of a VGAM1236 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1236 RNA, herein designated VGAM RNA, to host target binding sites on VGAM1236 host target RNA, herein designated VGAM HOST TARGET RNA, such as BINDING SITE I, BINDING SITE II and BINDING SITE III, inhibits translation of VGAM1236 host target RNA into VGAM1236 host target protein, herein designated VGAM HOST TARGET PROTEIN. VGAM host target protein is therefore outlined by a broken line.

It is appreciated that VGAM1236 host target gene, herein designated VGAM HOST TARGET GENE, in fact represents a plurality of VGAM1236 host target genes. The mRNA of each one of this plurality of VGAM1236 host target genes comprises one or more host target binding sites, each having a nucleotide sequence which is at least partly complementary to VGAM1236 RNA, herein designated VGAM RNA, and which when bound by VGAM1236 RNA causes inhibition of translation of respective one or more VGAM1236 host target proteins.

It is further appreciated by one skilled in the art that the mode of translational inhibition illustrated by FIG. 1 with specific reference to translational inhibition exerted by VGAM1236 gene, herein designated VGAM GENE, on one or more VGAM1236 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1236 is inhibition of expression of host target genes, as part of a novel viral mechanism of attacking a host. Accordingly, utilities of VGAM1236 include diagnosis, prevention and treatment of viral infection by Bovine Herpesvirus 4. Specific functions, and accordingly utilities, of VGAM1236 correlate with, and may be deduced from, the identity of the host target genes which VGAM1236 binds and inhibits, and the function of these host target genes, as elaborated hereinbelow.

Nucleotide sequences of the VGAM1236 precursor RNA, herein designated VGAM PRECURSOR RNA, and of the 'diced' VGAM1236 RNA, herein designated VGAM RNA, and a schematic representation of the secondary folding of VGAM1236 folded precursor RNA, herein designated VGAM FOLDED PRECURSOR RNA, of VGAM1236 are further described hereinbelow with reference to Table 1.

Nucleotide sequences of host target binding sites, such as BINDING SITE-I, BINDING SITE-II and BINDING SITE-III of FIG. 1, found on VGAM1236 host target RNA, and schematic representation of the complementarity of each of these host target binding sites to VGAM1236 RNA, herein designated VGAM RNA, are described hereinbelow with reference to Table 2.

As mentioned hereinabove with reference to FIG. 1, a function of VGAM1236 gene, herein designated VGAM is inhibition of expression of VGAM1236 target genes. It is appreciated that specific functions, and accordingly utilities, of VGAM1236 correlate with, and may be deduced from, the identity of the target genes which VGAM1236 binds and inhibits, and the function of these target genes, as elaborated hereinbelow.

Sex Comb On Midleg-like 2 (Drosophila) (SCML2, Accession NM_006089) is a VGAM1236 host target gene. SCML2 BINDING SITE is HOST TARGET binding site found in the 3' untranslated region of mRNA encoded by SCML2, corresponding to a HOST TARGET binding site such as BINDING SITE I, BINDING SITE II or BINDING SITE III. Table 2 illustrates the complementarity of the nucleotide sequences of SCML2 BINDING SITE, designated SEQ ID:12735, to the nucleotide sequence of VGAM1236 RNA, herein designated VGAM RNA, also designated SEQ ID:3947.

A function of VGAM1236 is therefore inhibition of Sex Comb On Midleg-like 2 (Drosophila) (SCML2, Accession NM_006089). Accordingly, utilities of VGAM1236 include diagnosis, prevention and treatment of diseases and clinical conditions associated with SCML2. TRAM (Accession NM_014294) is another VGAM1236 host target gene. TRAM BINDING SITE is HOST TARGET binding site found in the 3' untranslated region of mRNA encoded by TRAM, corresponding to a HOST TARGET binding site such as BINDING SITE I, BINDING SITE II or BINDING SITE III. Table 2 illustrates the complementarity of the nucleotide sequences of TRAM BINDING SITE, designated SEQ ID:15591, to the nucleotide sequence of VGAM1236 RNA, herein designated VGAM RNA, also designated SEQ ID:3947.

Another function of VGAM1236 is therefore inhibition of TRAM (Accession NM_014294). Accordingly, utilities of VGAM1236 include diagnosis, prevention and treatment of diseases and clinical conditions associated with TRAM. KIAA0831 (Accession NM_014924) is another VGAM1236 host target gene. KIAA0831 BINDING SITE is HOST TARGET binding site found in the 3" untranslated region of mRNA encoded by KIAA0831, corresponding to a HOST TARGET binding site such as BINDING SITE I, BINDING SITE II or BINDING SITE III. Table 2 illustrates the complementarity of the nucleotide sequences of KIAA0831 BINDING SITE, designated SEQ ID:17206, to the nucleotide sequence of VGAM1236 RNA, herein designated VGAM RNA, also designated SEQ ID:3947.

Another function of VGAM1236 is therefore inhibition of KIAA0831 (Accession NM_014924). Accordingly, utilities of VGAM1236 include diagnosis, prevention and treatment of diseases and clinical conditions associated with KIAA0831. KIAA1300 (Accession XM_031744) is another VGAM1236 host target gene. KIAA1300 BINDING SITE is HOST TARGET binding site found in the 3' untranslated region of mRNA encoded by KIAA1300, corresponding to a HOST TARGET binding site such as BINDING SITE I, BINDING SITE II or BINDING SITE III. Table 2 illustrates the complementarity of the nucleotide sequences of KIAA1300 BINDING SITE, designated SEQ ID:31480, to the nucleotide sequence of VGAM1236 RNA, herein designated VGAM RNA, also designated SEQ ID:3947.

Another function of VGAM1236 is therefore inhibition of KIAA1300 (Accession XM_031744). Accordingly, utilities of VGAM1236 include diagnosis, prevention and treatment of diseases and clinical conditions associated with KIAA1300. LOC130813 (Accession XM_065904) is another VGAM1236 host target gene. LOC130813 BINDING SITE is HOST TARGET binding site found in the 3' untranslated region of mRNA encoded by LOC130813, corresponding to a HOST TARGET binding site such as BINDING SITE I, BINDING SITE II or BINDING SITE III. Table 2 illustrates the complementarity of the nucleotide sequences of LOC130813 BINDING SITE, designated SEQ ID:37306, to the nucleotide sequence of VGAM1236 RNA, herein designated VGAM RNA, also designated SEQ ID:3947.

Another function of VGAM1236 is therefore inhibition of LOC130813 (Accession XM_065904). Accordingly, utilities of VGAM1236 include diagnosis, prevention and treatment of diseases and clinical conditions associated with LOC130813. FIG. 1 further provides a conceptual description of a novel bioinformatically detected viral gene of the present invention, referred to here as Viral Genomic Address Messenger 1237 (VGAM1237) viral gene, which modulates expression of respective host target genes thereof, the function and utility of which host target genes is known in the art.

VGAM1237 is a novel bioinformatically detected regulatory, non protein coding, viral micro RNA (miRNA) gene. The method by which VGAM1237 was detected is described hereinabove with reference to FIGS. 1-8.

VGAM1237 gene, herein designated VGAM GENE, is a viral gene contained in the genome of Bovine Herpesvirus 4. VGAM1237 host target gene, herein designated VGAM HOST TARGET GENE, is a human gene contained in the human genome.

VGAM1237 gene encodes a VGAM1237 precursor RNA, herein designated VGAM PRECURSOR RNA. Similar to other miRNA genes, and unlike most ordinary genes, VGAM1237 precursor RNA does not encode a protein. A nucleotide sequence identical or highly similar to the nucleotide sequence of VGAM1237 precursor RNA is designated SEQ ID:1223, and is provided hereinbelow with reference to the sequence listing part. Nucleotide sequence SEQ ID:1223 is located at position 100957 relative to the genome of Bovine Herpesvirus 4.

VGAM1237 precursor RNA folds onto itself, forming VGAM1237 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1237 folded precursor RNA into VGAM1237 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM1237 RNA is designated SEQ ID:3948, and is provided hereinbelow with reference to the sequence listing part.

VGAM1237 host target gene, herein designated VGAM HOST TARGET GENE, encodes a corresponding messenger RNA, VGAM1237 host target RNA, herein designated VGAM HOST TARGET RNA. VGAM1237 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1237 RNA, herein designated VGAM RNA, binds complementarily to one or more host target binding sites located in untranslated regions of VGAM1237 host target RNA, herein designated VGAM HOST TARGET RNA. This complementary binding is due to the fact that the nucleotide sequence of VGAM1237 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1237 RNA, herein designated VGAM RNA, may have a different number of host target binding sites in untranslated regions of a VGAM1237 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1237 RNA, herein designated VGAM RNA, to host target binding sites on VGAM1237 host target RNA, herein designated VGAM HOST TARGET RNA, such as BINDING SITE I, BINDING SITE II and BINDING SITE III, inhibits translation of VGAM1237 host target RNA into VGAM1237 host target protein, herein designated VGAM HOST TARGET PROTEIN. VGAM host target protein is therefore outlined by a broken line.

It is appreciated that VGAM1237 host target gene, herein designated VGAM HOST TARGET GENE, in fact represents a plurality of VGAM1237 host target genes. The mRNA of each one of this plurality of VGAM1237 host target genes comprises one or more host target binding sites, each having a nucleotide sequence which is at least partly complementary to VGAM1237 RNA, herein designated VGAM RNA, and which when bound by VGAM1237 RNA causes inhibition of translation of respective one or more VGAM1237 host target proteins.

It is further appreciated by one skilled in the art that the mode of translational inhibition illustrated by FIG. 1 with specific reference to translational inhibition exerted by VGAM1237 gene, herein designated VGAM GENE, on one or more VGAM1237 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1237 is inhibition of expression of host target genes, as part of a novel viral mechanism of attacking a host. Accordingly, utilities of VGAM1237 include diagnosis, prevention and treatment of viral infection by Bovine Herpesvirus 4. Specific functions, and accordingly utilities, of VGAM1237 correlate with, and may be deduced from, the identity of the host target genes which VGAM1237 binds and inhibits, and the function of these host target genes, as elaborated hereinbelow.

Nucleotide sequences of the VGAM1237 precursor RNA, herein designated VGAM PRECURSOR RNA, and of the 'diced' VGAM1237 RNA, herein designated VGAM RNA, and a schematic representation of the secondary folding of VGAM1237 folded precursor RNA, herein designated VGAM FOLDED PRECURSOR RNA, of VGAM1237 are further described hereinbelow with reference to Table 1.

Nucleotide sequences of host target binding sites, such as BINDING SITE-I, BINDING SITE-II and BINDING SITE-III of FIG. 1, found on VGAM1237 host target RNA, and schematic representation of the complementarity of each of these host target binding sites to VGAM1237 RNA, herein designated VGAM RNA, are described hereinbelow with reference to Table 2.

As mentioned hereinabove with reference to FIG. 1, a function of VGAM1237 gene, herein designated VGAM is inhibition of expression of VGAM1237 target genes. It is appreciated that specific functions, and accordingly utilities, of VGAM1237 correlate with, and may be deduced from, the identity of the target genes which VGAM1237 binds and inhibits, and the function of these target genes, as elaborated hereinbelow.

Core-binding Factor, Runt Domain, Alpha Subunit 2; Translocated To, 2 (CBFA2T2, Accession NM_005093) is a VGAM1237 host target gene. CBFA2T2 BINDING SITE is HOST TARGET binding site found in the 3' untranslated region of mRNA encoded by CBFA2T2, corresponding to a HOST TARGET binding site such as BINDING SITE I, BINDING SITE II or BINDING SITE III. Table 2 illustrates the complementarity of the nucleotide sequences of CBFA2T2 BINDING SITE, designated SEQ ID:11551, to the nucleotide sequence of VGAM1237 RNA, herein designated VGAM RNA, also designated SEQ ID:3948.

A function of VGAM1237 is therefore inhibition of Core-binding Factor, Runt Domain, Alpha Subunit 2; Translocated To, 2 (CBFA2T2, Accession NM_005093), a gene which is a putative transcription factor. Accordingly, utilities of VGAM1237 include diagnosis, prevention and treatment of diseases and clinical conditions associated with CBFA2T2. The function of CBFA2T2 and its association with various diseases and clinical conditions, has been established by previous studies, as described hereinabove with reference to VGAM152. RAB5B, Member RAS Oncogene Family (RAB5B, Accession NM_002868) is another VGAM1237 host target gene. RAB5B BINDING SITE is HOST TARGET binding site found in the 3' untranslated region of mRNA encoded by RAB5B, corresponding to a HOST TARGET binding site such as BINDING SITE I, BINDING SITE II or BINDING SITE III. Table 2 illustrates the complementarity of the nucleotide sequences of RAB5B BINDING SITE, designated SEQ ID:8773, to the nucleotide sequence of VGAM1237 RNA, herein designated VGAM RNA, also designated SEQ ID:3948.

Another function of VGAM1237 is therefore inhibition of RAB5B, Member RAS Oncogene Family (RAB5B, Accession NM_002868), a gene which is presumably involved in vesicular trafficking at the plasma membrane. Accordingly, utilities of VGAM1237 include diagnosis, prevention and treatment of diseases and clinical conditions associated with RAB5B. The function of RAB5B has been established by previous studies. A number of processes in eukaryotic cells are believed to be regulated by small, monomeric GTPases belonging to the RAS superfamily. A subset of these GTPases (the yeast YPTI/SEC4 gene products and their mammalian counterparts, the RAB proteins) plays a central role in membrane trafficking. Each of the several proteins of this subfamily that have been identified is thought to regulate vesicular trafficking at a specific subcellular compartment. The subcellular location of several RAB proteins has been determined by immunohistochemical methods. For example, RAB2 (OMIM Ref. No. 179509) is found in the intermediate recycling pathway between the endoplasmic reticulum and the Golgi complex. RAB6 (OMIM Ref. No. 179513) is distributed in the medial and trans Golgi. RAB4 (OMIM Ref. No. 179511) and RAB5A (OMIM Ref. No. 179512) are associated with the plasma membrane and early endosomes. Wilson and Wilson (1992) cloned cDNA of a novel member of the RAB family by screening a human umbilical vein endothelial cell cDNA library with oligonucleotide probes corresponding to a region conserved in all RAB proteins. The newly identified RAB protein was 81% identical to human RAB5, the canine counterpart of which had been localized to the plasma membrane and early endosomes. In light of this homology, Wilson and Wilson (1992) called the new member of the GTPase superfamily RAB5B. It is presumably involved in vesicular trafficking at the plasma membrane. By fluorescence in situ hybridization, Korenberg et al. (1995) mapped the RAB5B gene to 12q13.

Full details of the abovementioned studies are described in the following publications, the disclosure of which are hereby incorporated by reference:

Korenberg, J. R.; Chen, X.-N.; Adams, M. D.; Venter, J. C.: Toward a cDNA map of the human genome. Genomics 29:364-370, 1995; and Wilson, D. B.; Wilson, M. P.: Identification and subcellular localization of human rab5b, a new member of the ras-related superfamily of GTPases. J. Clin. Invest. 89:996-1005, 1992.

Further studies establishing the function and utilities of RAB5B are found in John Hopkins OMIM database record ID 179514, and in sited publications numbered 2545-2546 listed in the bibliography section hereinbelow, which are also hereby incorporated by reference. Sorbin and SH3 Domain Containing 1 (SORBS1, Accession NM_015385) is another VGAM1237 host target gene. SORBS1 BINDING SITE is HOST TARGET binding site found in the 5' untranslated region of mRNA encoded by SORBS1, corresponding to a HOST TARGET binding site such as BINDING SITE I, BINDING SITE II or BINDING SITE III. Table 2 illustrates the complementarity of the nucleotide sequences of SORBS1 BINDING SITE, designated SEQ ID:17688, to the nucleotide sequence of VGAM1237 RNA, herein designated VGAM RNA, also designated SEQ ID:3948.

Another function of VGAM1237 is therefore inhibition of Sorbin and SH3 Domain Containing 1 (SORBS1, Accession NM_015385), a gene which necessary for cell polarization during vegetative growth. Accordingly, utilities of VGAM1237 include diagnosis, prevention and treatment of diseases and clinical conditions associated with SORBS1. The function of SORBS1 and its association with various diseases and clinical conditions, has been established by previous studies, as described hereinabove with reference to VGAM475. Chromosome 20 Open Reading Frame 18 (C20orf18, Accession NM_031228) is another VGAM1237 host target gene. C20orf18 BINDING SITE is HOST TARGET binding site found in the 3' untranslated region of mRNA encoded by C20orf18, corresponding to a HOST TARGET binding site such as BINDING SITE I, BINDING SITE II or BINDING SITE III. Table 2 illustrates the complementarity of the nucleotide sequences of C20orf18 BINDING SITE, designated SEQ ID:25274, to the nucleotide sequence of VGAM1237 RNA, herein designated VGAM RNA, also designated SEQ ID:3948.

Another function of VGAM1237 is therefore inhibition of Chromosome 20 Open Reading Frame 18 (C20orf18, Accession NM_031228). Accordingly, utilities of VGAM1237 include diagnosis, prevention and treatment of diseases and clinical conditions associated with C20orf18. Chromosome 20 Open Reading Frame 30 (C20orf30, Accession NM_014145) is another VGAM1237 host target gene. C20orf30 BINDING SITE is HOST TARGET binding site found in the 3' untranslated region of mRNA encoded by C20orf30, corresponding to a HOST TARGET binding site such as BINDING SITE I, BINDING SITE II or BINDING SITE III. Table 2 illustrates the complementarity of the nucleotide sequences of C20orf30 BINDING SITE, designated SEQ ID:15430, to the nucleotide sequence of VGAM1237 RNA, herein designated VGAM RNA, also designated SEQ ID:3948.

Another function of VGAM1237 is therefore inhibition of Chromosome 20 Open Reading Frame 30 (C20orf30, Accession NM_014145). Accordingly, utilities of VGAM1237 include diagnosis, prevention and treatment of diseases and clinical conditions associated with C20orf30. FLJ13612 (Accession NM_025202) is another VGAM1237 host target gene. FLJ13612 BINDING SITE is HOST TARGET binding site found in the 3' untranslated region of mRNA encoded by FLJ13612, corresponding to a HOST TARGET binding site such as BINDING SITE I, BINDING SITE II or BINDING SITE III. Table 2 illustrates the complementarity of the nucleotide sequences of FLJ13612 BINDING SITE, designated SEQ ID:24864, to the nucleotide sequence of VGAM1237 RNA, herein designated VGAM RNA, also designated SEQ ID:3948.

Another function of VGAM1237 is therefore inhibition of FLJ13612 (Accession NM_025202). Accordingly, utilities of VGAM1237 include diagnosis, prevention and treatment of diseases and clinical conditions associated with FLJ13612. Growth Hormone Inducible Transmembrane Protein (GHITM, Accession NM_014394) is another VGAM1237 host target gene. GHITM BINDING SITE is HOST TARGET binding site found in the 3' untranslated region of mRNA encoded by GHITM, corresponding to a HOST TARGET binding site such as BINDING SITE I, BINDING SITE II or BINDING SITE III. Table 2 illustrates the complementarity of the nucleotide sequences of GHITM BINDING SITE, designated SEQ ID:15726, to the nucleotide sequence of VGAM1237 RNA, herein designated VGAM RNA, also designated SEQ ID:3948.

Another function of VGAM1237 is therefore inhibition of Growth Hormone Inducible Transmembrane Protein (GHITM, Accession NM_014394). Accordingly, utilities of VGAM1237 include diagnosis, prevention and treatment of diseases and clinical conditions associated with GHITM. KIAA0700 (Accession XM_050561) is another VGAM1237 host target gene. KIAA0700 BINDING SITE is HOST TARGET binding site found in the 3' untranslated region of mRNA encoded by KIAA0700, corresponding to a HOST TARGET binding site such as BINDING SITE I, BINDING SITE II or BINDING SITE III. Table 2 illustrates the complementarity of the nucleotide sequences of KIAA0700 BINDING SITE, designated SEQ ID:35660, to the nucleotide sequence of VGAM1237 RNA, herein designated VGAM RNA, also designated SEQ ID:3948.

Another function of VGAM1237 is therefore inhibition of KIAA0700 (Accession XM_050561). Accordingly, utilities of VGAM1237 include diagnosis, prevention and treatment of diseases and clinical conditions associated with KIAA0700. KIAA1877 (Accession XM_038616) is another VGAM1237 host target gene. KIAA1877 BINDING SITE is HOST TARGET binding site found in the 3' untranslated region of mRNA encoded by KIAA1877, corresponding to a HOST TARGET binding site such as BINDING SITE I, BINDING SITE II or BINDING SITE III. Table 2 illustrates the complementarity of the nucleotide sequences of KIAA1877 BINDING SITE, designated SEQ ID:32884, to the nucleotide sequence of VGAM1237 RNA, herein designated VGAM RNA, also designated SEQ ID:3948.

Another function of VGAM1237 is therefore inhibition of KIAA1877 (Accession XM_038616). Accordingly, utilities of VGAM1237 include diagnosis, prevention and treatment of diseases and clinical conditions associated with KIAA1877. Ras Association (RalGDS/AF-6) Domain Family 2 (RASSF2, Accession NM_014737) is another VGAM1237 host target gene. RASSF2 BINDING SITE is HOST TARGET binding site found in the 3' untranslated region of mRNA encoded by RASSF2, corresponding to a HOST TARGET binding site such as BINDING SITE I, BINDING SITE II or BINDING SITE III. Table 2 illustrates the complementarity of the nucleotide sequences of RASSF2 BINDING SITE, designated SEQ ID:16394, to the nucleotide sequence of VGAM1237 RNA, herein designated VGAM RNA, also designated SEQ ID:3948.

Another function of VGAM1237 is therefore inhibition of Ras Association (RalGDS/AF-6) Domain Family 2 (RASSF2, Accession NM_014737). Accordingly, utilities of VGAM1237 include diagnosis, prevention and treatment of diseases and clinical conditions associated with RASSF2. SPEC1 (Accession NM_020239) is another VGAM1237 host target gene. SPEC1 BINDING SITE is HOST TARGET binding site found in the 3' untranslated region of mRNA encoded by SPEC1, corresponding to a HOST TARGET binding site such as BINDING SITE I, BINDING SITE II or BINDING SITE III. Table 2 illustrates the complementarity of the nucleotide sequences of SPEC1 BINDING SITE, designated SEQ ID:21512, to the nucleotide sequence of VGAM1237 RNA, herein designated VGAM RNA, also designated SEQ ID:3948.

Another function of VGAM1237 is therefore inhibition of SPEC1 (Accession NM_020239). Accordingly, utilities of VGAM1237 include diagnosis, prevention and treatment of diseases and clinical conditions associated with SPEC1. LOC143425 (Accession XM_113695) is another VGAM1237 host target gene. LOC143425 BINDING SITE is HOST TARGET binding site found in the 3' untranslated region of mRNA encoded by LOC143425, corresponding to a HOST TARGET binding site such as BINDING SITE I, BINDING SITE II or BINDING SITE III. Table 2 illustrates the complementarity of the nucleotide sequences of LOC143425 BINDING SITE, designated SEQ ID:42348, to the nucleotide sequence of VGAM1237 RNA, herein designated VGAM RNA, also designated SEQ ID:3948.

Another function of VGAM1237 is therefore inhibition of LOC143425 (Accession XM_113695). Accordingly, utilities of VGAM1237 include diagnosis, prevention and treatment of diseases and clinical conditions associated with LOC143425. LOC149832 (Accession XM_097733) is another VGAM1237 host target gene. LOC149832 BINDING SITE is HOST TARGET binding site found in the 5' untranslated region of mRNA encoded by LOC149832, corresponding to a HOST TARGET binding site such as BINDING SITE I, BINDING SITE II or BINDING SITE III. Table 2 illustrates the complementarity of the nucleotide sequences of LOC149832 BINDING SITE, designated SEQ ID:41082, to the nucleotide sequence of VGAM1237 RNA, herein designated VGAM RNA, also designated SEQ ID:3948.

Another function of VGAM1237 is therefore inhibition of LOC149832 (Accession XM_097733). Accordingly, utilities of VGAM1237 include diagnosis, prevention and treatment of diseases and clinical conditions associated with LOC149832. LOC150319 (Accession XM_086816) is another VGAM1237 host target gene. LOC150319 BINDING SITE is HOST TARGET binding site found in the 3' untranslated region of mRNA encoded by LOC150319, corresponding to a HOST TARGET binding site such as BINDING SITE I, BINDING SITE II or BINDING SITE III. Table 2 illustrates the complementarity of the nucleotide sequences of LOC150319 BINDING SITE, designated SEQ ID:38895, to the nucleotide sequence of VGAM1237 RNA, herein designated VGAM RNA, also designated SEQ ID:3948.

Another function of VGAM1237 is therefore inhibition of LOC150319 (Accession XM_086816). Accordingly, utilities of VGAM1237 include diagnosis, prevention and treatment of diseases and clinical conditions associated with LOC150319. FIG. 1 further provides a conceptual description of a novel bioinformatically detected viral gene of the present invention, referred to here as Viral Genomic Address Messenger 1238 (VGAM1238) viral gene, which modulates expression of respective host target genes thereof, the function and utility of which host target genes is known in the art.

VGAM1238 is a novel bioinformatically detected regulatory, non protein coding, viral micro RNA (miRNA) gene. The method by which VGAM1238 was detected is described hereinabove with reference to FIGS. 1-8.

VGAM1238 gene, herein designated VGAM GENE, is a viral gene contained in the genome of Bovine Herpesvirus 4. VGAM1238 host target gene, herein designated VGAM HOST TARGET GENE, is a human gene contained in the human genome.

VGAM1238 gene encodes a VGAM1238 precursor RNA, herein designated VGAM PRECURSOR RNA. Similar to other miRNA genes, and unlike most ordinary genes, VGAM1238 precursor RNA does not encode a protein. A nucleotide sequence identical or highly similar to the nucleotide sequence of VGAM1238 precursor RNA is designated SEQ ID:1224, and is provided hereinbelow with reference to the sequence listing part. Nucleotide sequence SEQ ID:1224 is located at position 105956 relative to the genome of Bovine Herpesvirus 4.

VGAM1238 precursor RNA folds onto itself, forming VGAM1238 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1238 folded precursor RNA into VGAM1238 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1238 RNA is designated SEQ ID:3949, and is provided hereinbelow with reference to the sequence listing part.

VGAM1238 host target gene, herein designated VGAM HOST TARGET GENE, encodes a corresponding messenger RNA, VGAM1238 host target RNA, herein designated VGAM HOST TARGET RNA. VGAM1238 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1238 RNA, herein designated VGAM RNA, binds complementarily to one or more host target binding sites located in untranslated regions of VGAM1238 host target RNA, herein designated VGAM HOST TARGET RNA. This complementary binding is due to the fact that the nucleotide sequence of VGAM1238 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1238 RNA, herein designated VGAM RNA, may have a different number of host target binding sites in untranslated regions of a VGAM1238 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1238 RNA, herein designated VGAM RNA, to host target binding sites on VGAM1238 host target RNA, herein designated VGAM HOST TARGET RNA, such as BINDING SITE I, BINDING SITE II and BINDING SITE III, inhibits translation of VGAM1238 host target RNA into VGAM1238 host target protein, herein designated VGAM HOST TARGET PROTEIN. VGAM host target protein is therefore outlined by a broken line.

It is appreciated that VGAM1238 host target gene, herein designated VGAM HOST TARGET GENE, in fact represents a plurality of VGAM1238 host target genes. The mRNA of each one of this plurality of VGAM1238 host target genes comprises one or more host target binding sites, each having a nucleotide sequence which is at least partly complementary to VGAM1238 RNA, herein designated VGAM RNA, and which when bound by VGAM1238 RNA causes inhibition of translation of respective one or more VGAM1238 host target proteins.

It is further appreciated by one skilled in the art that the mode of translational inhibition illustrated by FIG. 1 with specific reference to translational inhibition exerted by VGAM1238 gene, herein designated VGAM GENE, on one or more VGAM1238 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1238 is inhibition of expression of host target genes, as part of a novel viral mechanism of attacking a host. Accordingly, utilities of VGAM1238 include diagnosis, prevention and treatment of viral infection by Bovine Herpesvirus 4. Specific functions, and accordingly utilities, of VGAM1238 correlate with, and may be deduced from, the identity of the host target genes which VGAM1238 binds and inhibits, and the function of these host target genes, as elaborated hereinbelow.

Nucleotide sequences of the VGAM1238 precursor RNA, herein designated VGAM PRECURSOR RNA, and of the 'diced' VGAM1238 RNA, herein designated VGAM RNA, and a schematic representation of the secondary folding of VGAM1238 folded precursor RNA, herein designated VGAM FOLDED PRECURSOR RNA, of VGAM1238 are further described hereinbelow with reference to Table 1.

Nucleotide sequences of host target binding sites, such as BINDING SITE-I, BINDING SITE-II and BINDING SITE-III of FIG. 1, found on VGAM1238 host target RNA, and schematic representation of the complementarity of each of these host target binding sites to VGAM1238 RNA, herein designated VGAM RNA, are described hereinbelow with reference to Table 2.

As mentioned hereinabove with reference to FIG. 1, a function of VGAM1238 gene, herein designated VGAM is inhibition of expression of VGAM1238 target genes. It is appreciated that specific functions, and accordingly utilities, of VGAM1238 correlate with, and may be deduced from, the identity of the target genes which VGAM1238 binds and inhibits, and the function of these target genes, as elaborated hereinbelow.

AXIN1 Up-regulated 1 (AXUD1, Accession NM_033027) is a VGAM1238 host target gene. AXUD1 BINDING SITE is HOST TARGET binding site found in the 3' untranslated region of mRNA encoded by AXUD1, corresponding to a HOST TARGET binding site such as BINDING SITE I, BINDING SITE II or BINDING SITE III. Table 2 illustrates the complementarity of the nucleotide sequences of AXUD1 BINDING SITE, designated SEQ ID:26916, to the nucleotide sequence of VGAM1238 RNA, herein designated VGAM RNA, also designated SEQ ID:3949.

A function of VGAM1238 is therefore inhibition of AXIN1 Up-regulated 1 (AXUD1, Accession NM_033027). Accordingly, utilities of VGAM1238 include diagnosis, prevention and treatment of diseases and clinical conditions associated with AXUD1. Calcium Channel, Voltage-dependent, Alpha 2/delta Subunit 2 (CACNA2D2, Accession NM_006030) is another VGAM1238 host target gene. CACNA2D2 BINDING SITE is HOST TARGET binding site found in the 3' untranslated region of mRNA encoded by CACNA2D2, corresponding to a HOST TARGET binding site such as BINDING SITE I, BINDING SITE II or BINDING SITE III. Table 2 illustrates the complementarity of the nucleotide sequences of CACNA2D2 BINDING SITE, designated SEQ ID:12647, to the nucleotide sequence of VGAM1238 RNA, herein designated VGAM RNA, also designated SEQ ID:3949.

Another function of VGAM1238 is therefore inhibition of Calcium Channel, Voltage-dependent, Alpha 2/delta Subunit 2 (CACNA2D2, Accession NM_006030), a gene which is a calcium channel protein which plays an important role in excitation-contraction coupling. Accordingly, utilities of VGAM1238 include diagnosis, prevention and treatment of diseases and clinical conditions associated with CACNA2D2. The function of CACNA2D2 and its association with various diseases and clinical conditions, has been established by previous studies, as described hereinabove with reference to VGAM203. Chemokine (C-X3-C motif) Receptor 1 (CX3CR1, Accession XM_047502) is another VGAM1238 host target gene. CX3CR1 BINDING SITE is HOST TARGET binding site found in the 3' untranslated region of mRNA encoded by CX3CR1, corresponding to a HOST TARGET binding site such as BINDING SITE I, BINDING SITE II or BINDING SITE III. Table 2 illustrates the complementarity of the nucleotide sequences of CX3CR1 BINDING SITE, designated SEQ ID:34977, to the nucleotide sequence of VGAM1238 RNA, herein designated VGAM RNA, also designated SEQ ID:3949.

Another function of VGAM1238 is therefore inhibition of Chemokine (C-X3-C motif) Receptor 1 (CX3CR1, Accession XM_047502), a gene which mediates both the adhesive and migratory functions of fractalkine. Accordingly, utilities of VGAM1238 include diagnosis, prevention and treatment of diseases and clinical conditions associated with CX3CR1. The function of CX3CR1 and its association with various diseases and clinical conditions, has been established by previous studies, as described hereinabove with reference to VGAM25. Peroxisome Biogenesis Factor 10 (PEX10, Accession NM_002617) is another VGAM1238 host target gene. PEX10 BINDING SITE is HOST TARGET binding site found in the 3' untranslated region of mRNA encoded by PEX10, corresponding to a HOST TARGET binding site such as BINDING SITE I, BINDING SITE II or BINDING SITE III. Table 2 illustrates the complementarity of the nucleotide sequences of PEX10 BINDING SITE, designated SEQ ID:8478, to the nucleotide sequence of VGAM1238 RNA, herein designated VGAM RNA, also designated SEQ ID:3949.

Another function of VGAM1238 is therefore inhibition of Peroxisome Biogenesis Factor 10 (PEX10, Accession NM_002617). Accordingly, utilities of VGAM1238 include diagnosis, prevention and treatment of diseases and clinical conditions associated with PEX10. Ribonucleotide Reductase M2 B (TP53 inducible) (RRM2B, Accession XM_042096) is another VGAM1238 host target gene. RRM2B BINDING SITE is HOST TARGET binding site found in the 3' untranslated region of mRNA encoded by RRM2B, corresponding to a HOST TARGET binding site such as BINDING SITE I, BINDING SITE II or BINDING SITE III. Table 2 illustrates the complementarity of the nucleotide sequences of RRM2B BINDING SITE, designated SEQ ID:33687, to the nucleotide sequence of VGAM1238 RNA, herein designated VGAM RNA, also designated SEQ ID:3949.

Another function of VGAM1238 is therefore inhibition of Ribonucleotide Reductase M2 B (TP53 inducible) (RRM2B, Accession XM_042096). Accordingly, utilities of VGAM1238 include diagnosis, prevention and treatment of diseases and clinical conditions associated with RRM2B. Tumor-associated Calcium Signal Transducer 2 (TACSTD2, Accession NM_002353) is another VGAM1238 host target gene. TACSTD2 BINDING SITE is HOST TARGET binding site found in the 3' untranslated region of mRNA encoded by TACSTD2, corresponding to a HOST TARGET binding site such as BINDING SITE I, BINDING SITE II or BINDING SITE III. Table 2 illustrates the complementarity of the nucleotide sequences of TACSTD2 BINDING SITE, designated SEQ ID:8157, to the nucleotide sequence of VGAM1238 RNA, herein designated VGAM RNA, also designated SEQ ID:3949.

Another function of VGAM1238 is therefore inhibition of Tumor-associated Calcium Signal Transducer 2 (TACSTD2, Accession NM_002353), a gene which belongs to ga733 tumor-associated antigen gene family and may function as growth factor receptors. Accordingly, utilities of VGAM1238 include diagnosis, prevention and treatment of diseases and clinical conditions associated with TACSTD2. The function of TACSTD2 and its association with various diseases and clinical conditions, has been established by previous studies, as described hereinabove with reference to VGAM210. DKFZP564D116 (Accession XM_051050) is another VGAM1238 host target gene. DKFZP564D116 BINDING SITE is HOST TARGET binding site found in the 3' untranslated region of mRNA encoded by DKFZP564D116, corresponding to a HOST TARGET binding site such as BINDING SITE I, BINDING SITE II or BINDING SITE III. Table 2 illustrates the complementarity of the nucleotide sequences of DKFZP564D116 BINDING SITE, designated SEQ ID:35733, to the nucleotide sequence of VGAM1238 RNA, herein designated VGAM RNA, also designated SEQ ID:3949.

Another function of VGAM1238 is therefore inhibition of DKFZP564D116 (Accession XM_051050). Accordingly, utilities of VGAM1238 include diagnosis, prevention and treatment of diseases and clinical conditions associated with DKFZP564D116. FLJ14855 (Accession NM_033210) is another VGAM1238 host target gene. FLJ14855 BINDING SITE is HOST TARGET binding site found in the 3' untranslated region of mRNA encoded by FLJ14855, corresponding to a HOST TARGET binding site such as BINDING SITE I, BINDING SITE II or BINDING SITE III. Table 2 illustrates the complementarity of the nucleotide sequences of FLJ14855 BINDING SITE, designated SEQ ID:27057, to the nucleotide sequence of VGAM1238 RNA, herein designated VGAM RNA, also designated SEQ ID:3949.

Another function of VGAM1238 is therefore inhibition of FLJ14855 (Accession NM_033210). Accordingly, utilities of VGAM1238 include diagnosis, prevention and treatment of diseases and clinical conditions associated with FLJ14855. FLJ21709 (Accession XM_085480) is another VGAM1238 host target gene. FLJ21709 BINDING SITE is HOST TARGET binding site found in the 3' untranslated region of mRNA encoded by FLJ21709, corresponding to a HOST TARGET binding site such as BINDING SITE I, BINDING SITE II or BINDING SITE III. Table 2 illustrates the complementarity of the nucleotide sequences of FLJ21709 BINDING SITE, designated SEQ ID:38166, to the nucleotide sequence of VGAM1238 RNA, herein designated VGAM RNA, also designated SEQ ID:3949.

Another function of VGAM1238 is therefore inhibition of FLJ21709 (Accession XM_085480). Accordingly, utilities of VGAM1238 include diagnosis, prevention and treatment of diseases and clinical conditions associated with FLJ21709. FLJ22477 (Accession NM_024735) is another VGAM1238 host target gene. FLJ22477 BINDING SITE is HOST TARGET binding site found in the 3' untranslated region of mRNA encoded by FLJ22477, corresponding to a HOST TARGET binding site such as BINDING SITE I, BINDING SITE II or BINDING SITE III. Table 2 illustrates the complementarity of the nucleotide sequences of FLJ22477 BINDING SITE, designated SEQ ID:24074, to the nucleotide sequence of VGAM1238 RNA, herein designated VGAM RNA, also designated SEQ ID:3949.

Another function of VGAM1238 is therefore inhibition of FLJ22477 (Accession NM_024735). Accordingly, utilities of VGAM1238 include diagnosis, prevention and treatment of diseases and clinical conditions associated with FLJ22477. Golgi Associated, Gamma Adaptin Ear Containing, ARF Binding Protein 2 (GGA2, Accession NM_015044) is another VGAM1238 host target gene. GGA2 BINDING SITE1 and GGA2 BINDING SITE2 are HOST TARGET binding sites found in untranslated regions of mRNA encoded by GGA2, corresponding to HOST TARGET binding sites such as BINDING SITE I, BINDING SITE II or BINDING SITE III. Table 2 illustrates the complementarity of the nucleotide sequences of GGA2 BINDING SITE1 and GGA2

BINDING SITE2, designated SEQ ID:17396 and SEQ ID:28916 respectively, to the nucleotide sequence of VGAM1238 RNA, herein designated VGAM RNA, also designated SEQ ID:3949.

Another function of VGAM1238 is therefore inhibition of Golgi Associated, Gamma Adaptin Ear Containing, ARF Binding Protein 2 (GGA2, Accession NM_015044). Accordingly, utilities of VGAM1238 include diagnosis, prevention and treatment of diseases and clinical conditions associated with GGA2. MGC16075 (Accession NM_032761) is another VGAM1238 host target gene. MGC16075 BINDING SITE is HOST TARGET binding site found in the 3' untranslated region of mRNA encoded by MGC16075, corresponding to a HOST TARGET binding site such as BINDING SITE I, BINDING SITE II or BINDING SITE III. Table 2 illustrates the complementarity of the nucleotide sequences of MGC16075 BINDING SITE, designated SEQ ID:26503, to the nucleotide sequence of VGAM1238 RNA, herein designated VGAM RNA, also designated SEQ ID:3949.

Another function of VGAM1238 is therefore inhibition of MGC16075 (Accession NM_032761). Accordingly, utilities of VGAM1238 include diagnosis, prevention and treatment of diseases and clinical conditions associated with MGC16075. POPX1 (Accession NM_014906) is another VGAM1238 host target gene. POPX1 BINDING SITE is HOST TARGET binding site found in the 3' untranslated region of mRNA encoded by POPX1, corresponding to a HOST TARGET binding site such as BINDING SITE I, BINDING SITE II or BINDING SITE III. Table 2 illustrates the complementarity of the nucleotide sequences of POPX1 BINDING SITE, designated SEQ ID:17115, to the nucleotide sequence of VGAM1238 RNA, herein designated VGAM RNA, also designated SEQ ID:3949.

Another function of VGAM1238 is therefore inhibition of POPX1 (Accession NM_014906). Accordingly, utilities of VGAM1238 include diagnosis, prevention and treatment of diseases and clinical conditions associated with POPX1. RALGPS1A (Accession NM_014636) is another VGAM1238 host target gene. RALGPS1A BINDING SITE is HOST TARGET binding site found in the 3' untranslated region of mRNA encoded by RALGPS1A, corresponding to a HOST TARGET binding site such as BINDING SITE I, BINDING SITE II or BINDING SITE III. Table 2 illustrates the complementarity of the nucleotide sequences of RALGPS1A BINDING SITE, designated SEQ ID:16013, to the nucleotide sequence of VGAM1238 RNA, herein designated VGAM RNA, also designated SEQ ID:3949.

Another function of VGAM1238 is therefore inhibition of RALGPS1A (Accession NM_014636). Accordingly, utilities of VGAM1238 include diagnosis, prevention and treatment of diseases and clinical conditions associated with RALGPS1A. RSP3 (Accession NM_031924) is another VGAM1238 host target gene. RSP3 BINDING SITE is HOST TARGET binding site found in the 5' untranslated region of mRNA encoded by RSP3, corresponding to a HOST TARGET binding site such as BINDING SITE I, BINDING SITE II or BINDING SITE III. Table 2 illustrates the complementarity of the nucleotide sequences of RSP3 BINDING SITE, designated SEQ ID:25671, to the nucleotide sequence of VGAM1238 RNA, herein designated VGAM RNA, also designated SEQ ID:3949.

Another function of VGAM1238 is therefore inhibition of RSP3 (Accession NM_031924). Accordingly, utilities of VGAM1238 include diagnosis, prevention and treatment of diseases and clinical conditions associated with RSP3. LOC138399 (Accession XM_059971) is another VGAM1238 host target gene. LOC138399 BINDING SITE is HOST TARGET binding site found in the 5' untranslated region of mRNA encoded by LOC138399, corresponding to a HOST TARGET binding site such as BINDING SITE I, BINDING SITE II or BINDING SITE III. Table 2 illustrates the complementarity of the nucleotide sequences of LOC138399 BINDING SITE, designated SEQ ID:37129, to the nucleotide sequence of VGAM1238 RNA, herein designated VGAM RNA, also designated SEQ ID:3949.

Another function of VGAM1238 is therefore inhibition of LOC138399 (Accession XM_059971). Accordingly, utilities of VGAM1238 include diagnosis, prevention and treatment of diseases and clinical conditions associated with LOC138399. LOC139231 (Accession XM_060020) is another VGAM1238 host target gene. LOC139231 BINDING SITE is HOST TARGET binding site found in the 5' untranslated region of mRNA encoded by LOC139231, corresponding to a HOST TARGET binding site such as BINDING SITE I, BINDING SITE II or BINDING SITE III. Table 2 illustrates the complementarity of the nucleotide sequences of LOC139231 BINDING SITE, designated SEQ ID:37141, to the nucleotide sequence of VGAM1238 RNA, herein designated VGAM RNA, also designated SEQ ID:3949.

Another function of VGAM1238 is therefore inhibition of LOC139231 (Accession XM_060020). Accordingly, utilities of VGAM1238 include diagnosis, prevention and treatment of diseases and clinical conditions associated with LOC139231. LOC149706 (Accession XM_097718) is another VGAM1238 host target gene. LOC149706 BINDING SITE is HOST TARGET binding site found in the 5' untranslated region of mRNA encoded by LOC149706, corresponding to a HOST TARGET binding site such as BINDING SITE I, BINDING SITE II or BINDING SITE III. Table 2 illustrates the complementarity of the nucleotide sequences of LOC149706 BINDING SITE, designated SEQ ID:41056, to the nucleotide sequence of VGAM1238 RNA, herein designated VGAM RNA, also designated SEQ ID:3949.

Another function of VGAM1238 is therefore inhibition of LOC149706 (Accession XM_097718). Accordingly, utilities of VGAM1238 include diagnosis, prevention and treatment of diseases and clinical conditions associated with LOC149706. LOC150282 (Accession XM_086852) is another VGAM1238 host target gene. LOC150282 BINDING SITE is HOST TARGET binding site found in the 5' untranslated region of mRNA encoded by LOC150282, corresponding to a HOST TARGET binding site such as BINDING SITE I, BINDING SITE II or BINDING SITE III. Table 2 illustrates the complementarity of the nucleotide sequences of LOC150282 BINDING SITE, designated SEQ ID:38918, to the nucleotide sequence of VGAM1238 RNA, herein designated VGAM RNA, also designated SEQ ID:3949.

Another function of VGAM1238 is therefore inhibition of LOC150282 (Accession XM_086852). Accordingly, utilities of VGAM1238 include diagnosis, prevention and treatment of diseases and clinical conditions associated with LOC150282. LOC221474 (Accession XM_166464) is another VGAM1238 host target gene. LOC221474 BINDING SITE is HOST TARGET binding site found in the 5' untranslated region of mRNA encoded by LOC221474, corresponding to a HOST TARGET binding site such as BINDING SITE I, BINDING SITE II or BINDING SITE III. Table 2 illustrates the complementarity of the nucleotide sequences of LOC221474 BINDING SITE, designated SEQ ID:44376, to the nucleotide sequence of VGAM1238 RNA, herein designated VGAM RNA, also designated SEQ ID:3949.

Another function of VGAM1238 is therefore inhibition of LOC221474 (Accession XM_166464). Accordingly, utilities of VGAM1238 include diagnosis, prevention and treatment of diseases and clinical conditions associated with LOC221474. LOC93589 (Accession XM_052387) is another VGAM1238 host target gene. LOC93589 BINDING SITE is HOST TARGET binding site found in the 3' untranslated region of mRNA encoded by LOC93589, corresponding to a HOST TARGET binding site such as BINDING SITE I, BINDING SITE II or BINDING SITE III. Table 2 illustrates the complementarity of the nucleotide sequences of LOC93589 BINDING SITE, designated SEQ ID:35974, to the nucleotide sequence of VGAM1238 RNA, herein designated VGAM RNA, also designated SEQ ID:3949.

Another function of VGAM1238 is therefore inhibition of LOC93589 (Accession XM_052387). Accordingly, utilities of VGAM1238 include diagnosis, prevention and treatment of diseases and clinical conditions associated with LOC93589. FIG. 1 further provides a conceptual description of a novel bioinformatically detected viral gene of the present invention, referred to here as Viral Genomic Address Messenger 1239 (VGAM1239) viral gene, which modulates expression of respective host target genes thereof, the function and utility of which host target genes is known in the art.

VGAM1239 is a novel bioinformatically detected regulatory, non protein coding, viral micro RNA (miRNA) gene. The method by which VGAM1239 was detected is described hereinabove with reference to FIGS. 1-8.

VGAM1239 gene, herein designated VGAM GENE, is a viral gene contained in the genome of Bovine Herpesvirus 4. VGAM1239 host target gene, herein designated VGAM HOST TARGET GENE, is a human gene contained in the human genome.

VGAM1239 gene encodes a VGAM1239 precursor RNA, herein designated VGAM PRECURSOR RNA. Similar to other miRNA genes, and unlike most ordinary genes, VGAM1239 precursor RNA does not encode a protein. A nucleotide sequence identical or highly similar to the nucleotide sequence of VGAM1239 precursor RNA is designated SEQ ID:1225, and is provided hereinbelow with reference to the sequence listing part. Nucleotide sequence SEQ ID:1225 is located at position 106225 relative to the genome of Bovine Herpesvirus 4.

VGAM1239 precursor RNA folds onto itself, forming VGAM1239 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1239 folded precursor RNA into VGAM1239 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1239 RNA is designated SEQ ID:3950, and is provided hereinbelow with reference to the sequence listing part.

VGAM1239 host target gene, herein designated VGAM HOST TARGET GENE, encodes a corresponding messenger RNA, VGAM1239 host target RNA, herein designated VGAM HOST TARGET RNA. VGAM1239 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1239 RNA, herein designated VGAM RNA, binds complementarily to one or more host target binding sites located in untranslated regions of VGAM1239 host target RNA, herein designated VGAM HOST TARGET RNA. This complementary binding is due to the fact that the nucleotide sequence of VGAM1239 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1239 RNA, herein designated VGAM RNA, may have a different number of host target binding sites in untranslated regions of a VGAM1239 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1239 RNA, herein designated VGAM RNA, to host target binding sites on VGAM1239 host target RNA, herein designated VGAM HOST TARGET RNA, such as BINDING SITE I, BINDING SITE II and BINDING SITE III, inhibits translation of VGAM1239 host target RNA into VGAM1239 host target protein, herein designated VGAM HOST TARGET PROTEIN. VGAM host target protein is therefore outlined by a broken line.

It is appreciated that VGAM1239 host target gene, herein designated VGAM HOST TARGET GENE, in fact represents a plurality of VGAM1239 host target genes. The mRNA of each one of this plurality of VGAM1239 host target genes comprises one or more host target binding sites, each having a nucleotide sequence which is at least partly complementary to VGAM1239 RNA, herein designated VGAM RNA, and which when bound by VGAM1239 RNA causes inhibition of translation of respective one or more VGAM1239 host target proteins.

It is further appreciated by one skilled in the art that the mode of translational inhibition illustrated by FIG. 1 with specific reference to translational inhibition exerted by VGAM1239 gene, herein designated VGAM GENE, on one or more VGAM1239 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1239 is inhibition of expression of host target genes, as part of a novel viral mechanism of attacking a host. Accordingly, utilities of VGAM1239 include diagnosis, prevention and treatment of viral infection by Bovine Herpesvirus 4. Specific functions, and accordingly utilities, of VGAM1239 correlate with, and may be deduced from, the identity of the host target genes which VGAM1239 binds and inhibits, and the function of these host target genes, as elaborated hereinbelow.

Nucleotide sequences of the VGAM1239 precursor RNA, herein designated VGAM PRECURSOR RNA, and of the 'diced' VGAM1239 RNA, herein designated VGAM RNA, and a schematic representation of the secondary folding of VGAM1239 folded precursor RNA, herein designated VGAM FOLDED PRECURSOR RNA, of VGAM1239 are further described hereinbelow with reference to Table 1.

Nucleotide sequences of host target binding sites, such as BINDING SITE-I, BINDING SITE-II and BINDING SITE-III of FIG. 1, found on VGAM1239 host target RNA, and schematic representation of the complementarity of each of these host target binding sites to VGAM1239 RNA, herein designated VGAM RNA, are described hereinbelow with reference to Table 2.

As mentioned hereinabove with reference to FIG. 1, a function of VGAM1239 gene, herein designated VGAM is inhibition of expression of VGAM1239 target genes. It is appreciated that specific functions, and accordingly utilities, of VGAM1239 correlate with, and may be deduced from, the identity of the target genes which VGAM1239 binds and inhibits, and the function of these target genes, as elaborated hereinbelow.

Collagen, Type III, Alpha 1 (Ehlers-Danlos syndrome type IV, autosomal dominant) (COL3A1, Accession NM_000090) is a VGAM1239 host target gene. COL3A1 BINDING SITE is HOST TARGET binding site found in the 3' untranslated region of mRNA encoded by COL3A1, corresponding to a HOST TARGET binding site such as BINDING SITE I, BINDING SITE II or BINDING SITE III. Table 2 illustrates the complementarity of the nucleotide sequences of COL3A1 BINDING SITE, designated SEQ ID:5543, to the nucleotide sequence of VGAM1239 RNA, herein designated VGAM RNA, also designated SEQ ID:3950.

A function of VGAM1239 is therefore inhibition of Collagen, Type III, Alpha 1 (Ehlers-Danlos syndrome type IV, autosomal dominant) (COL3A1, Accession NM_000090). Accordingly, utilities of VGAM1239 include diagnosis, prevention and treatment of diseases and clinical conditions associated with COL3A1. CXYorf1 (Accession XM_088704) is another VGAM1239 host target gene. CXYorf1 BINDING SITE is HOST TARGET binding site found in the 5' untranslated region of mRNA encoded by CXYorf1, corresponding to a HOST TARGET binding site such as BINDING SITE I, BINDING SITE II or BINDING SITE III. Table 2 illustrates the complementarity of the nucleotide sequences of CXYorf1 BINDING SITE, designated SEQ ID:39903, to the nucleotide sequence of VGAM1239 RNA, herein designated VGAM RNA, also designated SEQ ID:3950.

Another function of VGAM1239 is therefore inhibition of CXYorf1 (Accession XM_088704). Accordingly, utilities of VGAM1239 include diagnosis, prevention and treatment of diseases and clinical conditions associated with CXYorf1. TRIP-Br2 (Accession NM_014755) is another VGAM1239 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16490, to the nucleotide sequence of VGAM1239 RNA, herein designated VGAM RNA, also designated SEQ ID:3950.

Another function of VGAM1239 is therefore inhibition of TRIP-Br2 (Accession NM_014755). Accordingly, utilities of VGAM1239 include diagnosis, prevention and treatment of diseases and clinical conditions associated with TRIP-Br2. LOC199725 (Accession XM_117119) is another VGAM1239 host target gene. LOC199725 BINDING SITE is HOST TARGET binding site found in the 3' untranslated region of mRNA encoded by LOC199725, corresponding to a HOST TARGET binding site such as BINDING SITE I, BINDING SITE II or BINDING SITE III. Table 2 illustrates the complementarity of the nucleotide sequences of LOC199725 BINDING SITE, designated SEQ ID:43241, to the nucleotide sequence of VGAM1239 RNA, herein designated VGAM RNA, also designated SEQ ID:3950.

Another function of VGAM1239 is therefore inhibition of LOC199725 (Accession XM_117119). Accordingly, utilities of VGAM1239 include diagnosis, prevention and treatment of diseases and clinical conditions associated with LOC199725. LOC200093 (Accession XM_032184) is another VGAM1239 host target gene. LOC200093 BINDING SITE is HOST TARGET binding site found in the 5' untranslated region of mRNA encoded by LOC200093, corresponding to a HOST TARGET binding site such as BINDING SITE I, BINDING SITE II or BINDING SITE III. Table 2 illustrates the complementarity of the nucleotide sequences of LOC200093 BINDING SITE, designated SEQ ID:31595, to the nucleotide sequence of VGAM1239 RNA, herein designated VGAM RNA, also designated SEQ ID:3950.

Another function of VGAM1239 is therefore inhibition of LOC200093 (Accession XM_032184). Accordingly, utilities of VGAM1239 include diagnosis, prevention and treatment of diseases and clinical conditions associated with LOC200093. LOC91040 (Accession XM_035641) is another VGAM1239 host target gene. LOC91040 BINDING SITE is HOST TARGET binding site found in the 5' untranslated region of mRNA encoded by LOC91040, corresponding to a HOST TARGET binding site such as BINDING SITE I, BINDING SITE II or BINDING SITE III. Table 2 illustrates the complementarity of the nucleotide sequences of LOC91040 BINDING SITE, designated SEQ ID:32312, to the nucleotide sequence of VGAM1239 RNA, herein designated VGAM RNA, also designated SEQ ID:3950.

Another function of VGAM1239 is therefore inhibition of LOC91040 (Accession XM_035641). Accordingly, utilities of VGAM1239 include diagnosis, prevention and treatment of diseases and clinical conditions associated with LOC91040. LOC91464 (Accession XM_038589) is another VGAM1239 host target gene. LOC91464 BINDING SITE is HOST TARGET binding site found in the 3' untranslated region of mRNA encoded by LOC91464, corresponding to a HOST TARGET binding site such as BINDING SITE I, BINDING SITE II or BINDING SITE III. Table 2 illustrates the complementarity of the nucleotide sequences of LOC91464 BINDING SITE, designated SEQ ID:32873, to the nucleotide sequence of VGAM1239 RNA, herein designated VGAM RNA, also designated SEQ ID:3950.

Another function of VGAM1239 is therefore inhibition of LOC91464 (Accession XM_038589). Accordingly, utilities of VGAM1239 include diagnosis, prevention and treatment of diseases and clinical conditions associated with LOC91464. FIG. 1 further provides a conceptual description of a novel bioinformatically detected viral gene of the present invention, referred to here as Viral Genomic Address Messenger 1240 (VGAM1240) viral gene, which modulates expression of respective host target genes thereof, the function and utility of which host target genes is known in the art.

VGAM1240 is a novel bioinformatically detected regulatory, non protein coding, viral micro RNA (miRNA) gene. The method by which VGAM1240 was detected is described hereinabove with reference to FIGS. 1-8.

VGAM1240 gene, herein designated VGAM GENE, is a viral gene contained in the genome of Bovine Herpesvirus 4. VGAM1240 host target gene, herein designated VGAM HOST TARGET GENE, is a human gene contained in the human genome.

VGAM1240 gene encodes a VGAM1240 precursor RNA, herein designated VGAM PRECURSOR RNA. Similar to other miRNA genes, and unlike most ordinary genes, VGAM1240 precursor RNA does not encode a protein. A nucleotide sequence identical or highly similar to the nucleotide sequence of VGAM1240 precursor RNA is designated SEQ ID:1226, and is provided hereinbelow with reference to the sequence listing part. Nucleotide sequence SEQ ID:1226 is located at position 100575 relative to the genome of Bovine Herpesvirus 4.

VGAM1240 precursor RNA folds onto itself, forming VGAM1240 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1240 folded precursor RNA into VGAM1240 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM1240 RNA is designated SEQ ID:3951, and is provided hereinbelow with reference to the sequence listing part.

VGAM1240 host target gene, herein designated VGAM HOST TARGET GENE, encodes a corresponding messenger RNA, VGAM1240 host target RNA, herein designated VGAM HOST TARGET RNA. VGAM1240 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1240 RNA, herein designated VGAM RNA, binds complementarily to one or more host target binding sites located in untranslated regions of VGAM1240 host target RNA, herein designated VGAM HOST TARGET RNA. This complementary binding is due to the fact that the nucleotide sequence of VGAM1240 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1240 RNA, herein designated VGAM RNA, may have a different number of host target binding sites in untranslated regions of a VGAM1240 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1240 RNA, herein designated VGAM RNA, to host target binding sites on VGAM1240 host target RNA, herein designated VGAM HOST TARGET RNA, such as BINDING SITE I, BINDING SITE II and BINDING SITE III, inhibits translation of VGAM1240 host target RNA into VGAM1240 host target protein, herein designated VGAM HOST TARGET PROTEIN. VGAM host target protein is therefore outlined by a broken line.

It is appreciated that VGAM1240 host target gene, herein designated VGAM HOST TARGET GENE, in fact represents a plurality of VGAM1240 host target genes. The mRNA of each one of this plurality of VGAM1240 host target genes comprises one or more host target binding sites, each having a nucleotide sequence which is at least partly complementary to VGAM1240 RNA, herein designated VGAM RNA, and which when bound by VGAM1240 RNA causes inhibition of translation of respective one or more VGAM1240 host target proteins.

It is further appreciated by one skilled in the art that the mode of translational inhibition illustrated by FIG. 1 with specific reference to translational inhibition exerted by VGAM1240 gene, herein designated VGAM GENE, on one or more VGAM1240 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1240 is inhibition of expression of host target genes, as part of a novel viral mechanism of attacking a host. Accordingly, utilities of VGAM1240 include diagnosis, prevention and treatment of viral infection by Bovine Herpesvirus 4. Specific functions, and accordingly utilities, of VGAM1240 correlate with, and may be deduced from, the identity of the host target genes which VGAM1240 binds and inhibits, and the function of these host target genes, as elaborated hereinbelow.

Nucleotide sequences of the VGAM1240 precursor RNA, herein designated VGAM PRECURSOR RNA, and of the 'diced' VGAM1240 RNA, herein designated VGAM RNA, and a schematic representation of the secondary folding of VGAM1240 folded precursor RNA, herein designated VGAM FOLDED PRECURSOR RNA, of VGAM1240 are further described hereinbelow with reference to Table 1.

Nucleotide sequences of host target binding sites, such as BINDING SITE-I, BINDING SITE-II and BINDING SITE-III of FIG. 1, found on VGAM1240 host target RNA, and schematic representation of the complementarity of each of these host target binding sites to VGAM1240 RNA, herein designated VGAM RNA, are described hereinbelow with reference to Table 2.

As mentioned hereinabove with reference to FIG. 1, a function of VGAM1240 gene, herein designated VGAM is inhibition of expression of VGAM1240 target genes. It is appreciated that specific functions, and accordingly utilities, of VGAM1240 correlate with, and may be deduced from, the identity of the target genes which VGAM1240 binds and inhibits, and the function of these target genes, as elaborated hereinbelow.

Aryl-hydrocarbon Receptor Nuclear Translocator 2 (ARNT2, Accession NM_014862) is a VGAM1240 host target gene. ARNT2 BINDING SITE is HOST TARGET binding site found in the 3' untranslated region of mRNA encoded by ARNT2, corresponding to a HOST TARGET binding site such as BINDING SITE I, BINDING SITE II or BINDING SITE III. Table 2 illustrates the complementarity of the nucleotide sequences of ARNT2 BINDING SITE, designated SEQ ID:16931, to the nucleotide sequence of VGAM1240 RNA, herein designated VGAM RNA, also designated SEQ ID:3951.

A function of VGAM1240 is therefore inhibition of Aryl-hydrocarbon Receptor Nuclear Translocator 2 (ARNT2, Accession NM_014862), a gene which specifically recognizes the xenobiotic response element (xre). Accordingly, utilities of VGAM1240 include diagnosis, prevention and treatment of diseases and clinical conditions associated with ARNT2. The function of ARNT2 and its association with various diseases and clinical conditions, has been established by previous studies, as described hereinabove with reference to VGAM345. Arginine Vasopressin Receptor 1A (AVPR1A, Accession NM_000706) is another VGAM1240 host target gene. AVPR1A BINDING SITE is HOST TARGET binding site found in the 3' untranslated region of mRNA encoded by AVPR1A, corresponding to a HOST TARGET binding site such as BINDING SITE I, BINDING SITE II or BINDING SITE III. Table 2 illustrates the complementarity of the nucleotide sequences of AVPR1A BINDING SITE, designated SEQ ID:6377, to the nucleotide sequence of VGAM1240 RNA, herein designated VGAM RNA, also designated SEQ ID:3951.

Another function of VGAM1240 is therefore inhibition of Arginine Vasopressin Receptor 1A (AVPR1A, Accession NM_000706), a gene which mediates cell contraction and proliferation, platelet aggregation, release of coagulation factor, and glycogenolysis. Accordingly, utilities of VGAM1240 include diagnosis, prevention and treatment of diseases and clinical conditions associated with AVPR1A. The function of AVPR1A and its association with various diseases and clinical conditions, has been established by previous studies, as described hereinabove with reference to VGAM549. Kelch-like 2, Mayven (Drosophila) (KLHL2, Accession NM_007246) is another VGAM1240 host target gene. KLHL2 BINDING SITE is HOST TARGET binding site found in the 3' untranslated region of mRNA encoded by KLHL2, corresponding to a HOST TARGET binding site such as BINDING SITE I, BINDING SITE II or BINDING SITE III. Table 2 illustrates the complementarity of the nucleotide sequences of KLHL2 BINDING SITE, designated SEQ ID:14113, to the nucleotide sequence of VGAM1240 RNA, herein designated VGAM RNA, also designated SEQ ID:3951.

Another function of VGAM1240 is therefore inhibition of Kelch-like 2, Mayven (Drosophila) (KLHL2, Accession NM_007246). Accordingly, utilities of VGAM1240 include diagnosis, prevention and treatment of diseases and clinical conditions associated with KLHL2. Mannose Receptor, C Type 1 (MRC1, Accession NM_002438) is another VGAM1240 host target gene. MRC1 BINDING SITE is HOST TARGET binding site found in the 3' untranslated region of mRNA encoded by MRC1, corresponding to a HOST TARGET binding site such as BINDING SITE I, BINDING SITE II or BINDING SITE III. Table 2 illustrates the complementarity of the nucleotide sequences of MRC1 BINDING SITE, designated SEQ ID:8280, to the nucleotide sequence of VGAM1240 RNA, herein designated VGAM RNA, also designated SEQ ID:3951.

Another function of VGAM1240 is therefore inhibition of Mannose Receptor, C Type 1 (MRC1, Accession NM_002438), a gene which mediates the endocytosis of glycoproteins. Accordingly, utilities of VGAM1240 include diagnosis, prevention and treatment of diseases and clinical conditions associated with MRC1. The function of MRC1 and its association with various diseases and clinical conditions, has been established by previous studies, as described hereinabove with reference to VGAM1217. Myosin, Heavy Polypeptide 11, Smooth Muscle (MYH11, Accession NM_002474) is another VGAM1240 host target gene. MYH11 BINDING SITE1 and MYH11 BINDING SITE2 are HOST TARGET binding sites found in untranslated regions of mRNA encoded by MYH11, corresponding to HOST TARGET binding sites such as BINDING SITE I, BINDING SITE II or BINDING SITE III. Table 2 illustrates the complementarity of the nucleotide sequences of MYH11 BINDING SITE1 and MYH11 BINDING SITE2, designated SEQ ID:8303 and SEQ ID:23145 respectively, to the nucleotide sequence of VGAM1240 RNA, herein designated VGAM RNA, also designated SEQ ID:3951.

Another function of VGAM1240 is therefore inhibition of Myosin, Heavy Polypeptide 11, Smooth Muscle (MYH11, Accession NM_002474), a gene which is involved in muscle contraction. Accordingly, utilities of VGAM1240 include diagnosis, prevention and treatment of diseases and clinical conditions associated with MYH11. The function of MYH11 and its association with various diseases and clinical conditions, has been established by previous studies, as described hereinabove with reference to VGAM178. CG018 (Accession NM_052818) is another VGAM1240 host target gene. CG018 BINDING SITE is HOST TARGET binding site found in the 3' untranslated region of mRNA encoded by CG018, corresponding to a HOST TARGET binding site such as BINDING SITE I, BINDING SITE II or BINDING SITE III. Table 2 illustrates the complementarity of the nucleotide sequences of CG018 BINDING SITE, designated SEQ ID:27402, to the nucleotide sequence of VGAM1240 RNA, herein designated VGAM RNA, also designated SEQ ID:3951.

Another function of VGAM1240 is therefore inhibition of CG018 (Accession NM_052818). Accordingly, utilities of VGAM1240 include diagnosis, prevention and treatment of diseases and clinical conditions associated with CG018. DKFZP434B172 (Accession XM_046264) is another VGAM1240 host target gene. DKFZP434B172 BINDING SITE is HOST TARGET binding site found in the 3' untranslated region of mRNA encoded by DKFZP434B172, corresponding to a HOST TARGET binding site such as BINDING SITE I, BINDING SITE II or BINDING SITE III. Table 2 illustrates the complementarity of the nucleotide sequences of DKFZP434B172 BINDING SITE, designated SEQ ID:34701, to the nucleotide sequence of VGAM1240 RNA, herein designated VGAM RNA, also designated SEQ ID:3951.

Another function of VGAM1240 is therefore inhibition of DKFZP434B172 (Accession XM_046264). Accordingly, utilities of VGAM1240 include diagnosis, prevention and treatment of diseases and clinical conditions associated with DKFZP434B172. DKFZP564M182 (Accession XM_085525) is another VGAM1240 host target gene. DKFZP564M182 BINDING SITE is HOST TARGET binding site found in the 3' untranslated region of mRNA encoded by DKFZP564M182, corresponding to a HOST TARGET binding site such as BINDING SITE I, BINDING SITE II or BINDING SITE III. Table 2 illustrates the complementarity of the nucleotide sequences of DKFZP564M182 BINDING SITE, designated SEQ ID:38217, to the nucleotide sequence of VGAM1240 RNA, herein designated VGAM RNA, also designated SEQ ID:3951.

Another function of VGAM1240 is therefore inhibition of DKFZP564M182 (Accession XM_085525). Accordingly, utilities of VGAM1240 include diagnosis, prevention and treatment of diseases and clinical conditions associated with DKFZP564M182. FLJ10830 (Accession NM_018235) is another VGAM1240 host target gene. FLJ10830 BINDING SITE is HOST TARGET binding site found in the 3' untranslated region of mRNA encoded by FLJ10830, corresponding to a HOST TARGET binding site such as BINDING SITE I, BINDING SITE II or BINDING SITE III. Table 2 illustrates the complementarity of the nucleotide sequences of FLJ10830 BINDING SITE, designated SEQ ID:20185, to the nucleotide sequence of VGAM1240 RNA, herein designated VGAM RNA, also designated SEQ ID:3951.

Another function of VGAM1240 is therefore inhibition of FLJ10830 (Accession NM_018235). Accordingly, utilities of VGAM1240 include diagnosis, prevention and treatment of diseases and clinical conditions associated with FLJ10830. FLJ12572 (Accession NM_022905) is another VGAM1240 host target gene. FLJ12572 BINDING SITE is HOST TARGET binding site found in the 3' untranslated region of mRNA encoded by FLJ12572, corresponding to a HOST TARGET binding site such as BINDING SITE I, BINDING SITE II or BINDING SITE III. Table 2 illustrates the complementarity of the nucleotide sequences of FLJ12572 BINDING SITE, designated SEQ ID:23200, to the nucleotide sequence of VGAM1240 RNA, herein designated VGAM RNA, also designated SEQ ID:3951.

Another function of VGAM1240 is therefore inhibition of FLJ12572 (Accession NM_022905). Accordingly, utilities of VGAM1240 include diagnosis, prevention and treatment of diseases and clinical conditions associated with FLJ12572. FLJ12592 (Accession NM_032169) is another VGAM1240 host target gene. FLJ12592 BINDING SITE is HOST TARGET binding site found in the 3' untranslated region of mRNA encoded by FLJ12592, corresponding to a HOST TARGET binding site such as BINDING SITE I, BINDING SITE II or BINDING SITE III. Table 2 illustrates the complementarity of the nucleotide sequences of FLJ12592 BINDING SITE, designated SEQ ID:25877, to the nucleotide sequence of VGAM1240 RNA, herein designated VGAM RNA, also designated SEQ ID:3951.

Another function of VGAM1240 is therefore inhibition of FLJ12592 (Accession NM_032169). Accordingly, utilities of VGAM1240 include diagnosis, prevention and treatment of diseases and clinical conditions associated with FLJ12592. HSPC043 (Accession XM_041943) is another VGAM1240 host target gene. HSPC043 BINDING SITE is HOST TARGET binding site found in the 3' untranslated region of mRNA encoded by HSPC043, corresponding to a HOST TARGET binding site such as BINDING SITE I, BINDING SITE II or BINDING SITE III. Table 2 illustrates the complementarity of the nucleotide sequences of HSPC043 BINDING SITE, designated SEQ ID:33638, to the nucleotide sequence of VGAM1240 RNA, herein designated VGAM RNA, also designated SEQ ID:3951.

Another function of VGAM1240 is therefore inhibition of HSPC043 (Accession XM_041943). Accordingly, utilities of VGAM1240 include diagnosis, prevention and treatment of diseases and clinical conditions associated with HSPC043. KIAA0052 (Accession XM_042108) is another VGAM1240 host target gene. KIAA0052 BINDING SITE is HOST TARGET binding site found in the 3' untranslated region of mRNA encoded by KIAA0052, corresponding to a HOST TARGET binding site such as BINDING SITE I, BINDING SITE II or BINDING SITE III. Table 2 illustrates the complementarity of the nucleotide sequences of KIAA0052 BINDING SITE, designated SEQ ID:33693, to the nucleotide sequence of VGAM1240 RNA, herein designated VGAM RNA, also designated SEQ ID:3951.

Another function of VGAM1240 is therefore inhibition of KIAA0052 (Accession XM_042108). Accordingly, utilities of VGAM1240 include diagnosis, prevention and treatment of diseases and clinical conditions associated with KIAA0052. KIAA0532 (Accession XM_047659) is another VGAM1240 host target gene. KIAA0532 BINDING SITE is HOST TARGET binding site found in the 3' untranslated region of mRNA encoded by KIAA0532, corresponding to a HOST TARGET binding site such as BINDING SITE I, BINDING SITE II or BINDING SITE III. Table 2 illustrates the complementarity of the nucleotide sequences of KIAA0532 BINDING SITE, designated SEQ ID:35020, to the nucleotide sequence of VGAM1240 RNA, herein designated VGAM RNA, also designated SEQ ID:3951.

Another function of VGAM1240 is therefore inhibition of KIAA0532 (Accession XM_047659). Accordingly, utilities of VGAM1240 include diagnosis, prevention and treatment of diseases and clinical conditions associated with KIAA0532. KIAA1719 (Accession XM_042936) is another VGAM1240 host target gene. KIAA1719 BINDING SITE is HOST TARGET binding site found in the 3' untranslated region of mRNA encoded by KIAA1719, corresponding to a HOST TARGET binding site such as BINDING SITE I, BINDING SITE II or BINDING SITE III. Table 2 illustrates the complementarity of the nucleotide sequences of KIAA1719 BINDING SITE, designated SEQ ID:33823, to the nucleotide sequence of VGAM1240 RNA, herein designated VGAM RNA, also designated SEQ ID:3951.

Another function of VGAM1240 is therefore inhibition of KIAA1719 (Accession XM_042936). Accordingly, utilities of VGAM1240 include diagnosis, prevention and treatment of diseases and clinical conditions associated with KIAA1719. Kallikrein 7 (chymotryptic, stratum corneum) (KLK7, Accession NM_139277) is another VGAM1240 host target gene. KLK7 BINDING SITE1 and KLK7 BINDING SITE2 are HOST TARGET binding sites found in untranslated regions of mRNA encoded by KLK7, corresponding to HOST TARGET binding sites such as BINDING SITE I, BINDING SITE II or BINDING SITE III. Table 2 illustrates the complementarity of the nucleotide sequences of KLK7 BINDING SITE1 and KLK7 BINDING SITE2, designated SEQ ID:29276 and SEQ ID:11479 respectively, to the nucleotide sequence of VGAM1240 RNA, herein designated VGAM RNA, also designated SEQ ID:3951.

Another function of VGAM1240 is therefore inhibition of Kallikrein 7 (chymotryptic, stratum corneum) (KLK7, Accession NM_139277). Accordingly, utilities of VGAM1240 include diagnosis, prevention and treatment of diseases and clinical conditions associated with KLK7. MGC27382 (Accession NM_144700) is another VGAM1240 host target gene. MGC27382 BINDING SITE is HOST TARGET binding site found in the 5' untranslated region of mRNA encoded by MGC27382, corresponding to a HOST TARGET binding site such as BINDING SITE I, BINDING SITE II or BINDING SITE III. Table 2 illustrates the complementarity of the nucleotide sequences of MGC27382 BINDING SITE, designated SEQ ID:29522, to the nucleotide sequence of VGAM1240 RNA, herein designated VGAM RNA, also designated SEQ ID:3951.

Another function of VGAM1240 is therefore inhibition of MGC27382 (Accession NM_144700). Accordingly, utilities of VGAM1240 include diagnosis, prevention and treatment of diseases and clinical conditions associated with MGC27382. MISS (Accession NM_144578) is another VGAM1240 host target gene. MISS BINDING SITE is HOST TARGET binding site found in the 3' untranslated region of mRNA encoded by MISS, corresponding to a HOST TARGET binding site such as BINDING SITE I, BINDING SITE II or BINDING SITE III. Table 2 illustrates the complementarity of the nucleotide sequences of MISS BINDING SITE, designated SEQ ID:29383, to the nucleotide sequence of VGAM1240 RNA, herein designated VGAM RNA, also designated SEQ ID:3951.

Another function of VGAM1240 is therefore inhibition of MISS (Accession NM_144578). Accordingly, utilities of VGAM1240 include diagnosis, prevention and treatment of diseases and clinical conditions associated with MISS. Neurolysin (metallopeptidase M3 family) (NLN, Accession NM_020726) is another VGAM1240 host target gene. NLN BINDING SITE is HOST TARGET binding site found in the 3' untranslated region of mRNA encoded by NLN, corresponding to a HOST TARGET binding site such as BINDING SITE I, BINDING SITE II or BINDING SITE III. Table 2 illustrates the complementarity of the nucleotide sequences of NLN BINDING SITE, designated SEQ ID:21858, to the nucleotide sequence of VGAM1240 RNA, herein designated VGAM RNA, also designated SEQ ID:3951.

Another function of VGAM1240 is therefore inhibition of Neurolysin (metallopeptidase M3 family) (NLN, Accession NM_020726). Accordingly, utilities of VGAM1240 include diagnosis, prevention and treatment of diseases and clinical conditions associated with NLN. PRO0097 (Accession NM_014114) is another VGAM1240 host target gene. PRO0097 BINDING SITE is HOST TARGET binding site found in the 5' untranslated region of mRNA encoded by PRO0097, corresponding to a HOST TARGET binding site such as BINDING SITE I, BINDING SITE II or BINDING SITE III. Table 2 illustrates the complementarity of the nucleotide sequences of PRO0097 BINDING SITE, designated SEQ ID:15362, to the nucleotide sequence of VGAM1240 RNA, herein designated VGAM RNA, also designated SEQ ID:3951.

Another function of VGAM1240 is therefore inhibition of PRO0097 (Accession NM_014114). Accordingly, utilities of VGAM1240 include diagnosis, prevention and treatment of diseases and clinical conditions associated with PRO0097. RAS-like, Estrogen-regulated, Growth-inhibitor (RERG, Accession NM_032918) is another VGAM1240 host target gene. RERG BINDING SITE is HOST TARGET binding site found in the 5' untranslated region of mRNA encoded by RERG, corresponding to a HOST TARGET binding site such as BINDING SITE I, BINDING SITE II or BINDING SITE III. Table 2 illustrates the complementarity of the nucleotide sequences of RERG BINDING SITE, designated SEQ ID:26736, to the nucleotide sequence of VGAM1240 RNA, herein designated VGAM RNA, also designated SEQ ID:3951.

Another function of VGAM1240 is therefore inhibition of RAS-like, Estrogen-regulated, Growth-inhibitor (RERG, Accession NM_032918). Accordingly, utilities of VGAM1240 include diagnosis, prevention and treatment of diseases and clinical conditions associated with RERG. LOC123435 (Accession XM_058706) is another VGAM1240 host target gene. LOC123435 BINDING SITE is HOST TARGET binding site found in the 5' untranslated region of mRNA encoded by LOC123435, corresponding to a HOST TARGET binding site such as BINDING SITE I, BINDING SITE II or BINDING SITE III. Table 2 illustrates the complementarity of the nucleotide sequences of LOC123435 BINDING SITE, designated SEQ ID:36724, to the nucleotide sequence of VGAM1240 RNA, herein designated VGAM RNA, also designated SEQ ID:3951.

Another function of VGAM1240 is therefore inhibition of LOC123435 (Accession XM_058706). Accordingly, utilities of VGAM1240 include diagnosis, prevention and treatment of diseases and clinical conditions associated with LOC123435. LOC147837 (Accession XM_085915) is another VGAM1240 host target gene. LOC147837 BINDING SITE is HOST TARGET binding site found in the 3' untranslated region of mRNA encoded by LOC147837, corresponding to a HOST TARGET binding site such as BINDING SITE I, BINDING SITE II or BINDING SITE III. Table 2 illustrates the complementarity of the nucleotide sequences of LOC147837 BINDING SITE, designated SEQ ID:38394, to the nucleotide sequence of VGAM1240 RNA, herein designated VGAM RNA, also designated SEQ ID:3951.

Another function of VGAM1240 is therefore inhibition of LOC147837 (Accession XM_085915). Accordingly, utilities of VGAM1240 include diagnosis, prevention and treatment of diseases and clinical conditions associated with LOC147837. LOC153894 (Accession XM_087796) is another VGAM1240 host target gene. LOC153894 BINDING SITE is HOST TARGET binding site found in the 3' untranslated region of mRNA encoded by LOC153894, corresponding to a HOST TARGET binding site such as BINDING SITE I, BINDING SITE II or BINDING SITE III. Table 2 illustrates the complementarity of the nucleotide sequences of LOC153894 BINDING SITE, designated SEQ ID:39428, to the nucleotide sequence of VGAM1240 RNA, herein designated VGAM RNA, also designated SEQ ID:3951.

Another function of VGAM1240 is therefore inhibition of LOC153894 (Accession XM_087796). Accordingly, utilities of VGAM1240 include diagnosis, prevention and treatment of diseases and clinical conditions associated with LOC153894. LOC154442 (Accession XM_098536) is another VGAM1240 host target gene. LOC154442 BINDING SITE is HOST TARGET binding site found in the 3' untranslated region of mRNA encoded by LOC154442, corresponding to a HOST TARGET binding site such as BINDING SITE I, BINDING SITE II or BINDING SITE III. Table 2 illustrates the complementarity of the nucleotide sequences of LOC154442 BINDING SITE, designated SEQ ID:41707, to the nucleotide sequence of VGAM1240 RNA, herein designated VGAM RNA, also designated SEQ ID:3951.

Another function of VGAM1240 is therefore inhibition of LOC154442 (Accession XM_098536). Accordingly, utilities of VGAM1240 include diagnosis, prevention and treatment of diseases and clinical conditions associated with LOC154442. LOC255328 (Accession XM_172920) is another VGAM1240 host target gene. LOC255328 BINDING SITE is HOST TARGET binding site found in the 3' untranslated region of mRNA encoded by LOC255328, corresponding to a HOST TARGET binding site such as BINDING SITE I, BINDING SITE II or BINDING SITE III. Table 2 illustrates the complementarity of the nucleotide sequences of LOC255328 BINDING SITE, designated SEQ ID:46177, to the nucleotide sequence of VGAM1240 RNA, herein designated VGAM RNA, also designated SEQ ID:3951.

Another function of VGAM1240 is therefore inhibition of LOC255328 (Accession XM_172920). Accordingly, utilities of VGAM1240 include diagnosis, prevention and treatment of diseases and clinical conditions associated with LOC255328. LOC51696 (Accession NM_016217) is another VGAM1240 host target gene. LOC51696 BINDING SITE is HOST TARGET binding site found in the 3' untranslated region of mRNA encoded by LOC51696, corresponding to a HOST TARGET binding site such as BINDING SITE I, BINDING SITE II or BINDING SITE III. Table 2 illustrates the complementarity of the nucleotide sequences of LOC51696 BINDING SITE, designated SEQ ID:18305, to the nucleotide sequence of VGAM1240 RNA, herein designated VGAM RNA, also designated SEQ ID:3951.

Another function of VGAM1240 is therefore inhibition of LOC51696 (Accession NM_016217). Accordingly, utilities of VGAM1240 include diagnosis, prevention and treatment of diseases and clinical conditions associated with LOC51696. LOC91012 (Accession XM_035503) is another VGAM1240 host target gene. LOC91012 BINDING SITE is HOST TARGET binding site found in the 5' untranslated region of mRNA encoded by LOC91012, corresponding to a HOST TARGET binding site such as BINDING SITE I, BINDING SITE II or BINDING SITE III. Table 2 illustrates the complementarity of the nucleotide sequences of LOC91012 BINDING SITE, designated SEQ ID:32284, to the nucleotide sequence of VGAM1240 RNA, herein designated VGAM RNA, also designated SEQ ID:3951.

Another function of VGAM1240 is therefore inhibition of LOC91012 (Accession XM_035503). Accordingly, utilities of VGAM1240 include diagnosis, prevention and treatment of diseases and clinical conditions associated with LOC91012. LOC91380 (Accession XM_038134) is another VGAM1240 host target gene. LOC91380 BINDING SITE is HOST TARGET binding site found in the 5' untranslated region of mRNA encoded by LOC91380, corresponding to a HOST TARGET binding site such as BINDING SITE I, BINDING SITE II or BINDING SITE III. Table 2 illustrates the complementarity of the nucleotide sequences of LOC91380 BINDING SITE, designated SEQ ID:32760, to the nucleotide sequence of VGAM1240 RNA, herein designated VGAM RNA, also designated SEQ ID:3951.

Another function of VGAM1240 is therefore inhibition of LOC91380 (Accession XM_038134). Accordingly, utilities of VGAM1240 include diagnosis, prevention and treatment of diseases and clinical conditions associated with LOC91380. FIG. 1 further provides a conceptual description of a novel bioinformatically detected viral gene of the present invention, referred to here as Viral Genomic Address Messenger 1241 (VGAM1241) viral gene, which modulates expression of respective host target genes thereof, the function and utility of which host target genes is known in the art.

VGAM1241 is a novel bioinformatically detected regulatory, non protein coding, viral micro RNA (miRNA) gene. The method by which VGAM1241 was detected is described hereinabove with reference to FIGS. 1-8.

VGAM1241 gene, herein designated VGAM GENE, is a viral gene contained in the genome of Gallid Herpesvirus 3. VGAM1241 host target gene, herein designated VGAM HOST TARGET GENE, is a human gene contained in the human genome.

VGAM1241 gene encodes a VGAM1241 precursor RNA, herein designated VGAM PRECURSOR RNA. Similar to other miRNA genes, and unlike most ordinary genes, VGAM1241 precursor RNA does not encode a protein. A nucleotide sequence identical or highly similar to the nucleotide sequence of VGAM1241 precursor RNA is designated SEQ ID:1227, and is provided hereinbelow with reference to the sequence listing part. Nucleotide sequence SEQ ID:1227 is located at position 107745 relative to the genome of Gallid Herpesvirus 3.

VGAM1241 precursor RNA folds onto itself, forming VGAM1241 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1241 folded precursor RNA into VGAM1241 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM1241 RNA is designated SEQ ID:3952, and is provided hereinbelow with reference to the sequence listing part.

VGAM1241 host target gene, herein designated VGAM HOST TARGET GENE, encodes a corresponding messenger RNA, VGAM1241 host target RNA, herein designated VGAM HOST TARGET RNA. VGAM1241 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1241 RNA, herein designated VGAM RNA, binds complementarily to one or more host target binding sites located in untranslated regions of VGAM1241 host target RNA, herein designated VGAM HOST TARGET RNA. This complementary binding is due to the fact that the nucleotide sequence of VGAM1241 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1241 RNA, herein designated VGAM RNA, may have a different number of host target binding sites in untranslated regions of a VGAM1241 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1241 RNA, herein designated VGAM RNA, to host target binding sites on VGAM1241 host target RNA, herein designated VGAM HOST TARGET RNA, such as BINDING SITE I, BINDING SITE II and BINDING SITE III, inhibits translation of VGAM1241 host target RNA into VGAM1241 host target protein, herein designated VGAM HOST TARGET PROTEIN. VGAM host target protein is therefore outlined by a broken line.

It is appreciated that VGAM1241 host target gene, herein designated VGAM HOST TARGET GENE, in fact represents a plurality of VGAM1241 host target genes. The mRNA of each one of this plurality of VGAM1241 host target genes comprises one or more host target binding sites, each having a nucleotide sequence which is at least partly complementary to VGAM1241 RNA, herein designated VGAM RNA, and which when bound by VGAM1241 RNA causes inhibition of translation of respective one or more VGAM1241 host target proteins.

It is further appreciated by one skilled in the art that the mode of translational inhibition illustrated by FIG. 1 with specific reference to translational inhibition exerted by VGAM1241 gene, herein designated VGAM GENE, on one or more VGAM1241 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1241 is inhibition of expression of host target genes, as part of a novel viral mechanism of attacking a host. Accordingly, utilities of VGAM1241 include diagnosis, prevention and treatment of viral infection by Gallid Herpesvirus 3. Specific functions, and accordingly utilities, of VGAM1241 correlate with, and may be deduced from, the identity of the host target genes which VGAM1241 binds and inhibits, and the function of these host target genes, as elaborated hereinbelow.

Nucleotide sequences of the VGAM1241 precursor RNA, herein designated VGAM PRECURSOR RNA, and of the 'diced' VGAM1241 RNA, herein designated VGAM RNA, and a schematic representation of the secondary folding of VGAM1241 folded precursor RNA, herein designated VGAM FOLDED PRECURSOR RNA, of VGAM1241 are further described hereinbelow with reference to Table 1.

Nucleotide sequences of host target binding sites, such as BINDING SITE-I, BINDING SITE-II and BINDING SITE-III of FIG. 1, found on VGAM1241 host target RNA, and schematic representation of the complementarity of each of these host target binding sites to VGAM1241 RNA, herein designated VGAM RNA, are described hereinbelow with reference to Table 2.

As mentioned hereinabove with reference to FIG. 1, a function of VGAM1241 gene, herein designated VGAM is inhibition of expression of VGAM1241 target genes. It is appreciated that specific functions, and accordingly utilities, of VGAM1241 correlate with, and may be deduced from, the identity of the target genes which VGAM1241 binds and inhibits, and the function of these target genes, as elaborated hereinbelow.

PORIMIN (Accession NM_052932) is a VGAM1241 host target gene. PORIMIN BINDING SITE is HOST TARGET binding site found in the 5' untranslated region of mRNA encoded by PORIMIN, corresponding to a HOST TARGET binding site such as BINDING SITE I, BINDING SITE II or BINDING SITE III. Table 2 illustrates the complementarity of the nucleotide sequences of PORIMIN BINDING SITE, designated SEQ ID:27492, to the nucleotide sequence of VGAM1241 RNA, herein designated VGAM RNA, also designated SEQ ID:3952.

A function of VGAM1241 is therefore inhibition of PORIMIN (Accession NM_052932). Accordingly, utilities of VGAM1241 include diagnosis, prevention and treatment of diseases and clinical conditions associated with PORIMIN. FIG. 1 further provides a conceptual description of a novel bioinformatically detected viral gene of the present invention, referred to here as Viral Genomic Address Messenger 1242 (VGAM1242) viral gene, which modulates expression of respective host target genes thereof, the function and utility of which host target genes is known in the art.

VGAM1242 is a novel bioinformatically detected regulatory, non protein coding, viral micro RNA (miRNA) gene. The method by which VGAM1242 was detected is described hereinabove with reference to FIGS. 1-8.

VGAM1242 gene, herein designated VGAM GENE, is a viral gene contained in the genome of Gallid Herpesvirus 3. VGAM1242 host target gene, herein designated VGAM HOST TARGET GENE, is a human gene contained in the human genome.

VGAM1242 gene encodes a VGAM1242 precursor RNA, herein designated VGAM PRECURSOR RNA. Similar to other miRNA genes, and unlike most ordinary genes, VGAM1242 precursor RNA does not encode a protein. A nucleotide sequence identical or highly similar to the nucleotide sequence of VGAM1242 precursor RNA is designated SEQ ID:1228, and is provided hereinbelow with reference to the sequence listing part. Nucleotide sequence SEQ ID:1228 is located at position 101522 relative to the genome of Gallid Herpesvirus 3.

VGAM1242 precursor RNA folds onto itself, forming VGAM1242 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1242 folded precursor RNA into VGAM1242 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM1242 RNA is designated SEQ ID:3953, and is provided hereinbelow with reference to the sequence listing part.

VGAM1242 host target gene, herein designated VGAM HOST TARGET GENE, encodes a corresponding messenger RNA, VGAM1242 host target RNA, herein designated VGAM HOST TARGET RNA. VGAM1242 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1242 RNA, herein designated VGAM RNA, binds complementarily to one or more host target binding sites located in untranslated regions of VGAM1242 host target RNA, herein designated VGAM HOST TARGET RNA. This complementary binding is due to the fact that the nucleotide sequence of VGAM1242 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1242 RNA, herein designated VGAM RNA, may have a different number of host target binding sites in untranslated regions of a VGAM1242 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1242 RNA, herein designated VGAM RNA, to host target binding sites on VGAM1242 host target RNA, herein designated VGAM HOST TARGET RNA, such as BINDING SITE I, BINDING SITE II and BINDING SITE III, inhibits translation of VGAM1242 host target RNA into VGAM1242 host target protein, herein designated VGAM HOST TARGET PROTEIN. VGAM host target protein is therefore outlined by a broken line.

It is appreciated that VGAM1242 host target gene, herein designated VGAM HOST TARGET GENE, in fact represents a plurality of VGAM1242 host target genes. The mRNA of each one of this plurality of VGAM1242 host target genes comprises one or more host target binding sites, each having a nucleotide sequence which is at least partly complementary to VGAM1242 RNA, herein designated VGAM RNA, and which when bound by VGAM1242 RNA causes inhibition of translation of respective one or more VGAM1242 host target proteins.

It is further appreciated by one skilled in the art that the mode of translational inhibition illustrated by FIG. 1 with specific reference to translational inhibition exerted by VGAM1242 gene, herein designated VGAM GENE, on one or more VGAM1242 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1242 is inhibition of expression of host target genes, as part of a novel viral mechanism of attacking a host. Accordingly, utilities of VGAM1242 include diagnosis, prevention and treatment of viral infection by Gallid Herpesvirus 3. Specific functions, and accordingly utilities, of VGAM1242 correlate with, and may be deduced from, the identity of the host target genes which VGAM1242 binds and inhibits, and the function of these host target genes, as elaborated hereinbelow.

Nucleotide sequences of the VGAM1242 precursor RNA, herein designated VGAM PRECURSOR RNA, and of the 'diced' VGAM1242 RNA, herein designated VGAM RNA, and a schematic representation of the secondary folding of VGAM1242 folded precursor RNA, herein designated VGAM FOLDED PRECURSOR RNA, of VGAM1242 are further described hereinbelow with reference to Table 1.

Nucleotide sequences of host target binding sites, such as BINDING SITE-I, BINDING SITE-II and BINDING SITE-III of FIG. 1, found on VGAM1242 host target RNA, and schematic representation of the complementarity of each of these host target binding sites to VGAM1242 RNA, herein designated VGAM RNA, are described hereinbelow with reference to Table 2.

As mentioned hereinabove with reference to FIG. 1, a function of VGAM1242 gene, herein designated VGAM is inhibition of expression of VGAM1242 target genes. It is appreciated that specific functions, and accordingly utilities, of VGAM1242 correlate with, and may be deduced from, the identity of the target genes which VGAM1242 binds and inhibits, and the function of these target genes, as elaborated hereinbelow.

Carnitine O-octanoyltransferase (CROT, Accession NM_021151) is a VGAM1242 host target gene. CROT BINDING SITE is HOST TARGET binding site found in the 3' untranslated region of mRNA encoded by CROT, corresponding to a HOST TARGET binding site such as BINDING SITE I, BINDING SITE II or BINDING SITE III. Table 2 illustrates the complementarity of the nucleotide sequences of CROT BINDING SITE, designated SEQ ID:22122, to the nucleotide sequence of VGAM1242 RNA, herein designated VGAM RNA, also designated SEQ ID:3953.

A function of VGAM1242 is therefore inhibition of Carnitine O-octanoyltransferase (CROT, Accession NM_021151), a gene which CROT plays a crucial role in the beta-oxidation of branched-chain fatty acids including pristanic acid. Accordingly, utilities of VGAM1242 include diagnosis, prevention and treatment of diseases and clinical conditions associated with CROT. The function of CROT and its association with various diseases and clinical conditions, has been established by previous studies, as described hereinabove with reference to VGAM70. Dual-specificity tyrosine-(Y)-phosphorylation Regulated Kinase 1A (DYRK1A, Accession NM_001396) is another VGAM1242 host target gene. DYRK1A BINDING SITE1 through DYRK1A BINDING SITE3 are HOST TARGET binding sites found in untranslated regions of mRNA encoded by DYRK1A, corresponding to HOST TARGET binding sites such as BINDING SITE I, BINDING SITE II or BINDING SITE III. Table 2 illustrates the complementarity of the nucleotide sequences of DYRK1A BINDING SITE1 through DYRK1A BINDING SITE3, designated SEQ ID:7093, SEQ ID:28186 and SEQ ID:28163 respectively, to the nucleotide sequence of VGAM1242 RNA, herein designated VGAM RNA, also designated SEQ ID:3953.

Another function of VGAM1242 is therefore inhibition of Dual-specificity tyrosine-(Y)-phosphorylation Regulated Kinase 1A (DYRK1A, Accession NM_001396), a gene which regulates cell proliferation and may be involved in brain development. Accordingly, utilities of VGAM1242 include diagnosis, prevention and treatment of diseases and clinical conditions associated with DYRK1A. The function of DYRK1A and its association with various diseases and clinical conditions, has been established by previous studies, as described hereinabove with reference to VGAM42. Unc-5 Homolog B (C. elegans) (UNC5C, Accession NM_003728) is another VGAM1242 host target gene. UNC5C BINDING SITE is HOST TARGET binding site found in the 3' untranslated region of mRNA encoded by UNC5C, corresponding to a HOST TARGET binding site such as BINDING SITE I, BINDING SITE II or BINDING SITE III. Table 2 illustrates the complementarity of the nucleotide sequences of UNC5C BINDING SITE, designated SEQ ID:9821, to the nucleotide sequence of VGAM1242 RNA, herein designated VGAM RNA, also designated SEQ ID:3953.

Another function of VGAM1242 is therefore inhibition of Unc-5 Homolog B (C. elegans) (UNC5C, Accession NM_003728), a gene which is a putative receptor for netrin, which is involved in axon guidance. Accordingly, utilities of VGAM1242 include diagnosis, prevention and treatment of diseases and clinical conditions associated with UNC5C. The function of UNC5C and its association with various diseases and clinical conditions, has been established by previous studies, as described hereinabove with reference to VGAM298. KIAA0599 (Accession XM_085127) is another VGAM1242 host target gene. KIAA0599 BINDING SITE is HOST TARGET binding site found in the 3' untranslated region of mRNA encoded by KIAA0599, corresponding to a HOST TARGET binding site such as BINDING SITE I, BINDING SITE II or BINDING SITE III. Table 2 illustrates the complementarity of the nucleotide sequences of KIAA0599 BINDING SITE, designated SEQ ID:37853, to the nucleotide sequence of VGAM1242 RNA, herein designated VGAM RNA, also designated SEQ ID:3953.

Another function of VGAM1242 is therefore inhibition of KIAA0599 (Accession XM_085127). Accordingly, utilities of VGAM1242 include diagnosis, prevention and treatment of diseases and clinical conditions associated with KIAA0599. MGC11266 (Accession NM_024322) is another VGAM1242 host target gene. MGC11266 BINDING SITE is HOST TARGET binding site found in the 3' untranslated region of mRNA encoded by MGC11266, corresponding to a HOST TARGET binding site such as BINDING SITE I, BINDING SITE II or BINDING SITE III. Table 2 illustrates the complementarity of the nucleotide sequences of MGC11266 BINDING SITE, designated SEQ ID:23611, to the nucleotide sequence of VGAM1242 RNA, herein designated VGAM RNA, also designated SEQ ID:3953.

Another function of VGAM1242 is therefore inhibition of MGC11266 (Accession NM_024322). Accordingly, utilities of VGAM1242 include diagnosis, prevention and treatment of diseases and clinical conditions associated with MGC11266. TUSP (Accession NM_020245) is another VGAM1242 host target gene. TUSP BINDING SITE is HOST TARGET binding site found in the 5' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21539, to the nucleotide sequence of VGAM1242 RNA, herein designated VGAM RNA, also designated SEQ ID:3953.

Another function of VGAM1242 is therefore inhibition of TUSP (Accession NM_020245). Accordingly, utilities of VGAM1242 include diagnosis, prevention and treatment of diseases and clinical conditions associated with TUSP. Zinc Finger Protein 262 (ZNF262, Accession NM_005095) is another VGAM1242 host target gene. ZNF262 BINDING SITE is HOST TARGET binding site found in the 3' untranslated region of mRNA encoded by ZNF262, corresponding to a HOST TARGET binding site such as BINDING SITE I, BINDING SITE II or BINDING SITE III. Table 2 illustrates the complementarity of the nucleotide sequences of ZNF262 BINDING SITE, designated SEQ ID:11556, to the nucleotide sequence of VGAM1242 RNA, herein designated VGAM RNA, also designated SEQ ID:3953.

Another function of VGAM1242 is therefore inhibition of Zinc Finger Protein 262 (ZNF262, Accession NM_005095). Accordingly, utilities of VGAM1242 include diagnosis, prevention and treatment of diseases and clinical conditions associated with ZNF262. LOC147072 (Accession XM_017121) is another VGAM1242 host target gene. LOC147072 BINDING SITE is HOST TARGET binding site found in the 3' untranslated region of mRNA encoded by LOC147072, corresponding to a HOST TARGET binding site such as BINDING SITE I, BINDING SITE II or BINDING SITE III. Table 2 illustrates the complementarity of the nucleotide sequences of LOC147072 BINDING SITE, designated SEQ ID:30301, to the nucleotide sequence of VGAM1242 RNA, herein designated VGAM RNA, also designated SEQ ID:3953.

Another function of VGAM1242 is therefore inhibition of LOC147072 (Accession XM_017121). Accordingly, utilities of VGAM1242 include diagnosis, prevention and treatment of diseases and clinical conditions associated with LOC147072. LOC147976 (Accession XM_085980) is another VGAM1242 host target gene. LOC147976 BINDING SITE is HOST TARGET binding site found in the 3' untranslated region of mRNA encoded by LOC147976, corresponding to a HOST TARGET binding site such as BINDING SITE I, BINDING SITE II or BINDING SITE III. Table 2 illustrates the complementarity of the nucleotide sequences of LOC147976 BINDING SITE, designated SEQ ID:38429, to the nucleotide sequence of VGAM1242 RNA, herein designated VGAM RNA, also designated SEQ ID:3953.

Another function of VGAM1242 is therefore inhibition of LOC147976 (Accession XM_085980). Accordingly, utilities of VGAM1242 include diagnosis, prevention and treatment of diseases and clinical conditions associated with LOC147976. LOC148645 (Accession XM_097492) is another VGAM1242 host target gene. LOC148645 BINDING SITE is HOST TARGET binding site found in the 5' untranslated region of mRNA encoded by LOC148645, corresponding to a HOST TARGET binding site such as BINDING SITE I, BINDING SITE II or BINDING SITE III. Table 2 illustrates the complementarity of the nucleotide sequences of LOC148645 BINDING SITE, designated SEQ ID:40891, to the nucleotide sequence of VGAM1242 RNA, herein designated VGAM RNA, also designated SEQ ID:3953.

Another function of VGAM1242 is therefore inhibition of LOC148645 (Accession XM_097492). Accordingly, utilities of VGAM1242 include diagnosis, prevention and treatment of diseases and clinical conditions associated with LOC148645. LOC164397 (Accession XM_092780) is another VGAM1242 host target gene. LOC164397 BINDING SITE is HOST TARGET binding site found in the 5' untranslated region of mRNA encoded by LOC164397, corresponding to a HOST TARGET binding site such as BINDING SITE I, BINDING SITE II or BINDING SITE III. Table 2 illustrates the complementarity of the nucleotide sequences of LOC164397 BINDING SITE, designated SEQ ID:40153, to the nucleotide sequence of VGAM1242 RNA, herein designated VGAM RNA, also designated SEQ ID:3953.

Another function of VGAM1242 is therefore inhibition of LOC164397 (Accession XM_092780). Accordingly, utilities of VGAM1242 include diagnosis, prevention and treatment of diseases and clinical conditions associated with LOC164397. LOC253985 (Accession XM_172875) is another VGAM1242 host target gene. LOC253985 BINDING SITE is HOST TARGET binding site found in the 5' untranslated region of mRNA encoded by LOC253985, corresponding to a HOST TARGET binding site such as BINDING SITE I, BINDING SITE II or BINDING SITE III. Table 2 illustrates the complementarity of the nucleotide sequences of LOC253985 BINDING SITE, designated SEQ ID:46151, to the nucleotide sequence of VGAM1242 RNA, herein designated VGAM RNA, also designated SEQ ID:3953.

Another function of VGAM1242 is therefore inhibition of LOC253985 (Accession XM_172875). Accordingly, utilities of VGAM1242 include diagnosis, prevention and treatment of diseases and clinical conditions associated with LOC253985. LOC93444 (Accession XM_051455) is another VGAM1242 host target gene. LOC93444 BINDING SITE is HOST TARGET binding site found in the 3' untranslated region of mRNA encoded by LOC93444, corresponding to a HOST TARGET binding site such as BINDING SITE I, BINDING SITE II or BINDING SITE III. Table 2 illustrates the complementarity of the nucleotide sequences of LOC93444 BINDING SITE, designated SEQ ID:35843, to the nucleotide sequence of VGAM1242 RNA, herein designated VGAM RNA, also designated SEQ ID:3953.

Another function of VGAM1242 is therefore inhibition of LOC93444 (Accession XM_051455). Accordingly, utilities of VGAM1242 include diagnosis, prevention and treatment of diseases and clinical conditions associated with LOC93444. FIG. 1 further provides a conceptual description of a novel bioinformatically detected viral gene of the present invention, referred to here as Viral Genomic Address Messenger 1243 (VGAM1243) viral gene, which modulates expression of respective host target genes thereof, the function and utility of which host target genes is known in the art.

VGAM1243 is a novel bioinformatically detected regulatory, non protein coding, viral micro RNA (miRNA) gene. The method by which VGAM1243 was detected is described hereinabove with reference to FIGS. 1-8.

VGAM1243 gene, herein designated VGAM GENE, is a viral gene contained in the genome of Turkey Adenovirus 3. VGAM1243 host target gene, herein designated VGAM HOST TARGET GENE, is a human gene contained in the human genome.

VGAM1243 gene encodes a VGAM1243 precursor RNA, herein designated VGAM PRECURSOR RNA. Similar to other miRNA genes, and unlike most ordinary genes, VGAM1243 precursor RNA does not encode a protein. A nucleotide sequence identical or highly similar to the nucleotide sequence of VGAM1243 precursor RNA is designated SEQ ID:1229, and is provided hereinbelow with reference to the sequence listing part. Nucleotide sequence SEQ ID:1229 is located at position 18764 relative to the genome of Turkey Adenovirus 3.

VGAM1243 precursor RNA folds onto itself, forming VGAM1243 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1243 folded precursor RNA into VGAM1243 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1243 RNA is designated SEQ ID:3954, and is provided hereinbelow with reference to the sequence listing part.

VGAM1243 host target gene, herein designated VGAM HOST TARGET GENE, encodes a corresponding messenger RNA, VGAM1243 host target RNA, herein designated VGAM HOST TARGET RNA. VGAM1243 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1243 RNA, herein designated VGAM RNA, binds complementarily to one or more host target binding sites located in untranslated regions of VGAM1243 host target RNA, herein designated VGAM HOST TARGET RNA. This complementary binding is due to the fact that the nucleotide sequence of VGAM1243 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1243 RNA, herein designated VGAM RNA, may have a different number of host target binding sites in untranslated regions of a VGAM1243 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1243 RNA, herein designated VGAM RNA, to host target binding sites on VGAM1243 host target RNA, herein designated VGAM HOST TARGET RNA, such as BINDING SITE I, BINDING SITE II and BINDING SITE III, inhibits translation of VGAM1243 host target RNA into VGAM1243 host target protein, herein designated VGAM HOST TARGET PROTEIN. VGAM host target protein is therefore outlined by a broken line.

It is appreciated that VGAM1243 host target gene, herein designated VGAM HOST TARGET GENE, in fact represents a plurality of VGAM1243 host target genes. The mRNA of each one of this plurality of VGAM1243 host target genes comprises one or more host target binding sites, each having a nucleotide sequence which is at least partly complementary to VGAM1243 RNA, herein designated VGAM RNA, and which when bound by VGAM1243 RNA causes inhibition of translation of respective one or more VGAM1243 host target proteins.

It is further appreciated by one skilled in the art that the mode of translational inhibition illustrated by FIG. 1 with specific reference to translational inhibition exerted by VGAM1243 gene, herein designated VGAM GENE, on one or more VGAM1243 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1243 is inhibition of expression of host target genes, as part of a novel viral mechanism of attacking a host. Accordingly, utilities of VGAM1243 include diagnosis, prevention and treatment of viral infection by Turkey Adenovirus 3. Specific functions, and accordingly utilities, of VGAM1243 correlate with, and may be deduced from, the identity of the host target genes which VGAM1243 binds and inhibits, and the function of these host target genes, as elaborated hereinbelow.

Nucleotide sequences of the VGAM1243 precursor RNA, herein designated VGAM PRECURSOR RNA, and of the 'diced' VGAM1243 RNA, herein designated VGAM RNA, and a schematic representation of the secondary folding of VGAM1243 folded precursor RNA, herein designated VGAM FOLDED PRECURSOR RNA, of VGAM1243 are further described hereinbelow with reference to Table 1.

Nucleotide sequences of host target binding sites, such as BINDING SITE-I, BINDING SITE-II and BINDING SITE-III of FIG. 1, found on VGAM1243 host target RNA, and schematic representation of the complementarity of each of these host target binding sites to VGAM1243 RNA, herein designated VGAM RNA, are described hereinbelow with reference to Table 2.

As mentioned hereinabove with reference to FIG. 1, a function of VGAM1243 gene, herein designated VGAM is inhibition of expression of VGAM1243 target genes. It is appreciated that specific functions, and accordingly utilities, of VGAM1243 correlate with, and may be deduced from, the identity of the target genes which VGAM1243 binds and inhibits, and the function of these target genes, as elaborated hereinbelow.

Luteinizing Hormone/choriogonadotropin Receptor (LH-CGR, Accession NM_000233) is a VGAM1243 host target gene. LHCGR BINDING SITE is HOST TARGET binding site found in the 3' untranslated region of mRNA encoded by LHCGR, corresponding to a HOST TARGET binding site such as BINDING SITE I, BINDING SITE II or BINDING SITE III. Table 2 illustrates the complementarity of the nucleotide sequences of LHCGR BINDING SITE, designated SEQ ID:5744, to the nucleotide sequence of VGAM1243 RNA, herein designated VGAM RNA, also designated SEQ ID:3954.

A function of VGAM1243 is therefore inhibition of Luteinizing Hormone/choriogonadotropin Receptor (LH-CGR, Accession NM_000233). Accordingly, utilities of VGAM1243 include diagnosis, prevention and treatment of diseases and clinical conditions associated with LHCGR. Thymine-DNA Glycosylase (TDG, Accession NM_003211) is another VGAM1243 host target gene. TDG BINDING SITE is HOST TARGET binding site found in the 3' untranslated region of mRNA encoded by TDG, corresponding to a HOST TARGET binding site such as BINDING SITE I, BINDING SITE II or BINDING SITE III. Table 2 illustrates the complementarity of the nucleotide sequences of TDG BINDING SITE, designated SEQ ID:9205, to the nucleotide sequence of VGAM1243 RNA, herein designated VGAM RNA, also designated SEQ ID:3954.

Another function of VGAM1243 is therefore inhibition of Thymine-DNA Glycosylase (TDG, Accession NM_003211), a gene which excises uracil and thymine from mispairs with guanidine. Accordingly, utilities of VGAM1243 include diagnosis, prevention and treatment of diseases and clinical conditions associated with TDG. The function of TDG and its association with various diseases and clinical conditions, has been established by previous studies, as described hereinabove with reference to VGAM196. KIAA1497 (Accession XM_041431) is another VGAM1243 host target gene. KIAA1497 BINDING SITE is HOST TARGET binding site found in the 5' untranslated region of mRNA encoded by KIAA1497, corresponding to a HOST TARGET binding site such as BINDING SITE I, BINDING SITE II or BINDING SITE III. Table 2 illustrates the complementarity of the nucleotide sequences of KIAA1497 BINDING SITE, designated SEQ ID:33522, to the nucleotide sequence of VGAM1243 RNA, herein designated VGAM RNA, also designated SEQ ID:3954.

Another function of VGAM1243 is therefore inhibition of KIAA1497 (Accession XM_041431). Accordingly, utilities of VGAM1243 include diagnosis, prevention and treatment of diseases and clinical conditions associated with KIAA1497. MGC12679 (Accession NM_032733) is another VGAM1243 host target gene. MGC12679 BINDING SITE is HOST TARGET binding site found in the 3' untranslated region of mRNA encoded by MGC12679, corresponding to a HOST TARGET binding site such as BINDING SITE I, BINDING SITE II or BINDING SITE III. Table 2 illustrates the complementarity of the nucleotide sequences of MGC12679 BINDING SITE, designated SEQ ID:26458, to the nucleotide sequence of VGAM1243 RNA, herein designated VGAM RNA, also designated SEQ ID:3954.

Another function of VGAM1243 is therefore inhibition of MGC12679 (Accession NM_032733). Accordingly, utilities of VGAM1243 include diagnosis, prevention and treatment of diseases and clinical conditions associated with MGC12679. FIG. 1 further provides a conceptual description of a novel bioinformatically detected viral gene of the present invention, referred to here as Viral Genomic Address Messenger 1244 (VGAM1244) viral gene, which modulates expression of respective host target genes thereof, the function and utility of which host target genes is known in the art.

VGAM1244 is a novel bioinformatically detected regulatory, non protein coding, viral micro RNA (miRNA) gene. The method by which VGAM1244 was detected is described hereinabove with reference to FIGS. 1-8.

VGAM1244 gene, herein designated VGAM GENE, is a viral gene contained in the genome of Turkey Adenovirus 3. VGAM1244 host target gene, herein designated VGAM HOST TARGET GENE, is a human gene contained in the human genome.

VGAM1244 gene encodes a VGAM1244 precursor RNA, herein designated VGAM PRECURSOR RNA. Similar to other miRNA genes, and unlike most ordinary genes, VGAM1244 precursor RNA does not encode a protein. A nucleotide sequence identical or highly similar to the nucleotide sequence of VGAM1244 precursor RNA is designated SEQ ID:1230, and is provided hereinbelow with reference to the sequence listing part. Nucleotide sequence SEQ ID:1230 is located at position 24452 relative to the genome of Turkey Adenovirus 3.

VGAM1244 precursor RNA folds onto itself, forming VGAM1244 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1244 folded precursor RNA into VGAM1244 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM1244 RNA is designated SEQ ID:3955, and is provided hereinbelow with reference to the sequence listing part.

VGAM1244 host target gene, herein designated VGAM HOST TARGET GENE, encodes a corresponding messenger RNA, VGAM1244 host target RNA, herein designated VGAM HOST TARGET RNA. VGAM1244 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1244 RNA, herein designated VGAM RNA, binds complementarily to one or more host target binding sites located in untranslated regions of VGAM1244 host target RNA, herein designated VGAM HOST TARGET RNA. This complementary binding is due to the fact that the nucleotide sequence of VGAM1244 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1244 RNA, herein designated VGAM RNA, may have a different number of host target binding sites in untranslated regions of a VGAM1244 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1244 RNA, herein designated VGAM RNA, to host target binding sites on VGAM1244 host target RNA, herein designated VGAM HOST TARGET RNA, such as BINDING SITE I, BINDING SITE II and BINDING SITE III, inhibits translation of VGAM1244 host target RNA into VGAM1244 host target protein, herein designated VGAM HOST TARGET PROTEIN. VGAM host target protein is therefore outlined by a broken line.

It is appreciated that VGAM1244 host target gene, herein designated VGAM HOST TARGET GENE, in fact represents a plurality of VGAM1244 host target genes. The mRNA of each one of this plurality of VGAM1244 host target genes comprises one or more host target binding sites, each having a nucleotide sequence which is at least partly complementary to VGAM1244 RNA, herein designated VGAM RNA, and which when bound by VGAM1244 RNA causes inhibition of translation of respective one or more VGAM1244 host target proteins.

It is further appreciated by one skilled in the art that the mode of translational inhibition illustrated by FIG. 1 with specific reference to translational inhibition exerted by VGAM1244 gene, herein designated VGAM GENE, on one or more VGAM1244 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1244 is inhibition of expression of host target genes, as part of a novel viral mechanism of attacking a host. Accordingly, utilities of VGAM1244 include diagnosis, prevention and treatment of viral infection by Turkey Adenovirus 3. Specific functions, and accordingly utilities, of VGAM1244 correlate with, and may be deduced from, the identity of the host target genes which VGAM1244 binds and inhibits, and the function of these host target genes, as elaborated hereinbelow.

Nucleotide sequences of the VGAM1244 precursor RNA, herein designated VGAM PRECURSOR RNA, and of the 'diced' VGAM1244 RNA, herein designated VGAM RNA, and a schematic representation of the secondary folding of VGAM1244 folded precursor RNA, herein designated VGAM FOLDED PRECURSOR RNA, of VGAM1244 are further described hereinbelow with reference to Table 1.

Nucleotide sequences of host target binding sites, such as BINDING SITE-I, BINDING SITE-II and BINDING SITE-III of FIG. 1, found on VGAM1244 host target RNA, and schematic representation of the complementarity of each of these host target binding sites to VGAM1244 RNA, herein designated VGAM RNA, are described hereinbelow with reference to Table 2.

As mentioned hereinabove with reference to FIG. 1, a function of VGAM1244 gene, herein designated VGAM is inhibition of expression of VGAM1244 target genes. It is appreciated that specific functions, and accordingly utilities, of VGAM1244 correlate with, and may be deduced from, the identity of the target genes which VGAM1244 binds and inhibits, and the function of these target genes, as elaborated hereinbelow.

Coxsackie Virus and Adenovirus Receptor (CXADR, Accession NM_001338) is a VGAM1244 host target gene. CXADR BINDING SITE is HOST TARGET binding site found in the 3' untranslated region of mRNA encoded by CXADR, corresponding to a HOST TARGET binding site such as BINDING SITE I, BINDING SITE II or BINDING SITE III. Table 2 illustrates the complementarity of the nucleotide sequences of CXADR BINDING SITE, designated SEQ ID:7018, to the nucleotide sequence of VGAM1244 RNA, herein designated VGAM RNA, also designated SEQ ID:3955.

A function of VGAM1244 is therefore inhibition of Coxsackie Virus and Adenovirus Receptor (CXADR, Accession NM_001338), a gene which is a member of the immunoglobulin superfamily. Accordingly, utilities of VGAM1244 include diagnosis, prevention and treatment of diseases and clinical conditions associated with CXADR. The function of CXADR has been established by previous studies. Bergelson et al. (1997) used immunoaffinity chromatography to purify a Coxsackie virus and adenovirus receptor protein, which they termed CAR. Based on the sequences of tryptic peptides, they cloned the corresponding cDNA from a HeLa cell library. The CAR cDNA encodes a predicted 365-amino acid polypeptide that contains a single transmembrane domain and is a member of the immunoglobulin superfamily. Bergelson et al. (1997) found that Chinese hamster cells bound to labeled Coxsackie viruses B3 and B4 and became susceptible to infection when transfected with CAR cDNA. Myocarditis and dilated cardiomyopathy are common causes of morbidity and mortality in children. Many studies have implicated the enteroviruses and particularly the Coxsackie virus B family as etiologic agents of the acquired forms of these diseases. However, Martin et al. (1994), Griffin et al. (1995), and Pauschinger et al. (1999) showed that the group C adenoviruses are as commonly detected as enteroviruses in the myocardium of children and adults with these diseases. The description of the common Coxsackie virus B and adenovirus receptor offers a partial explanation for the observation that 2 such divergent virus families cause these diseases.

Full details of the abovementioned studies are described in the following publications, the disclosure of which are hereby incorporated by reference:

Bergelson, J. M.; Cunningham, J. A.; Droguett, G.; Kurt-Jones, E. A.; Krithivas, A.; Hong, J. S.; Horwitz, M. S.; Crowell, R. L.; Finberg, R. W.: Isolation of a common receptor for coxsackie B viruses and adenoviruses 2 and 5. Science 275:1320-1323, 1997; and Pauschinger, M.; Bowles, N. E.; Fuentes-Garcia, F. J.; Pham, V.; Kuhl, U.; Schwimmbeck, P. L.; Schultheiss, H.-P.; Towbin, J. A.: Detection of adenoviral genome in the myocardium of adu.

Further studies establishing the function and utilities of CXADR are found in John Hopkins OMIM database record ID 602621, and in sited publications numbered 8554-8560 listed in the bibliography section hereinbelow, which are also hereby incorporated by reference. Meis1, Myeloid Ecotropic Viral Integration Site 1 Homolog 2 (mouse) (MEIS2, Accession NM_020149) is another VGAM1244 host target gene. MEIS2 BINDING SITE is HOST TARGET binding site found in the 3' untranslated region of mRNA encoded by MEIS2, corresponding to a HOST TARGET binding site such as BINDING SITE I, BINDING SITE II or BINDING SITE III. Table 2 illustrates the complementarity of the nucleotide sequences of MEIS2 BINDING SITE, designated SEQ ID:21345, to the nucleotide sequence of VGAM1244 RNA, herein designated VGAM RNA, also designated SEQ ID:3955.

Another function of VGAM1244 is therefore inhibition of Meis1, Myeloid Ecotropic Viral Integration Site 1 Homolog 2 (mouse) (MEIS2, Accession NM_020149), a gene which may regulate gene expression and control cell differentiation. Accordingly, utilities of VGAM1244 include diagnosis, prevention and treatment of diseases and clinical conditions associated with MEIS2. The function of MEIS2 has been established by previous studies. The Meis1 locus (OMIM Ref. No. 601739) was isolated as a common site of viral integration involved in myeloid leukemia in BXH-2 mice. Steelman et al. (1997) noted that MEIS1 encodes a homeo box protein belonging to the TALE ('three amino acid loop extension') family of homeodomain-containing proteins. The homeodomain of MEIS1 is the only conserved motif in the entire 390-amino acid protein. Steelman et al. (1997) reported that Southern blot analyses using the MEIS1 homeodomain as a probe revealed the existence of a family of Meis1-related genes (MRGs) in several divergent species. In addition, the 3-prime untranslated region (UTR) of MEIS1 is remarkably conserved in evolution. Steelman et al. (1997) cloned Meis1-related genes from the mouse and human genomes. One such gene, which the authors designated Mrg1, shares a similar genomic organization in the mouse with Meis1 but was found to be located on mouse chromosome 2, not mouse chromosome 11, where Meis1 maps. In human S, Steelman et al. (1997) mapped MRG1 to 15q22-q25 in a region associated with various cytogenetic abnormalities associated with acute myelocytic leukemia, chronic myeloid leukemia, and astrocytomas. The authors reported data suggesting that another related gene (MRG2) maps to human chromosome 17. During the course of their studies of the human MEIS1 homeo box gene, Smith et al. (1997) identified a gene closely related but not identical to MEIS1. Sequence analysis showed it to be the human counterpart of the mouse gene Meis2 (Nakamura et al., 1996). Human MEIS2 was found to be expressed in various human tissues. In hematopoietic tissues, the lymphoid organs expressed high levels of MEIS2 as 2 transcripts of 4.0 kb and 3.5 kb. MEIS2 is also expressed in some regions of the brain, such as the putamen. Nakamura et al. (1996) mapped the mouse Meis2 gene to chromosome 2 in a region syntenic to human 15q. By fluorescence in situ hybridization with a genomic MEIS2 clone, Smith et al. (1997) mapped the human MEIS2 gene to a position that is 27% of the distance from the chromosome 15 centromere to the telomere, corresponding to 15q14. Capdevila et al. (1999) showed that restriction of expression of the chick homeobox gene Meis2 to proximal regions of the limb bud is essential for limb development, since ectopic Meis2 severely disrupted limb outgrowth. They also uncovered an antagonistic relationship between the secreted factor Gremlin (OMIM Ref. No. 603054) and the bone morphogenetic proteins (Bmps; OMIM Ref. No. 112264) that is required to maintain the Sonic hedgehog (OMIM Ref. No. 600725)/fibroblast growth factor (see OMIM Ref. No. 131220) loop that regulates distal outgrowth. These proximal and distal factors were found to have coordinated activities: Meis2 could repress distal genes, and the Bmp and Hoxd (OMIM Ref. No. 142987) genes restricted Meis2 expression to the proximal limb bud. Moreover, combinations of Bmps and apical ectodermal ridge (AER) factors were sufficient to distalize proximal limb cells. These results unveiled a set of proximal-distal regulatory interactions that establish and maintain outgrowth of the vertebrate limb. Mercader et al. (1999) described the role of homeo box genes Meis1, Meis2, and Pbx1 (OMIM Ref. No. 176310) in the development of mouse, chicken, and Drosophila limbs. Mercader et al. (1999) found that Meis1 and Meis2 expression is restricted to the proximal domain, coincident with the previously reported domain in which Pbx1 is localized to the nucleus. Meis1 regulates Pbx1 activity by promoting nuclear import of the Pbx1 protein. Mercader et al. (1999) also demonstrated that ectopic expression of Meis1 in chicken disrupts distal limb development and induces distal-to-proximal transformations. Mercader et al. (1999) concluded that the restriction of Meis1 to proximal regions of the vertebrate limb is essential to specify cell fates and differentiation patterns along the proximodistal axis of the limb.

Full details of the abovementioned studies are described in the following publications, the disclosure of which are hereby incorporated by reference:

Capdevila, J.; Tsukui, T.; Esteban, C. R.; Zappavigna, V.; Belmonte, J. C. I.: Control of vertebrate limb outgrowth by the proximal factor Meis2 and distal antagonism of BMPs by Gremlin. Molec. Cell 4:839-849, 1999; and Mercader, N.; Leonardo, E.; Azpiazu, N.; Serrano, A.; Morata, G.; Martinez-A, C.; Torres, M.: Conserved regulation of proximodistal limb axis development by Meis1/Hth. Nature 402:425.

Further studies establishing the function and utilities of MEIS2 are found in John Hopkins OMIM database record ID 601740, and in sited publications numbered 9329, 10366-933 and 9405 listed in the bibliography section hereinbelow, which are also hereby incorporated by reference. DKFZP564D172 (Accession NM_032042) is another VGAM1244 host target gene. DKFZP564D172 BINDING SITE is HOST TARGET binding site found in the 3' untranslated region of mRNA encoded by DKFZP564D172, corresponding to a HOST TARGET binding site such as BINDING SITE I, BINDING SITE II or BINDING SITE III. Table 2 illustrates the complementarity of the nucleotide sequences of DKFZP564D172 BINDING SITE, designated SEQ ID:25751, to the nucleotide sequence of VGAM1244 RNA, herein designated VGAM RNA, also designated SEQ ID:3955.

Another function of VGAM1244 is therefore inhibition of DKFZP564D172 (Accession NM_032042). Accordingly, utilities of VGAM1244 include diagnosis, prevention and treatment of diseases and clinical conditions associated with DKFZP564D172. HSMPP8 (Accession XM_167894) is another VGAM1244 host target gene. HSMPP8 BINDING SITE is HOST TARGET binding site found in the 3' untranslated region of mRNA encoded by HSMPP8, corresponding to a HOST TARGET binding site such as BINDING SITE I, BINDING SITE II or BINDING SITE III. Table 2 illustrates the complementarity of the nucleotide sequences of HSMPP8 BINDING SITE, designated SEQ ID:44901, to the nucleotide sequence of VGAM1244 RNA, herein designated VGAM RNA, also designated SEQ ID:3955.

Another function of VGAM1244 is therefore inhibition of HSMPP8 (Accession XM_167894). Accordingly, utilities of VGAM1244 include diagnosis, prevention and treatment of diseases and clinical conditions associated with HSMPP8. Leucine-rich Repeat LGI Family, Member 4 (LGI4, Accession NM_139284) is another VGAM1244 host target gene. LGI4 BINDING SITE is HOST TARGET binding site found in the 5' untranslated region of mRNA encoded by LGI4, corresponding to a HOST TARGET binding site such as BINDING SITE I, BINDING SITE II or BINDING SITE III. Table 2 illustrates the complementarity of the nucleotide sequences of LGI4 BINDING SITE, designated SEQ ID:29287, to the nucleotide sequence of VGAM1244 RNA, herein designated VGAM RNA, also designated SEQ ID:3955.

Another function of VGAM1244 is therefore inhibition of Leucine-rich Repeat LGI Family, Member 4 (LGI4, Accession NM_139284). Accordingly, utilities of VGAM1244 include diagnosis, prevention and treatment of diseases and clinical conditions associated with LGI4. Mitogen-activated Protein Kinase 6 (MAPK6, Accession NM_002748) is another VGAM1244 host target gene. MAPK6 BINDING SITE is HOST TARGET binding site found in the 5' untranslated region of mRNA encoded by MAPK6, corresponding to a HOST TARGET binding site such as BINDING SITE I, BINDING SITE II or BINDING SITE III. Table 2 illustrates the complementarity of the nucleotide sequences of MAPK6 BINDING SITE, designated SEQ ID:8625, to the nucleotide sequence of VGAM1244 RNA, herein designated VGAM RNA, also designated SEQ ID:3955.

Another function of VGAM1244 is therefore inhibition of Mitogen-activated Protein Kinase 6 (MAPK6, Accession NM_002748). Accordingly, utilities of VGAM1244 include diagnosis, prevention and treatment of diseases and clinical conditions associated with MAPK6. FIG. 1 further provides a conceptual description of a novel bioinformatically detected viral gene of the present invention, referred to here as Viral Genomic Address Messenger 1245 (VGAM1245) viral gene, which modulates expression of respective host target genes thereof, the function and utility of which host target genes is known in the art.

VGAM1245 is a novel bioinformatically detected regulatory, non protein coding, viral micro RNA (miRNA) gene. The method by which VGAM1245 was detected is described hereinabove with reference to FIGS. 1-8.

VGAM1245 gene, herein designated VGAM GENE, is a viral gene contained in the genome of Turkey Adenovirus 3. VGAM1245 host target gene, herein designated VGAM HOST TARGET GENE, is a human gene contained in the human genome.

VGAM1245 gene encodes a VGAM1245 precursor RNA, herein designated VGAM PRECURSOR RNA. Similar to other miRNA genes, and unlike most ordinary genes, VGAM1245 precursor RNA does not encode a protein. A nucleotide sequence identical or highly similar to the nucleotide sequence of VGAM1245 precursor RNA is designated SEQ ID:1231, and is provided hereinbelow with reference to the sequence listing part. Nucleotide sequence SEQ ID:1231 is located at position 19532 relative to the genome of Turkey Adenovirus 3.

VGAM1245 precursor RNA folds onto itself, forming VGAM1245 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1245 folded precursor RNA into VGAM1245 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1245 RNA is designated SEQ ID:3956, and is provided hereinbelow with reference to the sequence listing part.

VGAM1245 host target gene, herein designated VGAM HOST TARGET GENE, encodes a corresponding messenger RNA, VGAM1245 host target RNA, herein designated VGAM HOST TARGET RNA. VGAM1245 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1245 RNA, herein designated VGAM RNA, binds complementarily to one or more host target binding sites located in untranslated regions of VGAM1245 host target RNA, herein designated VGAM HOST TARGET RNA. This complementary binding is due to the fact that the nucleotide sequence of VGAM1245 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1245 RNA, herein designated VGAM RNA, may have a different number of host target binding sites in untranslated regions of a VGAM1245 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1245 RNA, herein designated VGAM RNA, to host target binding sites on VGAM1245 host target RNA, herein designated VGAM HOST TARGET RNA, such as BINDING SITE I, BINDING SITE II and BINDING SITE III, inhibits translation of VGAM1245 host target RNA into VGAM1245 host target protein, herein designated VGAM HOST TARGET PROTEIN. VGAM host target protein is therefore outlined by a broken line.

It is appreciated that VGAM1245 host target gene, herein designated VGAM HOST TARGET GENE, in fact represents a plurality of VGAM1245 host target genes. The mRNA of each one of this plurality of VGAM1245 host target genes comprises one or more host target binding sites, each having a nucleotide sequence which is at least partly complementary to VGAM1245 RNA, herein designated VGAM RNA, and which when bound by VGAM1245 RNA causes inhibition of translation of respective one or more VGAM1245 host target proteins.

It is further appreciated by one skilled in the art that the mode of translational inhibition illustrated by FIG. 1 with specific reference to translational inhibition exerted by VGAM1245 gene, herein designated VGAM GENE, on one or more VGAM1245 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1245 is inhibition of expression of host target genes, as part of a novel viral mechanism of attacking a host. Accordingly, utilities of VGAM1245 include diagnosis, prevention and treatment of viral infection by Turkey Adenovirus 3. Specific functions, and accordingly utilities, of VGAM1245 correlate with, and may be deduced from, the identity of the host target genes which VGAM1245 binds and inhibits, and the function of these host target genes, as elaborated hereinbelow.

Nucleotide sequences of the VGAM1245 precursor RNA, herein designated VGAM PRECURSOR RNA, and of the 'diced' VGAM1245 RNA, herein designated VGAM RNA, and a schematic representation of the secondary folding of VGAM1245 folded precursor RNA, herein designated VGAM FOLDED PRECURSOR RNA, of VGAM1245 are further described hereinbelow with reference to Table 1.

Nucleotide sequences of host target binding sites, such as BINDING SITE-I, BINDING SITE-II and BINDING SITE-III of FIG. 1, found on VGAM1245 host target RNA, and schematic representation of the complementarity of each of these host target binding sites to VGAM1245 RNA, herein designated VGAM RNA, are described hereinbelow with reference to Table 2.

As mentioned hereinabove with reference to FIG. 1, a function of VGAM1245 gene, herein designated VGAM is inhibition of expression of VGAM1245 target genes. It is appreciated that specific functions, and accordingly utilities, of VGAM1245 correlate with, and may be deduced from, the identity of the target genes which VGAM1245 binds and inhibits, and the function of these target genes, as elaborated hereinbelow.

Arylsulfatase D (ARSD, Accession NM_009589) is a VGAM1245 host target gene. ARSD BINDING SITE is HOST TARGET binding site found in the 3" untranslated region of mRNA encoded by ARSD, corresponding to a HOST TARGET binding site such as BINDING SITE I, BINDING SITE II or BINDING SITE III. Table 2 illustrates the complementarity of the nucleotide sequences of ARSD BINDING SITE, designated SEQ ID:14316, to the nucleotide sequence of VGAM1245 RNA, herein designated VGAM RNA, also designated SEQ ID:3956.

A function of VGAM1245 is therefore inhibition of Arylsulfatase D (ARSD, Accession NM_009589), a gene which hydrolyzes sulfate groups from sugar residues in complex glycoconjugates. Accordingly, utilities of VGAM1245 include diagnosis, prevention and treatment of diseases and clinical conditions associated with ARSD. The function of ARSD and its association with various diseases and clinical conditions, has been established by previous studies, as described hereinabove with reference to VGAM232. V-erb-a Erythroblastic Leukemia Viral Oncogene Homolog 4 (avian) (ERBB4, Accession NM_005235) is another VGAM1245 host target gene. ERBB4 BINDING SITE is HOST TARGET binding site found in the 3' untranslated region of mRNA encoded by ERBB4, corresponding to a HOST TARGET binding site such as BINDING SITE I, BINDING SITE II or BINDING SITE III. Table 2 illustrates the complementarity of the nucleotide sequences of ERBB4 BINDING SITE, designated SEQ ID:11746, to the nucleotide sequence of VGAM1245 RNA, herein designated VGAM RNA, also designated SEQ ID:3956.

Another function of VGAM1245 is therefore inhibition of V-erb-a Erythroblastic Leukemia Viral Oncogene Homolog 4 (avian) (ERBB4, Accession NM_005235), a gene which may function in growth/differentiation of normal and transformed cells. Accordingly, utilities of VGAM1245 include diagnosis, prevention and treatment of diseases and clinical conditions associated with ERBB4. The function of ERBB4 and its association with various diseases and clinical conditions, has been established by previous studies, as described hereinabove with reference to VGAM381. Galanin Receptor 1 (GALR1, Accession NM_001480) is another VGAM1245 host target gene. GALR1 BINDING SITE is HOST TARGET binding site found in the 3' untranslated region of mRNA encoded by GALR1, corresponding to a HOST TARGET binding site such as BINDING SITE I, BINDING SITE II or BINDING SITE III. Table 2 illustrates the complementarity of the nucleotide sequences of GALR1 BINDING SITE, designated SEQ ID:7215, to the nucleotide sequence of VGAM1245 RNA, herein designated VGAM RNA, also designated SEQ ID:3956.

Another function of VGAM1245 is therefore inhibition of Galanin Receptor 1 (GALR1, Accession NM_001480), a gene which plays a role in regulating ion transport. Accordingly, utilities of VGAM1245 include diagnosis, prevention and treatment of diseases and clinical conditions associated with GALR1. The function of GALR1 has been established by previous studies. Galanin (OMIM Ref. No. 137035) is an important neuromodulator present in the brain, gastrointestinal system, and hypothalamopituitary axis. It is a 30-amino acid non-C-terminally amidated peptide that potently stimulates growth hormone secretion, inhibits cardiac vagal slowing of heart rate, abolishes sinus arrhythmia, and inhibits postprandial gastrointestinal motility. The actions of galanin are mediated through interaction with specific membrane receptors that are members of the 7-transmembrane family of G protein-coupled receptors. Walli et al. (1994) identified and biochemically characterized a specific receptor for galanin in various areas of human brain. Habert-Ortoli et al. (1994) also cloned a functional human galanin receptor. Hecht et al. (1999) showed that pathogenic E. coli, but not normal commensal organisms, increase GALR1, which they called GAL1R, mRNA synthesis and (125)I-galanin binding sites. In mice infected with enterohemorrhagic E. coli by gavage, infection caused a progressive increase in both nuclear factor kappa-B (see OMIM Ref. No. 164011) activation and GALR1 expression, with maximal levels of both observed 3 days after gavage. With Ussing chamber studies, they showed that colons infected with enterohemorrhagic E. coli, but not those exposed to normal colonic flora, markedly increased short-circuit current in response to galanin. These data indicated that pathogen-induced increases in GALR1 expression by epithelial cells lining the colon represent a novel unifying pathway responsible for at least a portion of the excessive fluid secretion observed during infectious diarrhea.

Full details of the abovementioned studies are described in the following publications, the disclosure of which are hereby incorporated by reference:

Hecht, G.; Marrero, J. A.; Danilkovich, A.; Matkowskyj, K. A.; Savkovic, S. D.; Koutsouris, A.; Benya, R. V.: Pathogenic Escherichia coli increase Cl- secretion from intestinal epithelia by upregulating galanin-1 receptor expression. J. Clin. Invest. 104:253-262, 1999; and Jacoby, A. S.; Webb, G. C.; Liu, M. L.; Kofler, B.; Hort, Y. J.; Fathi, Z.; Bottema, C. D. K.; Shine, J.; Iismaa, T. P.: Structural organization of the mouse and human GALR1 galanin r.

Further studies establishing the function and utilities of GALR1 are found in John Hopkins OMIM database record ID 600377, and in sited publications numbered 1627-1629, 1025 and 10376-10380 listed in the bibliography section hereinbelow, which are also hereby incorporated by reference. FLJ10204 (Accession NM_018024) is another VGAM1245 host target gene. FLJ10204 BINDING SITE is HOST TARGET binding site found in the 3' untranslated region of mRNA encoded by FLJ10204, corresponding to a HOST TARGET binding site such as BINDING SITE I, BINDING SITE II or BINDING SITE III. Table 2 illustrates the complementarity of the nucleotide sequences of FLJ10204 BINDING SITE, designated SEQ ID:19765, to the nucleotide sequence of VGAM1245 RNA, herein designated VGAM RNA, also designated SEQ ID:3956.

Another function of VGAM1245 is therefore inhibition of FLJ10204 (Accession NM_018024). Accordingly, utilities of VGAM1245 include diagnosis, prevention and treatment of diseases and clinical conditions associated with FLJ10204. FLJ21272 (Accession NM_025032) is another VGAM1245 host target gene. FLJ21272 BINDING SITE is HOST TARGET binding site found in the 3' untranslated region of mRNA encoded by FLJ21272, corresponding to a HOST TARGET binding site such as BINDING SITE I, BINDING SITE II or BINDING SITE III. Table 2 illustrates the complementarity of the nucleotide sequences of FLJ21272 BINDING SITE, designated SEQ ID:24629, to the nucleotide sequence of VGAM1245 RNA, herein designated VGAM RNA, also designated SEQ ID:3956.

Another function of VGAM1245 is therefore inhibition of FLJ21272 (Accession NM_025032). Accordingly, utilities of VGAM1245 include diagnosis, prevention and treatment of diseases and clinical conditions associated with FLJ21272. KIAA0461 (Accession XM_047883) is another VGAM1245 host target gene. KIAA0461 BINDING SITE is HOST TARGET binding site found in the 3' untranslated region of mRNA encoded by KIAA0461, corresponding to a HOST TARGET binding site such as BINDING SITE I, BINDING SITE II or BINDING SITE III. Table 2 illustrates the complementarity of the nucleotide sequences of KIAA0461 BINDING SITE, designated SEQ ID:35072, to the nucleotide sequence of VGAM1245 RNA, herein designated VGAM RNA, also designated SEQ ID:3956.

Another function of VGAM1245 is therefore inhibition of KIAA0461 (Accession XM_047883). Accordingly, utilities of VGAM1245 include diagnosis, prevention and treatment of diseases and clinical conditions associated with KIAA0461. LOC150139 (Accession XM_086794) is another VGAM1245 host target gene. LOC150139 BINDING SITE is HOST TARGET binding site found in the 3' untranslated region of mRNA encoded by LOC150139, corresponding to a HOST TARGET binding site such as BINDING SITE I, BINDING SITE II or BINDING SITE III. Table 2 illustrates the complementarity of the nucleotide sequences of LOC150139 BINDING SITE, designated SEQ ID:38858, to the nucleotide sequence of VGAM1245 RNA, herein designated VGAM RNA, also designated SEQ ID:3956.

Another function of VGAM1245 is therefore inhibition of LOC150139 (Accession XM_086794). Accordingly, utilities of VGAM1245 include diagnosis, prevention and treatment of diseases and clinical conditions associated with LOC150139. LOC150481 (Accession XM_086929) is another VGAM1245 host target gene. LOC150481 BINDING SITE is HOST TARGET binding site found in the 3' untranslated region of mRNA encoded by LOC150481, corresponding to a HOST TARGET binding site such as BINDING SITE I, BINDING SITE II or BINDING SITE III. Table 2 illustrates the complementarity of the nucleotide sequences of LOC150481 BINDING SITE, designated SEQ ID:38978, to the nucleotide sequence of VGAM1245 RNA, herein designated VGAM RNA, also designated SEQ ID:3956.

Another function of VGAM1245 is therefore inhibition of LOC150481 (Accession XM_086929). Accordingly, utilities of VGAM1245 include diagnosis, prevention and treatment of diseases and clinical conditions associated with LOC150481. FIG. 1 further provides a conceptual description of a novel bioinformatically detected viral gene of the present invention, referred to here as Viral Genomic Address Messenger 1246 (VGAM1246) viral gene, which modulates expression of respective host target genes thereof, the function and utility of which host target genes is known in the art.

VGAM1246 is a novel bioinformatically detected regulatory, non protein coding, viral micro RNA (miRNA) gene. The method by which VGAM1246 was detected is described hereinabove with reference to FIGS. 1-8.

VGAM1246 gene, herein designated VGAM GENE, is a viral gene contained in the genome of Turkey Adenovirus 3. VGAM1246 host target gene, herein designated VGAM HOST TARGET GENE, is a human gene contained in the human genome.

VGAM1246 gene encodes a VGAM1246 precursor RNA, herein designated VGAM PRECURSOR RNA. Similar to other miRNA genes, and unlike most ordinary genes, VGAM1246 precursor RNA does not encode a protein. A nucleotide sequence identical or highly similar to the nucleotide sequence of VGAM1246 precursor RNA is designated SEQ ID:1232, and is provided hereinbelow with reference to the sequence listing part. Nucleotide sequence SEQ ID:1232 is located at position 24059 relative to the genome of Turkey Adenovirus 3.

VGAM1246 precursor RNA folds onto itself, forming VGAM1246 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1246 folded precursor RNA into VGAM1246 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1246 RNA is designated SEQ ID:3957, and is provided hereinbelow with reference to the sequence listing part.

VGAM1246 host target gene, herein designated VGAM HOST TARGET GENE, encodes a corresponding messenger RNA, VGAM1246 host target RNA, herein designated VGAM HOST TARGET RNA. VGAM1246 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1246 RNA, herein designated VGAM RNA, binds complementarily to one or more host target binding sites located in untranslated regions of VGAM1246 host target RNA, herein designated VGAM HOST TARGET RNA. This complementary binding is due to the fact that the nucleotide sequence of VGAM1246 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1246 RNA, herein designated VGAM RNA, may have a different number of host target binding sites in untranslated regions of a VGAM1246 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1246 RNA, herein designated VGAM RNA, to host target binding sites on VGAM1246 host target RNA, herein designated VGAM HOST TARGET RNA, such as BINDING SITE I, BINDING SITE II and BINDING SITE III, inhibits translation of VGAM1246 host target RNA into VGAM1246 host target protein, herein designated VGAM HOST TARGET PROTEIN. VGAM host target protein is therefore outlined by a broken line.

It is appreciated that VGAM1246 host target gene, herein designated VGAM HOST TARGET GENE, in fact represents a plurality of VGAM1246 host target genes. The mRNA of each one of this plurality of VGAM1246 host target genes comprises one or more host target binding sites, each having a nucleotide sequence which is at least partly complementary to VGAM1246 RNA, herein designated VGAM RNA, and which when bound by VGAM1246 RNA causes inhibition of translation of respective one or more VGAM1246 host target proteins.

It is further appreciated by one skilled in the art that the mode of translational inhibition illustrated by FIG. 1 with specific reference to translational inhibition exerted by VGAM1246 gene, herein designated VGAM GENE, on one or more VGAM1246 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1246 is inhibition of expression of host target genes, as part of a novel viral mechanism of attacking a host. Accordingly, utilities of VGAM1246 include diagnosis, prevention and treatment of viral infection by Turkey Adenovirus 3. Specific functions, and accordingly utilities, of VGAM1246 correlate with, and may be deduced from, the identity of the host target genes which VGAM1246 binds and inhibits, and the function of these host target genes, as elaborated hereinbelow.

Nucleotide sequences of the VGAM1246 precursor RNA, herein designated VGAM PRECURSOR RNA, and of the 'diced' VGAM1246 RNA, herein designated VGAM RNA, and a schematic representation of the secondary folding of VGAM1246 folded precursor RNA, herein designated VGAM FOLDED PRECURSOR RNA, of VGAM1246 are further described hereinbelow with reference to Table 1.

Nucleotide sequences of host target binding sites, such as BINDING SITE-I, BINDING SITE-II and BINDING SITE-III of FIG. 1, found on VGAM1246 host target RNA, and schematic representation of the complementarity of each of these host target binding sites to VGAM1246 RNA, herein designated VGAM RNA, are described hereinbelow with reference to Table 2.

As mentioned hereinabove with reference to FIG. 1, a function of VGAM1246 gene, herein designated VGAM is inhibition of expression of VGAM1246 target genes. It is appreciated that specific functions, and accordingly utilities, of VGAM1246 correlate with, and may be deduced from, the identity of the target genes which VGAM1246 binds and inhibits, and the function of these target genes, as elaborated hereinbelow.

ATP-binding Cassette, Sub-family C (CFTR/MRP), Member 12 (ABCC12, Accession NM_033226) is a VGAM1246 host target gene. ABCC12 BINDING SITE is HOST TARGET binding site found in the 5' untranslated region of mRNA encoded by ABCC12, corresponding to a HOST TARGET binding site such as BINDING SITE I, BINDING SITE II or BINDING SITE III. Table 2 illustrates the complementarity of the nucleotide sequences of ABCC12 BINDING SITE, designated SEQ ID:27073, to the nucleotide sequence of VGAM1246 RNA, herein designated VGAM RNA, also designated SEQ ID:3957.

A function of VGAM1246 is therefore inhibition of ATP-binding Cassette, Sub-family C (CFTR/MRP), Member 12 (ABCC12, Accession NM_033226), a gene which acts as a multispecific organic anion pump which can transport nucleotide analogs (by similarity). Accordingly, utilities of VGAM1246 include diagnosis, prevention and treatment of diseases and clinical conditions associated with ABCC12. The function of ABCC12 has been established by previous studies. Tammur et al. (2001) identified ABCC12 and ABCC11 (OMIM Ref. No. 607040) by database analysis using ABC transporter sequences as queries. The deduced 1,359-amino acid ABCC12 protein contains 2 ATP-binding domains and 2 transmembrane regions. It shares 42% amino acid sequence identity with ABCC5 (OMIM Ref. No. 605251). PCR of a 16-tissue panel revealed expression only in testis, ovary, and prostate. Bera et al. (2002) detected expression in testis, pancreas, ovary, skeletal muscle, and various brain regions. Northern blot and dot blot analyses using variant-specific probes revealed a 4.5-kb transcript expressed in testis, normal breast, and breast cancer tissues, and a 1.3-kb transcript in brain, skeletal muscle, and ovary. In situ hybridization of normal and cancerous breast tissue revealed stronger staining in tumor cells. Tammur et al. (2001) mapped the ABCC12 gene to chromosome 16q12.1 by radiation hybrid analysis and by the presence of ABCC12 within a BAC clone. They stated that chromosomal localization, potential function, and expression profiles of the ABCC11 and ABCC12 genes make them promising candidates for paroxysmal kinesigenic choreoathetosis (PKC; 128200) and infantile convulsions with paroxysmal choreoathetosis (ICCA; 602066).

Full details of the abovementioned studies are described in the following publications, the disclosure of which are hereby incorporated by reference:

Tammur, J.; Prades, C.; Arnould, I.; Rzhetsky, A.; Hutchinson, A.; Adachi, M.; Schuetz, J. D.; Swoboda, K. J.; Ptacek, L. J.; Rosier, M.; Dean, M.; Allikmets, R.: Two new genes from the human ATP-binding cassette transporter superfamily, ABCC11 and ABCC12, tandemly duplicated on chromosome 16q12. Gene 273:89-96, 2001; and Bera, T. K.; Iavarone, C.; Kumar, V.; Lee, S.; Lee, B.; Pastan, I.: MRP9, an unusual truncated member of the ABC transporter superfamily, is highly expressed in breast cancer. Proc. Na.

Further studies establishing the function and utilities of ABCC12 are found in John Hopkins OMIM database record ID 607041, and in sited publications numbered 5171-5166 listed in the bibliography section hereinbelow, which are also hereby incorporated by reference. Beclin 1 (coiled-coil, myosin-like BCL2 interacting protein) (BECN1, Accession NM_003766) is another VGAM1246 host target gene. BECN1 BINDING SITE is HOST TARGET binding site found in the 3' untranslated region of mRNA encoded by BECN1, corresponding to a HOST TARGET binding site such as BINDING SITE I, BINDING SITE II or BINDING SITE III. Table 2 illustrates the complementarity of the nucleotide sequences of BECN1 BINDING SITE, designated SEQ ID:9843, to the nucleotide sequence of VGAM1246 RNA, herein designated VGAM RNA, also designated SEQ ID:3957.

Another function of VGAM1246 is therefore inhibition of Beclin 1 (coiled-coil, myosin-like BCL2 interacting protein) (BECN1, Accession NM_003766), a gene which protects cell from viral-induced apoptosis. Accordingly, utilities of VGAM1246 include diagnosis, prevention and treatment of diseases and clinical conditions associated with BECN1. The function of BECN1 has been established by previous studies. The process of autophagy, or bulk degradation of cellular proteins through an autophagosomic-lysosomal pathway, is important in normal growth control and may be defective in tumor cells. However, little is known about the genetic mediators of autophagy in mammalian cells or their role in tumor development. Beclin-1 was found to have structural similarity to the yeast autophagy gene, apg6/vps30, and is monoallelically deleted in 40 to 75% of sporadic human breast cancers and ovarian cancers. Liang et al. (1999) used gene transfer techniques to demonstrate that beclin-1 promotes autophagy in autophagy-defective yeast with a targeted disruption of apg6/vps30, and in human MCF7 breast carcinoma cells. The autophagy-promoting activity of beclin-1 in MCF7 cells was associated with inhibition of MCF7 cellular proliferation, in vitro clonigenicity, and tumorigenesis in nude mice. Furthermore, endogenous beclin-1 protein expression is frequently low in human breast epithelial carcinoma cell lines and tissue, but is ubiquitous at high levels in normal breast epithelia. Thus, Liang et al. (1999) concluded that beclin-1 is a mammalian autophagy gene that can inhibit tumorigenesis and is expressed at decreased levels in human breast carcinoma. Liang et al. (1999) suggested that decreased expression of autophagy proteins may contribute to the development or progression of breast and other human malignancies. Short leucine-rich nuclear export signals (NESs), which were first identified in the human immunodeficiency virus-1 (HIV-1) Rev protein, are found in viral and cellular proteins required for RNA export. The NES forms a complex with CRM1 (OMIM Ref. No. 602559), the nuclear export receptor, and RanGTP (see OMIM Ref. No. 602362). Complex formation can be blocked by the fungicide leptomycin B. By structural analysis, Liang et al. (2001) identified an NES at positions 180 to 189 in BECN1. Fluorescence microscopy demonstrated nuclear and cytoplasmic expression of wildtype BECN1, while leptomycin B-treated BECN1 or BECN1 carrying leucine mutations in its NES were expressed only in the nucleus. Mutant BECN1 was unable to promote basal or nutrient deprivation-induced autophagy and was unable to suppress growth of breast cancer cells in vitro or in vivo. Liang et al. (2001) suggested that the nuclear export pathway may be important in the functional regulation of autophagic growth control.

Full details of the abovementioned studies are described in the following publications, the disclosure of which are hereby incorporated by reference:

Liang, X. H.; Jackson, S.; Seaman, M.; Brown, K.; Kempkes, B.; Hibshoosh, H.; Levine, B.: Induction of autophagy and inhibition of tumorigenesis by beclin 1. Nature 402:672-676, 1999; and Liang, X. H.; Yu, J.; Brown, K.; Levine, B.: Beclin 1 contains a leucine-rich nuclear export signal that is required for its autophagy and tumor suppressor function. Cancer Res. 61:34.

Further studies establishing the function and utilities of BECN1 are found in John Hopkins OMIM database record ID 604378, and in sited publications numbered 7073-7076 listed in the bibliography section hereinbelow, which are also hereby incorporated by reference. Cysteine Dioxygenase, Type I (CDO1, Accession NM_001801) is another VGAM1246 host target gene. CDO1 BINDING SITE is HOST TARGET binding site found in the 5' untranslated region of mRNA encoded by CDO1, corresponding to a HOST TARGET binding site such as BINDING SITE I, BINDING SITE II or BINDING SITE III. Table 2 illustrates the complementarity of the nucleotide sequences of CDO1 BINDING SITE, designated SEQ ID:7556, to the nucleotide sequence of VGAM1246 RNA, herein designated VGAM RNA, also designated SEQ ID:3957.

Another function of VGAM1246 is therefore inhibition of Cysteine Dioxygenase, Type I (CDO1, Accession NM_001801), a gene which is involved in degradation of cysteine to pyruvate. Accordingly, utilities of VGAM1246 include diagnosis, prevention and treatment of diseases and clinical conditions associated with CDO1. The function of CDO1 has been established by previous studies. The first step in the oxidation of cysteine to inorganic sulphate is its conversion to cysteine sulphinate by cysteine dioxygenase (CDO; EC 1.13.11.20). In rat, at least 2 enzymes catalyze this reaction, one cytosolic (CDO-I) and the other membrane-bound. Rat liver CDO contains 1 atom of iron per molecule of protein, and the enzyme is activated by anaerobic incubation with either L-cysteine or its analogs. Hosokawa et al. (1990) isolated rat liver cDNAs encoding the cytosolic CDO. The protein's predicted molecular weight of 23 kD was in good agreement with its apparent molecular mass by SDS-PAGE. By screening a human liver library with a rat CDO-I cDNA, McCann et al. (1994) identified human CDO-I cDNAs. The predicted 200-amino acid human and rat proteins are 94% identical. Northern blot analysis revealed that CDO-I is expressed as an approximately 1.5-kb mRNA in liver. Ramsden et al. (1997) reported that the human CDO-I gene contains 5 exons and spans more than 12 kb. By analysis of somatic cell hybrids and by fluorescence in situ hybridization, Jeremiah et al. (1996) mapped the CDO1 gene to human chromosome 5q22-q23. Using an interspecific backcross, these authors mapped the mouse homolog to the central region of mouse chromosome 18, in a region sharing homology of synteny with human chromosome 5.

Full details of the abovementioned studies are described in the following publications, the disclosure of which are hereby incorporated by reference:

Hosokawa, Y.; Matsumoto, A.; Oka, J.; Itakura, H.; Yamaguchi, K.: Isolation and characterization of a cDNA for rat liver cysteine dioxygenase. Biochem. Biophys. Res. Commun. 168:473-478, 1990; and Jeremiah, S.; McCann, K. P.; Williams, A. C.; Ramsden, D. B.; Pilz, A. J.; Fox, M. F.; Povey, S.: Chromosomal localisation of genes coding for human and mouse liver cytosolic cysteine.

Further studies establishing the function and utilities of CDO1 are found in John Hopkins OMIM database record ID 603943, and in sited publications numbered 5192-519 and 5169 listed in the bibliography section hereinbelow, which are also hereby incorporated by reference. Drebrin 1 (DBN1, Accession NM_004395) is another VGAM1246 host target gene. DBN1 BINDING SITE1 and DBN1 BINDING SITE2 are HOST TARGET binding sites found in untranslated regions of mRNA encoded by DBN1, corresponding to HOST TARGET binding sites such as BINDING SITE I, BINDING SITE II or BINDING SITE III. Table 2 illustrates the complementarity of the nucleotide sequences of DBN1 BINDING SITE1 and DBN1 BINDING SITE2, designated SEQ ID:10640 and SEQ ID:28125 respectively, to the nucleotide sequence of VGAM1246 RNA, herein designated VGAM RNA, also designated SEQ ID:3957.

Another function of VGAM1246 is therefore inhibition of Drebrin 1 (DBN1, Accession NM_004395). Accordingly, utilities of VGAM1246 include diagnosis, prevention and treatment of diseases and clinical conditions associated with DBN1. FUS1 (Accession NM_007275) is another VGAM1246 host target gene. FUS1 BINDING SITE is HOST TARGET binding site found in the 3' untranslated region of mRNA encoded by FUS1, corresponding to a HOST TARGET binding site such as BINDING SITE I, BINDING SITE II or BINDING SITE III. Table 2 illustrates the complementarity of the nucleotide sequences of FUS1 BINDING SITE, designated SEQ ID:14138, to the nucleotide sequence of VGAM1246 RNA, herein designated VGAM RNA, also designated SEQ ID:3957.

Another function of VGAM1246 is therefore inhibition of FUS1 (Accession NM_007275), a gene which may function as a tumor suppressor. Accordingly, utilities of VGAM1246 include diagnosis, prevention and treatment of diseases and clinical conditions associated with FUS1. The function of FUS1 has been established by previous studies. Lerman and Minna (2000) identified a FUS1 mutation in 2 nonsmall cell lung cancer (NSCLC) cell lines that resulted in a 28-bp truncation at the 3-prime end of exon 2 and a predicted protein of only 82 amino acids. Using SSCP and CpG island promoter methylation analyses, Kondo et al. (2001) failed to detect mutations, polymorphisms, or methylation of FUS1 in lung cancer specimens. Western blot analysis indicated low or no expression of FUS1 in lung cancer cell lines. Overexpression of transfected wildtype but not mutant FUS1 in NSCLCs led to the detection of an approximately 20-kD protein and a dramatic reduction in colony-forming cells. Ecdysone-induced expression of FUS1 had the same effects. Flow cytometric analysis indicated that the arrest occurred in G1 phase.

Full details of the abovementioned studies are described in the following publications, the disclosure of which are hereby incorporated by reference:

Kondo, M.; Ji, L.; Kamibayashi, C.; Tomizawa, Y.; Randle, D.; Sekido, Y.; Yokota, J.; Kashuba, V.; Zabarovsky, E.; Kuzmin, I.; Lerman, M.; Roth, J.; Minna, J. D.: Overexpression of candidate tumor suppressor gene FUS1 isolated from the 3p21.3 homozygous deletion region leads to G1 arrest and growth inhibition of lung cancer cells. Oncogene 20:6258-6262, 2001; and Lerman, M. I.; Minna, J. D.: The 630-kb lung cancer homozygous deletion region on human chromosome 3p21.3: identification and evaluation of the resident candidate tumor suppressor gen.

Further studies establishing the function and utilities of FUS1 are found in John Hopkins OMIM database record ID 607052, and in sited publications numbered 5388 listed in the bibliography section hereinbelow, which are also hereby incorporated by reference. Protein Phosphatase 4, Regulatory Subunit 1 (PPP4R1, Accession NM_005134) is another VGAM1246 host target gene. PPP4R1 BINDING SITE is HOST TARGET binding site found in the 3' untranslated region of mRNA encoded by PPP4R1, corresponding to a HOST TARGET binding site such as BINDING SITE I, BINDING SITE II or BINDING SITE III. Table 2 illustrates the complementarity of the nucleotide sequences of PPP4R1 BINDING SITE, designated SEQ ID:11610, to the nucleotide sequence of VGAM1246 RNA, herein designated VGAM RNA, also designated SEQ ID:3957.

Another function of VGAM1246 is therefore inhibition of Protein Phosphatase 4, Regulatory Subunit 1 (PPP4R1, Accession NM_005134). Accordingly, utilities of VGAM1246 include diagnosis, prevention and treatment of diseases and clinical conditions associated with PPP4R1. Retinoic Acid Induced 3 (RAI3, Accession NM_003979) is another VGAM1246 host target gene. RAI3 BINDING SITE is HOST TARGET binding site found in the 3' untranslated region of mRNA encoded by RAI3, corresponding to a HOST TARGET binding site such as BINDING SITE I, BINDING SITE II or BINDING SITE III. Table 2 illustrates the complementarity of the nucleotide sequences of RAI3 BINDING SITE, designated SEQ ID:10113, to the nucleotide sequence of VGAM1246 RNA, herein designated VGAM RNA, also designated SEQ ID:3957.

Another function of VGAM1246 is therefore inhibition of Retinoic Acid Induced 3 (RAI3, Accession NM_003979). Accordingly, utilities of VGAM1246 include diagnosis, prevention and treatment of diseases and clinical conditions associated with RAI3. Transcription Factor 19 (SC1) (TCF19, Accession XM_175167) is another VGAM1246 host target gene. TCF19 BINDING SITE1 and TCF19 BINDING SITE2 are HOST TARGET binding sites found in untranslated regions of mRNA encoded by TCF19, corresponding to HOST TARGET binding sites such as BINDING SITE I, BINDING SITE II or BINDING SITE III. Table 2 illustrates the complementarity of the nucleotide sequences of TCF19 BINDING SITE1 and TCF19 BINDING SITE2, designated SEQ ID:46660 and SEQ ID:46709 respectively, to the nucleotide sequence of VGAM1246 RNA, herein designated VGAM RNA, also designated SEQ ID:3957.

Another function of VGAM1246 is therefore inhibition of Transcription Factor 19 (SC1) (TCF19, Accession XM_175167), a gene which plays an important role in the transcription of genes required for the later stages of cell cycle progression. Accordingly, utilities of VGAM1246 include diagnosis, prevention and treatment of diseases and clinical conditions associated with TCF19. The function of TCF19 and its association with various diseases and clinical conditions, has been established by previous studies, as described hereinabove with reference to VGAM299. UPF3A (Accession NM_023011) is another VGAM1246 host target gene. UPF3A BINDING SITE1 and UPF3A BINDING SITE2 are HOST TARGET binding sites found in untranslated regions of mRNA encoded by UPF3A, corresponding to HOST TARGET binding sites such as BINDING SITE I, BINDING SITE II or BINDING SITE III. Table 2 illustrates the complementarity of the nucleotide sequences of UPF3A BINDING SITE1 and UPF3A BINDING SITE2, designated SEQ ID:23275 and SEQ ID:33765 respectively, to the nucleotide sequence of VGAM1246 RNA, herein designated VGAM RNA, also designated SEQ ID:3957.

Another function of VGAM1246 is therefore inhibition of UPF3A (Accession NM_023011), a gene which facilitates the export of spliced mRNAs by recruiting mRNA export proteins. Accordingly, utilities of VGAM1246 include diagnosis, prevention and treatment of diseases and clinical conditions associated with UPF3A. The function of UPF3A and its association with various diseases and clinical conditions, has been established by previous studies, as described hereinabove with reference to VGAM360. FLJ12747 (Accession NM_032173) is another VGAM1246 host target gene. FLJ12747 BINDING SITE is HOST TARGET binding site found in the 3' untranslated region of mRNA encoded by FLJ12747, corresponding to a HOST TARGET binding site such as BINDING SITE I, BINDING SITE II or BINDING SITE III. Table 2 illustrates the complementarity of the nucleotide sequences of FLJ12747 BINDING SITE, designated SEQ ID:25881, to the nucleotide sequence of VGAM1246 RNA, herein designated VGAM RNA, also designated SEQ ID:3957.

Another function of VGAM1246 is therefore inhibition of FLJ12747 (Accession NM_032173). Accordingly, utilities of VGAM1246 include diagnosis, prevention and treatment of diseases and clinical conditions associated with FLJ12747. FLJ20313 (Accession NM_017762) is another VGAM1246 host target gene. FLJ20313 BINDING SITE is HOST TARGET binding site found in the 5' untranslated region of mRNA encoded by FLJ20313, corresponding to a HOST TARGET binding site such as BINDING SITE I, BINDING SITE II or BINDING SITE III. Table 2 illustrates the complementarity of the nucleotide sequences of FLJ20313 BINDING SITE, designated SEQ ID:19377, to the nucleotide sequence of VGAM1246 RNA, herein designated VGAM RNA, also designated SEQ ID:3957.

Another function of VGAM1246 is therefore inhibition of FLJ20313 (Accession NM_017762). Accordingly, utilities of VGAM1246 include diagnosis, prevention and treatment of diseases and clinical conditions associated with FLJ20313. KIAA0237 (Accession NM_014747) is another VGAM1246 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16449, to the nucleotide sequence of VGAM1246 RNA, herein designated VGAM RNA, also designated SEQ ID:3957.

Another function of VGAM1246 is therefore inhibition of KIAA0237 (Accession NM_014747). Accordingly, utilities of VGAM1246 include diagnosis, prevention and treatment of diseases and clinical conditions associated with KIAA0237. Ring Finger Protein 10 (RNF10, Accession NM_014868) is another VGAM1246 host target gene. RNF10 BINDING SITE is HOST TARGET binding site found in the 5' untranslated region of mRNA encoded by RNF10, corresponding to a HOST TARGET binding site such as BINDING SITE I, BINDING SITE II or BINDING SITE III. Table 2 illustrates the complementarity of the nucleotide sequences of RNF10 BINDING SITE, designated SEQ ID:16964, to the nucleotide sequence of VGAM1246 RNA, herein designated VGAM RNA, also designated SEQ ID:3957.

Another function of VGAM1246 is therefore inhibition of Ring Finger Protein 10 (RNF10, Accession NM_014868). Accordingly, utilities of VGAM1246 include diagnosis, prevention and treatment of diseases and clinical conditions associated with RNF10. Solute Carrier Family 31 (copper transporters), Member 2 (SLC31A2, Accession XM_011776) is another VGAM1246 host target gene. SLC31A2 BINDING SITE is HOST TARGET binding site found in the 3' untranslated region of mRNA encoded by SLC31A2, corresponding to a HOST TARGET binding site such as BINDING SITE I, BINDING SITE II or BINDING SITE III. Table 2 illustrates the complementarity of the nucleotide sequences of SLC31A2 BINDING SITE, designated SEQ ID:30194, to the nucleotide sequence of VGAM1246 RNA, herein designated VGAM RNA, also designated SEQ ID:3957.

Another function of VGAM1246 is therefore inhibition of Solute Carrier Family 31 (copper transporters), Member 2 (SLC31A2, Accession XM_011776). Accordingly, utilities of VGAM1246 include diagnosis, prevention and treatment of diseases and clinical conditions associated with SLC31A2. LOC115297 (Accession XM_053313) is another VGAM1246 host target gene. LOC115297 BINDING SITE is HOST TARGET binding site found in the 3' untranslated region of mRNA encoded by LOC115297, corresponding to a HOST TARGET binding site such as BINDING SITE I, BINDING SITE II or BINDING SITE III. Table 2 illustrates the complementarity of the nucleotide sequences of LOC115297 BINDING SITE, designated SEQ ID:36074, to the nucleotide sequence of VGAM1246 RNA, herein designated VGAM RNA, also designated SEQ ID:3957.

Another function of VGAM1246 is therefore inhibition of LOC115297 (Accession XM_053313). Accordingly, utilities of VGAM1246 include diagnosis, prevention and treatment of diseases and clinical conditions associated with LOC115297. LOC115817 (Accession NM_138452) is another VGAM1246 host target gene. LOC115817 BINDING SITE is HOST TARGET binding site found in the 5' untranslated region of mRNA encoded by LOC115817, corresponding to a HOST TARGET binding site such as BINDING SITE I, BINDING SITE II or BINDING SITE III. Table 2 illustrates the complementarity of the nucleotide sequences of LOC115817 BINDING SITE, designated SEQ ID:28814, to the nucleotide sequence of VGAM1246 RNA, herein designated VGAM RNA, also designated SEQ ID:3957.

Another function of VGAM1246 is therefore inhibition of LOC115817 (Accession NM_138452). Accordingly, utilities of VGAM1246 include diagnosis, prevention and treatment of diseases and clinical conditions associated with LOC115817. LOC126755 (Accession XM_059074) is another VGAM1246 host target gene. LOC126755 BINDING SITE is HOST TARGET binding site found in the 3' untranslated region of mRNA encoded by LOC126755, corresponding to a HOST TARGET binding site such as BINDING SITE I, BINDING SITE II or BINDING SITE III. Table 2 illustrates the complementarity of the nucleotide sequences of LOC126755 BINDING SITE, designated SEQ ID:36858, to the nucleotide sequence of VGAM1246 RNA, herein designated VGAM RNA, also designated SEQ ID:3957.

Another function of VGAM1246 is therefore inhibition of LOC126755 (Accession XM_059074). Accordingly, utilities of VGAM1246 include diagnosis, prevention and treatment of diseases and clinical conditions associated with LOC126755. LOC200014 (Accession XM_114087) is another VGAM1246 host target gene. LOC200014 BINDING SITE is HOST TARGET binding site found in the 3' untranslated region of mRNA encoded by LOC200014, corresponding to a HOST TARGET binding site such as BINDING SITE I, BINDING SITE II or BINDING SITE III. Table 2 illustrates the complementarity of the nucleotide sequences of LOC200014 BINDING SITE, designated SEQ ID:42692, to the nucleotide sequence of VGAM1246 RNA, herein designated VGAM RNA, also designated SEQ ID:3957.

Another function of VGAM1246 is therefore inhibition of LOC200014 (Accession XM_114087). Accordingly, utilities of VGAM1246 include diagnosis, prevention and treatment of diseases and clinical conditions associated with LOC200014. FIG. 1 further provides a conceptual description of a novel bioinformatically detected viral gene of the present invention, referred to here as Viral Genomic Address Messenger 1247 (VGAM1247) viral gene, which modulates expression of respective host target genes thereof, the function and utility of which host target genes is known in the art.

VGAM1247 is a novel bioinformatically detected regulatory, non protein coding, viral micro RNA (miRNA) gene. The method by which VGAM1247 was detected is described hereinabove with reference to FIGS. 1-8.

VGAM1247 gene, herein designated VGAM GENE, is a viral gene contained in the genome of Monkeypox Virus. VGAM1247 host target gene, herein designated VGAM HOST TARGET GENE, is a human gene contained in the human genome.

VGAM1247 gene encodes a VGAM1247 precursor RNA, herein designated VGAM PRECURSOR RNA. Similar to other miRNA genes, and unlike most ordinary genes, VGAM1247 precursor RNA does not encode a protein. A nucleotide sequence identical or highly similar to the nucleotide sequence of VGAM1247 precursor RNA is designated SEQ ID:1233, and is provided hereinbelow with reference to the sequence listing part. Nucleotide sequence SEQ ID:1233 is located at position 132081 relative to the genome of Monkeypox Virus.

VGAM1247 precursor RNA folds onto itself, forming VGAM1247 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1247 folded precursor RNA into VGAM1247 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1247 RNA is designated SEQ ID:3958, and is provided hereinbelow with reference to the sequence listing part.

VGAM1247 host target gene, herein designated VGAM HOST TARGET GENE, encodes a corresponding messenger RNA, VGAM1247 host target RNA, herein designated VGAM HOST TARGET RNA. VGAM1247 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1247 RNA, herein designated VGAM RNA, binds complementarily to one or more host target binding sites located in untranslated regions of VGAM1247 host target RNA, herein designated VGAM HOST TARGET RNA. This complementary binding is due to the fact that the nucleotide sequence of VGAM1247 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1247 RNA, herein designated VGAM RNA, may have a different number of host target binding sites in untranslated regions of a VGAM1247 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1247 RNA, herein designated VGAM RNA, to host target binding sites on VGAM1247 host target RNA, herein designated VGAM HOST TARGET RNA, such as BINDING SITE I, BINDING SITE II and BINDING SITE III, inhibits translation of VGAM1247 host target RNA into VGAM1247 host target protein, herein designated VGAM HOST TARGET PROTEIN. VGAM host target protein is therefore outlined by a broken line.

It is appreciated that VGAM1247 host target gene, herein designated VGAM HOST TARGET GENE, in fact represents a plurality of VGAM1247 host target genes. The mRNA of each one of this plurality of VGAM1247 host target genes comprises one or more host target binding sites, each having a nucleotide sequence which is at least partly complementary to VGAM1247 RNA, herein designated VGAM RNA, and which when bound by VGAM1247 RNA causes inhibition of translation of respective one or more VGAM1247 host target proteins.

It is further appreciated by one skilled in the art that the mode of translational inhibition illustrated by FIG. 1 with specific reference to translational inhibition exerted by VGAM1247 gene, herein designated VGAM GENE, on one or more VGAM1247 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1247 is inhibition of expression of host target genes, as part of a novel viral mechanism of attacking a host. Accordingly, utilities of VGAM1247 include diagnosis, prevention and treatment of viral infection by Monkeypox Virus. Specific functions, and accordingly utilities, of VGAM1247 correlate with, and may be deduced from, the identity of the host target genes which VGAM1247 binds and inhibits, and the function of these host target genes, as elaborated hereinbelow.

Nucleotide sequences of the VGAM1247 precursor RNA, herein designated VGAM PRECURSOR RNA, and of the 'diced' VGAM1247 RNA, herein designated VGAM RNA, and a schematic representation of the secondary folding of VGAM1247 folded precursor RNA, herein designated VGAM FOLDED PRECURSOR RNA, of VGAM1247 are further described hereinbelow with reference to Table 1.

Nucleotide sequences of host target binding sites, such as BINDING SITE-I, BINDING SITE-II and BINDING SITE-III of FIG. 1, found on VGAM1247 host target RNA, and schematic representation of the complementarity of each of these host target binding sites to VGAM1247 RNA, herein designated VGAM RNA, are described hereinbelow with reference to Table 2.

As mentioned hereinabove with reference to FIG. 1, a function of VGAM1247 gene, herein designated VGAM is inhibition of expression of VGAM1247 target genes. It is appreciated that specific functions, and accordingly utilities, of VGAM1247 correlate with, and may be deduced from, the identity of the target genes which VGAM1247 binds and inhibits, and the function of these target genes, as elaborated hereinbelow.

Ankylosis, Progressive Homolog (mouse) (ANKH, Accession NM_054027) is a VGAM1247 host target gene. ANKH BINDING SITE is HOST TARGET binding site found in the 3' untranslated region of mRNA encoded by ANKH, corresponding to a HOST TARGET binding site such as BINDING SITE I, BINDING SITE II or BINDING SITE III. Table 2 illustrates the complementarity of the nucleotide sequences of ANKH BINDING SITE, designated SEQ ID:27638, to the nucleotide sequence of VGAM1247 RNA, herein designated VGAM RNA, also designated SEQ ID:3958.

A function of VGAM1247 is therefore inhibition of Ankylosis, Progressive Homolog (mouse) (ANKH, Accession NM_054027), a gene which regulates intra- and extracellular levels of inorganic pyrophosphate (ppi), probably functioning as ppi transporter. Accordingly, utilities of VGAM1247 include diagnosis, prevention and treatment of diseases and clinical conditions associated with ANKH. The function of ANKH has been established by previous studies. Craniometaphyseal dysplasia (CMD; 123000) is a bone dysplasia characterized by overgrowth and sclerosis of the craniofacial bones and abnormal modeling of the metaphyses of the tubular bones. Hyperostosis and sclerosis of the skull may lead to cranial nerve compressions resulting in hearing loss and facial palsy. An autosomal dominant form of the disorder was mapped to 5p15.2-p14.1 (Nurnberg et al., 1997) within a region harboring the human homolog (ANKH) of the mouse progressive ankylosis (ank) gene. The ANK protein spans the outer cell membrane and shuttles inorganic pyrophosphate, a major inhibitor of physiologic and pathologic calcification, bone mineralization, and bone resorption. Nurnberg et al. (2001) identified 6 different mutations in the ANKH gene in 8 of 9 families with CMD. The mutations predicted single amino acid substitutions, deletions, or insertions. Using a helix prediction program, they proposed for the ANK molecule 12 membrane-spanning helices with an alternate inside/out orientation and a central channel permitting the passage of inorganic pyrophosphate. The mutations occurred at highly conserved amino acid residues presumed to be located in the cytosolic portion of the protein. The results linked the inorganic pyrophosphate channel ANK with bone formation and remodeling. Animal model experiments lend further support to the function of ANKH. Mice carrying the progressive ankylosis mutation have been studied as a model of arthritis. The autosomal recessive Ank mutation causes an abnormal flat-footed gait in young mice due to decreased mobility of ankle and toe joints. Loss of joint mobility becomes more severe with age and spreads to most joints throughout the limbs and vertebral column leading to complete rigidity and death around 6 months of age. Hydroxyapatite crystals develop in articular surfaces and synovial fluid of Ank mice, accompanied by joint space narrowing, cartilage erosion, and formation of bony outgrowths or osteophytes that cause fusion (ankylosis) and joint immobility. Ho et al. (2000) identified a G-to-T substitution in the mouse Ank gene, leading to a nonsense mutation in exon 11, the penultimate exon of mouse Ank. This mutation truncates the C-terminal region of the protein and greatly reduces its activity in vitro. The mouse Ank gene is expressed in developing articular surfaces and may help maintain the unmineralized state by providing a local source of inorganic pyrophosphate to inhibit hydroxyapatite formation. In the absence of normal Ank activity, mineralization extends unhindered throughout articular cartilage, hydroxyapatite deposits form in synovial fluid, and new bone is deposited in and around joints, showing that the gene is essential for normal joint maintenance.

It is appreciated that the abovementioned animal model for ANKH is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ho, A. M.; Johnson, M. D.; Kingsley, D. M.: Role of the mouse ank gene in control of tissue calcification and arthritis. Science 289:265-270, 2000; and Nurnberg, P.; Tinschert, S.; Mrug, M.; Hampe, J.; Muller, C. R.; Fuhrmann, E.; Braun, H.-S.; Reis, A.: The gene for autosomal dominant craniometaphyseal dysplasia maps to chromosome 5q.

Further studies establishing the function and utilities of ANKH are found in John Hopkins OMIM database record ID 605145, and in sited publications numbered 2877, 3552-355 and 7300 listed in the bibliography section hereinbelow, which are also hereby incorporated by reference. Protocadherin Beta 4 (PCDHB4, Accession NM_018938) is another VGAM1247 host target gene. PCDHB4 BINDING SITE is HOST TARGET binding site found in the 3' untranslated region of mRNA encoded by PCDHB4, corresponding to a HOST TARGET binding site such as BINDING SITE I, BINDING SITE II or BINDING SITE III. Table 2 illustrates the complementarity of the nucleotide sequences of PCDHB4 BINDING SITE, designated SEQ ID:21005, to the nucleotide sequence of VGAM1247 RNA, herein designated VGAM RNA, also designated SEQ ID:3958.

Another function of VGAM1247 is therefore inhibition of Protocadherin Beta 4 (PCDHB4, Accession NM_018938). Accordingly, utilities of VGAM1247 include diagnosis, prevention and treatment of diseases and clinical conditions associated with PCDHB4. Zinc Finger Protein 266 (ZNF266, Accession XM_113992) is another VGAM1247 host target gene. ZNF266 BINDING SITE is HOST TARGET binding site found in the 3' untranslated region of mRNA encoded by ZNF266, corresponding to a HOST TARGET binding site such as BINDING SITE I, BINDING SITE II or BINDING SITE III. Table 2 illustrates the complementarity of the nucleotide sequences of ZNF266 BINDING SITE, designated SEQ ID:42598, to the nucleotide sequence of VGAM1247 RNA, herein designated VGAM RNA, also designated SEQ ID:3958.

Another function of VGAM1247 is therefore inhibition of Zinc Finger Protein 266 (ZNF266, Accession XM_113992). Accordingly, utilities of VGAM1247 include diagnosis, prevention and treatment of diseases and clinical conditions associated with ZNF266. KIAA0293 (Accession XM_027045) is another VGAM1247 host target gene. KIAA0293 BINDING SITE is HOST TARGET binding site found in the 3' untranslated region of mRNA encoded by KIAA0293, corresponding to a HOST TARGET binding site such as BINDING SITE I, BINDING SITE II or BINDING SITE III. Table 2 illustrates the complementarity of the nucleotide sequences of KIAA0293 BINDING SITE, designated SEQ ID:30391, to the nucleotide sequence of VGAM1247 RNA, herein designated VGAM RNA, also designated SEQ ID:3958.

Another function of VGAM1247 is therefore inhibition of KIAA0293 (Accession XM_027045). Accordingly, utilities of VGAM1247 include diagnosis, prevention and treatment of diseases and clinical conditions associated with KIAA0293. LOC163026 (Accession XM_091942) is another VGAM1247 host target gene. LOC163026 BIND- ING SITE is HOST TARGET binding site found in the 5' untranslated region of mRNA encoded by LOC163026, corresponding to a HOST TARGET binding site such as BINDING SITE I, BINDING SITE II or BINDING SITE III. Table 2 illustrates the complementarity of the nucleotide sequences of LOC163026 BINDING SITE, designated SEQ ID:40071, to the nucleotide sequence of VGAM1247 RNA, herein designated VGAM RNA, also designated SEQ ID:3958.

Another function of VGAM1247 is therefore inhibition of LOC163026 (Accession XM_091942). Accordingly, utilities of VGAM1247 include diagnosis, prevention and treatment of diseases and clinical conditions associated with LOC163026. FIG. 1 further provides a conceptual description of a novel bioinformatically detected viral gene of the present invention, referred to here as Viral Genomic Address Messenger 1248 (VGAM1248) viral gene, which modulates expression of respective host target genes thereof, the function and utility of which host target genes is known in the art.

VGAM1248 is a novel bioinformatically detected regulatory, non protein coding, viral micro RNA (miRNA) gene. The method by which VGAM1248 was detected is described hereinabove with reference to FIGS. 1-8.

VGAM1248 gene, herein designated VGAM GENE, is a viral gene contained in the genome of Monkeypox Virus. VGAM1248 host target gene, herein designated VGAM HOST TARGET GENE, is a human gene contained in the human genome.

VGAM1248 gene encodes a VGAM1248 precursor RNA, herein designated VGAM PRECURSOR RNA. Similar to other miRNA genes, and unlike most ordinary genes, VGAM1248 precursor RNA does not encode a protein. A nucleotide sequence identical or highly similar to the nucleotide sequence of VGAM1248 precursor RNA is designated SEQ ID:1234, and is provided hereinbelow with reference to the sequence listing part. Nucleotide sequence SEQ ID:1234 is located at position 131818 relative to the genome of Monkeypox Virus.

VGAM1248 precursor RNA folds onto itself, forming VGAM1248 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1248 folded precursor RNA into VGAM1248 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM1248 RNA is designated SEQ ID:3959, and is provided hereinbelow with reference to the sequence listing part.

VGAM1248 host target gene, herein designated VGAM HOST TARGET GENE, encodes a corresponding messenger RNA, VGAM1248 host target RNA, herein designated VGAM HOST TARGET RNA. VGAM1248 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1248 RNA, herein designated VGAM RNA, binds complementarily to one or more host target binding sites located in untranslated regions of VGAM1248 host target RNA, herein designated VGAM HOST TARGET RNA. This complementary binding is due to the fact that the nucleotide sequence of VGAM1248 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1248 RNA, herein designated VGAM RNA, may have a different number of host target binding sites in untranslated regions of a VGAM1248 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1248 RNA, herein designated VGAM RNA, to host target binding sites on VGAM1248 host target RNA, herein designated VGAM HOST TARGET RNA, such as BINDING SITE I, BINDING SITE II and BINDING SITE III, inhibits translation of VGAM1248 host target RNA into VGAM1248 host target protein, herein designated VGAM HOST TARGET PROTEIN. VGAM host target protein is therefore outlined by a broken line.

It is appreciated that VGAM1248 host target gene, herein designated VGAM HOST TARGET GENE, in fact represents a plurality of VGAM1248 host target genes. The mRNA of each one of this plurality of VGAM1248 host target genes comprises one or more host target binding sites, each having a nucleotide sequence which is at least partly complementary to VGAM1248 RNA, herein designated VGAM RNA, and which when bound by VGAM1248 RNA causes inhibition of translation of respective one or more VGAM1248 host target proteins.

It is further appreciated by one skilled in the art that the mode of translational inhibition illustrated by FIG. 1 with specific reference to translational inhibition exerted by VGAM1248 gene, herein designated VGAM GENE, on one or more VGAM1248 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1248 is inhibition of expression of host target genes, as part of a novel viral mechanism of attacking a host. Accordingly, utilities of VGAM1248 include diagnosis, prevention and treatment of viral infection by Monkeypox Virus. Specific functions, and accordingly utilities, of VGAM1248 correlate with, and may be deduced from, the identity of the host target genes which VGAM1248 binds and inhibits, and the function of these host target genes, as elaborated hereinbelow.

Nucleotide sequences of the VGAM1248 precursor RNA, herein designated VGAM PRECURSOR RNA, and of the 'diced' VGAM1248 RNA, herein designated VGAM RNA, and a schematic representation of the secondary folding of VGAM1248 folded precursor RNA, herein designated VGAM FOLDED PRECURSOR RNA, of VGAM1248 are further described hereinbelow with reference to Table 1.

Nucleotide sequences of host target binding sites, such as BINDING SITE-I, BINDING SITE-II and BINDING SITE-III of FIG. 1, found on VGAM1248 host target RNA, and schematic representation of the complementarity of each of these host target binding sites to VGAM1248 RNA, herein designated VGAM RNA, are described hereinbelow with reference to Table 2.

As mentioned hereinabove with reference to FIG. 1, a function of VGAM1248 gene, herein designated VGAM is inhibition of expression of VGAM1248 target genes. It is appreciated that specific functions, and accordingly utilities, of VGAM1248 correlate with, and may be deduced from, the identity of the target genes which VGAM1248 binds and inhibits, and the function of these target genes, as elaborated hereinbelow.

BDG-29 (Accession XM_051343) is a VGAM1248 host target gene. BDG-29 BINDING SITE is HOST TARGET binding site found in the 3' untranslated region of mRNA encoded by BDG-29, corresponding to a HOST TARGET binding site such as BINDING SITE I, BINDING SITE II or BINDING SITE III. Table 2 illustrates the complementarity of the nucleotide sequences of BDG-29 BINDING SITE, designated SEQ ID:35816, to the nucleotide sequence of VGAM1248 RNA, herein designated VGAM RNA, also designated SEQ ID:3959.

A function of VGAM1248 is therefore inhibition of BDG-29 (Accession XM_051343). Accordingly, utilities of VGAM1248 include diagnosis, prevention and treatment of diseases and clinical conditions associated with BDG-29. Chromosome 21 Open Reading Frame 6 (C21orf6, Accession NM_016940) is another VGAM1248 host target gene. C21orf6 BINDING SITE is HOST TARGET binding site found in the 3" untranslated region of mRNA encoded by C21orf6, corresponding to a HOST TARGET binding site such as BINDING SITE I, BINDING SITE II or BINDING SITE III. Table 2 illustrates the complementarity of the nucleotide sequences of C21orf6 BINDING SITE, designated SEQ ID:18855, to the nucleotide sequence of VGAM1248 RNA, herein designated VGAM RNA, also designated SEQ ID:3959.

Another function of VGAM1248 is therefore inhibition of Chromosome 21 Open Reading Frame 6 (C21orf6, Accession NM_016940). Accordingly, utilities of VGAM1248 include diagnosis, prevention and treatment of diseases and clinical conditions associated with C21orf6. DKFZp434D177 (Accession NM_032264) is another VGAM1248 host target gene. DKFZp434D177 BINDING SITE is HOST TARGET binding site found in the 3' untranslated region of mRNA encoded by DKFZp434D177, corresponding to a HOST TARGET binding site such as BINDING SITE I, BINDING SITE II or BINDING SITE III. Table 2 illustrates the complementarity of the nucleotide sequences of DKFZp434D177 BINDING SITE, designated SEQ ID:26007, to the nucleotide sequence of VGAM1248 RNA, herein designated VGAM RNA, also designated SEQ ID:3959.

Another function of VGAM1248 is therefore inhibition of DKFZp434D177 (Accession NM_032264). Accordingly, utilities of VGAM1248 include diagnosis, prevention and treatment of diseases and clinical conditions associated with DKFZp434D177. HSA249128 (Accession NM_017583) is another VGAM1248 host target gene. HSA249128 BINDING SITE is HOST TARGET binding site found in the 3' untranslated region of mRNA encoded by HSA249128, corresponding to a HOST TARGET binding site such as BINDING SITE I, BINDING SITE II or BINDING SITE III. Table 2 illustrates the complementarity of the nucleotide sequences of HSA249128 BINDING SITE, designated SEQ ID:19027, to the nucleotide sequence of VGAM1248 RNA, herein designated VGAM RNA, also designated SEQ ID:3959.

Another function of VGAM1248 is therefore inhibition of HSA249128 (Accession NM_017583). Accordingly, utilities of VGAM1248 include diagnosis, prevention and treatment of diseases and clinical conditions associated with HSA249128. KIAA1634 (Accession XM_032749) is another VGAM1248 host target gene. KIAA1634 BINDING SITE is HOST TARGET binding site found in the 3' untranslated region of mRNA encoded by KIAA1634, corresponding to a HOST TARGET binding site such as BINDING SITE I, BINDING SITE II or BINDING SITE III. Table 2 illustrates the complementarity of the nucleotide sequences of KIAA1634 BINDING SITE, designated SEQ ID:31751, to the nucleotide sequence of VGAM1248 RNA, herein designated VGAM RNA, also designated SEQ ID:3959.

Another function of VGAM1248 is therefore inhibition of KIAA1634 (Accession XM_032749). Accordingly, utilities of VGAM1248 include diagnosis, prevention and treatment of diseases and clinical conditions associated with KIAA1634. KIAA1941 (Accession XM_059318) is another VGAM1248 host target gene. KIAA1941 BINDING SITE is HOST TARGET binding site found in the 3' untranslated region of mRNA encoded by KIAA1941, corresponding to a HOST TARGET binding site such as BINDING SITE I, BINDING SITE II or BINDING SITE III. Table 2 illustrates the complementarity of the nucleotide sequences of KIAA1941 BINDING SITE, designated SEQ ID:36951, to the nucleotide sequence of VGAM1248 RNA, herein designated VGAM RNA, also designated SEQ ID:3959.

Another function of VGAM1248 is therefore inhibition of KIAA1941 (Accession XM_059318). Accordingly, utilities of VGAM1248 include diagnosis, prevention and treatment of diseases and clinical conditions associated with KIAA1941. PRO2533 (Accession NM_018629) is another VGAM1248 host target gene. PRO2533 BINDING SITE is HOST TARGET binding site found in the 3' untranslated region of mRNA encoded by PRO2533, corresponding to a HOST TARGET binding site such as BINDING SITE I, BINDING SITE II or BINDING SITE III. Table 2 illustrates the complementarity of the nucleotide sequences of PRO2533 BINDING SITE, designated SEQ ID:20702, to the nucleotide sequence of VGAM1248 RNA, herein designated VGAM RNA, also designated SEQ ID:3959.

Another function of VGAM1248 is therefore inhibition of PRO2533 (Accession NM_018629). Accordingly, utilities of VGAM1248 include diagnosis, prevention and treatment of diseases and clinical conditions associated with PRO2533. LOC151201 (Accession XM_098021) is another VGAM1248 host target gene. LOC151201 BINDING SITE is HOST TARGET binding site found in the 3' untranslated region of mRNA encoded by LOC151201, corresponding to a HOST TARGET binding site such as BINDING SITE I, BINDING SITE II or BINDING SITE III. Table 2 illustrates the complementarity of the nucleotide sequences of LOC151201 BINDING SITE, designated SEQ ID:41323, to the nucleotide sequence of VGAM1248 RNA, herein designated VGAM RNA, also designated SEQ ID:3959.

Another function of VGAM1248 is therefore inhibition of LOC151201 (Accession XM_098021). Accordingly, utilities of VGAM1248 include diagnosis, prevention and treatment of diseases and clinical conditions associated with LOC151201. FIG. 1 further provides a conceptual description of a novel bioinformatically detected viral gene of the present invention, referred to here as Viral Genomic Address Messenger 1249 (VGAM1249) viral gene, which modulates expression of respective host target genes thereof, the function and utility of which host target genes is known in the art.

VGAM1249 is a novel bioinformatically detected regulatory, non protein coding, viral micro RNA (miRNA) gene. The method by which VGAM1249 was detected is described hereinabove with reference to FIGS. 1-8.

VGAM1249 gene, herein designated VGAM GENE, is a viral gene contained in the genome of Monkeypox Virus. VGAM1249 host target gene, herein designated VGAM HOST TARGET GENE, is a human gene contained in the human genome.

VGAM1249 gene encodes a VGAM1249 precursor RNA, herein designated VGAM PRECURSOR RNA. Similar to other miRNA genes, and unlike most ordinary genes, VGAM1249 precursor RNA does not encode a protein. A nucleotide sequence identical or highly similar to the nucleotide sequence of VGAM1249 precursor RNA is designated SEQ ID:1235, and is provided hereinbelow with reference to the sequence listing part. Nucleotide sequence SEQ ID:1235 is located at position 130478 relative to the genome of Monkeypox Virus.

VGAM1249 precursor RNA folds onto itself, forming VGAM1249 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1249 folded precursor RNA into VGAM1249 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM1249 RNA is designated SEQ ID:3960, and is provided hereinbelow with reference to the sequence listing part.

VGAM1249 host target gene, herein designated VGAM HOST TARGET GENE, encodes a corresponding messenger RNA, VGAM1249 host target RNA, herein designated VGAM HOST TARGET RNA. VGAM1249 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1249 RNA, herein designated VGAM RNA, binds complementarily to one or more host target binding sites located in untranslated regions of VGAM1249 host target RNA, herein designated VGAM HOST TARGET RNA. This complementary binding is due to the fact that the nucleotide sequence of VGAM1249 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1249 RNA, herein designated VGAM RNA, may have a different number of host target binding sites in untranslated regions of a VGAM1249 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1249 RNA, herein designated VGAM RNA, to host target binding sites on VGAM1249 host target RNA, herein designated VGAM HOST TARGET RNA, such as BINDING SITE I, BINDING SITE II and BINDING SITE III, inhibits translation of VGAM1249 host target RNA into VGAM1249 host target protein, herein designated VGAM HOST TARGET PROTEIN. VGAM host target protein is therefore outlined by a broken line.

It is appreciated that VGAM1249 host target gene, herein designated VGAM HOST TARGET GENE, in fact represents a plurality of VGAM1249 host target genes. The mRNA of each one of this plurality of VGAM1249 host target genes comprises one or more host target binding sites, each having a nucleotide sequence which is at least partly complementary to VGAM1249 RNA, herein designated VGAM RNA, and which when bound by VGAM1249 RNA causes inhibition of translation of respective one or more VGAM1249 host target proteins.

It is further appreciated by one skilled in the art that the mode of translational inhibition illustrated by FIG. 1 with specific reference to translational inhibition exerted by VGAM1249 gene, herein designated VGAM GENE, on one or more VGAM1249 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1249 is inhibition of expression of host target genes, as part of a novel viral mechanism of attacking a host. Accordingly, utilities of VGAM1249 include diagnosis, prevention and treatment of viral infection by Monkeypox Virus. Specific functions, and accordingly utilities, of VGAM1249 correlate with, and may be deduced from, the identity of the host target genes which VGAM1249 binds and inhibits, and the function of these host target genes, as elaborated hereinbelow.

Nucleotide sequences of the VGAM1249 precursor RNA, herein designated VGAM PRECURSOR RNA, and of the 'diced' VGAM1249 RNA, herein designated VGAM RNA, and a schematic representation of the secondary folding of VGAM1249 folded precursor RNA, herein designated VGAM FOLDED PRECURSOR RNA, of VGAM1249 are further described hereinbelow with reference to Table 1.

Nucleotide sequences of host target binding sites, such as BINDING SITE-I, BINDING SITE-II and BINDING SITE-III of FIG. 1, found on VGAM1249 host target RNA, and schematic representation of the complementarity of each of these host target binding sites to VGAM1249 RNA, herein designated VGAM RNA, are described hereinbelow with reference to Table 2.

As mentioned hereinabove with reference to FIG. 1, a function of VGAM1249 gene, herein designated VGAM is inhibition of expression of VGAM1249 target genes. It is appreciated that specific functions, and accordingly utilities, of VGAM1249 correlate with, and may be deduced from, the identity of the target genes which VGAM1249 binds and inhibits, and the function of these target genes, as elaborated hereinbelow.

Bullous Pemphigoid Antigen 1, 230/240 kDa (BPAG1, Accession NM_015548) is a VGAM1249 host target gene. BPAG1 BINDING SITE is HOST TARGET binding site found in the 3' untranslated region of mRNA encoded by BPAG1, corresponding to a HOST TARGET binding site such as BINDING SITE I, BINDING SITE II or BINDING SITE III. Table 2 illustrates the complementarity of the nucleotide sequences of BPAG1 BINDING SITE, designated SEQ ID:17811, to the nucleotide sequence of VGAM1249 RNA, herein designated VGAM RNA, also designated SEQ ID:3960.

A function of VGAM1249 is therefore inhibition of Bullous Pemphigoid Antigen 1, 230/240 kDa (BPAG1, Accession NM_015548), a gene which plays a role in cross-linking actin to other cytoskeletal proteins, binds to microtubules. Accordingly, utilities of VGAM1249 include diagnosis, prevention and treatment of diseases and clinical conditions associated with BPAG1. The function of BPAG1 and its association with various diseases and clinical conditions, has been established by previous studies, as described hereinabove with reference to VGAM494. CUB and Sushi Multiple Domains 1 (CSMD1, Accession XM_054838) is another VGAM1249 host target gene. CSMD1 BINDING SITE is HOST TARGET binding site found in the 3' untranslated region of mRNA encoded by CSMD1, corresponding to a HOST TARGET binding site such as BINDING SITE I, BINDING SITE II or BINDING SITE III. Table 2 illustrates the complementarity of the nucleotide sequences of CSMD1 BINDING SITE, designated SEQ ID:36189, to the nucleotide sequence of VGAM1249 RNA, herein designated VGAM RNA, also designated SEQ ID:3960.

Another function of VGAM1249 is therefore inhibition of CUB and Sushi Multiple Domains 1 (CSMD1, Accession XM_054838). Accordingly, utilities of VGAM1249 include diagnosis, prevention and treatment of diseases and clinical conditions associated with CSMD1. KIAA1987 (Accession XM_113870) is another VGAM1249 host target gene. KIAA1987 BINDING SITE is HOST TARGET binding site found in the 3' untranslated region of mRNA encoded by KIAA1987, corresponding to a HOST TARGET binding site such as BINDING SITE I, BINDING SITE II or BINDING SITE III. Table 2 illustrates the complementarity of the nucleotide sequences of KIAA1987 BINDING SITE, designated SEQ ID:42501, to the nucleotide sequence of VGAM1249 RNA, herein designated VGAM RNA, also designated SEQ ID:3960.

Another function of VGAM1249 is therefore inhibition of KIAA1987 (Accession XM_113870). Accordingly, utilities of VGAM1249 include diagnosis, prevention and treatment of diseases and clinical conditions associated with KIAA1987. SH3 Domain Binding Glutamic Acid-rich Protein Like 2 (SH3BGRL2, Accession NM_031469) is another VGAM1249 host target gene. SH3BGRL2 BINDING SITE is HOST TARGET binding site found in the 3' untranslated region of mRNA encoded by SH3BGRL2, corresponding to a HOST TARGET binding site such as BINDING SITE I, BINDING SITE II or BINDING SITE III. Table 2 illustrates the complementarity of the nucleotide sequences of SH3BGRL2 BINDING SITE, designated SEQ ID:25532, to the nucleotide sequence of VGAM1249 RNA, herein designated VGAM RNA, also designated SEQ ID:3960.

Another function of VGAM1249 is therefore inhibition of SH3 Domain Binding Glutamic Acid-rich Protein Like 2 (SH3BGRL2, Accession NM_031469). Accordingly, utilities of VGAM1249 include diagnosis, prevention and treatment of diseases and clinical conditions associated with SH3BGRL2. LOC123242 (Accession XM_063548) is another VGAM1249 host target gene. LOC123242 BINDING SITE is HOST TARGET binding site found in the 5' untranslated region of mRNA encoded by LOC123242, corresponding to a HOST TARGET binding site such as BINDING SITE I, BINDING SITE II or BINDING SITE III. Table 2 illustrates the complementarity of the nucleotide sequences of LOC123242 BINDING SITE, designated SEQ ID:37247, to the nucleotide sequence of VGAM1249 RNA, herein designated VGAM RNA, also designated SEQ ID:3960.

Another function of VGAM1249 is therefore inhibition of LOC123242 (Accession XM_063548). Accordingly, utilities of VGAM1249 include diagnosis, prevention and treatment of diseases and clinical conditions associated with LOC123242. LOC145945 (Accession XM_096908) is another VGAM1249 host target gene. LOC145945 BINDING SITE is HOST TARGET binding site found in the 5' untranslated region of mRNA encoded by LOC145945, corresponding to a HOST TARGET binding site such as BINDING SITE I, BINDING SITE II or BINDING SITE III. Table 2 illustrates the complementarity of the nucleotide sequences of LOC145945 BINDING SITE, designated SEQ ID:40638, to the nucleotide sequence of VGAM1249 RNA, herein designated VGAM RNA, also designated SEQ ID:3960.

Another function of VGAM1249 is therefore inhibition of LOC145945 (Accession XM_096908). Accordingly, utilities of VGAM1249 include diagnosis, prevention and treatment of diseases and clinical conditions associated with LOC145945. LOC149013 (Accession XM_086398) is another VGAM1249 host target gene. LOC149013 BINDING SITE is HOST TARGET binding site found in the 3' untranslated region of mRNA encoded by LOC149013, corresponding to a HOST TARGET binding site such as BINDING SITE I, BINDING SITE II or BINDING SITE III. Table 2 illustrates the complementarity of the nucleotide sequences of LOC149013 BINDING SITE, designated SEQ ID:38632, to the nucleotide sequence of VGAM1249 RNA, herein designated VGAM RNA, also designated SEQ ID:3960.

Another function of VGAM1249 is therefore inhibition of LOC149013 (Accession XM_086398). Accordingly, utilities of VGAM1249 include diagnosis, prevention and treatment of diseases and clinical conditions associated with LOC149013. LOC253001 (Accession XM_171711) is another VGAM1249 host target gene. LOC253001 BINDING SITE is HOST TARGET binding site found in the 5' untranslated region of mRNA encoded by LOC253001, corresponding to a HOST TARGET binding site such as BINDING SITE I, BINDING SITE II or BINDING SITE III. Table 2 illustrates the complementarity of the nucleotide sequences of LOC253001 BINDING SITE, designated SEQ ID:46061, to the nucleotide sequence of VGAM1249 RNA, herein designated VGAM RNA, also designated SEQ ID:3960.

Another function of VGAM1249 is therefore inhibition of LOC253001 (Accession XM_171711). Accordingly, utilities of VGAM1249 include diagnosis, prevention and treatment of diseases and clinical conditions associated with LOC253001. FIG. 1 further provides a conceptual description of a novel bioinformatically detected viral gene of the present invention, referred to here as Viral Genomic Address Messenger 1250 (VGAM1250) viral gene, which modulates expression of respective host target genes thereof, the function and utility of which host target genes is known in the art.

VGAM1250 is a novel bioinformatically detected regulatory, non protein coding, viral micro RNA (miRNA) gene.

The method by which VGAM1250 was detected is described hereinabove with reference to FIGS. 1-8.

VGAM1250 gene, herein designated VGAM GENE, is a viral gene contained in the genome of Camelpox Virus. VGAM1250 host target gene, herein designated VGAM HOST TARGET GENE, is a human gene contained in the human genome.

VGAM1250 gene encodes a VGAM1250 precursor RNA, herein designated VGAM PRECURSOR RNA. Similar to other miRNA genes, and unlike most ordinary genes, VGAM1250 precursor RNA does not encode a protein. A nucleotide sequence identical or highly similar to the nucleotide sequence of VGAM1250 precursor RNA is designated SEQ ID:1236, and is provided hereinbelow with reference to the sequence listing part. Nucleotide sequence SEQ ID:1236 is located at position 136377 relative to the genome of Camelpox Virus.

VGAM1250 precursor RNA folds onto itself, forming VGAM1250 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1250 folded precursor RNA into VGAM1250 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1250 RNA is designated SEQ ID:3961, and is provided hereinbelow with reference to the sequence listing part.

VGAM1250 host target gene, herein designated VGAM HOST TARGET GENE, encodes a corresponding messenger RNA, VGAM1250 host target RNA, herein designated VGAM HOST TARGET RNA. VGAM1250 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1250 RNA, herein designated VGAM RNA, binds complementarily to one or more host target binding sites located in untranslated regions of VGAM1250 host target RNA, herein designated VGAM HOST TARGET RNA. This complementary binding is due to the fact that the nucleotide sequence of VGAM1250 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1250 RNA, herein designated VGAM RNA, may have a different number of host target binding sites in untranslated regions of a VGAM1250 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1250 RNA, herein designated VGAM RNA, to host target binding sites on VGAM1250 host target RNA, herein designated VGAM HOST TARGET RNA, such as BINDING SITE I, BINDING SITE II and BINDING SITE III, inhibits translation of VGAM1250 host target RNA into VGAM1250 host target protein, herein designated VGAM HOST TARGET PROTEIN. VGAM host target protein is therefore outlined by a broken line.

It is appreciated that VGAM1250 host target gene, herein designated VGAM HOST TARGET GENE, in fact represents a plurality of VGAM1250 host target genes. The mRNA of each one of this plurality of VGAM1250 host target genes comprises one or more host target binding sites, each having a nucleotide sequence which is at least partly complementary to VGAM1250 RNA, herein designated VGAM RNA, and which when bound by VGAM1250 RNA causes inhibition of translation of respective one or more VGAM1250 host target proteins.

It is further appreciated by one skilled in the art that the mode of translational inhibition illustrated by FIG. 1 with specific reference to translational inhibition exerted by VGAM1250 gene, herein designated VGAM GENE, on one or more VGAM1250 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1250 is inhibition of expression of host target genes, as part of a novel viral mechanism of attacking a host. Accordingly, utilities of VGAM1250 include diagnosis, prevention and treatment of viral infection by Camelpox Virus. Specific functions, and accordingly utilities, of VGAM1250 correlate with, and may be deduced from, the identity of the host target genes which VGAM1250 binds and inhibits, and the function of these host target genes, as elaborated hereinbelow.

Nucleotide sequences of the VGAM1250 precursor RNA, herein designated VGAM PRECURSOR RNA, and of the 'diced' VGAM1250 RNA, herein designated VGAM RNA, and a schematic representation of the secondary folding of VGAM1250 folded precursor RNA, herein designated VGAM FOLDED PRECURSOR RNA, of VGAM1250 are further described hereinbelow with reference to Table 1.

Nucleotide sequences of host target binding sites, such as BINDING SITE-I, BINDING SITE-II and BINDING SITE-III of FIG. 1, found on VGAM1250 host target RNA, and schematic representation of the complementarity of each of these host target binding sites to VGAM1250 RNA, herein designated VGAM RNA, are described hereinbelow with reference to Table 2.

As mentioned hereinabove with reference to FIG. 1, a function of VGAM1250 gene, herein designated VGAM is inhibition of expression of VGAM1250 target genes. It is appreciated that specific functions, and accordingly utilities, of VGAM1250 correlate with, and may be deduced from, the identity of the target genes which VGAM1250 binds and inhibits, and the function of these target genes, as elaborated hereinbelow.

Glutamate Receptor, Ionotropic, N-methyl D-aspartate-like 1A (GRINL1A, Accession XM_045376) is a VGAM1250 host target gene. GRINL1A BINDING SITE is HOST TARGET binding site found in the 3' untranslated region of mRNA encoded by GRINL1A, corresponding to a HOST TARGET binding site such as BINDING SITE I, BINDING SITE II or BINDING SITE III. Table 2 illustrates the complementarity of the nucleotide sequences of GRINL1A BINDING SITE, designated SEQ ID:34444, to the nucleotide sequence of VGAM1250 RNA, herein designated VGAM RNA, also designated SEQ ID:3961.

A function of VGAM1250 is therefore inhibition of Glutamate Receptor, Ionotropic, N-methyl D-aspartate-like 1A (GRINL1A, Accession XM_045376), a gene which plays a role in the development and function of the mammalian brain. Accordingly, utilities of VGAM1250 include diagnosis, prevention and treatment of diseases and clinical conditions associated with GRINL1A. The function of GRINL1A and its association with various diseases and clinical conditions, has been established by previous studies, as described hereinabove with reference to VGAM53. FHX (Accession NM_018416) is another VGAM1250 host target gene. FHX BINDING SITE is HOST TARGET binding site found in the 3' untranslated region of mRNA encoded by FHX, corresponding to a HOST TARGET binding site such as BINDING SITE I, BINDING SITE II or BINDING SITE III. Table 2 illustrates the complementarity of the nucleotide sequences of FHX BINDING SITE, designated SEQ ID:20462, to the nucleotide sequence of VGAM1250 RNA, herein designated VGAM RNA, also designated SEQ ID:3961.

Another function of VGAM1250 is therefore inhibition of FHX (Accession NM_018416). Accordingly, utilities of VGAM1250 include diagnosis, prevention and treatment of diseases and clinical conditions associated with FHX. FLJ13611 (Accession NM_024941) is another VGAM1250 host target gene. FLJ13611 BINDING SITE is HOST TARGET binding site found in the 3' untranslated region of mRNA encoded by FLJ13611, corresponding to a HOST TARGET binding site such as BINDING SITE I, BINDING SITE II or BINDING SITE III. Table 2 illustrates the complementarity of the nucleotide sequences of FLJ13611 BINDING SITE, designated SEQ ID:24486, to the nucleotide sequence of VGAM1250 RNA, herein designated VGAM RNA, also designated SEQ ID:3961.

Another function of VGAM1250 is therefore inhibition of FLJ13611 (Accession NM_024941). Accordingly, utilities of VGAM1250 include diagnosis, prevention and treatment of diseases and clinical conditions associated with FLJ13611. KIAA0746 (Accession XM_045277) is another VGAM1250 host target gene. KIAA0746 BINDING SITE is HOST TARGET binding site found in the 5' untranslated region of mRNA encoded by KIAA0746, corresponding to a HOST TARGET binding site such as BINDING SITE I, BINDING SITE II or BINDING SITE III. Table 2 illustrates the complementarity of the nucleotide sequences of KIAA0746 BINDING SITE, designated SEQ ID:34416, to the nucleotide sequence of VGAM1250 RNA, herein designated VGAM RNA, also designated SEQ ID:3961.

Another function of VGAM1250 is therefore inhibition of KIAA0746 (Accession XM_045277). Accordingly, utilities of VGAM1250 include diagnosis, prevention and treatment of diseases and clinical conditions associated with KIAA0746. KIAA1363 (Accession XM_045056) is another VGAM1250 host target gene. KIAA1363 BINDING SITE is HOST TARGET binding site found in the 3' untranslated region of mRNA encoded by KIAA1363, corresponding to a HOST TARGET binding site such as BINDING SITE I, BINDING SITE II or BINDING SITE III. Table 2 illustrates the complementarity of the nucleotide sequences of KIAA1363 BINDING SITE, designated SEQ ID:34335, to the nucleotide sequence of VGAM1250 RNA, herein designated VGAM RNA, also designated SEQ ID:3961.

Another function of VGAM1250 is therefore inhibition of KIAA1363 (Accession XM_045056). Accordingly, utilities of VGAM1250 include diagnosis, prevention and treatment of diseases and clinical conditions associated with KIAA1363. LOC220766 (Accession XM_165471) is another VGAM1250 host target gene. LOC220766 BINDING SITE is HOST TARGET binding site found in the 5' untranslated region of mRNA encoded by LOC220766, corresponding to a HOST TARGET binding site such as BINDING SITE I, BINDING SITE II or BINDING SITE III. Table 2 illustrates the complementarity of the nucleotide sequences of LOC220766 BINDING SITE, designated SEQ ID:43655, to the nucleotide sequence of VGAM1250 RNA, herein designated VGAM RNA, also designated SEQ ID:3961.

Another function of VGAM1250 is therefore inhibition of LOC220766 (Accession XM_165471). Accordingly, utilities of VGAM1250 include diagnosis, prevention and treatment of diseases and clinical conditions associated with LOC220766. LOC221964 (Accession XM_168342) is another VGAM1250 host target gene. LOC221964 BINDING SITE is HOST TARGET binding site found in the 3' untranslated region of mRNA encoded by LOC221964, corresponding to a HOST TARGET binding site such as BINDING SITE I, BINDING SITE II or BINDING SITE III. Table 2 illustrates the complementarity of the nucleotide sequences of LOC221964 BINDING SITE, designated SEQ ID:45111, to the nucleotide sequence of VGAM1250 RNA, herein designated VGAM RNA, also designated SEQ ID:3961.

Another function of VGAM1250 is therefore inhibition of LOC221964 (Accession XM_168342). Accordingly, utilities of VGAM1250 include diagnosis, prevention and treatment of diseases and clinical conditions associated with LOC221964. LOC92181 (Accession XM_043394) is another VGAM1250 host target gene. LOC92181 BINDING SITE is HOST TARGET binding site found in the 3' untranslated region of mRNA encoded by LOC92181, corresponding to a HOST TARGET binding site such as BINDING SITE I, BINDING SITE II or BINDING SITE III. Table 2 illustrates the complementarity of the nucleotide sequences of LOC92181 BINDING SITE, designated SEQ ID:33942, to the nucleotide sequence of VGAM1250 RNA, herein designated VGAM RNA, also designated SEQ ID:3961.

Another function of VGAM1250 is therefore inhibition of LOC92181 (Accession XM_043394). Accordingly, utilities of VGAM1250 include diagnosis, prevention and treatment of diseases and clinical conditions associated with LOC92181. FIG. 1 further provides a conceptual description of a novel bioinformatically detected viral gene of the present invention, referred to here as Viral Genomic Address Messenger 1251 (VGAM1251) viral gene, which modulates expression of respective host target genes thereof, the function and utility of which host target genes is known in the art.

VGAM1251 is a novel bioinformatically detected regulatory, non protein coding, viral micro RNA (miRNA) gene. The method by which VGAM1251 was detected is described hereinabove with reference to FIGS. 1-8.

VGAM1251 gene, herein designated VGAM GENE, is a viral gene contained in the genome of Monkeypox Virus. VGAM1251 host target gene, herein designated VGAM HOST TARGET GENE, is a human gene contained in the human genome.

VGAM1251 gene encodes a VGAM1251 precursor RNA, herein designated VGAM PRECURSOR RNA. Similar to other miRNA genes, and unlike most ordinary genes, VGAM1251 precursor RNA does not encode a protein. A nucleotide sequence identical or highly similar to the nucleotide sequence of VGAM1251 precursor RNA is designated SEQ ID:1237, and is provided hereinbelow with reference to the sequence listing part. Nucleotide sequence SEQ ID:1237 is located at position 132303 relative to the genome of Monkeypox Virus.

VGAM1251 precursor RNA folds onto itself, forming VGAM1251 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1251 folded precursor RNA into VGAM1251 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1251 RNA is designated SEQ ID:3962, and is provided hereinbelow with reference to the sequence listing part.

VGAM1251 host target gene, herein designated VGAM HOST TARGET GENE, encodes a corresponding messenger RNA, VGAM1251 host target RNA, herein designated VGAM HOST TARGET RNA. VGAM1251 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1251 RNA, herein designated VGAM RNA, binds complementarily to one or more host target binding sites located in untranslated regions of VGAM1251 host target RNA, herein designated VGAM HOST TARGET RNA. This complementary binding is due to the fact that the nucleotide sequence of VGAM1251 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1251 RNA, herein designated VGAM RNA, may have a different number of host target binding sites in untranslated regions of a VGAM1251 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1251 RNA, herein designated VGAM RNA, to host target binding sites on VGAM1251 host target RNA, herein designated VGAM HOST TARGET RNA, such as BINDING SITE I, BINDING SITE II and BINDING SITE III, inhibits translation of VGAM1251 host target RNA into VGAM1251 host target protein, herein designated VGAM HOST TARGET PROTEIN. VGAM host target protein is therefore outlined by a broken line.

It is appreciated that VGAM1251 host target gene, herein designated VGAM HOST TARGET GENE, in fact represents a plurality of VGAM1251 host target genes. The mRNA of each one of this plurality of VGAM1251 host target genes comprises one or more host target binding sites, each having a nucleotide sequence which is at least partly complementary to VGAM1251 RNA, herein designated VGAM RNA, and which when bound by VGAM1251 RNA causes inhibition of translation of respective one or more VGAM1251 host target proteins.

It is further appreciated by one skilled in the art that the mode of translational inhibition illustrated by FIG. 1 with specific reference to translational inhibition exerted by VGAM1251 gene, herein designated VGAM GENE, on one or more VGAM1251 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1251 is inhibition of expression of host target genes, as part of a novel viral mechanism of attacking a host. Accordingly, utilities of VGAM1251 include diagnosis, prevention and treatment of viral infection by Monkeypox Virus. Specific functions, and accordingly utilities, of VGAM1251 correlate with, and may be deduced from, the identity of the host target genes which VGAM1251 binds and inhibits, and the function of these host target genes, as elaborated hereinbelow.

Nucleotide sequences of the VGAM1251 precursor RNA, herein designated VGAM PRECURSOR RNA, and of the 'diced' VGAM1251 RNA, herein designated VGAM RNA, and a schematic representation of the secondary folding of VGAM1251 folded precursor RNA, herein designated VGAM FOLDED PRECURSOR RNA, of VGAM1251 are further described hereinbelow with reference to Table 1.

Nucleotide sequences of host target binding sites, such as BINDING SITE-I, BINDING SITE-II and BINDING SITE-III of FIG. 1, found on VGAM1251 host target RNA, and schematic representation of the complementarity of each of these host target binding sites to VGAM1251 RNA, herein designated VGAM RNA, are described hereinbelow with reference to Table 2.

As mentioned hereinabove with reference to FIG. 1, a function of VGAM1251 gene, herein designated VGAM is inhibition of expression of VGAM1251 target genes. It is appreciated that specific functions, and accordingly utilities, of VGAM1251 correlate with, and may be deduced from, the identity of the target genes which VGAM1251 binds and inhibits, and the function of these target genes, as elaborated hereinbelow.

Dmx-like 1 (DMXL1, Accession NM_005509) is a VGAM1251 host target gene. DMXL1 BINDING SITE is HOST TARGET binding site found in the 3' untranslated region of mRNA encoded by DMXL1, corresponding to a HOST TARGET binding site such as BINDING SITE I, BINDING SITE II or BINDING SITE III. Table 2 illustrates the complementarity of the nucleotide sequences of DMXL1 BINDING SITE, designated SEQ ID:12024, to the nucleotide sequence of VGAM1251 RNA, herein designated VGAM RNA, also designated SEQ ID:3962.

A function of VGAM1251 is therefore inhibition of Dmx-like 1 (DMXL1, Accession NM_005509). Accordingly, utilities of VGAM1251 include diagnosis, prevention and treatment of diseases and clinical conditions associated with DMXL1. Human T-cell Leukemia Virus Enhancer Factor (HTLF, Accession NM_002158) is another VGAM1251 host target gene. HTLF BINDING SITE is HOST TARGET binding site found in the 5' untranslated region of mRNA encoded by HTLF, corresponding to a HOST TARGET binding site such as BINDING SITE I, BINDING SITE II or BINDING SITE III. Table 2 illustrates the complementarity of the nucleotide sequences of HTLF BINDING SITE, designated SEQ ID:7933, to the nucleotide sequence of VGAM1251 RNA, herein designated VGAM RNA, also designated SEQ ID:3962.

Another function of VGAM1251 is therefore inhibition of Human T-cell Leukemia Virus Enhancer Factor (HTLF, Accession NM_002158). Accordingly, utilities of VGAM1251 include diagnosis, prevention and treatment of diseases and clinical conditions associated with HTLF. Splicing Factor, Arginine/serine-rich 2, Interacting Protein (SFRS2IP, Accession NM_004719) is another VGAM1251 host target gene. SFRS2IP BINDING SITE is HOST TARGET binding site found in the 5' untranslated region of mRNA encoded by SFRS2IP, corresponding to a HOST TARGET binding site such as BINDING SITE I, BINDING SITE II or BINDING SITE III. Table 2 illustrates the complementarity of the nucleotide sequences of SFRS2IP BINDING SITE, designated SEQ ID:11086, to the nucleotide sequence of VGAM1251 RNA, herein designated VGAM RNA, also designated SEQ ID:3962.

Another function of VGAM1251 is therefore inhibition of Splicing Factor, Arginine/serine-rich 2, Interacting Protein (SFRS2IP, Accession NM_004719), a gene which plays an essential role in pre-mRNA splicing. Accordingly, utilities of VGAM1251 include diagnosis, prevention and treatment of diseases and clinical conditions associated with SFRS2IP. The function of SFRS2IP and its association with various diseases and clinical conditions, has been established by previous studies, as described hereinabove with reference to VGAM700. Solute Carrier Family 21 (organic anion transporter), Member 9 (SLC21A9, Accession NM_007256) is another VGAM1251 host target gene. SLC21A9 BINDING SITE is HOST TARGET binding site found in the 3' untranslated region of mRNA encoded by SLC21A9, corresponding to a HOST TARGET binding site such as BINDING SITE I, BINDING SITE II or BINDING SITE III. Table 2 illustrates the complementarity of the nucleotide sequences of SLC21A9 BINDING SITE, designated SEQ ID:14129, to the nucleotide sequence of VGAM1251 RNA, herein designated VGAM RNA, also designated SEQ ID:3962.

Another function of VGAM1251 is therefore inhibition of Solute Carrier Family 21 (organic anion transporter), Member 9 (SLC21A9, Accession NM_007256), a gene which is Moderately similar to SLC21A2 prostaglandin transporter. Accordingly, utilities of VGAM1251 include diagnosis, prevention and treatment of diseases and clinical conditions associated with SLC21A9. The function of SLC21A9 and its association with various diseases and clinical conditions, has been established by previous studies, as described hereinabove with reference to VGAM894. V-akt Murine Thymoma Viral Oncogene Homolog 3 (protein kinase B, gamma) (AKT3, Accession NM_005465) is another VGAM1251 host target gene. AKT3 BINDING SITE is HOST TARGET binding site found in the 3' untranslated region of mRNA encoded by AKT3, corresponding to a HOST TARGET binding site such as BINDING SITE I, BINDING SITE II or BINDING SITE III. Table 2 illustrates the complementarity of the nucleotide sequences of AKT3 BINDING SITE, designated SEQ ID:11960, to the nucleotide sequence of VGAM1251 RNA, herein designated VGAM RNA, also designated SEQ ID:3962.

Another function of VGAM1251 is therefore inhibition of V-akt Murine Thymoma Viral Oncogene Homolog 3 (protein kinase B, gamma) (AKT3, Accession NM_005465). Accordingly, utilities of VGAM1251 include diagnosis, prevention and treatment of diseases and clinical conditions associated with AKT3. Butyrophilin, Subfamily 2, Member A1 (BTN2A1, Accession NM_078476) is another VGAM1251 host target gene. BTN2A1 BINDING SITE is HOST TARGET binding site found in the 3' untranslated region of mRNA encoded by BTN2A1, corresponding to a HOST TARGET binding site such as BINDING SITE I, BINDING SITE II or BINDING SITE III. Table 2 illustrates the complementarity of the nucleotide sequences of BTN2A1 BINDING SITE, designated SEQ ID:27805, to the nucleotide sequence of VGAM1251 RNA, herein designated VGAM RNA, also designated SEQ ID:3962.

Another function of VGAM1251 is therefore inhibition of Butyrophilin, Subfamily 2, Member A1 (BTN2A1, Accession NM_078476). Accordingly, utilities of VGAM1251 include diagnosis, prevention and treatment of diseases and clinical conditions associated with BTN2A1. Chromobox Homolog 6 (CBX6, Accession NM_014292) is another VGAM1251 host target gene. CBX6 BINDING SITE is HOST TARGET binding site found in the 3' untranslated region of mRNA encoded by CBX6, corresponding to a HOST TARGET binding site such as BINDING SITE I, BINDING SITE II or BINDING SITE III. Table 2 illustrates the complementarity of the nucleotide sequences of CBX6 BINDING SITE, designated SEQ ID:15581, to the nucleotide sequence of VGAM1251 RNA, herein designated VGAM RNA, also designated SEQ ID:3962.

Another function of VGAM1251 is therefore inhibition of Chromobox Homolog 6 (CBX6, Accession NM_014292). Accordingly, utilities of VGAM1251 include diagnosis, prevention and treatment of diseases and clinical conditions associated with CBX6. DCOHM (Accession NM_032151) is another VGAM1251 host target gene. DCOHM BINDING SITE is HOST TARGET binding site found in the 3' untranslated region of mRNA encoded by DCOHM, corresponding to a HOST TARGET binding site such as BINDING SITE I, BINDING SITE II or BINDING SITE III. Table 2 illustrates the complementarity of the nucleotide sequences of DCOHM BINDING SITE, designated SEQ ID:25851, to the nucleotide sequence of VGAM1251 RNA, herein designated VGAM RNA, also designated SEQ ID:3962.

Another function of VGAM1251 is therefore inhibition of DCOHM (Accession NM_032151). Accordingly, utilities of VGAM1251 include diagnosis, prevention and treatment of diseases and clinical conditions associated with DCOHM. FLJ22009 (Accession XM_015700) is another VGAM1251 host target gene. FLJ22009 BINDING SITE is HOST TARGET binding site found in the 3' untranslated region of mRNA encoded by FLJ22009, corresponding to a HOST TARGET binding site such as BINDING SITE I, BINDING SITE II or BINDING SITE III. Table 2 illustrates the complementarity of the nucleotide sequences of FLJ22009 BINDING SITE, designated SEQ ID:30246, to the nucleotide sequence of VGAM1251 RNA, herein designated VGAM RNA, also designated SEQ ID:3962.

Another function of VGAM1251 is therefore inhibition of FLJ22009 (Accession XM_015700). Accordingly, utilities of VGAM1251 include diagnosis, prevention and treatment of diseases and clinical conditions associated with FLJ22009. KIAA0193 (Accession NM_014766) is another VGAM1251 host target gene. KIAA0193 BINDING SITE is HOST TARGET binding site found in the 3' untranslated region of mRNA encoded by KIAA0193, corresponding to a HOST TARGET binding site such as BINDING SITE I, BINDING SITE II or BINDING SITE III. Table 2 illustrates the complementarity of the nucleotide sequences of KIAA0193 BINDING SITE, designated SEQ ID:16547, to the nucleotide sequence of VGAM1251 RNA, herein designated VGAM RNA, also designated SEQ ID:3962.

Another function of VGAM1251 is therefore inhibition of KIAA0193 (Accession NM_014766). Accordingly, utilities of VGAM1251 include diagnosis, prevention and treatment of diseases and clinical conditions associated with KIAA0193. KIAA1364 (Accession XM_032997) is another VGAM1251 host target gene. KIAA1364 BINDING SITE is HOST TARGET binding site found in the 3' untranslated region of mRNA encoded by KIAA1364, corresponding to a HOST TARGET binding site such as BINDING SITE I, BINDING SITE II or BINDING SITE III. Table 2 illustrates the complementarity of the nucleotide sequences of KIAA1364 BINDING SITE, designated SEQ ID:31814, to the nucleotide sequence of VGAM1251 RNA, herein designated VGAM RNA, also designated SEQ ID:3962.

Another function of VGAM1251 is therefore inhibition of KIAA1364 (Accession XM_032997). Accordingly, utilities of VGAM1251 include diagnosis, prevention and treatment of diseases and clinical conditions associated with KIAA1364. Netrin 4 (NTN4, Accession XM_031896) is another VGAM1251 host target gene. NTN4 BINDING SITE is HOST TARGET binding site found in the 3' untranslated region of mRNA encoded by NTN4, corresponding to a HOST TARGET binding site such as BINDING SITE I, BINDING SITE II or BINDING SITE III. Table 2 illustrates the complementarity of the nucleotide sequences of NTN4 BINDING SITE, designated SEQ ID:31509, to the nucleotide sequence of VGAM1251 RNA, herein designated VGAM RNA, also designated SEQ ID:3962.

Another function of VGAM1251 is therefore inhibition of Netrin 4 (NTN4, Accession XM_031896). Accordingly, utilities of VGAM1251 include diagnosis, prevention and treatment of diseases and clinical conditions associated with NTN4. PRO0943 (Accession NM_018568) is another VGAM1251 host target gene. PRO0943 BINDING SITE is HOST TARGET binding site found in the 5' untranslated region of mRNA encoded by PRO0943, corresponding to a HOST TARGET binding site such as BINDING SITE I, BINDING SITE II or BINDING SITE III. Table 2 illustrates the complementarity of the nucleotide sequences of PRO0943 BINDING SITE, designated SEQ ID:20650, to the nucleotide sequence of VGAM1251 RNA, herein designated VGAM RNA, also designated SEQ ID:3962.

Another function of VGAM1251 is therefore inhibition of PRO0943 (Accession NM_018568). Accordingly, utilities of VGAM1251 include diagnosis, prevention and treatment of diseases and clinical conditions associated with PRO0943. Protein Tyrosine Phosphatase, Non-receptor Type Substrate 1 (PTPNS1, Accession NM_080792) is another VGAM1251 host target gene. PTPNS1 BINDING SITE is HOST TARGET binding site found in the 3' untranslated region of mRNA encoded by PTPNS1, corresponding to a HOST TARGET binding site such as BINDING SITE I, BINDING SITE II or BINDING SITE III. Table 2 illustrates the complementarity of the nucleotide sequences of PTPNS1 BINDING SITE, designated SEQ ID:28060, to the nucleotide sequence of VGAM1251 RNA, herein designated VGAM RNA, also designated SEQ ID:3962.

Another function of VGAM1251 is therefore inhibition of Protein Tyrosine Phosphatase, Non-receptor Type Substrate 1 (PTPNS1, Accession NM_080792). Accordingly, utilities of VGAM1251 include diagnosis, prevention and treatment of diseases and clinical conditions associated with PTPNS1. LOC147632 (Accession NM_138478) is another VGAM1251 host target gene. LOC147632 BINDING SITE is HOST TARGET binding site found in the 5' untranslated region of mRNA encoded by LOC147632, corresponding to a HOST TARGET binding site such as BINDING SITE I, BINDING SITE II or BINDING SITE III. Table 2 illustrates the complementarity of the nucleotide sequences of LOC147632 BINDING SITE, designated SEQ ID:28825, to the nucleotide sequence of VGAM1251 RNA, herein designated VGAM RNA, also designated SEQ ID:3962.

Another function of VGAM1251 is therefore inhibition of LOC147632 (Accession NM_138478). Accordingly, utilities of VGAM1251 include diagnosis, prevention and treatment of diseases and clinical conditions associated with LOC147632. LOC152426 (Accession XM_098225) is another VGAM1251 host target gene. LOC152426 BINDING SITE is HOST TARGET binding site found in the 3' untranslated region of mRNA encoded by LOC152426, corresponding to a HOST TARGET binding site such as BINDING SITE I, BINDING SITE II or BINDING SITE III. Table 2 illustrates the complementarity of the nucleotide sequences of LOC152426 BINDING SITE, designated SEQ ID:41501, to the nucleotide sequence of VGAM1251 RNA, herein designated VGAM RNA, also designated SEQ ID:3962.

Another function of VGAM1251 is therefore inhibition of LOC152426 (Accession XM_098225). Accordingly, utilities of VGAM1251 include diagnosis, prevention and treatment of diseases and clinical conditions associated with LOC152426. LOC165741 (Accession XM_105272) is another VGAM1251 host target gene. LOC165741 BINDING SITE is HOST TARGET binding site found in the 3' untranslated region of mRNA encoded by LOC165741, corresponding to a HOST TARGET binding site such as BINDING SITE I, BINDING SITE II or BINDING SITE III. Table 2 illustrates the complementarity of the nucleotide sequences of LOC165741 BINDING SITE, designated SEQ ID:42193, to the nucleotide sequence of VGAM1251 RNA, herein designated VGAM RNA, also designated SEQ ID:3962.

Another function of VGAM1251 is therefore inhibition of LOC165741 (Accession XM_105272). Accordingly, utilities of VGAM1251 include diagnosis, prevention and treatment of diseases and clinical conditions associated with LOC165741. LOC200728 (Accession XM_117267) is another VGAM1251 host target gene. LOC200728 BINDING SITE is HOST TARGET binding site found in the 3' untranslated region of mRNA encoded by LOC200728, corresponding to a HOST TARGET binding site such as BINDING SITE I, BINDING SITE II or BINDING SITE III. Table 2 illustrates the complementarity of the nucleotide sequences of LOC200728 BINDING SITE, designated SEQ ID:43343, to the nucleotide sequence of VGAM1251 RNA, herein designated VGAM RNA, also designated SEQ ID:3962.

Another function of VGAM1251 is therefore inhibition of LOC200728 (Accession XM_117267). Accordingly, utilities of VGAM1251 include diagnosis, prevention and treatment of diseases and clinical conditions associated with LOC200728. LOC51112 (Accession NM_016030) is another VGAM1251 host target gene. LOC51112 BINDING SITE is HOST TARGET binding site found in the 5' untranslated region of mRNA encoded by LOC51112, corresponding to a HOST TARGET binding site such as BINDING SITE I, BINDING SITE II or BINDING SITE III. Table 2 illustrates the complementarity of the nucleotide sequences of LOC51112 BINDING SITE, designated SEQ ID:18113, to the nucleotide sequence of VGAM1251 RNA, herein designated VGAM RNA, also designated SEQ ID:3962.

Another function of VGAM1251 is therefore inhibition of LOC51112 (Accession NM_016030). Accordingly, utilities of VGAM1251 include diagnosis, prevention and treatment of diseases and clinical conditions associated with LOC51112. FIG. 1 further provides a conceptual description of a novel bioinformatically detected viral gene of the present invention, referred to here as Viral Genomic Address Messenger 1252 (VGAM1252) viral gene, which modulates expression of respective host target genes thereof, the function and utility of which host target genes is known in the art.

VGAM1252 is a novel bioinformatically detected regulatory, non protein coding, viral micro RNA (miRNA) gene. The method by which VGAM1252 was detected is described hereinabove with reference to FIGS. 1-8.

VGAM1252 gene, herein designated VGAM GENE, is a viral gene contained in the genome of Human Adenovirus D. VGAM1252 host target gene, herein designated VGAM HOST TARGET GENE, is a human gene contained in the human genome.

VGAM1252 gene encodes a VGAM1252 precursor RNA, herein designated VGAM PRECURSOR RNA. Similar to other miRNA genes, and unlike most ordinary genes, VGAM1252 precursor RNA does not encode a protein. A nucleotide sequence identical or highly similar to the nucleotide sequence of VGAM1252 precursor RNA is designated SEQ ID:1238, and is provided hereinbelow with reference to the sequence listing part. Nucleotide sequence SEQ ID:1238 is located at position 5977 relative to the genome of Human Adenovirus D.

VGAM1252 precursor RNA folds onto itself, forming VGAM1252 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1252 folded precursor RNA into VGAM1252 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 52%) nucleotide sequence of VGAM1252 RNA is designated SEQ ID:3963, and is provided hereinbelow with reference to the sequence listing part.

VGAM1252 host target gene, herein designated VGAM HOST TARGET GENE, encodes a corresponding messenger RNA, VGAM1252 host target RNA, herein designated VGAM HOST TARGET RNA. VGAM1252 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1252 RNA, herein designated VGAM RNA, binds complementarily to one or more host target binding sites located in untranslated regions of VGAM1252 host target RNA, herein designated VGAM HOST TARGET RNA. This complementary binding is due to the fact that the nucleotide sequence of VGAM1252 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1252 RNA, herein designated VGAM RNA, may have a different number of host target binding sites in untranslated regions of a VGAM1252 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1252 RNA, herein designated VGAM RNA, to host target binding sites on VGAM1252 host target RNA, herein designated VGAM HOST TARGET RNA, such as BINDING SITE I, BINDING SITE II and BINDING SITE III, inhibits translation of VGAM1252 host target RNA into VGAM1252 host target protein, herein designated VGAM HOST TARGET PROTEIN. VGAM host target protein is therefore outlined by a broken line.

It is appreciated that VGAM1252 host target gene, herein designated VGAM HOST TARGET GENE, in fact represents a plurality of VGAM1252 host target genes. The mRNA of each one of this plurality of VGAM1252 host target genes comprises one or more host target binding sites, each having a nucleotide sequence which is at least partly complementary to VGAM1252 RNA, herein designated VGAM RNA, and which when bound by VGAM1252 RNA causes inhibition of translation of respective one or more VGAM1252 host target proteins.

It is further appreciated by one skilled in the art that the mode of translational inhibition illustrated by FIG. 1 with specific reference to translational inhibition exerted by VGAM1252 gene, herein designated VGAM GENE, on one or more VGAM1252 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1252 is inhibition of expression of host target genes, as part of a novel viral mechanism of attacking a host. Accordingly, utilities of VGAM1252 include diagnosis, prevention and treatment of viral infection by Human Adenovirus D. Specific functions, and accordingly utilities, of VGAM1252 correlate with, and may be deduced from, the identity of the host target genes which VGAM1252 binds and inhibits, and the function of these host target genes, as elaborated hereinbelow.

Nucleotide sequences of the VGAM1252 precursor RNA, herein designated VGAM PRECURSOR RNA, and of the ‘diced’ VGAM1252 RNA, herein designated VGAM RNA, and a schematic representation of the secondary folding of VGAM1252 folded precursor RNA, herein designated VGAM FOLDED PRECURSOR RNA, of VGAM1252 are further described hereinbelow with reference to Table 1.

Nucleotide sequences of host target binding sites, such as BINDING SITE-I, BINDING SITE-II and BINDING SITE-III of FIG. 1, found on VGAM1252 host target RNA, and schematic representation of the complementarity of each of these host target binding sites to VGAM1252 RNA, herein designated VGAM RNA, are described hereinbelow with reference to Table 2.

As mentioned hereinabove with reference to FIG. 1, a function of VGAM1252 gene, herein designated VGAM is inhibition of expression of VGAM1252 target genes. It is appreciated that specific functions, and accordingly utilities, of VGAM1252 correlate with, and may be deduced from, the identity of the target genes which VGAM1252 binds and inhibits, and the function of these target genes, as elaborated hereinbelow.

ATP-binding Cassette, Sub-family C (CFTR/MRP), Member 3 (ABCC3, Accession NM_020038) is a VGAM1252 host target gene. ABCC3 BINDING SITE is HOST TARGET binding site found in the 3' untranslated region of mRNA encoded by ABCC3, corresponding to a HOST TARGET binding site such as BINDING SITE I, BINDING SITE II or BINDING SITE III. Table 2 illustrates the complementarity of the nucleotide sequences of ABCC3 BINDING SITE, designated SEQ ID:21293, to the nucleotide sequence of VGAM1252 RNA, herein designated VGAM RNA, also designated SEQ ID:3963.

A function of VGAM1252 is therefore inhibition of ATP-binding Cassette, Sub-family C (CFTR/MRP), Member 3 (ABCC3, Accession NM_020038), a gene which may act as an inducible transporter in the biliary and intestinal excretion of organic anions. Accordingly, utilities of VGAM1252 include diagnosis, prevention and treatment of diseases and clinical conditions associated with ABCC3. The function of ABCC3 and its association with various diseases and clinical conditions, has been established by previous studies, as described hereinabove with reference to VGAM505. Ceroid-lipofuscinosis, Neuronal 2, Late Infantile (Jansky-Bielschowsky disease) (CLN2, Accession NM_000391) is another VGAM1252 host target gene. CLN2 BINDING SITE is HOST TARGET binding site found in the 3' untranslated region of mRNA encoded by CLN2, corresponding to a HOST TARGET binding site such as BINDING SITE I, BINDING SITE II or BINDING SITE III. Table 2 illustrates the complementarity of the nucleotide sequences of CLN2 BINDING SITE, designated SEQ ID:5965, to the nucleotide sequence of VGAM1252 RNA, herein designated VGAM RNA, also designated SEQ ID:3963.

Another function of VGAM1252 is therefore inhibition of Ceroid-lipofuscinosis, Neuronal 2, Late Infantile (Jansky-Bielschowsky disease) (CLN2, Accession NM_000391). Accordingly, utilities of VGAM1252 include diagnosis, prevention and treatment of diseases and clinical conditions associated with CLN2. Inositol 1,4,5-trisphosphate 3-kinase B (ITPKB, Accession NM_002221) is another VGAM1252 host target gene. ITPKB BINDING SITE is HOST TARGET binding site found in the 3' untranslated region of mRNA encoded by ITPKB, corresponding to a HOST TARGET binding site such as BINDING SITE I, BINDING SITE II or BINDING SITE III. Table 2 illustrates the complementarity of the nucleotide sequences of ITPKB BINDING SITE, designated SEQ ID:7980, to the nucleotide sequence of VGAM1252 RNA, herein designated VGAM RNA, also designated SEQ ID:3963.

Another function of VGAM1252 is therefore inhibition of Inositol 1,4,5-trisphosphate 3-kinase B (ITPKB, Accession NM_002221), a gene which is a type B inositol 1,4,5-triphosphate 3 kinase. Accordingly, utilities of VGAM1252 include diagnosis, prevention and treatment of diseases and clinical conditions associated with ITPKB. The function of ITPKB has been established by previous studies. Takazawa et al. (1991) isolated a second inositol 1,4,5-trisphosphate 3-kinase cDNA from a human hippocampus cDNA library. Sequencing yielded an open reading frame encoding a 472-amino acid protein with a calculated relative mass of 53,451. The C-terminal part of this enzyme, referred to as 3-kinase-B, namely, residues 187-462, was 68% identical to 3-kinase-A (OMIM Ref. No. 147521) in amino acid sequence. By in situ hybridization, Erneux et al. (1992) mapped the ITPKB gene to 1q41-q43.

Full details of the abovementioned studies are described in the following publications, the disclosure of which are hereby incorporated by reference:

Erneux, C.; Roeckel, N.; Takazawa, K.; Mailleux, P.; Vassart, G.; Mattei, M. G.: Localization of the genes for human inositol 1,4,5-trisphosphate 3-kinase A (ITPKA) and B (ITPKB) to chromosome regions 15q14-q21 and 1q41-q43, respectively, by in situ hybridization. Genomics 14:546-547, 1992; and Takazawa, K.; Perret, J.; Dumont, J. E.; Erneux, C.: Molecular cloning and expression of a new putative inositol 1,4,5-trisphosphate 3-kinase isoenzyme. Biochem. J. 278:883-886, 1991.

Further studies establishing the function and utilities of ITPKB are found in John Hopkins OMIM database record ID 147522, and in sited publications numbered 127-128 listed in the bibliography section hereinbelow, which are also hereby incorporated by reference. DKFZP586P0123 (Accession XM_170681) is another VGAM1252 host target gene. DKFZP586P0123 BINDING SITE is HOST TARGET binding site found in the 3' untranslated region of mRNA encoded by DKFZP586P0123, corresponding to a HOST TARGET binding site such as BINDING SITE I, BINDING SITE II or BINDING SITE III. Table 2 illustrates the complementarity of the nucleotide sequences of DKFZP586P0123 BINDING SITE, designated SEQ ID:45463, to the nucleotide sequence of VGAM1252 RNA, herein designated VGAM RNA, also designated SEQ ID:3963.

Another function of VGAM1252 is therefore inhibition of DKFZP586P0123 (Accession XM_170681). Accordingly, utilities of VGAM1252 include diagnosis, prevention and treatment of diseases and clinical conditions associated with DKFZP586P0123. Dihydrolipoamide S-acetyltransferase (E2 component of pyruvate dehydrogenase complex) (DLAT, Accession XM_041355) is another VGAM1252 host target gene. DLAT BINDING SITE is HOST TARGET binding site found in the 5' untranslated region of mRNA encoded by DLAT, corresponding to a HOST TARGET binding site such as BINDING SITE I, BINDING SITE II or BINDING SITE III. Table 2 illustrates the complementarity of the nucleotide sequences of DLAT BINDING SITE, designated SEQ ID:33503, to the nucleotide sequence of VGAM1252 RNA, herein designated VGAM RNA, also designated SEQ ID:3963.

Another function of VGAM1252 is therefore inhibition of Dihydrolipoamide S-acetyltransferase (E2 component of pyruvate dehydrogenase complex) (DLAT, Accession XM_041355). Accordingly, utilities of VGAM1252 include diagnosis, prevention and treatment of diseases and clinical conditions associated with DLAT. FLJ10350 (Accession XM_170946) is another VGAM1252 host target gene.

FLJ10350 BINDING SITE is HOST TARGET binding site found in the 3' untranslated region of mRNA encoded by FLJ10350, corresponding to a HOST TARGET binding site such as BINDING SITE I, BINDING SITE II or BINDING SITE III. Table 2 illustrates the complementarity of the nucleotide sequences of FLJ10350 BINDING SITE, designated SEQ ID:45728, to the nucleotide sequence of VGAM1252 RNA, herein designated VGAM RNA, also designated SEQ ID:3963.

Another function of VGAM1252 is therefore inhibition of FLJ10350 (Accession XM_170946). Accordingly, utilities of VGAM1252 include diagnosis, prevention and treatment of diseases and clinical conditions associated with FLJ10350. FLJ20337 (Accession NM_017772) is another VGAM1252 host target gene. FLJ20337 BINDING SITE is HOST TARGET binding site found in the 3' untranslated region of mRNA encoded by FLJ20337, corresponding to a HOST TARGET binding site such as BINDING SITE I, BINDING SITE II or BINDING SITE III. Table 2 illustrates the complementarity of the nucleotide sequences of FLJ20337 BINDING SITE, designated SEQ ID:19391, to the nucleotide sequence of VGAM1252 RNA, herein designated VGAM RNA, also designated SEQ ID:3963.

Another function of VGAM1252 is therefore inhibition of FLJ20337 (Accession NM_017772). Accordingly, utilities of VGAM1252 include diagnosis, prevention and treatment of diseases and clinical conditions associated with FLJ20337. Histamine Receptor H3 (HRH3, Accession NM_007232) is another VGAM1252 host target gene. HRH3 BINDING SITE is HOST TARGET binding site found in the 3' untranslated region of mRNA encoded by HRH3, corresponding to a HOST TARGET binding site such as BINDING SITE I, BINDING SITE II or BINDING SITE III. Table 2 illustrates the complementarity of the nucleotide sequences of HRH3 BINDING SITE, designated SEQ ID:14108, to the nucleotide sequence of VGAM1252 RNA, herein designated VGAM RNA, also designated SEQ ID:3963.

Another function of VGAM1252 is therefore inhibition of Histamine Receptor H3 (HRH3, Accession NM_007232). Accordingly, utilities of VGAM1252 include diagnosis, prevention and treatment of diseases and clinical conditions associated with HRH3. KIAA0284 (Accession XM_032235) is another VGAM1252 host target gene. KIAA0284 BINDING SITE1 and KIAA0284 BINDING SITE2 are HOST TARGET binding sites found in untranslated regions of mRNA encoded by KIAA0284, corresponding to HOST TARGET binding sites such as BINDING SITE I, BINDING SITE II or BINDING SITE III. Table 2 illustrates the complementarity of the nucleotide sequences of KIAA0284 BINDING SITE1 and KIAA0284 BINDING SITE2, designated SEQ ID:31617 and SEQ ID:31616 respectively, to the nucleotide sequence of VGAM1252 RNA, herein designated VGAM RNA, also designated SEQ ID:3963.

Another function of VGAM1252 is therefore inhibition of KIAA0284 (Accession XM_032235). Accordingly, utilities of VGAM1252 include diagnosis, prevention and treatment of diseases and clinical conditions associated with KIAA0284. PP1057 (Accession NM_031285) is another VGAM1252 host target gene. PP1057 BINDING SITE is HOST TARGET binding site found in the 3' untranslated region of mRNA encoded by PP1057, corresponding to a HOST TARGET binding site such as BINDING SITE I, BINDING SITE II or BINDING SITE III. Table 2 illustrates the complementarity of the nucleotide sequences of PP1057 BINDING SITE, designated SEQ ID:25310, to the nucleotide sequence of VGAM1252 RNA, herein designated VGAM RNA, also designated SEQ ID:3963.

Another function of VGAM1252 is therefore inhibition of PP1057 (Accession NM_031285). Accordingly, utilities of VGAM1252 include diagnosis, prevention and treatment of diseases and clinical conditions associated with PP1057. Solute Carrier Family 12, (potassium-chloride transporter) Member 5 (SLC12A5, Accession NM_020708) is another VGAM1252 host target gene. SLC12A5 BINDING SITE is HOST TARGET binding site found in the 3' untranslated region of mRNA encoded by SLC12A5, corresponding to a HOST TARGET binding site such as BINDING SITE I, BINDING SITE II or BINDING SITE III. Table 2 illustrates the complementarity of the nucleotide sequences of SLC12A5 BINDING SITE, designated SEQ ID:21853, to the nucleotide sequence of VGAM1252 RNA, herein designated VGAM RNA, also designated SEQ ID:3963.

Another function of VGAM1252 is therefore inhibition of Solute Carrier Family 12, (potassium-chloride transporter) Member 5 (SLC12A5, Accession NM_020708). Accordingly, utilities of VGAM1252 include diagnosis, prevention and treatment of diseases and clinical conditions associated with SLC12A5. LOC164584 (Accession XM_092883) is another VGAM1252 host target gene. LOC164584 BINDING SITE is HOST TARGET binding site found in the 5' untranslated region of mRNA encoded by LOC164584, corresponding to a HOST TARGET binding site such as BINDING SITE I, BINDING SITE II or BINDING SITE III. Table 2 illustrates the complementarity of the nucleotide sequences of LOC164584 BINDING SITE, designated SEQ ID:40157, to the nucleotide sequence of VGAM1252 RNA, herein designated VGAM RNA, also designated SEQ ID:3963.

Another function of VGAM1252 is therefore inhibition of LOC164584 (Accession XM_092883). Accordingly, utilities of VGAM1252 include diagnosis, prevention and treatment of diseases and clinical conditions associated with LOC164584. LOC253216 (Accession XM_170765) is another VGAM1252 host target gene. LOC253216 BINDING SITE is HOST TARGET binding site found in the 3' untranslated region of mRNA encoded by LOC253216, corresponding to a HOST TARGET binding site such as BINDING SITE I, BINDING SITE II or BINDING SITE III. Table 2 illustrates the complementarity of the nucleotide sequences of LOC253216 BINDING SITE, designated SEQ ID:45517, to the nucleotide sequence of VGAM1252 RNA, herein designated VGAM RNA, also designated SEQ ID:3963.

Another function of VGAM1252 is therefore inhibition of LOC253216 (Accession XM_170765). Accordingly, utilities of VGAM1252 include diagnosis, prevention and treatment of diseases and clinical conditions associated with LOC253216. LOC90120 (Accession XM_029168) is another VGAM1252 host target gene. LOC90120 BINDING SITE is HOST TARGET binding site found in the 5' untranslated region of mRNA encoded by LOC90120, corresponding to a HOST TARGET binding site such as BINDING SITE I, BINDING SITE II or BINDING SITE III. Table 2 illustrates the complementarity of the nucleotide sequences of LOC90120 BINDING SITE, designated SEQ ID:30850, to the nucleotide sequence of VGAM1252 RNA, herein designated VGAM RNA, also designated SEQ ID:3963.

Another function of VGAM1252 is therefore inhibition of LOC90120 (Accession XM_029168). Accordingly, utilities of VGAM1252 include diagnosis, prevention and treatment of diseases and clinical conditions associated with LOC90120. LOC90288 (Accession XM_030669) is another VGAM1252 host target gene. LOC90288 BINDING SITE is HOST TARGET binding site found in the 5' untranslated region of mRNA encoded by LOC90288, corresponding to a HOST TARGET binding site such as BINDING SITE I, BINDING SITE II or BINDING SITE III. Table 2 illustrates the complementarity of the nucleotide sequences of LOC90288 BINDING SITE, designated SEQ ID:31104, to the nucleotide sequence of VGAM1252 RNA, herein designated VGAM RNA, also designated SEQ ID:3963.

Another function of VGAM1252 is therefore inhibition of LOC90288 (Accession XM_030669). Accordingly, utilities of VGAM1252 include diagnosis, prevention and treatment of diseases and clinical conditions associated with LOC90288. FIG. 1 further provides a conceptual description of a novel bioinformatically detected viral gene of the present invention, referred to here as Viral Genomic Address Messenger 1253 (VGAM1253) viral gene, which modulates expression of respective host target genes thereof, the function and utility of which host target genes is known in the art.

VGAM1253 is a novel bioinformatically detected regulatory, non protein coding, viral micro RNA (miRNA) gene. The method by which VGAM1253 was detected is described hereinabove with reference to FIGS. 1-8.

VGAM1253 gene, herein designated VGAM GENE, is a viral gene contained in the genome of Human Adenovirus D. VGAM1253 host target gene, herein designated VGAM HOST TARGET GENE, is a human gene contained in the human genome.

VGAM1253 gene encodes a VGAM1253 precursor RNA, herein designated VGAM PRECURSOR RNA. Similar to other miRNA genes, and unlike most ordinary genes, VGAM1253 precursor RNA does not encode a protein. A nucleotide sequence identical or highly similar to the nucleotide sequence of VGAM1253 precursor RNA is designated SEQ ID:1239, and is provided hereinbelow with reference to the sequence listing part. Nucleotide sequence SEQ ID:1239 is located at position 8179 relative to the genome of Human Adenovirus D.

VGAM1253 precursor RNA folds onto itself, forming VGAM1253 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1253 folded precursor RNA into VGAM1253 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1253 RNA is designated SEQ ID:3964, and is provided hereinbelow with reference to the sequence listing part.

VGAM1253 host target gene, herein designated VGAM HOST TARGET GENE, encodes a corresponding messenger RNA, VGAM1253 host target RNA, herein designated VGAM HOST TARGET RNA. VGAM1253 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1253 RNA, herein designated VGAM RNA, binds complementarily to one or more host target binding sites located in untranslated regions of VGAM1253 host target RNA, herein designated VGAM HOST TARGET RNA. This complementary binding is due to the fact that the nucleotide sequence of VGAM1253 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1253 RNA, herein designated VGAM RNA, may have a different number of host target binding sites in untranslated regions of a VGAM1253 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1253 RNA, herein designated VGAM RNA, to host target binding sites on VGAM1253 host target RNA, herein designated VGAM HOST TARGET RNA, such as BINDING SITE I, BINDING SITE II and BINDING SITE III, inhibits translation of VGAM1253 host target RNA into VGAM1253 host target protein, herein designated VGAM HOST TARGET PROTEIN. VGAM host target protein is therefore outlined by a broken line.

It is appreciated that VGAM1253 host target gene, herein designated VGAM HOST TARGET GENE, in fact represents a plurality of VGAM1253 host target genes. The mRNA of each one of this plurality of VGAM1253 host target genes comprises one or more host target binding sites, each having a nucleotide sequence which is at least partly complementary to VGAM1253 RNA, herein designated VGAM RNA, and which when bound by VGAM1253 RNA causes inhibition of translation of respective one or more VGAM1253 host target proteins.

It is further appreciated by one skilled in the art that the mode of translational inhibition illustrated by FIG. 1 with specific reference to translational inhibition exerted by VGAM1253 gene, herein designated VGAM GENE, on one or more VGAM1253 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1253 is inhibition of expression of host target genes, as part of a novel viral mechanism of attacking a host. Accordingly, utilities of VGAM1253 include diagnosis, prevention and treatment of viral infection by Human Adenovirus D. Specific functions, and accordingly utilities, of VGAM1253 correlate with, and may be deduced from, the identity of the host target genes which VGAM1253 binds and inhibits, and the function of these host target genes, as elaborated hereinbelow.

Nucleotide sequences of the VGAM1253 precursor RNA, herein designated VGAM PRECURSOR RNA, and of the 'diced' VGAM1253 RNA, herein designated VGAM RNA, and a schematic representation of the secondary folding of VGAM1253 folded precursor RNA, herein designated VGAM FOLDED PRECURSOR RNA, of VGAM1253 are further described hereinbelow with reference to Table 1.

Nucleotide sequences of host target binding sites, such as BINDING SITE-I, BINDING SITE-II and BINDING SITE-III of FIG. 1, found on VGAM1253 host target RNA, and schematic representation of the complementarity of each of these host target binding sites to VGAM1253 RNA, herein designated VGAM RNA, are described hereinbelow with reference to Table 2.

As mentioned hereinabove with reference to FIG. 1, a function of VGAM1253 gene, herein designated VGAM is inhibition of expression of VGAM1253 target genes. It is appreciated that specific functions, and accordingly utilities, of VGAM1253 correlate with, and may be deduced from, the identity of the target genes which VGAM1253 binds and inhibits, and the function of these target genes, as elaborated hereinbelow.

Fibrillin 2 (congenital contractural arachnodactyly) (FBN2, Accession NM_001999) is a VGAM1253 host target gene. FBN2 BINDING SITE is HOST TARGET binding site found in the 3' untranslated region of mRNA encoded by FBN2, corresponding to a HOST TARGET binding site such as BINDING SITE I, BINDING SITE II or BINDING SITE III. Table 2 illustrates the complementarity of the nucleotide sequences of FBN2 BINDING SITE, designated SEQ ID:7726, to the nucleotide sequence of VGAM1253 RNA, herein designated VGAM RNA, also designated SEQ ID:3964.

A function of VGAM1253 is therefore inhibition of Fibrillin 2 (congenital contractural arachnodactyly) (FBN2, Accession NM_001999), a gene which structural component of connective tissue microfibrils that binds calcium. fibrillin-2-containing microfibrils regulate the early process of elastic fiber assembly. Accordingly, utilities of VGAM1253 include diagnosis, prevention and treatment of diseases and clinical conditions associated with FBN2. The function of FBN2 and its association with various diseases and clinical conditions, has been established by previous studies, as described hereinabove with reference to VGAM254. Low Density Lipoprotein Receptor (familial hypercholesterolemia) (LDLR, Accession NM_000527) is another VGAM1253 host target gene. LDLR BINDING SITE is HOST TARGET binding site found in the 3' untranslated region of mRNA encoded by LDLR, corresponding to a HOST TARGET binding site such as BINDING SITE I, BINDING SITE II or BINDING SITE III. Table 2 illustrates the complementarity of the nucleotide sequences of LDLR BINDING SITE, designated SEQ ID:6127, to the nucleotide sequence of VGAM1253 RNA, herein designated VGAM RNA, also designated SEQ ID:3964.

Another function of VGAM1253 is therefore inhibition of Low Density Lipoprotein Receptor (familial hypercholesterolemia) (LDLR, Accession NM_000527), a gene which also acts as a tumor suppressor. Accordingly, utilities of VGAM1253 include diagnosis, prevention and treatment of diseases and clinical conditions associated with LDLR. The function of LDLR and its association with various diseases and clinical conditions, has been established by previous studies, as described hereinabove with reference to VGAM1030. START Domain Containing 5 (STARD5, Accession NM_030574) is another VGAM1253 host target gene. STARD5 BINDING SITE is HOST TARGET binding site found in the 5' untranslated region of mRNA encoded by STARD5, corresponding to a HOST TARGET binding site such as BINDING SITE I, BINDING SITE II or BINDING SITE III. Table 2 illustrates the complementarity of the nucleotide sequences of STARD5 BINDING SITE, designated SEQ ID:24948, to the nucleotide sequence of VGAM1253 RNA, herein designated VGAM RNA, also designated SEQ ID:3964.

Another function of VGAM1253 is therefore inhibition of START Domain Containing 5 (STARD5, Accession NM_030574). Accordingly, utilities of VGAM1253 include diagnosis, prevention and treatment of diseases and clinical conditions associated with STARD5. FLJ20308 (Accession XM_039852) is another VGAM1253 host target gene. FLJ20308 BINDING SITE is HOST TARGET binding site found in the 3' untranslated region of mRNA encoded by FLJ20308, corresponding to a HOST TARGET binding site such as BINDING SITE I, BINDING SITE II or BINDING SITE III. Table 2 illustrates the complementarity of the nucleotide sequences of FLJ20308 BINDING SITE, designated SEQ ID:33197, to the nucleotide sequence of VGAM1253 RNA, herein designated VGAM RNA, also designated SEQ ID:3964.

Another function of VGAM1253 is therefore inhibition of FLJ20308 (Accession XM_039852). Accordingly, utilities of VGAM1253 include diagnosis, prevention and treatment of diseases and clinical conditions associated with FLJ20308. PC4 and SFRS1 Interacting Protein 2 (PSIP2, Accession NM_033222) is another VGAM1253 host target gene. PSIP2 BINDING SITE is HOST TARGET binding site found in the 5' untranslated region of mRNA encoded by PSIP2, corresponding to a HOST TARGET binding site such as BINDING SITE I, BINDING SITE II or BINDING SITE III. Table 2 illustrates the complementarity of the nucleotide sequences of PSIP2 BINDING SITE, designated SEQ ID:27068, to the nucleotide sequence of VGAM1253 RNA, herein designated VGAM RNA, also designated SEQ ID:3964.

Another function of VGAM1253 is therefore inhibition of PC4 and SFRS1 Interacting Protein 2 (PSIP2, Accession NM_033222). Accordingly, utilities of VGAM1253 include diagnosis, prevention and treatment of diseases and clinical conditions associated with PSIP2. LOC163682 (Accession XM_099402) is another VGAM1253 host target gene. LOC163682 BINDING SITE is HOST TARGET binding site found in the 3' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42091, to the nucleotide sequence of VGAM1253 RNA, herein designated VGAM RNA, also designated SEQ ID:3964.

Another function of VGAM1253 is therefore inhibition of LOC163682 (Accession XM_099402). Accordingly, utilities of VGAM1253 include diagnosis, prevention and treatment of diseases and clinical conditions associated with LOC163682. FIG. 1 further provides a conceptual description of a novel bioinformatically detected viral gene of the present invention, referred to here as Viral Genomic Address Messenger 1254 (VGAM1254) viral gene, which modulates expression of respective host target genes thereof, the function and utility of which host target genes is known in the art.

VGAM1254 is a novel bioinformatically detected regulatory, non protein coding, viral micro RNA (miRNA) gene. The method by which VGAM1254 was detected is described hereinabove with reference to FIGS. 1-8.

VGAM1254 gene, herein designated VGAM GENE, is a viral gene contained in the genome of Human Adenovirus D. VGAM1254 host target gene, herein designated VGAM HOST TARGET GENE, is a human gene contained in the human genome.

VGAM1254 gene encodes a VGAM1254 precursor RNA, herein designated VGAM PRECURSOR RNA. Similar to other miRNA genes, and unlike most ordinary genes, VGAM1254 precursor RNA does not encode a protein. A nucleotide sequence identical or highly similar to the nucleotide sequence of VGAM1254 precursor RNA is designated SEQ ID:1240, and is provided hereinbelow with reference to the sequence listing part. Nucleotide sequence SEQ ID:1240 is located at position 8988 relative to the genome of Human Adenovirus D.

VGAM1254 precursor RNA folds onto itself, forming VGAM1254 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1254 folded precursor RNA into VGAM1254 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1254 RNA is designated SEQ ID:3965, and is provided hereinbelow with reference to the sequence listing part.

VGAM1254 host target gene, herein designated VGAM HOST TARGET GENE, encodes a corresponding messenger RNA, VGAM1254 host target RNA, herein designated VGAM HOST TARGET RNA. VGAM1254 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1254 RNA, herein designated VGAM RNA, binds complementarily to one or more host target binding sites located in untranslated regions of VGAM1254 host target RNA, herein designated VGAM HOST TARGET RNA. This complementary binding is due to the fact that the nucleotide sequence of VGAM1254 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1254 RNA, herein designated VGAM RNA, may have a different number of host target binding sites in untranslated regions of a VGAM1254 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1254 RNA, herein designated VGAM RNA, to host target binding sites on VGAM1254 host target RNA, herein designated VGAM HOST TARGET RNA, such as BINDING SITE I, BINDING SITE II and BINDING SITE III, inhibits translation of VGAM1254 host target RNA into VGAM1254 host target protein, herein designated VGAM HOST TARGET PROTEIN. VGAM host target protein is therefore outlined by a broken line.

It is appreciated that VGAM1254 host target gene, herein designated VGAM HOST TARGET GENE, in fact represents a plurality of VGAM1254 host target genes. The mRNA of each one of this plurality of VGAM1254 host target genes comprises one or more host target binding sites, each having a nucleotide sequence which is at least partly complementary to VGAM1254 RNA, herein designated VGAM RNA, and which when bound by VGAM1254 RNA causes inhibition of translation of respective one or more VGAM1254 host target proteins.

It is further appreciated by one skilled in the art that the mode of translational inhibition illustrated by FIG. 1 with specific reference to translational inhibition exerted by VGAM1254 gene, herein designated VGAM GENE, on one or more VGAM1254 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1254 is inhibition of expression of host target genes, as part of a novel viral mechanism of attacking a host. Accordingly, utilities of VGAM1254 include diagnosis, prevention and treatment of viral infection by Human Adenovirus D. Specific functions, and accordingly utilities, of VGAM1254 correlate with, and may be deduced from, the identity of the host target genes which VGAM1254 binds and inhibits, and the function of these host target genes, as elaborated hereinbelow.

Nucleotide sequences of the VGAM1254 precursor RNA, herein designated VGAM PRECURSOR RNA, and of the 'diced' VGAM1254 RNA, herein designated VGAM RNA, and a schematic representation of the secondary folding of VGAM1254 folded precursor RNA, herein designated VGAM FOLDED PRECURSOR RNA, of VGAM1254 are further described hereinbelow with reference to Table 1.

Nucleotide sequences of host target binding sites, such as BINDING SITE-I, BINDING SITE-II and BINDING SITE-III of FIG. 1, found on VGAM1254 host target RNA, and schematic representation of the complementarity of each of these host target binding sites to VGAM1254 RNA, herein designated VGAM RNA, are described hereinbelow with reference to Table 2.

As mentioned hereinabove with reference to FIG. 1, a function of VGAM1254 gene, herein designated VGAM is inhibition of expression of VGAM1254 target genes. It is appreciated that specific functions, and accordingly utilities, of VGAM1254 correlate with, and may be deduced from, the identity of the target genes which VGAM1254 binds and inhibits, and the function of these target genes, as elaborated hereinbelow.

EH-domain Containing 2 (EHD2, Accession NM_014601) is a VGAM1254 host target gene. EHD2 BINDING SITE is HOST TARGET binding site found in the 3' untranslated region of mRNA encoded by EHD2, corresponding to a HOST TARGET binding site such as BINDING SITE I, BINDING SITE II or BINDING SITE III. Table 2 illustrates the complementarity of the nucleotide sequences of EHD2 BINDING SITE, designated SEQ ID:15964, to the nucleotide sequence of VGAM1254 RNA, herein designated VGAM RNA, also designated SEQ ID:3965.

A function of VGAM1254 is therefore inhibition of EH-domain Containing 2 (EHD2, Accession NM_014601). Accordingly, utilities of VGAM1254 include diagnosis, prevention and treatment of diseases and clinical conditions associated with EHD2. Eukaryotic Translation Initiation Factor 2, Subunit 3 Gamma, 52 kDa (EIF2S3, Accession NM_001415) is another VGAM1254 host target gene. EIF2S3 BINDING SITE is HOST TARGET binding site found in the 3' untranslated region of mRNA encoded by EIF2S3, corresponding to a HOST TARGET binding site such as BINDING SITE I, BINDING SITE II or BINDING SITE III. Table 2 illustrates the complementarity of the nucleotide sequences of EIF2S3 BINDING SITE, designated SEQ ID:7114, to the nucleotide sequence of VGAM1254 RNA, herein designated VGAM RNA, also designated SEQ ID:3965.

Another function of VGAM1254 is therefore inhibition of Eukaryotic Translation Initiation Factor 2, Subunit 3 Gamma, 52 kDa (EIF2S3, Accession NM_001415), a gene which functions in the early steps of protein synthesis. Accordingly, utilities of VGAM1254 include diagnosis, prevention and treatment of diseases and clinical conditions associated with EIF2S3. The function of EIF2S3 has been established by previous studies. Translation initiation factor eIF-2 is a heterotrimeric GTP-binding protein involved in the recruitment of methionyl-tRNA(i) to the 40 S ribosomal subunit. Gasper et al. (1994) cloned a human cDNA encoding the largest subunit of eIF-2, EIF2G. The EIF2G cDNA encodes a 472-amino acid protein with a molecular mass of 51.8 kD and contains 3 consensus GTP-binding elements. Human EIF2G is highly related to the yeast homolog, GCD11, exhibiting 71% sequence identity and an additional 13% similarity. Genes controlling the functions of spermatogenesis, Spy, and expression of the male-specific minor transplantation antigen H-Y, Hya (OMIM Ref. No. 426000), map to a region of the short arm of the mouse Y chromosome, delta-Sxr (b), that lies between the zinc finger genes Zfy1 and Zfy2 (OMIM Ref. No. 490000) and is deleted in Sxr (b) mutant mice. These Sxr (b) mice arose from an original sex-reversed mutation, Sxr (a), that carries a duplication of most of the Y chromosome short arm translocated to the telomeric end of the pseudoautosomal region of the Y chromosome. Several genes were mapped to that interval of the mouse Y chromosome and each was found to have a homolog on the X chromosome. Four of them, Zfy1 and Zfy2 (OMIM Ref. No. 490000), Ube1y (OMIM Ref. No. 489000), and Dffry (OMIM Ref. No. 400005), are expressed specifically in the testis and their X homologs (Zfx, 314980; Ube1x, 314370; Dffrx, 300072) are not transcribed from the inactive X chromosome. A further 2, Smcy (OMIM Ref. No. 426000) and Uty (OMIM Ref. No. 400009), are ubiquitously expressed and their X homologs (Smcx, 314690; Utx, 300128) escape X inactivation. Ehrmann et al. (1998) identified another gene from this region of the mouse Y chromosome. It was found to encode the highly conserved eukaryotic translation initiation factor eIF-2-gamma. In the mouse this gene was found to be ubiquitously expressed, to have an X chromosome homolog that maps close to Dmd (OMIM Ref. No. 300377), and to escape X inactivation. The coding regions of the X and Y genes show 86% nucleotide identity and encode the putative products with 98% amino acid identity. Ehrmann et al. (1998) found that the human homolog is located on Xp21 and also escapes X inactivation. No evidence of a Y copy of this gene was found in human S, however. In both human S and mice, Ehrmann et al. (1998) identified autosomal retroposons of EIF2G in both human S and mice and an additional retroposon on the X chromosome in some mouse strains. Ark blot analysis of eutherian and metatherian genomic DNA indicated that X-Y homologs are present in all species tested except in simian primates and kangaroo and that retroposons are common to a wide range of mammals. ('Zoo blots' are Southern blots of genomic DNA from multiple species without regard to gender; 'ark blots' are Southern blots used to compare male and female from multiple species.)

Full details of the abovementioned studies are described in the following publications, the disclosure of which are hereby incorporated by reference:

Ehrmann, I. E.; Ellis, P. S.; Mazeyrat, S.; Duthie, S.; Brockdorff, N.; Mattei, M. G.; Gavin, M. A.; Affara, N. A.; Brown, G. M.; Simpson, E.; Mitchell, M. J.; Scott, D. M.: Characterization of genes encoding translation initiation factor eIF-2-gamma in mouse and human: sex chromosome localization, escape from X-inactivation and evolution. Hum. Molec. Genet. 7:1725-1737, 1998; and Gasper, N. J.; Kinzy, T. G.; Scherer, B. J.; Humbelin, M.; Hershey, J. W. B.; Merrick, W. C.: Translation initiation factor eIF-2: cloning and expression of the human cDNA encoding the.

Further studies establishing the function and utilities of EIF2S3 are found in John Hopkins OMIM database record ID 300161, and in sited publications numbered 11002 listed in the bibliography section hereinbelow, which are also hereby incorporated by reference. Farnesyltransferase, CAAX Box, Beta (FNTB, Accession NM_002028) is another VGAM1254 host target gene. FNTB BINDING SITE is HOST TARGET binding site found in the 3' untranslated region of mRNA encoded by FNTB, corresponding to a HOST TARGET binding site such as BINDING SITE I, BINDING SITE II or BINDING SITE III. Table 2 illustrates the complementarity of the nucleotide sequences of FNTB BINDING SITE, designated SEQ ID:7783, to the nucleotide sequence of VGAM1254 RNA, herein designated VGAM RNA, also designated SEQ ID:3965.

Another function of VGAM1254 is therefore inhibition of Farnesyltransferase, CAAX Box, Beta (FNTB, Accession NM_002028), a gene which transfers farnesyl groups to proteins. Accordingly, utilities of VGAM1254 include diagnosis, prevention and treatment of diseases and clinical conditions associated with FNTB. The function of FNTB and its association with various diseases and clinical conditions, has been established by previous studies, as described hereinabove with reference to VGAM615. Suppression of Tumorigenicity 7 (ST7, Accession NM_021908) is another VGAM1254 host target gene. ST7 BINDING SITE1 and ST7 BINDING SITE2 are HOST TARGET binding sites found in untranslated regions of mRNA encoded by ST7, corresponding to HOST TARGET binding sites such as BINDING SITE I, BINDING SITE II or BINDING SITE III. Table 2 illustrates the complementarity of the nucleotide sequences of ST7 BINDING SITE1 and ST7 BINDING SITE2, designated SEQ ID:22430 and SEQ ID:20454 respectively, to the nucleotide sequence of VGAM1254 RNA, herein designated VGAM RNA, also designated SEQ ID:3965.

Another function of VGAM1254 is therefore inhibition of Suppression of Tumorigenicity 7 (ST7, Accession NM_021908), a gene which has a role in regulating cell-environment or cell-cell interactions. Accordingly, utilities of VGAM1254 include diagnosis, prevention and treatment of diseases and clinical conditions associated with ST7. The function of ST7 and its association with various diseases and clinical conditions, has been established by previous studies, as described hereinabove with reference to VGAM107. FLJ14351 (Accession NM_024732) is another VGAM1254 host target gene. FLJ14351 BINDING SITE is HOST TAR- GET binding site found in the 3' untranslated region of mRNA encoded by FLJ14351, corresponding to a HOST TARGET binding site such as BINDING SITE I, BINDING SITE II or BINDING SITE III. Table 2 illustrates the complementarity of the nucleotide sequences of FLJ14351 BINDING SITE, designated SEQ ID:24072, to the nucleotide sequence of VGAM1254 RNA, herein designated VGAM RNA, also designated SEQ ID:3965.

Another function of VGAM1254 is therefore inhibition of FLJ14351 (Accession NM_024732). Accordingly, utilities of VGAM1254 include diagnosis, prevention and treatment of diseases and clinical conditions associated with FLJ14351. FLJ20154 (Accession XM_053688) is another VGAM1254 host target gene. FLJ20154 BINDING SITE is HOST TARGET binding site found in the 5' untranslated region of mRNA encoded by FLJ20154, corresponding to a HOST TARGET binding site such as BINDING SITE I, BINDING SITE II or BINDING SITE III. Table 2 illustrates the complementarity of the nucleotide sequences of FLJ20154 BINDING SITE, designated SEQ ID:36109, to the nucleotide sequence of VGAM1254 RNA, herein designated VGAM RNA, also designated SEQ ID:3965.

Another function of VGAM1254 is therefore inhibition of FLJ20154 (Accession XM_053688). Accordingly, utilities of VGAM1254 include diagnosis, prevention and treatment of diseases and clinical conditions associated with FLJ20154. FLJ22160 (Accession NM_024585) is another VGAM1254 host target gene. FLJ22160 BINDING SITE is HOST TARGET binding site found in the 3' untranslated region of mRNA encoded by FLJ22160, corresponding to a HOST TARGET binding site such as BINDING SITE I, BINDING SITE II or BINDING SITE III. Table 2 illustrates the complementarity of the nucleotide sequences of FLJ22160 BINDING SITE, designated SEQ ID:23820, to the nucleotide sequence of VGAM1254 RNA, herein designated VGAM RNA, also designated SEQ ID:3965.

Another function of VGAM1254 is therefore inhibition of FLJ22160 (Accession NM_024585). Accordingly, utilities of VGAM1254 include diagnosis, prevention and treatment of diseases and clinical conditions associated with FLJ22160. Guanine Nucleotide Binding Protein (G protein), Gamma 4 (GNG4, Accession NM_004485) is another VGAM1254 host target gene. GNG4 BINDING SITE is HOST TARGET binding site found in the 3' untranslated region of mRNA encoded by GNG4, corresponding to a HOST TARGET binding site such as BINDING SITE I, BINDING SITE II or BINDING SITE III. Table 2 illustrates the complementarity of the nucleotide sequences of GNG4 BINDING SITE, designated SEQ ID:10810, to the nucleotide sequence of VGAM1254 RNA, herein designated VGAM RNA, also designated SEQ ID:3965.

Another function of VGAM1254 is therefore inhibition of Guanine Nucleotide Binding Protein (G protein), Gamma 4 (GNG4, Accession NM_004485). Accordingly, utilities of VGAM1254 include diagnosis, prevention and treatment of diseases and clinical conditions associated with GNG4. H2AV (Accession NM_138635) is another VGAM1254 host target gene. H2AV BINDING SITE is HOST TARGET binding site found in the 3' untranslated region of mRNA encoded by H2AV, corresponding to a HOST TARGET binding site such as BINDING SITE I, BINDING SITE II or BINDING SITE III. Table 2 illustrates the complementarity of the nucleotide sequences of H2AV BINDING SITE, designated SEQ ID:28911, to the nucleotide sequence of VGAM1254 RNA, herein designated VGAM RNA, also designated SEQ ID:3965.

Another function of VGAM1254 is therefore inhibition of H2AV (Accession NM_138635). Accordingly, utilities of VGAM1254 include diagnosis, prevention and treatment of diseases and clinical conditions associated with H2AV. KIAA1465 (Accession XM_027396) is another VGAM1254 host target gene. KIAA1465 BINDING SITE is HOST TARGET binding site found in the 3' untranslated region of mRNA encoded by KIAA1465, corresponding to a HOST TARGET binding site such as BINDING SITE I, BINDING SITE II or BINDING SITE III. Table 2 illustrates the complementarity of the nucleotide sequences of KIAA1465 BINDING SITE, designated SEQ ID:30504, to the nucleotide sequence of VGAM1254 RNA, herein designated VGAM RNA, also designated SEQ ID:3965.

Another function of VGAM1254 is therefore inhibition of KIAA1465 (Accession XM_027396). Accordingly, utilities of VGAM1254 include diagnosis, prevention and treatment of diseases and clinical conditions associated with KIAA1465. Solute Carrier Family 11 (proton-coupled divalent metal ion transporters), Member 1 (SLC11A1, Accession XM_002585) is another VGAM1254 host target gene. SLC11A1 BINDING SITE is HOST TARGET binding site found in the 3' untranslated region of mRNA encoded by SLC11A1, corresponding to a HOST TARGET binding site such as BINDING SITE I, BINDING SITE II or BINDING SITE III. Table 2 illustrates the complementarity of the nucleotide sequences of SLC11A1 BINDING SITE, designated SEQ ID:29902, to the nucleotide sequence of VGAM1254 RNA, herein designated VGAM RNA, also designated SEQ ID:3965.

Another function of VGAM1254 is therefore inhibition of Solute Carrier Family 11 (proton-coupled divalent metal ion transporters), Member 1 (SLC11A1, Accession XM_002585). Accordingly, utilities of VGAM1254 include diagnosis, prevention and treatment of diseases and clinical conditions associated with SLC11A1. Transducin-like Enhancer of Split 4 (E(sp1) Homolog, Drosophila) (TLE4, Accession XM_042357) is another VGAM1254 host target gene. TLE4 BINDING SITE is HOST TARGET binding site found in the 5' untranslated region of mRNA encoded by TLE4, corresponding to a HOST TARGET binding site such as BINDING SITE I, BINDING SITE II or BINDING SITE III. Table 2 illustrates the complementarity of the nucleotide sequences of TLE4 BINDING SITE, designated SEQ ID:33720, to the nucleotide sequence of VGAM1254 RNA, herein designated VGAM RNA, also designated SEQ ID:3965.

Another function of VGAM1254 is therefore inhibition of Transducin-like Enhancer of Split 4 (E(sp1) Homolog, Drosophila) (TLE4, Accession XM_042357). Accordingly, utilities of VGAM1254 include diagnosis, prevention and treatment of diseases and clinical conditions associated with TLE4. LOC126353 (Accession XM_059034) is another VGAM1254 host target gene. LOC126353 BINDING SITE is HOST TARGET binding site found in the 3' untranslated region of mRNA encoded by LOC126353, corresponding to a HOST TARGET binding site such as BINDING SITE I, BINDING SITE II or BINDING SITE III. Table 2 illustrates the complementarity of the nucleotide sequences of LOC126353 BINDING SITE, designated SEQ ID:36832, to the nucleotide sequence of VGAM1254 RNA, herein designated VGAM RNA, also designated SEQ ID:3965.

Another function of VGAM1254 is therefore inhibition of LOC126353 (Accession XM_059034). Accordingly, utilities of VGAM1254 include diagnosis, prevention and treatment of diseases and clinical conditions associated with LOC126353. LOC145725 (Accession XM_085211) is another VGAM1254 host target gene. LOC145725 BINDING SITE is HOST TARGET binding site found in the 3' untranslated region of mRNA encoded by LOC145725, corresponding to a HOST TARGET binding site such as BINDING SITE I, BINDING SITE II or BINDING SITE III. Table 2 illustrates the complementarity of the nucleotide sequences of LOC145725 BINDING SITE, designated SEQ ID:37951, to the nucleotide sequence of VGAM1254 RNA, herein designated VGAM RNA, also designated SEQ ID:3965.

Another function of VGAM1254 is therefore inhibition of LOC145725 (Accession XM_085211). Accordingly, utilities of VGAM1254 include diagnosis, prevention and treatment of diseases and clinical conditions associated with LOC145725. LOC145732 (Accession XM_085218) is another VGAM1254 host target gene. LOC145732 BINDING SITE is HOST TARGET binding site found in the 3' untranslated region of mRNA encoded by LOC145732, corresponding to a HOST TARGET binding site such as BINDING SITE I, BINDING SITE II or BINDING SITE III. Table 2 illustrates the complementarity of the nucleotide sequences of LOC145732 BINDING SITE, designated SEQ ID:37960, to the nucleotide sequence of VGAM1254 RNA, herein designated VGAM RNA, also designated SEQ ID:3965.

Another function of VGAM1254 is therefore inhibition of LOC145732 (Accession XM_085218). Accordingly, utilities of VGAM1254 include diagnosis, prevention and treatment of diseases and clinical conditions associated with LOC145732. LOC146443 (Accession XM_085461) is another VGAM1254 host target gene. LOC146443 BINDING SITE is HOST TARGET binding site found in the 5' untranslated region of mRNA encoded by LOC146443, corresponding to a HOST TARGET binding site such as BINDING SITE I, BINDING SITE II or BINDING SITE III. Table 2 illustrates the complementarity of the nucleotide sequences of LOC146443 BINDING SITE, designated SEQ ID:38149, to the nucleotide sequence of VGAM1254 RNA, herein designated VGAM RNA, also designated SEQ ID:3965.

Another function of VGAM1254 is therefore inhibition of LOC146443 (Accession XM_085461). Accordingly, utilities of VGAM1254 include diagnosis, prevention and treatment of diseases and clinical conditions associated with LOC146443. LOC166983 (Accession XM_106422) is another VGAM1254 host target gene. LOC166983 BINDING SITE is HOST TARGET binding site found in the 5' untranslated region of mRNA encoded by LOC166983, corresponding to a HOST TARGET binding site such as BINDING SITE I, BINDING SITE II or BINDING SITE III. Table 2 illustrates the complementarity of the nucleotide sequences of LOC166983 BINDING SITE, designated SEQ ID:42199, to the nucleotide sequence of VGAM1254 RNA, herein designated VGAM RNA, also designated SEQ ID:3965.

Another function of VGAM1254 is therefore inhibition of LOC166983 (Accession XM_106422). Accordingly, utilities of VGAM1254 include diagnosis, prevention and treatment of diseases and clinical conditions associated with LOC166983. LOC196957 (Accession XM_113789) is another VGAM1254 host target gene. LOC196957 BINDING SITE is HOST TARGET binding site found in the 3' untranslated region of mRNA encoded by LOC196957, corresponding to a HOST TARGET binding site such as BINDING SITE I, BINDING SITE II or BINDING SITE III. Table 2 illustrates the complementarity of the nucleotide sequences of LOC196957 BINDING SITE, designated SEQ ID:42432, to the nucleotide sequence of VGAM1254 RNA, herein designated VGAM RNA, also designated SEQ ID:3965.

Another function of VGAM1254 is therefore inhibition of LOC196957 (Accession XM_113789). Accordingly, utilities of VGAM1254 include diagnosis, prevention and treatment of diseases and clinical conditions associated with LOC196957. LOC196961 (Accession XM_113790) is another VGAM1254 host target gene. LOC196961 BINDING SITE is HOST TARGET binding site found in the 3' untranslated region of mRNA encoded by LOC196961, corresponding to a HOST TARGET binding site such as BINDING SITE I, BINDING SITE II or BINDING SITE III. Table 2 illustrates the complementarity of the nucleotide sequences of LOC196961 BINDING SITE, designated SEQ ID:42441, to the nucleotide sequence of VGAM1254 RNA, herein designated VGAM RNA, also designated SEQ ID:3965.

Another function of VGAM1254 is therefore inhibition of LOC196961 (Accession XM_113790). Accordingly, utilities of VGAM1254 include diagnosis, prevention and treatment of diseases and clinical conditions associated with LOC196961. LOC197138 (Accession XM_113829) is another VGAM1254 host target gene. LOC197138 BINDING SITE is HOST TARGET binding site found in the 3' untranslated region of mRNA encoded by LOC197138, corresponding to a HOST TARGET binding site such as BINDING SITE I, BINDING SITE II or BINDING SITE III. Table 2 illustrates the complementarity of the nucleotide sequences of LOC197138 BINDING SITE, designated SEQ ID:42459, to the nucleotide sequence of VGAM1254 RNA, herein designated VGAM RNA, also designated SEQ ID:3965.

Another function of VGAM1254 is therefore inhibition of LOC197138 (Accession XM_113829). Accordingly, utilities of VGAM1254 include diagnosis, prevention and treatment of diseases and clinical conditions associated with LOC197138. FIG. 1 further provides a conceptual description of a novel bioinformatically detected viral gene of the present invention, referred to here as Viral Genomic Address Messenger 1255 (VGAM1255) viral gene, which modulates expression of respective host target genes thereof, the function and utility of which host target genes is known in the art.

VGAM1255 is a novel bioinformatically detected regulatory, non protein coding, viral micro RNA (miRNA) gene. The method by which VGAM1255 was detected is described hereinabove with reference to FIGS. 1-8.

VGAM1255 gene, herein designated VGAM GENE, is a viral gene contained in the genome of Human Adenovirus D. VGAM1255 host target gene, herein designated VGAM HOST TARGET GENE, is a human gene contained in the human genome.

VGAM1255 gene encodes a VGAM1255 precursor RNA, herein designated VGAM PRECURSOR RNA. Similar to other miRNA genes, and unlike most ordinary genes, VGAM1255 precursor RNA does not encode a protein. A nucleotide sequence identical or highly similar to the nucleotide sequence of VGAM1255 precursor RNA is designated SEQ ID:1241, and is provided hereinbelow with reference to the sequence listing part. Nucleotide sequence SEQ ID:1241 is located at position 5672 relative to the genome of Human Adenovirus D.

VGAM1255 precursor RNA folds onto itself, forming VGAM1255 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1255 folded precursor RNA into VGAM1255 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1255 RNA is designated SEQ ID:3966, and is provided hereinbelow with reference to the sequence listing part.

VGAM1255 host target gene, herein designated VGAM HOST TARGET GENE, encodes a corresponding messenger RNA, VGAM1255 host target RNA, herein designated VGAM HOST TARGET RNA. VGAM1255 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1255 RNA, herein designated VGAM RNA, binds complementarily to one or more host target binding sites located in untranslated regions of VGAM1255 host target RNA, herein designated VGAM HOST TARGET RNA. This complementary binding is due to the fact that the nucleotide sequence of VGAM1255 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1255 RNA, herein designated VGAM RNA, may have a different number of host target binding sites in untranslated regions of a VGAM1255 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1255 RNA, herein designated VGAM RNA, to host target binding sites on VGAM1255 host target RNA, herein designated VGAM HOST TARGET RNA, such as BINDING SITE I, BINDING SITE II and BINDING SITE III, inhibits translation of VGAM1255 host target RNA into VGAM1255 host target protein, herein designated VGAM HOST TARGET PROTEIN. VGAM host target protein is therefore outlined by a broken line.

It is appreciated that VGAM1255 host target gene, herein designated VGAM HOST TARGET GENE, in fact represents a plurality of VGAM1255 host target genes. The mRNA of each one of this plurality of VGAM1255 host target genes comprises one or more host target binding sites, each having a nucleotide sequence which is at least partly complementary to VGAM1255 RNA, herein designated VGAM RNA, and which when bound by VGAM1255 RNA causes inhibition of translation of respective one or more VGAM1255 host target proteins.

It is further appreciated by one skilled in the art that the mode of translational inhibition illustrated by FIG. 1 with specific reference to translational inhibition exerted by VGAM1255 gene, herein designated VGAM GENE, on one or more VGAM1255 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1255 is inhibition of expression of host target genes, as part of a novel viral mechanism of attacking a host. Accordingly, utilities of VGAM1255 include diagnosis, prevention and treatment of viral infection by Human Adenovirus D. Specific functions, and accordingly utilities, of VGAM1255 correlate with, and may be deduced from, the identity of the host target genes which VGAM1255 binds and inhibits, and the function of these host target genes, as elaborated hereinbelow.

Nucleotide sequences of the VGAM1255 precursor RNA, herein designated VGAM PRECURSOR RNA, and of the 'diced' VGAM1255 RNA, herein designated VGAM RNA, and a schematic representation of the secondary folding of VGAM1255 folded precursor RNA, herein designated VGAM FOLDED PRECURSOR RNA, of VGAM1255 are further described hereinbelow with reference to Table 1.

Nucleotide sequences of host target binding sites, such as BINDING SITE-I, BINDING SITE-II and BINDING SITE-III of FIG. 1, found on VGAM1255 host target RNA, and schematic representation of the complementarity of each of these host target binding sites to VGAM1255 RNA, herein designated VGAM RNA, are described hereinbelow with reference to Table 2.

As mentioned hereinabove with reference to FIG. 1, a function of VGAM1255 gene, herein designated VGAM is inhibition of expression of VGAM1255 target genes. It is appreciated that specific functions, and accordingly utilities, of VGAM1255 correlate with, and may be deduced from, the identity of the target genes which VGAM1255 binds and inhibits, and the function of these target genes, as elaborated hereinbelow.

Contactin 2 (axonal) (CNTN2, Accession NM_005076) is a VGAM1255 host target gene. CNTN2 BINDING SITE is HOST TARGET binding site found in the 3' untranslated region of mRNA encoded by CNTN2, corresponding to a HOST TARGET binding site such as BINDING SITE I, BINDING SITE II or BINDING SITE III. Table 2 illustrates the complementarity of the nucleotide sequences of CNTN2 BINDING SITE, designated SEQ ID:11525, to the nucleotide sequence of VGAM1255 RNA, herein designated VGAM RNA, also designated SEQ ID:3966.

A function of VGAM1255 is therefore inhibition of Contactin 2 (axonal) (CNTN2, Accession NM_005076), a gene which may play a role in axonal growth and cell adhesion. Accordingly, utilities of VGAM1255 include diagnosis, prevention and treatment of diseases and clinical conditions associated with CNTN2. The function of CNTN2 and its association with various diseases and clinical conditions, has been established by previous studies, as described hereinabove with reference to VGAM259. FKRP (Accession NM_024301) is another VGAM1255 host target gene. FKRP BINDING SITE is HOST TARGET binding site found in the 3' untranslated region of mRNA encoded by FKRP, corresponding to a HOST TARGET binding site such as BINDING SITE I, BINDING SITE II or BINDING SITE III. Table 2 illustrates the complementarity of the nucleotide sequences of FKRP BINDING SITE, designated SEQ ID:23593, to the nucleotide sequence of VGAM1255 RNA, herein designated VGAM RNA, also designated SEQ ID:3966.

Another function of VGAM1255 is therefore inhibition of FKRP (Accession NM_024301). Accordingly, utilities of VGAM1255 include diagnosis, prevention and treatment of diseases and clinical conditions associated with FKRP. Hairless Homolog (mouse) (HR, Accession NM_005144) is another VGAM1255 host target gene. HR BINDING SITE is HOST TARGET binding site found in the 5' untranslated region of mRNA encoded by HR, corresponding to a HOST TARGET binding site such as BINDING SITE I, BINDING SITE II or BINDING SITE III. Table 2 illustrates the complementarity of the nucleotide sequences of HR BINDING SITE, designated SEQ ID:11618, to the nucleotide sequence of VGAM1255 RNA, herein designated VGAM RNA, also designated SEQ ID:3966.

Another function of VGAM1255 is therefore inhibition of Hairless Homolog (mouse) (HR, Accession NM_005144). Accordingly, utilities of VGAM1255 include diagnosis, prevention and treatment of diseases and clinical conditions associated with HR. Isoprenylcysteine Carboxyl Methyltransferase (ICMT, Accession NM_012405) is another VGAM1255 host target gene. ICMT BINDING SITE is HOST TARGET binding site found in the 3' untranslated region of mRNA encoded by ICMT, corresponding to a HOST TARGET binding site such as BINDING SITE I, BINDING SITE II or BINDING SITE III. Table 2 illustrates the complementarity of the nucleotide sequences of ICMT BINDING SITE, designated SEQ ID:14781, to the nucleotide sequence of VGAM1255 RNA, herein designated VGAM RNA, also designated SEQ ID:3966.

Another function of VGAM1255 is therefore inhibition of Isoprenylcysteine Carboxyl Methyltransferase (ICMT, Accession NM_012405). Accordingly, utilities of VGAM1255 include diagnosis, prevention and treatment of diseases and clinical conditions associated with ICMT. Meningioma (disrupted in balanced translocation) 1 (MN1, Accession NM_002430) is another VGAM1255 host target gene. MN1 BINDING SITE is HOST TARGET binding site found in the 3' untranslated region of mRNA encoded by MN1, corresponding to a HOST TARGET binding site such as BINDING SITE I, BINDING SITE II or BINDING SITE III. Table 2 illustrates the complementarity of the nucleotide sequences of MN1 BINDING SITE, designated SEQ ID:8276, to the nucleotide sequence of VGAM1255 RNA, herein designated VGAM RNA, also designated SEQ ID:3966.

Another function of VGAM1255 is therefore inhibition of Meningioma (disrupted in balanced translocation) 1 (MN1, Accession NM_002430). Accordingly, utilities of VGAM1255 include diagnosis, prevention and treatment of diseases and clinical conditions associated with MN1. Ret Proto-oncogene (multiple endocrine neoplasia and medullary thyroid carcinoma 1, Hirschsprung disease) (RET, Accession NM_020975) is another VGAM1255 host target gene. RET BINDING SITE1 and RET BINDING SITE2 are HOST TARGET binding sites found in untranslated regions of mRNA encoded by RET, corresponding to HOST TARGET binding sites such as BINDING SITE I, BINDING SITE II or BINDING SITE III. Table 2 illustrates the complementarity of the nucleotide sequences of RET BINDING SITE1 and RET BINDING SITE2, designated SEQ ID:21960 and SEQ ID:21786 respectively, to the nucleotide sequence of VGAM1255 RNA, herein designated VGAM RNA, also designated SEQ ID:3966.

Another function of VGAM1255 is therefore inhibition of Ret Proto-oncogene (multiple endocrine neoplasia and medullary thyroid carcinoma 1, Hirschsprung disease) (RET, Accession NM_020975), a gene which transduces signals for cell growth and differentiation. Accordingly, utilities of VGAM1255 include diagnosis, prevention and treatment of diseases and clinical conditions associated with RET. The function of RET and its association with various diseases and clinical conditions, has been established by previous studies, as described hereinabove with reference to VGAM381. Ubiquitin-conjugating Enzyme E2H (UBC8 homolog, yeast) (UBE2H, Accession NM_003344) is another VGAM1255 host target gene. UBE2H BINDING SITE is HOST TARGET binding site found in the 3' untranslated region of mRNA encoded by UBE2H, corresponding to a HOST TARGET binding site such as BINDING SITE I, BINDING SITE II or BINDING SITE III. Table 2 illustrates the complementarity of the nucleotide sequences of UBE2H BINDING SITE, designated SEQ ID:9352, to the nucleotide sequence of VGAM1255 RNA, herein designated VGAM RNA, also designated SEQ ID:3966.

Another function of VGAM1255 is therefore inhibition of Ubiquitin-conjugating Enzyme E2H (UBC8 homolog, yeast) (UBE2H, Accession NM_003344), a gene which catalyzes the covalent attachment of ubiquitin to other proteins. Accordingly, utilities of VGAM1255 include diagnosis, prevention and treatment of diseases and clinical conditions associated with UBE2H. The function of UBE2H and its association with various diseases and clinical conditions, has been established by previous studies, as described hereinabove with reference to VGAM811. Centaurin, Gamma 1 (CENTG1, Accession NM_014770) is another VGAM1255 host target gene. CENTG1 BINDING SITE is HOST TARGET binding site found in the 3' untranslated region of mRNA encoded by CENTG1, corresponding to a HOST TARGET binding site such as BINDING SITE I, BINDING SITE II or BINDING SITE III. Table 2 illustrates the complementarity of the nucleotide sequences of CENTG1 BINDING SITE, designated SEQ ID:16563, to the nucleotide sequence of VGAM1255 RNA, herein designated VGAM RNA, also designated SEQ ID:3966.

Another function of VGAM1255 is therefore inhibition of Centaurin, Gamma 1 (CENTG1, Accession NM_014770). Accordingly, utilities of VGAM1255 include diagnosis, prevention and treatment of diseases and clinical conditions associated with CENTG1. FLJ10901 (Accession NM_018265) is another VGAM1255 host target gene. FLJ10901 BINDING SITE is HOST TARGET binding site found in the 3' untranslated region of mRNA encoded by FLJ10901, corresponding to a HOST TARGET binding site such as BINDING SITE I, BINDING SITE II or BINDING SITE III. Table 2 illustrates the complementarity of the nucleotide sequences of FLJ10901 BINDING SITE, designated SEQ ID:20232, to the nucleotide sequence of VGAM1255 RNA, herein designated VGAM RNA, also designated SEQ ID:3966.

Another function of VGAM1255 is therefore inhibition of FLJ10901 (Accession NM_018265). Accordingly, utilities of VGAM1255 include diagnosis, prevention and treatment of diseases and clinical conditions associated with FLJ10901. Fucosyltransferase 10 (alpha (1,3) Fucosyltransferase) (FUT10, Accession NM_032664) is another VGAM1255 host target gene. FUT10 BINDING SITE is HOST TARGET binding site found in the 3' untranslated region of mRNA encoded by FUT10, corresponding to a HOST TARGET binding site such as BINDING SITE I, BINDING SITE II or BINDING SITE III. Table 2 illustrates the complementarity of the nucleotide sequences of FUT10 BINDING SITE, designated SEQ ID:26391, to the nucleotide sequence of VGAM1255 RNA, herein designated VGAM RNA, also designated SEQ ID:3966.

Another function of VGAM1255 is therefore inhibition of Fucosyltransferase 10 (alpha (1,3) Fucosyltransferase) (FUT10, Accession NM_032664). Accordingly, utilities of VGAM1255 include diagnosis, prevention and treatment of diseases and clinical conditions associated with FUT10. Gamma-aminobutyric Acid (GABA) B Receptor, 1 (GABBR1, Accession NM_021903) is another VGAM1255 host target gene. GABBR1 BINDING SITE is HOST TARGET binding site found in the 5' untranslated region of mRNA encoded by GABBR1, corresponding to a HOST TARGET binding site such as BINDING SITE I, BINDING SITE II or BINDING SITE III. Table 2 illustrates the complementarity of the nucleotide sequences of GABBR1 BINDING SITE, designated SEQ ID:22424, to the nucleotide sequence of VGAM1255 RNA, herein designated VGAM RNA, also designated SEQ ID:3966.

Another function of VGAM1255 is therefore inhibition of Gamma-aminobutyric Acid (GABA) B Receptor, 1 (GABBR1, Accession NM_021903). Accordingly, utilities of VGAM1255 include diagnosis, prevention and treatment of diseases and clinical conditions associated with GABBR1. KIAA1399 (Accession XM_046685) is another VGAM1255 host target gene. KIAA1399 BINDING SITE is HOST TARGET binding site found in the 3' untranslated region of mRNA encoded by KIAA1399, corresponding to a HOST TARGET binding site such as BINDING SITE I, BINDING SITE II or BINDING SITE III. Table 2 illustrates the complementarity of the nucleotide sequences of KIAA1399 BINDING SITE, designated SEQ ID:34798, to the nucleotide sequence of VGAM1255 RNA, herein designated VGAM RNA, also designated SEQ ID:3966.

Another function of VGAM1255 is therefore inhibition of KIAA1399 (Accession XM_046685). Accordingly, utilities of VGAM1255 include diagnosis, prevention and treatment of diseases and clinical conditions associated with KIAA1399. KIAA1924 (Accession XM_057091) is another VGAM1255 host target gene. KIAA1924 BINDING SITE is HOST TARGET binding site found in the 3' untranslated region of mRNA encoded by KIAA1924, corresponding to a HOST TARGET binding site such as BINDING SITE I, BINDING SITE II or BINDING SITE III. Table 2 illustrates the complementarity of the nucleotide sequences of KIAA1924 BINDING SITE, designated SEQ ID:36481, to the nucleotide sequence of VGAM1255 RNA, herein designated VGAM RNA, also designated SEQ ID:3966.

Another function of VGAM1255 is therefore inhibition of KIAA1924 (Accession XM_057091). Accordingly, utilities of VGAM1255 include diagnosis, prevention and treatment of diseases and clinical conditions associated with KIAA1924. PRP8 Pre-mRNA Processing Factor 8 Homolog (yeast) (PRPF8, Accession XM_028335) is another VGAM1255 host target gene. PRPF8 BINDING SITE is HOST TARGET binding site found in the 3' untranslated region of mRNA encoded by PRPF8, corresponding to a HOST TARGET binding site such as BINDING SITE I, BINDING SITE II or BINDING SITE III. Table 2 illustrates the complementarity of the nucleotide sequences of PRPF8 BINDING SITE, designated SEQ ID:30689, to the nucleotide sequence of VGAM1255 RNA, herein designated VGAM RNA, also designated SEQ ID:3966.

Another function of VGAM1255 is therefore inhibition of PRP8 Pre-mRNA Processing Factor 8 Homolog (yeast) (PRPF8, Accession XM_028335). Accordingly, utilities of VGAM1255 include diagnosis, prevention and treatment of diseases and clinical conditions associated with PRPF8. LOC221935 (Accession XM_166537) is another VGAM1255 host target gene. LOC221935 BINDING SITE is HOST TARGET binding site found in the 3' untranslated region of mRNA encoded by LOC221935, corresponding to a HOST TARGET binding site such as BINDING SITE I, BINDING SITE II or BINDING SITE III. Table 2 illustrates the complementarity of the nucleotide sequences of LOC221935 BINDING SITE, designated SEQ ID:44501, to the nucleotide sequence of VGAM1255 RNA, herein designated VGAM RNA, also designated SEQ ID:3966.

Another function of VGAM1255 is therefore inhibition of LOC221935 (Accession XM_166537). Accordingly, utilities of VGAM1255 include diagnosis, prevention and treatment of diseases and clinical conditions associated with LOC221935. LOC245771 (Accession XM_167366) is another VGAM1255 host target gene. LOC245771 BINDING SITE is HOST TARGET binding site found in the 5' untranslated region of mRNA encoded by LOC245771, corresponding to a HOST TARGET binding site such as BINDING SITE I, BINDING SITE II or BINDING SITE III. Table 2 illustrates the complementarity of the nucleotide sequences of LOC245771 BINDING SITE, designated SEQ ID:44637, to the nucleotide sequence of VGAM1255 RNA, herein designated VGAM RNA, also designated SEQ ID:3966.

Another function of VGAM1255 is therefore inhibition of LOC245771 (Accession XM_167366). Accordingly, utilities of VGAM1255 include diagnosis, prevention and treatment of diseases and clinical conditions associated with LOC245771. FIG. 1 further provides a conceptual description of a novel bioinformatically detected viral gene of the present invention, referred to here as Viral Genomic Address Messenger 1256 (VGAM1256) viral gene, which modulates expression of respective host target genes thereof, the function and utility of which host target genes is known in the art.

VGAM1256 is a novel bioinformatically detected regulatory, non protein coding, viral micro RNA (miRNA) gene. The method by which VGAM1256 was detected is described hereinabove with reference to FIGS. 1-8.

VGAM1256 gene, herein designated VGAM GENE, is a viral gene contained in the genome of Human Adenovirus D. VGAM1256 host target gene, herein designated VGAM HOST TARGET GENE, is a human gene contained in the human genome.

VGAM1256 gene encodes a VGAM1256 precursor RNA, herein designated VGAM PRECURSOR RNA. Similar to other miRNA genes, and unlike most ordinary genes, VGAM1256 precursor RNA does not encode a protein. A nucleotide sequence identical or highly similar to the nucleotide sequence of VGAM1256 precursor RNA is designated SEQ ID:1242, and is provided hereinbelow with reference to the sequence listing part. Nucleotide sequence SEQ ID:1242 is located at position 4027 relative to the genome of Human Adenovirus D.

VGAM1256 precursor RNA folds onto itself, forming VGAM1256 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1256 folded precursor RNA into VGAM1256 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1256 RNA is designated SEQ ID:3967, and is provided hereinbelow with reference to the sequence listing part.

VGAM1256 host target gene, herein designated VGAM HOST TARGET GENE, encodes a corresponding messenger RNA, VGAM1256 host target RNA, herein designated VGAM HOST TARGET RNA. VGAM1256 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1256 RNA, herein designated VGAM RNA, binds complementarily to one or more host target binding sites located in untranslated regions of VGAM1256 host target RNA, herein designated VGAM HOST TARGET RNA. This complementary binding is due to the fact that the nucleotide sequence of VGAM1256 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1256 RNA, herein designated VGAM RNA, may have a different number of host target binding sites in untranslated regions of a VGAM1256 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1256 RNA, herein designated VGAM RNA, to host target binding sites on VGAM1256 host target RNA, herein designated VGAM HOST TARGET RNA, such as BINDING SITE I, BINDING SITE II and BINDING SITE III, inhibits translation of VGAM1256 host target RNA into VGAM1256 host target protein, herein designated VGAM HOST TARGET PROTEIN. VGAM host target protein is therefore outlined by a broken line.

It is appreciated that VGAM1256 host target gene, herein designated VGAM HOST TARGET GENE, in fact represents a plurality of VGAM1256 host target genes. The mRNA of each one of this plurality of VGAM1256 host target genes comprises one or more host target binding sites, each having a nucleotide sequence which is at least partly complementary to VGAM1256 RNA, herein designated VGAM RNA, and which when bound by VGAM1256 RNA causes inhibition of translation of respective one or more VGAM1256 host target proteins.

It is further appreciated by one skilled in the art that the mode of translational inhibition illustrated by FIG. 1 with specific reference to translational inhibition exerted by VGAM1256 gene, herein designated VGAM GENE, on one or more VGAM1256 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1256 is inhibition of expression of host target genes, as part of a novel viral mechanism of attacking a host. Accordingly, utilities of VGAM1256 include diagnosis, prevention and treatment of viral infection by Human Adenovirus D. Specific functions, and accordingly utilities, of VGAM1256 correlate with, and may be deduced from, the identity of the host target genes which VGAM1256 binds and inhibits, and the function of these host target genes, as elaborated hereinbelow.

Nucleotide sequences of the VGAM1256 precursor RNA, herein designated VGAM PRECURSOR RNA, and of the 'diced' VGAM1256 RNA, herein designated VGAM RNA, and a schematic representation of the secondary folding of VGAM1256 folded precursor RNA, herein designated VGAM FOLDED PRECURSOR RNA, of VGAM1256 are further described hereinbelow with reference to Table 1.

Nucleotide sequences of host target binding sites, such as BINDING SITE-I, BINDING SITE-II and BINDING SITE-III of FIG. 1, found on VGAM1256 host target RNA, and schematic representation of the complementarity of each of these host target binding sites to VGAM1256 RNA, herein designated VGAM RNA, are described hereinbelow with reference to Table 2.

As mentioned hereinabove with reference to FIG. 1, a function of VGAM1256 gene, herein designated VGAM is inhibition of expression of VGAM1256 target genes. It is appreciated that specific functions, and accordingly utilities, of VGAM1256 correlate with, and may be deduced from, the identity of the target genes which VGAM1256 binds and inhibits, and the function of these target genes, as elaborated hereinbelow.

Fatty-acid-Coenzyme A Ligase, Long-chain 4 (FACL4, Accession NM_022977) is a VGAM1256 host target gene. FACL4 BINDING SITE1 and FACL4 BINDING SITE2 are HOST TARGET binding sites found in untranslated regions of mRNA encoded by FACL4, corresponding to HOST TARGET binding sites such as BINDING SITE I, BINDING SITE II or BINDING SITE III. Table 2 illustrates the complementarity of the nucleotide sequences of FACL4 BINDING SITE1 and FACL4 BINDING SITE2, designated SEQ ID:23251 and SEQ ID:10761 respectively, to the nucleotide sequence of VGAM1256 RNA, herein designated VGAM RNA, also designated SEQ ID:3967.

A function of VGAM1256 is therefore inhibition of Fatty-acid-Coenzyme A Ligase, Long-chain 4 (FACL4, Accession NM_022977). Accordingly, utilities of VGAM1256 include diagnosis, prevention and treatment of diseases and clinical conditions associated with FACL4. Integrin, Alpha 4 (antigen CD49D, alpha 4 subunit of VLA-4 receptor) (ITGA4, Accession NM_000885) is another VGAM1256 host target gene. ITGA4 BINDING SITE is HOST TARGET binding site found in the 5' untranslated region of mRNA encoded by ITGA4, corresponding to a HOST TARGET binding site such as BINDING SITE I, BINDING SITE II or BINDING SITE III. Table 2 illustrates the complementarity of the nucleotide sequences of ITGA4 BINDING SITE, designated SEQ ID:6583, to the nucleotide sequence of VGAM1256 RNA, herein designated VGAM RNA, also designated SEQ ID:3967.

Another function of VGAM1256 is therefore inhibition of Integrin, Alpha 4 (antigen CD49D, alpha 4 subunit of VLA-4 receptor) (ITGA4, Accession NM_000885), a gene which recognizes one or more domains within the alternatively spliced cs-1 and cs-5 regions of fibronectin. Accordingly, utilities of VGAM1256 include diagnosis, prevention and treatment of diseases and clinical conditions associated with ITGA4. The function of ITGA4 and its association with various diseases and clinical conditions, has been established by previous studies, as described hereinabove with reference to VGAM1096. Microtubule-associated Protein, RP/EB Family, Member 3 (MAPRE3, Accession NM_012326) is another VGAM1256 host target gene. MAPRE3 BINDING SITE is HOST TARGET binding site found in the 5' untranslated region of mRNA encoded by MAPRE3, corresponding to a HOST TARGET binding site such as BINDING SITE I, BINDING SITE II or BINDING SITE III. Table 2 illustrates the complementarity of the nucleotide sequences of MAPRE3 BINDING SITE, designated SEQ ID:14714, to the nucleotide sequence of VGAM1256 RNA, herein designated VGAM RNA, also designated SEQ ID:3967.

Another function of VGAM1256 is therefore inhibition of Microtubule-associated Protein, RP/EB Family, Member 3 (MAPRE3, Accession NM_012326), a gene which interact with cytoplasmic microtubules, and with the adenomatous polyposis coli. Accordingly, utilities of VGAM1256 include diagnosis, prevention and treatment of diseases and clinical conditions associated with MAPRE3. The function of MAPRE3 and its association with various diseases and clinical conditions, has been established by previous studies, as described hereinabove with reference to VGAM340. MHC Class II Transactivator (MHC2TA, Accession NM_000246) is another VGAM1256 host target gene. MHC2TA BINDING SITE is HOST TARGET binding site found in the 3' untranslated region of mRNA encoded by MHC2TA, corresponding to a HOST TARGET binding site such as BINDING SITE I, BINDING SITE II or BINDING SITE III. Table 2 illustrates the complementarity of the nucleotide sequences of MHC2TA BINDING SITE, designated SEQ ID:5779, to the nucleotide sequence of VGAM1256 RNA, herein designated VGAM RNA, also designated SEQ ID:3967.

Another function of VGAM1256 is therefore inhibition of MHC Class II Transactivator (MHC2TA, Accession NM_000246). Accordingly, utilities of VGAM1256 include diagnosis, prevention and treatment of diseases and clinical conditions associated with MHC2TA. Matrix Metalloproteinase 15 (membrane-inserted) (MMP15, Accession NM_002428) is another VGAM1256 host target gene. MMP15 BINDING SITE is HOST TARGET binding site found in the 3' untranslated region of mRNA encoded by MMP15, corresponding to a HOST TARGET binding site such as BINDING SITE I, BINDING SITE II or BINDING SITE III. Table 2 illustrates the complementarity of the nucleotide sequences of MMP15 BINDING SITE, designated SEQ ID:8263, to the nucleotide sequence of VGAM1256 RNA, herein designated VGAM RNA, also designated SEQ ID:3967.

Another function of VGAM1256 is therefore inhibition of Matrix Metalloproteinase 15 (membrane-inserted) (MMP15, Accession NM_002428). Accordingly, utilities of VGAM1256 include diagnosis, prevention and treatment of diseases and clinical conditions associated with MMP15. AD-020 (Accession NM_020141) is another VGAM1256 host target gene. AD-020 BINDING SITE1 and AD-020 BINDING SITE2 are HOST TARGET binding sites found in untranslated regions of mRNA encoded by AD-020, corresponding to HOST TARGET binding sites such as BINDING SITE I, BINDING SITE II or BINDING SITE III. Table 2 illustrates the complementarity of the nucleotide sequences of AD-020 BINDING SITE1 and AD-020 BINDING SITE2, designated SEQ ID:21339 and SEQ ID:29869 respectively, to the nucleotide sequence of VGAM1256 RNA, herein designated VGAM RNA, also designated SEQ ID:3967.

Another function of VGAM1256 is therefore inhibition of AD-020 (Accession NM_020141). Accordingly, utilities of VGAM1256 include diagnosis, prevention and treatment of diseases and clinical conditions associated with AD-020. KIAA1808 (Accession XM_098260) is another VGAM1256 host target gene. KIAA1808 BINDING SITE is HOST TARGET binding site found in the 3' untranslated region of mRNA encoded by KIAA1808, corresponding to a HOST TARGET binding site such as BINDING SITE I, BINDING SITE II or BINDING SITE III. Table 2 illustrates the complementarity of the nucleotide sequences of KIAA1808 BINDING SITE, designated SEQ ID:41547, to the nucleotide sequence of VGAM1256 RNA, herein designated VGAM RNA, also designated SEQ ID:3967.

Another function of VGAM1256 is therefore inhibition of KIAA1808 (Accession XM_098260). Accordingly, utilities of VGAM1256 include diagnosis, prevention and treatment of diseases and clinical conditions associated with KIAA1808. KIAA1867 (Accession XM_170675) is another VGAM1256 host target gene. KIAA1867 BINDING SITE is HOST TARGET binding site found in the 3' untranslated region of mRNA encoded by KIAA1867, corresponding to a HOST TARGET binding site such as BINDING SITE I, BINDING SITE II or BINDING SITE III. Table 2 illustrates the complementarity of the nucleotide sequences of KIAA1867 BINDING SITE, designated SEQ ID:45454, to the nucleotide sequence of VGAM1256 RNA, herein designated VGAM RNA, also designated SEQ ID:3967.

Another function of VGAM1256 is therefore inhibition of KIAA1867 (Accession XM_170675). Accordingly, utilities of VGAM1256 include diagnosis, prevention and treatment of diseases and clinical conditions associated with KIAA1867. KIAA1904 (Accession XM_056282) is another VGAM1256 host target gene. KIAA1904 BINDING SITE is HOST TARGET binding site found in the 3' untranslated region of mRNA encoded by KIAA1904, corresponding to a HOST TARGET binding site such as BINDING SITE I, BINDING SITE II or BINDING SITE III. Table 2 illustrates the complementarity of the nucleotide sequences of KIAA1904 BINDING SITE, designated SEQ ID:36382, to the nucleotide sequence of VGAM1256 RNA, herein designated VGAM RNA, also designated SEQ ID:3967.

Another function of VGAM1256 is therefore inhibition of KIAA1904 (Accession XM_056282). Accordingly, utilities of VGAM1256 include diagnosis, prevention and treatment of diseases and clinical conditions associated with KIAA1904. MGC4796 (Accession XM_029031) is another VGAM1256 host target gene. MGC4796 BINDING SITE is HOST TARGET binding site found in the 3' untranslated region of mRNA encoded by MGC4796, corresponding to a HOST TARGET binding site such as BINDING SITE I, BINDING SITE II or BINDING SITE III. Table 2 illustrates the complementarity of the nucleotide sequences of MGC4796 BINDING SITE, designated SEQ ID:30828, to the nucleotide sequence of VGAM1256 RNA, herein designated VGAM RNA, also designated SEQ ID:3967.

Another function of VGAM1256 is therefore inhibition of MGC4796 (Accession XM_029031). Accordingly, utilities of VGAM1256 include diagnosis, prevention and treatment of diseases and clinical conditions associated with MGC4796. T-cell Lymphoma Invasion and Metastasis 2 (TIAM2, Accession NM_012454) is another VGAM1256 host target gene. TIAM2 BINDING SITE is HOST TARGET binding site found in the 3' untranslated region of mRNA encoded by TIAM2, corresponding to a HOST TARGET binding site such as BINDING SITE I, BINDING SITE II or BINDING SITE III. Table 2 illustrates the complementarity of the nucleotide sequences of TIAM2 BINDING SITE, designated SEQ ID:14823, to the nucleotide sequence of VGAM1256 RNA, herein designated VGAM RNA, also designated SEQ ID:3967.

Another function of VGAM1256 is therefore inhibition of T-cell Lymphoma Invasion and Metastasis 2 (TIAM2, Accession NM_012454). Accordingly, utilities of VGAM1256 include diagnosis, prevention and treatment of diseases and clinical conditions associated with TIAM2. TSPEAR (Accession NM_144991) is another VGAM1256 host target gene. TSPEAR BINDING SITE is HOST TARGET binding site found in the 3' untranslated region of mRNA encoded by TSPEAR, corresponding to a HOST TARGET binding site such as BINDING SITE I, BINDING SITE II or BINDING SITE III. Table 2 illustrates the complementarity of the nucleotide sequences of TSPEAR BINDING SITE, designated SEQ ID:29597, to the nucleotide sequence of VGAM1256 RNA, herein designated VGAM RNA, also designated SEQ ID:3967.

Another function of VGAM1256 is therefore inhibition of TSPEAR (Accession NM_144991). Accordingly, utilities of VGAM1256 include diagnosis, prevention and treatment of diseases and clinical conditions associated with TSPEAR. LOC158310 (Accession XM_098919) is another VGAM1256 host target gene. LOC158310 BINDING SITE is HOST TARGET binding site found in the 5' untranslated region of mRNA encoded by LOC158310, corresponding to a HOST TARGET binding site such as BINDING SITE I, BINDING SITE II or BINDING SITE III. Table 2 illustrates the complementarity of the nucleotide sequences of LOC158310 BINDING SITE, designated SEQ ID:41943, to the nucleotide sequence of VGAM1256 RNA, herein designated VGAM RNA, also designated SEQ ID:3967.

Another function of VGAM1256 is therefore inhibition of LOC158310 (Accession XM_098919). Accordingly, utilities of VGAM1256 include diagnosis, prevention and treatment of diseases and clinical conditions associated with LOC158310. LOC199990 (Accession XM_114083) is another VGAM1256 host target gene. LOC199990 BINDING SITE is HOST TARGET binding site found in the 3' untranslated region of mRNA encoded by LOC199990, corresponding to a HOST TARGET binding site such as BINDING SITE I, BINDING SITE II or BINDING SITE III. Table 2 illustrates the complementarity of the nucleotide sequences of LOC199990 BINDING SITE, designated SEQ ID:42683, to the nucleotide sequence of VGAM1256 RNA, herein designated VGAM RNA, also designated SEQ ID:3967.

Another function of VGAM1256 is therefore inhibition of LOC199990 (Accession XM_114083). Accordingly, utilities of VGAM1256 include diagnosis, prevention and treatment of diseases and clinical conditions associated with LOC199990. LOC220143 (Accession XM_168046) is another VGAM1256 host target gene. LOC220143 BINDING SITE is HOST TARGET binding site found in the 5' untranslated region of mRNA encoded by LOC220143, corresponding to a HOST TARGET binding site such as BINDING SITE I, BINDING SITE II or BINDING SITE III. Table 2 illustrates the complementarity of the nucleotide sequences of LOC220143 BINDING SITE, designated SEQ ID:44954, to the nucleotide sequence of VGAM1256 RNA, herein designated VGAM RNA, also designated SEQ ID:3967.

Another function of VGAM1256 is therefore inhibition of LOC220143 (Accession XM_168046). Accordingly, utilities of VGAM1256 include diagnosis, prevention and treatment of diseases and clinical conditions associated with LOC220143. LOC90249 (Accession XM_030300) is another VGAM1256 host target gene. LOC90249 BINDING SITE is HOST TARGET binding site found in the 5' untranslated region of mRNA encoded by LOC90249, corresponding to a HOST TARGET binding site such as BINDING SITE I, BINDING SITE II or BINDING SITE III. Table 2 illustrates the complementarity of the nucleotide sequences of LOC90249 BINDING SITE, designated SEQ ID:31011, to the nucleotide sequence of VGAM1256 RNA, herein designated VGAM RNA, also designated SEQ ID:3967.

Another function of VGAM1256 is therefore inhibition of LOC90249 (Accession XM_030300). Accordingly, utilities of VGAM1256 include diagnosis, prevention and treatment of diseases and clinical conditions associated with LOC90249. FIG. 1 further provides a conceptual description of a novel bioinformatically detected viral gene of the present invention, referred to here as Viral Genomic Address Messenger 1257 (VGAM1257) viral gene, which modulates expression of respective host target genes thereof, the function and utility of which host target genes is known in the art.

VGAM1257 is a novel bioinformatically detected regulatory, non protein coding, viral micro RNA (miRNA) gene. The method by which VGAM1257 was detected is described hereinabove with reference to FIGS. 1-8.

VGAM1257 gene, herein designated VGAM GENE, is a viral gene contained in the genome of Yaba-like Disease Virus. VGAM1257 host target gene, herein designated VGAM HOST TARGET GENE, is a human gene contained in the human genome.

VGAM1257 gene encodes a VGAM1257 precursor RNA, herein designated VGAM PRECURSOR RNA. Similar to other miRNA genes, and unlike most ordinary genes, VGAM1257 precursor RNA does not encode a protein. A nucleotide sequence identical or highly similar to the nucleotide sequence of VGAM1257 precursor RNA is designated SEQ ID:1243, and is provided hereinbelow with reference to the sequence listing part. Nucleotide sequence SEQ ID:1243 is located at position 39908 relative to the genome of Yaba-like Disease Virus.

VGAM1257 precursor RNA folds onto itself, forming VGAM1257 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1257 folded precursor RNA into VGAM1257 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1257 RNA is designated SEQ ID:3968, and is provided hereinbelow with reference to the sequence listing part.

VGAM1257 host target gene, herein designated VGAM HOST TARGET GENE, encodes a corresponding messenger RNA, VGAM1257 host target RNA, herein designated VGAM HOST TARGET RNA. VGAM1257 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1257 RNA, herein designated VGAM RNA, binds complementarily to one or more host target binding sites located in untranslated regions of VGAM1257 host target RNA, herein designated VGAM HOST TARGET RNA. This complementary binding is due to the fact that the nucleotide sequence of VGAM1257 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1257 RNA, herein designated VGAM RNA, may have a different number of host target binding sites in untranslated regions of a VGAM1257 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1257 RNA, herein designated VGAM RNA, to host target binding sites on VGAM1257 host target RNA, herein designated VGAM HOST TARGET RNA, such as BINDING SITE I, BINDING SITE II and BINDING SITE III, inhibits translation of VGAM1257 host target RNA into VGAM1257 host target protein, herein designated VGAM HOST TARGET PROTEIN. VGAM host target protein is therefore outlined by a broken line.

It is appreciated that VGAM1257 host target gene, herein designated VGAM HOST TARGET GENE, in fact represents a plurality of VGAM1257 host target genes. The mRNA of each one of this plurality of VGAM1257 host target genes comprises one or more host target binding sites, each having a nucleotide sequence which is at least partly complementary to VGAM1257 RNA, herein designated VGAM RNA, and which when bound by VGAM1257 RNA causes inhibition of translation of respective one or more VGAM1257 host target proteins.

It is further appreciated by one skilled in the art that the mode of translational inhibition illustrated by FIG. 1 with specific reference to translational inhibition exerted by VGAM1257 gene, herein designated VGAM GENE, on one or more VGAM1257 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1257 is inhibition of expression of host target genes, as part of a novel viral mechanism of attacking a host. Accordingly, utilities of VGAM1257 include diagnosis, prevention and treatment of viral infection by Yaba-like Disease Virus. Specific functions, and accordingly utilities, of VGAM1257 correlate with, and may be deduced from, the identity of the host target genes which VGAM1257 binds and inhibits, and the function of these host target genes, as elaborated hereinbelow.

Nucleotide sequences of the VGAM1257 precursor RNA, herein designated VGAM PRECURSOR RNA, and of the 'diced' VGAM1257 RNA, herein designated VGAM RNA, and a schematic representation of the secondary folding of VGAM1257 folded precursor RNA, herein designated VGAM FOLDED PRECURSOR RNA, of VGAM1257 are further described hereinbelow with reference to Table 1.

Nucleotide sequences of host target binding sites, such as BINDING SITE-I, BINDING SITE-II and BINDING SITE-III of FIG. 1, found on VGAM1257 host target RNA, and schematic representation of the complementarity of each of these host target binding sites to VGAM1257 RNA, herein designated VGAM RNA, are described hereinbelow with reference to Table 2.

As mentioned hereinabove with reference to FIG. 1, a function of VGAM1257 gene, herein designated VGAM is inhibition of expression of VGAM1257 target genes. It is appreciated that specific functions, and accordingly utilities, of VGAM1257 correlate with, and may be deduced from, the identity of the target genes which VGAM1257 binds and inhibits, and the function of these target genes, as elaborated hereinbelow.

ATP-binding Cassette, Sub-family D (ALD), Member 2 (ABCD2, Accession NM_005164) is a VGAM1257 host target gene. ABCD2 BINDING SITE is HOST TARGET binding site found in the 3' untranslated region of mRNA encoded by ABCD2, corresponding to a HOST TARGET binding site such as BINDING SITE I, BINDING SITE II or BINDING SITE III. Table 2 illustrates the complementarity of the nucleotide sequences of ABCD2 BINDING SITE, designated SEQ ID:11656, to the nucleotide sequence of VGAM1257 RNA, herein designated VGAM RNA, also designated SEQ ID:3968.

A function of VGAM1257 is therefore inhibition of ATP-binding Cassette, Sub-family D (ALD), Member 2 (ABCD2, Accession NM_005164), a gene which probable transporter. Accordingly, utilities of VGAM1257 include diagnosis, prevention and treatment of diseases and clinical conditions associated with ABCD2. The function of ABCD2 and its association with various diseases and clinical conditions, has been established by previous studies, as described hereinabove with reference to VGAM229. ATPase, Na+/K+ Transporting, Alpha 2 (+) Polypeptide (ATP1A2, Accession NM_000702) is another VGAM1257 host target gene. ATP1A2 BINDING SITE is HOST TARGET binding site found in the 3' untranslated region of mRNA encoded by ATP1A2, corresponding to a HOST TARGET binding site such as BINDING SITE I, BINDING SITE II or BINDING SITE III. Table 2 illustrates the complementarity of the nucleotide sequences of ATP1A2 BINDING SITE, designated SEQ ID:6369, to the nucleotide sequence of VGAM1257 RNA, herein designated VGAM RNA, also designated SEQ ID:3968.

Another function of VGAM1257 is therefore inhibition of ATPase, Na+/K+ Transporting, Alpha 2 (+) Polypeptide (ATP1A2, Accession NM_000702). Accordingly, utilities of VGAM1257 include diagnosis, prevention and treatment of diseases and clinical conditions associated with ATP1A2. Endothelin Receptor Type A (EDNRA, Accession XM_034331) is another VGAM1257 host target gene. EDNRA BINDING SITE is HOST TARGET binding site found in the 3' untranslated region of mRNA encoded by EDNRA, corresponding to a HOST TARGET binding site such as BINDING SITE I, BINDING SITE II or BINDING SITE III. Table 2 illustrates the complementarity of the nucleotide sequences of EDNRA BINDING SITE, designated SEQ ID:32061, to the nucleotide sequence of VGAM1257 RNA, herein designated VGAM RNA, also designated SEQ ID:3968.

Another function of VGAM1257 is therefore inhibition of Endothelin Receptor Type A (EDNRA, Accession XM_034331), a gene which binds endothelins, and induces intracellular calcium flux and arachidonic acid accumulation. Accordingly, utilities of VGAM1257 include diagnosis, prevention and treatment of diseases and clinical conditions associated with EDNRA. The function of EDNRA and its association with various diseases and clinical conditions, has been established by previous studies, as described hereinabove with reference to VGAM441. Myeloid Cell Leukemia Sequence 1 (BCL2-related) (MCL1, Accession NM_021960) is another VGAM1257 host target gene. MCL1 BINDING SITE is HOST TARGET binding site found in the 3' untranslated region of mRNA encoded by MCL1, corresponding to a HOST TARGET binding site such as BINDING SITE I, BINDING SITE II or BINDING SITE III. Table 2 illustrates the complementarity of the nucleotide sequences of MCL1 BINDING SITE, designated SEQ ID:22488, to the nucleotide sequence of VGAM1257 RNA, herein designated VGAM RNA, also designated SEQ ID:3968.

Another function of VGAM1257 is therefore inhibition of Myeloid Cell Leukemia Sequence 1 (BCL2-related) (MCL1, Accession NM_021960), a gene which involved in programing of differentiation and concomitant maintenance of viability. Accordingly, utilities of VGAM1257 include diagnosis, prevention and treatment of diseases and clinical conditions associated with MCL1. The function of MCL1 and its association with various diseases and clinical conditions, has been established by previous studies, as described hereinabove with reference to VGAM1083. Transcription Elongation Factor A (SII), 1 (TCEA1, Accession XM_087370) is another VGAM1257 host target gene. TCEA1 BINDING SITE is HOST TARGET binding site found in the 3' untranslated region of mRNA encoded by TCEA1, corresponding to a HOST TARGET binding site such as BINDING SITE I, BINDING SITE II or BINDING SITE III. Table 2 illustrates the complementarity of the nucleotide sequences of TCEA1 BINDING SITE, designated SEQ ID:39204, to the nucleotide sequence of VGAM1257 RNA, herein designated VGAM RNA, also designated SEQ ID:3968.

Another function of VGAM1257 is therefore inhibition of Transcription Elongation Factor A (SII), 1 (TCEA1, Accession XM_087370), a gene which helps RNA polymerase II to transcribe past blockages. Accordingly, utilities of VGAM1257 include diagnosis, prevention and treatment of diseases and clinical conditions associated with TCEA1. The function of TCEA1 and its association with various diseases and clinical conditions, has been established by previous studies, as described hereinabove with reference to VGAM211. MGC2376 (Accession NM_023930) is another VGAM1257 host target gene. MGC2376 BINDING SITE is HOST TARGET binding site found in the 3' untranslated region of mRNA encoded by MGC2376, corresponding to a HOST TARGET binding site such as BINDING SITE I, BINDING SITE II or BINDING SITE III. Table 2 illustrates the complementarity of the nucleotide sequences of MGC2376 BINDING SITE, designated SEQ ID:23413, to the nucleotide sequence of VGAM1257 RNA, herein designated VGAM RNA, also designated SEQ ID:3968.

Another function of VGAM1257 is therefore inhibition of MGC2376 (Accession NM_023930). Accordingly, utilities of VGAM1257 include diagnosis, prevention and treatment of diseases and clinical conditions associated with MGC2376. MIG2 (Accession XM_051693) is another VGAM1257 host target gene. MIG2 BINDING SITE is HOST TARGET binding site found in the 3' untranslated region of mRNA encoded by MIG2, corresponding to a HOST TARGET binding site such as BINDING SITE I, BINDING SITE II or BINDING SITE III. Table 2 illustrates the complementarity of the nucleotide sequences of MIG2 BINDING SITE, designated SEQ ID:35862, to the nucleotide sequence of VGAM1257 RNA, herein designated VGAM RNA, also designated SEQ ID:3968.

Another function of VGAM1257 is therefore inhibition of MIG2 (Accession XM_051693). Accordingly, utilities of VGAM1257 include diagnosis, prevention and treatment of diseases and clinical conditions associated with MIG2. Zinc Finger Protein 387 (ZNF387, Accession NM_014682) is another VGAM1257 host target gene. ZNF387 BINDING SITE is HOST TARGET binding site found in the 3' untranslated region of mRNA encoded by ZNF387, corresponding to a HOST TARGET binding site such as BINDING SITE I, BINDING SITE II or BINDING SITE III. Table 2 illustrates the complementarity of the nucleotide sequences of ZNF387 BINDING SITE, designated SEQ ID:16179, to the nucleotide sequence of VGAM1257 RNA, herein designated VGAM RNA, also designated SEQ ID:3968.

Another function of VGAM1257 is therefore inhibition of Zinc Finger Protein 387 (ZNF387, Accession NM_014682). Accordingly, utilities of VGAM1257 include diagnosis, prevention and treatment of diseases and clinical conditions associated with ZNF387. LOC151473 (Accession XM_087215) is another VGAM1257 host target gene. LOC151473 BINDING SITE is HOST TARGET binding site found in the 3' untranslated region of mRNA encoded by LOC151473, corresponding to a HOST TARGET binding site such as BINDING SITE I, BINDING SITE II or BINDING SITE III. Table 2 illustrates the complementarity of the nucleotide sequences of LOC151473 BINDING SITE, designated SEQ ID:39123, to the nucleotide sequence of VGAM1257 RNA, herein designated VGAM RNA, also designated SEQ ID:3968.

Another function of VGAM1257 is therefore inhibition of LOC151473 (Accession XM_087215). Accordingly, utilities of VGAM1257 include diagnosis, prevention and treatment of diseases and clinical conditions associated with LOC151473. LOC151521 (Accession XM_098076) is another VGAM1257 host target gene. LOC151521 BINDING SITE is HOST TARGET binding site found in the 3' untranslated region of mRNA encoded by LOC151521, corresponding to a HOST TARGET binding site such as BINDING SITE I, BINDING SITE II or BINDING SITE III. Table 2 illustrates the complementarity of the nucleotide sequences of LOC151521 BINDING SITE, designated SEQ ID:41365, to the nucleotide sequence of VGAM1257 RNA, herein designated VGAM RNA, also designated SEQ ID:3968.

Another function of VGAM1257 is therefore inhibition of LOC151521 (Accession XM_098076). Accordingly, utilities of VGAM1257 include diagnosis, prevention and treatment of diseases and clinical conditions associated with LOC151521. LOC197131 (Accession XM_113823) is another VGAM1257 host target gene. LOC197131 BINDING SITE is HOST TARGET binding site found in the 3' untranslated region of mRNA encoded by LOC197131, corresponding to a HOST TARGET binding site such as BINDING SITE I, BINDING SITE II or BINDING SITE III. Table 2 illustrates the complementarity of the nucleotide sequences of LOC197131 BINDING SITE, designated SEQ ID:42448, to the nucleotide sequence of VGAM1257 RNA, herein designated VGAM RNA, also designated SEQ ID:3968.

Another function of VGAM1257 is therefore inhibition of LOC197131 (Accession XM_113823). Accordingly, utilities of VGAM1257 include diagnosis, prevention and treatment of diseases and clinical conditions associated with LOC197131. LOC254973 (Accession XM_172751) is another VGAM1257 host target gene. LOC254973 BINDING SITE is HOST TARGET binding site found in the 5' untranslated region of mRNA encoded by LOC254973, corresponding to a HOST TARGET binding site such as BINDING SITE I, BINDING SITE II or BINDING SITE III. Table 2 illustrates the complementarity of the nucleotide sequences of LOC254973 BINDING SITE, designated SEQ ID:46078, to the nucleotide sequence of VGAM1257 RNA, herein designated VGAM RNA, also designated SEQ ID:3968.

Another function of VGAM1257 is therefore inhibition of LOC254973 (Accession XM_172751). Accordingly, utilities of VGAM1257 include diagnosis, prevention and treatment of diseases and clinical conditions associated with LOC254973. FIG. 1 further provides a conceptual description of a novel bioinformatically detected viral gene of the present invention, referred to here as Viral Genomic Address Messenger 1258 (VGAM1258) viral gene, which modulates expression of respective host target genes thereof, the function and utility of which host target genes is known in the art.

VGAM1258 is a novel bioinformatically detected regulatory, non protein coding, viral micro RNA (miRNA) gene. The method by which VGAM1258 was detected is described hereinabove with reference to FIGS. 1-8.

VGAM1258 gene, herein designated VGAM GENE, is a viral gene contained in the genome of Yaba-like Disease Virus. VGAM1258 host target gene, herein designated VGAM HOST TARGET GENE, is a human gene contained in the human genome.

VGAM1258 gene encodes a VGAM1258 precursor RNA, herein designated VGAM PRECURSOR RNA. Similar to other miRNA genes, and unlike most ordinary genes, VGAM1258 precursor RNA does not encode a protein. A nucleotide sequence identical or highly similar to the nucleotide sequence of VGAM1258 precursor RNA is designated SEQ ID:1244, and is provided hereinbelow with reference to the sequence listing part. Nucleotide sequence SEQ ID:1244 is located at position 40891 relative to the genome of Yaba-like Disease Virus.

VGAM1258 precursor RNA folds onto itself, forming VGAM1258 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1258 folded precursor RNA into VGAM1258 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1258 RNA is designated SEQ ID:3969, and is provided hereinbelow with reference to the sequence listing part.

VGAM1258 host target gene, herein designated VGAM HOST TARGET GENE, encodes a corresponding messenger RNA, VGAM1258 host target RNA, herein designated VGAM HOST TARGET RNA. VGAM1258 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1258 RNA, herein designated VGAM RNA, binds complementarily to one or more host target binding sites located in untranslated regions of VGAM1258 host target RNA, herein designated VGAM HOST TARGET RNA. This complementary binding is due to the fact that the nucleotide sequence of VGAM1258 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1258 RNA, herein designated VGAM RNA, may have a different number of host target binding sites in untranslated regions of a VGAM1258 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1258 RNA, herein designated VGAM RNA, to host target binding sites on VGAM1258 host target RNA, herein designated VGAM HOST TARGET RNA, such as BINDING SITE I, BINDING SITE II and BINDING SITE III, inhibits translation of VGAM1258 host target RNA into VGAM1258 host target protein, herein designated VGAM HOST TARGET PROTEIN. VGAM host target protein is therefore outlined by a broken line.

It is appreciated that VGAM1258 host target gene, herein designated VGAM HOST TARGET GENE, in fact represents a plurality of VGAM1258 host target genes. The mRNA of each one of this plurality of VGAM1258 host target genes comprises one or more host target binding sites, each having a nucleotide sequence which is at least partly complementary to VGAM1258 RNA, herein designated VGAM RNA, and which when bound by VGAM1258 RNA causes inhibition of translation of respective one or more VGAM1258 host target proteins.

It is further appreciated by one skilled in the art that the mode of translational inhibition illustrated by FIG. 1 with specific reference to translational inhibition exerted by VGAM1258 gene, herein designated VGAM GENE, on one or more VGAM1258 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1258 is inhibition of expression of host target genes, as part of a novel viral mechanism of attacking a host. Accordingly, utilities of VGAM1258 include diagnosis, prevention and treatment of viral infection by Yaba-like Disease Virus. Specific functions, and accordingly utilities, of VGAM1258 correlate with, and may be deduced from, the identity of the host target genes which VGAM1258 binds and inhibits, and the function of these host target genes, as elaborated hereinbelow.

Nucleotide sequences of the VGAM1258 precursor RNA, herein designated VGAM PRECURSOR RNA, and of the 'diced' VGAM1258 RNA, herein designated VGAM RNA, and a schematic representation of the secondary folding of VGAM1258 folded precursor RNA, herein designated VGAM FOLDED PRECURSOR RNA, of VGAM1258 are further described hereinbelow with reference to Table 1.

Nucleotide sequences of host target binding sites, such as BINDING SITE-I, BINDING SITE-II and BINDING SITE-III of FIG. 1, found on VGAM1258 host target RNA, and schematic representation of the complementarity of each of these host target binding sites to VGAM1258 RNA, herein designated VGAM RNA, are described hereinbelow with reference to Table 2.

As mentioned hereinabove with reference to FIG. 1, a function of VGAM1258 gene, herein designated VGAM is inhibition of expression of VGAM1258 target genes. It is appreciated that specific functions, and accordingly utilities, of VGAM1258 correlate with, and may be deduced from, the identity of the target genes which VGAM1258 binds and inhibits, and the function of these target genes, as elaborated hereinbelow.

Protein Phosphatase 3 (formerly 2B), Catalytic Subunit, Alpha Isoform (calcineurin A alpha) (PPP3CA, Accession NM_000944) is a VGAM1258 host target gene. PPP3CA BINDING SITE is HOST TARGET binding site found in the 3' untranslated region of mRNA encoded by PPP3CA, corresponding to a HOST TARGET binding site such as BINDING SITE I, BINDING SITE II or BINDING SITE III. Table 2 illustrates the complementarity of the nucleotide sequences of PPP3CA BINDING SITE, designated SEQ ID:6644, to the nucleotide sequence of VGAM1258 RNA, herein designated VGAM RNA, also designated SEQ ID:3969.

A function of VGAM1258 is therefore inhibition of Protein Phosphatase 3 (formerly 2B), Catalytic Subunit, Alpha Isoform (calcineurin A alpha) (PPP3CA, Accession NM_000944), a gene which is the catalytic subunit of calcium-dependent, calmodulin-stimulated protein phosphatase. Accordingly, utilities of VGAM1258 include diagnosis, prevention and treatment of diseases and clinical conditions associated with PPP3CA. The function of PPP3CA and its association with various diseases and clinical conditions, has been established by previous studies, as described hereinabove with reference to VGAM497. KIAA0471 (Accession NM_014857) is another VGAM1258 host target gene. KIAA0471 BINDING SITE is HOST TARGET binding site found in the 3' untranslated region of mRNA encoded by KIAA0471, corresponding to a HOST TARGET binding site such as BINDING SITE I, BINDING SITE II or BINDING SITE III. Table 2 illustrates the complementarity of the nucleotide sequences of KIAA0471 BINDING SITE, designated SEQ ID:16914, to the nucleotide sequence of VGAM1258 RNA, herein designated VGAM RNA, also designated SEQ ID:3969.

Another function of VGAM1258 is therefore inhibition of KIAA0471 (Accession NM_014857). Accordingly, utilities of VGAM1258 include diagnosis, prevention and treatment of diseases and clinical conditions associated with KIAA0471. KIAA1594 (Accession XM_050754) is another VGAM1258 host target gene. KIAA1594 BINDING SITE is HOST TARGET binding site found in the 3' untranslated region of mRNA encoded by KIAA1594, corresponding to a HOST TARGET binding site such as BINDING SITE I, BINDING SITE II or BINDING SITE III. Table 2 illustrates the complementarity of the nucleotide sequences of KIAA1594 BINDING SITE, designated SEQ ID:35673, to the nucleotide sequence of VGAM1258 RNA, herein designated VGAM RNA, also designated SEQ ID:3969.

Another function of VGAM1258 is therefore inhibition of KIAA1594 (Accession XM_050754). Accordingly, utilities of VGAM1258 include diagnosis, prevention and treatment of diseases and clinical conditions associated with KIAA1594. Kelch-like 4 (Drosophila) (KLHL4, Accession NM_019117) is another VGAM1258 host target gene. KLHL4 BINDING SITE is HOST TARGET binding site found in the 3' untranslated region of mRNA encoded by KLHL4, corresponding to a HOST TARGET binding site such as BINDING SITE I, BINDING SITE II or BINDING SITE III. Table 2 illustrates the complementarity of the nucleotide sequences of KLHL4 BINDING SITE, designated SEQ ID:21194, to the nucleotide sequence of VGAM1258 RNA, herein designated VGAM RNA, also designated SEQ ID:3969.

Another function of VGAM1258 is therefore inhibition of Kelch-like 4 (Drosophila) (KLHL4, Accession NM_019117). Accordingly, utilities of VGAM1258 include diagnosis, prevention and treatment of diseases and clinical conditions associated with KLHL4. LOC219401 (Accession XM_166706) is another VGAM1258 host target gene. LOC219401 BINDING SITE is HOST TARGET binding site found in the 3' untranslated region of mRNA encoded by LOC219401, corresponding to a HOST TARGET binding site such as BINDING SITE I, BINDING SITE II or BINDING SITE III. Table 2 illustrates the complementarity of the nucleotide sequences of LOC219401 BINDING SITE, designated SEQ ID:44588, to the nucleotide sequence of VGAM1258 RNA, herein designated VGAM RNA, also designated SEQ ID:3969.

Another function of VGAM1258 is therefore inhibition of LOC219401 (Accession XM_166706). Accordingly, utilities of VGAM1258 include diagnosis, prevention and treatment of diseases and clinical conditions associated with LOC219401. LOC219686 (Accession XM_165544) is another VGAM1258 host target gene. LOC219686 BINDING SITE is HOST TARGET binding site found in the 3' untranslated region of mRNA encoded by LOC219686, corresponding to a HOST TARGET binding site such as BINDING SITE I, BINDING SITE II or BINDING SITE III. Table 2 illustrates the complementarity of the nucleotide sequences of LOC219686 BINDING SITE, designated SEQ ID:43677, to the nucleotide sequence of VGAM1258 RNA, herein designated VGAM RNA, also designated SEQ ID:3969.

Another function of VGAM1258 is therefore inhibition of LOC219686 (Accession XM_165544). Accordingly, utilities of VGAM1258 include diagnosis, prevention and treatment of diseases and clinical conditions associated with LOC219686. FIG. 1 further provides a conceptual description of a novel bioinformatically detected viral gene of the present invention, referred to here as Viral Genomic Address Messenger 1259 (VGAM1259) viral gene, which modulates expression of respective host target genes thereof, the function and utility of which host target genes is known in the art.

VGAM1259 is a novel bioinformatically detected regulatory, non protein coding, viral micro RNA (miRNA) gene. The method by which VGAM1259 was detected is described hereinabove with reference to FIGS. 1-8.

VGAM1259 gene, herein designated VGAM GENE, is a viral gene contained in the genome of Blackcurrant Reversion Virus. VGAM1259 host target gene, herein designated VGAM HOST TARGET GENE, is a human gene contained in the human genome.

VGAM1259 gene encodes a VGAM1259 precursor RNA, herein designated VGAM PRECURSOR RNA. Similar to other miRNA genes, and unlike most ordinary genes, VGAM1259 precursor RNA does not encode a protein. A nucleotide sequence identical or highly similar to the nucleotide sequence of VGAM1259 precursor RNA is designated SEQ ID:1245, and is provided hereinbelow with reference to the sequence listing part. Nucleotide sequence SEQ ID:1245 is located at position 4609 relative to the genome of Blackcurrant Reversion Virus.

VGAM1259 precursor RNA folds onto itself, forming VGAM1259 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1259 folded precursor RNA into VGAM1259 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM1259 RNA is designated SEQ ID:3970, and is provided hereinbelow with reference to the sequence listing part.

VGAM1259 host target gene, herein designated VGAM HOST TARGET GENE, encodes a corresponding messenger RNA, VGAM1259 host target RNA, herein designated VGAM HOST TARGET RNA. VGAM1259 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1259 RNA, herein designated VGAM RNA, binds complementarily to one or more host target binding sites located in untranslated regions of VGAM1259 host target RNA, herein designated VGAM HOST TARGET RNA. This complementary binding is due to the fact that the nucleotide sequence of VGAM1259 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1259 RNA, herein designated VGAM RNA, may have a different number of host target binding sites in untranslated regions of a VGAM1259 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1259 RNA, herein designated VGAM RNA, to host target binding sites on VGAM1259 host target RNA, herein designated VGAM HOST TARGET RNA, such as BINDING SITE I, BINDING SITE II and BINDING SITE III, inhibits translation of VGAM1259 host target RNA into VGAM1259 host target protein, herein designated VGAM HOST TARGET PROTEIN. VGAM host target protein is therefore outlined by a broken line.

It is appreciated that VGAM1259 host target gene, herein designated VGAM HOST TARGET GENE, in fact represents a plurality of VGAM1259 host target genes. The mRNA of each one of this plurality of VGAM1259 host target genes comprises one or more host target binding sites, each having a nucleotide sequence which is at least partly complementary to VGAM1259 RNA, herein designated VGAM RNA, and which when bound by VGAM1259 RNA causes inhibition of translation of respective one or more VGAM1259 host target proteins.

It is further appreciated by one skilled in the art that the mode of translational inhibition illustrated by FIG. 1 with specific reference to translational inhibition exerted by VGAM1259 gene, herein designated VGAM GENE, on one or more VGAM1259 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1259 is inhibition of expression of host target genes, as part of a novel viral mechanism of attacking a host. Accordingly, utilities of VGAM1259 include diagnosis, prevention and treatment of viral infection by Blackcurrant Reversion Virus. Specific functions, and accordingly utilities, of VGAM1259 correlate with, and may be deduced from, the identity of the host target genes which VGAM1259 binds and inhibits, and the function of these host target genes, as elaborated hereinbelow.

Nucleotide sequences of the VGAM1259 precursor RNA, herein designated VGAM PRECURSOR RNA, and of the 'diced' VGAM1259 RNA, herein designated VGAM RNA, and a schematic representation of the secondary folding of VGAM1259 folded precursor RNA, herein designated VGAM FOLDED PRECURSOR RNA, of VGAM1259 are further described hereinbelow with reference to Table 1.

Nucleotide sequences of host target binding sites, such as BINDING SITE-I, BINDING SITE-II and BINDING SITE-III of FIG. 1, found on VGAM1259 host target RNA, and schematic representation of the complementarity of each of these host target binding sites to VGAM1259 RNA, herein designated VGAM RNA, are described hereinbelow with reference to Table 2.

As mentioned hereinabove with reference to FIG. 1, a function of VGAM1259 gene, herein designated VGAM is inhibition of expression of VGAM1259 target genes. It is appreciated that specific functions, and accordingly utilities, of VGAM1259 correlate with, and may be deduced from, the identity of the target genes which VGAM1259 binds and inhibits, and the function of these target genes, as elaborated hereinbelow.

ATPase, Aminophospholipid Transporter-like, Class I, Type 8A, Member 2 (ATP8A2, Accession XM_167916) is a VGAM1259 host target gene. ATP8A2 BINDING SITE is HOST TARGET binding site found in the 3' untranslated region of mRNA encoded by ATP8A2, corresponding to a HOST TARGET binding site such as BINDING SITE I, BINDING SITE II or BINDING SITE III. Table 2 illustrates the complementarity of the nucleotide sequences of ATP8A2 BINDING SITE, designated SEQ ID:44915, to the nucleotide sequence of VGAM1259 RNA, herein designated VGAM RNA, also designated SEQ ID:3970.

A function of VGAM1259 is therefore inhibition of ATPase, Aminophospholipid Transporter-like, Class I, Type 8A, Member 2 (ATP8A2, Accession XM_167916). Accordingly, utilities of VGAM1259 include diagnosis, prevention and treatment of diseases and clinical conditions associated with ATP8A2. Cleavage and Polyadenylation Specific Factor 6, 68 kDa (CPSF6, Accession NM_007007) is another VGAM1259 host target gene. CPSF6 BINDING SITE is HOST TARGET binding site found in the 3' untranslated region of mRNA encoded by CPSF6, corresponding to a HOST TARGET binding site such as BINDING SITE I, BINDING SITE II or BINDING SITE III. Table 2 illustrates the complementarity of the nucleotide sequences of CPSF6 BINDING SITE, designated SEQ ID:13869, to the nucleotide sequence of VGAM1259 RNA, herein designated VGAM RNA, also designated SEQ ID:3970.

Another function of VGAM1259 is therefore inhibition of Cleavage and Polyadenylation Specific Factor 6, 68 kDa (CPSF6, Accession NM_007007). Accordingly, utilities of VGAM1259 include diagnosis, prevention and treatment of diseases and clinical conditions associated with CPSF6. HIR Histone Cell Cycle Regulation Defective Homolog A (S. cerevisiae) (HIRA, Accession NM_003325) is another VGAM1259 host target gene. HIRA BINDING SITE is HOST TARGET binding site found in the 3' untranslated region of mRNA encoded by HIRA, corresponding to a HOST TARGET binding site such as BINDING SITE I, BINDING SITE II or BINDING SITE III. Table 2 illustrates the complementarity of the nucleotide sequences of HIRA BINDING SITE, designated SEQ ID:9325, to the nucleotide sequence of VGAM1259 RNA, herein designated VGAM RNA, also designated SEQ ID:3970.

Another function of VGAM1259 is therefore inhibition of HIR Histone Cell Cycle Regulation Defective Homolog A (S. cerevisiae) (HIRA, Accession NM_003325), a gene which could have a part in mechanisms of transcriptional regulation similar to that played by yeast hir1 and hir2 together. Accordingly, utilities of VGAM1259 include diagnosis, prevention and treatment of diseases and clinical conditions associated with HIRA. The function of HIRA has been established by previous studies. The human TUPLE1 gene encodes a putative transcription regulator with a sequence similar to that of the yeast TUP1 gene (Halford et al., 1993). The protein product of the TUPLE1 gene contains WD40 domains, motifs thought to be involved in protein-protein interactions. Halford et al. (1993) demonstrated that the TUPLE1 gene maps to chromosome 22 and to the shortest region of deletion overlap in a series of over 100 patients with the DiGeorge syndrome (DGS; 188400), velocardiofacial syndrome (VCFS; 192430), or a related disorder. It is expressed in a range of fetal tissues. Halford et al. (1993) cloned the murine Tuple1 gene and showed that it has strong sequence similarity to the human gene. Since TUPLE1 is a candidate gene for DGS through the mechanism of haploinsufficiency and it might be possible to produce models of this disorder by creating mutations in the mouse gene, Mattei et al. (1994) mapped the gene to mouse chromosome 16 by isotopic in situ hybridization. The experiments were carried out using metaphase spreads from a WMP male mouse in which all of the autosomes, except 19, were in the form of metacentric Robertsonian translocations. In the human, TUPLE1 is centromeric to COMT (OMIM Ref. No. 116790), which in turn is centromeric to IGLC1 (OMIM Ref. No. 147220); all of these expressed sequences map to mouse chromosome 16. Magnaghi et al. (1998) reported an interaction between HIRA and the transcription factor PAX3 (OMIM Ref. No. 606597). PAX3 haploinsufficiency results in the mouse 'splotch' and human Waardenburg syndrome (see OMIM Ref. No. 193500) phenotypes. Mice homozygous for PAX3 mutations die in utero with a phenocopy of DiGeorge syndrome, or neonatally with neural tube defects. HIRA was also found to interact with core histones. Thus, altered stoichiometry of complexes containing HIRA may be important for the development of structures affected in Waardenburg syndrome and DiGeorge syndrome.

Full details of the abovementioned studies are described in the following publications, the disclosure of which are hereby incorporated by reference:

Halford, S.; Wilson, D. I.; Daw, S. C. M.; Roberts, C.; Wadey, R.; Kamath, S.; Wickremasinghe, A.; Burn, J.; Goodship, J.; Mattei, M.-G.; Moorman, A. F. M.; Scambler, P. J.: Isolation of a gene expressed during early embryogenesis from the region of 22q11 commonly deleted in DiGeorge syndrome. Hum. Molec. Genet. 2: 1577-1582, 1993; and Magnaghi, P.; Roberts, C.; Lorain, S.; Lipinski, M.; Scambler, P. J.: HIRA, a mammalian homologue of Saccharomyces cerevisiae transcriptional co-repressors, interacts with Pax3. Natur.

Further studies establishing the function and utilities of HIRA are found in John Hopkins OMIM database record ID 600237, and in sited publications numbered 593 and 7692-7698 listed in the bibliography section hereinbelow, which are also hereby incorporated by reference. LIM Domains Containing 1 (LIMD1, Accession NM_014240) is another VGAM1259 host target gene. LIMD1 BINDING SITE is HOST TARGET binding site found in the 3' untranslated region of mRNA encoded by LIMD1, corresponding to a HOST TARGET binding site such as BINDING SITE I, BINDING SITE II or BINDING SITE III. Table 2 illustrates the complementarity of the nucleotide sequences of LIMD1 BINDING SITE, designated SEQ ID:15499, to the nucleotide sequence of VGAM1259 RNA, herein designated VGAM RNA, also designated SEQ ID:3970.

Another function of VGAM1259 is therefore inhibition of LIM Domains Containing 1 (LIMD1, Accession NM_014240). Accordingly, utilities of VGAM1259 include diagnosis, prevention and treatment of diseases and clinical conditions associated with LIMD1. NKX3A (Accession NM_006167) is another VGAM1259 host target gene. NKX3A BINDING SITE is HOST TARGET binding site found in the 3' untranslated region of mRNA encoded by NKX3A, corresponding to a HOST TARGET binding site such as BINDING SITE I, BINDING SITE II or BINDING SITE III. Table 2 illustrates the complementarity of the nucleotide sequences of NKX3A BINDING SITE, designated SEQ ID:12829, to the nucleotide sequence of VGAM1259 RNA, herein designated VGAM RNA, also designated SEQ ID:3970.

Another function of VGAM1259 is therefore inhibition of NKX3A (Accession NM_006167), a gene which may regulate gene expression and control cell differentiation. Accordingly, utilities of VGAM1259 include diagnosis, prevention and treatment of diseases and clinical conditions associated with NKX3A. The function of NKX3A and its association with various diseases and clinical conditions, has been established by previous studies, as described hereinabove with reference to VGAM481. Neuregulin 1 (NRG1, Accession NM_013959) is another VGAM1259 host target gene. NRG1 BINDING SITE is HOST TARGET binding site found in the 5' untranslated region of mRNA encoded by NRG1, corresponding to a HOST TARGET binding site such as BINDING SITE I, BINDING SITE II or BINDING SITE III. Table 2 illustrates the complementarity of the nucleotide sequences of NRG1 BINDING SITE, designated SEQ ID:15140, to the nucleotide sequence of VGAM1259 RNA, herein designated VGAM RNA, also designated SEQ ID:3970.

Another function of VGAM1259 is therefore inhibition of Neuregulin 1 (NRG1, Accession NM_013959), a gene which is essential for neuronal development. Accordingly, utilities of VGAM1259 include diagnosis, prevention and treatment of diseases and clinical conditions associated with NRG1. The function of NRG1 has been established by previous studies. The NEU/ERBB2 proto-oncogene (OMIM Ref. No. 164870) encodes a molecule that is closely related to epidermal growth factor receptor (EGFR; 131550) but binds none of the ligands of this receptor. Originally, NEU was identified as a dominant transforming gene in tumors of the peripheral nervous system that were induced by transplacental treatment of rat embryos with N-ethylnitrosourea. The period of susceptibility of NEU to carcinogenesis, i.e., midgestation, correlated with the timing of its expression in the nervous system. The existence of a NEU-specific ligand of endogenous nature activating NEU at a specific developmental stage was suggested. This ligand, known as heregulin (Holmes et al., 1992) or NEU differentiation factor, is a 44-kD glycoprotein that interacts with the NEU/ERBB2 receptor tyrosine kinase to increase its phosphorylation on tyrosine residues. Splice variants of heregulin, referred to as heregulin betas, have been described by Holmes et al. (1992). Animal model experiments lend further support to the function of NRG1. Mice homozygous for disruptions of all NRG1 isoforms, all Ig-NRG1 isoforms, and all cytoplasmic tail-containing isoforms die at embryonic day 10.5 from cardiac defects. In particular, these mice die before significant expression of CRD-NRG1 isoforms, which predominate after midgestation. By histologic analyses, Wolpowitz et al. (2000) found that homozygous CRD-NRG1-deficient mice had normal neuronal trajectory and outgrowth, but that the projections defasciculated, branched abnormally, and failed to sustain peripheral neuromuscular synaptic development. Newborn mutants had immature skeletal muscle. Schwann cells were generated in the mutants but failed to survive, consistent with the designation of NRG1 as a Schwann cell survival factor. Schwann cells in turn appeared to provide trophic support only after the nerve had entered its target field and had begun synapse formation.

It is appreciated that the abovementioned animal model for NRG1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Holmes, W. E.; Sliwkowski, M. X.; Akita, R. W.; Henzel, W. J.; Lee, J.; Park, J. W.; Yansura, D.; Abadi, N.; Raab, H.; Lewis, G. D.; Shepard, H. M.; Kuang, W.-J.; Wood, W. I.; Goeddel, D. V.; Vandlen, R. L.: Identification of heregulin, a specific activator of p185(erbB2). Science 256:1205-1210, 1992; and Wolpowitz, D.; Mason, T. B. A.; Dietrich, P.; Mendelsohn, M.; Talmage, D. A.; Role, L. W.: Cysteine-rich domain isoforms of the neuregulin-1 gene are required for maintenance of periph.

Further studies establishing the function and utilities of NRG1 are found in John Hopkins OMIM database record ID 142445, and in sited publications numbered 11569-11577, 188 and 11612 listed in the bibliography section hereinbelow, which are also hereby incorporated by reference. Purinergic Receptor P2Y, G-protein Coupled, 2 (P2RY2, Accession NM_002564) is another VGAM1259 host target gene. P2RY2 BINDING SITE is HOST TARGET binding site found in the 3' untranslated region of mRNA encoded by P2RY2, corresponding to a HOST TARGET binding site such as BINDING SITE I, BINDING SITE II or BINDING SITE III. Table 2 illustrates the complementarity of the nucleotide sequences of P2RY2 BINDING SITE, designated SEQ ID:8413, to the nucleotide sequence of VGAM1259 RNA, herein designated VGAM RNA, also designated SEQ ID:3970.

Another function of VGAM1259 is therefore inhibition of Purinergic Receptor P2Y, G-protein Coupled, 2 (P2RY2, Accession NM_002564), a gene which mediates cellular responses to ATP. Accordingly, utilities of VGAM1259 include diagnosis, prevention and treatment of diseases and clinical conditions associated with P2RY2. The function of P2RY2 has been established by previous studies. The chloride ion secretory pathway that is defective in cystic fibrosis (OMIM Ref. No. 219700) can be bypassed by an alternative pathway for chloride ion transport that is activated by extracellular nucleotides. Accordingly, the P2 receptor that mediates this effect is a therapeutic target for improving chloride secretion in CF patients. Parr et al. (1994) reported the sequence and functional expression of a cDNA cloned from human airway epithelial cells that encodes a protein with properties of a P2U nucleotide receptor. With a retrovirus system, the human airway clone was stably expressed in 1321N1 astrocytoma cells, a human cell line unresponsive to extracellular nucleotides. Studies of inositol phosphate accumulation and intracellular Ca (2+) mobilization induced by extracellular nucleotides in 1321N1 cells expressing the receptor identified this clone as the target receptor in human airway epithelia. Parr et al. (1994) also isolated an identical cDNA from human colonic epithelial cells, indicating that this is the same P2U receptor that had been functionally identified in other human tissues. Expression of the human P2U receptor in 1321N1 cells revealed evidence for autocrine ATP release and stimulation of transduced receptors. Thus, P2U expression in the cell line was proposed as a useful system for studying autocrine regulatory mechanisms and for screening potential therapeutic drugs. Tai et al. (2000) studied the expression and regulation of the P2UR gene in human granulosa-luteal cells (GLCs) by RT-PCR and Northern blot analysis. Expression of P2UR mRNA was downregulated by human chorionic gonadotropin (CG) in a dose- and time-dependent manner. Treatment with 8-bromo-cAMP and forskolin also attenuated P2UR mRNA levels. The authors concluded that the P2UR mRNA is expressed in human GLCs and that P2UR mRNA is regulated by human CG, cAMP, and forskolin. These findings further supported a potential role of this neurotransmitter receptor in the human ovary.

Full details of the abovementioned studies are described in the following publications, the disclosure of which are hereby incorporated by reference:

Parr, C. E.; Sullivan, D. M.; Paradiso, A. M.; Lazarowski, E. R.; Burch, L. H.; Olsen, J. C.; Erb, L.; Weisman, G. A.; Boucher, R. C.; Turner, J. T.: Cloning and expression of a human P(2U) nucleotide receptor, a target for cystic fibrosis pharmacotherapy. Proc. Nat. Acad. Sci. 91:3275-3279, 1994; and Tai, C.-J.; Kang, S. K.; Cheng, K. W.; Choi, K.-C.; Nathwani, P. S.; Leung, P. C. K.: Expression and regulation of P2U-purinergic receptor in human granulosa-luteal cells. J. Clin. End.

Further studies establishing the function and utilities of P2RY2 are found in John Hopkins OMIM database record ID 600041, and in sited publications numbered 7715-7719 listed in the bibliography section hereinbelow, which are also hereby incorporated by reference. Piccolo (presynaptic cytomatrix protein) (PCLO, Accession XM_168530) is another VGAM1259 host target gene. PCLO BINDING SITE is HOST TARGET binding site found in the 3' untranslated region of mRNA encoded by PCLO, corresponding to a HOST TARGET binding site such as BINDING SITE I, BINDING SITE II or BINDING SITE III. Table 2 illustrates the complementarity of the nucleotide sequences of PCLO BINDING SITE, designated SEQ ID:45212, to the nucleotide sequence of VGAM1259 RNA, herein designated VGAM RNA, also designated SEQ ID:3970.

Another function of VGAM1259 is therefore inhibition of Piccolo (presynaptic cytomatrix protein) (PCLO, Accession XM_168530), a gene which involves in the cycling of synaptic vesicles. Accordingly, utilities of VGAM1259 include diagnosis, prevention and treatment of diseases and clinical conditions associated with PCLO. The function of PCLO and its association with various diseases and clinical conditions, has been established by previous studies, as described hereinabove with reference to VGAM71. Serine (or cysteine) Proteinase Inhibitor, Clade D (heparin cofactor), Member 1 (SERPIND1, Accession NM_000185) is another VGAM1259 host target gene. SERPIND1 BINDING SITE is HOST TARGET binding site found in the 3' untranslated region of mRNA encoded by SERPIND1, corresponding to a HOST TARGET binding site such as BINDING SITE I, BINDING SITE II or BINDING SITE III. Table 2 illustrates the complementarity of the nucleotide sequences of SERPIND1 BINDING SITE, designated SEQ ID:5688, to the nucleotide sequence of VGAM1259 RNA, herein designated VGAM RNA, also designated SEQ ID:3970.

Another function of VGAM1259 is therefore inhibition of Serine (or cysteine) Proteinase Inhibitor, Clade D (heparin cofactor), Member 1 (SERPIND1, Accession NM_000185). Accordingly, utilities of VGAM1259 include diagnosis, prevention and treatment of diseases and clinical conditions associated with SERPIND1. Transmembrane, Prostate Androgen Induced RNA (TMEPAI, Accession NM_020182) is another VGAM1259 host target gene. TMEPAI BINDING SITE is HOST TARGET binding site found in the 3' untranslated region of mRNA encoded by TMEPAI, corresponding to a HOST TARGET binding site such as BINDING SITE I, BINDING SITE II or BINDING SITE III. Table 2 illustrates the complementarity of the nucleotide sequences of TMEPAI BINDING SITE, designated SEQ ID:21403, to the nucleotide sequence of VGAM1259 RNA, herein designated VGAM RNA, also designated SEQ ID:3970.

Another function of VGAM1259 is therefore inhibition of Transmembrane, Prostate Androgen Induced RNA (TMEPAI, Accession NM_020182). Accordingly, utilities of VGAM1259 include diagnosis, prevention and treatment of diseases and clinical conditions associated with TMEPAI. Transient Receptor Potential Cation Channel, Subfamily M, Member 6 (TRPM6, Accession NM_017662) is another VGAM1259 host target gene. TRPM6 BINDING SITE is HOST TARGET binding site found in the 3' untranslated region of mRNA encoded by TRPM6, corresponding to a HOST TARGET binding site such as BINDING SITE I, BINDING SITE II or BINDING SITE III. Table 2 illustrates the complementarity of the nucleotide sequences of TRPM6 BINDING SITE, designated SEQ ID:19196, to the nucleotide sequence of VGAM1259 RNA, herein designated VGAM RNA, also designated SEQ ID:3970.

Another function of VGAM1259 is therefore inhibition of Transient Receptor Potential Cation Channel, Subfamily M, Member 6 (TRPM6, Accession NM_017662), a gene which contains a predicted ion channel domain and a protein kinase domain. Accordingly, utilities of VGAM1259 include diagnosis, prevention and treatment of diseases and clinical conditions associated with TRPM6. The function of TRPM6 and its association with various diseases and clinical conditions, has been established by previous studies, as described hereinabove with reference to VGAM173. Cadherin-like 26 (CDH26, Accession NM_021810) is another VGAM1259 host target gene. CDH26 BINDING SITE is HOST TARGET binding site found in the 5' untranslated region of mRNA encoded by CDH26, corresponding to a HOST TARGET binding site such as BINDING SITE I, BINDING SITE II or BINDING SITE III. Table 2 illustrates the complementarity of the nucleotide sequences of CDH26 BINDING SITE, designated SEQ ID:22369, to the nucleotide sequence of VGAM1259 RNA, herein designated VGAM RNA, also designated SEQ ID:3970.

Another function of VGAM1259 is therefore inhibition of Cadherin-like 26 (CDH26, Accession NM_021810). Accordingly, utilities of VGAM1259 include diagnosis, prevention and treatment of diseases and clinical conditions associated with CDH26. FLJ12587 (Accession NM_022480) is another VGAM1259 host target gene. FLJ12587 BINDING SITE is HOST TARGET binding site found in the 3' untranslated region of mRNA encoded by FLJ12587, corresponding to a HOST TARGET binding site such as BINDING SITE I, BINDING SITE II or BINDING SITE III. Table 2 illustrates the complementarity of the nucleotide sequences of FLJ12587 BINDING SITE, designated SEQ ID:22851, to the nucleotide sequence of VGAM1259 RNA, herein designated VGAM RNA, also designated SEQ ID:3970.

Another function of VGAM1259 is therefore inhibition of FLJ12587 (Accession NM_022480). Accordingly, utilities of VGAM1259 include diagnosis, prevention and treatment of diseases and clinical conditions associated with FLJ12587. KIAA0759 (Accession XM_041090) is another VGAM1259 host target gene. KIAA0759 BINDING SITE is HOST TARGET binding site found in the 3' untranslated region of mRNA encoded by KIAA0759, corresponding to a HOST TARGET binding site such as BINDING SITE I, BINDING SITE II or BINDING SITE III. Table 2 illustrates the complementarity of the nucleotide sequences of KIAA0759 BINDING SITE, designated SEQ ID:33439, to the nucleotide sequence of VGAM1259 RNA, herein designated VGAM RNA, also designated SEQ ID:3970.

Another function of VGAM1259 is therefore inhibition of KIAA0759 (Accession XM_041090). Accordingly, utilities of VGAM1259 include diagnosis, prevention and treatment of diseases and clinical conditions associated with KIAA0759. MGC4294 (Accession NM_024314) is another VGAM1259 host target gene. MGC4294 BINDING SITE is HOST TARGET binding site found in the 5' untranslated region of mRNA encoded by MGC4294, corresponding to a HOST TARGET binding site such as BINDING SITE I, BINDING SITE II or BINDING SITE III. Table 2 illustrates the complementarity of the nucleotide sequences of MGC4294 BINDING SITE, designated SEQ ID:23607, to the nucleotide sequence of VGAM1259 RNA, herein designated VGAM RNA, also designated SEQ ID:3970.

Another function of VGAM1259 is therefore inhibition of MGC4294 (Accession NM_024314). Accordingly, utilities of VGAM1259 include diagnosis, prevention and treatment of diseases and clinical conditions associated with MGC4294. SARM (Accession NM_015077) is another VGAM1259 host target gene. SARM BINDING SITE is HOST TARGET binding site found in the 3' untranslated region of mRNA encoded by SARM, corresponding to a HOST TARGET binding site such as BINDING SITE I, BINDING SITE II or BINDING SITE III. Table 2 illustrates the complementarity of the nucleotide sequences of SARM BINDING SITE, designated SEQ ID:17461, to the nucleotide sequence of VGAM1259 RNA, herein designated VGAM RNA, also designated SEQ ID:3970.

Another function of VGAM1259 is therefore inhibition of SARM (Accession NM_015077). Accordingly, utilities of VGAM1259 include diagnosis, prevention and treatment of diseases and clinical conditions associated with SARM. LOC146481 (Accession XM_085484) is another VGAM1259 host target gene. LOC146481 BINDING SITE is HOST TARGET binding site found in the 5' untranslated region of mRNA encoded by LOC146481, corresponding to a HOST TARGET binding site such as BINDING SITE I, BINDING SITE II or BINDING SITE III. Table 2 illustrates the complementarity of the nucleotide sequences of LOC146481 BINDING SITE, designated SEQ ID:38175, to the nucleotide sequence of VGAM1259 RNA, herein designated VGAM RNA, also designated SEQ ID:3970.

Another function of VGAM1259 is therefore inhibition of LOC146481 (Accession XM_085484). Accordingly, utilities of VGAM1259 include diagnosis, prevention and treatment of diseases and clinical conditions associated with LOC146481. LOC152002 (Accession XM_087360) is another VGAM1259 host target gene. LOC152002 BINDING SITE is HOST TARGET binding site found in the 3' untranslated region of mRNA encoded by LOC152002, corresponding to a HOST TARGET binding site such as BINDING SITE I, BINDING SITE II or BINDING SITE III. Table 2 illustrates the complementarity of the nucleotide sequences of LOC152002 BINDING SITE, designated SEQ ID:39196, to the nucleotide sequence of VGAM1259 RNA, herein designated VGAM RNA, also designated SEQ ID:3970.

Another function of VGAM1259 is therefore inhibition of LOC152002 (Accession XM_087360). Accordingly, utilities of VGAM1259 include diagnosis, prevention and treatment of diseases and clinical conditions associated with LOC152002. LOC153205 (Accession XM_098322) is another VGAM1259 host target gene. LOC153205 BINDING SITE is HOST TARGET binding site found in the 5' untranslated region of mRNA encoded by LOC153205, corresponding to a HOST TARGET binding site such as BINDING SITE I, BINDING SITE II or BINDING SITE III. Table 2 illustrates the complementarity of the nucleotide sequences of LOC153205 BINDING SITE, designated SEQ ID:41579, to the nucleotide sequence of VGAM1259 RNA, herein designated VGAM RNA, also designated SEQ ID:3970.

Another function of VGAM1259 is therefore inhibition of LOC153205 (Accession XM_098322). Accordingly, utilities of VGAM1259 include diagnosis, prevention and treatment of diseases and clinical conditions associated with LOC153205. LOC220565 (Accession XM_165417) is another VGAM1259 host target gene. LOC220565 BINDING SITE is HOST TARGET binding site found in the 3' untranslated region of mRNA encoded by LOC220565, corresponding to a HOST TARGET binding site such as BINDING SITE I, BINDING SITE II or BINDING SITE III. Table 2 illustrates the complementarity of the nucleotide sequences of LOC220565 BINDING SITE, designated SEQ ID:43631, to the nucleotide sequence of VGAM1259 RNA, herein designated VGAM RNA, also designated SEQ ID:3970.

Another function of VGAM1259 is therefore inhibition of LOC220565 (Accession XM_165417). Accordingly, utilities of VGAM1259 include diagnosis, prevention and treatment of diseases and clinical conditions associated with LOC220565. LOC221362 (Accession XM_168093) is another VGAM1259 host target gene. LOC221362 BINDING SITE is HOST TARGET binding site found in the 3' untranslated region of mRNA encoded by LOC221362, corresponding to a HOST TARGET binding site such as BINDING SITE I, BINDING SITE II or BINDING SITE III. Table 2 illustrates the complementarity of the nucleotide sequences of LOC221362 BINDING SITE, designated SEQ ID:45019, to the nucleotide sequence of VGAM1259 RNA, herein designated VGAM RNA, also designated SEQ ID:3970.

Another function of VGAM1259 is therefore inhibition of LOC221362 (Accession XM_168093). Accordingly, utilities of VGAM1259 include diagnosis, prevention and treatment of diseases and clinical conditions associated with LOC221362. LOC92078 (Accession XM_042684) is another VGAM1259 host target gene. LOC92078 BINDING SITE is HOST TARGET binding site found in the 5' untranslated region of mRNA encoded by LOC92078, corresponding to a HOST TARGET binding site such as BINDING SITE I, BINDING SITE II or BINDING SITE III. Table 2 illustrates the complementarity of the nucleotide sequences of LOC92078 BINDING SITE, designated SEQ ID:33745, to the nucleotide sequence of VGAM1259 RNA, herein designated VGAM RNA, also designated SEQ ID:3970.

Another function of VGAM1259 is therefore inhibition of LOC92078 (Accession XM_042684). Accordingly, utilities of VGAM1259 include diagnosis, prevention and treatment of diseases and clinical conditions associated with LOC92078. FIG. 1 further provides a conceptual description of a novel bioinformatically detected viral gene of the present invention, referred to here as Viral Genomic Address Messenger 1260 (VGAM1260) viral gene, which modulates expression of respective host target genes thereof, the function and utility of which host target genes is known in the art.

VGAM1260 is a novel bioinformatically detected regulatory, non protein coding, viral micro RNA (miRNA) gene. The method by which VGAM1260 was detected is described hereinabove with reference to FIGS. 1-8.

VGAM1260 gene, herein designated VGAM GENE, is a viral gene contained in the genome of Blackcurrant Reversion Virus. VGAM1260 host target gene, herein designated VGAM HOST TARGET GENE, is a human gene contained in the human genome.

VGAM1260 gene encodes a VGAM1260 precursor RNA, herein designated VGAM PRECURSOR RNA. Similar to other miRNA genes, and unlike most ordinary genes, VGAM1260 precursor RNA does not encode a protein. A nucleotide sequence identical or highly similar to the nucleotide sequence of VGAM1260 precursor RNA is designated SEQ ID:1246, and is provided hereinbelow with reference to the sequence listing part. Nucleotide sequence SEQ ID:1246 is located at position 1827 relative to the genome of Blackcurrant Reversion Virus.

VGAM1260 precursor RNA folds onto itself, forming VGAM1260 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1260 folded precursor RNA into VGAM1260 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 87%) nucleotide sequence of VGAM1260 RNA is designated SEQ ID:3971, and is provided hereinbelow with reference to the sequence listing part.

VGAM1260 host target gene, herein designated VGAM HOST TARGET GENE, encodes a corresponding messenger RNA, VGAM1260 host target RNA, herein designated VGAM HOST TARGET RNA. VGAM1260 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1260 RNA, herein designated VGAM RNA, binds complementarily to one or more host target binding sites located in untranslated regions of VGAM1260 host target RNA, herein designated VGAM HOST TARGET RNA. This complementary binding is due to the fact that the nucleotide sequence of VGAM1260 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1260 RNA, herein designated VGAM RNA, may have a different number of host target binding sites in untranslated regions of a VGAM1260 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1260 RNA, herein designated VGAM RNA, to host target binding sites on VGAM1260 host target RNA, herein designated VGAM HOST TARGET RNA, such as BINDING SITE I, BINDING SITE II and BINDING SITE III, inhibits translation of VGAM1260 host target RNA into VGAM1260 host target protein, herein designated VGAM HOST TARGET PROTEIN. VGAM host target protein is therefore outlined by a broken line.

It is appreciated that VGAM1260 host target gene, herein designated VGAM HOST TARGET GENE, in fact represents a plurality of VGAM1260 host target genes. The mRNA of each one of this plurality of VGAM1260 host target genes comprises one or more host target binding sites, each having a nucleotide sequence which is at least partly complementary to VGAM1260 RNA, herein designated VGAM RNA, and which when bound by VGAM1260 RNA causes inhibition of translation of respective one or more VGAM1260 host target proteins.

It is further appreciated by one skilled in the art that the mode of translational inhibition illustrated by FIG. 1 with specific reference to translational inhibition exerted by VGAM1260 gene, herein designated VGAM GENE, on one or more VGAM1260 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1260 is inhibition of expression of host target genes, as part of a novel viral mechanism of attacking a host. Accordingly, utilities of VGAM1260 include diagnosis, prevention and treatment of viral infection by Blackcurrant Reversion Virus. Specific functions, and accordingly utilities, of VGAM1260 correlate with, and may be deduced from, the identity of the host target genes which VGAM1260 binds and inhibits, and the function of these host target genes, as elaborated hereinbelow.

Nucleotide sequences of the VGAM1260 precursor RNA, herein designated VGAM PRECURSOR RNA, and of the 'diced' VGAM1260 RNA, herein designated VGAM RNA, and a schematic representation of the secondary folding of VGAM1260 folded precursor RNA, herein designated VGAM FOLDED PRECURSOR RNA, of VGAM1260 are further described hereinbelow with reference to Table 1.

Nucleotide sequences of host target binding sites, such as BINDING SITE-I, BINDING SITE-II and BINDING SITE-III of FIG. 1, found on VGAM1260 host target RNA, and schematic representation of the complementarity of each of these host target binding sites to VGAM1260 RNA, herein designated VGAM RNA, are described hereinbelow with reference to Table 2.

As mentioned hereinabove with reference to FIG. 1, a function of VGAM1260 gene, herein designated VGAM is inhibition of expression of VGAM1260 target genes. It is appreciated that specific functions, and accordingly utilities, of VGAM1260 correlate with, and may be deduced from, the identity of the target genes which VGAM1260 binds and inhibits, and the function of these target genes, as elaborated hereinbelow.

BLAME (Accession NM_020125) is a VGAM1260 host target gene. BLAME BINDING SITE is HOST TARGET binding site found in the 3' untranslated region of mRNA encoded by BLAME, corresponding to a HOST TARGET binding site such as BINDING SITE I, BINDING SITE II or BINDING SITE III. Table 2 illustrates the complementarity of the nucleotide sequences of BLAME BINDING SITE, designated SEQ ID:21311, to the nucleotide sequence of VGAM1260 RNA, herein designated VGAM RNA, also designated SEQ ID:3971.

A function of VGAM1260 is therefore inhibition of BLAME (Accession NM_020125). Accordingly, utilities of VGAM1260 include diagnosis, prevention and treatment of diseases and clinical conditions associated with BLAME. Microtubule-associated Protein, RP/EB Family, Member 3 (MAPRE3, Accession NM_012326) is another VGAM1260 host target gene. MAPRE3 BINDING SITE is HOST TARGET binding site found in the 5' untranslated region of mRNA encoded by MAPRE3, corresponding to a HOST TARGET binding site such as BINDING SITE I, BINDING SITE II or BINDING SITE III. Table 2 illustrates the complementarity of the nucleotide sequences of MAPRE3 BINDING SITE, designated SEQ ID:14710, to the nucleotide sequence of VGAM1260 RNA, herein designated VGAM RNA, also designated SEQ ID:3971.

Another function of VGAM1260 is therefore inhibition of Microtubule-associated Protein, RP/EB Family, Member 3 (MAPRE3, Accession NM_012326), a gene which interact with cytoplasmic microtubules, and with the adenomatous polyposis coli. Accordingly, utilities of VGAM1260 include diagnosis, prevention and treatment of diseases and clinical conditions associated with MAPRE3. The function of MAPRE3 and its association with various diseases and clinical conditions, has been established by previous studies, as described hereinabove with reference to VGAM340. Dynein, Axonemal, Light Polypeptide 4 (DNAL4, Accession NM_005740) is another VGAM1260 host target gene. DNAL4 BINDING SITE is HOST TARGET binding site found in the 3' untranslated region of mRNA encoded by DNAL4, corresponding to a HOST TARGET binding site such as BINDING SITE I, BINDING SITE II or BINDING SITE III. Table 2 illustrates the complementarity of the nucleotide sequences of DNAL4 BINDING SITE, designated SEQ ID:12305, to the nucleotide sequence of VGAM1260 RNA, herein designated VGAM RNA, also designated SEQ ID:3971.

Another function of VGAM1260 is therefore inhibition of Dynein, Axonemal, Light Polypeptide 4 (DNAL4, Accession NM_005740). Accordingly, utilities of VGAM1260 include diagnosis, prevention and treatment of diseases and clinical conditions associated with DNAL4. FLJ10922 (Accession NM_018273) is another VGAM1260 host target gene. FLJ10922 BINDING SITE is HOST TARGET binding site found in the 3' untranslated region of mRNA encoded by FLJ10922, corresponding to a HOST TARGET binding site such as BINDING SITE I, BINDING SITE II or BINDING SITE III. Table 2 illustrates the complementarity of the nucleotide sequences of FLJ10922 BINDING SITE, designated SEQ ID:20252, to the nucleotide sequence of VGAM1260 RNA, herein designated VGAM RNA, also designated SEQ ID:3971.

Another function of VGAM1260 is therefore inhibition of FLJ10922 (Accession NM_018273). Accordingly, utilities of VGAM1260 include diagnosis, prevention and treatment of diseases and clinical conditions associated with FLJ10922. FLJ11286 (Accession NM_018381) is another VGAM1260 host target gene. FLJ11286 BINDING SITE is HOST TARGET binding site found in the 3' untranslated region of mRNA encoded by FLJ11286, corresponding to a HOST TARGET binding site such as BINDING SITE I, BINDING SITE II or BINDING SITE III. Table 2 illustrates the complementarity of the nucleotide sequences of FLJ11286 BINDING SITE, designated SEQ ID:20413, to the nucleotide sequence of VGAM1260 RNA, herein designated VGAM RNA, also designated SEQ ID:3971.

Another function of VGAM1260 is therefore inhibition of FLJ11286 (Accession NM_018381). Accordingly, utilities of VGAM1260 include diagnosis, prevention and treatment of diseases and clinical conditions associated with FLJ11286. KIAA0789 (Accession XM_033113) is another VGAM1260 host target gene. KIAA0789 BINDING SITE is HOST TARGET binding site found in the 5' untranslated region of mRNA encoded by KIAA0789, corresponding to a HOST TARGET binding site such as BINDING SITE I, BINDING SITE II or BINDING SITE III. Table 2 illustrates the complementarity of the nucleotide sequences of KIAA0789 BINDING SITE, designated SEQ ID:31844, to the nucleotide sequence of VGAM1260 RNA, herein designated VGAM RNA, also designated SEQ ID:3971.

Another function of VGAM1260 is therefore inhibition of KIAA0789 (Accession XM_033113). Accordingly, utilities of VGAM1260 include diagnosis, prevention and treatment of diseases and clinical conditions associated with KIAA0789. KIAA1856 (Accession XM_166549) is another VGAM1260 host target gene. KIAA1856 BINDING SITE is HOST TARGET binding site found in the 3' untranslated region of mRNA encoded by KIAA1856, corresponding to a HOST TARGET binding site such as BINDING SITE I, BINDING SITE II or BINDING SITE III. Table 2 illustrates the complementarity of the nucleotide sequences of KIAA1856 BINDING SITE, designated SEQ ID:44522, to the nucleotide sequence of VGAM1260 RNA, herein designated VGAM RNA, also designated SEQ ID:3971.

Another function of VGAM1260 is therefore inhibition of KIAA1856 (Accession XM_166549). Accordingly, utilities of VGAM1260 include diagnosis, prevention and treatment of diseases and clinical conditions associated with KIAA1856. MGC3248 (Accession NM_032486) is another VGAM1260 host target gene. MGC3248 BINDING SITE is HOST TARGET binding site found in the 3' untranslated region of mRNA encoded by MGC3248, corresponding to a HOST TARGET binding site such as BINDING SITE I, BINDING SITE II or BINDING SITE III. Table 2 illustrates the complementarity of the nucleotide sequences of MGC3248 BINDING SITE, designated SEQ ID:26239, to the nucleotide sequence of VGAM1260 RNA, herein designated VGAM RNA, also designated SEQ ID:3971.

Another function of VGAM1260 is therefore inhibition of MGC3248 (Accession NM_032486). Accordingly, utilities of VGAM1260 include diagnosis, prevention and treatment of diseases and clinical conditions associated with MGC3248. ODZ2 (Accession XM_047995) is another VGAM1260 host target gene. ODZ2 BINDING SITE is HOST TARGET binding site found in the 3' untranslated region of mRNA encoded by ODZ2, corresponding to a HOST TARGET binding site such as BINDING SITE I, BINDING SITE II or BINDING SITE III. Table 2 illustrates the complementarity of the nucleotide sequences of ODZ2 BINDING SITE, designated SEQ ID:35098, to the nucleotide sequence of VGAM1260 RNA, herein designated VGAM RNA, also designated SEQ ID:3971.

Another function of VGAM1260 is therefore inhibition of ODZ2 (Accession XM_047995). Accordingly, utilities of VGAM1260 include diagnosis, prevention and treatment of diseases and clinical conditions associated with ODZ2. PP1665 (Accession NM_030792) is another VGAM1260 host target gene. PP1665 BINDING SITE is HOST TARGET binding site found in the 3' untranslated region of mRNA encoded by PP1665, corresponding to a HOST TARGET binding site such as BINDING SITE I, BINDING SITE II or BINDING SITE III. Table 2 illustrates the complementarity of the nucleotide sequences of PP1665 BINDING SITE, designated SEQ ID:25089, to the nucleotide sequence of VGAM1260 RNA, herein designated VGAM RNA, also designated SEQ ID:3971.

Another function of VGAM1260 is therefore inhibition of PP1665 (Accession NM_030792). Accordingly, utilities of VGAM1260 include diagnosis, prevention and treatment of diseases and clinical conditions associated with PP1665. LOC163231 (Accession XM_092094) is another VGAM1260 host target gene. LOC163231 BINDING SITE1 and LOC163231 BINDING SITE2 are HOST TARGET binding sites found in untranslated regions of mRNA encoded by LOC163231, corresponding to HOST TARGET binding sites such as BINDING SITE I, BINDING SITE II or BINDING SITE III. Table 2 illustrates the complementarity of the nucleotide sequences of LOC163231 BINDING SITE1 and LOC163231 BINDING SITE2, designated SEQ ID:40095 and SEQ ID:40096 respectively, to the nucleotide sequence of VGAM1260 RNA, herein designated VGAM RNA, also designated SEQ ID:3971.

Another function of VGAM1260 is therefore inhibition of LOC163231 (Accession XM_092094). Accordingly, utilities of VGAM1260 include diagnosis, prevention and treatment of diseases and clinical conditions associated with LOC163231. FIG. 1 further provides a conceptual description of a novel bioinformatically detected viral gene of the present invention, referred to here as Viral Genomic Address Messenger 1261 (VGAM1261) viral gene, which modulates expression of respective host target genes thereof, the function and utility of which host target genes is known in the art.

VGAM1261 is a novel bioinformatically detected regulatory, non protein coding, viral micro RNA (miRNA) gene.

The method by which VGAM1261 was detected is described hereinabove with reference to FIGS. 1-8.

VGAM1261 gene, herein designated VGAM GENE, is a viral gene contained in the genome of Blackcurrant Reversion Virus. VGAM1261 host target gene, herein designated VGAM HOST TARGET GENE, is a human gene contained in the human genome.

VGAM1261 gene encodes a VGAM1261 precursor RNA, herein designated VGAM PRECURSOR RNA. Similar to other miRNA genes, and unlike most ordinary genes, VGAM1261 precursor RNA does not encode a protein. A nucleotide sequence identical or highly similar to the nucleotide sequence of VGAM1261 precursor RNA is designated SEQ ID:1247, and is provided hereinbelow with reference to the sequence listing part. Nucleotide sequence SEQ ID:1247 is located at position 2798 relative to the genome of Blackcurrant Reversion Virus.

VGAM1261 precursor RNA folds onto itself, forming VGAM1261 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1261 folded precursor RNA into VGAM1261 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM1261 RNA is designated SEQ ID:3972, and is provided hereinbelow with reference to the sequence listing part.

VGAM1261 host target gene, herein designated VGAM HOST TARGET GENE, encodes a corresponding messenger RNA, VGAM1261 host target RNA, herein designated VGAM HOST TARGET RNA. VGAM1261 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1261 RNA, herein designated VGAM RNA, binds complementarily to one or more host target binding sites located in untranslated regions of VGAM1261 host target RNA, herein designated VGAM HOST TARGET RNA. This complementary binding is due to the fact that the nucleotide sequence of VGAM1261 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1261 RNA, herein designated VGAM RNA, may have a different number of host target binding sites in untranslated regions of a VGAM1261 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1261 RNA, herein designated VGAM RNA, to host target binding sites on VGAM1261 host target RNA, herein designated VGAM HOST TARGET RNA, such as BINDING SITE I, BINDING SITE II and BINDING SITE III, inhibits translation of VGAM1261 host target RNA into VGAM1261 host target protein, herein designated VGAM HOST TARGET PROTEIN. VGAM host target protein is therefore outlined by a broken line.

It is appreciated that VGAM1261 host target gene, herein designated VGAM HOST TARGET GENE, in fact represents a plurality of VGAM1261 host target genes. The mRNA of each one of this plurality of VGAM1261 host target genes comprises one or more host target binding sites, each having a nucleotide sequence which is at least partly complementary to VGAM1261 RNA, herein designated VGAM RNA, and which when bound by VGAM1261 RNA causes inhibition of translation of respective one or more VGAM1261 host target proteins.

It is further appreciated by one skilled in the art that the mode of translational inhibition illustrated by FIG. 1 with specific reference to translational inhibition exerted by VGAM1261 gene, herein designated VGAM GENE, on one or more VGAM1261 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1261 is inhibition of expression of host target genes, as part of a novel viral mechanism of attacking a host. Accordingly, utilities of VGAM1261 include diagnosis, prevention and treatment of viral infection by Blackcurrant Reversion Virus. Specific functions, and accordingly utilities, of VGAM1261 correlate with, and may be deduced from, the identity of the host target genes which VGAM1261 binds and inhibits, and the function of these host target genes, as elaborated hereinbelow.

Nucleotide sequences of the VGAM1261 precursor RNA, herein designated VGAM PRECURSOR RNA, and of the 'diced' VGAM1261 RNA, herein designated VGAM RNA, and a schematic representation of the secondary folding of VGAM1261 folded precursor RNA, herein designated VGAM FOLDED PRECURSOR RNA, of VGAM1261 are further described hereinbelow with reference to Table 1.

Nucleotide sequences of host target binding sites, such as BINDING SITE-I, BINDING SITE-II and BINDING SITE-III of FIG. 1, found on VGAM1261 host target RNA, and schematic representation of the complementarity of each of these host target binding sites to VGAM1261 RNA, herein designated VGAM RNA, are described hereinbelow with reference to Table 2.

As mentioned hereinabove with reference to FIG. 1, a function of VGAM1261 gene, herein designated VGAM is inhibition of expression of VGAM1261 target genes. It is appreciated that specific functions, and accordingly utilities, of VGAM1261 correlate with, and may be deduced from, the identity of the target genes which VGAM1261 binds and inhibits, and the function of these target genes, as elaborated hereinbelow.

FLJ21168 (Accession NM_025073) is a VGAM1261 host target gene. FLJ21168 BINDING SITE is HOST TARGET binding site found in the 3' untranslated region of mRNA encoded by FLJ21168, corresponding to a HOST TARGET binding site such as BINDING SITE I, BINDING SITE II or BINDING SITE III. Table 2 illustrates the complementarity of the nucleotide sequences of FLJ21168 BINDING SITE, designated SEQ ID:24671, to the nucleotide sequence of VGAM1261 RNA, herein designated VGAM RNA, also designated SEQ ID:3972.

A function of VGAM1261 is therefore inhibition of FLJ21168 (Accession NM_025073). Accordingly, utilities of VGAM1261 include diagnosis, prevention and treatment of diseases and clinical conditions associated with FLJ21168. FIG. 1 further provides a conceptual description of a novel bioinformatically detected viral gene of the present invention, referred to here as Viral Genomic Address Messenger 1262 (VGAM1262) viral gene, which modulates expression of respective host target genes thereof, the function and utility of which host target genes is known in the art.

VGAM1262 is a novel bioinformatically detected regulatory, non protein coding, viral micro RNA (miRNA) gene. The method by which VGAM1262 was detected is described hereinabove with reference to FIGS. 1-8.

VGAM1262 gene, herein designated VGAM GENE, is a viral gene contained in the genome of Blackcurrant Reversion Virus. VGAM1262 host target gene, herein designated VGAM HOST TARGET GENE, is a human gene contained in the human genome.

VGAM1262 gene encodes a VGAM1262 precursor RNA, herein designated VGAM PRECURSOR RNA. Similar to other miRNA genes, and unlike most ordinary genes, VGAM1262 precursor RNA does not encode a protein. A nucleotide sequence identical or highly similar to the nucleotide sequence of VGAM1262 precursor RNA is designated SEQ ID:1248, and is provided hereinbelow with reference to the sequence listing part. Nucleotide sequence SEQ ID:1248 is located at position 3891 relative to the genome of Blackcurrant Reversion Virus.

VGAM1262 precursor RNA folds onto itself, forming VGAM1262 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1262 folded precursor RNA into VGAM1262 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1262 RNA is designated SEQ ID:3973, and is provided hereinbelow with reference to the sequence listing part.

VGAM1262 host target gene, herein designated VGAM HOST TARGET GENE, encodes a corresponding messenger RNA, VGAM1262 host target RNA, herein designated VGAM HOST TARGET RNA. VGAM1262 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1262 RNA, herein designated VGAM RNA, binds complementarily to one or more host target binding sites located in untranslated regions of VGAM1262 host target RNA, herein designated VGAM HOST TARGET RNA. This complementary binding is due to the fact that the nucleotide sequence of VGAM1262 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1262 RNA, herein designated VGAM RNA, may have a different number of host target binding sites in untranslated regions of a VGAM1262 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1262 RNA, herein designated VGAM RNA, to host target binding sites on VGAM1262 host target RNA, herein designated VGAM HOST TARGET RNA, such as BINDING SITE I, BINDING SITE II and BINDING SITE III, inhibits translation of VGAM1262 host target RNA into VGAM1262 host target protein, herein designated VGAM HOST TARGET PROTEIN. VGAM host target protein is therefore outlined by a broken line.

It is appreciated that VGAM1262 host target gene, herein designated VGAM HOST TARGET GENE, in fact represents a plurality of VGAM1262 host target genes. The mRNA of each one of this plurality of VGAM1262 host target genes comprises one or more host target binding sites, each having a nucleotide sequence which is at least partly complementary to VGAM1262 RNA, herein designated VGAM RNA, and which when bound by VGAM1262 RNA causes inhibition of translation of respective one or more VGAM1262 host target proteins.

It is further appreciated by one skilled in the art that the mode of translational inhibition illustrated by FIG. 1 with specific reference to translational inhibition exerted by VGAM1262 gene, herein designated VGAM GENE, on one or more VGAM1262 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1262 is inhibition of expression of host target genes, as part of a novel viral mechanism of attacking a host. Accordingly, utilities of VGAM1262 include diagnosis, prevention and treatment of viral infection by Blackcurrant Reversion Virus. Specific functions, and accordingly utilities, of VGAM1262 correlate with, and may be deduced from, the identity of the host target genes which VGAM1262 binds and inhibits, and the function of these host target genes, as elaborated hereinbelow.

Nucleotide sequences of the VGAM1262 precursor RNA, herein designated VGAM PRECURSOR RNA, and of the 'diced' VGAM1262 RNA, herein designated VGAM RNA, and a schematic representation of the secondary folding of VGAM1262 folded precursor RNA, herein designated VGAM FOLDED PRECURSOR RNA, of VGAM1262 are further described hereinbelow with reference to Table 1.

Nucleotide sequences of host target binding sites, such as BINDING SITE-I, BINDING SITE-II and BINDING SITE-III of FIG. 1, found on VGAM1262 host target RNA, and schematic representation of the complementarity of each of these host target binding sites to VGAM1262 RNA, herein designated VGAM RNA, are described hereinbelow with reference to Table 2.

As mentioned hereinabove with reference to FIG. 1, a function of VGAM1262 gene, herein designated VGAM is inhibition of expression of VGAM1262 target genes. It is appreciated that specific functions, and accordingly utilities, of VGAM1262 correlate with, and may be deduced from, the identity of the target genes which VGAM1262 binds and inhibits, and the function of these target genes, as elaborated hereinbelow.

CD28 Antigen (Tp44) (CD28, Accession NM_006139) is a VGAM1262 host target gene. CD28 BINDING SITE is HOST TARGET binding site found in the 3' untranslated region of mRNA encoded by CD28, corresponding to a HOST TARGET binding site such as BINDING SITE I, BINDING SITE II or BINDING SITE III. Table 2 illustrates the complementarity of the nucleotide sequences of CD28 BINDING SITE, designated SEQ ID:12780, to the nucleotide sequence of VGAM1262 RNA, herein designated VGAM RNA, also designated SEQ ID:3973.

A function of VGAM1262 is therefore inhibition of CD28 Antigen (Tp44) (CD28, Accession NM_006139), a gene which possibly involved in t-cell activation. Accordingly, utilities of VGAM1262 include diagnosis, prevention and treatment of diseases and clinical conditions associated with CD28. The function of CD28 and its association with various diseases and clinical conditions, has been established by previous studies, as described hereinabove with reference to VGAM281. LOC148371 (Accession XM_086164) is another VGAM1262 host target gene. LOC148371 BINDING SITE is HOST TARGET binding site found in the 5' untranslated region of mRNA encoded by LOC148371, corresponding to a HOST TARGET binding site such as BINDING SITE I, BINDING SITE II or BINDING SITE III. Table 2 illustrates the complementarity of the nucleotide sequences of LOC148371 BINDING SITE, designated SEQ ID:38525, to the nucleotide sequence of VGAM1262 RNA, herein designated VGAM RNA, also designated SEQ ID:3973.

Another function of VGAM1262 is therefore inhibition of LOC148371 (Accession XM_086164). Accordingly, utilities of VGAM1262 include diagnosis, prevention and treatment of diseases and clinical conditions associated with LOC148371. LOC221838 (Accession XM_166521) is another VGAM1262 host target gene. LOC221838 BINDING SITE is HOST TARGET binding site found in the 5' untranslated region of mRNA encoded by LOC221838, corresponding to a HOST TARGET binding site such as BINDING SITE I, BINDING SITE II or BINDING SITE III. Table 2 illustrates the complementarity of the nucleotide sequences of LOC221838 BINDING SITE, designated SEQ ID:44458, to the nucleotide sequence of VGAM1262 RNA, herein designated VGAM RNA, also designated SEQ ID:3973.

Another function of VGAM1262 is therefore inhibition of LOC221838 (Accession XM_166521). Accordingly, utilities of VGAM1262 include diagnosis, prevention and treatment of diseases and clinical conditions associated with LOC221838. FIG. 1 further provides a conceptual description of a novel bioinformatically detected viral gene of the present invention, referred to here as Viral Genomic Address Messenger 1263 (VGAM1263) viral gene, which modulates expression of respective host target genes thereof, the function and utility of which host target genes is known in the art.

VGAM1263 is a novel bioinformatically detected regulatory, non protein coding, viral micro RNA (miRNA) gene. The method by which VGAM1263 was detected is described hereinabove with reference to FIGS. 1-8.

VGAM1263 gene, herein designated VGAM GENE, is a viral gene contained in the genome of Beet Soil-borne Mosaic Virus. VGAM1263 host target gene, herein designated VGAM HOST TARGET GENE, is a human gene contained in the human genome.

VGAM1263 gene encodes a VGAM1263 precursor RNA, herein designated VGAM PRECURSOR RNA. Similar to other miRNA genes, and unlike most ordinary genes, VGAM1263 precursor RNA does not encode a protein. A nucleotide sequence identical or highly similar to the nucleotide sequence of VGAM1263 precursor RNA is designated SEQ ID:1249, and is provided hereinbelow with reference to the sequence listing part. Nucleotide sequence SEQ ID:1249 is located at position 1764 relative to the genome of Beet Soil-borne Mosaic Virus.

VGAM1263 precursor RNA folds onto itself, forming VGAM1263 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1263 folded precursor RNA into VGAM1263 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1263 RNA is designated SEQ ID:3974, and is provided hereinbelow with reference to the sequence listing part.

VGAM1263 host target gene, herein designated VGAM HOST TARGET GENE, encodes a corresponding messenger RNA, VGAM1263 host target RNA, herein designated VGAM HOST TARGET RNA. VGAM1263 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1263 RNA, herein designated VGAM RNA, binds complementarily to one or more host target binding sites located in untranslated regions of VGAM1263 host target RNA, herein designated VGAM HOST TARGET RNA. This complementary binding is due to the fact that the nucleotide sequence of VGAM1263 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1263 RNA, herein designated VGAM RNA, may have a different number of host target binding sites in untranslated regions of a VGAM1263 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1263 RNA, herein designated VGAM RNA, to host target binding sites on VGAM1263 host target RNA, herein designated VGAM HOST TARGET RNA, such as BINDING SITE I, BINDING SITE II and BINDING SITE III, inhibits translation of VGAM1263 host target RNA into VGAM1263 host target protein, herein designated VGAM HOST TARGET PROTEIN. VGAM host target protein is therefore outlined by a broken line.

It is appreciated that VGAM1263 host target gene, herein designated VGAM HOST TARGET GENE, in fact represents a plurality of VGAM1263 host target genes. The mRNA of each one of this plurality of VGAM1263 host target genes comprises one or more host target binding sites, each having a nucleotide sequence which is at least partly complementary to VGAM1263 RNA, herein designated VGAM RNA, and which when bound by VGAM1263 RNA causes inhibition of translation of respective one or more VGAM1263 host target proteins.

It is further appreciated by one skilled in the art that the mode of translational inhibition illustrated by FIG. 1 with specific reference to translational inhibition exerted by VGAM1263 gene, herein designated VGAM GENE, on one or more VGAM1263 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1263 is inhibition of expression of host target genes, as part of a novel viral mechanism of attacking a host. Accordingly, utilities of VGAM1263 include diagnosis, prevention and treatment of viral infection by Beet Soil-borne Mosaic Virus. Specific functions, and accordingly utilities, of VGAM1263 correlate with, and may be deduced from, the identity of the host target genes which VGAM1263 binds and inhibits, and the function of these host target genes, as elaborated hereinbelow.

Nucleotide sequences of the VGAM1263 precursor RNA, herein designated VGAM PRECURSOR RNA, and of the 'diced' VGAM1263 RNA, herein designated VGAM RNA, and a schematic representation of the secondary folding of VGAM1263 folded precursor RNA, herein designated VGAM FOLDED PRECURSOR RNA, of VGAM1263 are further described hereinbelow with reference to Table 1.

Nucleotide sequences of host target binding sites, such as BINDING SITE-I, BINDING SITE-II and BINDING SITE-III of FIG. 1, found on VGAM1263 host target RNA, and schematic representation of the complementarity of each of these host target binding sites to VGAM1263 RNA, herein designated VGAM RNA, are described hereinbelow with reference to Table 2.

As mentioned hereinabove with reference to FIG. 1, a function of VGAM1263 gene, herein designated VGAM is inhibition of expression of VGAM1263 target genes. It is appreciated that specific functions, and accordingly utilities, of VGAM1263 correlate with, and may be deduced from, the identity of the target genes which VGAM1263 binds and inhibits, and the function of these target genes, as elaborated hereinbelow.

Solute Carrier Family 7 (cationic amino acid transporter, y+ system), Member 8 (SLC7A8, Accession NM_012244) is a VGAM1263 host target gene. SLC7A8 BINDING SITE is HOST TARGET binding site found in the 3' untranslated region of mRNA encoded by SLC7A8, corresponding to a HOST TARGET binding site such as BINDING SITE I, BINDING SITE II or BINDING SITE III. Table 2 illustrates the complementarity of the nucleotide sequences of SLC7A8 BINDING SITE, designated SEQ ID:14552, to the nucleotide sequence of VGAM1263 RNA, herein designated VGAM RNA, also designated SEQ ID:3974.

A function of VGAM1263 is therefore inhibition of Solute Carrier Family 7 (cationic amino acid transporter, y+ system), Member 8 (SLC7A8, Accession NM_012244), a gene which helps mediate transport of large and small neutral amino acids. Accordingly, utilities of VGAM1263 include diagnosis, prevention and treatment of diseases and clinical conditions associated with SLC7A8. The function of SLC7A8 has been established by previous studies. Amino acid transport occurs through several systems, including systems L and y (+)L. System L mediates high-affinity, sodium-independent, and trans-stimulated transport of large zwitterionic amino acids. LAT1 (SLC7A5; 600182), y (+)LAT1 (SLC7A7; 603593), and y (+)LAT2 (SLC7A6; 605641) have been identified as light chains of the heterodimeric cell surface antigen 4F2. These subunits induce amino acid transport activity in association with the heavy chain of 4F2 (MDU1; 158070). By searching an EST database with the amino acid sequence of SLC7A5, Borsani et al. (1999) identified an EST corresponding to SLC7A8, a novel gene that encodes a protein sharing significant sequence identity with SLC7A5.

Full details of the abovementioned studies are described in the following publications, the disclosure of which are hereby incorporated by reference:

Borsani, G.; Bassi, M. T.; Sperandeo, M. P.; De Grandi, A.; Buoninconti, A.; Riboni, M.; Manzoni, M.; Incerti, B.; Pepe, A.; Andria, G.; Ballabio, A.; Sebastio, G.: SLC7A7, encoding a putative permease-related protein, is mutated in patients with lysinuric protein intolerance. Nature Genet. 21:297-301, 1999; and Pineda, M.; Fernandez, E.; Torrents, D.; Estevez, R.; Lopez, C.; Camps, M.; Lloberas, J.; Zorzano, A.; Palacin, M.: Identification of a membrane protein, LAT-2, that co-expresses with 4F2.

Further studies establishing the function and utilities of SLC7A8 are found in John Hopkins OMIM database record ID 604235, and in sited publications numbered 156 and 12054 listed in the bibliography section hereinbelow, which are also hereby incorporated by reference. ERAP140 (Accession XM_059748) is another VGAM1263 host target gene. ERAP140 BINDING SITE is HOST TARGET binding site found in the 3' untranslated region of mRNA encoded by ERAP140, corresponding to a HOST TARGET binding site such as BINDING SITE I, BINDING SITE II or BINDING SITE III. Table 2 illustrates the complementarity of the nucleotide sequences of ERAP140 BINDING SITE, designated SEQ ID:37088, to the nucleotide sequence of VGAM1263 RNA, herein designated VGAM RNA, also designated SEQ ID:3974.

Another function of VGAM1263 is therefore inhibition of ERAP140 (Accession XM_059748). Accordingly, utilities of VGAM1263 include diagnosis, prevention and treatment of diseases and clinical conditions associated with ERAP140. KIAA0865 (Accession XM_028522) is another VGAM1263 host target gene. KIAA0865 BINDING SITE is HOST TARGET binding site found in the 3' untranslated region of mRNA encoded by KIAA0865, corresponding to a HOST TARGET binding site such as BINDING SITE I, BINDING SITE II or BINDING SITE III. Table 2 illustrates the complementarity of the nucleotide sequences of KIAA0865 BINDING SITE, designated SEQ ID:30711, to the nucleotide sequence of VGAM1263 RNA, herein designated VGAM RNA, also designated SEQ ID:3974.

Another function of VGAM1263 is therefore inhibition of KIAA0865 (Accession XM_028522). Accordingly, utilities of VGAM1263 include diagnosis, prevention and treatment of diseases and clinical conditions associated with KIAA0865. KIAA1550 (Accession XM_039393) is another VGAM1263 host target gene. KIAA1550 BINDING SITE is HOST TARGET binding site found in the 3' untranslated region of mRNA encoded by KIAA1550, corresponding to a HOST TARGET binding site such as BINDING SITE I, BINDING SITE II or BINDING SITE III. Table 2 illustrates the complementarity of the nucleotide sequences of KIAA1550 BINDING SITE, designated SEQ ID:33068, to the nucleotide sequence of VGAM1263 RNA, herein designated VGAM RNA, also designated SEQ ID:3974.

Another function of VGAM1263 is therefore inhibition of KIAA1550 (Accession XM_039393). Accordingly, utilities of VGAM1263 include diagnosis, prevention and treatment of diseases and clinical conditions associated with KIAA1550. KIAA1715 (Accession XM_042834) is another VGAM1263 host target gene. KIAA1715 BINDING SITE is HOST TARGET binding site found in the 3' untranslated region of mRNA encoded by KIAA1715, corresponding to a HOST TARGET binding site such as BINDING SITE I, BINDING SITE II or BINDING SITE III. Table 2 illustrates the complementarity of the nucleotide sequences of KIAA1715 BINDING SITE, designated SEQ ID:33790, to the nucleotide sequence of VGAM1263 RNA, herein designated VGAM RNA, also designated SEQ ID:3974.

Another function of VGAM1263 is therefore inhibition of KIAA1715 (Accession XM_042834). Accordingly, utilities of VGAM1263 include diagnosis, prevention and treatment of diseases and clinical conditions associated with KIAA1715. Neuronal Pentraxin Receptor (NPTXR, Accession NM_014293) is another VGAM1263 host target gene. NPTXR BINDING SITE1 and NPTXR BINDING SITE2 are HOST TARGET binding sites found in untranslated regions of mRNA encoded by NPTXR, corresponding to HOST TARGET binding sites such as BINDING SITE I, BINDING SITE II or BINDING SITE III. Table 2 illustrates the complementarity of the nucleotide sequences of NPTXR BINDING SITE1 and NPTXR BINDING SITE2, designated SEQ ID:15582 and SEQ ID:27730 respectively, to the nucleotide sequence of VGAM1263 RNA, herein designated VGAM RNA, also designated SEQ ID:3974.

Another function of VGAM1263 is therefore inhibition of Neuronal Pentraxin Receptor (NPTXR, Accession NM_014293). Accordingly, utilities of VGAM1263 include diagnosis, prevention and treatment of diseases and clinical conditions associated with NPTXR. LOC253891 (Accession XM_170485) is another VGAM1263 host target gene. LOC253891 BINDING SITE is HOST TARGET binding site found in the 3' untranslated region of mRNA encoded by LOC253891, corresponding to a HOST TARGET binding site such as BINDING SITE I, BINDING SITE II or BINDING SITE III. Table 2 illustrates the complementarity of the nucleotide sequences of LOC253891 BINDING SITE, designated SEQ ID:45322, to the nucleotide sequence of VGAM1263 RNA, herein designated VGAM RNA, also designated SEQ ID:3974.

Another function of VGAM1263 is therefore inhibition of LOC253891 (Accession XM_170485). Accordingly, utilities of VGAM1263 include diagnosis, prevention and treatment of diseases and clinical conditions associated with LOC253891. FIG. 1 further provides a conceptual description of a novel bioinformatically detected viral gene of the present invention, referred to here as Viral Genomic Address Messenger 1264 (VGAM1264) viral gene, which modulates expression of respective host target genes thereof, the function and utility of which host target genes is known in the art.

VGAM1264 is a novel bioinformatically detected regulatory, non protein coding, viral micro RNA (miRNA) gene. The method by which VGAM1264 was detected is described hereinabove with reference to FIGS. 1-8.

VGAM1264 gene, herein designated VGAM GENE, is a viral gene contained in the genome of Beet Soil-borne Mosaic Virus. VGAM1264 host target gene, herein designated VGAM HOST TARGET GENE, is a human gene contained in the human genome.

VGAM1264 gene encodes a VGAM1264 precursor RNA, herein designated VGAM PRECURSOR RNA. Similar to other miRNA genes, and unlike most ordinary genes, VGAM1264 precursor RNA does not encode a protein. A nucleotide sequence identical or highly similar to the nucleotide sequence of VGAM1264 precursor RNA is designated SEQ ID:1250, and is provided hereinbelow with reference to the sequence listing part. Nucleotide sequence SEQ ID:1250 is located at position 1403 relative to the genome of Beet Soil-borne Mosaic Virus.

VGAM1264 precursor RNA folds onto itself, forming VGAM1264 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1264 folded precursor RNA into VGAM1264 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1264 RNA is designated SEQ ID:3975, and is provided hereinbelow with reference to the sequence listing part.

VGAM1264 host target gene, herein designated VGAM HOST TARGET GENE, encodes a corresponding messenger RNA, VGAM1264 host target RNA, herein designated VGAM HOST TARGET RNA. VGAM1264 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1264 RNA, herein designated VGAM RNA, binds complementarily to one or more host target binding sites located in untranslated regions of VGAM1264 host target RNA, herein designated VGAM HOST TARGET RNA. This complementary binding is due to the fact that the nucleotide sequence of VGAM1264 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1264 RNA, herein designated VGAM RNA, may have a different number of host target binding sites in untranslated regions of a VGAM1264 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1264 RNA, herein designated VGAM RNA, to host target binding sites on VGAM1264 host target RNA, herein designated VGAM HOST TARGET RNA, such as BINDING SITE I, BINDING SITE II and BINDING SITE III, inhibits translation of VGAM1264 host target RNA into VGAM1264 host target protein, herein designated VGAM HOST TARGET PROTEIN. VGAM host target protein is therefore outlined by a broken line.

It is appreciated that VGAM1264 host target gene, herein designated VGAM HOST TARGET GENE, in fact represents a plurality of VGAM1264 host target genes. The mRNA of each one of this plurality of VGAM1264 host target genes comprises one or more host target binding sites, each having a nucleotide sequence which is at least partly complementary to VGAM1264 RNA, herein designated VGAM RNA, and which when bound by VGAM1264 RNA causes inhibition of translation of respective one or more VGAM1264 host target proteins.

It is further appreciated by one skilled in the art that the mode of translational inhibition illustrated by FIG. 1 with specific reference to translational inhibition exerted by VGAM1264 gene, herein designated VGAM GENE, on one or more VGAM1264 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1264 is inhibition of expression of host target genes, as part of a novel viral mechanism of attacking a host. Accordingly, utilities of VGAM1264 include diagnosis, prevention and treatment of viral infection by Beet Soil-borne Mosaic Virus. Specific functions, and accordingly utilities, of VGAM1264 correlate with, and may be deduced from, the identity of the host target genes which VGAM1264 binds and inhibits, and the function of these host target genes, as elaborated hereinbelow.

Nucleotide sequences of the VGAM1264 precursor RNA, herein designated VGAM PRECURSOR RNA, and of the 'diced' VGAM1264 RNA, herein designated VGAM RNA, and a schematic representation of the secondary folding of VGAM1264 folded precursor RNA, herein designated VGAM FOLDED PRECURSOR RNA, of VGAM1264 are further described hereinbelow with reference to Table 1.

Nucleotide sequences of host target binding sites, such as BINDING SITE-I, BINDING SITE-II and BINDING SITE-III of FIG. 1, found on VGAM1264 host target RNA, and schematic representation of the complementarity of each of these host target binding sites to VGAM1264 RNA, herein designated VGAM RNA, are described hereinbelow with reference to Table 2.

As mentioned hereinabove with reference to FIG. 1, a function of VGAM1264 gene, herein designated VGAM is inhibition of expression of VGAM1264 target genes. It is appreciated that specific functions, and accordingly utilities, of VGAM1264 correlate with, and may be deduced from, the identity of the target genes which VGAM1264 binds and inhibits, and the function of these target genes, as elaborated hereinbelow.

Caspase 8, Apoptosis-related Cysteine Protease (CASP8, Accession NM_033357) is a VGAM1264 host target gene. CASP8 BINDING SITE is HOST TARGET binding site found in the 3' untranslated region of mRNA encoded by CASP8, corresponding to a HOST TARGET binding site such as BINDING SITE I, BINDING SITE II or BINDING SITE III. Table 2 illustrates the complementarity of the nucleotide sequences of CASP8 BINDING SITE, designated SEQ ID:27209, to the nucleotide sequence of VGAM1264 RNA, herein designated VGAM RNA, also designated SEQ ID:3975.

A function of VGAM1264 is therefore inhibition of Caspase 8, Apoptosis-related Cysteine Protease (CASP8, Accession NM_033357), a gene which is an apoptosis-related caspase and an upstream component of Fas receptor and tumor necrosis factor (TNF) receptor-induced apoptosis. Accordingly, utilities of VGAM1264 include diagnosis, prevention and treatment of diseases and clinical conditions associated with CASP8. The function of CASP8 and its association with various diseases and clinical conditions, has been established by previous studies, as described hereinabove with reference to VGAM145. Interferon Regulatory Factor 1 (IRF1, Accession XM_034862) is another VGAM1264 host target gene. IRF1 BINDING SITE is HOST TARGET binding site found in the 3' untranslated region of mRNA encoded by IRF1, corresponding to a HOST TARGET binding site such as BINDING SITE I, BINDING SITE II or BINDING SITE III. Table 2 illustrates the complementarity of the nucleotide sequences of IRF1 BINDING SITE, designated SEQ ID:32175, to the nucleotide sequence of VGAM1264 RNA, herein designated VGAM RNA, also designated SEQ ID:3975.

Another function of VGAM1264 is therefore inhibition of Interferon Regulatory Factor 1 (IRF1, Accession XM_034862), a gene which specifically binds to the upstream regulatory region of type i ifn and ifn-inducible mhc class i genes. Accordingly, utilities of VGAM1264 include diagnosis, prevention and treatment of diseases and clinical conditions associated with IRF1. The function of IRF1 has been established by previous studies. In the course of studies of the regulation of type I interferon gene expression (147660, 147640), Miyamoto et al. (1988) identified a nuclear factor, termed interferon regulatory factor-1 (IRF1), that binds to the upstream cis elements of both the interferon-alpha and the interferon-beta genes. It was found that IRF1 functions as a transcriptional activator for the type I IFN genes (Harada et al., 1990). Harada et al. (1989) found that another factor, IRF2 (OMIM Ref. No. 147576), apparently antagonizes the IRF1 effect by competing for the same cis elements. By linkage studies using RFLPs, the IRF1 gene was assigned to 5q23-q31. To assess the possible role of IRF1 in the regulation of cell growth and differentiation, Yamada et al. (1991) generated transgenic mice carrying the human IRF1 gene, the constitutive expression of which was driven at a high level by the juxtaposed human immunoglobulin heavy-chain enhancer. They found that these transgenic mice showed a dramatic reduction in the number of B lymphocytes. Itoh et al. (1991) also mapped IRF1 to chromosome 5 by analysis of mouse-human somatic cell hybrids. Loss of heterozygosity (LOH) at the IRF1 locus occurs frequently in human gastric cancer (OMIM Ref. No. 137215) (Tamura et al., 1996). Nozawa et al. (1998) identified a point mutation in a human gastric cancer cell line (147575.0001) that changed methionine at codon 8 to leucine and produced an IRF1 protein with reduced transcriptional activity, but unaltered DNA-binding activity. In addition, Harada et al. (1994) had observed alternative splicing of IRF1 mRNA, producing nonfunctional IRF1 protein at high frequencies in patients with myelodysplastic syndrome and acute myelogenous leukemia Animal model experiments lend further support to the function of IRF1. Ko et al. (2002) noted that Irf1 -/- mice are deficient in Inos (OMIM Ref. No. 163730), Il12b (OMIM Ref. No. 161561), Cd8 (see OMIM Ref. No. 186910)-positive T cells, and natural killer (NK) cells, whereas Irf2 -/- mice are deficient in NK cells and have dysregulated Il12b induction. Icsbp (OMIM Ref. No. 601565) -/- mice are deficient in Il12b, Irf2, and reactive oxygen intermediates (ROIs). The Irf1, Irf2, and Icsbp genes are all inducible by gamma-interferon (Ifng; 147570). Irf1-, Irf2-, and Icsbp-deficient mouse strains have varying susceptibility to different intracellular bacterial and protozoan pathogens. Ko et al. (2002) determined that Irf1 -/- mice are highly susceptible to fatal liver damage from Brucella abortus, the causative agent of brucellosis, which manifests as arthritis, endocarditis, and meningitis in human S. In contrast, Irf2 -/- mice are highly resistant to Brucella, whereas Icsbp -/- mice maintain a plateau of infection similar to that seen in Il12b -/- mice. The authors concluded that IL12, reactive nitrogen intermediates, and ROIs are probably crucial immune components in resistance to Brucella infection.

It is appreciated that the abovementioned animal model for IRF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Yamada, G.; Ogawa, M.; Akagi, K.; Miyamoto, H.; Nakano, N.; Itoh, S.; Miyazaki, J.; Nishikawa, S.; Yamamura, K.; Taniguchi, T.: Specific depletion of the B-cell population induced by aberrant expression of human interferon regulatory factor 1 gene in transgenic mice. Proc. Nat. Acad. Sci. 88:532-536, 1991.; and Ko, J.; Gendron-Fitzpatrick, A.; Splitter, G. A.: Susceptibility of IFN regulatory factor-1 and IFN consensus sequence binding protein-deficient mice to brucellosis. J. Immun. 168: 2433.

Further studies establishing the function and utilities of IRF1 are found in John Hopkins OMIM database record ID 147575, and in sited publications numbered 4814, 338 and 3388-3396 listed in the bibliography section hereinbelow, which are also hereby incorporated by reference. Mitogen-activated Protein Kinase 4 (MAPK4, Accession NM_002747) is another VGAM1264 host target gene. MAPK4 BINDING SITE is HOST TARGET binding site found in the 3' untranslated region of mRNA encoded by MAPK4, corresponding to a HOST TARGET binding site such as BINDING SITE I, BINDING SITE II or BINDING SITE III. Table 2 illustrates the complementarity of the nucleotide sequences of MAPK4 BINDING SITE, designated SEQ ID:8623, to the nucleotide sequence of VGAM1264 RNA, herein designated VGAM RNA, also designated SEQ ID:3975.

Another function of VGAM1264 is therefore inhibition of Mitogen-activated Protein Kinase 4 (MAPK4, Accession NM_002747), a gene which phosphorylates microtubule-associated protein-2 may promote entry into the cell cycle. Accordingly, utilities of VGAM1264 include diagnosis, prevention and treatment of diseases and clinical conditions associated with MAPK4. The function of MAPK4 and its association with various diseases and clinical conditions, has been established by previous studies, as described hereinabove with reference to VGAM655. Nuclear Receptor Subfamily 1, Group I, Member 2 (NR1I2, Accession NM_003889) is another VGAM1264 host target gene. NR1I2 BINDING SITE is HOST TARGET binding site found in the 5' untranslated region of mRNA encoded by NR1I2, corresponding to a HOST TARGET binding site such as BINDING SITE I, BINDING SITE II or BINDING SITE III. Table 2 illustrates the complementarity of the nucleotide sequences of NR1I2 BINDING SITE, designated SEQ ID:9974, to the nucleotide sequence of VGAM1264 RNA, herein designated VGAM RNA, also designated SEQ ID:3975.

Another function of VGAM1264 is therefore inhibition of Nuclear Receptor Subfamily 1, Group I, Member 2 (NR1I2, Accession NM_003889), a gene which binds to a response element in the cyp3a4 gene promoter and activates its expression in response to a wide variety of endobiotics and xenobiotics. Accordingly, utilities of VGAM1264 include diagnosis, prevention and treatment of diseases and clinical conditions associated with NR1I2. The function of NR1I2 and its association with various diseases and clinical conditions, has been established by previous studies, as described hereinabove with reference to VGAM336. TEM6 (Accession NM_022748) is another VGAM1264 host target gene. TEM6 BINDING SITE is HOST TARGET binding site found in the 3' untranslated region of mRNA encoded by TEM6, corresponding to a HOST TARGET binding site such as BINDING SITE I, BINDING SITE II or BINDING SITE III. Table 2 illustrates the complementarity of the nucleotide sequences of TEM6 BINDING SITE, designated SEQ ID:22966, to the nucleotide sequence of VGAM1264 RNA, herein designated VGAM RNA, also designated SEQ ID:3975.

Another function of VGAM1264 is therefore inhibition of TEM6 (Accession NM_022748), a gene which displayes elevated expression during tumor angiogenesis. Accordingly, utilities of VGAM1264 include diagnosis, prevention and treatment of diseases and clinical conditions associated with TEM6. The function of TEM6 and its association with various diseases and clinical conditions, has been established by previous studies, as described hereinabove with reference to VGAM175. Zinc Finger Protein 14 (KOX 6) (ZNF14, Accession NM_021030) is another VGAM1264 host target gene. ZNF14 BINDING SITE is HOST TARGET binding site found in the 3' untranslated region of mRNA encoded by ZNF14, corresponding to a HOST TARGET binding site such as BINDING SITE I, BINDING SITE II or BINDING SITE III. Table 2 illustrates the complementarity of the nucleotide sequences of ZNF14 BINDING SITE, designated SEQ ID:22017, to the nucleotide sequence of VGAM1264 RNA, herein designated VGAM RNA, also designated SEQ ID:3975.

Another function of VGAM1264 is therefore inhibition of Zinc Finger Protein 14 (KOX 6) (ZNF14, Accession NM_021030). Accordingly, utilities of VGAM1264 include diagnosis, prevention and treatment of diseases and clinical conditions associated with ZNF14. Chorionic Gonadotropin, Beta Polypeptide 5 (CGB5, Accession NM_033043) is another VGAM1264 host target gene. CGB5 BINDING SITE is HOST TARGET binding site found in the 5' untranslated region of mRNA encoded by CGB5, corresponding to a HOST TARGET binding site such as BINDING SITE I, BINDING SITE II or BINDING SITE III. Table 2 illustrates the complementarity of the nucleotide sequences of CGB5 BINDING SITE, designated SEQ ID:26932, to the nucleotide sequence of VGAM1264 RNA, herein designated VGAM RNA, also designated SEQ ID:3975.

Another function of VGAM1264 is therefore inhibition of Chorionic Gonadotropin, Beta Polypeptide 5 (CGB5, Accession NM_033043). Accordingly, utilities of VGAM1264 include diagnosis, prevention and treatment of diseases and clinical conditions associated with CGB5. DKFZp434M0331 (Accession NM_017600) is another VGAM1264 host target gene. DKFZp434M0331 BINDING SITE is HOST TARGET binding site found in the 5' untranslated region of mRNA encoded by DKFZp434M0331, corresponding to a HOST TARGET binding site such as BINDING SITE I, BINDING SITE II or BINDING SITE III. Table 2 illustrates the complementarity of the nucleotide sequences of DKFZp434M0331 BINDING SITE, designated SEQ ID:19074, to the nucleotide sequence of VGAM1264 RNA, herein designated VGAM RNA, also designated SEQ ID:3975.

Another function of VGAM1264 is therefore inhibition of DKFZp434M0331 (Accession NM_017600). Accordingly, utilities of VGAM1264 include diagnosis, prevention and treatment of diseases and clinical conditions associated with DKFZp434M0331. DKFZp547I224 (Accession NM_020221) is another VGAM1264 host target gene. DKFZp547I224 BINDING SITE is HOST TARGET binding site found in the 5' untranslated region of mRNA encoded by DKFZp547I224, corresponding to a HOST TARGET binding site such as BINDING SITE I, BINDING SITE II or BINDING SITE III. Table 2 illustrates the complementarity of the nucleotide sequences of DKFZp547I224 BINDING SITE, designated SEQ ID:21481, to the nucleotide sequence of VGAM1264 RNA, herein designated VGAM RNA, also designated SEQ ID:3975.

Another function of VGAM1264 is therefore inhibition of DKFZp547I224 (Accession NM_020221). Accordingly, utilities of VGAM1264 include diagnosis, prevention and treatment of diseases and clinical conditions associated with DKFZp547I224. FIG. 1 further provides a conceptual description of a novel bioinformatically detected viral gene of the present invention, referred to here as Viral Genomic Address Messenger 1265 (VGAM1265) viral gene, which modulates expression of respective host target genes thereof, the function and utility of which host target genes is known in the art.

VGAM1265 is a novel bioinformatically detected regulatory, non protein coding, viral micro RNA (miRNA) gene. The method by which VGAM1265 was detected is described hereinabove with reference to FIGS. 1-8.

VGAM1265 gene, herein designated VGAM GENE, is a viral gene contained in the genome of Beet Soil-borne Mosaic Virus. VGAM1265 host target gene, herein designated VGAM HOST TARGET GENE, is a human gene contained in the human genome.

VGAM1265 gene encodes a VGAM1265 precursor RNA, herein designated VGAM PRECURSOR RNA. Similar to other miRNA genes, and unlike most ordinary genes, VGAM1265 precursor RNA does not encode a protein. A nucleotide sequence identical or highly similar to the nucleotide sequence of VGAM1265 precursor RNA is designated SEQ ID:1251, and is provided hereinbelow with reference to the sequence listing part. Nucleotide sequence SEQ ID:1251 is located at position 275 relative to the genome of Beet Soil-borne Mosaic Virus.

VGAM1265 precursor RNA folds onto itself, forming VGAM1265 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1265 folded precursor RNA into VGAM1265 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM1265 RNA is designated SEQ ID:3976, and is provided hereinbelow with reference to the sequence listing part.

VGAM1265 host target gene, herein designated VGAM HOST TARGET GENE, encodes a corresponding messenger RNA, VGAM1265 host target RNA, herein designated VGAM HOST TARGET RNA. VGAM1265 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1265 RNA, herein designated VGAM RNA, binds complementarily to one or more host target binding sites located in untranslated regions of VGAM1265 host target RNA, herein designated VGAM HOST TARGET RNA. This complementary binding is due to the fact that the nucleotide sequence of VGAM1265 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1265 RNA, herein designated VGAM RNA, may have a different number of host target binding sites in untranslated regions of a VGAM1265 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1265 RNA, herein designated VGAM RNA, to host target binding sites on VGAM1265 host target RNA, herein designated VGAM HOST TARGET RNA, such as BINDING SITE I, BINDING SITE II and BINDING SITE III, inhibits translation of VGAM1265 host target RNA into VGAM1265 host target protein, herein designated VGAM HOST TARGET PROTEIN. VGAM host target protein is therefore outlined by a broken line.

It is appreciated that VGAM1265 host target gene, herein designated VGAM HOST TARGET GENE, in fact represents a plurality of VGAM1265 host target genes. The mRNA of each one of this plurality of VGAM1265 host target genes comprises one or more host target binding sites, each having a nucleotide sequence which is at least partly complementary to VGAM1265 RNA, herein designated VGAM RNA, and which when bound by VGAM1265 RNA causes inhibition of translation of respective one or more VGAM1265 host target proteins.

It is further appreciated by one skilled in the art that the mode of translational inhibition illustrated by FIG. 1 with specific reference to translational inhibition exerted by VGAM1265 gene, herein designated VGAM GENE, on one or more VGAM1265 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1265 is inhibition of expression of host target genes, as part of a novel viral mechanism of attacking a host. Accordingly, utilities of VGAM1265 include diagnosis, prevention and treatment of viral infection by Beet Soil-borne Mosaic Virus. Specific functions, and accordingly utilities, of VGAM1265 correlate with, and may be deduced from, the identity of the host target genes which VGAM1265 binds and inhibits, and the function of these host target genes, as elaborated hereinbelow.

Nucleotide sequences of the VGAM1265 precursor RNA, herein designated VGAM PRECURSOR RNA, and of the 'diced' VGAM1265 RNA, herein designated VGAM RNA, and a schematic representation of the secondary folding of VGAM1265 folded precursor RNA, herein designated VGAM FOLDED PRECURSOR RNA, of VGAM1265 are further described hereinbelow with reference to Table 1.

Nucleotide sequences of host target binding sites, such as BINDING SITE-I, BINDING SITE-II and BINDING SITE-III of FIG. 1, found on VGAM1265 host target RNA, and schematic representation of the complementarity of each of these host target binding sites to VGAM1265 RNA, herein designated VGAM RNA, are described hereinbelow with reference to Table 2.

As mentioned hereinabove with reference to FIG. 1, a function of VGAM1265 gene, herein designated VGAM is inhibition of expression of VGAM1265 target genes. It is appreciated that specific functions, and accordingly utilities, of VGAM1265 correlate with, and may be deduced from, the identity of the target genes which VGAM1265 binds and inhibits, and the function of these target genes, as elaborated hereinbelow.

UDP-Gal:betaGlcNAc Beta 1,4-Galactosyltransferase, Polypeptide 1 (B4GALT1, Accession NM_001497) is a VGAM1265 host target gene. B4GALT1 BINDING SITE is HOST TARGET binding site found in the 3' untranslated region of mRNA encoded by B4GALT1, corresponding to a HOST TARGET binding site such as BINDING SITE I, BINDING SITE II or BINDING SITE III. Table 2 illustrates the complementarity of the nucleotide sequences of B4GALT1 BINDING SITE, designated SEQ ID:7249, to the nucleotide sequence of VGAM1265 RNA, herein designated VGAM RNA, also designated SEQ ID:3976.

A function of VGAM1265 is therefore inhibition of UDP-Gal:betaGlcNAc Beta 1,4-Galactosyltransferase, Polypeptide 1 (B4GALT1, Accession NM_001497). Accordingly, utilities of VGAM1265 include diagnosis, prevention and treatment of diseases and clinical conditions associated with B4GALT1. Ribosomal Protein L15 (RPL15, Accession NM_002948) is another VGAM1265 host target gene. RPL15 BINDING SITE is HOST TARGET binding site found in the 3' untranslated region of mRNA encoded by RPL15, corresponding to a HOST TARGET binding site such as BINDING SITE I, BINDING SITE II or BINDING SITE III. Table 2 illustrates the complementarity of the nucleotide sequences of RPL15 BINDING SITE, designated SEQ ID:8862, to the nucleotide sequence of VGAM1265 RNA, herein designated VGAM RNA, also designated SEQ ID:3976.

Another function of VGAM1265 is therefore inhibition of Ribosomal Protein L15 (RPL15, Accession NM_002948). Accordingly, utilities of VGAM1265 include diagnosis, prevention and treatment of diseases and clinical conditions associated with RPL15. Syndecan 4 (amphiglycan, ryudocan) (SDC4, Accession NM_002999) is another VGAM1265 host target gene. SDC4 BINDING SITE is HOST TARGET binding site found in the 3' untranslated region of mRNA encoded by SDC4, corresponding to a HOST TARGET binding site such as BINDING SITE I, BINDING SITE II or BINDING SITE III. Table 2 illustrates the complementarity of the nucleotide sequences of SDC4 BINDING SITE, designated SEQ ID:8895, to the nucleotide sequence of VGAM1265 RNA, herein designated VGAM RNA, also designated SEQ ID:3976.

Another function of VGAM1265 is therefore inhibition of Syndecan 4 (amphiglycan, ryudocan) (SDC4, Accession NM_002999), a gene which is a cell surface proteoglycan. Accordingly, utilities of VGAM1265 include diagnosis, prevention and treatment of diseases and clinical conditions associated with SDC4. The function of SDC4 and its association with various diseases and clinical conditions, has been established by previous studies, as described hereinabove with reference to VGAM552. AND-1 (Accession NM_007086) is another VGAM1265 host target gene. AND-1 BINDING SITE is HOST TARGET binding site found in the 3' untranslated region of mRNA encoded by AND-1, corresponding to a HOST TARGET binding site such as BINDING SITE I, BINDING SITE II or BINDING SITE III. Table 2 illustrates the complementarity of the nucleotide sequences of AND-1 BINDING SITE, designated SEQ ID:13956, to the nucleotide sequence of VGAM1265 RNA, herein designated VGAM RNA, also designated SEQ ID:3976.

Another function of VGAM1265 is therefore inhibition of AND-1 (Accession NM_007086). Accordingly, utilities of VGAM1265 include diagnosis, prevention and treatment of diseases and clinical conditions associated with AND-1. Formyltetrahydrofolate Dehydrogenase (FTHFD, Accession NM_012190) is another VGAM1265 host target gene. FTHFD BINDING SITE is HOST TARGET binding site found in the 5' untranslated region of mRNA encoded by FTHFD, corresponding to a HOST TARGET binding site such as BINDING SITE I, BINDING SITE II or BINDING SITE III. Table 2 illustrates the complementarity of the nucleotide sequences of FTHFD BINDING SITE, designated SEQ ID:14480, to the nucleotide sequence of VGAM1265 RNA, herein designated VGAM RNA, also designated SEQ ID:3976.

Another function of VGAM1265 is therefore inhibition of Formyltetrahydrofolate Dehydrogenase (FTHFD, Accession NM_012190). Accordingly, utilities of VGAM1265 include diagnosis, prevention and treatment of diseases and clinical conditions associated with FTHFD. UDP-N-acetyl-alpha-D-galactosamine:polypeptide N-acetylgalactosaminyltransferase 6 (GalNAc-T6) (GALNT6, Accession NM_007210) is another VGAM1265 host target gene. GALNT6 BINDING SITE is HOST TARGET binding site found in the 3' untranslated region of mRNA encoded by GALNT6, corresponding to a HOST TARGET binding site such as BINDING SITE I, BINDING SITE II or BINDING SITE III. Table 2 illustrates the complementarity of the nucleotide sequences of GALNT6 BINDING SITE, designated SEQ ID:14072, to the nucleotide sequence of VGAM1265 RNA, herein designated VGAM RNA, also designated SEQ ID:3976.

Another function of VGAM1265 is therefore inhibition of UDP-N-acetyl-alpha-D-galactosamine:polypeptide N-acetylgalactosaminyltransferase 6 (GalNAc-T6) (GALNT6, Accession NM_007210). Accordingly, utilities of VGAM1265 include diagnosis, prevention and treatment of diseases and clinical conditions associated with GALNT6. KIAA0836 (Accession XM_035390) is another VGAM1265 host target gene. KIAA0836 BINDING SITE is HOST TARGET binding site found in the 3' untranslated region of mRNA encoded by KIAA0836, corresponding to a HOST TARGET binding site such as BINDING SITE I, BINDING SITE II or BINDING SITE III. Table 2 illustrates the complementarity of the nucleotide sequences of KIAA0836 BINDING SITE, designated SEQ ID:32250, to the nucleotide sequence of VGAM1265 RNA, herein designated VGAM RNA, also designated SEQ ID:3976.

Another function of VGAM1265 is therefore inhibition of KIAA0836 (Accession XM_035390). Accordingly, utilities of VGAM1265 include diagnosis, prevention and treatment of diseases and clinical conditions associated with KIAA0836. KIAA1322 (Accession XM_052626) is another VGAM1265 host target gene. KIAA1322 BINDING SITE is HOST TARGET binding site found in the 3' untranslated region of mRNA encoded by KIAA1322, corresponding to a HOST TARGET binding site such as BINDING SITE I, BINDING SITE II or BINDING SITE III. Table 2 illustrates the complementarity of the nucleotide sequences of KIAA1322 BINDING SITE, designated SEQ ID:36029, to the nucleotide sequence of VGAM1265 RNA, herein designated VGAM RNA, also designated SEQ ID:3976.

Another function of VGAM1265 is therefore inhibition of KIAA1322 (Accession XM_052626). Accordingly, utilities of VGAM1265 include diagnosis, prevention and treatment of diseases and clinical conditions associated with KIAA1322. Oxysterol Binding Protein-like 5 (OSBPL5, Accession XM_052567) is another VGAM1265 host target gene. OSBPL5 BINDING SITE is HOST TARGET binding site found in the 3' untranslated region of mRNA encoded by OSBPL5, corresponding to a HOST TARGET binding site such as BINDING SITE I, BINDING SITE II or BINDING SITE III. Table 2 illustrates the complementarity of the nucleotide sequences of OSBPL5 BINDING SITE, designated SEQ ID:35992, to the nucleotide sequence of VGAM1265 RNA, herein designated VGAM RNA, also designated SEQ ID:3976.

Another function of VGAM1265 is therefore inhibition of Oxysterol Binding Protein-like 5 (OSBPL5, Accession XM_052567). Accordingly, utilities of VGAM1265 include diagnosis, prevention and treatment of diseases and clinical conditions associated with OSBPL5. p25 (Accession NM_007030) is another VGAM1265 host target gene. p25 BINDING SITE is HOST TARGET binding site found in the 3' untranslated region of mRNA encoded by p25, corresponding to a HOST TARGET binding site such as BINDING SITE I, BINDING SITE II or BINDING SITE III. Table 2 illustrates the complementarity of the nucleotide sequences of p25 BINDING SITE, designated SEQ ID:13894, to the nucleotide sequence of VGAM1265 RNA, herein designated VGAM RNA, also designated SEQ ID:3976.

Another function of VGAM1265 is therefore inhibition of p25 (Accession NM_007030). Accordingly, utilities of VGAM1265 include diagnosis, prevention and treatment of diseases and clinical conditions associated with p25. RAGB (Accession NM_016656) is another VGAM1265 host target gene. RAGB BINDING SITE is HOST TARGET binding site found in the 5' untranslated region of mRNA encoded by RAGB, corresponding to a HOST TARGET binding site such as BINDING SITE I, BINDING SITE II or BINDING SITE III. Table 2 illustrates the complementarity of the nucleotide sequences of RAGB BINDING SITE, designated SEQ ID:18780, to the nucleotide sequence of VGAM1265 RNA, herein designated VGAM RNA, also designated SEQ ID:3976.

Another function of VGAM1265 is therefore inhibition of RAGB (Accession NM_016656). Accordingly, utilities of VGAM1265 include diagnosis, prevention and treatment of diseases and clinical conditions associated with RAGB. LOC148114 (Accession XM_086050) is another VGAM1265 host target gene. LOC148114 BINDING SITE is HOST TARGET binding site found in the 5' untranslated region of mRNA encoded by LOC148114, corresponding to a HOST TARGET binding site such as BINDING SITE I, BINDING SITE II or BINDING SITE III. Table 2 illustrates the complementarity of the nucleotide sequences of LOC148114 BINDING SITE, designated SEQ ID:38469, to the nucleotide sequence of VGAM1265 RNA, herein designated VGAM RNA, also designated SEQ ID:3976.

Another function of VGAM1265 is therefore inhibition of LOC148114 (Accession XM_086050). Accordingly, utilities of VGAM1265 include diagnosis, prevention and treatment of diseases and clinical conditions associated with LOC148114. LOC152641 (Accession XM_087497) is another VGAM1265 host target gene. LOC152641 BINDING SITE is HOST TARGET binding site found in the 3' untranslated region of mRNA encoded by LOC152641, corresponding to a HOST TARGET binding site such as BINDING SITE I, BINDING SITE II or BINDING SITE III. Table 2 illustrates the complementarity of the nucleotide sequences of LOC152641 BINDING SITE, designated SEQ ID:39299, to the nucleotide sequence of VGAM1265 RNA, herein designated VGAM RNA, also designated SEQ ID:3976.

Another function of VGAM1265 is therefore inhibition of LOC152641 (Accession XM_087497). Accordingly, utilities of VGAM1265 include diagnosis, prevention and treatment of diseases and clinical conditions associated with LOC152641. LOC51696 (Accession NM_016217) is another VGAM1265 host target gene. LOC51696 BINDING SITE is HOST TARGET binding site found in the 3' untranslated region of mRNA encoded by LOC51696, corresponding to a HOST TARGET binding site such as BINDING SITE I, BINDING SITE II or BINDING SITE III. Table 2 illustrates the complementarity of the nucleotide sequences of LOC51696 BINDING SITE, designated SEQ ID:18313, to the nucleotide sequence of VGAM1265 RNA, herein designated VGAM RNA, also designated SEQ ID:3976.

Another function of VGAM1265 is therefore inhibition of LOC51696 (Accession NM_016217). Accordingly, utilities of VGAM1265 include diagnosis, prevention and treatment of diseases and clinical conditions associated with LOC51696. FIG. 1 further provides a conceptual description of a novel bioinformatically detected viral gene of the present invention, referred to here as Viral Genomic Address Messenger 1266 (VGAM1266) viral gene, which modulates expression of respective host target genes thereof, the function and utility of which host target genes is known in the art.

VGAM1266 is a novel bioinformatically detected regulatory, non protein coding, viral micro RNA (miRNA) gene. The method by which VGAM1266 was detected is described hereinabove with reference to FIGS. 1-8.

VGAM1266 gene, herein designated VGAM GENE, is a viral gene contained in the genome of Beet Soil-borne Mosaic Virus. VGAM1266 host target gene, herein designated VGAM HOST TARGET GENE, is a human gene contained in the human genome.

VGAM1266 gene encodes a VGAM1266 precursor RNA, herein designated VGAM PRECURSOR RNA. Similar to other miRNA genes, and unlike most ordinary genes, VGAM1266 precursor RNA does not encode a protein. A nucleotide sequence identical or highly similar to the nucleotide sequence of VGAM1266 precursor RNA is designated SEQ ID:1252, and is provided hereinbelow with reference to the sequence listing part. Nucleotide sequence SEQ ID:1252 is located at position 1065 relative to the genome of Beet Soil-borne Mosaic Virus.

VGAM1266 precursor RNA folds onto itself, forming VGAM1266 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1266 folded precursor RNA into VGAM1266 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM1266 RNA is designated SEQ ID:3977, and is provided hereinbelow with reference to the sequence listing part.

VGAM1266 host target gene, herein designated VGAM HOST TARGET GENE, encodes a corresponding messenger RNA, VGAM1266 host target RNA, herein designated VGAM HOST TARGET RNA. VGAM1266 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1266 RNA, herein designated VGAM RNA, binds complementarily to one or more host target binding sites located in untranslated regions of VGAM1266 host target RNA, herein designated VGAM HOST TARGET RNA. This complementary binding is due to the fact that the nucleotide sequence of VGAM1266 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1266 RNA, herein designated VGAM RNA, may have a different number of host target binding sites in untranslated regions of a VGAM1266 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1266 RNA, herein designated VGAM RNA, to host target binding sites on VGAM1266 host target RNA, herein designated VGAM HOST TARGET RNA, such as BINDING SITE I, BINDING SITE II and BINDING SITE III, inhibits translation of VGAM1266 host target RNA into VGAM1266 host target protein, herein designated VGAM HOST TARGET PROTEIN. VGAM host target protein is therefore outlined by a broken line.

It is appreciated that VGAM1266 host target gene, herein designated VGAM HOST TARGET GENE, in fact represents a plurality of VGAM1266 host target genes. The mRNA of each one of this plurality of VGAM1266 host target genes comprises one or more host target binding sites, each having a nucleotide sequence which is at least partly complementary to VGAM1266 RNA, herein designated VGAM RNA, and which when bound by VGAM1266 RNA causes inhibition of translation of respective one or more VGAM1266 host target proteins.

It is further appreciated by one skilled in the art that the mode of translational inhibition illustrated by FIG. 1 with specific reference to translational inhibition exerted by VGAM1266 gene, herein designated VGAM GENE, on one or more VGAM1266 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1266 is inhibition of expression of host target genes, as part of a novel viral mechanism of attacking a host. Accordingly, utilities of VGAM1266 include diagnosis, prevention and treatment of viral infection by Beet Soil-borne Mosaic Virus. Specific functions, and accordingly utilities, of VGAM1266 correlate with, and may be deduced from, the identity of the host target genes which VGAM1266 binds and inhibits, and the function of these host target genes, as elaborated hereinbelow.

Nucleotide sequences of the VGAM1266 precursor RNA, herein designated VGAM PRECURSOR RNA, and of the 'diced' VGAM1266 RNA, herein designated VGAM RNA, and a schematic representation of the secondary folding of VGAM1266 folded precursor RNA, herein designated VGAM FOLDED PRECURSOR RNA, of VGAM1266 are further described hereinbelow with reference to Table 1.

Nucleotide sequences of host target binding sites, such as BINDING SITE-I, BINDING SITE-II and BINDING SITE-III of FIG. 1, found on VGAM1266 host target RNA, and schematic representation of the complementarity of each of these host target binding sites to VGAM1266 RNA, herein designated VGAM RNA, are described hereinbelow with reference to Table 2.

As mentioned hereinabove with reference to FIG. 1, a function of VGAM1266 gene, herein designated VGAM is inhibition of expression of VGAM1266 target genes. It is appreciated that specific functions, and accordingly utilities, of VGAM1266 correlate with, and may be deduced from, the identity of the target genes which VGAM1266 binds and inhibits, and the function of these target genes, as elaborated hereinbelow.

CAPON (Accession XM_034002) is a VGAM1266 host target gene. CAPON BINDING SITE is HOST TARGET binding site found in the 3' untranslated region of mRNA encoded by CAPON, corresponding to a HOST TARGET binding site such as BINDING SITE I, BINDING SITE II or BINDING SITE III. Table 2 illustrates the complementarity of the nucleotide sequences of CAPON BINDING SITE, designated SEQ ID:31988, to the nucleotide sequence of VGAM1266 RNA, herein designated VGAM RNA, also designated SEQ ID:3977.

A function of VGAM1266 is therefore inhibition of CAPON (Accession XM_034002), a gene which binds to neuronal nitric oxide synthase and leads to a decreased access to NMDA receptor-gated calcium influx and a catalytically inactive enzyme. Accordingly, utilities of VGAM1266 include diagnosis, prevention and treatment of diseases and clinical conditions associated with CAPON. The function of CAPON has been established by previous studies. Using the first 377 amino acids of neuronal nitric oxide synthase (nNOS; 163731) as bait in a yeast 2-hybrid screen, Jaffrey et al. (1998) isolated cDNAs encoding CAPON. CAPON appears to have 2 alternate splice forms, one encoding a 125-amino acid protein and the other encoding a 327-amino acid protein. The 125-amino acid C-terminal fragment of CAPON specifically interacted with nNOS in a 2-hybrid system. The full-length cDNA produces a 503-amino acid protein. CAPON displayed no significant homology to any other class of protein except for an N-terminal 145-amino acid stretch that has residues suggestive of a phosphotyrosine-binding (PTB) domain. Northern blot analysis detected a predominant 7.5-kb transcript only in brain regions, with no expression evident in adrenal, bladder, heart, kidney, lung, and skeletal muscle. Marked regional variations occurred in brain, with highest density in the cerebral cortex and medulla oblongata and lowest levels in the hippocampus. CAPON and nNOS interacted in vivo and in vitro and colocalized in rat brain. CAPON was found to compete with PSD95 (OMIM Ref. No. 602887) for interaction with nNOS, and overexpression of CAPON resulted in a loss of PSD95-nNOS complexes in transfected cells. Jaffrey et al. (1998) concluded that CAPON may influence nNOS by regulating its ability to associate with PSD95-NMDA receptor complexes. They proposed a model of PSD95-nNOS regulation by CAPON in which NMDA receptors are coupled to nNOS through a PSD95 multimer; these interactions are mediated by PDZ domains. In this complex, nNOS is situated close to NMDA receptor-modulated calcium influx. Binding of CAPON results in the reduction of NMDA receptor-PSD95-nNOS complexes, leading to a decreased access to NMDA receptor-gated calcium influx and a catalytically inactive enzyme. Seki et al. (1997) mapped the CAPON gene, which they called KIAA0464, to chromosome 1 by radiation hybrid analysis.

Full details of the abovementioned studies are described in the following publications, the disclosure of which are hereby incorporated by reference:

Jaffrey, S. R.; Snowman, A. M.; Eliasson, M. J. L.; Cohen, N. A.; Snyder, S. H.: CAPON: a protein associated with neuronal nitric oxide synthase that regulates its interactions with PSD95. Neuron 115-124, 1998; and Seki, N.; Ohira, M.; Nagase, T.; Ishikawa, K.; Miyajima, N.; Nakajima, D.; Nomura, N.; Ohara, O.: Characterization of cDNA clones in size-fractionated cDNA libraries from human brain.

Further studies establishing the function and utilities of CAPON are found in John Hopkins OMIM database record ID 605551, and in sited publications numbered 6405 listed in the bibliography section hereinbelow, which are also hereby incorporated by reference. Epidermal Growth Factor Receptor (erythroblastic leukemia viral (v-erb-b) Oncogene Homolog, Avian) (EGFR, Accession NM_005228) is another VGAM1266 host target gene. EGFR BINDING SITE is HOST TARGET binding site found in the 3' untranslated region of mRNA encoded by EGFR, corresponding to a HOST TARGET binding site such as BINDING SITE I, BINDING SITE II or BINDING SITE III. Table 2 illustrates the complementarity of the nucleotide sequences of EGFR BINDING SITE, designated SEQ ID:11723, to the nucleotide sequence of VGAM1266 RNA, herein designated VGAM RNA, also designated SEQ ID:3977.

Another function of VGAM1266 is therefore inhibition of Epidermal Growth Factor Receptor (erythroblastic leukemia viral (v-erb-b) Oncogene Homolog, Avian) (EGFR, Accession NM_005228), a gene which is a receptor for egf, but also for other members of the egf family. Accordingly, utilities of VGAM1266 include diagnosis, prevention and treatment of diseases and clinical conditions associated with EGFR. The function of EGFR and its association with various diseases and clinical conditions, has been established by previous studies, as described hereinabove with reference to VGAM229. Interleukin 18 Receptor 1 (IL18R1, Accession NM_003855) is another VGAM1266 host target gene. IL18R1 BINDING SITE is HOST TARGET binding site found in the 3' untranslated region of mRNA encoded by IL18R1, corresponding to a HOST TARGET binding site such as BINDING SITE I, BINDING SITE II or BINDING SITE III. Table 2 illustrates the complementarity of the nucleotide sequences of IL18R1 BINDING SITE, designated SEQ ID:9949, to the nucleotide sequence of VGAM1266 RNA, herein designated VGAM RNA, also designated SEQ ID:3977.

Another function of VGAM1266 is therefore inhibition of Interleukin 18 Receptor 1 (IL18R1, Accession NM_003855), a gene which is required for dorsal-ventral embryonic polarity and promotes heterophilic cellular adhesion. Accordingly, utilities of VGAM1266 include diagnosis, prevention and treatment of diseases and clinical conditions associated with IL18R1. The function of IL18R1 and its association with various diseases and clinical conditions, has been established by previous studies, as described hereinabove with reference to VGAM37. FLJ10081 (Accession NM_017991) is another VGAM1266 host target gene. FLJ10081 BINDING SITE is HOST TARGET binding site found in the 3' untranslated region of mRNA encoded by FLJ10081, corresponding to a HOST TARGET binding site such as BINDING SITE I, BINDING SITE II or BINDING SITE III. Table 2 illustrates the complementarity of the nucleotide sequences of FLJ10081 BINDING SITE, designated SEQ ID:19723, to the nucleotide sequence of VGAM1266 RNA, herein designated VGAM RNA, also designated SEQ ID:3977.

Another function of VGAM1266 is therefore inhibition of FLJ10081 (Accession NM_017991). Accordingly, utilities of VGAM1266 include diagnosis, prevention and treatment of diseases and clinical conditions associated with FLJ10081. FLJ10511 (Accession NM_018120) is another VGAM1266 host target gene. FLJ10511 BINDING SITE is HOST TARGET binding site found in the 3' untranslated region of mRNA encoded by FLJ10511, corresponding to a HOST TARGET binding site such as BINDING SITE I, BINDING SITE II or BINDING SITE III. Table 2 illustrates the complementarity of the nucleotide sequences of FLJ10511 BINDING SITE, designated SEQ ID:19899, to the nucleotide sequence of VGAM1266 RNA, herein designated VGAM RNA, also designated SEQ ID:3977.

Another function of VGAM1266 is therefore inhibition of FLJ10511 (Accession NM_018120). Accordingly, utilities of VGAM1266 include diagnosis, prevention and treatment of diseases and clinical conditions associated with FLJ10511. KIAA0426 (Accession NM_014724) is another VGAM1266 host target gene. KIAA0426 BINDING SITE is HOST TARGET binding site found in the 3' untranslated region of mRNA encoded by KIAA0426, corresponding to a HOST TARGET binding site such as BINDING SITE I, BINDING SITE II or BINDING SITE III. Table 2 illustrates the complementarity of the nucleotide sequences of KIAA0426 BINDING SITE, designated SEQ ID:16308, to the nucleotide sequence of VGAM1266 RNA, herein designated VGAM RNA, also designated SEQ ID:3977.

Another function of VGAM1266 is therefore inhibition of KIAA0426 (Accession NM_014724). Accordingly, utilities of VGAM1266 include diagnosis, prevention and treatment of diseases and clinical conditions associated with KIAA0426. LOC150577 (Accession XM_097918) is another VGAM1266 host target gene. LOC150577 BINDING SITE is HOST TARGET binding site found in the 5' untranslated region of mRNA encoded by LOC150577, corresponding to a HOST TARGET binding site such as BINDING SITE I, BINDING SITE II or BINDING SITE III. Table 2 illustrates the complementarity of the nucleotide sequences of LOC150577 BINDING SITE, designated SEQ ID:41219, to the nucleotide sequence of VGAM1266 RNA, herein designated VGAM RNA, also designated SEQ ID:3977.

Another function of VGAM1266 is therefore inhibition of LOC150577 (Accession XM_097918). Accordingly, utilities of VGAM1266 include diagnosis, prevention and treatment of diseases and clinical conditions associated with LOC150577. FIG. 1 further provides a conceptual description of a novel bioinformatically detected viral gene of the present invention, referred to here as Viral Genomic Address Messenger 1267 (VGAM1267) viral gene, which modulates expression of respective host target genes thereof, the function and utility of which host target genes is known in the art.

VGAM1267 is a novel bioinformatically detected regulatory, non protein coding, viral micro RNA (miRNA) gene. The method by which VGAM1267 was detected is described hereinabove with reference to FIGS. 1-8.

VGAM1267 gene, herein designated VGAM GENE, is a viral gene contained in the genome of Beet Soil-borne Mosaic Virus. VGAM1267 host target gene, herein designated VGAM HOST TARGET GENE, is a human gene contained in the human genome.

VGAM1267 gene encodes a VGAM1267 precursor RNA, herein designated VGAM PRECURSOR RNA. Similar to other miRNA genes, and unlike most ordinary genes, VGAM1267 precursor RNA does not encode a protein. A nucleotide sequence identical or highly similar to the nucleotide sequence of VGAM1267 precursor RNA is designated SEQ ID:1253, and is provided hereinbelow with reference to the sequence listing part. Nucleotide sequence SEQ ID:1253 is located at position 1249 relative to the genome of Beet Soil-borne Mosaic Virus.

VGAM1267 precursor RNA folds onto itself, forming VGAM1267 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1267 folded precursor RNA into VGAM1267 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1267 RNA is designated SEQ ID:3978, and is provided hereinbelow with reference to the sequence listing part.

VGAM1267 host target gene, herein designated VGAM HOST TARGET GENE, encodes a corresponding messenger RNA, VGAM1267 host target RNA, herein designated VGAM HOST TARGET RNA. VGAM1267 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1267 RNA, herein designated VGAM RNA, binds complementarily to one or more host target binding sites located in untranslated regions of VGAM1267 host target RNA, herein designated VGAM HOST TARGET RNA. This complementary binding is due to the fact that the nucleotide sequence of VGAM1267 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1267 RNA, herein designated VGAM RNA, may have a different number of host target binding sites in untranslated regions of a VGAM1267 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1267 RNA, herein designated VGAM RNA, to host target binding sites on VGAM1267 host target RNA, herein designated VGAM HOST TARGET RNA, such as BINDING SITE I, BINDING SITE II and BINDING SITE III, inhibits translation of VGAM1267 host target RNA into VGAM1267 host target protein, herein designated VGAM HOST TARGET PROTEIN. VGAM host target protein is therefore outlined by a broken line.

It is appreciated that VGAM1267 host target gene, herein designated VGAM HOST TARGET GENE, in fact represents a plurality of VGAM1267 host target genes. The mRNA of each one of this plurality of VGAM1267 host target genes comprises one or more host target binding sites, each having a nucleotide sequence which is at least partly complementary to VGAM1267 RNA, herein designated VGAM RNA, and which when bound by VGAM1267 RNA causes inhibition of translation of respective one or more VGAM1267 host target proteins.

It is further appreciated by one skilled in the art that the mode of translational inhibition illustrated by FIG. 1 with specific reference to translational inhibition exerted by VGAM1267 gene, herein designated VGAM GENE, on one or more VGAM1267 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1267 is inhibition of expression of host target genes, as part of a novel viral mechanism of attacking a host. Accordingly, utilities of VGAM1267 include diagnosis, prevention and treatment of viral infection by Beet Soil-borne Mosaic Virus. Specific functions, and accordingly utilities, of VGAM1267 correlate with, and may be deduced from, the identity of the host target genes which VGAM1267 binds and inhibits, and the function of these host target genes, as elaborated hereinbelow.

Nucleotide sequences of the VGAM1267 precursor RNA, herein designated VGAM PRECURSOR RNA, and of the 'diced' VGAM1267 RNA, herein designated VGAM RNA, and a schematic representation of the secondary folding of VGAM1267 folded precursor RNA, herein designated VGAM FOLDED PRECURSOR RNA, of VGAM1267 are further described hereinbelow with reference to Table 1.

Nucleotide sequences of host target binding sites, such as BINDING SITE-I, BINDING SITE-II and BINDING SITE-III of FIG. 1, found on VGAM1267 host target RNA, and schematic representation of the complementarity of each of these host target binding sites to VGAM1267 RNA, herein designated VGAM RNA, are described hereinbelow with reference to Table 2.

As mentioned hereinabove with reference to FIG. 1, a function of VGAM1267 gene, herein designated VGAM is inhibition of expression of VGAM1267 target genes. It is appreciated that specific functions, and accordingly utilities, of VGAM1267 correlate with, and may be deduced from, the identity of the target genes which VGAM1267 binds and inhibits, and the function of these target genes, as elaborated hereinbelow.

Collagen, Type IV, Alpha 6 (COL4A6, Accession NM_001847) is a VGAM1267 host target gene. COL4A6 BINDING SITE1 and COL4A6 BINDING SITE2 are HOST TARGET binding sites found in untranslated regions of mRNA encoded by COL4A6, corresponding to HOST TARGET binding sites such as BINDING SITE I, BINDING SITE II or BINDING SITE III. Table 2 illustrates the complementarity of the nucleotide sequences of COL4A6 BINDING SITE1 and COL4A6 BINDING SITE2, designated SEQ ID:7582 and SEQ ID:27358 respectively, to the nucleotide sequence of VGAM1267 RNA, herein designated VGAM RNA, also designated SEQ ID:3978.

A function of VGAM1267 is therefore inhibition of Collagen, Type IV, Alpha 6 (COL4A6, Accession NM_001847). Accordingly, utilities of VGAM1267 include diagnosis, prevention and treatment of diseases and clinical conditions associated with COL4A6. LOC148756 (Accession XM_097516) is another VGAM1267 host target gene. LOC148756 BINDING SITE is HOST TARGET binding site found in the 3' untranslated region of mRNA encoded by LOC148756, corresponding to a HOST TARGET binding site such as BINDING SITE I, BINDING SITE II or BINDING SITE III. Table 2 illustrates the complementarity of the nucleotide sequences of LOC148756 BINDING SITE, designated SEQ ID:40901, to the nucleotide sequence of VGAM1267 RNA, herein designated VGAM RNA, also designated SEQ ID:3978.

Another function of VGAM1267 is therefore inhibition of LOC148756 (Accession XM_097516). Accordingly, utilities of VGAM1267 include diagnosis, prevention and treatment of diseases and clinical conditions associated with LOC148756. LOC151405 (Accession XM_098058) is another VGAM1267 host target gene. LOC151405 BINDING SITE is HOST TARGET binding site found in the 5' untranslated region of mRNA encoded by LOC151405, corresponding to a HOST TARGET binding site such as BINDING SITE I, BINDING SITE II or BINDING SITE III. Table 2 illustrates the complementarity of the nucleotide sequences of LOC151405 BINDING SITE, designated SEQ ID:41337, to the nucleotide sequence of VGAM1267 RNA, herein designated VGAM RNA, also designated SEQ ID:3978.

Another function of VGAM1267 is therefore inhibition of LOC151405 (Accession XM_098058). Accordingly, utilities of VGAM1267 include diagnosis, prevention and treatment of diseases and clinical conditions associated with LOC151405. LOC221061 (Accession XM_167709) is another VGAM1267 host target gene. LOC221061 BINDING SITE is HOST TARGET binding site found in the 3' untranslated region of mRNA encoded by LOC221061, corresponding to a HOST TARGET binding site such as BINDING SITE I, BINDING SITE II or BINDING SITE III. Table 2 illustrates the complementarity of the nucleotide sequences of LOC221061 BINDING SITE, designated SEQ ID:44770, to the nucleotide sequence of VGAM1267 RNA, herein designated VGAM RNA, also designated SEQ ID:3978.

Another function of VGAM1267 is therefore inhibition of LOC221061 (Accession XM_167709). Accordingly, utilities of VGAM1267 include diagnosis, prevention and treatment of diseases and clinical conditions associated with LOC221061. FIG. 1 further provides a conceptual description of a novel bioinformatically detected viral gene of the present invention, referred to here as Viral Genomic Address Messenger 1268 (VGAM1268) viral gene, which modulates expression of respective host target genes thereof, the function and utility of which host target genes is known in the art.

VGAM1268 is a novel bioinformatically detected regulatory, non protein coding, viral micro RNA (miRNA) gene. The method by which VGAM1268 was detected is described hereinabove with reference to FIGS. 1-8.

VGAM1268 gene, herein designated VGAM GENE, is a viral gene contained in the genome of Grapevine Virus A. VGAM1268 host target gene, herein designated VGAM HOST TARGET GENE, is a human gene contained in the human genome.

VGAM1268 gene encodes a VGAM1268 precursor RNA, herein designated VGAM PRECURSOR RNA. Similar to other miRNA genes, and unlike most ordinary genes, VGAM1268 precursor RNA does not encode a protein. A nucleotide sequence identical or highly similar to the nucleotide sequence of VGAM1268 precursor RNA is designated SEQ ID:1254, and is provided hereinbelow with reference to the sequence listing part. Nucleotide sequence SEQ ID:1254 is located at position 6970 relative to the genome of Grapevine Virus A.

VGAM1268 precursor RNA folds onto itself, forming VGAM1268 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1268 folded precursor RNA into VGAM1268 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1268 RNA is designated SEQ ID:3979, and is provided hereinbelow with reference to the sequence listing part.

VGAM1268 host target gene, herein designated VGAM HOST TARGET GENE, encodes a corresponding messenger RNA, VGAM1268 host target RNA, herein designated VGAM HOST TARGET RNA. VGAM1268 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1268 RNA, herein designated VGAM RNA, binds complementarily to one or more host target binding sites located in untranslated regions of VGAM1268 host target RNA, herein designated VGAM HOST TARGET RNA. This complementary binding is due to the fact that the nucleotide sequence of VGAM1268 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1268 RNA, herein designated VGAM RNA, may have a different number of host target binding sites in untranslated regions of a VGAM1268 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1268 RNA, herein designated VGAM RNA, to host target binding sites on VGAM1268 host target RNA, herein designated VGAM HOST TARGET RNA, such as BINDING SITE I, BINDING SITE II and BINDING SITE III, inhibits translation of VGAM1268 host target RNA into VGAM1268 host target protein, herein designated VGAM HOST TARGET PROTEIN. VGAM host target protein is therefore outlined by a broken line.

It is appreciated that VGAM1268 host target gene, herein designated VGAM HOST TARGET GENE, in fact represents a plurality of VGAM1268 host target genes. The mRNA of each one of this plurality of VGAM1268 host target genes comprises one or more host target binding sites, each having a nucleotide sequence which is at least partly complementary to VGAM1268 RNA, herein designated VGAM RNA, and which when bound by VGAM1268 RNA causes inhibition of translation of respective one or more VGAM1268 host target proteins.

It is further appreciated by one skilled in the art that the mode of translational inhibition illustrated by FIG. 1 with specific reference to translational inhibition exerted by VGAM1268 gene, herein designated VGAM GENE, on one or more VGAM1268 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1268 is inhibition of expression of host target genes, as part of a novel viral mechanism of attacking a host. Accordingly, utilities of VGAM1268 include diagnosis, prevention and treatment of viral infection by Grapevine Virus A. Specific functions, and accordingly utilities, of VGAM1268 correlate with, and may be deduced from, the identity of the host target genes which VGAM1268 binds and inhibits, and the function of these host target genes, as elaborated hereinbelow.

Nucleotide sequences of the VGAM1268 precursor RNA, herein designated VGAM PRECURSOR RNA, and of the 'diced' VGAM1268 RNA, herein designated VGAM RNA, and a schematic representation of the secondary folding of VGAM1268 folded precursor RNA, herein designated VGAM FOLDED PRECURSOR RNA, of VGAM1268 are further described hereinbelow with reference to Table 1.

Nucleotide sequences of host target binding sites, such as BINDING SITE-I, BINDING SITE-II and BINDING SITE-III of FIG. 1, found on VGAM1268 host target RNA, and schematic representation of the complementarity of each of these host target binding sites to VGAM1268 RNA, herein designated VGAM RNA, are described hereinbelow with reference to Table 2.

As mentioned hereinabove with reference to FIG. 1, a function of VGAM1268 gene, herein designated VGAM is inhibition of expression of VGAM1268 target genes. It is appreciated that specific functions, and accordingly utilities, of VGAM1268 correlate with, and may be deduced from, the identity of the target genes which VGAM1268 binds and inhibits, and the function of these target genes, as elaborated hereinbelow.

RNA Binding Motif Protein 3 (RBM3, Accession XM_047024) is a VGAM1268 host target gene. RBM3 BINDING SITE is HOST TARGET binding site found in the 5' untranslated region of mRNA encoded by RBM3, corresponding to a HOST TARGET binding site such as BINDING SITE I, BINDING SITE II or BINDING SITE III. Table 2 illustrates the complementarity of the nucleotide sequences of RBM3 BINDING SITE, designated SEQ ID:34893, to the nucleotide sequence of VGAM1268 RNA, herein designated VGAM RNA, also designated SEQ ID:3979.

A function of VGAM1268 is therefore inhibition of RNA Binding Motif Protein 3 (RBM3, Accession XM_047024). Accordingly, utilities of VGAM1268 include diagnosis, prevention and treatment of diseases and clinical conditions associated with RBM3. KIAA0523 (Accession XM_041964) is another VGAM1268 host target gene. KIAA0523 BINDING SITE is HOST TARGET binding site found in the 3' untranslated region of mRNA encoded by KIAA0523, corresponding to a HOST TARGET binding site such as BINDING SITE I, BINDING SITE II or BINDING SITE III. Table 2 illustrates the complementarity of the nucleotide sequences of KIAA0523 BINDING SITE, designated SEQ ID:33643, to the nucleotide sequence of VGAM1268 RNA, herein designated VGAM RNA, also designated SEQ ID:3979.

Another function of VGAM1268 is therefore inhibition of KIAA0523 (Accession XM_041964). Accordingly, utilities of VGAM1268 include diagnosis, prevention and treatment of diseases and clinical conditions associated with KIAA0523. Proteasome (prosome, macropain) 26S Subunit, Non-ATPase, 10 (PSMD10, Accession NM_002814) is another VGAM1268 host target gene. PSMD10 BINDING SITE is HOST TARGET binding site found in the 3' untranslated region of mRNA encoded by PSMD10, corresponding to a HOST TARGET binding site such as BINDING SITE I, BINDING SITE II or BINDING SITE III. Table 2 illustrates the complementarity of the nucleotide sequences of PSMD10 BINDING SITE, designated SEQ ID:8679, to the nucleotide sequence of VGAM1268 RNA, herein designated VGAM RNA, also designated SEQ ID:3979.

Another function of VGAM1268 is therefore inhibition of Proteasome (prosome, macropain) 26S Subunit, Non-ATPase, 10 (PSMD10, Accession NM_002814). Accordingly, utilities of VGAM1268 include diagnosis, prevention and treatment of diseases and clinical conditions associated with PSMD10. LOC256107 (Accession XM_173003) is another VGAM1268 host target gene. LOC256107 BINDING SITE is HOST TARGET binding site found in the 5' untranslated region of mRNA encoded by LOC256107, corresponding to a HOST TARGET binding site such as BINDING SITE I, BINDING SITE II or BINDING SITE III. Table 2 illustrates the complementarity of the nucleotide sequences of LOC256107 BINDING SITE, designated SEQ ID:46275, to the nucleotide sequence of VGAM1268 RNA, herein designated VGAM RNA, also designated SEQ ID:3979.

Another function of VGAM1268 is therefore inhibition of LOC256107 (Accession XM_173003). Accordingly, utilities of VGAM1268 include diagnosis, prevention and treatment of diseases and clinical conditions associated with LOC256107. FIG. 1 further provides a conceptual description of a novel bioinformatically detected viral gene of the present invention, referred to here as Viral Genomic Address Messenger 1269 (VGAM1269) viral gene, which modulates expression of respective host target genes thereof, the function and utility of which host target genes is known in the art.

VGAM1269 is a novel bioinformatically detected regulatory, non protein coding, viral micro RNA (miRNA) gene. The method by which VGAM1269 was detected is described hereinabove with reference to FIGS. 1-8.

VGAM1269 gene, herein designated VGAM GENE, is a viral gene contained in the genome of Grapevine Virus A. VGAM1269 host target gene, herein designated VGAM HOST TARGET GENE, is a human gene contained in the human genome.

VGAM1269 gene encodes a VGAM1269 precursor RNA, herein designated VGAM PRECURSOR RNA. Similar to other miRNA genes, and unlike most ordinary genes, VGAM1269 precursor RNA does not encode a protein. A nucleotide sequence identical or highly similar to the nucleotide sequence of VGAM1269 precursor RNA is designated SEQ ID:1255, and is provided hereinbelow with reference to the sequence listing part. Nucleotide sequence SEQ ID:1255 is located at position 2009 relative to the genome of Grapevine Virus A.

VGAM1269 precursor RNA folds onto itself, forming VGAM1269 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1269 folded precursor RNA into VGAM1269 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1269 RNA is designated SEQ ID:3980, and is provided hereinbelow with reference to the sequence listing part.

VGAM1269 host target gene, herein designated VGAM HOST TARGET GENE, encodes a corresponding messenger RNA, VGAM1269 host target RNA, herein designated VGAM HOST TARGET RNA. VGAM1269 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1269 RNA, herein designated VGAM RNA, binds complementarily to one or more host target binding sites located in untranslated regions of VGAM1269 host target RNA, herein designated VGAM HOST TARGET RNA. This complementary binding is due to the fact that the nucleotide sequence of VGAM1269 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1269 RNA, herein designated VGAM RNA, may have a different number of host target binding sites in untranslated regions of a VGAM1269 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1269 RNA, herein designated VGAM RNA, to host target binding sites on VGAM1269 host target RNA, herein designated VGAM HOST TARGET RNA, such as BINDING SITE I, BINDING SITE II and BINDING SITE III, inhibits translation of VGAM1269 host target RNA into VGAM1269 host target protein, herein designated VGAM HOST TARGET PROTEIN. VGAM host target protein is therefore outlined by a broken line.

It is appreciated that VGAM1269 host target gene, herein designated VGAM HOST TARGET GENE, in fact represents a plurality of VGAM1269 host target genes. The mRNA of each one of this plurality of VGAM1269 host target genes comprises one or more host target binding sites, each having a nucleotide sequence which is at least partly complementary to VGAM1269 RNA, herein designated VGAM RNA, and which when bound by VGAM1269 RNA causes inhibition of translation of respective one or more VGAM1269 host target proteins.

It is further appreciated by one skilled in the art that the mode of translational inhibition illustrated by FIG. 1 with specific reference to translational inhibition exerted by VGAM1269 gene, herein designated VGAM GENE, on one or more VGAM1269 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1269 is inhibition of expression of host target genes, as part of a novel viral mechanism of attacking a host. Accordingly, utilities of VGAM1269 include diagnosis, prevention and treatment of viral infection by Grapevine Virus A. Specific functions, and accordingly utilities, of VGAM1269 correlate with, and may be deduced from, the identity of the host target genes which VGAM1269 binds and inhibits, and the function of these host target genes, as elaborated hereinbelow.

Nucleotide sequences of the VGAM1269 precursor RNA, herein designated VGAM PRECURSOR RNA, and of the 'diced' VGAM1269 RNA, herein designated VGAM RNA, and a schematic representation of the secondary folding of VGAM1269 folded precursor RNA, herein designated VGAM FOLDED PRECURSOR RNA, of VGAM1269 are further described hereinbelow with reference to Table 1.

Nucleotide sequences of host target binding sites, such as BINDING SITE-I, BINDING SITE-II and BINDING SITE-III of FIG. 1, found on VGAM1269 host target RNA, and schematic representation of the complementarity of each of these host target binding sites to VGAM1269 RNA, herein designated VGAM RNA, are described hereinbelow with reference to Table 2.

As mentioned hereinabove with reference to FIG. 1, a function of VGAM1269 gene, herein designated VGAM is inhibition of expression of VGAM1269 target genes. It is appreciated that specific functions, and accordingly utilities, of VGAM1269 correlate with, and may be deduced from, the identity of the target genes which VGAM1269 binds and inhibits, and the function of these target genes, as elaborated hereinbelow.

DKFZp547J036 (Accession NM_032281) is a VGAM1269 host target gene. DKFZp547J036 BINDING SITE is HOST TARGET binding site found in the 5' untranslated region of mRNA encoded by DKFZp547J036, corresponding to a HOST TARGET binding site such as BINDING SITE I, BINDING SITE II or BINDING SITE III. Table 2 illustrates the complementarity of the nucleotide sequences of DKFZp547J036 BINDING SITE, designated SEQ ID:26040, to the nucleotide sequence of VGAM1269 RNA, herein designated VGAM RNA, also designated SEQ ID:3980.

A function of VGAM1269 is therefore inhibition of DKFZp547J036 (Accession NM_032281). Accordingly, utilities of VGAM1269 include diagnosis, prevention and treatment of diseases and clinical conditions associated with DKFZp547J036. KIAA1337 (Accession XM_052561) is another VGAM1269 host target gene. KIAA1337 BINDING SITE is HOST TARGET binding site found in the 3' untranslated region of mRNA encoded by KIAA1337, corresponding to a HOST TARGET binding site such as BINDING SITE I, BINDING SITE II or BINDING SITE III. Table 2 illustrates the complementarity of the nucleotide sequences of KIAA1337 BINDING SITE, designated SEQ ID:35983, to the nucleotide sequence of VGAM1269 RNA, herein designated VGAM RNA, also designated SEQ ID:3980.

Another function of VGAM1269 is therefore inhibition of KIAA1337 (Accession XM_052561). Accordingly, utilities of VGAM1269 include diagnosis, prevention and treatment of diseases and clinical conditions associated with KIAA1337. FIG. 1 further provides a conceptual description of a novel bioinformatically detected viral gene of the present invention, referred to here as Viral Genomic Address Messenger 1270 (VGAM1270) viral gene, which modulates expression of respective host target genes thereof, the function and utility of which host target genes is known in the art.

VGAM1270 is a novel bioinformatically detected regulatory, non protein coding, viral micro RNA (miRNA) gene. The method by which VGAM1270 was detected is described hereinabove with reference to FIGS. 1-8.

VGAM1270 gene, herein designated VGAM GENE, is a viral gene contained in the genome of Grapevine Virus A. VGAM1270 host target gene, herein designated VGAM HOST TARGET GENE, is a human gene contained in the human genome.

VGAM1270 gene encodes a VGAM1270 precursor RNA, herein designated VGAM PRECURSOR RNA. Similar to other miRNA genes, and unlike most ordinary genes, VGAM1270 precursor RNA does not encode a protein. A nucleotide sequence identical or highly similar to the nucleotide sequence of VGAM1270 precursor RNA is designated SEQ ID:1256, and is provided hereinbelow with reference to the sequence listing part. Nucleotide sequence SEQ ID:1256 is located at position 205 relative to the genome of Grapevine Virus A.

VGAM1270 precursor RNA folds onto itself, forming VGAM1270 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1270 folded precursor RNA into VGAM1270 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1270 RNA is designated SEQ ID:3981, and is provided hereinbelow with reference to the sequence listing part.

VGAM1270 host target gene, herein designated VGAM HOST TARGET GENE, encodes a corresponding messenger RNA, VGAM1270 host target RNA, herein designated VGAM HOST TARGET RNA. VGAM1270 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1270 RNA, herein designated VGAM RNA, binds complementarily to one or more host target binding sites located in untranslated regions of VGAM1270 host target RNA, herein designated VGAM HOST TARGET RNA. This complementary binding is due to the fact that the nucleotide sequence of VGAM1270 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1270 RNA, herein designated VGAM RNA, may have a different number of host target binding sites in untranslated regions of a VGAM1270 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1270 RNA, herein designated VGAM RNA, to host target binding sites on VGAM1270 host target RNA, herein designated VGAM HOST TARGET RNA, such as BINDING SITE I, BINDING SITE II and BINDING SITE III, inhibits translation of VGAM1270 host target RNA into VGAM1270 host target protein, herein designated VGAM HOST TARGET PROTEIN. VGAM host target protein is therefore outlined by a broken line.

It is appreciated that VGAM1270 host target gene, herein designated VGAM HOST TARGET GENE, in fact represents a plurality of VGAM1270 host target genes. The mRNA of each one of this plurality of VGAM1270 host target genes comprises one or more host target binding sites, each having a nucleotide sequence which is at least partly complementary to VGAM1270 RNA, herein designated VGAM RNA, and which when bound by VGAM1270 RNA causes inhibition of translation of respective one or more VGAM1270 host target proteins.

It is further appreciated by one skilled in the art that the mode of translational inhibition illustrated by FIG. 1 with specific reference to translational inhibition exerted by VGAM1270 gene, herein designated VGAM GENE, on one or more VGAM1270 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1270 is inhibition of expression of host target genes, as part of a novel viral mechanism of attacking a host. Accordingly, utilities of VGAM1270 include diagnosis, prevention and treatment of viral infection by Grapevine Virus A. Specific functions, and accordingly utilities, of VGAM1270 correlate with, and may be deduced from, the identity of the host target genes which VGAM1270 binds and inhibits, and the function of these host target genes, as elaborated hereinbelow.

Nucleotide sequences of the VGAM1270 precursor RNA, herein designated VGAM PRECURSOR RNA, and of the 'diced' VGAM1270 RNA, herein designated VGAM RNA, and a schematic representation of the secondary folding of VGAM1270 folded precursor RNA, herein designated VGAM FOLDED PRECURSOR RNA, of VGAM1270 are further described hereinbelow with reference to Table 1.

Nucleotide sequences of host target binding sites, such as BINDING SITE-I, BINDING SITE-II and BINDING SITE-III of FIG. 1, found on VGAM1270 host target RNA, and schematic representation of the complementarity of each of these host target binding sites to VGAM1270 RNA, herein designated VGAM RNA, are described hereinbelow with reference to Table 2.

As mentioned hereinabove with reference to FIG. 1, a function of VGAM1270 gene, herein designated VGAM is inhibition of expression of VGAM1270 target genes. It is appreciated that specific functions, and accordingly utilities, of VGAM1270 correlate with, and may be deduced from, the identity of the target genes which VGAM1270 binds and inhibits, and the function of these target genes, as elaborated hereinbelow.

Trichorhinophalangeal Syndrome I (TRPS1, Accession NM_014112) is a VGAM1270 host target gene. TRPS1 BINDING SITE is HOST TARGET binding site found in the 3' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15354, to the nucleotide sequence of VGAM1270 RNA, herein designated VGAM RNA, also designated SEQ ID:3981.

A function of VGAM1270 is therefore inhibition of Trichorhinophalangeal Syndrome I (TRPS1, Accession NM_014112), a gene which may function as a transcriptional activator protein. Accordingly, utilities of VGAM1270 include diagnosis, prevention and treatment of diseases and clinical conditions associated with TRPS1. The function of TRPS1 and its association with various diseases and clinical conditions, has been established by previous studies, as described hereinabove with reference to VGAM172. DKFZp434O0515 (Accession XM_038277) is another VGAM1270 host target gene. DKFZp434O0515 BINDING SITE is HOST TARGET binding site found in the 5' untranslated region of mRNA encoded by DKFZp434O0515, corresponding to a HOST TARGET binding site such as BINDING SITE I, BINDING SITE II or BINDING SITE III. Table 2 illustrates the complementarity of the nucleotide sequences of DKFZp434O0515 BINDING SITE, designated SEQ ID:32787, to the nucleotide sequence of VGAM1270 RNA, herein designated VGAM RNA, also designated SEQ ID:3981.

Another function of VGAM1270 is therefore inhibition of DKFZp434O0515 (Accession XM_038277). Accordingly, utilities of VGAM1270 include diagnosis, prevention and treatment of diseases and clinical conditions associated with DKFZp434O0515. LOC148823 (Accession NM_145278) is another VGAM1270 host target gene. LOC148823 BINDING SITE is HOST TARGET binding site found in the 3' untranslated region of mRNA encoded by LOC148823, corresponding to a HOST TARGET binding site such as BINDING SITE I, BINDING SITE II or BINDING SITE III. Table 2 illustrates the complementarity of the nucleotide sequences of LOC148823 BINDING SITE, designated SEQ ID:29794, to the nucleotide sequence of VGAM1270 RNA, herein designated VGAM RNA, also designated SEQ ID:3981.

Another function of VGAM1270 is therefore inhibition of LOC148823 (Accession NM_145278). Accordingly, utilities of VGAM1270 include diagnosis, prevention and treatment of diseases and clinical conditions associated with LOC148823. LOC152316 (Accession XM_098185) is another VGAM1270 host target gene. LOC152316 BINDING SITE is HOST TARGET binding site found in the 3' untranslated region of mRNA encoded by LOC152316, corresponding to a HOST TARGET binding site such as BINDING SITE I, BINDING SITE II or BINDING SITE III. Table 2 illustrates the complementarity of the nucleotide sequences of LOC152316 BINDING SITE, designated SEQ ID:41452, to the nucleotide sequence of VGAM1270 RNA, herein designated VGAM RNA, also designated SEQ ID:3981.

Another function of VGAM1270 is therefore inhibition of LOC152316 (Accession XM_098185). Accordingly, utilities of VGAM1270 include diagnosis, prevention and treatment of diseases and clinical conditions associated with LOC152316. LOC93444 (Accession XM_051455) is another VGAM1270 host target gene. LOC93444 BINDING SITE is HOST TARGET binding site found in the 3' untranslated region of mRNA encoded by LOC93444, corresponding to a HOST TARGET binding site such as BINDING SITE I, BINDING SITE II or BINDING SITE III. Table 2 illustrates the complementarity of the nucleotide sequences of LOC93444 BINDING SITE, designated SEQ ID:35842, to the nucleotide sequence of VGAM1270 RNA, herein designated VGAM RNA, also designated SEQ ID:3981.

Another function of VGAM1270 is therefore inhibition of LOC93444 (Accession XM_051455). Accordingly, utilities of VGAM1270 include diagnosis, prevention and treatment of diseases and clinical conditions associated with LOC93444. FIG. 1 further provides a conceptual description of a novel bioinformatically detected viral gene of the present invention, referred to here as Viral Genomic Address Messenger 1271 (VGAM1271) viral gene, which modulates expression of respective host target genes thereof, the function and utility of which host target genes is known in the art.

VGAM1271 is a novel bioinformatically detected regulatory, non protein coding, viral micro RNA (miRNA) gene. The method by which VGAM1271 was detected is described hereinabove with reference to FIGS. 1-8.

VGAM1271 gene, herein designated VGAM GENE, is a viral gene contained in the genome of Grapevine Virus A. VGAM1271 host target gene, herein designated VGAM HOST TARGET GENE, is a human gene contained in the human genome.

VGAM1271 gene encodes a VGAM1271 precursor RNA, herein designated VGAM PRECURSOR RNA. Similar to other miRNA genes, and unlike most ordinary genes, VGAM1271 precursor RNA does not encode a protein. A nucleotide sequence identical or highly similar to the nucleotide sequence of VGAM1271 precursor RNA is designated SEQ ID:1257, and is provided hereinbelow with reference to the sequence listing part. Nucleotide sequence SEQ ID:1257 is located at position 6496 relative to the genome of Grapevine Virus A.

VGAM1271 precursor RNA folds onto itself, forming VGAM1271 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1271 folded precursor RNA into VGAM1271 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1271 RNA is designated SEQ ID:3982, and is provided hereinbelow with reference to the sequence listing part.

VGAM1271 host target gene, herein designated VGAM HOST TARGET GENE, encodes a corresponding messenger RNA, VGAM1271 host target RNA, herein designated VGAM HOST TARGET RNA. VGAM1271 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1271 RNA, herein designated VGAM RNA, binds complementarily to one or more host target binding sites located in untranslated regions of VGAM1271 host target RNA, herein designated VGAM HOST TARGET RNA. This complementary binding is due to the fact that the nucleotide sequence of VGAM1271 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1271 RNA, herein designated VGAM RNA, may have a different number of host target binding sites in untranslated regions of a VGAM1271 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1271 RNA, herein designated VGAM RNA, to host target binding sites on VGAM1271 host target RNA, herein designated VGAM HOST TARGET RNA, such as BINDING SITE I, BINDING SITE II and BINDING SITE III, inhibits translation of VGAM1271 host target RNA into VGAM1271 host target protein, herein designated VGAM HOST TARGET PROTEIN. VGAM host target protein is therefore outlined by a broken line.

It is appreciated that VGAM1271 host target gene, herein designated VGAM HOST TARGET GENE, in fact represents a plurality of VGAM1271 host target genes. The mRNA of each one of this plurality of VGAM1271 host target genes comprises one or more host target binding sites, each having a nucleotide sequence which is at least partly complementary to VGAM1271 RNA, herein designated VGAM RNA, and which when bound by VGAM1271 RNA causes inhibition of translation of respective one or more VGAM1271 host target proteins.

It is further appreciated by one skilled in the art that the mode of translational inhibition illustrated by FIG. 1 with specific reference to translational inhibition exerted by VGAM1271 gene, herein designated VGAM GENE, on one or more VGAM1271 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1271 is inhibition of expression of host target genes, as part of a novel viral mechanism of attacking a host. Accordingly, utilities of VGAM1271 include diagnosis, prevention and treatment of viral infection by Grapevine Virus A. Specific functions, and accordingly utilities, of VGAM1271 correlate with, and may be deduced from, the identity of the host target genes which VGAM1271 binds and inhibits, and the function of these host target genes, as elaborated hereinbelow.

Nucleotide sequences of the VGAM1271 precursor RNA, herein designated VGAM PRECURSOR RNA, and of the 'diced' VGAM1271 RNA, herein designated VGAM RNA, and a schematic representation of the secondary folding of VGAM1271 folded precursor RNA, herein designated VGAM FOLDED PRECURSOR RNA, of VGAM1271 are further described hereinbelow with reference to Table 1.

Nucleotide sequences of host target binding sites, such as BINDING SITE-I, BINDING SITE-II and BINDING SITE-III of FIG. 1, found on VGAM1271 host target RNA, and schematic representation of the complementarity of each of these host target binding sites to VGAM1271 RNA, herein designated VGAM RNA, are described hereinbelow with reference to Table 2.

As mentioned hereinabove with reference to FIG. 1, a function of VGAM1271 gene, herein designated VGAM is inhibition of expression of VGAM1271 target genes. It is appreciated that specific functions, and accordingly utilities, of VGAM1271 correlate with, and may be deduced from, the identity of the target genes which VGAM1271 binds and inhibits, and the function of these target genes, as elaborated hereinbelow.

Cyclin D-type Binding-protein 1 (CCNDBP1, Accession NM_037370) is a VGAM1271 host target gene. CCNDBP1 BINDING SITE is HOST TARGET binding site found in the 5' untranslated region of mRNA encoded by CCNDBP1, corresponding to a HOST TARGET binding site such as BINDING SITE I, BINDING SITE II or BINDING SITE III. Table 2 illustrates the complementarity of the nucleotide sequences of CCNDBP1 BINDING SITE, designated SEQ ID:27397, to the nucleotide sequence of VGAM1271 RNA, herein designated VGAM RNA, also designated SEQ ID:3982.

A function of VGAM1271 is therefore inhibition of Cyclin D-type Binding-protein 1 (CCNDBP1, Accession NM_037370). Accordingly, utilities of VGAM1271 include diagnosis, prevention and treatment of diseases and clinical conditions associated with CCNDBP1. Phosphotriesterase Related (PTER, Accession NM_030664) is another VGAM1271 host target gene. PTER BINDING SITE is HOST TARGET binding site found in the 3' untranslated region of mRNA encoded by PTER, corresponding to a HOST TARGET binding site such as BINDING SITE I, BINDING SITE II or BINDING SITE III. Table 2 illustrates the complementarity of the nucleotide sequences of PTER BINDING SITE, designated SEQ ID:24998, to the nucleotide sequence of VGAM1271 RNA, herein designated VGAM RNA, also designated SEQ ID:3982.

Another function of VGAM1271 is therefore inhibition of Phosphotriesterase Related (PTER, Accession NM_030664), a gene which is a phosphotriesterase homology protein. Accordingly, utilities of VGAM1271 include diagnosis, prevention and treatment of diseases and clinical conditions associated with PTER. The function of PTER and its association with various diseases and clinical conditions, has been established by previous studies, as described hereinabove with reference to VGAM713. Soc-2 Suppressor of Clear Homolog (C. elegans) (SHOC2, Accession NM_007373) is another VGAM1271 host target gene. SHOC2 BINDING SITE is HOST TARGET binding site found in the 3' untranslated region of mRNA encoded by SHOC2, corresponding to a HOST TARGET binding site such as BINDING SITE I, BINDING SITE II or BINDING SITE III. Table 2 illustrates the complementarity of the nucleotide sequences of SHOC2 BINDING SITE, designated SEQ ID:14306, to the nucleotide sequence of VGAM1271 RNA, herein designated VGAM RNA, also designated SEQ ID:3982.

Another function of VGAM1271 is therefore inhibition of Soc-2 Suppressor of Clear Homolog (C. elegans) (SHOC2, Accession NM_007373), a gene which may be a regulator of the let-60 ras pathway. Accordingly, utilities of VGAM1271 include diagnosis, prevention and treatment of diseases and clinical conditions associated with SHOC2. The function of SHOC2 and its association with various diseases and clinical conditions, has been established by previous studies, as described hereinabove with reference to VGAM464. DKFZP434I116 (Accession NM_015496) is another VGAM1271 host target gene. DKFZP434I116 BINDING SITE is HOST TARGET binding site found in the 5' untranslated region of mRNA encoded by DKFZP434I116, corresponding to a HOST TARGET binding site such as BINDING SITE I, BINDING SITE II or BINDING SITE III. Table 2 illustrates the complementarity of the nucleotide sequences of DKFZP434I116 BINDING SITE, designated SEQ ID:17764, to the nucleotide sequence of VGAM1271 RNA, herein designated VGAM RNA, also designated SEQ ID:3982.

Another function of VGAM1271 is therefore inhibition of DKFZP434I116 (Accession NM_015496). Accordingly, utilities of VGAM1271 include diagnosis, prevention and treatment of diseases and clinical conditions associated with DKFZP434I116. FLJ13848 (Accession NM_024771) is another VGAM1271 host target gene. FLJ13848 BINDING SITE is HOST TARGET binding site found in the 3' untranslated region of mRNA encoded by FLJ13848, corresponding to a HOST TARGET binding site such as BINDING SITE I, BINDING SITE II or BINDING SITE III. Table 2 illustrates the complementarity of the nucleotide sequences of FLJ13848 BINDING SITE, designated SEQ ID:24132, to the nucleotide sequence of VGAM1271 RNA, herein designated VGAM RNA, also designated SEQ ID:3982.

Another function of VGAM1271 is therefore inhibition of FLJ13848 (Accession NM_024771). Accordingly, utilities of VGAM1271 include diagnosis, prevention and treatment of diseases and clinical conditions associated with FLJ13848. KIAA1257 (Accession XM_031577) is another VGAM1271 host target gene. KIAA1257 BINDING SITE is HOST TARGET binding site found in the 3' untranslated region of mRNA encoded by KIAA1257, corresponding to a HOST TARGET binding site such as BINDING SITE I, BINDING SITE II or BINDING SITE III. Table 2 illustrates the complementarity of the nucleotide sequences of KIAA1257 BINDING SITE, designated SEQ ID:31436, to the nucleotide sequence of VGAM1271 RNA, herein designated VGAM RNA, also designated SEQ ID:3982.

Another function of VGAM1271 is therefore inhibition of KIAA1257 (Accession XM_031577). Accordingly, utilities of VGAM1271 include diagnosis, prevention and treatment of diseases and clinical conditions associated with KIAA1257. LOC128989 (Accession XM_059310) is another VGAM1271 host target gene. LOC128989 BINDING SITE is HOST TARGET binding site found in the 3' untranslated region of mRNA encoded by LOC128989, corresponding to a HOST TARGET binding site such as BINDING SITE I, BINDING SITE II or BINDING SITE III. Table 2 illustrates the complementarity of the nucleotide sequences of LOC128989 BINDING SITE, designated SEQ ID:36945, to the nucleotide sequence of VGAM1271 RNA, herein designated VGAM RNA, also designated SEQ ID:3982.

Another function of VGAM1271 is therefore inhibition of LOC128989 (Accession XM_059310). Accordingly, utilities of VGAM1271 include diagnosis, prevention and treatment of diseases and clinical conditions associated with LOC128989. LOC146894 (Accession NM_145273) is another VGAM1271 host target gene. LOC146894 BINDING SITE is HOST TARGET binding site found in the 3' untranslated region of mRNA encoded by LOC146894, corresponding to a HOST TARGET binding site such as BINDING SITE I, BINDING SITE II or BINDING SITE III. Table 2 illustrates the complementarity of the nucleotide sequences of LOC146894 BINDING SITE, designated SEQ ID:29783, to the nucleotide sequence of VGAM1271 RNA, herein designated VGAM RNA, also designated SEQ ID:3982.

Another function of VGAM1271 is therefore inhibition of LOC146894 (Accession NM_145273). Accordingly, utilities of VGAM1271 include diagnosis, prevention and treatment of diseases and clinical conditions associated with LOC146894. LOC150155 (Accession XM_047977) is another VGAM1271 host target gene. LOC150155 BINDING SITE is HOST TARGET binding site found in the 3' untranslated region of mRNA encoded by LOC150155, corresponding to a HOST TARGET binding site such as BINDING SITE I, BINDING SITE II or BINDING SITE III. Table 2 illustrates the complementarity of the nucleotide sequences of LOC150155 BINDING SITE, designated SEQ ID:35090, to the nucleotide sequence of VGAM1271 RNA, herein designated VGAM RNA, also designated SEQ ID:3982.

Another function of VGAM1271 is therefore inhibition of LOC150155 (Accession XM_047977). Accordingly, utilities of VGAM1271 include diagnosis, prevention and treatment of diseases and clinical conditions associated with LOC150155. LOC150383 (Accession XM_086905) is another VGAM1271 host target gene. LOC150383 BINDING SITE is HOST TARGET binding site found in the 3' untranslated region of mRNA encoded by LOC150383, corresponding to a HOST TARGET binding site such as BINDING SITE I, BINDING SITE II or BINDING SITE III. Table 2 illustrates the complementarity of the nucleotide sequences of LOC150383 BINDING SITE, designated SEQ ID:38946, to the nucleotide sequence of VGAM1271 RNA, herein designated VGAM RNA, also designated SEQ ID:3982.

Another function of VGAM1271 is therefore inhibition of LOC150383 (Accession XM_086905). Accordingly, utilities of VGAM1271 include diagnosis, prevention and treatment of diseases and clinical conditions associated with LOC150383. FIG. 1 further provides a conceptual description of a novel bioinformatically detected viral gene of the present invention, referred to here as Viral Genomic Address Messenger 1272 (VGAM1272) viral gene, which modulates expression of respective host target genes thereof, the function and utility of which host target genes is known in the art.

VGAM1272 is a novel bioinformatically detected regulatory, non protein coding, viral micro RNA (miRNA) gene. The method by which VGAM1272 was detected is described hereinabove with reference to FIGS. 1-8.

VGAM1272 gene, herein designated VGAM GENE, is a viral gene contained in the genome of Grapevine Virus A. VGAM1272 host target gene, herein designated VGAM HOST TARGET GENE, is a human gene contained in the human genome.

VGAM1272 gene encodes a VGAM1272 precursor RNA, herein designated VGAM PRECURSOR RNA. Similar to other miRNA genes, and unlike most ordinary genes, VGAM1272 precursor RNA does not encode a protein. A nucleotide sequence identical or highly similar to the nucleotide sequence of VGAM1272 precursor RNA is designated SEQ ID:1258, and is provided hereinbelow with reference to the sequence listing part. Nucleotide sequence SEQ ID:1258 is located at position 2895 relative to the genome of Grapevine Virus A.

VGAM1272 precursor RNA folds onto itself, forming VGAM1272 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1272 folded precursor RNA into VGAM1272 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 40%) nucleotide sequence of VGAM1272 RNA is designated SEQ ID:3983, and is provided hereinbelow with reference to the sequence listing part.

VGAM1272 host target gene, herein designated VGAM HOST TARGET GENE, encodes a corresponding messenger RNA, VGAM1272 host target RNA, herein designated VGAM HOST TARGET RNA. VGAM1272 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1272 RNA, herein designated VGAM RNA, binds complementarily to one or more host target binding sites located in untranslated regions of VGAM1272 host target RNA, herein designated VGAM HOST TARGET RNA. This complementary binding is due to the fact that the nucleotide sequence of VGAM1272 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1272 RNA, herein designated VGAM RNA, may have a different number of host target binding sites in untranslated regions of a VGAM1272 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1272 RNA, herein designated VGAM RNA, to host target binding sites on VGAM1272 host target RNA, herein designated VGAM HOST TARGET RNA, such as BINDING SITE I, BINDING SITE II and BINDING SITE III, inhibits translation of VGAM1272 host target RNA into VGAM1272 host target protein, herein designated VGAM HOST TARGET PROTEIN. VGAM host target protein is therefore outlined by a broken line.

It is appreciated that VGAM1272 host target gene, herein designated VGAM HOST TARGET GENE, in fact represents a plurality of VGAM1272 host target genes. The mRNA of each one of this plurality of VGAM1272 host target genes comprises one or more host target binding sites, each having a nucleotide sequence which is at least partly complementary to VGAM1272 RNA, herein designated VGAM RNA, and which when bound by VGAM1272 RNA causes inhibition of translation of respective one or more VGAM1272 host target proteins.

It is further appreciated by one skilled in the art that the mode of translational inhibition illustrated by FIG. 1 with specific reference to translational inhibition exerted by VGAM1272 gene, herein designated VGAM GENE, on one or more VGAM1272 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1272 is inhibition of expression of host target genes, as part of a novel viral mechanism of attacking a host. Accordingly, utilities of VGAM1272 include diagnosis, prevention and treatment of viral infection by Grapevine Virus A. Specific functions, and accordingly utilities, of VGAM1272 correlate with, and may be deduced from, the identity of the host target genes which VGAM1272 binds and inhibits, and the function of these host target genes, as elaborated hereinbelow.

Nucleotide sequences of the VGAM1272 precursor RNA, herein designated VGAM PRECURSOR RNA, and of the 'diced' VGAM1272 RNA, herein designated VGAM RNA, and a schematic representation of the secondary folding of VGAM1272 folded precursor RNA, herein designated VGAM FOLDED PRECURSOR RNA, of VGAM1272 are further described hereinbelow with reference to Table 1.

Nucleotide sequences of host target binding sites, such as BINDING SITE-I, BINDING SITE-II and BINDING SITE-III of FIG. 1, found on VGAM1272 host target RNA, and schematic representation of the complementarity of each of these host target binding sites to VGAM1272 RNA, herein designated VGAM RNA, are described hereinbelow with reference to Table 2.

As mentioned hereinabove with reference to FIG. 1, a function of VGAM1272 gene, herein designated VGAM is inhibition of expression of VGAM1272 target genes. It is appreciated that specific functions, and accordingly utilities, of VGAM1272 correlate with, and may be deduced from, the identity of the target genes which VGAM1272 binds and inhibits, and the function of these target genes, as elaborated hereinbelow.

Deiodinase, Iodothyronine, Type I (DIO1, Accession NM_000792) is a VGAM1272 host target gene. DIO1 BINDING SITE is HOST TARGET binding site found in the 3' untranslated region of mRNA encoded by DIO1, corresponding to a HOST TARGET binding site such as BINDING SITE I, BINDING SITE II or BINDING SITE III. Table 2 illustrates the complementarity of the nucleotide sequences of DIO1 BINDING SITE, designated SEQ ID:6451, to the nucleotide sequence of VGAM1272 RNA, herein designated VGAM RNA, also designated SEQ ID:3983.

A function of VGAM1272 is therefore inhibition of Deiodinase, Iodothyronine, Type I (DIO1, Accession NM_000792). Accordingly, utilities of VGAM1272 include diagnosis, prevention and treatment of diseases and clinical conditions associated with DIO1. High-mobility Group Box 3 (HMGB3, Accession NM_005342) is another VGAM1272 host target gene. HMGB3 BINDING SITE is HOST TARGET binding site found in the 3' untranslated region of mRNA encoded by HMGB3, corresponding to a HOST TARGET binding site such as BINDING SITE I, BINDING SITE II or BINDING SITE III. Table 2 illustrates the complementarity of the nucleotide sequences of HMGB3 BINDING SITE, designated SEQ ID:11817, to the nucleotide sequence of VGAM1272 RNA, herein designated VGAM RNA, also designated SEQ ID:3983.

Another function of VGAM1272 is therefore inhibition of High-mobility Group Box 3 (HMGB3, Accession NM_005342), a gene which plays a fundamental role in DNA replication, nucleosome assembly, and transcription. Accordingly, utilities of VGAM1272 include diagnosis, prevention and treatment of diseases and clinical conditions associated with HMGB3. The function of HMGB3 has been established by previous studies. One group of high mobility group (HMG) proteins includes the HMG1 (OMIM Ref. No. 163905) and HMG2 (OMIM Ref. No. 163906) proteins, which appear to play a fundamental role in DNA replication, nucleosome assembly, and transcription. By using direct cDNA selection to identify genes located in human chromosome Xq28, Wilke et al. (1997) cloned cDNAs encoding the human homolog of chicken HMG2a. The predicted 199-amino acid human protein shares 97%, 88%, and 86% identity with chicken HMG2a, human HMG1, and human HMG2, respectively. Like the HMG1 and HMG2 proteins, human HMG2A contains 2 HMG box repeats and an acidic C-terminal domain. Northern blot analysis revealed that HMG2A is expressed predominantly in placenta as 1.2- and 1.7-kb mRNAs. Wilke et al. (1997) also identified ESTs corresponding to the mouse HMG2a homolog. Independently, Vaccari et al. (1998) isolated mouse and human cDNAs corresponding to HGM2A, which they called HMG4. They reported that the deduced mouse and human proteins contain 200 amino acids and are 97% identical. Northern blot and RT-PCR analyses suggested that mouse Hmg4 transcripts are much more abundant in embryonic than in adult tissues.

Full details of the abovementioned studies are described in the following publications, the disclosure of which are hereby incorporated by reference:

Vaccari, T.; Beltrame, M.; Ferrari, S.; Bianchi, M. E.: Hmg4, a new member of the Hmg1/2 gene family. Genomics 49:247-252, 1998; and Wilke, K.; Wiemann, S.; Gaul, R.; Gong, W.; Poustka, A.: Isolation of human and mouse HMG2a cDNAs: evidence for an HMG2a-specific 3-prime untranslated region. Gene 198: 269-274, 1997.

Further studies establishing the function and utilities of HMGB3 are found in John Hopkins OMIM database record ID 300193, and in sited publications numbered 11391-11392 listed in the bibliography section hereinbelow, which are also hereby incorporated by reference. Integrin, Alpha 6 (ITGA6, Accession NM_000210) is another VGAM1272 host target gene. ITGA6 BINDING SITE is HOST TARGET binding site found in the 3' untranslated region of mRNA encoded by ITGA6, corresponding to a HOST TARGET binding site such as BINDING SITE I, BINDING SITE II or BINDING SITE III. Table 2 illustrates the complementarity of the nucleotide sequences of ITGA6 BINDING SITE, designated SEQ ID:5703, to the nucleotide sequence of VGAM1272 RNA, herein designated VGAM RNA, also designated SEQ ID:3983.

Another function of VGAM1272 is therefore inhibition of Integrin, Alpha 6 (ITGA6, Accession NM_000210). Accordingly, utilities of VGAM1272 include diagnosis, prevention and treatment of diseases and clinical conditions associated with ITGA6. Latent Transforming Growth Factor Beta Binding Protein 2 (LTBP2, Accession NM_000428) is another VGAM1272 host target gene. LTBP2 BINDING SITE is HOST TARGET binding site found in the 3' untranslated region of mRNA encoded by LTBP2, corresponding to a HOST TARGET binding site such as BINDING SITE I, BINDING SITE II or BINDING SITE III. Table 2 illustrates the complementarity of the nucleotide sequences of LTBP2 BINDING SITE, designated SEQ ID:6005, to the nucleotide sequence of VGAM1272 RNA, herein designated VGAM RNA, also designated SEQ ID:3983.

Another function of VGAM1272 is therefore inhibition of Latent Transforming Growth Factor Beta Binding Protein 2 (LTBP2, Accession NM_000428), a gene which targets latent TGF-beta to the extracellular matrix. Accordingly, utilities of VGAM1272 include diagnosis, prevention and treatment of diseases and clinical conditions associated with LTBP2. The function of LTBP2 and its association with various diseases and clinical conditions, has been established by previous studies, as described hereinabove with reference to VGAM476. Serine (or cysteine) Proteinase Inhibitor, Clade B (ovalbumin), Member 9 (SERPINB9, Accession NM_004155) is another VGAM1272 host target gene. SERPINB9 BINDING SITE is HOST TARGET binding site found in the 3' untranslated region of mRNA encoded by SERPINB9, corresponding to a HOST TARGET binding site such as BINDING SITE I, BINDING SITE II or BINDING SITE III. Table 2 illustrates the complementarity of the nucleotide sequences of SERPINB9 BINDING SITE, designated SEQ ID:10361, to the nucleotide sequence of VGAM1272 RNA, herein designated VGAM RNA, also designated SEQ ID:3983.

Another function of VGAM1272 is therefore inhibition of Serine (or cysteine) Proteinase Inhibitor, Clade B (ovalbumin), Member 9 (SERPINB9, Accession NM_004155), a gene which may be a serpin serine protease inhibitor that interacts with granzyme B (GZMB). Accordingly, utilities of VGAM1272 include diagnosis, prevention and treatment of diseases and clinical conditions associated with SERPINB9. The function of SERPINB9 and its association with various diseases and clinical conditions, has been established by previous studies, as described hereinabove with reference to VGAM60. Chromosome 20 Open Reading Frame 142 (C20orf142, Accession XM_059257) is another VGAM1272 host target gene. C20orf142 BINDING SITE is HOST TARGET binding site found in the 3' untranslated region of mRNA encoded by C20orf142, corresponding to a HOST TARGET binding site such as BINDING SITE I, BINDING SITE II or BINDING SITE III. Table 2 illustrates the complementarity of the nucleotide sequences of C20orf142 BINDING SITE, designated SEQ ID:36929, to the nucleotide sequence of VGAM1272 RNA, herein designated VGAM RNA, also designated SEQ ID:3983.

Another function of VGAM1272 is therefore inhibition of Chromosome 20 Open Reading Frame 142 (C20orf142, Accession XM_059257). Accordingly, utilities of VGAM1272 include diagnosis, prevention and treatment of diseases and clinical conditions associated with C20orf142. CDC14 Cell Division Cycle 14 Homolog B (S. cerevisiae) (CDC14B, Accession NM_033331) is another VGAM1272 host target gene. CDC14B BINDING SITE1 and CDC14B BINDING SITE2 are HOST TARGET binding sites found in untranslated regions of mRNA encoded by CDC14B, corresponding to HOST TARGET binding sites such as BINDING SITE I, BINDING SITE II or BINDING SITE III. Table 2 illustrates the complementarity of the nucleotide sequences of CDC14B BINDING SITE1 and CDC14B BINDING SITE2, designated SEQ ID:27160 and SEQ ID:9757 respectively, to the nucleotide sequence of VGAM1272 RNA, herein designated VGAM RNA, also designated SEQ ID:3983.

Another function of VGAM1272 is therefore inhibition of CDC14 Cell Division Cycle 14 Homolog B (S. cerevisiae) (CDC14B, Accession NM_033331). Accordingly, utilities of VGAM1272 include diagnosis, prevention and treatment of diseases and clinical conditions associated with CDC14B. Death Associated Transcription Factor 1 (DATF1, Accession NM_080796) is another VGAM1272 host target gene. DATF1 BINDING SITE1 and DATF1 BINDING SITE2 are HOST TARGET binding sites found in untranslated regions of mRNA encoded by DATF1, corresponding to HOST TARGET binding sites such as BINDING SITE I, BINDING SITE II or BINDING SITE III. Table 2 illustrates the complementarity of the nucleotide sequences of DATF1 BINDING SITE1 and DATF1 BINDING SITE2, designated SEQ ID:28064 and SEQ ID:15317 respectively, to the nucleotide sequence of VGAM1272 RNA, herein designated VGAM RNA, also designated SEQ ID:3983.

Another function of VGAM1272 is therefore inhibition of Death Associated Transcription Factor 1 (DATF1, Accession NM_080796). Accordingly, utilities of VGAM1272 include diagnosis, prevention and treatment of diseases and clinical conditions associated with DATF1. FLJ11011 (Accession NM_018299) is another VGAM1272 host target gene. FLJ11011 BINDING SITE is HOST TARGET binding site found in the 3' untranslated region of mRNA encoded by FLJ11011, corresponding to a HOST TARGET binding site such as BINDING SITE I, BINDING SITE II or BINDING SITE III. Table 2 illustrates the complementarity of the nucleotide sequences of FLJ11011 BINDING SITE, designated SEQ ID:20291, to the nucleotide sequence of VGAM1272 RNA, herein designated VGAM RNA, also designated SEQ ID:3983.

Another function of VGAM1272 is therefore inhibition of FLJ11011 (Accession NM_018299). Accordingly, utilities of VGAM1272 include diagnosis, prevention and treatment of diseases and clinical conditions associated with FLJ11011. FLJ31153 (Accession NM_144600) is another VGAM1272 host target gene. FLJ31153 BINDING SITE is HOST TARGET binding site found in the 3' untranslated region of mRNA encoded by FLJ31153, corresponding to a HOST TARGET binding site such as BINDING SITE I, BINDING SITE II or BINDING SITE III. Table 2 illustrates the complementarity of the nucleotide sequences of FLJ31153 BINDING SITE, designated SEQ ID:29413, to the nucleotide sequence of VGAM1272 RNA, herein designated VGAM RNA, also designated SEQ ID:3983.

Another function of VGAM1272 is therefore inhibition of FLJ31153 (Accession NM_144600). Accordingly, utilities of VGAM1272 include diagnosis, prevention and treatment of diseases and clinical conditions associated with FLJ31153. HSA250839 (Accession NM_018401) is another VGAM1272 host target gene. HSA250839 BINDING SITE is HOST TARGET binding site found in the 3' untranslated region of mRNA encoded by HSA250839, corresponding to a HOST TARGET binding site such as BINDING SITE I, BINDING SITE II or BINDING SITE III. Table 2 illustrates the complementarity of the nucleotide sequences of HSA250839 BINDING SITE, designated SEQ ID:20438, to the nucleotide sequence of VGAM1272 RNA, herein designated VGAM RNA, also designated SEQ ID:3983.

Another function of VGAM1272 is therefore inhibition of HSA250839 (Accession NM_018401). Accordingly, utilities of VGAM1272 include diagnosis, prevention and treatment of diseases and clinical conditions associated with HSA250839. KIAA0377 (Accession NM_014659) is another VGAM1272 host target gene. KIAA0377 BINDING SITE is HOST TARGET binding site found in the 3' untranslated region of mRNA encoded by KIAA0377, corresponding to a HOST TARGET binding site such as BINDING SITE I, BINDING SITE II or BINDING SITE III. Table 2 illustrates the complementarity of the nucleotide sequences of KIAA0377 BINDING SITE, designated SEQ ID:16103, to the nucleotide sequence of VGAM1272 RNA, herein designated VGAM RNA, also designated SEQ ID:3983.

Another function of VGAM1272 is therefore inhibition of KIAA0377 (Accession NM_014659). Accordingly, utilities of VGAM1272 include diagnosis, prevention and treatment of diseases and clinical conditions associated with KIAA0377. Serologically Defined Colon Cancer Antigen 1 (SDCCAG1, Accession NM_004713) is another VGAM1272 host target gene. SDCCAG1 BINDING SITE is HOST TARGET binding site found in the 3' untranslated region of mRNA encoded by SDCCAG1, corresponding to a HOST TARGET binding site such as BINDING SITE I, BINDING SITE II or BINDING SITE III. Table 2 illustrates the complementarity of the nucleotide sequences of SDCCAG1 BINDING SITE, designated SEQ ID:11071, to the nucleotide sequence of VGAM1272 RNA, herein designated VGAM RNA, also designated SEQ ID:3983.

Another function of VGAM1272 is therefore inhibition of Serologically Defined Colon Cancer Antigen 1 (SDCCAG1, Accession NM_004713). Accordingly, utilities of VGAM1272 include diagnosis, prevention and treatment of diseases and clinical conditions associated with SDCCAG1. LOC122330 (Accession XM_074145) is another VGAM1272 host target gene. LOC122330 BINDING SITE is HOST TARGET binding site found in the 5' untranslated region of mRNA encoded by LOC122330, corresponding to a HOST TARGET binding site such as BINDING SITE I, BINDING SITE II or BINDING SITE III. Table 2 illustrates the complementarity of the nucleotide sequences of LOC122330 BINDING SITE, designated SEQ ID:37517, to the nucleotide sequence of VGAM1272 RNA, herein designated VGAM RNA, also designated SEQ ID:3983.

Another function of VGAM1272 is therefore inhibition of LOC122330 (Accession XM_074145). Accordingly, utilities of VGAM1272 include diagnosis, prevention and treatment of diseases and clinical conditions associated with LOC122330. LOC256401 (Accession XM_171149) is another VGAM1272 host target gene. LOC256401 BINDING SITE is HOST TARGET binding site found in the 3' untranslated region of mRNA encoded by LOC256401, corresponding to a HOST TARGET binding site such as BINDING SITE I, BINDING SITE II or BINDING SITE III. Table 2 illustrates the complementarity of the nucleotide sequences of LOC256401 BINDING SITE, designated SEQ ID:45944, to the nucleotide sequence of VGAM1272 RNA, herein designated VGAM RNA, also designated SEQ ID:3983.

Another function of VGAM1272 is therefore inhibition of LOC256401 (Accession XM_171149). Accordingly, utilities of VGAM1272 include diagnosis, prevention and treatment of diseases and clinical conditions associated with LOC256401. LOC90719 (Accession XM_033704) is another VGAM1272 host target gene. LOC90719 BINDING SITE is HOST TARGET binding site found in the 3' untranslated region of mRNA encoded by LOC90719, corresponding to a HOST TARGET binding site such as BINDING SITE I, BINDING SITE II or BINDING SITE III. Table 2 illustrates the complementarity of the nucleotide sequences of LOC90719 BINDING SITE, designated SEQ ID:31946, to the nucleotide sequence of VGAM1272 RNA, herein designated VGAM RNA, also designated SEQ ID:3983.

Another function of VGAM1272 is therefore inhibition of LOC90719 (Accession XM_033704). Accordingly, utilities of VGAM1272 include diagnosis, prevention and treatment of diseases and clinical conditions associated with LOC90719. FIG. 1 further provides a conceptual description of a novel bioinformatically detected viral gene of the present invention, referred to here as Viral Genomic Address Messenger 1273 (VGAM1273) viral gene, which modulates expression of respective host target genes thereof, the function and utility of which host target genes is known in the art.

VGAM1273 is a novel bioinformatically detected regulatory, non protein coding, viral micro RNA (miRNA) gene. The method by which VGAM1273 was detected is described hereinabove with reference to FIGS. 1-8.

VGAM1273 gene, herein designated VGAM GENE, is a viral gene contained in the genome of A-2 Plaque Virus. VGAM1273 host target gene, herein designated VGAM HOST TARGET GENE, is a human gene contained in the human genome.

VGAM1273 gene encodes a VGAM1273 precursor RNA, herein designated VGAM PRECURSOR RNA. Similar to other miRNA genes, and unlike most ordinary genes, VGAM1273 precursor RNA does not encode a protein. A nucleotide sequence identical or highly similar to the nucleotide sequence of VGAM1273 precursor RNA is designated SEQ ID:1259, and is provided hereinbelow with reference to the sequence listing part. Nucleotide sequence SEQ ID:1259 is located at position 7172 relative to the genome of A-2 Plaque Virus.

VGAM1273 precursor RNA folds onto itself, forming VGAM1273 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1273 folded precursor RNA into VGAM1273 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 85%) nucleotide sequence of VGAM1273 RNA is designated SEQ ID:3984, and is provided hereinbelow with reference to the sequence listing part.

VGAM1273 host target gene, herein designated VGAM HOST TARGET GENE, encodes a corresponding messenger RNA, VGAM1273 host target RNA, herein designated VGAM HOST TARGET RNA. VGAM1273 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1273 RNA, herein designated VGAM RNA, binds complementarily to one or more host target binding sites located in untranslated regions of VGAM1273 host target RNA, herein designated VGAM HOST TARGET RNA. This complementary binding is due to the fact that the nucleotide sequence of VGAM1273 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1273 RNA, herein designated VGAM RNA, may have a different number of host target binding sites in untranslated regions of a VGAM1273 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1273 RNA, herein designated VGAM RNA, to host target binding sites on VGAM1273 host target RNA, herein designated VGAM HOST TARGET RNA, such as BINDING SITE I, BINDING SITE II and BINDING SITE III, inhibits translation of VGAM1273 host target RNA into VGAM1273 host target protein, herein designated VGAM HOST TARGET PROTEIN. VGAM host target protein is therefore outlined by a broken line.

It is appreciated that VGAM1273 host target gene, herein designated VGAM HOST TARGET GENE, in fact represents a plurality of VGAM1273 host target genes. The mRNA of each one of this plurality of VGAM1273 host target genes comprises one or more host target binding sites, each having a nucleotide sequence which is at least partly complementary to VGAM1273 RNA, herein designated VGAM RNA, and which when bound by VGAM1273 RNA causes inhibition of translation of respective one or more VGAM1273 host target proteins.

It is further appreciated by one skilled in the art that the mode of translational inhibition illustrated by FIG. 1 with specific reference to translational inhibition exerted by VGAM1273 gene, herein designated VGAM GENE, on one or more VGAM1273 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1273 is inhibition of expression of host target genes, as part of a novel viral mechanism of attacking a host. Accordingly, utilities of VGAM1273 include diagnosis, prevention and treatment of viral infection by A-2 Plaque Virus. Specific functions, and accordingly utilities, of VGAM1273 correlate with, and may be deduced from, the identity of the host target genes which VGAM1273 binds and inhibits, and the function of these host target genes, as elaborated hereinbelow.

Nucleotide sequences of the VGAM1273 precursor RNA, herein designated VGAM PRECURSOR RNA, and of the 'diced' VGAM1273 RNA, herein designated VGAM RNA, and a schematic representation of the secondary folding of VGAM1273 folded precursor RNA, herein designated VGAM FOLDED PRECURSOR RNA, of VGAM1273 are further described hereinbelow with reference to Table 1.

Nucleotide sequences of host target binding sites, such as BINDING SITE-I, BINDING SITE-II and BINDING SITE-III of FIG. 1, found on VGAM1273 host target RNA, and schematic representation of the complementarity of each of these host target binding sites to VGAM1273 RNA, herein designated VGAM RNA, are described hereinbelow with reference to Table 2.

As mentioned hereinabove with reference to FIG. 1, a function of VGAM1273 gene, herein designated VGAM is inhibition of expression of VGAM1273 target genes. It is appreciated that specific functions, and accordingly utilities, of VGAM1273 correlate with, and may be deduced from, the identity of the target genes which VGAM1273 binds and inhibits, and the function of these target genes, as elaborated hereinbelow.

Core-binding Factor, Runt Domain, Alpha Subunit 2; Translocated To, 2 (CBFA2T2, Accession NM_005093) is a VGAM1273 host target gene. CBFA2T2 BINDING SITE is HOST TARGET binding site found in the 3' untranslated region of mRNA encoded by CBFA2T2, corresponding to a HOST TARGET binding site such as BINDING SITE I, BINDING SITE II or BINDING SITE III. Table 2 illustrates the complementarity of the nucleotide sequences of CBFA2T2 BINDING SITE, designated SEQ ID:11547, to the nucleotide sequence of VGAM1273 RNA, herein designated VGAM RNA, also designated SEQ ID:3984.

A function of VGAM1273 is therefore inhibition of Core-binding Factor, Runt Domain, Alpha Subunit 2; Translocated To, 2 (CBFA2T2, Accession NM_005093), a gene which is a putative transcription factor. Accordingly, utilities of VGAM1273 include diagnosis, prevention and treatment of diseases and clinical conditions associated with CBFA2T2. The function of CBFA2T2 and its association with various diseases and clinical conditions, has been established by previous studies, as described hereinabove with reference to VGAM152. Cytochrome P450, Subfamily XXIV (vitamin D 24-hydroxylase) (CYP24, Accession NM_000782) is another VGAM1273 host target gene. CYP24 BINDING SITE is HOST TARGET binding site found in the 3' untranslated region of mRNA encoded by CYP24, corresponding to a HOST TARGET binding site such as BINDING SITE I, BINDING SITE II or BINDING SITE III. Table 2 illustrates the complementarity of the nucleotide sequences of CYP24 BINDING SITE, designated SEQ ID:6430, to the nucleotide sequence of VGAM1273 RNA, herein designated VGAM RNA, also designated SEQ ID:3984.

Another function of VGAM1273 is therefore inhibition of Cytochrome P450, Subfamily XXIV (vitamin D 24-hydroxylase) (CYP24, Accession NM_000782), a gene which induces the differentiation of promyelocytes into monocytes/macrophages. Accordingly, utilities of VGAM1273 include diagnosis, prevention and treatment of diseases and clinical conditions associated with CYP24. The function of CYP24 and its association with various diseases and clinical conditions, has been established by previous studies, as described hereinabove with reference to VGAM1204. DEAD/H (Asp-Glu-Ala-Asp/His) Box Polypeptide 6 (RNA helicase, 54 kDa) (DDX6, Accession NM_004397) is another VGAM1273 host target gene. DDX6 BINDING SITE is HOST TARGET binding site found in the 3' untranslated region of mRNA encoded by DDX6, corresponding to a HOST TARGET binding site such as BINDING SITE I, BINDING SITE II or BINDING SITE III. Table 2 illustrates the complementarity of the nucleotide sequences of DDX6 BINDING SITE, designated SEQ ID:10643, to the nucleotide sequence of VGAM1273 RNA, herein designated VGAM RNA, also designated SEQ ID:3984.

Another function of VGAM1273 is therefore inhibition of DEAD/H (Asp-Glu-Ala-Asp/His) Box Polypeptide 6 (RNA helicase, 54 kDa) (DDX6, Accession NM_004397), a gene which is putative RNA helicases. Accordingly, utilities of VGAM1273 include diagnosis, prevention and treatment of diseases and clinical conditions associated with DDX6. The function of DDX6 and its association with various diseases and clinical conditions, has been established by previous studies, as described hereinabove with reference to VGAM179. Galactosamine (N-acetyl)-6-sulfate Sulfatase (Morquio syndrome, mucopolysaccharidosis type IVA) (GALNS, Accession NM_000512) is another VGAM1273 host target gene. GALNS BINDING SITE is HOST TARGET binding site found in the 3' untranslated region of mRNA encoded by GALNS, corresponding to a HOST TARGET binding site such as BINDING SITE I, BINDING SITE II or BINDING SITE III. Table 2 illustrates the complementarity of the nucleotide sequences of GALNS BINDING SITE, designated SEQ ID:6121, to the nucleotide sequence of VGAM1273 RNA, herein designated VGAM RNA, also designated SEQ ID:3984.

Another function of VGAM1273 is therefore inhibition of Galactosamine (N-acetyl)-6-sulfate Sulfatase (Morquio syndrome, mucopolysaccharidosis type IVA) (GALNS, Accession NM_000512). Accordingly, utilities of VGAM1273 include diagnosis, prevention and treatment of diseases and clinical conditions associated with GALNS. Heterogeneous Nuclear Ribonucleoprotein D (AU-rich element RNA binding protein 1, 37 kDa) (HNRPD, Accession NM_002138) is another VGAM1273 host target gene. HNRPD BINDING SITE1 and HNRPD BINDING SITE2 are HOST TARGET binding sites found in untranslated regions of mRNA encoded by HNRPD, corresponding to HOST TARGET binding sites such as BINDING SITE I, BINDING SITE II or BINDING SITE III. Table 2 illustrates the complementarity of the nucleotide sequences of HNRPD BINDING SITE1 and HNRPD BINDING SITE2, designated SEQ ID:7914 and SEQ ID:25364 respectively, to the nucleotide sequence of VGAM1273 RNA, herein designated VGAM RNA, also designated SEQ ID:3984.

Another function of VGAM1273 is therefore inhibition of Heterogeneous Nuclear Ribonucleoprotein D (AU-rich element RNA binding protein 1, 37 kDa) (HNRPD, Accession NM_002138). Accordingly, utilities of VGAM1273 include diagnosis, prevention and treatment of diseases and clinical conditions associated with HNRPD. Src Homology Three (SH3) and Cysteine Rich Domain (STAC, Accession NM_003149) is another VGAM1273 host target gene. STAC BINDING SITE is HOST TARGET binding site found in the 3' untranslated region of mRNA encoded by STAC, corresponding to a HOST TARGET binding site such as BINDING SITE I, BINDING SITE II or BINDING SITE III. Table 2 illustrates the complementarity of the nucleotide sequences of STAC BINDING SITE, designated SEQ ID:9118, to the nucleotide sequence of VGAM1273 RNA, herein designated VGAM RNA, also designated SEQ ID:3984.

Another function of VGAM1273 is therefore inhibition of Src Homology Three (SH3) and Cysteine Rich Domain (STAC, Accession NM_003149), a gene which is probably involved in a neuron-specific signal transduction. Accordingly, utilities of VGAM1273 include diagnosis, prevention and treatment of diseases and clinical conditions associated with STAC. The function of STAC and its association with various diseases and clinical conditions, has been established by previous studies, as described hereinabove with reference to VGAM331. Tetratricopeptide Repeat Domain 3 (TTC3, Accession NM_003316) is another VGAM1273 host target gene. TTC3 BINDING SITE is HOST TARGET binding site found in the 3' untranslated region of mRNA encoded by TTC3, corresponding to a HOST TARGET binding site such as BINDING SITE I, BINDING SITE II or BINDING SITE III. Table 2 illustrates the complementarity of the nucleotide sequences of TTC3 BINDING SITE, designated SEQ ID:9316, to the nucleotide sequence of VGAM1273 RNA, herein designated VGAM RNA, also designated SEQ ID:3984.

Another function of VGAM1273 is therefore inhibition of Tetratricopeptide Repeat Domain 3 (TTC3, Accession NM_003316), a gene which contains tetratricopeptide repeat (TPR) motifs. Accordingly, utilities of VGAM1273 include diagnosis, prevention and treatment of diseases and clinical conditions associated with TTC3. The function of TTC3 and its association with various diseases and clinical conditions, has been established by previous studies, as described hereinabove with reference to VGAM699. Angiomotin (AMOT, Accession NM_133265) is another VGAM1273 host target gene. AMOT BINDING SITE is HOST TARGET binding site found in the 3' untranslated region of mRNA encoded by AMOT, corresponding to a HOST TARGET binding site such as BINDING SITE I, BINDING SITE II or BINDING SITE III. Table 2 illustrates the complementarity of the nucleotide sequences of AMOT BINDING SITE, designated SEQ ID:28417, to the nucleotide sequence of VGAM1273 RNA, herein designated VGAM RNA, also designated SEQ ID:3984.

Another function of VGAM1273 is therefore inhibition of Angiomotin (AMOT, Accession NM_133265). Accordingly, utilities of VGAM1273 include diagnosis, prevention and treatment of diseases and clinical conditions associated with AMOT. UDP-GlcNAc:betaGal Beta-1,3-N-acetylglucosaminyltransferase 1 (B3GNT1, Accession NM_006577) is another VGAM1273 host target gene. B3GNT1 BINDING SITE is HOST TARGET binding site found in the 5' untranslated region of mRNA encoded by B3GNT1, corresponding to a HOST TARGET binding site such as BINDING SITE I, BINDING SITE II or BINDING SITE III. Table 2 illustrates the complementarity of the nucleotide sequences of B3GNT1 BINDING SITE, designated SEQ ID:13343, to the nucleotide sequence of VGAM1273 RNA, herein designated VGAM RNA, also designated SEQ ID:3984.

Another function of VGAM1273 is therefore inhibition of UDP-GlcNAc:betaGal Beta-1,3-N-acetylglucosaminyltransferase 1 (B3GNT1, Accession NM_006577). Accordingly, utilities of VGAM1273 include diagnosis, prevention and treatment of diseases and clinical conditions associated with B3GNT1. DKFZp434E1822 (Accession XM_043624) is another VGAM1273 host target gene. DKFZp434E1822 BINDING SITE is HOST TARGET binding site found in the 5' untranslated region of mRNA encoded by DKFZp434E1822, corresponding to a HOST TARGET binding site such as BINDING SITE I, BINDING SITE II or BINDING SITE III. Table 2 illustrates the complementarity of the nucleotide sequences of DKFZp434E1822 BINDING SITE, designated SEQ ID:33983, to the nucleotide sequence of VGAM1273 RNA, herein designated VGAM RNA, also designated SEQ ID:3984.

Another function of VGAM1273 is therefore inhibition of DKFZp434E1822 (Accession XM_043624). Accordingly, utilities of VGAM1273 include diagnosis, prevention and treatment of diseases and clinical conditions associated with DKFZp434E1822. FLJ20297 (Accession NM_017751) is another VGAM1273 host target gene. FLJ20297 BINDING SITE1 and FLJ20297 BINDING SITE2 are HOST TARGET binding sites found in untranslated regions of mRNA encoded by FLJ20297, corresponding to HOST TARGET binding sites such as BINDING SITE I, BINDING SITE II or BIND- ING SITE III. Table 2 illustrates the complementarity of the nucleotide sequences of FLJ20297 BINDING SITE1 and FLJ20297 BINDING SITE2, designated SEQ ID:19359 and SEQ ID:19649 respectively, to the nucleotide sequence of VGAM1273 RNA, herein designated VGAM RNA, also designated SEQ ID:3984.

Another function of VGAM1273 is therefore inhibition of FLJ20297 (Accession NM_017751). Accordingly, utilities of VGAM1273 include diagnosis, prevention and treatment of diseases and clinical conditions associated with FLJ20297. G2 (Accession XM_039515) is another VGAM1273 host target gene. G2 BINDING SITE is HOST TARGET binding site found in the 3' untranslated region of mRNA encoded by G2, corresponding to a HOST TARGET binding site such as BINDING SITE I, BINDING SITE II or BINDING SITE III. Table 2 illustrates the complementarity of the nucleotide sequences of G2 BINDING SITE, designated SEQ ID:33113, to the nucleotide sequence of VGAM1273 RNA, herein designated VGAM RNA, also designated SEQ ID:3984.

Another function of VGAM1273 is therefore inhibition of G2 (Accession XM_039515). Accordingly, utilities of VGAM1273 include diagnosis, prevention and treatment of diseases and clinical conditions associated with G2. KIAA0286 (Accession XM_043118) is another VGAM1273 host target gene. KIAA0286 BINDING SITE is HOST TARGET binding site found in the 3' untranslated region of mRNA encoded by KIAA0286, corresponding to a HOST TARGET binding site such as BINDING SITE I, BINDING SITE II or BINDING SITE III. Table 2 illustrates the complementarity of the nucleotide sequences of KIAA0286 BINDING SITE, designated SEQ ID:33904, to the nucleotide sequence of VGAM1273 RNA, herein designated VGAM RNA, also designated SEQ ID:3984.

Another function of VGAM1273 is therefore inhibition of KIAA0286 (Accession XM_043118). Accordingly, utilities of VGAM1273 include diagnosis, prevention and treatment of diseases and clinical conditions associated with KIAA0286. Phospholipase A2, Group XII (PLA2G12, Accession NM_030821) is another VGAM1273 host target gene. PLA2G12 BINDING SITE is HOST TARGET binding site found in the 3" untranslated region of mRNA encoded by PLA2G12, corresponding to a HOST TARGET binding site such as BINDING SITE I, BINDING SITE II or BINDING SITE III. Table 2 illustrates the complementarity of the nucleotide sequences of PLA2G12 BINDING SITE, designated SEQ ID:25150, to the nucleotide sequence of VGAM1273 RNA, herein designated VGAM RNA, also designated SEQ ID:3984.

Another function of VGAM1273 is therefore inhibition of Phospholipase A2, Group XII (PLA2G12, Accession NM_030821). Accordingly, utilities of VGAM1273 include diagnosis, prevention and treatment of diseases and clinical conditions associated with PLA2G12. SV2B (Accession NM_014848) is another VGAM1273 host target gene. SV2B BINDING SITE is HOST TARGET binding site found in the 3' untranslated region of mRNA encoded by SV2B, corresponding to a HOST TARGET binding site such as BINDING SITE I, BINDING SITE II or BINDING SITE III. Table 2 illustrates the complementarity of the nucleotide sequences of SV2B BINDING SITE, designated SEQ ID:16883, to the nucleotide sequence of VGAM1273 RNA, herein designated VGAM RNA, also designated SEQ ID:3984.

Another function of VGAM1273 is therefore inhibition of SV2B (Accession NM_014848). Accordingly, utilities of VGAM1273 include diagnosis, prevention and treatment of diseases and clinical conditions associated with SV2B. LOC133634 (Accession XM_059664) is another VGAM1273 host target gene. LOC133634 BINDING SITE is HOST TARGET binding site found in the 3' untranslated region of mRNA encoded by LOC133634, corresponding to a HOST TARGET binding site such as BINDING SITE I, BINDING SITE II or BINDING SITE III. Table 2 illustrates the complementarity of the nucleotide sequences of LOC133634 BINDING SITE, designated SEQ ID:37050, to the nucleotide sequence of VGAM1273 RNA, herein designated VGAM RNA, also designated SEQ ID:3984.

Another function of VGAM1273 is therefore inhibition of LOC133634 (Accession XM_059664). Accordingly, utilities of VGAM1273 include diagnosis, prevention and treatment of diseases and clinical conditions associated with LOC133634. LOC146146 (Accession XM_085343) is another VGAM1273 host target gene. LOC146146 BINDING SITE is HOST TARGET binding site found in the 5' untranslated region of mRNA encoded by LOC146146, corresponding to a HOST TARGET binding site such as BINDING SITE I, BINDING SITE II or BINDING SITE III. Table 2 illustrates the complementarity of the nucleotide sequences of LOC146146 BINDING SITE, designated SEQ ID:38073, to the nucleotide sequence of VGAM1273 RNA, herein designated VGAM RNA, also designated SEQ ID:3984.

Another function of VGAM1273 is therefore inhibition of LOC146146 (Accession XM_085343). Accordingly, utilities of VGAM1273 include diagnosis, prevention and treatment of diseases and clinical conditions associated with LOC146146. LOC146452 (Accession XM_085473) is another VGAM1273 host target gene. LOC146452 BINDING SITE is HOST TARGET binding site found in the 3' untranslated region of mRNA encoded by LOC146452, corresponding to a HOST TARGET binding site such as BINDING SITE I, BINDING SITE II or BINDING SITE III. Table 2 illustrates the complementarity of the nucleotide sequences of LOC146452 BINDING SITE, designated SEQ ID:38165, to the nucleotide sequence of VGAM1273 RNA, herein designated VGAM RNA, also designated SEQ ID:3984.

Another function of VGAM1273 is therefore inhibition of LOC146452 (Accession XM_085473). Accordingly, utilities of VGAM1273 include diagnosis, prevention and treatment of diseases and clinical conditions associated with LOC146452. LOC150630 (Accession XM_097931) is another VGAM1273 host target gene. LOC150630 BINDING SITE is HOST TARGET binding site found in the 3' untranslated region of mRNA encoded by LOC150630, corresponding to a HOST TARGET binding site such as BINDING SITE I, BINDING SITE II or BINDING SITE III. Table 2 illustrates the complementarity of the nucleotide sequences of LOC150630 BINDING SITE, designated SEQ ID:41242, to the nucleotide sequence of VGAM1273 RNA, herein designated VGAM RNA, also designated SEQ ID:3984.

Another function of VGAM1273 is therefore inhibition of LOC150630 (Accession XM_097931). Accordingly, utilities of VGAM1273 include diagnosis, prevention and treatment of diseases and clinical conditions associated with LOC150630. LOC150776 (Accession XM_032542) is another VGAM1273 host target gene. LOC150776 BINDING SITE is HOST TARGET binding site found in the 3' untranslated region of mRNA encoded by LOC150776, corresponding to a HOST TARGET binding site such as BINDING SITE I, BINDING SITE II or BINDING SITE III. Table 2 illustrates the complementarity of the nucleotide sequences of LOC150776 BINDING SITE, designated SEQ ID:31676, to the nucleotide sequence of VGAM1273 RNA, herein designated VGAM RNA, also designated SEQ ID:3984.

Another function of VGAM1273 is therefore inhibition of LOC150776 (Accession XM_032542). Accordingly, utilities of VGAM1273 include diagnosis, prevention and treatment of diseases and clinical conditions associated with LOC150776. LOC164295 (Accession XM_092767) is another VGAM1273 host target gene. LOC164295 BINDING SITE is HOST TARGET binding site found in the 5' untranslated region of mRNA encoded by LOC164295, corresponding to a HOST TARGET binding site such as BINDING SITE I, BINDING SITE II or BINDING SITE III. Table 2 illustrates the complementarity of the nucleotide sequences of LOC164295 BINDING SITE, designated SEQ ID:40141, to the nucleotide sequence of VGAM1273 RNA, herein designated VGAM RNA, also designated SEQ ID:3984.

Another function of VGAM1273 is therefore inhibition of LOC164295 (Accession XM_092767). Accordingly, utilities of VGAM1273 include diagnosis, prevention and treatment of diseases and clinical conditions associated with LOC164295. LOC203429 (Accession XM_114701) is another VGAM1273 host target gene. LOC203429 BINDING SITE is HOST TARGET binding site found in the 3' untranslated region of mRNA encoded by LOC203429, corresponding to a HOST TARGET binding site such as BINDING SITE I, BINDING SITE II or BINDING SITE III. Table 2 illustrates the complementarity of the nucleotide sequences of LOC203429 BINDING SITE, designated SEQ ID:43048, to the nucleotide sequence of VGAM1273 RNA, herein designated VGAM RNA, also designated SEQ ID:3984.

Another function of VGAM1273 is therefore inhibition of LOC203429 (Accession XM_114701). Accordingly, utilities of VGAM1273 include diagnosis, prevention and treatment of diseases and clinical conditions associated with LOC203429. LOC221272 (Accession XM_168050) is another VGAM1273 host target gene. LOC221272 BINDING SITE is HOST TARGET binding site found in the 5' untranslated region of mRNA encoded by LOC221272, corresponding to a HOST TARGET binding site such as BINDING SITE I, BINDING SITE II or BINDING SITE III. Table 2 illustrates the complementarity of the nucleotide sequences of LOC221272 BINDING SITE, designated SEQ ID:44964, to the nucleotide sequence of VGAM1273 RNA, herein designated VGAM RNA, also designated SEQ ID:3984.

Another function of VGAM1273 is therefore inhibition of LOC221272 (Accession XM_168050). Accordingly, utilities of VGAM1273 include diagnosis, prevention and treatment of diseases and clinical conditions associated with LOC221272. LOC91445 (Accession XM_018516) is another VGAM1273 host target gene. LOC91445 BINDING SITE is HOST TARGET binding site found in the 3' untranslated region of mRNA encoded by LOC91445, corresponding to a HOST TARGET binding site such as BINDING SITE I, BINDING SITE II or BINDING SITE III. Table 2 illustrates the complementarity of the nucleotide sequences of LOC91445 BINDING SITE, designated SEQ ID:30372, to the nucleotide sequence of VGAM1273 RNA, herein designated VGAM RNA, also designated SEQ ID:3984.

Another function of VGAM1273 is therefore inhibition of LOC91445 (Accession XM_018516). Accordingly, utilities of VGAM1273 include diagnosis, prevention and treatment of diseases and clinical conditions associated with LOC91445. LOC92497 (Accession XM_045436) is another VGAM1273 host target gene. LOC92497 BINDING SITE is HOST TARGET binding site found in the 5' untranslated region of mRNA encoded by LOC92497, corresponding to a HOST TARGET binding site such as BINDING SITE I, BINDING SITE II or BINDING SITE III. Table 2 illustrates the complementarity of the nucleotide sequences of LOC92497 BINDING SITE, designated SEQ ID:34461, to the nucleotide sequence of VGAM1273 RNA, herein designated VGAM RNA, also designated SEQ ID:3984.

Another function of VGAM1273 is therefore inhibition of LOC92497 (Accession XM_045436). Accordingly, utilities of VGAM1273 include diagnosis, prevention and treatment of diseases and clinical conditions associated with LOC92497. LOC92689 (Accession XM_046663) is another VGAM1273 host target gene. LOC92689 BINDING SITE is HOST TARGET binding site found in the 3' untranslated region of mRNA encoded by LOC92689, corresponding to a HOST TARGET binding site such as BINDING SITE I, BINDING SITE II or BINDING SITE III. Table 2 illustrates the complementarity of the nucleotide sequences of LOC92689 BINDING SITE, designated SEQ ID:34782, to the nucleotide sequence of VGAM1273 RNA, herein designated VGAM RNA, also designated SEQ ID:3984.

Another function of VGAM1273 is therefore inhibition of LOC92689 (Accession XM_046663). Accordingly, utilities of VGAM1273 include diagnosis, prevention and treatment of diseases and clinical conditions associated with LOC92689. FIG. 1 further provides a conceptual description of a novel bioinformatically detected viral gene of the present invention, referred to here as Viral Genomic Address Messenger 1274 (VGAM1274) viral gene, which modulates expression of respective host target genes thereof, the function and utility of which host target genes is known in the art.

VGAM1274 is a novel bioinformatically detected regulatory, non protein coding, viral micro RNA (miRNA) gene. The method by which VGAM1274 was detected is described hereinabove with reference to FIGS. 1-8.

VGAM1274 gene, herein designated VGAM GENE, is a viral gene contained in the genome of A-2 Plaque Virus. VGAM1274 host target gene, herein designated VGAM HOST TARGET GENE, is a human gene contained in the human genome.

VGAM1274 gene encodes a VGAM1274 precursor RNA, herein designated VGAM PRECURSOR RNA. Similar to other miRNA genes, and unlike most ordinary genes, VGAM1274 precursor RNA does not encode a protein. A nucleotide sequence identical or highly similar to the nucleotide sequence of VGAM1274 precursor RNA is designated SEQ ID:1260, and is provided hereinbelow with reference to the sequence listing part. Nucleotide sequence SEQ ID:1260 is located at position 5481 relative to the genome of A-2 Plaque Virus.

VGAM1274 precursor RNA folds onto itself, forming VGAM1274 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1274 folded precursor RNA into VGAM1274 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1274 RNA is designated SEQ ID:3985, and is provided hereinbelow with reference to the sequence listing part.

VGAM1274 host target gene, herein designated VGAM HOST TARGET GENE, encodes a corresponding messenger RNA, VGAM1274 host target RNA, herein designated VGAM HOST TARGET RNA. VGAM1274 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1274 RNA, herein designated VGAM RNA, binds complementarily to one or more host target binding sites located in untranslated regions of VGAM1274 host target RNA, herein designated VGAM HOST TARGET RNA. This complementary binding is due to the fact that the nucleotide sequence of VGAM1274 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1274 RNA, herein designated VGAM RNA, may have a different number of host target binding sites in untranslated regions of a VGAM1274 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1274 RNA, herein designated VGAM RNA, to host target binding sites on VGAM1274 host target RNA, herein designated VGAM HOST TARGET RNA, such as BINDING SITE I, BINDING SITE II and BINDING SITE III, inhibits translation of VGAM1274 host target RNA into VGAM1274 host target protein, herein designated VGAM HOST TARGET PROTEIN. VGAM host target protein is therefore outlined by a broken line.

It is appreciated that VGAM1274 host target gene, herein designated VGAM HOST TARGET GENE, in fact represents a plurality of VGAM1274 host target genes. The mRNA of each one of this plurality of VGAM1274 host target genes comprises one or more host target binding sites, each having a nucleotide sequence which is at least partly complementary to VGAM1274 RNA, herein designated VGAM RNA, and which when bound by VGAM1274 RNA causes inhibition of translation of respective one or more VGAM1274 host target proteins.

It is further appreciated by one skilled in the art that the mode of translational inhibition illustrated by FIG. 1 with specific reference to translational inhibition exerted by VGAM1274 gene, herein designated VGAM GENE, on one or more VGAM1274 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1274 is inhibition of expression of host target genes, as part of a novel viral mechanism of attacking a host. Accordingly, utilities of VGAM1274 include diagnosis, prevention and treatment of viral infection by A-2 Plaque Virus. Specific functions, and accordingly utilities, of VGAM1274 correlate with, and may be deduced from, the identity of the host target genes which VGAM1274 binds and inhibits, and the function of these host target genes, as elaborated hereinbelow.

Nucleotide sequences of the VGAM1274 precursor RNA, herein designated VGAM PRECURSOR RNA, and of the 'diced' VGAM1274 RNA, herein designated VGAM RNA, and a schematic representation of the secondary folding of VGAM1274 folded precursor RNA, herein designated VGAM FOLDED PRECURSOR RNA, of VGAM1274 are further described hereinbelow with reference to Table 1.

Nucleotide sequences of host target binding sites, such as BINDING SITE-I, BINDING SITE-II and BINDING SITE-III of FIG. 1, found on VGAM1274 host target RNA, and schematic representation of the complementarity of each of these host target binding sites to VGAM1274 RNA, herein designated VGAM RNA, are described hereinbelow with reference to Table 2.

As mentioned hereinabove with reference to FIG. 1, a function of VGAM1274 gene, herein designated VGAM is inhibition of expression of VGAM1274 target genes. It is appreciated that specific functions, and accordingly utilities, of VGAM1274 correlate with, and may be deduced from, the identity of the target genes which VGAM1274 binds and inhibits, and the function of these target genes, as elaborated hereinbelow.

Inositol Polyphosphate-5-phosphatase, 75 kDa (INPP5B, Accession XM_170949) is a VGAM1274 host target gene. INPP5B BINDING SITE is HOST TARGET binding site found in the 3' untranslated region of mRNA encoded by INPP5B, corresponding to a HOST TARGET binding site such as BINDING SITE I, BINDING SITE II or BINDING SITE III. Table 2 illustrates the complementarity of the nucleotide sequences of INPP5B BINDING SITE, designated SEQ ID:45735, to the nucleotide sequence of VGAM1274 RNA, herein designated VGAM RNA, also designated SEQ ID:3985.

A function of VGAM1274 is therefore inhibition of Inositol Polyphosphate-5-phosphatase, 75 kDa (INPP5B, Accession XM_170949), a gene which hydrolyzes the calcium-mobilizing second messenger ins (1,4,5) p3. Accordingly, utilities of VGAM1274 include diagnosis, prevention and treatment of diseases and clinical conditions associated with INPP5B. The function of INPP5B and its association with various diseases and clinical conditions, has been established by previous studies, as described hereinabove with reference to VGAM50. FLJ23790 (Accession NM_144963) is another VGAM1274 host target gene. FLJ23790 BINDING SITE is HOST TARGET binding site found in the 5' untranslated region of mRNA encoded by FLJ23790, corresponding to a HOST TARGET binding site such as BINDING SITE I, BINDING SITE II or BINDING SITE III. Table 2 illustrates the complementarity of the nucleotide sequences of FLJ23790 BINDING SITE, designated SEQ ID:29579, to the nucleotide sequence of VGAM1274 RNA, herein designated VGAM RNA, also designated SEQ ID:3985.

Another function of VGAM1274 is therefore inhibition of FLJ23790 (Accession NM_144963). Accordingly, utilities of VGAM1274 include diagnosis, prevention and treatment of diseases and clinical conditions associated with FLJ23790. KIAA0493 (Accession XM_034717) is another VGAM1274 host target gene. KIAA0493 BINDING SITE is HOST TARGET binding site found in the 5' untranslated region of mRNA encoded by KIAA0493, corresponding to a HOST TARGET binding site such as BINDING SITE I, BINDING SITE II or BINDING SITE III. Table 2 illustrates the complementarity of the nucleotide sequences of KIAA0493 BIND- ING SITE, designated SEQ ID:32138, to the nucleotide sequence of VGAM1274 RNA, herein designated VGAM RNA, also designated SEQ ID:3985.

Another function of VGAM1274 is therefore inhibition of KIAA0493 (Accession XM_034717). Accordingly, utilities of VGAM1274 include diagnosis, prevention and treatment of diseases and clinical conditions associated with KIAA0493. KIAA0596 (Accession XM_031706) is another VGAM1274 host target gene. KIAA0596 BINDING SITE is HOST TARGET binding site found in the 3' untranslated region of mRNA encoded by KIAA0596, corresponding to a HOST TARGET binding site such as BINDING SITE I, BINDING SITE II or BINDING SITE III. Table 2 illustrates the complementarity of the nucleotide sequences of KIAA0596 BINDING SITE, designated SEQ ID:31460, to the nucleotide sequence of VGAM1274 RNA, herein designated VGAM RNA, also designated SEQ ID:3985.

Another function of VGAM1274 is therefore inhibition of KIAA0596 (Accession XM_031706). Accordingly, utilities of VGAM1274 include diagnosis, prevention and treatment of diseases and clinical conditions associated with KIAA0596. FIG. 1 further provides a conceptual description of a novel bioinformatically detected viral gene of the present invention, referred to here as Viral Genomic Address Messenger 1275 (VGAM1275) viral gene, which modulates expression of respective host target genes thereof, the function and utility of which host target genes is known in the art.

VGAM1275 is a novel bioinformatically detected regulatory, non protein coding, viral micro RNA (miRNA) gene. The method by which VGAM1275 was detected is described hereinabove with reference to FIGS. 1-8.

VGAM1275 gene, herein designated VGAM GENE, is a viral gene contained in the genome of A-2 Plaque Virus. VGAM1275 host target gene, herein designated VGAM HOST TARGET GENE, is a human gene contained in the human genome.

VGAM1275 gene encodes a VGAM1275 precursor RNA, herein designated VGAM PRECURSOR RNA. Similar to other miRNA genes, and unlike most ordinary genes, VGAM1275 precursor RNA does not encode a protein. A nucleotide sequence identical or highly similar to the nucleotide sequence of VGAM1275 precursor RNA is designated SEQ ID:1261, and is provided hereinbelow with reference to the sequence listing part. Nucleotide sequence SEQ ID:1261 is located at position 5027 relative to the genome of A-2 Plaque Virus.

VGAM1275 precursor RNA folds onto itself, forming VGAM1275 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1275 folded precursor RNA into VGAM1275 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1275 RNA is designated SEQ ID:3986, and is provided hereinbelow with reference to the sequence listing part.

VGAM1275 host target gene, herein designated VGAM HOST TARGET GENE, encodes a corresponding messenger RNA, VGAM1275 host target RNA, herein designated VGAM HOST TARGET RNA. VGAM1275 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1275 RNA, herein designated VGAM RNA, binds complementarily to one or more host target binding sites located in untranslated regions of VGAM1275 host target RNA, herein designated VGAM HOST TARGET RNA. This complementary binding is due to the fact that the nucleotide sequence of VGAM1275 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1275 RNA, herein designated VGAM RNA, may have a different number of host target binding sites in untranslated regions of a VGAM1275 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1275 RNA, herein designated VGAM RNA, to host target binding sites on VGAM1275 host target RNA, herein designated VGAM HOST TARGET RNA, such as BINDING SITE I, BINDING SITE II and BINDING SITE III, inhibits translation of VGAM1275 host target RNA into VGAM1275 host target protein, herein designated VGAM HOST TARGET PROTEIN. VGAM host target protein is therefore outlined by a broken line.

It is appreciated that VGAM1275 host target gene, herein designated VGAM HOST TARGET GENE, in fact represents a plurality of VGAM1275 host target genes. The mRNA of each one of this plurality of VGAM1275 host target genes comprises one or more host target binding sites, each having a nucleotide sequence which is at least partly complementary to VGAM1275 RNA, herein designated VGAM RNA, and which when bound by VGAM1275 RNA causes inhibition of translation of respective one or more VGAM1275 host target proteins.

It is further appreciated by one skilled in the art that the mode of translational inhibition illustrated by FIG. 1 with specific reference to translational inhibition exerted by VGAM1275 gene, herein designated VGAM GENE, on one or more VGAM1275 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1275 is inhibition of expression of host target genes, as part of a novel viral mechanism of attacking a host. Accordingly, utilities of VGAM1275 include diagnosis, prevention and treatment of viral infection by A-2 Plaque Virus. Specific functions, and accordingly utilities, of VGAM1275 correlate with, and may be deduced from, the identity of the host target genes which VGAM1275 binds and inhibits, and the function of these host target genes, as elaborated hereinbelow.

Nucleotide sequences of the VGAM1275 precursor RNA, herein designated VGAM PRECURSOR RNA, and of the 'diced' VGAM1275 RNA, herein designated VGAM RNA, and a schematic representation of the secondary folding of VGAM1275 folded precursor RNA, herein designated VGAM FOLDED PRECURSOR RNA, of VGAM1275 are further described hereinbelow with reference to Table 1.

Nucleotide sequences of host target binding sites, such as BINDING SITE-I, BINDING SITE-II and BINDING SITE-III of FIG. 1, found on VGAM1275 host target RNA, and schematic representation of the complementarity of each of these host target binding sites to VGAM1275 RNA, herein designated VGAM RNA, are described hereinbelow with reference to Table 2.

As mentioned hereinabove with reference to FIG. 1, a function of VGAM1275 gene, herein designated VGAM is inhibition of expression of VGAM1275 target genes. It is appreciated that specific functions, and accordingly utilities, of VGAM1275 correlate with, and may be deduced from, the identity of the target genes which VGAM1275 binds and inhibits, and the function of these target genes, as elaborated hereinbelow.

Myosin IC (MYO1C, Accession XM_028385) is a VGAM1275 host target gene. MYO1C BINDING SITE is HOST TARGET binding site found in the 3' untranslated region of mRNA encoded by MYO1C, corresponding to a HOST TARGET binding site such as BINDING SITE I, BINDING SITE II or BINDING SITE III. Table 2 illustrates the complementarity of the nucleotide sequences of MYO1C BINDING SITE, designated SEQ ID:30695, to the nucleotide sequence of VGAM1275 RNA, herein designated VGAM RNA, also designated SEQ ID:3986.

A function of VGAM1275 is therefore inhibition of Myosin IC (MYO1C, Accession XM_028385), a gene which participates in adaptation in hair cells. Accordingly, utilities of VGAM1275 include diagnosis, prevention and treatment of diseases and clinical conditions associated with MYO1C. The function of MYO1C and its association with various diseases and clinical conditions, has been established by previous studies, as described hereinabove with reference to VGAM381. FLJ20209 (Accession XM_098142) is another VGAM1275 host target gene. FLJ20209 BINDING SITE is HOST TARGET binding site found in the 3' untranslated region of mRNA encoded by FLJ20209, corresponding to a HOST TARGET binding site such as BINDING SITE I, BINDING SITE II or BINDING SITE III. Table 2 illustrates the complementarity of the nucleotide sequences of FLJ20209 BINDING SITE, designated SEQ ID:41401, to the nucleotide sequence of VGAM1275 RNA, herein designated VGAM RNA, also designated SEQ ID:3986.

Another function of VGAM1275 is therefore inhibition of FLJ20209 (Accession XM_098142). Accordingly, utilities of VGAM1275 include diagnosis, prevention and treatment of diseases and clinical conditions associated with FLJ20209. FLJ21919 (Accession NM_023015) is another VGAM1275 host target gene. FLJ21919 BINDING SITE is HOST TARGET binding site found in the 3' untranslated region of mRNA encoded by FLJ21919, corresponding to a HOST TARGET binding site such as BINDING SITE I, BINDING SITE II or BINDING SITE III. Table 2 illustrates the complementarity of the nucleotide sequences of FLJ21919 BINDING SITE, designated SEQ ID:23277, to the nucleotide sequence of VGAM1275 RNA, herein designated VGAM RNA, also designated SEQ ID:3986.

Another function of VGAM1275 is therefore inhibition of FLJ21919 (Accession NM_023015). Accordingly, utilities of VGAM1275 include diagnosis, prevention and treatment of diseases and clinical conditions associated with FLJ21919. FLJ30678 (Accession NM_144657) is another VGAM1275 host target gene. FLJ30678 BINDING SITE is HOST TARGET binding site found in the 5' untranslated region of mRNA encoded by FLJ30678, corresponding to a HOST TARGET binding site such as BINDING SITE I, BINDING SITE II or BINDING SITE III. Table 2 illustrates the complementarity of the nucleotide sequences of FLJ30678 BINDING SITE, designated SEQ ID:29479, to the nucleotide sequence of VGAM1275 RNA, herein designated VGAM RNA, also designated SEQ ID:3986.

Another function of VGAM1275 is therefore inhibition of FLJ30678 (Accession NM_144657). Accordingly, utilities of VGAM1275 include diagnosis, prevention and treatment of diseases and clinical conditions associated with FLJ30678. FYVE and Coiled-coil Domain Containing 1 (FYCO1, Accession NM_024513) is another VGAM1275 host target gene. FYCO1 BINDING SITE is HOST TARGET binding site found in the 3' untranslated region of mRNA encoded by FYCO1, corresponding to a HOST TARGET binding site such as BINDING SITE I, BINDING SITE II or BINDING SITE III. Table 2 illustrates the complementarity of the nucleotide sequences of FYCO1 BINDING SITE, designated SEQ ID:23706, to the nucleotide sequence of VGAM1275 RNA, herein designated VGAM RNA, also designated SEQ ID:3986.

Another function of VGAM1275 is therefore inhibition of FYVE and Coiled-coil Domain Containing 1 (FYCO1, Accession NM_024513). Accordingly, utilities of VGAM1275 include diagnosis, prevention and treatment of diseases and clinical conditions associated with FYCO1. FIG. 1 further provides a conceptual description of a novel bioinformatically detected viral gene of the present invention, referred to here as Viral Genomic Address Messenger 1276 (VGAM1276) viral gene, which modulates expression of respective host target genes thereof, the function and utility of which host target genes is known in the art.

VGAM1276 is a novel bioinformatically detected regulatory, non protein coding, viral micro RNA (miRNA) gene. The method by which VGAM1276 was detected is described hereinabove with reference to FIGS. 1-8.

VGAM1276 gene, herein designated VGAM GENE, is a viral gene contained in the genome of A-2 Plaque Virus. VGAM1276 host target gene, herein designated VGAM HOST TARGET GENE, is a human gene contained in the human genome.

VGAM1276 gene encodes a VGAM1276 precursor RNA, herein designated VGAM PRECURSOR RNA. Similar to other miRNA genes, and unlike most ordinary genes, VGAM1276 precursor RNA does not encode a protein. A nucleotide sequence identical or highly similar to the nucleotide sequence of VGAM1276 precursor RNA is designated SEQ ID:1262, and is provided hereinbelow with reference to the sequence listing part. Nucleotide sequence SEQ ID:1262 is located at position 6716 relative to the genome of A-2 Plaque Virus.

VGAM1276 precursor RNA folds onto itself, forming VGAM1276 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1276 folded precursor RNA into VGAM1276 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1276 RNA is designated SEQ ID:3987, and is provided hereinbelow with reference to the sequence listing part.

VGAM1276 host target gene, herein designated VGAM HOST TARGET GENE, encodes a corresponding messenger RNA, VGAM1276 host target RNA, herein designated VGAM HOST TARGET RNA. VGAM1276 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1276 RNA, herein designated VGAM RNA, binds complementarily to one or more host target binding sites located in untranslated regions of VGAM1276 host target RNA, herein designated VGAM HOST TARGET RNA. This complementary binding is due to the fact that the nucleotide sequence of VGAM1276 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1276 RNA, herein designated VGAM RNA, may have a different number of host target binding sites in untranslated regions of a VGAM1276 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1276 RNA, herein designated VGAM RNA, to host target binding sites on VGAM1276 host target RNA, herein designated VGAM HOST TARGET RNA, such as BINDING SITE I, BINDING SITE II and BINDING SITE III, inhibits translation of VGAM1276 host target RNA into VGAM1276 host target protein, herein designated VGAM HOST TARGET PROTEIN. VGAM host target protein is therefore outlined by a broken line.

It is appreciated that VGAM1276 host target gene, herein designated VGAM HOST TARGET GENE, in fact represents a plurality of VGAM1276 host target genes. The mRNA of each one of this plurality of VGAM1276 host target genes comprises one or more host target binding sites, each having a nucleotide sequence which is at least partly complementary to VGAM1276 RNA, herein designated VGAM RNA, and which when bound by VGAM1276 RNA causes inhibition of translation of respective one or more VGAM1276 host target proteins.

It is further appreciated by one skilled in the art that the mode of translational inhibition illustrated by FIG. 1 with specific reference to translational inhibition exerted by VGAM1276 gene, herein designated VGAM GENE, on one or more VGAM1276 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1276 is inhibition of expression of host target genes, as part of a novel viral mechanism of attacking a host. Accordingly, utilities of VGAM1276 include diagnosis, prevention and treatment of viral infection by A-2 Plaque Virus. Specific functions, and accordingly utilities, of VGAM1276 correlate with, and may be deduced from, the identity of the host target genes which VGAM1276 binds and inhibits, and the function of these host target genes, as elaborated hereinbelow.

Nucleotide sequences of the VGAM1276 precursor RNA, herein designated VGAM PRECURSOR RNA, and of the 'diced' VGAM1276 RNA, herein designated VGAM RNA, and a schematic representation of the secondary folding of VGAM1276 folded precursor RNA, herein designated VGAM FOLDED PRECURSOR RNA, of VGAM1276 are further described hereinbelow with reference to Table 1.

Nucleotide sequences of host target binding sites, such as BINDING SITE-I, BINDING SITE-II and BINDING SITE-III of FIG. 1, found on VGAM1276 host target RNA, and schematic representation of the complementarity of each of these host target binding sites to VGAM1276 RNA, herein designated VGAM RNA, are described hereinbelow with reference to Table 2.

As mentioned hereinabove with reference to FIG. 1, a function of VGAM1276 gene, herein designated VGAM is inhibition of expression of VGAM1276 target genes. It is appreciated that specific functions, and accordingly utilities, of VGAM1276 correlate with, and may be deduced from, the identity of the target genes which VGAM1276 binds and inhibits, and the function of these target genes, as elaborated hereinbelow.

Amylo-1, 6-glucosidase, 4-alpha-glucanotransferase (glycogen debranching enzyme, glycogen storage disease type III) (AGL, Accession NM_000028) is a VGAM1276 host target gene. AGL BINDING SITE1 through AGL BINDING SITE6 are HOST TARGET binding sites found in untranslated regions of mRNA encoded by AGL, corresponding to HOST TARGET binding sites such as BINDING SITE I, BINDING SITE II or BINDING SITE III. Table 2 illustrates the complementarity of the nucleotide sequences of AGL BINDING SITE1 through AGL BINDING SITE6, designated SEQ ID:5465, SEQ ID:6282, SEQ ID:6287, SEQ ID:6292, SEQ ID:6297 and SEQ ID:6304 respectively, to the nucleotide sequence of VGAM1276 RNA, herein designated VGAM RNA, also designated SEQ ID:3987.

A function of VGAM1276 is therefore inhibition of Amylo-1, 6-glucosidase, 4-alpha-glucanotransferase (glycogen debranching enzyme, glycogen storage disease type III) (AGL, Accession NM_000028). Accordingly, utilities of VGAM1276 include diagnosis, prevention and treatment of diseases and clinical conditions associated with AGL. Ankyrin 2, Neuronal (ANK2, Accession NM_020977) is another VGAM1276 host target gene. ANK2 BINDING SITE1 and ANK2 BINDING SITE2 are HOST TARGET binding sites found in untranslated regions of mRNA encoded by ANK2, corresponding to HOST TARGET binding sites such as BINDING SITE I, BINDING SITE II or BINDING SITE III. Table 2 illustrates the complementarity of the nucleotide sequences of ANK2 BINDING SITE1 and ANK2 BINDING SITE2, designated SEQ ID:21965 and SEQ ID:13134 respectively, to the nucleotide sequence of VGAM1276 RNA, herein designated VGAM RNA, also designated SEQ ID:3987.

Another function of VGAM1276 is therefore inhibition of Ankyrin 2, Neuronal (ANK2, Accession NM_020977), a gene which attaches integral membrane proteins to cytoskeletal elements. also binds to cytoskeletal proteins. Accordingly, utilities of VGAM1276 include diagnosis, prevention and treatment of diseases and clinical conditions associated with ANK2. The function of ANK2 and its association with various diseases and clinical conditions, has been established by previous studies, as described hereinabove with reference to VGAM769. Plastin 1 (I isoform) (PLS1, Accession NM_002670) is another VGAM1276 host target gene. PLS1 BINDING SITE is HOST TARGET binding site found in the 3' untranslated region of mRNA encoded by PLS1, corresponding to a HOST TARGET binding site such as BINDING SITE I, BINDING SITE II or BINDING SITE III. Table 2 illustrates the complementarity of the nucleotide sequences of PLS1 BINDING SITE, designated SEQ ID:8540, to the nucleotide sequence of VGAM1276 RNA, herein designated VGAM RNA, also designated SEQ ID:3987.

Another function of VGAM1276 is therefore inhibition of Plastin 1 (I isoform) (PLS1, Accession NM_002670). Accordingly, utilities of VGAM1276 include diagnosis, prevention and treatment of diseases and clinical conditions associated with PLS1. N-ethylmaleimide-sensitive Factor Attachment Protein, Gamma (NAPG, Accession XM_172983) is another VGAM1276 host target gene. NAPG BINDING SITE is HOST TARGET binding site found in the 3" untranslated region of mRNA encoded by NAPG, corresponding to a HOST TARGET binding site such as BINDING SITE I, BINDING SITE II or BINDING SITE III. Table 2 illustrates the complementarity of the nucleotide sequences of NAPG BINDING SITE, designated SEQ ID:46250, to the nucleotide sequence of VGAM1276 RNA, herein designated VGAM RNA, also designated SEQ ID:3987.

Another function of VGAM1276 is therefore inhibition of N-ethylmaleimide-sensitive Factor Attachment Protein, Gamma (NAPG, Accession XM_172983). Accordingly, utilities of VGAM1276 include diagnosis, prevention and treatment of diseases and clinical conditions associated with NAPG. PRO1992 (Accession NM_014107) is another VGAM1276 host target gene. PRO1992 BINDING SITE is HOST TARGET binding site found in the 3" untranslated region of mRNA encoded by PRO1992, corresponding to a HOST TARGET binding site such as BINDING SITE I, BINDING SITE II or BINDING SITE III. Table 2 illustrates the complementarity of the nucleotide sequences of PRO1992 BINDING SITE, designated SEQ ID:15335, to the nucleotide sequence of VGAM1276 RNA, herein designated VGAM RNA, also designated SEQ ID:3987.

Another function of VGAM1276 is therefore inhibition of PRO1992 (Accession NM_014107). Accordingly, utilities of VGAM1276 include diagnosis, prevention and treatment of diseases and clinical conditions associated with PRO1992. LOC150606 (Accession XM_097928) is another VGAM1276 host target gene. LOC150606 BINDING SITE is HOST TARGET binding site found in the 5' untranslated region of mRNA encoded by LOC150606, corresponding to a HOST TARGET binding site such as BINDING SITE I, BINDING SITE II or BINDING SITE III. Table 2 illustrates the complementarity of the nucleotide sequences of LOC150606 BINDING SITE, designated SEQ ID:41234, to the nucleotide sequence of VGAM1276 RNA, herein designated VGAM RNA, also designated SEQ ID:3987.

Another function of VGAM1276 is therefore inhibition of LOC150606 (Accession XM_097928). Accordingly, utilities of VGAM1276 include diagnosis, prevention and treatment of diseases and clinical conditions associated with LOC150606. LOC203286 (Accession XM_117526) is another VGAM1276 host target gene. LOC203286 BINDING SITE is HOST TARGET binding site found in the 5' untranslated region of mRNA encoded by LOC203286, corresponding to a HOST TARGET binding site such as BINDING SITE I, BINDING SITE II or BINDING SITE III. Table 2 illustrates the complementarity of the nucleotide sequences of LOC203286 BINDING SITE, designated SEQ ID:43496, to the nucleotide sequence of VGAM1276 RNA, herein designated VGAM RNA, also designated SEQ ID:3987.

Another function of VGAM1276 is therefore inhibition of LOC203286 (Accession XM_117526). Accordingly, utilities of VGAM1276 include diagnosis, prevention and treatment of diseases and clinical conditions associated with LOC203286. FIG. 1 further provides a conceptual description of a novel bioinformatically detected viral gene of the present invention, referred to here as Viral Genomic Address Messenger 1277 (VGAM1277) viral gene, which modulates expression of respective host target genes thereof, the function and utility of which host target genes is known in the art.

VGAM1277 is a novel bioinformatically detected regulatory, non protein coding, viral micro RNA (miRNA) gene. The method by which VGAM1277 was detected is described hereinabove with reference to FIGS. 1-8.

VGAM1277 gene, herein designated VGAM GENE, is a viral gene contained in the genome of Human Enterovirus C. VGAM1277 host target gene, herein designated VGAM HOST TARGET GENE, is a human gene contained in the human genome.

VGAM1277 gene encodes a VGAM1277 precursor RNA, herein designated VGAM PRECURSOR RNA. Similar to other miRNA genes, and unlike most ordinary genes, VGAM1277 precursor RNA does not encode a protein. A nucleotide sequence identical or highly similar to the nucleotide sequence of VGAM1277 precursor RNA is designated SEQ ID:1263, and is provided hereinbelow with reference to the sequence listing part. Nucleotide sequence SEQ ID:1263 is located at position 156 relative to the genome of Human Enterovirus C.

VGAM1277 precursor RNA folds onto itself, forming VGAM1277 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1277 folded precursor RNA into VGAM1277 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1277 RNA is designated SEQ ID:3988, and is provided hereinbelow with reference to the sequence listing part.

VGAM1277 host target gene, herein designated VGAM HOST TARGET GENE, encodes a corresponding messenger RNA, VGAM1277 host target RNA, herein designated VGAM HOST TARGET RNA. VGAM1277 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1277 RNA, herein designated VGAM RNA, binds complementarily to one or more host target binding sites located in untranslated regions of VGAM1277 host target RNA, herein designated VGAM HOST TARGET RNA. This complementary binding is due to the fact that the nucleotide sequence of VGAM1277 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1277 RNA, herein designated VGAM RNA, may have a different number of host target binding sites in untranslated regions of a VGAM1277 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1277 RNA, herein designated VGAM RNA, to host target binding sites on VGAM1277 host target RNA, herein designated VGAM HOST TARGET RNA, such as BINDING SITE I, BINDING SITE II and BINDING SITE III, inhibits translation of VGAM1277 host target RNA into VGAM1277 host target protein, herein designated VGAM HOST TARGET PROTEIN. VGAM host target protein is therefore outlined by a broken line.

It is appreciated that VGAM1277 host target gene, herein designated VGAM HOST TARGET GENE, in fact represents a plurality of VGAM1277 host target genes. The mRNA of each one of this plurality of VGAM1277 host target genes comprises one or more host target binding sites, each having a nucleotide sequence which is at least partly complementary to VGAM1277 RNA, herein designated VGAM RNA, and which when bound by VGAM1277 RNA causes inhibition of translation of respective one or more VGAM1277 host target proteins.

It is further appreciated by one skilled in the art that the mode of translational inhibition illustrated by FIG. 1 with specific reference to translational inhibition exerted by VGAM1277 gene, herein designated VGAM GENE, on one or more VGAM1277 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1277 is inhibition of expression of host target genes, as part of a novel viral mechanism of attacking a host. Accordingly, utilities of VGAM1277 include diagnosis, prevention and treatment of viral infection by Human Enterovirus C. Specific functions, and accordingly utilities, of VGAM1277 correlate with, and may be deduced from, the identity of the host target genes which VGAM1277 binds and inhibits, and the function of these host target genes, as elaborated hereinbelow.

Nucleotide sequences of the VGAM1277 precursor RNA, herein designated VGAM PRECURSOR RNA, and of the 'diced' VGAM1277 RNA, herein designated VGAM RNA, and a schematic representation of the secondary folding of VGAM1277 folded precursor RNA, herein designated VGAM FOLDED PRECURSOR RNA, of VGAM1277 are further described hereinbelow with reference to Table 1.

Nucleotide sequences of host target binding sites, such as BINDING SITE-I, BINDING SITE-II and BINDING SITE-III of FIG. 1, found on VGAM1277 host target RNA, and schematic representation of the complementarity of each of these host target binding sites to VGAM1277 RNA, herein designated VGAM RNA, are described hereinbelow with reference to Table 2.

As mentioned hereinabove with reference to FIG. 1, a function of VGAM1277 gene, herein designated VGAM is inhibition of expression of VGAM1277 target genes. It is appreciated that specific functions, and accordingly utilities, of VGAM1277 correlate with, and may be deduced from, the identity of the target genes which VGAM1277 binds and inhibits, and the function of these target genes, as elaborated hereinbelow.

Acid Phosphatase 1, Soluble (ACP1, Accession NM_007099) is a VGAM1277 host target gene. ACP1 BINDING SITE1 and ACP1 BINDING SITE2 are HOST TARGET binding sites found in untranslated regions of mRNA encoded by ACP1, corresponding to HOST TARGET binding sites such as BINDING SITE I, BINDING SITE II or BINDING SITE III. Table 2 illustrates the complementarity of the nucleotide sequences of ACP1 BINDING SITE1 and ACP1 BINDING SITE2, designated SEQ ID:13957 and SEQ ID:10507 respectively, to the nucleotide sequence of VGAM1277 RNA, herein designated VGAM RNA, also designated SEQ ID:3988.

A function of VGAM1277 is therefore inhibition of Acid Phosphatase 1, Soluble (ACP1, Accession NM_007099), a gene which as demonstrated in starch-gel electrophoresis. Accordingly, utilities of VGAM1277 include diagnosis, prevention and treatment of diseases and clinical conditions associated with ACP1. The function of ACP1 and its association with various diseases and clinical conditions, has been established by previous studies, as described hereinabove with reference to VGAM179. Zinc Finger Protein 179 (ZNF179, Accession NM_007148) is another VGAM1277 host target gene. ZNF179 BINDING SITE is HOST TARGET binding site found in the 3' untranslated region of mRNA encoded by ZNF179, corresponding to a HOST TARGET binding site such as BINDING SITE I, BINDING SITE II or BINDING SITE III. Table 2 illustrates the complementarity of the nucleotide sequences of ZNF179 BINDING SITE, designated SEQ ID:14000, to the nucleotide sequence of VGAM1277 RNA, herein designated VGAM RNA, also designated SEQ ID:3988.

Another function of VGAM1277 is therefore inhibition of Zinc Finger Protein 179 (ZNF179, Accession NM_007148), a gene which has zink finger and a member of the RING finger protein family of transcription factors. Accordingly, utilities of VGAM1277 include diagnosis, prevention and treatment of diseases and clinical conditions associated with ZNF179. The function of ZNF179 has been established by previous studies. Kimura et al. (1997) showed, by FISH analysis of metaphase or interphase chromosomes of 6 patients with Smith-Magenis syndrome (SMS; 182290), that ZNF179 was deleted in one of the homologs, indicating possible involvement of this gene in the pathogenesis of SMS. ZNF179 was sublocalized to a site proximal to LLGL (OMIM Ref. No. 600966), which is thought to be critical to SMS Full details of the abovementioned studies are described in the following publications, the disclosure of which are hereby incorporated by reference:

Kimura, T.; Arakawa, Y.; Inoue, S.; Fukushima, Y.; Kondo, I.; Koyama, K.; Hosoi, T.; Orimo, A.; Muramatsu, M.; Nakamura, Y.; Abe, T.; Inazawa, J.: The brain finger protein gene (ZNF179), a member of the RING finger family, maps within the Smith-Magenis syndrome region at 17p11.2. Am. J. Med. Genet. 69: 320-324, 1997; and Matsuda, Y.; Inue, S.; Seki, N.; Hosoi, T.; Orimo, A.; Muramatsu, M.; Hori, T.: Chromosome mapping of human (ZNF179), mouse, and rat genes for brain finger protein (bfp), a member of the R.

Further studies establishing the function and utilities of ZNF179 are found in John Hopkins OMIM database record ID 601237, and in sited publications numbered 2839-2840 listed in the bibliography section hereinbelow, which are also hereby incorporated by reference. FLJ14082 (Accession NM_025024) is another VGAM1277 host target gene. FLJ14082 BINDING SITE is HOST TARGET binding site found in the 3' untranslated region of mRNA encoded by FLJ14082, corresponding to a HOST TARGET binding site such as BINDING SITE I, BINDING SITE II or BINDING SITE III. Table 2 illustrates the complementarity of the nucleotide sequences of FLJ14082 BINDING SITE, designated SEQ ID:24610, to the nucleotide sequence of VGAM1277 RNA, herein designated VGAM RNA, also designated SEQ ID:3988.

Another function of VGAM1277 is therefore inhibition of FLJ14082 (Accession NM_025024). Accordingly, utilities of VGAM1277 include diagnosis, prevention and treatment of diseases and clinical conditions associated with FLJ14082. KIAA1130 (Accession XM_031104) is another VGAM1277 host target gene. KIAA1130 BINDING SITE is HOST TARGET binding site found in the 3' untranslated region of mRNA encoded by KIAA1130, corresponding to a HOST TARGET binding site such as BINDING SITE I, BINDING SITE II or BINDING SITE III. Table 2 illustrates the complementarity of the nucleotide sequences of KIAA1130 BINDING SITE, designated SEQ ID:31281, to the nucleotide sequence of VGAM1277 RNA, herein designated VGAM RNA, also designated SEQ ID:3988.

Another function of VGAM1277 is therefore inhibition of KIAA1130 (Accession XM_031104). Accordingly, utilities of VGAM1277 include diagnosis, prevention and treatment of diseases and clinical conditions associated with KIAA1130. KIAA1536 (Accession NM_020898) is another VGAM1277 host target gene. KIAA1536 BINDING SITE is HOST TARGET binding site found in the 3' untranslated region of mRNA encoded by KIAA1536, corresponding to a HOST TARGET binding site such as BINDING SITE I, BINDING SITE II or BINDING SITE III. Table 2 illustrates the complementarity of the nucleotide sequences of KIAA1536 BINDING SITE, designated SEQ ID:21925, to the nucleotide sequence of VGAM1277 RNA, herein designated VGAM RNA, also designated SEQ ID:3988.

Another function of VGAM1277 is therefore inhibition of KIAA1536 (Accession NM_020898). Accordingly, utilities of VGAM1277 include diagnosis, prevention and treatment of diseases and clinical conditions associated with KIAA1536. LOC121457 (Accession XM_058563) is another VGAM1277 host target gene. LOC121457 BINDING SITE is HOST TARGET binding site found in the 5' untranslated region of mRNA encoded by LOC121457, corresponding to a HOST TARGET binding site such as BINDING SITE I, BINDING SITE II or BINDING SITE III. Table 2 illustrates the complementarity of the nucleotide sequences of LOC121457 BINDING SITE, designated SEQ ID:36661, to the nucleotide sequence of VGAM1277 RNA, herein designated VGAM RNA, also designated SEQ ID:3988.

Another function of VGAM1277 is therefore inhibition of LOC121457 (Accession XM_058563). Accordingly, utilities of VGAM1277 include diagnosis, prevention and treatment of diseases and clinical conditions associated with LOC121457. LOC146227 (Accession XM_085374) is another VGAM1277 host target gene. LOC146227 BINDING SITE is HOST TARGET binding site found in the 3' untranslated region of mRNA encoded by LOC146227, corresponding to a HOST TARGET binding site such as BINDING SITE I, BINDING SITE II or BINDING SITE III. Table 2 illustrates the complementarity of the nucleotide sequences of LOC146227 BINDING SITE, designated SEQ ID:38087, to the nucleotide sequence of VGAM1277 RNA, herein designated VGAM RNA, also designated SEQ ID:3988.

Another function of VGAM1277 is therefore inhibition of LOC146227 (Accession XM_085374). Accordingly, utilities of VGAM1277 include diagnosis, prevention and treatment of diseases and clinical conditions associated with LOC146227. LOC256940 (Accession XM_172879) is another VGAM1277 host target gene. LOC256940 BINDING SITE is HOST TARGET binding site found in the 5' untranslated region of mRNA encoded by LOC256940, corresponding to a HOST TARGET binding site such as BINDING SITE I, BINDING SITE II or BINDING SITE III. Table 2 illustrates the complementarity of the nucleotide sequences of LOC256940 BINDING SITE, designated SEQ ID:46153, to the nucleotide sequence of VGAM1277 RNA, herein designated VGAM RNA, also designated SEQ ID:3988.

Another function of VGAM1277 is therefore inhibition of LOC256940 (Accession XM_172879). Accordingly, utilities of VGAM1277 include diagnosis, prevention and treatment of diseases and clinical conditions associated with LOC256940. FIG. 1 further provides a conceptual description of a novel bioinformatically detected viral gene of the present invention, referred to here as Viral Genomic Address Messenger 1278 (VGAM1278) viral gene, which modulates expression of respective host target genes thereof, the function and utility of which host target genes is known in the art.

VGAM1278 is a novel bioinformatically detected regulatory, non protein coding, viral micro RNA (miRNA) gene. The method by which VGAM1278 was detected is described hereinabove with reference to FIGS. 1-8.

VGAM1278 gene, herein designated VGAM GENE, is a viral gene contained in the genome of Human Enterovirus C. VGAM1278 host target gene, herein designated VGAM HOST TARGET GENE, is a human gene contained in the human genome.

VGAM1278 gene encodes a VGAM1278 precursor RNA, herein designated VGAM PRECURSOR RNA. Similar to other miRNA genes, and unlike most ordinary genes, VGAM1278 precursor RNA does not encode a protein. A nucleotide sequence identical or highly similar to the nucleotide sequence of VGAM1278 precursor RNA is designated SEQ ID:1264, and is provided hereinbelow with reference to the sequence listing part. Nucleotide sequence SEQ ID:1264 is located at position 1945 relative to the genome of Human Enterovirus C.

VGAM1278 precursor RNA folds onto itself, forming VGAM1278 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1278 folded precursor RNA into VGAM1278 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1278 RNA is designated SEQ ID:3989, and is provided hereinbelow with reference to the sequence listing part.

VGAM1278 host target gene, herein designated VGAM HOST TARGET GENE, encodes a corresponding messenger RNA, VGAM1278 host target RNA, herein designated VGAM HOST TARGET RNA. VGAM1278 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1278 RNA, herein designated VGAM RNA, binds complementarily to one or more host target binding sites located in untranslated regions of VGAM1278 host target RNA, herein designated VGAM HOST TARGET RNA. This complementary binding is due to the fact that the nucleotide sequence of VGAM1278 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1278 RNA, herein designated VGAM RNA, may have a different number of host target binding sites in untranslated regions of a VGAM1278 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1278 RNA, herein designated VGAM RNA, to host target binding sites on VGAM1278 host target RNA, herein designated VGAM HOST TARGET RNA, such as BINDING SITE I, BINDING SITE II and BINDING SITE III, inhibits translation of VGAM1278 host target RNA into VGAM1278 host target protein, herein designated VGAM HOST TARGET PROTEIN. VGAM host target protein is therefore outlined by a broken line.

It is appreciated that VGAM1278 host target gene, herein designated VGAM HOST TARGET GENE, in fact represents a plurality of VGAM1278 host target genes. The mRNA of each one of this plurality of VGAM1278 host target genes comprises one or more host target binding sites, each having a nucleotide sequence which is at least partly complementary to VGAM1278 RNA, herein designated VGAM RNA, and which when bound by VGAM1278 RNA causes inhibition of translation of respective one or more VGAM1278 host target proteins.

It is further appreciated by one skilled in the art that the mode of translational inhibition illustrated by FIG. 1 with specific reference to translational inhibition exerted by VGAM1278 gene, herein designated VGAM GENE, on one or more VGAM1278 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1278 is inhibition of expression of host target genes, as part of a novel viral mechanism of attacking a host. Accordingly, utilities of VGAM1278 include diagnosis, prevention and treatment of viral infection by Human Enterovirus C. Specific functions, and accordingly utilities, of VGAM1278 correlate with, and may be deduced from, the identity of the host target genes which VGAM1278 binds and inhibits, and the function of these host target genes, as elaborated hereinbelow.

Nucleotide sequences of the VGAM1278 precursor RNA, herein designated VGAM PRECURSOR RNA, and of the 'diced' VGAM1278 RNA, herein designated VGAM RNA, and a schematic representation of the secondary folding of VGAM1278 folded precursor RNA, herein designated VGAM FOLDED PRECURSOR RNA, of VGAM1278 are further described hereinbelow with reference to Table 1.

Nucleotide sequences of host target binding sites, such as BINDING SITE-I, BINDING SITE-II and BINDING SITE-III of FIG. 1, found on VGAM1278 host target RNA, and schematic representation of the complementarity of each of these host target binding sites to VGAM1278 RNA, herein designated VGAM RNA, are described hereinbelow with reference to Table 2.

As mentioned hereinabove with reference to FIG. 1, a function of VGAM1278 gene, herein designated VGAM is inhibition of expression of VGAM1278 target genes. It is appreciated that specific functions, and accordingly utilities, of VGAM1278 correlate with, and may be deduced from, the identity of the target genes which VGAM1278 binds and inhibits, and the function of these target genes, as elaborated hereinbelow.

Adaptor-related Protein Complex 2, Beta 1 Subunit (AP2B1, Accession NM_001282) is a VGAM1278 host target gene. AP2B1 BINDING SITE is HOST TARGET binding site found in the 3' untranslated region of mRNA encoded by AP2B1, corresponding to a HOST TARGET binding site such as BINDING SITE I, BINDING SITE II or BINDING SITE III. Table 2 illustrates the complementarity of the nucleotide sequences of AP2B1 BINDING SITE, designated SEQ ID:6952, to the nucleotide sequence of VGAM1278 RNA, herein designated VGAM RNA, also designated SEQ ID:3989.

A function of VGAM1278 is therefore inhibition of Adaptor-related Protein Complex 2, Beta 1 Subunit (AP2B1, Accession NM_001282), a gene which links clathrin to receptors in coated vesicles. Accordingly, utilities of VGAM1278 include diagnosis, prevention and treatment of diseases and clinical conditions associated with AP2B1. The function of AP2B1 and its association with various diseases and clinical conditions, has been established by previous studies, as described hereinabove with reference to VGAM1126. Core-binding Factor, Beta Subunit (CBFB, Accession NM_001755) is another VGAM1278 host target gene. CBFB BINDING SITE1 and CBFB BINDING SITE2 are HOST TARGET binding sites found in untranslated regions of mRNA encoded by CBFB, corresponding to HOST TARGET binding sites such as BINDING SITE I, BINDING SITE II or BINDING SITE III. Table 2 illustrates the complementarity of the nucleotide sequences of CBFB BINDING SITE1 and CBFB BINDING SITE2, designated SEQ ID:7506 and SEQ ID:23147 respectively, to the nucleotide sequence of VGAM1278 RNA, herein designated VGAM RNA, also designated SEQ ID:3989.

Another function of VGAM1278 is therefore inhibition of Core-binding Factor, Beta Subunit (CBFB, Accession NM_001755), a gene which is beta subunit of the transcription factor CBF which causes leukemia. Accordingly, utilities of VGAM1278 include diagnosis, prevention and treatment of diseases and clinical conditions associated with CBFB. The function of CBFB and its association with various diseases and clinical conditions, has been established by previous studies, as described hereinabove with reference to VGAM98. MBLL39 (Accession NM_144778) is another VGAM1278 host target gene. MBLL39 BINDING SITE is HOST TARGET binding site found in the 3' untranslated region of mRNA encoded by MBLL39, corresponding to a HOST TARGET binding site such as BINDING SITE I, BINDING SITE II or BINDING SITE III. Table 2 illustrates the complementarity of the nucleotide sequences of MBLL39 BINDING SITE, designated SEQ ID:29573, to the nucleotide sequence of VGAM1278 RNA, herein designated VGAM RNA, also designated SEQ ID:3989.

Another function of VGAM1278 is therefore inhibition of MBLL39 (Accession NM_144778). Accordingly, utilities of VGAM1278 include diagnosis, prevention and treatment of diseases and clinical conditions associated with MBLL39. FIG. 1 further provides a conceptual description of a novel bioinformatically detected viral gene of the present invention, referred to here as Viral Genomic Address Messenger 1279 (VGAM1279) viral gene, which modulates expression of respective host target genes thereof, the function and utility of which host target genes is known in the art.

VGAM1279 is a novel bioinformatically detected regulatory, non protein coding, viral micro RNA (miRNA) gene. The method by which VGAM1279 was detected is described hereinabove with reference to FIGS. 1-8.

VGAM1279 gene, herein designated VGAM GENE, is a viral gene contained in the genome of Human Enterovirus C. VGAM1279 host target gene, herein designated VGAM HOST TARGET GENE, is a human gene contained in the human genome.

VGAM1279 gene encodes a VGAM1279 precursor RNA, herein designated VGAM PRECURSOR RNA. Similar to other miRNA genes, and unlike most ordinary genes, VGAM1279 precursor RNA does not encode a protein. A nucleotide sequence identical or highly similar to the nucleotide sequence of VGAM1279 precursor RNA is designated SEQ ID:1265, and is provided hereinbelow with reference to the sequence listing part. Nucleotide sequence SEQ ID:1265 is located at position 1075 relative to the genome of Human Enterovirus C.

VGAM1279 precursor RNA folds onto itself, forming VGAM1279 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1279 folded precursor RNA into VGAM1279 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1279 RNA is designated SEQ ID:3990, and is provided hereinbelow with reference to the sequence listing part.

VGAM1279 host target gene, herein designated VGAM HOST TARGET GENE, encodes a corresponding messenger RNA, VGAM1279 host target RNA, herein designated VGAM HOST TARGET RNA. VGAM1279 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1279 RNA, herein designated VGAM RNA, binds complementarily to one or more host target binding sites located in untranslated regions of VGAM1279 host target RNA, herein designated VGAM HOST TARGET RNA. This complementary binding is due to the fact that the nucleotide sequence of VGAM1279 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1279 RNA, herein designated VGAM RNA, may have a different number of host target binding sites in untranslated regions of a VGAM1279 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1279 RNA, herein designated VGAM RNA, to host target binding sites on VGAM1279 host target RNA, herein designated VGAM HOST TARGET RNA, such as BINDING SITE I, BINDING SITE II and BINDING SITE III, inhibits translation of VGAM1279 host target RNA into VGAM1279 host target protein, herein designated VGAM HOST TARGET PROTEIN. VGAM host target protein is therefore outlined by a broken line.

It is appreciated that VGAM1279 host target gene, herein designated VGAM HOST TARGET GENE, in fact represents a plurality of VGAM1279 host target genes. The mRNA of each one of this plurality of VGAM1279 host target genes comprises one or more host target binding sites, each having a nucleotide sequence which is at least partly complementary to VGAM1279 RNA, herein designated VGAM RNA, and which when bound by VGAM1279 RNA causes inhibition of translation of respective one or more VGAM1279 host target proteins.

It is further appreciated by one skilled in the art that the mode of translational inhibition illustrated by FIG. 1 with specific reference to translational inhibition exerted by VGAM1279 gene, herein designated VGAM GENE, on one or more VGAM1279 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1279 is inhibition of expression of host target genes, as part of a novel viral mechanism of attacking a host. Accordingly, utilities of VGAM1279 include diagnosis, prevention and treatment of viral infection by Human Enterovirus C. Specific functions, and accordingly utilities, of VGAM1279 correlate with, and may be deduced from, the identity of the host target genes which VGAM1279 binds and inhibits, and the function of these host target genes, as elaborated hereinbelow.

Nucleotide sequences of the VGAM1279 precursor RNA, herein designated VGAM PRECURSOR RNA, and of the 'diced' VGAM1279 RNA, herein designated VGAM RNA, and a schematic representation of the secondary folding of VGAM1279 folded precursor RNA, herein designated VGAM FOLDED PRECURSOR RNA, of VGAM1279 are further described hereinbelow with reference to Table 1.

Nucleotide sequences of host target binding sites, such as BINDING SITE-I, BINDING SITE-II and BINDING SITE-III of FIG. 1, found on VGAM1279 host target RNA, and schematic representation of the complementarity of each of these host target binding sites to VGAM1279 RNA, herein designated VGAM RNA, are described hereinbelow with reference to Table 2.

As mentioned hereinabove with reference to FIG. 1, a function of VGAM1279 gene, herein designated VGAM is inhibition of expression of VGAM1279 target genes. It is appreciated that specific functions, and accordingly utilities, of VGAM1279 correlate with, and may be deduced from, the identity of the target genes which VGAM1279 binds and inhibits, and the function of these target genes, as elaborated hereinbelow.

Chromosome 17 Open Reading Frame 31 (C17orf31, Accession NM_017575) is a VGAM1279 host target gene. C17orf31 BINDING SITE is HOST TARGET binding site found in the 3' untranslated region of mRNA encoded by C17orf31, corresponding to a HOST TARGET binding site such as BINDING SITE I, BINDING SITE II or BINDING SITE III. Table 2 illustrates the complementarity of the nucleotide sequences of C17orf31 BINDING SITE, designated SEQ ID:18996, to the nucleotide sequence of VGAM1279 RNA, herein designated VGAM RNA, also designated SEQ ID:3990.

A function of VGAM1279 is therefore inhibition of Chromosome 17 Open Reading Frame 31 (C17orf31, Accession NM_017575). Accordingly, utilities of VGAM1279 include diagnosis, prevention and treatment of diseases and clinical conditions associated with C17orf31. FLJ12960 (Accession NM_024638) is another VGAM1279 host target gene. FLJ12960 BINDING SITE is HOST TARGET binding site found in the 3' untranslated region of mRNA encoded by FLJ12960, corresponding to a HOST TARGET binding site such as BINDING SITE I, BINDING SITE II or BINDING SITE III. Table 2 illustrates the complementarity of the nucleotide sequences of FLJ12960 BINDING SITE, designated SEQ ID:23913, to the nucleotide sequence of VGAM1279 RNA, herein designated VGAM RNA, also designated SEQ ID:3990.

Another function of VGAM1279 is therefore inhibition of FLJ12960 (Accession NM_024638). Accordingly, utilities of VGAM1279 include diagnosis, prevention and treatment of diseases and clinical conditions associated with FLJ12960. G Protein Pathway Suppressor 2 (GPS2, Accession NM_004489) is another VGAM1279 host target gene. GPS2 BINDING SITE1 and GPS2 BINDING SITE2 are HOST TARGET binding sites found in untranslated regions of mRNA encoded by GPS2, corresponding to HOST TARGET binding sites such as BINDING SITE I, BINDING SITE II or BINDING SITE III. Table 2 illustrates the complementarity of the nucleotide sequences of GPS2 BINDING SITE1 and GPS2 BINDING SITE2, designated SEQ ID:10824 and SEQ ID:42146 respectively, to the nucleotide sequence of VGAM1279 RNA, herein designated VGAM RNA, also designated SEQ ID:3990.

Another function of VGAM1279 is therefore inhibition of G Protein Pathway Suppressor 2 (GPS2, Accession NM_004489). Accordingly, utilities of VGAM1279 include diagnosis, prevention and treatment of diseases and clinical conditions associated with GPS2. LOC126430 (Accession XM_065082) is another VGAM1279 host target gene. LOC126430 BINDING SITE is HOST TARGET binding site found in the 5' untranslated region of mRNA encoded by LOC126430, corresponding to a HOST TARGET binding site such as BINDING SITE I, BINDING SITE II or BINDING SITE III. Table 2 illustrates the complementarity of the nucleotide sequences of LOC126430 BINDING SITE, designated SEQ ID:37276, to the nucleotide sequence of VGAM1279 RNA, herein designated VGAM RNA, also designated SEQ ID:3990.

Another function of VGAM1279 is therefore inhibition of LOC126430 (Accession XM_065082). Accordingly, utilities of VGAM1279 include diagnosis, prevention and treatment of diseases and clinical conditions associated with LOC126430. LOC144501 (Accession XM_096612) is another VGAM1279 host target gene. LOC144501 BINDING SITE is HOST TARGET binding site found in the 3' untranslated region of mRNA encoded by LOC144501, corresponding to a HOST TARGET binding site such as BINDING SITE I, BINDING SITE II or BINDING SITE III. Table 2 illustrates the complementarity of the nucleotide sequences of LOC144501 BINDING SITE, designated SEQ ID:40428, to the nucleotide sequence of VGAM1279 RNA, herein designated VGAM RNA, also designated SEQ ID:3990.

Another function of VGAM1279 is therefore inhibition of LOC144501 (Accession XM_096612). Accordingly, utilities of VGAM1279 include diagnosis, prevention and treatment of diseases and clinical conditions associated with LOC144501. LOC148398 (Accession XM_086174) is another VGAM1279 host target gene. LOC148398 BINDING SITE is HOST TARGET binding site found in the 5' untranslated region of mRNA encoded by LOC148398, corresponding to a HOST TARGET binding site such as BINDING SITE I, BINDING SITE II or BINDING SITE III. Table 2 illustrates the complementarity of the nucleotide sequences of LOC148398 BINDING SITE, designated SEQ ID:38530, to the nucleotide sequence of VGAM1279 RNA, herein designated VGAM RNA, also designated SEQ ID:3990.

Another function of VGAM1279 is therefore inhibition of LOC148398 (Accession XM_086174). Accordingly, utilities of VGAM1279 include diagnosis, prevention and treatment of diseases and clinical conditions associated with LOC148398. LOC167153 (Accession XM_094312) is another VGAM1279 host target gene. LOC167153 BIND- ING SITE is HOST TARGET binding site found in the 5' untranslated region of mRNA encoded by LOC167153, corresponding to a HOST TARGET binding site such as BINDING SITE I, BINDING SITE II or BINDING SITE III. Table 2 illustrates the complementarity of the nucleotide sequences of LOC167153 BINDING SITE, designated SEQ ID:40230, to the nucleotide sequence of VGAM1279 RNA, herein designated VGAM RNA, also designated SEQ ID:3990.

Another function of VGAM1279 is therefore inhibition of LOC167153 (Accession XM_094312). Accordingly, utilities of VGAM1279 include diagnosis, prevention and treatment of diseases and clinical conditions associated with LOC167153. LOC199221 (Accession XM_087310) is another VGAM1279 host target gene. LOC199221 BINDING SITE is HOST TARGET binding site found in the 5' untranslated region of mRNA encoded by LOC199221, corresponding to a HOST TARGET binding site such as BINDING SITE I, BINDING SITE II or BINDING SITE III. Table 2 illustrates the complementarity of the nucleotide sequences of LOC199221 BINDING SITE, designated SEQ ID:39163, to the nucleotide sequence of VGAM1279 RNA, herein designated VGAM RNA, also designated SEQ ID:3990.

Another function of VGAM1279 is therefore inhibition of LOC199221 (Accession XM_087310). Accordingly, utilities of VGAM1279 include diagnosis, prevention and treatment of diseases and clinical conditions associated with LOC199221. LOC201911 (Accession XM_117339) is another VGAM1279 host target gene. LOC201911 BINDING SITE is HOST TARGET binding site found in the 3' untranslated region of mRNA encoded by LOC201911, corresponding to a HOST TARGET binding site such as BINDING SITE I, BINDING SITE II or BINDING SITE III. Table 2 illustrates the complementarity of the nucleotide sequences of LOC201911 BINDING SITE, designated SEQ ID:43389, to the nucleotide sequence of VGAM1279 RNA, herein designated VGAM RNA, also designated SEQ ID:3990.

Another function of VGAM1279 is therefore inhibition of LOC201911 (Accession XM_117339). Accordingly, utilities of VGAM1279 include diagnosis, prevention and treatment of diseases and clinical conditions associated with LOC201911. LOC220565 (Accession XM_165417) is another VGAM1279 host target gene. LOC220565 BINDING SITE is HOST TARGET binding site found in the 3' untranslated region of mRNA encoded by LOC220565, corresponding to a HOST TARGET binding site such as BINDING SITE I, BINDING SITE II or BINDING SITE III. Table 2 illustrates the complementarity of the nucleotide sequences of LOC220565 BINDING SITE, designated SEQ ID:43632, to the nucleotide sequence of VGAM1279 RNA, herein designated VGAM RNA, also designated SEQ ID:3990.

Another function of VGAM1279 is therefore inhibition of LOC220565 (Accession XM_165417). Accordingly, utilities of VGAM1279 include diagnosis, prevention and treatment of diseases and clinical conditions associated with LOC220565. LOC254228 (Accession XM_171123) is another VGAM1279 host target gene. LOC254228 BINDING SITE is HOST TARGET binding site found in the 3' untranslated region of mRNA encoded by LOC254228, corresponding to a HOST TARGET binding site such as BINDING SITE I, BINDING SITE II or BINDING SITE III. Table 2 illustrates the complementarity of the nucleotide sequences of LOC254228 BINDING SITE, designated SEQ ID:45917, to the nucleotide sequence of VGAM1279 RNA, herein designated VGAM RNA, also designated SEQ ID:3990.

Another function of VGAM1279 is therefore inhibition of LOC254228 (Accession XM_171123). Accordingly, utilities of VGAM1279 include diagnosis, prevention and treatment of diseases and clinical conditions associated with LOC254228. LOC256310 (Accession XM_172813) is another VGAM1279 host target gene. LOC256310 BINDING SITE is HOST TARGET binding site found in the 3' untranslated region of mRNA encoded by LOC256310, corresponding to a HOST TARGET binding site such as BINDING SITE I, BINDING SITE II or BINDING SITE III. Table 2 illustrates the complementarity of the nucleotide sequences of LOC256310 BINDING SITE, designated SEQ ID:46094, to the nucleotide sequence of VGAM1279 RNA, herein designated VGAM RNA, also designated SEQ ID:3990.

Another function of VGAM1279 is therefore inhibition of LOC256310 (Accession XM_172813). Accordingly, utilities of VGAM1279 include diagnosis, prevention and treatment of diseases and clinical conditions associated with LOC256310. FIG. 1 further provides a conceptual description of a novel bioinformatically detected viral gene of the present invention, referred to here as Viral Genomic Address Messenger 1280 (VGAM1280) viral gene, which modulates expression of respective host target genes thereof, the function and utility of which host target genes is known in the art.

VGAM1280 is a novel bioinformatically detected regulatory, non protein coding, viral micro RNA (miRNA) gene. The method by which VGAM1280 was detected is described hereinabove with reference to FIGS. 1-8.

VGAM1280 gene, herein designated VGAM GENE, is a viral gene contained in the genome of Human Enterovirus C. VGAM1280 host target gene, herein designated VGAM HOST TARGET GENE, is a human gene contained in the human genome.

VGAM1280 gene encodes a VGAM1280 precursor RNA, herein designated VGAM PRECURSOR RNA. Similar to other miRNA genes, and unlike most ordinary genes, VGAM1280 precursor RNA does not encode a protein. A nucleotide sequence identical or highly similar to the nucleotide sequence of VGAM1280 precursor RNA is designated SEQ ID:1266, and is provided hereinbelow with reference to the sequence listing part. Nucleotide sequence SEQ ID:1266 is located at position 1669 relative to the genome of Human Enterovirus C.

VGAM1280 precursor RNA folds onto itself, forming VGAM1280 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1280 folded precursor RNA into VGAM1280 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1280 RNA is designated SEQ ID:3991, and is provided hereinbelow with reference to the sequence listing part.

VGAM1280 host target gene, herein designated VGAM HOST TARGET GENE, encodes a corresponding messenger RNA, VGAM1280 host target RNA, herein designated VGAM HOST TARGET RNA. VGAM1280 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1280 RNA, herein designated VGAM RNA, binds complementarily to one or more host target binding sites located in untranslated regions of VGAM1280 host target RNA, herein designated VGAM HOST TARGET RNA. This complementary binding is due to the fact that the nucleotide sequence of VGAM1280 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1280 RNA, herein designated VGAM RNA, may have a different number of host target binding sites in untranslated regions of a VGAM1280 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1280 RNA, herein designated VGAM RNA, to host target binding sites on VGAM1280 host target RNA, herein designated VGAM HOST TARGET RNA, such as BINDING SITE I, BINDING SITE II and BINDING SITE III, inhibits translation of VGAM1280 host target RNA into VGAM1280 host target protein, herein designated VGAM HOST TARGET PROTEIN. VGAM host target protein is therefore outlined by a broken line.

It is appreciated that VGAM1280 host target gene, herein designated VGAM HOST TARGET GENE, in fact represents a plurality of VGAM1280 host target genes. The mRNA of each one of this plurality of VGAM1280 host target genes comprises one or more host target binding sites, each having a nucleotide sequence which is at least partly complementary to VGAM1280 RNA, herein designated VGAM RNA, and which when bound by VGAM1280 RNA causes inhibition of translation of respective one or more VGAM1280 host target proteins.

It is further appreciated by one skilled in the art that the mode of translational inhibition illustrated by FIG. 1 with specific reference to translational inhibition exerted by VGAM1280 gene, herein designated VGAM GENE, on one or more VGAM1280 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1280 is inhibition of expression of host target genes, as part of a novel viral mechanism of attacking a host. Accordingly, utilities of VGAM1280 include diagnosis, prevention and treatment of viral infection by Human Enterovirus C. Specific functions, and accordingly utilities, of VGAM1280 correlate with, and may be deduced from, the identity of the host target genes which VGAM1280 binds and inhibits, and the function of these host target genes, as elaborated hereinbelow.

Nucleotide sequences of the VGAM1280 precursor RNA, herein designated VGAM PRECURSOR RNA, and of the 'diced' VGAM1280 RNA, herein designated VGAM RNA, and a schematic representation of the secondary folding of VGAM1280 folded precursor RNA, herein designated VGAM FOLDED PRECURSOR RNA, of VGAM1280 are further described hereinbelow with reference to Table 1.

Nucleotide sequences of host target binding sites, such as BINDING SITE-I, BINDING SITE-II and BINDING SITE-III of FIG. 1, found on VGAM1280 host target RNA, and schematic representation of the complementarity of each of these host target binding sites to VGAM1280 RNA, herein designated VGAM RNA, are described hereinbelow with reference to Table 2.

As mentioned hereinabove with reference to FIG. 1, a function of VGAM1280 gene, herein designated VGAM is inhibition of expression of VGAM1280 target genes. It is appreciated that specific functions, and accordingly utilities, of VGAM1280 correlate with, and may be deduced from, the identity of the target genes which VGAM1280 binds and inhibits, and the function of these target genes, as elaborated hereinbelow.

Activin A Receptor, Type I (ACVR1, Accession NM_001105) is a VGAM1280 host target gene. ACVR1 BINDING SITE is HOST TARGET binding site found in the 5' untranslated region of mRNA encoded by ACVR1, corresponding to a HOST TARGET binding site such as BINDING SITE I, BINDING SITE II or BINDING SITE III. Table 2 illustrates the complementarity of the nucleotide sequences of ACVR1 BINDING SITE, designated SEQ ID:6763, to the nucleotide sequence of VGAM1280 RNA, herein designated VGAM RNA, also designated SEQ ID:3991.

A function of VGAM1280 is therefore inhibition of Activin A Receptor, Type I (ACVR1, Accession NM_001105), a gene which Activin receptor-like kinase; similar to activin, TGF-beta, and C. elegans daf-1 receptors. Accordingly, utilities of VGAM1280 include diagnosis, prevention and treatment of diseases and clinical conditions associated with ACVR1. The function of ACVR1 and its association with various diseases and clinical conditions, has been established by previous studies, as described hereinabove with reference to VGAM217. AF3P21 (Accession NM_016453) is another VGAM1280 host target gene. AF3P21 BINDING SITE is HOST TARGET binding site found in the 3' untranslated region of mRNA encoded by AF3P21, corresponding to a HOST TARGET binding site such as BINDING SITE I, BINDING SITE II or BINDING SITE III. Table 2 illustrates the complementarity of the nucleotide sequences of AF3P21 BINDING SITE, designated SEQ ID:18568, to the nucleotide sequence of VGAM1280 RNA, herein designated VGAM RNA, also designated SEQ ID:3991.

Another function of VGAM1280 is therefore inhibition of AF3P21 (Accession NM_016453), a gene which has an important role in stress fiber formation induced by active diaphanous protein homolog 1 (drf1). Accordingly, utilities of VGAM1280 include diagnosis, prevention and treatment of diseases and clinical conditions associated with AF3P21. The function of AF3P21 has been established by previous studies. Sano et al. (2000) identified the AF3p21 gene as a novel fusion partner of the MLL gene (OMIM Ref. No. 159555) in a 23-year-old patient who developed therapy-related leukemia (AML, FAB M5b) with t (3;11)(p21; q23). Hayakawa et al. (2001) further characterized the AF3p21 gene. AF3p21 encodes a nuclear protein consisting of 722 amino acids with an SH3 domain, a proline-rich domain, and a bipartite nuclear localization signal. The protein's SH3 domain has high homology with that of FYN (OMIM Ref.

No. 137025). Hayakawa et al. (2001) found that in DNA from the patient's leukemic cells, intron 6 of the MLL gene was fused at a point upstream of exon 1 in the AF3p21 gene, and that the der (11) chromosome formed an MLL-AF3p21 fusion transcript in leukemic cells, whereas the der (3) chromosome did not form any fusion transcript. Dot blot RNA analysis showed that the AF3p21 gene was expressed in all adult and embryonic human tissues examined, including bone marrow, brain, liver, thymus, lung, and skeletal muscle. Northern blot analysis of HeLa cell RNA detected a 3.5-kb transcript. The protein has an apparent molecular weight of 80 kD and is localized exclusively in the cell nucleus. These results suggested that AF3p21 protein plays a role in signal transduction in the nucleus. Hayakawa et al. (2001) determined that the AF3p21 gene on 3p21 is 19 kb long and consists of 13 exons.

Full details of the abovementioned studies are described in the following publications, the disclosure of which are hereby incorporated by reference:

Hayakawa, A.; Matsuda, Y.; Daibata, M.; Nakamura, H.; Sano, K.: Genomic organization, tissue expression, and cellular localization of AF3p21, a fusion partner of MLL in therapy-related leukemia. Genes Chromosomes Cancer 30: 364-374, 2001; and Sano, K.; Hayakawa, A.; Piao, J.-H.; Kosaka, Y.; Nakamura, H.: Novel SH3 protein encoded by the AF3p21 gene is fused to the mixed lineage leukemia protein in a therapy-related leukemi.

Further studies establishing the function and utilities of AF3P21 are found in John Hopkins OMIM database record ID 606671, and in sited publications numbered 6457-6458 listed in the bibliography section hereinbelow, which are also hereby incorporated by reference. Frizzled Homolog 6 (Drosophila) (FZD6, Accession NM_003506) is another VGAM1280 host target gene. FZD6 BINDING SITE is HOST TARGET binding site found in the 3' untranslated region of mRNA encoded by FZD6, corresponding to a HOST TARGET binding site such as BINDING SITE I, BINDING SITE II or BINDING SITE III. Table 2 illustrates the complementarity of the nucleotide sequences of FZD6 BINDING SITE, designated SEQ ID:9596, to the nucleotide sequence of VGAM1280 RNA, herein designated VGAM RNA, also designated SEQ ID:3991.

Another function of VGAM1280 is therefore inhibition of Frizzled Homolog 6 (Drosophila) (FZD6, Accession NM_003506). Accordingly, utilities of VGAM1280 include diagnosis, prevention and treatment of diseases and clinical conditions associated with FZD6. Growth Arrest-specific 11 (GAS11, Accession NM_001481) is another VGAM1280 host target gene. GAS11 BINDING SITE is HOST TARGET binding site found in the 3' untranslated region of mRNA encoded by GAS11, corresponding to a HOST TARGET binding site such as BINDING SITE I, BINDING SITE II or BINDING SITE III. Table 2 illustrates the complementarity of the nucleotide sequences of GAS11 BINDING SITE, designated SEQ ID:7223, to the nucleotide sequence of VGAM1280 RNA, herein designated VGAM RNA, also designated SEQ ID:3991.

Another function of VGAM1280 is therefore inhibition of Growth Arrest-specific 11 (GAS11, Accession NM_001481). Accordingly, utilities of VGAM1280 include diagnosis, prevention and treatment of diseases and clinical conditions associated with GAS11. Glutamate Receptor, Ionotropic, N-methyl D-aspartate 2B (GRIN2B, Accession NM_000834) is another VGAM1280 host target gene. GRIN2B BINDING SITE is HOST TARGET binding site found in the 3' untranslated region of mRNA encoded by GRIN2B, corresponding to a HOST TARGET binding site such as BINDING SITE I, BINDING SITE II or BINDING SITE III. Table 2 illustrates the complementarity of the nucleotide sequences of GRIN2B BINDING SITE, designated SEQ ID:6490, to the nucleotide sequence of VGAM1280 RNA, herein designated VGAM RNA, also designated SEQ ID:3991.

Another function of VGAM1280 is therefore inhibition of Glutamate Receptor, Ionotropic, N-methyl D-aspartate 2B (GRIN2B, Accession NM_000834). Accordingly, utilities of VGAM1280 include diagnosis, prevention and treatment of diseases and clinical conditions associated with GRIN2B. BH-protocadherin (brain-heart) (PCDH7, Accession NM_002589) is another VGAM1280 host target gene. PCDH7 BINDING SITE1 through PCDH7 BINDING SITE3 are HOST TARGET binding sites found in untranslated regions of mRNA encoded by PCDH7, corresponding to HOST TARGET binding sites such as BINDING SITE I, BINDING SITE II or BINDING SITE III. Table 2 illustrates the complementarity of the nucleotide sequences of PCDH7 BINDING SITE1 through PCDH7 BINDING SITE3, designated SEQ ID:8451, SEQ ID:26215 and SEQ ID:26219 respectively, to the nucleotide sequence of VGAM1280 RNA, herein designated VGAM RNA, also designated SEQ ID:3991.

Another function of VGAM1280 is therefore inhibition of BH-protocadherin (brain-heart) (PCDH7, Accession NM_002589). Accordingly, utilities of VGAM1280 include diagnosis, prevention and treatment of diseases and clinical conditions associated with PCDH7. Ret Proto-oncogene (multiple endocrine neoplasia and medullary thyroid carcinoma 1, Hirschsprung disease) (RET, Accession NM_020975) is another VGAM1280 host target gene. RET BINDING SITE1 and RET BINDING SITE2 are HOST TARGET binding sites found in untranslated regions of mRNA encoded by RET, corresponding to HOST TARGET binding sites such as BINDING SITE I, BINDING SITE II or BINDING SITE III. Table 2 illustrates the complementarity of the nucleotide sequences of RET BINDING SITE1 and RET BINDING SITE2, designated SEQ ID:21961 and SEQ ID:17508 respectively, to the nucleotide sequence of VGAM1280 RNA, herein designated VGAM RNA, also designated SEQ ID:3991.

Another function of VGAM1280 is therefore inhibition of Ret Proto-oncogene (multiple endocrine neoplasia and medullary thyroid carcinoma 1, Hirschsprung disease) (RET, Accession NM_020975), a gene which transduces signals for cell growth and differentiation. Accordingly, utilities of VGAM1280 include diagnosis, prevention and treatment of diseases and clinical conditions associated with RET. The function of RET and its association with various diseases and clinical conditions, has been established by previous studies, as described hereinabove with reference to VGAM381. SH3-domain Binding Protein 4 (SH3BP4, Accession NM_014521) is another VGAM1280 host target gene. SH3BP4 BINDING SITE is HOST TARGET binding site found in the 3' untranslated region of mRNA encoded by SH3BP4, corresponding to a HOST TARGET binding site such as BINDING SITE I, BINDING SITE II or BINDING SITE III. Table 2 illustrates the complementarity of the nucleotide sequences of SH3BP4 BINDING SITE, designated SEQ ID:15855, to the nucleotide sequence of VGAM1280 RNA, herein designated VGAM RNA, also designated SEQ ID:3991.

Another function of VGAM1280 is therefore inhibition of SH3-domain Binding Protein 4 (SH3BP4, Accession NM_014521), a gene which is of unknown function, contains SH3-domain binding protein 4; similar to the EH-binding protein. Accordingly, utilities of VGAM1280 include diagnosis, prevention and treatment of diseases and clinical conditions associated with SH3BP4. The function of SH3BP4 and its association with various diseases and clinical conditions, has been established by previous studies, as described hereinabove with reference to VGAM179. Chromosome 1 Open Reading Frame 8 (C1orf8, Accession NM_004872) is another VGAM1280 host target gene. C1orf8 BINDING SITE is HOST TARGET binding site found in the 5' untranslated region of mRNA encoded by C1orf8, corresponding to a HOST TARGET binding site such as BINDING SITE I, BINDING SITE II or BINDING SITE III. Table 2 illustrates the complementarity of the nucleotide sequences of C1orf8 BINDING SITE, designated SEQ ID:11299, to the nucleotide sequence of VGAM1280 RNA, herein designated VGAM RNA, also designated SEQ ID:3991.

Another function of VGAM1280 is therefore inhibition of Chromosome 1 Open Reading Frame 8 (C1orf8, Accession NM_004872). Accordingly, utilities of VGAM1280 include diagnosis, prevention and treatment of diseases and clinical conditions associated with C1orf8. Catenin, Beta Interacting Protein 1 (CTNNBIP1, Accession NM_020248) is another VGAM1280 host target gene. CTNNBIP1 BINDING SITE is HOST TARGET binding site found in the 3' untranslated region of mRNA encoded by CTNNBIP1, corresponding to a HOST TARGET binding site such as BINDING SITE I, BINDING SITE II or BINDING SITE III. Table 2 illustrates the complementarity of the nucleotide sequences of CTNNBIP1 BINDING SITE, designated SEQ ID:21546, to the nucleotide sequence of VGAM1280 RNA, herein designated VGAM RNA, also designated SEQ ID:3991.

Another function of VGAM1280 is therefore inhibition of Catenin, Beta Interacting Protein 1 (CTNNBIP1, Accession NM_020248). Accordingly, utilities of VGAM1280 include diagnosis, prevention and treatment of diseases and clinical conditions associated with CTNNBIP1. DKFZP434E2135 (Accession NM_030804) is another VGAM1280 host target gene. DKFZP434E2135 BINDING SITE is HOST TARGET binding site found in the 3' untranslated region of mRNA encoded by DKFZP434E2135, corresponding to a HOST TARGET binding site such as BINDING SITE I, BINDING SITE II or BINDING SITE III. Table 2 illustrates the complementarity of the nucleotide sequences of DKFZP434E2135 BINDING SITE, designated SEQ ID:25117, to the nucleotide sequence of VGAM1280 RNA, herein designated VGAM RNA, also designated SEQ ID:3991.

Another function of VGAM1280 is therefore inhibition of DKFZP434E2135 (Accession NM_030804). Accordingly, utilities of VGAM1280 include diagnosis, prevention and treatment of diseases and clinical conditions associated with DKFZP434E2135. DKFZp761N0624 (Accession NM_032295) is another VGAM1280 host target gene. DKFZp761N0624 BINDING SITE is HOST TARGET binding site found in the 3' untranslated region of mRNA encoded by DKFZp761N0624, corresponding to a HOST TARGET binding site such as BINDING SITE I, BINDING SITE II or BINDING SITE III. Table 2 illustrates the complementarity of the nucleotide sequences of DKFZp761N0624 BINDING SITE, designated SEQ ID:26072, to the nucleotide sequence of VGAM1280 RNA, herein designated VGAM RNA, also designated SEQ ID:3991.

Another function of VGAM1280 is therefore inhibition of DKFZp761N0624 (Accession NM_032295). Accordingly, utilities of VGAM1280 include diagnosis, prevention and treatment of diseases and clinical conditions associated with DKFZp761N0624. DKFZp762E1312 (Accession NM_018410) is another VGAM1280 host target gene. DKFZp762E1312 BINDING SITE is HOST TARGET binding site found in the 5' untranslated region of mRNA encoded by DKFZp762E1312, corresponding to a HOST TARGET binding site such as BINDING SITE I, BINDING SITE II or BINDING SITE III. Table 2 illustrates the complementarity of the nucleotide sequences of DKFZp762E1312 BINDING SITE, designated SEQ ID:20452, to the nucleotide sequence of VGAM1280 RNA, herein designated VGAM RNA, also designated SEQ ID:3991.

Another function of VGAM1280 is therefore inhibition of DKFZp762E1312 (Accession NM_018410). Accordingly, utilities of VGAM1280 include diagnosis, prevention and treatment of diseases and clinical conditions associated with DKFZp762E1312. F-box Only Protein 24 (FBXO24, Accession NM_012172) is another VGAM1280 host target gene. FBXO24 BINDING SITE is HOST TARGET binding site found in the 3' untranslated region of mRNA encoded by FBXO24, corresponding to a HOST TARGET binding site such as BINDING SITE I, BINDING SITE II or BINDING SITE III. Table 2 illustrates the complementarity of the nucleotide sequences of FBXO24 BINDING SITE, designated SEQ ID:14465, to the nucleotide sequence of VGAM1280 RNA, herein designated VGAM RNA, also designated SEQ ID:3991.

Another function of VGAM1280 is therefore inhibition of F-box Only Protein 24 (FBXO24, Accession NM_012172). Accordingly, utilities of VGAM1280 include diagnosis, prevention and treatment of diseases and clinical conditions associated with FBXO24. FLJ20651 (Accession NM_017919) is another VGAM1280 host target gene. FLJ20651 BINDING SITE is HOST TARGET binding site found in the 3' untranslated region of mRNA encoded by FLJ20651, corresponding to a HOST TARGET binding site such as BINDING SITE I, BINDING SITE II or BINDING SITE III. Table 2 illustrates the complementarity of the nucleotide sequences of FLJ20651 BINDING SITE, designated SEQ ID:19576, to the nucleotide sequence of VGAM1280 RNA, herein designated VGAM RNA, also designated SEQ ID:3991.

Another function of VGAM1280 is therefore inhibition of FLJ20651 (Accession NM_017919). Accordingly, utilities of VGAM1280 include diagnosis, prevention and treatment of diseases and clinical conditions associated with FLJ20651. FLJ21168 (Accession NM_025073) is another VGAM1280 host target gene. FLJ21168 BINDING SITE is HOST TARGET binding site found in the 3' untranslated region of mRNA encoded by FLJ21168, corresponding to a HOST TARGET binding site such as BINDING SITE I, BINDING SITE II or BINDING SITE III. Table 2 illustrates the complementarity of the nucleotide sequences of FLJ21168 BINDING SITE, designated SEQ ID:24672, to the nucleotide sequence of VGAM1280 RNA, herein designated VGAM RNA, also designated SEQ ID:3991.

Another function of VGAM1280 is therefore inhibition of FLJ21168 (Accession NM_025073). Accordingly, utilities of VGAM1280 include diagnosis, prevention and treatment of diseases and clinical conditions associated with FLJ21168. Golgi Associated, Gamma Adaptin Ear Containing, ARF Binding Protein 2 (GGA2, Accession NM_138640) is another VGAM1280 host target gene. GGA2 BINDING SITE1 and GGA2 BINDING SITE2 are HOST TARGET binding sites found in untranslated regions of mRNA encoded by GGA2, corresponding to HOST TARGET binding sites such as BINDING SITE I, BINDING SITE II or BINDING SITE III. Table 2 illustrates the complementarity of the nucleotide sequences of GGA2 BINDING SITE1 and GGA2

BINDING SITE2, designated SEQ ID:28923 and SEQ ID:17402 respectively, to the nucleotide sequence of VGAM1280 RNA, herein designated VGAM RNA, also designated SEQ ID:3991.

Another function of VGAM1280 is therefore inhibition of Golgi Associated, Gamma Adaptin Ear Containing, ARF Binding Protein 2 (GGA2, Accession NM_138640). Accordingly, utilities of VGAM1280 include diagnosis, prevention and treatment of diseases and clinical conditions associated with GGA2. KIAA1550 (Accession XM_039393) is another VGAM1280 host target gene. KIAA1550 BINDING SITE is HOST TARGET binding site found in the 3' untranslated region of mRNA encoded by KIAA1550, corresponding to a HOST TARGET binding site such as BINDING SITE I, BINDING SITE II or BINDING SITE III. Table 2 illustrates the complementarity of the nucleotide sequences of KIAA1550 BINDING SITE, designated SEQ ID:33074, to the nucleotide sequence of VGAM1280 RNA, herein designated VGAM RNA, also designated SEQ ID:3991.

Another function of VGAM1280 is therefore inhibition of KIAA1550 (Accession XM_039393). Accordingly, utilities of VGAM1280 include diagnosis, prevention and treatment of diseases and clinical conditions associated with KIAA1550. KIAA1729 (Accession XM_114418) is another VGAM1280 host target gene. KIAA1729 BINDING SITE is HOST TARGET binding site found in the 5' untranslated region of mRNA encoded by KIAA1729, corresponding to a HOST TARGET binding site such as BINDING SITE I, BINDING SITE II or BINDING SITE III. Table 2 illustrates the complementarity of the nucleotide sequences of KIAA1729 BINDING SITE, designated SEQ ID:42951, to the nucleotide sequence of VGAM1280 RNA, herein designated VGAM RNA, also designated SEQ ID:3991.

Another function of VGAM1280 is therefore inhibition of KIAA1729 (Accession XM_114418). Accordingly, utilities of VGAM1280 include diagnosis, prevention and treatment of diseases and clinical conditions associated with KIAA1729. MGC4663 (Accession NM_024514) is another VGAM1280 host target gene. MGC4663 BINDING SITE is HOST TARGET binding site found in the 3' untranslated region of mRNA encoded by MGC4663, corresponding to a HOST TARGET binding site such as BINDING SITE I, BINDING SITE II or BINDING SITE III. Table 2 illustrates the complementarity of the nucleotide sequences of MGC4663 BINDING SITE, designated SEQ ID:23717, to the nucleotide sequence of VGAM1280 RNA, herein designated VGAM RNA, also designated SEQ ID:3991.

Another function of VGAM1280 is therefore inhibition of MGC4663 (Accession NM_024514). Accordingly, utilities of VGAM1280 include diagnosis, prevention and treatment of diseases and clinical conditions associated with MGC4663. RIS1 (Accession XM_087461) is another VGAM1280 host target gene. RIS1 BINDING SITE is HOST TARGET binding site found in the 3' untranslated region of mRNA encoded by RIS1, corresponding to a HOST TARGET binding site such as BINDING SITE I, BINDING SITE II or BINDING SITE III. Table 2 illustrates the complementarity of the nucleotide sequences of RIS1 BINDING SITE, designated SEQ ID:39273, to the nucleotide sequence of VGAM1280 RNA, herein designated VGAM RNA, also designated SEQ ID:3991.

Another function of VGAM1280 is therefore inhibition of RIS1 (Accession XM_087461). Accordingly, utilities of VGAM1280 include diagnosis, prevention and treatment of diseases and clinical conditions associated with RIS1. Zinc Finger Protein 220 (ZNF220, Accession NM_006766) is another VGAM1280 host target gene. ZNF220 BINDING SITE is HOST TARGET binding site found in the 5' untranslated region of mRNA encoded by ZNF220, corresponding to a HOST TARGET binding site such as BINDING SITE I, BINDING SITE II or BINDING SITE III. Table 2 illustrates the complementarity of the nucleotide sequences of ZNF220 BINDING SITE, designated SEQ ID:13632, to the nucleotide sequence of VGAM1280 RNA, herein designated VGAM RNA, also designated SEQ ID:3991.

Another function of VGAM1280 is therefore inhibition of Zinc Finger Protein 220 (ZNF220, Accession NM_006766). Accordingly, utilities of VGAM1280 include diagnosis, prevention and treatment of diseases and clinical conditions associated with ZNF220. LOC116064 (Accession XM_057296) is another VGAM1280 host target gene. LOC116064 BINDING SITE is HOST TARGET binding site found in the 3' untranslated region of mRNA encoded by LOC116064, corresponding to a HOST TARGET binding site such as BINDING SITE I, BINDING SITE II or BINDING SITE III. Table 2 illustrates the complementarity of the nucleotide sequences of LOC116064 BINDING SITE, designated SEQ ID:36497, to the nucleotide sequence of VGAM1280 RNA, herein designated VGAM RNA, also designated SEQ ID:3991.

Another function of VGAM1280 is therefore inhibition of LOC116064 (Accession XM_057296). Accordingly, utilities of VGAM1280 include diagnosis, prevention and treatment of diseases and clinical conditions associated with LOC116064. LOC158293 (Accession XM_088541) is another VGAM1280 host target gene. LOC158293 BINDING SITE is HOST TARGET binding site found in the 3' untranslated region of mRNA encoded by LOC158293, corresponding to a HOST TARGET binding site such as BINDING SITE I, BINDING SITE II or BINDING SITE III. Table 2 illustrates the complementarity of the nucleotide sequences of LOC158293 BINDING SITE, designated SEQ ID:39805, to the nucleotide sequence of VGAM1280 RNA, herein designated VGAM RNA, also designated SEQ ID:3991.

Another function of VGAM1280 is therefore inhibition of LOC158293 (Accession XM_088541). Accordingly, utilities of VGAM1280 include diagnosis, prevention and treatment of diseases and clinical conditions associated with LOC158293. FIG. 1 further provides a conceptual description of a novel bioinformatically detected viral gene of the present invention, referred to here as Viral Genomic Address Messenger 1281 (VGAM1281) viral gene, which modulates expression of respective host target genes thereof, the function and utility of which host target genes is known in the art.

VGAM1281 is a novel bioinformatically detected regulatory, non protein coding, viral micro RNA (miRNA) gene. The method by which VGAM1281 was detected is described hereinabove with reference to FIGS. 1-8.

VGAM1281 gene, herein designated VGAM GENE, is a viral gene contained in the genome of Beet Virus Q. VGAM1281 host target gene, herein designated VGAM HOST TARGET GENE, is a human gene contained in the human genome.

VGAM1281 gene encodes a VGAM1281 precursor RNA, herein designated VGAM PRECURSOR RNA. Similar to other miRNA genes, and unlike most ordinary genes, VGAM1281 precursor RNA does not encode a protein. A nucleotide sequence identical or highly similar to the nucleotide sequence of VGAM1281 precursor RNA is designated SEQ ID:1267, and is provided hereinbelow with reference to the sequence listing part. Nucleotide sequence SEQ ID:1267 is located at position 1984 relative to the genome of Beet Virus Q.

VGAM1281 precursor RNA folds onto itself, forming VGAM1281 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1281 folded precursor RNA into VGAM1281 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1281 RNA is designated SEQ ID:3992, and is provided hereinbelow with reference to the sequence listing part.

VGAM1281 host target gene, herein designated VGAM HOST TARGET GENE, encodes a corresponding messenger RNA, VGAM1281 host target RNA, herein designated VGAM HOST TARGET RNA. VGAM1281 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1281 RNA, herein designated VGAM RNA, binds complementarily to one or more host target binding sites located in untranslated regions of VGAM1281 host target RNA, herein designated VGAM HOST TARGET RNA. This complementary binding is due to the fact that the nucleotide sequence of VGAM1281 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1281 RNA, herein designated VGAM RNA, may have a different number of host target binding sites in untranslated regions of a VGAM1281 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1281 RNA, herein designated VGAM RNA, to host target binding sites on VGAM1281 host target RNA, herein designated VGAM HOST TARGET RNA, such as BINDING SITE I, BINDING SITE II and BINDING SITE III, inhibits translation of VGAM1281 host target RNA into VGAM1281 host target protein, herein designated VGAM HOST TARGET PROTEIN. VGAM host target protein is therefore outlined by a broken line.

It is appreciated that VGAM1281 host target gene, herein designated VGAM HOST TARGET GENE, in fact represents a plurality of VGAM1281 host target genes. The mRNA of each one of this plurality of VGAM1281 host target genes comprises one or more host target binding sites, each having a nucleotide sequence which is at least partly complementary to VGAM1281 RNA, herein designated VGAM RNA, and which when bound by VGAM1281 RNA causes inhibition of translation of respective one or more VGAM1281 host target proteins.

It is further appreciated by one skilled in the art that the mode of translational inhibition illustrated by FIG. 1 with specific reference to translational inhibition exerted by VGAM1281 gene, herein designated VGAM GENE, on one or more VGAM1281 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1281 is inhibition of expression of host target genes, as part of a novel viral mechanism of attacking a host. Accordingly, utilities of VGAM1281 include diagnosis, prevention and treatment of viral infection by Beet Virus Q. Specific functions, and accordingly utilities, of VGAM1281 correlate with, and may be deduced from, the identity of the host target genes which VGAM1281 binds and inhibits, and the function of these host target genes, as elaborated hereinbelow.

Nucleotide sequences of the VGAM1281 precursor RNA, herein designated VGAM PRECURSOR RNA, and of the 'diced' VGAM1281 RNA, herein designated VGAM RNA, and a schematic representation of the secondary folding of VGAM1281 folded precursor RNA, herein designated VGAM FOLDED PRECURSOR RNA, of VGAM1281 are further described hereinbelow with reference to Table 1.

Nucleotide sequences of host target binding sites, such as BINDING SITE-I, BINDING SITE-II and BINDING SITE-III of FIG. 1, found on VGAM1281 host target RNA, and schematic representation of the complementarity of each of these host target binding sites to VGAM1281 RNA, herein designated VGAM RNA, are described hereinbelow with reference to Table 2.

As mentioned hereinabove with reference to FIG. 1, a function of VGAM1281 gene, herein designated VGAM is inhibition of expression of VGAM1281 target genes. It is appreciated that specific functions, and accordingly utilities, of VGAM1281 correlate with, and may be deduced from, the identity of the target genes which VGAM1281 binds and inhibits, and the function of these target genes, as elaborated hereinbelow.

LFG (Accession XM_084780) is a VGAM1281 host target gene. LFG BINDING SITE is HOST TARGET binding site found in the 3' untranslated region of mRNA encoded by LFG, corresponding to a HOST TARGET binding site such as BINDING SITE I, BINDING SITE II or BINDING SITE III. Table 2 illustrates the complementarity of the nucleotide sequences of LFG BINDING SITE, designated SEQ ID:37698, to the nucleotide sequence of VGAM1281 RNA, herein designated VGAM RNA, also designated SEQ ID:3992.

A function of VGAM1281 is therefore inhibition of LFG (Accession XM_084780). Accordingly, utilities of VGAM1281 include diagnosis, prevention and treatment of diseases and clinical conditions associated with LFG. Multiple Endocrine Neoplasia I (MEN1, Accession XM_167804) is another VGAM1281 host target gene. MEN1 BINDING SITE is HOST TARGET binding site found in the 5' untranslated region of mRNA encoded by MEN1, corresponding to a HOST TARGET binding site such as BINDING SITE I, BINDING SITE II or BINDING SITE III. Table 2 illustrates the complementarity of the nucleotide sequences of MEN1 BINDING SITE, designated SEQ ID:44843, to the nucleotide sequence of VGAM1281 RNA, herein designated VGAM RNA, also designated SEQ ID:3992.

Another function of VGAM1281 is therefore inhibition of Multiple Endocrine Neoplasia I (MEN1, Accession XM_167804). Accordingly, utilities of VGAM1281 include diagnosis, prevention and treatment of diseases and clinical conditions associated with MEN1. Regulatory Factor X, 5 (influences HLA class II expression) (RFX5, Accession NM_000449) is another VGAM1281 host target gene. RFX5 BINDING SITE is HOST TARGET binding site found in the 3' untranslated region of mRNA encoded by RFX5, corresponding to a HOST TARGET binding site such as BINDING SITE I, BINDING SITE II or BINDING SITE III. Table 2 illustrates the complementarity of the nucleotide sequences of RFX5 BINDING SITE, designated SEQ ID:6049, to the nucleotide sequence of VGAM1281 RNA, herein designated VGAM RNA, also designated SEQ ID:3992.

Another function of VGAM1281 is therefore inhibition of Regulatory Factor X, 5 (influences HLA class II expression) (RFX5, Accession NM_000449), a gene which activates transcription from class ii mhc promoters. Accordingly, utilities of VGAM1281 include diagnosis, prevention and treatment of diseases and clinical conditions associated with RFX5. The function of RFX5 and its association with various diseases and clinical conditions, has been established by previous studies, as described hereinabove with reference to VGAM55. Sorting Nexin 6 (SNX6, Accession NM_021249) is another VGAM1281 host target gene. SNX6 BINDING SITE is HOST TARGET binding site found in the 3' untranslated region of mRNA encoded by SNX6, corresponding to a HOST TARGET binding site such as BINDING SITE I, BINDING SITE II or BINDING SITE III. Table 2 illustrates the complementarity of the nucleotide sequences of SNX6 BINDING SITE, designated SEQ ID:22218, to the nucleotide sequence of VGAM1281 RNA, herein designated VGAM RNA, also designated SEQ ID:3992.

Another function of VGAM1281 is therefore inhibition of Sorting Nexin 6 (SNX6, Accession NM_021249). Accordingly, utilities of VGAM1281 include diagnosis, prevention and treatment of diseases and clinical conditions associated with SNX6. TAR (HIV) RNA Binding Protein 2 (TARBP2, Accession NM_134324) is another VGAM1281 host target gene. TARBP2 BINDING SITE is HOST TARGET binding site found in the 3' untranslated region of mRNA encoded by TARBP2, corresponding to a HOST TARGET binding site such as BINDING SITE I, BINDING SITE II or BINDING SITE III. Table 2 illustrates the complementarity of the nucleotide sequences of TARBP2 BINDING SITE, designated SEQ ID:28630, to the nucleotide sequence of VGAM1281 RNA, herein designated VGAM RNA, also designated SEQ ID:3992.

Another function of VGAM1281 is therefore inhibition of TAR (HIV) RNA Binding Protein 2 (TARBP2, Accession NM_134324), a gene which is involved in the regulation of HIV replication. Accordingly, utilities of VGAM1281 include diagnosis, prevention and treatment of diseases and clinical conditions associated with TARBP2. The function of TARBP2 and its association with various diseases and clinical conditions, has been established by previous studies, as described hereinabove with reference to VGAM95. Thiopurine S-methyltransferase (TPMT, Accession NM_000367) is another VGAM1281 host target gene. TPMT BINDING SITE is HOST TARGET binding site found in the 3' untranslated region of mRNA encoded by TPMT, corresponding to a HOST TARGET binding site such as BINDING SITE I, BINDING SITE II or BINDING SITE III. Table 2 illustrates the complementarity of the nucleotide sequences of TPMT BINDING SITE, designated SEQ ID:5937, to the nucleotide sequence of VGAM1281 RNA, herein designated VGAM RNA, also designated SEQ ID:3992.

Another function of VGAM1281 is therefore inhibition of Thiopurine S-methyltransferase (TPMT, Accession NM_000367), a gene which catalyzes the s-methylation of thiopurine drugs such as 6-mercaptopurine. Accordingly, utilities of VGAM1281 include diagnosis, prevention and treatment of diseases and clinical conditions associated with TPMT. The function of TPMT and its association with various diseases and clinical conditions, has been established by previous studies, as described hereinabove with reference to VGAM682. Aminoadipate-semialdehyde Dehydrogenase-phosphopantetheinyl Transferase (AASDHPPT, Accession NM_015423) is another VGAM1281 host target gene. AASDHPPT BINDING SITE is HOST TARGET binding site found in the 3' untranslated region of mRNA encoded by AASDHPPT, corresponding to a HOST TARGET binding site such as BINDING SITE I, BINDING SITE II or BINDING SITE III. Table 2 illustrates the complementarity of the nucleotide sequences of AASDHPPT BINDING SITE, designated SEQ ID:17723, to the nucleotide sequence of VGAM1281 RNA, herein designated VGAM RNA, also designated SEQ ID:3992.

Another function of VGAM1281 is therefore inhibition of Aminoadipate-semialdehyde Dehydrogenase-phosphopantetheinyl Transferase (AASDHPPT, Accession NM_015423). Accordingly, utilities of VGAM1281 include diagnosis, prevention and treatment of diseases and clinical conditions associated with AASDHPPT. UDP-Gal:betaGal Beta 1,3-galactosyltransferase Polypeptide 6 (B3GALT6, Accession NM_080605) is another VGAM1281 host target gene. B3GALT6 BINDING SITE is HOST TARGET binding site found in the 3' untranslated region of mRNA encoded by B3GALT6, corresponding to a HOST TARGET binding site such as BINDING SITE I, BINDING SITE II or BINDING SITE III. Table 2 illustrates the complementarity of the nucleotide sequences of B3GALT6 BINDING SITE, designated SEQ ID:27923, to the nucleotide sequence of VGAM1281 RNA, herein designated VGAM RNA, also designated SEQ ID:3992.

Another function of VGAM1281 is therefore inhibition of UDP-Gal:betaGal Beta 1,3-galactosyltransferase Polypeptide 6 (B3GALT6, Accession NM_080605). Accordingly, utilities of VGAM1281 include diagnosis, prevention and treatment of diseases and clinical conditions associated with B3GALT6. Death-associated Protein Kinase 2 (DAPK2, Accession NM_014326) is another VGAM1281 host target gene. DAPK2 BINDING SITE is HOST TARGET binding site found in the 3' untranslated region of mRNA encoded by DAPK2, corresponding to a HOST TARGET binding site such as BINDING SITE I, BINDING SITE II or BINDING SITE III. Table 2 illustrates the complementarity of the nucleotide sequences of DAPK2 BINDING SITE, designated SEQ ID:15632, to the nucleotide sequence of VGAM1281 RNA, herein designated VGAM RNA, also designated SEQ ID:3992.

Another function of VGAM1281 is therefore inhibition of Death-associated Protein Kinase 2 (DAPK2, Accession NM_014326). Accordingly, utilities of VGAM1281 include diagnosis, prevention and treatment of diseases and clinical conditions associated with DAPK2. DKFZP761F241 (Accession NM_031455) is another VGAM1281 host target gene. DKFZP761F241 BINDING SITE is HOST TARGET binding site found in the 3' untranslated region of mRNA encoded by DKFZP761F241, corresponding to a HOST TARGET binding site such as BINDING SITE I, BINDING SITE II or BINDING SITE III. Table 2 illustrates the complementarity of the nucleotide sequences of DKFZP761F241 BINDING SITE, designated SEQ ID:25475, to the nucleotide sequence of VGAM1281 RNA, herein designated VGAM RNA, also designated SEQ ID:3992.

Another function of VGAM1281 is therefore inhibition of DKFZP761F241 (Accession NM_031455). Accordingly, utilities of VGAM1281 include diagnosis, prevention and treatment of diseases and clinical conditions associated with DKFZP761F241. Enabled Homolog (Drosophila) (ENAH, Accession NM_018212) is another VGAM1281 host target gene. ENAH BINDING SITE is HOST TARGET binding site found in the 3' untranslated region of mRNA encoded by ENAH, corresponding to a HOST TARGET binding site such as BINDING SITE I, BINDING SITE II or BINDING SITE III. Table 2 illustrates the complementarity of the nucleotide sequences of ENAH BINDING SITE, designated SEQ ID:20122, to the nucleotide sequence of VGAM1281 RNA, herein designated VGAM RNA, also designated SEQ ID:3992.

Another function of VGAM1281 is therefore inhibition of Enabled Homolog (Drosophila) (ENAH, Accession NM_018212). Accordingly, utilities of VGAM1281 include diagnosis, prevention and treatment of diseases and clinical conditions associated with ENAH. FLJ30574 (Accession NM_144629) is another VGAM1281 host target gene. FLJ30574 BINDING SITE is HOST TARGET binding site found in the 3' untranslated region of mRNA encoded by FLJ30574, corresponding to a HOST TARGET binding site such as BINDING SITE I, BINDING SITE II or BINDING SITE III. Table 2 illustrates the complementarity of the nucleotide sequences of FLJ30574 BINDING SITE, designated SEQ ID:29446, to the nucleotide sequence of VGAM1281 RNA, herein designated VGAM RNA, also designated SEQ ID:3992.

Another function of VGAM1281 is therefore inhibition of FLJ30574 (Accession NM_144629). Accordingly, utilities of VGAM1281 include diagnosis, prevention and treatment of diseases and clinical conditions associated with FLJ30574. Oxysterol Binding Protein-like 10 (OSBPL10, Accession NM_017784) is another VGAM1281 host target gene. OSBPL10 BINDING SITE is HOST TARGET binding site found in the 3' untranslated region of mRNA encoded by OSBPL10, corresponding to a HOST TARGET binding site such as BINDING SITE I, BINDING SITE II or BINDING SITE III. Table 2 illustrates the complementarity of the nucleotide sequences of OSBPL10 BINDING SITE, designated SEQ ID:19416, to the nucleotide sequence of VGAM1281 RNA, herein designated VGAM RNA, also designated SEQ ID:3992.

Another function of VGAM1281 is therefore inhibition of Oxysterol Binding Protein-like 10 (OSBPL10, Accession NM_017784). Accordingly, utilities of VGAM1281 include diagnosis, prevention and treatment of diseases and clinical conditions associated with OSBPL10. ZF (Accession NM_021212) is another VGAM1281 host target gene. ZF BINDING SITE is HOST TARGET binding site found in the 3' untranslated region of mRNA encoded by ZF, corresponding to a HOST TARGET binding site such as BINDING SITE I, BINDING SITE II or BINDING SITE III. Table 2 illustrates the complementarity of the nucleotide sequences of ZF BINDING SITE, designated SEQ ID:22190, to the nucleotide sequence of VGAM1281 RNA, herein designated VGAM RNA, also designated SEQ ID:3992.

Another function of VGAM1281 is therefore inhibition of ZF (Accession NM_021212). Accordingly, utilities of VGAM1281 include diagnosis, prevention and treatment of diseases and clinical conditions associated with ZF. LOC116068 (Accession XM_057302) is another VGAM1281 host target gene. LOC116068 BINDING SITE is HOST TARGET binding site found in the 3' untranslated region of mRNA encoded by LOC116068, corresponding to a HOST TARGET binding site such as BINDING SITE I, BINDING SITE II or BINDING SITE III. Table 2 illustrates the complementarity of the nucleotide sequences of LOC116068 BINDING SITE, designated SEQ ID:36501, to the nucleotide sequence of VGAM1281 RNA, herein designated VGAM RNA, also designated SEQ ID:3992.

Another function of VGAM1281 is therefore inhibition of LOC116068 (Accession XM_057302). Accordingly, utilities of VGAM1281 include diagnosis, prevention and treatment of diseases and clinical conditions associated with LOC116068. LOC151121 (Accession XM_087102) is another VGAM1281 host target gene. LOC151121 BINDING SITE is HOST TARGET binding site found in the 5' untranslated region of mRNA encoded by LOC151121, corresponding to a HOST TARGET binding site such as BINDING SITE I, BINDING SITE II or BINDING SITE III. Table 2 illustrates the complementarity of the nucleotide sequences of LOC151121 BINDING SITE, designated SEQ ID:39052, to the nucleotide sequence of VGAM1281 RNA, herein designated VGAM RNA, also designated SEQ ID:3992.

Another function of VGAM1281 is therefore inhibition of LOC151121 (Accession XM_087102). Accordingly, utilities of VGAM1281 include diagnosis, prevention and treatment of diseases and clinical conditions associated with LOC151121. LOC201411 (Accession XM_031946) is another VGAM1281 host target gene. LOC201411 BINDING SITE is HOST TARGET binding site found in the 3' untranslated region of mRNA encoded by LOC201411, corresponding to a HOST TARGET binding site such as BINDING SITE I, BINDING SITE II or BINDING SITE III. Table 2 illustrates the complementarity of the nucleotide sequences of LOC201411 BINDING SITE, designated SEQ ID:31526, to the nucleotide sequence of VGAM1281 RNA, herein designated VGAM RNA, also designated SEQ ID:3992.

Another function of VGAM1281 is therefore inhibition of LOC201411 (Accession XM_031946). Accordingly, utilities of VGAM1281 include diagnosis, prevention and treatment of diseases and clinical conditions associated with LOC201411. LOC254085 (Accession XM_171189) is another VGAM1281 host target gene. LOC254085 BINDING SITE is HOST TARGET binding site found in the 5' untranslated region of mRNA encoded by LOC254085, corresponding to a HOST TARGET binding site such as BINDING SITE I, BINDING SITE II or BINDING SITE III. Table 2 illustrates the complementarity of the nucleotide sequences of LOC254085 BINDING SITE, designated SEQ ID:45972, to the nucleotide sequence of VGAM1281 RNA, herein designated VGAM RNA, also designated SEQ ID:3992.

Another function of VGAM1281 is therefore inhibition of LOC254085 (Accession XM_171189). Accordingly, utilities of VGAM1281 include diagnosis, prevention and treatment of diseases and clinical conditions associated with LOC254085. FIG. 1 further provides a conceptual description of a novel bioinformatically detected viral gene of the present invention, referred to here as Viral Genomic Address Messenger 1282 (VGAM1282) viral gene, which modulates expression of respective host target genes thereof, the function and utility of which host target genes is known in the art.

VGAM1282 is a novel bioinformatically detected regulatory, non protein coding, viral micro RNA (miRNA) gene. The method by which VGAM1282 was detected is described hereinabove with reference to FIGS. 1-8.

VGAM1282 gene, herein designated VGAM GENE, is a viral gene contained in the genome of Beet Virus Q. VGAM1282 host target gene, herein designated VGAM HOST TARGET GENE, is a human gene contained in the human genome.

VGAM1282 gene encodes a VGAM1282 precursor RNA, herein designated VGAM PRECURSOR RNA. Similar to other miRNA genes, and unlike most ordinary genes, VGAM1282 precursor RNA does not encode a protein. A nucleotide sequence identical or highly similar to the nucleotide sequence of VGAM1282 precursor RNA is designated SEQ ID:1268, and is provided hereinbelow with reference to the sequence listing part. Nucleotide sequence SEQ ID:1268 is located at position 3568 relative to the genome of Beet Virus Q.

VGAM1282 precursor RNA folds onto itself, forming VGAM1282 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1282 folded precursor RNA into VGAM1282 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM1282 RNA is designated SEQ ID:3993, and is provided hereinbelow with reference to the sequence listing part.

VGAM1282 host target gene, herein designated VGAM HOST TARGET GENE, encodes a corresponding messenger RNA, VGAM1282 host target RNA, herein designated VGAM HOST TARGET RNA. VGAM1282 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1282 RNA, herein designated VGAM RNA, binds complementarily to one or more host target binding sites located in untranslated regions of VGAM1282 host target RNA, herein designated VGAM HOST TARGET RNA. This complementary binding is due to the fact that the nucleotide sequence of VGAM1282 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1282 RNA, herein designated VGAM RNA, may have a different number of host target binding sites in untranslated regions of a VGAM1282 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1282 RNA, herein designated VGAM RNA, to host target binding sites on VGAM1282 host target RNA, herein designated VGAM HOST TARGET RNA, such as BINDING SITE I, BINDING SITE II and BINDING SITE III, inhibits translation of VGAM1282 host target RNA into VGAM1282 host target protein, herein designated VGAM HOST TARGET PROTEIN. VGAM host target protein is therefore outlined by a broken line.

It is appreciated that VGAM1282 host target gene, herein designated VGAM HOST TARGET GENE, in fact represents a plurality of VGAM1282 host target genes. The mRNA of each one of this plurality of VGAM1282 host target genes comprises one or more host target binding sites, each having a nucleotide sequence which is at least partly complementary to VGAM1282 RNA, herein designated VGAM RNA, and which when bound by VGAM1282 RNA causes inhibition of translation of respective one or more VGAM1282 host target proteins.

It is further appreciated by one skilled in the art that the mode of translational inhibition illustrated by FIG. 1 with specific reference to translational inhibition exerted by VGAM1282 gene, herein designated VGAM GENE, on one or more VGAM1282 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1282 is inhibition of expression of host target genes, as part of a novel viral mechanism of attacking a host. Accordingly, utilities of VGAM1282 include diagnosis, prevention and treatment of viral infection by Beet Virus Q. Specific functions, and accordingly utilities, of VGAM1282 correlate with, and may be deduced from, the identity of the host target genes which VGAM1282 binds and inhibits, and the function of these host target genes, as elaborated hereinbelow.

Nucleotide sequences of the VGAM1282 precursor RNA, herein designated VGAM PRECURSOR RNA, and of the 'diced' VGAM1282 RNA, herein designated VGAM RNA, and a schematic representation of the secondary folding of VGAM1282 folded precursor RNA, herein designated VGAM FOLDED PRECURSOR RNA, of VGAM1282 are further described hereinbelow with reference to Table 1.

Nucleotide sequences of host target binding sites, such as BINDING SITE-I, BINDING SITE-II and BINDING SITE-III of FIG. 1, found on VGAM1282 host target RNA, and schematic representation of the complementarity of each of these host target binding sites to VGAM1282 RNA, herein designated VGAM RNA, are described hereinbelow with reference to Table 2.

As mentioned hereinabove with reference to FIG. 1, a function of VGAM1282 gene, herein designated VGAM is inhibition of expression of VGAM1282 target genes. It is appreciated that specific functions, and accordingly utilities, of VGAM1282 correlate with, and may be deduced from, the identity of the target genes which VGAM1282 binds and inhibits, and the function of these target genes, as elaborated hereinbelow.

FLJ10726 (Accession NM_018195) is a VGAM1282 host target gene. FLJ10726 BINDING SITE is HOST TARGET binding site found in the 3' untranslated region of mRNA encoded by FLJ10726, corresponding to a HOST TARGET binding site such as BINDING SITE I, BINDING SITE II or BINDING SITE III. Table 2 illustrates the complementarity of the nucleotide sequences of FLJ10726 BINDING SITE, designated SEQ ID:20058, to the nucleotide sequence of VGAM1282 RNA, herein designated VGAM RNA, also designated SEQ ID:3993.

A function of VGAM1282 is therefore inhibition of FLJ10726 (Accession NM_018195). Accordingly, utilities of VGAM1282 include diagnosis, prevention and treatment of diseases and clinical conditions associated with FLJ10726. FLJ23153 (Accession NM_024636) is another VGAM1282 host target gene. FLJ23153 BINDING SITE is HOST TARGET binding site found in the 3' untranslated region of mRNA encoded by FLJ23153, corresponding to a HOST TARGET binding site such as BINDING SITE I, BINDING SITE II or BINDING SITE III. Table 2 illustrates the complementarity of the nucleotide sequences of FLJ23153 BINDING SITE, designated SEQ ID:23908, to the nucleotide sequence of VGAM1282 RNA, herein designated VGAM RNA, also designated SEQ ID:3993.

Another function of VGAM1282 is therefore inhibition of FLJ23153 (Accession NM_024636). Accordingly, utilities of VGAM1282 include diagnosis, prevention and treatment of diseases and clinical conditions associated with FLJ23153. KIAA1036 (Accession NM_014909) is another VGAM1282 host target gene. KIAA1036 BINDING SITE is HOST TARGET binding site found in the 3' untranslated region of mRNA encoded by KIAA1036, corresponding to a HOST TARGET binding site such as BINDING SITE I, BINDING SITE II or BINDING SITE III. Table 2 illustrates the complementarity of the nucleotide sequences of KIAA1036 BINDING SITE, designated SEQ ID:17127, to the nucleotide sequence of VGAM1282 RNA, herein designated VGAM RNA, also designated SEQ ID:3993.

Another function of VGAM1282 is therefore inhibition of KIAA1036 (Accession NM_014909). Accordingly, utilities of VGAM1282 include diagnosis, prevention and treatment of diseases and clinical conditions associated with KIAA1036. KIAA1577 (Accession XM_035299) is another VGAM1282 host target gene. KIAA1577 BINDING SITE is HOST TARGET binding site found in the 5' untranslated region of mRNA encoded by KIAA1577, corresponding to a HOST TARGET binding site such as BINDING SITE I, BINDING SITE II or BINDING SITE III. Table 2 illustrates the complementarity of the nucleotide sequences of KIAA1577 BINDING SITE, designated SEQ ID:32212, to the nucleotide sequence of VGAM1282 RNA, herein designated VGAM RNA, also designated SEQ ID:3993.

Another function of VGAM1282 is therefore inhibition of KIAA1577 (Accession XM_035299). Accordingly, utilities of VGAM1282 include diagnosis, prevention and treatment of diseases and clinical conditions associated with KIAA1577. LOC91308 (Accession XM_037600) is another VGAM1282 host target gene. LOC91308 BINDING SITE is HOST TARGET binding site found in the 3' untranslated region of mRNA encoded by LOC91308, corresponding to a HOST TARGET binding site such as BINDING SITE I, BINDING SITE II or BINDING SITE III. Table 2 illustrates the complementarity of the nucleotide sequences of LOC91308 BINDING SITE, designated SEQ ID:32657, to the nucleotide sequence of VGAM1282 RNA, herein designated VGAM RNA, also designated SEQ ID:3993.

Another function of VGAM1282 is therefore inhibition of LOC91308 (Accession XM_037600). Accordingly, utilities of VGAM1282 include diagnosis, prevention and treatment of diseases and clinical conditions associated with LOC91308. FIG. 1 further provides a conceptual description of a novel bioinformatically detected viral gene of the present invention, referred to here as Viral Genomic Address Messenger 1283 (VGAM1283) viral gene, which modulates expression of respective host target genes thereof, the function and utility of which host target genes is known in the art.

VGAM1283 is a novel bioinformatically detected regulatory, non protein coding, viral micro RNA (miRNA) gene. The method by which VGAM1283 was detected is described hereinabove with reference to FIGS. 1-8.

VGAM1283 gene, herein designated VGAM GENE, is a viral gene contained in the genome of Beet Virus Q. VGAM1283 host target gene, herein designated VGAM HOST TARGET GENE, is a human gene contained in the human genome.

VGAM1283 gene encodes a VGAM1283 precursor RNA, herein designated VGAM PRECURSOR RNA. Similar to other miRNA genes, and unlike most ordinary genes, VGAM1283 precursor RNA does not encode a protein. A nucleotide sequence identical or highly similar to the nucleotide sequence of VGAM1283 precursor RNA is designated SEQ ID:1269, and is provided hereinbelow with reference to the sequence listing part. Nucleotide sequence SEQ ID:1269 is located at position 3671 relative to the genome of Beet Virus Q.

VGAM1283 precursor RNA folds onto itself, forming VGAM1283 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1283 folded precursor RNA into VGAM1283 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1283 RNA is designated SEQ ID:3994, and is provided hereinbelow with reference to the sequence listing part.

VGAM1283 host target gene, herein designated VGAM HOST TARGET GENE, encodes a corresponding messenger RNA, VGAM1283 host target RNA, herein designated VGAM HOST TARGET RNA. VGAM1283 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1283 RNA, herein designated VGAM RNA, binds complementarily to one or more host target binding sites located in untranslated regions of VGAM1283 host target RNA, herein designated VGAM HOST TARGET RNA. This complementary binding is due to the fact that the nucleotide sequence of VGAM1283 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1283 RNA, herein designated VGAM RNA, may have a different number of host target binding sites in untranslated regions of a VGAM1283 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1283 RNA, herein designated VGAM RNA, to host target binding sites on VGAM1283 host target RNA, herein designated VGAM HOST TARGET RNA, such as BINDING SITE I, BINDING SITE II and BINDING SITE III, inhibits translation of VGAM1283 host target RNA into VGAM1283 host target protein, herein designated VGAM HOST TARGET PROTEIN. VGAM host target protein is therefore outlined by a broken line.

It is appreciated that VGAM1283 host target gene, herein designated VGAM HOST TARGET GENE, in fact represents a plurality of VGAM1283 host target genes. The mRNA of each one of this plurality of VGAM1283 host target genes comprises one or more host target binding sites, each having a nucleotide sequence which is at least partly complementary to VGAM1283 RNA, herein designated VGAM RNA, and which when bound by VGAM1283 RNA causes inhibition of translation of respective one or more VGAM1283 host target proteins.

It is further appreciated by one skilled in the art that the mode of translational inhibition illustrated by FIG. 1 with specific reference to translational inhibition exerted by VGAM1283 gene, herein designated VGAM GENE, on one or more VGAM1283 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1283 is inhibition of expression of host target genes, as part of a novel viral mechanism of attacking a host. Accordingly, utilities of VGAM1283 include diagnosis, prevention and treatment of viral infection by Beet Virus Q. Specific functions, and accordingly utilities, of VGAM1283 correlate with, and may be deduced from, the identity of the host target genes which VGAM1283 binds and inhibits, and the function of these target genes, as elaborated hereinbelow.

Nucleotide sequences of the VGAM1283 precursor RNA, herein designated VGAM PRECURSOR RNA, and of the 'diced' VGAM1283 RNA, herein designated VGAM RNA, and a schematic representation of the secondary folding of VGAM1283 folded precursor RNA, herein designated VGAM FOLDED PRECURSOR RNA, of VGAM1283 are further described hereinbelow with reference to Table 1.

Nucleotide sequences of host target binding sites, such as BINDING SITE-I, BINDING SITE-II and BINDING SITE-III of FIG. 1, found on VGAM1283 host target RNA, and schematic representation of the complementarity of each of these host target binding sites to VGAM1283 RNA, herein designated VGAM RNA, are described hereinbelow with reference to Table 2.

As mentioned hereinabove with reference to FIG. 1, a function of VGAM1283 gene, herein designated VGAM is inhibition of expression of VGAM1283 target genes. It is appreciated that specific functions, and accordingly utilities, of VGAM1283 correlate with, and may be deduced from, the identity of the target genes which VGAM1283 binds and inhibits, and the function of these target genes, as elaborated hereinbelow.

S-adenosylhomocysteine Hydrolase (AHCY, Accession NM_000687) is a VGAM1283 host target gene. AHCY BINDING SITE is HOST TARGET binding site found in the 3' untranslated region of mRNA encoded by AHCY, corresponding to a HOST TARGET binding site such as BINDING SITE I, BINDING SITE II or BINDING SITE III. Table 2 illustrates the complementarity of the nucleotide sequences of AHCY BINDING SITE, designated SEQ ID:6344, to the nucleotide sequence of VGAM1283 RNA, herein designated VGAM RNA, also designated SEQ ID:3994.

A function of VGAM1283 is therefore inhibition of S-adenosylhomocysteine Hydrolase (AHCY, Accession NM_000687). Accordingly, utilities of VGAM1283 include diagnosis, prevention and treatment of diseases and clinical conditions associated with AHCY. Archain 1 (ARCN1, Accession NM_001655) is another VGAM1283 host target gene. ARCN1 BINDING SITE1 and ARCN1 BINDING SITE2 are HOST TARGET binding sites found in untranslated regions of mRNA encoded by ARCN1, corresponding to HOST TARGET binding sites such as BINDING SITE I, BINDING SITE II or BINDING SITE III. Table 2 illustrates the complementarity of the nucleotide sequences of ARCN1 BINDING SITE1 and ARCN1 BINDING SITE2, designated SEQ ID:7367 and SEQ ID:7369 respectively, to the nucleotide sequence of VGAM1283 RNA, herein designated VGAM RNA, also designated SEQ ID:3994.

Another function of VGAM1283 is therefore inhibition of Archain 1 (ARCN1, Accession NM_001655), a gene which plays a fundamental role in eukaryotic cell biology. Accordingly, utilities of VGAM1283 include diagnosis, prevention and treatment of diseases and clinical conditions associated with ARCN1. The function of ARCN1 and its association with various diseases and clinical conditions, has been established by previous studies, as described hereinabove with reference to VGAM1226. Cell Division Cycle 42 (GTP binding protein, 25 kDa) (CDC42, Accession NM_001791) is another VGAM1283 host target gene. CDC42 BINDING SITE is HOST TARGET binding site found in the 3' untranslated region of mRNA encoded by CDC42, corresponding to a HOST TARGET binding site such as BINDING SITE I, BINDING SITE II or BINDING SITE III. Table 2 illustrates the complementarity of the nucleotide sequences of CDC42 BINDING SITE, designated SEQ ID:7542, to the nucleotide sequence of VGAM1283 RNA, herein designated VGAM RNA, also designated SEQ ID:3994.

Another function of VGAM1283 is therefore inhibition of Cell Division Cycle 42 (GTP binding protein, 25 kDa) (CDC42, Accession NM_001791). Accordingly, utilities of VGAM1283 include diagnosis, prevention and treatment of diseases and clinical conditions associated with CDC42. Cadherin 1, Type 1, E-cadherin (epithelial) (CDH1, Accession NM_004360) is another VGAM1283 host target gene. CDH1 BINDING SITE is HOST TARGET binding site found in the 3' untranslated region of mRNA encoded by CDH1, corresponding to a HOST TARGET binding site such as BINDING SITE I, BINDING SITE II or BINDING SITE III. Table 2 illustrates the complementarity of the nucleotide sequences of CDH1 BINDING SITE, designated SEQ ID:10566, to the nucleotide sequence of VGAM1283 RNA, herein designated VGAM RNA, also designated SEQ ID:3994.

Another function of VGAM1283 is therefore inhibition of Cadherin 1, Type 1, E-cadherin (epithelial) (CDH1, Accession NM_004360). Accordingly, utilities of VGAM1283 include diagnosis, prevention and treatment of diseases and clinical conditions associated with CDH1. Cyclin-dependent Kinase 5, Regulatory Subunit 2 (p39) (CDK5R2, Accession NM_003936) is another VGAM1283 host target gene. CDK5R2 BINDING SITE is HOST TARGET binding site found in the 3' untranslated region of mRNA encoded by CDK5R2, corresponding to a HOST TARGET binding site such as BINDING SITE I, BINDING SITE II or BINDING SITE III. Table 2 illustrates the complementarity of the nucleotide sequences of CDK5R2 BINDING SITE, designated SEQ ID:10043, to the nucleotide sequence of VGAM1283 RNA, herein designated VGAM RNA, also designated SEQ ID:3994.

Another function of VGAM1283 is therefore inhibition of Cyclin-dependent Kinase 5, Regulatory Subunit 2 (p39) (CDK5R2, Accession NM_003936), a gene which acts as a regulatory subunit for the cyclin-dependent CDK5. Accordingly, utilities of VGAM1283 include diagnosis, prevention and treatment of diseases and clinical conditions associated with CDK5R2. The function of CDK5R2 and its association with various diseases and clinical conditions, has been established by previous studies, as described hereinabove with reference to VGAM403. Dedicator of Cyto-kinesis 1 (DOCK1, Accession NM_001380) is another VGAM1283 host target gene. DOCK1 BINDING SITE is HOST TARGET binding site found in the 3' untranslated region of mRNA encoded by DOCK1, corresponding to a HOST TARGET binding site such as BINDING SITE I, BINDING SITE II or BINDING SITE III. Table 2 illustrates the complementarity of the nucleotide sequences of DOCK1 BINDING SITE, designated SEQ ID:7052, to the nucleotide sequence of VGAM1283 RNA, herein designated VGAM RNA, also designated SEQ ID:3994.

Another function of VGAM1283 is therefore inhibition of Dedicator of Cyto-kinesis 1 (DOCK1, Accession NM_001380), a gene which may function in the extension of cell surfaces. Accordingly, utilities of VGAM1283 include diagnosis, prevention and treatment of diseases and clinical conditions associated with DOCK1. The function of DOCK1 and its association with various diseases and clinical conditions, has been established by previous studies, as described hereinabove with reference to VGAM564. Golgi Associated, Gamma Adaptin Ear Containing, ARF Binding Protein 3 (GGA3, Accession NM_138619) is another VGAM1283 host target gene. GGA3 BINDING SITE1 and GGA3 BINDING SITE2 are HOST TARGET binding sites found in untranslated regions of mRNA encoded by GGA3, corresponding to HOST TARGET binding sites such as BINDING SITE I, BINDING SITE II or BINDING SITE III. Table 2 illustrates the complementarity of the nucleotide sequences of GGA3 BINDING SITE1 and GGA3 BINDING SITE2, designated SEQ ID:28902 and SEQ ID:15199 respectively, to the nucleotide sequence of VGAM1283 RNA, herein designated VGAM RNA, also designated SEQ ID:3994.

Another function of VGAM1283 is therefore inhibition of Golgi Associated, Gamma Adaptin Ear Containing, ARF Binding Protein 3 (GGA3, Accession NM_138619), a gene which may play a role in the regulation of membrane traffic through the trans-golgi network. Accordingly, utilities of VGAM1283 include diagnosis, prevention and treatment of diseases and clinical conditions associated with GGA3. The function of GGA3 and its association with various diseases and clinical conditions, has been established by previous studies, as described hereinabove with reference to VGAM353. Interleukin 22 Receptor, Alpha 2 (IL22RA2, Accession NM_052962) is another VGAM1283 host target gene. IL22RA2 BINDING SITE is HOST TARGET binding site found in the 5' untranslated region of mRNA encoded by IL22RA2, corresponding to a HOST TARGET binding site such as BINDING SITE I, BINDING SITE II or BINDING SITE III. Table 2 illustrates the complementarity of the nucleotide sequences of IL22RA2 BINDING SITE, designated SEQ ID:27524, to the nucleotide sequence of VGAM1283 RNA, herein designated VGAM RNA, also designated SEQ ID:3994.

Another function of VGAM1283 is therefore inhibition of Interleukin 22 Receptor, Alpha 2 (IL22RA2, Accession NM_052962), a gene which induces the production of acute-phase reactants. Accordingly, utilities of VGAM1283 include diagnosis, prevention and treatment of diseases and clinical conditions associated with IL22RA2. The function of IL22RA2 and its association with various diseases and clinical conditions, has been established by previous studies, as described hereinabove with reference to VGAM167. Potassium Voltage-gated Channel, Shal-related Subfamily, Member 2 (KCND2, Accession NM_012281) is another VGAM1283 host target gene. KCND2 BINDING SITE is HOST TARGET binding site found in the 5' untranslated region of mRNA encoded by KCND2, corresponding to a HOST TARGET binding site such as BINDING SITE I, BINDING SITE II or BINDING SITE III. Table 2 illustrates the complementarity of the nucleotide sequences of KCND2 BINDING SITE, designated SEQ ID:14612, to the nucleotide sequence of VGAM1283 RNA, herein designated VGAM RNA, also designated SEQ ID:3994.

Another function of VGAM1283 is therefore inhibition of Potassium Voltage-gated Channel, Shal-related Subfamily, Member 2 (KCND2, Accession NM_012281), a gene which is prominent in the repolarization phase of the action potential. Accordingly, utilities of VGAM1283 include diagnosis, prevention and treatment of diseases and clinical conditions associated with KCND2. The function of KCND2 and its association with various diseases and clinical conditions, has been established by previous studies, as described hereinabove with reference to VGAM449. Kelch-like 3 (Drosophila) (KLHL3, Accession XM_113450) is another VGAM1283 host target gene. KLHL3 BINDING SITE is HOST TARGET binding site found in the 3' untranslated region of mRNA encoded by KLHL3, corresponding to a HOST TARGET binding site such as BINDING SITE I, BINDING SITE II or BINDING SITE III. Table 2 illustrates the complementarity of the nucleotide sequences of KLHL3 BINDING SITE, designated SEQ ID:42268, to the nucleotide sequence of VGAM1283 RNA, herein designated VGAM RNA, also designated SEQ ID:3994.

Another function of VGAM1283 is therefore inhibition of Kelch-like 3 (Drosophila) (KLHL3, Accession XM_113450). Accordingly, utilities of VGAM1283 include diagnosis, prevention and treatment of diseases and clinical conditions associated with KLHL3. LIM Domain Only 1 (rhombotin 1) (LMO1, Accession NM_002315) is another VGAM1283 host target gene. LMO1 BINDING SITE is HOST TARGET binding site found in the 5' untranslated region of mRNA encoded by LMO1, corresponding to a HOST TARGET binding site such as BINDING SITE I, BINDING SITE II or BINDING SITE III. Table 2 illustrates the complementarity of the nucleotide sequences of LMO1 BINDING SITE, designated SEQ ID:8128, to the nucleotide sequence of VGAM1283 RNA, herein designated VGAM RNA, also designated SEQ ID:3994.

Another function of VGAM1283 is therefore inhibition of LIM Domain Only 1 (rhombotin 1) (LMO1, Accession NM_002315). Accordingly, utilities of VGAM1283 include diagnosis, prevention and treatment of diseases and clinical conditions associated with LMO1. Lysyl Oxidase-like 2 (LOXL2, Accession NM_002318) is another VGAM1283 host target gene. LOXL2 BINDING SITE is HOST TARGET binding site found in the 3' untranslated region of mRNA encoded by LOXL2, corresponding to a HOST TARGET binding site such as BINDING SITE I, BINDING SITE II or BINDING SITE III. Table 2 illustrates the complementarity of the nucleotide sequences of LOXL2 BINDING SITE, designated SEQ ID:8132, to the nucleotide sequence of VGAM1283 RNA, herein designated VGAM RNA, also designated SEQ ID:3994.

Another function of VGAM1283 is therefore inhibition of Lysyl Oxidase-like 2 (LOXL2, Accession NM_002318), a gene which may have roles in senescence and cell adhesion. Accordingly, utilities of VGAM1283 include diagnosis, prevention and treatment of diseases and clinical conditions associated with LOXL2. The function of LOXL2 and its association with various diseases and clinical conditions, has been established by previous studies, as described hereinabove with reference to VGAM147. Nuclear Receptor Subfamily 2, Group E, Member 1 (NR2E1, Accession NM_003269) is another VGAM1283 host target gene. NR2E1 BINDING SITE is HOST TARGET binding site found in the 5' untranslated region of mRNA encoded by NR2E1, corresponding to a HOST TARGET binding site such as BINDING SITE I, BINDING SITE II or BINDING SITE III. Table 2 illustrates the complementarity of the nucleotide sequences of NR2E1 BINDING SITE, designated SEQ ID:9280, to the nucleotide sequence of VGAM1283 RNA, herein designated VGAM RNA, also designated SEQ ID:3994.

Another function of VGAM1283 is therefore inhibition of Nuclear Receptor Subfamily 2, Group E, Member 1 (NR2E1, Accession NM_003269), a gene which may be required for brain development and be involved in the regulation of retinal development. Accordingly, utilities of VGAM1283 include diagnosis, prevention and treatment of diseases and clinical conditions associated with NR2E1. The function of NR2E1 and its association with various diseases and clinical conditions, has been established by previous studies, as described hereinabove with reference to VGAM689. Phosphodiesterase 4A, CAMP-specific (phosphodiesterase E2 dunce homolog, Drosophila) (PDE4A, Accession NM_006202) is another VGAM1283 host target gene. PDE4A BINDING SITE is HOST TARGET binding site found in the 3' untranslated region of mRNA encoded by PDE4A, corresponding to a HOST TARGET binding site such as BINDING SITE I, BINDING SITE II or BINDING SITE III. Table 2 illustrates the complementarity of the nucleotide sequences of PDE4A BINDING SITE, designated SEQ ID:12877, to the nucleotide sequence of VGAM1283 RNA, herein designated VGAM RNA, also designated SEQ ID:3994.

Another function of VGAM1283 is therefore inhibition of Phosphodiesterase 4A, CAMP-specific (phosphodiesterase E2 dunce homolog, Drosophila) (PDE4A, Accession NM_006202), a gene which is a CAMP-specific phosphodiesterase. Accordingly, utilities of VGAM1283 include diagnosis, prevention and treatment of diseases and clinical conditions associated with PDE4A. The function of PDE4A and its association with various diseases and clinical conditions, has been established by previous studies, as described hereinabove with reference to VGAM1214. Platelet-derived Growth Factor Beta Polypeptide (simian sarcoma viral (v-sis) Oncogene Homolog) (PDGFB, Accession NM_002608) is another VGAM1283 host target gene. PDGFB BINDING SITE is HOST TARGET binding site found in the 3' untranslated region of mRNA encoded by PDGFB, corresponding to a HOST TARGET binding site such as BINDING SITE I, BINDING SITE II or BINDING SITE III. Table 2 illustrates the complementarity of the nucleotide sequences of PDGFB BINDING SITE, designated SEQ ID:8471, to the nucleotide sequence of VGAM1283 RNA, herein designated VGAM RNA, also designated SEQ ID:3994.

Another function of VGAM1283 is therefore inhibition of Platelet-derived Growth Factor Beta Polypeptide (simian sarcoma viral (v-sis) Oncogene Homolog) (PDGFB, Accession NM_002608), a gene which plays an important role in stimulating adjacent cells to grow and thereby heal the wound. Accordingly, utilities of VGAM1283 include diagnosis, prevention and treatment of diseases and clinical conditions associated with PDGFB. The function of PDGFB and its association with various diseases and clinical conditions, has been established by previous studies, as described hereinabove with reference to VGAM173. Protein Phosphatase 2, Regulatory Subunit B (B56), Delta Isoform (PPP2R5D, Accession NM_006245) is another VGAM1283 host target gene. PPP2R5D BINDING SITE is HOST TARGET binding site found in the 3' untranslated region of mRNA encoded by PPP2R5D, corresponding to a HOST TARGET binding site such as BINDING SITE I, BINDING SITE II or BINDING SITE III. Table 2 illustrates the complementarity of the nucleotide sequences of PPP2R5D BINDING SITE, designated SEQ ID:12916, to the nucleotide sequence of VGAM1283 RNA, herein designated VGAM RNA, also designated SEQ ID:3994.

Another function of VGAM1283 is therefore inhibition of Protein Phosphatase 2, Regulatory Subunit B (B56), Delta Isoform (PPP2R5D, Accession NM_006245), a gene which is a regulatory subunit of protein phosphatase 2A. Accordingly, utilities of VGAM1283 include diagnosis, prevention and treatment of diseases and clinical conditions associated with PPP2R5D. The function of PPP2R5D and its association with various diseases and clinical conditions, has been established by previous studies, as described hereinabove with reference to VGAM96. Protein Phosphatase 3 (formerly 2B), Catalytic Subunit, Alpha Isoform (calcineurin A alpha) (PPP3CA, Accession NM_000944) is another VGAM1283 host target gene. PPP3CA BINDING SITE is HOST TARGET binding site found in the 3' untranslated region of mRNA encoded by PPP3CA, corresponding to a HOST TARGET binding site such as BINDING SITE I, BINDING SITE II or BINDING SITE III. Table 2 illustrates the complementarity of the nucleotide sequences of PPP3CA BINDING SITE, designated SEQ ID:6647, to the nucleotide sequence of VGAM1283 RNA, herein designated VGAM RNA, also designated SEQ ID:3994.

Another function of VGAM1283 is therefore inhibition of Protein Phosphatase 3 (formerly 2B), Catalytic Subunit, Alpha Isoform (calcineurin A alpha) (PPP3CA, Accession NM_000944), a gene which is the catalytic subunit of calcium-dependent, calmodulin-stimulated protein phosphatase. Accordingly, utilities of VGAM1283 include diagnosis, prevention and treatment of diseases and clinical conditions associated with PPP3CA. The function of PPP3CA and its association with various diseases and clinical conditions, has been established by previous studies, as described hereinabove with reference to VGAM497. Periaxin (PRX, Accession NM_020956) is another VGAM1283 host target gene. PRX BINDING SITE is HOST TARGET binding site found in the 3' untranslated region of mRNA encoded by PRX, corresponding to a HOST TARGET binding site such as BINDING SITE I, BINDING SITE II or BINDING SITE III. Table 2 illustrates the complementarity of the nucleotide sequences of PRX BINDING SITE, designated SEQ ID:21939, to the nucleotide sequence of VGAM1283 RNA, herein designated VGAM RNA, also designated SEQ ID:3994.

Another function of VGAM1283 is therefore inhibition of Periaxin (PRX, Accession NM_020956), a gene which seems to be required for maintenance of peripheral nerve myelin sheath. may have a role in axon-glial interactions, possibly by interacting with the cytoplasmic domains of integral membrane proteins such as myelin-associated glycoprotein in the periaxonal regions of the schwann cell plasma membrane. may have a role in the early phases of myelin deposition. Accordingly, utilities of VGAM1283 include diagnosis, prevention and treatment of diseases and clinical conditions associated with PRX. The function of PRX and its association with various diseases and clinical conditions, has been established by previous studies, as described hereinabove with reference to VGAM476. Phosphatase and Tensin Homolog (mutated in multiple advanced cancers 1) (PTEN, Accession NM_000314) is another VGAM1283 host target gene. PTEN BINDING SITE is HOST TARGET binding site found in the 5' untranslated region of mRNA encoded by PTEN, corresponding to a HOST TARGET binding site such as BINDING SITE I, BINDING SITE II or BINDING SITE III. Table 2 illustrates the complementarity of the nucleotide sequences of PTEN BINDING SITE, designated SEQ ID:5852, to the nucleotide sequence of VGAM1283 RNA, herein designated VGAM RNA, also designated SEQ ID:3994.

Another function of VGAM1283 is therefore inhibition of Phosphatase and Tensin Homolog (mutated in multiple advanced cancers 1) (PTEN, Accession NM_000314). Accordingly, utilities of VGAM1283 include diagnosis, prevention and treatment of diseases and clinical conditions associated with PTEN. Paxillin (PXN, Accession NM_002859) is another VGAM1283 host target gene. PXN BINDING SITE is HOST TARGET binding site found in the 3' untranslated region of mRNA encoded by PXN, corresponding to a HOST TARGET binding site such as BINDING SITE I, BINDING SITE II or BINDING SITE III. Table 2 illustrates the complementarity of the nucleotide sequences of PXN BINDING SITE, designated SEQ ID:8758, to the nucleotide sequence of VGAM1283 RNA, herein designated VGAM RNA, also designated SEQ ID:3994.

Another function of VGAM1283 is therefore inhibition of Paxillin (PXN, Accession NM_002859), a gene which may be involved in p53-dependent apoptosis. Accordingly, utilities of VGAM1283 include diagnosis, prevention and treatment of diseases and clinical conditions associated with PXN. The function of PXN and its association with various diseases and clinical conditions, has been established by previous studies, as described hereinabove with reference to VGAM132. Retinal G Protein Coupled Receptor (RGR, Accession NM_002921) is another VGAM1283 host target gene. RGR BINDING SITE is HOST TARGET binding site found in the 3' untranslated region of mRNA encoded by RGR, corresponding to a HOST TARGET binding site such as BINDING SITE I, BINDING SITE II or BINDING SITE III. Table 2 illustrates the complementarity of the nucleotide sequences of RGR BINDING SITE, designated SEQ ID:8826, to the nucleotide sequence of VGAM1283 RNA, herein designated VGAM RNA, also designated SEQ ID:3994.

Another function of VGAM1283 is therefore inhibition of Retinal G Protein Coupled Receptor (RGR, Accession NM_002921), a gene which catalyse the isomerization of the chromophore by a retinochrome-like mechanism and act as a receptor for all-trans- and 11-cis-retinal. Accordingly, utilities of VGAM1283 include diagnosis, prevention and treatment of diseases and clinical conditions associated with RGR. The function of RGR has been established by previous studies. Jiang et al. (1993) identified an opsin-related gene that is preferentially expressed at high levels in the RPE and Muller cells of the neural retina. The gene encodes a putative RPE-retinal G protein-coupled receptor (RGR) with 7 transmembrane segments. The putative receptor most closely resembled the subfamily of visual pigments and retinochromes. Shen et al. (1994) found that the amino acid sequence of RGR in human S is 86% identical to that of bovine RGR and that a lysine residue, analogous to the retinaldehyde attachment site of rhodopsin (OMIM Ref. No. 180380), is conserved in the seventh transmembrane domain of RGR in both species. The human gene spans 14.8 kb and is split into 7 exons. The structure of the gene is distinct from that of the visual pigment genes. Shen et al. (1994) suggested that the RGR gene represents the earliest independent branch of the vertebrate opsin gene family. A second form of human RGR in retina was predicted by alternative splicing of its precursor mRNA. This RGR variant resulted from the alternative use of an internal acceptor splice site in the second intron of the human gene, and it contained an insertion of 4 amino acids in the connecting loop between the second and third transmembrane domains Morimura et al. (1999) reported 2 mutations in RGR in patients with photoreceptor degeneration, indicating that RGR is essential to the retina. Using a single-strand conformation technique, Morimura et al. (1999) searched for mutations in the exons and flanking intron sequences of RGR in 182 unrelated patients with dominantly inherited retinitis pigmentosa, 182 with recessive retinitis pigmentosa, 383 with simplex retinitis pigmentosa (sporadic cases), 45 with Leber congenital amaurosis, 28 with retinitis punctata albescens, 22 with choroidal sclerosis, and 93-95 normal controls. One index patient with recessive RP was homozygous for a ser66-to-arg missense mutation (600342.0001). A second patient, originally diagnosed with choroidal sclerosis, was heterozygous for a 1-bp insertion in codon gly275 (GGA-to-GGGA) near the 3-prime end of the coding region (600342.0002). Both affected sibs were heterozygotes and an unaffected sib was homozygous wildtype. The deceased father was said to have been affected, making it likely that the retinal degeneration in this family is dominantly inherited. Morimura et al. (1999) detected no alteration of the other allele in the 2 affected individuals or in unaffected members of this family.

Full details of the abovementioned studies are described in the following publications, the disclosure of which are hereby incorporated by reference:

Mutations in RGR, encoding a light-sensitive opsin homologue, in patients with retinitis pigmentosa. (Letter) Nature Genet. 23:393-394, 1999; and Shen, D.; Jiang, M.; Hao, W.; Tao, L.; Salazar, M.; Fong, H. K. W.: A human opsin-related gene that encodes a retinaldehyde-binding protein. Biochemistry 33:13117-13125, 1994.

Further studies establishing the function and utilities of RGR are found in John Hopkins OMIM database record ID 600342, and in sited publications numbered 8287-8291 listed in the bibliography section hereinbelow, which are also hereby incorporated by reference. Solute Carrier Family 2 (facilitated glucose transporter), Member 1 (SLC2A1, Accession NM_006516) is another VGAM1283 host target gene. SLC2A1 BINDING SITE is HOST TARGET binding site found in the 3' untranslated region of mRNA encoded by SLC2A1, corresponding to a HOST TARGET binding site such as BINDING SITE I, BINDING SITE II or BINDING SITE III. Table 2 illustrates the complementarity of the nucleotide sequences of SLC2A1 BINDING SITE, designated SEQ ID:13265, to the nucleotide sequence of VGAM1283 RNA, herein designated VGAM RNA, also designated SEQ ID:3994.

Another function of VGAM1283 is therefore inhibition of Solute Carrier Family 2 (facilitated glucose transporter), Member 1 (SLC2A1, Accession NM_006516). Accordingly, utilities of VGAM1283 include diagnosis, prevention and treatment of diseases and clinical conditions associated with SLC2A1. Solute Carrier Family 30 (zinc transporter), Member 3 (SLC30A3, Accession NM_003459) is another VGAM1283 host target gene. SLC30A3 BINDING SITE is HOST TARGET binding site found in the 3' untranslated region of mRNA encoded by SLC30A3, corresponding to a HOST TARGET binding site such as BINDING SITE I, BINDING SITE II or BINDING SITE III. Table 2 illustrates the complementarity of the nucleotide sequences of SLC30A3 BINDING SITE, designated SEQ ID:9528, to the nucleotide sequence of VGAM1283 RNA, herein designated VGAM RNA, also designated SEQ ID:3994.

Another function of VGAM1283 is therefore inhibition of Solute Carrier Family 30 (zinc transporter), Member 3 (SLC30A3, Accession NM_003459). Accordingly, utilities of VGAM1283 include diagnosis, prevention and treatment of diseases and clinical conditions associated with SLC30A3. Uncoupling Protein 2 (mitochondrial, proton carrier) (UCP2, Accession NM_003355) is another VGAM1283 host target gene. UCP2 BINDING SITE is HOST TARGET binding site found in the 5' untranslated region of mRNA encoded by UCP2, corresponding to a HOST TARGET binding site such as BINDING SITE I, BINDING SITE II or BINDING SITE III. Table 2 illustrates the complementarity of the nucleotide sequences of UCP2 BINDING SITE, designated SEQ ID:9381, to the nucleotide sequence of VGAM1283 RNA, herein designated VGAM RNA, also designated SEQ ID:3994.

Another function of VGAM1283 is therefore inhibition of Uncoupling Protein 2 (mitochondrial, proton carrier) (UCP2, Accession NM_003355), a gene which is an inner mitochondrial membrane transporter and uncouples electron transport from oxidative phosphorylation. Accordingly, utilities of VGAM1283 include diagnosis, prevention and treatment of diseases and clinical conditions associated with UCP2. The function of UCP2 and its association with various diseases and clinical conditions, has been established by previous studies, as described hereinabove with reference to VGAM1135. Zinc Finger Protein 175 (ZNF175, Accession NM_007147) is another VGAM1283 host target gene. ZNF175 BINDING SITE is HOST TARGET binding site found in the 3' untranslated region of mRNA encoded by ZNF175, corresponding to a HOST TARGET binding site such as BINDING SITE I, BINDING SITE II or BINDING SITE III. Table 2 illustrates the complementarity of the nucleotide sequences of ZNF175 BINDING SITE, designated SEQ ID:13999, to the nucleotide sequence of VGAM1283 RNA, herein designated VGAM RNA, also designated SEQ ID:3994.

Another function of VGAM1283 is therefore inhibition of Zinc Finger Protein 175 (ZNF175, Accession NM_007147). Accordingly, utilities of VGAM1283 include diagnosis, prevention and treatment of diseases and clinical conditions associated with ZNF175. A Kinase (PRKA) Anchor Protein 11 (AKAP11, Accession NM_016248) is another VGAM1283 host target gene. AKAP11 BINDING SITE is HOST TARGET binding site found in the 3' untranslated region of mRNA encoded by AKAP11, corresponding to a HOST TARGET binding site such as BINDING SITE I, BINDING SITE II or BINDING SITE III. Table 2 illustrates the complementarity of the nucleotide sequences of AKAP11 BINDING SITE, designated SEQ ID:18368, to the nucleotide sequence of VGAM1283 RNA, herein designated VGAM RNA, also designated SEQ ID:3994.

Another function of VGAM1283 is therefore inhibition of A Kinase (PRKA) Anchor Protein 11 (AKAP11, Accession NM_016248). Accordingly, utilities of VGAM1283 include diagnosis, prevention and treatment of diseases and clinical conditions associated with AKAP11. ARP5 (Accession XM_049490) is another VGAM1283 host target gene. ARP5 BINDING SITE is HOST TARGET binding site found in the 5' untranslated region of mRNA encoded by ARP5, corresponding to a HOST TARGET binding site such as BINDING SITE I, BINDING SITE II or BINDING SITE III. Table 2 illustrates the complementarity of the nucleotide sequences of ARP5 BINDING SITE, designated SEQ ID:35440, to the nucleotide sequence of VGAM1283 RNA, herein designated VGAM RNA, also designated SEQ ID:3994.

Another function of VGAM1283 is therefore inhibition of ARP5 (Accession XM_049490). Accordingly, utilities of VGAM1283 include diagnosis, prevention and treatment of diseases and clinical conditions associated with ARP5. BCAA (Accession NM_016374) is another VGAM1283 host target gene. BCAA BINDING SITE is HOST TARGET binding site found in the 5' untranslated region of mRNA encoded by BCAA, corresponding to a HOST TARGET binding site such as BINDING SITE I, BINDING SITE II or BINDING SITE III. Table 2 illustrates the complementarity of the nucleotide sequences of BCAA BINDING SITE, designated SEQ ID:18512, to the nucleotide sequence of VGAM1283 RNA, herein designated VGAM RNA, also designated SEQ ID:3994.

Another function of VGAM1283 is therefore inhibition of BCAA (Accession NM_016374). Accordingly, utilities of VGAM1283 include diagnosis, prevention and treatment of diseases and clinical conditions associated with BCAA. Chromosome 17 Open Reading Frame 31 (C17orf31, Accession NM_017575) is another VGAM1283 host target gene. C17orf31 BINDING SITE is HOST TARGET binding site found in the 5' untranslated region of mRNA encoded by C17orf31, corresponding to a HOST TARGET binding site such as BINDING SITE I, BINDING SITE II or BINDING SITE III. Table 2 illustrates the complementarity of the nucleotide sequences of C17orf31 BINDING SITE, designated SEQ ID:19009, to the nucleotide sequence of VGAM1283 RNA, herein designated VGAM RNA, also designated SEQ ID:3994.

Another function of VGAM1283 is therefore inhibition of Chromosome 17 Open Reading Frame 31 (C17orf31, Accession NM_017575). Accordingly, utilities of VGAM1283 include diagnosis, prevention and treatment of diseases and clinical conditions associated with C17orf31. Chromosome 1 Open Reading Frame 16 (C1orf16, Accession NM_014837) is another VGAM1283 host target gene. C1orf16 BINDING SITE is HOST TARGET binding site found in the 3' untranslated region of mRNA encoded by C1orf16, corresponding to a HOST TARGET binding site such as BINDING SITE I, BINDING SITE II or BINDING SITE III. Table 2 illustrates the complementarity of the nucleotide sequences of C1orf16 BINDING SITE, designated SEQ ID:16859, to the nucleotide sequence of VGAM1283 RNA, herein designated VGAM RNA, also designated SEQ ID:3994.

Another function of VGAM1283 is therefore inhibition of Chromosome 1 Open Reading Frame 16 (C1orf16, Accession NM_014837). Accordingly, utilities of VGAM1283 include diagnosis, prevention and treatment of diseases and clinical conditions associated with C1orf16. Chromosome 1 Open Reading Frame 24 (C1orf24, Accession NM_052966) is another VGAM1283 host target gene. C1orf24 BINDING SITE is HOST TARGET binding site found in the 3' untranslated region of mRNA encoded by C1orf24, corresponding to a HOST TARGET binding site such as BINDING SITE I, BINDING SITE II or BINDING SITE III. Table 2 illustrates the complementarity of the nucleotide sequences of C1orf24 BINDING SITE, designated SEQ ID:27537, to the nucleotide sequence of VGAM1283 RNA, herein designated VGAM RNA, also designated SEQ ID:3994.

Another function of VGAM1283 is therefore inhibition of Chromosome 1 Open Reading Frame 24 (C1orf24, Accession NM_052966). Accordingly, utilities of VGAM1283 include diagnosis, prevention and treatment of diseases and clinical conditions associated with C1orf24. Chromosome 9 Open Reading Frame 5 (C9orf5, Accession NM_032012) is another VGAM1283 host target gene. C9orf5 BINDING SITE is HOST TARGET binding site found in the 3' untranslated region of mRNA encoded by C9orf5, corresponding to a HOST TARGET binding site such as BINDING SITE I, BINDING SITE II or BINDING SITE III. Table 2 illustrates the complementarity of the nucleotide sequences of C9orf5 BINDING SITE, designated SEQ ID:25718, to the nucleotide sequence of VGAM1283 RNA, herein designated VGAM RNA, also designated SEQ ID:3994.

Another function of VGAM1283 is therefore inhibition of Chromosome 9 Open Reading Frame 5 (C9orf5, Accession NM_032012). Accordingly, utilities of VGAM1283 include diagnosis, prevention and treatment of diseases and clinical conditions associated with C9orf5. C-type (calcium dependent, carbohydrate-recognition domain) Lectin, Superfamily Member 9 (CLECSF9, Accession NM_014358) is another VGAM1283 host target gene. CLECSF9 BINDING SITE is HOST TARGET binding site found in the 3' untranslated region of mRNA encoded by CLECSF9, corresponding to a HOST TARGET binding site such as BINDING SITE I, BINDING SITE II or BINDING SITE III. Table 2 illustrates the complementarity of the nucleotide sequences of CLECSF9 BINDING SITE, designated SEQ ID:15690, to the nucleotide sequence of VGAM1283 RNA, herein designated VGAM RNA, also designated SEQ ID:3994.

Another function of VGAM1283 is therefore inhibition of C-type (calcium dependent, carbohydrate-recognition domain) Lectin, Superfamily Member 9 (CLECSF9, Accession NM_014358). Accordingly, utilities of VGAM1283 include diagnosis, prevention and treatment of diseases and clinical conditions associated with CLECSF9. Cyclin M1 (CNNM1, Accession NM_020348) is another VGAM1283 host target gene. CNNM1 BINDING SITE is HOST TARGET binding site found in the 3' untranslated region of mRNA encoded by CNNM1, corresponding to a HOST TARGET binding site such as BINDING SITE I, BINDING SITE II or BINDING SITE III. Table 2 illustrates the complementarity of the nucleotide sequences of CNNM1 BINDING SITE, designated SEQ ID:21611, to the nucleotide sequence of VGAM1283 RNA, herein designated VGAM RNA, also designated SEQ ID:3994.

Another function of VGAM1283 is therefore inhibition of Cyclin M1 (CNNM1, Accession NM_020348). Accordingly, utilities of VGAM1283 include diagnosis, prevention and treatment of diseases and clinical conditions associated with CNNM1. DKFZP564C103 (Accession NM_015654) is another VGAM1283 host target gene. DKFZP564C103 BINDING SITE is HOST TARGET binding site found in the 3' untranslated region of mRNA encoded by DKFZP564C103, corresponding to a HOST TARGET binding site such as BINDING SITE I, BINDING SITE II or BINDING SITE III. Table 2 illustrates the complementarity of the nucleotide sequences of DKFZP564C103 BINDING SITE, designated SEQ ID:17902, to the nucleotide sequence of VGAM1283 RNA, herein designated VGAM RNA, also designated SEQ ID:3994.

Another function of VGAM1283 is therefore inhibition of DKFZP564C103 (Accession NM_015654). Accordingly, utilities of VGAM1283 include diagnosis, prevention and treatment of diseases and clinical conditions associated with DKFZP564C103. DKFZP586I2223 (Accession NM_015438) is another VGAM1283 host target gene. DKFZP586I2223 BINDING SITE1 through DKFZP586I2223 BINDING SITE3 are HOST TARGET binding sites found in untranslated regions of mRNA encoded by DKFZP586I2223, corresponding to HOST TARGET binding sites such as BINDING SITE I, BINDING SITE II or BINDING SITE III. Table 2 illustrates the complementarity of the nucleotide sequences of DKFZP586I2223 BINDING SITE1 through DKFZP586I2223 BINDING SITE3, designated SEQ ID:17734, SEQ ID:28018 and SEQ ID:28020 respectively, to the nucleotide sequence of VGAM1283 RNA, herein designated VGAM RNA, also designated SEQ ID:3994.

Another function of VGAM1283 is therefore inhibition of DKFZP586I2223 (Accession NM_015438). Accordingly, utilities of VGAM1283 include diagnosis, prevention and treatment of diseases and clinical conditions associated with DKFZP586I2223. Fidgetin (FIGN, Accession XM_171005) is another VGAM1283 host target gene. FIGN BINDING SITE is HOST TARGET binding site found in the 3' untranslated region of mRNA encoded by FIGN, corresponding to a HOST TARGET binding site such as BINDING SITE I, BINDING SITE II or BINDING SITE III. Table 2 illustrates the complementarity of the nucleotide sequences of FIGN BINDING SITE, designated SEQ ID:45776, to the nucleotide sequence of VGAM1283 RNA, herein designated VGAM RNA, also designated SEQ ID:3994.

Another function of VGAM1283 is therefore inhibition of Fidgetin (FIGN, Accession XM_171005). Accordingly, utilities of VGAM1283 include diagnosis, prevention and treatment of diseases and clinical conditions associated with FIGN. FLJ10139 (Accession NM_018005) is another VGAM1283 host target gene. FLJ10139 BINDING SITE is HOST TARGET binding site found in the 3' untranslated region of mRNA encoded by FLJ10139, corresponding to a HOST TARGET binding site such as BINDING SITE I, BINDING SITE II or BINDING SITE III. Table 2 illustrates the complementarity of the nucleotide sequences of FLJ10139 BINDING SITE, designated SEQ ID:19735, to the nucleotide sequence of VGAM1283 RNA, herein designated VGAM RNA, also designated SEQ ID:3994.

Another function of VGAM1283 is therefore inhibition of FLJ10139 (Accession NM_018005). Accordingly, utilities of VGAM1283 include diagnosis, prevention and treatment of diseases and clinical conditions associated with FLJ10139. FLJ12704 (Accession NM_024998) is another VGAM1283 host target gene. FLJ12704 BINDING SITE1 and FLJ12704

BINDING SITE2 are HOST TARGET binding sites found in untranslated regions of mRNA encoded by FLJ12704, corresponding to HOST TARGET binding sites such as BINDING SITE I, BINDING SITE II or BINDING SITE III. Table 2 illustrates the complementarity of the nucleotide sequences of FLJ12704 BINDING SITE1 and FLJ12704 BINDING SITE2, designated SEQ ID:24564 and SEQ ID:24566 respectively, to the nucleotide sequence of VGAM1283 RNA, herein designated VGAM RNA, also designated SEQ ID:3994.

Another function of VGAM1283 is therefore inhibition of FLJ12704 (Accession NM_024998). Accordingly, utilities of VGAM1283 include diagnosis, prevention and treatment of diseases and clinical conditions associated with FLJ12704. FLJ14213 (Accession NM_024841) is another VGAM1283 host target gene. FLJ14213 BINDING SITE1 and FLJ14213 BINDING SITE2 are HOST TARGET binding sites found in untranslated regions of mRNA encoded by FLJ14213, corresponding to HOST TARGET binding sites such as BINDING SITE I, BINDING SITE II or BINDING SITE III. Table 2 illustrates the complementarity of the nucleotide sequences of FLJ14213 BINDING SITE1 and FLJ14213 BINDING SITE2, designated SEQ ID:24252 and SEQ ID:24253 respectively, to the nucleotide sequence of VGAM1283 RNA, herein designated VGAM RNA, also designated SEQ ID:3994.

Another function of VGAM1283 is therefore inhibition of FLJ14213 (Accession NM_024841). Accordingly, utilities of VGAM1283 include diagnosis, prevention and treatment of diseases and clinical conditions associated with FLJ14213. FLJ14768 (Accession NM_032836) is another VGAM1283 host target gene. FLJ14768 BINDING SITE is HOST TARGET binding site found in the 3' untranslated region of mRNA encoded by FLJ14768, corresponding to a HOST TARGET binding site such as BINDING SITE I, BINDING SITE II or BINDING SITE III. Table 2 illustrates the complementarity of the nucleotide sequences of FLJ14768 BINDING SITE, designated SEQ ID:26615, to the nucleotide sequence of VGAM1283 RNA, herein designated VGAM RNA, also designated SEQ ID:3994.

Another function of VGAM1283 is therefore inhibition of FLJ14768 (Accession NM_032836). Accordingly, utilities of VGAM1283 include diagnosis, prevention and treatment of diseases and clinical conditions associated with FLJ14768. FLJ20281 (Accession XM_165663) is another VGAM1283 host target gene. FLJ20281 BINDING SITE is HOST TARGET binding site found in the 5' untranslated region of mRNA encoded by FLJ20281, corresponding to a HOST TARGET binding site such as BINDING SITE I, BINDING SITE II or BINDING SITE III. Table 2 illustrates the complementarity of the nucleotide sequences of FLJ20281 BINDING SITE, designated SEQ ID:43725, to the nucleotide sequence of VGAM1283 RNA, herein designated VGAM RNA, also designated SEQ ID:3994.

Another function of VGAM1283 is therefore inhibition of FLJ20281 (Accession XM_165663). Accordingly, utilities of VGAM1283 include diagnosis, prevention and treatment of diseases and clinical conditions associated with FLJ20281. FLJ20802 (Accession NM_017959) is another VGAM1283 host target gene. FLJ20802 BINDING SITE is HOST TARGET binding site found in the 3' untranslated region of mRNA encoded by FLJ20802, corresponding to a HOST TARGET binding site such as BINDING SITE I, BINDING SITE II or BINDING SITE III. Table 2 illustrates the complementarity of the nucleotide sequences of FLJ20802 BINDING SITE, designated SEQ ID:19675, to the nucleotide sequence of VGAM1283 RNA, herein designated VGAM RNA, also designated SEQ ID:3994.

Another function of VGAM1283 is therefore inhibition of FLJ20802 (Accession NM_017959). Accordingly, utilities of VGAM1283 include diagnosis, prevention and treatment of diseases and clinical conditions associated with FLJ20802. FLJ22215 (Accession XM_173021) is another VGAM1283 host target gene. FLJ22215 BINDING SITE is HOST TARGET binding site found in the 3' untranslated region of mRNA encoded by FLJ22215, corresponding to a HOST TARGET binding site such as BINDING SITE I, BINDING SITE II or BINDING SITE III. Table 2 illustrates the complementarity of the nucleotide sequences of FLJ22215 BINDING SITE, designated SEQ ID:46283, to the nucleotide sequence of VGAM1283 RNA, herein designated VGAM RNA, also designated SEQ ID:3994.

Another function of VGAM1283 is therefore inhibition of FLJ22215 (Accession XM_173021). Accordingly, utilities of VGAM1283 include diagnosis, prevention and treatment of diseases and clinical conditions associated with FLJ22215. Glucocorticoid Induced Transcript 1 (GLCCI1, Accession XM_166529) is another VGAM1283 host target gene. GLCCI1 BINDING SITE is HOST TARGET binding site found in the 5' untranslated region of mRNA encoded by GLCCI1, corresponding to a HOST TARGET binding site such as BINDING SITE I, BINDING SITE II or BINDING SITE III. Table 2 illustrates the complementarity of the nucleotide sequences of GLCCI1 BINDING SITE, designated SEQ ID:44480, to the nucleotide sequence of VGAM1283 RNA, herein designated VGAM RNA, also designated SEQ ID:3994.

Another function of VGAM1283 is therefore inhibition of Glucocorticoid Induced Transcript 1 (GLCCI1, Accession XM_166529). Accordingly, utilities of VGAM1283 include diagnosis, prevention and treatment of diseases and clinical conditions associated with GLCCI1. Glycoprotein A33 (transmembrane) (GPA33, Accession NM_005814) is another VGAM1283 host target gene. GPA33 BINDING SITE is HOST TARGET binding site found in the 3' untranslated region of mRNA encoded by GPA33, corresponding to a HOST TARGET binding site such as BINDING SITE I, BINDING SITE II or BINDING SITE III. Table 2 illustrates the complementarity of the nucleotide sequences of GPA33 BINDING SITE, designated SEQ ID:12407, to the nucleotide sequence of VGAM1283 RNA, herein designated VGAM RNA, also designated SEQ ID:3994.

Another function of VGAM1283 is therefore inhibition of Glycoprotein A33 (transmembrane) (GPA33, Accession NM_005814). Accordingly, utilities of VGAM1283 include diagnosis, prevention and treatment of diseases and clinical conditions associated with GPA33. Hippocalcin Like 4 (HPCAL4, Accession NM_016257) is another VGAM1283 host target gene. HPCAL4 BINDING SITE is HOST TARGET binding site found in the 3' untranslated region of mRNA encoded by HPCAL4, corresponding to a HOST TARGET binding site such as BINDING SITE I, BINDING SITE II or BINDING SITE III. Table 2 illustrates the complementarity of the nucleotide sequences of HPCAL4 BINDING SITE, designated SEQ ID:18388, to the nucleotide sequence of VGAM1283 RNA, herein designated VGAM RNA, also designated SEQ ID:3994.

Another function of VGAM1283 is therefore inhibition of Hippocalcin Like 4 (HPCAL4, Accession NM_016257). Accordingly, utilities of VGAM1283 include diagnosis, prevention and treatment of diseases and clinical conditions associated with HPCAL4. KIAA0268 (Accession XM_046126) is another VGAM1283 host target gene.

KIAA0268 BINDING SITE is HOST TARGET binding site found in the 3' untranslated region of mRNA encoded by KIAA0268, corresponding to a HOST TARGET binding site such as BINDING SITE I, BINDING SITE II or BINDING SITE III. Table 2 illustrates the complementarity of the nucleotide sequences of KIAA0268 BINDING SITE, designated SEQ ID:34685, to the nucleotide sequence of VGAM1283 RNA, herein designated VGAM RNA, also designated SEQ ID:3994.

Another function of VGAM1283 is therefore inhibition of KIAA0268 (Accession XM_046126). Accordingly, utilities of VGAM1283 include diagnosis, prevention and treatment of diseases and clinical conditions associated with KIAA0268. KIAA0523 (Accession XM_041964) is another VGAM1283 host target gene. KIAA0523 BINDING SITE is HOST TARGET binding site found in the 3' untranslated region of mRNA encoded by KIAA0523, corresponding to a HOST TARGET binding site such as BINDING SITE I, BINDING SITE II or BINDING SITE III. Table 2 illustrates the complementarity of the nucleotide sequences of KIAA0523 BINDING SITE, designated SEQ ID:33639, to the nucleotide sequence of VGAM1283 RNA, herein designated VGAM RNA, also designated SEQ ID:3994.

Another function of VGAM1283 is therefore inhibition of KIAA0523 (Accession XM_041964). Accordingly, utilities of VGAM1283 include diagnosis, prevention and treatment of diseases and clinical conditions associated with KIAA0523. KIAA0939 (Accession XM_030524) is another VGAM1283 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31058, to the nucleotide sequence of VGAM1283 RNA, herein designated VGAM RNA, also designated SEQ ID:3994.

Another function of VGAM1283 is therefore inhibition of KIAA0939 (Accession XM_030524). Accordingly, utilities of VGAM1283 include diagnosis, prevention and treatment of diseases and clinical conditions associated with KIAA0939. KIAA0953 (Accession XM_039733) is another VGAM1283 host target gene. KIAA0953 BINDING SITE is HOST TARGET binding site found in the 3' untranslated region of mRNA encoded by KIAA0953, corresponding to a HOST TARGET binding site such as BINDING SITE I, BINDING SITE II or BINDING SITE III. Table 2 illustrates the complementarity of the nucleotide sequences of KIAA0953 BINDING SITE, designated SEQ ID:33172, to the nucleotide sequence of VGAM1283 RNA, herein designated VGAM RNA, also designated SEQ ID:3994.

Another function of VGAM1283 is therefore inhibition of KIAA0953 (Accession XM_039733). Accordingly, utilities of VGAM1283 include diagnosis, prevention and treatment of diseases and clinical conditions associated with KIAA0953. KIAA1280 (Accession XM_045766) is another VGAM1283 host target gene. KIAA1280 BINDING SITE is HOST TARGET binding site found in the 5' untranslated region of mRNA encoded by KIAA1280, corresponding to a HOST TARGET binding site such as BINDING SITE I, BINDING SITE II or BINDING SITE III. Table 2 illustrates the complementarity of the nucleotide sequences of KIAA1280 BINDING SITE, designated SEQ ID:34556, to the nucleotide sequence of VGAM1283 RNA, herein designated VGAM RNA, also designated SEQ ID:3994.

Another function of VGAM1283 is therefore inhibition of KIAA1280 (Accession XM_045766). Accordingly, utilities of VGAM1283 include diagnosis, prevention and treatment of diseases and clinical conditions associated with KIAA1280. KIAA1301 (Accession XM_038999) is another VGAM1283 host target gene. KIAA1301 BINDING SITE is HOST TARGET binding site found in the 3' untranslated region of mRNA encoded by KIAA1301, corresponding to a HOST TARGET binding site such as BINDING SITE I, BINDING SITE II or BINDING SITE III. Table 2 illustrates the complementarity of the nucleotide sequences of KIAA1301 BINDING SITE, designated SEQ ID:32980, to the nucleotide sequence of VGAM1283 RNA, herein designated VGAM RNA, also designated SEQ ID:3994.

Another function of VGAM1283 is therefore inhibition of KIAA1301 (Accession XM_038999). Accordingly, utilities of VGAM1283 include diagnosis, prevention and treatment of diseases and clinical conditions associated with KIAA1301. KIAA1363 (Accession XM_045056) is another VGAM1283 host target gene. KIAA1363 BINDING SITE is HOST TARGET binding site found in the 3' untranslated region of mRNA encoded by KIAA1363, corresponding to a HOST TARGET binding site such as BINDING SITE I, BINDING SITE II or BINDING SITE III. Table 2 illustrates the complementarity of the nucleotide sequences of KIAA1363 BINDING SITE, designated SEQ ID:34336, to the nucleotide sequence of VGAM1283 RNA, herein designated VGAM RNA, also designated SEQ ID:3994.

Another function of VGAM1283 is therefore inhibition of KIAA1363 (Accession XM_045056). Accordingly, utilities of VGAM1283 include diagnosis, prevention and treatment of diseases and clinical conditions associated with KIAA1363. KIAA1655 (Accession XM_039442) is another VGAM1283 host target gene. KIAA1655 BINDING SITE is HOST TARGET binding site found in the 3' untranslated region of mRNA encoded by KIAA1655, corresponding to a HOST TARGET binding site such as BINDING SITE I, BINDING SITE II or BINDING SITE III. Table 2 illustrates the complementarity of the nucleotide sequences of KIAA1655 BINDING SITE, designated SEQ ID:33093, to the nucleotide sequence of VGAM1283 RNA, herein designated VGAM RNA, also designated SEQ ID:3994.

Another function of VGAM1283 is therefore inhibition of KIAA1655 (Accession XM_039442). Accordingly, utilities of VGAM1283 include diagnosis, prevention and treatment of diseases and clinical conditions associated with KIAA1655. KIAA1879 (Accession XM_056635) is another VGAM1283 host target gene. KIAA1879 BINDING SITE is HOST TARGET binding site found in the 5' untranslated region of mRNA encoded by KIAA1879, corresponding to a HOST TARGET binding site such as BINDING SITE I, BINDING SITE II or BINDING SITE III. Table 2 illustrates the complementarity of the nucleotide sequences of KIAA1879 BINDING SITE, designated SEQ ID:36417, to the nucleotide sequence of VGAM1283 RNA, herein designated VGAM RNA, also designated SEQ ID:3994.

Another function of VGAM1283 is therefore inhibition of KIAA1879 (Accession XM_056635). Accordingly, utilities of VGAM1283 include diagnosis, prevention and treatment of diseases and clinical conditions associated with KIAA1879. LIM and SH3 Protein 1 (LASP1, Accession NM_006148) is another VGAM1283 host target gene. LASP1 BINDING SITE is HOST TARGET binding site found in the 3' untranslated region of mRNA encoded by LASP1, corresponding to a HOST TARGET binding site such as BINDING SITE I, BINDING SITE II or BINDING SITE III. Table 2 illustrates the complementarity of the nucleotide sequences of LASP1 BINDING SITE, designated SEQ ID:12791, to the nucleotide sequence of VGAM1283 RNA, herein designated VGAM RNA, also designated SEQ ID:3994.

Another function of VGAM1283 is therefore inhibition of LIM and SH3 Protein 1 (LASP1, Accession NM_006148). Accordingly, utilities of VGAM1283 include diagnosis, prevention and treatment of diseases and clinical conditions associated with LASP1. MGC10960 (Accession NM_032653) is another VGAM1283 host target gene. MGC10960 BINDING SITE is HOST TARGET binding site found in the 3' untranslated region of mRNA encoded by MGC10960, corresponding to a HOST TARGET binding site such as BINDING SITE I, BINDING SITE II or BINDING SITE III. Table 2 illustrates the complementarity of the nucleotide sequences of MGC10960 BINDING SITE, designated SEQ ID:26381, to the nucleotide sequence of VGAM1283 RNA, herein designated VGAM RNA, also designated SEQ ID:3994.

Another function of VGAM1283 is therefore inhibition of MGC10960 (Accession NM_032653). Accordingly, utilities of VGAM1283 include diagnosis, prevention and treatment of diseases and clinical conditions associated with MGC10960. MGC12760 (Accession NM_032723) is another VGAM1283 host target gene. MGC12760 BINDING SITE is HOST TARGET binding site found in the 3' untranslated region of mRNA encoded by MGC12760, corresponding to a HOST TARGET binding site such as BINDING SITE I, BINDING SITE II or BINDING SITE III. Table 2 illustrates the complementarity of the nucleotide sequences of MGC12760 BINDING SITE, designated SEQ ID:26449, to the nucleotide sequence of VGAM1283 RNA, herein designated VGAM RNA, also designated SEQ ID:3994.

Another function of VGAM1283 is therefore inhibition of MGC12760 (Accession NM_032723). Accordingly, utilities of VGAM1283 include diagnosis, prevention and treatment of diseases and clinical conditions associated with MGC12760. MGC5139 (Accession XM_058587) is another VGAM1283 host target gene. MGC5139 BINDING SITE is HOST TARGET binding site found in the 5' untranslated region of mRNA encoded by MGC5139, corresponding to a HOST TARGET binding site such as BINDING SITE I, BINDING SITE II or BINDING SITE III. Table 2 illustrates the complementarity of the nucleotide sequences of MGC5139 BINDING SITE, designated SEQ ID:36675, to the nucleotide sequence of VGAM1283 RNA, herein designated VGAM RNA, also designated SEQ ID:3994.

Another function of VGAM1283 is therefore inhibition of MGC5139 (Accession XM_058587). Accordingly, utilities of VGAM1283 include diagnosis, prevention and treatment of diseases and clinical conditions associated with MGC5139. NIBAN (Accession NM_022083) is another VGAM1283 host target gene. NIBAN BINDING SITE is HOST TARGET binding site found in the 3' untranslated region of mRNA encoded by NIBAN, corresponding to a HOST TARGET binding site such as BINDING SITE I, BINDING SITE II or BINDING SITE III. Table 2 illustrates the complementarity of the nucleotide sequences of NIBAN BINDING SITE, designated SEQ ID:22632, to the nucleotide sequence of VGAM1283 RNA, herein designated VGAM RNA, also designated SEQ ID:3994.

Another function of VGAM1283 is therefore inhibition of NIBAN (Accession NM_022083). Accordingly, utilities of VGAM1283 include diagnosis, prevention and treatment of diseases and clinical conditions associated with NIBAN. NSG-X (Accession NM_014411) is another VGAM1283 host target gene. NSG-X BINDING SITE is HOST TARGET binding site found in the 3' untranslated region of mRNA encoded by NSG-X, corresponding to a HOST TARGET binding site such as BINDING SITE I, BINDING SITE II or BINDING SITE III. Table 2 illustrates the complementarity of the nucleotide sequences of NSG-X BINDING SITE, designated SEQ ID:15755, to the nucleotide sequence of VGAM1283 RNA, herein designated VGAM RNA, also designated SEQ ID:3994.

Another function of VGAM1283 is therefore inhibition of NSG-X (Accession NM_014411). Accordingly, utilities of VGAM1283 include diagnosis, prevention and treatment of diseases and clinical conditions associated with NSG-X. Nucleoredoxin (NXN, Accession NM_022463) is another VGAM1283 host target gene. NXN BINDING SITE is HOST TARGET binding site found in the 3" untranslated region of mRNA encoded by NXN, corresponding to a HOST TARGET binding site such as BINDING SITE I, BINDING SITE II or BINDING SITE III. Table 2 illustrates the complementarity of the nucleotide sequences of NXN BINDING SITE, designated SEQ ID:22806, to the nucleotide sequence of VGAM1283 RNA, herein designated VGAM RNA, also designated SEQ ID:3994.

Another function of VGAM1283 is therefore inhibition of Nucleoredoxin (NXN, Accession NM_022463). Accordingly, utilities of VGAM1283 include diagnosis, prevention and treatment of diseases and clinical conditions associated with NXN. poly (rC) Binding Protein 3 (PCBP3, Accession NM_020528) is another VGAM1283 host target gene. PCBP3 BINDING SITE is HOST TARGET binding site found in the 3' untranslated region of mRNA encoded by PCBP3, corresponding to a HOST TARGET binding site such as BINDING SITE I, BINDING SITE II or BINDING SITE III. Table 2 illustrates the complementarity of the nucleotide sequences of PCBP3 BINDING SITE, designated SEQ ID:21752, to the nucleotide sequence of VGAM1283 RNA, herein designated VGAM RNA, also designated SEQ ID:3994.

Another function of VGAM1283 is therefore inhibition of poly (rC) Binding Protein 3 (PCBP3, Accession NM_020528). Accordingly, utilities of VGAM1283 include diagnosis, prevention and treatment of diseases and clinical conditions associated with PCBP3. PI4KII (Accession NM_018425) is another VGAM1283 host target gene. PI4KII BINDING SITE is HOST TARGET binding site found in the 3' untranslated region of mRNA encoded by PI4KII, corresponding to a HOST TARGET binding site such as BINDING SITE I, BINDING SITE II or BINDING SITE III. Table 2 illustrates the complementarity of the nucleotide sequences of PI4KII BINDING SITE, designated SEQ ID:20484, to the nucleotide sequence of VGAM1283 RNA, herein designated VGAM RNA, also designated SEQ ID:3994.

Another function of VGAM1283 is therefore inhibition of PI4KII (Accession NM_018425). Accordingly, utilities of VGAM1283 include diagnosis, prevention and treatment of diseases and clinical conditions associated with PI4KII. PRO0659 (Accession NM_014138) is another VGAM1283 host target gene. PRO0659 BINDING SITE is HOST TARGET binding site found in the 3' untranslated region of mRNA encoded by PRO0659, corresponding to a HOST TARGET binding site such as BINDING SITE I, BINDING SITE II or BINDING SITE III. Table 2 illustrates the complementarity of the nucleotide sequences of PRO0659 BINDING SITE, designated SEQ ID:15405, to the nucleotide sequence of VGAM1283 RNA, herein designated VGAM RNA, also designated SEQ ID:3994.

Another function of VGAM1283 is therefore inhibition of PRO0659 (Accession NM_014138). Accordingly, utilities of VGAM1283 include diagnosis, prevention and treatment of diseases and clinical conditions associated with PRO0659.

Protein Tyrosine Phosphatase, Receptor Type, N Polypeptide 2 (PTPRN2, Accession NM_130842) is another VGAM1283 host target gene. PTPRN2 BINDING SITE1 and PTPRN2 BINDING SITE2 are HOST TARGET binding sites found in untranslated regions of mRNA encoded by PTPRN2, corresponding to HOST TARGET binding sites such as BINDING SITE I, BINDING SITE II or BINDING SITE III. Table 2 illustrates the complementarity of the nucleotide sequences of PTPRN2 BINDING SITE1 and PTPRN2 BINDING SITE2, designated SEQ ID:28367 and SEQ ID:28372 respectively, to the nucleotide sequence of VGAM1283 RNA, herein designated VGAM RNA, also designated SEQ ID:3994.

Another function of VGAM1283 is therefore inhibition of Protein Tyrosine Phosphatase, Receptor Type, N Polypeptide 2 (PTPRN2, Accession NM_130842). Accordingly, utilities of VGAM1283 include diagnosis, prevention and treatment of diseases and clinical conditions associated with PTPRN2. Sialyltransferase 9 (CMP-NeuAc:lactosylceramide alpha-2, 3-sialyl transferase; GM3 synthase) (SIAT9, Accession NM_003896) is another VGAM1283 host target gene. SIAT9 BINDING SITE is HOST TARGET binding site found in the 3' untranslated region of mRNA encoded by SIAT9, corresponding to a HOST TARGET binding site such as BINDING SITE I, BINDING SITE II or BINDING SITE III. Table 2 illustrates the complementarity of the nucleotide sequences of SIAT9 BINDING SITE, designated SEQ ID:9979, to the nucleotide sequence of VGAM1283 RNA, herein designated VGAM RNA, also designated SEQ ID:3994.

Another function of VGAM1283 is therefore inhibition of Sialyltransferase 9 (CMP-NeuAc:lactosylceramide alpha-2, 3-sialyl transferase; GM3 synthase) (SIAT9, Accession NM_003896). Accordingly, utilities of VGAM1283 include diagnosis, prevention and treatment of diseases and clinical conditions associated with SIAT9. Tigger Transposable Element Derived 1 (TIGD1, Accession XM_114293) is another VGAM1283 host target gene. TIGD1 BINDING SITE is HOST TARGET binding site found in the 5' untranslated region of mRNA encoded by TIGD1, corresponding to a HOST TARGET binding site such as BINDING SITE I, BINDING SITE II or BINDING SITE III. Table 2 illustrates the complementarity of the nucleotide sequences of TIGD1 BINDING SITE, designated SEQ ID:42847, to the nucleotide sequence of VGAM1283 RNA, herein designated VGAM RNA, also designated SEQ ID:3994.

Another function of VGAM1283 is therefore inhibition of Tigger Transposable Element Derived 1 (TIGD1, Accession XM_114293). Accordingly, utilities of VGAM1283 include diagnosis, prevention and treatment of diseases and clinical conditions associated with TIGD1. WD Repeat Domain 9 (WDR9, Accession NM_033656) is another VGAM1283 host target gene. WDR9 BINDING SITE is HOST TARGET binding site found in the 3' untranslated region of mRNA encoded by WDR9, corresponding to a HOST TARGET binding site such as BINDING SITE I, BINDING SITE II or BINDING SITE III. Table 2 illustrates the complementarity of the nucleotide sequences of WDR9 BINDING SITE, designated SEQ ID:27390, to the nucleotide sequence of VGAM1283 RNA, herein designated VGAM RNA, also designated SEQ ID:3994.

Another function of VGAM1283 is therefore inhibition of WD Repeat Domain 9 (WDR9, Accession NM_033656). Accordingly, utilities of VGAM1283 include diagnosis, prevention and treatment of diseases and clinical conditions associated with WDR9. LOC112616 (Accession NM_138410) is another VGAM1283 host target gene. LOC112616 BINDING SITE is HOST TARGET binding site found in the 3' untranslated region of mRNA encoded by LOC112616, corresponding to a HOST TARGET binding site such as BINDING SITE I, BINDING SITE II or BINDING SITE III. Table 2 illustrates the complementarity of the nucleotide sequences of LOC112616 BINDING SITE, designated SEQ ID:28775, to the nucleotide sequence of VGAM1283 RNA, herein designated VGAM RNA, also designated SEQ ID:3994.

Another function of VGAM1283 is therefore inhibition of LOC112616 (Accession NM_138410). Accordingly, utilities of VGAM1283 include diagnosis, prevention and treatment of diseases and clinical conditions associated with LOC112616. LOC126364 (Accession XM_065047) is another VGAM1283 host target gene. LOC126364 BINDING SITE is HOST TARGET binding site found in the 3' untranslated region of mRNA encoded by LOC126364, corresponding to a HOST TARGET binding site such as BINDING SITE I, BINDING SITE II or BINDING SITE III. Table 2 illustrates the complementarity of the nucleotide sequences of LOC126364 BINDING SITE, designated SEQ ID:37274, to the nucleotide sequence of VGAM1283 RNA, herein designated VGAM RNA, also designated SEQ ID:3994.

Another function of VGAM1283 is therefore inhibition of LOC126364 (Accession XM_065047). Accordingly, utilities of VGAM1283 include diagnosis, prevention and treatment of diseases and clinical conditions associated with LOC126364. LOC145739 (Accession XM_085222) is another VGAM1283 host target gene. LOC145739 BINDING SITE is HOST TARGET binding site found in the 3' untranslated region of mRNA encoded by LOC145739, corresponding to a HOST TARGET binding site such as BINDING SITE I, BINDING SITE II or BINDING SITE III. Table 2 illustrates the complementarity of the nucleotide sequences of LOC145739 BINDING SITE, designated SEQ ID:37964, to the nucleotide sequence of VGAM1283 RNA, herein designated VGAM RNA, also designated SEQ ID:3994.

Another function of VGAM1283 is therefore inhibition of LOC145739 (Accession XM_085222). Accordingly, utilities of VGAM1283 include diagnosis, prevention and treatment of diseases and clinical conditions associated with LOC145739. LOC145845 (Accession XM_096884) is another VGAM1283 host target gene. LOC145845 BINDING SITE is HOST TARGET binding site found in the 3' untranslated region of mRNA encoded by LOC145845, corresponding to a HOST TARGET binding site such as BINDING SITE I, BINDING SITE II or BINDING SITE III. Table 2 illustrates the complementarity of the nucleotide sequences of LOC145845 BINDING SITE, designated SEQ ID:40619, to the nucleotide sequence of VGAM1283 RNA, herein designated VGAM RNA, also designated SEQ ID:3994.

Another function of VGAM1283 is therefore inhibition of LOC145845 (Accession XM_096884). Accordingly, utilities of VGAM1283 include diagnosis, prevention and treatment of diseases and clinical conditions associated with LOC145845. LOC146909 (Accession XM_085634) is another VGAM1283 host target gene. LOC146909 BINDING SITE is HOST TARGET binding site found in the 3' untranslated region of mRNA encoded by LOC146909, corresponding to a HOST TARGET binding site such as BINDING SITE I, BINDING SITE II or BINDING SITE III. Table 2 illustrates the complementarity of the nucleotide sequences of LOC146909 BINDING SITE, designated SEQ ID:38270, to the nucleotide sequence of VGAM1283 RNA, herein designated VGAM RNA, also designated SEQ ID:3994.

Another function of VGAM1283 is therefore inhibition of LOC146909 (Accession XM_085634). Accordingly, utilities of VGAM1283 include diagnosis, prevention and treatment of diseases and clinical conditions associated with LOC146909. LOC146957 (Accession XM_085652) is another VGAM1283 host target gene. LOC146957 BINDING SITE is HOST TARGET binding site found in the 3' untranslated region of mRNA encoded by LOC146957, corresponding to a HOST TARGET binding site such as BINDING SITE I, BINDING SITE II or BINDING SITE III. Table 2 illustrates the complementarity of the nucleotide sequences of LOC146957 BINDING SITE, designated SEQ ID:38282, to the nucleotide sequence of VGAM1283 RNA, herein designated VGAM RNA, also designated SEQ ID:3994.

Another function of VGAM1283 is therefore inhibition of LOC146957 (Accession XM_085652). Accordingly, utilities of VGAM1283 include diagnosis, prevention and treatment of diseases and clinical conditions associated with LOC146957. LOC147791 (Accession XM_097293) is another VGAM1283 host target gene. LOC147791 BINDING SITE is HOST TARGET binding site found in the 3' untranslated region of mRNA encoded by LOC147791, corresponding to a HOST TARGET binding site such as BINDING SITE I, BINDING SITE II or BINDING SITE III. Table 2 illustrates the complementarity of the nucleotide sequences of LOC147791 BINDING SITE, designated SEQ ID:40859, to the nucleotide sequence of VGAM1283 RNA, herein designated VGAM RNA, also designated SEQ ID:3994.

Another function of VGAM1283 is therefore inhibition of LOC147791 (Accession XM_097293). Accordingly, utilities of VGAM1283 include diagnosis, prevention and treatment of diseases and clinical conditions associated with LOC147791. LOC148710 (Accession XM_097506) is another VGAM1283 host target gene. LOC148710 BINDING SITE is HOST TARGET binding site found in the 3' untranslated region of mRNA encoded by LOC148710, corresponding to a HOST TARGET binding site such as BINDING SITE I, BINDING SITE II or BINDING SITE III. Table 2 illustrates the complementarity of the nucleotide sequences of LOC148710 BINDING SITE, designated SEQ ID:40895, to the nucleotide sequence of VGAM1283 RNA, herein designated VGAM RNA, also designated SEQ ID:3994.

Another function of VGAM1283 is therefore inhibition of LOC148710 (Accession XM_097506). Accordingly, utilities of VGAM1283 include diagnosis, prevention and treatment of diseases and clinical conditions associated with LOC148710. LOC149372 (Accession XM_086509) is another VGAM1283 host target gene. LOC149372 BINDING SITE is HOST TARGET binding site found in the 3' untranslated region of mRNA encoded by LOC149372, corresponding to a HOST TARGET binding site such as BINDING SITE I, BINDING SITE II or BINDING SITE III. Table 2 illustrates the complementarity of the nucleotide sequences of LOC149372 BINDING SITE, designated SEQ ID:38727, to the nucleotide sequence of VGAM1283 RNA, herein designated VGAM RNA, also designated SEQ ID:3994.

Another function of VGAM1283 is therefore inhibition of LOC149372 (Accession XM_086509). Accordingly, utilities of VGAM1283 include diagnosis, prevention and treatment of diseases and clinical conditions associated with LOC149372. LOC150319 (Accession XM_086816) is another VGAM1283 host target gene. LOC150319 BINDING SITE is HOST TARGET binding site found in the 3' untranslated region of mRNA encoded by LOC150319, corresponding to a HOST TARGET binding site such as BINDING SITE I, BINDING SITE II or BINDING SITE III. Table 2 illustrates the complementarity of the nucleotide sequences of LOC150319 BINDING SITE, designated SEQ ID:38898, to the nucleotide sequence of VGAM1283 RNA, herein designated VGAM RNA, also designated SEQ ID:3994.

Another function of VGAM1283 is therefore inhibition of LOC150319 (Accession XM_086816). Accordingly, utilities of VGAM1283 include diagnosis, prevention and treatment of diseases and clinical conditions associated with LOC150319. LOC151154 (Accession XM_098008) is another VGAM1283 host target gene. LOC151154 BINDING SITE is HOST TARGET binding site found in the 5' untranslated region of mRNA encoded by LOC151154, corresponding to a HOST TARGET binding site such as BINDING SITE I, BINDING SITE II or BINDING SITE III. Table 2 illustrates the complementarity of the nucleotide sequences of LOC151154 BINDING SITE, designated SEQ ID:41304, to the nucleotide sequence of VGAM1283 RNA, herein designated VGAM RNA, also designated SEQ ID:3994.

Another function of VGAM1283 is therefore inhibition of LOC151154 (Accession XM_098008). Accordingly, utilities of VGAM1283 include diagnosis, prevention and treatment of diseases and clinical conditions associated with LOC151154. LOC152245 (Accession XM_098182) is another VGAM1283 host target gene. LOC152245 BINDING SITE is HOST TARGET binding site found in the 5' untranslated region of mRNA encoded by LOC152245, corresponding to a HOST TARGET binding site such as BINDING SITE I, BINDING SITE II or BINDING SITE III. Table 2 illustrates the complementarity of the nucleotide sequences of LOC152245 BINDING SITE, designated SEQ ID:41450, to the nucleotide sequence of VGAM1283 RNA, herein designated VGAM RNA, also designated SEQ ID:3994.

Another function of VGAM1283 is therefore inhibition of LOC152245 (Accession XM_098182). Accordingly, utilities of VGAM1283 include diagnosis, prevention and treatment of diseases and clinical conditions associated with LOC152245. LOC152271 (Accession XM_087419) is another VGAM1283 host target gene. LOC152271 BINDING SITE is HOST TARGET binding site found in the 3' untranslated region of mRNA encoded by LOC152271, corresponding to a HOST TARGET binding site such as BINDING SITE I, BINDING SITE II or BINDING SITE III. Table 2 illustrates the complementarity of the nucleotide sequences of LOC152271 BINDING SITE, designated SEQ ID:39241, to the nucleotide sequence of VGAM1283 RNA, herein designated VGAM RNA, also designated SEQ ID:3994.

Another function of VGAM1283 is therefore inhibition of LOC152271 (Accession XM_087419). Accordingly, utilities of VGAM1283 include diagnosis, prevention and treatment of diseases and clinical conditions associated with LOC152271. LOC154860 (Accession XM_098623) is another VGAM1283 host target gene. LOC154860 BINDING SITE is HOST TARGET binding site found in the 5' untranslated region of mRNA encoded by LOC154860, corresponding to a HOST TARGET binding site such as BINDING SITE I, BINDING SITE II or BINDING SITE III. Table 2 illustrates the complementarity of the nucleotide sequences of LOC154860 BINDING SITE, designated SEQ ID:41734, to the nucleotide sequence of VGAM1283 RNA, herein designated VGAM RNA, also designated SEQ ID:3994.

Another function of VGAM1283 is therefore inhibition of LOC154860 (Accession XM_098623). Accordingly, utilities of VGAM1283 include diagnosis, prevention and treatment of diseases and clinical conditions associated with LOC154860. LOC157681 (Accession XM_088363) is another VGAM1283 host target gene. LOC157681 BINDING SITE is HOST TARGET binding site found in the 5' untranslated region of mRNA encoded by LOC157681, corresponding to a HOST TARGET binding site such as BINDING SITE I, BINDING SITE II or BINDING SITE III. Table 2 illustrates the complementarity of the nucleotide sequences of LOC157681 BINDING SITE, designated SEQ ID:39643, to the nucleotide sequence of VGAM1283 RNA, herein designated VGAM RNA, also designated SEQ ID:3994.

Another function of VGAM1283 is therefore inhibition of LOC157681 (Accession XM_088363). Accordingly, utilities of VGAM1283 include diagnosis, prevention and treatment of diseases and clinical conditions associated with LOC157681. LOC164714 (Accession XM_104657) is another VGAM1283 host target gene. LOC164714 BINDING SITE is HOST TARGET binding site found in the 3' untranslated region of mRNA encoded by LOC164714, corresponding to a HOST TARGET binding site such as BINDING SITE I, BINDING SITE II or BINDING SITE III. Table 2 illustrates the complementarity of the nucleotide sequences of LOC164714 BINDING SITE, designated SEQ ID:42177, to the nucleotide sequence of VGAM1283 RNA, herein designated VGAM RNA, also designated SEQ ID:3994.

Another function of VGAM1283 is therefore inhibition of LOC164714 (Accession XM_104657). Accordingly, utilities of VGAM1283 include diagnosis, prevention and treatment of diseases and clinical conditions associated with LOC164714. LOC196337 (Accession XM_113696) is another VGAM1283 host target gene. LOC196337 BINDING SITE is HOST TARGET binding site found in the 3' untranslated region of mRNA encoded by LOC196337, corresponding to a HOST TARGET binding site such as BINDING SITE I, BINDING SITE II or BINDING SITE III. Table 2 illustrates the complementarity of the nucleotide sequences of LOC196337 BINDING SITE, designated SEQ ID:42362, to the nucleotide sequence of VGAM1283 RNA, herein designated VGAM RNA, also designated SEQ ID:3994.

Another function of VGAM1283 is therefore inhibition of LOC196337 (Accession XM_113696). Accordingly, utilities of VGAM1283 include diagnosis, prevention and treatment of diseases and clinical conditions associated with LOC196337. LOC200982 (Accession XM_117305) is another VGAM1283 host target gene. LOC200982 BINDING SITE is HOST TARGET binding site found in the 3' untranslated region of mRNA encoded by LOC200982, corresponding to a HOST TARGET binding site such as BINDING SITE I, BINDING SITE II or BINDING SITE III. Table 2 illustrates the complementarity of the nucleotide sequences of LOC200982 BINDING SITE, designated SEQ ID:43373, to the nucleotide sequence of VGAM1283 RNA, herein designated VGAM RNA, also designated SEQ ID:3994.

Another function of VGAM1283 is therefore inhibition of LOC200982 (Accession XM_117305). Accordingly, utilities of VGAM1283 include diagnosis, prevention and treatment of diseases and clinical conditions associated with LOC200982. LOC203350 (Accession XM_117536) is another VGAM1283 host target gene. LOC203350 BINDING SITE is HOST TARGET binding site found in the 3' untranslated region of mRNA encoded by LOC203350, corresponding to a HOST TARGET binding site such as BINDING SITE I, BINDING SITE II or BINDING SITE III. Table 2 illustrates the complementarity of the nucleotide sequences of LOC203350 BINDING SITE, designated SEQ ID:43539, to the nucleotide sequence of VGAM1283 RNA, herein designated VGAM RNA, also designated SEQ ID:3994.

Another function of VGAM1283 is therefore inhibition of LOC203350 (Accession XM_117536). Accordingly, utilities of VGAM1283 include diagnosis, prevention and treatment of diseases and clinical conditions associated with LOC203350. LOC222128 (Accession XM_166560) is another VGAM1283 host target gene. LOC222128 BINDING SITE is HOST TARGET binding site found in the 5' untranslated region of mRNA encoded by LOC222128, corresponding to a HOST TARGET binding site such as BINDING SITE I, BINDING SITE II or BINDING SITE III. Table 2 illustrates the complementarity of the nucleotide sequences of LOC222128 BINDING SITE, designated SEQ ID:44539, to the nucleotide sequence of VGAM1283 RNA, herein designated VGAM RNA, also designated SEQ ID:3994.

Another function of VGAM1283 is therefore inhibition of LOC222128 (Accession XM_166560). Accordingly, utilities of VGAM1283 include diagnosis, prevention and treatment of diseases and clinical conditions associated with LOC222128. LOC254085 (Accession XM_171189) is another VGAM1283 host target gene. LOC254085 BINDING SITE is HOST TARGET binding site found in the 5' untranslated region of mRNA encoded by LOC254085, corresponding to a HOST TARGET binding site such as BINDING SITE I, BINDING SITE II or BINDING SITE III. Table 2 illustrates the complementarity of the nucleotide sequences of LOC254085 BINDING SITE, designated SEQ ID:45973, to the nucleotide sequence of VGAM1283 RNA, herein designated VGAM RNA, also designated SEQ ID:3994.

Another function of VGAM1283 is therefore inhibition of LOC254085 (Accession XM_171189). Accordingly, utilities of VGAM1283 include diagnosis, prevention and treatment of diseases and clinical conditions associated with LOC254085. LOC51107 (Accession NM_016022) is another VGAM1283 host target gene. LOC51107 BINDING SITE is HOST TARGET binding site found in the 3' untranslated region of mRNA encoded by LOC51107, corresponding to a HOST TARGET binding site such as BINDING SITE I, BINDING SITE II or BINDING SITE III. Table 2 illustrates the complementarity of the nucleotide sequences of LOC51107 BINDING SITE, designated SEQ ID:18096, to the nucleotide sequence of VGAM1283 RNA, herein designated VGAM RNA, also designated SEQ ID:3994.

Another function of VGAM1283 is therefore inhibition of LOC51107 (Accession NM_016022). Accordingly, utilities of VGAM1283 include diagnosis, prevention and treatment of diseases and clinical conditions associated with LOC51107. LOC51308 (Accession NM_016606) is another VGAM1283 host target gene. LOC51308 BINDING SITE is HOST TARGET binding site found in the 3' untranslated region of mRNA encoded by LOC51308, corresponding to a HOST TARGET binding site such as BINDING SITE I, BINDING SITE II or BINDING SITE III. Table 2 illustrates the complementarity of the nucleotide sequences of LOC51308 BINDING SITE, designated SEQ ID:18711, to the nucleotide sequence of VGAM1283 RNA, herein designated VGAM RNA, also designated SEQ ID:3994.

Another function of VGAM1283 is therefore inhibition of LOC51308 (Accession NM_016606). Accordingly, utilities of VGAM1283 include diagnosis, prevention and treatment of diseases and clinical conditions associated with LOC51308. LOC63928 (Accession NM_022097) is another VGAM1283 host target gene. LOC63928 BINDING SITE is HOST TARGET binding site found in the 3' untranslated region of mRNA encoded by LOC63928, corresponding to a HOST TARGET binding site such as BINDING SITE I, BINDING SITE II or BINDING SITE III. Table 2 illustrates the complementarity of the nucleotide sequences of LOC63928 BINDING SITE, designated SEQ ID:22636, to the nucleotide sequence of VGAM1283 RNA, herein designated VGAM RNA, also designated SEQ ID:3994.

Another function of VGAM1283 is therefore inhibition of LOC63928 (Accession NM_022097). Accordingly, utilities of VGAM1283 include diagnosis, prevention and treatment of diseases and clinical conditions associated with LOC63928. LOC85414 (Accession NM_033102) is another VGAM1283 host target gene. LOC85414 BINDING SITE is HOST TARGET binding site found in the 3' untranslated region of mRNA encoded by LOC85414, corresponding to a HOST TARGET binding site such as BINDING SITE I, BINDING SITE II or BINDING SITE III. Table 2 illustrates the complementarity of the nucleotide sequences of LOC85414 BINDING SITE, designated SEQ ID:26950, to the nucleotide sequence of VGAM1283 RNA, herein designated VGAM RNA, also designated SEQ ID:3994.

Another function of VGAM1283 is therefore inhibition of LOC85414 (Accession NM_033102). Accordingly, utilities of VGAM1283 include diagnosis, prevention and treatment of diseases and clinical conditions associated with LOC85414. LOC90678 (Accession NM_138361) is another VGAM1283 host target gene. LOC90678 BINDING SITE is HOST TARGET binding site found in the 3' untranslated region of mRNA encoded by LOC90678, corresponding to a HOST TARGET binding site such as BINDING SITE I, BINDING SITE II or BINDING SITE III. Table 2 illustrates the complementarity of the nucleotide sequences of LOC90678 BINDING SITE, designated SEQ ID:28749, to the nucleotide sequence of VGAM1283 RNA, herein designated VGAM RNA, also designated SEQ ID:3994.

Another function of VGAM1283 is therefore inhibition of LOC90678 (Accession NM_138361). Accordingly, utilities of VGAM1283 include diagnosis, prevention and treatment of diseases and clinical conditions associated with LOC90678. LOC91151 (Accession NM_033208) is another VGAM1283 host target gene. LOC91151 BINDING SITE is HOST TARGET binding site found in the 5' untranslated region of mRNA encoded by LOC91151, corresponding to a HOST TARGET binding site such as BINDING SITE I, BINDING SITE II or BINDING SITE III. Table 2 illustrates the complementarity of the nucleotide sequences of LOC91151 BINDING SITE, designated SEQ ID:27055, to the nucleotide sequence of VGAM1283 RNA, herein designated VGAM RNA, also designated SEQ ID:3994.

Another function of VGAM1283 is therefore inhibition of LOC91151 (Accession NM_033208). Accordingly, utilities of VGAM1283 include diagnosis, prevention and treatment of diseases and clinical conditions associated with LOC91151. LOC91301 (Accession XM_037564) is another VGAM1283 host target gene. LOC91301 BINDING SITE is HOST TARGET binding site found in the 5' untranslated region of mRNA encoded by LOC91301, corresponding to a HOST TARGET binding site such as BINDING SITE I, BINDING SITE II or BINDING SITE III. Table 2 illustrates the complementarity of the nucleotide sequences of LOC91301 BINDING SITE, designated SEQ ID:32653, to the nucleotide sequence of VGAM1283 RNA, herein designated VGAM RNA, also designated SEQ ID:3994.

Another function of VGAM1283 is therefore inhibition of LOC91301 (Accession XM_037564). Accordingly, utilities of VGAM1283 include diagnosis, prevention and treatment of diseases and clinical conditions associated with LOC91301. FIG. 1 further provides a conceptual description of a novel bioinformatically detected viral gene of the present invention, referred to here as Viral Genomic Address Messenger 1284 (VGAM1284) viral gene, which modulates expression of respective host target genes thereof, the function and utility of which host target genes is known in the art.

VGAM1284 is a novel bioinformatically detected regulatory, non protein coding, viral micro RNA (miRNA) gene. The method by which VGAM1284 was detected is described hereinabove with reference to FIGS. 1-8.

VGAM1284 gene, herein designated VGAM GENE, is a viral gene contained in the genome of Human Enterovirus A. VGAM1284 host target gene, herein designated VGAM HOST TARGET GENE, is a human gene contained in the human genome.

VGAM1284 gene encodes a VGAM1284 precursor RNA, herein designated VGAM PRECURSOR RNA. Similar to other miRNA genes, and unlike most ordinary genes, VGAM1284 precursor RNA does not encode a protein. A nucleotide sequence identical or highly similar to the nucleotide sequence of VGAM1284 precursor RNA is designated SEQ ID:1270, and is provided hereinbelow with reference to the sequence listing part. Nucleotide sequence SEQ ID:1270 is located at position 4771 relative to the genome of Human Enterovirus A.

VGAM1284 precursor RNA folds onto itself, forming VGAM1284 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1284 folded precursor RNA into VGAM1284 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM1284 RNA is designated SEQ ID:3995, and is provided hereinbelow with reference to the sequence listing part.

VGAM1284 host target gene, herein designated VGAM HOST TARGET GENE, encodes a corresponding messenger RNA, VGAM1284 host target RNA, herein designated VGAM HOST TARGET RNA. VGAM1284 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1284 RNA, herein designated VGAM RNA, binds complementarily to one or more host target binding sites located in untranslated regions of VGAM1284 host target RNA, herein designated VGAM HOST TARGET RNA. This complementary binding is due to the fact that the nucleotide sequence of VGAM1284 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1284 RNA, herein designated VGAM RNA, may have a different number of host target binding sites in untranslated regions of a VGAM1284 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1284 RNA, herein designated VGAM RNA, to host target binding sites on VGAM1284 host target RNA, herein designated VGAM HOST TARGET RNA, such as BINDING SITE I, BINDING SITE II and BINDING SITE III, inhibits translation of VGAM1284 host target RNA into VGAM1284 host target protein, herein designated VGAM HOST TARGET PROTEIN. VGAM host target protein is therefore outlined by a broken line.

It is appreciated that VGAM1284 host target gene, herein designated VGAM HOST TARGET GENE, in fact represents a plurality of VGAM1284 host target genes. The mRNA of each one of this plurality of VGAM1284 host target genes comprises one or more host target binding sites, each having a nucleotide sequence which is at least partly complementary to VGAM1284 RNA, herein designated VGAM RNA, and which when bound by VGAM1284 RNA causes inhibition of translation of respective one or more VGAM1284 host target proteins.

It is further appreciated by one skilled in the art that the mode of translational inhibition illustrated by FIG. 1 with specific reference to translational inhibition exerted by VGAM1284 gene, herein designated VGAM GENE, on one or more VGAM1284 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1284 is inhibition of expression of host target genes, as part of a novel viral mechanism of attacking a host. Accordingly, utilities of VGAM1284 include diagnosis, prevention and treatment of viral infection by Human Enterovirus A. Specific functions, and accordingly utilities, of VGAM1284 correlate with, and may be deduced from, the identity of the host target genes which VGAM1284 binds and inhibits, and the function of these host target genes, as elaborated hereinbelow.

Nucleotide sequences of the VGAM1284 precursor RNA, herein designated VGAM PRECURSOR RNA, and of the 'diced' VGAM1284 RNA, herein designated VGAM RNA, and a schematic representation of the secondary folding of VGAM1284 folded precursor RNA, herein designated VGAM FOLDED PRECURSOR RNA, of VGAM1284 are further described hereinbelow with reference to Table 1.

Nucleotide sequences of host target binding sites, such as BINDING SITE-I, BINDING SITE-II and BINDING SITE-III of FIG. 1, found on VGAM1284 host target RNA, and schematic representation of the complementarity of each of these host target binding sites to VGAM1284 RNA, herein designated VGAM RNA, are described hereinbelow with reference to Table 2.

As mentioned hereinabove with reference to FIG. 1, a function of VGAM1284 gene, herein designated VGAM is inhibition of expression of VGAM1284 target genes. It is appreciated that specific functions, and accordingly utilities, of VGAM1284 correlate with, and may be deduced from, the identity of the target genes which VGAM1284 binds and inhibits, and the function of these target genes, as elaborated hereinbelow.

Amyloid Beta Precursor Protein (cytoplasmic tail) Binding Protein 2 (APPBP2, Accession NM_006380) is a VGAM1284 host target gene. APPBP2 BINDING SITE is HOST TARGET binding site found in the 3' untranslated region of mRNA encoded by APPBP2, corresponding to a HOST TARGET binding site such as BINDING SITE I, BINDING SITE II or BINDING SITE III. Table 2 illustrates the complementarity of the nucleotide sequences of APPBP2 BINDING SITE, designated SEQ ID:13080, to the nucleotide sequence of VGAM1284 RNA, herein designated VGAM RNA, also designated SEQ ID:3995.

A function of VGAM1284 is therefore inhibition of Amyloid Beta Precursor Protein (cytoplasmic tail) Binding Protein 2 (APPBP2, Accession NM_006380), a gene which interacts with the basolateral sorting signal of amyloid precursor protein. Accordingly, utilities of VGAM1284 include diagnosis, prevention and treatment of diseases and clinical conditions associated with APPBP2. The function of APPBP2 and its association with various diseases and clinical conditions, has been established by previous studies, as described hereinabove with reference to VGAM525. POU Domain, Class 2, Associating Factor 1 (POU2AF1, Accession NM_006235) is another VGAM1284 host target gene. POU2AF1 BINDING SITE is HOST TARGET binding site found in the 3' untranslated region of mRNA encoded by POU2AF1, corresponding to a HOST TARGET binding site such as BINDING SITE I, BINDING SITE II or BINDING SITE III. Table 2 illustrates the complementarity of the nucleotide sequences of POU2AF1 BINDING SITE, designated SEQ ID:12890, to the nucleotide sequence of VGAM1284 RNA, herein designated VGAM RNA, also designated SEQ ID:3995.

Another function of VGAM1284 is therefore inhibition of POU Domain, Class 2, Associating Factor 1 (POU2AF1, Accession NM_006235), a gene which is a transcriptional coactivator that specifically associates with either oct1 or oct2. Accordingly, utilities of VGAM1284 include diagnosis, prevention and treatment of diseases and clinical conditions associated with POU2AF1. The function of POU2AF1 and its association with various diseases and clinical conditions, has been established by previous studies, as described hereinabove with reference to VGAM171. LOC149401 (Accession XM_086511) is another VGAM1284 host target gene. LOC149401 BINDING SITE is HOST TARGET binding site found in the 5' untranslated region of mRNA encoded by LOC149401, corresponding to a HOST TARGET binding site such as BINDING SITE I, BINDING SITE II or BINDING SITE III. Table 2 illustrates the complementarity of the nucleotide sequences of LOC149401 BINDING SITE, designated SEQ ID:38739, to the nucleotide sequence of VGAM1284 RNA, herein designated VGAM RNA, also designated SEQ ID:3995.

Another function of VGAM1284 is therefore inhibition of LOC149401 (Accession XM_086511). Accordingly, utilities of VGAM1284 include diagnosis, prevention and treatment of diseases and clinical conditions associated with LOC149401. FIG. 1 further provides a conceptual description of a novel bioinformatically detected viral gene of the present invention, referred to here as Viral Genomic Address Messenger 1285 (VGAM1285) viral gene, which modulates expression of respective host target genes thereof, the function and utility of which host target genes is known in the art.

VGAM1285 is a novel bioinformatically detected regulatory, non protein coding, viral micro RNA (miRNA) gene. The method by which VGAM1285 was detected is described hereinabove with reference to FIGS. 1-8.

VGAM1285 gene, herein designated VGAM GENE, is a viral gene contained in the genome of Beet Virus Q. VGAM1285 host target gene, herein designated VGAM HOST TARGET GENE, is a human gene contained in the human genome.

VGAM1285 gene encodes a VGAM1285 precursor RNA, herein designated VGAM PRECURSOR RNA. Similar to other miRNA genes, and unlike most ordinary genes, VGAM1285 precursor RNA does not encode a protein. A nucleotide sequence identical or highly similar to the nucleotide sequence of VGAM1285 precursor RNA is designated SEQ ID:1271, and is provided hereinbelow with reference to the sequence listing part. Nucleotide sequence SEQ ID:1271 is located at position 460 relative to the genome of Beet Virus Q.

VGAM1285 precursor RNA folds onto itself, forming VGAM1285 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1285 folded precursor RNA into VGAM1285 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1285 RNA is designated SEQ ID:3996, and is provided hereinbelow with reference to the sequence listing part.

VGAM1285 host target gene, herein designated VGAM HOST TARGET GENE, encodes a corresponding messenger RNA, VGAM1285 host target RNA, herein designated VGAM HOST TARGET RNA. VGAM1285 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1285 RNA, herein designated VGAM RNA, binds complementarily to one or more host target binding sites located in untranslated regions of VGAM1285 host target RNA, herein designated VGAM HOST TARGET RNA. This complementary binding is due to the fact that the nucleotide sequence of VGAM1285 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1285 RNA, herein designated VGAM RNA, may have a different number of host target binding sites in untranslated regions of a VGAM1285 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1285 RNA, herein designated VGAM RNA, to host target binding sites on VGAM1285 host target RNA, herein designated VGAM HOST TARGET RNA, such as BINDING SITE I, BINDING SITE II and BINDING SITE III, inhibits translation of VGAM1285 host target RNA into VGAM1285 host target protein, herein designated VGAM HOST TARGET PROTEIN. VGAM host target protein is therefore outlined by a broken line.

It is appreciated that VGAM1285 host target gene, herein designated VGAM HOST TARGET GENE, in fact represents a plurality of VGAM1285 host target genes. The mRNA of each one of this plurality of VGAM1285 host target genes comprises one or more host target binding sites, each having a nucleotide sequence which is at least partly complementary to VGAM1285 RNA, herein designated VGAM RNA, and which when bound by VGAM1285 RNA causes inhibition of translation of respective one or more VGAM1285 host target proteins.

It is further appreciated by one skilled in the art that the mode of translational inhibition illustrated by FIG. 1 with specific reference to translational inhibition exerted by VGAM1285 gene, herein designated VGAM GENE, on one or more VGAM1285 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1285 is inhibition of expression of host target genes, as part of a novel viral mechanism of attacking a host. Accordingly, utilities of VGAM1285 include diagnosis, prevention and treatment of viral infection by Beet Virus Q. Specific functions, and accordingly utilities, of VGAM1285 correlate with, and may be deduced from, the identity of the host target genes which VGAM1285 binds and inhibits, and the function of these host target genes, as elaborated hereinbelow.

Nucleotide sequences of the VGAM1285 precursor RNA, herein designated VGAM PRECURSOR RNA, and of the 'diced' VGAM1285 RNA, herein designated VGAM RNA, and a schematic representation of the secondary folding of VGAM1285 folded precursor RNA, herein designated VGAM FOLDED PRECURSOR RNA, of VGAM1285 are further described hereinbelow with reference to Table 1.

Nucleotide sequences of host target binding sites, such as BINDING SITE-I, BINDING SITE-II and BINDING SITE-III of FIG. 1, found on VGAM1285 host target RNA, and schematic representation of the complementarity of each of these host target binding sites to VGAM1285 RNA, herein designated VGAM RNA, are described hereinbelow with reference to Table 2.

As mentioned hereinabove with reference to FIG. 1, a function of VGAM1285 gene, herein designated VGAM is inhibition of expression of VGAM1285 target genes. It is appreciated that specific functions, and accordingly utilities, of VGAM1285 correlate with, and may be deduced from, the identity of the target genes which VGAM1285 binds and inhibits, and the function of these target genes, as elaborated hereinbelow.

Alpha-1-B Glycoprotein (A1BG, Accession NM_130786) is a VGAM1285 host target gene. A1BG BINDING SITE is HOST TARGET binding site found in the 3' untranslated region of mRNA encoded by A1BG, corresponding to a HOST TARGET binding site such as BINDING SITE I, BINDING SITE II or BINDING SITE III. Table 2 illustrates the complementarity of the nucleotide sequences of A1BG BINDING SITE, designated SEQ ID:28276, to the nucleotide sequence of VGAM1285 RNA, herein designated VGAM RNA, also designated SEQ ID:3996.

A function of VGAM1285 is therefore inhibition of Alpha-1-B Glycoprotein (A1BG, Accession NM_130786), a gene which a plasma protein of unknown function. Accordingly, utilities of VGAM1285 include diagnosis, prevention and treatment of diseases and clinical conditions associated with A1BG. The function of A1BG and its association with various diseases and clinical conditions, has been established by previous studies, as described hereinabove with reference to VGAM172. Platelet-derived Growth Factor Receptor, Alpha Polypeptide (PDGFRA, Accession NM_006206) is another VGAM1285 host target gene. PDGFRA BINDING SITE is HOST TARGET binding site found in the 3" untranslated region of mRNA encoded by PDGFRA, corresponding to a HOST TARGET binding site such as BINDING SITE I, BINDING SITE II or BINDING SITE III. Table 2 illustrates the complementarity of the nucleotide sequences of PDGFRA BINDING SITE, designated SEQ ID:12883, to the nucleotide sequence of VGAM1285 RNA, herein designated VGAM RNA, also designated SEQ ID:3996.

Another function of VGAM1285 is therefore inhibition of Platelet-derived Growth Factor Receptor, Alpha Polypeptide (PDGFRA, Accession NM_006206), a gene which this receptor binds platelet-derived growth factor and has a tyrosine-protein kinase activity. Accordingly, utilities of VGAM1285 include diagnosis, prevention and treatment of diseases and clinical conditions associated with PDGFRA. The function of PDGFRA and its association with various diseases and clinical conditions, has been established by previous studies, as described hereinabove with reference to VGAM117. Chromobox Homolog 6 (CBX6, Accession NM_014292) is another VGAM1285 host target gene. CBX6 BINDING SITE is HOST TARGET binding site found in the 3' untranslated region of mRNA encoded by CBX6, corresponding to a HOST TARGET binding site such as BINDING SITE I, BINDING SITE II or BINDING SITE III. Table 2 illustrates the complementarity of the nucleotide sequences of CBX6 BINDING SITE, designated SEQ ID:15577, to the nucleotide sequence of VGAM1285 RNA, herein designated VGAM RNA, also designated SEQ ID:3996.

Another function of VGAM1285 is therefore inhibition of Chromobox Homolog 6 (CBX6, Accession NM_014292). Accordingly, utilities of VGAM1285 include diagnosis, prevention and treatment of diseases and clinical conditions associated with CBX6. Centaurin, Gamma 2 (CENTG2, Accession NM_014914) is another VGAM1285 host target gene. CENTG2 BINDING SITE is HOST TARGET binding site found in the 3' untranslated region of mRNA encoded by CENTG2, corresponding to a HOST TARGET binding site such as BINDING SITE I, BINDING SITE II or BINDING SITE III. Table 2 illustrates the complementarity of the nucleotide sequences of CENTG2 BINDING SITE, designated SEQ ID:17157, to the nucleotide sequence of VGAM1285 RNA, herein designated VGAM RNA, also designated SEQ ID:3996.

Another function of VGAM1285 is therefore inhibition of Centaurin, Gamma 2 (CENTG2, Accession NM_014914). Accordingly, utilities of VGAM1285 include diagnosis, prevention and treatment of diseases and clinical conditions associated with CENTG2. DKFZP434A0131 (Accession NM_018991) is another VGAM1285 host target gene. DKFZP434A0131 BINDING SITE is HOST TARGET binding site found in the 3' untranslated region of mRNA encoded by DKFZP434A0131, corresponding to a HOST TARGET binding site such as BINDING SITE I, BINDING SITE II or BINDING SITE III. Table 2 illustrates the complementarity of the nucleotide sequences of DKFZP434A0131 BINDING SITE, designated SEQ ID:21062, to the nucleotide sequence of VGAM1285 RNA, herein designated VGAM RNA, also designated SEQ ID:3996.

Another function of VGAM1285 is therefore inhibition of DKFZP434A0131 (Accession NM_018991). Accordingly, utilities of VGAM1285 include diagnosis, prevention and treatment of diseases and clinical conditions associated with DKFZP434A0131. Potassium Channel, Subfamily V, Member 1 (KCNV1, Accession NM_014379) is another VGAM1285 host target gene. KCNV1 BINDING SITE is HOST TARGET binding site found in the 5' untranslated region of mRNA encoded by KCNV1, corresponding to a HOST TARGET binding site such as BINDING SITE I, BINDING SITE II or BINDING SITE III. Table 2 illustrates the complementarity of the nucleotide sequences of KCNV1 BINDING SITE, designated SEQ ID:15711, to the nucleotide sequence of VGAM1285 RNA, herein designated VGAM RNA, also designated SEQ ID:3996.

Another function of VGAM1285 is therefore inhibition of Potassium Channel, Subfamily V, Member 1 (KCNV1, Accession NM_014379). Accordingly, utilities of VGAM1285 include diagnosis, prevention and treatment of diseases and clinical conditions associated with KCNV1. MARKL1 (Accession NM_031417) is another VGAM1285 host target gene. MARKL1 BINDING SITE is HOST TARGET binding site found in the 3' untranslated region of mRNA encoded by MARKL1, corresponding to a HOST TARGET binding site such as BINDING SITE I, BINDING SITE II or BINDING SITE III. Table 2 illustrates the complementarity of the nucleotide sequences of MARKL1 BINDING SITE, designated SEQ ID:25396, to the nucleotide sequence of VGAM1285 RNA, herein designated VGAM RNA, also designated SEQ ID:3996.

Another function of VGAM1285 is therefore inhibition of MARKL1 (Accession NM_031417). Accordingly, utilities of VGAM1285 include diagnosis, prevention and treatment of diseases and clinical conditions associated with MARKL1. LOC148293 (Accession XM_086138) is another VGAM1285 host target gene. LOC148293 BINDING SITE is HOST TARGET binding site found in the 3' untranslated region of mRNA encoded by LOC148293, corresponding to a HOST TARGET binding site such as BINDING SITE I, BINDING SITE II or BINDING SITE III. Table 2 illustrates the complementarity of the nucleotide sequences of LOC148293 BINDING SITE, designated SEQ ID:38518, to the nucleotide sequence of VGAM1285 RNA, herein designated VGAM RNA, also designated SEQ ID:3996.

Another function of VGAM1285 is therefore inhibition of LOC148293 (Accession XM_086138). Accordingly, utilities of VGAM1285 include diagnosis, prevention and treatment of diseases and clinical conditions associated with LOC148293. LOC220018 (Accession XM_167816) is another VGAM1285 host target gene. LOC220018 BINDING SITE is HOST TARGET binding site found in the 5' untranslated region of mRNA encoded by LOC220018, corresponding to a HOST TARGET binding site such as BINDING SITE I, BINDING SITE II or BINDING SITE III. Table 2 illustrates the complementarity of the nucleotide sequences of LOC220018 BINDING SITE, designated SEQ ID:44857, to the nucleotide sequence of VGAM1285 RNA, herein designated VGAM RNA, also designated SEQ ID:3996.

Another function of VGAM1285 is therefore inhibition of LOC220018 (Accession XM_167816). Accordingly, utilities of VGAM1285 include diagnosis, prevention and treatment of diseases and clinical conditions associated with LOC220018. LOC86651 (Accession XM_044052) is another VGAM1285 host target gene. LOC86651 BINDING SITE is HOST TARGET binding site found in the 5' untranslated region of mRNA encoded by LOC86651, corresponding to a HOST TARGET binding site such as BINDING SITE I, BINDING SITE II or BINDING SITE III. Table 2 illustrates the complementarity of the nucleotide sequences of LOC86651 BINDING SITE, designated SEQ ID:34099, to the nucleotide sequence of VGAM1285 RNA, herein designated VGAM RNA, also designated SEQ ID:3996.

Another function of VGAM1285 is therefore inhibition of LOC86651 (Accession XM_044052). Accordingly, utilities of VGAM1285 include diagnosis, prevention and treatment of diseases and clinical conditions associated with LOC86651. FIG. 1 further provides a conceptual description of a novel bioinformatically detected viral gene of the present invention, referred to here as Viral Genomic Address Messenger 1286 (VGAM1286) viral gene, which modulates expression of respective host target genes thereof, the function and utility of which host target genes is known in the art.

VGAM1286 is a novel bioinformatically detected regulatory, non protein coding, viral micro RNA (miRNA) gene. The method by which VGAM1286 was detected is described hereinabove with reference to FIGS. 1-8.

VGAM1286 gene, herein designated VGAM GENE, is a viral gene contained in the genome of Human Enterovirus A. VGAM1286 host target gene, herein designated VGAM HOST TARGET GENE, is a human gene contained in the human genome.

VGAM1286 gene encodes a VGAM1286 precursor RNA, herein designated VGAM PRECURSOR RNA. Similar to other miRNA genes, and unlike most ordinary genes, VGAM1286 precursor RNA does not encode a protein. A nucleotide sequence identical or highly similar to the nucleotide sequence of VGAM1286 precursor RNA is designated SEQ ID:1272, and is provided hereinbelow with reference to the sequence listing part. Nucleotide sequence SEQ ID:1272 is located at position 1767 relative to the genome of Human Enterovirus A.

VGAM1286 precursor RNA folds onto itself, forming VGAM1286 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1286 folded precursor RNA into VGAM1286 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 84%) nucleotide sequence of VGAM1286 RNA is designated SEQ ID:3997, and is provided hereinbelow with reference to the sequence listing part.

VGAM1286 host target gene, herein designated VGAM HOST TARGET GENE, encodes a corresponding messenger RNA, VGAM1286 host target RNA, herein designated VGAM HOST TARGET RNA. VGAM1286 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1286 RNA, herein designated VGAM RNA, binds complementarily to one or more host target binding sites located in untranslated regions of VGAM1286 host target RNA, herein designated VGAM HOST TARGET RNA. This complementary binding is due to the fact that the nucleotide sequence of VGAM1286 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1286 RNA, herein designated VGAM RNA, may have a different number of host target binding sites in untranslated regions of a VGAM1286 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1286 RNA, herein designated VGAM RNA, to host target binding sites on VGAM1286 host target RNA, herein designated VGAM HOST TARGET RNA, such as BINDING SITE I, BINDING SITE II and BINDING SITE III, inhibits translation of VGAM1286 host target RNA into VGAM1286 host target protein, herein designated VGAM HOST TARGET PROTEIN. VGAM host target protein is therefore outlined by a broken line.

It is appreciated that VGAM1286 host target gene, herein designated VGAM HOST TARGET GENE, in fact represents a plurality of VGAM1286 host target genes. The mRNA of each one of this plurality of VGAM1286 host target genes comprises one or more host target binding sites, each having a nucleotide sequence which is at least partly complementary to VGAM1286 RNA, herein designated VGAM RNA, and which when bound by VGAM1286 RNA causes inhibition of translation of respective one or more VGAM1286 host target proteins.

It is further appreciated by one skilled in the art that the mode of translational inhibition illustrated by FIG. 1 with specific reference to translational inhibition exerted by VGAM1286 gene, herein designated VGAM GENE, on one or more VGAM1286 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1286 is inhibition of expression of host target genes, as part of a novel viral mechanism of attacking a host. Accordingly, utilities of VGAM1286 include diagnosis, prevention and treatment of viral infection by Human Enterovirus A. Specific functions, and accordingly utilities, of VGAM1286 correlate with, and may be deduced from, the identity of the host target genes which VGAM1286 binds and inhibits, and the function of these host target genes, as elaborated hereinbelow.

Nucleotide sequences of the VGAM1286 precursor RNA, herein designated VGAM PRECURSOR RNA, and of the ‘diced’ VGAM1286 RNA, herein designated VGAM RNA, and a schematic representation of the secondary folding of VGAM1286 folded precursor RNA, herein designated VGAM FOLDED PRECURSOR RNA, of VGAM1286 are further described hereinbelow with reference to Table 1.

Nucleotide sequences of host target binding sites, such as BINDING SITE-I, BINDING SITE-II and BINDING SITE-III of FIG. 1, found on VGAM1286 host target RNA, and schematic representation of the complementarity of each of these host target binding sites to VGAM1286 RNA, herein designated VGAM RNA, are described hereinbelow with reference to Table 2.

As mentioned hereinabove with reference to FIG. 1, a function of VGAM1286 gene, herein designated VGAM is inhibition of expression of VGAM1286 target genes. It is appreciated that specific functions, and accordingly utilities, of VGAM1286 correlate with, and may be deduced from, the identity of the target genes which VGAM1286 binds and inhibits, and the function of these target genes, as elaborated hereinbelow.

Chromosome 1 Open Reading Frame 6 (C1orf6, Accession NM_020131) is a VGAM1286 host target gene. C1orf6 BINDING SITE is HOST TARGET binding site found in the 3' untranslated region of mRNA encoded by C1orf6, corresponding to a HOST TARGET binding site such as BINDING SITE I, BINDING SITE II or BINDING SITE III. Table 2 illustrates the complementarity of the nucleotide sequences of C1orf6 BINDING SITE, designated SEQ ID:21328, to the nucleotide sequence of VGAM1286 RNA, herein designated VGAM RNA, also designated SEQ ID:3997.

A function of VGAM1286 is therefore inhibition of Chromosome 1 Open Reading Frame 6 (C1orf6, Accession NM_020131), a gene which may link ataxin-1 with the chaperone and ubiquitin/proteasome pathways. Accordingly, utilities of VGAM1286 include diagnosis, prevention and treatment of diseases and clinical conditions associated with C1orf6. The function of C1orf6 has been established by previous studies. By a yeast 2-hybrid screen of an adult human brain cDNA library, Davidson et al. (2000) isolated cDNA clones which they used to assemble a complete cDNA encoding the 601-amino acid ataxin-1 ubiquitin-like interacting protein (A1U). Sequence comparison revealed that A1U contains an N-terminal ubiquitin-like region, placing it within a large family of similar proteins. In addition, A1U shows substantial homology to human UBQLN2 (OMIM Ref. No. 300264), a protein that binds the ATPase domain of the HSP70-like STCH protein (OMIM Ref. No. 601100). Expression analyses demonstrated that A1U mRNA is widely expressed as a 4.0-kb transcript and is present in Purkinje cells, the primary site of spinocerebellar ataxia-1 (SCA1; 164400) cerebellar pathology. The A1U protein localized to the nucleus and cytoplasm of transfected COS-1 cells. Sequences important for the transport of A1U into the nucleus appeared to lie within the C terminus. In the nucleus, A1U colocalized with mutant ataxin-1 (ATX1; 601556), further demonstrating that A1U interacts with ataxin-1. Davidson et al. (2000) suggested that A1U may link ataxin-1 with the chaperone and ubiquitin/proteasome pathways and that ataxin-1 may function in the formation and regulation of multimeric protein complexes within the nucleus.

Full details of the abovementioned studies are described in the following publications, the disclosure of which are hereby incorporated by reference:

Davidson, J. D.; Riley, B.; Burright, E. N.; Duvick, L. A.; Zoghbi, H. Y.; Orr, H. T.: Identification and characterization of an ataxin-1-interacting protein: A1Up, a ubiquitin-like nuclear protein. Hum. Molec. Genet. 9:2305-2312, 2000; and Fogli, A.; Giglio, S.; Arrigo, G.; Lo Nigro, C.; Zollo, M.; Viggiano, L.; Rocchi, M.; Archidiacono, N.; Zuffardi, O.; Carrozzo, R.: Identification of two paralogous regions mapping to.

Further studies establishing the function and utilities of C1orf6 are found in John Hopkins OMIM database record ID 605440, and in sited publications numbered 4794 listed in the bibliography section hereinbelow, which are also hereby incorporated by reference. Peroxisomal Biogenesis Factor 3 (PEX3, Accession NM_003630) is another VGAM1286 host target gene. PEX3 BINDING SITE is HOST TARGET binding site found in the 3' untranslated region of mRNA encoded by PEX3, corresponding to a HOST TARGET binding site such as BINDING SITE I, BINDING SITE II or BINDING SITE III. Table 2 illustrates the complementarity of the nucleotide sequences of PEX3 BINDING SITE, designated SEQ ID:9690, to the nucleotide sequence of VGAM1286 RNA, herein designated VGAM RNA, also designated SEQ ID:3997.

Another function of VGAM1286 is therefore inhibition of Peroxisomal Biogenesis Factor 3 (PEX3, Accession NM_003630). Accordingly, utilities of VGAM1286 include diagnosis, prevention and treatment of diseases and clinical conditions associated with PEX3. BCMP1 (Accession NM_031442) is another VGAM1286 host target gene. BCMP1 BINDING SITE is HOST TARGET binding site found in the 3' untranslated region of mRNA encoded by BCMP1, corresponding to a HOST TARGET binding site such as BINDING SITE I, BINDING SITE II or BINDING SITE III. Table 2 illustrates the complementarity of the nucleotide sequences of BCMP1 BINDING SITE, designated SEQ ID:25454, to the nucleotide sequence of VGAM1286 RNA, herein designated VGAM RNA, also designated SEQ ID:3997.

Another function of VGAM1286 is therefore inhibition of BCMP1 (Accession NM_031442). Accordingly, utilities of VGAM1286 include diagnosis, prevention and treatment of diseases and clinical conditions associated with BCMP1. DKFZP434F1735 (Accession NM_015590) is another VGAM1286 host target gene. DKFZP434F1735 BINDING SITE is HOST TARGET binding site found in the 5' untranslated region of mRNA encoded by DKFZP434F1735, corresponding to a HOST TARGET binding site such as BINDING SITE I, BINDING SITE II or BINDING SITE III. Table 2 illustrates the complementarity of the nucleotide sequences of DKFZP434F1735 BINDING SITE, designated SEQ ID:17857, to the nucleotide sequence of VGAM1286 RNA, herein designated VGAM RNA, also designated SEQ ID:3997.

Another function of VGAM1286 is therefore inhibition of DKFZP434F1735 (Accession NM_015590). Accordingly, utilities of VGAM1286 include diagnosis, prevention and treatment of diseases and clinical conditions associated with DKFZP434F1735. FLJ21106 (Accession NM_025097) is another VGAM1286 host target gene. FLJ21106 BINDING SITE is HOST TARGET binding site found in the 5' untranslated region of mRNA encoded by FLJ21106, corresponding to a HOST TARGET binding site such as BINDING SITE I, BINDING SITE II or BINDING SITE III. Table 2 illustrates the complementarity of the nucleotide sequences of FLJ21106 BINDING SITE, designated SEQ ID:24733, to the nucleotide sequence of VGAM1286 RNA, herein designated VGAM RNA, also designated SEQ ID:3997.

Another function of VGAM1286 is therefore inhibition of FLJ21106 (Accession NM_025097). Accordingly, utilities of VGAM1286 include diagnosis, prevention and treatment of diseases and clinical conditions associated with FLJ21106. KIAA0914 (Accession NM_014883) is another VGAM1286 host target gene. KIAA0914 BINDING SITE is HOST TAR- GET binding site found in the 3' untranslated region of mRNA encoded by KIAA0914, corresponding to a HOST TARGET binding site such as BINDING SITE I, BINDING SITE II or BINDING SITE III. Table 2 illustrates the complementarity of the nucleotide sequences of KIAA0914 BINDING SITE, designated SEQ ID:17032, to the nucleotide sequence of VGAM1286 RNA, herein designated VGAM RNA, also designated SEQ ID:3997.

Another function of VGAM1286 is therefore inhibition of KIAA0914 (Accession NM_014883). Accordingly, utilities of VGAM1286 include diagnosis, prevention and treatment of diseases and clinical conditions associated with KIAA0914. KIAA1287 (Accession XM_085753) is another VGAM1286 host target gene. KIAA1287 BINDING SITE is HOST TARGET binding site found in the 3' untranslated region of mRNA encoded by KIAA1287, corresponding to a HOST TARGET binding site such as BINDING SITE I, BINDING SITE II or BINDING SITE III. Table 2 illustrates the complementarity of the nucleotide sequences of KIAA1287 BINDING SITE, designated SEQ ID:38324, to the nucleotide sequence of VGAM1286 RNA, herein designated VGAM RNA, also designated SEQ ID:3997.

Another function of VGAM1286 is therefore inhibition of KIAA1287 (Accession XM_085753). Accordingly, utilities of VGAM1286 include diagnosis, prevention and treatment of diseases and clinical conditions associated with KIAA1287. Mitochondrial Ribosomal Protein S14 (MRPS14, Accession NM_022100) is another VGAM1286 host target gene. MRPS14 BINDING SITE is HOST TARGET binding site found in the 3' untranslated region of mRNA encoded by MRPS14, corresponding to a HOST TARGET binding site such as BINDING SITE I, BINDING SITE II or BINDING SITE III. Table 2 illustrates the complementarity of the nucleotide sequences of MRPS14 BINDING SITE, designated SEQ ID:22641, to the nucleotide sequence of VGAM1286 RNA, herein designated VGAM RNA, also designated SEQ ID:3997.

Another function of VGAM1286 is therefore inhibition of Mitochondrial Ribosomal Protein S14 (MRPS14, Accession NM_022100). Accordingly, utilities of VGAM1286 include diagnosis, prevention and treatment of diseases and clinical conditions associated with MRPS14. LOC91351 (Accession XM_037817) is another VGAM1286 host target gene. LOC91351 BINDING SITE is HOST TARGET binding site found in the 3' untranslated region of mRNA encoded by LOC91351, corresponding to a HOST TARGET binding site such as BINDING SITE I, BINDING SITE II or BINDING SITE III. Table 2 illustrates the complementarity of the nucleotide sequences of LOC91351 BINDING SITE, designated SEQ ID:32695, to the nucleotide sequence of VGAM1286 RNA, herein designated VGAM RNA, also designated SEQ ID:3997.

Another function of VGAM1286 is therefore inhibition of LOC91351 (Accession XM_037817). Accordingly, utilities of VGAM1286 include diagnosis, prevention and treatment of diseases and clinical conditions associated with LOC91351. FIG. 1 further provides a conceptual description of a novel bioinformatically detected viral gene of the present invention, referred to here as Viral Genomic Address Messenger 1287 (VGAM1287) viral gene, which modulates expression of respective host target genes thereof, the function and utility of which host target genes is known in the art.

VGAM1287 is a novel bioinformatically detected regulatory, non protein coding, viral micro RNA (miRNA) gene. The method by which VGAM1287 was detected is described hereinabove with reference to FIGS. 1-8.

VGAM1287 gene, herein designated VGAM GENE, is a viral gene contained in the genome of Beet Virus Q. VGAM1287 host target gene, herein designated VGAM HOST TARGET GENE, is a human gene contained in the human genome.

VGAM1287 gene encodes a VGAM1287 precursor RNA, herein designated VGAM PRECURSOR RNA. Similar to other miRNA genes, and unlike most ordinary genes, VGAM1287 precursor RNA does not encode a protein. A nucleotide sequence identical or highly similar to the nucleotide sequence of VGAM1287 precursor RNA is designated SEQ ID:1273, and is provided hereinbelow with reference to the sequence listing part. Nucleotide sequence SEQ ID:1273 is located at position 1305 relative to the genome of Beet Virus Q.

VGAM1287 precursor RNA folds onto itself, forming VGAM1287 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1287 folded precursor RNA into VGAM1287 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1287 RNA is designated SEQ ID:3998, and is provided hereinbelow with reference to the sequence listing part.

VGAM1287 host target gene, herein designated VGAM HOST TARGET GENE, encodes a corresponding messenger RNA, VGAM1287 host target RNA, herein designated VGAM HOST TARGET RNA. VGAM1287 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1287 RNA, herein designated VGAM RNA, binds complementarily to one or more host target binding sites located in untranslated regions of VGAM1287 host target RNA, herein designated VGAM HOST TARGET RNA. This complementary binding is due to the fact that the nucleotide sequence of VGAM1287 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1287 RNA, herein designated VGAM RNA, may have a different number of host target binding sites in untranslated regions of a VGAM1287 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1287 RNA, herein designated VGAM RNA, to host target binding sites on VGAM1287 host target RNA, herein designated VGAM HOST TARGET RNA, such as BINDING SITE I, BINDING SITE II and BINDING SITE III, inhibits translation of VGAM1287 host target RNA into VGAM1287 host target protein, herein designated VGAM HOST TARGET PROTEIN. VGAM host target protein is therefore outlined by a broken line.

It is appreciated that VGAM1287 host target gene, herein designated VGAM HOST TARGET GENE, in fact represents a plurality of VGAM1287 host target genes. The mRNA of each one of this plurality of VGAM1287 host target genes comprises one or more host target binding sites, each having a nucleotide sequence which is at least partly complementary to VGAM1287 RNA, herein designated VGAM RNA, and which when bound by VGAM1287 RNA causes inhibition of translation of respective one or more VGAM1287 host target proteins.

It is further appreciated by one skilled in the art that the mode of translational inhibition illustrated by FIG. 1 with specific reference to translational inhibition exerted by VGAM1287 gene, herein designated VGAM GENE, on one or more VGAM1287 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1287 is inhibition of expression of host target genes, as part of a novel viral mechanism of attacking a host. Accordingly, utilities of VGAM1287 include diagnosis, prevention and treatment of viral infection by Beet Virus Q. Specific functions, and accordingly utilities, of VGAM1287 correlate with, and may be deduced from, the identity of the host target genes which VGAM1287 binds and inhibits, and the function of these host target genes, as elaborated hereinbelow.

Nucleotide sequences of the VGAM1287 precursor RNA, herein designated VGAM PRECURSOR RNA, and of the 'diced' VGAM1287 RNA, herein designated VGAM RNA, and a schematic representation of the secondary folding of VGAM1287 folded precursor RNA, herein designated VGAM FOLDED PRECURSOR RNA, of VGAM1287 are further described hereinbelow with reference to Table 1.

Nucleotide sequences of host target binding sites, such as BINDING SITE-I, BINDING SITE-II and BINDING SITE-III of FIG. 1, found on VGAM1287 host target RNA, and schematic representation of the complementarity of each of these host target binding sites to VGAM1287 RNA, herein designated VGAM RNA, are described hereinbelow with reference to Table 2.

As mentioned hereinabove with reference to FIG. 1, a function of VGAM1287 gene, herein designated VGAM is inhibition of expression of VGAM1287 target genes. It is appreciated that specific functions, and accordingly utilities, of VGAM1287 correlate with, and may be deduced from, the identity of the target genes which VGAM1287 binds and inhibits, and the function of these target genes, as elaborated hereinbelow.

ATPase, Cu++ Transporting, Alpha Polypeptide (Menkes syndrome) (ATP7A, Accession NM_000052) is a VGAM1287 host target gene. ATP7A BINDING SITE is HOST TARGET binding site found in the 3' untranslated region of mRNA encoded by ATP7A, corresponding to a HOST TARGET binding site such as BINDING SITE I, BINDING SITE II or BINDING SITE III. Table 2 illustrates the complementarity of the nucleotide sequences of ATP7A BINDING SITE, designated SEQ ID:5492, to the nucleotide sequence of VGAM1287 RNA, herein designated VGAM RNA, also designated SEQ ID:3998.

A function of VGAM1287 is therefore inhibition of ATPase, Cu++ Transporting, Alpha Polypeptide (Menkes syndrome) (ATP7A, Accession NM_000052). Accordingly, utilities of VGAM1287 include diagnosis, prevention and treatment of diseases and clinical conditions associated with ATP7A. CGTHBA (Accession NM_012075) is another VGAM1287 host target gene. CGTHBA BINDING SITE is HOST TARGET binding site found in the 3' untranslated region of mRNA encoded by CGTHBA, corresponding to a HOST TARGET binding site such as BINDING SITE I, BINDING SITE II or BINDING SITE III. Table 2 illustrates the complementarity of the nucleotide sequences of CGTHBA BINDING SITE, designated SEQ ID:14355, to the nucleotide sequence of VGAM1287 RNA, herein designated VGAM RNA, also designated SEQ ID:3998.

Another function of VGAM1287 is therefore inhibition of CGTHBA (Accession NM_012075). Accordingly, utilities of VGAM1287 include diagnosis, prevention and treatment of diseases and clinical conditions associated with CGTHBA. Estrogen-related Receptor Gamma (ESRRG, Accession XM_039053) is another VGAM1287 host target gene. ESRRG BINDING SITE is HOST TARGET binding site found in the 3' untranslated region of mRNA encoded by ESRRG, corresponding to a HOST TARGET binding site such as BINDING SITE I, BINDING SITE II or BINDING SITE III. Table 2 illustrates the complementarity of the nucleotide sequences of ESRRG BINDING SITE, designated SEQ ID:32997, to the nucleotide sequence of VGAM1287 RNA, herein designated VGAM RNA, also designated SEQ ID:3998.

Another function of VGAM1287 is therefore inhibition of Estrogen-related Receptor Gamma (ESRRG, Accession XM_039053), a gene which Estrogen-related receptor gamma. Accordingly, utilities of VGAM1287 include diagnosis, prevention and treatment of diseases and clinical conditions associated with ESRRG. The function of ESRRG and its association with various diseases and clinical conditions, has been established by previous studies, as described hereinabove with reference to VGAM359. Regulatory Factor X, 5 (influences HLA class II expression) (RFX5, Accession NM_000449) is another VGAM1287 host target gene. RFX5 BINDING SITE is HOST TARGET binding site found in the 3' untranslated region of mRNA encoded by RFX5, corresponding to a HOST TARGET binding site such as BINDING SITE I, BINDING SITE II or BINDING SITE III. Table 2 illustrates the complementarity of the nucleotide sequences of RFX5 BINDING SITE, designated SEQ ID:6045, to the nucleotide sequence of VGAM1287 RNA, herein designated VGAM RNA, also designated SEQ ID:3998.

Another function of VGAM1287 is therefore inhibition of Regulatory Factor X, 5 (influences HLA class II expression) (RFX5, Accession NM_000449), a gene which activates transcription from class ii mhc promoters. Accordingly, utilities of VGAM1287 include diagnosis, prevention and treatment of diseases and clinical conditions associated with RFX5. The function of RFX5 and its association with various diseases and clinical conditions, has been established by previous studies, as described hereinabove with reference to VGAM55. Suppressor of Fused Homolog (Drosophila) (SUFU, Accession NM_016169) is another VGAM1287 host target gene. SUFU BINDING SITE is HOST TARGET binding site found in the 3' untranslated region of mRNA encoded by SUFU, corresponding to a HOST TARGET binding site such as BINDING SITE I, BINDING SITE II or BINDING SITE III. Table 2 illustrates the complementarity of the nucleotide sequences of SUFU BINDING SITE, designated SEQ ID:18251, to the nucleotide sequence of VGAM1287 RNA, herein designated VGAM RNA, also designated SEQ ID:3998.

Another function of VGAM1287 is therefore inhibition of Suppressor of Fused Homolog (Drosophila) (SUFU, Accession NM_016169). Accordingly, utilities of VGAM1287 include diagnosis, prevention and treatment of diseases and clinical conditions associated with SUFU. DJ971N18.2 (Accession NM_021156) is another VGAM1287 host target gene. DJ971N18.2 BINDING SITE is HOST TARGET binding site found in the 3' untranslated region of mRNA encoded by DJ971N18.2, corresponding to a HOST TARGET binding site such as BINDING SITE I, BINDING SITE II or BINDING SITE III. Table 2 illustrates the complementarity of the nucleotide sequences of DJ971N18.2 BINDING SITE, designated SEQ ID:22133, to the nucleotide sequence of VGAM1287 RNA, herein designated VGAM RNA, also designated SEQ ID:3998.

Another function of VGAM1287 is therefore inhibition of DJ971N18.2 (Accession NM_021156). Accordingly, utilities of VGAM1287 include diagnosis, prevention and treatment of diseases and clinical conditions associated with DJ971N18.2. FLJ20079 (Accession NM_017656) is another VGAM1287 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19170, to the nucleotide sequence of VGAM1287 RNA, herein designated VGAM RNA, also designated SEQ ID:3998.

Another function of VGAM1287 is therefore inhibition of FLJ20079 (Accession NM_017656). Accordingly, utilities of VGAM1287 include diagnosis, prevention and treatment of diseases and clinical conditions associated with FLJ20079. KIAA1949 (Accession XM_175173) is another VGAM1287 host target gene. KIAA1949 BINDING SITE1 through KIAA1949 BINDING SITE3 are HOST TARGET binding sites found in untranslated regions of mRNA encoded by KIAA1949, corresponding to HOST TARGET binding sites such as BINDING SITE I, BINDING SITE II or BINDING SITE III. Table 2 illustrates the complementarity of the nucleotide sequences of KIAA1949 BINDING SITE1 through KIAA1949 BINDING SITE3, designated SEQ ID:46667, SEQ ID:44208 and SEQ ID:46712 respectively, to the nucleotide sequence of VGAM1287 RNA, herein designated VGAM RNA, also designated SEQ ID:3998.

Another function of VGAM1287 is therefore inhibition of KIAA1949 (Accession XM_175173). Accordingly, utilities of VGAM1287 include diagnosis, prevention and treatment of diseases and clinical conditions associated with KIAA1949. Testis-specific Transcript, Y-linked 2 (TTTY2, Accession XM_099029) is another VGAM1287 host target gene. TTTY2 BINDING SITE is HOST TARGET binding site found in the 5' untranslated region of mRNA encoded by TTTY2, corresponding to a HOST TARGET binding site such as BINDING SITE I, BINDING SITE II or BINDING SITE III. Table 2 illustrates the complementarity of the nucleotide sequences of TTTY2 BINDING SITE, designated SEQ ID:42070, to the nucleotide sequence of VGAM1287 RNA, herein designated VGAM RNA, also designated SEQ ID:3998.

Another function of VGAM1287 is therefore inhibition of Testis-specific Transcript, Y-linked 2 (TTTY2, Accession XM_099029). Accordingly, utilities of VGAM1287 include diagnosis, prevention and treatment of diseases and clinical conditions associated with TTTY2. LOC159148 (Accession XM_099030) is another VGAM1287 host target gene. LOC159148 BINDING SITE is HOST TARGET binding site found in the 5' untranslated region of mRNA encoded by LOC159148, corresponding to a HOST TARGET binding site such as BINDING SITE I, BINDING SITE II or BINDING SITE III. Table 2 illustrates the complementarity of the nucleotide sequences of LOC159148 BINDING SITE, designated SEQ ID:42077, to the nucleotide sequence of VGAM1287 RNA, herein designated VGAM RNA, also designated SEQ ID:3998.

Another function of VGAM1287 is therefore inhibition of LOC159148 (Accession XM_099030). Accordingly, utilities of VGAM1287 include diagnosis, prevention and treatment of diseases and clinical conditions associated with LOC159148. LOC199692 (Accession NM_145295) is another VGAM1287 host target gene. LOC199692 BINDING SITE is HOST TARGET binding site found in the 3' untranslated region of mRNA encoded by LOC199692, corresponding to a HOST TARGET binding site such as BINDING SITE I, BINDING SITE II or BINDING SITE III. Table 2 illustrates the complementarity of the nucleotide sequences of LOC199692 BINDING SITE, designated SEQ ID:29810, to the nucleotide sequence of VGAM1287 RNA, herein designated VGAM RNA, also designated SEQ ID:3998.

Another function of VGAM1287 is therefore inhibition of LOC199692 (Accession NM_145295). Accordingly, utilities of VGAM1287 include diagnosis, prevention and treatment of diseases and clinical conditions associated with LOC199692. LOC91012 (Accession XM_035503) is another VGAM1287 host target gene. LOC91012 BINDING SITE is HOST TARGET binding site found in the 3' untranslated region of mRNA encoded by LOC91012, corresponding to a HOST TARGET binding site such as BINDING SITE I, BINDING SITE II or BINDING SITE III. Table 2 illustrates the complementarity of the nucleotide sequences of LOC91012 BINDING SITE, designated SEQ ID:32280, to the nucleotide sequence of VGAM1287 RNA, herein designated VGAM RNA, also designated SEQ ID:3998.

Another function of VGAM1287 is therefore inhibition of LOC91012 (Accession XM_035503). Accordingly, utilities of VGAM1287 include diagnosis, prevention and treatment of diseases and clinical conditions associated with LOC91012. FIG. 1 further provides a conceptual description of a novel bioinformatically detected viral gene of the present invention, referred to here as Viral Genomic Address Messenger 1288 (VGAM1288) viral gene, which modulates expression of respective host target genes thereof, the function and utility of which host target genes is known in the art.

VGAM1288 is a novel bioinformatically detected regulatory, non protein coding, viral micro RNA (miRNA) gene. The method by which VGAM1288 was detected is described hereinabove with reference to FIGS. 1-8.

VGAM1288 gene, herein designated VGAM GENE, is a viral gene contained in the genome of Saimiriine Herpesvirus 2. VGAM1288 host target gene, herein designated VGAM HOST TARGET GENE, is a human gene contained in the human genome.

VGAM1288 gene encodes a VGAM1288 precursor RNA, herein designated VGAM PRECURSOR RNA. Similar to other miRNA genes, and unlike most ordinary genes, VGAM1288 precursor RNA does not encode a protein. A nucleotide sequence identical or highly similar to the nucleotide sequence of VGAM1288 precursor RNA is designated SEQ ID:1274, and is provided hereinbelow with reference to the sequence listing part. Nucleotide sequence SEQ ID:1274 is located at position 9116 relative to the genome of Saimiriine Herpesvirus 2.

VGAM1288 precursor RNA folds onto itself, forming VGAM1288 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1288 folded precursor RNA into VGAM1288 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM1288 RNA is designated SEQ ID:3999, and is provided hereinbelow with reference to the sequence listing part.

VGAM1288 host target gene, herein designated VGAM HOST TARGET GENE, encodes a corresponding messenger RNA, VGAM1288 host target RNA, herein designated VGAM HOST TARGET RNA. VGAM1288 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1288 RNA, herein designated VGAM RNA, binds complementarily to one or more host target binding sites located in untranslated regions of VGAM1288 host target RNA, herein designated VGAM HOST TARGET RNA. This complementary binding is due to the fact that the nucleotide sequence of VGAM1288 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1288 RNA, herein designated VGAM RNA, may have a different number of host target binding sites in untranslated regions of a VGAM1288 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1288 RNA, herein designated VGAM RNA, to host target binding sites on VGAM1288 host target RNA, herein designated VGAM HOST TARGET RNA, such as BINDING SITE I, BINDING SITE II and BINDING SITE III, inhibits translation of VGAM1288 host target RNA into VGAM1288 host target protein, herein designated VGAM HOST TARGET PROTEIN. VGAM host target protein is therefore outlined by a broken line.

It is appreciated that VGAM1288 host target gene, herein designated VGAM HOST TARGET GENE, in fact represents a plurality of VGAM1288 host target genes. The mRNA of each one of this plurality of VGAM1288 host target genes comprises one or more host target binding sites, each having a nucleotide sequence which is at least partly complementary to VGAM1288 RNA, herein designated VGAM RNA, and which when bound by VGAM1288 RNA causes inhibition of translation of respective one or more VGAM1288 host target proteins.

It is further appreciated by one skilled in the art that the mode of translational inhibition illustrated by FIG. 1 with specific reference to translational inhibition exerted by VGAM1288 gene, herein designated VGAM GENE, on one or more VGAM1288 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1288 is inhibition of expression of host target genes, as part of a novel viral mechanism of attacking a host. Accordingly, utilities of VGAM1288 include diagnosis, prevention and treatment of viral infection by Saimiriine Herpesvirus 2. Specific functions, and accordingly utilities, of VGAM1288 correlate with, and may be deduced from, the identity of the host target genes which VGAM1288 binds and inhibits, and the function of these host target genes, as elaborated hereinbelow.

Nucleotide sequences of the VGAM1288 precursor RNA, herein designated VGAM PRECURSOR RNA, and of the 'diced' VGAM1288 RNA, herein designated VGAM RNA, and a schematic representation of the secondary folding of VGAM1288 folded precursor RNA, herein designated VGAM FOLDED PRECURSOR RNA, of VGAM1288 are further described hereinbelow with reference to Table 1.

Nucleotide sequences of host target binding sites, such as BINDING SITE-I, BINDING SITE-II and BINDING SITE-III of FIG. 1, found on VGAM1288 host target RNA, and schematic representation of the complementarity of each of these host target binding sites to VGAM1288 RNA, herein designated VGAM RNA, are described hereinbelow with reference to Table 2.

As mentioned hereinabove with reference to FIG. 1, a function of VGAM1288 gene, herein designated VGAM is inhibition of expression of VGAM1288 target genes. It is appreciated that specific functions, and accordingly utilities, of VGAM1288 correlate with, and may be deduced from, the identity of the target genes which VGAM1288 binds and inhibits, and the function of these target genes, as elaborated hereinbelow.

Fucosyltransferase 6 (alpha (1,3) Fucosyltransferase) (FUT6, Accession NM_000150) is a VGAM1288 host target gene. FUT6 BINDING SITE is HOST TARGET binding site found in the 5' untranslated region of mRNA encoded by FUT6, corresponding to a HOST TARGET binding site such as BINDING SITE I, BINDING SITE II or BINDING SITE III. Table 2 illustrates the complementarity of the nucleotide sequences of FUT6 BINDING SITE, designated SEQ ID:5649, to the nucleotide sequence of VGAM1288 RNA, herein designated VGAM RNA, also designated SEQ ID:3999.

A function of VGAM1288 is therefore inhibition of Fucosyltransferase 6 (alpha (1,3) Fucosyltransferase) (FUT6, Accession NM_000150), a gene which is involved in the biosynthesis of the e-selectin ligand, sialyl-lewis x. catalyzes the transfer of fucose from gdp-beta-fucose to alpha-2,3 sialylated substrates. Accordingly, utilities of VGAM1288 include diagnosis, prevention and treatment of diseases and clinical conditions associated with FUT6. The function of FUT6 and its association with various diseases and clinical conditions, has been established by previous studies, as described hereinabove with reference to VGAM194. Protein Kinase C, Nu (PRKCN, Accession NM_005813) is another VGAM1288 host target gene. PRKCN BINDING SITE is HOST TARGET binding site found in the 3' untranslated region of mRNA encoded by PRKCN, corresponding to a HOST TARGET binding site such as BINDING SITE I, BINDING SITE II or BINDING SITE III. Table 2 illustrates the complementarity of the nucleotide sequences of PRKCN BINDING SITE, designated SEQ ID:12399, to the nucleotide sequence of VGAM1288 RNA, herein designated VGAM RNA, also designated SEQ ID:3999.

Another function of VGAM1288 is therefore inhibition of Protein Kinase C, Nu (PRKCN, Accession NM_005813). Accordingly, utilities of VGAM1288 include diagnosis, prevention and treatment of diseases and clinical conditions associated with PRKCN. SWI/SNF Related, Matrix Associated, Actin Dependent Regulator of Chromatin, Subfamily D, Member 2 (SMARCD2, Accession NM_003077) is another VGAM1288 host target gene. SMARCD2 BINDING SITE is HOST TARGET binding site found in the 3' untranslated region of mRNA encoded by SMARCD2, corresponding to a HOST TARGET binding site such as BINDING SITE I, BINDING SITE II or BINDING SITE III. Table 2 illustrates the complementarity of the nucleotide sequences of SMARCD2 BINDING SITE, designated SEQ ID:9052, to the nucleotide sequence of VGAM1288 RNA, herein designated VGAM RNA, also designated SEQ ID:3999.

Another function of VGAM1288 is therefore inhibition of SWI/SNF Related, Matrix Associated, Actin Dependent Regulator of Chromatin, Subfamily D, Member 2 (SMARCD2, Accession NM_003077), a gene which is involved in chromatin remodeling. Accordingly, utilities of VGAM1288 include diagnosis, prevention and treatment of diseases and clinical conditions associated with SMARCD2. The function of SMARCD2 and its association with various diseases and clinical conditions, has been established by previous studies, as described hereinabove with reference to VGAM554. Surfeit 5 (SURF5, Accession NM_006752) is another VGAM1288 host target gene. SURF5 BINDING SITE is HOST TARGET binding site found in the 3' untranslated region of mRNA encoded by SURF5, corresponding to a HOST TARGET binding site such as BINDING SITE I, BINDING SITE II or BINDING SITE III. Table 2 illustrates the complementarity of the nucleotide sequences of SURF5 BINDING SITE, designated SEQ ID:13605, to the nucleotide sequence of VGAM1288 RNA, herein designated VGAM RNA, also designated SEQ ID:3999.

Another function of VGAM1288 is therefore inhibition of Surfeit 5 (SURF5, Accession NM_006752). Accordingly, utilities of VGAM1288 include diagnosis, prevention and treatment of diseases and clinical conditions associated with SURF5. FLJ11142 (Accession NM_018338) is another VGAM1288 host target gene. FLJ11142 BINDING SITE is HOST TARGET binding site found in the 3' untranslated region of mRNA encoded by FLJ11142, corresponding to a HOST TARGET binding site such as BINDING SITE I, BINDING SITE II or BINDING SITE III. Table 2 illustrates the complementarity of the nucleotide sequences of FLJ11142 BINDING SITE, designated SEQ ID:20342, to the nucleotide sequence of VGAM1288 RNA, herein designated VGAM RNA, also designated SEQ ID:3999.

Another function of VGAM1288 is therefore inhibition of FLJ11142 (Accession NM_018338). Accordingly, utilities of VGAM1288 include diagnosis, prevention and treatment of diseases and clinical conditions associated with FLJ11142. KIAA0256 (Accession XM_034905) is another VGAM1288 host target gene. KIAA0256 BINDING SITE is HOST TARGET binding site found in the 3' untranslated region of mRNA encoded by KIAA0256, corresponding to a HOST TARGET binding site such as BINDING SITE I, BINDING SITE II or BINDING SITE III. Table 2 illustrates the complementarity of the nucleotide sequences of KIAA0256 BINDING SITE, designated SEQ ID:32186, to the nucleotide sequence of VGAM1288 RNA, herein designated VGAM RNA, also designated SEQ ID:3999.

Another function of VGAM1288 is therefore inhibition of KIAA0256 (Accession XM_034905). Accordingly, utilities of VGAM1288 include diagnosis, prevention and treatment of diseases and clinical conditions associated with KIAA0256. KIAA1450 (Accession XM_038035) is another VGAM1288 host target gene. KIAA1450 BINDING SITE is HOST TARGET binding site found in the 3' untranslated region of mRNA encoded by KIAA1450, corresponding to a HOST TARGET binding site such as BINDING SITE I, BINDING SITE II or BINDING SITE III. Table 2 illustrates the complementarity of the nucleotide sequences of KIAA1450 BINDING SITE, designated SEQ ID:32748, to the nucleotide sequence of VGAM1288 RNA, herein designated VGAM RNA, also designated SEQ ID:3999.

Another function of VGAM1288 is therefore inhibition of KIAA1450 (Accession XM_038035). Accordingly, utilities of VGAM1288 include diagnosis, prevention and treatment of diseases and clinical conditions associated with KIAA1450. KIAA1829 (Accession XM_030378) is another VGAM1288 host target gene. KIAA1829 BINDING SITE is HOST TARGET binding site found in the 3' untranslated region of mRNA encoded by KIAA1829, corresponding to a HOST TARGET binding site such as BINDING SITE I, BINDING SITE II or BINDING SITE III. Table 2 illustrates the complementarity of the nucleotide sequences of KIAA1829 BINDING SITE, designated SEQ ID:31032, to the nucleotide sequence of VGAM1288 RNA, herein designated VGAM RNA, also designated SEQ ID:3999.

Another function of VGAM1288 is therefore inhibition of KIAA1829 (Accession XM_030378). Accordingly, utilities of VGAM1288 include diagnosis, prevention and treatment of diseases and clinical conditions associated with KIAA1829. PRO1580 (Accession NM_018502) is another VGAM1288 host target gene. PRO1580 BINDING SITE is HOST TARGET binding site found in the 5' untranslated region of mRNA encoded by PRO1580, corresponding to a HOST TARGET binding site such as BINDING SITE I, BINDING SITE II or BINDING SITE III. Table 2 illustrates the complementarity of the nucleotide sequences of PRO1580 BINDING SITE, designated SEQ ID:20566, to the nucleotide sequence of VGAM1288 RNA, herein designated VGAM RNA, also designated SEQ ID:3999.

Another function of VGAM1288 is therefore inhibition of PRO1580 (Accession NM_018502). Accordingly, utilities of VGAM1288 include diagnosis, prevention and treatment of diseases and clinical conditions associated with PRO1580. LOC149373 (Accession XM_086507) is another VGAM1288 host target gene. LOC149373 BINDING SITE is HOST TARGET binding site found in the 3' untranslated region of mRNA encoded by LOC149373, corresponding to a HOST TARGET binding site such as BINDING SITE I, BINDING SITE II or BINDING SITE III. Table 2 illustrates the complementarity of the nucleotide sequences of LOC149373 BINDING SITE, designated SEQ ID:38718, to the nucleotide sequence of VGAM1288 RNA, herein designated VGAM RNA, also designated SEQ ID:3999.

Another function of VGAM1288 is therefore inhibition of LOC149373 (Accession XM_086507). Accordingly, utilities of VGAM1288 include diagnosis, prevention and treatment of diseases and clinical conditions associated with LOC149373. LOC165246 (Accession XM_092473) is another VGAM1288 host target gene. LOC165246 BINDING SITE is HOST TARGET binding site found in the 5' untranslated region of mRNA encoded by LOC165246, corresponding to a HOST TARGET binding site such as BINDING SITE I, BINDING SITE II or BINDING SITE III. Table 2 illustrates the complementarity of the nucleotide sequences of LOC165246 BINDING SITE, designated SEQ ID:40126, to the nucleotide sequence of VGAM1288 RNA, herein designated VGAM RNA, also designated SEQ ID:3999.

Another function of VGAM1288 is therefore inhibition of LOC165246 (Accession XM_092473). Accordingly, utilities of VGAM1288 include diagnosis, prevention and treatment of diseases and clinical conditions associated with LOC165246. LOC256207 (Accession XM_170837) is another VGAM1288 host target gene. LOC256207 BINDING SITE is HOST TARGET binding site found in the 3' untranslated region of mRNA encoded by LOC256207, corresponding to a HOST TARGET binding site such as BINDING SITE I, BINDING SITE II or BINDING SITE III. Table 2 illustrates the complementarity of the nucleotide sequences of LOC256207 BINDING SITE, designated SEQ ID:45620, to the nucleotide sequence of VGAM1288 RNA, herein designated VGAM RNA, also designated SEQ ID:3999.

Another function of VGAM1288 is therefore inhibition of LOC256207 (Accession XM_170837). Accordingly, utilities of VGAM1288 include diagnosis, prevention and treatment of diseases and clinical conditions associated with LOC256207. LOC90459 (Accession XM_031826) is another VGAM1288 host target gene. LOC90459 BINDING SITE is HOST TARGET binding site found in the 3' untranslated region of mRNA encoded by LOC90459, corresponding to a HOST TARGET binding site such as BINDING SITE I, BINDING SITE II or BINDING SITE III. Table 2 illustrates the complementarity of the nucleotide sequences of LOC90459 BINDING SITE, designated SEQ ID:31489, to the nucleotide sequence of VGAM1288 RNA, herein designated VGAM RNA, also designated SEQ ID:3999.

Another function of VGAM1288 is therefore inhibition of LOC90459 (Accession XM_031826). Accordingly, utilities of VGAM1288 include diagnosis, prevention and treatment of diseases and clinical conditions associated with LOC90459. FIG. 1 further provides a conceptual description of a novel bioinformatically detected viral gene of the present invention, referred to here as Viral Genomic Address Messenger 1289 (VGAM1289) viral gene, which modulates expression of respective host target genes thereof, the function and utility of which host target genes is known in the art.

VGAM1289 is a novel bioinformatically detected regulatory, non protein coding, viral micro RNA (miRNA) gene. The method by which VGAM1289 was detected is described hereinabove with reference to FIGS. 1-8.

VGAM1289 gene, herein designated VGAM GENE, is a viral gene contained in the genome of Saimiriine Herpesvirus 2. VGAM1289 host target gene, herein designated VGAM HOST TARGET GENE, is a human gene contained in the human genome.

VGAM1289 gene encodes a VGAM1289 precursor RNA, herein designated VGAM PRECURSOR RNA. Similar to other miRNA genes, and unlike most ordinary genes, VGAM1289 precursor RNA does not encode a protein. A nucleotide sequence identical or highly similar to the nucleotide sequence of VGAM1289 precursor RNA is designated SEQ ID:1275, and is provided hereinbelow with reference to the sequence listing part. Nucleotide sequence SEQ ID:1275 is located at position 9692 relative to the genome of Saimiriine Herpesvirus 2.

VGAM1289 precursor RNA folds onto itself, forming VGAM1289 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1289 folded precursor RNA into VGAM1289 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 81%) nucleotide sequence of VGAM1289 RNA is designated SEQ ID:4000, and is provided hereinbelow with reference to the sequence listing part.

VGAM1289 host target gene, herein designated VGAM HOST TARGET GENE, encodes a corresponding messenger RNA, VGAM1289 host target RNA, herein designated VGAM HOST TARGET RNA. VGAM1289 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1289 RNA, herein designated VGAM RNA, binds complementarily to one or more host target binding sites located in untranslated regions of VGAM1289 host target RNA, herein designated VGAM HOST TARGET RNA. This complementary binding is due to the fact that the nucleotide sequence of VGAM1289 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1289 RNA, herein designated VGAM RNA, may have a different number of host target binding sites in untranslated regions of a VGAM1289 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1289 RNA, herein designated VGAM RNA, to host target binding sites on VGAM1289 host target RNA, herein designated VGAM HOST TARGET RNA, such as BINDING SITE I, BINDING SITE II and BINDING SITE III, inhibits translation of VGAM1289 host target RNA into VGAM1289 host target protein, herein designated VGAM HOST TARGET PROTEIN. VGAM host target protein is therefore outlined by a broken line.

It is appreciated that VGAM1289 host target gene, herein designated VGAM HOST TARGET GENE, in fact represents a plurality of VGAM1289 host target genes. The mRNA of each one of this plurality of VGAM1289 host target genes comprises one or more host target binding sites, each having a nucleotide sequence which is at least partly complementary to VGAM1289 RNA, herein designated VGAM RNA, and which when bound by VGAM1289 RNA causes inhibition of translation of respective one or more VGAM1289 host target proteins.

It is further appreciated by one skilled in the art that the mode of translational inhibition illustrated by FIG. 1 with specific reference to translational inhibition exerted by VGAM1289 gene, herein designated VGAM GENE, on one or more VGAM1289 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1289 is inhibition of expression of host target genes, as part of a novel viral mechanism of attacking a host. Accordingly, utilities of VGAM1289 include diagnosis, prevention and treatment of viral infection by Saimiriine Herpesvirus 2. Specific functions, and accordingly utilities, of VGAM1289 correlate with, and may be deduced from, the identity of the host target genes which VGAM1289 binds and inhibits, and the function of these host target genes, as elaborated hereinbelow.

Nucleotide sequences of the VGAM1289 precursor RNA, herein designated VGAM PRECURSOR RNA, and of the 'diced' VGAM1289 RNA, herein designated VGAM RNA, and a schematic representation of the secondary folding of VGAM1289 folded precursor RNA, herein designated VGAM FOLDED PRECURSOR RNA, of VGAM1289 are further described hereinbelow with reference to Table 1.

Nucleotide sequences of host target binding sites, such as BINDING SITE-I, BINDING SITE-II and BINDING SITE-III of FIG. 1, found on VGAM1289 host target RNA, and schematic representation of the complementarity of each of these host target binding sites to VGAM1289 RNA, herein designated VGAM RNA, are described hereinbelow with reference to Table 2.

As mentioned hereinabove with reference to FIG. 1, a function of VGAM1289 gene, herein designated VGAM is inhibition of expression of VGAM1289 target genes. It is appreciated that specific functions, and accordingly utilities, of VGAM1289 correlate with, and may be deduced from, the identity of the target genes which VGAM1289 binds and inhibits, and the function of these target genes, as elaborated hereinbelow.

Cyclin D2 (CCND2, Accession NM_001759) is a VGAM1289 host target gene. CCND2 BINDING SITE is HOST TARGET binding site found in the 3' untranslated region of mRNA encoded by CCND2, corresponding to a HOST TARGET binding site such as BINDING SITE I, BINDING SITE II or BINDING SITE III. Table 2 illustrates the complementarity of the nucleotide sequences of CCND2 BINDING SITE, designated SEQ ID:7513, to the nucleotide sequence of VGAM1289 RNA, herein designated VGAM RNA, also designated SEQ ID:4000.

A function of VGAM1289 is therefore inhibition of Cyclin D2 (CCND2, Accession NM_001759), a gene which is essential for the control of the cell cycle at the g1/s (start) transition. Accordingly, utilities of VGAM1289 include diagnosis, prevention and treatment of diseases and clinical conditions associated with CCND2. The function of CCND2 and its association with various diseases and clinical conditions, has been established by previous studies, as described hereinabove with reference to VGAM128. EphA2 (EPHA2, Accession NM_004431) is another VGAM1289 host target gene. EPHA2 BINDING SITE is HOST TARGET binding site found in the 3' untranslated region of mRNA encoded by EPHA2, corresponding to a HOST TARGET binding site such as BINDING SITE I, BINDING SITE II or BINDING SITE III. Table 2 illustrates the complementarity of the nucleotide sequences of EPHA2 BINDING SITE, designated SEQ ID:10714, to the nucleotide sequence of VGAM1289 RNA, herein designated VGAM RNA, also designated SEQ ID:4000.

Another function of VGAM1289 is therefore inhibition of EphA2 (EPHA2, Accession NM_004431), a gene which binds to ephrin-a1, -a3, -a4 and -a5. Accordingly, utilities of VGAM1289 include diagnosis, prevention and treatment of diseases and clinical conditions associated with EPHA2. The function of EPHA2 has been established by previous studies. See 179610 for background on Eph receptors and their ligands, the ephrins. By screening a HeLa cell cDNA library with degenerate oligonucleotides based on highly conserved regions of receptor protein-tyrosine kinases, Lindberg and Hunter (1990) isolated cDNAs encoding EPHA2, named ECK by them. The predicted 976-amino acid protein consists of a 534-amino acid external domain that includes a signal peptide; a 24-amino acid transmembrane domain; and a 418-amino acid cytoplasmic domain that contains a canonical protein-tyrosine kinase catalytic domain. Immunoprecipitated ECK from human cells migrated as an approximately 125- to 130-kD doublet by SDS-PAGE. Northern blot analysis detected an approximately 4.7-kb ECK transcript in human cells. Rat Eck mRNA is highly expressed in tissues that contain a high proportion of epithelial cells, including lung, skin, small intestine, and ovary. Immunohistochemical analysis detected rat Eck protein in lung and kidney epithelial cells. By somatic cell hybrid analysis and fluorescence in situ hybridization, Sulman et al. (1997) mapped the EPHA2 gene, called ECK by them, to 1p36.1. They noted that there appears to be clusters of EPH genes on several chromosomes. Ganju et al. (1994) mapped the mouse Eck gene to the distal region of chromosome 4, between the Akp2 (OMIM Ref. No. 171760) and Gpd1 (OMIM Ref. No. 138420) genes. They noted that this region shows homology of synteny with human 1p36-p34.

Full details of the abovementioned studies are described in the following publications, the disclosure of which are hereby incorporated by reference:

Lindberg, R. A.; Hunter, T.: cDNA cloning and characterization of eck, an epithelial cell receptor-tyrosine kinase in the eph/elk family of protein kinases. Molec. Cell. Biol. 10:6316-6324, 1990; and Sulman, E. P.; Tang, X. X.; Allen, C.; Biegel, J. A.; Pleasure, D. E.; Brodeur, G. M.; Ikegaki, N.: ECK, a human EPH-related gene, maps to 1p36.1, a common region of alteration in human.

Further studies establishing the function and utilities of EPHA2 are found in John Hopkins OMIM database record ID 176946, and in sited publications numbered 12702-12704 listed in the bibliography section hereinbelow, which are also hereby incorporated by reference. Ubiquitination Factor E4A (UFD2 homolog, yeast) (UBE4A, Accession NM_004788) is another VGAM1289 host target gene. UBE4A BINDING SITE is HOST TARGET binding site found in the 3' untranslated region of mRNA encoded by UBE4A, corresponding to a HOST TARGET binding site such as BINDING SITE I, BINDING SITE II or BINDING SITE III. Table 2 illustrates the complementarity of the nucleotide sequences of UBE4A BINDING SITE, designated SEQ ID:11197, to the nucleotide sequence of VGAM1289 RNA, herein designated VGAM RNA, also designated SEQ ID:4000.

Another function of VGAM1289 is therefore inhibition of Ubiquitination Factor E4A (UFD2 homolog, yeast) (UBE4A, Accession NM_004788), a gene which binds to the ubiquitin moieties of preformed conjugates and catalyzes ubiquitin chain assembly in conjunction with E1, E2, and E3. Accordingly, utilities of VGAM1289 include diagnosis, prevention and treatment of diseases and clinical conditions associated with UBE4A. The function of UBE4A and its association with various diseases and clinical conditions, has been established by previous studies, as described hereinabove with reference to VGAM60. DKFZP434P0721 (Accession XM_033181) is another VGAM1289 host target gene. DKFZP434P0721 BINDING SITE is HOST TARGET binding site found in the 3' untranslated region of mRNA encoded by DKFZP434P0721, corresponding to a HOST TARGET binding site such as BINDING SITE I, BINDING SITE II or BINDING SITE III. Table 2 illustrates the complementarity of the nucleotide sequences of DKFZP434P0721 BINDING SITE, designated SEQ ID:31874, to the nucleotide sequence of VGAM1289 RNA, herein designated VGAM RNA, also designated SEQ ID:4000.

Another function of VGAM1289 is therefore inhibition of DKFZP434P0721 (Accession XM_033181). Accordingly, utilities of VGAM1289 include diagnosis, prevention and treatment of diseases and clinical conditions associated with DKFZP434P0721. FLJ10287 (Accession NM_019083) is another VGAM1289 host target gene. FLJ10287 BINDING SITE is HOST TARGET binding site found in the 3' untranslated region of mRNA encoded by FLJ10287, corresponding to a HOST TARGET binding site such as BINDING SITE I, BINDING SITE II or BINDING SITE III. Table 2 illustrates the complementarity of the nucleotide sequences of FLJ10287 BINDING SITE, designated SEQ ID:21155, to the nucleotide sequence of VGAM1289 RNA, herein designated VGAM RNA, also designated SEQ ID:4000.

Another function of VGAM1289 is therefore inhibition of FLJ10287 (Accession NM_019083). Accordingly, utilities of VGAM1289 include diagnosis, prevention and treatment of diseases and clinical conditions associated with FLJ10287. FLJ10607 (Accession XM_085119) is another VGAM1289 host target gene. FLJ10607 BINDING SITE is HOST TARGET binding site found in the 3' untranslated region of mRNA encoded by FLJ10607, corresponding to a HOST TARGET binding site such as BINDING SITE I, BINDING SITE II or BINDING SITE III. Table 2 illustrates the complementarity of the nucleotide sequences of FLJ10607 BINDING SITE, designated SEQ ID:37835, to the nucleotide sequence of VGAM1289 RNA, herein designated VGAM RNA, also designated SEQ ID:4000.

Another function of VGAM1289 is therefore inhibition of FLJ10607 (Accession XM_085119). Accordingly, utilities of VGAM1289 include diagnosis, prevention and treatment of diseases and clinical conditions associated with FLJ10607. KIAA0182 (Accession XM_050495) is another VGAM1289 host target gene. KIAA0182 BINDING SITE is HOST TARGET binding site found in the 3' untranslated region of mRNA encoded by KIAA0182, corresponding to a HOST TARGET binding site such as BINDING SITE I, BINDING SITE II or BINDING SITE III. Table 2 illustrates the complementarity of the nucleotide sequences of KIAA0182 BINDING SITE, designated SEQ ID:35646, to the nucleotide sequence of VGAM1289 RNA, herein designated VGAM RNA, also designated SEQ ID:4000.

Another function of VGAM1289 is therefore inhibition of KIAA0182 (Accession XM_050495). Accordingly, utilities of VGAM1289 include diagnosis, prevention and treatment of diseases and clinical conditions associated with KIAA0182. KIAA1908 (Accession XM_055834) is another VGAM1289 host target gene. KIAA1908 BINDING SITE is HOST TARGET binding site found in the 5' untranslated region of mRNA encoded by KIAA1908, corresponding to a HOST TARGET binding site such as BINDING SITE I, BINDING SITE II or BINDING SITE III. Table 2 illustrates the complementarity of the nucleotide sequences of KIAA1908 BINDING SITE, designated SEQ ID:36327, to the nucleotide sequence of VGAM1289 RNA, herein designated VGAM RNA, also designated SEQ ID:4000.

Another function of VGAM1289 is therefore inhibition of KIAA1908 (Accession XM_055834). Accordingly, utilities of VGAM1289 include diagnosis, prevention and treatment of diseases and clinical conditions associated with KIAA1908. FIG. 1 further provides a conceptual description of a novel bioinformatically detected viral gene of the present invention, referred to here as Viral Genomic Address Messenger 1290 (VGAM1290) viral gene, which modulates expression of respective host target genes thereof, the function and utility of which host target genes is known in the art.

VGAM1290 is a novel bioinformatically detected regulatory, non protein coding, viral micro RNA (miRNA) gene. The method by which VGAM1290 was detected is described hereinabove with reference to FIGS. 1-8.

VGAM1290 gene, herein designated VGAM GENE, is a viral gene contained in the genome of Grapevine Fleck Virus. VGAM1290 host target gene, herein designated VGAM HOST TARGET GENE, is a human gene contained in the human genome.

VGAM1290 gene encodes a VGAM1290 precursor RNA, herein designated VGAM PRECURSOR RNA. Similar to other miRNA genes, and unlike most ordinary genes, VGAM1290 precursor RNA does not encode a protein. A nucleotide sequence identical or highly similar to the nucleotide sequence of VGAM1290 precursor RNA is designated SEQ ID:1276, and is provided hereinbelow with reference to the sequence listing part. Nucleotide sequence SEQ ID:1276 is located at position 5505 relative to the genome of Grapevine Fleck Virus.

VGAM1290 precursor RNA folds onto itself, forming VGAM1290 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1290 folded precursor RNA into VGAM1290 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM1290 RNA is designated SEQ ID:4001, and is provided hereinbelow with reference to the sequence listing part.

VGAM1290 host target gene, herein designated VGAM HOST TARGET GENE, encodes a corresponding messenger RNA, VGAM1290 host target RNA, herein designated VGAM HOST TARGET RNA. VGAM1290 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1290 RNA, herein designated VGAM RNA, binds complementarily to one or more host target binding sites located in untranslated regions of VGAM1290 host target RNA, herein designated VGAM HOST TARGET RNA. This complementary binding is due to the fact that the nucleotide sequence of VGAM1290 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1290 RNA, herein designated VGAM RNA, may have a different number of host target binding sites in untranslated regions of a VGAM1290 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1290 RNA, herein designated VGAM RNA, to host target binding sites on VGAM1290 host target RNA, herein designated VGAM HOST TARGET RNA, such as BINDING SITE I, BINDING SITE II and BINDING SITE III, inhibits translation of VGAM1290 host target RNA into VGAM1290 host target protein, herein designated VGAM HOST TARGET PROTEIN. VGAM host target protein is therefore outlined by a broken line.

It is appreciated that VGAM1290 host target gene, herein designated VGAM HOST TARGET GENE, in fact represents a plurality of VGAM1290 host target genes. The mRNA of each one of this plurality of VGAM1290 host target genes comprises one or more host target binding sites, each having a nucleotide sequence which is at least partly complementary to VGAM1290 RNA, herein designated VGAM RNA, and which when bound by VGAM1290 RNA causes inhibition of translation of respective one or more VGAM1290 host target proteins.

It is further appreciated by one skilled in the art that the mode of translational inhibition illustrated by FIG. 1 with specific reference to translational inhibition exerted by VGAM1290 gene, herein designated VGAM GENE, on one or more VGAM1290 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1290 is inhibition of expression of host target genes, as part of a novel viral mechanism of attacking a host. Accordingly, utilities of VGAM1290 include diagnosis, prevention and treatment of viral infection by Grapevine Fleck Virus. Specific functions, and accordingly utilities, of VGAM1290 correlate with, and may be deduced from, the identity of the host target genes which VGAM1290 binds and inhibits, and the function of these host target genes, as elaborated hereinbelow.

Nucleotide sequences of the VGAM1290 precursor RNA, herein designated VGAM PRECURSOR RNA, and of the 'diced' VGAM1290 RNA, herein designated VGAM RNA, and a schematic representation of the secondary folding of VGAM1290 folded precursor RNA, herein designated VGAM FOLDED PRECURSOR RNA, of VGAM1290 are further described hereinbelow with reference to Table 1.

Nucleotide sequences of host target binding sites, such as BINDING SITE-I, BINDING SITE-II and BINDING SITE-III of FIG. 1, found on VGAM1290 host target RNA, and schematic representation of the complementarity of each of these host target binding sites to VGAM1290 RNA, herein designated VGAM RNA, are described hereinbelow with reference to Table 2.

As mentioned hereinabove with reference to FIG. 1, a function of VGAM1290 gene, herein designated VGAM is inhibition of expression of VGAM1290 target genes. It is appreciated that specific functions, and accordingly utilities, of VGAM1290 correlate with, and may be deduced from, the identity of the target genes which VGAM1290 binds and inhibits, and the function of these target genes, as elaborated hereinbelow.

Rho GTPase Activating Protein 6 (ARHGAP6, Accession NM_001174) is a VGAM1290 host target gene. ARHGAP6 BINDING SITE is HOST TARGET binding site found in the 5' untranslated region of mRNA encoded by ARHGAP6, corresponding to a HOST TARGET binding site such as BINDING SITE I, BINDING SITE II or BINDING SITE III. Table 2 illustrates the complementarity of the nucleotide sequences of ARHGAP6 BINDING SITE, designated SEQ ID:6844, to the nucleotide sequence of VGAM1290 RNA, herein designated VGAM RNA, also designated SEQ ID:4001.

A function of VGAM1290 is therefore inhibition of Rho GTPase Activating Protein 6 (ARHGAP6, Accession NM_001174), a gene which activates the rho-type GTPases by converting them to an inactive GTP-bound state. Accordingly, utilities of VGAM1290 include diagnosis, prevention and treatment of diseases and clinical conditions associated with ARHGAP6. The function of ARHGAP6 and its association with various diseases and clinical conditions, has been established by previous studies, as described hereinabove with reference to VGAM55. Cathepsin B (CTSB, Accession XM_035662) is another VGAM1290 host target gene. CTSB BINDING SITE is HOST TARGET binding site found in the 3' untranslated region of mRNA encoded by CTSB, corresponding to a HOST TARGET binding site such as BINDING SITE I, BINDING SITE II or BINDING SITE III. Table 2 illustrates the complementarity of the nucleotide sequences of CTSB BINDING SITE, designated SEQ ID:32327, to the nucleotide sequence of VGAM1290 RNA, herein designated VGAM RNA, also designated SEQ ID:4001.

Another function of VGAM1290 is therefore inhibition of Cathepsin B (CTSB, Accession XM_035662). Accordingly, utilities of VGAM1290 include diagnosis, prevention and treatment of diseases and clinical conditions associated with CTSB. Dystrophia Myotonica-protein Kinase (DMPK, Accession NM_004409) is another VGAM1290 host target gene. DMPK BINDING SITE is HOST TARGET binding site found in the 3' untranslated region of mRNA encoded by DMPK, corresponding to a HOST TARGET binding site such as BINDING SITE I, BINDING SITE II or BINDING SITE III. Table 2 illustrates the complementarity of the nucleotide sequences of DMPK BINDING SITE, designated SEQ ID:10661, to the nucleotide sequence of VGAM1290 RNA, herein designated VGAM RNA, also designated SEQ ID:4001.

Another function of VGAM1290 is therefore inhibition of Dystrophia Myotonica-protein Kinase (DMPK, Accession NM_004409). Accordingly, utilities of VGAM1290 include diagnosis, prevention and treatment of diseases and clinical conditions associated with DMPK. DNA (cytosine-5-)-methyltransferase 3-like (DNMT3L, Accession NM_013369) is another VGAM1290 host target gene. DNMT3L BINDING SITE is HOST TARGET binding site found in the 5' untranslated region of mRNA encoded by DNMT3L, corresponding to a HOST TARGET binding site such as BINDING SITE I, BINDING SITE II or BINDING SITE III. Table 2 illustrates the complementarity of the nucleotide sequences of DNMT3L BINDING SITE, designated SEQ ID:15017, to the nucleotide sequence of VGAM1290 RNA, herein designated VGAM RNA, also designated SEQ ID:4001.

Another function of VGAM1290 is therefore inhibition of DNA (cytosine-5-)-methyltransferase 3-like (DNMT3L, Accession NM_013369), a gene which plays a role in de novo methylation of CpG islands. Accordingly, utilities of VGAM1290 include diagnosis, prevention and treatment of diseases and clinical conditions associated with DNMT3L. The function of DNMT3L and its association with various diseases and clinical conditions, has been established by previous studies, as described hereinabove with reference to VGAM447. Glial Fibrillary Acidic Protein (GFAP, Accession NM_002055) is another VGAM1290 host target gene. GFAP BINDING SITE is HOST TARGET binding site found in the 3' untranslated region of mRNA encoded by GFAP, corresponding to a HOST TARGET binding site such as BINDING SITE I, BINDING SITE II or BINDING SITE III. Table 2 illustrates the complementarity of the nucleotide sequences of GFAP BINDING SITE, designated SEQ ID:7812, to the nucleotide sequence of VGAM1290 RNA, herein designated VGAM RNA, also designated SEQ ID:4001.

Another function of VGAM1290 is therefore inhibition of Glial Fibrillary Acidic Protein (GFAP, Accession NM_002055). Accordingly, utilities of VGAM1290 include diagnosis, prevention and treatment of diseases and clinical conditions associated with GFAP. Mucin 3B (MUC3B, Accession XM_168578) is another VGAM1290 host target gene. MUC3B BINDING SITE is HOST TARGET binding site found in the 3' untranslated region of mRNA encoded by MUC3B, corresponding to a HOST TARGET binding site such as BINDING SITE I, BINDING SITE II or BINDING SITE III. Table 2 illustrates the complementarity of the nucleotide sequences of MUC3B BINDING SITE, designated SEQ ID:45252, to the nucleotide sequence of VGAM1290 RNA, herein designated VGAM RNA, also designated SEQ ID:4001.

Another function of VGAM1290 is therefore inhibition of Mucin 3B (MUC3B, Accession XM_168578), a gene which provides a protective, lubricating barrier against particles and infectious agents at mucosal surfaces. Accordingly, utilities of VGAM1290 include diagnosis, prevention and treatment of diseases and clinical conditions associated with MUC3B. The function of MUC3B and its association with various diseases and clinical conditions, has been established by previous studies, as described hereinabove with reference to VGAM55. Mucin 4, Tracheobronchial (MUC4, Accession NM_138298) is another VGAM1290 host target gene. MUC4 BINDING SITE is HOST TARGET binding site found in the 3' untranslated region of mRNA encoded by MUC4, corresponding to a HOST TARGET binding site such as BINDING SITE I, BINDING SITE II or BINDING SITE III. Table 2 illustrates the complementarity of the nucleotide sequences of MUC4 BINDING SITE, designated SEQ ID:28710, to the nucleotide sequence of VGAM1290 RNA, herein designated VGAM RNA, also designated SEQ ID:4001.

Another function of VGAM1290 is therefore inhibition of Mucin 4, Tracheobronchial (MUC4, Accession NM_138298), a gene which may act as a ligand for ErbB2 mediated cell signalling. Accordingly, utilities of VGAM1290 include diagnosis, prevention and treatment of diseases and clinical conditions associated with MUC4. The function of MUC4 has been established by previous studies. From a lambda-gt11 cDNA library constructed from human tracheobronchial mucosa, Porchet et al. (1991) isolated a partial cDNA clone that reacted with a polyclonal antiserum raised to chemically deglycosylated pronase glycopeptides from human bronchial mucins. The novel tracheobronchial mucin gene, referred to as mucin 4, was mapped to chromosome 3 by analysis of somatic cell hybrids. By in situ hybridization, Van Cong et al. (1991) mapped MUC4 to 3q29. They also demonstrated a VNTR polymorphism useful for family linkage studies. The full report was given by Gross et al. (1992). (Note that Nguyen Van Cong's name is sometimes published as Nguyen, V. C. rather than Van Cong, N. Nguyen is indeed the surname.)

Full details of the abovementioned studies are described in the following publications, the disclosure of which are hereby incorporated by reference:

Gross, M.-S.; Guyonnet-Duperat, V.; Porchet, N.; Bernheim, A.; Aubert, J. P.; Nguyen, V. C.: Mucin 4 (MUC4) gene: regional assignment (3q29) and RFLP analysis. Ann. Genet. 35:21-26, 1992; and Porchet, N.; Van Cong, N.; Dufosse, J.; Audie, J. P.; Guyonnet-Duperat, V.; Gross, M. S.; Denis, C.; Degand, P.; Bernheim, A.; Aubert, J. P.: Molecular cloning and chromosomal localiza.

Further studies establishing the function and utilities of MUC4 are found in John Hopkins OMIM database record ID 158372, and in sited publications numbered 3797-3799 listed in the bibliography section hereinbelow, which are also hereby incorporated by reference. Rhodopsin (opsin 2, rod pigment) (retinitis pigmentosa 4, autosomal dominant) (RHO, Accession NM_000539) is another VGAM1290 host target gene. RHO BINDING SITE is HOST TARGET binding site found in the 3' untranslated region of mRNA encoded by RHO, corresponding to a HOST TARGET binding site such as BINDING SITE I, BINDING SITE II or BINDING SITE III. Table 2 illustrates the complementarity of the nucleotide sequences of RHO BINDING SITE, designated SEQ ID:6138, to the nucleotide sequence of VGAM1290 RNA, herein designated VGAM RNA, also designated SEQ ID:4001.

Another function of VGAM1290 is therefore inhibition of Rhodopsin (opsin 2, rod pigment) (retinitis pigmentosa 4, autosomal dominant) (RHO, Accession NM_000539). Accordingly, utilities of VGAM1290 include diagnosis, prevention and treatment of diseases and clinical conditions associated with RHO. X-ray Repair Complementing Defective Repair In Chinese Hamster Cells 3 (XRCC3, Accession NM_005432) is another VGAM1290 host target gene.

XRCC3 BINDING SITE is HOST TARGET binding site found in the 3' untranslated region of mRNA encoded by XRCC3, corresponding to a HOST TARGET binding site such as BINDING SITE I, BINDING SITE II or BINDING SITE III. Table 2 illustrates the complementarity of the nucleotide sequences of XRCC3 BINDING SITE, designated SEQ ID:11907, to the nucleotide sequence of VGAM1290 RNA, herein designated VGAM RNA, also designated SEQ ID:4001.

Another function of VGAM1290 is therefore inhibition of X-ray Repair Complementing Defective Repair In Chinese Hamster Cells 3 (XRCC3, Accession NM_005432), a gene which is required for meiotic recombination, synaptonemal complex formation and cell cycle progression. Accordingly, utilities of VGAM1290 include diagnosis, prevention and treatment of diseases and clinical conditions associated with XRCC3. The function of XRCC3 has been established by previous studies. Masson et al. (2001) found that antibody directed against RAD51C (OMIM Ref. No. 602774) coimmunoprecipitated XRCC2 in an endogenous complex with RAD51C in HeLa cell lysates. Gel filtration of the complex suggested that a heterodimer is formed between the proteins. Using coprecipitation and multiple pull-down assays, Liu et al. (2002) confirmed interaction between these proteins. They also found that RAD51 coprecipitates with XRCC3, suggesting that RAD51 can be present in a trimeric complex of XRCC3, RAD51C, and RAD51. Brenneman et al. (2002) found that XRCC3 mutant cells displayed radically altered homologous recombination (HR) product spectra, with increased gene conversion tract lengths, increased frequencies of discontinuous tracts, and frequent local rearrangements associated with HR. These results indicated that XRCC3 function is not limited to HR initiation, but extends to later stages in formation and resolution of HR intermediates, possibly by stabilizing heteroduplex DNA. The results further demonstrated that HR defects can promote genomic instability not only through failure to initiate HR (leading to nonhomologous repair), but also through aberrant processing of HR intermediates. The authors suggested that both mechanisms may contribute to carcinogenesis in HR-deficient cells.

Full details of the abovementioned studies are described in the following publications, the disclosure of which are hereby incorporated by reference:

Masson, J.-Y.; Tarsounas, M. C.; Stasiak, A. Z.; Stasiak, A.; Shah, R.; McIlwraith, M. J.; Benson, F. E.; West, S. C.: Identification and purification of two distinct complexes containing the five RAD51 paralogs. Genes Dev. 15:3296-3307, 2001; and Brenneman, M. A.; Wagener, B. M.; Miller, C. A.; Allen, C.; Nickoloff, J. A.: XRCC3 controls the fidelity of homologous recombination: roles for XRCC3 in late stages of recombination.

Further studies establishing the function and utilities of XRCC3 are found in John Hopkins OMIM database record ID 600675, and in sited publications numbered 9920-9921, 1602-160 and 9922-9923 listed in the bibliography section hereinbelow, which are also hereby incorporated by reference. Docking Protein 4 (DOK4, Accession NM_018110) is another VGAM1290 host target gene. DOK4 BINDING SITE is HOST TARGET binding site found in the 3' untranslated region of mRNA encoded by DOK4, corresponding to a HOST TARGET binding site such as BINDING SITE I, BINDING SITE II or BINDING SITE III. Table 2 illustrates the complementarity of the nucleotide sequences of DOK4 BINDING SITE, designated SEQ ID:19880, to the nucleotide sequence of VGAM1290 RNA, herein designated VGAM RNA, also designated SEQ ID:4001.

Another function of VGAM1290 is therefore inhibition of Docking Protein 4 (DOK4, Accession NM_018110). Accordingly, utilities of VGAM1290 include diagnosis, prevention and treatment of diseases and clinical conditions associated with DOK4. FLJ12910 (Accession NM_024573) is another VGAM1290 host target gene. FLJ12910 BINDING SITE is HOST TARGET binding site found in the 5' untranslated region of mRNA encoded by FLJ12910, corresponding to a HOST TARGET binding site such as BINDING SITE I, BINDING SITE II or BINDING SITE III. Table 2 illustrates the complementarity of the nucleotide sequences of FLJ12910 BINDING SITE, designated SEQ ID:23799, to the nucleotide sequence of VGAM1290 RNA, herein designated VGAM RNA, also designated SEQ ID:4001.

Another function of VGAM1290 is therefore inhibition of FLJ12910 (Accession NM_024573). Accordingly, utilities of VGAM1290 include diagnosis, prevention and treatment of diseases and clinical conditions associated with FLJ12910. KIAA1130 (Accession XM_031104) is another VGAM1290 host target gene. KIAA1130 BINDING SITE is HOST TARGET binding site found in the 3' untranslated region of mRNA encoded by KIAA1130, corresponding to a HOST TARGET binding site such as BINDING SITE I, BINDING SITE II or BINDING SITE III. Table 2 illustrates the complementarity of the nucleotide sequences of KIAA1130 BINDING SITE, designated SEQ ID:31282, to the nucleotide sequence of VGAM1290 RNA, herein designated VGAM RNA, also designated SEQ ID:4001.

Another function of VGAM1290 is therefore inhibition of KIAA1130 (Accession XM_031104). Accordingly, utilities of VGAM1290 include diagnosis, prevention and treatment of diseases and clinical conditions associated with KIAA1130. KIAA1297 (Accession XM_051005) is another VGAM1290 host target gene. KIAA1297 BINDING SITE is HOST TARGET binding site found in the 3' untranslated region of mRNA encoded by KIAA1297, corresponding to a HOST TARGET binding site such as BINDING SITE I, BINDING SITE II or BINDING SITE III. Table 2 illustrates the complementarity of the nucleotide sequences of KIAA1297 BINDING SITE, designated SEQ ID:35709, to the nucleotide sequence of VGAM1290 RNA, herein designated VGAM RNA, also designated SEQ ID:4001.

Another function of VGAM1290 is therefore inhibition of KIAA1297 (Accession XM_051005). Accordingly, utilities of VGAM1290 include diagnosis, prevention and treatment of diseases and clinical conditions associated with KIAA1297. N-myristoyltransferase 1 (NMT1, Accession NM_021079) is another VGAM1290 host target gene. NMT1 BINDING SITE is HOST TARGET binding site found in the 3' untranslated region of mRNA encoded by NMT1, corresponding to a HOST TARGET binding site such as BINDING SITE I, BINDING SITE II or BINDING SITE III. Table 2 illustrates the complementarity of the nucleotide sequences of NMT1 BINDING SITE, designated SEQ ID:22048, to the nucleotide sequence of VGAM1290 RNA, herein designated VGAM RNA, also designated SEQ ID:4001.

Another function of VGAM1290 is therefore inhibition of N-myristoyltransferase 1 (NMT1, Accession NM_021079). Accordingly, utilities of VGAM1290 include diagnosis, prevention and treatment of diseases and clinical conditions associated with NMT1. Phosphatase, Orphan 1 (phospho1, Accession XM_091572) is another VGAM1290 host target gene. phospho1 BINDING SITE is HOST TARGET binding site found in the 5' untranslated region of mRNA encoded by phospho1, corresponding to a HOST TARGET binding site such as BINDING SITE I, BINDING SITE II or BINDING SITE III. Table 2 illustrates the complementarity of the nucleotide sequences of phospho1 BINDING SITE, designated SEQ ID:40060, to the nucleotide sequence of VGAM1290 RNA, herein designated VGAM RNA, also designated SEQ ID:4001.

Another function of VGAM1290 is therefore inhibition of Phosphatase, Orphan 1 (phospho1, Accession XM_091572). Accordingly, utilities of VGAM1290 include diagnosis, prevention and treatment of diseases and clinical conditions associated with phospho1. LOC149606 (Accession XM_086600) is another VGAM1290 host target gene. LOC149606 BINDING SITE is HOST TARGET binding site found in the 3' untranslated region of mRNA encoded by LOC149606, corresponding to a HOST TARGET binding site such as BINDING SITE I, BINDING SITE II or BINDING SITE III. Table 2 illustrates the complementarity of the nucleotide sequences of LOC149606 BINDING SITE, designated SEQ ID:38781, to the nucleotide sequence of VGAM1290 RNA, herein designated VGAM RNA, also designated SEQ ID:4001.

Another function of VGAM1290 is therefore inhibition of LOC149606 (Accession XM_086600). Accordingly, utilities of VGAM1290 include diagnosis, prevention and treatment of diseases and clinical conditions associated with LOC149606. LOC206426 (Accession XM_116505) is another VGAM1290 host target gene. LOC206426 BINDING SITE is HOST TARGET binding site found in the 3' untranslated region of mRNA encoded by LOC206426, corresponding to a HOST TARGET binding site such as BINDING SITE I, BINDING SITE II or BINDING SITE III. Table 2 illustrates the complementarity of the nucleotide sequences of LOC206426 BINDING SITE, designated SEQ ID:43117, to the nucleotide sequence of VGAM1290 RNA, herein designated VGAM RNA, also designated SEQ ID:4001.

Another function of VGAM1290 is therefore inhibition of LOC206426 (Accession XM_116505). Accordingly, utilities of VGAM1290 include diagnosis, prevention and treatment of diseases and clinical conditions associated with LOC206426. LOC221486 (Accession XM_165760) is another VGAM1290 host target gene. LOC221486 BINDING SITE is HOST TARGET binding site found in the 3' untranslated region of mRNA encoded by LOC221486, corresponding to a HOST TARGET binding site such as BINDING SITE I, BINDING SITE II or BINDING SITE III. Table 2 illustrates the complementarity of the nucleotide sequences of LOC221486 BINDING SITE, designated SEQ ID:43741, to the nucleotide sequence of VGAM1290 RNA, herein designated VGAM RNA, also designated SEQ ID:4001.

Another function of VGAM1290 is therefore inhibition of LOC221486 (Accession XM_165760). Accordingly, utilities of VGAM1290 include diagnosis, prevention and treatment of diseases and clinical conditions associated with LOC221486. LOC91208 (Accession XM_036935) is another VGAM1290 host target gene. LOC91208 BINDING SITE is HOST TARGET binding site found in the 5' untranslated region of mRNA encoded by LOC91208, corresponding to a HOST TARGET binding site such as BINDING SITE I, BINDING SITE II or BINDING SITE III. Table 2 illustrates the complementarity of the nucleotide sequences of LOC91208 BINDING SITE, designated SEQ ID:32522, to the nucleotide sequence of VGAM1290 RNA, herein designated VGAM RNA, also designated SEQ ID:4001.

Another function of VGAM1290 is therefore inhibition of LOC91208 (Accession XM_036935). Accordingly, utilities of VGAM1290 include diagnosis, prevention and treatment of diseases and clinical conditions associated with LOC91208. LOC93589 (Accession XM_052387) is another VGAM1290 host target gene. LOC93589 BINDING SITE is HOST TARGET binding site found in the 3' untranslated region of mRNA encoded by LOC93589, corresponding to a HOST TARGET binding site such as BINDING SITE I, BINDING SITE II or BINDING SITE III. Table 2 illustrates the complementarity of the nucleotide sequences of LOC93589 BINDING SITE, designated SEQ ID:35977, to the nucleotide sequence of VGAM1290 RNA, herein designated VGAM RNA, also designated SEQ ID:4001.

Another function of VGAM1290 is therefore inhibition of LOC93589 (Accession XM_052387). Accordingly, utilities of VGAM1290 include diagnosis, prevention and treatment of diseases and clinical conditions associated with LOC93589. FIG. 1 further provides a conceptual description of a novel bioinformatically detected viral gene of the present invention, referred to here as Viral Genomic Address Messenger 1291 (VGAM1291) viral gene, which modulates expression of respective host target genes thereof, the function and utility of which host target genes is known in the art.

VGAM1291 is a novel bioinformatically detected regulatory, non protein coding, viral micro RNA (miRNA) gene. The method by which VGAM1291 was detected is described hereinabove with reference to FIGS. 1-8.

VGAM1291 gene, herein designated VGAM GENE, is a viral gene contained in the genome of Swinepox Virus. VGAM1291 host target gene, herein designated VGAM HOST TARGET GENE, is a human gene contained in the human genome.

VGAM1291 gene encodes a VGAM1291 precursor RNA, herein designated VGAM PRECURSOR RNA. Similar to other miRNA genes, and unlike most ordinary genes, VGAM1291 precursor RNA does not encode a protein. A nucleotide sequence identical or highly similar to the nucleotide sequence of VGAM1291 precursor RNA is designated SEQ ID:1277, and is provided hereinbelow with reference to the sequence listing part. Nucleotide sequence SEQ ID:1277 is located at position 74471 relative to the genome of Swinepox Virus.

VGAM1291 precursor RNA folds onto itself, forming VGAM1291 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1291 folded precursor RNA into VGAM1291 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1291 RNA is designated SEQ ID:4002, and is provided hereinbelow with reference to the sequence listing part.

VGAM1291 host target gene, herein designated VGAM HOST TARGET GENE, encodes a corresponding messenger RNA, VGAM1291 host target RNA, herein designated VGAM HOST TARGET RNA. VGAM1291 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1291 RNA, herein designated VGAM RNA, binds complementarily to one or more host target binding sites located in untranslated regions of VGAM1291 host target RNA, herein designated VGAM HOST TARGET RNA. This complementary binding is due to the fact that the nucleotide sequence of VGAM1291 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1291 RNA, herein designated VGAM RNA, may have a different number of host target binding sites in untranslated regions of a VGAM1291 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1291 RNA, herein designated VGAM RNA, to host target binding sites on VGAM1291 host target RNA, herein designated VGAM HOST TARGET RNA, such as BINDING SITE I, BINDING SITE II and BINDING SITE III, inhibits translation of VGAM1291 host target RNA into VGAM1291 host target protein, herein designated VGAM HOST TARGET PROTEIN. VGAM host target protein is therefore outlined by a broken line.

It is appreciated that VGAM1291 host target gene, herein designated VGAM HOST TARGET GENE, in fact represents a plurality of VGAM1291 host target genes. The mRNA of each one of this plurality of VGAM1291 host target genes comprises one or more host target binding sites, each having a nucleotide sequence which is at least partly complementary to VGAM1291 RNA, herein designated VGAM RNA, and which when bound by VGAM1291 RNA causes inhibition of translation of respective one or more VGAM1291 host target proteins.

It is further appreciated by one skilled in the art that the mode of translational inhibition illustrated by FIG. 1 with specific reference to translational inhibition exerted by VGAM1291 gene, herein designated VGAM GENE, on one or more VGAM1291 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1291 is inhibition of expression of host target genes, as part of a novel viral mechanism of attacking a host. Accordingly, utilities of VGAM1291 include diagnosis, prevention and treatment of viral infection by Swinepox Virus. Specific functions, and accordingly utilities, of VGAM1291 correlate with, and may be deduced from, the identity of the host target genes which VGAM1291 binds and inhibits, and the function of these host target genes, as elaborated hereinbelow.

Nucleotide sequences of the VGAM1291 precursor RNA, herein designated VGAM PRECURSOR RNA, and of the 'diced' VGAM1291 RNA, herein designated VGAM RNA, and a schematic representation of the secondary folding of VGAM1291 folded precursor RNA, herein designated VGAM FOLDED PRECURSOR RNA, of VGAM1291 are further described hereinbelow with reference to Table 1.

Nucleotide sequences of host target binding sites, such as BINDING SITE-I, BINDING SITE-II and BINDING SITE-III of FIG. 1, found on VGAM1291 host target RNA, and schematic representation of the complementarity of each of these host target binding sites to VGAM1291 RNA, herein designated VGAM RNA, are described hereinbelow with reference to Table 2.

As mentioned hereinabove with reference to FIG. 1, a function of VGAM1291 gene, herein designated VGAM is inhibition of expression of VGAM1291 target genes. It is appreciated that specific functions, and accordingly utilities, of VGAM1291 correlate with, and may be deduced from, the identity of the target genes which VGAM1291 binds and inhibits, and the function of these target genes, as elaborated hereinbelow.

Interleukin-1 Receptor-associated Kinase 4 (IRAK4, Accession XM_028349) is a VGAM1291 host target gene. IRAK4 BINDING SITE is HOST TARGET binding site found in the 3' untranslated region of mRNA encoded by IRAK4, corresponding to a HOST TARGET binding site such as BINDING SITE I, BINDING SITE II or BINDING SITE III. Table 2 illustrates the complementarity of the nucleotide sequences of IRAK4 BINDING SITE, designated SEQ ID:30693, to the nucleotide sequence of VGAM1291 RNA, herein designated VGAM RNA, also designated SEQ ID:4002.

A function of VGAM1291 is therefore inhibition of Interleukin-1 Receptor-associated Kinase 4 (IRAK4, Accession XM_028349), a gene which may function as an IRAK1 kinase, triggering a cascade of phosphorylation events. Accordingly, utilities of VGAM1291 include diagnosis, prevention and treatment of diseases and clinical conditions associated with IRAK4. The function of IRAK4 has been established by previous studies. By SEREX (serologic analysis of recombinant cDNA expression libraries) screening of renal tumors, Scanlan et al. (1999) identified multiple antigens, including REN64. The deduced 460-amino acid protein is strongly expressed in kidney, as determined by immunohistochemistry. RT-PCR analysis detected expression in all 6 tissues tested (lung, testis, small intestine, breast, liver, and placenta). By database searching for IRAK-like sequences and PCR of a universal cDNA library, Li et al. (2002) obtained a cDNA encoding IRAK4, which is 98% identical to REN64. The predicted protein is 84% identical to the mouse protein and, like IRAK1, IRAK2 (OMIM Ref. No. 603304), IRAKM (OMIM Ref. No. 604459), and the Drosophila Pelle protein, it has an N-terminal death domain and a central kinase domain. Unlike the other IRAK proteins, however, but similar to Pelle, IRAK4 has a short C-terminal domain. Northern blot analysis revealed expression of 3.0- and 4.4-kb transcripts, with strongest expression in kidney and liver. RT-PCR analysis detected wide, low-level expression of IRAK4. Functional analysis by Li et al. (2002) determined that IRAK4, like IRAK1 and Pelle, has auto- and cross-phosphorylation kinase activity. Precipitation and binding analyses showed weak interaction between IRAK4 and IRAK1, but IRAK4 did not interact with other IRAK family members. Overexpressed IRAK4 interacted with MYD88 (OMIM Ref. No. 602170) and TRAF6 (OMIM Ref. No. 602355) and activated mitogen-activated protein kinase (MAPK) and nuclear factor kappa-B (NFKB; 164011) pathways. Endogenous IRAK4 associated in a transient IL1 (see OMIM Ref. No. 147720)-dependent manner with unmodified IRAK1 and TRAF6. Luciferase reporter analysis showed that IRAK4 lacking the kinase domain inhibited IL1- but not tumor necrosis factor (TNF; 191160)- induced NFKB and IRAK1 activation. SDS-PAGE and autoradiographic analysis indicated that IRAK4 phosphorylates and activates IRAK1 at thr387, but not vice versa. Li et al. (2002) proposed that IRAK4 acts upstream of other IRAKs and may function as an IRAK1 kinase, triggering a cascade of phosphorylation events By gene targeting, Suzuki et al. (2002) generated mice deficient in Irak4. Mutant mice and macrophages or embryonic fibroblasts (MEFs) from these mice were unable to respond to Il1 by production of Il6 (OMIM Ref. No. 147620), Tnf, or nitric oxide, or by activation of Nfkb or Jnk (OMIM Ref. No. 601158). Responses to Tnf, however, were intact, suggesting that the defect was specific for Il1. Analysis of responses to lipopolysaccharide (LPS), bacterial DNA (unmethylated CpG), peptidoglycan, or viral RNA extended the importance of Irak4 to Tlr4, Tlr9 (OMIM Ref. No. 605474), Tlr2 (OMIM Ref. No. 603028), and Tlr3 (OMIM Ref. No. 603029), respectively, which use signaling mechanisms similar to IL1R. Challenge of Irak4 -/- mice with lymphocytic choriomeningitis virus showed reduced production of gamma-interferon (IFNG; 147570) by natural killer cells, but no loss of cytolytic function of these cells. Challenge with Staphylococcus aureus was lethal in all mutant mice but not in most wildtype mice. Luciferase reporter analysis suggested that Irak4 acts upstream of Myd88 and Mal (OMIM Ref. No. 606252) and downstream of Traf6. Animal model experiments lend further support to the function of IRAK4. By gene targeting, Suzuki et al. (2002) generated mice deficient in Irak4. Mutant mice and macrophages or embryonic fibroblasts (MEFs) from these mice were unable to respond to Il1 by production of Il6 (OMIM Ref. No. 147620), Tnf, or nitric oxide, or by activation of Nfkb or Jnk (OMIM Ref. No. 601158). Responses to Tnf, however, were intact, suggesting that the defect was specific for Il1. Analysis of responses to lipopolysaccharide (LPS), bacterial DNA (unmethylated CpG), peptidoglycan, or viral RNA extended the importance of Irak4 to Tlr4, Tlr9 (OMIM Ref. No. 605474), Tlr2 (OMIM Ref. No. 603028), and Tlr3 (OMIM Ref. No. 603029), respectively, which use signaling mechanisms similar to IL1R. Challenge of Irak4 -/- mice with lymphocytic choriomeningitis virus showed reduced production of gamma-interferon (IFNG; 147570) by natural killer cells, but no loss of cytolytic function of these cells. Challenge with Staphylococcus aureus was lethal in all mutant mice but not in most wildtype mice. Luciferase reporter analysis suggested that Irak4 acts upstream of Myd88 and Mal (OMIM Ref. No. 606252) and downstream of Traf6

It is appreciated that the abovementioned animal model for IRAK4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Li, S.; Strelow, A.; Fontana, E. J.; Wesche, H.: IRAK-4: a novel member of the IRAK family with the properties of an IRAK-kinase. Proc. Nat. Acad. Sci. 99:5567-5572, 2002; and Scanlan, M. J.; Gordon, J. D.; Williamson, B.; Stockert, E.; Bander, N. H.; Jongeneel, V.; Gure, A. O.; Jager, D.; Jager, E.; Knuth, A.; Chen, Y.-T.; Old, L. J.: Antigens recognized b.

Further studies establishing the function and utilities of IRAK4 are found in John Hopkins OMIM database record ID 606883, and in sited publications numbered 6391-6394 listed in the bibliography section hereinbelow, which are also hereby incorporated by reference. FLJ20772 (Accession NM_017956) is another VGAM1291 host target gene. FLJ20772 BINDING SITE is HOST TARGET binding site found in the 3' untranslated region of mRNA encoded by FLJ20772, corresponding to a HOST TARGET binding site such as BINDING SITE I, BINDING SITE II or BINDING SITE III. Table 2 illustrates the complementarity of the nucleotide sequences of FLJ20772 BINDING SITE, designated SEQ ID:19664, to the nucleotide sequence of VGAM1291 RNA, herein designated VGAM RNA, also designated SEQ ID:4002.

Another function of VGAM1291 is therefore inhibition of FLJ20772 (Accession NM_017956). Accordingly, utilities of VGAM1291 include diagnosis, prevention and treatment of diseases and clinical conditions associated with FLJ20772. Vav 3 Oncogene (VAV3, Accession NM_006113) is another VGAM1291 host target gene. VAV3 BINDING SITE is HOST TARGET binding site found in the 3' untranslated region of mRNA encoded by VAV3, corresponding to a HOST TARGET binding site such as BINDING SITE I, BINDING SITE II or BINDING SITE III. Table 2 illustrates the complementarity of the nucleotide sequences of VAV3 BINDING SITE, designated SEQ ID:12758, to the nucleotide sequence of VGAM1291 RNA, herein designated VGAM RNA, also designated SEQ ID:4002.

Another function of VGAM1291 is therefore inhibition of Vav 3 Oncogene (VAV3, Accession NM_006113). Accordingly, utilities of VGAM1291 include diagnosis, prevention and treatment of diseases and clinical conditions associated with VAV3. LOC150759 (Accession XM_086995) is another VGAM1291 host target gene. LOC150759 BINDING SITE is HOST TARGET binding site found in the 3' untranslated region of mRNA encoded by LOC150759, corresponding to a HOST TARGET binding site such as BINDING SITE I, BINDING SITE II or BINDING SITE III. Table 2 illustrates the complementarity of the nucleotide sequences of LOC150759 BINDING SITE, designated SEQ ID:39013, to the nucleotide sequence of VGAM1291 RNA, herein designated VGAM RNA, also designated SEQ ID:4002.

Another function of VGAM1291 is therefore inhibition of LOC150759 (Accession XM_086995). Accordingly, utilities of VGAM1291 include diagnosis, prevention and treatment of diseases and clinical conditions associated with LOC150759. LOC151323 (Accession XM_087168) is another VGAM1291 host target gene. LOC151323 BINDING SITE is HOST TARGET binding site found in the 3' untranslated region of mRNA encoded by LOC151323, corresponding to a HOST TARGET binding site such as BINDING SITE I, BINDING SITE II or BINDING SITE III. Table 2 illustrates the complementarity of the nucleotide sequences of LOC151323 BINDING SITE, designated SEQ ID:39102, to the nucleotide sequence of VGAM1291 RNA, herein designated VGAM RNA, also designated SEQ ID:4002.

Another function of VGAM1291 is therefore inhibition of LOC151323 (Accession XM_087168). Accordingly, utilities of VGAM1291 include diagnosis, prevention and treatment of diseases and clinical conditions associated with LOC151323. LOC200399 (Accession XM_114226) is another VGAM1291 host target gene. LOC200399 BINDING SITE is HOST TARGET binding site found in the 3' untranslated region of mRNA encoded by LOC200399, corresponding to a HOST TARGET binding site such as BINDING SITE I, BINDING SITE II or BINDING SITE III. Table 2 illustrates the complementarity of the nucleotide sequences of LOC200399 BINDING SITE, designated SEQ ID:42810, to the nucleotide sequence of VGAM1291 RNA, herein designated VGAM RNA, also designated SEQ ID:4002.

Another function of VGAM1291 is therefore inhibition of LOC200399 (Accession XM_114226). Accordingly, utilities of VGAM1291 include diagnosis, prevention and treatment of diseases and clinical conditions associated with LOC200399. LOC253955 (Accession XM_170486) is another VGAM1291 host target gene. LOC253955 BINDING SITE is HOST TARGET binding site found in the 3' untranslated region of mRNA encoded by LOC253955, corresponding to a HOST TARGET binding site such as BINDING SITE I, BINDING SITE II or BINDING SITE III. Table 2 illustrates the complementarity of the nucleotide sequences of LOC253955 BINDING SITE, designated SEQ ID:45325, to the nucleotide sequence of VGAM1291 RNA, herein designated VGAM RNA, also designated SEQ ID:4002.

Another function of VGAM1291 is therefore inhibition of LOC253955 (Accession XM_170486). Accordingly, utilities of VGAM1291 include diagnosis, prevention and treatment of diseases and clinical conditions associated with LOC253955. LOC91923 (Accession XM_041526) is another VGAM1291 host target gene. LOC91923 BINDING SITE is HOST TARGET binding site found in the 5' untranslated region of mRNA encoded by LOC91923, corresponding to a HOST TARGET binding site such as BINDING SITE I, BINDING SITE II or BINDING SITE III. Table 2 illustrates the complementarity of the nucleotide sequences of LOC91923 BINDING SITE, designated SEQ ID:33543, to the nucleotide sequence of VGAM1291 RNA, herein designated VGAM RNA, also designated SEQ ID:4002.

Another function of VGAM1291 is therefore inhibition of LOC91923 (Accession XM_041526). Accordingly, utilities of VGAM1291 include diagnosis, prevention and treatment of diseases and clinical conditions associated with LOC91923. FIG. 1 further provides a conceptual description of a novel bioinformatically detected viral gene of the present invention, referred to here as Viral Genomic Address Messenger 1292 (VGAM1292) viral gene, which modulates expression of respective host target genes thereof, the function and utility of which host target genes is known in the art.

VGAM1292 is a novel bioinformatically detected regulatory, non protein coding, viral micro RNA (miRNA) gene. The method by which VGAM1292 was detected is described hereinabove with reference to FIGS. 1-8.

VGAM1292 gene, herein designated VGAM GENE, is a viral gene contained in the genome of Swinepox Virus. VGAM1292 host target gene, herein designated VGAM HOST TARGET GENE, is a human gene contained in the human genome.

VGAM1292 gene encodes a VGAM1292 precursor RNA, herein designated VGAM PRECURSOR RNA. Similar to other miRNA genes, and unlike most ordinary genes, VGAM1292 precursor RNA does not encode a protein. A nucleotide sequence identical or highly similar to the nucleotide sequence of VGAM1292 precursor RNA is designated SEQ ID:1278, and is provided hereinbelow with reference to the sequence listing part. Nucleotide sequence SEQ ID:1278 is located at position 74650 relative to the genome of Swinepox Virus.

VGAM1292 precursor RNA folds onto itself, forming VGAM1292 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1292 folded precursor RNA into VGAM1292 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 41%) nucleotide sequence of VGAM1292 RNA is designated SEQ ID:4003, and is provided hereinbelow with reference to the sequence listing part.

VGAM1292 host target gene, herein designated VGAM HOST TARGET GENE, encodes a corresponding messenger RNA, VGAM1292 host target RNA, herein designated VGAM HOST TARGET RNA. VGAM1292 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1292 RNA, herein designated VGAM RNA, binds complementarily to one or more host target binding sites located in untranslated regions of VGAM1292 host target RNA, herein designated VGAM HOST TARGET RNA. This complementary binding is due to the fact that the nucleotide sequence of VGAM1292 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1292 RNA, herein designated VGAM RNA, may have a different number of host target binding sites in untranslated regions of a VGAM1292 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1292 RNA, herein designated VGAM RNA, to host target binding sites on VGAM1292 host target RNA, herein designated VGAM HOST TARGET RNA, such as BINDING SITE I, BINDING SITE II and BINDING SITE III, inhibits translation of VGAM1292 host target RNA into VGAM1292 host target protein, herein designated VGAM HOST TARGET PROTEIN. VGAM host target protein is therefore outlined by a broken line.

It is appreciated that VGAM1292 host target gene, herein designated VGAM HOST TARGET GENE, in fact represents a plurality of VGAM1292 host target genes. The mRNA of each one of this plurality of VGAM1292 host target genes comprises one or more host target binding sites, each having a nucleotide sequence which is at least partly complementary to VGAM1292 RNA, herein designated VGAM RNA, and which when bound by VGAM1292 RNA causes inhibition of translation of respective one or more VGAM1292 host target proteins.

It is further appreciated by one skilled in the art that the mode of translational inhibition illustrated by FIG. 1 with specific reference to translational inhibition exerted by VGAM1292 gene, herein designated VGAM GENE, on one or more VGAM1292 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1292 is inhibition of expression of host target genes, as part of a novel viral mechanism of attacking a host. Accordingly, utilities of VGAM1292 include diagnosis, prevention and treatment of viral infection by Swinepox Virus. Specific functions, and accordingly utilities, of VGAM1292 correlate with, and may be deduced from, the identity of the host target genes which VGAM1292 binds and inhibits, and the function of these host target genes, as elaborated hereinbelow.

Nucleotide sequences of the VGAM1292 precursor RNA, herein designated VGAM PRECURSOR RNA, and of the 'diced' VGAM1292 RNA, herein designated VGAM RNA, and a schematic representation of the secondary folding of VGAM1292 folded precursor RNA, herein designated VGAM FOLDED PRECURSOR RNA, of VGAM1292 are further described hereinbelow with reference to Table 1.

Nucleotide sequences of host target binding sites, such as BINDING SITE-I, BINDING SITE-II and BINDING SITE-III of FIG. 1, found on VGAM1292 host target RNA, and schematic representation of the complementarity of each of these host target binding sites to VGAM1292 RNA, herein designated VGAM RNA, are described hereinbelow with reference to Table 2.

As mentioned hereinabove with reference to FIG. 1, a function of VGAM1292 gene, herein designated VGAM is inhibition of expression of VGAM1292 target genes. It is appreciated that specific functions, and accordingly utilities, of VGAM1292 correlate with, and may be deduced from, the identity of the target genes which VGAM1292 binds and inhibits, and the function of these target genes, as elaborated hereinbelow.

G Protein-coupled Receptor Kinase-interactor 2 (GIT2, Accession NM_014776) is a VGAM1292 host target gene. GIT2 BINDING SITE1 through GIT2 BINDING SITE3 are HOST TARGET binding sites found in untranslated regions of mRNA encoded by GIT2, corresponding to HOST TARGET binding sites such as BINDING SITE I, BINDING SITE II or BINDING SITE III. Table 2 illustrates the complementarity of the nucleotide sequences of GIT2 BINDING SITE1 through GIT2 BINDING SITE3, designated SEQ ID:16596, SEQ ID:27678 and SEQ ID:27691 respectively, to the nucleotide sequence of VGAM1292 RNA, herein designated VGAM RNA, also designated SEQ ID:4003.

A function of VGAM1292 is therefore inhibition of G Protein-coupled Receptor Kinase-interactor 2 (GIT2, Accession NM_014776). Accordingly, utilities of VGAM1292 include diagnosis, prevention and treatment of diseases and clinical conditions associated with GIT2. DRCTNNB1A (Accession NM_032581) is another VGAM1293 host target gene. DRCTNNB1A BINDING SITE is HOST TARGET binding site found in the 3' untranslated region of mRNA encoded by DRCTNNB1A, corresponding to a HOST TARGET binding site such as BINDING SITE I, BINDING SITE II or BINDING SITE III. Table 2 illustrates the complementarity of the nucleotide sequences of DRCTNNB1A BINDING SITE, designated SEQ ID:26314, to the nucleotide sequence of VGAM1293 RNA, herein designated VGAM RNA, also designated SEQ ID:4004.

Another function of VGAM1293 is therefore inhibition of DRCTNNB1A (Accession NM_032581). Accordingly, utilities of VGAM1293 include diagnosis, prevention and treatment of diseases and clinical conditions associated with DRCTNNB1A. HGC6.1.1 (Accession NM_014354) is another VGAM1293 host target gene. HGC6.1.1 BINDING SITE is HOST TARGET binding site found in the 3' untranslated region of mRNA encoded by HGC6.1.1, corresponding to a HOST TARGET binding site such as BINDING SITE I, BINDING SITE II or BINDING SITE III. Table 2 illustrates the complementarity of the nucleotide sequences of HGC6.1.1 BINDING SITE, designated SEQ ID:15682, to the nucleotide sequence of VGAM1293 RNA, herein designated VGAM RNA, also designated SEQ ID:4004.

Another function of VGAM1293 is therefore inhibition of HGC6.1.1 (Accession NM_014354). Accordingly, utilities of VGAM1293 include diagnosis, prevention and treatment of diseases and clinical conditions associated with HGC6.1.1. Zinc Finger Protein 387 (ZNF387, Accession NM_014682) is another VGAM1293 host target gene. ZNF387 BINDING SITE is HOST TARGET binding site found in the 3' untranslated region of mRNA encoded by ZNF387, corresponding to a HOST TARGET binding site such as BINDING SITE I, BINDING SITE II or BINDING SITE III. Table 2 illustrates the complementarity of the nucleotide sequences of ZNF387 BINDING SITE, designated SEQ ID:16170, to the nucleotide sequence of VGAM1293 RNA, herein designated VGAM RNA, also designated SEQ ID:4004.

Another function of VGAM1293 is therefore inhibition of Zinc Finger Protein 387 (ZNF387, Accession NM_014682). Accordingly, utilities of VGAM1293 include diagnosis, prevention and treatment of diseases and clinical conditions associated with ZNF387. FIG. 1 further provides a conceptual description of a novel bioinformatically detected viral gene of the present invention, referred to here as Viral Genomic Address Messenger 1294 (VGAM1294) viral gene, which modulates expression of respective host target genes thereof, the function and utility of which host target genes is known in the art.

VGAM1294 is a novel bioinformatically detected regulatory, non protein coding, viral micro RNA (miRNA) gene. The method by which VGAM1294 was detected is described hereinabove with reference to FIGS. 1-8.

VGAM1294 gene, herein designated VGAM GENE, is a viral gene contained in the genome of Vaccinia Virus. VGAM1294 host target gene, herein designated VGAM HOST TARGET GENE, is a human gene contained in the human genome.

VGAM1294 gene encodes a VGAM1294 precursor RNA, herein designated VGAM PRECURSOR RNA. Similar to other miRNA genes, and unlike most ordinary genes, VGAM1294 precursor RNA does not encode a protein. A nucleotide sequence identical or highly similar to the nucleotide sequence of VGAM1294 precursor RNA is designated SEQ ID:1280, and is provided hereinbelow with reference to the sequence listing part. Nucleotide sequence SEQ ID:1280 is located at position 8120 relative to the genome of Vaccinia Virus.

VGAM1294 precursor RNA folds onto itself, forming VGAM1294 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1294 folded precursor RNA into VGAM1294 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1294 RNA is designated SEQ ID:4005, and is provided hereinbelow with reference to the sequence listing part.

VGAM1294 host target gene, herein designated VGAM HOST TARGET GENE, encodes a corresponding messenger RNA, VGAM1294 host target RNA, herein designated VGAM HOST TARGET RNA. VGAM1294 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1294 RNA, herein designated VGAM RNA, binds complementarily to one or more host target binding sites located in untranslated regions of VGAM1294 host target RNA, herein designated VGAM HOST TARGET RNA. This complementary binding is due to the fact that the nucleotide sequence of VGAM1294 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1294 RNA, herein designated VGAM RNA, may have a different number of host target binding sites in untranslated regions of a VGAM1294 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1294 RNA, herein designated VGAM RNA, to host target binding sites on VGAM1294 host target RNA, herein designated VGAM HOST TARGET RNA, such as BINDING SITE I, BINDING SITE II and BINDING SITE III, inhibits translation of VGAM1294 host target RNA into VGAM1294 host target protein, herein designated VGAM HOST TARGET PROTEIN. VGAM host target protein is therefore outlined by a broken line.

It is appreciated that VGAM1294 host target gene, herein designated VGAM HOST TARGET GENE, in fact represents a plurality of VGAM1294 host target genes. The mRNA of each one of this plurality of VGAM1294 host target genes comprises one or more host target binding sites, each having a nucleotide sequence which is at least partly complementary to VGAM1294 RNA, herein designated VGAM RNA, and which when bound by VGAM1294 RNA causes inhibition of translation of respective one or more VGAM1294 host target proteins.

It is further appreciated by one skilled in the art that the mode of translational inhibition illustrated by FIG. 1 with specific reference to translational inhibition exerted by VGAM1294 gene, herein designated VGAM GENE, on one or more VGAM1294 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1294 is inhibition of expression of host target genes, as part of a novel viral mechanism of attacking a host. Accordingly, utilities of VGAM1294 include diagnosis, prevention and treatment of viral infection by Vaccinia Virus. Specific functions, and accordingly utilities, of VGAM1294 correlate with, and may be deduced from, the identity of the host target genes which VGAM1294 binds and inhibits, and the function of these host target genes, as elaborated hereinbelow.

Nucleotide sequences of the VGAM1294 precursor RNA, herein designated VGAM PRECURSOR RNA, and of the 'diced' VGAM1294 RNA, herein designated VGAM RNA, and a schematic representation of the secondary folding of VGAM1294 folded precursor RNA, herein designated VGAM FOLDED PRECURSOR RNA, of VGAM1294 are further described hereinbelow with reference to Table 1.

Nucleotide sequences of host target binding sites, such as BINDING SITE-I, BINDING SITE-II and BINDING SITE-III of FIG. 1, found on VGAM1294 host target RNA, and schematic representation of the complementarity of each of these host target binding sites to VGAM1294 RNA, herein designated VGAM RNA, are described hereinbelow with reference to Table 2.

As mentioned hereinabove with reference to FIG. 1, a function of VGAM1294 gene, herein designated VGAM is inhibition of expression of VGAM1294 target genes. It is appreciated that specific functions, and accordingly utilities, of VGAM1294 correlate with, and may be deduced from, the identity of the target genes which VGAM1294 binds and inhibits, and the function of these target genes, as elaborated hereinbelow.

ATP-binding Cassette, Sub-family A (ABC1), Member 3 (ABCA3, Accession NM_001089) is a VGAM1294 host target gene. ABCA3 BINDING SITE is HOST TARGET binding site found in the 3' untranslated region of mRNA encoded by ABCA3, corresponding to a HOST TARGET binding site such as BINDING SITE I, BINDING SITE II or BINDING SITE III. Table 2 illustrates the complementarity of the nucleotide sequences of ABCA3 BINDING SITE, designated SEQ ID:6744, to the nucleotide sequence of VGAM1294 RNA, herein designated VGAM RNA, also designated SEQ ID:4005.

A function of VGAM1294 is therefore inhibition of ATP-binding Cassette, Sub-family A (ABC1), Member 3 (ABCA3, Accession NM_001089), a gene which may be a transporter, may act as an efflux pump for chemotherapeutics drugs. Accordingly, utilities of VGAM1294 include diagnosis, prevention and treatment of diseases and clinical conditions associated with ABCA3. The function of ABCA3 and its association with various diseases and clinical conditions, has been established by previous studies, as described hereinabove with reference to VGAM336. Brain and Acute Leukemia, Cytoplasmic (BAALC, Accession NM_024812) is another VGAM1294 host target gene. BAALC BINDING SITE is HOST TARGET binding site found in the 3' untranslated region of mRNA encoded by BAALC, corresponding to a HOST TARGET binding site such as BINDING SITE I, BINDING SITE II or BINDING SITE III. Table 2 illustrates the complementarity of the nucleotide sequences of BAALC BINDING SITE, designated SEQ ID:24197, to the nucleotide sequence of VGAM1294 RNA, herein designated VGAM RNA, also designated SEQ ID:4005.

Another function of VGAM1294 is therefore inhibition of Brain and Acute Leukemia, Cytoplasmic (BAALC, Accession NM_024812). Accordingly, utilities of VGAM1294 include diagnosis, prevention and treatment of diseases and clinical conditions associated with BAALC. CERD4 (Accession NM_012074) is another VGAM1294 host target gene. CERD4 BINDING SITE is HOST TARGET binding site found in the 3' untranslated region of mRNA encoded by CERD4, corresponding to a HOST TARGET binding site such as BINDING SITE I, BINDING SITE II or BINDING SITE III. Table 2 illustrates the complementarity of the nucleotide sequences of CERD4 BINDING SITE, designated SEQ ID:14343, to the nucleotide sequence of VGAM1294 RNA, herein designated VGAM RNA, also designated SEQ ID:4005.

Another function of VGAM1294 is therefore inhibition of CERD4 (Accession NM_012074). Accordingly, utilities of VGAM1294 include diagnosis, prevention and treatment of diseases and clinical conditions associated with CERD4. Cleavage and Polyadenylation Specific Factor 4, 30 kDa (CPSF4, Accession NM_006693) is another VGAM1294 host target gene. CPSF4 BINDING SITE is HOST TARGET binding site found in the 3' untranslated region of mRNA encoded by CPSF4, corresponding to a HOST TARGET binding site such as BINDING SITE I, BINDING SITE II or BINDING SITE III. Table 2 illustrates the complementarity of the nucleotide sequences of CPSF4 BINDING SITE, designated SEQ ID:13512, to the nucleotide sequence of VGAM1294 RNA, herein designated VGAM RNA, also designated SEQ ID:4005.

Another function of VGAM1294 is therefore inhibition of Cleavage and Polyadenylation Specific Factor 4, 30 kDa (CPSF4, Accession NM_006693), a gene which may bind DNA. Accordingly, utilities of VGAM1294 include diagnosis, prevention and treatment of diseases and clinical conditions associated with CPSF4. The function of CPSF4 and its association with various diseases and clinical conditions, has been established by previous studies, as described hereinabove with reference to VGAM998. HYA22 (Accession NM_005808) is another VGAM1294 host target gene. HYA22 BINDING SITE is HOST TARGET binding site found in the 3' untranslated region of mRNA encoded by HYA22, corresponding to a HOST TARGET binding site such as BINDING SITE I, BINDING SITE II or BINDING SITE III. Table 2 illustrates the complementarity of the nucleotide sequences of HYA22 BINDING SITE, designated SEQ ID:12385, to the nucleotide sequence of VGAM1294 RNA, herein designated VGAM RNA, also designated SEQ ID:4005.

Another function of VGAM1294 is therefore inhibition of HYA22 (Accession NM_005808). Accordingly, utilities of VGAM1294 include diagnosis, prevention and treatment of diseases and clinical conditions associated with HYA22. KIAA1078 (Accession XM_036589) is another VGAM1294 host target gene. KIAA1078 BINDING SITE is HOST TARGET binding site found in the 3' untranslated region of mRNA encoded by KIAA1078, corresponding to a HOST TARGET binding site such as BINDING SITE I, BINDING SITE II or BINDING SITE III. Table 2 illustrates the complementarity of the nucleotide sequences of KIAA1078 BINDING SITE, designated SEQ ID:32472, to the nucleotide sequence of VGAM1294 RNA, herein designated VGAM RNA, also designated SEQ ID:4005.

Another function of VGAM1294 is therefore inhibition of KIAA1078 (Accession XM_036589). Accordingly, utilities of VGAM1294 include diagnosis, prevention and treatment of diseases and clinical conditions associated with KIAA1078. LOC145842 (Accession XM_085254) is another VGAM1294 host target gene. LOC145842 BINDING SITE is HOST TARGET binding site found in the 5' untranslated region of mRNA encoded by LOC145842, corresponding to a HOST TARGET binding site such as BINDING SITE I, BINDING SITE II or BINDING SITE III. Table 2 illustrates the complementarity of the nucleotide sequences of LOC145842 BINDING SITE, designated SEQ ID:37998, to the nucleotide sequence of VGAM1294 RNA, herein designated VGAM RNA, also designated SEQ ID:4005.

Another function of VGAM1294 is therefore inhibition of LOC145842 (Accession XM_085254). Accordingly, utilities of VGAM1294 include diagnosis, prevention and treatment of diseases and clinical conditions associated with LOC145842. LOC203378 (Accession XM_117541) is another VGAM1294 host target gene. LOC203378 BINDING SITE is HOST TARGET binding site found in the 3' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43561, to the nucleotide sequence of VGAM1294 RNA, herein designated VGAM RNA, also designated SEQ ID:4005.

Another function of VGAM1294 is therefore inhibition of LOC203378 (Accession XM_117541). Accordingly, utilities of VGAM1294 include diagnosis, prevention and treatment of diseases and clinical conditions associated with LOC203378. LOC253975 (Accession XM_171130) is another VGAM1294 host target gene. LOC253975 BINDING SITE is HOST TARGET binding site found in the 5' untranslated region of mRNA encoded by LOC253975, corresponding to a HOST TARGET binding site such as BINDING SITE I, BINDING SITE II or BINDING SITE III. Table 2 illustrates the complementarity of the nucleotide sequences of LOC253975 BINDING SITE, designated SEQ ID:45937, to the nucleotide sequence of VGAM1294 RNA, herein designated VGAM RNA, also designated SEQ ID:4005.

Another function of VGAM1294 is therefore inhibition of LOC253975 (Accession XM_171130). Accordingly, utilities of VGAM1294 include diagnosis, prevention and treatment of diseases and clinical conditions associated with LOC253975. FIG. 1 further provides a conceptual description of a novel bioinformatically detected viral gene of the present invention, referred to here as Viral Genomic Address Messenger 1295 (VGAM1295) viral gene, which modulates expression of respective host target genes thereof, the function and utility of which host target genes is known in the art.

VGAM1295 is a novel bioinformatically detected regulatory, non protein coding, viral micro RNA (miRNA) gene. The method by which VGAM1295 was detected is described hereinabove with reference to FIGS. 1-8.

VGAM1295 gene, herein designated VGAM GENE, is a viral gene contained in the genome of Vaccinia Virus. VGAM1295 host target gene, herein designated VGAM HOST TARGET GENE, is a human gene contained in the human genome.

VGAM1295 gene encodes a VGAM1295 precursor RNA, herein designated VGAM PRECURSOR RNA. Similar to other miRNA genes, and unlike most ordinary genes, VGAM1295 precursor RNA does not encode a protein. A nucleotide sequence identical or highly similar to the nucleotide sequence of VGAM1295 precursor RNA is designated SEQ ID:1281, and is provided hereinbelow with reference to the sequence listing part. Nucleotide sequence SEQ ID:1281 is located at position 10613 relative to the genome of Vaccinia Virus.

VGAM1295 precursor RNA folds onto itself, forming VGAM1295 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1295 folded precursor RNA into VGAM1295 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1295 RNA is designated SEQ ID:4006, and is provided hereinbelow with reference to the sequence listing part.

VGAM1295 host target gene, herein designated VGAM HOST TARGET GENE, encodes a corresponding messenger RNA, VGAM1295 host target RNA, herein designated VGAM HOST TARGET RNA. VGAM1295 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1295 RNA, herein designated VGAM RNA, binds complementarily to one or more host target binding sites located in untranslated regions of VGAM1295 host target RNA, herein designated VGAM HOST TARGET RNA. This complementary binding is due to the fact that the nucleotide sequence of VGAM1295 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1295 RNA, herein designated VGAM RNA, may have a different number of host target binding sites in untranslated regions of a VGAM1295 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1295 RNA, herein designated VGAM RNA, to host target binding sites on VGAM1295 host target RNA, herein designated VGAM HOST TARGET RNA, such as BINDING SITE I, BINDING SITE II and BINDING SITE III, inhibits translation of VGAM1295 host target RNA into VGAM1295 host target protein, herein designated VGAM HOST TARGET PROTEIN. VGAM host target protein is therefore outlined by a broken line.

It is appreciated that VGAM1295 host target gene, herein designated VGAM HOST TARGET GENE, in fact represents a plurality of VGAM1295 host target genes. The mRNA of each one of this plurality of VGAM1295 host target genes comprises one or more host target binding sites, each having a nucleotide sequence which is at least partly complementary to VGAM1295 RNA, herein designated VGAM RNA, and which when bound by VGAM1295 RNA causes inhibition of translation of respective one or more VGAM1295 host target proteins.

It is further appreciated by one skilled in the art that the mode of translational inhibition illustrated by FIG. 1 with specific reference to translational inhibition exerted by VGAM1295 gene, herein designated VGAM GENE, on one or more VGAM1295 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1295 is inhibition of expression of host target genes, as part of a novel viral mechanism of attacking a host. Accordingly, utilities of VGAM1295 include diagnosis, prevention and treatment of viral infection by Vaccinia Virus. Specific functions, and accordingly utilities, of VGAM1295 correlate with, and may be deduced from, the identity of the host target genes which VGAM1295 binds and inhibits, and the function of these host target genes, as elaborated hereinbelow.

Nucleotide sequences of the VGAM1295 precursor RNA, herein designated VGAM PRECURSOR RNA, and of the 'diced' VGAM1295 RNA, herein designated VGAM RNA, and a schematic representation of the secondary folding of VGAM1295 folded precursor RNA, herein designated VGAM FOLDED PRECURSOR RNA, of VGAM1295 are further described hereinbelow with reference to Table 1.

Nucleotide sequences of host target binding sites, such as BINDING SITE-I, BINDING SITE-II and BINDING SITE-III of FIG. 1, found on VGAM1295 host target RNA, and schematic representation of the complementarity of each of these host target binding sites to VGAM1295 RNA, herein designated VGAM RNA, are described hereinbelow with reference to Table 2.

As mentioned hereinabove with reference to FIG. 1, a function of VGAM1295 gene, herein designated VGAM is inhibition of expression of VGAM1295 target genes. It is appreciated that specific functions, and accordingly utilities, of VGAM1295 correlate with, and may be deduced from, the identity of the target genes which VGAM1295 binds and inhibits, and the function of these target genes, as elaborated hereinbelow.

Centrosomal Protein 1 (CEP1, Accession NM_007018) is a VGAM1295 host target gene. CEP1 BINDING SITE is HOST TARGET binding site found in the 5' untranslated region of mRNA encoded by CEP1, corresponding to a HOST TARGET binding site such as BINDING SITE I, BINDING SITE II or BINDING SITE III. Table 2 illustrates the complementarity of the nucleotide sequences of CEP1 BINDING SITE, designated SEQ ID:13874, to the nucleotide sequence of VGAM1295 RNA, herein designated VGAM RNA, also designated SEQ ID:4006.

A function of VGAM1295 is therefore inhibition of Centrosomal Protein 1 (CEP1, Accession NM_007018), a gene which mediates actin cytoskeleton reorganization at the plasma membrane. Accordingly, utilities of VGAM1295 include diagnosis, prevention and treatment of diseases and clinical conditions associated with CEP1. The function of CEP1 has been established by previous studies. Hemonectin is an extracellular matrix cytoadhesive protein that promotes the attachment of developing bone marrow granulocytic cells to bone marrow stroma. By immunoscreening an endothelial cell cDNA library with a polyclonal anti-rabbit hemonectin antibody and probing an oligo (dT)-primed library, Bahou et al. (1992) obtained a cDNA encoding MSE55. Sequence analysis predicted that the 391-amino acid serum protein lacks a signal peptide but contains a series of 8 proline/alanine repeats as well as EF-hand motifs. Southern blot analysis suggested that the MSE55 gene is conserved in primates, dogs, and ducks. Northern blot analysis detected a 2.5-kb MSE55 transcript in endothelial and K562 cells; expression was not detected in monocytic, myeloid, erythroleukemic, or lymphocytic cell lines. Immunoblot analysis showed expression of a 55-kD protein in endothelial cell lines and serum. Because antibody raised against MSE55 did not recognize hemonectin and anti-hemonectin antibody did not react with the recombinant protein, Bahou et al. (1992) concluded that hemonectin and MSE55 are distinct. Burbelo et al. (1995) identified a 16-amino acid CDC42 (OMIM Ref. No. 116952)/ RAC (OMIM Ref. No. 602048) interactive-binding (CRIB) region in a number of kinase and nonkinase proteins, including MSE55. MSE55, a nonkinase, bound more strongly to the GTP form of CDC42 than to RAC. Burbelo et al. (1999) showed that MSE55 increases membrane actin polymerization and induces the formation of long, actin-based protrusions in fibroblasts. They concluded that MSE55 is a CDC42 effector protein that mediates actin cytoskeleton reorganization at the plasma membrane.

Full details of the abovementioned studies are described in the following publications, the disclosure of which are hereby incorporated by reference:

Burbelo, P. D.; Drechsel, D.; Hall, A.: A conserved binding motif defines numerous candidate target proteins for both Cdc42 and Rac GTPases. J. Biol. Chem. 270:29071-29074, 1995; and Burbelo, P. D.; Snow, D. M.; Bahou, W.; Spiegel, S.: MSE55, a Cdc42 effector protein, induces long cellular extensions in fibroblasts. Proc. Nat. Acad. Sci. 96:9083-9088, 1999.

Further studies establishing the function and utilities of CEP1 are found in John Hopkins OMIM database record ID 606084, and in sited publications numbered 4425-442 and 4908 listed in the bibliography section hereinbelow, which are also hereby incorporated by reference. UDP-N-acetyl-alpha-D-galactosamine:polypeptide N-acetylgalactosaminyltransferase 7 (GalNAc-T7) (GALNT7, Accession NM_017423) is another VGAM1295 host target gene. GALNT7 BINDING SITE is HOST TARGET binding site found in the 3' untranslated region of mRNA encoded by GALNT7, corresponding to a HOST TARGET binding site such as BINDING SITE I, BINDING SITE II or BINDING SITE III. Table 2 illustrates the complementarity of the nucleotide sequences of GALNT7 BINDING SITE, designated SEQ ID:18879, to the nucleotide sequence of VGAM1295 RNA, herein designated VGAM RNA, also designated SEQ ID:4006.

Another function of VGAM1295 is therefore inhibition of UDP-N-acetyl-alpha-D-galactosamine:polypeptide N-acetylgalactosaminyltransferase 7 (GalNAc-T7) (GALNT7, Accession NM_017423). Accordingly, utilities of VGAM1295 include diagnosis, prevention and treatment of diseases and clinical conditions associated with GALNT7. Gap Junction Protein, Alpha 1, 43 kDa (connexin 43) (GJA1, Accession NM_000165) is another VGAM1295 host target gene. GJA1 BINDING SITE is HOST TARGET binding site found in the 3' untranslated region of mRNA encoded by GJA1, corresponding to a HOST TARGET binding site such as BINDING SITE I, BINDING SITE II or BINDING SITE III. Table 2 illustrates the complementarity of the nucleotide sequences of GJA1 BINDING SITE, designated SEQ ID:5676, to the nucleotide sequence of VGAM1295 RNA, herein designated VGAM RNA, also designated SEQ ID:4006.

Another function of VGAM1295 is therefore inhibition of Gap Junction Protein, Alpha 1, 43 kDa (connexin 43) (GJA1, Accession NM_000165), a gene which may act in synchronizing heart contraction and embryonic development. Accordingly, utilities of VGAM1295 include diagnosis, prevention and treatment of diseases and clinical conditions associated with GJA1. The function of GJA1 and its association with various diseases and clinical conditions, has been established by previous studies, as described hereinabove with reference to VGAM341. Phosphomannomutase 2 (PMM2, Accession XM_050755) is another VGAM1295 host target gene. PMM2 BINDING SITE is HOST TARGET binding site found in the 3' untranslated region of mRNA encoded by PMM2, corresponding to a HOST TARGET binding site such as BINDING SITE I, BINDING SITE II or BINDING SITE III. Table 2 illustrates the complementarity of the nucleotide sequences of PMM2 BINDING SITE, designated SEQ ID:35676, to the nucleotide sequence of VGAM1295 RNA, herein designated VGAM RNA, also designated SEQ ID:4006.

Another function of VGAM1295 is therefore inhibition of Phosphomannomutase 2 (PMM2, Accession XM_050755). Accordingly, utilities of VGAM1295 include diagnosis, prevention and treatment of diseases and clinical conditions associated with PMM2. RalA Binding Protein 1 (RALBP1, Accession NM_006788) is another VGAM1295 host target gene. RALBP1 BINDING SITE is HOST TARGET binding site found in the 3' untranslated region of mRNA encoded by RALBP1, corresponding to a HOST TARGET binding site such as BINDING SITE I, BINDING SITE II or BINDING SITE III. Table 2 illustrates the complementarity of the nucleotide sequences of RALBP1 BINDING SITE, designated SEQ ID:13655, to the nucleotide sequence of VGAM1295 RNA, herein designated VGAM RNA, also designated SEQ ID:4006.

Another function of VGAM1295 is therefore inhibition of RalA Binding Protein 1 (RALBP1, Accession NM_006788), a gene which plays a role in signal transduction and catalyzes the transport of glutathione conjugates and xenobiotics. Accordingly, utilities of VGAM1295 include diagnosis, prevention and treatment of diseases and clinical conditions associated with RALBP1. The function of RALBP1 and its association with various diseases and clinical conditions, has been established by previous studies, as described hereinabove with reference to VGAM345. Ubiquilin 1 (UBQLN1, Accession NM_013438) is another VGAM1295 host target gene. UBQLN1 BINDING SITE is HOST TARGET binding site found in the 3' untranslated region of mRNA encoded by UBQLN1, corresponding to a HOST TARGET binding site such as BINDING SITE I, BINDING SITE II or BINDING SITE III. Table 2 illustrates the complementarity of the nucleotide sequences of UBQLN1 BINDING SITE, designated SEQ ID:15100, to the nucleotide sequence of VGAM1295 RNA, herein designated VGAM RNA, also designated SEQ ID:4006.

Another function of VGAM1295 is therefore inhibition of Ubiquilin 1 (UBQLN1, Accession NM_013438), a gene which may have a role in regulating cell cycle progression. Accordingly, utilities of VGAM1295 include diagnosis, prevention and treatment of diseases and clinical conditions associated with UBQLN1. The function of UBQLN1 has been established by previous studies. By screening a human nigra cDNA library with a rat DA41 cDNA as a probe, Hanaoka et al. (2000) isolated the human DA41 homolog. Human DA41 encodes a 589-amino acid protein with a predicted molecular mass of 62.4 kD. The protein shows 86% amino acid sequence identity with the rat protein, indicating the evolutionarily conserved structure and function of DA41. DA41 was expressed ubiquitously in adult human tissues, with relatively higher levels in pituitary gland, adrenal gland, kidney, thymus, and placenta. By performing independent yeast 2-hybrid screens, Kleijnen et al. (2000) isolated cDNAs encoding PLIC1 and PLIC2 (UBQLN2; 300264), homologs of the mouse Plics (proteins linking integrin-associated protein (IAP; 601028) and cytoskeleton) and the yeast Dsk2 protein. PLIC1, also called UBQLN1, shares 72% amino acid identity with PLIC2. Two motifs are conserved in the mammalian PLICs and yeast Dsk2, an N-terminal ubiquitin (OMIM Ref. No. 191320)-like (UBL) domain and a C-terminal ubiquitin-associated (UBA) domain. Unlike ubiquitin, the UBL domain of the PLICs does not have a diglycine motif in its C terminus; the diglycine motif serves as a target site for cellular hydrolases that release ubiquitin from precursor fusion proteins. The absence of a GG sequence suggests that the UBL domain in the PLICs is an integral part of the open reading frame. The UBA domain is a loosely defined sequence motif present in multiple enzyme classes of the ubiquitination machinery. The most notable difference between the mammalian PLICs is the presence of a collagen-like motif in PLIC2 that is absent in PLIC1 and yeast Dsk2. This domain is most homologous to the collagen-like oncoprotein of herpesvirus Saimiri, STP-C488, which is implicated in intracellular signaling via the RAS-RAF pathway (see OMIM Ref. No. 190020). The collagen-like domain of PLIC2 contains 8 PXGP motifs that are susceptible to cleavage by collagenase in vitro. Kleijnen et al (2000) showed that the human PLICs physically associate with both proteasomes and ubiquitin ligases in large complexes. Overexpression of PLICs interfered with the in vivo degradation of 2 unrelated ubiquitin-dependent proteasome substrates, p53 (OMIM Ref. No. 191170) and I-kappa-B-alpha (NFKBIA; 164008), but not a ubiquitin-independent substrate. These findings raised the possibility that the PLICs, and possibly related ubiquitin-like family members, may functionally link the ubiquitination machinery to the proteasome to affect in vivo protein degradation.

Full details of the abovementioned studies are described in the following publications, the disclosure of which are hereby incorporated by reference:

Hanaoka, E.; Ozaki, T.; Ohira, M.; Nakamura, Y.; Suzuki, M.; Takahashi, E.; Moriya, H.; Nakagawara, A.; Sakiyama, S.: Molecular cloning and expression analysis of the human DA41 gene and its mapping to chromosome 9q21.2-q21.3. J. Hum. Genet. 45:188-191, 2000; and Kleijnen, M. F.; Shih, A. H.; Zhou, P.; Kumar, S.; Soccio, R. E.; Kedersha, N. L.; Gill, G.; Howley, P. M.: The hPLIC proteins may provide a link between the ubiquitination machinery.

Further studies establishing the function and utilities of UBQLN1 are found in John Hopkins OMIM database record ID 605046, and in sited publications numbered 659 and 10635 listed in the bibliography section hereinbelow, which are also hereby incorporated by reference. Ubiquilin 2 (UBQLN2, Accession NM_013444) is another VGAM1295 host target gene. UBQLN2 BINDING SITE is HOST TARGET binding site found in the 3' untranslated region of mRNA encoded by UBQLN2, corresponding to a HOST TARGET binding site such as BINDING SITE I, BINDING SITE II or BINDING SITE III. Table 2 illustrates the complementarity of the nucleotide sequences of UBQLN2 BINDING SITE, designated SEQ ID:15111, to the nucleotide sequence of VGAM1295 RNA, herein designated VGAM RNA, also designated SEQ ID:4006.

Another function of VGAM1295 is therefore inhibition of Ubiquilin 2 (UBQLN2, Accession NM_013444), a gene which is involved in spindle pole body duplication with rad23. Accordingly, utilities of VGAM1295 include diagnosis, prevention and treatment of diseases and clinical conditions associated with UBQLN2. The function of UBQLN2 has been established by previous studies. By performing independent yeast 2-hybrid screens, Kleijnen et al. (2000) isolated cDNAs encoding PLIC1 (UBQLN1; 605046) and PLIC2, homologs of the mouse Plics (proteins linking integrin-associated protein (IAP; 601028) and cytoskeleton) and the yeast Dsk2 protein. The predicted 624-amino acid PLIC2 protein, also called UBQLN2, shares 72% amino acid identity with PLIC1. Two motifs are conserved in the mammalian PLICs and yeast Dsk2, an N-terminal ubiquitin (OMIM Ref. No. 191320)-like (UBL) domain and a C-terminal ubiquitin-associated (UBA) domain. Unlike ubiquitin, the UBL domain of the PLICs does not have a diglycine motif in its C terminus; the diglycine motif serves as a target site for cellular hydrolases that release ubiquitin from precursor fusion proteins. The absence of a GG sequence suggests that the UBL domain in the PLICs is an integral part of the open reading frame. The UBA domain is a loosely defined sequence motif present in multiple enzyme classes of the ubiquitination machinery. The most notable difference between the mammalian PLICs is the presence of a collagen-like motif in PLIC2 that is absent in PLIC1 and yeast Dsk2. This domain is most homologous to the collagen-like oncoprotein of herpesvirus Saimiri, STP-C488, which is implicated in intracellular signaling via the RAS-RAF pathway (see OMIM Ref. No. 190020). The collagen-like domain of PLIC2 contains 8 PXGP motifs that are susceptible to cleavage by collagenase in vitro. Kleijnen et al (2000) showed that the human PLICs physically associate with both proteasomes and ubiquitin ligases in large complexes. Overexpression of PLICs interfered with the in vivo degradation of 2 unrelated ubiquitin-dependent proteasome substrates, p53 (OMIM Ref. No. 191170) and I-kappa-B-alpha (NFKBIA; 164008), but not a ubiquitin-independent substrate. These findings raised the possibility that the PLICs, and possibly related ubiquitin-like family members, may functionally link the ubiquitination machinery to the proteasome to affect in vivo protein degradation. By screening a human lung 2-hybrid cDNA library using a pGBT9-STCH (OMIM Ref. No. 601100) plasmid as bait, Kaye et al. (2000) isolated a cDNA encoding UBQLN2, which they termed CHAP1/DSK2. Mutation analysis determined that the C-terminal Sti1-like repeat sequence, but neither the N-terminal UBL domain nor the C-terminal UBA domain, is required for binding of UBQLN2 to the ATPase domain of STCH.

Full details of the abovementioned studies are described in the following publications, the disclosure of which are hereby incorporated by reference:

Kaye, F. J.; Shows, T. B.: Assignment of ubiquilin 2 (UBQLN2) to human chromosome xp11.23-p11.1 by Gene-Bridge radiation hybrids. Cytogenet. Cell Genet. 89:116-117, 2000; and Kleijnen, M. F.; Shih, A. H.; Zhou, P.; Kumar, S.; Soccio, R. E.; Kedersha, N. L.; Gill, G.; Howley, P. M.: The hPLIC proteins may provide a link between the ubiquitination machinery.

Further studies establishing the function and utilities of UBQLN2 are found in John Hopkins OMIM database record ID 300264, and in sited publications numbered 10633-10635 listed in the bibliography section hereinbelow, which are also hereby incorporated by reference. Adaptor-related Protein Complex 1, Sigma 2 Subunit (AP1S2, Accession NM_003916) is another VGAM1295 host target gene. AP1S2 BINDING SITE is HOST TARGET binding site found in the 3' untranslated region of mRNA encoded by AP1S2, corresponding to a HOST TARGET binding site such as BINDING SITE I, BINDING SITE II or BINDING SITE III. Table 2 illustrates the complementarity of the nucleotide sequences of AP1S2 BINDING SITE, designated SEQ ID:10001, to the nucleotide sequence of VGAM1295 RNA, herein designated VGAM RNA, also designated SEQ ID:4006.

Another function of VGAM1295 is therefore inhibition of Adaptor-related Protein Complex 1, Sigma 2 Subunit (AP1S2, Accession NM_003916). Accordingly, utilities of VGAM1295 include diagnosis, prevention and treatment of diseases and clinical conditions associated with AP1S2. Claudin 1 (CLDN1, Accession NM_021101) is another VGAM1295 host target gene. CLDN1 BINDING SITE is HOST TARGET binding site found in the 3' untranslated region of mRNA encoded by CLDN1, corresponding to a HOST TARGET binding site such as BINDING SITE I, BINDING SITE II or BINDING SITE III. Table 2 illustrates the complementarity of the nucleotide sequences of CLDN1 BINDING SITE, designated SEQ ID:22080, to the nucleotide sequence of VGAM1295 RNA, herein designated VGAM RNA, also designated SEQ ID:4006.

Another function of VGAM1295 is therefore inhibition of Claudin 1 (CLDN1, Accession NM_021101). Accordingly, utilities of VGAM1295 include diagnosis, prevention and treatment of diseases and clinical conditions associated with CLDN1. dA141H5.1 (Accession NM_145234) is another VGAM1295 host target gene. dA141H5.1 BINDING SITE is HOST TARGET binding site found in the 3' untranslated region of mRNA encoded by dA141H5.1, corresponding to a HOST TARGET binding site such as BINDING SITE I, BINDING SITE II or BINDING SITE III. Table 2 illustrates the complementarity of the nucleotide sequences of dA141H5.1 BINDING SITE, designated SEQ ID:29747, to the nucleotide sequence of VGAM1295 RNA, herein designated VGAM RNA, also designated SEQ ID:4006.

Another function of VGAM1295 is therefore inhibition of dA141H5.1 (Accession NM_145234). Accordingly, utilities of VGAM1295 include diagnosis, prevention and treatment of diseases and clinical conditions associated with dA141H5.1. FHX (Accession NM_018416) is another VGAM1295 host target gene. FHX BINDING SITE is HOST TARGET binding site found in the 3' untranslated region of mRNA encoded by FHX, corresponding to a HOST TARGET binding site such as BINDING SITE I, BINDING SITE II or BINDING SITE III. Table 2 illustrates the complementarity of the nucleotide sequences of FHX BINDING SITE, designated SEQ ID:20460, to the nucleotide sequence of VGAM1295 RNA, herein designated VGAM RNA, also designated SEQ ID:4006.

Another function of VGAM1295 is therefore inhibition of FHX (Accession NM_018416). Accordingly, utilities of VGAM1295 include diagnosis, prevention and treatment of diseases and clinical conditions associated with FHX. FLJ20254 (Accession NM_017727) is another VGAM1295 host target gene. FLJ20254 BINDING SITE is HOST TARGET binding site found in the 3' untranslated region of mRNA encoded by FLJ20254, corresponding to a HOST TARGET binding site such as BINDING SITE I, BINDING SITE II or BINDING SITE III. Table 2 illustrates the complementarity of the nucleotide sequences of FLJ20254 BINDING SITE, designated SEQ ID:19315, to the nucleotide sequence of VGAM1295 RNA, herein designated VGAM RNA, also designated SEQ ID:4006.

Another function of VGAM1295 is therefore inhibition of FLJ20254 (Accession NM_017727). Accordingly, utilities of VGAM1295 include diagnosis, prevention and treatment of diseases and clinical conditions associated with FLJ20254. FLJ22690 (Accession NM_024711) is another VGAM1295 host target gene. FLJ22690 BINDING SITE is HOST TARGET binding site found in the 3' untranslated region of mRNA encoded by FLJ22690, corresponding to a HOST TARGET binding site such as BINDING SITE I, BINDING SITE II or BINDING SITE III. Table 2 illustrates the complementarity of the nucleotide sequences of FLJ22690 BINDING SITE, designated SEQ ID:24036, to the nucleotide sequence of VGAM1295 RNA, herein designated VGAM RNA, also designated SEQ ID:4006.

Another function of VGAM1295 is therefore inhibition of FLJ22690 (Accession NM_024711). Accordingly, utilities of VGAM1295 include diagnosis, prevention and treatment of diseases and clinical conditions associated with FLJ22690. Ganglioside-induced Differentiation-associated Protein 1-like 1 (GDAP1L1, Accession NM_024034) is another VGAM1295 host target gene. GDAP1L1 BINDING SITE is HOST TARGET binding site found in the 3' untranslated region of mRNA encoded by GDAP1L1, corresponding to a HOST TARGET binding site such as BINDING SITE I, BINDING SITE II or BINDING SITE III. Table 2 illustrates the complementarity of the nucleotide sequences of GDAP1L1 BINDING SITE, designated SEQ ID:23465, to the nucleotide sequence of VGAM1295 RNA, herein designated VGAM RNA, also designated SEQ ID:4006.

Another function of VGAM1295 is therefore inhibition of Ganglioside-induced Differentiation-associated Protein 1-like 1 (GDAP1L1, Accession NM_024034). Accordingly, utilities of VGAM1295 include diagnosis, prevention and treatment of diseases and clinical conditions associated with GDAP1L1. Glia Maturation Factor, Beta (GMFB, Accession NM_004124) is another VGAM1295 host target gene. GMFB BINDING SITE is HOST TARGET binding site found in the 3' untranslated region of mRNA encoded by GMFB, corresponding to a HOST TARGET binding site such as BINDING SITE I, BINDING SITE II or BINDING SITE III. Table 2 illustrates the complementarity of the nucleotide sequences of GMFB BINDING SITE, designated SEQ ID:10330, to the nucleotide sequence of VGAM1295 RNA, herein designated VGAM RNA, also designated SEQ ID:4006.

Another function of VGAM1295 is therefore inhibition of Glia Maturation Factor, Beta (GMFB, Accession NM_004124). Accordingly, utilities of VGAM1295 include diagnosis, prevention and treatment of diseases and clinical conditions associated with GMFB. KIAA0254 (Accession NM_014758) is another VGAM1295 host target gene. KIAA0254 BINDING SITE is HOST TARGET binding site found in the 3' untranslated region of mRNA encoded by KIAA0254, corresponding to a HOST TARGET binding site such as BINDING SITE I, BINDING SITE II or BINDING SITE III. Table 2 illustrates the complementarity of the nucleotide sequences of KIAA0254 BINDING SITE, designated SEQ ID:16502, to the nucleotide sequence of VGAM1295 RNA, herein designated VGAM RNA, also designated SEQ ID:4006.

Another function of VGAM1295 is therefore inhibition of KIAA0254 (Accession NM_014758). Accordingly, utilities of VGAM1295 include diagnosis, prevention and treatment of diseases and clinical conditions associated with KIAA0254. KIAA1524 (Accession XM_056015) is another VGAM1295 host target gene. KIAA1524 BINDING SITE is HOST TARGET binding site found in the 5' untranslated region of mRNA encoded by KIAA1524, corresponding to a HOST TARGET binding site such as BINDING SITE I, BINDING SITE II or BINDING SITE III. Table 2 illustrates the complementarity of the nucleotide sequences of KIAA1524 BINDING SITE, designated SEQ ID:36359, to the nucleotide sequence of VGAM1295 RNA, herein designated VGAM RNA, also designated SEQ ID:4006.

Another function of VGAM1295 is therefore inhibition of KIAA1524 (Accession XM_056015). Accordingly, utilities of VGAM1295 include diagnosis, prevention and treatment of diseases and clinical conditions associated with KIAA1524. MGC13007 (Accession NM_032320) is another VGAM1295 host target gene. MGC13007 BINDING SITE is HOST TARGET binding site found in the 3' untranslated region of mRNA encoded by MGC13007, corresponding to a HOST TARGET binding site such as BINDING SITE I, BINDING SITE II or BINDING SITE III. Table 2 illustrates the complementarity of the nucleotide sequences of MGC13007 BINDING SITE, designated SEQ ID:26119, to the nucleotide sequence of VGAM1295 RNA, herein designated VGAM RNA, also designated SEQ ID:4006.

Another function of VGAM1295 is therefore inhibition of MGC13007 (Accession NM_032320). Accordingly, utilities of VGAM1295 include diagnosis, prevention and treatment of diseases and clinical conditions associated with MGC13007. Phytoceramidase, Alkaline (PHCA, Accession NM_018367) is another VGAM1295 host target gene. PHCA BINDING SITE is HOST TARGET binding site found in the 3' untranslated region of mRNA encoded by PHCA, corresponding to a HOST TARGET binding site such as BINDING SITE I, BINDING SITE II or BINDING SITE III. Table 2 illustrates the complementarity of the nucleotide sequences of PHCA BINDING SITE, designated SEQ ID:20378, to the nucleotide sequence of VGAM1295 RNA, herein designated VGAM RNA, also designated SEQ ID:4006.

Another function of VGAM1295 is therefore inhibition of Phytoceramidase, Alkaline (PHCA, Accession NM_018367). Accordingly, utilities of VGAM1295 include diagnosis, prevention and treatment of diseases and clinical conditions associated with PHCA. PRO1580 (Accession NM_018502) is another VGAM1295 host target gene. PRO1580 BINDING SITE is HOST TARGET binding site found in the 5' untranslated region of mRNA encoded by PRO1580, corresponding to a HOST TARGET binding site such as BINDING SITE I, BINDING SITE II or BINDING SITE III. Table 2 illustrates the complementarity of the nucleotide sequences of PRO1580 BINDING SITE, designated SEQ ID:20565, to the nucleotide sequence of VGAM1295 RNA, herein designated VGAM RNA, also designated SEQ ID:4006.

Another function of VGAM1295 is therefore inhibition of PRO1580 (Accession NM_018502). Accordingly, utilities of VGAM1295 include diagnosis, prevention and treatment of diseases and clinical conditions associated with PRO1580. LOC126661 (Accession XM_059061) is another VGAM1295 host target gene. LOC126661 BINDING SITE is HOST TARGET binding site found in the 3' untranslated region of mRNA encoded by LOC126661, corresponding to a HOST TARGET binding site such as BINDING SITE I, BINDING SITE II or BINDING SITE III. Table 2 illustrates the complementarity of the nucleotide sequences of LOC126661 BINDING SITE, designated SEQ ID:36855, to the nucleotide sequence of VGAM1295 RNA, herein designated VGAM RNA, also designated SEQ ID:4006.

Another function of VGAM1295 is therefore inhibition of LOC126661 (Accession XM_059061). Accordingly, utilities of VGAM1295 include diagnosis, prevention and treatment of diseases and clinical conditions associated with LOC126661. LOC158364 (Accession XM_088546) is another VGAM1295 host target gene. LOC158364 BINDING SITE is HOST TARGET binding site found in the 5' untranslated region of mRNA encoded by LOC158364, corresponding to a HOST TARGET binding site such as BINDING SITE I, BINDING SITE II or BINDING SITE III. Table 2 illustrates the complementarity of the nucleotide sequences of LOC158364 BINDING SITE, designated SEQ ID:39813, to the nucleotide sequence of VGAM1295 RNA, herein designated VGAM RNA, also designated SEQ ID:4006.

Another function of VGAM1295 is therefore inhibition of LOC158364 (Accession XM_088546). Accordingly, utilities of VGAM1295 include diagnosis, prevention and treatment of diseases and clinical conditions associated with LOC158364. LOC197319 (Accession XM_113862) is another VGAM1295 host target gene. LOC197319 BINDING SITE is HOST TARGET binding site found in the 3' untranslated region of mRNA encoded by LOC197319, corresponding to a HOST TARGET binding site such as BINDING SITE I, BINDING SITE II or BINDING SITE III. Table 2 illustrates the complementarity of the nucleotide sequences of LOC197319 BINDING SITE, designated SEQ ID:42475, to the nucleotide sequence of VGAM1295 RNA, herein designated VGAM RNA, also designated SEQ ID:4006.

Another function of VGAM1295 is therefore inhibition of LOC197319 (Accession XM_113862). Accordingly, utilities of VGAM1295 include diagnosis, prevention and treatment of diseases and clinical conditions associated with LOC197319. FIG. 1 further provides a conceptual description of a novel bioinformatically detected viral gene of the present invention, referred to here as Viral Genomic Address Messenger 1296 (VGAM1296) viral gene, which modulates expression of respective host target genes thereof, the function and utility of which host target genes is known in the art.

VGAM1296 is a novel bioinformatically detected regulatory, non protein coding, viral micro RNA (miRNA) gene. The method by which VGAM1296 was detected is described hereinabove with reference to FIGS. 1-8.

VGAM1296 gene, herein designated VGAM GENE, is a viral gene contained in the genome of Vaccinia Virus. VGAM1296 host target gene, herein designated VGAM HOST TARGET GENE, is a human gene contained in the human genome.

VGAM1296 gene encodes a VGAM1296 precursor RNA, herein designated VGAM PRECURSOR RNA. Similar to other miRNA genes, and unlike most ordinary genes, VGAM1296 precursor RNA does not encode a protein. A nucleotide sequence identical or highly similar to the nucleotide sequence of VGAM1296 precursor RNA is designated SEQ ID:1282, and is provided hereinbelow with reference to the sequence listing part. Nucleotide sequence SEQ ID:1282 is located at position 11590 relative to the genome of Vaccinia Virus.

VGAM1296 precursor RNA folds onto itself, forming VGAM1296 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1296 folded precursor RNA into VGAM1296 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM1296 RNA is designated SEQ ID:4007, and is provided hereinbelow with reference to the sequence listing part.

VGAM1296 host target gene, herein designated VGAM HOST TARGET GENE, encodes a corresponding messenger RNA, VGAM1296 host target RNA, herein designated VGAM HOST TARGET RNA. VGAM1296 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1296 RNA, herein designated VGAM RNA, binds complementarily to one or more host target binding sites located in untranslated regions of VGAM1296 host target RNA, herein designated VGAM HOST TARGET RNA. This complementary binding is due to the fact that the nucleotide sequence of VGAM1296 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1296 RNA, herein designated VGAM RNA, may have a different number of host target binding sites in untranslated regions of a VGAM1296 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1296 RNA, herein designated VGAM RNA, to host target binding sites on VGAM1296 host target RNA, herein designated VGAM HOST TARGET RNA, such as BINDING SITE I, BINDING SITE II and BINDING SITE III, inhibits translation of VGAM1296 host target RNA into VGAM1296 host target protein, herein designated VGAM HOST TARGET PROTEIN. VGAM host target protein is therefore outlined by a broken line.

It is appreciated that VGAM1296 host target gene, herein designated VGAM HOST TARGET GENE, in fact represents a plurality of VGAM1296 host target genes. The mRNA of each one of this plurality of VGAM1296 host target genes comprises one or more host target binding sites, each having a nucleotide sequence which is at least partly complementary to VGAM1296 RNA, herein designated VGAM RNA, and which when bound by VGAM1296 RNA causes inhibition of translation of respective one or more VGAM1296 host target proteins.

It is further appreciated by one skilled in the art that the mode of translational inhibition illustrated by FIG. 1 with specific reference to translational inhibition exerted by VGAM1296 gene, herein designated VGAM GENE, on one or more VGAM1296 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1296 is inhibition of expression of host target genes, as part of a novel viral mechanism of attacking a host. Accordingly, utilities of VGAM1296 include diagnosis, prevention and treatment of viral infection by Vaccinia Virus. Specific functions, and accordingly utilities, of VGAM1296 correlate with, and may be deduced from, the identity of the host target genes which VGAM1296 binds and inhibits, and the function of these host target genes, as elaborated hereinbelow.

Nucleotide sequences of the VGAM1296 precursor RNA, herein designated VGAM PRECURSOR RNA, and of the 'diced' VGAM1296 RNA, herein designated VGAM RNA, and a schematic representation of the secondary folding of VGAM1296 folded precursor RNA, herein designated VGAM FOLDED PRECURSOR RNA, of VGAM1296 are further described hereinbelow with reference to Table 1.

Nucleotide sequences of host target binding sites, such as BINDING SITE-I, BINDING SITE-II and BINDING SITE-III of FIG. 1, found on VGAM1296 host target RNA, and schematic representation of the complementarity of each of these host target binding sites to VGAM1296 RNA, herein designated VGAM RNA, are described hereinbelow with reference to Table 2.

As mentioned hereinabove with reference to FIG. 1, a function of VGAM1296 gene, herein designated VGAM is inhibition of expression of VGAM1296 target genes. It is appreciated that specific functions, and accordingly utilities, of VGAM1296 correlate with, and may be deduced from, the identity of the target genes which VGAM1296 binds and inhibits, and the function of these target genes, as elaborated hereinbelow.

B-cell Translocation Gene 1, Anti-proliferative (BTG1, Accession NM_001731) is a VGAM1296 host target gene. BTG1 BINDING SITE is HOST TARGET binding site found in the 3' untranslated region of mRNA encoded by BTG1, corresponding to a HOST TARGET binding site such as BINDING SITE I, BINDING SITE II or BINDING SITE III. Table 2 illustrates the complementarity of the nucleotide sequences of BTG1 BINDING SITE, designated SEQ ID:7465, to the nucleotide sequence of VGAM1296 RNA, herein designated VGAM RNA, also designated SEQ ID:4007.

A function of VGAM1296 is therefore inhibition of B-cell Translocation Gene 1, Anti-proliferative (BTG1, Accession NM_001731), a gene which is a member of a new family of antiproliferative proteins. Accordingly, utilities of VGAM1296 include diagnosis, prevention and treatment of diseases and clinical conditions associated with BTG1. The function of BTG1 has been established by previous studies. Rimokh et al. (1991) cloned the breakpoint of a t (8;12) chromosomal translocation in a case of B-cell chronic lymphocytic leukemia and isolated a coding sequence mapping on 12q22. This sequence detected a 1.8-kb transcript in virtually all tissues tested except in the brain and muscle where the signal was barely detectable. The putative gene corresponding to this sequence, termed BTG1 for B-cell translocation gene 1, was shown to be highly conserved in evolution; a similar 1.8-kb transcript could be detected in murine and chicken tissue by using a human BTG1 DNA probe. Rouault et al. (1992) established the genomic organization of the gene. The full-length cDNA isolated from a lymphoblastoid cell line contained an open reading frame of 171 amino acids. BTG1 expression was maximal in the G0/G1 phases of the cell cycle and downregulated when cells progressed throughout G1. Furthermore, transfection experiments using NIH 3T3 cells indicated that BTG1 negatively regulates cell proliferation. Rouault et al. (1992) postulated that BTG1 is a member of a new family of antiproliferative genes Full details of the abovementioned studies are described in the following publications, the disclosure of which are hereby incorporated by reference:

Rouault, J.-P.; Rimokh, R.; Tessa, C.; Paranhos, G.; Ffrench, M.; Duret, L.; Garoccio, M.; Germain, D.; Samarut, J.; Magaud, J.-P.: BTG1, a member of a new family of antiproliferative genes. EMBO J. 11:1663-1670, 1992; and Rimokh, R.; Rouault, J. P.; Wahbi, K.; Gadoux, M.; Lafage, M.; Archimbaud, E.; Charrin, C.; Gentilhomme, O.; Germain, D.; Samarut, J.; Magaud, J. P.: A chromosome 12 coding region is ju.

Further studies establishing the function and utilities of BTG1 are found in John Hopkins OMIM database record ID 109580, and in sited publications numbered 138 and 1445 listed in the bibliography section hereinbelow, which are also hereby incorporated by reference. BH-protocadherin (brain-heart) (PCDH7, Accession NM_002589) is another VGAM1296 host target gene. PCDH7 BINDING SITE1 through PCDH7 BINDING SITE3 are HOST TARGET binding sites found in untranslated regions of mRNA encoded by PCDH7, corresponding to HOST TARGET binding sites such as BINDING SITE I, BINDING SITE II or BINDING SITE III. Table 2 illustrates the complementarity of the nucleotide sequences of PCDH7 BINDING SITE1 through PCDH7 BINDING SITE3, designated SEQ ID:8452, SEQ ID:26217 and SEQ ID:26220 respectively, to the nucleotide sequence of VGAM1296 RNA, herein designated VGAM RNA, also designated SEQ ID:4007.

Another function of VGAM1296 is therefore inhibition of BH-protocadherin (brain-heart) (PCDH7, Accession NM_002589). Accordingly, utilities of VGAM1296 include diagnosis, prevention and treatment of diseases and clinical conditions associated with PCDH7. KIAA1950 (Accession XM_166532) is another VGAM1296 host target gene. KIAA1950 BINDING SITE is HOST TARGET binding site found in the 3' untranslated region of mRNA encoded by KIAA1950, corresponding to a HOST TARGET binding site such as BINDING SITE I, BINDING SITE II or BINDING SITE III. Table 2 illustrates the complementarity of the nucleotide sequences of KIAA1950 BINDING SITE, designated SEQ ID:44484, to the nucleotide sequence of VGAM1296 RNA, herein designated VGAM RNA, also designated SEQ ID:4007.

Another function of VGAM1296 is therefore inhibition of KIAA1950 (Accession XM_166532). Accordingly, utilities of VGAM1296 include diagnosis, prevention and treatment of diseases and clinical conditions associated with KIAA1950. MAC30 (Accession XM_031536) is another VGAM1296 host target gene. MAC30 BINDING SITE is HOST TARGET binding site found in the 3' untranslated region of mRNA encoded by MAC30, corresponding to a HOST TARGET binding site such as BINDING SITE I, BINDING SITE II or BINDING SITE III. Table 2 illustrates the complementarity of the nucleotide sequences of MAC30 BINDING SITE, designated SEQ ID:31407, to the nucleotide sequence of VGAM1296 RNA, herein designated VGAM RNA, also designated SEQ ID:4007.

Another function of VGAM1296 is therefore inhibition of MAC30 (Accession XM_031536). Accordingly, utilities of VGAM1296 include diagnosis, prevention and treatment of diseases and clinical conditions associated with MAC30. LOC147219 (Accession XM_097214) is another VGAM1296 host target gene. LOC147219 BINDING SITE is HOST TARGET binding site found in the 3' untranslated region of mRNA encoded by LOC147219, corresponding to a HOST TARGET binding site such as BINDING SITE I, BINDING SITE II or BINDING SITE III. Table 2 illustrates the complementarity of the nucleotide sequences of LOC147219 BINDING SITE, designated SEQ ID:40823, to the nucleotide sequence of VGAM1296 RNA, herein designated VGAM RNA, also designated SEQ ID:4007.

Another function of VGAM1296 is therefore inhibition of LOC147219 (Accession XM_097214). Accordingly, utilities of VGAM1296 include diagnosis, prevention and treatment of diseases and clinical conditions associated with LOC147219. LOC150174 (Accession XM_086802) is another VGAM1296 host target gene. LOC150174 BINDING SITE is HOST TARGET binding site found in the 5' untranslated region of mRNA encoded by LOC150174, corresponding to a HOST TARGET binding site such as BINDING SITE I, BINDING SITE II or BINDING SITE III. Table 2 illustrates the complementarity of the nucleotide sequences of LOC150174 BINDING SITE, designated SEQ ID:38867, to the nucleotide sequence of VGAM1296 RNA, herein designated VGAM RNA, also designated SEQ ID:4007.

Another function of VGAM1296 is therefore inhibition of LOC150174 (Accession XM_086802). Accordingly, utilities of VGAM1296 include diagnosis, prevention and treatment of diseases and clinical conditions associated with LOC150174. FIG. 1 further provides a conceptual description of a novel bioinformatically detected viral gene of the present invention, referred to here as Viral Genomic Address Messenger 1297 (VGAM1297) viral gene, which modulates expression of respective host target genes thereof, the function and utility of which host target genes is known in the art.

VGAM1297 is a novel bioinformatically detected regulatory, non protein coding, viral micro RNA (miRNA) gene. The method by which VGAM1297 was detected is described hereinabove with reference to FIGS. 1-8.

VGAM1297 gene, herein designated VGAM GENE, is a viral gene contained in the genome of Yaba-like Disease Virus. VGAM1297 host target gene, herein designated VGAM HOST TARGET GENE, is a human gene contained in the human genome.

VGAM1297 gene encodes a VGAM1297 precursor RNA, herein designated VGAM PRECURSOR RNA. Similar to other miRNA genes, and unlike most ordinary genes, VGAM1297 precursor RNA does not encode a protein. A nucleotide sequence identical or highly similar to the nucleotide sequence of VGAM1297 precursor RNA is designated SEQ ID:1283, and is provided hereinbelow with reference to the sequence listing part. Nucleotide sequence SEQ ID:1283 is located at position 75507 relative to the genome of Yaba-like Disease Virus.

VGAM1297 precursor RNA folds onto itself, forming VGAM1297 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1297 folded precursor RNA into VGAM1297 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM1297 RNA is designated SEQ ID:4008, and is provided hereinbelow with reference to the sequence listing part.

VGAM1297 host target gene, herein designated VGAM HOST TARGET GENE, encodes a corresponding messenger RNA, VGAM1297 host target RNA, herein designated VGAM HOST TARGET RNA. VGAM1297 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1297 RNA, herein designated VGAM RNA, binds complementarily to one or more host target binding sites located in untranslated regions of VGAM1297 host target RNA, herein designated VGAM HOST TARGET RNA. This complementary binding is due to the fact that the nucleotide sequence of VGAM1297 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1297 RNA, herein designated VGAM RNA, may have a different number of host target binding sites in untranslated regions of a VGAM1297 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1297 RNA, herein designated VGAM RNA, to host target binding sites on VGAM1297 host target RNA, herein designated VGAM HOST TARGET RNA, such as BINDING SITE I, BINDING SITE II and BINDING SITE III, inhibits translation of VGAM1297 host target RNA into VGAM1297 host target protein, herein designated VGAM HOST TARGET PROTEIN. VGAM host target protein is therefore outlined by a broken line.

It is appreciated that VGAM1297 host target gene, herein designated VGAM HOST TARGET GENE, in fact represents a plurality of VGAM1297 host target genes. The mRNA of each one of this plurality of VGAM1297 host target genes comprises one or more host target binding sites, each having a nucleotide sequence which is at least partly complementary to VGAM1297 RNA, herein designated VGAM RNA, and which when bound by VGAM1297 RNA causes inhibition of translation of respective one or more VGAM1297 host target proteins.

It is further appreciated by one skilled in the art that the mode of translational inhibition illustrated by FIG. 1 with specific reference to translational inhibition exerted by VGAM1297 gene, herein designated VGAM GENE, on one or more VGAM1297 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1297 is inhibition of expression of host target genes, as part of a novel viral mechanism of attacking a host. Accordingly, utilities of VGAM1297 include diagnosis, prevention and treatment of viral infection by Yaba-like Disease Virus. Specific functions, and accordingly utilities, of VGAM1297 correlate with, and may be deduced from, the identity of the host target genes which VGAM1297 binds and inhibits, and the function of these host target genes, as elaborated hereinbelow.

Nucleotide sequences of the VGAM1297 precursor RNA, herein designated VGAM PRECURSOR RNA, and of the 'diced' VGAM1297 RNA, herein designated VGAM RNA, and a schematic representation of the secondary folding of VGAM1297 folded precursor RNA, herein designated VGAM FOLDED PRECURSOR RNA, of VGAM1297 are further described hereinbelow with reference to Table 1.

Nucleotide sequences of host target binding sites, such as BINDING SITE-I, BINDING SITE-II and BINDING SITE-III of FIG. 1, found on VGAM1297 host target RNA, and schematic representation of the complementarity of each of these host target binding sites to VGAM1297 RNA, herein designated VGAM RNA, are described hereinbelow with reference to Table 2.

As mentioned hereinabove with reference to FIG. 1, a function of VGAM1297 gene, herein designated VGAM is inhibition of expression of VGAM1297 target genes. It is appreciated that specific functions, and accordingly utilities, of VGAM1297 correlate with, and may be deduced from, the identity of the target genes which VGAM1297 binds and inhibits, and the function of these target genes, as elaborated hereinbelow.

Reserved (C8orf6, Accession XM_114624) is a VGAM1297 host target gene. C8orf6 BINDING SITE is HOST TARGET binding site found in the 5' untranslated region of mRNA encoded by C8orf6, corresponding to a HOST TARGET binding site such as BINDING SITE I, BINDING SITE II or BINDING SITE III. Table 2 illustrates the complementarity of the nucleotide sequences of C8orf6 BINDING SITE, designated SEQ ID:43004, to the nucleotide sequence of VGAM1297 RNA, herein designated VGAM RNA, also designated SEQ ID:4008.

A function of VGAM1297 is therefore inhibition of Reserved (C8orf6, Accession XM_114624). Accordingly, utilities of VGAM1297 include diagnosis, prevention and treatment of diseases and clinical conditions associated with C8orf6. FLJ10193 (Accession NM_018019) is another VGAM1297 host target gene. FLJ10193 BINDING SITE is HOST TARGET binding site found in the 3' untranslated region of mRNA encoded by FLJ10193, corresponding to a HOST TARGET binding site such as BINDING SITE I, BINDING SITE II or BINDING SITE III. Table 2 illustrates the complementarity of the nucleotide sequences of FLJ10193 BINDING SITE, designated SEQ ID:19760, to the nucleotide sequence of VGAM1297 RNA, herein designated VGAM RNA, also designated SEQ ID:4008.

Another function of VGAM1297 is therefore inhibition of FLJ10193 (Accession NM_018019). Accordingly, utilities of VGAM1297 include diagnosis, prevention and treatment of diseases and clinical conditions associated with FLJ10193.

FLJ30532 (Accession NM_144724) is another VGAM1297 host target gene. FLJ30532 BINDING SITE is HOST TARGET binding site found in the 3' untranslated region of mRNA encoded by FLJ30532, corresponding to a HOST TARGET binding site such as BINDING SITE I, BINDING SITE II or BINDING SITE III. Table 2 illustrates the complementarity of the nucleotide sequences of FLJ30532 BINDING SITE, designated SEQ ID:29548, to the nucleotide sequence of VGAM1297 RNA, herein designated VGAM RNA, also designated SEQ ID:4008.

Another function of VGAM1297 is therefore inhibition of FLJ30532 (Accession NM_144724). Accordingly, utilities of VGAM1297 include diagnosis, prevention and treatment of diseases and clinical conditions associated with FLJ30532. KIAA0537 (Accession NM_014840) is another VGAM1297 host target gene. KIAA0537 BINDING SITE is HOST TARGET binding site found in the 3' untranslated region of mRNA encoded by KIAA0537, corresponding to a HOST TARGET binding site such as BINDING SITE I, BINDING SITE II or BINDING SITE III. Table 2 illustrates the complementarity of the nucleotide sequences of KIAA0537 BINDING SITE, designated SEQ ID:16863, to the nucleotide sequence of VGAM1297 RNA, herein designated VGAM RNA, also designated SEQ ID:4008.

Another function of VGAM1297 is therefore inhibition of KIAA0537 (Accession NM_014840). Accordingly, utilities of VGAM1297 include diagnosis, prevention and treatment of diseases and clinical conditions associated with KIAA0537. KIAA0596 (Accession XM_031706) is another VGAM1297 host target gene. KIAA0596 BINDING SITE1 and KIAA0596 BINDING SITE2 are HOST TARGET binding sites found in untranslated regions of mRNA encoded by KIAA0596, corresponding to HOST TARGET binding sites such as BINDING SITE I, BINDING SITE II or BINDING SITE III. Table 2 illustrates the complementarity of the nucleotide sequences of KIAA0596 BINDING SITE1 and KIAA0596 BINDING SITE2, designated SEQ ID:31466 and SEQ ID:31464 respectively, to the nucleotide sequence of VGAM1297 RNA, herein designated VGAM RNA, also designated SEQ ID:4008.

Another function of VGAM1297 is therefore inhibition of KIAA0596 (Accession XM_031706). Accordingly, utilities of VGAM1297 include diagnosis, prevention and treatment of diseases and clinical conditions associated with KIAA0596. KIAA1766 (Accession XM_049218) is another VGAM1297 host target gene. KIAA1766 BINDING SITE is HOST TARGET binding site found in the 3' untranslated region of mRNA encoded by KIAA1766, corresponding to a HOST TARGET binding site such as BINDING SITE I, BINDING SITE II or BINDING SITE III. Table 2 illustrates the complementarity of the nucleotide sequences of KIAA1766 BINDING SITE, designated SEQ ID:35353, to the nucleotide sequence of VGAM1297 RNA, herein designated VGAM RNA, also designated SEQ ID:4008.

Another function of VGAM1297 is therefore inhibition of KIAA1766 (Accession XM_049218). Accordingly, utilities of VGAM1297 include diagnosis, prevention and treatment of diseases and clinical conditions associated with KIAA1766. LAGY (Accession NM_139212) is another VGAM1297 host target gene. LAGY BINDING SITE1 through LAGY BINDING SITE3 are HOST TARGET binding sites found in untranslated regions of mRNA encoded by LAGY, corresponding to HOST TARGET binding sites such as BINDING SITE I, BINDING SITE II or BINDING SITE III. Table 2 illustrates the complementarity of the nucleotide sequences of LAGY BINDING SITE1 through LAGY BINDING SITE3, designated SEQ ID:29234, SEQ ID:26246 and SEQ ID:29232 respectively, to the nucleotide sequence of VGAM1297 RNA, herein designated VGAM RNA, also designated SEQ ID:4008.

Another function of VGAM1297 is therefore inhibition of LAGY (Accession NM_139212). Accordingly, utilities of VGAM1297 include diagnosis, prevention and treatment of diseases and clinical conditions associated with LAGY. LOC124152 (Accession XM_058777) is another VGAM1297 host target gene. LOC124152 BINDING SITE is HOST TARGET binding site found in the 3' untranslated region of mRNA encoded by LOC124152, corresponding to a HOST TARGET binding site such as BINDING SITE I, BINDING SITE II or BINDING SITE III. Table 2 illustrates the complementarity of the nucleotide sequences of LOC124152 BINDING SITE, designated SEQ ID:36737, to the nucleotide sequence of VGAM1297 RNA, herein designated VGAM RNA, also designated SEQ ID:4008.

Another function of VGAM1297 is therefore inhibition of LOC124152 (Accession XM_058777). Accordingly, utilities of VGAM1297 include diagnosis, prevention and treatment of diseases and clinical conditions associated with LOC124152. LOC158835 (Accession XM_088683) is another VGAM1297 host target gene. LOC158835 BINDING SITE is HOST TARGET binding site found in the 5' untranslated region of mRNA encoded by LOC158835, corresponding to a HOST TARGET binding site such as BINDING SITE I, BINDING SITE II or BINDING SITE III. Table 2 illustrates the complementarity of the nucleotide sequences of LOC158835 BINDING SITE, designated SEQ ID:39895, to the nucleotide sequence of VGAM1297 RNA, herein designated VGAM RNA, also designated SEQ ID:4008.

Another function of VGAM1297 is therefore inhibition of LOC158835 (Accession XM_088683). Accordingly, utilities of VGAM1297 include diagnosis, prevention and treatment of diseases and clinical conditions associated with LOC158835. FIG. 1 further provides a conceptual description of a novel bioinformatically detected viral gene of the present invention, referred to here as Viral Genomic Address Messenger 1298 (VGAM1298) viral gene, which modulates expression of respective host target genes thereof, the function and utility of which host target genes is known in the art.

VGAM1298 is a novel bioinformatically detected regulatory, non protein coding, viral micro RNA (miRNA) gene. The method by which VGAM1298 was detected is described hereinabove with reference to FIGS. 1-8.

VGAM1298 gene, herein designated VGAM GENE, is a viral gene contained in the genome of Yaba-like Disease Virus. VGAM1298 host target gene, herein designated VGAM HOST TARGET GENE, is a human gene contained in the human genome.

VGAM1298 gene encodes a VGAM1298 precursor RNA, herein designated VGAM PRECURSOR RNA. Similar to other miRNA genes, and unlike most ordinary genes, VGAM1298 precursor RNA does not encode a protein. A nucleotide sequence identical or highly similar to the nucleotide sequence of VGAM1298 precursor RNA is designated SEQ ID:1284, and is provided hereinbelow with reference to the sequence listing part. Nucleotide sequence SEQ ID:1284 is located at position 77434 relative to the genome of Yaba-like Disease Virus.

VGAM1298 precursor RNA folds onto itself, forming VGAM1298 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1298 folded precursor RNA into VGAM1298 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1298 RNA is designated SEQ ID:4009, and is provided hereinbelow with reference to the sequence listing part.

VGAM1298 host target gene, herein designated VGAM HOST TARGET GENE, encodes a corresponding messenger RNA, VGAM1298 host target RNA, herein designated VGAM HOST TARGET RNA. VGAM1298 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1298 RNA, herein designated VGAM RNA, binds complementarily to one or more host target binding sites located in untranslated regions of VGAM1298 host target RNA, herein designated VGAM HOST TARGET RNA. This complementary binding is due to the fact that the nucleotide sequence of VGAM1298 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1298 RNA, herein designated VGAM RNA, may have a different number of host target binding sites in untranslated regions of a VGAM1298 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1298 RNA, herein designated VGAM RNA, to host target binding sites on VGAM1298 host target RNA, herein designated VGAM HOST TARGET RNA, such as BINDING SITE I, BINDING SITE II and BINDING SITE III, inhibits translation of VGAM1298 host target RNA into VGAM1298 host target protein, herein designated VGAM HOST TARGET PROTEIN. VGAM host target protein is therefore outlined by a broken line.

It is appreciated that VGAM1298 host target gene, herein designated VGAM HOST TARGET GENE, in fact represents a plurality of VGAM1298 host target genes. The mRNA of each one of this plurality of VGAM1298 host target genes comprises one or more host target binding sites, each having a nucleotide sequence which is at least partly complementary to VGAM1298 RNA, herein designated VGAM RNA, and which when bound by VGAM1298 RNA causes inhibition of translation of respective one or more VGAM1298 host target proteins.

It is further appreciated by one skilled in the art that the mode of translational inhibition illustrated by FIG. 1 with specific reference to translational inhibition exerted by VGAM1298 gene, herein designated VGAM GENE, on one or more VGAM1298 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1298 is inhibition of expression of host target genes, as part of a novel viral mechanism of attacking a host. Accordingly, utilities of VGAM1298 include diagnosis, prevention and treatment of viral infection by Yaba-like Disease Virus. Specific functions, and accordingly utilities, of VGAM1298 correlate with, and may be deduced from, the identity of the host target genes which VGAM1298 binds and inhibits, and the function of these host target genes, as elaborated hereinbelow.

Nucleotide sequences of the VGAM1298 precursor RNA, herein designated VGAM PRECURSOR RNA, and of the 'diced' VGAM1298 RNA, herein designated VGAM RNA, and a schematic representation of the secondary folding of VGAM1298 folded precursor RNA, herein designated VGAM FOLDED PRECURSOR RNA, of VGAM1298 are further described hereinbelow with reference to Table 1.

Nucleotide sequences of host target binding sites, such as BINDING SITE-I, BINDING SITE-II and BINDING SITE-III of FIG. 1, found on VGAM1298 host target RNA, and schematic representation of the complementarity of each of these host target binding sites to VGAM1298 RNA, herein designated VGAM RNA, are described hereinbelow with reference to Table 2.

As mentioned hereinabove with reference to FIG. 1, a function of VGAM1298 gene, herein designated VGAM is inhibition of expression of VGAM1298 target genes. It is appreciated that specific functions, and accordingly utilities, of VGAM1298 correlate with, and may be deduced from, the identity of the target genes which VGAM1298 binds and inhibits, and the function of these target genes, as elaborated hereinbelow.

LOC158014 (Accession XM_088442) is a VGAM1298 host target gene. LOC158014 BINDING SITE is HOST TARGET binding site found in the 5' untranslated region of mRNA encoded by LOC158014, corresponding to a HOST TARGET binding site such as BINDING SITE I, BINDING SITE II or BINDING SITE III. Table 2 illustrates the complementarity of the nucleotide sequences of LOC158014 BINDING SITE, designated SEQ ID:39689, to the nucleotide sequence of VGAM1298 RNA, herein designated VGAM RNA, also designated SEQ ID:4009.

A function of VGAM1298 is therefore inhibition of LOC158014 (Accession XM_088442). Accordingly, utilities of VGAM1298 include diagnosis, prevention and treatment of diseases and clinical conditions associated with LOC158014. FIG. 1 further provides a conceptual description of a novel bioinformatically detected viral gene of the present invention, referred to here as Viral Genomic Address Messenger 1299 (VGAM1299) viral gene, which modulates expression of respective host target genes thereof, the function and utility of which host target genes is known in the art.

VGAM1299 is a novel bioinformatically detected regulatory, non protein coding, viral micro RNA (miRNA) gene. The method by which VGAM1299 was detected is described hereinabove with reference to FIGS. 1-8.

VGAM1299 gene, herein designated VGAM GENE, is a viral gene contained in the genome of Yaba-like Disease Virus. VGAM1299 host target gene, herein designated VGAM HOST TARGET GENE, is a human gene contained in the human genome.

VGAM1299 gene encodes a VGAM1299 precursor RNA, herein designated VGAM PRECURSOR RNA. Similar to other miRNA genes, and unlike most ordinary genes, VGAM1299 precursor RNA does not encode a protein. A nucleotide sequence identical or highly similar to the nucleotide sequence of VGAM1299 precursor RNA is designated SEQ ID:1285, and is provided hereinbelow with reference to the sequence listing part. Nucleotide sequence SEQ ID:1285 is located at position 80251 relative to the genome of Yaba-like Disease Virus.

VGAM1299 precursor RNA folds onto itself, forming VGAM1299 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1299 folded precursor RNA into VGAM1299 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1299 RNA is designated SEQ ID:4010, and is provided hereinbelow with reference to the sequence listing part.

VGAM1299 host target gene, herein designated VGAM HOST TARGET GENE, encodes a corresponding messenger RNA, VGAM1299 host target RNA, herein designated VGAM HOST TARGET RNA. VGAM1299 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1299 RNA, herein designated VGAM RNA, binds complementarily to one or more host target binding sites located in untranslated regions of VGAM1299 host target RNA, herein designated VGAM HOST TARGET RNA. This complementary binding is due to the fact that the nucleotide sequence of VGAM1299 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1299 RNA, herein designated VGAM RNA, may have a different number of host target binding sites in untranslated regions of a VGAM1299 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1299 RNA, herein designated VGAM RNA, to host target binding sites on VGAM1299 host target RNA, herein designated VGAM HOST TARGET RNA, such as BINDING SITE I, BINDING SITE II and BINDING SITE III, inhibits translation of VGAM1299 host target RNA into VGAM1299 host target protein, herein designated VGAM HOST TARGET PROTEIN. VGAM host target protein is therefore outlined by a broken line.

It is appreciated that VGAM1299 host target gene, herein designated VGAM HOST TARGET GENE, in fact represents a plurality of VGAM1299 host target genes. The mRNA of each one of this plurality of VGAM1299 host target genes comprises one or more host target binding sites, each having a nucleotide sequence which is at least partly complementary to VGAM1299 RNA, herein designated VGAM RNA, and which when bound by VGAM1299 RNA causes inhibition of translation of respective one or more VGAM1299 host target proteins.

It is further appreciated by one skilled in the art that the mode of translational inhibition illustrated by FIG. 1 with specific reference to translational inhibition exerted by VGAM1299 gene, herein designated VGAM GENE, on one or more VGAM1299 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1299 is inhibition of expression of host target genes, as part of a novel viral mechanism of attacking a host. Accordingly, utilities of VGAM1299 include diagnosis, prevention and treatment of viral infection by Yaba-like Disease Virus. Specific functions, and accordingly utilities, of VGAM1299 correlate with, and may be deduced from, the identity of the host target genes which VGAM1299 binds and inhibits, and the function of these host target genes, as elaborated hereinbelow.

Nucleotide sequences of the VGAM1299 precursor RNA, herein designated VGAM PRECURSOR RNA, and of the 'diced' VGAM1299 RNA, herein designated VGAM RNA, and a schematic representation of the secondary folding of VGAM1299 folded precursor RNA, herein designated VGAM FOLDED PRECURSOR RNA, of VGAM1299 are further described hereinbelow with reference to Table 1.

Nucleotide sequences of host target binding sites, such as BINDING SITE-I, BINDING SITE-II and BINDING SITE-III of FIG. 1, found on VGAM1299 host target RNA, and schematic representation of the complementarity of each of these host target binding sites to VGAM1299 RNA, herein designated VGAM RNA, are described hereinbelow with reference to Table 2.

As mentioned hereinabove with reference to FIG. 1, a function of VGAM1299 gene, herein designated VGAM is inhibition of expression of VGAM1299 target genes. It is appreciated that specific functions, and accordingly utilities, of VGAM1299 correlate with, and may be deduced from, the identity of the target genes which VGAM1299 binds and inhibits, and the function of these target genes, as elaborated hereinbelow.

POU Domain, Class 4, Transcription Factor 1 (POU4F1, Accession NM_006237) is a VGAM1299 host target gene. POU4F1 BINDING SITE is HOST TARGET binding site found in the 3' untranslated region of mRNA encoded by POU4F1, corresponding to a HOST TARGET binding site such as BINDING SITE I, BINDING SITE II or BINDING SITE III. Table 2 illustrates the complementarity of the nucleotide sequences of POU4F1 BINDING SITE, designated SEQ ID:12898, to the nucleotide sequence of VGAM1299 RNA, herein designated VGAM RNA, also designated SEQ ID:4010.

A function of VGAM1299 is therefore inhibition of POU Domain, Class 4, Transcription Factor 1 (POU4F1, Accession NM_006237), a gene which plays a role in the regulation of specific gene expression within a subset of neuronal lineages. Accordingly, utilities of VGAM1299 include diagnosis, prevention and treatment of diseases and clinical conditions associated with POU4F1. The function of POU4F1 and its association with various diseases and clinical conditions, has been established by previous studies, as described hereinabove with reference to VGAM1026. FIG. 1 further provides a conceptual description of a novel bioinformatically detected viral gene of the present invention, referred to here as Viral Genomic Address Messenger 1300 (VGAM1300) viral gene, which modulates expression of respective host target genes thereof, the function and utility of which host target genes is known in the art.

VGAM1300 is a novel bioinformatically detected regulatory, non protein coding, viral micro RNA (miRNA) gene. The method by which VGAM1300 was detected is described hereinabove with reference to FIGS. 1-8.

VGAM1300 gene, herein designated VGAM GENE, is a viral gene contained in the genome of Yaba-like Disease Virus. VGAM1300 host target gene, herein designated VGAM HOST TARGET GENE, is a human gene contained in the human genome.

VGAM1300 gene encodes a VGAM1300 precursor RNA, herein designated VGAM PRECURSOR RNA. Similar to other miRNA genes, and unlike most ordinary genes, VGAM1300 precursor RNA does not encode a protein. A nucleotide sequence identical or highly similar to the nucleotide sequence of VGAM1300 precursor RNA is designated SEQ ID:1286, and is provided hereinbelow with reference to the sequence listing part. Nucleotide sequence SEQ ID:1286 is located at position 78499 relative to the genome of Yaba-like Disease Virus.

VGAM1300 precursor RNA folds onto itself, forming VGAM1300 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1300 folded precursor RNA into VGAM1300 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1300 RNA is designated SEQ ID:4011, and is provided hereinbelow with reference to the sequence listing part.

VGAM1300 host target gene, herein designated VGAM HOST TARGET GENE, encodes a corresponding messenger RNA, VGAM1300 host target RNA, herein designated VGAM HOST TARGET RNA. VGAM1300 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1300 RNA, herein designated VGAM RNA, binds complementarily to one or more host target binding sites located in untranslated regions of VGAM1300 host target RNA, herein designated VGAM HOST TARGET RNA. This complementary binding is due to the fact that the nucleotide sequence of VGAM1300 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1300 RNA, herein designated VGAM RNA, may have a different number of host target binding sites in untranslated regions of a VGAM1300 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1300 RNA, herein designated VGAM RNA, to host target binding sites on VGAM1300 host target RNA, herein designated VGAM HOST TARGET RNA, such as BINDING SITE I, BINDING SITE II and BINDING SITE III, inhibits translation of VGAM1300 host target RNA into VGAM1300 host target protein, herein designated VGAM HOST TARGET PROTEIN. VGAM host target protein is therefore outlined by a broken line.

It is appreciated that VGAM1300 host target gene, herein designated VGAM HOST TARGET GENE, in fact represents a plurality of VGAM1300 host target genes. The mRNA of each one of this plurality of VGAM1300 host target genes comprises one or more host target binding sites, each having a nucleotide sequence which is at least partly complementary to VGAM1300 RNA, herein designated VGAM RNA, and which when bound by VGAM1300 RNA causes inhibition of translation of respective one or more VGAM1300 host target proteins.

It is further appreciated by one skilled in the art that the mode of translational inhibition illustrated by FIG. 1 with specific reference to translational inhibition exerted by VGAM1300 gene, herein designated VGAM GENE, on one or more VGAM1300 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1300 is inhibition of expression of host target genes, as part of a novel viral mechanism of attacking a host. Accordingly, utilities of VGAM1300 include diagnosis, prevention and treatment of viral infection by Yaba-like Disease Virus. Specific functions, and accordingly utilities, of VGAM1300 correlate with, and may be deduced from, the identity of the host target genes which VGAM1300 binds and inhibits, and the function of these host target genes, as elaborated hereinbelow.

Nucleotide sequences of the VGAM1300 precursor RNA, herein designated VGAM PRECURSOR RNA, and of the 'diced' VGAM1300 RNA, herein designated VGAM RNA, and a schematic representation of the secondary folding of VGAM1300 folded precursor RNA, herein designated VGAM FOLDED PRECURSOR RNA, of VGAM1300 are further described hereinbelow with reference to Table 1.

Nucleotide sequences of host target binding sites, such as BINDING SITE-I, BINDING SITE-II and BINDING SITE-III of FIG. 1, found on VGAM1300 host target RNA, and schematic representation of the complementarity of each of these host target binding sites to VGAM1300 RNA, herein designated VGAM RNA, are described hereinbelow with reference to Table 2.

As mentioned hereinabove with reference to FIG. 1, a function of VGAM1300 gene, herein designated VGAM is inhibition of expression of VGAM1300 target genes. It is appreciated that specific functions, and accordingly utilities, of VGAM1300 correlate with, and may be deduced from, the identity of the target genes which VGAM1300 binds and inhibits, and the function of these target genes, as elaborated hereinbelow.

Mab-21-like 1 (C. elegans) (MAB21L1, Accession NM_005584) is a VGAM1300 host target gene. MAB21L1 BINDING SITE is HOST TARGET binding site found in the 3' untranslated region of mRNA encoded by MAB21L1, corresponding to a HOST TARGET binding site such as BINDING SITE I, BINDING SITE II or BINDING SITE III. Table 2 illustrates the complementarity of the nucleotide sequences of MAB21L1 BINDING SITE, designated SEQ ID:12110, to the nucleotide sequence of VGAM1300 RNA, herein designated VGAM RNA, also designated SEQ ID:4011.

A function of VGAM1300 is therefore inhibition of Mab-21-like 1 (C. elegans) (MAB21L1, Accession NM_005584), a gene which may control cerebellum and eye development; very strongly similar to murine Mm.10798. Accordingly, utilities of VGAM1300 include diagnosis, prevention and treatment of diseases and clinical conditions associated with MAB21L1. The function of MAB21L1 and its association with various diseases and clinical conditions, has been established by previous studies, as described hereinabove with reference to VGAM39. Spastic Paraplegia 3A (autosomal dominant) (SPG3A, Accession NM_015915) is another VGAM1300 host target gene. SPG3A BINDING SITE is HOST TARGET binding site found in the 3' untranslated region of mRNA encoded by SPG3A, corresponding to a HOST TARGET binding site such as BINDING SITE I, BINDING SITE II or BINDING SITE III. Table 2 illustrates the complementarity of the nucleotide sequences of SPG3A BINDING SITE, designated SEQ ID:18046, to the nucleotide sequence of VGAM1300 RNA, herein designated VGAM RNA, also designated SEQ ID:4011.

Another function of VGAM1300 is therefore inhibition of Spastic Paraplegia 3A (autosomal dominant) (SPG3A, Accession NM_015915). Accordingly, utilities of VGAM1300 include diagnosis, prevention and treatment of diseases and clinical conditions associated with SPG3A. C6orf5 (Accession NM_015524) is another VGAM1300 host target gene. C6orf5 BINDING SITE is HOST TARGET binding site found in the 3' untranslated region of mRNA encoded by C6orf5, corresponding to a HOST TARGET binding site such as BINDING SITE I, BINDING SITE II or BINDING SITE III. Table 2 illustrates the complementarity of the nucleotide sequences of C6orf5 BINDING SITE, designated SEQ ID:17783, to the nucleotide sequence of VGAM1300 RNA, herein designated VGAM RNA, also designated SEQ ID:4011.

Another function of VGAM1300 is therefore inhibition of C6orf5 (Accession NM_015524). Accordingly, utilities of VGAM1300 include diagnosis, prevention and treatment of diseases and clinical conditions associated with C6orf5. DKFZP586M0622 (Accession NM_015583) is another VGAM1300 host target gene. DKFZP586M0622 BINDING SITE is HOST TARGET binding site found in the 5' untranslated region of mRNA encoded by DKFZP586M0622, corresponding to a HOST TARGET binding site such as BINDING SITE I, BINDING SITE II or BINDING SITE III. Table 2 illustrates the complementarity of the nucleotide sequences of DKFZP586M0622 BINDING SITE, designated SEQ ID:17849, to the nucleotide sequence of VGAM1300 RNA, herein designated VGAM RNA, also designated SEQ ID:4011.

Another function of VGAM1300 is therefore inhibition of DKFZP586M0622 (Accession NM_015583). Accordingly, utilities of VGAM1300 include diagnosis, prevention and treatment of diseases and clinical conditions associated with DKFZP586M0622. FLJ14281 (Accession NM_024920) is another VGAM1300 host target gene. FLJ14281 BINDING SITE is HOST TARGET binding site found in the 3' untranslated region of mRNA encoded by FLJ14281, corresponding to a HOST TARGET binding site such as BINDING SITE I, BINDING SITE II or BINDING SITE III. Table 2 illustrates the complementarity of the nucleotide sequences of FLJ14281 BINDING SITE, designated SEQ ID:24450, to the nucleotide sequence of VGAM1300 RNA, herein designated VGAM RNA, also designated SEQ ID:4011.

Another function of VGAM1300 is therefore inhibition of FLJ14281 (Accession NM_024920). Accordingly, utilities of VGAM1300 include diagnosis, prevention and treatment of diseases and clinical conditions associated with FLJ14281. KIAA1789 (Accession XM_040486) is another VGAM1300 host target gene. KIAA1789 BINDING SITE is HOST TARGET binding site found in the 5' untranslated region of mRNA encoded by KIAA1789, corresponding to a HOST TARGET binding site such as BINDING SITE I, BINDING SITE II or BINDING SITE III. Table 2 illustrates the complementarity of the nucleotide sequences of KIAA1789 BINDING SITE, designated SEQ ID:33315, to the nucleotide sequence of VGAM1300 RNA, herein designated VGAM RNA, also designated SEQ ID:4011.

Another function of VGAM1300 is therefore inhibition of KIAA1789 (Accession XM_040486). Accordingly, utilities of VGAM1300 include diagnosis, prevention and treatment of diseases and clinical conditions associated with KIAA1789. Oxysterol Binding Protein-like 8 (OSBPL8, Accession NM_020841) is another VGAM1300 host target gene. OSBPL8 BINDING SITE is HOST TARGET binding site found in the 3' untranslated region of mRNA encoded by OSBPL8, corresponding to a HOST TARGET binding site such as BINDING SITE I, BINDING SITE II or BINDING SITE III. Table 2 illustrates the complementarity of the nucleotide sequences of OSBPL8 BINDING SITE, designated SEQ ID:21902, to the nucleotide sequence of VGAM1300 RNA, herein designated VGAM RNA, also designated SEQ ID:4011.

Another function of VGAM1300 is therefore inhibition of Oxysterol Binding Protein-like 8 (OSBPL8, Accession NM_020841). Accordingly, utilities of VGAM1300 include diagnosis, prevention and treatment of diseases and clinical conditions associated with OSBPL8. Regulator of G-protein Signalling 13 (RGS13, Accession NM_144766) is another VGAM1300 host target gene. RGS13 BINDING SITE1 and RGS13 BINDING SITE2 are HOST TARGET binding sites found in untranslated regions of mRNA encoded by RGS13, corresponding to HOST TARGET binding sites such as BINDING SITE I, BINDING SITE II or BINDING SITE III. Table 2 illustrates the complementarity of the nucleotide sequences of RGS13 BINDING SITE1 and RGS13 BINDING SITE2, designated SEQ ID:29557 and SEQ ID:8831 respectively, to the nucleotide sequence of VGAM1300 RNA, herein designated VGAM RNA, also designated SEQ ID:4011.

Another function of VGAM1300 is therefore inhibition of Regulator of G-protein Signalling 13 (RGS13, Accession NM_144766). Accordingly, utilities of VGAM1300 include diagnosis, prevention and treatment of diseases and clinical conditions associated with RGS13. LOC51134 (Accession NM_016122) is another VGAM1300 host target gene. LOC51134 BINDING SITE is HOST TARGET binding site found in the 3' untranslated region of mRNA encoded by LOC51134, corresponding to a HOST TARGET binding site such as BINDING SITE I, BINDING SITE II or BINDING SITE III. Table 2 illustrates the complementarity of the nucleotide sequences of LOC51134 BINDING SITE, designated SEQ ID:18208, to the nucleotide sequence of VGAM1300 RNA, herein designated VGAM RNA, also designated SEQ ID:4011.

Another function of VGAM1300 is therefore inhibition of LOC51134 (Accession NM_016122). Accordingly, utilities of VGAM1300 include diagnosis, prevention and treatment of diseases and clinical conditions associated with LOC51134. FIG. 1 further provides a conceptual description of a novel bioinformatically detected viral gene of the present invention, referred to here as Viral Genomic Address Messenger 1301 (VGAM1301) viral gene, which modulates expression of respective host target genes thereof, the function and utility of which host target genes is known in the art.

VGAM1301 is a novel bioinformatically detected regulatory, non protein coding, viral micro RNA (miRNA) gene. The method by which VGAM1301 was detected is described hereinabove with reference to FIGS. 1-8.

VGAM1301 gene, herein designated VGAM GENE, is a viral gene contained in the genome of Yaba-like Disease Virus. VGAM1301 host target gene, herein designated VGAM HOST TARGET GENE, is a human gene contained in the human genome.

VGAM1301 gene encodes a VGAM1301 precursor RNA, herein designated VGAM PRECURSOR RNA. Similar to other miRNA genes, and unlike most ordinary genes, VGAM1301 precursor RNA does not encode a protein. A nucleotide sequence identical or highly similar to the nucleotide sequence of VGAM1301 precursor RNA is designated SEQ ID:1287, and is provided hereinbelow with reference to the sequence listing part. Nucleotide sequence SEQ ID:1287 is located at position 78643 relative to the genome of Yaba-like Disease Virus.

VGAM1301 precursor RNA folds onto itself, forming VGAM1301 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1301 folded precursor RNA into VGAM1301 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM1301 RNA is designated SEQ ID:4012, and is provided hereinbelow with reference to the sequence listing part.

VGAM1301 host target gene, herein designated VGAM HOST TARGET GENE, encodes a corresponding messenger RNA, VGAM1301 host target RNA, herein designated VGAM HOST TARGET RNA. VGAM1301 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1301 RNA, herein designated VGAM RNA, binds complementarily to one or more host target binding sites located in untranslated regions of VGAM1301 host target RNA, herein designated VGAM HOST TARGET RNA. This complementary binding is due to the fact that the nucleotide sequence of VGAM1301 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1301 RNA, herein designated VGAM RNA, may have a different number of host target binding sites in untranslated regions of a VGAM1301 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1301 RNA, herein designated VGAM RNA, to host target binding sites on VGAM1301 host target RNA, herein designated VGAM HOST TARGET RNA, such as BINDING SITE I, BINDING SITE II and BINDING SITE III, inhibits translation of VGAM1301 host target RNA into VGAM1301 host target protein, herein designated VGAM HOST TARGET PROTEIN. VGAM host target protein is therefore outlined by a broken line.

It is appreciated that VGAM1301 host target gene, herein designated VGAM HOST TARGET GENE, in fact represents a plurality of VGAM1301 host target genes. The mRNA of each one of this plurality of VGAM1301 host target genes comprises one or more host target binding sites, each having a nucleotide sequence which is at least partly complementary to VGAM1301 RNA, herein designated VGAM RNA, and which when bound by VGAM1301 RNA causes inhibition of translation of respective one or more VGAM1301 host target proteins.

It is further appreciated by one skilled in the art that the mode of translational inhibition illustrated by FIG. 1 with specific reference to translational inhibition exerted by VGAM1301 gene, herein designated VGAM GENE, on one or more VGAM1301 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1301 is inhibition of expression of host target genes, as part of a novel viral mechanism of attacking a host. Accordingly, utilities of VGAM1301 include diagnosis, prevention and treatment of viral infection by Yaba-like Disease Virus. Specific functions, and accordingly utilities, of VGAM1301 correlate with, and may be deduced from, the identity of the host target genes which VGAM1301 binds and inhibits, and the function of these host target genes, as elaborated hereinbelow.

Nucleotide sequences of the VGAM1301 precursor RNA, herein designated VGAM PRECURSOR RNA, and of the 'diced' VGAM1301 RNA, herein designated VGAM RNA, and a schematic representation of the secondary folding of VGAM1301 folded precursor RNA, herein designated VGAM FOLDED PRECURSOR RNA, of VGAM1301 are further described hereinbelow with reference to Table 1.

Nucleotide sequences of host target binding sites, such as BINDING SITE-I, BINDING SITE-II and BINDING SITE-III of FIG. 1, found on VGAM1301 host target RNA, and schematic representation of the complementarity of each of these host target binding sites to VGAM1301 RNA, herein designated VGAM RNA, are described hereinbelow with reference to Table 2.

As mentioned hereinabove with reference to FIG. 1, a function of VGAM1301 gene, herein designated VGAM is inhibition of expression of VGAM1301 target genes. It is appreciated that specific functions, and accordingly utilities, of VGAM1301 correlate with, and may be deduced from, the identity of the target genes which VGAM1301 binds and inhibits, and the function of these target genes, as elaborated hereinbelow.

STAF65(gamma) (Accession NM_014860) is a VGAM1301 host target gene. STAF65(gamma) BINDING SITE is HOST TARGET binding site found in the 3' untranslated region of mRNA encoded by STAF65(gamma), corresponding to a HOST TARGET binding site such as BINDING SITE I, BINDING SITE II or BINDING SITE III. Table 2 illustrates the complementarity of the nucleotide sequences of STAF65(gamma) BINDING SITE, designated SEQ ID:16925, to the nucleotide sequence of VGAM1301 RNA, herein designated VGAM RNA, also designated SEQ ID:4012.

A function of VGAM1301 is therefore inhibition of STAF65(gamma) (Accession NM_014860). Accordingly, utilities of VGAM1301 include diagnosis, prevention and treatment of diseases and clinical conditions associated with STAF65(gamma). FIG. 1 further provides a conceptual description of a novel bioinformatically detected viral gene of the present invention, referred to here as Viral Genomic Address Messenger 1302 (VGAM1302) viral gene, which modulates expression of respective host target genes thereof, the function and utility of which host target genes is known in the art.

VGAM1302 is a novel bioinformatically detected regulatory, non protein coding, viral micro RNA (miRNA) gene. The method by which VGAM1302 was detected is described hereinabove with reference to FIGS. 1-8.

VGAM1302 gene, herein designated VGAM GENE, is a viral gene contained in the genome of Human Herpesvirus 5. VGAM1302 host target gene, herein designated VGAM HOST TARGET GENE, is a human gene contained in the human genome.

VGAM1302 gene encodes a VGAM1302 precursor RNA, herein designated VGAM PRECURSOR RNA. Similar to other miRNA genes, and unlike most ordinary genes, VGAM1302 precursor RNA does not encode a protein. A nucleotide sequence identical or highly similar to the nucleotide sequence of VGAM1302 precursor RNA is designated SEQ ID:1288, and is provided hereinbelow with reference to the sequence listing part. Nucleotide sequence SEQ ID:1288 is located at position 180181 relative to the genome of Human Herpesvirus 5.

VGAM1302 precursor RNA folds onto itself, forming VGAM1302 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1302 folded precursor RNA into VGAM1302 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1302 RNA is designated SEQ ID:4013, and is provided hereinbelow with reference to the sequence listing part.

VGAM1302 host target gene, herein designated VGAM HOST TARGET GENE, encodes a corresponding messenger RNA, VGAM1302 host target RNA, herein designated VGAM HOST TARGET RNA. VGAM1302 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1302 RNA, herein designated VGAM RNA, binds complementarily to one or more host target binding sites located in untranslated regions of VGAM1302 host target RNA, herein designated VGAM HOST TARGET RNA. This complementary binding is due to the fact that the nucleotide sequence of VGAM1302 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1302 RNA, herein designated VGAM RNA, may have a different number of host target binding sites in untranslated regions of a VGAM1302 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1302 RNA, herein designated VGAM RNA, to host target binding sites on VGAM1302 host target RNA, herein designated VGAM HOST TARGET RNA, such as BINDING SITE I, BINDING SITE II and BINDING SITE III, inhibits translation of VGAM1302 host target RNA into VGAM1302 host target protein, herein designated VGAM HOST TARGET PROTEIN. VGAM host target protein is therefore outlined by a broken line.

It is appreciated that VGAM1302 host target gene, herein designated VGAM HOST TARGET GENE, in fact represents a plurality of VGAM1302 host target genes. The mRNA of each one of this plurality of VGAM1302 host target genes comprises one or more host target binding sites, each having a nucleotide sequence which is at least partly complementary to VGAM1302 RNA, herein designated VGAM RNA, and which when bound by VGAM1302 RNA causes inhibition of translation of respective one or more VGAM1302 host target proteins.

It is further appreciated by one skilled in the art that the mode of translational inhibition illustrated by FIG. 1 with specific reference to translational inhibition exerted by VGAM1302 gene, herein designated VGAM GENE, on one or more VGAM1302 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1302 is inhibition of expression of host target genes, as part of a novel viral mechanism of attacking a host. Accordingly, utilities of VGAM1302 include diagnosis, prevention and treatment of viral infection by Human Herpesvirus 5. Specific functions, and accordingly utilities, of VGAM1302 correlate with, and may be deduced from, the identity of the host target genes which VGAM1302 binds and inhibits, and the function of these host target genes, as elaborated hereinbelow.

Nucleotide sequences of the VGAM1302 precursor RNA, herein designated VGAM PRECURSOR RNA, and of the 'diced' VGAM1302 RNA, herein designated VGAM RNA, and a schematic representation of the secondary folding of VGAM1302 folded precursor RNA, herein designated VGAM FOLDED PRECURSOR RNA, of VGAM1302 are further described hereinbelow with reference to Table 1.

Nucleotide sequences of host target binding sites, such as BINDING SITE-I, BINDING SITE-II and BINDING SITE-III of FIG. 1, found on VGAM1302 host target RNA, and schematic representation of the complementarity of each of these host target binding sites to VGAM1302 RNA, herein designated VGAM RNA, are described hereinbelow with reference to Table 2.

As mentioned hereinabove with reference to FIG. 1, a function of VGAM1302 gene, herein designated VGAM is inhibition of expression of VGAM1302 target genes. It is appreciated that specific functions, and accordingly utilities, of VGAM1302 correlate with, and may be deduced from, the identity of the target genes which VGAM1302 binds and inhibits, and the function of these target genes, as elaborated hereinbelow.

LOC254528 (Accession XM_170797) is a VGAM1302 host target gene. LOC254528 BINDING SITE is HOST TARGET binding site found in the 5' untranslated region of mRNA encoded by LOC254528, corresponding to a HOST TARGET binding site such as BINDING SITE I, BINDING SITE II or BINDING SITE III. Table 2 illustrates the complementarity of the nucleotide sequences of LOC254528 BINDING SITE, designated SEQ ID:45566, to the nucleotide sequence of VGAM1302 RNA, herein designated VGAM RNA, also designated SEQ ID:4013.

A function of VGAM1302 is therefore inhibition of LOC254528 (Accession XM_170797). Accordingly, utilities of VGAM1302 include diagnosis, prevention and treatment of diseases and clinical conditions associated with LOC254528. FIG. 1 further provides a conceptual description of a novel bioinformatically detected viral gene of the present invention, referred to here as Viral Genomic Address Messenger 1303 (VGAM1303) viral gene, which modulates expression of respective host target genes thereof, the function and utility of which host target genes is known in the art.

VGAM1303 is a novel bioinformatically detected regulatory, non protein coding, viral micro RNA (miRNA) gene. The method by which VGAM1303 was detected is described hereinabove with reference to FIGS. 1-8.

VGAM1303 gene, herein designated VGAM GENE, is a viral gene contained in the genome of Human Herpesvirus 5. VGAM1303 host target gene, herein designated VGAM HOST TARGET GENE, is a human gene contained in the human genome.

VGAM1303 gene encodes a VGAM1303 precursor RNA, herein designated VGAM PRECURSOR RNA. Similar to other miRNA genes, and unlike most ordinary genes, VGAM1303 precursor RNA does not encode a protein. A nucleotide sequence identical or highly similar to the nucleotide sequence of VGAM1303 precursor RNA is designated SEQ ID:1289, and is provided hereinbelow with reference to the sequence listing part. Nucleotide sequence SEQ ID:1289 is located at position 177616 relative to the genome of Human Herpesvirus 5.

VGAM1303 precursor RNA folds onto itself, forming VGAM1303 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1303 folded precursor RNA into VGAM1303 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1303 RNA is designated SEQ ID:4014, and is provided hereinbelow with reference to the sequence listing part.

VGAM1303 host target gene, herein designated VGAM HOST TARGET GENE, encodes a corresponding messenger RNA, VGAM1303 host target RNA, herein designated VGAM HOST TARGET RNA. VGAM1303 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1303 RNA, herein designated VGAM RNA, binds complementarily to one or more host target binding sites located in untranslated regions of VGAM1303 host target RNA, herein designated VGAM HOST TARGET RNA. This complementary binding is due to the fact that the nucleotide sequence of VGAM1303 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1303 RNA, herein designated VGAM RNA, may have a different number of host target binding sites in untranslated regions of a VGAM1303 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1303 RNA, herein designated VGAM RNA, to host target binding sites on VGAM1303 host target RNA, herein designated VGAM HOST TARGET RNA, such as BINDING SITE I, BINDING SITE II and BINDING SITE III, inhibits translation of VGAM1303 host target RNA into VGAM1303 host target protein, herein designated VGAM HOST TARGET PROTEIN. VGAM host target protein is therefore outlined by a broken line.

It is appreciated that VGAM1303 host target gene, herein designated VGAM HOST TARGET GENE, in fact represents a plurality of VGAM1303 host target genes. The mRNA of each one of this plurality of VGAM1303 host target genes comprises one or more host target binding sites, each having a nucleotide sequence which is at least partly complementary to VGAM1303 RNA, herein designated VGAM RNA, and which when bound by VGAM1303 RNA causes inhibition of translation of respective one or more VGAM1303 host target proteins.

It is further appreciated by one skilled in the art that the mode of translational inhibition illustrated by FIG. 1 with specific reference to translational inhibition exerted by VGAM1303 gene, herein designated VGAM GENE, on one or more VGAM1303 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1303 is inhibition of expression of host target genes, as part of a novel viral mechanism of attacking a host. Accordingly, utilities of VGAM1303 include diagnosis, prevention and treatment of viral infection by Human Herpesvirus 5. Specific functions, and accordingly utilities, of VGAM1303 correlate with, and may be deduced from, the identity of the host target genes which VGAM1303 binds and inhibits, and the function of these host target genes, as elaborated hereinbelow.

Nucleotide sequences of the VGAM1303 precursor RNA, herein designated VGAM PRECURSOR RNA, and of the 'diced' VGAM1303 RNA, herein designated VGAM RNA, and a schematic representation of the secondary folding of VGAM1303 folded precursor RNA, herein designated VGAM FOLDED PRECURSOR RNA, of VGAM1303 are further described hereinbelow with reference to Table 1.

Nucleotide sequences of host target binding sites, such as BINDING SITE-I, BINDING SITE-II and BINDING SITE-III of FIG. 1, found on VGAM1303 host target RNA, and schematic representation of the complementarity of each of these host target binding sites to VGAM1303 RNA, herein designated VGAM RNA, are described hereinbelow with reference to Table 2.

As mentioned hereinabove with reference to FIG. 1, a function of VGAM1303 gene, herein designated VGAM is inhibition of expression of VGAM1303 target genes. It is appreciated that specific functions, and accordingly utilities, of VGAM1303 correlate with, and may be deduced from, the identity of the target genes which VGAM1303 binds and inhibits, and the function of these target genes, as elaborated hereinbelow.

Dishevelled, Dsh Homolog 3 (Drosophila) (DVL3, Accession NM_004423) is a VGAM1303 host target gene. DVL3 BINDING SITE is HOST TARGET binding site found in the 3' untranslated region of mRNA encoded by DVL3, corresponding to a HOST TARGET binding site such as BINDING SITE I, BINDING SITE II or BINDING SITE III. Table 2 illustrates the complementarity of the nucleotide sequences of DVL3 BINDING SITE, designated SEQ ID:10696, to the nucleotide sequence of VGAM1303 RNA, herein designated VGAM RNA, also designated SEQ ID:4014.

A function of VGAM1303 is therefore inhibition of Dishevelled, Dsh Homolog 3 (Drosophila) (DVL3, Accession NM_004423), a gene which regulates cell proliferation. Accordingly, utilities of VGAM1303 include diagnosis, prevention and treatment of diseases and clinical conditions associated with DVL3. The function of DVL3 and its association with various diseases and clinical conditions, has been established by previous studies, as described hereinabove with reference to VGAM57. E2F Transcription Factor 3 (E2F3, Accession NM_001949) is another VGAM1303 host target gene. E2F3 BINDING SITE is HOST TARGET binding site found in the 3' untranslated region of mRNA encoded by E2F3, corresponding to a HOST TARGET binding site such as BINDING SITE I, BINDING SITE II or BINDING SITE III. Table 2 illustrates the complementarity of the nucleotide sequences of E2F3 BINDING SITE, designated SEQ ID:7667, to the nucleotide sequence of VGAM1303 RNA, herein designated VGAM RNA, also designated SEQ ID:4014.

Another function of VGAM1303 is therefore inhibition of E2F Transcription Factor 3 (E2F3, Accession NM_001949), a gene which binds dna and controls cell-cycle progression from g1 to s phase. Accordingly, utilities of VGAM1303 include diagnosis, prevention and treatment of diseases and clinical conditions associated with E2F3. The function of E2F3 and its association with various diseases and clinical conditions, has been established by previous studies, as described hereinabove with reference to VGAM475. Guanine Nucleotide Binding Protein (G protein), Alpha Inhibiting Activity Polypeptide 1 (GNAI1, Accession NM_002069) is another VGAM1303 host target gene. GNAI1 BINDING SITE is HOST TARGET binding site found in the 5' untranslated region of mRNA encoded by GNAI1, corresponding to a HOST TARGET binding site such as BINDING SITE I, BINDING SITE II or BINDING SITE III. Table 2 illustrates the complementarity of the nucleotide sequences of GNAI1 BINDING SITE, designated SEQ ID:7839, to the nucleotide sequence of VGAM1303 RNA, herein designated VGAM RNA, also designated SEQ ID:4014.

Another function of VGAM1303 is therefore inhibition of Guanine Nucleotide Binding Protein (G protein), Alpha Inhibiting Activity Polypeptide 1 (GNAI1, Accession NM_002069), a gene which is involved as modulators or transducers in various transmembrane signaling systems. Accordingly, utilities of VGAM1303 include diagnosis, prevention and treatment of diseases and clinical conditions associated with GNAI1. The function of GNAI1 and its association with various diseases and clinical conditions, has been established by previous studies, as described hereinabove with reference to VGAM57. Heparanase (HPSE, Accession NM_006665) is another VGAM1303 host target gene. HPSE BINDING SITE is HOST TARGET binding site found in the 3' untranslated region of mRNA encoded by HPSE, corresponding to a HOST TARGET binding site such as BINDING SITE I, BINDING SITE II or BINDING SITE III. Table 2 illustrates the complementarity of the nucleotide sequences of HPSE BINDING SITE, designated SEQ ID:13476, to the nucleotide sequence of VGAM1303 RNA, herein designated VGAM RNA, also designated SEQ ID:4014.

Another function of VGAM1303 is therefore inhibition of Heparanase (HPSE, Accession NM_006665), a gene which is an endoglycosidase that cleaves heparan sulfate. Accordingly, utilities of VGAM1303 include diagnosis, prevention and treatment of diseases and clinical conditions associated with HPSE. The function of HPSE and its association with various diseases and clinical conditions, has been established by previous studies, as described hereinabove with reference to VGAM374. Interleukin 1 Receptor, Type I (IL1R1, Accession NM_000877) is another VGAM1303 host target gene. IL1R1 BINDING SITE is HOST TARGET binding site found in the 3' untranslated region of mRNA encoded by IL1R1, corresponding to a HOST TARGET binding site such as BINDING SITE I, BINDING SITE II or BINDING SITE III. Table 2 illustrates the complementarity of the nucleotide sequences of IL1R1 BINDING SITE, designated SEQ ID:6565, to the nucleotide sequence of VGAM1303 RNA, herein designated VGAM RNA, also designated SEQ ID:4014.

Another function of VGAM1303 is therefore inhibition of Interleukin 1 Receptor, Type I (IL1R1, Accession NM_000877), a gene which is a receptor for interleukin-1 alpha (il-1a), beta (il-1b), and interleukin-1 receptor antagonist protein (il-1ra). Accordingly, utilities of VGAM1303 include diagnosis, prevention and treatment of diseases and clinical conditions associated with IL1R1. The function of IL1R1 and its association with various diseases and clinical conditions, has been established by previous studies, as described hereinabove with reference to VGAM704. MAD, Mothers Against Decapentaplegic Homolog 4 (Drosophila) (MADH4, Accession NM_005359) is another VGAM1303 host target gene. MADH4 BINDING SITE is HOST TARGET binding site found in the 5' untranslated region of mRNA encoded by MADH4, corresponding to a HOST TARGET binding site such as BINDING SITE I, BINDING SITE II or BINDING SITE III. Table 2 illustrates the complementarity of the nucleotide sequences of MADH4 BINDING SITE, designated SEQ ID:11832, to the nucleotide sequence of VGAM1303 RNA, herein designated VGAM RNA, also designated SEQ ID:4014.

Another function of VGAM1303 is therefore inhibition of MAD, Mothers Against Decapentaplegic Homolog 4 (Drosophila) (MADH4, Accession NM_005359), a gene which common mediator of signal transduction by tgf-beta (transforming growth factor) superfamily; smad4 is the common smad (co-smad). promotes binding of the smad2/smad4/fast-1 complex to dna and provides an activation function required for smad1 or smad2 to stimulate transcription. may act as a tumor suppressor. Accordingly, utilities of VGAM1303 include diagnosis, prevention and treatment of diseases and clinical conditions associated with MADH4. The function of MADH4 and its association with various diseases and clinical conditions, has been established by previous studies, as described hereinabove with reference to VGAM217. Regulator of G-protein Signalling 3 (RGS3, Accession NM_021106) is another VGAM1303 host target gene. RGS3 BINDING SITE is HOST TARGET binding site found in the 5' untranslated region of mRNA encoded by RGS3, corresponding to a HOST TARGET binding site such as BINDING SITE I, BINDING SITE II or BINDING SITE III. Table 2 illustrates the complementarity of the nucleotide sequences of RGS3 BINDING SITE, designated SEQ ID:22089, to the nucleotide sequence of VGAM1303 RNA, herein designated VGAM RNA, also designated SEQ ID:4014.

Another function of VGAM1303 is therefore inhibition of Regulator of G-protein Signalling 3 (RGS3, Accession NM_021106), a gene which negatively regulates G protein-coupled receptor signalling. Accordingly, utilities of VGAM1303 include diagnosis, prevention and treatment of diseases and clinical conditions associated with RGS3. The function of RGS3 and its association with various diseases and clinical conditions, has been established by previous studies, as described hereinabove with reference to VGAM404. DKFZp434G179 (Accession XM_087065) is another VGAM1303 host target gene. DKFZp434G179 BINDING SITE is HOST TARGET binding site found in the 3' untranslated region of mRNA encoded by DKFZp434G179, corresponding to a HOST TARGET binding site such as BINDING SITE I, BINDING SITE II or BINDING SITE III. Table 2 illustrates the complementarity of the nucleotide sequences of DKFZp434G179 BINDING SITE, designated SEQ ID:39040, to the nucleotide sequence of VGAM1303 RNA, herein designated VGAM RNA, also designated SEQ ID:4014.

Another function of VGAM1303 is therefore inhibition of DKFZp434G179 (Accession XM_087065). Accordingly, utilities of VGAM1303 include diagnosis, prevention and treatment of diseases and clinical conditions associated with DKFZp434G179. DKFZP434J037 (Accession NM_030952) is another VGAM1303 host target gene. DKFZP434J037 BINDING SITE is HOST TARGET binding site found in the 3' untranslated region of mRNA encoded by DKFZP434J037, corresponding to a HOST TARGET binding site such as BINDING SITE I, BINDING SITE II or BINDING SITE III. Table 2 illustrates the complementarity of the nucleotide sequences of DKFZP434J037 BINDING SITE, designated SEQ ID:25218, to the nucleotide sequence of VGAM1303 RNA, herein designated VGAM RNA, also designated SEQ ID:4014.

Another function of VGAM1303 is therefore inhibition of DKFZP434J037 (Accession NM_030952). Accordingly, utilities of VGAM1303 include diagnosis, prevention and treatment of diseases and clinical conditions associated with DKFZP434J037. DKFZP564J157 (Accession NM_018457) is another VGAM1303 host target gene. DKFZP564J157 BINDING SITE is HOST TARGET binding site found in the 3' untranslated region of mRNA encoded by DKFZP564J157, corresponding to a HOST TARGET binding site such as BINDING SITE I, BINDING SITE II or BINDING SITE III. Table 2 illustrates the complementarity of the nucleotide sequences of DKFZP564J157 BINDING SITE, designated SEQ ID:20528, to the nucleotide sequence of VGAM1303 RNA, herein designated VGAM RNA, also designated SEQ ID:4014.

Another function of VGAM1303 is therefore inhibition of DKFZP564J157 (Accession NM_018457). Accordingly, utilities of VGAM1303 include diagnosis, prevention and treatment of diseases and clinical conditions associated with DKFZP564J157. DQX1 (Accession NM_133637) is another VGAM1303 host target gene. DQX1 BINDING SITE is HOST TARGET binding site found in the 5' untranslated region of mRNA encoded by DQX1, corresponding to a HOST TARGET binding site such as BINDING SITE I, BINDING SITE II or BINDING SITE III. Table 2 illustrates the complementarity of the nucleotide sequences of DQX1 BINDING SITE, designated SEQ ID:28598, to the nucleotide sequence of VGAM1303 RNA, herein designated VGAM RNA, also designated SEQ ID:4014.

Another function of VGAM1303 is therefore inhibition of DQX1 (Accession NM_133637). Accordingly, utilities of VGAM1303 include diagnosis, prevention and treatment of diseases and clinical conditions associated with DQX1. FLJ10922 (Accession NM_018273) is another VGAM1303 host target gene. FLJ10922 BINDING SITE is HOST TARGET binding site found in the 3' untranslated region of mRNA encoded by FLJ10922, corresponding to a HOST TARGET binding site such as BINDING SITE I, BINDING SITE II or BINDING SITE III. Table 2 illustrates the complementarity of the nucleotide sequences of FLJ10922 BINDING SITE, designated SEQ ID:20254, to the nucleotide sequence of VGAM1303 RNA, herein designated VGAM RNA, also designated SEQ ID:4014.

Another function of VGAM1303 is therefore inhibition of FLJ10922 (Accession NM_018273). Accordingly, utilities of VGAM1303 include diagnosis, prevention and treatment of diseases and clinical conditions associated with FLJ10922. FLJ13769 (Accession NM_025012) is another VGAM1303 host target gene. FLJ13769 BINDING SITE is HOST TARGET binding site found in the 3' untranslated region of mRNA encoded by FLJ13769, corresponding to a HOST TARGET binding site such as BINDING SITE I, BINDING SITE II or BINDING SITE III. Table 2 illustrates the complementarity of the nucleotide sequences of FLJ13769 BINDING SITE, designated SEQ ID:24593, to the nucleotide sequence of VGAM1303 RNA, herein designated VGAM RNA, also designated SEQ ID:4014.

Another function of VGAM1303 is therefore inhibition of FLJ13769 (Accession NM_025012). Accordingly, utilities of VGAM1303 include diagnosis, prevention and treatment of diseases and clinical conditions associated with FLJ13769. KIAA1691 (Accession XM_166523) is another VGAM1303 host target gene. KIAA1691 BINDING SITE is HOST TARGET binding site found in the 3' untranslated region of mRNA encoded by KIAA1691, corresponding to a HOST TARGET binding site such as BINDING SITE I, BINDING SITE II or BINDING SITE III. Table 2 illustrates the complementarity of the nucleotide sequences of KIAA1691 BINDING SITE, designated SEQ ID:44468, to the nucleotide sequence of VGAM1303 RNA, herein designated VGAM RNA, also designated SEQ ID:4014.

Another function of VGAM1303 is therefore inhibition of KIAA1691 (Accession XM_166523). Accordingly, utilities of VGAM1303 include diagnosis, prevention and treatment of diseases and clinical conditions associated with KIAA1691. Leucine-rich Repeat LGI Family, Member 2 (LGI2, Accession NM_018176) is another VGAM1303 host target gene. LGI2 BINDING SITE is HOST TARGET binding site found in the 3' untranslated region of mRNA encoded by LGI2, corresponding to a HOST TARGET binding site such as BINDING SITE I, BINDING SITE II or BINDING SITE III. Table 2 illustrates the complementarity of the nucleotide sequences of LGI2 BINDING SITE, designated SEQ ID:20000, to the nucleotide sequence of VGAM1303 RNA, herein designated VGAM RNA, also designated SEQ ID:4014.

Another function of VGAM1303 is therefore inhibition of Leucine-rich Repeat LGI Family, Member 2 (LGI2, Accession NM_018176). Accordingly, utilities of VGAM1303 include diagnosis, prevention and treatment of diseases and clinical conditions associated with LGI2. Paired Mesoderm Homeobox 2b (PMX2B, Accession NM_003924) is another VGAM1303 host target gene. PMX2B BINDING SITE is HOST TARGET binding site found in the 3' untranslated region of mRNA encoded by PMX2B, corresponding to a HOST TARGET binding site such as BINDING SITE I, BINDING SITE II or BINDING SITE III. Table 2 illustrates the complementarity of the nucleotide sequences of PMX2B BINDING SITE, designated SEQ ID:10017, to the nucleotide sequence of VGAM1303 RNA, herein designated VGAM RNA, also designated SEQ ID:4014.

Another function of VGAM1303 is therefore inhibition of Paired Mesoderm Homeobox 2b (PMX2B, Accession NM_003924). Accordingly, utilities of VGAM1303 include diagnosis, prevention and treatment of diseases and clinical conditions associated with PMX2B. LOC144438 (Accession XM_084860) is another VGAM1303 host target gene. LOC144438 BINDING SITE is HOST TARGET binding site found in the 3' untranslated region of mRNA encoded by LOC144438, corresponding to a HOST TARGET binding site such as BINDING SITE I, BINDING SITE II or BINDING SITE III. Table 2 illustrates the complementarity of the nucleotide sequences of LOC144438 BINDING SITE, designated SEQ ID:37735, to the nucleotide sequence of VGAM1303 RNA, herein designated VGAM RNA, also designated SEQ ID:4014.

Another function of VGAM1303 is therefore inhibition of LOC144438 (Accession XM_084860). Accordingly, utilities of VGAM1303 include diagnosis, prevention and treatment of diseases and clinical conditions associated with LOC144438. LOC147804 (Accession XM_085901) is another VGAM1303 host target gene. LOC147804 BINDING SITE is HOST TARGET binding site found in the 5' untranslated region of mRNA encoded by LOC147804, corresponding to a HOST TARGET binding site such as BINDING SITE I, BINDING SITE II or BINDING SITE III. Table 2 illustrates the complementarity of the nucleotide sequences of LOC147804 BINDING SITE, designated SEQ ID:38382, to the nucleotide sequence of VGAM1303 RNA, herein designated VGAM RNA, also designated SEQ ID:4014.

Another function of VGAM1303 is therefore inhibition of LOC147804 (Accession XM_085901). Accordingly, utilities of VGAM1303 include diagnosis, prevention and treatment of diseases and clinical conditions associated with LOC147804. LOC148759 (Accession XM_097517) is another VGAM1303 host target gene. LOC148759 BINDING SITE is HOST TARGET binding site found in the 3' untranslated region of mRNA encoded by LOC148759, corresponding to a HOST TARGET binding site such as BINDING SITE I, BINDING SITE II or BINDING SITE III. Table 2 illustrates the complementarity of the nucleotide sequences of LOC148759 BINDING SITE, designated SEQ ID:40903, to the nucleotide sequence of VGAM1303 RNA, herein designated VGAM RNA, also designated SEQ ID:4014.

Another function of VGAM1303 is therefore inhibition of LOC148759 (Accession XM_097517). Accordingly, utilities of VGAM1303 include diagnosis, prevention and treatment of diseases and clinical conditions associated with LOC148759. LOC253219 (Accession XM_173743) is another VGAM1303 host target gene. LOC253219 BINDING SITE is HOST TARGET binding site found in the 5' untranslated region of mRNA encoded by LOC253219, corresponding to a HOST TARGET binding site such as BINDING SITE I, BINDING SITE II or BINDING SITE III. Table 2 illustrates the complementarity of the nucleotide sequences of LOC253219 BINDING SITE, designated SEQ ID:46561, to the nucleotide sequence of VGAM1303 RNA, herein designated VGAM RNA, also designated SEQ ID:4014.

Another function of VGAM1303 is therefore inhibition of LOC253219 (Accession XM_173743). Accordingly, utilities of VGAM1303 include diagnosis, prevention and treatment of diseases and clinical conditions associated with LOC253219. LOC257358 (Accession XM_173138) is another VGAM1303 host target gene. LOC257358 BINDING SITE is HOST TARGET binding site found in the 3' untranslated region of mRNA encoded by LOC257358, corresponding to a HOST TARGET binding site such as BINDING SITE I, BINDING SITE II or BINDING SITE III. Table 2 illustrates the complementarity of the nucleotide sequences of LOC257358 BINDING SITE, designated SEQ ID:46388, to the nucleotide sequence of VGAM1303 RNA, herein designated VGAM RNA, also designated SEQ ID:4014.

Another function of VGAM1303 is therefore inhibition of LOC257358 (Accession XM_173138). Accordingly, utilities of VGAM1303 include diagnosis, prevention and treatment of diseases and clinical conditions associated with LOC257358. LOC91759 (Accession XM_040467) is another VGAM1303 host target gene. LOC91759 BINDING SITE is HOST TARGET binding site found in the 5' untranslated region of mRNA encoded by LOC91759, corresponding to a HOST TARGET binding site such as BINDING SITE I, BINDING SITE II or BINDING SITE III. Table 2 illustrates the complementarity of the nucleotide sequences of LOC91759 BINDING SITE, designated SEQ ID:33304, to the nucleotide sequence of VGAM1303 RNA, herein designated VGAM RNA, also designated SEQ ID:4014.

Another function of VGAM1303 is therefore inhibition of LOC91759 (Accession XM_040467). Accordingly, utilities of VGAM1303 include diagnosis, prevention and treatment of diseases and clinical conditions associated with LOC91759. FIG. 1 further provides a conceptual description of a novel bioinformatically detected viral gene of the present invention, referred to here as Viral Genomic Address Messenger 1304 (VGAM1304) viral gene, which modulates expression of respective host target genes thereof, the function and utility of which host target genes is known in the art.

VGAM1304 is a novel bioinformatically detected regulatory, non protein coding, viral micro RNA (miRNA) gene. The method by which VGAM1304 was detected is described hereinabove with reference to FIGS. 1-8.

VGAM1304 gene, herein designated VGAM GENE, is a viral gene contained in the genome of Human Herpesvirus 5. VGAM1304 host target gene, herein designated VGAM HOST TARGET GENE, is a human gene contained in the human genome.

VGAM1304 gene encodes a VGAM1304 precursor RNA, herein designated VGAM PRECURSOR RNA. Similar to other miRNA genes, and unlike most ordinary genes, VGAM1304 precursor RNA does not encode a protein. A nucleotide sequence identical or highly similar to the nucleotide sequence of VGAM1304 precursor RNA is designated SEQ ID:1290, and is provided hereinbelow with reference to the sequence listing part. Nucleotide sequence SEQ ID:1290 is located at position 179588 relative to the genome of Human Herpesvirus 5.

VGAM1304 precursor RNA folds onto itself, forming VGAM1304 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1304 folded precursor RNA into VGAM1304 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1304 RNA is designated SEQ ID:4015, and is provided hereinbelow with reference to the sequence listing part.

VGAM1304 host target gene, herein designated VGAM HOST TARGET GENE, encodes a corresponding messenger RNA, VGAM1304 host target RNA, herein designated VGAM HOST TARGET RNA. VGAM1304 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1304 RNA, herein designated VGAM RNA, binds complementarily to one or more host target binding sites located in untranslated regions of VGAM1304 host target RNA, herein designated VGAM HOST TARGET RNA. This complementary binding is due to the fact that the nucleotide sequence of VGAM1304 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1304 RNA, herein designated VGAM RNA, may have a different number of host target binding sites in untranslated regions of a VGAM1304 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1304 RNA, herein designated VGAM RNA, to host target binding sites on VGAM1304 host target RNA, herein designated VGAM HOST TARGET RNA, such as BINDING SITE I, BINDING SITE II and BINDING SITE III, inhibits translation of VGAM1304 host target RNA into VGAM1304 host target protein, herein designated VGAM HOST TARGET PROTEIN. VGAM host target protein is therefore outlined by a broken line.

It is appreciated that VGAM1304 host target gene, herein designated VGAM HOST TARGET GENE, in fact represents a plurality of VGAM1304 host target genes. The mRNA of each one of this plurality of VGAM1304 host target genes comprises one or more host target binding sites, each having a nucleotide sequence which is at least partly complementary to VGAM1304 RNA, herein designated VGAM RNA, and which when bound by VGAM1304 RNA causes inhibition of translation of respective one or more VGAM1304 host target proteins.

It is further appreciated by one skilled in the art that the mode of translational inhibition illustrated by FIG. 1 with specific reference to translational inhibition exerted by VGAM1304 gene, herein designated VGAM GENE, on one or more VGAM1304 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1304 is inhibition of expression of host target genes, as part of a novel viral mechanism of attacking a host. Accordingly, utilities of VGAM1304 include diagnosis, prevention and treatment of viral infection by Human Herpesvirus 5. Specific functions, and accordingly utilities, of VGAM1304 correlate with, and may be deduced from, the identity of the host target genes which VGAM1304 binds and inhibits, and the function of these host target genes, as elaborated hereinbelow.

Nucleotide sequences of the VGAM1304 precursor RNA, herein designated VGAM PRECURSOR RNA, and of the 'diced' VGAM1304 RNA, herein designated VGAM RNA, and a schematic representation of the secondary folding of VGAM1304 folded precursor RNA, herein designated VGAM FOLDED PRECURSOR RNA, of VGAM1304 are further described hereinbelow with reference to Table 1.

Nucleotide sequences of host target binding sites, such as BINDING SITE-I, BINDING SITE-II and BINDING SITE-III of FIG. 1, found on VGAM1304 host target RNA, and schematic representation of the complementarity of each of these host target binding sites to VGAM1304 RNA, herein designated VGAM RNA, are described hereinbelow with reference to Table 2.

As mentioned hereinabove with reference to FIG. 1, a function of VGAM1304 gene, herein designated VGAM is inhibition of expression of VGAM1304 target genes. It is appreciated that specific functions, and accordingly utilities, of VGAM1304 correlate with, and may be deduced from, the identity of the target genes which VGAM1304 binds and inhibits, and the function of these target genes, as elaborated hereinbelow.

Diacylglycerol Kinase, Iota (DGKI, Accession NM_004717) is a VGAM1304 host target gene. DGKI BINDING SITE is HOST TARGET binding site found in the 3' untranslated region of mRNA encoded by DGKI, corresponding to a HOST TARGET binding site such as BINDING SITE I, BINDING SITE II or BINDING SITE III. Table 2 illustrates the complementarity of the nucleotide sequences of DGKI BINDING SITE, designated SEQ ID:11078, to the nucleotide sequence of VGAM1304 RNA, herein designated VGAM RNA, also designated SEQ ID:4015.

A function of VGAM1304 is therefore inhibition of Diacylglycerol Kinase, Iota (DGKI, Accession NM_004717), a gene which regulates the intracellular concentration of the second messenger diacylglycerol (DAG). Accordingly, utilities of VGAM1304 include diagnosis, prevention and treatment of diseases and clinical conditions associated with DGKI. The function of DGKI and its association with various diseases and clinical conditions, has been established by previous studies, as described hereinabove with reference to VGAM1107. DKFZp547J036 (Accession NM_032281) is another VGAM1304 host target gene. DKFZp547J036 BINDING SITE is HOST TARGET binding site found in the 5' untranslated region of mRNA encoded by DKFZp547J036, corresponding to a HOST TARGET binding site such as BINDING SITE I, BINDING SITE II or BINDING SITE III. Table 2 illustrates the complementarity of the nucleotide sequences of DKFZp547J036 BINDING SITE, designated SEQ ID:26039, to the nucleotide sequence of VGAM1304 RNA, herein designated VGAM RNA, also designated SEQ ID:4015.

Another function of VGAM1304 is therefore inhibition of DKFZp547J036 (Accession NM_032281). Accordingly, utilities of VGAM1304 include diagnosis, prevention and treatment of diseases and clinical conditions associated with DKFZp547J036. KIAA0872 (Accession NM_014940) is another VGAM1304 host target gene. KIAA0872 BINDING SITE is HOST TARGET binding site found in the 3' untranslated region of mRNA encoded by KIAA0872, corresponding to a HOST TARGET binding site such as BINDING SITE I, BINDING SITE II or BINDING SITE III. Table 2 illustrates the complementarity of the nucleotide sequences of KIAA0872 BINDING SITE, designated SEQ ID:17242, to the nucleotide sequence of VGAM1304 RNA, herein designated VGAM RNA, also designated SEQ ID:4015.

Another function of VGAM1304 is therefore inhibition of KIAA0872 (Accession NM_014940). Accordingly, utilities of VGAM1304 include diagnosis, prevention and treatment of diseases and clinical conditions associated with KIAA0872. KIAA1979 (Accession XM_113984) is another VGAM1304 host target gene. KIAA1979 BINDING SITE is HOST TARGET binding site found in the 3' untranslated region of mRNA encoded by KIAA1979, corresponding to a HOST TARGET binding site such as BINDING SITE I, BINDING SITE II or BINDING SITE III. Table 2 illustrates the complementarity of the nucleotide sequences of KIAA1979 BINDING SITE, designated SEQ ID:42589, to the nucleotide sequence of VGAM1304 RNA, herein designated VGAM RNA, also designated SEQ ID:4015.

Another function of VGAM1304 is therefore inhibition of KIAA1979 (Accession XM_113984). Accordingly, utilities of VGAM1304 include diagnosis, prevention and treatment of diseases and clinical conditions associated with KIAA1979. FIG. 1 further provides a conceptual description of a novel bioinformatically detected viral gene of the present invention, referred to here as Viral Genomic Address Messenger 1305 (VGAM1305) viral gene, which modulates expression of respective host target genes thereof, the function and utility of which host target genes is known in the art.

VGAM1305 is a novel bioinformatically detected regulatory, non protein coding, viral micro RNA (miRNA) gene. The method by which VGAM1305 was detected is described hereinabove with reference to FIGS. 1-8.

VGAM1305 gene, herein designated VGAM GENE, is a viral gene contained in the genome of Foot-and-mouth Disease Virus SAT 2 (FMDV-SAT2). VGAM1305 host target gene, herein designated VGAM HOST TARGET GENE, is a human gene contained in the human genome.

VGAM1305 gene encodes a VGAM1305 precursor RNA, herein designated VGAM PRECURSOR RNA. Similar to other miRNA genes, and unlike most ordinary genes, VGAM1305 precursor RNA does not encode a protein. A nucleotide sequence identical or highly similar to the nucleotide sequence of VGAM1305 precursor RNA is designated SEQ ID:1291, and is provided hereinbelow with reference to the sequence listing part. Nucleotide sequence SEQ ID:1291 is located at position 409 relative to the genome of Foot-and-mouth Disease Virus SAT 2 (FMDV-SAT2).

VGAM1305 precursor RNA folds onto itself, forming VGAM1305 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1305 folded precursor RNA into VGAM1305 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1305 RNA is designated SEQ ID:4016, and is provided hereinbelow with reference to the sequence listing part.

VGAM1305 host target gene, herein designated VGAM HOST TARGET GENE, encodes a corresponding messenger RNA, VGAM1305 host target RNA, herein designated VGAM HOST TARGET RNA. VGAM1305 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1305 RNA, herein designated VGAM RNA, binds complementarily to one or more host target binding sites located in untranslated regions of VGAM1305 host target RNA, herein designated VGAM HOST TARGET RNA. This complementary binding is due to the fact that the nucleotide sequence of VGAM1305 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1305 RNA, herein designated VGAM RNA, may have a different number of host target binding sites in untranslated regions of a VGAM1305 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1305 RNA, herein designated VGAM RNA, to host target binding sites on VGAM1305 host target RNA, herein designated VGAM HOST TARGET RNA, such as BINDING SITE I, BINDING SITE II and BINDING SITE III, inhibits translation of VGAM1305 host target RNA into VGAM1305 host target protein, herein designated VGAM HOST TARGET PROTEIN. VGAM host target protein is therefore outlined by a broken line.

It is appreciated that VGAM1305 host target gene, herein designated VGAM HOST TARGET GENE, in fact represents a plurality of VGAM1305 host target genes. The mRNA of each one of this plurality of VGAM1305 host target genes comprises one or more host target binding sites, each having a nucleotide sequence which is at least partly complementary to VGAM1305 RNA, herein designated VGAM RNA, and which when bound by VGAM1305 RNA causes inhibition of translation of respective one or more VGAM1305 host target proteins.

It is further appreciated by one skilled in the art that the mode of translational inhibition illustrated by FIG. 1 with specific reference to translational inhibition exerted by VGAM1305 gene, herein designated VGAM GENE, on one or more VGAM1305 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1305 is inhibition of expression of host target genes, as part of a novel viral mechanism of attacking a host. Accordingly, utilities of VGAM1305 include diagnosis, prevention and treatment of viral infection by Foot-and-mouth Disease Virus SAT 2 (FMDV-SAT2). Specific functions, and accordingly utilities, of VGAM1305 correlate with, and may be deduced from, the identity of the host target genes which VGAM1305 binds and inhibits, and the function of these host target genes, as elaborated hereinbelow.

Nucleotide sequences of the VGAM1305 precursor RNA, herein designated VGAM PRECURSOR RNA, and of the 'diced' VGAM1305 RNA, herein designated VGAM RNA, and a schematic representation of the secondary folding of VGAM1305 folded precursor RNA, herein designated VGAM FOLDED PRECURSOR RNA, of VGAM1305 are further described hereinbelow with reference to Table 1.

Nucleotide sequences of host target binding sites, such as BINDING SITE-I, BINDING SITE-II and BINDING SITE-III of FIG. 1, found on VGAM1305 host target RNA, and schematic representation of the complementarity of each of these host target binding sites to VGAM1305 RNA, herein designated VGAM RNA, are described hereinbelow with reference to Table 2.

As mentioned hereinabove with reference to FIG. 1, a function of VGAM1305 gene, herein designated VGAM is inhibition of expression of VGAM1305 target genes. It is appreciated that specific functions, and accordingly utilities, of VGAM1305 correlate with, and may be deduced from, the identity of the target genes which VGAM1305 binds and inhibits, and the function of these target genes, as elaborated hereinbelow.

Checkpoint Suppressor 1 (CHES1, Accession NM_005197) is a VGAM1305 host target gene. CHES1 BINDING SITE is HOST TARGET binding site found in the 3' untranslated region of mRNA encoded by CHES1, corresponding to a HOST TARGET binding site such as BINDING SITE I, BINDING SITE II or BINDING SITE III. Table 2 illustrates the complementarity of the nucleotide sequences of CHES1 BINDING SITE, designated SEQ ID:11697, to the nucleotide sequence of VGAM1305 RNA, herein designated VGAM RNA, also designated SEQ ID:4016.

A function of VGAM1305 is therefore inhibition of Checkpoint Suppressor 1 (CHES1, Accession NM_005197). Accordingly, utilities of VGAM1305 include diagnosis, prevention and treatment of diseases and clinical conditions associated with CHES1. Coagulation Factor C Homolog, Cochlin (Limulus polyphemus) (COCH, Accession NM_004086) is another VGAM1305 host target gene. COCH BINDING SITE is HOST TARGET binding site found in the 3" untranslated region of mRNA encoded by COCH, corresponding to a HOST TARGET binding site such as BINDING SITE I, BINDING SITE II or BINDING SITE III. Table 2 illustrates the complementarity of the nucleotide sequences of COCH BINDING SITE, designated SEQ ID:10292, to the nucleotide sequence of VGAM1305 RNA, herein designated VGAM RNA, also designated SEQ ID:4016.

Another function of VGAM1305 is therefore inhibition of Coagulation Factor C Homolog, Cochlin (Limulus polyphemus) (COCH, Accession NM_004086). Accordingly, utilities of VGAM1305 include diagnosis, prevention and treatment of diseases and clinical conditions associated with COCH. Dachshund Homolog (Drosophila) (DACH, Accession NM_080759) is another VGAM1305 host target gene. DACH BINDING SITE is HOST TARGET binding site found in the 3' untranslated region of mRNA encoded by DACH, corresponding to a HOST TARGET binding site such as BINDING SITE I, BINDING SITE II or BINDING SITE III. Table 2 illustrates the complementarity of the nucleotide sequences of DACH BINDING SITE, designated SEQ ID:28034, to the nucleotide sequence of VGAM1305 RNA, herein designated VGAM RNA, also designated SEQ ID:4016.

Another function of VGAM1305 is therefore inhibition of Dachshund Homolog (Drosophila) (DACH, Accession NM_080759), a gene which regulates early progenitor cell proliferation during retinogenesis and pituitary development. Accordingly, utilities of VGAM1305 include diagnosis, prevention and treatment of diseases and clinical conditions associated with DACH. The function of DACH and its association with various diseases and clinical conditions, has been established by previous studies, as described hereinabove with reference to VGAM260. Inositol Polyphosphate-5-phosphatase, 40 kDa (INPP5A, Accession NM_005539) is another VGAM1305 host target gene. INPP5A BINDING SITE is HOST TARGET binding site found in the 3' untranslated region of mRNA encoded by INPP5A, corresponding to a HOST TARGET binding site such as BINDING SITE I, BINDING SITE II or BINDING SITE III. Table 2 illustrates the complementarity of the nucleotide sequences of INPP5A BINDING SITE, designated SEQ ID:12066, to the nucleotide sequence of VGAM1305 RNA, herein designated VGAM RNA, also designated SEQ ID:4016.

Another function of VGAM1305 is therefore inhibition of Inositol Polyphosphate-5-phosphatase, 40 kDa (INPP5A, Accession NM_005539), a gene which hydrolyzes the calcium-mobilizing second messenger ins (1,4,5) p3. Accordingly, utilities of VGAM1305 include diagnosis, prevention and treatment of diseases and clinical conditions associated with INPP5A. The function of INPP5A has been established by previous studies. The phosphatidylinositols serve as precursors for a number of different messenger molecules. Agonist stimulation of cells results in phosphatidylinositol turnover and the generation of inositol 1,4,5-triphosphate, Ins (1,4,5)P3, which mobilizes intracellular calcium. The inositol polyphosphate-5-phosphatase enzymes hydrolyze Ins (1,4,5) P3 in a signal-terminating reaction. Laxminarayan et al. (1994) isolated a 2.7-kb composite cDNA encoding the 43-kD membrane-associated 5-phosphatase by screening a human placental lambda-gt11 library using degenerate oligonucleotides. The 2.7-kb cDNA contained a 1.1-kb open reading frame, comprising 363 amino acids, which encoded a protein of predicted molecular mass of 42 kD. They showed that a 73-amino acid domain in the COOH terminus of the 43-kD membrane-associated 5-phosphatase had 30% sequence identity and 67% similarity to a region in the 75-kD 5-phosphatase (OMIM Ref. No. 147264) and 34% identity and 70% similarity to a sequence in the protein that is encoded by the gene defective in Lowe oculocerebral renal syndrome (OMIM Ref. No. 309000). The 43-kD membrane-associated 5-phosphatase appeared to be predominantly expressed in heart, brain, and skeletal muscle.

Full details of the abovementioned studies are described in the following publications, the disclosure of which are hereby incorporated by reference:

Laxminarayan, K. M.; Chan, B. K.; Tetaz, T.; Bird, P. I.; Mitchell, C. A.: Characterization of a cDNA encoding the 43-kDa membrane-associated inositol-polyphosphate 5-phosphatase. J. Biol. Chem. 269:17305-17310, 1994; and Mitchell, C. A.; Speed, C. J.; Nicholl, J.; Sutherland, G. R.: Chromosomal mapping of the gene (INPP5A) encoding the 43-kDa membrane-associated inositol polyphosphate 5-phosphatase to 1.

Further studies establishing the function and utilities of INPP5A are found in John Hopkins OMIM database record ID 600106, and in sited publications numbered 878 and 8792 listed in the bibliography section hereinbelow, which are also hereby incorporated by reference. Nucleoporin 98 kDa (NUP98, Accession NM_016320) is another VGAM1305 host target gene. NUP98 BINDING SITE is HOST TARGET binding site found in the 5' untranslated region of mRNA encoded by NUP98, corresponding to a HOST TARGET binding site such as BINDING SITE I, BINDING SITE II or BINDING SITE III. Table 2 illustrates the complementarity of the nucleotide sequences of NUP98 BINDING SITE, designated SEQ ID:18442, to the nucleotide sequence of VGAM1305 RNA, herein designated VGAM RNA, also designated SEQ ID:4016.

Another function of VGAM1305 is therefore inhibition of Nucleoporin 98 kDa (NUP98, Accession NM_016320), a gene which functions in the nuclear transport of protein and RNA. Accordingly, utilities of VGAM1305 include diagnosis, prevention and treatment of diseases and clinical conditions associated with NUP98. The function of NUP98 and its association with various diseases and clinical conditions, has been established by previous studies, as described hereinabove with reference to VGAM55. RAP1, GTPase Activating Protein 1 (RAP1GA1, Accession NM_002885) is another VGAM1305 host target gene. RAP1GA1 BINDING SITE is HOST TARGET binding site found in the 3' untranslated region of mRNA encoded by RAP1GA1, corresponding to a HOST TARGET binding site such as BINDING SITE I, BINDING SITE II or BINDING SITE III. Table 2 illustrates the complementarity of the nucleotide sequences of RAP1GA1 BINDING SITE, designated SEQ ID:8797, to the nucleotide sequence of VGAM1305 RNA, herein designated VGAM RNA, also designated SEQ ID:4016.

Another function of VGAM1305 is therefore inhibition of RAP1, GTPase Activating Protein 1 (RAP1GA1, Accession NM_002885). Accordingly, utilities of VGAM1305 include diagnosis, prevention and treatment of diseases and clinical conditions associated with RAP1GA1. Son of Sevenless Homolog 2 (Drosophila) (SOS2, Accession XM_043720) is another VGAM1305 host target gene. SOS2 BINDING SITE is HOST TARGET binding site found in the 3' untranslated region of mRNA encoded by SOS2, corresponding to a HOST TARGET binding site such as BINDING SITE I, BINDING SITE II or BINDING SITE III. Table 2 illustrates the complementarity of the nucleotide sequences of SOS2 BINDING SITE, designated SEQ ID:33999, to the nucleotide sequence of VGAM1305 RNA, herein designated VGAM RNA, also designated SEQ ID:4016.

Another function of VGAM1305 is therefore inhibition of Son of Sevenless Homolog 2 (Drosophila) (SOS2, Accession XM_043720). Accordingly, utilities of VGAM1305 include diagnosis, prevention and treatment of diseases and clinical conditions associated with SOS2. Chromosome 20 Open Reading Frame 121 (C20orf121, Accession NM_024331) is another VGAM1305 host target gene. C20orf121 BINDING SITE is HOST TARGET binding site found in the 5' untranslated region of mRNA encoded by C20orf121, corresponding to a HOST TARGET binding site such as BINDING SITE I, BINDING SITE II or BINDING SITE III. Table 2 illustrates the complementarity of the nucleotide sequences of C20orf121 BINDING SITE, designated SEQ ID:23630, to the nucleotide sequence of VGAM1305 RNA, herein designated VGAM RNA, also designated SEQ ID:4016.

Another function of VGAM1305 is therefore inhibition of Chromosome 20 Open Reading Frame 121 (C20orf121, Accession NM_024331). Accordingly, utilities of VGAM1305 include diagnosis, prevention and treatment of diseases and clinical conditions associated with C20orf121. E74-like Factor 4 (ets domain transcription factor) (ELF4, Accession NM_001421) is another VGAM1305 host target gene. ELF4 BINDING SITE is HOST TARGET binding site found in the 5' untranslated region of mRNA encoded by ELF4, corresponding to a HOST TARGET binding site such as BINDING SITE I, BINDING SITE II or BINDING SITE III. Table 2 illustrates the complementarity of the nucleotide sequences of ELF4 BINDING SITE, designated SEQ ID:7121, to the nucleotide sequence of VGAM1305 RNA, herein designated VGAM RNA, also designated SEQ ID:4016.

Another function of VGAM1305 is therefore inhibition of E74-like Factor 4 (ets domain transcription factor) (ELF4, Accession NM_001421). Accordingly, utilities of VGAM1305 include diagnosis, prevention and treatment of diseases and clinical conditions associated with ELF4. KIAA0218 (Accession NM_014760) is another VGAM1305 host target gene. KIAA0218 BINDING SITE is HOST TARGET binding site found in the 3" untranslated region of mRNA encoded by KIAA0218, corresponding to a HOST TARGET binding site such as BINDING SITE I, BINDING SITE II or BINDING SITE III. Table 2 illustrates the complementarity of the nucleotide sequences of KIAA0218 BINDING SITE, designated SEQ ID:16516, to the nucleotide sequence of VGAM1305 RNA, herein designated VGAM RNA, also designated SEQ ID:4016.

Another function of VGAM1305 is therefore inhibition of KIAA0218 (Accession NM_014760). Accordingly, utilities of VGAM1305 include diagnosis, prevention and treatment of diseases and clinical conditions associated with KIAA0218. KIAA0889 (Accession NM_015377) is another VGAM1305 host target gene. KIAA0889 BINDING SITE is HOST TARGET binding site found in the 3' untranslated region of mRNA encoded by KIAA0889, corresponding to a HOST TARGET binding site such as BINDING SITE I, BINDING SITE II or BINDING SITE III. Table 2 illustrates the complementarity of the nucleotide sequences of KIAA0889 BINDING SITE, designated SEQ ID:17676, to the nucleotide sequence of VGAM1305 RNA, herein designated VGAM RNA, also designated SEQ ID:4016.

Another function of VGAM1305 is therefore inhibition of KIAA0889 (Accession NM_015377). Accordingly, utilities of VGAM1305 include diagnosis, prevention and treatment of diseases and clinical conditions associated with KIAA0889. KIAA0945 (Accession NM_014952) is another VGAM1305 host target gene. KIAA0945 BINDING SITE is HOST TARGET binding site found in the 3' untranslated region of mRNA encoded by KIAA0945, corresponding to a HOST TARGET binding site such as BINDING SITE I, BINDING SITE II or BINDING SITE III. Table 2 illustrates the complementarity of the nucleotide sequences of KIAA0945 BINDING SITE, designated SEQ ID:17294, to the nucleotide sequence of VGAM1305 RNA, herein designated VGAM RNA, also designated SEQ ID:4016.

Another function of VGAM1305 is therefore inhibition of KIAA0945 (Accession NM_014952). Accordingly, utilities of VGAM1305 include diagnosis, prevention and treatment of diseases and clinical conditions associated with KIAA0945. KIAA1198 (Accession XM_032674) is another VGAM1305 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31707, to the nucleotide sequence of VGAM1305 RNA, herein designated VGAM RNA, also designated SEQ ID:4016.

Another function of VGAM1305 is therefore inhibition of KIAA1198 (Accession XM_032674). Accordingly, utilities of VGAM1305 include diagnosis, prevention and treatment of diseases and clinical conditions associated with KIAA1198. MGC2827 (Accession NM_023940) is another VGAM1305 host target gene. MGC2827 BINDING SITE is HOST TARGET binding site found in the 3' untranslated region of mRNA encoded by MGC2827, corresponding to a HOST TARGET binding site such as BINDING SITE I, BINDING SITE II or BINDING SITE III. Table 2 illustrates the complementarity of the nucleotide sequences of MGC2827 BINDING SITE, designated SEQ ID:23424, to the nucleotide sequence of VGAM1305 RNA, herein designated VGAM RNA, also designated SEQ ID:4016.

Another function of VGAM1305 is therefore inhibition of MGC2827 (Accession NM_023940). Accordingly, utilities of VGAM1305 include diagnosis, prevention and treatment of diseases and clinical conditions associated with MGC2827. TRIP-Br2 (Accession NM_014755) is another VGAM1305 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16484, to the nucleotide sequence of VGAM1305 RNA, herein designated VGAM RNA, also designated SEQ ID:4016.

Another function of VGAM1305 is therefore inhibition of TRIP-Br2 (Accession NM_014755). Accordingly, utilities of VGAM1305 include diagnosis, prevention and treatment of diseases and clinical conditions associated with TRIP-Br2. LOC115110 (Accession XM_049825) is another VGAM1305 host target gene. LOC115110 BINDING SITE is HOST TARGET binding site found in the 3' untranslated region of mRNA encoded by LOC115110, corresponding to a HOST TARGET binding site such as BINDING SITE I, BINDING SITE II or BINDING SITE III. Table 2 illustrates the complementarity of the nucleotide sequences of LOC115110 BINDING SITE, designated SEQ ID:35507, to the nucleotide sequence of VGAM1305 RNA, herein designated VGAM RNA, also designated SEQ ID:4016.

Another function of VGAM1305 is therefore inhibition of LOC115110 (Accession XM_049825). Accordingly, utilities of VGAM1305 include diagnosis, prevention and treatment of diseases and clinical conditions associated with LOC115110. LOC149506 (Accession XM_097661) is another VGAM1305 host target gene. LOC149506 BINDING SITE is HOST TARGET binding site found in the 5' untranslated region of mRNA encoded by LOC149506, corresponding to a HOST TARGET binding site such as BINDING SITE I, BINDING SITE II or BINDING SITE III. Table 2 illustrates the complementarity of the nucleotide sequences of LOC149506 BINDING SITE, designated SEQ ID:41005, to the nucleotide sequence of VGAM1305 RNA, herein designated VGAM RNA, also designated SEQ ID:4016.

Another function of VGAM1305 is therefore inhibition of LOC149506 (Accession XM_097661). Accordingly, utilities of VGAM1305 include diagnosis, prevention and treatment of diseases and clinical conditions associated with LOC149506. LOC152317 (Accession XM_098189) is another VGAM1305 host target gene. LOC152317 BINDING SITE is HOST TARGET binding site found in the 3' untranslated region of mRNA encoded by LOC152317, corresponding to a HOST TARGET binding site such as BINDING SITE I, BINDING SITE II or BINDING SITE III. Table 2 illustrates the complementarity of the nucleotide sequences of LOC152317 BINDING SITE, designated SEQ ID:41466, to the nucleotide sequence of VGAM1305 RNA, herein designated VGAM RNA, also designated SEQ ID:4016.

Another function of VGAM1305 is therefore inhibition of LOC152317 (Accession XM_098189). Accordingly, utilities of VGAM1305 include diagnosis, prevention and treatment of diseases and clinical conditions associated with LOC152317. LOC163882 (Accession XM_089211) is another VGAM1305 host target gene. LOC163882 BINDING SITE is HOST TARGET binding site found in the 3' untranslated region of mRNA encoded by LOC163882, corresponding to a HOST TARGET binding site such as BINDING SITE I, BINDING SITE II or BINDING SITE III. Table 2 illustrates the complementarity of the nucleotide sequences of LOC163882 BINDING SITE, designated SEQ ID:39971, to the nucleotide sequence of VGAM1305 RNA, herein designated VGAM RNA, also designated SEQ ID:4016.

Another function of VGAM1305 is therefore inhibition of LOC163882 (Accession XM_089211). Accordingly, utilities of VGAM1305 include diagnosis, prevention and treatment of diseases and clinical conditions associated with LOC163882. LOC253148 (Accession XM_173032) is another VGAM1305 host target gene. LOC253148 BINDING SITE is HOST TARGET binding site found in the 5' untranslated region of mRNA encoded by LOC253148, corresponding to a HOST TARGET binding site such as BINDING SITE I, BINDING SITE II or BINDING SITE III. Table 2 illustrates the complementarity of the nucleotide sequences of LOC253148 BINDING SITE, designated SEQ ID:46299, to the nucleotide sequence of VGAM1305 RNA, herein designated VGAM RNA, also designated SEQ ID:4016.

Another function of VGAM1305 is therefore inhibition of LOC253148 (Accession XM_173032). Accordingly, utilities of VGAM1305 include diagnosis, prevention and treatment of diseases and clinical conditions associated with LOC253148. LOC90072 (Accession XM_028702) is another VGAM1305 host target gene. LOC90072 BINDING SITE is HOST TARGET binding site found in the 3' untranslated region of mRNA encoded by LOC90072, corresponding to a HOST TARGET binding site such as BINDING SITE I, BINDING SITE II or BINDING SITE III. Table 2 illustrates the complementarity of the nucleotide sequences of LOC90072 BINDING SITE, designated SEQ ID:30727, to the nucleotide sequence of VGAM1305 RNA, herein designated VGAM RNA, also designated SEQ ID:4016.

Another function of VGAM1305 is therefore inhibition of LOC90072 (Accession XM_028702). Accordingly, utilities of VGAM1305 include diagnosis, prevention and treatment of diseases and clinical conditions associated with LOC90072. LOC90630 (Accession XM_033046) is another VGAM1305 host target gene. LOC90630 BINDING SITE is HOST TARGET binding site found in the 5' untranslated region of mRNA encoded by LOC90630, corresponding to a HOST TARGET binding site such as BINDING SITE I, BINDING SITE II or BINDING SITE III. Table 2 illustrates the complementarity of the nucleotide sequences of LOC90630 BINDING SITE, designated SEQ ID:31825, to the nucleotide sequence of VGAM1305 RNA, herein designated VGAM RNA, also designated SEQ ID:4016.

Another function of VGAM1305 is therefore inhibition of LOC90630 (Accession XM_033046). Accordingly, utilities of VGAM1305 include diagnosis, prevention and treatment of diseases and clinical conditions associated with LOC90630. FIG. 1 further provides a conceptual description of a novel bioinformatically detected viral gene of the present invention, referred to here as Viral Genomic Address Messenger 1306 (VGAM1306) viral gene, which modulates expression of respective host target genes thereof, the function and utility of which host target genes is known in the art.

VGAM1306 is a novel bioinformatically detected regulatory, non protein coding, viral micro RNA (miRNA) gene. The method by which VGAM1306 was detected is described hereinabove with reference to FIGS. 1-8.

VGAM1306 gene, herein designated VGAM GENE, is a viral gene contained in the genome of Foot-and-mouth Disease Virus SAT 2 (FMDV-SAT2). VGAM1306 host target gene, herein designated VGAM HOST TARGET GENE, is a human gene contained in the human genome.

VGAM1306 gene encodes a VGAM1306 precursor RNA, herein designated VGAM PRECURSOR RNA. Similar to other miRNA genes, and unlike most ordinary genes, VGAM1306 precursor RNA does not encode a protein. A nucleotide sequence identical or highly similar to the nucleotide sequence of VGAM1306 precursor RNA is designated SEQ ID:1292, and is provided hereinbelow with reference to the sequence listing part. Nucleotide sequence SEQ ID:1292 is located at position 4577 relative to the genome of Foot-and-mouth Disease Virus SAT 2 (FMDV-SAT2).

VGAM1306 precursor RNA folds onto itself, forming VGAM1306 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1306 folded precursor RNA into VGAM1306 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1306 RNA is designated SEQ ID:4017, and is provided hereinbelow with reference to the sequence listing part.

VGAM1306 host target gene, herein designated VGAM HOST TARGET GENE, encodes a corresponding messenger RNA, VGAM1306 host target RNA, herein designated VGAM HOST TARGET RNA. VGAM1306 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1306 RNA, herein designated VGAM RNA, binds complementarily to one or more host target binding sites located in untranslated regions of VGAM1306 host target RNA, herein designated VGAM HOST TARGET RNA. This complementary binding is due to the fact that the nucleotide sequence of VGAM1306 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1306 RNA, herein designated VGAM RNA, may have a different number of host target binding sites in untranslated regions of a VGAM1306 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1306 RNA, herein designated VGAM RNA, to host target binding sites on VGAM1306 host target RNA, herein designated VGAM HOST TARGET RNA, such as BINDING SITE I, BINDING SITE II and BINDING SITE III, inhibits translation of VGAM1306 host target RNA into VGAM1306 host target protein, herein designated VGAM HOST TARGET PROTEIN. VGAM host target protein is therefore outlined by a broken line.

It is appreciated that VGAM1306 host target gene, herein designated VGAM HOST TARGET GENE, in fact represents a plurality of VGAM1306 host target genes. The mRNA of each one of this plurality of VGAM1306 host target genes comprises one or more host target binding sites, each having a nucleotide sequence which is at least partly complementary to VGAM1306 RNA, herein designated VGAM RNA, and which when bound by VGAM1306 RNA causes inhibition of translation of respective one or more VGAM1306 host target proteins.

It is further appreciated by one skilled in the art that the mode of translational inhibition illustrated by FIG. 1 with specific reference to translational inhibition exerted by VGAM1306 gene, herein designated VGAM GENE, on one or more VGAM1306 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1306 is inhibition of expression of host target genes, as part of a novel viral mechanism of attacking a host. Accordingly, utilities of VGAM1306 include diagnosis, prevention and treatment of viral infection by Foot-and-mouth Disease Virus SAT 2 (FMDV-SAT2). Specific functions, and accordingly utilities, of VGAM1306 correlate with, and may be deduced from, the identity of the host target genes which VGAM1306 binds and inhibits, and the function of these host target genes, as elaborated hereinbelow.

Nucleotide sequences of the VGAM1306 precursor RNA, herein designated VGAM PRECURSOR RNA, and of the 'diced' VGAM1306 RNA, herein designated VGAM RNA, and a schematic representation of the secondary folding of VGAM1306 folded precursor RNA, herein designated VGAM FOLDED PRECURSOR RNA, of VGAM1306 are further described hereinbelow with reference to Table 1.

Nucleotide sequences of host target binding sites, such as BINDING SITE-I, BINDING SITE-II and BINDING SITE-III of FIG. 1, found on VGAM1306 host target RNA, and schematic representation of the complementarity of each of these host target binding sites to VGAM1306 RNA, herein designated VGAM RNA, are described hereinbelow with reference to Table 2.

As mentioned hereinabove with reference to FIG. 1, a function of VGAM1306 gene, herein designated VGAM is inhibition of expression of VGAM1306 target genes. It is appreciated that specific functions, and accordingly utilities, of VGAM1306 correlate with, and may be deduced from, the identity of the target genes which VGAM1306 binds and inhibits, and the function of these target genes, as elaborated hereinbelow.

Alcohol Dehydrogenase 7 (class IV), Mu Or Sigma Polypeptide (ADH7, Accession NM_000673) is a VGAM1306 host target gene. ADH7 BINDING SITE is HOST TARGET binding site found in the 3' untranslated region of mRNA encoded by ADH7, corresponding to a HOST TARGET binding site such as BINDING SITE I, BINDING SITE II or BINDING SITE III. Table 2 illustrates the complementarity of the nucleotide sequences of ADH7 BINDING SITE, designated SEQ ID:6326, to the nucleotide sequence of VGAM1306 RNA, herein designated VGAM RNA, also designated SEQ ID:4017.

A function of VGAM1306 is therefore inhibition of Alcohol Dehydrogenase 7 (class IV), Mu Or Sigma Polypeptide (ADH7, Accession NM_000673), a gene which retinol oxidation for the synthesis of retinoic acid, a hormone important for cellular differentiation. Accordingly, utilities of VGAM1306 include diagnosis, prevention and treatment of diseases and clinical conditions associated with ADH7. The function of ADH7 has been established by previous studies. Satre et al. (1994) characterized a novel human alcohol dehydrogenase gene called ADH7 and determined that it encodes a class IV ADH that is very active as a retinol dehydrogenase. They isolated a nearly full-length cDNA for ADH7 from a human stomach cDNA library and a 5-prime genomic clone containing exons 1 and 2 from a human genomic library. The deduced full-length amino acid sequence predicted a protein of 373 amino acids following the initiator methionine. The class IV identity of the sequence was confirmed by agreement with previously determined sequences for several human stomach class IV ADH peptides. Sequence comparison suggested that human ADH classes I and IV may have diverged from a common ancestor after the separation of the other classes, and may still share common physiologic functions. Satre et al. (1994) discussed the possibility that one of these functions is retinol oxidation for the synthesis of retinoic acid, a hormone important for cellular differentiation. Zgombic-Knight et al. (1995) demonstrated that the ADH7 gene has 9 exons and encodes a predicted polypeptide of 373 amino acids, excluding the amino-terminal methionine. ADH7 showed greater sequence identity with class I ADH (69%) than with classes II (e.g., 103740), III (e.g., 103710), or V, with which it is only 59-61% homologous. Zgombic-Knight et al. (1995) confirmed that ADH7 is the major stomach ADH, but, unlike the others, is absent from liver. Also, transcriptional regulation of the ADH7 gene appeared to be different from that of the other classes in that the ADH7 promoter lacks a TATA box and GC boxes upstream of the transcription initiation site. As outlined by Osier et al. (2002), 7 genes encoding ADH enzymes exist in a cluster extending approximately 380 kb on the long arm of chromosome 4. The class I ADH genes exist in a tighter cluster of approximately 77 kb, flanked upstream by ADH7 and downstream by ADH6

(OMIM Ref. No. 103735), ADH4 (OMIM Ref. No. 103740), and ADH5 (OMIM Ref. No. 103710), in that order.

Full details of the abovementioned studies are described in the following publications, the disclosure of which are hereby incorporated by reference:

Zgombic-Knight, M.; Foglio, M. H.; Duester, G.: Genomic structure and expression of the ADH7 gene encoding human class IV alcohol dehydrogenase, the form most efficient for retinol metabolism in vitro. J. Biol. Chem. 270:4305-4311, 1995; and Osier, M. V.; Pakstis, A. J.; Soodyall, H.; Comas, D.; Goldman, D.; Odunsi, A.; Okonofua, F.; Parnas, J.; Schulz, L. O.; Bertranpetit, J.; Bonne-Tamir, B.; Lu, R.-B.; Kidd, J. R.; Kidd.

Further studies establishing the function and utilities of ADH7 are found in John Hopkins OMIM database record ID 600086, and in sited publications numbered 12102-7899 listed in the bibliography section hereinbelow, which are also hereby incorporated by reference. MADS Box Transcription Enhancer Factor 2, Polypeptide D (myocyte enhancer factor 2D) (MEF2D, Accession XM_173049) is another VGAM1306 host target gene. MEF2D BINDING SITE is HOST TARGET binding site found in the 3' untranslated region of mRNA encoded by MEF2D, corresponding to a HOST TARGET binding site such as BINDING SITE I, BINDING SITE II or BINDING SITE III. Table 2 illustrates the complementarity of the nucleotide sequences of MEF2D BINDING SITE, designated SEQ ID:46308, to the nucleotide sequence of VGAM1306 RNA, herein designated VGAM RNA, also designated SEQ ID:4017.

Another function of VGAM1306 is therefore inhibition of MADS Box Transcription Enhancer Factor 2, Polypeptide D (myocyte enhancer factor 2D) (MEF2D, Accession XM_173049), a gene which regulates muscle-specific and mitogen-inducible genes. Accordingly, utilities of VGAM1306 include diagnosis, prevention and treatment of diseases and clinical conditions associated with MEF2D. The function of MEF2D has been established by previous studies. The MEF2 family of regulatory proteins are, like the myogenic basic helix-loop-helix proteins (see OMIM Ref. No. 159970), involved in myogenesis; see (OMIM Ref. No. 600660). Breitbart et al. (1993) obtained MEF2D cDNAs from an adult cardiac ventricle expression library screened at low stringency with a human MEF2B probe. One of the cDNAs encoded a 521-amino acid protein with highly conserved MADS and MEF2 domains. The recombinantly expressed MEF2D protein showed DNA binding to the MEF2 site. Breitbart et al. (1993) found that MEF2D occurs as several alternatively spliced transcripts, one of which resembles the Xenopus SRF-related factor SL-1. Unlike the other MEF2 family members, MEF2D is present in undifferentiated myoblasts and may participate in the earliest stages of commitment. Hobson et al. (1995) mapped the MEF2D gene to 1q12-q23 using somatic cell hybrid panel DNAs containing deletion or derivative chromosomes. Mouse Mef2D was mapped by Martin et al. (1994) to chromosome 3. Ikeshima et al. (1995) demonstrated strong expression of MEF2D in the cerebellum and cerebrum of developing mouse brains and also in central nervous system neurons of adult mice, suggesting that it may be involved in the differentiation of neurogenic as well as myogenic cells.

Full details of the abovementioned studies are described in the following publications, the disclosure of which are hereby incorporated by reference:

Hobson, G. M.; Krahe, R.; Garcia, E.; Siciliano, M. J.; Funanage, V. L.: Regional chromosomal assignments for four members of the MADS domain transcription enhancer factor 2 (MEF2) gene family to human chromosomes 15q26, 19p12, 5q14, and 1q12-q23. Genomics 29:704-711, 1995; and Ikeshima, H.; Imai, S.; Shimoda, K.; Hata, J.; Takano, T.: Expression of a MADS box gene, MEF2D, in neurons of the mouse central nervous system: implication of its binary function in m.

Further studies establishing the function and utilities of MEF2D are found in John Hopkins OMIM database record ID 600663, and in sited publications numbered 8293-8294, 817 and 8296 listed in the bibliography section hereinbelow, which are also hereby incorporated by reference. Wolf-Hirschhorn Syndrome Candidate 1 (WHSC1, Accession NM_133332) is another VGAM1306 host target gene. WHSC1 BINDING SITE1 through WHSC1 BINDING SITE3 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE3, designated SEQ ID:28442, SEQ ID:28459 and SEQ ID:17178 respectively, to the nucleotide sequence of VGAM1306 RNA, herein designated VGAM RNA, also designated SEQ ID:4017.

Another function of VGAM1306 is therefore inhibition of Wolf-Hirschhorn Syndrome Candidate 1 (WHSC1, Accession NM_133332), a gene which binds covalently to and repairs g/t mismatches. Accordingly, utilities of VGAM1306 include diagnosis, prevention and treatment of diseases and clinical conditions associated with WHSC1. The function of WHSC1 and its association with various diseases and clinical conditions, has been established by previous studies, as described hereinabove with reference to VGAM200. KIAA1276 (Accession XM_039169) is another VGAM1306 host target gene. KIAA1276 BINDING SITE is HOST TARGET binding site found in the 5' untranslated region of mRNA encoded by KIAA1276, corresponding to a HOST TARGET binding site such as BINDING SITE I, BINDING SITE II or BINDING SITE III. Table 2 illustrates the complementarity of the nucleotide sequences of KIAA1276 BINDING SITE, designated SEQ ID:33019, to the nucleotide sequence of VGAM1306 RNA, herein designated VGAM RNA, also designated SEQ ID:4017.

Another function of VGAM1306 is therefore inhibition of KIAA1276 (Accession XM_039169). Accordingly, utilities of VGAM1306 include diagnosis, prevention and treatment of diseases and clinical conditions associated with KIAA1276. PRO0800 (Accession NM_018592) is another VGAM1306 host target gene. PRO0800 BINDING SITE is HOST TARGET binding site found in the 5' untranslated region of mRNA encoded by PRO0800, corresponding to a HOST TARGET binding site such as BINDING SITE I, BINDING SITE II or BINDING SITE III. Table 2 illustrates the complementarity of the nucleotide sequences of PRO0800 BINDING SITE, designated SEQ ID:20671, to the nucleotide sequence of VGAM1306 RNA, herein designated VGAM RNA, also designated SEQ ID:4017.

Another function of VGAM1306 is therefore inhibition of PRO0800 (Accession NM_018592). Accordingly, utilities of VGAM1306 include diagnosis, prevention and treatment of diseases and clinical conditions associated with PRO0800. LOC148266 (Accession XM_086128) is another VGAM1306 host target gene. LOC148266 BINDING SITE is HOST TARGET binding site found in the 5' untranslated region of mRNA encoded by LOC148266, corresponding to a HOST TARGET binding site such as BINDING SITE I, BINDING SITE II or BINDING SITE III. Table 2 illustrates the complementarity of the nucleotide sequences of LOC148266 BINDING SITE, designated SEQ ID:38513, to the nucleotide sequence of VGAM1306 RNA, herein designated VGAM RNA, also designated SEQ ID:4017.

Another function of VGAM1306 is therefore inhibition of LOC148266 (Accession XM_086128). Accordingly, utilities of VGAM1306 include diagnosis, prevention and treatment of diseases and clinical conditions associated with LOC148266. LOC151009 (Accession XM_097992) is another VGAM1306 host target gene. LOC151009 BINDING SITE is HOST TARGET binding site found in the 3' untranslated region of mRNA encoded by LOC151009, corresponding to a HOST TARGET binding site such as BINDING SITE I, BINDING SITE II or BINDING SITE III. Table 2 illustrates the complementarity of the nucleotide sequences of LOC151009 BINDING SITE, designated SEQ ID:41290, to the nucleotide sequence of VGAM1306 RNA, herein designated VGAM RNA, also designated SEQ ID:4017.

Another function of VGAM1306 is therefore inhibition of LOC151009 (Accession XM_097992). Accordingly, utilities of VGAM1306 include diagnosis, prevention and treatment of diseases and clinical conditions associated with LOC151009. LOC157660 (Accession XM_098805) is another VGAM1306 host target gene. LOC157660 BINDING SITE is HOST TARGET binding site found in the 3' untranslated region of mRNA encoded by LOC157660, corresponding to a HOST TARGET binding site such as BINDING SITE I, BINDING SITE II or BINDING SITE III. Table 2 illustrates the complementarity of the nucleotide sequences of LOC157660 BINDING SITE, designated SEQ ID:41829, to the nucleotide sequence of VGAM1306 RNA, herein designated VGAM RNA, also designated SEQ ID:4017.

Another function of VGAM1306 is therefore inhibition of LOC157660 (Accession XM_098805). Accordingly, utilities of VGAM1306 include diagnosis, prevention and treatment of diseases and clinical conditions associated with LOC157660. LOC170409 (Accession XM_096330) is another VGAM1306 host target gene. LOC170409 BINDING SITE is HOST TARGET binding site found in the 3' untranslated region of mRNA encoded by LOC170409, corresponding to a HOST TARGET binding site such as BINDING SITE I, BINDING SITE II or BINDING SITE III. Table 2 illustrates the complementarity of the nucleotide sequences of LOC170409 BINDING SITE, designated SEQ ID:40317, to the nucleotide sequence of VGAM1306 RNA, herein designated VGAM RNA, also designated SEQ ID:4017.

Another function of VGAM1306 is therefore inhibition of LOC170409 (Accession XM_096330). Accordingly, utilities of VGAM1306 include diagnosis, prevention and treatment of diseases and clinical conditions associated with LOC170409. FIG. 1 further provides a conceptual description of a novel bioinformatically detected viral gene of the present invention, referred to here as Viral Genomic Address Messenger 1307 (VGAM1307) viral gene, which modulates expression of respective host target genes thereof, the function and utility of which host target genes is known in the art.

VGAM1307 is a novel bioinformatically detected regulatory, non protein coding, viral micro RNA (miRNA) gene. The method by which VGAM1307 was detected is described hereinabove with reference to FIGS. 1-8.

VGAM1307 gene, herein designated VGAM GENE, is a viral gene contained in the genome of Foot-and-mouth Disease Virus SAT 2 (FMDV-SAT2). VGAM1307 host target gene, herein designated VGAM HOST TARGET GENE, is a human gene contained in the human genome.

VGAM1307 gene encodes a VGAM1307 precursor RNA, herein designated VGAM PRECURSOR RNA. Similar to other miRNA genes, and unlike most ordinary genes, VGAM1307 precursor RNA does not encode a protein. A nucleotide sequence identical or highly similar to the nucleotide sequence of VGAM1307 precursor RNA is designated SEQ ID:1293, and is provided hereinbelow with reference to the sequence listing part. Nucleotide sequence SEQ ID:1293 is located at position 5733 relative to the genome of Foot-and-mouth Disease Virus SAT 2 (FMDV-SAT2).

VGAM1307 precursor RNA folds onto itself, forming VGAM1307 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1307 folded precursor RNA into VGAM1307 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1307 RNA is designated SEQ ID:4018, and is provided hereinbelow with reference to the sequence listing part.

VGAM1307 host target gene, herein designated VGAM HOST TARGET GENE, encodes a corresponding messenger RNA, VGAM1307 host target RNA, herein designated VGAM HOST TARGET RNA. VGAM1307 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1307 RNA, herein designated VGAM RNA, binds complementarily to one or more host target binding sites located in untranslated regions of VGAM1307 host target RNA, herein designated VGAM HOST TARGET RNA. This complementary binding is due to the fact that the nucleotide sequence of VGAM1307 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1307 RNA, herein designated VGAM RNA, may have a different number of host target binding sites in untranslated regions of a VGAM1307 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1307 RNA, herein designated VGAM RNA, to host target binding sites on VGAM1307 host target RNA, herein designated VGAM HOST TARGET RNA, such as BINDING SITE I, BINDING SITE II and BINDING SITE III, inhibits translation of VGAM1307 host target RNA into VGAM1307 host target protein, herein designated VGAM HOST TARGET PROTEIN. VGAM host target protein is therefore outlined by a broken line.

It is appreciated that VGAM1307 host target gene, herein designated VGAM HOST TARGET GENE, in fact represents a plurality of VGAM1307 host target genes. The mRNA of each one of this plurality of VGAM1307 host target genes comprises one or more host target binding sites, each having a nucleotide sequence which is at least partly complementary to VGAM1307 RNA, herein designated VGAM RNA, and which when bound by VGAM1307 RNA causes inhibition of translation of respective one or more VGAM1307 host target proteins.

It is further appreciated by one skilled in the art that the mode of translational inhibition illustrated by FIG. 1 with specific reference to translational inhibition exerted by VGAM1307 gene, herein designated VGAM GENE, on one or more VGAM1307 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1307 is inhibition of expression of host target genes, as part of a novel viral mechanism of attacking a host. Accordingly, utilities of VGAM1307 include diagnosis, prevention and treatment of viral infection by Foot-and-mouth Disease Virus SAT 2 (FMDV-SAT2). Specific functions, and accordingly utilities, of VGAM1307 correlate with, and may be deduced from, the identity of the host target genes which VGAM1307 binds and inhibits, and the function of these host target genes, as elaborated hereinbelow.

Nucleotide sequences of the VGAM1307 precursor RNA, herein designated VGAM PRECURSOR RNA, and of the 'diced' VGAM1307 RNA, herein designated VGAM RNA, and a schematic representation of the secondary folding of VGAM1307 folded precursor RNA, herein designated VGAM FOLDED PRECURSOR RNA, of VGAM1307 are further described hereinbelow with reference to Table 1.

Nucleotide sequences of host target binding sites, such as BINDING SITE-I, BINDING SITE-II and BINDING SITE-III of FIG. 1, found on VGAM1307 host target RNA, and schematic representation of the complementarity of each of these host target binding sites to VGAM1307 RNA, herein designated VGAM RNA, are described hereinbelow with reference to Table 2.

As mentioned hereinabove with reference to FIG. 1, a function of VGAM1307 gene, herein designated VGAM is inhibition of expression of VGAM1307 target genes. It is appreciated that specific functions, and accordingly utilities, of VGAM1307 correlate with, and may be deduced from, the identity of the target genes which VGAM1307 binds and inhibits, and the function of these target genes, as elaborated hereinbelow.

Growth Arrest-specific 11 (GAS11, Accession NM_001481) is a VGAM1307 host target gene. GAS11 BINDING SITE is HOST TARGET binding site found in the 3' untranslated region of mRNA encoded by GAS11, corresponding to a HOST TARGET binding site such as BINDING SITE I, BINDING SITE II or BINDING SITE III. Table 2 illustrates the complementarity of the nucleotide sequences of GAS11 BINDING SITE, designated SEQ ID:7219, to the nucleotide sequence of VGAM1307 RNA, herein designated VGAM RNA, also designated SEQ ID:4018.

A function of VGAM1307 is therefore inhibition of Growth Arrest-specific 11 (GAS11, Accession NM_001481). Accordingly, utilities of VGAM1307 include diagnosis, prevention and treatment of diseases and clinical conditions associated with GAS11. LanC Lantibiotic Synthetase Component C-like 1 (bacterial) (LANCL1, Accession NM_006055) is another VGAM1307 host target gene. LANCL1 BINDING SITE is HOST TARGET binding site found in the 3' untranslated region of mRNA encoded by LANCL1, corresponding to a HOST TARGET binding site such as BINDING SITE I, BINDING SITE II or BINDING SITE III. Table 2 illustrates the complementarity of the nucleotide sequences of LANCL1 BINDING SITE, designated SEQ ID:12695, to the nucleotide sequence of VGAM1307 RNA, herein designated VGAM RNA, also designated SEQ ID:4018.

Another function of VGAM1307 is therefore inhibition of LanC Lantibiotic Synthetase Component C-like 1 (bacterial) (LANCL1, Accession NM_006055), a gene which binds the C-terminus of stomatin. Accordingly, utilities of VGAM1307 include diagnosis, prevention and treatment of diseases and clinical conditions associated with LANCL1. The function of LANCL1 and its association with various diseases and clinical conditions, has been established by previous studies, as described hereinabove with reference to VGAM656. Microtubule-associated Protein Tau (MAPT, Accession NM_016835) is another VGAM1307 host target gene. MAPT BINDING SITE1 through MAPT BINDING SITE4 are HOST TARGET binding sites found in untranslated regions of mRNA encoded by MAPT, corresponding to HOST TARGET binding sites such as BINDING SITE I, BINDING SITE II or BINDING SITE III. Table 2 illustrates the complementarity of the nucleotide sequences of MAPT BINDING SITE1 through MAPT BINDING SITE4, designated SEQ ID:18831, SEQ ID:18837, SEQ ID:12537 and SEQ ID:18825 respectively, to the nucleotide sequence of VGAM1307 RNA, herein designated VGAM RNA, also designated SEQ ID:4018.

Another function of VGAM1307 is therefore inhibition of Microtubule-associated Protein Tau (MAPT, Accession NM_016835), a gene which Microtubule-associated protein tau; promotes microtubule assembly. Accordingly, utilities of VGAM1307 include diagnosis, prevention and treatment of diseases and clinical conditions associated with MAPT. The function of MAPT and its association with various diseases and clinical conditions, has been established by previous studies, as described hereinabove with reference to VGAM178. Neurexin 2 (NRXN2, Accession NM_138732) is another VGAM1307 host target gene. NRXN2 BINDING SITE1 through NRXN2 BINDING SITE3 are HOST TARGET binding sites found in untranslated regions of mRNA encoded by NRXN2, corresponding to HOST TARGET binding sites such as BINDING SITE I, BINDING SITE II or BINDING SITE III. Table 2 illustrates the complementarity of the nucleotide sequences of NRXN2 BINDING SITE1 through NRXN2 BINDING SITE3, designated SEQ ID:28984, SEQ ID:17468 and SEQ ID:42767 respectively, to the nucleotide sequence of VGAM1307 RNA, herein designated VGAM RNA, also designated SEQ ID:4018.

Another function of VGAM1307 is therefore inhibition of Neurexin 2 (NRXN2, Accession NM_138732), a gene which may be involved in cell recognition, cell adhesion, and may mediate intracellular signaling. Accordingly, utilities of VGAM1307 include diagnosis, prevention and treatment of diseases and clinical conditions associated with NRXN2. The function of NRXN2 and its association with various diseases and clinical conditions, has been established by previous studies, as described hereinabove with reference to VGAM178. FLJ10829 (Accession NM_018234) is another VGAM1307 host target gene. FLJ10829 BINDING SITE is HOST TARGET binding site found in the 3' untranslated region of mRNA encoded by FLJ10829, corresponding to a HOST TARGET binding site such as BINDING SITE I, BINDING SITE II or BINDING SITE III. Table 2 illustrates the complementarity of the nucleotide sequences of FLJ10829 BINDING SITE, designated SEQ ID:20177, to the nucleotide sequence of VGAM1307 RNA, herein designated VGAM RNA, also designated SEQ ID:4018.

Another function of VGAM1307 is therefore inhibition of FLJ10829 (Accession NM_018234). Accordingly, utilities of VGAM1307 include diagnosis, prevention and treatment of diseases and clinical conditions associated with FLJ10829. KIAA0923 (Accession NM_014021) is another VGAM1307 host target gene. KIAA0923 BINDING SITE is HOST TARGET binding site found in the 3' untranslated region of mRNA encoded by KIAA0923, corresponding to a HOST TARGET binding site such as BINDING SITE I, BINDING SITE II or BINDING SITE III. Table 2 illustrates the complementarity of the nucleotide sequences of KIAA0923 BINDING SITE, designated SEQ ID:15243, to the nucleotide sequence of VGAM1307 RNA, herein designated VGAM RNA, also designated SEQ ID:4018.

Another function of VGAM1307 is therefore inhibition of KIAA0923 (Accession NM_014021). Accordingly, utilities of VGAM1307 include diagnosis, prevention and treatment of diseases and clinical conditions associated with KIAA0923. FIG. 1 further provides a conceptual description of a novel bioinformatically detected viral gene of the present invention, referred to here as Viral Genomic Address Messenger 1308 (VGAM1308) viral gene, which modulates expression of respective host target genes thereof, the function and utility of which host target genes is known in the art.

VGAM1308 is a novel bioinformatically detected regulatory, non protein coding, viral micro RNA (miRNA) gene. The method by which VGAM1308 was detected is described hereinabove with reference to FIGS. 1-8.

VGAM1308 gene, herein designated VGAM GENE, is a viral gene contained in the genome of Foot-and-mouth Disease Virus SAT 2 (FMDV-SAT2). VGAM1308 host target gene, herein designated VGAM HOST TARGET GENE, is a human gene contained in the human genome.

VGAM1308 gene encodes a VGAM1308 precursor RNA, herein designated VGAM PRECURSOR RNA. Similar to other miRNA genes, and unlike most ordinary genes, VGAM1308 precursor RNA does not encode a protein. A nucleotide sequence identical or highly similar to the nucleotide sequence of VGAM1308 precursor RNA is designated SEQ ID:1294, and is provided hereinbelow with reference to the sequence listing part. Nucleotide sequence SEQ ID:1294 is located at position 4790 relative to the genome of Foot-and-mouth Disease Virus SAT 2 (FMDV-SAT2).

VGAM1308 precursor RNA folds onto itself, forming VGAM1308 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1308 folded precursor RNA into VGAM1308 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1308 RNA is designated SEQ ID:4019, and is provided hereinbelow with reference to the sequence listing part.

VGAM1308 host target gene, herein designated VGAM HOST TARGET GENE, encodes a corresponding messenger RNA, VGAM1308 host target RNA, herein designated VGAM HOST TARGET RNA. VGAM1308 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1308 RNA, herein designated VGAM RNA, binds complementarily to one or more host target binding sites located in untranslated regions of VGAM1308 host target RNA, herein designated VGAM HOST TARGET RNA. This complementary binding is due to the fact that the nucleotide sequence of VGAM1308 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1308 RNA, herein designated VGAM RNA, may have a different number of host target binding sites in untranslated regions of a VGAM1308 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1308 RNA, herein designated VGAM RNA, to host target binding sites on VGAM1308 host target RNA, herein designated VGAM HOST TARGET RNA, such as BINDING SITE I, BINDING SITE II and BINDING SITE III, inhibits translation of VGAM1308 host target RNA into VGAM1308 host target protein, herein designated VGAM HOST TARGET PROTEIN. VGAM host target protein is therefore outlined by a broken line.

It is appreciated that VGAM1308 host target gene, herein designated VGAM HOST TARGET GENE, in fact represents a plurality of VGAM1308 host target genes. The mRNA of each one of this plurality of VGAM1308 host target genes comprises one or more host target binding sites, each having a nucleotide sequence which is at least partly complementary to VGAM1308 RNA, herein designated VGAM RNA, and which when bound by VGAM1308 RNA causes inhibition of translation of respective one or more VGAM1308 host target proteins.

It is further appreciated by one skilled in the art that the mode of translational inhibition illustrated by FIG. 1 with specific reference to translational inhibition exerted by VGAM1308 gene, herein designated VGAM GENE, on one or more VGAM1308 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let- 7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1308 is inhibition of expression of host target genes, as part of a novel viral mechanism of attacking a host. Accordingly, utilities of VGAM1308 include diagnosis, prevention and treatment of viral infection by Foot-and-mouth Disease Virus SAT 2 (FMDV-SAT2). Specific functions, and accordingly utilities, of VGAM1308 correlate with, and may be deduced from, the identity of the host target genes which VGAM1308 binds and inhibits, and the function of these host target genes, as elaborated hereinbelow.

Nucleotide sequences of the VGAM1308 precursor RNA, herein designated VGAM PRECURSOR RNA, and of the 'diced' VGAM1308 RNA, herein designated VGAM RNA, and a schematic representation of the secondary folding of VGAM1308 folded precursor RNA, herein designated VGAM FOLDED PRECURSOR RNA, of VGAM1308 are further described hereinbelow with reference to Table 1.

Nucleotide sequences of host target binding sites, such as BINDING SITE-I, BINDING SITE-II and BINDING SITE-III of FIG. 1, found on VGAM1308 host target RNA, and schematic representation of the complementarity of each of these host target binding sites to VGAM1308 RNA, herein designated VGAM RNA, are described hereinbelow with reference to Table 2.

As mentioned hereinabove with reference to FIG. 1, a function of VGAM1308 gene, herein designated VGAM is inhibition of expression of VGAM1308 target genes. It is appreciated that specific functions, and accordingly utilities, of VGAM1308 correlate with, and may be deduced from, the identity of the target genes which VGAM1308 binds and inhibits, and the function of these target genes, as elaborated hereinbelow.

Aprataxin (APTX, Accession NM_017692) is a VGAM1308 host target gene. APTX BINDING SITE is HOST TARGET binding site found in the 3' untranslated region of mRNA encoded by APTX, corresponding to a HOST TARGET binding site such as BINDING SITE I, BINDING SITE II or BINDING SITE III. Table 2 illustrates the complementarity of the nucleotide sequences of APTX BINDING SITE, designated SEQ ID:19250, to the nucleotide sequence of VGAM1308 RNA, herein designated VGAM RNA, also designated SEQ ID:4019.

A function of VGAM1308 is therefore inhibition of Aprataxin (APTX, Accession NM_017692). Accordingly, utilities of VGAM1308 include diagnosis, prevention and treatment of diseases and clinical conditions associated with APTX. CERD4 (Accession NM_012074) is another VGAM1308 host target gene. CERD4 BINDING SITE is HOST TARGET binding site found in the 3' untranslated region of mRNA encoded by CERD4, corresponding to a HOST TARGET binding site such as BINDING SITE I, BINDING SITE II or BINDING SITE III. Table 2 illustrates the complementarity of the nucleotide sequences of CERD4 BINDING SITE, designated SEQ ID:14350, to the nucleotide sequence of VGAM1308 RNA, herein designated VGAM RNA, also designated SEQ ID:4019.

Another function of VGAM1308 is therefore inhibition of CERD4 (Accession NM_012074). Accordingly, utilities of VGAM1308 include diagnosis, prevention and treatment of diseases and clinical conditions associated with CERD4. G Protein-coupled Receptor Kinase 6 (GPRK6, Accession NM_002082) is another VGAM1308 host target gene. GPRK6 BINDING SITE is HOST TARGET binding site found in the 3' untranslated region of mRNA encoded by GPRK6, corresponding to a HOST TARGET binding site such as BINDING SITE I, BINDING SITE II or BINDING SITE III. Table 2 illustrates the complementarity of the nucleotide sequences of GPRK6 BINDING SITE, designated SEQ ID:7877, to the nucleotide sequence of VGAM1308 RNA, herein designated VGAM RNA, also designated SEQ ID:4019.

Another function of VGAM1308 is therefore inhibition of G Protein-coupled Receptor Kinase 6 (GPRK6, Accession NM_002082), a gene which regulates the G protein-coupled receptors. Accordingly, utilities of VGAM1308 include diagnosis, prevention and treatment of diseases and clinical conditions associated with GPRK6. The function of GPRK6 has been established by previous studies. By PCR on neutrophil cDNA using primers based on sequences of known receptor kinases, Haribabu and Snyderman (1993) identified GPRK5 (OMIM Ref. No. 600870) and GPRK6 sequences. Using a fragment of the GPRK6 PCR clone to screen a cDNA library, they isolated a cDNA encoding GPRK6. Sequence analysis predicted that the 544-amino acid GPRK6 protein contains the conserved DLG (asp-leu-gly) and ENIL (glu-asn-ile-leu) motifs. Northern blot analysis detected 2.1- and 2.9-kb GPRK6 transcripts in all tissues tested, with strongest expression in placenta and skeletal muscle. By somatic cell hybrid analysis, Haribabu and Snyderman (1993) mapped the GPRK6 gene and a closely related gene to chromosomes 5 and 13, respectively. Bullrich et al. (1995) mapped GPRK6 to 5q35 by analysis of a rodent human hybrid panel. The GPRK6-related locus was found to map to 13pter-q21.

Full details of the abovementioned studies are described in the following publications, the disclosure of which are hereby incorporated by reference:

Bullrich, F.; Druck, T.; Kunapuli, P.; Gomez, J.; Gripp, K. W.; Schlegelberger, B.; Lasota, J.; Aronson, M.; Cannizzaro, L. A.; Huebner, K.; Benovic, J. L.: Chromosomal mapping of the genes GPRK5 and GPRK6 encoding G protein-coupled receptor kinases GRK5 and GRK6. Cytogenet. Cell Genet. 70:250-254, 1995; and Haribabu, B.; Snyderman, R.: Identification of additional members of human G-protein-coupled receptor kinase multigene family. Proc. Nat. Acad. Sci. 90: 9398-9402, 1993.

Further studies establishing the function and utilities of GPRK6 are found in John Hopkins OMIM database record ID 600869, and in sited publications numbered 7022-7023 listed in the bibliography section hereinbelow, which are also hereby incorporated by reference. Inositol Polyphosphate-5-phosphatase, 145 kDa (INPP5D, Accession XM_096169) is another VGAM1308 host target gene. INPP5D BINDING SITE is HOST TARGET binding site found in the 3' untranslated region of mRNA encoded by INPP5D, corresponding to a HOST TARGET binding site such as BINDING SITE I, BINDING SITE II or BINDING SITE III. Table 2 illustrates the complementarity of the nucleotide sequences of INPP5D BINDING SITE, designated SEQ ID:40303, to the nucleotide sequence of VGAM1308 RNA, herein designated VGAM RNA, also designated SEQ ID:4019.

Another function of VGAM1308 is therefore inhibition of Inositol Polyphosphate-5-phosphatase, 145 kDa (INPP5D, Accession XM_096169), a gene which hydrolyzes Ins (1,3, 4,5)P4 and PtdIns (3,4,5)P3; contains an SH2-domain. Accordingly, utilities of VGAM1308 include diagnosis, prevention and treatment of diseases and clinical conditions associated with INPP5D. The function of INPP5D and its association with various diseases and clinical conditions, has been established by previous studies, as described hereinabove with reference to VGAM64. Mab-21-like 1 (C. elegans) (MAB21L1, Accession NM_005584) is another VGAM1308 host target gene. MAB21L1 BINDING SITE is HOST TARGET binding site found in the 3' untranslated region of mRNA encoded by MAB21L1, corresponding to a HOST TARGET binding site such as BINDING SITE I, BINDING SITE II or BINDING SITE III. Table 2 illustrates the complementarity of the nucleotide sequences of MAB21L1 BINDING SITE, designated SEQ ID:12112, to the nucleotide sequence of VGAM1308 RNA, herein designated VGAM RNA, also designated SEQ ID:4019.

Another function of VGAM1308 is therefore inhibition of Mab-21-like 1 (C. elegans) (MAB21L1, Accession NM_005584), a gene which may control cerebellum and eye development; very strongly similar to murine Mm.10798. Accordingly, utilities of VGAM1308 include diagnosis, prevention and treatment of diseases and clinical conditions associated with MAB21L1. The function of MAB21L1 and its association with various diseases and clinical conditions, has been established by previous studies, as described hereinabove with reference to VGAM39. Protein Kinase, CAMP-dependent, Regulatory, Type I, Alpha (tissue specific extinguisher 1) (PRKAR1A, Accession NM_002734) is another VGAM1308 host target gene. PRKAR1A BINDING SITE is HOST TARGET binding site found in the 3' untranslated region of mRNA encoded by PRKAR1A, corresponding to a HOST TARGET binding site such as BINDING SITE I, BINDING SITE II or BINDING SITE III. Table 2 illustrates the complementarity of the nucleotide sequences of PRKAR1A BINDING SITE, designated SEQ ID:8607, to the nucleotide sequence of VGAM1308 RNA, herein designated VGAM RNA, also designated SEQ ID:4019.

Another function of VGAM1308 is therefore inhibition of Protein Kinase, CAMP-dependent, Regulatory, Type I, Alpha (tissue specific extinguisher 1) (PRKAR1A, Accession NM_002734). Accordingly, utilities of VGAM1308 include diagnosis, prevention and treatment of diseases and clinical conditions associated with PRKAR1A. Stearoyl-CoA Desaturase (delta-9-desaturase) (SCD, Accession NM_005063) is another VGAM1308 host target gene. SCD BINDING SITE is HOST TARGET binding site found in the 3' untranslated region of mRNA encoded by SCD, corresponding to a HOST TARGET binding site such as BINDING SITE I, BINDING SITE II or BINDING SITE III. Table 2 illustrates the complementarity of the nucleotide sequences of SCD BINDING SITE, designated SEQ ID:11495, to the nucleotide sequence of VGAM1308 RNA, herein designated VGAM RNA, also designated SEQ ID:4019.

Another function of VGAM1308 is therefore inhibition of Stearoyl-CoA Desaturase (delta-9-desaturase) (SCD, Accession NM_005063), a gene which functions in the synthesis of unsaturated fatty acids. Accordingly, utilities of VGAM1308 include diagnosis, prevention and treatment of diseases and clinical conditions associated with SCD. The function of SCD and its association with various diseases and clinical conditions, has been established by previous studies, as described hereinabove with reference to VGAM314. Transforming Growth Factor, Beta 1 (Camurati-Engelmann disease) (TGFB1, Accession NM_000660) is another VGAM1308 host target gene. TGFB1 BINDING SITE is HOST TARGET binding site found in the 5' untranslated region of mRNA encoded by TGFB1, corresponding to a HOST TARGET binding site such as BINDING SITE I, BINDING SITE II or BINDING SITE III. Table 2 illustrates the complementarity of the nucleotide sequences of TGFB1 BINDING SITE, designated SEQ ID:6320, to the nucleotide sequence of VGAM1308 RNA, herein designated VGAM RNA, also designated SEQ ID:4019.

Another function of VGAM1308 is therefore inhibition of Transforming Growth Factor, Beta 1 (Camurati-Engelmann disease) (TGFB1, Accession NM_000660). Accordingly, utilities of VGAM1308 include diagnosis, prevention and treatment of diseases and clinical conditions associated with TGFB1. Zinc Finger Protein 236 (ZNF236, Accession NM_007345) is another VGAM1308 host target gene. ZNF236 BINDING SITE is HOST TARGET binding site found in the 3' untranslated region of mRNA encoded by ZNF236, corresponding to a HOST TARGET binding site such as BINDING SITE I, BINDING SITE II or BINDING SITE III. Table 2 illustrates the complementarity of the nucleotide sequences of ZNF236 BINDING SITE, designated SEQ ID:14275, to the nucleotide sequence of VGAM1308 RNA, herein designated VGAM RNA, also designated SEQ ID:4019.

Another function of VGAM1308 is therefore inhibition of Zinc Finger Protein 236 (ZNF236, Accession NM_007345). Accordingly, utilities of VGAM1308 include diagnosis, prevention and treatment of diseases and clinical conditions associated with ZNF236. Cyclin M4 (CNNM4, Accession NM_020184) is another VGAM1308 host target gene. CNNM4 BINDING SITE is HOST TARGET binding site found in the 3' untranslated region of mRNA encoded by CNNM4, corresponding to a HOST TARGET binding site such as BINDING SITE I, BINDING SITE II or BINDING SITE III. Table 2 illustrates the complementarity of the nucleotide sequences of CNNM4 BINDING SITE, designated SEQ ID:21424, to the nucleotide sequence of VGAM1308 RNA, herein designated VGAM RNA, also designated SEQ ID:4019.

Another function of VGAM1308 is therefore inhibition of Cyclin M4 (CNNM4, Accession NM_020184). Accordingly, utilities of VGAM1308 include diagnosis, prevention and treatment of diseases and clinical conditions associated with CNNM4. DDM36 (Accession NM_020962) is another VGAM1308 host target gene. DDM36 BINDING SITE is HOST TARGET binding site found in the 3' untranslated region of mRNA encoded by DDM36, corresponding to a HOST TARGET binding site such as BINDING SITE I, BINDING SITE II or BINDING SITE III. Table 2 illustrates the complementarity of the nucleotide sequences of DDM36 BINDING SITE, designated SEQ ID:21951, to the nucleotide sequence of VGAM1308 RNA, herein designated VGAM RNA, also designated SEQ ID:4019.

Another function of VGAM1308 is therefore inhibition of DDM36 (Accession NM_020962). Accordingly, utilities of VGAM1308 include diagnosis, prevention and treatment of diseases and clinical conditions associated with DDM36. DKFZp761B0514 (Accession NM_032289) is another VGAM1308 host target gene. DKFZp761B0514 BINDING SITE is HOST TARGET binding site found in the 3' untranslated region of mRNA encoded by DKFZp761B0514, corresponding to a HOST TARGET binding site such as BINDING SITE I, BINDING SITE II or BINDING SITE III. Table 2 illustrates the complementarity of the nucleotide sequences of DKFZp761B0514 BINDING SITE, designated SEQ ID:26049, to the nucleotide sequence of VGAM1308 RNA, herein designated VGAM RNA, also designated SEQ ID:4019.

Another function of VGAM1308 is therefore inhibition of DKFZp761B0514 (Accession NM_032289). Accordingly, utilities of VGAM1308 include diagnosis, prevention and treatment of diseases and clinical conditions associated with DKFZp761B0514. Fibroblast Growth Factor 19 (FGF19, Accession NM_005117) is another VGAM1308 host target gene. FGF19 BINDING SITE is HOST TARGET binding site found in the 3' untranslated region of mRNA encoded by FGF19, corresponding to a HOST TARGET binding site such as BINDING SITE I, BINDING SITE II or BINDING SITE III. Table 2 illustrates the complementarity of the nucleotide sequences of FGF19 BINDING SITE, designated SEQ ID:11595, to the nucleotide sequence of VGAM1308 RNA, herein designated VGAM RNA, also designated SEQ ID:4019.

Another function of VGAM1308 is therefore inhibition of Fibroblast Growth Factor 19 (FGF19, Accession NM_005117). Accordingly, utilities of VGAM1308 include diagnosis, prevention and treatment of diseases and clinical conditions associated with FGF19. FLJ12547 (Accession NM_024992) is another VGAM1308 host target gene. FLJ12547 BINDING SITE is HOST TARGET binding site found in the 3' untranslated region of mRNA encoded by FLJ12547, corresponding to a HOST TARGET binding site such as BINDING SITE I, BINDING SITE II or BINDING SITE III. Table 2 illustrates the complementarity of the nucleotide sequences of FLJ12547 BINDING SITE, designated SEQ ID:24546, to the nucleotide sequence of VGAM1308 RNA, herein designated VGAM RNA, also designated SEQ ID:4019.

Another function of VGAM1308 is therefore inhibition of FLJ12547 (Accession NM_024992). Accordingly, utilities of VGAM1308 include diagnosis, prevention and treatment of diseases and clinical conditions associated with FLJ12547. KIAA0296 (Accession NM_014699) is another VGAM1308 host target gene. KIAA0296 BINDING SITE is HOST TARGET binding site found in the 3' untranslated region of mRNA encoded by KIAA0296, corresponding to a HOST TARGET binding site such as BINDING SITE I, BINDING SITE II or BINDING SITE III. Table 2 illustrates the complementarity of the nucleotide sequences of KIAA0296 BINDING SITE, designated SEQ ID:16219, to the nucleotide sequence of VGAM1308 RNA, herein designated VGAM RNA, also designated SEQ ID:4019.

Another function of VGAM1308 is therefore inhibition of KIAA0296 (Accession NM_014699). Accordingly, utilities of VGAM1308 include diagnosis, prevention and treatment of diseases and clinical conditions associated with KIAA0296. KIAA0523 (Accession XM_041964) is another VGAM1308 host target gene. KIAA0523 BINDING SITE is HOST TARGET binding site found in the 3' untranslated region of mRNA encoded by KIAA0523, corresponding to a HOST TARGET binding site such as BINDING SITE I, BINDING SITE II or BINDING SITE III. Table 2 illustrates the complementarity of the nucleotide sequences of KIAA0523 BINDING SITE, designated SEQ ID:33640, to the nucleotide sequence of VGAM1308 RNA, herein designated VGAM RNA, also designated SEQ ID:4019.

Another function of VGAM1308 is therefore inhibition of KIAA0523 (Accession XM_041964). Accordingly, utilities of VGAM1308 include diagnosis, prevention and treatment of diseases and clinical conditions associated with KIAA0523. KIAA1297 (Accession XM_051005) is another VGAM1308 host target gene. KIAA1297 BINDING SITE is HOST TARGET binding site found in the 5' untranslated region of mRNA encoded by KIAA1297, corresponding to a HOST TARGET binding site such as BINDING SITE I, BINDING SITE II or BINDING SITE III. Table 2 illustrates the complementarity of the nucleotide sequences of KIAA1297 BINDING SITE, designated SEQ ID:35720, to the nucleotide sequence of VGAM1308 RNA, herein designated VGAM RNA, also designated SEQ ID:4019.

Another function of VGAM1308 is therefore inhibition of KIAA1297 (Accession XM_051005). Accordingly, utilities of VGAM1308 include diagnosis, prevention and treatment of diseases and clinical conditions associated with KIAA1297. KREMEN (Accession NM_032045) is another VGAM1308 host target gene. KREMEN BINDING SITE is HOST TARGET binding site found in the 3' untranslated region of mRNA encoded by KREMEN, corresponding to a HOST TARGET binding site such as BINDING SITE I, BINDING SITE II or BINDING SITE III. Table 2 illustrates the complementarity of the nucleotide sequences of KREMEN BINDING SITE, designated SEQ ID:25759, to the nucleotide sequence of VGAM1308 RNA, herein designated VGAM RNA, also designated SEQ ID:4019.

Another function of VGAM1308 is therefore inhibition of KREMEN (Accession NM_032045). Accordingly, utilities of VGAM1308 include diagnosis, prevention and treatment of diseases and clinical conditions associated with KREMEN. MGC5457 (Accession NM_032633) is another VGAM1308 host target gene. MGC5457 BINDING SITE is HOST TARGET binding site found in the 5' untranslated region of mRNA encoded by MGC5457, corresponding to a HOST TARGET binding site such as BINDING SITE I, BINDING SITE II or BINDING SITE III. Table 2 illustrates the complementarity of the nucleotide sequences of MGC5457 BINDING SITE, designated SEQ ID:26347, to the nucleotide sequence of VGAM1308 RNA, herein designated VGAM RNA, also designated SEQ ID:4019.

Another function of VGAM1308 is therefore inhibition of MGC5457 (Accession NM_032633). Accordingly, utilities of VGAM1308 include diagnosis, prevention and treatment of diseases and clinical conditions associated with MGC5457. Pleiomorphic Adenoma Gene-like 2 (PLAGL2, Accession XM_047007) is another VGAM1308 host target gene. PLAGL2 BINDING SITE is HOST TARGET binding site found in the 3' untranslated region of mRNA encoded by PLAGL2, corresponding to a HOST TARGET binding site such as BINDING SITE I, BINDING SITE II or BINDING SITE III. Table 2 illustrates the complementarity of the nucleotide sequences of PLAGL2 BINDING SITE, designated SEQ ID:34881, to the nucleotide sequence of VGAM1308 RNA, herein designated VGAM RNA, also designated SEQ ID:4019.

Another function of VGAM1308 is therefore inhibition of Pleiomorphic Adenoma Gene-like 2 (PLAGL2, Accession XM_047007). Accordingly, utilities of VGAM1308 include diagnosis, prevention and treatment of diseases and clinical conditions associated with PLAGL2. PRO1430 (Accession NM_018599) is another VGAM1308 host target gene. PRO1430 BINDING SITE is HOST TARGET binding site found in the 5' untranslated region of mRNA encoded by PRO1430, corresponding to a HOST TARGET binding site such as BINDING SITE I, BINDING SITE II or BINDING SITE III. Table 2 illustrates the complementarity of the nucleotide sequences of PRO1430 BINDING SITE, designated SEQ ID:20677, to the nucleotide sequence of VGAM1308 RNA, herein designated VGAM RNA, also designated SEQ ID:4019.

Another function of VGAM1308 is therefore inhibition of PRO1430 (Accession NM_018599). Accordingly, utilities of VGAM1308 include diagnosis, prevention and treatment of diseases and clinical conditions associated with PRO1430. LOC130951 (Accession NM_138804) is another VGAM1308 host target gene. LOC130951 BINDING SITE is HOST TARGET binding site found in the 3' untranslated region of mRNA encoded by LOC130951, corresponding to a HOST TARGET binding site such as BINDING SITE I, BINDING SITE II or BINDING SITE III. Table 2 illustrates the complementarity of the nucleotide sequences of LOC130951 BINDING SITE, designated SEQ ID:29027, to the nucleotide sequence of VGAM1308 RNA, herein designated VGAM RNA, also designated SEQ ID:4019.

Another function of VGAM1308 is therefore inhibition of LOC130951 (Accession NM_138804). Accordingly, utilities of VGAM1308 include diagnosis, prevention and treatment of diseases and clinical conditions associated with LOC130951. LOC201324 (Accession XM_043753) is another VGAM1308 host target gene. LOC201324 BINDING SITE is HOST TARGET binding site found in the 5' untranslated region of mRNA encoded by LOC201324, corresponding to a HOST TARGET binding site such as BINDING SITE I, BINDING SITE II or BINDING SITE III. Table 2 illustrates the complementarity of the nucleotide sequences of LOC201324 BINDING SITE, designated SEQ ID:34013, to the nucleotide sequence of VGAM1308 RNA, herein designated VGAM RNA, also designated SEQ ID:4019.

Another function of VGAM1308 is therefore inhibition of LOC201324 (Accession XM_043753). Accordingly, utilities of VGAM1308 include diagnosis, prevention and treatment of diseases and clinical conditions associated with LOC201324. LOC256021 (Accession XM_172884) is another VGAM1308 host target gene. LOC256021 BINDING SITE is HOST TARGET binding site found in the 3' untranslated region of mRNA encoded by LOC256021, corresponding to a HOST TARGET binding site such as BINDING SITE I, BINDING SITE II or BINDING SITE III. Table 2 illustrates the complementarity of the nucleotide sequences of LOC256021 BINDING SITE, designated SEQ ID:46166, to the nucleotide sequence of VGAM1308 RNA, herein designated VGAM RNA, also designated SEQ ID:4019.

Another function of VGAM1308 is therefore inhibition of LOC256021 (Accession XM_172884). Accordingly, utilities of VGAM1308 include diagnosis, prevention and treatment of diseases and clinical conditions associated with LOC256021. FIG. 1 further provides a conceptual description of a novel bioinformatically detected viral gene of the present invention, referred to here as Viral Genomic Address Messenger 1309 (VGAM1309) viral gene, which modulates expression of respective host target genes thereof, the function and utility of which host target genes is known in the art.

VGAM1309 is a novel bioinformatically detected regulatory, non protein coding, viral micro RNA (miRNA) gene. The method by which VGAM1309 was detected is described hereinabove with reference to FIGS. 1-8.

VGAM1309 gene, herein designated VGAM GENE, is a viral gene contained in the genome of Human Adenovirus D. VGAM1309 host target gene, herein designated VGAM HOST TARGET GENE, is a human gene contained in the human genome.

VGAM1309 gene encodes a VGAM1309 precursor RNA, herein designated VGAM PRECURSOR RNA. Similar to other miRNA genes, and unlike most ordinary genes, VGAM1309 precursor RNA does not encode a protein. A nucleotide sequence identical or highly similar to the nucleotide sequence of VGAM1309 precursor RNA is designated SEQ ID:1295, and is provided hereinbelow with reference to the sequence listing part. Nucleotide sequence SEQ ID:1295 is located at position 28090 relative to the genome of Human Adenovirus D.

VGAM1309 precursor RNA folds onto itself, forming VGAM1309 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1309 folded precursor RNA into VGAM1309 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1309 RNA is designated SEQ ID:4020, and is provided hereinbelow with reference to the sequence listing part.

VGAM1309 host target gene, herein designated VGAM HOST TARGET GENE, encodes a corresponding messenger RNA, VGAM1309 host target RNA, herein designated VGAM HOST TARGET RNA. VGAM1309 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1309 RNA, herein designated VGAM RNA, binds complementarily to one or more host target binding sites located in untranslated regions of VGAM1309 host target RNA, herein designated VGAM HOST TARGET RNA. This complementary binding is due to the fact that the nucleotide sequence of VGAM1309 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1309 RNA, herein designated VGAM RNA, may have a different number of host target binding sites in untranslated regions of a VGAM1309 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1309 RNA, herein designated VGAM RNA, to host target binding sites on VGAM1309 host target RNA, herein designated VGAM HOST TARGET RNA, such as BINDING SITE I, BINDING SITE II and BINDING SITE III, inhibits translation of VGAM1309 host target RNA into VGAM1309 host target protein, herein designated VGAM HOST TARGET PROTEIN. VGAM host target protein is therefore outlined by a broken line.

It is appreciated that VGAM1309 host target gene, herein designated VGAM HOST TARGET GENE, in fact represents a plurality of VGAM1309 host target genes. The mRNA of each one of this plurality of VGAM1309 host target genes comprises one or more host target binding sites, each having a nucleotide sequence which is at least partly complementary to VGAM1309 RNA, herein designated VGAM RNA, and which when bound by VGAM1309 RNA causes inhibition of translation of respective one or more VGAM1309 host target proteins.

It is further appreciated by one skilled in the art that the mode of translational inhibition illustrated by FIG. 1 with specific reference to translational inhibition exerted by VGAM1309 gene, herein designated VGAM GENE, on one or more VGAM1309 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1309 is inhibition of expression of host target genes, as part of a novel viral mechanism of attacking a host. Accordingly, utilities of VGAM1309 include diagnosis, prevention and treatment of viral infection by Human Adenovirus D. Specific functions, and accordingly utilities, of VGAM1309 correlate with, and may be deduced from, the identity of the host target genes which VGAM1309 binds and inhibits, and the function of these host target genes, as elaborated hereinbelow.

Nucleotide sequences of the VGAM1309 precursor RNA, herein designated VGAM PRECURSOR RNA, and of the 'diced' VGAM1309 RNA, herein designated VGAM RNA, and a schematic representation of the secondary folding of VGAM1309 folded precursor RNA, herein designated VGAM FOLDED PRECURSOR RNA, of VGAM1309 are further described hereinbelow with reference to Table 1.

Nucleotide sequences of host target binding sites, such as BINDING SITE-I, BINDING SITE-II and BINDING SITE-III of FIG. 1, found on VGAM1309 host target RNA, and schematic representation of the complementarity of each of these host target binding sites to VGAM1309 RNA, herein designated VGAM RNA, are described hereinbelow with reference to Table 2.

As mentioned hereinabove with reference to FIG. 1, a function of VGAM1309 gene, herein designated VGAM is inhibition of expression of VGAM1309 target genes. It is appreciated that specific functions, and accordingly utilities, of VGAM1309 correlate with, and may be deduced from, the identity of the target genes which VGAM1309 binds and inhibits, and the function of these target genes, as elaborated hereinbelow.

Cyclin-dependent Kinase Inhibitor 2D (p19, inhibits CDK4) (CDKN2D, Accession NM_001800) is a VGAM1309 host target gene. CDKN2D BINDING SITE1 and CDKN2D BINDING SITE2 are HOST TARGET binding sites found in untranslated regions of mRNA encoded by CDKN2D, corresponding to HOST TARGET binding sites such as BINDING SITE I, BINDING SITE II or BINDING SITE III. Table 2 illustrates the complementarity of the nucleotide sequences of CDKN2D BINDING SITE1 and CDKN2D BINDING SITE2, designated SEQ ID:7555 and SEQ ID:27817 respectively, to the nucleotide sequence of VGAM1309 RNA, herein designated VGAM RNA, also designated SEQ ID:4020.

A function of VGAM1309 is therefore inhibition of Cyclin-dependent Kinase Inhibitor 2D (p19, inhibits CDK4) (CDKN2D, Accession NM_001800), a gene which interacts strongly with cdk4 and cdk6. Accordingly, utilities of VGAM1309 include diagnosis, prevention and treatment of diseases and clinical conditions associated with CDKN2D. The function of CDKN2D and its association with various diseases and clinical conditions, has been established by previous studies, as described hereinabove with reference to VGAM247. Nuclear RNA Export Factor 2 (NXF2, Accession NM_017809) is another VGAM1309 host target gene. NXF2 BINDING SITE1 and NXF2 BINDING SITE2 are HOST TARGET binding sites found in untranslated regions of mRNA encoded by NXF2, corresponding to HOST TARGET binding sites such as BINDING SITE I, BINDING SITE II or BINDING SITE III. Table 2 illustrates the complementarity of the nucleotide sequences of NXF2 BINDING SITE1 and NXF2 BINDING SITE2, designated SEQ ID:19458 and SEQ ID:22590 respectively, to the nucleotide sequence of VGAM1309 RNA, herein designated VGAM RNA, also designated SEQ ID:4020.

Another function of VGAM1309 is therefore inhibition of Nuclear RNA Export Factor 2 (NXF2, Accession NM_017809), a gene which is involved in the export of mrna from the nucleus to the cytoplasm. Accordingly, utilities of VGAM1309 include diagnosis, prevention and treatment of diseases and clinical conditions associated with NXF2. The function of NXF2 and its association with various diseases and clinical conditions, has been established by previous studies, as described hereinabove with reference to VGAM595. ZFP93 (Accession NM_004234) is another VGAM1309 host target gene. ZFP93 BINDING SITE is HOST TARGET binding site found in the 3' untranslated region of mRNA encoded by ZFP93, corresponding to a HOST TARGET binding site such as BINDING SITE I, BINDING SITE II or BINDING SITE III. Table 2 illustrates the complementarity of the nucleotide sequences of ZFP93 BINDING SITE, designated SEQ ID:10428, to the nucleotide sequence of VGAM1309 RNA, herein designated VGAM RNA, also designated SEQ ID:4020.

Another function of VGAM1309 is therefore inhibition of ZFP93 (Accession NM_004234). Accordingly, utilities of VGAM1309 include diagnosis, prevention and treatment of diseases and clinical conditions associated with ZFP93. CDC14 Cell Division Cycle 14 Homolog B (S. cerevisiae) (CDC14B, Accession NM_033331) is another VGAM1309 host target gene. CDC14B BINDING SITE is HOST TARGET binding site found in the 3' untranslated region of mRNA encoded by CDC14B, corresponding to a HOST TARGET binding site such as BINDING SITE I, BINDING SITE II or BINDING SITE III. Table 2 illustrates the complementarity of the nucleotide sequences of CDC14B BINDING SITE, designated SEQ ID:27161, to the nucleotide sequence of VGAM1309 RNA, herein designated VGAM RNA, also designated SEQ ID:4020.

Another function of VGAM1309 is therefore inhibition of CDC14 Cell Division Cycle 14 Homolog B (S. cerevisiae) (CDC14B, Accession NM_033331). Accordingly, utilities of VGAM1309 include diagnosis, prevention and treatment of diseases and clinical conditions associated with CDC14B. FLJ12806 (Accession NM_022831) is another VGAM1309 host target gene. FLJ12806 BINDING SITE is HOST TARGET binding site found in the 3' untranslated region of mRNA encoded by FLJ12806, corresponding to a HOST TARGET binding site such as BINDING SITE I, BINDING SITE II or BINDING SITE III. Table 2 illustrates the complementarity of the nucleotide sequences of FLJ12806 BINDING SITE, designated SEQ ID:23108, to the nucleotide sequence of VGAM1309 RNA, herein designated VGAM RNA, also designated SEQ ID:4020.

Another function of VGAM1309 is therefore inhibition of FLJ12806 (Accession NM_022831). Accordingly, utilities of VGAM1309 include diagnosis, prevention and treatment of diseases and clinical conditions associated with FLJ12806. HSPC065 (Accession NM_014157) is another VGAM1309 host target gene. HSPC065 BINDING SITE is HOST TARGET binding site found in the 3' untranslated region of mRNA encoded by HSPC065, corresponding to a HOST TARGET binding site such as BINDING SITE I, BINDING SITE II or BINDING SITE III. Table 2 illustrates the complementarity of the nucleotide sequences of HSPC065 BINDING SITE, designated SEQ ID:15454, to the nucleotide sequence of VGAM1309 RNA, herein designated VGAM RNA, also designated SEQ ID:4020.

Another function of VGAM1309 is therefore inhibition of HSPC065 (Accession NM_014157). Accordingly, utilities of VGAM1309 include diagnosis, prevention and treatment of diseases and clinical conditions associated with HSPC065. 5-hydroxytryptamine (serotonin) Receptor 3A (HTR3A, Accession NM_000869) is another VGAM1309 host target gene. HTR3A BINDING SITE is HOST TARGET binding site found in the 5" untranslated region of mRNA encoded by HTR3A, corresponding to a HOST TARGET binding site such as BINDING SITE I, BINDING SITE II or BINDING SITE III. Table 2 illustrates the complementarity of the nucleotide sequences of HTR3A BINDING SITE, designated SEQ ID:6538, to the nucleotide sequence of VGAM1309 RNA, herein designated VGAM RNA, also designated SEQ ID:4020.

Another function of VGAM1309 is therefore inhibition of 5-hydroxytryptamine (serotonin) Receptor 3A (HTR3A, Accession NM_000869). Accordingly, utilities of VGAM1309 include diagnosis, prevention and treatment of diseases and clinical conditions associated with HTR3A. LANO (Accession NM_018214) is another VGAM1309 host target gene. LANO BINDING SITE is HOST TARGET binding site found in the 3' untranslated region of mRNA encoded by LANO, corresponding to a HOST TARGET binding site such as BINDING SITE I, BINDING SITE II or BINDING SITE III. Table 2 illustrates the complementarity of the nucleotide sequences of LANO BINDING SITE, designated SEQ ID:20129, to the nucleotide sequence of VGAM1309 RNA, herein designated VGAM RNA, also designated SEQ ID:4020.

Another function of VGAM1309 is therefore inhibition of LANO (Accession NM_018214). Accordingly, utilities of VGAM1309 include diagnosis, prevention and treatment of diseases and clinical conditions associated with LANO. PAS Domain Containing Serine/threonine Kinase (PASK, Accession NM_015148) is another VGAM1309 host target gene. PASK BINDING SITE is HOST TARGET binding site found in the 3' untranslated region of mRNA encoded by PASK, corresponding to a HOST TARGET binding site such as BINDING SITE I, BINDING SITE II or BINDING SITE III. Table 2 illustrates the complementarity of the nucleotide sequences of PASK BINDING SITE, designated SEQ ID:17503, to the nucleotide sequence of VGAM1309 RNA, herein designated VGAM RNA, also designated SEQ ID:4020.

Another function of VGAM1309 is therefore inhibition of PAS Domain Containing Serine/threonine Kinase (PASK, Accession NM_015148). Accordingly, utilities of VGAM1309 include diagnosis, prevention and treatment of diseases and clinical conditions associated with PASK. LOC145663 (Accession XM_096829) is another VGAM1309 host target gene. LOC145663 BINDING SITE is HOST TARGET binding site found in the 3' untranslated region of mRNA encoded by LOC145663, corresponding to a HOST TARGET binding site such as BINDING SITE I, BINDING SITE II or BINDING SITE III. Table 2 illustrates the complementarity of the nucleotide sequences of LOC145663 BINDING SITE, designated SEQ ID:40551, to the nucleotide sequence of VGAM1309 RNA, herein designated VGAM RNA, also designated SEQ ID:4020.

Another function of VGAM1309 is therefore inhibition of LOC145663 (Accession XM_096829). Accordingly, utilities of VGAM1309 include diagnosis, prevention and treatment of diseases and clinical conditions associated with LOC145663. LOC157507 (Accession XM_088312) is another VGAM1309 host target gene. LOC157507 BINDING SITE is HOST TARGET binding site found in the 5' untranslated region of mRNA encoded by LOC157507, corresponding to a HOST TARGET binding site such as BINDING SITE I, BINDING SITE II or BINDING SITE III. Table 2 illustrates the complementarity of the nucleotide sequences of LOC157507 BINDING SITE, designated SEQ ID:39606, to the nucleotide sequence of VGAM1309 RNA, herein designated VGAM RNA, also designated SEQ ID:4020.

Another function of VGAM1309 is therefore inhibition of LOC157507 (Accession XM_088312). Accordingly, utilities of VGAM1309 include diagnosis, prevention and treatment of diseases and clinical conditions associated with LOC157507. LOC221337 (Accession XM_166387) is another VGAM1309 host target gene. LOC221337 BINDING SITE is HOST TARGET binding site found in the 5' untranslated region of mRNA encoded by LOC221337, corresponding to a HOST TARGET binding site such as BINDING SITE I, BINDING SITE II or BINDING SITE III. Table 2 illustrates the complementarity of the nucleotide sequences of LOC221337 BINDING SITE, designated SEQ ID:44235, to the nucleotide sequence of VGAM1309 RNA, herein designated VGAM RNA, also designated SEQ ID:4020.

Another function of VGAM1309 is therefore inhibition of LOC221337 (Accession XM_166387). Accordingly, utilities of VGAM1309 include diagnosis, prevention and treatment of diseases and clinical conditions associated with LOC221337. LOC92340 (Accession XM_044426) is another VGAM1309 host target gene. LOC92340 BINDING SITE is HOST TARGET binding site found in the 3' untranslated region of mRNA encoded by LOC92340, corresponding to a HOST TARGET binding site such as BINDING SITE I, BINDING SITE II or BINDING SITE III. Table 2 illustrates the complementarity of the nucleotide sequences of LOC92340 BINDING SITE, designated SEQ ID:34200, to the nucleotide sequence of VGAM1309 RNA, herein designated VGAM RNA, also designated SEQ ID:4020.

Another function of VGAM1309 is therefore inhibition of LOC92340 (Accession XM_044426). Accordingly, utilities of VGAM1309 include diagnosis, prevention and treatment of diseases and clinical conditions associated with LOC92340. FIG. 1 further provides a conceptual description of a novel bioinformatically detected viral gene of the present invention, referred to here as Viral Genomic Address Messenger 1310 (VGAM1310) viral gene, which modulates expression of respective host target genes thereof, the function and utility of which host target genes is known in the art.

VGAM1310 is a novel bioinformatically detected regulatory, non protein coding, viral micro RNA (miRNA) gene. The method by which VGAM1310 was detected is described hereinabove with reference to FIGS. 1-8.

VGAM1310 gene, herein designated VGAM GENE, is a viral gene contained in the genome of Human Adenovirus D. VGAM1310 host target gene, herein designated VGAM HOST TARGET GENE, is a human gene contained in the human genome.

VGAM1310 gene encodes a VGAM1310 precursor RNA, herein designated VGAM PRECURSOR RNA. Similar to other miRNA genes, and unlike most ordinary genes, VGAM1310 precursor RNA does not encode a protein. A nucleotide sequence identical or highly similar to the nucleotide sequence of VGAM1310 precursor RNA is designated SEQ ID:1296, and is provided hereinbelow with reference to the sequence listing part. Nucleotide sequence SEQ ID:1296 is located at position 24460 relative to the genome of Human Adenovirus D.

VGAM1310 precursor RNA folds onto itself, forming VGAM1310 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1310 folded precursor RNA into VGAM1310 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM1310 RNA is designated SEQ ID:4021, and is provided hereinbelow with reference to the sequence listing part.

VGAM1310 host target gene, herein designated VGAM HOST TARGET GENE, encodes a corresponding messenger RNA, VGAM1310 host target RNA, herein designated VGAM HOST TARGET RNA. VGAM1310 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1310 RNA, herein designated VGAM RNA, binds complementarily to one or more host target binding sites located in untranslated regions of VGAM1310 host target RNA, herein designated VGAM HOST TARGET RNA. This complementary binding is due to the fact that the nucleotide sequence of VGAM1310 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1310 RNA, herein designated VGAM RNA, may have a different number of host target binding sites in untranslated regions of a VGAM1310 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1310 RNA, herein designated VGAM RNA, to host target binding sites on VGAM1310 host target RNA, herein designated VGAM HOST TARGET RNA, such as BINDING SITE I, BINDING SITE II and BINDING SITE III, inhibits translation of VGAM1310 host target RNA into VGAM1310 host target protein, herein designated VGAM HOST TARGET PROTEIN. VGAM host target protein is therefore outlined by a broken line.

It is appreciated that VGAM1310 host target gene, herein designated VGAM HOST TARGET GENE, in fact represents a plurality of VGAM1310 host target genes. The mRNA of each one of this plurality of VGAM1310 host target genes comprises one or more host target binding sites, each having a nucleotide sequence which is at least partly complementary to VGAM1310 RNA, herein designated VGAM RNA, and which when bound by VGAM1310 RNA causes inhibition of translation of respective one or more VGAM1310 host target proteins.

It is further appreciated by one skilled in the art that the mode of translational inhibition illustrated by FIG. 1 with specific reference to translational inhibition exerted by VGAM1310 gene, herein designated VGAM GENE, on one or more VGAM1310 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1310 is inhibition of expression of host target genes, as part of a novel viral mechanism of attacking a host. Accordingly, utilities of VGAM1310 include diagnosis, prevention and treatment of viral infection by Human Adenovirus D. Specific functions, and accordingly utilities, of VGAM1310 correlate with, and may be deduced from, the identity of the host target genes which VGAM1310 binds and inhibits, and the function of these host target genes, as elaborated hereinbelow.

Nucleotide sequences of the VGAM1310 precursor RNA, herein designated VGAM PRECURSOR RNA, and of the 'diced' VGAM1310 RNA, herein designated VGAM RNA, and a schematic representation of the secondary folding of VGAM1310 folded precursor RNA, herein designated VGAM FOLDED PRECURSOR RNA, of VGAM1310 are further described hereinbelow with reference to Table 1.

Nucleotide sequences of host target binding sites, such as BINDING SITE-I, BINDING SITE-II and BINDING SITE-III of FIG. 1, found on VGAM1310 host target RNA, and schematic representation of the complementarity of each of these host target binding sites to VGAM1310 RNA, herein designated VGAM RNA, are described hereinbelow with reference to Table 2.

As mentioned hereinabove with reference to FIG. 1, a function of VGAM1310 gene, herein designated VGAM is inhibition of expression of VGAM1310 target genes. It is appreciated that specific functions, and accordingly utilities, of VGAM1310 correlate with, and may be deduced from, the identity of the target genes which VGAM1310 binds and inhibits, and the function of these target genes, as elaborated hereinbelow.

B-cell CLL/lymphoma 7B (BCL7B, Accession NM_001707) is a VGAM1310 host target gene. BCL7B BINDING SITE is HOST TARGET binding site found in the 3' untranslated region of mRNA encoded by BCL7B, corresponding to a HOST TARGET binding site such as BINDING SITE I, BINDING SITE II or BINDING SITE III. Table 2 illustrates the complementarity of the nucleotide sequences of BCL7B BINDING SITE, designated SEQ ID:7437, to the nucleotide sequence of VGAM1310 RNA, herein designated VGAM RNA, also designated SEQ ID:4021.

A function of VGAM1310 is therefore inhibition of B-cell CLL/lymphoma 7B (BCL7B, Accession NM_001707), a gene which is of yet unknown fanction. Accordingly, utilities of VGAM1310 include diagnosis, prevention and treatment of diseases and clinical conditions associated with BCL7B.

The function of BCL7B and its association with various diseases and clinical conditions, has been established by previous studies, as described hereinabove with reference to VGAM1189. Coagulation Factor VII (serum prothrombin conversion accelerator) (F7, Accession NM_019616) is another VGAM1310 host target gene. F7 BINDING SITE1 and F7 BINDING SITE2 are HOST TARGET binding sites found in untranslated regions of mRNA encoded by F7, corresponding to HOST TARGET binding sites such as BINDING SITE I, BINDING SITE II or BINDING SITE III. Table 2 illustrates the complementarity of the nucleotide sequences of F7 BINDING SITE1 and F7 BINDING SITE2, designated SEQ ID:21239 and SEQ ID:5610 respectively, to the nucleotide sequence of VGAM1310 RNA, herein designated VGAM RNA, also designated SEQ ID:4021.

Another function of VGAM1310 is therefore inhibition of Coagulation Factor VII (serum prothrombin conversion accelerator) (F7, Accession NM_019616). Accordingly, utilities of VGAM1310 include diagnosis, prevention and treatment of diseases and clinical conditions associated with F7. RAD51-like 3 (S. cerevisiae) (RAD51L3, Accession NM_133630) is another VGAM1310 host target gene. RAD51L3 BINDING SITE1 and RAD51L3 BINDING SITE2 are HOST TARGET binding sites found in untranslated regions of mRNA encoded by RAD51L3, corresponding to HOST TARGET binding sites such as BINDING SITE I, BINDING SITE II or BINDING SITE III. Table 2 illustrates the complementarity of the nucleotide sequences of RAD51L3 BINDING SITE1 and RAD51L3 BINDING SITE2, designated SEQ ID:28581 and SEQ ID:25181 respectively, to the nucleotide sequence of VGAM1310 RNA, herein designated VGAM RNA, also designated SEQ ID:4021.

Another function of VGAM1310 is therefore inhibition of RAD51-like 3 (S. cerevisiae) (RAD51L3, Accession NM_133630), a gene which may have a role in dna repair and recombination. Accordingly, utilities of VGAM1310 include diagnosis, prevention and treatment of diseases and clinical conditions associated with RAD51L3. The function of RAD51L3 has been established by previous studies. The S. cerevisiae gene RAD51, which encodes a protein related to the ATP-binding E. coli RecA protein, is critical for DNA repair and meiotic recombination. Homologs of this gene have been identified in several species, including mouse and human. Pittman et al. (1998) reported the identification of a novel member of the RAD51 gene family in both mouse and human. The mouse cDNA, Rad51d, isolated by screening EST databases with yeast RAD55 and human RAD51B amino acid sequences, encodes a predicted 329-amino acid protein with a molecular mass of 35,260 Da. Northern blot analysis revealed the presence of multiple transcripts of the Rad51d gene in all tissues examined. Southern analysis of genomic DNA from 7 mammalian species demonstrated that the RAD51D gene is conserved. Pittman et al. (1998) used the mouse nucleotide sequence to screen a human EST database and identified 2 RAD51D cDNA clones from human T-lymphocyte and placenta libraries; both cDNAs appeared to be variants of the mouse gene. The shorter cDNA represented an alternatively spliced product and excluded sequences corresponding to 2 exons in the mouse gene, one of which encodes the first ATP-binding motif. The longer cDNA skipped a single exon present in the mouse gene, resulting in a frameshift and a predicted truncated protein. The authors stated that if the frameshift is ignored, the full-length putative 289-amino acid protein shares 71% sequence identity with the predicted mouse protein, and the mouse and human RAD51D genes have 2 conserved ATP-binding domains similar to other RecA-related genes. Cartwright et al. (1998) also isolated human and mouse RAD51L3, or R51H3, cDNAs. They found that the sequence of the predicted 328-amino acid human protein is 82% identical to that of mouse RAD51L3. Northern blot analysis revealed that human RAD51L3 is expressed as a 1.7-kb mRNA in all tissues, with the highest levels in testis.

Full details of the abovementioned studies are described in the following publications, the disclosure of which are hereby incorporated by reference:

Pittman, D. L.; Weinberg, L. R.; Schimenti, J. C.: Identification, characterization, and genetic mapping of Rad51d, a new mouse and human RAD51/RecA-related gene. Genomics 49:103-111, 1998; and Cartwright, R.; Dunn, A. M.; Simpson, P. J.; Tambini, C. E.; Thacker, J.: Isolation of novel human and mouse genes of the recA/RAD51 recombination-repair gene family. Nucleic Acids Res.

Further studies establishing the function and utilities of RAD51L3 are found in John Hopkins OMIM database record ID 602954, and in sited publications numbered 1597, 8639-160 and 8640 listed in the bibliography section hereinbelow, which are also hereby incorporated by reference. DKFZp434G171 (Accession XM_086583) is another VGAM1310 host target gene. DKFZp434G171 BINDING SITE is HOST TARGET binding site found in the 3' untranslated region of mRNA encoded by DKFZp434G171, corresponding to a HOST TARGET binding site such as BINDING SITE I, BINDING SITE II or BINDING SITE III. Table 2 illustrates the complementarity of the nucleotide sequences of DKFZp434G171 BINDING SITE, designated SEQ ID:38777, to the nucleotide sequence of VGAM1310 RNA, herein designated VGAM RNA, also designated SEQ ID:4021.

Another function of VGAM1310 is therefore inhibition of DKFZp434G171 (Accession XM_086583). Accordingly, utilities of VGAM1310 include diagnosis, prevention and treatment of diseases and clinical conditions associated with DKFZp434G171. FBP17 (Accession XM_052666) is another VGAM1310 host target gene. FBP17 BINDING SITE is HOST TARGET binding site found in the 3' untranslated region of mRNA encoded by FBP17, corresponding to a HOST TARGET binding site such as BINDING SITE I, BINDING SITE II or BINDING SITE III. Table 2 illustrates the complementarity of the nucleotide sequences of FBP17 BINDING SITE, designated SEQ ID:36050, to the nucleotide sequence of VGAM1310 RNA, herein designated VGAM RNA, also designated SEQ ID:4021.

Another function of VGAM1310 is therefore inhibition of FBP17 (Accession XM_052666). Accordingly, utilities of VGAM1310 include diagnosis, prevention and treatment of diseases and clinical conditions associated with FBP17. FLJ00001 (Accession XM_088525) is another VGAM1310 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39785, to the nucleotide sequence of VGAM1310 RNA, herein designated VGAM RNA, also designated SEQ ID:4021.

Another function of VGAM1310 is therefore inhibition of FLJ00001 (Accession XM_088525). Accordingly, utilities of VGAM1310 include diagnosis, prevention and treatment of diseases and clinical conditions associated with FLJ00001. FLJ12056 (Accession NM_024933) is another VGAM1310 host target gene. FLJ12056 BINDING SITE is HOST TAR- GET binding site found in the 3' untranslated region of mRNA encoded by FLJ12056, corresponding to a HOST TARGET binding site such as BINDING SITE I, BINDING SITE II or BINDING SITE III. Table 2 illustrates the complementarity of the nucleotide sequences of FLJ12056 BINDING SITE, designated SEQ ID:24470, to the nucleotide sequence of VGAM1310 RNA, herein designated VGAM RNA, also designated SEQ ID:4021.

Another function of VGAM1310 is therefore inhibition of FLJ12056 (Accession NM_024933). Accordingly, utilities of VGAM1310 include diagnosis, prevention and treatment of diseases and clinical conditions associated with FLJ12056. G Protein-coupled Receptor Kinase-interactor 1 (GIT1, Accession NM_014030) is another VGAM1310 host target gene. GIT1 BINDING SITE is HOST TARGET binding site found in the 3' untranslated region of mRNA encoded by GIT1, corresponding to a HOST TARGET binding site such as BINDING SITE I, BINDING SITE II or BINDING SITE III. Table 2 illustrates the complementarity of the nucleotide sequences of GIT1 BINDING SITE, designated SEQ ID:15257, to the nucleotide sequence of VGAM1310 RNA, herein designated VGAM RNA, also designated SEQ ID:4021.

Another function of VGAM1310 is therefore inhibition of G Protein-coupled Receptor Kinase-interactor 1 (GIT1, Accession NM_014030). Accordingly, utilities of VGAM1310 include diagnosis, prevention and treatment of diseases and clinical conditions associated with GIT1. Mitogen-activated Protein Kinase 11 (MAPK11, Accession NM_002751) is another VGAM1310 host target gene. MAPK11 BINDING SITE is HOST TARGET binding site found in the 3' untranslated region of mRNA encoded by MAPK11, corresponding to a HOST TARGET binding site such as BINDING SITE I, BINDING SITE II or BINDING SITE III. Table 2 illustrates the complementarity of the nucleotide sequences of MAPK11 BINDING SITE, designated SEQ ID:8628, to the nucleotide sequence of VGAM1310 RNA, herein designated VGAM RNA, also designated SEQ ID:4021.

Another function of VGAM1310 is therefore inhibition of Mitogen-activated Protein Kinase 11 (MAPK11, Accession NM_002751). Accordingly, utilities of VGAM1310 include diagnosis, prevention and treatment of diseases and clinical conditions associated with MAPK11. Tumor Necrosis Factor Receptor Superfamily, Member 19-like (TNFRSF19L, Accession NM_032871) is another VGAM1310 host target gene. TNFRSF19L BINDING SITE is HOST TARGET binding site found in the 5' untranslated region of mRNA encoded by TNFRSF19L, corresponding to a HOST TARGET binding site such as BINDING SITE I, BINDING SITE II or BINDING SITE III. Table 2 illustrates the complementarity of the nucleotide sequences of TNFRSF19L BINDING SITE, designated SEQ ID:26687, to the nucleotide sequence of VGAM1310 RNA, herein designated VGAM RNA, also designated SEQ ID:4021.

Another function of VGAM1310 is therefore inhibition of Tumor Necrosis Factor Receptor Superfamily, Member 19-like (TNFRSF19L, Accession NM_032871). Accordingly, utilities of VGAM1310 include diagnosis, prevention and treatment of diseases and clinical conditions associated with TNFRSF19L. LOC146475 (Accession XM_097006) is another VGAM1310 host target gene. LOC146475 BINDING SITE is HOST TARGET binding site found in the 5' untranslated region of mRNA encoded by LOC146475, corresponding to a HOST TARGET binding site such as BINDING SITE I, BINDING SITE II or BINDING SITE III. Table 2 illustrates the complementarity of the nucleotide sequences of LOC146475 BINDING SITE, designated SEQ ID:40701, to the nucleotide sequence of VGAM1310 RNA, herein designated VGAM RNA, also designated SEQ ID:4021.

Another function of VGAM1310 is therefore inhibition of LOC146475 (Accession XM_097006). Accordingly, utilities of VGAM1310 include diagnosis, prevention and treatment of diseases and clinical conditions associated with LOC146475. LOC148753 (Accession XM_097515) is another VGAM1310 host target gene. LOC148753 BINDING SITE is HOST TARGET binding site found in the 5' untranslated region of mRNA encoded by LOC148753, corresponding to a HOST TARGET binding site such as BINDING SITE I, BINDING SITE II or BINDING SITE III. Table 2 illustrates the complementarity of the nucleotide sequences of LOC148753 BINDING SITE, designated SEQ ID:40899, to the nucleotide sequence of VGAM1310 RNA, herein designated VGAM RNA, also designated SEQ ID:4021.

Another function of VGAM1310 is therefore inhibition of LOC148753 (Accession XM_097515). Accordingly, utilities of VGAM1310 include diagnosis, prevention and treatment of diseases and clinical conditions associated with LOC148753. LOC220002 (Accession XM_166224) is another VGAM1310 host target gene. LOC220002 BINDING SITE is HOST TARGET binding site found in the 3' untranslated region of mRNA encoded by LOC220002, corresponding to a HOST TARGET binding site such as BINDING SITE I, BINDING SITE II or BINDING SITE III. Table 2 illustrates the complementarity of the nucleotide sequences of LOC220002 BINDING SITE, designated SEQ ID:44050, to the nucleotide sequence of VGAM1310 RNA, herein designated VGAM RNA, also designated SEQ ID:4021.

Another function of VGAM1310 is therefore inhibition of LOC220002 (Accession XM_166224). Accordingly, utilities of VGAM1310 include diagnosis, prevention and treatment of diseases and clinical conditions associated with LOC220002. LOC255265 (Accession XM_170902) is another VGAM1310 host target gene. LOC255265 BINDING SITE is HOST TARGET binding site found in the 5' untranslated region of mRNA encoded by LOC255265, corresponding to a HOST TARGET binding site such as BINDING SITE I, BINDING SITE II or BINDING SITE III. Table 2 illustrates the complementarity of the nucleotide sequences of LOC255265 BINDING SITE, designated SEQ ID:45659, to the nucleotide sequence of VGAM1310 RNA, herein designated VGAM RNA, also designated SEQ ID:4021.

Another function of VGAM1310 is therefore inhibition of LOC255265 (Accession XM_170902). Accordingly, utilities of VGAM1310 include diagnosis, prevention and treatment of diseases and clinical conditions associated with LOC255265. FIG. 1 further provides a conceptual description of a novel bioinformatically detected viral gene of the present invention, referred to here as Viral Genomic Address Messenger 1311 (VGAM1311) viral gene, which modulates expression of respective host target genes thereof, the function and utility of which host target genes is known in the art.

VGAM1311 is a novel bioinformatically detected regulatory, non protein coding, viral micro RNA (miRNA) gene. The method by which VGAM1311 was detected is described hereinabove with reference to FIGS. 1-8.

VGAM1311 gene, herein designated VGAM GENE, is a viral gene contained in the genome of Foot-and-mouth Disease Virus C. VGAM1311 host target gene, herein designated VGAM HOST TARGET GENE, is a human gene contained in the human genome.

VGAM1311 gene encodes a VGAM1311 precursor RNA, herein designated VGAM PRECURSOR RNA. Similar to other miRNA genes, and unlike most ordinary genes, VGAM1311 precursor RNA does not encode a protein. A nucleotide sequence identical or highly similar to the nucleotide sequence of VGAM1311 precursor RNA is designated SEQ ID:1297, and is provided hereinbelow with reference to the sequence listing part. Nucleotide sequence SEQ ID:1297 is located at position 3024 relative to the genome of Foot-and-mouth Disease Virus C.

VGAM1311 precursor RNA folds onto itself, forming VGAM1311 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1311 folded precursor RNA into VGAM1311 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1311 RNA is designated SEQ ID:4022, and is provided hereinbelow with reference to the sequence listing part.

VGAM1311 host target gene, herein designated VGAM HOST TARGET GENE, encodes a corresponding messenger RNA, VGAM1311 host target RNA, herein designated VGAM HOST TARGET RNA. VGAM1311 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1311 RNA, herein designated VGAM RNA, binds complementarily to one or more host target binding sites located in untranslated regions of VGAM1311 host target RNA, herein designated VGAM HOST TARGET RNA. This complementary binding is due to the fact that the nucleotide sequence of VGAM1311 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1311 RNA, herein designated VGAM RNA, may have a different number of host target binding sites in untranslated regions of a VGAM1311 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1311 RNA, herein designated VGAM RNA, to host target binding sites on VGAM1311 host target RNA, herein designated VGAM HOST TARGET RNA, such as BINDING SITE I, BINDING SITE II and BINDING SITE III, inhibits translation of VGAM1311 host target RNA into VGAM1311 host target protein, herein designated VGAM HOST TARGET PROTEIN. VGAM host target protein is therefore outlined by a broken line.

It is appreciated that VGAM1311 host target gene, herein designated VGAM HOST TARGET GENE, in fact represents a plurality of VGAM1311 host target genes. The mRNA of each one of this plurality of VGAM1311 host target genes comprises one or more host target binding sites, each having a nucleotide sequence which is at least partly complementary to VGAM1311 RNA, herein designated VGAM RNA, and which when bound by VGAM1311 RNA causes inhibition of translation of respective one or more VGAM1311 host target proteins.

It is further appreciated by one skilled in the art that the mode of translational inhibition illustrated by FIG. 1 with specific reference to translational inhibition exerted by VGAM1311 gene, herein designated VGAM GENE, on one or more VGAM1311 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1311 is inhibition of expression of host target genes, as part of a novel viral mechanism of attacking a host. Accordingly, utilities of VGAM1311 include diagnosis, prevention and treatment of viral infection by Foot-and-mouth Disease Virus C. Specific functions, and accordingly utilities, of VGAM1311 correlate with, and may be deduced from, the identity of the host target genes which VGAM1311 binds and inhibits, and the function of these host target genes, as elaborated hereinbelow.

Nucleotide sequences of the VGAM1311 precursor RNA, herein designated VGAM PRECURSOR RNA, and of the 'diced' VGAM1311 RNA, herein designated VGAM RNA, and a schematic representation of the secondary folding of VGAM1311 folded precursor RNA, herein designated VGAM FOLDED PRECURSOR RNA, of VGAM1311 are further described hereinbelow with reference to Table 1.

Nucleotide sequences of host target binding sites, such as BINDING SITE-I, BINDING SITE-II and BINDING SITE-III of FIG. 1, found on VGAM1311 host target RNA, and schematic representation of the complementarity of each of these host target binding sites to VGAM1311 RNA, herein designated VGAM RNA, are described hereinbelow with reference to Table 2.

As mentioned hereinabove with reference to FIG. 1, a function of VGAM1311 gene, herein designated VGAM is inhibition of expression of VGAM1311 target genes. It is appreciated that specific functions, and accordingly utilities, of VGAM1311 correlate with, and may be deduced from, the identity of the target genes which VGAM1311 binds and inhibits, and the function of these target genes, as elaborated hereinbelow.

Copine VII (CPNE7, Accession NM_014427) is a VGAM1311 host target gene. CPNE7 BINDING SITE is HOST TARGET binding site found in the 3' untranslated region of mRNA encoded by CPNE7, corresponding to a HOST TARGET binding site such as BINDING SITE I, BINDING SITE II or BINDING SITE III. Table 2 illustrates the complementarity of the nucleotide sequences of CPNE7 BINDING SITE, designated SEQ ID:15786, to the nucleotide sequence of VGAM1311 RNA, herein designated VGAM RNA, also designated SEQ ID:4022.

A function of VGAM1311 is therefore inhibition of Copine VII (CPNE7, Accession NM_014427). Accordingly, utilities of VGAM1311 include diagnosis, prevention and treatment of diseases and clinical conditions associated with CPNE7. Inositol Hexaphosphate Kinase 3 (IHPK3, Accession NM_054111) is another VGAM1311 host target gene. IHPK3 BINDING SITE is HOST TARGET binding site found in the 3' untranslated region of mRNA encoded by IHPK3, corresponding to a HOST TARGET binding site such as BINDING SITE I, BINDING SITE II or BINDING SITE III. Table 2 illustrates the complementarity of the nucleotide sequences of IHPK3 BINDING SITE, designated SEQ ID:27655, to the nucleotide sequence of VGAM1311 RNA, herein designated VGAM RNA, also designated SEQ ID:4022.

Another function of VGAM1311 is therefore inhibition of Inositol Hexaphosphate Kinase 3 (IHPK3, Accession NM_054111). Accordingly, utilities of VGAM1311 include diagnosis, prevention and treatment of diseases and clinical conditions associated with IHPK3. Kruppel-like Factor 8 (KLF8, Accession NM_007250) is another VGAM1311 host target gene. KLF8 BINDING SITE is HOST TARGET binding site found in the 3' untranslated region of mRNA encoded by KLF8, corresponding to a HOST TARGET binding site such as BINDING SITE I, BINDING SITE II or BINDING SITE III. Table 2 illustrates the complementarity of the nucleotide sequences of KLF8 BINDING SITE, designated SEQ ID:14121, to the nucleotide sequence of VGAM1311 RNA, herein designated VGAM RNA, also designated SEQ ID:4022.

Another function of VGAM1311 is therefore inhibition of Kruppel-like Factor 8 (KLF8, Accession NM_007250). Accordingly, utilities of VGAM1311 include diagnosis, prevention and treatment of diseases and clinical conditions associated with KLF8. Matrix Metalloproteinase 19 (MMP19, Accession NM_022790) is another VGAM1311 host target gene. MMP19 BINDING SITE is HOST TARGET binding site found in the 5' untranslated region of mRNA encoded by MMP19, corresponding to a HOST TARGET binding site such as BINDING SITE I, BINDING SITE II or BINDING SITE III. Table 2 illustrates the complementarity of the nucleotide sequences of MMP19 BINDING SITE, designated SEQ ID:23073, to the nucleotide sequence of VGAM1311 RNA, herein designated VGAM RNA, also designated SEQ ID:4022.

Another function of VGAM1311 is therefore inhibition of Matrix Metalloproteinase 19 (MMP19, Accession NM_022790). Accordingly, utilities of VGAM1311 include diagnosis, prevention and treatment of diseases and clinical conditions associated with MMP19. Transcription Factor 20 (AR1) (TCF20, Accession XM_040067) is another VGAM1311 host target gene. TCF20 BINDING SITE is HOST TARGET binding site found in the 3' untranslated region of mRNA encoded by TCF20, corresponding to a HOST TARGET binding site such as BINDING SITE I, BINDING SITE II or BINDING SITE III. Table 2 illustrates the complementarity of the nucleotide sequences of TCF20 BINDING SITE, designated SEQ ID:33247, to the nucleotide sequence of VGAM1311 RNA, herein designated VGAM RNA, also designated SEQ ID:4022.

Another function of VGAM1311 is therefore inhibition of Transcription Factor 20 (AR1) (TCF20, Accession XM_040067), a gene which is strongly similar to murine Tcf20 and may act as a transcription activator. Accordingly, utilities of VGAM1311 include diagnosis, prevention and treatment of diseases and clinical conditions associated with TCF20. The function of TCF20 has been established by previous studies. Stromelysins, which are the metalloproteinases with the widest substrate specificities, play a critical role in tumor invasion and metastasis. See 185261. Stromelysin expression is induced by mitogens, oncogenes, and inflammatory cytokines. A 19-nucleotide promoter element called the SPRE (stromelysin-1 PDGF-responsive element), controls stromelysin-1 (OMIM Ref. No. 185250) expression in response to mitogen stimulation. Sanz et al. (1995) screened a mouse fibroblast expression library to identify factors that bind to the SPRE. They isolated a cDNA encoding a predicted 937-amino acid protein designated SPBP for 'SPRE-binding protein.' SPBP contains several features characteristic of transcription factors, including a putative leucine zipper region, a nuclear localization signal, and a basic domain similar to the DNA-binding domain found in the Fos (OMIM Ref. No. 164810)-Jun (OMIM Ref. No. 165160) family of transcription factors. However, while in Fos and Jun the ZIP and DNA-binding domains lie very close together, in SPBP they are widely separated. Sanz et al. (1995) found that expression of SPBP in mammalian cells activated transcription of a reporter gene construct containing either the full-length stromelysin promoter or a single copy of the SPRE inserted upstream of a heterologous promoter. Rajadhyaksha et al. (1998) identified cDNAs encoding AR1, a human SPBP homolog. By analysis of somatic cell hybrids and by fluorescence in situ hybridization, Rajadhyaksha et al. (1998) localized the AR1 gene to 22q13.3.

Full details of the abovementioned studies are described in the following publications, the disclosure of which are hereby incorporated by reference:

Rajadhyaksha, A. Riviere, M.; Van Vooren, P.; Szpirer, J.; Szpirer, C.; Babin, J.; Bina, M.: Assignment of AR1, transcription factor 20 (TCF20), to human chromosome 22q13.3 with somatic cell hybrids and in situ hybridization. Cytogenet. Cell Genet. 81:176-177, 1998; and Sanz, L.; Moscat, J.; Diaz-Meco, M. T.: Molecular characterization of a novel transcription factor that controls stromelysin expression. Molec. Cell. Biol. 15:3164-3170, 1995.

Further studies establishing the function and utilities of TCF20 are found in John Hopkins OMIM database record ID 603107, and in sited publications numbered 8494-8495 listed in the bibliography section hereinbelow, which are also hereby incorporated by reference. STAF42 (Accession NM_053053) is another VGAM1311 host target gene. STAF42 BINDING SITE is HOST TARGET binding site found in the 3' untranslated region of mRNA encoded by STAF42, corresponding to a HOST TARGET binding site such as BINDING SITE I, BINDING SITE II or BINDING SITE III. Table 2 illustrates the complementarity of the nucleotide sequences of STAF42 BINDING SITE, designated SEQ ID:27596, to the nucleotide sequence of VGAM1311 RNA, herein designated VGAM RNA, also designated SEQ ID:4022.

Another function of VGAM1311 is therefore inhibition of STAF42 (Accession NM_053053). Accordingly, utilities of VGAM1311 include diagnosis, prevention and treatment of diseases and clinical conditions associated with STAF42. LOC146520 (Accession XM_085492) is another VGAM1311 host target gene. LOC146520 BINDING SITE is HOST TARGET binding site found in the 5' untranslated region of mRNA encoded by LOC146520, corresponding to a HOST TARGET binding site such as BINDING SITE I, BINDING SITE II or BINDING SITE III. Table 2 illustrates the complementarity of the nucleotide sequences of LOC146520 BINDING SITE, designated SEQ ID:38185, to the nucleotide sequence of VGAM1311 RNA, herein designated VGAM RNA, also designated SEQ ID:4022.

Another function of VGAM1311 is therefore inhibition of LOC146520 (Accession XM_085492). Accordingly, utilities of VGAM1311 include diagnosis, prevention and treatment of diseases and clinical conditions associated with LOC146520. LOC253502 (Accession XM_170561) is another VGAM1311 host target gene. LOC253502 BINDING SITE is HOST TARGET binding site found in the 3' untranslated region of mRNA encoded by LOC253502, corresponding to a HOST TARGET binding site such as BINDING SITE I, BINDING SITE II or BINDING SITE III. Table 2 illustrates the complementarity of the nucleotide sequences of LOC253502 BINDING SITE, designated SEQ ID:45379, to the nucleotide sequence of VGAM1311 RNA, herein designated VGAM RNA, also designated SEQ ID:4022.

Another function of VGAM1311 is therefore inhibition of LOC253502 (Accession XM_170561). Accordingly, utilities of VGAM1311 include diagnosis, prevention and treatment of diseases and clinical conditions associated with LOC253502. LOC90750 (Accession XM_033868) is another VGAM1311 host target gene. LOC90750 BINDING SITE is HOST TARGET binding site found in the 3' untranslated region of mRNA encoded by LOC90750, corresponding to a HOST TARGET binding site such as BINDING SITE I, BINDING SITE II or BINDING SITE III. Table 2 illustrates the complementarity of the nucleotide sequences of LOC90750 BINDING SITE, designated SEQ ID:31973, to the nucleotide sequence of VGAM1311 RNA, herein designated VGAM RNA, also designated SEQ ID:4022.

Another function of VGAM1311 is therefore inhibition of LOC90750 (Accession XM_033868). Accordingly, utilities of VGAM1311 include diagnosis, prevention and treatment of diseases and clinical conditions associated with LOC90750. FIG. 1 further provides a conceptual description of a novel bioinformatically detected viral gene of the present invention, referred to here as Viral Genomic Address Messenger 1312 (VGAM1312) viral gene, which modulates expression of respective host target genes thereof, the function and utility of which host target genes is known in the art.

VGAM1312 is a novel bioinformatically detected regulatory, non protein coding, viral micro RNA (miRNA) gene. The method by which VGAM1312 was detected is described hereinabove with reference to FIGS. 1-8.

VGAM1312 gene, herein designated VGAM GENE, is a viral gene contained in the genome of Foot-and-mouth Disease Virus C. VGAM1312 host target gene, herein designated VGAM HOST TARGET GENE, is a human gene contained in the human genome.

VGAM1312 gene encodes a VGAM1312 precursor RNA, herein designated VGAM PRECURSOR RNA. Similar to other miRNA genes, and unlike most ordinary genes, VGAM1312 precursor RNA does not encode a protein. A nucleotide sequence identical or highly similar to the nucleotide sequence of VGAM1312 precursor RNA is designated SEQ ID:1298, and is provided hereinbelow with reference to the sequence listing part. Nucleotide sequence SEQ ID:1298 is located at position 1074 relative to the genome of Foot-and-mouth Disease Virus C.

VGAM1312 precursor RNA folds onto itself, forming VGAM1312 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1312 folded precursor RNA into VGAM1312 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1312 RNA is designated SEQ ID:4023, and is provided hereinbelow with reference to the sequence listing part.

VGAM1312 host target gene, herein designated VGAM HOST TARGET GENE, encodes a corresponding messenger RNA, VGAM1312 host target RNA, herein designated VGAM HOST TARGET RNA. VGAM1312 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1312 RNA, herein designated VGAM RNA, binds complementarily to one or more host target binding sites located in untranslated regions of VGAM1312 host target RNA, herein designated VGAM HOST TARGET RNA. This complementary binding is due to the fact that the nucleotide sequence of VGAM1312 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1312 RNA, herein designated VGAM RNA, may have a different number of host target binding sites in untranslated regions of a VGAM1312 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1312 RNA, herein designated VGAM RNA, to host target binding sites on VGAM1312 host target RNA, herein designated VGAM HOST TARGET RNA, such as BINDING SITE I, BINDING SITE II and BINDING SITE III, inhibits translation of VGAM1312 host target RNA into VGAM1312 host target protein, herein designated VGAM HOST TARGET PROTEIN. VGAM host target protein is therefore outlined by a broken line.

It is appreciated that VGAM1312 host target gene, herein designated VGAM HOST TARGET GENE, in fact represents a plurality of VGAM1312 host target genes. The mRNA of each one of this plurality of VGAM1312 host target genes comprises one or more host target binding sites, each having a nucleotide sequence which is at least partly complementary to VGAM1312 RNA, herein designated VGAM RNA, and which when bound by VGAM1312 RNA causes inhibition of translation of respective one or more VGAM1312 host target proteins.

It is further appreciated by one skilled in the art that the mode of translational inhibition illustrated by FIG. 1 with specific reference to translational inhibition exerted by VGAM1312 gene, herein designated VGAM GENE, on one or more VGAM1312 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1312 is inhibition of expression of host target genes, as part of a novel viral mechanism of attacking a host. Accordingly, utilities of VGAM1312 include diagnosis, prevention and treatment of viral infection by Foot-and-mouth Disease Virus C. Specific functions, and accordingly utilities, of VGAM1312 correlate with, and may be deduced from, the identity of the host target genes which VGAM1312 binds and inhibits, and the function of these host target genes, as elaborated hereinbelow.

Nucleotide sequences of the VGAM1312 precursor RNA, herein designated VGAM PRECURSOR RNA, and of the 'diced' VGAM1312 RNA, herein designated VGAM RNA, and a schematic representation of the secondary folding of VGAM1312 folded precursor RNA, herein designated VGAM FOLDED PRECURSOR RNA, of VGAM1312 are further described hereinbelow with reference to Table 1.

Nucleotide sequences of host target binding sites, such as BINDING SITE-I, BINDING SITE-II and BINDING SITE-III of FIG. 1, found on VGAM1312 host target RNA, and schematic representation of the complementarity of each of these host target binding sites to VGAM1312 RNA, herein designated VGAM RNA, are described hereinbelow with reference to Table 2.

As mentioned hereinabove with reference to FIG. 1, a function of VGAM1312 gene, herein designated VGAM is inhibition of expression of VGAM1312 target genes. It is appreciated that specific functions, and accordingly utilities, of VGAM1312 correlate with, and may be deduced from, the identity of the target genes which VGAM1312 binds and inhibits, and the function of these target genes, as elaborated hereinbelow.

Protein Kinase (cAMP-dependent, catalytic) Inhibitor Alpha (PKIA, Accession NM_006823) is a VGAM1312 host target gene. PKIA BINDING SITE is HOST TARGET binding site found in the 5' untranslated region of mRNA encoded by PKIA, corresponding to a HOST TARGET binding site such as BINDING SITE I, BINDING SITE II or BINDING SITE III. Table 2 illustrates the complementarity of the nucleotide sequences of PKIA BINDING SITE, designated SEQ ID:13700, to the nucleotide sequence of VGAM1312 RNA, herein designated VGAM RNA, also designated SEQ ID:4023.

A function of VGAM1312 is therefore inhibition of Protein Kinase (cAMP-dependent, catalytic) Inhibitor Alpha (PKIA, Accession NM_006823). Accordingly, utilities of VGAM1312 include diagnosis, prevention and treatment of diseases and clinical conditions associated with PKIA. Solute Carrier Family 1 (neuronal/epithelial high affinity glutamate transporter, system Xag), Member 1 (SLC1A1, Accession NM_004170) is another VGAM1312 host target gene. SLC1A1 BINDING SITE is HOST TARGET binding site found in the 3' untranslated region of mRNA encoded by SLC1A1, corresponding to a HOST TARGET binding site such as BINDING SITE I, BINDING SITE II or BINDING SITE III. Table 2 illustrates the complementarity of the nucleotide sequences of SLC1A1 BINDING SITE, designated SEQ ID:10379, to the nucleotide sequence of VGAM1312 RNA, herein designated VGAM RNA, also designated SEQ ID:4023.

Another function of VGAM1312 is therefore inhibition of Solute Carrier Family 1 (neuronal/epithelial high affinity glutamate transporter, system Xag), Member 1 (SLC1A1, Accession NM_004170), a gene which is a glutamate transporter, essential for terminating the postsynaptic action of glutamate by rapidly removing it from the synaptic cleft. Accordingly, utilities of VGAM1312 include diagnosis, prevention and treatment of diseases and clinical conditions associated with SLC1A1. The function of SLC1A1 and its association with various diseases and clinical conditions, has been established by previous studies, as described hereinabove with reference to VGAM206. Solute Carrier Family 6 (neurotransmitter transporter, betaine/GABA), Member 12 (SLC6A12, Accession NM_003044) is another VGAM1312 host target gene. SLC6A12 BINDING SITE is HOST TARGET binding site found in the 3' untranslated region of mRNA encoded by SLC6A12, corresponding to a HOST TARGET binding site such as BINDING SITE I, BINDING SITE II or BINDING SITE III. Table 2 illustrates the complementarity of the nucleotide sequences of SLC6A12 BINDING SITE, designated SEQ ID:9009, to the nucleotide sequence of VGAM1312 RNA, herein designated VGAM RNA, also designated SEQ ID:4023.

Another function of VGAM1312 is therefore inhibition of Solute Carrier Family 6 (neurotransmitter transporter, betaine/GABA), Member 12 (SLC6A12, Accession NM_003044), a gene which transports betaine and gaba. Accordingly, utilities of VGAM1312 include diagnosis, prevention and treatment of diseases and clinical conditions associated with SLC6A12. The function of SLC6A12 and its association with various diseases and clinical conditions, has been established by previous studies, as described hereinabove with reference to VGAM293. Transporter 2, ATP-binding Cassette, Sub-family B (MDR/TAP) (TAP2, Accession NM_000544) is another VGAM1312 host target gene. TAP2 BINDING SITE is HOST TARGET binding site found in the 3' untranslated region of mRNA encoded by TAP2, corresponding to a HOST TARGET binding site such as BINDING SITE I, BINDING SITE II or BINDING SITE III. Table 2 illustrates the complementarity of the nucleotide sequences of TAP2 BINDING SITE, designated SEQ ID:6141, to the nucleotide sequence of VGAM1312 RNA, herein designated VGAM RNA, also designated SEQ ID:4023.

Another function of VGAM1312 is therefore inhibition of Transporter 2, ATP-binding Cassette, Sub-family B (MDR/TAP) (TAP2, Accession NM_000544), a gene which is involved in the transport of antigens from the cytoplasm to a membrane-bound compartment for association with mhc class i molecules. Accordingly, utilities of VGAM1312 include diagnosis, prevention and treatment of diseases and clinical conditions associated with TAP2. The function of TAP2 and its association with various diseases and clinical conditions, has been established by previous studies, as described hereinabove with reference to VGAM55. Chromosome 20 Open Reading Frame 4 (C20orf4, Accession NM_015511) is another VGAM1312 host target gene. C20orf4 BINDING SITE is HOST TARGET binding site found in the 3' untranslated region of mRNA encoded by C20orf4, corresponding to a HOST TARGET binding site such as BINDING SITE I, BINDING SITE II or BINDING SITE III. Table 2 illustrates the complementarity of the nucleotide sequences of C20orf4 BINDING SITE, designated SEQ ID:17771, to the nucleotide sequence of VGAM1312 RNA, herein designated VGAM RNA, also designated SEQ ID:4023.

Another function of VGAM1312 is therefore inhibition of Chromosome 20 Open Reading Frame 4 (C20orf4, Accession NM_015511). Accordingly, utilities of VGAM1312 include diagnosis, prevention and treatment of diseases and clinical conditions associated with C20orf4. Carbohydrate (N-acetyl-glucosamine 6-O) Sulfotransferase 4 (CHST4, Accession NM_005769) is another VGAM1312 host target gene. CHST4 BINDING SITE is HOST TARGET binding site found in the 3' untranslated region of mRNA encoded by CHST4, corresponding to a HOST TARGET binding site such as BINDING SITE I, BINDING SITE II or BINDING SITE III. Table 2 illustrates the complementarity of the nucleotide sequences of CHST4 BINDING SITE, designated SEQ ID:12335, to the nucleotide sequence of VGAM1312 RNA, herein designated VGAM RNA, also designated SEQ ID:4023.

Another function of VGAM1312 is therefore inhibition of Carbohydrate (N-acetylglucosamine 6-O) Sulfotransferase 4 (CHST4, Accession NM_005769). Accordingly, utilities of VGAM1312 include diagnosis, prevention and treatment of diseases and clinical conditions associated with CHST4. CTAGE-1 (Accession NM_022663) is another VGAM1312 host target gene. CTAGE-1 BINDING SITE is HOST TARGET binding site found in the 3' untranslated region of mRNA encoded by CTAGE-1, corresponding to a HOST TARGET binding site such as BINDING SITE I, BINDING SITE II or BINDING SITE III. Table 2 illustrates the complementarity of the nucleotide sequences of CTAGE-1 BINDING SITE, designated SEQ ID:22909, to the nucleotide sequence of VGAM1312 RNA, herein designated VGAM RNA, also designated SEQ ID:4023.

Another function of VGAM1312 is therefore inhibition of CTAGE-1 (Accession NM_022663). Accordingly, utilities of VGAM1312 include diagnosis, prevention and treatment of diseases and clinical conditions associated with CTAGE-1. HSPC129 (Accession NM_016396) is another VGAM1312 host target gene. HSPC129 BINDING SITE is HOST TARGET binding site found in the 3' untranslated region of mRNA encoded by HSPC129, corresponding to a HOST TARGET binding site such as BINDING SITE I, BINDING SITE II or BINDING SITE III. Table 2 illustrates the complementarity of the nucleotide sequences of HSPC129 BINDING SITE, designated SEQ ID:18534, to the nucleotide sequence of VGAM1312 RNA, herein designated VGAM RNA, also designated SEQ ID:4023.

Another function of VGAM1312 is therefore inhibition of HSPC129 (Accession NM_016396). Accordingly, utilities of VGAM1312 include diagnosis, prevention and treatment of diseases and clinical conditions associated with HSPC129. KIAA1323 (Accession XM_032146) is another VGAM1312 host target gene. KIAA1323 BINDING SITE is HOST TARGET binding site found in the 3' untranslated region of mRNA encoded by KIAA1323, corresponding to a HOST TARGET binding site such as BINDING SITE I, BINDING SITE II or BINDING SITE III. Table 2 illustrates the complementarity of the nucleotide sequences of KIAA1323 BINDING SITE, designated SEQ ID:31569, to the nucleotide sequence of VGAM1312 RNA, herein designated VGAM RNA, also designated SEQ ID:4023.

Another function of VGAM1312 is therefore inhibition of KIAA1323 (Accession XM_032146). Accordingly, utilities of VGAM1312 include diagnosis, prevention and treatment of diseases and clinical conditions associated with KIAA1323. KIAA1462 (Accession XM_166132) is another VGAM1312 host target gene. KIAA1462 BINDING SITE is HOST TARGET binding site found in the 3' untranslated region of mRNA encoded by KIAA1462, corresponding to a HOST TARGET binding site such as BINDING SITE I, BINDING SITE II or BINDING SITE III. Table 2 illustrates the complementarity of the nucleotide sequences of KIAA1462 BINDING SITE, designated SEQ ID:43920, to the nucleotide sequence of VGAM1312 RNA, herein designated VGAM RNA, also designated SEQ ID:4023.

Another function of VGAM1312 is therefore inhibition of KIAA1462 (Accession XM_166132). Accordingly, utilities of VGAM1312 include diagnosis, prevention and treatment of diseases and clinical conditions associated with KIAA1462. P66 (Accession NM_020699) is another VGAM1312 host target gene. P66 BINDING SITE is HOST TARGET binding site found in the 3' untranslated region of mRNA encoded by P66, corresponding to a HOST TARGET binding site such as BINDING SITE I, BINDING SITE II or BINDING SITE III. Table 2 illustrates the complementarity of the nucleotide sequences of P66 BINDING SITE, designated SEQ ID:21848, to the nucleotide sequence of VGAM1312 RNA, herein designated VGAM RNA, also designated SEQ ID:4023.

Another function of VGAM1312 is therefore inhibition of P66 (Accession NM_020699). Accordingly, utilities of VGAM1312 include diagnosis, prevention and treatment of diseases and clinical conditions associated with P66. PRO1635 (Accession NM_018589) is another VGAM1312 host target gene. PRO1635 BINDING SITE is HOST TARGET binding site found in the 3' untranslated region of mRNA encoded by PRO1635, corresponding to a HOST TARGET binding site such as BINDING SITE I, BINDING SITE II or BINDING SITE III. Table 2 illustrates the complementarity of the nucleotide sequences of PRO1635 BINDING SITE, designated SEQ ID:20667, to the nucleotide sequence of VGAM1312 RNA, herein designated VGAM RNA, also designated SEQ ID:4023.

Another function of VGAM1312 is therefore inhibition of PRO1635 (Accession NM_018589). Accordingly, utilities of VGAM1312 include diagnosis, prevention and treatment of diseases and clinical conditions associated with PRO1635. TRIP-Br2 (Accession NM_014755) is another VGAM1312 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16479, to the nucleotide sequence of VGAM1312 RNA, herein designated VGAM RNA, also designated SEQ ID:4023.

Another function of VGAM1312 is therefore inhibition of TRIP-Br2 (Accession NM_014755). Accordingly, utilities of VGAM1312 include diagnosis, prevention and treatment of diseases and clinical conditions associated with TRIP-Br2. LOC221178 (Accession XM_167936) is another VGAM1312 host target gene. LOC221178 BINDING SITE is HOST TARGET binding site found in the 3' untranslated region of mRNA encoded by LOC221178, corresponding to a HOST TARGET binding site such as BINDING SITE I, BINDING SITE II or BINDING SITE III. Table 2 illustrates the complementarity of the nucleotide sequences of LOC221178 BINDING SITE, designated SEQ ID:44926, to the nucleotide sequence of VGAM1312 RNA, herein designated VGAM RNA, also designated SEQ ID:4023.

Another function of VGAM1312 is therefore inhibition of LOC221178 (Accession XM_167936). Accordingly, utilities of VGAM1312 include diagnosis, prevention and treatment of diseases and clinical conditions associated with LOC221178. LOC221300 (Accession XM_166322) is another VGAM1312 host target gene. LOC221300 BINDING SITE is HOST TARGET binding site found in the 3' untranslated region of mRNA encoded by LOC221300, corresponding to a HOST TARGET binding site such as BINDING SITE I, BINDING SITE II or BINDING SITE III. Table 2 illustrates the complementarity of the nucleotide sequences of LOC221300 BINDING SITE, designated SEQ ID:44148, to the nucleotide sequence of VGAM1312 RNA, herein designated VGAM RNA, also designated SEQ ID:4023.

Another function of VGAM1312 is therefore inhibition of LOC221300 (Accession XM_166322). Accordingly, utilities of VGAM1312 include diagnosis, prevention and treatment of diseases and clinical conditions associated with LOC221300. LOC221712 (Accession XM_168059) is another VGAM1312 host target gene. LOC221712 BINDING SITE is HOST TARGET binding site found in the 5' untranslated region of mRNA encoded by LOC221712, corresponding to a HOST TARGET binding site such as BINDING SITE I, BINDING SITE II or BINDING SITE III. Table 2 illustrates the complementarity of the nucleotide sequences of LOC221712 BINDING SITE, designated SEQ ID:44975, to the nucleotide sequence of VGAM1312 RNA, herein designated VGAM RNA, also designated SEQ ID:4023.

Another function of VGAM1312 is therefore inhibition of LOC221712 (Accession XM_168059). Accordingly, utilities of VGAM1312 include diagnosis, prevention and treatment of diseases and clinical conditions associated with LOC221712. LOC256849 (Accession XM_173059) is another VGAM1312 host target gene. LOC256849 BINDING SITE is HOST TARGET binding site found in the 5' untranslated region of mRNA encoded by LOC256849, corresponding to a HOST TARGET binding site such as BINDING SITE I, BINDING SITE II or BINDING SITE III. Table 2 illustrates the complementarity of the nucleotide sequences of LOC256849 BINDING SITE, designated SEQ ID:46313, to the nucleotide sequence of VGAM1312 RNA, herein designated VGAM RNA, also designated SEQ ID:4023.

Another function of VGAM1312 is therefore inhibition of LOC256849 (Accession XM_173059). Accordingly, utilities of VGAM1312 include diagnosis, prevention and treatment of diseases and clinical conditions associated with LOC256849. FIG. 1 further provides a conceptual description of a novel bioinformatically detected viral gene of the present invention, referred to here as Viral Genomic Address Messenger 1313 (VGAM1313) viral gene, which modulates expression of respective host target genes thereof, the function and utility of which host target genes is known in the art.

VGAM1313 is a novel bioinformatically detected regulatory, non protein coding, viral micro RNA (miRNA) gene. The method by which VGAM1313 was detected is described hereinabove with reference to FIGS. 1-8.

VGAM1313 gene, herein designated VGAM GENE, is a viral gene contained in the genome of Foot-and-mouth Disease Virus C. VGAM1313 host target gene, herein designated VGAM HOST TARGET GENE, is a human gene contained in the human genome.

VGAM1313 gene encodes a VGAM1313 precursor RNA, herein designated VGAM PRECURSOR RNA. Similar to other miRNA genes, and unlike most ordinary genes, VGAM1313 precursor RNA does not encode a protein. A nucleotide sequence identical or highly similar to the nucleotide sequence of VGAM1313 precursor RNA is designated SEQ ID:1299, and is provided hereinbelow with reference to the sequence listing part. Nucleotide sequence SEQ ID:1299 is located at position 4912 relative to the genome of Foot-and-mouth Disease Virus C.

VGAM1313 precursor RNA folds onto itself, forming VGAM1313 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1313 folded precursor RNA into VGAM1313 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1313 RNA is designated SEQ ID:4024, and is provided hereinbelow with reference to the sequence listing part.

VGAM1313 host target gene, herein designated VGAM HOST TARGET GENE, encodes a corresponding messenger RNA, VGAM1313 host target RNA, herein designated VGAM HOST TARGET RNA. VGAM1313 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1313 RNA, herein designated VGAM RNA, binds complementarily to one or more host target binding sites located in untranslated regions of VGAM1313 host target RNA, herein designated VGAM HOST TARGET RNA. This complementary binding is due to the fact that the nucleotide sequence of VGAM1313 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1313 RNA, herein designated VGAM RNA, may have a different number of host target binding sites in untranslated regions of a VGAM1313 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1313 RNA, herein designated VGAM RNA, to host target binding sites on VGAM1313 host target RNA, herein designated VGAM HOST TARGET RNA, such as BINDING SITE I, BINDING SITE II and BINDING SITE III, inhibits translation of VGAM1313 host target RNA into VGAM1313 host target protein, herein designated VGAM HOST TARGET PROTEIN. VGAM host target protein is therefore outlined by a broken line.

It is appreciated that VGAM1313 host target gene, herein designated VGAM HOST TARGET GENE, in fact represents a plurality of VGAM1313 host target genes. The mRNA of each one of this plurality of VGAM1313 host target genes comprises one or more host target binding sites, each having a nucleotide sequence which is at least partly complementary to VGAM1313 RNA, herein designated VGAM RNA, and which when bound by VGAM1313 RNA causes inhibition of translation of respective one or more VGAM1313 host target proteins.

It is further appreciated by one skilled in the art that the mode of translational inhibition illustrated by FIG. 1 with specific reference to translational inhibition exerted by VGAM1313 gene, herein designated VGAM GENE, on one or more VGAM1313 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1313 is inhibition of expression of host target genes, as part of a novel viral mechanism of attacking a host. Accordingly, utilities of VGAM1313 include diagnosis, prevention and treatment of viral infection by Foot-and-mouth Disease Virus C. Specific functions, and accordingly utilities, of VGAM1313 correlate with, and may be deduced from, the identity of the host target genes which VGAM1313 binds and inhibits, and the function of these host target genes, as elaborated hereinbelow.

Nucleotide sequences of the VGAM1313 precursor RNA, herein designated VGAM PRECURSOR RNA, and of the 'diced' VGAM1313 RNA, herein designated VGAM RNA, and a schematic representation of the secondary folding of VGAM1313 folded precursor RNA, herein designated VGAM FOLDED PRECURSOR RNA, of VGAM1313 are further described hereinbelow with reference to Table 1.

Nucleotide sequences of host target binding sites, such as BINDING SITE-I, BINDING SITE-II and BINDING SITE-III of FIG. 1, found on VGAM1313 host target RNA, and schematic representation of the complementarity of each of these host target binding sites to VGAM1313 RNA, herein designated VGAM RNA, are described hereinbelow with reference to Table 2.

As mentioned hereinabove with reference to FIG. 1, a function of VGAM1313 gene, herein designated VGAM is inhibition of expression of VGAM1313 target genes. It is appreciated that specific functions, and accordingly utilities, of VGAM1313 correlate with, and may be deduced from, the identity of the target genes which VGAM1313 binds and inhibits, and the function of these target genes, as elaborated hereinbelow.

Aquaporin 6, Kidney Specific (AQP6, Accession NM_001652) is a VGAM1313 host target gene. AQP6 BINDING SITE1 and AQP6 BINDING SITE2 are HOST TARGET binding sites found in untranslated regions of mRNA encoded by AQP6, corresponding to HOST TARGET binding sites such as BINDING SITE I, BINDING SITE II or BINDING SITE III. Table 2 illustrates the complementarity of the nucleotide sequences of AQP6 BINDING SITE1 and AQP6 BINDING SITE2, designated SEQ ID:7359 and SEQ ID:27614 respectively, to the nucleotide sequence of VGAM1313 RNA, herein designated VGAM RNA, also designated SEQ ID:4024.

A function of VGAM1313 is therefore inhibition of Aquaporin 6, Kidney Specific (AQP6, Accession NM_001652), a gene which participates in distinct physiologic function such as glomerular filtration, tubular endocytosis, and acid-base metabolism. Accordingly, utilities of VGAM1313 include diagnosis, prevention and treatment of diseases and clinical conditions associated with AQP6. The function of AQP6 and its association with various diseases and clinical conditions, has been established by previous studies, as described hereinabove with reference to VGAM340. GRB2-associated Binding Protein 2 (GAB2, Accession NM_012296) is another VGAM1313 host target gene. GAB2 BINDING SITE1 and GAB2 BINDING SITE2 are HOST TARGET binding sites found in untranslated regions of mRNA encoded by GAB2, corresponding to HOST TARGET binding sites such as BINDING SITE I, BINDING SITE II or BINDING SITE III. Table 2 illustrates the complementarity of the nucleotide sequences of GAB2 BINDING SITE1 and GAB2 BINDING SITE2, designated SEQ ID:14652 and SEQ ID:27847 respectively, to the nucleotide sequence of VGAM1313 RNA, herein designated VGAM RNA, also designated SEQ ID:4024.

Another function of VGAM1313 is therefore inhibition of GRB2-associated Binding Protein 2 (GAB2, Accession NM_012296), a gene which act as adapters for transmitting various signals. Accordingly, utilities of VGAM1313 include diagnosis, prevention and treatment of diseases and clinical conditions associated with GAB2. The function of GAB2 and its association with various diseases and clinical conditions, has been established by previous studies, as described hereinabove with reference to VGAM53. HMT1 HnRNP Methyltransferase-like 1 (S. cerevisiae) (HRMT1L1, Accession XM_036869) is another VGAM1313 host target gene. HRMT1L1 BINDING SITE is HOST TARGET binding site found in the 3' untranslated region of mRNA encoded by HRMT1L1, corresponding to a HOST TARGET binding site such as BINDING SITE I, BINDING SITE II or BINDING SITE III. Table 2 illustrates the complementarity of the nucleotide sequences of HRMT1L1 BINDING SITE, designated SEQ ID:32506, to the nucleotide sequence of VGAM1313 RNA, herein designated VGAM RNA, also designated SEQ ID:4024.

Another function of VGAM1313 is therefore inhibition of HMT1 HnRNP Methyltransferase-like 1 (S. cerevisiae) (HRMT1L1, Accession XM_036869), a gene which is post-translational methylation of arginine residues. Accordingly, utilities of VGAM1313 include diagnosis, prevention and treatment of diseases and clinical conditions associated with HRMT1L1. The function of HRMT1L1 has been established by previous studies. Katsanis et al. (1997) isolated a novel transcript from chromosome 21 that they found to be similar to the rat protein arginine N-methyltransferase-1 gene (PRMT1) reported by Lin et al. (1996). Katsanis et al. (1997) mapped the human gene (HRMT1L1) to chromosome 21 by study of monochromosomal cell hybrids and fine mapped the gene by PCR analysis of a partial chromosome 21 hybrid panel to a telomeric position on 21q22.3. Hybridization to a YAC that was positive for S100B (OMIM Ref. No. 176990) indicated that HRMT1L1 is no more than 10 kb from S100B. S100B was the most telomeric chromosome 21 gene known at that time. Katsanis et al. (1997) found that HRMT1L1 was expressed in all tissues they investigated. They noted that the function of such protein methyltransferases is posttranslational methylation of arginine residues. Two types of activity had been described, attributed to different classes of enzymes. One methylates myelin protein zero (MPZ; 159440); the other was originally thought to methylate histones, but was later found to methylate hnRNPs far more efficiently. The authors suggested that this human homolog of yeast RMT1 associates with hnRNPs. Scott et al. (1998) further characterized HRMT1L1 and HRMT1L2. By Northern blot analysis, they found that HRMT1L1 is expressed as a 2.4-kb transcript in various adult and fetal tissues. The HRMT1L1 protein could not methylate HNRNPA1 (OMIM Ref. No. 164017) or any other tested substrate in vitro, and did not complement a yeast arginine methyltransferase mutant strain.

Full details of the abovementioned studies are described in the following publications, the disclosure of which are hereby incorporated by reference:

Lin, W. J.; Gary, J. D.; Yang, M. C.; Clarke, S.; Herschman, H. R.: The mammalian intermediate-early TIS21 protein and the leukemia-associated BTG1 protein interact with a protein-arginine N-methyltransferase. J. Biol. Chem. 271: 15034-15044, 1996; and Scott, H. S.; Antonarakis, S. E.; Lalioti, M. D.; Rossier, C.; Silver, P. A.; Henry, M. F.: Identification and characterization of two putative human arginine methyltransferases (HRMT1.

Further studies establishing the function and utilities of HRMT1L1 are found in John Hopkins OMIM database record ID 601961, and in sited publications numbered 5819-5821 listed in the bibliography section hereinbelow, which are also hereby incorporated by reference. Leucine Zipper-EF-hand Containing Transmembrane Protein 1 (LETM1, Accession NM_012318) is another VGAM1313 host target gene. LETM1 BINDING SITE is HOST TARGET binding site found in the 3' untranslated region of mRNA encoded by LETM1, corresponding to a HOST TARGET binding site such as BINDING SITE I, BINDING SITE II or BINDING SITE III. Table 2 illustrates the complementarity of the nucleotide sequences of LETM1 BINDING SITE, designated SEQ ID:14697, to the nucleotide sequence of VGAM1313 RNA, herein designated VGAM RNA, also designated SEQ ID:4024.

Another function of VGAM1313 is therefore inhibition of Leucine Zipper-EF-hand Containing Transmembrane Protein 1 (LETM1, Accession NM_012318). Accordingly, utilities of VGAM1313 include diagnosis, prevention and treatment of diseases and clinical conditions associated with LETM1. Microtubule-associated Protein, RP/EB Family, Member 1 (MAPRE1, Accession NM_012325) is another VGAM1313 host target gene. MAPRE1 BINDING SITE is HOST TARGET binding site found in the 3' untranslated region of mRNA encoded by MAPRE1, corresponding to a HOST TARGET binding site such as BINDING SITE I, BINDING SITE II or BINDING SITE III. Table 2 illustrates the complementarity of the nucleotide sequences of MAPRE1 BINDING SITE, designated SEQ ID:14708, to the nucleotide sequence of VGAM1313 RNA, herein designated VGAM RNA, also designated SEQ ID:4024.

Another function of VGAM1313 is therefore inhibition of Microtubule-associated Protein, RP/EB Family, Member 1 (MAPRE1, Accession NM_012325). Accordingly, utilities of VGAM1313 include diagnosis, prevention and treatment of diseases and clinical conditions associated with MAPRE1. Myotubularin Related Protein 6 (MTMR6, Accession XM_167970) is another VGAM1313 host target gene. MTMR6 BINDING SITE is HOST TARGET binding site found in the 3' untranslated region of mRNA encoded by MTMR6, corresponding to a HOST TARGET binding site such as BINDING SITE I, BINDING SITE II or BINDING SITE III. Table 2 illustrates the complementarity of the nucleotide sequences of MTMR6 BINDING SITE, designated SEQ ID:44936, to the nucleotide sequence of VGAM1313 RNA, herein designated VGAM RNA, also designated SEQ ID:4024.

Another function of VGAM1313 is therefore inhibition of Myotubularin Related Protein 6 (MTMR6, Accession XM_167970). Accordingly, utilities of VGAM1313 include diagnosis, prevention and treatment of diseases and clinical conditions associated with MTMR6. Natural Killer-tumor Recognition Sequence (NKTR, Accession NM_005385) is another VGAM1313 host target gene. NKTR BINDING SITE is HOST TARGET binding site found in the 3' untranslated region of mRNA encoded by NKTR, corresponding to a HOST TARGET binding site such as BINDING SITE I, BINDING SITE II or BINDING SITE III. Table 2 illustrates the complementarity of the nucleotide sequences of NKTR BINDING SITE, designated SEQ ID:11863, to the nucleotide sequence of VGAM1313 RNA, herein designated VGAM RNA, also designated SEQ ID:4024.

Another function of VGAM1313 is therefore inhibition of Natural Killer-tumor Recognition Sequence (NKTR, Accession NM_005385), a gene which is involved in the function of nk cells. Accordingly, utilities of VGAM1313 include diagnosis, prevention and treatment of diseases and clinical conditions associated with NKTR. The function of NKTR and its association with various diseases and clinical conditions, has been established by previous studies, as described hereinabove with reference to VGAM133. Wolf-Hirschhorn Syndrome Candidate 1 (WHSC1, Accession NM_133332) is another VGAM1313 host target gene. WHSC1 BINDING SITE1 through WHSC1 BINDING SITE3 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE3, designated SEQ ID:28444, SEQ ID:28461 and SEQ ID:17180 respectively, to the nucleotide sequence of VGAM1313 RNA, herein designated VGAM RNA, also designated SEQ ID:4024.

Another function of VGAM1313 is therefore inhibition of Wolf-Hirschhorn Syndrome Candidate 1 (WHSC1, Accession NM_133332), a gene which binds covalently to and repairs g/t mismatches. Accordingly, utilities of VGAM1313 include diagnosis, prevention and treatment of diseases and clinical conditions associated with WHSC1. The function of WHSC1 and its association with various diseases and clinical conditions, has been established by previous studies, as described hereinabove with reference to VGAM200. DnaJ (Hsp40) Homolog, Subfamily C, Member 6 (DNAJC6, Accession NM_014787) is another VGAM1313 host target gene. DNAJC6 BINDING SITE is HOST TARGET binding site found in the 3' untranslated region of mRNA encoded by DNAJC6, corresponding to a HOST TARGET binding site such as BINDING SITE I, BINDING SITE II or BINDING SITE III. Table 2 illustrates the complementarity of the nucleotide sequences of DNAJC6 BINDING SITE, designated SEQ ID:16660, to the nucleotide sequence of VGAM1313 RNA, herein designated VGAM RNA, also designated SEQ ID:4024.

Another function of VGAM1313 is therefore inhibition of DnaJ (Hsp40) Homolog, Subfamily C, Member 6 (DNAJC6, Accession NM_014787). Accordingly, utilities of VGAM1313 include diagnosis, prevention and treatment of diseases and clinical conditions associated with DNAJC6. FLJ10314 (Accession NM_018055) is another VGAM1313 host target gene. FLJ10314 BINDING SITE is HOST TARGET binding site found in the 3' untranslated region of mRNA encoded by FLJ10314, corresponding to a HOST TARGET binding site such as BINDING SITE I, BINDING SITE II or BINDING SITE III. Table 2 illustrates the complementarity of the nucleotide sequences of FLJ10314 BINDING SITE, designated SEQ ID:19817, to the nucleotide sequence of VGAM1313 RNA, herein designated VGAM RNA, also designated SEQ ID:4024.

Another function of VGAM1313 is therefore inhibition of FLJ10314 (Accession NM_018055). Accordingly, utilities of VGAM1313 include diagnosis, prevention and treatment of diseases and clinical conditions associated with FLJ10314. FLJ20171 (Accession NM_017697) is another VGAM1313 host target gene. FLJ20171 BINDING SITE is HOST TARGET binding site found in the 3' untranslated region of mRNA encoded by FLJ20171, corresponding to a HOST TARGET binding site such as BINDING SITE I, BINDING SITE II or BINDING SITE III. Table 2 illustrates the complementarity of the nucleotide sequences of FLJ20171 BINDING SITE, designated SEQ ID:19261, to the nucleotide sequence of VGAM1313 RNA, herein designated VGAM RNA, also designated SEQ ID:4024.

Another function of VGAM1313 is therefore inhibition of FLJ20171 (Accession NM_017697). Accordingly, utilities of VGAM1313 include diagnosis, prevention and treatment of diseases and clinical conditions associated with FLJ20171. KIAA0229 (Accession XM_166478) is another VGAM1313 host target gene. KIAA0229 BINDING SITE is HOST TARGET binding site found in the 3' untranslated region of mRNA encoded by KIAA0229, corresponding to a HOST TARGET binding site such as BINDING SITE I, BINDING SITE II or BINDING SITE III. Table 2 illustrates the complementarity of the nucleotide sequences of KIAA0229 BINDING SITE, designated SEQ ID:44403, to the nucleotide sequence of VGAM1313 RNA, herein designated VGAM RNA, also designated SEQ ID:4024.

Another function of VGAM1313 is therefore inhibition of KIAA0229 (Accession XM_166478). Accordingly, utilities of VGAM1313 include diagnosis, prevention and treatment of diseases and clinical conditions associated with KIAA0229. KIAA0410 (Accession NM_014778) is another VGAM1313 host target gene. KIAA0410 BINDING SITE is HOST TARGET binding site found in the 3' untranslated region of mRNA encoded by KIAA0410, corresponding to a HOST TARGET binding site such as BINDING SITE I, BINDING SITE II or BINDING SITE III. Table 2 illustrates the complementarity of the nucleotide sequences of KIAA0410 BINDING SITE, designated SEQ ID:16619, to the nucleotide sequence of VGAM1313 RNA, herein designated VGAM RNA, also designated SEQ ID:4024.

Another function of VGAM1313 is therefore inhibition of KIAA0410 (Accession NM_014778). Accordingly, utilities of VGAM1313 include diagnosis, prevention and treatment of diseases and clinical conditions associated with KIAA0410. KIAA0565 (Accession XM_039912) is another VGAM1313 host target gene. KIAA0565 BINDING SITE is HOST TARGET binding site found in the 3' untranslated region of mRNA encoded by KIAA0565, corresponding to a HOST TARGET binding site such as BINDING SITE I, BINDING SITE II or BINDING SITE III. Table 2 illustrates the complementarity of the nucleotide sequences of KIAA0565 BINDING SITE, designated SEQ ID:33215, to the nucleotide sequence of VGAM1313 RNA, herein designated VGAM RNA, also designated SEQ ID:4024.

Another function of VGAM1313 is therefore inhibition of KIAA0565 (Accession XM_039912). Accordingly, utilities of VGAM1313 include diagnosis, prevention and treatment of diseases and clinical conditions associated with KIAA0565. KIAA1462 (Accession XM_166132) is another VGAM1313 host target gene. KIAA1462 BINDING SITE is HOST TARGET binding site found in the 3' untranslated region of mRNA encoded by KIAA1462, corresponding to a HOST TARGET binding site such as BINDING SITE I, BINDING SITE II or BINDING SITE III. Table 2 illustrates the complementarity of the nucleotide sequences of KIAA1462 BINDING SITE, designated SEQ ID:43918, to the nucleotide sequence of VGAM1313 RNA, herein designated VGAM RNA, also designated SEQ ID:4024.

Another function of VGAM1313 is therefore inhibition of KIAA1462 (Accession XM_166132). Accordingly, utilities of VGAM1313 include diagnosis, prevention and treatment of diseases and clinical conditions associated with KIAA1462. MIC2 Like 1 (MIC2L1, Accession NM_031462) is another VGAM1313 host target gene. MIC2L1 BINDING SITE is HOST TARGET binding site found in the 3' untranslated region of mRNA encoded by MIC2L1, corresponding to a HOST TARGET binding site such as BINDING SITE I, BINDING SITE II or BINDING SITE III. Table 2 illustrates the complementarity of the nucleotide sequences of MIC2L1 BINDING SITE, designated SEQ ID:25490, to the nucleotide sequence of VGAM1313 RNA, herein designated VGAM RNA, also designated SEQ ID:4024.

Another function of VGAM1313 is therefore inhibition of MIC2 Like 1 (MIC2L1, Accession NM_031462). Accordingly, utilities of VGAM1313 include diagnosis, prevention and treatment of diseases and clinical conditions associated with MIC2L1. Nuclear Autoantigenic Sperm Protein (histone-binding) (NASP, Accession XM_042664) is another VGAM1313 host target gene. NASP BINDING SITE is HOST TARGET binding site found in the 3' untranslated region of mRNA encoded by NASP, corresponding to a HOST TARGET binding site such as BINDING SITE I, BINDING SITE II or BINDING SITE III. Table 2 illustrates the complementarity of the nucleotide sequences of NASP BINDING SITE, designated SEQ ID:33738, to the nucleotide sequence of VGAM1313 RNA, herein designated VGAM RNA, also designated SEQ ID:4024.

Another function of VGAM1313 is therefore inhibition of Nuclear Autoantigenic Sperm Protein (histone-binding) (NASP, Accession XM_042664). Accordingly, utilities of VGAM1313 include diagnosis, prevention and treatment of diseases and clinical conditions associated with NASP. ZFP106 (Accession NM_022473) is another VGAM1313 host target gene. ZFP106 BINDING SITE is HOST TARGET binding site found in the 3' untranslated region of mRNA encoded by ZFP106, corresponding to a HOST TARGET binding site such as BINDING SITE I, BINDING SITE II or BINDING SITE III. Table 2 illustrates the complementarity of the nucleotide sequences of ZFP106 BINDING SITE, designated SEQ ID:22830, to the nucleotide sequence of VGAM1313 RNA, herein designated VGAM RNA, also designated SEQ ID:4024.

Another function of VGAM1313 is therefore inhibition of ZFP106 (Accession NM_022473). Accordingly, utilities of VGAM1313 include diagnosis, prevention and treatment of diseases and clinical conditions associated with ZFP106. LOC152220 (Accession XM_098176) is another VGAM1313 host target gene. LOC152220 BINDING SITE is HOST TARGET binding site found in the 3' untranslated region of mRNA encoded by LOC152220, corresponding to a HOST TARGET binding site such as BINDING SITE I, BINDING SITE II or BINDING SITE III. Table 2 illustrates the complementarity of the nucleotide sequences of LOC152220 BINDING SITE, designated SEQ ID:41443, to the nucleotide sequence of VGAM1313 RNA, herein designated VGAM RNA, also designated SEQ ID:4024.

Another function of VGAM1313 is therefore inhibition of LOC152220 (Accession XM_098176). Accordingly, utilities of VGAM1313 include diagnosis, prevention and treatment of diseases and clinical conditions associated with LOC152220. LOC254057 (Accession XM_173085) is another VGAM1313 host target gene. LOC254057 BIND- ING SITE is HOST TARGET binding site found in the 3' untranslated region of mRNA encoded by LOC254057, corresponding to a HOST TARGET binding site such as BINDING SITE I, BINDING SITE II or BINDING SITE III. Table 2 illustrates the complementarity of the nucleotide sequences of LOC254057 BINDING SITE, designated SEQ ID:46349, to the nucleotide sequence of VGAM1313 RNA, herein designated VGAM RNA, also designated SEQ ID:4024.

Another function of VGAM1313 is therefore inhibition of LOC254057 (Accession XM_173085). Accordingly, utilities of VGAM1313 include diagnosis, prevention and treatment of diseases and clinical conditions associated with LOC254057. LOC254302 (Accession XM_171219) is another VGAM1313 host target gene. LOC254302 BINDING SITE is HOST TARGET binding site found in the 5' untranslated region of mRNA encoded by LOC254302, corresponding to a HOST TARGET binding site such as BINDING SITE I, BINDING SITE II or BINDING SITE III. Table 2 illustrates the complementarity of the nucleotide sequences of LOC254302 BINDING SITE, designated SEQ ID:46005, to the nucleotide sequence of VGAM1313 RNA, herein designated VGAM RNA, also designated SEQ ID:4024.

Another function of VGAM1313 is therefore inhibition of LOC254302 (Accession XM_171219). Accordingly, utilities of VGAM1313 include diagnosis, prevention and treatment of diseases and clinical conditions associated with LOC254302. LOC254874 (Accession XM_171217) is another VGAM1313 host target gene. LOC254874 BINDING SITE is HOST TARGET binding site found in the 5' untranslated region of mRNA encoded by LOC254874, corresponding to a HOST TARGET binding site such as BINDING SITE I, BINDING SITE II or BINDING SITE III. Table 2 illustrates the complementarity of the nucleotide sequences of LOC254874 BINDING SITE, designated SEQ ID:46004, to the nucleotide sequence of VGAM1313 RNA, herein designated VGAM RNA, also designated SEQ ID:4024.

Another function of VGAM1313 is therefore inhibition of LOC254874 (Accession XM_171217). Accordingly, utilities of VGAM1313 include diagnosis, prevention and treatment of diseases and clinical conditions associated with LOC254874. LOC256207 (Accession XM_170837) is another VGAM1313 host target gene. LOC256207 BINDING SITE is HOST TARGET binding site found in the 3' untranslated region of mRNA encoded by LOC256207, corresponding to a HOST TARGET binding site such as BINDING SITE I, BINDING SITE II or BINDING SITE III. Table 2 illustrates the complementarity of the nucleotide sequences of LOC256207 BINDING SITE, designated SEQ ID:45616, to the nucleotide sequence of VGAM1313 RNA, herein designated VGAM RNA, also designated SEQ ID:4024.

Another function of VGAM1313 is therefore inhibition of LOC256207 (Accession XM_170837). Accordingly, utilities of VGAM1313 include diagnosis, prevention and treatment of diseases and clinical conditions associated with LOC256207. LOC257407 (Accession XM_173078) is another VGAM1313 host target gene. LOC257407 BINDING SITE is HOST TARGET binding site found in the 5' untranslated region of mRNA encoded by LOC257407, corresponding to a HOST TARGET binding site such as BINDING SITE I, BINDING SITE II or BINDING SITE III. Table 2 illustrates the complementarity of the nucleotide sequences of LOC257407 BINDING SITE, designated SEQ ID:46335, to the nucleotide sequence of VGAM1313 RNA, herein designated VGAM RNA, also designated SEQ ID:4024.

Another function of VGAM1313 is therefore inhibition of LOC257407 (Accession XM_173078). Accordingly, utilities of VGAM1313 include diagnosis, prevention and treatment of diseases and clinical conditions associated with LOC257407. LOC90170 (Accession XM_029589) is another VGAM1313 host target gene. LOC90170 BINDING SITE is HOST TARGET binding site found in the 5' untranslated region of mRNA encoded by LOC90170, corresponding to a HOST TARGET binding site such as BINDING SITE I, BINDING SITE II or BINDING SITE III. Table 2 illustrates the complementarity of the nucleotide sequences of LOC90170 BINDING SITE, designated SEQ ID:30908, to the nucleotide sequence of VGAM1313 RNA, herein designated VGAM RNA, also designated SEQ ID:4024.

Another function of VGAM1313 is therefore inhibition of LOC90170 (Accession XM_029589). Accordingly, utilities of VGAM1313 include diagnosis, prevention and treatment of diseases and clinical conditions associated with LOC90170. LOC90268 (Accession XM_030424) is another VGAM1313 host target gene. LOC90268 BINDING SITE is HOST TARGET binding site found in the 3' untranslated region of mRNA encoded by LOC90268, corresponding to a HOST TARGET binding site such as BINDING SITE I, BINDING SITE II or BINDING SITE III. Table 2 illustrates the complementarity of the nucleotide sequences of LOC90268 BINDING SITE, designated SEQ ID:31043, to the nucleotide sequence of VGAM1313 RNA, herein designated VGAM RNA, also designated SEQ ID:4024.

Another function of VGAM1313 is therefore inhibition of LOC90268 (Accession XM_030424). Accordingly, utilities of VGAM1313 include diagnosis, prevention and treatment of diseases and clinical conditions associated with LOC90268. LOC91496 (Accession XM_038788) is another VGAM1313 host target gene. LOC91496 BINDING SITE is HOST TARGET binding site found in the 5' untranslated region of mRNA encoded by LOC91496, corresponding to a HOST TARGET binding site such as BINDING SITE I, BINDING SITE II or BINDING SITE III. Table 2 illustrates the complementarity of the nucleotide sequences of LOC91496 BINDING SITE, designated SEQ ID:32917, to the nucleotide sequence of VGAM1313 RNA, herein designated VGAM RNA, also designated SEQ ID:4024.

Another function of VGAM1313 is therefore inhibition of LOC91496 (Accession XM_038788). Accordingly, utilities of VGAM1313 include diagnosis, prevention and treatment of diseases and clinical conditions associated with LOC91496. LOC91661 (Accession NM_138372) is another VGAM1313 host target gene. LOC91661 BINDING SITE is HOST TARGET binding site found in the 3' untranslated region of mRNA encoded by LOC91661, corresponding to a HOST TARGET binding site such as BINDING SITE I, BINDING SITE II or BINDING SITE III. Table 2 illustrates the complementarity of the nucleotide sequences of LOC91661 BINDING SITE, designated SEQ ID:28752, to the nucleotide sequence of VGAM1313 RNA, herein designated VGAM RNA, also designated SEQ ID:4024.

Another function of VGAM1313 is therefore inhibition of LOC91661 (Accession NM_138372). Accordingly, utilities of VGAM1313 include diagnosis, prevention and treatment of diseases and clinical conditions associated with LOC91661. LOC92997 (Accession XM_048690) is another VGAM1313 host target gene. LOC92997 BINDING SITE is HOST TARGET binding site found in the 3' untranslated region of mRNA encoded by LOC92997, corresponding to a HOST TARGET binding site such as BINDING SITE I, BINDING SITE II or BINDING SITE III. Table 2 illustrates the complementarity of the nucleotide sequences of LOC92997 BINDING SITE, designated SEQ ID:35220, to the nucleotide sequence of VGAM1313 RNA, herein designated VGAM RNA, also designated SEQ ID:4024.

Another function of VGAM1313 is therefore inhibition of LOC92997 (Accession XM_048690). Accordingly, utilities of VGAM1313 include diagnosis, prevention and treatment of diseases and clinical conditions associated with LOC92997. FIG. 1 further provides a conceptual description of a novel bioinformatically detected viral gene of the present invention, referred to here as Viral Genomic Address Messenger 1314 (VGAM1314) viral gene, which modulates expression of respective host target genes thereof, the function and utility of which host target genes is known in the art.

VGAM1314 is a novel bioinformatically detected regulatory, non protein coding, viral micro RNA (miRNA) gene. The method by which VGAM1314 was detected is described hereinabove with reference to FIGS. 1-8.

VGAM1314 gene, herein designated VGAM GENE, is a viral gene contained in the genome of Foot-and-mouth Disease Virus C. VGAM1314 host target gene, herein designated VGAM HOST TARGET GENE, is a human gene contained in the human genome.

VGAM1314 gene encodes a VGAM1314 precursor RNA, herein designated VGAM PRECURSOR RNA. Similar to other miRNA genes, and unlike most ordinary genes, VGAM1314 precursor RNA does not encode a protein. A nucleotide sequence identical or highly similar to the nucleotide sequence of VGAM1314 precursor RNA is designated SEQ ID:1300, and is provided hereinbelow with reference to the sequence listing part. Nucleotide sequence SEQ ID:1300 is located at position 4399 relative to the genome of Foot-and-mouth Disease Virus C.

VGAM1314 precursor RNA folds onto itself, forming VGAM1314 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1314 folded precursor RNA into VGAM1314 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM1314 RNA is designated SEQ ID:4025, and is provided hereinbelow with reference to the sequence listing part.

VGAM1314 host target gene, herein designated VGAM HOST TARGET GENE, encodes a corresponding messenger RNA, VGAM1314 host target RNA, herein designated VGAM HOST TARGET RNA. VGAM1314 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1314 RNA, herein designated VGAM RNA, binds complementarily to one or more host target binding sites located in untranslated regions of VGAM1314 host target RNA, herein designated VGAM HOST TARGET RNA. This complementary binding is due to the fact that the nucleotide sequence of VGAM1314 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1314 RNA, herein designated VGAM RNA, may have a different number of host target binding sites in untranslated regions of a VGAM1314 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1314 RNA, herein designated VGAM RNA, to host target binding sites on VGAM1314 host target RNA, herein designated VGAM HOST TARGET RNA, such as BINDING SITE I, BINDING SITE II and BINDING SITE III, inhibits translation of VGAM1314 host target RNA into VGAM1314 host target protein, herein designated VGAM HOST TARGET PROTEIN. VGAM host target protein is therefore outlined by a broken line.

It is appreciated that VGAM1314 host target gene, herein designated VGAM HOST TARGET GENE, in fact represents a plurality of VGAM1314 host target genes. The mRNA of each one of this plurality of VGAM1314 host target genes comprises one or more host target binding sites, each having a nucleotide sequence which is at least partly complementary to VGAM1314 RNA, herein designated VGAM RNA, and which when bound by VGAM1314 RNA causes inhibition of translation of respective one or more VGAM1314 host target proteins.

It is further appreciated by one skilled in the art that the mode of translational inhibition illustrated by FIG. 1 with specific reference to translational inhibition exerted by VGAM1314 gene, herein designated VGAM GENE, on one or more VGAM1314 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1314 is inhibition of expression of host target genes, as part of a novel viral mechanism of attacking a host. Accordingly, utilities of VGAM1314 include diagnosis, prevention and treatment of viral infection by Foot-and-mouth Disease Virus C. Specific functions, and accordingly utilities, of VGAM1314 correlate with, and may be deduced from, the identity of the host target genes which VGAM1314 binds and inhibits, and the function of these host target genes, as elaborated hereinbelow.

Nucleotide sequences of the VGAM1314 precursor RNA, herein designated VGAM PRECURSOR RNA, and of the 'diced' VGAM1314 RNA, herein designated VGAM RNA, and a schematic representation of the secondary folding of VGAM1314 folded precursor RNA, herein designated VGAM FOLDED PRECURSOR RNA, of VGAM1314 are further described hereinbelow with reference to Table 1.

Nucleotide sequences of host target binding sites, such as BINDING SITE-I, BINDING SITE-II and BINDING SITE-III of FIG. 1, found on VGAM1314 host target RNA, and schematic representation of the complementarity of each of these host target binding sites to VGAM1314 RNA, herein designated VGAM RNA, are described hereinbelow with reference to Table 2.

As mentioned hereinabove with reference to FIG. 1, a function of VGAM1314 gene, herein designated VGAM is inhibition of expression of VGAM1314 target genes. It is appreciated that specific functions, and accordingly utilities, of VGAM1314 correlate with, and may be deduced from, the identity of the target genes which VGAM1314 binds and inhibits, and the function of these target genes, as elaborated hereinbelow.

BCL2-like 2 (BCL2L2, Accession NM_004050) is a VGAM1314 host target gene. BCL2L2 BINDING SITE is HOST TARGET binding site found in the 5' untranslated region of mRNA encoded by BCL2L2, corresponding to a HOST TARGET binding site such as BINDING SITE I, BINDING SITE II or BINDING SITE III. Table 2 illustrates the complementarity of the nucleotide sequences of BCL2L2 BINDING SITE, designated SEQ ID:10257, to the nucleotide sequence of VGAM1314 RNA, herein designated VGAM RNA, also designated SEQ ID:4025.

A function of VGAM1314 is therefore inhibition of BCL2-like 2 (BCL2L2, Accession NM_004050), a gene which promotes cell survival. Accordingly, utilities of VGAM1314 include diagnosis, prevention and treatment of diseases and clinical conditions associated with BCL2L2. The function of BCL2L2 and its association with various diseases and clinical conditions, has been established by previous studies, as described hereinabove with reference to VGAM431. Caspase Recruitment Domain Family, Member 15 (CARD15, Accession NM_022162) is another VGAM1314 host target gene. CARD15 BINDING SITE is HOST TARGET binding site found in the 3' untranslated region of mRNA encoded by CARD15, corresponding to a HOST TARGET binding site such as BINDING SITE I, BINDING SITE II or BINDING SITE III. Table 2 illustrates the complementarity of the nucleotide sequences of CARD15 BINDING SITE, designated SEQ ID:22716, to the nucleotide sequence of VGAM1314 RNA, herein designated VGAM RNA, also designated SEQ ID:4025.

Another function of VGAM1314 is therefore inhibition of Caspase Recruitment Domain Family, Member 15 (CARD15, Accession NM_022162), a gene which serves as an intracellular receptor for bacterial products in monocytes and transduces signals leading to NFKB activation. Accordingly, utilities of VGAM1314 include diagnosis, prevention and treatment of diseases and clinical conditions associated with CARD15. The function of CARD15 and its association with various diseases and clinical conditions, has been established by previous studies, as described hereinabove with reference to VGAM126. Diaphorase (NADH) (cytochrome b-5 reductase) (DIA1, Accession NM_007326) is another VGAM1314 host target gene. DIA1 BINDING SITE is HOST TARGET binding site found in the 3' untranslated region of mRNA encoded by DIA1, corresponding to a HOST TARGET binding site such as BINDING SITE I, BINDING SITE II or BINDING SITE III. Table 2 illustrates the complementarity of the nucleotide sequences of DIA1 BINDING SITE, designated SEQ ID:14247, to the nucleotide sequence of VGAM1314 RNA, herein designated VGAM RNA, also designated SEQ ID:4025.

Another function of VGAM1314 is therefore inhibition of Diaphorase (NADH) (cytochrome b-5 reductase) (DIA1, Accession NM_007326). Accordingly, utilities of VGAM1314 include diagnosis, prevention and treatment of diseases and clinical conditions associated with DIA1. Fibroblast Growth Factor 7 (keratinocyte growth factor) (FGF7, Accession NM_002009) is another VGAM1314 host target gene. FGF7 BINDING SITE is HOST TARGET binding site found in the 3' untranslated region of mRNA encoded by FGF7, corresponding to a HOST TARGET binding site such as BINDING SITE I, BINDING SITE II or BINDING SITE III. Table 2 illustrates the complementarity of the nucleotide sequences of FGF7 BINDING SITE, designated SEQ ID:7750, to the nucleotide sequence of VGAM1314 RNA, herein designated VGAM RNA, also designated SEQ ID:4025.

Another function of VGAM1314 is therefore inhibition of Fibroblast Growth Factor 7 (keratinocyte growth factor) (FGF7, Accession NM_002009), a gene which growth factor active on keratinocytes. Accordingly, utilities of VGAM1314 include diagnosis, prevention and treatment of diseases and clinical conditions associated with FGF7. The function of FGF7 and its association with various diseases and clinical conditions, has been established by previous studies, as described hereinabove with reference to VGAM678. Glycoprotein A Repetitions Predominant (GARP, Accession NM_005512) is another VGAM1314 host target gene. GARP BINDING SITE is HOST TARGET binding site found in the 3" untranslated region of mRNA encoded by GARP, corresponding to a HOST TARGET binding site such as BINDING SITE I, BINDING SITE II or BINDING SITE III. Table 2 illustrates the complementarity of the nucleotide sequences of GARP BINDING SITE, designated SEQ ID:12030, to the nucleotide sequence of VGAM1314 RNA, herein designated VGAM RNA, also designated SEQ ID:4025.

Another function of VGAM1314 is therefore inhibition of Glycoprotein A Repetitions Predominant (GARP, Accession NM_005512). Accordingly, utilities of VGAM1314 include diagnosis, prevention and treatment of diseases and clinical conditions associated with GARP. Glucosaminyl (N-acetyl) Transferase 2, I-branching Enzyme (GCNT2, Accession NM_001491) is another VGAM1314 host target gene. GCNT2 BINDING SITE is HOST TARGET binding site found in the 5' untranslated region of mRNA encoded by GCNT2, corresponding to a HOST TARGET binding site such as BINDING SITE I, BINDING SITE II or BINDING SITE III. Table 2 illustrates the complementarity of the nucleotide sequences of GCNT2 BINDING SITE, designated SEQ ID:7238, to the nucleotide sequence of VGAM1314 RNA, herein designated VGAM RNA, also designated SEQ ID:4025.

Another function of VGAM1314 is therefore inhibition of Glucosaminyl (N-acetyl) Transferase 2, I-branching Enzyme (GCNT2, Accession NM_001491), a gene which converts linear into branched poly-n-acetyllactosaminoglycans. Accordingly, utilities of VGAM1314 include diagnosis, prevention and treatment of diseases and clinical conditions associated with GCNT2. The function of GCNT2 and its association with various diseases and clinical conditions, has been established by previous studies, as described hereinabove with reference to VGAM943. Golgi Associated, Gamma Adaptin Ear Containing, ARF Binding Protein 3 (GGA3, Accession NM_138619) is another VGAM1314 host target gene. GGA3 BINDING SITE1 and GGA3 BINDING SITE2 are HOST TARGET binding sites found in untranslated regions of mRNA encoded by GGA3, corresponding to HOST TARGET binding sites such as BINDING SITE I, BINDING SITE II or BINDING SITE III. Table 2 illustrates the complementarity of the nucleotide sequences of GGA3 BINDING SITE1 and GGA3 BINDING SITE2, designated SEQ ID:28903 and SEQ ID:15200 respectively, to the nucleotide sequence of VGAM1314 RNA, herein designated VGAM RNA, also designated SEQ ID:4025.

Another function of VGAM1314 is therefore inhibition of Golgi Associated, Gamma Adaptin Ear Containing, ARF Binding Protein 3 (GGA3, Accession NM_138619), a gene which may play a role in the regulation of membrane traffic through the trans-golgi network. Accordingly, utilities of VGAM1314 include diagnosis, prevention and treatment of diseases and clinical conditions associated with GGA3. The function of GGA3 and its association with various diseases and clinical conditions, has been established by previous studies, as described hereinabove with reference to VGAM353. Nuclear Respiratory Factor 1 (NRF1, Accession XM_011548) is another VGAM1314 host target gene. NRF1 BINDING SITE is HOST TARGET binding site found in the 3' untranslated region of mRNA encoded by NRF1, corresponding to a HOST TARGET binding site such as BINDING SITE I, BINDING SITE II or BINDING SITE III. Table 2 illustrates the complementarity of the nucleotide sequences of NRF1 BINDING SITE, designated SEQ ID:30191, to the nucleotide sequence of VGAM1314 RNA, herein designated VGAM RNA, also designated SEQ ID:4025.

Another function of VGAM1314 is therefore inhibition of Nuclear Respiratory Factor 1 (NRF1, Accession XM_011548), a gene which is a basic leucine zipper (bZIP) transcriptional activator and involved in the regulation of genes for EIF2A and respiratory subunits. Accordingly, utilities of VGAM1314 include diagnosis, prevention and treatment of diseases and clinical conditions associated with NRF1. The function of NRF1 has been established by previous studies. Gopalakrishnan and Scarpulla (1995) noted that the electron transport chain and oxidative phosphorylation system rely on the functional interplay of gene products expressed from both nuclear and mitochondrial genomes. Because of the limited coding capacity of the mitochondrial chromosome, nuclear genes must provide most of the respiratory subunits and all of the gene products necessary for mitochondrial DNA transcription and replication. Nuclear respiratory factor-1 (NRF1) is a transcription factor that acts on nuclear genes encoding respiratory subunits and components of the mitochondrial transcription and replication machinery. Virbasius et al. (1993) cloned the human NRF1 cDNA from HeLa cells using degenerate primers based on partial tryptic peptide sequences and showed a predicted 504 amino acid protein encoded by a 2,970 nucleotide cDNA. The recombinantly expressed protein activated transcription of several NRF1-responsive promoters. Animal model experiments lend further support to the function of NRF1.

It is appreciated that the abovementioned animal model for NRF1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gopalakrishnan, L.; Scarpulla, R. C.: Structure, expression, and chromosomal assignment of the human gene encoding nuclear respiratory factor 1. J. Biol. Chem. 270:18019-18025, 1995; and Virbasius, C. A.; Virbasius, J. V.; Scarpulla, R. C.: NRF-1, an activator involved in nuclear-mitochondrial interactions, utilizes a new DNA-binding domain conserved in a family of dev.

Further studies establishing the function and utilities of NRF1 are found in John Hopkins OMIM database record ID 600879, and in sited publications numbered 6852-6855, 714 and 10060 listed in the bibliography section hereinbelow, which are also hereby incorporated by reference. Neurotensin Receptor 1 (high affinity) (NTSR1, Accession NM_002531) is another VGAM1314 host target gene. NTSR1 BINDING SITE is HOST TARGET binding site found in the 3' untranslated region of mRNA encoded by NTSR1, corresponding to a HOST TARGET binding site such as BINDING SITE I, BINDING SITE II or BINDING SITE III. Table 2 illustrates the complementarity of the nucleotide sequences of NTSR1 BINDING SITE, designated SEQ ID:8368, to the nucleotide sequence of VGAM1314 RNA, herein designated VGAM RNA, also designated SEQ ID:4025.

Another function of VGAM1314 is therefore inhibition of Neurotensin Receptor 1 (high affinity) (NTSR1, Accession NM_002531), a gene which is associated with g proteins that activate a phosphatidylinositol- calcium second messenger system. Accordingly, utilities of VGAM1314 include diagnosis, prevention and treatment of diseases and clinical conditions associated with NTSR1. The function of NTSR1 and its association with various diseases and clinical conditions, has been established by previous studies, as described hereinabove with reference to VGAM200. Synaptogyrin 1 (SYNGR1, Accession NM_004711) is another VGAM1314 host target gene. SYNGR1 BINDING SITE is HOST TARGET binding site found in the 3' untranslated region of mRNA encoded by SYNGR1, corresponding to a HOST TARGET binding site such as BINDING SITE I, BINDING SITE II or BINDING SITE III. Table 2 illustrates the complementarity of the nucleotide sequences of SYNGR1 BINDING SITE, designated SEQ ID:11065, to the nucleotide sequence of VGAM1314 RNA, herein designated VGAM RNA, also designated SEQ ID:4025.

Another function of VGAM1314 is therefore inhibition of Synaptogyrin 1 (SYNGR1, Accession NM_004711), a gene which belongs to transmembrane synaptic vesicle protein and may function in membrane recycling. Accordingly, utilities of VGAM1314 include diagnosis, prevention and treatment of diseases and clinical conditions associated with SYNGR1. The function of SYNGR1 and its association with various diseases and clinical conditions, has been established by previous studies, as described hereinabove with reference to VGAM107. Transcription Factor 1, Hepatic; LF-B1, Hepatic Nuclear Factor (HNF1), Albumin Proximal Factor (TCF1, Accession NM_000545) is another VGAM1314 host target gene. TCF1 BINDING SITE is HOST TARGET binding site found in the 3' untranslated region of mRNA encoded by TCF1, corresponding to a HOST TARGET binding site such as BINDING SITE I, BINDING SITE II or BINDING SITE III. Table 2 illustrates the complementarity of the nucleotide sequences of TCF1 BINDING SITE, designated SEQ ID:6148, to the nucleotide sequence of VGAM1314 RNA, herein designated VGAM RNA, also designated SEQ ID:4025.

Another function of VGAM1314 is therefore inhibition of Transcription Factor 1, Hepatic; LF-B1, Hepatic Nuclear Factor (HNF1), Albumin Proximal Factor (TCF1, Accession NM_000545), a gene which is required for the expression of several liver specific genes. binds to the inverted palindrome 5'-gttaatnattaac-3'. Accordingly, utilities of VGAM1314 include diagnosis, prevention and treatment of diseases and clinical conditions associated with TCF1. The function of TCF1 and its association with various diseases and clinical conditions, has been established by previous studies, as described hereinabove with reference to VGAM1189. Aquaporin 9 (AQP9, Accession NM_020980) is another VGAM1314 host target gene. AQP9 BINDING SITE is HOST TARGET binding site found in the 3' untranslated region of mRNA encoded by AQP9, corresponding to a HOST TARGET binding site such as BINDING SITE I, BINDING SITE II or BINDING SITE III. Table 2 illustrates the complementarity of the nucleotide sequences of AQP9 BINDING SITE, designated SEQ ID:21968, to the nucleotide sequence of VGAM1314 RNA, herein designated VGAM RNA, also designated SEQ ID:4025.

Another function of VGAM1314 is therefore inhibition of Aquaporin 9 (AQP9, Accession NM_020980). Accordingly, utilities of VGAM1314 include diagnosis, prevention and treatment of diseases and clinical conditions associated with AQP9. Chromosome 8 Open Reading Frame 2 (C8orf2, Accession NM_007175) is another VGAM1314 host target gene. C8orf2 BINDING SITE is HOST TARGET binding site found in the 3' untranslated region of mRNA encoded by C8orf2, corresponding to a HOST TARGET binding site such as BINDING SITE I, BINDING SITE II or BINDING SITE III. Table 2 illustrates the complementarity of the nucleotide sequences of C8orf2 BINDING SITE, designated SEQ ID:14022, to the nucleotide sequence of VGAM1314 RNA, herein designated VGAM RNA, also designated SEQ ID:4025.

Another function of VGAM1314 is therefore inhibition of Chromosome 8 Open Reading Frame 2 (C8orf2, Accession NM_007175). Accordingly, utilities of VGAM1314 include diagnosis, prevention and treatment of diseases and clinical conditions associated with C8orf2. DKFZP586I2223 (Accession NM_015438) is another VGAM1314 host target gene. DKFZP586I2223 BINDING SITE is HOST TARGET binding site found in the 3' untranslated region of mRNA encoded by DKFZP586I2223, corresponding to a HOST TARGET binding site such as BINDING SITE I, BINDING SITE II or BINDING SITE III. Table 2 illustrates the complementarity of the nucleotide sequences of DKFZP586I2223 BINDING SITE, designated SEQ ID:17731, to the nucleotide sequence of VGAM1314 RNA, herein designated VGAM RNA, also designated SEQ ID:4025.

Another function of VGAM1314 is therefore inhibition of DKFZP586I2223 (Accession NM_015438). Accordingly, utilities of VGAM1314 include diagnosis, prevention and treatment of diseases and clinical conditions associated with DKFZP586I2223. FLJ20275 (Accession NM_017737) is another VGAM1314 host target gene. FLJ20275 BINDING SITE is HOST TARGET binding site found in the 3' untranslated region of mRNA encoded by FLJ20275, corresponding to a HOST TARGET binding site such as BINDING SITE I, BINDING SITE II or BINDING SITE III. Table 2 illustrates the complementarity of the nucleotide sequences of FLJ20275 BINDING SITE, designated SEQ ID:19322, to the nucleotide sequence of VGAM1314 RNA, herein designated VGAM RNA, also designated SEQ ID:4025.

Another function of VGAM1314 is therefore inhibition of FLJ20275 (Accession NM_017737). Accordingly, utilities of VGAM1314 include diagnosis, prevention and treatment of diseases and clinical conditions associated with FLJ20275. FLJ21742 (Accession NM_032207) is another VGAM1314 host target gene. FLJ21742 BINDING SITE is HOST TARGET binding site found in the 3' untranslated region of mRNA encoded by FLJ21742, corresponding to a HOST TARGET binding site such as BINDING SITE I, BINDING SITE II or BINDING SITE III. Table 2 illustrates the complementarity of the nucleotide sequences of FLJ21742 BINDING SITE, designated SEQ ID:25913, to the nucleotide sequence of VGAM1314 RNA, herein designated VGAM RNA, also designated SEQ ID:4025.

Another function of VGAM1314 is therefore inhibition of FLJ21742 (Accession NM_032207). Accordingly, utilities of VGAM1314 include diagnosis, prevention and treatment of diseases and clinical conditions associated with FLJ21742. FYVE and Coiled-coil Domain Containing 1 (FYCO1, Accession NM_024513) is another VGAM1314 host target gene. FYCO1 BINDING SITE is HOST TARGET binding site found in the 3' untranslated region of mRNA encoded by FYCO1, corresponding to a HOST TARGET binding site such as BINDING SITE I, BINDING SITE II or BINDING SITE III. Table 2 illustrates the complementarity of the nucleotide sequences of FYCO1 BINDING SITE, designated SEQ ID:23709, to the nucleotide sequence of VGAM1314 RNA, herein designated VGAM RNA, also designated SEQ ID:4025.

Another function of VGAM1314 is therefore inhibition of FYVE and Coiled-coil Domain Containing 1 (FYCO1, Accession NM_024513). Accordingly, utilities of VGAM1314 include diagnosis, prevention and treatment of diseases and clinical conditions associated with FYCO1. Hypermethylated In Cancer 2 (HIC2, Accession XM_036937) is another VGAM1314 host target gene. HIC2 BINDING SITE is HOST TARGET binding site found in the 3' untranslated region of mRNA encoded by HIC2, corresponding to a HOST TARGET binding site such as BINDING SITE I, BINDING SITE II or BINDING SITE III. Table 2 illustrates the complementarity of the nucleotide sequences of HIC2 BINDING SITE, designated SEQ ID:32529, to the nucleotide sequence of VGAM1314 RNA, herein designated VGAM RNA, also designated SEQ ID:4025.

Another function of VGAM1314 is therefore inhibition of Hypermethylated In Cancer 2 (HIC2, Accession XM_036937). Accordingly, utilities of VGAM1314 include diagnosis, prevention and treatment of diseases and clinical conditions associated with HIC2. KIAA0319 (Accession NM_014809) is another VGAM1314 host target gene. KIAA0319 BINDING SITE is HOST TARGET binding site found in the 3' untranslated region of mRNA encoded by KIAA0319, corresponding to a HOST TARGET binding site such as BINDING SITE I, BINDING SITE II or BINDING SITE III. Table 2 illustrates the complementarity of the nucleotide sequences of KIAA0319 BINDING SITE, designated SEQ ID:16762, to the nucleotide sequence of VGAM1314 RNA, herein designated VGAM RNA, also designated SEQ ID:4025.

Another function of VGAM1314 is therefore inhibition of KIAA0319 (Accession NM_014809). Accordingly, utilities of VGAM1314 include diagnosis, prevention and treatment of diseases and clinical conditions associated with KIAA0319. KIAA0672 (Accession NM_014859) is another VGAM1314 host target gene. KIAA0672 BINDING SITE is HOST TARGET binding site found in the 3' untranslated region of mRNA encoded by KIAA0672, corresponding to a HOST TARGET binding site such as BINDING SITE I, BINDING SITE II or BINDING SITE III. Table 2 illustrates the complementarity of the nucleotide sequences of KIAA0672 BINDING SITE, designated SEQ ID:16919, to the nucleotide sequence of VGAM1314 RNA, herein designated VGAM RNA, also designated SEQ ID:4025.

Another function of VGAM1314 is therefore inhibition of KIAA0672 (Accession NM_014859). Accordingly, utilities of VGAM1314 include diagnosis, prevention and treatment of diseases and clinical conditions associated with KIAA0672. KIAA1036 (Accession NM_014909) is another VGAM1314 host target gene. KIAA1036 BINDING SITE is HOST TARGET binding site found in the 3' untranslated region of mRNA encoded by KIAA1036, corresponding to a HOST TARGET binding site such as BINDING SITE I, BINDING SITE II or BINDING SITE III. Table 2 illustrates the complementarity of the nucleotide sequences of KIAA1036 BINDING SITE, designated SEQ ID:17133, to the nucleotide sequence of VGAM1314 RNA, herein designated VGAM RNA, also designated SEQ ID:4025.

Another function of VGAM1314 is therefore inhibition of KIAA1036 (Accession NM_014909). Accordingly, utilities of VGAM1314 include diagnosis, prevention and treatment of diseases and clinical conditions associated with KIAA1036. KIAA1280 (Accession XM_045766) is another VGAM1314 host target gene. KIAA1280 BINDING SITE is HOST TARGET binding site found in the 5' untranslated region of mRNA encoded by KIAA1280, corresponding to a HOST TARGET binding site such as BINDING SITE I, BINDING SITE II or BINDING SITE III. Table 2 illustrates the complementarity of the nucleotide sequences of KIAA1280 BINDING SITE, designated SEQ ID:34551, to the nucleotide sequence of VGAM1314 RNA, herein designated VGAM RNA, also designated SEQ ID:4025.

Another function of VGAM1314 is therefore inhibition of KIAA1280 (Accession XM_045766). Accordingly, utilities of VGAM1314 include diagnosis, prevention and treatment of diseases and clinical conditions associated with KIAA1280. KIAA1855 (Accession XM_166453) is another VGAM1314 host target gene. KIAA1855 BINDING SITE is HOST TARGET binding site found in the 3' untranslated region of mRNA encoded by KIAA1855, corresponding to a HOST TARGET binding site such as BINDING SITE I, BINDING SITE II or BINDING SITE III. Table 2 illustrates the complementarity of the nucleotide sequences of KIAA1855 BINDING SITE, designated SEQ ID:44358, to the nucleotide sequence of VGAM1314 RNA, herein designated VGAM RNA, also designated SEQ ID:4025.

Another function of VGAM1314 is therefore inhibition of KIAA1855 (Accession XM_166453). Accordingly, utilities of VGAM1314 include diagnosis, prevention and treatment of diseases and clinical conditions associated with KIAA1855. Lysyl Oxidase-like 4 (LOXL4, Accession NM_032211) is another VGAM1314 host target gene. LOXL4 BINDING SITE is HOST TARGET binding site found in the 3' untranslated region of mRNA encoded by LOXL4, corresponding to a HOST TARGET binding site such as BINDING SITE I, BINDING SITE II or BINDING SITE III. Table 2 illustrates the complementarity of the nucleotide sequences of LOXL4 BINDING SITE, designated SEQ ID:25930, to the nucleotide sequence of VGAM1314 RNA, herein designated VGAM RNA, also designated SEQ ID:4025.

Another function of VGAM1314 is therefore inhibition of Lysyl Oxidase-like 4 (LOXL4, Accession NM_032211). Accordingly, utilities of VGAM1314 include diagnosis, prevention and treatment of diseases and clinical conditions associated with LOXL4. SCMH1 (Accession NM_012236) is another VGAM1314 host target gene. SCMH1 BINDING SITE is HOST TARGET binding site found in the 3' untranslated region of mRNA encoded by SCMH1, corresponding to a HOST TARGET binding site such as BINDING SITE I, BINDING SITE II or BINDING SITE III. Table 2 illustrates the complementarity of the nucleotide sequences of SCMH1 BINDING SITE, designated SEQ ID:14539, to the nucleotide sequence of VGAM1314 RNA, herein designated VGAM RNA, also designated SEQ ID:4025.

Another function of VGAM1314 is therefore inhibition of SCMH1 (Accession NM_012236). Accordingly, utilities of VGAM1314 include diagnosis, prevention and treatment of diseases and clinical conditions associated with SCMH1. Synaptosomal-associated Protein, 29 kDa (SNAP29, Accession NM_004782) is another VGAM1314 host target gene. SNAP29 BINDING SITE is HOST TARGET binding site found in the 3' untranslated region of mRNA encoded by SNAP29, corresponding to a HOST TARGET binding site such as BINDING SITE I, BINDING SITE II or BINDING SITE III. Table 2 illustrates the complementarity of the nucleotide sequences of SNAP29 BINDING SITE, designated SEQ ID:11187, to the nucleotide sequence of VGAM1314 RNA, herein designated VGAM RNA, also designated SEQ ID:4025.

Another function of VGAM1314 is therefore inhibition of Synaptosomal-associated Protein, 29 kDa (SNAP29, Accession NM_004782). Accordingly, utilities of VGAM1314 include diagnosis, prevention and treatment of diseases and clinical conditions associated with SNAP29. LOC112868 (Accession XM_053402) is another VGAM1314 host target gene. LOC112868 BINDING SITE is HOST TARGET binding site found in the 5' untranslated region of mRNA encoded by LOC112868, corresponding to a HOST TARGET binding site such as BINDING SITE I, BINDING SITE II or BINDING SITE III. Table 2 illustrates the complementarity of the nucleotide sequences of LOC112868 BINDING SITE, designated SEQ ID:36084, to the nucleotide sequence of VGAM1314 RNA, herein designated VGAM RNA, also designated SEQ ID:4025.

Another function of VGAM1314 is therefore inhibition of LOC112868 (Accession XM_053402). Accordingly, utilities of VGAM1314 include diagnosis, prevention and treatment of diseases and clinical conditions associated with LOC112868. LOC132880 (Accession XM_059609) is another VGAM1314 host target gene. LOC132880 BINDING SITE is HOST TARGET binding site found in the 5' untranslated region of mRNA encoded by LOC132880, corresponding to a HOST TARGET binding site such as BINDING SITE I, BINDING SITE II or BINDING SITE III. Table 2 illustrates the complementarity of the nucleotide sequences of LOC132880 BINDING SITE, designated SEQ ID:37031, to the nucleotide sequence of VGAM1314 RNA, herein designated VGAM RNA, also designated SEQ ID:4025.

Another function of VGAM1314 is therefore inhibition of LOC132880 (Accession XM_059609). Accordingly, utilities of VGAM1314 include diagnosis, prevention and treatment of diseases and clinical conditions associated with LOC132880. LOC136015 (Accession XM_072440) is another VGAM1314 host target gene. LOC136015 BINDING SITE is HOST TARGET binding site found in the 3' untranslated region of mRNA encoded by LOC136015, corresponding to a HOST TARGET binding site such as BINDING SITE I, BINDING SITE II or BINDING SITE III. Table 2 illustrates the complementarity of the nucleotide sequences of LOC136015 BINDING SITE, designated SEQ ID:37501, to the nucleotide sequence of VGAM1314 RNA, herein designated VGAM RNA, also designated SEQ ID:4025.

Another function of VGAM1314 is therefore inhibition of LOC136015 (Accession XM_072440). Accordingly, utilities of VGAM1314 include diagnosis, prevention and treatment of diseases and clinical conditions associated with LOC136015. LOC142927 (Accession XM_084380) is another VGAM1314 host target gene. LOC142927 BINDING SITE is HOST TARGET binding site found in the 5' untranslated region of mRNA encoded by LOC142927, corresponding to a HOST TARGET binding site such as BINDING SITE I, BINDING SITE II or BINDING SITE III. Table 2 illustrates the complementarity of the nucleotide sequences of LOC142927 BINDING SITE, designated SEQ ID:37567, to the nucleotide sequence of VGAM1314 RNA, herein designated VGAM RNA, also designated SEQ ID:4025.

Another function of VGAM1314 is therefore inhibition of LOC142927 (Accession XM_084380). Accordingly, utilities of VGAM1314 include diagnosis, prevention and treatment of diseases and clinical conditions associated with LOC142927. LOC143425 (Accession XM_113695) is another VGAM1314 host target gene. LOC143425 BINDING SITE is HOST TARGET binding site found in the 3' untranslated region of mRNA encoded by LOC143425, corresponding to a HOST TARGET binding site such as BINDING SITE I, BINDING SITE II or BINDING SITE III. Table 2 illustrates the complementarity of the nucleotide sequences of LOC143425 BINDING SITE, designated SEQ ID:42355, to the nucleotide sequence of VGAM1314 RNA, herein designated VGAM RNA, also designated SEQ ID:4025.

Another function of VGAM1314 is therefore inhibition of LOC143425 (Accession XM_113695). Accordingly, utilities of VGAM1314 include diagnosis, prevention and treatment of diseases and clinical conditions associated with LOC143425. LOC145566 (Accession XM_085174) is another VGAM1314 host target gene. LOC145566 BINDING SITE is HOST TARGET binding site found in the 5' untranslated region of mRNA encoded by LOC145566, corresponding to a HOST TARGET binding site such as BINDING SITE I, BINDING SITE II or BINDING SITE III. Table 2 illustrates the complementarity of the nucleotide sequences of LOC145566 BINDING SITE, designated SEQ ID:37897, to the nucleotide sequence of VGAM1314 RNA, herein designated VGAM RNA, also designated SEQ ID:4025.

Another function of VGAM1314 is therefore inhibition of LOC145566 (Accession XM_085174). Accordingly, utilities of VGAM1314 include diagnosis, prevention and treatment of diseases and clinical conditions associated with LOC145566. LOC151391 (Accession XM_098050) is another VGAM1314 host target gene. LOC151391 BINDING SITE is HOST TARGET binding site found in the 3' untranslated region of mRNA encoded by LOC151391, corresponding to a HOST TARGET binding site such as BINDING SITE I, BINDING SITE II or BINDING SITE III. Table 2 illustrates the complementarity of the nucleotide sequences of LOC151391 BINDING SITE, designated SEQ ID:41335, to the nucleotide sequence of VGAM1314 RNA, herein designated VGAM RNA, also designated SEQ ID:4025.

Another function of VGAM1314 is therefore inhibition of LOC151391 (Accession XM_098050). Accordingly, utilities of VGAM1314 include diagnosis, prevention and treatment of diseases and clinical conditions associated with LOC151391. LOC152200 (Accession XM_098174) is another VGAM1314 host target gene. LOC152200 BINDING SITE is HOST TARGET binding site found in the 3' untranslated region of mRNA encoded by LOC152200, corresponding to a HOST TARGET binding site such as BINDING SITE I, BINDING SITE II or BINDING SITE III. Table 2 illustrates the complementarity of the nucleotide sequences of LOC152200 BINDING SITE, designated SEQ ID:41439, to the nucleotide sequence of VGAM1314 RNA, herein designated VGAM RNA, also designated SEQ ID:4025.

Another function of VGAM1314 is therefore inhibition of LOC152200 (Accession XM_098174). Accordingly, utilities of VGAM1314 include diagnosis, prevention and treatment of diseases and clinical conditions associated with LOC152200. LOC154788 (Accession XM_098607) is another VGAM1314 host target gene. LOC154788 BINDING SITE is HOST TARGET binding site found in the 3' untranslated region of mRNA encoded by LOC154788, corresponding to a HOST TARGET binding site such as BINDING SITE I, BINDING SITE II or BINDING SITE III. Table 2 illustrates the complementarity of the nucleotide sequences of LOC154788 BINDING SITE, designated SEQ ID:41726, to the nucleotide sequence of VGAM1314 RNA, herein designated VGAM RNA, also designated SEQ ID:4025.

Another function of VGAM1314 is therefore inhibition of LOC154788 (Accession XM_098607). Accordingly, utilities of VGAM1314 include diagnosis, prevention and treatment of diseases and clinical conditions associated with LOC154788. LOC219505 (Accession XM_166086) is another VGAM1314 host target gene. LOC219505 BINDING SITE is HOST TARGET binding site found in the 5' untranslated region of mRNA encoded by LOC219505, corresponding to a HOST TARGET binding site such as BINDING SITE I, BINDING SITE II or BINDING SITE III. Table 2 illustrates the complementarity of the nucleotide sequences of LOC219505 BINDING SITE, designated SEQ ID:43853, to the nucleotide sequence of VGAM1314 RNA, herein designated VGAM RNA, also designated SEQ ID:4025.

Another function of VGAM1314 is therefore inhibition of LOC219505 (Accession XM_166086). Accordingly, utilities of VGAM1314 include diagnosis, prevention and treatment of diseases and clinical conditions associated with LOC219505. LOC219988 (Accession XM_166223) is another VGAM1314 host target gene. LOC219988 BINDING SITE is HOST TARGET binding site found in the 5' untranslated region of mRNA encoded by LOC219988, corresponding to a HOST TARGET binding site such as BINDING SITE I, BINDING SITE II or BINDING SITE III. Table 2 illustrates the complementarity of the nucleotide sequences of LOC219988 BINDING SITE, designated SEQ ID:44043, to the nucleotide sequence of VGAM1314 RNA, herein designated VGAM RNA, also designated SEQ ID:4025.

Another function of VGAM1314 is therefore inhibition of LOC219988 (Accession XM_166223). Accordingly, utilities of VGAM1314 include diagnosis, prevention and treatment of diseases and clinical conditions associated with LOC219988. LOC222936 (Accession XM_170043) is another VGAM1314 host target gene. LOC222936 BINDING SITE is HOST TARGET binding site found in the 5' untranslated region of mRNA encoded by LOC222936, corresponding to a HOST TARGET binding site such as BINDING SITE I, BINDING SITE II or BINDING SITE III. Table 2 illustrates the complementarity of the nucleotide sequences of LOC222936 BINDING SITE, designated SEQ ID:45309, to the nucleotide sequence of VGAM1314 RNA, herein designated VGAM RNA, also designated SEQ ID:4025.

Another function of VGAM1314 is therefore inhibition of LOC222936 (Accession XM_170043). Accordingly, utilities of VGAM1314 include diagnosis, prevention and treatment of diseases and clinical conditions associated with LOC222936. LOC56965 (Accession NM_020213) is another VGAM1314 host target gene. LOC56965 BINDING SITE is HOST TARGET binding site found in the 3' untranslated region of mRNA encoded by LOC56965, corresponding to a HOST TARGET binding site such as BINDING SITE I, BINDING SITE II or BINDING SITE III. Table 2 illustrates the complementarity of the nucleotide sequences of LOC56965 BINDING SITE, designated SEQ ID:21452, to the nucleotide sequence of VGAM1314 RNA, herein designated VGAM RNA, also designated SEQ ID:4025.

Another function of VGAM1314 is therefore inhibition of LOC56965 (Accession NM_020213). Accordingly, utilities of VGAM1314 include diagnosis, prevention and treatment of diseases and clinical conditions associated with LOC56965. LOC85414 (Accession NM_033102) is another VGAM1314 host target gene. LOC85414 BINDING SITE is HOST TARGET binding site found in the 3' untranslated region of mRNA encoded by LOC85414, corresponding to a HOST TARGET binding site such as BINDING SITE I, BINDING SITE II or BINDING SITE III. Table 2 illustrates the complementarity of the nucleotide sequences of LOC85414 BINDING SITE, designated SEQ ID:26951, to the nucleotide sequence of VGAM1314 RNA, herein designated VGAM RNA, also designated SEQ ID:4025.

Another function of VGAM1314 is therefore inhibition of LOC85414 (Accession NM_033102). Accordingly, utilities of VGAM1314 include diagnosis, prevention and treatment of diseases and clinical conditions associated with LOC85414. FIG. 1 further provides a conceptual description of a novel bioinformatically detected viral gene of the present invention, referred to here as Viral Genomic Address Messenger 1315 (VGAM1315) viral gene, which modulates expression of respective host target genes thereof, the function and utility of which host target genes is known in the art.

VGAM1315 is a novel bioinformatically detected regulatory, non protein coding, viral micro RNA (miRNA) gene. The method by which VGAM1315 was detected is described hereinabove with reference to FIGS. 1-8.

VGAM1315 gene, herein designated VGAM GENE, is a viral gene contained in the genome of Foot-and-mouth Disease Virus C. VGAM1315 host target gene, herein designated VGAM HOST TARGET GENE, is a human gene contained in the human genome.

VGAM1315 gene encodes a VGAM1315 precursor RNA, herein designated VGAM PRECURSOR RNA. Similar to other miRNA genes, and unlike most ordinary genes, VGAM1315 precursor RNA does not encode a protein. A nucleotide sequence identical or highly similar to the nucleotide sequence of VGAM1315 precursor RNA is designated SEQ ID:1301, and is provided hereinbelow with reference to the sequence listing part. Nucleotide sequence SEQ ID:1301 is located at position 7067 relative to the genome of Foot-and-mouth Disease Virus C.

VGAM1315 precursor RNA folds onto itself, forming VGAM1315 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1315 folded precursor RNA into VGAM1315 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 86%) nucleotide sequence of VGAM1315 RNA is designated SEQ ID:4026, and is provided hereinbelow with reference to the sequence listing part.

VGAM1315 host target gene, herein designated VGAM HOST TARGET GENE, encodes a corresponding messenger RNA, VGAM1315 host target RNA, herein designated VGAM HOST TARGET RNA. VGAM1315 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1315 RNA, herein designated VGAM RNA, binds complementarily to one or more host target binding sites located in untranslated regions of VGAM1315 host target RNA, herein designated VGAM HOST TARGET RNA. This complementary binding is due to the fact that the nucleotide sequence of VGAM1315 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1315 RNA, herein designated VGAM RNA, may have a different number of host target binding sites in untranslated regions of a VGAM1315 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1315 RNA, herein designated VGAM RNA, to host target binding sites on VGAM1315 host target RNA, herein designated VGAM HOST TARGET RNA, such as BINDING SITE I, BINDING SITE II and BINDING SITE III, inhibits translation of VGAM1315 host target RNA into VGAM1315 host target protein, herein designated VGAM HOST TARGET PROTEIN. VGAM host target protein is therefore outlined by a broken line.

It is appreciated that VGAM1315 host target gene, herein designated VGAM HOST TARGET GENE, in fact represents a plurality of VGAM1315 host target genes. The mRNA of each one of this plurality of VGAM1315 host target genes comprises one or more host target binding sites, each having a nucleotide sequence which is at least partly complementary to VGAM1315 RNA, herein designated VGAM RNA, and which when bound by VGAM1315 RNA causes inhibition of translation of respective one or more VGAM1315 host target proteins.

It is further appreciated by one skilled in the art that the mode of translational inhibition illustrated by FIG. 1 with specific reference to translational inhibition exerted by VGAM1315 gene, herein designated VGAM GENE, on one or more VGAM1315 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1315 is inhibition of expression of host target genes, as part of a novel viral mechanism of attacking a host. Accordingly, utilities of VGAM1315 include diagnosis, prevention and treatment of viral infection by Foot-and-mouth Disease Virus C. Specific functions, and accordingly utilities, of VGAM1315 correlate with, and may be deduced from, the identity of the host target genes which VGAM1315 binds and inhibits, and the function of these host target genes, as elaborated hereinbelow.

Nucleotide sequences of the VGAM1315 precursor RNA, herein designated VGAM PRECURSOR RNA, and of the 'diced' VGAM1315 RNA, herein designated VGAM RNA, and a schematic representation of the secondary folding of VGAM1315 folded precursor RNA, herein designated VGAM FOLDED PRECURSOR RNA, of VGAM1315 are further described hereinbelow with reference to Table 1.

Nucleotide sequences of host target binding sites, such as BINDING SITE-I, BINDING SITE-II and BINDING SITE-III of FIG. 1, found on VGAM1315 host target RNA, and schematic representation of the complementarity of each of these host target binding sites to VGAM1315 RNA, herein designated VGAM RNA, are described hereinbelow with reference to Table 2.

As mentioned hereinabove with reference to FIG. 1, a function of VGAM1315 gene, herein designated VGAM is inhibition of expression of VGAM1315 target genes. It is appreciated that specific functions, and accordingly utilities, of VGAM1315 correlate with, and may be deduced from, the identity of the target genes which VGAM1315 binds and inhibits, and the function of these target genes, as elaborated hereinbelow.

Ca2+-dependent Activator Protein For Secretion (CADPS, Accession XM_036915) is a VGAM1315 host target gene. CADPS BINDING SITE is HOST TARGET binding site found in the 3' untranslated region of mRNA encoded by CADPS, corresponding to a HOST TARGET binding site such as BINDING SITE I, BINDING SITE II or BINDING SITE III. Table 2 illustrates the complementarity of the nucleotide sequences of CADPS BINDING SITE, designated SEQ ID:32507, to the nucleotide sequence of VGAM1315 RNA, herein designated VGAM RNA, also designated SEQ ID:4026.

A function of VGAM1315 is therefore inhibition of Ca2+-dependent Activator Protein For Secretion (CADPS, Accession XM_036915), a gene which is required for the Ca2+-regulated exocytosis of secretory vesicles. Accordingly, utilities of VGAM1315 include diagnosis, prevention and treatment of diseases and clinical conditions associated with CADPS. The function of CADPS has been established by previous studies. Calcium-activated secretion in neuroendocrine cells is dependent on ATP and cytosolic proteins such as NSF (OMIM Ref. No. 601633), SNAPs (see OMIM Ref. No. 603215) GTP-binding proteins, and components of a vesicle coat complex. Walent et al. (1992) isolated a rat cytosolic factor, which they termed p145, that reconstitutes Ca (2+)-activated secretion via dense core vesicle exocytosis in permeable neuroendocrine cells. The protein is a dimer of 145-kD subunits. By screening rat brain cDNA libraries with anti-p145, Ann et al. (1997) obtained a cDNA encoding a protein of 1,289 amino acids, which they designated CAPS. Sequence analysis revealed an overall hydrophilic protein with 2 potential coiled-coil regions. Northern blot analysis on mRNA from human tissue revealed expression of a 5.6-kb transcript in brain, pancreas, hypothalamus, pituitary, and adrenal, but not in heart, placenta, lung, liver, skeletal muscle, or kidney. The sequence of rat CAPS is 75% similar and 54% identical to that of C. elegans UNC31; loss-of-function UNC31 mutants exhibit multiple nervous system defects. Equilibrium dialysis studies showed that CAPS is a calcium-binding protein. By subcellular fractionation of isolated rat presynaptic nerve terminals, or synaptosomes, Berwin et al. (1998) determined that CAPS is primarily associated with plasma membranes and large dense core vesicles but not with small clear synaptic vesicles.

Full details of the abovementioned studies are described in the following publications, the disclosure of which are hereby incorporated by reference:

Walent, J. H.; Porter, B. W.; Martin, T. F. J.: A novel 145 kd brain cytosolic protein reconstitutes Ca (2+)-regulated secretion in permeable neuroendocrine cells. Cell 70:765-775, 1992; and Ann, K.; Kowalchyk, J. A.; Loyet, K. M.; Martin, T. F. J.: Novel Ca (2+)-binding protein (CAPS) related to UNC-31 required for Ca (2+)-activated exocytosis. J. Biol. Chem. 272:19637-1964.

Further studies establishing the function and utilities of CADPS are found in John Hopkins OMIM database record ID 604667, and in sited publications numbered 7478-7481 listed in the bibliography section hereinbelow, which are also hereby incorporated by reference. Cyclin D2 (CCND2, Accession NM_001759) is another VGAM1315 host target gene. CCND2 BINDING SITE is HOST TARGET binding site found in the 3' untranslated region of mRNA encoded by CCND2, corresponding to a HOST TARGET binding site such as BINDING SITE I, BINDING SITE II or BINDING SITE III. Table 2 illustrates the complementarity of the nucleotide sequences of CCND2 BINDING SITE, designated SEQ ID:7515, to the nucleotide sequence of VGAM1315 RNA, herein designated VGAM RNA, also designated SEQ ID:4026.

Another function of VGAM1315 is therefore inhibition of Cyclin D2 (CCND2, Accession NM_001759), a gene which is essential for the control of the cell cycle at the g1/s (start) transition. Accordingly, utilities of VGAM1315 include diagnosis, prevention and treatment of diseases and clinical conditions associated with CCND2. The function of CCND2 and its association with various diseases and clinical conditions, has been established by previous studies, as described hereinabove with reference to VGAM128. EphB4 (EPHB4, Accession NM_004444) is another VGAM1315 host target gene. EPHB4 BINDING SITE is HOST TARGET binding site found in the 3' untranslated region of mRNA encoded by EPHB4, corresponding to a HOST TARGET binding site such as BINDING SITE I, BINDING SITE II or BINDING SITE III. Table 2 illustrates the complementarity of the nucleotide sequences of EPHB4 BINDING SITE, designated SEQ ID:10739, to the nucleotide sequence of VGAM1315 RNA, herein designated VGAM RNA, also designated SEQ ID:4026.

Another function of VGAM1315 is therefore inhibition of EphB4 (EPHB4, Accession NM_004444), a gene which receptor for members of the ephrin-b family. binds to ephrin-b2. Accordingly, utilities of VGAM1315 include diagnosis, prevention and treatment of diseases and clinical conditions associated with EPHB4. The function of EPHB4 and its association with various diseases and clinical conditions, has been established by previous studies, as described hereinabove with reference to VGAM808. Lysosomal-associated Membrane Protein 2 (LAMP2, Accession NM_013995) is another VGAM1315 host target gene. LAMP2 BINDING SITE is HOST TARGET binding site found in the 3' untranslated region of mRNA encoded by LAMP2, corresponding to a HOST TARGET binding site such as BINDING SITE I, BINDING SITE II or BINDING SITE III. Table 2 illustrates the complementarity of the nucleotide sequences of LAMP2 BINDING SITE, designated SEQ ID:15185, to the nucleotide sequence of VGAM1315 RNA, herein designated VGAM RNA, also designated SEQ ID:4026.

Another function of VGAM1315 is therefore inhibition of Lysosomal-associated Membrane Protein 2 (LAMP2, Accession NM_013995). Accordingly, utilities of VGAM1315 include diagnosis, prevention and treatment of diseases and clinical conditions associated with LAMP2. LIM Domain Containing Preferred Translocation Partner In Lipoma (LPP, Accession NM_005578) is another VGAM1315 host target gene. LPP BINDING SITE is HOST TARGET binding site found in the 3' untranslated region of mRNA encoded by LPP, corresponding to a HOST TARGET binding site such as BINDING SITE I, BINDING SITE II or BINDING SITE III. Table 2 illustrates the complementarity of the nucleotide sequences of LPP BINDING SITE, designated SEQ ID:12107, to the nucleotide sequence of VGAM1315 RNA, herein designated VGAM RNA, also designated SEQ ID:4026.

Another function of VGAM1315 is therefore inhibition of LIM Domain Containing Preferred Translocation Partner In Lipoma (LPP, Accession NM_005578). Accordingly, utilities of VGAM1315 include diagnosis, prevention and treatment of diseases and clinical conditions associated with LPP. Low Density Lipoprotein Receptor-related Protein 4 (LRP4, Accession XM_035037) is another VGAM1315 host target gene. LRP4 BINDING SITE is HOST TARGET binding site found in the 5' untranslated region of mRNA encoded by LRP4, corresponding to a HOST TARGET binding site such as BINDING SITE I, BINDING SITE II or BINDING SITE III. Table 2 illustrates the complementarity of the nucleotide sequences of LRP4 BINDING SITE, designated SEQ ID:32200, to the nucleotide sequence of VGAM1315 RNA, herein designated VGAM RNA, also designated SEQ ID:4026.

Another function of VGAM1315 is therefore inhibition of Low Density Lipoprotein Receptor-related Protein 4 (LRP4, Accession XM_035037). Accordingly, utilities of VGAM1315 include diagnosis, prevention and treatment of diseases and clinical conditions associated with LRP4. Antigen Identified By Monoclonal Antibody MRC OX-2 (MOX2, Accession XM_039962) is another VGAM1315 host target gene. MOX2 BINDING SITE is HOST TARGET binding site found in the 3' untranslated region of mRNA encoded by MOX2, corresponding to a HOST TARGET binding site such as BINDING SITE I, BINDING SITE II or BINDING SITE III. Table 2 illustrates the complementarity of the nucleotide sequences of MOX2 BINDING SITE, designated SEQ ID:33236, to the nucleotide sequence of VGAM1315 RNA, herein designated VGAM RNA, also designated SEQ ID:4026.

Another function of VGAM1315 is therefore inhibition of Antigen Identified By Monoclonal Antibody MRC OX-2 (MOX2, Accession XM_039962). Accordingly, utilities of VGAM1315 include diagnosis, prevention and treatment of diseases and clinical conditions associated with MOX2. Nebulin-related Anchoring Protein (NRAP, Accession NM_006175) is another VGAM1315 host target gene. NRAP BINDING SITE is HOST TARGET binding site found in the 3' untranslated region of mRNA encoded by NRAP, corresponding to a HOST TARGET binding site such as BINDING SITE I, BINDING SITE II or BINDING SITE III. Table 2 illustrates the complementarity of the nucleotide sequences of NRAP BINDING SITE, designated SEQ ID:12833, to the nucleotide sequence of VGAM1315 RNA, herein designated VGAM RNA, also designated SEQ ID:4026.

Another function of VGAM1315 is therefore inhibition of Nebulin-related Anchoring Protein (NRAP, Accession NM_006175), a gene which performs an anchoring function to link the terminal actin filaments of myofibrils to protein complexes located beneath the sarcolemma. Accordingly, utilities of VGAM1315 include diagnosis, prevention and treatment of diseases and clinical conditions associated with NRAP. The function of NRAP and its association with various diseases and clinical conditions, has been established by previous studies, as described hereinabove with reference to VGAM649. Pinin, Desmosome Associated Protein (PNN, Accession XM_048719) is another VGAM1315 host target gene. PNN BINDING SITE is HOST TARGET binding site found in the 3' untranslated region of mRNA encoded by PNN, corresponding to a HOST TARGET binding site such as BINDING SITE I, BINDING SITE II or BINDING SITE III. Table 2 illustrates the complementarity of the nucleotide sequences of PNN BINDING SITE, designated SEQ ID:35232, to the nucleotide sequence of VGAM1315 RNA, herein designated VGAM RNA, also designated SEQ ID:4026.

Another function of VGAM1315 is therefore inhibition of Pinin, Desmosome Associated Protein (PNN, Accession XM_048719), a gene which reinforces the intermediate filament-desmosome complex. Accordingly, utilities of VGAM1315 include diagnosis, prevention and treatment of diseases and clinical conditions associated with PNN. The function of PNN and its association with various diseases and clinical conditions, has been established by previous studies, as described hereinabove with reference to VGAM120. Palmitoyl-protein Thioesterase 1 (ceroid-lipofuscinosis, neuronal 1, infantile) (PPT1, Accession XM_029842) is another VGAM1315 host target gene. PPT1 BINDING SITE is HOST TARGET binding site found in the 3' untranslated region of mRNA encoded by PPT1, corresponding to a HOST TARGET binding site such as BINDING SITE I, BINDING SITE II or BINDING SITE III. Table 2 illustrates the complementarity of the nucleotide sequences of PPT1 BINDING SITE, designated SEQ ID:30955, to the nucleotide sequence of VGAM1315 RNA, herein designated VGAM RNA, also designated SEQ ID:4026.

Another function of VGAM1315 is therefore inhibition of Palmitoyl-protein Thioesterase 1 (ceroid-lipofuscinosis, neuronal 1, infantile) (PPT1, Accession XM_029842). Accordingly, utilities of VGAM1315 include diagnosis, prevention and treatment of diseases and clinical conditions associated with PPT1. Sorting Nexin 5 (SNX5, Accession NM_014426) is another VGAM1315 host target gene. SNX5 BINDING SITE is HOST TARGET binding site found in the 3' untranslated region of mRNA encoded by SNX5, corresponding to a HOST TARGET binding site such as BINDING SITE I, BINDING SITE II or BINDING SITE III. Table 2 illustrates the complementarity of the nucleotide sequences of SNX5 BINDING SITE, designated SEQ ID:15784, to the nucleotide sequence of VGAM1315 RNA, herein designated VGAM RNA, also designated SEQ ID:4026.

Another function of VGAM1315 is therefore inhibition of Sorting Nexin 5 (SNX5, Accession NM_014426). Accordingly, utilities of VGAM1315 include diagnosis, prevention and treatment of diseases and clinical conditions associated with SNX5. Transient Receptor Potential Cation Channel, Subfamily M, Member 6 (TRPM6, Accession NM_017662) is another VGAM1315 host target gene. TRPM6 BINDING SITE is HOST TARGET binding site found in the 3' untranslated region of mRNA encoded by TRPM6, corresponding to a HOST TARGET binding site such as BINDING SITE I, BINDING SITE II or BINDING SITE III. Table 2 illustrates the complementarity of the nucleotide sequences of TRPM6 BINDING SITE, designated SEQ ID:19195, to the nucleotide sequence of VGAM1315 RNA, herein designated VGAM RNA, also designated SEQ ID:4026.

Another function of VGAM1315 is therefore inhibition of Transient Receptor Potential Cation Channel, Subfamily M, Member 6 (TRPM6, Accession NM_017662), a gene which contains a predicted ion channel domain and a protein kinase domain. Accordingly, utilities of VGAM1315 include diagnosis, prevention and treatment of diseases and clinical conditions associated with TRPM6. The function of TRPM6 and its association with various diseases and clinical conditions, has been established by previous studies, as described hereinabove with reference to VGAM173. Vitronectin (serum spreading factor, somatomedin B, complement S-protein) (VTN, Accession NM_000638) is another VGAM1315 host target gene. VTN BINDING SITE is HOST TARGET binding site found in the 5' untranslated region of mRNA encoded by VTN, corresponding to a HOST TARGET binding site such as BINDING SITE I, BINDING SITE II or BINDING SITE III. Table 2 illustrates the complementarity of the nucleotide sequences of VTN BINDING SITE, designated SEQ ID:6272, to the nucleotide sequence of VGAM1315 RNA, herein designated VGAM RNA, also designated SEQ ID:4026.

Another function of VGAM1315 is therefore inhibition of Vitronectin (serum spreading factor, somatomedin B, complement S-protein) (VTN, Accession NM_000638), a gene which is a cell adhesion and spreading factor found in serum and tissues. Accordingly, utilities of VGAM1315 include diagnosis, prevention and treatment of diseases and clinical conditions associated with VTN. The function of VTN and its association with various diseases and clinical conditions, has been established by previous studies, as described hereinabove with reference to VGAM850. Angiomotin (AMOT, Accession NM_133265) is another VGAM1315 host target gene. AMOT BINDING SITE is HOST TARGET binding site found in the 3' untranslated region of mRNA encoded by AMOT, corresponding to a HOST TARGET binding site such as BINDING SITE I, BINDING SITE II or BINDING SITE III. Table 2 illustrates the complementarity of the nucleotide sequences of AMOT BINDING SITE, designated SEQ ID:28413, to the nucleotide sequence of VGAM1315 RNA, herein designated VGAM RNA, also designated SEQ ID:4026.

Another function of VGAM1315 is therefore inhibition of Angiomotin (AMOT, Accession NM_133265). Accordingly, utilities of VGAM1315 include diagnosis, prevention and treatment of diseases and clinical conditions associated with AMOT. DEAD/H (Asp-Glu-Ala-Asp/His) Box Polypeptide 39 (DDX39, Accession NM_138998) is another VGAM1315 host target gene. DDX39 BINDING SITE is HOST TARGET binding site found in the 3' untranslated region of mRNA encoded by DDX39, corresponding to a HOST TARGET binding site such as BINDING SITE I, BINDING SITE II or BINDING SITE III. Table 2 illustrates the complementarity of the nucleotide sequences of DDX39 BINDING SITE, designated SEQ ID:29096, to the nucleotide sequence of VGAM1315 RNA, herein designated VGAM RNA, also designated SEQ ID:4026.

Another function of VGAM1315 is therefore inhibition of DEAD/H (Asp-Glu-Ala-Asp/His) Box Polypeptide 39 (DDX39, Accession NM_138998). Accordingly, utilities of VGAM1315 include diagnosis, prevention and treatment of diseases and clinical conditions associated with DDX39. DKFZP434K2235 (Accession XM_096869) is another VGAM1315 host target gene. DKFZP434K2235 BINDING SITE is HOST TARGET binding site found in the 3' untranslated region of mRNA encoded by DKFZP434K2235, corresponding to a HOST TARGET binding site such as BINDING SITE I, BINDING SITE II or BINDING SITE III. Table 2 illustrates the complementarity of the nucleotide sequences of DKFZP434K2235 BINDING SITE, designated SEQ ID:40594, to the nucleotide sequence of VGAM1315 RNA, herein designated VGAM RNA, also designated SEQ ID:4026.

Another function of VGAM1315 is therefore inhibition of DKFZP434K2235 (Accession XM_096869). Accordingly, utilities of VGAM1315 include diagnosis, prevention and treatment of diseases and clinical conditions associated with DKFZP434K2235. DKFZP564O0423 (Accession XM_166254) is another VGAM1315 host target gene. DKFZP564O0423 BINDING SITE is HOST TARGET binding site found in the 3' untranslated region of mRNA encoded by DKFZP564O0423, corresponding to a HOST TARGET binding site such as BINDING SITE I, BINDING SITE II or BINDING SITE III. Table 2 illustrates the complementarity of the nucleotide sequences of DKFZP564O0423 BINDING SITE, designated SEQ ID:44063, to the nucleotide sequence of VGAM1315 RNA, herein designated VGAM RNA, also designated SEQ ID:4026.

Another function of VGAM1315 is therefore inhibition of DKFZP564O0423 (Accession XM_166254). Accordingly, utilities of VGAM1315 include diagnosis, prevention and treatment of diseases and clinical conditions associated with DKFZP564O0423. DnaJ (Hsp40) Homolog, Subfamily C, Member 6 (DNAJC6, Accession NM_014787) is another VGAM1315 host target gene. DNAJC6 BINDING SITE is HOST TARGET binding site found in the 3' untranslated region of mRNA encoded by DNAJC6, corresponding to a HOST TARGET binding site such as BINDING SITE I, BINDING SITE II or BINDING SITE III. Table 2 illustrates the complementarity of the nucleotide sequences of DNAJC6 BINDING SITE, designated SEQ ID:16659, to the nucleotide sequence of VGAM1315 RNA, herein designated VGAM RNA, also designated SEQ ID:4026.

Another function of VGAM1315 is therefore inhibition of DnaJ (Hsp40) Homolog, Subfamily C, Member 6 (DNAJC6, Accession NM_014787). Accordingly, utilities of VGAM1315 include diagnosis, prevention and treatment of diseases and clinical conditions associated with DNAJC6. Dual-specificity tyrosine-(Y)-phosphorylation Regulated Kinase 4 (DYRK4, Accession XM_034551) is another VGAM1315 host target gene. DYRK4 BINDING SITE is HOST TARGET binding site found in the 5' untranslated region of mRNA encoded by DYRK4, corresponding to a HOST TARGET binding site such as BINDING SITE I, BINDING SITE II or BINDING SITE III. Table 2 illustrates the complementarity of the nucleotide sequences of DYRK4 BINDING SITE, designated SEQ ID:32122, to the nucleotide sequence of VGAM1315 RNA, herein designated VGAM RNA, also designated SEQ ID:4026.

Another function of VGAM1315 is therefore inhibition of Dual-specificity tyrosine-(Y)-phosphorylation Regulated Kinase 4 (DYRK4, Accession XM_034551). Accordingly, utilities of VGAM1315 include diagnosis, prevention and treatment of diseases and clinical conditions associated with DYRK4. EFA6R (Accession NM_015310) is another VGAM1315 host target gene. EFA6R BINDING SITE is HOST TARGET binding site found in the 3" untranslated region of mRNA encoded by EFA6R, corresponding to a HOST TARGET binding site such as BINDING SITE I, BINDING SITE II or BINDING SITE III. Table 2 illustrates the complementarity of the nucleotide sequences of EFA6R BINDING SITE, designated SEQ ID:17624, to the nucleotide sequence of VGAM1315 RNA, herein designated VGAM RNA, also designated SEQ ID:4026.

Another function of VGAM1315 is therefore inhibition of EFA6R (Accession NM_015310). Accordingly, utilities of VGAM1315 include diagnosis, prevention and treatment of diseases and clinical conditions associated with EFA6R. FBP17 (Accession XM_052666) is another VGAM1315 host target gene. FBP17 BINDING SITE is HOST TARGET binding site found in the 5' untranslated region of mRNA encoded by FBP17, corresponding to a HOST TARGET binding site such as BINDING SITE I, BINDING SITE II or BINDING SITE III. Table 2 illustrates the complementarity of the nucleotide sequences of FBP17 BINDING SITE, designated SEQ ID:36046, to the nucleotide sequence of VGAM1315 RNA, herein designated VGAM RNA, also designated SEQ ID:4026.

Another function of VGAM1315 is therefore inhibition of FBP17 (Accession XM_052666). Accordingly, utilities of VGAM1315 include diagnosis, prevention and treatment of diseases and clinical conditions associated with FBP17. FLJ10420 (Accession NM_018090) is another VGAM1315 host target gene. FLJ10420 BINDING SITE is HOST TARGET binding site found in the 3' untranslated region of mRNA encoded by FLJ10420, corresponding to a HOST TARGET binding site such as BINDING SITE I, BINDING SITE II or BINDING SITE III. Table 2 illustrates the complementarity of the nucleotide sequences of FLJ10420 BINDING SITE, designated SEQ ID:19855, to the nucleotide sequence of VGAM1315 RNA, herein designated VGAM RNA, also designated SEQ ID:4026.

Another function of VGAM1315 is therefore inhibition of FLJ10420 (Accession NM_018090). Accordingly, utilities of VGAM1315 include diagnosis, prevention and treatment of diseases and clinical conditions associated with FLJ10420. FLJ13409 (Accession NM_024617) is another VGAM1315 host target gene. FLJ13409 BINDING SITE is HOST TARGET binding site found in the 3' untranslated region of mRNA encoded by FLJ13409, corresponding to a HOST TARGET binding site such as BINDING SITE I, BINDING SITE II or BINDING SITE III. Table 2 illustrates the complementarity of the nucleotide sequences of FLJ13409 BINDING SITE, designated SEQ ID:23878, to the nucleotide sequence of VGAM1315 RNA, herein designated VGAM RNA, also designated SEQ ID:4026.

Another function of VGAM1315 is therefore inhibition of FLJ13409 (Accession NM_024617). Accordingly, utilities of VGAM1315 include diagnosis, prevention and treatment of diseases and clinical conditions associated with FLJ13409. FLJ13782 (Accession NM_024915) is another VGAM1315 host target gene. FLJ13782 BINDING SITE is HOST TARGET binding site found in the 3' untranslated region of mRNA encoded by FLJ13782, corresponding to a HOST TARGET binding site such as BINDING SITE I, BINDING SITE II or BINDING SITE III. Table 2 illustrates the complementarity of the nucleotide sequences of FLJ13782 BINDING SITE, designated SEQ ID:24437, to the nucleotide sequence of VGAM1315 RNA, herein designated VGAM RNA, also designated SEQ ID:4026.

Another function of VGAM1315 is therefore inhibition of FLJ13782 (Accession NM_024915). Accordingly, utilities of VGAM1315 include diagnosis, prevention and treatment of diseases and clinical conditions associated with FLJ13782. FLJ20343 (Accession NM_017775) is another VGAM1315 host target gene. FLJ20343 BINDING SITE is HOST TARGET binding site found in the 3' untranslated region of mRNA encoded by FLJ20343, corresponding to a HOST TARGET binding site such as BINDING SITE I, BINDING SITE II or BINDING SITE III. Table 2 illustrates the complementarity of the nucleotide sequences of FLJ20343 BINDING SITE, designated SEQ ID:19399, to the nucleotide sequence of VGAM1315 RNA, herein designated VGAM RNA, also designated SEQ ID:4026.

Another function of VGAM1315 is therefore inhibition of FLJ20343 (Accession NM_017775). Accordingly, utilities of VGAM1315 include diagnosis, prevention and treatment of diseases and clinical conditions associated with FLJ20343. FLJ21125 (Accession NM_024627) is another VGAM1315 host target gene. FLJ21125 BINDING SITE is HOST TARGET binding site found in the 3' untranslated region of mRNA encoded by FLJ21125, corresponding to a HOST TARGET binding site such as BINDING SITE I, BINDING SITE II or BINDING SITE III. Table 2 illustrates the complementarity of the nucleotide sequences of FLJ21125 BINDING SITE, designated SEQ ID:23891, to the nucleotide sequence of VGAM1315 RNA, herein designated VGAM RNA, also designated SEQ ID:4026.

Another function of VGAM1315 is therefore inhibition of FLJ21125 (Accession NM_024627). Accordingly, utilities of VGAM1315 include diagnosis, prevention and treatment of diseases and clinical conditions associated with FLJ21125. FLJ22009 (Accession XM_015700) is another VGAM1315 host target gene. FLJ22009 BINDING SITE is HOST TARGET binding site found in the 3' untranslated region of mRNA encoded by FLJ22009, corresponding to a HOST TARGET binding site such as BINDING SITE I, BINDING SITE II or BINDING SITE III. Table 2 illustrates the complementarity of the nucleotide sequences of FLJ22009 BINDING SITE, designated SEQ ID:30243, to the nucleotide sequence of VGAM1315 RNA, herein designated VGAM RNA, also designated SEQ ID:4026.

Another function of VGAM1315 is therefore inhibition of FLJ22009 (Accession XM_015700). Accordingly, utilities of VGAM1315 include diagnosis, prevention and treatment of diseases and clinical conditions associated with FLJ22009. KIAA0987 (Accession NM_012307) is another VGAM1315 host target gene. KIAA0987 BINDING SITE is HOST TARGET binding site found in the 5' untranslated region of mRNA encoded by KIAA0987, corresponding to a HOST TARGET binding site such as BINDING SITE I, BINDING SITE II or BINDING SITE III. Table 2 illustrates the complementarity of the nucleotide sequences of KIAA0987 BINDING SITE, designated SEQ ID:14676, to the nucleotide sequence of VGAM1315 RNA, herein designated VGAM RNA, also designated SEQ ID:4026.

Another function of VGAM1315 is therefore inhibition of KIAA0987 (Accession NM_012307). Accordingly, utilities of VGAM1315 include diagnosis, prevention and treatment of diseases and clinical conditions associated with KIAA0987. MGC19556 (Accession NM_033551) is another VGAM1315 host target gene. MGC19556 BINDING SITE is HOST TARGET binding site found in the 3' untranslated region of mRNA encoded by MGC19556, corresponding to a HOST TARGET binding site such as BINDING SITE I, BINDING SITE II or BINDING SITE III. Table 2 illustrates the complementarity of the nucleotide sequences of MGC19556 BINDING SITE, designated SEQ ID:27312, to the nucleotide sequence of VGAM1315 RNA, herein designated VGAM RNA, also designated SEQ ID:4026.

Another function of VGAM1315 is therefore inhibition of MGC19556 (Accession NM_033551). Accordingly, utilities of VGAM1315 include diagnosis, prevention and treatment of diseases and clinical conditions associated with MGC19556. VIT1 (Accession NM_018693) is another VGAM1315 host target gene. VIT1 BINDING SITE is HOST TARGET binding site found in the 5' untranslated region of mRNA encoded by VIT1, corresponding to a HOST TARGET binding site such as BINDING SITE I, BINDING SITE II or BINDING SITE III. Table 2 illustrates the complementarity of the nucleotide sequences of VIT1 BINDING SITE, designated SEQ ID:20764, to the nucleotide sequence of VGAM1315 RNA, herein designated VGAM RNA, also designated SEQ ID:4026.

Another function of VGAM1315 is therefore inhibition of VIT1 (Accession NM_018693). Accordingly, utilities of VGAM1315 include diagnosis, prevention and treatment of diseases and clinical conditions associated with VIT1. YME1-like 1 (S. cerevisiae) (YME1L1, Accession NM_014263) is another VGAM1315 host target gene.

YME1L1 BINDING SITE is HOST TARGET binding site found in the 3' untranslated region of mRNA encoded by YME1L1, corresponding to a HOST TARGET binding site such as BINDING SITE I, BINDING SITE II or BINDING SITE III. Table 2 illustrates the complementarity of the nucleotide sequences of YME1L1 BINDING SITE, designated SEQ ID:15535, to the nucleotide sequence of VGAM1315 RNA, herein designated VGAM RNA, also designated SEQ ID:4026.

Another function of VGAM1315 is therefore inhibition of YME1-like 1 (S. cerevisiae) (YME1L1, Accession NM_014263). Accordingly, utilities of VGAM1315 include diagnosis, prevention and treatment of diseases and clinical conditions associated with YME1L1. LOC145483 (Accession XM_085156) is another VGAM1315 host target gene. LOC145483 BINDING SITE is HOST TARGET binding site found in the 3' untranslated region of mRNA encoded by LOC145483, corresponding to a HOST TARGET binding site such as BINDING SITE I, BINDING SITE II or BINDING SITE III. Table 2 illustrates the complementarity of the nucleotide sequences of LOC145483 BINDING SITE, designated SEQ ID:37880, to the nucleotide sequence of VGAM1315 RNA, herein designated VGAM RNA, also designated SEQ ID:4026.

Another function of VGAM1315 is therefore inhibition of LOC145483 (Accession XM_085156). Accordingly, utilities of VGAM1315 include diagnosis, prevention and treatment of diseases and clinical conditions associated with LOC145483. LOC147649 (Accession XM_085830) is another VGAM1315 host target gene. LOC147649 BINDING SITE is HOST TARGET binding site found in the 3' untranslated region of mRNA encoded by LOC147649, corresponding to a HOST TARGET binding site such as BINDING SITE I, BINDING SITE II or BINDING SITE III. Table 2 illustrates the complementarity of the nucleotide sequences of LOC147649 BINDING SITE, designated SEQ ID:38356, to the nucleotide sequence of VGAM1315 RNA, herein designated VGAM RNA, also designated SEQ ID:4026.

Another function of VGAM1315 is therefore inhibition of LOC147649 (Accession XM_085830). Accordingly, utilities of VGAM1315 include diagnosis, prevention and treatment of diseases and clinical conditions associated with LOC147649. LOC151443 (Accession XM_087200) is another VGAM1315 host target gene. LOC151443 BINDING SITE is HOST TARGET binding site found in the 5' untranslated region of mRNA encoded by LOC151443, corresponding to a HOST TARGET binding site such as BINDING SITE I, BINDING SITE II or BINDING SITE III. Table 2 illustrates the complementarity of the nucleotide sequences of LOC151443 BINDING SITE, designated SEQ ID:39115, to the nucleotide sequence of VGAM1315 RNA, herein designated VGAM RNA, also designated SEQ ID:4026.

Another function of VGAM1315 is therefore inhibition of LOC151443 (Accession XM_087200). Accordingly, utilities of VGAM1315 include diagnosis, prevention and treatment of diseases and clinical conditions associated with LOC151443. LOC167153 (Accession XM_094312) is another VGAM1315 host target gene. LOC167153 BINDING SITE is HOST TARGET binding site found in the 5' untranslated region of mRNA encoded by LOC167153, corresponding to a HOST TARGET binding site such as BINDING SITE I, BINDING SITE II or BINDING SITE III. Table 2 illustrates the complementarity of the nucleotide sequences of LOC167153 BINDING SITE, designated SEQ ID:40229, to the nucleotide sequence of VGAM1315 RNA, herein designated VGAM RNA, also designated SEQ ID:4026.

Another function of VGAM1315 is therefore inhibition of LOC167153 (Accession XM_094312). Accordingly, utilities of VGAM1315 include diagnosis, prevention and treatment of diseases and clinical conditions associated with LOC167153. LOC220930 (Accession XM_167624) is another VGAM1315 host target gene. LOC220930 BINDING SITE is HOST TARGET binding site found in the 5' untranslated region of mRNA encoded by LOC220930, corresponding to a HOST TARGET binding site such as BINDING SITE I, BINDING SITE II or BINDING SITE III. Table 2 illustrates the complementarity of the nucleotide sequences of LOC220930 BINDING SITE, designated SEQ ID:44735, to the nucleotide sequence of VGAM1315 RNA, herein designated VGAM RNA, also designated SEQ ID:4026.

Another function of VGAM1315 is therefore inhibition of LOC220930 (Accession XM_167624). Accordingly, utilities of VGAM1315 include diagnosis, prevention and treatment of diseases and clinical conditions associated with LOC220930. LOC220965 (Accession XM_166142) is another VGAM1315 host target gene. LOC220965 BINDING SITE is HOST TARGET binding site found in the 3' untranslated region of mRNA encoded by LOC220965, corresponding to a HOST TARGET binding site such as BINDING SITE I, BINDING SITE II or BINDING SITE III. Table 2 illustrates the complementarity of the nucleotide sequences of LOC220965 BINDING SITE, designated SEQ ID:43946, to the nucleotide sequence of VGAM1315 RNA, herein designated VGAM RNA, also designated SEQ ID:4026.

Another function of VGAM1315 is therefore inhibition of LOC220965 (Accession XM_166142). Accordingly, utilities of VGAM1315 include diagnosis, prevention and treatment of diseases and clinical conditions associated with LOC220965. LOC91286 (Accession XM_037444) is another VGAM1315 host target gene. LOC91286 BINDING SITE is HOST TARGET binding site found in the 3' untranslated region of mRNA encoded by LOC91286, corresponding to a HOST TARGET binding site such as BINDING SITE I, BINDING SITE II or BINDING SITE III. Table 2 illustrates the complementarity of the nucleotide sequences of LOC91286 BINDING SITE, designated SEQ ID:32621, to the nucleotide sequence of VGAM1315 RNA, herein designated VGAM RNA, also designated SEQ ID:4026.

Another function of VGAM1315 is therefore inhibition of LOC91286 (Accession XM_037444). Accordingly, utilities of VGAM1315 include diagnosis, prevention and treatment of diseases and clinical conditions associated with LOC91286. FIG. 1 further provides a conceptual description of a novel bioinformatically detected viral gene of the present invention, referred to here as Viral Genomic Address Messenger 1316 (VGAM1316) viral gene, which modulates expression of respective host target genes thereof, the function and utility of which host target genes is known in the art.

VGAM1316 is a novel bioinformatically detected regulatory, non protein coding, viral micro RNA (miRNA) gene. The method by which VGAM1316 was detected is described hereinabove with reference to FIGS. 1-8.

VGAM1316 gene, herein designated VGAM GENE, is a viral gene contained in the genome of Foot-and-mouth Disease Virus C. VGAM1316 host target gene, herein designated VGAM HOST TARGET GENE, is a human gene contained in the human genome.

VGAM1316 gene encodes a VGAM1316 precursor RNA, herein designated VGAM PRECURSOR RNA. Similar to other miRNA genes, and unlike most ordinary genes, VGAM1316 precursor RNA does not encode a protein. A nucleotide sequence identical or highly similar to the nucleotide sequence of VGAM1316 precursor RNA is designated SEQ ID:1302, and is provided hereinbelow with reference to the sequence listing part. Nucleotide sequence SEQ ID:1302 is located at position 3523 relative to the genome of Foot-and-mouth Disease Virus C.

VGAM1316 precursor RNA folds onto itself, forming VGAM1316 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1316 folded precursor RNA into VGAM1316 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1316 RNA is designated SEQ ID:4027, and is provided hereinbelow with reference to the sequence listing part.

VGAM1316 host target gene, herein designated VGAM HOST TARGET GENE, encodes a corresponding messenger RNA, VGAM1316 host target RNA, herein designated VGAM HOST TARGET RNA. VGAM1316 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1316 RNA, herein designated VGAM RNA, binds complementarily to one or more host target binding sites located in untranslated regions of VGAM1316 host target RNA, herein designated VGAM HOST TARGET RNA. This complementary binding is due to the fact that the nucleotide sequence of VGAM1316 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1316 RNA, herein designated VGAM RNA, may have a different number of host target binding sites in untranslated regions of a VGAM1316 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1316 RNA, herein designated VGAM RNA, to host target binding sites on VGAM1316 host target RNA, herein designated VGAM HOST TARGET RNA, such as BINDING SITE I, BINDING SITE II and BINDING SITE III, inhibits translation of VGAM1316 host target RNA into VGAM1316 host target protein, herein designated VGAM HOST TARGET PROTEIN. VGAM host target protein is therefore outlined by a broken line.

It is appreciated that VGAM1316 host target gene, herein designated VGAM HOST TARGET GENE, in fact represents a plurality of VGAM1316 host target genes. The mRNA of each one of this plurality of VGAM1316 host target genes comprises one or more host target binding sites, each having a nucleotide sequence which is at least partly complementary to VGAM1316 RNA, herein designated VGAM RNA, and which when bound by VGAM1316 RNA causes inhibition of translation of respective one or more VGAM1316 host target proteins.

It is further appreciated by one skilled in the art that the mode of translational inhibition illustrated by FIG. 1 with specific reference to translational inhibition exerted by VGAM1316 gene, herein designated VGAM GENE, on one or more VGAM1316 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1316 is inhibition of expression of host target genes, as part of a novel viral mechanism of attacking a host. Accordingly, utilities of VGAM1316 include diagnosis, prevention and treatment of viral infection by Foot-and-mouth Disease Virus C. Specific functions, and accordingly utilities, of VGAM1316 correlate with, and may be deduced from, the identity of the host target genes which VGAM1316 binds and inhibits, and the function of these host target genes, as elaborated hereinbelow.

Nucleotide sequences of the VGAM1316 precursor RNA, herein designated VGAM PRECURSOR RNA, and of the 'diced' VGAM1316 RNA, herein designated VGAM RNA, and a schematic representation of the secondary folding of VGAM1316 folded precursor RNA, herein designated VGAM FOLDED PRECURSOR RNA, of VGAM1316 are further described hereinbelow with reference to Table 1.

Nucleotide sequences of host target binding sites, such as BINDING SITE-I, BINDING SITE-II and BINDING SITE-III of FIG. 1, found on VGAM1316 host target RNA, and schematic representation of the complementarity of each of these host target binding sites to VGAM1316 RNA, herein designated VGAM RNA, are described hereinbelow with reference to Table 2.

As mentioned hereinabove with reference to FIG. 1, a function of VGAM1316 gene, herein designated VGAM is inhibition of expression of VGAM1316 target genes. It is appreciated that specific functions, and accordingly utilities, of VGAM1316 correlate with, and may be deduced from, the identity of the target genes which VGAM1316 binds and inhibits, and the function of these target genes, as elaborated hereinbelow.

Claudin 14 (CLDN14, Accession NM_144492) is a VGAM1316 host target gene. CLDN14 BINDING SITE is HOST TARGET binding site found in the 5' untranslated region of mRNA encoded by CLDN14, corresponding to a HOST TARGET binding site such as BINDING SITE I, BINDING SITE II or BINDING SITE III. Table 2 illustrates the complementarity of the nucleotide sequences of CLDN14 BINDING SITE, designated SEQ ID:29309, to the nucleotide sequence of VGAM1316 RNA, herein designated VGAM RNA, also designated SEQ ID:4027.

A function of VGAM1316 is therefore inhibition of Claudin 14 (CLDN14, Accession NM_144492), a gene which provides structural support for the auditory neuroepithelium. Accordingly, utilities of VGAM1316 include diagnosis, prevention and treatment of diseases and clinical conditions associated with CLDN14. The function of CLDN14 has been established by previous studies. By sequencing the long arm of chromosome 21, Hattori et al. (2000) identified the CLDN14 gene. Using RACE, Wilcox et al. (2001) amplified a cDNA encoding CLDN14 from human liver cDNA. Comparison of the genomic chromosome 21 sequence with the cDNA sequence indicated that the CLDN14 gene contains 3 exons, and the authors identified 2 splice isoforms, one with and the other without exon 2. Northern blot analysis detected CLDN14 expression in liver and kidney. In situ hybridization and immunofluorescence studies revealed mouse Cldn14 expression in the sensory epithelium of the organ of Corti. By sequence analysis of chromosome 21q, Hattori et al. (2000) mapped the CLDN14 gene to 21q22.3. Wilcox et al. (2001) showed that the profound, congenital, recessive deafness segregating in 2 Pakistani families, PKSN6 and PKSR9a, defines a novel locus, DFNB29, on 21q22.1. These families supported maximum 2-point lod scores of 6.7 at theta of zero for the marker D21S1252 and 6.1 at theta of zero for marker D21S2079, respectively. Critical recombinants and homozygosity for polymorphic markers defined a DFNB29 linkage interval of 228,600 bp on 21q22.1. Since the CLDN14 gene maps within the critical interval and was considered a good candidate, Wilcox et al. (2001) examined the sequence of its single protein-coding exon. In affected individuals of family PKSN6, they identified a homozygous 1-bp deletion (398delT; 605608.0001), while in family PKSR9a they identified a val85-to-asp missense mutation (605608.0002). Val85 is conserved among 12 of the 20 claudins, while isoleucine is present among 5 claudins, and the remaining 3 claudins have either a cysteine or a proline at this position of the consensus molecule. Aspartic acid at position 85 was predicted to affect hydrophobicity and disrupt the predicted secondary structures in transmembrane domain 2.

Full details of the abovementioned studies are described in the following publications, the disclosure of which are hereby incorporated by reference:

Hattori, M.; Fujiyama, A.; Taylor, T. D.; Watanabe, H.; Yada, T.; Park, H.-S.; Toyoda, A.; Ishii, K.; Totoki, Y.; Choi, D.-K.; Groner, Y.; Soeda, E.; and 52 others: The DNA sequence of human chromosome 21. Nature 405:311-319, 2000. Note: Erratum: Nature:407:110 only, 2000; and Wilcox, E. R.; Burton, Q. L.; Naz, S.; Riazuddin, S.; Smith, T. N.; Ploplis, B.; Belyatseva, I.; Ben-Yosef, T.; Liburd, N. A.; Morell, R. J.; Kachar, B.; Wu, D. K.; Griffith, A. J.; Ri.

Further studies establishing the function and utilities of CLDN14 are found in John Hopkins OMIM database record ID 605608, and in sited publications numbered 6766-6767 listed in the bibliography section hereinbelow, which are also hereby incorporated by reference. Ceroid-lipofuscinosis, Neuronal 6, Late Infantile, Variant (CLN6, Accession NM_017882) is another VGAM1316 host target gene. CLN6 BINDING SITE is HOST TARGET binding site found in the 3' untranslated region of mRNA encoded by CLN6, corresponding to a HOST TARGET binding site such as BINDING SITE I, BINDING SITE II or BINDING SITE III. Table 2 illustrates the complementarity of the nucleotide sequences of CLN6 BINDING SITE, designated SEQ ID:19551, to the nucleotide sequence of VGAM1316 RNA, herein designated VGAM RNA, also designated SEQ ID:4027.

Another function of VGAM1316 is therefore inhibition of Ceroid-lipofuscinosis, Neuronal 6, Late Infantile, Variant (CLN6, Accession NM_017882). Accordingly, utilities of VGAM1316 include diagnosis, prevention and treatment of diseases and clinical conditions associated with CLN6. C-terminal Binding Protein 1 (CTBP1, Accession XM_042659) is another VGAM1316 host target gene. CTBP1 BINDING SITE is HOST TARGET binding site found in the 3' untranslated region of mRNA encoded by CTBP1, corresponding to a HOST TARGET binding site such as BINDING SITE I, BINDING SITE II or BINDING SITE III. Table 2 illustrates the complementarity of the nucleotide sequences of CTBP1 BINDING SITE, designated SEQ ID:33729, to the nucleotide sequence of VGAM1316 RNA, herein designated VGAM RNA, also designated SEQ ID:4027.

Another function of VGAM1316 is therefore inhibition of C-terminal Binding Protein 1 (CTBP1, Accession XM_042659), a gene which binds to cellular and viral transcriptional repressors regulated by NAD+ and NADH. Accordingly, utilities of VGAM1316 include diagnosis, prevention and treatment of diseases and clinical conditions associated with CTBP1. The function of CTBP1 has been established by previous studies. Polycomb (Pc) is part of a Pc group (PcG) protein complex that is involved in repression of gene activity during Drosophila and vertebrate development. Using a yeast 2-hybrid assay, Sewalt et al. (1999) found that Xenopus Ctbp1 interacts with Xenopus Pc and that human CTBP2 interacts with PC2 (OMIM Ref. No. 603079), a human Pc homolog. Immunofluorescence studies indicated that CTBP1 and CTBP2 partially colocalize with PC2 in large PcG domains in interphase nuclei. As with PC2, chimeric LexA-CTBP2 and LexA-CTBP1 proteins repressed gene activity when targeted to a reporter gene. Sewalt et al. (1999) suggested that PC2-mediated repression of gene expression involves an association with corepressors such as the CTBPs. They speculated that the interference of the adenoviral E1A protein with the transcription machinery of the infected cell may involve interference with PcG-mediated repression through disruption of the CTBP-PcG interaction. Northern blot analysis revealed that the CTBP1 gene was expressed as a 2.4-kb mRNA in all human tissues tested Zhang et al. (2002) demonstrated that CTBP binding to cellular and viral transcriptional repressors is regulated by NAD+ and NADH, with NADH being 2 to 3 orders of magnitude more effective. Levels of free nuclear nicotinamide adenine dinucleotides, determined using 2-photon microscopy, corresponded to the levels required for half-maximal CTBP binding and were considerably lower than those previously reported. Agents capable of increasing NADH levels stimulated CTBP binding to its partners in vivo and potentiated CTBP-mediated repression. Zhang et al. (2002) proposed that this ability to detect changes in nuclear NAD+/NADH ratio allows CTBP to serve as a redox sensor for transcription.

Full details of the abovementioned studies are described in the following publications, the disclosure of which are hereby incorporated by reference:

Sewalt, R. G. A. B.; Gunster, M. J.; van der Vlag, J.; Satijn, D. P. E.; Otte, A. P.: C-terminal binding protein is a transcriptional repressor that interacts with a specific class of vertebrate polycomb proteins. Molec. Cell. Biol. 19:777-787, 1999; and Zhang, Q.; Piston, D. W.; Goodman, R. H.: Regulation of corepressor function by nuclear NADH. Science 295:1895-1897, 2002.

Further studies establishing the function and utilities of CTBP1 are found in John Hopkins OMIM database record ID 602618, and in sited publications numbered 8463-8468 listed in the bibliography section hereinbelow, which are also hereby incorporated by reference. Chromosome X Open Reading Frame 6 (CXorf6, Accession NM_005491) is another VGAM1316 host target gene. CXorf6 BINDING SITE1 and CXorf6 BINDING SITE2 are HOST TARGET binding sites found in untranslated regions of mRNA encoded by CXorf6, corresponding to HOST TARGET binding sites such as BINDING SITE I, BINDING SITE II or BINDING SITE III. Table 2 illustrates the complementarity of the nucleotide sequences of CXorf6 BINDING SITE1 and CXorf6 BINDING SITE2, designated SEQ ID:11993 and SEQ ID:11992 respectively, to the nucleotide sequence of VGAM1316 RNA, herein designated VGAM RNA, also designated SEQ ID:4027.

Another function of VGAM1316 is therefore inhibition of Chromosome X Open Reading Frame 6 (CXorf6, Accession NM_005491). Accordingly, utilities of VGAM1316 include diagnosis, prevention and treatment of diseases and clinical conditions associated with CXorf6. Dihydrofolate Reductase (DHFR, Accession NM_000791) is another VGAM1316 host target gene. DHFR BINDING SITE is HOST TARGET binding site found in the 5' untranslated region of mRNA encoded by DHFR, corresponding to a HOST TARGET binding site such as BINDING SITE I, BINDING SITE II or BINDING SITE III. Table 2 illustrates the complementarity of the nucleotide sequences of DHFR BINDING SITE, designated SEQ ID:6449, to the nucleotide sequence of VGAM1316 RNA, herein designated VGAM RNA, also designated SEQ ID:4027.

Another function of VGAM1316 is therefore inhibition of Dihydrofolate Reductase (DHFR, Accession NM_000791), a gene which converts dihydrofolate into tetrahydrofolate. Accordingly, utilities of VGAM1316 include diagnosis, prevention and treatment of diseases and clinical conditions associated with DHFR. The function of DHFR and its association with various diseases and clinical conditions, has been established by previous studies, as described hereinabove with reference to VGAM826. Folylpolyglutamate Synthase (FPGS, Accession NM_004957) is another VGAM1316 host target gene. FPGS BINDING SITE is HOST TARGET binding site found in the 3' untranslated region of mRNA encoded by FPGS, corresponding to a HOST TARGET binding site such as BINDING SITE I, BINDING SITE II or BINDING SITE III. Table 2 illustrates the complementarity of the nucleotide sequences of FPGS BINDING SITE, designated SEQ ID:11402, to the nucleotide sequence of VGAM1316 RNA, herein designated VGAM RNA, also designated SEQ ID:4027.

Another function of VGAM1316 is therefore inhibition of Folylpolyglutamate Synthase (FPGS, Accession NM_004957), a gene which is involved in conversion of folates to polyglutamate derivatives. Accordingly, utilities of VGAM1316 include diagnosis, prevention and treatment of diseases and clinical conditions associated with FPGS. The function of FPGS has been established by previous studies. By functional complementation of an Escherichia coli folC mutant, Garrow et al. (1992) cloned a human cDNA for folylpoly (gamma-glutamate) synthetase (FPGS; tetrahydrofolate:L-glutamate gamma-ligase (ADP forming); EC 6.3.2.17). The cDNA encodes a 545-residue protein of Mr 60,128. Expression of the cDNA in E. coli resulted in elevated expression of an enzyme with characteristics of mammalian FPGS. Furthermore, expression of the cDNA in AUXB1, a mammalian cell lacking FPGS activity, overcame the cell's requirement for thymidine and purines but did not overcome the cell's glycine auxotrophy, consistent with expression of the protein in the cytosol but not in the mitochondria. Freemantle et al. (1995) proposed that the mitochondrial and cytosolic forms of FPGS are, in fact, derived from the same gene, arising from the use of the 2 different translation initiation codons, and that the translation products differ by the presence of a 42-residue amino-terminal mitochondrial leader peptide. Taylor et al. (1995) likewise concluded that a single locus encodes FPGS-related sequences in the human genome. The complete 2256 nucleotides of cDNA for the 5-prime untranslated region, mitochondrial leader sequence, coding region, and 3-prime untranslated region were found to be distributed on 15 exons stretching over 11.2 kb of genomic DNA.

Full details of the abovementioned studies are described in the following publications, the disclosure of which are hereby incorporated by reference:

Freemantle, S. J.; Taylor, S. M.; Krystal, G.; Moran, R. G.: Upstream organization of and multiple transcripts from the human folylpoly-gamma-glutamate synthetase gene. J. Biol. Chem. 270:9579-9584, 1995; and Garrow, T. A.; Admon, A.; Shane, B.: Expression cloning of a human cDNA encoding folylpoly (gamma-glutamate) synthetase and determination of its primary structure. Proc. Nat. Acad. Sci.

Further studies establishing the function and utilities of FPGS are found in John Hopkins OMIM database record ID 136510, and in sited publications numbered 11763-11771 listed in the bibliography section hereinbelow, which are also hereby incorporated by reference. Glypican 1 (GPC1, Accession NM_002081) is another VGAM1316 host target gene. GPC1 BINDING SITE is HOST TARGET binding site found in the 3' untranslated region of mRNA encoded by GPC1, corresponding to a HOST TARGET binding site such as BINDING SITE I, BINDING SITE II or BINDING SITE III. Table 2 illustrates the complementarity of the nucleotide sequences of GPC1 BINDING SITE, designated SEQ ID:7873, to the nucleotide sequence of VGAM1316 RNA, herein designated VGAM RNA, also designated SEQ ID:4027.

Another function of VGAM1316 is therefore inhibition of Glypican 1 (GPC1, Accession NM_002081), a gene which may play a role in growth control and differentation. Accordingly, utilities of VGAM1316 include diagnosis, prevention and treatment of diseases and clinical conditions associated with GPC1. The function of GPC1 and its association with various diseases and clinical conditions, has been established by previous studies, as described hereinabove with reference to VGAM125. Hyperpolarization Activated Cyclic Nucleotide-gated Potassium Channel 4 (HCN4, Accession NM_005477) is another VGAM1316 host target gene. HCN4 BINDING SITE is HOST TARGET binding site found in the 5' untranslated region of mRNA encoded by HCN4, corresponding to a HOST TARGET binding site such as BINDING SITE I, BINDING SITE II or BINDING SITE III. Table 2 illustrates the complementarity of the nucleotide sequences of HCN4 BINDING SITE, designated SEQ ID:11978, to the nucleotide sequence of VGAM1316 RNA, herein designated VGAM RNA, also designated SEQ ID:4027.

Another function of VGAM1316 is therefore inhibition of Hyperpolarization Activated Cyclic Nucleotide-gated Potassium Channel 4 (HCN4, Accession NM_005477), a gene which is hyperpolarization activated cyclic nucleotide-gated cation channel 4 and may act as a pacemaker channel in the heart. Accordingly, utilities of VGAM1316 include diagnosis, prevention and treatment of diseases and clinical conditions associated with HCN4. The function of HCN4 and its association with various diseases and clinical conditions, has been established by previous studies, as described hereinabove with reference to VGAM430. Lymphotoxin Beta Receptor (TNFR superfamily, member 3) (LTBR, Accession NM_002342) is another VGAM1316 host target gene. LTBR BINDING SITE is HOST TARGET binding site found in the 3' untranslated region of mRNA encoded by LTBR, corresponding to a HOST TARGET binding site such as BIND- ING SITE I, BINDING SITE II or BINDING SITE III. Table 2 illustrates the complementarity of the nucleotide sequences of LTBR BINDING SITE, designated SEQ ID:8141, to the nucleotide sequence of VGAM1316 RNA, herein designated VGAM RNA, also designated SEQ ID:4027.

Another function of VGAM1316 is therefore inhibition of Lymphotoxin Beta Receptor (TNFR superfamily, member 3) (LTBR, Accession NM_002342), a gene which is a receptor for the heterotrimeric lymphotoxin containing lta and ltb, and for tnfs14/light. promotes apoptosis via traf3 and traf5. may play a role in the development of lymphoid organs. Accordingly, utilities of VGAM1316 include diagnosis, prevention and treatment of diseases and clinical conditions associated with LTBR. The function of LTBR has been established by previous studies. Crowe et al. (1994) demonstrated that the tumor necrosis factor receptor related protein is the human receptor for the heterotrimer of lymphotoxin-alpha (OMIM Ref. No. 153440) and lymphotoxin-beta (OMIM Ref. No. 600978). This LT-alpha/LT-beta heterotrimer is assumed to take part in immunologic reactions by cell-cell contact, but does not bind to either TNFR1 (OMIM Ref. No. 191190) or TNFR2 (OMIM Ref. No. 191191). Nakamura et al. (1995) isolated the LT-beta receptor cDNA from a cDNA library of murine embryonic heart mRNA, using the signal sequence trap (SST) method, a newly developed strategy for cloning secreted proteins and type I membrane proteins (Tashiro et al., 1993). This method, which does not require specific functional assays, takes advantage of the fact that their precursors carry amino-terminal signal sequences. The deduced amino acid sequence of the mouse LT-beta receptor is 66% identical to that of the human protein. Northern analysis of various organs in adult mice have showed that expression levels of LTBR mRNA were strong in lung, liver, and kidney, moderate in heart and testes, but weak in brain, thymus, spleen, and lymph nodes. Nakamura et al. (1995) speculated that, since the mouse receptor was already expressed in 7 day-postcoitus embryos, the LT-alpha/LT-beta receptor system may have some function in early embryogenesis. By linkage analysis with recombinant inbred mouse strains, Nakamura et al. (1995) demonstrated that the locus, designated Tnfcr, is very close to the Tnfr1 gene on mouse chromosome 6. Presumably, the human homolog is located on 12p13

Full details of the abovementioned studies are described in the following publications, the disclosure of which are hereby incorporated by reference:

Crowe, P. D.; VanArsdale, T. L.; Walter, B. N.; Ware, C. F.; Hession, C.; Ehrenfels, B.; Browning, J. L.; Din, W. S.; Goodwin, R. G; Smith, C. A.: A lymphotoxin-beta-specific receptor. Science 264:707-710, 1994; and Nakamura, T.; Tashiro, K.; Nazarea, M.; Nakano, T.; Sasayama, S.; Honjo, T.: The murine lymphotoxin-beta receptor cDNA: isolation by the signal sequence trap and chromosomal mapping. Gen.

Further studies establishing the function and utilities of LTBR are found in John Hopkins OMIM database record ID 600979, and in sited publications numbered 7804-7806 listed in the bibliography section hereinbelow, which are also hereby incorporated by reference. NADH Dehydrogenase (ubiquinone) Flavoprotein 3, 10 kDa (NDUFV3, Accession NM_021075) is another VGAM1316 host target gene. NDUFV3 BINDING SITE is HOST TARGET binding site found in the 5' untranslated region of mRNA encoded by NDUFV3, corresponding to a HOST TARGET binding site such as BINDING SITE I, BINDING SITE II or BINDING SITE III. Table 2 illustrates the complementarity of the nucleotide sequences of NDUFV3 BINDING SITE, designated SEQ ID:22045, to the nucleotide sequence of VGAM1316 RNA, herein designated VGAM RNA, also designated SEQ ID:4027.

Another function of VGAM1316 is therefore inhibition of NADH Dehydrogenase (ubiquinone) Flavoprotein 3, 10 kDa (NDUFV3, Accession NM_021075), a gene which transports electrons from NADH to ubiquinone. Accordingly, utilities of VGAM1316 include diagnosis, prevention and treatment of diseases and clinical conditions associated with NDUFV3. The function of NDUFV3 and its association with various diseases and clinical conditions, has been established by previous studies, as described hereinabove with reference to VGAM626.6-phosphofructo-2-kinase/fructose-2,6-biphosphatase 4 (PFKFB4, Accession NM_004567) is another VGAM1316 host target gene. PFKFB4 BINDING SITE is HOST TARGET binding site found in the 3' untranslated region of mRNA encoded by PFKFB4, corresponding to a HOST TARGET binding site such as BINDING SITE I, BINDING SITE II or BINDING SITE III. Table 2 illustrates the complementarity of the nucleotide sequences of PFKFB4 BINDING SITE, designated SEQ ID:10909, to the nucleotide sequence of VGAM1316 RNA, herein designated VGAM RNA, also designated SEQ ID:4027.

Another function of VGAM1316 is therefore inhibition of 6-phosphofructo-2-kinase/fructose-2,6-biphosphatase 4 (PFKFB4, Accession NM_004567), a gene which catalyzes synthesis and degradation of fructose 2,6-bisphosphate. Accordingly, utilities of VGAM1316 include diagnosis, prevention and treatment of diseases and clinical conditions associated with PFKFB4. The function of PFKFB4 has been established by previous studies. The bifunctional 6-phosphofructo-2-kinase (EC 2.7.1.105)/fructose-2,6-bisphosphatase (EC 3.1.3.46) (PFKFB) regulates the steady-state concentration of fructose-2,6-bisphosphate, a potent activator of a key regulatory enzyme of glycolysis, phosphofructokinase. Isozymes of PFKFB differ in the regions surrounding the catalytic core, which are important for the differential response to allosteric effectors and hormonal signals in different tissues By screening a placental cDNA library with human and frog liver PFKFB (PFKFB1; 311790) as probes, Sakai et al. (1996) obtained a partial cDNA encoding PFKFB4, which they termed 2K-1. Manzano et al. (1999) isolated a cDNA encoding PFKFB4 by screening a human testis cDNA library with a rat liver Pfkfb probe, followed by RT-PCR. The predicted 469-amino acid PFKFB4 protein, which is 97% homologous to the rat sequence and approximately 70% identical to the human PFKFB isoforms, contains multiple phosphorylation sites. Northern blot analysis of rat brain, heart, liver, muscle, placenta, adipose tissue, ovary, fallopian tubes, and testis with the human PFKFB4 sequence as probe detected testis-specific expression of 2.4- and 3.3-kb transcripts. Western blot analysis showed expression of a 55-kD protein, close to the predicted value.

Full details of the abovementioned studies are described in the following publications, the disclosure of which are hereby incorporated by reference:

Sakai, A.; Kato, M.; Fukasawa, M.; Ishiguro, M.; Furuya, E.; Sakakibara, R.: Cloning of cDNA encoding for a novel isozyme of fructose 6-phosphate,2-kinase/fructose 2,6-bisphosphatase from human placenta. J. Biochem. 119: 506-511, 1996; and Manzano, A.; Perez, J. X.; Nadal, M.; Estivill, X.; Lange, A.; Bartrons, R.: Cloning, expression and chromosomal localization of a human testis 6-phosphofructo-2-kinase/fructose-2,6-bis.

Further studies establishing the function and utilities of PFKFB4 are found in John Hopkins OMIM database record ID 605320, and in sited publications numbered 4491 listed in the bibliography section hereinbelow, which are also hereby incorporated by reference. TAL1 (SCL) Interrupting Locus (SIL, Accession NM_003035) is another VGAM1316 host target gene. SIL BINDING SITE is HOST TARGET binding site found in the 3' untranslated region of mRNA encoded by SIL, corresponding to a HOST TARGET binding site such as BINDING SITE I, BINDING SITE II or BINDING SITE III. Table 2 illustrates the complementarity of the nucleotide sequences of SIL BINDING SITE, designated SEQ ID:8985, to the nucleotide sequence of VGAM1316 RNA, herein designated VGAM RNA, also designated SEQ ID:4027.

Another function of VGAM1316 is therefore inhibition of TAL1 (SCL) Interrupting Locus (SIL, Accession NM_003035), a gene which may be required for axial development and left-right specification. Accordingly, utilities of VGAM1316 include diagnosis, prevention and treatment of diseases and clinical conditions associated with SIL. The function of SIL has been established by previous studies. Aplan et al. (1997) demonstrated that transgenic mice in which inappropriately expressed scl protein, driven by sil regulatory elements, developed aggressive T-cell malignancies in collaboration with a misexpressed LMO1 (OMIM Ref. No. 186921) protein, thus recapitulating the situation seen in a subset of human T-cell ALL. Aplan et al. (1997) also demonstrated that inappropriately expressed scl can interfere with the development of other tissues derived from mesoderm. Finally, Aplan et al. (1997) demonstrated that an scl construct lacking the scl transactivation domain collaborates with misexpressed LMO1, demonstrating that the scl transactivation domain is dispensable for oncogenesis, and supporting the hypothesis that the scl gene product exerts its oncogenic action through a dominant-negative mechanism. Animal model experiments lend further support to the function of SIL. Izraeli et al. (1999) disrupted the Sil gene in mouse by homologous recombination. Heterozygotes were normal but mutant homozygotes died in utero after embryonic day 10.5. Between embryonic days 7.5 and 8.5, striking developmental anomalies appeared in Sil -/- embryos. In addition to reduced size and limited developmental progress compared to wild-type embryos, Sil mutants displayed prominent midline neural tube defects. These included delay or failure of neural tube closure and holoprosencephaly (OMIM Ref. No. 236100). In addition, left-right development was abnormal. In heterozygous and wildtype embryos, the embryonic heart tube always loops to the right, whereas in Sil mutants the direction of heart looping is randomized. Nodal (OMIM Ref. No. 601265), lefty-2 (OMIM Ref. No. 603037) and Pitx2 (OMIM Ref. No. 601542) are normally expressed only in the left lateral-plate mesoderm before heart looping, with continued expression of Pitx2 on the left side of the looping heart tube. In contrast, Sil mutants showed bilaterally symmetric expression of nodal and Pitx2 at all stages examined. For lefty-2, most Sil -/- embryos also showed bilaterally symmetric expression. However, a small number of mutants expressed lefty-2 only on the right. Expression of both Patched (OMIM Ref. No. 601309) and Gli1 (OMIM Ref. No. 165220) was greatly reduced in Sil -/- embryos. Shh (OMIM Ref. No. 600725) and Hnf3b (OMIM Ref. No. 600288) were expressed in the notochord of Sil mutants. However, the markedly reduced expression of their target genes indicated that Shh signaling in the midline may be blocked in Sil -/- embryos. Comparison with Shh mutant embryos, which have axial defects but normal cardiac looping, indicated that the consequences of abnormal midline development for left-right patterning depend on the time of onset, duration, and severity of disruption of the normal asymmetric patterns of expression of nodal, lefty-2, and Pitx2.

It is appreciated that the abovementioned animal model for SIL is acknowledged by those skilled in the art as a scientifically valid animal model, as can be further appreciated from the publications sited hereinbelow.

Full details of the abovementioned studies are described in the following publications, the disclosure of which are hereby incorporated by reference:

Aplan, P. D.; Jones, C. A.; Chervinsky, D. S.; Zhao, X.; Ellsworth, M.; Wu, C.; McGuire, E. A.; Gross, K. W.: An scl gene product lacking the transactivation domain induces bony abnormalities and cooperates with LMO1 to generate T-cell malignancies in transgenic mice. EMBO J. 16:2408-2419, 1997; and Izraeli, S.; Lowe, L. A.; Bertness, V. L.; Good, D. J.; Dorward, D. W.; Kirsch, I. R.; Kuehn, M. R.: The SIL gene is required for mouse embryonic axial development and left-right spec.

Further studies establishing the function and utilities of SIL are found in John Hopkins OMIM database record ID 181590, and in sited publications numbered 12610-12615 listed in the bibliography section hereinbelow, which are also hereby incorporated by reference. SRY (sex determining region Y)-box 4 (SOX4, Accession NM_003107) is another VGAM1316 host target gene. SOX4 BINDING SITE is HOST TARGET binding site found in the 5' untranslated region of mRNA encoded by SOX4, corresponding to a HOST TARGET binding site such as BINDING SITE I, BINDING SITE II or BINDING SITE III. Table 2 illustrates the complementarity of the nucleotide sequences of SOX4 BINDING SITE, designated SEQ ID:9072, to the nucleotide sequence of VGAM1316 RNA, herein designated VGAM RNA, also designated SEQ ID:4027.

Another function of VGAM1316 is therefore inhibition of SRY (sex determining region Y)-box 4 (SOX4, Accession NM_003107), a gene which binds with high affinity to the t-cell enhancer motif 5'-aacaaag-3' motif. Accordingly, utilities of VGAM1316 include diagnosis, prevention and treatment of diseases and clinical conditions associated with SOX4. The function of SOX4 and its association with various diseases and clinical conditions, has been established by previous studies, as described hereinabove with reference to VGAM409. Synaptogyrin 1 (SYNGR1, Accession NM_004711) is another VGAM1316 host target gene. SYNGR1 BINDING SITE is HOST TARGET binding site found in the 3' untranslated region of mRNA encoded by SYNGR1, corresponding to a HOST TARGET binding site such as BINDING SITE I, BINDING SITE II or BINDING SITE III. Table 2 illustrates the complementarity of the nucleotide sequences of SYNGR1 BINDING SITE, designated SEQ ID:11067, to the nucleotide sequence of VGAM1316 RNA, herein designated VGAM RNA, also designated SEQ ID:4027.

Another function of VGAM1316 is therefore inhibition of Synaptogyrin 1 (SYNGR1, Accession NM_004711), a gene which belongs to transmembrane synaptic vesicle protein and may function in membrane recycling. Accordingly, utilities of VGAM1316 include diagnosis, prevention and treatment of diseases and clinical conditions associated with SYNGR1. The function of SYNGR1 and its association with various diseases and clinical conditions, has been established by previous studies, as described hereinabove with reference to VGAM107. TAF7 RNA Polymerase II, TATA Box Binding Protein (TBP)-associated Factor, 55 kDa (TAF7, Accession NM_005642) is another VGAM1316 host target gene. TAF7 BINDING SITE is HOST TARGET binding site found in the 5' untranslated region of mRNA encoded by TAF7, corresponding to a HOST TARGET binding site such as BIND- ING SITE I, BINDING SITE II or BINDING SITE III. Table 2 illustrates the complementarity of the nucleotide sequences of TAF7 BINDING SITE, designated SEQ ID:12176, to the nucleotide sequence of VGAM1316 RNA, herein designated VGAM RNA, also designated SEQ ID:4027.

Another function of VGAM1316 is therefore inhibition of TAF7 RNA Polymerase II, TATA Box Binding Protein (TBP)-associated Factor, 55 kDa (TAF7, Accession NM_005642), a gene which may function as a coactivator of transcription with some activators. Accordingly, utilities of VGAM1316 include diagnosis, prevention and treatment of diseases and clinical conditions associated with TAF7. The function of TAF7 has been established by previous studies. Chiang and Roeder (1995) reported the cloning of a subunit of the TFIID protein complex (OMIM Ref. No. 313650) which is required for transcription by promoters targeted by RNA polymerase II. The TFIID complex binds to the TATA box in class II promoters and then recruits other factors as well as RNA polymerase II. TFIID is composed of the TATA-binding protein (TBP; 600075) and multiple TBP-associated factors (TAFs), one of which has a predicted size of 55 kD from SDS gel electrophoresis. The human TFIID subunit TAF2F (also referred to as TAFII55) was isolated from a cell line that expresses an epitope-tagged TBP allowing for the immuno-precipitation of the TFIID complex and associated factors. Based on partial peptide sequence of 1 TAF, Chiang and Roeder (1995) designed degenerate PCR primers and used them to produce a probe which was, in turn, hybridized to a human placenta cDNA library. The predicted protein is 349 amino acids (40 kD) and contains 40% charged residues, which may account for its larger than expected electro-phoretic mobility. The mRNA was expressed in all tissues examined. The authors showed that TAFII55 interacts with TAFII230, the largest subunit of TFIID, and with multiple transcription activators, including Sp1 (OMIM Ref. No. 189906), YY1 (OMIM Ref. No. 600013), USF (OMIM Ref. No. 191523), CTF (600729; discussed also in 164005), and adenoviral E1A (discussed in 607102). By genomic sequence analysis, Wu et al. (2001) determined that the mouse and human TAF2F genes contain a single exon.

Full details of the abovementioned studies are described in the following publications, the disclosure of which are hereby incorporated by reference:

Chiang, C.-M.; Roeder, R. G.: Cloning of an intrinsic human TFIID subunit that interacts with multiple transcrip-tional activators. Science 267:531-536, 1995; and Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse an.

Further studies establishing the function and utilities of TAF7 are found in John Hopkins OMIM database record ID 600573, and in sited publications numbered 9534-9535 listed in the bibliography section hereinbelow, which are also hereby incorporated by reference. Thrombospondin 1 (THBS1, Accession NM_003246) is another VGAM1316 host target gene. THBS1 BINDING SITE is HOST TARGET binding site found in the 3' untranslated region of mRNA encoded by THBS1, corresponding to a HOST TARGET binding site such as BINDING SITE I, BINDING SITE II or BINDING SITE III. Table 2 illustrates the complementarity of the nucleotide sequences of THBS1 BINDING SITE, designated SEQ ID:9255, to the nucleotide sequence of VGAM1316 RNA, herein designated VGAM RNA, also designated SEQ ID:4027.

Another function of VGAM1316 is therefore inhibition of Thrombospondin 1 (THBS1, Accession NM_003246), a gene which is a member of a family of adhesive molecules, involves in blood clotting and in angiogenesis. Accordingly, utilities of VGAM1316 include diagnosis, prevention and treatment of diseases and clinical conditions associated with THBS1. The function of THBS1 and its association with various diseases and clinical conditions, has been established by previous studies, as described hereinabove with reference to VGAM20. Tuftelin 1 (TUFT1, Accession NM_020127) is another VGAM1316 host target gene. TUFT1 BINDING SITE is HOST TARGET binding site found in the 3' untranslated region of mRNA encoded by TUFT1, corresponding to a HOST TARGET binding site such as BINDING SITE I, BINDING SITE II or BINDING SITE III. Table 2 illustrates the complementarity of the nucleotide sequences of TUFT1 BINDING SITE, designated SEQ ID:21316, to the nucleotide sequence of VGAM1316 RNA, herein designated VGAM RNA, also designated SEQ ID:4027.

Another function of VGAM1316 is therefore inhibition of Tuftelin 1 (TUFT1, Accession NM_020127), a gene which appears to play a role in cytokinesis, cell shape, and special-ized functions such as secretion and capping. Accordingly, utilities of VGAM1316 include diagnosis, prevention and treatment of diseases and clinical conditions associated with TUFT1. The function of TUFT1 and its association with various diseases and clinical conditions, has been established by previous studies, as described hereinabove with reference to VGAM1152. A Disintegrin-like and Metalloprotease (re-prolysin type) with Thrombospondin Type 1 Motif, 10 (AD-AMTS10, Accession NM_030957) is another VGAM1316 host target gene. ADAMTS10 BINDING SITE is HOST TARGET binding site found in the 5' untranslated region of mRNA encoded by ADAMTS10, corresponding to a HOST TARGET binding site such as BINDING SITE I, BINDING SITE II or BINDING SITE III. Table 2 illustrates the comple-mentarity of the nucleotide sequences of ADAMTS10 BIND-ING SITE, designated SEQ ID:25231, to the nucleotide sequence of VGAM1316 RNA, herein designated VGAM RNA, also designated SEQ ID:4027.

Another function of VGAM1316 is therefore inhibition of A Disintegrin-like and Metalloprotease (reprolysin type) with Thrombospondin Type 1 Motif, 10 (ADAMTS10, Accession NM_030957). Accordingly, utilities of VGAM1316 include diagnosis, prevention and treatment of diseases and clinical conditions associated with ADAMTS10. BRAG (Accession NM_014863) is another VGAM1316 host target gene. BRAG BINDING SITE is HOST TARGET bind-ing site found in the 5' untranslated region of mRNA encoded by BRAG, corresponding to a HOST TARGET binding site such as BINDING SITE I, BINDING SITE II or BINDING SITE III. Table 2 illustrates the complementarity of the nucle-otide sequences of BRAG BINDING SITE, designated SEQ ID:16942, to the nucleotide sequence of VGAM1316 RNA, herein designated VGAM RNA, also designated SEQ ID:4027.

Another function of VGAM1316 is therefore inhibition of BRAG (Accession NM_014863). Accordingly, utilities of VGAM1316 include diagnosis, prevention and treatment of diseases and clinical conditions associated with BRAG. DKFZP762D096 (Accession XM_037662) is another VGAM1316 host target gene. DKFZP762D096 BINDING SITE is HOST TARGET binding site found in the 5' untrans-lated region of mRNA encoded by DKFZP762D096, corre-sponding to a HOST TARGET binding site such as BIND-ING SITE I, BINDING SITE II or BINDING SITE III. Table 2 illustrates the complementarity of the nucleotide sequences of DKFZP762D096 BINDING SITE, designated SEQ ID:32665, to the nucleotide sequence of VGAM1316 RNA, herein designated VGAM RNA, also designated SEQ ID:4027.

Another function of VGAM1316 is therefore inhibition of DKFZP762D096 (Accession XM_037662). Accordingly, utilities of VGAM1316 include diagnosis, prevention and treatment of diseases and clinical conditions associated with DKFZP762D096. FASTK (Accession NM_025096) is another VGAM1316 host target gene. FASTK BINDING SITE is HOST TARGET binding site found in the 5' untranslated region of mRNA encoded by FASTK, corresponding to a HOST TARGET binding site such as BINDING SITE I, BINDING SITE II or BINDING SITE III. Table 2 illustrates the complementarity of the nucleotide sequences of FASTK BINDING SITE, designated SEQ ID:24729, to the nucleotide sequence of VGAM1316 RNA, herein designated VGAM RNA, also designated SEQ ID:4027.

Another function of VGAM1316 is therefore inhibition of FASTK (Accession NM_025096). Accordingly, utilities of VGAM1316 include diagnosis, prevention and treatment of diseases and clinical conditions associated with FASTK. FLJ10898 (Accession XM_002486) is another VGAM1316 host target gene. FLJ10898 BINDING SITE is HOST TARGET binding site found in the 5' untranslated region of mRNA encoded by FLJ10898, corresponding to a HOST TARGET binding site such as BINDING SITE I, BINDING SITE II or BINDING SITE III. Table 2 illustrates the complementarity of the nucleotide sequences of FLJ10898 BINDING SITE, designated SEQ ID:29894, to the nucleotide sequence of VGAM1316 RNA, herein designated VGAM RNA, also designated SEQ ID:4027.

Another function of VGAM1316 is therefore inhibition of FLJ10898 (Accession XM_002486). Accordingly, utilities of VGAM1316 include diagnosis, prevention and treatment of diseases and clinical conditions associated with FLJ10898. FLJ12800 (Accession NM_022903) is another VGAM1316 host target gene. FLJ12800 BINDING SITE is HOST TARGET binding site found in the 3' untranslated region of mRNA encoded by FLJ12800, corresponding to a HOST TARGET binding site such as BINDING SITE I, BINDING SITE II or BINDING SITE III. Table 2 illustrates the complementarity of the nucleotide sequences of FLJ12800 BINDING SITE, designated SEQ ID:23192, to the nucleotide sequence of VGAM1316 RNA, herein designated VGAM RNA, also designated SEQ ID:4027.

Another function of VGAM1316 is therefore inhibition of FLJ12800 (Accession NM_022903). Accordingly, utilities of VGAM1316 include diagnosis, prevention and treatment of diseases and clinical conditions associated with FLJ12800. FLJ21709 (Accession XM_085480) is another VGAM1316 host target gene. FLJ21709 BINDING SITE is HOST TARGET binding site found in the 3' untranslated region of mRNA encoded by FLJ21709, corresponding to a HOST TARGET binding site such as BINDING SITE I, BINDING SITE II or BINDING SITE III. Table 2 illustrates the complementarity of the nucleotide sequences of FLJ21709 BINDING SITE, designated SEQ ID:38168, to the nucleotide sequence of VGAM1316 RNA, herein designated VGAM RNA, also designated SEQ ID:4027.

Another function of VGAM1316 is therefore inhibition of FLJ21709 (Accession XM_085480). Accordingly, utilities of VGAM1316 include diagnosis, prevention and treatment of diseases and clinical conditions associated with FLJ21709. Heat Shock 27 kDa Protein Family, Member 7 (cardiovascular) (HSPB7, Accession NM_014424) is another VGAM1316 host target gene. HSPB7 BINDING SITE is HOST TARGET binding site found in the 5' untranslated region of mRNA encoded by HSPB7, corresponding to a HOST TARGET binding site such as BINDING SITE I, BINDING SITE II or BINDING SITE III. Table 2 illustrates the complementarity of the nucleotide sequences of HSPB7 BINDING SITE, designated SEQ ID:15782, to the nucleotide sequence of VGAM1316 RNA, herein designated VGAM RNA, also designated SEQ ID:4027.

Another function of VGAM1316 is therefore inhibition of Heat Shock 27 kDa Protein Family, Member 7 (cardiovascular) (HSPB7, Accession NM_014424). Accordingly, utilities of VGAM1316 include diagnosis, prevention and treatment of diseases and clinical conditions associated with HSPB7. KIAA0087 (Accession NM_014769) is another VGAM1316 host target gene. KIAA0087 BINDING SITE is HOST TARGET binding site found in the 3' untranslated region of mRNA encoded by KIAA0087, corresponding to a HOST TARGET binding site such as BINDING SITE I, BINDING SITE II or BINDING SITE III. Table 2 illustrates the complementarity of the nucleotide sequences of KIAA0087 BINDING SITE, designated SEQ ID:16556, to the nucleotide sequence of VGAM1316 RNA, herein designated VGAM RNA, also designated SEQ ID:4027.

Another function of VGAM1316 is therefore inhibition of KIAA0087 (Accession NM_014769). Accordingly, utilities of VGAM1316 include diagnosis, prevention and treatment of diseases and clinical conditions associated with KIAA0087. KIAA0318 (Accession XM_044334) is another VGAM1316 host target gene. KIAA0318 BINDING SITE is HOST TARGET binding site found in the 5' untranslated region of mRNA encoded by KIAA0318, corresponding to a HOST TARGET binding site such as BINDING SITE I, BINDING SITE II or BINDING SITE III. Table 2 illustrates the complementarity of the nucleotide sequences of KIAA0318 BINDING SITE, designated SEQ ID:34188, to the nucleotide sequence of VGAM1316 RNA, herein designated VGAM RNA, also designated SEQ ID:4027.

Another function of VGAM1316 is therefore inhibition of KIAA0318 (Accession XM_044334). Accordingly, utilities of VGAM1316 include diagnosis, prevention and treatment of diseases and clinical conditions associated with KIAA0318. KIAA0545 (Accession XM_032278) is another VGAM1316 host target gene. KIAA0545 BINDING SITE is HOST TARGET binding site found in the 3' untranslated region of mRNA encoded by KIAA0545, corresponding to a HOST TARGET binding site such as BINDING SITE I, BINDING SITE II or BINDING SITE III. Table 2 illustrates the complementarity of the nucleotide sequences of KIAA0545 BINDING SITE, designated SEQ ID:31636, to the nucleotide sequence of VGAM1316 RNA, herein designated VGAM RNA, also designated SEQ ID:4027.

Another function of VGAM1316 is therefore inhibition of KIAA0545 (Accession XM_032278). Accordingly, utilities of VGAM1316 include diagnosis, prevention and treatment of diseases and clinical conditions associated with KIAA0545. KIAA1322 (Accession XM_052626) is another VGAM1316 host target gene. KIAA1322 BINDING SITE is HOST TARGET binding site found in the 5' untranslated region of mRNA encoded by KIAA1322, corresponding to a HOST TARGET binding site such as BINDING SITE I, BINDING SITE II or BINDING SITE III. Table 2 illustrates the complementarity of the nucleotide sequences of KIAA1322 BINDING SITE, designated SEQ ID:36028, to the nucleotide sequence of VGAM1316 RNA, herein designated VGAM RNA, also designated SEQ ID:4027.

Another function of VGAM1316 is therefore inhibition of KIAA1322 (Accession XM_052626). Accordingly, utilities of VGAM1316 include diagnosis, prevention and treatment of diseases and clinical conditions associated with KIAA1322. KIAA1719 (Accession XM_042936) is another VGAM1316 host target gene. KIAA1719 BINDING SITE is HOST TARGET binding site found in the 5' untranslated region of mRNA encoded by KIAA1719, corresponding to a HOST TARGET binding site such as BINDING SITE I, BINDING SITE II or BINDING SITE III. Table 2 illustrates the complementarity of the nucleotide sequences of KIAA1719 BINDING SITE, designated SEQ ID:33818, to the nucleotide sequence of VGAM1316 RNA, herein designated VGAM RNA, also designated SEQ ID:4027.

Another function of VGAM1316 is therefore inhibition of KIAA1719 (Accession XM_042936). Accordingly, utilities of VGAM1316 include diagnosis, prevention and treatment of diseases and clinical conditions associated with KIAA1719. KIAA1924 (Accession XM_057091) is another VGAM1316 host target gene. KIAA1924 BINDING SITE is HOST TARGET binding site found in the 3' untranslated region of mRNA encoded by KIAA1924, corresponding to a HOST TARGET binding site such as BINDING SITE I, BINDING SITE II or BINDING SITE III. Table 2 illustrates the complementarity of the nucleotide sequences of KIAA1924 BINDING SITE, designated SEQ ID:36477, to the nucleotide sequence of VGAM1316 RNA, herein designated VGAM RNA, also designated SEQ ID:4027.

Another function of VGAM1316 is therefore inhibition of KIAA1924 (Accession XM_057091). Accordingly, utilities of VGAM1316 include diagnosis, prevention and treatment of diseases and clinical conditions associated with KIAA1924. Karyopherin Alpha 6 (importin alpha 7) (KPNA6, Accession NM_012316) is another VGAM1316 host target gene. KPNA6 BINDING SITE is HOST TARGET binding site found in the 3' untranslated region of mRNA encoded by KPNA6, corresponding to a HOST TARGET binding site such as BINDING SITE I, BINDING SITE II or BINDING SITE III. Table 2 illustrates the complementarity of the nucleotide sequences of KPNA6 BINDING SITE, designated SEQ ID:14688, to the nucleotide sequence of VGAM1316 RNA, herein designated VGAM RNA, also designated SEQ ID:4027.

Another function of VGAM1316 is therefore inhibition of Karyopherin Alpha 6 (importin alpha 7) (KPNA6, Accession NM_012316). Accordingly, utilities of VGAM1316 include diagnosis, prevention and treatment of diseases and clinical conditions associated with KPNA6. MGC10812 (Accession NM_031425) is another VGAM1316 host target gene. MGC10812 BINDING SITE is HOST TARGET binding site found in the 3' untranslated region of mRNA encoded by MGC10812, corresponding to a HOST TARGET binding site such as BINDING SITE I, BINDING SITE II or BINDING SITE III. Table 2 illustrates the complementarity of the nucleotide sequences of MGC10812 BINDING SITE, designated SEQ ID:25413, to the nucleotide sequence of VGAM1316 RNA, herein designated VGAM RNA, also designated SEQ ID:4027.

Another function of VGAM1316 is therefore inhibition of MGC10812 (Accession NM_031425). Accordingly, utilities of VGAM1316 include diagnosis, prevention and treatment of diseases and clinical conditions associated with MGC10812. MGC15827 (Accession NM_032882) is another VGAM1316 host target gene. MGC15827 BINDING SITE is HOST TARGET binding site found in the 3' untranslated region of mRNA encoded by MGC15827, corresponding to a HOST TARGET binding site such as BINDING SITE I, BINDING SITE II or BINDING SITE III. Table 2 illustrates the complementarity of the nucleotide sequences of MGC15827 BINDING SITE, designated SEQ ID:26702, to the nucleotide sequence of VGAM1316 RNA, herein designated VGAM RNA, also designated SEQ ID:4027.

Another function of VGAM1316 is therefore inhibition of MGC15827 (Accession NM_032882). Accordingly, utilities of VGAM1316 include diagnosis, prevention and treatment of diseases and clinical conditions associated with MGC15827. MR (Accession NM_031212) is another VGAM1316 host target gene. MR BINDING SITE is HOST TARGET binding site found in the 5' untranslated region of mRNA encoded by MR, corresponding to a HOST TARGET binding site such as BINDING SITE I, BINDING SITE II or BINDING SITE III. Table 2 illustrates the complementarity of the nucleotide sequences of MR BINDING SITE, designated SEQ ID:25255, to the nucleotide sequence of VGAM1316 RNA, herein designated VGAM RNA, also designated SEQ ID:4027.

Another function of VGAM1316 is therefore inhibition of MR (Accession NM_031212). Accordingly, utilities of VGAM1316 include diagnosis, prevention and treatment of diseases and clinical conditions associated with MR. Tripartite Motif-containing 2 (TRIM2, Accession NM_015271) is another VGAM1316 host target gene. TRIM2 BINDING SITE is HOST TARGET binding site found in the 3' untranslated region of mRNA encoded by TRIM2, corresponding to a HOST TARGET binding site such as BINDING SITE I, BINDING SITE II or BINDING SITE III. Table 2 illustrates the complementarity of the nucleotide sequences of TRIM2 BINDING SITE, designated SEQ ID:17600, to the nucleotide sequence of VGAM1316 RNA, herein designated VGAM RNA, also designated SEQ ID:4027.

Another function of VGAM1316 is therefore inhibition of Tripartite Motif-containing 2 (TRIM2, Accession NM_015271). Accordingly, utilities of VGAM1316 include diagnosis, prevention and treatment of diseases and clinical conditions associated with TRIM2. LOC199964 (Accession XM_117165) is another VGAM1316 host target gene. LOC199964 BINDING SITE is HOST TARGET binding site found in the 5' untranslated region of mRNA encoded by LOC199964, corresponding to a HOST TARGET binding site such as BINDING SITE I, BINDING SITE II or BINDING SITE III. Table 2 illustrates the complementarity of the nucleotide sequences of LOC199964 BINDING SITE, designated SEQ ID:43267, to the nucleotide sequence of VGAM1316 RNA, herein designated VGAM RNA, also designated SEQ ID:4027.

Another function of VGAM1316 is therefore inhibition of LOC199964 (Accession XM_117165). Accordingly, utilities of VGAM1316 include diagnosis, prevention and treatment of diseases and clinical conditions associated with LOC199964. LOC199986 (Accession XM_117168) is another VGAM1316 host target gene. LOC199986 BINDING SITE is HOST TARGET binding site found in the 5' untranslated region of mRNA encoded by LOC199986, corresponding to a HOST TARGET binding site such as BINDING SITE I, BINDING SITE II or BINDING SITE III. Table 2 illustrates the complementarity of the nucleotide sequences of LOC199986 BINDING SITE, designated SEQ ID:43273, to the nucleotide sequence of VGAM1316 RNA, herein designated VGAM RNA, also designated SEQ ID:4027.

Another function of VGAM1316 is therefore inhibition of LOC199986 (Accession XM_117168). Accordingly, utilities of VGAM1316 include diagnosis, prevention and treatment of diseases and clinical conditions associated with LOC199986. LOC220549 (Accession XM_167521) is another VGAM1316 host target gene. LOC220549 BINDING SITE is HOST TARGET binding site found in the 5' untranslated region of mRNA encoded by LOC220549, corresponding to a HOST TARGET binding site such as BINDING SITE I, BINDING SITE II or BINDING SITE III. Table 2 illustrates the complementarity of the nucleotide sequences of LOC220549 BINDING SITE, designated SEQ ID:44651, to the nucleotide sequence of VGAM1316 RNA, herein designated VGAM RNA, also designated SEQ ID:4027.

Another function of VGAM1316 is therefore inhibition of LOC220549 (Accession XM_167521). Accordingly, utilities of VGAM1316 include diagnosis, prevention and treatment of diseases and clinical conditions associated with LOC220549. LOC254532 (Accession XM_172961) is another VGAM1316 host target gene. LOC254532 BINDING SITE is HOST TARGET binding site found in the 3' untranslated region of mRNA encoded by LOC254532, corresponding to a HOST TARGET binding site such as BINDING SITE I, BINDING SITE II or BINDING SITE III. Table 2 illustrates the complementarity of the nucleotide sequences of LOC254532 BINDING SITE, designated SEQ ID:46211, to the nucleotide sequence of VGAM1316 RNA, herein designated VGAM RNA, also designated SEQ ID:4027.

Another function of VGAM1316 is therefore inhibition of LOC254532 (Accession XM_172961). Accordingly, utilities of VGAM1316 include diagnosis, prevention and treatment of diseases and clinical conditions associated with LOC254532. LOC90917 (Accession XM_034861) is another VGAM1316 host target gene. LOC90917 BINDING SITE is HOST TARGET binding site found in the 3' untranslated region of mRNA encoded by LOC90917, corresponding to a HOST TARGET binding site such as BINDING SITE I, BINDING SITE II or BINDING SITE III. Table 2 illustrates the complementarity of the nucleotide sequences of LOC90917 BINDING SITE, designated SEQ ID:32169, to the nucleotide sequence of VGAM1316 RNA, herein designated VGAM RNA, also designated SEQ ID:4027.

Another function of VGAM1316 is therefore inhibition of LOC90917 (Accession XM_034861). Accordingly, utilities of VGAM1316 include diagnosis, prevention and treatment of diseases and clinical conditions associated with LOC90917. LOC91409 (Accession XM_038298) is another VGAM1316 host target gene. LOC91409 BINDING SITE is HOST TARGET binding site found in the 3' untranslated region of mRNA encoded by LOC91409, corresponding to a HOST TARGET binding site such as BINDING SITE I, BINDING SITE II or BINDING SITE III. Table 2 illustrates the complementarity of the nucleotide sequences of LOC91409 BINDING SITE, designated SEQ ID:32801, to the nucleotide sequence of VGAM1316 RNA, herein designated VGAM RNA, also designated SEQ ID:4027.

Another function of VGAM1316 is therefore inhibition of LOC91409 (Accession XM_038298). Accordingly, utilities of VGAM1316 include diagnosis, prevention and treatment of diseases and clinical conditions associated with LOC91409. LOC91948 (Accession XM_041723) is another VGAM1316 host target gene. LOC91948 BINDING SITE is HOST TARGET binding site found in the 5' untranslated region of mRNA encoded by LOC91948, corresponding to a HOST TARGET binding site such as BINDING SITE I, BINDING SITE II or BINDING SITE III. Table 2 illustrates the complementarity of the nucleotide sequences of LOC91948 BINDING SITE, designated SEQ ID:33572, to the nucleotide sequence of VGAM1316 RNA, herein designated VGAM RNA, also designated SEQ ID:4027.

Another function of VGAM1316 is therefore inhibition of LOC91948 (Accession XM_041723). Accordingly, utilities of VGAM1316 include diagnosis, prevention and treatment of diseases and clinical conditions associated with LOC91948. FIG. 1 further provides a conceptual description of a novel bioinformatically detected viral gene of the present invention, referred to here as Viral Genomic Address Messenger 1317 (VGAM1317) viral gene, which modulates expression of respective host target genes thereof, the function and utility of which host target genes is known in the art.

VGAM1317 is a novel bioinformatically detected regulatory, non protein coding, viral micro RNA (miRNA) gene. The method by which VGAM1317 was detected is described hereinabove with reference to FIGS. 1-8.

VGAM1317 gene, herein designated VGAM GENE, is a viral gene contained in the genome of Foot-and-mouth Disease Virus O. VGAM1317 host target gene, herein designated VGAM HOST TARGET GENE, is a human gene contained in the human genome.

VGAM1317 gene encodes a VGAM1317 precursor RNA, herein designated VGAM PRECURSOR RNA. Similar to other miRNA genes, and unlike most ordinary genes, VGAM1317 precursor RNA does not encode a protein. A nucleotide sequence identical or highly similar to the nucleotide sequence of VGAM1317 precursor RNA is designated SEQ ID:1303, and is provided hereinbelow with reference to the sequence listing part. Nucleotide sequence SEQ ID:1303 is located at position 1129 relative to the genome of Foot-and-mouth Disease Virus O.

VGAM1317 precursor RNA folds onto itself, forming VGAM1317 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1317 folded precursor RNA into VGAM1317 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1317 RNA is designated SEQ ID:4028, and is provided hereinbelow with reference to the sequence listing part.

VGAM1317 host target gene, herein designated VGAM HOST TARGET GENE, encodes a corresponding messenger RNA, VGAM1317 host target RNA, herein designated VGAM HOST TARGET RNA. VGAM1317 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1317 RNA, herein designated VGAM RNA, binds complementarily to one or more host target binding sites located in untranslated regions of VGAM1317 host target RNA, herein designated VGAM HOST TARGET RNA. This complementary binding is due to the fact that the nucleotide sequence of VGAM1317 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1317 RNA, herein designated VGAM RNA, may have a different number of host target binding sites in untranslated regions of a VGAM1317 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1317 RNA, herein designated VGAM RNA, to host target binding sites on VGAM1317 host target RNA, herein designated VGAM HOST TARGET RNA, such as BINDING SITE I, BINDING SITE II and BINDING SITE III, inhibits translation of VGAM1317 host target RNA into VGAM1317 host target protein, herein designated VGAM HOST TARGET PROTEIN. VGAM host target protein is therefore outlined by a broken line.

It is appreciated that VGAM1317 host target gene, herein designated VGAM HOST TARGET GENE, in fact represents a plurality of VGAM1317 host target genes. The mRNA of each one of this plurality of VGAM1317 host target genes comprises one or more host target binding sites, each having a nucleotide sequence which is at least partly complementary to VGAM1317 RNA, herein designated VGAM RNA, and which when bound by VGAM1317 RNA causes inhibition of translation of respective one or more VGAM1317 host target proteins.

It is further appreciated by one skilled in the art that the mode of translational inhibition illustrated by FIG. 1 with specific reference to translational inhibition exerted by VGAM1317 gene, herein designated VGAM GENE, on one or more VGAM1317 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1317 is inhibition of expression of host target genes, as part of a novel viral mechanism of attacking a host. Accordingly, utilities of VGAM1317 include diagnosis, prevention and treatment of viral infection by Foot-and-mouth Disease Virus O. Specific functions, and accordingly utilities, of VGAM1317 correlate with, and may be deduced from, the identity of the host target genes which VGAM1317 binds and inhibits, and the function of these host target genes, as elaborated hereinbelow.

Nucleotide sequences of the VGAM1317 precursor RNA, herein designated VGAM PRECURSOR RNA, and of the 'diced' VGAM1317 RNA, herein designated VGAM RNA, and a schematic representation of the secondary folding of VGAM1317 folded precursor RNA, herein designated VGAM FOLDED PRECURSOR RNA, of VGAM1317 are further described hereinbelow with reference to Table 1.

Nucleotide sequences of host target binding sites, such as BINDING SITE-I, BINDING SITE-II and BINDING SITE-III of FIG. 1, found on VGAM1317 host target RNA, and schematic representation of the complementarity of each of these host target binding sites to VGAM1317 RNA, herein designated VGAM RNA, are described hereinbelow with reference to Table 2.

As mentioned hereinabove with reference to FIG. 1, a function of VGAM1317 gene, herein designated VGAM is inhibition of expression of VGAM1317 target genes. It is appreciated that specific functions, and accordingly utilities, of VGAM1317 correlate with, and may be deduced from, the identity of the target genes which VGAM1317 binds and inhibits, and the function of these target genes, as elaborated hereinbelow.

Uncoupling Protein 3 (mitochondrial, proton carrier) (UCP3, Accession NM_003356) is a VGAM1317 host target gene. UCP3 BINDING SITE is HOST TARGET binding site found in the 3' untranslated region of mRNA encoded by UCP3, corresponding to a HOST TARGET binding site such as BINDING SITE I, BINDING SITE II or BINDING SITE III. Table 2 illustrates the complementarity of the nucleotide sequences of UCP3 BINDING SITE, designated SEQ ID:9384, to the nucleotide sequence of VGAM1317 RNA, herein designated VGAM RNA, also designated SEQ ID:4028.

A function of VGAM1317 is therefore inhibition of Uncoupling Protein 3 (mitochondrial, proton carrier) (UCP3, Accession NM_003356), a gene which is a mitochondrial transporter protein that creates proton leaks across the inner mitochondrial membrane, thus uncoupling oxidative phosphorylation. Accordingly, utilities of VGAM1317 include diagnosis, prevention and treatment of diseases and clinical conditions associated with UCP3. The function of UCP3 has been established by previous studies. With the capacity to participate in thermogenesis and energy balance, UCP3 is an important obesity candidate gene. Bouchard et al. (1997) demonstrated linkage between markers at the UCP2/UCP3 region with resting metabolic rate. This region is syntenic to a region of mouse chromosome 7 that has been linked to hyperinsulinemia and obesity (Fleury et al., 1997). Animal model experiments lend further support to the function of UCP3. Clapham et al. (2000) created transgenic mice that overexpress human UCP3 in skeletal muscle. UCP3 expression was driven by the human alpha-skeletal actin (OMIM Ref. No. 102610) promoter, limiting expression to skeletal muscle. Clapham et al. (2000) bred 3 independent lines to homozygosity and selected a line of mice that had a 66-fold increase in UCP3 expression. These mice were hyperphagic but weighed less than their wildtype littermates. Magnetic resonance imaging (MRI) showed a striking reduction in adipose tissue mass. The mice also exhibited lower fasting plasma glucose and insulin levels and an increased glucose clearance rate. Clapham et al. (2000) concluded that their data provided evidence that skeletal muscle UCP3 has the potential to influence metabolic rates and glucose homeostasis in the whole animal.

It is appreciated that the abovementioned animal model for UCP3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Clapham, J. C.; Arch, J. R. S.; Chapman, H.; Haynes, A.; Lister, C.; Moore, G. B. T.; Piercy, V.; Carter, S. A.; Lehner, I.; Smith, S. A.; Beeley, L. J.; Godden, R. J.; and 15 others. Mice overexpressing human uncoupling protein-3 in skeletal muscle are hyperphagic and lean. Nature 406:415-418, 2000; and Fleury, C.; Neverova, M.; Collins, S.; Raimbault, S.; Champigny, O.; Levi-Meyrueis, C.; Bouillaud, F.; Seldin, M. F.; Surwit, R. S.; Ricquier, D.; Warden, C. H.: Uncoupling protein-2.

Further studies establishing the function and utilities of UCP3 are found in John Hopkins OMIM database record ID 602044, and in sited publications numbered 6660-6662, 6484, 6663, 5960-5961, 3700, 6487, 6489, 8525-852 and 2794 listed in the bibliography section hereinbelow, which are also hereby incorporated by reference. CDC10 Cell Division Cycle 10 Homolog (S. cerevisiae) (CDC10, Accession XM_165879) is another VGAM1317 host target gene. CDC10 BINDING SITE is HOST TARGET binding site found in the 3' untranslated region of mRNA encoded by CDC10, corresponding to a HOST TARGET binding site such as BINDING SITE I, BINDING SITE II or BINDING SITE III. Table 2 illustrates the complementarity of the nucleotide sequences of CDC10 BINDING SITE, designated SEQ ID:43792, to the nucleotide sequence of VGAM1317 RNA, herein designated VGAM RNA, also designated SEQ ID:4028.

Another function of VGAM1317 is therefore inhibition of CDC10 Cell Division Cycle 10 Homolog (S. cerevisiae) (CDC10, Accession XM_165879). Accordingly, utilities of VGAM1317 include diagnosis, prevention and treatment of diseases and clinical conditions associated with CDC10. FLJ10716 (Accession NM_018191) is another VGAM1317 host target gene. FLJ10716 BINDING SITE is HOST TARGET binding site found in the 3' untranslated region of mRNA encoded by FLJ10716, corresponding to a HOST TARGET binding site such as BINDING SITE I, BINDING SITE II or BINDING SITE III. Table 2 illustrates the complementarity of the nucleotide sequences of FLJ10716 BINDING SITE, designated SEQ ID:20045, to the nucleotide sequence of VGAM1317 RNA, herein designated VGAM RNA, also designated SEQ ID:4028.

Another function of VGAM1317 is therefore inhibition of FLJ10716 (Accession NM_018191). Accordingly, utilities of VGAM1317 include diagnosis, prevention and treatment of diseases and clinical conditions associated with FLJ10716. KIAA0976 (Accession NM_014917) is another VGAM1317 host target gene. KIAA0976 BINDING SITE is HOST TARGET binding site found in the 3' untranslated region of mRNA encoded by KIAA0976, corresponding to a HOST TARGET binding site such as BINDING SITE I, BINDING SITE II or BINDING SITE III. Table 2 illustrates the complementarity of the nucleotide sequences of KIAA0976 BINDING SITE, designated SEQ ID:17165, to the nucleotide sequence of VGAM1317 RNA, herein designated VGAM RNA, also designated SEQ ID:4028.

Another function of VGAM1317 is therefore inhibition of KIAA0976 (Accession NM_014917). Accordingly, utilities of VGAM1317 include diagnosis, prevention and treatment of diseases and clinical conditions associated with KIAA0976. KIAA1136 (Accession XM_166110) is another VGAM1317 host target gene. KIAA1136 BINDING SITE is HOST TARGET binding site found in the 3' untranslated region of mRNA encoded by KIAA1136, corresponding to a HOST TARGET binding site such as BINDING SITE I, BINDING SITE II or BINDING SITE III. Table 2 illustrates the complementarity of the nucleotide sequences of KIAA1136 BINDING SITE, designated SEQ ID:43882, to the nucleotide sequence of VGAM1317 RNA, herein designated VGAM RNA, also designated SEQ ID:4028.

Another function of VGAM1317 is therefore inhibition of KIAA1136 (Accession XM_166110). Accordingly, utilities of VGAM1317 include diagnosis, prevention and treatment of diseases and clinical conditions associated with KIAA1136. Ubiquitin-conjugating Enzyme E2 Variant 2 (UBE2V2, Accession NM_003350) is another VGAM1317 host target gene. UBE2V2 BINDING SITE is HOST TARGET binding site found in the 3' untranslated region of mRNA encoded by UBE2V2, corresponding to a HOST TARGET binding site such as BINDING SITE I, BINDING SITE II or BINDING SITE III. Table 2 illustrates the complementarity of the nucleotide sequences of UBE2V2 BINDING SITE, designated SEQ ID:9375, to the nucleotide sequence of VGAM1317 RNA, herein designated VGAM RNA, also designated SEQ ID:4028.

Another function of VGAM1317 is therefore inhibition of Ubiquitin-conjugating Enzyme E2 Variant 2 (UBE2V2, Accession NM_003350). Accordingly, utilities of VGAM1317 include diagnosis, prevention and treatment of diseases and clinical conditions associated with UBE2V2. LOC121274 (Accession XM_058547) is another VGAM1317 host target gene. LOC121274 BINDING SITE is HOST TARGET binding site found in the 5' untranslated region of mRNA encoded by LOC121274, corresponding to a HOST TARGET binding site such as BINDING SITE I, BINDING SITE II or BINDING SITE III. Table 2 illustrates the complementarity of the nucleotide sequences of LOC121274 BINDING SITE, designated SEQ ID:36655, to the nucleotide sequence of VGAM1317 RNA, herein designated VGAM RNA, also designated SEQ ID:4028.

Another function of VGAM1317 is therefore inhibition of LOC121274 (Accession XM_058547). Accordingly, utilities of VGAM1317 include diagnosis, prevention and treatment of diseases and clinical conditions associated with LOC121274. LOC121536 (Accession XM_058567) is another VGAM1317 host target gene. LOC121536 BINDING SITE is HOST TARGET binding site found in the 3' untranslated region of mRNA encoded by LOC121536, corresponding to a HOST TARGET binding site such as BINDING SITE I, BINDING SITE II or BINDING SITE III. Table 2 illustrates the complementarity of the nucleotide sequences of LOC121536 BINDING SITE, designated SEQ ID:36662, to the nucleotide sequence of VGAM1317 RNA, herein designated VGAM RNA, also designated SEQ ID:4028.

Another function of VGAM1317 is therefore inhibition of LOC121536 (Accession XM_058567). Accordingly, utilities of VGAM1317 include diagnosis, prevention and treatment of diseases and clinical conditions associated with LOC121536. LOC151201 (Accession XM_098021) is another VGAM1317 host target gene. LOC151201 BINDING SITE is HOST TARGET binding site found in the 3' untranslated region of mRNA encoded by LOC151201, corresponding to a HOST TARGET binding site such as BINDING SITE I, BINDING SITE II or BINDING SITE III. Table 2 illustrates the complementarity of the nucleotide sequences of LOC151201 BINDING SITE, designated SEQ ID:41319, to the nucleotide sequence of VGAM1317 RNA, herein designated VGAM RNA, also designated SEQ ID:4028.

Another function of VGAM1317 is therefore inhibition of LOC151201 (Accession XM_098021). Accordingly, utilities of VGAM1317 include diagnosis, prevention and treatment of diseases and clinical conditions associated with LOC151201. LOC152282 (Accession XM_087435) is another VGAM1317 host target gene. LOC152282 BINDING SITE is HOST TARGET binding site found in the 5' untranslated region of mRNA encoded by LOC152282, corresponding to a HOST TARGET binding site such as BINDING SITE I, BINDING SITE II or BINDING SITE III. Table 2 illustrates the complementarity of the nucleotide sequences of LOC152282 BINDING SITE, designated SEQ ID:39254, to the nucleotide sequence of VGAM1317 RNA, herein designated VGAM RNA, also designated SEQ ID:4028.

Another function of VGAM1317 is therefore inhibition of LOC152282 (Accession XM_087435). Accordingly, utilities of VGAM1317 include diagnosis, prevention and treatment of diseases and clinical conditions associated with LOC152282. LOC254312 (Accession XM_172839) is another VGAM1317 host target gene. LOC254312 BINDING SITE is HOST TARGET binding site found in the 5' untranslated region of mRNA encoded by LOC254312, corresponding to a HOST TARGET binding site such as BINDING SITE I, BINDING SITE II or BINDING SITE III. Table 2 illustrates the complementarity of the nucleotide sequences of LOC254312 BINDING SITE, designated SEQ ID:46114, to the nucleotide sequence of VGAM1317 RNA, herein designated VGAM RNA, also designated SEQ ID:4028.

Another function of VGAM1317 is therefore inhibition of LOC254312 (Accession XM_172839). Accordingly, utilities of VGAM1317 include diagnosis, prevention and treatment of diseases and clinical conditions associated with LOC254312. LOC254413 (Accession XM_173141) is another VGAM1317 host target gene. LOC254413 BINDING SITE is HOST TARGET binding site found in the 5' untranslated region of mRNA encoded by LOC254413, corresponding to a HOST TARGET binding site such as BINDING SITE I, BINDING SITE II or BINDING SITE III. Table 2 illustrates the complementarity of the nucleotide sequences of LOC254413 BINDING SITE, designated SEQ ID:46401, to the nucleotide sequence of VGAM1317 RNA, herein designated VGAM RNA, also designated SEQ ID:4028.

Another function of VGAM1317 is therefore inhibition of LOC254413 (Accession XM_173141). Accordingly, utilities of VGAM1317 include diagnosis, prevention and treatment of diseases and clinical conditions associated with LOC254413. LOC90288 (Accession XM_030669) is another VGAM1317 host target gene. LOC90288 BINDING SITE is HOST TARGET binding site found in the 3' untranslated region of mRNA encoded by LOC90288, corresponding to a HOST TARGET binding site such as BINDING SITE I, BINDING SITE II or BINDING SITE III. Table 2 illustrates the complementarity of the nucleotide sequences of LOC90288 BINDING SITE, designated SEQ ID:31107, to the nucleotide sequence of VGAM1317 RNA, herein designated VGAM RNA, also designated SEQ ID:4028.

Another function of VGAM1317 is therefore inhibition of LOC90288 (Accession XM_030669). Accordingly, utilities of VGAM1317 include diagnosis, prevention and treatment of diseases and clinical conditions associated with LOC90288. FIG. 1 further provides a conceptual description of a novel bioinformatically detected viral gene of the present invention, referred to here as Viral Genomic Address Messenger 1318 (VGAM1318) viral gene, which modulates expression of respective host target genes thereof, the function and utility of which host target genes is known in the art.

VGAM1318 is a novel bioinformatically detected regulatory, non protein coding, viral micro RNA (miRNA) gene. The method by which VGAM1318 was detected is described hereinabove with reference to FIGS. 1-8.

VGAM1318 gene, herein designated VGAM GENE, is a viral gene contained in the genome of Foot-and-mouth Disease Virus O. VGAM1318 host target gene, herein designated VGAM HOST TARGET GENE, is a human gene contained in the human genome.

VGAM1318 gene encodes a VGAM1318 precursor RNA, herein designated VGAM PRECURSOR RNA. Similar to other miRNA genes, and unlike most ordinary genes, VGAM1318 precursor RNA does not encode a protein. A nucleotide sequence identical or highly similar to the nucleotide sequence of VGAM1318 precursor RNA is designated SEQ ID:1304, and is provided hereinbelow with reference to the sequence listing part. Nucleotide sequence SEQ ID:1304 is located at position 7392 relative to the genome of Foot-and-mouth Disease Virus O.

VGAM1318 precursor RNA folds onto itself, forming VGAM1318 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1318 folded precursor RNA into VGAM1318 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1318 RNA is designated SEQ ID:4029, and is provided hereinbelow with reference to the sequence listing part.

VGAM1318 host target gene, herein designated VGAM HOST TARGET GENE, encodes a corresponding messenger RNA, VGAM1318 host target RNA, herein designated VGAM HOST TARGET RNA. VGAM1318 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1318 RNA, herein designated VGAM RNA, binds complementarily to one or more host target binding sites located in untranslated regions of VGAM1318 host target RNA, herein designated VGAM HOST TARGET RNA. This complementary binding is due to the fact that the nucleotide sequence of VGAM1318 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1318 RNA, herein designated VGAM RNA, may have a different number of host target binding sites in untranslated regions of a VGAM1318 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1318 RNA, herein designated VGAM RNA, to host target binding sites on VGAM1318 host target RNA, herein designated VGAM HOST TARGET RNA, such as BINDING SITE I, BINDING SITE II and BINDING SITE III, inhibits translation of VGAM1318 host target RNA into VGAM1318 host target protein, herein designated VGAM HOST TARGET PROTEIN. VGAM host target protein is therefore outlined by a broken line.

It is appreciated that VGAM1318 host target gene, herein designated VGAM HOST TARGET GENE, in fact represents a plurality of VGAM1318 host target genes. The mRNA of each one of this plurality of VGAM1318 host target genes comprises one or more host target binding sites, each having a nucleotide sequence which is at least partly complementary to VGAM1318 RNA, herein designated VGAM RNA, and which when bound by VGAM1318 RNA causes inhibition of translation of respective one or more VGAM1318 host target proteins.

It is further appreciated by one skilled in the art that the mode of translational inhibition illustrated by FIG. 1 with specific reference to translational inhibition exerted by VGAM1318 gene, herein designated VGAM GENE, on one or more VGAM1318 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1318 is inhibition of expression of host target genes, as part of a novel viral mechanism of attacking a host. Accordingly, utilities of VGAM1318 include diagnosis, prevention and treatment of viral infection by Foot-and-mouth Disease Virus O. Specific functions, and accordingly utilities, of VGAM1318 correlate with, and may be deduced from, the identity of the host target genes which VGAM1318 binds and inhibits, and the function of these host target genes, as elaborated hereinbelow.

Nucleotide sequences of the VGAM1318 precursor RNA, herein designated VGAM PRECURSOR RNA, and of the 'diced' VGAM1318 RNA, herein designated VGAM RNA, and a schematic representation of the secondary folding of VGAM1318 folded precursor RNA, herein designated VGAM FOLDED PRECURSOR RNA, of VGAM1318 are further described hereinbelow with reference to Table 1.

Nucleotide sequences of host target binding sites, such as BINDING SITE-I, BINDING SITE-II and BINDING SITE-III of FIG. 1, found on VGAM1318 host target RNA, and schematic representation of the complementarity of each of these host target binding sites to VGAM1318 RNA, herein designated VGAM RNA, are described hereinbelow with reference to Table 2.

As mentioned hereinabove with reference to FIG. 1, a function of VGAM1318 gene, herein designated VGAM is inhibition of expression of VGAM1318 target genes. It is appreciated that specific functions, and accordingly utilities, of VGAM1318 correlate with, and may be deduced from, the identity of the target genes which VGAM1318 binds and inhibits, and the function of these target genes, as elaborated hereinbelow.

Zinc Finger Protein 103 Homolog (mouse) (ZFP103, Accession NM_005667) is a VGAM1318 host target gene. ZFP103 BINDING SITE is HOST TARGET binding site found in the 5' untranslated region of mRNA encoded by ZFP103, corresponding to a HOST TARGET binding site such as BINDING SITE I, BINDING SITE II or BINDING SITE III. Table 2 illustrates the complementarity of the nucleotide sequences of ZFP103 BINDING SITE, designated SEQ ID:12220, to the nucleotide sequence of VGAM1318 RNA, herein designated VGAM RNA, also designated SEQ ID:4029.

A function of VGAM1318 is therefore inhibition of Zinc Finger Protein 103 Homolog (mouse) (ZFP103, Accession NM_005667). Accordingly, utilities of VGAM1318 include diagnosis, prevention and treatment of diseases and clinical conditions associated with ZFP103. FLJ11850 (Accession NM_022741) is another VGAM1318 host target gene. FLJ11850 BINDING SITE is HOST TARGET binding site found in the 3' untranslated region of mRNA encoded by FLJ11850, corresponding to a HOST TARGET binding site such as BINDING SITE I, BINDING SITE II or BINDING SITE III. Table 2 illustrates the complementarity of the nucleotide sequences of FLJ11850 BINDING SITE, designated SEQ ID:22953, to the nucleotide sequence of VGAM1318 RNA, herein designated VGAM RNA, also designated SEQ ID:4029.

Another function of VGAM1318 is therefore inhibition of FLJ11850 (Accession NM_022741). Accordingly, utilities of VGAM1318 include diagnosis, prevention and treatment of diseases and clinical conditions associated with FLJ11850. FLJ20507 (Accession NM_017849) is another VGAM1318 host target gene. FLJ20507 BINDING SITE1 and FLJ20507 BINDING SITE2 are HOST TARGET binding sites found in untranslated regions of mRNA encoded by FLJ20507, corresponding to HOST TARGET binding sites such as BINDING SITE I, BINDING SITE II or BINDING SITE III. Table 2 illustrates the complementarity of the nucleotide sequences of FLJ20507 BINDING SITE1 and FLJ20507 BINDING SITE2, designated SEQ ID:19515 and SEQ ID:30223 respectively, to the nucleotide sequence of VGAM1318 RNA, herein designated VGAM RNA, also designated SEQ ID:4029.

Another function of VGAM1318 is therefore inhibition of FLJ20507 (Accession NM_017849). Accordingly, utilities of VGAM1318 include diagnosis, prevention and treatment of diseases and clinical conditions associated with FLJ20507. LOC126302 (Accession XM_059020) is another VGAM1318 host target gene. LOC126302 BINDING SITE1 through LOC126302 BINDING SITE3 are HOST TARGET binding sites found in untranslated regions of mRNA encoded by LOC126302, corresponding to HOST TARGET binding sites such as BINDING SITE I, BINDING SITE II or BINDING SITE III. Table 2 illustrates the complementarity of the nucleotide sequences of LOC126302 BINDING SITE1 through LOC126302 BINDING SITE3, designated SEQ ID:36820, SEQ ID:36821 and SEQ ID:36822 respectively, to the nucleotide sequence of VGAM1318 RNA, herein designated VGAM RNA, also designated SEQ ID:4029.

Another function of VGAM1318 is therefore inhibition of LOC126302 (Accession XM_059020). Accordingly, utilities of VGAM1318 include diagnosis, prevention and treatment of diseases and clinical conditions associated with LOC126302. LOC149703 (Accession XM_097719) is another VGAM1318 host target gene. LOC149703 BINDING SITE is HOST TARGET binding site found in the 3' untranslated region of mRNA encoded by LOC149703, corresponding to a HOST TARGET binding site such as BINDING SITE I, BINDING SITE II or BINDING SITE III. Table 2 illustrates the complementarity of the nucleotide sequences of LOC149703 BINDING SITE, designated SEQ ID:41063, to the nucleotide sequence of VGAM1318 RNA, herein designated VGAM RNA, also designated SEQ ID:4029.

Another function of VGAM1318 is therefore inhibition of LOC149703 (Accession XM_097719). Accordingly, utilities of VGAM1318 include diagnosis, prevention and treatment of diseases and clinical conditions associated with LOC149703. FIG. 1 further provides a conceptual description of a novel bioinformatically detected viral gene of the present invention, referred to here as Viral Genomic Address Messenger 1319 (VGAM1319) viral gene, which modulates expression of respective host target genes thereof, the function and utility of which host target genes is known in the art.

VGAM1319 is a novel bioinformatically detected regulatory, non protein coding, viral micro RNA (miRNA) gene.

The method by which VGAM1319 was detected is described hereinabove with reference to FIGS. 1-8.

VGAM1319 gene, herein designated VGAM GENE, is a viral gene contained in the genome of Foot-and-mouth Disease Virus O. VGAM1319 host target gene, herein designated VGAM HOST TARGET GENE, is a human gene contained in the human genome.

VGAM1319 gene encodes a VGAM1319 precursor RNA, herein designated VGAM PRECURSOR RNA. Similar to other miRNA genes, and unlike most ordinary genes, VGAM1319 precursor RNA does not encode a protein. A nucleotide sequence identical or highly similar to the nucleotide sequence of VGAM1319 precursor RNA is designated SEQ ID:1305, and is provided hereinbelow with reference to the sequence listing part. Nucleotide sequence SEQ ID:1305 is located at position 6082 relative to the genome of Foot-and-mouth Disease Virus O.

VGAM1319 precursor RNA folds onto itself, forming VGAM1319 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1319 folded precursor RNA into VGAM1319 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1319 RNA is designated SEQ ID:4030, and is provided hereinbelow with reference to the sequence listing part.

VGAM1319 host target gene, herein designated VGAM HOST TARGET GENE, encodes a corresponding messenger RNA, VGAM1319 host target RNA, herein designated VGAM HOST TARGET RNA. VGAM1319 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1319 RNA, herein designated VGAM RNA, binds complementarily to one or more host target binding sites located in untranslated regions of VGAM1319 host target RNA, herein designated VGAM HOST TARGET RNA. This complementary binding is due to the fact that the nucleotide sequence of VGAM1319 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1319 RNA, herein designated VGAM RNA, may have a different number of host target binding sites in untranslated regions of a VGAM1319 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1319 RNA, herein designated VGAM RNA, to host target binding sites on VGAM1319 host target RNA, herein designated VGAM HOST TARGET RNA, such as BINDING SITE I, BINDING SITE II and BINDING SITE III, inhibits translation of VGAM1319 host target RNA into VGAM1319 host target protein, herein designated VGAM HOST TARGET PROTEIN. VGAM host target protein is therefore outlined by a broken line.

It is appreciated that VGAM1319 host target gene, herein designated VGAM HOST TARGET GENE, in fact represents a plurality of VGAM1319 host target genes. The mRNA of each one of this plurality of VGAM1319 host target genes comprises one or more host target binding sites, each having a nucleotide sequence which is at least partly complementary to VGAM1319 RNA, herein designated VGAM RNA, and which when bound by VGAM1319 RNA causes inhibition of translation of respective one or more VGAM1319 host target proteins.

It is further appreciated by one skilled in the art that the mode of translational inhibition illustrated by FIG. 1 with specific reference to translational inhibition exerted by VGAM1319 gene, herein designated VGAM GENE, on one or more VGAM1319 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1319 is inhibition of expression of host target genes, as part of a novel viral mechanism of attacking a host. Accordingly, utilities of VGAM1319 include diagnosis, prevention and treatment of viral infection by Foot-and-mouth Disease Virus O. Specific functions, and accordingly utilities, of VGAM1319 correlate with, and may be deduced from, the identity of the host target genes which VGAM1319 binds and inhibits, and the function of these host target genes, as elaborated hereinbelow.

Nucleotide sequences of the VGAM1319 precursor RNA, herein designated VGAM PRECURSOR RNA, and of the 'diced' VGAM1319 RNA, herein designated VGAM RNA, and a schematic representation of the secondary folding of VGAM1319 folded precursor RNA, herein designated VGAM FOLDED PRECURSOR RNA, of VGAM1319 are further described hereinbelow with reference to Table 1.

Nucleotide sequences of host target binding sites, such as BINDING SITE-I, BINDING SITE-II and BINDING SITE-III of FIG. 1, found on VGAM1319 host target RNA, and schematic representation of the complementarity of each of these host target binding sites to VGAM1319 RNA, herein designated VGAM RNA, are described hereinbelow with reference to Table 2.

As mentioned hereinabove with reference to FIG. 1, a function of VGAM1319 gene, herein designated VGAM is inhibition of expression of VGAM1319 target genes. It is appreciated that specific functions, and accordingly utilities, of VGAM1319 correlate with, and may be deduced from, the identity of the target genes which VGAM1319 binds and inhibits, and the function of these target genes, as elaborated hereinbelow.

Ankyrin-like with Transmembrane Domains 1 (ANKTM1, Accession NM_007332) is a VGAM1319 host target gene. ANKTM1 BINDING SITE is HOST TARGET binding site found in the 3' untranslated region of mRNA encoded by ANKTM1, corresponding to a HOST TARGET binding site such as BINDING SITE I, BINDING SITE II or BINDING SITE III. Table 2 illustrates the complementarity of the nucleotide sequences of ANKTM1 BINDING SITE, designated SEQ ID:14254, to the nucleotide sequence of VGAM1319 RNA, herein designated VGAM RNA, also designated SEQ ID:4030.

A function of VGAM1319 is therefore inhibition of Ankyrin-like with Transmembrane Domains 1 (ANKTM1, Accession NM_007332), a gene which attaches integral membrane proteins to cytoskeletal elements. Accordingly, utilities of VGAM1319 include diagnosis, prevention and treatment of diseases and clinical conditions associated with ANKTM1. The function of ANKTM1 and its association with various diseases and clinical conditions, has been established by previous studies, as described hereinabove with reference to VGAM644. Growth Arrest-specific 11 (GAS11, Accession NM_001481) is another VGAM1319 host target gene. GAS11 BINDING SITE is HOST TARGET binding site found in the 3' untranslated region of mRNA encoded by GAS11, corresponding to a HOST TARGET binding site such as BINDING SITE I, BINDING SITE II or BINDING SITE III. Table 2 illustrates the complementarity of the nucleotide sequences of GAS11 BINDING SITE, designated SEQ ID:7221, to the nucleotide sequence of VGAM1319 RNA, herein designated VGAM RNA, also designated SEQ ID:4030.

Another function of VGAM1319 is therefore inhibition of Growth Arrest-specific 11 (GAS11, Accession NM_001481). Accordingly, utilities of VGAM1319 include diagnosis, prevention and treatment of diseases and clinical conditions associated with GAS11. LanC Lantibiotic Synthetase Component C-like 1 (bacterial) (LANCL1, Accession NM_006055) is another VGAM1319 host target gene. LANCL1 BINDING SITE is HOST TARGET binding site found in the 3' untranslated region of mRNA encoded by LANCL1, corresponding to a HOST TARGET binding site such as BINDING SITE I, BINDING SITE II or BINDING SITE III. Table 2 illustrates the complementarity of the nucleotide sequences of LANCL1 BINDING SITE, designated SEQ ID:12695, to the nucleotide sequence of VGAM1319 RNA, herein designated VGAM RNA, also designated SEQ ID:4030.

Another function of VGAM1319 is therefore inhibition of LanC Lantibiotic Synthetase Component C-like 1 (bacterial) (LANCL1, Accession NM_006055), a gene which binds the C-terminus of stomatin. Accordingly, utilities of VGAM1319 include diagnosis, prevention and treatment of diseases and clinical conditions associated with LANCL1. The function of LANCL1 and its association with various diseases and clinical conditions, has been established by previous studies, as described hereinabove with reference to VGAM656. Microtubule-associated Protein Tau (MAPT, Accession NM_005910) is another VGAM1319 host target gene. MAPT BINDING SITE1 through MAPT BINDING SITE4 are HOST TARGET binding sites found in untranslated regions of mRNA encoded by MAPT, corresponding to HOST TARGET binding sites such as BINDING SITE I, BINDING SITE II or BINDING SITE III. Table 2 illustrates the complementarity of the nucleotide sequences of MAPT BINDING SITE1 through MAPT BINDING SITE4, designated SEQ ID:12539, SEQ ID:18827, SEQ ID:18833 and SEQ ID:18839 respectively, to the nucleotide sequence of VGAM1319 RNA, herein designated VGAM RNA, also designated SEQ ID:4030.

Another function of VGAM1319 is therefore inhibition of Microtubule-associated Protein Tau (MAPT, Accession NM_005910), a gene which Microtubule-associated protein tau; promotes microtubule assembly. Accordingly, utilities of VGAM1319 include diagnosis, prevention and treatment of diseases and clinical conditions associated with MAPT. The function of MAPT and its association with various diseases and clinical conditions, has been established by previous studies, as described hereinabove with reference to VGAM178. Neurexin 2 (NRXN2, Accession NM_138734) is another VGAM1319 host target gene. NRXN2 BINDING SITE1 through NRXN2 BINDING SITE3 are HOST TARGET binding sites found in untranslated regions of mRNA encoded by NRXN2, corresponding to HOST TARGET binding sites such as BINDING SITE I, BINDING SITE II or BINDING SITE III. Table 2 illustrates the complementarity of the nucleotide sequences of NRXN2 BINDING SITE1 through NRXN2 BINDING SITE3, designated SEQ ID:28990, SEQ ID:17468 and SEQ ID:8667 respectively, to the nucleotide sequence of VGAM1319 RNA, herein designated VGAM RNA, also designated SEQ ID:4030.

Another function of VGAM1319 is therefore inhibition of Neurexin 2 (NRXN2, Accession NM_138734), a gene which may be involved in cell recognition, cell adhesion, and may mediate intracellular signaling. Accordingly, utilities of VGAM1319 include diagnosis, prevention and treatment of diseases and clinical conditions associated with NRXN2. The function of NRXN2 and its association with various diseases and clinical conditions, has been established by previous studies, as described hereinabove with reference to VGAM178. FLJ20584 (Accession NM_017891) is another VGAM1319 host target gene. FLJ20584 BINDING SITE is HOST TARGET binding site found in the 3' untranslated region of mRNA encoded by FLJ20584, corresponding to a HOST TARGET binding site such as BINDING SITE I, BINDING SITE II or BINDING SITE III. Table 2 illustrates the complementarity of the nucleotide sequences of FLJ20584 BINDING SITE, designated SEQ ID:19558, to the nucleotide sequence of VGAM1319 RNA, herein designated VGAM RNA, also designated SEQ ID:4030.

Another function of VGAM1319 is therefore inhibition of FLJ20584 (Accession NM_017891). Accordingly, utilities of VGAM1319 include diagnosis, prevention and treatment of diseases and clinical conditions associated with FLJ20584. FLJ20699 (Accession NM_017931) is another VGAM1319 host target gene. FLJ20699 BINDING SITE is HOST TARGET binding site found in the 3' untranslated region of mRNA encoded by FLJ20699, corresponding to a HOST TARGET binding site such as BINDING SITE I, BINDING SITE II or BINDING SITE III. Table 2 illustrates the complementarity of the nucleotide sequences of FLJ20699 BINDING SITE, designated SEQ ID:19616, to the nucleotide sequence of VGAM1319 RNA, herein designated VGAM RNA, also designated SEQ ID:4030.

Another function of VGAM1319 is therefore inhibition of FLJ20699 (Accession NM_017931). Accordingly, utilities of VGAM1319 include diagnosis, prevention and treatment of diseases and clinical conditions associated with FLJ20699. KIAA0603 (Accession NM_014832) is another VGAM1319 host target gene. KIAA0603 BINDING SITE is HOST TARGET binding site found in the 3' untranslated region of mRNA encoded by KIAA0603, corresponding to a HOST TARGET binding site such as BINDING SITE I, BINDING SITE II or BINDING SITE III. Table 2 illustrates the complementarity of the nucleotide sequences of KIAA0603 BIND- ING SITE, designated SEQ ID:16830, to the nucleotide sequence of VGAM1319 RNA, herein designated VGAM RNA, also designated SEQ ID:4030.

Another function of VGAM1319 is therefore inhibition of KIAA0603 (Accession NM_014832). Accordingly, utilities of VGAM1319 include diagnosis, prevention and treatment of diseases and clinical conditions associated with KIAA0603. KIAA1399 (Accession XM_046685) is another VGAM1319 host target gene. KIAA1399 BINDING SITE is HOST TARGET binding site found in the 5' untranslated region of mRNA encoded by KIAA1399, corresponding to a HOST TARGET binding site such as BINDING SITE I, BINDING SITE II or BINDING SITE III. Table 2 illustrates the complementarity of the nucleotide sequences of KIAA1399 BINDING SITE, designated SEQ ID:34797, to the nucleotide sequence of VGAM1319 RNA, herein designated VGAM RNA, also designated SEQ ID:4030.

Another function of VGAM1319 is therefore inhibition of KIAA1399 (Accession XM_046685). Accordingly, utilities of VGAM1319 include diagnosis, prevention and treatment of diseases and clinical conditions associated with KIAA1399. KIAA1404 (Accession XM_030494) is another VGAM1319 host target gene. KIAA1404 BINDING SITE is HOST TARGET binding site found in the 3' untranslated region of mRNA encoded by KIAA1404, corresponding to a HOST TARGET binding site such as BINDING SITE I, BINDING SITE II or BINDING SITE III. Table 2 illustrates the complementarity of the nucleotide sequences of KIAA1404 BINDING SITE, designated SEQ ID:31049, to the nucleotide sequence of VGAM1319 RNA, herein designated VGAM RNA, also designated SEQ ID:4030.

Another function of VGAM1319 is therefore inhibition of KIAA1404 (Accession XM_030494). Accordingly, utilities of VGAM1319 include diagnosis, prevention and treatment of diseases and clinical conditions associated with KIAA1404. WIT-1 (Accession NM_015855) is another VGAM1319 host target gene. WIT-1 BINDING SITE is HOST TARGET binding site found in the 5' untranslated region of mRNA encoded by WIT-1, corresponding to a HOST TARGET binding site such as BINDING SITE I, BINDING SITE II or BINDING SITE III. Table 2 illustrates the complementarity of the nucleotide sequences of WIT-1 BINDING SITE, designated SEQ ID:17988, to the nucleotide sequence of VGAM1319 RNA, herein designated VGAM RNA, also designated SEQ ID:4030.

Another function of VGAM1319 is therefore inhibition of WIT-1 (Accession NM_015855). Accordingly, utilities of VGAM1319 include diagnosis, prevention and treatment of diseases and clinical conditions associated with WIT-1. LOC197342 (Accession XM_113869) is another VGAM1319 host target gene. LOC197342 BINDING SITE is HOST TARGET binding site found in the 3' untranslated region of mRNA encoded by LOC197342, corresponding to a HOST TARGET binding site such as BINDING SITE I, BINDING SITE II or BINDING SITE III. Table 2 illustrates the complementarity of the nucleotide sequences of LOC197342 BINDING SITE, designated SEQ ID:42486, to the nucleotide sequence of VGAM1319 RNA, herein designated VGAM RNA, also designated SEQ ID:4030.

Another function of VGAM1319 is therefore inhibition of LOC197342 (Accession XM_113869). Accordingly, utilities of VGAM1319 include diagnosis, prevention and treatment of diseases and clinical conditions associated with LOC197342. FIG. 1 further provides a conceptual description of a novel bioinformatically detected viral gene of the present invention, referred to here as Viral Genomic Address Messenger 1320 (VGAM1320) viral gene, which modulates expression of respective host target genes thereof, the function and utility of which host target genes is known in the art.

VGAM1320 is a novel bioinformatically detected regulatory, non protein coding, viral micro RNA (miRNA) gene. The method by which VGAM1320 was detected is described hereinabove with reference to FIGS. 1-8.

VGAM1320 gene, herein designated VGAM GENE, is a viral gene contained in the genome of Melanoplus Sanguinipes Entomopoxvirus. VGAM1320 host target gene, herein designated VGAM HOST TARGET GENE, is a human gene contained in the human genome.

VGAM1320 gene encodes a VGAM1320 precursor RNA, herein designated VGAM PRECURSOR RNA. Similar to other miRNA genes, and unlike most ordinary genes, VGAM1320 precursor RNA does not encode a protein. A nucleotide sequence identical or highly similar to the nucleotide sequence of VGAM1320 precursor RNA is designated SEQ ID:1306, and is provided hereinbelow with reference to the sequence listing part. Nucleotide sequence SEQ ID:1306 is located at position 221058 relative to the genome of Melanoplus Sanguinipes Entomopoxvirus.

VGAM1320 precursor RNA folds onto itself, forming VGAM1320 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1320 folded precursor RNA into VGAM1320 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1320 RNA is designated SEQ ID:4031, and is provided hereinbelow with reference to the sequence listing part.

VGAM1320 host target gene, herein designated VGAM HOST TARGET GENE, encodes a corresponding messenger RNA, VGAM1320 host target RNA, herein designated VGAM HOST TARGET RNA. VGAM1320 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1320 RNA, herein designated VGAM RNA, binds complementarily to one or more host target binding sites located in untranslated regions of VGAM1320 host target RNA, herein designated VGAM HOST TARGET RNA. This complementary binding is due to the fact that the nucleotide sequence of VGAM1320 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1320 RNA, herein designated VGAM RNA, may have a different number of host target binding sites in untranslated regions of a VGAM1320 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1320 RNA, herein designated VGAM RNA, to host target binding sites on VGAM1320 host target RNA, herein designated VGAM HOST TARGET RNA, such as BINDING SITE I, BINDING SITE II and BINDING SITE III, inhibits translation of VGAM1320 host target RNA into VGAM1320 host target protein, herein designated VGAM HOST TARGET PROTEIN. VGAM host target protein is therefore outlined by a broken line.

It is appreciated that VGAM1320 host target gene, herein designated VGAM HOST TARGET GENE, in fact represents a plurality of VGAM1320 host target genes. The mRNA of each one of this plurality of VGAM1320 host target genes comprises one or more host target binding sites, each having a nucleotide sequence which is at least partly complementary to VGAM1320 RNA, herein designated VGAM RNA, and which when bound by VGAM1320 RNA causes inhibition of translation of respective one or more VGAM1320 host target proteins.

It is further appreciated by one skilled in the art that the mode of translational inhibition illustrated by FIG. 1 with specific reference to translational inhibition exerted by VGAM1320 gene, herein designated VGAM GENE, on one or more VGAM1320 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1320 is inhibition of expression of host target genes, as part of a novel viral mechanism of attacking a host. Accordingly, utilities of VGAM1320 include diagnosis, prevention and treatment of viral infection by Melanoplus Sanguinipes Entomopoxvirus. Specific functions, and accordingly utilities, of VGAM1320 correlate with, and may be deduced from, the identity of the host target genes which VGAM1320 binds and inhibits, and the function of these host target genes, as elaborated hereinbelow.

Nucleotide sequences of the VGAM1320 precursor RNA, herein designated VGAM PRECURSOR RNA, and of the 'diced' VGAM1320 RNA, herein designated VGAM RNA, and a schematic representation of the secondary folding of VGAM1320 folded precursor RNA, herein designated VGAM FOLDED PRECURSOR RNA, of VGAM1320 are further described hereinbelow with reference to Table 1.

Nucleotide sequences of host target binding sites, such as BINDING SITE-I, BINDING SITE-II and BINDING SITE-III of FIG. 1, found on VGAM1320 host target RNA, and schematic representation of the complementarity of each of these host target binding sites to VGAM1320 RNA, herein designated VGAM RNA, are described hereinbelow with reference to Table 2.

As mentioned hereinabove with reference to FIG. 1, a function of VGAM1320 gene, herein designated VGAM is inhibition of expression of VGAM1320 target genes. It is appreciated that specific functions, and accordingly utilities, of VGAM1320 correlate with, and may be deduced from, the identity of the target genes which VGAM1320 binds and inhibits, and the function of these target genes, as elaborated hereinbelow.

Histidine Ammonia-lyase (HAL, Accession NM_002108) is a VGAM1320 host target gene. HAL BINDING SITE is HOST TARGET binding site found in the 3" untranslated region of mRNA encoded by HAL, corresponding to a HOST TARGET binding site such as BINDING SITE I, BINDING SITE II or BINDING SITE III. Table 2 illustrates the complementarity of the nucleotide sequences of HAL BINDING SITE, designated SEQ ID:7886, to the nucleotide sequence of VGAM1320 RNA, herein designated VGAM RNA, also designated SEQ ID:4031.

A function of VGAM1320 is therefore inhibition of Histidine Ammonia-lyase (HAL, Accession NM_002108). Accordingly, utilities of VGAM1320 include diagnosis, prevention and treatment of diseases and clinical conditions associated with HAL. TSG (Accession NM_020648) is another VGAM1320 host target gene. TSG BINDING SITE is HOST TARGET binding site found in the 3" untranslated region of mRNA encoded by TSG, corresponding to a HOST TARGET binding site such as BINDING SITE I, BINDING SITE II or BINDING SITE III. Table 2 illustrates the complementarity of the nucleotide sequences of TSG BINDING SITE, designated SEQ ID:21809, to the nucleotide sequence of VGAM1320 RNA, herein designated VGAM RNA, also designated SEQ ID:4031.

Another function of VGAM1320 is therefore inhibition of TSG (Accession NM_020648). Accordingly, utilities of VGAM1320 include diagnosis, prevention and treatment of diseases and clinical conditions associated with TSG. BCMP1 (Accession NM_031442) is another VGAM1320 host target gene. BCMP1 BINDING SITE is HOST TARGET binding site found in the 3' untranslated region of mRNA encoded by BCMP1, corresponding to a HOST TARGET binding site such as BINDING SITE I, BINDING SITE II or BINDING SITE III. Table 2 illustrates the complementarity of the nucleotide sequences of BCMP1 BINDING SITE, designated SEQ ID:25453, to the nucleotide sequence of VGAM1320 RNA, herein designated VGAM RNA, also designated SEQ ID:4031.

Another function of VGAM1320 is therefore inhibition of BCMP1 (Accession NM_031442). Accordingly, utilities of VGAM1320 include diagnosis, prevention and treatment of diseases and clinical conditions associated with BCMP1. FIG. 1 further provides a conceptual description of a novel bioinformatically detected viral gene of the present invention, referred to here as Viral Genomic Address Messenger 1321 (VGAM1321) viral gene, which modulates expression of respective host target genes thereof, the function and utility of which host target genes is known in the art.

VGAM1321 is a novel bioinformatically detected regulatory, non protein coding, viral micro RNA (miRNA) gene. The method by which VGAM1321 was detected is described hereinabove with reference to FIGS. 1-8.

VGAM1321 gene, herein designated VGAM GENE, is a viral gene contained in the genome of Melanoplus Sanguinipes Entomopoxvirus. VGAM1321 host target gene, herein designated VGAM HOST TARGET GENE, is a human gene contained in the human genome.

VGAM1321 gene encodes a VGAM1321 precursor RNA, herein designated VGAM PRECURSOR RNA. Similar to other miRNA genes, and unlike most ordinary genes, VGAM1321 precursor RNA does not encode a protein. A nucleotide sequence identical or highly similar to the nucleotide sequence of VGAM1321 precursor RNA is designated SEQ ID:1307, and is provided hereinbelow with reference to the sequence listing part. Nucleotide sequence SEQ ID:1307 is located at position 223345 relative to the genome of Melanoplus Sanguinipes Entomopoxvirus.

VGAM1321 precursor RNA folds onto itself, forming VGAM1321 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1321 folded precursor RNA into VGAM1321 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1321 RNA is designated SEQ ID:4032, and is provided hereinbelow with reference to the sequence listing part.

VGAM1321 host target gene, herein designated VGAM HOST TARGET GENE, encodes a corresponding messenger RNA, VGAM1321 host target RNA, herein designated VGAM HOST TARGET RNA. VGAM1321 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1321 RNA, herein designated VGAM RNA, binds complementarily to one or more host target binding sites located in untranslated regions of VGAM1321 host target RNA, herein designated VGAM HOST TARGET RNA. This complementary binding is due to the fact that the nucleotide sequence of VGAM1321 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1321 RNA, herein designated VGAM RNA, may have a different number of host target binding sites in untranslated regions of a VGAM1321 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1321 RNA, herein designated VGAM RNA, to host target binding sites on VGAM1321 host target RNA, herein designated VGAM HOST TARGET RNA, such as BINDING SITE I, BINDING SITE II and BINDING SITE III, inhibits translation of VGAM1321 host target RNA into VGAM1321 host target protein, herein designated VGAM HOST TARGET PROTEIN. VGAM host target protein is therefore outlined by a broken line.

It is appreciated that VGAM1321 host target gene, herein designated VGAM HOST TARGET GENE, in fact represents a plurality of VGAM1321 host target genes. The mRNA of each one of this plurality of VGAM1321 host target genes comprises one or more host target binding sites, each having a nucleotide sequence which is at least partly complementary to VGAM1321 RNA, herein designated VGAM RNA, and which when bound by VGAM1321 RNA causes inhibition of translation of respective one or more VGAM1321 host target proteins.

It is further appreciated by one skilled in the art that the mode of translational inhibition illustrated by FIG. 1 with specific reference to translational inhibition exerted by VGAM1321 gene, herein designated VGAM GENE, on one or more VGAM1321 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1321 is inhibition of expression of host target genes, as part of a novel viral mechanism of attacking a host. Accordingly, utilities of VGAM1321 include diagnosis, prevention and treatment of viral infection by Melanoplus Sanguinipes Entomopoxvirus. Specific functions, and accordingly utilities, of VGAM1321 correlate with, and may be deduced from, the identity of the host target genes which VGAM1321 binds and inhibits, and the function of these host target genes, as elaborated hereinbelow.

Nucleotide sequences of the VGAM1321 precursor RNA, herein designated VGAM PRECURSOR RNA, and of the 'diced' VGAM1321 RNA, herein designated VGAM RNA, and a schematic representation of the secondary folding of VGAM1321 folded precursor RNA, herein designated VGAM FOLDED PRECURSOR RNA, of VGAM1321 are further described hereinbelow with reference to Table 1.

Nucleotide sequences of host target binding sites, such as BINDING SITE-I, BINDING SITE-II and BINDING SITE-III of FIG. 1, found on VGAM1321 host target RNA, and schematic representation of the complementarity of each of these host target binding sites to VGAM1321 RNA, herein designated VGAM RNA, are described hereinbelow with reference to Table 2.

As mentioned hereinabove with reference to FIG. 1, a function of VGAM1321 gene, herein designated VGAM is inhibition of expression of VGAM1321 target genes. It is appreciated that specific functions, and accordingly utilities, of VGAM1321 correlate with, and may be deduced from, the identity of the target genes which VGAM1321 binds and inhibits, and the function of these target genes, as elaborated hereinbelow.

Cyclin D2 (CCND2, Accession NM_001759) is a VGAM1321 host target gene. CCND2 BINDING SITE is HOST TARGET binding site found in the 3' untranslated region of mRNA encoded by CCND2, corresponding to a HOST TARGET binding site such as BINDING SITE I, BINDING SITE II or BINDING SITE III. Table 2 illustrates the complementarity of the nucleotide sequences of CCND2 BINDING SITE, designated SEQ ID:7511, to the nucleotide sequence of VGAM1321 RNA, herein designated VGAM RNA, also designated SEQ ID:4032.

A function of VGAM1321 is therefore inhibition of Cyclin D2 (CCND2, Accession NM_001759), a gene which is essential for the control of the cell cycle at the g1/s (start) transition. Accordingly, utilities of VGAM1321 include diagnosis, prevention and treatment of diseases and clinical conditions associated with CCND2. The function of CCND2 and its association with various diseases and clinical conditions, has been established by previous studies, as described hereinabove with reference to VGAM128. Chloride Channel, Calcium Activated, Family Member 2 (CLCA2, Accession NM_006536) is another VGAM1321 host target gene. CLCA2 BINDING SITE is HOST TARGET binding site found in the 3' untranslated region of mRNA encoded by CLCA2, corresponding to a HOST TARGET binding site such as BINDING SITE I, BINDING SITE II or BINDING SITE III. Table 2 illustrates the complementarity of the nucleotide sequences of CLCA2 BINDING SITE, designated SEQ ID:13289, to the nucleotide sequence of VGAM1321 RNA, herein designated VGAM RNA, also designated SEQ ID:4032.

Another function of VGAM1321 is therefore inhibition of Chloride Channel, Calcium Activated, Family Member 2 (CLCA2, Accession NM_006536), a gene which Calcium-sensitive chloride channel, is suggested to play a role in the complex pathogenesis of cystic fibrosis. Accordingly, utilities of VGAM1321 include diagnosis, prevention and treatment of diseases and clinical conditions associated with CLCA2. The function of CLCA2 and its association with various diseases and clinical conditions, has been established by previous studies, as described hereinabove with reference to VGAM851. M-phase Phosphoprotein 1 (MPHOSPH1, Accession NM_016195) is another VGAM1321 host target gene. MPHOSPH1 BINDING SITE is HOST TARGET binding site found in the 3' untranslated region of mRNA encoded by MPHOSPH1, corresponding to a HOST TARGET binding site such as BINDING SITE I, BINDING SITE II or BINDING SITE III. Table 2 illustrates the complementarity of the nucleotide sequences of MPHOSPH1 BINDING SITE, designated SEQ ID:18286, to the nucleotide sequence of VGAM1321 RNA, herein designated VGAM RNA, also designated SEQ ID:4032.

Another function of VGAM1321 is therefore inhibition of M-phase Phosphoprotein 1 (MPHOSPH1, Accession NM_016195), a gene which is Phosphorylated during M-phase and interacts with guanosine triphosphate. Accordingly, utilities of VGAM1321 include diagnosis, prevention and treatment of diseases and clinical conditions associated with MPHOSPH1. The function of MPHOSPH1 and its association with various diseases and clinical conditions, has been established by previous studies, as described hereinabove with reference to VGAM1189. Burkitt Lymphoma Receptor 1, GTP Binding Protein (chemokine (C-X-C motif) Receptor 5) (BLR1, Accession NM_001716) is another VGAM1321 host target gene. BLR1 BINDING SITE1 and BLR1 BINDING SITE2 are HOST TARGET binding sites found in untranslated regions of mRNA encoded by BLR1, corresponding to HOST TARGET binding sites such as BINDING SITE I, BINDING SITE II or BINDING SITE III. Table 2 illustrates the complementarity of the nucleotide sequences of BLR1 BINDING SITE1 and BLR1 BINDING SITE2, designated SEQ ID:7446 and SEQ ID:26776 respectively, to the nucleotide sequence of VGAM1321 RNA, herein designated VGAM RNA, also designated SEQ ID:4032.

Another function of VGAM1321 is therefore inhibition of Burkitt Lymphoma Receptor 1, GTP Binding Protein (chemokine (C-X-C motif) Receptor 5) (BLR1, Accession NM_001716). Accordingly, utilities of VGAM1321 include diagnosis, prevention and treatment of diseases and clinical conditions associated with BLR1. Dynein, Cytoplasmic, Light Intermediate Polypeptide 1 (DNCLI1, Accession XM_003119) is another VGAM1321 host target gene. DNCLI1 BINDING SITE is HOST TARGET binding site found in the 3' untranslated region of mRNA encoded by DNCLI1, corresponding to a HOST TARGET binding site such as BINDING SITE I, BINDING SITE II or BINDING SITE III. Table 2 illustrates the complementarity of the nucleotide sequences of DNCLI1 BINDING SITE, designated SEQ ID:29928, to the nucleotide sequence of VGAM1321 RNA, herein designated VGAM RNA, also designated SEQ ID:4032.

Another function of VGAM1321 is therefore inhibition of Dynein, Cytoplasmic, Light Intermediate Polypeptide 1 (DNCLI1, Accession XM_003119). Accordingly, utilities of VGAM1321 include diagnosis, prevention and treatment of diseases and clinical conditions associated with DNCLI1. KIAA0644 (Accession NM_014817) is another VGAM1321 host target gene. KIAA0644 BINDING SITE is HOST TARGET binding site found in the 3" untranslated region of mRNA encoded by KIAA0644, corresponding to a HOST TARGET binding site such as BINDING SITE I, BINDING SITE II or BINDING SITE III. Table 2 illustrates the complementarity of the nucleotide sequences of KIAA0644 BINDING SITE, designated SEQ ID:16781, to the nucleotide sequence of VGAM1321 RNA, herein designated VGAM RNA, also designated SEQ ID:4032.

Another function of VGAM1321 is therefore inhibition of KIAA0644 (Accession NM_014817). Accordingly, utilities of VGAM1321 include diagnosis, prevention and treatment of diseases and clinical conditions associated with KIAA0644. M96 (Accession NM_007358) is another VGAM1321 host target gene. M96 BINDING SITE is HOST TARGET binding site found in the 3' untranslated region of mRNA encoded by M96, corresponding to a HOST TARGET binding site such as BINDING SITE I, BINDING SITE II or BINDING SITE III. Table 2 illustrates the complementarity of the nucleotide sequences of M96 BINDING SITE, designated SEQ ID:14288, to the nucleotide sequence of VGAM1321 RNA, herein designated VGAM RNA, also designated SEQ ID:4032.

Another function of VGAM1321 is therefore inhibition of M96 (Accession NM_007358). Accordingly, utilities of VGAM1321 include diagnosis, prevention and treatment of diseases and clinical conditions associated with M96. MIG-6 (Accession NM_018948) is another VGAM1321 host target gene. MIG-6 BINDING SITE is HOST TARGET binding site found in the 3' untranslated region of mRNA encoded by MIG-6, corresponding to a HOST TARGET binding site such as BINDING SITE I, BINDING SITE II or BINDING SITE III. Table 2 illustrates the complementarity of the nucleotide sequences of MIG-6 BINDING SITE, designated SEQ ID:21018, to the nucleotide sequence of VGAM1321 RNA, herein designated VGAM RNA, also designated SEQ ID:4032.

Another function of VGAM1321 is therefore inhibition of MIG-6 (Accession NM_018948). Accordingly, utilities of VGAM1321 include diagnosis, prevention and treatment of diseases and clinical conditions associated with MIG-6. MRPL56 (Accession NM_032857) is another VGAM1321 host target gene. MRPL56 BINDING SITE is HOST TARGET binding site found in the 3' untranslated region of mRNA encoded by MRPL56, corresponding to a HOST TARGET binding site such as BINDING SITE I, BINDING SITE II or BINDING SITE III. Table 2 illustrates the complementarity of the nucleotide sequences of MRPL56 BINDING SITE, designated SEQ ID:26658, to the nucleotide sequence of VGAM1321 RNA, herein designated VGAM RNA, also designated SEQ ID:4032.

Another function of VGAM1321 is therefore inhibition of MRPL56 (Accession NM_032857). Accordingly, utilities of VGAM1321 include diagnosis, prevention and treatment of diseases and clinical conditions associated with MRPL56. Oxysterol Binding Protein-like 8 (OSBPL8, Accession NM_020841) is another VGAM1321 host target gene. OSBPL8 BINDING SITE is HOST TARGET binding site found in the 3' untranslated region of mRNA encoded by OSBPL8, corresponding to a HOST TARGET binding site such as BINDING SITE I, BINDING SITE II or BINDING SITE III. Table 2 illustrates the complementarity of the nucleotide sequences of OSBPL8 BINDING SITE, designated SEQ ID:21901, to the nucleotide sequence of VGAM1321 RNA, herein designated VGAM RNA, also designated SEQ ID:4032.

Another function of VGAM1321 is therefore inhibition of Oxysterol Binding Protein-like 8 (OSBPL8, Accession NM_020841). Accordingly, utilities of VGAM1321 include diagnosis, prevention and treatment of diseases and clinical conditions associated with OSBPL8. LOC116068 (Accession XM_057302) is another VGAM1321 host target gene. LOC116068 BINDING SITE is HOST TARGET binding site found in the 3' untranslated region of mRNA encoded by LOC116068, corresponding to a HOST TARGET binding site such as BINDING SITE I, BINDING SITE II or BINDING SITE III. Table 2 illustrates the complementarity of the nucleotide sequences of LOC116068 BINDING SITE, designated SEQ ID:36499, to the nucleotide sequence of VGAM1321 RNA, herein designated VGAM RNA, also designated SEQ ID:4032.

Another function of VGAM1321 is therefore inhibition of LOC116068 (Accession XM_057302). Accordingly, utilities of VGAM1321 include diagnosis, prevention and treatment of diseases and clinical conditions associated with LOC116068. LOC51141 (Accession XM_043953) is another VGAM1321 host target gene. LOC51141 BINDING SITE is HOST TARGET binding site found in the 3' untranslated region of mRNA encoded by LOC51141, corresponding to a HOST TARGET binding site such as BINDING SITE I, BINDING SITE II or BINDING SITE III. Table 2 illustrates the complementarity of the nucleotide sequences of LOC51141 BINDING SITE, designated SEQ ID:34050, to the nucleotide sequence of VGAM1321 RNA, herein designated VGAM RNA, also designated SEQ ID:4032.

Another function of VGAM1321 is therefore inhibition of LOC51141 (Accession XM_043953). Accordingly, utilities of VGAM1321 include diagnosis, prevention and treatment of diseases and clinical conditions associated with LOC51141. LOC92249 (Accession XM_043814) is another VGAM1321 host target gene. LOC92249 BINDING SITE is HOST TARGET binding site found in the 3' untranslated region of mRNA encoded by LOC92249, corresponding to a HOST TARGET binding site such as BINDING SITE I, BINDING SITE II or BINDING SITE III. Table 2 illustrates the complementarity of the nucleotide sequences of LOC92249 BINDING SITE, designated SEQ ID:34017, to the nucleotide sequence of VGAM1321 RNA, herein designated VGAM RNA, also designated SEQ ID:4032.

Another function of VGAM1321 is therefore inhibition of LOC92249 (Accession XM_043814). Accordingly, utilities of VGAM1321 include diagnosis, prevention and treatment of diseases and clinical conditions associated with LOC92249. FIG. 1 further provides a conceptual description of a novel bioinformatically detected viral gene of the present invention, referred to here as Viral Genomic Address Messenger 1322 (VGAM1322) viral gene, which modulates expression of respective host target genes thereof, the function and utility of which host target genes is known in the art.

VGAM1322 is a novel bioinformatically detected regulatory, non protein coding, viral micro RNA (miRNA) gene. The method by which VGAM1322 was detected is described hereinabove with reference to FIGS. 1-8.

VGAM1322 gene, herein designated VGAM GENE, is a viral gene contained in the genome of Garlic Latent Virus. VGAM1322 host target gene, herein designated VGAM HOST TARGET GENE, is a human gene contained in the human genome.

VGAM1322 gene encodes a VGAM1322 precursor RNA, herein designated VGAM PRECURSOR RNA. Similar to other miRNA genes, and unlike most ordinary genes, VGAM1322 precursor RNA does not encode a protein. A nucleotide sequence identical or highly similar to the nucleotide sequence of VGAM1322 precursor RNA is designated SEQ ID:1308, and is provided hereinbelow with reference to the sequence listing part. Nucleotide sequence SEQ ID:1308 is located at position 5259 relative to the genome of Garlic Latent Virus.

VGAM1322 precursor RNA folds onto itself, forming VGAM1322 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1322 folded precursor RNA into VGAM1322 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM1322 RNA is designated SEQ ID:4033, and is provided hereinbelow with reference to the sequence listing part.

VGAM1322 host target gene, herein designated VGAM HOST TARGET GENE, encodes a corresponding messenger RNA, VGAM1322 host target RNA, herein designated VGAM HOST TARGET RNA. VGAM1322 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1322 RNA, herein designated VGAM RNA, binds complementarily to one or more host target binding sites located in untranslated regions of VGAM1322 host target RNA, herein designated VGAM HOST TARGET RNA. This complementary binding is due to the fact that the nucleotide sequence of VGAM1322 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1322 RNA, herein designated VGAM RNA, may have a different number of host target binding sites in untranslated regions of a VGAM1322 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1322 RNA, herein designated VGAM RNA, to host target binding sites on VGAM1322 host target RNA, herein designated VGAM HOST TARGET RNA, such as BINDING SITE I, BINDING SITE II and BINDING SITE III, inhibits translation of VGAM1322 host target RNA into VGAM1322 host target protein, herein designated VGAM HOST TARGET PROTEIN. VGAM host target protein is therefore outlined by a broken line.

It is appreciated that VGAM1322 host target gene, herein designated VGAM HOST TARGET GENE, in fact represents a plurality of VGAM1322 host target genes. The mRNA of each one of this plurality of VGAM1322 host target genes comprises one or more host target binding sites, each having a nucleotide sequence which is at least partly complementary to VGAM1322 RNA, herein designated VGAM RNA, and which when bound by VGAM1322 RNA causes inhibition of translation of respective one or more VGAM1322 host target proteins.

It is further appreciated by one skilled in the art that the mode of translational inhibition illustrated by FIG. 1 with specific reference to translational inhibition exerted by VGAM1322 gene, herein designated VGAM GENE, on one or more VGAM1322 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1322 is inhibition of expression of host target genes, as part of a novel viral mechanism of attacking a host. Accordingly, utilities of VGAM1322 include diagnosis, prevention and treatment of viral infection by Garlic Latent Virus. Specific functions, and accordingly utilities, of VGAM1322 correlate with, and may be deduced from, the identity of the host target genes which VGAM1322 binds and inhibits, and the function of these host target genes, as elaborated hereinbelow.

Nucleotide sequences of the VGAM1322 precursor RNA, herein designated VGAM PRECURSOR RNA, and of the 'diced' VGAM1322 RNA, herein designated VGAM RNA, and a schematic representation of the secondary folding of VGAM1322 folded precursor RNA, herein designated VGAM FOLDED PRECURSOR RNA, of VGAM1322 are further described hereinbelow with reference to Table 1.

Nucleotide sequences of host target binding sites, such as BINDING SITE-I, BINDING SITE-II and BINDING SITE-III of FIG. 1, found on VGAM1322 host target RNA, and schematic representation of the complementarity of each of these host target binding sites to VGAM1322 RNA, herein designated VGAM RNA, are described hereinbelow with reference to Table 2.

As mentioned hereinabove with reference to FIG. 1, a function of VGAM1322 gene, herein designated VGAM is inhibition of expression of VGAM1322 target genes. It is appreciated that specific functions, and accordingly utilities, of VGAM1322 correlate with, and may be deduced from, the identity of the target genes which VGAM1322 binds and inhibits, and the function of these target genes, as elaborated hereinbelow.

Alpha-1-B Glycoprotein (A1BG, Accession NM_130786) is a VGAM1322 host target gene. A1BG BINDING SITE is HOST TARGET binding site found in the 3' untranslated region of mRNA encoded by A1BG, corresponding to a HOST TARGET binding site such as BINDING SITE I, BINDING SITE II or BINDING SITE III. Table 2 illustrates the complementarity of the nucleotide sequences of A1BG BINDING SITE, designated SEQ ID:28275, to the nucleotide sequence of VGAM1322 RNA, herein designated VGAM RNA, also designated SEQ ID:4033.

A function of VGAM1322 is therefore inhibition of Alpha-1-B Glycoprotein (A1BG, Accession NM_130786), a gene which a plasma protein of unknown function. Accordingly, utilities of VGAM1322 include diagnosis, prevention and treatment of diseases and clinical conditions associated with A1BG. The function of A1BG and its association with various diseases and clinical conditions, has been established by previous studies, as described hereinabove with reference to VGAM172. Aryl Hydrocarbon Receptor (AHR, Accession NM_001621) is another VGAM1322 host target gene. AHR BINDING SITE is HOST TARGET binding site found in the 3' untranslated region of mRNA encoded by AHR, corresponding to a HOST TARGET binding site such as BINDING SITE I, BINDING SITE II or BINDING SITE III. Table 2 illustrates the complementarity of the nucleotide sequences of AHR BINDING SITE, designated SEQ ID:7331, to the nucleotide sequence of VGAM1322 RNA, herein designated VGAM RNA, also designated SEQ ID:4033.

Another function of VGAM1322 is therefore inhibition of Aryl Hydrocarbon Receptor (AHR, Accession NM_001621), a gene which plays a role in modulating carcinogenesis through the induction of xenobiotic-metabolizing enzymes. Accordingly, utilities of VGAM1322 include diagnosis, prevention and treatment of diseases and clinical conditions associated with AHR. The function of AHR and its association with various diseases and clinical conditions, has been established by previous studies, as described hereinabove with reference to VGAM368. ATPase, Cu++ Transporting, Alpha Polypeptide (Menkes syndrome) (ATP7A, Accession NM_000052) is another VGAM1322 host target gene. ATP7A BINDING SITE is HOST TARGET binding site found in the 3' untranslated region of mRNA encoded by ATP7A, corresponding to a HOST TARGET binding site such as BINDING SITE I, BINDING SITE II or BINDING SITE III. Table 2 illustrates the complementarity of the nucleotide sequences of ATP7A BINDING SITE, designated SEQ ID:5490, to the nucleotide sequence of VGAM1322 RNA, herein designated VGAM RNA, also designated SEQ ID:4033.

Another function of VGAM1322 is therefore inhibition of ATPase, Cu++ Transporting, Alpha Polypeptide (Menkes syndrome) (ATP7A, Accession NM_000052). Accordingly, utilities of VGAM1322 include diagnosis, prevention and treatment of diseases and clinical conditions associated with ATP7A. Calpain 10 (CAPN10, Accession NM_023084) is another VGAM1322 host target gene. CAPN10 BINDING SITE1 through CAPN10 BINDING SITE4 are HOST TARGET binding sites found in untranslated regions of mRNA encoded by CAPN10, corresponding to HOST TARGET binding sites such as BINDING SITE I, BINDING SITE II or BINDING SITE III. Table 2 illustrates the complementarity of the nucleotide sequences of CAPN10 BINDING SITE1 through CAPN10 BINDING SITE4, designated SEQ ID:23346, SEQ ID:23348, SEQ ID:23350 and SEQ ID:23352 respectively, to the nucleotide sequence of VGAM1322

RNA, herein designated VGAM RNA, also designated SEQ ID:4033.

Another function of VGAM1322 is therefore inhibition of Calpain 10 (CAPN10, Accession NM_023084), a gene which catalyzes limited proteolysis of substrates involved in cytoskeletal remodelling and signal tranduction. Accordingly, utilities of VGAM1322 include diagnosis, prevention and treatment of diseases and clinical conditions associated with CAPN10. The function of CAPN10 and its association with various diseases and clinical conditions, has been established by previous studies, as described hereinabove with reference to VGAM247. Cytochrome P450, Subfamily VIIIB (sterol 12-alpha-hydroxylase), Polypeptide 1 (CYP8B1, Accession NM_004391) is another VGAM1322 host target gene. CYP8B1 BINDING SITE is HOST TARGET binding site found in the 3' untranslated region of mRNA encoded by CYP8B1, corresponding to a HOST TARGET binding site such as BINDING SITE I, BINDING SITE II or BINDING SITE III. Table 2 illustrates the complementarity of the nucleotide sequences of CYP8B1 BINDING SITE, designated SEQ ID:10621, to the nucleotide sequence of VGAM1322 RNA, herein designated VGAM RNA, also designated SEQ ID:4033.

Another function of VGAM1322 is therefore inhibition of Cytochrome P450, Subfamily VIIIB (sterol 12-alpha-hydroxylase), Polypeptide 1 (CYP8B1, Accession NM_004391), a gene which functions in bile acid biosynthesis. Accordingly, utilities of VGAM1322 include diagnosis, prevention and treatment of diseases and clinical conditions associated with CYP8B1. The function of CYP8B1 and its association with various diseases and clinical conditions, has been established by previous studies, as described hereinabove with reference to VGAM923. DNA Fragmentation Factor, 40 kDa, Beta Polypeptide (caspase-activated DNase) (DFFB, Accession XM_113366) is another VGAM1322 host target gene. DFFB BINDING SITE is HOST TARGET binding site found in the 3' untranslated region of mRNA encoded by DFFB, corresponding to a HOST TARGET binding site such as BINDING SITE I, BINDING SITE II or BINDING SITE III. Table 2 illustrates the complementarity of the nucleotide sequences of DFFB BINDING SITE, designated SEQ ID:42239, to the nucleotide sequence of VGAM1322 RNA, herein designated VGAM RNA, also designated SEQ ID:4033.

Another function of VGAM1322 is therefore inhibition of DNA Fragmentation Factor, 40 kDa, Beta Polypeptide (caspase-activated DNase) (DFFB, Accession XM_113366), a gene which induces DNA fragmentation and chromatin condensation during apoptosis. Accordingly, utilities of VGAM1322 include diagnosis, prevention and treatment of diseases and clinical conditions associated with DFFB. The function of DFFB and its association with various diseases and clinical conditions, has been established by previous studies, as described hereinabove with reference to VGAM74. Frizzled Homolog 4 (Drosophila) (FZD4, Accession NM_012193) is another VGAM1322 host target gene. FZD4 BINDING SITE is HOST TARGET binding site found in the 3' untranslated region of mRNA encoded by FZD4, corresponding to a HOST TARGET binding site such as BINDING SITE I, BINDING SITE II or BINDING SITE III. Table 2 illustrates the complementarity of the nucleotide sequences of FZD4 BINDING SITE, designated SEQ ID:14482, to the nucleotide sequence of VGAM1322 RNA, herein designated VGAM RNA, also designated SEQ ID:4033.

Another function of VGAM1322 is therefore inhibition of Frizzled Homolog 4 (Drosophila) (FZD4, Accession NM_012193), a gene which may function in cell polarity, cell fate specification and cancer; similar to frizzled receptor family, has seven transmembrane domains. Accordingly, utilities of VGAM1322 include diagnosis, prevention and treatment of diseases and clinical conditions associated with FZD4. The function of FZD4 and its association with various diseases and clinical conditions, has been established by previous studies, as described hereinabove with reference to VGAM309. Male Germ Cell-associated Kinase (MAK, Accession NM_005906) is another VGAM1322 host target gene. MAK BINDING SITE is HOST TARGET binding site found in the 3' untranslated region of mRNA encoded by MAK, corresponding to a HOST TARGET binding site such as BINDING SITE I, BINDING SITE II or BINDING SITE III. Table 2 illustrates the complementarity of the nucleotide sequences of MAK BINDING SITE, designated SEQ ID:12527, to the nucleotide sequence of VGAM1322 RNA, herein designated VGAM RNA, also designated SEQ ID:4033.

Another function of VGAM1322 is therefore inhibition of Male Germ Cell-associated Kinase (MAK, Accession NM_005906), a gene which plays an important role in spermatogenesis. Accordingly, utilities of VGAM1322 include diagnosis, prevention and treatment of diseases and clinical conditions associated with MAK. The function of MAK has been established by previous studies. Male germ cell-associated kinase is one of the protein kinases that was isolated by weak cross-hybridization with the v-ros (OMIM Ref. No. 165020) protein kinase sequence (Matsushime et al., 1990). The gene encoding this kinase is expressed almost exclusively in testis, mainly in germ cells at and/or after the pachytene stage, as 66- and 60-kD proteins that form a distinct complex with cellular phosphoprotein p210. The p210 protein is sufficiently phosphorylated in vitro by the MAK gene product at serine and threonine residues. These results suggest that the MAK gene plays an important role in spermatogenesis. Using a panel of DNA samples from an interspecific cross, Taketo et al. (1994) mapped the Mak gene to mouse chromosome 13 in an area situated between 2 regions that are homologous with human chromosome 6p and chromosome 5. Taketo et al. (1994) stated that preliminary Southern analysis of DNA samples from a panel of mouse/human somatic cell hybrids showed concordant hybridization of the MAK gene and the ROS1 gene, previously mapped to 6q22

Full details of the abovementioned studies are described in the following publications, the disclosure of which are hereby incorporated by reference:

Matsushime, H.; Jinno, A.; Takagi, N.; Shibuya, M.: A novel mammalian protein kinase gene (mak) is highly expressed in testicular germ cells at and after meiosis. Molec. Cell. Biol. 10:2261-2268, 1990; and Taketo, M.; Jinno, A.; Yamaguchi, S.; Matushime, H.; Shibuya, M.; Seldin, M. F.: Mouse Mak gene for male germ cell-associated kinase maps to chromosome 13. Genomics 19:397-398, 1994.

Further studies establishing the function and utilities of MAK are found in John Hopkins OMIM database record ID 154235, and in sited publications numbered 2196-2197 listed in the bibliography section hereinbelow, which are also hereby incorporated by reference. Mediterranean Fever (MEFV, Accession NM_000243) is another VGAM1322 host target gene. MEFV BINDING SITE is HOST TARGET binding site found in the 3' untranslated region of mRNA encoded by MEFV, corresponding to a HOST TARGET binding site such as BINDING SITE I, BINDING SITE II or BINDING SITE III. Table 2 illustrates the complementarity of the nucleotide sequences of MEFV BINDING SITE, designated SEQ ID:5767, to the nucleotide sequence of VGAM1322 RNA, herein designated VGAM RNA, also designated SEQ ID:4033.

Another function of VGAM1322 is therefore inhibition of Mediterranean Fever (MEFV, Accession NM_000243). Accordingly, utilities of VGAM1322 include diagnosis, prevention and treatment of diseases and clinical conditions associated with MEFV. Melan-A (MLANA, Accession NM_005511) is another VGAM1322 host target gene. MLANA BINDING SITE is HOST TARGET binding site found in the 3' untranslated region of mRNA encoded by MLANA, corresponding to a HOST TARGET binding site such as BINDING SITE I, BINDING SITE II or BINDING SITE III. Table 2 illustrates the complementarity of the nucleotide sequences of MLANA BINDING SITE, designated SEQ ID:12027, to the nucleotide sequence of VGAM1322 RNA, herein designated VGAM RNA, also designated SEQ ID:4033.

Another function of VGAM1322 is therefore inhibition of Melan-A (MLANA, Accession NM_005511). Accordingly, utilities of VGAM1322 include diagnosis, prevention and treatment of diseases and clinical conditions associated with MLANA. Membrane-spanning 4-domains, Subfamily A, Member 1 (MS4A1, Accession NM_000139) is another VGAM1322 host target gene. MS4A1 BINDING SITE is HOST TARGET binding site found in the 3' untranslated region of mRNA encoded by MS4A1, corresponding to a HOST TARGET binding site such as BINDING SITE I, BINDING SITE II or BINDING SITE III. Table 2 illustrates the complementarity of the nucleotide sequences of MS4A1 BINDING SITE, designated SEQ ID:5634, to the nucleotide sequence of VGAM1322 RNA, herein designated VGAM RNA, also designated SEQ ID:4033.

Another function of VGAM1322 is therefore inhibition of Membrane-spanning 4-domains, Subfamily A, Member 1 (MS4A1, Accession NM_000139), a gene which may be involved in the regulation of b-cell activation and proliferation. Accordingly, utilities of VGAM1322 include diagnosis, prevention and treatment of diseases and clinical conditions associated with MS4A1. The function of MS4A1 and its association with various diseases and clinical conditions, has been established by previous studies, as described hereinabove with reference to VGAM62. Non-POU Domain Containing, Octamer-binding (NONO, Accession XM_088688) is another VGAM1322 host target gene. NONO BINDING SITE is HOST TARGET binding site found in the 3' untranslated region of mRNA encoded by NONO, corresponding to a HOST TARGET binding site such as BINDING SITE I, BINDING SITE II or BINDING SITE III. Table 2 illustrates the complementarity of the nucleotide sequences of NONO BINDING SITE, designated SEQ ID:39898, to the nucleotide sequence of VGAM1322 RNA, herein designated VGAM RNA, also designated SEQ ID:4033.

Another function of VGAM1322 is therefore inhibition of Non-POU Domain Containing, Octamer-binding (NONO, Accession XM_088688), a gene which is a nuclear protein which contains RNA recognition motifs. Accordingly, utilities of VGAM1322 include diagnosis, prevention and treatment of diseases and clinical conditions associated with NONO. The function of NONO and its association with various diseases and clinical conditions, has been established by previous studies, as described hereinabove with reference to VGAM95. Period Homolog 2 (Drosophila) (PER2, Accession NM_022817) is another VGAM1322 host target gene. PER2 BINDING SITE is HOST TARGET binding site found in the 3' untranslated region of mRNA encoded by PER2, corresponding to a HOST TARGET binding site such as BINDING SITE I, BINDING SITE II or BINDING SITE III. Table 2 illustrates the complementarity of the nucleotide sequences of PER2 BINDING SITE, designated SEQ ID:23087, to the nucleotide sequence of VGAM1322 RNA, herein designated VGAM RNA, also designated SEQ ID:4033.

Another function of VGAM1322 is therefore inhibition of Period Homolog 2 (Drosophila) (PER2, Accession NM_022817), a gene which Period homolog 2; putative circadian clock protein; has a PAS dimerization domain. Accordingly, utilities of VGAM1322 include diagnosis, prevention and treatment of diseases and clinical conditions associated with PER2. The function of PER2 and its association with various diseases and clinical conditions, has been established by previous studies, as described hereinabove with reference to VGAM74. Rhesus Blood Group, D Antigen (RHD, Accession NM_016124) is another VGAM1322 host target gene. RHD BINDING SITE1 and RHD BINDING SITE2 are HOST TARGET binding sites found in untranslated regions of mRNA encoded by RHD, corresponding to HOST TARGET binding sites such as BINDING SITE I, BINDING SITE II or BINDING SITE III. Table 2 illustrates the complementarity of the nucleotide sequences of RHD BINDING SITE1 and RHD BINDING SITE2, designated SEQ ID:18216 and SEQ ID:18336 respectively, to the nucleotide sequence of VGAM1322 RNA, herein designated VGAM RNA, also designated SEQ ID:4033.

Another function of VGAM1322 is therefore inhibition of Rhesus Blood Group, D Antigen (RHD, Accession NM_016124), a gene which Major antigen of the RH system. Accordingly, utilities of VGAM1322 include diagnosis, prevention and treatment of diseases and clinical conditions associated with RHD. The function of RHD and its association with various diseases and clinical conditions, has been established by previous studies, as described hereinabove with reference to VGAM74. Spondyloepiphyseal Dysplasia, Late (SEDL, Accession NM_014563) is another VGAM1322 host target gene. SEDL BINDING SITE1 and SEDL BINDING SITE2 are HOST TARGET binding sites found in untranslated regions of mRNA encoded by SEDL, corresponding to HOST TARGET binding sites such as BINDING SITE I, BINDING SITE II or BINDING SITE III. Table 2 illustrates the complementarity of the nucleotide sequences of SEDL BINDING SITE1 and SEDL BINDING SITE2, designated SEQ ID:15906 and SEQ ID:32987 respectively, to the nucleotide sequence of VGAM1322 RNA, herein designated VGAM RNA, also designated SEQ ID:4033.

Another function of VGAM1322 is therefore inhibition of Spondyloepiphyseal Dysplasia, Late (SEDL, Accession NM_014563), a gene which may play role in vesicular transport from endoplasmic reticulum to golgi. Accordingly, utilities of VGAM1322 include diagnosis, prevention and treatment of diseases and clinical conditions associated with SEDL. The function of SEDL and its association with various diseases and clinical conditions, has been established by previous studies, as described hereinabove with reference to VGAM74. TAP Binding Protein (tapasin) (TAPBP, Accession NM_003190) is another VGAM1322 host target gene. TAPBP BINDING SITE is HOST TARGET binding site found in the 3' untranslated region of mRNA encoded by TAPBP, corresponding to a HOST TARGET binding site such as BINDING SITE I, BINDING SITE II or BINDING SITE III. Table 2 illustrates the complementarity of the nucleotide sequences of TAPBP BINDING SITE, designated SEQ ID:9177, to the nucleotide sequence of VGAM1322 RNA, herein designated VGAM RNA, also designated SEQ ID:4033.

Another function of VGAM1322 is therefore inhibition of TAP Binding Protein (tapasin) (TAPBP, Accession NM_003190), a gene which is involved in MHC class I-restricted antigen processing. Accordingly, utilities of VGAM1322 include diagnosis, prevention and treatment of diseases and clinical conditions associated with TAPBP. The function of TAPBP and its association with various diseases and clinical conditions, has been established by previous studies, as described hereinabove with reference to VGAM122. Teratocarcinoma-derived Growth Factor 1 (TDGF1, Accession NM_003212) is another VGAM1322 host target gene. TDGF1 BINDING SITE is HOST TARGET binding site found in the 3' untranslated region of mRNA encoded by TDGF1, corresponding to a HOST TARGET binding site such as BINDING SITE I, BINDING SITE II or BINDING SITE III. Table 2 illustrates the complementarity of the nucleotide sequences of TDGF1 BINDING SITE, designated SEQ ID:9208, to the nucleotide sequence of VGAM1322 RNA, herein designated VGAM RNA, also designated SEQ ID:4033.

Another function of VGAM1322 is therefore inhibition of Teratocarcinoma-derived Growth Factor 1 (TDGF1, Accession NM_003212), a gene which can play a role in the determination of the epiblastic cells that subsequently give rise to the mesoderm. Accordingly, utilities of VGAM1322 include diagnosis, prevention and treatment of diseases and clinical conditions associated with TDGF1. The function of TDGF1 has been established by previous studies. Cryptic protein is required for proper laterality development in human S. TDGF1, like CFC1, is an EGF-CFC family member and an obligate coreceptor involved in NODAL signaling, a developmental program implicated in midline, forebrain, and left-right axis development in model organisms. A mutation in the conserved CFC domain of the TDGF1 gene (187395.0001) was demonstrated by de la Cruz et al. (2002) in a patient with midline anomalies of the forebrain. The mutant protein was inactive in a zebrafish rescue assay, indicating a role for TDGF1 in human midline and forebrain development. From a teratocarcinoma cell line, Ciccodicola et al. (1989) isolated a human cDNA (referred to as CRIPTO by them) encoding a protein of 188 amino acids. The central portion of this protein shared structural similarities with the human transforming growth factor alpha (OMIM Ref. No. 190170) and epidermal growth factor (EGF; 131530). Northern blot analysis of a wide variety of tumor and normal cell lines and tissues showed that CRIPTO transcripts are detected only in undifferentiated cells and disappear after cell differentiation induced by retinoic acid treatment.

Full details of the abovementioned studies are described in the following publications, the disclosure of which are hereby incorporated by reference:

de la Cruz, J. M.; Bamford, R. N.; Burdine, R. D.; Roessler, E.; Barkovich, A. J.; Donnai, D.; Schier, A. F.; Muenke, M.: A loss-of-function mutation in the CFC domain of TDGF1 is associated with human forebrain defects. Hum. Genet. 110: 422-428, 2002; and Ciccodicola, A.; Dono, R.; Obici, S.; Simeone, A.; Zollo, M.; Persico, M. G.: Molecular characterization of a gene of the 'EGF family' expressed in undifferentiated human NTERA2 terato.

Further studies establishing the function and utilities of TDGF1 are found in John Hopkins OMIM database record ID 187395, and in sited publications numbered 593-600 listed in the bibliography section hereinbelow, which are also hereby incorporated by reference. Tumor Necrosis Factor Receptor Superfamily, Member 10b (TNFRSF10B, Accession NM_003842) is another VGAM1322 host target gene. TNFRSF10B BINDING SITE is HOST TARGET binding site found in the 3' untranslated region of mRNA encoded by TNFRSF10B, corresponding to a HOST TARGET binding site such as BINDING SITE I, BINDING SITE II or BINDING SITE III. Table 2 illustrates the complementarity of the nucleotide sequences of TNFRSF10B BINDING SITE, designated SEQ ID:9935, to the nucleotide sequence of VGAM1322 RNA, herein designated VGAM RNA, also designated SEQ ID:4033.

Another function of VGAM1322 is therefore inhibition of Tumor Necrosis Factor Receptor Superfamily, Member 10b (TNFRSF10B, Accession NM_003842), a gene which forms complex that induces apoptosis. Accordingly, utilities of VGAM1322 include diagnosis, prevention and treatment of diseases and clinical conditions associated with TNFRSF10B. The function of TNFRSF10B and its association with various diseases and clinical conditions, has been established by previous studies, as described hereinabove with reference to VGAM400. Transient Receptor Potential Cation Channel, Subfamily V, Member 1 (TRPV1, Accession NM_018727) is another VGAM1322 host target gene. TRPV1 BINDING SITE1 through TRPV1 BINDING SITE4 are HOST TARGET binding sites found in untranslated regions of mRNA encoded by TRPV1, corresponding to HOST TARGET binding sites such as BINDING SITE I, BINDING SITE II or BINDING SITE III. Table 2 illustrates the complementarity of the nucleotide sequences of TRPV1 BINDING SITE1 through TRPV1 BINDING SITE4, designated SEQ ID:20810, SEQ ID:27990, SEQ ID:27998 and SEQ ID:28006 respectively, to the nucleotide sequence of VGAM1322 RNA, herein designated VGAM RNA, also designated SEQ ID:4033.

Another function of VGAM1322 is therefore inhibition of Transient Receptor Potential Cation Channel, Subfamily V, Member 1 (TRPV1, Accession NM_018727), a gene which functions as a receptor for capsaicin. Accordingly, utilities of VGAM1322 include diagnosis, prevention and treatment of diseases and clinical conditions associated with TRPV1. The function of TRPV1 and its association with various diseases and clinical conditions, has been established by previous studies, as described hereinabove with reference to VGAM146. Zinc Finger Protein 264 (ZNF264, Accession NM_003417) is another VGAM1322 host target gene. ZNF264 BINDING SITE is HOST TARGET binding site found in the 3' untranslated region of mRNA encoded by ZNF264, corresponding to a HOST TARGET binding site such as BINDING SITE I, BINDING SITE II or BINDING SITE III. Table 2 illustrates the complementarity of the nucleotide sequences of ZNF264 BINDING SITE, designated SEQ ID:9453, to the nucleotide sequence of VGAM1322 RNA, herein designated VGAM RNA, also designated SEQ ID:4033.

Another function of VGAM1322 is therefore inhibition of Zinc Finger Protein 264 (ZNF264, Accession NM_003417). Accordingly, utilities of VGAM1322 include diagnosis, prevention and treatment of diseases and clinical conditions associated with ZNF264. ARPP-19 (Accession NM_006628) is another VGAM1322 host target gene. ARPP-19 BINDING SITE is HOST TARGET binding site found in the 3' untranslated region of mRNA encoded by ARPP-19, corresponding to a HOST TARGET binding site such as BINDING SITE I, BINDING SITE II or BINDING SITE III. Table 2 illustrates the complementarity of the nucleotide sequences of ARPP-19 BINDING SITE, designated SEQ ID:13418, to the nucleotide sequence of VGAM1322 RNA, herein designated VGAM RNA, also designated SEQ ID:4033.

Another function of VGAM1322 is therefore inhibition of ARPP-19 (Accession NM_006628). Accordingly, utilities of VGAM1322 include diagnosis, prevention and treatment of diseases and clinical conditions associated with ARPP-19. ASE-1 (Accession NM_012099) is another VGAM1322 host target gene. ASE-1 BINDING SITE is HOST TARGET binding site found in the 3' untranslated region of mRNA encoded by ASE-1, corresponding to a HOST TARGET binding site such as BINDING SITE I, BINDING SITE II or BINDING SITE III. Table 2 illustrates the complementarity of the nucleotide sequences of ASE-1 BINDING SITE, designated SEQ ID:14403, to the nucleotide sequence of VGAM1322 RNA, herein designated VGAM RNA, also designated SEQ ID:4033.

Another function of VGAM1322 is therefore inhibition of ASE-1 (Accession NM_012099). Accordingly, utilities of VGAM1322 include diagnosis, prevention and treatment of diseases and clinical conditions associated with ASE-1. BA108L7.2 (Accession NM_030971) is another VGAM1322 host target gene. BA108L7.2 BINDING SITE is HOST TARGET binding site found in the 3' untranslated region of mRNA encoded by BA108L7.2, corresponding to a HOST TARGET binding site such as BINDING SITE I, BINDING SITE II or BINDING SITE III. Table 2 illustrates the complementarity of the nucleotide sequences of BA108L7.2 BINDING SITE, designated SEQ ID:25235, to the nucleotide sequence of VGAM1322 RNA, herein designated VGAM RNA, also designated SEQ ID:4033.

Another function of VGAM1322 is therefore inhibition of BA108L7.2 (Accession NM_030971). Accordingly, utilities of VGAM1322 include diagnosis, prevention and treatment of diseases and clinical conditions associated with BA108L7.2. BICD2 (Accession XM_046863) is another VGAM1322 host target gene. BICD2 BINDING SITE is HOST TARGET binding site found in the 3' untranslated region of mRNA encoded by BICD2, corresponding to a HOST TARGET binding site such as BINDING SITE I, BINDING SITE II or BINDING SITE III. Table 2 illustrates the complementarity of the nucleotide sequences of BICD2 BINDING SITE, designated SEQ ID:34850, to the nucleotide sequence of VGAM1322 RNA, herein designated VGAM RNA, also designated SEQ ID:4033.

Another function of VGAM1322 is therefore inhibition of BICD2 (Accession XM_046863). Accordingly, utilities of VGAM1322 include diagnosis, prevention and treatment of diseases and clinical conditions associated with BICD2. Chromosome 13 Open Reading Frame 1 (C13orf1, Accession NM_020456) is another VGAM1322 host target gene. C13orf1 BINDING SITE is HOST TARGET binding site found in the 3' untranslated region of mRNA encoded by C13orf1, corresponding to a HOST TARGET binding site such as BINDING SITE I, BINDING SITE II or BINDING SITE III. Table 2 illustrates the complementarity of the nucleotide sequences of C13orf1 BINDING SITE, designated SEQ ID:21689, to the nucleotide sequence of VGAM1322 RNA, herein designated VGAM RNA, also designated SEQ ID:4033.

Another function of VGAM1322 is therefore inhibition of Chromosome 13 Open Reading Frame 1 (C13orf1, Accession NM_020456). Accordingly, utilities of VGAM1322 include diagnosis, prevention and treatment of diseases and clinical conditions associated with C13orf1. Chromosome 9 Open Reading Frame 9 (C9orf9, Accession NM_018956) is another VGAM1322 host target gene. C9orf9 BINDING SITE is HOST TARGET binding site found in the 3' untranslated region of mRNA encoded by C9orf9, corresponding to a HOST TARGET binding site such as BINDING SITE I, BINDING SITE II or BINDING SITE III. Table 2 illustrates the complementarity of the nucleotide sequences of C9orf9 BINDING SITE, designated SEQ ID:21023, to the nucleotide sequence of VGAM1322 RNA, herein designated VGAM RNA, also designated SEQ ID:4033.

Another function of VGAM1322 is therefore inhibition of Chromosome 9 Open Reading Frame 9 (C9orf9, Accession NM_018956). Accordingly, utilities of VGAM1322 include diagnosis, prevention and treatment of diseases and clinical conditions associated with C9orf9. Claudin 15 (CLDN15, Accession NM_138429) is another VGAM1322 host target gene. CLDN15 BINDING SITE is HOST TARGET binding site found in the 3' untranslated region of mRNA encoded by CLDN15, corresponding to a HOST TARGET binding site such as BINDING SITE I, BINDING SITE II or BINDING SITE III. Table 2 illustrates the complementarity of the nucleotide sequences of CLDN15 BINDING SITE, designated SEQ ID:28791, to the nucleotide sequence of VGAM1322 RNA, herein designated VGAM RNA, also designated SEQ ID:4033.

Another function of VGAM1322 is therefore inhibition of Claudin 15 (CLDN15, Accession NM_138429). Accordingly, utilities of VGAM1322 include diagnosis, prevention and treatment of diseases and clinical conditions associated with CLDN15. DCOHM (Accession NM_032151) is another VGAM1322 host target gene. DCOHM BINDING SITE is HOST TARGET binding site found in the 3' untranslated region of mRNA encoded by DCOHM, corresponding to a HOST TARGET binding site such as BINDING SITE I, BINDING SITE II or BINDING SITE III. Table 2 illustrates the complementarity of the nucleotide sequences of DCOHM BINDING SITE, designated SEQ ID:25841, to the nucleotide sequence of VGAM1322 RNA, herein designated VGAM RNA, also designated SEQ ID:4033.

Another function of VGAM1322 is therefore inhibition of DCOHM (Accession NM_032151). Accordingly, utilities of VGAM1322 include diagnosis, prevention and treatment of diseases and clinical conditions associated with DCOHM. FLJ10232 (Accession NM_018033) is another VGAM1322 host target gene. FLJ10232 BINDING SITE is HOST TARGET binding site found in the 3' untranslated region of mRNA encoded by FLJ10232, corresponding to a HOST TARGET binding site such as BINDING SITE I, BINDING SITE II or BINDING SITE III. Table 2 illustrates the complementarity of the nucleotide sequences of FLJ10232 BINDING SITE, designated SEQ ID:19772, to the nucleotide sequence of VGAM1322 RNA, herein designated VGAM RNA, also designated SEQ ID:4033.

Another function of VGAM1322 is therefore inhibition of FLJ10232 (Accession NM_018033). Accordingly, utilities of VGAM1322 include diagnosis, prevention and treatment of diseases and clinical conditions associated with FLJ10232. FLJ10535 (Accession NM_018129) is another VGAM1322 host target gene. FLJ10535 BINDING SITE is HOST TARGET binding site found in the 3' untranslated region of mRNA encoded by FLJ10535, corresponding to a HOST TARGET binding site such as BINDING SITE I, BINDING SITE II or BINDING SITE III. Table 2 illustrates the complementarity of the nucleotide sequences of FLJ10535 BINDING SITE, designated SEQ ID:19916, to the nucleotide sequence of VGAM1322 RNA, herein designated VGAM RNA, also designated SEQ ID:4033.

Another function of VGAM1322 is therefore inhibition of FLJ10535 (Accession NM_018129). Accordingly, utilities of VGAM1322 include diagnosis, prevention and treatment of diseases and clinical conditions associated with FLJ10535. FLJ10922 (Accession NM_018273) is another VGAM1322 host target gene. FLJ10922 BINDING SITE is HOST TARGET binding site found in the 3' untranslated region of mRNA encoded by FLJ10922, corresponding to a HOST TARGET binding site such as BINDING SITE I, BINDING SITE II or BINDING SITE III. Table 2 illustrates the complementarity of the nucleotide sequences of FLJ10922 BINDING SITE, designated SEQ ID:20253, to the nucleotide sequence of VGAM1322 RNA, herein designated VGAM RNA, also designated SEQ ID:4033.

Another function of VGAM1322 is therefore inhibition of FLJ10922 (Accession NM_018273). Accordingly, utilities of VGAM1322 include diagnosis, prevention and treatment of diseases and clinical conditions associated with FLJ10922. FLJ12572 (Accession NM_022905) is another VGAM1322 host target gene. FLJ12572 BINDING SITE is HOST TARGET binding site found in the 5' untranslated region of mRNA encoded by FLJ12572, corresponding to a HOST TARGET binding site such as BINDING SITE I, BINDING SITE II or BINDING SITE III. Table 2 illustrates the complementarity of the nucleotide sequences of FLJ12572 BINDING SITE, designated SEQ ID:23196, to the nucleotide sequence of VGAM1322 RNA, herein designated VGAM RNA, also designated SEQ ID:4033.

Another function of VGAM1322 is therefore inhibition of FLJ12572 (Accession NM_022905). Accordingly, utilities of VGAM1322 include diagnosis, prevention and treatment of diseases and clinical conditions associated with FLJ12572. FLJ14642 (Accession NM_032818) is another VGAM1322 host target gene. FLJ14642 BINDING SITE is HOST TARGET binding site found in the 3' untranslated region of mRNA encoded by FLJ14642, corresponding to a HOST TARGET binding site such as BINDING SITE I, BINDING SITE II or BINDING SITE III. Table 2 illustrates the complementarity of the nucleotide sequences of FLJ14642 BINDING SITE, designated SEQ ID:26593, to the nucleotide sequence of VGAM1322 RNA, herein designated VGAM RNA, also designated SEQ ID:4033.

Another function of VGAM1322 is therefore inhibition of FLJ14642 (Accession NM_032818). Accordingly, utilities of VGAM1322 include diagnosis, prevention and treatment of diseases and clinical conditions associated with FLJ14642. FLJ20136 (Accession NM_017684) is another VGAM1322 host target gene. FLJ20136 BINDING SITE is HOST TARGET binding site found in the 3' untranslated region of mRNA encoded by FLJ20136, corresponding to a HOST TARGET binding site such as BINDING SITE I, BINDING SITE II or BINDING SITE III. Table 2 illustrates the complementarity of the nucleotide sequences of FLJ20136 BINDING SITE, designated SEQ ID:19227, to the nucleotide sequence of VGAM1322 RNA, herein designated VGAM RNA, also designated SEQ ID:4033.

Another function of VGAM1322 is therefore inhibition of FLJ20136 (Accession NM_017684). Accordingly, utilities of VGAM1322 include diagnosis, prevention and treatment of diseases and clinical conditions associated with FLJ20136. FLJ20344 (Accession NM_017776) is another VGAM1322 host target gene. FLJ20344 BINDING SITE is HOST TARGET binding site found in the 3' untranslated region of mRNA encoded by FLJ20344, corresponding to a HOST TARGET binding site such as BINDING SITE I, BINDING SITE II or BINDING SITE III. Table 2 illustrates the complementarity of the nucleotide sequences of FLJ20344 BINDING SITE, designated SEQ ID:19403, to the nucleotide sequence of VGAM1322 RNA, herein designated VGAM RNA, also designated SEQ ID:4033.

Another function of VGAM1322 is therefore inhibition of FLJ20344 (Accession NM_017776). Accordingly, utilities of VGAM1322 include diagnosis, prevention and treatment of diseases and clinical conditions associated with FLJ20344. FLJ20452 (Accession NM_017828) is another VGAM1322 host target gene. FLJ20452 BINDING SITE is HOST TARGET binding site found in the 3' untranslated region of mRNA encoded by FLJ20452, corresponding to a HOST TARGET binding site such as BINDING SITE I, BINDING SITE II or BINDING SITE III. Table 2 illustrates the complementarity of the nucleotide sequences of FLJ20452 BINDING SITE, designated SEQ ID:19490, to the nucleotide sequence of VGAM1322 RNA, herein designated VGAM RNA, also designated SEQ ID:4033.

Another function of VGAM1322 is therefore inhibition of FLJ20452 (Accession NM_017828). Accordingly, utilities of VGAM1322 include diagnosis, prevention and treatment of diseases and clinical conditions associated with FLJ20452. FLJ23356 (Accession NM_032237) is another VGAM1322 host target gene. FLJ23356 BINDING SITE is HOST TARGET binding site found in the 3' untranslated region of mRNA encoded by FLJ23356, corresponding to a HOST TARGET binding site such as BINDING SITE I, BINDING SITE II or BINDING SITE III. Table 2 illustrates the complementarity of the nucleotide sequences of FLJ23356 BINDING SITE, designated SEQ ID:25957, to the nucleotide sequence of VGAM1322 RNA, herein designated VGAM RNA, also designated SEQ ID:4033.

Another function of VGAM1322 is therefore inhibition of FLJ23356 (Accession NM_032237). Accordingly, utilities of VGAM1322 include diagnosis, prevention and treatment of diseases and clinical conditions associated with FLJ23356. FLJ23563 (Accession XM_041701) is another VGAM1322 host target gene. FLJ23563 BINDING SITE is HOST TARGET binding site found in the 3' untranslated region of mRNA encoded by FLJ23563, corresponding to a HOST TARGET binding site such as BINDING SITE I, BINDING SITE II or BINDING SITE III. Table 2 illustrates the complementarity of the nucleotide sequences of FLJ23563 BINDING SITE, designated SEQ ID:33559, to the nucleotide sequence of VGAM1322 RNA, herein designated VGAM RNA, also designated SEQ ID:4033.

Another function of VGAM1322 is therefore inhibition of FLJ23563 (Accession XM_041701). Accordingly, utilities of VGAM1322 include diagnosis, prevention and treatment of diseases and clinical conditions associated with FLJ23563. FLJ30532 (Accession NM_144724) is another VGAM1322 host target gene. FLJ30532 BINDING SITE is HOST TARGET binding site found in the 3' untranslated region of mRNA encoded by FLJ30532, corresponding to a HOST TARGET binding site such as BINDING SITE I, BINDING SITE II or BINDING SITE III. Table 2 illustrates the complementarity of the nucleotide sequences of FLJ30532 BINDING SITE, designated SEQ ID:29547, to the nucleotide sequence of VGAM1322 RNA, herein designated VGAM RNA, also designated SEQ ID:4033.

Another function of VGAM1322 is therefore inhibition of FLJ30532 (Accession NM_144724). Accordingly, utilities of VGAM1322 include diagnosis, prevention and treatment of diseases and clinical conditions associated with FLJ30532. FLJ31153 (Accession NM_144600) is another VGAM1322 host target gene. FLJ31153 BINDING SITE is HOST TARGET binding site found in the 3' untranslated region of mRNA encoded by FLJ31153, corresponding to a HOST TARGET binding site such as BINDING SITE I, BINDING SITE II or BINDING SITE III. Table 2 illustrates the complementarity of the nucleotide sequences of FLJ31153 BINDING SITE, designated SEQ ID:29412, to the nucleotide sequence of VGAM1322 RNA, herein designated VGAM RNA, also designated SEQ ID:4033.

Another function of VGAM1322 is therefore inhibition of FLJ31153 (Accession NM_144600). Accordingly, utilities of VGAM1322 include diagnosis, prevention and treatment of diseases and clinical conditions associated with FLJ31153. GRWD (Accession NM_031485) is another VGAM1322 host target gene. GRWD BINDING SITE is HOST TARGET binding site found in the 3' untranslated region of mRNA encoded by GRWD, corresponding to a HOST TARGET binding site such as BINDING SITE I, BINDING SITE II or BINDING SITE III. Table 2 illustrates the complementarity of the nucleotide sequences of GRWD BINDING SITE, designated SEQ ID:25576, to the nucleotide sequence of VGAM1322 RNA, herein designated VGAM RNA, also designated SEQ ID:4033.

Another function of VGAM1322 is therefore inhibition of GRWD (Accession NM_031485). Accordingly, utilities of VGAM1322 include diagnosis, prevention and treatment of diseases and clinical conditions associated with GRWD. H2AV (Accession NM_138635) is another VGAM1322 host target gene. H2AV BINDING SITE is HOST TARGET binding site found in the 3' untranslated region of mRNA encoded by H2AV, corresponding to a HOST TARGET binding site such as BINDING SITE I, BINDING SITE II or BINDING SITE III. Table 2 illustrates the complementarity of the nucleotide sequences of H2AV BINDING SITE, designated SEQ ID:28908, to the nucleotide sequence of VGAM1322 RNA, herein designated VGAM RNA, also designated SEQ ID:4033.

Another function of VGAM1322 is therefore inhibition of H2AV (Accession NM_138635). Accordingly, utilities of VGAM1322 include diagnosis, prevention and treatment of diseases and clinical conditions associated with H2AV. HCA4 (Accession XM_085287) is another VGAM1322 host target gene. HCA4 BINDING SITE is HOST TARGET binding site found in the 3' untranslated region of mRNA encoded by HCA4, corresponding to a HOST TARGET binding site such as BINDING SITE I, BINDING SITE II or BINDING SITE III. Table 2 illustrates the complementarity of the nucleotide sequences of HCA4 BINDING SITE, designated SEQ ID:38020, to the nucleotide sequence of VGAM1322 RNA, herein designated VGAM RNA, also designated SEQ ID:4033.

Another function of VGAM1322 is therefore inhibition of HCA4 (Accession XM_085287). Accordingly, utilities of VGAM1322 include diagnosis, prevention and treatment of diseases and clinical conditions associated with HCA4. KIAA0022 (Accession NM_014880) is another VGAM1322 host target gene. KIAA0022 BINDING SITE is HOST TARGET binding site found in the 3' untranslated region of mRNA encoded by KIAA0022, corresponding to a HOST TARGET binding site such as BINDING SITE I, BINDING SITE II or BINDING SITE III. Table 2 illustrates the complementarity of the nucleotide sequences of KIAA0022 BINDING SITE, designated SEQ ID:17025, to the nucleotide sequence of VGAM1322 RNA, herein designated VGAM RNA, also designated SEQ ID:4033.

Another function of VGAM1322 is therefore inhibition of KIAA0022 (Accession NM_014880). Accordingly, utilities of VGAM1322 include diagnosis, prevention and treatment of diseases and clinical conditions associated with KIAA0022. KIAA0186 (Accession NM_021067) is another VGAM1322 host target gene. KIAA0186 BINDING SITE is HOST TARGET binding site found in the 3' untranslated region of mRNA encoded by KIAA0186, corresponding to a HOST TARGET binding site such as BINDING SITE I, BINDING SITE II or BINDING SITE III. Table 2 illustrates the complementarity of the nucleotide sequences of KIAA0186 BINDING SITE, designated SEQ ID:22036, to the nucleotide sequence of VGAM1322 RNA, herein designated VGAM RNA, also designated SEQ ID:4033.

Another function of VGAM1322 is therefore inhibition of KIAA0186 (Accession NM_021067). Accordingly, utilities of VGAM1322 include diagnosis, prevention and treatment of diseases and clinical conditions associated with KIAA0186. KIAA0453 (Accession XM_044546) is another VGAM1322 host target gene. KIAA0453 BINDING SITE is HOST TARGET binding site found in the 3' untranslated region of mRNA encoded by KIAA0453, corresponding to a HOST TARGET binding site such as BINDING SITE I, BINDING SITE II or BINDING SITE III. Table 2 illustrates the complementarity of the nucleotide sequences of KIAA0453 BINDING SITE, designated SEQ ID:34228, to the nucleotide sequence of VGAM1322 RNA, herein designated VGAM RNA, also designated SEQ ID:4033.

Another function of VGAM1322 is therefore inhibition of KIAA0453 (Accession XM_044546). Accordingly, utilities of VGAM1322 include diagnosis, prevention and treatment of diseases and clinical conditions associated with KIAA0453. KIAA0475 (Accession NM_014864) is another VGAM1322 host target gene. KIAA0475 BINDING SITE is HOST TARGET binding site found in the 3' untranslated region of mRNA encoded by KIAA0475, corresponding to a HOST TARGET binding site such as BINDING SITE I, BINDING SITE II or BINDING SITE III. Table 2 illustrates the complementarity of the nucleotide sequences of KIAA0475 BINDING SITE, designated SEQ ID:16947, to the nucleotide sequence of VGAM1322 RNA, herein designated VGAM RNA, also designated SEQ ID:4033.

Another function of VGAM1322 is therefore inhibition of KIAA0475 (Accession NM_014864). Accordingly, utilities of VGAM1322 include diagnosis, prevention and treatment of diseases and clinical conditions associated with KIAA0475. KIAA0514 (Accession NM_014696) is another VGAM1322 host target gene. KIAA0514 BINDING SITE is HOST TARGET binding site found in the 3' untranslated region of mRNA encoded by KIAA0514, corresponding to a HOST TARGET binding site such as BINDING SITE I, BINDING SITE II or BINDING SITE III. Table 2 illustrates the complementarity of the nucleotide sequences of KIAA0514 BINDING SITE, designated SEQ ID:16204, to the nucleotide sequence of VGAM1322 RNA, herein designated VGAM RNA, also designated SEQ ID:4033.

Another function of VGAM1322 is therefore inhibition of KIAA0514 (Accession NM_014696). Accordingly, utilities of VGAM1322 include diagnosis, prevention and treatment of diseases and clinical conditions associated with KIAA0514. KIAA0557 (Accession XM_085507) is another VGAM1322 host target gene. KIAA0557 BINDING SITE is HOST TARGET binding site found in the 3' untranslated region of mRNA encoded by KIAA0557, corresponding to a HOST TARGET binding site such as BINDING SITE I, BINDING SITE II or BINDING SITE III. Table 2 illustrates the complementarity of the nucleotide sequences of KIAA0557 BINDING SITE, designated SEQ ID:38203, to the nucleotide sequence of VGAM1322 RNA, herein designated VGAM RNA, also designated SEQ ID:4033.

Another function of VGAM1322 is therefore inhibition of KIAA0557 (Accession XM_085507). Accordingly, utilities of VGAM1322 include diagnosis, prevention and treatment of diseases and clinical conditions associated with KIAA0557. KIAA0599 (Accession XM_085127) is another VGAM1322 host target gene. KIAA0599 BINDING SITE is HOST TARGET binding site found in the 3' untranslated region of mRNA encoded by KIAA0599, corresponding to a HOST TARGET binding site such as BINDING SITE I, BINDING SITE II or BINDING SITE III. Table 2 illustrates the complementarity of the nucleotide sequences of KIAA0599 BINDING SITE, designated SEQ ID:37854, to the nucleotide sequence of VGAM1322 RNA, herein designated VGAM RNA, also designated SEQ ID:4033.

Another function of VGAM1322 is therefore inhibition of KIAA0599 (Accession XM_085127). Accordingly, utilities of VGAM1322 include diagnosis, prevention and treatment of diseases and clinical conditions associated with KIAA0599. KIAA0945 (Accession NM_014952) is another VGAM1322 host target gene. KIAA0945 BINDING SITE is HOST TARGET binding site found in the 3' untranslated region of mRNA encoded by KIAA0945, corresponding to a HOST TARGET binding site such as BINDING SITE I, BINDING SITE II or BINDING SITE III. Table 2 illustrates the complementarity of the nucleotide sequences of KIAA0945 BINDING SITE, designated SEQ ID:17290, to the nucleotide sequence of VGAM1322 RNA, herein designated VGAM RNA, also designated SEQ ID:4033.

Another function of VGAM1322 is therefore inhibition of KIAA0945 (Accession NM_014952). Accordingly, utilities of VGAM1322 include diagnosis, prevention and treatment of diseases and clinical conditions associated with KIAA0945. KIAA1028 (Accession XM_166324) is another VGAM1322 host target gene. KIAA1028 BINDING SITE is HOST TARGET binding site found in the 3' untranslated region of mRNA encoded by KIAA1028, corresponding to a HOST TARGET binding site such as BINDING SITE I, BINDING SITE II or BINDING SITE III. Table 2 illustrates the complementarity of the nucleotide sequences of KIAA1028 BINDING SITE, designated SEQ ID:44154, to the nucleotide sequence of VGAM1322 RNA, herein designated VGAM RNA, also designated SEQ ID:4033.

Another function of VGAM1322 is therefore inhibition of KIAA1028 (Accession XM_166324). Accordingly, utilities of VGAM1322 include diagnosis, prevention and treatment of diseases and clinical conditions associated with KIAA1028. KIAA1040 (Accession XM_051091) is another VGAM1322 host target gene. KIAA1040 BINDING SITE is HOST TARGET binding site found in the 3' untranslated region of mRNA encoded by KIAA1040, corresponding to a HOST TARGET binding site such as BINDING SITE I, BINDING SITE II or BINDING SITE III. Table 2 illustrates the complementarity of the nucleotide sequences of KIAA1040 BINDING SITE, designated SEQ ID:35739, to the nucleotide sequence of VGAM1322 RNA, herein designated VGAM RNA, also designated SEQ ID:4033.

Another function of VGAM1322 is therefore inhibition of KIAA1040 (Accession XM_051091). Accordingly, utilities of VGAM1322 include diagnosis, prevention and treatment of diseases and clinical conditions associated with KIAA1040. KIAA1198 (Accession XM_032674) is another VGAM1322 host target gene. KIAA1198 BINDING SITE1 and KIAA1198 BINDING SITE2 are HOST TARGET binding sites found in untranslated regions of mRNA encoded by KIAA1198, corresponding to HOST TARGET binding sites such as BINDING SITE I, BINDING SITE II or BINDING SITE III. Table 2 illustrates the complementarity of the nucleotide sequences of KIAA1198 BINDING SITE1 and KIAA1198 BINDING SITE2, designated SEQ ID:31703 and SEQ ID:31704 respectively, to the nucleotide sequence of VGAM1322 RNA, herein designated VGAM RNA, also designated SEQ ID:4033.

Another function of VGAM1322 is therefore inhibition of KIAA1198 (Accession XM_032674). Accordingly, utilities of VGAM1322 include diagnosis, prevention and treatment of diseases and clinical conditions associated with KIAA1198. KIAA1497 (Accession XM_041431) is another VGAM1322 host target gene. KIAA1497 BINDING SITE is HOST TARGET binding site found in the 5' untranslated region of mRNA encoded by KIAA1497, corresponding to a HOST TARGET binding site such as BINDING SITE I, BINDING SITE II or BINDING SITE III. Table 2 illustrates the complementarity of the nucleotide sequences of KIAA1497 BINDING SITE, designated SEQ ID:33524, to the nucleotide sequence of VGAM1322 RNA, herein designated VGAM RNA, also designated SEQ ID:4033.

Another function of VGAM1322 is therefore inhibition of KIAA1497 (Accession XM_041431). Accordingly, utilities of VGAM1322 include diagnosis, prevention and treatment of diseases and clinical conditions associated with KIAA1497. KIAA1582 (Accession XM_037262) is another VGAM1322 host target gene. KIAA1582 BINDING SITE is HOST TARGET binding site found in the 5' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32581, to the nucleotide sequence of VGAM1322 RNA, herein designated VGAM RNA, also designated SEQ ID:4033.

Another function of VGAM1322 is therefore inhibition of KIAA1582 (Accession XM_037262). Accordingly, utilities of VGAM1322 include diagnosis, prevention and treatment of diseases and clinical conditions associated with KIAA1582. KIAA1829 (Accession XM_030378) is another VGAM1322 host target gene. KIAA1829 BINDING SITE is HOST TARGET binding site found in the 3' untranslated region of mRNA encoded by KIAA1829, corresponding to a HOST TARGET binding site such as BINDING SITE I, BINDING SITE II or BINDING SITE III. Table 2 illustrates the complementarity of the nucleotide sequences of KIAA1829 BINDING SITE, designated SEQ ID:31028, to the nucleotide sequence of VGAM1322 RNA, herein designated VGAM RNA, also designated SEQ ID:4033.

Another function of VGAM1322 is therefore inhibition of KIAA1829 (Accession XM_030378). Accordingly, utilities of VGAM1322 include diagnosis, prevention and treatment of diseases and clinical conditions associated with KIAA1829. KIAA1915 (Accession XM_055481) is another VGAM1322 host target gene. KIAA1915 BINDING SITE is HOST TARGET binding site found in the 3' untranslated region of mRNA encoded by KIAA1915, corresponding to a HOST TARGET binding site such as BINDING SITE I, BINDING SITE II or BINDING SITE III. Table 2 illustrates the complementarity of the nucleotide sequences of KIAA1915 BINDING SITE, designated SEQ ID:36268, to the nucleotide sequence of VGAM1322 RNA, herein designated VGAM RNA, also designated SEQ ID:4033.

Another function of VGAM1322 is therefore inhibition of KIAA1915 (Accession XM_055481). Accordingly, utilities of VGAM1322 include diagnosis, prevention and treatment of diseases and clinical conditions associated with KIAA1915. KIAA1918 (Accession XM_054951) is another VGAM1322 host target gene. KIAA1918 BINDING SITE is HOST TARGET binding site found in the 3' untranslated region of mRNA encoded by KIAA1918, corresponding to a HOST TARGET binding site such as BINDING SITE I, BINDING SITE II or BINDING SITE III. Table 2 illustrates the complementarity of the nucleotide sequences of KIAA1918 BINDING SITE, designated SEQ ID:36212, to the nucleotide sequence of VGAM1322 RNA, herein designated VGAM RNA, also designated SEQ ID:4033.

Another function of VGAM1322 is therefore inhibition of KIAA1918 (Accession XM_054951). Accordingly, utilities of VGAM1322 include diagnosis, prevention and treatment of diseases and clinical conditions associated with KIAA1918. KIAA1971 (Accession XM_058720) is another VGAM1322 host target gene. KIAA1971 BINDING SITE is HOST TARGET binding site found in the 3' untranslated region of mRNA encoded by KIAA1971, corresponding to a HOST TARGET binding site such as BINDING SITE I, BINDING SITE II or BINDING SITE III. Table 2 illustrates the complementarity of the nucleotide sequences of KIAA1971 BINDING SITE, designated SEQ ID:36728, to the nucleotide sequence of VGAM1322 RNA, herein designated VGAM RNA, also designated SEQ ID:4033.

Another function of VGAM1322 is therefore inhibition of KIAA1971 (Accession XM_058720). Accordingly, utilities of VGAM1322 include diagnosis, prevention and treatment of diseases and clinical conditions associated with KIAA1971. KIAA1987 (Accession XM_113870) is another VGAM1322 host target gene. KIAA1987 BINDING SITE is HOST TARGET binding site found in the 5' untranslated region of mRNA encoded by KIAA1987, corresponding to a HOST TARGET binding site such as BINDING SITE I, BINDING SITE II or BINDING SITE III. Table 2 illustrates the complementarity of the nucleotide sequences of KIAA1987 BINDING SITE, designated SEQ ID:42494, to the nucleotide sequence of VGAM1322 RNA, herein designated VGAM RNA, also designated SEQ ID:4033.

Another function of VGAM1322 is therefore inhibition of KIAA1987 (Accession XM_113870). Accordingly, utilities of VGAM1322 include diagnosis, prevention and treatment of diseases and clinical conditions associated with KIAA1987. Kallikrein 7 (chymotryptic, stratum corneum) (KLK7, Accession NM_139277) is another VGAM1322 host target gene. KLK7 BINDING SITE1 and KLK7 BINDING SITE2 are HOST TARGET binding sites found in untranslated regions of mRNA encoded by KLK7, corresponding to HOST TARGET binding sites such as BINDING SITE I, BINDING SITE II or BINDING SITE III. Table 2 illustrates the complementarity of the nucleotide sequences of KLK7 BINDING SITE1 and KLK7 BINDING SITE2, designated SEQ ID:29273 and SEQ ID:11476 respectively, to the nucleotide sequence of VGAM1322 RNA, herein designated VGAM RNA, also designated SEQ ID:4033.

Another function of VGAM1322 is therefore inhibition of Kallikrein 7 (chymotryptic, stratum corneum) (KLK7, Accession NM_139277). Accordingly, utilities of VGAM1322 include diagnosis, prevention and treatment of diseases and clinical conditions associated with KLK7. MGC3771 (Accession NM_030970) is another VGAM1322 host target gene. MGC3771 BINDING SITE is HOST TARGET binding site found in the 5' untranslated region of mRNA encoded by MGC3771, corresponding to a HOST TARGET binding site such as BINDING SITE I, BINDING SITE II or BINDING SITE III. Table 2 illustrates the complementarity of the nucleotide sequences of MGC3771 BINDING SITE, designated SEQ ID:25233, to the nucleotide sequence of VGAM1322 RNA, herein designated VGAM RNA, also designated SEQ ID:4033.

Another function of VGAM1322 is therefore inhibition of MGC3771 (Accession NM_030970). Accordingly, utilities of VGAM1322 include diagnosis, prevention and treatment of diseases and clinical conditions associated with MGC3771. MGC4638 (Accession NM_031479) is another VGAM1322 host target gene. MGC4638 BINDING SITE is HOST TARGET binding site found in the 3' untranslated region of mRNA encoded by MGC4638, corresponding to a HOST TARGET binding site such as BINDING SITE I, BINDING SITE II or BINDING SITE III. Table 2 illustrates the complementarity of the nucleotide sequences of MGC4638 BINDING SITE, designated SEQ ID:25557, to the nucleotide sequence of VGAM1322 RNA, herein designated VGAM RNA, also designated SEQ ID:4033.

Another function of VGAM1322 is therefore inhibition of MGC4638 (Accession NM_031479). Accordingly, utilities of VGAM1322 include diagnosis, prevention and treatment of diseases and clinical conditions associated with MGC4638. Makorin, Ring Finger Protein, 4 (MKRN4, Accession NM_030757) is another VGAM1322 host target gene. MKRN4 BINDING SITE is HOST TARGET binding site found in the 3' untranslated region of mRNA encoded by MKRN4, corresponding to a HOST TARGET binding site such as BINDING SITE I, BINDING SITE II or BINDING SITE III. Table 2 illustrates the complementarity of the nucleotide sequences of MKRN4 BINDING SITE, designated SEQ ID:25041, to the nucleotide sequence of VGAM1322 RNA, herein designated VGAM RNA, also designated SEQ ID:4033.

Another function of VGAM1322 is therefore inhibition of Makorin, Ring Finger Protein, 4 (MKRN4, Accession NM_030757). Accordingly, utilities of VGAM1322 include diagnosis, prevention and treatment of diseases and clinical conditions associated with MKRN4. Mitochondrial Ribosomal Protein L44 (MRPL44, Accession NM_022915) is another VGAM1322 host target gene. MRPL44 BINDING SITE is HOST TARGET binding site found in the 3' untranslated region of mRNA encoded by MRPL44, corresponding to a HOST TARGET binding site such as BINDING SITE I, BINDING SITE II or BINDING SITE III. Table 2 illustrates the complementarity of the nucleotide sequences of MRPL44 BINDING SITE, designated SEQ ID:23226, to the nucleotide sequence of VGAM1322 RNA, herein designated VGAM RNA, also designated SEQ ID:4033.

Another function of VGAM1322 is therefore inhibition of Mitochondrial Ribosomal Protein L44 (MRPL44, Accession NM_022915). Accordingly, utilities of VGAM1322 include diagnosis, prevention and treatment of diseases and clinical conditions associated with MRPL44. Mitochondrial Ribosomal Protein S27 (MRPS27, Accession NM_015084) is another VGAM1322 host target gene. MRPS27 BINDING SITE is HOST TARGET binding site found in the 3' untranslated region of mRNA encoded by MRPS27, corresponding to a HOST TARGET binding site such as BINDING SITE I, BINDING SITE II or BINDING SITE III. Table 2 illustrates the complementarity of the nucleotide sequences of MRPS27 BINDING SITE, designated SEQ ID:17473, to the nucleotide sequence of VGAM1322 RNA, herein designated VGAM RNA, also designated SEQ ID:4033.

Another function of VGAM1322 is therefore inhibition of Mitochondrial Ribosomal Protein S27 (MRPS27, Accession NM_015084). Accordingly, utilities of VGAM1322 include diagnosis, prevention and treatment of diseases and clinical conditions associated with MRPS27. p21(CDKN1A)-activated Kinase 6 (PAK6, Accession NM_020168) is another VGAM1322 host target gene. PAK6 BINDING SITE is HOST TARGET binding site found in the 3' untranslated region of mRNA encoded by PAK6, corresponding to a HOST TARGET binding site such as BINDING SITE I, BINDING SITE II or BINDING SITE III. Table 2 illustrates the complementarity of the nucleotide sequences of PAK6 BINDING SITE, designated SEQ ID:21390, to the nucleotide sequence of VGAM1322 RNA, herein designated VGAM RNA, also designated SEQ ID:4033.

Another function of VGAM1322 is therefore inhibition of p21(CDKN1A)-activated Kinase 6 (PAK6, Accession NM_020168). Accordingly, utilities of VGAM1322 include diagnosis, prevention and treatment of diseases and clinical conditions associated with PAK6. PRO0365 (Accession NM_014126) is another VGAM1322 host target gene. PRO0365 BINDING SITE is HOST TARGET binding site found in the 5' untranslated region of mRNA encoded by PRO0365, corresponding to a HOST TARGET binding site such as BINDING SITE I, BINDING SITE II or BINDING SITE III. Table 2 illustrates the complementarity of the nucleotide sequences of PRO0365 BINDING SITE, designated SEQ ID:15385, to the nucleotide sequence of VGAM1322 RNA, herein designated VGAM RNA, also designated SEQ ID:4033.

Another function of VGAM1322 is therefore inhibition of PRO0365 (Accession NM_014126). Accordingly, utilities of VGAM1322 include diagnosis, prevention and treatment of diseases and clinical conditions associated with PRO0365. Solute Carrier Family 2 (facilitated glucose transporter), Member 10 (SLC2A10, Accession NM_030777) is another VGAM1322 host target gene. SLC2A10 BINDING SITE is HOST TARGET binding site found in the 3' untranslated region of mRNA encoded by SLC2A10, corresponding to a HOST TARGET binding site such as BINDING SITE I, BINDING SITE II or BINDING SITE III. Table 2 illustrates the complementarity of the nucleotide sequences of SLC2A10 BINDING SITE, designated SEQ ID:25062, to the nucleotide sequence of VGAM1322 RNA, herein designated VGAM RNA, also designated SEQ ID:4033.

Another function of VGAM1322 is therefore inhibition of Solute Carrier Family 2 (facilitated glucose transporter), Member 10 (SLC2A10, Accession NM_030777). Accordingly, utilities of VGAM1322 include diagnosis, prevention and treatment of diseases and clinical conditions associated with SLC2A10. SSH2 (Accession XM_030846) is another VGAM1322 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31177, to the nucleotide sequence of VGAM1322 RNA, herein designated VGAM RNA, also designated SEQ ID:4033.

Another function of VGAM1322 is therefore inhibition of SSH2 (Accession XM_030846). Accordingly, utilities of VGAM1322 include diagnosis, prevention and treatment of diseases and clinical conditions associated with SSH2. TU12B1-TY (Accession NM_016575) is another VGAM1322 host target gene. TU12B1-TY BINDING SITE is HOST TARGET binding site found in the 3' untranslated region of mRNA encoded by TU12B1-TY, corresponding to a HOST TARGET binding site such as BINDING SITE I, BINDING SITE II or BINDING SITE III. Table 2 illustrates the complementarity of the nucleotide sequences of TU12B1-TY BINDING SITE, designated SEQ ID:18643, to the nucleotide sequence of VGAM1322 RNA, herein designated VGAM RNA, also designated SEQ ID:4033.

Another function of VGAM1322 is therefore inhibition of TU12B1-TY (Accession NM_016575). Accordingly, utilities of VGAM1322 include diagnosis, prevention and treatment of diseases and clinical conditions associated with TU12B1-TY. LOC115704 (Accession XM_056533) is another VGAM1322 host target gene. LOC115704 BINDING SITE is HOST TARGET binding site found in the 3' untranslated region of mRNA encoded by LOC115704, corresponding to a HOST TARGET binding site such as BINDING SITE I, BINDING SITE II or BINDING SITE III. Table 2 illustrates the complementarity of the nucleotide sequences of LOC115704 BINDING SITE, designated SEQ ID:36401, to the nucleotide sequence of VGAM1322 RNA, herein designated VGAM RNA, also designated SEQ ID:4033.

Another function of VGAM1322 is therefore inhibition of LOC115704 (Accession XM_056533). Accordingly, utilities of VGAM1322 include diagnosis, prevention and treatment of diseases and clinical conditions associated with LOC115704. LOC116236 (Accession XM_057674) is another VGAM1322 host target gene. LOC116236 BINDING SITE is HOST TARGET binding site found in the 3' untranslated region of mRNA encoded by LOC116236, corresponding to a HOST TARGET binding site such as BINDING SITE I, BINDING SITE II or BINDING SITE III. Table 2 illustrates the complementarity of the nucleotide sequences of LOC116236 BINDING SITE, designated SEQ ID:36544, to the nucleotide sequence of VGAM1322 RNA, herein designated VGAM RNA, also designated SEQ ID:4033.

Another function of VGAM1322 is therefore inhibition of LOC116236 (Accession XM_057674). Accordingly, utilities of VGAM1322 include diagnosis, prevention and treatment of diseases and clinical conditions associated with LOC116236. LOC120526 (Accession XM_058475) is another VGAM1322 host target gene. LOC120526 BINDING SITE is HOST TARGET binding site found in the 3' untranslated region of mRNA encoded by LOC120526, corresponding to a HOST TARGET binding site such as BINDING SITE I, BINDING SITE II or BINDING SITE III. Table 2 illustrates the complementarity of the nucleotide sequences of LOC120526 BINDING SITE, designated SEQ ID:36623, to the nucleotide sequence of VGAM1322 RNA, herein designated VGAM RNA, also designated SEQ ID:4033.

Another function of VGAM1322 is therefore inhibition of LOC120526 (Accession XM_058475). Accordingly, utilities of VGAM1322 include diagnosis, prevention and treatment of diseases and clinical conditions associated with LOC120526. LOC121506 (Accession XM_058570) is another VGAM1322 host target gene. LOC121506 BINDING SITE is HOST TARGET binding site found in the 5' untranslated region of mRNA encoded by LOC121506, corresponding to a HOST TARGET binding site such as BINDING SITE I, BINDING SITE II or BINDING SITE III. Table 2 illustrates the complementarity of the nucleotide sequences of LOC121506 BINDING SITE, designated SEQ ID:36667, to the nucleotide sequence of VGAM1322 RNA, herein designated VGAM RNA, also designated SEQ ID:4033.

Another function of VGAM1322 is therefore inhibition of LOC121506 (Accession XM_058570). Accordingly, utilities of VGAM1322 include diagnosis, prevention and treatment of diseases and clinical conditions associated with LOC121506. LOC128387 (Accession XM_059243) is another VGAM1322 host target gene. LOC128387 BINDING SITE is HOST TARGET binding site found in the 3' untranslated region of mRNA encoded by LOC128387, corresponding to a HOST TARGET binding site such as BINDING SITE I, BINDING SITE II or BINDING SITE III. Table 2 illustrates the complementarity of the nucleotide sequences of LOC128387 BINDING SITE, designated SEQ ID:36928, to the nucleotide sequence of VGAM1322 RNA, herein designated VGAM RNA, also designated SEQ ID:4033.

Another function of VGAM1322 is therefore inhibition of LOC128387 (Accession XM_059243). Accordingly, utilities of VGAM1322 include diagnosis, prevention and treatment of diseases and clinical conditions associated with LOC128387. LOC132625 (Accession XM_067946) is another VGAM1322 host target gene. LOC132625 BINDING SITE is HOST TARGET binding site found in the 3' untranslated region of mRNA encoded by LOC132625, corresponding to a HOST TARGET binding site such as BINDING SITE I, BINDING SITE II or BINDING SITE III. Table 2 illustrates the complementarity of the nucleotide sequences of LOC132625 BINDING SITE, designated SEQ ID:37372, to the nucleotide sequence of VGAM1322 RNA, herein designated VGAM RNA, also designated SEQ ID:4033.

Another function of VGAM1322 is therefore inhibition of LOC132625 (Accession XM_067946). Accordingly, utilities of VGAM1322 include diagnosis, prevention and treatment of diseases and clinical conditions associated with LOC132625. LOC135763 (Accession NM_138572) is another VGAM1322 host target gene. LOC135763 BINDING SITE is HOST TARGET binding site found in the 3' untranslated region of mRNA encoded by LOC135763, corresponding to a HOST TARGET binding site such as BINDING SITE I, BINDING SITE II or BINDING SITE III. Table 2 illustrates the complementarity of the nucleotide sequences of LOC135763 BINDING SITE, designated SEQ ID:28880, to the nucleotide sequence of VGAM1322 RNA, herein designated VGAM RNA, also designated SEQ ID:4033.

Another function of VGAM1322 is therefore inhibition of LOC135763 (Accession NM_138572). Accordingly, utilities of VGAM1322 include diagnosis, prevention and treatment of diseases and clinical conditions associated with LOC135763. LOC143187 (Accession NM_145206) is another VGAM1322 host target gene. LOC143187 BINDING SITE is HOST TARGET binding site found in the 3' untranslated region of mRNA encoded by LOC143187, corresponding to a HOST TARGET binding site such as BINDING SITE I, BINDING SITE II or BINDING SITE III. Table 2 illustrates the complementarity of the nucleotide sequences of LOC143187 BINDING SITE, designated SEQ ID:29743, to the nucleotide sequence of VGAM1322 RNA, herein designated VGAM RNA, also designated SEQ ID:4033.

Another function of VGAM1322 is therefore inhibition of LOC143187 (Accession NM_145206). Accordingly, utilities of VGAM1322 include diagnosis, prevention and treatment of diseases and clinical conditions associated with LOC143187. LOC145226 (Accession XM_085058) is another VGAM1322 host target gene. LOC145226 BINDING SITE is HOST TARGET binding site found in the 3' untranslated region of mRNA encoded by LOC145226, corresponding to a HOST TARGET binding site such as BINDING SITE I, BINDING SITE II or BINDING SITE III. Table 2 illustrates the complementarity of the nucleotide sequences of LOC145226 BINDING SITE, designated SEQ ID:37810, to the nucleotide sequence of VGAM1322 RNA, herein designated VGAM RNA, also designated SEQ ID:4033.

Another function of VGAM1322 is therefore inhibition of LOC145226 (Accession XM_085058). Accordingly, utilities of VGAM1322 include diagnosis, prevention and treatment of diseases and clinical conditions associated with LOC145226. LOC145955 (Accession XM_096912) is another VGAM1322 host target gene. LOC145955 BINDING SITE is HOST TARGET binding site found in the 3' untranslated region of mRNA encoded by LOC145955, corresponding to a HOST TARGET binding site such as BINDING SITE I, BINDING SITE II or BINDING SITE III. Table 2 illustrates the complementarity of the nucleotide sequences of LOC145955 BINDING SITE, designated SEQ ID:40643, to the nucleotide sequence of VGAM1322 RNA, herein designated VGAM RNA, also designated SEQ ID:4033.

Another function of VGAM1322 is therefore inhibition of LOC145955 (Accession XM_096912). Accordingly, utilities of VGAM1322 include diagnosis, prevention and treatment of diseases and clinical conditions associated with LOC145955. LOC146455 (Accession XM_085471) is another VGAM1322 host target gene. LOC146455 BINDING SITE is HOST TARGET binding site found in the 3' untranslated region of mRNA encoded by LOC146455, corresponding to a HOST TARGET binding site such as BINDING SITE I, BINDING SITE II or BINDING SITE III. Table 2 illustrates the complementarity of the nucleotide sequences of LOC146455 BINDING SITE, designated SEQ ID:38156, to the nucleotide sequence of VGAM1322 RNA, herein designated VGAM RNA, also designated SEQ ID:4033.

Another function of VGAM1322 is therefore inhibition of LOC146455 (Accession XM_085471). Accordingly, utilities of VGAM1322 include diagnosis, prevention and treatment of diseases and clinical conditions associated with LOC146455. LOC146909 (Accession XM_085634) is another VGAM1322 host target gene. LOC146909 BINDING SITE is HOST TARGET binding site found in the 3' untranslated region of mRNA encoded by LOC146909, corresponding to a HOST TARGET binding site such as BINDING SITE I, BINDING SITE II or BINDING SITE III. Table 2 illustrates the complementarity of the nucleotide sequences of LOC146909 BINDING SITE, designated SEQ ID:38264, to the nucleotide sequence of VGAM1322 RNA, herein designated VGAM RNA, also designated SEQ ID:4033.

Another function of VGAM1322 is therefore inhibition of LOC146909 (Accession XM_085634). Accordingly, utilities of VGAM1322 include diagnosis, prevention and treatment of diseases and clinical conditions associated with LOC146909. LOC147429 (Accession XM_085793) is another VGAM1322 host target gene. LOC147429 BINDING SITE is HOST TARGET binding site found in the 5' untranslated region of mRNA encoded by LOC147429, corresponding to a HOST TARGET binding site such as BINDING SITE I, BINDING SITE II or BINDING SITE III. Table 2 illustrates the complementarity of the nucleotide sequences of LOC147429 BINDING SITE, designated SEQ ID:38336, to the nucleotide sequence of VGAM1322 RNA, herein designated VGAM RNA, also designated SEQ ID:4033.

Another function of VGAM1322 is therefore inhibition of LOC147429 (Accession XM_085793). Accordingly, utilities of VGAM1322 include diagnosis, prevention and treatment of diseases and clinical conditions associated with LOC147429. LOC149117 (Accession XM_097587) is another VGAM1322 host target gene. LOC149117 BINDING SITE is HOST TARGET binding site found in the 5' untranslated region of mRNA encoded by LOC149117, corresponding to a HOST TARGET binding site such as BINDING SITE I, BINDING SITE II or BINDING SITE III. Table 2 illustrates the complementarity of the nucleotide sequences of LOC149117 BINDING SITE, designated SEQ ID:40953, to the nucleotide sequence of VGAM1322 RNA, herein designated VGAM RNA, also designated SEQ ID:4033.

Another function of VGAM1322 is therefore inhibition of LOC149117 (Accession XM_097587). Accordingly, utilities of VGAM1322 include diagnosis, prevention and treatment of diseases and clinical conditions associated with LOC149117. LOC149461 (Accession XM_086547) is another VGAM1322 host target gene. LOC149461 BINDING SITE is HOST TARGET binding site found in the 3' untranslated region of mRNA encoded by LOC149461, corresponding to a HOST TARGET binding site such as BINDING SITE I, BINDING SITE II or BINDING SITE III. Table 2 illustrates the complementarity of the nucleotide sequences of LOC149461 BINDING SITE, designated SEQ ID:38760, to the nucleotide sequence of VGAM1322 RNA, herein designated VGAM RNA, also designated SEQ ID:4033.

Another function of VGAM1322 is therefore inhibition of LOC149461 (Accession XM_086547). Accordingly, utilities of VGAM1322 include diagnosis, prevention and treatment of diseases and clinical conditions associated with LOC149461. LOC149836 (Accession XM_086685) is another VGAM1322 host target gene. LOC149836 BINDING SITE is HOST TARGET binding site found in the 5' untranslated region of mRNA encoded by LOC149836, corresponding to a HOST TARGET binding site such as BINDING SITE I, BINDING SITE II or BINDING SITE III. Table 2 illustrates the complementarity of the nucleotide sequences of LOC149836 BINDING SITE, designated SEQ ID:38824, to the nucleotide sequence of VGAM1322 RNA, herein designated VGAM RNA, also designated SEQ ID:4033.

Another function of VGAM1322 is therefore inhibition of LOC149836 (Accession XM_086685). Accordingly, utilities of VGAM1322 include diagnosis, prevention and treatment of diseases and clinical conditions associated with LOC149836. LOC150054 (Accession XM_097797) is another VGAM1322 host target gene. LOC150054 BINDING SITE is HOST TARGET binding site found in the 5' untranslated region of mRNA encoded by LOC150054, corresponding to a HOST TARGET binding site such as BINDING SITE I, BINDING SITE II or BINDING SITE III. Table 2 illustrates the complementarity of the nucleotide sequences of LOC150054 BINDING SITE, designated SEQ ID:41124, to the nucleotide sequence of VGAM1322 RNA, herein designated VGAM RNA, also designated SEQ ID:4033.

Another function of VGAM1322 is therefore inhibition of LOC150054 (Accession XM_097797). Accordingly, utilities of VGAM1322 include diagnosis, prevention and treatment of diseases and clinical conditions associated with LOC150054. LOC150960 (Accession XM_087059) is another VGAM1322 host target gene. LOC150960 BINDING SITE is HOST TARGET binding site found in the 3' untranslated region of mRNA encoded by LOC150960, corresponding to a HOST TARGET binding site such as BINDING SITE I, BINDING SITE II or BINDING SITE III. Table 2 illustrates the complementarity of the nucleotide sequences of LOC150960 BINDING SITE, designated SEQ ID:39029, to the nucleotide sequence of VGAM1322 RNA, herein designated VGAM RNA, also designated SEQ ID:4033.

Another function of VGAM1322 is therefore inhibition of LOC150960 (Accession XM_087059). Accordingly, utilities of VGAM1322 include diagnosis, prevention and treatment of diseases and clinical conditions associated with LOC150960. LOC152925 (Accession XM_087559) is another VGAM1322 host target gene. LOC152925 BINDING SITE is HOST TARGET binding site found in the 3' untranslated region of mRNA encoded by LOC152925, corresponding to a HOST TARGET binding site such as BINDING SITE I, BINDING SITE II or BINDING SITE III. Table 2 illustrates the complementarity of the nucleotide sequences of LOC152925 BINDING SITE, designated SEQ ID:39329, to the nucleotide sequence of VGAM1322 RNA, herein designated VGAM RNA, also designated SEQ ID:4033.

Another function of VGAM1322 is therefore inhibition of LOC152925 (Accession XM_087559). Accordingly, utilities of VGAM1322 include diagnosis, prevention and treatment of diseases and clinical conditions associated with LOC152925. LOC154739 (Accession XM_098602) is another VGAM1322 host target gene. LOC154739 BINDING SITE is HOST TARGET binding site found in the 5' untranslated region of mRNA encoded by LOC154739, corresponding to a HOST TARGET binding site such as BINDING SITE I, BINDING SITE II or BINDING SITE III. Table 2 illustrates the complementarity of the nucleotide sequences of LOC154739 BINDING SITE, designated SEQ ID:41715, to the nucleotide sequence of VGAM1322 RNA, herein designated VGAM RNA, also designated SEQ ID:4033.

Another function of VGAM1322 is therefore inhibition of LOC154739 (Accession XM_098602). Accordingly, utilities of VGAM1322 include diagnosis, prevention and treatment of diseases and clinical conditions associated with LOC154739. LOC157798 (Accession XM_098827) is another VGAM1322 host target gene. LOC157798 BINDING SITE is HOST TARGET binding site found in the 5' untranslated region of mRNA encoded by LOC157798, corresponding to a HOST TARGET binding site such as BINDING SITE I, BINDING SITE II or BINDING SITE III. Table 2 illustrates the complementarity of the nucleotide sequences of LOC157798 BINDING SITE, designated SEQ ID:41846, to the nucleotide sequence of VGAM1322 RNA, herein designated VGAM RNA, also designated SEQ ID:4033.

Another function of VGAM1322 is therefore inhibition of LOC157798 (Accession XM_098827). Accordingly, utilities of VGAM1322 include diagnosis, prevention and treatment of diseases and clinical conditions associated with LOC157798. LOC158237 (Accession XM_017584) is another VGAM1322 host target gene. LOC158237 BINDING SITE is HOST TARGET binding site found in the 5' untranslated region of mRNA encoded by LOC158237, corresponding to a HOST TARGET binding site such as BINDING SITE I, BINDING SITE II or BINDING SITE III. Table 2 illustrates the complementarity of the nucleotide sequences of LOC158237 BINDING SITE, designated SEQ ID:30326, to the nucleotide sequence of VGAM1322 RNA, herein designated VGAM RNA, also designated SEQ ID:4033.

Another function of VGAM1322 is therefore inhibition of LOC158237 (Accession XM_017584). Accordingly, utilities of VGAM1322 include diagnosis, prevention and treatment of diseases and clinical conditions associated with LOC158237. LOC165229 (Accession XM_092464) is another VGAM1322 host target gene. LOC165229 BINDING SITE is HOST TARGET binding site found in the 5' untranslated region of mRNA encoded by LOC165229, corresponding to a HOST TARGET binding site such as BINDING SITE I, BINDING SITE II or BINDING SITE III. Table 2 illustrates the complementarity of the nucleotide sequences of LOC165229 BINDING SITE, designated SEQ ID:40124, to the nucleotide sequence of VGAM1322 RNA, herein designated VGAM RNA, also designated SEQ ID:4033.

Another function of VGAM1322 is therefore inhibition of LOC165229 (Accession XM_092464). Accordingly, utilities of VGAM1322 include diagnosis, prevention and treatment of diseases and clinical conditions associated with LOC165229. LOC170082 (Accession XM_093092) is another VGAM1322 host target gene. LOC170082 BINDING SITE is HOST TARGET binding site found in the 5' untranslated region of mRNA encoded by LOC170082, corresponding to a HOST TARGET binding site such as BINDING SITE I, BINDING SITE II or BINDING SITE III. Table 2 illustrates the complementarity of the nucleotide sequences of LOC170082 BINDING SITE, designated SEQ ID:40168, to the nucleotide sequence of VGAM1322 RNA, herein designated VGAM RNA, also designated SEQ ID:4033.

Another function of VGAM1322 is therefore inhibition of LOC170082 (Accession XM_093092). Accordingly, utilities of VGAM1322 include diagnosis, prevention and treatment of diseases and clinical conditions associated with LOC170082. LOC196264 (Accession XM_113683) is another VGAM1322 host target gene. LOC196264 BINDING SITE is HOST TARGET binding site found in the 3' untranslated region of mRNA encoded by LOC196264, corresponding to a HOST TARGET binding site such as BINDING SITE I, BINDING SITE II or BINDING SITE III. Table 2 illustrates the complementarity of the nucleotide sequences of LOC196264 BINDING SITE, designated SEQ ID:42333, to the nucleotide sequence of VGAM1322 RNA, herein designated VGAM RNA, also designated SEQ ID:4033.

Another function of VGAM1322 is therefore inhibition of LOC196264 (Accession XM_113683). Accordingly, utilities of VGAM1322 include diagnosis, prevention and treatment of diseases and clinical conditions associated with LOC196264. LOC200169 (Accession XM_117200) is another VGAM1322 host target gene. LOC200169 BINDING SITE is HOST TARGET binding site found in the 5' untranslated region of mRNA encoded by LOC200169, corresponding to a HOST TARGET binding site such as BINDING SITE I, BINDING SITE II or BINDING SITE III. Table 2 illustrates the complementarity of the nucleotide sequences of LOC200169 BINDING SITE, designated SEQ ID:43283, to the nucleotide sequence of VGAM1322 RNA, herein designated VGAM RNA, also designated SEQ ID:4033.

Another function of VGAM1322 is therefore inhibition of LOC200169 (Accession XM_117200). Accordingly, utilities of VGAM1322 include diagnosis, prevention and treatment of diseases and clinical conditions associated with LOC200169. LOC200314 (Accession XM_117225) is another VGAM1322 host target gene. LOC200314 BINDING SITE is HOST TARGET binding site found in the 3' untranslated region of mRNA encoded by LOC200314, corresponding to a HOST TARGET binding site such as BINDING SITE I, BINDING SITE II or BINDING SITE III. Table 2 illustrates the complementarity of the nucleotide sequences of LOC200314 BINDING SITE, designated SEQ ID:43292, to the nucleotide sequence of VGAM1322 RNA, herein designated VGAM RNA, also designated SEQ ID:4033.

Another function of VGAM1322 is therefore inhibition of LOC200314 (Accession XM_117225). Accordingly, utilities of VGAM1322 include diagnosis, prevention and treatment of diseases and clinical conditions associated with LOC200314. LOC200339 (Accession XM_117226) is another VGAM1322 host target gene. LOC200339 BINDING SITE is HOST TARGET binding site found in the 3' untranslated region of mRNA encoded by LOC200339, corresponding to a HOST TARGET binding site such as BINDING SITE I, BINDING SITE II or BINDING SITE III. Table 2 illustrates the complementarity of the nucleotide sequences of LOC200339 BINDING SITE, designated SEQ ID:43296, to the nucleotide sequence of VGAM1322 RNA, herein designated VGAM RNA, also designated SEQ ID:4033.

Another function of VGAM1322 is therefore inhibition of LOC200339 (Accession XM_117226). Accordingly, utilities of VGAM1322 include diagnosis, prevention and treatment of diseases and clinical conditions associated with LOC200339. LOC200860 (Accession XM_117289) is another VGAM1322 host target gene. LOC200860 BINDING SITE is HOST TARGET binding site found in the 3' untranslated region of mRNA encoded by LOC200860, corresponding to a HOST TARGET binding site such as BINDING SITE I, BINDING SITE II or BINDING SITE III. Table 2 illustrates the complementarity of the nucleotide sequences of LOC200860 BINDING SITE, designated SEQ ID:43352, to the nucleotide sequence of VGAM1322 RNA, herein designated VGAM RNA, also designated SEQ ID:4033.

Another function of VGAM1322 is therefore inhibition of LOC200860 (Accession XM_117289). Accordingly, utilities of VGAM1322 include diagnosis, prevention and treatment of diseases and clinical conditions associated with LOC200860. LOC201292 (Accession XM_113949) is another VGAM1322 host target gene. LOC201292 BINDING SITE is HOST TARGET binding site found in the 5' untranslated region of mRNA encoded by LOC201292, corresponding to a HOST TARGET binding site such as BINDING SITE I, BINDING SITE II or BINDING SITE III. Table 2 illustrates the complementarity of the nucleotide sequences of LOC201292 BINDING SITE, designated SEQ ID:42562, to the nucleotide sequence of VGAM1322 RNA, herein designated VGAM RNA, also designated SEQ ID:4033.

Another function of VGAM1322 is therefore inhibition of LOC201292 (Accession XM_113949). Accordingly, utilities of VGAM1322 include diagnosis, prevention and treatment of diseases and clinical conditions associated with LOC201292. LOC201294 (Accession XM_113950) is another VGAM1322 host target gene. LOC201294 BINDING SITE is HOST TARGET binding site found in the 3' untranslated region of mRNA encoded by LOC201294, corresponding to a HOST TARGET binding site such as BINDING SITE I, BINDING SITE II or BINDING SITE III. Table 2 illustrates the complementarity of the nucleotide sequences of LOC201294 BINDING SITE, designated SEQ ID:42565, to the nucleotide sequence of VGAM1322 RNA, herein designated VGAM RNA, also designated SEQ ID:4033.

Another function of VGAM1322 is therefore inhibition of LOC201294 (Accession XM_113950). Accordingly, utilities of VGAM1322 include diagnosis, prevention and treatment of diseases and clinical conditions associated with LOC201294. LOC203276 (Accession XM_117523) is another VGAM1322 host target gene. LOC203276 BINDING SITE is HOST TARGET binding site found in the 3' untranslated region of mRNA encoded by LOC203276, corresponding to a HOST TARGET binding site such as BINDING SITE I, BINDING SITE II or BINDING SITE III. Table 2 illustrates the complementarity of the nucleotide sequences of LOC203276 BINDING SITE, designated SEQ ID:43482, to the nucleotide sequence of VGAM1322 RNA, herein designated VGAM RNA, also designated SEQ ID:4033.

Another function of VGAM1322 is therefore inhibition of LOC203276 (Accession XM_117523). Accordingly, utilities of VGAM1322 include diagnosis, prevention and treatment of diseases and clinical conditions associated with LOC203276. LOC203305 (Accession XM_117529) is another VGAM1322 host target gene. LOC203305 BINDING SITE is HOST TARGET binding site found in the 3' untranslated region of mRNA encoded by LOC203305, corresponding to a HOST TARGET binding site such as BINDING SITE I, BINDING SITE II or BINDING SITE III. Table 2 illustrates the complementarity of the nucleotide sequences of LOC203305 BINDING SITE, designated SEQ ID:43506, to the nucleotide sequence of VGAM1322 RNA, herein designated VGAM RNA, also designated SEQ ID:4033.

Another function of VGAM1322 is therefore inhibition of LOC203305 (Accession XM_117529). Accordingly, utilities of VGAM1322 include diagnosis, prevention and treatment of diseases and clinical conditions associated with LOC203305. LOC220662 (Accession XM_165978) is another VGAM1322 host target gene. LOC220662 BINDING SITE is HOST TARGET binding site found in the 3' untranslated region of mRNA encoded by LOC220662, corresponding to a HOST TARGET binding site such as BINDING SITE I, BINDING SITE II or BINDING SITE III. Table 2 illustrates the complementarity of the nucleotide sequences of LOC220662 BINDING SITE, designated SEQ ID:43821, to the nucleotide sequence of VGAM1322 RNA, herein designated VGAM RNA, also designated SEQ ID:4033.

Another function of VGAM1322 is therefore inhibition of LOC220662 (Accession XM_165978). Accordingly, utilities of VGAM1322 include diagnosis, prevention and treatment of diseases and clinical conditions associated with LOC220662. LOC222070 (Accession XM_168433) is another VGAM1322 host target gene. LOC222070 BINDING SITE is HOST TARGET binding site found in the 5' untranslated region of mRNA encoded by LOC222070, corresponding to a HOST TARGET binding site such as BINDING SITE I, BINDING SITE II or BINDING SITE III. Table 2 illustrates the complementarity of the nucleotide sequences of LOC222070 BINDING SITE, designated SEQ ID:45177, to the nucleotide sequence of VGAM1322 RNA, herein designated VGAM RNA, also designated SEQ ID:4033.

Another function of VGAM1322 is therefore inhibition of LOC222070 (Accession XM_168433). Accordingly, utilities of VGAM1322 include diagnosis, prevention and treatment of diseases and clinical conditions associated with LOC222070. LOC254243 (Accession XM_173233) is another VGAM1322 host target gene. LOC254243 BINDING SITE is HOST TARGET binding site found in the 3' untranslated region of mRNA encoded by LOC254243, corresponding to a HOST TARGET binding site such as BINDING SITE I, BINDING SITE II or BINDING SITE III. Table 2 illustrates the complementarity of the nucleotide sequences of LOC254243 BINDING SITE, designated SEQ ID:46508, to the nucleotide sequence of VGAM1322 RNA, herein designated VGAM RNA, also designated SEQ ID:4033.

Another function of VGAM1322 is therefore inhibition of LOC254243 (Accession XM_173233). Accordingly, utilities of VGAM1322 include diagnosis, prevention and treatment of diseases and clinical conditions associated with LOC254243. LOC51193 (Accession NM_016331) is another VGAM1322 host target gene. LOC51193 BINDING SITE is HOST TARGET binding site found in the 5' untranslated region of mRNA encoded by LOC51193, corresponding to a HOST TARGET binding site such as BINDING SITE I, BINDING SITE II or BINDING SITE III. Table 2 illustrates the complementarity of the nucleotide sequences of LOC51193 BINDING SITE, designated SEQ ID:18453, to the nucleotide sequence of VGAM1322 RNA, herein designated VGAM RNA, also designated SEQ ID:4033.

Another function of VGAM1322 is therefore inhibition of LOC51193 (Accession NM_016331). Accordingly, utilities of VGAM1322 include diagnosis, prevention and treatment of diseases and clinical conditions associated with LOC51193. LOC51200 (Accession NM_016352) is another VGAM1322 host target gene. LOC51200 BINDING SITE is HOST TARGET binding site found in the 3' untranslated region of mRNA encoded by LOC51200, corresponding to a HOST TARGET binding site such as BINDING SITE I, BINDING SITE II or BINDING SITE III. Table 2 illustrates the complementarity of the nucleotide sequences of LOC51200 BINDING SITE, designated SEQ ID:18480, to the nucleotide sequence of VGAM1322 RNA, herein designated VGAM RNA, also designated SEQ ID:4033.

Another function of VGAM1322 is therefore inhibition of LOC51200 (Accession NM_016352). Accordingly, utilities of VGAM1322 include diagnosis, prevention and treatment of diseases and clinical conditions associated with LOC51200. LOC89932 (Accession XM_027341) is another VGAM1322 host target gene. LOC89932 BINDING SITE is HOST TARGET binding site found in the 3' untranslated region of mRNA encoded by LOC89932, corresponding to a HOST TARGET binding site such as BINDING SITE I, BINDING SITE II or BINDING SITE III. Table 2 illustrates the complementarity of the nucleotide sequences of LOC89932 BINDING SITE, designated SEQ ID:30487, to the nucleotide sequence of VGAM1322 RNA, herein designated VGAM RNA, also designated SEQ ID:4033.

Another function of VGAM1322 is therefore inhibition of LOC89932 (Accession XM_027341). Accordingly, utilities of VGAM1322 include diagnosis, prevention and treatment of diseases and clinical conditions associated with LOC89932. LOC90038 (Accession XM_028305) is another VGAM1322 host target gene. LOC90038 BINDING SITE is HOST TARGET binding site found in the 3' untranslated region of mRNA encoded by LOC90038, corresponding to a HOST TARGET binding site such as BINDING SITE I, BINDING SITE II or BINDING SITE III. Table 2 illustrates the complementarity of the nucleotide sequences of LOC90038 BINDING SITE, designated SEQ ID:30645, to the nucleotide sequence of VGAM1322 RNA, herein designated VGAM RNA, also designated SEQ ID:4033.

Another function of VGAM1322 is therefore inhibition of LOC90038 (Accession XM_028305). Accordingly, utilities of VGAM1322 include diagnosis, prevention and treatment of diseases and clinical conditions associated with LOC90038. LOC90371 (Accession XM_031261) is another VGAM1322 host target gene. LOC90371 BINDING SITE is HOST TARGET binding site found in the 5' untranslated region of mRNA encoded by LOC90371, corresponding to a HOST TARGET binding site such as BINDING SITE I, BINDING SITE II or BINDING SITE III. Table 2 illustrates the complementarity of the nucleotide sequences of LOC90371 BINDING SITE, designated SEQ ID:31319, to the nucleotide sequence of VGAM1322 RNA, herein designated VGAM RNA, also designated SEQ ID:4033.

Another function of VGAM1322 is therefore inhibition of LOC90371 (Accession XM_031261). Accordingly, utilities of VGAM1322 include diagnosis, prevention and treatment of diseases and clinical conditions associated with LOC90371. LOC90408 (Accession XM_031517) is another VGAM1322 host target gene. LOC90408 BINDING SITE is HOST TARGET binding site found in the 5' untranslated region of mRNA encoded by LOC90408, corresponding to a HOST TARGET binding site such as BINDING SITE I, BINDING SITE II or BINDING SITE III. Table 2 illustrates the complementarity of the nucleotide sequences of LOC90408 BINDING SITE, designated SEQ ID:31394, to the nucleotide sequence of VGAM1322 RNA, herein designated VGAM RNA, also designated SEQ ID:4033.

Another function of VGAM1322 is therefore inhibition of LOC90408 (Accession XM_031517). Accordingly, utilities of VGAM1322 include diagnosis, prevention and treatment of diseases and clinical conditions associated with LOC90408. LOC92249 (Accession XM_043814) is another VGAM1322 host target gene. LOC92249 BINDING SITE is HOST TARGET binding site found in the 5' untranslated region of mRNA encoded by LOC92249, corresponding to a HOST TARGET binding site such as BINDING SITE I, BINDING SITE II or BINDING SITE III. Table 2 illustrates the complementarity of the nucleotide sequences of LOC92249 BINDING SITE, designated SEQ ID:34023, to the nucleotide sequence of VGAM1322 RNA, herein designated VGAM RNA, also designated SEQ ID:4033.

Another function of VGAM1322 is therefore inhibition of LOC92249 (Accession XM_043814). Accordingly, utilities of VGAM1322 include diagnosis, prevention and treatment of diseases and clinical conditions associated with LOC92249. LOC92283 (Accession XM_044049) is another VGAM1322 host target gene. LOC92283 BINDING SITE is HOST TARGET binding site found in the 3' untranslated region of mRNA encoded by LOC92283, corresponding to a HOST TARGET binding site such as BINDING SITE I, BINDING SITE II or BINDING SITE III. Table 2 illustrates the complementarity of the nucleotide sequences of LOC92283 BINDING SITE, designated SEQ ID:34091, to the nucleotide sequence of VGAM1322 RNA, herein designated VGAM RNA, also designated SEQ ID:4033.

Another function of VGAM1322 is therefore inhibition of LOC92283 (Accession XM_044049). Accordingly, utilities of VGAM1322 include diagnosis, prevention and treatment of diseases and clinical conditions associated with LOC92283. FIG. 1 further provides a conceptual description of a novel bioinformatically detected viral gene of the present invention, referred to here as Viral Genomic Address Messenger 1323 (VGAM1323) viral gene, which modulates expression of respective host target genes thereof, the function and utility of which host target genes is known in the art.

VGAM1323 is a novel bioinformatically detected regulatory, non protein coding, viral micro RNA (miRNA) gene. The method by which VGAM1323 was detected is described hereinabove with reference to FIGS. 1-8.

VGAM1323 gene, herein designated VGAM GENE, is a viral gene contained in the genome of Garlic Latent Virus. VGAM1323 host target gene, herein designated VGAM HOST TARGET GENE, is a human gene contained in the human genome.

VGAM1323 gene encodes a VGAM1323 precursor RNA, herein designated VGAM PRECURSOR RNA. Similar to other miRNA genes, and unlike most ordinary genes, VGAM1323 precursor RNA does not encode a protein. A nucleotide sequence identical or highly similar to the nucleotide sequence of VGAM1323 precursor RNA is designated SEQ ID:1309, and is provided hereinbelow with reference to the sequence listing part. Nucleotide sequence SEQ ID:1309 is located at position 5155 relative to the genome of Garlic Latent Virus.

VGAM1323 precursor RNA folds onto itself, forming VGAM1323 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1323 folded precursor RNA into VGAM1323 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM1323 RNA is designated SEQ ID:4034, and is provided hereinbelow with reference to the sequence listing part.

VGAM1323 host target gene, herein designated VGAM HOST TARGET GENE, encodes a corresponding messenger RNA, VGAM1323 host target RNA, herein designated VGAM HOST TARGET RNA. VGAM1323 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1323 RNA, herein designated VGAM RNA, binds complementarily to one or more host target binding sites located in untranslated regions of VGAM1323 host target RNA, herein designated VGAM HOST TARGET RNA. This complementary binding is due to the fact that the nucleotide sequence of VGAM1323 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1323 RNA, herein designated VGAM RNA, may have a different number of host target binding sites in untranslated regions of a VGAM1323 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1323 RNA, herein designated VGAM RNA, to host target binding sites on VGAM1323 host target RNA, herein designated VGAM HOST TARGET RNA, such as BINDING SITE I, BINDING SITE II and BINDING SITE III, inhibits translation of VGAM1323 host target RNA into VGAM1323 host target protein, herein designated VGAM HOST TARGET PROTEIN. VGAM host target protein is therefore outlined by a broken line.

It is appreciated that VGAM1323 host target gene, herein designated VGAM HOST TARGET GENE, in fact represents a plurality of VGAM1323 host target genes. The mRNA of each one of this plurality of VGAM1323 host target genes comprises one or more host target binding sites, each having a nucleotide sequence which is at least partly complementary to VGAM1323 RNA, herein designated VGAM RNA, and which when bound by VGAM1323 RNA causes inhibition of translation of respective one or more VGAM1323 host target proteins.

It is further appreciated by one skilled in the art that the mode of translational inhibition illustrated by FIG. 1 with specific reference to translational inhibition exerted by VGAM1323 gene, herein designated VGAM GENE, on one or more VGAM1323 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1323 is inhibition of expression of host target genes, as part of a novel viral mechanism of attacking a host. Accordingly, utilities of VGAM1323 include diagnosis, prevention and treatment of viral infection by Garlic Latent Virus. Specific functions, and accordingly utilities, of VGAM1323 correlate with, and may be deduced from, the identity of the host target genes which VGAM1323 binds and inhibits, and the function of these host target genes, as elaborated hereinbelow.

Nucleotide sequences of the VGAM1323 precursor RNA, herein designated VGAM PRECURSOR RNA, and of the 'diced' VGAM1323 RNA, herein designated VGAM RNA, and a schematic representation of the secondary folding of VGAM1323 folded precursor RNA, herein designated VGAM FOLDED PRECURSOR RNA, of VGAM1323 are further described hereinbelow with reference to Table 1.

Nucleotide sequences of host target binding sites, such as BINDING SITE-I, BINDING SITE-II and BINDING SITE-III of FIG. 1, found on VGAM1323 host target RNA, and schematic representation of the complementarity of each of these host target binding sites to VGAM1323 RNA, herein designated VGAM RNA, are described hereinbelow with reference to Table 2.

As mentioned hereinabove with reference to FIG. 1, a function of VGAM1323 gene, herein designated VGAM is inhibition of expression of VGAM1323 target genes. It is appreciated that specific functions, and accordingly utilities, of VGAM1323 correlate with, and may be deduced from, the identity of the target genes which VGAM1323 binds and inhibits, and the function of these target genes, as elaborated hereinbelow.

Engulfment and Cell Motility 1 (ced-12 homolog, C. elegans) (ELMO1, Accession NM_130442) is a VGAM1323 host target gene. ELMO1 BINDING SITE is HOST TARGET binding site found in the 3' untranslated region of mRNA encoded by ELMO1, corresponding to a HOST TARGET binding site such as BINDING SITE I, BINDING SITE II or BINDING SITE III. Table 2 illustrates the complementarity of the nucleotide sequences of ELMO1 BINDING SITE, designated SEQ ID:28201, to the nucleotide sequence of VGAM1323 RNA, herein designated VGAM RNA, also designated SEQ ID:4034.

A function of VGAM1323 is therefore inhibition of Engulfment and Cell Motility 1 (ced-12 homolog, C. elegans) (ELMO1, Accession NM_130442). Accordingly, utilities of VGAM1323 include diagnosis, prevention and treatment of diseases and clinical conditions associated with ELMO1. Formin 2 (FMN2, Accession XM_086525) is another VGAM1323 host target gene. FMN2 BINDING SITE is HOST TARGET binding site found in the 3' untranslated region of mRNA encoded by FMN2, corresponding to a HOST TARGET binding site such as BINDING SITE I, BINDING SITE II or BINDING SITE III. Table 2 illustrates the complementarity of the nucleotide sequences of FMN2 BINDING SITE, designated SEQ ID:38742, to the nucleotide sequence of VGAM1323 RNA, herein designated VGAM RNA, also designated SEQ ID:4034.

Another function of VGAM1323 is therefore inhibition of Formin 2 (FMN2, Accession XM_086525). Accordingly, utilities of VGAM1323 include diagnosis, prevention and treatment of diseases and clinical conditions associated with FMN2. Glycogen Synthase 1 (muscle) (GYS1, Accession XM_114024) is another VGAM1323 host target gene. GYS1 BINDING SITE is HOST TARGET binding site found in the 3' untranslated region of mRNA encoded by GYS1, corresponding to a HOST TARGET binding site such as BINDING SITE I, BINDING SITE II or BINDING SITE III. Table 2 illustrates the complementarity of the nucleotide sequences of GYS1 BINDING SITE, designated SEQ ID:42625, to the nucleotide sequence of VGAM1323 RNA, herein designated VGAM RNA, also designated SEQ ID:4034.

Another function of VGAM1323 is therefore inhibition of Glycogen Synthase 1 (muscle) (GYS1, Accession XM_114024), a gene which transfers the glycosyl residue from udp-glc to the nonreducing end of alpha-1,4-glucan. Accordingly, utilities of VGAM1323 include diagnosis, prevention and treatment of diseases and clinical conditions associated with GYS1. The function of GYS1 has been established by previous studies. To examine whether defective muscle GYS1 expression is associated with impaired glycogen synthesis in type 2 diabetes and whether the defect is inherited or acquired, Huang et al. (2000) measured GYS1 gene expression and enzyme activity in muscle biopsies taken before and after an insulin clamp in 12 monozygotic twin pairs discordant for type 2 diabetes and in 12 matched control subjects. The effect of insulin on GYS1 fractional activity, when expressed as the increment over the basal values, was significantly impaired in diabetic (15.7 +/-3.3%; P less than 0.01), but not in nondiabetic (23.7 +/-1.8%; P=NS) twins compared with that in control subjects (28.1 +/-2.3%). Insulin increased GYS1 mRNA expression in control subjects (from 0.14 +/-0.02 to 1.74 +/-0.10 relative units; P less than 0.01) and in nondiabetic (from 0.24 +/-0.05 to 1.81 +/-0.16 relative units; P less than 0.01) and diabetic (from 0.20 +/-0.07 to 1.08 +/-0.14 relative units; P less than 0.01) twins. The effect of insulin on GYS1 expression was, however, significantly reduced in the diabetic (P less than 0.003), but not in the nondiabetic, twins, compared with that in control subjects. The postclamp GYS1 mRNA levels correlated strongly with the hemoglobin A1c levels (r=-0.61; P less than 0.001). The authors concluded that insulin stimulates GYS1 mRNA expression and that impaired stimulation of GYS1 gene expression by insulin in patients with type 2 diabetes is acquired and most likely is secondary to chronic hyperglycemia. Inbred mouse strains fed on a diabetogenic diet (high in fat and sucrose) differ in their propensities to develop features analogous to type 2 diabetes mellitus. To define chromosomal locations that control these characteristics, Seldin et al. (1994) studied recombinant inbred strains from diabetes-prone C57BL/6J and diabetes-resistant A/J strains. Hyperglycemia correlated with the marker D7Mit25 on mouse chromosome 7. This putative susceptibility locus is consistent with that of the glycogen synthase gene, which was implicated by Groop et al. (1993) in the pathogenesis of type 2 diabetes in the human. Seldin et al. (1994) found that fractional glycogen synthase activity in isolated muscle was significantly lower in normal B/6J diabetes-prone mice than in normal diabetes-resistant A/J mice, a finding similar to that reported in relatives of human patients with type 2 diabetes.

Full details of the abovementioned studies are described in the following publications, the disclosure of which are hereby incorporated by reference:

Huang, X.; Vaag, A.; Hansson, M.; Weng, J.; Laurila, E.; Groop, L.: Impaired insulin-stimulated expression of the glycogen synthase gene in skeletal muscle of type 2 diabetic patients is acquired rather than inherited. J. Clin. Endocr. Metab. 85:1584-1590, 2000; and Seldin, M. F.; Mott, D.; Bhat, D.; Petro, A.; Kuhn, C. M.; Kingsmore, S. F.; Bogardus, C.; Opara, E.; Feinglos, M. N.; Surwit, R. S.: Glycogen synthase: a putative locus for diet-induc.

Further studies establishing the function and utilities of GYS1 are found in John Hopkins OMIM database record ID 138570, and in sited publications numbered 11617-11623 listed in the bibliography section hereinbelow, which are also hereby incorporated by reference. Single-minded Homolog 1 (Drosophila) (SIM1, Accession NM_005068) is another VGAM1323 host target gene. SIM1 BINDING SITE is HOST TARGET binding site found in the 3' untranslated region of mRNA encoded by SIM1, corresponding to a HOST TARGET binding site such as BINDING SITE I, BINDING SITE II or BINDING SITE III. Table 2 illustrates the complementarity of the nucleotide sequences of SIM1 BINDING SITE, designated SEQ ID:11508, to the nucleotide sequence of VGAM1323 RNA, herein designated VGAM RNA, also designated SEQ ID:4034.

Another function of VGAM1323 is therefore inhibition of Single-minded Homolog 1 (Drosophila) (SIM1, Accession NM_005068), a gene which may have pleiotropic effects during embryogenesis and in the adult. Accordingly, utilities of VGAM1323 include diagnosis, prevention and treatment of diseases and clinical conditions associated with SIM1. The function of SIM1 and its association with various diseases and clinical conditions, has been established by previous studies, as described hereinabove with reference to VGAM665. FLJ11383 (Accession NM_024938) is another VGAM1323 host target gene. FLJ11383 BINDING SITE is HOST TARGET binding site found in the 3' untranslated region of mRNA encoded by FLJ11383, corresponding to a HOST TARGET binding site such as BINDING SITE I, BINDING SITE II or BINDING SITE III. Table 2 illustrates the complementarity of the nucleotide sequences of FLJ11383 BINDING SITE, designated SEQ ID:24479, to the nucleotide sequence of VGAM1323 RNA, herein designated VGAM RNA, also designated SEQ ID:4034.

Another function of VGAM1323 is therefore inhibition of FLJ11383 (Accession NM_024938). Accordingly, utilities of VGAM1323 include diagnosis, prevention and treatment of diseases and clinical conditions associated with FLJ11383. KIAA0268 (Accession XM_046126) is another VGAM1323 host target gene. KIAA0268 BINDING SITE is HOST TARGET binding site found in the 3' untranslated region of mRNA encoded by KIAA0268, corresponding to a HOST TARGET binding site such as BINDING SITE I, BINDING SITE II or BINDING SITE III. Table 2 illustrates the complementarity of the nucleotide sequences of KIAA0268 BINDING SITE, designated SEQ ID:34686, to the nucleotide sequence of VGAM1323 RNA, herein designated VGAM RNA, also designated SEQ ID:4034.

Another function of VGAM1323 is therefore inhibition of KIAA0268 (Accession XM_046126). Accordingly, utilities of VGAM1323 include diagnosis, prevention and treatment of diseases and clinical conditions associated with KIAA0268. KIAA0416 (Accession NM_015564) is another VGAM1323 host target gene. KIAA0416 BINDING SITE is HOST TARGET binding site found in the 3' untranslated region of mRNA encoded by KIAA0416, corresponding to a HOST TARGET binding site such as BINDING SITE I, BINDING SITE II or BINDING SITE III. Table 2 illustrates the complementarity of the nucleotide sequences of KIAA0416 BINDING SITE, designated SEQ ID:17838, to the nucleotide sequence of VGAM1323 RNA, herein designated VGAM RNA, also designated SEQ ID:4034.

Another function of VGAM1323 is therefore inhibition of KIAA0416 (Accession NM_015564). Accordingly, utilities of VGAM1323 include diagnosis, prevention and treatment of diseases and clinical conditions associated with KIAA0416. KIAA0836 (Accession XM_035390) is another VGAM1323 host target gene. KIAA0836 BINDING SITE is HOST TARGET binding site found in the 3' untranslated region of mRNA encoded by KIAA0836, corresponding to a HOST TARGET binding site such as BINDING SITE I, BINDING SITE II or BINDING SITE III. Table 2 illustrates the complementarity of the nucleotide sequences of KIAA0836 BINDING SITE, designated SEQ ID:32244, to the nucleotide sequence of VGAM1323 RNA, herein designated VGAM RNA, also designated SEQ ID:4034.

Another function of VGAM1323 is therefore inhibition of KIAA0836 (Accession XM_035390). Accordingly, utilities of VGAM1323 include diagnosis, prevention and treatment of diseases and clinical conditions associated with KIAA0836. KIAA0884 (Accession XM_046660) is another VGAM1323 host target gene. KIAA0884 BINDING SITE is HOST TARGET binding site found in the 5' untranslated region of mRNA encoded by KIAA0884, corresponding to a HOST TARGET binding site such as BINDING SITE I, BINDING SITE II or BINDING SITE III. Table 2 illustrates the complementarity of the nucleotide sequences of KIAA0884 BINDING SITE, designated SEQ ID:34774, to the nucleotide sequence of VGAM1323 RNA, herein designated VGAM RNA, also designated SEQ ID:4034.

Another function of VGAM1323 is therefore inhibition of KIAA0884 (Accession XM_046660). Accordingly, utilities of VGAM1323 include diagnosis, prevention and treatment of diseases and clinical conditions associated with KIAA0884. SMOC1 (Accession NM_022137) is another VGAM1323 host target gene. SMOC1 BINDING SITE is HOST TARGET binding site found in the 3' untranslated region of mRNA encoded by SMOC1, corresponding to a HOST TARGET binding site such as BINDING SITE I, BINDING SITE II or BINDING SITE III. Table 2 illustrates the complementarity of the nucleotide sequences of SMOC1 BINDING SITE, designated SEQ ID:22699, to the nucleotide sequence of VGAM1323 RNA, herein designated VGAM RNA, also designated SEQ ID:4034.

Another function of VGAM1323 is therefore inhibition of SMOC1 (Accession NM_022137). Accordingly, utilities of VGAM1323 include diagnosis, prevention and treatment of diseases and clinical conditions associated with SMOC1. LOC115399 (Accession XM_055874) is another VGAM1323 host target gene. LOC115399 BINDING SITE is HOST TARGET binding site found in the 3' untranslated region of mRNA encoded by LOC115399, corresponding to a HOST TARGET binding site such as BINDING SITE I, BINDING SITE II or BINDING SITE III. Table 2 illustrates the complementarity of the nucleotide sequences of LOC115399 BINDING SITE, designated SEQ ID:36343, to the nucleotide sequence of VGAM1323 RNA, herein designated VGAM RNA, also designated SEQ ID:4034.

Another function of VGAM1323 is therefore inhibition of LOC115399 (Accession XM_055874). Accordingly, utilities of VGAM1323 include diagnosis, prevention and treatment of diseases and clinical conditions associated with LOC115399. LOC116236 (Accession XM_057674) is another VGAM1323 host target gene. LOC116236 BINDING SITE is HOST TARGET binding site found in the 3' untranslated region of mRNA encoded by LOC116236, corresponding to a HOST TARGET binding site such as BINDING SITE I, BINDING SITE II or BINDING SITE III. Table 2 illustrates the complementarity of the nucleotide sequences of LOC116236 BINDING SITE, designated SEQ ID:36543, to the nucleotide sequence of VGAM1323 RNA, herein designated VGAM RNA, also designated SEQ ID:4034.

Another function of VGAM1323 is therefore inhibition of LOC116236 (Accession XM_057674). Accordingly, utilities of VGAM1323 include diagnosis, prevention and treatment of diseases and clinical conditions associated with LOC116236. FIG. 1 further provides a conceptual description of a novel bioinformatically detected viral gene of the present invention, referred to here as Viral Genomic Address Messenger 1324 (VGAM1324) viral gene, which modulates expression of respective host target genes thereof, the function and utility of which host target genes is known in the art.

VGAM1324 is a novel bioinformatically detected regulatory, non protein coding, viral micro RNA (miRNA) gene. The method by which VGAM1324 was detected is described hereinabove with reference to FIGS. 1-8.

VGAM1324 gene, herein designated VGAM GENE, is a viral gene contained in the genome of Garlic Latent Virus. VGAM1324 host target gene, herein designated VGAM HOST TARGET GENE, is a human gene contained in the human genome.

VGAM1324 gene encodes a VGAM1324 precursor RNA, herein designated VGAM PRECURSOR RNA. Similar to other miRNA genes, and unlike most ordinary genes, VGAM1324 precursor RNA does not encode a protein. A nucleotide sequence identical or highly similar to the nucleotide sequence of VGAM1324 precursor RNA is designated SEQ ID:1310, and is provided hereinbelow with reference to the sequence listing part. Nucleotide sequence SEQ ID:1310 is located at position 4855 relative to the genome of Garlic Latent Virus.

VGAM1324 precursor RNA folds onto itself, forming VGAM1324 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1324 folded precursor RNA into VGAM1324 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM1324 RNA is designated SEQ ID:4035, and is provided hereinbelow with reference to the sequence listing part.

VGAM1324 host target gene, herein designated VGAM HOST TARGET GENE, encodes a corresponding messenger RNA, VGAM1324 host target RNA, herein designated VGAM HOST TARGET RNA. VGAM1324 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1324 RNA, herein designated VGAM RNA, binds complementarily to one or more host target binding sites located in untranslated regions of VGAM1324 host target RNA, herein designated VGAM HOST TARGET RNA. This complementary binding is due to the fact that the nucleotide sequence of VGAM1324 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1324 RNA, herein designated VGAM RNA, may have a different number of host target binding sites in untranslated regions of a VGAM1324 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1324 RNA, herein designated VGAM RNA, to host target binding sites on VGAM1324 host target RNA, herein designated VGAM HOST TARGET RNA, such as BINDING SITE I, BINDING SITE II and BINDING SITE III, inhibits translation of VGAM1324 host target RNA into VGAM1324 host target protein, herein designated VGAM HOST TARGET PROTEIN. VGAM host target protein is therefore outlined by a broken line.

It is appreciated that VGAM1324 host target gene, herein designated VGAM HOST TARGET GENE, in fact represents a plurality of VGAM1324 host target genes. The mRNA of each one of this plurality of VGAM1324 host target genes comprises one or more host target binding sites, each having a nucleotide sequence which is at least partly complementary to VGAM1324 RNA, herein designated VGAM RNA, and which when bound by VGAM1324 RNA causes inhibition of translation of respective one or more VGAM1324 host target proteins.

It is further appreciated by one skilled in the art that the mode of translational inhibition illustrated by FIG. 1 with specific reference to translational inhibition exerted by VGAM1324 gene, herein designated VGAM GENE, on one or more VGAM1324 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1324 is inhibition of expression of host target genes, as part of a novel viral mechanism of attacking a host. Accordingly, utilities of VGAM1324 include diagnosis, prevention and treatment of viral infection by Garlic Latent Virus. Specific functions, and accordingly utilities, of VGAM1324 correlate with, and may be deduced from, the identity of the host target genes which VGAM1324 binds and inhibits, and the function of these host target genes, as elaborated hereinbelow.

Nucleotide sequences of the VGAM1324 precursor RNA, herein designated VGAM PRECURSOR RNA, and of the 'diced' VGAM1324 RNA, herein designated VGAM RNA, and a schematic representation of the secondary folding of VGAM1324 folded precursor RNA, herein designated VGAM FOLDED PRECURSOR RNA, of VGAM1324 are further described hereinbelow with reference to Table 1.

Nucleotide sequences of host target binding sites, such as BINDING SITE-I, BINDING SITE-II and BINDING SITE-III of FIG. 1, found on VGAM1324 host target RNA, and schematic representation of the complementarity of each of these host target binding sites to VGAM1324 RNA, herein designated VGAM RNA, are described hereinbelow with reference to Table 2.

As mentioned hereinabove with reference to FIG. 1, a function of VGAM1324 gene, herein designated VGAM is inhibition of expression of VGAM1324 target genes. It is appreciated that specific functions, and accordingly utilities, of VGAM1324 correlate with, and may be deduced from, the identity of the target genes which VGAM1324 binds and inhibits, and the function of these target genes, as elaborated hereinbelow.

Chemokine (C-C motif) Receptor 9 (CCR9, Accession NM_006641) is a VGAM1324 host target gene. CCR9 BINDING SITE1 and CCR9 BINDING SITE2 are HOST TARGET binding sites found in untranslated regions of mRNA encoded by CCR9, corresponding to HOST TARGET binding sites such as BINDING SITE I, BINDING SITE II or BINDING SITE III. Table 2 illustrates the complementarity of the nucleotide sequences of CCR9 BINDING SITE1 and CCR9 BINDING SITE2, designated SEQ ID:13433 and SEQ ID:25250 respectively, to the nucleotide sequence of VGAM1324 RNA, herein designated VGAM RNA, also designated SEQ ID:4035.

A function of VGAM1324 is therefore inhibition of Chemokine (C-C motif) Receptor 9 (CCR9, Accession NM_006641), a gene which binds beta-chemokine family and subsequently transduces a signal by increasing the intracellular calcium ions level. Accordingly, utilities of VGAM1324 include diagnosis, prevention and treatment of diseases and clinical conditions associated with CCR9. The function of CCR9 has been established by previous studies. Chemokines are small peptides involved in the chemotaxis and activation of leukocytes in response to inflammation, tissue damage, or infection. Chemokine receptors belong to the superfamily of G protein-coupled receptors. See CMKBR1 (OMIM Ref. No. 601159) for background. Nibbs et al. (1997) stated that they had previously identified the mouse cysteine-cysteine (C-C) chemokine receptor D6. To identify the human homolog of D6, they performed PCR on human genomic DNA using primers based on the sequence of the mouse D6 gene. The human D6 gene encodes a predicted 384-amino acid protein that contains the characteristic 7 transmembrane domains and 4 conserved cysteine residues of chemokine receptors. The human and mouse D6 proteins share 71% amino acid identity. By Northern blot analysis, human D6 is expressed as approximately 4- and 6-kb transcripts in several tissues, with the highest expression in placenta. Although human D6 binds with relatively high-affinity to the majority of members of the beta-chemokine family (for example, MCP2; 602283), Nibbs et al. (1997) were unable to demonstrate any signaling following the ligand binding. Therefore, the International Union of Pharmacology (OMIM Ref. No. IUPHAR) proposed that the human D6 receptor be designated ccr9, with the lower cases indicating that receptor function has not been demonstrated. Bonini et al. (1997) cloned a cDNA encoding CMKBR9, which they called CCR10 because it is homologous to rat 'Ccr10-related receptor' (Ccr10rR). The CMKBR9 and rat Ccr10rR proteins have 72% amino acid identity. By PCR of a radiation hybrid panel, Bonini et al. (1997) mapped the CMKBR9 (CCBP2) gene to 3p21.32-p21.31, a region containing other C-C chemokine receptor genes such as CMKBR1, CMKBR2 (OMIM Ref. No. 601267), CMKBR3 (OMIM Ref. No. 601268), and CMKBR5 (OMIM Ref. No. 601373). By radiation hybrid analysis and organization of BAC contigs by FISH on combed genomic DNA, Maho et al. (1999) localized the CCBP2 gene within the CCR cluster at 3p21.3.

Full details of the abovementioned studies are described in the following publications, the disclosure of which are hereby incorporated by reference:

Nibbs, R. J. B.; Wylie, S. M.; Yang, J.; Landau, N. R.; Graham, G. J.: Cloning and characterization of a novel promiscuous human beta-chemokine receptor D6. J. Biol. Chem. 272:32078-32083, 1997; and Bonini, J. A.; Martin, S. K.; Dralyuk, F.; Roe, M. W.; Philipson, L. H.; Steiner, D. F.: Cloning, expression, and chromosomal mapping of a novel human CC-chemokine receptor (CCR10) that.

Further studies establishing the function and utilities of CCR9 are found in John Hopkins OMIM database record ID 602648, and in sited publications numbered 858 and 8586 listed in the bibliography section hereinbelow, which are also hereby incorporated by reference. Collagen, Type XVII, Alpha 1 (COL17A1, Accession NM_000494) is another VGAM1324 host target gene. COL17A1 BINDING SITE1 and COL17A1 BINDING SITE2 are HOST TARGET binding sites found in untranslated regions of mRNA encoded by COL17A1, corresponding to HOST TARGET binding sites such as BINDING SITE I, BINDING SITE II or BINDING SITE III. Table 2 illustrates the complementarity of the nucleotide sequences of COL17A1 BINDING SITE1 and COL17A1 BINDING SITE2, designated SEQ ID:6107 and SEQ ID:10613 respectively, to the nucleotide sequence of VGAM1324 RNA, herein designated VGAM RNA, also designated SEQ ID:4035.

Another function of VGAM1324 is therefore inhibition of Collagen, Type XVII, Alpha 1 (COL17A1, Accession NM_000494). Accordingly, utilities of VGAM1324 include diagnosis, prevention and treatment of diseases and clinical conditions associated with COL17A1. Diacylglycerol Kinase, Iota (DGKI, Accession NM_004717) is another VGAM1324 host target gene. DGKI BINDING SITE is HOST TARGET binding site found in the 3' untranslated region of mRNA encoded by DGKI, corresponding to a HOST TARGET binding site such as BINDING SITE I, BINDING SITE II or BINDING SITE III. Table 2 illustrates the complementarity of the nucleotide sequences of DGKI BINDING SITE, designated SEQ ID:11080, to the nucleotide sequence of VGAM1324 RNA, herein designated VGAM RNA, also designated SEQ ID:4035.

Another function of VGAM1324 is therefore inhibition of Diacylglycerol Kinase, Iota (DGKI, Accession NM_004717), a gene which regulates the intracellular concentration of the second messenger diacylglycerol (DAG). Accordingly, utilities of VGAM1324 include diagnosis, prevention and treatment of diseases and clinical conditions associated with DGKI. The function of DGKI and its association with various diseases and clinical conditions, has been established by previous studies, as described hereinabove with reference to VGAM1107. Hermansky-Pudlak Syndrome 1 (HPS1, Accession NM_000195) is another VGAM1324 host target gene. HPS1 BINDING SITE is HOST TARGET binding site found in the 3' untranslated region of mRNA encoded by HPS1, corresponding to a HOST TARGET binding site such as BINDING SITE I, BINDING SITE II or BINDING SITE III. Table 2 illustrates the complementarity of the nucleotide sequences of HPS1 BINDING SITE, designated SEQ ID:5695, to the nucleotide sequence of VGAM1324 RNA, herein designated VGAM RNA, also designated SEQ ID:4035.

Another function of VGAM1324 is therefore inhibition of Hermansky-Pudlak Syndrome 1 (HPS1, Accession NM_000195). Accordingly, utilities of VGAM1324 include diagnosis, prevention and treatment of diseases and clinical conditions associated with HPS1. Heparan Sulfate 2-O-sulfotransferase 1 (HS2ST1, Accession NM_012262) is another VGAM1324 host target gene. HS2ST1 BINDING SITE is HOST TARGET binding site found in the 3' untranslated region of mRNA encoded by HS2ST1, corresponding to a HOST TARGET binding site such as BINDING SITE I, BINDING SITE II or BINDING SITE III. Table 2 illustrates the complementarity of the nucleotide sequences of HS2ST1 BINDING SITE, designated SEQ ID:14579, to the nucleotide sequence of VGAM1324 RNA, herein designated VGAM RNA, also designated SEQ ID:4035.

Another function of VGAM1324 is therefore inhibition of Heparan Sulfate 2-O-sulfotransferase 1 (HS2ST1, Accession NM_012262). Accordingly, utilities of VGAM1324 include diagnosis, prevention and treatment of diseases and clinical conditions associated with HS2ST1. Mitogen-activated Protein Kinase Kinase Kinase 7 Interacting Protein 2 (MAP3K7IP2, Accession NM_015093) is another VGAM1324 host target gene. MAP3K7IP2 BINDING SITE is HOST TARGET binding site found in the 3' untranslated region of mRNA encoded by MAP3K7IP2, corresponding to a HOST TARGET binding site such as BINDING SITE I, BINDING SITE II or BINDING SITE III. Table 2 illustrates the complementarity of the nucleotide sequences of MAP3K7IP2 BINDING SITE, designated SEQ ID:17485, to the nucleotide sequence of VGAM1324 RNA, herein designated VGAM RNA, also designated SEQ ID:4035.

Another function of VGAM1324 is therefore inhibition of Mitogen-activated Protein Kinase Kinase Kinase 7 Interacting Protein 2 (MAP3K7IP2, Accession NM_015093). Accordingly, utilities of VGAM1324 include diagnosis, prevention and treatment of diseases and clinical conditions associated with MAP3K7IP2. Mannosyl (alpha-1,6-)-glycoprotein Beta-1,6-N-acetyl-glucosaminyltransferase (MGAT5, Accession NM_002410) is another VGAM1324 host target gene. MGAT5 BINDING SITE is HOST TARGET binding site found in the 5' untranslated region of mRNA encoded by MGAT5, corresponding to a HOST TARGET binding site such as BINDING SITE I, BINDING SITE II or BINDING SITE III. Table 2 illustrates the complementarity of the nucleotide sequences of MGAT5 BINDING SITE, designated SEQ ID:8241, to the nucleotide sequence of VGAM1324 RNA, herein designated VGAM RNA, also designated SEQ ID:4035.

Another function of VGAM1324 is therefore inhibition of Mannosyl (alpha-1,6-)-glycoprotein Beta-1,6-N-acetyl-glucosaminyltransferase (MGAT5, Accession NM_002410). Accordingly, utilities of VGAM1324 include diagnosis, prevention and treatment of diseases and clinical conditions associated with MGAT5. 8-oxoguanine DNA Glycosylase (OGG1, Accession NM_002542) is another VGAM1324 host target gene. OGG1 BINDING SITE1 through OGG1 BINDING SITE3 are HOST TARGET binding sites found in untranslated regions of mRNA encoded by OGG1, corresponding to HOST TARGET binding sites such as BINDING SITE I, BINDING SITE II or BINDING SITE III. Table 2 illustrates the complementarity of the nucleotide sequences of OGG1 BINDING SITE1 through OGG1 BINDING SITE3, designated SEQ ID:8391, SEQ ID:18808 and SEQ ID:18813 respectively, to the nucleotide sequence of VGAM1324 RNA, herein designated VGAM RNA, also designated SEQ ID:4035.

Another function of VGAM1324 is therefore inhibition of 8-oxoguanine DNA Glycosylase (OGG1, Accession NM_002542), a gene which is involved in base excision DNA repair and removal of 8-oxyguanine. Accordingly, utilities of VGAM1324 include diagnosis, prevention and treatment of diseases and clinical conditions associated with OGG1. The function of OGG1 and its association with various diseases and clinical conditions, has been established by previous studies, as described hereinabove with reference to VGAM390. Protein Phosphatase 1, Regulatory (inhibitor) Subunit 12A (PPP1R12A, Accession NM_002480) is another VGAM1324 host target gene. PPP1R12A BINDING SITE is HOST TARGET binding site found in the 3' untranslated region of mRNA encoded by PPP1R12A, corresponding to a HOST TARGET binding site such as BINDING SITE I, BINDING SITE II or BINDING SITE III. Table 2 illustrates the complementarity of the nucleotide sequences of PPP1R12A BINDING SITE, designated SEQ ID:8306, to the nucleotide sequence of VGAM1324 RNA, herein designated VGAM RNA, also designated SEQ ID:4035.

Another function of VGAM1324 is therefore inhibition of Protein Phosphatase 1, Regulatory (inhibitor) Subunit 12A (PPP1R12A, Accession NM_002480), a gene which regulates the interaction of actin and myosin. Accordingly, utilities of VGAM1324 include diagnosis, prevention and treatment of diseases and clinical conditions associated with PPP1R12A. The function of PPP1R12A and its association with various diseases and clinical conditions, has been established by previous studies, as described hereinabove with reference to VGAM838. Protein Kinase, CGMP-dependent, Type II (PRKG2, Accession NM_006259) is another VGAM1324 host target gene. PRKG2 BINDING SITE is HOST TARGET binding site found in the 3' untranslated region of mRNA encoded by PRKG2, corresponding to a HOST TARGET binding site such as BINDING SITE I, BINDING SITE II or BINDING SITE III. Table 2 illustrates the complementarity of the nucleotide sequences of PRKG2 BINDING SITE, designated SEQ ID:12941, to the nucleotide sequence of VGAM1324 RNA, herein designated VGAM RNA, also designated SEQ ID:4035.

Another function of VGAM1324 is therefore inhibition of Protein Kinase, CGMP-dependent, Type II (PRKG2, Accession NM_006259), a gene which regulate a great variety of functions, including smooth muscle relaxation, neuronal excitability, and epithelial electrolyte transport. Accordingly, utilities of VGAM1324 include diagnosis, prevention and treatment of diseases and clinical conditions associated with PRKG2. The function of PRKG2 and its association with various diseases and clinical conditions, has been established by previous studies, as described hereinabove with reference to VGAM16. TEM6 (Accession NM_022748) is another VGAM1324 host target gene. TEM6 BINDING SITE is HOST TARGET binding site found in the 3' untranslated region of mRNA encoded by TEM6, corresponding to a HOST TARGET binding site such as BINDING SITE I, BINDING SITE II or BINDING SITE III. Table 2 illustrates the complementarity of the nucleotide sequences of TEM6 BINDING SITE, designated SEQ ID:22965, to the nucleotide sequence of VGAM1324 RNA, herein designated VGAM RNA, also designated SEQ ID:4035.

Another function of VGAM1324 is therefore inhibition of TEM6 (Accession NM_022748), a gene which displayes elevated expression during tumor angiogenesis. Accordingly, utilities of VGAM1324 include diagnosis, prevention and treatment of diseases and clinical conditions associated with TEM6. The function of TEM6 and its association with various diseases and clinical conditions, has been established by previous studies, as described hereinabove with reference to VGAM175. BCoR (Accession NM_017745) is another VGAM1324 host target gene. BCoR BINDING SITE is HOST TARGET binding site found in the 3' untranslated region of mRNA encoded by BCoR, corresponding to a HOST TARGET binding site such as BINDING SITE I, BINDING SITE II or BINDING SITE III. Table 2 illustrates the complementarity of the nucleotide sequences of BCoR BINDING SITE, designated SEQ ID:19339, to the nucleotide sequence of VGAM1324 RNA, herein designated VGAM RNA, also designated SEQ ID:4035.

Another function of VGAM1324 is therefore inhibition of BCoR (Accession NM_017745). Accordingly, utilities of VGAM1324 include diagnosis, prevention and treatment of diseases and clinical conditions associated with BCoR. Calmegin (CLGN, Accession NM_004362) is another VGAM1324 host target gene. CLGN BINDING SITE is HOST TARGET binding site found in the 3' untranslated region of mRNA encoded by CLGN, corresponding to a HOST TARGET binding site such as BINDING SITE I, BINDING SITE II or BINDING SITE III. Table 2 illustrates the complementarity of the nucleotide sequences of CLGN BINDING SITE, designated SEQ ID:10568, to the nucleotide sequence of VGAM1324 RNA, herein designated VGAM RNA, also designated SEQ ID:4035.

Another function of VGAM1324 is therefore inhibition of Calmegin (CLGN, Accession NM_004362). Accordingly, utilities of VGAM1324 include diagnosis, prevention and treatment of diseases and clinical conditions associated with CLGN. DKFZP564F013 (Accession XM_168479) is another VGAM1324 host target gene. DKFZP564F013 BINDING SITE is HOST TARGET binding site found in the 3' untranslated region of mRNA encoded by DKFZP564F013, corresponding to a HOST TARGET binding site such as BINDING SITE I, BINDING SITE II or BINDING SITE III. Table 2 illustrates the complementarity of the nucleotide sequences of DKFZP564F013 BINDING SITE, designated SEQ ID:45206, to the nucleotide sequence of VGAM1324 RNA, herein designated VGAM RNA, also designated SEQ ID:4035.

Another function of VGAM1324 is therefore inhibition of DKFZP564F013 (Accession XM_168479). Accordingly, utilities of VGAM1324 include diagnosis, prevention and treatment of diseases and clinical conditions associated with DKFZP564F013. DKFZp761F2014 (Accession NM_020215) is another VGAM1324 host target gene. DKFZp761F2014 BINDING SITE is HOST TARGET binding site found in the 3' untranslated region of mRNA encoded by DKFZp761F2014, corresponding to a HOST TARGET binding site such as BINDING SITE I, BINDING SITE II or BINDING SITE III. Table 2 illustrates the complementarity of the nucleotide sequences of DKFZp761F2014 BINDING SITE, designated SEQ ID:21465, to the nucleotide sequence of VGAM1324 RNA, herein designated VGAM RNA, also designated SEQ ID:4035.

Another function of VGAM1324 is therefore inhibition of DKFZp761F2014 (Accession NM_020215). Accordingly, utilities of VGAM1324 include diagnosis, prevention and treatment of diseases and clinical conditions associated with DKFZp761F2014. FLJ10738 (Accession NM_018199) is another VGAM1324 host target gene. FLJ10738 BINDING SITE is HOST TARGET binding site found in the 3' untranslated region of mRNA encoded by FLJ10738, corresponding to a HOST TARGET binding site such as BINDING SITE I, BINDING SITE II or BINDING SITE III. Table 2 illustrates the complementarity of the nucleotide sequences of FLJ10738 BINDING SITE, designated SEQ ID:20069, to the nucleotide sequence of VGAM1324 RNA, herein designated VGAM RNA, also designated SEQ ID:4035.

Another function of VGAM1324 is therefore inhibition of FLJ10738 (Accession NM_018199). Accordingly, utilities of VGAM1324 include diagnosis, prevention and treatment of diseases and clinical conditions associated with FLJ10738. FLJ13962 (Accession NM_024862) is another VGAM1324 host target gene. FLJ13962 BINDING SITE is HOST TARGET binding site found in the 3' untranslated region of mRNA encoded by FLJ13962, corresponding to a HOST TARGET binding site such as BINDING SITE I, BINDING SITE II or BINDING SITE III. Table 2 illustrates the complementarity of the nucleotide sequences of FLJ13962 BINDING SITE, designated SEQ ID:24297, to the nucleotide sequence of VGAM1324 RNA, herein designated VGAM RNA, also designated SEQ ID:4035.

Another function of VGAM1324 is therefore inhibition of FLJ13962 (Accession NM_024862). Accordingly, utilities of VGAM1324 include diagnosis, prevention and treatment of diseases and clinical conditions associated with FLJ13962. FLJ14621 (Accession NM_032811) is another VGAM1324 host target gene. FLJ14621 BINDING SITE is HOST TARGET binding site found in the 5' untranslated region of mRNA encoded by FLJ14621, corresponding to a HOST TARGET binding site such as BINDING SITE I, BINDING SITE II or BINDING SITE III. Table 2 illustrates the complementarity of the nucleotide sequences of FLJ14621 BINDING SITE, designated SEQ ID:26584, to the nucleotide sequence of VGAM1324 RNA, herein designated VGAM RNA, also designated SEQ ID:4035.

Another function of VGAM1324 is therefore inhibition of FLJ14621 (Accession NM_032811). Accordingly, utilities of VGAM1324 include diagnosis, prevention and treatment of diseases and clinical conditions associated with FLJ14621. FLJ20275 (Accession NM_017737) is another VGAM1324 host target gene. FLJ20275 BINDING SITE is HOST TARGET binding site found in the 3' untranslated region of mRNA encoded by FLJ20275, corresponding to a HOST TARGET binding site such as BINDING SITE I, BINDING SITE II or BINDING SITE III. Table 2 illustrates the complementarity of the nucleotide sequences of FLJ20275 BINDING SITE, designated SEQ ID:19324, to the nucleotide sequence of VGAM1324 RNA, herein designated VGAM RNA, also designated SEQ ID:4035.

Another function of VGAM1324 is therefore inhibition of FLJ20275 (Accession NM_017737). Accordingly, utilities of VGAM1324 include diagnosis, prevention and treatment of diseases and clinical conditions associated with FLJ20275. KIAA1013 (Accession XM_114303) is another VGAM1324 host target gene. KIAA1013 BINDING SITE is HOST TARGET binding site found in the 3' untranslated region of mRNA encoded by KIAA1013, corresponding to a HOST TARGET binding site such as BINDING SITE I, BINDING SITE II or BINDING SITE III. Table 2 illustrates the complementarity of the nucleotide sequences of KIAA1013 BINDING SITE, designated SEQ ID:42858, to the nucleotide sequence of VGAM1324 RNA, herein designated VGAM RNA, also designated SEQ ID:4035.

Another function of VGAM1324 is therefore inhibition of KIAA1013 (Accession XM_114303). Accordingly, utilities of VGAM1324 include diagnosis, prevention and treatment of diseases and clinical conditions associated with KIAA1013. KIAA1028 (Accession XM_166324) is another VGAM1324 host target gene. KIAA1028 BINDING SITE is HOST TARGET binding site found in the 3' untranslated region of mRNA encoded by KIAA1028, corresponding to a HOST TARGET binding site such as BINDING SITE I, BINDING SITE II or BINDING SITE III. Table 2 illustrates the complementarity of the nucleotide sequences of KIAA1028 BINDING SITE, designated SEQ ID:44165, to the nucleotide sequence of VGAM1324 RNA, herein designated VGAM RNA, also designated SEQ ID:4035.

Another function of VGAM1324 is therefore inhibition of KIAA1028 (Accession XM_166324). Accordingly, utilities of VGAM1324 include diagnosis, prevention and treatment of diseases and clinical conditions associated with KIAA1028. KIAA1254 (Accession XM_046132) is another VGAM1324 host target gene. KIAA1254 BINDING SITE is HOST TARGET binding site found in the 3' untranslated region of mRNA encoded by KIAA1254, corresponding to a HOST TARGET binding site such as BINDING SITE I, BINDING SITE II or BINDING SITE III. Table 2 illustrates the complementarity of the nucleotide sequences of KIAA1254 BINDING SITE, designated SEQ ID:34700, to the nucleotide sequence of VGAM1324 RNA, herein designated VGAM RNA, also designated SEQ ID:4035.

Another function of VGAM1324 is therefore inhibition of KIAA1254 (Accession XM_046132). Accordingly, utilities of VGAM1324 include diagnosis, prevention and treatment of diseases and clinical conditions associated with KIAA1254. MGC16175 (Accession NM_032765) is another VGAM1324 host target gene. MGC16175 BINDING SITE is HOST TARGET binding site found in the 5' untranslated region of mRNA encoded by MGC16175, corresponding to a HOST TARGET binding site such as BINDING SITE I, BINDING SITE II or BINDING SITE III. Table 2 illustrates the complementarity of the nucleotide sequences of MGC16175 BINDING SITE, designated SEQ ID:26512, to the nucleotide sequence of VGAM1324 RNA, herein designated VGAM RNA, also designated SEQ ID:4035.

Another function of VGAM1324 is therefore inhibition of MGC16175 (Accession NM_032765). Accordingly, utilities of VGAM1324 include diagnosis, prevention and treatment of diseases and clinical conditions associated with MGC16175. Neurexophilin 3 (NXPH3, Accession XM_037847) is another VGAM1324 host target gene. NXPH3 BINDING SITE is HOST TARGET binding site found in the 3' untranslated region of mRNA encoded by NXPH3, corresponding to a HOST TARGET binding site such as BINDING SITE I, BINDING SITE II or BINDING SITE III. Table 2 illustrates the complementarity of the nucleotide sequences of NXPH3 BINDING SITE, designated SEQ ID:32722, to the nucleotide sequence of VGAM1324 RNA, herein designated VGAM RNA, also designated SEQ ID:4035.

Another function of VGAM1324 is therefore inhibition of Neurexophilin 3 (NXPH3, Accession XM_037847). Accordingly, utilities of VGAM1324 include diagnosis, prevention and treatment of diseases and clinical conditions associated with NXPH3. Ring Finger Protein 38 (RNF38, Accession NM_022781) is another VGAM1324 host target gene. RNF38 BINDING SITE is HOST TARGET binding site found in the 3' untranslated region of mRNA encoded by RNF38, corresponding to a HOST TARGET binding site such as BINDING SITE I, BINDING SITE II or BINDING SITE III. Table 2 illustrates the complementarity of the nucleotide sequences of RNF38 BINDING SITE, designated SEQ ID:23061, to the nucleotide sequence of VGAM1324 RNA, herein designated VGAM RNA, also designated SEQ ID:4035.

Another function of VGAM1324 is therefore inhibition of Ring Finger Protein 38 (RNF38, Accession NM_022781). Accordingly, utilities of VGAM1324 include diagnosis, prevention and treatment of diseases and clinical conditions associated with RNF38. SP329 (Accession NM_030793) is another VGAM1324 host target gene. SP329 BINDING SITE is HOST TARGET binding site found in the 5' untranslated region of mRNA encoded by SP329, corresponding to a HOST TARGET binding site such as BINDING SITE I, BINDING SITE II or BINDING SITE III. Table 2 illustrates the complementarity of the nucleotide sequences of SP329 BINDING SITE, designated SEQ ID:25098, to the nucleotide sequence of VGAM1324 RNA, herein designated VGAM RNA, also designated SEQ ID:4035.

Another function of VGAM1324 is therefore inhibition of SP329 (Accession NM_030793). Accordingly, utilities of VGAM1324 include diagnosis, prevention and treatment of diseases and clinical conditions associated with SP329. LOC145195 (Accession XM_096731) is another VGAM1324 host target gene. LOC145195 BINDING SITE is HOST TARGET binding site found in the 3' untranslated region of mRNA encoded by LOC145195, corresponding to a HOST TARGET binding site such as BINDING SITE I, BINDING SITE II or BINDING SITE III. Table 2 illustrates the complementarity of the nucleotide sequences of LOC145195 BINDING SITE, designated SEQ ID:40517, to the nucleotide sequence of VGAM1324 RNA, herein designated VGAM RNA, also designated SEQ ID:4035.

Another function of VGAM1324 is therefore inhibition of LOC145195 (Accession XM_096731). Accordingly, utilities of VGAM1324 include diagnosis, prevention and treatment of diseases and clinical conditions associated with LOC145195. LOC145900 (Accession XM_085276) is another VGAM1324 host target gene. LOC145900 BINDING SITE is HOST TARGET binding site found in the 5' untranslated region of mRNA encoded by LOC145900, corresponding to a HOST TARGET binding site such as BINDING SITE I, BINDING SITE II or BINDING SITE III. Table 2 illustrates the complementarity of the nucleotide sequences of LOC145900 BINDING SITE, designated SEQ ID:38011, to the nucleotide sequence of VGAM1324 RNA, herein designated VGAM RNA, also designated SEQ ID:4035.

Another function of VGAM1324 is therefore inhibition of LOC145900 (Accession XM_085276). Accordingly, utilities of VGAM1324 include diagnosis, prevention and treatment of diseases and clinical conditions associated with LOC145900. LOC149372 (Accession XM_086509) is another VGAM1324 host target gene. LOC149372 BINDING SITE is HOST TARGET binding site found in the 5' untranslated region of mRNA encoded by LOC149372, corresponding to a HOST TARGET binding site such as BINDING SITE I, BINDING SITE II or BINDING SITE III. Table 2 illustrates the complementarity of the nucleotide sequences of LOC149372 BINDING SITE, designated SEQ ID:38733, to the nucleotide sequence of VGAM1324 RNA, herein designated VGAM RNA, also designated SEQ ID:4035.

Another function of VGAM1324 is therefore inhibition of LOC149372 (Accession XM_086509). Accordingly, utilities of VGAM1324 include diagnosis, prevention and treatment of diseases and clinical conditions associated with LOC149372. LOC153146 (Accession XM_098319) is another VGAM1324 host target gene. LOC153146 BINDING SITE is HOST TARGET binding site found in the 3' untranslated region of mRNA encoded by LOC153146, corresponding to a HOST TARGET binding site such as BINDING SITE I, BINDING SITE II or BINDING SITE III. Table 2 illustrates the complementarity of the nucleotide sequences of LOC153146 BINDING SITE, designated SEQ ID:41576, to the nucleotide sequence of VGAM1324 RNA, herein designated VGAM RNA, also designated SEQ ID:4035.

Another function of VGAM1324 is therefore inhibition of LOC153146 (Accession XM_098319). Accordingly, utilities of VGAM1324 include diagnosis, prevention and treatment of diseases and clinical conditions associated with LOC153146. LOC203378 (Accession XM_117541) is another VGAM1324 host target gene. LOC203378 BINDING SITE is HOST TARGET binding site found in the 3' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43547, to the nucleotide sequence of VGAM1324 RNA, herein designated VGAM RNA, also designated SEQ ID:4035.

Another function of VGAM1324 is therefore inhibition of LOC203378 (Accession XM_117541). Accordingly, utilities of VGAM1324 include diagnosis, prevention and treatment of diseases and clinical conditions associated with LOC203378. LOC254778 (Accession XM_171193) is another VGAM1324 host target gene. LOC254778 BINDING SITE is HOST TARGET binding site found in the 3' untranslated region of mRNA encoded by LOC254778, corresponding to a HOST TARGET binding site such as BIND- ING SITE I, BINDING SITE II or BINDING SITE III. Table 2 illustrates the complementarity of the nucleotide sequences of LOC254778 BINDING SITE, designated SEQ ID:45976, to the nucleotide sequence of VGAM1324 RNA, herein designated VGAM RNA, also designated SEQ ID:4035.

Another function of VGAM1324 is therefore inhibition of LOC254778 (Accession XM_171193). Accordingly, utilities of VGAM1324 include diagnosis, prevention and treatment of diseases and clinical conditions associated with LOC254778. LOC254936 (Accession XM_170770) is another VGAM1324 host target gene. LOC254936 BINDING SITE is HOST TARGET binding site found in the 5' untranslated region of mRNA encoded by LOC254936, corresponding to a HOST TARGET binding site such as BINDING SITE I, BINDING SITE II or BINDING SITE III. Table 2 illustrates the complementarity of the nucleotide sequences of LOC254936 BINDING SITE, designated SEQ ID:45526, to the nucleotide sequence of VGAM1324 RNA, herein designated VGAM RNA, also designated SEQ ID:4035.

Another function of VGAM1324 is therefore inhibition of LOC254936 (Accession XM_170770). Accordingly, utilities of VGAM1324 include diagnosis, prevention and treatment of diseases and clinical conditions associated with LOC254936. LOC51580 (Accession NM_015874) is another VGAM1324 host target gene. LOC51580 BINDING SITE is HOST TARGET binding site found in the 3' untranslated region of mRNA encoded by LOC51580, corresponding to a HOST TARGET binding site such as BINDING SITE I, BINDING SITE II or BINDING SITE III. Table 2 illustrates the complementarity of the nucleotide sequences of LOC51580 BINDING SITE, designated SEQ ID:18012, to the nucleotide sequence of VGAM1324 RNA, herein designated VGAM RNA, also designated SEQ ID:4035.

Another function of VGAM1324 is therefore inhibition of LOC51580 (Accession NM_015874). Accordingly, utilities of VGAM1324 include diagnosis, prevention and treatment of diseases and clinical conditions associated with LOC51580. LOC90639 (Accession XM_033092) is another VGAM1324 host target gene. LOC90639 BINDING SITE is HOST TARGET binding site found in the 5' untranslated region of mRNA encoded by LOC90639, corresponding to a HOST TARGET binding site such as BINDING SITE I, BINDING SITE II or BINDING SITE III. Table 2 illustrates the complementarity of the nucleotide sequences of LOC90639 BINDING SITE, designated SEQ ID:31833, to the nucleotide sequence of VGAM1324 RNA, herein designated VGAM RNA, also designated SEQ ID:4035.

Another function of VGAM1324 is therefore inhibition of LOC90639 (Accession XM_033092). Accordingly, utilities of VGAM1324 include diagnosis, prevention and treatment of diseases and clinical conditions associated with LOC90639. LOC90777 (Accession XM_034052) is another VGAM1324 host target gene. LOC90777 BINDING SITE is HOST TARGET binding site found in the 3' untranslated region of mRNA encoded by LOC90777, corresponding to a HOST TARGET binding site such as BINDING SITE I, BINDING SITE II or BINDING SITE III. Table 2 illustrates the complementarity of the nucleotide sequences of LOC90777 BINDING SITE, designated SEQ ID:31990, to the nucleotide sequence of VGAM1324 RNA, herein designated VGAM RNA, also designated SEQ ID:4035.

Another function of VGAM1324 is therefore inhibition of LOC90777 (Accession XM_034052). Accordingly, utilities of VGAM1324 include diagnosis, prevention and treatment of diseases and clinical conditions associated with LOC90777. FIG. 1 further provides a conceptual description of a novel bioinformatically detected viral gene of the present invention, referred to here as Viral Genomic Address Messenger 1325 (VGAM1325) viral gene, which modulates expression of respective host target genes thereof, the function and utility of which host target genes is known in the art.

VGAM1325 is a novel bioinformatically detected regulatory, non protein coding, viral micro RNA (miRNA) gene. The method by which VGAM1325 was detected is described hereinabove with reference to FIGS. 1-8.

VGAM1325 gene, herein designated VGAM GENE, is a viral gene contained in the genome of Garlic Latent Virus. VGAM1325 host target gene, herein designated VGAM HOST TARGET GENE, is a human gene contained in the human genome.

VGAM1325 gene encodes a VGAM1325 precursor RNA, herein designated VGAM PRECURSOR RNA. Similar to other miRNA genes, and unlike most ordinary genes, VGAM1325 precursor RNA does not encode a protein. A nucleotide sequence identical or highly similar to the nucleotide sequence of VGAM1325 precursor RNA is designated SEQ ID:1311, and is provided hereinbelow with reference to the sequence listing part. Nucleotide sequence SEQ ID:1311 is located at position 3735 relative to the genome of Garlic Latent Virus.

VGAM1325 precursor RNA folds onto itself, forming VGAM1325 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1325 folded precursor RNA into VGAM1325 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1325 RNA is designated SEQ ID:4036, and is provided hereinbelow with reference to the sequence listing part.

VGAM1325 host target gene, herein designated VGAM HOST TARGET GENE, encodes a corresponding messenger RNA, VGAM1325 host target RNA, herein designated VGAM HOST TARGET RNA. VGAM1325 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1325 RNA, herein designated VGAM RNA, binds complementarily to one or more host target binding sites located in untranslated regions of VGAM1325 host target RNA, herein designated VGAM HOST TARGET RNA. This complementary binding is due to the fact that the nucleotide sequence of VGAM1325 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1325 RNA, herein designated VGAM RNA, may have a different number of host target binding sites in untranslated regions of a VGAM1325 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1325 RNA, herein designated VGAM RNA, to host target binding sites on VGAM1325 host target RNA, herein designated VGAM HOST TARGET RNA, such as BINDING SITE I, BINDING SITE II and BINDING SITE III, inhibits translation of VGAM1325 host target RNA into VGAM1325 host target protein, herein designated VGAM HOST TARGET PROTEIN. VGAM host target protein is therefore outlined by a broken line.

It is appreciated that VGAM1325 host target gene, herein designated VGAM HOST TARGET GENE, in fact represents a plurality of VGAM1325 host target genes. The mRNA of each one of this plurality of VGAM1325 host target genes comprises one or more host target binding sites, each having a nucleotide sequence which is at least partly complementary to VGAM1325 RNA, herein designated VGAM RNA, and which when bound by VGAM1325 RNA causes inhibition of translation of respective one or more VGAM1325 host target proteins.

It is further appreciated by one skilled in the art that the mode of translational inhibition illustrated by FIG. 1 with specific reference to translational inhibition exerted by VGAM1325 gene, herein designated VGAM GENE, on one or more VGAM1325 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1325 is inhibition of expression of host target genes, as part of a novel viral mechanism of attacking a host. Accordingly, utilities of VGAM1325 include diagnosis, prevention and treatment of viral infection by Garlic Latent Virus. Specific functions, and accordingly utilities, of VGAM1325 correlate with, and may be deduced from, the identity of the host target genes which VGAM1325 binds and inhibits, and the function of these host target genes, as elaborated hereinbelow.

Nucleotide sequences of the VGAM1325 precursor RNA, herein designated VGAM PRECURSOR RNA, and of the ‘diced’ VGAM1325 RNA, herein designated VGAM RNA, and a schematic representation of the secondary folding of VGAM1325 folded precursor RNA, herein designated VGAM FOLDED PRECURSOR RNA, of VGAM1325 are further described hereinbelow with reference to Table 1.

Nucleotide sequences of host target binding sites, such as BINDING SITE-I, BINDING SITE-II and BINDING SITE-III of FIG. 1, found on VGAM1325 host target RNA, and schematic representation of the complementarity of each of these host target binding sites to VGAM1325 RNA, herein designated VGAM RNA, are described hereinbelow with reference to Table 2.

As mentioned hereinabove with reference to FIG. 1, a function of VGAM1325 gene, herein designated VGAM is inhibition of expression of VGAM1325 target genes. It is appreciated that specific functions, and accordingly utilities, of VGAM1325 correlate with, and may be deduced from, the identity of the target genes which VGAM1325 binds and inhibits, and the function of these target genes, as elaborated hereinbelow.

Glycoprotein A Repetitions Predominant (GARP, Accession NM_005512) is a VGAM1325 host target gene. GARP BINDING SITE is HOST TARGET binding site found in the 3' untranslated region of mRNA encoded by GARP, corresponding to a HOST TARGET binding site such as BINDING SITE I, BINDING SITE II or BINDING SITE III. Table 2 illustrates the complementarity of the nucleotide sequences of GARP BINDING SITE, designated SEQ ID:12032, to the nucleotide sequence of VGAM1325 RNA, herein designated VGAM RNA, also designated SEQ ID:4036.

A function of VGAM1325 is therefore inhibition of Glycoprotein A Repetitions Predominant (GARP, Accession NM_005512). Accordingly, utilities of VGAM1325 include diagnosis, prevention and treatment of diseases and clinical conditions associated with GARP. Glial Fibrillary Acidic Protein (GFAP, Accession NM_002055) is another VGAM1325 host target gene. GFAP BINDING SITE is HOST TARGET binding site found in the 3' untranslated region of mRNA encoded by GFAP, corresponding to a HOST TARGET binding site such as BINDING SITE I, BINDING SITE II or BINDING SITE III. Table 2 illustrates the complementarity of the nucleotide sequences of GFAP BINDING SITE, designated SEQ ID:7814, to the nucleotide sequence of VGAM1325 RNA, herein designated VGAM RNA, also designated SEQ ID:4036.

Another function of VGAM1325 is therefore inhibition of Glial Fibrillary Acidic Protein (GFAP, Accession NM_002055). Accordingly, utilities of VGAM1325 include diagnosis, prevention and treatment of diseases and clinical conditions associated with GFAP. LOC91252 (Accession XM_037173) is another VGAM1325 host target gene. LOC91252 BINDING SITE is HOST TARGET binding site found in the 3' untranslated region of mRNA encoded by LOC91252, corresponding to a HOST TARGET binding site such as BINDING SITE I, BINDING SITE II or BINDING SITE III. Table 2 illustrates the complementarity of the nucleotide sequences of LOC91252 BINDING SITE, designated SEQ ID:32551, to the nucleotide sequence of VGAM1325 RNA, herein designated VGAM RNA, also designated SEQ ID:4036.

Another function of VGAM1325 is therefore inhibition of LOC91252 (Accession XM_037173). Accordingly, utilities of VGAM1325 include diagnosis, prevention and treatment of diseases and clinical conditions associated with LOC91252. FIG. 1 further provides a conceptual description of a novel bioinformatically detected viral gene of the present invention, referred to here as Viral Genomic Address Messenger 1326 (VGAM1326) viral gene, which modulates expression of respective host target genes thereof, the function and utility of which host target genes is known in the art.

VGAM1326 is a novel bioinformatically detected regulatory, non protein coding, viral micro RNA (miRNA) gene. The method by which VGAM1326 was detected is described hereinabove with reference to FIGS. 1-8.

VGAM1326 gene, herein designated VGAM GENE, is a viral gene contained in the genome of Myxoma Virus. VGAM1326 host target gene, herein designated VGAM HOST TARGET GENE, is a human gene contained in the human genome.

VGAM1326 gene encodes a VGAM1326 precursor RNA, herein designated VGAM PRECURSOR RNA. Similar to other miRNA genes, and unlike most ordinary genes, VGAM1326 precursor RNA does not encode a protein. A nucleotide sequence identical or highly similar to the nucleotide sequence of VGAM1326 precursor RNA is designated SEQ ID:1312, and is provided hereinbelow with reference to the sequence listing part. Nucleotide sequence SEQ ID:1312 is located at position 91066 relative to the genome of Myxoma Virus.

VGAM1326 precursor RNA folds onto itself, forming VGAM1326 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1326 folded precursor RNA into VGAM1326 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1326 RNA is designated SEQ ID:4037, and is provided hereinbelow with reference to the sequence listing part.

VGAM1326 host target gene, herein designated VGAM HOST TARGET GENE, encodes a corresponding messenger RNA, VGAM1326 host target RNA, herein designated VGAM HOST TARGET RNA. VGAM1326 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1326 RNA, herein designated VGAM RNA, binds complementarily to one or more host target binding sites located in untranslated regions of VGAM1326 host target RNA, herein designated VGAM HOST TARGET RNA. This complementary binding is due to the fact that the nucleotide sequence of VGAM1326 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1326 RNA, herein designated VGAM RNA, may have a different number of host target binding sites in untranslated regions of a VGAM1326 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1326 RNA, herein designated VGAM RNA, to host target binding sites on VGAM1326 host target RNA, herein designated VGAM HOST TARGET RNA, such as BINDING SITE I, BINDING SITE II and BINDING SITE III, inhibits translation of VGAM1326 host target RNA into VGAM1326 host target protein, herein designated VGAM HOST TARGET PROTEIN. VGAM host target protein is therefore outlined by a broken line.

It is appreciated that VGAM1326 host target gene, herein designated VGAM HOST TARGET GENE, in fact represents a plurality of VGAM1326 host target genes. The mRNA of each one of this plurality of VGAM1326 host target genes comprises one or more host target binding sites, each having a nucleotide sequence which is at least partly complementary to VGAM1326 RNA, herein designated VGAM RNA, and which when bound by VGAM1326 RNA causes inhibition of translation of respective one or more VGAM1326 host target proteins.

It is further appreciated by one skilled in the art that the mode of translational inhibition illustrated by FIG. 1 with specific reference to translational inhibition exerted by VGAM1326 gene, herein designated VGAM GENE, on one or more VGAM1326 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1326 is inhibition of expression of host target genes, as part of a novel viral mechanism of attacking a host. Accordingly, utilities of VGAM1326 include diagnosis, prevention and treatment of viral infection by Myxoma Virus. Specific functions, and accordingly utilities, of VGAM1326 correlate with, and may be deduced from, the identity of the host target genes which VGAM1326 binds and inhibits, and the function of these host target genes, as elaborated hereinbelow.

Nucleotide sequences of the VGAM1326 precursor RNA, herein designated VGAM PRECURSOR RNA, and of the 'diced' VGAM1326 RNA, herein designated VGAM RNA, and a schematic representation of the secondary folding of VGAM1326 folded precursor RNA, herein designated VGAM FOLDED PRECURSOR RNA, of VGAM1326 are further described hereinbelow with reference to Table 1.

Nucleotide sequences of host target binding sites, such as BINDING SITE-I, BINDING SITE-II and BINDING SITE-III of FIG. 1, found on VGAM1326 host target RNA, and schematic representation of the complementarity of each of these host target binding sites to VGAM1326 RNA, herein designated VGAM RNA, are described hereinbelow with reference to Table 2.

As mentioned hereinabove with reference to FIG. 1, a function of VGAM1326 gene, herein designated VGAM is inhibition of expression of VGAM1326 target genes. It is appreciated that specific functions, and accordingly utilities, of VGAM1326 correlate with, and may be deduced from, the identity of the target genes which VGAM1326 binds and inhibits, and the function of these target genes, as elaborated hereinbelow.

Aldehyde Dehydrogenase 1 Family, Member B1 (ALDH1B1, Accession NM_000692) is a VGAM1326 host target gene. ALDH1B1 BINDING SITE is HOST TARGET binding site found in the 3' untranslated region of mRNA encoded by ALDH1B1, corresponding to a HOST TARGET binding site such as BINDING SITE I, BINDING SITE II or BINDING SITE III. Table 2 illustrates the complementarity of the nucleotide sequences of ALDH1B1 BINDING SITE, designated SEQ ID:6347, to the nucleotide sequence of VGAM1326 RNA, herein designated VGAM RNA, also designated SEQ ID:4037.

A function of VGAM1326 is therefore inhibition of Aldehyde Dehydrogenase 1 Family, Member B1 (ALDH1B1, Accession NM_000692). Accordingly, utilities of VGAM1326 include diagnosis, prevention and treatment of diseases and clinical conditions associated with ALDH1B1. Complement Component 7 (C7, Accession NM_000587) is another VGAM1326 host target gene. C7 BINDING SITE is HOST TARGET binding site found in the 3' untranslated region of mRNA encoded by C7, corresponding to a HOST TARGET binding site such as BINDING SITE I, BINDING SITE II or BINDING SITE III. Table 2 illustrates the complementarity of the nucleotide sequences of C7 BINDING SITE, designated SEQ ID:6187, to the nucleotide sequence of VGAM1326 RNA, herein designated VGAM RNA, also designated SEQ ID:4037.

Another function of VGAM1326 is therefore inhibition of Complement Component 7 (C7, Accession NM_000587). Accordingly, utilities of VGAM1326 include diagnosis, prevention and treatment of diseases and clinical conditions associated with C7. Cytoplasmic Linker Associated Protein 2 (CLASP2, Accession XM_035453) is another VGAM1326 host target gene. CLASP2 BINDING SITE is HOST TARGET binding site found in the 3' untranslated region of mRNA encoded by CLASP2, corresponding to a HOST TARGET binding site such as BINDING SITE I, BINDING SITE II or BINDING SITE III. Table 2 illustrates the complementarity of the nucleotide sequences of CLASP2 BINDING SITE, designated SEQ ID:32266, to the nucleotide sequence of VGAM1326 RNA, herein designated VGAM RNA, also designated SEQ ID:4037.

Another function of VGAM1326 is therefore inhibition of Cytoplasmic Linker Associated Protein 2 (CLASP2, Accession XM_035453), a gene which is involved in the regional regulation of microtubule dynamics in motile fibroblasts. Accordingly, utilities of VGAM1326 include diagnosis, prevention and treatment of diseases and clinical conditions associated with CLASP2. The function of CLASP2 and its association with various diseases and clinical conditions, has been established by previous studies, as described hereinabove with reference to VGAM897. Cytochrome P450, Subfamily VIIIB (sterol 12-alpha-hydroxylase), Polypeptide 1 (CYP8B1, Accession NM_004391) is another VGAM1326 host target gene. CYP8B1 BINDING SITE is HOST TARGET binding site found in the 3' untranslated region of mRNA encoded by CYP8B1, corresponding to a HOST TARGET binding site such as BINDING SITE I, BINDING SITE II or BINDING SITE III. Table 2 illustrates the complementarity of the nucleotide sequences of CYP8B1 BINDING SITE, designated SEQ ID:10620, to the nucleotide sequence of VGAM1326 RNA, herein designated VGAM RNA, also designated SEQ ID:4037.

Another function of VGAM1326 is therefore inhibition of Cytochrome P450, Subfamily VIIIB (sterol 12-alpha-hydroxylase), Polypeptide 1 (CYP8B1, Accession NM_004391), a gene which functions in bile acid biosynthesis. Accordingly, utilities of VGAM1326 include diagnosis, prevention and treatment of diseases and clinical conditions associated with CYP8B1. The function of CYP8B1 and its association with various diseases and clinical conditions, has been established by previous studies, as described hereinabove with reference to VGAM923. Decorin (DCN, Accession NM_133507) is another VGAM1326 host target gene. DCN BINDING SITE is HOST TARGET binding site found in the 3' untranslated region of mRNA encoded by DCN, corresponding to a HOST TARGET binding site such as BINDING SITE I, BINDING SITE II or BINDING SITE III. Table 2 illustrates the complementarity of the nucleotide sequences of DCN BINDING SITE, designated SEQ ID:28574, to the nucleotide sequence of VGAM1326 RNA, herein designated VGAM RNA, also designated SEQ ID:4037.

Another function of VGAM1326 is therefore inhibition of Decorin (DCN, Accession NM_133507), a gene which may mediate in epithelial/mesenchymal interactions. Accordingly, utilities of VGAM1326 include diagnosis, prevention and treatment of diseases and clinical conditions associated with DCN. The function of DCN has been established by previous studies. Decorin and biglycan (OMIM Ref. No. 301870) are related but distinct small proteoglycans found in many connective tissues. Danielson et al. (1993) found that the human decorin gene spans more than 38 kb and contains 8 exons and very large introns, 2 of which are 5.4 and more than 13.2 kb. They discovered 2 alternatively spliced leader exons, Ia and Ib, in the 5-prime untranslated region. Using Northern blotting or reverse transcriptase PCR, they detected the 2 leader exons in a variety of mRNAs isolated from human cell lines and tissues. Sequences highly homologous (OMIM Ref. No. 74-87%) to exons Ia and Ib were found in the 5-prime untranslated region of avian and bovine decorin, respectively. This high degree of conservation among species suggested regulatory functions for these leader exons. In situ hybridization studies of developing mouse embryos suggested that decorin may play a role in epithelial/mesenchymal interactions during organ development and shaping (Scholzen et al., 1994). Dyne et al. (1996) studied 2 patients with osteogenesis imperfecta and the same gly415-to-ser mutation of the COL1A1 gene (120150.0044), but a different clinical expression. They speculated that these differences could be the result of abnormalities in other connective tissue proteins. Since decorin is a component of connective tissue, binds to type I collagen fibrils, and plays a role in matrix assembly, they studied decorin production in skin fibroblasts from these 2 patients. Cultured fibroblasts from the patient with extremely severe osteogenesis imperfecta (classified as type II/III) were found to secrete barely detectable amounts of decorin into culture medium. Northern blot analysis showed decorin mRNA levels below the limit of detection. The patient with a less severe phenotype had fibroblasts that expressed decorin normally. Dyne et al. (1996) suggested that the different clinical phenotypes could be due to the differing genetic backgrounds of the patients, such that in the more severely affected patient the absence of decorin aggravated the clinical phenotype.

Full details of the abovementioned studies are described in the following publications, the disclosure of which are hereby incorporated by reference:

Scholzen, T.; Solursh, M.; Suzuki, S.; Reiter, R.; Morgan, J. L.; Buchberg, A. M.; Siracusa, L. D.; Iozzo, R. V.: The murine decorin: complete cDNA cloning, genomic organization, chromosomal assignment, and expression during organogenesis and tissue differentiation. J. Biol. Chem. 269: 28270-28281, 1994; and Dyne, K. M.; Valli, M.; Forlino, A.; Mottes, M.; Kresse, H.; Cetta, G.: Deficient expression of the small proteoglycan decorin in a case of severe/lethal osteogenesis imperfecta. Am. J.

Further studies establishing the function and utilities of DCN are found in John Hopkins OMIM database record ID 125255, and in sited publications numbered 1989-1998 listed in the bibliography section hereinbelow, which are also hereby incorporated by reference. DEK Oncogene (DNA binding) (DEK, Accession NM_003472) is another VGAM1326 host target gene. DEK BINDING SITE is HOST TARGET binding site found in the 3' untranslated region of mRNA encoded by DEK, corresponding to a HOST TARGET binding site such as BINDING SITE I, BINDING SITE II or BINDING SITE III. Table 2 illustrates the complementarity of the nucleotide sequences of DEK BINDING SITE, designated SEQ ID:9536, to the nucleotide sequence of VGAM1326 RNA, herein designated VGAM RNA, also designated SEQ ID:4037.

Another function of VGAM1326 is therefore inhibition of DEK Oncogene (DNA binding) (DEK, Accession NM_003472), a gene which interacts in transcriptional regulation and signal transduction. Accordingly, utilities of VGAM1326 include diagnosis, prevention and treatment of diseases and clinical conditions associated with DEK. The function of DEK and its association with various diseases and clinical conditions, has been established by previous studies, as described hereinabove with reference to VGAM795. EGF-like-domain, Multiple 5 (EGFL5, Accession XM_098838) is another VGAM1326 host target gene. EGFL5 BINDING SITE is HOST TARGET binding site found in the 5' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41887, to the nucleotide sequence of VGAM1326 RNA, herein designated VGAM RNA, also designated SEQ ID:4037.

Another function of VGAM1326 is therefore inhibition of EGF-like-domain, Multiple 5 (EGFL5, Accession XM_098838). Accordingly, utilities of VGAM1326 include diagnosis, prevention and treatment of diseases and clinical conditions associated with EGFL5. MAP-kinase Activating Death Domain (MADD, Accession NM_130470) is another VGAM1326 host target gene. MADD BINDING SITE1 through MADD BINDING SITE6 are HOST TARGET binding sites found in untranslated regions of mRNA encoded by MADD, corresponding to HOST TARGET binding sites such as BINDING SITE I, BINDING SITE II or BINDING SITE III. Table 2 illustrates the complementarity of the nucleotide sequences of MADD BINDING SITE1 through MADD BINDING SITE6, designated SEQ ID:28234, SEQ ID:28250, SEQ ID:28245, SEQ ID:28240, SEQ ID:28255 and SEQ ID:9785 respectively, to the nucleotide sequence of VGAM1326 RNA, herein designated VGAM RNA, also designated SEQ ID:4037.

Another function of VGAM1326 is therefore inhibition of MAP-kinase Activating Death Domain (MADD, Accession NM_130470), a gene which may regulate two different pathways for neural activities.interacts with the type-1 tumor necrosis factor receptor (TNFR1); death domain-containing protein. Accordingly, utilities of VGAM1326 include diagnosis, prevention and treatment of diseases and clinical conditions associated with MADD. The function of MADD and its association with various diseases and clinical conditions, has been established by previous studies, as described hereinabove with reference to VGAM430. NKX3A (Accession NM_006167) is another VGAM1326 host target gene. NKX3A BINDING SITE is HOST TARGET binding site found in the 3' untranslated region of mRNA encoded by NKX3A, corresponding to a HOST TARGET binding site such as BINDING SITE I, BINDING SITE II or BINDING SITE III. Table 2 illustrates the complementarity of the nucleotide sequences of NKX3A BINDING SITE, designated SEQ ID:12831, to the nucleotide sequence of VGAM1326 RNA, herein designated VGAM RNA, also designated SEQ ID:4037.

Another function of VGAM1326 is therefore inhibition of NKX3A (Accession NM_006167), a gene which may regulate gene expression and control cell differentiation. Accordingly, utilities of VGAM1326 include diagnosis, prevention and treatment of diseases and clinical conditions associated with NKX3A. The function of NKX3A and its association with various diseases and clinical conditions, has been established by previous studies, as described hereinabove with reference to VGAM481. Spondyloepiphyseal Dysplasia, Late (SEDL, Accession NM_014563) is another VGAM1326 host target gene. SEDL BINDING SITE is HOST TARGET binding site found in the 3' untranslated region of mRNA encoded by SEDL, corresponding to a HOST TARGET binding site such as BINDING SITE I, BINDING SITE II or BINDING SITE III. Table 2 illustrates the complementarity of the nucleotide sequences of SEDL BINDING SITE, designated SEQ ID:15903, to the nucleotide sequence of VGAM1326 RNA, herein designated VGAM RNA, also designated SEQ ID:4037.

Another function of VGAM1326 is therefore inhibition of Spondyloepiphyseal Dysplasia, Late (SEDL, Accession NM_014563), a gene which may play role in vesicular transport from endoplasmic reticulum to golgi. Accordingly, utilities of VGAM1326 include diagnosis, prevention and treatment of diseases and clinical conditions associated with SEDL. The function of SEDL and its association with various diseases and clinical conditions, has been established by previous studies, as described hereinabove with reference to VGAM74. Splicing Factor, Arginine/serine-rich 2, Interacting Protein (SFRS2IP, Accession NM_004719) is another VGAM1326 host target gene. SFRS2IP BINDING SITE is HOST TARGET binding site found in the 5' untranslated region of mRNA encoded by SFRS2IP, corresponding to a HOST TARGET binding site such as BINDING SITE I, BINDING SITE II or BINDING SITE III. Table 2 illustrates the complementarity of the nucleotide sequences of SFRS2IP BINDING SITE, designated SEQ ID:11085, to the nucleotide sequence of VGAM1326 RNA, herein designated VGAM RNA, also designated SEQ ID:4037.

Another function of VGAM1326 is therefore inhibition of Splicing Factor, Arginine/serine-rich 2, Interacting Protein (SFRS2IP, Accession NM_004719), a gene which plays an essential role in pre-mRNA splicing. Accordingly, utilities of VGAM1326 include diagnosis, prevention and treatment of diseases and clinical conditions associated with SFRS2IP. The function of SFRS2IP and its association with various diseases and clinical conditions, has been established by previous studies, as described hereinabove with reference to VGAM700. Translin (TSN, Accession NM_004622) is another VGAM1326 host target gene. TSN BINDING SITE is HOST TARGET binding site found in the 3' untranslated region of mRNA encoded by TSN, corresponding to a HOST TARGET binding site such as BINDING SITE I, BINDING SITE II or BINDING SITE III. Table 2 illustrates the complementarity of the nucleotide sequences of TSN BINDING SITE, designated SEQ ID:10988, to the nucleotide sequence of VGAM1326 RNA, herein designated VGAM RNA, also designated SEQ ID:4037.

Another function of VGAM1326 is therefore inhibition of Translin (TSN, Accession NM_004622), a gene which is a DNA binding protein and involved in DNA repair, replication, or recombination. Accordingly, utilities of VGAM1326 include diagnosis, prevention and treatment of diseases and clinical conditions associated with TSN. The function of TSN and its association with various diseases and clinical conditions, has been established by previous studies, as described hereinabove with reference to VGAM98. Visinin-like 1 (VSNL1, Accession NM_003385) is another VGAM1326 host target gene. VSNL1 BINDING SITE is HOST TARGET binding site found in the 3' untranslated region of mRNA encoded by VSNL1, corresponding to a HOST TARGET binding site such as BINDING SITE I, BINDING SITE II or BINDING SITE III. Table 2 illustrates the complementarity of the nucleotide sequences of VSNL1 BINDING SITE, designated SEQ ID:9419, to the nucleotide sequence of VGAM1326 RNA, herein designated VGAM RNA, also designated SEQ ID:4037.

Another function of VGAM1326 is therefore inhibition of Visinin-like 1 (VSNL1, Accession NM_003385). Accordingly, utilities of VGAM1326 include diagnosis, prevention and treatment of diseases and clinical conditions associated with VSNL1. Vitronectin (serum spreading factor, somatomedin B, complement S-protein) (VTN, Accession NM_000638) is another VGAM1326 host target gene. VTN BINDING SITE is HOST TARGET binding site found in the 5' untranslated region of mRNA encoded by VTN, corresponding to a HOST TARGET binding site such as BINDING SITE I, BINDING SITE II or BINDING SITE III. Table 2 illustrates the complementarity of the nucleotide sequences of VTN BINDING SITE, designated SEQ ID:6274, to the nucleotide sequence of VGAM1326 RNA, herein designated VGAM RNA, also designated SEQ ID:4037.

Another function of VGAM1326 is therefore inhibition of Vitronectin (serum spreading factor, somatomedin B, complement S-protein) (VTN, Accession NM_000638), a gene which is a cell adhesion and spreading factor found in serum and tissues. Accordingly, utilities of VGAM1326 include diagnosis, prevention and treatment of diseases and clinical conditions associated with VTN. The function of VTN and its association with various diseases and clinical conditions, has been established by previous studies, as described hereinabove with reference to VGAM850. Ac-like Transposable Element (ALTE, Accession NM_004729) is another VGAM1326 host target gene. ALTE BINDING SITE is HOST TARGET binding site found in the 3' untranslated region of mRNA encoded by ALTE, corresponding to a HOST TARGET binding site such as BINDING SITE I, BINDING SITE II or BINDING SITE III. Table 2 illustrates the complementarity of the nucleotide sequences of ALTE BINDING SITE, designated SEQ ID:11108, to the nucleotide sequence of VGAM1326 RNA, herein designated VGAM RNA, also designated SEQ ID:4037.

Another function of VGAM1326 is therefore inhibition of Ac-like Transposable Element (ALTE, Accession NM_004729). Accordingly, utilities of VGAM1326 include diagnosis, prevention and treatment of diseases and clinical conditions associated with ALTE. Ankyrin Repeat and SOCS Box-containing 16 (ASB16, Accession NM_080863) is another VGAM1326 host target gene. ASB16 BINDING SITE is HOST TARGET binding site found in the 3' untranslated region of mRNA encoded by ASB16, corresponding to a HOST TARGET binding site such as BINDING SITE I, BINDING SITE II or BINDING SITE III. Table 2 illustrates the complementarity of the nucleotide sequences of ASB16 BINDING SITE, designated SEQ ID:28107, to the nucleotide sequence of VGAM1326 RNA, herein designated VGAM RNA, also designated SEQ ID:4037.

Another function of VGAM1326 is therefore inhibition of Ankyrin Repeat and SOCS Box-containing 16 (ASB16, Accession NM_080863). Accordingly, utilities of VGAM1326 include diagnosis, prevention and treatment of diseases and clinical conditions associated with ASB16. Chromosome 11 Open Reading Frame 17 (C11orf17, Accession NM_020642) is another VGAM1326 host target gene. C11orf17 BINDING SITE is HOST TARGET binding site found in the 3' untranslated region of mRNA encoded by C11orf17, corresponding to a HOST TARGET binding site such as BINDING SITE I, BINDING SITE II or BINDING SITE III. Table 2 illustrates the complementarity of the nucleotide sequences of C11orf17 BINDING SITE, designated SEQ ID:21805, to the nucleotide sequence of VGAM1326 RNA, herein designated VGAM RNA, also designated SEQ ID:4037.

Another function of VGAM1326 is therefore inhibition of Chromosome 11 Open Reading Frame 17 (C11orf17, Accession NM_020642). Accordingly, utilities of VGAM1326 include diagnosis, prevention and treatment of diseases and clinical conditions associated with C11orf17. Chromosome 21 Open Reading Frame 25 (C21orf25, Accession XM_032945) is another VGAM1326 host target gene. C21orf25 BINDING SITE1 and C21orf25 BINDING SITE2 are HOST TARGET binding sites found in untranslated regions of mRNA encoded by C21orf25, corresponding to HOST TARGET binding sites such as BINDING SITE I, BINDING SITE II or BINDING SITE III. Table 2 illustrates the complementarity of the nucleotide sequences of C21orf25 BINDING SITE1 and C21orf25 BINDING SITE2, designated SEQ ID:31797 and SEQ ID:31803 respectively, to the nucleotide sequence of VGAM1326 RNA, herein designated VGAM RNA, also designated SEQ ID:4037.

Another function of VGAM1326 is therefore inhibition of Chromosome 21 Open Reading Frame 25 (C21orf25, Accession XM_032945). Accordingly, utilities of VGAM1326 include diagnosis, prevention and treatment of diseases and clinical conditions associated with C21orf25. Carbohydrate (chondroitin) Synthase 1 (CHSY1, Accession NM_014918) is another VGAM1326 host target gene. CHSY1 BINDING SITE is HOST TARGET binding site found in the 3' untranslated region of mRNA encoded by CHSY1, corresponding to a HOST TARGET binding site such as BINDING SITE I, BINDING SITE II or BINDING SITE III. Table 2 illustrates the complementarity of the nucleotide sequences of CHSY1 BINDING SITE, designated SEQ ID:17171, to the nucleotide sequence of VGAM1326 RNA, herein designated VGAM RNA, also designated SEQ ID:4037.

Another function of VGAM1326 is therefore inhibition of Carbohydrate (chondroitin) Synthase 1 (CHSY1, Accession NM_014918). Accordingly, utilities of VGAM1326 include diagnosis, prevention and treatment of diseases and clinical conditions associated with CHSY1. DKFZP434B044 (Accession NM_031476) is another VGAM1326 host target gene. DKFZP434B044 BINDING SITE is HOST TARGET binding site found in the 3' untranslated region of mRNA encoded by DKFZP434B044, corresponding to a HOST TARGET binding site such as BINDING SITE I, BINDING SITE II or BINDING SITE III. Table 2 illustrates the complementarity of the nucleotide sequences of DKFZP434B044 BINDING SITE, designated SEQ ID:25552, to the nucleotide sequence of VGAM1326 RNA, herein designated VGAM RNA, also designated SEQ ID:4037.

Another function of VGAM1326 is therefore inhibition of DKFZP434B044 (Accession NM_031476). Accordingly, utilities of VGAM1326 include diagnosis, prevention and treatment of diseases and clinical conditions associated with DKFZP434B044. DKFZp761F2014 (Accession NM_020215) is another VGAM1326 host target gene. DKFZp761F2014 BINDING SITE is HOST TARGET binding site found in the 3' untranslated region of mRNA encoded by DKFZp761F2014, corresponding to a HOST TARGET binding site such as BINDING SITE I, BINDING SITE II or BINDING SITE III. Table 2 illustrates the complementarity of the nucleotide sequences of DKFZp761F2014 BINDING SITE, designated SEQ ID:21462, to the nucleotide sequence of VGAM1326 RNA, herein designated VGAM RNA, also designated SEQ ID:4037.

Another function of VGAM1326 is therefore inhibition of DKFZp761F2014 (Accession NM_020215). Accordingly, utilities of VGAM1326 include diagnosis, prevention and treatment of diseases and clinical conditions associated with DKFZp761F2014. DKFZp761N1114 (Accession XM_086327) is another VGAM1326 host target gene. DKFZp761N1114 BINDING SITE is HOST TARGET binding site found in the 3' untranslated region of mRNA encoded by DKFZp761N1114, corresponding to a HOST TARGET binding site such as BINDING SITE I, BINDING SITE II or BINDING SITE III. Table 2 illustrates the complementarity of the nucleotide sequences of DKFZp761N1114 BINDING SITE, designated SEQ ID:38604, to the nucleotide sequence of VGAM1326 RNA, herein designated VGAM RNA, also designated SEQ ID:4037.

Another function of VGAM1326 is therefore inhibition of DKFZp761N1114 (Accession XM_086327). Accordingly, utilities of VGAM1326 include diagnosis, prevention and treatment of diseases and clinical conditions associated with DKFZp761N1114. FLJ10640 (Accession NM_019023) is another VGAM1326 host target gene. FLJ10640 BINDING SITE is HOST TARGET binding site found in the 5' untranslated region of mRNA encoded by FLJ10640, corresponding to a HOST TARGET binding site such as BINDING SITE I, BINDING SITE II or BINDING SITE III. Table 2 illustrates the complementarity of the nucleotide sequences of FLJ10640 BINDING SITE, designated SEQ ID:21111, to the nucleotide sequence of VGAM1326 RNA, herein designated VGAM RNA, also designated SEQ ID:4037.

Another function of VGAM1326 is therefore inhibition of FLJ10640 (Accession NM_019023). Accordingly, utilities of VGAM1326 include diagnosis, prevention and treatment of diseases and clinical conditions associated with FLJ10640. FLJ13114 (Accession NM_024541) is another VGAM1326 host target gene. FLJ13114 BINDING SITE is HOST TARGET binding site found in the 3' untranslated region of mRNA encoded by FLJ13114, corresponding to a HOST TARGET binding site such as BINDING SITE I, BINDING SITE II or BINDING SITE III. Table 2 illustrates the complementarity of the nucleotide sequences of FLJ13114 BINDING SITE, designated SEQ ID:23748, to the nucleotide sequence of VGAM1326 RNA, herein designated VGAM RNA, also designated SEQ ID:4037.

Another function of VGAM1326 is therefore inhibition of FLJ13114 (Accession NM_024541). Accordingly, utilities of VGAM1326 include diagnosis, prevention and treatment of diseases and clinical conditions associated with FLJ13114. FLJ13197 (Accession NM_024614) is another VGAM1326 host target gene. FLJ13197 BINDING SITE is HOST TARGET binding site found in the 3' untranslated region of mRNA encoded by FLJ13197, corresponding to a HOST TARGET binding site such as BINDING SITE I, BINDING SITE II or BINDING SITE III. Table 2 illustrates the complementarity of the nucleotide sequences of FLJ13197 BINDING SITE, designated SEQ ID:23871, to the nucleotide sequence of VGAM1326 RNA, herein designated VGAM RNA, also designated SEQ ID:4037.

Another function of VGAM1326 is therefore inhibition of FLJ13197 (Accession NM_024614). Accordingly, utilities of VGAM1326 include diagnosis, prevention and treatment of diseases and clinical conditions associated with FLJ13197. FLJ13456 (Accession XM_038291) is another VGAM1326 host target gene. FLJ13456 BINDING SITE is HOST TARGET binding site found in the 3' untranslated region of mRNA encoded by FLJ13456, corresponding to a HOST TARGET binding site such as BINDING SITE I, BINDING SITE II or BINDING SITE III. Table 2 illustrates the complementarity of the nucleotide sequences of FLJ13456 BINDING SITE, designated SEQ ID:32796, to the nucleotide sequence of VGAM1326 RNA, herein designated VGAM RNA, also designated SEQ ID:4037.

Another function of VGAM1326 is therefore inhibition of FLJ13456 (Accession XM_038291). Accordingly, utilities of VGAM1326 include diagnosis, prevention and treatment of diseases and clinical conditions associated with FLJ13456. FLJ14442 (Accession NM_032785) is another VGAM1326 host target gene. FLJ14442 BINDING SITE is HOST TARGET binding site found in the 3' untranslated region of mRNA encoded by FLJ14442, corresponding to a HOST TARGET binding site such as BINDING SITE I, BINDING SITE II or BINDING SITE III. Table 2 illustrates the complementarity of the nucleotide sequences of FLJ14442 BINDING SITE, designated SEQ ID:26533, to the nucleotide sequence of VGAM1326 RNA, herein designated VGAM RNA, also designated SEQ ID:4037.

Another function of VGAM1326 is therefore inhibition of FLJ14442 (Accession NM_032785). Accordingly, utilities of VGAM1326 include diagnosis, prevention and treatment of diseases and clinical conditions associated with FLJ14442. FLJ20004 (Accession XM_170889) is another VGAM1326 host target gene. FLJ20004 BINDING SITE is HOST TARGET binding site found in the 3' untranslated region of mRNA encoded by FLJ20004, corresponding to a HOST TARGET binding site such as BINDING SITE I, BINDING SITE II or BINDING SITE III. Table 2 illustrates the complementarity of the nucleotide sequences of FLJ20004 BINDING SITE, designated SEQ ID:45645, to the nucleotide sequence of VGAM1326 RNA, herein designated VGAM RNA, also designated SEQ ID:4037.

Another function of VGAM1326 is therefore inhibition of FLJ20004 (Accession XM_170889). Accordingly, utilities of VGAM1326 include diagnosis, prevention and treatment of diseases and clinical conditions associated with FLJ20004. FLJ22531 (Accession NM_024650) is another VGAM1326 host target gene. FLJ22531 BINDING SITE is HOST TARGET binding site found in the 5' untranslated region of mRNA encoded by FLJ22531, corresponding to a HOST TARGET binding site such as BINDING SITE I, BINDING SITE II or BINDING SITE III. Table 2 illustrates the complementarity of the nucleotide sequences of FLJ22531 BINDING SITE, designated SEQ ID:23943, to the nucleotide sequence of VGAM1326 RNA, herein designated VGAM RNA, also designated SEQ ID:4037.

Another function of VGAM1326 is therefore inhibition of FLJ22531 (Accession NM_024650). Accordingly, utilities of VGAM1326 include diagnosis, prevention and treatment of diseases and clinical conditions associated with FLJ22531. FLJ23263 (Accession NM_025115) is another VGAM1326 host target gene. FLJ23263 BINDING SITE is HOST TARGET binding site found in the 5' untranslated region of mRNA encoded by FLJ23263, corresponding to a HOST TARGET binding site such as BINDING SITE I, BINDING SITE II or BINDING SITE III. Table 2 illustrates the complementarity of the nucleotide sequences of FLJ23263 BINDING SITE, designated SEQ ID:24765, to the nucleotide sequence of VGAM1326 RNA, herein designated VGAM RNA, also designated SEQ ID:4037.

Another function of VGAM1326 is therefore inhibition of FLJ23263 (Accession NM_025115). Accordingly, utilities of VGAM1326 include diagnosis, prevention and treatment of diseases and clinical conditions associated with FLJ23263. FLJ31101 (Accession NM_017964) is another VGAM1326 host target gene. FLJ31101 BINDING SITE is HOST TARGET binding site found in the 3' untranslated region of mRNA encoded by FLJ31101, corresponding to a HOST TARGET binding site such as BINDING SITE I, BINDING SITE II or BINDING SITE III. Table 2 illustrates the complementarity of the nucleotide sequences of FLJ31101 BINDING SITE, designated SEQ ID:19682, to the nucleotide sequence of VGAM1326 RNA, herein designated VGAM RNA, also designated SEQ ID:4037.

Another function of VGAM1326 is therefore inhibition of FLJ31101 (Accession NM_017964). Accordingly, utilities of VGAM1326 include diagnosis, prevention and treatment of diseases and clinical conditions associated with FLJ31101. GBTS1 (Accession NM_145173) is another VGAM1326 host target gene. GBTS1 BINDING SITE is HOST TARGET binding site found in the 3' untranslated region of mRNA encoded by GBTS1, corresponding to a HOST TARGET binding site such as BINDING SITE I, BINDING SITE II or BINDING SITE III. Table 2 illustrates the complementarity of the nucleotide sequences of GBTS1 BINDING SITE, designated SEQ ID:29732, to the nucleotide sequence of VGAM1326 RNA, herein designated VGAM RNA, also designated SEQ ID:4037.

Another function of VGAM1326 is therefore inhibition of GBTS1 (Accession NM_145173). Accordingly, utilities of VGAM1326 include diagnosis, prevention and treatment of diseases and clinical conditions associated with GBTS1. GL004 (Accession XM_038373) is another VGAM1326 host target gene. GL004 BINDING SITE is HOST TARGET binding site found in the 3' untranslated region of mRNA encoded by GL004, corresponding to a HOST TARGET binding site such as BINDING SITE I, BINDING SITE II or BINDING SITE III. Table 2 illustrates the complementarity of the nucleotide sequences of GL004 BINDING SITE, designated SEQ ID:32830, to the nucleotide sequence of VGAM1326 RNA, herein designated VGAM RNA, also designated SEQ ID:4037.

Another function of VGAM1326 is therefore inhibition of GL004 (Accession XM_038373). Accordingly, utilities of VGAM1326 include diagnosis, prevention and treatment of diseases and clinical conditions associated with GL004. KIAA0417 (Accession XM_048898) is another VGAM1326 host target gene. KIAA0417 BINDING SITE is HOST TARGET binding site found in the 3' untranslated region of mRNA encoded by KIAA0417, corresponding to a HOST TARGET binding site such as BINDING SITE I, BINDING SITE II or BINDING SITE III. Table 2 illustrates the complementarity of the nucleotide sequences of KIAA0417 BINDING SITE, designated SEQ ID:35294, to the nucleotide sequence of VGAM1326 RNA, herein designated VGAM RNA, also designated SEQ ID:4037.

Another function of VGAM1326 is therefore inhibition of KIAA0417 (Accession XM_048898). Accordingly, utilities of VGAM1326 include diagnosis, prevention and treatment of diseases and clinical conditions associated with KIAA0417. KIAA0475 (Accession NM_014864) is another VGAM1326 host target gene. KIAA0475 BINDING SITE is HOST TARGET binding site found in the 3' untranslated region of mRNA encoded by KIAA0475, corresponding to a HOST TARGET binding site such as BINDING SITE I, BINDING SITE II or BINDING SITE III. Table 2 illustrates the complementarity of the nucleotide sequences of KIAA0475 BINDING SITE, designated SEQ ID:16946, to the nucleotide sequence of VGAM1326 RNA, herein designated VGAM RNA, also designated SEQ ID:4037.

Another function of VGAM1326 is therefore inhibition of KIAA0475 (Accession NM_014864). Accordingly, utilities of VGAM1326 include diagnosis, prevention and treatment of diseases and clinical conditions associated with KIAA0475. KIAA0561 (Accession XM_038150) is another VGAM1326 host target gene. KIAA0561 BINDING SITE is HOST TARGET binding site found in the 3' untranslated region of mRNA encoded by KIAA0561, corresponding to a HOST TARGET binding site such as BINDING SITE I, BINDING SITE II or BINDING SITE III. Table 2 illustrates the complementarity of the nucleotide sequences of KIAA0561 BINDING SITE, designated SEQ ID:32763, to the nucleotide sequence of VGAM1326 RNA, herein designated VGAM RNA, also designated SEQ ID:4037.

Another function of VGAM1326 is therefore inhibition of KIAA0561 (Accession XM_038150). Accordingly, utilities of VGAM1326 include diagnosis, prevention and treatment of diseases and clinical conditions associated with KIAA0561. KIAA0594 (Accession XM_036117) is another VGAM1326 host target gene. KIAA0594 BINDING SITE is HOST TARGET binding site found in the 3' untranslated region of mRNA encoded by KIAA0594, corresponding to a HOST TARGET binding site such as BINDING SITE I, BINDING SITE II or BINDING SITE III. Table 2 illustrates the complementarity of the nucleotide sequences of KIAA0594 BINDING SITE, designated SEQ ID:32385, to the nucleotide sequence of VGAM1326 RNA, herein designated VGAM RNA, also designated SEQ ID:4037.

Another function of VGAM1326 is therefore inhibition of KIAA0594 (Accession XM_036117). Accordingly, utilities of VGAM1326 include diagnosis, prevention and treatment of diseases and clinical conditions associated with KIAA0594. KIAA0720 (Accession XM_030970) is another VGAM1326 host target gene. KIAA0720 BINDING SITE is HOST TARGET binding site found in the 3' untranslated region of mRNA encoded by KIAA0720, corresponding to a HOST TARGET binding site such as BINDING SITE I, BINDING SITE II or BINDING SITE III. Table 2 illustrates the complementarity of the nucleotide sequences of KIAA0720 BINDING SITE, designated SEQ ID:31230, to the nucleotide sequence of VGAM1326 RNA, herein designated VGAM RNA, also designated SEQ ID:4037.

Another function of VGAM1326 is therefore inhibition of KIAA0720 (Accession XM_030970). Accordingly, utilities of VGAM1326 include diagnosis, prevention and treatment of diseases and clinical conditions associated with KIAA0720. KIAA1054 (Accession XM_043493) is another VGAM1326 host target gene. KIAA1054 BINDING SITE is HOST TARGET binding site found in the 3' untranslated region of mRNA encoded by KIAA1054, corresponding to a HOST TARGET binding site such as BINDING SITE I, BINDING SITE II or BINDING SITE III. Table 2 illustrates the complementarity of the nucleotide sequences of KIAA1054 BINDING SITE, designated SEQ ID:33952, to the nucleotide sequence of VGAM1326 RNA, herein designated VGAM RNA, also designated SEQ ID:4037.

Another function of VGAM1326 is therefore inhibition of KIAA1054 (Accession XM_043493). Accordingly, utilities of VGAM1326 include diagnosis, prevention and treatment of diseases and clinical conditions associated with KIAA1054. KIAA1143 (Accession XM_044014) is another VGAM1326 host target gene. KIAA1143 BINDING SITE is HOST TARGET binding site found in the 3' untranslated region of mRNA encoded by KIAA1143, corresponding to a HOST TARGET binding site such as BINDING SITE I, BINDING SITE II or BINDING SITE III. Table 2 illustrates the complementarity of the nucleotide sequences of KIAA1143 BINDING SITE, designated SEQ ID:34071, to the nucleotide sequence of VGAM1326 RNA, herein designated VGAM RNA, also designated SEQ ID:4037.

Another function of VGAM1326 is therefore inhibition of KIAA1143 (Accession XM_044014). Accordingly, utilities of VGAM1326 include diagnosis, prevention and treatment of diseases and clinical conditions associated with KIAA1143. KIAA1373 (Accession XM_048195) is another VGAM1326 host target gene. KIAA1373 BINDING SITE is HOST TARGET binding site found in the 3' untranslated region of mRNA encoded by KIAA1373, corresponding to a HOST TARGET binding site such as BINDING SITE I, BINDING SITE II or BINDING SITE III. Table 2 illustrates the complementarity of the nucleotide sequences of KIAA1373 BINDING SITE, designated SEQ ID:35122, to the nucleotide sequence of VGAM1326 RNA, herein designated VGAM RNA, also designated SEQ ID:4037.

Another function of VGAM1326 is therefore inhibition of KIAA1373 (Accession XM_048195). Accordingly, utilities of VGAM1326 include diagnosis, prevention and treatment of diseases and clinical conditions associated with KIAA1373. KIAA1649 (Accession NM_032311) is another VGAM1326 host target gene. KIAA1649 BINDING SITE is HOST TARGET binding site found in the 3' untranslated region of mRNA encoded by KIAA1649, corresponding to a HOST TARGET binding site such as BINDING SITE I, BINDING SITE II or BINDING SITE III. Table 2 illustrates the complementarity of the nucleotide sequences of KIAA1649 BINDING SITE, designated SEQ ID:26102, to the nucleotide sequence of VGAM1326 RNA, herein designated VGAM RNA, also designated SEQ ID:4037.

Another function of VGAM1326 is therefore inhibition of KIAA1649 (Accession NM_032311). Accordingly, utilities of VGAM1326 include diagnosis, prevention and treatment of diseases and clinical conditions associated with KIAA1649. KIAA1655 (Accession XM_039442) is another VGAM1326 host target gene. KIAA1655 BINDING SITE is HOST TARGET binding site found in the 3' untranslated region of mRNA encoded by KIAA1655, corresponding to a HOST TARGET binding site such as BINDING SITE I, BINDING SITE II or BINDING SITE III. Table 2 illustrates the complementarity of the nucleotide sequences of KIAA1655 BINDING SITE, designated SEQ ID:33081, to the nucleotide sequence of VGAM1326 RNA, herein designated VGAM RNA, also designated SEQ ID:4037.

Another function of VGAM1326 is therefore inhibition of KIAA1655 (Accession XM_039442). Accordingly, utilities of VGAM1326 include diagnosis, prevention and treatment of diseases and clinical conditions associated with KIAA1655. KIAA1971 (Accession XM_058720) is another VGAM1326 host target gene. KIAA1971 BINDING SITE is HOST TARGET binding site found in the 3' untranslated region of mRNA encoded by KIAA1971, corresponding to a HOST TARGET binding site such as BINDING SITE I, BINDING SITE II or BINDING SITE III. Table 2 illustrates the complementarity of the nucleotide sequences of KIAA1971 BINDING SITE, designated SEQ ID:36727, to the nucleotide sequence of VGAM1326 RNA, herein designated VGAM RNA, also designated SEQ ID:4037.

Another function of VGAM1326 is therefore inhibition of KIAA1971 (Accession XM_058720). Accordingly, utilities of VGAM1326 include diagnosis, prevention and treatment of diseases and clinical conditions associated with KIAA1971. MGC2477 (Accession NM_024099) is another VGAM1326 host target gene. MGC2477 BINDING SITE is HOST TARGET binding site found in the 5' untranslated region of mRNA encoded by MGC2477, corresponding to a HOST TARGET binding site such as BINDING SITE I, BINDING SITE II or BINDING SITE III. Table 2 illustrates the complementarity of the nucleotide sequences of MGC2477 BINDING SITE, designated SEQ ID:23540, to the nucleotide sequence of VGAM1326 RNA, herein designated VGAM RNA, also designated SEQ ID:4037.

Another function of VGAM1326 is therefore inhibition of MGC2477 (Accession NM_024099). Accordingly, utilities of VGAM1326 include diagnosis, prevention and treatment of diseases and clinical conditions associated with MGC2477. MGC5149 (Accession XM_051200) is another VGAM1326 host target gene. MGC5149 BINDING SITE is HOST TARGET binding site found in the 3' untranslated region of mRNA encoded by MGC5149, corresponding to a HOST TARGET binding site such as BINDING SITE I, BINDING SITE II or BINDING SITE III. Table 2 illustrates the complementarity of the nucleotide sequences of MGC5149 BINDING SITE, designated SEQ ID:35782, to the nucleotide sequence of VGAM1326 RNA, herein designated VGAM RNA, also designated SEQ ID:4037.

Another function of VGAM1326 is therefore inhibition of MGC5149 (Accession XM_051200). Accordingly, utilities of VGAM1326 include diagnosis, prevention and treatment of diseases and clinical conditions associated with MGC5149. Paternally Expressed 10 (PEG10, Accession NM_015068) is another VGAM1326 host target gene. PEG10 BINDING SITE is HOST TARGET binding site found in the 3' untranslated region of mRNA encoded by PEG10, corresponding to a HOST TARGET binding site such as BINDING SITE I, BINDING SITE II or BINDING SITE III. Table 2 illustrates the complementarity of the nucleotide sequences of PEG10 BINDING SITE, designated SEQ ID:17423, to the nucleotide sequence of VGAM1326 RNA, herein designated VGAM RNA, also designated SEQ ID:4037.

Another function of VGAM1326 is therefore inhibition of Paternally Expressed 10 (PEG10, Accession NM_015068). Accordingly, utilities of VGAM1326 include diagnosis, prevention and treatment of diseases and clinical conditions associated with PEG10. Pellino Homolog 1 (Drosophila) (PELI1, Accession NM_020651) is another VGAM1326 host target gene. PELI1 BINDING SITE is HOST TARGET binding site found in the 5' untranslated region of mRNA encoded by PELI1, corresponding to a HOST TARGET binding site such as BINDING SITE I, BINDING SITE II or BINDING SITE III. Table 2 illustrates the complementarity of the nucleotide sequences of PELI1 BINDING SITE, designated SEQ ID:21814, to the nucleotide sequence of VGAM1326 RNA, herein designated VGAM RNA, also designated SEQ ID:4037.

Another function of VGAM1326 is therefore inhibition of Pellino Homolog 1 (Drosophila) (PELI1, Accession NM_020651). Accordingly, utilities of VGAM1326 include diagnosis, prevention and treatment of diseases and clinical conditions associated with PELI1. SCAMP-4 (Accession NM_079834) is another VGAM1326 host target gene. SCAMP-4 BINDING SITE is HOST TARGET binding site found in the 3' untranslated region of mRNA encoded by SCAMP-4, corresponding to a HOST TARGET binding site such as BINDING SITE I, BINDING SITE II or BINDING SITE III. Table 2 illustrates the complementarity of the nucleotide sequences of SCAMP-4 BINDING SITE, designated SEQ ID:27818, to the nucleotide sequence of VGAM1326 RNA, herein designated VGAM RNA, also designated SEQ ID:4037.

Another function of VGAM1326 is therefore inhibition of SCAMP-4 (Accession NM_079834). Accordingly, utilities of VGAM1326 include diagnosis, prevention and treatment of diseases and clinical conditions associated with SCAMP-4. Small EDRK-rich Factor 1B (centromeric) (SERF1B, Accession NM_022978) is another VGAM1326 host target gene. SERF1B BINDING SITE is HOST TARGET binding site found in the 3' untranslated region of mRNA encoded by SERF1B, corresponding to a HOST TARGET binding site such as BINDING SITE I, BINDING SITE II or BINDING SITE III. Table 2 illustrates the complementarity of the nucleotide sequences of SERF1B BINDING SITE, designated SEQ ID:23256, to the nucleotide sequence of VGAM1326 RNA, herein designated VGAM RNA, also designated SEQ ID:4037.

Another function of VGAM1326 is therefore inhibition of Small EDRK-rich Factor 1B (centromeric) (SERF1B, Accession NM_022978). Accordingly, utilities of VGAM1326 include diagnosis, prevention and treatment of diseases and clinical conditions associated with SERF1B. SS-56 (Accession XM_006063) is another VGAM1326 host target gene. SS-56 BINDING SITE is HOST TARGET binding site found in the 3' untranslated region of mRNA encoded by SS-56, corresponding to a HOST TARGET binding site such as BINDING SITE I, BINDING SITE II or BINDING SITE III. Table 2 illustrates the complementarity of the nucleotide sequences of SS-56 BINDING SITE, designated SEQ ID:29988, to the nucleotide sequence of VGAM1326 RNA, herein designated VGAM RNA, also designated SEQ ID:4037.

Another function of VGAM1326 is therefore inhibition of SS-56 (Accession XM_006063). Accordingly, utilities of VGAM1326 include diagnosis, prevention and treatment of diseases and clinical conditions associated with SS-56. Serine/threonine Kinase 33 (STK33, Accession XM_031831) is another VGAM1326 host target gene. STK33 BINDING SITE is HOST TARGET binding site found in the 5' untranslated region of mRNA encoded by STK33, corresponding to a HOST TARGET binding site such as BINDING SITE I, BINDING SITE II or BINDING SITE III. Table 2 illustrates the complementarity of the nucleotide sequences of STK33 BINDING SITE, designated SEQ ID:31495, to the nucleotide sequence of VGAM1326 RNA, herein designated VGAM RNA, also designated SEQ ID:4037.

Another function of VGAM1326 is therefore inhibition of Serine/threonine Kinase 33 (STK33, Accession XM_031831). Accordingly, utilities of VGAM1326 include diagnosis, prevention and treatment of diseases and clinical conditions associated with STK33. SUN1 (Accession NM_025154) is another VGAM1326 host target gene. SUN1 BINDING SITE is HOST TARGET binding site found in the 3' untranslated region of mRNA encoded by SUN1, corresponding to a HOST TARGET binding site such as BINDING SITE I, BINDING SITE II or BINDING SITE III. Table 2 illustrates the complementarity of the nucleotide sequences of SUN1 BINDING SITE, designated SEQ ID:24792, to the nucleotide sequence of VGAM1326 RNA, herein designated VGAM RNA, also designated SEQ ID:4037.

Another function of VGAM1326 is therefore inhibition of SUN1 (Accession NM_025154). Accordingly, utilities of VGAM1326 include diagnosis, prevention and treatment of diseases and clinical conditions associated with SUN1. LOC112724 (Accession NM_138412) is another VGAM1326 host target gene. LOC112724 BINDING SITE is HOST TARGET binding site found in the 5' untranslated region of mRNA encoded by LOC112724, corresponding to a HOST TARGET binding site such as BINDING SITE I, BINDING SITE II or BINDING SITE III. Table 2 illustrates the complementarity of the nucleotide sequences of LOC112724 BINDING SITE, designated SEQ ID:28778, to the nucleotide sequence of VGAM1326 RNA, herein designated VGAM RNA, also designated SEQ ID:4037.

Another function of VGAM1326 is therefore inhibition of LOC112724 (Accession NM_138412). Accordingly, utilities of VGAM1326 include diagnosis, prevention and treatment of diseases and clinical conditions associated with LOC112724. LOC112817 (Accession NM_138413) is another VGAM1326 host target gene. LOC112817 BINDING SITE is HOST TARGET binding site found in the 3' untranslated region of mRNA encoded by LOC112817, corresponding to a HOST TARGET binding site such as BINDING SITE I, BINDING SITE II or BINDING SITE III. Table 2 illustrates the complementarity of the nucleotide sequences of LOC112817 BINDING SITE, designated SEQ ID:28780, to the nucleotide sequence of VGAM1326 RNA, herein designated VGAM RNA, also designated SEQ ID:4037.

Another function of VGAM1326 is therefore inhibition of LOC112817 (Accession NM_138413). Accordingly, utilities of VGAM1326 include diagnosis, prevention and treatment of diseases and clinical conditions associated with LOC112817. LOC135398 (Accession XM_069333) is another VGAM1326 host target gene. LOC135398 BINDING SITE is HOST TARGET binding site found in the 3' untranslated region of mRNA encoded by LOC135398, corresponding to a HOST TARGET binding site such as BINDING SITE I, BINDING SITE II or BINDING SITE III. Table 2 illustrates the complementarity of the nucleotide sequences of LOC135398 BINDING SITE, designated SEQ ID:37385, to the nucleotide sequence of VGAM1326 RNA, herein designated VGAM RNA, also designated SEQ ID:4037.

Another function of VGAM1326 is therefore inhibition of LOC135398 (Accession XM_069333). Accordingly, utilities of VGAM1326 include diagnosis, prevention and treatment of diseases and clinical conditions associated with LOC135398. LOC146050 (Accession XM_085301) is another VGAM1326 host target gene. LOC146050 BINDING SITE is HOST TARGET binding site found in the 3' untranslated region of mRNA encoded by LOC146050, corresponding to a HOST TARGET binding site such as BINDING SITE I, BINDING SITE II or BINDING SITE III. Table 2 illustrates the complementarity of the nucleotide sequences of LOC146050 BINDING SITE, designated SEQ ID:38053, to the nucleotide sequence of VGAM1326 RNA, herein designated VGAM RNA, also designated SEQ ID:4037.

Another function of VGAM1326 is therefore inhibition of LOC146050 (Accession XM_085301). Accordingly, utilities of VGAM1326 include diagnosis, prevention and treatment of diseases and clinical conditions associated with LOC146050. LOC152220 (Accession XM_098176) is another VGAM1326 host target gene. LOC152220 BINDING SITE is HOST TARGET binding site found in the 3' untranslated region of mRNA encoded by LOC152220, corresponding to a HOST TARGET binding site such as BINDING SITE I, BINDING SITE II or BINDING SITE III. Table 2 illustrates the complementarity of the nucleotide sequences of LOC152220 BINDING SITE, designated SEQ ID:41440, to the nucleotide sequence of VGAM1326 RNA, herein designated VGAM RNA, also designated SEQ ID:4037.

Another function of VGAM1326 is therefore inhibition of LOC152220 (Accession XM_098176). Accordingly, utilities of VGAM1326 include diagnosis, prevention and treatment of diseases and clinical conditions associated with LOC152220. LOC152300 (Accession XM_087432) is another VGAM1326 host target gene. LOC152300 BINDING SITE is HOST TARGET binding site found in the 3' untranslated region of mRNA encoded by LOC152300, corresponding to a HOST TARGET binding site such as BIND- ING SITE I, BINDING SITE II or BINDING SITE III. Table 2 illustrates the complementarity of the nucleotide sequences of LOC152300 BINDING SITE, designated SEQ ID:39249, to the nucleotide sequence of VGAM1326 RNA, herein designated VGAM RNA, also designated SEQ ID:4037.

Another function of VGAM1326 is therefore inhibition of LOC152300 (Accession XM_087432). Accordingly, utilities of VGAM1326 include diagnosis, prevention and treatment of diseases and clinical conditions associated with LOC152300. LOC158293 (Accession XM_088541) is another VGAM1326 host target gene. LOC158293 BINDING SITE is HOST TARGET binding site found in the 3' untranslated region of mRNA encoded by LOC158293, corresponding to a HOST TARGET binding site such as BINDING SITE I, BINDING SITE II or BINDING SITE III. Table 2 illustrates the complementarity of the nucleotide sequences of LOC158293 BINDING SITE, designated SEQ ID:39807, to the nucleotide sequence of VGAM1326 RNA, herein designated VGAM RNA, also designated SEQ ID:4037.

Another function of VGAM1326 is therefore inhibition of LOC158293 (Accession XM_088541). Accordingly, utilities of VGAM1326 include diagnosis, prevention and treatment of diseases and clinical conditions associated with LOC158293. LOC196264 (Accession XM_113683) is another VGAM1326 host target gene. LOC196264 BINDING SITE is HOST TARGET binding site found in the 3' untranslated region of mRNA encoded by LOC196264, corresponding to a HOST TARGET binding site such as BINDING SITE I, BINDING SITE II or BINDING SITE III. Table 2 illustrates the complementarity of the nucleotide sequences of LOC196264 BINDING SITE, designated SEQ ID:42331, to the nucleotide sequence of VGAM1326 RNA, herein designated VGAM RNA, also designated SEQ ID:4037.

Another function of VGAM1326 is therefore inhibition of LOC196264 (Accession XM_113683). Accordingly, utilities of VGAM1326 include diagnosis, prevention and treatment of diseases and clinical conditions associated with LOC196264. LOC200316 (Accession XM_114205) is another VGAM1326 host target gene. LOC200316 BINDING SITE is HOST TARGET binding site found in the 3' untranslated region of mRNA encoded by LOC200316, corresponding to a HOST TARGET binding site such as BINDING SITE I, BINDING SITE II or BINDING SITE III. Table 2 illustrates the complementarity of the nucleotide sequences of LOC200316 BINDING SITE, designated SEQ ID:42795, to the nucleotide sequence of VGAM1326 RNA, herein designated VGAM RNA, also designated SEQ ID:4037.

Another function of VGAM1326 is therefore inhibition of LOC200316 (Accession XM_114205). Accordingly, utilities of VGAM1326 include diagnosis, prevention and treatment of diseases and clinical conditions associated with LOC200316. LOC200471 (Accession XM_117234) is another VGAM1326 host target gene. LOC200471 BINDING SITE is HOST TARGET binding site found in the 5' untranslated region of mRNA encoded by LOC200471, corresponding to a HOST TARGET binding site such as BINDING SITE I, BINDING SITE II or BINDING SITE III. Table 2 illustrates the complementarity of the nucleotide sequences of LOC200471 BINDING SITE, designated SEQ ID:43304, to the nucleotide sequence of VGAM1326 RNA, herein designated VGAM RNA, also designated SEQ ID:4037.

Another function of VGAM1326 is therefore inhibition of LOC200471 (Accession XM_117234). Accordingly, utilities of VGAM1326 include diagnosis, prevention and treatment of diseases and clinical conditions associated with LOC200471. LOC202908 (Accession XM_114602) is another VGAM1326 host target gene. LOC202908 BINDING SITE is HOST TARGET binding site found in the 5' untranslated region of mRNA encoded by LOC202908, corresponding to a HOST TARGET binding site such as BINDING SITE I, BINDING SITE II or BINDING SITE III. Table 2 illustrates the complementarity of the nucleotide sequences of LOC202908 BINDING SITE, designated SEQ ID:42994, to the nucleotide sequence of VGAM1326 RNA, herein designated VGAM RNA, also designated SEQ ID:4037.

Another function of VGAM1326 is therefore inhibition of LOC202908 (Accession XM_114602). Accordingly, utilities of VGAM1326 include diagnosis, prevention and treatment of diseases and clinical conditions associated with LOC202908. LOC203350 (Accession XM_117536) is another VGAM1326 host target gene. LOC203350 BINDING SITE is HOST TARGET binding site found in the 3' untranslated region of mRNA encoded by LOC203350, corresponding to a HOST TARGET binding site such as BINDING SITE I, BINDING SITE II or BINDING SITE III. Table 2 illustrates the complementarity of the nucleotide sequences of LOC203350 BINDING SITE, designated SEQ ID:43529, to the nucleotide sequence of VGAM1326 RNA, herein designated VGAM RNA, also designated SEQ ID:4037.

Another function of VGAM1326 is therefore inhibition of LOC203350 (Accession XM_117536). Accordingly, utilities of VGAM1326 include diagnosis, prevention and treatment of diseases and clinical conditions associated with LOC203350. LOC220074 (Accession NM_145309) is another VGAM1326 host target gene. LOC220074 BINDING SITE is HOST TARGET binding site found in the 3' untranslated region of mRNA encoded by LOC220074, corresponding to a HOST TARGET binding site such as BINDING SITE I, BINDING SITE II or BINDING SITE III. Table 2 illustrates the complementarity of the nucleotide sequences of LOC220074 BINDING SITE, designated SEQ ID:29822, to the nucleotide sequence of VGAM1326 RNA, herein designated VGAM RNA, also designated SEQ ID:4037.

Another function of VGAM1326 is therefore inhibition of LOC220074 (Accession NM_145309). Accordingly, utilities of VGAM1326 include diagnosis, prevention and treatment of diseases and clinical conditions associated with LOC220074. LOC221477 (Accession XM_166397) is another VGAM1326 host target gene. LOC221477 BINDING SITE is HOST TARGET binding site found in the 3' untranslated region of mRNA encoded by LOC221477, corresponding to a HOST TARGET binding site such as BINDING SITE I, BINDING SITE II or BINDING SITE III. Table 2 illustrates the complementarity of the nucleotide sequences of LOC221477 BINDING SITE, designated SEQ ID:44259, to the nucleotide sequence of VGAM1326 RNA, herein designated VGAM RNA, also designated SEQ ID:4037.

Another function of VGAM1326 is therefore inhibition of LOC221477 (Accession XM_166397). Accordingly, utilities of VGAM1326 include diagnosis, prevention and treatment of diseases and clinical conditions associated with LOC221477. LOC254249 (Accession XM_170931) is another VGAM1326 host target gene. LOC254249 BINDING SITE is HOST TARGET binding site found in the 5' untranslated region of mRNA encoded by LOC254249, corresponding to a HOST TARGET binding site such as BINDING SITE I, BINDING SITE II or BINDING SITE III. Table 2 illustrates the complementarity of the nucleotide sequences of LOC254249 BINDING SITE, designated SEQ ID:45712, to the nucleotide sequence of VGAM1326 RNA, herein designated VGAM RNA, also designated SEQ ID:4037.

Another function of VGAM1326 is therefore inhibition of LOC254249 (Accession XM_170931). Accordingly, utilities of VGAM1326 include diagnosis, prevention and treatment of diseases and clinical conditions associated with LOC254249. LOC50999 (Accession NM_016040) is another VGAM1326 host target gene. LOC50999 BINDING SITE is HOST TARGET binding site found in the 3' untranslated region of mRNA encoded by LOC50999, corresponding to a HOST TARGET binding site such as BINDING SITE I, BINDING SITE II or BINDING SITE III. Table 2 illustrates the complementarity of the nucleotide sequences of LOC50999 BINDING SITE, designated SEQ ID:18119, to the nucleotide sequence of VGAM1326 RNA, herein designated VGAM RNA, also designated SEQ ID:4037.

Another function of VGAM1326 is therefore inhibition of LOC50999 (Accession NM_016040). Accordingly, utilities of VGAM1326 include diagnosis, prevention and treatment of diseases and clinical conditions associated with LOC50999. LOC90141 (Accession XM_029373) is another VGAM1326 host target gene. LOC90141 BINDING SITE is HOST TARGET binding site found in the 3' untranslated region of mRNA encoded by LOC90141, corresponding to a HOST TARGET binding site such as BINDING SITE I, BINDING SITE II or BINDING SITE III. Table 2 illustrates the complementarity of the nucleotide sequences of LOC90141 BINDING SITE, designated SEQ ID:30879, to the nucleotide sequence of VGAM1326 RNA, herein designated VGAM RNA, also designated SEQ ID:4037.

Another function of VGAM1326 is therefore inhibition of LOC90141 (Accession XM_029373). Accordingly, utilities of VGAM1326 include diagnosis, prevention and treatment of diseases and clinical conditions associated with LOC90141. LOC93276 (Accession XM_050200) is another VGAM1326 host target gene. LOC93276 BINDING SITE is HOST TARGET binding site found in the 5' untranslated region of mRNA encoded by LOC93276, corresponding to a HOST TARGET binding site such as BINDING SITE I, BINDING SITE II or BINDING SITE III. Table 2 illustrates the complementarity of the nucleotide sequences of LOC93276 BINDING SITE, designated SEQ ID:35589, to the nucleotide sequence of VGAM1326 RNA, herein designated VGAM RNA, also designated SEQ ID:4037.

Another function of VGAM1326 is therefore inhibition of LOC93276 (Accession XM_050200). Accordingly, utilities of VGAM1326 include diagnosis, prevention and treatment of diseases and clinical conditions associated with LOC93276. FIG. 1 further provides a conceptual description of a novel bioinformatically detected viral gene of the present invention, referred to here as Viral Genomic Address Messenger 1327 (VGAM1327) viral gene, which modulates expression of respective host target genes thereof, the function and utility of which host target genes is known in the art.

VGAM1327 is a novel bioinformatically detected regulatory, non protein coding, viral micro RNA (miRNA) gene. The method by which VGAM1327 was detected is described hereinabove with reference to FIGS. 1-8.

VGAM1327 gene, herein designated VGAM GENE, is a viral gene contained in the genome of Myxoma Virus. VGAM1327 host target gene, herein designated VGAM HOST TARGET GENE, is a human gene contained in the human genome.

VGAM1327 gene encodes a VGAM1327 precursor RNA, herein designated VGAM PRECURSOR RNA. Similar to other miRNA genes, and unlike most ordinary genes, VGAM1327 precursor RNA does not encode a protein. A nucleotide sequence identical or highly similar to the nucleotide sequence of VGAM1327 precursor RNA is designated SEQ ID:1313, and is provided hereinbelow with reference to the sequence listing part. Nucleotide sequence SEQ ID:1313 is located at position 86115 relative to the genome of Myxoma Virus.

VGAM1327 precursor RNA folds onto itself, forming VGAM1327 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1327 folded precursor RNA into VGAM1327 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1327 RNA is designated SEQ ID:4038, and is provided hereinbelow with reference to the sequence listing part.

VGAM1327 host target gene, herein designated VGAM HOST TARGET GENE, encodes a corresponding messenger RNA, VGAM1327 host target RNA, herein designated VGAM HOST TARGET RNA. VGAM1327 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1327 RNA, herein designated VGAM RNA, binds complementarily to one or more host target binding sites located in untranslated regions of VGAM1327 host target RNA, herein designated VGAM HOST TARGET RNA. This complementary binding is due to the fact that the nucleotide sequence of VGAM1327 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1327 RNA, herein designated VGAM RNA, may have a different number of host target binding sites in untranslated regions of a VGAM1327 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1327 RNA, herein designated VGAM RNA, to host target binding sites on VGAM1327 host target RNA, herein designated VGAM HOST TARGET RNA, such as BINDING SITE I, BINDING SITE II and BINDING SITE III, inhibits translation of VGAM1327 host target RNA into VGAM1327 host target protein, herein designated VGAM HOST TARGET PROTEIN. VGAM host target protein is therefore outlined by a broken line.

It is appreciated that VGAM1327 host target gene, herein designated VGAM HOST TARGET GENE, in fact represents a plurality of VGAM1327 host target genes. The mRNA of each one of this plurality of VGAM1327 host target genes comprises one or more host target binding sites, each having a nucleotide sequence which is at least partly complementary to VGAM1327 RNA, herein designated VGAM RNA, and which when bound by VGAM1327 RNA causes inhibition of translation of respective one or more VGAM1327 host target proteins.

It is further appreciated by one skilled in the art that the mode of translational inhibition illustrated by FIG. 1 with specific reference to translational inhibition exerted by VGAM1327 gene, herein designated VGAM GENE, on one or more VGAM1327 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1327 is inhibition of expression of host target genes, as part of a novel viral mechanism of attacking a host. Accordingly, utilities of VGAM1327 include diagnosis, prevention and treatment of viral infection by Myxoma Virus. Specific functions, and accordingly utilities, of VGAM1327 correlate with, and may be deduced from, the identity of the host target genes which VGAM1327 binds and inhibits, and the function of these host target genes, as elaborated hereinbelow.

Nucleotide sequences of the VGAM1327 precursor RNA, herein designated VGAM PRECURSOR RNA, and of the 'diced' VGAM1327 RNA, herein designated VGAM RNA, and a schematic representation of the secondary folding of VGAM1327 folded precursor RNA, herein designated VGAM FOLDED PRECURSOR RNA, of VGAM1327 are further described hereinbelow with reference to Table 1.

Nucleotide sequences of host target binding sites, such as BINDING SITE-I, BINDING SITE-II and BINDING SITE-III of FIG. 1, found on VGAM1327 host target RNA, and schematic representation of the complementarity of each of these host target binding sites to VGAM1327 RNA, herein designated VGAM RNA, are described hereinbelow with reference to Table 2.

As mentioned hereinabove with reference to FIG. 1, a function of VGAM1327 gene, herein designated VGAM is inhibition of expression of VGAM1327 target genes. It is appreciated that specific functions, and accordingly utilities, of VGAM1327 correlate with, and may be deduced from, the identity of the target genes which VGAM1327 binds and inhibits, and the function of these target genes, as elaborated hereinbelow.

Coronin, Actin Binding Protein, 2B (CORO2B, Accession XM_035403) is a VGAM1327 host target gene. CORO2B BINDING SITE is HOST TARGET binding site found in the 3' untranslated region of mRNA encoded by CORO2B, corresponding to a HOST TARGET binding site such as BINDING SITE I, BINDING SITE II or BINDING SITE III. Table 2 illustrates the complementarity of the nucleotide sequences of CORO2B BINDING SITE, designated SEQ ID:32256, to the nucleotide sequence of VGAM1327 RNA, herein designated VGAM RNA, also designated SEQ ID:4038.

A function of VGAM1327 is therefore inhibition of Coronin, Actin Binding Protein, 2B (CORO2B, Accession XM_035403), a gene which may play a role in the reorganization of neuronal actin structure. Accordingly, utilities of VGAM1327 include diagnosis, prevention and treatment of diseases and clinical conditions associated with CORO2B. The function of CORO2B and its association with various diseases and clinical conditions, has been established by previous studies, as described hereinabove with reference to VGAM923. Lymphoid Enhancer-binding Factor 1 (LEF1, Accession NM_016269) is another VGAM1327 host target gene. LEF1 BINDING SITE is HOST TARGET binding site found in the 3' untranslated region of mRNA encoded by LEF1, corresponding to a HOST TARGET binding site such as BINDING SITE I, BINDING SITE II or BINDING SITE III. Table 2 illustrates the complementarity of the nucleotide sequences of LEF1 BINDING SITE, designated SEQ ID:18391, to the nucleotide sequence of VGAM1327 RNA, herein designated VGAM RNA, also designated SEQ ID:4038.

Another function of VGAM1327 is therefore inhibition of Lymphoid Enhancer-binding Factor 1 (LEF1, Accession NM_016269), a gene which plays an essential role in the formation of several organs and structures that require inductive tissue interactions. Accordingly, utilities of VGAM1327 include diagnosis, prevention and treatment of diseases and clinical conditions associated with LEF1. The function of LEF1 and its association with various diseases and clinical conditions, has been established by previous studies, as described hereinabove with reference to VGAM200. FIG. 1 further provides a conceptual description of a novel bioinformatically detected viral gene of the present invention, referred to here as Viral Genomic Address Messenger 1328 (VGAM1328) viral gene, which modulates expression of respective host target genes thereof, the function and utility of which host target genes is known in the art.

VGAM1328 is a novel bioinformatically detected regulatory, non protein coding, viral micro RNA (miRNA) gene. The method by which VGAM1328 was detected is described hereinabove with reference to FIGS. 1-8.

VGAM1328 gene, herein designated VGAM GENE, is a viral gene contained in the genome of Myxoma Virus. VGAM1328 host target gene, herein designated VGAM HOST TARGET GENE, is a human gene contained in the human genome.

VGAM1328 gene encodes a VGAM1328 precursor RNA, herein designated VGAM PRECURSOR RNA. Similar to other miRNA genes, and unlike most ordinary genes, VGAM1328 precursor RNA does not encode a protein. A nucleotide sequence identical or highly similar to the nucleotide sequence of VGAM1328 precursor RNA is designated SEQ ID:1314, and is provided hereinbelow with reference to the sequence listing part. Nucleotide sequence SEQ ID:1314 is located at position 84471 relative to the genome of Myxoma Virus.

VGAM1328 precursor RNA folds onto itself, forming VGAM1328 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1328 folded precursor RNA into VGAM1328 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1328 RNA is designated SEQ ID:4039, and is provided hereinbelow with reference to the sequence listing part.

VGAM1328 host target gene, herein designated VGAM HOST TARGET GENE, encodes a corresponding messenger RNA, VGAM1328 host target RNA, herein designated VGAM HOST TARGET RNA. VGAM1328 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1328 RNA, herein designated VGAM RNA, binds complementarily to one or more host target binding sites located in untranslated regions of VGAM1328 host target RNA, herein designated VGAM HOST TARGET RNA. This complementary binding is due to the fact that the nucleotide sequence of VGAM1328 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1328 RNA, herein designated VGAM RNA, may have a different number of host target binding sites in untranslated regions of a VGAM1328 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1328 RNA, herein designated VGAM RNA, to host target binding sites on VGAM1328 host target RNA, herein designated VGAM HOST TARGET RNA, such as BINDING SITE I, BINDING SITE II and BINDING SITE III, inhibits translation of VGAM1328 host target RNA into VGAM1328 host target protein, herein designated VGAM HOST TARGET PROTEIN. VGAM host target protein is therefore outlined by a broken line.

It is appreciated that VGAM1328 host target gene, herein designated VGAM HOST TARGET GENE, in fact represents a plurality of VGAM1328 host target genes. The mRNA of each one of this plurality of VGAM1328 host target genes comprises one or more host target binding sites, each having a nucleotide sequence which is at least partly complementary to VGAM1328 RNA, herein designated VGAM RNA, and which when bound by VGAM1328 RNA causes inhibition of translation of respective one or more VGAM1328 host target proteins.

It is further appreciated by one skilled in the art that the mode of translational inhibition illustrated by FIG. 1 with specific reference to translational inhibition exerted by VGAM1328 gene, herein designated VGAM GENE, on one or more VGAM1328 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1328 is inhibition of expression of host target genes, as part of a novel viral mechanism of attacking a host. Accordingly, utilities of VGAM1328 include diagnosis, prevention and treatment of viral infection by Myxoma Virus. Specific functions, and accordingly utilities, of VGAM1328 correlate with, and may be deduced from, the identity of the host target genes which VGAM1328 binds and inhibits, and the function of these host target genes, as elaborated hereinbelow.

Nucleotide sequences of the VGAM1328 precursor RNA, herein designated VGAM PRECURSOR RNA, and of the 'diced' VGAM1328 RNA, herein designated VGAM RNA, and a schematic representation of the secondary folding of VGAM1328 folded precursor RNA, herein designated VGAM FOLDED PRECURSOR RNA, of VGAM1328 are further described hereinbelow with reference to Table 1.

Nucleotide sequences of host target binding sites, such as BINDING SITE-I, BINDING SITE-II and BINDING SITE-III of FIG. 1, found on VGAM1328 host target RNA, and schematic representation of the complementarity of each of these host target binding sites to VGAM1328 RNA, herein designated VGAM RNA, are described hereinbelow with reference to Table 2.

As mentioned hereinabove with reference to FIG. 1, a function of VGAM1328 gene, herein designated VGAM is inhibition of expression of VGAM1328 target genes. It is appreciated that specific functions, and accordingly utilities, of VGAM1328 correlate with, and may be deduced from, the identity of the target genes which VGAM1328 binds and inhibits, and the function of these target genes, as elaborated hereinbelow.

Inositol 1,4,5-triphosphate Receptor, Type 2 (ITPR2, Accession NM_002223) is a VGAM1328 host target gene. ITPR2 BINDING SITE is HOST TARGET binding site found in the 3' untranslated region of mRNA encoded by ITPR2, corresponding to a HOST TARGET binding site such as BINDING SITE I, BINDING SITE II or BINDING SITE III. Table 2 illustrates the complementarity of the nucleotide sequences of ITPR2 BINDING SITE, designated SEQ ID:7994, to the nucleotide sequence of VGAM1328 RNA, herein designated VGAM RNA, also designated SEQ ID:4039.

A function of VGAM1328 is therefore inhibition of Inositol 1,4,5-triphosphate Receptor, Type 2 (ITPR2, Accession NM_002223). Accordingly, utilities of VGAM1328 include diagnosis, prevention and treatment of diseases and clinical conditions associated with ITPR2. Solute Carrier Family 19 (thiamine transporter), Member 2 (SLC19A2, Accession XM_044421) is another VGAM1328 host target gene. SLC19A2 BINDING SITE is HOST TARGET binding site found in the 3' untranslated region of mRNA encoded by SLC19A2, corresponding to a HOST TARGET binding site such as BINDING SITE I, BINDING SITE II or BINDING SITE III. Table 2 illustrates the complementarity of the nucleotide sequences of SLC19A2 BINDING SITE, designated SEQ ID:34195, to the nucleotide sequence of VGAM1328 RNA, herein designated VGAM RNA, also designated SEQ ID:4039.

Another function of VGAM1328 is therefore inhibition of Solute Carrier Family 19 (thiamine transporter), Member 2 (SLC19A2, Accession XM_044421). Accordingly, utilities of VGAM1328 include diagnosis, prevention and treatment of diseases and clinical conditions associated with SLC19A2. Chromosome 1 Open Reading Frame 24 (C1orf24, Accession NM_052966) is another VGAM1328 host target gene. C1orf24 BINDING SITE is HOST TARGET binding site found in the 3' untranslated region of mRNA encoded by C1orf24, corresponding to a HOST TARGET binding site such as BINDING SITE I, BINDING SITE II or BINDING SITE III. Table 2 illustrates the complementarity of the nucleotide sequences of C1orf24 BINDING SITE, designated SEQ ID:27534, to the nucleotide sequence of VGAM1328 RNA, herein designated VGAM RNA, also designated SEQ ID:4039.

Another function of VGAM1328 is therefore inhibition of Chromosome 1 Open Reading Frame 24 (C1orf24, Accession NM_052966). Accordingly, utilities of VGAM1328 include diagnosis, prevention and treatment of diseases and clinical conditions associated with C1orf24. Chromosome 20 Open Reading Frame 82 (C20orf82, Accession XM_097736) is another VGAM1328 host target gene. C20orf82 BINDING SITE is HOST TARGET binding site found in the 3' untranslated region of mRNA encoded by C20orf82, corresponding to a HOST TARGET binding site such as BINDING SITE I, BINDING SITE II or BINDING SITE III. Table 2 illustrates the complementarity of the nucleotide sequences of C20orf82 BINDING SITE, designated SEQ ID:41084, to the nucleotide sequence of VGAM1328 RNA, herein designated VGAM RNA, also designated SEQ ID:4039.

Another function of VGAM1328 is therefore inhibition of Chromosome 20 Open Reading Frame 82 (C20orf82, Accession XM_097736). Accordingly, utilities of VGAM1328 include diagnosis, prevention and treatment of diseases and clinical conditions associated with C20orf82. KIAA0217 (Accession XM_040265) is another VGAM1328 host target gene. KIAA0217 BINDING SITE is HOST TARGET binding site found in the 3' untranslated region of mRNA encoded by KIAA0217, corresponding to a HOST TARGET binding site such as BINDING SITE I, BINDING SITE II or BINDING SITE III. Table 2 illustrates the complementarity of the nucleotide sequences of KIAA0217 BINDING SITE, designated SEQ ID:33277, to the nucleotide sequence of VGAM1328 RNA, herein designated VGAM RNA, also designated SEQ ID:4039.

Another function of VGAM1328 is therefore inhibition of KIAA0217 (Accession XM_040265). Accordingly, utilities of VGAM1328 include diagnosis, prevention and treatment of diseases and clinical conditions associated with KIAA0217. KIAA0729 (Accession XM_171027) is another VGAM1328 host target gene. KIAA0729 BINDING SITE is HOST TARGET binding site found in the 3' untranslated region of mRNA encoded by KIAA0729, corresponding to a HOST TARGET binding site such as BINDING SITE I, BINDING SITE II or BINDING SITE III. Table 2 illustrates the complementarity of the nucleotide sequences of KIAA0729 BINDING SITE, designated SEQ ID:45806, to the nucleotide sequence of VGAM1328 RNA, herein designated VGAM RNA, also designated SEQ ID:4039.

Another function of VGAM1328 is therefore inhibition of KIAA0729 (Accession XM_171027). Accordingly, utilities of VGAM1328 include diagnosis, prevention and treatment of diseases and clinical conditions associated with KIAA0729. LOC253017 (Accession XM_171068) is another VGAM1328 host target gene. LOC253017 BINDING SITE is HOST TARGET binding site found in the 5' untranslated region of mRNA encoded by LOC253017, corresponding to a HOST TARGET binding site such as BINDING SITE I, BINDING SITE II or BINDING SITE III. Table 2 illustrates the complementarity of the nucleotide sequences of LOC253017 BINDING SITE, designated SEQ ID:45870, to the nucleotide sequence of VGAM1328 RNA, herein designated VGAM RNA, also designated SEQ ID:4039.

Another function of VGAM1328 is therefore inhibition of LOC253017 (Accession XM_171068). Accordingly, utilities of VGAM1328 include diagnosis, prevention and treatment of diseases and clinical conditions associated with LOC253017. FIG. 1 further provides a conceptual description of a novel bioinformatically detected viral gene of the present invention, referred to here as Viral Genomic Address Messenger 1329 (VGAM1329) viral gene, which modulates expression of respective host target genes thereof, the function and utility of which host target genes is known in the art.

VGAM1329 is a novel bioinformatically detected regulatory, non protein coding, viral micro RNA (miRNA) gene. The method by which VGAM1329 was detected is described hereinabove with reference to FIGS. 1-8.

VGAM1329 gene, herein designated VGAM GENE, is a viral gene contained in the genome of Garlic Virus C. VGAM1329 host target gene, herein designated VGAM HOST TARGET GENE, is a human gene contained in the human genome.

VGAM1329 gene encodes a VGAM1329 precursor RNA, herein designated VGAM PRECURSOR RNA. Similar to other miRNA genes, and unlike most ordinary genes, VGAM1329 precursor RNA does not encode a protein. A nucleotide sequence identical or highly similar to the nucleotide sequence of VGAM1329 precursor RNA is designated SEQ ID:1315, and is provided hereinbelow with reference to the sequence listing part. Nucleotide sequence SEQ ID:1315 is located at position 7174 relative to the genome of Garlic Virus C.

VGAM1329 precursor RNA folds onto itself, forming VGAM1329 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1329 folded precursor RNA into VGAM1329 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1329 RNA is designated SEQ ID:4040, and is provided hereinbelow with reference to the sequence listing part.

VGAM1329 host target gene, herein designated VGAM HOST TARGET GENE, encodes a corresponding messenger RNA, VGAM1329 host target RNA, herein designated VGAM HOST TARGET RNA. VGAM1329 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1329 RNA, herein designated VGAM RNA, binds complementarily to one or more host target binding sites located in untranslated regions of VGAM1329 host target RNA, herein designated VGAM HOST TARGET RNA. This complementary binding is due to the fact that the nucleotide sequence of VGAM1329 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1329 RNA, herein designated VGAM RNA, may have a different number of host target binding sites in untranslated regions of a VGAM1329 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1329 RNA, herein designated VGAM RNA, to host target binding sites on VGAM1329 host target RNA, herein designated VGAM HOST TARGET RNA, such as BINDING SITE I, BINDING SITE II and BINDING SITE III, inhibits translation of VGAM1329 host target RNA into VGAM1329 host target protein, herein designated VGAM HOST TARGET PROTEIN. VGAM host target protein is therefore outlined by a broken line.

It is appreciated that VGAM1329 host target gene, herein designated VGAM HOST TARGET GENE, in fact represents a plurality of VGAM1329 host target genes. The mRNA of each one of this plurality of VGAM1329 host target genes comprises one or more host target binding sites, each having a nucleotide sequence which is at least partly complementary to VGAM1329 RNA, herein designated VGAM RNA, and which when bound by VGAM1329 RNA causes inhibition of translation of respective one or more VGAM1329 host target proteins.

It is further appreciated by one skilled in the art that the mode of translational inhibition illustrated by FIG. 1 with specific reference to translational inhibition exerted by VGAM1329 gene, herein designated VGAM GENE, on one or more VGAM1329 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1329 is inhibition of expression of host target genes, as part of a novel viral mechanism of attacking a host. Accordingly, utilities of VGAM1329 include diagnosis, prevention and treatment of viral infection by Garlic Virus C. Specific functions, and accordingly utilities, of VGAM1329 correlate with, and may be deduced from, the identity of the host target genes which VGAM1329 binds and inhibits, and the function of these host target genes, as elaborated hereinbelow.

Nucleotide sequences of the VGAM1329 precursor RNA, herein designated VGAM PRECURSOR RNA, and of the 'diced' VGAM1329 RNA, herein designated VGAM RNA, and a schematic representation of the secondary folding of VGAM1329 folded precursor RNA, herein designated VGAM FOLDED PRECURSOR RNA, of VGAM1329 are further described hereinbelow with reference to Table 1.

Nucleotide sequences of host target binding sites, such as BINDING SITE-I, BINDING SITE-II and BINDING SITE-III of FIG. 1, found on VGAM1329 host target RNA, and schematic representation of the complementarity of each of these host target binding sites to VGAM1329 RNA, herein designated VGAM RNA, are described hereinbelow with reference to Table 2.

As mentioned hereinabove with reference to FIG. 1, a function of VGAM1329 gene, herein designated VGAM is inhibition of expression of VGAM1329 target genes. It is appreciated that specific functions, and accordingly utilities, of VGAM1329 correlate with, and may be deduced from, the identity of the target genes which VGAM1329 binds and inhibits, and the function of these target genes, as elaborated hereinbelow.

Chromosome 20 Open Reading Frame 4 (C20orf4, Accession NM_015511) is a VGAM1329 host target gene. C20orf4 BINDING SITE is HOST TARGET binding site found in the 3' untranslated region of mRNA encoded by C20orf4, corresponding to a HOST TARGET binding site such as BINDING SITE I, BINDING SITE II or BINDING SITE III. Table 2 illustrates the complementarity of the nucleotide sequences of C20orf4 BINDING SITE, designated SEQ ID:17770, to the nucleotide sequence of VGAM1329 RNA, herein designated VGAM RNA, also designated SEQ ID:4040.

A function of VGAM1329 is therefore inhibition of Chromosome 20 Open Reading Frame 4 (C20orf4, Accession NM_015511). Accordingly, utilities of VGAM1329 include diagnosis, prevention and treatment of diseases and clinical conditions associated with C20orf4. Chromosome 9 Open Reading Frame 7 (C9orf7, Accession NM_017586) is another VGAM1329 host target gene. C9orf7 BINDING SITE is HOST TARGET binding site found in the 3' untranslated region of mRNA encoded by C9orf7, corresponding to a HOST TARGET binding site such as BINDING SITE I, BINDING SITE II or BINDING SITE III. Table 2 illustrates the complementarity of the nucleotide sequences of C9orf7 BINDING SITE, designated SEQ ID:19034, to the nucleotide sequence of VGAM1329 RNA, herein designated VGAM RNA, also designated SEQ ID:4040.

Another function of VGAM1329 is therefore inhibition of Chromosome 9 Open Reading Frame 7 (C9orf7, Accession NM_017586). Accordingly, utilities of VGAM1329 include diagnosis, prevention and treatment of diseases and clinical conditions associated with C9orf7. DKFZP762D096 (Accession XM_037662) is another VGAM1329 host target gene. DKFZP762D096 BINDING SITE is HOST TARGET binding site found in the 3' untranslated region of mRNA encoded by DKFZP762D096, corresponding to a HOST TARGET binding site such as BINDING SITE I, BINDING SITE II or BINDING SITE III. Table 2 illustrates the complementarity of the nucleotide sequences of DKFZP762D096 BINDING SITE, designated SEQ ID:32663, to the nucleotide sequence of VGAM1329 RNA, herein designated VGAM RNA, also designated SEQ ID:4040.

Another function of VGAM1329 is therefore inhibition of DKFZP762D096 (Accession XM_037662). Accordingly, utilities of VGAM1329 include diagnosis, prevention and treatment of diseases and clinical conditions associated with DKFZP762D096. FLJ10829 (Accession NM_018234) is another VGAM1329 host target gene. FLJ10829 BINDING SITE is HOST TARGET binding site found in the 3' untranslated region of mRNA encoded by FLJ10829, corresponding to a HOST TARGET binding site such as BINDING SITE I, BINDING SITE II or BINDING SITE III. Table 2 illustrates the complementarity of the nucleotide sequences of FLJ10829 BINDING SITE, designated SEQ ID:20176, to the nucleotide sequence of VGAM1329 RNA, herein designated VGAM RNA, also designated SEQ ID:4040.

Another function of VGAM1329 is therefore inhibition of FLJ10829 (Accession NM_018234). Accordingly, utilities of VGAM1329 include diagnosis, prevention and treatment of diseases and clinical conditions associated with FLJ10829. KIAA0255 (Accession NM_014742) is another VGAM1329 host target gene. KIAA0255 BINDING SITE is HOST TARGET binding site found in the 3' untranslated region of mRNA encoded by KIAA0255, corresponding to a HOST TARGET binding site such as BINDING SITE I, BINDING SITE II or BINDING SITE III. Table 2 illustrates the complementarity of the nucleotide sequences of KIAA0255 BINDING SITE, designated SEQ ID:16412, to the nucleotide sequence of VGAM1329 RNA, herein designated VGAM RNA, also designated SEQ ID:4040.

Another function of VGAM1329 is therefore inhibition of KIAA0255 (Accession NM_014742). Accordingly, utilities of VGAM1329 include diagnosis, prevention and treatment of diseases and clinical conditions associated with KIAA0255. LOC143909 (Accession XM_096506) is another VGAM1329 host target gene. LOC143909 BINDING SITE is HOST TARGET binding site found in the 5' untranslated region of mRNA encoded by LOC143909, corresponding to a HOST TARGET binding site such as BINDING SITE I, BINDING SITE II or BINDING SITE III. Table 2 illustrates the complementarity of the nucleotide sequences of LOC143909 BINDING SITE, designated SEQ ID:40386, to the nucleotide sequence of VGAM1329 RNA, herein designated VGAM RNA, also designated SEQ ID:4040.

Another function of VGAM1329 is therefore inhibition of LOC143909 (Accession XM_096506). Accordingly, utilities of VGAM1329 include diagnosis, prevention and treatment of diseases and clinical conditions associated with LOC143909. LOC151996 (Accession XM_098151) is another VGAM1329 host target gene. LOC151996 BINDING SITE is HOST TARGET binding site found in the 5' untranslated region of mRNA encoded by LOC151996, corresponding to a HOST TARGET binding site such as BINDING SITE I, BINDING SITE II or BINDING SITE III. Table 2 illustrates the complementarity of the nucleotide sequences of LOC151996 BINDING SITE, designated SEQ ID:41411, to the nucleotide sequence of VGAM1329 RNA, herein designated VGAM RNA, also designated SEQ ID:4040.

Another function of VGAM1329 is therefore inhibition of LOC151996 (Accession XM_098151). Accordingly, utilities of VGAM1329 include diagnosis, prevention and treatment of diseases and clinical conditions associated with LOC151996. LOC254042 (Accession XM_171022) is another VGAM1329 host target gene. LOC254042 BINDING SITE is HOST TARGET binding site found in the 3' untranslated region of mRNA encoded by LOC254042, corresponding to a HOST TARGET binding site such as BINDING SITE I, BINDING SITE II or BINDING SITE III. Table 2 illustrates the complementarity of the nucleotide sequences of LOC254042 BINDING SITE, designated SEQ ID:45790, to the nucleotide sequence of VGAM1329 RNA, herein designated VGAM RNA, also designated SEQ ID:4040.

Another function of VGAM1329 is therefore inhibition of LOC254042 (Accession XM_171022). Accordingly, utilities of VGAM1329 include diagnosis, prevention and treatment of diseases and clinical conditions associated with LOC254042. LOC256158 (Accession XM_175125) is another VGAM1329 host target gene. LOC256158 BINDING SITE1 and LOC256158 BINDING SITE2 are HOST TARGET binding sites found in untranslated regions of mRNA encoded by LOC256158, corresponding to HOST TARGET binding sites such as BINDING SITE I, BINDING SITE II or BINDING SITE III. Table 2 illustrates the complementarity of the nucleotide sequences of LOC256158 BINDING SITE1 and LOC256158 BINDING SITE2, designated SEQ ID:46614 and SEQ ID:46615 respectively, to the nucleotide sequence of VGAM1329 RNA, herein designated VGAM RNA, also designated SEQ ID:4040.

Another function of VGAM1329 is therefore inhibition of LOC256158 (Accession XM_175125). Accordingly, utilities of VGAM1329 include diagnosis, prevention and treatment of diseases and clinical conditions associated with LOC256158. FIG. 1 further provides a conceptual description of a novel bioinformatically detected viral gene of the present invention, referred to here as Viral Genomic Address Messenger 1330 (VGAM1330) viral gene, which modulates expression of respective host target genes thereof, the function and utility of which host target genes is known in the art.

VGAM1330 is a novel bioinformatically detected regulatory, non protein coding, viral micro RNA (miRNA) gene. The method by which VGAM1330 was detected is described hereinabove with reference to FIGS. 1-8.

VGAM1330 gene, herein designated VGAM GENE, is a viral gene contained in the genome of Human Adenovirus A. VGAM1330 host target gene, herein designated VGAM HOST TARGET GENE, is a human gene contained in the human genome.

VGAM1330 gene encodes a VGAM1330 precursor RNA, herein designated VGAM PRECURSOR RNA. Similar to other miRNA genes, and unlike most ordinary genes, VGAM1330 precursor RNA does not encode a protein. A nucleotide sequence identical or highly similar to the nucleotide sequence of VGAM1330 precursor RNA is designated SEQ ID:1316, and is provided hereinbelow with reference to the sequence listing part. Nucleotide sequence SEQ ID:1316 is located at position 27688 relative to the genome of Human Adenovirus A.

VGAM1330 precursor RNA folds onto itself, forming VGAM1330 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1330 folded precursor RNA into VGAM1330 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1330 RNA is designated SEQ ID:4041, and is provided hereinbelow with reference to the sequence listing part.

VGAM1330 host target gene, herein designated VGAM HOST TARGET GENE, encodes a corresponding messenger RNA, VGAM1330 host target RNA, herein designated VGAM HOST TARGET RNA. VGAM1330 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1330 RNA, herein designated VGAM RNA, binds complementarily to one or more host target binding sites located in untranslated regions of VGAM1330 host target RNA, herein designated VGAM HOST TARGET RNA. This complementary binding is due to the fact that the nucleotide sequence of VGAM1330 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1330 RNA, herein designated VGAM RNA, may have a different number of host target binding sites in untranslated regions of a VGAM1330 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1330 RNA, herein designated VGAM RNA, to host target binding sites on VGAM1330 host target RNA, herein designated VGAM HOST TARGET RNA, such as BINDING SITE I, BINDING SITE II and BINDING SITE III, inhibits translation of VGAM1330 host target RNA into VGAM1330 host target protein, herein designated VGAM HOST TARGET PROTEIN. VGAM host target protein is therefore outlined by a broken line.

It is appreciated that VGAM1330 host target gene, herein designated VGAM HOST TARGET GENE, in fact represents a plurality of VGAM1330 host target genes. The mRNA of each one of this plurality of VGAM1330 host target genes comprises one or more host target binding sites, each having a nucleotide sequence which is at least partly complementary to VGAM1330 RNA, herein designated VGAM RNA, and which when bound by VGAM1330 RNA causes inhibition of translation of respective one or more VGAM1330 host target proteins.

It is further appreciated by one skilled in the art that the mode of translational inhibition illustrated by FIG. 1 with specific reference to translational inhibition exerted by VGAM1330 gene, herein designated VGAM GENE, on one or more VGAM1330 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1330 is inhibition of expression of host target genes, as part of a novel viral mechanism of attacking a host. Accordingly, utilities of VGAM1330 include diagnosis, prevention and treatment of viral infection by Human Adenovirus A. Specific functions, and accordingly utilities, of VGAM1330 correlate with, and may be deduced from, the identity of the host target genes which VGAM1330 binds and inhibits, and the function of these host target genes, as elaborated hereinbelow.

Nucleotide sequences of the VGAM1330 precursor RNA, herein designated VGAM PRECURSOR RNA, and of the 'diced' VGAM1330 RNA, herein designated VGAM RNA, and a schematic representation of the secondary folding of VGAM1330 folded precursor RNA, herein designated VGAM FOLDED PRECURSOR RNA, of VGAM1330 are further described hereinbelow with reference to Table 1.

Nucleotide sequences of host target binding sites, such as BINDING SITE-I, BINDING SITE-II and BINDING SITE-III of FIG. 1, found on VGAM1330 host target RNA, and schematic representation of the complementarity of each of these host target binding sites to VGAM1330 RNA, herein designated VGAM RNA, are described hereinbelow with reference to Table 2.

As mentioned hereinabove with reference to FIG. 1, a function of VGAM1330 gene, herein designated VGAM is inhibition of expression of VGAM1330 target genes. It is appreciated that specific functions, and accordingly utilities, of VGAM1330 correlate with, and may be deduced from, the identity of the target genes which VGAM1330 binds and inhibits, and the function of these target genes, as elaborated hereinbelow.

SWI/SNF Related, Matrix Associated, Actin Dependent Regulator of Chromatin, Subfamily A, Member 3 (SMARCA3, Accession NM_003071) is a VGAM1330 host target gene. SMARCA3 BINDING SITE is HOST TARGET binding site found in the 3' untranslated region of mRNA encoded by SMARCA3, corresponding to a HOST TARGET binding site such as BINDING SITE I, BINDING SITE II or BINDING SITE III. Table 2 illustrates the complementarity of the nucleotide sequences of SMARCA3 BINDING SITE, designated SEQ ID:9039, to the nucleotide sequence of VGAM1330 RNA, herein designated VGAM RNA, also designated SEQ ID:4041.

A function of VGAM1330 is therefore inhibition of SWI/SNF Related, Matrix Associated, Actin Dependent Regulator of Chromatin, Subfamily A, Member 3 (SMARCA3, Accession NM_003071), a gene which is involved in chromatin assembly and remodeling. Accordingly, utilities of VGAM1330 include diagnosis, prevention and treatment of diseases and clinical conditions associated with SMARCA3. The function of SMARCA3 has been established by previous studies. Chromatin remodeling enzymes are implicated in a variety of important cellular functions. Various components of chromatin remodeling complexes, including several members of the SWI/SNF family, are disrupted in cancer. Moinova et al. (2002) identified the HLTF gene (SMARCA3) as a target for gene inactivation in colon cancer. Loss of HLTF expression accompanied by HLTF promoter methylation was noted in 9 of 34 colon cancer cell lines. In these cell lines, HLTF expression was restored by treatment with the demethylating agent 5-azacytidine. In further studies of primary colon cancer tissues, HLTF methylation was detected in 27 of 63 cases (43%). No methylation of HLTF was detected in breast or lung cancers, suggesting selection for HLTF methylation in colonic malignancies. Transfection of HLTF suppressed 75% of colon growth in each of 3 different HLTF-deficient cell lines, but showed no suppressive effect in any of 3 HLTF-proficient cell lines. These findings showed that HLTF is a common target for methylation and epigenetic gene silencing in colon cancer and suggested HLTF as a candidate colon cancer suppressor gene.

Full details of the abovementioned studies are described in the following publications, the disclosure of which are hereby incorporated by reference:

Moinova, H. R.; Chen, W.-D.; Shen, L.; Smiraglia, D.; Olechnowicz, J.; Ravi, L.; Kasturi, L.; Myeroff, L.; Plass, C.; Parsons, R.; Minna, J.; Willson, J. K. V.; Green, S. B.; Issa, J.-P.; Markowitz, S. D.: HLTF gene silencing in human colon cancer. Proc. Nat. Acad. Sci. 99:4562-4567, 2002; and Sheridan, P. L.; Schorpp, Ding, H.; Descheemaeker, K.; Marynen, P.; Nelles, L.; Carvalho, T.; Carmo-Fonseca, M.; Collen, D.; Belayew, A.: Characterization of a helicase-like transcrip.

Further studies establishing the function and utilities of SMARCA3 are found in John Hopkins OMIM database record ID 603257, and in sited publications numbered 8496-8499 listed in the bibliography section hereinbelow, which are also hereby incorporated by reference. Thromboxane A2

Receptor (TBXA2R, Accession NM_001060) is another VGAM1330 host target gene. TBXA2R BINDING SITE is HOST TARGET binding site found in the 5' untranslated region of mRNA encoded by TBXA2R, corresponding to a HOST TARGET binding site such as BINDING SITE I, BINDING SITE II or BINDING SITE III. Table 2 illustrates the complementarity of the nucleotide sequences of TBXA2R BINDING SITE, designated SEQ ID:6726, to the nucleotide sequence of VGAM1330 RNA, herein designated VGAM RNA, also designated SEQ ID:4041.

Another function of VGAM1330 is therefore inhibition of Thromboxane A2 Receptor (TBXA2R, Accession NM_001060), a gene which activates Ca2+-activated chloride channels; stimulates platelet aggregation and smooth muscle constriction. Accordingly, utilities of VGAM1330 include diagnosis, prevention and treatment of diseases and clinical conditions associated with TBXA2R. The function of TBXA2R and its association with various diseases and clinical conditions, has been established by previous studies, as described hereinabove with reference to VGAM433. FLJ22843 (Accession NM_025184) is another VGAM1330 host target gene. FLJ22843 BINDING SITE is HOST TARGET binding site found in the 3' untranslated region of mRNA encoded by FLJ22843, corresponding to a HOST TARGET binding site such as BINDING SITE I, BINDING SITE II or BINDING SITE III. Table 2 illustrates the complementarity of the nucleotide sequences of FLJ22843 BINDING SITE, designated SEQ ID:24820, to the nucleotide sequence of VGAM1330 RNA, herein designated VGAM RNA, also designated SEQ ID:4041.

Another function of VGAM1330 is therefore inhibition of FLJ22843 (Accession NM_025184). Accordingly, utilities of VGAM1330 include diagnosis, prevention and treatment of diseases and clinical conditions associated with FLJ22843. KIAA1465 (Accession XM_027396) is another VGAM1330 host target gene. KIAA1465 BINDING SITE is HOST TARGET binding site found in the 5' untranslated region of mRNA encoded by KIAA1465, corresponding to a HOST TARGET binding site such as BINDING SITE I, BINDING SITE II or BINDING SITE III. Table 2 illustrates the complementarity of the nucleotide sequences of KIAA1465 BINDING SITE, designated SEQ ID:30499, to the nucleotide sequence of VGAM1330 RNA, herein designated VGAM RNA, also designated SEQ ID:4041.

Another function of VGAM1330 is therefore inhibition of KIAA1465 (Accession XM_027396). Accordingly, utilities of VGAM1330 include diagnosis, prevention and treatment of diseases and clinical conditions associated with KIAA1465. KIAA1958 (Accession XM_088566) is another VGAM1330 host target gene. KIAA1958 BINDING SITE is HOST TARGET binding site found in the 3' untranslated region of mRNA encoded by KIAA1958, corresponding to a HOST TARGET binding site such as BINDING SITE I, BINDING SITE II or BINDING SITE III. Table 2 illustrates the complementarity of the nucleotide sequences of KIAA1958 BINDING SITE, designated SEQ ID:39833, to the nucleotide sequence of VGAM1330 RNA, herein designated VGAM RNA, also designated SEQ ID:4041.

Another function of VGAM1330 is therefore inhibition of KIAA1958 (Accession XM_088566). Accordingly, utilities of VGAM1330 include diagnosis, prevention and treatment of diseases and clinical conditions associated with KIAA1958. PRO1770 (Accession NM_014100) is another VGAM1330 host target gene. PRO1770 BINDING SITE is HOST TARGET binding site found in the 3' untranslated region of mRNA encoded by PRO1770, corresponding to a HOST TARGET binding site such as BINDING SITE I, BINDING SITE II or BINDING SITE III. Table 2 illustrates the complementarity of the nucleotide sequences of PRO1770 BINDING SITE, designated SEQ ID:15327, to the nucleotide sequence of VGAM1330 RNA, herein designated VGAM RNA, also designated SEQ ID:4041.

Another function of VGAM1330 is therefore inhibition of PRO1770 (Accession NM_014100). Accordingly, utilities of VGAM1330 include diagnosis, prevention and treatment of diseases and clinical conditions associated with PRO1770. PTD012 (Accession NM_014039) is another VGAM1330 host target gene. PTD012 BINDING SITE is HOST TARGET binding site found in the 5' untranslated region of mRNA encoded by PTD012, corresponding to a HOST TARGET binding site such as BINDING SITE I, BINDING SITE II or BINDING SITE III. Table 2 illustrates the complementarity of the nucleotide sequences of PTD012 BINDING SITE, designated SEQ ID:15268, to the nucleotide sequence of VGAM1330 RNA, herein designated VGAM RNA, also designated SEQ ID:4041.

Another function of VGAM1330 is therefore inhibition of PTD012 (Accession NM_014039). Accordingly, utilities of VGAM1330 include diagnosis, prevention and treatment of diseases and clinical conditions associated with PTD012. Sorting Nexin 10 (SNX10, Accession NM_013322) is another VGAM1330 host target gene. SNX10 BINDING SITE is HOST TARGET binding site found in the 3' untranslated region of mRNA encoded by SNX10, corresponding to a HOST TARGET binding site such as BINDING SITE I, BINDING SITE II or BINDING SITE III. Table 2 illustrates the complementarity of the nucleotide sequences of SNX10 BINDING SITE, designated SEQ ID:14969, to the nucleotide sequence of VGAM1330 RNA, herein designated VGAM RNA, also designated SEQ ID:4041.

Another function of VGAM1330 is therefore inhibition of Sorting Nexin 10 (SNX10, Accession NM_013322). Accordingly, utilities of VGAM1330 include diagnosis, prevention and treatment of diseases and clinical conditions associated with SNX10. Striatin, Calmodulin Binding Protein 3 (STRN3, Accession NM_014574) is another VGAM1330 host target gene. STRN3 BINDING SITE is HOST TARGET binding site found in the 3' untranslated region of mRNA encoded by STRN3, corresponding to a HOST TARGET binding site such as BINDING SITE I, BINDING SITE II or BINDING SITE III. Table 2 illustrates the complementarity of the nucleotide sequences of STRN3 BINDING SITE, designated SEQ ID:15934, to the nucleotide sequence of VGAM1330 RNA, herein designated VGAM RNA, also designated SEQ ID:4041.

Another function of VGAM1330 is therefore inhibition of Striatin, Calmodulin Binding Protein 3 (STRN3, Accession NM_014574). Accordingly, utilities of VGAM1330 include diagnosis, prevention and treatment of diseases and clinical conditions associated with STRN3. LOC221931 (Accession XM_168348) is another VGAM1330 host target gene. LOC221931 BINDING SITE is HOST TARGET binding site found in the 3' untranslated region of mRNA encoded by LOC221931, corresponding to a HOST TARGET binding site such as BINDING SITE I, BINDING SITE II or BINDING SITE III. Table 2 illustrates the complementarity of the nucleotide sequences of LOC221931 BINDING SITE, designated SEQ ID:45120, to the nucleotide sequence of VGAM1330 RNA, herein designated VGAM RNA, also designated SEQ ID:4041.

Another function of VGAM1330 is therefore inhibition of LOC221931 (Accession XM_168348). Accordingly, utilities of VGAM1330 include diagnosis, prevention and treatment of diseases and clinical conditions associated with LOC221931. FIG. 1 further provides a conceptual description of a novel bioinformatically detected viral gene of the present invention, referred to here as Viral Genomic Address Messenger 1331 (VGAM1331) viral gene, which modulates expression of respective host target genes thereof, the function and utility of which host target genes is known in the art.

VGAM1331 is a novel bioinformatically detected regulatory, non protein coding, viral micro RNA (miRNA) gene. The method by which VGAM1331 was detected is described hereinabove with reference to FIGS. 1-8.

VGAM1331 gene, herein designated VGAM GENE, is a viral gene contained in the genome of Human Adenovirus A. VGAM1331 host target gene, herein designated VGAM HOST TARGET GENE, is a human gene contained in the human genome.

VGAM1331 gene encodes a VGAM1331 precursor RNA, herein designated VGAM PRECURSOR RNA. Similar to other miRNA genes, and unlike most ordinary genes, VGAM1331 precursor RNA does not encode a protein. A nucleotide sequence identical or highly similar to the nucleotide sequence of VGAM1331 precursor RNA is designated SEQ ID:1317, and is provided hereinbelow with reference to the sequence listing part. Nucleotide sequence SEQ ID:1317 is located at position 25669 relative to the genome of Human Adenovirus A.

VGAM1331 precursor RNA folds onto itself, forming VGAM1331 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1331 folded precursor RNA into VGAM1331 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1331 RNA is designated SEQ ID:4042, and is provided hereinbelow with reference to the sequence listing part.

VGAM1331 host target gene, herein designated VGAM HOST TARGET GENE, encodes a corresponding messenger RNA, VGAM1331 host target RNA, herein designated VGAM HOST TARGET RNA. VGAM1331 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1331 RNA, herein designated VGAM RNA, binds complementarily to one or more host target binding sites located in untranslated regions of VGAM1331 host target RNA, herein designated VGAM HOST TARGET RNA. This complementary binding is due to the fact that the nucleotide sequence of VGAM1331 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1331 RNA, herein designated VGAM RNA, may have a different number of host target binding sites in untranslated regions of a VGAM1331 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1331 RNA, herein designated VGAM RNA, to host target binding sites on VGAM1331 host target RNA, herein designated VGAM HOST TARGET RNA, such as BINDING SITE I, BINDING SITE II and BINDING SITE III, inhibits translation of VGAM1331 host target RNA into VGAM1331 host target protein, herein designated VGAM HOST TARGET PROTEIN. VGAM host target protein is therefore outlined by a broken line.

It is appreciated that VGAM1331 host target gene, herein designated VGAM HOST TARGET GENE, in fact represents a plurality of VGAM1331 host target genes. The mRNA of each one of this plurality of VGAM1331 host target genes comprises one or more host target binding sites, each having a nucleotide sequence which is at least partly complementary to VGAM1331 RNA, herein designated VGAM RNA, and which when bound by VGAM1331 RNA causes inhibition of translation of respective one or more VGAM1331 host target proteins.

It is further appreciated by one skilled in the art that the mode of translational inhibition illustrated by FIG. 1 with specific reference to translational inhibition exerted by VGAM1331 gene, herein designated VGAM GENE, on one or more VGAM1331 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1331 is inhibition of expression of host target genes, as part of a novel viral mechanism of attacking a host. Accordingly, utilities of VGAM1331 include diagnosis, prevention and treatment of viral infection by Human Adenovirus A. Specific functions, and accordingly utilities, of VGAM1331 correlate with, and may be deduced from, the identity of the host target genes which VGAM1331 binds and inhibits, and the function of these host target genes, as elaborated hereinbelow.

Nucleotide sequences of the VGAM1331 precursor RNA, herein designated VGAM PRECURSOR RNA, and of the 'diced' VGAM1331 RNA, herein designated VGAM RNA, and a schematic representation of the secondary folding of VGAM1331 folded precursor RNA, herein designated VGAM FOLDED PRECURSOR RNA, of VGAM1331 are further described hereinbelow with reference to Table 1.

Nucleotide sequences of host target binding sites, such as BINDING SITE-I, BINDING SITE-II and BINDING SITE-III of FIG. 1, found on VGAM1331 host target RNA, and schematic representation of the complementarity of each of these host target binding sites to VGAM1331 RNA, herein designated VGAM RNA, are described hereinbelow with reference to Table 2.

As mentioned hereinabove with reference to FIG. 1, a function of VGAM1331 gene, herein designated VGAM is inhibition of expression of VGAM1331 target genes. It is appreciated that specific functions, and accordingly utilities, of VGAM1331 correlate with, and may be deduced from, the identity of the target genes which VGAM1331 binds and inhibits, and the function of these target genes, as elaborated hereinbelow.

Chromosome 21 Open Reading Frame 108 (C21orf108, Accession XM_114191) is a VGAM1331 host target gene. C21orf108 BINDING SITE is HOST TARGET binding site found in the 3' untranslated region of mRNA encoded by C21orf108, corresponding to a HOST TARGET binding site such as BINDING SITE I, BINDING SITE II or BINDING SITE III. Table 2 illustrates the complementarity of the nucleotide sequences of C21orf108 BINDING SITE, designated SEQ ID:42770, to the nucleotide sequence of VGAM1331 RNA, herein designated VGAM RNA, also designated SEQ ID:4042.

A function of VGAM1331 is therefore inhibition of Chromosome 21 Open Reading Frame 108 (C21orf108, Accession XM_114191). Accordingly, utilities of VGAM1331 include diagnosis, prevention and treatment of diseases and clinical conditions associated with C21orf108. LOC168391 (Accession XM_095061) is another VGAM1331 host target gene. LOC168391 BINDING SITE is HOST TARGET binding site found in the 5' untranslated region of mRNA encoded by LOC168391, corresponding to a HOST TARGET binding site such as BINDING SITE I, BINDING SITE II or BINDING SITE III. Table 2 illustrates the complementarity of the nucleotide sequences of LOC168391 BINDING SITE, designated SEQ ID:40243, to the nucleotide sequence of VGAM1331 RNA, herein designated VGAM RNA, also designated SEQ ID:4042.

Another function of VGAM1331 is therefore inhibition of LOC168391 (Accession XM_095061). Accordingly, utilities of VGAM1331 include diagnosis, prevention and treatment of diseases and clinical conditions associated with LOC168391. FIG. 1 further provides a conceptual description of a novel bioinformatically detected viral gene of the present invention, referred to here as Viral Genomic Address Messenger 1332 (VGAM1332) viral gene, which modulates expression of respective host target genes thereof, the function and utility of which host target genes is known in the art.

VGAM1332 is a novel bioinformatically detected regulatory, non protein coding, viral micro RNA (miRNA) gene. The method by which VGAM1332 was detected is described hereinabove with reference to FIGS. 1-8.

VGAM1332 gene, herein designated VGAM GENE, is a viral gene contained in the genome of Human Adenovirus A. VGAM1332 host target gene, herein designated VGAM HOST TARGET GENE, is a human gene contained in the human genome.

VGAM1332 gene encodes a VGAM1332 precursor RNA, herein designated VGAM PRECURSOR RNA. Similar to other miRNA genes, and unlike most ordinary genes, VGAM1332 precursor RNA does not encode a protein. A nucleotide sequence identical or highly similar to the nucleotide sequence of VGAM1332 precursor RNA is designated SEQ ID:1318, and is provided hereinbelow with reference to the sequence listing part. Nucleotide sequence SEQ ID:1318 is located at position 26522 relative to the genome of Human Adenovirus A.

VGAM1332 precursor RNA folds onto itself, forming VGAM1332 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1332 folded precursor RNA into VGAM1332 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1332 RNA is designated SEQ ID:4043, and is provided hereinbelow with reference to the sequence listing part.

VGAM1332 host target gene, herein designated VGAM HOST TARGET GENE, encodes a corresponding messenger RNA, VGAM1332 host target RNA, herein designated VGAM HOST TARGET RNA. VGAM1332 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1332 RNA, herein designated VGAM RNA, binds complementarily to one or more host target binding sites located in untranslated regions of VGAM1332 host target RNA, herein designated VGAM HOST TARGET RNA. This complementary binding is due to the fact that the nucleotide sequence of VGAM1332 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1332 RNA, herein designated VGAM RNA, may have a different number of host target binding sites in untranslated regions of a VGAM1332 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1332 RNA, herein designated VGAM RNA, to host target binding sites on VGAM1332 host target RNA, herein designated VGAM HOST TARGET RNA, such as BINDING SITE I, BINDING SITE II and BINDING SITE III, inhibits translation of VGAM1332 host target RNA into VGAM1332 host target protein, herein designated VGAM HOST TARGET PROTEIN. VGAM host target protein is therefore outlined by a broken line.

It is appreciated that VGAM1332 host target gene, herein designated VGAM HOST TARGET GENE, in fact represents a plurality of VGAM1332 host target genes. The mRNA of each one of this plurality of VGAM1332 host target genes comprises one or more host target binding sites, each having a nucleotide sequence which is at least partly complementary to VGAM1332 RNA, herein designated VGAM RNA, and which when bound by VGAM1332 RNA causes inhibition of translation of respective one or more VGAM1332 host target proteins.

It is further appreciated by one skilled in the art that the mode of translational inhibition illustrated by FIG. 1 with specific reference to translational inhibition exerted by VGAM1332 gene, herein designated VGAM GENE, on one or more VGAM1332 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1332 is inhibition of expression of host target genes, as part of a novel viral mechanism of attacking a host. Accordingly, utilities of VGAM1332 include diagnosis, prevention and treatment of viral infection by Human Adenovirus A. Specific functions, and accordingly utilities, of VGAM1332 correlate with, and may be deduced from, the identity of the host target genes which VGAM1332 binds and inhibits, and the function of these host target genes, as elaborated hereinbelow.

Nucleotide sequences of the VGAM1332 precursor RNA, herein designated VGAM PRECURSOR RNA, and of the 'diced' VGAM1332 RNA, herein designated VGAM RNA, and a schematic representation of the secondary folding of VGAM1332 folded precursor RNA, herein designated VGAM FOLDED PRECURSOR RNA, of VGAM1332 are further described hereinbelow with reference to Table 1.

Nucleotide sequences of host target binding sites, such as BINDING SITE-I, BINDING SITE-II and BINDING SITE-III of FIG. 1, found on VGAM1332 host target RNA, and schematic representation of the complementarity of each of these host target binding sites to VGAM1332 RNA, herein designated VGAM RNA, are described hereinbelow with reference to Table 2.

As mentioned hereinabove with reference to FIG. 1, a function of VGAM1332 gene, herein designated VGAM is inhibition of expression of VGAM1332 target genes. It is appreciated that specific functions, and accordingly utilities, of VGAM1332 correlate with, and may be deduced from, the identity of the target genes which VGAM1332 binds and inhibits, and the function of these target genes, as elaborated hereinbelow.

Chloride Channel 3 (CLCN3, Accession NM_001829) is a VGAM1332 host target gene. CLCN3 BINDING SITE is HOST TARGET binding site found in the 3' untranslated region of mRNA encoded by CLCN3, corresponding to a HOST TARGET binding site such as BINDING SITE I, BINDING SITE II or BINDING SITE III. Table 2 illustrates the complementarity of the nucleotide sequences of CLCN3 BINDING SITE, designated SEQ ID:7563, to the nucleotide sequence of VGAM1332 RNA, herein designated VGAM RNA, also designated SEQ ID:4043.

A function of VGAM1332 is therefore inhibition of Chloride Channel 3 (CLCN3, Accession NM_001829), a gene which play a role in the neural cell function through regulation of membrane excitability. Accordingly, utilities of VGAM1332 include diagnosis, prevention and treatment of diseases and clinical conditions associated with CLCN3. The function of CLCN3 has been established by previous studies. Cid et al. (1995) cloned a human homolog of the rat voltage-gated chloride channel CLC2 from a T84 epithelial cell cDNA library. The predicted 898-amino acid protein is over 93% identical to the rat sequence. The gene was mapped to 3q26-qter by PCR of somatic cell hybrid DNAs. Schwiebert et al. (1998) found that CLC2 chloride channels are expressed in epithelia affected by cystic fibrosis (CF; 219700) and raised the possibility that these might represent an alternative target for pharmacotherapy of CF. The explore this possibility, they manipulated genetically the expression levels of CLC2 channels in airway epithelial cells derived from cystic fibrosis patients. Whole-cell patch-clamp analysis of cells overexpressing CLC2 identified hyperpolarization-activated chloride ion currents (HACCs) that displayed time- and voltage-dependent activation and an inwardly rectifying steady-state current voltage relationship. Reduction of extracellular pH to 5.0 caused significant increases in HACCs in overexpressing cells and the appearance of robust currents in parental cells from the cystic fibrosis patient. CF cells stably transfected with the antisense CLC2 cDNA showed reduced expression of CLC2 compared with parental cells by Western blotting, and a significant reduction in the magnitude of pH-dependent HACCs. To determine whether changes in the extracellular pH alone could initiate chloride transport via CLC2 channels, they performed chloride-36 efflux studies on overexpressing cells and cells with endogenous expression of CLC2. Acidic extracellular pH increased chloride-36 efflux rates in both cell types, although the CLC2-overexpressing cells had significantly greater chloride conduction and a longer duration of efflux than the parental cells. Compounds that exploit the pH mechanism of activating endogenous CLC2 channels may provide a pharmacologic option for increasing chloride conductance in airways of CF patients.

Full details of the abovementioned studies are described in the following publications, the disclosure of which are hereby incorporated by reference:

Cid, L. P.; Montrose-Rafizadeh, C.; Smith, D. I.; Guggino, W. B.; Cutting, G. R. : Cloning of a putative human voltage-gated chloride channel (CLC-2) cDNA widely expressed in human tissues. Hum. Molec. Genet. 4:407-413, 1995; and Schwiebert, E. M.; Cid-Soto, L. P.; Stafford, D.; Carter, M.; Blaisdell, C. J.; Zeitlin, P. L.; Guggino, W. B.; Cutting, G. R.: Analysis of ClC-2 channels as an alternative pathway for.

Further studies establishing the function and utilities of CLCN3 are found in John Hopkins OMIM database record ID 600580, and in sited publications numbered 10180-10183, 377 and 10184 listed in the bibliography section hereinbelow, which are also hereby incorporated by reference. Interferon Regulatory Factor 2 (IRF2, Accession NM_002199) is another VGAM1332 host target gene. IRF2 BINDING SITE is HOST TARGET binding site found in the 3' untranslated region of mRNA encoded by IRF2, corresponding to a HOST TARGET binding site such as BINDING SITE I, BINDING SITE II or BINDING SITE III. Table 2 illustrates the complementarity of the nucleotide sequences of IRF2 BINDING SITE, designated SEQ ID:7956, to the nucleotide sequence of VGAM1332 RNA, herein designated VGAM RNA, also designated SEQ ID:4043.

Another function of VGAM1332 is therefore inhibition of Interferon Regulatory Factor 2 (IRF2, Accession NM_002199), a gene which is a transcriptional activator of type I interferon and interferon-inducible genes. Accordingly, utilities of VGAM1332 include diagnosis, prevention and treatment of diseases and clinical conditions associated with IRF2. The function of IRF2 and its association with various diseases and clinical conditions, has been established by previous studies, as described hereinabove with reference to VGAM511. LIM Domain Containing Preferred Translocation Partner In Lipoma (LPP, Accession NM_005578) is another VGAM1332 host target gene. LPP BINDING SITE is HOST TARGET binding site found in the 3' untranslated region of mRNA encoded by LPP, corresponding to a HOST TARGET binding site such as BINDING SITE I, BINDING SITE II or BINDING SITE III. Table 2 illustrates the complementarity of the nucleotide sequences of LPP BINDING SITE, designated SEQ ID:12106, to the nucleotide sequence of VGAM1332 RNA, herein designated VGAM RNA, also designated SEQ ID:4043.

Another function of VGAM1332 is therefore inhibition of LIM Domain Containing Preferred Translocation Partner In Lipoma (LPP, Accession NM_005578). Accordingly, utilities of VGAM1332 include diagnosis, prevention and treatment of diseases and clinical conditions associated with LPP. Membrane Metallo-endopeptidase (neutral endopeptidase, enkephalinase, CALLA, CD10) (MME, Accession NM_007288) is another VGAM1332 host target gene. MME BINDING SITE1 through MME BINDING SITE4 are HOST TARGET binding sites found in untranslated regions of mRNA encoded by MME, corresponding to HOST TARGET binding sites such as BINDING SITE I, BINDING SITE II or BINDING SITE III. Table 2 illustrates the complementarity of the nucleotide sequences of MME BINDING SITE1 through MME BINDING SITE4, designated SEQ ID:14152, SEQ ID:6600, SEQ ID:14148 and SEQ ID:14156 respectively, to the nucleotide sequence of VGAM1332 RNA, herein designated VGAM RNA, also designated SEQ ID:4043.

Another function of VGAM1332 is therefore inhibition of Membrane Metallo-endopeptidase (neutral endopeptidase, enkephalinase, CALLA, CD10) (MME, Accession NM_007288), a gene which is thermolysin-like specificity. Accordingly, utilities of VGAM1332 include diagnosis, prevention and treatment of diseases and clinical conditions associated with MME. The function of MME has been established by previous studies. Common acute lymphocytic leukemia antigen is an important cell surface marker in the diagnosis of human acute lymphocytic leukemia (ALL). It is present on leukemic cells of pre-B phenotype, which represent 85% of cases of ALL. CALLA is not restricted to leukemic cells, however, and is found on a variety of normal tissues. CALLA is a glycoprotein that is particularly abundant in kidney, where it is present on the brush border of proximal tubules and on glomerular epithelium. Letarte et al. (1988) cloned a cDNA coding for CALLA and showed that the amino acid sequence deduced from the cDNA sequence is identical to that of human membrane-associated neutral endopeptidase (NEP; EC 3.4.24.11), also known as enkephalinase. NEP cleaves peptides at the amino side of hydrophobic residues and inactivates several peptide hormones including glucagon, enkephalins, substance P, neurotensin, oxytocin, and bradykinin. By cDNA transfection analysis, Shipp et al. (1989) confirmed that CALLA is a functional neutral endopeptidase of the type that has previously been called enkephalinase. Barker et al. (1989) demonstrated that the CALLA gene, which encodes a 100-kD type II transmembrane glycoprotein, exists in a single copy of greater than 45 kb which is not rearranged in malignancies expressing cell surface CALLA. d'Adamio et al. (1989) demonstrated that the CALLA gene spans more than 80 kb and is composed of 24 exons. Animal model experiments lend further support to the function of MME. Amyloid-beta peptide (OMIM Ref. No. 104760), the pathogenic agent of Alzheimer disease (OMIM Ref. No. 104300), is a physiologic metabolite in the brain. Iwata et al. (2001) examined the role of neprilysin, a candidate amyloid-beta degrading peptidase, in the metabolism using neprilysin gene-disrupted mice. Neprilysin deficiency resulted in defects both in the degradation of exogenously administered amyloid-beta and in the metabolic suppression of the endogenous amyloid-beta levels in a gene dose-dependent manner. The regional levels of amyloid-beta in the neprilysin-deficient mouse brain were in the distinct order of hippocampus, cortex, thalamus/striatum, and cerebellum, where hippocampus has the highest level and cerebellum the lowest, correlating with the vulnerability to amyloid-beta deposition in brains of human S with Alzheimer disease. Iwata et al. (2001) concluded that even partial down regulation of neprilysin activity, which could be caused by aging, can contribute to Alzheimer disease by promoting amyloid-beta accumulation.

It is appreciated that the abovementioned animal model for MME is acknowledged by those skilled in the art as a scientifically valid animal model, as can be further appreciated from the publications sited hereinbelow.

Full details of the abovementioned studies are described in the following publications, the disclosure of which are hereby incorporated by reference:

Iwata, N.; Tsubuki, S.; Takaki, Y.; Shirotani, K.; Lu, B.; Gerard, N. P.; Gerard, C.; Hama, E.; Lee, H.-J.; Saido, T. C.: Metabolic regulation of brain A-beta by neprilysin. Science 292:1550-1552, 2001; and Letarte, M.; Vera, S.; Tran, R.; Addis, J. B. L.; Onizuka, R. J.; Quackenbush, E. J.; Jongeneel, C. V.; McInnes, R. R.: Common acute lymphocytic leukemia antigen is identical to neutr.

Further studies establishing the function and utilities of MME are found in John Hopkins OMIM database record ID 120520, and in sited publications numbered 12226-12228, 413 and 12229-12231 listed in the bibliography section hereinbelow, which are also hereby incorporated by reference. Retinoblastoma Binding Protein 8 (RBBP8, Accession NM_002894) is another VGAM1332 host target gene. RBBP8 BINDING SITE is HOST TARGET binding site found in the 5' untranslated region of mRNA encoded by RBBP8, corresponding to a HOST TARGET binding site such as BINDING SITE I, BINDING SITE II or BINDING SITE III. Table 2 illustrates the complementarity of the nucleotide sequences of RBBP8 BINDING SITE, designated SEQ ID:8801, to the nucleotide sequence of VGAM1332 RNA, herein designated VGAM RNA, also designated SEQ ID:4043.

Another function of VGAM1332 is therefore inhibition of Retinoblastoma Binding Protein 8 (RBBP8, Accession NM_002894), a gene which may be a tumor suppressor. Accordingly, utilities of VGAM1332 include diagnosis, prevention and treatment of diseases and clinical conditions associated with RBBP8. The function of RBBP8 has been established by previous studies. Fusco et al. (1998) described the isolation and characterization of a cDNA encoding a polypeptide, named RIM for 'retinoblastoma-interacting myosin-like,' that interacted in a yeast 2-hybrid system as well as in mammalian cells with the retinoblastoma (RB; 180200) protein. The RIM cDNA predicts a 897-amino acid polypeptide containing 2 leucine zipper motifs, an RB-binding domain, and a CTBP (see OMIM Ref. No. 602618)-binding domain. The RIM protein has weak homology to myosin family (see OMIM Ref. No. 160720) proteins throughout its length. Northern blot analysis revealed a ubiquitously expressed 3.6-kb mRNA. Immunoprecipitation experiments revealed that a truncated RIM protein containing amino acids 142-897 interacts with RB in mammalian cells. To understand the mechanism by which interaction between E1A and CTBP results in tumorigenesis-restraining activity, Schaeper et al. (1998) searched for cellular proteins that complex with CTBP. By a yeast 2-hybrid screen and RACE PCR, Schaeper et al. (1998) identified and cloned a CTBP-interacting protein (CTIP). CTIP contains a 5-amino acid motif, the PLDLS motif, that is highly conserved among E1A proteins of all human adenoviruses. CTIP binds to CTBP via the PLDLS motif. Yu et al. (1998) used the Sos recruitment system to screen for proteins that bind to the region of BRCA1 (OMIM Ref. No. 113705) containing the BRCT domains. Yu et al. (1998) found that the BRCT domains interact in vivo with CTIP, a protein identified on the basis of its association with the CTBP transcriptional corepressor (Schaeper et al., 1998). Yu et al. (1998) concluded that BRCA1 regulates gene expression, at least in part, by modulating CTBP-mediated transcriptional repression. Moreover, Yu et al. (1998) found that the in vivo interaction between BRCA1 and CTIP is completely ablated by each of 3 independent tumor-associated mutations affecting the BRCT motifs of BRCA1. Yu et al. (1998) concluded that BRCA1-CTIP interaction may be required for tumor suppression by BRCA1.

Full details of the abovementioned studies are described in the following publications, the disclosure of which are hereby incorporated by reference:

Fusco, C.; Reymond, A.; Zervos, A. S.: Molecular cloning and characterization of a novel retinoblastoma-binding protein. Genomics 51:351-358, 1998; and Yu, X.; Wu, L. C.; Bowcock, A. M.; Aronheim, A.; Baer, R.: The C-terminal (BRCT) domains of BRCA1 interact in vivo with CtIP, a protein implicated in the CtBP pathway of transcriptional.

Further studies establishing the function and utilities of RBBP8 are found in John Hopkins OMIM database record ID 604124, and in sited publications numbered 740 and 7406-7409 listed in the bibliography section hereinbelow, which are also hereby incorporated by reference. BM-002 (Accession NM_016617) is another VGAM1332 host target gene. BM-002 BINDING SITE is HOST TARGET binding site found in the 3' untranslated region of mRNA encoded by BM-002, corresponding to a HOST TARGET binding site such as BINDING SITE I, BINDING SITE II or BINDING SITE III. Table 2 illustrates the complementarity of the nucleotide sequences of BM-002 BINDING SITE, designated SEQ ID:18723, to the nucleotide sequence of VGAM1332 RNA, herein designated VGAM RNA, also designated SEQ ID:4043.

Another function of VGAM1332 is therefore inhibition of BM-002 (Accession NM_016617). Accordingly, utilities of VGAM1332 include diagnosis, prevention and treatment of diseases and clinical conditions associated with BM-002. KIAA0855 (Accession NM_015003) is another VGAM1332 host target gene. KIAA0855 BINDING SITE is HOST TARGET binding site found in the 3' untranslated region of mRNA encoded by KIAA0855, corresponding to a HOST TARGET binding site such as BINDING SITE I, BINDING SITE II or BINDING SITE III. Table 2 illustrates the complementarity of the nucleotide sequences of KIAA0855 BINDING SITE, designated SEQ ID:17375, to the nucleotide sequence of VGAM1332 RNA, herein designated VGAM RNA, also designated SEQ ID:4043.

Another function of VGAM1332 is therefore inhibition of KIAA0855 (Accession NM_015003). Accordingly, utilities of VGAM1332 include diagnosis, prevention and treatment of diseases and clinical conditions associated with KIAA0855. KIAA0871 (Accession NM_014961) is another VGAM1332 host target gene. KIAA0871 BINDING SITE is HOST TARGET binding site found in the 3' untranslated region of mRNA encoded by KIAA0871, corresponding to a HOST TARGET binding site such as BINDING SITE I, BINDING SITE II or BINDING SITE III. Table 2 illustrates the complementarity of the nucleotide sequences of KIAA0871 BINDING SITE, designated SEQ ID:17331, to the nucleotide sequence of VGAM1332 RNA, herein designated VGAM RNA, also designated SEQ ID:4043.

Another function of VGAM1332 is therefore inhibition of KIAA0871 (Accession NM_014961). Accordingly, utilities of VGAM1332 include diagnosis, prevention and treatment of diseases and clinical conditions associated with KIAA0871. KIAA1843 (Accession XM_030838) is another VGAM1332 host target gene. KIAA1843 BINDING SITE is HOST TARGET binding site found in the 3' untranslated region of mRNA encoded by KIAA1843, corresponding to a HOST TARGET binding site such as BINDING SITE I, BINDING SITE II or BINDING SITE III. Table 2 illustrates the complementarity of the nucleotide sequences of KIAA1843 BINDING SITE, designated SEQ ID:31162, to the nucleotide sequence of VGAM1332 RNA, herein designated VGAM RNA, also designated SEQ ID:4043.

Another function of VGAM1332 is therefore inhibition of KIAA1843 (Accession XM_030838). Accordingly, utilities of VGAM1332 include diagnosis, prevention and treatment of diseases and clinical conditions associated with KIAA1843. Kelch-like 4 (Drosophila) (KLHL4, Accession NM_019117) is another VGAM1332 host target gene. KLHL4 BINDING SITE is HOST TARGET binding site found in the 3' untranslated region of mRNA encoded by KLHL4, corresponding to a HOST TARGET binding site such as BINDING SITE I, BINDING SITE II or BINDING SITE III. Table 2 illustrates the complementarity of the nucleotide sequences of KLHL4 BINDING SITE, designated SEQ ID:21191, to the nucleotide sequence of VGAM1332 RNA, herein designated VGAM RNA, also designated SEQ ID:4043.

Another function of VGAM1332 is therefore inhibition of Kelch-like 4 (Drosophila) (KLHL4, Accession NM_019117). Accordingly, utilities of VGAM1332 include diagnosis, prevention and treatment of diseases and clinical conditions associated with KLHL4. OCT11 (Accession NM_014352) is another VGAM1332 host target gene. OCT11 BINDING SITE is HOST TARGET binding site found in the 3' untranslated region of mRNA encoded by OCT11, corresponding to a HOST TARGET binding site such as BINDING SITE I, BINDING SITE II or BINDING SITE III. Table 2 illustrates the complementarity of the nucleotide sequences of OCT11 BINDING SITE, designated SEQ ID:15679, to the nucleotide sequence of VGAM1332 RNA, herein designated VGAM RNA, also designated SEQ ID:4043.

Another function of VGAM1332 is therefore inhibition of OCT11 (Accession NM_014352). Accordingly, utilities of VGAM1332 include diagnosis, prevention and treatment of diseases and clinical conditions associated with OCT11. Sprouty Homolog 2 (Drosophila) (SPRY2, Accession NM_005842) is another VGAM1332 host target gene. SPRY2 BINDING SITE is HOST TARGET binding site found in the 5' untranslated region of mRNA encoded by SPRY2, corresponding to a HOST TARGET binding site such as BINDING SITE I, BINDING SITE II or BINDING SITE III. Table 2 illustrates the complementarity of the nucleotide sequences of SPRY2 BINDING SITE, designated SEQ ID:12454, to the nucleotide sequence of VGAM1332 RNA, herein designated VGAM RNA, also designated SEQ ID:4043.

Another function of VGAM1332 is therefore inhibition of Sprouty Homolog 2 (Drosophila) (SPRY2, Accession NM_005842). Accordingly, utilities of VGAM1332 include diagnosis, prevention and treatment of diseases and clinical conditions associated with SPRY2. Spermatid Perinuclear RNA Binding Protein (STRBP, Accession NM_018387) is another VGAM1332 host target gene. STRBP BINDING SITE is HOST TARGET binding site found in the 5' untranslated region of mRNA encoded by STRBP, corresponding to a HOST TARGET binding site such as BINDING SITE I, BINDING SITE II or BINDING SITE III. Table 2 illustrates the complementarity of the nucleotide sequences of STRBP BINDING SITE, designated SEQ ID:20420, to the nucleotide sequence of VGAM1332 RNA, herein designated VGAM RNA, also designated SEQ ID:4043.

Another function of VGAM1332 is therefore inhibition of Spermatid Perinuclear RNA Binding Protein (STRBP, Accession NM_018387). Accordingly, utilities of VGAM1332 include diagnosis, prevention and treatment of diseases and clinical conditions associated with STRBP. TIP47 (Accession NM_005817) is another VGAM1332 host target gene. TIP47 BINDING SITE is HOST TARGET binding site found in the 3' untranslated region of mRNA encoded by TIP47, corresponding to a HOST TARGET binding site such as BINDING SITE I, BINDING SITE II or BINDING SITE III. Table 2 illustrates the complementarity of the nucleotide sequences of TIP47 BINDING SITE, designated SEQ ID:12416, to the nucleotide sequence of VGAM1332 RNA, herein designated VGAM RNA, also designated SEQ ID:4043.

Another function of VGAM1332 is therefore inhibition of TIP47 (Accession NM_005817). Accordingly, utilities of VGAM1332 include diagnosis, prevention and treatment of diseases and clinical conditions associated with TIP47. LOC200268 (Accession XM_114178) is another VGAM1332 host target gene. LOC200268 BINDING SITE is HOST TARGET binding site found in the 3' untranslated region of mRNA encoded by LOC200268, corresponding to a HOST TARGET binding site such as BINDING SITE I, BINDING SITE II or BINDING SITE III. Table 2 illustrates the complementarity of the nucleotide sequences of LOC200268 BINDING SITE, designated SEQ ID:42763, to the nucleotide sequence of VGAM1332 RNA, herein designated VGAM RNA, also designated SEQ ID:4043.

Another function of VGAM1332 is therefore inhibition of LOC200268 (Accession XM_114178). Accordingly, utilities of VGAM1332 include diagnosis, prevention and treatment of diseases and clinical conditions associated with LOC200268. LOC91818 (Accession XM_040878) is another VGAM1332 host target gene. LOC91818 BINDING SITE is HOST TARGET binding site found in the 5' untranslated region of mRNA encoded by LOC91818, corresponding to a HOST TARGET binding site such as BINDING SITE I, BINDING SITE II or BINDING SITE III. Table 2 illustrates the complementarity of the nucleotide sequences of LOC91818 BINDING SITE, designated SEQ ID:33404, to the nucleotide sequence of VGAM1332 RNA, herein designated VGAM RNA, also designated SEQ ID:4043.

Another function of VGAM1332 is therefore inhibition of LOC91818 (Accession XM_040878). Accordingly, utilities of VGAM1332 include diagnosis, prevention and treatment of diseases and clinical conditions associated with LOC91818. LOC92573 (Accession XM_045884) is another VGAM1332 host target gene. LOC92573 BINDING SITE is HOST TARGET binding site found in the 5' untranslated region of mRNA encoded by LOC92573, corresponding to a HOST TARGET binding site such as BINDING SITE I, BINDING SITE II or BINDING SITE III. Table 2 illustrates the complementarity of the nucleotide sequences of LOC92573 BINDING SITE, designated SEQ ID:34598, to the nucleotide sequence of VGAM1332 RNA, herein designated VGAM RNA, also designated SEQ ID:4043.

Another function of VGAM1332 is therefore inhibition of LOC92573 (Accession XM_045884). Accordingly, utilities of VGAM1332 include diagnosis, prevention and treatment of diseases and clinical conditions associated with LOC92573. FIG. 1 further provides a conceptual description of a novel bioinformatically detected viral gene of the present invention, referred to here as Viral Genomic Address Messenger 1333 (VGAM1333) viral gene, which modulates expression of respective host target genes thereof, the function and utility of which host target genes is known in the art.

VGAM1333 is a novel bioinformatically detected regulatory, non protein coding, viral micro RNA (miRNA) gene. The method by which VGAM1333 was detected is described hereinabove with reference to FIGS. 1-8.

VGAM1333 gene, herein designated VGAM GENE, is a viral gene contained in the genome of Human Adenovirus A. VGAM1333 host target gene, herein designated VGAM HOST TARGET GENE, is a human gene contained in the human genome.

VGAM1333 gene encodes a VGAM1333 precursor RNA, herein designated VGAM PRECURSOR RNA. Similar to other miRNA genes, and unlike most ordinary genes, VGAM1333 precursor RNA does not encode a protein. A nucleotide sequence identical or highly similar to the nucleotide sequence of VGAM1333 precursor RNA is designated SEQ ID:1319, and is provided hereinbelow with reference to the sequence listing part. Nucleotide sequence SEQ ID:1319 is located at position 24338 relative to the genome of Human Adenovirus A.

VGAM1333 precursor RNA folds onto itself, forming VGAM1333 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1333 folded precursor RNA into VGAM1333 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM1333 RNA is designated SEQ ID:4044, and is provided hereinbelow with reference to the sequence listing part.

VGAM1333 host target gene, herein designated VGAM HOST TARGET GENE, encodes a corresponding messenger RNA, VGAM1333 host target RNA, herein designated VGAM HOST TARGET RNA. VGAM1333 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1333 RNA, herein designated VGAM RNA, binds complementarily to one or more host target binding sites located in untranslated regions of VGAM1333 host target RNA, herein designated VGAM HOST TARGET RNA. This complementary binding is due to the fact that the nucleotide sequence of VGAM1333 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1333 RNA, herein designated VGAM RNA, may have a different number of host target binding sites in untranslated regions of a VGAM1333 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1333 RNA, herein designated VGAM RNA, to host target binding sites on VGAM1333 host target RNA, herein designated VGAM HOST TARGET RNA, such as BINDING SITE I, BINDING SITE II and BINDING SITE III, inhibits translation of VGAM1333 host target RNA into VGAM1333 host target protein, herein designated VGAM HOST TARGET PROTEIN. VGAM host target protein is therefore outlined by a broken line.

It is appreciated that VGAM1333 host target gene, herein designated VGAM HOST TARGET GENE, in fact represents a plurality of VGAM1333 host target genes. The mRNA of each one of this plurality of VGAM1333 host target genes comprises one or more host target binding sites, each having a nucleotide sequence which is at least partly complementary to VGAM1333 RNA, herein designated VGAM RNA, and which when bound by VGAM1333 RNA causes inhibition of translation of respective one or more VGAM1333 host target proteins.

It is further appreciated by one skilled in the art that the mode of translational inhibition illustrated by FIG. 1 with specific reference to translational inhibition exerted by VGAM1333 gene, herein designated VGAM GENE, on one or more VGAM1333 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1333 is inhibition of expression of host target genes, as part of a novel viral mechanism of attacking a host. Accordingly, utilities of VGAM1333 include diagnosis, prevention and treatment of viral infection by Human Adenovirus A. Specific functions, and accordingly utilities, of VGAM1333 correlate with, and may be deduced from, the identity of the host target genes which VGAM1333 binds and inhibits, and the function of these host target genes, as elaborated hereinbelow.

Nucleotide sequences of the VGAM1333 precursor RNA, herein designated VGAM PRECURSOR RNA, and of the 'diced' VGAM1333 RNA, herein designated VGAM RNA, and a schematic representation of the secondary folding of VGAM1333 folded precursor RNA, herein designated VGAM FOLDED PRECURSOR RNA, of VGAM1333 are further described hereinbelow with reference to Table 1.

Nucleotide sequences of host target binding sites, such as BINDING SITE-I, BINDING SITE-II and BINDING SITE-III of FIG. 1, found on VGAM1333 host target RNA, and schematic representation of the complementarity of each of these host target binding sites to VGAM1333 RNA, herein designated VGAM RNA, are described hereinbelow with reference to Table 2.

As mentioned hereinabove with reference to FIG. 1, a function of VGAM1333 gene, herein designated VGAM is inhibition of expression of VGAM1333 target genes. It is appreciated that specific functions, and accordingly utilities, of VGAM1333 correlate with, and may be deduced from, the identity of the target genes which VGAM1333 binds and inhibits, and the function of these target genes, as elaborated hereinbelow.

UDP-Gal:betaGlcNAc Beta 1,4-Galactosyltransferase, Polypeptide 4 (B4GALT4, Accession NM_003778) is a VGAM1333 host target gene. B4GALT4 BINDING SITE is HOST TARGET binding site found in the 3' untranslated region of mRNA encoded by B4GALT4, corresponding to a HOST TARGET binding site such as BINDING SITE I, BINDING SITE II or BINDING SITE III. Table 2 illustrates the complementarity of the nucleotide sequences of B4GALT4 BINDING SITE, designated SEQ ID:9859, to the nucleotide sequence of VGAM1333 RNA, herein designated VGAM RNA, also designated SEQ ID:4044.

A function of VGAM1333 is therefore inhibition of UDP-Gal:betaGlcNAc Beta 1,4-Galactosyltransferase, Polypeptide 4 (B4GALT4, Accession NM_003778). Accordingly, utilities of VGAM1333 include diagnosis, prevention and treatment of diseases and clinical conditions associated with B4GALT4. Dystrophia Myotonica-protein Kinase (DMPK, Accession NM_004409) is another VGAM1333 host target gene. DMPK BINDING SITE is HOST TARGET binding site found in the 3' untranslated region of mRNA encoded by DMPK, corresponding to a HOST TARGET binding site such as BINDING SITE I, BINDING SITE II or BINDING SITE III. Table 2 illustrates the complementarity of the nucleotide sequences of DMPK BINDING SITE, designated SEQ ID:10664, to the nucleotide sequence of VGAM1333 RNA, herein designated VGAM RNA, also designated SEQ ID:4044.

Another function of VGAM1333 is therefore inhibition of Dystrophia Myotonica-protein Kinase (DMPK, Accession NM_004409). Accordingly, utilities of VGAM1333 include diagnosis, prevention and treatment of diseases and clinical conditions associated with DMPK. Neuroepithelial Cell Transforming Gene 1 (NET1, Accession NM_005863) is another VGAM1333 host target gene. NET1 BINDING SITE is HOST TARGET binding site found in the 3' untranslated region of mRNA encoded by NET1, corresponding to a HOST TARGET binding site such as BINDING SITE I, BINDING SITE II or BINDING SITE III. Table 2 illustrates the complementarity of the nucleotide sequences of NET1 BINDING SITE, designated SEQ ID:12476, to the nucleotide sequence of VGAM1333 RNA, herein designated VGAM RNA, also designated SEQ ID:4044.

Another function of VGAM1333 is therefore inhibition of Neuroepithelial Cell Transforming Gene 1 (NET1, Accession NM_005863), a gene which is induced morphologic alterations and conferred a malignant phenotype in vitro and in nude mice. Accordingly, utilities of VGAM1333 include diagnosis, prevention and treatment of diseases and clinical conditions associated with NET1. The function of NET1 has been established by previous studies. Pacholczyk et al. (1991) isolated a cDNA encoding a human noradrenaline transporter. The cDNA sequence predicted a protein of 617 amino acids, with 12-13 highly hydrophobic regions compatible with membrane-spanning domains. Expression of the cDNA clone in transfected HeLa cells indicated that noradrenaline transport activity is sodium-dependent and sensitive to selective noradrenaline transport inhibitors. Transporter RNA was localized to the brain stem and adrenal. The predicted protein sequence demonstrated significant amino acid identity with the Na (+)/gamma-aminobutyric acid transporter, thus identifying a new gene family for neurotransmitter transporter proteins. Pacholczyk et al. (1991) suggested that analysis of the structure and function of this transporter may aid structure-based drug design for the treatment of human depression and lead to a determination of whether transporter abnormalities underlie affective disorders. By hybridization of a panel of somatic cell hybrids and by fluorescence in situ hybridization to metaphase chromosomes, Bruss et al. (1993) mapped the NET1 gene to 16q12.2. Gelernter et al. (1993) reported a TaqI RFLP at the NET1 locus. Gelernter et al. (1993) used PCR with a somatic cell hybrid panel to obtain a provisional assignment of the NET1 gene to chromosome 16. They typed the genetic polymorphism at the NET1 locus in 3 large multigenerational families and, by linkage analysis, confirmed the preliminary assignment and refined the localization to 16q, near the haptoglobin locus (HP; 140100). They then typed the NET1 RFLP on the CEPH families; the additional linkage data localized NET1 to 16q13-q21, flanked by D16S71 centromerically and HP telomerically.

Full details of the abovementioned studies are described in the following publications, the disclosure of which are hereby incorporated by reference:

Gelernter, J.; Kruger, S.; Pakstis, A. J.; Pacholczyk, T.; Sparkes, R. S.; Kidd, K. K.; Amara, S.: Assignment of the norepinephrine transporter protein (NET1) locus to chromosome 16. Genomics 18:690-692, 1993; and Pacholczyk, T.; Blakely, R. D.; Amara, S. G.: Expression cloning of a cocaine- and antidepressant-sensitive human noradrenaline transporter. Nature 350:350-354, 1991.

Further studies establishing the function and utilities of NET1 are found in John Hopkins OMIM database record ID 163970, and in sited publications numbered 10785-10796 listed in the bibliography section hereinbelow, which are also hereby incorporated by reference. Retinoschisis (X-linked, juvenile) 1 (RS1, Accession NM_000330) is another VGAM1333 host target gene. RS1 BINDING SITE is HOST TARGET binding site found in the 3' untranslated region of mRNA encoded by RS1, corresponding to a HOST TARGET binding site such as BINDING SITE I, BINDING SITE II or BINDING SITE III. Table 2 illustrates the complementarity of the nucleotide sequences of RS1 BINDING SITE, designated SEQ ID:5875, to the nucleotide sequence of VGAM1333 RNA, herein designated VGAM RNA, also designated SEQ ID:4044.

Another function of VGAM1333 is therefore inhibition of Retinoschisis (X-linked, juvenile) 1 (RS1, Accession NM_000330). Accordingly, utilities of VGAM1333 include diagnosis, prevention and treatment of diseases and clinical conditions associated with RS1. Chromosome 20 Open Reading Frame 110 (C20orf110, Accession XM_086728) is another VGAM1333 host target gene. C20orf110 BINDING SITE is HOST TARGET binding site found in the 3' untranslated region of mRNA encoded by C20orf110, corresponding to a HOST TARGET binding site such as BINDING SITE I, BINDING SITE II or BINDING SITE III. Table 2 illustrates the complementarity of the nucleotide sequences of C20orf110 BINDING SITE, designated SEQ ID:38835, to the nucleotide sequence of VGAM1333 RNA, herein designated VGAM RNA, also designated SEQ ID:4044.

Another function of VGAM1333 is therefore inhibition of Chromosome 20 Open Reading Frame 110 (C20orf110, Accession XM_086728). Accordingly, utilities of VGAM1333 include diagnosis, prevention and treatment of diseases and clinical conditions associated with C20orf110. DKFZP586C1619 (Accession XM_030350) is another VGAM1333 host target gene. DKFZP586C1619 BINDING SITE is HOST TARGET binding site found in the 3' untranslated region of mRNA encoded by DKFZP586C1619, corresponding to a HOST TARGET binding site such as BINDING SITE I, BINDING SITE II or BINDING SITE III. Table 2 illustrates the complementarity of the nucleotide sequences of DKFZP586C1619 BINDING SITE, designated SEQ ID:31018, to the nucleotide sequence of VGAM1333 RNA, herein designated VGAM RNA, also designated SEQ ID:4044.

Another function of VGAM1333 is therefore inhibition of DKFZP586C1619 (Accession XM_030350). Accordingly, utilities of VGAM1333 include diagnosis, prevention and treatment of diseases and clinical conditions associated with DKFZP586C1619. FLJ13593 (Accession NM_024780) is another VGAM1333 host target gene. FLJ13593 BINDING SITE is HOST TARGET binding site found in the 3' untranslated region of mRNA encoded by FLJ13593, corresponding to a HOST TARGET binding site such as BINDING SITE I, BINDING SITE II or BINDING SITE III. Table 2 illustrates the complementarity of the nucleotide sequences of FLJ13593 BINDING SITE, designated SEQ ID:24149, to the nucleotide sequence of VGAM1333 RNA, herein designated VGAM RNA, also designated SEQ ID:4044.

Another function of VGAM1333 is therefore inhibition of FLJ13593 (Accession NM_024780). Accordingly, utilities of VGAM1333 include diagnosis, prevention and treatment of diseases and clinical conditions associated with FLJ13593. My015 (Accession XM_039512) is another VGAM1333 host target gene. My015 BINDING SITE is HOST TARGET binding site found in the 3' untranslated region of mRNA encoded by My015, corresponding to a HOST TARGET binding site such as BINDING SITE I, BINDING SITE II or BINDING SITE III. Table 2 illustrates the complementarity of the nucleotide sequences of My015 BINDING SITE, designated SEQ ID:33106, to the nucleotide sequence of VGAM1333 RNA, herein designated VGAM RNA, also designated SEQ ID:4044.

Another function of VGAM1333 is therefore inhibition of My015 (Accession XM_039512). Accordingly, utilities of VGAM1333 include diagnosis, prevention and treatment of diseases and clinical conditions associated with My015. PIP3-E (Accession XM_039749) is another VGAM1333 host target gene. PIP3-E BINDING SITE is HOST TARGET binding site found in the 3' untranslated region of mRNA encoded by PIP3-E, corresponding to a HOST TARGET binding site such as BINDING SITE I, BINDING SITE II or BINDING SITE III. Table 2 illustrates the complementarity of the nucleotide sequences of PIP3-E BINDING SITE, designated SEQ ID:33176, to the nucleotide sequence of VGAM1333 RNA, herein designated VGAM RNA, also designated SEQ ID:4044.

Another function of VGAM1333 is therefore inhibition of PIP3-E (Accession XM_039749). Accordingly, utilities of VGAM1333 include diagnosis, prevention and treatment of diseases and clinical conditions associated with PIP3-E. LOC129011 (Accession XM_059326) is another VGAM1333 host target gene. LOC129011 BINDING SITE is HOST TARGET binding site found in the 5' untranslated region of mRNA encoded by LOC129011, corresponding to a HOST TARGET binding site such as BINDING SITE I, BINDING SITE II or BINDING SITE III. Table 2 illustrates the complementarity of the nucleotide sequences of LOC129011 BINDING SITE, designated SEQ ID:36964, to the nucleotide sequence of VGAM1333 RNA, herein designated VGAM RNA, also designated SEQ ID:4044.

Another function of VGAM1333 is therefore inhibition of LOC129011 (Accession XM_059326). Accordingly, utilities of VGAM1333 include diagnosis, prevention and treatment of diseases and clinical conditions associated with LOC129011. LOC204301 (Accession XM_115306) is another VGAM1333 host target gene. LOC204301 BINDING SITE is HOST TARGET binding site found in the 3' untranslated region of mRNA encoded by LOC204301, corresponding to a HOST TARGET binding site such as BINDING SITE I, BINDING SITE II or BINDING SITE III. Table 2 illustrates the complementarity of the nucleotide sequences of LOC204301 BINDING SITE, designated SEQ ID:43092, to the nucleotide sequence of VGAM1333 RNA, herein designated VGAM RNA, also designated SEQ ID:4044.

Another function of VGAM1333 is therefore inhibition of LOC204301 (Accession XM_115306). Accordingly, utilities of VGAM1333 include diagnosis, prevention and treatment of diseases and clinical conditions associated with LOC204301. LOC253805 (Accession XM_172854) is another VGAM1333 host target gene. LOC253805 BINDING SITE is HOST TARGET binding site found in the 3' untranslated region of mRNA encoded by LOC253805, corresponding to a HOST TARGET binding site such as BINDING SITE I, BINDING SITE II or BINDING SITE III. Table 2 illustrates the complementarity of the nucleotide sequences of LOC253805 BINDING SITE, designated SEQ ID:46133, to the nucleotide sequence of VGAM1333 RNA, herein designated VGAM RNA, also designated SEQ ID:4044.

Another function of VGAM1333 is therefore inhibition of LOC253805 (Accession XM_172854). Accordingly, utilities of VGAM1333 include diagnosis, prevention and treatment of diseases and clinical conditions associated with LOC253805. LOC254358 (Accession XM_170771) is another VGAM1333 host target gene. LOC254358 BINDING SITE is HOST TARGET binding site found in the 3' untranslated region of mRNA encoded by LOC254358, corresponding to a HOST TARGET binding site such as BINDING SITE I, BINDING SITE II or BINDING SITE III. Table 2 illustrates the complementarity of the nucleotide sequences of LOC254358 BINDING SITE, designated SEQ ID:45530, to the nucleotide sequence of VGAM1333 RNA, herein designated VGAM RNA, also designated SEQ ID:4044.

Another function of VGAM1333 is therefore inhibition of LOC254358 (Accession XM_170771). Accordingly, utilities of VGAM1333 include diagnosis, prevention and treatment of diseases and clinical conditions associated with LOC254358. FIG. 1 further provides a conceptual description of a novel bioinformatically detected viral gene of the present invention, referred to here as Viral Genomic Address Messenger 1334 (VGAM1334) viral gene, which modulates expression of respective host target genes thereof, the function and utility of which host target genes is known in the art.

VGAM1334 is a novel bioinformatically detected regulatory, non protein coding, viral micro RNA (miRNA) gene. The method by which VGAM1334 was detected is described hereinabove with reference to FIGS. 1-8.

VGAM1334 gene, herein designated VGAM GENE, is a viral gene contained in the genome of Human Adenovirus A. VGAM1334 host target gene, herein designated VGAM HOST TARGET GENE, is a human gene contained in the human genome.

VGAM1334 gene encodes a VGAM1334 precursor RNA, herein designated VGAM PRECURSOR RNA. Similar to other miRNA genes, and unlike most ordinary genes, VGAM1334 precursor RNA does not encode a protein. A nucleotide sequence identical or highly similar to the nucleotide sequence of VGAM1334 precursor RNA is designated SEQ ID:1320, and is provided hereinbelow with reference to the sequence listing part. Nucleotide sequence SEQ ID:1320 is located at position 28536 relative to the genome of Human Adenovirus A.

VGAM1334 precursor RNA folds onto itself, forming VGAM1334 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1334 folded precursor RNA into VGAM1334 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1334 RNA is designated SEQ ID:4045, and is provided hereinbelow with reference to the sequence listing part.

VGAM1334 host target gene, herein designated VGAM HOST TARGET GENE, encodes a corresponding messenger RNA, VGAM1334 host target RNA, herein designated VGAM HOST TARGET RNA. VGAM1334 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1334 RNA, herein designated VGAM RNA, binds complementarily to one or more host target binding sites located in untranslated regions of VGAM1334 host target RNA, herein designated VGAM HOST TARGET RNA. This complementary binding is due to the fact that the nucleotide sequence of VGAM1334 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1334 RNA, herein designated VGAM RNA, may have a different number of host target binding sites in untranslated regions of a VGAM1334 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1334 RNA, herein designated VGAM RNA, to host target binding sites on VGAM1334 host target RNA, herein designated VGAM HOST TARGET RNA, such as BINDING SITE I, BINDING SITE II and BINDING SITE III, inhibits translation of VGAM1334 host target RNA into VGAM1334 host target protein, herein designated VGAM HOST TARGET PROTEIN. VGAM host target protein is therefore outlined by a broken line.

It is appreciated that VGAM1334 host target gene, herein designated VGAM HOST TARGET GENE, in fact represents a plurality of VGAM1334 host target genes. The mRNA of each one of this plurality of VGAM1334 host target genes comprises one or more host target binding sites, each having a nucleotide sequence which is at least partly complementary to VGAM1334 RNA, herein designated VGAM RNA, and which when bound by VGAM1334 RNA causes inhibition of translation of respective one or more VGAM1334 host target proteins.

It is further appreciated by one skilled in the art that the mode of translational inhibition illustrated by FIG. 1 with specific reference to translational inhibition exerted by VGAM1334 gene, herein designated VGAM GENE, on one or more VGAM1334 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1334 is inhibition of expression of host target genes, as part of a novel viral mechanism of attacking a host. Accordingly, utilities of VGAM1334 include diagnosis, prevention and treatment of viral infection by Human Adenovirus A. Specific functions, and accordingly utilities, of VGAM1334 correlate with, and may be deduced from, the identity of the host target genes which VGAM1334 binds and inhibits, and the function of these host target genes, as elaborated hereinbelow.

Nucleotide sequences of the VGAM1334 precursor RNA, herein designated VGAM PRECURSOR RNA, and of the 'diced' VGAM1334 RNA, herein designated VGAM RNA, and a schematic representation of the secondary folding of VGAM1334 folded precursor RNA, herein designated VGAM FOLDED PRECURSOR RNA, of VGAM1334 are further described hereinbelow with reference to Table 1.

Nucleotide sequences of host target binding sites, such as BINDING SITE-I, BINDING SITE-II and BINDING SITE-III of FIG. 1, found on VGAM1334 host target RNA, and schematic representation of the complementarity of each of these host target binding sites to VGAM1334 RNA, herein designated VGAM RNA, are described hereinbelow with reference to Table 2.

As mentioned hereinabove with reference to FIG. 1, a function of VGAM1334 gene, herein designated VGAM is inhibition of expression of VGAM1334 target genes. It is appreciated that specific functions, and accordingly utilities, of VGAM1334 correlate with, and may be deduced from, the identity of the target genes which VGAM1334 binds and inhibits, and the function of these target genes, as elaborated hereinbelow.

Coagulation Factor III (thromboplastin, tissue factor) (F3, Accession XM_040465) is a VGAM1334 host target gene. F3 BINDING SITE is HOST TARGET binding site found in the 3' untranslated region of mRNA encoded by F3, corresponding to a HOST TARGET binding site such as BINDING SITE I, BINDING SITE II or BINDING SITE III. Table 2 illustrates the complementarity of the nucleotide sequences of F3 BINDING SITE, designated SEQ ID:33295, to the nucleotide sequence of VGAM1334 RNA, herein designated VGAM RNA, also designated SEQ ID:4045.

A function of VGAM1334 is therefore inhibition of Coagulation Factor III (thromboplastin, tissue factor) (F3, Accession XM_040465), a gene which functions in normal hemostasis. Accordingly, utilities of VGAM1334 include diagnosis, prevention and treatment of diseases and clinical conditions associated with F3. The function of F3 and its association with various diseases and clinical conditions, has been established by previous studies, as described hereinabove with reference to VGAM817. Ubiquitin Specific Protease 14 (tRNA-guanine transglycosylase) (USP14, Accession NM_005151) is another VGAM1334 host target gene. USP14 BINDING SITE is HOST TARGET binding site found in the 3' untranslated region of mRNA encoded by USP14, corresponding to a HOST TARGET binding site such as BINDING SITE I, BINDING SITE II or BINDING SITE III. Table 2 illustrates the complementarity of the nucleotide sequences of USP14 BINDING SITE, designated SEQ ID:11626, to the nucleotide sequence of VGAM1334 RNA, herein designated VGAM RNA, also designated SEQ ID:4045.

Another function of VGAM1334 is therefore inhibition of Ubiquitin Specific Protease 14 (tRNA-guanine transglycosylase) (USP14, Accession NM_005151), a gene which is similar to ubiquitin-specific cysteine (thiol) proteases and tRNA-guanine transglycosylase. Accordingly, utilities of VGAM1334 include diagnosis, prevention and treatment of diseases and clinical conditions associated with USP14. The function of USP14 has been established by previous studies. Using Tgt purified from rabbit erythrocytes, Deshpande et al. (1996) measured significant tRNA-guanine transglycosylase activity. Noting significant sequence similarity between Tgt and the deubiquitinating enzyme family, they proposed that Tgt may act as a signal to link deficiency of the transglycosylase product, queuosine, to the ubiquitin-dependent proteolytic pathway for the removal of abnormal or inappropriately expressed proteins. The International Radiation Hybrid Mapping Consortium mapped the USP14 gene to chromosome 18 (SJGC-11272). Wilson et al. (2002) stated that 2 human neurologic disorders possibly involving alterations of synaptic function map to 18p near USP14: major affective disorder-1 (MAFD1; 125480) and schizophrenia disorder 8 (SCZD8; 603206). Animal model experiments lend further support to the function of USP14. Mice that are homozygous with respect to the spontaneous mutation ax (J) in the ataxia (ax) gene develop severe tremors by 2 to 3 weeks of age followed by hindlimb paralysis and death by 6 to 10 weeks of age. Wilson et al. (2002) showed that ax encodes Usp14, one of the large family of cysteine proteases that specifically feed ubiquitin conjugates. Although Usp14 can cleave a ubiquitin-tagged protein in vitro, it is unable to process polyubiquitin, which is belived to be associated with the protein aggregates seen in Parkinson disease, spinocerebellar ataxia type 1 (SCA1; 164400), and gracile axonal dystrophy (GAD) in mice. The physiologic substrate of Usp14 may therefore contain a monoubiquitin side chain, the removal of which would regulate processes such as protein localization and protein activity. Expression of Usp14 is altered in homozygous ax (J) mice as a result of the insertion of an intracisternal A particle (IAP) into intron 5 of Usp14. In contrast to other neurodegenerative disorders such as Parkinson disease and SCA1 in human S and GAD in mice, neither ubiquitin-positive protein aggregates nor neuronal cell loss was detectable in the CNS of ax (J) mice. Instead, these mice had defects in synaptic transmission in both the central and peripheral nervous systems. These results suggested that ubiquitin proteases are important in regulating synaptic activity in mammals.

It is appreciated that the abovementioned animal model for USP14 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Deshpande, K. L.; Seubert, P. H.; Tillman, D. M.; Farkas, W. R.; Katze, J. R.: Cloning and characterization of cDNA encoding the rabbit tRNA-guanine transglycosylase 60-kilodalton subunit. Arch. Biochem. Biophys. 326:1-7, 1996; and Wilson, S. M.; Bhattacharyya, B.; Rachel, R. A.; Coppola, V.; Tessarollo, L.; Householder, D. B.; Fletcher, C. F.; Miller, R. J.; Copeland, N. G.; Jenkins, N. A.: Synaptic defects in at.

Further studies establishing the function and utilities of USP14 are found in John Hopkins OMIM database record ID 607274, and in sited publications numbered 5389-5390 listed in the bibliography section hereinbelow, which are also hereby incorporated by reference. Chromosome 17 Open Reading Frame 26 (C17orf26, Accession NM_139177) is another VGAM1334 host target gene. C17orf26 BINDING SITE is HOST TARGET binding site found in the 3' untranslated region of mRNA encoded by C17orf26, corresponding to a HOST TARGET binding site such as BINDING SITE I, BINDING SITE II or BINDING SITE III. Table 2 illustrates the complementarity of the nucleotide sequences of C17orf26 BINDING SITE, designated SEQ ID:29184, to the nucleotide sequence of VGAM1334 RNA, herein designated VGAM RNA, also designated SEQ ID:4045.

Another function of VGAM1334 is therefore inhibition of Chromosome 17 Open Reading Frame 26 (C17orf26, Accession NM_139177). Accordingly, utilities of VGAM1334 include diagnosis, prevention and treatment of diseases and clinical conditions associated with C17orf26. MO25 (Accession NM_016289) is another VGAM1334 host target gene. MO25 BINDING SITE is HOST TARGET binding site found in the 3' untranslated region of mRNA encoded by MO25, corresponding to a HOST TARGET binding site such as BINDING SITE I, BINDING SITE II or BINDING SITE III. Table 2 illustrates the complementarity of the nucleotide sequences of MO25 BINDING SITE, designated SEQ ID:18413, to the nucleotide sequence of VGAM1334 RNA, herein designated VGAM RNA, also designated SEQ ID:4045.

Another function of VGAM1334 is therefore inhibition of MO25 (Accession NM_016289). Accordingly, utilities of VGAM1334 include diagnosis, prevention and treatment of diseases and clinical conditions associated with MO25. Solute Carrier Family 11 (proton-coupled divalent metal ion transporters), Member 2 (SLC11A2, Accession NM_000617) is another VGAM1334 host target gene. SLC11A2 BINDING SITE is HOST TARGET binding site found in the 3' untranslated region of mRNA encoded by SLC11A2, corresponding to a HOST TARGET binding site such as BINDING SITE I, BINDING SITE II or BINDING SITE III. Table 2 illustrates the complementarity of the nucleotide sequences of SLC11A2 BINDING SITE, designated SEQ ID:6227, to the nucleotide sequence of VGAM1334 RNA, herein designated VGAM RNA, also designated SEQ ID:4045.

Another function of VGAM1334 is therefore inhibition of Solute Carrier Family 11 (proton-coupled divalent metal ion transporters), Member 2 (SLC11A2, Accession NM_000617). Accordingly, utilities of VGAM1334 include diagnosis, prevention and treatment of diseases and clinical conditions associated with SLC11A2. FIG. 1 further provides a conceptual description of a novel bioinformatically detected viral gene of the present invention, referred to here as Viral Genomic Address Messenger 1335 (VGAM1335) viral gene, which modulates expression of respective host target genes thereof, the function and utility of which host target genes is known in the art.

VGAM1335 is a novel bioinformatically detected regulatory, non protein coding, viral micro RNA (miRNA) gene. The method by which VGAM1335 was detected is described hereinabove with reference to FIGS. 1-8.

VGAM1335 gene, herein designated VGAM GENE, is a viral gene contained in the genome of Human Adenovirus A. VGAM1335 host target gene, herein designated VGAM HOST TARGET GENE, is a human gene contained in the human genome.

VGAM1335 gene encodes a VGAM1335 precursor RNA, herein designated VGAM PRECURSOR RNA. Similar to other miRNA genes, and unlike most ordinary genes, VGAM1335 precursor RNA does not encode a protein. A nucleotide sequence identical or highly similar to the nucleotide sequence of VGAM1335 precursor RNA is designated SEQ ID:1321, and is provided hereinbelow with reference to the sequence listing part. Nucleotide sequence SEQ ID:1321 is located at position 27935 relative to the genome of Human Adenovirus A.

VGAM1335 precursor RNA folds onto itself, forming VGAM1335 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1335 folded precursor RNA into VGAM1335 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 43%) nucleotide sequence of VGAM1335 RNA is designated SEQ ID:4046, and is provided hereinbelow with reference to the sequence listing part.

VGAM1335 host target gene, herein designated VGAM HOST TARGET GENE, encodes a corresponding messenger RNA, VGAM1335 host target RNA, herein designated VGAM HOST TARGET RNA. VGAM1335 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1335 RNA, herein designated VGAM RNA, binds complementarily to one or more host target binding sites located in untranslated regions of VGAM1335 host target RNA, herein designated VGAM HOST TARGET RNA. This complementary binding is due to the fact that the nucleotide sequence of VGAM1335 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1335 RNA, herein designated VGAM RNA, may have a different number of host target binding sites in untranslated regions of a VGAM1335 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1335 RNA, herein designated VGAM RNA, to host target binding sites on VGAM1335 host target RNA, herein designated VGAM HOST TARGET RNA, such as BINDING SITE I, BINDING SITE II and BINDING SITE III, inhibits translation of VGAM1335 host target RNA into VGAM1335 host target protein, herein designated VGAM HOST TARGET PROTEIN. VGAM host target protein is therefore outlined by a broken line.

It is appreciated that VGAM1335 host target gene, herein designated VGAM HOST TARGET GENE, in fact represents a plurality of VGAM1335 host target genes. The mRNA of each one of this plurality of VGAM1335 host target genes comprises one or more host target binding sites, each having a nucleotide sequence which is at least partly complementary to VGAM1335 RNA, herein designated VGAM RNA, and which when bound by VGAM1335 RNA causes inhibition of translation of respective one or more VGAM1335 host target proteins.

It is further appreciated by one skilled in the art that the mode of translational inhibition illustrated by FIG. 1 with specific reference to translational inhibition exerted by VGAM1335 gene, herein designated VGAM GENE, on one or more VGAM1335 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1335 is inhibition of expression of host target genes, as part of a novel viral mechanism of attacking a host. Accordingly, utilities of VGAM1335 include diagnosis, prevention and treatment of viral infection by Human Adenovirus A. Specific functions, and accordingly utilities, of VGAM1335 correlate with, and may be deduced from, the identity of the host target genes which VGAM1335 binds and inhibits, and the function of these host target genes, as elaborated hereinbelow.

Nucleotide sequences of the VGAM1335 precursor RNA, herein designated VGAM PRECURSOR RNA, and of the 'diced' VGAM1335 RNA, herein designated VGAM RNA, and a schematic representation of the secondary folding of VGAM1335 folded precursor RNA, herein designated VGAM FOLDED PRECURSOR RNA, of VGAM1335 are further described hereinbelow with reference to Table 1.

Nucleotide sequences of host target binding sites, such as BINDING SITE-I, BINDING SITE-II and BINDING SITE-III of FIG. 1, found on VGAM1335 host target RNA, and schematic representation of the complementarity of each of these host target binding sites to VGAM1335 RNA, herein designated VGAM RNA, are described hereinbelow with reference to Table 2.

As mentioned hereinabove with reference to FIG. 1, a function of VGAM1335 gene, herein designated VGAM is inhibition of expression of VGAM1335 target genes. It is appreciated that specific functions, and accordingly utilities, of VGAM1335 correlate with, and may be deduced from, the identity of the target genes which VGAM1335 binds and inhibits, and the function of these target genes, as elaborated hereinbelow.

Carbohydrate (N-acetylglucosamine 6-O) Sulfotransferase 6 (CHST6, Accession NM_021615) is a VGAM1335 host target gene. CHST6 BINDING SITE is HOST TARGET binding site found in the 3' untranslated region of mRNA encoded by CHST6, corresponding to a HOST TARGET binding site such as BINDING SITE I, BINDING SITE II or BINDING SITE III. Table 2 illustrates the complementarity of the nucleotide sequences of CHST6 BINDING SITE, designated SEQ ID:22244, to the nucleotide sequence of VGAM1335 RNA, herein designated VGAM RNA, also designated SEQ ID:4046.

A function of VGAM1335 is therefore inhibition of Carbohydrate (N-acetylglucosamine 6-O) Sulfotransferase 6 (CHST6, Accession NM_021615). Accordingly, utilities of VGAM1335 include diagnosis, prevention and treatment of diseases and clinical conditions associated with CHST6. Retinoblastoma 1 (including osteosarcoma) (RB1, Accession XM_165641) is another VGAM1335 host target gene. RB1 BINDING SITE is HOST TARGET binding site found in the 3' untranslated region of mRNA encoded by RB1, corresponding to a HOST TARGET binding site such as BINDING SITE I, BINDING SITE II or BINDING SITE III. Table 2 illustrates the complementarity of the nucleotide sequences of RB1 BINDING SITE, designated SEQ ID:43705, to the nucleotide sequence of VGAM1335 RNA, herein designated VGAM RNA, also designated SEQ ID:4046.

Another function of VGAM1335 is therefore inhibition of Retinoblastoma 1 (including osteosarcoma) (RB1, Accession XM_165641), a gene which probably acts as a regulator of other genes. Accordingly, utilities of VGAM1335 include diagnosis, prevention and treatment of diseases and clinical conditions associated with RB1. The function of RB1 and its association with various diseases and clinical conditions, has been established by previous studies, as described hereinabove with reference to VGAM795. Zinc Finger Protein 2 (A1-5) (ZNF2, Accession NM_021088) is another VGAM1335 host target gene. ZNF2 BINDING SITE is HOST TARGET binding site found in the 3' untranslated region of mRNA encoded by ZNF2, corresponding to a HOST TARGET binding site such as BINDING SITE I, BINDING SITE II or BINDING SITE III. Table 2 illustrates the complementarity of the nucleotide sequences of ZNF2 BINDING SITE, designated SEQ ID:22068, to the nucleotide sequence of VGAM1335 RNA, herein designated VGAM RNA, also designated SEQ ID:4046.

Another function of VGAM1335 is therefore inhibition of Zinc Finger Protein 2 (A1-5) (ZNF2, Accession NM_021088). Accordingly, utilities of VGAM1335 include diagnosis, prevention and treatment of diseases and clinical conditions associated with ZNF2. Chromosome 1 Open Reading Frame 22 (C1orf22, Accession NM_025191) is another VGAM1335 host target gene. C1orf22 BINDING SITE is HOST TARGET binding site found in the 3' untranslated region of mRNA encoded by C1orf22, corresponding to a HOST TARGET binding site such as BINDING SITE I, BINDING SITE II or BINDING SITE III. Table 2 illustrates the complementarity of the nucleotide sequences of C1orf22 BINDING SITE, designated SEQ ID:24843, to the nucleotide sequence of VGAM1335 RNA, herein designated VGAM RNA, also designated SEQ ID:4046.

Another function of VGAM1335 is therefore inhibition of Chromosome 1 Open Reading Frame 22 (C1orf22, Accession NM_025191). Accordingly, utilities of VGAM1335 include diagnosis, prevention and treatment of diseases and clinical conditions associated with C1orf22. Cyclin M1 (CNNM1, Accession NM_020348) is another VGAM1335 host target gene. CNNM1 BINDING SITE is HOST TARGET binding site found in the 3' untranslated region of mRNA encoded by CNNM1, corresponding to a HOST TARGET binding site such as BINDING SITE I, BINDING SITE II or BINDING SITE III. Table 2 illustrates the complementarity of the nucleotide sequences of CNNM1 BINDING SITE, designated SEQ ID:21612, to the nucleotide sequence of VGAM1335 RNA, herein designated VGAM RNA, also designated SEQ ID:4046.

Another function of VGAM1335 is therefore inhibition of Cyclin M1 (CNNM1, Accession NM_020348). Accordingly, utilities of VGAM1335 include diagnosis, prevention and treatment of diseases and clinical conditions associated with CNNM1. FLJ10619 (Accession NM_018156) is another VGAM1335 host target gene. FLJ10619 BINDING SITE is HOST TARGET binding site found in the 3' untranslated region of mRNA encoded by FLJ10619, corresponding to a HOST TARGET binding site such as BINDING SITE I, BINDING SITE II or BINDING SITE III. Table 2 illustrates the complementarity of the nucleotide sequences of FLJ10619 BINDING SITE, designated SEQ ID:19970, to the nucleotide sequence of VGAM1335 RNA, herein designated VGAM RNA, also designated SEQ ID:4046.

Another function of VGAM1335 is therefore inhibition of FLJ10619 (Accession NM_018156). Accordingly, utilities of VGAM1335 include diagnosis, prevention and treatment of diseases and clinical conditions associated with FLJ10619. FLJ20986 (Accession NM_024524) is another VGAM1335 host target gene. FLJ20986 BINDING SITE is HOST TARGET binding site found in the 5' untranslated region of mRNA encoded by FLJ20986, corresponding to a HOST TARGET binding site such as BINDING SITE I, BINDING SITE II or BINDING SITE III. Table 2 illustrates the complementarity of the nucleotide sequences of FLJ20986 BINDING SITE, designated SEQ ID:23729, to the nucleotide sequence of VGAM1335 RNA, herein designated VGAM RNA, also designated SEQ ID:4046.

Another function of VGAM1335 is therefore inhibition of FLJ20986 (Accession NM_024524). Accordingly, utilities of VGAM1335 include diagnosis, prevention and treatment of diseases and clinical conditions associated with FLJ20986. KIAA0748 (Accession NM_014796) is another VGAM1335 host target gene. KIAA0748 BINDING SITE is HOST TARGET binding site found in the 3' untranslated region of mRNA encoded by KIAA0748, corresponding to a HOST TARGET binding site such as BINDING SITE I, BINDING SITE II or BINDING SITE III. Table 2 illustrates the complementarity of the nucleotide sequences of KIAA0748 BINDING SITE, designated SEQ ID:16702, to the nucleotide sequence of VGAM1335 RNA, herein designated VGAM RNA, also designated SEQ ID:4046.

Another function of VGAM1335 is therefore inhibition of KIAA0748 (Accession NM_014796). Accordingly, utilities of VGAM1335 include diagnosis, prevention and treatment of diseases and clinical conditions associated with KIAA0748. MDS028 (Accession NM_018463) is another VGAM1335 host target gene. MDS028 BINDING SITE is HOST TARGET binding site found in the 3' untranslated region of mRNA encoded by MDS028, corresponding to a HOST TARGET binding site such as BINDING SITE I, BINDING SITE II or BINDING SITE III. Table 2 illustrates the complementarity of the nucleotide sequences of MDS028 BINDING SITE, designated SEQ ID:20537, to the nucleotide sequence of VGAM1335 RNA, herein designated VGAM RNA, also designated SEQ ID:4046.

Another function of VGAM1335 is therefore inhibition of MDS028 (Accession NM_018463). Accordingly, utilities of VGAM1335 include diagnosis, prevention and treatment of diseases and clinical conditions associated with MDS028. Pleiomorphic Adenoma Gene-like 2 (PLAGL2, Accession XM_047007) is another VGAM1335 host target gene. PLAGL2 BINDING SITE is HOST TARGET binding site found in the 3' untranslated region of mRNA encoded by PLAGL2, corresponding to a HOST TARGET binding site such as BINDING SITE I, BINDING SITE II or BINDING SITE III. Table 2 illustrates the complementarity of the nucleotide sequences of PLAGL2 BINDING SITE, designated SEQ ID:34883, to the nucleotide sequence of VGAM1335 RNA, herein designated VGAM RNA, also designated SEQ ID:4046.

Another function of VGAM1335 is therefore inhibition of Pleiomorphic Adenoma Gene-like 2 (PLAGL2, Accession XM_047007). Accordingly, utilities of VGAM1335 include diagnosis, prevention and treatment of diseases and clinical conditions associated with PLAGL2. SCYB5 (Accession NM_002994) is another VGAM1335 host target gene. SCYB5 BINDING SITE is HOST TARGET binding site found in the 3' untranslated region of mRNA encoded by SCYB5, corresponding to a HOST TARGET binding site such as BINDING SITE I, BINDING SITE II or BINDING SITE III. Table 2 illustrates the complementarity of the nucleotide sequences of SCYB5 BINDING SITE, designated SEQ ID:8885, to the nucleotide sequence of VGAM1335 RNA, herein designated VGAM RNA, also designated SEQ ID:4046.

Another function of VGAM1335 is therefore inhibition of SCYB5 (Accession NM_002994). Accordingly, utilities of VGAM1335 include diagnosis, prevention and treatment of diseases and clinical conditions associated with SCYB5. Tumor Protein P53 Inducible Nuclear Protein 1 (TP53INP1, Accession NM_033285) is another VGAM1335 host target gene. TP53INP1 BINDING SITE1 and TP53INP1 BINDING SITE2 are HOST TARGET binding sites found in untranslated regions of mRNA encoded by TP53INP1, corresponding to HOST TARGET binding sites such as BINDING SITE I, BINDING SITE II or BINDING SITE III. Table 2 illustrates the complementarity of the nucleotide sequences of TP53INP1 BINDING SITE1 and TP53INP1 BINDING SITE2, designated SEQ ID:27113 and SEQ ID:36122 respectively, to the nucleotide sequence of VGAM1335 RNA, herein designated VGAM RNA, also designated SEQ ID:4046.

Another function of VGAM1335 is therefore inhibition of Tumor Protein P53 Inducible Nuclear Protein 1 (TP53INP1, Accession NM_033285). Accordingly, utilities of VGAM1335 include diagnosis, prevention and treatment of diseases and clinical conditions associated with TP53INP1. LOC158798 (Accession XM_088671) is another VGAM1335 host target gene. LOC158798 BINDING SITE is HOST TARGET binding site found in the 5' untranslated region of mRNA encoded by LOC158798, corresponding to a HOST TARGET binding site such as BINDING SITE I, BINDING SITE II or BINDING SITE III. Table 2 illustrates the complementarity of the nucleotide sequences of LOC158798 BINDING SITE, designated SEQ ID:39893, to the nucleotide sequence of VGAM1335 RNA, herein designated VGAM RNA, also designated SEQ ID:4046.

Another function of VGAM1335 is therefore inhibition of LOC158798 (Accession XM_088671). Accordingly, utilities of VGAM1335 include diagnosis, prevention and treatment of diseases and clinical conditions associated with LOC158798. LOC196411 (Accession XM_113714) is another VGAM1335 host target gene. LOC196411 BINDING SITE is HOST TARGET binding site found in the 3' untranslated region of mRNA encoded by LOC196411, corresponding to a HOST TARGET binding site such as BINDING SITE I, BINDING SITE II or BINDING SITE III. Table 2 illustrates the complementarity of the nucleotide sequences of LOC196411 BINDING SITE, designated SEQ ID:42364, to the nucleotide sequence of VGAM1335 RNA, herein designated VGAM RNA, also designated SEQ ID:4046.

Another function of VGAM1335 is therefore inhibition of LOC196411 (Accession XM_113714). Accordingly, utilities of VGAM1335 include diagnosis, prevention and treatment of diseases and clinical conditions associated with LOC196411. LOC90233 (Accession NM_138347) is another VGAM1335 host target gene. LOC90233 BINDING SITE is HOST TARGET binding site found in the 3' untranslated region of mRNA encoded by LOC90233, corresponding to a HOST TARGET binding site such as BINDING SITE I, BINDING SITE II or BINDING SITE III. Table 2 illustrates the complementarity of the nucleotide sequences of LOC90233 BINDING SITE, designated SEQ ID:28745, to the nucleotide sequence of VGAM1335 RNA, herein designated VGAM RNA, also designated SEQ ID:4046.

Another function of VGAM1335 is therefore inhibition of LOC90233 (Accession NM_138347). Accordingly, utilities of VGAM1335 include diagnosis, prevention and treatment of diseases and clinical conditions associated with LOC90233. FIG. 1 further provides a conceptual description of a novel bioinformatically detected viral gene of the present invention, referred to here as Viral Genomic Address Messenger 1336 (VGAM1336) viral gene, which modulates expression of respective host target genes thereof, the function and utility of which host target genes is known in the art.

VGAM1336 is a novel bioinformatically detected regulatory, non protein coding, viral micro RNA (miRNA) gene. The method by which VGAM1336 was detected is described hereinabove with reference to FIGS. 1-8.

VGAM1336 gene, herein designated VGAM GENE, is a viral gene contained in the genome of Sheeppox Virus. VGAM1336 host target gene, herein designated VGAM HOST TARGET GENE, is a human gene contained in the human genome.

VGAM1336 gene encodes a VGAM1336 precursor RNA, herein designated VGAM PRECURSOR RNA. Similar to other miRNA genes, and unlike most ordinary genes, VGAM1336 precursor RNA does not encode a protein. A nucleotide sequence identical or highly similar to the nucleotide sequence of VGAM1336 precursor RNA is designated SEQ ID:1322, and is provided hereinbelow with reference to the sequence listing part. Nucleotide sequence SEQ ID:1322 is located at position 83573 relative to the genome of Sheeppox Virus.

VGAM1336 precursor RNA folds onto itself, forming VGAM1336 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1336 folded precursor RNA into VGAM1336 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1336 RNA is designated SEQ ID:4047, and is provided hereinbelow with reference to the sequence listing part.

VGAM1336 host target gene, herein designated VGAM HOST TARGET GENE, encodes a corresponding messenger RNA, VGAM1336 host target RNA, herein designated VGAM HOST TARGET RNA. VGAM1336 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1336 RNA, herein designated VGAM RNA, binds complementarily to one or more host target binding sites located in untranslated regions of VGAM1336 host target RNA, herein designated VGAM HOST TARGET RNA. This complementary binding is due to the fact that the nucleotide sequence of VGAM1336 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1336 RNA, herein designated VGAM RNA, may have a different number of host target binding sites in untranslated regions of a VGAM1336 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1336 RNA, herein designated VGAM RNA, to host target binding sites on VGAM1336 host target RNA, herein designated VGAM HOST TARGET RNA, such as BINDING SITE I, BINDING SITE II and BINDING SITE III, inhibits translation of VGAM1336 host target RNA into VGAM1336 host target protein, herein designated VGAM HOST TARGET PROTEIN. VGAM host target protein is therefore outlined by a broken line.

It is appreciated that VGAM1336 host target gene, herein designated VGAM HOST TARGET GENE, in fact represents a plurality of VGAM1336 host target genes. The mRNA of each one of this plurality of VGAM1336 host target genes comprises one or more host target binding sites, each having a nucleotide sequence which is at least partly complementary to VGAM1336 RNA, herein designated VGAM RNA, and which when bound by VGAM1336 RNA causes inhibition of translation of respective one or more VGAM1336 host target proteins.

It is further appreciated by one skilled in the art that the mode of translational inhibition illustrated by FIG. 1 with specific reference to translational inhibition exerted by VGAM1336 gene, herein designated VGAM GENE, on one or more VGAM1336 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1336 is inhibition of expression of host target genes, as part of a novel viral mechanism of attacking a host. Accordingly, utilities of VGAM1336 include diagnosis, prevention and treatment of viral infection by Sheeppox Virus. Specific functions, and accordingly utilities, of VGAM1336 correlate with, and may be deduced from, the identity of the host target genes which VGAM1336 binds and inhibits, and the function of these host target genes, as elaborated hereinbelow.

Nucleotide sequences of the VGAM1336 precursor RNA, herein designated VGAM PRECURSOR RNA, and of the 'diced' VGAM1336 RNA, herein designated VGAM RNA, and a schematic representation of the secondary folding of VGAM1336 folded precursor RNA, herein designated VGAM FOLDED PRECURSOR RNA, of VGAM1336 are further described hereinbelow with reference to Table 1.

Nucleotide sequences of host target binding sites, such as BINDING SITE-I, BINDING SITE-II and BINDING SITE-III of FIG. 1, found on VGAM1336 host target RNA, and schematic representation of the complementarity of each of these host target binding sites to VGAM1336 RNA, herein designated VGAM RNA, are described hereinbelow with reference to Table 2.

As mentioned hereinabove with reference to FIG. 1, a function of VGAM1336 gene, herein designated VGAM is inhibition of expression of VGAM1336 target genes. It is appreciated that specific functions, and accordingly utilities, of VGAM1336 correlate with, and may be deduced from, the identity of the target genes which VGAM1336 binds and inhibits, and the function of these target genes, as elaborated hereinbelow.

NCK-associated Protein 1 (NCKAP1, Accession NM_013436) is a VGAM1336 host target gene. NCKAP1 BINDING SITE is HOST TARGET binding site found in the 3' untranslated region of mRNA encoded by NCKAP1, corresponding to a HOST TARGET binding site such as BINDING SITE I, BINDING SITE II or BINDING SITE III. Table 2 illustrates the complementarity of the nucleotide sequences of NCKAP1 BINDING SITE, designated SEQ ID:15095, to the nucleotide sequence of VGAM1336 RNA, herein designated VGAM RNA, also designated SEQ ID:4047.

A function of VGAM1336 is therefore inhibition of NCK-associated Protein 1 (NCKAP1, Accession NM_013436). Accordingly, utilities of VGAM1336 include diagnosis, prevention and treatment of diseases and clinical conditions associated with NCKAP1. ATPase, Class V, Type 10D (ATP10D, Accession XM_054907) is another VGAM1336 host target gene. ATP10D BINDING SITE is HOST TARGET binding site found in the 3' untranslated region of mRNA encoded by ATP10D, corresponding to a HOST TARGET binding site such as BINDING SITE I, BINDING SITE II or BINDING SITE III. Table 2 illustrates the complementarity of the nucleotide sequences of ATP10D BINDING SITE, designated SEQ ID:36200, to the nucleotide sequence of VGAM1336 RNA, herein designated VGAM RNA, also designated SEQ ID:4047.

Another function of VGAM1336 is therefore inhibition of ATPase, Class V, Type 10D (ATP10D, Accession XM_054907). Accordingly, utilities of VGAM1336 include diagnosis, prevention and treatment of diseases and clinical conditions associated with ATP10D. FLJ12085 (Accession NM_022771) is another VGAM1336 host target gene. FLJ12085 BINDING SITE is HOST TARGET binding site found in the 3' untranslated region of mRNA encoded by FLJ12085, corresponding to a HOST TARGET binding site such as BINDING SITE I, BINDING SITE II or BINDING SITE III. Table 2 illustrates the complementarity of the nucleotide sequences of FLJ12085 BINDING SITE, designated SEQ ID:23032, to the nucleotide sequence of VGAM1336 RNA, herein designated VGAM RNA, also designated SEQ ID:4047.

Another function of VGAM1336 is therefore inhibition of FLJ12085 (Accession NM_022771). Accordingly, utilities of VGAM1336 include diagnosis, prevention and treatment of diseases and clinical conditions associated with FLJ12085. Microtubule-actin Crosslinking Factor 1 (MACF1, Accession NM_012090) is another VGAM1336 host target gene. MACF1 BINDING SITE is HOST TARGET binding site found in the 3' untranslated region of mRNA encoded by MACF1, corresponding to a HOST TARGET binding site such as BINDING SITE I, BINDING SITE II or BINDING SITE III. Table 2 illustrates the complementarity of the nucleotide sequences of MACF1 BINDING SITE, designated SEQ ID:14379, to the nucleotide sequence of VGAM1336 RNA, herein designated VGAM RNA, also designated SEQ ID:4047.

Another function of VGAM1336 is therefore inhibition of Microtubule-actin Crosslinking Factor 1 (MACF1, Accession NM_012090). Accordingly, utilities of VGAM1336 include diagnosis, prevention and treatment of diseases and clinical conditions associated with MACF1. SCLY (Accession NM_016510) is another VGAM1336 host target gene. SCLY BINDING SITE is HOST TARGET binding site found in the 3' untranslated region of mRNA encoded by SCLY, corresponding to a HOST TARGET binding site such as BINDING SITE I, BINDING SITE II or BINDING SITE III. Table 2 illustrates the complementarity of the nucleotide sequences of SCLY BINDING SITE, designated SEQ ID:18588, to the nucleotide sequence of VGAM1336 RNA, herein designated VGAM RNA, also designated SEQ ID:4047.

Another function of VGAM1336 is therefore inhibition of SCLY (Accession NM_016510). Accordingly, utilities of VGAM1336 include diagnosis, prevention and treatment of diseases and clinical conditions associated with SCLY. LOC143879 (Accession XM_084666) is another VGAM1336 host target gene. LOC143879 BINDING SITE is HOST TARGET binding site found in the 3' untranslated region of mRNA encoded by LOC143879, corresponding to a HOST TARGET binding site such as BINDING SITE I, BINDING SITE II or BINDING SITE III. Table 2 illustrates the complementarity of the nucleotide sequences of LOC143879 BINDING SITE, designated SEQ ID:37658, to the nucleotide sequence of VGAM1336 RNA, herein designated VGAM RNA, also designated SEQ ID:4047.

Another function of VGAM1336 is therefore inhibition of LOC143879 (Accession XM_084666). Accordingly, utilities of VGAM1336 include diagnosis, prevention and treatment of diseases and clinical conditions associated with LOC143879. LOC197131 (Accession XM_113823) is another VGAM1336 host target gene. LOC197131 BINDING SITE is HOST TARGET binding site found in the 3' untranslated region of mRNA encoded by LOC197131, corresponding to a HOST TARGET binding site such as BINDING SITE I, BINDING SITE II or BINDING SITE III. Table 2 illustrates the complementarity of the nucleotide sequences of LOC197131 BINDING SITE, designated SEQ ID:42447, to the nucleotide sequence of VGAM1336 RNA, herein designated VGAM RNA, also designated SEQ ID:4047.

Another function of VGAM1336 is therefore inhibition of LOC197131 (Accession XM_113823). Accordingly, utilities of VGAM1336 include diagnosis, prevention and treatment of diseases and clinical conditions associated with LOC197131. FIG. 1 further provides a conceptual description of a novel bioinformatically detected viral gene of the present invention, referred to here as Viral Genomic Address Messenger 1337 (VGAM1337) viral gene, which modulates expression of respective host target genes thereof, the function and utility of which host target genes is known in the art.

VGAM1337 is a novel bioinformatically detected regulatory, non protein coding, viral micro RNA (miRNA) gene. The method by which VGAM1337 was detected is described hereinabove with reference to FIGS. 1-8.

VGAM1337 gene, herein designated VGAM GENE, is a viral gene contained in the genome of Sheeppox Virus. VGAM1337 host target gene, herein designated VGAM HOST TARGET GENE, is a human gene contained in the human genome.

VGAM1337 gene encodes a VGAM1337 precursor RNA, herein designated VGAM PRECURSOR RNA. Similar to other miRNA genes, and unlike most ordinary genes, VGAM1337 precursor RNA does not encode a protein. A nucleotide sequence identical or highly similar to the nucleotide sequence of VGAM1337 precursor RNA is designated SEQ ID:1323, and is provided hereinbelow with reference to the sequence listing part. Nucleotide sequence SEQ ID:1323 is located at position 84667 relative to the genome of Sheeppox Virus.

VGAM1337 precursor RNA folds onto itself, forming VGAM1337 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1337 folded precursor RNA into VGAM1337 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1337 RNA is designated SEQ ID:4048, and is provided hereinbelow with reference to the sequence listing part.

VGAM1337 host target gene, herein designated VGAM HOST TARGET GENE, encodes a corresponding messenger RNA, VGAM1337 host target RNA, herein designated VGAM HOST TARGET RNA. VGAM1337 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1337 RNA, herein designated VGAM RNA, binds complementarily to one or more host target binding sites located in untranslated regions of VGAM1337 host target RNA, herein designated VGAM HOST TARGET RNA. This complementary binding is due to the fact that the nucleotide sequence of VGAM1337 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1337 RNA, herein designated VGAM RNA, may have a different number of host target binding sites in untranslated regions of a VGAM1337 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1337 RNA, herein designated VGAM RNA, to host target binding sites on VGAM1337 host target RNA, herein designated VGAM HOST TARGET RNA, such as BINDING SITE I, BINDING SITE II and BINDING SITE III, inhibits translation of VGAM1337 host target RNA into VGAM1337 host target protein, herein designated VGAM HOST TARGET PROTEIN. VGAM host target protein is therefore outlined by a broken line.

It is appreciated that VGAM1337 host target gene, herein designated VGAM HOST TARGET GENE, in fact represents a plurality of VGAM1337 host target genes. The mRNA of each one of this plurality of VGAM1337 host target genes comprises one or more host target binding sites, each having a nucleotide sequence which is at least partly complementary to VGAM1337 RNA, herein designated VGAM RNA, and which when bound by VGAM1337 RNA causes inhibition of translation of respective one or more VGAM1337 host target proteins.

It is further appreciated by one skilled in the art that the mode of translational inhibition illustrated by FIG. 1 with specific reference to translational inhibition exerted by VGAM1337 gene, herein designated VGAM GENE, on one or more VGAM1337 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1337 is inhibition of expression of host target genes, as part of a novel viral mechanism of attacking a host. Accordingly, utilities of VGAM1337 include diagnosis, prevention and treatment of viral infection by Sheeppox Virus. Specific functions, and accordingly utilities, of VGAM1337 correlate with, and may be deduced from, the identity of the host target genes which VGAM1337 binds and inhibits, and the function of these host target genes, as elaborated hereinbelow.

Nucleotide sequences of the VGAM1337 precursor RNA, herein designated VGAM PRECURSOR RNA, and of the 'diced' VGAM1337 RNA, herein designated VGAM RNA, and a schematic representation of the secondary folding of VGAM1337 folded precursor RNA, herein designated VGAM FOLDED PRECURSOR RNA, of VGAM1337 are further described hereinbelow with reference to Table 1.

Nucleotide sequences of host target binding sites, such as BINDING SITE-I, BINDING SITE-II and BINDING SITE-III of FIG. 1, found on VGAM1337 host target RNA, and schematic representation of the complementarity of each of these host target binding sites to VGAM1337 RNA, herein designated VGAM RNA, are described hereinbelow with reference to Table 2.

As mentioned hereinabove with reference to FIG. 1, a function of VGAM1337 gene, herein designated VGAM is inhibition of expression of VGAM1337 target genes. It is appreciated that specific functions, and accordingly utilities, of VGAM1337 correlate with, and may be deduced from, the identity of the target genes which VGAM1337 binds and inhibits, and the function of these target genes, as elaborated hereinbelow.

RAN Binding Protein 2 (RANBP2, Accession NM_006267) is a VGAM1337 host target gene. RANBP2 BINDING SITE is HOST TARGET binding site found in the 3' untranslated region of mRNA encoded by RANBP2, corresponding to a HOST TARGET binding site such as BINDING SITE I, BINDING SITE II or BINDING SITE III. Table 2 illustrates the complementarity of the nucleotide sequences of RANBP2 BINDING SITE, designated SEQ ID:12948, to the nucleotide sequence of VGAM1337 RNA, herein designated VGAM RNA, also designated SEQ ID:4048.

A function of VGAM1337 is therefore inhibition of RAN Binding Protein 2 (RANBP2, Accession NM_006267), a gene which is thought to control a variety of cellular functions through its interactions with other proteins. Accordingly, utilities of VGAM1337 include diagnosis, prevention and treatment of diseases and clinical conditions associated with RANBP2. The function of RANBP2 has been established by previous studies. RAN (OMIM Ref. No. 601179) is a small GTP-binding protein of the RAS superfamily (see OMIM Ref. No. 190020) that is associated with the nuclear membrane and is thought to control a variety of cellular functions through its interactions with other proteins. Yokoyama et al. (1995) described a human cDNA for one such RAN-binding protein which they cloned using a 2-hybrid screen with RAN. The cDNA, designated RANBP2 (RAN-binding protein-2) by them, encodes a very large protein (3,224 amino acids) that was immunolocalized to the nuclear pore complex. The protein has a 700-residue leucine-rich domain at the amino end, 4 motifs in common with RANBP1 (OMIM Ref. No. 601180), 8 zinc finger motifs, and a C terminus related to cyclophilin (OMIM Ref. No. 123840). The authors showed that an antibody directed against RANBP2 inhibited nuclear import. Beddow et al. (1995) described a nearly identical partial cDNA which contains a motif of about 150 residues that stabilizes the GTP-bound state of RAN. A mutation in that domain markedly reduced RAN binding. The gene is also referred to as NUP358 (Wu et al., 1995). Pichler et al. (2002) showed that the nucleoporin RANBP2 has SUMO1 (OMIM Ref. No. 601912) E3-like activity. RANBP2 directly interacts with the E2 enzyme UBC9 (OMIM Ref. No. 601661) and strongly enhances SUMO1 transfer from UBC9 to the SUMO1 target SP100 (OMIM Ref. No. 604585). The E3-like activity is contained within a 33-kD domain of RANBP2 that lacks RING finger motifs and does not resemble PIAS (see OMIM Ref. No. 603566) family proteins. These findings placed sumoylation at the cytoplasmic filaments of the nuclear pore complexes and suggested that, at least for some substrates, modification and nuclear import are linked events.

Full details of the abovementioned studies are described in the following publications, the disclosure of which are hereby incorporated by reference:

Beddow, A. L.; Richards, S. A.; Orem, N. R.; Macara, I. G.: The Ran/TC4 GTPase-binding domain: identification by expression cloning and characterization of a conserved sequence motif. Proc. Nat. Acad. Sci. 92:3328-3332, 1995; and Pichler, A.; Gast, A.; Seeler, J. S.; Dejean, A.; Melchior, F.: The nucleoporin RanBP2 has SUMO1 E3 ligase activity. Cell 108:109-120, 2002.

Further studies establishing the function and utilities of RANBP2 are found in John Hopkins OMIM database record ID 601181, and in sited publications numbered 9499-9504 listed in the bibliography section hereinbelow, which are also hereby incorporated by reference. DKFZp761D0614 (Accession XM_113634) is another VGAM1337 host target gene. DKFZp761D0614 BINDING SITE is HOST TARGET binding site found in the 3' untranslated region of mRNA encoded by DKFZp761D0614, corresponding to a HOST TARGET binding site such as BINDING SITE I, BINDING SITE II or BINDING SITE III. Table 2 illustrates the complementarity of the nucleotide sequences of DKFZp761D0614 BINDING SITE, designated SEQ ID:42313, to the nucleotide sequence of VGAM1337 RNA, herein designated VGAM RNA, also designated SEQ ID:4048.

Another function of VGAM1337 is therefore inhibition of DKFZp761D0614 (Accession XM_113634). Accordingly, utilities of VGAM1337 include diagnosis, prevention and treatment of diseases and clinical conditions associated with DKFZp761D0614. FLJ10546 (Accession XM_002989) is another VGAM1337 host target gene. FLJ10546 BINDING SITE is HOST TARGET binding site found in the 3' untranslated region of mRNA encoded by FLJ10546, corresponding to a HOST TARGET binding site such as BINDING SITE I, BINDING SITE II or BINDING SITE III. Table 2 illustrates the complementarity of the nucleotide sequences of FLJ10546 BINDING SITE, designated SEQ ID:29910, to the nucleotide sequence of VGAM1337 RNA, herein designated VGAM RNA, also designated SEQ ID:4048.

Another function of VGAM1337 is therefore inhibition of FLJ10546 (Accession XM_002989). Accordingly, utilities of VGAM1337 include diagnosis, prevention and treatment of diseases and clinical conditions associated with FLJ10546. FLJ23074 (Accession NM_025052) is another VGAM1337 host target gene. FLJ23074 BINDING SITE is HOST TARGET binding site found in the 3' untranslated region of mRNA encoded by FLJ23074, corresponding to a HOST TARGET binding site such as BINDING SITE I, BINDING SITE II or BINDING SITE III. Table 2 illustrates the complementarity of the nucleotide sequences of FLJ23074 BINDING SITE, designated SEQ ID:24651, to the nucleotide sequence of VGAM1337 RNA, herein designated VGAM RNA, also designated SEQ ID:4048.

Another function of VGAM1337 is therefore inhibition of FLJ23074 (Accession NM_025052). Accordingly, utilities of VGAM1337 include diagnosis, prevention and treatment of diseases and clinical conditions associated with FLJ23074. LOC123628 (Accession XM_063764) is another VGAM1337 host target gene. LOC123628 BINDING SITE is HOST TARGET binding site found in the 5' untranslated region of mRNA encoded by LOC123628, corresponding to a HOST TARGET binding site such as BINDING SITE I, BINDING SITE II or BINDING SITE III. Table 2 illustrates the complementarity of the nucleotide sequences of LOC123628 BINDING SITE, designated SEQ ID:37254, to the nucleotide sequence of VGAM1337 RNA, herein designated VGAM RNA, also designated SEQ ID:4048.

Another function of VGAM1337 is therefore inhibition of LOC123628 (Accession XM_063764). Accordingly, utilities of VGAM1337 include diagnosis, prevention and treatment of diseases and clinical conditions associated with LOC123628. FIG. 1 further provides a conceptual description of a novel bioinformatically detected viral gene of the present invention, referred to here as Viral Genomic Address Messenger 1338 (VGAM1338) viral gene, which modulates expression of respective host target genes thereof, the function and utility of which host target genes is known in the art.

VGAM1338 is a novel bioinformatically detected regulatory, non protein coding, viral micro RNA (miRNA) gene.

The method by which VGAM1338 was detected is described hereinabove with reference to FIGS. 1-8.

VGAM1338 gene, herein designated VGAM GENE, is a viral gene contained in the genome of Variola Virus. VGAM1338 host target gene, herein designated VGAM HOST TARGET GENE, is a human gene contained in the human genome.

VGAM1338 gene encodes a VGAM1338 precursor RNA, herein designated VGAM PRECURSOR RNA. Similar to other miRNA genes, and unlike most ordinary genes, VGAM1338 precursor RNA does not encode a protein. A nucleotide sequence identical or highly similar to the nucleotide sequence of VGAM1338 precursor RNA is designated SEQ ID:1324, and is provided hereinbelow with reference to the sequence listing part. Nucleotide sequence SEQ ID:1324 is located at position 146622 relative to the genome of Variola Virus.

VGAM1338 precursor RNA folds onto itself, forming VGAM1338 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1338 folded precursor RNA into VGAM1338 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1338 RNA is designated SEQ ID:4049, and is provided hereinbelow with reference to the sequence listing part.

VGAM1338 host target gene, herein designated VGAM HOST TARGET GENE, encodes a corresponding messenger RNA, VGAM1338 host target RNA, herein designated VGAM HOST TARGET RNA. VGAM1338 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1338 RNA, herein designated VGAM RNA, binds complementarily to one or more host target binding sites located in untranslated regions of VGAM1338 host target RNA, herein designated VGAM HOST TARGET RNA. This complementary binding is due to the fact that the nucleotide sequence of VGAM1338 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1338 RNA, herein designated VGAM RNA, may have a different number of host target binding sites in untranslated regions of a VGAM1338 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1338 RNA, herein designated VGAM RNA, to host target binding sites on VGAM1338 host target RNA, herein designated VGAM HOST TARGET RNA, such as BINDING SITE I, BINDING SITE II and BINDING SITE III, inhibits translation of VGAM1338 host target RNA into VGAM1338 host target protein, herein designated VGAM HOST TARGET PROTEIN. VGAM host target protein is therefore outlined by a broken line.

It is appreciated that VGAM1338 host target gene, herein designated VGAM HOST TARGET GENE, in fact represents a plurality of VGAM1338 host target genes. The mRNA of each one of this plurality of VGAM1338 host target genes comprises one or more host target binding sites, each having a nucleotide sequence which is at least partly complementary to VGAM1338 RNA, herein designated VGAM RNA, and which when bound by VGAM1338 RNA causes inhibition of translation of respective one or more VGAM1338 host target proteins.

It is further appreciated by one skilled in the art that the mode of translational inhibition illustrated by FIG. 1 with specific reference to translational inhibition exerted by VGAM1338 gene, herein designated VGAM GENE, on one or more VGAM1338 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1338 is inhibition of expression of host target genes, as part of a novel viral mechanism of attacking a host. Accordingly, utilities of VGAM1338 include diagnosis, prevention and treatment of viral infection by Variola Virus. Specific functions, and accordingly utilities, of VGAM1338 correlate with, and may be deduced from, the identity of the host target genes which VGAM1338 binds and inhibits, and the function of these host target genes, as elaborated hereinbelow.

Nucleotide sequences of the VGAM1338 precursor RNA, herein designated VGAM PRECURSOR RNA, and of the 'diced' VGAM1338 RNA, herein designated VGAM RNA, and a schematic representation of the secondary folding of VGAM1338 folded precursor RNA, herein designated VGAM FOLDED PRECURSOR RNA, of VGAM1338 are further described hereinbelow with reference to Table 1.

Nucleotide sequences of host target binding sites, such as BINDING SITE-I, BINDING SITE-II and BINDING SITE-III of FIG. 1, found on VGAM1338 host target RNA, and schematic representation of the complementarity of each of these host target binding sites to VGAM1338 RNA, herein designated VGAM RNA, are described hereinbelow with reference to Table 2.

As mentioned hereinabove with reference to FIG. 1, a function of VGAM1338 gene, herein designated VGAM is inhibition of expression of VGAM1338 target genes. It is appreciated that specific functions, and accordingly utilities, of VGAM1338 correlate with, and may be deduced from, the identity of the target genes which VGAM1338 binds and inhibits, and the function of these target genes, as elaborated hereinbelow.

FLJ13769 (Accession NM_025012) is a VGAM1338 host target gene. FLJ13769 BINDING SITE is HOST TARGET binding site found in the 3' untranslated region of mRNA encoded by FLJ13769, corresponding to a HOST TARGET binding site such as BINDING SITE I, BINDING SITE II or BINDING SITE III. Table 2 illustrates the complementarity of the nucleotide sequences of FLJ13769 BINDING SITE, designated SEQ ID:24595, to the nucleotide sequence of VGAM1338 RNA, herein designated VGAM RNA, also designated SEQ ID:4049.

A function of VGAM1338 is therefore inhibition of FLJ13769 (Accession NM_025012). Accordingly, utilities of VGAM1338 include diagnosis, prevention and treatment of diseases and clinical conditions associated with FLJ13769. KIAA1958 (Accession XM_088566) is another VGAM1338 host target gene. KIAA1958 BINDING SITE is HOST TARGET binding site found in the 3' untranslated region of mRNA encoded by KIAA1958, corresponding to a HOST TARGET binding site such as BINDING SITE I, BINDING SITE II or BINDING SITE III. Table 2 illustrates the complementarity of the nucleotide sequences of KIAA1958 BINDING SITE, designated SEQ ID:39830, to the nucleotide sequence of VGAM1338 RNA, herein designated VGAM RNA, also designated SEQ ID:4049.

Another function of VGAM1338 is therefore inhibition of KIAA1958 (Accession XM_088566). Accordingly, utilities of VGAM1338 include diagnosis, prevention and treatment of diseases and clinical conditions associated with KIAA1958. MGC26651 (Accession NM_144642) is another VGAM1338 host target gene. MGC26651 BINDING SITE is HOST TARGET binding site found in the 3' untranslated region of mRNA encoded by MGC26651, corresponding to a HOST TARGET binding site such as BINDING SITE I, BINDING SITE II or BINDING SITE III. Table 2 illustrates the complementarity of the nucleotide sequences of MGC26651 BINDING SITE, designated SEQ ID:29470, to the nucleotide sequence of VGAM1338 RNA, herein designated VGAM RNA, also designated SEQ ID:4049.

Another function of VGAM1338 is therefore inhibition of MGC26651 (Accession NM_144642). Accordingly, utilities of VGAM1338 include diagnosis, prevention and treatment of diseases and clinical conditions associated with MGC26651. FIG. 1 further provides a conceptual description of a novel bioinformatically detected viral gene of the present invention, referred to here as Viral Genomic Address Messenger 1339 (VGAM1339) viral gene, which modulates expression of respective host target genes thereof, the function and utility of which host target genes is known in the art.

VGAM1339 is a novel bioinformatically detected regulatory, non protein coding, viral micro RNA (miRNA) gene. The method by which VGAM1339 was detected is described hereinabove with reference to FIGS. 1-8.

VGAM1339 gene, herein designated VGAM GENE, is a viral gene contained in the genome of Fowlpox Virus. VGAM1339 host target gene, herein designated VGAM HOST TARGET GENE, is a human gene contained in the human genome.

VGAM1339 gene encodes a VGAM1339 precursor RNA, herein designated VGAM PRECURSOR RNA. Similar to other miRNA genes, and unlike most ordinary genes, VGAM1339 precursor RNA does not encode a protein. A nucleotide sequence identical or highly similar to the nucleotide sequence of VGAM1339 precursor RNA is designated SEQ ID:1325, and is provided hereinbelow with reference to the sequence listing part. Nucleotide sequence SEQ ID:1325 is located at position 245147 relative to the genome of Fowlpox Virus.

VGAM1339 precursor RNA folds onto itself, forming VGAM1339 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1339 folded precursor RNA into VGAM1339 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1339 RNA is designated SEQ ID:4050, and is provided hereinbelow with reference to the sequence listing part.

VGAM1339 host target gene, herein designated VGAM HOST TARGET GENE, encodes a corresponding messenger RNA, VGAM1339 host target RNA, herein designated VGAM HOST TARGET RNA. VGAM1339 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1339 RNA, herein designated VGAM RNA, binds complementarily to one or more host target binding sites located in untranslated regions of VGAM1339 host target RNA, herein designated VGAM HOST TARGET RNA. This complementary binding is due to the fact that the nucleotide sequence of VGAM1339 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1339 RNA, herein designated VGAM RNA, may have a different number of host target binding sites in untranslated regions of a VGAM1339 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1339 RNA, herein designated VGAM RNA, to host target binding sites on VGAM1339 host target RNA, herein designated VGAM HOST TARGET RNA, such as BINDING SITE I, BINDING SITE II and BINDING SITE III, inhibits translation of VGAM1339 host target RNA into VGAM1339 host target protein, herein designated VGAM HOST TARGET PROTEIN. VGAM host target protein is therefore outlined by a broken line.

It is appreciated that VGAM1339 host target gene, herein designated VGAM HOST TARGET GENE, in fact represents a plurality of VGAM1339 host target genes. The mRNA of each one of this plurality of VGAM1339 host target genes comprises one or more host target binding sites, each having a nucleotide sequence which is at least partly complementary to VGAM1339 RNA, herein designated VGAM RNA, and which when bound by VGAM1339 RNA causes inhibition of translation of respective one or more VGAM1339 host target proteins.

It is further appreciated by one skilled in the art that the mode of translational inhibition illustrated by FIG. 1 with specific reference to translational inhibition exerted by VGAM1339 gene, herein designated VGAM GENE, on one or more VGAM1339 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1339 is inhibition of expression of host target genes, as part of a novel viral mechanism of attacking a host. Accordingly, utilities of VGAM1339 include diagnosis, prevention and treatment of viral infection by Fowlpox Virus. Specific functions, and accordingly utilities, of VGAM1339 correlate with, and may be deduced from, the identity of the host target genes which VGAM1339 binds and inhibits, and the function of these host target genes, as elaborated hereinbelow.

Nucleotide sequences of the VGAM1339 precursor RNA, herein designated VGAM PRECURSOR RNA, and of the 'diced' VGAM1339 RNA, herein designated VGAM RNA, and a schematic representation of the secondary folding of VGAM1339 folded precursor RNA, herein designated VGAM FOLDED PRECURSOR RNA, of VGAM1339 are further described hereinbelow with reference to Table 1.

Nucleotide sequences of host target binding sites, such as BINDING SITE-I, BINDING SITE-II and BINDING SITE-III of FIG. 1, found on VGAM1339 host target RNA, and schematic representation of the complementarity of each of these host target binding sites to VGAM1339 RNA, herein designated VGAM RNA, are described hereinbelow with reference to Table 2.

As mentioned hereinabove with reference to FIG. 1, a function of VGAM1339 gene, herein designated VGAM is inhibition of expression of VGAM1339 target genes. It is appreciated that specific functions, and accordingly utilities, of VGAM1339 correlate with, and may be deduced from, the identity of the target genes which VGAM1339 binds and inhibits, and the function of these target genes, as elaborated hereinbelow.

LOC199725 (Accession XM_117119) is a VGAM1339 host target gene. LOC199725 BINDING SITE is HOST TARGET binding site found in the 3' untranslated region of mRNA encoded by LOC199725, corresponding to a HOST TARGET binding site such as BINDING SITE I, BINDING SITE II or BINDING SITE III. Table 2 illustrates the complementarity of the nucleotide sequences of LOC199725 BINDING SITE, designated SEQ ID:43242, to the nucleotide sequence of VGAM1339 RNA, herein designated VGAM RNA, also designated SEQ ID:4050.

A function of VGAM1339 is therefore inhibition of LOC199725 (Accession XM_117119). Accordingly, utilities of VGAM1339 include diagnosis, prevention and treatment of diseases and clinical conditions associated with LOC199725. FIG. 1 further provides a conceptual description of a novel bioinformatically detected viral gene of the present invention, referred to here as Viral Genomic Address Messenger 1340 (VGAM1340) viral gene, which modulates expression of respective host target genes thereof, the function and utility of which host target genes is known in the art.

VGAM1340 is a novel bioinformatically detected regulatory, non protein coding, viral micro RNA (miRNA) gene. The method by which VGAM1340 was detected is described hereinabove with reference to FIGS. 1-8.

VGAM1340 gene, herein designated VGAM GENE, is a viral gene contained in the genome of Garlic Virus A. VGAM1340 host target gene, herein designated VGAM HOST TARGET GENE, is a human gene contained in the human genome.

VGAM1340 gene encodes a VGAM1340 precursor RNA, herein designated VGAM PRECURSOR RNA. Similar to other miRNA genes, and unlike most ordinary genes, VGAM1340 precursor RNA does not encode a protein. A nucleotide sequence identical or highly similar to the nucleotide sequence of VGAM1340 precursor RNA is designated SEQ ID:1326, and is provided hereinbelow with reference to the sequence listing part. Nucleotide sequence SEQ ID:1326 is located at position 7154 relative to the genome of Garlic Virus A.

VGAM1340 precursor RNA folds onto itself, forming VGAM1340 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1340 folded precursor RNA into VGAM1340 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM1340 RNA is designated SEQ ID:4051, and is provided hereinbelow with reference to the sequence listing part.

VGAM1340 host target gene, herein designated VGAM HOST TARGET GENE, encodes a corresponding messenger RNA, VGAM1340 host target RNA, herein designated VGAM HOST TARGET RNA. VGAM1340 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1340 RNA, herein designated VGAM RNA, binds complementarily to one or more host target binding sites located in untranslated regions of VGAM1340 host target RNA, herein designated VGAM HOST TARGET RNA. This complementary binding is due to the fact that the nucleotide sequence of VGAM1340 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1340 RNA, herein designated VGAM RNA, may have a different number of host target binding sites in untranslated regions of a VGAM1340 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1340 RNA, herein designated VGAM RNA, to host target binding sites on VGAM1340 host target RNA, herein designated VGAM HOST TARGET RNA, such as BINDING SITE I, BINDING SITE II and BINDING SITE III, inhibits translation of VGAM1340 host target RNA into VGAM1340 host target protein, herein designated VGAM HOST TARGET PROTEIN. VGAM host target protein is therefore outlined by a broken line.

It is appreciated that VGAM1340 host target gene, herein designated VGAM HOST TARGET GENE, in fact represents a plurality of VGAM1340 host target genes. The mRNA of each one of this plurality of VGAM1340 host target genes comprises one or more host target binding sites, each having a nucleotide sequence which is at least partly complementary to VGAM1340 RNA, herein designated VGAM RNA, and which when bound by VGAM1340 RNA causes inhibition of translation of respective one or more VGAM1340 host target proteins.

It is further appreciated by one skilled in the art that the mode of translational inhibition illustrated by FIG. 1 with specific reference to translational inhibition exerted by VGAM1340 gene, herein designated VGAM GENE, on one or more VGAM1340 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1340 is inhibition of expression of host target genes, as part of a novel viral mechanism of attacking a host. Accordingly, utilities of VGAM1340 include diagnosis, prevention and treatment of viral infection by Garlic Virus A. Specific functions, and accordingly utilities, of VGAM1340 correlate with, and may be deduced from, the identity of the host target genes which VGAM1340 binds and inhibits, and the function of these host target genes, as elaborated hereinbelow.

Nucleotide sequences of the VGAM1340 precursor RNA, herein designated VGAM PRECURSOR RNA, and of the 'diced' VGAM1340 RNA, herein designated VGAM RNA, and a schematic representation of the secondary folding of VGAM1340 folded precursor RNA, herein designated VGAM FOLDED PRECURSOR RNA, of VGAM1340 are further described hereinbelow with reference to Table 1.

Nucleotide sequences of host target binding sites, such as BINDING SITE-I, BINDING SITE-II and BINDING SITE-III of FIG. 1, found on VGAM1340 host target RNA, and schematic representation of the complementarity of each of these host target binding sites to VGAM1340 RNA, herein designated VGAM RNA, are described hereinbelow with reference to Table 2.

As mentioned hereinabove with reference to FIG. 1, a function of VGAM1340 gene, herein designated VGAM is inhibition of expression of VGAM1340 target genes. It is appreciated that specific functions, and accordingly utilities, of VGAM1340 correlate with, and may be deduced from, the identity of the target genes which VGAM1340 binds and inhibits, and the function of these target genes, as elaborated hereinbelow.

Glutamate Receptor, Ionotropic, N-methyl D-aspartate 2C (GRIN2C, Accession NM_000835) is a VGAM1340 host target gene. GRIN2C BINDING SITE is HOST TARGET binding site found in the 5' untranslated region of mRNA encoded by GRIN2C, corresponding to a HOST TARGET binding site such as BINDING SITE I, BINDING SITE II or BINDING SITE III. Table 2 illustrates the complementarity of the nucleotide sequences of GRIN2C BINDING SITE, designated SEQ ID:6493, to the nucleotide sequence of VGAM1340 RNA, herein designated VGAM RNA, also designated SEQ ID:4051.

A function of VGAM1340 is therefore inhibition of Glutamate Receptor, Ionotropic, N-methyl D-aspartate 2C (GRIN2C, Accession NM_000835), a gene which has effect on CREB function, gene regulation, and neuronal survival. Accordingly, utilities of VGAM1340 include diagnosis, prevention and treatment of diseases and clinical conditions associated with GRIN2C. The function of GRIN2C has been established by previous studies. The NMDA receptors are 1 class of ionotropic glutamate receptors (see OMIM Ref. No. GRIN2D; 602717). By screening a human hippocampal cDNA library with a rat Nr2a (GRIN2A; 138253) cDNA, Lin et al. (1996) isolated cDNAs encoding GRIN2C, called NR2C by them. Northern blot analysis showed that the 4.4-kb GRIN2C mRNA was widely expressed in the brain, with the highest level of expression in the cerebellum; this transcript was also found in several other tissues. An additional, slightly larger, transcript was detected in the cerebellum. The sequence of the deduced 1,233-amino acid protein is 88% identical to those of rat and mouse Nr2c. Hydropathy analysis of GRIN2C predicted a large N terminus, 4 hydrophobic regions, and a large C terminus. Animal model experiments lend further support to the function of GRIN2C. Kadotani et al. (1996) showed that targeted disruption of the mouse Nmdar2c gene produced homozygous -/- mice with no obvious deficiency. By gene targeting, Sprengel et al. (1998) generated mutant mice expressing the Nmdar2c gene without the large intracellular C-terminal domain. These mice were viable but exhibited deficits in motor coordination. The authors concluded that the observed phenotypes appear to reflect defective intracellular signaling.

It is appreciated that the abovementioned animal model for GRIN2C is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kadotani, H.; Hirano, T.; Masugi, M.; Nakamura, K.; Nakao, K.; Katsuki, M.; Nakanishi, S.: Motor discoordination results from combined gene disruption of the NMDA receptor NR2A and NR2C subunits, but not from single disruption of the NR2A or NR2C subunit. J. Neurosci. 16:7859-7867, 1996; and Lin, Y. J.; Bovetto, S.; Carver, J. M.; Giordano, T.: Cloning of the cDNA for the human NMDA receptor NR2C subunit and its expression in the central nervous system and periphery. Mole.

Further studies establishing the function and utilities of GRIN2C are found in John Hopkins OMIM database record ID 138254, and in sited publications numbered 3598, 11922, 1192 and 3599 listed in the bibliography section hereinbelow, which are also hereby incorporated by reference. Period Homolog 2 (Drosophila) (PER2, Accession NM_022817) is another VGAM1340 host target gene. PER2 BINDING SITE is HOST TARGET binding site found in the 3' untranslated region of mRNA encoded by PER2, corresponding to a HOST TARGET binding site such as BINDING SITE I, BINDING SITE II or BINDING SITE III. Table 2 illustrates the complementarity of the nucleotide sequences of PER2 BINDING SITE, designated SEQ ID:23092, to the nucleotide sequence of VGAM1340 RNA, herein designated VGAM RNA, also designated SEQ ID:4051.

Another function of VGAM1340 is therefore inhibition of Period Homolog 2 (Drosophila) (PER2, Accession NM_022817), a gene which Period homolog 2; putative circadian clock protein; has a PAS dimerization domain. Accordingly, utilities of VGAM1340 include diagnosis, prevention and treatment of diseases and clinical conditions associated with PER2. The function of PER2 and its association with various diseases and clinical conditions, has been established by previous studies, as described hereinabove with reference to VGAM74. TAP Binding Protein (tapasin) (TAPBP, Accession NM_003190) is another VGAM1340 host target gene. TAPBP BINDING SITE is HOST TARGET binding site found in the 3' untranslated region of mRNA encoded by TAPBP, corresponding to a HOST TARGET binding site such as BINDING SITE I, BINDING SITE II or BINDING SITE III. Table 2 illustrates the complementarity of the nucleotide sequences of TAPBP BINDING SITE, designated SEQ ID:9184, to the nucleotide sequence of VGAM1340 RNA, herein designated VGAM RNA, also designated SEQ ID:4051.

Another function of VGAM1340 is therefore inhibition of TAP Binding Protein (tapasin) (TAPBP, Accession NM_003190), a gene which is involved in MHC class I-restricted antigen processing. Accordingly, utilities of VGAM1340 include diagnosis, prevention and treatment of diseases and clinical conditions associated with TAPBP. The function of TAPBP and its association with various diseases and clinical conditions, has been established by previous studies, as described hereinabove with reference to VGAM122. Chromosome 20 Open Reading Frame 21 (C20orf21, Accession NM_017798) is another VGAM1340 host target gene. C20orf21 BINDING SITE is HOST TARGET binding site found in the 3' untranslated region of mRNA encoded by C20orf21, corresponding to a HOST TARGET binding site such as BINDING SITE I, BINDING SITE II or BINDING SITE III. Table 2 illustrates the complementarity of the nucleotide sequences of C20orf21 BINDING SITE, designated SEQ ID:19440, to the nucleotide sequence of VGAM1340 RNA, herein designated VGAM RNA, also designated SEQ ID:4051.

Another function of VGAM1340 is therefore inhibition of Chromosome 20 Open Reading Frame 21 (C20orf21, Accession NM_017798). Accordingly, utilities of VGAM1340 include diagnosis, prevention and treatment of diseases and clinical conditions associated with C20orf21. FLJ10535 (Accession NM_018129) is another VGAM1340 host target gene. FLJ10535 BINDING SITE is HOST TARGET binding site found in the 3' untranslated region of mRNA encoded by FLJ10535, corresponding to a HOST TARGET binding site such as BINDING SITE I, BINDING SITE II or BINDING SITE III. Table 2 illustrates the complementarity of the nucleotide sequences of FLJ10535 BINDING SITE, designated SEQ ID:19920, to the nucleotide sequence of VGAM1340 RNA, herein designated VGAM RNA, also designated SEQ ID:4051.

Another function of VGAM1340 is therefore inhibition of FLJ10535 (Accession NM_018129). Accordingly, utilities of VGAM1340 include diagnosis, prevention and treatment of diseases and clinical conditions associated with FLJ10535. FLJ10687 (Accession NM_018178) is another VGAM1340 host target gene. FLJ10687 BINDING SITE is HOST TARGET binding site found in the 3' untranslated region of mRNA encoded by FLJ10687, corresponding to a HOST TARGET binding site such as BINDING SITE I, BINDING SITE II or BINDING SITE III. Table 2 illustrates the complementarity of the nucleotide sequences of FLJ10687 BINDING SITE, designated SEQ ID:20010, to the nucleotide sequence of VGAM1340 RNA, herein designated VGAM RNA, also designated SEQ ID:4051.

Another function of VGAM1340 is therefore inhibition of FLJ10687 (Accession NM_018178). Accordingly, utilities of VGAM1340 include diagnosis, prevention and treatment of diseases and clinical conditions associated with FLJ10687. KIAA0350 (Accession XM_028332) is another VGAM1340 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30672, to the nucleotide sequence of VGAM1340 RNA, herein designated VGAM RNA, also designated SEQ ID:4051.

Another function of VGAM1340 is therefore inhibition of KIAA0350 (Accession XM_028332). Accordingly, utilities of VGAM1340 include diagnosis, prevention and treatment of diseases and clinical conditions associated with KIAA0350. LEAP-2 (Accession NM_052971) is another VGAM1340 host target gene. LEAP-2 BINDING SITE is HOST TARGET binding site found in the 5' untranslated region of mRNA encoded by LEAP-2, corresponding to a HOST TARGET binding site such as BINDING SITE I, BINDING SITE II or BINDING SITE III. Table 2 illustrates the complementarity of the nucleotide sequences of LEAP-2 BINDING SITE, designated SEQ ID:27543, to the nucleotide sequence of VGAM1340 RNA, herein designated VGAM RNA, also designated SEQ ID:4051.

Another function of VGAM1340 is therefore inhibition of LEAP-2 (Accession NM_052971). Accordingly, utilities of VGAM1340 include diagnosis, prevention and treatment of diseases and clinical conditions associated with LEAP-2. LOC148534 (Accession XM_086222) is another VGAM1340 host target gene. LOC148534 BINDING SITE is HOST TARGET binding site found in the 3' untranslated region of mRNA encoded by LOC148534, corresponding to a HOST TARGET binding site such as BINDING SITE I, BINDING SITE II or BINDING SITE III. Table 2 illustrates the complementarity of the nucleotide sequences of LOC148534 BINDING SITE, designated SEQ ID:38547, to the nucleotide sequence of VGAM1340 RNA, herein designated VGAM RNA, also designated SEQ ID:4051.

Another function of VGAM1340 is therefore inhibition of LOC148534 (Accession XM_086222). Accordingly, utilities of VGAM1340 include diagnosis, prevention and treatment of diseases and clinical conditions associated with LOC148534. FIG. 1 further provides a conceptual description of a novel bioinformatically detected viral gene of the present invention, referred to here as Viral Genomic Address Messenger 1341 (VGAM1341) viral gene, which modulates expression of respective host target genes thereof, the function and utility of which host target genes is known in the art.

VGAM1341 is a novel bioinformatically detected regulatory, non protein coding, viral micro RNA (miRNA) gene. The method by which VGAM1341 was detected is described hereinabove with reference to FIGS. 1-8.

VGAM1341 gene, herein designated VGAM GENE, is a viral gene contained in the genome of Garlic Virus A. VGAM1341 host target gene, herein designated VGAM HOST TARGET GENE, is a human gene contained in the human genome.

VGAM1341 gene encodes a VGAM1341 precursor RNA, herein designated VGAM PRECURSOR RNA. Similar to other miRNA genes, and unlike most ordinary genes, VGAM1341 precursor RNA does not encode a protein. A nucleotide sequence identical or highly similar to the nucleotide sequence of VGAM1341 precursor RNA is designated SEQ ID:1327, and is provided hereinbelow with reference to the sequence listing part. Nucleotide sequence SEQ ID:1327 is located at position 6737 relative to the genome of Garlic Virus A.

VGAM1341 precursor RNA folds onto itself, forming VGAM1341 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1341 folded precursor RNA into VGAM1341 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1341 RNA is designated SEQ ID:4052, and is provided hereinbelow with reference to the sequence listing part.

VGAM1341 host target gene, herein designated VGAM HOST TARGET GENE, encodes a corresponding messenger RNA, VGAM1341 host target RNA, herein designated VGAM HOST TARGET RNA. VGAM1341 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1341 RNA, herein designated VGAM RNA, binds complementarily to one or more host target binding sites located in untranslated regions of VGAM1341 host target RNA, herein designated VGAM HOST TARGET RNA. This complementary binding is due to the fact that the nucleotide sequence of VGAM1341 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1341 RNA, herein designated VGAM RNA, may have a different number of host target binding sites in untranslated regions of a VGAM1341 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1341 RNA, herein designated VGAM RNA, to host target binding sites on VGAM1341 host target RNA, herein designated VGAM HOST TARGET RNA, such as BINDING SITE I, BINDING SITE II and BINDING SITE III, inhibits translation of VGAM1341 host target RNA into VGAM1341 host target protein, herein designated VGAM HOST TARGET PROTEIN. VGAM host target protein is therefore outlined by a broken line.

It is appreciated that VGAM1341 host target gene, herein designated VGAM HOST TARGET GENE, in fact represents a plurality of VGAM1341 host target genes. The mRNA of each one of this plurality of VGAM1341 host target genes comprises one or more host target binding sites, each having a nucleotide sequence which is at least partly complementary to VGAM1341 RNA, herein designated VGAM RNA, and which when bound by VGAM1341 RNA causes inhibition of translation of respective one or more VGAM1341 host target proteins.

It is further appreciated by one skilled in the art that the mode of translational inhibition illustrated by FIG. 1 with specific reference to translational inhibition exerted by VGAM1341 gene, herein designated VGAM GENE, on one or more VGAM1341 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1341 is inhibition of expression of host target genes, as part of a novel viral mechanism of attacking a host. Accordingly, utilities of VGAM1341 include diagnosis, prevention and treatment of viral infection by Garlic Virus A. Specific functions, and accordingly utilities, of VGAM1341 correlate with, and may be deduced from, the identity of the host target genes which VGAM1341 binds and inhibits, and the function of these host target genes, as elaborated hereinbelow.

Nucleotide sequences of the VGAM1341 precursor RNA, herein designated VGAM PRECURSOR RNA, and of the 'diced' VGAM1341 RNA, herein designated VGAM RNA, and a schematic representation of the secondary folding of VGAM1341 folded precursor RNA, herein designated VGAM FOLDED PRECURSOR RNA, of VGAM1341 are further described hereinbelow with reference to Table 1.

Nucleotide sequences of host target binding sites, such as BINDING SITE-I, BINDING SITE-II and BINDING SITE-III of FIG. 1, found on VGAM1341 host target RNA, and schematic representation of the complementarity of each of these host target binding sites to VGAM1341 RNA, herein designated VGAM RNA, are described hereinbelow with reference to Table 2.

As mentioned hereinabove with reference to FIG. 1, a function of VGAM1341 gene, herein designated VGAM is inhibition of expression of VGAM1341 target genes. It is appreciated that specific functions, and accordingly utilities, of VGAM1341 correlate with, and may be deduced from, the identity of the target genes which VGAM1341 binds and inhibits, and the function of these target genes, as elaborated hereinbelow.

Aryl Hydrocarbon Receptor (AHR, Accession NM_001621) is a VGAM1341 host target gene. AHR BINDING SITE is HOST TARGET binding site found in the 3' untranslated region of mRNA encoded by AHR, corresponding to a HOST TARGET binding site such as BINDING SITE I, BINDING SITE II or BINDING SITE III. Table 2 illustrates the complementarity of the nucleotide sequences of AHR BINDING SITE, designated SEQ ID:7333, to the nucleotide sequence of VGAM1341 RNA, herein designated VGAM RNA, also designated SEQ ID:4052.

A function of VGAM1341 is therefore inhibition of Aryl Hydrocarbon Receptor (AHR, Accession NM_001621), a gene which plays a role in modulating carcinogenesis through the induction of xenobiotic-metabolizing enzymes. Accordingly, utilities of VGAM1341 include diagnosis, prevention and treatment of diseases and clinical conditions associated with AHR. The function of AHR and its association with various diseases and clinical conditions, has been established by previous studies, as described hereinabove with reference to VGAM368. Carbonic Anhydrase XII (CA12, Accession NM_001218) is another VGAM1341 host target gene. CA12 BINDING SITE is HOST TARGET binding site found in the 3' untranslated region of mRNA encoded by CA12, corresponding to a HOST TARGET binding site such as BINDING SITE I, BINDING SITE II or BINDING SITE III. Table 2 illustrates the complementarity of the nucleotide sequences of CA12 BINDING SITE, designated SEQ ID:6879, to the nucleotide sequence of VGAM1341 RNA, herein designated VGAM RNA, also designated SEQ ID:4052.

Another function of VGAM1341 is therefore inhibition of Carbonic Anhydrase XII (CA12, Accession NM_001218), a gene which functions in cellular transport and metabolic processes. Accordingly, utilities of VGAM1341 include diagnosis, prevention and treatment of diseases and clinical conditions associated with CA12. The function of CA12 and its association with various diseases and clinical conditions, has been established by previous studies, as described hereinabove with reference to VGAM508. Cell Adhesion Molecule with Homology to L1CAM (close homolog of L1) (CHL1, Accession NM_006614) is another VGAM1341 host target gene. CHL1 BINDING SITE is HOST TARGET binding site found in the 3' untranslated region of mRNA encoded by CHL1, corresponding to a HOST TARGET binding site such as BINDING SITE I, BINDING SITE II or BINDING SITE III. Table 2 illustrates the complementarity of the nucleotide sequences of CHL1 BINDING SITE, designated SEQ ID:13394, to the nucleotide sequence of VGAM1341 RNA, herein designated VGAM RNA, also designated SEQ ID:4052.

Another function of VGAM1341 is therefore inhibition of Cell Adhesion Molecule with Homology to L1CAM (close homolog of L1) (CHL1, Accession NM_006614). Accordingly, utilities of VGAM1341 include diagnosis, prevention and treatment of diseases and clinical conditions associated with CHL1. KIAA1190 (Accession XM_048695) is another VGAM1341 host target gene. KIAA1190 BINDING SITE is HOST TARGET binding site found in the 3' untranslated region of mRNA encoded by KIAA1190, corresponding to a HOST TARGET binding site such as BINDING SITE I, BINDING SITE II or BINDING SITE III. Table 2 illustrates the complementarity of the nucleotide sequences of KIAA1190 BINDING SITE, designated SEQ ID:35226, to the nucleotide sequence of VGAM1341 RNA, herein designated VGAM RNA, also designated SEQ ID:4052.

Another function of VGAM1341 is therefore inhibition of KIAA1190 (Accession XM_048695). Accordingly, utilities of VGAM1341 include diagnosis, prevention and treatment of diseases and clinical conditions associated with KIAA1190. PRO1386 (Accession NM_031269) is another VGAM1341 host target gene. PRO1386 BINDING SITE is HOST TARGET binding site found in the 5' untranslated region of mRNA encoded by PRO1386, corresponding to a HOST TARGET binding site such as BINDING SITE I, BINDING SITE II or BINDING SITE III. Table 2 illustrates the complementarity of the nucleotide sequences of PRO1386 BINDING SITE, designated SEQ ID:25286, to the nucleotide sequence of VGAM1341 RNA, herein designated VGAM RNA, also designated SEQ ID:4052.

Another function of VGAM1341 is therefore inhibition of PRO1386 (Accession NM_031269). Accordingly, utilities of VGAM1341 include diagnosis, prevention and treatment of diseases and clinical conditions associated with PRO1386. FIG. 1 further provides a conceptual description of a novel bioinformatically detected viral gene of the present invention, referred to here as Viral Genomic Address Messenger 1342 (VGAM1342) viral gene, which modulates expression of respective host target genes thereof, the function and utility of which host target genes is known in the art.

VGAM1342 is a novel bioinformatically detected regulatory, non protein coding, viral micro RNA (miRNA) gene. The method by which VGAM1342 was detected is described hereinabove with reference to FIGS. 1-8.

VGAM1342 gene, herein designated VGAM GENE, is a viral gene contained in the genome of Garlic Virus A. VGAM1342 host target gene, herein designated VGAM HOST TARGET GENE, is a human gene contained in the human genome.

VGAM1342 gene encodes a VGAM1342 precursor RNA, herein designated VGAM PRECURSOR RNA. Similar to other miRNA genes, and unlike most ordinary genes, VGAM1342 precursor RNA does not encode a protein. A nucleotide sequence identical or highly similar to the nucleotide sequence of VGAM1342 precursor RNA is designated SEQ ID:1328, and is provided hereinbelow with reference to the sequence listing part. Nucleotide sequence SEQ ID:1328 is located at position 2936 relative to the genome of Garlic Virus A.

VGAM1342 precursor RNA folds onto itself, forming VGAM1342 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1342 folded precursor RNA into VGAM1342 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 87%) nucleotide sequence of VGAM1342 RNA is designated SEQ ID:4053, and is provided hereinbelow with reference to the sequence listing part.

VGAM1342 host target gene, herein designated VGAM HOST TARGET GENE, encodes a corresponding messenger RNA, VGAM1342 host target RNA, herein designated VGAM HOST TARGET RNA. VGAM1342 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1342 RNA, herein designated VGAM RNA, binds complementarily to one or more host target binding sites located in untranslated regions of VGAM1342 host target RNA, herein designated VGAM HOST TARGET RNA. This complementary binding is due to the fact that the nucleotide sequence of VGAM1342 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1342 RNA, herein designated VGAM RNA, may have a different number of host target binding sites in untranslated regions of a VGAM1342 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1342 RNA, herein designated VGAM RNA, to host target binding sites on VGAM1342 host target RNA, herein designated VGAM HOST TARGET RNA, such as BINDING SITE I, BINDING SITE II and BINDING SITE III, inhibits translation of VGAM1342 host target RNA into VGAM1342 host target protein, herein designated VGAM HOST TARGET PROTEIN. VGAM host target protein is therefore outlined by a broken line.

It is appreciated that VGAM1342 host target gene, herein designated VGAM HOST TARGET GENE, in fact represents a plurality of VGAM1342 host target genes. The mRNA of each one of this plurality of VGAM1342 host target genes comprises one or more host target binding sites, each having a nucleotide sequence which is at least partly complementary to VGAM1342 RNA, herein designated VGAM RNA, and which when bound by VGAM1342 RNA causes inhibition of translation of respective one or more VGAM1342 host target proteins.

It is further appreciated by one skilled in the art that the mode of translational inhibition illustrated by FIG. 1 with specific reference to translational inhibition exerted by VGAM1342 gene, herein designated VGAM GENE, on one or more VGAM1342 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1342 is inhibition of expression of host target genes, as part of a novel viral mechanism of attacking a host. Accordingly, utilities of VGAM1342 include diagnosis, prevention and treatment of viral infection by Garlic Virus A. Specific functions, and accordingly utilities, of VGAM1342 correlate with, and may be deduced from, the identity of the host target genes which VGAM1342 binds and inhibits, and the function of these host target genes, as elaborated hereinbelow.

Nucleotide sequences of the VGAM1342 precursor RNA, herein designated VGAM PRECURSOR RNA, and of the 'diced' VGAM1342 RNA, herein designated VGAM RNA, and a schematic representation of the secondary folding of VGAM1342 folded precursor RNA, herein designated VGAM FOLDED PRECURSOR RNA, of VGAM1342 are further described hereinbelow with reference to Table 1.

Nucleotide sequences of host target binding sites, such as BINDING SITE-I, BINDING SITE-II and BINDING SITE-III of FIG. 1, found on VGAM1342 host target RNA, and schematic representation of the complementarity of each of these host target binding sites to VGAM1342 RNA, herein designated VGAM RNA, are described hereinbelow with reference to Table 2.

As mentioned hereinabove with reference to FIG. 1, a function of VGAM1342 gene, herein designated VGAM is inhibition of expression of VGAM1342 target genes. It is appreciated that specific functions, and accordingly utilities, of VGAM1342 correlate with, and may be deduced from, the identity of the target genes which VGAM1342 binds and inhibits, and the function of these target genes, as elaborated hereinbelow.

Cadherin 5, Type 2, VE-cadherin (vascular epithelium) (CDH5, Accession NM_001795) is a VGAM1342 host target gene. CDH5 BINDING SITE is HOST TARGET binding site found in the 3' untranslated region of mRNA encoded by CDH5, corresponding to a HOST TARGET binding site such as BINDING SITE I, BINDING SITE II or BINDING SITE III. Table 2 illustrates the complementarity of the nucleotide sequences of CDH5 BINDING SITE, designated SEQ ID:7548, to the nucleotide sequence of VGAM1342 RNA, herein designated VGAM RNA, also designated SEQ ID:4053.

A function of VGAM1342 is therefore inhibition of Cadherin 5, Type 2, VE-cadherin (vascular epithelium) (CDH5, Accession NM_001795), a gene which associates with alpha-catenin forming a link to the cytoskeleton. Accordingly, utilities of VGAM1342 include diagnosis, prevention and treatment of diseases and clinical conditions associated with CDH5. The function of CDH5 has been established by previous studies. Cadherins are calcium-dependent adhesive proteins that mediate cell-to-cell interaction. Huber et al. (1996) noted that they constitute an expanding family of receptors involved in the structural and functional organization of cells in various tissues. Members of the family include epithelial cadherin (E-cadherin; 192090), neural cadherin (N-cadherin; 114020), placental cadherin (P-cadherin; 114021), muscle cadherin (M-cadherin; 114019), and vascular endothelial cadherin (VE-cadherin, or CDH5). They share a common domain structure and primary sequence homologies. Each cadherin type has a unique tissue-distribution pattern. In most of them, expression is not restricted to 1 cell type, and more than 1 cadherin type may be found at the surface of a particular cell. The authors stated that endothelial cells have been shown to express N-cadherin, VE-cadherin, and to a lesser extent, P-cadherin. Among these, only VE-cadherin is expressed specifically in endothelial cells (Salomon et al., 1992). Furthermore, VE-cadherin is associated consistently with intercellular junctions, whereas N-cadherin remains diffuse on the cell membrane. In order to define the role of CDH5 and of its binding to beta-catenin (see OMIM Ref. No. 116806) in intracellular signaling, Carmeliet et al. (1999) generated mice that lacked a functional Cdh5 gene, that expressed a mutant Cdh5 gene lacking the beta-catenin-binding cytoplasmic tail, or that did not express detectable Cdh5 levels because of an intronic neomycin phosphotransferase (neo) gene. They found in all of these mice that deletion or truncation of the Cdh5 gene did not affect assembly of endothelial cells in vascular plexi, but did impair their subsequent remodeling and maturation, causing lethality at 9.5 days of gestation. Deficiency or truncation of Cdh5 induced endothelial apoptosis and abolished transmission of the endothelial survival signal by vascular endothelial growth factor A (VEGF; 192240) to AKT kinase (OMIM Ref. No. 164730) and BCL2 (OMIM Ref. No. 151430) via reduced complex formation with VEGF receptor-2 (OMIM Ref. No. 191306), beta-catenin, and phosphoinositide-3 kinase (see OMIM Ref. No. 171833). Thus, Carmeliet et al. (1999) concluded that CDH5/beta-catenin signaling controls endothelial survival.

Full details of the abovementioned studies are described in the following publications, the disclosure of which are hereby incorporated by reference:

Carmeliet, P.; Lampugnani, M.-G.; Moons, L.; Breviario, F.; Compernolle, V.; Bono, F.; Balconi, G.; Spagnuolo, R.; Oosthuyse, B.; Dewerchin, M.; Zanetti, A.; Angellilo, A.; and 11 others. Targeted deficiency of cytosolic truncation of the VE-cadherin gene in mice impairs VEGF-mediated endothelial survival and angiogenesis. Cell 98:147-157, 1999; and Huber, P.; Dalmon, J.; Engiles, J.; Breviario, F.; Gory, S.; Siracusa, L. D.; Buchberg, A. M.; Dejana, E.: Genomic structure and chromosomal mapping of the mouse VE-cadherin gene (Cdh5.

Further studies establishing the function and utilities of CDH5 are found in John Hopkins OMIM database record ID 601120, and in sited publications numbered 6362-636 and 11646 listed in the bibliography section hereinbelow, which are also hereby incorporated by reference. Polycystic Kidney and Hepatic Disease 1 (autosomal recessive) (PKHD1, Accession NM_138694) is another VGAM1342 host target gene. PKHD1 BINDING SITE is HOST TARGET binding site found in the 3' untranslated region of mRNA encoded by PKHD1, corresponding to a HOST TARGET binding site such as BINDING SITE I, BINDING SITE II or BINDING SITE III. Table 2 illustrates the complementarity of the nucleotide sequences of PKHD1 BINDING SITE, designated SEQ ID:28942, to the nucleotide sequence of VGAM1342 RNA, herein designated VGAM RNA, also designated SEQ ID:4053.

Another function of VGAM1342 is therefore inhibition of Polycystic Kidney and Hepatic Disease 1 (autosomal recessive) (PKHD1, Accession NM_138694). Accordingly, utilities of VGAM1342 include diagnosis, prevention and treatment of diseases and clinical conditions associated with PKHD1. RAB5A, Member RAS Oncogene Family (RAB5A, Accession NM_004162) is another VGAM1342 host target gene. RAB5A BINDING SITE is HOST TARGET binding site found in the 3' untranslated region of mRNA encoded by RAB5A, corresponding to a HOST TARGET binding site such as BINDING SITE I, BINDING SITE II or BINDING SITE III. Table 2 illustrates the complementarity of the nucleotide sequences of RAB5A BINDING SITE, designated SEQ ID:10371, to the nucleotide sequence of VGAM1342 RNA, herein designated VGAM RNA, also designated SEQ ID:4053.

Another function of VGAM1342 is therefore inhibition of RAB5A, Member RAS Oncogene Family (RAB5A, Accession NM_004162), a gene which is a rate-limiting component of the machinery regulating the kinetics of membrane traffic. Accordingly, utilities of VGAM1342 include diagnosis, prevention and treatment of diseases and clinical conditions associated with RAB5A. The function of RAB5A has been established by previous studies. The S. cerevisiae YPT1 and SEC4 genes encode Ras-related GTP-binding proteins involved in the regulation of secretion. Mammalian cells express a large number of RAB proteins, GTP-binding proteins closely related to YPT1 and SEC4. By screening a human pheochromocytoma library with probes derived from the SEC4 gene and from various rat and human RAB cDNAs, Zahraoui et al. (1989) isolated cDNAs encoding RAB1 (OMIM Ref. No. 179508), RAB2 (OMIM Ref. No. 179509), RAB3A (OMIM Ref. No. 179490), RAB3B (OMIM Ref. No. 179510), RAB4 (OMIM Ref. No. 179511), RAB5, and RAB6 (OMIM Ref. No. 179513). Except for the closely related RAB3A and RAB3B, the deduced human RAB proteins share 32 to 50% homology. The predicted 214-amino acid RAB5 protein is 31% and 38% identical to SEC4 and YPT1, respectively. All 6 human RAB proteins tested bound GTP and exhibited GTPase activities in vitro. Northern blot analysis revealed that RAB5 was expressed as 2.7- and 2.8-kb mRNAs in a human fibroblast cell line. Bucci et al. (1992) demonstrated that RAB5 is a rate-limiting component of the machinery regulating the kinetics of membrane traffic in the early endocytic pathway. Stenmark et al. (1995) reported that rabaptin-5 (OMIM Ref. No. 603616) is an effector of RAB5 that transmits the signal of the active GTP-bound RAB5 conformation to the membrane docking and/or fusion apparatus. Xiao et al. (1997) found that tuberin (OMIM Ref. No. 191092) exhibits substantial GTPase-activating protein (GAP) activity towards RAB5, and that rabaptin-5 mediates the tuberin association with RAB5. The authors suggested that tuberin functions as a RAB5GAP in vivo to negatively regulate RAB5-GTP activity in endocytosis.

Full details of the abovementioned studies are described in the following publications, the disclosure of which are hereby incorporated by reference:

Bucci, C.; Parton, R. G.; Mather, I. H.; Stunnenberg, H.; Simons, K.; Hoflack, B.; Zerial, M.: The small GTPase rab5 functions as a regulatory factor in the early endocytic pathway. Cell 70:715-728, 1992; and Xiao, G.-H.; Shoarinejad, F.; Jin, F.; Golemis, E. A.; Yeung, R. S.: The tuberous sclerosis 2 gene product, tuberin, functions as a Rab5 GTPase activating protein (GAP) in modulating en.

Further studies establishing the function and utilities of RAB5A are found in John Hopkins OMIM database record ID 179512, and in sited publications numbered 2542, 2539, 2543-254 and 2722 listed in the bibliography section hereinbelow, which are also hereby incorporated by reference. DKFZp761K1423 (Accession NM_018422) is another VGAM1342 host target gene. DKFZp761K1423 BINDING SITE is HOST TARGET binding site found in the 3' untranslated region of mRNA encoded by DKFZp761K1423, corresponding to a HOST TARGET binding site such as BINDING SITE I, BINDING SITE II or BINDING SITE III. Table 2 illustrates the complementarity of the nucleotide sequences of DKFZp761K1423 BINDING SITE, designated SEQ ID:20471, to the nucleotide sequence of VGAM1342 RNA, herein designated VGAM RNA, also designated SEQ ID:4053.

Another function of VGAM1342 is therefore inhibition of DKFZp761K1423 (Accession NM_018422). Accordingly, utilities of VGAM1342 include diagnosis, prevention and treatment of diseases and clinical conditions associated with DKFZp761K1423. Hairy/enhancer-of-split Related with YRPW Motif-like (HEYL, Accession NM_014571) is another VGAM1342 host target gene. HEYL BINDING SITE is HOST TARGET binding site found in the 3' untranslated region of mRNA encoded by HEYL, corresponding to a HOST TARGET binding site such as BINDING SITE I, BINDING SITE II or BINDING SITE III. Table 2 illustrates the complementarity of the nucleotide sequences of HEYL BINDING SITE, designated SEQ ID:15929, to the nucleotide sequence of VGAM1342 RNA, herein designated VGAM RNA, also designated SEQ ID:4053.

Another function of VGAM1342 is therefore inhibition of Hairy/enhancer-of-split Related with YRPW Motif-like (HEYL, Accession NM_014571). Accordingly, utilities of VGAM1342 include diagnosis, prevention and treatment of diseases and clinical conditions associated with HEYL. KIAA0418 (Accession NM_014631) is another VGAM1342 host target gene. KIAA0418 BINDING SITE is HOST TARGET binding site found in the 3' untranslated region of mRNA encoded by KIAA0418, corresponding to a HOST TARGET binding site such as BINDING SITE I, BINDING SITE II or BINDING SITE III. Table 2 illustrates the complementarity of the nucleotide sequences of KIAA0418 BINDING SITE, designated SEQ ID:15997, to the nucleotide sequence of VGAM1342 RNA, herein designated VGAM RNA, also designated SEQ ID:4053.

Another function of VGAM1342 is therefore inhibition of KIAA0418 (Accession NM_014631). Accordingly, utilities of VGAM1342 include diagnosis, prevention and treatment of diseases and clinical conditions associated with KIAA0418. KIAA1247 (Accession XM_030036) is another VGAM1342 host target gene. KIAA1247 BINDING SITE is HOST TARGET binding site found in the 3' untranslated region of mRNA encoded by KIAA1247, corresponding to a HOST TARGET binding site such as BINDING SITE I, BINDING SITE II or BINDING SITE III. Table 2 illustrates the complementarity of the nucleotide sequences of KIAA1247 BINDING SITE, designated SEQ ID:30989, to the nucleotide sequence of VGAM1342 RNA, herein designated VGAM RNA, also designated SEQ ID:4053.

Another function of VGAM1342 is therefore inhibition of KIAA1247 (Accession XM_030036). Accordingly, utilities of VGAM1342 include diagnosis, prevention and treatment of diseases and clinical conditions associated with KIAA1247. KIAA1701 (Accession XM_042087) is another VGAM1342 host target gene. KIAA1701 BINDING SITE is HOST TARGET binding site found in the 3' untranslated region of mRNA encoded by KIAA1701, corresponding to a HOST TARGET binding site such as BINDING SITE I, BINDING SITE II or BINDING SITE III. Table 2 illustrates the complementarity of the nucleotide sequences of KIAA1701 BINDING SITE, designated SEQ ID:33684, to the nucleotide sequence of VGAM1342 RNA, herein designated VGAM RNA, also designated SEQ ID:4053.

Another function of VGAM1342 is therefore inhibition of KIAA1701 (Accession XM_042087). Accordingly, utilities of VGAM1342 include diagnosis, prevention and treatment of diseases and clinical conditions associated with KIAA1701. Mab-21-like 2 (C. elegans) (MAB21L2, Accession NM_006439) is another VGAM1342 host target gene. MAB21L2 BINDING SITE is HOST TARGET binding site found in the 5' untranslated region of mRNA encoded by MAB21L2, corresponding to a HOST TARGET binding site such as BINDING SITE I, BINDING SITE II or BINDING SITE III. Table 2 illustrates the complementarity of the nucleotide sequences of MAB21L2 BINDING SITE, designated SEQ ID:13149, to the nucleotide sequence of VGAM1342 RNA, herein designated VGAM RNA, also designated SEQ ID:4053.

Another function of VGAM1342 is therefore inhibition of Mab-21-like 2 (C. elegans) (MAB21L2, Accession NM_006439). Accordingly, utilities of VGAM1342 include diagnosis, prevention and treatment of diseases and clinical conditions associated with MAB21L2. MDS028 (Accession NM_018463) is another VGAM1342 host target gene. MDS028 BINDING SITE is HOST TARGET binding site found in the 3' untranslated region of mRNA encoded by MDS028, corresponding to a HOST TARGET binding site such as BINDING SITE I, BINDING SITE II or BINDING SITE III. Table 2 illustrates the complementarity of the nucleotide sequences of MDS028 BINDING SITE, designated SEQ ID:20534, to the nucleotide sequence of VGAM1342 RNA, herein designated VGAM RNA, also designated SEQ ID:4053.

Another function of VGAM1342 is therefore inhibition of MDS028 (Accession NM_018463). Accordingly, utilities of VGAM1342 include diagnosis, prevention and treatment of diseases and clinical conditions associated with MDS028. PRO2012 (Accession NM_018614) is another VGAM1342 host target gene. PRO2012 BINDING SITE is HOST TARGET binding site found in the 3' untranslated region of mRNA encoded by PRO2012, corresponding to a HOST TARGET binding site such as BINDING SITE I, BINDING SITE II or BINDING SITE III. Table 2 illustrates the complementarity of the nucleotide sequences of PRO2012 BINDING SITE, designated SEQ ID:20681, to the nucleotide sequence of VGAM1342 RNA, herein designated VGAM RNA, also designated SEQ ID:4053.

Another function of VGAM1342 is therefore inhibition of PRO2012 (Accession NM_018614). Accordingly, utilities of VGAM1342 include diagnosis, prevention and treatment of diseases and clinical conditions associated with PRO2012. FIG. 1 further provides a conceptual description of a novel bioinformatically detected viral gene of the present invention, referred to here as Viral Genomic Address Messenger 1343 (VGAM1343) viral gene, which modulates expression of respective host target genes thereof, the function and utility of which host target genes is known in the art.

VGAM1343 is a novel bioinformatically detected regulatory, non protein coding, viral micro RNA (miRNA) gene. The method by which VGAM1343 was detected is described hereinabove with reference to FIGS. 1-8.

VGAM1343 gene, herein designated VGAM GENE, is a viral gene contained in the genome of Garlic Virus A. VGAM1343 host target gene, herein designated VGAM HOST TARGET GENE, is a human gene contained in the human genome.

VGAM1343 gene encodes a VGAM1343 precursor RNA, herein designated VGAM PRECURSOR RNA. Similar to other miRNA genes, and unlike most ordinary genes, VGAM1343 precursor RNA does not encode a protein. A nucleotide sequence identical or highly similar to the nucleotide sequence of VGAM1343 precursor RNA is designated SEQ ID:1329, and is provided hereinbelow with reference to the sequence listing part. Nucleotide sequence SEQ ID:1329 is located at position 1501 relative to the genome of Garlic Virus A.

VGAM1343 precursor RNA folds onto itself, forming VGAM1343 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1343 folded precursor RNA into VGAM1343 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM1343 RNA is designated SEQ ID:4054, and is provided hereinbelow with reference to the sequence listing part.

VGAM1343 host target gene, herein designated VGAM HOST TARGET GENE, encodes a corresponding messenger RNA, VGAM1343 host target RNA, herein designated VGAM HOST TARGET RNA. VGAM1343 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1343 RNA, herein designated VGAM RNA, binds complementarily to one or more host target binding sites located in untranslated regions of VGAM1343 host target RNA, herein designated VGAM HOST TARGET RNA. This complementary binding is due to the fact that the nucleotide sequence of VGAM1343 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1343 RNA, herein designated VGAM RNA, may have a different number of host target binding sites in untranslated regions of a VGAM1343 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1343 RNA, herein designated VGAM RNA, to host target binding sites on VGAM1343 host target RNA, herein designated VGAM HOST TARGET RNA, such as BINDING SITE I, BINDING SITE II and BINDING SITE III, inhibits translation of VGAM1343 host target RNA into VGAM1343 host target protein, herein designated VGAM HOST TARGET PROTEIN. VGAM host target protein is therefore outlined by a broken line.

It is appreciated that VGAM1343 host target gene, herein designated VGAM HOST TARGET GENE, in fact represents a plurality of VGAM1343 host target genes. The mRNA of each one of this plurality of VGAM1343 host target genes comprises one or more host target binding sites, each having a nucleotide sequence which is at least partly complementary to VGAM1343 RNA, herein designated VGAM RNA, and which when bound by VGAM1343 RNA causes inhibition of translation of respective one or more VGAM1343 host target proteins.

It is further appreciated by one skilled in the art that the mode of translational inhibition illustrated by FIG. 1 with specific reference to translational inhibition exerted by VGAM1343 gene, herein designated VGAM GENE, on one or more VGAM1343 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1343 is inhibition of expression of host target genes, as part of a novel viral mechanism of attacking a host. Accordingly, utilities of VGAM1343 include diagnosis, prevention and treatment of viral infection by Garlic Virus A. Specific functions, and accordingly utilities, of VGAM1343 correlate with, and may be deduced from, the identity of the host target genes which VGAM1343 binds and inhibits, and the function of these host target genes, as elaborated hereinbelow.

Nucleotide sequences of the VGAM1343 precursor RNA, herein designated VGAM PRECURSOR RNA, and of the 'diced' VGAM1343 RNA, herein designated VGAM RNA, and a schematic representation of the secondary folding of VGAM1343 folded precursor RNA, herein designated VGAM FOLDED PRECURSOR RNA, of VGAM1343 are further described hereinbelow with reference to Table 1.

Nucleotide sequences of host target binding sites, such as BINDING SITE-I, BINDING SITE-II and BINDING SITE-III of FIG. 1, found on VGAM1343 host target RNA, and schematic representation of the complementarity of each of these host target binding sites to VGAM1343 RNA, herein designated VGAM RNA, are described hereinbelow with reference to Table 2.

As mentioned hereinabove with reference to FIG. 1, a function of VGAM1343 gene, herein designated VGAM is inhibition of expression of VGAM1343 target genes. It is appreciated that specific functions, and accordingly utilities, of VGAM1343 correlate with, and may be deduced from, the identity of the target genes which VGAM1343 binds and inhibits, and the function of these target genes, as elaborated hereinbelow.

CD22 Antigen (CD22, Accession NM_001771) is a VGAM1343 host target gene. CD22 BINDING SITE is HOST TARGET binding site found in the 3' untranslated region of mRNA encoded by CD22, corresponding to a HOST TARGET binding site such as BINDING SITE I, BINDING SITE II or BINDING SITE III. Table 2 illustrates the complementarity of the nucleotide sequences of CD22 BINDING SITE, designated SEQ ID:7531, to the nucleotide sequence of VGAM1343 RNA, herein designated VGAM RNA, also designated SEQ ID:4054.

A function of VGAM1343 is therefore inhibition of CD22 Antigen (CD22, Accession NM_001771), a gene which is an antigen expressed specifically in B lymphocytes (Cd22 antigen) and may act in cell-cell interactions. Accordingly, utilities of VGAM1343 include diagnosis, prevention and treatment of diseases and clinical conditions associated with CD22. The function of CD22 has been established by previous studies. Non human mammalian cells express N-acetylneuraminic acid (OMIM Ref. No. Neu5Ac) and N-glycolylneuraminic acid (OMIM Ref. No. Neu5Gc). Human cells contain only Neu5Ac because of an exon deletion/frameshift mutation in cytidine monophospho-sialic acid hydroxylase (CMAH; 603209), which converts Neu5Ac to Neu5Gc. Sialic acid-binding immunoglobulin-like lectins, or SIGLECs, such as CD22 (SIGLEC2), recognize sialic acids. Brinkman-Van der Linden et al. (2000) showed that human SIGLEC1 (SN; 600751) strongly prefers Neu5Ac over Neu5Gc. Sequence analysis of SIGLEC2 cDNA found that while the chimpanzee sequence is 97% homologous to human, bonobo and gorilla are only 96% homologous, and the orangutan is only 93% homologous. Using regions of SIGLEC2 proteins from mouse, chimpanzee, orangutan, and human fused to the Fc region of human IgG, and flow cytometry analysis, Brinkman-Van der Linden et al. (2000) showed that all bound well to chimpanzee Epstein-Barr virus (EBV)-transformed B cells, which expressed high levels of Neu5Gc. Except for mouse, all bound well to human EBV-transformed B cells, which expressed high levels of Neu5Ac. Animal model experiments lend further support to the function of CD22. O'Keefe et al. (1996) made observations in mice with a targeted disruption of the CD22 gene indicating that CD22 is a negative regulator of antigen receptor signaling whose onset of expression at the mature B cell stage may serve to raise the antigen concentration threshold required for B cell triggering. Splenic B cells from CD22 knockout mice were found to be hyperresponsive to receptor signaling. Heightened calcium fluxes and cell proliferation were obtained at lower ligand concentrations. The mice gave augmented immune response, had an expanded peritoneal B-1 cell population, and contained increased serum titers of autoantibody.

It is appreciated that the abovementioned animal model for CD22 is acknowledged by those skilled in the art as a scientifically valid animal model, as can be further appreciated from the publications sited hereinbelow.

Full details of the abovementioned studies are described in the following publications, the disclosure of which are hereby incorporated by reference:

O'Keefe, T. L.; Williams, G. T.; Davies, S. L.; Neuberger, M. S.: Hyperresponsive B cells in CD22-deficient mice. Science 274:798-801, 1996; and Brinkman-Van der Linden, E. C. M.; Sjoberg, E. R.; Juneja, L. R.; Crocker, P. R.; Varki, N.; Varki, A.: Loss of N-glycolylneuraminic acid in human evolution: implications for sialic aci.

Further studies establishing the function and utilities of CD22 are found in John Hopkins OMIM database record ID 107266, and in sited publications numbered 206-20 and 2959-209 listed in the bibliography section hereinbelow, which are also hereby incorporated by reference. Dachshund Homolog (Drosophila) (DACH, Accession NM_080759) is another VGAM1343 host target gene. DACH BINDING SITE is HOST TARGET binding site found in the 5" untranslated region of mRNA encoded by DACH, corresponding to a HOST TARGET binding site such as BINDING SITE I, BINDING SITE II or BINDING SITE III. Table 2 illustrates the complementarity of the nucleotide sequences of DACH BINDING SITE, designated SEQ ID:28033, to the nucleotide sequence of VGAM1343 RNA, herein designated VGAM RNA, also designated SEQ ID:4054.

Another function of VGAM1343 is therefore inhibition of Dachshund Homolog (Drosophila) (DACH, Accession NM_080759), a gene which regulates early progenitor cell proliferation during retinogenesis and pituitary development. Accordingly, utilities of VGAM1343 include diagnosis, prevention and treatment of diseases and clinical conditions associated with DACH. The function of DACH and its association with various diseases and clinical conditions, has been established by previous studies, as described hereinabove with reference to VGAM260. Heme Oxygenase (decycling) 1 (HMOX1, Accession NM_002133) is another VGAM1343 host target gene. HMOX1 BINDING SITE is HOST TARGET binding site found in the 3' untranslated region of mRNA encoded by HMOX1, corresponding to a HOST TARGET binding site such as BINDING SITE I, BINDING SITE II or BINDING SITE III. Table 2 illustrates the complementarity of the nucleotide sequences of HMOX1 BINDING SITE, designated SEQ ID:7908, to the nucleotide sequence of VGAM1343 RNA, herein designated VGAM RNA, also designated SEQ ID:4054.

Another function of VGAM1343 is therefore inhibition of Heme Oxygenase (decycling) 1 (HMOX1, Accession NM_002133). Accordingly, utilities of VGAM1343 include diagnosis, prevention and treatment of diseases and clinical conditions associated with HMOX1. PCCX2 (Accession XM_038352) is another VGAM1343 host target gene. PCCX2 BINDING SITE is HOST TARGET binding site found in the 3' untranslated region of mRNA encoded by PCCX2, corresponding to a HOST TARGET binding site such as BINDING SITE I, BINDING SITE II or BINDING SITE III. Table 2 illustrates the complementarity of the nucleotide sequences of PCCX2 BINDING SITE, designated SEQ ID:32821, to the nucleotide sequence of VGAM1343 RNA, herein designated VGAM RNA, also designated SEQ ID:4054.

Another function of VGAM1343 is therefore inhibition of PCCX2 (Accession XM_038352). Accordingly, utilities of VGAM1343 include diagnosis, prevention and treatment of diseases and clinical conditions associated with PCCX2. FIG. 1 further provides a conceptual description of a novel bioinformatically detected viral gene of the present invention, referred to here as Viral Genomic Address Messenger 1344 (VGAM1344) viral gene, which modulates expression of respective host target genes thereof, the function and utility of which host target genes is known in the art.

VGAM1344 is a novel bioinformatically detected regulatory, non protein coding, viral micro RNA (miRNA) gene. The method by which VGAM1344 was detected is described hereinabove with reference to FIGS. 1-8.

VGAM1344 gene, herein designated VGAM GENE, is a viral gene contained in the genome of Macaca Mulatta Rhadinovirus. VGAM1344 host target gene, herein designated VGAM HOST TARGET GENE, is a human gene contained in the human genome.

VGAM1344 gene encodes a VGAM1344 precursor RNA, herein designated VGAM PRECURSOR RNA. Similar to other miRNA genes, and unlike most ordinary genes, VGAM1344 precursor RNA does not encode a protein. A nucleotide sequence identical or highly similar to the nucleotide sequence of VGAM1344 precursor RNA is designated SEQ ID:1330, and is provided hereinbelow with reference to the sequence listing part. Nucleotide sequence SEQ ID:1330 is located at position 128312 relative to the genome of Macaca Mulatta Rhadinovirus.

VGAM1344 precursor RNA folds onto itself, forming VGAM1344 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1344 folded precursor RNA into VGAM1344 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM1344 RNA is designated SEQ ID:4055, and is provided hereinbelow with reference to the sequence listing part.

VGAM1344 host target gene, herein designated VGAM HOST TARGET GENE, encodes a corresponding messenger RNA, VGAM1344 host target RNA, herein designated VGAM HOST TARGET RNA. VGAM1344 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1344 RNA, herein designated VGAM RNA, binds complementarily to one or more host target binding sites located in untranslated regions of VGAM1344 host target RNA, herein designated VGAM HOST TARGET RNA. This complementary binding is due to the fact that the nucleotide sequence of VGAM1344 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1344 RNA, herein designated VGAM RNA, may have a different number of host target binding sites in untranslated regions of a VGAM1344 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1344 RNA, herein designated VGAM RNA, to host target binding sites on VGAM1344 host target RNA, herein designated VGAM HOST TARGET RNA, such as BINDING SITE I, BINDING SITE II and BINDING SITE III, inhibits translation of VGAM1344 host target RNA into VGAM1344 host target protein, herein designated VGAM HOST TARGET PROTEIN. VGAM host target protein is therefore outlined by a broken line.

It is appreciated that VGAM1344 host target gene, herein designated VGAM HOST TARGET GENE, in fact represents a plurality of VGAM1344 host target genes. The mRNA of each one of this plurality of VGAM1344 host target genes comprises one or more host target binding sites, each having a nucleotide sequence which is at least partly complementary to VGAM1344 RNA, herein designated VGAM RNA, and which when bound by VGAM1344 RNA causes inhibition of translation of respective one or more VGAM1344 host target proteins.

It is further appreciated by one skilled in the art that the mode of translational inhibition illustrated by FIG. 1 with specific reference to translational inhibition exerted by VGAM1344 gene, herein designated VGAM GENE, on one or more VGAM1344 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1344 is inhibition of expression of host target genes, as part of a novel viral mechanism of attacking a host. Accordingly, utilities of VGAM1344 include diagnosis, prevention and treatment of viral infection by Macaca Mulatta Rhadinovirus. Specific functions, and accordingly utilities, of VGAM1344 correlate with, and may be deduced from, the identity of the host target genes which VGAM1344 binds and inhibits, and the function of these host target genes, as elaborated hereinbelow.

Nucleotide sequences of the VGAM1344 precursor RNA, herein designated VGAM PRECURSOR RNA, and of the 'diced' VGAM1344 RNA, herein designated VGAM RNA, and a schematic representation of the secondary folding of VGAM1344 folded precursor RNA, herein designated VGAM FOLDED PRECURSOR RNA, of VGAM1344 are further described hereinbelow with reference to Table 1.

Nucleotide sequences of host target binding sites, such as BINDING SITE-I, BINDING SITE-II and BINDING SITE-III of FIG. 1, found on VGAM1344 host target RNA, and schematic representation of the complementarity of each of these host target binding sites to VGAM1344 RNA, herein designated VGAM RNA, are described hereinbelow with reference to Table 2.

As mentioned hereinabove with reference to FIG. 1, a function of VGAM1344 gene, herein designated VGAM is inhibition of expression of VGAM1344 target genes. It is appreciated that specific functions, and accordingly utilities, of VGAM1344 correlate with, and may be deduced from, the identity of the target genes which VGAM1344 binds and inhibits, and the function of these target genes, as elaborated hereinbelow.

MOT8 (Accession NM_018836) is a VGAM1344 host target gene. MOT8 BINDING SITE is HOST TARGET binding site found in the 5' untranslated region of mRNA encoded by MOT8, corresponding to a HOST TARGET binding site such as BINDING SITE I, BINDING SITE II or BINDING SITE III. Table 2 illustrates the complementarity of the nucleotide sequences of MOT8 BINDING SITE, designated SEQ ID:20825, to the nucleotide sequence of VGAM1344 RNA, herein designated VGAM RNA, also designated SEQ ID:4055.

A function of VGAM1344 is therefore inhibition of MOT8 (Accession NM_018836). Accordingly, utilities of VGAM1344 include diagnosis, prevention and treatment of diseases and clinical conditions associated with MOT8. Toll-like Receptor 10 (TLR10, Accession NM_030956) is another VGAM1344 host target gene. TLR10 BINDING SITE is HOST TARGET binding site found in the 5' untranslated region of mRNA encoded by TLR10, corresponding to a HOST TARGET binding site such as BINDING SITE I, BINDING SITE II or BINDING SITE III. Table 2 illustrates the complementarity of the nucleotide sequences of TLR10 BINDING SITE, designated SEQ ID:25229, to the nucleotide sequence of VGAM1344 RNA, herein designated VGAM RNA, also designated SEQ ID:4055.

Another function of VGAM1344 is therefore inhibition of Toll-like Receptor 10 (TLR10, Accession NM_030956). Accordingly, utilities of VGAM1344 include diagnosis, prevention and treatment of diseases and clinical conditions associated with TLR10. YAP (Accession NM_139121) is another VGAM1344 host target gene. YAP BINDING SITE is HOST TARGET binding site found in the 5' untranslated region of mRNA encoded by YAP, corresponding to a HOST TARGET binding site such as BINDING SITE I, BINDING SITE II or BINDING SITE III. Table 2 illustrates the complementarity of the nucleotide sequences of YAP BINDING SITE, designated SEQ ID:29153, to the nucleotide sequence of VGAM1344 RNA, herein designated VGAM RNA, also designated SEQ ID:4055.

Another function of VGAM1344 is therefore inhibition of YAP (Accession NM_139121). Accordingly, utilities of VGAM1344 include diagnosis, prevention and treatment of diseases and clinical conditions associated with YAP. FIG. 1 further provides a conceptual description of a novel bioinformatically detected viral gene of the present invention, referred to here as Viral Genomic Address Messenger 1345 (VGAM1345) viral gene, which modulates expression of respective host target genes thereof, the function and utility of which host target genes is known in the art.

VGAM1345 is a novel bioinformatically detected regulatory, non protein coding, viral micro RNA (miRNA) gene. The method by which VGAM1345 was detected is described hereinabove with reference to FIGS. 1-8.

VGAM1345 gene, herein designated VGAM GENE, is a viral gene contained in the genome of Bovine Herpesvirus 1. VGAM1345 host target gene, herein designated VGAM HOST TARGET GENE, is a human gene contained in the human genome.

VGAM1345 gene encodes a VGAM1345 precursor RNA, herein designated VGAM PRECURSOR RNA. Similar to other miRNA genes, and unlike most ordinary genes, VGAM1345 precursor RNA does not encode a protein. A nucleotide sequence identical or highly similar to the nucleotide sequence of VGAM1345 precursor RNA is designated SEQ ID:1331, and is provided hereinbelow with reference to the sequence listing part. Nucleotide sequence SEQ ID:1331 is located at position 123564 relative to the genome of Bovine Herpesvirus 1.

VGAM1345 precursor RNA folds onto itself, forming VGAM1345 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1345 folded precursor RNA into VGAM1345 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM1345 RNA is designated SEQ ID:4056, and is provided hereinbelow with reference to the sequence listing part.

VGAM1345 host target gene, herein designated VGAM HOST TARGET GENE, encodes a corresponding messenger RNA, VGAM1345 host target RNA, herein designated VGAM HOST TARGET RNA. VGAM1345 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1345 RNA, herein designated VGAM RNA, binds complementarily to one or more host target binding sites located in untranslated regions of VGAM1345 host target RNA, herein designated VGAM HOST TARGET RNA. This complementary binding is due to the fact that the nucleotide sequence of VGAM1345 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1345 RNA, herein designated VGAM RNA, may have a different number of host target binding sites in untranslated regions of a VGAM1345 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1345 RNA, herein designated VGAM RNA, to host target binding sites on VGAM1345 host target RNA, herein designated VGAM HOST TARGET RNA, such as BINDING SITE I, BINDING SITE II and BINDING SITE III, inhibits translation of VGAM1345 host target RNA into VGAM1345 host target protein, herein designated VGAM HOST TARGET PROTEIN. VGAM host target protein is therefore outlined by a broken line.

It is appreciated that VGAM1345 host target gene, herein designated VGAM HOST TARGET GENE, in fact represents a plurality of VGAM1345 host target genes. The mRNA of each one of this plurality of VGAM1345 host target genes comprises one or more host target binding sites, each having a nucleotide sequence which is at least partly complementary to VGAM1345 RNA, herein designated VGAM RNA, and which when bound by VGAM1345 RNA causes inhibition of translation of respective one or more VGAM1345 host target proteins.

It is further appreciated by one skilled in the art that the mode of translational inhibition illustrated by FIG. 1 with specific reference to translational inhibition exerted by VGAM1345 gene, herein designated VGAM GENE, on one or more VGAM1345 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1345 is inhibition of expression of host target genes, as part of a novel viral mechanism of attacking a host. Accordingly, utilities of VGAM1345 include diagnosis, prevention and treatment of viral infection by Bovine Herpesvirus 1. Specific functions, and accordingly utilities, of VGAM1345 correlate with, and may be deduced from, the identity of the host target genes which VGAM1345 binds and inhibits, and the function of these host target genes, as elaborated hereinbelow.

Nucleotide sequences of the VGAM1345 precursor RNA, herein designated VGAM PRECURSOR RNA, and of the 'diced' VGAM1345 RNA, herein designated VGAM RNA, and a schematic representation of the secondary folding of VGAM1345 folded precursor RNA, herein designated VGAM FOLDED PRECURSOR RNA, of VGAM1345 are further described hereinbelow with reference to Table 1.

Nucleotide sequences of host target binding sites, such as BINDING SITE-I, BINDING SITE-II and BINDING SITE-III of FIG. 1, found on VGAM1345 host target RNA, and schematic representation of the complementarity of each of these host target binding sites to VGAM1345 RNA, herein designated VGAM RNA, are described hereinbelow with reference to Table 2.

As mentioned hereinabove with reference to FIG. 1, a function of VGAM1345 gene, herein designated VGAM is inhibition of expression of VGAM1345 target genes. It is appreciated that specific functions, and accordingly utilities, of VGAM1345 correlate with, and may be deduced from, the identity of the target genes which VGAM1345 binds and inhibits, and the function of these target genes, as elaborated hereinbelow.

V-abl Abelson Murine Leukemia Viral Oncogene Homolog 1 (ABL1, Accession NM_007313) is a VGAM1345 host target gene. ABL1 BINDING SITE1 and ABL1 BINDING SITE2 are HOST TARGET binding sites found in untranslated regions of mRNA encoded by ABL1, corresponding to HOST TARGET binding sites such as BINDING SITE I, BINDING SITE II or BINDING SITE III. Table 2 illustrates the complementarity of the nucleotide sequences of ABL1 BINDING SITE1 and ABL1 BINDING SITE2, designated SEQ ID:14228 and SEQ ID:11640 respectively, to the nucleotide sequence of VGAM1345 RNA, herein designated VGAM RNA, also designated SEQ ID:4056.

A function of VGAM1345 is therefore inhibition of V-abl Abelson Murine Leukemia Viral Oncogene Homolog 1 (ABL1, Accession NM_007313). Accordingly, utilities of VGAM1345 include diagnosis, prevention and treatment of diseases and clinical conditions associated with ABL1. Ems1 Sequence (mammary tumor and squamous cell carcinoma-associated (p80/85 src substrate) (EMS1, Accession NM_138565) is another VGAM1345 host target gene. EMS1 BINDING SITE1 and EMS1 BINDING SITE2 are HOST TARGET binding sites found in untranslated regions of mRNA encoded by EMS1, corresponding to HOST TARGET binding sites such as BINDING SITE I, BINDING SITE II or BINDING SITE III. Table 2 illustrates the complementarity of the nucleotide sequences of EMS1 BINDING SITE1 and EMS1 BINDING SITE2, designated SEQ ID:28866 and SEQ ID:11735 respectively, to the nucleotide sequence of VGAM1345 RNA, herein designated VGAM RNA, also designated SEQ ID:4056.

Another function of VGAM1345 is therefore inhibition of Ems1 Sequence (mammary tumor and squamous cell carcinoma-associated (p80/85 src substrate) (EMS1, Accession NM_138565), a gene which may contribute to the organization of cell structure. in transformed cells may contribute to cellular growth regulation and transformation. Accordingly, utilities of VGAM1345 include diagnosis, prevention and treatment of diseases and clinical conditions associated with EMS1. The function of EMS1 and its association with various diseases and clinical conditions, has been established by previous studies, as described hereinabove with reference to VGAM497. PACE (Accession NM_002569) is another VGAM1345 host target gene. PACE BINDING SITE1 and PACE BINDING SITE2 are HOST TARGET binding sites found in untranslated regions of mRNA encoded by PACE, corresponding to HOST TARGET binding sites such as BINDING SITE I, BINDING SITE II or BINDING SITE III. Table 2 illustrates the complementarity of the nucleotide sequences of PACE BINDING SITE1 and PACE BINDING SITE2, designated SEQ ID:8423 and SEQ ID:8425 respectively, to the nucleotide sequence of VGAM1345 RNA, herein designated VGAM RNA, also designated SEQ ID:4056.

Another function of VGAM1345 is therefore inhibition of PACE (Accession NM_002569), a gene which processes pro-parathyroid hormone, pro-transforming growth factor beta. Accordingly, utilities of VGAM1345 include diagnosis, prevention and treatment of diseases and clinical conditions associated with PACE. The function of PACE and its association with various diseases and clinical conditions, has been established by previous studies, as described hereinabove with reference to VGAM151. Syntaxin Binding Protein 1 (STXBP1, Accession NM_003165) is another VGAM1345 host target gene. STXBP1 BINDING SITE is HOST TARGET binding site found in the 3' untranslated region of mRNA encoded by STXBP1, corresponding to a HOST TARGET binding site such as BINDING SITE I, BINDING SITE II or BINDING SITE III. Table 2 illustrates the complementarity of the nucleotide sequences of STXBP1 BINDING SITE, designated SEQ ID:9144, to the nucleotide sequence of VGAM1345 RNA, herein designated VGAM RNA, also designated SEQ ID:4056.

Another function of VGAM1345 is therefore inhibition of Syntaxin Binding Protein 1 (STXBP1, Accession NM_003165), a gene which may play a role in determining the specificity of intracellular fusion reactions. Accordingly, utilities of VGAM1345 include diagnosis, prevention and treatment of diseases and clinical conditions associated with STXBP1. The function of STXBP1 and its association with various diseases and clinical conditions, has been established by previous studies, as described hereinabove with reference to VGAM708. Reserved (C8orf13, Accession XM_088377) is another VGAM1345 host target gene. C8orf13 BINDING SITE is HOST TARGET binding site found in the 3' untranslated region of mRNA encoded by C8orf13, corresponding to a HOST TARGET binding site such as BINDING SITE I, BINDING SITE II or BINDING SITE III. Table 2 illustrates the complementarity of the nucleotide sequences of C8orf13 BINDING SITE, designated SEQ ID:39658, to the nucleotide sequence of VGAM1345 RNA, herein designated VGAM RNA, also designated SEQ ID:4056.

Another function of VGAM1345 is therefore inhibition of Reserved (C8orf13, Accession XM_088377). Accordingly, utilities of VGAM1345 include diagnosis, prevention and treatment of diseases and clinical conditions associated with C8orf13. FLJ12442 (Accession NM_022908) is another VGAM1345 host target gene. FLJ12442 BINDING SITE is HOST TARGET binding site found in the 5' untranslated region of mRNA encoded by FLJ12442, corresponding to a HOST TARGET binding site such as BINDING SITE I, BINDING SITE II or BINDING SITE III. Table 2 illustrates the complementarity of the nucleotide sequences of FLJ12442 BINDING SITE, designated SEQ ID:23209, to the nucleotide sequence of VGAM1345 RNA, herein designated VGAM RNA, also designated SEQ ID:4056.

Another function of VGAM1345 is therefore inhibition of FLJ12442 (Accession NM_022908). Accordingly, utilities of VGAM1345 include diagnosis, prevention and treatment of diseases and clinical conditions associated with FLJ12442. FLJ21032 (Accession NM_024906) is another VGAM1345 host target gene. FLJ21032 BINDING SITE is HOST TARGET binding site found in the 5' untranslated region of mRNA encoded by FLJ21032, corresponding to a HOST TARGET binding site such as BINDING SITE I, BINDING SITE II or BINDING SITE III. Table 2 illustrates the complementarity of the nucleotide sequences of FLJ21032 BINDING SITE, designated SEQ ID:24396, to the nucleotide sequence of VGAM1345 RNA, herein designated VGAM RNA, also designated SEQ ID:4056.

Another function of VGAM1345 is therefore inhibition of FLJ21032 (Accession NM_024906). Accordingly, utilities of VGAM1345 include diagnosis, prevention and treatment of diseases and clinical conditions associated with FLJ21032. FLJ21432 (Accession NM_024551) is another VGAM1345 host target gene. FLJ21432 BINDING SITE is HOST TARGET binding site found in the 3' untranslated region of mRNA encoded by FLJ21432, corresponding to a HOST TARGET binding site such as BINDING SITE I, BINDING SITE II or BINDING SITE III. Table 2 illustrates the complementarity of the nucleotide sequences of FLJ21432 BINDING SITE, designated SEQ ID:23770, to the nucleotide sequence of VGAM1345 RNA, herein designated VGAM RNA, also designated SEQ ID:4056.

Another function of VGAM1345 is therefore inhibition of FLJ21432 (Accession NM_024551). Accordingly, utilities of VGAM1345 include diagnosis, prevention and treatment of diseases and clinical conditions associated with FLJ21432. JM4 (Accession NM_007213) is another VGAM1345 host target gene. JM4 BINDING SITE is HOST TARGET binding site found in the 3' untranslated region of mRNA encoded by JM4, corresponding to a HOST TARGET binding site such as BINDING SITE I, BINDING SITE II or BINDING SITE III. Table 2 illustrates the complementarity of the nucleotide sequences of JM4 BINDING SITE, designated SEQ ID:14078, to the nucleotide sequence of VGAM1345 RNA, herein designated VGAM RNA, also designated SEQ ID:4056.

Another function of VGAM1345 is therefore inhibition of JM4 (Accession NM_007213). Accordingly, utilities of VGAM1345 include diagnosis, prevention and treatment of diseases and clinical conditions associated with JM4. KIAA0984 (Accession XM_037557) is another VGAM1345 host target gene. KIAA0984 BINDING SITE is HOST TARGET binding site found in the 5' untranslated region of mRNA encoded by KIAA0984, corresponding to a HOST TARGET binding site such as BINDING SITE I, BINDING SITE II or BINDING SITE III. Table 2 illustrates the complementarity of the nucleotide sequences of KIAA0984 BINDING SITE, designated SEQ ID:32643, to the nucleotide sequence of VGAM1345 RNA, herein designated VGAM RNA, also designated SEQ ID:4056.

Another function of VGAM1345 is therefore inhibition of KIAA0984 (Accession XM_037557). Accordingly, utilities of VGAM1345 include diagnosis, prevention and treatment of diseases and clinical conditions associated with KIAA0984. KIAA1463 (Accession XM_051160) is another VGAM1345 host target gene. KIAA1463 BINDING SITE is HOST TARGET binding site found in the 3' untranslated region of mRNA encoded by KIAA1463, corresponding to a HOST TARGET binding site such as BINDING SITE I, BINDING SITE II or BINDING SITE III. Table 2 illustrates the complementarity of the nucleotide sequences of KIAA1463 BINDING SITE, designated SEQ ID:35769, to the nucleotide sequence of VGAM1345 RNA, herein designated VGAM RNA, also designated SEQ ID:4056.

Another function of VGAM1345 is therefore inhibition of KIAA1463 (Accession XM_051160). Accordingly, utilities of VGAM1345 include diagnosis, prevention and treatment of diseases and clinical conditions associated with KIAA1463. KIAA1706 (Accession XM_166595) is another VGAM1345 host target gene. KIAA1706 BINDING SITE is HOST TARGET binding site found in the 3' untranslated region of mRNA encoded by KIAA1706, corresponding to a HOST TARGET binding site such as BINDING SITE I, BINDING SITE II or BINDING SITE III. Table 2 illustrates the complementarity of the nucleotide sequences of KIAA1706 BINDING SITE, designated SEQ ID:44575, to the nucleotide sequence of VGAM1345 RNA, herein designated VGAM RNA, also designated SEQ ID:4056.

Another function of VGAM1345 is therefore inhibition of KIAA1706 (Accession XM_166595). Accordingly, utilities of VGAM1345 include diagnosis, prevention and treatment of diseases and clinical conditions associated with KIAA1706. LIM and SH3 Protein 1 (LASP1, Accession NM_006148) is another VGAM1345 host target gene. LASP1 BINDING SITE is HOST TARGET binding site found in the 3' untranslated region of mRNA encoded by LASP1, corresponding to a HOST TARGET binding site such as BINDING SITE I, BINDING SITE II or BINDING SITE III. Table 2 illustrates the complementarity of the nucleotide sequences of LASP1 BINDING SITE, designated SEQ ID:12792, to the nucleotide sequence of VGAM1345 RNA, herein designated VGAM RNA, also designated SEQ ID:4056.

Another function of VGAM1345 is therefore inhibition of LIM and SH3 Protein 1 (LASP1, Accession NM_006148). Accordingly, utilities of VGAM1345 include diagnosis, prevention and treatment of diseases and clinical conditions associated with LASP1. MGC16063 (Accession NM_053047) is another VGAM1345 host target gene. MGC16063 BINDING SITE is HOST TARGET binding site found in the 3' untranslated region of mRNA encoded by MGC16063, corresponding to a HOST TARGET binding site such as BINDING SITE I, BINDING SITE II or BINDING SITE III. Table 2 illustrates the complementarity of the nucleotide sequences of MGC16063 BINDING SITE, designated SEQ ID:27591, to the nucleotide sequence of VGAM1345 RNA, herein designated VGAM RNA, also designated SEQ ID:4056.

Another function of VGAM1345 is therefore inhibition of MGC16063 (Accession NM_053047). Accordingly, utilities of VGAM1345 include diagnosis, prevention and treatment of diseases and clinical conditions associated with MGC16063. MGC2474 (Accession NM_023931) is another VGAM1345 host target gene. MGC2474 BINDING SITE is HOST TARGET binding site found in the 3' untranslated region of mRNA encoded by MGC2474, corresponding to a HOST TARGET binding site such as BINDING SITE I, BINDING SITE II or BINDING SITE III. Table 2 illustrates the complementarity of the nucleotide sequences of MGC2474 BINDING SITE, designated SEQ ID:23421, to the nucleotide sequence of VGAM1345 RNA, herein designated VGAM RNA, also designated SEQ ID:4056.

Another function of VGAM1345 is therefore inhibition of MGC2474 (Accession NM_023931). Accordingly, utilities of VGAM1345 include diagnosis, prevention and treatment of diseases and clinical conditions associated with MGC2474. Osteomodulin (OMD, Accession NM_005014) is another VGAM1345 host target gene. OMD BINDING SITE is HOST TARGET binding site found in the 3' untranslated region of mRNA encoded by OMD, corresponding to a HOST TARGET binding site such as BINDING SITE I, BINDING SITE II or BINDING SITE III. Table 2 illustrates the complementarity of the nucleotide sequences of OMD BINDING SITE, designated SEQ ID:11456, to the nucleotide sequence of VGAM1345 RNA, herein designated VGAM RNA, also designated SEQ ID:4056.

Another function of VGAM1345 is therefore inhibition of Osteomodulin (OMD, Accession NM_005014). Accordingly, utilities of VGAM1345 include diagnosis, prevention and treatment of diseases and clinical conditions associated with OMD. P37NB (Accession NM_005824) is another VGAM1345 host target gene. P37NB BINDING SITE is HOST TARGET binding site found in the 5" untranslated region of mRNA encoded by P37NB, corresponding to a HOST TARGET binding site such as BINDING SITE I, BINDING SITE II or BINDING SITE III. Table 2 illustrates the complementarity of the nucleotide sequences of P37NB BINDING SITE, designated SEQ ID:12435, to the nucleotide sequence of VGAM1345 RNA, herein designated VGAM RNA, also designated SEQ ID:4056.

Another function of VGAM1345 is therefore inhibition of P37NB (Accession NM_005824). Accordingly, utilities of VGAM1345 include diagnosis, prevention and treatment of diseases and clinical conditions associated with P37NB. Period Homolog 3 (Drosophila) (PER3, Accession NM_016831) is another VGAM1345 host target gene. PER3 BINDING SITE is HOST TARGET binding site found in the 3' untranslated region of mRNA encoded by PER3, corresponding to a HOST TARGET binding site such as BINDING SITE I, BINDING SITE II or BINDING SITE III. Table 2 illustrates the complementarity of the nucleotide sequences of PER3 BINDING SITE, designated SEQ ID:18822, to the nucleotide sequence of VGAM1345 RNA, herein designated VGAM RNA, also designated SEQ ID:4056.

Another function of VGAM1345 is therefore inhibition of Period Homolog 3 (Drosophila) (PER3, Accession NM_016831). Accordingly, utilities of VGAM1345 include diagnosis, prevention and treatment of diseases and clinical conditions associated with PER3. T2BP (Accession XM_046111) is another VGAM1345 host target gene. T2BP BINDING SITE is HOST TARGET binding site found in the 5' untranslated region of mRNA encoded by T2BP, corresponding to a HOST TARGET binding site such as BINDING SITE I, BINDING SITE II or BINDING SITE III. Table 2 illustrates the complementarity of the nucleotide sequences of T2BP BINDING SITE, designated SEQ ID:34683, to the nucleotide sequence of VGAM1345 RNA, herein designated VGAM RNA, also designated SEQ ID:4056.

Another function of VGAM1345 is therefore inhibition of T2BP (Accession XM_046111). Accordingly, utilities of VGAM1345 include diagnosis, prevention and treatment of diseases and clinical conditions associated with T2BP. Transducer of ERBB2, 2 (TOB2, Accession XM_170995) is another VGAM1345 host target gene. TOB2 BINDING SITE is HOST TARGET binding site found in the 3' untranslated region of mRNA encoded by TOB2, corresponding to a HOST TARGET binding site such as BINDING SITE I, BINDING SITE II or BINDING SITE III. Table 2 illustrates the complementarity of the nucleotide sequences of TOB2 BINDING SITE, designated SEQ ID:45766, to the nucleotide sequence of VGAM1345 RNA, herein designated VGAM RNA, also designated SEQ ID:4056.

Another function of VGAM1345 is therefore inhibition of Transducer of ERBB2, 2 (TOB2, Accession XM_170995). Accordingly, utilities of VGAM1345 include diagnosis, prevention and treatment of diseases and clinical conditions associated with TOB2. LOC120939 (Accession XM_073688) is another VGAM1345 host target gene. LOC120939 BINDING SITE is HOST TARGET binding site found in the 5' untranslated region of mRNA encoded by LOC120939, corresponding to a HOST TARGET binding site such as BINDING SITE I, BINDING SITE II or BINDING SITE III. Table 2 illustrates the complementarity of the nucleotide sequences of LOC120939 BINDING SITE, designated SEQ ID:37516, to the nucleotide sequence of VGAM1345 RNA, herein designated VGAM RNA, also designated SEQ ID:4056.

Another function of VGAM1345 is therefore inhibition of LOC120939 (Accession XM_073688). Accordingly, utilities of VGAM1345 include diagnosis, prevention and treatment of diseases and clinical conditions associated with LOC120939. LOC128989 (Accession XM_059310) is another VGAM1345 host target gene. LOC128989 BINDING SITE is HOST TARGET binding site found in the 3' untranslated region of mRNA encoded by LOC128989, corresponding to a HOST TARGET binding site such as BINDING SITE I, BINDING SITE II or BINDING SITE III. Table 2 illustrates the complementarity of the nucleotide sequences of LOC128989 BINDING SITE, designated SEQ ID:36941, to the nucleotide sequence of VGAM1345 RNA, herein designated VGAM RNA, also designated SEQ ID:4056.

Another function of VGAM1345 is therefore inhibition of LOC128989 (Accession XM_059310). Accordingly, utilities of VGAM1345 include diagnosis, prevention and treatment of diseases and clinical conditions associated with LOC128989. LOC148085 (Accession XM_097388) is another VGAM1345 host target gene. LOC148085 BINDING SITE is HOST TARGET binding site found in the 5' untranslated region of mRNA encoded by LOC148085, corresponding to a HOST TARGET binding site such as BINDING SITE I, BINDING SITE II or BINDING SITE III. Table 2 illustrates the complementarity of the nucleotide sequences of LOC148085 BINDING SITE, designated SEQ ID:40868, to the nucleotide sequence of VGAM1345 RNA, herein designated VGAM RNA, also designated SEQ ID:4056.

Another function of VGAM1345 is therefore inhibition of LOC148085 (Accession XM_097388). Accordingly, utilities of VGAM1345 include diagnosis, prevention and treatment of diseases and clinical conditions associated with LOC148085. LOC220776 (Accession XM_043388) is another VGAM1345 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33930, to the nucleotide sequence of VGAM1345 RNA, herein designated VGAM RNA, also designated SEQ ID:4056.

Another function of VGAM1345 is therefore inhibition of LOC220776 (Accession XM_043388). Accordingly, utilities of VGAM1345 include diagnosis, prevention and treatment of diseases and clinical conditions associated with LOC220776. LOC221042 (Accession XM_167669) is another VGAM1345 host target gene. LOC221042 BINDING SITE is HOST TARGET binding site found in the 5' untranslated region of mRNA encoded by LOC221042, corresponding to a HOST TARGET binding site such as BINDING SITE I, BINDING SITE II or BINDING SITE III. Table 2 illustrates the complementarity of the nucleotide sequences of LOC221042 BINDING SITE, designated SEQ ID:44752, to the nucleotide sequence of VGAM1345 RNA, herein designated VGAM RNA, also designated SEQ ID:4056.

Another function of VGAM1345 is therefore inhibition of LOC221042 (Accession XM_167669). Accordingly, utilities of VGAM1345 include diagnosis, prevention and treatment of diseases and clinical conditions associated with LOC221042. LOC256905 (Accession XM_173031) is another VGAM1345 host target gene. LOC256905 BINDING SITE is HOST TARGET binding site found in the 3' untranslated region of mRNA encoded by LOC256905, corresponding to a HOST TARGET binding site such as BINDING SITE I, BINDING SITE II or BINDING SITE III. Table 2 illustrates the complementarity of the nucleotide sequences of LOC256905 BINDING SITE, designated SEQ ID:46296, to the nucleotide sequence of VGAM1345 RNA, herein designated VGAM RNA, also designated SEQ ID:4056.

Another function of VGAM1345 is therefore inhibition of LOC256905 (Accession XM_173031). Accordingly, utilities of VGAM1345 include diagnosis, prevention and treatment of diseases and clinical conditions associated with LOC256905. LOC93380 (Accession XM_051020) is another VGAM1345 host target gene. LOC93380 BINDING SITE is HOST TARGET binding site found in the 3' untranslated region of mRNA encoded by LOC93380, corresponding to a HOST TARGET binding site such as BINDING SITE I, BINDING SITE II or BINDING SITE III. Table 2 illustrates the complementarity of the nucleotide sequences of LOC93380 BINDING SITE, designated SEQ ID:35728, to the nucleotide sequence of VGAM1345 RNA, herein designated VGAM RNA, also designated SEQ ID:4056.

Another function of VGAM1345 is therefore inhibition of LOC93380 (Accession XM_051020). Accordingly, utilities of VGAM1345 include diagnosis, prevention and treatment of diseases and clinical conditions associated with LOC93380. FIG. 1 further provides a conceptual description of a novel bioinformatically detected viral gene of the present invention, referred to here as Viral Genomic Address Messenger 1346 (VGAM1346) viral gene, which modulates expression of respective host target genes thereof, the function and utility of which host target genes is known in the art.

VGAM1346 is a novel bioinformatically detected regulatory, non protein coding, viral micro RNA (miRNA) gene. The method by which VGAM1346 was detected is described hereinabove with reference to FIGS. 1-8.

VGAM1346 gene, herein designated VGAM GENE, is a viral gene contained in the genome of Fowlpox Virus. VGAM1346 host target gene, herein designated VGAM HOST TARGET GENE, is a human gene contained in the human genome.

VGAM1346 gene encodes a VGAM1346 precursor RNA, herein designated VGAM PRECURSOR RNA. Similar to other miRNA genes, and unlike most ordinary genes, VGAM1346 precursor RNA does not encode a protein. A nucleotide sequence identical or highly similar to the nucleotide sequence of VGAM1346 precursor RNA is designated SEQ ID:1332, and is provided hereinbelow with reference to the sequence listing part. Nucleotide sequence SEQ ID:1332 is located at position 256840 relative to the genome of Fowlpox Virus.

VGAM1346 precursor RNA folds onto itself, forming VGAM1346 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1346 folded precursor RNA into VGAM1346 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1346 RNA is designated SEQ ID:4057, and is provided hereinbelow with reference to the sequence listing part.

VGAM1346 host target gene, herein designated VGAM HOST TARGET GENE, encodes a corresponding messenger RNA, VGAM1346 host target RNA, herein designated VGAM HOST TARGET RNA. VGAM1346 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1346 RNA, herein designated VGAM RNA, binds complementarily to one or more host target binding sites located in untranslated regions of VGAM1346 host target RNA, herein designated VGAM HOST TARGET RNA. This complementary binding is due to the fact that the nucleotide sequence of VGAM1346 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1346 RNA, herein designated VGAM RNA, may have a different number of host target binding sites in untranslated regions of a VGAM1346 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1346 RNA, herein designated VGAM RNA, to host target binding sites on VGAM1346 host target RNA, herein designated VGAM HOST TARGET RNA, such as BINDING SITE I, BINDING SITE II and BINDING SITE III, inhibits translation of VGAM1346 host target RNA into VGAM1346 host target protein, herein designated VGAM HOST TARGET PROTEIN. VGAM host target protein is therefore outlined by a broken line.

It is appreciated that VGAM1346 host target gene, herein designated VGAM HOST TARGET GENE, in fact represents a plurality of VGAM1346 host target genes. The mRNA of each one of this plurality of VGAM1346 host target genes comprises one or more host target binding sites, each having a nucleotide sequence which is at least partly complementary to VGAM1346 RNA, herein designated VGAM RNA, and which when bound by VGAM1346 RNA causes inhibition of translation of respective one or more VGAM1346 host target proteins.

It is further appreciated by one skilled in the art that the mode of translational inhibition illustrated by FIG. 1 with specific reference to translational inhibition exerted by VGAM1346 gene, herein designated VGAM GENE, on one or more VGAM1346 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1346 is inhibition of expression of host target genes, as part of a novel viral mechanism of attacking a host. Accordingly, utilities of VGAM1346 include diagnosis, prevention and treatment of viral infection by Fowlpox Virus. Specific functions, and accordingly utilities, of VGAM1346 correlate with, and may be deduced from, the identity of the host target genes which VGAM1346 binds and inhibits, and the function of these host target genes, as elaborated hereinbelow.

Nucleotide sequences of the VGAM1346 precursor RNA, herein designated VGAM PRECURSOR RNA, and of the 'diced' VGAM1346 RNA, herein designated VGAM RNA, and a schematic representation of the secondary folding of VGAM1346 folded precursor RNA, herein designated VGAM FOLDED PRECURSOR RNA, of VGAM1346 are further described hereinbelow with reference to Table 1.

Nucleotide sequences of host target binding sites, such as BINDING SITE-I, BINDING SITE-II and BINDING SITE-III of FIG. 1, found on VGAM1346 host target RNA, and schematic representation of the complementarity of each of these host target binding sites to VGAM1346 RNA, herein designated VGAM RNA, are described hereinbelow with reference to Table 2.

As mentioned hereinabove with reference to FIG. 1, a function of VGAM1346 gene, herein designated VGAM is inhibition of expression of VGAM1346 target genes. It is appreciated that specific functions, and accordingly utilities, of VGAM1346 correlate with, and may be deduced from, the identity of the target genes which VGAM1346 binds and inhibits, and the function of these target genes, as elaborated hereinbelow.

ATPase, Ca++ Transporting, Cardiac Muscle, Slow Twitch 2 (ATP2A2, Accession NM_001681) is a VGAM1346 host target gene. ATP2A2 BINDING SITE is HOST TARGET binding site found in the 3' untranslated region of mRNA encoded by ATP2A2, corresponding to a HOST TARGET binding site such as BINDING SITE I, BINDING SITE II or BINDING SITE III. Table 2 illustrates the complementarity of the nucleotide sequences of ATP2A2 BINDING SITE, designated SEQ ID:7402, to the nucleotide sequence of VGAM1346 RNA, herein designated VGAM RNA, also designated SEQ ID:4057.

A function of VGAM1346 is therefore inhibition of ATPase, Ca++ Transporting, Cardiac Muscle, Slow Twitch 2 (ATP2A2, Accession NM_001681). Accordingly, utilities of VGAM1346 include diagnosis, prevention and treatment of diseases and clinical conditions associated with ATP2A2.

KIAA1674 (Accession XM_044065) is another VGAM1346 host target gene. KIAA1674 BINDING SITE is HOST TARGET binding site found in the 3' untranslated region of mRNA encoded by KIAA1674, corresponding to a HOST TARGET binding site such as BINDING SITE I, BINDING SITE II or BINDING SITE III. Table 2 illustrates the complementarity of the nucleotide sequences of KIAA1674 BINDING SITE, designated SEQ ID:34102, to the nucleotide sequence of VGAM1346 RNA, herein designated VGAM RNA, also designated SEQ ID:4057.

Another function of VGAM1346 is therefore inhibition of KIAA1674 (Accession XM_044065). Accordingly, utilities of VGAM1346 include diagnosis, prevention and treatment of diseases and clinical conditions associated with KIAA1674. FIG. 1 further provides a conceptual description of a novel bioinformatically detected viral gene of the present invention, referred to here as Viral Genomic Address Messenger 1347 (VGAM1347) viral gene, which modulates expression of respective host target genes thereof, the function and utility of which host target genes is known in the art.

VGAM1347 is a novel bioinformatically detected regulatory, non protein coding, viral micro RNA (miRNA) gene. The method by which VGAM1347 was detected is described hereinabove with reference to FIGS. 1-8.

VGAM1347 gene, herein designated VGAM GENE, is a viral gene contained in the genome of Fowlpox Virus. VGAM1347 host target gene, herein designated VGAM HOST TARGET GENE, is a human gene contained in the human genome.

VGAM1347 gene encodes a VGAM1347 precursor RNA, herein designated VGAM PRECURSOR RNA. Similar to other miRNA genes, and unlike most ordinary genes, VGAM1347 precursor RNA does not encode a protein. A nucleotide sequence identical or highly similar to the nucleotide sequence of VGAM1347 precursor RNA is designated SEQ ID:1333, and is provided hereinbelow with reference to the sequence listing part. Nucleotide sequence SEQ ID:1333 is located at position 251073 relative to the genome of Fowlpox Virus.

VGAM1347 precursor RNA folds onto itself, forming VGAM1347 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1347 folded precursor RNA into VGAM1347 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1347 RNA is designated SEQ ID:4058, and is provided hereinbelow with reference to the sequence listing part.

VGAM1347 host target gene, herein designated VGAM HOST TARGET GENE, encodes a corresponding messenger RNA, VGAM1347 host target RNA, herein designated VGAM HOST TARGET RNA. VGAM1347 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1347 RNA, herein designated VGAM RNA, binds complementarily to one or more host target binding sites located in untranslated regions of VGAM1347 host target RNA, herein designated VGAM HOST TARGET RNA. This complementary binding is due to the fact that the nucleotide sequence of VGAM1347 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1347 RNA, herein designated VGAM RNA, may have a different number of host target binding sites in untranslated regions of a VGAM1347 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1347 RNA, herein designated VGAM RNA, to host target binding sites on VGAM1347 host target RNA, herein designated VGAM HOST TARGET RNA, such as BINDING SITE I, BINDING SITE II and BINDING SITE III, inhibits translation of VGAM1347 host target RNA into VGAM1347 host target protein, herein designated VGAM HOST TARGET PROTEIN. VGAM host target protein is therefore outlined by a broken line.

It is appreciated that VGAM1347 host target gene, herein designated VGAM HOST TARGET GENE, in fact represents a plurality of VGAM1347 host target genes. The mRNA of each one of this plurality of VGAM1347 host target genes comprises one or more host target binding sites, each having a nucleotide sequence which is at least partly complementary to VGAM1347 RNA, herein designated VGAM RNA, and which when bound by VGAM1347 RNA causes inhibition of translation of respective one or more VGAM1347 host target proteins.

It is further appreciated by one skilled in the art that the mode of translational inhibition illustrated by FIG. 1 with specific reference to translational inhibition exerted by VGAM1347 gene, herein designated VGAM GENE, on one or more VGAM1347 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1347 is inhibition of expression of host target genes, as part of a novel viral mechanism of attacking a host. Accordingly, utilities of VGAM1347 include diagnosis, prevention and treatment of viral infection by Fowlpox Virus. Specific functions, and accordingly utilities, of VGAM1347 correlate with, and may be deduced from, the identity of the host target genes which VGAM1347 binds and inhibits, and the function of these host target genes, as elaborated hereinbelow.

Nucleotide sequences of the VGAM1347 precursor RNA, herein designated VGAM PRECURSOR RNA, and of the 'diced' VGAM1347 RNA, herein designated VGAM RNA, and a schematic representation of the secondary folding of VGAM1347 folded precursor RNA, herein designated VGAM FOLDED PRECURSOR RNA, of VGAM1347 are further described hereinbelow with reference to Table 1.

Nucleotide sequences of host target binding sites, such as BINDING SITE-I, BINDING SITE-II and BINDING SITE-III of FIG. 1, found on VGAM1347 host target RNA, and schematic representation of the complementarity of each of these host target binding sites to VGAM1347 RNA, herein designated VGAM RNA, are described hereinbelow with reference to Table 2.

As mentioned hereinabove with reference to FIG. 1, a function of VGAM1347 gene, herein designated VGAM is inhibition of expression of VGAM1347 target genes. It is appreciated that specific functions, and accordingly utilities, of VGAM1347 correlate with, and may be deduced from, the identity of the target genes which VGAM1347 binds and inhibits, and the function of these target genes, as elaborated hereinbelow.

Iduronate 2-sulfatase (Hunter syndrome) (IDS, Accession NM_000202) is a VGAM1347 host target gene. IDS BINDING SITE is HOST TARGET binding site found in the 5' untranslated region of mRNA encoded by IDS, corresponding to a HOST TARGET binding site such as BINDING SITE I, BINDING SITE II or BINDING SITE III. Table 2 illustrates the complementarity of the nucleotide sequences of IDS BINDING SITE, designated SEQ ID:5698, to the nucleotide sequence of VGAM1347 RNA, herein designated VGAM RNA, also designated SEQ ID:4058.

A function of VGAM1347 is therefore inhibition of Iduronate 2-sulfatase (Hunter syndrome) (IDS, Accession NM_000202). Accordingly, utilities of VGAM1347 include diagnosis, prevention and treatment of diseases and clinical conditions associated with IDS. LOC200269 (Accession XM_114175) is another VGAM1347 host target gene. LOC200269 BINDING SITE is HOST TARGET binding site found in the 3' untranslated region of mRNA encoded by LOC200269, corresponding to a HOST TARGET binding site such as BINDING SITE I, BINDING SITE II or BINDING SITE III. Table 2 illustrates the complementarity of the nucleotide sequences of LOC200269 BINDING SITE, designated SEQ ID:42759, to the nucleotide sequence of VGAM1347 RNA, herein designated VGAM RNA, also designated SEQ ID:4058.

Another function of VGAM1347 is therefore inhibition of LOC200269 (Accession XM_114175). Accordingly, utilities of VGAM1347 include diagnosis, prevention and treatment of diseases and clinical conditions associated with LOC200269. FIG. 1 further provides a conceptual description of a novel bioinformatically detected viral gene of the present invention, referred to here as Viral Genomic Address Messenger 1348 (VGAM1348) viral gene, which modulates expression of respective host target genes thereof, the function and utility of which host target genes is known in the art.

VGAM1348 is a novel bioinformatically detected regulatory, non protein coding, viral micro RNA (miRNA) gene. The method by which VGAM1348 was detected is described hereinabove with reference to FIGS. 1-8.

VGAM1348 gene, herein designated VGAM GENE, is a viral gene contained in the genome of Fowlpox Virus. VGAM1348 host target gene, herein designated VGAM HOST TARGET GENE, is a human gene contained in the human genome.

VGAM1348 gene encodes a VGAM1348 precursor RNA, herein designated VGAM PRECURSOR RNA. Similar to other miRNA genes, and unlike most ordinary genes, VGAM1348 precursor RNA does not encode a protein. A nucleotide sequence identical or highly similar to the nucleotide sequence of VGAM1348 precursor RNA is designated SEQ ID:1334, and is provided hereinbelow with reference to the sequence listing part. Nucleotide sequence SEQ ID:1334 is located at position 254555 relative to the genome of Fowlpox Virus.

VGAM1348 precursor RNA folds onto itself, forming VGAM1348 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1348 folded precursor RNA into VGAM1348 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1348 RNA is designated SEQ ID:4059, and is provided hereinbelow with reference to the sequence listing part.

VGAM1348 host target gene, herein designated VGAM HOST TARGET GENE, encodes a corresponding messenger RNA, VGAM1348 host target RNA, herein designated VGAM HOST TARGET RNA. VGAM1348 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1348 RNA, herein designated VGAM RNA, binds complementarily to one or more host target binding sites located in untranslated regions of VGAM1348 host target RNA, herein designated VGAM HOST TARGET RNA. This complementary binding is due to the fact that the nucleotide sequence of VGAM1348 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1348 RNA, herein designated VGAM RNA, may have a different number of host target binding sites in untranslated regions of a VGAM1348 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1348 RNA, herein designated VGAM RNA, to host target binding sites on VGAM1348 host target RNA, herein designated VGAM HOST TARGET RNA, such as BINDING SITE I, BINDING SITE II and BINDING SITE III, inhibits translation of VGAM1348 host target RNA into VGAM1348 host target protein, herein designated VGAM HOST TARGET PROTEIN. VGAM host target protein is therefore outlined by a broken line.

It is appreciated that VGAM1348 host target gene, herein designated VGAM HOST TARGET GENE, in fact represents a plurality of VGAM1348 host target genes. The mRNA of each one of this plurality of VGAM1348 host target genes comprises one or more host target binding sites, each having a nucleotide sequence which is at least partly complementary to VGAM1348 RNA, herein designated VGAM RNA, and which when bound by VGAM1348 RNA causes inhibition of translation of respective one or more VGAM1348 host target proteins.

It is further appreciated by one skilled in the art that the mode of translational inhibition illustrated by FIG. 1 with specific reference to translational inhibition exerted by VGAM1348 gene, herein designated VGAM GENE, on one or more VGAM1348 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1348 is inhibition of expression of host target genes, as part of a novel viral mechanism of attacking a host. Accordingly, utilities of VGAM1348 include diagnosis, prevention and treatment of viral infection by Fowlpox Virus. Specific functions, and accordingly utilities, of VGAM1348 correlate with, and may be deduced from, the identity of the host target genes which VGAM1348 binds and inhibits, and the function of these target genes, as elaborated hereinbelow.

Nucleotide sequences of the VGAM1348 precursor RNA, herein designated VGAM PRECURSOR RNA, and of the 'diced' VGAM1348 RNA, herein designated VGAM RNA, and a schematic representation of the secondary folding of VGAM1348 folded precursor RNA, herein designated VGAM FOLDED PRECURSOR RNA, of VGAM1348 are further described hereinbelow with reference to Table 1.

Nucleotide sequences of host target binding sites, such as BINDING SITE-I, BINDING SITE-II and BINDING SITE-III of FIG. 1, found on VGAM1348 host target RNA, and schematic representation of the complementarity of each of these host target binding sites to VGAM1348 RNA, herein designated VGAM RNA, are described hereinbelow with reference to Table 2.

As mentioned hereinabove with reference to FIG. 1, a function of VGAM1348 gene, herein designated VGAM is inhibition of expression of VGAM1348 target genes. It is appreciated that specific functions, and accordingly utilities, of VGAM1348 correlate with, and may be deduced from, the identity of the target genes which VGAM1348 binds and inhibits, and the function of these target genes, as elaborated hereinbelow.

Interferon Regulatory Factor 1 (IRF1, Accession XM_034862) is a VGAM1348 host target gene. IRF1 BINDING SITE is HOST TARGET binding site found in the 3' untranslated region of mRNA encoded by IRF1, corresponding to a HOST TARGET binding site such as BINDING SITE I, BINDING SITE II or BINDING SITE III. Table 2 illustrates the complementarity of the nucleotide sequences of IRF1 BINDING SITE, designated SEQ ID:32174, to the nucleotide sequence of VGAM1348 RNA, herein designated VGAM RNA, also designated SEQ ID:4059.

A function of VGAM1348 is therefore inhibition of Interferon Regulatory Factor 1 (IRF1, Accession XM_034862), a gene which specifically binds to the upstream regulatory region of type i ifn and ifn-inducible mhc class i genes. Accordingly, utilities of VGAM1348 include diagnosis, prevention and treatment of diseases and clinical conditions associated with IRF1. The function of IRF1 and its association with various diseases and clinical conditions, has been established by previous studies, as described hereinabove with reference to VGAM1264. Membrane Protein, Palmitoylated 2 (MAGUK p55 subfamily member 2) (MPP2, Accession XM_008355) is another VGAM1348 host target gene. MPP2 BINDING SITE is HOST TARGET binding site found in the 3' untranslated region of mRNA encoded by MPP2, corresponding to a HOST TARGET binding site such as BINDING SITE I, BINDING SITE II or BINDING SITE III. Table 2 illustrates the complementarity of the nucleotide sequences of MPP2 BINDING SITE, designated SEQ ID:30079, to the nucleotide sequence of VGAM1348 RNA, herein designated VGAM RNA, also designated SEQ ID:4059.

Another function of VGAM1348 is therefore inhibition of Membrane Protein, Palmitoylated 2 (MAGUK p55 subfamily member 2) (MPP2, Accession XM_008355). Accordingly, utilities of VGAM1348 include diagnosis, prevention and treatment of diseases and clinical conditions associated with MPP2. Rhesus Blood Group, D Antigen (RHD, Accession NM_016225) is another VGAM1348 host target gene. RHD BINDING SITE1 and RHD BINDING SITE2 are HOST TARGET binding sites found in untranslated regions of mRNA encoded by RHD, corresponding to HOST TARGET binding sites such as BINDING SITE I, BINDING SITE II or BINDING SITE III. Table 2 illustrates the complementarity of the nucleotide sequences of RHD BINDING SITE1 and RHD BINDING SITE2, designated SEQ ID:18335 and SEQ ID:18215 respectively, to the nucleotide sequence of VGAM1348 RNA, herein designated VGAM RNA, also designated SEQ ID:4059.

Another function of VGAM1348 is therefore inhibition of Rhesus Blood Group, D Antigen (RHD, Accession NM_016225), a gene which Major antigen of the RH system. Accordingly, utilities of VGAM1348 include diagnosis, prevention and treatment of diseases and clinical conditions associated with RHD. The function of RHD and its association with various diseases and clinical conditions, has been established by previous studies, as described hereinabove with reference to VGAM74. FLJ10620 (Accession NM_018157) is another VGAM1348 host target gene. FLJ10620 BINDING SITE is HOST TARGET binding site found in the 3' untranslated region of mRNA encoded by FLJ10620, corresponding to a HOST TARGET binding site such as BINDING SITE I, BINDING SITE II or BINDING SITE III. Table 2 illustrates the complementarity of the nucleotide sequences of FLJ10620 BINDING SITE, designated SEQ ID:19971, to the nucleotide sequence of VGAM1348 RNA, herein designated VGAM RNA, also designated SEQ ID:4059.

Another function of VGAM1348 is therefore inhibition of FLJ10620 (Accession NM_018157). Accordingly, utilities of VGAM1348 include diagnosis, prevention and treatment of diseases and clinical conditions associated with FLJ10620. FLJ11753 (Accession NM_024659) is another VGAM1348 host target gene. FLJ11753 BINDING SITE is HOST TARGET binding site found in the 3' untranslated region of mRNA encoded by FLJ11753, corresponding to a HOST TARGET binding site such as BINDING SITE I, BINDING SITE II or BINDING SITE III. Table 2 illustrates the complementarity of the nucleotide sequences of FLJ11753 BINDING SITE, designated SEQ ID:23962, to the nucleotide sequence of VGAM1348 RNA, herein designated VGAM RNA, also designated SEQ ID:4059.

Another function of VGAM1348 is therefore inhibition of FLJ11753 (Accession NM_024659). Accordingly, utilities of VGAM1348 include diagnosis, prevention and treatment of diseases and clinical conditions associated with FLJ11753. KIAA1100 (Accession NM_014901) is another VGAM1348 host target gene. KIAA1100 BINDING SITE is HOST TARGET binding site found in the 3' untranslated region of mRNA encoded by KIAA1100, corresponding to a HOST TARGET binding site such as BINDING SITE I, BINDING SITE II or BINDING SITE III. Table 2 illustrates the complementarity of the nucleotide sequences of KIAA1100 BINDING SITE, designated SEQ ID:17086, to the nucleotide sequence of VGAM1348 RNA, herein designated VGAM RNA, also designated SEQ ID:4059.

Another function of VGAM1348 is therefore inhibition of KIAA1100 (Accession NM_014901). Accordingly, utilities of VGAM1348 include diagnosis, prevention and treatment of diseases and clinical conditions associated with KIAA1100. KIAA1199 (Accession XM_051860) is another VGAM1348 host target gene. KIAA1199 BINDING SITE is HOST TARGET binding site found in the 3' untranslated region of mRNA encoded by KIAA1199, corresponding to a HOST TARGET binding site such as BINDING SITE I, BINDING SITE II or BINDING SITE III. Table 2 illustrates the complementarity of the nucleotide sequences of KIAA1199 BINDING SITE, designated SEQ ID:35897, to the nucleotide sequence of VGAM1348 RNA, herein designated VGAM RNA, also designated SEQ ID:4059.

Another function of VGAM1348 is therefore inhibition of KIAA1199 (Accession XM_051860). Accordingly, utilities of VGAM1348 include diagnosis, prevention and treatment of diseases and clinical conditions associated with KIAA1199. NCX (Accession NM_016170) is another VGAM1348 host target gene. NCX BINDING SITE is HOST TARGET binding site found in the 5' untranslated region of mRNA encoded by NCX, corresponding to a HOST TARGET binding site such as BINDING SITE I, BINDING SITE II or BINDING SITE III. Table 2 illustrates the complementarity of the nucleotide sequences of NCX BINDING SITE, designated SEQ ID:18261, to the nucleotide sequence of VGAM1348 RNA, herein designated VGAM RNA, also designated SEQ ID:4059.

Another function of VGAM1348 is therefore inhibition of NCX (Accession NM_016170). Accordingly, utilities of VGAM1348 include diagnosis, prevention and treatment of diseases and clinical conditions associated with NCX. Oligodendrocyte Transcription Factor 1 (OLIG1, Accession XM_170977) is another VGAM1348 host target gene. OLIG1 BINDING SITE is HOST TARGET binding site found in the 3' untranslated region of mRNA encoded by OLIG1, corresponding to a HOST TARGET binding site such as BINDING SITE I, BINDING SITE II or BINDING SITE III. Table 2 illustrates the complementarity of the nucleotide sequences of OLIG1 BINDING SITE, designated SEQ ID:45752, to the nucleotide sequence of VGAM1348 RNA, herein designated VGAM RNA, also designated SEQ ID:4059.

Another function of VGAM1348 is therefore inhibition of Oligodendrocyte Transcription Factor 1 (OLIG1, Accession XM_170977). Accordingly, utilities of VGAM1348 include diagnosis, prevention and treatment of diseases and clinical conditions associated with OLIG1. PP3501 (Accession NM_021731) is another VGAM1348 host target gene. PP3501 BINDING SITE is HOST TARGET binding site found in the 3' untranslated region of mRNA encoded by PP3501, corresponding to a HOST TARGET binding site such as BINDING SITE I, BINDING SITE II or BINDING SITE III. Table 2 illustrates the complementarity of the nucleotide sequences of PP3501 BINDING SITE, designated SEQ ID:22329, to the nucleotide sequence of VGAM1348 RNA, herein designated VGAM RNA, also designated SEQ ID:4059.

Another function of VGAM1348 is therefore inhibition of PP3501 (Accession NM_021731). Accordingly, utilities of VGAM1348 include diagnosis, prevention and treatment of diseases and clinical conditions associated with PP3501. STIP-1 (Accession XM_045694) is another VGAM1348 host target gene. STIP-1 BINDING SITE is HOST TARGET binding site found in the 3' untranslated region of mRNA encoded by STIP-1, corresponding to a HOST TARGET binding site such as BINDING SITE I, BINDING SITE II or BINDING SITE III. Table 2 illustrates the complementarity of the nucleotide sequences of STIP-1 BINDING SITE, designated SEQ ID:34527, to the nucleotide sequence of VGAM1348 RNA, herein designated VGAM RNA, also designated SEQ ID:4059.

Another function of VGAM1348 is therefore inhibition of STIP-1 (Accession XM_045694). Accordingly, utilities of VGAM1348 include diagnosis, prevention and treatment of diseases and clinical conditions associated with STIP-1. YKT6 (Accession NM_006555) is another VGAM1348 host target gene. YKT6 BINDING SITE is HOST TARGET binding site found in the 3' untranslated region of mRNA encoded by YKT6, corresponding to a HOST TARGET binding site such as BINDING SITE I, BINDING SITE II or BINDING SITE III. Table 2 illustrates the complementarity of the nucleotide sequences of YKT6 BINDING SITE, designated SEQ ID:13318, to the nucleotide sequence of VGAM1348 RNA, herein designated VGAM RNA, also designated SEQ ID:4059.

Another function of VGAM1348 is therefore inhibition of YKT6 (Accession NM_006555). Accordingly, utilities of VGAM1348 include diagnosis, prevention and treatment of diseases and clinical conditions associated with YKT6. LOC145216 (Accession XM_096730) is another VGAM1348 host target gene. LOC145216 BINDING SITE is HOST TARGET binding site found in the 3' untranslated region of mRNA encoded by LOC145216, corresponding to a HOST TARGET binding site such as BINDING SITE I, BINDING SITE II or BINDING SITE III. Table 2 illustrates the complementarity of the nucleotide sequences of LOC145216 BINDING SITE, designated SEQ ID:40507, to the nucleotide sequence of VGAM1348 RNA, herein designated VGAM RNA, also designated SEQ ID:4059.

Another function of VGAM1348 is therefore inhibition of LOC145216 (Accession XM_096730). Accordingly, utilities of VGAM1348 include diagnosis, prevention and treatment of diseases and clinical conditions associated with LOC145216. LOC146513 (Accession XM_097013) is another VGAM1348 host target gene. LOC146513 BINDING SITE is HOST TARGET binding site found in the 5' untranslated region of mRNA encoded by LOC146513, corresponding to a HOST TARGET binding site such as BINDING SITE I, BINDING SITE II or BINDING SITE III. Table 2 illustrates the complementarity of the nucleotide sequences of LOC146513 BINDING SITE, designated SEQ ID:40708, to the nucleotide sequence of VGAM1348 RNA, herein designated VGAM RNA, also designated SEQ ID:4059.

Another function of VGAM1348 is therefore inhibition of LOC146513 (Accession XM_097013). Accordingly, utilities of VGAM1348 include diagnosis, prevention and treatment of diseases and clinical conditions associated with LOC146513. LOC147081 (Accession XM_085696) is another VGAM1348 host target gene. LOC147081 BINDING SITE is HOST TARGET binding site found in the 5' untranslated region of mRNA encoded by LOC147081, corresponding to a HOST TARGET binding site such as BINDING SITE I, BINDING SITE II or BINDING SITE III. Table 2 illustrates the complementarity of the nucleotide sequences of LOC147081 BINDING SITE, designated SEQ ID:38288, to the nucleotide sequence of VGAM1348 RNA, herein designated VGAM RNA, also designated SEQ ID:4059.

Another function of VGAM1348 is therefore inhibition of LOC147081 (Accession XM_085696). Accordingly, utilities of VGAM1348 include diagnosis, prevention and treatment of diseases and clinical conditions associated with LOC147081. LOC257464 (Accession XM_116972) is another VGAM1348 host target gene. LOC257464 BINDING SITE is HOST TARGET binding site found in the 5' untranslated region of mRNA encoded by LOC257464, corresponding to a HOST TARGET binding site such as BINDING SITE I, BINDING SITE II or BINDING SITE III. Table 2 illustrates the complementarity of the nucleotide sequences of LOC257464 BINDING SITE, designated SEQ ID:43162, to the nucleotide sequence of VGAM1348 RNA, herein designated VGAM RNA, also designated SEQ ID:4059.

Another function of VGAM1348 is therefore inhibition of LOC257464 (Accession XM_116972). Accordingly, utilities of VGAM1348 include diagnosis, prevention and treatment of diseases and clinical conditions associated with LOC257464. LOC51194 (Accession NM_016338) is another VGAM1348 host target gene. LOC51194 BINDING SITE is HOST TARGET binding site found in the 3' untranslated region of mRNA encoded by LOC51194, corresponding to a HOST TARGET binding site such as BINDING SITE I, BINDING SITE II or BINDING SITE III. Table 2 illustrates the complementarity of the nucleotide sequences of LOC51194 BINDING SITE, designated SEQ ID:18459, to the nucleotide sequence of VGAM1348 RNA, herein designated VGAM RNA, also designated SEQ ID:4059.

Another function of VGAM1348 is therefore inhibition of LOC51194 (Accession NM_016338). Accordingly, utilities of VGAM1348 include diagnosis, prevention and treatment of diseases and clinical conditions associated with LOC51194. LOC90190 (Accession XM_029758) is another VGAM1348 host target gene. LOC90190 BINDING SITE is HOST TARGET binding site found in the 3' untranslated region of mRNA encoded by LOC90190, corresponding to a HOST TARGET binding site such as BINDING SITE I, BINDING SITE II or BINDING SITE III. Table 2 illustrates the complementarity of the nucleotide sequences of LOC90190 BINDING SITE, designated SEQ ID:30948, to the nucleotide sequence of VGAM1348 RNA, herein designated VGAM RNA, also designated SEQ ID:4059.

Another function of VGAM1348 is therefore inhibition of LOC90190 (Accession XM_029758). Accordingly, utilities of VGAM1348 include diagnosis, prevention and treatment of diseases and clinical conditions associated with LOC90190. FIG. 1 further provides a conceptual description of a novel bioinformatically detected viral gene of the present invention, referred to here as Viral Genomic Address Messenger 1349 (VGAM1349) viral gene, which modulates expression of respective host target genes thereof, the function and utility of which host target genes is known in the art.

VGAM1349 is a novel bioinformatically detected regulatory, non protein coding, viral micro RNA (miRNA) gene. The method by which VGAM1349 was detected is described hereinabove with reference to FIGS. 1-8.

VGAM1349 gene, herein designated VGAM GENE, is a viral gene contained in the genome of Fowlpox Virus. VGAM1349 host target gene, herein designated VGAM HOST TARGET GENE, is a human gene contained in the human genome.

VGAM1349 gene encodes a VGAM1349 precursor RNA, herein designated VGAM PRECURSOR RNA. Similar to other miRNA genes, and unlike most ordinary genes, VGAM1349 precursor RNA does not encode a protein. A nucleotide sequence identical or highly similar to the nucleotide sequence of VGAM1349 precursor RNA is designated SEQ ID:1335, and is provided hereinbelow with reference to the sequence listing part. Nucleotide sequence SEQ ID:1335 is located at position 252237 relative to the genome of Fowlpox Virus.

VGAM1349 precursor RNA folds onto itself, forming VGAM1349 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1349 folded precursor RNA into VGAM1349 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1349 RNA is designated SEQ ID:4060, and is provided hereinbelow with reference to the sequence listing part.

VGAM1349 host target gene, herein designated VGAM HOST TARGET GENE, encodes a corresponding messenger RNA, VGAM1349 host target RNA, herein designated VGAM HOST TARGET RNA. VGAM1349 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1349 RNA, herein designated VGAM RNA, binds complementarily to one or more host target binding sites located in untranslated regions of VGAM1349 host target RNA, herein designated VGAM HOST TARGET RNA. This complementary binding is due to the fact that the nucleotide sequence of VGAM1349 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1349 RNA, herein designated VGAM RNA, may have a different number of host target binding sites in untranslated regions of a VGAM1349 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1349 RNA, herein designated VGAM RNA, to host target binding sites on VGAM1349 host target RNA, herein designated VGAM HOST TARGET RNA, such as BINDING SITE I, BINDING SITE II and BINDING SITE III, inhibits translation of VGAM1349 host target RNA into VGAM1349 host target protein, herein designated VGAM HOST TARGET PROTEIN. VGAM host target protein is therefore outlined by a broken line.

It is appreciated that VGAM1349 host target gene, herein designated VGAM HOST TARGET GENE, in fact represents a plurality of VGAM1349 host target genes. The mRNA of each one of this plurality of VGAM1349 host target genes comprises one or more host target binding sites, each having a nucleotide sequence which is at least partly complementary to VGAM1349 RNA, herein designated VGAM RNA, and which when bound by VGAM1349 RNA causes inhibition of translation of respective one or more VGAM1349 host target proteins.

It is further appreciated by one skilled in the art that the mode of translational inhibition illustrated by FIG. 1 with specific reference to translational inhibition exerted by VGAM1349 gene, herein designated VGAM GENE, on one or more VGAM1349 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1349 is inhibition of expression of host target genes, as part of a novel viral mechanism of attacking a host. Accordingly, utilities of VGAM1349 include diagnosis, prevention and treatment of viral infection by Fowlpox Virus. Specific functions, and accordingly utilities, of VGAM1349 correlate with, and may be deduced from, the identity of the host target genes which VGAM1349 binds and inhibits, and the function of these host target genes, as elaborated hereinbelow.

Nucleotide sequences of the VGAM1349 precursor RNA, herein designated VGAM PRECURSOR RNA, and of the 'diced' VGAM1349 RNA, herein designated VGAM RNA, and a schematic representation of the secondary folding of VGAM1349 folded precursor RNA, herein designated VGAM FOLDED PRECURSOR RNA, of VGAM1349 are further described hereinbelow with reference to Table 1.

Nucleotide sequences of host target binding sites, such as BINDING SITE-I, BINDING SITE-II and BINDING SITE-III of FIG. 1, found on VGAM1349 host target RNA, and schematic representation of the complementarity of each of these host target binding sites to VGAM1349 RNA, herein designated VGAM RNA, are described hereinbelow with reference to Table 2.

As mentioned hereinabove with reference to FIG. 1, a function of VGAM1349 gene, herein designated VGAM is inhibition of expression of VGAM1349 target genes. It is appreciated that specific functions, and accordingly utilities, of VGAM1349 correlate with, and may be deduced from, the identity of the target genes which VGAM1349 binds and inhibits, and the function of these target genes, as elaborated hereinbelow.

DKFZP586D0623 (Accession XM_050418) is a VGAM1349 host target gene. DKFZP586D0623 BINDING SITE is HOST TARGET binding site found in the 5' untranslated region of mRNA encoded by DKFZP586D0623, corresponding to a HOST TARGET binding site such as BINDING SITE I, BINDING SITE II or BINDING SITE III. Table 2 illustrates the complementarity of the nucleotide sequences of DKFZP586D0623 BINDING SITE, designated SEQ ID:35626, to the nucleotide sequence of VGAM1349 RNA, herein designated VGAM RNA, also designated SEQ ID:4060.

A function of VGAM1349 is therefore inhibition of DKFZP586D0623 (Accession XM_050418). Accordingly, utilities of VGAM1349 include diagnosis, prevention and treatment of diseases and clinical conditions associated with DKFZP586D0623. Mitogen-activated Protein Kinase-activated Protein Kinase 3 (MAPKAPK3, Accession NM_004635) is another VGAM1349 host target gene. MAPKAPK3 BINDING SITE is HOST TARGET binding site found in the 3' untranslated region of mRNA encoded by MAPKAPK3, corresponding to a HOST TARGET binding site such as BINDING SITE I, BINDING SITE II or BINDING SITE III. Table 2 illustrates the complementarity of the nucleotide sequences of MAPKAPK3 BINDING SITE, designated SEQ ID:11010, to the nucleotide sequence of VGAM1349 RNA, herein designated VGAM RNA, also designated SEQ ID:4060.

Another function of VGAM1349 is therefore inhibition of Mitogen-activated Protein Kinase-activated Protein Kinase 3 (MAPKAPK3, Accession NM_004635). Accordingly, utilities of VGAM1349 include diagnosis, prevention and treatment of diseases and clinical conditions associated with MAPKAPK3. MGC10955 (Accession NM_032676) is another VGAM1349 host target gene. MGC10955 BINDING SITE is HOST TARGET binding site found in the 5' untranslated region of mRNA encoded by MGC10955, corresponding to a HOST TARGET binding site such as BINDING SITE I, BINDING SITE II or BINDING SITE III. Table 2 illustrates the complementarity of the nucleotide sequences of MGC10955 BINDING SITE, designated SEQ ID:26398, to the nucleotide sequence of VGAM1349 RNA, herein designated VGAM RNA, also designated SEQ ID:4060.

Another function of VGAM1349 is therefore inhibition of MGC10955 (Accession NM_032676). Accordingly, utilities of VGAM1349 include diagnosis, prevention and treatment of diseases and clinical conditions associated with MGC10955. Mitochondrial Ribosomal Protein L10 (MRPL10, Accession NM_145255) is another VGAM1349 host target gene. MRPL10 BINDING SITE is HOST TARGET binding site found in the 3' untranslated region of mRNA encoded by MRPL10, corresponding to a HOST TARGET binding site such as BINDING SITE I, BINDING SITE II or BINDING SITE III. Table 2 illustrates the complementarity of the nucleotide sequences of MRPL10 BINDING SITE, designated SEQ ID:29768, to the nucleotide sequence of VGAM1349 RNA, herein designated VGAM RNA, also designated SEQ ID:4060.

Another function of VGAM1349 is therefore inhibition of Mitochondrial Ribosomal Protein L10 (MRPL10, Accession NM_145255). Accordingly, utilities of VGAM1349 include diagnosis, prevention and treatment of diseases and clinical conditions associated with MRPL10. LOC149578 (Accession XM_086592) is another VGAM1349 host target gene. LOC149578 BINDING SITE is HOST TARGET binding site found in the 5' untranslated region of mRNA encoded by LOC149578, corresponding to a HOST TARGET binding site such as BINDING SITE I, BINDING SITE II or BINDING SITE III. Table 2 illustrates the complementarity of the nucleotide sequences of LOC149578 BINDING SITE, designated SEQ ID:38780, to the nucleotide sequence of VGAM1349 RNA, herein designated VGAM RNA, also designated SEQ ID:4060.

Another function of VGAM1349 is therefore inhibition of LOC149578 (Accession XM_086592). Accordingly, utilities of VGAM1349 include diagnosis, prevention and treatment of diseases and clinical conditions associated with LOC149578. FIG. 1 further provides a conceptual description of a novel bioinformatically detected viral gene of the present invention, referred to here as Viral Genomic Address Messenger 1350 (VGAM1350) viral gene, which modulates expression of respective host target genes thereof, the function and utility of which host target genes is known in the art.

VGAM1350 is a novel bioinformatically detected regulatory, non protein coding, viral micro RNA (miRNA) gene. The method by which VGAM1350 was detected is described hereinabove with reference to FIGS. 1-8.

VGAM1350 gene, herein designated VGAM GENE, is a viral gene contained in the genome of Fowlpox Virus. VGAM1350 host target gene, herein designated VGAM HOST TARGET GENE, is a human gene contained in the human genome.

VGAM1350 gene encodes a VGAM1350 precursor RNA, herein designated VGAM PRECURSOR RNA. Similar to other miRNA genes, and unlike most ordinary genes, VGAM1350 precursor RNA does not encode a protein. A nucleotide sequence identical or highly similar to the nucleotide sequence of VGAM1350 precursor RNA is designated SEQ ID:1336, and is provided hereinbelow with reference to the sequence listing part. Nucleotide sequence SEQ ID:1336 is located at position 254693 relative to the genome of Fowlpox Virus.

VGAM1350 precursor RNA folds onto itself, forming VGAM1350 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1350 folded precursor RNA into VGAM1350 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM1350 RNA is designated SEQ ID:4061, and is provided hereinbelow with reference to the sequence listing part.

VGAM1350 host target gene, herein designated VGAM HOST TARGET GENE, encodes a corresponding messenger RNA, VGAM1350 host target RNA, herein designated VGAM HOST TARGET RNA. VGAM1350 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1350 RNA, herein designated VGAM RNA, binds complementarily to one or more host target binding sites located in untranslated regions of VGAM1350 host target RNA, herein designated VGAM HOST TARGET RNA. This complementary binding is due to the fact that the nucleotide sequence of VGAM1350 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1350 RNA, herein designated VGAM RNA, may have a different number of host target binding sites in untranslated regions of a VGAM1350 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1350 RNA, herein designated VGAM RNA, to host target binding sites on VGAM1350 host target RNA, herein designated VGAM HOST TARGET RNA, such as BINDING SITE I, BINDING SITE II and BINDING SITE III, inhibits translation of VGAM1350 host target RNA into VGAM1350 host target protein, herein designated VGAM HOST TARGET PROTEIN. VGAM host target protein is therefore outlined by a broken line.

It is appreciated that VGAM1350 host target gene, herein designated VGAM HOST TARGET GENE, in fact represents a plurality of VGAM1350 host target genes. The mRNA of each one of this plurality of VGAM1350 host target genes comprises one or more host target binding sites, each having a nucleotide sequence which is at least partly complementary to VGAM1350 RNA, herein designated VGAM RNA, and which when bound by VGAM1350 RNA causes inhibition of translation of respective one or more VGAM1350 host target proteins.

It is further appreciated by one skilled in the art that the mode of translational inhibition illustrated by FIG. 1 with specific reference to translational inhibition exerted by VGAM1350 gene, herein designated VGAM GENE, on one or more VGAM1350 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1350 is inhibition of expression of host target genes, as part of a novel viral mechanism of attacking a host. Accordingly, utilities of VGAM1350 include diagnosis, prevention and treatment of viral infection by Fowlpox Virus. Specific functions, and accordingly utilities, of VGAM1350 correlate with, and may be deduced from, the identity of the host target genes which VGAM1350 binds and inhibits, and the function of these host target genes, as elaborated hereinbelow.

Nucleotide sequences of the VGAM1350 precursor RNA, herein designated VGAM PRECURSOR RNA, and of the 'diced' VGAM1350 RNA, herein designated VGAM RNA, and a schematic representation of the secondary folding of VGAM1350 folded precursor RNA, herein designated VGAM FOLDED PRECURSOR RNA, of VGAM1350 are further described hereinbelow with reference to Table 1.

Nucleotide sequences of host target binding sites, such as BINDING SITE-I, BINDING SITE-II and BINDING SITE-III of FIG. 1, found on VGAM1350 host target RNA, and schematic representation of the complementarity of each of these host target binding sites to VGAM1350 RNA, herein designated VGAM RNA, are described hereinbelow with reference to Table 2.

As mentioned hereinabove with reference to FIG. 1, a function of VGAM1350 gene, herein designated VGAM is inhibition of expression of VGAM1350 target genes. It is appreciated that specific functions, and accordingly utilities, of VGAM1350 correlate with, and may be deduced from, the identity of the target genes which VGAM1350 binds and inhibits, and the function of these target genes, as elaborated hereinbelow.

Chloride Channel 3 (CLCN3, Accession NM_001829) is a VGAM1350 host target gene. CLCN3 BINDING SITE is HOST TARGET binding site found in the 3' untranslated region of mRNA encoded by CLCN3, corresponding to a HOST TARGET binding site such as BINDING SITE I, BINDING SITE II or BINDING SITE III. Table 2 illustrates the complementarity of the nucleotide sequences of CLCN3 BINDING SITE, designated SEQ ID:7568, to the nucleotide sequence of VGAM1350 RNA, herein designated VGAM RNA, also designated SEQ ID:4061.

A function of VGAM1350 is therefore inhibition of Chloride Channel 3 (CLCN3, Accession NM_001829), a gene which play a role in the neural cell function through regulation of membrane excitability. Accordingly, utilities of VGAM1350 include diagnosis, prevention and treatment of diseases and clinical conditions associated with CLCN3. The function of CLCN3 and its association with various diseases and clinical conditions, has been established by previous studies, as described hereinabove with reference to VGAM1332. Tripartite Motif-containing 14 (TRIM14, Accession NM_014788) is another VGAM1350 host target gene. TRIM14 BINDING SITE is HOST TARGET binding site found in the 3' untranslated region of mRNA encoded by TRIM14, corresponding to a HOST TARGET binding site such as BINDING SITE I, BINDING SITE II or BINDING SITE III. Table 2 illustrates the complementarity of the nucleotide sequences of TRIM14 BINDING SITE, designated SEQ ID:16664, to the nucleotide sequence of VGAM1350 RNA, herein designated VGAM RNA, also designated SEQ ID:4061.

Another function of VGAM1350 is therefore inhibition of Tripartite Motif-containing 14 (TRIM14, Accession NM_014788), a gene which is composed of 3 zinc-binding domains and is involved in development and cell growth. Accordingly, utilities of VGAM1350 include diagnosis, prevention and treatment of diseases and clinical conditions associated with TRIM14. The function of TRIM14 and its association with various diseases and clinical conditions, has been established by previous studies, as described hereinabove with reference to VGAM180. Trichorhinophalangeal Syndrome I (TRPS1, Accession NM_014112) is another VGAM1350 host target gene. TRPS1 BINDING SITE is HOST TARGET binding site found in the 3' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15346, to the nucleotide sequence of VGAM1350 RNA, herein designated VGAM RNA, also designated SEQ ID:4061.

Another function of VGAM1350 is therefore inhibition of Trichorhinophalangeal Syndrome I (TRPS1, Accession NM_014112), a gene which may function as a transcriptional activator protein. Accordingly, utilities of VGAM1350 include diagnosis, prevention and treatment of diseases and clinical conditions associated with TRPS1. The function of TRPS1 and its association with various diseases and clinical conditions, has been established by previous studies, as described hereinabove with reference to VGAM172. KIAA1431 (Accession XM_032055) is another VGAM1350 host target gene. KIAA1431 BINDING SITE is HOST TARGET binding site found in the 3' untranslated region of mRNA encoded by KIAA1431, corresponding to a HOST TARGET binding site such as BINDING SITE I, BINDING SITE II or BINDING SITE III. Table 2 illustrates the complementarity of the nucleotide sequences of KIAA1431 BINDING SITE, designated SEQ ID:31549, to the nucleotide sequence of VGAM1350 RNA, herein designated VGAM RNA, also designated SEQ ID:4061.

Another function of VGAM1350 is therefore inhibition of KIAA1431 (Accession XM_032055). Accordingly, utilities of VGAM1350 include diagnosis, prevention and treatment of diseases and clinical conditions associated with KIAA1431. FIG. 1 further provides a conceptual description of a novel bioinformatically detected viral gene of the present invention, referred to here as Viral Genomic Address Messenger 1351 (VGAM1351) viral gene, which modulates expression of respective host target genes thereof, the function and utility of which host target genes is known in the art.

VGAM1351 is a novel bioinformatically detected regulatory, non protein coding, viral micro RNA (miRNA) gene. The method by which VGAM1351 was detected is described hereinabove with reference to FIGS. 1-8.

VGAM1351 gene, herein designated VGAM GENE, is a viral gene contained in the genome of Fowlpox Virus. VGAM1351 host target gene, herein designated VGAM HOST TARGET GENE, is a human gene contained in the human genome.

VGAM1351 gene encodes a VGAM1351 precursor RNA, herein designated VGAM PRECURSOR RNA. Similar to other miRNA genes, and unlike most ordinary genes, VGAM1351 precursor RNA does not encode a protein. A nucleotide sequence identical or highly similar to the nucleotide sequence of VGAM1351 precursor RNA is designated SEQ ID:1337, and is provided hereinbelow with reference to the sequence listing part. Nucleotide sequence SEQ ID:1337 is located at position 252589 relative to the genome of Fowlpox Virus.

VGAM1351 precursor RNA folds onto itself, forming VGAM1351 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1351 folded precursor RNA into VGAM1351 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM1351 RNA is designated SEQ ID:4062, and is provided hereinbelow with reference to the sequence listing part.

VGAM1351 host target gene, herein designated VGAM HOST TARGET GENE, encodes a corresponding messenger RNA, VGAM1351 host target RNA, herein designated VGAM HOST TARGET RNA. VGAM1351 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1351 RNA, herein designated VGAM RNA, binds complementarily to one or more host target binding sites located in untranslated regions of VGAM1351 host target RNA, herein designated VGAM HOST TARGET RNA. This complementary binding is due to the fact that the nucleotide sequence of VGAM1351 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1351 RNA, herein designated VGAM RNA, may have a different number of host target binding sites in untranslated regions of a VGAM1351 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1351 RNA, herein designated VGAM RNA, to host target binding sites on VGAM1351 host target RNA, herein designated VGAM HOST TARGET RNA, such as BINDING SITE I, BINDING SITE II and BINDING SITE III, inhibits translation of VGAM1351 host target RNA into VGAM1351 host target protein, herein designated VGAM HOST TARGET PROTEIN. VGAM host target protein is therefore outlined by a broken line.

It is appreciated that VGAM1351 host target gene, herein designated VGAM HOST TARGET GENE, in fact represents a plurality of VGAM1351 host target genes. The mRNA of each one of this plurality of VGAM1351 host target genes comprises one or more host target binding sites, each having a nucleotide sequence which is at least partly complementary to VGAM1351 RNA, herein designated VGAM RNA, and which when bound by VGAM1351 RNA causes inhibition of translation of respective one or more VGAM1351 host target proteins.

It is further appreciated by one skilled in the art that the mode of translational inhibition illustrated by FIG. 1 with specific reference to translational inhibition exerted by VGAM1351 gene, herein designated VGAM GENE, on one or more VGAM1351 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1351 is inhibition of expression of host target genes, as part of a novel viral mechanism of attacking a host. Accordingly, utilities of VGAM1351 include diagnosis, prevention and treatment of viral infection by Fowlpox Virus. Specific functions, and accordingly utilities, of VGAM1351 correlate with, and may be deduced from, the identity of the host target genes which VGAM1351 binds and inhibits, and the function of these host target genes, as elaborated hereinbelow.

Nucleotide sequences of the VGAM1351 precursor RNA, herein designated VGAM PRECURSOR RNA, and of the 'diced' VGAM1351 RNA, herein designated VGAM RNA, and a schematic representation of the secondary folding of VGAM1351 folded precursor RNA, herein designated VGAM FOLDED PRECURSOR RNA, of VGAM1351 are further described hereinbelow with reference to Table 1.

Nucleotide sequences of host target binding sites, such as BINDING SITE-I, BINDING SITE-II and BINDING SITE-III of FIG. 1, found on VGAM1351 host target RNA, and schematic representation of the complementarity of each of these host target binding sites to VGAM1351 RNA, herein designated VGAM RNA, are described hereinbelow with reference to Table 2.

As mentioned hereinabove with reference to FIG. 1, a function of VGAM1351 gene, herein designated VGAM is inhibition of expression of VGAM1351 target genes. It is appreciated that specific functions, and accordingly utilities, of VGAM1351 correlate with, and may be deduced from, the identity of the target genes which VGAM1351 binds and inhibits, and the function of these target genes, as elaborated hereinbelow.

ARPP-19 (Accession NM_006628) is a VGAM1351 host target gene. ARPP-19 BINDING SITE is HOST TARGET binding site found in the 3' untranslated region of mRNA encoded by ARPP-19, corresponding to a HOST TARGET binding site such as BINDING SITE I, BINDING SITE II or BINDING SITE III. Table 2 illustrates the complementarity of the nucleotide sequences of ARPP-19 BINDING SITE, designated SEQ ID:13421, to the nucleotide sequence of VGAM1351 RNA, herein designated VGAM RNA, also designated SEQ ID:4062.

A function of VGAM1351 is therefore inhibition of ARPP-19 (Accession NM_006628). Accordingly, utilities of VGAM1351 include diagnosis, prevention and treatment of diseases and clinical conditions associated with ARPP-19. LOC113523 (Accession XM_054378) is another VGAM1351 host target gene. LOC113523 BINDING SITE is HOST TARGET binding site found in the 3' untranslated region of mRNA encoded by LOC113523, corresponding to a HOST TARGET binding site such as BINDING SITE I, BINDING SITE II or BINDING SITE III. Table 2 illustrates the complementarity of the nucleotide sequences of LOC113523 BINDING SITE, designated SEQ ID:36149, to the nucleotide sequence of VGAM1351 RNA, herein designated VGAM RNA, also designated SEQ ID:4062.

Another function of VGAM1351 is therefore inhibition of LOC113523 (Accession XM_054378). Accordingly, utilities of VGAM1351 include diagnosis, prevention and treatment of diseases and clinical conditions associated with LOC113523. FIG. 1 further provides a conceptual description of a novel bioinformatically detected viral gene of the present invention, referred to here as Viral Genomic Address Messenger 1352 (VGAM1352) viral gene, which modulates expression of respective host target genes thereof, the function and utility of which host target genes is known in the art.

VGAM1352 is a novel bioinformatically detected regulatory, non protein coding, viral micro RNA (miRNA) gene. The method by which VGAM1352 was detected is described hereinabove with reference to FIGS. 1-8.

VGAM1352 gene, herein designated VGAM GENE, is a viral gene contained in the genome of Fowlpox Virus. VGAM1352 host target gene, herein designated VGAM HOST TARGET GENE, is a human gene contained in the human genome.

VGAM1352 gene encodes a VGAM1352 precursor RNA, herein designated VGAM PRECURSOR RNA. Similar to other miRNA genes, and unlike most ordinary genes, VGAM1352 precursor RNA does not encode a protein. A nucleotide sequence identical or highly similar to the nucleotide sequence of VGAM1352 precursor RNA is designated SEQ ID:1338, and is provided hereinbelow with reference to the sequence listing part. Nucleotide sequence SEQ ID:1338 is located at position 252917 relative to the genome of Fowlpox Virus.

VGAM1352 precursor RNA folds onto itself, forming VGAM1352 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1352 folded precursor RNA into VGAM1352 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1352 RNA is designated SEQ ID:4063, and is provided hereinbelow with reference to the sequence listing part.

VGAM1352 host target gene, herein designated VGAM HOST TARGET GENE, encodes a corresponding messenger RNA, VGAM1352 host target RNA, herein designated VGAM HOST TARGET RNA. VGAM1352 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1352 RNA, herein designated VGAM RNA, binds complementarily to one or more host target binding sites located in untranslated regions of VGAM1352 host target RNA, herein designated VGAM HOST TARGET RNA. This complementary binding is due to the fact that the nucleotide sequence of VGAM1352 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1352 RNA, herein designated VGAM RNA, may have a different number of host target binding sites in untranslated regions of a VGAM1352 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1352 RNA, herein designated VGAM RNA, to host target binding sites on VGAM1352 host target RNA, herein designated VGAM HOST TARGET RNA, such as BINDING SITE I, BINDING SITE II and BINDING SITE III, inhibits translation of VGAM1352 host target RNA into VGAM1352 host target protein, herein designated VGAM HOST TARGET PROTEIN. VGAM host target protein is therefore outlined by a broken line.

It is appreciated that VGAM1352 host target gene, herein designated VGAM HOST TARGET GENE, in fact represents a plurality of VGAM1352 host target genes. The mRNA of each one of this plurality of VGAM1352 host target genes comprises one or more host target binding sites, each having a nucleotide sequence which is at least partly complementary to VGAM1352 RNA, herein designated VGAM RNA, and which when bound by VGAM1352 RNA causes inhibition of translation of respective one or more VGAM1352 host target proteins.

It is further appreciated by one skilled in the art that the mode of translational inhibition illustrated by FIG. 1 with specific reference to translational inhibition exerted by VGAM1352 gene, herein designated VGAM GENE, on one or more VGAM1352 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1352 is inhibition of expression of host target genes, as part of a novel viral mechanism of attacking a host. Accordingly, utilities of VGAM1352 include diagnosis, prevention and treatment of viral infection by Fowlpox Virus. Specific functions, and accordingly utilities, of VGAM1352 correlate with, and may be deduced from, the identity of the host target genes which VGAM1352 binds and inhibits, and the function of these host target genes, as elaborated hereinbelow.

Nucleotide sequences of the VGAM1352 precursor RNA, herein designated VGAM PRECURSOR RNA, and of the 'diced' VGAM1352 RNA, herein designated VGAM RNA, and a schematic representation of the secondary folding of VGAM1352 folded precursor RNA, herein designated VGAM FOLDED PRECURSOR RNA, of VGAM1352 are further described hereinbelow with reference to Table 1.

Nucleotide sequences of host target binding sites, such as BINDING SITE-I, BINDING SITE-II and BINDING SITE-III of FIG. 1, found on VGAM1352 host target RNA, and schematic representation of the complementarity of each of these host target binding sites to VGAM1352 RNA, herein designated VGAM RNA, are described hereinbelow with reference to Table 2.

As mentioned hereinabove with reference to FIG. 1, a function of VGAM1352 gene, herein designated VGAM is inhibition of expression of VGAM1352 target genes. It is appreciated that specific functions, and accordingly utilities, of VGAM1352 correlate with, and may be deduced from, the identity of the target genes which VGAM1352 binds and inhibits, and the function of these target genes, as elaborated hereinbelow.

Homeo Box A7 (HOXA7, Accession NM_006896) is a VGAM1352 host target gene. HOXA7 BINDING SITE is HOST TARGET binding site found in the 3' untranslated region of mRNA encoded by HOXA7, corresponding to a HOST TARGET binding site such as BINDING SITE I, BINDING SITE II or BINDING SITE III. Table 2 illustrates the complementarity of the nucleotide sequences of HOXA7 BINDING SITE, designated SEQ ID:13768, to the nucleotide sequence of VGAM1352 RNA, herein designated VGAM RNA, also designated SEQ ID:4063.

A function of VGAM1352 is therefore inhibition of Homeo Box A7 (HOXA7, Accession NM_006896), a gene which provides cells with specific positional identities on the anterior-posterior axis. Accordingly, utilities of VGAM1352 include diagnosis, prevention and treatment of diseases and clinical conditions associated with HOXA7. The function of HOXA7 and its association with various diseases and clinical conditions, has been established by previous studies, as described hereinabove with reference to VGAM206. Sodium Channel, Voltage-gated, Type I, Alpha Polypeptide (SCN1A, Accession XM_114281) is another VGAM1352 host target gene. SCN1A BINDING SITE is HOST TARGET binding site found in the 3' untranslated region of mRNA encoded by SCN1A, corresponding to a HOST TARGET binding site such as BINDING SITE I, BINDING SITE II or BINDING SITE III. Table 2 illustrates the complementarity of the nucleotide sequences of SCN1A BINDING SITE, designated SEQ ID:42838, to the nucleotide sequence of VGAM1352 RNA, herein designated VGAM RNA, also designated SEQ ID:4063.

Another function of VGAM1352 is therefore inhibition of Sodium Channel, Voltage-gated, Type I, Alpha Polypeptide (SCN1A, Accession XM_114281). Accordingly, utilities of VGAM1352 include diagnosis, prevention and treatment of diseases and clinical conditions associated with SCN1A. DKFZp761N1114 (Accession XM_086327) is another VGAM1352 host target gene. DKFZp761N1114 BINDING SITE is HOST TARGET binding site found in the 3' untranslated region of mRNA encoded by DKFZp761N1114, corresponding to a HOST TARGET binding site such as BINDING SITE I, BINDING SITE II or BINDING SITE III. Table 2 illustrates the complementarity of the nucleotide sequences of DKFZp761N1114 BINDING SITE, designated SEQ ID:38603, to the nucleotide sequence of VGAM1352 RNA, herein designated VGAM RNA, also designated SEQ ID:4063.

Another function of VGAM1352 is therefore inhibition of DKFZp761N1114 (Accession XM_086327). Accordingly, utilities of VGAM1352 include diagnosis, prevention and treatment of diseases and clinical conditions associated with DKFZp761N1114. FLJ11040 (Accession NM_018307) is another VGAM1352 host target gene. FLJ11040 BINDING SITE is HOST TARGET binding site found in the 3' untranslated region of mRNA encoded by FLJ11040, corresponding to a HOST TARGET binding site such as BINDING SITE I, BINDING SITE II or BINDING SITE III. Table 2 illustrates the complementarity of the nucleotide sequences of FLJ11040 BINDING SITE, designated SEQ ID:20297, to the nucleotide sequence of VGAM1352 RNA, herein designated VGAM RNA, also designated SEQ ID:4063.

Another function of VGAM1352 is therefore inhibition of FLJ11040 (Accession NM_018307). Accordingly, utilities of VGAM1352 include diagnosis, prevention and treatment of diseases and clinical conditions associated with FLJ11040. LOC199678 (Accession XM_117111) is another VGAM1352 host target gene. LOC199678 BINDING SITE is HOST TARGET binding site found in the 3' untranslated region of mRNA encoded by LOC199678, corresponding to a HOST TARGET binding site such as BINDING SITE I, BINDING SITE II or BINDING SITE III. Table 2 illustrates the complementarity of the nucleotide sequences of LOC199678 BINDING SITE, designated SEQ ID:43226, to the nucleotide sequence of VGAM1352 RNA, herein designated VGAM RNA, also designated SEQ ID:4063.

Another function of VGAM1352 is therefore inhibition of LOC199678 (Accession XM_117111). Accordingly, utilities of VGAM1352 include diagnosis, prevention and treatment of diseases and clinical conditions associated with LOC199678. FIG. 1 further provides a conceptual description of a novel bioinformatically detected viral gene of the present invention, referred to here as Viral Genomic Address Messenger 1353 (VGAM1353) viral gene, which modulates expression of respective host target genes thereof, the function and utility of which host target genes is known in the art.

VGAM1353 is a novel bioinformatically detected regulatory, non protein coding, viral micro RNA (miRNA) gene. The method by which VGAM1353 was detected is described hereinabove with reference to FIGS. 1-8.

VGAM1353 gene, herein designated VGAM GENE, is a viral gene contained in the genome of Fowlpox Virus. VGAM1353 host target gene, herein designated VGAM HOST TARGET GENE, is a human gene contained in the human genome.

VGAM1353 gene encodes a VGAM1353 precursor RNA, herein designated VGAM PRECURSOR RNA. Similar to other miRNA genes, and unlike most ordinary genes, VGAM1353 precursor RNA does not encode a protein. A nucleotide sequence identical or highly similar to the nucleotide sequence of VGAM1353 precursor RNA is designated SEQ ID:1339, and is provided hereinbelow with reference to the sequence listing part. Nucleotide sequence SEQ ID:1339 is located at position 251158 relative to the genome of Fowlpox Virus.

VGAM1353 precursor RNA folds onto itself, forming VGAM1353 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1353 folded precursor RNA into VGAM1353 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1353 RNA is designated SEQ ID:4064, and is provided hereinbelow with reference to the sequence listing part.

VGAM1353 host target gene, herein designated VGAM HOST TARGET GENE, encodes a corresponding messenger RNA, VGAM1353 host target RNA, herein designated VGAM HOST TARGET RNA. VGAM1353 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1353 RNA, herein designated VGAM RNA, binds complementarily to one or more host target binding sites located in untranslated regions of VGAM1353 host target RNA, herein designated VGAM HOST TARGET RNA. This complementary binding is due to the fact that the nucleotide sequence of VGAM1353 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1353 RNA, herein designated VGAM RNA, may have a different number of host target binding sites in untranslated regions of a VGAM1353 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1353 RNA, herein designated VGAM RNA, to host target binding sites on VGAM1353 host target RNA, herein designated VGAM HOST TARGET RNA, such as BINDING SITE I, BINDING SITE II and BINDING SITE III, inhibits translation of VGAM1353 host target RNA into VGAM1353 host target protein, herein designated VGAM HOST TARGET PROTEIN. VGAM host target protein is therefore outlined by a broken line.

It is appreciated that VGAM1353 host target gene, herein designated VGAM HOST TARGET GENE, in fact represents a plurality of VGAM1353 host target genes. The mRNA of each one of this plurality of VGAM1353 host target genes comprises one or more host target binding sites, each having a nucleotide sequence which is at least partly complementary to VGAM1353 RNA, herein designated VGAM RNA, and which when bound by VGAM1353 RNA causes inhibition of translation of respective one or more VGAM1353 host target proteins.

It is further appreciated by one skilled in the art that the mode of translational inhibition illustrated by FIG. 1 with specific reference to translational inhibition exerted by VGAM1353 gene, herein designated VGAM GENE, on one or more VGAM1353 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1353 is inhibition of expression of host target genes, as part of a novel viral mechanism of attacking a host. Accordingly, utilities of VGAM1353 include diagnosis, prevention and treatment of viral infection by Fowlpox Virus. Specific functions, and accordingly utilities, of VGAM1353 correlate with, and may be deduced from, the identity of the host target genes which VGAM1353 binds and inhibits, and the function of these host target genes, as elaborated hereinbelow.

Nucleotide sequences of the VGAM1353 precursor RNA, herein designated VGAM PRECURSOR RNA, and of the 'diced' VGAM1353 RNA, herein designated VGAM RNA, and a schematic representation of the secondary folding of VGAM1353 folded precursor RNA, herein designated VGAM FOLDED PRECURSOR RNA, of VGAM1353 are further described hereinbelow with reference to Table 1.

Nucleotide sequences of host target binding sites, such as BINDING SITE-I, BINDING SITE-II and BINDING SITE-III of FIG. 1, found on VGAM1353 host target RNA, and schematic representation of the complementarity of each of these host target binding sites to VGAM1353 RNA, herein designated VGAM RNA, are described hereinbelow with reference to Table 2.

As mentioned hereinabove with reference to FIG. 1, a function of VGAM1353 gene, herein designated VGAM is inhibition of expression of VGAM1353 target genes. It is appreciated that specific functions, and accordingly utilities, of VGAM1353 correlate with, and may be deduced from, the identity of the target genes which VGAM1353 binds and inhibits, and the function of these target genes, as elaborated hereinbelow.

Egl Nine Homolog 2 (C. elegans) (EGLN2, Accession NM_017555) is a VGAM1353 host target gene. EGLN2 BINDING SITE is HOST TARGET binding site found in the 5' untranslated region of mRNA encoded by EGLN2, corresponding to a HOST TARGET binding site such as BINDING SITE I, BINDING SITE II or BINDING SITE III. Table 2 illustrates the complementarity of the nucleotide sequences of EGLN2 BINDING SITE, designated SEQ ID:18993, to the nucleotide sequence of VGAM1353 RNA, herein designated VGAM RNA, also designated SEQ ID:4064.

A function of VGAM1353 is therefore inhibition of Egl Nine Homolog 2 (C. elegans) (EGLN2, Accession NM_017555), a gene which is an essential component of the pathway. Accordingly, utilities of VGAM1353 include diagnosis, prevention and treatment of diseases and clinical conditions associated with EGLN2. The function of EGLN2 and its association with various diseases and clinical conditions, has been established by previous studies, as described hereinabove with reference to VGAM432. BCL2-associated Athanogene 4 (BAG4, Accession NM_004874) is another VGAM1353 host target gene. BAG4 BINDING SITE is HOST TARGET binding site found in the 5' untranslated region of mRNA encoded by BAG4, corresponding to a HOST TARGET binding site such as BINDING SITE I, BINDING SITE II or BINDING SITE III. Table 2 illustrates the complementarity of the nucleotide sequences of BAG4 BINDING SITE, designated SEQ ID:11310, to the nucleotide sequence of VGAM1353 RNA, herein designated VGAM RNA, also designated SEQ ID:4064.

Another function of VGAM1353 is therefore inhibition of BCL2-associated Athanogene 4 (BAG4, Accession NM_004874). Accordingly, utilities of VGAM1353 include diagnosis, prevention and treatment of diseases and clinical conditions associated with BAG4. DKFZp761H079 (Accession NM_144996) is another VGAM1353 host target gene. DKFZp761H079 BINDING SITE is HOST TARGET binding site found in the 3' untranslated region of mRNA encoded by DKFZp761H079, corresponding to a HOST TARGET binding site such as BINDING SITE I, BINDING SITE II or BINDING SITE III. Table 2 illustrates the complementarity of the nucleotide sequences of DKFZp761H079 BINDING SITE, designated SEQ ID:29600, to the nucleotide sequence of VGAM1353 RNA, herein designated VGAM RNA, also designated SEQ ID:4064.

Another function of VGAM1353 is therefore inhibition of DKFZp761H079 (Accession NM_144996). Accordingly, utilities of VGAM1353 include diagnosis, prevention and treatment of diseases and clinical conditions associated with DKFZp761H079. KIAA0232 (Accession XM_052627) is another VGAM1353 host target gene. KIAA0232 BINDING SITE is HOST TARGET binding site found in the 3' untranslated region of mRNA encoded by KIAA0232, corresponding to a HOST TARGET binding site such as BINDING SITE I, BINDING SITE II or BINDING SITE III. Table 2 illustrates the complementarity of the nucleotide sequences of KIAA0232 BINDING SITE, designated SEQ ID:36040, to the nucleotide sequence of VGAM1353 RNA, herein designated VGAM RNA, also designated SEQ ID:4064.

Another function of VGAM1353 is therefore inhibition of KIAA0232 (Accession XM_052627). Accordingly, utilities of VGAM1353 include diagnosis, prevention and treatment of diseases and clinical conditions associated with KIAA0232. KIAA1116 (Accession NM_014892) is another VGAM1353 host target gene. KIAA1116 BINDING SITE is HOST TARGET binding site found in the 3' untranslated region of mRNA encoded by KIAA1116, corresponding to a HOST TARGET binding site such as BINDING SITE I, BINDING SITE II or BINDING SITE III. Table 2 illustrates the complementarity of the nucleotide sequences of KIAA1116 BINDING SITE, designated SEQ ID:17042, to the nucleotide sequence of VGAM1353 RNA, herein designated VGAM RNA, also designated SEQ ID:4064.

Another function of VGAM1353 is therefore inhibition of KIAA1116 (Accession NM_014892). Accordingly, utilities of VGAM1353 include diagnosis, prevention and treatment of diseases and clinical conditions associated with KIAA1116. KIAA1557 (Accession XM_028289) is another VGAM1353 host target gene. KIAA1557 BINDING SITE is HOST TARGET binding site found in the 3' untranslated region of mRNA encoded by KIAA1557, corresponding to a HOST TARGET binding site such as BINDING SITE I, BINDING SITE II or BINDING SITE III. Table 2 illustrates the complementarity of the nucleotide sequences of KIAA1557 BINDING SITE, designated SEQ ID:30642, to the nucleotide sequence of VGAM1353 RNA, herein designated VGAM RNA, also designated SEQ ID:4064.

Another function of VGAM1353 is therefore inhibition of KIAA1557 (Accession XM_028289). Accordingly, utilities of VGAM1353 include diagnosis, prevention and treatment of diseases and clinical conditions associated with KIAA1557. LOC158549 (Accession XM_098963) is another VGAM1353 host target gene. LOC158549 BINDING SITE is HOST TARGET binding site found in the 3' untranslated region of mRNA encoded by LOC158549, corresponding to a HOST TARGET binding site such as BINDING SITE I, BINDING SITE II or BINDING SITE III. Table 2 illustrates the complementarity of the nucleotide sequences of LOC158549 BINDING SITE, designated SEQ ID:42013, to the nucleotide sequence of VGAM1353 RNA, herein designated VGAM RNA, also designated SEQ ID:4064.

Another function of VGAM1353 is therefore inhibition of LOC158549 (Accession XM_098963). Accordingly, utilities of VGAM1353 include diagnosis, prevention and treatment of diseases and clinical conditions associated with LOC158549. LOC51212 (Accession NM_016380) is another VGAM1353 host target gene. LOC51212 BINDING SITE is HOST TARGET binding site found in the 5' untranslated region of mRNA encoded by LOC51212, corresponding to a HOST TARGET binding site such as BINDING SITE I, BINDING SITE II or BINDING SITE III. Table 2 illustrates the complementarity of the nucleotide sequences of LOC51212 BINDING SITE, designated SEQ ID:18519, to the nucleotide sequence of VGAM1353 RNA, herein designated VGAM RNA, also designated SEQ ID:4064.

Another function of VGAM1353 is therefore inhibition of LOC51212 (Accession NM_016380). Accordingly, utilities of VGAM1353 include diagnosis, prevention and treatment of diseases and clinical conditions associated with LOC51212. FIG. 1 further provides a conceptual description of a novel bioinformatically detected viral gene of the present invention, referred to here as Viral Genomic Address Messenger 1354 (VGAM1354) viral gene, which modulates expression of respective host target genes thereof, the function and utility of which host target genes is known in the art.

VGAM1354 is a novel bioinformatically detected regulatory, non protein coding, viral micro RNA (miRNA) gene. The method by which VGAM1354 was detected is described hereinabove with reference to FIGS. 1-8.

VGAM1354 gene, herein designated VGAM GENE, is a viral gene contained in the genome of Triatoma Virus. VGAM1354 host target gene, herein designated VGAM HOST TARGET GENE, is a human gene contained in the human genome.

VGAM1354 gene encodes a VGAM1354 precursor RNA, herein designated VGAM PRECURSOR RNA. Similar to other miRNA genes, and unlike most ordinary genes, VGAM1354 precursor RNA does not encode a protein. A nucleotide sequence identical or highly similar to the nucleotide sequence of VGAM1354 precursor RNA is designated SEQ ID:1340, and is provided hereinbelow with reference to the sequence listing part. Nucleotide sequence SEQ ID:1340 is located at position 7412 relative to the genome of Triatoma Virus.

VGAM1354 precursor RNA folds onto itself, forming VGAM1354 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1354 folded precursor RNA into VGAM1354 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM1354 RNA is designated SEQ ID:4065, and is provided hereinbelow with reference to the sequence listing part.

VGAM1354 host target gene, herein designated VGAM HOST TARGET GENE, encodes a corresponding messenger RNA, VGAM1354 host target RNA, herein designated VGAM HOST TARGET RNA. VGAM1354 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1354 RNA, herein designated VGAM RNA, binds complementarily to one or more host target binding sites located in untranslated regions of VGAM1354 host target RNA, herein designated VGAM HOST TARGET RNA. This complementary binding is due to the fact that the nucleotide sequence of VGAM1354 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1354 RNA, herein designated VGAM RNA, may have a different number of host target binding sites in untranslated regions of a VGAM1354 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1354 RNA, herein designated VGAM RNA, to host target binding sites on VGAM1354 host target RNA, herein designated VGAM HOST TARGET RNA, such as BINDING SITE I, BINDING SITE II and BINDING SITE III, inhibits translation of VGAM1354 host target RNA into VGAM1354 host target protein, herein designated VGAM HOST TARGET PROTEIN. VGAM host target protein is therefore outlined by a broken line.

It is appreciated that VGAM1354 host target gene, herein designated VGAM HOST TARGET GENE, in fact represents a plurality of VGAM1354 host target genes. The mRNA of each one of this plurality of VGAM1354 host target genes comprises one or more host target binding sites, each having a nucleotide sequence which is at least partly complementary to VGAM1354 RNA, herein designated VGAM RNA, and which when bound by VGAM1354 RNA causes inhibition of translation of respective one or more VGAM1354 host target proteins.

It is further appreciated by one skilled in the art that the mode of translational inhibition illustrated by FIG. 1 with specific reference to translational inhibition exerted by VGAM1354 gene, herein designated VGAM GENE, on one or more VGAM1354 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1354 is inhibition of expression of host target genes, as part of a novel viral mechanism of attacking a host. Accordingly, utilities of VGAM1354 include diagnosis, prevention and treatment of viral infection by Triatoma Virus. Specific functions, and accordingly utilities, of VGAM1354 correlate with, and may be deduced from, the identity of the host target genes which VGAM1354 binds and inhibits, and the function of these host target genes, as elaborated hereinbelow.

Nucleotide sequences of the VGAM1354 precursor RNA, herein designated VGAM PRECURSOR RNA, and of the 'diced' VGAM1354 RNA, herein designated VGAM RNA, and a schematic representation of the secondary folding of VGAM1354 folded precursor RNA, herein designated VGAM FOLDED PRECURSOR RNA, of VGAM1354 are further described hereinbelow with reference to Table 1.

Nucleotide sequences of host target binding sites, such as BINDING SITE-I, BINDING SITE-II and BINDING SITE-III of FIG. 1, found on VGAM1354 host target RNA, and schematic representation of the complementarity of each of these host target binding sites to VGAM1354 RNA, herein designated VGAM RNA, are described hereinbelow with reference to Table 2.

As mentioned hereinabove with reference to FIG. 1, a function of VGAM1354 gene, herein designated VGAM is inhibition of expression of VGAM1354 target genes. It is appreciated that specific functions, and accordingly utilities, of VGAM1354 correlate with, and may be deduced from, the identity of the target genes which VGAM1354 binds and inhibits, and the function of these target genes, as elaborated hereinbelow.

Glycoprotein A Repetitions Predominant (GARP, Accession NM_005512) is a VGAM1354 host target gene. GARP BINDING SITE is HOST TARGET binding site found in the 3' untranslated region of mRNA encoded by GARP, corresponding to a HOST TARGET binding site such as BINDING SITE I, BINDING SITE II or BINDING SITE III. Table 2 illustrates the complementarity of the nucleotide sequences of GARP BINDING SITE, designated SEQ ID:12034, to the nucleotide sequence of VGAM1354 RNA, herein designated VGAM RNA, also designated SEQ ID:4065.

A function of VGAM1354 is therefore inhibition of Glycoprotein A Repetitions Predominant (GARP, Accession NM_005512). Accordingly, utilities of VGAM1354 include diagnosis, prevention and treatment of diseases and clinical conditions associated with GARP. Growth Differentiation Factor 8 (GDF8, Accession NM_005259) is another VGAM1354 host target gene. GDF8 BINDING SITE is HOST TARGET binding site found in the 3' untranslated region of mRNA encoded by GDF8, corresponding to a HOST TARGET binding site such as BINDING SITE I, BINDING SITE II or BINDING SITE III. Table 2 illustrates the complementarity of the nucleotide sequences of GDF8 BINDING SITE, designated SEQ ID:11765, to the nucleotide sequence of VGAM1354 RNA, herein designated VGAM RNA, also designated SEQ ID:4065.

Another function of VGAM1354 is therefore inhibition of Growth Differentiation Factor 8 (GDF8, Accession NM_005259), a gene which acts specifically as a negative regulator of skeletal muscle growth. Accordingly, utilities of VGAM1354 include diagnosis, prevention and treatment of diseases and clinical conditions associated with GDF8. The function of GDF8 and its association with various diseases and clinical conditions, has been established by previous studies, as described hereinabove with reference to VGAM386. LIM Domain Containing Preferred Translocation Partner In Lipoma (LPP, Accession NM_005578) is another VGAM1354 host target gene. LPP BINDING SITE is HOST TARGET binding site found in the 3' untranslated region of mRNA encoded by LPP, corresponding to a HOST TARGET binding site such as BINDING SITE I, BINDING SITE II or BINDING SITE III. Table 2 illustrates the complementarity of the nucleotide sequences of LPP BINDING SITE, designated SEQ ID:12104, to the nucleotide sequence of VGAM1354 RNA, herein designated VGAM RNA, also designated SEQ ID:4065.

Another function of VGAM1354 is therefore inhibition of LIM Domain Containing Preferred Translocation Partner In Lipoma (LPP, Accession NM_005578). Accordingly, utilities of VGAM1354 include diagnosis, prevention and treatment of diseases and clinical conditions associated with LPP. RAP1A, Member of RAS Oncogene Family (RAP1A, Accession NM_002884) is another VGAM1354 host target gene. RAP1A BINDING SITE is HOST TARGET binding site found in the 3' untranslated region of mRNA encoded by RAP1A, corresponding to a HOST TARGET binding site such as BINDING SITE I, BINDING SITE II or BINDING SITE III. Table 2 illustrates the complementarity of the nucleotide sequences of RAP1A BINDING SITE, designated SEQ ID:8793, to the nucleotide sequence of VGAM1354 RNA, herein designated VGAM RNA, also designated SEQ ID:4065.

Another function of VGAM1354 is therefore inhibition of RAP1A, Member of RAS Oncogene Family (RAP1A, Accession NM_002884), a gene which induces morphological reversion of a cell line transformed by a ras oncogene. Accordingly, utilities of VGAM1354 include diagnosis, prevention and treatment of diseases and clinical conditions associated with RAP1A. The function of RAP1A and its association with various diseases and clinical conditions, has been established by previous studies, as described hereinabove with reference to VGAM993. FLJ10052 (Accession NM_017982) is another VGAM1354 host target gene. FLJ10052 BINDING SITE is HOST TARGET binding site found in the 3' untranslated region of mRNA encoded by FLJ10052, corresponding to a HOST TARGET binding site such as BINDING SITE I, BINDING SITE II or BINDING SITE III. Table 2 illustrates the complementarity of the nucleotide sequences of FLJ10052 BINDING SITE, designated SEQ ID:19713, to the nucleotide sequence of VGAM1354 RNA, herein designated VGAM RNA, also designated SEQ ID:4065.

Another function of VGAM1354 is therefore inhibition of FLJ10052 (Accession NM_017982). Accordingly, utilities of VGAM1354 include diagnosis, prevention and treatment of diseases and clinical conditions associated with FLJ10052. FLJ11730 (Accession NM_022756) is another VGAM1354 host target gene. FLJ11730 BINDING SITE is HOST TARGET binding site found in the 3' untranslated region of mRNA encoded by FLJ11730, corresponding to a HOST TARGET binding site such as BINDING SITE I, BINDING SITE II or BINDING SITE III. Table 2 illustrates the complementarity of the nucleotide sequences of FLJ11730 BINDING SITE, designated SEQ ID:22994, to the nucleotide sequence of VGAM1354 RNA, herein designated VGAM RNA, also designated SEQ ID:4065.

Another function of VGAM1354 is therefore inhibition of FLJ11730 (Accession NM_022756). Accordingly, utilities of VGAM1354 include diagnosis, prevention and treatment of diseases and clinical conditions associated with FLJ11730. FLJ21939 (Accession NM_022461) is another VGAM1354 host target gene. FLJ21939 BINDING SITE is HOST TARGET binding site found in the 3' untranslated region of mRNA encoded by FLJ21939, corresponding to a HOST TARGET binding site such as BINDING SITE I, BINDING SITE II or BINDING SITE III. Table 2 illustrates the complementarity of the nucleotide sequences of FLJ21939 BINDING SITE, designated SEQ ID:22803, to the nucleotide sequence of VGAM1354 RNA, herein designated VGAM RNA, also designated SEQ ID:4065.

Another function of VGAM1354 is therefore inhibition of FLJ21939 (Accession NM_022461). Accordingly, utilities of VGAM1354 include diagnosis, prevention and treatment of diseases and clinical conditions associated with FLJ21939. FLJ23537 (Accession NM_024889) is another VGAM1354 host target gene. FLJ23537 BINDING SITE is HOST TARGET binding site found in the 3' untranslated region of mRNA encoded by FLJ23537, corresponding to a HOST TARGET binding site such as BINDING SITE I, BINDING SITE II or BINDING SITE III. Table 2 illustrates the complementarity of the nucleotide sequences of FLJ23537 BINDING SITE, designated SEQ ID:24363, to the nucleotide sequence of VGAM1354 RNA, herein designated VGAM RNA, also designated SEQ ID:4065.

Another function of VGAM1354 is therefore inhibition of FLJ23537 (Accession NM_024889). Accordingly, utilities of VGAM1354 include diagnosis, prevention and treatment of diseases and clinical conditions associated with FLJ23537. KIAA0367 (Accession XM_041018) is another VGAM1354 host target gene. KIAA0367 BINDING SITE is HOST TARGET binding site found in the 3' untranslated region of mRNA encoded by KIAA0367, corresponding to a HOST TARGET binding site such as BINDING SITE I, BINDING SITE II or BINDING SITE III. Table 2 illustrates the complementarity of the nucleotide sequences of KIAA0367 BINDING SITE, designated SEQ ID:33421, to the nucleotide sequence of VGAM1354 RNA, herein designated VGAM RNA, also designated SEQ ID:4065.

Another function of VGAM1354 is therefore inhibition of KIAA0367 (Accession XM_041018). Accordingly, utilities of VGAM1354 include diagnosis, prevention and treatment of diseases and clinical conditions associated with KIAA0367. KIAA0555 (Accession NM_014790) is another VGAM1354 host target gene. KIAA0555 BINDING SITE is HOST TARGET binding site found in the 3' untranslated region of mRNA encoded by KIAA0555, corresponding to a HOST TARGET binding site such as BINDING SITE I, BINDING SITE II or BINDING SITE III. Table 2 illustrates the complementarity of the nucleotide sequences of KIAA0555 BINDING SITE, designated SEQ ID:16685, to the nucleotide sequence of VGAM1354 RNA, herein designated VGAM RNA, also designated SEQ ID:4065.

Another function of VGAM1354 is therefore inhibition of KIAA0555 (Accession NM_014790). Accordingly, utilities of VGAM1354 include diagnosis, prevention and treatment of diseases and clinical conditions associated with KIAA0555. KIAA0594 (Accession XM_036117) is another VGAM1354 host target gene. KIAA0594 BINDING SITE is HOST TARGET binding site found in the 3' untranslated region of mRNA encoded by KIAA0594, corresponding to a HOST TARGET binding site such as BINDING SITE I, BINDING SITE II or BINDING SITE III. Table 2 illustrates the complementarity of the nucleotide sequences of KIAA0594 BINDING SITE, designated SEQ ID:32388, to the nucleotide sequence of VGAM1354 RNA, herein designated VGAM RNA, also designated SEQ ID:4065.

Another function of VGAM1354 is therefore inhibition of KIAA0594 (Accession XM_036117). Accordingly, utilities of VGAM1354 include diagnosis, prevention and treatment of diseases and clinical conditions associated with KIAA0594. KIAA1691 (Accession XM_166523) is another VGAM1354 host target gene. KIAA1691 BINDING SITE is HOST TARGET binding site found in the 3' untranslated region of mRNA encoded by KIAA1691, corresponding to a HOST TARGET binding site such as BINDING SITE I, BINDING SITE II or BINDING SITE III. Table 2 illustrates the complementarity of the nucleotide sequences of KIAA1691 BINDING SITE, designated SEQ ID:44461, to the nucleotide sequence of VGAM1354 RNA, herein designated VGAM RNA, also designated SEQ ID:4065.

Another function of VGAM1354 is therefore inhibition of KIAA1691 (Accession XM_166523). Accordingly, utilities of VGAM1354 include diagnosis, prevention and treatment of diseases and clinical conditions associated with KIAA1691. MGC13159 (Accession NM_032927) is another VGAM1354 host target gene. MGC13159 BINDING SITE is HOST TARGET binding site found in the 3' untranslated region of mRNA encoded by MGC13159, corresponding to a HOST TARGET binding site such as BINDING SITE I, BINDING SITE II or BINDING SITE III. Table 2 illustrates the complementarity of the nucleotide sequences of MGC13159 BINDING SITE, designated SEQ ID:26750, to the nucleotide sequence of VGAM1354 RNA, herein designated VGAM RNA, also designated SEQ ID:4065.

Another function of VGAM1354 is therefore inhibition of MGC13159 (Accession NM_032927). Accordingly, utilities of VGAM1354 include diagnosis, prevention and treatment of diseases and clinical conditions associated with MGC13159. SCDGF-B (Accession NM_033135) is another VGAM1354 host target gene. SCDGF-B BINDING SITE1 and SCDGF-B BINDING SITE2 are HOST TARGET binding sites found in untranslated regions of mRNA encoded by SCDGF-B, corresponding to HOST TARGET binding sites such as BINDING SITE I, BINDING SITE II or BINDING SITE III. Table 2 illustrates the complementarity of the nucleotide sequences of SCDGF-B BINDING SITE1 and SCDGF-B BINDING SITE2, designated SEQ ID:26985 and SEQ ID:24883 respectively, to the nucleotide sequence of VGAM1354 RNA, herein designated VGAM RNA, also designated SEQ ID:4065.

Another function of VGAM1354 is therefore inhibition of SCDGF-B (Accession NM_033135). Accordingly, utilities of VGAM1354 include diagnosis, prevention and treatment of diseases and clinical conditions associated with SCDGF-B. LOC152742 (Accession XM_098259) is another VGAM1354 host target gene. LOC152742 BINDING SITE is HOST TARGET binding site found in the 3' untranslated region of mRNA encoded by LOC152742, corresponding to a HOST TARGET binding site such as BINDING SITE I, BINDING SITE II or BINDING SITE III. Table 2 illustrates the complementarity of the nucleotide sequences of LOC152742 BINDING SITE, designated SEQ ID:41545, to the nucleotide sequence of VGAM1354 RNA, herein designated VGAM RNA, also designated SEQ ID:4065.

Another function of VGAM1354 is therefore inhibition of LOC152742 (Accession XM_098259). Accordingly, utilities of VGAM1354 include diagnosis, prevention and treatment of diseases and clinical conditions associated with LOC152742. LOC153163 (Accession XM_087612) is another VGAM1354 host target gene. LOC153163 BINDING SITE is HOST TARGET binding site found in the 3' untranslated region of mRNA encoded by LOC153163, corresponding to a HOST TARGET binding site such as BINDING SITE I, BINDING SITE II or BINDING SITE III. Table 2 illustrates the complementarity of the nucleotide sequences of LOC153163 BINDING SITE, designated SEQ ID:39363, to the nucleotide sequence of VGAM1354 RNA, herein designated VGAM RNA, also designated SEQ ID:4065.

Another function of VGAM1354 is therefore inhibition of LOC153163 (Accession XM_087612). Accordingly, utilities of VGAM1354 include diagnosis, prevention and treatment of diseases and clinical conditions associated with LOC153163. LOC196453 (Accession XM_118365) is another VGAM1354 host target gene. LOC196453 BINDING SITE is HOST TARGET binding site found in the 5' untranslated region of mRNA encoded by LOC196453, corresponding to a HOST TARGET binding site such as BINDING SITE I, BINDING SITE II or BINDING SITE III. Table 2 illustrates the complementarity of the nucleotide sequences of LOC196453 BINDING SITE, designated SEQ ID:43577, to the nucleotide sequence of VGAM1354 RNA, herein designated VGAM RNA, also designated SEQ ID:4065.

Another function of VGAM1354 is therefore inhibition of LOC196453 (Accession XM_118365). Accordingly, utilities of VGAM1354 include diagnosis, prevention and treatment of diseases and clinical conditions associated with LOC196453. FIG. 1 further provides a conceptual description of a novel bioinformatically detected viral gene of the present invention, referred to here as Viral Genomic Address Messenger 1355 (VGAM1355) viral gene, which modulates expression of respective host target genes thereof, the function and utility of which host target genes is known in the art.

VGAM1355 is a novel bioinformatically detected regulatory, non protein coding, viral micro RNA (miRNA) gene. The method by which VGAM1355 was detected is described hereinabove with reference to FIGS. 1-8.

VGAM1355 gene, herein designated VGAM GENE, is a viral gene contained in the genome of Triatoma Virus. VGAM1355 host target gene, herein designated VGAM HOST TARGET GENE, is a human gene contained in the human genome.

VGAM1355 gene encodes a VGAM1355 precursor RNA, herein designated VGAM PRECURSOR RNA. Similar to other miRNA genes, and unlike most ordinary genes, VGAM1355 precursor RNA does not encode a protein. A nucleotide sequence identical or highly similar to the nucleotide sequence of VGAM1355 precursor RNA is designated SEQ ID:1341, and is provided hereinbelow with reference to the sequence listing part. Nucleotide sequence SEQ ID:1341 is located at position 3387 relative to the genome of Triatoma Virus.

VGAM1355 precursor RNA folds onto itself, forming VGAM1355 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1355 folded precursor RNA into VGAM1355 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1355 RNA is designated SEQ ID:4066, and is provided hereinbelow with reference to the sequence listing part.

VGAM1355 host target gene, herein designated VGAM HOST TARGET GENE, encodes a corresponding messenger RNA, VGAM1355 host target RNA, herein designated VGAM HOST TARGET RNA. VGAM1355 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1355 RNA, herein designated VGAM RNA, binds complementarily to one or more host target binding sites located in untranslated regions of VGAM1355 host target RNA, herein designated VGAM HOST TARGET RNA. This complementary binding is due to the fact that the nucleotide sequence of VGAM1355 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1355 RNA, herein designated VGAM RNA, may have a different number of host target binding sites in untranslated regions of a VGAM1355 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1355 RNA, herein designated VGAM RNA, to host target binding sites on VGAM1355 host target RNA, herein designated VGAM HOST TARGET RNA, such as BINDING SITE I, BINDING SITE II and BINDING SITE III, inhibits translation of VGAM1355 host target RNA into VGAM1355 host target protein, herein designated VGAM HOST TARGET PROTEIN. VGAM host target protein is therefore outlined by a broken line.

It is appreciated that VGAM1355 host target gene, herein designated VGAM HOST TARGET GENE, in fact represents a plurality of VGAM1355 host target genes. The mRNA of each one of this plurality of VGAM1355 host target genes comprises one or more host target binding sites, each having a nucleotide sequence which is at least partly complementary to VGAM1355 RNA, herein designated VGAM RNA, and which when bound by VGAM1355 RNA causes inhibition of translation of respective one or more VGAM1355 host target proteins.

It is further appreciated by one skilled in the art that the mode of translational inhibition illustrated by FIG. 1 with specific reference to translational inhibition exerted by VGAM1355 gene, herein designated VGAM GENE, on one or more VGAM1355 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1355 is inhibition of expression of host target genes, as part of a novel viral mechanism of attacking a host. Accordingly, utilities of VGAM1355 include diagnosis, prevention and treatment of viral infection by Triatoma Virus. Specific functions, and accordingly utilities, of VGAM1355 correlate with, and may be deduced from, the identity of the host target genes which VGAM1355 binds and inhibits, and the function of these host target genes, as elaborated hereinbelow.

Nucleotide sequences of the VGAM1355 precursor RNA, herein designated VGAM PRECURSOR RNA, and of the 'diced' VGAM1355 RNA, herein designated VGAM RNA, and a schematic representation of the secondary folding of VGAM1355 folded precursor RNA, herein designated VGAM FOLDED PRECURSOR RNA, of VGAM1355 are further described hereinbelow with reference to Table 1.

Nucleotide sequences of host target binding sites, such as BINDING SITE-I, BINDING SITE-II and BINDING SITE-III of FIG. 1, found on VGAM1355 host target RNA, and schematic representation of the complementarity of each of these host target binding sites to VGAM1355 RNA, herein designated VGAM RNA, are described hereinbelow with reference to Table 2.

As mentioned hereinabove with reference to FIG. 1, a function of VGAM1355 gene, herein designated VGAM is inhibition of expression of VGAM1355 target genes. It is appreciated that specific functions, and accordingly utilities, of VGAM1355 correlate with, and may be deduced from, the identity of the target genes which VGAM1355 binds and inhibits, and the function of these target genes, as elaborated hereinbelow.

UDP-Gal:betaGlcNAc Beta 1,3-galactosyltransferase, Polypeptide 2 (B3GALT2, Accession NM_003783) is a VGAM1355 host target gene. B3GALT2 BINDING SITE is HOST TARGET binding site found in the 3' untranslated region of mRNA encoded by B3GALT2, corresponding to a HOST TARGET binding site such as BINDING SITE I, BINDING SITE II or BINDING SITE III. Table 2 illustrates the complementarity of the nucleotide sequences of B3GALT2 BINDING SITE, designated SEQ ID:9870, to the nucleotide sequence of VGAM1355 RNA, herein designated VGAM RNA, also designated SEQ ID:4066.

A function of VGAM1355 is therefore inhibition of UDP-Gal:betaGlcNAc Beta 1,3-galactosyltransferase, Polypeptide 2 (B3GALT2, Accession NM_003783). Accordingly, utilities of VGAM1355 include diagnosis, prevention and treatment of diseases and clinical conditions associated with B3GALT2. UDP-Gal:betaGlcNAc Beta 1,4-Galactosyltransferase, Polypeptide 4 (B4GALT4, Accession NM_003778) is another VGAM1355 host target gene. B4GALT4 BINDING SITE is HOST TARGET binding site found in the 3' untranslated region of mRNA encoded by B4GALT4, corresponding to a HOST TARGET binding site such as BINDING SITE I, BINDING SITE II or BINDING SITE III. Table 2 illustrates the complementarity of the nucleotide sequences of B4GALT4 BINDING SITE, designated SEQ ID:9860, to the nucleotide sequence of VGAM1355 RNA, herein designated VGAM RNA, also designated SEQ ID:4066.

Another function of VGAM1355 is therefore inhibition of UDP-Gal:betaGlcNAc Beta 1,4-Galactosyltransferase, Polypeptide 4 (B4GALT4, Accession NM_003778). Accordingly, utilities of VGAM1355 include diagnosis, prevention and treatment of diseases and clinical conditions associated with B4GALT4. Disrupted In Schizophrenia 1 (DISC1, Accession NM_018662) is another VGAM1355 host target gene. DISC1 BINDING SITE is HOST TARGET binding site found in the 3' untranslated region of mRNA encoded by DISC1, corresponding to a HOST TARGET binding site such as BINDING SITE I, BINDING SITE II or BINDING SITE III. Table 2 illustrates the complementarity of the nucleotide sequences of DISC1 BINDING SITE, designated SEQ ID:20738, to the nucleotide sequence of VGAM1355 RNA, herein designated VGAM RNA, also designated SEQ ID:4066.

Another function of VGAM1355 is therefore inhibition of Disrupted In Schizophrenia 1 (DISC1, Accession NM_018662), a gene which has globular N-terminal domain (s) and a helical C-terminal domain. Accordingly, utilities of VGAM1355 include diagnosis, prevention and treatment of diseases and clinical conditions associated with DISC1. The function of DISC1 and its association with various diseases and clinical conditions, has been established by previous studies, as described hereinabove with reference to VGAM74. EGF-like-domain, Multiple 5 (EGFL5, Accession XM_098838) is another VGAM1355 host target gene. EGFL5 BINDING SITE is HOST TARGET binding site found in the 5' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41882, to the nucleotide sequence of VGAM1355 RNA, herein designated VGAM RNA, also designated SEQ ID:4066.

Another function of VGAM1355 is therefore inhibition of EGF-like-domain, Multiple 5 (EGFL5, Accession XM_098838). Accordingly, utilities of VGAM1355 include diagnosis, prevention and treatment of diseases and clinical conditions associated with EGFL5. Homeo Box B6 (HOXB6, Accession XM_008560) is another VGAM1355 host target gene. HOXB6 BINDING SITE is HOST TARGET binding site found in the 3' untranslated region of mRNA encoded by HOXB6, corresponding to a HOST TARGET binding site such as BINDING SITE I, BINDING SITE II or BINDING SITE III. Table 2 illustrates the complementarity of the nucleotide sequences of HOXB6 BINDING SITE, designated SEQ ID:30087, to the nucleotide sequence of VGAM1355 RNA, herein designated VGAM RNA, also designated SEQ ID:4066.

Another function of VGAM1355 is therefore inhibition of Homeo Box B6 (HOXB6, Accession XM_008560), a gene which participates in establishing segmentation patterns and in determining segment identities. Accordingly, utilities of VGAM1355 include diagnosis, prevention and treatment of diseases and clinical conditions associated with HOXB6. The function of HOXB6 has been established by previous studies. See 142960. To understand better the developmental significance of the murine Hox-2.2 gene (the homolog of human HOXB6, also symbolized HOX2B), Kaur et al. (1992) generated gain-of-function mutants by using the chicken beta-actin promoter to drive ubiquitous expression in transgenic mice. The resulting Hox-2.2 misexpression produced early postnatal lethality as well as craniofacial and axial skeletal perturbations that included open eyes at birth, cleft palate, micrognathia, microtia, skull bone deficiencies, and structural and positional alterations in the vertebral column. Complete or partial absence of the supraoccipital bone and malformations of the exoccipital and the basioccipital bones were observed. By fluorescence in situ hybridization, Apiou et al. (1996) mapped the HOXB gene cluster precisely to 17q21.3.

Full details of the abovementioned studies are described in the following publications, the disclosure of which are hereby incorporated by reference:

Apiou, F.; Flagiello, D.; Cillo, C.; Malfoy, B.; Poupon, M.-F.; Dutrillaux, B.: Fine mapping of human HOX gene clusters. Cytogenet. Cell Genet. 73:114-115, 1996; and Kaur, S.; Singh, G.; Stock, J. L.; Schreiner, C. M.; Kier, A. B.; Yager, K. L.; Mucenski, M. L.; Scott, W. J., Jr.; Potter, S. S.: Dominant mutation of the murine Hox-2.2 gene results.

Further studies establishing the function and utilities of HOXB6 are found in John Hopkins OMIM database record ID 142961, and in sited publications numbered 5223 listed in the bibliography section hereinbelow, which are also hereby incorporated by reference. DKFZP434G1415 (Accession NM_031292) is another VGAM1355 host target gene. DKFZP434G1415 BINDING SITE is HOST TARGET binding site found in the 3' untranslated region of mRNA encoded by DKFZP434G1415, corresponding to a HOST TARGET binding site such as BINDING SITE I, BINDING SITE II or BINDING SITE III. Table 2 illustrates the complementarity of the nucleotide sequences of DKFZP434G1415 BINDING SITE, designated SEQ ID:25314, to the nucleotide sequence of VGAM1355 RNA, herein designated VGAM RNA, also designated SEQ ID:4066.

Another function of VGAM1355 is therefore inhibition of DKFZP434G1415 (Accession NM_031292). Accordingly, utilities of VGAM1355 include diagnosis, prevention and treatment of diseases and clinical conditions associated with DKFZP434G1415. KIAA1958 (Accession XM_088566) is another VGAM1355 host target gene. KIAA1958 BINDING SITE is HOST TARGET binding site found in the 3' untranslated region of mRNA encoded by KIAA1958, corresponding to a HOST TARGET binding site such as BINDING SITE I, BINDING SITE II or BINDING SITE III. Table 2 illustrates the complementarity of the nucleotide sequences of KIAA1958 BINDING SITE, designated SEQ ID:39828, to the nucleotide sequence of VGAM1355 RNA, herein designated VGAM RNA, also designated SEQ ID:4066.

Another function of VGAM1355 is therefore inhibition of KIAA1958 (Accession XM_088566). Accordingly, utilities of VGAM1355 include diagnosis, prevention and treatment of diseases and clinical conditions associated with KIAA1958. LOC153163 (Accession XM_087612) is another VGAM1355 host target gene. LOC153163 BINDING SITE is HOST TARGET binding site found in the 3' untranslated region of mRNA encoded by LOC153163, corresponding to a HOST TARGET binding site such as BINDING SITE I, BINDING SITE II or BINDING SITE III. Table 2 illustrates the complementarity of the nucleotide sequences of LOC153163 BINDING SITE, designated SEQ ID:39362, to the nucleotide sequence of VGAM1355 RNA, herein designated VGAM RNA, also designated SEQ ID:4066.

Another function of VGAM1355 is therefore inhibition of LOC153163 (Accession XM_087612). Accordingly, utilities of VGAM1355 include diagnosis, prevention and treatment of diseases and clinical conditions associated with LOC153163. LOC200609 (Accession XM_117256) is another VGAM1355 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43325, to the nucleotide sequence of VGAM1355 RNA, herein designated VGAM RNA, also designated SEQ ID:4066.

Another function of VGAM1355 is therefore inhibition of LOC200609 (Accession XM_117256). Accordingly, utilities of VGAM1355 include diagnosis, prevention and treatment of diseases and clinical conditions associated with LOC200609. LOC202266 (Accession XM_117373) is another VGAM1355 host target gene. LOC202266 BINDING SITE is HOST TARGET binding site found in the 3' untranslated region of mRNA encoded by LOC202266, corresponding to a HOST TARGET binding site such as BINDING SITE I, BINDING SITE II or BINDING SITE III. Table 2 illustrates the complementarity of the nucleotide sequences of LOC202266 BINDING SITE, designated SEQ ID:43419, to the nucleotide sequence of VGAM1355 RNA, herein designated VGAM RNA, also designated SEQ ID:4066.

Another function of VGAM1355 is therefore inhibition of LOC202266 (Accession XM_117373). Accordingly, utilities of VGAM1355 include diagnosis, prevention and treatment of diseases and clinical conditions associated with LOC202266. FIG. 1 further provides a conceptual description of a novel bioinformatically detected viral gene of the present invention, referred to here as Viral Genomic Address Messenger 1356 (VGAM1356) viral gene, which modulates expression of respective host target genes thereof, the function and utility of which host target genes is known in the art.

VGAM1356 is a novel bioinformatically detected regulatory, non protein coding, viral micro RNA (miRNA) gene. The method by which VGAM1356 was detected is described hereinabove with reference to FIGS. 1-8.

VGAM1356 gene, herein designated VGAM GENE, is a viral gene contained in the genome of Triatoma Virus. VGAM1356 host target gene, herein designated VGAM HOST TARGET GENE, is a human gene contained in the human genome.

VGAM1356 gene encodes a VGAM1356 precursor RNA, herein designated VGAM PRECURSOR RNA. Similar to other miRNA genes, and unlike most ordinary genes, VGAM1356 precursor RNA does not encode a protein. A nucleotide sequence identical or highly similar to the nucleotide sequence of VGAM1356 precursor RNA is designated SEQ ID:1342, and is provided hereinbelow with reference to the sequence listing part. Nucleotide sequence SEQ ID:1342 is located at position 7993 relative to the genome of Triatoma Virus.

VGAM1356 precursor RNA folds onto itself, forming VGAM1356 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1356 folded precursor RNA into VGAM1356 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1356 RNA is designated SEQ ID:4067, and is provided hereinbelow with reference to the sequence listing part.

VGAM1356 host target gene, herein designated VGAM HOST TARGET GENE, encodes a corresponding messenger RNA, VGAM1356 host target RNA, herein designated VGAM HOST TARGET RNA. VGAM1356 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1356 RNA, herein designated VGAM RNA, binds complementarily to one or more host target binding sites located in untranslated regions of VGAM1356 host target RNA, herein designated VGAM HOST TARGET RNA. This complementary binding is due to the fact that the nucleotide sequence of VGAM1356 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1356 RNA, herein designated VGAM RNA, may have a different number of host target binding sites in untranslated regions of a VGAM1356 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1356 RNA, herein designated VGAM RNA, to host target binding sites on VGAM1356 host target RNA, herein designated VGAM HOST TARGET RNA, such as BINDING SITE I, BINDING SITE II and BINDING SITE III, inhibits translation of VGAM1356 host target RNA into VGAM1356 host target protein, herein designated VGAM HOST TARGET PROTEIN. VGAM host target protein is therefore outlined by a broken line.

It is appreciated that VGAM1356 host target gene, herein designated VGAM HOST TARGET GENE, in fact represents a plurality of VGAM1356 host target genes. The mRNA of each one of this plurality of VGAM1356 host target genes comprises one or more host target binding sites, each having a nucleotide sequence which is at least partly complementary to VGAM1356 RNA, herein designated VGAM RNA, and which when bound by VGAM1356 RNA causes inhibition of translation of respective one or more VGAM1356 host target proteins.

It is further appreciated by one skilled in the art that the mode of translational inhibition illustrated by FIG. 1 with specific reference to translational inhibition exerted by VGAM1356 gene, herein designated VGAM GENE, on one or more VGAM1356 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1356 is inhibition of expression of host target genes, as part of a novel viral mechanism of attacking a host. Accordingly, utilities of VGAM1356 include diagnosis, prevention and treatment of viral infection by Triatoma Virus. Specific functions, and accordingly utilities, of VGAM1356 correlate with, and may be deduced from, the identity of the host target genes which VGAM1356 binds and inhibits, and the function of these host target genes, as elaborated hereinbelow.

Nucleotide sequences of the VGAM1356 precursor RNA, herein designated VGAM PRECURSOR RNA, and of the 'diced' VGAM1356 RNA, herein designated VGAM RNA, and a schematic representation of the secondary folding of VGAM1356 folded precursor RNA, herein designated VGAM FOLDED PRECURSOR RNA, of VGAM1356 are further described hereinbelow with reference to Table 1.

Nucleotide sequences of host target binding sites, such as BINDING SITE-I, BINDING SITE-II and BINDING SITE-III of FIG. 1, found on VGAM1356 host target RNA, and schematic representation of the complementarity of each of these host target binding sites to VGAM1356 RNA, herein designated VGAM RNA, are described hereinbelow with reference to Table 2.

As mentioned hereinabove with reference to FIG. 1, a function of VGAM1356 gene, herein designated VGAM is inhibition of expression of VGAM1356 target genes. It is appreciated that specific functions, and accordingly utilities, of VGAM1356 correlate with, and may be deduced from, the identity of the target genes which VGAM1356 binds and inhibits, and the function of these target genes, as elaborated hereinbelow.

KIAA1348 (Accession XM_043826) is a VGAM1356 host target gene. KIAA1348 BINDING SITE is HOST TARGET binding site found in the 3' untranslated region of mRNA encoded by KIAA1348, corresponding to a HOST TARGET binding site such as BINDING SITE I, BINDING SITE II or BINDING SITE III. Table 2 illustrates the complementarity of the nucleotide sequences of KIAA1348 BINDING SITE, designated SEQ ID:34030, to the nucleotide sequence of VGAM1356 RNA, herein designated VGAM RNA, also designated SEQ ID:4067.

A function of VGAM1356 is therefore inhibition of KIAA1348 (Accession XM_043826). Accordingly, utilities of VGAM1356 include diagnosis, prevention and treatment of diseases and clinical conditions associated with KIAA1348. RAB39, Member RAS Oncogene Family (RAB39, Accession XM_084662) is another VGAM1356 host target gene. RAB39 BINDING SITE is HOST TARGET binding site found in the 3' untranslated region of mRNA encoded by RAB39, corresponding to a HOST TARGET binding site such as BINDING SITE I, BINDING SITE II or BINDING SITE III. Table 2 illustrates the complementarity of the nucleotide sequences of RAB39 BINDING SITE, designated SEQ ID:37645, to the nucleotide sequence of VGAM1356 RNA, herein designated VGAM RNA, also designated SEQ ID:4067.

Another function of VGAM1356 is therefore inhibition of RAB39, Member RAS Oncogene Family (RAB39, Accession XM_084662). Accordingly, utilities of VGAM1356 include diagnosis, prevention and treatment of diseases and clinical conditions associated with RAB39. LOC150630 (Accession XM_097931) is another VGAM1356 host target gene. LOC150630 BINDING SITE is HOST TARGET binding site found in the 5' untranslated region of mRNA encoded by LOC150630, corresponding to a HOST TARGET binding site such as BINDING SITE I, BINDING SITE II or BINDING SITE III. Table 2 illustrates the complementarity of the nucleotide sequences of LOC150630 BINDING SITE, designated SEQ ID:41237, to the nucleotide sequence of VGAM1356 RNA, herein designated VGAM RNA, also designated SEQ ID:4067.

Another function of VGAM1356 is therefore inhibition of LOC150630 (Accession XM_097931). Accordingly, utilities of VGAM1356 include diagnosis, prevention and treatment of diseases and clinical conditions associated with LOC150630. FIG. 1 further provides a conceptual description of a novel bioinformatically detected viral gene of the present invention, referred to here as Viral Genomic Address Messenger 1357 (VGAM1357) viral gene, which modulates expression of respective host target genes thereof, the function and utility of which host target genes is known in the art.

VGAM1357 is a novel bioinformatically detected regulatory, non protein coding, viral micro RNA (miRNA) gene. The method by which VGAM1357 was detected is described hereinabove with reference to FIGS. 1-8.

VGAM1357 gene, herein designated VGAM GENE, is a viral gene contained in the genome of Triatoma Virus. VGAM1357 host target gene, herein designated VGAM HOST TARGET GENE, is a human gene contained in the human genome.

VGAM1357 gene encodes a VGAM1357 precursor RNA, herein designated VGAM PRECURSOR RNA. Similar to other miRNA genes, and unlike most ordinary genes, VGAM1357 precursor RNA does not encode a protein. A nucleotide sequence identical or highly similar to the nucleotide sequence of VGAM1357 precursor RNA is designated SEQ ID:1343, and is provided hereinbelow with reference to the sequence listing part. Nucleotide sequence SEQ ID:1343 is located at position 7136 relative to the genome of Triatoma Virus.

VGAM1357 precursor RNA folds onto itself, forming VGAM1357 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1357 folded precursor RNA into VGAM1357 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1357 RNA is designated SEQ ID:4068, and is provided hereinbelow with reference to the sequence listing part.

VGAM1357 host target gene, herein designated VGAM HOST TARGET GENE, encodes a corresponding messenger RNA, VGAM1357 host target RNA, herein designated VGAM HOST TARGET RNA. VGAM1357 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1357 RNA, herein designated VGAM RNA, binds complementarily to one or more host target binding sites located in untranslated regions of VGAM1357 host target RNA, herein designated VGAM HOST TARGET RNA. This complementary binding is due to the fact that the nucleotide sequence of VGAM1357 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1357 RNA, herein designated VGAM RNA, may have a different number of host target binding sites in untranslated regions of a VGAM1357 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1357 RNA, herein designated VGAM RNA, to host target binding sites on VGAM1357 host target RNA, herein designated VGAM HOST TARGET RNA, such as BINDING SITE I, BINDING SITE II and BINDING SITE III, inhibits translation of VGAM1357 host target RNA into VGAM1357 host target protein, herein designated VGAM HOST TARGET PROTEIN. VGAM host target protein is therefore outlined by a broken line.

It is appreciated that VGAM1357 host target gene, herein designated VGAM HOST TARGET GENE, in fact represents a plurality of VGAM1357 host target genes. The mRNA of each one of this plurality of VGAM1357 host target genes comprises one or more host target binding sites, each having a nucleotide sequence which is at least partly complementary to VGAM1357 RNA, herein designated VGAM RNA, and which when bound by VGAM1357 RNA causes inhibition of translation of respective one or more VGAM1357 host target proteins.

It is further appreciated by one skilled in the art that the mode of translational inhibition illustrated by FIG. 1 with specific reference to translational inhibition exerted by VGAM1357 gene, herein designated VGAM GENE, on one or more VGAM1357 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1357 is inhibition of expression of host target genes, as part of a novel viral mechanism of attacking a host. Accordingly, utilities of VGAM1357 include diagnosis, prevention and treatment of viral infection by Triatoma Virus. Specific functions, and accordingly utilities, of VGAM1357 correlate with, and may be deduced from, the identity of the host target genes which VGAM1357 binds and inhibits, and the function of these host target genes, as elaborated hereinbelow.

Nucleotide sequences of the VGAM1357 precursor RNA, herein designated VGAM PRECURSOR RNA, and of the 'diced' VGAM1357 RNA, herein designated VGAM RNA, and a schematic representation of the secondary folding of VGAM1357 folded precursor RNA, herein designated VGAM FOLDED PRECURSOR RNA, of VGAM1357 are further described hereinbelow with reference to Table 1.

Nucleotide sequences of host target binding sites, such as BINDING SITE-I, BINDING SITE-II and BINDING SITE-III of FIG. 1, found on VGAM1357 host target RNA, and schematic representation of the complementarity of each of these host target binding sites to VGAM1357 RNA, herein designated VGAM RNA, are described hereinbelow with reference to Table 2.

As mentioned hereinabove with reference to FIG. 1, a function of VGAM1357 gene, herein designated VGAM is inhibition of expression of VGAM1357 target genes. It is appreciated that specific functions, and accordingly utilities, of VGAM1357 correlate with, and may be deduced from, the identity of the target genes which VGAM1357 binds and inhibits, and the function of these target genes, as elaborated hereinbelow.

2'-5'-oligoadenylate Synthetase 3, 100 kDa (OAS3, Accession NM_006187) is a VGAM1357 host target gene. OAS3 BINDING SITE is HOST TARGET binding site found in the 3' untranslated region of mRNA encoded by OAS3, corresponding to a HOST TARGET binding site such as BINDING SITE I, BINDING SITE II or BINDING SITE III. Table 2 illustrates the complementarity of the nucleotide sequences of OAS3 BINDING SITE, designated SEQ ID:12863, to the nucleotide sequence of VGAM1357 RNA, herein designated VGAM RNA, also designated SEQ ID:4068.

A function of VGAM1357 is therefore inhibition of 2'-5'-oligoadenylate Synthetase 3, 100 kDa (OAS3, Accession NM_006187), a gene which may play a role in mediating resistance to virus infection, control of cell growth, differentiation, and apoptosis. Accordingly, utilities of VGAM1357 include diagnosis, prevention and treatment of diseases and clinical conditions associated with OAS3. The function of OAS3 and its association with various diseases and clinical conditions, has been established by previous studies, as described hereinabove with reference to VGAM309. Chromosome 1 Open Reading Frame 9 (C1orf9, Accession NM_016227) is another VGAM1357 host target gene. C1orf9 BINDING SITE is HOST TARGET binding site found in the 3' untranslated region of mRNA encoded by C1orf9, corresponding to a HOST TARGET binding site such as BINDING SITE I, BINDING SITE II or BINDING SITE III. Table 2 illustrates the complementarity of the nucleotide sequences of C1orf9 BINDING SITE, designated SEQ ID:18341, to the nucleotide sequence of VGAM1357 RNA, herein designated VGAM RNA, also designated SEQ ID:4068.

Another function of VGAM1357 is therefore inhibition of Chromosome 1 Open Reading Frame 9 (C1orf9, Accession NM_016227). Accordingly, utilities of VGAM1357 include diagnosis, prevention and treatment of diseases and clinical conditions associated with C1orf9. ENDOFIN (Accession NM_014733) is another VGAM1357 host target gene. ENDOFIN BINDING SITE is HOST TARGET binding site found in the 3' untranslated region of mRNA encoded by ENDOFIN, corresponding to a HOST TARGET binding site such as BINDING SITE I, BINDING SITE II or BINDING SITE III. Table 2 illustrates the complementarity of the nucleotide sequences of ENDOFIN BINDING SITE, designated SEQ ID:16369, to the nucleotide sequence of VGAM1357 RNA, herein designated VGAM RNA, also designated SEQ ID:4068.

Another function of VGAM1357 is therefore inhibition of ENDOFIN (Accession NM_014733). Accordingly, utilities of VGAM1357 include diagnosis, prevention and treatment of diseases and clinical conditions associated with ENDOFIN. FLJ10607 (Accession XM_085119) is another VGAM1357 host target gene. FLJ10607 BINDING SITE is HOST TARGET binding site found in the 3' untranslated region of mRNA encoded by FLJ10607, corresponding to a HOST TARGET binding site such as BINDING SITE I, BINDING SITE II or BINDING SITE III. Table 2 illustrates the complementarity of the nucleotide sequences of FLJ10607 BINDING SITE, designated SEQ ID:37831, to the nucleotide sequence of VGAM1357 RNA, herein designated VGAM RNA, also designated SEQ ID:4068.

Another function of VGAM1357 is therefore inhibition of FLJ10607 (Accession XM_085119). Accordingly, utilities of VGAM1357 include diagnosis, prevention and treatment of diseases and clinical conditions associated with FLJ10607.

KIAA0332 (Accession XM_031553) is another VGAM1357 host target gene. KIAA0332 BINDING SITE is HOST TARGET binding site found in the 3' untranslated region of mRNA encoded by KIAA0332, corresponding to a HOST TARGET binding site such as BINDING SITE I, BINDING SITE II or BINDING SITE III. Table 2 illustrates the complementarity of the nucleotide sequences of KIAA0332 BINDING SITE, designated SEQ ID:31424, to the nucleotide sequence of VGAM1357 RNA, herein designated VGAM RNA, also designated SEQ ID:4068.

Another function of VGAM1357 is therefore inhibition of KIAA0332 (Accession XM_031553). Accordingly, utilities of VGAM1357 include diagnosis, prevention and treatment of diseases and clinical conditions associated with KIAA0332. NBR2 (Accession NM_005821) is another VGAM1357 host target gene. NBR2 BINDING SITE is HOST TARGET binding site found in the 3' untranslated region of mRNA encoded by NBR2, corresponding to a HOST TARGET binding site such as BINDING SITE I, BINDING SITE II or BINDING SITE III. Table 2 illustrates the complementarity of the nucleotide sequences of NBR2 BINDING SITE, designated SEQ ID:12422, to the nucleotide sequence of VGAM1357 RNA, herein designated VGAM RNA, also designated SEQ ID:4068.

Another function of VGAM1357 is therefore inhibition of NBR2 (Accession NM_005821). Accordingly, utilities of VGAM1357 include diagnosis, prevention and treatment of diseases and clinical conditions associated with NBR2. Zinc Finger, DHHC Domain Containing 2 (ZDHHC2, Accession NM_016353) is another VGAM1357 host target gene. ZDHHC2 BINDING SITE is HOST TARGET binding site found in the 3' untranslated region of mRNA encoded by ZDHHC2, corresponding to a HOST TARGET binding site such as BINDING SITE I, BINDING SITE II or BINDING SITE III. Table 2 illustrates the complementarity of the nucleotide sequences of ZDHHC2 BINDING SITE, designated SEQ ID:18491, to the nucleotide sequence of VGAM1357 RNA, herein designated VGAM RNA, also designated SEQ ID:4068.

Another function of VGAM1357 is therefore inhibition of Zinc Finger, DHHC Domain Containing 2 (ZDHHC2, Accession NM_016353). Accordingly, utilities of VGAM1357 include diagnosis, prevention and treatment of diseases and clinical conditions associated with ZDHHC2. LOC128338 (Accession XM_059238) is another VGAM1357 host target gene. LOC128338 BINDING SITE is HOST TARGET binding site found in the 3' untranslated region of mRNA encoded by LOC128338, corresponding to a HOST TARGET binding site such as BINDING SITE I, BINDING SITE II or BINDING SITE III. Table 2 illustrates the complementarity of the nucleotide sequences of LOC128338 BINDING SITE, designated SEQ ID:36926, to the nucleotide sequence of VGAM1357 RNA, herein designated VGAM RNA, also designated SEQ ID:4068.

Another function of VGAM1357 is therefore inhibition of LOC128338 (Accession XM_059238). Accordingly, utilities of VGAM1357 include diagnosis, prevention and treatment of diseases and clinical conditions associated with LOC128338. LOC253981 (Accession XM_171064) is another VGAM1357 host target gene. LOC253981 BINDING SITE is HOST TARGET binding site found in the 3' untranslated region of mRNA encoded by LOC253981, corresponding to a HOST TARGET binding site such as BINDING SITE I, BINDING SITE II or BINDING SITE III. Table 2 illustrates the complementarity of the nucleotide sequences of LOC253981 BINDING SITE, designated SEQ ID:45869, to the nucleotide sequence of VGAM1357 RNA, herein designated VGAM RNA, also designated SEQ ID:4068.

Another function of VGAM1357 is therefore inhibition of LOC253981 (Accession XM_171064). Accordingly, utilities of VGAM1357 include diagnosis, prevention and treatment of diseases and clinical conditions associated with LOC253981. FIG. 1 further provides a conceptual description of a novel bioinformatically detected viral gene of the present invention, referred to here as Viral Genomic Address Messenger 1358 (VGAM1358) viral gene, which modulates expression of respective host target genes thereof, the function and utility of which host target genes is known in the art.

VGAM1358 is a novel bioinformatically detected regulatory, non protein coding, viral micro RNA (miRNA) gene. The method by which VGAM1358 was detected is described hereinabove with reference to FIGS. 1-8.

VGAM1358 gene, herein designated VGAM GENE, is a viral gene contained in the genome of Triatoma Virus. VGAM1358 host target gene, herein designated VGAM HOST TARGET GENE, is a human gene contained in the human genome.

VGAM1358 gene encodes a VGAM1358 precursor RNA, herein designated VGAM PRECURSOR RNA. Similar to other miRNA genes, and unlike most ordinary genes, VGAM1358 precursor RNA does not encode a protein. A nucleotide sequence identical or highly similar to the nucleotide sequence of VGAM1358 precursor RNA is designated SEQ ID:1344, and is provided hereinbelow with reference to the sequence listing part. Nucleotide sequence SEQ ID:1344 is located at position 8558 relative to the genome of Triatoma Virus.

VGAM1358 precursor RNA folds onto itself, forming VGAM1358 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1358 folded precursor RNA into VGAM1358 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1358 RNA is designated SEQ ID:4069, and is provided hereinbelow with reference to the sequence listing part.

VGAM1358 host target gene, herein designated VGAM HOST TARGET GENE, encodes a corresponding messenger RNA, VGAM1358 host target RNA, herein designated VGAM HOST TARGET RNA. VGAM1358 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1358 RNA, herein designated VGAM RNA, binds complementarily to one or more host target binding sites located in untranslated regions of VGAM1358 host target RNA, herein designated VGAM HOST TARGET RNA. This complementary binding is due to the fact that the nucleotide sequence of VGAM1358 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1358 RNA, herein designated VGAM RNA, may have a different number of host target binding sites in untranslated regions of a VGAM1358 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1358 RNA, herein designated VGAM RNA, to host target binding sites on VGAM1358 host target RNA, herein designated VGAM HOST TARGET RNA, such as BINDING SITE I, BINDING SITE II and BINDING SITE III, inhibits translation of VGAM1358 host target RNA into VGAM1358 host target protein, herein designated VGAM HOST TARGET PROTEIN. VGAM host target protein is therefore outlined by a broken line.

It is appreciated that VGAM1358 host target gene, herein designated VGAM HOST TARGET GENE, in fact represents a plurality of VGAM1358 host target genes. The mRNA of each one of this plurality of VGAM1358 host target genes comprises one or more host target binding sites, each having a nucleotide sequence which is at least partly complementary to VGAM1358 RNA, herein designated VGAM RNA, and which when bound by VGAM1358 RNA causes inhibition of translation of respective one or more VGAM1358 host target proteins.

It is further appreciated by one skilled in the art that the mode of translational inhibition illustrated by FIG. 1 with specific reference to translational inhibition exerted by VGAM1358 gene, herein designated VGAM GENE, on one or more VGAM1358 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1358 is inhibition of expression of host target genes, as part of a novel viral mechanism of attacking a host. Accordingly, utilities of VGAM1358 include diagnosis, prevention and treatment of viral infection by Triatoma Virus. Specific functions, and accordingly utilities, of VGAM1358 correlate with, and may be deduced from, the identity of the host target genes which VGAM1358 binds and inhibits, and the function of these target genes, as elaborated hereinbelow.

Nucleotide sequences of the VGAM1358 precursor RNA, herein designated VGAM PRECURSOR RNA, and of the 'diced' VGAM1358 RNA, herein designated VGAM RNA, and a schematic representation of the secondary folding of VGAM1358 folded precursor RNA, herein designated VGAM FOLDED PRECURSOR RNA, of VGAM1358 are further described hereinbelow with reference to Table 1.

Nucleotide sequences of host target binding sites, such as BINDING SITE-I, BINDING SITE-II and BINDING SITE-III of FIG. 1, found on VGAM1358 host target RNA, and schematic representation of the complementarity of each of these host target binding sites to VGAM1358 RNA, herein designated VGAM RNA, are described hereinbelow with reference to Table 2.

As mentioned hereinabove with reference to FIG. 1, a function of VGAM1358 gene, herein designated VGAM is inhibition of expression of VGAM1358 target genes. It is appreciated that specific functions, and accordingly utilities, of VGAM1358 correlate with, and may be deduced from, the identity of the target genes which VGAM1358 binds and inhibits, and the function of these target genes, as elaborated hereinbelow.

Dishevelled, Dsh Homolog 3 (Drosophila) (DVL3, Accession NM_004423) is a VGAM1358 host target gene. DVL3 BINDING SITE is HOST TARGET binding site found in the 3' untranslated region of mRNA encoded by DVL3, corresponding to a HOST TARGET binding site such as BINDING SITE I, BINDING SITE II or BINDING SITE III. Table 2 illustrates the complementarity of the nucleotide sequences of DVL3 BINDING SITE, designated SEQ ID:10688, to the nucleotide sequence of VGAM1358 RNA, herein designated VGAM RNA, also designated SEQ ID:4069.

A function of VGAM1358 is therefore inhibition of Dishevelled, Dsh Homolog 3 (Drosophila) (DVL3, Accession NM_004423), a gene which regulates cell proliferation. Accordingly, utilities of VGAM1358 include diagnosis, prevention and treatment of diseases and clinical conditions associated with DVL3. The function of DVL3 and its association with various diseases and clinical conditions, has been established by previous studies, as described hereinabove with reference to VGAM57. FLJ10244 (Accession NM_018037) is another VGAM1358 host target gene. FLJ10244 BINDING SITE is HOST TARGET binding site found in the 3' untranslated region of mRNA encoded by FLJ10244, corresponding to a HOST TARGET binding site such as BINDING SITE I, BINDING SITE II or BINDING SITE III. Table 2 illustrates the complementarity of the nucleotide sequences of FLJ10244 BINDING SITE, designated SEQ ID:19778, to the nucleotide sequence of VGAM1358 RNA, herein designated VGAM RNA, also designated SEQ ID:4069.

Another function of VGAM1358 is therefore inhibition of FLJ10244 (Accession NM_018037). Accordingly, utilities of VGAM1358 include diagnosis, prevention and treatment of diseases and clinical conditions associated with FLJ10244. FIG. 1 further provides a conceptual description of a novel bioinformatically detected viral gene of the present invention, referred to here as Viral Genomic Address Messenger 1359 (VGAM1359) viral gene, which modulates expression of respective host target genes thereof, the function and utility of which host target genes is known in the art.

VGAM1359 is a novel bioinformatically detected regulatory, non protein coding, viral micro RNA (miRNA) gene. The method by which VGAM1359 was detected is described hereinabove with reference to FIGS. 1-8.

VGAM1359 gene, herein designated VGAM GENE, is a viral gene contained in the genome of Triatoma Virus. VGAM1359 host target gene, herein designated VGAM HOST TARGET GENE, is a human gene contained in the human genome.

VGAM1359 gene encodes a VGAM1359 precursor RNA, herein designated VGAM PRECURSOR RNA. Similar to other miRNA genes, and unlike most ordinary genes, VGAM1359 precursor RNA does not encode a protein. A nucleotide sequence identical or highly similar to the nucleotide sequence of VGAM1359 precursor RNA is designated SEQ ID:1345, and is provided hereinbelow with reference to the sequence listing part. Nucleotide sequence SEQ ID:1345 is located at position 2393 relative to the genome of Triatoma Virus.

VGAM1359 precursor RNA folds onto itself, forming VGAM1359 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1359 folded precursor RNA into VGAM1359 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM1359 RNA is designated SEQ ID:4070, and is provided hereinbelow with reference to the sequence listing part.

VGAM1359 host target gene, herein designated VGAM HOST TARGET GENE, encodes a corresponding messenger RNA, VGAM1359 host target RNA, herein designated VGAM HOST TARGET RNA. VGAM1359 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1359 RNA, herein designated VGAM RNA, binds complementarily to one or more host target binding sites located in untranslated regions of VGAM1359 host target RNA, herein designated VGAM HOST TARGET RNA. This complementary binding is due to the fact that the nucleotide sequence of VGAM1359 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1359 RNA, herein designated VGAM RNA, may have a different number of host target binding sites in untranslated regions of a VGAM1359 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1359 RNA, herein designated VGAM RNA, to host target binding sites on VGAM1359 host target RNA, herein designated VGAM HOST TARGET RNA, such as BINDING SITE I, BINDING SITE II and BINDING SITE III, inhibits translation of VGAM1359 host target RNA into VGAM1359 host target protein, herein designated VGAM HOST TARGET PROTEIN. VGAM host target protein is therefore outlined by a broken line.

It is appreciated that VGAM1359 host target gene, herein designated VGAM HOST TARGET GENE, in fact represents a plurality of VGAM1359 host target genes. The mRNA of each one of this plurality of VGAM1359 host target genes comprises one or more host target binding sites, each having a nucleotide sequence which is at least partly complementary to VGAM1359 RNA, herein designated VGAM RNA, and which when bound by VGAM1359 RNA causes inhibition of translation of respective one or more VGAM1359 host target proteins.

It is further appreciated by one skilled in the art that the mode of translational inhibition illustrated by FIG. 1 with specific reference to translational inhibition exerted by VGAM1359 gene, herein designated VGAM GENE, on one or more VGAM1359 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1359 is inhibition of expression of host target genes, as part of a novel viral mechanism of attacking a host. Accordingly, utilities of VGAM1359 include diagnosis, prevention and treatment of viral infection by Triatoma Virus. Specific functions, and accordingly utilities, of VGAM1359 correlate with, and may be deduced from, the identity of the host target genes which VGAM1359 binds and inhibits, and the function of these host target genes, as elaborated hereinbelow.

Nucleotide sequences of the VGAM1359 precursor RNA, herein designated VGAM PRECURSOR RNA, and of the 'diced' VGAM1359 RNA, herein designated VGAM RNA, and a schematic representation of the secondary folding of VGAM1359 folded precursor RNA, herein designated VGAM FOLDED PRECURSOR RNA, of VGAM1359 are further described hereinbelow with reference to Table 1.

Nucleotide sequences of host target binding sites, such as BINDING SITE-I, BINDING SITE-II and BINDING SITE-III of FIG. 1, found on VGAM1359 host target RNA, and schematic representation of the complementarity of each of these host target binding sites to VGAM1359 RNA, herein designated VGAM RNA, are described hereinbelow with reference to Table 2.

As mentioned hereinabove with reference to FIG. 1, a function of VGAM1359 gene, herein designated VGAM is inhibition of expression of VGAM1359 target genes. It is appreciated that specific functions, and accordingly utilities, of VGAM1359 correlate with, and may be deduced from, the identity of the target genes which VGAM1359 binds and inhibits, and the function of these target genes, as elaborated hereinbelow.

Microtubule-associated Protein, RP/EB Family, Member 1 (MAPRE1, Accession NM_012325) is a VGAM1359 host target gene. MAPRE1 BINDING SITE is HOST TARGET binding site found in the 3' untranslated region of mRNA encoded by MAPRE1, corresponding to a HOST TARGET binding site such as BINDING SITE I, BINDING SITE II or BINDING SITE III. Table 2 illustrates the complementarity of the nucleotide sequences of MAPRE1 BINDING SITE, designated SEQ ID:14709, to the nucleotide sequence of VGAM1359 RNA, herein designated VGAM RNA, also designated SEQ ID:4070.

A function of VGAM1359 is therefore inhibition of Microtubule-associated Protein, RP/EB Family, Member 1 (MAPRE1, Accession NM_012325). Accordingly, utilities of VGAM1359 include diagnosis, prevention and treatment of diseases and clinical conditions associated with MAPRE1.

Mannose-binding Lectin (protein C) 2, Soluble (opsonic defect) (MBL2, Accession NM_000242) is another VGAM1359 host target gene. MBL2 BINDING SITE is HOST TARGET binding site found in the 3' untranslated region of mRNA encoded by MBL2, corresponding to a HOST TARGET binding site such as BINDING SITE I, BINDING SITE II or BINDING SITE III. Table 2 illustrates the complementarity of the nucleotide sequences of MBL2 BINDING SITE, designated SEQ ID:5765, to the nucleotide sequence of VGAM1359 RNA, herein designated VGAM RNA, also designated SEQ ID:4070.

Another function of VGAM1359 is therefore inhibition of Mannose-binding Lectin (protein C) 2, Soluble (opsonic defect) (MBL2, Accession NM_000242). Accordingly, utilities of VGAM1359 include diagnosis, prevention and treatment of diseases and clinical conditions associated with MBL2. Polycystic Kidney Disease 2 (autosomal dominant) (PKD2, Accession XM_011124) is another VGAM1359 host target gene. PKD2 BINDING SITE is HOST TARGET binding site found in the 3' untranslated region of mRNA encoded by PKD2, corresponding to a HOST TARGET binding site such as BINDING SITE I, BINDING SITE II or BINDING SITE III. Table 2 illustrates the complementarity of the nucleotide sequences of PKD2 BINDING SITE, designated SEQ ID:30178, to the nucleotide sequence of VGAM1359 RNA, herein designated VGAM RNA, also designated SEQ ID:4070.

Another function of VGAM1359 is therefore inhibition of Polycystic Kidney Disease 2 (autosomal dominant) (PKD2, Accession XM_011124). Accordingly, utilities of VGAM1359 include diagnosis, prevention and treatment of diseases and clinical conditions associated with PKD2. DEAD/H (Asp-Glu-Ala-Asp/His) Box Polypeptide 33 (DDX33, Accession NM_020162) is another VGAM1359 host target gene. DDX33 BINDING SITE is HOST TARGET binding site found in the 3' untranslated region of mRNA encoded by DDX33, corresponding to a HOST TARGET binding site such as BINDING SITE I, BINDING SITE II or BINDING SITE III. Table 2 illustrates the complementarity of the nucleotide sequences of DDX33 BINDING SITE, designated SEQ ID:21377, to the nucleotide sequence of VGAM1359 RNA, herein designated VGAM RNA, also designated SEQ ID:4070.

Another function of VGAM1359 is therefore inhibition of DEAD/H (Asp-Glu-Ala-Asp/His) Box Polypeptide 33 (DDX33, Accession NM_020162). Accordingly, utilities of VGAM1359 include diagnosis, prevention and treatment of diseases and clinical conditions associated with DDX33. FLJ13491 (Accession NM_024623) is another VGAM1359 host target gene. FLJ13491 BINDING SITE is HOST TARGET binding site found in the 3' untranslated region of mRNA encoded by FLJ13491, corresponding to a HOST TARGET binding site such as BINDING SITE I, BINDING SITE II or BINDING SITE III. Table 2 illustrates the complementarity of the nucleotide sequences of FLJ13491 BINDING SITE, designated SEQ ID:23889, to the nucleotide sequence of VGAM1359 RNA, herein designated VGAM RNA, also designated SEQ ID:4070.

Another function of VGAM1359 is therefore inhibition of FLJ13491 (Accession NM_024623). Accordingly, utilities of VGAM1359 include diagnosis, prevention and treatment of diseases and clinical conditions associated with FLJ13491. KIAA1915 (Accession XM_055481) is another VGAM1359 host target gene. KIAA1915 BINDING SITE is HOST TARGET binding site found in the 5' untranslated region of mRNA encoded by KIAA1915, corresponding to a HOST TARGET binding site such as BINDING SITE I, BINDING SITE II or BINDING SITE III. Table 2 illustrates the complementarity of the nucleotide sequences of KIAA1915 BINDING SITE, designated SEQ ID:36271, to the nucleotide sequence of VGAM1359 RNA, herein designated VGAM RNA, also designated SEQ ID:4070.

Another function of VGAM1359 is therefore inhibition of KIAA1915 (Accession XM_055481). Accordingly, utilities of VGAM1359 include diagnosis, prevention and treatment of diseases and clinical conditions associated with KIAA1915. NXP-2 (Accession XM_048706) is another VGAM1359 host target gene. NXP-2 BINDING SITE is HOST TARGET binding site found in the 3' untranslated region of mRNA encoded by NXP-2, corresponding to a HOST TARGET binding site such as BINDING SITE I, BINDING SITE II or BINDING SITE III. Table 2 illustrates the complementarity of the nucleotide sequences of NXP-2 BINDING SITE, designated SEQ ID:35231, to the nucleotide sequence of VGAM1359 RNA, herein designated VGAM RNA, also designated SEQ ID:4070.

Another function of VGAM1359 is therefore inhibition of NXP-2 (Accession XM_048706). Accordingly, utilities of VGAM1359 include diagnosis, prevention and treatment of diseases and clinical conditions associated with NXP-2. Zinc Finger Protein 33a (KOX 31) (ZNF33A, Accession XM_166119) is another VGAM1359 host target gene. ZNF33A BINDING SITE is HOST TARGET binding site found in the 3' untranslated region of mRNA encoded by ZNF33A, corresponding to a HOST TARGET binding site such as BINDING SITE I, BINDING SITE II or BINDING SITE III. Table 2 illustrates the complementarity of the nucleotide sequences of ZNF33A BINDING SITE, designated SEQ ID:43902, to the nucleotide sequence of VGAM1359 RNA, herein designated VGAM RNA, also designated SEQ ID:4070.

Another function of VGAM1359 is therefore inhibition of Zinc Finger Protein 33a (KOX 31) (ZNF33A, Accession XM_166119). Accordingly, utilities of VGAM1359 include diagnosis, prevention and treatment of diseases and clinical conditions associated with ZNF33A. LOC157226 (Accession XM_033876) is another VGAM1359 host target gene. LOC157226 BINDING SITE is HOST TARGET binding site found in the 5' untranslated region of mRNA encoded by LOC157226, corresponding to a HOST TARGET binding site such as BINDING SITE I, BINDING SITE II or BINDING SITE III. Table 2 illustrates the complementarity of the nucleotide sequences of LOC157226 BINDING SITE, designated SEQ ID:31977, to the nucleotide sequence of VGAM1359 RNA, herein designated VGAM RNA, also designated SEQ ID:4070.

Another function of VGAM1359 is therefore inhibition of LOC157226 (Accession XM_033876). Accordingly, utilities of VGAM1359 include diagnosis, prevention and treatment of diseases and clinical conditions associated with LOC157226. FIG. 1 further provides a conceptual description of a novel bioinformatically detected viral gene of the present invention, referred to here as Viral Genomic Address Messenger 1360 (VGAM1360) viral gene, which modulates expression of respective host target genes thereof, the function and utility of which host target genes is known in the art.

VGAM1360 is a novel bioinformatically detected regulatory, non protein coding, viral micro RNA (miRNA) gene. The method by which VGAM1360 was detected is described hereinabove with reference to FIGS. 1-8.

VGAM1360 gene, herein designated VGAM GENE, is a viral gene contained in the genome of Triatoma Virus. VGAM1360 host target gene, herein designated VGAM HOST TARGET GENE, is a human gene contained in the human genome.

VGAM1360 gene encodes a VGAM1360 precursor RNA, herein designated VGAM PRECURSOR RNA. Similar to other miRNA genes, and unlike most ordinary genes, VGAM1360 precursor RNA does not encode a protein. A nucleotide sequence identical or highly similar to the nucleotide sequence of VGAM1360 precursor RNA is designated SEQ ID:1346, and is provided hereinbelow with reference to the sequence listing part. Nucleotide sequence SEQ ID:1346 is located at position 6392 relative to the genome of Triatoma Virus.

VGAM1360 precursor RNA folds onto itself, forming VGAM1360 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1360 folded precursor RNA into VGAM1360 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1360 RNA is designated SEQ ID:4071, and is provided hereinbelow with reference to the sequence listing part.

VGAM1360 host target gene, herein designated VGAM HOST TARGET GENE, encodes a corresponding messenger RNA, VGAM1360 host target RNA, herein designated VGAM HOST TARGET RNA. VGAM1360 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1360 RNA, herein designated VGAM RNA, binds complementarily to one or more host target binding sites located in untranslated regions of VGAM1360 host target RNA, herein designated VGAM HOST TARGET RNA. This complementary binding is due to the fact that the nucleotide sequence of VGAM1360 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1360 RNA, herein designated VGAM RNA, may have a different number of host target binding sites in untranslated regions of a VGAM1360 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1360 RNA, herein designated VGAM RNA, to host target binding sites on VGAM1360 host target RNA, herein designated VGAM HOST TARGET RNA, such as BINDING SITE I, BINDING SITE II and BINDING SITE III, inhibits translation of VGAM1360 host target RNA into VGAM1360 host target protein, herein designated VGAM HOST TARGET PROTEIN. VGAM host target protein is therefore outlined by a broken line.

It is appreciated that VGAM1360 host target gene, herein designated VGAM HOST TARGET GENE, in fact represents a plurality of VGAM1360 host target genes. The mRNA of each one of this plurality of VGAM1360 host target genes comprises one or more host target binding sites, each having a nucleotide sequence which is at least partly complementary to VGAM1360 RNA, herein designated VGAM RNA, and which when bound by VGAM1360 RNA causes inhibition of translation of respective one or more VGAM1360 host target proteins.

It is further appreciated by one skilled in the art that the mode of translational inhibition illustrated by FIG. 1 with specific reference to translational inhibition exerted by VGAM1360 gene, herein designated VGAM GENE, on one or more VGAM1360 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1360 is inhibition of expression of host target genes, as part of a novel viral mechanism of attacking a host. Accordingly, utilities of VGAM1360 include diagnosis, prevention and treatment of viral infection by Triatoma Virus. Specific functions, and accordingly utilities, of VGAM1360 correlate with, and may be deduced from, the identity of the host target genes which VGAM1360 binds and inhibits, and the function of these host target genes, as elaborated hereinbelow.

Nucleotide sequences of the VGAM1360 precursor RNA, herein designated VGAM PRECURSOR RNA, and of the 'diced' VGAM1360 RNA, herein designated VGAM RNA, and a schematic representation of the secondary folding of VGAM1360 folded precursor RNA, herein designated VGAM FOLDED PRECURSOR RNA, of VGAM1360 are further described hereinbelow with reference to Table 1.

Nucleotide sequences of host target binding sites, such as BINDING SITE-I, BINDING SITE-II and BINDING SITE-III of FIG. 1, found on VGAM1360 host target RNA, and schematic representation of the complementarity of each of these host target binding sites to VGAM1360 RNA, herein designated VGAM RNA, are described hereinbelow with reference to Table 2.

As mentioned hereinabove with reference to FIG. 1, a function of VGAM1360 gene, herein designated VGAM is inhibition of expression of VGAM1360 target genes. It is appreciated that specific functions, and accordingly utilities, of VGAM1360 correlate with, and may be deduced from, the identity of the target genes which VGAM1360 binds and inhibits, and the function of these target genes, as elaborated hereinbelow.

PART1 (Accession NM_016590) is a VGAM1360 host target gene. PART1 BINDING SITE is HOST TARGET binding site found in the 3' untranslated region of mRNA encoded by PART1, corresponding to a HOST TARGET binding site such as BINDING SITE I, BINDING SITE II or BINDING SITE III. Table 2 illustrates the complementarity of the nucleotide sequences of PART1 BINDING SITE, designated SEQ ID:18665, to the nucleotide sequence of VGAM1360 RNA, herein designated VGAM RNA, also designated SEQ ID:4071.

A function of VGAM1360 is therefore inhibition of PART1 (Accession NM_016590). Accordingly, utilities of VGAM1360 include diagnosis, prevention and treatment of diseases and clinical conditions associated with PART1. Glutamate Receptor, Ionotropic, N-methyl-D-aspartate 3A (GRIN3A, Accession NM_133445) is another VGAM1360 host target gene. GRIN3A BINDING SITE is HOST TARGET binding site found in the 3' untranslated region of mRNA encoded by GRIN3A, corresponding to a HOST TARGET binding site such as BINDING SITE I, BINDING SITE II or BINDING SITE III. Table 2 illustrates the complementarity of the nucleotide sequences of GRIN3A BINDING SITE, designated SEQ ID:28537, to the nucleotide sequence of VGAM1360 RNA, herein designated VGAM RNA, also designated SEQ ID:4071.

Another function of VGAM1360 is therefore inhibition of Glutamate Receptor, Ionotropic, N-methyl-D-aspartate 3A (GRIN3A, Accession NM_133445). Accordingly, utilities of VGAM1360 include diagnosis, prevention and treatment of diseases and clinical conditions associated with GRIN3A. KIAA0218 (Accession NM_014760) is another VGAM1360 host target gene. KIAA0218 BINDING SITE is HOST TARGET binding site found in the 3" untranslated region of mRNA encoded by KIAA0218, corresponding to a HOST TARGET binding site such as BINDING SITE I, BINDING SITE II or BINDING SITE III. Table 2 illustrates the complementarity of the nucleotide sequences of KIAA0218 BINDING SITE, designated SEQ ID:16518, to the nucleotide sequence of VGAM1360 RNA, herein designated VGAM RNA, also designated SEQ ID:4071.

Another function of VGAM1360 is therefore inhibition of KIAA0218 (Accession NM_014760). Accordingly, utilities of VGAM1360 include diagnosis, prevention and treatment of diseases and clinical conditions associated with KIAA0218. FIG. 1 further provides a conceptual description of a novel bioinformatically detected viral gene of the present invention, referred to here as Viral Genomic Address Messenger 1361 (VGAM1361) viral gene, which modulates expression of respective host target genes thereof, the function and utility of which host target genes is known in the art.

VGAM1361 is a novel bioinformatically detected regulatory, non protein coding, viral micro RNA (miRNA) gene. The method by which VGAM1361 was detected is described hereinabove with reference to FIGS. 1-8.

VGAM1361 gene, herein designated VGAM GENE, is a viral gene contained in the genome of Triatoma Virus. VGAM1361 host target gene, herein designated VGAM HOST TARGET GENE, is a human gene contained in the human genome.

VGAM1361 gene encodes a VGAM1361 precursor RNA, herein designated VGAM PRECURSOR RNA. Similar to other miRNA genes, and unlike most ordinary genes, VGAM1361 precursor RNA does not encode a protein. A nucleotide sequence identical or highly similar to the nucleotide sequence of VGAM1361 precursor RNA is designated SEQ ID:1347, and is provided hereinbelow with reference to the sequence listing part. Nucleotide sequence SEQ ID:1347 is located at position 5836 relative to the genome of Triatoma Virus.

VGAM1361 precursor RNA folds onto itself, forming VGAM1361 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1361 folded precursor RNA into VGAM1361 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1361 RNA is designated SEQ ID:4072, and is provided hereinbelow with reference to the sequence listing part.

VGAM1361 host target gene, herein designated VGAM HOST TARGET GENE, encodes a corresponding messenger RNA, VGAM1361 host target RNA, herein designated VGAM HOST TARGET RNA. VGAM1361 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1361 RNA, herein designated VGAM RNA, binds complementarily to one or more host target binding sites located in untranslated regions of VGAM1361 host target RNA, herein designated VGAM HOST TARGET RNA. This complementary binding is due to the fact that the nucleotide sequence of VGAM1361 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1361 RNA, herein designated VGAM RNA, may have a different number of host target binding sites in untranslated regions of a VGAM1361 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1361 RNA, herein designated VGAM RNA, to host target binding sites on VGAM1361 host target RNA, herein designated VGAM HOST TARGET RNA, such as BINDING SITE I, BINDING SITE II and BINDING SITE III, inhibits translation of VGAM1361 host target RNA into VGAM1361 host target protein, herein designated VGAM HOST TARGET PROTEIN. VGAM host target protein is therefore outlined by a broken line.

It is appreciated that VGAM1361 host target gene, herein designated VGAM HOST TARGET GENE, in fact represents a plurality of VGAM1361 host target genes. The mRNA of each one of this plurality of VGAM1361 host target genes comprises one or more host target binding sites, each having a nucleotide sequence which is at least partly complementary to VGAM1361 RNA, herein designated VGAM RNA, and which when bound by VGAM1361 RNA causes inhibition of translation of respective one or more VGAM1361 host target proteins.

It is further appreciated by one skilled in the art that the mode of translational inhibition illustrated by FIG. 1 with specific reference to translational inhibition exerted by VGAM1361 gene, herein designated VGAM GENE, on one or more VGAM1361 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1361 is inhibition of expression of host target genes, as part of a novel viral mechanism of attacking a host. Accordingly, utilities of VGAM1361 include diagnosis, prevention and treatment of viral infection by Triatoma Virus. Specific functions, and accordingly utilities, of VGAM1361 correlate with, and may be deduced from, the identity of the host target genes which VGAM1361 binds and inhibits, and the function of these host target genes, as elaborated hereinbelow.

Nucleotide sequences of the VGAM1361 precursor RNA, herein designated VGAM PRECURSOR RNA, and of the 'diced' VGAM1361 RNA, herein designated VGAM RNA, and a schematic representation of the secondary folding of VGAM1361 folded precursor RNA, herein designated VGAM FOLDED PRECURSOR RNA, of VGAM1361 are further described hereinbelow with reference to Table 1.

Nucleotide sequences of host target binding sites, such as BINDING SITE-I, BINDING SITE-II and BINDING SITE-III of FIG. 1, found on VGAM1361 host target RNA, and schematic representation of the complementarity of each of these host target binding sites to VGAM1361 RNA, herein designated VGAM RNA, are described hereinbelow with reference to Table 2.

As mentioned hereinabove with reference to FIG. 1, a function of VGAM1361 gene, herein designated VGAM is inhibition of expression of VGAM1361 target genes. It is appreciated that specific functions, and accordingly utilities, of VGAM1361 correlate with, and may be deduced from, the identity of the target genes which VGAM1361 binds and inhibits, and the function of these target genes, as elaborated hereinbelow.

BUB3 Budding Uninhibited By Benzimidazoles 3 Homolog (yeast) (BUB3, Accession NM_004725) is a VGAM1361 host target gene. BUB3 BINDING SITE is HOST TARGET binding site found in the 3' untranslated region of mRNA encoded by BUB3, corresponding to a HOST TARGET binding site such as BINDING SITE I, BINDING SITE II or BINDING SITE III. Table 2 illustrates the complementarity of the nucleotide sequences of BUB3 BINDING SITE, designated SEQ ID:11096, to the nucleotide sequence of VGAM1361 RNA, herein designated VGAM RNA, also designated SEQ ID:4072.

A function of VGAM1361 is therefore inhibition of BUB3 Budding Uninhibited By Benzimidazoles 3 Homolog (yeast) (BUB3, Accession NM_004725), a gene which has a role in the mitotic spindle checkpoint. Accordingly, utilities of VGAM1361 include diagnosis, prevention and treatment of diseases and clinical conditions associated with BUB3. The function of BUB3 has been established by previous studies. A feedback control mechanism, or cell cycle checkpoint, delays the onset of anaphase until all the chromosomes are correctly aligned on the mitotic spindle. Mutations in the S. cerevisiae BUB and MAD genes abolish this checkpoint, such that mutant cells fail to undergo mitotic arrest in response to spindle damage. The yeast BUB1 (see OMIM Ref. No. 602452) gene encodes a protein kinase that can bind and phosphorylate BUB3. Mammalian BUB1 localizes to the kinetochore of unaligned chromosomes. To further characterize the role of BUB1 in mitosis, Taylor et al. (1998) searched an EST database to identify the human homolog of BUB3. They identified a partial human BUB3 cDNA and used a PCR strategy to isolate a full-length cDNA. The predicted 328-amino acid human protein shares approximately 34% identity with yeast BUB3. Both proteins contain 4 WD repeats. When expressed in mammalian cells, a chimeric GFP-BUB3 protein localized to kinetochores before chromosome alignment. Using deletion analysis, the authors identified a domain of BUB1 that is required both for binding BUB3 and for kinetochore localization of BUB1. Taylor et al. (1998) reported that a similar domain in BUBR1 (OMIM Ref. No. 602860) mediates binding to BUB3. They suggested that the BUB and MAD proteins may be part of a large protein complex that is recruited to unattached kinetochores and that dissociates from kinetochores upon achieving correct bipolar attachment. Animal model experiments lend further support to the function of BUB3. By gene-targeting techniques, Kalitsis et al. (2000) disrupted the Bub3 gene in mice, which resulted in embryonic lethality prior to day 8.5 postcoitum (pc) in homozygous mutants. Mutant embryos appeared normal at day 3.5 pc but rapidly degenerated. An observed accumulation of mitotic errors suggested that Bub3 is essential for normal mitosis and for early embryonic development in the mouse.

It is appreciated that the abovementioned animal model for BUB3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kalitsis, P.; Earle, E.; Fowler, K. J.; Choo, K. H. A.: Bub3 gene disruption in mice reveals essential mitotic spindle checkpoint function during early embryogenesis. Genes Dev. 14:2277-2282, 2000; and Taylor, S. S.; Ha, E.; McKeon, F.: The human homologue of Bub3 is required for kinetochore localization of Bub1 and a Mad3/Bub1-related protein kinase. J. Cell Biol. 142:1-11, 1998.

Further studies establishing the function and utilities of BUB3 are found in John Hopkins OMIM database record ID 603719, and in sited publications numbered 275 and 5362 listed in the bibliography section hereinbelow, which are also hereby incorporated by reference. Nuclear RNA Export Factor 2 (NXF2, Accession NM_017809) is another VGAM1361 host target gene. NXF2 BINDING SITE is HOST TARGET binding site found in the 5' untranslated region of mRNA encoded by NXF2, corresponding to a HOST TARGET binding site such as BINDING SITE I, BINDING SITE II or BINDING SITE III. Table 2 illustrates the complementarity of the nucleotide sequences of NXF2 BINDING SITE, designated SEQ ID:19457, to the nucleotide sequence of VGAM1361 RNA, herein designated VGAM RNA, also designated SEQ ID:4072.

Another function of VGAM1361 is therefore inhibition of Nuclear RNA Export Factor 2 (NXF2, Accession NM_017809), a gene which is involved in the export of mrna from the nucleus to the cytoplasm. Accordingly, utilities of VGAM1361 include diagnosis, prevention and treatment of diseases and clinical conditions associated with NXF2. The function of NXF2 and its association with various diseases and clinical conditions, has been established by previous studies, as described hereinabove with reference to VGAM595. Ribosomal Protein S6 Kinase, 90 kDa, Polypeptide 5 (RPS6KA5, Accession NM_004755) is another VGAM1361 host target gene. RPS6KA5 BINDING SITE is HOST TARGET binding site found in the 3' untranslated region of mRNA encoded by RPS6KA5, corresponding to a HOST TARGET binding site such as BINDING SITE I, BINDING SITE II or BINDING SITE III. Table 2 illustrates the complementarity of the nucleotide sequences of RPS6KA5 BINDING SITE, designated SEQ ID:11141, to the nucleotide sequence of VGAM1361 RNA, herein designated VGAM RNA, also designated SEQ ID:4072.

Another function of VGAM1361 is therefore inhibition of Ribosomal Protein S6 Kinase, 90 kDa, Polypeptide 5 (RPS6KA5, Accession NM_004755), a gene which plays an essential role in the proliferation of yeast cells. Accordingly, utilities of VGAM1361 include diagnosis, prevention and treatment of diseases and clinical conditions associated with RPS6KA5. The function of RPS6KA5 and its association with various diseases and clinical conditions, has been established by previous studies, as described hereinabove with reference to VGAM191. Zinc Finger Protein 2 (A1-5) (ZNF2, Accession NM_021088) is another VGAM1361 host target gene. ZNF2 BINDING SITE is HOST TARGET binding site found in the 3' untranslated region of mRNA encoded by ZNF2, corresponding to a HOST TARGET binding site such as BINDING SITE I, BINDING SITE II or BINDING SITE III. Table 2 illustrates the complementarity of the nucleotide sequences of ZNF2 BINDING SITE, designated SEQ ID:22066, to the nucleotide sequence of VGAM1361 RNA, herein designated VGAM RNA, also designated SEQ ID:4072.

Another function of VGAM1361 is therefore inhibition of Zinc Finger Protein 2 (A1-5) (ZNF2, Accession NM_021088). Accordingly, utilities of VGAM1361 include diagnosis, prevention and treatment of diseases and clinical conditions associated with ZNF2. FLJ11004 (Accession NM_018296) is another VGAM1361 host target gene. FLJ11004 BINDING SITE is HOST TARGET binding site found in the 5' untranslated region of mRNA encoded by FLJ11004, corresponding to a HOST TARGET binding site such as BINDING SITE I, BINDING SITE II or BINDING SITE III. Table 2 illustrates the complementarity of the nucleotide sequences of FLJ11004 BINDING SITE, designated SEQ ID:20287, to the nucleotide sequence of VGAM1361 RNA, herein designated VGAM RNA, also designated SEQ ID:4072.

Another function of VGAM1361 is therefore inhibition of FLJ11004 (Accession NM_018296). Accordingly, utilities of VGAM1361 include diagnosis, prevention and treatment of diseases and clinical conditions associated with FLJ11004. MOST2 (Accession NM_020250) is another VGAM1361 host target gene. MOST2 BINDING SITE is HOST TARGET binding site found in the 3' untranslated region of mRNA encoded by MOST2, corresponding to a HOST TARGET binding site such as BINDING SITE I, BINDING SITE II or BINDING SITE III. Table 2 illustrates the complementarity of the nucleotide sequences of MOST2 BINDING SITE, designated SEQ ID:21555, to the nucleotide sequence of VGAM1361 RNA, herein designated VGAM RNA, also designated SEQ ID:4072.

Another function of VGAM1361 is therefore inhibition of MOST2 (Accession NM_020250). Accordingly, utilities of VGAM1361 include diagnosis, prevention and treatment of diseases and clinical conditions associated with MOST2. Ras Protein-specific Guanine Nucleotide-releasing Factor 2 (RASGRF2, Accession XM_027943) is another VGAM1361 host target gene. RASGRF2 BINDING SITE is HOST TARGET binding site found in the 3' untranslated region of mRNA encoded by RASGRF2, corresponding to a HOST TARGET binding site such as BINDING SITE I, BINDING SITE II or BINDING SITE III. Table 2 illustrates the complementarity of the nucleotide sequences of RASGRF2 BINDING SITE, designated SEQ ID:30596, to the nucleotide sequence of VGAM1361 RNA, herein designated VGAM RNA, also designated SEQ ID:4072.

Another function of VGAM1361 is therefore inhibition of Ras Protein-specific Guanine Nucleotide-releasing Factor 2 (RASGRF2, Accession XM_027943). Accordingly, utilities of VGAM1361 include diagnosis, prevention and treatment of diseases and clinical conditions associated with RASGRF2. LOC219688 (Accession XM_167568) is another VGAM1361 host target gene. LOC219688 BINDING SITE is HOST TARGET binding site found in the 5' untranslated region of mRNA encoded by LOC219688, corresponding to a HOST TARGET binding site such as BINDING SITE I, BINDING SITE II or BINDING SITE III. Table 2 illustrates the complementarity of the nucleotide sequences of LOC219688 BINDING SITE, designated SEQ ID:44696, to the nucleotide sequence of VGAM1361 RNA, herein designated VGAM RNA, also designated SEQ ID:4072.

Another function of VGAM1361 is therefore inhibition of LOC219688 (Accession XM_167568). Accordingly, utilities of VGAM1361 include diagnosis, prevention and treatment of diseases and clinical conditions associated with LOC219688. LOC221663 (Accession XM_168131) is another VGAM1361 host target gene. LOC221663 BINDING SITE is HOST TARGET binding site found in the 5' untranslated region of mRNA encoded by LOC221663, corresponding to a HOST TARGET binding site such as BINDING SITE I, BINDING SITE II or BINDING SITE III. Table 2 illustrates the complementarity of the nucleotide sequences of LOC221663 BINDING SITE, designated SEQ ID:45037, to the nucleotide sequence of VGAM1361 RNA, herein designated VGAM RNA, also designated SEQ ID:4072.

Another function of VGAM1361 is therefore inhibition of LOC221663 (Accession XM_168131). Accordingly, utilities of VGAM1361 include diagnosis, prevention and treatment of diseases and clinical conditions associated with LOC221663. LOC51336 (Accession NM_016646) is another VGAM1361 host target gene. LOC51336 BINDING SITE is HOST TARGET binding site found in the 5' untranslated region of mRNA encoded by LOC51336, corresponding to a HOST TARGET binding site such as BINDING SITE I, BINDING SITE II or BINDING SITE III. Table 2 illustrates the complementarity of the nucleotide sequences of LOC51336 BINDING SITE, designated SEQ ID:18752, to the nucleotide sequence of VGAM1361 RNA, herein designated VGAM RNA, also designated SEQ ID:4072.

Another function of VGAM1361 is therefore inhibition of LOC51336 (Accession NM_016646). Accordingly, utilities of VGAM1361 include diagnosis, prevention and treatment of diseases and clinical conditions associated with LOC51336. LOC90670 (Accession XM_033352) is another VGAM1361 host target gene. LOC90670 BINDING SITE is HOST TARGET binding site found in the 3' untranslated region of mRNA encoded by LOC90670, corresponding to a HOST TARGET binding site such as BINDING SITE I, BINDING SITE II or BINDING SITE III. Table 2 illustrates the complementarity of the nucleotide sequences of LOC90670 BINDING SITE, designated SEQ ID:31885, to the nucleotide sequence of VGAM1361 RNA, herein designated VGAM RNA, also designated SEQ ID:4072.

Another function of VGAM1361 is therefore inhibition of LOC90670 (Accession XM_033352). Accordingly, utilities of VGAM1361 include diagnosis, prevention and treatment of diseases and clinical conditions associated with LOC90670. FIG. 1 further provides a conceptual description of a novel bioinformatically detected viral gene of the present invention, referred to here as Viral Genomic Address Messenger 1362 (VGAM1362) viral gene, which modulates expression of respective host target genes thereof, the function and utility of which host target genes is known in the art.

VGAM1362 is a novel bioinformatically detected regulatory, non protein coding, viral micro RNA (miRNA) gene. The method by which VGAM1362 was detected is described hereinabove with reference to FIGS. 1-8.

VGAM1362 gene, herein designated VGAM GENE, is a viral gene contained in the genome of Duck Adenovirus 1. VGAM1362 host target gene, herein designated VGAM HOST TARGET GENE, is a human gene contained in the human genome.

VGAM1362 gene encodes a VGAM1362 precursor RNA, herein designated VGAM PRECURSOR RNA. Similar to other miRNA genes, and unlike most ordinary genes, VGAM1362 precursor RNA does not encode a protein. A nucleotide sequence identical or highly similar to the nucleotide sequence of VGAM1362 precursor RNA is designated SEQ ID:1348, and is provided hereinbelow with reference to the sequence listing part. Nucleotide sequence SEQ ID:1348 is located at position 12491 relative to the genome of Duck Adenovirus 1.

VGAM1362 precursor RNA folds onto itself, forming VGAM1362 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1362 folded precursor RNA into VGAM1362 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1362 RNA is designated SEQ ID:4073, and is provided hereinbelow with reference to the sequence listing part.

VGAM1362 host target gene, herein designated VGAM HOST TARGET GENE, encodes a corresponding messenger RNA, VGAM1362 host target RNA, herein designated VGAM HOST TARGET RNA. VGAM1362 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1362 RNA, herein designated VGAM RNA, binds complementarily to one or more host target binding sites located in untranslated regions of VGAM1362 host target RNA, herein designated VGAM HOST TARGET RNA. This complementary binding is due to the fact that the nucleotide sequence of VGAM1362 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1362 RNA, herein designated VGAM RNA, may have a different number of host target binding sites in untranslated regions of a VGAM1362 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1362 RNA, herein designated VGAM RNA, to host target binding sites on VGAM1362 host target RNA, herein designated VGAM HOST TARGET RNA, such as BINDING SITE I, BINDING SITE II and BINDING SITE III, inhibits translation of VGAM1362 host target RNA into VGAM1362 host target protein, herein designated VGAM HOST TARGET PROTEIN. VGAM host target protein is therefore outlined by a broken line.

It is appreciated that VGAM1362 host target gene, herein designated VGAM HOST TARGET GENE, in fact represents a plurality of VGAM1362 host target genes. The mRNA of each one of this plurality of VGAM1362 host target genes comprises one or more host target binding sites, each having a nucleotide sequence which is at least partly complementary to VGAM1362 RNA, herein designated VGAM RNA, and which when bound by VGAM1362 RNA causes inhibition of translation of respective one or more VGAM1362 host target proteins.

It is further appreciated by one skilled in the art that the mode of translational inhibition illustrated by FIG. 1 with specific reference to translational inhibition exerted by VGAM1362 gene, herein designated VGAM GENE, on one or more VGAM1362 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1362 is inhibition of expression of host target genes, as part of a novel viral mechanism of attacking a host. Accordingly, utilities of VGAM1362 include diagnosis, prevention and treatment of viral infection by Duck Adenovirus 1. Specific functions, and accordingly utilities, of VGAM1362 correlate with, and may be deduced from, the identity of the host target genes which VGAM1362 binds and inhibits, and the function of these host target genes, as elaborated hereinbelow.

Nucleotide sequences of the VGAM1362 precursor RNA, herein designated VGAM PRECURSOR RNA, and of the 'diced' VGAM1362 RNA, herein designated VGAM RNA, and a schematic representation of the secondary folding of VGAM1362 folded precursor RNA, herein designated VGAM FOLDED PRECURSOR RNA, of VGAM1362 are further described hereinbelow with reference to Table 1.

Nucleotide sequences of host target binding sites, such as BINDING SITE-I, BINDING SITE-II and BINDING SITE-III of FIG. 1, found on VGAM1362 host target RNA, and schematic representation of the complementarity of each of these host target binding sites to VGAM1362 RNA, herein designated VGAM RNA, are described hereinbelow with reference to Table 2.

As mentioned hereinabove with reference to FIG. 1, a function of VGAM1362 gene, herein designated VGAM is inhibition of expression of VGAM1362 target genes. It is appreciated that specific functions, and accordingly utilities, of VGAM1362 correlate with, and may be deduced from, the identity of the target genes which VGAM1362 binds and inhibits, and the function of these target genes, as elaborated hereinbelow.

BS69 (Accession NM_006624) is a VGAM1362 host target gene. BS69 BINDING SITE is HOST TARGET binding site found in the 3' untranslated region of mRNA encoded by BS69, corresponding to a HOST TARGET binding site such as BINDING SITE I, BINDING SITE II or BINDING SITE III. Table 2 illustrates the complementarity of the nucleotide sequences of BS69 BINDING SITE, designated SEQ ID:13406, to the nucleotide sequence of VGAM1362 RNA, herein designated VGAM RNA, also designated SEQ ID:4073.

A function of VGAM1362 is therefore inhibition of BS69 (Accession NM_006624). Accordingly, utilities of VGAM1362 include diagnosis, prevention and treatment of diseases and clinical conditions associated with BS69. FLJ23590 (Accession NM_024649) is another VGAM1362 host target gene. FLJ23590 BINDING SITE is HOST TARGET binding site found in the 3' untranslated region of mRNA encoded by FLJ23590, corresponding to a HOST TARGET binding site such as BINDING SITE I, BINDING SITE II or BINDING SITE III. Table 2 illustrates the complementarity of the nucleotide sequences of FLJ23590 BINDING SITE, designated SEQ ID:23939, to the nucleotide sequence of VGAM1362 RNA, herein designated VGAM RNA, also designated SEQ ID:4073.

Another function of VGAM1362 is therefore inhibition of FLJ23590 (Accession NM_024649). Accordingly, utilities of VGAM1362 include diagnosis, prevention and treatment of diseases and clinical conditions associated with FLJ23590. KIAA0993 (Accession XM_034413) is another VGAM1362 host target gene. KIAA0993 BINDING SITE is HOST TARGET binding site found in the 3' untranslated region of mRNA encoded by KIAA0993, corresponding to a HOST TARGET binding site such as BINDING SITE I, BINDING SITE II or BINDING SITE III. Table 2 illustrates the complementarity of the nucleotide sequences of KIAA0993 BINDING SITE, designated SEQ ID:32075, to the nucleotide sequence of VGAM1362 RNA, herein designated VGAM RNA, also designated SEQ ID:4073.

Another function of VGAM1362 is therefore inhibition of KIAA0993 (Accession XM_034413). Accordingly, utilities of VGAM1362 include diagnosis, prevention and treatment of diseases and clinical conditions associated with KIAA0993. LOC222001 (Accession XM_167489) is another VGAM1362 host target gene. LOC222001 BINDING SITE is HOST TARGET binding site found in the 5' untranslated region of mRNA encoded by LOC222001, corresponding to a HOST TARGET binding site such as BINDING SITE I, BINDING SITE II or BINDING SITE III. Table 2 illustrates the complementarity of the nucleotide sequences of LOC222001 BINDING SITE, designated SEQ ID:44642, to the nucleotide sequence of VGAM1362 RNA, herein designated VGAM RNA, also designated SEQ ID:4073.

Another function of VGAM1362 is therefore inhibition of LOC222001 (Accession XM_167489). Accordingly, utilities of VGAM1362 include diagnosis, prevention and treatment of diseases and clinical conditions associated with LOC222001. FIG. 1 further provides a conceptual description of a novel bioinformatically detected viral gene of the present invention, referred to here as Viral Genomic Address Messenger 1363 (VGAM1363) viral gene, which modulates expression of respective host target genes thereof, the function and utility of which host target genes is known in the art.

VGAM1363 is a novel bioinformatically detected regulatory, non protein coding, viral micro RNA (miRNA) gene. The method by which VGAM1363 was detected is described hereinabove with reference to FIGS. 1-8.

VGAM1363 gene, herein designated VGAM GENE, is a viral gene contained in the genome of Duck Adenovirus 1. VGAM1363 host target gene, herein designated VGAM HOST TARGET GENE, is a human gene contained in the human genome.

VGAM1363 gene encodes a VGAM1363 precursor RNA, herein designated VGAM PRECURSOR RNA. Similar to other miRNA genes, and unlike most ordinary genes, VGAM1363 precursor RNA does not encode a protein. A nucleotide sequence identical or highly similar to the nucleotide sequence of VGAM1363 precursor RNA is designated SEQ ID:1349, and is provided hereinbelow with reference to the sequence listing part. Nucleotide sequence SEQ ID:1349 is located at position 14923 relative to the genome of Duck Adenovirus 1.

VGAM1363 precursor RNA folds onto itself, forming VGAM1363 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1363 folded precursor RNA into VGAM1363 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM1363 RNA is designated SEQ ID:4074, and is provided hereinbelow with reference to the sequence listing part.

VGAM1363 host target gene, herein designated VGAM HOST TARGET GENE, encodes a corresponding messenger RNA, VGAM1363 host target RNA, herein designated VGAM HOST TARGET RNA. VGAM1363 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1363 RNA, herein designated VGAM RNA, binds complementarily to one or more host target binding sites located in untranslated regions of VGAM1363 host target RNA, herein designated VGAM HOST TARGET RNA. This complementary binding is due to the fact that the nucleotide sequence of VGAM1363 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1363 RNA, herein designated VGAM RNA, may have a different number of host target binding sites in untranslated regions of a VGAM1363 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1363 RNA, herein designated VGAM RNA, to host target binding sites on VGAM1363 host target RNA, herein designated VGAM HOST TARGET RNA, such as BINDING SITE I, BINDING SITE II and BINDING SITE III, inhibits translation of VGAM1363 host target RNA into VGAM1363 host target protein, herein designated VGAM HOST TARGET PROTEIN. VGAM host target protein is therefore outlined by a broken line.

It is appreciated that VGAM1363 host target gene, herein designated VGAM HOST TARGET GENE, in fact represents a plurality of VGAM1363 host target genes. The mRNA of each one of this plurality of VGAM1363 host target genes comprises one or more host target binding sites, each having a nucleotide sequence which is at least partly complementary to VGAM1363 RNA, herein designated VGAM RNA, and which when bound by VGAM1363 RNA causes inhibition of translation of respective one or more VGAM1363 host target proteins.

It is further appreciated by one skilled in the art that the mode of translational inhibition illustrated by FIG. 1 with specific reference to translational inhibition exerted by VGAM1363 gene, herein designated VGAM GENE, on one or more VGAM1363 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1363 is inhibition of expression of host target genes, as part of a novel viral mechanism of attacking a host. Accordingly, utilities of VGAM1363 include diagnosis, prevention and treatment of viral infection by Duck Adenovirus 1. Specific functions, and accordingly utilities, of VGAM1363 correlate with, and may be deduced from, the identity of the host target genes which VGAM1363 binds and inhibits, and the function of these host target genes, as elaborated hereinbelow.

Nucleotide sequences of the VGAM1363 precursor RNA, herein designated VGAM PRECURSOR RNA, and of the 'diced' VGAM1363 RNA, herein designated VGAM RNA, and a schematic representation of the secondary folding of VGAM1363 folded precursor RNA, herein designated VGAM FOLDED PRECURSOR RNA, of VGAM1363 are further described hereinbelow with reference to Table 1.

Nucleotide sequences of host target binding sites, such as BINDING SITE-I, BINDING SITE-II and BINDING SITE-III of FIG. 1, found on VGAM1363 host target RNA, and schematic representation of the complementarity of each of these host target binding sites to VGAM1363 RNA, herein designated VGAM RNA, are described hereinbelow with reference to Table 2.

As mentioned hereinabove with reference to FIG. 1, a function of VGAM1363 gene, herein designated VGAM is inhibition of expression of VGAM1363 target genes. It is appreciated that specific functions, and accordingly utilities, of VGAM1363 correlate with, and may be deduced from, the identity of the target genes which VGAM1363 binds and inhibits, and the function of these target genes, as elaborated hereinbelow.

Transcription Factor 7 (T-cell specific, HMG-box) (TCF7, Accession NM_003202) is a VGAM1363 host target gene. TCF7 BINDING SITE is HOST TARGET binding site found in the 3' untranslated region of mRNA encoded by TCF7, corresponding to a HOST TARGET binding site such as BINDING SITE I, BINDING SITE II or BINDING SITE III. Table 2 illustrates the complementarity of the nucleotide sequences of TCF7 BINDING SITE, designated SEQ ID:9193, to the nucleotide sequence of VGAM1363 RNA, herein designated VGAM RNA, also designated SEQ ID:4074.

A function of VGAM1363 is therefore inhibition of Transcription Factor 7 (T-cell specific, HMG-box) (TCF7, Accession NM_003202). Accordingly, utilities of VGAM1363 include diagnosis, prevention and treatment of diseases and clinical conditions associated with TCF7. Ras Homolog Gene Family, Member U (ARHU, Accession NM_021205) is another VGAM1363 host target gene. ARHU BINDING SITE is HOST TARGET binding site found in the 3' untranslated region of mRNA encoded by ARHU, corresponding to a HOST TARGET binding site such as BINDING SITE I, BINDING SITE II or BINDING SITE III. Table 2 illustrates the complementarity of the nucleotide sequences of ARHU BINDING SITE, designated SEQ ID:22179, to the nucleotide sequence of VGAM1363 RNA, herein designated VGAM RNA, also designated SEQ ID:4074.

Another function of VGAM1363 is therefore inhibition of Ras Homolog Gene Family, Member U (ARHU, Accession NM_021205). Accordingly, utilities of VGAM1363 include diagnosis, prevention and treatment of diseases and clinical conditions associated with ARHU. KIAA0194 (Accession XM_038362) is another VGAM1363 host target gene. KIAA0194 BINDING SITE is HOST TARGET binding site found in the 3' untranslated region of mRNA encoded by KIAA0194, corresponding to a HOST TARGET binding site such as BINDING SITE I, BINDING SITE II or BINDING SITE III. Table 2 illustrates the complementarity of the nucleotide sequences of KIAA0194 BINDING SITE, designated SEQ ID:32826, to the nucleotide sequence of VGAM1363 RNA, herein designated VGAM RNA, also designated SEQ ID:4074.

Another function of VGAM1363 is therefore inhibition of KIAA0194 (Accession XM_038362). Accordingly, utilities of VGAM1363 include diagnosis, prevention and treatment of diseases and clinical conditions associated with KIAA0194. KIAA0222 (Accession NM_014643) is another VGAM1363 host target gene. KIAA0222 BINDING SITE is HOST TARGET binding site found in the 3' untranslated region of mRNA encoded by KIAA0222, corresponding to a HOST TARGET binding site such as BINDING SITE I, BINDING SITE II or BINDING SITE III. Table 2 illustrates the complementarity of the nucleotide sequences of KIAA0222 BINDING SITE, designated SEQ ID:16044, to the nucleotide sequence of VGAM1363 RNA, herein designated VGAM RNA, also designated SEQ ID:4074.

Another function of VGAM1363 is therefore inhibition of KIAA0222 (Accession NM_014643). Accordingly, utilities of VGAM1363 include diagnosis, prevention and treatment of diseases and clinical conditions associated with KIAA0222. Progesterone Receptor Membrane Component 2 (PGRMC2, Accession NM_006320) is another VGAM1363 host target gene. PGRMC2 BINDING SITE is HOST TARGET binding site found in the 3' untranslated region of mRNA encoded by PGRMC2, corresponding to a HOST TARGET binding site such as BINDING SITE I, BINDING SITE II or BINDING SITE III. Table 2 illustrates the complementarity of the nucleotide sequences of PGRMC2 BINDING SITE, designated SEQ ID:13011, to the nucleotide sequence of VGAM1363 RNA, herein designated VGAM RNA, also designated SEQ ID:4074.

Another function of VGAM1363 is therefore inhibition of Progesterone Receptor Membrane Component 2 (PGRMC2, Accession NM_006320). Accordingly, utilities of VGAM1363 include diagnosis, prevention and treatment of diseases and clinical conditions associated with PGRMC2. SAM Domain and HD Domain 1 (SAMHD1, Accession XM_028704) is another VGAM1363 host target gene. SAMHD1 BINDING SITE is HOST TARGET binding site found in the 3' untranslated region of mRNA encoded by SAMHD1, corresponding to a HOST TARGET binding site such as BINDING SITE I, BINDING SITE II or BINDING SITE III. Table 2 illustrates the complementarity of the nucleotide sequences of SAMHD1 BINDING SITE, designated SEQ ID:30734, to the nucleotide sequence of VGAM1363 RNA, herein designated VGAM RNA, also designated SEQ ID:4074.

Another function of VGAM1363 is therefore inhibition of SAM Domain and HD Domain 1 (SAMHD1, Accession XM_028704). Accordingly, utilities of VGAM1363 include diagnosis, prevention and treatment of diseases and clinical conditions associated with SAMHD1. TSPEAR (Accession NM_144991) is another VGAM1363 host target gene. TSPEAR BINDING SITE is HOST TARGET binding site found in the 3' untranslated region of mRNA encoded by TSPEAR, corresponding to a HOST TARGET binding site such as BINDING SITE I, BINDING SITE II or BINDING SITE III. Table 2 illustrates the complementarity of the nucleotide sequences of TSPEAR BINDING SITE, designated SEQ ID:29596, to the nucleotide sequence of VGAM1363 RNA, herein designated VGAM RNA, also designated SEQ ID:4074.

Another function of VGAM1363 is therefore inhibition of TSPEAR (Accession NM_144991). Accordingly, utilities of VGAM1363 include diagnosis, prevention and treatment of diseases and clinical conditions associated with TSPEAR. LOC148529 (Accession XM_097481) is another VGAM1363 host target gene. LOC148529 BINDING SITE is HOST TARGET binding site found in the 5' untranslated region of mRNA encoded by LOC148529, corresponding to a HOST TARGET binding site such as BINDING SITE I, BINDING SITE II or BINDING SITE III. Table 2 illustrates the complementarity of the nucleotide sequences of LOC148529 BINDING SITE, designated SEQ ID:40890, to the nucleotide sequence of VGAM1363 RNA, herein designated VGAM RNA, also designated SEQ ID:4074.

Another function of VGAM1363 is therefore inhibition of LOC148529 (Accession XM_097481). Accordingly, utilities of VGAM1363 include diagnosis, prevention and treatment of diseases and clinical conditions associated with LOC148529. LOC148823 (Accession NM_145278) is another VGAM1363 host target gene. LOC148823 BINDING SITE is HOST TARGET binding site found in the 3' untranslated region of mRNA encoded by LOC148823, corresponding to a HOST TARGET binding site such as BINDING SITE I, BINDING SITE II or BINDING SITE III. Table 2 illustrates the complementarity of the nucleotide sequences of LOC148823 BINDING SITE, designated SEQ ID:29792, to the nucleotide sequence of VGAM1363 RNA, herein designated VGAM RNA, also designated SEQ ID:4074.

Another function of VGAM1363 is therefore inhibition of LOC148823 (Accession NM_145278). Accordingly, utilities of VGAM1363 include diagnosis, prevention and treatment of diseases and clinical conditions associated with LOC148823. LOC220963 (Accession XM_166145) is another VGAM1363 host target gene. LOC220963 BINDING SITE is HOST TARGET binding site found in the 3' untranslated region of mRNA encoded by LOC220963, corresponding to a HOST TARGET binding site such as BINDING SITE I, BINDING SITE II or BINDING SITE III. Table 2 illustrates the complementarity of the nucleotide sequences of LOC220963 BINDING SITE, designated SEQ ID:43955, to the nucleotide sequence of VGAM1363 RNA, herein designated VGAM RNA, also designated SEQ ID:4074.

Another function of VGAM1363 is therefore inhibition of LOC220963 (Accession XM_166145). Accordingly, utilities of VGAM1363 include diagnosis, prevention and treatment of diseases and clinical conditions associated with LOC220963. LOC221337 (Accession XM_166387) is another VGAM1363 host target gene. LOC221337 BINDING SITE is HOST TARGET binding site found in the 3' untranslated region of mRNA encoded by LOC221337, corresponding to a HOST TARGET binding site such as BINDING SITE I, BINDING SITE II or BINDING SITE III. Table 2 illustrates the complementarity of the nucleotide sequences of LOC221337 BINDING SITE, designated SEQ ID:44234, to the nucleotide sequence of VGAM1363 RNA, herein designated VGAM RNA, also designated SEQ ID:4074.

Another function of VGAM1363 is therefore inhibition of LOC221337 (Accession XM_166387). Accordingly, utilities of VGAM1363 include diagnosis, prevention and treatment of diseases and clinical conditions associated with LOC221337. LOC255671 (Accession XM_173196) is another VGAM1363 host target gene. LOC255671 BINDING SITE is HOST TARGET binding site found in the 3' untranslated region of mRNA encoded by LOC255671, corresponding to a HOST TARGET binding site such as BINDING SITE I, BINDING SITE II or BINDING SITE III. Table 2 illustrates the complementarity of the nucleotide sequences of LOC255671 BINDING SITE, designated SEQ ID:46438, to the nucleotide sequence of VGAM1363 RNA, herein designated VGAM RNA, also designated SEQ ID:4074.

Another function of VGAM1363 is therefore inhibition of LOC255671 (Accession XM_173196). Accordingly, utilities of VGAM1363 include diagnosis, prevention and treatment of diseases and clinical conditions associated with LOC255671. FIG. 1 further provides a conceptual description of a novel bioinformatically detected viral gene of the present invention, referred to here as Viral Genomic Address Messenger 1364 (VGAM1364) viral gene, which modulates expression of respective host target genes thereof, the function and utility of which host target genes is known in the art.

VGAM1364 is a novel bioinformatically detected regulatory, non protein coding, viral micro RNA (miRNA) gene. The method by which VGAM1364 was detected is described hereinabove with reference to FIGS. 1-8.

VGAM1364 gene, herein designated VGAM GENE, is a viral gene contained in the genome of Duck Adenovirus 1. VGAM1364 host target gene, herein designated VGAM HOST TARGET GENE, is a human gene contained in the human genome.

VGAM1364 gene encodes a VGAM1364 precursor RNA, herein designated VGAM PRECURSOR RNA. Similar to other miRNA genes, and unlike most ordinary genes, VGAM1364 precursor RNA does not encode a protein. A nucleotide sequence identical or highly similar to the nucleotide sequence of VGAM1364 precursor RNA is designated SEQ ID:1350, and is provided hereinbelow with reference to the sequence listing part. Nucleotide sequence SEQ ID:1350 is located at position 14767 relative to the genome of Duck Adenovirus 1.

VGAM1364 precursor RNA folds onto itself, forming VGAM1364 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1364 folded precursor RNA into VGAM1364 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1364 RNA is designated SEQ ID:4075, and is provided hereinbelow with reference to the sequence listing part.

VGAM1364 host target gene, herein designated VGAM HOST TARGET GENE, encodes a corresponding messenger RNA, VGAM1364 host target RNA, herein designated VGAM HOST TARGET RNA. VGAM1364 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1364 RNA, herein designated VGAM RNA, binds complementarily to one or more host target binding sites located in untranslated regions of VGAM1364 host target RNA, herein designated VGAM HOST TARGET RNA. This complementary binding is due to the fact that the nucleotide sequence of VGAM1364 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1364 RNA, herein designated VGAM RNA, may have a different number of host target binding sites in untranslated regions of a VGAM1364 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1364 RNA, herein designated VGAM RNA, to host target binding sites on VGAM1364 host target RNA, herein designated VGAM HOST TARGET RNA, such as BINDING SITE I, BINDING SITE II and BINDING SITE III, inhibits translation of VGAM1364 host target RNA into VGAM1364 host target protein, herein designated VGAM HOST TARGET PROTEIN. VGAM host target protein is therefore outlined by a broken line.

It is appreciated that VGAM1364 host target gene, herein designated VGAM HOST TARGET GENE, in fact represents a plurality of VGAM1364 host target genes. The mRNA of each one of this plurality of VGAM1364 host target genes comprises one or more host target binding sites, each having a nucleotide sequence which is at least partly complementary to VGAM1364 RNA, herein designated VGAM RNA, and which when bound by VGAM1364 RNA causes inhibition of translation of respective one or more VGAM1364 host target proteins.

It is further appreciated by one skilled in the art that the mode of translational inhibition illustrated by FIG. 1 with specific reference to translational inhibition exerted by VGAM1364 gene, herein designated VGAM GENE, on one or more VGAM1364 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1364 is inhibition of expression of host target genes, as part of a novel viral mechanism of attacking a host. Accordingly, utilities of VGAM1364 include diagnosis, prevention and treatment of viral infection by Duck Adenovirus 1. Specific functions, and accordingly utilities, of VGAM1364 correlate with, and may be deduced from, the identity of the host target genes which VGAM1364 binds and inhibits, and the function of these host target genes, as elaborated hereinbelow.

Nucleotide sequences of the VGAM1364 precursor RNA, herein designated VGAM PRECURSOR RNA, and of the 'diced' VGAM1364 RNA, herein designated VGAM RNA, and a schematic representation of the secondary folding of VGAM1364 folded precursor RNA, herein designated VGAM FOLDED PRECURSOR RNA, of VGAM1364 are further described hereinbelow with reference to Table 1.

Nucleotide sequences of host target binding sites, such as BINDING SITE-I, BINDING SITE-II and BINDING SITE-III of FIG. 1, found on VGAM1364 host target RNA, and schematic representation of the complementarity of each of these host target binding sites to VGAM1364 RNA, herein designated VGAM RNA, are described hereinbelow with reference to Table 2.

As mentioned hereinabove with reference to FIG. 1, a function of VGAM1364 gene, herein designated VGAM is inhibition of expression of VGAM1364 target genes. It is appreciated that specific functions, and accordingly utilities, of VGAM1364 correlate with, and may be deduced from, the identity of the target genes which VGAM1364 binds and inhibits, and the function of these target genes, as elaborated hereinbelow.

Solute Carrier Family 25 (mitochondrial carrier; ornithine transporter) Member 15 (SLC25A15, Accession NM_014252) is a VGAM1364 host target gene. SLC25A15 BINDING SITE is HOST TARGET binding site found in the 3' untranslated region of mRNA encoded by SLC25A15, corresponding to a HOST TARGET binding site such as BINDING SITE I, BINDING SITE II or BINDING SITE III. Table 2 illustrates the complementarity of the nucleotide sequences of SLC25A15 BINDING SITE, designated SEQ ID:15526, to the nucleotide sequence of VGAM1364 RNA, herein designated VGAM RNA, also designated SEQ ID:4075.

A function of VGAM1364 is therefore inhibition of Solute Carrier Family 25 (mitochondrial carrier; ornithine transporter) Member 15 (SLC25A15, Accession NM_014252), a gene which participates the ornithine transport across inner mitochondrial membrane, from the cytoplasm to the matrix.

Accordingly, utilities of VGAM1364 include diagnosis, prevention and treatment of diseases and clinical conditions associated with SLC25A15. The function of SLC25A15 and its association with various diseases and clinical conditions, has been established by previous studies, as described hereinabove with reference to VGAM172. X-ray Repair Complementing Defective Repair In Chinese Hamster Cells 3 (XRCC3, Accession NM_005432) is another VGAM1364 host target gene. XRCC3 BINDING SITE is HOST TARGET binding site found in the 3' untranslated region of mRNA encoded by XRCC3, corresponding to a HOST TARGET binding site such as BINDING SITE I, BINDING SITE II or BINDING SITE III. Table 2 illustrates the complementarity of the nucleotide sequences of XRCC3 BINDING SITE, designated SEQ ID:11906, to the nucleotide sequence of VGAM1364 RNA, herein designated VGAM RNA, also designated SEQ ID:4075.

Another function of VGAM1364 is therefore inhibition of X-ray Repair Complementing Defective Repair In Chinese Hamster Cells 3 (XRCC3, Accession NM_005432), a gene which is required for meiotic recombination, synaptonemal complex formation and cell cycle progression. Accordingly, utilities of VGAM1364 include diagnosis, prevention and treatment of diseases and clinical conditions associated with XRCC3. The function of XRCC3 and its association with various diseases and clinical conditions, has been established by previous studies, as described hereinabove with reference to VGAM1290. FLJ00060 (Accession XM_028154) is another VGAM1364 host target gene. FLJ00060 BINDING SITE is HOST TARGET binding site found in the 5' untranslated region of mRNA encoded by FLJ00060, corresponding to a HOST TARGET binding site such as BINDING SITE I, BINDING SITE II or BINDING SITE III. Table 2 illustrates the complementarity of the nucleotide sequences of FLJ00060 BINDING SITE, designated SEQ ID:30627, to the nucleotide sequence of VGAM1364 RNA, herein designated VGAM RNA, also designated SEQ ID:4075.

Another function of VGAM1364 is therefore inhibition of FLJ00060 (Accession XM_028154). Accordingly, utilities of VGAM1364 include diagnosis, prevention and treatment of diseases and clinical conditions associated with FLJ00060. FLJ12969 (Accession NM_022838) is another VGAM1364 host target gene. FLJ12969 BINDING SITE is HOST TARGET binding site found in the 5' untranslated region of mRNA encoded by FLJ12969, corresponding to a HOST TARGET binding site such as BINDING SITE I, BINDING SITE II or BINDING SITE III. Table 2 illustrates the complementarity of the nucleotide sequences of FLJ12969 BINDING SITE, designated SEQ ID:23124, to the nucleotide sequence of VGAM1364 RNA, herein designated VGAM RNA, also designated SEQ ID:4075.

Another function of VGAM1364 is therefore inhibition of FLJ12969 (Accession NM_022838). Accordingly, utilities of VGAM1364 include diagnosis, prevention and treatment of diseases and clinical conditions associated with FLJ12969. FLJ13189 (Accession NM_024882) is another VGAM1364 host target gene. FLJ13189 BINDING SITE is HOST TARGET binding site found in the 3' untranslated region of mRNA encoded by FLJ13189, corresponding to a HOST TARGET binding site such as BINDING SITE I, BINDING SITE II or BINDING SITE III. Table 2 illustrates the complementarity of the nucleotide sequences of FLJ13189 BINDING SITE, designated SEQ ID:24328, to the nucleotide sequence of VGAM1364 RNA, herein designated VGAM RNA, also designated SEQ ID:4075.

Another function of VGAM1364 is therefore inhibition of FLJ13189 (Accession NM_024882). Accordingly, utilities of VGAM1364 include diagnosis, prevention and treatment of diseases and clinical conditions associated with FLJ13189. Forkhead Box P1 (FOXP1, Accession NM_032682) is another VGAM1364 host target gene. FOXP1 BINDING SITE is HOST TARGET binding site found in the 3' untranslated region of mRNA encoded by FOXP1, corresponding to a HOST TARGET binding site such as BINDING SITE I, BINDING SITE II or BINDING SITE III. Table 2 illustrates the complementarity of the nucleotide sequences of FOXP1 BINDING SITE, designated SEQ ID:26403, to the nucleotide sequence of VGAM1364 RNA, herein designated VGAM RNA, also designated SEQ ID:4075.

Another function of VGAM1364 is therefore inhibition of Forkhead Box P1 (FOXP1, Accession NM_032682). Accordingly, utilities of VGAM1364 include diagnosis, prevention and treatment of diseases and clinical conditions associated with FOXP1. Mitochondrial Ribosomal Protein S27 (MRPS27, Accession NM_015084) is another VGAM1364 host target gene. MRPS27 BINDING SITE is HOST TARGET binding site found in the 3' untranslated region of mRNA encoded by MRPS27, corresponding to a HOST TARGET binding site such as BINDING SITE I, BINDING SITE II or BINDING SITE III. Table 2 illustrates the complementarity of the nucleotide sequences of MRPS27 BINDING SITE, designated SEQ ID:17471, to the nucleotide sequence of VGAM1364 RNA, herein designated VGAM RNA, also designated SEQ ID:4075.

Another function of VGAM1364 is therefore inhibition of Mitochondrial Ribosomal Protein S27 (MRPS27, Accession NM_015084). Accordingly, utilities of VGAM1364 include diagnosis, prevention and treatment of diseases and clinical conditions associated with MRPS27. LOC157773 (Accession XM_088387) is another VGAM1364 host target gene. LOC157773 BINDING SITE is HOST TARGET binding site found in the 5' untranslated region of mRNA encoded by LOC157773, corresponding to a HOST TARGET binding site such as BINDING SITE I, BINDING SITE II or BINDING SITE III. Table 2 illustrates the complementarity of the nucleotide sequences of LOC157773 BINDING SITE, designated SEQ ID:39669, to the nucleotide sequence of VGAM1364 RNA, herein designated VGAM RNA, also designated SEQ ID:4075.

Another function of VGAM1364 is therefore inhibition of LOC157773 (Accession XM_088387). Accordingly, utilities of VGAM1364 include diagnosis, prevention and treatment of diseases and clinical conditions associated with LOC157773. LOC162333 (Accession XM_102591) is another VGAM1364 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42122, to the nucleotide sequence of VGAM1364 RNA, herein designated VGAM RNA, also designated SEQ ID:4075.

Another function of VGAM1364 is therefore inhibition of LOC162333 (Accession XM_102591). Accordingly, utilities of VGAM1364 include diagnosis, prevention and treatment of diseases and clinical conditions associated with LOC162333. FIG. 1 further provides a conceptual description of a novel bioinformatically detected viral gene of the present invention, referred to here as Viral Genomic Address Messenger 1365 (VGAM1365) viral gene, which modulates expression of respective host target genes thereof, the function and utility of which host target genes is known in the art.

VGAM1365 is a novel bioinformatically detected regulatory, non protein coding, viral micro RNA (miRNA) gene. The method by which VGAM1365 was detected is described hereinabove with reference to FIGS. 1-8.

VGAM1365 gene, herein designated VGAM GENE, is a viral gene contained in the genome of Duck Adenovirus 1. VGAM1365 host target gene, herein designated VGAM HOST TARGET GENE, is a human gene contained in the human genome.

VGAM1365 gene encodes a VGAM1365 precursor RNA, herein designated VGAM PRECURSOR RNA. Similar to other miRNA genes, and unlike most ordinary genes, VGAM1365 precursor RNA does not encode a protein. A nucleotide sequence identical or highly similar to the nucleotide sequence of VGAM1365 precursor RNA is designated SEQ ID:1351, and is provided hereinbelow with reference to the sequence listing part. Nucleotide sequence SEQ ID:1351 is located at position 10633 relative to the genome of Duck Adenovirus 1.

VGAM1365 precursor RNA folds onto itself, forming VGAM1365 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1365 folded precursor RNA into VGAM1365 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 93%) nucleotide sequence of VGAM1365 RNA is designated SEQ ID:4076, and is provided hereinbelow with reference to the sequence listing part.

VGAM1365 host target gene, herein designated VGAM HOST TARGET GENE, encodes a corresponding messenger RNA, VGAM1365 host target RNA, herein designated VGAM HOST TARGET RNA. VGAM1365 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1365 RNA, herein designated VGAM RNA, binds complementarily to one or more host target binding sites located in untranslated regions of VGAM1365 host target RNA, herein designated VGAM HOST TARGET RNA. This complementary binding is due to the fact that the nucleotide sequence of VGAM1365 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1365 RNA, herein designated VGAM RNA, may have a different number of host target binding sites in untranslated regions of VGAM1365 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1365 RNA, herein designated VGAM RNA, to host target binding sites on VGAM1365 host target RNA, herein designated VGAM HOST TARGET RNA, such as BINDING SITE I, BINDING SITE II and BINDING SITE III, inhibits translation of VGAM1365 host target RNA into VGAM1365 host target protein, herein designated VGAM HOST TARGET PROTEIN. VGAM host target protein is therefore outlined by a broken line.

It is appreciated that VGAM1365 host target gene, herein designated VGAM HOST TARGET GENE, in fact represents a plurality of VGAM1365 host target genes. The mRNA of each one of this plurality of VGAM1365 host target genes comprises one or more host target binding sites, each having a nucleotide sequence which is at least partly complementary to VGAM1365 RNA, herein designated VGAM RNA, and which when bound by VGAM1365 RNA causes inhibition of translation of respective one or more VGAM1365 host target proteins.

It is further appreciated by one skilled in the art that the mode of translational inhibition illustrated by FIG. 1 with specific reference to translational inhibition exerted by VGAM1365 gene, herein designated VGAM GENE, on one or more VGAM1365 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1365 is inhibition of expression of host target genes, as part of a novel viral mechanism of attacking a host. Accordingly, utilities of VGAM1365 include diagnosis, prevention and treatment of viral infection by Duck Adenovirus 1. Specific functions, and accordingly utilities, of VGAM1365 correlate with, and may be deduced from, the identity of the host target genes which VGAM1365 binds and inhibits, and the function of these host target genes, as elaborated hereinbelow.

Nucleotide sequences of the VGAM1365 precursor RNA, herein designated VGAM PRECURSOR RNA, and of the 'diced' VGAM1365 RNA, herein designated VGAM RNA, and a schematic representation of the secondary folding of VGAM1365 folded precursor RNA, herein designated VGAM FOLDED PRECURSOR RNA, of VGAM1365 are further described hereinbelow with reference to Table 1.

Nucleotide sequences of host target binding sites, such as BINDING SITE-I, BINDING SITE-II and BINDING SITE-III of FIG. 1, found on VGAM1365 host target RNA, and schematic representation of the complementarity of each of these host target binding sites to VGAM1365 RNA, herein designated VGAM RNA, are described hereinbelow with reference to Table 2.

As mentioned hereinabove with reference to FIG. 1, a function of VGAM1365 gene, herein designated VGAM is inhibition of expression of VGAM1365 target genes. It is appreciated that specific functions, and accordingly utilities, of VGAM1365 correlate with, and may be deduced from, the identity of the target genes which VGAM1365 binds and inhibits, and the function of these target genes, as elaborated hereinbelow.

Discs, Large (Drosophila) Homolog 5 (DLG5, Accession XM_096398) is a VGAM1365 host target gene. DLG5 BINDING SITE is HOST TARGET binding site found in the 5' untranslated region of mRNA encoded by DLG5, corresponding to a HOST TARGET binding site such as BINDING SITE I, BINDING SITE II or BINDING SITE III. Table 2 illustrates the complementarity of the nucleotide sequences of DLG5 BINDING SITE, designated SEQ ID:40334, to the nucleotide sequence of VGAM1365 RNA, herein designated VGAM RNA, also designated SEQ ID:4076.

A function of VGAM1365 is therefore inhibition of Discs, Large (Drosophila) Homolog 5 (DLG5, Accession XM_096398), a gene which may transmit extracellular signals to inhibit cell proliferation. Accordingly, utilities of VGAM1365 include diagnosis, prevention and treatment of diseases and clinical conditions associated with DLG5. The function of DLG5 and its association with various diseases and clinical conditions, has been established by previous studies, as described hereinabove with reference to VGAM444. Mannose-binding Lectin (protein C) 2, Soluble (opsonic defect) (MBL2, Accession NM_000242) is another VGAM1365 host target gene. MBL2 BINDING SITE is HOST TARGET binding site found in the 3' untranslated region of mRNA encoded by MBL2, corresponding to a HOST TARGET binding site such as BINDING SITE I, BINDING SITE II or BINDING SITE III. Table 2 illustrates the complementarity of the nucleotide sequences of MBL2 BINDING SITE, designated SEQ ID:5760, to the nucleotide sequence of VGAM1365 RNA, herein designated VGAM RNA, also designated SEQ ID:4076.

Another function of VGAM1365 is therefore inhibition of Mannose-binding Lectin (protein C) 2, Soluble (opsonic defect) (MBL2, Accession NM_000242). Accordingly, utilities of VGAM1365 include diagnosis, prevention and treatment of diseases and clinical conditions associated with MBL2. DKFZp566H0824 (Accession NM_017535) is another VGAM1365 host target gene. DKFZp566H0824 BINDING SITE is HOST TARGET binding site found in the 5' untranslated region of mRNA encoded by DKFZp566H0824, corresponding to a HOST TARGET binding site such as BINDING SITE I, BINDING SITE II or BINDING SITE III. Table 2 illustrates the complementarity of the nucleotide sequences of DKFZp566H0824 BINDING SITE, designated SEQ ID:18975, to the nucleotide sequence of VGAM1365 RNA, herein designated VGAM RNA, also designated SEQ ID:4076.

Another function of VGAM1365 is therefore inhibition of DKFZp566H0824 (Accession NM_017535). Accordingly, utilities of VGAM1365 include diagnosis, prevention and treatment of diseases and clinical conditions associated with DKFZp566H0824. DKFZP566J091 (Accession NM_030915) is another VGAM1365 host target gene. DKFZP566J091 BINDING SITE is HOST TARGET binding site found in the 3' untranslated region of mRNA encoded by DKFZP566J091, corresponding to a HOST TARGET binding site such as BINDING SITE I, BINDING SITE II or BINDING SITE III. Table 2 illustrates the complementarity of the nucleotide sequences of DKFZP566J091 BINDING SITE, designated SEQ ID:25185, to the nucleotide sequence of VGAM1365 RNA, herein designated VGAM RNA, also designated SEQ ID:4076.

Another function of VGAM1365 is therefore inhibition of DKFZP566J091 (Accession NM_030915). Accordingly, utilities of VGAM1365 include diagnosis, prevention and treatment of diseases and clinical conditions associated with DKFZP566J091. FLJ10901 (Accession NM_018265) is another VGAM1365 host target gene. FLJ10901 BINDING SITE is HOST TARGET binding site found in the 3' untranslated region of mRNA encoded by FLJ10901, corresponding to a HOST TARGET binding site such as BINDING SITE I, BINDING SITE II or BINDING SITE III. Table 2 illustrates the complementarity of the nucleotide sequences of FLJ10901 BINDING SITE, designated SEQ ID:20228, to the nucleotide sequence of VGAM1365 RNA, herein designated VGAM RNA, also designated SEQ ID:4076.

Another function of VGAM1365 is therefore inhibition of FLJ10901 (Accession NM_018265). Accordingly, utilities of VGAM1365 include diagnosis, prevention and treatment of diseases and clinical conditions associated with FLJ10901. GW112 (Accession NM_006418) is another VGAM1365 host target gene. GW112 BINDING SITE is HOST TARGET binding site found in the 3' untranslated region of mRNA encoded by GW112, corresponding to a HOST TARGET binding site such as BINDING SITE I, BINDING SITE II or BINDING SITE III. Table 2 illustrates the complementarity of the nucleotide sequences of GW112 BINDING SITE, designated SEQ ID:13132, to the nucleotide sequence of VGAM1365 RNA, herein designated VGAM RNA, also designated SEQ ID:4076.

Another function of VGAM1365 is therefore inhibition of GW112 (Accession NM_006418). Accordingly, utilities of VGAM1365 include diagnosis, prevention and treatment of diseases and clinical conditions associated with GW112. KIAA0993 (Accession XM_034413) is another VGAM1365 host target gene. KIAA0993 BINDING SITE is HOST TARGET binding site found in the 3' untranslated region of mRNA encoded by KIAA0993, corresponding to a HOST TARGET binding site such as BINDING SITE I, BINDING SITE II or BINDING SITE III. Table 2 illustrates the complementarity of the nucleotide sequences of KIAA0993 BINDING SITE, designated SEQ ID:32080, to the nucleotide sequence of VGAM1365 RNA, herein designated VGAM RNA, also designated SEQ ID:4076.

Another function of VGAM1365 is therefore inhibition of KIAA0993 (Accession XM_034413). Accordingly, utilities of VGAM1365 include diagnosis, prevention and treatment of diseases and clinical conditions associated with KIAA0993. KIAA1822 (Accession XM_041566) is another VGAM1365 host target gene. KIAA1822 BINDING SITE is HOST TARGET binding site found in the 3' untranslated region of mRNA encoded by KIAA1822, corresponding to a HOST TARGET binding site such as BINDING SITE I, BINDING SITE II or BINDING SITE III. Table 2 illustrates the complementarity of the nucleotide sequences of KIAA1822 BINDING SITE, designated SEQ ID:33550, to the nucleotide sequence of VGAM1365 RNA, herein designated VGAM RNA, also designated SEQ ID:4076.

Another function of VGAM1365 is therefore inhibition of KIAA1822 (Accession XM_041566). Accordingly, utilities of VGAM1365 include diagnosis, prevention and treatment of diseases and clinical conditions associated with KIAA1822. p21(CDKN1A)-activated Kinase 6 (PAK6, Accession NM_020168) is another VGAM1365 host target gene. PAK6 BINDING SITE is HOST TARGET binding site found in the 3' untranslated region of mRNA encoded by PAK6, corresponding to a HOST TARGET binding site such as BINDING SITE I, BINDING SITE II or BINDING SITE III. Table 2 illustrates the complementarity of the nucleotide sequences of PAK6 BINDING SITE, designated SEQ ID:21388, to the nucleotide sequence of VGAM1365 RNA, herein designated VGAM RNA, also designated SEQ ID:4076.

Another function of VGAM1365 is therefore inhibition of p21(CDKN1A)-activated Kinase 6 (PAK6, Accession NM_020168). Accordingly, utilities of VGAM1365 include diagnosis, prevention and treatment of diseases and clinical conditions associated with PAK6. Tumor Necrosis Factor Receptor Superfamily, Member 21 (TNFRSF21, Accession NM_014452) is another VGAM1365 host target gene. TNFRSF21 BINDING SITE is HOST TARGET binding site found in the 3' untranslated region of mRNA encoded by TNFRSF21, corresponding to a HOST TARGET binding site such as BINDING SITE I, BINDING SITE II or BINDING SITE III. Table 2 illustrates the complementarity of the nucleotide sequences of TNFRSF21 BINDING SITE, designated SEQ ID:15802, to the nucleotide sequence of VGAM1365 RNA, herein designated VGAM RNA, also designated SEQ ID:4076.

Another function of VGAM1365 is therefore inhibition of Tumor Necrosis Factor Receptor Superfamily, Member 21 (TNFRSF21, Accession NM_014452). Accordingly, utilities of VGAM1365 include diagnosis, prevention and treatment of diseases and clinical conditions associated with TNFRSF21. LOC120892 (Accession XM_058513) is another VGAM1365 host target gene. LOC120892 BINDING SITE is HOST TARGET binding site found in the 3' untranslated region of mRNA encoded by LOC120892, corresponding to a HOST TARGET binding site such as BINDING SITE I, BINDING SITE II or BINDING SITE III. Table 2 illustrates the complementarity of the nucleotide sequences of LOC120892 BINDING SITE, designated SEQ ID:36648, to the nucleotide sequence of VGAM1365 RNA, herein designated VGAM RNA, also designated SEQ ID:4076.

Another function of VGAM1365 is therefore inhibition of LOC120892 (Accession XM_058513). Accordingly, utilities of VGAM1365 include diagnosis, prevention and treatment of diseases and clinical conditions associated with LOC120892. LOC157653 (Accession XM_088353) is another VGAM1365 host target gene. LOC157653 BINDING SITE is HOST TARGET binding site found in the 5' untranslated region of mRNA encoded by LOC157653, corresponding to a HOST TARGET binding site such as BINDING SITE I, BINDING SITE II or BINDING SITE III. Table 2 illustrates the complementarity of the nucleotide sequences of LOC157653 BINDING SITE, designated SEQ ID:39633, to the nucleotide sequence of VGAM1365 RNA, herein designated VGAM RNA, also designated SEQ ID:4076.

Another function of VGAM1365 is therefore inhibition of LOC157653 (Accession XM_088353). Accordingly, utilities of VGAM1365 include diagnosis, prevention and treatment of diseases and clinical conditions associated with LOC157653. LOC245771 (Accession XM_167366) is another VGAM1365 host target gene. LOC245771 BINDING SITE is HOST TARGET binding site found in the 5' untranslated region of mRNA encoded by LOC245771, corresponding to a HOST TARGET binding site such as BINDING SITE I, BINDING SITE II or BINDING SITE III. Table 2 illustrates the complementarity of the nucleotide sequences of LOC245771 BINDING SITE, designated SEQ ID:44633, to the nucleotide sequence of VGAM1365 RNA, herein designated VGAM RNA, also designated SEQ ID:4076.

Another function of VGAM1365 is therefore inhibition of LOC245771 (Accession XM_167366). Accordingly, utilities of VGAM1365 include diagnosis, prevention and treatment of diseases and clinical conditions associated with LOC245771. FIG. 1 further provides a conceptual description of a novel bioinformatically detected viral gene of the present invention, referred to here as Viral Genomic Address Messenger 1366 (VGAM1366) viral gene, which modulates expression of respective host target genes thereof, the function and utility of which host target genes is known in the art.

VGAM1366 is a novel bioinformatically detected regulatory, non protein coding, viral micro RNA (miRNA) gene. The method by which VGAM1366 was detected is described hereinabove with reference to FIGS. 1-8.

VGAM1366 gene, herein designated VGAM GENE, is a viral gene contained in the genome of Human Herpesvirus 6. VGAM1366 host target gene, herein designated VGAM HOST TARGET GENE, is a human gene contained in the human genome.

VGAM1366 gene encodes a VGAM1366 precursor RNA, herein designated VGAM PRECURSOR RNA. Similar to other miRNA genes, and unlike most ordinary genes, VGAM1366 precursor RNA does not encode a protein. A nucleotide sequence identical or highly similar to the nucleotide sequence of VGAM1366 precursor RNA is designated SEQ ID:1352, and is provided hereinbelow with reference to the sequence listing part. Nucleotide sequence SEQ ID:1352 is located at position 50024 relative to the genome of Human Herpesvirus 6.

VGAM1366 precursor RNA folds onto itself, forming VGAM1366 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1366 folded precursor RNA into VGAM1366 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1366 RNA is designated SEQ ID:4077, and is provided hereinbelow with reference to the sequence listing part.

VGAM1366 host target gene, herein designated VGAM HOST TARGET GENE, encodes a corresponding messenger RNA, VGAM1366 host target RNA, herein designated VGAM HOST TARGET RNA. VGAM1366 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1366 RNA, herein designated VGAM RNA, binds complementarily to one or more host target binding sites located in untranslated regions of VGAM1366 host target RNA, herein designated VGAM HOST TARGET RNA. This complementary binding is due to the fact that the nucleotide sequence of VGAM1366 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1366 RNA, herein designated VGAM RNA, may have a different number of host target binding sites in untranslated regions of a VGAM1366 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1366 RNA, herein designated VGAM RNA, to host target binding sites on VGAM1366 host target RNA, herein designated VGAM HOST TARGET RNA, such as BINDING SITE I, BINDING SITE II and BINDING SITE III, inhibits translation of VGAM1366 host target RNA into VGAM1366 host target protein, herein designated VGAM HOST TARGET PROTEIN. VGAM host target protein is therefore outlined by a broken line.

It is appreciated that VGAM1366 host target gene, herein designated VGAM HOST TARGET GENE, in fact represents a plurality of VGAM1366 host target genes. The mRNA of each one of this plurality of VGAM1366 host target genes comprises one or more host target binding sites, each having a nucleotide sequence which is at least partly complementary to VGAM1366 RNA, herein designated VGAM RNA, and which when bound by VGAM1366 RNA causes inhibition of translation of respective one or more VGAM1366 host target proteins.

It is further appreciated by one skilled in the art that the mode of translational inhibition illustrated by FIG. 1 with specific reference to translational inhibition exerted by VGAM1366 gene, herein designated VGAM GENE, on one or more VGAM1366 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1366 is inhibition of expression of host target genes, as part of a novel viral mechanism of attacking a host. Accordingly, utilities of VGAM1366 include diagnosis, prevention and treatment of viral infection by Human Herpesvirus 6. Specific functions, and accordingly utilities, of VGAM1366 correlate with, and may be deduced from, the identity of the host target genes which VGAM1366 binds and inhibits, and the function of these host target genes, as elaborated hereinbelow.

Nucleotide sequences of the VGAM1366 precursor RNA, herein designated VGAM PRECURSOR RNA, and of the 'diced' VGAM1366 RNA, herein designated VGAM RNA, and a schematic representation of the secondary folding of VGAM1366 folded precursor RNA, herein designated VGAM FOLDED PRECURSOR RNA, of VGAM1366 are further described hereinbelow with reference to Table 1.

Nucleotide sequences of host target binding sites, such as BINDING SITE-I, BINDING SITE-II and BINDING SITE-III of FIG. 1, found on VGAM1366 host target RNA, and schematic representation of the complementarity of each of these host target binding sites to VGAM1366 RNA, herein designated VGAM RNA, are described hereinbelow with reference to Table 2.

As mentioned hereinabove with reference to FIG. 1, a function of VGAM1366 gene, herein designated VGAM is inhibition of expression of VGAM1366 target genes. It is appreciated that specific functions, and accordingly utilities, of VGAM1366 correlate with, and may be deduced from, the identity of the target genes which VGAM1366 binds and inhibits, and the function of these target genes, as elaborated hereinbelow.

V-erb-b2 Erythroblastic Leukemia Viral Oncogene Homolog 2, Neuro/glioblastoma Derived Oncogene Homolog (avian) (ERBB2, Accession NM_004448) is a VGAM1366 host target gene. ERBB2 BINDING SITE is HOST TARGET binding site found in the 3' untranslated region of mRNA encoded by ERBB2, corresponding to a HOST TARGET binding site such as BINDING SITE I, BINDING SITE II or BINDING SITE III. Table 2 illustrates the complementarity of the nucleotide sequences of ERBB2 BINDING SITE, designated SEQ ID:10745, to the nucleotide sequence of VGAM1366 RNA, herein designated VGAM RNA, also designated SEQ ID:4077.

A function of VGAM1366 is therefore inhibition of V-erb-b2 Erythroblastic Leukemia Viral Oncogene Homolog 2, Neuro/glioblastoma Derived Oncogene Homolog (avian) (ERBB2, Accession NM_004448), a gene which Tyrosine kinase receptor. Accordingly, utilities of VGAM1366 include diagnosis, prevention and treatment of diseases and clinical conditions associated with ERBB2. The function of ERBB2 has been established by previous studies. The oncogene originally called NEU was derived from rat neuro/glioblastoma cell lines. It encodes a tumor antigen, p185, which is serologically related to EGFR, the epidermal growth factor receptor (OMIM Ref. No. 131550). EGFR maps to chromosome 7. Yang-Feng et al. (1985) found, however, that the human homolog, which they designated NGL (to avoid confusion with neuraminidase, which is also symbolized NEU), maps to 17q12-q22 by in situ hybridization and to 17q21-qter in somatic cell hybrids. Thus, the SRO is 17q21-q22. Coussens et al. (1985) identified a potential cell surface receptor of the tyrosine kinase gene family and characterized it by cloning the gene. Its primary sequence is very similar to that of the human epidermal growth factor receptor. Because of the seemingly close relationship to the human EGF receptor, the authors called the gene HER2. By Southern blot analysis of somatic cell hybrid DNA and by in situ hybridization, the gene was assigned to 17q21-q22. This chromosomal location of the gene is coincident with the NEU oncogene, which suggests that the 2 genes may in fact be the same; indeed, sequencing indicates that they are identical (Francke, 1988). Van de Vijver et al. (1988) found a correlation between over-expression of NEU protein and the large-cell, comedo growth type of ductal carcinoma. They could find no correlation, however, with lymph-node status or tumor recurrence. Slamon et al. (1989) described the role of HER2/NEU in breast (OMIM Ref. No. 114480) and ovarian cancer (OMIM Ref. No. 167000), which together account for one-third of all cancers in women and approximately one-quarter of cancer-related deaths in females. The HER2 gene is amplified and HER2 is overexpressed in 25 to 30% of breast cancers, increasing the aggressiveness of the tumor. Slamon et al. (2001) found that herceptin increased the clinical benefit of first-line chemotherapy in metastatic breast cancer that over-expresses HER2. In a population-based case control study of the val655-to-ile polymorphism (164870.0001), Xie et al. (2000) found that the val allele was associated with an increased risk of breast cancer, particularly among younger women. Because of the significant ethnic differences in the incidence of breast cancer and other solid tumors, Ameyaw et al. (2002) undertook a study of 7 ethnic groups from 3 separate continents. The frequency of the val allele was highly variable between populations (1 to 24%). The continental African populations had a lower frequency than did the other subjects, corresponding with the lower incidence and lower risk of breast cancer in African women compared with Caucasian and African-American women. Animal model experiments lend further support to the function of ERBB2. An activated mutant form of ERBB2 is rarely found in human cancer. Instead, wildtype ERBB2 is overexpressed and/or amplified in 10 to 30% of breast cancers, where it correlates with chemoresistance and poor patient prognosis. Herceptin, a monoclonal antibody against ERBB2, is an effective treatment for a subset of patients with advanced breast cancer. Liu et al. (2002) used a transgenic mouse model with targeted aberrant overexpression of ERBB2 to determine whether genetic instability is associated with mammary tumorigenesis in vivo in the absence of heritable defects in known DNA maintenance genes.

It is appreciated that the abovementioned animal model for ERBB2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Coussens, L.; Yang-Feng, T. L.; Liao, Y.-C.; Chen, E.; Gray, A.; McGrath, J.; Seeburg, P. H.; Libermann, T. A.; Schlessinger, J.; Francke, U.; Levinson, A.; Ullrich, A.: Tyrosine kinase receptor with extensive homology to EGF receptor shares chromosomal location with NEU oncogene. Science 230:1132-1139, 1985; and Liu, S.; Liu, W.; Jakubczak, J. L.; Erexson, G. L.; Tindall, K. R.; Chan, R.; Muller, W. J.; Adhya, S.; Garges, S.; Merlino, G.: Genetic instability favoring transversions associated w.

Further studies establishing the function and utilities of ERBB2 are found in John Hopkins OMIM database record ID 164870, and in sited publications numbered 1826-1827, 11591-2086, 11999-2102, 274 and 3136-3140 listed in the bibliography section hereinbelow, which are also hereby incorporated by reference. Forkhead Box D2 (FOXD2, Accession NM_004474) is another VGAM1366 host target gene. FOXD2 BINDING SITE is HOST TARGET binding site found in the 5' untranslated region of mRNA encoded by FOXD2, corresponding to a HOST TARGET binding site such as BINDING SITE I, BINDING SITE II or BINDING SITE III. Table 2 illustrates the complementarity of the nucleotide sequences of FOXD2 BINDING SITE, designated SEQ ID:10787, to the nucleotide sequence of VGAM1366 RNA, herein designated VGAM RNA, also designated SEQ ID:4077.

Another function of VGAM1366 is therefore inhibition of Forkhead Box D2 (FOXD2, Accession NM_004474). Accordingly, utilities of VGAM1366 include diagnosis, prevention and treatment of diseases and clinical conditions associated with FOXD2. Acetyl-Coenzyme A Acyltransferase 2 (mitochondrial 3-oxoacyl-Coenzyme A thiolase) (ACAA2, Accession XM_166287) is another VGAM1366 host target gene. ACAA2 BINDING SITE is HOST TARGET binding site found in the 5' untranslated region of mRNA encoded by ACAA2, corresponding to a HOST TARGET binding site such as BINDING SITE I, BINDING SITE II or BINDING SITE III. Table 2 illustrates the complementarity of the nucleotide sequences of ACAA2 BINDING SITE, designated SEQ ID:44096, to the nucleotide sequence of VGAM1366 RNA, herein designated VGAM RNA, also designated SEQ ID:4077.

Another function of VGAM1366 is therefore inhibition of Acetyl-Coenzyme A Acyltransferase 2 (mitochondrial 3-oxoacyl-Coenzyme A thiolase) (ACAA2, Accession XM_166287). Accordingly, utilities of VGAM1366 include diagnosis, prevention and treatment of diseases and clinical conditions associated with ACAA2. Conserved Helix-loop-helix Ubiquitous Kinase (CHUK, Accession NM_001278) is another VGAM1366 host target gene. CHUK BINDING SITE is HOST TARGET binding site found in the 3' untranslated region of mRNA encoded by CHUK, corresponding to a HOST TARGET binding site such as BINDING SITE I, BINDING SITE II or BINDING SITE III. Table 2 illustrates the complementarity of the nucleotide sequences of CHUK BINDING SITE, designated SEQ ID:6947, to the nucleotide sequence of VGAM1366 RNA, herein designated VGAM RNA, also designated SEQ ID:4077.

Another function of VGAM1366 is therefore inhibition of Conserved Helix-loop-helix Ubiquitous Kinase (CHUK, Accession NM_001278). Accordingly, utilities of VGAM1366 include diagnosis, prevention and treatment of diseases and clinical conditions associated with CHUK. DEAD/H (Asp-Glu-Ala-Asp/His) Box Polypeptide 28 (DDX28, Accession NM_018380) is another VGAM1366 host target gene. DDX28 BINDING SITE is HOST TARGET binding site found in the 5' untranslated region of mRNA encoded by DDX28, corresponding to a HOST TARGET binding site such as BINDING SITE I, BINDING SITE II or BINDING SITE III. Table 2 illustrates the complementarity of the nucleotide sequences of DDX28 BINDING SITE, designated SEQ ID:20409, to the nucleotide sequence of VGAM1366 RNA, herein designated VGAM RNA, also designated SEQ ID:4077.

Another function of VGAM1366 is therefore inhibition of DEAD/H (Asp-Glu-Ala-Asp/His) Box Polypeptide 28 (DDX28, Accession NM_018380). Accordingly, utilities of VGAM1366 include diagnosis, prevention and treatment of diseases and clinical conditions associated with DDX28. DIS3 (Accession NM_014953) is another VGAM1366 host target gene. DIS3 BINDING SITE is HOST TARGET binding site found in the 3' untranslated region of mRNA encoded by DIS3, corresponding to a HOST TARGET binding site such as BINDING SITE I, BINDING SITE II or BINDING SITE III. Table 2 illustrates the complementarity of the nucleotide sequences of DIS3 BINDING SITE, designated SEQ ID:17303, to the nucleotide sequence of VGAM1366 RNA, herein designated VGAM RNA, also designated SEQ ID:4077.

Another function of VGAM1366 is therefore inhibition of DIS3 (Accession NM_014953). Accordingly, utilities of VGAM1366 include diagnosis, prevention and treatment of diseases and clinical conditions associated with DIS3. DJ328E19. C1.1 (Accession NM_015383) is another VGAM1366 host target gene. DJ328E19. C1.1 BINDING SITE is HOST TARGET binding site found in the 3' untranslated region of mRNA encoded by DJ328E19. C1.1, corresponding to a HOST TARGET binding site such as BINDING SITE I, BINDING SITE II or BINDING SITE III. Table 2 illustrates the complementarity of the nucleotide sequences of DJ328E19. C1.1 BINDING SITE, designated SEQ ID:17683, to the nucleotide sequence of VGAM1366 RNA, herein designated VGAM RNA, also designated SEQ ID:4077.

Another function of VGAM1366 is therefore inhibition of DJ328E19. C1.1 (Accession NM_015383). Accordingly, utilities of VGAM1366 include diagnosis, prevention and treatment of diseases and clinical conditions associated with DJ328E19. C1.1. FLJ21032 (Accession NM_024906) is another VGAM1366 host target gene. FLJ21032 BINDING SITE is HOST TARGET binding site found in the 3' untranslated region of mRNA encoded by FLJ21032, corresponding to a HOST TARGET binding site such as BINDING SITE I, BINDING SITE II or BINDING SITE III. Table 2 illustrates the complementarity of the nucleotide sequences of FLJ21032 BINDING SITE, designated SEQ ID:24398, to the nucleotide sequence of VGAM1366 RNA, herein designated VGAM RNA, also designated SEQ ID:4077.

Another function of VGAM1366 is therefore inhibition of FLJ21032 (Accession NM_024906). Accordingly, utilities of VGAM1366 include diagnosis, prevention and treatment of diseases and clinical conditions associated with FLJ21032. FLJ21817 (Accession NM_022448) is another VGAM1366 host target gene. FLJ21817 BINDING SITE is HOST TARGET binding site found in the 3' untranslated region of mRNA encoded by FLJ21817, corresponding to a HOST TARGET binding site such as BINDING SITE I, BINDING SITE II or BINDING SITE III. Table 2 illustrates the complementarity of the nucleotide sequences of FLJ21817 BINDING SITE, designated SEQ ID:22783, to the nucleotide sequence of VGAM1366 RNA, herein designated VGAM RNA, also designated SEQ ID:4077.

Another function of VGAM1366 is therefore inhibition of FLJ21817 (Accession NM_022448). Accordingly, utilities of VGAM1366 include diagnosis, prevention and treatment of diseases and clinical conditions associated with FLJ21817. G-protein Coupled Receptor 88 (GPR88, Accession NM_022049) is another VGAM1366 host target gene. GPR88 BINDING SITE is HOST TARGET binding site found in the 3' untranslated region of mRNA encoded by GPR88, corresponding to a HOST TARGET binding site such as BINDING SITE I, BINDING SITE II or BINDING SITE III. Table 2 illustrates the complementarity of the nucleotide sequences of GPR88 BINDING SITE, designated SEQ ID:22573, to the nucleotide sequence of VGAM1366 RNA, herein designated VGAM RNA, also designated SEQ ID:4077.

Another function of VGAM1366 is therefore inhibition of G-protein Coupled Receptor 88 (GPR88, Accession NM_022049). Accordingly, utilities of VGAM1366 include diagnosis, prevention and treatment of diseases and clinical conditions associated with GPR88. G Protein Pathway Suppressor 2 (GPS2, Accession NM_004489) is another VGAM1366 host target gene. GPS2 BINDING SITE is HOST TARGET binding site found in the 5' untranslated region of mRNA encoded by GPS2, corresponding to a HOST TARGET binding site such as BINDING SITE I, BINDING SITE II or BINDING SITE III. Table 2 illustrates the complementarity of the nucleotide sequences of GPS2 BINDING SITE, designated SEQ ID:10825, to the nucleotide sequence of VGAM1366 RNA, herein designated VGAM RNA, also designated SEQ ID:4077.

Another function of VGAM1366 is therefore inhibition of G Protein Pathway Suppressor 2 (GPS2, Accession NM_004489). Accordingly, utilities of VGAM1366 include diagnosis, prevention and treatment of diseases and clinical conditions associated with GPS2. KIAA0295 (Accession XM_042833) is another VGAM1366 host target gene. KIAA0295 BINDING SITE is HOST TARGET binding site found in the 3' untranslated region of mRNA encoded by KIAA0295, corresponding to a HOST TARGET binding site such as BINDING SITE I, BINDING SITE II or BINDING SITE III. Table 2 illustrates the complementarity of the nucleotide sequences of KIAA0295 BINDING SITE, designated SEQ ID:33786, to the nucleotide sequence of VGAM1366 RNA, herein designated VGAM RNA, also designated SEQ ID:4077.

Another function of VGAM1366 is therefore inhibition of KIAA0295 (Accession XM_042833). Accordingly, utilities of VGAM1366 include diagnosis, prevention and treatment of diseases and clinical conditions associated with KIAA0295. KIAA0561 (Accession XM_038150) is another VGAM1366 host target gene. KIAA0561 BINDING SITE is HOST TARGET binding site found in the 3' untranslated region of mRNA encoded by KIAA0561, corresponding to a HOST TARGET binding site such as BINDING SITE I, BINDING SITE II or BINDING SITE III. Table 2 illustrates the complementarity of the nucleotide sequences of KIAA0561 BINDING SITE, designated SEQ ID:32766, to the nucleotide sequence of VGAM1366 RNA, herein designated VGAM RNA, also designated SEQ ID:4077.

Another function of VGAM1366 is therefore inhibition of KIAA0561 (Accession XM_038150). Accordingly, utilities of VGAM1366 include diagnosis, prevention and treatment of diseases and clinical conditions associated with KIAA0561. KIAA1826 (Accession XM_040784) is another VGAM1366 host target gene. KIAA1826 BINDING SITE is HOST TARGET binding site found in the 3' untranslated region of mRNA encoded by KIAA1826, corresponding to a HOST TARGET binding site such as BINDING SITE I, BINDING SITE II or BINDING SITE III. Table 2 illustrates the complementarity of the nucleotide sequences of KIAA1826 BINDING SITE, designated SEQ ID:33378, to the nucleotide sequence of VGAM1366 RNA, herein designated VGAM RNA, also designated SEQ ID:4077.

Another function of VGAM1366 is therefore inhibition of KIAA1826 (Accession XM_040784). Accordingly, utilities of VGAM1366 include diagnosis, prevention and treatment of diseases and clinical conditions associated with KIAA1826. MGC3184 (Accession NM_030965) is another VGAM1366 host target gene. MGC3184 BINDING SITE is HOST TARGET binding site found in the 3' untranslated region of mRNA encoded by MGC3184, corresponding to a HOST TARGET binding site such as BINDING SITE I, BINDING SITE II or BINDING SITE III. Table 2 illustrates the complementarity of the nucleotide sequences of MGC3184 BINDING SITE, designated SEQ ID:25232, to the nucleotide sequence of VGAM1366 RNA, herein designated VGAM RNA, also designated SEQ ID:4077.

Another function of VGAM1366 is therefore inhibition of MGC3184 (Accession NM_030965). Accordingly, utilities of VGAM1366 include diagnosis, prevention and treatment of diseases and clinical conditions associated with MGC3184. MGC5139 (Accession XM_058587) is another VGAM1366 host target gene. MGC5139 BINDING SITE is HOST TARGET binding site found in the 5' untranslated region of mRNA encoded by MGC5139, corresponding to a HOST TARGET binding site such as BINDING SITE I, BINDING SITE II or BINDING SITE III. Table 2 illustrates the complementarity of the nucleotide sequences of MGC5139 BINDING SITE, designated SEQ ID:36679, to the nucleotide sequence of VGAM1366 RNA, herein designated VGAM RNA, also designated SEQ ID:4077.

Another function of VGAM1366 is therefore inhibition of MGC5139 (Accession XM_058587). Accordingly, utilities of VGAM1366 include diagnosis, prevention and treatment of diseases and clinical conditions associated with MGC5139. Neurexophilin 3 (NXPH3, Accession XM_037847) is another VGAM1366 host target gene. NXPH3 BINDING SITE is HOST TARGET binding site found in the 3' untranslated region of mRNA encoded by NXPH3, corresponding to a HOST TARGET binding site such as BINDING SITE I, BINDING SITE II or BINDING SITE III. Table 2 illustrates the complementarity of the nucleotide sequences of NXPH3 BINDING SITE, designated SEQ ID:32720, to the nucleotide sequence of VGAM1366 RNA, herein designated VGAM RNA, also designated SEQ ID:4077.

Another function of VGAM1366 is therefore inhibition of Neurexophilin 3 (NXPH3, Accession XM_037847). Accordingly, utilities of VGAM1366 include diagnosis, prevention and treatment of diseases and clinical conditions associated with NXPH3. P11 (Accession NM_006025) is another VGAM1366 host target gene. P11 BINDING SITE is HOST TARGET binding site found in the 5' untranslated region of mRNA encoded by P11, corresponding to a HOST TARGET binding site such as BINDING SITE I, BINDING SITE II or BINDING SITE III. Table 2 illustrates the complementarity of the nucleotide sequences of P11 BINDING SITE, designated SEQ ID:12642, to the nucleotide sequence of VGAM1366 RNA, herein designated VGAM RNA, also designated SEQ ID:4077.

Another function of VGAM1366 is therefore inhibition of P11 (Accession NM_006025). Accordingly, utilities of VGAM1366 include diagnosis, prevention and treatment of diseases and clinical conditions associated with P11. LOC127262 (Accession XM_072073) is another VGAM1366 host target gene. LOC127262 BINDING SITE is HOST TARGET binding site found in the 3' untranslated region of mRNA encoded by LOC127262, corresponding to a HOST TARGET binding site such as BINDING SITE I, BINDING SITE II or BINDING SITE III. Table 2 illustrates the complementarity of the nucleotide sequences of LOC127262 BINDING SITE, designated SEQ ID:37459, to the nucleotide sequence of VGAM1366 RNA, herein designated VGAM RNA, also designated SEQ ID:4077.

Another function of VGAM1366 is therefore inhibition of LOC127262 (Accession XM_072073). Accordingly, utilities of VGAM1366 include diagnosis, prevention and treatment of diseases and clinical conditions associated with LOC127262. LOC149013 (Accession XM_086398) is another VGAM1366 host target gene. LOC149013 BINDING SITE is HOST TARGET binding site found in the 3' untranslated region of mRNA encoded by LOC149013, corresponding to a HOST TARGET binding site such as BINDING SITE I, BINDING SITE II or BINDING SITE III. Table 2 illustrates the complementarity of the nucleotide sequences of LOC149013 BINDING SITE, designated SEQ ID:38633, to the nucleotide sequence of VGAM1366 RNA, herein designated VGAM RNA, also designated SEQ ID:4077.

Another function of VGAM1366 is therefore inhibition of LOC149013 (Accession XM_086398). Accordingly, utilities of VGAM1366 include diagnosis, prevention and treatment of diseases and clinical conditions associated with LOC149013. LOC149317 (Accession XM_086493) is another VGAM1366 host target gene. LOC149317 BINDING SITE is HOST TARGET binding site found in the 3' untranslated region of mRNA encoded by LOC149317, corresponding to a HOST TARGET binding site such as BINDING SITE I, BINDING SITE II or BINDING SITE III. Table 2 illustrates the complementarity of the nucleotide sequences of LOC149317 BINDING SITE, designated SEQ ID:38709, to the nucleotide sequence of VGAM1366 RNA, herein designated VGAM RNA, also designated SEQ ID:4077.

Another function of VGAM1366 is therefore inhibition of LOC149317 (Accession XM_086493). Accordingly, utilities of VGAM1366 include diagnosis, prevention and treatment of diseases and clinical conditions associated with LOC149317. LOC220638 (Accession XM_058247) is another VGAM1366 host target gene. LOC220638 BINDING SITE is HOST TARGET binding site found in the 3' untranslated region of mRNA encoded by LOC220638, corresponding to a HOST TARGET binding site such as BINDING SITE I, BINDING SITE II or BINDING SITE III. Table 2 illustrates the complementarity of the nucleotide sequences of LOC220638 BINDING SITE, designated SEQ ID:36589, to the nucleotide sequence of VGAM1366 RNA, herein designated VGAM RNA, also designated SEQ ID:4077.

Another function of VGAM1366 is therefore inhibition of LOC220638 (Accession XM_058247). Accordingly, utilities of VGAM1366 include diagnosis, prevention and treatment of diseases and clinical conditions associated with LOC220638. LOC221975 (Accession XM_166534) is another VGAM1366 host target gene. LOC221975 BINDING SITE is HOST TARGET binding site found in the 3' untranslated region of mRNA encoded by LOC221975, corresponding to a HOST TARGET binding site such as BINDING SITE I, BINDING SITE II or BINDING SITE III. Table 2 illustrates the complementarity of the nucleotide sequences of LOC221975 BINDING SITE, designated SEQ ID:44496, to the nucleotide sequence of VGAM1366 RNA, herein designated VGAM RNA, also designated SEQ ID:4077.

Another function of VGAM1366 is therefore inhibition of LOC221975 (Accession XM_166534). Accordingly, utilities of VGAM1366 include diagnosis, prevention and treatment of diseases and clinical conditions associated with LOC221975. LOC257031 (Accession XM_170583) is another VGAM1366 host target gene. LOC257031 BINDING SITE is HOST TARGET binding site found in the 3' untranslated region of mRNA encoded by LOC257031, corresponding to a HOST TARGET binding site such as BINDING SITE I, BINDING SITE II or BINDING SITE III. Table 2 illustrates the complementarity of the nucleotide sequences of LOC257031 BINDING SITE, designated SEQ ID:45390, to the nucleotide sequence of VGAM1366 RNA, herein designated VGAM RNA, also designated SEQ ID:4077.

Another function of VGAM1366 is therefore inhibition of LOC257031 (Accession XM_170583). Accordingly, utilities of VGAM1366 include diagnosis, prevention and treatment of diseases and clinical conditions associated with LOC257031. FIG. 1 further provides a conceptual description of a novel bioinformatically detected viral gene of the present invention, referred to here as Viral Genomic Address Messenger 1367 (VGAM1367) viral gene, which modulates expression of respective host target genes thereof, the function and utility of which host target genes is known in the art.

VGAM1367 is a novel bioinformatically detected regulatory, non protein coding, viral micro RNA (miRNA) gene. The method by which VGAM1367 was detected is described hereinabove with reference to FIGS. 1-8.

VGAM1367 gene, herein designated VGAM GENE, is a viral gene contained in the genome of Human Herpesvirus 6. VGAM1367 host target gene, herein designated VGAM HOST TARGET GENE, is a human gene contained in the human genome.

VGAM1367 gene encodes a VGAM1367 precursor RNA, herein designated VGAM PRECURSOR RNA. Similar to other miRNA genes, and unlike most ordinary genes, VGAM1367 precursor RNA does not encode a protein. A nucleotide sequence identical or highly similar to the nucleotide sequence of VGAM1367 precursor RNA is designated SEQ ID:1353, and is provided hereinbelow with reference to the sequence listing part. Nucleotide sequence SEQ ID:1353 is located at position 48800 relative to the genome of Human Herpesvirus 6.

VGAM1367 precursor RNA folds onto itself, forming VGAM1367 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1367 folded precursor RNA into VGAM1367 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM1367 RNA is designated SEQ ID:4078, and is provided hereinbelow with reference to the sequence listing part.

VGAM1367 host target gene, herein designated VGAM HOST TARGET GENE, encodes a corresponding messenger RNA, VGAM1367 host target RNA, herein designated VGAM HOST TARGET RNA. VGAM1367 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1367 RNA, herein designated VGAM RNA, binds complementarily to one or more host target binding sites located in untranslated regions of VGAM1367 host target RNA, herein designated VGAM HOST TARGET RNA. This complementary binding is due to the fact that the nucleotide sequence of VGAM1367 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1367 RNA, herein designated VGAM RNA, may have a different number of host target binding sites in untranslated regions of a VGAM1367 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1367 RNA, herein designated VGAM RNA, to host target binding sites on VGAM1367 host target RNA, herein designated VGAM HOST TARGET RNA, such as BINDING SITE I, BINDING SITE II and BINDING SITE III, inhibits translation of VGAM1367 host target RNA into VGAM1367 host target protein, herein designated VGAM HOST TARGET PROTEIN. VGAM host target protein is therefore outlined by a broken line.

It is appreciated that VGAM1367 host target gene, herein designated VGAM HOST TARGET GENE, in fact represents a plurality of VGAM1367 host target genes. The mRNA of each one of this plurality of VGAM1367 host target genes comprises one or more host target binding sites, each having a nucleotide sequence which is at least partly complementary to VGAM1367 RNA, herein designated VGAM RNA, and which when bound by VGAM1367 RNA causes inhibition of translation of respective one or more VGAM1367 host target proteins.

It is further appreciated by one skilled in the art that the mode of translational inhibition illustrated by FIG. 1 with specific reference to translational inhibition exerted by VGAM1367 gene, herein designated VGAM GENE, on one or more VGAM1367 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1367 is inhibition of expression of host target genes, as part of a novel viral mechanism of attacking a host. Accordingly, utilities of VGAM1367 include diagnosis, prevention and treatment of viral infection by Human Herpesvirus 6. Specific functions, and accordingly utilities, of VGAM1367 correlate with, and may be deduced from, the identity of the host target genes which VGAM1367 binds and inhibits, and the function of these host target genes, as elaborated hereinbelow.

Nucleotide sequences of the VGAM1367 precursor RNA, herein designated VGAM PRECURSOR RNA, and of the 'diced' VGAM1367 RNA, herein designated VGAM RNA, and a schematic representation of the secondary folding of VGAM1367 folded precursor RNA, herein designated VGAM FOLDED PRECURSOR RNA, of VGAM1367 are further described hereinbelow with reference to Table 1.

Nucleotide sequences of host target binding sites, such as BINDING SITE-I, BINDING SITE-II and BINDING SITE-III of FIG. 1, found on VGAM1367 host target RNA, and schematic representation of the complementarity of each of these host target binding sites to VGAM1367 RNA, herein designated VGAM RNA, are described hereinbelow with reference to Table 2.

As mentioned hereinabove with reference to FIG. 1, a function of VGAM1367 gene, herein designated VGAM is inhibition of expression of VGAM1367 target genes. It is appreciated that specific functions, and accordingly utilities, of VGAM1367 correlate with, and may be deduced from, the identity of the target genes which VGAM1367 binds and inhibits, and the function of these target genes, as elaborated hereinbelow.

Branched Chain Aminotransferase 1, Cytosolic (BCAT1, Accession XM_038659) is a VGAM1367 host target gene. BCAT1 BINDING SITE is HOST TARGET binding site found in the 3' untranslated region of mRNA encoded by BCAT1, corresponding to a HOST TARGET binding site such as BINDING SITE I, BINDING SITE II or BINDING SITE III. Table 2 illustrates the complementarity of the nucleotide sequences of BCAT1 BINDING SITE, designated SEQ ID:32896, to the nucleotide sequence of VGAM1367 RNA, herein designated VGAM RNA, also designated SEQ ID:4078.

A function of VGAM1367 is therefore inhibition of Branched Chain Aminotransferase 1, Cytosolic (BCAT1, Accession XM_038659), a gene which catalyzes of the essential branched chain leucine, isoleucine, and valine. Accordingly, utilities of VGAM1367 include diagnosis, prevention and treatment of diseases and clinical conditions associated with BCAT1. The function of BCAT1 has been established by previous studies. Jones and Moore (1976) isolated an auxotrophic mutant in Chinese-hamster ovary cells that lacks the ability to grow if alpha-ketoisovaleric acid, alpha-ketoisocaproic acid and alpha-keto-beta-methylvaleric acid are substituted for valine, leucine and isoleucine in the culture medium. This auxotroph, called TRANS-minus, is caused by lack of the enzyme branched-chain amino acid transaminase (BCT). Jones and Moore (1979) provisionally assigned the BCT1 gene to 12pter-q12. Naylor and Shows (1979, 1980) also assigned BCT1 to chromosome 12 and BCT2 (OMIM Ref. No. 113530) to chromosome 19. There may be 2 different clinical disorders due to defect of branched-chain amino acid transamination, hypervalinemia (OMIM Ref. No. 277100) and hyperleucine-isoleucinemia (OMIM Ref. No. 238340). Since there are 2 distinct BCATs (see OMIM Ref. No. 113530), it is possible that one is mutant in each of these 2 conditions. Animal model experiments lend further support to the function of BCAT1. In the mouse, Benvenisty et al. (1992) isolated the Bcat1 gene by a subtraction/coexpression strategy with Myc-induced tumors of transgenic mice, and proved that Bcat1 is a direct genetic target for Myc regulation in the mouse. The Bcat1 gene is highly expressed early in embryogenesis, and during organogenesis its expression is localized to the neural tube, the somites, and the mesonephric tubules. The gene is also expressed in several MYC-based tumors. Schuldiner et al. (1996) isolated and compared the structural sequences of the Bcat1 homolog in mice, human, nematode, and yeast and showed that in human, as in mouse, the BCAT1 gene is a target for MYC activity in the oncogenesis process.

It is appreciated that the abovementioned animal model for BCAT1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Jones, C.; Moore, E. E.: Isolation of mutants lacking branched-chain amino acid transaminase. Somat. Cell Genet. 2:235-243, 1976; and Schuldiner, O.; Eden, A.; Ben-Yosef, T.; Yanuka, O.; Simchen, G.; Benvenisty, N.: ECA39, a conserved gene regulated by c-Myc in mice, is involved in G1/S cell cycle regulation in yeast.

Further studies establishing the function and utilities of BCAT1 are found in John Hopkins OMIM database record ID 113520, and in sited publications numbered 4194-4203 listed in the bibliography section hereinbelow, which are also hereby incorporated by reference. TIRAP (Accession NM_052887) is another VGAM1367 host target gene. TIRAP BINDING SITE is HOST TARGET binding site found in the 3' untranslated region of mRNA encoded by TIRAP, corresponding to a HOST TARGET binding site such as BINDING SITE I, BINDING SITE II or BINDING SITE III. Table 2 illustrates the complementarity of the nucleotide sequences of TIRAP BINDING SITE, designated SEQ ID:27475, to the nucleotide sequence of VGAM1367 RNA, herein designated VGAM RNA, also designated SEQ ID:4078.

Another function of VGAM1367 is therefore inhibition of TIRAP (Accession NM_052887), a gene which is a adapter involved in the TLR4 signaling pathway in the innate immune response. Accordingly, utilities of VGAM1367 include diagnosis, prevention and treatment of diseases and clinical conditions associated with TIRAP. The function of TIRAP and its association with various diseases and clinical conditions, has been established by previous studies, as described hereinabove with reference to VGAM189. BCL2-like 12 (proline rich) (BCL2L12, Accession NM_138639) is another VGAM1367 host target gene. BCL2L12 BINDING SITE is HOST TARGET binding site found in the 5' untranslated region of mRNA encoded by BCL2L12, corresponding to a HOST TARGET binding site such as BINDING SITE I, BINDING SITE II or BINDING SITE III. Table 2 illustrates the complementarity of the nucleotide sequences of BCL2L12 BINDING SITE, designated SEQ ID:28914, to the nucleotide sequence of VGAM1367 RNA, herein designated VGAM RNA, also designated SEQ ID:4078.

Another function of VGAM1367 is therefore inhibition of BCL2-like 12 (proline rich) (BCL2L12, Accession NM_138639). Accordingly, utilities of VGAM1367 include diagnosis, prevention and treatment of diseases and clinical conditions associated with BCL2L12. KIAA1798 (Accession XM_027074) is another VGAM1367 host target gene. KIAA1798 BINDING SITE is HOST TARGET binding site found in the 5' untranslated region of mRNA encoded by KIAA1798, corresponding to a HOST TARGET binding site such as BINDING SITE I, BINDING SITE II or BINDING SITE III. Table 2 illustrates the complementarity of the nucleotide sequences of KIAA1798 BINDING SITE, designated SEQ ID:30402, to the nucleotide sequence of VGAM1367 RNA, herein designated VGAM RNA, also designated SEQ ID:4078.

Another function of VGAM1367 is therefore inhibition of KIAA1798 (Accession XM_027074). Accordingly, utilities of VGAM1367 include diagnosis, prevention and treatment of diseases and clinical conditions associated with KIAA1798. FIG. 1 further provides a conceptual description of a novel bioinformatically detected viral gene of the present invention, referred to here as Viral Genomic Address Messenger 1368 (VGAM1368) viral gene, which modulates expression of respective host target genes thereof, the function and utility of which host target genes is known in the art.

VGAM1368 is a novel bioinformatically detected regulatory, non protein coding, viral micro RNA (miRNA) gene. The method by which VGAM1368 was detected is described hereinabove with reference to FIGS. 1-8.

VGAM1368 gene, herein designated VGAM GENE, is a viral gene contained in the genome of Human Herpesvirus 6. VGAM1368 host target gene, herein designated VGAM HOST TARGET GENE, is a human gene contained in the human genome.

VGAM1368 gene encodes a VGAM1368 precursor RNA, herein designated VGAM PRECURSOR RNA. Similar to other miRNA genes, and unlike most ordinary genes, VGAM1368 precursor RNA does not encode a protein. A nucleotide sequence identical or highly similar to the nucleotide sequence of VGAM1368 precursor RNA is designated SEQ ID:1354, and is provided hereinbelow with reference to the sequence listing part. Nucleotide sequence SEQ ID:1354 is located at position 44241 relative to the genome of Human Herpesvirus 6.

VGAM1368 precursor RNA folds onto itself, forming VGAM1368 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1368 folded precursor RNA into VGAM1368 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1368 RNA is designated SEQ ID:4079, and is provided hereinbelow with reference to the sequence listing part.

VGAM1368 host target gene, herein designated VGAM HOST TARGET GENE, encodes a corresponding messenger RNA, VGAM1368 host target RNA, herein designated VGAM HOST TARGET RNA. VGAM1368 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1368 RNA, herein designated VGAM RNA, binds complementarily to one or more host target binding sites located in untranslated regions of VGAM1368 host target RNA, herein designated VGAM HOST TARGET RNA. This complementary binding is due to the fact that the nucleotide sequence of VGAM1368 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1368 RNA, herein designated VGAM RNA, may have a different number of host target binding sites in untranslated regions of a VGAM1368 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1368 RNA, herein designated VGAM RNA, to host target binding sites on VGAM1368 host target RNA, herein designated VGAM HOST TARGET RNA, such as BINDING SITE I, BINDING SITE II and BINDING SITE III, inhibits translation of VGAM1368 host target RNA into VGAM1368 host target protein, herein designated VGAM HOST TARGET PROTEIN. VGAM host target protein is therefore outlined by a broken line.

It is appreciated that VGAM1368 host target gene, herein designated VGAM HOST TARGET GENE, in fact represents a plurality of VGAM1368 host target genes. The mRNA of each one of this plurality of VGAM1368 host target genes comprises one or more host target binding sites, each having a nucleotide sequence which is at least partly complementary to VGAM1368 RNA, herein designated VGAM RNA, and which when bound by VGAM1368 RNA causes inhibition of translation of respective one or more VGAM1368 host target proteins.

It is further appreciated by one skilled in the art that the mode of translational inhibition illustrated by FIG. 1 with specific reference to translational inhibition exerted by VGAM1368 gene, herein designated VGAM GENE, on one or more VGAM1368 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1368 is inhibition of expression of host target genes, as part of a novel viral mechanism of attacking a host. Accordingly, utilities of VGAM1368 include diagnosis, prevention and treatment of viral infection by Human Herpesvirus 6. Specific functions, and accordingly utilities, of VGAM1368 correlate with, and may be deduced from, the identity of the host target genes which VGAM1368 binds and inhibits, and the function of these host target genes, as elaborated hereinbelow.

Nucleotide sequences of the VGAM1368 precursor RNA, herein designated VGAM PRECURSOR RNA, and of the 'diced' VGAM1368 RNA, herein designated VGAM RNA, and a schematic representation of the secondary folding of VGAM1368 folded precursor RNA, herein designated VGAM FOLDED PRECURSOR RNA, of VGAM1368 are further described hereinbelow with reference to Table 1.

Nucleotide sequences of host target binding sites, such as BINDING SITE-I, BINDING SITE-II and BINDING SITE-III of FIG. 1, found on VGAM1368 host target RNA, and schematic representation of the complementarity of each of these host target binding sites to VGAM1368 RNA, herein designated VGAM RNA, are described hereinbelow with reference to Table 2.

As mentioned hereinabove with reference to FIG. 1, a function of VGAM1368 gene, herein designated VGAM is inhibition of expression of VGAM1368 target genes. It is appreciated that specific functions, and accordingly utilities, of VGAM1368 correlate with, and may be deduced from, the identity of the target genes which VGAM1368 binds and inhibits, and the function of these target genes, as elaborated hereinbelow.

Matrix Metalloproteinase 19 (MMP19, Accession NM_002429) is a VGAM1368 host target gene. MMP19 BINDING SITE1 and MMP19 BINDING SITE2 are HOST TARGET binding sites found in untranslated regions of mRNA encoded by MMP19, corresponding to HOST TARGET binding sites such as BINDING SITE I, BINDING SITE II or BINDING SITE III. Table 2 illustrates the complementarity of the nucleotide sequences of MMP19 BINDING SITE1 and MMP19 BINDING SITE2, designated SEQ ID:8266 and SEQ ID:23071 respectively, to the nucleotide sequence of VGAM1368 RNA, herein designated VGAM RNA, also designated SEQ ID:4079.

A function of VGAM1368 is therefore inhibition of Matrix Metalloproteinase 19 (MMP19, Accession NM_002429). Accordingly, utilities of VGAM1368 include diagnosis, prevention and treatment of diseases and clinical conditions associated with MMP19. FIG. 1 further provides a conceptual description of a novel bioinformatically detected viral gene of the present invention, referred to here as Viral Genomic Address Messenger 1369 (VGAM1369) viral gene, which modulates expression of respective host target genes thereof, the function and utility of which host target genes is known in the art.

VGAM1369 is a novel bioinformatically detected regulatory, non protein coding, viral micro RNA (miRNA) gene. The method by which VGAM1369 was detected is described hereinabove with reference to FIGS. 1-8.

VGAM1369 gene, herein designated VGAM GENE, is a viral gene contained in the genome of Human Herpesvirus 6. VGAM1369 host target gene, herein designated VGAM HOST TARGET GENE, is a human gene contained in the human genome.

VGAM1369 gene encodes a VGAM1369 precursor RNA, herein designated VGAM PRECURSOR RNA. Similar to other miRNA genes, and unlike most ordinary genes, VGAM1369 precursor RNA does not encode a protein. A nucleotide sequence identical or highly similar to the nucleotide sequence of VGAM1369 precursor RNA is designated SEQ ID:1355, and is provided hereinbelow with reference to the sequence listing part. Nucleotide sequence SEQ ID:1355 is located at position 50681 relative to the genome of Human Herpesvirus 6.

VGAM1369 precursor RNA folds onto itself, forming VGAM1369 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1369 folded precursor RNA into VGAM1369 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM1369 RNA is designated SEQ ID:4080, and is provided hereinbelow with reference to the sequence listing part.

VGAM1369 host target gene, herein designated VGAM HOST TARGET GENE, encodes a corresponding messenger RNA, VGAM1369 host target RNA, herein designated VGAM HOST TARGET RNA. VGAM1369 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1369 RNA, herein designated VGAM RNA, binds complementarily to one or more host target binding sites located in untranslated regions of VGAM1369 host target RNA, herein designated VGAM HOST TARGET RNA. This complementary binding is due to the fact that the nucleotide sequence of VGAM1369 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1369 RNA, herein designated VGAM RNA, may have a different number of host target binding sites in untranslated regions of a VGAM1369 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1369 RNA, herein designated VGAM RNA, to host target binding sites on VGAM1369 host target RNA, herein designated VGAM HOST TARGET RNA, such as BINDING SITE I, BINDING SITE II and BINDING SITE III, inhibits translation of VGAM1369 host target RNA into VGAM1369 host target protein, herein designated VGAM HOST TARGET PROTEIN. VGAM host target protein is therefore outlined by a broken line.

It is appreciated that VGAM1369 host target gene, herein designated VGAM HOST TARGET GENE, in fact represents a plurality of VGAM1369 host target genes. The mRNA of each one of this plurality of VGAM1369 host target genes comprises one or more host target binding sites, each having a nucleotide sequence which is at least partly complementary to VGAM1369 RNA, herein designated VGAM RNA, and which when bound by VGAM1369 RNA causes inhibition of translation of respective one or more VGAM1369 host target proteins.

It is further appreciated by one skilled in the art that the mode of translational inhibition illustrated by FIG. 1 with specific reference to translational inhibition exerted by VGAM1369 gene, herein designated VGAM GENE, on one or more VGAM1369 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1369 is inhibition of expression of host target genes, as part of a novel viral mechanism of attacking a host. Accordingly, utilities of VGAM1369 include diagnosis, prevention and treatment of viral infection by Human Herpesvirus 6. Specific functions, and accordingly utilities, of VGAM1369 correlate with, and may be deduced from, the identity of the host target genes which VGAM1369 binds and inhibits, and the function of these host target genes, as elaborated hereinbelow.

Nucleotide sequences of the VGAM1369 precursor RNA, herein designated VGAM PRECURSOR RNA, and of the 'diced' VGAM1369 RNA, herein designated VGAM RNA, and a schematic representation of the secondary folding of VGAM1369 folded precursor RNA, herein designated VGAM FOLDED PRECURSOR RNA, of VGAM1369 are further described hereinbelow with reference to Table 1.

Nucleotide sequences of host target binding sites, such as BINDING SITE-I, BINDING SITE-II and BINDING SITE-III of FIG. 1, found on VGAM1369 host target RNA, and schematic representation of the complementarity of each of these host target binding sites to VGAM1369 RNA, herein designated VGAM RNA, are described hereinbelow with reference to Table 2.

As mentioned hereinabove with reference to FIG. 1, a function of VGAM1369 gene, herein designated VGAM is inhibition of expression of VGAM1369 target genes. It is appreciated that specific functions, and accordingly utilities, of VGAM1369 correlate with, and may be deduced from, the identity of the target genes which VGAM1369 binds and inhibits, and the function of these target genes, as elaborated hereinbelow.

ATP10C (Accession NM_024490) is a VGAM1369 host target gene. ATP10C BINDING SITE is HOST TARGET binding site found in the 3' untranslated region of mRNA encoded by ATP10C, corresponding to a HOST TARGET binding site such as BINDING SITE I, BINDING SITE II or BINDING SITE III. Table 2 illustrates the complementarity of the nucleotide sequences of ATP10C BINDING SITE, designated SEQ ID:23689, to the nucleotide sequence of VGAM1369 RNA, herein designated VGAM RNA, also designated SEQ ID:4080.

A function of VGAM1369 is therefore inhibition of ATP10C (Accession NM_024490), a gene which is phosphorylated in their intermediate state, drives uphill transport of ions across membranes. Accordingly, utilities of VGAM1369 include diagnosis, prevention and treatment of diseases and clinical conditions associated with ATP10C. The function of ATP10C and its association with various diseases and clinical conditions, has been established by previous studies, as described hereinabove with reference to VGAM801. Protein Tyrosine Phosphatase, Receptor Type, F (PTPRF, Accession NM_130440) is another VGAM1369 host target gene. PTPRF BINDING SITE1 and PTPRF BINDING SITE2 are HOST TARGET binding sites found in untranslated regions of mRNA encoded by PTPRF, corresponding to HOST TARGET binding sites such as BINDING SITE I, BINDING SITE II or BINDING SITE III. Table 2 illustrates the complementarity of the nucleotide sequences of PTPRF BINDING SITE1 and PTPRF BINDING SITE2, designated SEQ ID:28199 and SEQ ID:8725 respectively, to the nucleotide sequence of VGAM1369 RNA, herein designated VGAM RNA, also designated SEQ ID:4080.

Another function of VGAM1369 is therefore inhibition of Protein Tyrosine Phosphatase, Receptor Type, F (PTPRF, Accession NM_130440), a gene which negatively regulates the insulin signaling pathway. Accordingly, utilities of VGAM1369 include diagnosis, prevention and treatment of diseases and clinical conditions associated with PTPRF. The function of PTPRF and its association with various diseases and clinical conditions, has been established by previous studies, as described hereinabove with reference to VGAM1105. Cyclin M3 (CNNM3, Accession NM_017623) is another VGAM1369 host target gene. CNNM3 BINDING SITE is HOST TARGET binding site found in the 3' untranslated region of mRNA encoded by CNNM3, corresponding to a HOST TARGET binding site such as BINDING SITE I, BINDING SITE II or BINDING SITE III. Table 2 illustrates the complementarity of the nucleotide sequences of CNNM3 BINDING SITE, designated SEQ ID:19125, to the nucleotide sequence of VGAM1369 RNA, herein designated VGAM RNA, also designated SEQ ID:4080.

Another function of VGAM1369 is therefore inhibition of Cyclin M3 (CNNM3, Accession NM_017623). Accordingly, utilities of VGAM1369 include diagnosis, prevention and treatment of diseases and clinical conditions associated with CNNM3. KIAA1786 (Accession XM_038436) is another VGAM1369 host target gene. KIAA1786 BINDING SITE is HOST TARGET binding site found in the 3' untranslated region of mRNA encoded by KIAA1786, corresponding to a HOST TARGET binding site such as BINDING SITE I, BINDING SITE II or BINDING SITE III. Table 2 illustrates the complementarity of the nucleotide sequences of KIAA1786 BINDING SITE, designated SEQ ID:32847, to the nucleotide sequence of VGAM1369 RNA, herein designated VGAM RNA, also designated SEQ ID:4080.

Another function of VGAM1369 is therefore inhibition of KIAA1786 (Accession XM_038436). Accordingly, utilities of VGAM1369 include diagnosis, prevention and treatment of diseases and clinical conditions associated with KIAA1786. NY-REN-41 (Accession NM_080654) is another VGAM1369 host target gene. NY-REN-41 BINDING SITE is HOST TARGET binding site found in the 3' untranslated region of mRNA encoded by NY-REN-41, corresponding to a HOST TARGET binding site such as BINDING SITE I, BINDING SITE II or BINDING SITE III. Table 2 illustrates the complementarity of the nucleotide sequences of NY-REN-41 BINDING SITE, designated SEQ ID:27943, to the nucleotide sequence of VGAM1369 RNA, herein designated VGAM RNA, also designated SEQ ID:4080.

Another function of VGAM1369 is therefore inhibition of NY-REN-41 (Accession NM_080654). Accordingly, utilities of VGAM1369 include diagnosis, prevention and treatment of diseases and clinical conditions associated with NY-REN-41. Paralemmin (PALM, Accession NM_002579) is another VGAM1369 host target gene. PALM BINDING SITE is HOST TARGET binding site found in the 3' untranslated region of mRNA encoded by PALM, corresponding to a HOST TARGET binding site such as BINDING SITE I, BINDING SITE II or BINDING SITE III. Table 2 illustrates the complementarity of the nucleotide sequences of PALM BINDING SITE, designated SEQ ID:8440, to the nucleotide sequence of VGAM1369 RNA, herein designated VGAM RNA, also designated SEQ ID:4080.

Another function of VGAM1369 is therefore inhibition of Paralemmin (PALM, Accession NM_002579). Accordingly, utilities of VGAM1369 include diagnosis, prevention and treatment of diseases and clinical conditions associated with PALM. PC2 (positive cofactor 2, multiprotein complex) Glutamine/Q-rich-associated Protein (PCQAP, Accession NM_015889) is another VGAM1369 host target gene. PCQAP BINDING SITE is HOST TARGET binding site found in the 3' untranslated region of mRNA encoded by PCQAP, corresponding to a HOST TARGET binding site such as BINDING SITE I, BINDING SITE II or BINDING SITE III. Table 2 illustrates the complementarity of the nucleotide sequences of PCQAP BINDING SITE, designated SEQ ID:18034, to the nucleotide sequence of VGAM1369 RNA, herein designated VGAM RNA, also designated SEQ ID:4080.

Another function of VGAM1369 is therefore inhibition of PC2 (positive cofactor 2, multiprotein complex) Glutamine/Q-rich-associated Protein (PCQAP, Accession NM_015889). Accordingly, utilities of VGAM1369 include diagnosis, prevention and treatment of diseases and clinical conditions associated with PCQAP. LOC57019 (Accession NM_020313) is another VGAM1369 host target gene. LOC57019 BINDING SITE is HOST TARGET binding site found in the 3' untranslated region of mRNA encoded by LOC57019, corresponding to a HOST TARGET binding site such as BINDING SITE I, BINDING SITE II or BINDING SITE III. Table 2 illustrates the complementarity of the nucleotide sequences of LOC57019 BINDING SITE, designated SEQ ID:21569, to the nucleotide sequence of VGAM1369 RNA, herein designated VGAM RNA, also designated SEQ ID:4080.

Another function of VGAM1369 is therefore inhibition of LOC57019 (Accession NM_020313). Accordingly, utilities of VGAM1369 include diagnosis, prevention and treatment of diseases and clinical conditions associated with LOC57019. LOC90485 (Accession XM_032059) is another VGAM1369 host target gene. LOC90485 BINDING SITE is HOST TARGET binding site found in the 3' untranslated region of mRNA encoded by LOC90485, corresponding to a HOST TARGET binding site such as BINDING SITE I, BINDING SITE II or BINDING SITE III. Table 2 illustrates the complementarity of the nucleotide sequences of LOC90485 BINDING SITE, designated SEQ ID:31553, to the nucleotide sequence of VGAM1369 RNA, herein designated VGAM RNA, also designated SEQ ID:4080.

Another function of VGAM1369 is therefore inhibition of LOC90485 (Accession XM_032059). Accordingly, utilities of VGAM1369 include diagnosis, prevention and treatment of diseases and clinical conditions associated with LOC90485. FIG. 1 further provides a conceptual description of a novel bioinformatically detected viral gene of the present invention, referred to here as Viral Genomic Address Messenger 1370 (VGAM1370) viral gene, which modulates expression of respective host target genes thereof, the function and utility of which host target genes is known in the art.

VGAM1370 is a novel bioinformatically detected regulatory, non protein coding, viral micro RNA (miRNA) gene.

The method by which VGAM1370 was detected is described hereinabove with reference to FIGS. 1-8.

VGAM1370 gene, herein designated VGAM GENE, is a viral gene contained in the genome of Human Herpesvirus 6. VGAM1370 host target gene, herein designated VGAM HOST TARGET GENE, is a human gene contained in the human genome.

VGAM1370 gene encodes a VGAM1370 precursor RNA, herein designated VGAM PRECURSOR RNA. Similar to other miRNA genes, and unlike most ordinary genes, VGAM1370 precursor RNA does not encode a protein. A nucleotide sequence identical or highly similar to the nucleotide sequence of VGAM1370 precursor RNA is designated SEQ ID:1356, and is provided hereinbelow with reference to the sequence listing part. Nucleotide sequence SEQ ID:1356 is located at position 50239 relative to the genome of Human Herpesvirus 6.

VGAM1370 precursor RNA folds onto itself, forming VGAM1370 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1370 folded precursor RNA into VGAM1370 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1370 RNA is designated SEQ ID:4081, and is provided hereinbelow with reference to the sequence listing part.

VGAM1370 host target gene, herein designated VGAM HOST TARGET GENE, encodes a corresponding messenger RNA, VGAM1370 host target RNA, herein designated VGAM HOST TARGET RNA. VGAM1370 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1370 RNA, herein designated VGAM RNA, binds complementarily to one or more host target binding sites located in untranslated regions of VGAM1370 host target RNA, herein designated VGAM HOST TARGET RNA. This complementary binding is due to the fact that the nucleotide sequence of VGAM1370 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1370 RNA, herein designated VGAM RNA, may have a different number of host target binding sites in untranslated regions of a VGAM1370 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1370 RNA, herein designated VGAM RNA, to host target binding sites on VGAM1370 host target RNA, herein designated VGAM HOST TARGET RNA, such as BINDING SITE I, BINDING SITE II and BINDING SITE III, inhibits translation of VGAM1370 host target RNA into VGAM1370 host target protein, herein designated VGAM HOST TARGET PROTEIN. VGAM host target protein is therefore outlined by a broken line.

It is appreciated that VGAM1370 host target gene, herein designated VGAM HOST TARGET GENE, in fact represents a plurality of VGAM1370 host target genes. The mRNA of each one of this plurality of VGAM1370 host target genes comprises one or more host target binding sites, each having a nucleotide sequence which is at least partly complementary to VGAM1370 RNA, herein designated VGAM RNA, and which when bound by VGAM1370 RNA causes inhibition of translation of respective one or more VGAM1370 host target proteins.

It is further appreciated by one skilled in the art that the mode of translational inhibition illustrated by FIG. 1 with specific reference to translational inhibition exerted by VGAM1370 gene, herein designated VGAM GENE, on one or more VGAM1370 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1370 is inhibition of expression of host target genes, as part of a novel viral mechanism of attacking a host. Accordingly, utilities of VGAM1370 include diagnosis, prevention and treatment of viral infection by Human Herpesvirus 6. Specific functions, and accordingly utilities, of VGAM1370 correlate with, and may be deduced from, the identity of the host target genes which VGAM1370 binds and inhibits, and the function of these host target genes, as elaborated hereinbelow.

Nucleotide sequences of the VGAM1370 precursor RNA, herein designated VGAM PRECURSOR RNA, and of the 'diced' VGAM1370 RNA, herein designated VGAM RNA, and a schematic representation of the secondary folding of VGAM1370 folded precursor RNA, herein designated VGAM FOLDED PRECURSOR RNA, of VGAM1370 are further described hereinbelow with reference to Table 1.

Nucleotide sequences of host target binding sites, such as BINDING SITE-I, BINDING SITE-II and BINDING SITE-III of FIG. 1, found on VGAM1370 host target RNA, and schematic representation of the complementarity of each of these host target binding sites to VGAM1370 RNA, herein designated VGAM RNA, are described hereinbelow with reference to Table 2.

As mentioned hereinabove with reference to FIG. 1, a function of VGAM1370 gene, herein designated VGAM is inhibition of expression of VGAM1370 target genes. It is appreciated that specific functions, and accordingly utilities, of VGAM1370 correlate with, and may be deduced from, the identity of the target genes which VGAM1370 binds and inhibits, and the function of these target genes, as elaborated hereinbelow.

Membrane Component, Chromosome 17, Surface Marker 2 (ovarian carcinoma antigen CA125) (M17S2, Accession NM_031858) is a VGAM1370 host target gene. M17S2 BINDING SITE is HOST TARGET binding site found in the 5' untranslated region of mRNA encoded by M17S2, corresponding to a HOST TARGET binding site such as BINDING SITE I, BINDING SITE II or BINDING SITE III. Table 2 illustrates the complementarity of the nucleotide sequences of M17S2 BINDING SITE, designated SEQ ID:25608, to the nucleotide sequence of VGAM1370 RNA, herein designated VGAM RNA, also designated SEQ ID:4081.

A function of VGAM1370 is therefore inhibition of Membrane Component, Chromosome 17, Surface Marker 2 (ovarian carcinoma antigen CA125) (M17S2, Accession NM_031858), a gene which Contains a B-box/coiled coil motif. Accordingly, utilities of VGAM1370 include diagnosis, prevention and treatment of diseases and clinical conditions associated with M17S2. The function of M17S2 and its association with various diseases and clinical conditions, has been established by previous studies, as described hereinabove with reference to VGAM1081. Phosphoinositide-3-kinase, Regulatory Subunit, Polypeptide 3 (p55, gamma) (PIK3R3, Accession XM_027982) is another VGAM1370 host target gene. PIK3R3 BINDING SITE is HOST TARGET binding site found in the 3' untranslated region of mRNA encoded by PIK3R3, corresponding to a HOST TARGET binding site such as BINDING SITE I, BINDING SITE II or BINDING SITE III. Table 2 illustrates the complementarity of the nucleotide sequences of PIK3R3 BINDING SITE, designated SEQ ID:30603, to the nucleotide sequence of VGAM1370 RNA, herein designated VGAM RNA, also designated SEQ ID:4081.

Another function of VGAM1370 is therefore inhibition of Phosphoinositide-3-kinase, Regulatory Subunit, Polypeptide 3 (p55, gamma) (PIK3R3, Accession XM_027982). Accordingly, utilities of VGAM1370 include diagnosis, prevention and treatment of diseases and clinical conditions associated with PIK3R3. Zinc Finger Protein 10 (KOX 1) (ZNF10, Accession NM_015394) is another VGAM1370 host target gene. ZNF10 BINDING SITE is HOST TARGET binding site found in the 3' untranslated region of mRNA encoded by ZNF10, corresponding to a HOST TARGET binding site such as BINDING SITE I, BINDING SITE II or BINDING SITE III. Table 2 illustrates the complementarity of the nucleotide sequences of ZNF10 BINDING SITE, designated SEQ ID:17695, to the nucleotide sequence of VGAM1370 RNA, herein designated VGAM RNA, also designated SEQ ID:4081.

Another function of VGAM1370 is therefore inhibition of Zinc Finger Protein 10 (KOX 1) (ZNF10, Accession NM_015394), a gene which may function as a transcriptional regulator. Accordingly, utilities of VGAM1370 include diagnosis, prevention and treatment of diseases and clinical conditions associated with ZNF10. The function of ZNF10 and its association with various diseases and clinical conditions, has been established by previous studies, as described hereinabove with reference to VGAM36. DKFZP564I052 (Accession XM_039660) is another VGAM1370 host target gene. DKFZP564I052 BINDING SITE is HOST TARGET binding site found in the 3' untranslated region of mRNA encoded by DKFZP564I052, corresponding to a HOST TARGET binding site such as BINDING SITE I, BINDING SITE II or BINDING SITE III. Table 2 illustrates the complementarity of the nucleotide sequences of DKFZP564I052 BINDING SITE, designated SEQ ID:33136, to the nucleotide sequence of VGAM1370 RNA, herein designated VGAM RNA, also designated SEQ ID:4081.

Another function of VGAM1370 is therefore inhibition of DKFZP564I052 (Accession XM_039660). Accordingly, utilities of VGAM1370 include diagnosis, prevention and treatment of diseases and clinical conditions associated with DKFZP564I052. FEM-2 (Accession NM_014634) is another VGAM1370 host target gene. FEM-2 BINDING SITE is HOST TARGET binding site found in the 3' untranslated region of mRNA encoded by FEM-2, corresponding to a HOST TARGET binding site such as BINDING SITE I, BINDING SITE II or BINDING SITE III. Table 2 illustrates the complementarity of the nucleotide sequences of FEM-2 BINDING SITE, designated SEQ ID:16008, to the nucleotide sequence of VGAM1370 RNA, herein designated VGAM RNA, also designated SEQ ID:4081.

Another function of VGAM1370 is therefore inhibition of FEM-2 (Accession NM_014634). Accordingly, utilities of VGAM1370 include diagnosis, prevention and treatment of diseases and clinical conditions associated with FEM-2. Myosin, Heavy Polypeptide 10, Non-muscle (MYH10, Accession XM_044702) is another VGAM1370 host target gene. MYH10 BINDING SITE is HOST TARGET binding site found in the 5' untranslated region of mRNA encoded by MYH10, corresponding to a HOST TARGET binding site such as BINDING SITE I, BINDING SITE II or BINDING SITE III. Table 2 illustrates the complementarity of the nucleotide sequences of MYH10 BINDING SITE, designated SEQ ID:34263, to the nucleotide sequence of VGAM1370 RNA, herein designated VGAM RNA, also designated SEQ ID:4081.

Another function of VGAM1370 is therefore inhibition of Myosin, Heavy Polypeptide 10, Non-muscle (MYH10, Accession XM_044702). Accordingly, utilities of VGAM1370 include diagnosis, prevention and treatment of diseases and clinical conditions associated with MYH10. LOC201283 (Accession XM_017132) is another VGAM1370 host target gene. LOC201283 BINDING SITE is HOST TARGET binding site found in the 3' untranslated region of mRNA encoded by LOC201283, corresponding to a HOST TARGET binding site such as BINDING SITE I, BINDING SITE II or BINDING SITE III. Table 2 illustrates the complementarity of the nucleotide sequences of LOC201283 BINDING SITE, designated SEQ ID:30304, to the nucleotide sequence of VGAM1370 RNA, herein designated VGAM RNA, also designated SEQ ID:4081.

Another function of VGAM1370 is therefore inhibition of LOC201283 (Accession XM_017132). Accordingly, utilities of VGAM1370 include diagnosis, prevention and treatment of diseases and clinical conditions associated with LOC201283. LOC51321 (Accession NM_016627) is another VGAM1370 host target gene. LOC51321 BINDING SITE is HOST TARGET binding site found in the 5' untranslated region of mRNA encoded by LOC51321, corresponding to a HOST TARGET binding site such as BINDING SITE I, BINDING SITE II or BINDING SITE III. Table 2 illustrates the complementarity of the nucleotide sequences of LOC51321 BINDING SITE, designated SEQ ID:18742, to the nucleotide sequence of VGAM1370 RNA, herein designated VGAM RNA, also designated SEQ ID:4081.

Another function of VGAM1370 is therefore inhibition of LOC51321 (Accession NM_016627). Accordingly, utilities of VGAM1370 include diagnosis, prevention and treatment of diseases and clinical conditions associated with LOC51321. LOC91768 (Accession XM_040512) is another VGAM1370 host target gene. LOC91768 BINDING SITE is HOST TARGET binding site found in the 3' untranslated region of mRNA encoded by LOC91768, corresponding to a HOST TARGET binding site such as BINDING SITE I, BINDING SITE II or BINDING SITE III. Table 2 illustrates the complementarity of the nucleotide sequences of LOC91768 BINDING SITE, designated SEQ ID:33321, to the nucleotide sequence of VGAM1370 RNA, herein designated VGAM RNA, also designated SEQ ID:4081.

Another function of VGAM1370 is therefore inhibition of LOC91768 (Accession XM_040512). Accordingly, utilities of VGAM1370 include diagnosis, prevention and treatment of diseases and clinical conditions associated with LOC91768. FIG. 1 further provides a conceptual description of a novel bioinformatically detected viral gene of the present invention, referred to here as Viral Genomic Address Messenger 1371 (VGAM1371) viral gene, which modulates expression of respective host target genes thereof, the function and utility of which host target genes is known in the art.

VGAM1371 is a novel bioinformatically detected regulatory, non protein coding, viral micro RNA (miRNA) gene. The method by which VGAM1371 was detected is described hereinabove with reference to FIGS. 1-8.

VGAM1371 gene, herein designated VGAM GENE, is a viral gene contained in the genome of Human Herpesvirus 6. VGAM1371 host target gene, herein designated VGAM HOST TARGET GENE, is a human gene contained in the human genome.

VGAM1371 gene encodes a VGAM1371 precursor RNA, herein designated VGAM PRECURSOR RNA. Similar to other miRNA genes, and unlike most ordinary genes, VGAM1371 precursor RNA does not encode a protein. A nucleotide sequence identical or highly similar to the nucleotide sequence of VGAM1371 precursor RNA is designated SEQ ID:1357, and is provided hereinbelow with reference to the sequence listing part. Nucleotide sequence SEQ ID:1357 is located at position 46060 relative to the genome of Human Herpesvirus 6.

VGAM1371 precursor RNA folds onto itself, forming VGAM1371 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1371 folded precursor RNA into VGAM1371 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM1371 RNA is designated SEQ ID:4082, and is provided hereinbelow with reference to the sequence listing part.

VGAM1371 host target gene, herein designated VGAM HOST TARGET GENE, encodes a corresponding messenger RNA, VGAM1371 host target RNA, herein designated VGAM HOST TARGET RNA. VGAM1371 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1371 RNA, herein designated VGAM RNA, binds complementarily to one or more host target binding sites located in untranslated regions of VGAM1371 host target RNA, herein designated VGAM HOST TARGET RNA. This complementary binding is due to the fact that the nucleotide sequence of VGAM1371 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1371 RNA, herein designated VGAM RNA, may have a different number of host target binding sites in untranslated regions of a VGAM1371 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1371 RNA, herein designated VGAM RNA, to host target binding sites on VGAM1371 host target RNA, herein designated VGAM HOST TARGET RNA, such as BINDING SITE I, BINDING SITE II and BINDING SITE III, inhibits translation of VGAM1371 host target RNA into VGAM1371 host target protein, herein designated VGAM HOST TARGET PROTEIN. VGAM host target protein is therefore outlined by a broken line.

It is appreciated that VGAM1371 host target gene, herein designated VGAM HOST TARGET GENE, in fact represents a plurality of VGAM1371 host target genes. The mRNA of each one of this plurality of VGAM1371 host target genes comprises one or more host target binding sites, each having a nucleotide sequence which is at least partly complementary to VGAM1371 RNA, herein designated VGAM RNA, and which when bound by VGAM1371 RNA causes inhibition of translation of respective one or more VGAM1371 host target proteins.

It is further appreciated by one skilled in the art that the mode of translational inhibition illustrated by FIG. 1 with specific reference to translational inhibition exerted by VGAM1371 gene, herein designated VGAM GENE, on one or more VGAM1371 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1371 is inhibition of expression of host target genes, as part of a novel viral mechanism of attacking a host. Accordingly, utilities of VGAM1371 include diagnosis, prevention and treatment of viral infection by Human Herpesvirus 6. Specific functions, and accordingly utilities, of VGAM1371 correlate with, and may be deduced from, the identity of the host target genes which VGAM1371 binds and inhibits, and the function of these host target genes, as elaborated hereinbelow.

Nucleotide sequences of the VGAM1371 precursor RNA, herein designated VGAM PRECURSOR RNA, and of the 'diced' VGAM1371 RNA, herein designated VGAM RNA, and a schematic representation of the secondary folding of VGAM1371 folded precursor RNA, herein designated VGAM FOLDED PRECURSOR RNA, of VGAM1371 are further described hereinbelow with reference to Table 1.

Nucleotide sequences of host target binding sites, such as BINDING SITE-I, BINDING SITE-II and BINDING SITE-III of FIG. 1, found on VGAM1371 host target RNA, and schematic representation of the complementarity of each of these host target binding sites to VGAM1371 RNA, herein designated VGAM RNA, are described hereinbelow with reference to Table 2.

As mentioned hereinabove with reference to FIG. 1, a function of VGAM1371 gene, herein designated VGAM is inhibition of expression of VGAM1371 target genes. It is appreciated that specific functions, and accordingly utilities, of VGAM1371 correlate with, and may be deduced from, the identity of the target genes which VGAM1371 binds and inhibits, and the function of these target genes, as elaborated hereinbelow.

KIAA0092 (Accession NM_014679) is a VGAM1371 host target gene. KIAA0092 BINDING SITE is HOST TARGET binding site found in the 3' untranslated region of mRNA encoded by KIAA0092, corresponding to a HOST TARGET binding site such as BINDING SITE I, BINDING SITE II or BINDING SITE III. Table 2 illustrates the complementarity of the nucleotide sequences of KIAA0092 BINDING SITE, designated SEQ ID:16153, to the nucleotide sequence of VGAM1371 RNA, herein designated VGAM RNA, also designated SEQ ID:4082.

A function of VGAM1371 is therefore inhibition of KIAA0092 (Accession NM_014679). Accordingly, utilities of VGAM1371 include diagnosis, prevention and treatment of diseases and clinical conditions associated with KIAA0092. LOC221979 (Accession XM_166540) is another VGAM1371 host target gene. LOC221979 BINDING SITE is HOST TARGET binding site found in the 3' untranslated region of mRNA encoded by LOC221979, corresponding to a HOST TARGET binding site such as BINDING SITE I, BINDING SITE II or BINDING SITE III. Table 2 illustrates the complementarity of the nucleotide sequences of LOC221979 BINDING SITE, designated SEQ ID:44512, to the nucleotide sequence of VGAM1371 RNA, herein designated VGAM RNA, also designated SEQ ID:4082.

Another function of VGAM1371 is therefore inhibition of LOC221979 (Accession XM_166540). Accordingly, utilities of VGAM1371 include diagnosis, prevention and treatment of diseases and clinical conditions associated with LOC221979. FIG. 1 further provides a conceptual description of a novel bioinformatically detected viral gene of the present invention, referred to here as Viral Genomic Address Messenger 1372 (VGAM1372) viral gene, which modulates expression of respective host target genes thereof, the function and utility of which host target genes is known in the art.

VGAM1372 is a novel bioinformatically detected regulatory, non protein coding, viral micro RNA (miRNA) gene. The method by which VGAM1372 was detected is described hereinabove with reference to FIGS. 1-8.

VGAM1372 gene, herein designated VGAM GENE, is a viral gene contained in the genome of Alcelaphine Herpesvirus 1. VGAM1372 host target gene, herein designated VGAM HOST TARGET GENE, is a human gene contained in the human genome.

VGAM1372 gene encodes a VGAM1372 precursor RNA, herein designated VGAM PRECURSOR RNA. Similar to other miRNA genes, and unlike most ordinary genes, VGAM1372 precursor RNA does not encode a protein. A nucleotide sequence identical or highly similar to the nucleotide sequence of VGAM1372 precursor RNA is designated SEQ ID:1358, and is provided hereinbelow with reference to the sequence listing part. Nucleotide sequence SEQ ID:1358 is located at position 29852 relative to the genome of Alcelaphine Herpesvirus 1.

VGAM1372 precursor RNA folds onto itself, forming VGAM1372 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1372 folded precursor RNA into VGAM1372 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1372 RNA is designated SEQ ID:4083, and is provided hereinbelow with reference to the sequence listing part.

VGAM1372 host target gene, herein designated VGAM HOST TARGET GENE, encodes a corresponding messenger RNA, VGAM1372 host target RNA, herein designated VGAM HOST TARGET RNA. VGAM1372 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1372 RNA, herein designated VGAM RNA, binds complementarily to one or more host target binding sites located in untranslated regions of VGAM1372 host target RNA, herein designated VGAM HOST TARGET RNA. This complementary binding is due to the fact that the nucleotide sequence of VGAM1372 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1372 RNA, herein designated VGAM RNA, may have a different number of host target binding sites in untranslated regions of a VGAM1372 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1372 RNA, herein designated VGAM RNA, to host target binding sites on VGAM1372 host target RNA, herein designated VGAM HOST TARGET RNA, such as BINDING SITE I, BINDING SITE II and BINDING SITE III, inhibits translation of VGAM1372 host target RNA into VGAM1372 host target protein, herein designated VGAM HOST TARGET PROTEIN. VGAM host target protein is therefore outlined by a broken line.

It is appreciated that VGAM1372 host target gene, herein designated VGAM HOST TARGET GENE, in fact represents a plurality of VGAM1372 host target genes. The mRNA of each one of this plurality of VGAM1372 host target genes comprises one or more host target binding sites, each having a nucleotide sequence which is at least partly complementary to VGAM1372 RNA, herein designated VGAM RNA, and which when bound by VGAM1372 RNA causes inhibition of translation of respective one or more VGAM1372 host target proteins.

It is further appreciated by one skilled in the art that the mode of translational inhibition illustrated by FIG. 1 with specific reference to translational inhibition exerted by VGAM1372 gene, herein designated VGAM GENE, on one or more VGAM1372 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1372 is inhibition of expression of host target genes, as part of a novel viral mechanism of attacking a host. Accordingly, utilities of VGAM1372 include diagnosis, prevention and treatment of viral infection by Alcelaphine Herpesvirus 1. Specific functions, and accordingly utilities, of VGAM1372 correlate with, and may be deduced from, the identity of the host target genes which VGAM1372 binds and inhibits, and the function of these host target genes, as elaborated hereinbelow.

Nucleotide sequences of the VGAM1372 precursor RNA, herein designated VGAM PRECURSOR RNA, and of the 'diced' VGAM1372 RNA, herein designated VGAM RNA, and a schematic representation of the secondary folding of VGAM1372 folded precursor RNA, herein designated VGAM FOLDED PRECURSOR RNA, of VGAM1372 are further described hereinbelow with reference to Table 1.

Nucleotide sequences of host target binding sites, such as BINDING SITE-I, BINDING SITE-II and BINDING SITE-III of FIG. 1, found on VGAM1372 host target RNA, and schematic representation of the complementarity of each of these host target binding sites to VGAM1372 RNA, herein designated VGAM RNA, are described hereinbelow with reference to Table 2.

As mentioned hereinabove with reference to FIG. 1, a function of VGAM1372 gene, herein designated VGAM is inhibition of expression of VGAM1372 target genes. It is appreciated that specific functions, and accordingly utilities, of VGAM1372 correlate with, and may be deduced from, the identity of the target genes which VGAM1372 binds and inhibits, and the function of these target genes, as elaborated hereinbelow.

ATPase, H+ Transporting, Lysosomal 70 kDa, V1 Subunit A, Isoform 1 (ATP6V1A1, Accession NM_001690) is a VGAM1372 host target gene. ATP6V1A1 BINDING SITE is HOST TARGET binding site found in the 3' untranslated region of mRNA encoded by ATP6V1A1, corresponding to a HOST TARGET binding site such as BINDING SITE I, BINDING SITE II or BINDING SITE III. Table 2 illustrates the complementarity of the nucleotide sequences of ATP6V1A1 BINDING SITE, designated SEQ ID:7411, to the nucleotide sequence of VGAM1372 RNA, herein designated VGAM RNA, also designated SEQ ID:4083.

A function of VGAM1372 is therefore inhibition of ATPase, H+ Transporting, Lysosomal 70 kDa, V1 Subunit A, Isoform 1 (ATP6V1A1, Accession NM_001690), a gene which is responsible for acidifying a variety of intracellular compartments in eukaryotic cells. Accordingly, utilities of VGAM1372 include diagnosis, prevention and treatment of diseases and clinical conditions associated with ATP6V1A1. The function of ATP6V1A1 and its association with various diseases and clinical conditions, has been established by previous studies, as described hereinabove with reference to VGAM827. BTG Family, Member 2 (BTG2, Accession NM_006763) is another VGAM1372 host target gene. BTG2 BINDING SITE is HOST TARGET binding site found in the 3' untranslated region of mRNA encoded by BTG2, corresponding to a HOST TARGET binding site such as BINDING SITE I, BINDING SITE II or BINDING SITE III. Table 2 illustrates the complementarity of the nucleotide sequences of BTG2 BINDING SITE, designated SEQ ID:13631, to the nucleotide sequence of VGAM1372 RNA, herein designated VGAM RNA, also designated SEQ ID:4083.

Another function of VGAM1372 is therefore inhibition of BTG Family, Member 2 (BTG2, Accession NM_006763). Accordingly, utilities of VGAM1372 include diagnosis, prevention and treatment of diseases and clinical conditions associated with BTG2. Catalase (CAT, Accession NM_001752) is another VGAM1372 host target gene. CAT BINDING SITE is HOST TARGET binding site found in the 3' untranslated region of mRNA encoded by CAT, corresponding to a HOST TARGET binding site such as BINDING SITE I, BINDING SITE II or BINDING SITE III. Table 2 illustrates the complementarity of the nucleotide sequences of CAT BINDING SITE, designated SEQ ID:7488, to the nucleotide sequence of VGAM1372 RNA, herein designated VGAM RNA, also designated SEQ ID:4083.

Another function of VGAM1372 is therefore inhibition of Catalase (CAT, Accession NM_001752). Accordingly, utilities of VGAM1372 include diagnosis, prevention and treatment of diseases and clinical conditions associated with CAT. Core-binding Factor, Runt Domain, Alpha Subunit 2; Translocated To, 3 (CBFA2T3, Accession NM_005187) is another VGAM1372 host target gene. CBFA2T3 BINDING SITE is HOST TARGET binding site found in the 3' untranslated region of mRNA encoded by CBFA2T3, corresponding to a HOST TARGET binding site such as BINDING SITE I, BINDING SITE II or BINDING SITE III. Table 2 illustrates the complementarity of the nucleotide sequences of CBFA2T3 BINDING SITE, designated SEQ ID:11690, to the nucleotide sequence of VGAM1372 RNA, herein designated VGAM RNA, also designated SEQ ID:4083.

Another function of VGAM1372 is therefore inhibition of Core-binding Factor, Runt Domain, Alpha Subunit 2; Translocated To, 3 (CBFA2T3, Accession NM_005187). Accordingly, utilities of VGAM1372 include diagnosis, prevention and treatment of diseases and clinical conditions associated with CBFA2T3. GM2 Ganglioside Activator Protein (GM2A, Accession XM_041978) is another VGAM1372 host target gene. GM2A BINDING SITE is HOST TARGET binding site found in the 3' untranslated region of mRNA encoded by GM2A, corresponding to a HOST TARGET binding site such as BINDING SITE I, BINDING SITE II or BINDING SITE III. Table 2 illustrates the complementarity of the nucleotide sequences of GM2A BINDING SITE, designated SEQ ID:33657, to the nucleotide sequence of VGAM1372 RNA, herein designated VGAM RNA, also designated SEQ ID:4083.

Another function of VGAM1372 is therefore inhibition of GM2 Ganglioside Activator Protein (GM2A, Accession XM_041978). Accordingly, utilities of VGAM1372 include diagnosis, prevention and treatment of diseases and clinical conditions associated with GM2A. Mitogen-activated Protein Kinase 8 Interacting Protein 1 (MAPK8IP1, Accession NM_005456) is another VGAM1372 host target gene. MAPK8IP1 BINDING SITE is HOST TARGET binding site found in the 3' untranslated region of mRNA encoded by MAPK8IP1, corresponding to a HOST TARGET binding site such as BINDING SITE I, BINDING SITE II or BINDING SITE III. Table 2 illustrates the complementarity of the nucleotide sequences of MAPK8IP1 BINDING SITE, designated SEQ ID:11941, to the nucleotide sequence of VGAM1372 RNA, herein designated VGAM RNA, also designated SEQ ID:4083.

Another function of VGAM1372 is therefore inhibition of Mitogen-activated Protein Kinase 8 Interacting Protein 1 (MAPK8IP1, Accession NM_005456). Accordingly, utilities of VGAM1372 include diagnosis, prevention and treatment of diseases and clinical conditions associated with MAPK8IP1. Pyrroline-5-carboxylate Reductase 1 (PYCR1, Accession XM_046472) is another VGAM1372 host target gene. PYCR1 BINDING SITE is HOST TARGET binding site found in the 3' untranslated region of mRNA encoded by PYCR1, corresponding to a HOST TARGET binding site such as BINDING SITE I, BINDING SITE II or BINDING SITE III. Table 2 illustrates the complementarity of the nucleotide sequences of PYCR1 BINDING SITE, designated SEQ ID:34731, to the nucleotide sequence of VGAM1372 RNA, herein designated VGAM RNA, also designated SEQ ID:4083.

Another function of VGAM1372 is therefore inhibition of Pyrroline-5-carboxylate Reductase 1 (PYCR1, Accession XM_046472), a gene which catalyzes the NAD(P)H-dependent conversion of pyrroline-5-carboxylate to proline. Accordingly, utilities of VGAM1372 include diagnosis, prevention and treatment of diseases and clinical conditions associated with PYCR1. The function of PYCR1 and its association with various diseases and clinical conditions, has been established by previous studies, as described hereinabove with reference to VGAM178. Sal-like 2 (Drosophila) (SALL2, Accession XM_033473) is another VGAM1372 host target gene. SALL2 BINDING SITE is HOST TARGET binding site found in the 3' untranslated region of mRNA encoded by SALL2, corresponding to a HOST TARGET binding site such as BINDING SITE I, BINDING SITE II or BINDING SITE III. Table 2 illustrates the complementarity of the nucleotide sequences of SALL2 BINDING SITE, designated SEQ ID:31937, to the nucleotide sequence of VGAM1372 RNA, herein designated VGAM RNA, also designated SEQ ID:4083.

Another function of VGAM1372 is therefore inhibition of Sal-like 2 (Drosophila) (SALL2, Accession XM_033473). Accordingly, utilities of VGAM1372 include diagnosis, prevention and treatment of diseases and clinical conditions associated with SALL2. Selenoprotein X, 1 (SEPX1, Accession NM_016332) is another VGAM1372 host target gene. SEPX1 BINDING SITE is HOST TARGET binding site found in the 3' untranslated region of mRNA encoded by SEPX1, corresponding to a HOST TARGET binding site such as BINDING SITE I, BINDING SITE II or BINDING SITE III. Table 2 illustrates the complementarity of the nucleotide sequences of SEPX1 BINDING SITE, designated SEQ ID:18458, to the nucleotide sequence of VGAM1372 RNA, herein designated VGAM RNA, also designated SEQ ID:4083.

Another function of VGAM1372 is therefore inhibition of Selenoprotein X, 1 (SEPX1, Accession NM_016332). Accordingly, utilities of VGAM1372 include diagnosis, prevention and treatment of diseases and clinical conditions associated with SEPX1. FLJ11186 (Accession NM_018353) is another VGAM1372 host target gene. FLJ11186 BINDING SITE is HOST TARGET binding site found in the 3' untranslated region of mRNA encoded by FLJ11186, corresponding to a HOST TARGET binding site such as BINDING SITE I, BINDING SITE II or BINDING SITE III. Table 2 illustrates the complementarity of the nucleotide sequences of FLJ11186 BINDING SITE, designated SEQ ID:20368, to the nucleotide sequence of VGAM1372 RNA, herein designated VGAM RNA, also designated SEQ ID:4083.

Another function of VGAM1372 is therefore inhibition of FLJ11186 (Accession NM_018353). Accordingly, utilities of VGAM1372 include diagnosis, prevention and treatment of diseases and clinical conditions associated with FLJ11186. KIAA0367 (Accession XM_041018) is another VGAM1372 host target gene. KIAA0367 BINDING SITE is HOST TARGET binding site found in the 3' untranslated region of mRNA encoded by KIAA0367, corresponding to a HOST TARGET binding site such as BINDING SITE I, BINDING SITE II or BINDING SITE III. Table 2 illustrates the complementarity of the nucleotide sequences of KIAA0367 BINDING SITE, designated SEQ ID:33428, to the nucleotide sequence of VGAM1372 RNA, herein designated VGAM RNA, also designated SEQ ID:4083.

Another function of VGAM1372 is therefore inhibition of KIAA0367 (Accession XM_041018). Accordingly, utilities of VGAM1372 include diagnosis, prevention and treatment of diseases and clinical conditions associated with KIAA0367. KIAA0924 (Accession NM_014897) is another VGAM1372 host target gene. KIAA0924 BINDING SITE is HOST TARGET binding site found in the 3' untranslated region of mRNA encoded by KIAA0924, corresponding to a HOST TARGET binding site such as BINDING SITE I, BINDING SITE II or BINDING SITE III. Table 2 illustrates the complementarity of the nucleotide sequences of KIAA0924 BINDING SITE, designated SEQ ID:17069, to the nucleotide sequence of VGAM1372 RNA, herein designated VGAM RNA, also designated SEQ ID:4083.

Another function of VGAM1372 is therefore inhibition of KIAA0924 (Accession NM_014897). Accordingly, utilities of VGAM1372 include diagnosis, prevention and treatment of diseases and clinical conditions associated with KIAA0924. KIAA1503 (Accession XM_043197) is another VGAM1372 host target gene. KIAA1503 BINDING SITE is HOST TARGET binding site found in the 5' untranslated region of mRNA encoded by KIAA1503, corresponding to a HOST TARGET binding site such as BINDING SITE I, BINDING SITE II or BINDING SITE III. Table 2 illustrates the complementarity of the nucleotide sequences of KIAA1503 BINDING SITE, designated SEQ ID:33915, to the nucleotide sequence of VGAM1372 RNA, herein designated VGAM RNA, also designated SEQ ID:4083.

Another function of VGAM1372 is therefore inhibition of KIAA1503 (Accession XM_043197). Accordingly, utilities of VGAM1372 include diagnosis, prevention and treatment of diseases and clinical conditions associated with KIAA1503. Spermatid Perinuclear RNA Binding Protein (STRBP, Accession NM_018387) is another VGAM1372 host target gene. STRBP BINDING SITE is HOST TARGET binding site found in the 5' untranslated region of mRNA encoded by STRBP, corresponding to a HOST TARGET binding site such as BINDING SITE I, BINDING SITE II or BINDING SITE III. Table 2 illustrates the complementarity of the nucleotide sequences of STRBP BINDING SITE, designated SEQ ID:20419, to the nucleotide sequence of VGAM1372 RNA, herein designated VGAM RNA, also designated SEQ ID:4083.

Another function of VGAM1372 is therefore inhibition of Spermatid Perinuclear RNA Binding Protein (STRBP, Accession NM_018387). Accordingly, utilities of VGAM1372 include diagnosis, prevention and treatment of diseases and clinical conditions associated with STRBP. LOC134266 (Accession XM_059701) is another VGAM1372 host target gene. LOC134266 BINDING SITE is HOST TARGET binding site found in the 3' untranslated region of mRNA encoded by LOC134266, corresponding to a HOST TARGET binding site such as BINDING SITE I, BINDING SITE II or BINDING SITE III. Table 2 illustrates the complementarity of the nucleotide sequences of LOC134266 BINDING SITE, designated SEQ ID:37069, to the nucleotide sequence of VGAM1372 RNA, herein designated VGAM RNA, also designated SEQ ID:4083.

Another function of VGAM1372 is therefore inhibition of LOC134266 (Accession XM_059701). Accordingly, utilities of VGAM1372 include diagnosis, prevention and treatment of diseases and clinical conditions associated with LOC134266. LOC149506 (Accession XM_097661) is another VGAM1372 host target gene. LOC149506 BINDING SITE is HOST TARGET binding site found in the 3' untranslated region of mRNA encoded by LOC149506, corresponding to a HOST TARGET binding site such as BINDING SITE I, BINDING SITE II or BINDING SITE III. Table 2 illustrates the complementarity of the nucleotide sequences of LOC149506 BINDING SITE, designated SEQ ID:41007, to the nucleotide sequence of VGAM1372 RNA, herein designated VGAM RNA, also designated SEQ ID:4083.

Another function of VGAM1372 is therefore inhibition of LOC149506 (Accession XM_097661). Accordingly, utilities of VGAM1372 include diagnosis, prevention and treatment of diseases and clinical conditions associated with LOC149506. LOC158364 (Accession XM_088546) is another VGAM1372 host target gene. LOC158364 BINDING SITE is HOST TARGET binding site found in the 5' untranslated region of mRNA encoded by LOC158364, corresponding to a HOST TARGET binding site such as BINDING SITE I, BINDING SITE II or BINDING SITE III. Table 2 illustrates the complementarity of the nucleotide sequences of LOC158364 BINDING SITE, designated SEQ ID:39815, to the nucleotide sequence of VGAM1372 RNA, herein designated VGAM RNA, also designated SEQ ID:4083.

Another function of VGAM1372 is therefore inhibition of LOC158364 (Accession XM_088546). Accordingly, utilities of VGAM1372 include diagnosis, prevention and treatment of diseases and clinical conditions associated with LOC158364. LOC200470 (Accession XM_117235) is another VGAM1372 host target gene. LOC200470 BINDING SITE is HOST TARGET binding site found in the 5' untranslated region of mRNA encoded by LOC200470, corresponding to a HOST TARGET binding site such as BINDING SITE I, BINDING SITE II or BINDING SITE III. Table 2 illustrates the complementarity of the nucleotide sequences of LOC200470 BINDING SITE, designated SEQ ID:43310, to the nucleotide sequence of VGAM1372 RNA, herein designated VGAM RNA, also designated SEQ ID:4083.

Another function of VGAM1372 is therefore inhibition of LOC200470 (Accession XM_117235). Accordingly, utilities of VGAM1372 include diagnosis, prevention and treatment of diseases and clinical conditions associated with LOC200470. LOC201627 (Accession XM_114353) is another VGAM1372 host target gene. LOC201627 BINDING SITE is HOST TARGET binding site found in the 3' untranslated region of mRNA encoded by LOC201627, corresponding to a HOST TARGET binding site such as BINDING SITE I, BINDING SITE II or BINDING SITE III. Table 2 illustrates the complementarity of the nucleotide sequences of LOC201627 BINDING SITE, designated SEQ ID:42899, to the nucleotide sequence of VGAM1372 RNA, herein designated VGAM RNA, also designated SEQ ID:4083.

Another function of VGAM1372 is therefore inhibition of LOC201627 (Accession XM_114353). Accordingly, utilities of VGAM1372 include diagnosis, prevention and treatment of diseases and clinical conditions associated with LOC201627. LOC221042 (Accession XM_167669) is another VGAM1372 host target gene. LOC221042 BINDING SITE is HOST TARGET binding site found in the 5' untranslated region of mRNA encoded by LOC221042, corresponding to a HOST TARGET binding site such as BINDING SITE I, BINDING SITE II or BINDING SITE III. Table 2 illustrates the complementarity of the nucleotide sequences of LOC221042 BINDING SITE, designated SEQ ID:44755, to the nucleotide sequence of VGAM1372 RNA, herein designated VGAM RNA, also designated SEQ ID:4083.

Another function of VGAM1372 is therefore inhibition of LOC221042 (Accession XM_167669). Accordingly, utilities of VGAM1372 include diagnosis, prevention and treatment of diseases and clinical conditions associated with LOC221042. FIG. 1 further provides a conceptual description of a novel bioinformatically detected viral gene of the present invention, referred to here as Viral Genomic Address Messenger 1373 (VGAM1373) viral gene, which modulates expression of respective host target genes thereof, the function and utility of which host target genes is known in the art.

VGAM1373 is a novel bioinformatically detected regulatory, non protein coding, viral micro RNA (miRNA) gene. The method by which VGAM1373 was detected is described hereinabove with reference to FIGS. 1-8.

VGAM1373 gene, herein designated VGAM GENE, is a viral gene contained in the genome of Alcelaphine Herpesvirus 1. VGAM1373 host target gene, herein designated VGAM HOST TARGET GENE, is a human gene contained in the human genome.

VGAM1373 gene encodes a VGAM1373 precursor RNA, herein designated VGAM PRECURSOR RNA. Similar to other miRNA genes, and unlike most ordinary genes, VGAM1373 precursor RNA does not encode a protein. A nucleotide sequence identical or highly similar to the nucleotide sequence of VGAM1373 precursor RNA is designated SEQ ID:1359, and is provided hereinbelow with reference to the sequence listing part. Nucleotide sequence SEQ ID:1359 is located at position 26710 relative to the genome of Alcelaphine Herpesvirus 1.

VGAM1373 precursor RNA folds onto itself, forming VGAM1373 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1373 folded precursor RNA into VGAM1373 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1373 RNA is designated SEQ ID:4084, and is provided hereinbelow with reference to the sequence listing part.

VGAM1373 host target gene, herein designated VGAM HOST TARGET GENE, encodes a corresponding messenger RNA, VGAM1373 host target RNA, herein designated VGAM HOST TARGET RNA. VGAM1373 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1373 RNA, herein designated VGAM RNA, binds complementarily to one or more host target binding sites located in untranslated regions of VGAM1373 host target RNA, herein designated VGAM HOST TARGET RNA. This complementary binding is due to the fact that the nucleotide sequence of VGAM1373 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1373 RNA, herein designated VGAM RNA, may have a different number of host target binding sites in untranslated regions of a VGAM1373 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1373 RNA, herein designated VGAM RNA, to host target binding sites on VGAM1373 host target RNA, herein designated VGAM HOST TARGET RNA, such as BINDING SITE I, BINDING SITE II and BINDING SITE III, inhibits translation of VGAM1373 host target RNA into VGAM1373 host target protein, herein designated VGAM HOST TARGET PROTEIN. VGAM host target protein is therefore outlined by a broken line.

It is appreciated that VGAM1373 host target gene, herein designated VGAM HOST TARGET GENE, in fact represents a plurality of VGAM1373 host target genes. The mRNA of each one of this plurality of VGAM1373 host target genes comprises one or more host target binding sites, each having a nucleotide sequence which is at least partly complementary to VGAM1373 RNA, herein designated VGAM RNA, and which when bound by VGAM1373 RNA causes inhibition of translation of respective one or more VGAM1373 host target proteins.

It is further appreciated by one skilled in the art that the mode of translational inhibition illustrated by FIG. 1 with specific reference to translational inhibition exerted by VGAM1373 gene, herein designated VGAM GENE, on one or more VGAM1373 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1373 is inhibition of expression of host target genes, as part of a novel viral mechanism of attacking a host. Accordingly, utilities of VGAM1373 include diagnosis, prevention and treatment of viral infection by Alcelaphine Herpesvirus 1. Specific functions, and accordingly utilities, of VGAM1373 correlate with, and may be deduced from, the identity of the host target genes which VGAM1373 binds and inhibits, and the function of these host target genes, as elaborated hereinbelow.

Nucleotide sequences of the VGAM1373 precursor RNA, herein designated VGAM PRECURSOR RNA, and of the 'diced' VGAM1373 RNA, herein designated VGAM RNA, and a schematic representation of the secondary folding of VGAM1373 folded precursor RNA, herein designated VGAM FOLDED PRECURSOR RNA, of VGAM1373 are further described hereinbelow with reference to Table 1.

Nucleotide sequences of host target binding sites, such as BINDING SITE-I, BINDING SITE-II and BINDING SITE-III of FIG. 1, found on VGAM1373 host target RNA, and schematic representation of the complementarity of each of these host target binding sites to VGAM1373 RNA, herein designated VGAM RNA, are described hereinbelow with reference to Table 2.

As mentioned hereinabove with reference to FIG. 1, a function of VGAM1373 gene, herein designated VGAM is inhibition of expression of VGAM1373 target genes. It is appreciated that specific functions, and accordingly utilities, of VGAM1373 correlate with, and may be deduced from, the identity of the target genes which VGAM1373 binds and inhibits, and the function of these target genes, as elaborated hereinbelow.

Disrupted In Schizophrenia 1 (DISC1, Accession NM_018662) is a VGAM1373 host target gene. DISC1 BINDING SITE is HOST TARGET binding site found in the 3' untranslated region of mRNA encoded by DISC1, corresponding to a HOST TARGET binding site such as BINDING SITE I, BINDING SITE II or BINDING SITE III. Table 2 illustrates the complementarity of the nucleotide sequences of DISC1 BINDING SITE, designated SEQ ID:20741, to the nucleotide sequence of VGAM1373 RNA, herein designated VGAM RNA, also designated SEQ ID:4084.

A function of VGAM1373 is therefore inhibition of Disrupted In Schizophrenia 1 (DISC1, Accession NM_018662), a gene which has globular N-terminal domain(s) and a helical C-terminal domain. Accordingly, utilities of VGAM1373 include diagnosis, prevention and treatment of diseases and clinical conditions associated with DISC1. The function of DISC1 and its association with various diseases and clinical conditions, has been established by previous studies, as described hereinabove with reference to VGAM74. Epithelial V-like Antigen 1 (EVA1, Accession NM_005797) is another VGAM1373 host target gene. EVA1 BINDING SITE is HOST TARGET binding site found in the 3' untranslated region of mRNA encoded by EVA1, corresponding to a HOST TARGET binding site such as BINDING SITE I, BINDING SITE II or BINDING SITE III. Table 2 illustrates the complementarity of the nucleotide sequences of EVA1 BINDING SITE, designated SEQ ID:12380, to the nucleotide sequence of VGAM1373 RNA, herein designated VGAM RNA, also designated SEQ ID:4084.

Another function of VGAM1373 is therefore inhibition of Epithelial V-like Antigen 1 (EVA1, Accession NM_005797). Accordingly, utilities of VGAM1373 include diagnosis, prevention and treatment of diseases and clinical conditions associated with EVA1. Coagulation Factor XIII, A1 Polypeptide (F13A1, Accession XM_165833) is another VGAM1373 host target gene. F13A1 BINDING SITE is HOST TARGET binding site found in the 3' untranslated region of mRNA encoded by F13A1, corresponding to a HOST TARGET binding site such as BINDING SITE I, BINDING SITE II or BINDING SITE III. Table 2 illustrates the complementarity of the nucleotide sequences of F13A1 BINDING SITE, designated SEQ ID:43773, to the nucleotide sequence of VGAM1373 RNA, herein designated VGAM RNA, also designated SEQ ID:4084.

Another function of VGAM1373 is therefore inhibition of Coagulation Factor XIII, A1 Polypeptide (F13A1, Accession XM_165833). Accordingly, utilities of VGAM1373 include diagnosis, prevention and treatment of diseases and clinical conditions associated with F13A1. Glycoprotein M6A (GPM6A, Accession NM_005277) is another VGAM1373 host target gene. GPM6A BINDING SITE is HOST TARGET binding site found in the 3' untranslated region of mRNA encoded by GPM6A, corresponding to a HOST TARGET binding site such as BINDING SITE I, BINDING SITE II or BINDING SITE III. Table 2 illustrates the complementarity of the nucleotide sequences of GPM6A BINDING SITE, designated SEQ ID:11780, to the nucleotide sequence of VGAM1373 RNA, herein designated VGAM RNA, also designated SEQ ID:4084.

Another function of VGAM1373 is therefore inhibition of Glycoprotein M6A (GPM6A, Accession NM_005277), a gene which may play a role in neuronal development. Accordingly, utilities of VGAM1373 include diagnosis, prevention and treatment of diseases and clinical conditions associated with GPM6A. The function of GPM6A and its association with various diseases and clinical conditions, has been established by previous studies, as described hereinabove with reference to VGAM326. Kinesin Family Member 5C (KIF5C, Accession NM_004522) is another VGAM1373 host target gene. KIF5C BINDING SITE is HOST TARGET binding site found in the 3' untranslated region of mRNA encoded by KIF5C, corresponding to a HOST TARGET binding site such as BINDING SITE I, BINDING SITE II or BINDING SITE III. Table 2 illustrates the complementarity of the nucleotide sequences of KIF5C BINDING SITE, designated SEQ ID:10851, to the nucleotide sequence of VGAM1373 RNA, herein designated VGAM RNA, also designated SEQ ID:4084.

Another function of VGAM1373 is therefore inhibition of Kinesin Family Member 5C (KIF5C, Accession NM_004522). Accordingly, utilities of VGAM1373 include diagnosis, prevention and treatment of diseases and clinical conditions associated with KIF5C. Microtubule-associated Protein 7 (MAP7, Accession NM_003980) is another VGAM1373 host target gene. MAP7 BINDING SITE is HOST TARGET binding site found in the 3' untranslated region of mRNA encoded by MAP7, corresponding to a HOST TARGET binding site such as BINDING SITE I, BINDING SITE II or BINDING SITE III. Table 2 illustrates the complementarity of the nucleotide sequences of MAP7 BINDING SITE, designated SEQ ID:10117, to the nucleotide sequence of VGAM1373 RNA, herein designated VGAM RNA, also designated SEQ ID:4084.

Another function of VGAM1373 is therefore inhibition of Microtubule-associated Protein 7 (MAP7, Accession NM_003980), a gene which Microtubule-associated protein 7; stabilizes microtubules, may help establish epithelial cell polarity. Accordingly, utilities of VGAM1373 include diagnosis, prevention and treatment of diseases and clinical conditions associated with MAP7. The function of MAP7 has been established by previous studies. By screening a HeLa cell expression library with antisera raised against crude microtubule-binding proteins from HeLa cells, Masson and Kreis (1993) isolated cDNAs encoding MAP7, which they designated EMAP115. The predicted 749-amino acid protein has a calculated molecular mass of 84 kD, although it migrates anomalously at 115 kD by SDS-PAGE. EMAP115 contains a basic, highly charged N-terminal region that is separated from an acidic C-terminal half by a stretch of amino acids rich in proline and alanine (PAPA region). The N-terminal basic domain contains the EMAP115 microtubule-binding site. Using immunoblots, the authors determined that EMAP115 is predominantly expressed in cells of epithelial origin. Immunofluorescence and immunoelectron microscopy indicated that it is specifically associated with microtubules in HeLa cells. Overexpression of the N-terminal microtubule-binding domain in monkey fibroblasts, which do not have significant levels of endogenous EMAP115, led to stabilization of microtubules. Masson and Kreis (1993) concluded that EMAP115 is a microtubule-stabilizing protein that may play an important role in reorganization of microtubules during polarization and differentiation of epithelial cells. Vitamin A deficiency causes a number of defects, including deficient spermatogenesis. Almost all of these defects are reversible by the administration of a vitamin A metabolite, retinoic acid (RA), which binds and activates 2 types of receptor families, RAR (e.g., RARA; 180240) and RXR (e.g., RXRA; 180245). Using gene trap mutagenesis on mouse embryonic stem (ES) cells, Komada et al. (2000) identified MAP7 as an RA-responsive gene. The gene trap insertion led to a mutation in the Map7 gene that the authors designated ROSA63. Northern blot analysis detected broad expression of a 3.4-kb Map7 transcript, as well as a testis-specific 2.5-kb transcript, in wildtype mice, with lower expression in heterozygous ROSA63 mice and no expression in homozygous ROSA63 mice, consistent with a null allele. The authors showed that RA induces Map7 expression in ES cells in vitro and in vitamin A-deficient mice in vivo. Male mice with the ROSA63 mutation, though able to copulate, were sterile and had smaller testes and epididymis than wildtype mice, while other organs were of normal size. Histologic analysis showed that ROSA63 mutant mice exhibited defective spermatogenesis, with spermatid deformation in the first wave of spermatogenesis and subsequent germ cell loss. Both of these abnormalities were associated with morphologically abnormal MTs in the manchette of the spermatids and in Sertoli cells. Komada et al. (2000) noted that similar defects occur in Rara knockout mice, but not in other RA receptor knockout mice.

Full details of the abovementioned studies are described in the following publications, the disclosure of which are hereby incorporated by reference:

Komada, M.; McLean, D. J.; Griswold, M. D.; Russell, L. D.; Soriano, P.: E-MAP-115, encoding a microtubule-associated protein, is a retinoic acid-inducible gene required for spermatogenesis. Genes Dev. 14:1332-1342, 2000; and Masson, D.; Kreis, T. E.: Identification and molecular characterization of E-MAP-115, a novel microtubule-associated protein predominantly expressed in epithelial cells. J. Cell Biol.

Further studies establishing the function and utilities of MAP7 are found in John Hopkins OMIM database record ID 604108, and in sited publications numbered 7059-7060 listed in the bibliography section hereinbelow, which are also hereby incorporated by reference. Recombination Activating Gene 1 (RAG1, Accession NM_000448) is another VGAM1373 host target gene. RAG1 BINDING SITE is HOST TARGET binding site found in the 3' untranslated region of mRNA encoded by RAG1, corresponding to a HOST TARGET binding site such as BINDING SITE I, BINDING SITE II or BINDING SITE III. Table 2 illustrates the complementarity of the nucleotide sequences of RAG1 BINDING SITE, designated SEQ ID:6043, to the nucleotide sequence of VGAM1373 RNA, herein designated VGAM RNA, also designated SEQ ID:4084.

Another function of VGAM1373 is therefore inhibition of Recombination Activating Gene 1 (RAG1, Accession NM_000448). Accordingly, utilities of VGAM1373 include diagnosis, prevention and treatment of diseases and clinical conditions associated with RAG1. Transcription Factor Dp-2 (E2F dimerization partner 2) (TFDP2, Accession NM_006286) is another VGAM1373 host target gene. TFDP2 BINDING SITE is HOST TARGET binding site found in the 3' untranslated region of mRNA encoded by TFDP2, corresponding to a HOST TARGET binding site such as BINDING SITE I, BINDING SITE II or BINDING SITE III. Table 2 illustrates the complementarity of the nucleotide sequences of TFDP2 BINDING SITE, designated SEQ ID:12974, to the nucleotide sequence of VGAM1373 RNA, herein designated VGAM RNA, also designated SEQ ID:4084.

Another function of VGAM1373 is therefore inhibition of Transcription Factor Dp-2 (E2F dimerization partner 2) (TFDP2, Accession NM_006286), a gene which is required for the progression of S-phase during the cell cycle. Accordingly, utilities of VGAM1373 include diagnosis, prevention and treatment of diseases and clinical conditions associated with TFDP2. The function of TFDP2 and its association with various diseases and clinical conditions, has been established by previous studies, as described hereinabove with reference to VGAM222. KIAA1819 (Accession XM_045716) is another VGAM1373 host target gene. KIAA1819 BINDING SITE is HOST TARGET binding site found in the 3' untranslated region of mRNA encoded by KIAA1819, corresponding to a HOST TARGET binding site such as BINDING SITE I, BINDING SITE II or BINDING SITE III. Table 2 illustrates the complementarity of the nucleotide sequences of KIAA1819 BINDING SITE, designated SEQ ID:34537, to the nucleotide sequence of VGAM1373 RNA, herein designated VGAM RNA, also designated SEQ ID:4084.

Another function of VGAM1373 is therefore inhibition of KIAA1819 (Accession XM_045716). Accordingly, utilities of VGAM1373 include diagnosis, prevention and treatment of diseases and clinical conditions associated with KIAA1819. MGC15619 (Accession NM_032369) is another VGAM1373 host target gene. MGC15619 BINDING SITE is HOST TARGET binding site found in the 5' untranslated region of mRNA encoded by MGC15619, corresponding to a HOST TARGET binding site such as BINDING SITE I, BINDING SITE II or BINDING SITE III. Table 2 illustrates the complementarity of the nucleotide sequences of MGC15619 BINDING SITE, designated SEQ ID:26157, to the nucleotide sequence of VGAM1373 RNA, herein designated VGAM RNA, also designated SEQ ID:4084.

Another function of VGAM1373 is therefore inhibition of MGC15619 (Accession NM_032369). Accordingly, utilities of VGAM1373 include diagnosis, prevention and treatment of diseases and clinical conditions associated with MGC15619. LOC115294 (Accession XM_054302) is another VGAM1373 host target gene. LOC115294 BINDING SITE is HOST TARGET binding site found in the 3' untranslated region of mRNA encoded by LOC115294, corresponding to a HOST TARGET binding site such as BINDING SITE I, BINDING SITE II or BINDING SITE III. Table 2 illustrates the complementarity of the nucleotide sequences of LOC115294 BINDING SITE, designated SEQ ID:36146, to the nucleotide sequence of VGAM1373 RNA, herein designated VGAM RNA, also designated SEQ ID:4084.

Another function of VGAM1373 is therefore inhibition of LOC115294 (Accession XM_054302). Accordingly, utilities of VGAM1373 include diagnosis, prevention and treatment of diseases and clinical conditions associated with LOC115294. LOC158357 (Accession XM_088553) is another VGAM1373 host target gene. LOC158357 BINDING SITE is HOST TARGET binding site found in the 3' untranslated region of mRNA encoded by LOC158357, corresponding to a HOST TARGET binding site such as BINDING SITE I, BINDING SITE II or BINDING SITE III. Table 2 illustrates the complementarity of the nucleotide sequences of LOC158357 BINDING SITE, designated SEQ ID:39820, to the nucleotide sequence of VGAM1373 RNA, herein designated VGAM RNA, also designated SEQ ID:4084.

Another function of VGAM1373 is therefore inhibition of LOC158357 (Accession XM_088553). Accordingly, utilities of VGAM1373 include diagnosis, prevention and treatment of diseases and clinical conditions associated with LOC158357. LOC256905 (Accession XM_173031) is another VGAM1373 host target gene. LOC256905 BINDING SITE is HOST TARGET binding site found in the 3' untranslated region of mRNA encoded by LOC256905, corresponding to a HOST TARGET binding site such as BINDING SITE I, BINDING SITE II or BINDING SITE III. Table 2 illustrates the complementarity of the nucleotide sequences of LOC256905 BINDING SITE, designated SEQ ID:46295, to the nucleotide sequence of VGAM1373 RNA, herein designated VGAM RNA, also designated SEQ ID:4084.

Another function of VGAM1373 is therefore inhibition of LOC256905 (Accession XM_173031). Accordingly, utilities of VGAM1373 include diagnosis, prevention and treatment of diseases and clinical conditions associated with LOC256905. FIG. 1 further provides a conceptual description of a novel bioinformatically detected viral gene of the present invention, referred to here as Viral Genomic Address Messenger 1374 (VGAM1374) viral gene, which modulates expression of respective host target genes thereof, the function and utility of which host target genes is known in the art.

VGAM1374 is a novel bioinformatically detected regulatory, non protein coding, viral micro RNA (miRNA) gene. The method by which VGAM1374 was detected is described hereinabove with reference to FIGS. 1-8.

VGAM1374 gene, herein designated VGAM GENE, is a viral gene contained in the genome of Alcelaphine Herpesvirus 1. VGAM1374 host target gene, herein designated VGAM HOST TARGET GENE, is a human gene contained in the human genome.

VGAM1374 gene encodes a VGAM1374 precursor RNA, herein designated VGAM PRECURSOR RNA. Similar to other miRNA genes, and unlike most ordinary genes, VGAM1374 precursor RNA does not encode a protein. A nucleotide sequence identical or highly similar to the nucleotide sequence of VGAM1374 precursor RNA is designated SEQ ID:1360, and is provided hereinbelow with reference to the sequence listing part. Nucleotide sequence SEQ ID:1360 is located at position 27936 relative to the genome of Alcelaphine Herpesvirus 1.

VGAM1374 precursor RNA folds onto itself, forming VGAM1374 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1374 folded precursor RNA into VGAM1374 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1374 RNA is designated SEQ ID:4085, and is provided hereinbelow with reference to the sequence listing part.

VGAM1374 host target gene, herein designated VGAM HOST TARGET GENE, encodes a corresponding messenger RNA, VGAM1374 host target RNA, herein designated VGAM HOST TARGET RNA. VGAM1374 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1374 RNA, herein designated VGAM RNA, binds complementarily to one or more host target binding sites located in untranslated regions of VGAM1374 host target RNA, herein designated VGAM HOST TARGET RNA. This complementary binding is due to the fact that the nucleotide sequence of VGAM1374 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1374 RNA, herein designated VGAM RNA, may have a different number of host target binding sites in untranslated regions of a VGAM1374 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1374 RNA, herein designated VGAM RNA, to host target binding sites on VGAM1374 host target RNA, herein designated VGAM HOST TARGET RNA, such as BINDING SITE I, BINDING SITE II and BINDING SITE III, inhibits translation of VGAM1374 host target RNA into VGAM1374 host target protein, herein designated VGAM HOST TARGET PROTEIN. VGAM host target protein is therefore outlined by a broken line.

It is appreciated that VGAM1374 host target gene, herein designated VGAM HOST TARGET GENE, in fact represents a plurality of VGAM1374 host target genes. The mRNA of each one of this plurality of VGAM1374 host target genes comprises one or more host target binding sites, each having a nucleotide sequence which is at least partly complementary to VGAM1374 RNA, herein designated VGAM RNA, and which when bound by VGAM1374 RNA causes inhibition of translation of respective one or more VGAM1374 host target proteins.

It is further appreciated by one skilled in the art that the mode of translational inhibition illustrated by FIG. 1 with specific reference to translational inhibition exerted by VGAM1374 gene, herein designated VGAM GENE, on one or more VGAM1374 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1374 is inhibition of expression of host target genes, as part of a novel viral mechanism of attacking a host. Accordingly, utilities of VGAM1374 include diagnosis, prevention and treatment of viral infection by Alcelaphine Herpesvirus 1. Specific functions, and accordingly utilities, of VGAM1374 correlate with, and may be deduced from, the identity of the host target genes which VGAM1374 binds and inhibits, and the function of these host target genes, as elaborated hereinbelow.

Nucleotide sequences of the VGAM1374 precursor RNA, herein designated VGAM PRECURSOR RNA, and of the 'diced' VGAM1374 RNA, herein designated VGAM RNA, and a schematic representation of the secondary folding of VGAM1374 folded precursor RNA, herein designated VGAM FOLDED PRECURSOR RNA, of VGAM1374 are further described hereinbelow with reference to Table 1.

Nucleotide sequences of host target binding sites, such as BINDING SITE-I, BINDING SITE-II and BINDING SITE-III of FIG. 1, found on VGAM1374 host target RNA, and schematic representation of the complementarity of each of these host target binding sites to VGAM1374 RNA, herein designated VGAM RNA, are described hereinbelow with reference to Table 2.

As mentioned hereinabove with reference to FIG. 1, a function of VGAM1374 gene, herein designated VGAM is inhibition of expression of VGAM1374 target genes. It is appreciated that specific functions, and accordingly utilities, of VGAM1374 correlate with, and may be deduced from, the identity of the target genes which VGAM1374 binds and inhibits, and the function of these target genes, as elaborated hereinbelow.

Cannabinoid Receptor 1 (brain) (CNR1, Accession NM_016083) is a VGAM1374 host target gene. CNR1 BINDING SITE is HOST TARGET binding site found in the 3' untranslated region of mRNA encoded by CNR1, corresponding to a HOST TARGET binding site such as BINDING SITE I, BINDING SITE II or BINDING SITE III. Table 2 illustrates the complementarity of the nucleotide sequences of CNR1 BINDING SITE, designated SEQ ID:18160, to the nucleotide sequence of VGAM1374 RNA, herein designated VGAM RNA, also designated SEQ ID:4085.

A function of VGAM1374 is therefore inhibition of Cannabinoid Receptor 1 (brain) (CNR1, Accession NM_016083), a gene which is involved in the cannabinoid-induced CNS effects. Accordingly, utilities of VGAM1374 include diagnosis, prevention and treatment of diseases and clinical conditions associated with CNR1. The function of CNR1 and its association with various diseases and clinical conditions, has been established by previous studies, as described hereinabove with reference to VGAM533. Killer Cell Lectin-like Receptor Subfamily G, Member 1 (KLRG1, Accession NM_005810) is another VGAM1374 host target gene. KLRG1 BINDING SITE is HOST TARGET binding site found in the 3' untranslated region of mRNA encoded by KLRG1, corresponding to a HOST TARGET binding site such as BINDING SITE I, BINDING SITE II or BINDING SITE III. Table 2 illustrates the complementarity of the nucleotide sequences of KLRG1 BINDING SITE, designated SEQ ID:12391, to the nucleotide sequence of VGAM1374 RNA, herein designated VGAM RNA, also designated SEQ ID:4085.

Another function of VGAM1374 is therefore inhibition of Killer Cell Lectin-like Receptor Subfamily G, Member 1 (KLRG1, Accession NM_005810), a gene which plays a role in host defense. Accordingly, utilities of VGAM1374 include diagnosis, prevention and treatment of diseases and clinical conditions associated with KLRG1. The function of KLRG1 and its association with various diseases and clinical conditions, has been established by previous studies, as described hereinabove with reference to VGAM648. FLJ25416 (Accession NM_145018) is another VGAM1374 host target gene. FLJ25416 BINDING SITE is HOST TARGET binding site found in the 3' untranslated region of mRNA encoded by FLJ25416, corresponding to a HOST TARGET binding site such as BINDING SITE I, BINDING SITE II or BINDING SITE III. Table 2 illustrates the complementarity of the nucleotide sequences of FLJ25416 BINDING SITE, designated SEQ ID:29623, to the nucleotide sequence of VGAM1374 RNA, herein designated VGAM RNA, also designated SEQ ID:4085.

Another function of VGAM1374 is therefore inhibition of FLJ25416 (Accession NM_145018). Accordingly, utilities of VGAM1374 include diagnosis, prevention and treatment of diseases and clinical conditions associated with FLJ25416. PFTAIRE Protein Kinase 1 (PFTK1, Accession NM_012395) is another VGAM1374 host target gene. PFTK1 BINDING SITE is HOST TARGET binding site found in the 3' untranslated region of mRNA encoded by PFTK1, corresponding to a HOST TARGET binding site such as BINDING SITE I, BINDING SITE II or BINDING SITE III. Table 2 illustrates the complementarity of the nucleotide sequences of PFTK1 BINDING SITE, designated SEQ ID:14749, to the nucleotide sequence of VGAM1374 RNA, herein designated VGAM RNA, also designated SEQ ID:4085.

Another function of VGAM1374 is therefore inhibition of PFTAIRE Protein Kinase 1 (PFTK1, Accession NM_012395). Accordingly, utilities of VGAM1374 include diagnosis, prevention and treatment of diseases and clinical conditions associated with PFTK1. FIG. 1 further provides a conceptual description of a novel bioinformatically detected viral gene of the present invention, referred to here as Viral Genomic Address Messenger 1375 (VGAM1375) viral gene, which modulates expression of respective host target genes thereof, the function and utility of which host target genes is known in the art.

VGAM1375 is a novel bioinformatically detected regulatory, non protein coding, viral micro RNA (miRNA) gene. The method by which VGAM1375 was detected is described hereinabove with reference to FIGS. 1-8.

VGAM1375 gene, herein designated VGAM GENE, is a viral gene contained in the genome of Alcelaphine Herpesvirus 1. VGAM1375 host target gene, herein designated VGAM HOST TARGET GENE, is a human gene contained in the human genome.

VGAM1375 gene encodes a VGAM1375 precursor RNA, herein designated VGAM PRECURSOR RNA. Similar to other miRNA genes, and unlike most ordinary genes, VGAM1375 precursor RNA does not encode a protein. A nucleotide sequence identical or highly similar to the nucleotide sequence of VGAM1375 precursor RNA is designated SEQ ID:1361, and is provided hereinbelow with reference to the sequence listing part. Nucleotide sequence SEQ ID:1361 is located at position 32330 relative to the genome of Alcelaphine Herpesvirus 1.

VGAM1375 precursor RNA folds onto itself, forming VGAM1375 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1375 folded precursor RNA into VGAM1375 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1375 RNA is designated SEQ ID:4086, and is provided hereinbelow with reference to the sequence listing part.

VGAM1375 host target gene, herein designated VGAM HOST TARGET GENE, encodes a corresponding messenger RNA, VGAM1375 host target RNA, herein designated VGAM HOST TARGET RNA. VGAM1375 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1375 RNA, herein designated VGAM RNA, binds complementarily to one or more host target binding sites located in untranslated regions of VGAM1375 host target RNA, herein designated VGAM HOST TARGET RNA. This complementary binding is due to the fact that the nucleotide sequence of VGAM1375 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1375 RNA, herein designated VGAM RNA, may have a different number of host target binding sites in untranslated regions of a VGAM1375 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1375 RNA, herein designated VGAM RNA, to host target binding sites on VGAM1375 host target RNA, herein designated VGAM HOST TARGET RNA, such as BINDING SITE I, BINDING SITE II and BINDING SITE III, inhibits translation of VGAM1375 host target RNA into VGAM1375 host target protein, herein designated VGAM HOST TARGET PROTEIN. VGAM host target protein is therefore outlined by a broken line.

It is appreciated that VGAM1375 host target gene, herein designated VGAM HOST TARGET GENE, in fact represents a plurality of VGAM1375 host target genes. The mRNA of each one of this plurality of VGAM1375 host target genes comprises one or more host target binding sites, each having a nucleotide sequence which is at least partly complementary to VGAM1375 RNA, herein designated VGAM RNA, and which when bound by VGAM1375 RNA causes inhibition of translation of respective one or more VGAM1375 host target proteins.

It is further appreciated by one skilled in the art that the mode of translational inhibition illustrated by FIG. 1 with specific reference to translational inhibition exerted by VGAM1375 gene, herein designated VGAM GENE, on one or more VGAM1375 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1375 is inhibition of expression of host target genes, as part of a novel viral mechanism of attacking a host. Accordingly, utilities of VGAM1375 include diagnosis, prevention and treatment of viral infection by Alcelaphine Herpesvirus 1. Specific functions, and accordingly utilities, of VGAM1375 correlate with, and may be deduced from, the identity of the host target genes which VGAM1375 binds and inhibits, and the function of these host target genes, as elaborated hereinbelow.

Nucleotide sequences of the VGAM1375 precursor RNA, herein designated VGAM PRECURSOR RNA, and of the 'diced' VGAM1375 RNA, herein designated VGAM RNA, and a schematic representation of the secondary folding of VGAM1375 folded precursor RNA, herein designated VGAM FOLDED PRECURSOR RNA, of VGAM1375 are further described hereinbelow with reference to Table 1.

Nucleotide sequences of host target binding sites, such as BINDING SITE-I, BINDING SITE-II and BINDING SITE-III of FIG. 1, found on VGAM1375 host target RNA, and schematic representation of the complementarity of each of these host target binding sites to VGAM1375 RNA, herein designated VGAM RNA, are described hereinbelow with reference to Table 2.

As mentioned hereinabove with reference to FIG. 1, a function of VGAM1375 gene, herein designated VGAM is inhibition of expression of VGAM1375 target genes. It is appreciated that specific functions, and accordingly utilities, of VGAM1375 correlate with, and may be deduced from, the identity of the target genes which VGAM1375 binds and inhibits, and the function of these target genes, as elaborated hereinbelow.

Solute Carrier Family 17 (anion/sugar transporter), Member 5 (SLC17A5, Accession NM_012434) is a VGAM1375 host target gene. SLC17A5 BINDING SITE is HOST TARGET binding site found in the 3' untranslated region of mRNA encoded by SLC17A5, corresponding to a HOST TARGET binding site such as BINDING SITE I, BINDING SITE II or BINDING SITE III. Table 2 illustrates the complementarity of the nucleotide sequences of SLC17A5 BINDING SITE, designated SEQ ID:14813, to the nucleotide sequence of VGAM1375 RNA, herein designated VGAM RNA, also designated SEQ ID:4086.

A function of VGAM1375 is therefore inhibition of Solute Carrier Family 17 (anion/sugar transporter), Member 5 (SLC17A5, Accession NM_012434), a gene which is a member of a family of anion/cation symporters. Accordingly, utilities of VGAM1375 include diagnosis, prevention and treatment of diseases and clinical conditions associated with SLC17A5. The function of SLC17A5 and its association with various diseases and clinical conditions, has been established by previous studies, as described hereinabove with reference to VGAM766. Spectrin, Beta, Non-erythrocytic 1 (SPTBN1, Accession NM_003128) is another VGAM1375 host target gene. SPTBN1 BINDING SITE is HOST TARGET binding site found in the 5' untranslated region of mRNA encoded by SPTBN1, corresponding to a HOST TARGET binding site such as BINDING SITE I, BINDING SITE II or BINDING SITE III. Table 2 illustrates the complementarity of the nucleotide sequences of SPTBN1 BINDING SITE, designated SEQ ID:9095, to the nucleotide sequence of VGAM1375 RNA, herein designated VGAM RNA, also designated SEQ ID:4086.

Another function of VGAM1375 is therefore inhibition of Spectrin, Beta, Non-erythrocytic 1 (SPTBN1, Accession NM_003128), a gene which seems to be involved in secretion. Accordingly, utilities of VGAM1375 include diagnosis, prevention and treatment of diseases and clinical conditions associated with SPTBN1. The function of SPTBN1 has been established by previous studies. Immunochemical studies demonstrate the existence of beta-spectrin-like polypeptides in nonerythroid tissues. Watkins et al. (1988) obtained a genomic clone for nonerythroid beta-spectrin by screening a DNA library with a synthetic oligonucleotide probe corresponding to human erythroid beta-spectrin (OMIM Ref. No. 182870) cDNA. The genomic clone showed 76% homology to the erythroid beta-spectrin cDNA when translated to amino acid sequence. Watkins et al. (1988) used the genomic clone to map the gene to human chromosome 2 by study of DNA from somatic cell hybrids. Chang et al. (1993) found that the genomic DNA for human brain beta-fodrin contained regions that cross-hybridized with an erythroid beta-spectrin cDNA probe and that the DNA sequence of these regions showed a high degree of identity and a similar exon/intron organization. By hybridization to DNA of a panel of somatic hybrid cell lines, they mapped the gene to chromosome 2 and localized the gene to 2p21 by isotopic in situ hybridization.

Full details of the abovementioned studies are described in the following publications, the disclosure of which are hereby incorporated by reference:

Chang, J. G.; Scarpa, A.; Eddy, R. L.; Byers, M. G.; Harris, A. S.; Morrow, J. S.; Watkins, P.; Shows, T. B.; Forget, B. G.: Cloning of a portion of the chromosomal gene and cDNA for human beta-fodrin, the nonerythroid form of beta-spectrin. Genomics 17:287-293, 1993; and Watkins, P. C.; Eddy, R.; Forget, B. G.; Chang, J. G.; Rochelle, R.; Shows, T. B.: Assignment of a non-erythroid spectrin gene to human chromosome 2. (Abstract) Am. J. Hum. Genet. 43: A16.

Further studies establishing the function and utilities of SPTBN1 are found in John Hopkins OMIM database record ID 182790, and in sited publications numbered 10090-10091 listed in the bibliography section hereinbelow, which are also hereby incorporated by reference. Thymidine Kinase 2, Mitochondrial (TK2, Accession NM_004614) is another VGAM1375 host target gene. TK2 BINDING SITE is HOST TARGET binding site found in the 3' untranslated region of mRNA encoded by TK2, corresponding to a HOST TARGET binding site such as BINDING SITE I, BINDING SITE II or BINDING SITE III. Table 2 illustrates the complementarity of the nucleotide sequences of TK2 BINDING SITE, designated SEQ ID:10957, to the nucleotide sequence of VGAM1375 RNA, herein designated VGAM RNA, also designated SEQ ID:4086.

Another function of VGAM1375 is therefore inhibition of Thymidine Kinase 2, Mitochondrial (TK2, Accession NM_004614), a gene which phosphorylates thymidine, deoxycytidine, deoxyuridine, and also anti-viral and anti-cancer nucleoside analogs. Accordingly, utilities of VGAM1375 include diagnosis, prevention and treatment of diseases and clinical conditions associated with TK2. The function of TK2 and its association with various diseases and clinical conditions, has been established by previous studies, as described hereinabove with reference to VGAM210.

CBCIP2 (Accession NM_032831) is another VGAM1375 host target gene. CBCIP2 BINDING SITE is HOST TARGET binding site found in the 3' untranslated region of mRNA encoded by CBCIP2, corresponding to a HOST TARGET binding site such as BINDING SITE I, BINDING SITE II or BINDING SITE III. Table 2 illustrates the complementarity of the nucleotide sequences of CBCIP2 BINDING SITE, designated SEQ ID:26605, to the nucleotide sequence of VGAM1375 RNA, herein designated VGAM RNA, also designated SEQ ID:4086.

Another function of VGAM1375 is therefore inhibition of CBCIP2 (Accession NM_032831). Accordingly, utilities of VGAM1375 include diagnosis, prevention and treatment of diseases and clinical conditions associated with CBCIP2. Doublecortin and CaM Kinase-like 1 (DCAMKL1, Accession NM_004734) is another VGAM1375 host target gene. DCAMKL1 BINDING SITE is HOST TARGET binding site found in the 3' untranslated region of mRNA encoded by DCAMKL1, corresponding to a HOST TARGET binding site such as BINDING SITE I, BINDING SITE II or BINDING SITE III. Table 2 illustrates the complementarity of the nucleotide sequences of DCAMKL1 BINDING SITE, designated SEQ ID:11116, to the nucleotide sequence of VGAM1375 RNA, herein designated VGAM RNA, also designated SEQ ID:4086.

Another function of VGAM1375 is therefore inhibition of Doublecortin and CaM Kinase-like 1 (DCAMKL1, Accession NM_004734). Accordingly, utilities of VGAM1375 include diagnosis, prevention and treatment of diseases and clinical conditions associated with DCAMKL1. DKFZp761F2014 (Accession NM_020215) is another VGAM1375 host target gene. DKFZp761F2014 BINDING SITE is HOST TARGET binding site found in the 3' untranslated region of mRNA encoded by DKFZp761F2014, corresponding to a HOST TARGET binding site such as BINDING SITE I, BINDING SITE II or BINDING SITE III. Table 2 illustrates the complementarity of the nucleotide sequences of DKFZp761F2014 BINDING SITE, designated SEQ ID:21460, to the nucleotide sequence of VGAM1375 RNA, herein designated VGAM RNA, also designated SEQ ID:4086.

Another function of VGAM1375 is therefore inhibition of DKFZp761F2014 (Accession NM_020215). Accordingly, utilities of VGAM1375 include diagnosis, prevention and treatment of diseases and clinical conditions associated with DKFZp761F2014. ElaC Homolog 1 (E. coli) (ELAC1, Accession XM_165659) is another VGAM1375 host target gene. ELAC1 BINDING SITE is HOST TARGET binding site found in the 3' untranslated region of mRNA encoded by ELAC1, corresponding to a HOST TARGET binding site such as BINDING SITE I, BINDING SITE II or BINDING SITE III. Table 2 illustrates the complementarity of the nucleotide sequences of ELAC1 BINDING SITE, designated SEQ ID:43722, to the nucleotide sequence of VGAM1375 RNA, herein designated VGAM RNA, also designated SEQ ID:4086.

Another function of VGAM1375 is therefore inhibition of ElaC Homolog 1 (E. coli) (ELAC1, Accession XM_165659). Accordingly, utilities of VGAM1375 include diagnosis, prevention and treatment of diseases and clinical conditions associated with ELAC1. FLJ00007 (Accession XM_048928) is another VGAM1375 host target gene. FLJ00007 BINDING SITE is HOST TARGET binding site found in the 3' untranslated region of mRNA encoded by FLJ00007, corresponding to a HOST TARGET binding site such as BINDING SITE I, BINDING SITE II or BINDING SITE III. Table 2 illustrates the complementarity of the nucleotide sequences of FLJ00007 BINDING SITE, designated SEQ ID:35306, to the nucleotide sequence of VGAM1375 RNA, herein designated VGAM RNA, also designated SEQ ID:4086.

Another function of VGAM1375 is therefore inhibition of FLJ00007 (Accession XM_048928). Accordingly, utilities of VGAM1375 include diagnosis, prevention and treatment of diseases and clinical conditions associated with FLJ00007. FLJ14768 (Accession NM_032836) is another VGAM1375 host target gene. FLJ14768 BINDING SITE is HOST TARGET binding site found in the 3' untranslated region of mRNA encoded by FLJ14768, corresponding to a HOST TARGET binding site such as BINDING SITE I, BINDING SITE II or BINDING SITE III. Table 2 illustrates the complementarity of the nucleotide sequences of FLJ14768 BINDING SITE, designated SEQ ID:26614, to the nucleotide sequence of VGAM1375 RNA, herein designated VGAM RNA, also designated SEQ ID:4086.

Another function of VGAM1375 is therefore inhibition of FLJ14768 (Accession NM_032836). Accordingly, utilities of VGAM1375 include diagnosis, prevention and treatment of diseases and clinical conditions associated with FLJ14768. GFR (Accession NM_012294) is another VGAM1375 host target gene. GFR BINDING SITE is HOST TARGET binding site found in the 3' untranslated region of mRNA encoded by GFR, corresponding to a HOST TARGET binding site such as BINDING SITE I, BINDING SITE II or BINDING SITE III. Table 2 illustrates the complementarity of the nucleotide sequences of GFR BINDING SITE, designated SEQ ID:14632, to the nucleotide sequence of VGAM1375 RNA, herein designated VGAM RNA, also designated SEQ ID:4086.

Another function of VGAM1375 is therefore inhibition of GFR (Accession NM_012294). Accordingly, utilities of VGAM1375 include diagnosis, prevention and treatment of diseases and clinical conditions associated with GFR. KIAA0346 (Accession XM_043272) is another VGAM1375 host target gene. KIAA0346 BINDING SITE is HOST TARGET binding site found in the 5" untranslated region of mRNA encoded by KIAA0346, corresponding to a HOST TARGET binding site such as BINDING SITE I, BINDING SITE II or BINDING SITE III. Table 2 illustrates the complementarity of the nucleotide sequences of KIAA0346 BINDING SITE, designated SEQ ID:33919, to the nucleotide sequence of VGAM1375 RNA, herein designated VGAM RNA, also designated SEQ ID:4086.

Another function of VGAM1375 is therefore inhibition of KIAA0346 (Accession XM_043272). Accordingly, utilities of VGAM1375 include diagnosis, prevention and treatment of diseases and clinical conditions associated with KIAA0346. KIAA1327 (Accession XM_051146) is another VGAM1375 host target gene. KIAA1327 BINDING SITE is HOST TARGET binding site found in the 5' untranslated region of mRNA encoded by KIAA1327, corresponding to a HOST TARGET binding site such as BINDING SITE I, BINDING SITE II or BINDING SITE III. Table 2 illustrates the complementarity of the nucleotide sequences of KIAA1327 BINDING SITE, designated SEQ ID:35762, to the nucleotide sequence of VGAM1375 RNA, herein designated VGAM RNA, also designated SEQ ID:4086.

Another function of VGAM1375 is therefore inhibition of KIAA1327 (Accession XM_051146). Accordingly, utilities of VGAM1375 include diagnosis, prevention and treatment of diseases and clinical conditions associated with KIAA1327. P17.3 (Accession NM_019056) is another VGAM1375 host target gene. P17.3 BINDING SITE is HOST TARGET binding site found in the 5' untranslated region of mRNA encoded by P17.3, corresponding to a HOST TARGET binding site such as BINDING SITE I, BINDING SITE II or BINDING SITE III. Table 2 illustrates the complementarity of the nucleotide sequences of P17.3 BINDING SITE, designated SEQ ID:21139, to the nucleotide sequence of VGAM1375 RNA, herein designated VGAM RNA, also designated SEQ ID:4086.

Another function of VGAM1375 is therefore inhibition of P17.3 (Accession NM_019056). Accordingly, utilities of VGAM1375 include diagnosis, prevention and treatment of diseases and clinical conditions associated with P17.3. Ras Association (RalGDS/AF-6) Domain Family 2 (RASSF2, Accession NM_014737) is another VGAM1375 host target gene. RASSF2 BINDING SITE is HOST TARGET binding site found in the 3' untranslated region of mRNA encoded by RASSF2, corresponding to a HOST TARGET binding site such as BINDING SITE I, BINDING SITE II or BINDING SITE III. Table 2 illustrates the complementarity of the nucleotide sequences of RASSF2 BINDING SITE, designated SEQ ID:16390, to the nucleotide sequence of VGAM1375 RNA, herein designated VGAM RNA, also designated SEQ ID:4086.

Another function of VGAM1375 is therefore inhibition of Ras Association (RalGDS/AF-6) Domain Family 2 (RASSF2, Accession NM_014737). Accordingly, utilities of VGAM1375 include diagnosis, prevention and treatment of diseases and clinical conditions associated with RASSF2. Testis Expressed Sequence 27 (TEX27, Accession NM_021943) is another VGAM1375 host target gene. TEX27 BINDING SITE is HOST TARGET binding site found in the 3' untranslated region of mRNA encoded by TEX27, corresponding to a HOST TARGET binding site such as BINDING SITE I, BINDING SITE II or BINDING SITE III. Table 2 illustrates the complementarity of the nucleotide sequences of TEX27 BINDING SITE, designated SEQ ID:22458, to the nucleotide sequence of VGAM1375 RNA, herein designated VGAM RNA, also designated SEQ ID:4086.

Another function of VGAM1375 is therefore inhibition of Testis Expressed Sequence 27 (TEX27, Accession NM_021943). Accordingly, utilities of VGAM1375 include diagnosis, prevention and treatment of diseases and clinical conditions associated with TEX27. VI (Accession NM_013443) is another VGAM1375 host target gene. VI BINDING SITE is HOST TARGET binding site found in the 3' untranslated region of mRNA encoded by VI, corresponding to a HOST TARGET binding site such as BINDING SITE I, BINDING SITE II or BINDING SITE III. Table 2 illustrates the complementarity of the nucleotide sequences of VI BINDING SITE, designated SEQ ID:15106, to the nucleotide sequence of VGAM1375 RNA, herein designated VGAM RNA, also designated SEQ ID:4086.

Another function of VGAM1375 is therefore inhibition of VI (Accession NM_013443). Accordingly, utilities of VGAM1375 include diagnosis, prevention and treatment of diseases and clinical conditions associated with VI. LOC150935 (Accession XM_087049) is another VGAM1375 host target gene. LOC150935 BINDING SITE is HOST TARGET binding site found in the 5' untranslated region of mRNA encoded by LOC150935, corresponding to a HOST TARGET binding site such as BINDING SITE I, BINDING SITE II or BINDING SITE III. Table 2 illustrates the complementarity of the nucleotide sequences of LOC150935 BINDING SITE, designated SEQ ID:39017, to the nucleotide sequence of VGAM1375 RNA, herein designated VGAM RNA, also designated SEQ ID:4086.

Another function of VGAM1375 is therefore inhibition of LOC150935 (Accession XM_087049). Accordingly, utilities of VGAM1375 include diagnosis, prevention and treatment of diseases and clinical conditions associated with LOC150935. LOC196955 (Accession XM_085210) is another VGAM1375 host target gene. LOC196955 BINDING SITE is HOST TARGET binding site found in the 5' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37928, to the nucleotide sequence of VGAM1375 RNA, herein designated VGAM RNA, also designated SEQ ID:4086.

Another function of VGAM1375 is therefore inhibition of LOC196955 (Accession XM_085210). Accordingly, utilities of VGAM1375 include diagnosis, prevention and treatment of diseases and clinical conditions associated with LOC196955. LOC222008 (Accession XM_168361) is another VGAM1375 host target gene. LOC222008 BINDING SITE is HOST TARGET binding site found in the 3' untranslated region of mRNA encoded by LOC222008, corresponding to a HOST TARGET binding site such as BINDING SITE I, BINDING SITE II or BINDING SITE III. Table 2 illustrates the complementarity of the nucleotide sequences of LOC222008 BINDING SITE, designated SEQ ID:45122, to the nucleotide sequence of VGAM1375 RNA, herein designated VGAM RNA, also designated SEQ ID:4086.

Another function of VGAM1375 is therefore inhibition of LOC222008 (Accession XM_168361). Accordingly, utilities of VGAM1375 include diagnosis, prevention and treatment of diseases and clinical conditions associated with LOC222008. LOC57805 (Accession NM_021174) is another VGAM1375 host target gene. LOC57805 BINDING SITE is HOST TARGET binding site found in the 3' untranslated region of mRNA encoded by LOC57805, corresponding to a HOST TARGET binding site such as BINDING SITE I, BINDING SITE II or BINDING SITE III. Table 2 illustrates the complementarity of the nucleotide sequences of LOC57805 BINDING SITE, designated SEQ ID:22149, to the nucleotide sequence of VGAM1375 RNA, herein designated VGAM RNA, also designated SEQ ID:4086.

Another function of VGAM1375 is therefore inhibition of LOC57805 (Accession NM_021174). Accordingly, utilities of VGAM1375 include diagnosis, prevention and treatment of diseases and clinical conditions associated with LOC57805. FIG. 1 further provides a conceptual description of a novel bioinformatically detected viral gene of the present invention, referred to here as Viral Genomic Address Messenger 1376 (VGAM1376) viral gene, which modulates expression of respective host target genes thereof, the function and utility of which host target genes is known in the art.

VGAM1376 is a novel bioinformatically detected regulatory, non protein coding, viral micro RNA (miRNA) gene. The method by which VGAM1376 was detected is described hereinabove with reference to FIGS. 1-8.

VGAM1376 gene, herein designated VGAM GENE, is a viral gene contained in the genome of Alcelaphine Herpesvirus 1. VGAM1376 host target gene, herein designated VGAM HOST TARGET GENE, is a human gene contained in the human genome.

VGAM1376 gene encodes a VGAM1376 precursor RNA, herein designated VGAM PRECURSOR RNA. Similar to other miRNA genes, and unlike most ordinary genes, VGAM1376 precursor RNA does not encode a protein. A nucleotide sequence identical or highly similar to the nucleotide sequence of VGAM1376 precursor RNA is designated SEQ ID:1362, and is provided hereinbelow with reference to the sequence listing part. Nucleotide sequence SEQ ID:1362 is located at position 28622 relative to the genome of Alcelaphine Herpesvirus 1.

VGAM1376 precursor RNA folds onto itself, forming VGAM1376 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1376 folded precursor RNA into VGAM1376 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1376 RNA is designated SEQ ID:4087, and is provided hereinbelow with reference to the sequence listing part.

VGAM1376 host target gene, herein designated VGAM HOST TARGET GENE, encodes a corresponding messenger RNA, VGAM1376 host target RNA, herein designated VGAM HOST TARGET RNA. VGAM1376 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1376 RNA, herein designated VGAM RNA, binds complementarily to one or more host target binding sites located in untranslated regions of VGAM1376 host target RNA, herein designated VGAM HOST TARGET RNA. This complementary binding is due to the fact that the nucleotide sequence of VGAM1376 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1376 RNA, herein designated VGAM RNA, may have a different number of host target binding sites in untranslated regions of a VGAM1376 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1376 RNA, herein designated VGAM RNA, to host target binding sites on VGAM1376 host target RNA, herein designated VGAM HOST TARGET RNA, such as BINDING SITE I, BINDING SITE II and BINDING SITE III, inhibits translation of VGAM1376 host target RNA into VGAM1376 host target protein, herein designated VGAM HOST TARGET PROTEIN. VGAM host target protein is therefore outlined by a broken line.

It is appreciated that VGAM1376 host target gene, herein designated VGAM HOST TARGET GENE, in fact represents a plurality of VGAM1376 host target genes. The mRNA of each one of this plurality of VGAM1376 host target genes comprises one or more host target binding sites, each having a nucleotide sequence which is at least partly complementary to VGAM1376 RNA, herein designated VGAM RNA, and which when bound by VGAM1376 RNA causes inhibition of translation of respective one or more VGAM1376 host target proteins.

It is further appreciated by one skilled in the art that the mode of translational inhibition illustrated by FIG. 1 with specific reference to translational inhibition exerted by VGAM1376 gene, herein designated VGAM GENE, on one or more VGAM1376 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1376 is inhibition of expression of host target genes, as part of a novel viral mechanism of attacking a host. Accordingly, utilities of VGAM1376 include diagnosis, prevention and treatment of viral infection by Alcelaphine Herpesvirus 1. Specific functions, and accordingly utilities, of VGAM1376 correlate with, and may be deduced from, the identity of the host target genes which VGAM1376 binds and inhibits, and the function of these host target genes, as elaborated hereinbelow.

Nucleotide sequences of the VGAM1376 precursor RNA, herein designated VGAM PRECURSOR RNA, and of the 'diced' VGAM1376 RNA, herein designated VGAM RNA, and a schematic representation of the secondary folding of VGAM1376 folded precursor RNA, herein designated VGAM FOLDED PRECURSOR RNA, of VGAM1376 are further described hereinbelow with reference to Table 1.

Nucleotide sequences of host target binding sites, such as BINDING SITE-I, BINDING SITE-II and BINDING SITE-III of FIG. 1, found on VGAM1376 host target RNA, and schematic representation of the complementarity of each of these host target binding sites to VGAM1376 RNA, herein designated VGAM RNA, are described hereinbelow with reference to Table 2.

As mentioned hereinabove with reference to FIG. 1, a function of VGAM1376 gene, herein designated VGAM is inhibition of expression of VGAM1376 target genes. It is appreciated that specific functions, and accordingly utilities, of VGAM1376 correlate with, and may be deduced from, the identity of the target genes which VGAM1376 binds and inhibits, and the function of these target genes, as elaborated hereinbelow.

Transcobalamin II; Macrocytic Anemia (TCN2, Accession NM_000355) is a VGAM1376 host target gene. TCN2 BINDING SITE is HOST TARGET binding site found in the 5' untranslated region of mRNA encoded by TCN2, corresponding to a HOST TARGET binding site such as BINDING SITE I, BINDING SITE II or BINDING SITE III. Table 2 illustrates the complementarity of the nucleotide sequences of TCN2 BINDING SITE, designated SEQ ID:5915, to the nucleotide sequence of VGAM1376 RNA, herein designated VGAM RNA, also designated SEQ ID:4087.

A function of VGAM1376 is therefore inhibition of Transcobalamin II; Macrocytic Anemia (TCN2, Accession NM_000355). Accordingly, utilities of VGAM1376 include diagnosis, prevention and treatment of diseases and clinical conditions associated with TCN2. Transient Receptor Potential Cation Channel, Subfamily C, Member 6 (TRPC6, Accession NM_004621) is another VGAM1376 host target gene.

TRPC6 BINDING SITE is HOST TARGET binding site found in the 5' untranslated region of mRNA encoded by TRPC6, corresponding to a HOST TARGET binding site such as BINDING SITE I, BINDING SITE II or BINDING SITE III. Table 2 illustrates the complementarity of the nucleotide sequences of TRPC6 BINDING SITE, designated SEQ ID:10974, to the nucleotide sequence of VGAM1376 RNA, herein designated VGAM RNA, also designated SEQ ID:4087.

Another function of VGAM1376 is therefore inhibition of Transient Receptor Potential Cation Channel, Subfamily C, Member 6 (TRPC6, Accession NM_004621), a gene which has calcium channel activity. Accordingly, utilities of VGAM1376 include diagnosis, prevention and treatment of diseases and clinical conditions associated with TRPC6. The function of TRPC6 and its association with various diseases and clinical conditions, has been established by previous studies, as described hereinabove with reference to VGAM25. DKFZP434F091 (Accession NM_015453) is another VGAM1376 host target gene. DKFZP434F091 BINDING SITE is HOST TARGET binding site found in the 5' untranslated region of mRNA encoded by DKFZP434F091, corresponding to a HOST TARGET binding site such as BINDING SITE I, BINDING SITE II or BINDING SITE III. Table 2 illustrates the complementarity of the nucleotide sequences of DKFZP434F091 BINDING SITE, designated SEQ ID:17738, to the nucleotide sequence of VGAM1376 RNA, herein designated VGAM RNA, also designated SEQ ID:4087.

Another function of VGAM1376 is therefore inhibition of DKFZP434F091 (Accession NM_015453). Accordingly, utilities of VGAM1376 include diagnosis, prevention and treatment of diseases and clinical conditions associated with DKFZP434F091. FLJ23132 (Accession XM_171194) is another VGAM1376 host target gene. FLJ23132 BINDING SITE is HOST TARGET binding site found in the 5' untranslated region of mRNA encoded by FLJ23132, corresponding to a HOST TARGET binding site such as BINDING SITE I, BINDING SITE II or BINDING SITE III. Table 2 illustrates the complementarity of the nucleotide sequences of FLJ23132 BINDING SITE, designated SEQ ID:45981, to the nucleotide sequence of VGAM1376 RNA, herein designated VGAM RNA, also designated SEQ ID:4087.

Another function of VGAM1376 is therefore inhibition of FLJ23132 (Accession XM_171194). Accordingly, utilities of VGAM1376 include diagnosis, prevention and treatment of diseases and clinical conditions associated with FLJ23132. Netrin 4 (NTN4, Accession XM_031896) is another VGAM1376 host target gene. NTN4 BINDING SITE is HOST TARGET binding site found in the 5' untranslated region of mRNA encoded by NTN4, corresponding to a HOST TARGET binding site such as BINDING SITE I, BINDING SITE II or BINDING SITE III. Table 2 illustrates the complementarity of the nucleotide sequences of NTN4 BINDING SITE, designated SEQ ID:31512, to the nucleotide sequence of VGAM1376 RNA, herein designated VGAM RNA, also designated SEQ ID:4087.

Another function of VGAM1376 is therefore inhibition of Netrin 4 (NTN4, Accession XM_031896). Accordingly, utilities of VGAM1376 include diagnosis, prevention and treatment of diseases and clinical conditions associated with NTN4. SEC61A1 (Accession NM_013336) is another VGAM1376 host target gene. SEC61A1 BINDING SITE is HOST TARGET binding site found in the 5' untranslated region of mRNA encoded by SEC61A1, corresponding to a HOST TARGET binding site such as BINDING SITE I, BINDING SITE II or BINDING SITE III. Table 2 illustrates the complementarity of the nucleotide sequences of SEC61A1 BINDING SITE, designated SEQ ID:14984, to the nucleotide sequence of VGAM1376 RNA, herein designated VGAM RNA, also designated SEQ ID:4087.

Another function of VGAM1376 is therefore inhibition of SEC61A1 (Accession NM_013336). Accordingly, utilities of VGAM1376 include diagnosis, prevention and treatment of diseases and clinical conditions associated with SEC61A1. TGFB-induced Factor 2 (TALE family homeobox) (TGIF2, Accession NM_021809) is another VGAM1376 host target gene. TGIF2 BINDING SITE is HOST TARGET binding site found in the 3' untranslated region of mRNA encoded by TGIF2, corresponding to a HOST TARGET binding site such as BINDING SITE I, BINDING SITE II or BINDING SITE III. Table 2 illustrates the complementarity of the nucleotide sequences of TGIF2 BINDING SITE, designated SEQ ID:22365, to the nucleotide sequence of VGAM1376 RNA, herein designated VGAM RNA, also designated SEQ ID:4087.

Another function of VGAM1376 is therefore inhibition of TGFB-induced Factor 2 (TALE family homeobox) (TGIF2, Accession NM_021809). Accordingly, utilities of VGAM1376 include diagnosis, prevention and treatment of diseases and clinical conditions associated with TGIF2. LOC145098 (Accession XM_085022) is another VGAM1376 host target gene. LOC145098 BINDING SITE is HOST TARGET binding site found in the 5' untranslated region of mRNA encoded by LOC145098, corresponding to a HOST TARGET binding site such as BINDING SITE I, BINDING SITE II or BINDING SITE III. Table 2 illustrates the complementarity of the nucleotide sequences of LOC145098 BINDING SITE, designated SEQ ID:37796, to the nucleotide sequence of VGAM1376 RNA, herein designated VGAM RNA, also designated SEQ ID:4087.

Another function of VGAM1376 is therefore inhibition of LOC145098 (Accession XM_085022). Accordingly, utilities of VGAM1376 include diagnosis, prevention and treatment of diseases and clinical conditions associated with LOC145098. LOC145719 (Accession XM_096848) is another VGAM1376 host target gene. LOC145719 BINDING SITE is HOST TARGET binding site found in the 5' untranslated region of mRNA encoded by LOC145719, corresponding to a HOST TARGET binding site such as BINDING SITE I, BINDING SITE II or BINDING SITE III. Table 2 illustrates the complementarity of the nucleotide sequences of LOC145719 BINDING SITE, designated SEQ ID:40572, to the nucleotide sequence of VGAM1376 RNA, herein designated VGAM RNA, also designated SEQ ID:4087.

Another function of VGAM1376 is therefore inhibition of LOC145719 (Accession XM_096848). Accordingly, utilities of VGAM1376 include diagnosis, prevention and treatment of diseases and clinical conditions associated with LOC145719. LOC145720 (Accession XM_096846) is another VGAM1376 host target gene. LOC145720 BINDING SITE is HOST TARGET binding site found in the 5' untranslated region of mRNA encoded by LOC145720, corresponding to a HOST TARGET binding site such as BINDING SITE I, BINDING SITE II or BINDING SITE III. Table 2 illustrates the complementarity of the nucleotide sequences of LOC145720 BINDING SITE, designated SEQ ID:40562, to the nucleotide sequence of VGAM1376 RNA, herein designated VGAM RNA, also designated SEQ ID:4087.

Another function of VGAM1376 is therefore inhibition of LOC145720 (Accession XM_096846). Accordingly, utilities of VGAM1376 include diagnosis, prevention and treatment of diseases and clinical conditions associated with LOC145720. LOC155382 (Accession XM_098713) is another VGAM1376 host target gene. LOC155382 BINDING SITE is HOST TARGET binding site found in the 5' untranslated region of mRNA encoded by LOC155382, corresponding to a HOST TARGET binding site such as BINDING SITE I, BINDING SITE II or BINDING SITE III. Table 2 illustrates the complementarity of the nucleotide sequences of LOC155382 BINDING SITE, designated SEQ ID:41764, to the nucleotide sequence of VGAM1376 RNA, herein designated VGAM RNA, also designated SEQ ID:4087.

Another function of VGAM1376 is therefore inhibition of LOC155382 (Accession XM_098713). Accordingly, utilities of VGAM1376 include diagnosis, prevention and treatment of diseases and clinical conditions associated with LOC155382. LOC197114 (Accession XM_116987) is another VGAM1376 host target gene. LOC197114 BINDING SITE is HOST TARGET binding site found in the 5' untranslated region of mRNA encoded by LOC197114, corresponding to a HOST TARGET binding site such as BINDING SITE I, BINDING SITE II or BINDING SITE III. Table 2 illustrates the complementarity of the nucleotide sequences of LOC197114 BINDING SITE, designated SEQ ID:43186, to the nucleotide sequence of VGAM1376 RNA, herein designated VGAM RNA, also designated SEQ ID:4087.

Another function of VGAM1376 is therefore inhibition of LOC197114 (Accession XM_116987). Accordingly, utilities of VGAM1376 include diagnosis, prevention and treatment of diseases and clinical conditions associated with LOC197114. LOC254013 (Accession XM_170700) is another VGAM1376 host target gene. LOC254013 BINDING SITE is HOST TARGET binding site found in the 5' untranslated region of mRNA encoded by LOC254013, corresponding to a HOST TARGET binding site such as BINDING SITE I, BINDING SITE II or BINDING SITE III. Table 2 illustrates the complementarity of the nucleotide sequences of LOC254013 BINDING SITE, designated SEQ ID:45479, to the nucleotide sequence of VGAM1376 RNA, herein designated VGAM RNA, also designated SEQ ID:4087.

Another function of VGAM1376 is therefore inhibition of LOC254013 (Accession XM_170700). Accordingly, utilities of VGAM1376 include diagnosis, prevention and treatment of diseases and clinical conditions associated with LOC254013. FIG. 1 further provides a conceptual description of a novel bioinformatically detected viral gene of the present invention, referred to here as Viral Genomic Address Messenger 1377 (VGAM1377) viral gene, which modulates expression of respective host target genes thereof, the function and utility of which host target genes is known in the art.

VGAM1377 is a novel bioinformatically detected regulatory, non protein coding, viral micro RNA (miRNA) gene. The method by which VGAM1377 was detected is described hereinabove with reference to FIGS. 1-8.

VGAM1377 gene, herein designated VGAM GENE, is a viral gene contained in the genome of Alcelaphine Herpesvirus 1. VGAM1377 host target gene, herein designated VGAM HOST TARGET GENE, is a human gene contained in the human genome.

VGAM1377 gene encodes a VGAM1377 precursor RNA, herein designated VGAM PRECURSOR RNA. Similar to other miRNA genes, and unlike most ordinary genes, VGAM1377 precursor RNA does not encode a protein. A nucleotide sequence identical or highly similar to the nucleotide sequence of VGAM1377 precursor RNA is designated SEQ ID:1363, and is provided hereinbelow with reference to the sequence listing part. Nucleotide sequence SEQ ID:1363 is located at position 27042 relative to the genome of Alcelaphine Herpesvirus 1.

VGAM1377 precursor RNA folds onto itself, forming VGAM1377 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1377 folded precursor RNA into VGAM1377 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1377 RNA is designated SEQ ID:4088, and is provided hereinbelow with reference to the sequence listing part.

VGAM1377 host target gene, herein designated VGAM HOST TARGET GENE, encodes a corresponding messenger RNA, VGAM1377 host target RNA, herein designated VGAM HOST TARGET RNA. VGAM1377 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1377 RNA, herein designated VGAM RNA, binds complementarily to one or more host target binding sites located in untranslated regions of VGAM1377 host target RNA, herein designated VGAM HOST TARGET RNA. This complementary binding is due to the fact that the nucleotide sequence of VGAM1377 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1377 RNA, herein designated VGAM RNA, may have a different number of host target binding sites in untranslated regions of a VGAM1377 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1377 RNA, herein designated VGAM RNA, to host target binding sites on VGAM1377 host target RNA, herein designated VGAM HOST TARGET RNA, such as BINDING SITE I, BINDING SITE II and BINDING SITE III, inhibits translation of VGAM1377 host target RNA into VGAM1377 host target protein, herein designated VGAM HOST TARGET PROTEIN. VGAM host target protein is therefore outlined by a broken line.

It is appreciated that VGAM1377 host target gene, herein designated VGAM HOST TARGET GENE, in fact represents a plurality of VGAM1377 host target genes. The mRNA of each one of this plurality of VGAM1377 host target genes comprises one or more host target binding sites, each having a nucleotide sequence which is at least partly complementary to VGAM1377 RNA, herein designated VGAM RNA, and which when bound by VGAM1377 RNA causes inhibition of translation of respective one or more VGAM1377 host target proteins.

It is further appreciated by one skilled in the art that the mode of translational inhibition illustrated by FIG. 1 with specific reference to translational inhibition exerted by VGAM1377 gene, herein designated VGAM GENE, on one or more VGAM1377 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1377 is inhibition of expression of host target genes, as part of a novel viral mechanism of attacking a host. Accordingly, utilities of VGAM1377 include diagnosis, prevention and treatment of viral infection by Alcelaphine Herpesvirus 1. Specific functions, and accordingly utilities, of VGAM1377 correlate with, and may be deduced from, the identity of the host target genes which VGAM1377 binds and inhibits, and the function of these host target genes, as elaborated hereinbelow.

Nucleotide sequences of the VGAM1377 precursor RNA, herein designated VGAM PRECURSOR RNA, and of the 'diced' VGAM1377 RNA, herein designated VGAM RNA, and a schematic representation of the secondary folding of VGAM1377 folded precursor RNA, herein designated VGAM FOLDED PRECURSOR RNA, of VGAM1377 are further described hereinbelow with reference to Table 1.

Nucleotide sequences of host target binding sites, such as BINDING SITE-I, BINDING SITE-II and BINDING SITE-III of FIG. 1, found on VGAM1377 host target RNA, and schematic representation of the complementarity of each of these host target binding sites to VGAM1377 RNA, herein designated VGAM RNA, are described hereinbelow with reference to Table 2.

As mentioned hereinabove with reference to FIG. 1, a function of VGAM1377 gene, herein designated VGAM is inhibition of expression of VGAM1377 target genes. It is appreciated that specific functions, and accordingly utilities, of VGAM1377 correlate with, and may be deduced from, the identity of the target genes which VGAM1377 binds and inhibits, and the function of these target genes, as elaborated hereinbelow.

Coronin, Actin Binding Protein, 2A (CORO2A, Accession NM_003389) is a VGAM1377 host target gene. CORO2A BINDING SITE is HOST TARGET binding site found in the 5' untranslated region of mRNA encoded by CORO2A, corresponding to a HOST TARGET binding site such as BINDING SITE I, BINDING SITE II or BINDING SITE III. Table 2 illustrates the complementarity of the nucleotide sequences of CORO2A BINDING SITE, designated SEQ ID:9426, to the nucleotide sequence of VGAM1377 RNA, herein designated VGAM RNA, also designated SEQ ID:4088.

A function of VGAM1377 is therefore inhibition of Coronin, Actin Binding Protein, 2A (CORO2A, Accession NM_003389). Accordingly, utilities of VGAM1377 include diagnosis, prevention and treatment of diseases and clinical conditions associated with CORO2A. Family with Sequence Similarity 8, Member A1 (FAM8A1, Accession NM_016255) is another VGAM1377 host target gene. FAM8A1 BINDING SITE is HOST TARGET binding site found in the 3' untranslated region of mRNA encoded by FAM8A1, corresponding to a HOST TARGET binding site such as BINDING SITE I, BINDING SITE II or BINDING SITE III. Table 2 illustrates the complementarity of the nucleotide sequences of FAM8A1 BINDING SITE, designated SEQ ID:18383, to the nucleotide sequence of VGAM1377 RNA, herein designated VGAM RNA, also designated SEQ ID:4088.

Another function of VGAM1377 is therefore inhibition of Family with Sequence Similarity 8, Member A1 (FAM8A1, Accession NM_016255). Accordingly, utilities of VGAM1377 include diagnosis, prevention and treatment of diseases and clinical conditions associated with FAM8A1. FLJ22843 (Accession NM_025184) is another VGAM1377 host target gene. FLJ22843 BINDING SITE is HOST TARGET binding site found in the 3' untranslated region of mRNA encoded by FLJ22843, corresponding to a HOST TARGET binding site such as BINDING SITE I, BINDING SITE II or BINDING SITE III. Table 2 illustrates the complementarity of the nucleotide sequences of FLJ22843 BINDING SITE, designated SEQ ID:24821, to the nucleotide sequence of VGAM1377 RNA, herein designated VGAM RNA, also designated SEQ ID:4088.

Another function of VGAM1377 is therefore inhibition of FLJ22843 (Accession NM_025184). Accordingly, utilities of VGAM1377 include diagnosis, prevention and treatment of diseases and clinical conditions associated with FLJ22843. LOC200310 (Accession XM_037840) is another VGAM1377 host target gene. LOC200310 BINDING SITE is HOST TARGET binding site found in the 3' untranslated region of mRNA encoded by LOC200310, corresponding to a HOST TARGET binding site such as BINDING SITE I, BINDING SITE II or BINDING SITE III. Table 2 illustrates the complementarity of the nucleotide sequences of LOC200310 BINDING SITE, designated SEQ ID:32707, to the nucleotide sequence of VGAM1377 RNA, herein designated VGAM RNA, also designated SEQ ID:4088.

Another function of VGAM1377 is therefore inhibition of LOC200310 (Accession XM_037840). Accordingly, utilities of VGAM1377 include diagnosis, prevention and treatment of diseases and clinical conditions associated with LOC200310. LOC90625 (Accession XM_033004) is another VGAM1377 host target gene. LOC90625 BINDING SITE is HOST TARGET binding site found in the 3' untranslated region of mRNA encoded by LOC90625, corresponding to a HOST TARGET binding site such as BINDING SITE I, BINDING SITE II or BINDING SITE III. Table 2 illustrates the complementarity of the nucleotide sequences of LOC90625 BINDING SITE, designated SEQ ID:31820, to the nucleotide sequence of VGAM1377 RNA, herein designated VGAM RNA, also designated SEQ ID:4088.

Another function of VGAM1377 is therefore inhibition of LOC90625 (Accession XM_033004). Accordingly, utilities of VGAM1377 include diagnosis, prevention and treatment of diseases and clinical conditions associated with LOC90625. FIG. 1 further provides a conceptual description of a novel bioinformatically detected viral gene of the present invention, referred to here as Viral Genomic Address Messenger 1378 (VGAM1378) viral gene, which modulates expression of respective host target genes thereof, the function and utility of which host target genes is known in the art.

VGAM1378 is a novel bioinformatically detected regulatory, non protein coding, viral micro RNA (miRNA) gene. The method by which VGAM1378 was detected is described hereinabove with reference to FIGS. 1-8.

VGAM1378 gene, herein designated VGAM GENE, is a viral gene contained in the genome of Human Herpesvirus 1.

VGAM1378 host target gene, herein designated VGAM HOST TARGET GENE, is a human gene contained in the human genome.

VGAM1378 gene encodes a VGAM1378 precursor RNA, herein designated VGAM PRECURSOR RNA. Similar to other miRNA genes, and unlike most ordinary genes, VGAM1378 precursor RNA does not encode a protein. A nucleotide sequence identical or highly similar to the nucleotide sequence of VGAM1378 precursor RNA is designated SEQ ID:1364, and is provided hereinbelow with reference to the sequence listing part. Nucleotide sequence SEQ ID:1364 is located at position 141854 relative to the genome of Human Herpesvirus 1.

VGAM1378 precursor RNA folds onto itself, forming VGAM1378 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1378 folded precursor RNA into VGAM1378 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1378 RNA is designated SEQ ID:4089, and is provided hereinbelow with reference to the sequence listing part.

VGAM1378 host target gene, herein designated VGAM HOST TARGET GENE, encodes a corresponding messenger RNA, VGAM1378 host target RNA, herein designated VGAM HOST TARGET RNA. VGAM1378 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1378 RNA, herein designated VGAM RNA, binds complementarily to one or more host target binding sites located in untranslated regions of VGAM1378 host target RNA, herein designated VGAM HOST TARGET RNA. This complementary binding is due to the fact that the nucleotide sequence of VGAM1378 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1378 RNA, herein designated VGAM RNA, may have a different number of host target binding sites in untranslated regions of a VGAM1378 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1378 RNA, herein designated VGAM RNA, to host target binding sites on VGAM1378 host target RNA, herein designated VGAM HOST TARGET RNA, such as BINDING SITE I, BINDING SITE II and BINDING SITE III, inhibits translation of VGAM1378 host target RNA into VGAM1378 host target protein, herein designated VGAM HOST TARGET PROTEIN. VGAM host target protein is therefore outlined by a broken line.

It is appreciated that VGAM1378 host target gene, herein designated VGAM HOST TARGET GENE, in fact represents a plurality of VGAM1378 host target genes. The mRNA of each one of this plurality of VGAM1378 host target genes comprises one or more host target binding sites, each having a nucleotide sequence which is at least partly complementary to VGAM1378 RNA, herein designated VGAM RNA, and which when bound by VGAM1378 RNA causes inhibition of translation of respective one or more VGAM1378 host target proteins.

It is further appreciated by one skilled in the art that the mode of translational inhibition illustrated by FIG. 1 with specific reference to translational inhibition exerted by VGAM1378 gene, herein designated VGAM GENE, on one or more VGAM1378 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1378 is inhibition of expression of host target genes, as part of a novel viral mechanism of attacking a host. Accordingly, utilities of VGAM1378 include diagnosis, prevention and treatment of viral infection by Human Herpesvirus 1. Specific functions, and accordingly utilities, of VGAM1378 correlate with, and may be deduced from, the identity of the host target genes which VGAM1378 binds and inhibits, and the function of these host target genes, as elaborated hereinbelow.

Nucleotide sequences of the VGAM1378 precursor RNA, herein designated VGAM PRECURSOR RNA, and of the 'diced' VGAM1378 RNA, herein designated VGAM RNA, and a schematic representation of the secondary folding of VGAM1378 folded precursor RNA, herein designated VGAM FOLDED PRECURSOR RNA, of VGAM1378 are further described hereinbelow with reference to Table 1.

Nucleotide sequences of host target binding sites, such as BINDING SITE-I, BINDING SITE-II and BINDING SITE-III of FIG. 1, found on VGAM1378 host target RNA, and schematic representation of the complementarity of each of these host target binding sites to VGAM1378 RNA, herein designated VGAM RNA, are described hereinbelow with reference to Table 2.

As mentioned hereinabove with reference to FIG. 1, a function of VGAM1378 gene, herein designated VGAM is inhibition of expression of VGAM1378 target genes. It is appreciated that specific functions, and accordingly utilities, of VGAM1378 correlate with, and may be deduced from, the identity of the target genes which VGAM1378 binds and inhibits, and the function of these target genes, as elaborated hereinbelow.

Axin 1 (AXIN1, Accession XM_027520) is a VGAM1378 host target gene. AXIN1 BINDING SITE is HOST TARGET binding site found in the 3' untranslated region of mRNA encoded by AXIN1, corresponding to a HOST TARGET binding site such as BINDING SITE I, BINDING SITE II or BINDING SITE III. Table 2 illustrates the complementarity of the nucleotide sequences of AXIN1 BINDING SITE, designated SEQ ID:30517, to the nucleotide sequence of VGAM1378 RNA, herein designated VGAM RNA, also designated SEQ ID:4089.

A function of VGAM1378 is therefore inhibition of Axin 1 (AXIN1, Accession XM_027520). Accordingly, utilities of VGAM1378 include diagnosis, prevention and treatment of diseases and clinical conditions associated with AXIN1. Calbindin 1, 28 kDa (CALB1, Accession NM_004929) is another VGAM1378 host target gene. CALB1 BINDING SITE is HOST TARGET binding site found in the 3' untranslated region of mRNA encoded by CALB1, corresponding to a HOST TARGET binding site such as BINDING SITE I, BINDING SITE II or BINDING SITE III. Table 2 illustrates the complementarity of the nucleotide sequences of CALB1 BINDING SITE, designated SEQ ID:11368, to the nucleotide sequence of VGAM1378 RNA, herein designated VGAM RNA, also designated SEQ ID:4089.

Another function of VGAM1378 is therefore inhibition of Calbindin 1, 28 kDa (CALB1, Accession NM_004929), a gene which buffers cytosolic calcium. Accordingly, utilities of VGAM1378 include diagnosis, prevention and treatment of diseases and clinical conditions associated with CALB1. The function of CALB1 and its association with various diseases and clinical conditions, has been established by previous studies, as described hereinabove with reference to VGAM266. Clathrin, Heavy Polypeptide-like 1 (CLTCL1, Accession XM_033096) is another VGAM1378 host target gene. CLTCL1 BINDING SITE is HOST TARGET binding site found in the 3' untranslated region of mRNA encoded by CLTCL1, corresponding to a HOST TARGET binding site such as BINDING SITE I, BINDING SITE II or BINDING SITE III. Table 2 illustrates the complementarity of the nucleotide sequences of CLTCL1 BINDING SITE, designated SEQ ID:31834, to the nucleotide sequence of VGAM1378 RNA, herein designated VGAM RNA, also designated SEQ ID:4089.

Another function of VGAM1378 is therefore inhibition of Clathrin, Heavy Polypeptide-like 1 (CLTCL1, Accession XM_033096), a gene which is involved in vesicle budding. Accordingly, utilities of VGAM1378 include diagnosis, prevention and treatment of diseases and clinical conditions associated with CLTCL1. The function of CLTCL1 and its association with various diseases and clinical conditions, has been established by previous studies, as described hereinabove with reference to VGAM42. EGF-like-domain, Multiple 4 (EGFL4, Accession XM_029883) is another VGAM1378 host target gene. EGFL4 BINDING SITE is HOST TARGET binding site found in the 5' untranslated region of mRNA encoded by EGFL4, corresponding to a HOST TARGET binding site such as BINDING SITE I, BINDING SITE II or BINDING SITE III. Table 2 illustrates the complementarity of the nucleotide sequences of EGFL4 BINDING SITE, designated SEQ ID:30961, to the nucleotide sequence of VGAM1378 RNA, herein designated VGAM RNA, also designated SEQ ID:4089.

Another function of VGAM1378 is therefore inhibition of EGF-like-domain, Multiple 4 (EGFL4, Accession XM_029883). Accordingly, utilities of VGAM1378 include diagnosis, prevention and treatment of diseases and clinical conditions associated with EGFL4. Exostoses (multiple)-like 3 (EXTL3, Accession NM_001440) is another VGAM1378 host target gene. EXTL3 BINDING SITE is HOST TARGET binding site found in the 3' untranslated region of mRNA encoded by EXTL3, corresponding to a HOST TARGET binding site such as BINDING SITE I, BINDING SITE II or BINDING SITE III. Table 2 illustrates the complementarity of the nucleotide sequences of EXTL3 BINDING SITE, designated SEQ ID:7169, to the nucleotide sequence of VGAM1378 RNA, herein designated VGAM RNA, also designated SEQ ID:4089.

Another function of VGAM1378 is therefore inhibition of Exostoses (multiple)-like 3 (EXTL3, Accession NM_001440), a gene which a member of the multiple exostoses gene family. Accordingly, utilities of VGAM1378 include diagnosis, prevention and treatment of diseases and clinical conditions associated with EXTL3. The function of EXTL3 and its association with various diseases and clinical conditions, has been established by previous studies, as described hereinabove with reference to VGAM95. Low Density Lipoprotein-related Protein 1 (alpha-2-macroglobulin receptor) (LRP1, Accession NM_002332) is another VGAM1378 host target gene. LRP1 BINDING SITE is HOST TARGET binding site found in the 3' untranslated region of mRNA encoded by LRP1, corresponding to a HOST TARGET binding site such as BINDING SITE I, BINDING SITE II or BINDING SITE III. Table 2 illustrates the complementarity of the nucleotide sequences of LRP1 BINDING SITE, designated SEQ ID:8138, to the nucleotide sequence of VGAM1378 RNA, herein designated VGAM RNA, also designated SEQ ID:4089.

Another function of VGAM1378 is therefore inhibition of Low Density Lipoprotein-related Protein 1 (alpha-2-macroglobulin receptor) (LRP1, Accession NM_002332), a gene which is a recycling lipoprotein receptor with possible growth-modulating effects. Accordingly, utilities of VGAM1378 include diagnosis, prevention and treatment of diseases and clinical conditions associated with LRP1. The function of LRP1 and its association with various diseases and clinical conditions, has been established by previous studies, as described hereinabove with reference to VGAM885. Protein Kinase C and Casein Kinase Substrate In Neurons 1 (PACSIN1, Accession XM_166424) is another VGAM1378 host target gene. PACSIN1 BINDING SITE1 and PACSIN1 BINDING SITE2 are HOST TARGET binding sites found in untranslated regions of mRNA encoded by PACSIN1, corresponding to HOST TARGET binding sites such as BINDING SITE I, BINDING SITE II or BINDING SITE III. Table 2 illustrates the complementarity of the nucleotide sequences of PACSIN1 BINDING SITE1 and PACSIN1 BINDING SITE2, designated SEQ ID:44312 and SEQ ID:44313 respectively, to the nucleotide sequence of VGAM1378 RNA, herein designated VGAM RNA, also designated SEQ ID:4089.

Another function of VGAM1378 is therefore inhibition of Protein Kinase C and Casein Kinase Substrate In Neurons 1 (PACSIN1, Accession XM_166424). Accordingly, utilities of VGAM1378 include diagnosis, prevention and treatment of diseases and clinical conditions associated with PACSIN1. FLJ14124 (Accession NM_024868) is another VGAM1378 host target gene. FLJ14124 BINDING SITE is HOST TARGET binding site found in the 3' untranslated region of mRNA encoded by FLJ14124, corresponding to a HOST TARGET binding site such as BINDING SITE I, BINDING SITE II or BINDING SITE III. Table 2 illustrates the complementarity of the nucleotide sequences of FLJ14124 BINDING SITE, designated SEQ ID:24303, to the nucleotide sequence of VGAM1378 RNA, herein designated VGAM RNA, also designated SEQ ID:4089.

Another function of VGAM1378 is therefore inhibition of FLJ14124 (Accession NM_024868). Accordingly, utilities of VGAM1378 include diagnosis, prevention and treatment of diseases and clinical conditions associated with FLJ14124. FLJ20413 (Accession NM_017808) is another VGAM1378 host target gene. FLJ20413 BINDING SITE is HOST TARGET binding site found in the 3' untranslated region of mRNA encoded by FLJ20413, corresponding to a HOST TARGET binding site such as BINDING SITE I, BINDING SITE II or BINDING SITE III. Table 2 illustrates the complementarity of the nucleotide sequences of FLJ20413 BINDING SITE, designated SEQ ID:19451, to the nucleotide sequence of VGAM1378 RNA, herein designated VGAM RNA, also designated SEQ ID:4089.

Another function of VGAM1378 is therefore inhibition of FLJ20413 (Accession NM_017808). Accordingly, utilities of VGAM1378 include diagnosis, prevention and treatment of diseases and clinical conditions associated with FLJ20413. IL-17RC (Accession NM_032732) is another VGAM1378 host target gene. IL-17RC BINDING SITE is HOST TARGET binding site found in the 3' untranslated region of mRNA encoded by IL-17RC, corresponding to a HOST TARGET binding site such as BINDING SITE I, BINDING SITE II or BINDING SITE III. Table 2 illustrates the complementarity of the nucleotide sequences of IL-17RC BINDING SITE, designated SEQ ID:26455, to the nucleotide sequence of VGAM1378 RNA, herein designated VGAM RNA, also designated SEQ ID:4089.

Another function of VGAM1378 is therefore inhibition of IL-17RC (Accession NM_032732). Accordingly, utilities of VGAM1378 include diagnosis, prevention and treatment of diseases and clinical conditions associated with IL-17RC. KIAA0876 (Accession XM_035625) is another VGAM1378 host target gene. KIAA0876 BINDING SITE is HOST TARGET binding site found in the 3' untranslated region of mRNA encoded by KIAA0876, corresponding to a HOST TARGET binding site such as BINDING SITE I, BINDING SITE II or BINDING SITE III. Table 2 illustrates the complementarity of the nucleotide sequences of KIAA0876 BINDING SITE, designated SEQ ID:32293, to the nucleotide sequence of VGAM1378 RNA, herein designated VGAM RNA, also designated SEQ ID:4089.

Another function of VGAM1378 is therefore inhibition of KIAA0876 (Accession XM_035625). Accordingly, utilities of VGAM1378 include diagnosis, prevention and treatment of diseases and clinical conditions associated with KIAA0876. KIAA1576 (Accession XM_038186) is another VGAM1378 host target gene. KIAA1576 BINDING SITE is HOST TARGET binding site found in the 3' untranslated region of mRNA encoded by KIAA1576, corresponding to a HOST TARGET binding site such as BINDING SITE I, BINDING SITE II or BINDING SITE III. Table 2 illustrates the complementarity of the nucleotide sequences of KIAA1576 BINDING SITE, designated SEQ ID:32774, to the nucleotide sequence of VGAM1378 RNA, herein designated VGAM RNA, also designated SEQ ID:4089.

Another function of VGAM1378 is therefore inhibition of KIAA1576 (Accession XM_038186). Accordingly, utilities of VGAM1378 include diagnosis, prevention and treatment of diseases and clinical conditions associated with KIAA1576. PP1201 (Accession NM_022152) is another VGAM1378 host target gene. PP1201 BINDING SITE is HOST TARGET binding site found in the 3' untranslated region of mRNA encoded by PP1201, corresponding to a HOST TARGET binding site such as BINDING SITE I, BINDING SITE II or BINDING SITE III. Table 2 illustrates the complementarity of the nucleotide sequences of PP1201 BINDING SITE, designated SEQ ID:22711, to the nucleotide sequence of VGAM1378 RNA, herein designated VGAM RNA, also designated SEQ ID:4089.

Another function of VGAM1378 is therefore inhibition of PP1201 (Accession NM_022152). Accordingly, utilities of VGAM1378 include diagnosis, prevention and treatment of diseases and clinical conditions associated with PP1201. WD Repeat Domain 7 (WDR7, Accession NM_015285) is another VGAM1378 host target gene. WDR7 BINDING SITE is HOST TARGET binding site found in the 3' untranslated region of mRNA encoded by WDR7, corresponding to a HOST TARGET binding site such as BINDING SITE I, BINDING SITE II or BINDING SITE III. Table 2 illustrates the complementarity of the nucleotide sequences of WDR7 BINDING SITE, designated SEQ ID:17608, to the nucleotide sequence of VGAM1378 RNA, herein designated VGAM RNA, also designated SEQ ID:4089.

Another function of VGAM1378 is therefore inhibition of WD Repeat Domain 7 (WDR7, Accession NM_015285). Accordingly, utilities of VGAM1378 include diagnosis, prevention and treatment of diseases and clinical conditions associated with WDR7. LOC149076 (Accession XM_086415) is another VGAM1378 host target gene. LOC149076 BINDING SITE is HOST TARGET binding site found in the 3' untranslated region of mRNA encoded by LOC149076, corresponding to a HOST TARGET binding site such as BINDING SITE I, BINDING SITE II or BINDING SITE III. Table 2 illustrates the complementarity of the nucleotide sequences of LOC149076 BINDING SITE, designated SEQ ID:38637, to the nucleotide sequence of VGAM1378 RNA, herein designated VGAM RNA, also designated SEQ ID:4089.

Another function of VGAM1378 is therefore inhibition of LOC149076 (Accession XM_086415). Accordingly, utilities of VGAM1378 include diagnosis, prevention and treatment of diseases and clinical conditions associated with LOC149076. LOC199920 (Accession XM_114056) is another VGAM1378 host target gene. LOC199920 BINDING SITE is HOST TARGET binding site found in the 5' untranslated region of mRNA encoded by LOC199920, corresponding to a HOST TARGET binding site such as BINDING SITE I, BINDING SITE II or BINDING SITE III. Table 2 illustrates the complementarity of the nucleotide sequences of LOC199920 BINDING SITE, designated SEQ ID:42661, to the nucleotide sequence of VGAM1378 RNA, herein designated VGAM RNA, also designated SEQ ID:4089.

Another function of VGAM1378 is therefore inhibition of LOC199920 (Accession XM_114056). Accordingly, utilities of VGAM1378 include diagnosis, prevention and treatment of diseases and clinical conditions associated with LOC199920. LOC200470 (Accession XM_117235) is another VGAM1378 host target gene. LOC200470 BINDING SITE is HOST TARGET binding site found in the 5' untranslated region of mRNA encoded by LOC200470, corresponding to a HOST TARGET binding site such as BINDING SITE I, BINDING SITE II or BINDING SITE III. Table 2 illustrates the complementarity of the nucleotide sequences of LOC200470 BINDING SITE, designated SEQ ID:43307, to the nucleotide sequence of VGAM1378 RNA, herein designated VGAM RNA, also designated SEQ ID:4089.

Another function of VGAM1378 is therefore inhibition of LOC200470 (Accession XM_117235). Accordingly, utilities of VGAM1378 include diagnosis, prevention and treatment of diseases and clinical conditions associated with LOC200470. LOC220097 (Accession XM_167887) is another VGAM1378 host target gene. LOC220097 BINDING SITE is HOST TARGET binding site found in the 5' untranslated region of mRNA encoded by LOC220097, corresponding to a HOST TARGET binding site such as BINDING SITE I, BINDING SITE II or BINDING SITE III. Table 2 illustrates the complementarity of the nucleotide sequences of LOC220097 BINDING SITE, designated SEQ ID:44896, to the nucleotide sequence of VGAM1378 RNA, herein designated VGAM RNA, also designated SEQ ID:4089.

Another function of VGAM1378 is therefore inhibition of LOC220097 (Accession XM_167887). Accordingly, utilities of VGAM1378 include diagnosis, prevention and treatment of diseases and clinical conditions associated with LOC220097. LOC222031 (Accession XM_168371) is another VGAM1378 host target gene. LOC222031 BINDING SITE is HOST TARGET binding site found in the 3' untranslated region of mRNA encoded by LOC222031, corresponding to a HOST TARGET binding site such as BINDING SITE I, BINDING SITE II or BINDING SITE III. Table 2 illustrates the complementarity of the nucleotide sequences of LOC222031 BINDING SITE, designated SEQ ID:45135, to the nucleotide sequence of VGAM1378 RNA, herein designated VGAM RNA, also designated SEQ ID:4089.

Another function of VGAM1378 is therefore inhibition of LOC222031 (Accession XM_168371). Accordingly, utilities of VGAM1378 include diagnosis, prevention and treatment of diseases and clinical conditions associated with LOC222031. LOC90979 (Accession XM_035323) is another VGAM1378 host target gene. LOC90979 BINDING SITE is HOST TARGET binding site found in the 3' untranslated region of mRNA encoded by LOC90979, corresponding to a HOST TARGET binding site such as BINDING SITE I, BINDING SITE II or BINDING SITE III. Table 2 illustrates the complementarity of the nucleotide sequences of LOC90979 BINDING SITE, designated SEQ ID:32231, to the nucleotide sequence of VGAM1378 RNA, herein designated VGAM RNA, also designated SEQ ID:4089.

Another function of VGAM1378 is therefore inhibition of LOC90979 (Accession XM_035323). Accordingly, utilities of VGAM1378 include diagnosis, prevention and treatment of diseases and clinical conditions associated with LOC90979. FIG. 1 further provides a conceptual description of a novel bioinformatically detected viral gene of the present invention, referred to here as Viral Genomic Address Messenger 1379 (VGAM1379) viral gene, which modulates expression of respective host target genes thereof, the function and utility of which host target genes is known in the art.

VGAM1379 is a novel bioinformatically detected regulatory, non protein coding, viral micro RNA (miRNA) gene. The method by which VGAM1379 was detected is described hereinabove with reference to FIGS. 1-8.

VGAM1379 gene, herein designated VGAM GENE, is a viral gene contained in the genome of Human Herpesvirus 1. VGAM1379 host target gene, herein designated VGAM HOST TARGET GENE, is a human gene contained in the human genome.

VGAM1379 gene encodes a VGAM1379 precursor RNA, herein designated VGAM PRECURSOR RNA. Similar to other miRNA genes, and unlike most ordinary genes, VGAM1379 precursor RNA does not encode a protein. A nucleotide sequence identical or highly similar to the nucleotide sequence of VGAM1379 precursor RNA is designated SEQ ID:1365, and is provided hereinbelow with reference to the sequence listing part. Nucleotide sequence SEQ ID:1365 is located at position 142746 relative to the genome of Human Herpesvirus 1.

VGAM1379 precursor RNA folds onto itself, forming VGAM1379 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1379 folded precursor RNA into VGAM1379 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1379 RNA is designated SEQ ID:4090, and is provided hereinbelow with reference to the sequence listing part.

VGAM1379 host target gene, herein designated VGAM HOST TARGET GENE, encodes a corresponding messenger RNA, VGAM1379 host target RNA, herein designated VGAM HOST TARGET RNA. VGAM1379 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1379 RNA, herein designated VGAM RNA, binds complementarily to one or more host target binding sites located in untranslated regions of VGAM1379 host target RNA, herein designated VGAM HOST TARGET RNA. This complementary binding is due to the fact that the nucleotide sequence of VGAM1379 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1379 RNA, herein designated VGAM RNA, may have a different number of host target binding sites in untranslated regions of a VGAM1379 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1379 RNA, herein designated VGAM RNA, to host target binding sites on VGAM1379 host target RNA, herein designated VGAM HOST TARGET RNA, such as BINDING SITE I, BINDING SITE II and BINDING SITE III, inhibits translation of VGAM1379 host target RNA into VGAM1379 host target protein, herein designated VGAM HOST TARGET PROTEIN. VGAM host target protein is therefore outlined by a broken line.

It is appreciated that VGAM1379 host target gene, herein designated VGAM HOST TARGET GENE, in fact represents a plurality of VGAM1379 host target genes. The mRNA of each one of this plurality of VGAM1379 host target genes comprises one or more host target binding sites, each having a nucleotide sequence which is at least partly complementary to VGAM1379 RNA, herein designated VGAM RNA, and which when bound by VGAM1379 RNA causes inhibition of translation of respective one or more VGAM1379 host target proteins.

It is further appreciated by one skilled in the art that the mode of translational inhibition illustrated by FIG. 1 with specific reference to translational inhibition exerted by VGAM1379 gene, herein designated VGAM GENE, on one or more VGAM1379 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1379 is inhibition of expression of host target genes, as part of a novel viral mechanism of attacking a host. Accordingly, utilities of VGAM1379 include diagnosis, prevention and treatment of viral infection by Human Herpesvirus 1. Specific functions, and accordingly utilities, of VGAM1379 correlate with, and may be deduced from, the identity of the host target genes which VGAM1379 binds and inhibits, and the function of these host target genes, as elaborated hereinbelow.

Nucleotide sequences of the VGAM1379 precursor RNA, herein designated VGAM PRECURSOR RNA, and of the 'diced' VGAM1379 RNA, herein designated VGAM RNA, and a schematic representation of the secondary folding of VGAM1379 folded precursor RNA, herein designated VGAM FOLDED PRECURSOR RNA, of VGAM1379 are further described hereinbelow with reference to Table 1.

Nucleotide sequences of host target binding sites, such as BINDING SITE-I, BINDING SITE-II and BINDING SITE-III of FIG. 1, found on VGAM1379 host target RNA, and schematic representation of the complementarity of each of these host target binding sites to VGAM1379 RNA, herein designated VGAM RNA, are described hereinbelow with reference to Table 2.

As mentioned hereinabove with reference to FIG. 1, a function of VGAM1379 gene, herein designated VGAM is inhibition of expression of VGAM1379 target genes. It is appreciated that specific functions, and accordingly utilities, of VGAM1379 correlate with, and may be deduced from, the identity of the target genes which VGAM1379 binds and inhibits, and the function of these target genes, as elaborated hereinbelow.

KIAA1322 (Accession XM_052626) is a VGAM1379 host target gene. KIAA1322 BINDING SITE is HOST TARGET binding site found in the 3' untranslated region of mRNA encoded by KIAA1322, corresponding to a HOST TARGET binding site such as BINDING SITE I, BINDING SITE II or BINDING SITE III. Table 2 illustrates the complementarity of the nucleotide sequences of KIAA1322 BINDING SITE, designated SEQ ID:36025, to the nucleotide sequence of VGAM1379 RNA, herein designated VGAM RNA, also designated SEQ ID:4090.

A function of VGAM1379 is therefore inhibition of KIAA1322 (Accession XM_052626). Accordingly, utilities of VGAM1379 include diagnosis, prevention and treatment of diseases and clinical conditions associated with KIAA1322. TIP120B (Accession XM_051590) is another VGAM1379 host target gene. TIP120B BINDING SITE is HOST TARGET binding site found in the 3' untranslated region of mRNA encoded by TIP120B, corresponding to a HOST TARGET binding site such as BINDING SITE I, BINDING SITE II or BINDING SITE III. Table 2 illustrates the complementarity of the nucleotide sequences of TIP120B BINDING SITE, designated SEQ ID:35859, to the nucleotide sequence of VGAM1379 RNA, herein designated VGAM RNA, also designated SEQ ID:4090.

Another function of VGAM1379 is therefore inhibition of TIP120B (Accession XM_051590). Accordingly, utilities of VGAM1379 include diagnosis, prevention and treatment of diseases and clinical conditions associated with TIP120B. LOC120448 (Accession XM_062032) is another VGAM1379 host target gene. LOC120448 BINDING SITE is HOST TARGET binding site found in the 5' untranslated region of mRNA encoded by LOC120448, corresponding to a HOST TARGET binding site such as BINDING SITE I, BINDING SITE II or BINDING SITE III. Table 2 illustrates the complementarity of the nucleotide sequences of LOC120448 BINDING SITE, designated SEQ ID:37222, to the nucleotide sequence of VGAM1379 RNA, herein designated VGAM RNA, also designated SEQ ID:4090.

Another function of VGAM1379 is therefore inhibition of LOC120448 (Accession XM_062032). Accordingly, utilities of VGAM1379 include diagnosis, prevention and treatment of diseases and clinical conditions associated with LOC120448. LOC256158 (Accession XM_175125) is another VGAM1379 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46627, to the nucleotide sequence of VGAM1379 RNA, herein designated VGAM RNA, also designated SEQ ID:4090.

Another function of VGAM1379 is therefore inhibition of LOC256158 (Accession XM_175125). Accordingly, utilities of VGAM1379 include diagnosis, prevention and treatment of diseases and clinical conditions associated with LOC256158. FIG. 1 further provides a conceptual description of a novel bioinformatically detected viral gene of the present invention, referred to here as Viral Genomic Address Messenger 1380 (VGAM1380) viral gene, which modulates expression of respective host target genes thereof, the function and utility of which host target genes is known in the art.

VGAM1380 is a novel bioinformatically detected regulatory, non protein coding, viral micro RNA (miRNA) gene. The method by which VGAM1380 was detected is described hereinabove with reference to FIGS. 1-8.

VGAM1380 gene, herein designated VGAM GENE, is a viral gene contained in the genome of Himetobi P Virus. VGAM1380 host target gene, herein designated VGAM HOST TARGET GENE, is a human gene contained in the human genome.

VGAM1380 gene encodes a VGAM1380 precursor RNA, herein designated VGAM PRECURSOR RNA. Similar to other miRNA genes, and unlike most ordinary genes, VGAM1380 precursor RNA does not encode a protein. A nucleotide sequence identical or highly similar to the nucleotide sequence of VGAM1380 precursor RNA is designated SEQ ID:1366, and is provided hereinbelow with reference to the sequence listing part. Nucleotide sequence SEQ ID:1366 is located at position 2325 relative to the genome of Himetobi P Virus.

VGAM1380 precursor RNA folds onto itself, forming VGAM1380 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1380 folded precursor RNA into VGAM1380 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1380 RNA is designated SEQ ID:4091, and is provided hereinbelow with reference to the sequence listing part.

VGAM1380 host target gene, herein designated VGAM HOST TARGET GENE, encodes a corresponding messenger RNA, VGAM1380 host target RNA, herein designated VGAM HOST TARGET RNA. VGAM1380 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1380 RNA, herein designated VGAM RNA, binds complementarily to one or more host target binding sites located in untranslated regions of VGAM1380 host target RNA, herein designated VGAM HOST TARGET RNA. This complementary binding is due to the fact that the nucleotide sequence of VGAM1380 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1380 RNA, herein designated VGAM RNA, may have a different number of host target binding sites in untranslated regions of a VGAM1380 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1380 RNA, herein designated VGAM RNA, to host target binding sites on VGAM1380 host target RNA, herein designated VGAM HOST TARGET RNA, such as BINDING SITE I, BINDING SITE II and BINDING SITE III, inhibits translation of VGAM1380 host target RNA into VGAM1380 host target protein, herein designated VGAM HOST TARGET PROTEIN. VGAM host target protein is therefore outlined by a broken line.

It is appreciated that VGAM1380 host target gene, herein designated VGAM HOST TARGET GENE, in fact represents a plurality of VGAM1380 host target genes. The mRNA of each one of this plurality of VGAM1380 host target genes comprises one or more host target binding sites, each having a nucleotide sequence which is at least partly complementary to VGAM1380 RNA, herein designated VGAM RNA, and which when bound by VGAM1380 RNA causes inhibition of translation of respective one or more VGAM1380 host target proteins.

It is further appreciated by one skilled in the art that the mode of translational inhibition illustrated by FIG. 1 with specific reference to translational inhibition exerted by VGAM1380 gene, herein designated VGAM GENE, on one or more VGAM1380 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1380 is inhibition of expression of host target genes, as part of a novel viral mechanism of attacking a host. Accordingly, utilities of VGAM1380 include diagnosis, prevention and treatment of viral infection by Himetobi P Virus. Specific functions, and accordingly utilities, of VGAM1380 correlate with, and may be deduced from, the identity of the host target genes which VGAM1380 binds and inhibits, and the function of these host target genes, as elaborated hereinbelow.

Nucleotide sequences of the VGAM1380 precursor RNA, herein designated VGAM PRECURSOR RNA, and of the 'diced' VGAM1380 RNA, herein designated VGAM RNA, and a schematic representation of the secondary folding of VGAM1380 folded precursor RNA, herein designated VGAM FOLDED PRECURSOR RNA, of VGAM1380 are further described hereinbelow with reference to Table 1.

Nucleotide sequences of host target binding sites, such as BINDING SITE-I, BINDING SITE-II and BINDING SITE-III of FIG. 1, found on VGAM1380 host target RNA, and schematic representation of the complementarity of each of these host target binding sites to VGAM1380 RNA, herein designated VGAM RNA, are described hereinbelow with reference to Table 2.

As mentioned hereinabove with reference to FIG. 1, a function of VGAM1380 gene, herein designated VGAM is inhibition of expression of VGAM1380 target genes. It is appreciated that specific functions, and accordingly utilities, of VGAM1380 correlate with, and may be deduced from, the identity of the target genes which VGAM1380 binds and inhibits, and the function of these target genes, as elaborated hereinbelow.

FENS-1 (Accession NM_020830) is a VGAM1380 host target gene. FENS-1 BINDING SITE is HOST TARGET binding site found in the 3' untranslated region of mRNA encoded by FENS-1, corresponding to a HOST TARGET binding site such as BINDING SITE I, BINDING SITE II or BINDING SITE III. Table 2 illustrates the complementarity of the nucleotide sequences of FENS-1 BINDING SITE, designated SEQ ID:21894, to the nucleotide sequence of VGAM1380 RNA, herein designated VGAM RNA, also designated SEQ ID:4091.

A function of VGAM1380 is therefore inhibition of FENS-1 (Accession NM_020830). Accordingly, utilities of VGAM1380 include diagnosis, prevention and treatment of diseases and clinical conditions associated with FENS-1. PRO0902 (Accession NM_053057) is another VGAM1380 host target gene. PRO0902 BINDING SITE is HOST TARGET binding site found in the 5' untranslated region of mRNA encoded by PRO0902, corresponding to a HOST TARGET binding site such as BINDING SITE I, BINDING SITE II or BINDING SITE III. Table 2 illustrates the complementarity of the nucleotide sequences of PRO0902 BINDING SITE, designated SEQ ID:27604, to the nucleotide sequence of VGAM1380 RNA, herein designated VGAM RNA, also designated SEQ ID:4091.

Another function of VGAM1380 is therefore inhibition of PRO0902 (Accession NM_053057). Accordingly, utilities of VGAM1380 include diagnosis, prevention and treatment of diseases and clinical conditions associated with PRO0902. FIG. 1 further provides a conceptual description of a novel bioinformatically detected viral gene of the present invention, referred to here as Viral Genomic Address Messenger 1381

(VGAM1381) viral gene, which modulates expression of respective host target genes thereof, the function and utility of which host target genes is known in the art.

VGAM1381 is a novel bioinformatically detected regulatory, non protein coding, viral micro RNA (miRNA) gene. The method by which VGAM1381 was detected is described hereinabove with reference to FIGS. 1-8.

VGAM1381 gene, herein designated VGAM GENE, is a viral gene contained in the genome of Himetobi P Virus. VGAM1381 host target gene, herein designated VGAM HOST TARGET GENE, is a human gene contained in the human genome.

VGAM1381 gene encodes a VGAM1381 precursor RNA, herein designated VGAM PRECURSOR RNA. Similar to other miRNA genes, and unlike most ordinary genes, VGAM1381 precursor RNA does not encode a protein. A nucleotide sequence identical or highly similar to the nucleotide sequence of VGAM1381 precursor RNA is designated SEQ ID:1367, and is provided hereinbelow with reference to the sequence listing part. Nucleotide sequence SEQ ID:1367 is located at position 8357 relative to the genome of Himetobi P Virus.

VGAM1381 precursor RNA folds onto itself, forming VGAM1381 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1381 folded precursor RNA into VGAM1381 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1381 RNA is designated SEQ ID:4092, and is provided hereinbelow with reference to the sequence listing part.

VGAM1381 host target gene, herein designated VGAM HOST TARGET GENE, encodes a corresponding messenger RNA, VGAM1381 host target RNA, herein designated VGAM HOST TARGET RNA. VGAM1381 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1381 RNA, herein designated VGAM RNA, binds complementarily to one or more host target binding sites located in untranslated regions of VGAM1381 host target RNA, herein designated VGAM HOST TARGET RNA. This complementary binding is due to the fact that the nucleotide sequence of VGAM1381 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1381 RNA, herein designated VGAM RNA, may have a different number of host target binding sites in untranslated regions of a VGAM1381 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1381 RNA, herein designated VGAM RNA, to host target binding sites on VGAM1381 host target RNA, herein designated VGAM HOST TARGET RNA, such as BINDING SITE I, BINDING SITE II and BINDING SITE III, inhibits translation of VGAM1381 host target RNA into VGAM1381 host target protein, herein designated VGAM HOST TARGET PROTEIN. VGAM host target protein is therefore outlined by a broken line.

It is appreciated that VGAM1381 host target gene, herein designated VGAM HOST TARGET GENE, in fact represents a plurality of VGAM1381 host target genes. The mRNA of each one of this plurality of VGAM1381 host target genes comprises one or more host target binding sites, each having a nucleotide sequence which is at least partly complementary to VGAM1381 RNA, herein designated VGAM RNA, and which when bound by VGAM1381 RNA causes inhibition of translation of respective one or more VGAM1381 host target proteins.

It is further appreciated by one skilled in the art that the mode of translational inhibition illustrated by FIG. 1 with specific reference to translational inhibition exerted by VGAM1381 gene, herein designated VGAM GENE, on one or more VGAM1381 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1381 is inhibition of expression of host target genes, as part of a novel viral mechanism of attacking a host. Accordingly, utilities of VGAM1381 include diagnosis, prevention and treatment of viral infection by Himetobi P Virus. Specific functions, and accordingly utilities, of VGAM1381 correlate with, and may be deduced from, the identity of the host target genes which VGAM1381 binds and inhibits, and the function of these host target genes, as elaborated hereinbelow.

Nucleotide sequences of the VGAM1381 precursor RNA, herein designated VGAM PRECURSOR RNA, and of the 'diced' VGAM1381 RNA, herein designated VGAM RNA, and a schematic representation of the secondary folding of VGAM1381 folded precursor RNA, herein designated VGAM FOLDED PRECURSOR RNA, of VGAM1381 are further described hereinbelow with reference to Table 1.

Nucleotide sequences of host target binding sites, such as BINDING SITE-I, BINDING SITE-II and BINDING SITE-III of FIG. 1, found on VGAM1381 host target RNA, and schematic representation of the complementarity of each of these host target binding sites to VGAM1381 RNA, herein designated VGAM RNA, are described hereinbelow with reference to Table 2.

As mentioned hereinabove with reference to FIG. 1, a function of VGAM1381 gene, herein designated VGAM is inhibition of expression of VGAM1381 target genes. It is appreciated that specific functions, and accordingly utilities, of VGAM1381 correlate with, and may be deduced from, the identity of the target genes which VGAM1381 binds and inhibits, and the function of these target genes, as elaborated hereinbelow.

RAB1A, Member RAS Oncogene Family (RAB1A, Accession XM_046674) is a VGAM1381 host target gene. RAB1A BINDING SITE is HOST TARGET binding site found in the 3' untranslated region of mRNA encoded by RAB1A, corresponding to a HOST TARGET binding site such as BINDING SITE I, BINDING SITE II or BINDING SITE III. Table 2 illustrates the complementarity of the nucleotide sequences of RAB1A BINDING SITE, designated SEQ ID:34786, to the nucleotide sequence of VGAM1381 RNA, herein designated VGAM RNA, also designated SEQ ID:4092.

A function of VGAM1381 is therefore inhibition of RAB1A, Member RAS Oncogene Family (RAB1A, Accession XM_046674), a gene which is involved in vesicle transport. Accordingly, utilities of VGAM1381 include diagnosis, prevention and treatment of diseases and clinical conditions associated with RAB1A. The function of RAB1A and its association with various diseases and clinical conditions, has been established by previous studies, as described hereinabove with reference to VGAM433. KIAA0367 (Accession XM_041018) is another VGAM1381 host target gene. KIAA0367 BINDING SITE is HOST TARGET binding site found in the 3' untranslated region of mRNA encoded by KIAA0367, corresponding to a HOST TARGET binding site such as BINDING SITE I, BINDING SITE II or BINDING SITE III. Table 2 illustrates the complementarity of the nucleotide sequences of KIAA0367 BINDING SITE, designated SEQ ID:33422, to the nucleotide sequence of VGAM1381 RNA, herein designated VGAM RNA, also designated SEQ ID:4092.

Another function of VGAM1381 is therefore inhibition of KIAA0367 (Accession XM_041018). Accordingly, utilities of VGAM1381 include diagnosis, prevention and treatment of diseases and clinical conditions associated with KIAA0367. KIAA1030 (Accession XM_167789) is another VGAM1381 host target gene. KIAA1030 BINDING SITE is HOST TARGET binding site found in the 3' untranslated region of mRNA encoded by KIAA1030, corresponding to a HOST TARGET binding site such as BINDING SITE I, BINDING SITE II or BINDING SITE III. Table 2 illustrates the complementarity of the nucleotide sequences of KIAA1030 BINDING SITE, designated SEQ ID:44816, to the nucleotide sequence of VGAM1381 RNA, herein designated VGAM RNA, also designated SEQ ID:4092.

Another function of VGAM1381 is therefore inhibition of KIAA1030 (Accession XM_167789). Accordingly, utilities of VGAM1381 include diagnosis, prevention and treatment of diseases and clinical conditions associated with KIAA1030. LOC162239 (Accession XM_091439) is another VGAM1381 host target gene. LOC162239 BINDING SITE is HOST TARGET binding site found in the 3' untranslated region of mRNA encoded by LOC162239, corresponding to a HOST TARGET binding site such as BINDING SITE I, BINDING SITE II or BINDING SITE III. Table 2 illustrates the complementarity of the nucleotide sequences of LOC162239 BINDING SITE, designated SEQ ID:40050, to the nucleotide sequence of VGAM1381 RNA, herein designated VGAM RNA, also designated SEQ ID:4092.

Another function of VGAM1381 is therefore inhibition of LOC162239 (Accession XM_091439). Accordingly, utilities of VGAM1381 include diagnosis, prevention and treatment of diseases and clinical conditions associated with LOC162239. FIG. 1 further provides a conceptual description of a novel bioinformatically detected viral gene of the present invention, referred to here as Viral Genomic Address Messenger 1382 (VGAM1382) viral gene, which modulates expression of respective host target genes thereof, the function and utility of which host target genes is known in the art.

VGAM1382 is a novel bioinformatically detected regulatory, non protein coding, viral micro RNA (miRNA) gene. The method by which VGAM1382 was detected is described hereinabove with reference to FIGS. 1-8.

VGAM1382 gene, herein designated VGAM GENE, is a viral gene contained in the genome of Himetobi P Virus. VGAM1382 host target gene, herein designated VGAM HOST TARGET GENE, is a human gene contained in the human genome.

VGAM1382 gene encodes a VGAM1382 precursor RNA, herein designated VGAM PRECURSOR RNA. Similar to other miRNA genes, and unlike most ordinary genes, VGAM1382 precursor RNA does not encode a protein. A nucleotide sequence identical or highly similar to the nucleotide sequence of VGAM1382 precursor RNA is designated SEQ ID:1368, and is provided hereinbelow with reference to the sequence listing part. Nucleotide sequence SEQ ID:1368 is located at position 4080 relative to the genome of Himetobi P Virus.

VGAM1382 precursor RNA folds onto itself, forming VGAM1382 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1382 folded precursor RNA into VGAM1382 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1382 RNA is designated SEQ ID:4093, and is provided hereinbelow with reference to the sequence listing part.

VGAM1382 host target gene, herein designated VGAM HOST TARGET GENE, encodes a corresponding messenger RNA, VGAM1382 host target RNA, herein designated VGAM HOST TARGET RNA. VGAM1382 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1382 RNA, herein designated VGAM RNA, binds complementarily to one or more host target binding sites located in untranslated regions of VGAM1382 host target RNA, herein designated VGAM HOST TARGET RNA. This complementary binding is due to the fact that the nucleotide sequence of VGAM1382 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1382 RNA, herein designated VGAM RNA, may have a different number of host target binding sites in untranslated regions of a VGAM1382 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1382 RNA, herein designated VGAM RNA, to host target binding sites on VGAM1382 host target RNA, herein designated VGAM HOST TARGET RNA, such as BINDING SITE I, BINDING SITE II and BINDING SITE III, inhibits translation of VGAM1382 host target RNA into VGAM1382 host target protein, herein designated VGAM HOST TARGET PROTEIN. VGAM host target protein is therefore outlined by a broken line.

It is appreciated that VGAM1382 host target gene, herein designated VGAM HOST TARGET GENE, in fact represents a plurality of VGAM1382 host target genes. The mRNA of each one of this plurality of VGAM1382 host target genes comprises one or more host target binding sites, each having a nucleotide sequence which is at least partly complementary to VGAM1382 RNA, herein designated VGAM RNA, and which when bound by VGAM1382 RNA causes inhibition of translation of respective one or more VGAM1382 host target proteins.

It is further appreciated by one skilled in the art that the mode of translational inhibition illustrated by FIG. 1 with specific reference to translational inhibition exerted by VGAM1382 gene, herein designated VGAM GENE, on one or more VGAM1382 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1382 is inhibition of expression of host target genes, as part of a novel viral mechanism of attacking a host. Accordingly, utilities of VGAM1382 include diagnosis, prevention and treatment of viral infection by Himetobi P Virus. Specific functions, and accordingly utilities, of VGAM1382 correlate with, and may be deduced from, the identity of the host target genes which VGAM1382 binds and inhibits, and the function of these host target genes, as elaborated hereinbelow.

Nucleotide sequences of the VGAM1382 precursor RNA, herein designated VGAM PRECURSOR RNA, and of the 'diced' VGAM1382 RNA, herein designated VGAM RNA, and a schematic representation of the secondary folding of VGAM1382 folded precursor RNA, herein designated VGAM FOLDED PRECURSOR RNA, of VGAM1382 are further described hereinbelow with reference to Table 1.

Nucleotide sequences of host target binding sites, such as BINDING SITE-I, BINDING SITE-II and BINDING SITE-III of FIG. 1, found on VGAM1382 host target RNA, and schematic representation of the complementarity of each of these host target binding sites to VGAM1382 RNA, herein designated VGAM RNA, are described hereinbelow with reference to Table 2.

As mentioned hereinabove with reference to FIG. 1, a function of VGAM1382 gene, herein designated VGAM is inhibition of expression of VGAM1382 target genes. It is appreciated that specific functions, and accordingly utilities, of VGAM1382 correlate with, and may be deduced from, the identity of the target genes which VGAM1382 binds and inhibits, and the function of these target genes, as elaborated hereinbelow.

Active BCR-related Gene (ABR, Accession NM_001092) is a VGAM1382 host target gene. ABR BINDING SITE1 and ABR BINDING SITE2 are HOST TARGET binding sites found in untranslated regions of mRNA encoded by ABR, corresponding to HOST TARGET binding sites such as BINDING SITE I, BINDING SITE II or BINDING SITE III. Table 2 illustrates the complementarity of the nucleotide sequences of ABR BINDING SITE1 and ABR BINDING SITE2, designated SEQ ID:6751 and SEQ ID:22496 respectively, to the nucleotide sequence of VGAM1382 RNA, herein designated VGAM RNA, also designated SEQ ID:4093.

A function of VGAM1382 is therefore inhibition of Active BCR-related Gene (ABR, Accession NM_001092), a gene which gtpase-activating protein for rac and cdc42. Accordingly, utilities of VGAM1382 include diagnosis, prevention and treatment of diseases and clinical conditions associated with ABR. The function of ABR and its association with various diseases and clinical conditions, has been established by previous studies, as described hereinabove with reference to VGAM489. Cell Matrix Adhesion Regulator (CMAR, Accession NM_005200) is another VGAM1382 host target gene. CMAR BINDING SITE is HOST TARGET binding site found in the 3' untranslated region of mRNA encoded by CMAR, corresponding to a HOST TARGET binding site such as BINDING SITE I, BINDING SITE II or BINDING SITE III. Table 2 illustrates the complementarity of the nucleotide sequences of CMAR BINDING SITE, designated SEQ ID:11699, to the nucleotide sequence of VGAM1382 RNA, herein designated VGAM RNA, also designated SEQ ID:4093.

Another function of VGAM1382 is therefore inhibition of Cell Matrix Adhesion Regulator (CMAR, Accession NM_005200). Accordingly, utilities of VGAM1382 include diagnosis, prevention and treatment of diseases and clinical conditions associated with CMAR. Cannabinoid Receptor 1 (brain) (CNR1, Accession NM_016083) is another VGAM1382 host target gene. CNR1 BINDING SITE is HOST TARGET binding site found in the 3' untranslated region of mRNA encoded by CNR1, corresponding to a HOST TARGET binding site such as BINDING SITE I, BINDING SITE II or BINDING SITE III. Table 2 illustrates the complementarity of the nucleotide sequences of CNR1 BINDING SITE, designated SEQ ID:18163, to the nucleotide sequence of VGAM1382 RNA, herein designated VGAM RNA, also designated SEQ ID:4093.

Another function of VGAM1382 is therefore inhibition of Cannabinoid Receptor 1 (brain) (CNR1, Accession NM_016083), a gene which is involved in the cannabinoid-induced CNS effects. Accordingly, utilities of VGAM1382 include diagnosis, prevention and treatment of diseases and clinical conditions associated with CNR1. The function of CNR1 and its association with various diseases and clinical conditions, has been established by previous studies, as described hereinabove with reference to VGAM533. Cysteine-rich Motor Neuron 1 (CRIM1, Accession NM_016441) is another VGAM1382 host target gene. CRIM1 BINDING SITE is HOST TARGET binding site found in the 3' untranslated region of mRNA encoded by CRIM1, corresponding to a HOST TARGET binding site such as BINDING SITE I, BINDING SITE II or BINDING SITE III. Table 2 illustrates the complementarity of the nucleotide sequences of CRIM1 BINDING SITE, designated SEQ ID:18562, to the nucleotide sequence of VGAM1382 RNA, herein designated VGAM RNA, also designated SEQ ID:4093.

Another function of VGAM1382 is therefore inhibition of Cysteine-rich Motor Neuron 1 (CRIM1, Accession NM_016441). Accordingly, utilities of VGAM1382 include diagnosis, prevention and treatment of diseases and clinical conditions associated with CRIM1. Protocadherin Alpha 1 (PCDHA1, Accession NM_031411) is another VGAM1382 host target gene. PCDHA1 BINDING SITE1 and PCDHA1 BINDING SITE2 are HOST TARGET binding sites found in untranslated regions of mRNA encoded by PCDHA1, corresponding to HOST TARGET binding sites such as BINDING SITE I, BINDING SITE II or BINDING SITE III. Table 2 illustrates the complementarity of the nucleotide sequences of PCDHA1 BINDING SITE1 and PCDHA1 BINDING SITE2, designated SEQ ID:25384 and SEQ ID:20865 respectively, to the nucleotide sequence of VGAM1382 RNA, herein designated VGAM RNA, also designated SEQ ID:4093.

Another function of VGAM1382 is therefore inhibition of Protocadherin Alpha 1 (PCDHA1, Accession NM_031411). Accordingly, utilities of VGAM1382 include diagnosis, prevention and treatment of diseases and clinical conditions associated with PCDHA1. Protocadherin Alpha 10 (PCDHA10, Accession NM_031860) is another VGAM1382 host target gene. PCDHA10 BINDING SITE1 and PCDHA10 BINDING SITE2 are HOST TARGET binding sites found in untranslated regions of mRNA encoded by PCDHA10, corresponding to HOST TARGET binding sites such as BINDING SITE I, BINDING SITE II or BINDING SITE III. Table 2 illustrates the complementarity of the nucleotide sequences of PCDHA10 BINDING SITE1 and PCDHA10 BINDING SITE2, designated SEQ ID:25616 and SEQ ID:20885 respectively, to the nucleotide sequence of VGAM1382 RNA, herein designated VGAM RNA, also designated SEQ ID:4093.

Another function of VGAM1382 is therefore inhibition of Protocadherin Alpha 10 (PCDHA10, Accession NM_031860). Accordingly, utilities of VGAM1382 include diagnosis, prevention and treatment of diseases and clinical conditions associated with PCDHA10. Protocadherin Alpha 13 (PCDHA13, Accession NM_018904) is another VGAM1382 host target gene. PCDHA13 BINDING SITE is HOST TARGET binding site found in the 3' untranslated region of mRNA encoded by PCDHA13, corresponding to a HOST TARGET binding site such as BINDING SITE I, BINDING SITE II or BINDING SITE III. Table 2 illustrates the complementarity of the nucleotide sequences of PCDHA13 BINDING SITE, designated SEQ ID:20906, to the nucleotide sequence of VGAM1382 RNA, herein designated VGAM RNA, also designated SEQ ID:4093.

Another function of VGAM1382 is therefore inhibition of Protocadherin Alpha 13 (PCDHA13, Accession NM_018904). Accordingly, utilities of VGAM1382 include diagnosis, prevention and treatment of diseases and clinical conditions associated with PCDHA13. Protocadherin Alpha 2 (PCDHA2, Accession NM_018905) is another VGAM1382 host target gene. PCDHA2 BINDING SITE is HOST TARGET binding site found in the 3' untranslated region of mRNA encoded by PCDHA2, corresponding to a HOST TARGET binding site such as BINDING SITE I, BINDING SITE II or BINDING SITE III. Table 2 illustrates the complementarity of the nucleotide sequences of PCDHA2 BINDING SITE, designated SEQ ID:20916, to the nucleotide sequence of VGAM1382 RNA, herein designated VGAM RNA, also designated SEQ ID:4093.

Another function of VGAM1382 is therefore inhibition of Protocadherin Alpha 2 (PCDHA2, Accession NM_018905). Accordingly, utilities of VGAM1382 include diagnosis, prevention and treatment of diseases and clinical conditions associated with PCDHA2. Protocadherin Alpha 3 (PCDHA3, Accession NM_018906) is another VGAM1382 host target gene. PCDHA3 BINDING SITE is HOST TARGET binding site found in the 3' untranslated region of mRNA encoded by PCDHA3, corresponding to a HOST TARGET binding site such as BINDING SITE I, BINDING SITE II or BINDING SITE III. Table 2 illustrates the complementarity of the nucleotide sequences of PCDHA3 BINDING SITE, designated SEQ ID:20926, to the nucleotide sequence of VGAM1382 RNA, herein designated VGAM RNA, also designated SEQ ID:4093.

Another function of VGAM1382 is therefore inhibition of Protocadherin Alpha 3 (PCDHA3, Accession NM_018906). Accordingly, utilities of VGAM1382 include diagnosis, prevention and treatment of diseases and clinical conditions associated with PCDHA3. Protocadherin Alpha 4 (PCDHA4, Accession NM_018907) is another VGAM1382 host target gene. PCDHA4 BINDING SITE is HOST TARGET binding site found in the 3' untranslated region of mRNA encoded by PCDHA4, corresponding to a HOST TARGET binding site such as BINDING SITE I, BINDING SITE II or BINDING SITE III. Table 2 illustrates the complementarity of the nucleotide sequences of PCDHA4 BINDING SITE, designated SEQ ID:20936, to the nucleotide sequence of VGAM1382 RNA, herein designated VGAM RNA, also designated SEQ ID:4093.

Another function of VGAM1382 is therefore inhibition of Protocadherin Alpha 4 (PCDHA4, Accession NM_018907). Accordingly, utilities of VGAM1382 include diagnosis, prevention and treatment of diseases and clinical conditions associated with PCDHA4. Protocadherin Alpha 5 (PCDHA5, Accession NM_018908) is another VGAM1382 host target gene. PCDHA5 BINDING SITE is HOST TARGET binding site found in the 3' untranslated region of mRNA encoded by PCDHA5, corresponding to a HOST TARGET binding site such as BINDING SITE I, BINDING SITE II or BINDING SITE III. Table 2 illustrates the complementarity of the nucleotide sequences of PCDHA5 BINDING SITE, designated SEQ ID:20946, to the nucleotide sequence of VGAM1382 RNA, herein designated VGAM RNA, also designated SEQ ID:4093.

Another function of VGAM1382 is therefore inhibition of Protocadherin Alpha 5 (PCDHA5, Accession NM_018908). Accordingly, utilities of VGAM1382 include diagnosis, prevention and treatment of diseases and clinical conditions associated with PCDHA5. Protocadherin Alpha 6 (PCDHA6, Accession NM_018909) is another VGAM1382 host target gene. PCDHA6 BINDING SITE1 and PCDHA6 BINDING SITE2 are HOST TARGET binding sites found in untranslated regions of mRNA encoded by PCDHA6, corresponding to HOST TARGET binding sites such as BINDING SITE I, BINDING SITE II or BINDING SITE III. Table 2 illustrates the complementarity of the nucleotide sequences of PCDHA6 BINDING SITE1 and PCDHA6 BINDING SITE2, designated SEQ ID:20956 and SEQ ID:25588 respectively, to the nucleotide sequence of VGAM1382 RNA, herein designated VGAM RNA, also designated SEQ ID:4093.

Another function of VGAM1382 is therefore inhibition of Protocadherin Alpha 6 (PCDHA6, Accession NM_018909). Accordingly, utilities of VGAM1382 include diagnosis, prevention and treatment of diseases and clinical conditions associated with PCDHA6. Protocadherin Alpha 8 (PCDHA8, Accession NM_018911) is another VGAM1382 host target gene. PCDHA8 BINDING SITE is HOST TARGET binding site found in the 3' untranslated region of mRNA encoded by PCDHA8, corresponding to a HOST TARGET binding site such as BINDING SITE I, BINDING SITE II or BINDING SITE III. Table 2 illustrates the complementarity of the nucleotide sequences of PCDHA8 BINDING SITE, designated SEQ ID:20976, to the nucleotide sequence of VGAM1382 RNA, herein designated VGAM RNA, also designated SEQ ID:4093.

Another function of VGAM1382 is therefore inhibition of Protocadherin Alpha 8 (PCDHA8, Accession NM_018911). Accordingly, utilities of VGAM1382 include diagnosis, prevention and treatment of diseases and clinical conditions associated with PCDHA8. Protocadherin Alpha 9 (PCDHA9, Accession NM_031857) is another VGAM1382 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:25601, to the nucleotide sequence of VGAM1382 RNA, herein designated VGAM RNA, also designated SEQ ID:4093.

Another function of VGAM1382 is therefore inhibition of Protocadherin Alpha 9 (PCDHA9, Accession NM_031857), a gene which is a calcium-dependent cell-adhesion protein. Accordingly, utilities of VGAM1382 include diagnosis, prevention and treatment of diseases and clinical conditions associated with PCDHA9. The function of PCDHA9 and its association with various diseases and clinical conditions, has been established by previous studies, as described hereinabove with reference to VGAM71. Protocadherin Alpha Subfamily C, 1 (PCDHAC1, Accession NM_018898) is another VGAM1382 host target gene. PCDHAC1 BINDING SITE is HOST TARGET binding site found in the 3' untranslated region of mRNA encoded by PCDHAC1, corresponding to a HOST TARGET binding site such as BINDING SITE I, BINDING SITE II or BINDING SITE III. Table 2 illustrates the complementarity of the nucleotide sequences of PCDHAC1 BINDING SITE, designated SEQ ID:20845, to the nucleotide sequence of VGAM1382 RNA, herein designated VGAM RNA, also designated SEQ ID:4093.

Another function of VGAM1382 is therefore inhibition of Protocadherin Alpha Subfamily C, 1 (PCDHAC1, Accession NM_018898). Accordingly, utilities of VGAM1382 include diagnosis, prevention and treatment of diseases and clinical conditions associated with PCDHAC1. Protocadherin Alpha Subfamily C, 2 (PCDHAC2, Accession NM_018899) is another VGAM1382 host target gene. PCDHAC2 BINDING SITE is HOST TARGET binding site found in the 3' untranslated region of mRNA encoded by PCDHAC2, corresponding to a HOST TARGET binding site such as BINDING SITE I, BINDING SITE II or BINDING SITE III. Table 2 illustrates the complementarity of the nucleotide sequences of PCDHAC2 BINDING SITE, designated SEQ ID:20855, to the nucleotide sequence of VGAM1382 RNA, herein designated VGAM RNA, also designated SEQ ID:4093.

Another function of VGAM1382 is therefore inhibition of Protocadherin Alpha Subfamily C, 2 (PCDHAC2, Accession NM_018899). Accordingly, utilities of VGAM1382 include diagnosis, prevention and treatment of diseases and clinical conditions associated with PCDHAC2. Phosphorylase, Glycogen; Muscle (McArdle syndrome, glycogen storage disease type V) (PYGM, Accession NM_005609) is another VGAM1382 host target gene. PYGM BINDING SITE is HOST TARGET binding site found in the 5' untranslated region of mRNA encoded by PYGM, corresponding to a HOST TARGET binding site such as BINDING SITE I, BINDING SITE II or BINDING SITE III. Table 2 illustrates the complementarity of the nucleotide sequences of PYGM BINDING SITE, designated SEQ ID:12128, to the nucleotide sequence of VGAM1382 RNA, herein designated VGAM RNA, also designated SEQ ID:4093.

Another function of VGAM1382 is therefore inhibition of Phosphorylase, Glycogen; Muscle (McArdle syndrome, glycogen storage disease type V) (PYGM, Accession NM_005609). Accordingly, utilities of VGAM1382 include diagnosis, prevention and treatment of diseases and clinical conditions associated with PYGM. Spastic Paraplegia 7, Paraplegin (pure and complicated autosomal recessive) (SPG7, Accession NM_003119) is another VGAM1382 host target gene. SPG7 BINDING SITE is HOST TARGET binding site found in the 3' untranslated region of mRNA encoded by SPG7, corresponding to a HOST TARGET binding site such as BINDING SITE I, BINDING SITE II or BINDING SITE III. Table 2 illustrates the complementarity of the nucleotide sequences of SPG7 BINDING SITE, designated SEQ ID:9090, to the nucleotide sequence of VGAM1382 RNA, herein designated VGAM RNA, also designated SEQ ID:4093.

Another function of VGAM1382 is therefore inhibition of Spastic Paraplegia 7, Paraplegin (pure and complicated autosomal recessive) (SPG7, Accession NM_003119), a gene which act as an atp-dependent zinc metallopeptidase. involved in the degradation of sigma-32. Accordingly, utilities of VGAM1382 include diagnosis, prevention and treatment of diseases and clinical conditions associated with SPG7. The function of SPG7 has been established by previous studies. Casari et al. (1998) determined that paraplegin is highly homologous to the yeast mitochondrial ATPases AFG3, RCA1, and YME1, which have both proteolytic and chaperone-like activities at the inner mitochondrial membrane. Immunofluorescence analysis and import experiments showed that paraplegin localizes to mitochondria. Analysis of muscle biopsies from 2 patients with paraplegin mutations showed typical signs of mitochondrial OXPHOS defects, thus suggesting a mechanism for neurodegeneration in SPG-type disorders. Based on linkage analysis of a family with autosomal recessive spastic paraplegia that mapped to 16q24.3 (SPG7; 607259), Casari et al. (1998) used an EST clone to screen a human cDNA library and isolate a candidate gene. The full-length cDNA sequence corresponding to this gene encoded a deduced 795-amino acid protein, which they named paraplegin. Northern blot analysis detected a transcript of approximately 3.2 kb in all fetal and adult tissues tested. Two additional hybridizing transcripts of approximately 2.6 and 7.5 kb were detected in heart and pancreas Full details of the abovementioned studies are described in the following publications, the disclosure of which are hereby incorporated by reference:

Casari, G.; De Fusco, M.; Ciarmatori, S.; Zeviani, M.; Mora, M.; Fernandez, P.; De Michele, G.; Filla, A.; Cocozza, S.; Marconi, R.; Durr, A.; Fontaine, B.; Ballabio, A.: Spastic paraplegia and OXPHOS impairment caused by mutations in paraplegin, a nuclear-encoded mitochondrial metalloprotease. Cell 93:973-983, 1998; and Casari, G.; De Fusco, M.; Ciarmatori, S.; Zeviani, M.; Mora, M.; Fernandez, P.; De Michele, G.; Filla, A.; Cocozza, S.; Marconi, R.; Durr, A.; Fontaine, B.; Ballabio, A.: Spastic paraplegi.

Further studies establishing the function and utilities of SPG7 are found in John Hopkins OMIM database record ID 602783, and in sited publications numbered 7660-7662 listed in the bibliography section hereinbelow, which are also hereby incorporated by reference. Chemokine (C-C motif) Receptor 6 (CCR6, Accession NM_031409) is another VGAM1382 host target gene. CCR6 BINDING SITE is HOST TARGET binding site found in the 5' untranslated region of mRNA encoded by CCR6, corresponding to a HOST TARGET binding site such as BINDING SITE I, BINDING SITE II or BINDING SITE III. Table 2 illustrates the complementarity of the nucleotide sequences of CCR6 BINDING SITE, designated SEQ ID:25368, to the nucleotide sequence of VGAM1382 RNA, herein designated VGAM RNA, also designated SEQ ID:4093.

Another function of VGAM1382 is therefore inhibition of Chemokine (C-C motif) Receptor 6 (CCR6, Accession NM_031409). Accordingly, utilities of VGAM1382 include diagnosis, prevention and treatment of diseases and clinical conditions associated with CCR6. COAS3 (Accession NM_139020) is another VGAM1382 host target gene. COAS3 BINDING SITE is HOST TARGET binding site found in the 3' untranslated region of mRNA encoded by COAS3, corresponding to a HOST TARGET binding site such as BINDING SITE I, BINDING SITE II or BINDING SITE III. Table 2 illustrates the complementarity of the nucleotide sequences of COAS3 BINDING SITE, designated SEQ ID:29118, to the nucleotide sequence of VGAM1382 RNA, herein designated VGAM RNA, also designated SEQ ID:4093.

Another function of VGAM1382 is therefore inhibition of COAS3 (Accession NM_139020). Accordingly, utilities of VGAM1382 include diagnosis, prevention and treatment of diseases and clinical conditions associated with COAS3. Complexin 1 (CPLX1, Accession NM_006651) is another VGAM1382 host target gene. CPLX1 BINDING SITE is HOST TARGET binding site found in the 3' untranslated region of mRNA encoded by CPLX1, corresponding to a HOST TARGET binding site such as BINDING SITE I, BINDING SITE II or BINDING SITE III. Table 2 illustrates the complementarity of the nucleotide sequences of CPLX1 BINDING SITE, designated SEQ ID:13452, to the nucleotide sequence of VGAM1382 RNA, herein designated VGAM RNA, also designated SEQ ID:4093.

Another function of VGAM1382 is therefore inhibition of Complexin 1 (CPLX1, Accession NM_006651). Accordingly, utilities of VGAM1382 include diagnosis, prevention and treatment of diseases and clinical conditions associated with CPLX1. DKFZP434L1435 (Accession XM_166401) is another VGAM1382 host target gene. DKFZP434L1435 BINDING SITE is HOST TARGET binding site found in the 5' untranslated region of mRNA encoded by DKFZP434L1435, corresponding to a HOST TARGET binding site such as BINDING SITE I, BINDING SITE II or BINDING SITE III. Table 2 illustrates the complementarity of the nucleotide sequences of DKFZP434L1435 BINDING SITE, designated SEQ ID:44266, to the nucleotide sequence of VGAM1382 RNA, herein designated VGAM RNA, also designated SEQ ID:4093.

Another function of VGAM1382 is therefore inhibition of DKFZP434L1435 (Accession XM_166401). Accordingly, utilities of VGAM1382 include diagnosis, prevention and treatment of diseases and clinical conditions associated with DKFZP434L1435. DnaJ (Hsp40) Homolog, Subfamily C, Member 5 (DNAJC5, Accession XM_028966) is another VGAM1382 host target gene. DNAJC5 BINDING SITE is HOST TARGET binding site found in the 3' untranslated region of mRNA encoded by DNAJC5, corresponding to a HOST TARGET binding site such as BINDING SITE I, BINDING SITE II or BINDING SITE III. Table 2 illustrates the complementarity of the nucleotide sequences of DNAJC5 BINDING SITE, designated SEQ ID:30815, to the nucleotide sequence of VGAM1382 RNA, herein designated VGAM RNA, also designated SEQ ID:4093.

Another function of VGAM1382 is therefore inhibition of DnaJ (Hsp40) Homolog, Subfamily C, Member 5 (DNAJC5, Accession XM_028966). Accordingly, utilities of VGAM1382 include diagnosis, prevention and treatment of diseases and clinical conditions associated with DNAJC5. FLJ12875 (Accession NM_024544) is another VGAM1382 host target gene. FLJ12875 BINDING SITE is HOST TARGET binding site found in the 3' untranslated region of mRNA encoded by FLJ12875, corresponding to a HOST TARGET binding site such as BINDING SITE I, BINDING SITE II or BINDING SITE III. Table 2 illustrates the complementarity of the nucleotide sequences of FLJ12875 BINDING SITE, designated SEQ ID:23754, to the nucleotide sequence of VGAM1382 RNA, herein designated VGAM RNA, also designated SEQ ID:4093.

Another function of VGAM1382 is therefore inhibition of FLJ12875 (Accession NM_024544). Accordingly, utilities of VGAM1382 include diagnosis, prevention and treatment of diseases and clinical conditions associated with FLJ12875. FLJ13181 (Accession NM_025188) is another VGAM1382 host target gene. FLJ13181 BINDING SITE is HOST TARGET binding site found in the 5' untranslated region of mRNA encoded by FLJ13181, corresponding to a HOST TARGET binding site such as BINDING SITE I, BINDING SITE II or BINDING SITE III. Table 2 illustrates the complementarity of the nucleotide sequences of FLJ13181 BINDING SITE, designated SEQ ID:24829, to the nucleotide sequence of VGAM1382 RNA, herein designated VGAM RNA, also designated SEQ ID:4093.

Another function of VGAM1382 is therefore inhibition of FLJ13181 (Accession NM_025188). Accordingly, utilities of VGAM1382 include diagnosis, prevention and treatment of diseases and clinical conditions associated with FLJ13181. FLJ14564 (Accession XM_084459) is another VGAM1382 host target gene. FLJ14564 BINDING SITE is HOST TARGET binding site found in the 3' untranslated region of mRNA encoded by FLJ14564, corresponding to a HOST TARGET binding site such as BINDING SITE I, BINDING SITE II or BINDING SITE III. Table 2 illustrates the complementarity of the nucleotide sequences of FLJ14564 BINDING SITE, designated SEQ ID:37596, to the nucleotide sequence of VGAM1382 RNA, herein designated VGAM RNA, also designated SEQ ID:4093.

Another function of VGAM1382 is therefore inhibition of FLJ14564 (Accession XM_084459). Accordingly, utilities of VGAM1382 include diagnosis, prevention and treatment of diseases and clinical conditions associated with FLJ14564. FLJ14800 (Accession NM_032840) is another VGAM1382 host target gene. FLJ14800 BINDING SITE is HOST TARGET binding site found in the 3' untranslated region of mRNA encoded by FLJ14800, corresponding to a HOST TARGET binding site such as BINDING SITE I, BINDING SITE II or BINDING SITE III. Table 2 illustrates the complementarity of the nucleotide sequences of FLJ14800 BINDING SITE, designated SEQ ID:26623, to the nucleotide sequence of VGAM1382 RNA, herein designated VGAM RNA, also designated SEQ ID:4093.

Another function of VGAM1382 is therefore inhibition of FLJ14800 (Accession NM_032840). Accordingly, utilities of VGAM1382 include diagnosis, prevention and treatment of diseases and clinical conditions associated with FLJ14800. Junctional Adhesion Molecule 1 (JAM1, Accession NM_144502) is another VGAM1382 host target gene. JAM1 BINDING SITE1 through JAM1 BINDING SITE4 are HOST TARGET binding sites found in untranslated regions of mRNA encoded by JAM1, corresponding to HOST TARGET binding sites such as BINDING SITE I, BINDING SITE II or BINDING SITE III. Table 2 illustrates the complementarity of the nucleotide sequences of JAM1 BINDING SITE1 through JAM1 BINDING SITE4, designated SEQ ID:29327, SEQ ID:29336, SEQ ID:29347 and SEQ ID:18860 respectively, to the nucleotide sequence of VGAM1382 RNA, herein designated VGAM RNA, also designated SEQ ID:4093.

Another function of VGAM1382 is therefore inhibition of Junctional Adhesion Molecule 1 (JAM1, Accession NM_144502). Accordingly, utilities of VGAM1382 include diagnosis, prevention and treatment of diseases and clinical conditions associated with JAM1. KIAA0275 (Accession NM_014767) is another VGAM1382 host target gene. KIAA0275 BINDING SITE is HOST TARGET binding site found in the 3' untranslated region of mRNA encoded by KIAA0275, corresponding to a HOST TARGET binding site such as BINDING SITE I, BINDING SITE II or BINDING SITE III. Table 2 illustrates the complementarity of the nucleotide sequences of KIAA0275 BINDING SITE, designated SEQ ID:16549, to the nucleotide sequence of VGAM1382 RNA, herein designated VGAM RNA, also designated SEQ ID:4093.

Another function of VGAM1382 is therefore inhibition of KIAA0275 (Accession NM_014767). Accordingly, utilities of VGAM1382 include diagnosis, prevention and treatment of diseases and clinical conditions associated with KIAA0275. KIAA0494 (Accession NM_014774) is another VGAM1382 host target gene. KIAA0494 BINDING SITE is HOST TARGET binding site found in the 5' untranslated region of mRNA encoded by KIAA0494, corresponding to a HOST TARGET binding site such as BINDING SITE I, BINDING SITE II or BINDING SITE III. Table 2 illustrates the complementarity of the nucleotide sequences of KIAA0494 BINDING SITE, designated SEQ ID:16591, to the nucleotide sequence of VGAM1382 RNA, herein designated VGAM RNA, also designated SEQ ID:4093.

Another function of VGAM1382 is therefore inhibition of KIAA0494 (Accession NM_014774). Accordingly, utilities of VGAM1382 include diagnosis, prevention and treatment of diseases and clinical conditions associated with KIAA0494. KIAA1184 (Accession NM_022572) is another VGAM1382 host target gene. KIAA1184 BINDING SITE is HOST TARGET binding site found in the 3' untranslated region of mRNA encoded by KIAA1184, corresponding to a HOST TARGET binding site such as BINDING SITE I, BINDING SITE II or BINDING SITE III. Table 2 illustrates the complementarity of the nucleotide sequences of KIAA1184 BINDING SITE, designated SEQ ID:22896, to the nucleotide sequence of VGAM1382 RNA, herein designated VGAM RNA, also designated SEQ ID:4093.

Another function of VGAM1382 is therefore inhibition of KIAA1184 (Accession NM_022572). Accordingly, utilities of VGAM1382 include diagnosis, prevention and treatment of diseases and clinical conditions associated with KIAA1184. OBTP (Accession NM_017601) is another VGAM1382 host target gene. OBTP BINDING SITE is HOST TARGET binding site found in the 5' untranslated region of mRNA encoded by OBTP, corresponding to a HOST TARGET binding site such as BINDING SITE I, BINDING SITE II or BINDING SITE III. Table 2 illustrates the complementarity of the nucleotide sequences of OBTP BINDING SITE, designated SEQ ID:19078, to the nucleotide sequence of VGAM1382 RNA, herein designated VGAM RNA, also designated SEQ ID:4093.

Another function of VGAM1382 is therefore inhibition of OBTP (Accession NM_017601). Accordingly, utilities of VGAM1382 include diagnosis, prevention and treatment of diseases and clinical conditions associated with OBTP. RP4-622L5 (Accession NM_019118) is another VGAM1382 host target gene. RP4-622L5 BINDING SITE is HOST TARGET binding site found in the 3' untranslated region of mRNA encoded by RP4-622L5, corresponding to a HOST TARGET binding site such as BINDING SITE I, BINDING SITE II or BINDING SITE III. Table 2 illustrates the complementarity of the nucleotide sequences of RP4-622L5 BINDING SITE, designated SEQ ID:21203, to the nucleotide sequence of VGAM1382 RNA, herein designated VGAM RNA, also designated SEQ ID:4093.

Another function of VGAM1382 is therefore inhibition of RP4-622L5 (Accession NM_019118). Accordingly, utilities of VGAM1382 include diagnosis, prevention and treatment of diseases and clinical conditions associated with RP4-622L5. LOC126302 (Accession XM_059020) is another VGAM1382 host target gene. LOC126302 BINDING SITE is HOST TARGET binding site found in the 3' untranslated region of mRNA encoded by LOC126302, corresponding to a HOST TARGET binding site such as BINDING SITE I, BINDING SITE II or BINDING SITE III. Table 2 illustrates the complementarity of the nucleotide sequences of LOC126302 BINDING SITE, designated SEQ ID:36819, to the nucleotide sequence of VGAM1382 RNA, herein designated VGAM RNA, also designated SEQ ID:4093.

Another function of VGAM1382 is therefore inhibition of LOC126302 (Accession XM_059020). Accordingly, utilities of VGAM1382 include diagnosis, prevention and treatment of diseases and clinical conditions associated with LOC126302. LOC127602 (Accession XM_059166) is another VGAM1382 host target gene. LOC127602 BINDING SITE is HOST TARGET binding site found in the 5' untranslated region of mRNA encoded by LOC127602, corresponding to a HOST TARGET binding site such as BINDING SITE I, BINDING SITE II or BINDING SITE III. Table 2 illustrates the complementarity of the nucleotide sequences of LOC127602 BINDING SITE, designated SEQ ID:36905, to the nucleotide sequence of VGAM1382 RNA, herein designated VGAM RNA, also designated SEQ ID:4093.

Another function of VGAM1382 is therefore inhibition of LOC127602 (Accession XM_059166). Accordingly, utilities of VGAM1382 include diagnosis, prevention and treatment of diseases and clinical conditions associated with LOC127602. LOC128954 (Accession XM_066252) is another VGAM1382 host target gene. LOC128954 BINDING SITE is HOST TARGET binding site found in the 5' untranslated region of mRNA encoded by LOC128954, corresponding to a HOST TARGET binding site such as BINDING SITE I, BINDING SITE II or BINDING SITE III. Table 2 illustrates the complementarity of the nucleotide sequences of LOC128954 BINDING SITE, designated SEQ ID:37322, to the nucleotide sequence of VGAM1382 RNA, herein designated VGAM RNA, also designated SEQ ID:4093.

Another function of VGAM1382 is therefore inhibition of LOC128954 (Accession XM_066252). Accordingly, utilities of VGAM1382 include diagnosis, prevention and treatment of diseases and clinical conditions associated with LOC128954. LOC136069 (Accession XM_069689) is another VGAM1382 host target gene. LOC136069 BINDING SITE is HOST TARGET binding site found in the 5' untranslated region of mRNA encoded by LOC136069, corresponding to a HOST TARGET binding site such as BIND- ING SITE I, BINDING SITE II or BINDING SITE III. Table 2 illustrates the complementarity of the nucleotide sequences of LOC136069 BINDING SITE, designated SEQ ID:37390, to the nucleotide sequence of VGAM1382 RNA, herein designated VGAM RNA, also designated SEQ ID:4093.

Another function of VGAM1382 is therefore inhibition of LOC136069 (Accession XM_069689). Accordingly, utilities of VGAM1382 include diagnosis, prevention and treatment of diseases and clinical conditions associated with LOC136069. LOC148490 (Accession XM_086210) is another VGAM1382 host target gene. LOC148490 BINDING SITE is HOST TARGET binding site found in the 5' untranslated region of mRNA encoded by LOC148490, corresponding to a HOST TARGET binding site such as BINDING SITE I, BINDING SITE II or BINDING SITE III. Table 2 illustrates the complementarity of the nucleotide sequences of LOC148490 BINDING SITE, designated SEQ ID:38545, to the nucleotide sequence of VGAM1382 RNA, herein designated VGAM RNA, also designated SEQ ID:4093.

Another function of VGAM1382 is therefore inhibition of LOC148490 (Accession XM_086210). Accordingly, utilities of VGAM1382 include diagnosis, prevention and treatment of diseases and clinical conditions associated with LOC148490. LOC149401 (Accession XM_086511) is another VGAM1382 host target gene. LOC149401 BINDING SITE is HOST TARGET binding site found in the 3' untranslated region of mRNA encoded by LOC149401, corresponding to a HOST TARGET binding site such as BINDING SITE I, BINDING SITE II or BINDING SITE III. Table 2 illustrates the complementarity of the nucleotide sequences of LOC149401 BINDING SITE, designated SEQ ID:38737, to the nucleotide sequence of VGAM1382 RNA, herein designated VGAM RNA, also designated SEQ ID:4093.

Another function of VGAM1382 is therefore inhibition of LOC149401 (Accession XM_086511). Accordingly, utilities of VGAM1382 include diagnosis, prevention and treatment of diseases and clinical conditions associated with LOC149401. LOC157273 (Accession XM_098743) is another VGAM1382 host target gene. LOC157273 BINDING SITE is HOST TARGET binding site found in the 3' untranslated region of mRNA encoded by LOC157273, corresponding to a HOST TARGET binding site such as BINDING SITE I, BINDING SITE II or BINDING SITE III. Table 2 illustrates the complementarity of the nucleotide sequences of LOC157273 BINDING SITE, designated SEQ ID:41785, to the nucleotide sequence of VGAM1382 RNA, herein designated VGAM RNA, also designated SEQ ID:4093.

Another function of VGAM1382 is therefore inhibition of LOC157273 (Accession XM_098743). Accordingly, utilities of VGAM1382 include diagnosis, prevention and treatment of diseases and clinical conditions associated with LOC157273. LOC160156 (Accession XM_090047) is another VGAM1382 host target gene. LOC160156 BINDING SITE is HOST TARGET binding site found in the 5' untranslated region of mRNA encoded by LOC160156, corresponding to a HOST TARGET binding site such as BINDING SITE I, BINDING SITE II or BINDING SITE III. Table 2 illustrates the complementarity of the nucleotide sequences of LOC160156 BINDING SITE, designated SEQ ID:39991, to the nucleotide sequence of VGAM1382 RNA, herein designated VGAM RNA, also designated SEQ ID:4093.

Another function of VGAM1382 is therefore inhibition of LOC160156 (Accession XM_090047). Accordingly, utilities of VGAM1382 include diagnosis, prevention and treatment of diseases and clinical conditions associated with LOC160156. LOC161247 (Accession XM_090783) is another VGAM1382 host target gene. LOC161247 BINDING SITE is HOST TARGET binding site found in the 5' untranslated region of mRNA encoded by LOC161247, corresponding to a HOST TARGET binding site such as BINDING SITE I, BINDING SITE II or BINDING SITE III. Table 2 illustrates the complementarity of the nucleotide sequences of LOC161247 BINDING SITE, designated SEQ ID:40015, to the nucleotide sequence of VGAM1382 RNA, herein designated VGAM RNA, also designated SEQ ID:4093.

Another function of VGAM1382 is therefore inhibition of LOC161247 (Accession XM_090783). Accordingly, utilities of VGAM1382 include diagnosis, prevention and treatment of diseases and clinical conditions associated with LOC161247. LOC255779 (Accession XM_171147) is another VGAM1382 host target gene. LOC255779 BINDING SITE is HOST TARGET binding site found in the 3' untranslated region of mRNA encoded by LOC255779, corresponding to a HOST TARGET binding site such as BINDING SITE I, BINDING SITE II or BINDING SITE III. Table 2 illustrates the complementarity of the nucleotide sequences of LOC255779 BINDING SITE, designated SEQ ID:45942, to the nucleotide sequence of VGAM1382 RNA, herein designated VGAM RNA, also designated SEQ ID:4093.

Another function of VGAM1382 is therefore inhibition of LOC255779 (Accession XM_171147). Accordingly, utilities of VGAM1382 include diagnosis, prevention and treatment of diseases and clinical conditions associated with LOC255779. FIG. 1 further provides a conceptual description of a novel bioinformatically detected viral gene of the present invention, referred to here as Viral Genomic Address Messenger 1383 (VGAM1383) viral gene, which modulates expression of respective host target genes thereof, the function and utility of which host target genes is known in the art.

VGAM1383 is a novel bioinformatically detected regulatory, non protein coding, viral micro RNA (miRNA) gene. The method by which VGAM1383 was detected is described hereinabove with reference to FIGS. 1-8.

VGAM1383 gene, herein designated VGAM GENE, is a viral gene contained in the genome of Himetobi P Virus. VGAM1383 host target gene, herein designated VGAM HOST TARGET GENE, is a human gene contained in the human genome.

VGAM1383 gene encodes a VGAM1383 precursor RNA, herein designated VGAM PRECURSOR RNA. Similar to other miRNA genes, and unlike most ordinary genes, VGAM1383 precursor RNA does not encode a protein. A nucleotide sequence identical or highly similar to the nucleotide sequence of VGAM1383 precursor RNA is designated SEQ ID:1369, and is provided hereinbelow with reference to the sequence listing part. Nucleotide sequence SEQ ID:1369 is located at position 7039 relative to the genome of Himetobi P Virus.

VGAM1383 precursor RNA folds onto itself, forming VGAM1383 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1383 folded precursor RNA into VGAM1383 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1383 RNA is designated SEQ ID:4094, and is provided hereinbelow with reference to the sequence listing part.

VGAM1383 host target gene, herein designated VGAM HOST TARGET GENE, encodes a corresponding messenger RNA, VGAM1383 host target RNA, herein designated VGAM HOST TARGET RNA. VGAM1383 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1383 RNA, herein designated VGAM RNA, binds complementarily to one or more host target binding sites located in untranslated regions of VGAM1383 host target RNA, herein designated VGAM HOST TARGET RNA. This complementary binding is due to the fact that the nucleotide sequence of VGAM1383 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1383 RNA, herein designated VGAM RNA, may have a different number of host target binding sites in untranslated regions of a VGAM1383 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1383 RNA, herein designated VGAM RNA, to host target binding sites on VGAM1383 host target RNA, herein designated VGAM HOST TARGET RNA, such as BINDING SITE I, BINDING SITE II and BINDING SITE III, inhibits translation of VGAM1383 host target RNA into VGAM1383 host target protein, herein designated VGAM HOST TARGET PROTEIN. VGAM host target protein is therefore outlined by a broken line.

It is appreciated that VGAM1383 host target gene, herein designated VGAM HOST TARGET GENE, in fact represents a plurality of VGAM1383 host target genes. The mRNA of each one of this plurality of VGAM1383 host target genes comprises one or more host target binding sites, each having a nucleotide sequence which is at least partly complementary to VGAM1383 RNA, herein designated VGAM RNA, and which when bound by VGAM1383 RNA causes inhibition of translation of respective one or more VGAM1383 host target proteins.

It is further appreciated by one skilled in the art that the mode of translational inhibition illustrated by FIG. 1 with specific reference to translational inhibition exerted by VGAM1383 gene, herein designated VGAM GENE, on one or more VGAM1383 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1383 is inhibition of expression of host target genes, as part of a novel viral mechanism of attacking a host. Accordingly, utilities of VGAM1383 include diagnosis, prevention and treatment of viral infection by Himetobi P Virus. Specific functions, and accordingly utilities, of VGAM1383 correlate with, and may be deduced from, the identity of the host target genes which VGAM1383 binds and inhibits, and the function of these host target genes, as elaborated hereinbelow.

Nucleotide sequences of the VGAM1383 precursor RNA, herein designated VGAM PRECURSOR RNA, and of the 'diced' VGAM1383 RNA, herein designated VGAM RNA, and a schematic representation of the secondary folding of VGAM1383 folded precursor RNA, herein designated VGAM FOLDED PRECURSOR RNA, of VGAM1383 are further described hereinbelow with reference to Table 1.

Nucleotide sequences of host target binding sites, such as BINDING SITE-I, BINDING SITE-II and BINDING SITE-III of FIG. 1, found on VGAM1383 host target RNA, and schematic representation of the complementarity of each of these host target binding sites to VGAM1383 RNA, herein designated VGAM RNA, are described hereinbelow with reference to Table 2.

As mentioned hereinabove with reference to FIG. 1, a function of VGAM1383 gene, herein designated VGAM is inhibition of expression of VGAM1383 target genes. It is appreciated that specific functions, and accordingly utilities, of VGAM1383 correlate with, and may be deduced from, the identity of the target genes which VGAM1383 binds and inhibits, and the function of these target genes, as elaborated hereinbelow.

Dystrophia Myotonica-protein Kinase (DMPK, Accession NM_004409) is a VGAM1383 host target gene. DMPK BINDING SITE is HOST TARGET binding site found in the 5' untranslated region of mRNA encoded by DMPK, corresponding to a HOST TARGET binding site such as BINDING SITE I, BINDING SITE II or BINDING SITE III. Table 2 illustrates the complementarity of the nucleotide sequences of DMPK BINDING SITE, designated SEQ ID:10662, to the nucleotide sequence of VGAM1383 RNA, herein designated VGAM RNA, also designated SEQ ID:4094.

A function of VGAM1383 is therefore inhibition of Dystrophia Myotonica-protein Kinase (DMPK, Accession NM_004409). Accordingly, utilities of VGAM1383 include diagnosis, prevention and treatment of diseases and clinical conditions associated with DMPK. Claudin 15 (CLDN15, Accession NM_138429) is another VGAM1383 host target gene. CLDN15 BINDING SITE is HOST TARGET binding site found in the 3' untranslated region of mRNA encoded by CLDN15, corresponding to a HOST TARGET binding site such as BINDING SITE I, BINDING SITE II or BINDING SITE III. Table 2 illustrates the complementarity of the nucleotide sequences of CLDN15 BINDING SITE, designated SEQ ID:28792, to the nucleotide sequence of VGAM1383 RNA, herein designated VGAM RNA, also designated SEQ ID:4094.

Another function of VGAM1383 is therefore inhibition of Claudin 15 (CLDN15, Accession NM_138429). Accordingly, utilities of VGAM1383 include diagnosis, prevention and treatment of diseases and clinical conditions associated with CLDN15. Hypermethylated In Cancer 2 (HIC2, Accession XM_036937) is another VGAM1383 host target gene. HIC2 BINDING SITE is HOST TARGET binding site found in the 3' untranslated region of mRNA encoded by HIC2, corresponding to a HOST TARGET binding site such as BINDING SITE I, BINDING SITE II or BINDING SITE III. Table 2 illustrates the complementarity of the nucleotide sequences of HIC2 BINDING SITE, designated SEQ ID:32532, to the nucleotide sequence of VGAM1383 RNA, herein designated VGAM RNA, also designated SEQ ID:4094.

Another function of VGAM1383 is therefore inhibition of Hypermethylated In Cancer 2 (HIC2, Accession XM_036937). Accordingly, utilities of VGAM1383 include diagnosis, prevention and treatment of diseases and clinical conditions associated with HIC2. KIAA1189 (Accession XM_050508) is another VGAM1383 host target gene. KIAA1189 BINDING SITE is HOST TARGET binding site found in the 3' untranslated region of mRNA encoded by KIAA1189, corresponding to a HOST TARGET binding site such as BINDING SITE I, BINDING SITE II or BINDING SITE III. Table 2 illustrates the complementarity of the nucleotide sequences of KIAA1189 BINDING SITE, designated SEQ ID:35651, to the nucleotide sequence of VGAM1383 RNA, herein designated VGAM RNA, also designated SEQ ID:4094.

Another function of VGAM1383 is therefore inhibition of KIAA1189 (Accession XM_050508). Accordingly, utilities of VGAM1383 include diagnosis, prevention and treatment of diseases and clinical conditions associated with KIAA1189. KIAA1500 (Accession XM_034353) is another VGAM1383 host target gene. KIAA1500 BINDING SITE is HOST TARGET binding site found in the 3' untranslated region of mRNA encoded by KIAA1500, corresponding to a HOST TARGET binding site such as BINDING SITE I, BINDING SITE II or BINDING SITE III. Table 2 illustrates the complementarity of the nucleotide sequences of KIAA1500 BINDING SITE, designated SEQ ID:32062, to the nucleotide sequence of VGAM1383 RNA, herein designated VGAM RNA, also designated SEQ ID:4094.

Another function of VGAM1383 is therefore inhibition of KIAA1500 (Accession XM_034353). Accordingly, utilities of VGAM1383 include diagnosis, prevention and treatment of diseases and clinical conditions associated with KIAA1500. NIR3 (Accession XM_038799) is another VGAM1383 host target gene. NIR3 BINDING SITE is HOST TARGET binding site found in the 3' untranslated region of mRNA encoded by NIR3, corresponding to a HOST TARGET binding site such as BINDING SITE I, BINDING SITE II or BINDING SITE III. Table 2 illustrates the complementarity of the nucleotide sequences of NIR3 BINDING SITE, designated SEQ ID:32923, to the nucleotide sequence of VGAM1383 RNA, herein designated VGAM RNA, also designated SEQ ID:4094.

Another function of VGAM1383 is therefore inhibition of NIR3 (Accession XM_038799). Accordingly, utilities of VGAM1383 include diagnosis, prevention and treatment of diseases and clinical conditions associated with NIR3. SPBPBP (Accession NM_006692) is another VGAM1383 host target gene. SPBPBP BINDING SITE is HOST TARGET binding site found in the 5' untranslated region of mRNA encoded by SPBPBP, corresponding to a HOST TARGET binding site such as BINDING SITE I, BINDING SITE II or BINDING SITE III. Table 2 illustrates the complementarity of the nucleotide sequences of SPBPBP BINDING SITE, designated SEQ ID:13508, to the nucleotide sequence of VGAM1383 RNA, herein designated VGAM RNA, also designated SEQ ID:4094.

Another function of VGAM1383 is therefore inhibition of SPBPBP (Accession NM_006692). Accordingly, utilities of VGAM1383 include diagnosis, prevention and treatment of diseases and clinical conditions associated with SPBPBP.

Signal Transducer and Activator of Transcription 2, 113 kDa (STAT2, Accession NM_005419) is another VGAM1383 host target gene. STAT2 BINDING SITE is HOST TARGET binding site found in the 3' untranslated region of mRNA encoded by STAT2, corresponding to a HOST TARGET binding site such as BINDING SITE I, BINDING SITE II or BINDING SITE III. Table 2 illustrates the complementarity of the nucleotide sequences of STAT2 BINDING SITE, designated SEQ ID:11890, to the nucleotide sequence of VGAM1383 RNA, herein designated VGAM RNA, also designated SEQ ID:4094.

Another function of VGAM1383 is therefore inhibition of Signal Transducer and Activator of Transcription 2, 113 kDa (STAT2, Accession NM_005419). Accordingly, utilities of VGAM1383 include diagnosis, prevention and treatment of diseases and clinical conditions associated with STAT2. LOC119392 (Accession NM_145247) is another VGAM1383 host target gene. LOC119392 BINDING SITE is HOST TARGET binding site found in the 3' untranslated region of mRNA encoded by LOC119392, corresponding to a HOST TARGET binding site such as BINDING SITE I, BINDING SITE II or BINDING SITE III. Table 2 illustrates the complementarity of the nucleotide sequences of LOC119392 BINDING SITE, designated SEQ ID:29757, to the nucleotide sequence of VGAM1383 RNA, herein designated VGAM RNA, also designated SEQ ID:4094.

Another function of VGAM1383 is therefore inhibition of LOC119392 (Accession NM_145247). Accordingly, utilities of VGAM1383 include diagnosis, prevention and treatment of diseases and clinical conditions associated with LOC119392. LOC123242 (Accession XM_063548) is another VGAM1383 host target gene. LOC123242 BINDING SITE is HOST TARGET binding site found in the 5' untranslated region of mRNA encoded by LOC123242, corresponding to a HOST TARGET binding site such as BINDING SITE I, BINDING SITE II or BINDING SITE III. Table 2 illustrates the complementarity of the nucleotide sequences of LOC123242 BINDING SITE, designated SEQ ID:37238, to the nucleotide sequence of VGAM1383 RNA, herein designated VGAM RNA, also designated SEQ ID:4094.

Another function of VGAM1383 is therefore inhibition of LOC123242 (Accession XM_063548). Accordingly, utilities of VGAM1383 include diagnosis, prevention and treatment of diseases and clinical conditions associated with LOC123242. LOC221688 (Accession XM_168085) is another VGAM1383 host target gene. LOC221688 BINDING SITE is HOST TARGET binding site found in the 3' untranslated region of mRNA encoded by LOC221688, corresponding to a HOST TARGET binding site such as BINDING SITE I, BINDING SITE II or BINDING SITE III. Table 2 illustrates the complementarity of the nucleotide sequences of LOC221688 BINDING SITE, designated SEQ ID:44990, to the nucleotide sequence of VGAM1383 RNA, herein designated VGAM RNA, also designated SEQ ID:4094.

Another function of VGAM1383 is therefore inhibition of LOC221688 (Accession XM_168085). Accordingly, utilities of VGAM1383 include diagnosis, prevention and treatment of diseases and clinical conditions associated with LOC221688. LOC253001 (Accession XM_171711) is another VGAM1383 host target gene. LOC253001 BINDING SITE is HOST TARGET binding site found in the 5' untranslated region of mRNA encoded by LOC253001, corresponding to a HOST TARGET binding site such as BINDING SITE I, BINDING SITE II or BINDING SITE III. Table 2 illustrates the complementarity of the nucleotide sequences of LOC253001 BINDING SITE, designated SEQ ID:46055, to the nucleotide sequence of VGAM1383 RNA, herein designated VGAM RNA, also designated SEQ ID:4094.

Another function of VGAM1383 is therefore inhibition of LOC253001 (Accession XM_171711). Accordingly, utilities of VGAM1383 include diagnosis, prevention and treatment of diseases and clinical conditions associated with LOC253001. FIG. 1 further provides a conceptual description of a novel bioinformatically detected viral gene of the present invention, referred to here as Viral Genomic Address Messenger 1384 (VGAM1384) viral gene, which modulates expression of respective host target genes thereof, the function and utility of which host target genes is known in the art.

VGAM1384 is a novel bioinformatically detected regulatory, non protein coding, viral micro RNA (miRNA) gene. The method by which VGAM1384 was detected is described hereinabove with reference to FIGS. 1-8.

VGAM1384 gene, herein designated VGAM GENE, is a viral gene contained in the genome of Himetobi P Virus. VGAM1384 host target gene, herein designated VGAM HOST TARGET GENE, is a human gene contained in the human genome.

VGAM1384 gene encodes a VGAM1384 precursor RNA, herein designated VGAM PRECURSOR RNA. Similar to other miRNA genes, and unlike most ordinary genes, VGAM1384 precursor RNA does not encode a protein. A nucleotide sequence identical or highly similar to the nucleotide sequence of VGAM1384 precursor RNA is designated SEQ ID:1370, and is provided hereinbelow with reference to the sequence listing part. Nucleotide sequence SEQ ID:1370 is located at position 1905 relative to the genome of Himetobi P Virus.

VGAM1384 precursor RNA folds onto itself, forming VGAM1384 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1384 folded precursor RNA into VGAM1384 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1384 RNA is designated SEQ ID:4095, and is provided hereinbelow with reference to the sequence listing part.

VGAM1384 host target gene, herein designated VGAM HOST TARGET GENE, encodes a corresponding messenger RNA, VGAM1384 host target RNA, herein designated VGAM HOST TARGET RNA. VGAM1384 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1384 RNA, herein designated VGAM RNA, binds complementarily to one or more host target binding sites located in untranslated regions of VGAM1384 host target RNA, herein designated VGAM HOST TARGET RNA. This complementary binding is due to the fact that the nucleotide sequence of VGAM1384 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1384 RNA, herein designated VGAM RNA, may have a different number of host target binding sites in untranslated regions of a VGAM1384 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1384 RNA, herein designated VGAM RNA, to host target binding sites on VGAM1384 host target RNA, herein designated VGAM HOST TARGET RNA, such as BINDING SITE I, BINDING SITE II and BINDING SITE III, inhibits translation of VGAM1384 host target RNA into VGAM1384 host target protein, herein designated VGAM HOST TARGET PROTEIN. VGAM host target protein is therefore outlined by a broken line.

It is appreciated that VGAM1384 host target gene, herein designated VGAM HOST TARGET GENE, in fact represents a plurality of VGAM1384 host target genes. The mRNA of each one of this plurality of VGAM1384 host target genes comprises one or more host target binding sites, each having a nucleotide sequence which is at least partly complementary to VGAM1384 RNA, herein designated VGAM RNA, and which when bound by VGAM1384 RNA causes inhibition of translation of respective one or more VGAM1384 host target proteins.

It is further appreciated by one skilled in the art that the mode of translational inhibition illustrated by FIG. 1 with specific reference to translational inhibition exerted by VGAM1384 gene, herein designated VGAM GENE, on one or more VGAM1384 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1384 is inhibition of expression of host target genes, as part of a novel viral mechanism of attacking a host. Accordingly, utilities of VGAM1384 include diagnosis, prevention and treatment of viral infection by Himetobi P Virus. Specific functions, and accordingly utilities, of VGAM1384 correlate with, and may be deduced from, the identity of the host target genes which VGAM1384 binds and inhibits, and the function of these host target genes, as elaborated hereinbelow.

Nucleotide sequences of the VGAM1384 precursor RNA, herein designated VGAM PRECURSOR RNA, and of the 'diced' VGAM1384 RNA, herein designated VGAM RNA, and a schematic representation of the secondary folding of VGAM1384 folded precursor RNA, herein designated VGAM FOLDED PRECURSOR RNA, of VGAM1384 are further described hereinbelow with reference to Table 1.

Nucleotide sequences of host target binding sites, such as BINDING SITE-I, BINDING SITE-II and BINDING SITE-III of FIG. 1, found on VGAM1384 host target RNA, and schematic representation of the complementarity of each of these host target binding sites to VGAM1384 RNA, herein designated VGAM RNA, are described hereinbelow with reference to Table 2.

As mentioned hereinabove with reference to FIG. 1, a function of VGAM1384 gene, herein designated VGAM is inhibition of expression of VGAM1384 target genes. It is appreciated that specific functions, and accordingly utilities, of VGAM1384 correlate with, and may be deduced from, the identity of the target genes which VGAM1384 binds and inhibits, and the function of these target genes, as elaborated hereinbelow.

Homeo Box D3 (HOXD3, Accession NM_006898) is a VGAM1384 host target gene. HOXD3 BINDING SITE is HOST TARGET binding site found in the 3' untranslated region of mRNA encoded by HOXD3, corresponding to a HOST TARGET binding site such as BINDING SITE I, BINDING SITE II or BINDING SITE III. Table 2 illustrates the complementarity of the nucleotide sequences of HOXD3 BINDING SITE, designated SEQ ID:13775, to the nucleotide sequence of VGAM1384 RNA, herein designated VGAM RNA, also designated SEQ ID:4095.

A function of VGAM1384 is therefore inhibition of Homeo Box D3 (HOXD3, Accession NM_006898), a gene which plays a role in the differentiation process of hematopoietic cells. Accordingly, utilities of VGAM1384 include diagnosis, prevention and treatment of diseases and clinical conditions associated with HOXD3. The function of HOXD3 has been established by previous studies. Magli et al. (1991) presented evidence that the genomic organization of the human HOX genes reflects a regulatory hierarchy involved in the differentiation process of hematopoietic cells. Their results demonstrated that cells representing various stages of hematopoietic differentiation display differential patterns of HOX gene expression and that HOX genes are coordinately switched on or off in blocks that may include entire clusters. The entire HOX4 cluster was silent in all erythroleukemic, promyelocytic, and monocytic cell lines analyzed, and almost all the so-called HOX-2 genes (e.g., HOX2A; 142960; also symbolized HOXB5) were active in erythroleukemic cells and turned off in myeloid-restricted cells. Taniguchi et al. (1995) showed that overexpression of the HOX4A (HOXD3) gene in erythroleukemia cells resulted in increased levels of the GP IIb/IIIa complex (ITGA2B; 273800) and corresponding mRNA levels. The results implicated the HOXD3 gene in the regulation of cell adhesion processes. Animal model experiments lend further support to the function of HOXD3. To examine directly the nature of functional overlap within the Hox3 family, Greer et al. (2000) exchanged reciprocally in the genome of mice the protein-coding portions of the Hoxa3 (OMIM Ref. No. 142954) and Hoxd3 genes. Thus, they generated mice that lacked any Hoxa3 protein but instead expressed the Hoxd3 protein from both the Hoxa3 and Hoxd3 loci, as well as mice that lacked Hoxd3 protein but expressed Hoxa3 from both loci. Embryos representing all Hoxa3 allelic combinations were examined histologically. At embryonic day 17.5, homozygous null Hoxa3 embryos demonstrated complete absence of the thymus. However, replacement of one or both copies of the Hoxa3 protein with the Hoxd3 protein restored this organ. Alterations of the hyoid cartilage, which is characteristic of embryos homozygous for the null allele of Hoxa3, were reversed by expression of the Hoxd3 protein at the Hoxa3 locus. One conclusion from this data was that the Hoxd3 protein is functionally equivalent to the Hoxa3 protein if it is expressed in the context of the Hoxa3 gene. A corollary would be that the Hoxa3 protein, if expressed at the Hoxd3 locus, would be unable to complement null mutations at Hoxa3. This was shown to be the case. Hoxa3 protein was able to complement Hoxd3 deficiency when expressed in the context of the Hoxd3 allele. Greer et al. (2000) concluded that bidirectional complementation demonstrated that these proteins, which share less than 50% identity in the amino acid sequence, are capable of carrying out equivalent biologic functions in the processes recognized to require Hox3 gene activity. In addition, it provided direct evidence that the different roles played by these genes during embryogenesis are mainly the result of cis-acting sequences that modulate expression of the individual loci.

It is appreciated that the abovementioned animal model for HOXD3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Magli, M. C.; Barba, P.; Celetti, A.; De Vita, G.; Cillo, C.; Boncinelli, E.: Coordinate regulation of HOX genes in human hematopoietic cells. Proc. Nat. Acad. Sci. 88:6348-6352, 1991; and Taniguchi, Y.; Komatsu, N.; Moriuchi, T.: Overexpression of the HOX4A (HOXD3) homeobox gene in human erythroleukemia HEL cells results in altered adhesive properties. Blood 85:2786-279.

Further studies establishing the function and utilities of HOXD3 are found in John Hopkins OMIM database record ID 142980, and in sited publications numbered 5207, 318 and 5222-3187 listed in the bibliography section hereinbelow, which are also hereby incorporated by reference. Jerky Homolog (mouse) (JRK, Accession XM_098818) is another VGAM1384 host target gene. JRK BINDING SITE is HOST TARGET binding site found in the 3' untranslated region of mRNA encoded by JRK, corresponding to a HOST TARGET binding site such as BINDING SITE I, BINDING SITE II or BINDING SITE III. Table 2 illustrates the complementarity of the nucleotide sequences of JRK BINDING SITE, designated SEQ ID:41838, to the nucleotide sequence of VGAM1384 RNA, herein designated VGAM RNA, also designated SEQ ID:4095.

Another function of VGAM1384 is therefore inhibition of Jerky Homolog (mouse) (JRK, Accession XM_098818), a gene which might function as a DNA-binding protein. Accordingly, utilities of VGAM1384 include diagnosis, prevention and treatment of diseases and clinical conditions associated with JRK. The function of JRK and its association with various diseases and clinical conditions, has been established by previous studies, as described hereinabove with reference to VGAM210.3-oxoacid CoA Transferase (OXCT, Accession NM_000436) is another VGAM1384 host target gene. OXCT BINDING SITE is HOST TARGET binding site found in the 3' untranslated region of mRNA encoded by OXCT, corresponding to a HOST TARGET binding site such as BINDING SITE I, BINDING SITE II or BINDING SITE III. Table 2 illustrates the complementarity of the nucleotide sequences of OXCT BINDING SITE, designated SEQ ID:6020, to the nucleotide sequence of VGAM1384 RNA, herein designated VGAM RNA, also designated SEQ ID:4095.

Another function of VGAM1384 is therefore inhibition of 3-oxoacid CoA Transferase (OXCT, Accession NM_000436). Accordingly, utilities of VGAM1384 include diagnosis, prevention and treatment of diseases and clinical conditions associated with OXCT. BH-protocadherin (brain-heart) (PCDH7, Accession NM_032456) is another VGAM1384 host target gene. PCDH7 BINDING SITE is HOST TARGET binding site found in the 3' untranslated region of mRNA encoded by PCDH7, corresponding to a HOST TARGET binding site such as BINDING SITE I, BINDING SITE II or BINDING SITE III. Table 2 illustrates the complementarity of the nucleotide sequences of PCDH7 BINDING SITE, designated SEQ ID:26216, to the nucleotide sequence of VGAM1384 RNA, herein designated VGAM RNA, also designated SEQ ID:4095.

Another function of VGAM1384 is therefore inhibition of BH-protocadherin (brain-heart) (PCDH7, Accession NM_032456). Accordingly, utilities of VGAM1384 include diagnosis, prevention and treatment of diseases and clinical conditions associated with PCDH7. Protein Kinase, AMP-activated, Beta 1 Non-catalytic Subunit (PRKAB1, Accession NM_006253) is another VGAM1384 host target gene. PRKAB1 BINDING SITE is HOST TARGET binding site found in the 3' untranslated region of mRNA encoded by PRKAB1, corresponding to a HOST TARGET binding site such as BINDING SITE I, BINDING SITE II or BINDING SITE III. Table 2 illustrates the complementarity of the nucleotide sequences of PRKAB1 BINDING SITE, designated SEQ ID:12932, to the nucleotide sequence of VGAM1384 RNA, herein designated VGAM RNA, also designated SEQ ID:4095.

Another function of VGAM1384 is therefore inhibition of Protein Kinase, AMP-activated, Beta 1 Non-catalytic Subunit (PRKAB1, Accession NM_006253), a gene which is responsible for the regulation of fatty acid synthesis by phosphorylation of acetyl-coa carboxylase. Accordingly, utilities of VGAM1384 include diagnosis, prevention and treatment of diseases and clinical conditions associated with PRKAB1. The function of PRKAB1 has been established by previous studies. The mammalian 5-prime-AMP-activated protein kinase (AMPK) appears to act as a metabolic stress-sensing protein kinase. AMPK is a heterotrimeric protein composed of a catalytic alpha subunit, a noncatalytic beta subunit, and a noncatalytic gamma subunit. See PRKAA1 (OMIM Ref. No. 602739) for additional background. Using PCR with degenerate oligonucleotides based on the rat Ampk-beta-1 protein sequence, Woods et al. (1996) isolated rat liver cDNAs encoding Ampk-beta-1. Both the Ampk-beta-1 mRNA and protein are widely expressed in rat tissues. The predicted 270-amino acid protein has a calculated mass of 30 kD, but Woods et al. (1996) reported that it migrates as a 38-kD protein by SDS-PAGE. Immunoprecipitation studies suggested that Ampk-beta-1 mediates the association of the AMPK heterotrimeric complex in vitro. By searching the sequence databases with a rat Ampk-beta-1 cDNA, Stapleton et al. (1997) identified an EST encoding human AMPK-beta-1. The human and rat AMPK-beta-1 proteins have 95% amino acid sequence identity. Thornton et al. (1998) reported that the predicted 271-amino acid human AMPK-beta-1 protein shares 71% sequence identity with human AMPK-beta-2 (PRKAB2; 602741). They found that both beta isoforms form complexes with Ampk-alpha-1 (OMIM Ref. No. PRKAA1) and Ampk-alpha-2 (PRKAA2; 600497) in rat liver and skeletal muscle. Coexpression of the alpha and AMPK-gamma-1 (PRKAG1; 602742) subunits with either AMPK-beta-1 or AMPK-beta-2 in mammalian cells did not reveal a significant difference in AMPK activity between the 2 beta isoforms. Using Western blot analysis and immunoprecipitation studies, Thornton et al. (1998) determined that Ampk-beta-1 was expressed at higher levels than Ampk-beta-2 in rat liver, while Ampk-beta-2 was more abundant in skeletal muscle. They suggested that the marked difference in expression patterns of Ampk-beta-1 and Ampk-beta-2 indicates tissue-specific roles for these isoforms. By Northern blot analysis, Thornton et al. (1998) found that AMPK-beta-1 was expressed as a 3-kb mRNA in all tissues tested. Stapleton et al. (1997) mapped the human AMPK-beta-1 gene to 12q24.1 by fluorescence in situ hybridization Full details of the abovementioned studies are described in the following publications, the disclosure of which are hereby incorporated by reference:

Stapleton, D.; Woollatt, E.; Mitchelhill, K. I.; Nicholl, J. K.; Fernandez, C. S.; Michell, B. J.; Witters, L. A.; Power, D. A.; Sutherland, G. R.; Kemp, B. E.: AMP-activated protein kinase isoenzyme family: subunit structure and chromosomal location. FEBS Lett. 409:452-456, 1997; and Thornton, C.; Snowden, M. A.; Carling, D.: Identification of a novel AMP-activated protein kinase beta subunit isoform that is highly expressed in skeletal muscle. J. Biol. Chem. 273:1.

Further studies establishing the function and utilities of PRKAB1 are found in John Hopkins OMIM database record ID 602740, and in sited publications numbered 10696-5324 listed in the bibliography section hereinbelow, which are also hereby incorporated by reference. Prospero-related Homeobox 1 (PROX1, Accession NM_002763) is another VGAM1384 host target gene. PROX1 BINDING SITE is HOST TARGET binding site found in the 5' untranslated region of mRNA encoded by PROX1, corresponding to a HOST TARGET binding site such as BINDING SITE I, BINDING SITE II or BINDING SITE III. Table 2 illustrates the complementarity of the nucleotide sequences of PROX1 BINDING SITE, designated SEQ ID:8649, to the nucleotide sequence of VGAM1384 RNA, herein designated VGAM RNA, also designated SEQ ID:4095.

Another function of VGAM1384 is therefore inhibition of Prospero-related Homeobox 1 (PROX1, Accession NM_002763), a gene which may regulate gene expression and development of postmitotic undifferentiated young neurons. Accordingly, utilities of VGAM1384 include diagnosis, prevention and treatment of diseases and clinical conditions associated with PROX1. The function of PROX1 and its association with various diseases and clinical conditions, has been established by previous studies, as described hereinabove with reference to VGAM430. SMT3 Suppressor of Mif Two 3 Homolog 1 (yeast) (SMT3H1, Accession XM_009805) is another VGAM1384 host target gene. SMT3H1 BINDING SITE is HOST TARGET binding site found in the 3' untranslated region of mRNA encoded by SMT3H1, corresponding to a HOST TARGET binding site such as BINDING SITE I, BINDING SITE II or BINDING SITE III. Table 2 illustrates the complementarity of the nucleotide sequences of SMT3H1 BINDING SITE, designated SEQ ID:30128, to the nucleotide sequence of VGAM1384 RNA, herein designated VGAM RNA, also designated SEQ ID:4095.

Another function of VGAM1384 is therefore inhibition of SMT3 Suppressor of Mif Two 3 Homolog 1 (yeast) (SMT3H1, Accession XM_009805), a gene which is involved in the function and/or structure of the eukaryotic kinetochore. Accordingly, utilities of VGAM1384 include diagnosis, prevention and treatment of diseases and clinical conditions associated with SMT3H1. The function of SMT3H1 and its association with various diseases and clinical conditions, has been established by previous studies, as described hereinabove with reference to VGAM119. Transient Receptor Potential Cation Channel, Subfamily C, Member 1 (TRPC1, Accession NM_003304) is another VGAM1384 host target gene. TRPC1 BINDING SITE is HOST TARGET binding site found in the 3' untranslated region of mRNA encoded by TRPC1, corresponding to a HOST TARGET binding site such as BINDING SITE I, BINDING SITE II or BINDING SITE III. Table 2 illustrates the complementarity of the nucleotide sequences of TRPC1 BINDING SITE, designated SEQ ID:9309, to the nucleotide sequence of VGAM1384 RNA, herein designated VGAM RNA, also designated SEQ ID:4095.

Another function of VGAM1384 is therefore inhibition of Transient Receptor Potential Cation Channel, Subfamily C, Member 1 (TRPC1, Accession NM_003304), a gene which acts as a non-voltage-sensitive store-operated Ca2+ channel. Accordingly, utilities of VGAM1384 include diagnosis, prevention and treatment of diseases and clinical conditions associated with TRPC1. The function of TRPC1 and its association with various diseases and clinical conditions, has been established by previous studies, as described hereinabove with reference to VGAM200. Butyrophilin, Subfamily 1, Member A1 (BTN1A1, Accession NM_001732) is another VGAM1384 host target gene. BTN1A1 BINDING SITE is HOST TARGET binding site found in the 3' untranslated region of mRNA encoded by BTN1A1, corresponding to a HOST TARGET binding site such as BINDING SITE I, BINDING SITE II or BINDING SITE III. Table 2 illustrates the complementarity of the nucleotide sequences of BTN1A1 BINDING SITE, designated SEQ ID:7468, to the nucleotide sequence of VGAM1384 RNA, herein designated VGAM RNA, also designated SEQ ID:4095.

Another function of VGAM1384 is therefore inhibition of Butyrophilin, Subfamily 1, Member A1 (BTN1A1, Accession NM_001732). Accordingly, utilities of VGAM1384 include diagnosis, prevention and treatment of diseases and clinical conditions associated with BTN1A1. CRA (Accession NM_006697) is another VGAM1384 host target gene. CRA BINDING SITE is HOST TARGET binding site found in the 3' untranslated region of mRNA encoded by CRA, corresponding to a HOST TARGET binding site such as BINDING SITE I, BINDING SITE II or BINDING SITE III. Table 2 illustrates the complementarity of the nucleotide sequences of CRA BINDING SITE, designated SEQ ID:13517, to the nucleotide sequence of VGAM1384 RNA, herein designated VGAM RNA, also designated SEQ ID:4095.

Another function of VGAM1384 is therefore inhibition of CRA (Accession NM_006697). Accordingly, utilities of VGAM1384 include diagnosis, prevention and treatment of diseases and clinical conditions associated with CRA. DKFZP434A043 (Accession NM_015396) is another VGAM1384 host target gene. DKFZP434A043 BINDING SITE is HOST TARGET binding site found in the 5' untranslated region of mRNA encoded by DKFZP434A043, corresponding to a HOST TARGET binding site such as BINDING SITE I, BINDING SITE II or BINDING SITE III. Table 2 illustrates the complementarity of the nucleotide sequences of DKFZP434A043 BINDING SITE, designated SEQ ID:17706, to the nucleotide sequence of VGAM1384 RNA, herein designated VGAM RNA, also designated SEQ ID:4095.

Another function of VGAM1384 is therefore inhibition of DKFZP434A043 (Accession NM_015396). Accordingly, utilities of VGAM1384 include diagnosis, prevention and treatment of diseases and clinical conditions associated with DKFZP434A043. FLJ10853 (Accession NM_018246) is another VGAM1384 host target gene. FLJ10853 BINDING SITE is HOST TARGET binding site found in the 5' untranslated region of mRNA encoded by FLJ10853, corresponding to a HOST TARGET binding site such as BINDING SITE I, BINDING SITE II or BINDING SITE III. Table 2 illustrates the complementarity of the nucleotide sequences of FLJ10853 BINDING SITE, designated SEQ ID:20215, to the nucleotide sequence of VGAM1384 RNA, herein designated VGAM RNA, also designated SEQ ID:4095.

Another function of VGAM1384 is therefore inhibition of FLJ10853 (Accession NM_018246). Accordingly, utilities of VGAM1384 include diagnosis, prevention and treatment of diseases and clinical conditions associated with FLJ10853. FLJ23462 (Accession NM_024843) is another VGAM1384 host target gene. FLJ23462 BINDING SITE is HOST TARGET binding site found in the 3' untranslated region of mRNA encoded by FLJ23462, corresponding to a HOST TARGET binding site such as BINDING SITE I, BINDING SITE II or BINDING SITE III. Table 2 illustrates the complementarity of the nucleotide sequences of FLJ23462 BINDING SITE, designated SEQ ID:24269, to the nucleotide sequence of VGAM1384 RNA, herein designated VGAM RNA, also designated SEQ ID:4095.

Another function of VGAM1384 is therefore inhibition of FLJ23462 (Accession NM_024843). Accordingly, utilities of VGAM1384 include diagnosis, prevention and treatment of diseases and clinical conditions associated with FLJ23462. HSPC019 (Accession NM_014028) is another VGAM1384 host target gene. HSPC019 BINDING SITE is HOST TARGET binding site found in the 3' untranslated region of mRNA encoded by HSPC019, corresponding to a HOST TARGET binding site such as BINDING SITE I, BINDING SITE II or BINDING SITE III. Table 2 illustrates the complementarity of the nucleotide sequences of HSPC019 BINDING SITE, designated SEQ ID:15253, to the nucleotide sequence of VGAM1384 RNA, herein designated VGAM RNA, also designated SEQ ID:4095.

Another function of VGAM1384 is therefore inhibition of HSPC019 (Accession NM_014028). Accordingly, utilities of VGAM1384 include diagnosis, prevention and treatment of diseases and clinical conditions associated with HSPC019. KIAA0057 (Accession NM_012288) is another VGAM1384 host target gene. KIAA0057 BINDING SITE is HOST TARGET binding site found in the 3' untranslated region of mRNA encoded by KIAA0057, corresponding to a HOST TARGET binding site such as BINDING SITE I, BINDING SITE II or BINDING SITE III. Table 2 illustrates the complementarity of the nucleotide sequences of KIAA0057 BINDING SITE, designated SEQ ID:14625, to the nucleotide sequence of VGAM1384 RNA, herein designated VGAM RNA, also designated SEQ ID:4095.

Another function of VGAM1384 is therefore inhibition of KIAA0057 (Accession NM_012288). Accordingly, utilities of VGAM1384 include diagnosis, prevention and treatment of diseases and clinical conditions associated with KIAA0057. KIAA0429 (Accession NM_014751) is another VGAM1384 host target gene. KIAA0429 BINDING SITE is HOST TARGET binding site found in the 5' untranslated region of mRNA encoded by KIAA0429, corresponding to a HOST TARGET binding site such as BINDING SITE I, BINDING SITE II or BINDING SITE III. Table 2 illustrates the complementarity of the nucleotide sequences of KIAA0429 BINDING SITE, designated SEQ ID:16474, to the nucleotide sequence of VGAM1384 RNA, herein designated VGAM RNA, also designated SEQ ID:4095.

Another function of VGAM1384 is therefore inhibition of KIAA0429 (Accession NM_014751). Accordingly, utilities of VGAM1384 include diagnosis, prevention and treatment of diseases and clinical conditions associated with KIAA0429. KIAA0523 (Accession XM_041964) is another VGAM1384 host target gene. KIAA0523 BINDING SITE is HOST TARGET binding site found in the 5' untranslated region of mRNA encoded by KIAA0523, corresponding to a HOST TARGET binding site such as BINDING SITE I, BINDING SITE II or BINDING SITE III. Table 2 illustrates the complementarity of the nucleotide sequences of KIAA0523 BINDING SITE, designated SEQ ID:33641, to the nucleotide sequence of VGAM1384 RNA, herein designated VGAM RNA, also designated SEQ ID:4095.

Another function of VGAM1384 is therefore inhibition of KIAA0523 (Accession XM_041964). Accordingly, utilities of VGAM1384 include diagnosis, prevention and treatment of diseases and clinical conditions associated with KIAA0523. KIAA1538 (Accession XM_049474) is another VGAM1384 host target gene. KIAA1538 BINDING SITE is HOST TARGET binding site found in the 3' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35436, to the nucleotide sequence of VGAM1384 RNA, herein designated VGAM RNA, also designated SEQ ID:4095.

Another function of VGAM1384 is therefore inhibition of KIAA1538 (Accession XM_049474). Accordingly, utilities of VGAM1384 include diagnosis, prevention and treatment of diseases and clinical conditions associated with KIAA1538. KIAA1644 (Accession XM_097892) is another VGAM1384 host target gene. KIAA1644 BINDING SITE is HOST TARGET binding site found in the 3' untranslated region of mRNA encoded by KIAA1644, corresponding to a HOST TARGET binding site such as BINDING SITE I, BINDING SITE II or BINDING SITE III. Table 2 illustrates the complementarity of the nucleotide sequences of KIAA1644 BINDING SITE, designated SEQ ID:41202, to the nucleotide sequence of VGAM1384 RNA, herein designated VGAM RNA, also designated SEQ ID:4095.

Another function of VGAM1384 is therefore inhibition of KIAA1644 (Accession XM_097892). Accordingly, utilities of VGAM1384 include diagnosis, prevention and treatment of diseases and clinical conditions associated with KIAA1644. S164 (Accession XM_027330) is another VGAM1384 host target gene. S164 BINDING SITE is HOST TARGET binding site found in the 3' untranslated region of mRNA encoded by S164, corresponding to a HOST TARGET binding site such as BINDING SITE I, BINDING SITE II or BINDING SITE III. Table 2 illustrates the complementarity of the nucleotide sequences of S164 BINDING SITE, designated SEQ ID:30484, to the nucleotide sequence of VGAM1384 RNA, herein designated VGAM RNA, also designated SEQ ID:4095.

Another function of VGAM1384 is therefore inhibition of S164 (Accession XM_027330). Accordingly, utilities of VGAM1384 include diagnosis, prevention and treatment of diseases and clinical conditions associated with S164. Serine/threonine Kinase 33 (STK33, Accession XM_031831) is another VGAM1384 host target gene. STK33 BINDING SITE is HOST TARGET binding site found in the 5' untranslated region of mRNA encoded by STK33, corresponding to a HOST TARGET binding site such as BINDING SITE I, BINDING SITE II or BINDING SITE III. Table 2 illustrates the complementarity of the nucleotide sequences of STK33 BINDING SITE, designated SEQ ID:31496, to the nucleotide sequence of VGAM1384 RNA, herein designated VGAM RNA, also designated SEQ ID:4095.

Another function of VGAM1384 is therefore inhibition of Serine/threonine Kinase 33 (STK33, Accession XM_031831). Accordingly, utilities of VGAM1384 include diagnosis, prevention and treatment of diseases and clinical conditions associated with STK33. LOC118611 (Accession XM_061055) is another VGAM1384 host target gene. LOC118611 BINDING SITE is HOST TARGET binding site found in the 5' untranslated region of mRNA encoded by LOC118611, corresponding to a HOST TARGET binding site such as BINDING SITE I, BINDING SITE II or BINDING SITE III. Table 2 illustrates the complementarity of the nucleotide sequences of LOC118611 BINDING SITE, designated SEQ ID:37186, to the nucleotide sequence of VGAM1384 RNA, herein designated VGAM RNA, also designated SEQ ID:4095.

Another function of VGAM1384 is therefore inhibition of LOC118611 (Accession XM_061055). Accordingly, utilities of VGAM1384 include diagnosis, prevention and treatment of diseases and clinical conditions associated with LOC118611. LOC124044 (Accession XM_071871) is another VGAM1384 host target gene. LOC124044 BINDING SITE is HOST TARGET binding site found in the 3' untranslated region of mRNA encoded by LOC124044, corresponding to a HOST TARGET binding site such as BINDING SITE I, BINDING SITE II or BINDING SITE III. Table 2 illustrates the complementarity of the nucleotide sequences of LOC124044 BINDING SITE, designated SEQ ID:37434, to the nucleotide sequence of VGAM1384 RNA, herein designated VGAM RNA, also designated SEQ ID:4095.

Another function of VGAM1384 is therefore inhibition of LOC124044 (Accession XM_071871). Accordingly, utilities of VGAM1384 include diagnosis, prevention and treatment of diseases and clinical conditions associated with LOC124044. LOC144110 (Accession XM_084735) is another VGAM1384 host target gene. LOC144110 BINDING SITE is HOST TARGET binding site found in the 3' untranslated region of mRNA encoded by LOC144110, corresponding to a HOST TARGET binding site such as BINDING SITE I, BINDING SITE II or BINDING SITE III. Table 2 illustrates the complementarity of the nucleotide sequences of LOC144110 BINDING SITE, designated SEQ ID:37678, to the nucleotide sequence of VGAM1384 RNA, herein designated VGAM RNA, also designated SEQ ID:4095.

Another function of VGAM1384 is therefore inhibition of LOC144110 (Accession XM_084735). Accordingly, utilities of VGAM1384 include diagnosis, prevention and treatment of diseases and clinical conditions associated with LOC144110. LOC149832 (Accession XM_097733) is another VGAM1384 host target gene. LOC149832 BINDING SITE is HOST TARGET binding site found in the 5' untranslated region of mRNA encoded by LOC149832, corresponding to a HOST TARGET binding site such as BINDING SITE I, BINDING SITE II or BINDING SITE III. Table 2 illustrates the complementarity of the nucleotide sequences of LOC149832 BINDING SITE, designated SEQ ID:41080, to the nucleotide sequence of VGAM1384 RNA, herein designated VGAM RNA, also designated SEQ ID:4095.

Another function of VGAM1384 is therefore inhibition of LOC149832 (Accession XM_097733). Accordingly, utilities of VGAM1384 include diagnosis, prevention and treatment of diseases and clinical conditions associated with LOC149832. LOC155038 (Accession XM_088130) is another VGAM1384 host target gene. LOC155038 BINDING SITE is HOST TARGET binding site found in the 3' untranslated region of mRNA encoded by LOC155038, corresponding to a HOST TARGET binding site such as BINDING SITE I, BINDING SITE II or BINDING SITE III. Table 2 illustrates the complementarity of the nucleotide sequences of LOC155038 BINDING SITE, designated SEQ ID:39534, to the nucleotide sequence of VGAM1384 RNA, herein designated VGAM RNA, also designated SEQ ID:4095.

Another function of VGAM1384 is therefore inhibition of LOC155038 (Accession XM_088130). Accordingly, utilities of VGAM1384 include diagnosis, prevention and treatment of diseases and clinical conditions associated with LOC155038. LOC220020 (Accession XM_167821) is another VGAM1384 host target gene. LOC220020 BINDING SITE is HOST TARGET binding site found in the 5' untranslated region of mRNA encoded by LOC220020, corresponding to a HOST TARGET binding site such as BINDING SITE I, BINDING SITE II or BINDING SITE III. Table 2 illustrates the complementarity of the nucleotide sequences of LOC220020 BINDING SITE, designated SEQ ID:44868, to the nucleotide sequence of VGAM1384 RNA, herein designated VGAM RNA, also designated SEQ ID:4095.

Another function of VGAM1384 is therefore inhibition of LOC220020 (Accession XM_167821). Accordingly, utilities of VGAM1384 include diagnosis, prevention and treatment of diseases and clinical conditions associated with LOC220020. LOC253842 (Accession XM_173230) is another VGAM1384 host target gene. LOC253842 BINDING SITE is HOST TARGET binding site found in the 3' untranslated region of mRNA encoded by LOC253842, corresponding to a HOST TARGET binding site such as BINDING SITE I, BINDING SITE II or BINDING SITE III. Table 2 illustrates the complementarity of the nucleotide sequences of LOC253842 BINDING SITE, designated SEQ ID:46505, to the nucleotide sequence of VGAM1384 RNA, herein designated VGAM RNA, also designated SEQ ID:4095.

Another function of VGAM1384 is therefore inhibition of LOC253842 (Accession XM_173230). Accordingly, utilities of VGAM1384 include diagnosis, prevention and treatment of diseases and clinical conditions associated with LOC253842. LOC255475 (Accession XM_174861) is another VGAM1384 host target gene. LOC255475 BINDING SITE is HOST TARGET binding site found in the 5' untranslated region of mRNA encoded by LOC255475, corresponding to a HOST TARGET binding site such as BINDING SITE I, BINDING SITE II or BINDING SITE III. Table 2 illustrates the complementarity of the nucleotide sequences of LOC255475 BINDING SITE, designated SEQ ID:46605, to the nucleotide sequence of VGAM1384 RNA, herein designated VGAM RNA, also designated SEQ ID:4095.

Another function of VGAM1384 is therefore inhibition of LOC255475 (Accession XM_174861). Accordingly, utilities of VGAM1384 include diagnosis, prevention and treatment of diseases and clinical conditions associated with LOC255475. LOC91263 (Accession XM_037264) is another VGAM1384 host target gene. LOC91263 BINDING SITE is HOST TARGET binding site found in the 3' untranslated region of mRNA encoded by LOC91263, corresponding to a HOST TARGET binding site such as BINDING SITE I, BINDING SITE II or BINDING SITE III. Table 2 illustrates the complementarity of the nucleotide sequences of LOC91263 BINDING SITE, designated SEQ ID:32595, to the nucleotide sequence of VGAM1384 RNA, herein designated VGAM RNA, also designated SEQ ID:4095.

Another function of VGAM1384 is therefore inhibition of LOC91263 (Accession XM_037264). Accordingly, utilities of VGAM1384 include diagnosis, prevention and treatment of diseases and clinical conditions associated with LOC91263. LOC91818 (Accession XM_040878) is another VGAM1384 host target gene. LOC91818 BINDING SITE is HOST TARGET binding site found in the 3' untranslated region of mRNA encoded by LOC91818, corresponding to a HOST TARGET binding site such as BINDING SITE I, BINDING SITE II or BINDING SITE III. Table 2 illustrates the complementarity of the nucleotide sequences of LOC91818 BINDING SITE, designated SEQ ID:33406, to the nucleotide sequence of VGAM1384 RNA, herein designated VGAM RNA, also designated SEQ ID:4095.

Another function of VGAM1384 is therefore inhibition of LOC91818 (Accession XM_040878). Accordingly, utilities of VGAM1384 include diagnosis, prevention and treatment of diseases and clinical conditions associated with LOC91818. LOC91923 (Accession XM_041526) is another VGAM1384 host target gene. LOC91923 BINDING SITE is HOST TARGET binding site found in the 5' untranslated region of mRNA encoded by LOC91923, corresponding to a HOST TARGET binding site such as BINDING SITE I, BINDING SITE II or BINDING SITE III. Table 2 illustrates the complementarity of the nucleotide sequences of LOC91923 BINDING SITE, designated SEQ ID:33546, to the nucleotide sequence of VGAM1384 RNA, herein designated VGAM RNA, also designated SEQ ID:4095.

Another function of VGAM1384 is therefore inhibition of LOC91923 (Accession XM_041526). Accordingly, utilities of VGAM1384 include diagnosis, prevention and treatment of diseases and clinical conditions associated with LOC91923. FIG. 1 further provides a conceptual description of a novel bioinformatically detected viral gene of the present invention, referred to here as Viral Genomic Address Messenger 1385 (VGAM1385) viral gene, which modulates expression of respective host target genes thereof, the function and utility of which host target genes is known in the art.

VGAM1385 is a novel bioinformatically detected regulatory, non protein coding, viral micro RNA (miRNA) gene. The method by which VGAM1385 was detected is described hereinabove with reference to FIGS. 1-8.

VGAM1385 gene, herein designated VGAM GENE, is a viral gene contained in the genome of Himetobi P Virus. VGAM1385 host target gene, herein designated VGAM HOST TARGET GENE, is a human gene contained in the human genome.

VGAM1385 gene encodes a VGAM1385 precursor RNA, herein designated VGAM PRECURSOR RNA. Similar to other miRNA genes, and unlike most ordinary genes, VGAM1385 precursor RNA does not encode a protein. A nucleotide sequence identical or highly similar to the nucleotide sequence of VGAM1385 precursor RNA is designated SEQ ID:1371, and is provided hereinbelow with reference to the sequence listing part. Nucleotide sequence SEQ ID:1371 is located at position 2435 relative to the genome of Himetobi P Virus.

VGAM1385 precursor RNA folds onto itself, forming VGAM1385 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1385 folded precursor RNA into VGAM1385 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 42%) nucleotide sequence of VGAM1385 RNA is designated SEQ ID:4096, and is provided hereinbelow with reference to the sequence listing part.

VGAM1385 host target gene, herein designated VGAM HOST TARGET GENE, encodes a corresponding messenger RNA, VGAM1385 host target RNA, herein designated VGAM HOST TARGET RNA. VGAM1385 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1385 RNA, herein designated VGAM RNA, binds complementarily to one or more host target binding sites located in untranslated regions of VGAM1385 host target RNA, herein designated VGAM HOST TARGET RNA. This complementary binding is due to the fact that the nucleotide sequence of VGAM1385 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1385 RNA, herein designated VGAM RNA, may have a different number of host target binding sites in untranslated regions of a VGAM1385 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1385 RNA, herein designated VGAM RNA, to host target binding sites on VGAM1385 host target RNA, herein designated VGAM HOST TARGET RNA, such as BINDING SITE I, BINDING SITE II and BINDING SITE III, inhibits translation of VGAM1385 host target RNA into VGAM1385 host target protein, herein designated VGAM HOST TARGET PROTEIN. VGAM host target protein is therefore outlined by a broken line.

It is appreciated that VGAM1385 host target gene, herein designated VGAM HOST TARGET GENE, in fact represents a plurality of VGAM1385 host target genes. The mRNA of each one of this plurality of VGAM1385 host target genes comprises one or more host target binding sites, each having a nucleotide sequence which is at least partly complementary to VGAM1385 RNA, herein designated VGAM RNA, and which when bound by VGAM1385 RNA causes inhibition of translation of respective one or more VGAM1385 host target proteins.

It is further appreciated by one skilled in the art that the mode of translational inhibition illustrated by FIG. 1 with specific reference to translational inhibition exerted by VGAM1385 gene, herein designated VGAM GENE, on one or more VGAM1385 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1385 is inhibition of expression of host target genes, as part of a novel viral mechanism of attacking a host. Accordingly, utilities of VGAM1385 include diagnosis, prevention and treatment of viral infection by Himetobi P Virus. Specific functions, and accordingly utilities, of VGAM1385 correlate with, and may be deduced from, the identity of the host target genes which VGAM1385 binds and inhibits, and the function of these host target genes, as elaborated hereinbelow.

Nucleotide sequences of the VGAM1385 precursor RNA, herein designated VGAM PRECURSOR RNA, and of the 'diced' VGAM1385 RNA, herein designated VGAM RNA, and a schematic representation of the secondary folding of VGAM1385 folded precursor RNA, herein designated VGAM FOLDED PRECURSOR RNA, of VGAM1385 are further described hereinbelow with reference to Table 1.

Nucleotide sequences of host target binding sites, such as BINDING SITE-I, BINDING SITE-II and BINDING SITE-III of FIG. 1, found on VGAM1385 host target RNA, and schematic representation of the complementarity of each of these host target binding sites to VGAM1385 RNA, herein designated VGAM RNA, are described hereinbelow with reference to Table 2.

As mentioned hereinabove with reference to FIG. 1, a function of VGAM1385 gene, herein designated VGAM is inhibition of expression of VGAM1385 target genes. It is appreciated that specific functions, and accordingly utilities, of VGAM1385 correlate with, and may be deduced from, the identity of the target genes which VGAM1385 binds and inhibits, and the function of these target genes, as elaborated hereinbelow.

Adenosine A1 Receptor (ADORA1, Accession NM_000674) is a VGAM1385 host target gene. ADORA1 BINDING SITE is HOST TARGET binding site found in the 3' untranslated region of mRNA encoded by ADORA1, corresponding to a HOST TARGET binding site such as BINDING SITE I, BINDING SITE II or BINDING SITE III. Table 2 illustrates the complementarity of the nucleotide sequences of ADORA1 BINDING SITE, designated SEQ ID:6328, to the nucleotide sequence of VGAM1385 RNA, herein designated VGAM RNA, also designated SEQ ID:4096.

A function of VGAM1385 is therefore inhibition of Adenosine A1 Receptor (ADORA1, Accession NM_000674), a gene which the activity of this receptor is mediated by g proteins which inhibit adenylyl cyclase. Accordingly, utilities of VGAM1385 include diagnosis, prevention and treatment of diseases and clinical conditions associated with ADORA1. The function of ADORA1 and its association with various diseases and clinical conditions, has been established by previous studies, as described hereinabove with reference to VGAM234. Anaplastic Lymphoma Kinase (Ki-1) (ALK, Accession XM_055726) is another VGAM1385 host target gene. ALK BINDING SITE is HOST TARGET binding site found in the 5' untranslated region of mRNA encoded by ALK, corresponding to a HOST TARGET binding site such as BINDING SITE I, BINDING SITE II or BINDING SITE III. Table 2 illustrates the complementarity of the nucleotide sequences of ALK BINDING SITE, designated SEQ ID:36321, to the nucleotide sequence of VGAM1385 RNA, herein designated VGAM RNA, also designated SEQ ID:4096.

Another function of VGAM1385 is therefore inhibition of Anaplastic Lymphoma Kinase (Ki-1) (ALK, Accession XM_055726). Accordingly, utilities of VGAM1385 include diagnosis, prevention and treatment of diseases and clinical conditions associated with ALK. Frequently Rearranged In Advanced T-cell Lymphomas 2 (FRAT2, Accession NM_012083) is another VGAM1385 host target gene. FRAT2 BINDING SITE is HOST TARGET binding site found in the 3' untranslated region of mRNA encoded by FRAT2, corresponding to a HOST TARGET binding site such as BINDING SITE I, BINDING SITE II or BINDING SITE III. Table 2 illustrates the complementarity of the nucleotide sequences of FRAT2 BINDING SITE, designated SEQ ID:14372, to the nucleotide sequence of VGAM1385 RNA, herein designated VGAM RNA, also designated SEQ ID:4096.

Another function of VGAM1385 is therefore inhibition of Frequently Rearranged In Advanced T-cell Lymphomas 2 (FRAT2, Accession NM_012083), a gene which binds gsk-3 and prevents gsk-3-dependent phosphorylation. Accordingly, utilities of VGAM1385 include diagnosis, prevention and treatment of diseases and clinical conditions associated with FRAT2. The function of FRAT2 has been established by previous studies. Dorsal accumulation of beta-catenin (CTNNB1; 116806) in early Xenopus embryos is required for body axis formation. Beta-catenin is dorsally stabilized by the localized inhibition of the kinase GSK3 (see OMIM Ref. No. GSK3B; 605004). Using a yeast 2-hybrid system to identify a cytoplasmic regulator of Xenopus GSK3, Yost et al. (1998) isolated an oocyte cDNA encoding a 169-amino acid protein that they termed GSK3-binding protein, or GBP. By searching sequence databases, Yost et al. (1998) identified 2 homologous human sequences, FRAT1 (OMIM Ref. No. 602503) and FRAT2, a partial sequence that shares 59% amino acid identity with FRAT1. Sequence analysis predicted that GBP and the FRAT proteins contain 3 well-conserved regions. Binding and functional analyses revealed that the GSK3-binding and -inhibitory activities of GBP and FRAT2 reside in the C-terminal conserved domain III sequence. The authors proposed that GBP, FRAT1, and FRAT2 form a family of GSK3-binding proteins that inhibit the phosphorylation of beta-catenin, preventing its degradation by the ubiquitin-proteasome pathway. By screening a fetal lung cDNA library with an FT2S probe, which was obtained from a gastric cancer cell line, that corresponds to an FRAT2 EST, Saitoh et al. (2001) isolated a full-length cDNA encoding FRAT2. The deduced 233-amino acid protein, which is 77% identical to FRAT1, contains an N-terminal acidic domain followed by a proline-rich domain and a GSK3B-binding domain near the C terminus, which is highly divergent from that of FRAT1. Northern blot analysis detected a 2.4-kb transcript, with highest expression in pancreas, heart, spleen, placenta, skeletal muscle, liver, peripheral blood leukocytes, and fetal kidney. Expression was higher in gastric cancer, cervical cancer, and chronic myelogenous leukemia cell lines than in other cancer cell lines. Functional analysis in the Xenopus axis duplication assay indicated that FRAT2 is a positive regulator of the WNT (see OMIM Ref. No. 164975) signaling pathway. Saitoh et al. (2001) suggested that upregulation of FRAT2 in human cancer may be implicated in carcinogenesis through activation of the WNT signaling pathway.

Full details of the abovementioned studies are described in the following publications, the disclosure of which are hereby incorporated by reference:

Saitoh, T.; Moriwaki, J.; Koike, J.; Takagi, A.; Miwa, T.; Shiokawa, K.; Katoh, M. : Molecular cloning and characterization of FRAT2, encoding a positive regulator of the WNT signaling pathway. Biochem. Biophys. Res. Commun. 281: 815-820, 2001; and Yost, C.; Farr, G. H., III; Pierce, S. B.; Ferkey, D. M.; Chen, M. M.; Kimelman, D.: GBP, an inhibitor of GSK-3, is implicated in Xenopus development and oncogenesis. Cell 93:1031-10.

Further studies establishing the function and utilities of FRAT2 are found in John Hopkins OMIM database record ID 605006, and in sited publications numbered 291 and 9026 listed in the bibliography section hereinbelow, which are also hereby incorporated by reference. FLJ10726 (Accession NM_018195) is another VGAM1385 host target gene. FLJ10726 BINDING SITE is HOST TARGET binding site found in the 3' untranslated region of mRNA encoded by FLJ10726, corresponding to a HOST TARGET binding site such as BINDING SITE I, BINDING SITE II or BINDING SITE III. Table 2 illustrates the complementarity of the nucleotide sequences of FLJ10726 BINDING SITE, designated SEQ ID:20056, to the nucleotide sequence of VGAM1385 RNA, herein designated VGAM RNA, also designated SEQ ID:4096.

Another function of VGAM1385 is therefore inhibition of FLJ10726 (Accession NM_018195). Accordingly, utilities of VGAM1385 include diagnosis, prevention and treatment of diseases and clinical conditions associated with FLJ10726. LOC219848 (Accession XM_166170) is another VGAM1385 host target gene. LOC219848 BINDING SITE is HOST TARGET binding site found in the 3' untranslated region of mRNA encoded by LOC219848, corresponding to a HOST TARGET binding site such as BINDING SITE I, BINDING SITE II or BINDING SITE III. Table 2 illustrates the complementarity of the nucleotide sequences of LOC219848 BINDING SITE, designated SEQ ID:43987, to the nucleotide sequence of VGAM1385 RNA, herein designated VGAM RNA, also designated SEQ ID:4096.

Another function of VGAM1385 is therefore inhibition of LOC219848 (Accession XM_166170). Accordingly, utilities of VGAM1385 include diagnosis, prevention and treatment of diseases and clinical conditions associated with LOC219848. LOC255031 (Accession XM_173187) is another VGAM1385 host target gene. LOC255031 BINDING SITE is HOST TARGET binding site found in the 5' untranslated region of mRNA encoded by LOC255031, corresponding to a HOST TARGET binding site such as BINDING SITE I, BINDING SITE II or BINDING SITE III. Table 2 illustrates the complementarity of the nucleotide sequences of LOC255031 BINDING SITE, designated SEQ ID:46432, to the nucleotide sequence of VGAM1385 RNA, herein designated VGAM RNA, also designated SEQ ID:4096.

Another function of VGAM1385 is therefore inhibition of LOC255031 (Accession XM_173187). Accordingly, utilities of VGAM1385 include diagnosis, prevention and treatment of diseases and clinical conditions associated with LOC255031. FIG. 1 further provides a conceptual description of a novel bioinformatically detected viral gene of the present invention, referred to here as Viral Genomic Address Messenger 1386 (VGAM1386) viral gene, which modulates expression of respective host target genes thereof, the function and utility of which host target genes is known in the art.

VGAM1386 is a novel bioinformatically detected regulatory, non protein coding, viral micro RNA (miRNA) gene. The method by which VGAM1386 was detected is described hereinabove with reference to FIGS. 1-8.

VGAM1386 gene, herein designated VGAM GENE, is a viral gene contained in the genome of Himetobi P Virus. VGAM1386 host target gene, herein designated VGAM HOST TARGET GENE, is a human gene contained in the human genome.

VGAM1386 gene encodes a VGAM1386 precursor RNA, herein designated VGAM PRECURSOR RNA. Similar to other miRNA genes, and unlike most ordinary genes, VGAM1386 precursor RNA does not encode a protein. A nucleotide sequence identical or highly similar to the nucleotide sequence of VGAM1386 precursor RNA is designated SEQ ID:1372, and is provided hereinbelow with reference to the sequence listing part. Nucleotide sequence SEQ ID:1372 is located at position 8878 relative to the genome of Himetobi P Virus.

VGAM1386 precursor RNA folds onto itself, forming VGAM1386 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1386 folded precursor RNA into VGAM1386 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM1386 RNA is designated SEQ ID:4097, and is provided hereinbelow with reference to the sequence listing part.

VGAM1386 host target gene, herein designated VGAM HOST TARGET GENE, encodes a corresponding messenger RNA, VGAM1386 host target RNA, herein designated VGAM HOST TARGET RNA. VGAM1386 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1386 RNA, herein designated VGAM RNA, binds complementarily to one or more host target binding sites located in untranslated regions of VGAM1386 host target RNA, herein designated VGAM HOST TARGET RNA. This complementary binding is due to the fact that the nucleotide sequence of VGAM1386 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1386 RNA, herein designated VGAM RNA, may have a different number of host target binding sites in untranslated regions of a VGAM1386 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1386 RNA, herein designated VGAM RNA, to host target binding sites on VGAM1386 host target RNA, herein designated VGAM HOST TARGET RNA, such as BINDING SITE I, BINDING SITE II and BINDING SITE III, inhibits translation of VGAM1386 host target RNA into VGAM1386 host target protein, herein designated VGAM HOST TARGET PROTEIN. VGAM host target protein is therefore outlined by a broken line.

It is appreciated that VGAM1386 host target gene, herein designated VGAM HOST TARGET GENE, in fact represents a plurality of VGAM1386 host target genes. The mRNA of each one of this plurality of VGAM1386 host target genes comprises one or more host target binding sites, each having a nucleotide sequence which is at least partly complementary to VGAM1386 RNA, herein designated VGAM RNA, and which when bound by VGAM1386 RNA causes inhibition of translation of respective one or more VGAM1386 host target proteins.

It is further appreciated by one skilled in the art that the mode of translational inhibition illustrated by FIG. 1 with specific reference to translational inhibition exerted by VGAM1386 gene, herein designated VGAM GENE, on one or more VGAM1386 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1386 is inhibition of expression of host target genes, as part of a novel viral mechanism of attacking a host. Accordingly, utilities of VGAM1386 include diagnosis, prevention and treatment of viral infection by Himetobi P Virus. Specific functions, and accordingly utilities, of VGAM1386 correlate with, and may be deduced from, the identity of the host target genes which VGAM1386 binds and inhibits, and the function of these host target genes, as elaborated hereinbelow.

Nucleotide sequences of the VGAM1386 precursor RNA, herein designated VGAM PRECURSOR RNA, and of the 'diced' VGAM1386 RNA, herein designated VGAM RNA, and a schematic representation of the secondary folding of VGAM1386 folded precursor RNA, herein designated VGAM FOLDED PRECURSOR RNA, of VGAM1386 are further described hereinbelow with reference to Table 1.

Nucleotide sequences of host target binding sites, such as BINDING SITE-I, BINDING SITE-II and BINDING SITE-III of FIG. 1, found on VGAM1386 host target RNA, and schematic representation of the complementarity of each of these host target binding sites to VGAM1386 RNA, herein designated VGAM RNA, are described hereinbelow with reference to Table 2.

As mentioned hereinabove with reference to FIG. 1, a function of VGAM1386 gene, herein designated VGAM is inhibition of expression of VGAM1386 target genes. It is appreciated that specific functions, and accordingly utilities, of VGAM1386 correlate with, and may be deduced from, the identity of the target genes which VGAM1386 binds and inhibits, and the function of these target genes, as elaborated hereinbelow.

ATPase, Class VI, Type 11A (ATP11A, Accession XM_085028) is a VGAM1386 host target gene. ATP11A BINDING SITE is HOST TARGET binding site found in the 3' untranslated region of mRNA encoded by ATP11A, corresponding to a HOST TARGET binding site such as BINDING SITE I, BINDING SITE II or BINDING SITE III. Table 2 illustrates the complementarity of the nucleotide sequences of ATP11A BINDING SITE, designated SEQ ID:37803, to the nucleotide sequence of VGAM1386 RNA, herein designated VGAM RNA, also designated SEQ ID:4097.

A function of VGAM1386 is therefore inhibition of ATPase, Class VI, Type 11A (ATP11A, Accession XM_085028). Accordingly, utilities of VGAM1386 include diagnosis, prevention and treatment of diseases and clinical conditions associated with ATP11A. Integrin, Alpha M (complement component receptor 3, alpha; also known as CD11b (p170), Macrophage Antigen Alpha Polypeptide) (IT- GAM, Accession NM_000632) is another VGAM1386 host target gene. ITGAM BINDING SITE is HOST TARGET binding site found in the 3" untranslated region of mRNA encoded by ITGAM, corresponding to a HOST TARGET binding site such as BINDING SITE I, BINDING SITE II or BINDING SITE III. Table 2 illustrates the complementarity of the nucleotide sequences of ITGAM BINDING SITE, designated SEQ ID:6247, to the nucleotide sequence of VGAM1386 RNA, herein designated VGAM RNA, also designated SEQ ID:4097.

Another function of VGAM1386 is therefore inhibition of Integrin, Alpha M (complement component receptor 3, alpha; also known as CD11b (p170), Macrophage Antigen Alpha Polypeptide) (ITGAM, Accession NM_000632), a gene which is invovled in various adhesive interactions of monocytes, macrophages and granulocytes as well as in mediating the uptake of complement-coated particles. Accordingly, utilities of VGAM1386 include diagnosis, prevention and treatment of diseases and clinical conditions associated with ITGAM. The function of ITGAM has been established by previous studies. A major surface antigen family on human leukocytes includes complement receptor type 3 (CR3A; also called integrin alpha-M, Mac1 or Mo1), lymphocyte function-associated antigen type 1 (LFA-1; 153370), and p150,95 (Leu M5; 151510). These antigens share a common beta chain (OMIM Ref. No. 116920) of 94 kD, linked noncovalently to 1 of 3 alpha chains distinctive to each. They promote adhesion of granulocytes to each other and to endothelial cell monolayers. The apparent molecular weight of the Mo1 alpha chain is 155 to 165 kD, that of the LFA1 alpha subunit is 180 kD, and that of the Leu M5 subunit is 130 to 150 kD. Pierce et al. (1986) purified human Mo1 to homogeneity from normal granulocytes by affinity chromatography and high performance liquid chromatography (HPLC) and determined the N-terminal amino acid sequence of its alpha subunit. The obtained sequence was identical, except for 2 conservative substitutions, to that of the alpha subunit of Mac1 antigen (Springer et al., 1985). Furthermore, Pierce et al. (1986) found that the N-terminal amino acid sequence of the alpha subunit of Mo1 was homologous to the alpha subunit of IIb/IIIa, a glycoprotein that serves similar adhesive functions on platelets and is deficient or defective in Glanzmann thrombasthenia (OMIM Ref. No. 273800). Patients with a history of recurrent bacterial infections and an inherited deficiency of all 3 leukocyte membrane surface antigens are thought to have reduced or absent synthesis of the common beta subunit of the antigen family; see 116920. By Southern analysis of DNA from hamster-human hybrids, Arnaout et al. (1988) localized the human MO1A gene to chromosome 16, which has been shown to contain the gene LFA1A (OMIM Ref. No. 153370). By in situ hybridization, Corbi et al. (1988) demonstrated that the alpha subunits of LFA-1, Mac1, and p150, 95 constitute a cluster that might be called leukocyte adhesion, alpha, cluster (LAAC) located on 16p13.1-p11. Callen et al. (1991) narrowed the assignment to 16p11.2. Inflammation plays an essential role in the initiation and progression of atherosclerosis. Simon et al. (2000) presented evidence that it also has a role in vascular repair after mechanical arterial injury (i.e., percutaneous transluminal coronary angioplasty, or PTCA). In animal models of vascular injury, leukocytes are recruited as a precursor to intimal thickening. Markers of leukocyte activation, in particular, increased expression of Mac1, which is responsible for firm leukocyte adhesion to platelets and fibrinogen on denuded vessels, predict restenosis after PTCA. To determine whether Mac1-mediated leukocyte recruitment is causally related to neointimal formation, Simon et al. (2000) subjected Mac1 knockout mice to a mechanical carotid artery dilation and complete endothelial denudation. They found that the selective absence of Mac1 impaired transplatelet leukocyte migration into the vessel wall, reducing leukocyte accumulation. Diminished medial leukocyte accumulation was accompanied by markedly reduced neointimal thickening after vascular injury. These data established a role for inflammation in neointimal thickening and suggested that leukocyte recruitment to mechanically injured arteries may prevent restenosis Full details of the abovementioned studies are described in the following publications, the disclosure of which are hereby incorporated by reference:

Pierce, M. W.; Remold-O'Donnell, E.; Todd, R. F., III; Arnaout, M. A.: N-terminal sequence of human leukocyte glycoprotein Mo1: conservation across species and homology to platelet IIb/IIIa. Biochim. Biophys. Acta 874:368-371, 1986; and Arnaout, M. A.; Remold-O'Donnell, E.; Pierce, M. W.; Harris, P.; Tenen, D. G.: Molecular cloning of the alpha-subunit of human and guinea pig leukocyte adhesion glycoprotein Mo1: chromo.

Further studies establishing the function and utilities of ITGAM are found in John Hopkins OMIM database record ID 120980, and in sited publications numbered 4960-4967 listed in the bibliography section hereinbelow, which are also hereby incorporated by reference. CSR1 (Accession NM_016240) is another VGAM1386 host target gene. CSR1 BINDING SITE1 and CSR1 BINDING SITE2 are HOST TARGET binding sites found in untranslated regions of mRNA encoded by CSR1, corresponding to HOST TARGET binding sites such as BINDING SITE I, BINDING SITE II or BINDING SITE III. Table 2 illustrates the complementarity of the nucleotide sequences of CSR1 BINDING SITE1 and CSR1 BINDING SITE2, designated SEQ ID:18357 and SEQ ID:18358 respectively, to the nucleotide sequence of VGAM1386 RNA, herein designated VGAM RNA, also designated SEQ ID:4097.

Another function of VGAM1386 is therefore inhibition of CSR1 (Accession NM_016240). Accordingly, utilities of VGAM1386 include diagnosis, prevention and treatment of diseases and clinical conditions associated with CSR1. FLJ11618 (Accession NM_022452) is another VGAM1386 host target gene. FLJ11618 BINDING SITE is HOST TARGET binding site found in the 3' untranslated region of mRNA encoded by FLJ11618, corresponding to a HOST TARGET binding site such as BINDING SITE I, BINDING SITE II or BINDING SITE III. Table 2 illustrates the complementarity of the nucleotide sequences of FLJ11618 BINDING SITE, designated SEQ ID:22792, to the nucleotide sequence of VGAM1386 RNA, herein designated VGAM RNA, also designated SEQ ID:4097.

Another function of VGAM1386 is therefore inhibition of FLJ11618 (Accession NM_022452). Accordingly, utilities of VGAM1386 include diagnosis, prevention and treatment of diseases and clinical conditions associated with FLJ11618. KIAA0914 (Accession NM_014883) is another VGAM1386 host target gene. KIAA0914 BINDING SITE is HOST TARGET binding site found in the 3' untranslated region of mRNA encoded by KIAA0914, corresponding to a HOST TARGET binding site such as BINDING SITE I, BINDING SITE II or BINDING SITE III. Table 2 illustrates the complementarity of the nucleotide sequences of KIAA0914 BINDING SITE, designated SEQ ID:17036, to the nucleotide sequence of VGAM1386 RNA, herein designated VGAM RNA, also designated SEQ ID:4097.

Another function of VGAM1386 is therefore inhibition of KIAA0914 (Accession NM_014883). Accordingly, utilities of VGAM1386 include diagnosis, prevention and treatment of diseases and clinical conditions associated with KIAA0914. MGC20255 (Accession NM_052848) is another VGAM1386 host target gene. MGC20255 BINDING SITE is HOST TARGET binding site found in the 3' untranslated region of mRNA encoded by MGC20255, corresponding to a HOST TARGET binding site such as BINDING SITE I, BINDING SITE II or BINDING SITE III. Table 2 illustrates the complementarity of the nucleotide sequences of MGC20255 BINDING SITE, designated SEQ ID:27427, to the nucleotide sequence of VGAM1386 RNA, herein designated VGAM RNA, also designated SEQ ID:4097.

Another function of VGAM1386 is therefore inhibition of MGC20255 (Accession NM_052848). Accordingly, utilities of VGAM1386 include diagnosis, prevention and treatment of diseases and clinical conditions associated with MGC20255. LOC162461 (Accession XM_091568) is another VGAM1386 host target gene. LOC162461 BINDING SITE is HOST TARGET binding site found in the 3' untranslated region of mRNA encoded by LOC162461, corresponding to a HOST TARGET binding site such as BINDING SITE I, BINDING SITE II or BINDING SITE III. Table 2 illustrates the complementarity of the nucleotide sequences of LOC162461 BINDING SITE, designated SEQ ID:40057, to the nucleotide sequence of VGAM1386 RNA, herein designated VGAM RNA, also designated SEQ ID:4097.

Another function of VGAM1386 is therefore inhibition of LOC162461 (Accession XM_091568). Accordingly, utilities of VGAM1386 include diagnosis, prevention and treatment of diseases and clinical conditions associated with LOC162461. FIG. 1 further provides a conceptual description of a novel bioinformatically detected viral gene of the present invention, referred to here as Viral Genomic Address Messenger 1387 (VGAM1387) viral gene, which modulates expression of respective host target genes thereof, the function and utility of which host target genes is known in the art.

VGAM1387 is a novel bioinformatically detected regulatory, non protein coding, viral micro RNA (miRNA) gene. The method by which VGAM1387 was detected is described hereinabove with reference to FIGS. 1-8.

VGAM1387 gene, herein designated VGAM GENE, is a viral gene contained in the genome of Himetobi P Virus. VGAM1387 host target gene, herein designated VGAM HOST TARGET GENE, is a human gene contained in the human genome.

VGAM1387 gene encodes a VGAM1387 precursor RNA, herein designated VGAM PRECURSOR RNA. Similar to other miRNA genes, and unlike most ordinary genes, VGAM1387 precursor RNA does not encode a protein. A nucleotide sequence identical or highly similar to the nucleotide sequence of VGAM1387 precursor RNA is designated SEQ ID:1373, and is provided hereinbelow with reference to the sequence listing part. Nucleotide sequence SEQ ID:1373 is located at position 7593 relative to the genome of Himetobi P Virus.

VGAM1387 precursor RNA folds onto itself, forming VGAM1387 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1387 folded precursor RNA into VGAM1387 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1387 RNA is designated SEQ ID:4098, and is provided hereinbelow with reference to the sequence listing part.

VGAM1387 host target gene, herein designated VGAM HOST TARGET GENE, encodes a corresponding messenger RNA, VGAM1387 host target RNA, herein designated VGAM HOST TARGET RNA. VGAM1387 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1387 RNA, herein designated VGAM RNA, binds complementarily to one or more host target binding sites located in untranslated regions of VGAM1387 host target RNA, herein designated VGAM HOST TARGET RNA. This complementary binding is due to the fact that the nucleotide sequence of VGAM1387 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1387 RNA, herein designated VGAM RNA, may have a different number of host target binding sites in untranslated regions of a VGAM1387 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1387 RNA, herein designated VGAM RNA, to host target binding sites on VGAM1387 host target RNA, herein designated VGAM HOST TARGET RNA, such as BINDING SITE I, BINDING SITE II and BINDING SITE III, inhibits translation of VGAM1387 host target RNA into VGAM1387 host target protein, herein designated VGAM HOST TARGET PROTEIN. VGAM host target protein is therefore outlined by a broken line.

It is appreciated that VGAM1387 host target gene, herein designated VGAM HOST TARGET GENE, in fact represents a plurality of VGAM1387 host target genes. The mRNA of each one of this plurality of VGAM1387 host target genes comprises one or more host target binding sites, each having a nucleotide sequence which is at least partly complementary to VGAM1387 RNA, herein designated VGAM RNA, and which when bound by VGAM1387 RNA causes inhibition of translation of respective one or more VGAM1387 host target proteins.

It is further appreciated by one skilled in the art that the mode of translational inhibition illustrated by FIG. 1 with specific reference to translational inhibition exerted by VGAM1387 gene, herein designated VGAM GENE, on one or more VGAM1387 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1387 is inhibition of expression of host target genes, as part of a novel viral mechanism of attacking a host. Accordingly, utilities of VGAM1387 include diagnosis, prevention and treatment of viral infection by Himetobi P Virus. Specific functions, and accordingly utilities, of VGAM1387 correlate with, and may be deduced from, the identity of the host target genes which VGAM1387 binds and inhibits, and the function of these host target genes, as elaborated hereinbelow.

Nucleotide sequences of the VGAM1387 precursor RNA, herein designated VGAM PRECURSOR RNA, and of the 'diced' VGAM1387 RNA, herein designated VGAM RNA, and a schematic representation of the secondary folding of VGAM1387 folded precursor RNA, herein designated VGAM FOLDED PRECURSOR RNA, of VGAM1387 are further described hereinbelow with reference to Table 1.

Nucleotide sequences of host target binding sites, such as BINDING SITE-I, BINDING SITE-II and BINDING SITE-III of FIG. 1, found on VGAM1387 host target RNA, and schematic representation of the complementarity of each of these host target binding sites to VGAM1387 RNA, herein designated VGAM RNA, are described hereinbelow with reference to Table 2.

As mentioned hereinabove with reference to FIG. 1, a function of VGAM1387 gene, herein designated VGAM is inhibition of expression of VGAM1387 target genes. It is appreciated that specific functions, and accordingly utilities, of VGAM1387 correlate with, and may be deduced from, the identity of the target genes which VGAM1387 binds and inhibits, and the function of these target genes, as elaborated hereinbelow.

B-cell CLL/lymphoma 11B (zinc finger protein) (BCL11B, Accession NM_022898) is a VGAM1387 host target gene. BCL11B BINDING SITE is HOST TARGET binding site found in the 3' untranslated region of mRNA encoded by BCL11B, corresponding to a HOST TARGET binding site such as BINDING SITE I, BINDING SITE II or BINDING SITE III. Table 2 illustrates the complementarity of the nucleotide sequences of BCL11B BINDING SITE, designated SEQ ID:23169, to the nucleotide sequence of VGAM1387 RNA, herein designated VGAM RNA, also designated SEQ ID:4098.

A function of VGAM1387 is therefore inhibition of B-cell CLL/lymphoma 11B (zinc finger protein) (BCL11B, Accession NM_022898). Accordingly, utilities of VGAM1387 include diagnosis, prevention and treatment of diseases and clinical conditions associated with BCL11B. Stearoyl-CoA Desaturase (delta-9-desaturase) (SCD, Accession NM_005063) is another VGAM1387 host target gene. SCD BINDING SITE is HOST TARGET binding site found in the 3' untranslated region of mRNA encoded by SCD, corresponding to a HOST TARGET binding site such as BINDING SITE I, BINDING SITE II or BINDING SITE III. Table 2 illustrates the complementarity of the nucleotide sequences of SCD BINDING SITE, designated SEQ ID:11493, to the nucleotide sequence of VGAM1387 RNA, herein designated VGAM RNA, also designated SEQ ID:4098.

Another function of VGAM1387 is therefore inhibition of Stearoyl-CoA Desaturase (delta-9-desaturase) (SCD, Accession NM_005063), a gene which functions in the synthesis of unsaturated fatty acids. Accordingly, utilities of VGAM1387 include diagnosis, prevention and treatment of diseases and clinical conditions associated with SCD. The function of SCD and its association with various diseases and clinical conditions, has been established by previous studies, as described hereinabove with reference to VGAM314. Transcription Factor-like 4 (TCFL4, Accession XM_032817) is another VGAM1387 host target gene. TCFL4 BINDING SITE is HOST TARGET binding site found in the 3' untranslated region of mRNA encoded by TCFL4, corresponding to a HOST TARGET binding site such as BINDING SITE I, BINDING SITE II or BINDING SITE III. Table 2 illustrates the complementarity of the nucleotide sequences of TCFL4 BINDING SITE, designated SEQ ID:31768, to the nucleotide sequence of VGAM1387 RNA, herein designated VGAM RNA, also designated SEQ ID:4098.

Another function of VGAM1387 is therefore inhibition of Transcription Factor-like 4 (TCFL4, Accession XM_032817), a gene which interacts with Mad and represses transcription by recruiting the Sin3A-histone deacetylase corepressor complex. Accordingly, utilities of VGAM1387 include diagnosis, prevention and treatment of diseases and clinical conditions associated with TCFL4. The function of TCFL4 and its association with various diseases and clinical conditions, has been established by previous studies, as described hereinabove with reference to VGAM172. Wingless-type MMTV Integration Site Family, Member 5A (WNT5A, Accession NM_003392) is another VGAM1387 host target gene. WNT5A BINDING SITE is HOST TARGET binding site found in the 3' untranslated region of mRNA encoded by WNT5A, corresponding to a HOST TARGET binding site such as BINDING SITE I, BINDING SITE II or BINDING SITE III. Table 2 illustrates the complementarity of the nucleotide sequences of WNT5A BINDING SITE, designated SEQ ID:9430, to the nucleotide sequence of VGAM1387 RNA, herein designated VGAM RNA, also designated SEQ ID:4098.

Another function of VGAM1387 is therefore inhibition of Wingless-type MMTV Integration Site Family, Member 5A (WNT5A, Accession NM_003392), a gene which is a ligand for members of the frizzled family of seven transmembrane receptors and is probablely a developmental protein. Accordingly, utilities of VGAM1387 include diagnosis, prevention and treatment of diseases and clinical conditions associated with WNT5A. The function of WNT5A and its association with various diseases and clinical conditions, has been established by previous studies, as described hereinabove with reference to VGAM996. Zinc Finger Protein 161 (ZNF161, Accession NM_007146) is another VGAM1387 host target gene. ZNF161 BINDING SITE is HOST TARGET binding site found in the 3' untranslated region of mRNA encoded by ZNF161, corresponding to a HOST TARGET binding site such as BINDING SITE I, BINDING SITE II or BINDING SITE III. Table 2 illustrates the complementarity of the nucleotide sequences of ZNF161 BINDING SITE, designated SEQ ID:13997, to the nucleotide sequence of VGAM1387 RNA, herein designated VGAM RNA, also designated SEQ ID:4098.

Another function of VGAM1387 is therefore inhibition of Zinc Finger Protein 161 (ZNF161, Accession NM_007146). Accordingly, utilities of VGAM1387 include diagnosis, prevention and treatment of diseases and clinical conditions associated with ZNF161. Basic Leucine Zipper and W2 Domains 1 (BZW1, Accession NM_014670) is another VGAM1387 host target gene. BZW1 BINDING SITE is HOST TARGET binding site found in the 3' untranslated region of mRNA encoded by BZW1, corresponding to a HOST TARGET binding site such as BINDING SITE I, BINDING SITE II or BINDING SITE III. Table 2 illustrates the complementarity of the nucleotide sequences of BZW1 BINDING SITE, designated SEQ ID:16128, to the nucleotide sequence of VGAM1387 RNA, herein designated VGAM RNA, also designated SEQ ID:4098.

Another function of VGAM1387 is therefore inhibition of Basic Leucine Zipper and W2 Domains 1 (BZW1, Accession NM_014670). Accordingly, utilities of VGAM1387 include diagnosis, prevention and treatment of diseases and clinical conditions associated with BZW1. Cysteine and Histidine-rich Domain (CHORD)-containing, Zinc Binding Protein 1 (CHORDC1, Accession NM_012124) is another VGAM1387 host target gene. CHORDC1 BINDING SITE is HOST TARGET binding site found in the 3' untranslated region of mRNA encoded by CHORDC1, corresponding to a HOST TARGET binding site such as BINDING SITE I, BINDING SITE II or BINDING SITE III. Table 2 illustrates the complementarity of the nucleotide sequences of CHORDC1 BINDING SITE, designated SEQ ID:14436, to the nucleotide sequence of VGAM1387 RNA, herein designated VGAM RNA, also designated SEQ ID:4098.

Another function of VGAM1387 is therefore inhibition of Cysteine and Histidine-rich Domain (CHORD)-containing, Zinc Binding Protein 1 (CHORDC1, Accession NM_012124). Accordingly, utilities of VGAM1387 include diagnosis, prevention and treatment of diseases and clinical conditions associated with CHORDC1. DKFZP434A043 (Accession NM_015396) is another VGAM1387 host target gene. DKFZP434A043 BINDING SITE is HOST TARGET binding site found in the 3' untranslated region of mRNA encoded by DKFZP434A043, corresponding to a HOST TARGET binding site such as BINDING SITE I, BINDING SITE II or BINDING SITE III. Table 2 illustrates the complementarity of the nucleotide sequences of DKFZP434A043 BINDING SITE, designated SEQ ID:17699, to the nucleotide sequence of VGAM1387 RNA, herein designated VGAM RNA, also designated SEQ ID:4098.

Another function of VGAM1387 is therefore inhibition of DKFZP434A043 (Accession NM_015396). Accordingly, utilities of VGAM1387 include diagnosis, prevention and treatment of diseases and clinical conditions associated with DKFZP434A043. DKFZP434L0718 (Accession NM_032139) is another VGAM1387 host target gene. DKFZP434L0718 BINDING SITE is HOST TARGET binding site found in the 3' untranslated region of mRNA encoded by DKFZP434L0718, corresponding to a HOST TARGET binding site such as BINDING SITE I, BINDING SITE II or BINDING SITE III. Table 2 illustrates the complementarity of the nucleotide sequences of DKFZP434L0718 BINDING SITE, designated SEQ ID:25821, to the nucleotide sequence of VGAM1387 RNA, herein designated VGAM RNA, also designated SEQ ID:4098.

Another function of VGAM1387 is therefore inhibition of DKFZP434L0718 (Accession NM_032139). Accordingly, utilities of VGAM1387 include diagnosis, prevention and treatment of diseases and clinical conditions associated with DKFZP434L0718. FLJ11827 (Accession NM_025093) is another VGAM1387 host target gene. FLJ11827 BINDING SITE is HOST TARGET binding site found in the 3' untranslated region of mRNA encoded by FLJ11827, corresponding to a HOST TARGET binding site such as BINDING SITE I, BINDING SITE II or BINDING SITE III. Table 2 illustrates the complementarity of the nucleotide sequences of FLJ11827 BINDING SITE, designated SEQ ID:24721, to the nucleotide sequence of VGAM1387 RNA, herein designated VGAM RNA, also designated SEQ ID:4098.

Another function of VGAM1387 is therefore inhibition of FLJ11827 (Accession NM_025093). Accordingly, utilities of VGAM1387 include diagnosis, prevention and treatment of diseases and clinical conditions associated with FLJ11827. FLJ22944 (Accession NM_025145) is another VGAM1387 host target gene. FLJ22944 BINDING SITE is HOST TARGET binding site found in the 3' untranslated region of mRNA encoded by FLJ22944, corresponding to a HOST TARGET binding site such as BINDING SITE I, BINDING SITE II or BINDING SITE III. Table 2 illustrates the complementarity of the nucleotide sequences of FLJ22944 BINDING SITE, designated SEQ ID:24781, to the nucleotide sequence of VGAM1387 RNA, herein designated VGAM RNA, also designated SEQ ID:4098.

Another function of VGAM1387 is therefore inhibition of FLJ22944 (Accession NM_025145). Accordingly, utilities of VGAM1387 include diagnosis, prevention and treatment of diseases and clinical conditions associated with FLJ22944. KIAA1371 (Accession XM_114371) is another VGAM1387 host target gene. KIAA1371 BINDING SITE is HOST TARGET binding site found in the 3' untranslated region of mRNA encoded by KIAA1371, corresponding to a HOST TARGET binding site such as BINDING SITE I, BINDING SITE II or BINDING SITE III. Table 2 illustrates the complementarity of the nucleotide sequences of KIAA1371 BINDING SITE, designated SEQ ID:42908, to the nucleotide sequence of VGAM1387 RNA, herein designated VGAM RNA, also designated SEQ ID:4098.

Another function of VGAM1387 is therefore inhibition of KIAA1371 (Accession XM_114371). Accordingly, utilities of VGAM1387 include diagnosis, prevention and treatment of diseases and clinical conditions associated with KIAA1371. KIAA1755 (Accession XM_028810) is another VGAM1387 host target gene. KIAA1755 BINDING SITE is HOST TARGET binding site found in the 3' untranslated region of mRNA encoded by KIAA1755, corresponding to a HOST TARGET binding site such as BINDING SITE I, BINDING SITE II or BINDING SITE III. Table 2 illustrates the complementarity of the nucleotide sequences of KIAA1755 BINDING SITE, designated SEQ ID:30747, to the nucleotide sequence of VGAM1387 RNA, herein designated VGAM RNA, also designated SEQ ID:4098.

Another function of VGAM1387 is therefore inhibition of KIAA1755 (Accession XM_028810). Accordingly, utilities of VGAM1387 include diagnosis, prevention and treatment of diseases and clinical conditions associated with KIAA1755. KIAA1795 (Accession XM_050988) is another VGAM1387 host target gene. KIAA1795 BINDING SITE is HOST TARGET binding site found in the 3' untranslated region of mRNA encoded by KIAA1795, corresponding to a HOST TARGET binding site such as BINDING SITE I, BINDING SITE II or BINDING SITE III. Table 2 illustrates the complementarity of the nucleotide sequences of KIAA1795 BINDING SITE, designated SEQ ID:35699, to the nucleotide sequence of VGAM1387 RNA, herein designated VGAM RNA, also designated SEQ ID:4098.

Another function of VGAM1387 is therefore inhibition of KIAA1795 (Accession XM_050988). Accordingly, utilities of VGAM1387 include diagnosis, prevention and treatment of diseases and clinical conditions associated with KIAA1795. RNAHP (Accession NM_007372) is another VGAM1387 host target gene. RNAHP BINDING SITE is HOST TARGET binding site found in the 3' untranslated region of mRNA encoded by RNAHP, corresponding to a HOST TARGET binding site such as BINDING SITE I, BINDING SITE II or BINDING SITE III. Table 2 illustrates the complementarity of the nucleotide sequences of RNAHP BINDING SITE, designated SEQ ID:14299, to the nucleotide sequence of VGAM1387 RNA, herein designated VGAM RNA, also designated SEQ ID:4098.

Another function of VGAM1387 is therefore inhibition of RNAHP (Accession NM_007372). Accordingly, utilities of VGAM1387 include diagnosis, prevention and treatment of diseases and clinical conditions associated with RNAHP. Solute Carrier Family 26, Member 7 (SLC26A7, Accession NM_052832) is another VGAM1387 host target gene. SLC26A7 BINDING SITE is HOST TARGET binding site found in the 3' untranslated region of mRNA encoded by SLC26A7, corresponding to a HOST TARGET binding site such as BINDING SITE I, BINDING SITE II or BINDING SITE III. Table 2 illustrates the complementarity of the nucleotide sequences of SLC26A7 BINDING SITE, designated SEQ ID:27411, to the nucleotide sequence of VGAM1387 RNA, herein designated VGAM RNA, also designated SEQ ID:4098.

Another function of VGAM1387 is therefore inhibition of Solute Carrier Family 26, Member 7 (SLC26A7, Accession NM_052832). Accordingly, utilities of VGAM1387 include diagnosis, prevention and treatment of diseases and clinical conditions associated with SLC26A7. Zinc Finger, DHHC Domain Containing 5 (ZDHHC5, Accession XM_166204) is another VGAM1387 host target gene. ZDHHC5 BINDING SITE is HOST TARGET binding site found in the 5' untranslated region of mRNA encoded by ZDHHC5, corresponding to a HOST TARGET binding site such as BINDING SITE I, BINDING SITE II or BINDING SITE III. Table 2 illustrates the complementarity of the nucleotide sequences of ZDHHC5 BINDING SITE, designated SEQ ID:44008, to the nucleotide sequence of VGAM1387 RNA, herein designated VGAM RNA, also designated SEQ ID:4098.

Another function of VGAM1387 is therefore inhibition of Zinc Finger, DHHC Domain Containing 5 (ZDHHC5, Accession XM_166204). Accordingly, utilities of VGAM1387 include diagnosis, prevention and treatment of diseases and clinical conditions associated with ZDHHC5. LOC145098 (Accession XM_085022) is another VGAM1387 host target gene. LOC145098 BINDING SITE is HOST TARGET binding site found in the 5' untranslated region of mRNA encoded by LOC145098, corresponding to a HOST TARGET binding site such as BINDING SITE I, BINDING SITE II or BINDING SITE III. Table 2 illustrates the complementarity of the nucleotide sequences of LOC145098 BINDING SITE, designated SEQ ID:37795, to the nucleotide sequence of VGAM1387 RNA, herein designated VGAM RNA, also designated SEQ ID:4098.

Another function of VGAM1387 is therefore inhibition of LOC145098 (Accession XM_085022). Accordingly, utilities of VGAM1387 include diagnosis, prevention and treatment of diseases and clinical conditions associated with LOC145098. LOC146795 (Accession XM_085593) is another VGAM1387 host target gene. LOC146795 BINDING SITE is HOST TARGET binding site found in the 5' untranslated region of mRNA encoded by LOC146795, corresponding to a HOST TARGET binding site such as BINDING SITE I, BINDING SITE II or BINDING SITE III. Table 2 illustrates the complementarity of the nucleotide sequences of LOC146795 BINDING SITE, designated SEQ ID:38242, to the nucleotide sequence of VGAM1387 RNA, herein designated VGAM RNA, also designated SEQ ID:4098.

Another function of VGAM1387 is therefore inhibition of LOC146795 (Accession XM_085593). Accordingly, utilities of VGAM1387 include diagnosis, prevention and treatment of diseases and clinical conditions associated with LOC146795. LOC148266 (Accession XM_086128) is another VGAM1387 host target gene. LOC148266 BINDING SITE is HOST TARGET binding site found in the 3' untranslated region of mRNA encoded by LOC148266, corresponding to a HOST TARGET binding site such as BINDING SITE I, BINDING SITE II or BINDING SITE III. Table 2 illustrates the complementarity of the nucleotide sequences of LOC148266 BINDING SITE, designated SEQ ID:38514, to the nucleotide sequence of VGAM1387 RNA, herein designated VGAM RNA, also designated SEQ ID:4098.

Another function of VGAM1387 is therefore inhibition of LOC148266 (Accession XM_086128). Accordingly, utilities of VGAM1387 include diagnosis, prevention and treatment of diseases and clinical conditions associated with LOC148266. LOC151579 (Accession XM_045290) is another VGAM1387 host target gene. LOC151579 BINDING SITE is HOST TARGET binding site found in the 3' untranslated region of mRNA encoded by LOC151579, corresponding to a HOST TARGET binding site such as BINDING SITE I, BINDING SITE II or BINDING SITE III. Table 2 illustrates the complementarity of the nucleotide sequences of LOC151579 BINDING SITE, designated SEQ ID:34422, to the nucleotide sequence of VGAM1387 RNA, herein designated VGAM RNA, also designated SEQ ID:4098.

Another function of VGAM1387 is therefore inhibition of LOC151579 (Accession XM_045290). Accordingly, utilities of VGAM1387 include diagnosis, prevention and treatment of diseases and clinical conditions associated with LOC151579. LOC152620 (Accession XM_011108) is another VGAM1387 host target gene. LOC152620 BINDING SITE is HOST TARGET binding site found in the 3' untranslated region of mRNA encoded by LOC152620, corresponding to a HOST TARGET binding site such as BINDING SITE I, BINDING SITE II or BINDING SITE III. Table 2 illustrates the complementarity of the nucleotide sequences of LOC152620 BINDING SITE, designated SEQ ID:30174, to the nucleotide sequence of VGAM1387 RNA, herein designated VGAM RNA, also designated SEQ ID:4098.

Another function of VGAM1387 is therefore inhibition of LOC152620 (Accession XM_011108). Accordingly, utilities of VGAM1387 include diagnosis, prevention and treatment of diseases and clinical conditions associated with LOC152620. LOC199907 (Accession XM_114051) is another VGAM1387 host target gene. LOC199907 BINDING SITE is HOST TARGET binding site found in the 3' untranslated region of mRNA encoded by LOC199907, corresponding to a HOST TARGET binding site such as BINDING SITE I, BINDING SITE II or BINDING SITE III. Table 2 illustrates the complementarity of the nucleotide sequences of LOC199907 BINDING SITE, designated SEQ ID:42657, to the nucleotide sequence of VGAM1387 RNA, herein designated VGAM RNA, also designated SEQ ID:4098.

Another function of VGAM1387 is therefore inhibition of LOC199907 (Accession XM_114051). Accordingly, utilities of VGAM1387 include diagnosis, prevention and treatment of diseases and clinical conditions associated with LOC199907. LOC255565 (Accession XM_170811) is another VGAM1387 host target gene. LOC255565 BINDING SITE is HOST TARGET binding site found in the 3' untranslated region of mRNA encoded by LOC255565, corresponding to a HOST TARGET binding site such as BINDING SITE I, BINDING SITE II or BINDING SITE III. Table 2 illustrates the complementarity of the nucleotide sequences of LOC255565 BINDING SITE, designated SEQ ID:45591, to the nucleotide sequence of VGAM1387 RNA, herein designated VGAM RNA, also designated SEQ ID:4098.

Another function of VGAM1387 is therefore inhibition of LOC255565 (Accession XM_170811). Accordingly, utilities of VGAM1387 include diagnosis, prevention and treatment of diseases and clinical conditions associated with LOC255565. FIG. 1 further provides a conceptual description of a novel bioinformatically detected viral gene of the present invention, referred to here as Viral Genomic Address Messenger 1388 (VGAM1388) viral gene, which modulates expression of respective host target genes thereof, the function and utility of which host target genes is known in the art.

VGAM1388 is a novel bioinformatically detected regulatory, non protein coding, viral micro RNA (miRNA) gene. The method by which VGAM1388 was detected is described hereinabove with reference to FIGS. 1-8.

VGAM1388 gene, herein designated VGAM GENE, is a viral gene contained in the genome of Cercopithecine Herpesvirus 7. VGAM1388 host target gene, herein designated VGAM HOST TARGET GENE, is a human gene contained in the human genome.

VGAM1388 gene encodes a VGAM1388 precursor RNA, herein designated VGAM PRECURSOR RNA. Similar to other miRNA genes, and unlike most ordinary genes, VGAM1388 precursor RNA does not encode a protein. A nucleotide sequence identical or highly similar to the nucleotide sequence of VGAM1388 precursor RNA is designated SEQ ID:1374, and is provided hereinbelow with reference to the sequence listing part. Nucleotide sequence SEQ ID:1374 is located at position 58541 relative to the genome of Cercopithecine Herpesvirus 7.

VGAM1388 precursor RNA folds onto itself, forming VGAM1388 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1388 folded precursor RNA into VGAM1388 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM1388 RNA is designated SEQ ID:4099, and is provided hereinbelow with reference to the sequence listing part.

VGAM1388 host target gene, herein designated VGAM HOST TARGET GENE, encodes a corresponding messenger RNA, VGAM1388 host target RNA, herein designated VGAM HOST TARGET RNA. VGAM1388 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1388 RNA, herein designated VGAM RNA, binds complementarily to one or more host target binding sites located in untranslated regions of VGAM1388 host target RNA, herein designated VGAM HOST TARGET RNA. This complementary binding is due to the fact that the nucleotide sequence of VGAM1388 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1388 RNA, herein designated VGAM RNA, may have a different number of host target binding sites in untranslated regions of a VGAM1388 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1388 RNA, herein designated VGAM RNA, to host target binding sites on VGAM1388 host target RNA, herein designated VGAM HOST TARGET RNA, such as BINDING SITE I, BINDING SITE II and BINDING SITE III, inhibits translation of VGAM1388 host target RNA into VGAM1388 host target protein, herein designated VGAM HOST TARGET PROTEIN. VGAM host target protein is therefore outlined by a broken line.

It is appreciated that VGAM1388 host target gene, herein designated VGAM HOST TARGET GENE, in fact represents a plurality of VGAM1388 host target genes. The mRNA of each one of this plurality of VGAM1388 host target genes comprises one or more host target binding sites, each having a nucleotide sequence which is at least partly complementary to VGAM1388 RNA, herein designated VGAM RNA, and which when bound by VGAM1388 RNA causes inhibition of translation of respective one or more VGAM1388 host target proteins.

It is further appreciated by one skilled in the art that the mode of translational inhibition illustrated by FIG. 1 with specific reference to translational inhibition exerted by VGAM1388 gene, herein designated VGAM GENE, on one or more VGAM1388 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1388 is inhibition of expression of host target genes, as part of a novel viral mechanism of attacking a host. Accordingly, utilities of VGAM1388 include diagnosis, prevention and treatment of viral infection by Cercopithecine Herpesvirus 7. Specific functions, and accordingly utilities, of VGAM1388 correlate with, and may be deduced from, the identity of the host target genes which VGAM1388 binds and inhibits, and the function of these host target genes, as elaborated hereinbelow.

Nucleotide sequences of the VGAM1388 precursor RNA, herein designated VGAM PRECURSOR RNA, and of the 'diced' VGAM1388 RNA, herein designated VGAM RNA, and a schematic representation of the secondary folding of VGAM1388 folded precursor RNA, herein designated VGAM FOLDED PRECURSOR RNA, of VGAM1388 are further described hereinbelow with reference to Table 1.

Nucleotide sequences of host target binding sites, such as BINDING SITE-I, BINDING SITE-II and BINDING SITE-III of FIG. 1, found on VGAM1388 host target RNA, and schematic representation of the complementarity of each of these host target binding sites to VGAM1388 RNA, herein designated VGAM RNA, are described hereinbelow with reference to Table 2.

As mentioned hereinabove with reference to FIG. 1, a function of VGAM1388 gene, herein designated VGAM is inhibition of expression of VGAM1388 target genes. It is appreciated that specific functions, and accordingly utilities, of VGAM1388 correlate with, and may be deduced from, the identity of the target genes which VGAM1388 binds and inhibits, and the function of these target genes, as elaborated hereinbelow.

DXS1283E (Accession XM_047871) is a VGAM1388 host target gene. DXS1283E BINDING SITE is HOST TARGET binding site found in the 3' untranslated region of mRNA encoded by DXS1283E, corresponding to a HOST TARGET binding site such as BINDING SITE I, BINDING SITE II or BINDING SITE III. Table 2 illustrates the complementarity of the nucleotide sequences of DXS1283E BINDING SITE, designated SEQ ID:35060, to the nucleotide sequence of VGAM1388 RNA, herein designated VGAM RNA, also designated SEQ ID:4099.

A function of VGAM1388 is therefore inhibition of DXS1283E (Accession XM_047871). Accordingly, utilities of VGAM1388 include diagnosis, prevention and treatment of diseases and clinical conditions associated with DXS1283E. TOPBP1 (Accession NM_007027) is another VGAM1388 host target gene. TOPBP1 BINDING SITE is HOST TARGET binding site found in the 3' untranslated region of mRNA encoded by TOPBP1, corresponding to a HOST TARGET binding site such as BINDING SITE I, BINDING SITE II or BINDING SITE III. Table 2 illustrates the complementarity of the nucleotide sequences of TOPBP1 BINDING SITE, designated SEQ ID:13885, to the nucleotide sequence of VGAM1388 RNA, herein designated VGAM RNA, also designated SEQ ID:4099.

Another function of VGAM1388 is therefore inhibition of TOPBP1 (Accession NM_007027). Accordingly, utilities of VGAM1388 include diagnosis, prevention and treatment of diseases and clinical conditions associated with TOPBP1. FIG. 1 further provides a conceptual description of a novel bioinformatically detected viral gene of the present invention, referred to here as Viral Genomic Address Messenger 1389 (VGAM1389) viral gene, which modulates expression of respective host target genes thereof, the function and utility of which host target genes is known in the art.

VGAM1389 is a novel bioinformatically detected regulatory, non protein coding, viral micro RNA (miRNA) gene. The method by which VGAM1389 was detected is described hereinabove with reference to FIGS. 1-8.

VGAM1389 gene, herein designated VGAM GENE, is a viral gene contained in the genome of Cercopithecine Herpesvirus 7. VGAM1389 host target gene, herein designated VGAM HOST TARGET GENE, is a human gene contained in the human genome.

VGAM1389 gene encodes a VGAM1389 precursor RNA, herein designated VGAM PRECURSOR RNA. Similar to other miRNA genes, and unlike most ordinary genes, VGAM1389 precursor RNA does not encode a protein. A nucleotide sequence identical or highly similar to the nucleotide sequence of VGAM1389 precursor RNA is designated SEQ ID:1375, and is provided hereinbelow with reference to the sequence listing part. Nucleotide sequence SEQ ID:1375 is located at position 56184 relative to the genome of Cercopithecine Herpesvirus 7.

VGAM1389 precursor RNA folds onto itself, forming VGAM1389 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1389 folded precursor RNA into VGAM1389 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1389 RNA is designated SEQ ID:4100, and is provided hereinbelow with reference to the sequence listing part.

VGAM1389 host target gene, herein designated VGAM HOST TARGET GENE, encodes a corresponding messenger RNA, VGAM1389 host target RNA, herein designated VGAM HOST TARGET RNA. VGAM1389 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1389 RNA, herein designated VGAM RNA, binds complementarily to one or more host target binding sites located in untranslated regions of VGAM1389 host target RNA, herein designated VGAM HOST TARGET RNA. This complementary binding is due to the fact that the nucleotide sequence of VGAM1389 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1389 RNA, herein designated VGAM RNA, may have a different number of host target binding sites in untranslated regions of a VGAM1389 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1389 RNA, herein designated VGAM RNA, to host target binding sites on VGAM1389 host target RNA, herein designated VGAM HOST TARGET RNA, such as BINDING SITE I, BINDING SITE II and BINDING SITE III, inhibits translation of VGAM1389 host target RNA into VGAM1389 host target protein, herein designated VGAM HOST TARGET PROTEIN. VGAM host target protein is therefore outlined by a broken line.

It is appreciated that VGAM1389 host target gene, herein designated VGAM HOST TARGET GENE, in fact represents a plurality of VGAM1389 host target genes. The mRNA of each one of this plurality of VGAM1389 host target genes comprises one or more host target binding sites, each having a nucleotide sequence which is at least partly complementary to VGAM1389 RNA, herein designated VGAM RNA, and which when bound by VGAM1389 RNA causes inhibition of translation of respective one or more VGAM1389 host target proteins.

It is further appreciated by one skilled in the art that the mode of translational inhibition illustrated by FIG. 1 with specific reference to translational inhibition exerted by VGAM1389 gene, herein designated VGAM GENE, on one or more VGAM1389 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1389 is inhibition of expression of host target genes, as part of a novel viral mechanism of attacking a host. Accordingly, utilities of VGAM1389 include diagnosis, prevention and treatment of viral infection by Cercopithecine Herpesvirus 7. Specific functions, and accordingly utilities, of VGAM1389 correlate with, and may be deduced from, the identity of the host target genes which VGAM1389 binds and inhibits, and the function of these host target genes, as elaborated hereinbelow.

Nucleotide sequences of the VGAM1389 precursor RNA, herein designated VGAM PRECURSOR RNA, and of the 'diced' VGAM1389 RNA, herein designated VGAM RNA, and a schematic representation of the secondary folding of VGAM1389 folded precursor RNA, herein designated VGAM FOLDED PRECURSOR RNA, of VGAM1389 are further described hereinbelow with reference to Table 1.

Nucleotide sequences of host target binding sites, such as BINDING SITE-I, BINDING SITE-II and BINDING SITE-III of FIG. 1, found on VGAM1389 host target RNA, and schematic representation of the complementarity of each of these host target binding sites to VGAM1389 RNA, herein designated VGAM RNA, are described hereinbelow with reference to Table 2.

As mentioned hereinabove with reference to FIG. 1, a function of VGAM1389 gene, herein designated VGAM is inhibition of expression of VGAM1389 target genes. It is appreciated that specific functions, and accordingly utilities, of VGAM1389 correlate with, and may be deduced from, the identity of the target genes which VGAM1389 binds and inhibits, and the function of these target genes, as elaborated hereinbelow.

Down Syndrome Critical Region Gene 3 (DSCR3, Accession NM_006052) is a VGAM1389 host target gene. DSCR3 BINDING SITE is HOST TARGET binding site found in the 3' untranslated region of mRNA encoded by DSCR3, corresponding to a HOST TARGET binding site such as BINDING SITE I, BINDING SITE II or BINDING SITE III. Table 2 illustrates the complementarity of the nucleotide sequences of DSCR3 BINDING SITE, designated SEQ ID:12683, to the nucleotide sequence of VGAM1389 RNA, herein designated VGAM RNA, also designated SEQ ID:4100.

A function of VGAM1389 is therefore inhibition of Down Syndrome Critical Region Gene 3 (DSCR3, Accession NM_006052). Accordingly, utilities of VGAM1389 include diagnosis, prevention and treatment of diseases and clinical conditions associated with DSCR3. Mannosyl (alpha-1,6-)-glycoprotein Beta-1,6-N-acetyl-glucosaminyltransferase (MGAT5, Accession NM_002410) is another VGAM1389 host target gene. MGAT5 BINDING SITE is HOST TARGET binding site found in the 5' untranslated region of mRNA encoded by MGAT5, corresponding to a HOST TARGET binding site such as BINDING SITE I, BINDING SITE II or BINDING SITE III. Table 2 illustrates the complementarity of the nucleotide sequences of MGAT5 BINDING SITE, designated SEQ ID:8236, to the nucleotide sequence of VGAM1389 RNA, herein designated VGAM RNA, also designated SEQ ID:4100.

Another function of VGAM1389 is therefore inhibition of Mannosyl (alpha-1,6-)-glycoprotein Beta-1,6-N-acetyl-glucosaminyltransferase (MGAT5, Accession NM_002410). Accordingly, utilities of VGAM1389 include diagnosis, prevention and treatment of diseases and clinical conditions associated with MGAT5. Phosphoinositide-3-kinase, Catalytic, Gamma Polypeptide (PIK3CG, Accession NM_002649) is another VGAM1389 host target gene. PIK3CG BINDING SITE is HOST TARGET binding site found in the 3' untranslated region of mRNA encoded by PIK3CG, corresponding to a HOST TARGET binding site such as BINDING SITE I, BINDING SITE II or BINDING SITE III. Table 2 illustrates the complementarity of the nucleotide sequences of PIK3CG BINDING SITE, designated SEQ ID:8511, to the nucleotide sequence of VGAM1389 RNA, herein designated VGAM RNA, also designated SEQ ID:4100.

Another function of VGAM1389 is therefore inhibition of Phosphoinositide-3-kinase, Catalytic, Gamma Polypeptide (PIK3CG, Accession NM_002649), a gene which regulating cell growth. Accordingly, utilities of VGAM1389 include diagnosis, prevention and treatment of diseases and clinical conditions associated with PIK3CG. The function of PIK3CG has been established by previous studies. Phosphatidylinositol 3-kinase (PIK3) activity is implicated in diverse cellular responses triggered by mammalian cell surface receptors. Stoyanov et al. (1995) noted that receptors with tyrosine kinase activity recruit heterodimeric PIK3 kinases composed of a p110 catalytic subunit and a p85 adaptor subunit (OMIM Ref. No. 171833). Stoyanov et al. (1995) screened a human bone marrow cDNA library with primers based on the sequences of yeast and bovine PIK3 p110 subunits. They isolated a human cDNA for a novel p110 subunit, which they termed p110-gamma. The cDNA encodes a predicted 120-kD, 1,050-amino acid polypeptide with 36% identity to human p110-alpha (OMIM Ref. No. 171834). The 5.3-kb p110-alpha transcript was detectable by Northern blot in human pancreas, skeletal muscle, liver, and heart. Stoyanov et al. (1995) found that recombinant p110-gamma did not interact with the p85 subunit in vivo, in contrast to recombinant p110-alpha. The transducin G protein subunits G-beta (t) (OMIM Ref. No. 189974)/G-gamma (t) (OMIM Ref. No. 189970) did, however, activate p110-gamma in vitro, and the stimulation was suppressed by G-alpha (t)-GDP (OMIM Ref. No. 139330); G-alpha (t)-GDP could stimulate p110-gamma only in the presence of AlF(4-). In contrast, the p85-dependent p110-alpha was not similarly affected by the G protein subunits. Stoyanov et al. (1995) speculated that the p110-gamma isotype may link signaling through G protein-coupled receptors and generate phosphoinositide second messengers phosphorylated in the D-3 position Animal model experiments lend further support to the function of PIK3CG. Hirsch et al. (2000), Sasaki et al. (2000), and Li et al. (2000) each independently developed mice deficient in PI3K-gamma by targeted disruption. PI3K-gamma -/- mice were viable and had fully differentiated neutrophils and macrophages. Chemoattractant-stimulated PI3K-gamma -/- neutrophils did not produce phosphatidylinositol 3,4,5-triphosphate, did not activate protein kinase B, and displayed impaired respiratory burst and motility. Peritoneal PI3K-gamma-null macrophages showed a reduced migration toward a wide range of chemotactic stimuli and a severely defective accumulation in a septic peritonitis model, as shown by Hirsch et al. (2000). These results demonstrated that PI3K-gamma is a crucial signaling molecule required for macrophage accumulation in inflammation. Sasaki et al. (2000) demonstrated that PI3K-gamma controls thymocyte survival and activation of mature T cells, but has no role in the development or function of B cells. PI3K-gamma-deficient neutrophils exhibited severe defects in migration and respiratory burst in response to G protein-coupled receptor agonists and chemotactic agents. PI3K-gamma links G protein-coupled receptor stimulation to the formation of phosphatidylinositol 3,4,5-triphosphate and the activation of protein kinase B, ribosomal protein S6 kinase (see OMIM Ref. No. 300075), and extracellular signal-regulated kinases 1 (OMIM Ref. No. 601795) and 2. Thus, Sasaki et al. (2000) concluded that PI3K-gamma regulates thymocyte development, T-cell activation, neutrophil migration, and the oxidative burst. Li et al. (2000) reported similar results and also found that PI3K-gamma has an important role in chemoattractant-induced superoxide production and chemotaxis and in the production of T cell-independent antigen-specific antibodies composed of the immunoglobulin-gamma light chain It is appreciated that the abovementioned animal model for PIK3CG is acknowledged by those skilled in the art as a scientifically valid animal model, as can be further appreciated from the publications sited hereinbelow.

Full details of the abovementioned studies are described in the following publications, the disclosure of which are hereby incorporated by reference:

Stoyanov, B.; Volinia, S.; Hanck, T.; Rubio, I.; Loubtchenkov, M.; Malek, D.; Stoyanova, S.; Vanhaesebroeck, B.; Dhand, R.; Nurnberg, B.; Gierschik, P.; Seedorf, K.; Hsuan, J. J.; Waterfield, M. D.; Wetzker, R.: Cloning and characterization of a G protein-activated human phosphoinositide-3 kinase. Science 269:690-693, 1995; and Li, Z.; Jiang, H.; Xie, W.; Zhang, Z.; Smrcka, A. V.; Wu, D.: Roles of PLC-beta-2 and -beta-3 and PI3K-gamma in chemoattractant-mediated signal transduction. Science 287: 1046-1049, 2000.

Further studies establishing the function and utilities of PIK3CG are found in John Hopkins OMIM database record ID 601232, and in sited publications numbered 9852-9855, 6842, 786 and 10854-2833 listed in the bibliography section hereinbelow, which are also hereby incorporated by reference. FLJ13449 (Accession NM_024546) is another VGAM1389 host target gene. FLJ13449 BINDING SITE is HOST TARGET binding site found in the 3' untranslated region of mRNA encoded by FLJ13449, corresponding to a HOST TARGET binding site such as BINDING SITE I, BINDING SITE II or BINDING SITE III. Table 2 illustrates the complementarity of the nucleotide sequences of FLJ13449 BINDING SITE, designated SEQ ID:23759, to the nucleotide sequence of VGAM1389 RNA, herein designated VGAM RNA, also designated SEQ ID:4100.

Another function of VGAM1389 is therefore inhibition of FLJ13449 (Accession NM_024546). Accordingly, utilities of VGAM1389 include diagnosis, prevention and treatment of diseases and clinical conditions associated with FLJ13449. KIAA1025 (Accession XM_034056) is another VGAM1389 host target gene. KIAA1025 BINDING SITE is HOST TARGET binding site found in the 3' untranslated region of mRNA encoded by KIAA1025, corresponding to a HOST TARGET binding site such as BINDING SITE I, BINDING SITE II or BINDING SITE III. Table 2 illustrates the complementarity of the nucleotide sequences of KIAA1025 BINDING SITE, designated SEQ ID:31995, to the nucleotide sequence of VGAM1389 RNA, herein designated VGAM RNA, also designated SEQ ID:4100.

Another function of VGAM1389 is therefore inhibition of KIAA1025 (Accession XM_034056). Accordingly, utilities of VGAM1389 include diagnosis, prevention and treatment of diseases and clinical conditions associated with KIAA1025. Protocadherin 17 (PCDH17, Accession NM_014459) is another VGAM1389 host target gene. PCDH17 BINDING SITE is HOST TARGET binding site found in the 5' untranslated region of mRNA encoded by PCDH17, corresponding to a HOST TARGET binding site such as BINDING SITE I, BINDING SITE II or BINDING SITE III. Table 2 illustrates the complementarity of the nucleotide sequences of PCDH17 BINDING SITE, designated SEQ ID:15811, to the nucleotide sequence of VGAM1389 RNA, herein designated VGAM RNA, also designated SEQ ID:4100.

Another function of VGAM1389 is therefore inhibition of Protocadherin 17 (PCDH17, Accession NM_014459). Accordingly, utilities of VGAM1389 include diagnosis, prevention and treatment of diseases and clinical conditions associated with PCDH17. Zinc Finger Protein 384 (ZNF384, Accession NM_133476) is another VGAM1389 host target gene. ZNF384 BINDING SITE is HOST TARGET binding site found in the 3' untranslated region of mRNA encoded by ZNF384, corresponding to a HOST TARGET binding site such as BINDING SITE I, BINDING SITE II or BINDING SITE III. Table 2 illustrates the complementarity of the nucleotide sequences of ZNF384 BINDING SITE, designated SEQ ID:28542, to the nucleotide sequence of VGAM1389 RNA, herein designated VGAM RNA, also designated SEQ ID:4100.

Another function of VGAM1389 is therefore inhibition of Zinc Finger Protein 384 (ZNF384, Accession NM_133476). Accordingly, utilities of VGAM1389 include diagnosis, prevention and treatment of diseases and clinical conditions associated with ZNF384. LOC166042 (Accession XM_093623) is another VGAM1389 host target gene. LOC166042 BINDING SITE is HOST TARGET binding site found in the 5' untranslated region of mRNA encoded by LOC166042, corresponding to a HOST TARGET binding site such as BINDING SITE I, BINDING SITE II or BINDING SITE III. Table 2 illustrates the complementarity of the nucleotide sequences of LOC166042 BINDING SITE, designated SEQ ID:40199, to the nucleotide sequence of VGAM1389 RNA, herein designated VGAM RNA, also designated SEQ ID:4100.

Another function of VGAM1389 is therefore inhibition of LOC166042 (Accession XM_093623). Accordingly, utilities of VGAM1389 include diagnosis, prevention and treatment of diseases and clinical conditions associated with LOC166042. LOC222662 (Accession XM_167086) is another VGAM1389 host target gene. LOC222662 BINDING SITE is HOST TARGET binding site found in the 3' untranslated region of mRNA encoded by LOC222662, corresponding to a HOST TARGET binding site such as BINDING SITE I, BINDING SITE II or BINDING SITE III. Table 2 illustrates the complementarity of the nucleotide sequences of LOC222662 BINDING SITE, designated SEQ ID:44601, to the nucleotide sequence of VGAM1389 RNA, herein designated VGAM RNA, also designated SEQ ID:4100.

Another function of VGAM1389 is therefore inhibition of LOC222662 (Accession XM_167086). Accordingly, utilities of VGAM1389 include diagnosis, prevention and treatment of diseases and clinical conditions associated with LOC222662. FIG. 1 further provides a conceptual description of a novel bioinformatically detected viral gene of the present invention, referred to here as Viral Genomic Address Messenger 1390 (VGAM1390) viral gene, which modulates expression of respective host target genes thereof, the function and utility of which host target genes is known in the art.

VGAM1390 is a novel bioinformatically detected regulatory, non protein coding, viral micro RNA (miRNA) gene. The method by which VGAM1390 was detected is described hereinabove with reference to FIGS. 1-8.

VGAM1390 gene, herein designated VGAM GENE, is a viral gene contained in the genome of Cercopithecine Herpesvirus 7. VGAM1390 host target gene, herein designated VGAM HOST TARGET GENE, is a human gene contained in the human genome.

VGAM1390 gene encodes a VGAM1390 precursor RNA, herein designated VGAM PRECURSOR RNA. Similar to other miRNA genes, and unlike most ordinary genes, VGAM1390 precursor RNA does not encode a protein. A nucleotide sequence identical or highly similar to the nucleotide sequence of VGAM1390 precursor RNA is designated SEQ ID:1376, and is provided hereinbelow with reference to the sequence listing part. Nucleotide sequence SEQ ID:1376 is located at position 57196 relative to the genome of Cercopithecine Herpesvirus 7.

VGAM1390 precursor RNA folds onto itself, forming VGAM1390 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1390 folded precursor RNA into VGAM1390 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1390 RNA is designated SEQ ID:4101, and is provided hereinbelow with reference to the sequence listing part.

VGAM1390 host target gene, herein designated VGAM HOST TARGET GENE, encodes a corresponding messenger RNA, VGAM1390 host target RNA, herein designated VGAM HOST TARGET RNA. VGAM1390 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1390 RNA, herein designated VGAM RNA, binds complementarily to one or more host target binding sites located in untranslated regions of VGAM1390 host target RNA, herein designated VGAM HOST TARGET RNA. This complementary binding is due to the fact that the nucleotide sequence of VGAM1390 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1390 RNA, herein designated VGAM RNA, may have a different number of host target binding sites in untranslated regions of a VGAM1390 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1390 RNA, herein designated VGAM RNA, to host target binding sites on VGAM1390 host target RNA, herein designated VGAM HOST TARGET RNA, such as BINDING SITE I, BINDING SITE II and BINDING SITE III, inhibits translation of VGAM1390 host target RNA into VGAM1390 host target protein, herein designated VGAM HOST TARGET PROTEIN. VGAM host target protein is therefore outlined by a broken line.

It is appreciated that VGAM1390 host target gene, herein designated VGAM HOST TARGET GENE, in fact represents a plurality of VGAM1390 host target genes. The mRNA of each one of this plurality of VGAM1390 host target genes comprises one or more host target binding sites, each having a nucleotide sequence which is at least partly complementary to VGAM1390 RNA, herein designated VGAM RNA, and which when bound by VGAM1390 RNA causes inhibition of translation of respective one or more VGAM1390 host target proteins.

It is further appreciated by one skilled in the art that the mode of translational inhibition illustrated by FIG. 1 with specific reference to translational inhibition exerted by VGAM1390 gene, herein designated VGAM GENE, on one or more VGAM1390 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1390 is inhibition of expression of host target genes, as part of a novel viral mechanism of attacking a host. Accordingly, utilities of VGAM1390 include diagnosis, prevention and treatment of viral infection by Cercopithecine Herpesvirus 7. Specific functions, and accordingly utilities, of VGAM1390 correlate with, and may be deduced from, the identity of the host target genes which VGAM1390 binds and inhibits, and the function of these host target genes, as elaborated hereinbelow.

Nucleotide sequences of the VGAM1390 precursor RNA, herein designated VGAM PRECURSOR RNA, and of the 'diced' VGAM1390 RNA, herein designated VGAM RNA, and a schematic representation of the secondary folding of VGAM1390 folded precursor RNA, herein designated VGAM FOLDED PRECURSOR RNA, of VGAM1390 are further described hereinbelow with reference to Table 1.

Nucleotide sequences of host target binding sites, such as BINDING SITE-I, BINDING SITE-II and BINDING SITE-III of FIG. 1, found on VGAM1390 host target RNA, and schematic representation of the complementarity of each of these host target binding sites to VGAM1390 RNA, herein designated VGAM RNA, are described hereinbelow with reference to Table 2.

As mentioned hereinabove with reference to FIG. 1, a function of VGAM1390 gene, herein designated VGAM is inhibition of expression of VGAM1390 target genes. It is appreciated that specific functions, and accordingly utilities, of VGAM1390 correlate with, and may be deduced from, the identity of the target genes which VGAM1390 binds and inhibits, and the function of these target genes, as elaborated hereinbelow.

Calumenin (CALU, Accession NM_001219) is a VGAM1390 host target gene. CALU BINDING SITE is HOST TARGET binding site found in the 3' untranslated region of mRNA encoded by CALU, corresponding to a HOST TARGET binding site such as BINDING SITE I, BINDING SITE II or BINDING SITE III. Table 2 illustrates the complementarity of the nucleotide sequences of CALU BINDING SITE, designated SEQ ID:6886, to the nucleotide sequence of VGAM1390 RNA, herein designated VGAM RNA, also designated SEQ ID:4101.

A function of VGAM1390 is therefore inhibition of Calumenin (CALU, Accession NM_001219), a gene which binds 7 calcium ions with a low affinity with unidtified function. Accordingly, utilities of VGAM1390 include diagnosis, prevention and treatment of diseases and clinical conditions associated with CALU. The function of CALU and its association with various diseases and clinical conditions, has been established by previous studies, as described hereinabove with reference to VGAM253. Eukaryotic Translation Initiation Factor 2-alpha Kinase 3 (EIF2AK3, Accession NM_004836) is another VGAM1390 host target gene. EIF2AK3 BINDING SITE is HOST TARGET binding site found in the 3' untranslated region of mRNA encoded by EIF2AK3, corresponding to a HOST TARGET binding site such as BINDING SITE I, BINDING SITE II or BINDING SITE III. Table 2 illustrates the complementarity of the nucleotide sequences of EIF2AK3 BINDING SITE, designated SEQ ID:11245, to the nucleotide sequence of VGAM1390 RNA, herein designated VGAM RNA, also designated SEQ ID:4101.

Another function of VGAM1390 is therefore inhibition of Eukaryotic Translation Initiation Factor 2-alpha Kinase 3 (EIF2AK3, Accession NM_004836). Accordingly, utilities of VGAM1390 include diagnosis, prevention and treatment of diseases and clinical conditions associated with EIF2AK3. Peroxisomal Biogenesis Factor 3 (PEX3, Accession NM_003630) is another VGAM1390 host target gene. PEX3 BINDING SITE is HOST TARGET binding site found in the 3' untranslated region of mRNA encoded by PEX3, corresponding to a HOST TARGET binding site such as BINDING SITE I, BINDING SITE II or BINDING SITE III. Table 2 illustrates the complementarity of the nucleotide sequences of PEX3 BINDING SITE, designated SEQ ID:9691, to the nucleotide sequence of VGAM1390 RNA, herein designated VGAM RNA, also designated SEQ ID:4101.

Another function of VGAM1390 is therefore inhibition of Peroxisomal Biogenesis Factor 3 (PEX3, Accession NM_003630). Accordingly, utilities of VGAM1390 include diagnosis, prevention and treatment of diseases and clinical conditions associated with PEX3. Single-minded Homolog 1 (Drosophila) (SIM1, Accession NM_005068) is another VGAM1390 host target gene. SIM1 BINDING SITE is HOST TARGET binding site found in the 3' untranslated region of mRNA encoded by SIM1, corresponding to a HOST TARGET binding site such as BINDING SITE I, BINDING SITE II or BINDING SITE III. Table 2 illustrates the complementarity of the nucleotide sequences of SIM1 BINDING SITE, designated SEQ ID:11509, to the nucleotide sequence of VGAM1390 RNA, herein designated VGAM RNA, also designated SEQ ID:4101.

Another function of VGAM1390 is therefore inhibition of Single-minded Homolog 1 (Drosophila) (SIM1, Accession NM_005068), a gene which may have pleiotropic effects during embryogenesis and in the adult. Accordingly, utilities of VGAM1390 include diagnosis, prevention and treatment of diseases and clinical conditions associated with SIM1. The function of SIM1 and its association with various diseases and clinical conditions, has been established by previous studies, as described hereinabove with reference to VGAM665. FIG. 1 further provides a conceptual description of a novel bioinformatically detected viral gene of the present invention, referred to here as Viral Genomic Address Messenger 1391 (VGAM1391) viral gene, which modulates expression of respective host target genes thereof, the function and utility of which host target genes is known in the art.

VGAM1391 is a novel bioinformatically detected regulatory, non protein coding, viral micro RNA (miRNA) gene. The method by which VGAM1391 was detected is described hereinabove with reference to FIGS. 1-8.

VGAM1391 gene, herein designated VGAM GENE, is a viral gene contained in the genome of Wheat Streak Mosaic Virus. VGAM1391 host target gene, herein designated VGAM HOST TARGET GENE, is a human gene contained in the human genome.

VGAM1391 gene encodes a VGAM1391 precursor RNA, herein designated VGAM PRECURSOR RNA. Similar to other miRNA genes, and unlike most ordinary genes, VGAM1391 precursor RNA does not encode a protein. A nucleotide sequence identical or highly similar to the nucleotide sequence of VGAM1391 precursor RNA is designated SEQ ID:1377, and is provided hereinbelow with reference to the sequence listing part. Nucleotide sequence SEQ ID:1377 is located at position 6460 relative to the genome of Wheat Streak Mosaic Virus.

VGAM1391 precursor RNA folds onto itself, forming VGAM1391 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1391 folded precursor RNA into VGAM1391 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 49%) nucleotide sequence of VGAM1391 RNA is designated SEQ ID:4102, and is provided hereinbelow with reference to the sequence listing part.

VGAM1391 host target gene, herein designated VGAM HOST TARGET GENE, encodes a corresponding messenger RNA, VGAM1391 host target RNA, herein designated VGAM HOST TARGET RNA. VGAM1391 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1391 RNA, herein designated VGAM RNA, binds complementarily to one or more host target binding sites located in untranslated regions of VGAM1391 host target RNA, herein designated VGAM HOST TARGET RNA. This complementary binding is due to the fact that the nucleotide sequence of VGAM1391 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1391 RNA, herein designated VGAM RNA, may have a different number of host target binding sites in untranslated regions of a VGAM1391 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1391 RNA, herein designated VGAM RNA, to host target binding sites on VGAM1391 host target RNA, herein designated VGAM HOST TARGET RNA, such as BINDING SITE I, BINDING SITE II and BINDING SITE III, inhibits translation of VGAM1391 host target RNA into VGAM1391 host target protein, herein designated VGAM HOST TARGET PROTEIN. VGAM host target protein is therefore outlined by a broken line.

It is appreciated that VGAM1391 host target gene, herein designated VGAM HOST TARGET GENE, in fact represents a plurality of VGAM1391 host target genes. The mRNA of each one of this plurality of VGAM1391 host target genes comprises one or more host target binding sites, each having a nucleotide sequence which is at least partly complementary to VGAM1391 RNA, herein designated VGAM RNA, and which when bound by VGAM1391 RNA causes inhibition of translation of respective one or more VGAM1391 host target proteins.

It is further appreciated by one skilled in the art that the mode of translational inhibition illustrated by FIG. 1 with specific reference to translational inhibition exerted by VGAM1391 gene, herein designated VGAM GENE, on one or more VGAM1391 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1391 is inhibition of expression of host target genes, as part of a novel viral mechanism of attacking a host. Accordingly, utilities of VGAM1391 include diagnosis, prevention and treatment of viral infection by Wheat Streak Mosaic Virus. Specific functions, and accordingly utilities, of VGAM1391 correlate with, and may be deduced from, the identity of the host target genes which VGAM1391 binds and inhibits, and the function of these host target genes, as elaborated hereinbelow.

Nucleotide sequences of the VGAM1391 precursor RNA, herein designated VGAM PRECURSOR RNA, and of the 'diced' VGAM1391 RNA, herein designated VGAM RNA, and a schematic representation of the secondary folding of VGAM1391 folded precursor RNA, herein designated VGAM FOLDED PRECURSOR RNA, of VGAM1391 are further described hereinbelow with reference to Table 1.

Nucleotide sequences of host target binding sites, such as BINDING SITE-I, BINDING SITE-II and BINDING SITE-III of FIG. 1, found on VGAM1391 host target RNA, and schematic representation of the complementarity of each of these host target binding sites to VGAM1391 RNA, herein designated VGAM RNA, are described hereinbelow with reference to Table 2.

As mentioned hereinabove with reference to FIG. 1, a function of VGAM1391 gene, herein designated VGAM is inhibition of expression of VGAM1391 target genes. It is appreciated that specific functions, and accordingly utilities, of VGAM1391 correlate with, and may be deduced from, the identity of the target genes which VGAM1391 binds and inhibits, and the function of these target genes, as elaborated hereinbelow.

ATP-binding Cassette, Sub-family D (ALD), Member 2 (ABCD2, Accession NM_005164) is a VGAM1391 host target gene. ABCD2 BINDING SITE is HOST TARGET binding site found in the 5' untranslated region of mRNA encoded by ABCD2, corresponding to a HOST TARGET binding site such as BINDING SITE I, BINDING SITE II or BINDING SITE III. Table 2 illustrates the complementarity of the nucleotide sequences of ABCD2 BINDING SITE, designated SEQ ID:11659, to the nucleotide sequence of VGAM1391 RNA, herein designated VGAM RNA, also designated SEQ ID:4102.

A function of VGAM1391 is therefore inhibition of ATP-binding Cassette, Sub-family D (ALD), Member 2 (ABCD2, Accession NM_005164), a gene which probable transporter. Accordingly, utilities of VGAM1391 include diagnosis, prevention and treatment of diseases and clinical conditions associated with ABCD2. The function of ABCD2 and its association with various diseases and clinical conditions, has been established by previous studies, as described hereinabove with reference to VGAM229. RAD51-like 1 (S. cerevisiae) (RAD51L1, Accession NM_133509) is another VGAM1391 host target gene. RAD51L1 BINDING SITE1 and RAD51L1 BINDING SITE2 are HOST TARGET binding sites found in untranslated regions of mRNA encoded by RAD51L1, corresponding to HOST TARGET binding sites such as BINDING SITE I, BINDING SITE II or BINDING SITE III. Table 2 illustrates the complementarity of the nucleotide sequences of RAD51L1 BINDING SITE1 and RAD51L1 BINDING SITE2, designated SEQ ID:28576 and SEQ ID:8787 respectively, to the nucleotide sequence of VGAM1391 RNA, herein designated VGAM RNA, also designated SEQ ID:4102.

Another function of VGAM1391 is therefore inhibition of RAD51-like 1 (S. cerevisiae) (RAD51L1, Accession NM_133509), a gene which is a member of the RAD51 family of strand-transfer proteins. Accordingly, utilities of VGAM1391 include diagnosis, prevention and treatment of diseases and clinical conditions associated with RAD51L1. The function of RAD51L1 and its association with various diseases and clinical conditions, has been established by previous studies, as described hereinabove with reference to VGAM1020. DKFZP434C212 (Accession XM_044196) is another VGAM1391 host target gene. DKFZP434C212 BINDING SITE is HOST TARGET binding site found in the 3' untranslated region of mRNA encoded by DKFZP434C212, corresponding to a HOST TARGET binding site such as BINDING SITE I, BINDING SITE II or BINDING SITE III. Table 2 illustrates the complementarity of the nucleotide sequences of DKFZP434C212 BINDING SITE, designated SEQ ID:34170, to the nucleotide sequence of VGAM1391 RNA, herein designated VGAM RNA, also designated SEQ ID:4102.

Another function of VGAM1391 is therefore inhibition of DKFZP434C212 (Accession XM_044196). Accordingly, utilities of VGAM1391 include diagnosis, prevention and treatment of diseases and clinical conditions associated with DKFZP434C212. DKFZP566J091 (Accession NM_030915) is another VGAM1391 host target gene. DKFZP566J091 BINDING SITE is HOST TARGET binding site found in the 3' untranslated region of mRNA encoded by DKFZP566J091, corresponding to a HOST TARGET binding site such as BINDING SITE I, BINDING SITE II or BINDING SITE III. Table 2 illustrates the complementarity of the nucleotide sequences of DKFZP566J091 BINDING SITE, designated SEQ ID:25184, to the nucleotide sequence of VGAM1391 RNA, herein designated VGAM RNA, also designated SEQ ID:4102.

Another function of VGAM1391 is therefore inhibition of DKFZP566J091 (Accession NM_030915). Accordingly, utilities of VGAM1391 include diagnosis, prevention and treatment of diseases and clinical conditions associated with DKFZP566J091. FLJ22419 (Accession NM_024697) is another VGAM1391 host target gene. FLJ22419 BINDING SITE is HOST TARGET binding site found in the 5' untranslated region of mRNA encoded by FLJ22419, corresponding to a HOST TARGET binding site such as BINDING SITE I, BINDING SITE II or BINDING SITE III. Table 2 illustrates the complementarity of the nucleotide sequences of FLJ22419 BINDING SITE, designated SEQ ID:24006, to the nucleotide sequence of VGAM1391 RNA, herein designated VGAM RNA, also designated SEQ ID:4102.

Another function of VGAM1391 is therefore inhibition of FLJ22419 (Accession NM_024697). Accordingly, utilities of VGAM1391 include diagnosis, prevention and treatment of diseases and clinical conditions associated with FLJ22419. HSPC055 (Accession NM_014153) is another VGAM1391 host target gene. HSPC055 BINDING SITE is HOST TARGET binding site found in the 5' untranslated region of mRNA encoded by HSPC055, corresponding to a HOST TARGET binding site such as BINDING SITE I, BINDING SITE II or BINDING SITE III. Table 2 illustrates the complementarity of the nucleotide sequences of HSPC055 BINDING SITE, designated SEQ ID:15436, to the nucleotide sequence of VGAM1391 RNA, herein designated VGAM RNA, also designated SEQ ID:4102.

Another function of VGAM1391 is therefore inhibition of HSPC055 (Accession NM_014153). Accordingly, utilities of VGAM1391 include diagnosis, prevention and treatment of diseases and clinical conditions associated with HSPC055. IL-17RE (Accession NM_144640) is another VGAM1391 host target gene. IL-17RE BINDING SITE is HOST TARGET binding site found in the 3' untranslated region of mRNA encoded by IL-17RE, corresponding to a HOST TARGET binding site such as BINDING SITE I, BINDING SITE II or BINDING SITE III. Table 2 illustrates the complementarity of the nucleotide sequences of IL-17RE BINDING SITE, designated SEQ ID:29464, to the nucleotide sequence of VGAM1391 RNA, herein designated VGAM RNA, also designated SEQ ID:4102.

Another function of VGAM1391 is therefore inhibition of IL-17RE (Accession NM_144640). Accordingly, utilities of VGAM1391 include diagnosis, prevention and treatment of diseases and clinical conditions associated with IL-17RE. KIAA0057 (Accession NM_012288) is another VGAM1391 host target gene. KIAA0057 BINDING SITE is HOST TARGET binding site found in the 3' untranslated region of mRNA encoded by KIAA0057, corresponding to a HOST TARGET binding site such as BINDING SITE I, BINDING SITE II or BINDING SITE III. Table 2 illustrates the complementarity of the nucleotide sequences of KIAA0057 BINDING SITE, designated SEQ ID:14619, to the nucleotide sequence of VGAM1391 RNA, herein designated VGAM RNA, also designated SEQ ID:4102.

Another function of VGAM1391 is therefore inhibition of KIAA0057 (Accession NM_012288). Accordingly, utilities of VGAM1391 include diagnosis, prevention and treatment of diseases and clinical conditions associated with KIAA0057. KIAA0447 (Accession XM_049733) is another VGAM1391 host target gene. KIAA0447 BINDING SITE is HOST TARGET binding site found in the 3' untranslated region of mRNA encoded by KIAA0447, corresponding to a HOST TARGET binding site such as BINDING SITE I, BINDING SITE II or BINDING SITE III. Table 2 illustrates the complementarity of the nucleotide sequences of KIAA0447 BINDING SITE, designated SEQ ID:35493, to the nucleotide sequence of VGAM1391 RNA, herein designated VGAM RNA, also designated SEQ ID:4102.

Another function of VGAM1391 is therefore inhibition of KIAA0447 (Accession XM_049733). Accordingly, utilities of VGAM1391 include diagnosis, prevention and treatment of diseases and clinical conditions associated with KIAA0447. KIAA1855 (Accession XM_166453) is another VGAM1391 host target gene. KIAA1855 BINDING SITE is HOST TARGET binding site found in the 3' untranslated region of mRNA encoded by KIAA1855, corresponding to a HOST TARGET binding site such as BINDING SITE I, BINDING SITE II or BINDING SITE III. Table 2 illustrates the complementarity of the nucleotide sequences of KIAA1855 BINDING SITE, designated SEQ ID:44350, to the nucleotide sequence of VGAM1391 RNA, herein designated VGAM RNA, also designated SEQ ID:4102.

Another function of VGAM1391 is therefore inhibition of KIAA1855 (Accession XM_166453). Accordingly, utilities of VGAM1391 include diagnosis, prevention and treatment of diseases and clinical conditions associated with KIAA1855. KIAA1871 (Accession XM_028409) is another VGAM1391 host target gene. KIAA1871 BINDING SITE is HOST TARGET binding site found in the 3' untranslated region of mRNA encoded by KIAA1871, corresponding to a HOST TARGET binding site such as BINDING SITE I, BINDING SITE II or BINDING SITE III. Table 2 illustrates the complementarity of the nucleotide sequences of KIAA1871 BINDING SITE, designated SEQ ID:30703, to the nucleotide sequence of VGAM1391 RNA, herein designated VGAM RNA, also designated SEQ ID:4102.

Another function of VGAM1391 is therefore inhibition of KIAA1871 (Accession XM_028409). Accordingly, utilities of VGAM1391 include diagnosis, prevention and treatment of diseases and clinical conditions associated with KIAA1871. MGC32104 (Accession NM_144684) is another VGAM1391 host target gene. MGC32104 BINDING SITE is HOST TARGET binding site found in the 3' untranslated region of mRNA encoded by MGC32104, corresponding to a HOST TARGET binding site such as BINDING SITE I, BINDING SITE II or BINDING SITE III. Table 2 illustrates the complementarity of the nucleotide sequences of MGC32104 BINDING SITE, designated SEQ ID:29503, to the nucleotide sequence of VGAM1391 RNA, herein designated VGAM RNA, also designated SEQ ID:4102.

Another function of VGAM1391 is therefore inhibition of MGC32104 (Accession NM_144684). Accordingly, utilities of VGAM1391 include diagnosis, prevention and treatment of diseases and clinical conditions associated with MGC32104. RPH3A (Accession NM_014954) is another VGAM1391 host target gene. RPH3A BINDING SITE is HOST TARGET binding site found in the 3' untranslated region of mRNA encoded by RPH3A, corresponding to a HOST TARGET binding site such as BINDING SITE I, BINDING SITE II or BINDING SITE III. Table 2 illustrates the complementarity of the nucleotide sequences of RPH3A BINDING SITE, designated SEQ ID:17308, to the nucleotide sequence of VGAM1391 RNA, herein designated VGAM RNA, also designated SEQ ID:4102.

Another function of VGAM1391 is therefore inhibition of RPH3A (Accession NM_014954). Accordingly, utilities of VGAM1391 include diagnosis, prevention and treatment of diseases and clinical conditions associated with RPH3A. LOC121838 (Accession XM_071772) is another VGAM1391 host target gene. LOC121838 BINDING SITE is HOST TARGET binding site found in the 5' untranslated region of mRNA encoded by LOC121838, corresponding to a HOST TARGET binding site such as BINDING SITE I, BINDING SITE II or BINDING SITE III. Table 2 illustrates the complementarity of the nucleotide sequences of LOC121838 BINDING SITE, designated SEQ ID:37416, to the nucleotide sequence of VGAM1391 RNA, herein designated VGAM RNA, also designated SEQ ID:4102.

Another function of VGAM1391 is therefore inhibition of LOC121838 (Accession XM_071772). Accordingly, utilities of VGAM1391 include diagnosis, prevention and treatment of diseases and clinical conditions associated with LOC121838. LOC145980 (Accession XM_096914) is another VGAM1391 host target gene. LOC145980 BINDING SITE is HOST TARGET binding site found in the 3' untranslated region of mRNA encoded by LOC145980, corresponding to a HOST TARGET binding site such as BINDING SITE I, BINDING SITE II or BINDING SITE III. Table 2 illustrates the complementarity of the nucleotide sequences of LOC145980 BINDING SITE, designated SEQ ID:40648, to the nucleotide sequence of VGAM1391 RNA, herein designated VGAM RNA, also designated SEQ ID:4102.

Another function of VGAM1391 is therefore inhibition of LOC145980 (Accession XM_096914). Accordingly, utilities of VGAM1391 include diagnosis, prevention and treatment of diseases and clinical conditions associated with LOC145980. LOC149703 (Accession XM_097719) is another VGAM1391 host target gene. LOC149703 BINDING SITE is HOST TARGET binding site found in the 3' untranslated region of mRNA encoded by LOC149703, corresponding to a HOST TARGET binding site such as BINDING SITE I, BINDING SITE II or BINDING SITE III. Table 2 illustrates the complementarity of the nucleotide sequences of LOC149703 BINDING SITE, designated SEQ ID:41062, to the nucleotide sequence of VGAM1391 RNA, herein designated VGAM RNA, also designated SEQ ID:4102.

Another function of VGAM1391 is therefore inhibition of LOC149703 (Accession XM_097719). Accordingly, utilities of VGAM1391 include diagnosis, prevention and treatment of diseases and clinical conditions associated with LOC149703. LOC170395 (Accession XM_084325) is another VGAM1391 host target gene. LOC170395 BINDING SITE is HOST TARGET binding site found in the 3' untranslated region of mRNA encoded by LOC170395, corresponding to a HOST TARGET binding site such as BINDING SITE I, BINDING SITE II or BINDING SITE III. Table 2 illustrates the complementarity of the nucleotide sequences of LOC170395 BINDING SITE, designated SEQ ID:37545, to the nucleotide sequence of VGAM1391 RNA, herein designated VGAM RNA, also designated SEQ ID:4102.

Another function of VGAM1391 is therefore inhibition of LOC170395 (Accession XM_084325). Accordingly, utilities of VGAM1391 include diagnosis, prevention and treatment of diseases and clinical conditions associated with LOC170395. FIG. 1 further provides a conceptual description of a novel bioinformatically detected viral gene of the present invention, referred to here as Viral Genomic Address Messenger 1392 (VGAM1392) viral gene, which modulates expression of respective host target genes thereof, the function and utility of which host target genes is known in the art.

VGAM1392 is a novel bioinformatically detected regulatory, non protein coding, viral micro RNA (miRNA) gene. The method by which VGAM1392 was detected is described hereinabove with reference to FIGS. 1-8.

VGAM1392 gene, herein designated VGAM GENE, is a viral gene contained in the genome of Wheat Streak Mosaic Virus. VGAM1392 host target gene, herein designated VGAM HOST TARGET GENE, is a human gene contained in the human genome.

VGAM1392 gene encodes a VGAM1392 precursor RNA, herein designated VGAM PRECURSOR RNA. Similar to other miRNA genes, and unlike most ordinary genes, VGAM1392 precursor RNA does not encode a protein. A nucleotide sequence identical or highly similar to the nucleotide sequence of VGAM1392 precursor RNA is designated SEQ ID:1378, and is provided hereinbelow with reference to the sequence listing part. Nucleotide sequence SEQ ID:1378 is located at position 9058 relative to the genome of Wheat Streak Mosaic Virus.

VGAM1392 precursor RNA folds onto itself, forming VGAM1392 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1392 folded precursor RNA into VGAM1392 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM1392 RNA is designated SEQ ID:4103, and is provided hereinbelow with reference to the sequence listing part.

VGAM1392 host target gene, herein designated VGAM HOST TARGET GENE, encodes a corresponding messenger RNA, VGAM1392 host target RNA, herein designated VGAM HOST TARGET RNA. VGAM1392 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1392 RNA, herein designated VGAM RNA, binds complementarily to one or more host target binding sites located in untranslated regions of VGAM1392 host target RNA, herein designated VGAM HOST TARGET RNA. This complementary binding is due to the fact that the nucleotide sequence of VGAM1392 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1392 RNA, herein designated VGAM RNA, may have a different number of host target binding sites in untranslated regions of a VGAM1392 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1392 RNA, herein designated VGAM RNA, to host target binding sites on VGAM1392 host target RNA, herein designated VGAM HOST TARGET RNA, such as BINDING SITE I, BINDING SITE II and BINDING SITE III, inhibits translation of VGAM1392 host target RNA into VGAM1392 host target protein, herein designated VGAM HOST TARGET PROTEIN. VGAM host target protein is therefore outlined by a broken line.

It is appreciated that VGAM1392 host target gene, herein designated VGAM HOST TARGET GENE, in fact represents a plurality of VGAM1392 host target genes. The mRNA of each one of this plurality of VGAM1392 host target genes comprises one or more host target binding sites, each having a nucleotide sequence which is at least partly complementary to VGAM1392 RNA, herein designated VGAM RNA, and which when bound by VGAM1392 RNA causes inhibition of translation of respective one or more VGAM1392 host target proteins.

It is further appreciated by one skilled in the art that the mode of translational inhibition illustrated by FIG. 1 with specific reference to translational inhibition exerted by VGAM1392 gene, herein designated VGAM GENE, on one or more VGAM1392 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1392 is inhibition of expression of host target genes, as part of a novel viral mechanism of attacking a host. Accordingly, utilities of VGAM1392 include diagnosis, prevention and treatment of viral infection by Wheat Streak Mosaic Virus. Specific functions, and accordingly utilities, of VGAM1392 correlate with, and may be deduced from, the identity of the host target genes which VGAM1392 binds and inhibits, and the function of these host target genes, as elaborated hereinbelow.

Nucleotide sequences of the VGAM1392 precursor RNA, herein designated VGAM PRECURSOR RNA, and of the 'diced' VGAM1392 RNA, herein designated VGAM RNA, and a schematic representation of the secondary folding of VGAM1392 folded precursor RNA, herein designated VGAM FOLDED PRECURSOR RNA, of VGAM1392 are further described hereinbelow with reference to Table 1.

Nucleotide sequences of host target binding sites, such as BINDING SITE-I, BINDING SITE-II and BINDING SITE-III of FIG. 1, found on VGAM1392 host target RNA, and schematic representation of the complementarity of each of these host target binding sites to VGAM1392 RNA, herein designated VGAM RNA, are described hereinbelow with reference to Table 2.

As mentioned hereinabove with reference to FIG. 1, a function of VGAM1392 gene, herein designated VGAM is inhibition of expression of VGAM1392 target genes. It is appreciated that specific functions, and accordingly utilities, of VGAM1392 correlate with, and may be deduced from, the identity of the target genes which VGAM1392 binds and inhibits, and the function of these target genes, as elaborated hereinbelow.

A Kinase (PRKA) Anchor Protein 1 (AKAP1, Accession NM_139275) is a VGAM1392 host target gene. AKAP1 BINDING SITE is HOST TARGET binding site found in the 3' untranslated region of mRNA encoded by AKAP1, corresponding to a HOST TARGET binding site such as BINDING SITE I, BINDING SITE II or BINDING SITE III. Table 2 illustrates the complementarity of the nucleotide sequences of AKAP1 BINDING SITE, designated SEQ ID:29266, to the nucleotide sequence of VGAM1392 RNA, herein designated VGAM RNA, also designated SEQ ID:4103.

A function of VGAM1392 is therefore inhibition of A Kinase (PRKA) Anchor Protein 1 (AKAP1, Accession NM_139275), a gene which binds to type i and ii regulatory subunits of protein kinase a. Accordingly, utilities of VGAM1392 include diagnosis, prevention and treatment of diseases and clinical conditions associated with AKAP1. The function of AKAP1 has been established by previous studies. In eukaryotic cells, cytosolic cAMP activates several isoforms of cAMP-dependent protein kinases (PKAs) involved in signal transduction. PKAs are composed of 2 regulatory and 2 catalytic subunits (see OMIM Ref. No. 176911). There are 2 classes of regulatory subunits: type I, which is found primarily in cytoplasmic PKAs, and type II, a significant proportion of which is found in PKAs associated with the particulate fraction of cell homogenates. The effects of individual PKA isoforms are determined by their cellular localization, specified through binding to distinct AKAPs, named for 'A-kinase anchor protein.' Anchoring proteins target the kinase by tethering a regulatory subunit. Trendelenburg et al. (1996) cloned AKAP149 using an antiserum to screen a human colon cDNA expression library. The cDNA sequence of AKAP149 predicted a polypeptide of 903 amino acids with a predicted mass of 97 kD. The authors noted that a portion of the cDNA sequence of AKAP149 is identical to S-AKAP84, previously described by Lin et al. (1995). The first 517 amino acids of the sequence of AKAP149 is identical to those of the S-AKAP84 sequence (except at amino acid positions 97 and 98), including a signal sequence. AKAP149 also has a protein/serine/threonine-rich region at amino acids 489-540, and a K-homologous (KH) motif at amino acids 612-659. Trendelenburg et al. (1996) suggested that AKAP149 and S-AKAP84 are splice variants of the same gene. The KH motif is an RNA-binding domain typically associated with proteins involved in RNA catalysis, mRNA processing, or translation. By Southern blotting, Trendelenburg et al. (1996) showed that AKAP149 is a single-copy gene in the human genome. By Northern blot analysis, they showed that AKAP149 was expressed as a 4.2-kb transcript in all epithelial tissues examined, with the strongest signal being detected in prostate and small intestine RNAs. In addition, a 3.2-kb transcript was expressed exclusively in testis. Lin et al. (1995) found a similar pattern of expression for S-AKAP84, but also detected a minor 7.5-kb transcript in kidney, pancreas, liver, lung, and brain. By Western blotting, Trendelenburg et al. (1996) detected expression of the AKAP149 protein in colon carcinoma LS174T cells. Trendelenburg et al. (1996) speculated that AKAP149 is involved in the cAMP-dependent signal transduction pathway and in directing RNA to a specific cellular compartment. Huang et al. (1997) cloned cDNAs encoding a possible mouse homolog of S-AKAP84. Since the protein bound both PKA type I and type II regulatory subunits, they designated the gene D-Akap1 for 'dual specificity Akap1.' Previously identified AKAPs had interacted specifically with type II subunits. Northern blot analysis detected D-Akap1 expression in all tissues examined except the spleen. Huang et al. (1997) isolated cDNAs representing at least 4 splice variants. By Western blot analysis, they showed that the different protein isoforms may be expressed in a tissue-specific manner. The mitochondria target/signal region found in both S-Akap84 and D-Akap1 suggested to Huang et al. (1997) that some of the protein isoforms may be targeted to the mitochondria.

Full details of the abovementioned studies are described in the following publications, the disclosure of which are hereby incorporated by reference:

Trendelenburg, G.; Hummel, M.; Riecken, E.-O.; Hanski, C.: Molecular characterization of AKAP149, a novel A kinase anchor protein with a KH domain. Biochem. Biophys. Res. Commun. 225:313-319, 1996; and Huang, L. J.; Durick, K.; Weiner, J. A.; Chun, J.; Taylor, S. S.: Identification of a novel protein kinase A anchoring protein that binds both type I and type II regulatory subunits. J.

Further studies establishing the function and utilities of AKAP1 are found in John Hopkins OMIM database record ID 602449, and in sited publications numbered 6316-6318 listed in the bibliography section hereinbelow, which are also hereby incorporated by reference. Hepatic Leukemia Factor (HLF, Accession NM_002126) is another VGAM1392 host target gene. HLF BINDING SITE is HOST TARGET binding site found in the 3' untranslated region of mRNA encoded by HLF, corresponding to a HOST TARGET binding site such as BINDING SITE I, BINDING SITE II or BINDING SITE III. Table 2 illustrates the complementarity of the nucleotide sequences of HLF BINDING SITE, designated SEQ ID:7904, to the nucleotide sequence of VGAM1392 RNA, herein designated VGAM RNA, also designated SEQ ID:4103.

Another function of VGAM1392 is therefore inhibition of Hepatic Leukemia Factor (HLF, Accession NM_002126). Accordingly, utilities of VGAM1392 include diagnosis, prevention and treatment of diseases and clinical conditions associated with HLF. Neogenin Homolog 1 (chicken) (NEO1, Accession NM_002499) is another VGAM1392 host target gene. NEO1 BINDING SITE is HOST TARGET binding site found in the 3' untranslated region of mRNA encoded by NEO1, corresponding to a HOST TARGET binding site such as BINDING SITE I, BINDING SITE II or BINDING SITE III. Table 2 illustrates the complementarity of the nucleotide sequences of NEO1 BINDING SITE, designated SEQ ID:8317, to the nucleotide sequence of VGAM1392 RNA, herein designated VGAM RNA, also designated SEQ ID:4103.

Another function of VGAM1392 is therefore inhibition of Neogenin Homolog 1 (chicken) (NEO1, Accession NM_002499), a gene which regulates the transition of undifferentiated proliferating cells to their differentiated state. Accordingly, utilities of VGAM1392 include diagnosis, prevention and treatment of diseases and clinical conditions associated with NEO1. The function of NEO1 and its association with various diseases and clinical conditions, has been established by previous studies, as described hereinabove with reference to VGAM329. Phosphomannomutase 2 (PMM2, Accession XM_050755) is another VGAM1392 host target gene. PMM2 BINDING SITE is HOST TARGET binding site found in the 3' untranslated region of mRNA encoded by PMM2, corresponding to a HOST TARGET binding site such as BINDING SITE I, BINDING SITE II or BINDING SITE III. Table 2 illustrates the complementarity of the nucleotide sequences of PMM2 BINDING SITE, designated SEQ ID:35680, to the nucleotide sequence of VGAM1392 RNA, herein designated VGAM RNA, also designated SEQ ID:4103.

Another function of VGAM1392 is therefore inhibition of Phosphomannomutase 2 (PMM2, Accession XM_050755). Accordingly, utilities of VGAM1392 include diagnosis, prevention and treatment of diseases and clinical conditions associated with PMM2. Titin (TTN, Accession NM_133378) is another VGAM1392 host target gene. TTN BINDING SITE1 through TTN BINDING SITE3 are HOST TARGET binding sites found in untranslated regions of mRNA encoded by TTN, corresponding to HOST TARGET binding sites such as BINDING SITE I, BINDING SITE II or BINDING SITE III. Table 2 illustrates the complementarity of the nucleotide sequences of TTN BINDING SITE1 through TTN BINDING SITE3, designated SEQ ID:28502, SEQ ID:28507 and SEQ ID:28517 respectively, to the nucleotide sequence of VGAM1392 RNA, herein designated VGAM RNA, also designated SEQ ID:4103.

Another function of VGAM1392 is therefore inhibition of Titin (TTN, Accession NM_133378). Accordingly, utilities of VGAM1392 include diagnosis, prevention and treatment of diseases and clinical conditions associated with TTN. CDC14 Cell Division Cycle 14 Homolog B (S. cerevisiae) (CDC14B, Accession NM_003671) is another VGAM1392 host target gene. CDC14B BINDING SITE is HOST TARGET binding site found in the 3' untranslated region of mRNA encoded by CDC14B, corresponding to a HOST TARGET binding site such as BINDING SITE I, BINDING SITE II or BINDING SITE III. Table 2 illustrates the complementarity of the nucleotide sequences of CDC14B BINDING SITE, designated SEQ ID:9761, to the nucleotide sequence of VGAM1392 RNA, herein designated VGAM RNA, also designated SEQ ID:4103.

Another function of VGAM1392 is therefore inhibition of CDC14 Cell Division Cycle 14 Homolog B (S. cerevisiae) (CDC14B, Accession NM_003671). Accordingly, utilities of VGAM1392 include diagnosis, prevention and treatment of diseases and clinical conditions associated with CDC14B. FLJ13441 (Accession NM_023924) is another VGAM1392 host target gene. FLJ13441 BINDING SITE is HOST TARGET binding site found in the 3' untranslated region of mRNA encoded by FLJ13441, corresponding to a HOST TARGET binding site such as BINDING SITE I, BINDING SITE II or BINDING SITE III. Table 2 illustrates the complementarity of the nucleotide sequences of FLJ13441 BINDING SITE, designated SEQ ID:23392, to the nucleotide sequence of VGAM1392 RNA, herein designated VGAM RNA, also designated SEQ ID:4103.

Another function of VGAM1392 is therefore inhibition of FLJ13441 (Accession NM_023924). Accordingly, utilities of VGAM1392 include diagnosis, prevention and treatment of diseases and clinical conditions associated with FLJ13441. FLJ22529 (Accession NM_024789) is another VGAM1392 host target gene. FLJ22529 BINDING SITE is HOST TARGET binding site found in the 3' untranslated region of mRNA encoded by FLJ22529, corresponding to a HOST TARGET binding site such as BINDING SITE I, BINDING SITE II or BINDING SITE III. Table 2 illustrates the complementarity of the nucleotide sequences of FLJ22529 BINDING SITE, designated SEQ ID:24171, to the nucleotide sequence of VGAM1392 RNA, herein designated VGAM RNA, also designated SEQ ID:4103.

Another function of VGAM1392 is therefore inhibition of FLJ22529 (Accession NM_024789). Accordingly, utilities of VGAM1392 include diagnosis, prevention and treatment of diseases and clinical conditions associated with FLJ22529. KIAA0738 (Accession NM_014719) is another VGAM1392 host target gene. KIAA0738 BINDING SITE is HOST TARGET binding site found in the 3' untranslated region of mRNA encoded by KIAA0738, corresponding to a HOST TARGET binding site such as BINDING SITE I, BINDING SITE II or BINDING SITE III. Table 2 illustrates the complementarity of the nucleotide sequences of KIAA0738 BINDING SITE, designated SEQ ID:16279, to the nucleotide sequence of VGAM1392 RNA, herein designated VGAM RNA, also designated SEQ ID:4103.

Another function of VGAM1392 is therefore inhibition of KIAA0738 (Accession NM_014719). Accordingly, utilities of VGAM1392 include diagnosis, prevention and treatment of diseases and clinical conditions associated with KIAA0738. KIAA1764 (Accession XM_045086) is another VGAM1392 host target gene. KIAA1764 BINDING SITE is HOST TARGET binding site found in the 5' untranslated region of mRNA encoded by KIAA1764, corresponding to a HOST TARGET binding site such as BINDING SITE I, BINDING SITE II or BINDING SITE III. Table 2 illustrates the complementarity of the nucleotide sequences of KIAA1764 BINDING SITE, designated SEQ ID:34354, to the nucleotide sequence of VGAM1392 RNA, herein designated VGAM RNA, also designated SEQ ID:4103.

Another function of VGAM1392 is therefore inhibition of KIAA1764 (Accession XM_045086). Accordingly, utilities of VGAM1392 include diagnosis, prevention and treatment of diseases and clinical conditions associated with KIAA1764. LAGY (Accession NM_139211) is another VGAM1392 host target gene. LAGY BINDING SITE1 through LAGY BINDING SITE3 are HOST TARGET binding sites found in untranslated regions of mRNA encoded by LAGY, corresponding to HOST TARGET binding sites such as BINDING SITE I, BINDING SITE II or BINDING SITE III. Table 2 illustrates the complementarity of the nucleotide sequences of LAGY BINDING SITE1 through LAGY BINDING SITE3, designated SEQ ID:29231, SEQ ID:29233 and SEQ ID:26245 respectively, to the nucleotide sequence of VGAM1392 RNA, herein designated VGAM RNA, also designated SEQ ID:4103.

Another function of VGAM1392 is therefore inhibition of LAGY (Accession NM_139211). Accordingly, utilities of VGAM1392 include diagnosis, prevention and treatment of diseases and clinical conditions associated with LAGY. Mitochondrial Ribosomal Protein S11 (MRPS11, Accession XM_170552) is another VGAM1392 host target gene. MRPS11 BINDING SITE1 and MRPS11 BINDING SITE2 are HOST TARGET binding sites found in untranslated regions of mRNA encoded by MRPS11, corresponding to HOST TARGET binding sites such as BINDING SITE I, BINDING SITE II or BINDING SITE III. Table 2 illustrates the complementarity of the nucleotide sequences of MRPS11 BINDING SITE1 and MRPS11 BINDING SITE2, designated SEQ ID:45377 and SEQ ID:12493 respectively, to the nucleotide sequence of VGAM1392 RNA, herein designated VGAM RNA, also designated SEQ ID:4103.

Another function of VGAM1392 is therefore inhibition of Mitochondrial Ribosomal Protein S11 (MRPS11, Accession XM_170552). Accordingly, utilities of VGAM1392 include diagnosis, prevention and treatment of diseases and clinical conditions associated with MRPS11. LOC150622 (Accession XM_086960) is another VGAM1392 host target gene. LOC150622 BINDING SITE is HOST TARGET binding site found in the 5' untranslated region of mRNA encoded by LOC150622, corresponding to a HOST TARGET binding site such as BINDING SITE I, BINDING SITE II or BINDING SITE III. Table 2 illustrates the complementarity of the nucleotide sequences of LOC150622 BINDING SITE, designated SEQ ID:38996, to the nucleotide sequence of VGAM1392 RNA, herein designated VGAM RNA, also designated SEQ ID:4103.

Another function of VGAM1392 is therefore inhibition of LOC150622 (Accession XM_086960). Accordingly, utilities of VGAM1392 include diagnosis, prevention and treatment of diseases and clinical conditions associated with LOC150622. LOC196540 (Accession XM_116933) is another VGAM1392 host target gene. LOC196540 BINDING SITE is HOST TARGET binding site found in the 3' untranslated region of mRNA encoded by LOC196540, corresponding to a HOST TARGET binding site such as BINDING SITE I, BINDING SITE II or BINDING SITE III. Table 2 illustrates the complementarity of the nucleotide sequences of LOC196540 BINDING SITE, designated SEQ ID:43150, to the nucleotide sequence of VGAM1392 RNA, herein designated VGAM RNA, also designated SEQ ID:4103.

Another function of VGAM1392 is therefore inhibition of LOC196540 (Accession XM_116933). Accordingly, utilities of VGAM1392 include diagnosis, prevention and treatment of diseases and clinical conditions associated with LOC196540. LOC200047 (Accession XM_114099) is another VGAM1392 host target gene. LOC200047 BINDING SITE is HOST TARGET binding site found in the 5' untranslated region of mRNA encoded by LOC200047, corresponding to a HOST TARGET binding site such as BINDING SITE I, BINDING SITE II or BINDING SITE III. Table 2 illustrates the complementarity of the nucleotide sequences of LOC200047 BINDING SITE, designated SEQ ID:42698, to the nucleotide sequence of VGAM1392 RNA, herein designated VGAM RNA, also designated SEQ ID:4103.

Another function of VGAM1392 is therefore inhibition of LOC200047 (Accession XM_114099). Accordingly, utilities of VGAM1392 include diagnosis, prevention and treatment of diseases and clinical conditions associated with LOC200047. LOC92597 (Accession XM_046066) is another VGAM1392 host target gene. LOC92597 BINDING SITE is HOST TARGET binding site found in the 3' untranslated region of mRNA encoded by LOC92597, corresponding to a HOST TARGET binding site such as BINDING SITE I, BINDING SITE II or BINDING SITE III. Table 2 illustrates the complementarity of the nucleotide sequences of LOC92597 BINDING SITE, designated SEQ ID:34671, to the nucleotide sequence of VGAM1392 RNA, herein designated VGAM RNA, also designated SEQ ID:4103.

Another function of VGAM1392 is therefore inhibition of LOC92597 (Accession XM_046066). Accordingly, utilities of VGAM1392 include diagnosis, prevention and treatment of diseases and clinical conditions associated with LOC92597. FIG. 1 further provides a conceptual description of a novel bioinformatically detected viral gene of the present invention, referred to here as Viral Genomic Address Messenger 1393 (VGAM1393) viral gene, which modulates expression of respective host target genes thereof, the function and utility of which host target genes is known in the art.

VGAM1393 is a novel bioinformatically detected regulatory, non protein coding, viral micro RNA (miRNA) gene. The method by which VGAM1393 was detected is described hereinabove with reference to FIGS. 1-8.

VGAM1393 gene, herein designated VGAM GENE, is a viral gene contained in the genome of Wheat Streak Mosaic Virus. VGAM1393 host target gene, herein designated VGAM HOST TARGET GENE, is a human gene contained in the human genome.

VGAM1393 gene encodes a VGAM1393 precursor RNA, herein designated VGAM PRECURSOR RNA. Similar to other miRNA genes, and unlike most ordinary genes, VGAM1393 precursor RNA does not encode a protein. A nucleotide sequence identical or highly similar to the nucleotide sequence of VGAM1393 precursor RNA is designated SEQ ID:1379, and is provided hereinbelow with reference to the sequence listing part. Nucleotide sequence SEQ ID:1379 is located at position 3923 relative to the genome of Wheat Streak Mosaic Virus.

VGAM1393 precursor RNA folds onto itself, forming VGAM1393 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1393 folded precursor RNA into VGAM1393 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1393 RNA is designated SEQ ID:4104, and is provided hereinbelow with reference to the sequence listing part.

VGAM1393 host target gene, herein designated VGAM HOST TARGET GENE, encodes a corresponding messenger RNA, VGAM1393 host target RNA, herein designated VGAM HOST TARGET RNA. VGAM1393 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1393 RNA, herein designated VGAM RNA, binds complementarily to one or more host target binding sites located in untranslated regions of VGAM1393 host target RNA, herein designated VGAM HOST TARGET RNA. This complementary binding is due to the fact that the nucleotide sequence of VGAM1393 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1393 RNA, herein designated VGAM RNA, may have a different number of host target binding sites in untranslated regions of a VGAM1393 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1393 RNA, herein designated VGAM RNA, to host target binding sites on VGAM1393 host target RNA, herein designated VGAM HOST TARGET RNA, such as BINDING SITE I, BINDING SITE II and BINDING SITE III, inhibits translation of VGAM1393 host target RNA into VGAM1393 host target protein, herein designated VGAM HOST TARGET PROTEIN. VGAM host target protein is therefore outlined by a broken line.

It is appreciated that VGAM1393 host target gene, herein designated VGAM HOST TARGET GENE, in fact represents a plurality of VGAM1393 host target genes. The mRNA of each one of this plurality of VGAM1393 host target genes comprises one or more host target binding sites, each having a nucleotide sequence which is at least partly complementary to VGAM1393 RNA, herein designated VGAM RNA, and which when bound by VGAM1393 RNA causes inhibition of translation of respective one or more VGAM1393 host target proteins.

It is further appreciated by one skilled in the art that the mode of translational inhibition illustrated by FIG. 1 with specific reference to translational inhibition exerted by VGAM1393 gene, herein designated VGAM GENE, on one or more VGAM1393 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1393 is inhibition of expression of host target genes, as part of a novel viral mechanism of attacking a host. Accordingly, utilities of VGAM1393 include diagnosis, prevention and treatment of viral infection by Wheat Streak Mosaic Virus. Specific functions, and accordingly utilities, of VGAM1393 correlate with, and may be deduced from, the identity of the host target genes which VGAM1393 binds and inhibits, and the function of these host target genes, as elaborated hereinbelow.

Nucleotide sequences of the VGAM1393 precursor RNA, herein designated VGAM PRECURSOR RNA, and of the 'diced' VGAM1393 RNA, herein designated VGAM RNA, and a schematic representation of the secondary folding of VGAM1393 folded precursor RNA, herein designated VGAM FOLDED PRECURSOR RNA, of VGAM1393 are further described hereinbelow with reference to Table 1.

Nucleotide sequences of host target binding sites, such as BINDING SITE-I, BINDING SITE-II and BINDING SITE-III of FIG. 1, found on VGAM1393 host target RNA, and schematic representation of the complementarity of each of these host target binding sites to VGAM1393 RNA, herein designated VGAM RNA, are described hereinbelow with reference to Table 2.

As mentioned hereinabove with reference to FIG. 1, a function of VGAM1393 gene, herein designated VGAM is inhibition of expression of VGAM1393 target genes. It is appreciated that specific functions, and accordingly utilities, of VGAM1393 correlate with, and may be deduced from, the identity of the target genes which VGAM1393 binds and inhibits, and the function of these target genes, as elaborated hereinbelow.

Chloride Channel, Calcium Activated, Family Member 3 (CLCA3, Accession NM_004921) is a VGAM1393 host target gene. CLCA3 BINDING SITE is HOST TARGET binding site found in the 3' untranslated region of mRNA encoded by CLCA3, corresponding to a HOST TARGET binding site such as BINDING SITE I, BINDING SITE II or BINDING SITE III. Table 2 illustrates the complementarity of the nucleotide sequences of CLCA3 BINDING SITE, designated SEQ ID:11354, to the nucleotide sequence of VGAM1393 RNA, herein designated VGAM RNA, also designated SEQ ID:4104.

A function of VGAM1393 is therefore inhibition of Chloride Channel, Calcium Activated, Family Member 3 (CLCA3, Accession NM_004921), a gene which is similar to calcium-activated chloride channel family. Accordingly, utilities of VGAM1393 include diagnosis, prevention and treatment of diseases and clinical conditions associated with CLCA3. The function of CLCA3 and its association with various diseases and clinical conditions, has been established by previous studies, as described hereinabove with reference to VGAM595. Epilepsy, Progressive Myoclonus Type 2, Lafora Disease (laforin) (EPM2A, Accession NM_005670) is another VGAM1393 host target gene. EPM2A BINDING SITE is HOST TARGET binding site found in the 3' untranslated region of mRNA encoded by EPM2A, corresponding to a HOST TARGET binding site such as BINDING SITE I, BINDING SITE II or BINDING SITE III. Table 2 illustrates the complementarity of the nucleotide sequences of EPM2A BINDING SITE, designated SEQ ID:12224, to the nucleotide sequence of VGAM1393 RNA, herein designated VGAM RNA, also designated SEQ ID:4104.

Another function of VGAM1393 is therefore inhibition of Epilepsy, Progressive Myoclonus Type 2, Lafora Disease (laforin) (EPM2A, Accession NM_005670), a gene which Laforin; protein tyrosine phosphatase that may have role in glycogen metabolism. Accordingly, utilities of VGAM1393 include diagnosis, prevention and treatment of diseases and clinical conditions associated with EPM2A. The function of EPM2A and its association with various diseases and clinical conditions, has been established by previous studies, as described hereinabove with reference to VGAM470. Melanoma Antigen, Family A, 10 (MAGEA10, Accession NM_021048) is another VGAM1393 host target gene. MAGEA10 BINDING SITE is HOST TARGET binding site found in the 5' untranslated region of mRNA encoded by MAGEA10, corresponding to a HOST TARGET binding site such as BINDING SITE I, BINDING SITE II or BINDING SITE III. Table 2 illustrates the complementarity of the nucleotide sequences of MAGEA10 BINDING SITE, designated SEQ ID:22034, to the nucleotide sequence of VGAM1393 RNA, herein designated VGAM RNA, also designated SEQ ID:4104.

Another function of VGAM1393 is therefore inhibition of Melanoma Antigen, Family A, 10 (MAGEA10, Accession NM_021048), a gene which may play a role in embryonal development and tumor transformation or aspects of tumor progression. Accordingly, utilities of VGAM1393 include diagnosis, prevention and treatment of diseases and clinical conditions associated with MAGEA10. The function of MAGEA10 and its association with various diseases and clinical conditions, has been established by previous studies, as described hereinabove with reference to VGAM125. Methyl-CpG Binding Domain Protein 3 (MBD3, Accession NM_003926) is another VGAM1393 host target gene. MBD3 BINDING SITE is HOST TARGET binding site found in the 3' untranslated region of mRNA encoded by MBD3, corresponding to a HOST TARGET binding site such as BINDING SITE I, BINDING SITE II or BINDING SITE III. Table 2 illustrates the complementarity of the nucleotide sequences of MBD3 BINDING SITE, designated SEQ ID:10020, to the nucleotide sequence of VGAM1393 RNA, herein designated VGAM RNA, also designated SEQ ID:4104.

Another function of VGAM1393 is therefore inhibition of Methyl-CpG Binding Domain Protein 3 (MBD3, Accession NM_003926), a gene which are subunits of the NURD (nucleosome remodeling and histone deacetylase) complex. Accordingly, utilities of VGAM1393 include diagnosis, prevention and treatment of diseases and clinical conditions associated with MBD3. The function of MBD3 and its association with various diseases and clinical conditions, has been established by previous studies, as described hereinabove with reference to VGAM247. Protocadherin 11 X-linked (PCDH11X, Accession NM_032969) is another VGAM1393 host target gene. PCDH11X BINDING SITE1 and PCDH11X BINDING SITE2 are HOST TARGET binding sites found in untranslated regions of mRNA encoded by PCDH11X, corresponding to HOST TARGET binding sites such as BINDING SITE I, BINDING SITE II or BINDING SITE III. Table 2 illustrates the complementarity of the nucleotide sequences of PCDH11X BINDING SITE1 and PCDH11X BINDING SITE2, designated SEQ ID:26799 and SEQ ID:26784 respectively, to the nucleotide sequence of VGAM1393 RNA, herein designated VGAM RNA, also designated SEQ ID:4104.

Another function of VGAM1393 is therefore inhibition of Protocadherin 11 X-linked (PCDH11X, Accession NM_032969), a gene which is thought to play a fundamental role in cell-cell recognition essential for the segmental development and function of the central nervous system. Accordingly, utilities of VGAM1393 include diagnosis, prevention and treatment of diseases and clinical conditions associated with PCDH11X. The function of PCDH11X and its association with various diseases and clinical conditions, has been established by previous studies, as described hereinabove with reference to VGAM433. SMG1 (Accession NM_015092) is another VGAM1393 host target gene. SMG1 BINDING SITE is HOST TARGET binding site found in the 3' untranslated region of mRNA encoded by SMG1, corresponding to a HOST TARGET binding site such as BINDING SITE I, BINDING SITE II or BINDING SITE III. Table 2 illustrates the complementarity of the nucleotide sequences of SMG1 BINDING SITE, designated SEQ ID:17477, to the nucleotide sequence of VGAM1393 RNA, herein designated VGAM RNA, also designated SEQ ID:4104.

Another function of VGAM1393 is therefore inhibition of SMG1 (Accession NM_015092), a gene which acts as the target for the cell-cycle arrest and immunosuppressive effects. Accordingly, utilities of VGAM1393 include diagnosis, prevention and treatment of diseases and clinical conditions associated with SMG1. The function of SMG1 and its association with various diseases and clinical conditions, has been established by previous studies, as described hereinabove with reference to VGAM419. AD-020 (Accession NM_020141) is another VGAM1393 host target gene. AD-020 BINDING SITE1 and AD-020 BINDING SITE2 are HOST TARGET binding sites found in untranslated regions of mRNA encoded by AD-020, corresponding to HOST TARGET binding sites such as BINDING SITE I, BINDING SITE II or BINDING SITE III. Table 2 illustrates the complementarity of the nucleotide sequences of AD-020 BINDING SITE1 and AD-020 BINDING SITE2, designated SEQ ID:21337 and SEQ ID:29867 respectively, to the nucleotide sequence of VGAM1393 RNA, herein designated VGAM RNA, also designated SEQ ID:4104.

Another function of VGAM1393 is therefore inhibition of AD-020 (Accession NM_020141). Accordingly, utilities of VGAM1393 include diagnosis, prevention and treatment of diseases and clinical conditions associated with AD-020. FLJ00024 (Accession XM_033361) is another VGAM1393 host target gene. FLJ00024 BINDING SITE is HOST TARGET binding site found in the 5' untranslated region of mRNA encoded by FLJ00024, corresponding to a HOST TARGET binding site such as BINDING SITE I, BINDING SITE II or BINDING SITE III. Table 2 illustrates the complementarity of the nucleotide sequences of FLJ00024 BIND- ING SITE, designated SEQ ID:31893, to the nucleotide sequence of VGAM1393 RNA, herein designated VGAM RNA, also designated SEQ ID:4104.

Another function of VGAM1393 is therefore inhibition of FLJ00024 (Accession XM_033361). Accordingly, utilities of VGAM1393 include diagnosis, prevention and treatment of diseases and clinical conditions associated with FLJ00024. LOC203297 (Accession XM_059986) is another VGAM1393 host target gene. LOC203297 BINDING SITE is HOST TARGET binding site found in the 5' untranslated region of mRNA encoded by LOC203297, corresponding to a HOST TARGET binding site such as BINDING SITE I, BINDING SITE II or BINDING SITE III. Table 2 illustrates the complementarity of the nucleotide sequences of LOC203297 BINDING SITE, designated SEQ ID:37137, to the nucleotide sequence of VGAM1393 RNA, herein designated VGAM RNA, also designated SEQ ID:4104.

Another function of VGAM1393 is therefore inhibition of LOC203297 (Accession XM_059986). Accordingly, utilities of VGAM1393 include diagnosis, prevention and treatment of diseases and clinical conditions associated with LOC203297. FIG. 1 further provides a conceptual description of a novel bioinformatically detected viral gene of the present invention, referred to here as Viral Genomic Address Messenger 1394 (VGAM1394) viral gene, which modulates expression of respective host target genes thereof, the function and utility of which host target genes is known in the art.

VGAM1394 is a novel bioinformatically detected regulatory, non protein coding, viral micro RNA (miRNA) gene. The method by which VGAM1394 was detected is described hereinabove with reference to FIGS. 1-8.

VGAM1394 gene, herein designated VGAM GENE, is a viral gene contained in the genome of Wheat Streak Mosaic Virus. VGAM1394 host target gene, herein designated VGAM HOST TARGET GENE, is a human gene contained in the human genome.

VGAM1394 gene encodes a VGAM1394 precursor RNA, herein designated VGAM PRECURSOR RNA. Similar to other miRNA genes, and unlike most ordinary genes, VGAM1394 precursor RNA does not encode a protein. A nucleotide sequence identical or highly similar to the nucleotide sequence of VGAM1394 precursor RNA is designated SEQ ID:1380, and is provided hereinbelow with reference to the sequence listing part. Nucleotide sequence SEQ ID:1380 is located at position 2215 relative to the genome of Wheat Streak Mosaic Virus.

VGAM1394 precursor RNA folds onto itself, forming VGAM1394 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1394 folded precursor RNA into VGAM1394 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1394 RNA is designated SEQ ID:4105, and is provided hereinbelow with reference to the sequence listing part.

VGAM1394 host target gene, herein designated VGAM HOST TARGET GENE, encodes a corresponding messenger RNA, VGAM1394 host target RNA, herein designated VGAM HOST TARGET RNA. VGAM1394 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1394 RNA, herein designated VGAM RNA, binds complementarily to one or more host target binding sites located in untranslated regions of VGAM1394 host target RNA, herein designated VGAM HOST TARGET RNA. This complementary binding is due to the fact that the nucleotide sequence of VGAM1394 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1394 RNA, herein designated VGAM RNA, may have a different number of host target binding sites in untranslated regions of a VGAM1394 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1394 RNA, herein designated VGAM RNA, to host target binding sites on VGAM1394 host target RNA, herein designated VGAM HOST TARGET RNA, such as BINDING SITE I, BINDING SITE II and BINDING SITE III, inhibits translation of VGAM1394 host target RNA into VGAM1394 host target protein, herein designated VGAM HOST TARGET PROTEIN. VGAM host target protein is therefore outlined by a broken line.

It is appreciated that VGAM1394 host target gene, herein designated VGAM HOST TARGET GENE, in fact represents a plurality of VGAM1394 host target genes. The mRNA of each one of this plurality of VGAM1394 host target genes comprises one or more host target binding sites, each having a nucleotide sequence which is at least partly complementary to VGAM1394 RNA, herein designated VGAM RNA, and which when bound by VGAM1394 RNA causes inhibition of translation of respective one or more VGAM1394 host target proteins.

It is further appreciated by one skilled in the art that the mode of translational inhibition illustrated by FIG. 1 with specific reference to translational inhibition exerted by VGAM1394 gene, herein designated VGAM GENE, on one or more VGAM1394 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1394 is inhibition of expression of host target genes, as part of a novel viral mechanism of attacking a host. Accordingly, utilities of VGAM1394 include diagnosis, prevention and treatment of viral infection by Wheat Streak Mosaic Virus. Specific functions, and accordingly utilities, of VGAM1394 correlate with, and may be deduced from, the identity of the host target genes which VGAM1394 binds and inhibits, and the function of these host target genes, as elaborated hereinbelow.

Nucleotide sequences of the VGAM1394 precursor RNA, herein designated VGAM PRECURSOR RNA, and of the 'diced' VGAM1394 RNA, herein designated VGAM RNA, and a schematic representation of the secondary folding of VGAM1394 folded precursor RNA, herein designated VGAM FOLDED PRECURSOR RNA, of VGAM1394 are further described hereinbelow with reference to Table 1.

Nucleotide sequences of host target binding sites, such as BINDING SITE-I, BINDING SITE-II and BINDING SITE-III of FIG. 1, found on VGAM1394 host target RNA, and schematic representation of the complementarity of each of these host target binding sites to VGAM1394 RNA, herein designated VGAM RNA, are described hereinbelow with reference to Table 2.

As mentioned hereinabove with reference to FIG. 1, a function of VGAM1394 gene, herein designated VGAM is inhibition of expression of VGAM1394 target genes. It is appreciated that specific functions, and accordingly utilities, of VGAM1394 correlate with, and may be deduced from, the identity of the target genes which VGAM1394 binds and inhibits, and the function of these target genes, as elaborated hereinbelow.

Phosphoinositide-3-kinase, Regulatory Subunit, Polypeptide 3 (p55, gamma) (PIK3R3, Accession XM_027982) is a VGAM1394 host target gene. PIK3R3 BINDING SITE is HOST TARGET binding site found in the 3' untranslated region of mRNA encoded by PIK3R3, corresponding to a HOST TARGET binding site such as BINDING SITE I, BINDING SITE II or BINDING SITE III. Table 2 illustrates the complementarity of the nucleotide sequences of PIK3R3 BINDING SITE, designated SEQ ID:30602, to the nucleotide sequence of VGAM1394 RNA, herein designated VGAM RNA, also designated SEQ ID:4105.

A function of VGAM1394 is therefore inhibition of Phosphoinositide-3-kinase, Regulatory Subunit, Polypeptide 3 (p55, gamma) (PIK3R3, Accession XM_027982). Accordingly, utilities of VGAM1394 include diagnosis, prevention and treatment of diseases and clinical conditions associated with PIK3R3. Sarcoglycan, Beta (43 kDa dystrophin-associated glycoprotein) (SGCB, Accession NM_000232) is another VGAM1394 host target gene. SGCB BINDING SITE is HOST TARGET binding site found in the 3" untranslated region of mRNA encoded by SGCB, corresponding to a HOST TARGET binding site such as BINDING SITE I, BINDING SITE II or BINDING SITE III. Table 2 illustrates the complementarity of the nucleotide sequences of SGCB BINDING SITE, designated SEQ ID:5743, to the nucleotide sequence of VGAM1394 RNA, herein designated VGAM RNA, also designated SEQ ID:4105.

Another function of VGAM1394 is therefore inhibition of Sarcoglycan, Beta (43 kDa dystrophin-associated glycoprotein) (SGCB, Accession NM_000232). Accordingly, utilities of VGAM1394 include diagnosis, prevention and treatment of diseases and clinical conditions associated with SGCB. Doublecortin and CaM Kinase-like 1 (DCAMKL1, Accession NM_004734) is another VGAM1394 host target gene. DCAMKL1 BINDING SITE is HOST TARGET binding site found in the 3' untranslated region of mRNA encoded by DCAMKL1, corresponding to a HOST TARGET binding site such as BINDING SITE I, BINDING SITE II or BINDING SITE III. Table 2 illustrates the complementarity of the nucleotide sequences of DCAMKL1 BINDING SITE, designated SEQ ID:11112, to the nucleotide sequence of VGAM1394 RNA, herein designated VGAM RNA, also designated SEQ ID:4105.

Another function of VGAM1394 is therefore inhibition of Doublecortin and CaM Kinase-like 1 (DCAMKL1, Accession NM_004734). Accordingly, utilities of VGAM1394 include diagnosis, prevention and treatment of diseases and clinical conditions associated with DCAMKL1. FLJ12517 (Accession NM_023007) is another VGAM1394 host target gene. FLJ12517 BINDING SITE is HOST TARGET binding site found in the 3' untranslated region of mRNA encoded by FLJ12517, corresponding to a HOST TARGET binding site such as BINDING SITE I, BINDING SITE II or BINDING SITE III. Table 2 illustrates the complementarity of the nucleotide sequences of FLJ12517 BINDING SITE, designated SEQ ID:23269, to the nucleotide sequence of VGAM1394 RNA, herein designated VGAM RNA, also designated SEQ ID:4105.

Another function of VGAM1394 is therefore inhibition of FLJ12517 (Accession NM_023007). Accordingly, utilities of VGAM1394 include diagnosis, prevention and treatment of diseases and clinical conditions associated with FLJ12517. FLJ14936 (Accession NM_032864) is another VGAM1394 host target gene. FLJ14936 BINDING SITE is HOST TARGET binding site found in the 3' untranslated region of mRNA encoded by FLJ14936, corresponding to a HOST TARGET binding site such as BINDING SITE I, BINDING SITE II or BINDING SITE III. Table 2 illustrates the complementarity of the nucleotide sequences of FLJ14936 BINDING SITE, designated SEQ ID:26669, to the nucleotide sequence of VGAM1394 RNA, herein designated VGAM RNA, also designated SEQ ID:4105.

Another function of VGAM1394 is therefore inhibition of FLJ14936 (Accession NM_032864). Accordingly, utilities of VGAM1394 include diagnosis, prevention and treatment of diseases and clinical conditions associated with FLJ14936. HH114 (Accession NM_032499) is another VGAM1394 host target gene. HH114 BINDING SITE is HOST TARGET binding site found in the 5' untranslated region of mRNA encoded by HH114, corresponding to a HOST TARGET binding site such as BINDING SITE I, BINDING SITE II or BINDING SITE III. Table 2 illustrates the complementarity of the nucleotide sequences of HH114 BINDING SITE, designated SEQ ID:26249, to the nucleotide sequence of VGAM1394 RNA, herein designated VGAM RNA, also designated SEQ ID:4105.

Another function of VGAM1394 is therefore inhibition of HH114 (Accession NM_032499). Accordingly, utilities of VGAM1394 include diagnosis, prevention and treatment of diseases and clinical conditions associated with HH114. TTY7 (Accession NM_031926) is another VGAM1394 host target gene. TTY7 BINDING SITE is HOST TARGET binding site found in the 3' untranslated region of mRNA encoded by TTY7, corresponding to a HOST TARGET binding site such as BINDING SITE I, BINDING SITE II or BINDING SITE III. Table 2 illustrates the complementarity of the nucleotide sequences of TTY7 BINDING SITE, designated SEQ ID:25672, to the nucleotide sequence of VGAM1394 RNA, herein designated VGAM RNA, also designated SEQ ID:4105.

Another function of VGAM1394 is therefore inhibition of TTY7 (Accession NM_031926). Accordingly, utilities of VGAM1394 include diagnosis, prevention and treatment of diseases and clinical conditions associated with TTY7. LOC147054 (Accession XM_097172) is another VGAM1394 host target gene. LOC147054 BINDING SITE is HOST TARGET binding site found in the 5' untranslated region of mRNA encoded by LOC147054, corresponding to a HOST TARGET binding site such as BINDING SITE I, BINDING SITE II or BINDING SITE III. Table 2 illustrates the complementarity of the nucleotide sequences of LOC147054 BINDING SITE, designated SEQ ID:40793, to the nucleotide sequence of VGAM1394 RNA, herein designated VGAM RNA, also designated SEQ ID:4105.

Another function of VGAM1394 is therefore inhibition of LOC147054 (Accession XM_097172). Accordingly, utilities of VGAM1394 include diagnosis, prevention and treatment of diseases and clinical conditions associated with LOC147054. LOC147929 (Accession XM_085961) is another VGAM1394 host target gene. LOC147929 BINDING SITE is HOST TARGET binding site found in the 5' untranslated region of mRNA encoded by LOC147929, corresponding to a HOST TARGET binding site such as BINDING SITE I, BINDING SITE II or BINDING SITE III. Table 2 illustrates the complementarity of the nucleotide sequences of LOC147929 BINDING SITE, designated SEQ ID:38420, to the nucleotide sequence of VGAM1394 RNA, herein designated VGAM RNA, also designated SEQ ID:4105.

Another function of VGAM1394 is therefore inhibition of LOC147929 (Accession XM_085961). Accordingly, utilities of VGAM1394 include diagnosis, prevention and treatment of diseases and clinical conditions associated with LOC147929. LOC90591 (Accession XM_032811) is another VGAM1394 host target gene. LOC90591 BINDING SITE is HOST TARGET binding site found in the 3' untranslated region of mRNA encoded by LOC90591, corresponding to a HOST TARGET binding site such as BINDING SITE I, BINDING SITE II or BINDING SITE III. Table 2 illustrates the complementarity of the nucleotide sequences of LOC90591 BINDING SITE, designated SEQ ID:31759, to the nucleotide sequence of VGAM1394 RNA, herein designated VGAM RNA, also designated SEQ ID:4105.

Another function of VGAM1394 is therefore inhibition of LOC90591 (Accession XM_032811). Accordingly, utilities of VGAM1394 include diagnosis, prevention and treatment of diseases and clinical conditions associated with LOC90591. FIG. 1 further provides a conceptual description of a novel bioinformatically detected viral gene of the present invention, referred to here as Viral Genomic Address Messenger 1395 (VGAM1395) viral gene, which modulates expression of respective host target genes thereof, the function and utility of which host target genes is known in the art.

VGAM1395 is a novel bioinformatically detected regulatory, non protein coding, viral micro RNA (miRNA) gene. The method by which VGAM1395 was detected is described hereinabove with reference to FIGS. 1-8.

VGAM1395 gene, herein designated VGAM GENE, is a viral gene contained in the genome of Cowpea Aphid-borne Mosaic Virus. VGAM1395 host target gene, herein designated VGAM HOST TARGET GENE, is a human gene contained in the human genome.

VGAM1395 gene encodes a VGAM1395 precursor RNA, herein designated VGAM PRECURSOR RNA. Similar to other miRNA genes, and unlike most ordinary genes, VGAM1395 precursor RNA does not encode a protein. A nucleotide sequence identical or highly similar to the nucleotide sequence of VGAM1395 precursor RNA is designated SEQ ID:1381, and is provided hereinbelow with reference to the sequence listing part. Nucleotide sequence SEQ ID:1381 is located at position 3170 relative to the genome of Cowpea Aphid-borne Mosaic Virus.

VGAM1395 precursor RNA folds onto itself, forming VGAM1395 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1395 folded precursor RNA into VGAM1395 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1395 RNA is designated SEQ ID:4106, and is provided hereinbelow with reference to the sequence listing part.

VGAM1395 host target gene, herein designated VGAM HOST TARGET GENE, encodes a corresponding messenger RNA, VGAM1395 host target RNA, herein designated VGAM HOST TARGET RNA. VGAM1395 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1395 RNA, herein designated VGAM RNA, binds complementarily to one or more host target binding sites located in untranslated regions of VGAM1395 host target RNA, herein designated VGAM HOST TARGET RNA. This complementary binding is due to the fact that the nucleotide sequence of VGAM1395 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1395 RNA, herein designated VGAM RNA, may have a different number of host target binding sites in untranslated regions of a VGAM1395 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1395 RNA, herein designated VGAM RNA, to host target binding sites on VGAM1395 host target RNA, herein designated VGAM HOST TARGET RNA, such as BINDING SITE I, BINDING SITE II and BINDING SITE III, inhibits translation of VGAM1395 host target RNA into VGAM1395 host target protein, herein designated VGAM HOST TARGET PROTEIN. VGAM host target protein is therefore outlined by a broken line.

It is appreciated that VGAM1395 host target gene, herein designated VGAM HOST TARGET GENE, in fact represents a plurality of VGAM1395 host target genes. The mRNA of each one of this plurality of VGAM1395 host target genes comprises one or more host target binding sites, each having a nucleotide sequence which is at least partly complementary to VGAM1395 RNA, herein designated VGAM RNA, and which when bound by VGAM1395 RNA causes inhibition of translation of respective one or more VGAM1395 host target proteins.

It is further appreciated by one skilled in the art that the mode of translational inhibition illustrated by FIG. 1 with specific reference to translational inhibition exerted by VGAM1395 gene, herein designated VGAM GENE, on one or more VGAM1395 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1395 is inhibition of expression of host target genes, as part of a novel viral mechanism of attacking a host. Accordingly, utilities of VGAM1395 include diagnosis, prevention and treatment of viral infection by Cowpea Aphid-borne Mosaic Virus. Specific functions, and accordingly utilities, of VGAM1395 correlate with, and may be deduced from, the identity of the host target genes which VGAM1395 binds and inhibits, and the function of these host target genes, as elaborated hereinbelow.

Nucleotide sequences of the VGAM1395 precursor RNA, herein designated VGAM PRECURSOR RNA, and of the 'diced' VGAM1395 RNA, herein designated VGAM RNA, and a schematic representation of the secondary folding of VGAM1395 folded precursor RNA, herein designated VGAM FOLDED PRECURSOR RNA, of VGAM1395 are further described hereinbelow with reference to Table 1.

Nucleotide sequences of host target binding sites, such as BINDING SITE-I, BINDING SITE-II and BINDING SITE-III of FIG. 1, found on VGAM1395 host target RNA, and schematic representation of the complementarity of each of these host target binding sites to VGAM1395 RNA, herein designated VGAM RNA, are described hereinbelow with reference to Table 2.

As mentioned hereinabove with reference to FIG. 1, a function of VGAM1395 gene, herein designated VGAM is inhibition of expression of VGAM1395 target genes. It is appreciated that specific functions, and accordingly utilities, of VGAM1395 correlate with, and may be deduced from, the identity of the target genes which VGAM1395 binds and inhibits, and the function of these target genes, as elaborated hereinbelow.

Chorea Acanthocytosis (CHAC, Accession NM_033305) is a VGAM1395 host target gene. CHAC BINDING SITE is HOST TARGET binding site found in the 3' untranslated region of mRNA encoded by CHAC, corresponding to a HOST TARGET binding site such as BINDING SITE I, BINDING SITE II or BINDING SITE III. Table 2 illustrates the complementarity of the nucleotide sequences of CHAC BINDING SITE, designated SEQ ID:27141, to the nucleotide sequence of VGAM1395 RNA, herein designated VGAM RNA, also designated SEQ ID:4106.

A function of VGAM1395 is therefore inhibition of Chorea Acanthocytosis (CHAC, Accession NM_033305), a gene which may regulate the cycling of proteins. Accordingly, utilities of VGAM1395 include diagnosis, prevention and treatment of diseases and clinical conditions associated with CHAC. The function of CHAC and its association with various diseases and clinical conditions, has been established by previous studies, as described hereinabove with reference to VGAM650. EphA3 (EPHA3, Accession NM_005233) is another VGAM1395 host target gene. EPHA3 BINDING SITE is HOST TARGET binding site found in the 3' untranslated region of mRNA encoded by EPHA3, corresponding to a HOST TARGET binding site such as BINDING SITE I, BINDING SITE II or BINDING SITE III. Table 2 illustrates the complementarity of the nucleotide sequences of EPHA3 BINDING SITE, designated SEQ ID:11739, to the nucleotide sequence of VGAM1395 RNA, herein designated VGAM RNA, also designated SEQ ID:4106.

Another function of VGAM1395 is therefore inhibition of EphA3 (EPHA3, Accession NM_005233), a gene which binds to ephrin-a2, -a3, -a4 and -a5. could play a role in lymphoid function. Accordingly, utilities of VGAM1395 include diagnosis, prevention and treatment of diseases and clinical conditions associated with EPHA3. The function of EPHA3 and its association with various diseases and clinical conditions, has been established by previous studies, as described hereinabove with reference to VGAM164. EphB2 (EPHB2, Accession NM_004442) is another VGAM1395 host target gene. EPHB2 BINDING SITE is HOST TARGET binding site found in the 3' untranslated region of mRNA encoded by EPHB2, corresponding to a HOST TARGET binding site such as BINDING SITE I, BINDING SITE II or BINDING SITE III. Table 2 illustrates the complementarity of the nucleotide sequences of EPHB2 BINDING SITE, designated SEQ ID:10729, to the nucleotide sequence of VGAM1395 RNA, herein designated VGAM RNA, also designated SEQ ID:4106.

Another function of VGAM1395 is therefore inhibition of EphB2 (EPHB2, Accession NM_004442), a gene which Eph-related receptor tyrosine kinase B2; may have a role in neurogenesis. Accordingly, utilities of VGAM1395 include diagnosis, prevention and treatment of diseases and clinical conditions associated with EPHB2. The function of EPHB2 and its association with various diseases and clinical conditions, has been established by previous studies, as described hereinabove with reference to VGAM533. RAR-related Orphan Receptor B (RORB, Accession NM_006914) is another VGAM1395 host target gene. RORB BINDING SITE is HOST TARGET binding site found in the 3' untranslated region of mRNA encoded by RORB, corresponding to a HOST TARGET binding site such as BINDING SITE I, BINDING SITE II or BINDING SITE III. Table 2 illustrates the complementarity of the nucleotide sequences of RORB BINDING SITE, designated SEQ ID:13788, to the nucleotide sequence of VGAM1395 RNA, herein designated VGAM RNA, also designated SEQ ID:4106.

Another function of VGAM1395 is therefore inhibition of RAR-related Orphan Receptor B (RORB, Accession NM_006914), a gene which is an orphan nuclear receptor. Accordingly, utilities of VGAM1395 include diagnosis, prevention and treatment of diseases and clinical conditions associated with RORB. The function of RORB and its association with various diseases and clinical conditions, has been established by previous studies, as described hereinabove with reference to VGAM178. Carbohydrate (chondroitin 6) Sulfotransferase 3 (CHST3, Accession NM_004273) is another VGAM1395 host target gene. CHST3 BINDING SITE1 and CHST3 BINDING SITE2 are HOST TARGET binding sites found in untranslated regions of mRNA encoded by CHST3, corresponding to HOST TARGET binding sites such as BINDING SITE I, BINDING SITE II or BINDING SITE III. Table 2 illustrates the complementarity of the nucleotide sequences of CHST3 BINDING SITE1 and CHST3 BINDING SITE2, designated SEQ ID:10473 and SEQ ID:10481 respectively, to the nucleotide sequence of VGAM1395 RNA, herein designated VGAM RNA, also designated SEQ ID:4106.

Another function of VGAM1395 is therefore inhibition of Carbohydrate (chondroitin 6) Sulfotransferase 3 (CHST3, Accession NM_004273). Accordingly, utilities of VGAM1395 include diagnosis, prevention and treatment of diseases and clinical conditions associated with CHST3. FLJ23042 (Accession NM_025157) is another VGAM1395 host target gene. FLJ23042 BINDING SITE is HOST TARGET binding site found in the 3' untranslated region of mRNA encoded by FLJ23042, corresponding to a HOST TARGET binding site such as BINDING SITE I, BINDING SITE II or BINDING SITE III. Table 2 illustrates the complementarity of the nucleotide sequences of FLJ23042 BINDING SITE, designated SEQ ID:24798, to the nucleotide sequence of VGAM1395 RNA, herein designated VGAM RNA, also designated SEQ ID:4106.

Another function of VGAM1395 is therefore inhibition of FLJ23042 (Accession NM_025157). Accordingly, utilities of VGAM1395 include diagnosis, prevention and treatment of diseases and clinical conditions associated with FLJ23042. KIAA0232 (Accession XM_052627) is another VGAM1395 host target gene. KIAA0232 BINDING SITE is HOST TARGET binding site found in the 3' untranslated region of mRNA encoded by KIAA0232, corresponding to a HOST TARGET binding site such as BINDING SITE I, BINDING SITE II or BINDING SITE III. Table 2 illustrates the complementarity of the nucleotide sequences of KIAA0232 BINDING SITE, designated SEQ ID:36036, to the nucleotide sequence of VGAM1395 RNA, herein designated VGAM RNA, also designated SEQ ID:4106.

Another function of VGAM1395 is therefore inhibition of KIAA0232 (Accession XM_052627). Accordingly, utilities of VGAM1395 include diagnosis, prevention and treatment of diseases and clinical conditions associated with KIAA0232. KIAA0478 (Accession NM_014870) is another VGAM1395 host target gene. KIAA0478 BINDING SITE is HOST TARGET binding site found in the 3' untranslated region of mRNA encoded by KIAA0478, corresponding to a HOST TARGET binding site such as BINDING SITE I, BINDING SITE II or BINDING SITE III. Table 2 illustrates the complementarity of the nucleotide sequences of KIAA0478 BINDING SITE, designated SEQ ID:16973, to the nucleotide sequence of VGAM1395 RNA, herein designated VGAM RNA, also designated SEQ ID:4106.

Another function of VGAM1395 is therefore inhibition of KIAA0478 (Accession NM_014870). Accordingly, utilities of VGAM1395 include diagnosis, prevention and treatment of diseases and clinical conditions associated with KIAA0478. KIAA1319 (Accession NM_020770) is another VGAM1395 host target gene. KIAA1319 BINDING SITE is HOST TARGET binding site found in the 3' untranslated region of mRNA encoded by KIAA1319, corresponding to a HOST TARGET binding site such as BINDING SITE I, BINDING SITE II or BINDING SITE III. Table 2 illustrates the complementarity of the nucleotide sequences of KIAA1319 BINDING SITE, designated SEQ ID:21865, to the nucleotide sequence of VGAM1395 RNA, herein designated VGAM RNA, also designated SEQ ID:4106.

Another function of VGAM1395 is therefore inhibition of KIAA1319 (Accession NM_020770). Accordingly, utilities of VGAM1395 include diagnosis, prevention and treatment of diseases and clinical conditions associated with KIAA1319. LOC139673 (Accession XM_071645) is another VGAM1395 host target gene. LOC139673 BINDING SITE is HOST TARGET binding site found in the 3' untranslated region of mRNA encoded by LOC139673, corresponding to a HOST TARGET binding site such as BINDING SITE I, BINDING SITE II or BINDING SITE III. Table 2 illustrates the complementarity of the nucleotide sequences of LOC139673 BINDING SITE, designated SEQ ID:37406, to the nucleotide sequence of VGAM1395 RNA, herein designated VGAM RNA, also designated SEQ ID:4106.

Another function of VGAM1395 is therefore inhibition of LOC139673 (Accession XM_071645). Accordingly, utilities of VGAM1395 include diagnosis, prevention and treatment of diseases and clinical conditions associated with LOC139673. LOC145317 (Accession XM_096760) is another VGAM1395 host target gene. LOC145317 BINDING SITE is HOST TARGET binding site found in the 5' untranslated region of mRNA encoded by LOC145317, corresponding to a HOST TARGET binding site such as BINDING SITE I, BINDING SITE II or BINDING SITE III. Table 2 illustrates the complementarity of the nucleotide sequences of LOC145317 BINDING SITE, designated SEQ ID:40529, to the nucleotide sequence of VGAM1395 RNA, herein designated VGAM RNA, also designated SEQ ID:4106.

Another function of VGAM1395 is therefore inhibition of LOC145317 (Accession XM_096760). Accordingly, utilities of VGAM1395 include diagnosis, prevention and treatment of diseases and clinical conditions associated with LOC145317. FIG. 1 further provides a conceptual description of a novel bioinformatically detected viral gene of the present invention, referred to here as Viral Genomic Address Messenger 1396 (VGAM1396) viral gene, which modulates expression of respective host target genes thereof, the function and utility of which host target genes is known in the art.

VGAM1396 is a novel bioinformatically detected regulatory, non protein coding, viral micro RNA (miRNA) gene. The method by which VGAM1396 was detected is described hereinabove with reference to FIGS. 1-8.

VGAM1396 gene, herein designated VGAM GENE, is a viral gene contained in the genome of Cowpea Aphid-borne Mosaic Virus. VGAM1396 host target gene, herein designated VGAM HOST TARGET GENE, is a human gene contained in the human genome.

VGAM1396 gene encodes a VGAM1396 precursor RNA, herein designated VGAM PRECURSOR RNA. Similar to other miRNA genes, and unlike most ordinary genes, VGAM1396 precursor RNA does not encode a protein. A nucleotide sequence identical or highly similar to the nucleotide sequence of VGAM1396 precursor RNA is designated SEQ ID:1382, and is provided hereinbelow with reference to the sequence listing part. Nucleotide sequence SEQ ID:1382 is located at position 3478 relative to the genome of Cowpea Aphid-borne Mosaic Virus.

VGAM1396 precursor RNA folds onto itself, forming VGAM1396 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1396 folded precursor RNA into VGAM1396 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1396 RNA is designated SEQ ID:4107, and is provided hereinbelow with reference to the sequence listing part.

VGAM1396 host target gene, herein designated VGAM HOST TARGET GENE, encodes a corresponding messenger RNA, VGAM1396 host target RNA, herein designated VGAM HOST TARGET RNA. VGAM1396 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1396 RNA, herein designated VGAM RNA, binds complementarily to one or more host target binding sites located in untranslated regions of VGAM1396 host target RNA, herein designated VGAM HOST TARGET RNA. This complementary binding is due to the fact that the nucleotide sequence of VGAM1396 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1396 RNA, herein designated VGAM RNA, may have a different number of host target binding sites in untranslated regions of a VGAM1396 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1396 RNA, herein designated VGAM RNA, to host target binding sites on VGAM1396 host target RNA, herein designated VGAM HOST TARGET RNA, such as BINDING SITE I, BINDING SITE II and BINDING SITE III, inhibits translation of VGAM1396 host target RNA into VGAM1396 host target protein, herein designated VGAM HOST TARGET PROTEIN. VGAM host target protein is therefore outlined by a broken line.

It is appreciated that VGAM1396 host target gene, herein designated VGAM HOST TARGET GENE, in fact represents a plurality of VGAM1396 host target genes. The mRNA of each one of this plurality of VGAM1396 host target genes comprises one or more host target binding sites, each having a nucleotide sequence which is at least partly complementary to VGAM1396 RNA, herein designated VGAM RNA, and which when bound by VGAM1396 RNA causes inhibition of translation of respective one or more VGAM1396 host target proteins.

It is further appreciated by one skilled in the art that the mode of translational inhibition illustrated by FIG. 1 with specific reference to translational inhibition exerted by VGAM1396 gene, herein designated VGAM GENE, on one or more VGAM1396 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1396 is inhibition of expression of host target genes, as part of a novel viral mechanism of attacking a host. Accordingly, utilities of VGAM1396 include diagnosis, prevention and treatment of viral infection by Cowpea Aphid-borne Mosaic Virus. Specific functions, and accordingly utilities, of VGAM1396 correlate with, and may be deduced from, the identity of the host target genes which VGAM1396 binds and inhibits, and the function of these host target genes, as elaborated hereinbelow.

Nucleotide sequences of the VGAM1396 precursor RNA, herein designated VGAM PRECURSOR RNA, and of the 'diced' VGAM1396 RNA, herein designated VGAM RNA, and a schematic representation of the secondary folding of VGAM1396 folded precursor RNA, herein designated VGAM FOLDED PRECURSOR RNA, of VGAM1396 are further described hereinbelow with reference to Table 1.

Nucleotide sequences of host target binding sites, such as BINDING SITE-I, BINDING SITE-II and BINDING SITE-III of FIG. 1, found on VGAM1396 host target RNA, and schematic representation of the complementarity of each of these host target binding sites to VGAM1396 RNA, herein designated VGAM RNA, are described hereinbelow with reference to Table 2.

As mentioned hereinabove with reference to FIG. 1, a function of VGAM1396 gene, herein designated VGAM is inhibition of expression of VGAM1396 target genes. It is appreciated that specific functions, and accordingly utilities, of VGAM1396 correlate with, and may be deduced from, the identity of the target genes which VGAM1396 binds and inhibits, and the function of these target genes, as elaborated hereinbelow.

FKRP (Accession NM_024301) is a VGAM1396 host target gene. FKRP BINDING SITE is HOST TARGET binding site found in the 3' untranslated region of mRNA encoded by FKRP, corresponding to a HOST TARGET binding site such as BINDING SITE I, BINDING SITE II or BINDING SITE III. Table 2 illustrates the complementarity of the nucleotide sequences of FKRP BINDING SITE, designated SEQ ID:23592, to the nucleotide sequence of VGAM1396 RNA, herein designated VGAM RNA, also designated SEQ ID:4107.

A function of VGAM1396 is therefore inhibition of FKRP (Accession NM_024301). Accordingly, utilities of VGAM1396 include diagnosis, prevention and treatment of diseases and clinical conditions associated with FKRP. Phosphatidylcholine Transfer Protein (PCTP, Accession NM_021213) is another VGAM1396 host target gene. PCTP BINDING SITE is HOST TARGET binding site found in the 3' untranslated region of mRNA encoded by PCTP, corresponding to a HOST TARGET binding site such as BINDING SITE I, BINDING SITE II or BINDING SITE III. Table 2 illustrates the complementarity of the nucleotide sequences of PCTP BINDING SITE, designated SEQ ID:22193, to the nucleotide sequence of VGAM1396 RNA, herein designated VGAM RNA, also designated SEQ ID:4107.

Another function of VGAM1396 is therefore inhibition of Phosphatidylcholine Transfer Protein (PCTP, Accession NM_021213), a gene which catalyzes the transfer of phosphatidylcholine between membranes (by similarity). Accordingly, utilities of VGAM1396 include diagnosis, prevention and treatment of diseases and clinical conditions associated with PCTP. The function of PCTP has been established by previous studies. Phosphatidylcholine (PC) transfer protein (PCTP) is a cytosolic protein first purified from bovine and rat liver that catalyzes intermembrane transfer of PC. By searching an EST database for homologs of bovine Pctp, followed by 5-prime RACE and PCR of a kidney cDNA library, Cohen et al. (1999) obtained a cDNA encoding human PCTP. The deduced 214-amino acid human protein is 76% and 80% identical to bovine and rat Pctp, respectively. Northern blot analysis revealed wide expression of an approximately 2.3-kb PCTP transcript in all tissues tested except thymus. Highest expression was detected in liver, placenta, testis, kidney, and heart, and lowest levels were found in brain and lung. Animal model experiments lend further support to the function of PCTP. Van Helvoort et al. (1999) disrupted the Pctp gene in mice. Pctp knockout mice showed no defects in the secretion of PC into bile or lung surfactant, and the lipid content and composition of bile and surfactant was normal. The authors concluded that PCTP does not play a major role in transporting PC from the endoplasmic reticulum, where it is synthesized, to the hepatocyte canalicular membrane.

It is appreciated that the abovementioned animal model for PCTP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Cohen, D. E.; Green, R. M.; Wu, M. K.; Beier, D. R.: Cloning, tissue-specific expression, gene structure and chromosomal localization of human phosphatidylcholine transfer protein. Biochim. Biophys. Acta 1447:265-270, 1999; and van Helvoort, A.; de Brouwer, A.; Ottenhoff, R.; Brouwers, J. F. H. M.; Wijnholds, J.; Beijnen, J. H.; Rijneveld, A.; van der Valk, M. A.; Majoor, D.; Voorhout, W.; Wirtz, K. W. A.; El.

Further studies establishing the function and utilities of PCTP are found in John Hopkins OMIM database record ID 606055, and in sited publications numbered 6826-6827 listed in the bibliography section hereinbelow, which are also hereby incorporated by reference. Renal Tumor Antigen (RAGE, Accession NM_014226) is another VGAM1396 host target gene. RAGE BINDING SITE is HOST TARGET binding site found in the 5' untranslated region of mRNA encoded by RAGE, corresponding to a HOST TARGET binding site such as BINDING SITE I, BINDING SITE II or BINDING SITE III. Table 2 illustrates the complementarity of the nucleotide sequences of RAGE BINDING SITE, designated SEQ ID:15495, to the nucleotide sequence of VGAM1396 RNA, herein designated VGAM RNA, also designated SEQ ID:4107.

Another function of VGAM1396 is therefore inhibition of Renal Tumor Antigen (RAGE, Accession NM_014226), a gene which is essential for the completion of the start, the controlling event, in the cell cycle. Accordingly, utilities of VGAM1396 include diagnosis, prevention and treatment of diseases and clinical conditions associated with RAGE. The function of RAGE has been established by previous studies. Sugaya et al. (1994) identified 3 genes located 90 to 140 kb centromeric to the tenascin-like gene (OMIM Ref. No. 600261) in the MHC class III region near the junction with class II. One of these was the gene for receptor of advanced glycosylation end products of proteins, a member of the immunoglobulin superfamily. A second was the PBX2 homeo box gene (OMIM Ref. No. 176311), and a third was the human counterpart of the mouse mammary tumor gene int-3 (OMIM Ref. No. 164951). The PBX2 and AGER genes are immediately contiguous and are transcribed in the same direction. In addition to mapping by contiguous cosmids and YAC clones, Sugaya et al. (1994) determined the location of the AGER sequence on 6p21.3 by fluorescence in situ hybridization. Yan et al. (1996) reported that the AGER protein, called RAGE (receptor for advanced glycation end products) by them, is an important receptor for the amyloid beta peptide (OMIM Ref. No. 104760) and that expression of this receptor increases in Alzheimer disease (OMIM Ref. No. 104300). They noted that expression of RAGE is particularly increased in neurons close to deposits of amyloid beta peptide and to neurofibrillary tangles.

Full details of the abovementioned studies are described in the following publications, the disclosure of which are hereby incorporated by reference:

Sugaya, K.; Fukagawa, T.; Matsumoto, K.; Mita, K.; Takahashi, E.; Ando, A.; Inoko, H.; Ikemura, T.: Three genes in the human MHC class III region near the junction with the class II: gene for receptor of advanced glycosylation end products, PBX2 homeobox gene and a Notch homolog, human counterpart of mouse mammary tumor gene int-3. Genomics 23:408-419, 1994; and Yan, S. D.; Chen, X.; Fu, J.; Chen, M.; Zhu, H.; Roher, A.; Slattery, T.; Zhao, L.; Nagashima, M.; Morser, J.; Migheli, A.; Nawroth, P.; Stern, D.; Schmidt, A. M.: RAGE and amyloid-beta.

Further studies establishing the function and utilities of RAGE are found in John Hopkins OMIM database record ID 600214, and in sited publications numbered 10683, 1080 and 10684 listed in the bibliography section hereinbelow, which are also hereby incorporated by reference. Serine/threonine Kinase 31 (STK31, Accession NM_032944) is another VGAM1396 host target gene. STK31 BINDING SITE is HOST TARGET binding site found in the 5' untranslated region of mRNA encoded by STK31, corresponding to a HOST TARGET binding site such as BINDING SITE I, BINDING SITE II or BINDING SITE III. Table 2 illustrates the complementarity of the nucleotide sequences of STK31 BINDING SITE, designated SEQ ID:26761, to the nucleotide sequence of VGAM1396 RNA, herein designated VGAM RNA, also designated SEQ ID:4107.

Another function of VGAM1396 is therefore inhibition of Serine/threonine Kinase 31 (STK31, Accession NM_032944). Accordingly, utilities of VGAM1396 include diagnosis, prevention and treatment of diseases and clinical conditions associated with STK31. KIAA0293 (Accession XM_027045) is another VGAM1396 host target gene. KIAA0293 BINDING SITE is HOST TARGET binding site found in the 5' untranslated region of mRNA encoded by KIAA0293, corresponding to a HOST TARGET binding site such as BINDING SITE I, BINDING SITE II or BINDING SITE III. Table 2 illustrates the complementarity of the nucleotide sequences of KIAA0293 BINDING SITE, designated SEQ ID:30396, to the nucleotide sequence of VGAM1396 RNA, herein designated VGAM RNA, also designated SEQ ID:4107.

Another function of VGAM1396 is therefore inhibition of KIAA0293 (Accession XM_027045). Accordingly, utilities of VGAM1396 include diagnosis, prevention and treatment of diseases and clinical conditions associated with KIAA0293. KIAA1023 (Accession NM_017604) is another VGAM1396 host target gene. KIAA1023 BINDING SITE is HOST TARGET binding site found in the 3' untranslated region of mRNA encoded by KIAA1023, corresponding to a HOST TARGET binding site such as BINDING SITE I, BINDING SITE II or BINDING SITE III. Table 2 illustrates the complementarity of the nucleotide sequences of KIAA1023 BINDING SITE, designated SEQ ID:19088, to the nucleotide sequence of VGAM1396 RNA, herein designated VGAM RNA, also designated SEQ ID:4107.

Another function of VGAM1396 is therefore inhibition of KIAA1023 (Accession NM_017604). Accordingly, utilities of VGAM1396 include diagnosis, prevention and treatment of diseases and clinical conditions associated with KIAA1023. MGC16384 (Accession NM_053048) is another VGAM1396 host target gene. MGC16384 BINDING SITE is HOST TARGET binding site found in the 3' untranslated region of mRNA encoded by MGC16384, corresponding to a HOST TARGET binding site such as BINDING SITE I, BINDING SITE II or BINDING SITE III. Table 2 illustrates the complementarity of the nucleotide sequences of MGC16384 BINDING SITE, designated SEQ ID:27593, to the nucleotide sequence of VGAM1396 RNA, herein designated VGAM RNA, also designated SEQ ID:4107.

Another function of VGAM1396 is therefore inhibition of MGC16384 (Accession NM_053048). Accordingly, utilities of VGAM1396 include diagnosis, prevention and treatment of diseases and clinical conditions associated with MGC16384. MGC16386 (Accession NM_080668) is another VGAM1396 host target gene. MGC16386 BINDING SITE is HOST TARGET binding site found in the 3' untranslated region of mRNA encoded by MGC16386, corresponding to a HOST TARGET binding site such as BINDING SITE I, BINDING SITE II or BINDING SITE III. Table 2 illustrates the complementarity of the nucleotide sequences of MGC16386 BINDING SITE, designated SEQ ID:27958, to the nucleotide sequence of VGAM1396 RNA, herein designated VGAM RNA, also designated SEQ ID:4107.

Another function of VGAM1396 is therefore inhibition of MGC16386 (Accession NM_080668). Accordingly, utilities of VGAM1396 include diagnosis, prevention and treatment of diseases and clinical conditions associated with MGC16386. MGC4549 (Accession NM_032377) is another VGAM1396 host target gene. MGC4549 BINDING SITE is HOST TARGET binding site found in the 3' untranslated region of mRNA encoded by MGC4549, corresponding to a HOST TARGET binding site such as BINDING SITE I, BINDING SITE II or BINDING SITE III. Table 2 illustrates the complementarity of the nucleotide sequences of MGC4549 BINDING SITE, designated SEQ ID:26171, to the nucleotide sequence of VGAM1396 RNA, herein designated VGAM RNA, also designated SEQ ID:4107.

Another function of VGAM1396 is therefore inhibition of MGC4549 (Accession NM_032377). Accordingly, utilities of VGAM1396 include diagnosis, prevention and treatment of diseases and clinical conditions associated with MGC4549. Synaptopodin 2 (SYNPO2, Accession XM_050219) is another VGAM1396 host target gene. SYNPO2 BINDING SITE is HOST TARGET binding site found in the 3' untranslated region of mRNA encoded by SYNPO2, corresponding to a HOST TARGET binding site such as BINDING SITE I, BINDING SITE II or BINDING SITE III. Table 2 illustrates the complementarity of the nucleotide sequences of SYNPO2 BINDING SITE, designated SEQ ID:35593, to the nucleotide sequence of VGAM1396 RNA, herein designated VGAM RNA, also designated SEQ ID:4107.

Another function of VGAM1396 is therefore inhibition of Synaptopodin 2 (SYNPO2, Accession XM_050219). Accordingly, utilities of VGAM1396 include diagnosis, prevention and treatment of diseases and clinical conditions associated with SYNPO2. LOC146229 (Accession XM_085387) is another VGAM1396 host target gene. LOC146229 BINDING SITE is HOST TARGET binding site found in the 3' untranslated region of mRNA encoded by LOC146229, corresponding to a HOST TARGET binding site such as BINDING SITE I, BINDING SITE II or BINDING SITE III. Table 2 illustrates the complementarity of the nucleotide sequences of LOC146229 BINDING SITE, designated SEQ ID:38108, to the nucleotide sequence of VGAM1396 RNA, herein designated VGAM RNA, also designated SEQ ID:4107.

Another function of VGAM1396 is therefore inhibition of LOC146229 (Accession XM_085387). Accordingly, utilities of VGAM1396 include diagnosis, prevention and treatment of diseases and clinical conditions associated with LOC146229. LOC151816 (Accession XM_098122) is another VGAM1396 host target gene. LOC151816 BINDING SITE is HOST TARGET binding site found in the 5' untranslated region of mRNA encoded by LOC151816, corresponding to a HOST TARGET binding site such as BINDING SITE I, BINDING SITE II or BINDING SITE III. Table 2 illustrates the complementarity of the nucleotide sequences of LOC151816 BINDING SITE, designated SEQ ID:41390, to the nucleotide sequence of VGAM1396 RNA, herein designated VGAM RNA, also designated SEQ ID:4107.

Another function of VGAM1396 is therefore inhibition of LOC151816 (Accession XM_098122). Accordingly, utilities of VGAM1396 include diagnosis, prevention and treatment of diseases and clinical conditions associated with LOC151816. LOC154449 (Accession XM_087928) is another VGAM1396 host target gene. LOC154449 BINDING SITE is HOST TARGET binding site found in the 5' untranslated region of mRNA encoded by LOC154449, corresponding to a HOST TARGET binding site such as BINDING SITE I, BINDING SITE II or BINDING SITE III. Table 2 illustrates the complementarity of the nucleotide sequences of LOC154449 BINDING SITE, designated SEQ ID:39476, to the nucleotide sequence of VGAM1396 RNA, herein designated VGAM RNA, also designated SEQ ID:4107.

Another function of VGAM1396 is therefore inhibition of LOC154449 (Accession XM_087928). Accordingly, utilities of VGAM1396 include diagnosis, prevention and treatment of diseases and clinical conditions associated with LOC154449. LOC155179 (Accession XM_088169) is another VGAM1396 host target gene. LOC155179 BINDING SITE is HOST TARGET binding site found in the 3' untranslated region of mRNA encoded by LOC155179, corresponding to a HOST TARGET binding site such as BINDING SITE I, BINDING SITE II or BINDING SITE III. Table 2 illustrates the complementarity of the nucleotide sequences of LOC155179 BINDING SITE, designated SEQ ID:39555, to the nucleotide sequence of VGAM1396 RNA, herein designated VGAM RNA, also designated SEQ ID:4107.

Another function of VGAM1396 is therefore inhibition of LOC155179 (Accession XM_088169). Accordingly, utilities of VGAM1396 include diagnosis, prevention and treatment of diseases and clinical conditions associated with LOC155179. LOC158056 (Accession XM_088463) is another VGAM1396 host target gene. LOC158056 BINDING SITE is HOST TARGET binding site found in the 5' untranslated region of mRNA encoded by LOC158056, corresponding to a HOST TARGET binding site such as BINDING SITE I, BINDING SITE II or BINDING SITE III. Table 2 illustrates the complementarity of the nucleotide sequences of LOC158056 BINDING SITE, designated SEQ ID:39716, to the nucleotide sequence of VGAM1396 RNA, herein designated VGAM RNA, also designated SEQ ID:4107.

Another function of VGAM1396 is therefore inhibition of LOC158056 (Accession XM_088463). Accordingly, utilities of VGAM1396 include diagnosis, prevention and treatment of diseases and clinical conditions associated with LOC158056. LOC158525 (Accession XM_088593) is another VGAM1396 host target gene. LOC158525 BINDING SITE is HOST TARGET binding site found in the 5' untranslated region of mRNA encoded by LOC158525, corresponding to a HOST TARGET binding site such as BIND- ING SITE I, BINDING SITE II or BINDING SITE III. Table 2 illustrates the complementarity of the nucleotide sequences of LOC158525 BINDING SITE, designated SEQ ID:39859, to the nucleotide sequence of VGAM1396 RNA, herein designated VGAM RNA, also designated SEQ ID:4107.

Another function of VGAM1396 is therefore inhibition of LOC158525 (Accession XM_088593). Accordingly, utilities of VGAM1396 include diagnosis, prevention and treatment of diseases and clinical conditions associated with LOC158525. LOC197196 (Accession XM_117003) is another VGAM1396 host target gene. LOC197196 BINDING SITE is HOST TARGET binding site found in the 5' untranslated region of mRNA encoded by LOC197196, corresponding to a HOST TARGET binding site such as BINDING SITE I, BINDING SITE II or BINDING SITE III. Table 2 illustrates the complementarity of the nucleotide sequences of LOC197196 BINDING SITE, designated SEQ ID:43198, to the nucleotide sequence of VGAM1396 RNA, herein designated VGAM RNA, also designated SEQ ID:4107.

Another function of VGAM1396 is therefore inhibition of LOC197196 (Accession XM_117003). Accordingly, utilities of VGAM1396 include diagnosis, prevention and treatment of diseases and clinical conditions associated with LOC197196. LOC221486 (Accession XM_165760) is another VGAM1396 host target gene. LOC221486 BINDING SITE is HOST TARGET binding site found in the 5' untranslated region of mRNA encoded by LOC221486, corresponding to a HOST TARGET binding site such as BINDING SITE I, BINDING SITE II or BINDING SITE III. Table 2 illustrates the complementarity of the nucleotide sequences of LOC221486 BINDING SITE, designated SEQ ID:43745, to the nucleotide sequence of VGAM1396 RNA, herein designated VGAM RNA, also designated SEQ ID:4107.

Another function of VGAM1396 is therefore inhibition of LOC221486 (Accession XM_165760). Accordingly, utilities of VGAM1396 include diagnosis, prevention and treatment of diseases and clinical conditions associated with LOC221486. LOC51200 (Accession NM_016352) is another VGAM1396 host target gene. LOC51200 BINDING SITE is HOST TARGET binding site found in the 3' untranslated region of mRNA encoded by LOC51200, corresponding to a HOST TARGET binding site such as BINDING SITE I, BINDING SITE II or BINDING SITE III. Table 2 illustrates the complementarity of the nucleotide sequences of LOC51200 BINDING SITE, designated SEQ ID:18483, to the nucleotide sequence of VGAM1396 RNA, herein designated VGAM RNA, also designated SEQ ID:4107.

Another function of VGAM1396 is therefore inhibition of LOC51200 (Accession NM_016352). Accordingly, utilities of VGAM1396 include diagnosis, prevention and treatment of diseases and clinical conditions associated with LOC51200. LOC90381 (Accession XM_031334) is another VGAM1396 host target gene. LOC90381 BINDING SITE is HOST TARGET binding site found in the 3' untranslated region of mRNA encoded by LOC90381, corresponding to a HOST TARGET binding site such as BINDING SITE I, BINDING SITE II or BINDING SITE III. Table 2 illustrates the complementarity of the nucleotide sequences of LOC90381 BINDING SITE, designated SEQ ID:31343, to the nucleotide sequence of VGAM1396 RNA, herein designated VGAM RNA, also designated SEQ ID:4107.

Another function of VGAM1396 is therefore inhibition of LOC90381 (Accession XM_031334). Accordingly, utilities of VGAM1396 include diagnosis, prevention and treatment of diseases and clinical conditions associated with LOC90381. FIG. 1 further provides a conceptual description of a novel bioinformatically detected viral gene of the present invention, referred to here as Viral Genomic Address Messenger 1397 (VGAM1397) viral gene, which modulates expression of respective host target genes thereof, the function and utility of which host target genes is known in the art.

VGAM1397 is a novel bioinformatically detected regulatory, non protein coding, viral micro RNA (miRNA) gene. The method by which VGAM1397 was detected is described hereinabove with reference to FIGS. 1-8.

VGAM1397 gene, herein designated VGAM GENE, is a viral gene contained in the genome of Cowpea Aphid-borne Mosaic Virus. VGAM1397 host target gene, herein designated VGAM HOST TARGET GENE, is a human gene contained in the human genome.

VGAM1397 gene encodes a VGAM1397 precursor RNA, herein designated VGAM PRECURSOR RNA. Similar to other miRNA genes, and unlike most ordinary genes, VGAM1397 precursor RNA does not encode a protein. A nucleotide sequence identical or highly similar to the nucleotide sequence of VGAM1397 precursor RNA is designated SEQ ID:1383, and is provided hereinbelow with reference to the sequence listing part. Nucleotide sequence SEQ ID:1383 is located at position 2518 relative to the genome of Cowpea Aphid-borne Mosaic Virus.

VGAM1397 precursor RNA folds onto itself, forming VGAM1397 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1397 folded precursor RNA into VGAM1397 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM1397 RNA is designated SEQ ID:4108, and is provided hereinbelow with reference to the sequence listing part.

VGAM1397 host target gene, herein designated VGAM HOST TARGET GENE, encodes a corresponding messenger RNA, VGAM1397 host target RNA, herein designated VGAM HOST TARGET RNA. VGAM1397 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1397 RNA, herein designated VGAM RNA, binds complementarily to one or more host target binding sites located in untranslated regions of VGAM1397 host target RNA, herein designated VGAM HOST TARGET RNA. This complementary binding is due to the fact that the nucleotide sequence of VGAM1397 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1397 RNA, herein designated VGAM RNA, may have a different number of host target binding sites in untranslated regions of a VGAM1397 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1397 RNA, herein designated VGAM RNA, to host target binding sites on VGAM1397 host target RNA, herein designated VGAM HOST TARGET RNA, such as BINDING SITE I, BINDING SITE II and BINDING SITE III, inhibits translation of VGAM1397 host target RNA into VGAM1397 host target protein, herein designated VGAM HOST TARGET PROTEIN. VGAM host target protein is therefore outlined by a broken line.

It is appreciated that VGAM1397 host target gene, herein designated VGAM HOST TARGET GENE, in fact represents a plurality of VGAM1397 host target genes. The mRNA of each one of this plurality of VGAM1397 host target genes comprises one or more host target binding sites, each having a nucleotide sequence which is at least partly complementary to VGAM1397 RNA, herein designated VGAM RNA, and which when bound by VGAM1397 RNA causes inhibition of translation of respective one or more VGAM1397 host target proteins.

It is further appreciated by one skilled in the art that the mode of translational inhibition illustrated by FIG. 1 with specific reference to translational inhibition exerted by VGAM1397 gene, herein designated VGAM GENE, on one or more VGAM1397 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1397 is inhibition of expression of host target genes, as part of a novel viral mechanism of attacking a host. Accordingly, utilities of VGAM1397 include diagnosis, prevention and treatment of viral infection by Cowpea Aphid-borne Mosaic Virus. Specific functions, and accordingly utilities, of VGAM1397 correlate with, and may be deduced from, the identity of the host target genes which VGAM1397 binds and inhibits, and the function of these host target genes, as elaborated hereinbelow.

Nucleotide sequences of the VGAM1397 precursor RNA, herein designated VGAM PRECURSOR RNA, and of the 'diced' VGAM1397 RNA, herein designated VGAM RNA, and a schematic representation of the secondary folding of VGAM1397 folded precursor RNA, herein designated VGAM FOLDED PRECURSOR RNA, of VGAM1397 are further described hereinbelow with reference to Table 1.

Nucleotide sequences of host target binding sites, such as BINDING SITE-I, BINDING SITE-II and BINDING SITE-III of FIG. 1, found on VGAM1397 host target RNA, and schematic representation of the complementarity of each of these host target binding sites to VGAM1397 RNA, herein designated VGAM RNA, are described hereinbelow with reference to Table 2.

As mentioned hereinabove with reference to FIG. 1, a function of VGAM1397 gene, herein designated VGAM is inhibition of expression of VGAM1397 target genes. It is appreciated that specific functions, and accordingly utilities, of VGAM1397 correlate with, and may be deduced from, the identity of the target genes which VGAM1397 binds and inhibits, and the function of these target genes, as elaborated hereinbelow.

Diptheria Toxin Resistance Protein Required For Diphthamide Biosynthesis-like 2 (S. cerevisiae) (DPH2L2, Accession NM_001384) is a VGAM1397 host target gene. DPH2L2 BINDING SITE is HOST TARGET binding site found in the 5' untranslated region of mRNA encoded by DPH2L2, corresponding to a HOST TARGET binding site such as BINDING SITE I, BINDING SITE II or BINDING SITE III. Table 2 illustrates the complementarity of the nucleotide sequences of DPH2L2 BINDING SITE, designated SEQ ID:7057, to the nucleotide sequence of VGAM1397 RNA, herein designated VGAM RNA, also designated SEQ ID:4108.

A function of VGAM1397 is therefore inhibition of Diptheria Toxin Resistance Protein Required For Diphthamide Biosynthesis-like 2 (S. cerevisiae) (DPH2L2, Accession NM_001384), a gene which is required for diphthamide biosynthesis. Accordingly, utilities of VGAM1397 include diagnosis, prevention and treatment of diseases and clinical conditions associated with DPH2L2. The function of DPH2L2 and its association with various diseases and clinical conditions, has been established by previous studies, as described hereinabove with reference to VGAM1221. Low Density Lipoprotein Receptor-related Protein 4 (LRP4, Accession XM_035037) is another VGAM1397 host target gene. LRP4 BINDING SITE is HOST TARGET binding site found in the 3' untranslated region of mRNA encoded by LRP4, corresponding to a HOST TARGET binding site such as BINDING SITE I, BINDING SITE II or BINDING SITE III. Table 2 illustrates the complementarity of the nucleotide sequences of LRP4 BINDING SITE, designated SEQ ID:32199, to the nucleotide sequence of VGAM1397 RNA, herein designated VGAM RNA, also designated SEQ ID:4108.

Another function of VGAM1397 is therefore inhibition of Low Density Lipoprotein Receptor-related Protein 4 (LRP4, Accession XM_035037). Accordingly, utilities of VGAM1397 include diagnosis, prevention and treatment of diseases and clinical conditions associated with LRP4. Presenilin 1 (Alzheimer disease 3) (PSEN1, Accession NM_000021) is another VGAM1397 host target gene. PSEN1 BINDING SITE1 and PSEN1 BINDING SITE2 are HOST TARGET binding sites found in untranslated regions of mRNA encoded by PSEN1, corresponding to HOST TARGET binding sites such as BINDING SITE I, BINDING SITE II or BINDING SITE III. Table 2 illustrates the complementarity of the nucleotide sequences of PSEN1 BINDING SITE1 and PSEN1 BINDING SITE2, designated SEQ ID:5454 and SEQ ID:14232 respectively, to the nucleotide sequence of VGAM1397 RNA, herein designated VGAM RNA, also designated SEQ ID:4108.

Another function of VGAM1397 is therefore inhibition of Presenilin 1 (Alzheimer disease 3) (PSEN1, Accession NM_000021). Accordingly, utilities of VGAM1397 include diagnosis, prevention and treatment of diseases and clinical conditions associated with PSEN1. Eukaryotic Translation Initiation Factor 5 (EIF5, Accession NM_001969) is another VGAM1397 host target gene. EIF5 BINDING SITE is HOST TARGET binding site found in the 3' untranslated region of mRNA encoded by EIF5, corresponding to a HOST TARGET binding site such as BINDING SITE I, BINDING SITE II or BINDING SITE III. Table 2 illustrates the complementarity of the nucleotide sequences of EIF5 BINDING SITE, designated SEQ ID:7697, to the nucleotide sequence of VGAM1397 RNA, herein designated VGAM RNA, also designated SEQ ID:4108.

Another function of VGAM1397 is therefore inhibition of Eukaryotic Translation Initiation Factor 5 (EIF5, Accession NM_001969). Accordingly, utilities of VGAM1397 include diagnosis, prevention and treatment of diseases and clinical conditions associated with EIF5. KIAA0179 (Accession XM_035973) is another VGAM1397 host target gene. KIAA0179 BINDING SITE is HOST TARGET binding site found in the 3' untranslated region of mRNA encoded by KIAA0179, corresponding to a HOST TARGET binding site such as BINDING SITE I, BINDING SITE II or BINDING SITE III. Table 2 illustrates the complementarity of the nucleotide sequences of KIAA0179 BINDING SITE, designated SEQ ID:32365, to the nucleotide sequence of VGAM1397 RNA, herein designated VGAM RNA, also designated SEQ ID:4108.

Another function of VGAM1397 is therefore inhibition of KIAA0179 (Accession XM_035973). Accordingly, utilities of VGAM1397 include diagnosis, prevention and treatment of diseases and clinical conditions associated with KIAA0179. KIAA0215 (Accession NM_014735) is another VGAM1397 host target gene. KIAA0215 BINDING SITE is HOST TARGET binding site found in the 3' untranslated region of mRNA encoded by KIAA0215, corresponding to a HOST TARGET binding site such as BINDING SITE I, BINDING SITE II or BINDING SITE III. Table 2 illustrates the complementarity of the nucleotide sequences of KIAA0215 BINDING SITE, designated SEQ ID:16382, to the nucleotide sequence of VGAM1397 RNA, herein designated VGAM RNA, also designated SEQ ID:4108.

Another function of VGAM1397 is therefore inhibition of KIAA0215 (Accession NM_014735). Accordingly, utilities of VGAM1397 include diagnosis, prevention and treatment of diseases and clinical conditions associated with KIAA0215. KIAA0459 (Accession XM_027862) is another VGAM1397 host target gene. KIAA0459 BINDING SITE is HOST TARGET binding site found in the 3' untranslated region of mRNA encoded by KIAA0459, corresponding to a HOST TARGET binding site such as BINDING SITE I, BINDING SITE II or BINDING SITE III. Table 2 illustrates the complementarity of the nucleotide sequences of KIAA0459 BINDING SITE, designated SEQ ID:30582, to the nucleotide sequence of VGAM1397 RNA, herein designated VGAM RNA, also designated SEQ ID:4108.

Another function of VGAM1397 is therefore inhibition of KIAA0459 (Accession XM_027862). Accordingly, utilities of VGAM1397 include diagnosis, prevention and treatment of diseases and clinical conditions associated with KIAA0459. KIAA1814 (Accession XM_046822) is another VGAM1397 host target gene. KIAA1814 BINDING SITE is HOST TARGET binding site found in the 3' untranslated region of mRNA encoded by KIAA1814, corresponding to a HOST TARGET binding site such as BINDING SITE I, BINDING SITE II or BINDING SITE III. Table 2 illustrates the complementarity of the nucleotide sequences of KIAA1814 BINDING SITE, designated SEQ ID:34836, to the nucleotide sequence of VGAM1397 RNA, herein designated VGAM RNA, also designated SEQ ID:4108.

Another function of VGAM1397 is therefore inhibition of KIAA1814 (Accession XM_046822). Accordingly, utilities of VGAM1397 include diagnosis, prevention and treatment of diseases and clinical conditions associated with KIAA1814. TNF Receptor-associated Factor 3 (TRAF3, Accession XM_007256) is another VGAM1397 host target gene. TRAF3 BINDING SITE is HOST TARGET binding site found in the 3' untranslated region of mRNA encoded by TRAF3, corresponding to a HOST TARGET binding site such as BINDING SITE I, BINDING SITE II or BINDING SITE III. Table 2 illustrates the complementarity of the nucleotide sequences of TRAF3 BINDING SITE, designated SEQ ID:30038, to the nucleotide sequence of VGAM1397 RNA, herein designated VGAM RNA, also designated SEQ ID:4108.

Another function of VGAM1397 is therefore inhibition of TNF Receptor-associated Factor 3 (TRAF3, Accession XM_007256). Accordingly, utilities of VGAM1397 include diagnosis, prevention and treatment of diseases and clinical conditions associated with TRAF3. FIG. 1 further provides a conceptual description of a novel bioinformatically detected viral gene of the present invention, referred to here as Viral Genomic Address Messenger 1398 (VGAM1398) viral gene, which modulates expression of respective host target genes thereof, the function and utility of which host target genes is known in the art.

VGAM1398 is a novel bioinformatically detected regulatory, non protein coding, viral micro RNA (miRNA) gene. The method by which VGAM1398 was detected is described hereinabove with reference to FIGS. 1-8.

VGAM1398 gene, herein designated VGAM GENE, is a viral gene contained in the genome of Perina Nuda Picorna-like Virus. VGAM1398 host target gene, herein designated VGAM HOST TARGET GENE, is a human gene contained in the human genome.

VGAM1398 gene encodes a VGAM1398 precursor RNA, herein designated VGAM PRECURSOR RNA. Similar to other miRNA genes, and unlike most ordinary genes, VGAM1398 precursor RNA does not encode a protein. A nucleotide sequence identical or highly similar to the nucleotide sequence of VGAM1398 precursor RNA is designated SEQ ID:1384, and is provided hereinbelow with reference to the sequence listing part. Nucleotide sequence SEQ ID:1384 is located at position 9232 relative to the genome of Perina Nuda Picorna-like Virus.

VGAM1398 precursor RNA folds onto itself, forming VGAM1398 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1398 folded precursor RNA into VGAM1398 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1398 RNA is designated SEQ ID:4109, and is provided hereinbelow with reference to the sequence listing part.

VGAM1398 host target gene, herein designated VGAM HOST TARGET GENE, encodes a corresponding messenger RNA, VGAM1398 host target RNA, herein designated VGAM HOST TARGET RNA. VGAM1398 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1398 RNA, herein designated VGAM RNA, binds complementarily to one or more host target binding sites located in untranslated regions of VGAM1398 host target RNA, herein designated VGAM HOST TARGET RNA. This complementary binding is due to the fact that the nucleotide sequence of VGAM1398 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1398 RNA, herein designated VGAM RNA, may have a different number of host target binding sites in untranslated regions of a VGAM1398 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1398 RNA, herein designated VGAM RNA, to host target binding sites on VGAM1398 host target RNA, herein designated VGAM HOST TARGET RNA, such as BINDING SITE I, BINDING SITE II and BINDING SITE III, inhibits translation of VGAM1398 host target RNA into VGAM1398 host target protein, herein designated VGAM HOST TARGET PROTEIN. VGAM host target protein is therefore outlined by a broken line.

It is appreciated that VGAM1398 host target gene, herein designated VGAM HOST TARGET GENE, in fact represents a plurality of VGAM1398 host target genes. The mRNA of each one of this plurality of VGAM1398 host target genes comprises one or more host target binding sites, each having a nucleotide sequence which is at least partly complementary to VGAM1398 RNA, herein designated VGAM RNA, and which when bound by VGAM1398 RNA causes inhibition of translation of respective one or more VGAM1398 host target proteins.

It is further appreciated by one skilled in the art that the mode of translational inhibition illustrated by FIG. 1 with specific reference to translational inhibition exerted by VGAM1398 gene, herein designated VGAM GENE, on one or more VGAM1398 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1398 is inhibition of expression of host target genes, as part of a novel viral mechanism of attacking a host. Accordingly, utilities of VGAM1398 include diagnosis, prevention and treatment of viral infection by Perina Nuda Picorna-like Virus. Specific functions, and accordingly utilities, of VGAM1398 correlate with, and may be deduced from, the identity of the host target genes which VGAM1398 binds and inhibits, and the function of these host target genes, as elaborated hereinbelow.

Nucleotide sequences of the VGAM1398 precursor RNA, herein designated VGAM PRECURSOR RNA, and of the 'diced' VGAM1398 RNA, herein designated VGAM RNA, and a schematic representation of the secondary folding of VGAM1398 folded precursor RNA, herein designated VGAM FOLDED PRECURSOR RNA, of VGAM1398 are further described hereinbelow with reference to Table 1.

Nucleotide sequences of host target binding sites, such as BINDING SITE-I, BINDING SITE-II and BINDING SITE-III of FIG. 1, found on VGAM1398 host target RNA, and schematic representation of the complementarity of each of these host target binding sites to VGAM1398 RNA, herein designated VGAM RNA, are described hereinbelow with reference to Table 2.

As mentioned hereinabove with reference to FIG. 1, a function of VGAM1398 gene, herein designated VGAM is inhibition of expression of VGAM1398 target genes. It is appreciated that specific functions, and accordingly utilities, of VGAM1398 correlate with, and may be deduced from, the identity of the target genes which VGAM1398 binds and inhibits, and the function of these target genes, as elaborated hereinbelow.

ATPase, Na+/K+ Transporting, Beta 2 Polypeptide (ATP1B2, Accession NM_001678) is a VGAM1398 host target gene. ATP1B2 BINDING SITE is HOST TARGET binding site found in the 3' untranslated region of mRNA encoded by ATP1B2, corresponding to a HOST TARGET binding site such as BINDING SITE I, BINDING SITE II or BINDING SITE III. Table 2 illustrates the complementarity of the nucleotide sequences of ATP1B2 BINDING SITE, designated SEQ ID:7387, to the nucleotide sequence of VGAM1398 RNA, herein designated VGAM RNA, also designated SEQ ID:4109.

A function of VGAM1398 is therefore inhibition of ATPase, Na+/K+ Transporting, Beta 2 Polypeptide (ATP1B2, Accession NM_001678), a gene which catalyzes the hydrolysis of ATP coupled with the exchange of Na +/K+ ions across the plasma membrane. Accordingly, utilities of VGAM1398 include diagnosis, prevention and treatment of diseases and clinical conditions associated with ATP1B2. The function of ATP1B2 and its association with various diseases and clinical conditions, has been established by previous studies, as described hereinabove with reference to VGAM152. Contactin Associated Protein-like 2 (CNTNAP2, Accession NM_014141) is another VGAM1398 host target gene. CNTNAP2 BINDING SITE is HOST TARGET binding site found in the 3' untranslated region of mRNA encoded by CNTNAP2, corresponding to a HOST TARGET binding site such as BINDING SITE I, BINDING SITE II or BINDING SITE III. Table 2 illustrates the complementarity of the nucleotide sequences of CNTNAP2 BINDING SITE, designated SEQ ID:15412, to the nucleotide sequence of VGAM1398 RNA, herein designated VGAM RNA, also designated SEQ ID:4109.

Another function of VGAM1398 is therefore inhibition of Contactin Associated Protein-like 2 (CNTNAP2, Accession NM_014141). Accordingly, utilities of VGAM1398 include diagnosis, prevention and treatment of diseases and clinical conditions associated with CNTNAP2. Cathepsin L (CTSL, Accession NM_001912) is another VGAM1398 host target gene. CTSL BINDING SITE is HOST TARGET binding site found in the 5' untranslated region of mRNA encoded by CTSL, corresponding to a HOST TARGET binding site such as BINDING SITE I, BINDING SITE II or BINDING SITE III. Table 2 illustrates the complementarity of the nucleotide sequences of CTSL BINDING SITE, designated SEQ ID:7628, to the nucleotide sequence of VGAM1398 RNA, herein designated VGAM RNA, also designated SEQ ID:4109.

Another function of VGAM1398 is therefore inhibition of Cathepsin L (CTSL, Accession NM_001912). Accordingly, utilities of VGAM1398 include diagnosis, prevention and treatment of diseases and clinical conditions associated with CTSL. GATA Binding Protein 2 (GATA2, Accession NM_002050) is another VGAM1398 host target gene. GATA2 BINDING SITE is HOST TARGET binding site found in the 3' untranslated region of mRNA encoded by GATA2, corresponding to a HOST TARGET binding site such as BINDING SITE I, BINDING SITE II or BINDING SITE III. Table 2 illustrates the complementarity of the nucleotide sequences of GATA2 BINDING SITE, designated SEQ ID:7801, to the nucleotide sequence of VGAM1398 RNA, herein designated VGAM RNA, also designated SEQ ID:4109.

Another function of VGAM1398 is therefore inhibition of GATA Binding Protein 2 (GATA2, Accession NM_002050). Accordingly, utilities of VGAM1398 include diagnosis, prevention and treatment of diseases and clinical conditions associated with GATA2. Interleukin 1, Alpha (IL1A, Accession XM_031221) is another VGAM1398 host target gene. IL1A BINDING SITE is HOST TARGET binding site found in the 3' untranslated region of mRNA encoded by IL1A, corresponding to a HOST TARGET binding site such as BINDING SITE I, BINDING SITE II or BINDING SITE III. Table 2 illustrates the complementarity of the nucleotide sequences of IL1A BINDING SITE, designated SEQ ID:31307, to the nucleotide sequence of VGAM1398 RNA, herein designated VGAM RNA, also designated SEQ ID:4109.

Another function of VGAM1398 is therefore inhibition of Interleukin 1, Alpha (IL1A, Accession XM_031221), a gene which stimulates thymocyte proliferation by inducing il-2 release, b-cell maturation & proliferation, & fibroblast growth factor activity. Accordingly, utilities of VGAM1398 include diagnosis, prevention and treatment of diseases and clinical conditions associated with IL1A. The function of IL1A and its association with various diseases and clinical conditions, has been established by previous studies, as described hereinabove with reference to VGAM475. IMP (inosine monophosphate) Dehydrogenase 1 (IMPDH1, Accession NM_000883) is another VGAM1398 host target gene. IMPDH1 BINDING SITE is HOST TARGET binding site found in the 3' untranslated region of mRNA encoded by IMPDH1, corresponding to a HOST TARGET binding site such as BINDING SITE I, BINDING SITE II or BINDING SITE III. Table 2 illustrates the complementarity of the nucleotide sequences of IMPDH1 BINDING SITE, designated SEQ ID:6577, to the nucleotide sequence of VGAM1398 RNA, herein designated VGAM RNA, also designated SEQ ID:4109.

Another function of VGAM1398 is therefore inhibition of IMP (inosine monophosphate) Dehydrogenase 1 (IMPDH1, Accession NM_000883). Accordingly, utilities of VGAM1398 include diagnosis, prevention and treatment of diseases and clinical conditions associated with IMPDH1. Proprotein Convertase Subtilisin/kexin Type 1 (PCSK1, Accession NM_000439) is another VGAM1398 host target gene. PCSK1 BINDING SITE is HOST TARGET binding site found in the 3' untranslated region of mRNA encoded by PCSK1, corresponding to a HOST TARGET binding site such as BINDING SITE I, BINDING SITE II or BINDING SITE III. Table 2 illustrates the complementarity of the nucleotide sequences of PCSK1 BINDING SITE, designated SEQ ID:6023, to the nucleotide sequence of VGAM1398 RNA, herein designated VGAM RNA, also designated SEQ ID:4109.

Another function of VGAM1398 is therefore inhibition of Proprotein Convertase Subtilisin/kexin Type 1 (PCSK1, Accession NM_000439), a gene which processes hormone precursors by cleaving paired basic amino acids; serine protease of the subtilase family. Accordingly, utilities of VGAM1398 include diagnosis, prevention and treatment of diseases and clinical conditions associated with PCSK1. The function of PCSK1 has been established by previous studies. A wide variety of biologically important polypeptides including hormones, enzymes, and receptors are initially synthesized as large inactive precursors. To release the active component (s), these precursors must undergo limited proteolysis at pairs of basic residues by specific convertases. There is, for example, a diarginyl-specific proalbumin convertase (see OMIM Ref. No. comment in 103600). Three mammalian convertases, PC1 (PCSK1; also known as PC3), PC2 (PCSK2; 162151), and furin (OMIM Ref. No. 136950), belonging to the family of serine proteinases of the subtilisin family, are prohormone and proprotein convertases. PC1 and PC2, known also as NEC1 and NEC2 (for neuroendocrine convertase 1 and 2, respectively), differentially cleave proopiomelanocortin (POMC; 176830). Proinsulin is converted to insulin (OMIM Ref. No. 176730) by the concerted action of PC2 and PC3. Furin is a specific proteinase capable of activating the beta subunit of pro-NGF (OMIM Ref. No. 162030) and von Willebrand factor (OMIM Ref. No. 193400). By in situ hybridization, Seidah et al. (1991) mapped NEC1 to human 5q15-q21 and to mouse chromosome 13. Copeland et al. (1992) refined the regional localization on mouse chromosome 13. Ohagi et al. (1996) stated that PC2 is responsible for cleavage of the C-peptide/A-chain junction of the proinsulin molecule, whereas PC3 cleaves the proinsulin molecule on the C-terminal side of the dibasic peptide, arg31-arg32, joining the B-chain and C-peptide. PC3 plays a key role in regulating insulin biosynthesis by initiating the sequential processing. Expression of insulin and PC3, but not PC2, is coordinately regulated by glucose, consistent with the important role of PC3 in regulating proinsulin processing. Noninsulin-dependent diabetes mellitus (NIDDM; 125853) is associated with increased secretion of proinsulin and proinsulin-like molecules, suggesting that mutations in the PC3 gene may be involved in the development of this disorder. Ohagi et al. (1996) showed that the human PC3 gene consists of 14 exons spanning more than 35 kb. The exon/intron organization of the PC2 and PC3 genes are conserved, consistent with a common evolutionary origin. Screening for mutations in the PC3 gene in Japanese subjects with NIDDM using SSCP analysis and nucleotide sequencing of the entire coding region, Ohagi et al. (1996) could find no mutation associated with NIDDM. A mutation in carboxypeptidase E (CPE; 114855), an enzyme active in the processing and sorting of prohormones, causes obesity in the fat/fat mouse (Naggert et al., 1995; Cool et al., 1997). The gene products of CPE and PC1 cooperate in prohormone processing. Mutations in the CPE gene had not been demonstrated in human obesity. However, Jackson et al. (1997) demonstrated mutations in the prohormone convertase 1 gene, which acts proximally to CPE in the pathway of posttranslational processing of prohormones and neuropeptides. The subject was a 43-year-old woman with extreme childhood obesity, abnormal glucose homeostasis, hypogonadotropic hypogonadism, hypocortisolism, and elevated plasma proinsulin and POMC concentrations, but very low insulin levels, all suggestive of defective prohormone processing by the patient's PC1. The patient had been described clinically by O'Rahilly et al. (1995); see 600955. The patient was found to be a compound heterozygote for mutations in PC1. Heteroallelism of the patient was confirmed by the fact that 1 substitution (162150.0001) was found in 3 of the proband's 4 children, all of whom were clinically unaffected; the fourth child had the other mutation, a splice site defect (162150.0002). The proband's fasting serum leptin (OMIM Ref. No. 164160) concentration was appropriate for her body mass index. There was a close similarity of phenotype between the proband and the fat/fat mouse.

Full details of the abovementioned studies are described in the following publications, the disclosure of which are hereby incorporated by reference:

Ohagi, S.; Sakaguchi, H.; Sanke, T.; Tatsuta, H.; Hanabusa, T.; Nanjo, K.: Human prohormone convertase 3 gene: exon-intron organization and molecular scanning for mutations in Japanese subjects with NIDDM. Diabetes 45:897-901, 1996; and O'Rahilly, S.; Gray, H.; Humphreys, P. J.; Krook, A.; Polonsky, K. S.; White, A.; Gibson, S.; Taylor, K.; Carr, C.: Brief report: impaired processing of prohormones associated with abno.

Further studies establishing the function and utilities of PCSK1 are found in John Hopkins OMIM database record ID 162150, and in sited publications numbered 1712, 3577-195 and 3583 listed in the bibliography section hereinbelow, which are also hereby incorporated by reference. BICD2 (Accession XM_046863) is another VGAM1398 host target gene. BICD2 BINDING SITE is HOST TARGET binding site found in the 3' untranslated region of mRNA encoded by BICD2, corresponding to a HOST TARGET binding site such as BINDING SITE I, BINDING SITE II or BINDING SITE III. Table 2 illustrates the complementarity of the nucleotide sequences of BICD2 BINDING SITE, designated SEQ ID:34851, to the nucleotide sequence of VGAM1398 RNA, herein designated VGAM RNA, also designated SEQ ID:4109.

Another function of VGAM1398 is therefore inhibition of BICD2 (Accession XM_046863). Accordingly, utilities of VGAM1398 include diagnosis, prevention and treatment of diseases and clinical conditions associated with BICD2. FLJ31709 (Accession NM_144636) is another VGAM1398 host target gene. FLJ31709 BINDING SITE is HOST TARGET binding site found in the 3' untranslated region of mRNA encoded by FLJ31709, corresponding to a HOST TARGET binding site such as BINDING SITE I, BINDING SITE II or BINDING SITE III. Table 2 illustrates the complementarity of the nucleotide sequences of FLJ31709 BINDING SITE, designated SEQ ID:29456, to the nucleotide sequence of VGAM1398 RNA, herein designated VGAM RNA, also designated SEQ ID:4109.

Another function of VGAM1398 is therefore inhibition of FLJ31709 (Accession NM_144636). Accordingly, utilities of VGAM1398 include diagnosis, prevention and treatment of diseases and clinical conditions associated with FLJ31709. KIAA0285 (Accession NM_014807) is another VGAM1398 host target gene. KIAA0285 BINDING SITE is HOST TARGET binding site found in the 3' untranslated region of mRNA encoded by KIAA0285, corresponding to a HOST TARGET binding site such as BINDING SITE I, BINDING SITE II or BINDING SITE III. Table 2 illustrates the complementarity of the nucleotide sequences of KIAA0285 BINDING SITE, designated SEQ ID:16745, to the nucleotide sequence of VGAM1398 RNA, herein designated VGAM RNA, also designated SEQ ID:4109.

Another function of VGAM1398 is therefore inhibition of KIAA0285 (Accession NM_014807). Accordingly, utilities of VGAM1398 include diagnosis, prevention and treatment of diseases and clinical conditions associated with KIAA0285. KIAA0367 (Accession XM_041018) is another VGAM1398 host target gene. KIAA0367 BINDING SITE is HOST TARGET binding site found in the 3' untranslated region of mRNA encoded by KIAA0367, corresponding to a HOST TARGET binding site such as BINDING SITE I, BINDING SITE II or BINDING SITE III. Table 2 illustrates the complementarity of the nucleotide sequences of KIAA0367 BINDING SITE, designated SEQ ID:33423, to the nucleotide sequence of VGAM1398 RNA, herein designated VGAM RNA, also designated SEQ ID:4109.

Another function of VGAM1398 is therefore inhibition of KIAA0367 (Accession XM_041018). Accordingly, utilities of VGAM1398 include diagnosis, prevention and treatment of diseases and clinical conditions associated with KIAA0367. KIAA1649 (Accession NM_032311) is another VGAM1398 host target gene. KIAA1649 BINDING SITE is HOST TARGET binding site found in the 3' untranslated region of mRNA encoded by KIAA1649, corresponding to a HOST TARGET binding site such as BINDING SITE I, BINDING SITE II or BINDING SITE III. Table 2 illustrates the complementarity of the nucleotide sequences of KIAA1649 BINDING SITE, designated SEQ ID:26114, to the nucleotide sequence of VGAM1398 RNA, herein designated VGAM RNA, also designated SEQ ID:4109.

Another function of VGAM1398 is therefore inhibition of KIAA1649 (Accession NM_032311). Accordingly, utilities of VGAM1398 include diagnosis, prevention and treatment of diseases and clinical conditions associated with KIAA1649. MGC2306 (Accession NM_032638) is another VGAM1398 host target gene. MGC2306 BINDING SITE is HOST TARGET binding site found in the 3' untranslated region of mRNA encoded by MGC2306, corresponding to a HOST TARGET binding site such as BINDING SITE I, BINDING SITE II or BINDING SITE III. Table 2 illustrates the complementarity of the nucleotide sequences of MGC2306 BINDING SITE, designated SEQ ID:26350, to the nucleotide sequence of VGAM1398 RNA, herein designated VGAM RNA, also designated SEQ ID:4109.

Another function of VGAM1398 is therefore inhibition of MGC2306 (Accession NM_032638). Accordingly, utilities of VGAM1398 include diagnosis, prevention and treatment of diseases and clinical conditions associated with MGC2306. POMT2 (Accession NM_013382) is another VGAM1398 host target gene. POMT2 BINDING SITE is HOST TARGET binding site found in the 5' untranslated region of mRNA encoded by POMT2, corresponding to a HOST TARGET binding site such as BINDING SITE I, BINDING SITE II or BINDING SITE III. Table 2 illustrates the complementarity of the nucleotide sequences of POMT2 BINDING SITE, designated SEQ ID:15034, to the nucleotide sequence of VGAM1398 RNA, herein designated VGAM RNA, also designated SEQ ID:4109.

Another function of VGAM1398 is therefore inhibition of POMT2 (Accession NM_013382). Accordingly, utilities of VGAM1398 include diagnosis, prevention and treatment of diseases and clinical conditions associated with POMT2. PRO2032 (Accession NM_018615) is another VGAM1398 host target gene. PRO2032 BINDING SITE is HOST TARGET binding site found in the 3' untranslated region of mRNA encoded by PRO2032, corresponding to a HOST TARGET binding site such as BINDING SITE I, BINDING SITE II or BINDING SITE III. Table 2 illustrates the complementarity of the nucleotide sequences of PRO2032 BINDING SITE, designated SEQ ID:20684, to the nucleotide sequence of VGAM1398 RNA, herein designated VGAM RNA, also designated SEQ ID:4109.

Another function of VGAM1398 is therefore inhibition of PRO2032 (Accession NM_018615). Accordingly, utilities of VGAM1398 include diagnosis, prevention and treatment of diseases and clinical conditions associated with PRO2032. RAB20, Member RAS Oncogene Family (RAB20, Accession NM_017817) is another VGAM1398 host target gene. RAB20 BINDING SITE is HOST TARGET binding site found in the 5' untranslated region of mRNA encoded by RAB20, corresponding to a HOST TARGET binding site such as BINDING SITE I, BINDING SITE II or BINDING SITE III. Table 2 illustrates the complementarity of the nucleotide sequences of RAB20 BINDING SITE, designated SEQ ID:19464, to the nucleotide sequence of VGAM1398 RNA, herein designated VGAM RNA, also designated SEQ ID:4109.

Another function of VGAM1398 is therefore inhibition of RAB20, Member RAS Oncogene Family (RAB20, Accession NM_017817). Accordingly, utilities of VGAM1398 include diagnosis, prevention and treatment of diseases and clinical conditions associated with RAB20. Tumor Protein D52 (TPD52, Accession NM_005079) is another VGAM1398 host target gene. TPD52 BINDING SITE is HOST TARGET binding site found in the 3' untranslated region of mRNA encoded by TPD52, corresponding to a HOST TARGET binding site such as BINDING SITE I, BINDING SITE II or BINDING SITE III. Table 2 illustrates the complementarity of the nucleotide sequences of TPD52 BINDING SITE, designated SEQ ID:11531, to the nucleotide sequence of VGAM1398 RNA, herein designated VGAM RNA, also designated SEQ ID:4109.

Another function of VGAM1398 is therefore inhibition of Tumor Protein D52 (TPD52, Accession NM_005079). Accordingly, utilities of VGAM1398 include diagnosis, prevention and treatment of diseases and clinical conditions associated with TPD52. LOC115399 (Accession XM_055874) is another VGAM1398 host target gene. LOC115399 BINDING SITE is HOST TARGET binding site found in the 3' untranslated region of mRNA encoded by LOC115399, corresponding to a HOST TARGET binding site such as BINDING SITE I, BINDING SITE II or BINDING SITE III. Table 2 illustrates the complementarity of the nucleotide sequences of LOC115399 BINDING SITE, designated SEQ ID:36344, to the nucleotide sequence of VGAM1398 RNA, herein designated VGAM RNA, also designated SEQ ID:4109.

Another function of VGAM1398 is therefore inhibition of LOC115399 (Accession XM_055874). Accordingly, utilities of VGAM1398 include diagnosis, prevention and treatment of diseases and clinical conditions associated with LOC115399. LOC146243 (Accession XM_096956) is another VGAM1398 host target gene. LOC146243 BINDING SITE is HOST TARGET binding site found in the 3' untranslated region of mRNA encoded by LOC146243, corresponding to a HOST TARGET binding site such as BINDING SITE I, BINDING SITE II or BINDING SITE III. Table 2 illustrates the complementarity of the nucleotide sequences of LOC146243 BINDING SITE, designated SEQ ID:40674, to the nucleotide sequence of VGAM1398 RNA, herein designated VGAM RNA, also designated SEQ ID:4109.

Another function of VGAM1398 is therefore inhibition of LOC146243 (Accession XM_096956). Accordingly, utilities of VGAM1398 include diagnosis, prevention and treatment of diseases and clinical conditions associated with LOC146243. LOC148293 (Accession XM_086138) is another VGAM1398 host target gene. LOC148293 BINDING SITE is HOST TARGET binding site found in the 3' untranslated region of mRNA encoded by LOC148293, corresponding to a HOST TARGET binding site such as BINDING SITE I, BINDING SITE II or BINDING SITE III. Table 2 illustrates the complementarity of the nucleotide sequences of LOC148293 BINDING SITE, designated SEQ ID:38517, to the nucleotide sequence of VGAM1398 RNA, herein designated VGAM RNA, also designated SEQ ID:4109.

Another function of VGAM1398 is therefore inhibition of LOC148293 (Accession XM_086138). Accordingly, utilities of VGAM1398 include diagnosis, prevention and treatment of diseases and clinical conditions associated with LOC148293. LOC256073 (Accession XM_172972) is another VGAM1398 host target gene. LOC256073 BINDING SITE is HOST TARGET binding site found in the 5' untranslated region of mRNA encoded by LOC256073, corresponding to a HOST TARGET binding site such as BINDING SITE I, BINDING SITE II or BINDING SITE III. Table 2 illustrates the complementarity of the nucleotide sequences of LOC256073 BINDING SITE, designated SEQ ID:46227, to the nucleotide sequence of VGAM1398 RNA, herein designated VGAM RNA, also designated SEQ ID:4109.

Another function of VGAM1398 is therefore inhibition of LOC256073 (Accession XM_172972). Accordingly, utilities of VGAM1398 include diagnosis, prevention and treatment of diseases and clinical conditions associated with LOC256073. FIG. 1 further provides a conceptual description of a novel bioinformatically detected viral gene of the present invention, referred to here as Viral Genomic Address Messenger 1399 (VGAM1399) viral gene, which modulates expression of respective host target genes thereof, the function and utility of which host target genes is known in the art.

VGAM1399 is a novel bioinformatically detected regulatory, non protein coding, viral micro RNA (miRNA) gene. The method by which VGAM1399 was detected is described hereinabove with reference to FIGS. 1-8.

VGAM1399 gene, herein designated VGAM GENE, is a viral gene contained in the genome of Perina Nuda Picorna-like Virus. VGAM1399 host target gene, herein designated VGAM HOST TARGET GENE, is a human gene contained in the human genome.

VGAM1399 gene encodes a VGAM1399 precursor RNA, herein designated VGAM PRECURSOR RNA. Similar to other miRNA genes, and unlike most ordinary genes, VGAM1399 precursor RNA does not encode a protein. A nucleotide sequence identical or highly similar to the nucleotide sequence of VGAM1399 precursor RNA is designated SEQ ID:1385, and is provided hereinbelow with reference to the sequence listing part. Nucleotide sequence SEQ ID:1385 is located at position 2981 relative to the genome of Perina Nuda Picorna-like Virus.

VGAM1399 precursor RNA folds onto itself, forming VGAM1399 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1399 folded precursor RNA into VGAM1399 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1399 RNA is designated SEQ ID:4110, and is provided hereinbelow with reference to the sequence listing part.

VGAM1399 host target gene, herein designated VGAM HOST TARGET GENE, encodes a corresponding messenger RNA, VGAM1399 host target RNA, herein designated VGAM HOST TARGET RNA. VGAM1399 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1399 RNA, herein designated VGAM RNA, binds complementarily to one or more host target binding sites located in untranslated regions of VGAM1399 host target RNA, herein designated VGAM HOST TARGET RNA. This complementary binding is due to the fact that the nucleotide sequence of VGAM1399 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1399 RNA, herein designated VGAM RNA, may have a different number of host target binding sites in untranslated regions of a VGAM1399 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1399 RNA, herein designated VGAM RNA, to host target binding sites on VGAM1399 host target RNA, herein designated VGAM HOST TARGET RNA, such as BINDING SITE I, BINDING SITE II and BINDING SITE III, inhibits translation of VGAM1399 host target RNA into VGAM1399 host target protein, herein designated VGAM HOST TARGET PROTEIN. VGAM host target protein is therefore outlined by a broken line.

It is appreciated that VGAM1399 host target gene, herein designated VGAM HOST TARGET GENE, in fact represents a plurality of VGAM1399 host target genes. The mRNA of each one of this plurality of VGAM1399 host target genes comprises one or more host target binding sites, each having a nucleotide sequence which is at least partly complementary to VGAM1399 RNA, herein designated VGAM RNA, and which when bound by VGAM1399 RNA causes inhibition of translation of respective one or more VGAM1399 host target proteins.

It is further appreciated by one skilled in the art that the mode of translational inhibition illustrated by FIG. 1 with specific reference to translational inhibition exerted by VGAM1399 gene, herein designated VGAM GENE, on one or more VGAM1399 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1399 is inhibition of expression of host target genes, as part of a novel viral mechanism of attacking a host. Accordingly, utilities of VGAM1399 include diagnosis, prevention and treatment of viral infection by Perina Nuda Picorna-like Virus. Specific functions, and accordingly utilities, of VGAM1399 correlate with, and may be deduced from, the identity of the host target genes which VGAM1399 binds and inhibits, and the function of these host target genes, as elaborated hereinbelow.

Nucleotide sequences of the VGAM1399 precursor RNA, herein designated VGAM PRECURSOR RNA, and of the 'diced' VGAM1399 RNA, herein designated VGAM RNA, and a schematic representation of the secondary folding of VGAM1399 folded precursor RNA, herein designated VGAM FOLDED PRECURSOR RNA, of VGAM1399 are further described hereinbelow with reference to Table 1.

Nucleotide sequences of host target binding sites, such as BINDING SITE-I, BINDING SITE-II and BINDING SITE-III of FIG. 1, found on VGAM1399 host target RNA, and schematic representation of the complementarity of each of these host target binding sites to VGAM1399 RNA, herein designated VGAM RNA, are described hereinbelow with reference to Table 2.

As mentioned hereinabove with reference to FIG. 1, a function of VGAM1399 gene, herein designated VGAM is inhibition of expression of VGAM1399 target genes. It is appreciated that specific functions, and accordingly utilities, of VGAM1399 correlate with, and may be deduced from, the identity of the target genes which VGAM1399 binds and inhibits, and the function of these target genes, as elaborated hereinbelow.

Membrane Protein, Palmitoylated 6 (MAGUK p55 subfamily member 6) (MPP6, Accession NM_016447) is a VGAM1399 host target gene. MPP6 BINDING SITE is HOST TARGET binding site found in the 5' untranslated region of mRNA encoded by MPP6, corresponding to a HOST TARGET binding site such as BINDING SITE I, BINDING SITE II or BINDING SITE III. Table 2 illustrates the complementarity of the nucleotide sequences of MPP6 BINDING SITE, designated SEQ ID:18566, to the nucleotide sequence of VGAM1399 RNA, herein designated VGAM RNA, also designated SEQ ID:4110.

A function of VGAM1399 is therefore inhibition of Membrane Protein, Palmitoylated 6 (MAGUK p55 subfamily member 6) (MPP6, Accession NM_016447), a gene which may regulate transmembrane proteins that bind calcium, calmodulin, or nucleotides. Accordingly, utilities of VGAM1399 include diagnosis, prevention and treatment of diseases and clinical conditions associated with MPP6. The function of MPP6 has been established by previous studies. By searching an EST database with DLG2 (OMIM Ref. No. 603583) as the probe, followed by PCR of a brain cDNA library and 5-prime RACE, Tseng et al. (2001) obtained a cDNA encoding MPP6, which they called VAM1 for VELI (OMIM Ref. No. 603380)-associated MAGUK-1. The deduced 540-amino acid protein has a single PDZ domain, a central SH3 domain, and a C-terminal GUK domain, resembling other members of the p55 MAGUK subfamily. Like MPP1, MPP6 also contains a protein 4.1 (EPB41; 130500)-binding domain with its characteristic KKKK sequence, as well as a leucine zipper and 2 phosphorylation sites. Northern blot analysis revealed expression of an abundant 2.3-kb transcript and a minor 4.2-kb transcript only in testis. RT-PCR analysis detected predominant expression in testis, with lower amounts in ovary, prostate, thymus, small intestine, and several other tissues; VELI has a similar expression pattern. GST pull-down and mutation analyses indicated that a domain N-terminal of the PDZ region of VAM1 contains the minimal VELI-binding sequence. No binding between VAM1 and EPB41 was detected. Kamberov et al. (2000) cloned and characterized the mouse Mpp5 (OMIM Ref. No. 606958) and Mpp6 genes, which they called Pals1 and Pals2, respectively. The Pals proteins bind to mouse Lin7 (VELI) through a region N-terminal to their PDZ domains.

Full details of the abovementioned studies are described in the following publications, the disclosure of which are hereby incorporated by reference:

Kamberov, E.; Makarova, O.; Roh, M.; Liu, A.; Karnak, D.; Straight, S.; Margolis, B.: Molecular cloning and characterization of Pals, proteins associated with mLin-7. J. Biol. Chem. 275:11425-11431, 2000; and Tseng, T.-C.; Marfatia, S. M.; Bryant, P. J.; Pack, S.; Zhuang, A.; O'Brien, J. E.; Lin, L.; Hanada, T.; Chishti, A. H.: VAM-1: a new member of the MAGUK family binds to human Veli-1.

Further studies establishing the function and utilities of MPP6 are found in John Hopkins OMIM database record ID 606959, and in sited publications numbered 5138-5139 listed in the bibliography section hereinbelow, which are also hereby incorporated by reference. FLJ10326 (Accession NM_018060) is another VGAM1399 host target gene. FLJ10326 BINDING SITE is HOST TARGET binding site found in the 3' untranslated region of mRNA encoded by FLJ10326, corresponding to a HOST TARGET binding site such as BINDING SITE I, BINDING SITE II or BINDING SITE III. Table 2 illustrates the complementarity of the nucleotide sequences of FLJ10326 BINDING SITE, designated SEQ ID:19829, to the nucleotide sequence of VGAM1399 RNA, herein designated VGAM RNA, also designated SEQ ID:4110.

Another function of VGAM1399 is therefore inhibition of FLJ10326 (Accession NM_018060). Accordingly, utilities of VGAM1399 include diagnosis, prevention and treatment of diseases and clinical conditions associated with FLJ10326. KIAA1111 (Accession XM_171233) is another VGAM1399 host target gene. KIAA1111 BINDING SITE is HOST TARGET binding site found in the 3' untranslated region of mRNA encoded by KIAA1111, corresponding to a HOST TARGET binding site such as BINDING SITE I, BINDING SITE II or BINDING SITE III. Table 2 illustrates the complementarity of the nucleotide sequences of KIAA1111 BINDING SITE, designated SEQ ID:46018, to the nucleotide sequence of VGAM1399 RNA, herein designated VGAM RNA, also designated SEQ ID:4110.

Another function of VGAM1399 is therefore inhibition of KIAA1111 (Accession XM_171233). Accordingly, utilities of VGAM1399 include diagnosis, prevention and treatment of diseases and clinical conditions associated with KIAA1111. MGC32104 (Accession NM_144684) is another VGAM1399 host target gene. MGC32104 BINDING SITE is HOST TARGET binding site found in the 3' untranslated region of mRNA encoded by MGC32104, corresponding to a HOST TARGET binding site such as BINDING SITE I, BINDING SITE II or BINDING SITE III. Table 2 illustrates the complementarity of the nucleotide sequences of MGC32104 BINDING SITE, designated SEQ ID:29507, to the nucleotide sequence of VGAM1399 RNA, herein designated VGAM RNA, also designated SEQ ID:4110.

Another function of VGAM1399 is therefore inhibition of MGC32104 (Accession NM_144684). Accordingly, utilities of VGAM1399 include diagnosis, prevention and treatment of diseases and clinical conditions associated with MGC32104. FIG. 1 further provides a conceptual description of a novel bioinformatically detected viral gene of the present invention, referred to here as Viral Genomic Address Messenger 1400 (VGAM1400) viral gene, which modulates expression of respective host target genes thereof, the function and utility of which host target genes is known in the art.

VGAM1400 is a novel bioinformatically detected regulatory, non protein coding, viral micro RNA (miRNA) gene. The method by which VGAM1400 was detected is described hereinabove with reference to FIGS. 1-8.

VGAM1400 gene, herein designated VGAM GENE, is a viral gene contained in the genome of Perina Nuda Picorna-like Virus. VGAM1400 host target gene, herein designated VGAM HOST TARGET GENE, is a human gene contained in the human genome.

VGAM1400 gene encodes a VGAM1400 precursor RNA, herein designated VGAM PRECURSOR RNA. Similar to other miRNA genes, and unlike most ordinary genes, VGAM1400 precursor RNA does not encode a protein. A nucleotide sequence identical or highly similar to the nucleotide sequence of VGAM1400 precursor RNA is designated SEQ ID:1386, and is provided hereinbelow with reference to the sequence listing part. Nucleotide sequence SEQ ID:1386 is located at position 2576 relative to the genome of Perina Nuda Picorna-like Virus.

VGAM1400 precursor RNA folds onto itself, forming VGAM1400 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1400 folded precursor RNA into VGAM1400 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1400 RNA is designated SEQ ID:4111, and is provided hereinbelow with reference to the sequence listing part.

VGAM1400 host target gene, herein designated VGAM HOST TARGET GENE, encodes a corresponding messenger RNA, VGAM1400 host target RNA, herein designated VGAM HOST TARGET RNA. VGAM1400 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1400 RNA, herein designated VGAM RNA, binds complementarily to one or more host target binding sites located in untranslated regions of VGAM1400 host target RNA, herein designated VGAM HOST TARGET RNA. This complementary binding is due to the fact that the nucleotide sequence of VGAM1400 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1400 RNA, herein designated VGAM RNA, may have a different number of host target binding sites in untranslated regions of a VGAM1400 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1400 RNA, herein designated VGAM RNA, to host target binding sites on VGAM1400 host target RNA, herein designated VGAM HOST TARGET RNA, such as BINDING SITE I, BINDING SITE II and BINDING SITE III, inhibits translation of VGAM1400 host target RNA into VGAM1400 host target protein, herein designated VGAM HOST TARGET PROTEIN. VGAM host target protein is therefore outlined by a broken line.

It is appreciated that VGAM1400 host target gene, herein designated VGAM HOST TARGET GENE, in fact represents a plurality of VGAM1400 host target genes. The mRNA of each one of this plurality of VGAM1400 host target genes comprises one or more host target binding sites, each having a nucleotide sequence which is at least partly complementary to VGAM1400 RNA, herein designated VGAM RNA, and which when bound by VGAM1400 RNA causes inhibition of translation of respective one or more VGAM1400 host target proteins.

It is further appreciated by one skilled in the art that the mode of translational inhibition illustrated by FIG. 1 with specific reference to translational inhibition exerted by VGAM1400 gene, herein designated VGAM GENE, on one or more VGAM1400 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1400 is inhibition of expression of host target genes, as part of a novel viral mechanism of attacking a host. Accordingly, utilities of VGAM1400 include diagnosis, prevention and treatment of viral infection by Perina Nuda Picorna-like Virus. Specific functions, and accordingly utilities, of VGAM1400 correlate with, and may be deduced from, the identity of the host target genes which VGAM1400 binds and inhibits, and the function of these host target genes, as elaborated hereinbelow.

Nucleotide sequences of the VGAM1400 precursor RNA, herein designated VGAM PRECURSOR RNA, and of the 'diced' VGAM1400 RNA, herein designated VGAM RNA, and a schematic representation of the secondary folding of VGAM1400 folded precursor RNA, herein designated VGAM FOLDED PRECURSOR RNA, of VGAM1400 are further described hereinbelow with reference to Table 1.

Nucleotide sequences of host target binding sites, such as BINDING SITE-I, BINDING SITE-II and BINDING SITE-III of FIG. 1, found on VGAM1400 host target RNA, and schematic representation of the complementarity of each of these host target binding sites to VGAM1400 RNA, herein designated VGAM RNA, are described hereinbelow with reference to Table 2.

As mentioned hereinabove with reference to FIG. 1, a function of VGAM1400 gene, herein designated VGAM is inhibition of expression of VGAM1400 target genes. It is appreciated that specific functions, and accordingly utilities, of VGAM1400 correlate with, and may be deduced from, the identity of the target genes which VGAM1400 binds and inhibits, and the function of these target genes, as elaborated hereinbelow.

KIAA0379 (Accession XM_042860) is a VGAM1400 host target gene. KIAA0379 BINDING SITE is HOST TARGET binding site found in the 3' untranslated region of mRNA encoded by KIAA0379, corresponding to a HOST TARGET binding site such as BINDING SITE I, BINDING SITE II or BINDING SITE III. Table 2 illustrates the complementarity of the nucleotide sequences of KIAA0379 BINDING SITE, designated SEQ ID:33811, to the nucleotide sequence of VGAM1400 RNA, herein designated VGAM RNA, also designated SEQ ID:4111.

A function of VGAM1400 is therefore inhibition of KIAA0379 (Accession XM_042860). Accordingly, utilities of VGAM1400 include diagnosis, prevention and treatment of diseases and clinical conditions associated with KIAA0379. KIAA1610 (Accession XM_040622) is another VGAM1400 host target gene. KIAA1610 BINDING SITE is HOST TARGET binding site found in the 3' untranslated region of mRNA encoded by KIAA1610, corresponding to a HOST TARGET binding site such as BINDING SITE I, BINDING SITE II or BINDING SITE III. Table 2 illustrates the complementarity of the nucleotide sequences of KIAA1610 BINDING SITE, designated SEQ ID:33340, to the nucleotide sequence of VGAM1400 RNA, herein designated VGAM RNA, also designated SEQ ID:4111.

Another function of VGAM1400 is therefore inhibition of KIAA1610 (Accession XM_040622). Accordingly, utilities of VGAM1400 include diagnosis, prevention and treatment of diseases and clinical conditions associated with KIAA1610. FIG. 1 further provides a conceptual description of a novel bioinformatically detected viral gene of the present invention, referred to here as Viral Genomic Address Messenger 1401 (VGAM1401) viral gene, which modulates expression of respective host target genes thereof, the function and utility of which host target genes is known in the art.

VGAM1401 is a novel bioinformatically detected regulatory, non protein coding, viral micro RNA (miRNA) gene. The method by which VGAM1401 was detected is described hereinabove with reference to FIGS. 1-8.

VGAM1401 gene, herein designated VGAM GENE, is a viral gene contained in the genome of Perina Nuda Picorna-like Virus. VGAM1401 host target gene, herein designated VGAM HOST TARGET GENE, is a human gene contained in the human genome.

VGAM1401 gene encodes a VGAM1401 precursor RNA, herein designated VGAM PRECURSOR RNA. Similar to other miRNA genes, and unlike most ordinary genes, VGAM1401 precursor RNA does not encode a protein. A nucleotide sequence identical or highly similar to the nucleotide sequence of VGAM1401 precursor RNA is designated SEQ ID:1387, and is provided hereinbelow with reference to the sequence listing part. Nucleotide sequence SEQ ID:1387 is located at position 7823 relative to the genome of Perina Nuda Picorna-like Virus.

VGAM1401 precursor RNA folds onto itself, forming VGAM1401 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1401 folded precursor RNA into VGAM1401 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1401 RNA is designated SEQ ID:4112, and is provided hereinbelow with reference to the sequence listing part.

VGAM1401 host target gene, herein designated VGAM HOST TARGET GENE, encodes a corresponding messenger RNA, VGAM1401 host target RNA, herein designated VGAM HOST TARGET RNA. VGAM1401 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1401 RNA, herein designated VGAM RNA, binds complementarily to one or more host target binding sites located in untranslated regions of VGAM1401 host target RNA, herein designated VGAM HOST TARGET RNA. This complementary binding is due to the fact that the nucleotide sequence of VGAM1401 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1401 RNA, herein designated VGAM RNA, may have a different number of host target binding sites in untranslated regions of a VGAM1401 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1401 RNA, herein designated VGAM RNA, to host target binding sites on VGAM1401 host target RNA, herein designated VGAM HOST TARGET RNA, such as BINDING SITE I, BINDING SITE II and BINDING SITE III, inhibits translation of VGAM1401 host target RNA into VGAM1401 host target protein, herein designated VGAM HOST TARGET PROTEIN. VGAM host target protein is therefore outlined by a broken line.

It is appreciated that VGAM1401 host target gene, herein designated VGAM HOST TARGET GENE, in fact represents a plurality of VGAM1401 host target genes. The mRNA of each one of this plurality of VGAM1401 host target genes comprises one or more host target binding sites, each having a nucleotide sequence which is at least partly complementary to VGAM1401 RNA, herein designated VGAM RNA, and which when bound by VGAM1401 RNA causes inhibition of translation of respective one or more VGAM1401 host target proteins.

It is further appreciated by one skilled in the art that the mode of translational inhibition illustrated by FIG. 1 with specific reference to translational inhibition exerted by VGAM1401 gene, herein designated VGAM GENE, on one or more VGAM1401 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1401 is inhibition of expression of host target genes, as part of a novel viral mechanism of attacking a host. Accordingly, utilities of VGAM1401 include diagnosis, prevention and treatment of viral infection by Perina Nuda Picorna-like Virus. Specific functions, and accordingly utilities, of VGAM1401 correlate with, and may be deduced from, the identity of the host target genes which VGAM1401 binds and inhibits, and the function of these host target genes, as elaborated hereinbelow.

Nucleotide sequences of the VGAM1401 precursor RNA, herein designated VGAM PRECURSOR RNA, and of the 'diced' VGAM1401 RNA, herein designated VGAM RNA, and a schematic representation of the secondary folding of VGAM1401 folded precursor RNA, herein designated VGAM FOLDED PRECURSOR RNA, of VGAM1401 are further described hereinbelow with reference to Table 1.

Nucleotide sequences of host target binding sites, such as BINDING SITE-I, BINDING SITE-II and BINDING SITE-III of FIG. 1, found on VGAM1401 host target RNA, and schematic representation of the complementarity of each of these host target binding sites to VGAM1401 RNA, herein designated VGAM RNA, are described hereinbelow with reference to Table 2.

As mentioned hereinabove with reference to FIG. 1, a function of VGAM1401 gene, herein designated VGAM is inhibition of expression of VGAM1401 target genes. It is appreciated that specific functions, and accordingly utilities, of VGAM1401 correlate with, and may be deduced from, the identity of the target genes which VGAM1401 binds and inhibits, and the function of these target genes, as elaborated hereinbelow.

Hypoxia-inducible Factor 1, Alpha Subunit (basic helix-loop-helix transcription factor) (HIF1A, Accession NM_001530) is a VGAM1401 host target gene. HIF1A BINDING SITE is HOST TARGET binding site found in the 3" untranslated region of mRNA encoded by HIF1A, corresponding to a HOST TARGET binding site such as BINDING SITE I, BINDING SITE II or BINDING SITE III. Table 2 illustrates the complementarity of the nucleotide sequences of HIF1A BINDING SITE, designated SEQ ID:7269, to the nucleotide sequence of VGAM1401 RNA, herein designated VGAM RNA, also designated SEQ ID:4112.

A function of VGAM1401 is therefore inhibition of Hypoxia-inducible Factor 1, Alpha Subunit (basic helix-loop-helix transcription factor) (HIF1A, Accession NM_001530), a gene which is a basic helix-loop-helix transcription factor and mediates transcriptional responses to hypoxia and dioxin-signaling. Accordingly, utilities of VGAM1401 include diagnosis, prevention and treatment of diseases and clinical conditions associated with HIF1A. The function of HIF1A and its association with various diseases and clinical conditions, has been established by previous studies, as described hereinabove with reference to VGAM229. Potassium Voltage-gated Channel, Delayed-rectifier, Subfamily S, Member 2 (KCNS2, Accession XM_043106) is another VGAM1401 host target gene. KCNS2 BINDING SITE is HOST TARGET binding site found in the 3' untranslated region of mRNA encoded by KCNS2, corresponding to a HOST TARGET binding site such as BINDING SITE I, BINDING SITE II or BINDING SITE III. Table 2 illustrates the complementarity of the nucleotide sequences of KCNS2 BINDING SITE, designated SEQ ID:33897, to the nucleotide sequence of VGAM1401 RNA, herein designated VGAM RNA, also designated SEQ ID:4112.

Another function of VGAM1401 is therefore inhibition of Potassium Voltage-gated Channel, Delayed-rectifier, Subfamily S, Member 2 (KCNS2, Accession XM_043106), a gene which mediates the voltage-dependent potassium ion permeability of excitable membranes. Accordingly, utilities of VGAM1401 include diagnosis, prevention and treatment of diseases and clinical conditions associated with KCNS2. The function of KCNS2 and its association with various diseases and clinical conditions, has been established by previous studies, as described hereinabove with reference to VGAM419. RB1-inducible Coiled-coil 1 (RB1CC1, Accession NM_014781) is another VGAM1401 host target gene. RB1CC1 BINDING SITE is HOST TARGET binding site found in the 3' untranslated region of mRNA encoded by RB1CC1, corresponding to a HOST TARGET binding site such as BINDING SITE I, BINDING SITE II or BINDING SITE III. Table 2 illustrates the complementarity of the nucleotide sequences of RB1CC1 BINDING SITE, designated SEQ ID:16632, to the nucleotide sequence of VGAM1401 RNA, herein designated VGAM RNA, also designated SEQ ID:4112.

Another function of VGAM1401 is therefore inhibition of RB1-inducible Coiled-coil 1 (RB1CC1, Accession NM_014781), a gene which is likely to participate in nuclear architecture by connecting chromatin with the nuclear matrix or envelope. Accordingly, utilities of VGAM1401 include diagnosis, prevention and treatment of diseases and clinical conditions associated with RB1CC1. The function of RB1CC1 and its association with various diseases and clinical conditions, has been established by previous studies, as described hereinabove with reference to VGAM18. Sterol-C5-desaturase (ERG3 delta-5-desaturase homolog, fungal)-like (SC5DL, Accession XM_165583) is another VGAM1401 host target gene. SC5DL BINDING SITE is HOST TARGET binding site found in the 3' untranslated region of mRNA encoded by SC5DL, corresponding to a HOST TARGET binding site such as BINDING SITE I, BINDING SITE II or BINDING SITE III. Table 2 illustrates the complementarity of the nucleotide sequences of SC5DL BINDING SITE, designated SEQ ID:43697, to the nucleotide sequence of VGAM1401 RNA, herein designated VGAM RNA, also designated SEQ ID:4112.

Another function of VGAM1401 is therefore inhibition of Sterol-C5-desaturase (ERG3 delta-5-desaturase homolog, fungal)-like (SC5DL, Accession XM_165583). Accordingly, utilities of VGAM1401 include diagnosis, prevention and treatment of diseases and clinical conditions associated with SC5DL. Secreted Frizzled-related Protein 4 (SFRP4, Accession NM_003014) is another VGAM1401 host target gene. SFRP4 BINDING SITE is HOST TARGET binding site found in the 3' untranslated region of mRNA encoded by SFRP4, corresponding to a HOST TARGET binding site such as BINDING SITE I, BINDING SITE II or BINDING SITE III. Table 2 illustrates the complementarity of the nucleotide sequences of SFRP4 BINDING SITE, designated SEQ ID:8939, to the nucleotide sequence of VGAM1401 RNA, herein designated VGAM RNA, also designated SEQ ID:4112.

Another function of VGAM1401 is therefore inhibition of Secreted Frizzled-related Protein 4 (SFRP4, Accession NM_003014). Accordingly, utilities of VGAM1401 include diagnosis, prevention and treatment of diseases and clinical conditions associated with SFRP4. Short Stature Homeobox (SHOX, Accession NM_000451) is another VGAM1401 host target gene. SHOX BINDING SITE is HOST TARGET binding site found in the 3' untranslated region of mRNA encoded by SHOX, corresponding to a HOST TARGET binding site such as BINDING SITE I, BINDING SITE II or BINDING SITE III. Table 2 illustrates the complementarity of the nucleotide sequences of SHOX BINDING SITE, designated SEQ ID:6057, to the nucleotide sequence of VGAM1401 RNA, herein designated VGAM RNA, also designated SEQ ID:4112.

Another function of VGAM1401 is therefore inhibition of Short Stature Homeobox (SHOX, Accession NM_000451). Accordingly, utilities of VGAM1401 include diagnosis, prevention and treatment of diseases and clinical conditions associated with SHOX. SudD Suppressor of BimD6 Homolog (A. nidulans) (SUDD, Accession NM_003831) is another VGAM1401 host target gene. SUDD BINDING SITE is HOST TARGET binding site found in the 3' untranslated region of mRNA encoded by SUDD, corresponding to a HOST TARGET binding site such as BINDING SITE I, BINDING SITE II or BINDING SITE III. Table 2 illustrates the complementarity of the nucleotide sequences of SUDD BINDING SITE, designated SEQ ID:9923, to the nucleotide sequence of VGAM1401 RNA, herein designated VGAM RNA, also designated SEQ ID:4112.

Another function of VGAM1401 is therefore inhibition of SudD Suppressor of BimD6 Homolog (A. nidulans) (SUDD, Accession NM_003831). Accordingly, utilities of VGAM1401 include diagnosis, prevention and treatment of diseases and clinical conditions associated with SUDD. SUV39H2 (Accession NM_024670) is another VGAM1401 host target gene. SUV39H2 BINDING SITE is HOST TARGET binding site found in the 3" untranslated region of mRNA encoded by SUV39H2, corresponding to a HOST TARGET binding site such as BINDING SITE I, BINDING SITE II or BINDING SITE III. Table 2 illustrates the complementarity of the nucleotide sequences of SUV39H2 BINDING SITE, designated SEQ ID:23976, to the nucleotide sequence of VGAM1401 RNA, herein designated VGAM RNA, also designated SEQ ID:4112.

Another function of VGAM1401 is therefore inhibition of SUV39H2 (Accession NM_024670), a gene which is involved in gene repression and the modification of position-effect- variegation. Accordingly, utilities of VGAM1401 include diagnosis, prevention and treatment of diseases and clinical conditions associated with SUV39H2. The function of SUV39H2 and its association with various diseases and clinical conditions, has been established by previous studies, as described hereinabove with reference to VGAM424. Ubiquitin-like 3 (UBL3, Accession NM_007106) is another VGAM1401 host target gene. UBL3 BINDING SITE is HOST TARGET binding site found in the 3' untranslated region of mRNA encoded by UBL3, corresponding to a HOST TARGET binding site such as BINDING SITE I, BINDING SITE II or BINDING SITE III. Table 2 illustrates the complementarity of the nucleotide sequences of UBL3 BINDING SITE, designated SEQ ID:13967, to the nucleotide sequence of VGAM1401 RNA, herein designated VGAM RNA, also designated SEQ ID:4112.

Another function of VGAM1401 is therefore inhibition of Ubiquitin-like 3 (UBL3, Accession NM_007106), a gene which appears to have a diverse range of cellular functions.

Accordingly, utilities of VGAM1401 include diagnosis, prevention and treatment of diseases and clinical conditions associated with UBL3. The function of UBL3 and its association with various diseases and clinical conditions, has been established by previous studies, as described hereinabove with reference to VGAM459. FLJ23074 (Accession NM_025052) is another VGAM1401 host target gene. FLJ23074 BINDING SITE is HOST TARGET binding site found in the 3' untranslated region of mRNA encoded by FLJ23074, corresponding to a HOST TARGET binding site such as BINDING SITE I, BINDING SITE II or BINDING SITE III. Table 2 illustrates the complementarity of the nucleotide sequences of FLJ23074 BINDING SITE, designated SEQ ID:24650, to the nucleotide sequence of VGAM1401 RNA, herein designated VGAM RNA, also designated SEQ ID:4112.

Another function of VGAM1401 is therefore inhibition of FLJ23074 (Accession NM_025052). Accordingly, utilities of VGAM1401 include diagnosis, prevention and treatment of diseases and clinical conditions associated with FLJ23074. SFRS Protein Kinase 1 (SRPK1, Accession NM_003137) is another VGAM1401 host target gene. SRPK1 BINDING SITE is HOST TARGET binding site found in the 3' untranslated region of mRNA encoded by SRPK1, corresponding to a HOST TARGET binding site such as BINDING SITE I, BINDING SITE II or BINDING SITE III. Table 2 illustrates the complementarity of the nucleotide sequences of SRPK1 BINDING SITE, designated SEQ ID:9107, to the nucleotide sequence of VGAM1401 RNA, herein designated VGAM RNA, also designated SEQ ID:4112.

Another function of VGAM1401 is therefore inhibition of SFRS Protein Kinase 1 (SRPK1, Accession NM_003137). Accordingly, utilities of VGAM1401 include diagnosis, prevention and treatment of diseases and clinical conditions associated with SRPK1. LOC158130 (Accession XM_044880) is another VGAM1401 host target gene. LOC158130 BINDING SITE is HOST TARGET binding site found in the 3' untranslated region of mRNA encoded by LOC158130, corresponding to a HOST TARGET binding site such as BINDING SITE I, BINDING SITE II or BINDING SITE III. Table 2 illustrates the complementarity of the nucleotide sequences of LOC158130 BINDING SITE, designated SEQ ID:34302, to the nucleotide sequence of VGAM1401 RNA, herein designated VGAM RNA, also designated SEQ ID:4112.

Another function of VGAM1401 is therefore inhibition of LOC158130 (Accession XM_044880). Accordingly, utilities of VGAM1401 include diagnosis, prevention and treatment of diseases and clinical conditions associated with LOC158130. LOC202781 (Accession XM_117455) is another VGAM1401 host target gene. LOC202781 BINDING SITE is HOST TARGET binding site found in the 3' untranslated region of mRNA encoded by LOC202781, corresponding to a HOST TARGET binding site such as BINDING SITE I, BINDING SITE II or BINDING SITE III. Table 2 illustrates the complementarity of the nucleotide sequences of LOC202781 BINDING SITE, designated SEQ ID:43442, to the nucleotide sequence of VGAM1401 RNA, herein designated VGAM RNA, also designated SEQ ID:4112.

Another function of VGAM1401 is therefore inhibition of LOC202781 (Accession XM_117455). Accordingly, utilities of VGAM1401 include diagnosis, prevention and treatment of diseases and clinical conditions associated with LOC202781. LOC221962 (Accession XM_166554) is another VGAM1401 host target gene. LOC221962 BINDING SITE is HOST TARGET binding site found in the 3' untranslated region of mRNA encoded by LOC221962, corresponding to a HOST TARGET binding site such as BINDING SITE I, BINDING SITE II or BINDING SITE III. Table 2 illustrates the complementarity of the nucleotide sequences of LOC221962 BINDING SITE, designated SEQ ID:44530, to the nucleotide sequence of VGAM1401 RNA, herein designated VGAM RNA, also designated SEQ ID:4112.

Another function of VGAM1401 is therefore inhibition of LOC221962 (Accession XM_166554). Accordingly, utilities of VGAM1401 include diagnosis, prevention and treatment of diseases and clinical conditions associated with LOC221962. FIG. 1 further provides a conceptual description of a novel bioinformatically detected viral gene of the present invention, referred to here as Viral Genomic Address Messenger 1402 (VGAM1402) viral gene, which modulates expression of respective host target genes thereof, the function and utility of which host target genes is known in the art.

VGAM1402 is a novel bioinformatically detected regulatory, non protein coding, viral micro RNA (miRNA) gene. The method by which VGAM1402 was detected is described hereinabove with reference to FIGS. 1-8.

VGAM1402 gene, herein designated VGAM GENE, is a viral gene contained in the genome of Perina Nuda Picorna-like Virus. VGAM1402 host target gene, herein designated VGAM HOST TARGET GENE, is a human gene contained in the human genome.

VGAM1402 gene encodes a VGAM1402 precursor RNA, herein designated VGAM PRECURSOR RNA. Similar to other miRNA genes, and unlike most ordinary genes, VGAM1402 precursor RNA does not encode a protein. A nucleotide sequence identical or highly similar to the nucleotide sequence of VGAM1402 precursor RNA is designated SEQ ID:1388, and is provided hereinbelow with reference to the sequence listing part. Nucleotide sequence SEQ ID:1388 is located at position 7345 relative to the genome of Perina Nuda Picorna-like Virus.

VGAM1402 precursor RNA folds onto itself, forming VGAM1402 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1402 folded precursor RNA into VGAM1402 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1402 RNA is designated SEQ ID:4113, and is provided hereinbelow with reference to the sequence listing part.

VGAM1402 host target gene, herein designated VGAM HOST TARGET GENE, encodes a corresponding messenger RNA, VGAM1402 host target RNA, herein designated VGAM HOST TARGET RNA. VGAM1402 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1402 RNA, herein designated VGAM RNA, binds complementarily to one or more host target binding sites located in untranslated regions of VGAM1402 host target RNA, herein designated VGAM HOST TARGET RNA. This complementary binding is due to the fact that the nucleotide sequence of VGAM1402 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1402 RNA, herein designated VGAM RNA, may have a different number of host target binding sites in untranslated regions of a VGAM1402 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1402 RNA, herein designated VGAM RNA, to host target binding sites on VGAM1402 host target RNA, herein designated VGAM HOST TARGET RNA, such as BINDING SITE I, BINDING SITE II and BINDING SITE III, inhibits translation of VGAM1402 host target RNA into VGAM1402 host target protein, herein designated VGAM HOST TARGET PROTEIN. VGAM host target protein is therefore outlined by a broken line.

It is appreciated that VGAM1402 host target gene, herein designated VGAM HOST TARGET GENE, in fact represents a plurality of VGAM1402 host target genes. The mRNA of each one of this plurality of VGAM1402 host target genes comprises one or more host target binding sites, each having a nucleotide sequence which is at least partly complementary to VGAM1402 RNA, herein designated VGAM RNA, and which when bound by VGAM1402 RNA causes inhibition of translation of respective one or more VGAM1402 host target proteins.

It is further appreciated by one skilled in the art that the mode of translational inhibition illustrated by FIG. 1 with specific reference to translational inhibition exerted by VGAM1402 gene, herein designated VGAM GENE, on one or more VGAM1402 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1402 is inhibition of expression of host target genes, as part of a novel viral mechanism of attacking a host. Accordingly, utilities of VGAM1402 include diagnosis, prevention and treatment of viral infection by Perina Nuda Picorna-like Virus. Specific functions, and accordingly utilities, of VGAM1402 correlate with, and may be deduced from, the identity of the host target genes which VGAM1402 binds and inhibits, and the function of these host target genes, as elaborated hereinbelow.

Nucleotide sequences of the VGAM1402 precursor RNA, herein designated VGAM PRECURSOR RNA, and of the 'diced' VGAM1402 RNA, herein designated VGAM RNA, and a schematic representation of the secondary folding of VGAM1402 folded precursor RNA, herein designated VGAM FOLDED PRECURSOR RNA, of VGAM1402 are further described hereinbelow with reference to Table 1.

Nucleotide sequences of host target binding sites, such as BINDING SITE-I, BINDING SITE-II and BINDING SITE-III of FIG. 1, found on VGAM1402 host target RNA, and schematic representation of the complementarity of each of these host target binding sites to VGAM1402 RNA, herein designated VGAM RNA, are described hereinbelow with reference to Table 2.

As mentioned hereinabove with reference to FIG. 1, a function of VGAM1402 gene, herein designated VGAM is inhibition of expression of VGAM1402 target genes. It is appreciated that specific functions, and accordingly utilities, of VGAM1402 correlate with, and may be deduced from, the identity of the target genes which VGAM1402 binds and inhibits, and the function of these target genes, as elaborated hereinbelow.

LOC90342 (Accession XM_031009) is a VGAM1402 host target gene. LOC90342 BINDING SITE is HOST TARGET binding site found in the 5' untranslated region of mRNA encoded by LOC90342, corresponding to a HOST TARGET binding site such as BINDING SITE I, BINDING SITE II or BINDING SITE III. Table 2 illustrates the complementarity of the nucleotide sequences of LOC90342 BINDING SITE, designated SEQ ID:31248, to the nucleotide sequence of VGAM1402 RNA, herein designated VGAM RNA, also designated SEQ ID:4113.

A function of VGAM1402 is therefore inhibition of LOC90342 (Accession XM_031009). Accordingly, utilities of VGAM1402 include diagnosis, prevention and treatment of diseases and clinical conditions associated with LOC90342. FIG. 1 further provides a conceptual description of a novel bioinformatically detected viral gene of the present invention, referred to here as Viral Genomic Address Messenger 1403 (VGAM1403) viral gene, which modulates expression of respective host target genes thereof, the function and utility of which host target genes is known in the art.

VGAM1403 is a novel bioinformatically detected regulatory, non protein coding, viral micro RNA (miRNA) gene. The method by which VGAM1403 was detected is described hereinabove with reference to FIGS. 1-8.

VGAM1403 gene, herein designated VGAM GENE, is a viral gene contained in the genome of Perina Nuda Picorna-like Virus. VGAM1403 host target gene, herein designated VGAM HOST TARGET GENE, is a human gene contained in the human genome.

VGAM1403 gene encodes a VGAM1403 precursor RNA, herein designated VGAM PRECURSOR RNA. Similar to other miRNA genes, and unlike most ordinary genes, VGAM1403 precursor RNA does not encode a protein. A nucleotide sequence identical or highly similar to the nucleotide sequence of VGAM1403 precursor RNA is designated SEQ ID:1389, and is provided hereinbelow with reference to the sequence listing part. Nucleotide sequence SEQ ID:1389 is located at position 7194 relative to the genome of Perina Nuda Picorna-like Virus.

VGAM1403 precursor RNA folds onto itself, forming VGAM1403 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1403 folded precursor RNA into VGAM1403 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1403 RNA is designated SEQ ID:4114, and is provided hereinbelow with reference to the sequence listing part.

VGAM1403 host target gene, herein designated VGAM HOST TARGET GENE, encodes a corresponding messenger RNA, VGAM1403 host target RNA, herein designated VGAM HOST TARGET RNA. VGAM1403 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1403 RNA, herein designated VGAM RNA, binds complementarily to one or more host target binding sites located in untranslated regions of VGAM1403 host target RNA, herein designated VGAM HOST TARGET RNA. This complementary binding is due to the fact that the nucleotide sequence of VGAM1403 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1403 RNA, herein designated VGAM RNA, may have a different number of host target binding sites in untranslated regions of a VGAM1403 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1403 RNA, herein designated VGAM RNA, to host target binding sites on VGAM1403 host target RNA, herein designated VGAM HOST TARGET RNA, such as BINDING SITE I, BINDING SITE II and BINDING SITE III, inhibits translation of VGAM1403 host target RNA into VGAM1403 host target protein, herein designated VGAM HOST TARGET PROTEIN. VGAM host target protein is therefore outlined by a broken line.

It is appreciated that VGAM1403 host target gene, herein designated VGAM HOST TARGET GENE, in fact represents a plurality of VGAM1403 host target genes. The mRNA of each one of this plurality of VGAM1403 host target genes comprises one or more host target binding sites, each having a nucleotide sequence which is at least partly complementary to VGAM1403 RNA, herein designated VGAM RNA, and which when bound by VGAM1403 RNA causes inhibition of translation of respective one or more VGAM1403 host target proteins.

It is further appreciated by one skilled in the art that the mode of translational inhibition illustrated by FIG. 1 with specific reference to translational inhibition exerted by VGAM1403 gene, herein designated VGAM GENE, on one or more VGAM1403 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1403 is inhibition of expression of host target genes, as part of a novel viral mechanism of attacking a host. Accordingly, utilities of VGAM1403 include diagnosis, prevention and treatment of viral infection by Perina Nuda Picorna-like Virus. Specific functions, and accordingly utilities, of VGAM1403 correlate with, and may be deduced from, the identity of the host target genes which VGAM1403 binds and inhibits, and the function of these host target genes, as elaborated hereinbelow.

Nucleotide sequences of the VGAM1403 precursor RNA, herein designated VGAM PRECURSOR RNA, and of the 'diced' VGAM1403 RNA, herein designated VGAM RNA, and a schematic representation of the secondary folding of VGAM1403 folded precursor RNA, herein designated VGAM FOLDED PRECURSOR RNA, of VGAM1403 are further described hereinbelow with reference to Table 1.

Nucleotide sequences of host target binding sites, such as BINDING SITE-I, BINDING SITE-II and BINDING SITE-III of FIG. 1, found on VGAM1403 host target RNA, and schematic representation of the complementarity of each of these host target binding sites to VGAM1403 RNA, herein designated VGAM RNA, are described hereinbelow with reference to Table 2.

As mentioned hereinabove with reference to FIG. 1, a function of VGAM1403 gene, herein designated VGAM is inhibition of expression of VGAM1403 target genes. It is appreciated that specific functions, and accordingly utilities, of VGAM1403 correlate with, and may be deduced from, the identity of the target genes which VGAM1403 binds and inhibits, and the function of these target genes, as elaborated hereinbelow.

Amyotrophic Lateral Sclerosis 2 (juvenile) (ALS2, Accession NM_020919) is a VGAM1403 host target gene. ALS2 BINDING SITE is HOST TARGET binding site found in the 3' untranslated region of mRNA encoded by ALS2, corresponding to a HOST TARGET binding site such as BINDING SITE I, BINDING SITE II or BINDING SITE III. Table 2 illustrates the complementarity of the nucleotide sequences of ALS2 BINDING SITE, designated SEQ ID:21928, to the nucleotide sequence of VGAM1403 RNA, herein designated VGAM RNA, also designated SEQ ID:4114.

A function of VGAM1403 is therefore inhibition of Amyotrophic Lateral Sclerosis 2 (juvenile) (ALS2, Accession NM_020919). Accordingly, utilities of VGAM1403 include diagnosis, prevention and treatment of diseases and clinical conditions associated with ALS2. Aquaporin 6, Kidney Specific (AQP6, Accession NM_053286) is another VGAM1403 host target gene. AQP6 BINDING SITE is HOST TARGET binding site found in the 3' untranslated region of mRNA encoded by AQP6, corresponding to a HOST TARGET binding site such as BINDING SITE I, BINDING SITE II or BINDING SITE III. Table 2 illustrates the complementarity of the nucleotide sequences of AQP6 BINDING SITE, designated SEQ ID:27611, to the nucleotide sequence of VGAM1403 RNA, herein designated VGAM RNA, also designated SEQ ID:4114.

Another function of VGAM1403 is therefore inhibition of Aquaporin 6, Kidney Specific (AQP6, Accession NM_053286), a gene which participates in distinct physiologic function such as glomerular filtration, tubular endocytosis, and acid-base metabolism. Accordingly, utilities of VGAM1403 include diagnosis, prevention and treatment of diseases and clinical conditions associated with AQP6. The function of AQP6 and its association with various diseases and clinical conditions, has been established by previous studies, as described hereinabove with reference to VGAM340. Cadherin 1, Type 1, E-cadherin (epithelial) (CDH1, Accession NM_004360) is another VGAM1403 host target gene. CDH1 BINDING SITE is HOST TARGET binding site found in the 3' untranslated region of mRNA encoded by CDH1, corresponding to a HOST TARGET binding site such as BINDING SITE I, BINDING SITE II or BINDING SITE III. Table 2 illustrates the complementarity of the nucleotide sequences of CDH1 BINDING SITE, designated SEQ ID:10563, to the nucleotide sequence of VGAM1403 RNA, herein designated VGAM RNA, also designated SEQ ID:4114.

Another function of VGAM1403 is therefore inhibition of Cadherin 1, Type 1, E-cadherin (epithelial) (CDH1, Accession NM_004360). Accordingly, utilities of VGAM1403 include diagnosis, prevention and treatment of diseases and clinical conditions associated with CDH1. Cytochrome P450, Subfamily VIIIB (sterol 12-alpha-hydroxylase), Polypeptide 1 (CYP8B1, Accession NM_004391) is another VGAM1403 host target gene. CYP8B1 BINDING SITE is HOST TARGET binding site found in the 5' untranslated region of mRNA encoded by CYP8B1, corresponding to a HOST TARGET binding site such as BINDING SITE I, BINDING SITE II or BINDING SITE III. Table 2 illustrates the complementarity of the nucleotide sequences of CYP8B1 BINDING SITE, designated SEQ ID:10623, to the nucleotide sequence of VGAM1403 RNA, herein designated VGAM RNA, also designated SEQ ID:4114.

Another function of VGAM1403 is therefore inhibition of Cytochrome P450, Subfamily VIIIB (sterol 12-alpha-hydroxylase), Polypeptide 1 (CYP8B1, Accession NM_004391), a gene which functions in bile acid biosynthesis. Accordingly, utilities of VGAM1403 include diagnosis, prevention and treatment of diseases and clinical conditions associated with CYP8B1. The function of CYP8B1 and its association with various diseases and clinical conditions, has been established by previous studies, as described hereinabove with reference to VGAM923. Eukaryotic Translation Initiation Factor 4 Gamma, 1 (EIF4G1, Accession NM_004953) is another VGAM1403 host target gene. EIF4G1 BINDING SITE is HOST TARGET binding site found in the 5' untranslated region of mRNA encoded by EIF4G1, corresponding to a HOST TARGET binding site such as BINDING SITE I, BINDING SITE II or BINDING SITE III. Table 2 illustrates the complementarity of the nucleotide sequences of EIF4G1 BINDING SITE, designated SEQ ID:11396, to the nucleotide sequence of VGAM1403 RNA, herein designated VGAM RNA, also designated SEQ ID:4114.

Another function of VGAM1403 is therefore inhibition of Eukaryotic Translation Initiation Factor 4 Gamma, 1 (EIF4G1, Accession NM_004953), a gene which is a Translation initiation factor. Accordingly, utilities of VGAM1403 include diagnosis, prevention and treatment of diseases and clinical conditions associated with EIF4G1. The function of EIF4G1 has been established by previous studies. Gradi et al. (1998) identified a second human eIF4G gene. They designated the original gene eIF4GI and the novel gene eIF4GII (EIF4G3; 603929). Imataka et al. (1998) found that the human eIF4GI protein contains an additional 156 N-terminal amino acids compared to the sequence published by Yan et al. (1992). They demonstrated that this N-terminal region binds poly (A)-binding protein (PABP; 604679). In an in vitro translation system, an N-terminal fragment of eIF4GI that included the PABP-binding site inhibited poly (A)-dependent translation, but had no effect on translation of a deadenylated mRNA. Imataka et al. (1998) concluded that eIF4G probably functions in poly (A)-dependent translation in mammalian cells. By screening a rabbit brain library with oligonucleotide probes based on the sequence of rabbit eIF4-gamma peptides, Yan et al. (1992) identified partial eIF4-gamma cDNAs. They used the rabbit cDNAs as probes and isolated human brain cDNAs encoding eIF4-gamma. The predicted human protein contains 1,396 amino acids. Western blot analysis of poliovirus-infected HeLa cell extracts revealed that eIF4-gamma has an apparent molecular weight of 200 to 220 kD and is cleaved by this picornavirus. Imataka and Sonenberg (1997) stated that the N-terminal region of eIF4G contains a binding site for eIF4E. They demonstrated that the central third of eIF4G contains an eIF3 (see OMIM Ref. No. 602039)-binding region and an eIF4A-binding domain. A second, separate eIF4A-binding site is present in the C-terminal third. Neither eIF4A-binding domain alone activates translation. In contrast to eIF4G, the eIF4G-related translation regulator p97 (OMIM Ref. No. 602325) binds eIF4A only through its N-terminal domain, which is homologous to the central domain of eIF4G Full details of the abovementioned studies are described in the following publications, the disclosure of which are hereby incorporated by reference:

Imataka, H.; Gradi, A.; Sonenberg, N.: A newly identified N-terminal amino acid sequence of human eIF4G binds poly (A)-binding protein and functions in poly (A)-dependent translation. EMBO J. 17:7480-7489, 1998; and Imataka, H.; Sonenberg, N.: Human eukaryotic translation initiation factor 4G (eIF4G) possesses two separate and independent binding sites for eIF4A. Molec. Cell. Biol. 17:6940-6947.

Further studies establishing the function and utilities of EIF4G1 are found in John Hopkins OMIM database record ID 600495, and in sited publications numbered 10197-10200, 821 and 10201-10202 listed in the bibliography section hereinbelow, which are also hereby incorporated by reference. Solute Carrier Family 1 (neutral amino acid transporter), Member 5 (SLC1A5, Accession NM_005628) is another VGAM1403 host target gene. SLC1A5 BINDING SITE1 and SLC1A5 BINDING SITE2 are HOST TARGET binding sites found in untranslated regions of mRNA encoded by SLC1A5, corresponding to HOST TARGET binding sites such as BINDING SITE I, BINDING SITE II or BINDING SITE III. Table 2 illustrates the complementarity of the nucleotide sequences of SLC1A5 BINDING SITE1 and SLC1A5 BINDING SITE2, designated SEQ ID:12141 and SEQ ID:38401 respectively, to the nucleotide sequence of VGAM1403 RNA, herein designated VGAM RNA, also designated SEQ ID:4114.

Another function of VGAM1403 is therefore inhibition of Solute Carrier Family 1 (neutral amino acid transporter), Member 5 (SLC1A5, Accession NM_005628). Accordingly, utilities of VGAM1403 include diagnosis, prevention and treatment of diseases and clinical conditions associated with SLC1A5. FLJ20033 (Accession NM_017629) is another VGAM1403 host target gene. FLJ20033 BINDING SITE is HOST TARGET binding site found in the 3' untranslated region of mRNA encoded by FLJ20033, corresponding to a HOST TARGET binding site such as BINDING SITE I, BINDING SITE II or BINDING SITE III. Table 2 illustrates the complementarity of the nucleotide sequences of FLJ20033 BINDING SITE, designated SEQ ID:19126, to the nucleotide sequence of VGAM1403 RNA, herein designated VGAM RNA, also designated SEQ ID:4114.

Another function of VGAM1403 is therefore inhibition of FLJ20033 (Accession NM_017629). Accordingly, utilities of VGAM1403 include diagnosis, prevention and treatment of diseases and clinical conditions associated with FLJ20033. FIG. 1 further provides a conceptual description of a novel bioinformatically detected viral gene of the present invention, referred to here as Viral Genomic Address Messenger 1404 (VGAM1404) viral gene, which modulates expression of respective host target genes thereof, the function and utility of which host target genes is known in the art.

VGAM1404 is a novel bioinformatically detected regulatory, non protein coding, viral micro RNA (miRNA) gene. The method by which VGAM1404 was detected is described hereinabove with reference to FIGS. 1-8.

VGAM1404 gene, herein designated VGAM GENE, is a viral gene contained in the genome of Perina Nuda Picorna-like Virus. VGAM1404 host target gene, herein designated VGAM HOST TARGET GENE, is a human gene contained in the human genome.

VGAM1404 gene encodes a VGAM1404 precursor RNA, herein designated VGAM PRECURSOR RNA. Similar to other miRNA genes, and unlike most ordinary genes, VGAM1404 precursor RNA does not encode a protein. A nucleotide sequence identical or highly similar to the nucleotide sequence of VGAM1404 precursor RNA is designated SEQ ID:1390, and is provided hereinbelow with reference to the sequence listing part. Nucleotide sequence SEQ ID:1390 is located at position 8964 relative to the genome of Perina Nuda Picorna-like Virus.

VGAM1404 precursor RNA folds onto itself, forming VGAM1404 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1404 folded precursor RNA into VGAM1404 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 62%) nucleotide sequence of VGAM1404 RNA is designated SEQ ID:4115, and is provided hereinbelow with reference to the sequence listing part.

VGAM1404 host target gene, herein designated VGAM HOST TARGET GENE, encodes a corresponding messenger RNA, VGAM1404 host target RNA, herein designated VGAM HOST TARGET RNA. VGAM1404 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1404 RNA, herein designated VGAM RNA, binds complementarily to one or more host target binding sites located in untranslated regions of VGAM1404 host target RNA, herein designated VGAM HOST TARGET RNA. This complementary binding is due to the fact that the nucleotide sequence of VGAM1404 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1404 RNA, herein designated VGAM RNA, may have a different number of host target binding sites in untranslated regions of a VGAM1404 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1404 RNA, herein designated VGAM RNA, to host target binding sites on VGAM1404 host target RNA, herein designated VGAM HOST TARGET RNA, such as BINDING SITE I, BINDING SITE II and BINDING SITE III, inhibits translation of VGAM1404 host target RNA into VGAM1404 host target protein, herein designated VGAM HOST TARGET PROTEIN. VGAM host target protein is therefore outlined by a broken line.

It is appreciated that VGAM1404 host target gene, herein designated VGAM HOST TARGET GENE, in fact represents a plurality of VGAM1404 host target genes. The mRNA of each one of this plurality of VGAM1404 host target genes comprises one or more host target binding sites, each having a nucleotide sequence which is at least partly complementary to VGAM1404 RNA, herein designated VGAM RNA, and which when bound by VGAM1404 RNA causes inhibition of translation of respective one or more VGAM1404 host target proteins.

It is further appreciated by one skilled in the art that the mode of translational inhibition illustrated by FIG. 1 with specific reference to translational inhibition exerted by VGAM1404 gene, herein designated VGAM GENE, on one or more VGAM1404 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1404 is inhibition of expression of host target genes, as part of a novel viral mechanism of attacking a host. Accordingly, utilities of VGAM1404 include diagnosis, prevention and treatment of viral infection by Perina Nuda Picorna-like Virus. Specific functions, and accordingly utilities, of VGAM1404 correlate with, and may be deduced from, the identity of the host target genes which VGAM1404 binds and inhibits, and the function of these host target genes, as elaborated hereinbelow.

Nucleotide sequences of the VGAM1404 precursor RNA, herein designated VGAM PRECURSOR RNA, and of the 'diced' VGAM1404 RNA, herein designated VGAM RNA, and a schematic representation of the secondary folding of VGAM1404 folded precursor RNA, herein designated VGAM FOLDED PRECURSOR RNA, of VGAM1404 are further described hereinbelow with reference to Table 1.

Nucleotide sequences of host target binding sites, such as BINDING SITE-I, BINDING SITE-II and BINDING SITE- III of FIG. 1, found on VGAM1404 host target RNA, and schematic representation of the complementarity of each of these host target binding sites to VGAM1404 RNA, herein designated VGAM RNA, are described hereinbelow with reference to Table 2.

As mentioned hereinabove with reference to FIG. 1, a function of VGAM1404 gene, herein designated VGAM is inhibition of expression of VGAM1404 target genes. It is appreciated that specific functions, and accordingly utilities, of VGAM1404 correlate with, and may be deduced from, the identity of the target genes which VGAM1404 binds and inhibits, and the function of these target genes, as elaborated hereinbelow.

Apical Protein-like (Xenopus laevis) (APXL, Accession NM_001649) is a VGAM1404 host target gene. APXL BINDING SITE is HOST TARGET binding site found in the 3' untranslated region of mRNA encoded by APXL, corresponding to a HOST TARGET binding site such as BINDING SITE I, BINDING SITE II or BINDING SITE III. Table 2 illustrates the complementarity of the nucleotide sequences of APXL BINDING SITE, designated SEQ ID:7355, to the nucleotide sequence of VGAM1404 RNA, herein designated VGAM RNA, also designated SEQ ID:4115.

A function of VGAM1404 is therefore inhibition of Apical Protein-like (Xenopus laevis) (APXL, Accession NM_001649), a gene which is implicated in amiloride-sensitive sodium channel activity. Accordingly, utilities of VGAM1404 include diagnosis, prevention and treatment of diseases and clinical conditions associated with APXL. The function of APXL and its association with various diseases and clinical conditions, has been established by previous studies, as described hereinabove with reference to VGAM152. KIAA0193 (Accession NM_014766) is another VGAM1404 host target gene. KIAA0193 BINDING SITE is HOST TARGET binding site found in the 3' untranslated region of mRNA encoded by KIAA0193, corresponding to a HOST TARGET binding site such as BINDING SITE I, BINDING SITE II or BINDING SITE III. Table 2 illustrates the complementarity of the nucleotide sequences of KIAA0193 BINDING SITE, designated SEQ ID:16546, to the nucleotide sequence of VGAM1404 RNA, herein designated VGAM RNA, also designated SEQ ID:4115.

Another function of VGAM1404 is therefore inhibition of KIAA0193 (Accession NM_014766). Accordingly, utilities of VGAM1404 include diagnosis, prevention and treatment of diseases and clinical conditions associated with KIAA0193. LOC151414 (Accession XM_087197) is another VGAM1404 host target gene. LOC151414 BINDING SITE is HOST TARGET binding site found in the 3' untranslated region of mRNA encoded by LOC151414, corresponding to a HOST TARGET binding site such as BINDING SITE I, BINDING SITE II or BINDING SITE III. Table 2 illustrates the complementarity of the nucleotide sequences of LOC151414 BINDING SITE, designated SEQ ID:39112, to the nucleotide sequence of VGAM1404 RNA, herein designated VGAM RNA, also designated SEQ ID:4115.

Another function of VGAM1404 is therefore inhibition of LOC151414 (Accession XM_087197). Accordingly, utilities of VGAM1404 include diagnosis, prevention and treatment of diseases and clinical conditions associated with LOC151414. LOC254532 (Accession XM_172961) is another VGAM1404 host target gene. LOC254532 BINDING SITE is HOST TARGET binding site found in the 5' untranslated region of mRNA encoded by LOC254532, corresponding to a HOST TARGET binding site such as BINDING SITE I, BINDING SITE II or BINDING SITE III. Table 2 illustrates the complementarity of the nucleotide sequences of LOC254532 BINDING SITE, designated SEQ ID:46213, to the nucleotide sequence of VGAM1404 RNA, herein designated VGAM RNA, also designated SEQ ID:4115.

Another function of VGAM1404 is therefore inhibition of LOC254532 (Accession XM_172961). Accordingly, utilities of VGAM1404 include diagnosis, prevention and treatment of diseases and clinical conditions associated with LOC254532. FIG. 1 further provides a conceptual description of a novel bioinformatically detected viral gene of the present invention, referred to here as Viral Genomic Address Messenger 1405 (VGAM1405) viral gene, which modulates expression of respective host target genes thereof, the function and utility of which host target genes is known in the art.

VGAM1405 is a novel bioinformatically detected regulatory, non protein coding, viral micro RNA (miRNA) gene. The method by which VGAM1405 was detected is described hereinabove with reference to FIGS. 1-8.

VGAM1405 gene, herein designated VGAM GENE, is a viral gene contained in the genome of Perina Nuda Picorna-like Virus. VGAM1405 host target gene, herein designated VGAM HOST TARGET GENE, is a human gene contained in the human genome.

VGAM1405 gene encodes a VGAM1405 precursor RNA, herein designated VGAM PRECURSOR RNA. Similar to other miRNA genes, and unlike most ordinary genes, VGAM1405 precursor RNA does not encode a protein. A nucleotide sequence identical or highly similar to the nucleotide sequence of VGAM1405 precursor RNA is designated SEQ ID:1391, and is provided hereinbelow with reference to the sequence listing part. Nucleotide sequence SEQ ID:1391 is located at position 3355 relative to the genome of Perina Nuda Picorna-like Virus.

VGAM1405 precursor RNA folds onto itself, forming VGAM1405 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1405 folded precursor RNA into VGAM1405 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM1405 RNA is designated SEQ ID:4116, and is provided hereinbelow with reference to the sequence listing part.

VGAM1405 host target gene, herein designated VGAM HOST TARGET GENE, encodes a corresponding messenger RNA, VGAM1405 host target RNA, herein designated VGAM HOST TARGET RNA. VGAM1405 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1405 RNA, herein designated VGAM RNA, binds complementarily to one or more host target binding sites located in untranslated regions of VGAM1405 host target RNA, herein designated VGAM HOST TARGET RNA. This complementary binding is due to the fact that the nucleotide sequence of VGAM1405 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1405 RNA, herein designated VGAM RNA, may have a different number of host target binding sites in untranslated regions of a VGAM1405 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1405 RNA, herein designated VGAM RNA, to host target binding sites on VGAM1405 host target RNA, herein designated VGAM HOST TARGET RNA, such as BINDING SITE I, BINDING SITE II and BINDING SITE III, inhibits translation of VGAM1405 host target RNA into VGAM1405 host target protein, herein designated VGAM HOST TARGET PROTEIN. VGAM host target protein is therefore outlined by a broken line.

It is appreciated that VGAM1405 host target gene, herein designated VGAM HOST TARGET GENE, in fact represents a plurality of VGAM1405 host target genes. The mRNA of each one of this plurality of VGAM1405 host target genes comprises one or more host target binding sites, each having a nucleotide sequence which is at least partly complementary to VGAM1405 RNA, herein designated VGAM RNA, and which when bound by VGAM1405 RNA causes inhibition of translation of respective one or more VGAM1405 host target proteins.

It is further appreciated by one skilled in the art that the mode of translational inhibition illustrated by FIG. 1 with specific reference to translational inhibition exerted by VGAM1405 gene, herein designated VGAM GENE, on one or more VGAM1405 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1405 is inhibition of expression of host target genes, as part of a novel viral mechanism of attacking a host. Accordingly, utilities of VGAM1405 include diagnosis, prevention and treatment of viral infection by Perina Nuda Picorna-like Virus. Specific functions, and accordingly utilities, of VGAM1405 correlate with, and may be deduced from, the identity of the host target genes which VGAM1405 binds and inhibits, and the function of these host target genes, as elaborated hereinbelow.

Nucleotide sequences of the VGAM1405 precursor RNA, herein designated VGAM PRECURSOR RNA, and of the 'diced' VGAM1405 RNA, herein designated VGAM RNA, and a schematic representation of the secondary folding of VGAM1405 folded precursor RNA, herein designated VGAM FOLDED PRECURSOR RNA, of VGAM1405 are further described hereinbelow with reference to Table 1.

Nucleotide sequences of host target binding sites, such as BINDING SITE-I, BINDING SITE-II and BINDING SITE-III of FIG. 1, found on VGAM1405 host target RNA, and schematic representation of the complementarity of each of these host target binding sites to VGAM1405 RNA, herein designated VGAM RNA, are described hereinbelow with reference to Table 2.

As mentioned hereinabove with reference to FIG. 1, a function of VGAM1405 gene, herein designated VGAM is inhibition of expression of VGAM1405 target genes. It is appreciated that specific functions, and accordingly utilities, of VGAM1405 correlate with, and may be deduced from, the identity of the target genes which VGAM1405 binds and inhibits, and the function of these target genes, as elaborated hereinbelow.

Frizzled Homolog 10 (Drosophila) (FZD10, Accession NM_007197) is a VGAM1405 host target gene. FZD10 BINDING SITE is HOST TARGET binding site found in the 3' untranslated region of mRNA encoded by FZD10, corresponding to a HOST TARGET binding site such as BINDING SITE I, BINDING SITE II or BINDING SITE III. Table 2 illustrates the complementarity of the nucleotide sequences of FZD10 BINDING SITE, designated SEQ ID:14053, to the nucleotide sequence of VGAM1405 RNA, herein designated VGAM RNA, also designated SEQ ID:4116.

A function of VGAM1405 is therefore inhibition of Frizzled Homolog 10 (Drosophila) (FZD10, Accession NM_007197). Accordingly, utilities of VGAM1405 include diagnosis, prevention and treatment of diseases and clinical conditions associated with FZD10. Mitogen-activated Protein Kinase 4 (MAPK4, Accession NM_002747) is another VGAM1405 host target gene. MAPK4 BINDING SITE is HOST TARGET binding site found in the 3' untranslated region of mRNA encoded by MAPK4, corresponding to a HOST TARGET binding site such as BINDING SITE I, BINDING SITE II or BINDING SITE III. Table 2 illustrates the complementarity of the nucleotide sequences of MAPK4 BINDING SITE, designated SEQ ID:8619, to the nucleotide sequence of VGAM1405 RNA, herein designated VGAM RNA, also designated SEQ ID:4116.

Another function of VGAM1405 is therefore inhibition of Mitogen-activated Protein Kinase 4 (MAPK4, Accession NM_002747), a gene which phosphorylates microtubule-associated protein-2 may promote entry into the cell cycle. Accordingly, utilities of VGAM1405 include diagnosis, prevention and treatment of diseases and clinical conditions associated with MAPK4. The function of MAPK4 and its association with various diseases and clinical conditions, has been established by previous studies, as described hereinabove with reference to VGAM655. TIA1 Cytotoxic Granule-associated RNA Binding Protein (TIA1, Accession NM_022037) is another VGAM1405 host target gene. TIA1 BINDING SITE1 and TIA1 BINDING SITE2 are HOST TARGET binding sites found in untranslated regions of mRNA encoded by TIA1, corresponding to HOST TARGET binding sites such as BINDING SITE I, BINDING SITE II or BINDING SITE III. Table 2 illustrates the complementarity of the nucleotide sequences of TIA1 BINDING SITE1 and TIA1 BINDING SITE2, designated SEQ ID:22558 and SEQ ID:22733 respectively, to the nucleotide sequence of VGAM1405 RNA, herein designated VGAM RNA, also designated SEQ ID:4116.

Another function of VGAM1405 is therefore inhibition of TIA1 Cytotoxic Granule-associated RNA Binding Protein (TIA1, Accession NM_022037), a gene which possesses nucleolytic activity against cytotoxic lymphocyte target cells. Accordingly, utilities of VGAM1405 include diagnosis, prevention and treatment of diseases and clinical conditions associated with TIA1. The function of TIA1 and its association with various diseases and clinical conditions, has been established by previous studies, as described hereinabove with reference to VGAM276. Zinc Finger Protein 216 (ZNF216, Accession NM_006007) is another VGAM1405 host target gene. ZNF216 BINDING SITE is HOST TARGET binding site found in the 3' untranslated region of mRNA encoded by ZNF216, corresponding to a HOST TARGET binding site such as BINDING SITE I, BINDING SITE II or BINDING SITE III. Table 2 illustrates the complementarity of the nucleotide sequences of ZNF216 BINDING SITE, designated SEQ ID:12619, to the nucleotide sequence of VGAM1405 RNA, herein designated VGAM RNA, also designated SEQ ID:4116.

Another function of VGAM1405 is therefore inhibition of Zinc Finger Protein 216 (ZNF216, Accession NM_006007). Accordingly, utilities of VGAM1405 include diagnosis, prevention and treatment of diseases and clinical conditions associated with ZNF216. DKFZP566M114 (Accession NM_032128) is another VGAM1405 host target gene. DKFZP566M114 BINDING SITE is HOST TARGET binding site found in the 3' untranslated region of mRNA encoded by DKFZP566M114, corresponding to a HOST TARGET binding site such as BINDING SITE I, BINDING SITE II or BINDING SITE III. Table 2 illustrates the complementarity of the nucleotide sequences of DKFZP566M114 BINDING SITE, designated SEQ ID:25815, to the nucleotide sequence of VGAM1405 RNA, herein designated VGAM RNA, also designated SEQ ID:4116.

Another function of VGAM1405 is therefore inhibition of DKFZP566M114 (Accession NM_032128). Accordingly, utilities of VGAM1405 include diagnosis, prevention and treatment of diseases and clinical conditions associated with DKFZP566M114.EFA6R (Accession NM_015310) is another VGAM1405 host target gene. EFA6R BINDING SITE is HOST TARGET binding site found in the 3' untranslated region of mRNA encoded by EFA6R, corresponding to a HOST TARGET binding site such as BINDING SITE I, BINDING SITE II or BINDING SITE III. Table 2 illustrates the complementarity of the nucleotide sequences of EFA6R BINDING SITE, designated SEQ ID:17622, to the nucleotide sequence of VGAM1405 RNA, herein designated VGAM RNA, also designated SEQ ID:4116.

Another function of VGAM1405 is therefore inhibition of EFA6R (Accession NM_015310). Accordingly, utilities of VGAM1405 include diagnosis, prevention and treatment of diseases and clinical conditions associated with EFA6R. FLJ23816 (Accession NM_144655) is another VGAM1405 host target gene. FLJ23816 BINDING SITE is HOST TARGET binding site found in the 5' untranslated region of mRNA encoded by FLJ23816, corresponding to a HOST TARGET binding site such as BINDING SITE I, BINDING SITE II or BINDING SITE III. Table 2 illustrates the complementarity of the nucleotide sequences of FLJ23816 BINDING SITE, designated SEQ ID:29477, to the nucleotide sequence of VGAM1405 RNA, herein designated VGAM RNA, also designated SEQ ID:4116.

Another function of VGAM1405 is therefore inhibition of FLJ23816 (Accession NM_144655). Accordingly, utilities of VGAM1405 include diagnosis, prevention and treatment of diseases and clinical conditions associated with FLJ23816. KIAA0478 (Accession NM_014870) is another VGAM1405 host target gene. KIAA0478 BINDING SITE is HOST TARGET binding site found in the 5' untranslated region of mRNA encoded by KIAA0478, corresponding to a HOST TARGET binding site such as BINDING SITE I, BINDING SITE II or BINDING SITE III. Table 2 illustrates the complementarity of the nucleotide sequences of KIAA0478 BINDING SITE, designated SEQ ID:16991, to the nucleotide sequence of VGAM1405 RNA, herein designated VGAM RNA, also designated SEQ ID:4116.

Another function of VGAM1405 is therefore inhibition of KIAA0478 (Accession NM_014870). Accordingly, utilities of VGAM1405 include diagnosis, prevention and treatment of diseases and clinical conditions associated with KIAA0478. KIAA1871 (Accession XM_028409) is another VGAM1405 host target gene. KIAA1871 BINDING SITE is HOST TARGET binding site found in the 3' untranslated region of mRNA encoded by KIAA1871, corresponding to a HOST TARGET binding site such as BINDING SITE I, BINDING SITE II or BINDING SITE III. Table 2 illustrates the complementarity of the nucleotide sequences of KIAA1871 BINDING SITE, designated SEQ ID:30701, to the nucleotide sequence of VGAM1405 RNA, herein designated VGAM RNA, also designated SEQ ID:4116.

Another function of VGAM1405 is therefore inhibition of KIAA1871 (Accession XM_028409). Accordingly, utilities of VGAM1405 include diagnosis, prevention and treatment of diseases and clinical conditions associated with KIAA1871. MGC22014 (Accession XM_035307) is another VGAM1405 host target gene. MGC22014 BINDING SITE is HOST TARGET binding site found in the 3' untranslated region of mRNA encoded by MGC22014, corresponding to a HOST TARGET binding site such as BINDING SITE I, BINDING SITE II or BINDING SITE III. Table 2 illustrates the complementarity of the nucleotide sequences of MGC22014 BINDING SITE, designated SEQ ID:32214, to the nucleotide sequence of VGAM1405 RNA, herein designated VGAM RNA, also designated SEQ ID:4116.

Another function of VGAM1405 is therefore inhibition of MGC22014 (Accession XM_035307). Accordingly, utilities of VGAM1405 include diagnosis, prevention and treatment of diseases and clinical conditions associated with MGC22014. Protein Kinase, Lysine Deficient 2 (PRKWNK2, Accession XM_117531) is another VGAM1405 host target gene. PRKWNK2 BINDING SITE is HOST TARGET binding site found in the 3' untranslated region of mRNA encoded by PRKWNK2, corresponding to a HOST TARGET binding site such as BINDING SITE I, BINDING SITE II or BINDING SITE III. Table 2 illustrates the complementarity of the nucleotide sequences of PRKWNK2 BINDING SITE, designated SEQ ID:43516, to the nucleotide sequence of VGAM1405 RNA, herein designated VGAM RNA, also designated SEQ ID:4116.

Another function of VGAM1405 is therefore inhibition of Protein Kinase, Lysine Deficient 2 (PRKWNK2, Accession XM_117531). Accordingly, utilities of VGAM1405 include diagnosis, prevention and treatment of diseases and clinical conditions associated with PRKWNK2. Sprouty Homolog 2 (Drosophila) (SPRY2, Accession NM_005842) is another VGAM1405 host target gene. SPRY2 BINDING SITE is HOST TARGET binding site found in the 3' untranslated region of mRNA encoded by SPRY2, corresponding to a HOST TARGET binding site such as BINDING SITE I, BINDING SITE II or BINDING SITE III. Table 2 illustrates the complementarity of the nucleotide sequences of SPRY2 BINDING SITE, designated SEQ ID:12455, to the nucleotide sequence of VGAM1405 RNA, herein designated VGAM RNA, also designated SEQ ID:4116.

Another function of VGAM1405 is therefore inhibition of Sprouty Homolog 2 (Drosophila) (SPRY2, Accession NM_005842). Accordingly, utilities of VGAM1405 include diagnosis, prevention and treatment of diseases and clinical conditions associated with SPRY2. LOC122786 (Accession XM_058660) is another VGAM1405 host target gene. LOC122786 BINDING SITE is HOST TARGET binding site found in the 3' untranslated region of mRNA encoded by LOC122786, corresponding to a HOST TARGET binding site such as BINDING SITE I, BINDING SITE II or BINDING SITE III. Table 2 illustrates the complementarity of the nucleotide sequences of LOC122786 BINDING SITE, designated SEQ ID:36701, to the nucleotide sequence of VGAM1405 RNA, herein designated VGAM RNA, also designated SEQ ID:4116.

Another function of VGAM1405 is therefore inhibition of LOC122786 (Accession XM_058660). Accordingly, utilities of VGAM1405 include diagnosis, prevention and treatment of diseases and clinical conditions associated with LOC122786. LOC203275 (Accession XM_114667) is another VGAM1405 host target gene. LOC203275 BINDING SITE is HOST TARGET binding site found in the 3' untranslated region of mRNA encoded by LOC203275, corresponding to a HOST TARGET binding site such as BINDING SITE I, BINDING SITE II or BINDING SITE III. Table 2 illustrates the complementarity of the nucleotide sequences of LOC203275 BINDING SITE, designated SEQ ID:43026, to the nucleotide sequence of VGAM1405 RNA, herein designated VGAM RNA, also designated SEQ ID:4116.

Another function of VGAM1405 is therefore inhibition of LOC203275 (Accession XM_114667). Accordingly, utilities of VGAM1405 include diagnosis, prevention and treatment of diseases and clinical conditions associated with LOC203275. LOC257319 (Accession XM_171049) is another VGAM1405 host target gene. LOC257319 BINDING SITE is HOST TARGET binding site found in the 3' untranslated region of mRNA encoded by LOC257319, corresponding to a HOST TARGET binding site such as BINDING SITE I, BINDING SITE II or BINDING SITE III. Table 2 illustrates the complementarity of the nucleotide sequences of LOC257319 BINDING SITE, designated SEQ ID:45828, to the nucleotide sequence of VGAM1405 RNA, herein designated VGAM RNA, also designated SEQ ID:4116.

Another function of VGAM1405 is therefore inhibition of LOC257319 (Accession XM_171049). Accordingly, utilities of VGAM1405 include diagnosis, prevention and treatment of diseases and clinical conditions associated with LOC257319. FIG. 1 further provides a conceptual description of a novel bioinformatically detected viral gene of the present invention, referred to here as Viral Genomic Address Messenger 1406 (VGAM1406) viral gene, which modulates expression of respective host target genes thereof, the function and utility of which host target genes is known in the art.

VGAM1406 is a novel bioinformatically detected regulatory, non protein coding, viral micro RNA (miRNA) gene. The method by which VGAM1406 was detected is described hereinabove with reference to FIGS. 1-8.

VGAM1406 gene, herein designated VGAM GENE, is a viral gene contained in the genome of Perina Nuda Picorna-like Virus. VGAM1406 host target gene, herein designated VGAM HOST TARGET GENE, is a human gene contained in the human genome.

VGAM1406 gene encodes a VGAM1406 precursor RNA, herein designated VGAM PRECURSOR RNA. Similar to other miRNA genes, and unlike most ordinary genes, VGAM1406 precursor RNA does not encode a protein. A nucleotide sequence identical or highly similar to the nucleotide sequence of VGAM1406 precursor RNA is designated SEQ ID:1392, and is provided hereinbelow with reference to the sequence listing part. Nucleotide sequence SEQ ID:1392 is located at position 6999 relative to the genome of Perina Nuda Picorna-like Virus.

VGAM1406 precursor RNA folds onto itself, forming VGAM1406 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1406 folded precursor RNA into VGAM1406 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1406 RNA is designated SEQ ID:4117, and is provided hereinbelow with reference to the sequence listing part.

VGAM1406 host target gene, herein designated VGAM HOST TARGET GENE, encodes a corresponding messenger RNA, VGAM1406 host target RNA, herein designated VGAM HOST TARGET RNA. VGAM1406 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1406 RNA, herein designated VGAM RNA, binds complementarily to one or more host target binding sites located in untranslated regions of VGAM1406 host target RNA, herein designated VGAM HOST TARGET RNA. This complementary binding is due to the fact that the nucleotide sequence of VGAM1406 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1406 RNA, herein designated VGAM RNA, may have a different number of host target binding sites in untranslated regions of a VGAM1406 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1406 RNA, herein designated VGAM RNA, to host target binding sites on VGAM1406 host target RNA, herein designated VGAM HOST TARGET RNA, such as BINDING SITE I, BINDING SITE II and BINDING SITE III, inhibits translation of VGAM1406 host target RNA into VGAM1406 host target protein, herein designated VGAM HOST TARGET PROTEIN. VGAM host target protein is therefore outlined by a broken line.

It is appreciated that VGAM1406 host target gene, herein designated VGAM HOST TARGET GENE, in fact represents a plurality of VGAM1406 host target genes. The mRNA of each one of this plurality of VGAM1406 host target genes comprises one or more host target binding sites, each having a nucleotide sequence which is at least partly complementary to VGAM1406 RNA, herein designated VGAM RNA, and which when bound by VGAM1406 RNA causes inhibition of translation of respective one or more VGAM1406 host target proteins.

It is further appreciated by one skilled in the art that the mode of translational inhibition illustrated by FIG. 1 with specific reference to translational inhibition exerted by VGAM1406 gene, herein designated VGAM GENE, on one or more VGAM1406 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1406 is inhibition of expression of host target genes, as part of a novel viral mechanism of attacking a host. Accordingly, utilities of VGAM1406 include diagnosis, prevention and treatment of viral infection by Perina Nuda Picorna-like Virus. Specific functions, and accordingly utilities, of VGAM1406 correlate with, and may be deduced from, the identity of the host target genes which VGAM1406 binds and inhibits, and the function of these host target genes, as elaborated hereinbelow.

Nucleotide sequences of the VGAM1406 precursor RNA, herein designated VGAM PRECURSOR RNA, and of the 'diced' VGAM1406 RNA, herein designated VGAM RNA, and a schematic representation of the secondary folding of VGAM1406 folded precursor RNA, herein designated VGAM FOLDED PRECURSOR RNA, of VGAM1406 are further described hereinbelow with reference to Table 1.

Nucleotide sequences of host target binding sites, such as BINDING SITE-I, BINDING SITE-II and BINDING SITE-III of FIG. 1, found on VGAM1406 host target RNA, and schematic representation of the complementarity of each of these host target binding sites to VGAM1406 RNA, herein designated VGAM RNA, are described hereinbelow with reference to Table 2.

As mentioned hereinabove with reference to FIG. 1, a function of VGAM1406 gene, herein designated VGAM is inhibition of expression of VGAM1406 target genes. It is appreciated that specific functions, and accordingly utilities, of VGAM1406 correlate with, and may be deduced from, the identity of the target genes which VGAM1406 binds and inhibits, and the function of these target genes, as elaborated hereinbelow.

DEAD/H (Asp-Glu-Ala-Asp/His) Box Polypeptide 3 (DDX3, Accession NM_001356) is a VGAM1406 host target gene. DDX3 BINDING SITE is HOST TARGET binding site found in the 3' untranslated region of mRNA encoded by DDX3, corresponding to a HOST TARGET binding site such as BINDING SITE I, BINDING SITE II or BINDING SITE III. Table 2 illustrates the complementarity of the nucleotide sequences of DDX3 BINDING SITE, designated SEQ ID:7032, to the nucleotide sequence of VGAM1406 RNA, herein designated VGAM RNA, also designated SEQ ID:4117.

A function of VGAM1406 is therefore inhibition of DEAD/H (Asp-Glu-Ala-Asp/His) Box Polypeptide 3 (DDX3, Accession NM_001356), a gene which interacts with hepatitis c virus core protein resulting a change in intracellular location. Accordingly, utilities of VGAM1406 include diagnosis, prevention and treatment of diseases and clinical conditions associated with DDX3. The function of DDX3 and its association with various diseases and clinical conditions, has been established by previous studies, as described hereinabove with reference to VGAM232. ARG99 (Accession NM_031920) is another VGAM1406 host target gene. ARG99 BINDING SITE is HOST TARGET binding site found in the 3' untranslated region of mRNA encoded by ARG99, corresponding to a HOST TARGET binding site such as BINDING SITE I, BINDING SITE II or BINDING SITE III. Table 2 illustrates the complementarity of the nucleotide sequences of ARG99 BINDING SITE, designated SEQ ID:25669, to the nucleotide sequence of VGAM1406 RNA, herein designated VGAM RNA, also designated SEQ ID:4117.

Another function of VGAM1406 is therefore inhibition of ARG99 (Accession NM_031920). Accordingly, utilities of VGAM1406 include diagnosis, prevention and treatment of diseases and clinical conditions associated with ARG99. FLJ23462 (Accession NM_024843) is another VGAM1406 host target gene. FLJ23462 BINDING SITE is HOST TARGET binding site found in the 3' untranslated region of mRNA encoded by FLJ23462, corresponding to a HOST TARGET binding site such as BINDING SITE I, BINDING SITE II or BINDING SITE III. Table 2 illustrates the complementarity of the nucleotide sequences of FLJ23462 BINDING SITE, designated SEQ ID:24260, to the nucleotide sequence of VGAM1406 RNA, herein designated VGAM RNA, also designated SEQ ID:4117.

Another function of VGAM1406 is therefore inhibition of FLJ23462 (Accession NM_024843). Accordingly, utilities of VGAM1406 include diagnosis, prevention and treatment of diseases and clinical conditions associated with FLJ23462. Golgi Autoantigen, Golgin Subfamily A, 1 (GOLGA1, Accession NM_002077) is another VGAM1406 host target gene. GOLGA1 BINDING SITE is HOST TARGET binding site found in the 3' untranslated region of mRNA encoded by GOLGA1, corresponding to a HOST TARGET binding site such as BINDING SITE I, BINDING SITE II or BINDING SITE III. Table 2 illustrates the complementarity of the nucleotide sequences of GOLGA1 BINDING SITE, designated SEQ ID:7857, to the nucleotide sequence of VGAM1406 RNA, herein designated VGAM RNA, also designated SEQ ID:4117.

Another function of VGAM1406 is therefore inhibition of Golgi Autoantigen, Golgin Subfamily A, 1 (GOLGA1, Accession NM_002077). Accordingly, utilities of VGAM1406 include diagnosis, prevention and treatment of diseases and clinical conditions associated with GOLGA1. FIG. 1 further provides a conceptual description of a novel bioinformatically detected viral gene of the present invention, referred to here as Viral Genomic Address Messenger 1407 (VGAM1407) viral gene, which modulates expression of respective host target genes thereof, the function and utility of which host target genes is known in the art.

VGAM1407 is a novel bioinformatically detected regulatory, non protein coding, viral micro RNA (miRNA) gene. The method by which VGAM1407 was detected is described hereinabove with reference to FIGS. 1-8.

VGAM1407 gene, herein designated VGAM GENE, is a viral gene contained in the genome of Acute Bee Paralysis Virus. VGAM1407 host target gene, herein designated VGAM HOST TARGET GENE, is a human gene contained in the human genome.

VGAM1407 gene encodes a VGAM1407 precursor RNA, herein designated VGAM PRECURSOR RNA. Similar to other miRNA genes, and unlike most ordinary genes, VGAM1407 precursor RNA does not encode a protein. A nucleotide sequence identical or highly similar to the nucleotide sequence of VGAM1407 precursor RNA is designated SEQ ID:1393, and is provided hereinbelow with reference to the sequence listing part. Nucleotide sequence SEQ ID:1393 is located at position 7313 relative to the genome of Acute Bee Paralysis Virus.

VGAM1407 precursor RNA folds onto itself, forming VGAM1407 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1407 folded precursor RNA into VGAM1407 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 68%) nucleotide sequence of VGAM1407 RNA is designated SEQ ID:4118, and is provided hereinbelow with reference to the sequence listing part.

VGAM1407 host target gene, herein designated VGAM HOST TARGET GENE, encodes a corresponding messenger RNA, VGAM1407 host target RNA, herein designated VGAM HOST TARGET RNA. VGAM1407 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1407 RNA, herein designated VGAM RNA, binds complementarily to one or more host target binding sites located in untranslated regions of VGAM1407 host target RNA, herein designated VGAM HOST TARGET RNA. This complementary binding is due to the fact that the nucleotide sequence of VGAM1407 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1407 RNA, herein designated VGAM RNA, may have a different number of host target binding sites in untranslated regions of a VGAM1407 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1407 RNA, herein designated VGAM RNA, to host target binding sites on VGAM1407 host target RNA, herein designated VGAM HOST TARGET RNA, such as BINDING SITE I, BINDING SITE II and BINDING SITE III, inhibits translation of VGAM1407 host target RNA into VGAM1407 host target protein, herein designated VGAM HOST TARGET PROTEIN. VGAM host target protein is therefore outlined by a broken line.

It is appreciated that VGAM1407 host target gene, herein designated VGAM HOST TARGET GENE, in fact represents a plurality of VGAM1407 host target genes. The mRNA of each one of this plurality of VGAM1407 host target genes comprises one or more host target binding sites, each having a nucleotide sequence which is at least partly complementary to VGAM1407 RNA, herein designated VGAM RNA, and which when bound by VGAM1407 RNA causes inhibition of translation of respective one or more VGAM1407 host target proteins.

It is further appreciated by one skilled in the art that the mode of translational inhibition illustrated by FIG. 1 with specific reference to translational inhibition exerted by VGAM1407 gene, herein designated VGAM GENE, on one or more VGAM1407 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1407 is inhibition of expression of host target genes, as part of a novel viral mechanism of attacking a host. Accordingly, utilities of VGAM1407 include diagnosis, prevention and treatment of viral infection by Acute Bee Paralysis Virus. Specific functions, and accordingly utilities, of VGAM1407 correlate with, and may be deduced from, the identity of the host target genes which VGAM1407 binds and inhibits, and the function of these host target genes, as elaborated hereinbelow.

Nucleotide sequences of the VGAM1407 precursor RNA, herein designated VGAM PRECURSOR RNA, and of the 'diced' VGAM1407 RNA, herein designated VGAM RNA, and a schematic representation of the secondary folding of VGAM1407 folded precursor RNA, herein designated VGAM FOLDED PRECURSOR RNA, of VGAM1407 are further described hereinbelow with reference to Table 1.

Nucleotide sequences of host target binding sites, such as BINDING SITE-I, BINDING SITE-II and BINDING SITE-III of FIG. 1, found on VGAM1407 host target RNA, and schematic representation of the complementarity of each of these host target binding sites to VGAM1407 RNA, herein designated VGAM RNA, are described hereinbelow with reference to Table 2.

As mentioned hereinabove with reference to FIG. 1, a function of VGAM1407 gene, herein designated VGAM is inhibition of expression of VGAM1407 target genes. It is appreciated that specific functions, and accordingly utilities, of VGAM1407 correlate with, and may be deduced from, the identity of the target genes which VGAM1407 binds and inhibits, and the function of these target genes, as elaborated hereinbelow.

24-dehydrocholesterol Reductase (DHCR24, Accession NM_014762) is a VGAM1407 host target gene. DHCR24 BINDING SITE is HOST TARGET binding site found in the 3' untranslated region of mRNA encoded by DHCR24, corresponding to a HOST TARGET binding site such as BINDING SITE I, BINDING SITE II or BINDING SITE III. Table 2 illustrates the complementarity of the nucleotide sequences of DHCR24 BINDING SITE, designated SEQ ID:16521, to the nucleotide sequence of VGAM1407 RNA, herein designated VGAM RNA, also designated SEQ ID:4118.

A function of VGAM1407 is therefore inhibition of 24-dehydrocholesterol Reductase (DHCR24, Accession NM_014762), a gene which catalyzes the reduction of sterol intermediates. Accordingly, utilities of VGAM1407 include diagnosis, prevention and treatment of diseases and clinical conditions associated with DHCR24. The function of DHCR24 and its association with various diseases and clinical conditions, has been established by previous studies, as described hereinabove with reference to VGAM235. General Transcription Factor IIH, Polypeptide 1, 62 kDa (GTF2H1, Accession NM_005316) is another VGAM1407 host target gene. GTF2H1 BINDING SITE is HOST TARGET binding site found in the 3' untranslated region of mRNA encoded by GTF2H1, corresponding to a HOST TARGET binding site such as BINDING SITE I, BINDING SITE II or BINDING SITE III. Table 2 illustrates the complementarity of the nucleotide sequences of GTF2H1 BINDING SITE, designated SEQ ID:11792, to the nucleotide sequence of VGAM1407 RNA, herein designated VGAM RNA, also designated SEQ ID:4118.

Another function of VGAM1407 is therefore inhibition of General Transcription Factor IIH, Polypeptide 1, 62 kDa (GTF2H1, Accession NM_005316), a gene which is subunit of RNA polymerase II transcription initiation factor IIH; involved in transcription and DNA repair mechanisms. Accordingly, utilities of VGAM1407 include diagnosis, prevention and treatment of diseases and clinical conditions associated with GTF2H1. The function of GTF2H1 has been established by previous studies. Initiation of transcription by RNA polymerase II is a complex process requiring, in addition to the polymerase itself, 7 auxiliary factors. Entry of the polymerase into the transcription cycle is mediated by transcription factor TFIIF (see OMIM Ref. No. 189968) and requires a DNA-protein complex composed of the TATA-binding protein subunit of TFIID (OMIM Ref. No. 313650) in association with the TATA motif and TFIIB (OMIM Ref. No. 189963), the so-called DB complex. The largest subunit of mammalian RNA polymerase II (OMIM Ref. No. 180660) contains a heptapeptide repeat, YSPTSPS in the single-letter amino acid code, occurring 52 times at its C terminus. Because the heptapeptide contains serine, threonine, and tyrosine, it is prone to phosphorylation. As a result, RNA polymerase II occurs in 2 forms in vivo: a highly phosphorylated II(O) form and a nonphosphorylated II(A) form. The nonphosphorylated form of RNA polymerase II is recruited by TFIIF to the DB complex. This complex is then recognized by TFIIE (OMIM Ref. No. 189962), TFIIH, and TFIIJ, which enter the transcription cycle in that order, to generate a transcription-competent complex. Phosphorylation of the C-terminal domain of the largest subunit of RNA polymerase II is believed to control the transition from transcription initiation to elongation. The general transcription factor TFIIH contains a kinase activity capable of phosphorylating this domain (Lu et al., 1992). Factors that promote the association of RNA polymerase II with the preinitiation complex stimulate this activity. TFIIE, which is required for the stable association of TFIIH with the preinitiation complex, affects the processivity of TFIIH kinase. TFIIH is a multisubunit factor consisting of at least 5 polypeptides of 92 (OMIM Ref. No. 133510), 62, 43 (OMIM Ref. No. 601748), 40, and 35 (OMIM Ref. No. 601750) kD (Flores et al., 1992). A 52-kD subunit (OMIM Ref. No. 601760) has also been identified as a component of the TFIIH 'core,' along with p89, p62, p44, and p34 (Marinoni et al., 1997). Lu et al. (1992) expressed the belief that TFIIH is the human counterpart of the yeast general transcription factor b. See also 133530 and Habraken et al. (1996). High levels of gene transcription by RNA polymerase II depend on high rates of transcription initiation and reinitiation. Initiation requires recruitment of the complete transcription machinery to a promoter, a process facilitated by activators and chromatin remodeling factors. Reinitiation is thought to occur through a different pathway. After initiation, a subset of the transcription machinery remains at the promoter, forming a platform for assembly of a second transcription complex. Yudkovsky et al. (2000) described the isolation of a reinitiation intermediate in yeast that includes transcription factors TFIID, TFIIA (see OMIM Ref. No. 600520), TFIIH, TFIIE, and Mediator. This intermediate can act as a scaffold for formation of a functional reinitiation complex. Formation of this scaffold is dependent on ATP and TFIIH. In yeast, the scaffold is stabilized in the presence of the activator Gal4-VP16, but not Gal4-AH, suggesting a new role for some activators and Mediator in promoting high levels of transcription.

Full details of the abovementioned studies are described in the following publications, the disclosure of which are hereby incorporated by reference:

Lu, H.; Zawel, L.; Fisher, L.; Egly, J.-M.; Reinberg, D.: Human general transcription factor IIH phosphorylates the C-terminal domain of RNA polymerase II. Nature 358:641-645, 1992; and Yudkovsky, N.; Ranish, J. A.; Hahn, S.: A transcription reinitiation intermediate that is stabilized by activator. Nature 408:225-229, 2000.

Further studies establishing the function and utilities of GTF2H1 are found in John Hopkins OMIM database record ID 189972, and in sited publications numbered 4706-769, 11357-77 and 1907 listed in the bibliography section hereinbelow, which are also hereby incorporated by reference. Chromosome 1 Open Reading Frame 24 (C1orf24, Accession NM_052966) is another VGAM1407 host target gene. C1orf24 BINDING SITE is HOST TARGET binding site found in the 3' untranslated region of mRNA encoded by C1orf24, corresponding to a HOST TARGET binding site such as BINDING SITE I, BINDING SITE II or BINDING SITE III. Table 2 illustrates the complementarity of the nucleotide sequences of C1orf24 BINDING SITE, designated SEQ ID:27527, to the nucleotide sequence of VGAM1407 RNA, herein designated VGAM RNA, also designated SEQ ID:4118.

Another function of VGAM1407 is therefore inhibition of Chromosome 1 Open Reading Frame 24 (C1orf24, Accession NM_052966). Accordingly, utilities of VGAM1407 include diagnosis, prevention and treatment of diseases and clinical conditions associated with C1orf24. FLJ10891 (Accession NM_018260) is another VGAM1407 host target gene. FLJ10891 BINDING SITE is HOST TARGET binding site found in the 3' untranslated region of mRNA encoded by FLJ10891, corresponding to a HOST TARGET binding site such as BINDING SITE I, BINDING SITE II or BINDING SITE III. Table 2 illustrates the complementarity of the nucleotide sequences of FLJ10891 BINDING SITE, designated SEQ ID:20226, to the nucleotide sequence of VGAM1407 RNA, herein designated VGAM RNA, also designated SEQ ID:4118.

Another function of VGAM1407 is therefore inhibition of FLJ10891 (Accession NM_018260). Accordingly, utilities of VGAM1407 include diagnosis, prevention and treatment of diseases and clinical conditions associated with FLJ10891. FLJ12666 (Accession NM_024595) is another VGAM1407 host target gene. FLJ12666 BINDING SITE is HOST TARGET binding site found in the 3' untranslated region of mRNA encoded by FLJ12666, corresponding to a HOST TARGET binding site such as BINDING SITE I, BINDING SITE II or BINDING SITE III. Table 2 illustrates the complementarity of the nucleotide sequences of FLJ12666 BIND- ING SITE, designated SEQ ID:23831, to the nucleotide sequence of VGAM1407 RNA, herein designated VGAM RNA, also designated SEQ ID:4118.

Another function of VGAM1407 is therefore inhibition of FLJ12666 (Accession NM_024595). Accordingly, utilities of VGAM1407 include diagnosis, prevention and treatment of diseases and clinical conditions associated with FLJ12666. FLJ14011 (Accession NM_022103) is another VGAM1407 host target gene. FLJ14011 BINDING SITE is HOST TARGET binding site found in the 5' untranslated region of mRNA encoded by FLJ14011, corresponding to a HOST TARGET binding site such as BINDING SITE I, BINDING SITE II or BINDING SITE III. Table 2 illustrates the complementarity of the nucleotide sequences of FLJ14011 BINDING SITE, designated SEQ ID:22649, to the nucleotide sequence of VGAM1407 RNA, herein designated VGAM RNA, also designated SEQ ID:4118.

Another function of VGAM1407 is therefore inhibition of FLJ14011 (Accession NM_022103). Accordingly, utilities of VGAM1407 include diagnosis, prevention and treatment of diseases and clinical conditions associated with FLJ14011. Histidyl-tRNA Synthetase 2 (HARS2, Accession NM_080820) is another VGAM1407 host target gene. HARS2 BINDING SITE is HOST TARGET binding site found in the 3' untranslated region of mRNA encoded by HARS2, corresponding to a HOST TARGET binding site such as BINDING SITE I, BINDING SITE II or BINDING SITE III. Table 2 illustrates the complementarity of the nucleotide sequences of HARS2 BINDING SITE, designated SEQ ID:28077, to the nucleotide sequence of VGAM1407 RNA, herein designated VGAM RNA, also designated SEQ ID:4118.

Another function of VGAM1407 is therefore inhibition of Histidyl-tRNA Synthetase 2 (HARS2, Accession NM_080820). Accordingly, utilities of VGAM1407 include diagnosis, prevention and treatment of diseases and clinical conditions associated with HARS2. KIAA0426 (Accession NM_014724) is another VGAM1407 host target gene. KIAA0426 BINDING SITE is HOST TARGET binding site found in the 3' untranslated region of mRNA encoded by KIAA0426, corresponding to a HOST TARGET binding site such as BINDING SITE I, BINDING SITE II or BINDING SITE III. Table 2 illustrates the complementarity of the nucleotide sequences of KIAA0426 BINDING SITE, designated SEQ ID:16304, to the nucleotide sequence of VGAM1407 RNA, herein designated VGAM RNA, also designated SEQ ID:4118.

Another function of VGAM1407 is therefore inhibition of KIAA0426 (Accession NM_014724). Accordingly, utilities of VGAM1407 include diagnosis, prevention and treatment of diseases and clinical conditions associated with KIAA0426. KIAA1871 (Accession XM_028409) is another VGAM1407 host target gene. KIAA1871 BINDING SITE is HOST TARGET binding site found in the 3' untranslated region of mRNA encoded by KIAA1871, corresponding to a HOST TARGET binding site such as BINDING SITE I, BINDING SITE II or BINDING SITE III. Table 2 illustrates the complementarity of the nucleotide sequences of KIAA1871 BINDING SITE, designated SEQ ID:30700, to the nucleotide sequence of VGAM1407 RNA, herein designated VGAM RNA, also designated SEQ ID:4118.

Another function of VGAM1407 is therefore inhibition of KIAA1871 (Accession XM_028409). Accordingly, utilities of VGAM1407 include diagnosis, prevention and treatment of diseases and clinical conditions associated with KIAA1871. LOC147660 (Accession XM_085825) is another VGAM1407 host target gene. LOC147660 BINDING SITE is HOST TARGET binding site found in the 3' untranslated region of mRNA encoded by LOC147660, corresponding to a HOST TARGET binding site such as BINDING SITE I, BINDING SITE II or BINDING SITE III. Table 2 illustrates the complementarity of the nucleotide sequences of LOC147660 BINDING SITE, designated SEQ ID:38349, to the nucleotide sequence of VGAM1407 RNA, herein designated VGAM RNA, also designated SEQ ID:4118.

Another function of VGAM1407 is therefore inhibition of LOC147660 (Accession XM_085825). Accordingly, utilities of VGAM1407 include diagnosis, prevention and treatment of diseases and clinical conditions associated with LOC147660. LOC157657 (Accession XM_088352) is another VGAM1407 host target gene. LOC157657 BINDING SITE is HOST TARGET binding site found in the 3' untranslated region of mRNA encoded by LOC157657, corresponding to a HOST TARGET binding site such as BINDING SITE I, BINDING SITE II or BINDING SITE III. Table 2 illustrates the complementarity of the nucleotide sequences of LOC157657 BINDING SITE, designated SEQ ID:39627, to the nucleotide sequence of VGAM1407 RNA, herein designated VGAM RNA, also designated SEQ ID:4118.

Another function of VGAM1407 is therefore inhibition of LOC157657 (Accession XM_088352). Accordingly, utilities of VGAM1407 include diagnosis, prevention and treatment of diseases and clinical conditions associated with LOC157657. LOC90333 (Accession XM_030958) is another VGAM1407 host target gene. LOC90333 BINDING SITE is HOST TARGET binding site found in the 3' untranslated region of mRNA encoded by LOC90333, corresponding to a HOST TARGET binding site such as BINDING SITE I, BINDING SITE II or BINDING SITE III. Table 2 illustrates the complementarity of the nucleotide sequences of LOC90333 BINDING SITE, designated SEQ ID:31217, to the nucleotide sequence of VGAM1407 RNA, herein designated VGAM RNA, also designated SEQ ID:4118.

Another function of VGAM1407 is therefore inhibition of LOC90333 (Accession XM_030958). Accordingly, utilities of VGAM1407 include diagnosis, prevention and treatment of diseases and clinical conditions associated with LOC90333. LOC91664 (Accession XM_039908) is another VGAM1407 host target gene. LOC91664 BINDING SITE is HOST TARGET binding site found in the 3' untranslated region of mRNA encoded by LOC91664, corresponding to a HOST TARGET binding site such as BINDING SITE I, BINDING SITE II or BINDING SITE III. Table 2 illustrates the complementarity of the nucleotide sequences of LOC91664 BINDING SITE, designated SEQ ID:33212, to the nucleotide sequence of VGAM1407 RNA, herein designated VGAM RNA, also designated SEQ ID:4118.

Another function of VGAM1407 is therefore inhibition of LOC91664 (Accession XM_039908). Accordingly, utilities of VGAM1407 include diagnosis, prevention and treatment of diseases and clinical conditions associated with LOC91664. LOC92283 (Accession XM_044049) is another VGAM1407 host target gene. LOC92283 BINDING SITE is HOST TARGET binding site found in the 3' untranslated region of mRNA encoded by LOC92283, corresponding to a HOST TARGET binding site such as BINDING SITE I, BINDING SITE II or BINDING SITE III. Table 2 illustrates the complementarity of the nucleotide sequences of LOC92283 BINDING SITE, designated SEQ ID:34090, to the nucleotide sequence of VGAM1407 RNA, herein designated VGAM RNA, also designated SEQ ID:4118.

Another function of VGAM1407 is therefore inhibition of LOC92283 (Accession XM_044049). Accordingly, utilities of VGAM1407 include diagnosis, prevention and treatment of diseases and clinical conditions associated with LOC92283. FIG. 1 further provides a conceptual description of a novel bioinformatically detected viral gene of the present invention, referred to here as Viral Genomic Address Messenger 1408 (VGAM1408) viral gene, which modulates expression of respective host target genes thereof, the function and utility of which host target genes is known in the art.

VGAM1408 is a novel bioinformatically detected regulatory, non protein coding, viral micro RNA (miRNA) gene. The method by which VGAM1408 was detected is described hereinabove with reference to FIGS. 1-8.

VGAM1408 gene, herein designated VGAM GENE, is a viral gene contained in the genome of Acute Bee Paralysis Virus. VGAM1408 host target gene, herein designated VGAM HOST TARGET GENE, is a human gene contained in the human genome.

VGAM1408 gene encodes a VGAM1408 precursor RNA, herein designated VGAM PRECURSOR RNA. Similar to other miRNA genes, and unlike most ordinary genes, VGAM1408 precursor RNA does not encode a protein. A nucleotide sequence identical or highly similar to the nucleotide sequence of VGAM1408 precursor RNA is designated SEQ ID:1394, and is provided hereinbelow with reference to the sequence listing part. Nucleotide sequence SEQ ID:1394 is located at position 6189 relative to the genome of Acute Bee Paralysis Virus.

VGAM1408 precursor RNA folds onto itself, forming VGAM1408 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1408 folded precursor RNA into VGAM1408 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM1408 RNA is designated SEQ ID:4119, and is provided hereinbelow with reference to the sequence listing part.

VGAM1408 host target gene, herein designated VGAM HOST TARGET GENE, encodes a corresponding messenger RNA, VGAM1408 host target RNA, herein designated VGAM HOST TARGET RNA. VGAM1408 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1408 RNA, herein designated VGAM RNA, binds complementarily to one or more host target binding sites located in untranslated regions of VGAM1408 host target RNA, herein designated VGAM HOST TARGET RNA. This complementary binding is due to the fact that the nucleotide sequence of VGAM1408 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1408 RNA, herein designated VGAM RNA, may have a different number of host target binding sites in untranslated regions of a VGAM1408 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1408 RNA, herein designated VGAM RNA, to host target binding sites on VGAM1408 host target RNA, herein designated VGAM HOST TARGET RNA, such as BINDING SITE I, BINDING SITE II and BINDING SITE III, inhibits translation of VGAM1408 host target RNA into VGAM1408 host target protein, herein designated VGAM HOST TARGET PROTEIN. VGAM host target protein is therefore outlined by a broken line.

It is appreciated that VGAM1408 host target gene, herein designated VGAM HOST TARGET GENE, in fact represents a plurality of VGAM1408 host target genes. The mRNA of each one of this plurality of VGAM1408 host target genes comprises one or more host target binding sites, each having a nucleotide sequence which is at least partly complementary to VGAM1408 RNA, herein designated VGAM RNA, and which when bound by VGAM1408 RNA causes inhibition of translation of respective one or more VGAM1408 host target proteins.

It is further appreciated by one skilled in the art that the mode of translational inhibition illustrated by FIG. 1 with specific reference to translational inhibition exerted by VGAM1408 gene, herein designated VGAM GENE, on one or more VGAM1408 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1408 is inhibition of expression of host target genes, as part of a novel viral mechanism of attacking a host. Accordingly, utilities of VGAM1408 include diagnosis, prevention and treatment of viral infection by Acute Bee Paralysis Virus. Specific functions, and accordingly utilities, of VGAM1408 correlate with, and may be deduced from, the identity of the host target genes which VGAM1408 binds and inhibits, and the function of these host target genes, as elaborated hereinbelow.

Nucleotide sequences of the VGAM1408 precursor RNA, herein designated VGAM PRECURSOR RNA, and of the 'diced' VGAM1408 RNA, herein designated VGAM RNA, and a schematic representation of the secondary folding of VGAM1408 folded precursor RNA, herein designated VGAM FOLDED PRECURSOR RNA, of VGAM1408 are further described hereinbelow with reference to Table 1.

Nucleotide sequences of host target binding sites, such as BINDING SITE-I, BINDING SITE-II and BINDING SITE-III of FIG. 1, found on VGAM1408 host target RNA, and schematic representation of the complementarity of each of these host target binding sites to VGAM1408 RNA, herein designated VGAM RNA, are described hereinbelow with reference to Table 2.

As mentioned hereinabove with reference to FIG. 1, a function of VGAM1408 gene, herein designated VGAM is inhibition of expression of VGAM1408 target genes. It is appreciated that specific functions, and accordingly utilities, of VGAM1408 correlate with, and may be deduced from, the identity of the target genes which VGAM1408 binds and inhibits, and the function of these target genes, as elaborated hereinbelow.

Ectonucleotide Pyrophosphatase/phosphodiesterase 3 (ENPP3, Accession NM_005021) is a VGAM1408 host target gene. ENPP3 BINDING SITE is HOST TARGET binding site found in the 3' untranslated region of mRNA encoded by ENPP3, corresponding to a HOST TARGET binding site such as BINDING SITE I, BINDING SITE II or BINDING SITE III. Table 2 illustrates the complementarity of the nucleotide sequences of ENPP3 BINDING SITE, designated SEQ ID:11461, to the nucleotide sequence of VGAM1408 RNA, herein designated VGAM RNA, also designated SEQ ID:4119.

A function of VGAM1408 is therefore inhibition of Ectonucleotide Pyrophosphatase/phosphodiesterase 3 (ENPP3, Accession NM_005021). Accordingly, utilities of VGAM1408 include diagnosis, prevention and treatment of diseases and clinical conditions associated with ENPP3. Solute Carrier Family 1 (glutamate/neutral amino acid transporter), Member 4 (SLC1A4, Accession NM_003038) is another VGAM1408 host target gene. SLC1A4 BINDING SITE is HOST TARGET binding site found in the 3' untranslated region of mRNA encoded by SLC1A4, corresponding to a HOST TARGET binding site such as BINDING SITE I, BINDING SITE II or BINDING SITE III. Table 2 illustrates the complementarity of the nucleotide sequences of SLC1A4 BINDING SITE, designated SEQ ID:8994, to the nucleotide sequence of VGAM1408 RNA, herein designated VGAM RNA, also designated SEQ ID:4119.

Another function of VGAM1408 is therefore inhibition of Solute Carrier Family 1 (glutamate/neutral amino acid transporter), Member 4 (SLC1A4, Accession NM_003038), a gene which transports alanine, serine, cysteine, and threonine. exhibits sodium dependence. Accordingly, utilities of VGAM1408 include diagnosis, prevention and treatment of diseases and clinical conditions associated with SLC1A4. The function of SLC1A4 and its association with various diseases and clinical conditions, has been established by previous studies, as described hereinabove with reference to VGAM859. LOC120856 (Accession XM_058509) is another VGAM1408 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36636, to the nucleotide sequence of VGAM1408 RNA, herein designated VGAM RNA, also designated SEQ ID:4119.

Another function of VGAM1408 is therefore inhibition of LOC120856 (Accession XM_058509). Accordingly, utilities of VGAM1408 include diagnosis, prevention and treatment of diseases and clinical conditions associated with LOC120856. LOC158263 (Accession XM_088530) is another VGAM1408 host target gene. LOC158263 BINDING SITE is HOST TARGET binding site found in the 3' untranslated region of mRNA encoded by LOC158263, corresponding to a HOST TARGET binding site such as BINDING SITE I, BINDING SITE II or BINDING SITE III. Table 2 illustrates the complementarity of the nucleotide sequences of LOC158263 BINDING SITE, designated SEQ ID:39798, to the nucleotide sequence of VGAM1408 RNA, herein designated VGAM RNA, also designated SEQ ID:4119.

Another function of VGAM1408 is therefore inhibition of LOC158263 (Accession XM_088530). Accordingly, utilities of VGAM1408 include diagnosis, prevention and treatment of diseases and clinical conditions associated with LOC158263. FIG. 1 further provides a conceptual description of a novel bioinformatically detected viral gene of the present invention, referred to here as Viral Genomic Address Messenger 1409 (VGAM1409) viral gene, which modulates expression of respective host target genes thereof, the function and utility of which host target genes is known in the art.

VGAM1409 is a novel bioinformatically detected regulatory, non protein coding, viral micro RNA (miRNA) gene. The method by which VGAM1409 was detected is described hereinabove with reference to FIGS. 1-8.

VGAM1409 gene, herein designated VGAM GENE, is a viral gene contained in the genome of Acute Bee Paralysis Virus. VGAM1409 host target gene, herein designated VGAM HOST TARGET GENE, is a human gene contained in the human genome.

VGAM1409 gene encodes a VGAM1409 precursor RNA, herein designated VGAM PRECURSOR RNA. Similar to other miRNA genes, and unlike most ordinary genes, VGAM1409 precursor RNA does not encode a protein. A nucleotide sequence identical or highly similar to the nucleotide sequence of VGAM1409 precursor RNA is designated SEQ ID:1395, and is provided hereinbelow with reference to the sequence listing part. Nucleotide sequence SEQ ID:1395 is located at position 9338 relative to the genome of Acute Bee Paralysis Virus.

VGAM1409 precursor RNA folds onto itself, forming VGAM1409 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1409 folded precursor RNA into VGAM1409 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM1409 RNA is designated SEQ ID:4120, and is provided hereinbelow with reference to the sequence listing part.

VGAM1409 host target gene, herein designated VGAM HOST TARGET GENE, encodes a corresponding messenger RNA, VGAM1409 host target RNA, herein designated VGAM HOST TARGET RNA. VGAM1409 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1409 RNA, herein designated VGAM RNA, binds complementarily to one or more host target binding sites located in untranslated regions of VGAM1409 host target RNA, herein designated VGAM HOST TARGET RNA. This complementary binding is due to the fact that the nucleotide sequence of VGAM1409 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1409 RNA, herein designated VGAM RNA, may have a different number of host target binding sites in untranslated regions of a VGAM1409 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1409 RNA, herein designated VGAM RNA, to host target binding sites on VGAM1409 host target RNA, herein designated VGAM HOST TARGET RNA, such as BINDING SITE I, BINDING SITE II and BINDING SITE III, inhibits translation of VGAM1409 host target RNA into VGAM1409 host target protein, herein designated VGAM HOST TARGET PROTEIN. VGAM host target protein is therefore outlined by a broken line.

It is appreciated that VGAM1409 host target gene, herein designated VGAM HOST TARGET GENE, in fact represents a plurality of VGAM1409 host target genes. The mRNA of each one of this plurality of VGAM1409 host target genes comprises one or more host target binding sites, each having a nucleotide sequence which is at least partly complementary to VGAM1409 RNA, herein designated VGAM RNA, and which when bound by VGAM1409 RNA causes inhibition of translation of respective one or more VGAM1409 host target proteins.

It is further appreciated by one skilled in the art that the mode of translational inhibition illustrated by FIG. 1 with specific reference to translational inhibition exerted by VGAM1409 gene, herein designated VGAM GENE, on one or more VGAM1409 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1409 is inhibition of expression of host target genes, as part of a novel viral mechanism of attacking a host. Accordingly, utilities of VGAM1409 include diagnosis, prevention and treatment of viral infection by Acute Bee Paralysis Virus. Specific functions, and accordingly utilities, of VGAM1409 correlate with, and may be deduced from, the identity of the host target genes which VGAM1409 binds and inhibits, and the function of these host target genes, as elaborated hereinbelow.

Nucleotide sequences of the VGAM1409 precursor RNA, herein designated VGAM PRECURSOR RNA, and of the 'diced' VGAM1409 RNA, herein designated VGAM RNA, and a schematic representation of the secondary folding of VGAM1409 folded precursor RNA, herein designated VGAM FOLDED PRECURSOR RNA, of VGAM1409 are further described hereinbelow with reference to Table 1.

Nucleotide sequences of host target binding sites, such as BINDING SITE-I, BINDING SITE-II and BINDING SITE-III of FIG. 1, found on VGAM1409 host target RNA, and schematic representation of the complementarity of each of these host target binding sites to VGAM1409 RNA, herein designated VGAM RNA, are described hereinbelow with reference to Table 2.

As mentioned hereinabove with reference to FIG. 1, a function of VGAM1409 gene, herein designated VGAM is inhibition of expression of VGAM1409 target genes. It is appreciated that specific functions, and accordingly utilities, of VGAM1409 correlate with, and may be deduced from, the identity of the target genes which VGAM1409 binds and inhibits, and the function of these target genes, as elaborated hereinbelow.

FLJ10718 (Accession NM_018192) is a VGAM1409 host target gene. FLJ10718 BINDING SITE is HOST TARGET binding site found in the 3' untranslated region of mRNA encoded by FLJ10718, corresponding to a HOST TARGET binding site such as BINDING SITE I, BINDING SITE II or BINDING SITE III. Table 2 illustrates the complementarity of the nucleotide sequences of FLJ10718 BINDING SITE, designated SEQ ID:20049, to the nucleotide sequence of VGAM1409 RNA, herein designated VGAM RNA, also designated SEQ ID:4120.

A function of VGAM1409 is therefore inhibition of FLJ10718 (Accession NM_018192). Accordingly, utilities of VGAM1409 include diagnosis, prevention and treatment of diseases and clinical conditions associated with FLJ10718. FLJ14281 (Accession NM_024920) is another VGAM1409 host target gene. FLJ14281 BINDING SITE is HOST TARGET binding site found in the 5' untranslated region of mRNA encoded by FLJ14281, corresponding to a HOST TARGET binding site such as BINDING SITE I, BINDING SITE II or BINDING SITE III. Table 2 illustrates the complementarity of the nucleotide sequences of FLJ14281 BINDING SITE, designated SEQ ID:24452, to the nucleotide sequence of VGAM1409 RNA, herein designated VGAM RNA, also designated SEQ ID:4120.

Another function of VGAM1409 is therefore inhibition of FLJ14281 (Accession NM_024920). Accordingly, utilities of VGAM1409 include diagnosis, prevention and treatment of diseases and clinical conditions associated with FLJ14281. FLJ20139 (Accession NM_017685) is another VGAM1409 host target gene. FLJ20139 BINDING SITE is HOST TARGET binding site found in the 3' untranslated region of mRNA encoded by FLJ20139, corresponding to a HOST TARGET binding site such as BINDING SITE I, BINDING SITE II or BINDING SITE III. Table 2 illustrates the complementarity of the nucleotide sequences of FLJ20139 BINDING SITE, designated SEQ ID:19236, to the nucleotide sequence of VGAM1409 RNA, herein designated VGAM RNA, also designated SEQ ID:4120.

Another function of VGAM1409 is therefore inhibition of FLJ20139 (Accession NM_017685). Accordingly, utilities of VGAM1409 include diagnosis, prevention and treatment of diseases and clinical conditions associated with FLJ20139. FLJ31101 (Accession NM_017964) is another VGAM1409 host target gene. FLJ31101 BINDING SITE is HOST TARGET binding site found in the 3' untranslated region of mRNA encoded by FLJ31101, corresponding to a HOST TARGET binding site such as BINDING SITE I, BINDING SITE II or BINDING SITE III. Table 2 illustrates the complementarity of the nucleotide sequences of FLJ31101 BINDING SITE, designated SEQ ID:19685, to the nucleotide sequence of VGAM1409 RNA, herein designated VGAM RNA, also designated SEQ ID:4120.

Another function of VGAM1409 is therefore inhibition of FLJ31101 (Accession NM_017964). Accordingly, utilities of VGAM1409 include diagnosis, prevention and treatment of diseases and clinical conditions associated with FLJ31101. KIAA0964 (Accession NM_014902) is another VGAM1409 host target gene. KIAA0964 BINDING SITE is HOST TARGET binding site found in the 3' untranslated region of mRNA encoded by KIAA0964, corresponding to a HOST TARGET binding site such as BINDING SITE I, BINDING SITE II or BINDING SITE III. Table 2 illustrates the complementarity of the nucleotide sequences of KIAA0964 BINDING SITE, designated SEQ ID:17087, to the nucleotide sequence of VGAM1409 RNA, herein designated VGAM RNA, also designated SEQ ID:4120.

Another function of VGAM1409 is therefore inhibition of KIAA0964 (Accession NM_014902). Accordingly, utilities of VGAM1409 include diagnosis, prevention and treatment of diseases and clinical conditions associated with KIAA0964. Syntaxin 12 (STX12, Accession XM_039018) is another VGAM1409 host target gene. STX12 BINDING SITE is HOST TARGET binding site found in the 3' untranslated region of mRNA encoded by STX12, corresponding to a HOST TARGET binding site such as BINDING SITE I, BINDING SITE II or BINDING SITE III. Table 2 illustrates the complementarity of the nucleotide sequences of STX12 BINDING SITE, designated SEQ ID:32982, to the nucleotide sequence of VGAM1409 RNA, herein designated VGAM RNA, also designated SEQ ID:4120.

Another function of VGAM1409 is therefore inhibition of Syntaxin 12 (STX12, Accession XM_039018). Accordingly, utilities of VGAM1409 include diagnosis, prevention and treatment of diseases and clinical conditions associated with STX12. LOC139231 (Accession XM_060020) is another VGAM1409 host target gene. LOC139231 BINDING SITE is HOST TARGET binding site found in the 3' untranslated region of mRNA encoded by LOC139231, corresponding to a HOST TARGET binding site such as BINDING SITE I, BINDING SITE II or BINDING SITE III. Table 2 illustrates the complementarity of the nucleotide sequences of LOC139231 BINDING SITE, designated SEQ ID:37142, to the nucleotide sequence of VGAM1409 RNA, herein designated VGAM RNA, also designated SEQ ID:4120.

Another function of VGAM1409 is therefore inhibition of LOC139231 (Accession XM_060020). Accordingly, utilities of VGAM1409 include diagnosis, prevention and treatment of diseases and clinical conditions associated with LOC139231. LOC146669 (Accession XM_085534) is another VGAM1409 host target gene. LOC146669 BINDING SITE is HOST TARGET binding site found in the 5' untranslated region of mRNA encoded by LOC146669, corresponding to a HOST TARGET binding site such as BINDING SITE I, BINDING SITE II or BINDING SITE III. Table 2 illustrates the complementarity of the nucleotide sequences of LOC146669 BINDING SITE, designated SEQ ID:38226, to the nucleotide sequence of VGAM1409 RNA, herein designated VGAM RNA, also designated SEQ ID:4120.

Another function of VGAM1409 is therefore inhibition of LOC146669 (Accession XM_085534). Accordingly, utilities of VGAM1409 include diagnosis, prevention and treatment of diseases and clinical conditions associated with LOC146669. LOC149650 (Accession XM_086623) is another VGAM1409 host target gene. LOC149650 BINDING SITE is HOST TARGET binding site found in the 3' untranslated region of mRNA encoded by LOC149650, corresponding to a HOST TARGET binding site such as BINDING SITE I, BINDING SITE II or BINDING SITE III. Table 2 illustrates the complementarity of the nucleotide sequences of LOC149650 BINDING SITE, designated SEQ ID:38794, to the nucleotide sequence of VGAM1409 RNA, herein designated VGAM RNA, also designated SEQ ID:4120.

Another function of VGAM1409 is therefore inhibition of LOC149650 (Accession XM_086623). Accordingly, utilities of VGAM1409 include diagnosis, prevention and treatment of diseases and clinical conditions associated with LOC149650. FIG. 1 further provides a conceptual description of a novel bioinformatically detected viral gene of the present invention, referred to here as Viral Genomic Address Messenger 1410 (VGAM1410) viral gene, which modulates expression of respective host target genes thereof, the function and utility of which host target genes is known in the art.

VGAM1410 is a novel bioinformatically detected regulatory, non protein coding, viral micro RNA (miRNA) gene. The method by which VGAM1410 was detected is described hereinabove with reference to FIGS. 1-8.

VGAM1410 gene, herein designated VGAM GENE, is a viral gene contained in the genome of Acute Bee Paralysis Virus. VGAM1410 host target gene, herein designated VGAM HOST TARGET GENE, is a human gene contained in the human genome.

VGAM1410 gene encodes a VGAM1410 precursor RNA, herein designated VGAM PRECURSOR RNA. Similar to other miRNA genes, and unlike most ordinary genes, VGAM1410 precursor RNA does not encode a protein. A nucleotide sequence identical or highly similar to the nucleotide sequence of VGAM1410 precursor RNA is designated SEQ ID:1396, and is provided hereinbelow with reference to the sequence listing part. Nucleotide sequence SEQ ID:1396 is located at position 8237 relative to the genome of Acute Bee Paralysis Virus.

VGAM1410 precursor RNA folds onto itself, forming VGAM1410 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1410 folded precursor RNA into VGAM1410 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1410 RNA is designated SEQ ID:4121, and is provided hereinbelow with reference to the sequence listing part.

VGAM1410 host target gene, herein designated VGAM HOST TARGET GENE, encodes a corresponding messenger RNA, VGAM1410 host target RNA, herein designated VGAM HOST TARGET RNA. VGAM1410 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1410 RNA, herein designated VGAM RNA, binds complementarily to one or more host target binding sites located in untranslated regions of VGAM1410 host target RNA, herein designated VGAM HOST TARGET RNA. This complementary binding is due to the fact that the nucleotide sequence of VGAM1410 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1410 RNA, herein designated VGAM RNA, may have a different number of host target binding sites in untranslated regions of a VGAM1410 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1410 RNA, herein designated VGAM RNA, to host target binding sites on VGAM1410 host target RNA, herein designated VGAM HOST TARGET RNA, such as BINDING SITE I, BINDING SITE II and BINDING SITE III, inhibits translation of VGAM1410 host target RNA into VGAM1410 host target protein, herein designated VGAM HOST TARGET PROTEIN. VGAM host target protein is therefore outlined by a broken line.

It is appreciated that VGAM1410 host target gene, herein designated VGAM HOST TARGET GENE, in fact represents a plurality of VGAM1410 host target genes. The mRNA of each one of this plurality of VGAM1410 host target genes comprises one or more host target binding sites, each having a nucleotide sequence which is at least partly complementary to VGAM1410 RNA, herein designated VGAM RNA, and which when bound by VGAM1410 RNA causes inhibition of translation of respective one or more VGAM1410 host target proteins.

It is further appreciated by one skilled in the art that the mode of translational inhibition illustrated by FIG. 1 with specific reference to translational inhibition exerted by VGAM1410 gene, herein designated VGAM GENE, on one or more VGAM1410 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1410 is inhibition of expression of host target genes, as part of a novel viral mechanism of attacking a host. Accordingly, utilities of VGAM1410 include diagnosis, prevention and treatment of viral infection by Acute Bee Paralysis Virus. Specific functions, and accordingly utilities, of VGAM1410 correlate with, and may be deduced from, the identity of the host target genes which VGAM1410 binds and inhibits, and the function of these host target genes, as elaborated hereinbelow.

Nucleotide sequences of the VGAM1410 precursor RNA, herein designated VGAM PRECURSOR RNA, and of the 'diced' VGAM1410 RNA, herein designated VGAM RNA, and a schematic representation of the secondary folding of VGAM1410 folded precursor RNA, herein designated VGAM FOLDED PRECURSOR RNA, of VGAM1410 are further described hereinbelow with reference to Table 1.

Nucleotide sequences of host target binding sites, such as BINDING SITE-I, BINDING SITE-II and BINDING SITE-III of FIG. 1, found on VGAM1410 host target RNA, and schematic representation of the complementarity of each of these host target binding sites to VGAM1410 RNA, herein designated VGAM RNA, are described hereinbelow with reference to Table 2.

As mentioned hereinabove with reference to FIG. 1, a function of VGAM1410 gene, herein designated VGAM is inhibition of expression of VGAM1410 target genes. It is appreciated that specific functions, and accordingly utilities, of VGAM1410 correlate with, and may be deduced from, the identity of the target genes which VGAM1410 binds and inhibits, and the function of these target genes, as elaborated hereinbelow.

B29 (Accession NM_031939) is a VGAM1410 host target gene. B29 BINDING SITE is HOST TARGET binding site found in the 3' untranslated region of mRNA encoded by B29, corresponding to a HOST TARGET binding site such as BINDING SITE I, BINDING SITE II or BINDING SITE III. Table 2 illustrates the complementarity of the nucleotide sequences of B29 BINDING SITE, designated SEQ ID:25685, to the nucleotide sequence of VGAM1410 RNA, herein designated VGAM RNA, also designated SEQ ID:4121.

A function of VGAM1410 is therefore inhibition of B29 (Accession NM_031939). Accordingly, utilities of VGAM1410 include diagnosis, prevention and treatment of diseases and clinical conditions associated with B29. Fanconi Anemia, Complementation Group C (FANCC, Accession XM_047190) is another VGAM1410 host target gene. FANCC BINDING SITE is HOST TARGET binding site found in the 3' untranslated region of mRNA encoded by FANCC, corresponding to a HOST TARGET binding site such as BINDING SITE I, BINDING SITE II or BINDING SITE III. Table 2 illustrates the complementarity of the nucleotide sequences of FANCC BINDING SITE, designated SEQ ID:34907, to the nucleotide sequence of VGAM1410 RNA, herein designated VGAM RNA, also designated SEQ ID:4121.

Another function of VGAM1410 is therefore inhibition of Fanconi Anemia, Complementation Group C (FANCC, Accession XM_047190). Accordingly, utilities of VGAM1410 include diagnosis, prevention and treatment of diseases and clinical conditions associated with FANCC. Guanine Nucleotide Binding Protein (G protein), Alpha 15 (Gq class) (GNA15, Accession XM_009220) is another VGAM1410 host target gene. GNA15 BINDING SITE is HOST TARGET binding site found in the 3' untranslated region of mRNA encoded by GNA15, corresponding to a HOST TARGET binding site such as BINDING SITE I, BINDING SITE II or BINDING SITE III. Table 2 illustrates the complementarity of the nucleotide sequences of GNA15 BINDING SITE, designated SEQ ID:30104, to the nucleotide sequence of VGAM1410 RNA, herein designated VGAM RNA, also designated SEQ ID:4121.

Another function of VGAM1410 is therefore inhibition of Guanine Nucleotide Binding Protein (G protein), Alpha 15 (Gq class) (GNA15, Accession XM_009220). Accordingly, utilities of VGAM1410 include diagnosis, prevention and treatment of diseases and clinical conditions associated with GNA15. Heparan Sulfate (glucosamine) 3-O-sulfotransferase 4 (HS3ST4, Accession XM_056254) is another VGAM1410 host target gene. HS3ST4 BINDING SITE is HOST TARGET binding site found in the 3' untranslated region of mRNA encoded by HS3ST4, corresponding to a HOST TARGET binding site such as BINDING SITE I, BINDING SITE II or BINDING SITE III. Table 2 illustrates the complementarity of the nucleotide sequences of HS3ST4 BINDING SITE, designated SEQ ID:36371, to the nucleotide sequence of VGAM1410 RNA, herein designated VGAM RNA, also designated SEQ ID:4121.

Another function of VGAM1410 is therefore inhibition of Heparan Sulfate (glucosamine) 3-O-sulfotransferase 4 (HS3ST4, Accession XM_056254). Accordingly, utilities of VGAM1410 include diagnosis, prevention and treatment of diseases and clinical conditions associated with HS3ST4. Mannosidase, Alpha, Class 2A, Member 1 (MAN2A1, Accession NM_002372) is another VGAM1410 host target gene. MAN2A1 BINDING SITE is HOST TARGET binding site found in the 5' untranslated region of mRNA encoded by MAN2A1, corresponding to a HOST TARGET binding site such as BINDING SITE I, BINDING SITE II or BINDING SITE III. Table 2 illustrates the complementarity of the nucleotide sequences of MAN2A1 BINDING SITE, designated SEQ ID:8180, to the nucleotide sequence of VGAM1410 RNA, herein designated VGAM RNA, also designated SEQ ID:4121.

Another function of VGAM1410 is therefore inhibition of Mannosidase, Alpha, Class 2A, Member 1 (MAN2A1, Accession NM_002372), a gene which catalyzes the final hydrolytic step in the asparagine-linked oligosaccharide (N-glycan) maturation pathway. Accordingly, utilities of VGAM1410 include diagnosis, prevention and treatment of diseases and clinical conditions associated with MAN2A1. The function of MAN2A1 has been established by previous studies. Alpha-mannosidase II catalyzes the first committed step in the biosynthesis of complex N-glycans. Genetic deficiency of this enzyme should abolish complex N-glycan production as reportedly does inhibition of the enzyme by swainsonine. Chui et al. (1997) found that mice in whom the alpha-mannosidase II gene had been disrupted developed a dyserythropoietic anemia concurrent with loss of erythrocyte complex N-glycans. Unexpectedly, nonerythroid cell types continued to produce complex N-glycans by an alternate pathway comprising a distinct alpha-mannosidase. These studies revealed cell type-specific variations in N-linked oligosaccharide biosynthesis and an essential role for alpha-mannosidase II in the formation of erythroid complex N-glycans. Alpha-mannosidase II deficiency elicited a phenotype in mice that corresponds to human congenital dyserythropoietic anemia type II. Although a genetic defect of MAN2A1 was thought to cause congenital dyserythropoietic anemia type II, or HEMPAS (OMIM Ref. No. 224100), Gasparini et al. (1997) excluded it as a candidate gene by demonstrating linkage of the disorder to markers on chromosome 20. Protein glycosylation in the Golgi apparatus produces structural variation at the cell surface and contributes to immune self-recognition. Altered protein glycosylation and antibodies that recognize endogenous glycans have been associated with various autoimmune syndromes, with the possibility that such abnormalities may reflect genetic defects in glycan formation. Studying mice with a null allele for alpha-mannosidase II, Chui et al. (2001) showed that mutation in this gene, which regulates the hybrid to complex branching pattern of extracellular asparagine (N)-linked oligosaccharide chains (N-glycans), results in a systemic autoimmune disease similar to human systemic lupus erythematosus (OMIM Ref. No. 152700). The findings demonstrated a genetic cause of autoimmune disease provoked by a defect in the pathway of protein N-glycosylation.

Full details of the abovementioned studies are described in the following publications, the disclosure of which are hereby incorporated by reference:

Chui, D.; Oh-Eda, M.; Liao, Y.-F.; Panneerselvam, K.; Lai, A.; Marek, K. W.; Freeze, H. H.; Moremen, K. W.; Fukuda, M. N.; Marth, J. D.: Alpha-mannosidase-II deficiency results in dyserythropoiesis and unveils an alternate pathway in oligosaccharide biosynthesis. Cell 90:157-167, 1997; and Chui, D.; Sellakumar, G.; Green, R. S.; Sutton-Smith, M.; McQuistan, T.; Marek, K. W.; Morris, H. R.; Dell, A.; Marth, J. D.: Genetic remodeling of protein glycosylation in vivo induces.

Further studies establishing the function and utilities of MAN2A1 are found in John Hopkins OMIM database record ID 154582, and in sited publications numbered 11526-11530 listed in the bibliography section hereinbelow, which are also hereby incorporated by reference. N-acetylgalactosaminidase, Alpha- (NAGA, Accession NM_000262) is another VGAM1410 host target gene. NAGA BINDING SITE is HOST TARGET binding site found in the 3' untranslated region of mRNA encoded by NAGA, corresponding to a HOST TARGET binding site such as BINDING SITE I, BINDING SITE II or BINDING SITE III. Table 2 illustrates the complementarity of the nucleotide sequences of NAGA BINDING SITE, designated SEQ ID:5800, to the nucleotide sequence of VGAM1410 RNA, herein designated VGAM RNA, also designated SEQ ID:4121.

Another function of VGAM1410 is therefore inhibition of N-acetylgalactosaminidase, Alpha- (NAGA, Accession NM_000262). Accordingly, utilities of VGAM1410 include diagnosis, prevention and treatment of diseases and clinical conditions associated with NAGA. Procollagen-proline, 2-oxoglutarate 4-dioxygenase (proline 4-hydroxylase), Alpha Polypeptide I (P4HA1, Accession NM_000917) is another VGAM1410 host target gene. P4HA1 BINDING SITE is HOST TARGET binding site found in the 3' untranslated region of mRNA encoded by P4HA1, corresponding to a HOST TARGET binding site such as BINDING SITE I, BINDING SITE II or BINDING SITE III. Table 2 illustrates the complementarity of the nucleotide sequences of P4HA1 BINDING SITE, designated SEQ ID:6626, to the nucleotide sequence of VGAM1410 RNA, herein designated VGAM RNA, also designated SEQ ID:4121.

Another function of VGAM1410 is therefore inhibition of Procollagen-proline, 2-oxoglutarate 4-dioxygenase (proline 4-hydroxylase), Alpha Polypeptide I (P4HA1, Accession NM_000917), a gene which catalyzes the formation of 4-hydroxyproline in collagen. Accordingly, utilities of VGAM1410 include diagnosis, prevention and treatment of diseases and clinical conditions associated with P4HA1. The function of P4HA1 and its association with various diseases and clinical conditions, has been established by previous studies, as described hereinabove with reference to VGAM260. Platelet-derived Growth Factor Receptor, Beta Polypeptide (PDGFRB, Accession XM_038350) is another VGAM1410 host target gene. PDGFRB BINDING SITE is HOST TARGET binding site found in the 3' untranslated region of mRNA encoded by PDGFRB, corresponding to a HOST TARGET binding site such as BINDING SITE I, BINDING SITE II or BINDING SITE III. Table 2 illustrates the complementarity of the nucleotide sequences of PDGFRB BINDING SITE, designated SEQ ID:32814, to the nucleotide sequence of VGAM1410 RNA, herein designated VGAM RNA, also designated SEQ ID:4121.

Another function of VGAM1410 is therefore inhibition of Platelet-derived Growth Factor Receptor, Beta Polypeptide (PDGFRB, Accession XM_038350), a gene which Platelet-derived growth factor receptor beta chain; tyrosine kinase receptor. Accordingly, utilities of VGAM1410 include diagnosis, prevention and treatment of diseases and clinical conditions associated with PDGFRB. The function of PDGFRB and its association with various diseases and clinical conditions, has been established by previous studies, as described hereinabove with reference to VGAM125. Prostaglandin-endoperoxide Synthase 1 (prostaglandin G/H synthase and cyclooxygenase) (PTGS1, Accession NM_080591) is another VGAM1410 host target gene. PTGS1 BINDING SITE1 and PTGS1 BINDING SITE2 are HOST TARGET binding sites found in untranslated regions of mRNA encoded by PTGS1, corresponding to HOST TARGET binding sites such as BINDING SITE I, BINDING SITE II or BINDING SITE III. Table 2 illustrates the complementarity of the nucleotide sequences of PTGS1 BINDING SITE1 and PTGS1 BINDING SITE2, designated SEQ ID:27900 and SEQ ID:6679 respectively, to the nucleotide sequence of VGAM1410 RNA, herein designated VGAM RNA, also designated SEQ ID:4121.

Another function of VGAM1410 is therefore inhibition of Prostaglandin-endoperoxide Synthase 1 (prostaglandin G/H synthase and cyclooxygenase) (PTGS1, Accession NM_080591), a gene which may play an important role in regulating or promoting cell proliferation in some normal and neoplastically transformed cells. Accordingly, utilities of VGAM1410 include diagnosis, prevention and treatment of diseases and clinical conditions associated with PTGS1. The function of PTGS1 and its association with various diseases and clinical conditions, has been established by previous studies, as described hereinabove with reference to VGAM1224. Chromosome 20 Open Reading Frame 20 (C20orf20, Accession NM_018270) is another VGAM1410 host target gene. C20orf20 BINDING SITE is HOST TARGET binding site found in the 3' untranslated region of mRNA encoded by C20orf20, corresponding to a HOST TARGET binding site such as BINDING SITE I, BINDING SITE II or BINDING SITE III. Table 2 illustrates the complementarity of the nucleotide sequences of C20orf20 BINDING SITE, designated SEQ ID:20248, to the nucleotide sequence of VGAM1410 RNA, herein designated VGAM RNA, also designated SEQ ID:4121.

Another function of VGAM1410 is therefore inhibition of Chromosome 20 Open Reading Frame 20 (C20orf20, Accession NM_018270). Accordingly, utilities of VGAM1410 include diagnosis, prevention and treatment of diseases and clinical conditions associated with C20orf20. Chloride Intracellular Channel 2 (CLIC2, Accession NM_001289) is another VGAM1410 host target gene. CLIC2 BINDING SITE is HOST TARGET binding site found in the 5' untranslated region of mRNA encoded by CLIC2, corresponding to a HOST TARGET binding site such as BINDING SITE I, BINDING SITE II or BINDING SITE III. Table 2 illustrates the complementarity of the nucleotide sequences of CLIC2 BINDING SITE, designated SEQ ID:6968, to the nucleotide sequence of VGAM1410 RNA, herein designated VGAM RNA, also designated SEQ ID:4121.

Another function of VGAM1410 is therefore inhibition of Chloride Intracellular Channel 2 (CLIC2, Accession NM_001289). Accordingly, utilities of VGAM1410 include diagnosis, prevention and treatment of diseases and clinical conditions associated with CLIC2. CTD (carboxy-terminal domain, RNA polymerase II, polypeptide A) Phosphatase, Subunit 1 (CTDP1, Accession NM_004715) is another VGAM1410 host target gene. CTDP1 BINDING SITE is HOST TARGET binding site found in the 3' untranslated region of mRNA encoded by CTDP1, corresponding to a HOST TARGET binding site such as BINDING SITE I, BINDING SITE II or BINDING SITE III. Table 2 illustrates the complementarity of the nucleotide sequences of CTDP1 BINDING SITE, designated SEQ ID:11073, to the nucleotide sequence of VGAM1410 RNA, herein designated VGAM RNA, also designated SEQ ID:4121.

Another function of VGAM1410 is therefore inhibition of CTD (carboxy-terminal domain, RNA polymerase II, polypeptide A) Phosphatase, Subunit 1 (CTDP1, Accession NM_004715). Accordingly, utilities of VGAM1410 include diagnosis, prevention and treatment of diseases and clinical conditions associated with CTDP1. Dynactin 4 (p62) (DCTN4, Accession XM_041993) is another VGAM1410 host target gene. DCTN4 BINDING SITE is HOST TARGET binding site found in the 3' untranslated region of mRNA encoded by DCTN4, corresponding to a HOST TARGET binding site such as BINDING SITE I, BINDING SITE II or BINDING SITE III. Table 2 illustrates the complementarity of the nucleotide sequences of DCTN4 BINDING SITE, designated SEQ ID:33665, to the nucleotide sequence of VGAM1410 RNA, herein designated VGAM RNA, also designated SEQ ID:4121.

Another function of VGAM1410 is therefore inhibition of Dynactin 4 (p62) (DCTN4, Accession XM_041993). Accordingly, utilities of VGAM1410 include diagnosis, prevention and treatment of diseases and clinical conditions associated with DCTN4. DKFZP586C1619 (Accession XM_030350) is another VGAM1410 host target gene. DKFZP586C1619 BINDING SITE is HOST TARGET binding site found in the 3' untranslated region of mRNA encoded by DKFZP586C1619, corresponding to a HOST TARGET binding site such as BINDING SITE I, BINDING SITE II or BINDING SITE III. Table 2 illustrates the complementarity of the nucleotide sequences of DKFZP586C1619 BINDING SITE, designated SEQ ID:31017, to the nucleotide sequence of VGAM1410 RNA, herein designated VGAM RNA, also designated SEQ ID:4121.

Another function of VGAM1410 is therefore inhibition of DKFZP586C1619 (Accession XM_030350). Accordingly, utilities of VGAM1410 include diagnosis, prevention and treatment of diseases and clinical conditions associated with DKFZP586C1619. FLJ20574 (Accession NM_017886) is another VGAM1410 host target gene. FLJ20574 BINDING SITE is HOST TARGET binding site found in the 3' untranslated region of mRNA encoded by FLJ20574, corresponding to a HOST TARGET binding site such as BINDING SITE I, BINDING SITE II or BINDING SITE III. Table 2 illustrates the complementarity of the nucleotide sequences of FLJ20574 BINDING SITE, designated SEQ ID:19556, to the nucleotide sequence of VGAM1410 RNA, herein designated VGAM RNA, also designated SEQ ID:4121.

Another function of VGAM1410 is therefore inhibition of FLJ20574 (Accession NM_017886). Accordingly, utilities of VGAM1410 include diagnosis, prevention and treatment of diseases and clinical conditions associated with FLJ20574. KIAA0121 (Accession XM_052386) is another VGAM1410 host target gene. KIAA0121 BINDING SITE is HOST TARGET binding site found in the 3' untranslated region of mRNA encoded by KIAA0121, corresponding to a HOST TARGET binding site such as BINDING SITE I, BINDING SITE II or BINDING SITE III. Table 2 illustrates the complementarity of the nucleotide sequences of KIAA0121 BINDING SITE, designated SEQ ID:35972, to the nucleotide sequence of VGAM1410 RNA, herein designated VGAM RNA, also designated SEQ ID:4121.

Another function of VGAM1410 is therefore inhibition of KIAA0121 (Accession XM_052386). Accordingly, utilities of VGAM1410 include diagnosis, prevention and treatment of diseases and clinical conditions associated with KIAA0121. KIAA0417 (Accession XM_048898) is another VGAM1410 host target gene. KIAA0417 BINDING SITE is HOST TARGET binding site found in the 3' untranslated region of mRNA encoded by KIAA0417, corresponding to a HOST TARGET binding site such as BINDING SITE I, BINDING SITE II or BINDING SITE III. Table 2 illustrates the complementarity of the nucleotide sequences of KIAA0417 BINDING SITE, designated SEQ ID:35291, to the nucleotide sequence of VGAM1410 RNA, herein designated VGAM RNA, also designated SEQ ID:4121.

Another function of VGAM1410 is therefore inhibition of KIAA0417 (Accession XM_048898). Accordingly, utilities of VGAM1410 include diagnosis, prevention and treatment of diseases and clinical conditions associated with KIAA0417. KIAA1538 (Accession XM_049474) is another VGAM1410 host target gene. KIAA1538 BINDING SITE is HOST TARGET binding site found in the 3' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35422, to the nucleotide sequence of VGAM1410 RNA, herein designated VGAM RNA, also designated SEQ ID:4121.

Another function of VGAM1410 is therefore inhibition of KIAA1538 (Accession XM_049474). Accordingly, utilities of VGAM1410 include diagnosis, prevention and treatment of diseases and clinical conditions associated with KIAA1538. KIAA1881 (Accession XM_170901) is another VGAM1410 host target gene. KIAA1881 BINDING SITE is HOST TARGET binding site found in the 5' untranslated region of mRNA encoded by KIAA1881, corresponding to a HOST TARGET binding site such as BINDING SITE I, BINDING SITE II or BINDING SITE III. Table 2 illustrates the complementarity of the nucleotide sequences of KIAA1881 BINDING SITE, designated SEQ ID:45655, to the nucleotide sequence of VGAM1410 RNA, herein designated VGAM RNA, also designated SEQ ID:4121.

Another function of VGAM1410 is therefore inhibition of KIAA1881 (Accession XM_170901). Accordingly, utilities of VGAM1410 include diagnosis, prevention and treatment of diseases and clinical conditions associated with KIAA1881. Myozenin 2 (MYOZ2, Accession NM_016599) is another VGAM1410 host target gene. MYOZ2 BINDING SITE is HOST TARGET binding site found in the 3' untranslated region of mRNA encoded by MYOZ2, corresponding to a HOST TARGET binding site such as BINDING SITE I, BINDING SITE II or BINDING SITE III. Table 2 illustrates the complementarity of the nucleotide sequences of MYOZ2 BINDING SITE, designated SEQ ID:18693, to the nucleotide sequence of VGAM1410 RNA, herein designated VGAM RNA, also designated SEQ ID:4121.

Another function of VGAM1410 is therefore inhibition of Myozenin 2 (MYOZ2, Accession NM_016599). Accordingly, utilities of VGAM1410 include diagnosis, prevention and treatment of diseases and clinical conditions associated with MYOZ2. NDST4 (Accession NM_022569) is another VGAM1410 host target gene. NDST4 BINDING SITE is HOST TARGET binding site found in the 5' untranslated region of mRNA encoded by NDST4, corresponding to a HOST TARGET binding site such as BINDING SITE I, BINDING SITE II or BINDING SITE III. Table 2 illustrates the complementarity of the nucleotide sequences of NDST4 BINDING SITE, designated SEQ ID:22892, to the nucleotide sequence of VGAM1410 RNA, herein designated VGAM RNA, also designated SEQ ID:4121.

Another function of VGAM1410 is therefore inhibition of NDST4 (Accession NM_022569). Accordingly, utilities of VGAM1410 include diagnosis, prevention and treatment of diseases and clinical conditions associated with NDST4. Neuronal PAS Domain Protein 3 (NPAS3, Accession NM_022123) is another VGAM1410 host target gene. NPAS3 BINDING SITE is HOST TARGET binding site found in the 3' untranslated region of mRNA encoded by NPAS3, corresponding to a HOST TARGET binding site such as BINDING SITE I, BINDING SITE II or BINDING SITE III. Table 2 illustrates the complementarity of the nucleotide sequences of NPAS3 BINDING SITE, designated SEQ ID:22666, to the nucleotide sequence of VGAM1410 RNA, herein designated VGAM RNA, also designated SEQ ID:4121.

Another function of VGAM1410 is therefore inhibition of Neuronal PAS Domain Protein 3 (NPAS3, Accession NM_022123). Accordingly, utilities of VGAM1410 include diagnosis, prevention and treatment of diseases and clinical conditions associated with NPAS3. SSB-4 (Accession NM_080862) is another VGAM1410 host target gene. SSB-4 BINDING SITE is HOST TARGET binding site found in the 3' untranslated region of mRNA encoded by SSB-4, corresponding to a HOST TARGET binding site such as BINDING SITE I, BINDING SITE II or BINDING SITE III. Table 2 illustrates the complementarity of the nucleotide sequences of SSB-4 BINDING SITE, designated SEQ ID:28104, to the nucleotide sequence of VGAM1410 RNA, herein designated VGAM RNA, also designated SEQ ID:4121.

Another function of VGAM1410 is therefore inhibition of SSB-4 (Accession NM_080862). Accordingly, utilities of VGAM1410 include diagnosis, prevention and treatment of diseases and clinical conditions associated with SSB-4. SYNE-1 (Accession NM_015293) is another VGAM1410 host target gene. SYNE-1 BINDING SITE is HOST TARGET binding site found in the 3' untranslated region of mRNA encoded by SYNE-1, corresponding to a HOST TARGET binding site such as BINDING SITE I, BINDING SITE II or BINDING SITE III. Table 2 illustrates the complementarity of the nucleotide sequences of SYNE-1 BINDING SITE, designated SEQ ID:17615, to the nucleotide sequence of VGAM1410 RNA, herein designated VGAM RNA, also designated SEQ ID:4121.

Another function of VGAM1410 is therefore inhibition of SYNE-1 (Accession NM_015293). Accordingly, utilities of VGAM1410 include diagnosis, prevention and treatment of diseases and clinical conditions associated with SYNE-1. Wingless-type MMTV Integration Site Family, Member 10A (WNT10A, Accession NM_025216) is another VGAM1410 host target gene. WNT10A BINDING SITE is HOST TARGET binding site found in the 5" untranslated region of mRNA encoded by WNT10A, corresponding to a HOST TARGET binding site such as BINDING SITE I, BINDING SITE II or BINDING SITE III. Table 2 illustrates the complementarity of the nucleotide sequences of WNT10A BINDING SITE, designated SEQ ID:24896, to the nucleotide sequence of VGAM1410 RNA, herein designated VGAM RNA, also designated SEQ ID:4121.

Another function of VGAM1410 is therefore inhibition of Wingless-type MMTV Integration Site Family, Member 10A (WNT10A, Accession NM_025216). Accordingly, utilities of VGAM1410 include diagnosis, prevention and treatment of diseases and clinical conditions associated with WNT10A. LOC148753 (Accession XM_097515) is another VGAM1410 host target gene. LOC148753 BINDING SITE is HOST TARGET binding site found in the 5' untranslated region of mRNA encoded by LOC148753, corresponding to a HOST TARGET binding site such as BINDING SITE I, BINDING SITE II or BINDING SITE III. Table 2 illustrates the complementarity of the nucleotide sequences of LOC148753 BINDING SITE, designated SEQ ID:40900, to the nucleotide sequence of VGAM1410 RNA, herein designated VGAM RNA, also designated SEQ ID:4121.

Another function of VGAM1410 is therefore inhibition of LOC148753 (Accession XM_097515). Accordingly, utilities of VGAM1410 include diagnosis, prevention and treatment of diseases and clinical conditions associated with LOC148753. LOC152559 (Accession XM_087487) is another VGAM1410 host target gene. LOC152559 BINDING SITE is HOST TARGET binding site found in the 3' untranslated region of mRNA encoded by LOC152559, corresponding to a HOST TARGET binding site such as BINDING SITE I, BINDING SITE II or BINDING SITE III. Table 2 illustrates the complementarity of the nucleotide sequences of LOC152559 BINDING SITE, designated SEQ ID:39283, to the nucleotide sequence of VGAM1410 RNA, herein designated VGAM RNA, also designated SEQ ID:4121.

Another function of VGAM1410 is therefore inhibition of LOC152559 (Accession XM_087487). Accordingly, utilities of VGAM1410 include diagnosis, prevention and treatment of diseases and clinical conditions associated with LOC152559. LOC155032 (Accession XM_098647) is another VGAM1410 host target gene. LOC155032 BINDING SITE is HOST TARGET binding site found in the 3' untranslated region of mRNA encoded by LOC155032, corresponding to a HOST TARGET binding site such as BINDING SITE I, BINDING SITE II or BINDING SITE III. Table 2 illustrates the complementarity of the nucleotide sequences of LOC155032 BINDING SITE, designated SEQ ID:41748, to the nucleotide sequence of VGAM1410 RNA, herein designated VGAM RNA, also designated SEQ ID:4121.

Another function of VGAM1410 is therefore inhibition of LOC155032 (Accession XM_098647). Accordingly, utilities of VGAM1410 include diagnosis, prevention and treatment of diseases and clinical conditions associated with LOC155032. LOC90155 (Accession XM_029487) is another VGAM1410 host target gene. LOC90155 BINDING SITE is HOST TARGET binding site found in the 3' untranslated region of mRNA encoded by LOC90155, corresponding to a HOST TARGET binding site such as BINDING SITE I, BINDING SITE II or BINDING SITE III. Table 2 illustrates the complementarity of the nucleotide sequences of LOC90155 BINDING SITE, designated SEQ ID:30900, to the nucleotide sequence of VGAM1410 RNA, herein designated VGAM RNA, also designated SEQ ID:4121.

Another function of VGAM1410 is therefore inhibition of LOC90155 (Accession XM_029487). Accordingly, utilities of VGAM1410 include diagnosis, prevention and treatment of diseases and clinical conditions associated with LOC90155. FIG. 1 further provides a conceptual description of a novel bioinformatically detected viral gene of the present invention, referred to here as Viral Genomic Address Messenger 1411 (VGAM1411) viral gene, which modulates expression of respective host target genes thereof, the function and utility of which host target genes is known in the art.

VGAM1411 is a novel bioinformatically detected regulatory, non protein coding, viral micro RNA (miRNA) gene. The method by which VGAM1411 was detected is described hereinabove with reference to FIGS. 1-8.

VGAM1411 gene, herein designated VGAM GENE, is a viral gene contained in the genome of Acute Bee Paralysis Virus. VGAM1411 host target gene, herein designated VGAM HOST TARGET GENE, is a human gene contained in the human genome.

VGAM1411 gene encodes a VGAM1411 precursor RNA, herein designated VGAM PRECURSOR RNA. Similar to other miRNA genes, and unlike most ordinary genes, VGAM1411 precursor RNA does not encode a protein. A nucleotide sequence identical or highly similar to the nucleotide sequence of VGAM1411 precursor RNA is designated SEQ ID:1397, and is provided hereinbelow with reference to the sequence listing part. Nucleotide sequence SEQ ID:1397 is located at position 3090 relative to the genome of Acute Bee Paralysis Virus.

VGAM1411 precursor RNA folds onto itself, forming VGAM1411 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1411 folded precursor RNA into VGAM1411 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1411 RNA is designated SEQ ID:4122, and is provided hereinbelow with reference to the sequence listing part.

VGAM1411 host target gene, herein designated VGAM HOST TARGET GENE, encodes a corresponding messenger RNA, VGAM1411 host target RNA, herein designated VGAM HOST TARGET RNA. VGAM1411 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1411 RNA, herein designated VGAM RNA, binds complementarily to one or more host target binding sites located in untranslated regions of VGAM1411 host target RNA, herein designated VGAM HOST TARGET RNA. This complementary binding is due to the fact that the nucleotide sequence of VGAM1411 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1411 RNA, herein designated VGAM RNA, may have a different number of host target binding sites in untranslated regions of a VGAM1411 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1411 RNA, herein designated VGAM RNA, to host target binding sites on VGAM1411 host target RNA, herein designated VGAM HOST TARGET RNA, such as BINDING SITE I, BINDING SITE II and BINDING SITE III, inhibits translation of VGAM1411 host target RNA into VGAM1411 host target protein, herein designated VGAM HOST TARGET PROTEIN. VGAM host target protein is therefore outlined by a broken line.

It is appreciated that VGAM1411 host target gene, herein designated VGAM HOST TARGET GENE, in fact represents a plurality of VGAM1411 host target genes. The mRNA of each one of this plurality of VGAM1411 host target genes comprises one or more host target binding sites, each having a nucleotide sequence which is at least partly complementary to VGAM1411 RNA, herein designated VGAM RNA, and which when bound by VGAM1411 RNA causes inhibition of translation of respective one or more VGAM1411 host target proteins.

It is further appreciated by one skilled in the art that the mode of translational inhibition illustrated by FIG. 1 with specific reference to translational inhibition exerted by VGAM1411 gene, herein designated VGAM GENE, on one or more VGAM1411 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1411 is inhibition of expression of host target genes, as part of a novel viral mechanism of attacking a host. Accordingly, utilities of VGAM1411 include diagnosis, prevention and treatment of viral infection by Acute Bee Paralysis Virus. Specific functions, and accordingly utilities, of VGAM1411 correlate with, and may be deduced from, the identity of the host target genes which VGAM1411 binds and inhibits, and the function of these host target genes, as elaborated hereinbelow.

Nucleotide sequences of the VGAM1411 precursor RNA, herein designated VGAM PRECURSOR RNA, and of the 'diced' VGAM1411 RNA, herein designated VGAM RNA, and a schematic representation of the secondary folding of VGAM1411 folded precursor RNA, herein designated VGAM FOLDED PRECURSOR RNA, of VGAM1411 are further described hereinbelow with reference to Table 1.

Nucleotide sequences of host target binding sites, such as BINDING SITE-I, BINDING SITE-II and BINDING SITE-III of FIG. 1, found on VGAM1411 host target RNA, and schematic representation of the complementarity of each of these host target binding sites to VGAM1411 RNA, herein designated VGAM RNA, are described hereinbelow with reference to Table 2.

As mentioned hereinabove with reference to FIG. 1, a function of VGAM1411 gene, herein designated VGAM is inhibition of expression of VGAM1411 target genes. It is appreciated that specific functions, and accordingly utilities, of VGAM1411 correlate with, and may be deduced from, the identity of the target genes which VGAM1411 binds and inhibits, and the function of these target genes, as elaborated hereinbelow.

Poliovirus Receptor (PVR, Accession NM_006505) is a VGAM1411 host target gene. PVR BINDING SITE is HOST TARGET binding site found in the 3" untranslated region of mRNA encoded by PVR, corresponding to a HOST TARGET binding site such as BINDING SITE I, BINDING SITE II or BINDING SITE III. Table 2 illustrates the complementarity of the nucleotide sequences of PVR BINDING SITE, designated SEQ ID:13253, to the nucleotide sequence of VGAM1411 RNA, herein designated VGAM RNA, also designated SEQ ID:4122.

A function of VGAM1411 is therefore inhibition of Poliovirus Receptor (PVR, Accession NM_006505), a gene which is a poliovirus receptor. Accordingly, utilities of VGAM1411 include diagnosis, prevention and treatment of diseases and clinical conditions associated with PVR. The function of PVR has been established by previous studies. Primates are susceptible to poliomyelitis infection, but rodents are not; furthermore, human cells but not rodent cells are killed by poliovirus in vitro. Susceptibility to poliovirus is a function of the presence or absence of a cellular receptor to which the virus binds as the first step in poliovirus replication. Mendelsohn et al. (1986) succeeded in transforming a human poliovirus receptor gene into mouse L cells which are ordinarily resistant to poliovirus infection because they do not bear a poliovirus receptor. Monoclonal antibody directed against the HeLa cell poliovirus receptor site was used in rosette assays to identify poliovirus-sensitive transformants. In a study of human-mouse hybrids, Miller et al. (1974) showed that chromosome 19 is correlated with susceptibility to poliovirus. Siddique et al. (1985) regionalized the PVS gene to 19q13-qter. By the study of rodent/human hybrid cell lines carrying 4 different regions of human chromosome 19, Siddique et al. (1988) demonstrated that the typical cytopathic effects of poliovirus infection were observed only when the region 19q12-q13.2 was contained as the smallest region of overlap. The same region contains the gene for myotonic dystrophy (OMIM Ref. No. 160900). The PVS gene is also of interest in connection with inherited motor neuron diseases because it encodes a cell-surface receptor expressed on motor neurons. Shepley et al. (1988) prepared a monoclonal antibody that identified a 100-kD membrane protein in HeLa cells and in human spinal cord involved in poliovirus attachment. They showed that the antigen identified by the monoclonal antibody was associated with the presence of human chromosome 19 in human-mouse hybrid cell lines. The monoclonal antibodies stained neurons in the reticular formation and clusters of brain stem neurons, consistent with the known pattern of damage caused by poliovirus infection in the brain stem. Furthermore, it reacted with human peripheral mononuclear cells, consistent with the known replication of poliovirus in Peyer patches and tonsils. Schonk et al. (1990) assigned the PVS gene to 19q13.2 by hybridization studies using a panel of somatic cell hybrids with subchromosomal segments of 19q. By fluorescence in situ hybridization, Trask et al. (1993) assigned the PVS gene to 19q13.2-q13.3. Seldin et al. (1991) mapped the homologous gene in the mouse to chromosome 9.

Full details of the abovementioned studies are described in the following publications, the disclosure of which are hereby incorporated by reference:

Mendelsohn, C.; Johnson, B.; Lionetti, K. A.; Nobis, P.; Wimmer, E.; Racaniello, V. R.: Transformation of a human poliovirus receptor gene into mouse cells. Proc. Nat. Acad. Sci. 83:7845-7849, 1986; and Seldin, M. F.; Saunders, A. M.; Rochelle, J. M.; Howard, T. A.: A proximal mouse chromosome 9 linkage map that further defines linkage groups homologous with segments of human chromosom.

Further studies establishing the function and utilities of PVR are found in John Hopkins OMIM database record ID 173850, and in sited publications numbered 2745-2751, 3792, 4813-177 and 4710 listed in the bibliography section hereinbelow, which are also hereby incorporated by reference. KIAA0635 (Accession NM_014645) is another VGAM1411 host target gene. KIAA0635 BINDING SITE is HOST TARGET binding site found in the 5" untranslated region of mRNA encoded by KIAA0635, corresponding to a HOST TARGET binding site such as BINDING SITE I, BINDING SITE II or BINDING SITE III. Table 2 illustrates the complementarity of the nucleotide sequences of KIAA0635 BINDING SITE, designated SEQ ID:16055, to the nucleotide sequence of VGAM1411 RNA, herein designated VGAM RNA, also designated SEQ ID:4122.

Another function of VGAM1411 is therefore inhibition of KIAA0635 (Accession NM_014645). Accordingly, utilities of VGAM1411 include diagnosis, prevention and treatment of diseases and clinical conditions associated with KIAA0635. KIAA0894 (Accession NM_014896) is another VGAM1411 host target gene. KIAA0894 BINDING SITE is HOST TARGET binding site found in the 3' untranslated region of mRNA encoded by KIAA0894, corresponding to a HOST TARGET binding site such as BINDING SITE I, BINDING SITE II or BINDING SITE III. Table 2 illustrates the complementarity of the nucleotide sequences of KIAA0894 BINDING SITE, designated SEQ ID:17055, to the nucleotide sequence of VGAM1411 RNA, herein designated VGAM RNA, also designated SEQ ID:4122.

Another function of VGAM1411 is therefore inhibition of KIAA0894 (Accession NM_014896). Accordingly, utilities of VGAM1411 include diagnosis, prevention and treatment of diseases and clinical conditions associated with KIAA0894. LOC54505 (Accession XM_042110) is another VGAM1411 host target gene. LOC54505 BINDING SITE is HOST TARGET binding site found in the 5' untranslated region of mRNA encoded by LOC54505, corresponding to a HOST TARGET binding site such as BINDING SITE I, BINDING SITE II or BINDING SITE III. Table 2 illustrates the complementarity of the nucleotide sequences of LOC54505 BINDING SITE, designated SEQ ID:33694, to the nucleotide sequence of VGAM1411 RNA, herein designated VGAM RNA, also designated SEQ ID:4122.

Another function of VGAM1411 is therefore inhibition of LOC54505 (Accession XM_042110). Accordingly, utilities of VGAM1411 include diagnosis, prevention and treatment of diseases and clinical conditions associated with LOC54505. FIG. 1 further provides a conceptual description of a novel bioinformatically detected viral gene of the present invention, referred to here as Viral Genomic Address Messenger 1412 (VGAM1412) viral gene, which modulates expression of respective host target genes thereof, the function and utility of which host target genes is known in the art.

VGAM1412 is a novel bioinformatically detected regulatory, non protein coding, viral micro RNA (miRNA) gene. The method by which VGAM1412 was detected is described hereinabove with reference to FIGS. 1-8.

VGAM1412 gene, herein designated VGAM GENE, is a viral gene contained in the genome of Bean Yellow Mosaic Virus. VGAM1412 host target gene, herein designated VGAM HOST TARGET GENE, is a human gene contained in the human genome.

VGAM1412 gene encodes a VGAM1412 precursor RNA, herein designated VGAM PRECURSOR RNA. Similar to other miRNA genes, and unlike most ordinary genes, VGAM1412 precursor RNA does not encode a protein. A nucleotide sequence identical or highly similar to the nucleotide sequence of VGAM1412 precursor RNA is designated SEQ ID:1398, and is provided hereinbelow with reference to the sequence listing part. Nucleotide sequence SEQ ID:1398 is located at position 555 relative to the genome of Bean Yellow Mosaic Virus.

VGAM1412 precursor RNA folds onto itself, forming VGAM1412 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1412 folded precursor RNA into VGAM1412 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1412 RNA is designated SEQ ID:4123, and is provided hereinbelow with reference to the sequence listing part.

VGAM1412 host target gene, herein designated VGAM HOST TARGET GENE, encodes a corresponding messenger RNA, VGAM1412 host target RNA, herein designated VGAM HOST TARGET RNA. VGAM1412 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1412 RNA, herein designated VGAM RNA, binds complementarily to one or more host target binding sites located in untranslated regions of VGAM1412 host target RNA, herein designated VGAM HOST TARGET RNA. This complementary binding is due to the fact that the nucleotide sequence of VGAM1412 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1412 RNA, herein designated VGAM RNA, may have a different number of host target binding sites in untranslated regions of a VGAM1412 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1412 RNA, herein designated VGAM RNA, to host target binding sites on VGAM1412 host target RNA, herein designated VGAM HOST TARGET RNA, such as BINDING SITE I, BINDING SITE II and BINDING SITE III, inhibits translation of VGAM1412 host target RNA into VGAM1412 host target protein, herein designated VGAM HOST TARGET PROTEIN. VGAM host target protein is therefore outlined by a broken line.

It is appreciated that VGAM1412 host target gene, herein designated VGAM HOST TARGET GENE, in fact represents a plurality of VGAM1412 host target genes. The mRNA of each one of this plurality of VGAM1412 host target genes comprises one or more host target binding sites, each having a nucleotide sequence which is at least partly complementary to VGAM1412 RNA, herein designated VGAM RNA, and which when bound by VGAM1412 RNA causes inhibition of translation of respective one or more VGAM1412 host target proteins.

It is further appreciated by one skilled in the art that the mode of translational inhibition illustrated by FIG. 1 with specific reference to translational inhibition exerted by VGAM1412 gene, herein designated VGAM GENE, on one or more VGAM1412 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1412 is inhibition of expression of host target genes, as part of a novel viral mechanism of attacking a host. Accordingly, utilities of VGAM1412 include diagnosis, prevention and treatment of viral infection by Bean Yellow Mosaic Virus. Specific functions, and accordingly utilities, of VGAM1412 correlate with, and may be deduced from, the identity of the host target genes which VGAM1412 binds and inhibits, and the function of these host target genes, as elaborated hereinbelow.

Nucleotide sequences of the VGAM1412 precursor RNA, herein designated VGAM PRECURSOR RNA, and of the 'diced' VGAM1412 RNA, herein designated VGAM RNA, and a schematic representation of the secondary folding of VGAM1412 folded precursor RNA, herein designated VGAM FOLDED PRECURSOR RNA, of VGAM1412 are further described hereinbelow with reference to Table 1.

Nucleotide sequences of host target binding sites, such as BINDING SITE-I, BINDING SITE-II and BINDING SITE-III of FIG. 1, found on VGAM1412 host target RNA, and schematic representation of the complementarity of each of these host target binding sites to VGAM1412 RNA, herein designated VGAM RNA, are described hereinbelow with reference to Table 2.

As mentioned hereinabove with reference to FIG. 1, a function of VGAM1412 gene, herein designated VGAM is inhibition of expression of VGAM1412 target genes. It is appreciated that specific functions, and accordingly utilities, of VGAM1412 correlate with, and may be deduced from, the identity of the target genes which VGAM1412 binds and inhibits, and the function of these target genes, as elaborated hereinbelow.

Platelet-derived Growth Factor Receptor, Alpha Polypeptide (PDGFRA, Accession NM_006206) is a VGAM1412 host target gene. PDGFRA BINDING SITE is HOST TARGET binding site found in the 3' untranslated region of mRNA encoded by PDGFRA, corresponding to a HOST TARGET binding site such as BINDING SITE I, BINDING SITE II or BINDING SITE III. Table 2 illustrates the complementarity of the nucleotide sequences of PDGFRA BINDING SITE, designated SEQ ID:12880, to the nucleotide sequence of VGAM1412 RNA, herein designated VGAM RNA, also designated SEQ ID:4123.

A function of VGAM1412 is therefore inhibition of Platelet-derived Growth Factor Receptor, Alpha Polypeptide (PDGFRA, Accession NM_006206), a gene which this receptor binds platelet-derived growth factor and has a tyrosine-protein kinase activity. Accordingly, utilities of VGAM1412 include diagnosis, prevention and treatment of diseases and clinical conditions associated with PDGFRA. The function of PDGFRA and its association with various diseases and clinical conditions, has been established by previous studies, as described hereinabove with reference to VGAM117. Serine/threonine Kinase 38 (STK38, Accession NM_007271) is another VGAM1412 host target gene. STK38 BINDING SITE is HOST TARGET binding site found in the 3' untranslated region of mRNA encoded by STK38, corresponding to a HOST TARGET binding site such as BINDING SITE I, BINDING SITE II or BINDING SITE III. Table 2 illustrates the complementarity of the nucleotide sequences of STK38 BINDING SITE, designated SEQ ID:14134, to the nucleotide sequence of VGAM1412 RNA, herein designated VGAM RNA, also designated SEQ ID:4123.

Another function of VGAM1412 is therefore inhibition of Serine/threonine Kinase 38 (STK38, Accession NM_007271). Accordingly, utilities of VGAM1412 include diagnosis, prevention and treatment of diseases and clinical conditions associated with STK38. DKFZp434K2435 (Accession NM_032256) is another VGAM1412 host target gene. DKFZp434K2435 BINDING SITE is HOST TARGET binding site found in the 3' untranslated region of mRNA encoded by DKFZp434K2435, corresponding to a HOST TARGET binding site such as BINDING SITE I, BINDING SITE II or BINDING SITE III. Table 2 illustrates the complementarity of the nucleotide sequences of DKFZp434K2435 BINDING SITE, designated SEQ ID:26001, to the nucleotide sequence of VGAM1412 RNA, herein designated VGAM RNA, also designated SEQ ID:4123.

Another function of VGAM1412 is therefore inhibition of DKFZp434K2435 (Accession NM_032256). Accordingly, utilities of VGAM1412 include diagnosis, prevention and treatment of diseases and clinical conditions associated with DKFZp434K2435. FLJ20051 (Accession NM_019087) is another VGAM1412 host target gene. FLJ20051 BINDING SITE is HOST TARGET binding site found in the 3' untranslated region of mRNA encoded by FLJ20051, corresponding to a HOST TARGET binding site such as BINDING SITE I, BINDING SITE II or BINDING SITE III. Table 2 illustrates the complementarity of the nucleotide sequences of FLJ20051 BINDING SITE, designated SEQ ID:21162, to the nucleotide sequence of VGAM1412 RNA, herein designated VGAM RNA, also designated SEQ ID:4123.

Another function of VGAM1412 is therefore inhibition of FLJ20051 (Accession NM_019087). Accordingly, utilities of VGAM1412 include diagnosis, prevention and treatment of diseases and clinical conditions associated with FLJ20051. LOC221687 (Accession XM_166423) is another VGAM1412 host target gene. LOC221687 BINDING SITE is HOST TARGET binding site found in the 3' untranslated region of mRNA encoded by LOC221687, corresponding to a HOST TARGET binding site such as BINDING SITE I, BINDING SITE II or BINDING SITE III. Table 2 illustrates the complementarity of the nucleotide sequences of LOC221687 BINDING SITE, designated SEQ ID:44302, to the nucleotide sequence of VGAM1412 RNA, herein designated VGAM RNA, also designated SEQ ID:4123.

Another function of VGAM1412 is therefore inhibition of LOC221687 (Accession XM_166423). Accordingly, utilities of VGAM1412 include diagnosis, prevention and treatment of diseases and clinical conditions associated with LOC221687. FIG. 1 further provides a conceptual description of a novel bioinformatically detected viral gene of the present invention, referred to here as Viral Genomic Address Messenger 1413 (VGAM1413) viral gene, which modulates expression of respective host target genes thereof, the function and utility of which host target genes is known in the art.

VGAM1413 is a novel bioinformatically detected regulatory, non protein coding, viral micro RNA (miRNA) gene. The method by which VGAM1413 was detected is described hereinabove with reference to FIGS. 1-8.

VGAM1413 gene, herein designated VGAM GENE, is a viral gene contained in the genome of Bean Yellow Mosaic Virus. VGAM1413 host target gene, herein designated VGAM HOST TARGET GENE, is a human gene contained in the human genome.

VGAM1413 gene encodes a VGAM1413 precursor RNA, herein designated VGAM PRECURSOR RNA. Similar to other miRNA genes, and unlike most ordinary genes, VGAM1413 precursor RNA does not encode a protein. A nucleotide sequence identical or highly similar to the nucleotide sequence of VGAM1413 precursor RNA is designated SEQ ID:1399, and is provided hereinbelow with reference to the sequence listing part. Nucleotide sequence SEQ ID:1399 is located at position 4084 relative to the genome of Bean Yellow Mosaic Virus.

VGAM1413 precursor RNA folds onto itself, forming VGAM1413 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1413 folded precursor RNA into VGAM1413 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1413 RNA is designated SEQ ID:4124, and is provided hereinbelow with reference to the sequence listing part.

VGAM1413 host target gene, herein designated VGAM HOST TARGET GENE, encodes a corresponding messenger RNA, VGAM1413 host target RNA, herein designated VGAM HOST TARGET RNA. VGAM1413 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1413 RNA, herein designated VGAM RNA, binds complementarily to one or more host target binding sites located in untranslated regions of VGAM1413 host target RNA, herein designated VGAM HOST TARGET RNA. This complementary binding is due to the fact that the nucleotide sequence of VGAM1413 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1413 RNA, herein designated VGAM RNA, may have a different number of host target binding sites in untranslated regions of a VGAM1413 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1413 RNA, herein designated VGAM RNA, to host target binding sites on VGAM1413 host target RNA, herein designated VGAM HOST TARGET RNA, such as BINDING SITE I, BINDING SITE II and BINDING SITE III, inhibits translation of VGAM1413 host target RNA into VGAM1413 host target protein, herein designated VGAM HOST TARGET PROTEIN. VGAM host target protein is therefore outlined by a broken line.

It is appreciated that VGAM1413 host target gene, herein designated VGAM HOST TARGET GENE, in fact represents a plurality of VGAM1413 host target genes. The mRNA of each one of this plurality of VGAM1413 host target genes comprises one or more host target binding sites, each having a nucleotide sequence which is at least partly complementary to VGAM1413 RNA, herein designated VGAM RNA, and which when bound by VGAM1413 RNA causes inhibition of translation of respective one or more VGAM1413 host target proteins.

It is further appreciated by one skilled in the art that the mode of translational inhibition illustrated by FIG. 1 with specific reference to translational inhibition exerted by VGAM1413 gene, herein designated VGAM GENE, on one or more VGAM1413 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1413 is inhibition of expression of host target genes, as part of a novel viral mechanism of attacking a host. Accordingly, utilities of VGAM1413 include diagnosis, prevention and treatment of viral infection by Bean Yellow Mosaic Virus. Specific functions, and accordingly utilities, of VGAM1413 correlate with, and may be deduced from, the identity of the host target genes which VGAM1413 binds and inhibits, and the function of these host target genes, as elaborated hereinbelow.

Nucleotide sequences of the VGAM1413 precursor RNA, herein designated VGAM PRECURSOR RNA, and of the 'diced' VGAM1413 RNA, herein designated VGAM RNA, and a schematic representation of the secondary folding of VGAM1413 folded precursor RNA, herein designated VGAM FOLDED PRECURSOR RNA, of VGAM1413 are further described hereinbelow with reference to Table 1.

Nucleotide sequences of host target binding sites, such as BINDING SITE-I, BINDING SITE-II and BINDING SITE-III of FIG. 1, found on VGAM1413 host target RNA, and schematic representation of the complementarity of each of these host target binding sites to VGAM1413 RNA, herein designated VGAM RNA, are described hereinbelow with reference to Table 2.

As mentioned hereinabove with reference to FIG. 1, a function of VGAM1413 gene, herein designated VGAM is inhibition of expression of VGAM1413 target genes. It is appreciated that specific functions, and accordingly utilities, of VGAM1413 correlate with, and may be deduced from, the identity of the target genes which VGAM1413 binds and inhibits, and the function of these target genes, as elaborated hereinbelow.

Dyskeratosis Congenita 1, Dyskerin (DKC1, Accession NM_001363) is a VGAM1413 host target gene. DKC1 BINDING SITE is HOST TARGET binding site found in the 3' untranslated region of mRNA encoded by DKC1, corresponding to a HOST TARGET binding site such as BINDING SITE I, BINDING SITE II or BINDING SITE III. Table 2 illustrates the complementarity of the nucleotide sequences of DKC1 BINDING SITE, designated SEQ ID:7043, to the nucleotide sequence of VGAM1413 RNA, herein designated VGAM RNA, also designated SEQ ID:4124.

A function of VGAM1413 is therefore inhibition of Dyskeratosis Congenita 1, Dyskerin (DKC1, Accession NM_001363), a gene which may have cell cycle and nucleolar functions. Accordingly, utilities of VGAM1413 include diagnosis, prevention and treatment of diseases and clinical conditions associated with DKC1. The function of DKC1 and its association with various diseases and clinical conditions, has been established by previous studies, as described hereinabove with reference to VGAM559. Interleukin 16 (lymphocyte chemoattractant factor) (IL16, Accession NM_004513) is another VGAM1413 host target gene. IL16 BINDING SITE is HOST TARGET binding site found in the 3' untranslated region of mRNA encoded by IL16, corresponding to a HOST TARGET binding site such as BINDING SITE I, BINDING SITE II or BINDING SITE III. Table 2 illustrates the complementarity of the nucleotide sequences of IL16 BINDING SITE, designated SEQ ID:10839, to the nucleotide sequence of VGAM1413 RNA, herein designated VGAM RNA, also designated SEQ ID:4124.

Another function of VGAM1413 is therefore inhibition of Interleukin 16 (lymphocyte chemoattractant factor) (IL16, Accession NM_004513), a gene which modulates T-cell activation. Accordingly, utilities of VGAM1413 include diagnosis, prevention and treatment of diseases and clinical conditions associated with IL16. The function of IL16 and its association with various diseases and clinical conditions, has been established by previous studies, as described hereinabove with reference to VGAM819. Cyclin B3 (CCNB3, Accession NM_033671) is another VGAM1413 host target gene. CCNB3 BINDING SITE is HOST TARGET binding site found in the 3' untranslated region of mRNA encoded by CCNB3, corresponding to a HOST TARGET binding site such as BINDING SITE I, BINDING SITE II or BINDING SITE III. Table 2 illustrates the complementarity of the nucleotide sequences of CCNB3 BINDING SITE, designated SEQ ID:27396, to the nucleotide sequence of VGAM1413 RNA, herein designated VGAM RNA, also designated SEQ ID:4124.

Another function of VGAM1413 is therefore inhibition of Cyclin B3 (CCNB3, Accession NM_033671). Accordingly, utilities of VGAM1413 include diagnosis, prevention and treatment of diseases and clinical conditions associated with CCNB3. DKFZP586M1120 (Accession NM_031294) is another VGAM1413 host target gene. DKFZP586M1120 BINDING SITE is HOST TARGET binding site found in the 3' untranslated region of mRNA encoded by DKFZP586M1120, corresponding to a HOST TARGET binding site such as BINDING SITE I, BINDING SITE II or BINDING SITE III. Table 2 illustrates the complementarity of the nucleotide sequences of DKFZP586M1120 BINDING SITE, designated SEQ ID:25317, to the nucleotide sequence of VGAM1413 RNA, herein designated VGAM RNA, also designated SEQ ID:4124.

Another function of VGAM1413 is therefore inhibition of DKFZP586M1120 (Accession NM_031294). Accordingly, utilities of VGAM1413 include diagnosis, prevention and treatment of diseases and clinical conditions associated with DKFZP586M1120. PB1 (Accession NM_018165) is another VGAM1413 host target gene. PB1 BINDING SITE is HOST TARGET binding site found in the 3' untranslated region of mRNA encoded by PB1, corresponding to a HOST TARGET binding site such as BINDING SITE I, BINDING SITE II or BINDING SITE III. Table 2 illustrates the complementarity of the nucleotide sequences of PB1 BINDING SITE, designated SEQ ID:19978, to the nucleotide sequence of VGAM1413 RNA, herein designated VGAM RNA, also designated SEQ ID:4124.

Another function of VGAM1413 is therefore inhibition of PB1 (Accession NM_018165). Accordingly, utilities of VGAM1413 include diagnosis, prevention and treatment of diseases and clinical conditions associated with PB1. Signal Recognition Particle 9 kDa (SRP9, Accession XM_086431) is another VGAM1413 host target gene. SRP9 BINDING SITE is HOST TARGET binding site found in the 3' untranslated region of mRNA encoded by SRP9, corresponding to a HOST TARGET binding site such as BINDING SITE I, BINDING SITE II or BINDING SITE III. Table 2 illustrates the complementarity of the nucleotide sequences of SRP9 BINDING SITE, designated SEQ ID:38649, to the nucleotide sequence of VGAM1413 RNA, herein designated VGAM RNA, also designated SEQ ID:4124.

Another function of VGAM1413 is therefore inhibition of Signal Recognition Particle 9 kDa (SRP9, Accession XM_086431). Accordingly, utilities of VGAM1413 include diagnosis, prevention and treatment of diseases and clinical conditions associated with SRP9. LOC145268 (Accession XM_085072) is another VGAM1413 host target gene. LOC145268 BINDING SITE is HOST TARGET binding site found in the 5' untranslated region of mRNA encoded by LOC145268, corresponding to a HOST TARGET binding site such as BINDING SITE I, BINDING SITE II or BINDING SITE III. Table 2 illustrates the complementarity of the nucleotide sequences of LOC145268 BINDING SITE, designated SEQ ID:37812, to the nucleotide sequence of VGAM1413 RNA, herein designated VGAM RNA, also designated SEQ ID:4124.

Another function of VGAM1413 is therefore inhibition of LOC145268 (Accession XM_085072). Accordingly, utilities of VGAM1413 include diagnosis, prevention and treatment of diseases and clinical conditions associated with LOC145268. LOC153205 (Accession XM_098322) is another VGAM1413 host target gene. LOC153205 BINDING SITE is HOST TARGET binding site found in the 3' untranslated region of mRNA encoded by LOC153205, corresponding to a HOST TARGET binding site such as BINDING SITE I, BINDING SITE II or BINDING SITE III. Table 2 illustrates the complementarity of the nucleotide sequences of LOC153205 BINDING SITE, designated SEQ ID:41580, to the nucleotide sequence of VGAM1413 RNA, herein designated VGAM RNA, also designated SEQ ID:4124.

Another function of VGAM1413 is therefore inhibition of LOC153205 (Accession XM_098322). Accordingly, utilities of VGAM1413 include diagnosis, prevention and treatment of diseases and clinical conditions associated with LOC153205. FIG. 1 further provides a conceptual description of a novel bioinformatically detected viral gene of the present invention, referred to here as Viral Genomic Address Messenger 1414 (VGAM1414) viral gene, which modulates expression of respective host target genes thereof, the function and utility of which host target genes is known in the art.

VGAM1414 is a novel bioinformatically detected regulatory, non protein coding, viral micro RNA (miRNA) gene. The method by which VGAM1414 was detected is described hereinabove with reference to FIGS. 1-8.

VGAM1414 gene, herein designated VGAM GENE, is a viral gene contained in the genome of Bean Yellow Mosaic Virus. VGAM1414 host target gene, herein designated VGAM HOST TARGET GENE, is a human gene contained in the human genome.

VGAM1414 gene encodes a VGAM1414 precursor RNA, herein designated VGAM PRECURSOR RNA. Similar to other miRNA genes, and unlike most ordinary genes, VGAM1414 precursor RNA does not encode a protein. A nucleotide sequence identical or highly similar to the nucleotide sequence of VGAM1414 precursor RNA is designated SEQ ID:1400, and is provided hereinbelow with reference to the sequence listing part. Nucleotide sequence SEQ ID:1400 is located at position 1603 relative to the genome of Bean Yellow Mosaic Virus.

VGAM1414 precursor RNA folds onto itself, forming VGAM1414 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1414 folded precursor RNA into VGAM1414 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1414 RNA is designated SEQ ID:4125, and is provided hereinbelow with reference to the sequence listing part.

VGAM1414 host target gene, herein designated VGAM HOST TARGET GENE, encodes a corresponding messenger RNA, VGAM1414 host target RNA, herein designated VGAM HOST TARGET RNA. VGAM1414 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1414 RNA, herein designated VGAM RNA, binds complementarily to one or more host target binding sites located in untranslated regions of VGAM1414 host target RNA, herein designated VGAM HOST TARGET RNA. This complementary binding is due to the fact that the nucleotide sequence of VGAM1414 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1414 RNA, herein designated VGAM RNA, may have a different number of host target binding sites in untranslated regions of a VGAM1414 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1414 RNA, herein designated VGAM RNA, to host target binding sites on VGAM1414 host target RNA, herein designated VGAM HOST TARGET RNA, such as BINDING SITE I, BINDING SITE II and BINDING SITE III, inhibits translation of VGAM1414 host target RNA into VGAM1414 host target protein, herein designated VGAM HOST TARGET PROTEIN. VGAM host target protein is therefore outlined by a broken line.

It is appreciated that VGAM1414 host target gene, herein designated VGAM HOST TARGET GENE, in fact represents a plurality of VGAM1414 host target genes. The mRNA of each one of this plurality of VGAM1414 host target genes comprises one or more host target binding sites, each having a nucleotide sequence which is at least partly complementary to VGAM1414 RNA, herein designated VGAM RNA, and which when bound by VGAM1414 RNA causes inhibition of translation of respective one or more VGAM1414 host target proteins.

It is further appreciated by one skilled in the art that the mode of translational inhibition illustrated by FIG. 1 with specific reference to translational inhibition exerted by VGAM1414 gene, herein designated VGAM GENE, on one or more VGAM1414 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1414 is inhibition of expression of host target genes, as part of a novel viral mechanism of attacking a host. Accordingly, utilities of VGAM1414 include diagnosis, prevention and treatment of viral infection by Bean Yellow Mosaic Virus. Specific functions, and accordingly utilities, of VGAM1414 correlate with, and may be deduced from, the identity of the host target genes which VGAM1414 binds and inhibits, and the function of these host target genes, as elaborated hereinbelow.

Nucleotide sequences of the VGAM1414 precursor RNA, herein designated VGAM PRECURSOR RNA, and of the 'diced' VGAM1414 RNA, herein designated VGAM RNA, and a schematic representation of the secondary folding of VGAM1414 folded precursor RNA, herein designated VGAM FOLDED PRECURSOR RNA, of VGAM1414 are further described hereinbelow with reference to Table 1.

Nucleotide sequences of host target binding sites, such as BINDING SITE-I, BINDING SITE-II and BINDING SITE-III of FIG. 1, found on VGAM1414 host target RNA, and schematic representation of the complementarity of each of these host target binding sites to VGAM1414 RNA, herein designated VGAM RNA, are described hereinbelow with reference to Table 2.

As mentioned hereinabove with reference to FIG. 1, a function of VGAM1414 gene, herein designated VGAM is inhibition of expression of VGAM1414 target genes. It is appreciated that specific functions, and accordingly utilities, of VGAM1414 correlate with, and may be deduced from, the identity of the target genes which VGAM1414 binds and inhibits, and the function of these target genes, as elaborated hereinbelow.

ATPase, Na+/K+ Transporting, Alpha 2 (+) Polypeptide (ATP1A2, Accession NM_000702) is a VGAM1414 host target gene. ATP1A2 BINDING SITE is HOST TARGET binding site found in the 3' untranslated region of mRNA encoded by ATP1A2, corresponding to a HOST TARGET binding site such as BINDING SITE I, BINDING SITE II or BINDING SITE III. Table 2 illustrates the complementarity of the nucleotide sequences of ATP1A2 BINDING SITE, designated SEQ ID:6366, to the nucleotide sequence of VGAM1414 RNA, herein designated VGAM RNA, also designated SEQ ID:4125.

A function of VGAM1414 is therefore inhibition of ATPase, Na+/K+ Transporting, Alpha 2 (+) Polypeptide (ATP1A2, Accession NM_000702). Accordingly, utilities of VGAM1414 include diagnosis, prevention and treatment of diseases and clinical conditions associated with ATP1A2. Proteoglycan 4, (megakaryocyte stimulating factor, articular superficial zone protein, camptodactyly, arthropathy, coxa vara, pericarditis syndrome) (PRG4, Accession NM_005807) is another VGAM1414 host target gene. PRG4 BINDING SITE is HOST TARGET binding site found in the 3' untranslated region of mRNA encoded by PRG4, corresponding to a HOST TARGET binding site such as BINDING SITE I, BINDING SITE II or BINDING SITE III. Table 2 illustrates the complementarity of the nucleotide sequences of PRG4 BINDING SITE, designated SEQ ID:12383, to the nucleotide sequence of VGAM1414 RNA, herein designated VGAM RNA, also designated SEQ ID:4125.

Another function of VGAM1414 is therefore inhibition of Proteoglycan 4, (megakaryocyte stimulating factor, articular superficial zone protein, camptodactyly, arthropathy, coxa vara, pericarditis syndrome) (PRG4, Accession NM_005807). Accordingly, utilities of VGAM1414 include diagnosis, prevention and treatment of diseases and clinical conditions associated with PRG4. TAP Binding Protein (tapasin) (TAPBP, Accession NM_003190) is another VGAM1414 host target gene. TAPBP BINDING SITE is HOST TARGET binding site found in the 3' untranslated region of mRNA encoded by TAPBP, corresponding to a HOST TARGET binding site such as BINDING SITE I, BINDING SITE II or BINDING SITE III. Table 2 illustrates the complementarity of the nucleotide sequences of TAPBP BINDING SITE, designated SEQ ID:9181, to the nucleotide sequence of VGAM1414 RNA, herein designated VGAM RNA, also designated SEQ ID:4125.

Another function of VGAM1414 is therefore inhibition of TAP Binding Protein (tapasin) (TAPBP, Accession NM_003190), a gene which is involved in MHC class I-restricted antigen processing. Accordingly, utilities of VGAM1414 include diagnosis, prevention and treatment of diseases and clinical conditions associated with TAPBP. The function of TAPBP and its association with various diseases and clinical conditions, has been established by previous studies, as described hereinabove with reference to VGAM122. CEPT1 (Accession NM_006090) is another VGAM1414 host target gene. CEPT1 BINDING SITE is HOST TARGET binding site found in the 3' untranslated region of mRNA encoded by CEPT1, corresponding to a HOST TARGET binding site such as BINDING SITE I, BINDING SITE II or BINDING SITE III. Table 2 illustrates the complementarity of the nucleotide sequences of CEPT1 BINDING SITE, designated SEQ ID:12737, to the nucleotide sequence of VGAM1414 RNA, herein designated VGAM RNA, also designated SEQ ID:4125.

Another function of VGAM1414 is therefore inhibition of CEPT1 (Accession NM_006090). Accordingly, utilities of VGAM1414 include diagnosis, prevention and treatment of diseases and clinical conditions associated with CEPT1. FLJ20086 (Accession NM_017661) is another VGAM1414 host target gene. FLJ20086 BINDING SITE is HOST TARGET binding site found in the 3' untranslated region of mRNA encoded by FLJ20086, corresponding to a HOST TARGET binding site such as BINDING SITE I, BINDING SITE II or BINDING SITE III. Table 2 illustrates the complementarity of the nucleotide sequences of FLJ20086 BINDING SITE, designated SEQ ID:19190, to the nucleotide sequence of VGAM1414 RNA, herein designated VGAM RNA, also designated SEQ ID:4125.

Another function of VGAM1414 is therefore inhibition of FLJ20086 (Accession NM_017661). Accordingly, utilities of VGAM1414 include diagnosis, prevention and treatment of diseases and clinical conditions associated with FLJ20086. FIG. 1 further provides a conceptual description of a novel bioinformatically detected viral gene of the present invention, referred to here as Viral Genomic Address Messenger 1415 (VGAM1415) viral gene, which modulates expression of respective host target genes thereof, the function and utility of which host target genes is known in the art.

VGAM1415 is a novel bioinformatically detected regulatory, non protein coding, viral micro RNA (miRNA) gene. The method by which VGAM1415 was detected is described hereinabove with reference to FIGS. 1-8.

VGAM1415 gene, herein designated VGAM GENE, is a viral gene contained in the genome of Bean Yellow Mosaic Virus. VGAM1415 host target gene, herein designated VGAM HOST TARGET GENE, is a human gene contained in the human genome.

VGAM1415 gene encodes a VGAM1415 precursor RNA, herein designated VGAM PRECURSOR RNA. Similar to other miRNA genes, and unlike most ordinary genes, VGAM1415 precursor RNA does not encode a protein. A nucleotide sequence identical or highly similar to the nucleotide sequence of VGAM1415 precursor RNA is designated SEQ ID:1401, and is provided hereinbelow with reference to the sequence listing part. Nucleotide sequence SEQ ID:1401 is located at position 1048 relative to the genome of Bean Yellow Mosaic Virus.

VGAM1415 precursor RNA folds onto itself, forming VGAM1415 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1415 folded precursor RNA into VGAM1415 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 67%) nucleotide sequence of VGAM1415 RNA is designated SEQ ID:4126, and is provided hereinbelow with reference to the sequence listing part.

VGAM1415 host target gene, herein designated VGAM HOST TARGET GENE, encodes a corresponding messenger RNA, VGAM1415 host target RNA, herein designated VGAM HOST TARGET RNA. VGAM1415 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1415 RNA, herein designated VGAM RNA, binds complementarily to one or more host target binding sites located in untranslated regions of VGAM1415 host target RNA, herein designated VGAM HOST TARGET RNA. This complementary binding is due to the fact that the nucleotide sequence of VGAM1415 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1415 RNA, herein designated VGAM RNA, may have a different number of host target binding sites in untranslated regions of a VGAM1415 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1415 RNA, herein designated VGAM RNA, to host target binding sites on VGAM1415 host target RNA, herein designated VGAM HOST TARGET RNA, such as BINDING SITE I, BINDING SITE II and BINDING SITE III, inhibits translation of VGAM1415 host target RNA into VGAM1415 host target protein, herein designated VGAM HOST TARGET PROTEIN. VGAM host target protein is therefore outlined by a broken line.

It is appreciated that VGAM1415 host target gene, herein designated VGAM HOST TARGET GENE, in fact represents a plurality of VGAM1415 host target genes. The mRNA of each one of this plurality of VGAM1415 host target genes comprises one or more host target binding sites, each having a nucleotide sequence which is at least partly complementary to VGAM1415 RNA, herein designated VGAM RNA, and which when bound by VGAM1415 RNA causes inhibition of translation of respective one or more VGAM1415 host target proteins.

It is further appreciated by one skilled in the art that the mode of translational inhibition illustrated by FIG. 1 with specific reference to translational inhibition exerted by VGAM1415 gene, herein designated VGAM GENE, on one or more VGAM1415 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1415 is inhibition of expression of host target genes, as part of a novel viral mechanism of attacking a host. Accordingly, utilities of VGAM1415 include diagnosis, prevention and treatment of viral infection by Bean Yellow Mosaic Virus. Specific functions, and accordingly utilities, of VGAM1415 correlate with, and may be deduced from, the identity of the host target genes which VGAM1415 binds and inhibits, and the function of these host target genes, as elaborated hereinbelow.

Nucleotide sequences of the VGAM1415 precursor RNA, herein designated VGAM PRECURSOR RNA, and of the 'diced' VGAM1415 RNA, herein designated VGAM RNA, and a schematic representation of the secondary folding of VGAM1415 folded precursor RNA, herein designated VGAM FOLDED PRECURSOR RNA, of VGAM1415 are further described hereinbelow with reference to Table 1.

Nucleotide sequences of host target binding sites, such as BINDING SITE-I, BINDING SITE-II and BINDING SITE-III of FIG. 1, found on VGAM1415 host target RNA, and schematic representation of the complementarity of each of these host target binding sites to VGAM1415 RNA, herein designated VGAM RNA, are described hereinbelow with reference to Table 2.

As mentioned hereinabove with reference to FIG. 1, a function of VGAM1415 gene, herein designated VGAM is inhibition of expression of VGAM1415 target genes. It is appreciated that specific functions, and accordingly utilities, of VGAM1415 correlate with, and may be deduced from, the identity of the target genes which VGAM1415 binds and inhibits, and the function of these target genes, as elaborated hereinbelow.

DEK Oncogene (DNA binding) (DEK, Accession NM_003472) is a VGAM1415 host target gene. DEK BINDING SITE is HOST TARGET binding site found in the 3' untranslated region of mRNA encoded by DEK, corresponding to a HOST TARGET binding site such as BINDING SITE I, BINDING SITE II or BINDING SITE III. Table 2 illustrates the complementarity of the nucleotide sequences of DEK BINDING SITE, designated SEQ ID:9535, to the nucleotide sequence of VGAM1415 RNA, herein designated VGAM RNA, also designated SEQ ID:4126.

A function of VGAM1415 is therefore inhibition of DEK Oncogene (DNA binding) (DEK, Accession NM_003472), a gene which interacts in transcriptional regulation and signal transduction. Accordingly, utilities of VGAM1415 include diagnosis, prevention and treatment of diseases and clinical conditions associated with DEK. The function of DEK and its association with various diseases and clinical conditions, has been established by previous studies, as described hereinabove with reference to VGAM795. FLJ31300 (Accession NM_144639) is another VGAM1415 host target gene. FLJ31300 BINDING SITE is HOST TARGET binding site found in the 3' untranslated region of mRNA encoded by FLJ31300, corresponding to a HOST TARGET binding site such as BINDING SITE I, BINDING SITE II or BINDING SITE III. Table 2 illustrates the complementarity of the nucleotide sequences of FLJ31300 BINDING SITE, designated SEQ ID:29461, to the nucleotide sequence of VGAM1415 RNA, herein designated VGAM RNA, also designated SEQ ID:4126.

Another function of VGAM1415 is therefore inhibition of FLJ31300 (Accession NM_144639). Accordingly, utilities of VGAM1415 include diagnosis, prevention and treatment of diseases and clinical conditions associated with FLJ31300. FIG. 1 further provides a conceptual description of a novel bioinformatically detected viral gene of the present invention, referred to here as Viral Genomic Address Messenger 1416 (VGAM1416) viral gene, which modulates expression of respective host target genes thereof, the function and utility of which host target genes is known in the art.

VGAM1416 is a novel bioinformatically detected regulatory, non protein coding, viral micro RNA (miRNA) gene. The method by which VGAM1416 was detected is described hereinabove with reference to FIGS. 1-8.

VGAM1416 gene, herein designated VGAM GENE, is a viral gene contained in the genome of Ryegrass Mosaic Virus. VGAM1416 host target gene, herein designated VGAM HOST TARGET GENE, is a human gene contained in the human genome.

VGAM1416 gene encodes a VGAM1416 precursor RNA, herein designated VGAM PRECURSOR RNA. Similar to other miRNA genes, and unlike most ordinary genes, VGAM1416 precursor RNA does not encode a protein. A nucleotide sequence identical or highly similar to the nucleotide sequence of VGAM1416 precursor RNA is designated SEQ ID:1402, and is provided hereinbelow with reference to the sequence listing part. Nucleotide sequence SEQ ID:1402 is located at position 4175 relative to the genome of Ryegrass Mosaic Virus.

VGAM1416 precursor RNA folds onto itself, forming VGAM1416 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1416 folded precursor RNA into VGAM1416 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM1416 RNA is designated SEQ ID:4127, and is provided hereinbelow with reference to the sequence listing part.

VGAM1416 host target gene, herein designated VGAM HOST TARGET GENE, encodes a corresponding messenger RNA, VGAM1416 host target RNA, herein designated VGAM HOST TARGET RNA. VGAM1416 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1416 RNA, herein designated VGAM RNA, binds complementarily to one or more host target binding sites located in untranslated regions of VGAM1416 host target RNA, herein designated VGAM HOST TARGET RNA. This complementary binding is due to the fact that the nucleotide sequence of VGAM1416 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1416 RNA, herein designated VGAM RNA, may have a different number of host target binding sites in untranslated regions of a VGAM1416 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1416 RNA, herein designated VGAM RNA, to host target binding sites on VGAM1416 host target RNA, herein designated VGAM HOST TARGET RNA, such as BINDING SITE I, BINDING SITE II and BINDING SITE III, inhibits translation of VGAM1416 host target RNA into VGAM1416 host target protein, herein designated VGAM HOST TARGET PROTEIN. VGAM host target protein is therefore outlined by a broken line.

It is appreciated that VGAM1416 host target gene, herein designated VGAM HOST TARGET GENE, in fact represents a plurality of VGAM1416 host target genes. The mRNA of each one of this plurality of VGAM1416 host target genes comprises one or more host target binding sites, each having a nucleotide sequence which is at least partly complementary to VGAM1416 RNA, herein designated VGAM RNA, and which when bound by VGAM1416 RNA causes inhibition of translation of respective one or more VGAM1416 host target proteins.

It is further appreciated by one skilled in the art that the mode of translational inhibition illustrated by FIG. 1 with specific reference to translational inhibition exerted by VGAM1416 gene, herein designated VGAM GENE, on one or more VGAM1416 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1416 is inhibition of expression of host target genes, as part of a novel viral mechanism of attacking a host. Accordingly, utilities of VGAM1416 include diagnosis, prevention and treatment of viral infection by Ryegrass Mosaic Virus. Specific functions, and accordingly utilities, of VGAM1416 correlate with, and may be deduced from, the identity of the host target genes which VGAM1416 binds and inhibits, and the function of these host target genes, as elaborated hereinbelow.

Nucleotide sequences of the VGAM1416 precursor RNA, herein designated VGAM PRECURSOR RNA, and of the 'diced' VGAM1416 RNA, herein designated VGAM RNA, and a schematic representation of the secondary folding of VGAM1416 folded precursor RNA, herein designated VGAM FOLDED PRECURSOR RNA, of VGAM1416 are further described hereinbelow with reference to Table 1.

Nucleotide sequences of host target binding sites, such as BINDING SITE-I, BINDING SITE-II and BINDING SITE-III of FIG. 1, found on VGAM1416 host target RNA, and schematic representation of the complementarity of each of these host target binding sites to VGAM1416 RNA, herein designated VGAM RNA, are described hereinbelow with reference to Table 2.

As mentioned hereinabove with reference to FIG. 1, a function of VGAM1416 gene, herein designated VGAM is inhibition of expression of VGAM1416 target genes. It is appreciated that specific functions, and accordingly utilities, of VGAM1416 correlate with, and may be deduced from, the identity of the target genes which VGAM1416 binds and inhibits, and the function of these target genes, as elaborated hereinbelow.

Dentin Matrix Acidic Phosphoprotein (DMP1, Accession NM_004407) is a VGAM1416 host target gene. DMP1 BINDING SITE is HOST TARGET binding site found in the 3' untranslated region of mRNA encoded by DMP1, corresponding to a HOST TARGET binding site such as BINDING SITE I, BINDING SITE II or BINDING SITE III. Table 2 illustrates the complementarity of the nucleotide sequences of DMP1 BINDING SITE, designated SEQ ID:10660, to the nucleotide sequence of VGAM1416 RNA, herein designated VGAM RNA, also designated SEQ ID:4127.

A function of VGAM1416 is therefore inhibition of Dentin Matrix Acidic Phosphoprotein (DMP1, Accession NM_004407), a gene which regulates mineralization of bone and dentin. Accordingly, utilities of VGAM1416 include diagnosis, prevention and treatment of diseases and clinical conditions associated with DMP1. The function of DMP1 has been established by previous studies. George et al. (1993) isolated a dentin matrix acidic phosphoprotein from a rat odontoblast cDNA library. It is a serine-rich acidic protein that has numerous potential phosphorylation sites, especially for messenger-independent kinases of the casein kinase II group. Expression analysis showed that dmp1 message is essentially dentin-specific. The mouse dmp1 gene was mapped to 5q21, a region of the mouse genome that shows homology of synteny with human 4q21. Dentinogenesis imperfecta type II (OMIM Ref. No. 125490) maps to that region of the genome, namely 4q13-q21. This prompted Aplin et al. (1995) to isolate a cosmid containing the human DMP1 gene. The isolation of a short tandem repeat polymorphism at this locus allowed them to map DMP1 to 4q21 and demonstrate that it is tightly linked to DGI1 in 2 families. The creation of a YAC contig around the gene for osteopontin (OMIM Ref. No. 166490) allowed them to demonstrate that DMP1 is located within 150 kb of the bone sialoprotein locus (OMIM Ref. No. 147563) and within 490 kb of the SPP1 locus. Mutation search in both SPP1 and IBSP in individuals with dentinogenesis imperfecta yielded negative results. DMP1 is a candidate for similar mutation screen. MacDougall et al. (1996) used fluorescence in situ hybridization to map DMP1 to 4q21. By screening a cDNA library constructed from mandibular and maxillary third molars with the mouse Dmp1 sequence as the probe, Hirst et al. (1997) isolated a cDNA encoding DMP1. The deduced 513-amino acid, highly acidic, serine-rich protein has a hydrophobic signal peptide, an Arg-Gly-Asp cell-attachment sequence, and numerous potential serine phosphorylation sites. Genomic sequence analysis indicated that the DMP1 gene contains 6 exons, and no disease-specific mutations were identified in 2 families with type II dentinogenesis imperfecta.

Full details of the abovementioned studies are described in the following publications, the disclosure of which are hereby incorporated by reference:

Hirst, K. L.; Simmons, D.; Feng, J.; Aplin, H.; Dixon, M. J.; MacDougall, M.: Elucidation of the sequence and the genomic organization of the human dentin matrix acidic phosphoprotein 1 (DMP1) gene: exclusion of the locus from a causative role in the pathogenesis of dentinogenesis imperfecta type II. Genomics 42:38-45, 1997; and MacDougall, M.; DuPont, B. R.; Simmons, D.; Leach, R. J.: Assignment of DMP1 to human chromosome 4 band q21 by in situ hybridization. Cytogenet. Cell. Genet. 74:189 only, 1996.

Further studies establishing the function and utilities of DMP1 are found in John Hopkins OMIM database record ID 600980, and in sited publications numbered 12524-7809 listed in the bibliography section hereinbelow, which are also hereby incorporated by reference. E74-like Factor 2 (ets domain transcription factor) (ELF2, Accession NM_006874) is another VGAM1416 host target gene. ELF2 BINDING SITE is HOST TARGET binding site found in the 3' untranslated region of mRNA encoded by ELF2, corresponding to a HOST TARGET binding site such as BINDING SITE I, BINDING SITE II or BINDING SITE III. Table 2 illustrates the complementarity of the nucleotide sequences of ELF2 BINDING SITE, designated SEQ ID:13742, to the nucleotide sequence of VGAM1416 RNA, herein designated VGAM RNA, also designated SEQ ID:4127.

Another function of VGAM1416 is therefore inhibition of E74-like Factor 2 (ets domain transcription factor) (ELF2, Accession NM_006874). Accordingly, utilities of VGAM1416 include diagnosis, prevention and treatment of diseases and clinical conditions associated with ELF2. KIAA1586 (Accession XM_166451) is another VGAM1416 host target gene. KIAA1586 BINDING SITE is HOST TARGET binding site found in the 5" untranslated region of mRNA encoded by KIAA1586, corresponding to a HOST TARGET binding site such as BINDING SITE I, BINDING SITE II or BINDING SITE III. Table 2 illustrates the complementarity of the nucleotide sequences of KIAA1586 BINDING SITE, designated SEQ ID:44347, to the nucleotide sequence of VGAM1416 RNA, herein designated VGAM RNA, also designated SEQ ID:4127.

Another function of VGAM1416 is therefore inhibition of KIAA1586 (Accession XM_166451). Accordingly, utilities of VGAM1416 include diagnosis, prevention and treatment of diseases and clinical conditions associated with KIAA1586. Mab-21-like 2 (C. elegans) (MAB21L2, Accession NM_006439) is another VGAM1416 host target gene. MAB21L2 BINDING SITE is HOST TARGET binding site found in the 5' untranslated region of mRNA encoded by MAB21L2, corresponding to a HOST TARGET binding site such as BINDING SITE I, BINDING SITE II or BINDING SITE III. Table 2 illustrates the complementarity of the nucleotide sequences of MAB21L2 BINDING SITE, designated SEQ ID:13148, to the nucleotide sequence of VGAM1416 RNA, herein designated VGAM RNA, also designated SEQ ID:4127.

Another function of VGAM1416 is therefore inhibition of Mab-21-like 2 (C. elegans) (MAB21L2, Accession NM_006439). Accordingly, utilities of VGAM1416 include diagnosis, prevention and treatment of diseases and clinical conditions associated with MAB21L2. Mitogen-activated Protein Kinase Kinase 6 (MAP2K6, Accession NM_031988) is another VGAM1416 host target gene. MAP2K6 BINDING SITE1 and MAP2K6 BINDING SITE2 are HOST TARGET binding sites found in untranslated regions of mRNA encoded by MAP2K6, corresponding to HOST TARGET binding sites such as BINDING SITE I, BINDING SITE II or BINDING SITE III. Table 2 illustrates the complementarity of the nucleotide sequences of MAP2K6 BINDING SITE1 and MAP2K6 BINDING SITE2, designated SEQ ID:25700 and SEQ ID:8640 respectively, to the nucleotide sequence of VGAM1416 RNA, herein designated VGAM RNA, also designated SEQ ID:4127.

Another function of VGAM1416 is therefore inhibition of Mitogen-activated Protein Kinase Kinase 6 (MAP2K6, Accession NM_031988). Accordingly, utilities of VGAM1416 include diagnosis, prevention and treatment of diseases and clinical conditions associated with MAP2K6. KIAA0907 (Accession NM_014949) is another VGAM1417 host target gene. KIAA0907 BINDING SITE is HOST TARGET binding site found in the 3" untranslated region of mRNA encoded by KIAA0907, corresponding to a HOST TARGET binding site such as BINDING SITE I, BINDING SITE II or BINDING SITE III. Table 2 illustrates the complementarity of the nucleotide sequences of KIAA0907 BINDING SITE, designated SEQ ID:17278, to the nucleotide sequence of VGAM1417 RNA, herein designated VGAM RNA, also designated SEQ ID:4128.

Another function of VGAM1417 is therefore inhibition of KIAA0907 (Accession NM_014949). Accordingly, utilities of VGAM1417 include diagnosis, prevention and treatment of diseases and clinical conditions associated with KIAA0907. LOC219722 (Accession XM_167593) is another VGAM1417 host target gene. LOC219722 BINDING SITE is HOST TARGET binding site found in the 5' untranslated region of mRNA encoded by LOC219722, corresponding to a HOST TARGET binding site such as BINDING SITE I, BINDING SITE II or BINDING SITE III. Table 2 illustrates the complementarity of the nucleotide sequences of LOC219722 BINDING SITE, designated SEQ ID:44711, to the nucleotide sequence of VGAM1417 RNA, herein designated VGAM RNA, also designated SEQ ID:4128.

Another function of VGAM1417 is therefore inhibition of LOC219722 (Accession XM_167593). Accordingly, utilities of VGAM1417 include diagnosis, prevention and treatment of diseases and clinical conditions associated with LOC219722. LOC256113 (Accession XM_172989) is another VGAM1417 host target gene. LOC256113 BINDING SITE is HOST TARGET binding site found in the 5' untranslated region of mRNA encoded by LOC256113, corresponding to a HOST TARGET binding site such as BINDING SITE I, BINDING SITE II or BINDING SITE III. Table 2 illustrates the complementarity of the nucleotide sequences of LOC256113 BINDING SITE, designated SEQ ID:46261, to the nucleotide sequence of VGAM1417 RNA, herein designated VGAM RNA, also designated SEQ ID:4128.

Another function of VGAM1417 is therefore inhibition of LOC256113 (Accession XM_172989). Accordingly, utilities of VGAM1417 include diagnosis, prevention and treatment of diseases and clinical conditions associated with LOC256113. FIG. 1 further provides a conceptual description of a novel bioinformatically detected viral gene of the present invention, referred to here as Viral Genomic Address Messenger 1418 (VGAM1418) viral gene, which modulates expression of respective host target genes thereof, the function and utility of which host target genes is known in the art.

VGAM1418 is a novel bioinformatically detected regulatory, non protein coding, viral micro RNA (miRNA) gene. The method by which VGAM1418 was detected is described hereinabove with reference to FIGS. 1-8.

VGAM1418 gene, herein designated VGAM GENE, is a viral gene contained in the genome of Ryegrass Mosaic Virus. VGAM1418 host target gene, herein designated VGAM HOST TARGET GENE, is a human gene contained in the human genome.

VGAM1418 gene encodes a VGAM1418 precursor RNA, herein designated VGAM PRECURSOR RNA. Similar to other miRNA genes, and unlike most ordinary genes, VGAM1418 precursor RNA does not encode a protein. A nucleotide sequence identical or highly similar to the nucleotide sequence of VGAM1418 precursor RNA is designated SEQ ID:1404, and is provided hereinbelow with reference to the sequence listing part. Nucleotide sequence SEQ ID:1404 is located at position 3047 relative to the genome of Ryegrass Mosaic Virus.

VGAM1418 precursor RNA folds onto itself, forming VGAM1418 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1418 folded precursor RNA into VGAM1418 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1418 RNA is designated SEQ ID:4129, and is provided hereinbelow with reference to the sequence listing part.

VGAM1418 host target gene, herein designated VGAM HOST TARGET GENE, encodes a corresponding messenger RNA, VGAM1418 host target RNA, herein designated VGAM HOST TARGET RNA. VGAM1418 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1418 RNA, herein designated VGAM RNA, binds complementarily to one or more host target binding sites located in untranslated regions of VGAM1418 host target RNA, herein designated VGAM HOST TARGET RNA. This complementary binding is due to the fact that the nucleotide sequence of VGAM1418 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1418 RNA, herein designated VGAM RNA, may have a different number of host target binding sites in untranslated regions of a VGAM1418 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1418 RNA, herein designated VGAM RNA, to host target binding sites on VGAM1418 host target RNA, herein designated VGAM HOST TARGET RNA, such as BINDING SITE I, BINDING SITE II and BINDING SITE III, inhibits translation of VGAM1418 host target RNA into VGAM1418 host target protein, herein designated VGAM HOST TARGET PROTEIN. VGAM host target protein is therefore outlined by a broken line.

It is appreciated that VGAM1418 host target gene, herein designated VGAM HOST TARGET GENE, in fact represents a plurality of VGAM1418 host target genes. The mRNA of each one of this plurality of VGAM1418 host target genes comprises one or more host target binding sites, each having a nucleotide sequence which is at least partly complementary to VGAM1418 RNA, herein designated VGAM RNA, and which when bound by VGAM1418 RNA causes inhibition of translation of respective one or more VGAM1418 host target proteins.

It is further appreciated by one skilled in the art that the mode of translational inhibition illustrated by FIG. 1 with specific reference to translational inhibition exerted by VGAM1418 gene, herein designated VGAM GENE, on one or more VGAM1418 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1418 is inhibition of expression of host target genes, as part of a novel viral mechanism of attacking a host. Accordingly, utilities of VGAM1418 include diagnosis, prevention and treatment of viral infection by Ryegrass Mosaic Virus. Specific functions, and accordingly utilities, of VGAM1418 correlate with, and may be deduced from, the identity of the host target genes which VGAM1418 binds and inhibits, and the function of these host target genes, as elaborated hereinbelow.

Nucleotide sequences of the VGAM1418 precursor RNA, herein designated VGAM PRECURSOR RNA, and of the 'diced' VGAM1418 RNA, herein designated VGAM RNA, and a schematic representation of the secondary folding of VGAM1418 folded precursor RNA, herein designated VGAM FOLDED PRECURSOR RNA, of VGAM1418 are further described hereinbelow with reference to Table 1.

Nucleotide sequences of host target binding sites, such as BINDING SITE-I, BINDING SITE-II and BINDING SITE-III of FIG. 1, found on VGAM1418 host target RNA, and schematic representation of the complementarity of each of these host target binding sites to VGAM1418 RNA, herein designated VGAM RNA, are described hereinbelow with reference to Table 2.

As mentioned hereinabove with reference to FIG. 1, a function of VGAM1418 gene, herein designated VGAM is inhibition of expression of VGAM1418 target genes. It is appreciated that specific functions, and accordingly utilities, of VGAM1418 correlate with, and may be deduced from, the identity of the target genes which VGAM1418 binds and inhibits, and the function of these target genes, as elaborated hereinbelow.

FLJ12409 (Accession NM_025105) is a VGAM1418 host target gene. FLJ12409 BINDING SITE is HOST TARGET binding site found in the 3' untranslated region of mRNA encoded by FLJ12409, corresponding to a HOST TARGET binding site such as BINDING SITE I, BINDING SITE II or BINDING SITE III. Table 2 illustrates the complementarity of the nucleotide sequences of FLJ12409 BINDING SITE, designated SEQ ID:24751, to the nucleotide sequence of VGAM1418 RNA, herein designated VGAM RNA, also designated SEQ ID:4129.

A function of VGAM1418 is therefore inhibition of FLJ12409 (Accession NM_025105). Accordingly, utilities of VGAM1418 include diagnosis, prevention and treatment of diseases and clinical conditions associated with FLJ12409. LOC115442 (Accession XM_052510) is another VGAM1418 host target gene. LOC115442 BINDING SITE is HOST TARGET binding site found in the 5' untranslated region of mRNA encoded by LOC115442, corresponding to a HOST TARGET binding site such as BINDING SITE I, BINDING SITE II or BINDING SITE III. Table 2 illustrates the complementarity of the nucleotide sequences of LOC115442 BINDING SITE, designated SEQ ID:35981, to the nucleotide sequence of VGAM1418 RNA, herein designated VGAM RNA, also designated SEQ ID:4129.

Another function of VGAM1418 is therefore inhibition of LOC115442 (Accession XM_052510). Accordingly, utilities of VGAM1418 include diagnosis, prevention and treatment of diseases and clinical conditions associated with LOC115442. LOC196074 (Accession XM_113647) is another VGAM1418 host target gene. LOC196074 BINDING SITE is HOST TARGET binding site found in the 3' untranslated region of mRNA encoded by LOC196074, corresponding to a HOST TARGET binding site such as BINDING SITE I, BINDING SITE II or BINDING SITE III. Table 2 illustrates the complementarity of the nucleotide sequences of LOC196074 BINDING SITE, designated SEQ ID:42322, to the nucleotide sequence of VGAM1418 RNA, herein designated VGAM RNA, also designated SEQ ID:4129.

Another function of VGAM1418 is therefore inhibition of LOC196074 (Accession XM_113647). Accordingly, utilities of VGAM1418 include diagnosis, prevention and treatment of diseases and clinical conditions associated with LOC196074. FIG. 1 further provides a conceptual description of a novel bioinformatically detected viral gene of the present invention, referred to here as Viral Genomic Address Messenger 1419 (VGAM1419) viral gene, which modulates expression of respective host target genes thereof, the function and utility of which host target genes is known in the art.

VGAM1419 is a novel bioinformatically detected regulatory, non protein coding, viral micro RNA (miRNA) gene. The method by which VGAM1419 was detected is described hereinabove with reference to FIGS. 1-8.

VGAM1419 gene, herein designated VGAM GENE, is a viral gene contained in the genome of Ryegrass Mosaic Virus. VGAM1419 host target gene, herein designated VGAM HOST TARGET GENE, is a human gene contained in the human genome.

VGAM1419 gene encodes a VGAM1419 precursor RNA, herein designated VGAM PRECURSOR RNA. Similar to other miRNA genes, and unlike most ordinary genes, VGAM1419 precursor RNA does not encode a protein. A nucleotide sequence identical or highly similar to the nucleotide sequence of VGAM1419 precursor RNA is designated SEQ ID:1405, and is provided hereinbelow with reference to the sequence listing part. Nucleotide sequence SEQ ID:1405 is located at position 4295 relative to the genome of Ryegrass Mosaic Virus.

VGAM1419 precursor RNA folds onto itself, forming VGAM1419 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1419 folded precursor RNA into VGAM1419 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1419 RNA is designated SEQ ID:4130, and is provided hereinbelow with reference to the sequence listing part.

VGAM1419 host target gene, herein designated VGAM HOST TARGET GENE, encodes a corresponding messenger RNA, VGAM1419 host target RNA, herein designated VGAM HOST TARGET RNA. VGAM1419 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1419 RNA, herein designated VGAM RNA, binds complementarily to one or more host target binding sites located in untranslated regions of VGAM1419 host target RNA, herein designated VGAM HOST TARGET RNA. This complementary binding is due to the fact that the nucleotide sequence of VGAM1419 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1419 RNA, herein designated VGAM RNA, may have a different number of host target binding sites in untranslated regions of a VGAM1419 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1419 RNA, herein designated VGAM RNA, to host target binding sites on VGAM1419 host target RNA, herein designated VGAM HOST TARGET RNA, such as BINDING SITE I, BINDING SITE II and BINDING SITE III, inhibits translation of VGAM1419 host target RNA into VGAM1419 host target protein, herein designated VGAM HOST TARGET PROTEIN. VGAM host target protein is therefore outlined by a broken line.

It is appreciated that VGAM1419 host target gene, herein designated VGAM HOST TARGET GENE, in fact represents a plurality of VGAM1419 host target genes. The mRNA of each one of this plurality of VGAM1419 host target genes comprises one or more host target binding sites, each having a nucleotide sequence which is at least partly complementary to VGAM1419 RNA, herein designated VGAM RNA, and which when bound by VGAM1419 RNA causes inhibition of translation of respective one or more VGAM1419 host target proteins.

It is further appreciated by one skilled in the art that the mode of translational inhibition illustrated by FIG. 1 with specific reference to translational inhibition exerted by VGAM1419 gene, herein designated VGAM GENE, on one or more VGAM1419 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1419 is inhibition of expression of host target genes, as part of a novel viral mechanism of attacking a host. Accordingly, utilities of VGAM1419 include diagnosis, prevention and treatment of viral infection by Ryegrass Mosaic Virus. Specific functions, and accordingly utilities, of VGAM1419 correlate with, and may be deduced from, the identity of the host target genes which VGAM1419 binds and inhibits, and the function of these host target genes, as elaborated hereinbelow.

Nucleotide sequences of the VGAM1419 precursor RNA, herein designated VGAM PRECURSOR RNA, and of the 'diced' VGAM1419 RNA, herein designated VGAM RNA, and a schematic representation of the secondary folding of VGAM1419 folded precursor RNA, herein designated VGAM FOLDED PRECURSOR RNA, of VGAM1419 are further described hereinbelow with reference to Table 1.

Nucleotide sequences of host target binding sites, such as BINDING SITE-I, BINDING SITE-II and BINDING SITE-III of FIG. 1, found on VGAM1419 host target RNA, and schematic representation of the complementarity of each of these host target binding sites to VGAM1419 RNA, herein designated VGAM RNA, are described hereinbelow with reference to Table 2.

As mentioned hereinabove with reference to FIG. 1, a function of VGAM1419 gene, herein designated VGAM is inhibition of expression of VGAM1419 target genes. It is appreciated that specific functions, and accordingly utilities, of VGAM1419 correlate with, and may be deduced from, the identity of the target genes which VGAM1419 binds and inhibits, and the function of these target genes, as elaborated hereinbelow.

Acidic Repeat Containing (ACRC, Accession NM_052957) is a VGAM1419 host target gene. ACRC BINDING SITE is HOST TARGET binding site found in the 3' untranslated region of mRNA encoded by ACRC, corresponding to a HOST TARGET binding site such as BINDING SITE I, BINDING SITE II or BINDING SITE III. Table 2 illustrates the complementarity of the nucleotide sequences of ACRC BINDING SITE, designated SEQ ID:27518, to the nucleotide sequence of VGAM1419 RNA, herein designated VGAM RNA, also designated SEQ ID:4130.

A function of VGAM1419 is therefore inhibition of Acidic Repeat Containing (ACRC, Accession NM_052957). Accordingly, utilities of VGAM1419 include diagnosis, prevention and treatment of diseases and clinical conditions associated with ACRC. Caspase 8, Apoptosis-related Cysteine Protease (CASP8, Accession NM_033357) is another VGAM1419 host target gene. CASP8 BINDING SITE is HOST TARGET binding site found in the 3' untranslated region of mRNA encoded by CASP8, corresponding to a HOST TARGET binding site such as BINDING SITE I, BINDING SITE II or BINDING SITE III. Table 2 illustrates the complementarity of the nucleotide sequences of CASP8 BINDING SITE, designated SEQ ID:27207, to the nucleotide sequence of VGAM1419 RNA, herein designated VGAM RNA, also designated SEQ ID:4130.

Another function of VGAM1419 is therefore inhibition of Caspase 8, Apoptosis-related Cysteine Protease (CASP8, Accession NM_033357), a gene which is an apoptosis-related caspase and an upstream component of Fas receptor and tumor necrosis factor (TNF) receptor-induced apoptosis. Accordingly, utilities of VGAM1419 include diagnosis, prevention and treatment of diseases and clinical conditions associated with CASP8. The function of CASP8 and its association with various diseases and clinical conditions, has been established by previous studies, as described hereinabove with reference to VGAM145. Nuclear Receptor Subfamily 2, Group E, Member 1 (NR2E1, Accession NM_003269) is another VGAM1419 host target gene. NR2E1 BINDING SITE is HOST TARGET binding site found in the 3' untranslated region of mRNA encoded by NR2E1, corresponding to a HOST TARGET binding site such as BINDING SITE I, BINDING SITE II or BINDING SITE III. Table 2 illustrates the complementarity of the nucleotide sequences of NR2E1 BINDING SITE, designated SEQ ID:9281, to the nucleotide sequence of VGAM1419 RNA, herein designated VGAM RNA, also designated SEQ ID:4130.

Another function of VGAM1419 is therefore inhibition of Nuclear Receptor Subfamily 2, Group E, Member 1 (NR2E1, Accession NM_003269), a gene which may be required for brain development and be involved in the regulation of retinal development. Accordingly, utilities of VGAM1419 include diagnosis, prevention and treatment of diseases and clinical conditions associated with NR2E1. The function of NR2E1 and its association with various diseases and clinical conditions, has been established by previous studies, as described hereinabove with reference to VGAM689. Vanin 1 (VNN1, Accession NM_004666) is another VGAM1419 host target gene. VNN1 BINDING SITE is HOST TARGET binding site found in the 3' untranslated region of mRNA encoded by VNN1, corresponding to a HOST TARGET binding site such as BINDING SITE I, BINDING SITE II or BINDING SITE III. Table 2 illustrates the complementarity of the nucleotide sequences of VNN1 BINDING SITE, designated SEQ ID:11041, to the nucleotide sequence of VGAM1419 RNA, herein designated VGAM RNA, also designated SEQ ID:4130.

Another function of VGAM1419 is therefore inhibition of Vanin 1 (VNN1, Accession NM_004666), a gene which may regulate steps in thymus homing and play a role in mammalian sexual development. Accordingly, utilities of VGAM1419 include diagnosis, prevention and treatment of diseases and clinical conditions associated with VNN1. The function of VNN1 and its association with various diseases and clinical conditions, has been established by previous studies, as described hereinabove with reference to VGAM419. Chromosome 6 Open Reading Frame 37 (C6orf37, Accession XM_041375) is another VGAM1419 host target gene. C6orf37 BINDING SITE is HOST TARGET binding site found in the 3' untranslated region of mRNA encoded by C6orf37, corresponding to a HOST TARGET binding site such as BINDING SITE I, BINDING SITE II or BINDING SITE III. Table 2 illustrates the complementarity of the nucleotide sequences of C6orf37 BINDING SITE, designated SEQ ID:33514, to the nucleotide sequence of VGAM1419 RNA, herein designated VGAM RNA, also designated SEQ ID:4130.

Another function of VGAM1419 is therefore inhibition of Chromosome 6 Open Reading Frame 37 (C6orf37, Accession XM_041375). Accordingly, utilities of VGAM1419 include diagnosis, prevention and treatment of diseases and clinical conditions associated with C6orf37. Chemokine (C-C motif) Receptor 6 (CCR6, Accession NM_004367) is another VGAM1419 host target gene. CCR6 BINDING SITE1 and CCR6 BINDING SITE2 are HOST TARGET binding sites found in untranslated regions of mRNA encoded by CCR6, corresponding to HOST TARGET binding sites such as BINDING SITE I, BINDING SITE II or BINDING SITE III. Table 2 illustrates the complementarity of the nucleotide sequences of CCR6 BINDING SITE1 and CCR6 BINDING SITE2, designated SEQ ID:10580 and SEQ ID:25374 respectively, to the nucleotide sequence of VGAM1419 RNA, herein designated VGAM RNA, also designated SEQ ID:4130.

Another function of VGAM1419 is therefore inhibition of Chemokine (C-C motif) Receptor 6 (CCR6, Accession NM_004367). Accordingly, utilities of VGAM1419 include diagnosis, prevention and treatment of diseases and clinical conditions associated with CCR6. Olfactory Receptor, Family 2, Subfamily C, Member 3 (OR2C3, Accession XM_060575) is another VGAM1419 host target gene. OR2C3 BINDING SITE is HOST TARGET binding site found in the 5' untranslated region of mRNA encoded by OR2C3, corresponding to a HOST TARGET binding site such as BINDING SITE I, BINDING SITE II or BINDING SITE III. Table 2 illustrates the complementarity of the nucleotide sequences of OR2C3 BINDING SITE, designated SEQ ID:37177, to the nucleotide sequence of VGAM1419 RNA, herein designated VGAM RNA, also designated SEQ ID:4130.

Another function of VGAM1419 is therefore inhibition of Olfactory Receptor, Family 2, Subfamily C, Member 3 (OR2C3, Accession XM_060575). Accordingly, utilities of VGAM1419 include diagnosis, prevention and treatment of diseases and clinical conditions associated with OR2C3. RI58 (Accession NM_012420) is another VGAM1419 host target gene. RI58 BINDING SITE is HOST TARGET binding site found in the 3' untranslated region of mRNA encoded by RI58, corresponding to a HOST TARGET binding site such as BINDING SITE I, BINDING SITE II or BINDING SITE III. Table 2 illustrates the complementarity of the nucleotide sequences of RI58 BINDING SITE, designated SEQ ID:14798, to the nucleotide sequence of VGAM1419 RNA, herein designated VGAM RNA, also designated SEQ ID:4130.

Another function of VGAM1419 is therefore inhibition of RI58 (Accession NM_012420). Accordingly, utilities of VGAM1419 include diagnosis, prevention and treatment of diseases and clinical conditions associated with RI58. Testis Expressed Sequence 27 (TEX27, Accession NM_021943) is another VGAM1419 host target gene. TEX27 BINDING SITE is HOST TARGET binding site found in the 3' untranslated region of mRNA encoded by TEX27, corresponding to a HOST TARGET binding site such as BINDING SITE I, BINDING SITE II or BINDING SITE III. Table 2 illustrates the complementarity of the nucleotide sequences of TEX27 BINDING SITE, designated SEQ ID:22462, to the nucleotide sequence of VGAM1419 RNA, herein designated VGAM RNA, also designated SEQ ID:4130.

Another function of VGAM1419 is therefore inhibition of Testis Expressed Sequence 27 (TEX27, Accession NM_021943). Accordingly, utilities of VGAM1419 include diagnosis, prevention and treatment of diseases and clinical conditions associated with TEX27. LOC123036 (Accession XM_058676) is another VGAM1419 host target gene. LOC123036 BINDING SITE is HOST TARGET binding site found in the 3' untranslated region of mRNA encoded by LOC123036, corresponding to a HOST TARGET binding site such as BINDING SITE I, BINDING SITE II or BINDING SITE III. Table 2 illustrates the complementarity of the nucleotide sequences of LOC123036 BINDING SITE, designated SEQ ID:36718, to the nucleotide sequence of VGAM1419 RNA, herein designated VGAM RNA, also designated SEQ ID:4130.

Another function of VGAM1419 is therefore inhibition of LOC123036 (Accession XM_058676). Accordingly, utilities of VGAM1419 include diagnosis, prevention and treatment of diseases and clinical conditions associated with LOC123036. LOC221773 (Accession XM_165802) is another VGAM1419 host target gene. LOC221773 BINDING SITE is HOST TARGET binding site found in the 3' untranslated region of mRNA encoded by LOC221773, corresponding to a HOST TARGET binding site such as BINDING SITE I, BINDING SITE II or BINDING SITE III. Table 2 illustrates the complementarity of the nucleotide sequences of LOC221773 BINDING SITE, designated SEQ ID:43768, to the nucleotide sequence of VGAM1419 RNA, herein designated VGAM RNA, also designated SEQ ID:4130.

Another function of VGAM1419 is therefore inhibition of LOC221773 (Accession XM_165802). Accordingly, utilities of VGAM1419 include diagnosis, prevention and treatment of diseases and clinical conditions associated with LOC221773. LOC253584 (Accession XM_173068) is another VGAM1419 host target gene. LOC253584 BINDING SITE is HOST TARGET binding site found in the 5' untranslated region of mRNA encoded by LOC253584, corresponding to a HOST TARGET binding site such as BINDING SITE I, BINDING SITE II or BINDING SITE III. Table 2 illustrates the complementarity of the nucleotide sequences of LOC253584 BINDING SITE, designated SEQ ID:46322, to the nucleotide sequence of VGAM1419 RNA, herein designated VGAM RNA, also designated SEQ ID:4130.

Another function of VGAM1419 is therefore inhibition of LOC253584 (Accession XM_173068). Accordingly, utilities of VGAM1419 include diagnosis, prevention and treatment of diseases and clinical conditions associated with LOC253584. LOC253912 (Accession XM_173222) is another VGAM1419 host target gene. LOC253912 BINDING SITE is HOST TARGET binding site found in the 3' untranslated region of mRNA encoded by LOC253912, corresponding to a HOST TARGET binding site such as BINDING SITE I, BINDING SITE II or BINDING SITE III. Table 2 illustrates the complementarity of the nucleotide sequences of LOC253912 BINDING SITE, designated SEQ ID:46484, to the nucleotide sequence of VGAM1419 RNA, herein designated VGAM RNA, also designated SEQ ID:4130.

Another function of VGAM1419 is therefore inhibition of LOC253912 (Accession XM_173222). Accordingly, utilities of VGAM1419 include diagnosis, prevention and treatment of diseases and clinical conditions associated with LOC253912. LOC51185 (Accession NM_016302) is another VGAM1419 host target gene. LOC51185 BINDING SITE is HOST TARGET binding site found in the 3' untranslated region of mRNA encoded by LOC51185, corresponding to a HOST TARGET binding site such as BINDING SITE I, BINDING SITE II or BINDING SITE III. Table 2 illustrates the complementarity of the nucleotide sequences of LOC51185 BINDING SITE, designated SEQ ID:18425, to the nucleotide sequence of VGAM1419 RNA, herein designated VGAM RNA, also designated SEQ ID:4130.

Another function of VGAM1419 is therefore inhibition of LOC51185 (Accession NM_016302). Accordingly, utilities of VGAM1419 include diagnosis, prevention and treatment of diseases and clinical conditions associated with LOC51185. FIG. 1 further provides a conceptual description of a novel bioinformatically detected viral gene of the present invention, referred to here as Viral Genomic Address Messenger 1420 (VGAM1420) viral gene, which modulates expression of respective host target genes thereof, the function and utility of which host target genes is known in the art.

VGAM1420 is a novel bioinformatically detected regulatory, non protein coding, viral micro RNA (miRNA) gene. The method by which VGAM1420 was detected is described hereinabove with reference to FIGS. 1-8.

VGAM1420 gene, herein designated VGAM GENE, is a viral gene contained in the genome of Hepatitis GB Virus A. VGAM1420 host target gene, herein designated VGAM HOST TARGET GENE, is a human gene contained in the human genome.

VGAM1420 gene encodes a VGAM1420 precursor RNA, herein designated VGAM PRECURSOR RNA. Similar to other miRNA genes, and unlike most ordinary genes, VGAM1420 precursor RNA does not encode a protein. A nucleotide sequence identical or highly similar to the nucleotide sequence of VGAM1420 precursor RNA is designated SEQ ID:1406, and is provided hereinbelow with reference to the sequence listing part. Nucleotide sequence SEQ ID:1406 is located at position 4594 relative to the genome of Hepatitis GB Virus A.

VGAM1420 precursor RNA folds onto itself, forming VGAM1420 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1420 folded precursor RNA into VGAM1420 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 90%) nucleotide sequence of VGAM1420 RNA is designated SEQ ID:4131, and is provided hereinbelow with reference to the sequence listing part.

VGAM1420 host target gene, herein designated VGAM HOST TARGET GENE, encodes a corresponding messenger RNA, VGAM1420 host target RNA, herein designated VGAM HOST TARGET RNA. VGAM1420 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1420 RNA, herein designated VGAM RNA, binds complementarily to one or more host target binding sites located in untranslated regions of VGAM1420 host target RNA, herein designated VGAM HOST TARGET RNA. This complementary binding is due to the fact that the nucleotide sequence of VGAM1420 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1420 RNA, herein designated VGAM RNA, may have a different number of host target binding sites in untranslated regions of a VGAM1420 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1420 RNA, herein designated VGAM RNA, to host target binding sites on VGAM1420 host target RNA, herein designated VGAM HOST TARGET RNA, such as BINDING SITE I, BINDING SITE II and BINDING SITE III, inhibits translation of VGAM1420 host target RNA into VGAM1420 host target protein, herein designated VGAM HOST TARGET PROTEIN. VGAM host target protein is therefore outlined by a broken line.

It is appreciated that VGAM1420 host target gene, herein designated VGAM HOST TARGET GENE, in fact represents a plurality of VGAM1420 host target genes. The mRNA of each one of this plurality of VGAM1420 host target genes comprises one or more host target binding sites, each having a nucleotide sequence which is at least partly complementary to VGAM1420 RNA, herein designated VGAM RNA, and which when bound by VGAM1420 RNA causes inhibition of translation of respective one or more VGAM1420 host target proteins.

It is further appreciated by one skilled in the art that the mode of translational inhibition illustrated by FIG. 1 with specific reference to translational inhibition exerted by VGAM1420 gene, herein designated VGAM GENE, on one or more VGAM1420 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1420 is inhibition of expression of host target genes, as part of a novel viral mechanism of attacking a host. Accordingly, utilities of VGAM1420 include diagnosis, prevention and treatment of viral infection by Hepatitis GB Virus A. Specific functions, and accordingly utilities, of VGAM1420 correlate with, and may be deduced from, the identity of the host target genes which VGAM1420 binds and inhibits, and the function of these host target genes, as elaborated hereinbelow.

Nucleotide sequences of the VGAM1420 precursor RNA, herein designated VGAM PRECURSOR RNA, and of the 'diced' VGAM1420 RNA, herein designated VGAM RNA, and a schematic representation of the secondary folding of VGAM1420 folded precursor RNA, herein designated VGAM FOLDED PRECURSOR RNA, of VGAM1420 are further described hereinbelow with reference to Table 1.

Nucleotide sequences of host target binding sites, such as BINDING SITE-I, BINDING SITE-II and BINDING SITE-III of FIG. 1, found on VGAM1420 host target RNA, and schematic representation of the complementarity of each of these host target binding sites to VGAM1420 RNA, herein designated VGAM RNA, are described hereinbelow with reference to Table 2.

As mentioned hereinabove with reference to FIG. 1, a function of VGAM1420 gene, herein designated VGAM is inhibition of expression of VGAM1420 target genes. It is appreciated that specific functions, and accordingly utilities, of VGAM1420 correlate with, and may be deduced from, the identity of the target genes which VGAM1420 binds and inhibits, and the function of these target genes, as elaborated hereinbelow.

Caspase 7, Apoptosis-related Cysteine Protease (CASP7, Accession NM_001227) is a VGAM1420 host target gene. CASP7 BINDING SITE1 through CASP7 BINDING SITE4 are HOST TARGET binding sites found in untranslated regions of mRNA encoded by CASP7, corresponding to HOST TARGET binding sites such as BINDING SITE I, BINDING SITE II or BINDING SITE III. Table 2 illustrates the complementarity of the nucleotide sequences of CASP7 BINDING SITE1 through CASP7 BINDING SITE4, designated SEQ ID:6895, SEQ ID:27191, SEQ ID:27192 and SEQ ID:27193 respectively, to the nucleotide sequence of VGAM1420 RNA, herein designated VGAM RNA, also designated SEQ ID:4131.

A function of VGAM1420 is therefore inhibition of Caspase 7, Apoptosis-related Cysteine Protease (CASP7, Accession NM_001227), a gene which is an apoptosis-related caspase and involves in the activation of executing caspases. Accordingly, utilities of VGAM1420 include diagnosis, prevention and treatment of diseases and clinical conditions associated with CASP7. The function of CASP7 has been established by previous studies. Fernandes-Alnemri et al. (1995) found that active MCH3-alpha protein is made by the cleavage of pro-MCH3-alpha into 2 subunits, p20 and p12. Active CPP32 is similarly made by cleavage of its precursor, pro-CPP32, into 2 subunits. They found that CPP32 could cleave pro-MCH3-alpha into its subunits, but that MCH3-alpha could not cleave pro-CPP32. The authors further demonstrated that MCH4 (OMIM Ref. No. 601762) can cleave pro-MCH3 into its 2 subunits (Fernandes-Alnemri et al., 1996). Expression of MCH3-alpha/CPP32 heterodimers in Sf9 cells induced apoptosis. They also found that MCH3 cleaves poly (ADP-ribose) polymerase (PARP) with similar kinetics to that of CPP32. Thus Fernandes-Alnemri et al. (1995) concluded that the cleavage of PARP during apoptosis cannot solely be attributed to CPP32 but could also be an activity of its closely related homolog, MCH3-alpha. Riedl et al. (2001) crystallized the C285A variant of human pro-caspase-7 and solved its crystal structure at 2.9 angstrom. Analysis of this executioner zymogen structure and its comparison with the structures of active caspase-7 unveiled the structural basis of the procaspase inactivity and suggested the conformational changes leading to procaspase activation.

Full details of the abovementioned studies are described in the following publications, the disclosure of which are hereby incorporated by reference:

Fernandes-Alnemri, T.; Armstrong, R. C.; Krebs, J.; Srinivasula, S. M.; Wang, L.; Bullrich, F.; Fritz, L. C.; Trapani, J. A.; Tomaselli, K. J.; Litwack, G.; Alnemri, E. S.: In vitro activation of CPP32 and Mch3 by Mch4, a novel human apoptotic cysteine protease containing two FADD-like domains. Proc. Nat. Acad. Sci. 93:7464-7469, 1996; and Riedl, S. J.; Fuentes-Prior, P.; Renatus, M.; Kairies, N.; Krapp, S.; Huber, R.; Salvesen, G. S.; Bode, W.: Structural basis for the activation of human procaspase-7. Proc. Nat. Acad. S.

Further studies establishing the function and utilities of CASP7 are found in John Hopkins OMIM database record ID 601761, and in sited publications numbered 6710, 7119-671 and 7126 listed in the bibliography section hereinbelow, which are also hereby incorporated by reference. G Protein-coupled Receptor 81 (GPR81, Accession NM_032554) is another VGAM1420 host target gene. GPR81 BINDING SITE is HOST TARGET binding site found in the 3' untranslated region of mRNA encoded by GPR81, corresponding to a HOST TARGET binding site such as BINDING SITE I, BINDING SITE II or BINDING SITE III. Table 2 illustrates the complementarity of the nucleotide sequences of GPR81 BINDING SITE, designated SEQ ID:26277, to the nucleotide sequence of VGAM1420 RNA, herein designated VGAM RNA, also designated SEQ ID:4131.

Another function of VGAM1420 is therefore inhibition of G Protein-coupled Receptor 81 (GPR81, Accession NM_032554). Accordingly, utilities of VGAM1420 include diagnosis, prevention and treatment of diseases and clinical conditions associated with GPR81. Heat Shock 60 kDa Protein 1 (chaperonin) (HSPD1, Accession XM_012182) is another VGAM1420 host target gene. HSPD1 BINDING SITE is HOST TARGET binding site found in the 3' untranslated region of mRNA encoded by HSPD1, corresponding to a HOST TARGET binding site such as BINDING SITE I, BINDING SITE II or BINDING SITE III. Table 2 illustrates the complementarity of the nucleotide sequences of HSPD1 BINDING SITE, designated SEQ ID:30207, to the nucleotide sequence of VGAM1420 RNA, herein designated VGAM RNA, also designated SEQ ID:4131.

Another function of VGAM1420 is therefore inhibition of Heat Shock 60kDa Protein 1 (chaperonin) (HSPD1, Accession XM_012182), a gene which is implicated in mitochondrial protein import and macromolecular assembly. may facilitate the correct folding of imported proteins. may also prevent misfolding and promote the refolding and proper assembly of unfolded polypeptides generated under stress conditions in the mitochondrial matrix. Accordingly, utilities of VGAM1420 include diagnosis, prevention and treatment of diseases and clinical conditions associated with HSPD1.

The function of HSPD1 and its association with various diseases and clinical conditions, has been established by previous studies, as described hereinabove with reference to VGAM1173. Oxysterol Binding Protein (OSBP, Accession NM_002556) is another VGAM1420 host target gene. OSBP BINDING SITE is HOST TARGET binding site found in the 5' untranslated region of mRNA encoded by OSBP, corresponding to a HOST TARGET binding site such as BINDING SITE I, BINDING SITE II or BINDING SITE III. Table 2 illustrates the complementarity of the nucleotide sequences of OSBP BINDING SITE, designated SEQ ID:8407, to the nucleotide sequence of VGAM1420 RNA, herein designated VGAM RNA, also designated SEQ ID:4131.

Another function of VGAM1420 is therefore inhibition of Oxysterol Binding Protein (OSBP, Accession NM_002556). Accordingly, utilities of VGAM1420 include diagnosis, prevention and treatment of diseases and clinical conditions associated with OSBP. Placental Growth Factor, Vascular Endothelial Growth Factor-related Protein (PGF, Accession NM_002632) is another VGAM1420 host target gene. PGF BINDING SITE is HOST TARGET binding site found in the 3' untranslated region of mRNA encoded by PGF, corresponding to a HOST TARGET binding site such as BINDING SITE I, BINDING SITE II or BINDING SITE III. Table 2 illustrates the complementarity of the nucleotide sequences of PGF BINDING SITE, designated SEQ ID:8491, to the nucleotide sequence of VGAM1420 RNA, herein designated VGAM RNA, also designated SEQ ID:4131.

Another function of VGAM1420 is therefore inhibition of Placental Growth Factor, Vascular Endothelial Growth Factor-related Protein (PGF, Accession NM_002632), a gene which is a growth factor active in angiogenesis, and endothelial cell growth, stimulating cell proliferation and migration. it binds to receptor vegfr-1/fl. Accordingly, utilities of VGAM1420 include diagnosis, prevention and treatment of diseases and clinical conditions associated with PGF. The function of PGF has been established by previous studies. Angiogenesis is a crucial process during development, certain periods of adult life, and tumorigenesis, and is tightly regulated by a network of growth factors and growth factor receptors. Maglione et al. (1991) isolated a human cDNA encoding a protein related to the vascular permeability factor (VPF; also VEGF; 192240). The protein, symbolized PLGF by them, is 149 amino acids long and shares 53% identity with the platelet-derived growth factor-like region of human VPF. They showed that the N-glycosylated PLGF protein is secreted into the medium and that it functions as a dimer Animal model experiments lend further support to the function of PGF. Carmeliet et al. (2001) developed Pgf-deficient mice by targeted disruption. Pgf -/- mice were born at expected mendelian ratios and were viable and fertile. Pgf -/- mice had subtle changes of VEGF-dependent retinal and luteal angiogenesis. Pgf -/- mice manifested impaired angiogenesis, plasma extravasation, and collateral growth during ischemia, inflammation, wound healing, and cancer. Transplantation of wildtype bone marrow rescued the impaired angiogenesis and collateral growth in Pgf -/- mice, indicating that PGF might have contributed to vessel growth in the adult by mobilizing bone marrow-derived cells. The synergism between PGF and VEGF was specific, as PGF deficiency impaired the response to VEGF, but not to FGF (OMIM Ref. No. 131220) or histamine. VEGFR1 was activated by PGF, given that anti-VEGFR1 antibodies and a Src-kinase inhibitor blocked the endothelial response to PGF or VEGF/PLGF. By upregulating PGF and the signaling subtype of VEGFR1, endothelial cells amplify their responsiveness to VEGF during the 'angiogenic switch' in many pathologic disorders It is appreciated that the abovementioned animal model for PGF is acknowledged by those skilled in the art as a scientifically valid animal model, as can be further appreciated from the publications sited hereinbelow.

Full details of the abovementioned studies are described in the following publications, the disclosure of which are hereby incorporated by reference:

Maglione, D.; Guerriero, V.; Viglietto, G.; Delli-Bovi, P.; Persico, M. G.: Isolation of a human placenta cDNA coding for a protein related to the vascular permeability factor. Proc. Nat. Acad. Sci. 88:9267-9271, 1991; and Carmeliet, P.; Moons, L.; Luttun, A.; Vincenti, V.; Compernolle, V.; De Mol, M.; Wu, Y.; Bono, F.; Devy, L.; Beck, H.; Scholz, D.; Acker, T.; and 17 others. Synergism between vascular endo.

Further studies establishing the function and utilities of PGF are found in John Hopkins OMIM database record ID 601121, and in sited publications numbered 6366-6369 listed in the bibliography section hereinbelow, which are also hereby incorporated by reference. Very Low Density Lipoprotein Receptor (VLDLR, Accession XM_045386) is another VGAM1420 host target gene. VLDLR BINDING SITE is HOST TARGET binding site found in the 3' untranslated region of mRNA encoded by VLDLR, corresponding to a HOST TARGET binding site such as BINDING SITE I, BINDING SITE II or BINDING SITE III. Table 2 illustrates the complementarity of the nucleotide sequences of VLDLR BINDING SITE, designated SEQ ID:34448, to the nucleotide sequence of VGAM1420 RNA, herein designated VGAM RNA, also designated SEQ ID:4131.

Another function of VGAM1420 is therefore inhibition of Very Low Density Lipoprotein Receptor (VLDLR, Accession XM_045386), a gene which may play a crucial role in triglyceride metabolism. Accordingly, utilities of VGAM1420 include diagnosis, prevention and treatment of diseases and clinical conditions associated with VLDLR. The function of VLDLR and its association with various diseases and clinical conditions, has been established by previous studies, as described hereinabove with reference to VGAM103. Aminocarboxymuconate Semialdehyde Decarboxylase (acmsd, Accession NM_138326) is another VGAM1420 host target gene. acmsd BINDING SITE is HOST TARGET binding site found in the 5" untranslated region of mRNA encoded by acmsd, corresponding to a HOST TARGET binding site such as BINDING SITE I, BINDING SITE II or BINDING SITE III. Table 2 illustrates the complementarity of the nucleotide sequences of acmsd BINDING SITE, designated SEQ ID:28727, to the nucleotide sequence of VGAM1420 RNA, herein designated VGAM RNA, also designated SEQ ID:4131.

Another function of VGAM1420 is therefore inhibition of Aminocarboxymuconate Semialdehyde Decarboxylase (acmsd, Accession NM_138326). Accordingly, utilities of VGAM1420 include diagnosis, prevention and treatment of diseases and clinical conditions associated with acmsd. A Disintegrin and Metalloproteinase Domain 9 (meltrin gamma) (ADAM9, Accession NM_003816) is another VGAM1420 host target gene. ADAM9 BINDING SITE is HOST TARGET binding site found in the 3' untranslated region of mRNA encoded by ADAM9, corresponding to a HOST TARGET binding site such as BINDING SITE I, BINDING SITE II or BINDING SITE III. Table 2 illustrates the complementarity of the nucleotide sequences of ADAM9 BINDING SITE, designated SEQ ID:9904, to the nucleotide sequence of VGAM1420 RNA, herein designated VGAM RNA, also designated SEQ ID:4131.

Another function of VGAM1420 is therefore inhibition of A Disintegrin and Metalloproteinase Domain 9 (meltrin gamma) (ADAM9, Accession NM_003816). Accordingly, utilities of VGAM1420 include diagnosis, prevention and treatment of diseases and clinical conditions associated with ADAM9. UDP-Gal:betaGal Beta 1,3-galactosyltransferase Polypeptide 6 (B3GALT6, Accession NM_080605) is another VGAM1420 host target gene. B3GALT6 BINDING SITE is HOST TARGET binding site found in the 3' untranslated region of mRNA encoded by B3GALT6, corresponding to a HOST TARGET binding site such as BINDING SITE I, BINDING SITE II or BINDING SITE III. Table 2 illustrates the complementarity of the nucleotide sequences of B3GALT6 BINDING SITE, designated SEQ ID:27922, to the nucleotide sequence of VGAM1420 RNA, herein designated VGAM RNA, also designated SEQ ID:4131.

Another function of VGAM1420 is therefore inhibition of UDP-Gal:betaGal Beta 1,3-galactosyltransferase Polypeptide 6 (B3GALT6, Accession NM_080605). Accordingly, utilities of VGAM1420 include diagnosis, prevention and treatment of diseases and clinical conditions associated with B3GALT6. BC008967 (Accession XM_027309) is another VGAM1420 host target gene. BC008967 BINDING SITE is HOST TARGET binding site found in the 5' untranslated region of mRNA encoded by BC008967, corresponding to a HOST TARGET binding site such as BINDING SITE I, BINDING SITE II or BINDING SITE III. Table 2 illustrates the complementarity of the nucleotide sequences of BC008967 BINDING SITE, designated SEQ ID:30477, to the nucleotide sequence of VGAM1420 RNA, herein designated VGAM RNA, also designated SEQ ID:4131.

Another function of VGAM1420 is therefore inhibition of BC008967 (Accession XM_027309). Accordingly, utilities of VGAM1420 include diagnosis, prevention and treatment of diseases and clinical conditions associated with BC008967. CL683 (Accession NM_015696) is another VGAM1420 host target gene. CL683 BINDING SITE is HOST TARGET binding site found in the 3' untranslated region of mRNA encoded by CL683, corresponding to a HOST TARGET binding site such as BINDING SITE I, BINDING SITE II or BINDING SITE III. Table 2 illustrates the complementarity of the nucleotide sequences of CL683 BINDING SITE, designated SEQ ID:17923, to the nucleotide sequence of VGAM1420 RNA, herein designated VGAM RNA, also designated SEQ ID:4131.

Another function of VGAM1420 is therefore inhibition of CL683 (Accession NM_015696). Accordingly, utilities of VGAM1420 include diagnosis, prevention and treatment of diseases and clinical conditions associated with CL683. FLJ14596 (Accession NM_032809) is another VGAM1420 host target gene. FLJ14596 BINDING SITE is HOST TARGET binding site found in the 5' untranslated region of mRNA encoded by FLJ14596, corresponding to a HOST TARGET binding site such as BINDING SITE I, BINDING SITE II or BINDING SITE III. Table 2 illustrates the complementarity of the nucleotide sequences of FLJ14596 BINDING SITE, designated SEQ ID:26571, to the nucleotide sequence of VGAM1420 RNA, herein designated VGAM RNA, also designated SEQ ID:4131.

Another function of VGAM1420 is therefore inhibition of FLJ14596 (Accession NM_032809). Accordingly, utilities of VGAM1420 include diagnosis, prevention and treatment of diseases and clinical conditions associated with FLJ14596. Glutamic Pyruvate Transaminase (alanine aminotransferase) 2 (GPT2, Accession NM_133443) is another VGAM1420 host target gene. GPT2 BINDING SITE is HOST TARGET binding site found in the 3' untranslated region of mRNA encoded by GPT2, corresponding to a HOST TARGET binding site such as BINDING SITE I, BINDING SITE II or BINDING SITE III. Table 2 illustrates the complementarity of the nucleotide sequences of GPT2 BINDING SITE, designated SEQ ID:28525, to the nucleotide sequence of VGAM1420 RNA, herein designated VGAM RNA, also designated SEQ ID:4131.

Another function of VGAM1420 is therefore inhibition of Glutamic Pyruvate Transaminase (alanine aminotransferase) 2 (GPT2, Accession NM_133443). Accordingly, utilities of VGAM1420 include diagnosis, prevention and treatment of diseases and clinical conditions associated with GPT2. KIAA0020 (Accession NM_014878) is another VGAM1420 host target gene. KIAA0020 BINDING SITE is HOST TARGET binding site found in the 5" untranslated region of mRNA encoded by KIAA0020, corresponding to a HOST TARGET binding site such as BINDING SITE I, BINDING SITE II or BINDING SITE III. Table 2 illustrates the complementarity of the nucleotide sequences of KIAA0020 BINDING SITE, designated SEQ ID:17020, to the nucleotide sequence of VGAM1420 RNA, herein designated VGAM RNA, also designated SEQ ID:4131.

Another function of VGAM1420 is therefore inhibition of KIAA0020 (Accession NM_014878). Accordingly, utilities of VGAM1420 include diagnosis, prevention and treatment of diseases and clinical conditions associated with KIAA0020. KIAA0766 (Accession NM_014805) is another VGAM1420 host target gene. KIAA0766 BINDING SITE is HOST TARGET binding site found in the 3' untranslated region of mRNA encoded by KIAA0766, corresponding to a HOST TARGET binding site such as BINDING SITE I, BINDING SITE II or BINDING SITE III. Table 2 illustrates the complementarity of the nucleotide sequences of KIAA0766 BINDING SITE, designated SEQ ID:16739, to the nucleotide sequence of VGAM1420 RNA, herein designated VGAM RNA, also designated SEQ ID:4131.

Another function of VGAM1420 is therefore inhibition of KIAA0766 (Accession NM_014805). Accordingly, utilities of VGAM1420 include diagnosis, prevention and treatment of diseases and clinical conditions associated with KIAA0766. KIAA0864 (Accession XM_032630) is another VGAM1420 host target gene. KIAA0864 BINDING SITE is HOST TARGET binding site found in the 3' untranslated region of mRNA encoded by KIAA0864, corresponding to a HOST TARGET binding site such as BINDING SITE I, BINDING SITE II or BINDING SITE III. Table 2 illustrates the complementarity of the nucleotide sequences of KIAA0864 BINDING SITE, designated SEQ ID:31685, to the nucleotide sequence of VGAM1420 RNA, herein designated VGAM RNA, also designated SEQ ID:4131.

Another function of VGAM1420 is therefore inhibition of KIAA0864 (Accession XM_032630). Accordingly, utilities of VGAM1420 include diagnosis, prevention and treatment of diseases and clinical conditions associated with KIAA0864. KIAA1344 (Accession XM_051699) is another VGAM1420 host target gene. KIAA1344 BINDING SITE is HOST TARGET binding site found in the 5' untranslated region of mRNA encoded by KIAA1344, corresponding to a HOST TARGET binding site such as BINDING SITE I, BINDING SITE II or BINDING SITE III. Table 2 illustrates the complementarity of the nucleotide sequences of KIAA1344 BINDING SITE, designated SEQ ID:35871, to the nucleotide sequence of VGAM1420 RNA, herein designated VGAM RNA, also designated SEQ ID:4131.

Another function of VGAM1420 is therefore inhibition of KIAA1344 (Accession XM_051699). Accordingly, utilities of VGAM1420 include diagnosis, prevention and treatment of diseases and clinical conditions associated with KIAA1344. LIM and SH3 Protein 1 (LASP1, Accession NM_006148) is another VGAM1420 host target gene. LASP1 BINDING SITE is HOST TARGET binding site found in the 3' untranslated region of mRNA encoded by LASP1, corresponding to a HOST TARGET binding site such as BINDING SITE I, BINDING SITE II or BINDING SITE III. Table 2 illustrates the complementarity of the nucleotide sequences of LASP1 BINDING SITE, designated SEQ ID:12798, to the nucleotide sequence of VGAM1420 RNA, herein designated VGAM RNA, also designated SEQ ID:4131.

Another function of VGAM1420 is therefore inhibition of LIM and SH3 Protein 1 (LASP1, Accession NM_006148). Accordingly, utilities of VGAM1420 include diagnosis, prevention and treatment of diseases and clinical conditions associated with LASP1. Mitochondrial Ribosomal Protein L35 (MRPL35, Accession NM_016622) is another VGAM1420 host target gene. MRPL35 BINDING SITE is HOST TARGET binding site found in the 3' untranslated region of mRNA encoded by MRPL35, corresponding to a HOST TARGET binding site such as BINDING SITE I, BINDING SITE II or BINDING SITE III. Table 2 illustrates the complementarity of the nucleotide sequences of MRPL35 BINDING SITE, designated SEQ ID:18737, to the nucleotide sequence of VGAM1420 RNA, herein designated VGAM RNA, also designated SEQ ID:4131.

Another function of VGAM1420 is therefore inhibition of Mitochondrial Ribosomal Protein L35 (MRPL35, Accession NM_016622). Accordingly, utilities of VGAM1420 include diagnosis, prevention and treatment of diseases and clinical conditions associated with MRPL35. PURG (Accession NM_013357) is another VGAM1420 host target gene. PURG BINDING SITE is HOST TARGET binding site found in the 3' untranslated region of mRNA encoded by PURG, corresponding to a HOST TARGET binding site such as BINDING SITE I, BINDING SITE II or BINDING SITE III. Table 2 illustrates the complementarity of the nucleotide sequences of PURG BINDING SITE, designated SEQ ID:15006, to the nucleotide sequence of VGAM1420 RNA, herein designated VGAM RNA, also designated SEQ ID:4131.

Another function of VGAM1420 is therefore inhibition of PURG (Accession NM_013357). Accordingly, utilities of VGAM1420 include diagnosis, prevention and treatment of diseases and clinical conditions associated with PURG. Rho-related BTB Domain Containing 1 (RHOBTB1, Accession XM_166144) is another VGAM1420 host target gene. RHOBTB1 BINDING SITE is HOST TARGET binding site found in the 3' untranslated region of mRNA encoded by RHOBTB1, corresponding to a HOST TARGET binding site such as BINDING SITE I, BINDING SITE II or BINDING SITE III. Table 2 illustrates the complementarity of the nucleotide sequences of RHOBTB1 BINDING SITE, designated SEQ ID:43949, to the nucleotide sequence of VGAM1420 RNA, herein designated VGAM RNA, also designated SEQ ID:4131.

Another function of VGAM1420 is therefore inhibition of Rho-related BTB Domain Containing 1 (RHOBTB1, Accession XM_166144). Accordingly, utilities of VGAM1420 include diagnosis, prevention and treatment of diseases and clinical conditions associated with RHOBTB1. Vacuolar Protein Sorting 4B (yeast) (VPS4B, Accession NM_004869) is another VGAM1420 host target gene. VPS4B BINDING SITE is HOST TARGET binding site found in the 3' untranslated region of mRNA encoded by VPS4B, corresponding to a HOST TARGET binding site such as BINDING SITE I, BINDING SITE II or BINDING SITE III. Table 2 illustrates the complementarity of the nucleotide sequences of VPS4B BINDING SITE, designated SEQ ID:11292, to the nucleotide sequence of VGAM1420 RNA, herein designated VGAM RNA, also designated SEQ ID:4131.

Another function of VGAM1420 is therefore inhibition of Vacuolar Protein Sorting 4B (yeast) (VPS4B, Accession NM_004869). Accordingly, utilities of VGAM1420 include diagnosis, prevention and treatment of diseases and clinical conditions associated with VPS4B. LOC150397 (Accession XM_086907) is another VGAM1420 host target gene. LOC150397 BINDING SITE is HOST TARGET binding site found in the 3' untranslated region of mRNA encoded by LOC150397, corresponding to a HOST TARGET binding site such as BINDING SITE I, BINDING SITE II or BINDING SITE III. Table 2 illustrates the complementarity of the nucleotide sequences of LOC150397 BINDING SITE, designated SEQ ID:38956, to the nucleotide sequence of VGAM1420 RNA, herein designated VGAM RNA, also designated SEQ ID:4131.

Another function of VGAM1420 is therefore inhibition of LOC150397 (Accession XM_086907). Accordingly, utilities of VGAM1420 include diagnosis, prevention and treatment of diseases and clinical conditions associated with LOC150397. LOC199221 (Accession XM_087310) is another VGAM1420 host target gene. LOC199221 BINDING SITE is HOST TARGET binding site found in the 5' untranslated region of mRNA encoded by LOC199221, corresponding to a HOST TARGET binding site such as BINDING SITE I, BINDING SITE II or BINDING SITE III. Table 2 illustrates the complementarity of the nucleotide sequences of LOC199221 BINDING SITE, designated SEQ ID:39164, to the nucleotide sequence of VGAM1420 RNA, herein designated VGAM RNA, also designated SEQ ID:4131.

Another function of VGAM1420 is therefore inhibition of LOC199221 (Accession XM_087310). Accordingly, utilities of VGAM1420 include diagnosis, prevention and treatment of diseases and clinical conditions associated with LOC199221. LOC221688 (Accession XM_168085) is another VGAM1420 host target gene. LOC221688 BINDING SITE is HOST TARGET binding site found in the 3' untranslated region of mRNA encoded by LOC221688, corresponding to a HOST TARGET binding site such as BINDING SITE I, BINDING SITE II or BINDING SITE III. Table 2 illustrates the complementarity of the nucleotide sequences of LOC221688 BINDING SITE, designated SEQ ID:44989, to the nucleotide sequence of VGAM1420 RNA, herein designated VGAM RNA, also designated SEQ ID:4131.

Another function of VGAM1420 is therefore inhibition of LOC221688 (Accession XM_168085). Accordingly, utilities of VGAM1420 include diagnosis, prevention and treatment of diseases and clinical conditions associated with LOC221688. FIG. 1 further provides a conceptual description of a novel bioinformatically detected viral gene of the present invention, referred to here as Viral Genomic Address Messenger 1421 (VGAM1421) viral gene, which modulates expression of respective host target genes thereof, the function and utility of which host target genes is known in the art.

VGAM1421 is a novel bioinformatically detected regulatory, non protein coding, viral micro RNA (miRNA) gene. The method by which VGAM1421 was detected is described hereinabove with reference to FIGS. 1-8.

VGAM1421 gene, herein designated VGAM GENE, is a viral gene contained in the genome of Hepatitis GB Virus A. VGAM1421 host target gene, herein designated VGAM HOST TARGET GENE, is a human gene contained in the human genome.

VGAM1421 gene encodes a VGAM1421 precursor RNA, herein designated VGAM PRECURSOR RNA. Similar to other miRNA genes, and unlike most ordinary genes, VGAM1421 precursor RNA does not encode a protein. A nucleotide sequence identical or highly similar to the nucleotide sequence of VGAM1421 precursor RNA is designated SEQ ID:1407, and is provided hereinbelow with reference to the sequence listing part. Nucleotide sequence SEQ ID:1407 is located at position 2844 relative to the genome of Hepatitis GB Virus A.

VGAM1421 precursor RNA folds onto itself, forming VGAM1421 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1421 folded precursor RNA into VGAM1421 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1421 RNA is designated SEQ ID:4132, and is provided hereinbelow with reference to the sequence listing part.

VGAM1421 host target gene, herein designated VGAM HOST TARGET GENE, encodes a corresponding messenger RNA, VGAM1421 host target RNA, herein designated VGAM HOST TARGET RNA. VGAM1421 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1421 RNA, herein designated VGAM RNA, binds complementarily to one or more host target binding sites located in untranslated regions of VGAM1421 host target RNA, herein designated VGAM HOST TARGET RNA. This complementary binding is due to the fact that the nucleotide sequence of VGAM1421 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1421 RNA, herein designated VGAM RNA, may have a different number of host target binding sites in untranslated regions of a VGAM1421 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1421 RNA, herein designated VGAM RNA, to host target binding sites on VGAM1421 host target RNA, herein designated VGAM HOST TARGET RNA, such as BINDING SITE I, BINDING SITE II and BINDING SITE III, inhibits translation of VGAM1421 host target RNA into VGAM1421 host target protein, herein designated VGAM HOST TARGET PROTEIN. VGAM host target protein is therefore outlined by a broken line.

It is appreciated that VGAM1421 host target gene, herein designated VGAM HOST TARGET GENE, in fact represents a plurality of VGAM1421 host target genes. The mRNA of each one of this plurality of VGAM1421 host target genes comprises one or more host target binding sites, each having a nucleotide sequence which is at least partly complementary to VGAM1421 RNA, herein designated VGAM RNA, and which when bound by VGAM1421 RNA causes inhibition of translation of respective one or more VGAM1421 host target proteins.

It is further appreciated by one skilled in the art that the mode of translational inhibition illustrated by FIG. 1 with specific reference to translational inhibition exerted by VGAM1421 gene, herein designated VGAM GENE, on one or more VGAM1421 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1421 is inhibition of expression of host target genes, as part of a novel viral mechanism of attacking a host. Accordingly, utilities of VGAM1421 include diagnosis, prevention and treatment of viral infection by Hepatitis GB Virus A. Specific functions, and accordingly utilities, of VGAM1421 correlate with, and may be deduced from, the identity of the host target genes which VGAM1421 binds and inhibits, and the function of these host target genes, as elaborated hereinbelow.

Nucleotide sequences of the VGAM1421 precursor RNA, herein designated VGAM PRECURSOR RNA, and of the 'diced' VGAM1421 RNA, herein designated VGAM RNA, and a schematic representation of the secondary folding of VGAM1421 folded precursor RNA, herein designated VGAM FOLDED PRECURSOR RNA, of VGAM1421 are further described hereinbelow with reference to Table 1.

Nucleotide sequences of host target binding sites, such as BINDING SITE-I, BINDING SITE-II and BINDING SITE-III of FIG. 1, found on VGAM1421 host target RNA, and schematic representation of the complementarity of each of these host target binding sites to VGAM1421 RNA, herein designated VGAM RNA, are described hereinbelow with reference to Table 2.

As mentioned hereinabove with reference to FIG. 1, a function of VGAM1421 gene, herein designated VGAM is inhibition of expression of VGAM1421 target genes. It is appreciated that specific functions, and accordingly utilities, of VGAM1421 correlate with, and may be deduced from, the identity of the target genes which VGAM1421 binds and inhibits, and the function of these target genes, as elaborated hereinbelow.

CD28 Antigen (Tp44) (CD28, Accession NM_006139) is a VGAM1421 host target gene. CD28 BINDING SITE is HOST TARGET binding site found in the 3' untranslated region of mRNA encoded by CD28, corresponding to a HOST TARGET binding site such as BINDING SITE I, BINDING SITE II or BINDING SITE III. Table 2 illustrates the complementarity of the nucleotide sequences of CD28 BINDING SITE, designated SEQ ID:12781, to the nucleotide sequence of VGAM1421 RNA, herein designated VGAM RNA, also designated SEQ ID:4132.

A function of VGAM1421 is therefore inhibition of CD28 Antigen (Tp44) (CD28, Accession NM_006139), a gene which possibly involved in t-cell activation. Accordingly, utilities of VGAM1421 include diagnosis, prevention and treatment of diseases and clinical conditions associated with CD28. The function of CD28 and its association with various diseases and clinical conditions, has been established by previous studies, as described hereinabove with reference to VGAM281. Desmoglein 1 (DSG1, Accession NM_001942) is another VGAM1421 host target gene. DSG1 BINDING SITE is HOST TARGET binding site found in the 3' untranslated region of mRNA encoded by DSG1, corresponding to a HOST TARGET binding site such as BINDING SITE I, BINDING SITE II or BINDING SITE III. Table 2 illustrates the complementarity of the nucleotide sequences of DSG1 BINDING SITE, designated SEQ ID:7656, to the nucleotide sequence of VGAM1421 RNA, herein designated VGAM RNA, also designated SEQ ID:4132.

Another function of VGAM1421 is therefore inhibition of Desmoglein 1 (DSG1, Accession NM_001942). Accordingly, utilities of VGAM1421 include diagnosis, prevention and treatment of diseases and clinical conditions associated with DSG1. Heterogeneous Nuclear Ribonucleoprotein A1 (HNRPA1, Accession NM_031157) is another VGAM1421 host target gene. HNRPA1 BINDING SITE is HOST TARGET binding site found in the 3' untranslated region of mRNA encoded by HNRPA1, corresponding to a HOST TARGET binding site such as BINDING SITE I, BINDING SITE II or BINDING SITE III. Table 2 illustrates the complementarity of the nucleotide sequences of HNRPA1 BINDING SITE, designated SEQ ID:25247, to the nucleotide sequence of VGAM1421 RNA, herein designated VGAM RNA, also designated SEQ ID:4132.

Another function of VGAM1421 is therefore inhibition of Heterogeneous Nuclear Ribonucleoprotein A1 (HNRPA1, Accession NM_031157), a gene which involves in the packaging of pre-mrna into hnrnp particles, transportes mRNA from the nucleus to the cytoplasm. Accordingly, utilities of VGAM1421 include diagnosis, prevention and treatment of diseases and clinical conditions associated with HNRPA1. The function of HNRPA1 has been established by previous studies. See 164020. In eukaryotic cells, nascent RNA polymerase II transcripts are associated in the nucleus with specific proteins to form ribonucleoprotein complexes called HNRP or 40S. Protein moiety of the 40S particle has 6 major components called core proteins, A1/A2, B1/B2, and C1/C2, plus a number of other proteins. Buvoli et al. (1988) isolated and sequenced the cDNA for human HNRPA1. Southern analysis showed that HNRPA1-specific sequences are present in the human genome as a multigene family of about 30 members, most of them corresponding to pseudogenes of the processed type. Biamonti et al. (1989) succeeded in isolating an active HNRPA1 gene which was split into 10 exons and was 4.6 kb long. Michael et al. (1995) reported that HNRPA1 shuttles continuously between the nucleus and cytoplasm and contains a 38-amino acid domain, termed M9, that acts as both a nuclear localization and nuclear export signal. They suggested that HNRPA1 and other shuttling hnRNPs function as carriers for RNA during export to the cytoplasm.

Full details of the abovementioned studies are described in the following publications, the disclosure of which are hereby incorporated by reference:

Biamonti, G.; Buvoli, M.; Bassi, M. T.; Morandi, C.; Cobianchi, F.; Riva, S.: Isolation of an active gene encoding human hnRNP protein A1: evidence for alternative splicing. J. Molec. Biol. 207:491-503, 1989; and Michael, W. M.; Choi, M.; Dreyfuss, G.: A nuclear export signal in hnRNP A1: a signal-mediated, temperature-dependent nuclear protein export pathway. Cell 83:415-422, 1995.

Further studies establishing the function and utilities of HNRPA1 are found in John Hopkins OMIM database record ID 164017, and in sited publications numbered 1719-172 and 1723 listed in the bibliography section hereinbelow, which are also hereby incorporated by reference. V-myc Myelocytomatosis Viral Oncogene Homolog 2 (avian) (MYCL2, Accession NM_005377) is another VGAM1421 host target gene. MYCL2 BINDING SITE is HOST TARGET binding site found in the 3' untranslated region of mRNA encoded by MYCL2, corresponding to a HOST TARGET binding site such as BINDING SITE I, BINDING SITE II or BINDING SITE III. Table 2 illustrates the complementarity of the nucleotide sequences of MYCL2 BINDING SITE, designated SEQ ID:11856, to the nucleotide sequence of VGAM1421 RNA, herein designated VGAM RNA, also designated SEQ ID:4132.

Another function of VGAM1421 is therefore inhibition of V-myc Myelocytomatosis Viral Oncogene Homolog 2 (avian) (MYCL2, Accession NM_005377). Accordingly, utilities of VGAM1421 include diagnosis, prevention and treatment of diseases and clinical conditions associated with MYCL2. PCTAIRE Protein Kinase 3 (PCTK3, Accession XM_053746) is another VGAM1421 host target gene. PCTK3 BINDING SITE is HOST TARGET binding site found in the 3' untranslated region of mRNA encoded by PCTK3, corresponding to a HOST TARGET binding site such as BINDING SITE I, BINDING SITE II or BINDING SITE III. Table 2 illustrates the complementarity of the nucleotide sequences of PCTK3 BINDING SITE, designated SEQ ID:36125, to the nucleotide sequence of VGAM1421 RNA, herein designated VGAM RNA, also designated SEQ ID:4132.

Another function of VGAM1421 is therefore inhibition of PCTAIRE Protein Kinase 3 (PCTK3, Accession XM_053746), a gene which may play a role in signal transduction cascades in terminally differentiated cells. Accordingly, utilities of VGAM1421 include diagnosis, prevention and treatment of diseases and clinical conditions associated with PCTK3. The function of PCTK3 and its association with various diseases and clinical conditions, has been established by previous studies, as described hereinabove with reference to VGAM132. SRGAP2 (Accession XM_059095) is another VGAM1421 host target gene. SRGAP2 BINDING SITE is HOST TARGET binding site found in the 3' untranslated region of mRNA encoded by SRGAP2, corresponding to a HOST TARGET binding site such as BINDING SITE I, BINDING SITE II or BINDING SITE III. Table 2 illustrates the complementarity of the nucleotide sequences of SRGAP2 BINDING SITE, designated SEQ ID:36880, to the nucleotide sequence of VGAM1421 RNA, herein designated VGAM RNA, also designated SEQ ID:4132.

Another function of VGAM1421 is therefore inhibition of SRGAP2 (Accession XM_059095). Accordingly, utilities of VGAM1421 include diagnosis, prevention and treatment of diseases and clinical conditions associated with SRGAP2. Chromosome 11 Open Reading Frame 9 (C11orf9, Accession NM_013279) is another VGAM1421 host target gene. C11orf9 BINDING SITE is HOST TARGET binding site found in the 3' untranslated region of mRNA encoded by C11orf9, corresponding to a HOST TARGET binding site such as BINDING SITE I, BINDING SITE II or BINDING SITE III. Table 2 illustrates the complementarity of the nucleotide sequences of C11orf9 BINDING SITE, designated SEQ ID:14943, to the nucleotide sequence of VGAM1421 RNA, herein designated VGAM RNA, also designated SEQ ID:4132.

Another function of VGAM1421 is therefore inhibition of Chromosome 11 Open Reading Frame 9 (C11orf9, Accession NM_013279). Accordingly, utilities of VGAM1421 include diagnosis, prevention and treatment of diseases and clinical conditions associated with C11orf9. Golgi Associated, Gamma Adaptin Ear Containing, ARF Binding Protein 2 (GGA2, Accession NM_138640) is another VGAM1421 host target gene. GGA2 BINDING SITE is HOST TARGET binding site found in the 3' untranslated region of mRNA encoded by GGA2, corresponding to a HOST TARGET binding site such as BINDING SITE I, BINDING SITE II or BINDING SITE III. Table 2 illustrates the complementarity of the nucleotide sequences of GGA2 BINDING SITE, designated SEQ ID:28924, to the nucleotide sequence of VGAM1421 RNA, herein designated VGAM RNA, also designated SEQ ID:4132.

Another function of VGAM1421 is therefore inhibition of Golgi Associated, Gamma Adaptin Ear Containing, ARF Binding Protein 2 (GGA2, Accession NM_138640). Accordingly, utilities of VGAM1421 include diagnosis, prevention and treatment of diseases and clinical conditions associated with GGA2. KIAA1856 (Accession XM_166549) is another VGAM1421 host target gene. KIAA1856 BINDING SITE is HOST TARGET binding site found in the 3' untranslated region of mRNA encoded by KIAA1856, corresponding to a HOST TARGET binding site such as BINDING SITE I, BINDING SITE II or BINDING SITE III. Table 2 illustrates the complementarity of the nucleotide sequences of KIAA1856 BINDING SITE, designated SEQ ID:44524, to the nucleotide sequence of VGAM1421 RNA, herein designated VGAM RNA, also designated SEQ ID:4132.

Another function of VGAM1421 is therefore inhibition of KIAA1856 (Accession XM_166549). Accordingly, utilities of VGAM1421 include diagnosis, prevention and treatment of diseases and clinical conditions associated with KIAA1856. MGC10870 (Accession NM_032301) is another VGAM1421 host target gene. MGC10870 BINDING SITE is HOST TARGET binding site found in the 5' untranslated region of mRNA encoded by MGC10870, corresponding to a HOST TARGET binding site such as BINDING SITE I, BINDING SITE II or BINDING SITE III. Table 2 illustrates the complementarity of the nucleotide sequences of MGC10870 BINDING SITE, designated SEQ ID:26083, to the nucleotide sequence of VGAM1421 RNA, herein designated VGAM RNA, also designated SEQ ID:4132.

Another function of VGAM1421 is therefore inhibition of MGC10870 (Accession NM_032301). Accordingly, utilities of VGAM1421 include diagnosis, prevention and treatment of diseases and clinical conditions associated with MGC10870. MGC20460 (Accession NM_053043) is another VGAM1421 host target gene. MGC20460 BINDING SITE is HOST TARGET binding site found in the 5' untranslated region of mRNA encoded by MGC20460, corresponding to a HOST TARGET binding site such as BINDING SITE I, BINDING SITE II or BINDING SITE III. Table 2 illustrates the complementarity of the nucleotide sequences of MGC20460 BINDING SITE, designated SEQ ID:27589, to the nucleotide sequence of VGAM1421 RNA, herein designated VGAM RNA, also designated SEQ ID:4132.

Another function of VGAM1421 is therefore inhibition of MGC20460 (Accession NM_053043). Accordingly, utilities of VGAM1421 include diagnosis, prevention and treatment of diseases and clinical conditions associated with MGC20460. Torsin Family 1, Member B (torsin B) (TOR1B, Accession NM_014506) is another VGAM1421 host target gene. TOR1B BINDING SITE is HOST TARGET binding site found in the 3' untranslated region of mRNA encoded by TOR1B, corresponding to a HOST TARGET binding site such as BINDING SITE I, BINDING SITE II or BINDING SITE III. Table 2 illustrates the complementarity of the nucleotide sequences of TOR1B BINDING SITE, designated SEQ ID:15842, to the nucleotide sequence of VGAM1421 RNA, herein designated VGAM RNA, also designated SEQ ID:4132.

Another function of VGAM1421 is therefore inhibition of Torsin Family 1, Member B (torsin B) (TOR1B, Accession NM_014506). Accordingly, utilities of VGAM1421 include diagnosis, prevention and treatment of diseases and clinical conditions associated with TOR1B. Zinc Finger Protein 17 (HPF3, KOX 10) (ZNF17, Accession XM_091895) is another VGAM1421 host target gene. ZNF17 BINDING SITE is HOST TARGET binding site found in the 3' untranslated region of mRNA encoded by ZNF17, corresponding to a HOST TARGET binding site such as BINDING SITE I, BINDING SITE II or BINDING SITE III. Table 2 illustrates the complementarity of the nucleotide sequences of ZNF17 BINDING SITE, designated SEQ ID:40068, to the nucleotide sequence of VGAM1421 RNA, herein designated VGAM RNA, also designated SEQ ID:4132.

Another function of VGAM1421 is therefore inhibition of Zinc Finger Protein 17 (HPF3, KOX 10) (ZNF17, Accession XM_091895). Accordingly, utilities of VGAM1421 include diagnosis, prevention and treatment of diseases and clinical conditions associated with ZNF17. LOC146237 (Accession XM_096954) is another VGAM1421 host target gene. LOC146237 BINDING SITE is HOST TARGET binding site found in the 5' untranslated region of mRNA encoded by LOC146237, corresponding to a HOST TARGET binding site such as BINDING SITE I, BINDING SITE II or BINDING SITE III. Table 2 illustrates the complementarity of the nucleotide sequences of LOC146237 BINDING SITE, designated SEQ ID:40671, to the nucleotide sequence of VGAM1421 RNA, herein designated VGAM RNA, also designated SEQ ID:4132.

Another function of VGAM1421 is therefore inhibition of LOC146237 (Accession XM_096954). Accordingly, utilities of VGAM1421 include diagnosis, prevention and treatment of diseases and clinical conditions associated with LOC146237. LOC146733 (Accession XM_097076) is another VGAM1421 host target gene. LOC146733 BINDING SITE is HOST TARGET binding site found in the 5' untranslated region of mRNA encoded by LOC146733, corresponding to a HOST TARGET binding site such as BINDING SITE I, BINDING SITE II or BINDING SITE III. Table 2 illustrates the complementarity of the nucleotide sequences of LOC146733 BINDING SITE, designated SEQ ID:40731, to the nucleotide sequence of VGAM1421 RNA, herein designated VGAM RNA, also designated SEQ ID:4132.

Another function of VGAM1421 is therefore inhibition of LOC146733 (Accession XM_097076). Accordingly, utilities of VGAM1421 include diagnosis, prevention and treatment of diseases and clinical conditions associated with LOC146733. LOC222183 (Accession XM_168436) is another VGAM1421 host target gene. LOC222183 BINDING SITE is HOST TARGET binding site found in the 3' untranslated region of mRNA encoded by LOC222183, corresponding to a HOST TARGET binding site such as BINDING SITE I, BINDING SITE II or BINDING SITE III. Table 2 illustrates the complementarity of the nucleotide sequences of LOC222183 BINDING SITE, designated SEQ ID:45185, to the nucleotide sequence of VGAM1421 RNA, herein designated VGAM RNA, also designated SEQ ID:4132.

Another function of VGAM1421 is therefore inhibition of LOC222183 (Accession XM_168436). Accordingly, utilities of VGAM1421 include diagnosis, prevention and treatment of diseases and clinical conditions associated with LOC222183. FIG. 1 further provides a conceptual description of a novel bioinformatically detected viral gene of the present invention, referred to here as Viral Genomic Address Messenger 1422 (VGAM1422) viral gene, which modulates expression of respective host target genes thereof, the function and utility of which host target genes is known in the art.

VGAM1422 is a novel bioinformatically detected regulatory, non protein coding, viral micro RNA (miRNA) gene. The method by which VGAM1422 was detected is described hereinabove with reference to FIGS. 1-8.

VGAM1422 gene, herein designated VGAM GENE, is a viral gene contained in the genome of Hepatitis GB Virus A. VGAM1422 host target gene, herein designated VGAM HOST TARGET GENE, is a human gene contained in the human genome.

VGAM1422 gene encodes a VGAM1422 precursor RNA, herein designated VGAM PRECURSOR RNA. Similar to other miRNA genes, and unlike most ordinary genes, VGAM1422 precursor RNA does not encode a protein. A nucleotide sequence identical or highly similar to the nucleotide sequence of VGAM1422 precursor RNA is designated SEQ ID:1408, and is provided hereinbelow with reference to the sequence listing part. Nucleotide sequence SEQ ID:1408 is located at position 1070 relative to the genome of Hepatitis GB Virus A.

VGAM1422 precursor RNA folds onto itself, forming VGAM1422 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1422 folded precursor RNA into VGAM1422 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1422 RNA is designated SEQ ID:4133, and is provided hereinbelow with reference to the sequence listing part.

VGAM1422 host target gene, herein designated VGAM HOST TARGET GENE, encodes a corresponding messenger RNA, VGAM1422 host target RNA, herein designated VGAM HOST TARGET RNA. VGAM1422 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1422 RNA, herein designated VGAM RNA, binds complementarily to one or more host target binding sites located in untranslated regions of VGAM1422 host target RNA, herein designated VGAM HOST TARGET RNA. This complementary binding is due to the fact that the nucleotide sequence of VGAM1422 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1422 RNA, herein designated VGAM RNA, may have a different number of host target binding sites in untranslated regions of a VGAM1422 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1422 RNA, herein designated VGAM RNA, to host target binding sites on VGAM1422 host target RNA, herein designated VGAM HOST TARGET RNA, such as BINDING SITE I, BINDING SITE II and BINDING SITE III, inhibits translation of VGAM1422 host target RNA into VGAM1422 host target protein, herein designated VGAM HOST TARGET PROTEIN. VGAM host target protein is therefore outlined by a broken line.

It is appreciated that VGAM1422 host target gene, herein designated VGAM HOST TARGET GENE, in fact represents a plurality of VGAM1422 host target genes. The mRNA of each one of this plurality of VGAM1422 host target genes comprises one or more host target binding sites, each having a nucleotide sequence which is at least partly complementary to VGAM1422 RNA, herein designated VGAM RNA, and which when bound by VGAM1422 RNA causes inhibition of translation of respective one or more VGAM1422 host target proteins.

It is further appreciated by one skilled in the art that the mode of translational inhibition illustrated by FIG. 1 with specific reference to translational inhibition exerted by VGAM1422 gene, herein designated VGAM GENE, on one or more VGAM1422 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1422 is inhibition of expression of host target genes, as part of a novel viral mechanism of attacking a host. Accordingly, utilities of VGAM1422 include diagnosis, prevention and treatment of viral infection by Hepatitis GB Virus A. Specific functions, and accordingly utilities, of VGAM1422 correlate with, and may be deduced from, the identity of the host target genes which VGAM1422 binds and inhibits, and the function of these host target genes, as elaborated hereinbelow.

Nucleotide sequences of the VGAM1422 precursor RNA, herein designated VGAM PRECURSOR RNA, and of the 'diced' VGAM1422 RNA, herein designated VGAM RNA, and a schematic representation of the secondary folding of VGAM1422 folded precursor RNA, herein designated VGAM FOLDED PRECURSOR RNA, of VGAM1422 are further described hereinbelow with reference to Table 1.

Nucleotide sequences of host target binding sites, such as BINDING SITE-I, BINDING SITE-II and BINDING SITE-III of FIG. 1, found on VGAM1422 host target RNA, and schematic representation of the complementarity of each of these host target binding sites to VGAM1422 RNA, herein designated VGAM RNA, are described hereinbelow with reference to Table 2.

As mentioned hereinabove with reference to FIG. 1, a function of VGAM1422 gene, herein designated VGAM is inhibition of expression of VGAM1422 target genes. It is appreciated that specific functions, and accordingly utilities, of VGAM1422 correlate with, and may be deduced from, the identity of the target genes which VGAM1422 binds and inhibits, and the function of these target genes, as elaborated hereinbelow.

CDC-like Kinase 2 (CLK2, Accession NM_001291) is a VGAM1422 host target gene. CLK2 BINDING SITE is HOST TARGET binding site found in the 3' untranslated region of mRNA encoded by CLK2, corresponding to a HOST TARGET binding site such as BINDING SITE I, BINDING SITE II or BINDING SITE III. Table 2 illustrates the complementarity of the nucleotide sequences of CLK2 BINDING SITE, designated SEQ ID:6972, to the nucleotide sequence of VGAM1422 RNA, herein designated VGAM RNA, also designated SEQ ID:4133.

A function of VGAM1422 is therefore inhibition of CDC-like Kinase 2 (CLK2, Accession NM_001291), a gene which catalyzes the phosphorylation of proteins. Accordingly, utilities of VGAM1422 include diagnosis, prevention and treatment of diseases and clinical conditions associated with CLK2. The function of CLK2 and its association with various diseases and clinical conditions, has been established by previous studies, as described hereinabove with reference to VGAM356. Dynamin 2 (DNM2, Accession NM_004945) is another VGAM1422 host target gene. DNM2 BINDING SITE is HOST TARGET binding site found in the 3' untranslated region of mRNA encoded by DNM2, corresponding to a HOST TARGET binding site such as BINDING SITE I, BINDING SITE II or BINDING SITE III. Table 2 illustrates the complementarity of the nucleotide sequences of DNM2 BINDING SITE, designated SEQ ID:11388, to the nucleotide sequence of VGAM1422 RNA, herein designated VGAM RNA, also designated SEQ ID:4133.

Another function of VGAM1422 is therefore inhibition of Dynamin 2 (DNM2, Accession NM_004945), a gene which regulates budding of endocytic vesicles. Accordingly, utilities of VGAM1422 include diagnosis, prevention and treatment of diseases and clinical conditions associated with DNM2. The function of DNM2 has been established by previous studies. Dynamins (DNMs) are members of a group of GTPases that share high homology in their N-terminal regions. Mammals have at least 3 DNMs: DNM1 (OMIM Ref. No. 602377), DNM2, and DNM3. Diatloff-Zito et al. (1995) had previously isolated a human genomic DNA fragment by its capacity to correct the mitomycin C hypersensitivity of cells from a Fanconi anemia patient belonging to genetic complementation group D (FACD; 227646). Using this fragment, they screened a human fibroblast cDNA library and isolated a cDNA encoding DNM2. The predicted 866-amino acid protein is 73% and 98% identical to DNM1 and rat Dnm2, respectively. It contains the 3 consensus sequence elements characteristic of GTP-binding proteins at its N terminus, a Pleckstrin homology domain, and a basic, proline-rich C-terminal region that contains multiple SRC homology 3 domains. DNM2 contains 9 consensus motifs for CDC2 (OMIM Ref. No. 116940) phosphorylation, indicating a potential role at the G2/mitosis transition. Northern blot analysis detected a 3.6-kb transcript in all tissues examined, with highest expression in heart and skeletal muscle. Sequencing and RT-PCR identified alternative splicing variants of DNM2. The authors suggested that multiple rounds of duplication and divergence occurred within DNM gene evolution. No alterations in DNM2 sequence or mRNA expression were detected in the FACD patient studied. By interspecific backcross analysis, Klocke et al. (1997) found that the mouse Dnm2 gene is closely linked to the Icam1 gene (OMIM Ref. No. 147840) on the proximal portion of chromosome 9, in a region with homologies to human 19p, 8q, and 11q.

Full details of the abovementioned studies are described in the following publications, the disclosure of which are hereby incorporated by reference:

Diatloff-Zito, C.; Gordon, A. J. E.; Duchaud, E.; Merlin, G.: Isolation of an ubiquitously expressed cDNA encoding human dynamin II, a member of the large GTP-binding protein family. Gene 163:301-306, 1995; and Klocke, R.; Augustin, A.; Ronsiek, M.; Stief, A.; van der Putten, H.; Jockusch, H. : Dynamin genes Dnm1 and Dnm2 are located on proximal mouse chromosomes 2 and 9, respectively. Genomic.

Further studies establishing the function and utilities of DNM2 are found in John Hopkins OMIM database record ID 602378, and in sited publications numbered 5604 listed in the bibliography section hereinbelow, which are also hereby incorporated by reference. Filamin B, Beta (actin binding protein 278) (FLNB, Accession XM_030806) is another VGAM1422 host target gene. FLNB BINDING SITE is HOST TARGET binding site found in the 3' untranslated region of mRNA encoded by FLNB, corresponding to a HOST TARGET binding site such as BINDING SITE I, BINDING SITE II or BINDING SITE III. Table 2 illustrates the complementarity of the nucleotide sequences of FLNB BINDING SITE, designated SEQ ID:31147, to the nucleotide sequence of VGAM1422 RNA, herein designated VGAM RNA, also designated SEQ ID:4133.

Another function of VGAM1422 is therefore inhibition of Filamin B, Beta (actin binding protein 278) (FLNB, Accession XM_030806), a gene which Filamin B, beta; binds actin, interacts with cytoplasmic domain of Ibalpha. Accordingly, utilities of VGAM1422 include diagnosis, prevention and treatment of diseases and clinical conditions associated with FLNB. The function of FLNB and its association with various diseases and clinical conditions, has been established by previous studies, as described hereinabove with reference to VGAM416. Hairless Homolog (mouse) (HR, Accession NM_005144) is another VGAM1422 host target gene. HR BINDING SITE is HOST TARGET binding site found in the 3' untranslated region of mRNA encoded by HR, corresponding to a HOST TARGET binding site such as BINDING SITE I, BINDING SITE II or BINDING SITE III. Table 2 illustrates the complementarity of the nucleotide sequences of HR BINDING SITE, designated SEQ ID:11619, to the nucleotide sequence of VGAM1422 RNA, herein designated VGAM RNA, also designated SEQ ID:4133.

Another function of VGAM1422 is therefore inhibition of Hairless Homolog (mouse) (HR, Accession NM_005144). Accordingly, utilities of VGAM1422 include diagnosis, prevention and treatment of diseases and clinical conditions associated with HR. Meningioma (disrupted in balanced translocation) 1 (MN1, Accession NM_002430) is another VGAM1422 host target gene. MN1 BINDING SITE is HOST TARGET binding site found in the 3" untranslated region of mRNA encoded by MN1, corresponding to a HOST TARGET binding site such as BINDING SITE I, BINDING SITE II or BINDING SITE III. Table 2 illustrates the complementarity of the nucleotide sequences of MN1 BINDING SITE, designated SEQ ID:8274, to the nucleotide sequence of VGAM1422 RNA, herein designated VGAM RNA, also designated SEQ ID:4133.

Another function of VGAM1422 is therefore inhibition of Meningioma (disrupted in balanced translocation) 1 (MN1, Accession NM_002430). Accordingly, utilities of VGAM1422 include diagnosis, prevention and treatment of diseases and clinical conditions associated with MN1. Nerve Growth Factor Receptor (TNFR superfamily, member 16) (NGFR, Accession NM_002507) is another VGAM1422 host target gene. NGFR BINDING SITE is HOST TARGET binding site found in the 3' untranslated region of mRNA encoded by NGFR, corresponding to a HOST TARGET binding site such as BINDING SITE I, BINDING SITE II or BINDING SITE III. Table 2 illustrates the complementarity of the nucleotide sequences of NGFR BINDING SITE, designated SEQ ID:8335, to the nucleotide sequence of VGAM1422 RNA, herein designated VGAM RNA, also designated SEQ ID:4133.

Another function of VGAM1422 is therefore inhibition of Nerve Growth Factor Receptor (TNFR superfamily, member 16) (NGFR, Accession NM_002507), a gene which can mediate cell survival as well as cell death of neural cells. Accordingly, utilities of VGAM1422 include diagnosis, prevention and treatment of diseases and clinical conditions associated with NGFR. The function of NGFR and its association with various diseases and clinical conditions, has been established by previous studies, as described hereinabove with reference to VGAM212. Retinoic Acid Induced 2 (RAI2, Accession NM_021785) is another VGAM1422 host target gene. RAI2 BINDING SITE is HOST TARGET binding site found in the 5' untranslated region of mRNA encoded by RAI2, corresponding to a HOST TARGET binding site such as BINDING SITE I, BINDING SITE II or BINDING SITE III. Table 2 illustrates the complementarity of the nucleotide sequences of RAI2 BINDING SITE, designated SEQ ID:22349, to the nucleotide sequence of VGAM1422 RNA, herein designated VGAM RNA, also designated SEQ ID:4133.

Another function of VGAM1422 is therefore inhibition of Retinoic Acid Induced 2 (RAI2, Accession NM_021785). Accordingly, utilities of VGAM1422 include diagnosis, prevention and treatment of diseases and clinical conditions associated with RAI2. Apg4B (Accession NM_013325) is another VGAM1422 host target gene. Apg4B BINDING SITE is HOST TARGET binding site found in the 3' untranslated region of mRNA encoded by Apg4B, corresponding to a HOST TARGET binding site such as BINDING SITE I, BINDING SITE II or BINDING SITE III. Table 2 illustrates the complementarity of the nucleotide sequences of Apg4B BINDING SITE, designated SEQ ID:14975, to the nucleotide sequence of VGAM1422 RNA, herein designated VGAM RNA, also designated SEQ ID:4133.

Another function of VGAM1422 is therefore inhibition of Apg4B (Accession NM_013325). Accordingly, utilities of VGAM1422 include diagnosis, prevention and treatment of diseases and clinical conditions associated with Apg4B. D15Wsu75e (Accession XM_039495) is another VGAM1422 host target gene. D15Wsu75e BINDING SITE is HOST TARGET binding site found in the 5' untranslated region of mRNA encoded by D15Wsu75e, corresponding to a HOST TARGET binding site such as BINDING SITE I, BINDING SITE II or BINDING SITE III. Table 2 illustrates the complementarity of the nucleotide sequences of D15Wsu75e BINDING SITE, designated SEQ ID:33102, to the nucleotide sequence of VGAM1422 RNA, herein designated VGAM RNA, also designated SEQ ID:4133.

Another function of VGAM1422 is therefore inhibition of D15Wsu75e (Accession XM_039495). Accordingly, utilities of VGAM1422 include diagnosis, prevention and treatment of diseases and clinical conditions associated with D15Wsu75e. DLAD (Accession NM_058248) is another VGAM1422 host target gene. DLAD BINDING SITE is HOST TARGET binding site found in the 5' untranslated region of mRNA encoded by DLAD, corresponding to a HOST TARGET binding site such as BINDING SITE I, BINDING SITE II or BINDING SITE III. Table 2 illustrates the complementarity of the nucleotide sequences of DLAD BINDING SITE, designated SEQ ID:27779, to the nucleotide sequence of VGAM1422 RNA, herein designated VGAM RNA, also designated SEQ ID:4133.

Another function of VGAM1422 is therefore inhibition of DLAD (Accession NM_058248). Accordingly, utilities of VGAM1422 include diagnosis, prevention and treatment of diseases and clinical conditions associated with DLAD. DnaJ (Hsp40) Homolog, Subfamily C, Member 8 (DNAJC8, Accession NM_014280) is another VGAM1422 host target gene. DNAJC8 BINDING SITE is HOST TARGET binding site found in the 3' untranslated region of mRNA encoded by DNAJC8, corresponding to a HOST TARGET binding site such as BINDING SITE I, BINDING SITE II or BINDING SITE III. Table 2 illustrates the complementarity of the nucleotide sequences of DNAJC8 BINDING SITE, designated SEQ ID:15559, to the nucleotide sequence of VGAM1422 RNA, herein designated VGAM RNA, also designated SEQ ID:4133.

Another function of VGAM1422 is therefore inhibition of DnaJ (Hsp40) Homolog, Subfamily C, Member 8 (DNAJC8, Accession NM_014280). Accordingly, utilities of VGAM1422 include diagnosis, prevention and treatment of diseases and clinical conditions associated with DNAJC8. FLJ14751 (Accession NM_032834) is another VGAM1422 host target gene. FLJ14751 BINDING SITE is HOST TARGET binding site found in the 3' untranslated region of mRNA encoded by FLJ14751, corresponding to a HOST TARGET binding site such as BINDING SITE I, BINDING SITE II or BINDING SITE III. Table 2 illustrates the complementarity of the nucleotide sequences of FLJ14751 BINDING SITE, designated SEQ ID:26612, to the nucleotide sequence of VGAM1422 RNA, herein designated VGAM RNA, also designated SEQ ID:4133.

Another function of VGAM1422 is therefore inhibition of FLJ14751 (Accession NM_032834). Accordingly, utilities of VGAM1422 include diagnosis, prevention and treatment of diseases and clinical conditions associated with FLJ14751. FLJ23548 (Accession NM_024590) is another VGAM1422 host target gene. FLJ23548 BINDING SITE is HOST TARGET binding site found in the 3' untranslated region of mRNA encoded by FLJ23548, corresponding to a HOST TARGET binding site such as BINDING SITE I, BINDING SITE II or BINDING SITE III. Table 2 illustrates the complementarity of the nucleotide sequences of FLJ23548 BINDING SITE, designated SEQ ID:23827, to the nucleotide sequence of VGAM1422 RNA, herein designated VGAM RNA, also designated SEQ ID:4133.

Another function of VGAM1422 is therefore inhibition of FLJ23548 (Accession NM_024590). Accordingly, utilities of VGAM1422 include diagnosis, prevention and treatment of diseases and clinical conditions associated with FLJ23548. KIAA1193 (Accession XM_041843) is another VGAM1422 host target gene. KIAA1193 BINDING SITE is HOST TARGET binding site found in the 3' untranslated region of mRNA encoded by KIAA1193, corresponding to a HOST TARGET binding site such as BINDING SITE I, BINDING SITE II or BINDING SITE III. Table 2 illustrates the complementarity of the nucleotide sequences of KIAA1193 BINDING SITE, designated SEQ ID:33585, to the nucleotide sequence of VGAM1422 RNA, herein designated VGAM RNA, also designated SEQ ID:4133.

Another function of VGAM1422 is therefore inhibition of KIAA1193 (Accession XM_041843). Accordingly, utilities of VGAM1422 include diagnosis, prevention and treatment of diseases and clinical conditions associated with KIAA1193. KIAA1323 (Accession XM_032146) is another VGAM1422 host target gene. KIAA1323 BINDING SITE is HOST TARGET binding site found in the 5' untranslated region of mRNA encoded by KIAA1323, corresponding to a HOST TARGET binding site such as BINDING SITE I, BINDING SITE II or BINDING SITE III. Table 2 illustrates the complementarity of the nucleotide sequences of KIAA1323 BINDING SITE, designated SEQ ID:31565, to the nucleotide sequence of VGAM1422 RNA, herein designated VGAM RNA, also designated SEQ ID:4133.

Another function of VGAM1422 is therefore inhibition of KIAA1323 (Accession XM_032146). Accordingly, utilities of VGAM1422 include diagnosis, prevention and treatment of diseases and clinical conditions associated with KIAA1323. KIAA1337 (Accession XM_052561) is another VGAM1422 host target gene. KIAA1337 BINDING SITE is HOST TARGET binding site found in the 3' untranslated region of mRNA encoded by KIAA1337, corresponding to a HOST TARGET binding site such as BINDING SITE I, BINDING SITE II or BINDING SITE III. Table 2 illustrates the complementarity of the nucleotide sequences of KIAA1337 BINDING SITE, designated SEQ ID:35986, to the nucleotide sequence of VGAM1422 RNA, herein designated VGAM RNA, also designated SEQ ID:4133.

Another function of VGAM1422 is therefore inhibition of KIAA1337 (Accession XM_052561). Accordingly, utilities of VGAM1422 include diagnosis, prevention and treatment of diseases and clinical conditions associated with KIAA1337. KIAA1705 (Accession XM_051692) is another VGAM1422 host target gene. KIAA1705 BINDING SITE is HOST TARGET binding site found in the 3' untranslated region of mRNA encoded by KIAA1705, corresponding to a HOST TARGET binding site such as BINDING SITE I, BINDING SITE II or BINDING SITE III. Table 2 illustrates the complementarity of the nucleotide sequences of KIAA1705 BINDING SITE, designated SEQ ID:35861, to the nucleotide sequence of VGAM1422 RNA, herein designated VGAM RNA, also designated SEQ ID:4133.

Another function of VGAM1422 is therefore inhibition of KIAA1705 (Accession XM_051692). Accordingly, utilities of VGAM1422 include diagnosis, prevention and treatment of diseases and clinical conditions associated with KIAA1705. MGC10715 (Accession NM_024325) is another VGAM1422 host target gene. MGC10715 BINDING SITE is HOST TARGET binding site found in the 3' untranslated region of mRNA encoded by MGC10715, corresponding to a HOST TARGET binding site such as BINDING SITE I, BINDING SITE II or BINDING SITE III. Table 2 illustrates the complementarity of the nucleotide sequences of MGC10715 BINDING SITE, designated SEQ ID:23616, to the nucleotide sequence of VGAM1422 RNA, herein designated VGAM RNA, also designated SEQ ID:4133.

Another function of VGAM1422 is therefore inhibition of MGC10715 (Accession NM_024325). Accordingly, utilities of VGAM1422 include diagnosis, prevention and treatment of diseases and clinical conditions associated with MGC10715. MGC20253 (Accession NM_144583) is another VGAM1422 host target gene. MGC20253 BINDING SITE is HOST TARGET binding site found in the 3' untranslated region of mRNA encoded by MGC20253, corresponding to a HOST TARGET binding site such as BINDING SITE I, BINDING SITE II or BINDING SITE III. Table 2 illustrates the complementarity of the nucleotide sequences of MGC20253 BINDING SITE, designated SEQ ID:29397, to the nucleotide sequence of VGAM1422 RNA, herein designated VGAM RNA, also designated SEQ ID:4133.

Another function of VGAM1422 is therefore inhibition of MGC20253 (Accession NM_144583). Accordingly, utilities of VGAM1422 include diagnosis, prevention and treatment of diseases and clinical conditions associated with MGC20253. Phosphodiesterase 2A, CGMP-stimulated (PDE2A, Accession NM_002599) is another VGAM1422 host target gene. PDE2A BINDING SITE is HOST TARGET binding site found in the 3' untranslated region of mRNA encoded by PDE2A, corresponding to a HOST TARGET binding site such as BINDING SITE I, BINDING SITE II or BINDING SITE III. Table 2 illustrates the complementarity of the nucleotide sequences of PDE2A BINDING SITE, designated SEQ ID:8463, to the nucleotide sequence of VGAM1422 RNA, herein designated VGAM RNA, also designated SEQ ID:4133.

Another function of VGAM1422 is therefore inhibition of Phosphodiesterase 2A, CGMP-stimulated (PDE2A, Accession NM_002599). Accordingly, utilities of VGAM1422 include diagnosis, prevention and treatment of diseases and clinical conditions associated with PDE2A. LOC123242 (Accession XM_063548) is another VGAM1422 host target gene. LOC123242 BINDING SITE is HOST TARGET binding site found in the 5' untranslated region of mRNA encoded by LOC123242, corresponding to a HOST TARGET binding site such as BINDING SITE I, BINDING SITE II or BINDING SITE III. Table 2 illustrates the complementarity of the nucleotide sequences of LOC123242 BINDING SITE, designated SEQ ID:37242, to the nucleotide sequence of VGAM1422 RNA, herein designated VGAM RNA, also designated SEQ ID:4133.

Another function of VGAM1422 is therefore inhibition of LOC123242 (Accession XM_063548). Accordingly, utilities of VGAM1422 include diagnosis, prevention and treatment of diseases and clinical conditions associated with LOC123242. LOC148114 (Accession XM_086050) is another VGAM1422 host target gene. LOC148114 BINDING SITE is HOST TARGET binding site found in the 5' untranslated region of mRNA encoded by LOC148114, corresponding to a HOST TARGET binding site such as BINDING SITE I, BINDING SITE II or BINDING SITE III. Table 2 illustrates the complementarity of the nucleotide sequences of LOC148114 BINDING SITE, designated SEQ ID:38468, to the nucleotide sequence of VGAM1422 RNA, herein designated VGAM RNA, also designated SEQ ID:4133.

Another function of VGAM1422 is therefore inhibition of LOC148114 (Accession XM_086050). Accordingly, utilities of VGAM1422 include diagnosis, prevention and treatment of diseases and clinical conditions associated with LOC148114. LOC149086 (Accession XM_097580) is another VGAM1422 host target gene. LOC149086 BINDING SITE is HOST TARGET binding site found in the 3' untranslated region of mRNA encoded by LOC149086, corresponding to a HOST TARGET binding site such as BINDING SITE I, BINDING SITE II or BINDING SITE III. Table 2 illustrates the complementarity of the nucleotide sequences of LOC149086 BINDING SITE, designated SEQ ID:40946, to the nucleotide sequence of VGAM1422 RNA, herein designated VGAM RNA, also designated SEQ ID:4133.

Another function of VGAM1422 is therefore inhibition of LOC149086 (Accession XM_097580). Accordingly, utilities of VGAM1422 include diagnosis, prevention and treatment of diseases and clinical conditions associated with LOC149086. LOC151996 (Accession XM_098151) is another VGAM1422 host target gene. LOC151996 BINDING SITE is HOST TARGET binding site found in the 5' untranslated region of mRNA encoded by LOC151996, corresponding to a HOST TARGET binding site such as BINDING SITE I, BINDING SITE II or BINDING SITE III. Table 2 illustrates the complementarity of the nucleotide sequences of LOC151996 BINDING SITE, designated SEQ ID:41414, to the nucleotide sequence of VGAM1422 RNA, herein designated VGAM RNA, also designated SEQ ID:4133.

Another function of VGAM1422 is therefore inhibition of LOC151996 (Accession XM_098151). Accordingly, utilities of VGAM1422 include diagnosis, prevention and treatment of diseases and clinical conditions associated with LOC151996. LOC253001 (Accession XM_171711) is another VGAM1422 host target gene. LOC253001 BINDING SITE is HOST TARGET binding site found in the 5' untranslated region of mRNA encoded by LOC253001, corresponding to a HOST TARGET binding site such as BINDING SITE I, BINDING SITE II or BINDING SITE III. Table 2 illustrates the complementarity of the nucleotide sequences of LOC253001 BINDING SITE, designated SEQ ID:46058, to the nucleotide sequence of VGAM1422 RNA, herein designated VGAM RNA, also designated SEQ ID:4133.

Another function of VGAM1422 is therefore inhibition of LOC253001 (Accession XM_171711). Accordingly, utilities of VGAM1422 include diagnosis, prevention and treatment of diseases and clinical conditions associated with LOC253001. LOC253256 (Accession XM_171506) is another VGAM1422 host target gene. LOC253256 BINDING SITE is HOST TARGET binding site found in the 5' untranslated region of mRNA encoded by LOC253256, corresponding to a HOST TARGET binding site such as BINDING SITE I, BINDING SITE II or BINDING SITE III. Table 2 illustrates the complementarity of the nucleotide sequences of LOC253256 BINDING SITE, designated SEQ ID:46048, to the nucleotide sequence of VGAM1422 RNA, herein designated VGAM RNA, also designated SEQ ID:4133.

Another function of VGAM1422 is therefore inhibition of LOC253256 (Accession XM_171506). Accordingly, utilities of VGAM1422 include diagnosis, prevention and treatment of diseases and clinical conditions associated with LOC253256. LOC253847 (Accession XM_171145) is another VGAM1422 host target gene. LOC253847 BINDING SITE is HOST TARGET binding site found in the 5' untranslated region of mRNA encoded by LOC253847, corresponding to a HOST TARGET binding site such as BINDING SITE I, BINDING SITE II or BINDING SITE III. Table 2 illustrates the complementarity of the nucleotide sequences of LOC253847 BINDING SITE, designated SEQ ID:45941, to the nucleotide sequence of VGAM1422 RNA, herein designated VGAM RNA, also designated SEQ ID:4133.

Another function of VGAM1422 is therefore inhibition of LOC253847 (Accession XM_171145). Accordingly, utilities of VGAM1422 include diagnosis, prevention and treatment of diseases and clinical conditions associated with LOC253847. LOC92840 (Accession NM_138393) is another VGAM1422 host target gene. LOC92840 BINDING SITE is HOST TARGET binding site found in the 3' untranslated region of mRNA encoded by LOC92840, corresponding to a HOST TARGET binding site such as BINDING SITE I, BINDING SITE II or BINDING SITE III. Table 2 illustrates the complementarity of the nucleotide sequences of LOC92840 BINDING SITE, designated SEQ ID:28761, to the nucleotide sequence of VGAM1422 RNA, herein designated VGAM RNA, also designated SEQ ID:4133.

Another function of VGAM1422 is therefore inhibition of LOC92840 (Accession NM_138393). Accordingly, utilities of VGAM1422 include diagnosis, prevention and treatment of diseases and clinical conditions associated with LOC92840. FIG. 1 further provides a conceptual description of a novel bioinformatically detected viral gene of the present invention, referred to here as Viral Genomic Address Messenger 1423 (VGAM1423) viral gene, which modulates expression of respective host target genes thereof, the function and utility of which host target genes is known in the art.

VGAM1423 is a novel bioinformatically detected regulatory, non protein coding, viral micro RNA (miRNA) gene. The method by which VGAM1423 was detected is described hereinabove with reference to FIGS. 1-8.

VGAM1423 gene, herein designated VGAM GENE, is a viral gene contained in the genome of Hepatitis GB Virus A. VGAM1423 host target gene, herein designated VGAM HOST TARGET GENE, is a human gene contained in the human genome.

VGAM1423 gene encodes a VGAM1423 precursor RNA, herein designated VGAM PRECURSOR RNA. Similar to other miRNA genes, and unlike most ordinary genes, VGAM1423 precursor RNA does not encode a protein. A nucleotide sequence identical or highly similar to the nucleotide sequence of VGAM1423 precursor RNA is designated SEQ ID:1409, and is provided hereinbelow with reference to the sequence listing part. Nucleotide sequence SEQ ID:1409 is located at position 8372 relative to the genome of Hepatitis GB Virus A.

VGAM1423 precursor RNA folds onto itself, forming VGAM1423 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1423 folded precursor RNA into VGAM1423 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1423 RNA is designated SEQ ID:4134, and is provided hereinbelow with reference to the sequence listing part.

VGAM1423 host target gene, herein designated VGAM HOST TARGET GENE, encodes a corresponding messenger RNA, VGAM1423 host target RNA, herein designated VGAM HOST TARGET RNA. VGAM1423 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1423 RNA, herein designated VGAM RNA, binds complementarily to one or more host target binding sites located in untranslated regions of VGAM1423 host target RNA, herein designated VGAM HOST TARGET RNA. This complementary binding is due to the fact that the nucleotide sequence of VGAM1423 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1423 RNA, herein designated VGAM RNA, may have a different number of host target binding sites in untranslated regions of a VGAM1423 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1423 RNA, herein designated VGAM RNA, to host target binding sites on VGAM1423 host target RNA, herein designated VGAM HOST TARGET RNA, such as BINDING SITE I, BINDING SITE II and BINDING SITE III, inhibits translation of VGAM1423 host target RNA into VGAM1423 host target protein, herein designated VGAM HOST TARGET PROTEIN. VGAM host target protein is therefore outlined by a broken line.

It is appreciated that VGAM1423 host target gene, herein designated VGAM HOST TARGET GENE, in fact represents a plurality of VGAM1423 host target genes. The mRNA of each one of this plurality of VGAM1423 host target genes comprises one or more host target binding sites, each having a nucleotide sequence which is at least partly complementary to VGAM1423 RNA, herein designated VGAM RNA, and which when bound by VGAM1423 RNA causes inhibition of translation of respective one or more VGAM1423 host target proteins.

It is further appreciated by one skilled in the art that the mode of translational inhibition illustrated by FIG. 1 with specific reference to translational inhibition exerted by VGAM1423 gene, herein designated VGAM GENE, on one or more VGAM1423 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1423 is inhibition of expression of host target genes, as part of a novel viral mechanism of attacking a host. Accordingly, utilities of VGAM1423 include diagnosis, prevention and treatment of viral infection by Hepatitis GB Virus A. Specific functions, and accordingly utilities, of VGAM1423 correlate with, and may be deduced from, the identity of the host target genes which VGAM1423 binds and inhibits, and the function of these host target genes, as elaborated hereinbelow.

Nucleotide sequences of the VGAM1423 precursor RNA, herein designated VGAM PRECURSOR RNA, and of the 'diced' VGAM1423 RNA, herein designated VGAM RNA, and a schematic representation of the secondary folding of VGAM1423 folded precursor RNA, herein designated VGAM FOLDED PRECURSOR RNA, of VGAM1423 are further described hereinbelow with reference to Table 1.

Nucleotide sequences of host target binding sites, such as BINDING SITE-I, BINDING SITE-II and BINDING SITE-III of FIG. 1, found on VGAM1423 host target RNA, and schematic representation of the complementarity of each of these host target binding sites to VGAM1423 RNA, herein designated VGAM RNA, are described hereinbelow with reference to Table 2.

As mentioned hereinabove with reference to FIG. 1, a function of VGAM1423 gene, herein designated VGAM is inhibition of expression of VGAM1423 target genes. It is appreciated that specific functions, and accordingly utilities, of VGAM1423 correlate with, and may be deduced from, the identity of the target genes which VGAM1423 binds and inhibits, and the function of these target genes, as elaborated hereinbelow.

Fibroblast Growth Factor 9 (glia-activating factor) (FGF9, Accession NM_002010) is a VGAM1423 host target gene. FGF9 BINDING SITE is HOST TARGET binding site found in the 3' untranslated region of mRNA encoded by FGF9, corresponding to a HOST TARGET binding site such as BINDING SITE I, BINDING SITE II or BINDING SITE III. Table 2 illustrates the complementarity of the nucleotide sequences of FGF9 BINDING SITE, designated SEQ ID:7752, to the nucleotide sequence of VGAM1423 RNA, herein designated VGAM RNA, also designated SEQ ID:4134.

A function of VGAM1423 is therefore inhibition of Fibroblast Growth Factor 9 (glia-activating factor) (FGF9, Accession NM_002010), a gene which Fibroblast growth factor 9 (glia-activating factor); secreted mitogen. Accordingly, utilities of VGAM1423 include diagnosis, prevention and treatment of diseases and clinical conditions associated with FGF9. The function of FGF9 and its association with various diseases and clinical conditions, has been established by previous studies, as described hereinabove with reference to VGAM864. Glypican 4 (GPC4, Accession NM_001448) is another VGAM1423 host target gene. GPC4 BINDING SITE is HOST TARGET binding site found in the 3' untranslated region of mRNA encoded by GPC4, corresponding to a HOST TARGET binding site such as BINDING SITE I, BINDING SITE II or BINDING SITE III. Table 2 illustrates the complementarity of the nucleotide sequences of GPC4 BINDING SITE, designated SEQ ID:7176, to the nucleotide sequence of VGAM1423 RNA, herein designated VGAM RNA, also designated SEQ ID:4134.

Another function of VGAM1423 is therefore inhibition of Glypican 4 (GPC4, Accession NM_001448), a gene which may play a role in growth control and cell division. Accordingly, utilities of VGAM1423 include diagnosis, prevention and treatment of diseases and clinical conditions associated with GPC4. The function of GPC4 and its association with various diseases and clinical conditions, has been established by previous studies, as described hereinabove with reference to VGAM538. Multiple Endocrine Neoplasia I (MEN1, Accession XM_167804) is another VGAM1423 host target gene. MEN1 BINDING SITE is HOST TARGET binding site found in the 5' untranslated region of mRNA encoded by MEN1, corresponding to a HOST TARGET binding site such as BINDING SITE I, BINDING SITE II or BINDING SITE III. Table 2 illustrates the complementarity of the nucleotide sequences of MEN1 BINDING SITE, designated SEQ ID:44842, to the nucleotide sequence of VGAM1423 RNA, herein designated VGAM RNA, also designated SEQ ID:4134.

Another function of VGAM1423 is therefore inhibition of Multiple Endocrine Neoplasia I (MEN1, Accession XM_167804). Accordingly, utilities of VGAM1423 include diagnosis, prevention and treatment of diseases and clinical conditions associated with MEN1. Molybdenum Cofactor Synthesis 2 (MOCS2, Accession NM_004531) is another VGAM1423 host target gene. MOCS2 BINDING SITE is HOST TARGET binding site found in the 5' untranslated region of mRNA encoded by MOCS2, corresponding to a HOST TARGET binding site such as BINDING SITE I, BINDING SITE II or BINDING SITE III. Table 2 illustrates the complementarity of the nucleotide sequences of MOCS2 BINDING SITE, designated SEQ ID:10874, to the nucleotide sequence of VGAM1423 RNA, herein designated VGAM RNA, also designated SEQ ID:4134.

Another function of VGAM1423 is therefore inhibition of Molybdenum Cofactor Synthesis 2 (MOCS2, Accession NM_004531). Accordingly, utilities of VGAM1423 include diagnosis, prevention and treatment of diseases and clinical conditions associated with MOCS2. Protein Kinase (cAMP-dependent, catalytic) Inhibitor Beta (PKIB, Accession NM_032471) is another VGAM1423 host target gene. PKIB BINDING SITE is HOST TARGET binding site found in the 3' untranslated region of mRNA encoded by PKIB, corresponding to a HOST TARGET binding site such as BINDING SITE I, BINDING SITE II or BINDING SITE III. Table 2 illustrates the complementarity of the nucleotide sequences of PKIB BINDING SITE, designated SEQ ID:26230, to the nucleotide sequence of VGAM1423 RNA, herein designated VGAM RNA, also designated SEQ ID:4134.

Another function of VGAM1423 is therefore inhibition of Protein Kinase (cAMP-dependent, catalytic) Inhibitor Beta (PKIB, Accession NM_032471). Accordingly, utilities of VGAM1423 include diagnosis, prevention and treatment of diseases and clinical conditions associated with PKIB. Presenilin 1 (Alzheimer disease 3) (PSEN1, Accession NM_007318) is another VGAM1423 host target gene. PSEN1 BINDING SITE1 and PSEN1 BINDING SITE2 are HOST TARGET binding sites found in untranslated regions of mRNA encoded by PSEN1, corresponding to HOST TARGET binding sites such as BINDING SITE I, BINDING SITE II or BINDING SITE III. Table 2 illustrates the complementarity of the nucleotide sequences of PSEN1 BINDING SITE1 and PSEN1 BINDING SITE2, designated SEQ ID:14235 and SEQ ID:5457 respectively, to the nucleotide sequence of VGAM1423 RNA, herein designated VGAM RNA, also designated SEQ ID:4134.

Another function of VGAM1423 is therefore inhibition of Presenilin 1 (Alzheimer disease 3) (PSEN1, Accession NM_007318). Accordingly, utilities of VGAM1423 include diagnosis, prevention and treatment of diseases and clinical conditions associated with PSEN1. Ubiquitin-conjugating Enzyme E2 Variant 1 (UBE2V1, Accession NM_003349) is another VGAM1423 host target gene. UBE2V1 BINDING SITE1 through UBE2V1 BINDING SITE3 are HOST TARGET binding sites found in untranslated regions of mRNA encoded by UBE2V1, corresponding to HOST TARGET binding sites such as BINDING SITE I, BINDING SITE II or BINDING SITE III. Table 2 illustrates the complementarity of the nucleotide sequences of UBE2V1 BINDING SITE1 through UBE2V1 BINDING SITE3, designated SEQ ID:9368, SEQ ID:22520 and SEQ ID:22767 respectively, to the nucleotide sequence of VGAM1423 RNA, herein designated VGAM RNA, also designated SEQ ID:4134.

Another function of VGAM1423 is therefore inhibition of Ubiquitin-conjugating Enzyme E2 Variant 1 (UBE2V1, Accession NM_003349), a gene which may play a role in signaling for DNA repair. Accordingly, utilities of VGAM1423 include diagnosis, prevention and treatment of diseases and clinical conditions associated with UBE2V1. The function of UBE2V1 and its association with various diseases and clinical conditions, has been established by previous studies, as described hereinabove with reference to VGAM155. FLJ12668 (Accession NM_024997) is another VGAM1423 host target gene. FLJ12668 BINDING SITE is HOST TARGET binding site found in the 3' untranslated region of mRNA encoded by FLJ12668, corresponding to a HOST TARGET binding site such as BINDING SITE I, BINDING SITE II or BINDING SITE III. Table 2 illustrates the complementarity of the nucleotide sequences of FLJ12668 BINDING SITE, designated SEQ ID:24559, to the nucleotide sequence of VGAM1423 RNA, herein designated VGAM RNA, also designated SEQ ID:4134.

Another function of VGAM1423 is therefore inhibition of FLJ12668 (Accession NM_024997). Accordingly, utilities of VGAM1423 include diagnosis, prevention and treatment of diseases and clinical conditions associated with FLJ12668. FLJ21916 (Accession NM_023112) is another VGAM1423 host target gene. FLJ21916 BINDING SITE is HOST TARGET binding site found in the 3' untranslated region of mRNA encoded by FLJ21916, corresponding to a HOST TARGET binding site such as BINDING SITE I, BINDING SITE II or BINDING SITE III. Table 2 illustrates the complementarity of the nucleotide sequences of FLJ21916 BINDING SITE, designated SEQ ID:23386, to the nucleotide sequence of VGAM1423 RNA, herein designated VGAM RNA, also designated SEQ ID:4134.

Another function of VGAM1423 is therefore inhibition of FLJ21916 (Accession NM_023112). Accordingly, utilities of VGAM1423 include diagnosis, prevention and treatment of diseases and clinical conditions associated with FLJ21916. FLJ22127 (Accession NM_022775) is another VGAM1423 host target gene. FLJ22127 BINDING SITE is HOST TARGET binding site found in the 3' untranslated region of mRNA encoded by FLJ22127, corresponding to a HOST TARGET binding site such as BINDING SITE I, BINDING SITE II or BINDING SITE III. Table 2 illustrates the complementarity of the nucleotide sequences of FLJ22127 BINDING SITE, designated SEQ ID:23043, to the nucleotide sequence of VGAM1423 RNA, herein designated VGAM RNA, also designated SEQ ID:4134.

Another function of VGAM1423 is therefore inhibition of FLJ22127 (Accession NM_022775). Accordingly, utilities of VGAM1423 include diagnosis, prevention and treatment of diseases and clinical conditions associated with FLJ22127. FLJ22794 (Accession XM_166220) is another VGAM1423 host target gene. FLJ22794 BINDING SITE is HOST TARGET binding site found in the 5' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44033, to the nucleotide sequence of VGAM1423 RNA, herein designated VGAM RNA, also designated SEQ ID:4134.

Another function of VGAM1423 is therefore inhibition of FLJ22794 (Accession XM_166220). Accordingly, utilities of VGAM1423 include diagnosis, prevention and treatment of diseases and clinical conditions associated with FLJ22794. KIAA0493 (Accession XM_034717) is another VGAM1423 host target gene. KIAA0493 BINDING SITE is HOST TARGET binding site found in the 3' untranslated region of mRNA encoded by KIAA0493, corresponding to a HOST TARGET binding site such as BINDING SITE I, BINDING SITE II or BINDING SITE III. Table 2 illustrates the complementarity of the nucleotide sequences of KIAA0493 BINDING SITE, designated SEQ ID:32140, to the nucleotide sequence of VGAM1423 RNA, herein designated VGAM RNA, also designated SEQ ID:4134.

Another function of VGAM1423 is therefore inhibition of KIAA0493 (Accession XM_034717). Accordingly, utilities of VGAM1423 include diagnosis, prevention and treatment of diseases and clinical conditions associated with KIAA0493. KIAA0515 (Accession XM_033380) is another VGAM1423 host target gene. KIAA0515 BINDING SITE is HOST TARGET binding site found in the 3' untranslated region of mRNA encoded by KIAA0515, corresponding to a HOST TARGET binding site such as BINDING SITE I, BINDING SITE II or BINDING SITE III. Table 2 illustrates the complementarity of the nucleotide sequences of KIAA0515 BINDING SITE, designated SEQ ID:31929, to the nucleotide sequence of VGAM1423 RNA, herein designated VGAM RNA, also designated SEQ ID:4134.

Another function of VGAM1423 is therefore inhibition of KIAA0515 (Accession XM_033380). Accordingly, utilities of VGAM1423 include diagnosis, prevention and treatment of diseases and clinical conditions associated with KIAA0515. KIAA0795 (Accession NM_025010) is another VGAM1423 host target gene. KIAA0795 BINDING SITE is HOST TARGET binding site found in the 3' untranslated region of mRNA encoded by KIAA0795, corresponding to a HOST TARGET binding site such as BINDING SITE I, BINDING SITE II or BINDING SITE III. Table 2 illustrates the complementarity of the nucleotide sequences of KIAA0795 BINDING SITE, designated SEQ ID:24587, to the nucleotide sequence of VGAM1423 RNA, herein designated VGAM RNA, also designated SEQ ID:4134.

Another function of VGAM1423 is therefore inhibition of KIAA0795 (Accession NM_025010). Accordingly, utilities of VGAM1423 include diagnosis, prevention and treatment of diseases and clinical conditions associated with KIAA0795. KIAA0863 (Accession XM_170863) is another VGAM1423 host target gene. KIAA0863 BINDING SITE is HOST TARGET binding site found in the 3' untranslated region of mRNA encoded by KIAA0863, corresponding to a HOST TARGET binding site such as BINDING SITE I, BINDING SITE II or BINDING SITE III. Table 2 illustrates the complementarity of the nucleotide sequences of KIAA0863 BINDING SITE, designated SEQ ID:45635, to the nucleotide sequence of VGAM1423 RNA, herein designated VGAM RNA, also designated SEQ ID:4134.

Another function of VGAM1423 is therefore inhibition of KIAA0863 (Accession XM_170863). Accordingly, utilities of VGAM1423 include diagnosis, prevention and treatment of diseases and clinical conditions associated with KIAA0863. KIAA1068 (Accession NM_015332) is another VGAM1423 host target gene. KIAA1068 BINDING SITE is HOST TARGET binding site found in the 3' untranslated region of mRNA encoded by KIAA1068, corresponding to a HOST TARGET binding site such as BINDING SITE I, BINDING SITE II or BINDING SITE III. Table 2 illustrates the complementarity of the nucleotide sequences of KIAA1068 BINDING SITE, designated SEQ ID:17644, to the nucleotide sequence of VGAM1423 RNA, herein designated VGAM RNA, also designated SEQ ID:4134.

Another function of VGAM1423 is therefore inhibition of KIAA1068 (Accession NM_015332). Accordingly, utilities of VGAM1423 include diagnosis, prevention and treatment of diseases and clinical conditions associated with KIAA1068. KIAA1332 (Accession XM_048774) is another VGAM1423 host target gene. KIAA1332 BINDING SITE is HOST TARGET binding site found in the 3' untranslated region of mRNA encoded by KIAA1332, corresponding to a HOST TARGET binding site such as BINDING SITE I, BINDING SITE II or BINDING SITE III. Table 2 illustrates the complementarity of the nucleotide sequences of KIAA1332 BINDING SITE, designated SEQ ID:35259, to the nucleotide sequence of VGAM1423 RNA, herein designated VGAM RNA, also designated SEQ ID:4134.

Another function of VGAM1423 is therefore inhibition of KIAA1332 (Accession XM_048774). Accordingly, utilities of VGAM1423 include diagnosis, prevention and treatment of diseases and clinical conditions associated with KIAA1332. KIAA1545 (Accession XM_027220) is another VGAM1423 host target gene. KIAA1545 BINDING SITE is HOST TARGET binding site found in the 3' untranslated region of mRNA encoded by KIAA1545, corresponding to a HOST TARGET binding site such as BINDING SITE I, BINDING SITE II or BINDING SITE III. Table 2 illustrates the complementarity of the nucleotide sequences of KIAA1545 BINDING SITE, designated SEQ ID:30442, to the nucleotide sequence of VGAM1423 RNA, herein designated VGAM RNA, also designated SEQ ID:4134.

Another function of VGAM1423 is therefore inhibition of KIAA1545 (Accession XM_027220). Accordingly, utilities of VGAM1423 include diagnosis, prevention and treatment of diseases and clinical conditions associated with KIAA1545. MGC16386 (Accession NM_080668) is another VGAM1423 host target gene. MGC16386 BINDING SITE is HOST TARGET binding site found in the 3' untranslated region of mRNA encoded by MGC16386, corresponding to a HOST TARGET binding site such as BINDING SITE I, BINDING SITE II or BINDING SITE III. Table 2 illustrates the complementarity of the nucleotide sequences of MGC16386 BINDING SITE, designated SEQ ID:27959, to the nucleotide sequence of VGAM1423 RNA, herein designated VGAM RNA, also designated SEQ ID:4134.

Another function of VGAM1423 is therefore inhibition of MGC16386 (Accession NM_080668). Accordingly, utilities of VGAM1423 include diagnosis, prevention and treatment of diseases and clinical conditions associated with MGC16386. MGC2560 (Accession NM_031452) is another VGAM1423 host target gene. MGC2560 BINDING SITE is HOST TARGET binding site found in the 3' untranslated region of mRNA encoded by MGC2560, corresponding to a HOST TARGET binding site such as BINDING SITE I, BINDING SITE II or BINDING SITE III. Table 2 illustrates the complementarity of the nucleotide sequences of MGC2560 BINDING SITE, designated SEQ ID:25467, to the nucleotide sequence of VGAM1423 RNA, herein designated VGAM RNA, also designated SEQ ID:4134.

Another function of VGAM1423 is therefore inhibition of MGC2560 (Accession NM_031452). Accordingly, utilities of VGAM1423 include diagnosis, prevention and treatment of diseases and clinical conditions associated with MGC2560. LOC127602 (Accession XM_059166) is another VGAM1423 host target gene. LOC127602 BINDING SITE is HOST TARGET binding site found in the 5' untranslated region of mRNA encoded by LOC127602, corresponding to a HOST TARGET binding site such as BINDING SITE I, BINDING SITE II or BINDING SITE III. Table 2 illustrates the complementarity of the nucleotide sequences of LOC127602 BINDING SITE, designated SEQ ID:36904, to the nucleotide sequence of VGAM1423 RNA, herein designated VGAM RNA, also designated SEQ ID:4134.

Another function of VGAM1423 is therefore inhibition of LOC127602 (Accession XM_059166). Accordingly, utilities of VGAM1423 include diagnosis, prevention and treatment of diseases and clinical conditions associated with LOC127602. LOC149606 (Accession XM_086600) is another VGAM1423 host target gene. LOC149606 BINDING SITE is HOST TARGET binding site found in the 3' untranslated region of mRNA encoded by LOC149606, corresponding to a HOST TARGET binding site such as BINDING SITE I, BINDING SITE II or BINDING SITE III. Table 2 illustrates the complementarity of the nucleotide sequences of LOC149606 BINDING SITE, designated SEQ ID:38786, to the nucleotide sequence of VGAM1423 RNA, herein designated VGAM RNA, also designated SEQ ID:4134.

Another function of VGAM1423 is therefore inhibition of LOC149606 (Accession XM_086600). Accordingly, utilities of VGAM1423 include diagnosis, prevention and treatment of diseases and clinical conditions associated with LOC149606. LOC149837 (Accession XM_097747) is another VGAM1423 host target gene. LOC149837 BINDING SITE is HOST TARGET binding site found in the 3' untranslated region of mRNA encoded by LOC149837, corresponding to a HOST TARGET binding site such as BINDING SITE I, BINDING SITE II or BINDING SITE III. Table 2 illustrates the complementarity of the nucleotide sequences of LOC149837 BINDING SITE, designated SEQ ID:41099, to the nucleotide sequence of VGAM1423 RNA, herein designated VGAM RNA, also designated SEQ ID:4134.

Another function of VGAM1423 is therefore inhibition of LOC149837 (Accession XM_097747). Accordingly, utilities of VGAM1423 include diagnosis, prevention and treatment of diseases and clinical conditions associated with LOC149837. LOC199692 (Accession NM_145295) is another VGAM1423 host target gene. LOC199692 BINDING SITE is HOST TARGET binding site found in the 3' untranslated region of mRNA encoded by LOC199692, corresponding to a HOST TARGET binding site such as BINDING SITE I, BINDING SITE II or BINDING SITE III. Table 2 illustrates the complementarity of the nucleotide sequences of LOC199692 BINDING SITE, designated SEQ ID:29811, to the nucleotide sequence of VGAM1423 RNA, herein designated VGAM RNA, also designated SEQ ID:4134.

Another function of VGAM1423 is therefore inhibition of LOC199692 (Accession NM_145295). Accordingly, utilities of VGAM1423 include diagnosis, prevention and treatment of diseases and clinical conditions associated with LOC199692. LOC202934 (Accession XM_117486) is another VGAM1423 host target gene. LOC202934 BINDING SITE is HOST TARGET binding site found in the 3' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43458, to the nucleotide sequence of VGAM1423 RNA, herein designated VGAM RNA, also designated SEQ ID:4134.

Another function of VGAM1423 is therefore inhibition of LOC202934 (Accession XM_117486). Accordingly, utilities of VGAM1423 include diagnosis, prevention and treatment of diseases and clinical conditions associated with LOC202934. LOC255465 (Accession XM_173206) is another VGAM1423 host target gene. LOC255465 BINDING SITE is HOST TARGET binding site found in the 3' untranslated region of mRNA encoded by LOC255465, corresponding to a HOST TARGET binding site such as BINDING SITE I, BINDING SITE II or BINDING SITE III. Table 2 illustrates the complementarity of the nucleotide sequences of LOC255465 BINDING SITE, designated SEQ ID:46451, to the nucleotide sequence of VGAM1423 RNA, herein designated VGAM RNA, also designated SEQ ID:4134.

Another function of VGAM1423 is therefore inhibition of LOC255465 (Accession XM_173206). Accordingly, utilities of VGAM1423 include diagnosis, prevention and treatment of diseases and clinical conditions associated with LOC255465. LOC257286 (Accession XM_170549) is another VGAM1423 host target gene. LOC257286 BINDING SITE is HOST TARGET binding site found in the 3' untranslated region of mRNA encoded by LOC257286, corresponding to a HOST TARGET binding site such as BINDING SITE I, BINDING SITE II or BINDING SITE III. Table 2 illustrates the complementarity of the nucleotide sequences of LOC257286 BINDING SITE, designated SEQ ID:45373, to the nucleotide sequence of VGAM1423 RNA, herein designated VGAM RNA, also designated SEQ ID:4134.

Another function of VGAM1423 is therefore inhibition of LOC257286 (Accession XM_170549). Accordingly, utilities of VGAM1423 include diagnosis, prevention and treatment of diseases and clinical conditions associated with LOC257286. LOC90979 (Accession XM_035323) is another VGAM1423 host target gene. LOC90979 BINDING SITE is HOST TARGET binding site found in the 3' untranslated region of mRNA encoded by LOC90979, corresponding to a HOST TARGET binding site such as BINDING SITE I, BINDING SITE II or BINDING SITE III. Table 2 illustrates the complementarity of the nucleotide sequences of LOC90979 BINDING SITE, designated SEQ ID:32233, to the nucleotide sequence of VGAM1423 RNA, herein designated VGAM RNA, also designated SEQ ID:4134.

Another function of VGAM1423 is therefore inhibition of LOC90979 (Accession XM_035323). Accordingly, utilities of VGAM1423 include diagnosis, prevention and treatment of diseases and clinical conditions associated with LOC90979. FIG. 1 further provides a conceptual description of a novel bioinformatically detected viral gene of the present invention, referred to here as Viral Genomic Address Messenger 1424 (VGAM1424) viral gene, which modulates expression of respective host target genes thereof, the function and utility of which host target genes is known in the art.

VGAM1424 is a novel bioinformatically detected regulatory, non protein coding, viral micro RNA (miRNA) gene. The method by which VGAM1424 was detected is described hereinabove with reference to FIGS. 1-8.

VGAM1424 gene, herein designated VGAM GENE, is a viral gene contained in the genome of Clover Yellow Vein Virus. VGAM1424 host target gene, herein designated VGAM HOST TARGET GENE, is a human gene contained in the human genome.

VGAM1424 gene encodes a VGAM1424 precursor RNA, herein designated VGAM PRECURSOR RNA. Similar to other miRNA genes, and unlike most ordinary genes, VGAM1424 precursor RNA does not encode a protein. A nucleotide sequence identical or highly similar to the nucleotide sequence of VGAM1424 precursor RNA is designated SEQ ID:1410, and is provided hereinbelow with reference to the sequence listing part. Nucleotide sequence SEQ ID:1410 is located at position 1464 relative to the genome of Clover Yellow Vein Virus.

VGAM1424 precursor RNA folds onto itself, forming VGAM1424 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1424 folded precursor RNA into VGAM1424 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1424 RNA is designated SEQ ID:4135, and is provided hereinbelow with reference to the sequence listing part.

VGAM1424 host target gene, herein designated VGAM HOST TARGET GENE, encodes a corresponding messenger RNA, VGAM1424 host target RNA, herein designated VGAM HOST TARGET RNA. VGAM1424 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1424 RNA, herein designated VGAM RNA, binds complementarily to one or more host target binding sites located in untranslated regions of VGAM1424 host target RNA, herein designated VGAM HOST TARGET RNA. This complementary binding is due to the fact that the nucleotide sequence of VGAM1424 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1424 RNA, herein designated VGAM RNA, may have a different number of host target binding sites in untranslated regions of a VGAM1424 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1424 RNA, herein designated VGAM RNA, to host target binding sites on VGAM1424 host target RNA, herein designated VGAM HOST TARGET RNA, such as BINDING SITE I, BINDING SITE II and BINDING SITE III, inhibits translation of VGAM1424 host target RNA into VGAM1424 host target protein, herein designated VGAM HOST TARGET PROTEIN. VGAM host target protein is therefore outlined by a broken line.

It is appreciated that VGAM1424 host target gene, herein designated VGAM HOST TARGET GENE, in fact represents a plurality of VGAM1424 host target genes. The mRNA of each one of this plurality of VGAM1424 host target genes comprises one or more host target binding sites, each having a nucleotide sequence which is at least partly complementary to VGAM1424 RNA, herein designated VGAM RNA, and which when bound by VGAM1424 RNA causes inhibition of translation of respective one or more VGAM1424 host target proteins.

It is further appreciated by one skilled in the art that the mode of translational inhibition illustrated by FIG. 1 with specific reference to translational inhibition exerted by VGAM1424 gene, herein designated VGAM GENE, on one or more VGAM1424 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1424 is inhibition of expression of host target genes, as part of a novel viral mechanism of attacking a host. Accordingly, utilities of VGAM1424 include diagnosis, prevention and treatment of viral infection by Clover Yellow Vein Virus. Specific functions, and accordingly utilities, of VGAM1424 correlate with, and may be deduced from, the identity of the host target genes which VGAM1424 binds and inhibits, and the function of these host target genes, as elaborated hereinbelow.

Nucleotide sequences of the VGAM1424 precursor RNA, herein designated VGAM PRECURSOR RNA, and of the 'diced' VGAM1424 RNA, herein designated VGAM RNA, and a schematic representation of the secondary folding of VGAM1424 folded precursor RNA, herein designated VGAM FOLDED PRECURSOR RNA, of VGAM1424 are further described hereinbelow with reference to Table 1.

Nucleotide sequences of host target binding sites, such as BINDING SITE-I, BINDING SITE-II and BINDING SITE-III of FIG. 1, found on VGAM1424 host target RNA, and schematic representation of the complementarity of each of these host target binding sites to VGAM1424 RNA, herein designated VGAM RNA, are described hereinbelow with reference to Table 2.

As mentioned hereinabove with reference to FIG. 1, a function of VGAM1424 gene, herein designated VGAM is inhibition of expression of VGAM1424 target genes. It is appreciated that specific functions, and accordingly utilities, of VGAM1424 correlate with, and may be deduced from, the identity of the target genes which VGAM1424 binds and inhibits, and the function of these target genes, as elaborated hereinbelow.

Syndecan 2 (heparan sulfate proteoglycan 1, cell surface-associated, fibroglycan) (SDC2, Accession XM_040582) is a VGAM1424 host target gene. SDC2 BINDING SITE is HOST TARGET binding site found in the 3' untranslated region of mRNA encoded by SDC2, corresponding to a HOST TARGET binding site such as BINDING SITE I, BINDING SITE II or BINDING SITE III. Table 2 illustrates the complementarity of the nucleotide sequences of SDC2 BINDING SITE, designated SEQ ID:33326, to the nucleotide sequence of VGAM1424 RNA, herein designated VGAM RNA, also designated SEQ ID:4135.

A function of VGAM1424 is therefore inhibition of Syndecan 2 (heparan sulfate proteoglycan 1, cell surface-associated, fibroglycan) (SDC2, Accession XM_040582). Accordingly, utilities of VGAM1424 include diagnosis, prevention and treatment of diseases and clinical conditions associated with SDC2. KIAA0171 (Accession NM_014666) is another VGAM1424 host target gene. KIAA0171 BINDING SITE is HOST TARGET binding site found in the 3' untranslated region of mRNA encoded by KIAA0171, corresponding to a HOST TARGET binding site such as BINDING SITE I, BINDING SITE II or BINDING SITE III. Table 2 illustrates the complementarity of the nucleotide sequences of KIAA0171 BINDING SITE, designated SEQ ID:16121, to the nucleotide sequence of VGAM1424 RNA, herein designated VGAM RNA, also designated SEQ ID:4135.

Another function of VGAM1424 is therefore inhibition of KIAA0171 (Accession NM_014666). Accordingly, utilities of VGAM1424 include diagnosis, prevention and treatment of diseases and clinical conditions associated with KIAA0171. MOST2 (Accession NM_020250) is another VGAM1424 host target gene. MOST2 BINDING SITE is HOST TARGET binding site found in the 5' untranslated region of mRNA encoded by MOST2, corresponding to a HOST TARGET binding site such as BINDING SITE I, BINDING SITE II or BINDING SITE III. Table 2 illustrates the complementarity of the nucleotide sequences of MOST2 BINDING SITE, designated SEQ ID:21548, to the nucleotide sequence of VGAM1424 RNA, herein designated VGAM RNA, also designated SEQ ID:4135.

Another function of VGAM1424 is therefore inhibition of MOST2 (Accession NM_020250). Accordingly, utilities of VGAM1424 include diagnosis, prevention and treatment of diseases and clinical conditions associated with MOST2. Ubiquitin Specific Protease 8 (USP8, Accession NM_005154) is another VGAM1424 host target gene. USP8 BINDING SITE is HOST TARGET binding site found in the 3' untranslated region of mRNA encoded by USP8, corresponding to a HOST TARGET binding site such as BINDING SITE I, BINDING SITE II or BINDING SITE III. Table 2 illustrates the complementarity of the nucleotide sequences of USP8 BINDING SITE, designated SEQ ID:11629, to the nucleotide sequence of VGAM1424 RNA, herein designated VGAM RNA, also designated SEQ ID:4135.

Another function of VGAM1424 is therefore inhibition of Ubiquitin Specific Protease 8 (USP8, Accession NM_005154). Accordingly, utilities of VGAM1424 include diagnosis, prevention and treatment of diseases and clinical conditions associated with USP8. Zinc Finger, DHHC Domain Containing 2 (ZDHHC2, Accession NM_016353) is another VGAM1424 host target gene. ZDHHC2 BINDING SITE is HOST TARGET binding site found in the 3' untranslated region of mRNA encoded by ZDHHC2, corresponding to a HOST TARGET binding site such as BINDING SITE I, BINDING SITE II or BINDING SITE III. Table 2 illustrates the complementarity of the nucleotide sequences of ZDHHC2 BINDING SITE, designated SEQ ID:18486, to the nucleotide sequence of VGAM1424 RNA, herein designated VGAM RNA, also designated SEQ ID:4135.

Another function of VGAM1424 is therefore inhibition of Zinc Finger, DHHC Domain Containing 2 (ZDHHC2, Accession NM_016353). Accordingly, utilities of VGAM1424 include diagnosis, prevention and treatment of diseases and clinical conditions associated with ZDHHC2. LOC220071 (Accession XM_167848) is another VGAM1424 host target gene. LOC220071 BINDING SITE is HOST TARGET binding site found in the 5' untranslated region of mRNA encoded by LOC220071, corresponding to a HOST TARGET binding site such as BINDING SITE I, BINDING SITE II or BINDING SITE III. Table 2 illustrates the complementarity of the nucleotide sequences of LOC220071 BINDING SITE, designated SEQ ID:44877, to the nucleotide sequence of VGAM1424 RNA, herein designated VGAM RNA, also designated SEQ ID:4135.

Another function of VGAM1424 is therefore inhibition of LOC220071 (Accession XM_167848). Accordingly, utilities of VGAM1424 include diagnosis, prevention and treatment of diseases and clinical conditions associated with LOC220071. FIG. 1 further provides a conceptual description of a novel bioinformatically detected viral gene of the present invention, referred to here as Viral Genomic Address Messenger 1425 (VGAM1425) viral gene, which modulates expression of respective host target genes thereof, the function and utility of which host target genes is known in the art.

VGAM1425 is a novel bioinformatically detected regulatory, non protein coding, viral micro RNA (miRNA) gene. The method by which VGAM1425 was detected is described hereinabove with reference to FIGS. 1-8.

VGAM1425 gene, herein designated VGAM GENE, is a viral gene contained in the genome of Clover Yellow Vein Virus. VGAM1425 host target gene, herein designated VGAM HOST TARGET GENE, is a human gene contained in the human genome.

VGAM1425 gene encodes a VGAM1425 precursor RNA, herein designated VGAM PRECURSOR RNA. Similar to other miRNA genes, and unlike most ordinary genes, VGAM1425 precursor RNA does not encode a protein. A nucleotide sequence identical or highly similar to the nucleotide sequence of VGAM1425 precursor RNA is designated SEQ ID:1411, and is provided hereinbelow with reference to the sequence listing part. Nucleotide sequence SEQ ID:1411 is located at position 767 relative to the genome of Clover Yellow Vein Virus.

VGAM1425 precursor RNA folds onto itself, forming VGAM1425 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1425 folded precursor RNA into VGAM1425 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1425 RNA is designated SEQ ID:4136, and is provided hereinbelow with reference to the sequence listing part.

VGAM1425 host target gene, herein designated VGAM HOST TARGET GENE, encodes a corresponding messenger RNA, VGAM1425 host target RNA, herein designated VGAM HOST TARGET RNA. VGAM1425 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1425 RNA, herein designated VGAM RNA, binds complementarily to one or more host target binding sites located in untranslated regions of VGAM1425 host target RNA, herein designated VGAM HOST TARGET RNA. This complementary binding is due to the fact that the nucleotide sequence of VGAM1425 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1425 RNA, herein designated VGAM RNA, may have a different number of host target binding sites in untranslated regions of a VGAM1425 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1425 RNA, herein designated VGAM RNA, to host target binding sites on VGAM1425 host target RNA, herein designated VGAM HOST TARGET RNA, such as BINDING SITE I, BINDING SITE II and BINDING SITE III, inhibits translation of VGAM1425 host target RNA into VGAM1425 host target protein, herein designated VGAM HOST TARGET PROTEIN. VGAM host target protein is therefore outlined by a broken line.

It is appreciated that VGAM1425 host target gene, herein designated VGAM HOST TARGET GENE, in fact represents a plurality of VGAM1425 host target genes. The mRNA of each one of this plurality of VGAM1425 host target genes comprises one or more host target binding sites, each having a nucleotide sequence which is at least partly complementary to VGAM1425 RNA, herein designated VGAM RNA, and which when bound by VGAM1425 RNA causes inhibition of translation of respective one or more VGAM1425 host target proteins.

It is further appreciated by one skilled in the art that the mode of translational inhibition illustrated by FIG. 1 with specific reference to translational inhibition exerted by VGAM1425 gene, herein designated VGAM GENE, on one or more VGAM1425 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1425 is inhibition of expression of host target genes, as part of a novel viral mechanism of attacking a host. Accordingly, utilities of VGAM1425 include diagnosis, prevention and treatment of viral infection by Clover Yellow Vein Virus. Specific functions, and accordingly utilities, of VGAM1425 correlate with, and may be deduced from, the identity of the host target genes which VGAM1425 binds and inhibits, and the function of these host target genes, as elaborated hereinbelow.

Nucleotide sequences of the VGAM1425 precursor RNA, herein designated VGAM PRECURSOR RNA, and of the 'diced' VGAM1425 RNA, herein designated VGAM RNA, and a schematic representation of the secondary folding of VGAM1425 folded precursor RNA, herein designated VGAM FOLDED PRECURSOR RNA, of VGAM1425 are further described hereinbelow with reference to Table 1.

Nucleotide sequences of host target binding sites, such as BINDING SITE-I, BINDING SITE-II and BINDING SITE-III of FIG. 1, found on VGAM1425 host target RNA, and schematic representation of the complementarity of each of these host target binding sites to VGAM1425 RNA, herein designated VGAM RNA, are described hereinbelow with reference to Table 2.

As mentioned hereinabove with reference to FIG. 1, a function of VGAM1425 gene, herein designated VGAM is inhibition of expression of VGAM1425 target genes. It is appreciated that specific functions, and accordingly utilities, of VGAM1425 correlate with, and may be deduced from, the identity of the target genes which VGAM1425 binds and inhibits, and the function of these target genes, as elaborated hereinbelow.

Disrupted In Schizophrenia 1 (DISC1, Accession NM_018662) is a VGAM1425 host target gene. DISC1 BINDING SITE is HOST TARGET binding site found in the 3' untranslated region of mRNA encoded by DISC1, corresponding to a HOST TARGET binding site such as BINDING SITE I, BINDING SITE II or BINDING SITE III. Table 2 illustrates the complementarity of the nucleotide sequences of DISC1 BINDING SITE, designated SEQ ID:20734, to the nucleotide sequence of VGAM1425 RNA, herein designated VGAM RNA, also designated SEQ ID:4136.

A function of VGAM1425 is therefore inhibition of Disrupted In Schizophrenia 1 (DISC1, Accession NM_018662), a gene which has globular N-terminal domain(s) and a helical C-terminal domain. Accordingly, utilities of VGAM1425 include diagnosis, prevention and treatment of diseases and clinical conditions associated with DISC1. The function of DISC1 and its association with various diseases and clinical conditions, has been established by previous studies, as described hereinabove with reference to VGAM74. Vascular Cell Adhesion Molecule 1 (VCAM1, Accession NM_001078) is another VGAM1425 host target gene. VCAM1 BINDING SITE1 and VCAM1 BINDING SITE2 are HOST TARGET binding sites found in untranslated regions of mRNA encoded by VCAM1, corresponding to HOST TARGET binding sites such as BINDING SITE I, BINDING SITE II or BINDING SITE III. Table 2 illustrates the complementarity of the nucleotide sequences of VCAM1 BINDING SITE1 and VCAM1 BINDING SITE2, designated SEQ ID:6737 and SEQ ID:27983 respectively, to the nucleotide sequence of VGAM1425 RNA, herein designated VGAM RNA, also designated SEQ ID:4136.

Another function of VGAM1425 is therefore inhibition of Vascular Cell Adhesion Molecule 1 (VCAM1, Accession NM_001078). Accordingly, utilities of VGAM1425 include diagnosis, prevention and treatment of diseases and clinical conditions associated with VCAM1. FLJ10852 (Accession NM_019028) is another VGAM1425 host target gene. FLJ10852 BINDING SITE is HOST TARGET binding site found in the 3' untranslated region of mRNA encoded by FLJ10852, corresponding to a HOST TARGET binding site such as BINDING SITE I, BINDING SITE II or BINDING SITE III. Table 2 illustrates the complementarity of the nucleotide sequences of FLJ10852 BINDING SITE, designated SEQ ID:21117, to the nucleotide sequence of VGAM1425 RNA, herein designated VGAM RNA, also designated SEQ ID:4136.

Another function of VGAM1425 is therefore inhibition of FLJ10852 (Accession NM_019028). Accordingly, utilities of VGAM1425 include diagnosis, prevention and treatment of diseases and clinical conditions associated with FLJ10852. MGC4643 (Accession NM_032715) is another VGAM1425 host target gene. MGC4643 BINDING SITE is HOST TARGET binding site found in the 3' untranslated region of mRNA encoded by MGC4643, corresponding to a HOST TARGET binding site such as BINDING SITE I, BINDING SITE II or BINDING SITE III. Table 2 illustrates the complementarity of the nucleotide sequences of MGC4643 BINDING SITE, designated SEQ ID:26438, to the nucleotide sequence of VGAM1425 RNA, herein designated VGAM RNA, also designated SEQ ID:4136.

Another function of VGAM1425 is therefore inhibition of MGC4643 (Accession NM_032715). Accordingly, utilities of VGAM1425 include diagnosis, prevention and treatment of diseases and clinical conditions associated with MGC4643. p25 (Accession NM_007030) is another VGAM1425 host target gene. p25 BINDING SITE is HOST TARGET binding site found in the 3' untranslated region of mRNA encoded by p25, corresponding to a HOST TARGET binding site such as BINDING SITE I, BINDING SITE II or BINDING SITE III. Table 2 illustrates the complementarity of the nucleotide sequences of p25 BINDING SITE, designated SEQ ID:13890, to the nucleotide sequence of VGAM1425 RNA, herein designated VGAM RNA, also designated SEQ ID:4136.

Another function of VGAM1425 is therefore inhibition of p25 (Accession NM_007030). Accordingly, utilities of VGAM1425 include diagnosis, prevention and treatment of diseases and clinical conditions associated with p25. FIG. 1 further provides a conceptual description of a novel bioinformatically detected viral gene of the present invention, referred to here as Viral Genomic Address Messenger 1426 (VGAM1426) viral gene, which modulates expression of respective host target genes thereof, the function and utility of which host target genes is known in the art.

VGAM1426 is a novel bioinformatically detected regulatory, non protein coding, viral micro RNA (miRNA) gene. The method by which VGAM1426 was detected is described hereinabove with reference to FIGS. 1-8.

VGAM1426 gene, herein designated VGAM GENE, is a viral gene contained in the genome of Clover Yellow Vein Virus. VGAM1426 host target gene, herein designated VGAM HOST TARGET GENE, is a human gene contained in the human genome.

VGAM1426 gene encodes a VGAM1426 precursor RNA, herein designated VGAM PRECURSOR RNA. Similar to other miRNA genes, and unlike most ordinary genes, VGAM1426 precursor RNA does not encode a protein. A nucleotide sequence identical or highly similar to the nucleotide sequence of VGAM1426 precursor RNA is designated SEQ ID:1412, and is provided hereinbelow with reference to the sequence listing part. Nucleotide sequence SEQ ID:1412 is located at position 8366 relative to the genome of Clover Yellow Vein Virus.

VGAM1426 precursor RNA folds onto itself, forming VGAM1426 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1426 folded precursor RNA into VGAM1426 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1426 RNA is designated SEQ ID:4137, and is provided hereinbelow with reference to the sequence listing part.

VGAM1426 host target gene, herein designated VGAM HOST TARGET GENE, encodes a corresponding messenger RNA, VGAM1426 host target RNA, herein designated VGAM HOST TARGET RNA. VGAM1426 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1426 RNA, herein designated VGAM RNA, binds complementarily to one or more host target binding sites located in untranslated regions of VGAM1426 host target RNA, herein designated VGAM HOST TARGET RNA. This complementary binding is due to the fact that the nucleotide sequence of VGAM1426 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1426 RNA, herein designated VGAM RNA, may have a different number of host target binding sites in untranslated regions of a VGAM1426 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1426 RNA, herein designated VGAM RNA, to host target binding sites on VGAM1426 host target RNA, herein designated VGAM HOST TARGET RNA, such as BINDING SITE I, BINDING SITE II and BINDING SITE III, inhibits translation of VGAM1426 host target RNA into VGAM1426 host target protein, herein designated VGAM HOST TARGET PROTEIN. VGAM host target protein is therefore outlined by a broken line.

It is appreciated that VGAM1426 host target gene, herein designated VGAM HOST TARGET GENE, in fact represents a plurality of VGAM1426 host target genes. The mRNA of each one of this plurality of VGAM1426 host target genes comprises one or more host target binding sites, each having a nucleotide sequence which is at least partly complementary to VGAM1426 RNA, herein designated VGAM RNA, and which when bound by VGAM1426 RNA causes inhibition of translation of respective one or more VGAM1426 host target proteins.

It is further appreciated by one skilled in the art that the mode of translational inhibition illustrated by FIG. 1 with specific reference to translational inhibition exerted by VGAM1426 gene, herein designated VGAM GENE, on one or more VGAM1426 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1426 is inhibition of expression of host target genes, as part of a novel viral mechanism of attacking a host. Accordingly, utilities of VGAM1426 include diagnosis, prevention and treatment of viral infection by Clover Yellow Vein Virus. Specific functions, and accordingly utilities, of VGAM1426 correlate with, and may be deduced from, the identity of the host target genes which VGAM1426 binds and inhibits, and the function of these host target genes, as elaborated hereinbelow.

Nucleotide sequences of the VGAM1426 precursor RNA, herein designated VGAM PRECURSOR RNA, and of the 'diced' VGAM1426 RNA, herein designated VGAM RNA, and a schematic representation of the secondary folding of VGAM1426 folded precursor RNA, herein designated VGAM FOLDED PRECURSOR RNA, of VGAM1426 are further described hereinbelow with reference to Table 1.

Nucleotide sequences of host target binding sites, such as BINDING SITE-I, BINDING SITE-II and BINDING SITE-III of FIG. 1, found on VGAM1426 host target RNA, and schematic representation of the complementarity of each of these host target binding sites to VGAM1426 RNA, herein designated VGAM RNA, are described hereinbelow with reference to Table 2.

As mentioned hereinabove with reference to FIG. 1, a function of VGAM1426 gene, herein designated VGAM is inhibition of expression of VGAM1426 target genes. It is appreciated that specific functions, and accordingly utilities, of VGAM1426 correlate with, and may be deduced from, the identity of the target genes which VGAM1426 binds and inhibits, and the function of these target genes, as elaborated hereinbelow.

Fibroblast Growth Factor Receptor 3 (achondroplasia, thanatophoric dwarfism) (FGFR3, Accession NM_000142) is a VGAM1426 host target gene. FGFR3 BINDING SITE is HOST TARGET binding site found in the 3' untranslated region of mRNA encoded by FGFR3, corresponding to a HOST TARGET binding site such as BINDING SITE I, BINDING SITE II or BINDING SITE III. Table 2 illustrates the complementarity of the nucleotide sequences of FGFR3 BINDING SITE, designated SEQ ID:5643, to the nucleotide sequence of VGAM1426 RNA, herein designated VGAM RNA, also designated SEQ ID:4137.

A function of VGAM1426 is therefore inhibition of Fibroblast Growth Factor Receptor 3 (achondroplasia, thanatophoric dwarfism) (FGFR3, Accession NM_000142). Accordingly, utilities of VGAM1426 include diagnosis, prevention and treatment of diseases and clinical conditions associated with FGFR3. Cyclin M4 (CNNM4, Accession NM_020184) is another VGAM1426 host target gene. CNNM4 BINDING SITE is HOST TARGET binding site found in the 3' untranslated region of mRNA encoded by CNNM4, corresponding to a HOST TARGET binding site such as BINDING SITE I, BINDING SITE II or BINDING SITE III. Table 2 illustrates the complementarity of the nucleotide sequences of CNNM4 BINDING SITE, designated SEQ ID:21422, to the nucleotide sequence of VGAM1426 RNA, herein designated VGAM RNA, also designated SEQ ID:4137.

Another function of VGAM1426 is therefore inhibition of Cyclin M4 (CNNM4, Accession NM_020184). Accordingly, utilities of VGAM1426 include diagnosis, prevention and treatment of diseases and clinical conditions associated with CNNM4. DKFZp434N035 (Accession NM_032262) is another VGAM1426 host target gene. DKFZp434N035 BINDING SITE is HOST TARGET binding site found in the 3' untranslated region of mRNA encoded by DKFZp434N035, corresponding to a HOST TARGET binding site such as BINDING SITE I, BINDING SITE II or BINDING SITE III. Table 2 illustrates the complementarity of the nucleotide sequences of DKFZp434N035 BINDING SITE, designated SEQ ID:26006, to the nucleotide sequence of VGAM1426 RNA, herein designated VGAM RNA, also designated SEQ ID:4137.

Another function of VGAM1426 is therefore inhibition of DKFZp434N035 (Accession NM_032262). Accordingly, utilities of VGAM1426 include diagnosis, prevention and treatment of diseases and clinical conditions associated with DKFZp434N035. MGC13138 (Accession NM_033410) is another VGAM1426 host target gene. MGC13138 BINDING SITE is HOST TARGET binding site found in the 3' untranslated region of mRNA encoded by MGC13138, corresponding to a HOST TARGET binding site such as BINDING SITE I, BINDING SITE II or BINDING SITE III. Table 2 illustrates the complementarity of the nucleotide sequences of MGC13138 BINDING SITE, designated SEQ ID:27232, to the nucleotide sequence of VGAM1426 RNA, herein designated VGAM RNA, also designated SEQ ID:4137.

Another function of VGAM1426 is therefore inhibition of MGC13138 (Accession NM_033410). Accordingly, utilities of VGAM1426 include diagnosis, prevention and treatment of diseases and clinical conditions associated with MGC13138. MIDORI (Accession XM_057651) is another VGAM1426 host target gene. MIDORI BINDING SITE is HOST TARGET binding site found in the 3' untranslated region of mRNA encoded by MIDORI, corresponding to a HOST TARGET binding site such as BINDING SITE I, BINDING SITE II or BINDING SITE III. Table 2 illustrates the complementarity of the nucleotide sequences of MIDORI BINDING SITE, designated SEQ ID:36530, to the nucleotide sequence of VGAM1426 RNA, herein designated VGAM RNA, also designated SEQ ID:4137.

Another function of VGAM1426 is therefore inhibition of MIDORI (Accession XM_057651). Accordingly, utilities of VGAM1426 include diagnosis, prevention and treatment of diseases and clinical conditions associated with MIDORI. Serine/threonine Kinase 29 (STK29, Accession XM_113646) is another VGAM1426 host target gene. STK29 BINDING SITE is HOST TARGET binding site found in the 3' untranslated region of mRNA encoded by STK29, corresponding to a HOST TARGET binding site such as BINDING SITE I, BINDING SITE II or BINDING SITE III. Table 2 illustrates the complementarity of the nucleotide sequences of STK29 BINDING SITE, designated SEQ ID:42319, to the nucleotide sequence of VGAM1426 RNA, herein designated VGAM RNA, also designated SEQ ID:4137.

Another function of VGAM1426 is therefore inhibition of Serine/threonine Kinase 29 (STK29, Accession XM_113646). Accordingly, utilities of VGAM1426 include diagnosis, prevention and treatment of diseases and clinical conditions associated with STK29. FIG. 1 further provides a conceptual description of a novel bioinformatically detected viral gene of the present invention, referred to here as Viral Genomic Address Messenger 1427 (VGAM1427) viral gene, which modulates expression of respective host target genes thereof, the function and utility of which host target genes is known in the art.

VGAM1427 is a novel bioinformatically detected regulatory, non protein coding, viral micro RNA (miRNA) gene. The method by which VGAM1427 was detected is described hereinabove with reference to FIGS. 1-8.

VGAM1427 gene, herein designated VGAM GENE, is a viral gene contained in the genome of Clover Yellow Vein Virus. VGAM1427 host target gene, herein designated VGAM HOST TARGET GENE, is a human gene contained in the human genome.

VGAM1427 gene encodes a VGAM1427 precursor RNA, herein designated VGAM PRECURSOR RNA. Similar to other miRNA genes, and unlike most ordinary genes, VGAM1427 precursor RNA does not encode a protein. A nucleotide sequence identical or highly similar to the nucleotide sequence of VGAM1427 precursor RNA is designated SEQ ID:1413, and is provided hereinbelow with reference to the sequence listing part. Nucleotide sequence SEQ ID:1413 is located at position 8119 relative to the genome of Clover Yellow Vein Virus.

VGAM1427 precursor RNA folds onto itself, forming VGAM1427 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1427 folded precursor RNA into VGAM1427 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1427 RNA is designated SEQ ID:4138, and is provided hereinbelow with reference to the sequence listing part.

VGAM1427 host target gene, herein designated VGAM HOST TARGET GENE, encodes a corresponding messenger RNA, VGAM1427 host target RNA, herein designated VGAM HOST TARGET RNA. VGAM1427 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1427 RNA, herein designated VGAM RNA, binds complementarily to one or more host target binding sites located in untranslated regions of VGAM1427 host target RNA, herein designated VGAM HOST TARGET RNA. This complementary binding is due to the fact that the nucleotide sequence of VGAM1427 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1427 RNA, herein designated VGAM RNA, may have a different number of host target binding sites in untranslated regions of a VGAM1427 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1427 RNA, herein designated VGAM RNA, to host target binding sites on VGAM1427 host target RNA, herein designated VGAM HOST TARGET RNA, such as BINDING SITE I, BINDING SITE II and BINDING SITE III, inhibits translation of VGAM1427 host target RNA into VGAM1427 host target protein, herein designated VGAM HOST TARGET PROTEIN. VGAM host target protein is therefore outlined by a broken line.

It is appreciated that VGAM1427 host target gene, herein designated VGAM HOST TARGET GENE, in fact represents a plurality of VGAM1427 host target genes. The mRNA of each one of this plurality of VGAM1427 host target genes comprises one or more host target binding sites, each having a nucleotide sequence which is at least partly complementary to VGAM1427 RNA, herein designated VGAM RNA, and which when bound by VGAM1427 RNA causes inhibition of translation of respective one or more VGAM1427 host target proteins.

It is further appreciated by one skilled in the art that the mode of translational inhibition illustrated by FIG. 1 with specific reference to translational inhibition exerted by VGAM1427 gene, herein designated VGAM GENE, on one or more VGAM1427 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1427 is inhibition of expression of host target genes, as part of a novel viral mechanism of attacking a host. Accordingly, utilities of VGAM1427 include diagnosis, prevention and treatment of viral infection by Clover Yellow Vein Virus. Specific functions, and accordingly utilities, of VGAM1427 correlate with, and may be deduced from, the identity of the host target genes which VGAM1427 binds and inhibits, and the function of these host target genes, as elaborated hereinbelow.

Nucleotide sequences of the VGAM1427 precursor RNA, herein designated VGAM PRECURSOR RNA, and of the 'diced' VGAM1427 RNA, herein designated VGAM RNA, and a schematic representation of the secondary folding of VGAM1427 folded precursor RNA, herein designated VGAM FOLDED PRECURSOR RNA, of VGAM1427 are further described hereinbelow with reference to Table 1.

Nucleotide sequences of host target binding sites, such as BINDING SITE-I, BINDING SITE-II and BINDING SITE-III of FIG. 1, found on VGAM1427 host target RNA, and schematic representation of the complementarity of each of these host target binding sites to VGAM1427 RNA, herein designated VGAM RNA, are described hereinbelow with reference to Table 2.

As mentioned hereinabove with reference to FIG. 1, a function of VGAM1427 gene, herein designated VGAM is inhibition of expression of VGAM1427 target genes. It is appreciated that specific functions, and accordingly utilities, of VGAM1427 correlate with, and may be deduced from, the identity of the target genes which VGAM1427 binds and inhibits, and the function of these target genes, as elaborated hereinbelow.

Discs, Large (Drosophila) Homolog 5 (DLG5, Accession XM_096398) is a VGAM1427 host target gene. DLG5 BINDING SITE is HOST TARGET binding site found in the 5' untranslated region of mRNA encoded by DLG5, corresponding to a HOST TARGET binding site such as BINDING SITE I, BINDING SITE II or BINDING SITE III. Table 2 illustrates the complementarity of the nucleotide sequences of DLG5 BINDING SITE, designated SEQ ID:40341, to the nucleotide sequence of VGAM1427 RNA, herein designated VGAM RNA, also designated SEQ ID:4138.

A function of VGAM1427 is therefore inhibition of Discs, Large (Drosophila) Homolog 5 (DLG5, Accession XM_096398), a gene which may transmit extracellular signals to inhibit cell proliferation. Accordingly, utilities of VGAM1427 include diagnosis, prevention and treatment of diseases and clinical conditions associated with DLG5. The function of DLG5 and its association with various diseases and clinical conditions, has been established by previous studies, as described hereinabove with reference to VGAM444. Fibronectin Leucine Rich Transmembrane Protein 2 (FLRT2, Accession NM_013231) is another VGAM1427 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14880, to the nucleotide sequence of VGAM1427 RNA, herein designated VGAM RNA, also designated SEQ ID:4138.

Another function of VGAM1427 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM1427 include diagnosis, prevention and treatment of diseases and clinical conditions associated with FLRT2. The function of FLRT2 and its association with various diseases and clinical conditions, has been established by previous studies, as described hereinabove with reference to VGAM247. Nebulin-related Anchoring Protein (Nrap, Accession NM_139235) is another VGAM1427 host target gene. Nrap BINDING SITE is HOST TARGET binding site found in the 3' untranslated region of mRNA encoded by Nrap, corresponding to a HOST TARGET binding site such as BINDING SITE I, BINDING SITE II or BINDING SITE III. Table 2 illustrates the complementarity of the nucleotide sequences of Nrap BINDING SITE, designated SEQ ID:29237, to the nucleotide sequence of VGAM1427 RNA, herein designated VGAM RNA, also designated SEQ ID:4138.

Another function of VGAM1427 is therefore inhibition of Nebulin-related Anchoring Protein (Nrap, Accession NM_139235), a gene which performs an anchoring function to link the terminal actin filaments of myofibrils to protein complexes located beneath the sarcolemma. Accordingly, utilities of VGAM1427 include diagnosis, prevention and treatment of diseases and clinical conditions associated with Nrap. The function of Nrap and its association with various diseases and clinical conditions, has been established by previous studies, as described hereinabove with reference to VGAM649. CDC14 Cell Division Cycle 14 Homolog B (S. cerevisiae) (CDC14B, Accession NM_033332) is another VGAM1427 host target gene. CDC14B BINDING SITE is HOST TARGET binding site found in the 3' untranslated region of mRNA encoded by CDC14B, corresponding to a HOST TARGET binding site such as BINDING SITE I, BINDING SITE II or BINDING SITE III. Table 2 illustrates the complementarity of the nucleotide sequences of CDC14B BINDING SITE, designated SEQ ID:27173, to the nucleotide sequence of VGAM1427 RNA, herein designated VGAM RNA, also designated SEQ ID:4138.

Another function of VGAM1427 is therefore inhibition of CDC14 Cell Division Cycle 14 Homolog B (S. cerevisiae) (CDC14B, Accession NM_033332). Accordingly, utilities of VGAM1427 include diagnosis, prevention and treatment of diseases and clinical conditions associated with CDC14B. DKFZP434C1715 (Accession XM_098421) is another VGAM1427 host target gene. DKFZP434C1715 BINDING SITE is HOST TARGET binding site found in the 3' untranslated region of mRNA encoded by DKFZP434C1715, corresponding to a HOST TARGET binding site such as BINDING SITE I, BINDING SITE II or BINDING SITE III. Table 2 illustrates the complementarity of the nucleotide sequences of DKFZP434C1715 BINDING SITE, designated SEQ ID:41677, to the nucleotide sequence of VGAM1427 RNA, herein designated VGAM RNA, also designated SEQ ID:4138.

Another function of VGAM1427 is therefore inhibition of DKFZP434C1715 (Accession XM_098421). Accordingly, utilities of VGAM1427 include diagnosis, prevention and treatment of diseases and clinical conditions associated with DKFZP434C1715. KIAA0171 (Accession NM_014666) is another VGAM1427 host target gene. KIAA0171 BINDING SITE is HOST TARGET binding site found in the 3' untranslated region of mRNA encoded by KIAA0171, corresponding to a HOST TARGET binding site such as BINDING SITE I, BINDING SITE II or BINDING SITE III. Table 2 illustrates the complementarity of the nucleotide sequences of KIAA0171 BINDING SITE, designated SEQ ID:16123, to the nucleotide sequence of VGAM1427 RNA, herein designated VGAM RNA, also designated SEQ ID:4138.

Another function of VGAM1427 is therefore inhibition of KIAA0171 (Accession NM_014666). Accordingly, utilities of VGAM1427 include diagnosis, prevention and treatment of diseases and clinical conditions associated with KIAA0171. KIAA0420 (Accession XM_032693) is another VGAM1427 host target gene. KIAA0420 BINDING SITE is HOST TARGET binding site found in the 3' untranslated region of mRNA encoded by KIAA0420, corresponding to a HOST TARGET binding site such as BINDING SITE I, BINDING SITE II or BINDING SITE III. Table 2 illustrates the complementarity of the nucleotide sequences of KIAA0420 BINDING SITE, designated SEQ ID:31729, to the nucleotide sequence of VGAM1427 RNA, herein designated VGAM RNA, also designated SEQ ID:4138.

Another function of VGAM1427 is therefore inhibition of KIAA0420 (Accession XM_032693). Accordingly, utilities of VGAM1427 include diagnosis, prevention and treatment of diseases and clinical conditions associated with KIAA0420. MGC4655 (Accession NM_033309) is another VGAM1427 host target gene. MGC4655 BINDING SITE is HOST TARGET binding site found in the 3' untranslated region of mRNA encoded by MGC4655, corresponding to a HOST TARGET binding site such as BINDING SITE I, BINDING SITE II or BINDING SITE III. Table 2 illustrates the complementarity of the nucleotide sequences of MGC4655 BINDING SITE, designated SEQ ID:27148, to the nucleotide sequence of VGAM1427 RNA, herein designated VGAM RNA, also designated SEQ ID:4138.

Another function of VGAM1427 is therefore inhibition of MGC4655 (Accession NM_033309). Accordingly, utilities of VGAM1427 include diagnosis, prevention and treatment of diseases and clinical conditions associated with MGC4655. Phosphodiesterase 10A (PDE10A, Accession NM_006661) is another VGAM1427 host target gene. PDE10A BINDING SITE is HOST TARGET binding site found in the 3' untranslated region of mRNA encoded by PDE10A, corresponding to a HOST TARGET binding site such as BINDING SITE I, BINDING SITE II or BINDING SITE III. Table 2 illustrates the complementarity of the nucleotide sequences of PDE10A BINDING SITE, designated SEQ ID:13465, to the nucleotide sequence of VGAM1427 RNA, herein designated VGAM RNA, also designated SEQ ID:4138.

Another function of VGAM1427 is therefore inhibition of Phosphodiesterase 10A (PDE10A, Accession NM_006661). Accordingly, utilities of VGAM1427 include diagnosis, prevention and treatment of diseases and clinical conditions associated with PDE10A. PPI5PIV (Accession NM_019892) is another VGAM1427 host target gene. PPI5PIV BINDING SITE is HOST TARGET binding site found in the 3' untranslated region of mRNA encoded by PPI5PIV, corresponding to a HOST TARGET binding site such as BINDING SITE I, BINDING SITE II or BINDING SITE III. Table 2 illustrates the complementarity of the nucleotide sequences of PPI5PIV BINDING SITE, designated SEQ ID:21278, to the nucleotide sequence of VGAM1427 RNA, herein designated VGAM RNA, also designated SEQ ID:4138.

Another function of VGAM1427 is therefore inhibition of PPI5PIV (Accession NM_019892). Accordingly, utilities of VGAM1427 include diagnosis, prevention and treatment of diseases and clinical conditions associated with PPI5PIV.

RDH-E2 (Accession NM_138969) is another VGAM1427 host target gene. RDH-E2 BINDING SITE is HOST TARGET binding site found in the 3' untranslated region of mRNA encoded by RDH-E2, corresponding to a HOST TARGET binding site such as BINDING SITE I, BINDING SITE II or BINDING SITE III. Table 2 illustrates the complementarity of the nucleotide sequences of RDH-E2 BINDING SITE, designated SEQ ID:29080, to the nucleotide sequence of VGAM1427 RNA, herein designated VGAM RNA, also designated SEQ ID:4138.

Another function of VGAM1427 is therefore inhibition of RDH-E2 (Accession NM_138969). Accordingly, utilities of VGAM1427 include diagnosis, prevention and treatment of diseases and clinical conditions associated with RDH-E2. LOC147632 (Accession NM_138478) is another VGAM1427 host target gene. LOC147632 BINDING SITE is HOST TARGET binding site found in the 5' untranslated region of mRNA encoded by LOC147632, corresponding to a HOST TARGET binding site such as BINDING SITE I, BINDING SITE II or BINDING SITE III. Table 2 illustrates the complementarity of the nucleotide sequences of LOC147632 BINDING SITE, designated SEQ ID:28828, to the nucleotide sequence of VGAM1427 RNA, herein designated VGAM RNA, also designated SEQ ID:4138.

Another function of VGAM1427 is therefore inhibition of LOC147632 (Accession NM_138478). Accordingly, utilities of VGAM1427 include diagnosis, prevention and treatment of diseases and clinical conditions associated with LOC147632. LOC155061 (Accession XM_088139) is another VGAM1427 host target gene. LOC155061 BINDING SITE is HOST TARGET binding site found in the 3' untranslated region of mRNA encoded by LOC155061, corresponding to a HOST TARGET binding site such as BINDING SITE I, BINDING SITE II or BINDING SITE III. Table 2 illustrates the complementarity of the nucleotide sequences of LOC155061 BINDING SITE, designated SEQ ID:39535, to the nucleotide sequence of VGAM1427 RNA, herein designated VGAM RNA, also designated SEQ ID:4138.

Another function of VGAM1427 is therefore inhibition of LOC155061 (Accession XM_088139). Accordingly, utilities of VGAM1427 include diagnosis, prevention and treatment of diseases and clinical conditions associated with LOC155061. LOC255252 (Accession XM_170779) is another VGAM1427 host target gene. LOC255252 BINDING SITE is HOST TARGET binding site found in the 3' untranslated region of mRNA encoded by LOC255252, corresponding to a HOST TARGET binding site such as BINDING SITE I, BINDING SITE II or BINDING SITE III. Table 2 illustrates the complementarity of the nucleotide sequences of LOC255252 BINDING SITE, designated SEQ ID:45547, to the nucleotide sequence of VGAM1427 RNA, herein designated VGAM RNA, also designated SEQ ID:4138.

Another function of VGAM1427 is therefore inhibition of LOC255252 (Accession XM_170779). Accordingly, utilities of VGAM1427 include diagnosis, prevention and treatment of diseases and clinical conditions associated with LOC255252. LOC257354 (Accession XM_170810) is another VGAM1427 host target gene. LOC257354 BINDING SITE is HOST TARGET binding site found in the 3' untranslated region of mRNA encoded by LOC257354, corresponding to a HOST TARGET binding site such as BINDING SITE I, BINDING SITE II or BINDING SITE III. Table 2 illustrates the complementarity of the nucleotide sequences of LOC257354 BINDING SITE, designated SEQ ID:45582, to the nucleotide sequence of VGAM1427 RNA, herein designated VGAM RNA, also designated SEQ ID:4138.

Another function of VGAM1427 is therefore inhibition of LOC257354 (Accession XM_170810). Accordingly, utilities of VGAM1427 include diagnosis, prevention and treatment of diseases and clinical conditions associated with LOC257354. FIG. 1 further provides a conceptual description of a novel bioinformatically detected viral gene of the present invention, referred to here as Viral Genomic Address Messenger 1428 (VGAM1428) viral gene, which modulates expression of respective host target genes thereof, the function and utility of which host target genes is known in the art.

VGAM1428 is a novel bioinformatically detected regulatory, non protein coding, viral micro RNA (miRNA) gene. The method by which VGAM1428 was detected is described hereinabove with reference to FIGS. 1-8.

VGAM1428 gene, herein designated VGAM GENE, is a viral gene contained in the genome of Clover Yellow Vein Virus. VGAM1428 host target gene, herein designated VGAM HOST TARGET GENE, is a human gene contained in the human genome.

VGAM1428 gene encodes a VGAM1428 precursor RNA, herein designated VGAM PRECURSOR RNA. Similar to other miRNA genes, and unlike most ordinary genes, VGAM1428 precursor RNA does not encode a protein. A nucleotide sequence identical or highly similar to the nucleotide sequence of VGAM1428 precursor RNA is designated SEQ ID:1414, and is provided hereinbelow with reference to the sequence listing part. Nucleotide sequence SEQ ID:1414 is located at position 1573 relative to the genome of Clover Yellow Vein Virus.

VGAM1428 precursor RNA folds onto itself, forming VGAM1428 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1428 folded precursor RNA into VGAM1428 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1428 RNA is designated SEQ ID:4139, and is provided hereinbelow with reference to the sequence listing part.

VGAM1428 host target gene, herein designated VGAM HOST TARGET GENE, encodes a corresponding messenger RNA, VGAM1428 host target RNA, herein designated VGAM HOST TARGET RNA. VGAM1428 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1428 RNA, herein designated VGAM RNA, binds complementarily to one or more host target binding sites located in untranslated regions of VGAM1428 host target RNA, herein designated VGAM HOST TARGET RNA. This complementary binding is due to the fact that the nucleotide sequence of VGAM1428 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1428 RNA, herein designated VGAM RNA, may have a different number of host target binding sites in untranslated regions of a VGAM1428 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1428 RNA, herein designated VGAM RNA, to host target binding sites on VGAM1428 host target RNA, herein designated VGAM HOST TARGET RNA, such as BINDING SITE I, BINDING SITE II and BINDING SITE III, inhibits translation of VGAM1428 host target RNA into VGAM1428 host target protein, herein designated VGAM HOST TARGET PROTEIN. VGAM host target protein is therefore outlined by a broken line.

It is appreciated that VGAM1428 host target gene, herein designated VGAM HOST TARGET GENE, in fact represents a plurality of VGAM1428 host target genes. The mRNA of each one of this plurality of VGAM1428 host target genes comprises one or more host target binding sites, each having a nucleotide sequence which is at least partly complementary to VGAM1428 RNA, herein designated VGAM RNA, and which when bound by VGAM1428 RNA causes inhibition of translation of respective one or more VGAM1428 host target proteins.

It is further appreciated by one skilled in the art that the mode of translational inhibition illustrated by FIG. 1 with specific reference to translational inhibition exerted by VGAM1428 gene, herein designated VGAM GENE, on one or more VGAM1428 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1428 is inhibition of expression of host target genes, as part of a novel viral mechanism of attacking a host. Accordingly, utilities of VGAM1428 include diagnosis, prevention and treatment of viral infection by Clover Yellow Vein Virus. Specific functions, and accordingly utilities, of VGAM1428 correlate with, and may be deduced from, the identity of the host target genes which VGAM1428 binds and inhibits, and the function of these host target genes, as elaborated hereinbelow.

Nucleotide sequences of the VGAM1428 precursor RNA, herein designated VGAM PRECURSOR RNA, and of the 'diced' VGAM1428 RNA, herein designated VGAM RNA, and a schematic representation of the secondary folding of VGAM1428 folded precursor RNA, herein designated VGAM FOLDED PRECURSOR RNA, of VGAM1428 are further described hereinbelow with reference to Table 1.

Nucleotide sequences of host target binding sites, such as BINDING SITE-I, BINDING SITE-II and BINDING SITE-III of FIG. 1, found on VGAM1428 host target RNA, and schematic representation of the complementarity of each of these host target binding sites to VGAM1428 RNA, herein designated VGAM RNA, are described hereinbelow with reference to Table 2.

As mentioned hereinabove with reference to FIG. 1, a function of VGAM1428 gene, herein designated VGAM is inhibition of expression of VGAM1428 target genes. It is appreciated that specific functions, and accordingly utilities, of VGAM1428 correlate with, and may be deduced from, the identity of the target genes which VGAM1428 binds and inhibits, and the function of these target genes, as elaborated hereinbelow.

Ankylosis, Progressive Homolog (mouse) (ANKH, Accession NM_054027) is a VGAM1428 host target gene. ANKH BINDING SITE is HOST TARGET binding site found in the 3' untranslated region of mRNA encoded by ANKH, corresponding to a HOST TARGET binding site such as BINDING SITE I, BINDING SITE II or BINDING SITE III. Table 2 illustrates the complementarity of the nucleotide sequences of ANKH BINDING SITE, designated SEQ ID:27637, to the nucleotide sequence of VGAM1428 RNA, herein designated VGAM RNA, also designated SEQ ID:4139.

A function of VGAM1428 is therefore inhibition of Ankylosis, Progressive Homolog (mouse) (ANKH, Accession NM_054027), a gene which regulates intra- and extracellular levels of inorganic pyrophosphate (ppi), probably functioning as ppi transporter. Accordingly, utilities of VGAM1428 include diagnosis, prevention and treatment of diseases and clinical conditions associated with ANKH. The function of ANKH and its association with various diseases and clinical conditions, has been established by previous studies, as described hereinabove with reference to VGAM1247. Calcitonin Receptor (CALCR, Accession NM_001742) is another VGAM1428 host target gene. CALCR BINDING SITE is HOST TARGET binding site found in the 3' untranslated region of mRNA encoded by CALCR, corresponding to a HOST TARGET binding site such as BINDING SITE I, BINDING SITE II or BINDING SITE III. Table 2 illustrates the complementarity of the nucleotide sequences of CALCR BINDING SITE, designated SEQ ID:7476, to the nucleotide sequence of VGAM1428 RNA, herein designated VGAM RNA, also designated SEQ ID:4139.

Another function of VGAM1428 is therefore inhibition of Calcitonin Receptor (CALCR, Accession NM_001742), a gene which is a receptor for calcitonin, is mediated by g proteins which activate adenylyl cyclase, and thought to couple to the heterotrimeric guanosine triphosphate-binding protein that is sensitive to cholera toxin. Accordingly, utilities of VGAM1428 include diagnosis, prevention and treatment of diseases and clinical conditions associated with CALCR. The function of CALCR and its association with various diseases and clinical conditions, has been established by previous studies, as described hereinabove with reference to VGAM94. Transferrin Receptor (p90, CD71) (TFRC, Accession NM_003234) is another VGAM1428 host target gene. TFRC BINDING SITE is HOST TARGET binding site found in the 3' untranslated region of mRNA encoded by TFRC, corresponding to a HOST TARGET binding site such as BINDING SITE I, BINDING SITE II or BINDING SITE III. Table 2 illustrates the complementarity of the nucleotide sequences of TFRC BINDING SITE, designated SEQ ID:9227, to the nucleotide sequence of VGAM1428 RNA, herein designated VGAM RNA, also designated SEQ ID:4139.

Another function of VGAM1428 is therefore inhibition of Transferrin Receptor (p90, CD71) (TFRC, Accession NM_003234), a gene which is involved in the transferrin cycle and iron adsorption. Accordingly, utilities of VGAM1428 include diagnosis, prevention and treatment of diseases and clinical conditions associated with TFRC. The function of TFRC has been established by previous studies. A monoclonal antibody, OKT-9, recognizes an antigen ubiquitously distributed on the cell surface of actively growing human cells. It is a glycoprotein composed of disulfide-linked polypeptide chains, each of 90,000 daltons molecular weight. Immunoprecipitation of the OKT-9 antigen in the presence of labeled transferrin results in specific precipitation of transferrin (Sutherland et al., 1981); thus, the OKT-9 antigen is presumably transferrin receptor. Nikinmaa and Schroder (1987) concluded that p90 and TFRC are the same protein: studies using monoclonal antibodies indicated that exhaustive precipitation of radioactively labeled lysates with one antibody removed all activity of lysates with the other. Peptide maps of antigens recognized with both antibodies showed great similarity and indicated that both antibodies react with the same antigen, the human transferrin receptor, but with different antigenic sites of the molecule. Casey et al. (1988) analyzed the regulation by iron of the TFRC gene by examining mouse cells transformed with chimeric constructs containing the human transferrin receptor gene's promoter and either the structural gene for bacterial chloramphenicol acetyltransferase or the human TFRC cDNA. They concluded that at least 2 genetic elements, one 5-prime and one 3-prime to the gene, are involved in the regulation of the TFRC gene by iron. Animal model experiments lend further support to the function of TFRC. Levy et al. (1999) disrupted the transferrin receptor gene, which they termed Trfr, in mice. Homozygous mutant mice were not viable beyond embryonic day 12.5 and had severe anemia with hydrops as well as diffuse neurologic abnormalities. There was some variation of onset of severe anemia, and in nonanemic embryos without tissue edema and necrosis (E9.5), both stressed erythropoiesis and neurologic abnormalities were apparent. The authors concluded that inadequate iron led to neuronal apoptosis, but that tissues other than erythrocytes and neurons can obtain sufficient iron for growth and development through mechanisms independent of the transferrin cycle. Haploinsufficiency for the transferrin receptor resulted in microcytic, hypochromic erythrocytes; normal hemoglobin and hematocrit values were due to compensatory increase in red cell numbers. Although iron saturation of serum transferrin was indistinguishable from that of wildtype, heterozygotes had significantly less tissue iron.

It is appreciated that the abovementioned animal model for TFRC is acknowledged by those skilled in the art as a scientifically valid animal model, as can be further appreciated from the publications sited hereinbelow.

Full details of the abovementioned studies are described in the following publications, the disclosure of which are hereby incorporated by reference:

Nikinmaa, B.; Schroder, J.: Two antigens, the transferrin receptor and p90 assigned to human chromosome 3, are probably the same protein. Hereditas 107:55-58, 1987; and Levy, J. E.; Jin, O.; Fujiwara, Y.; Kuo, F.; Andrews, N. C.: Transferrin receptor is necessary for development of erythrocytes and the nervous system. Nature Genet. 21:396-399, 1999.

Further studies establishing the function and utilities of TFRC are found in John Hopkins OMIM database record ID 190010, and in sited publications numbered 10757-10414, 10421-10420, 10422-10424, 55 and 10425-10426 listed in the bibliography section hereinbelow, which are also hereby incorporated by reference. BM-002 (Accession NM_016617) is another VGAM1428 host target gene. BM-002 BINDING SITE is HOST TARGET binding site found in the 3' untranslated region of mRNA encoded by BM-002, corresponding to a HOST TARGET binding site such as BINDING SITE I, BINDING SITE II or BINDING SITE III. Table 2 illustrates the complementarity of the nucleotide sequences of BM-002 BINDING SITE, designated SEQ ID:18726, to the nucleotide sequence of VGAM1428 RNA, herein designated VGAM RNA, also designated SEQ ID:4139.

Another function of VGAM1428 is therefore inhibition of BM-002 (Accession NM_016617). Accordingly, utilities of VGAM1428 include diagnosis, prevention and treatment of diseases and clinical conditions associated with BM-002. SEC15L (Accession XM_051147) is another VGAM1428 host target gene. SEC15L BINDING SITE is HOST TARGET binding site found in the 3' untranslated region of mRNA encoded by SEC15L, corresponding to a HOST TARGET binding site such as BINDING SITE I, BINDING SITE II or BINDING SITE III. Table 2 illustrates the complementarity of the nucleotide sequences of SEC15L BINDING SITE, designated SEQ ID:35766, to the nucleotide sequence of VGAM1428 RNA, herein designated VGAM RNA, also designated SEQ ID:4139.

Another function of VGAM1428 is therefore inhibition of SEC15L (Accession XM_051147). Accordingly, utilities of VGAM1428 include diagnosis, prevention and treatment of diseases and clinical conditions associated with SEC15L. LOC51667 (Accession NM_016118) is another VGAM1428 host target gene. LOC51667 BINDING SITE is HOST TARGET binding site found in the 3' untranslated region of mRNA encoded by LOC51667, corresponding to a HOST TARGET binding site such as BINDING SITE I, BINDING SITE II or BINDING SITE III. Table 2 illustrates the complementarity of the nucleotide sequences of LOC51667 BINDING SITE, designated SEQ ID:18199, to the nucleotide sequence of VGAM1428 RNA, herein designated VGAM RNA, also designated SEQ ID:4139.

Another function of VGAM1428 is therefore inhibition of LOC51667 (Accession NM_016118). Accordingly, utilities of VGAM1428 include diagnosis, prevention and treatment of diseases and clinical conditions associated with LOC51667. FIG. 1 further provides a conceptual description of a novel bioinformatically detected viral gene of the present invention, referred to here as Viral Genomic Address Messenger 1429 (VGAM1429) viral gene, which modulates expression of respective host target genes thereof, the function and utility of which host target genes is known in the art.

VGAM1429 is a novel bioinformatically detected regulatory, non protein coding, viral micro RNA (miRNA) gene. The method by which VGAM1429 was detected is described hereinabove with reference to FIGS. 1-8.

VGAM1429 gene, herein designated VGAM GENE, is a viral gene contained in the genome of Clover Yellow Vein Virus. VGAM1429 host target gene, herein designated VGAM HOST TARGET GENE, is a human gene contained in the human genome.

VGAM1429 gene encodes a VGAM1429 precursor RNA, herein designated VGAM PRECURSOR RNA. Similar to other miRNA genes, and unlike most ordinary genes, VGAM1429 precursor RNA does not encode a protein. A nucleotide sequence identical or highly similar to the nucleotide sequence of VGAM1429 precursor RNA is designated SEQ ID:1415, and is provided hereinbelow with reference to the sequence listing part. Nucleotide sequence SEQ ID:1415 is located at position 913 relative to the genome of Clover Yellow Vein Virus.

VGAM1429 precursor RNA folds onto itself, forming VGAM1429 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1429 folded precursor RNA into VGAM1429 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1429 RNA is designated SEQ ID:4140, and is provided hereinbelow with reference to the sequence listing part.

VGAM1429 host target gene, herein designated VGAM HOST TARGET GENE, encodes a corresponding messenger RNA, VGAM1429 host target RNA, herein designated VGAM HOST TARGET RNA. VGAM1429 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1429 RNA, herein designated VGAM RNA, binds complementarily to one or more host target binding sites located in untranslated regions of VGAM1429 host target RNA, herein designated VGAM HOST TARGET RNA. This complementary binding is due to the fact that the nucleotide sequence of VGAM1429 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1429 RNA, herein designated VGAM RNA, may have a different number of host target binding sites in untranslated regions of a VGAM1429 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1429 RNA, herein designated VGAM RNA, to host target binding sites on VGAM1429 host target RNA, herein designated VGAM HOST TARGET RNA, such as BINDING SITE I, BINDING SITE II and BINDING SITE III, inhibits translation of VGAM1429 host target RNA into VGAM1429 host target protein, herein designated VGAM HOST TARGET PROTEIN. VGAM host target protein is therefore outlined by a broken line.

It is appreciated that VGAM1429 host target gene, herein designated VGAM HOST TARGET GENE, in fact represents a plurality of VGAM1429 host target genes. The mRNA of each one of this plurality of VGAM1429 host target genes comprises one or more host target binding sites, each having a nucleotide sequence which is at least partly complementary to VGAM1429 RNA, herein designated VGAM RNA, and which when bound by VGAM1429 RNA causes inhibition of translation of respective one or more VGAM1429 host target proteins.

It is further appreciated by one skilled in the art that the mode of translational inhibition illustrated by FIG. 1 with specific reference to translational inhibition exerted by VGAM1429 gene, herein designated VGAM GENE, on one or more VGAM1429 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1429 is inhibition of expression of host target genes, as part of a novel viral mechanism of attacking a host. Accordingly, utilities of VGAM1429 include diagnosis, prevention and treatment of viral infection by Clover Yellow Vein Virus. Specific functions, and accordingly utilities, of VGAM1429 correlate with, and may be deduced from, the identity of the host target genes which VGAM1429 binds and inhibits, and the function of these host target genes, as elaborated hereinbelow.

Nucleotide sequences of the VGAM1429 precursor RNA, herein designated VGAM PRECURSOR RNA, and of the 'diced' VGAM1429 RNA, herein designated VGAM RNA, and a schematic representation of the secondary folding of VGAM1429 folded precursor RNA, herein designated VGAM FOLDED PRECURSOR RNA, of VGAM1429 are further described hereinbelow with reference to Table 1.

Nucleotide sequences of host target binding sites, such as BINDING SITE-I, BINDING SITE-II and BINDING SITE-III of FIG. 1, found on VGAM1429 host target RNA, and schematic representation of the complementarity of each of these host target binding sites to VGAM1429 RNA, herein designated VGAM RNA, are described hereinbelow with reference to Table 2.

As mentioned hereinabove with reference to FIG. 1, a function of VGAM1429 gene, herein designated VGAM is inhibition of expression of VGAM1429 target genes. It is appreciated that specific functions, and accordingly utilities, of VGAM1429 correlate with, and may be deduced from, the identity of the target genes which VGAM1429 binds and inhibits, and the function of these target genes, as elaborated hereinbelow.

A Kinase (PRKA) Anchor Protein 13 (AKAP13, Accession XM_116974) is a VGAM1429 host target gene. AKAP13 BINDING SITE is HOST TARGET binding site found in the 3' untranslated region of mRNA encoded by AKAP13, corresponding to a HOST TARGET binding site such as BINDING SITE I, BINDING SITE II or BINDING SITE III. Table 2 illustrates the complementarity of the nucleotide sequences of AKAP13 BINDING SITE, designated SEQ ID:43173, to the nucleotide sequence of VGAM1429 RNA, herein designated VGAM RNA, also designated SEQ ID:4140.

A function of VGAM1429 is therefore inhibition of A Kinase (PRKA) Anchor Protein 13 (AKAP13, Accession XM_116974), a gene which regulates subcellular localization of type II cAMP-dependent PKA. Accordingly, utilities of VGAM1429 include diagnosis, prevention and treatment of diseases and clinical conditions associated with AKAP13. The function of AKAP13 and its association with various diseases and clinical conditions, has been established by previous studies, as described hereinabove with reference to VGAM17. Cytochrome P450, Subfamily XIX (aromatization of androgens) (CYP19, Accession NM_000103) is another VGAM1429 host target gene. CYP19 BINDING SITE1 and CYP19 BINDING SITE2 are HOST TARGET binding sites found in untranslated regions of mRNA encoded by CYP19, corresponding to HOST TARGET binding sites such as BINDING SITE I, BINDING SITE II or BINDING SITE III. Table 2 illustrates the complementarity of the nucleotide sequences of CYP19 BINDING SITE1 and CYP19 BINDING SITE2, designated SEQ ID:5563 and SEQ ID:25273 respectively, to the nucleotide sequence of VGAM1429 RNA, herein designated VGAM RNA, also designated SEQ ID:4140.

Another function of VGAM1429 is therefore inhibition of Cytochrome P450, Subfamily XIX (aromatization of androgens) (CYP19, Accession NM_000103), a gene which catalyzes the last steps of estrogen biosynthesis. Accordingly, utilities of VGAM1429 include diagnosis, prevention and treatment of diseases and clinical conditions associated with CYP19. The function of CYP19 and its association with various diseases and clinical conditions, has been established by previous studies, as described hereinabove with reference to VGAM508. KIAA1676 (Accession XM_167612) is another VGAM1429 host target gene. KIAA1676 BINDING SITE is HOST TARGET binding site found in the 3' untranslated region of mRNA encoded by KIAA1676, corresponding to a HOST TARGET binding site such as BINDING SITE I, BINDING SITE II or BINDING SITE III. Table 2 illustrates the complementarity of the nucleotide sequences of KIAA1676 BINDING SITE, designated SEQ ID:44724, to the nucleotide sequence of VGAM1429 RNA, herein designated VGAM RNA, also designated SEQ ID:4140.

Another function of VGAM1429 is therefore inhibition of KIAA1676 (Accession XM_167612). Accordingly, utilities of VGAM1429 include diagnosis, prevention and treatment of diseases and clinical conditions associated with KIAA1676. KIAA1796 (Accession XM_166146) is another VGAM1429 host target gene. KIAA1796 BINDING SITE is HOST TARGET binding site found in the 3' untranslated region of mRNA encoded by KIAA1796, corresponding to a HOST TARGET binding site such as BINDING SITE I, BINDING SITE II or BINDING SITE III. Table 2 illustrates the complementarity of the nucleotide sequences of KIAA1796 BINDING SITE, designated SEQ ID:43961, to the nucleotide sequence of VGAM1429 RNA, herein designated VGAM RNA, also designated SEQ ID:4140.

Another function of VGAM1429 is therefore inhibition of KIAA1796 (Accession XM_166146). Accordingly, utilities of VGAM1429 include diagnosis, prevention and treatment of diseases and clinical conditions associated with KIAA1796. FIG. 1 further provides a conceptual description of a novel bioinformatically detected viral gene of the present invention, referred to here as Viral Genomic Address Messenger 1430 (VGAM1430) viral gene, which modulates expression of respective host target genes thereof, the function and utility of which host target genes is known in the art.

VGAM1430 is a novel bioinformatically detected regulatory, non protein coding, viral micro RNA (miRNA) gene. The method by which VGAM1430 was detected is described hereinabove with reference to FIGS. 1-8.

VGAM1430 gene, herein designated VGAM GENE, is a viral gene contained in the genome of Clover Yellow Vein Virus. VGAM1430 host target gene, herein designated VGAM HOST TARGET GENE, is a human gene contained in the human genome.

VGAM1430 gene encodes a VGAM1430 precursor RNA, herein designated VGAM PRECURSOR RNA. Similar to other miRNA genes, and unlike most ordinary genes, VGAM1430 precursor RNA does not encode a protein. A nucleotide sequence identical or highly similar to the nucleotide sequence of VGAM1430 precursor RNA is designated SEQ ID:1416, and is provided hereinbelow with reference to the sequence listing part. Nucleotide sequence SEQ ID:1416 is located at position 6030 relative to the genome of Clover Yellow Vein Virus.

VGAM1430 precursor RNA folds onto itself, forming VGAM1430 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1430 folded precursor RNA into VGAM1430 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 85%) nucleotide sequence of VGAM1430 RNA is designated SEQ ID:4141, and is provided hereinbelow with reference to the sequence listing part.

VGAM1430 host target gene, herein designated VGAM HOST TARGET GENE, encodes a corresponding messenger RNA, VGAM1430 host target RNA, herein designated VGAM HOST TARGET RNA. VGAM1430 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1430 RNA, herein designated VGAM RNA, binds complementarily to one or more host target binding sites located in untranslated regions of VGAM1430 host target RNA, herein designated VGAM HOST TARGET RNA. This complementary binding is due to the fact that the nucleotide sequence of VGAM1430 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1430 RNA, herein designated VGAM RNA, may have a different number of host target binding sites in untranslated regions of a VGAM1430 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1430 RNA, herein designated VGAM RNA, to host target binding sites on VGAM1430 host target RNA, herein designated VGAM HOST TARGET RNA, such as BINDING SITE I, BINDING SITE II and BINDING SITE III, inhibits translation of VGAM1430 host target RNA into VGAM1430 host target protein, herein designated VGAM HOST TARGET PROTEIN. VGAM host target protein is therefore outlined by a broken line.

It is appreciated that VGAM1430 host target gene, herein designated VGAM HOST TARGET GENE, in fact represents a plurality of VGAM1430 host target genes. The mRNA of each one of this plurality of VGAM1430 host target genes comprises one or more host target binding sites, each having a nucleotide sequence which is at least partly complementary to VGAM1430 RNA, herein designated VGAM RNA, and which when bound by VGAM1430 RNA causes inhibition of translation of respective one or more VGAM1430 host target proteins.

It is further appreciated by one skilled in the art that the mode of translational inhibition illustrated by FIG. 1 with specific reference to translational inhibition exerted by VGAM1430 gene, herein designated VGAM GENE, on one or more VGAM1430 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1430 is inhibition of expression of host target genes, as part of a novel viral mechanism of attacking a host. Accordingly, utilities of VGAM1430 include diagnosis, prevention and treatment of viral infection by Clover Yellow Vein Virus. Specific functions, and accordingly utilities, of VGAM1430 correlate with, and may be deduced from, the identity of the host target genes which VGAM1430 binds and inhibits, and the function of these host target genes, as elaborated hereinbelow.

Nucleotide sequences of the VGAM1430 precursor RNA, herein designated VGAM PRECURSOR RNA, and of the 'diced' VGAM1430 RNA, herein designated VGAM RNA, and a schematic representation of the secondary folding of VGAM1430 folded precursor RNA, herein designated VGAM FOLDED PRECURSOR RNA, of VGAM1430 are further described hereinbelow with reference to Table 1.

Nucleotide sequences of host target binding sites, such as BINDING SITE-I, BINDING SITE-II and BINDING SITE-III of FIG. 1, found on VGAM1430 host target RNA, and schematic representation of the complementarity of each of these host target binding sites to VGAM1430 RNA, herein designated VGAM RNA, are described hereinbelow with reference to Table 2.

As mentioned hereinabove with reference to FIG. 1, a function of VGAM1430 gene, herein designated VGAM is inhibition of expression of VGAM1430 target genes. It is appreciated that specific functions, and accordingly utilities, of VGAM1430 correlate with, and may be deduced from, the identity of the target genes which VGAM1430 binds and inhibits, and the function of these target genes, as elaborated hereinbelow.

B-cell CLL/lymphoma 7B (BCL7B, Accession NM_001707) is a VGAM1430 host target gene. BCL7B BINDING SITE is HOST TARGET binding site found in the 3' untranslated region of mRNA encoded by BCL7B, corresponding to a HOST TARGET binding site such as BINDING SITE I, BINDING SITE II or BINDING SITE III. Table 2 illustrates the complementarity of the nucleotide sequences of BCL7B BINDING SITE, designated SEQ ID:7436, to the nucleotide sequence of VGAM1430 RNA, herein designated VGAM RNA, also designated SEQ ID:4141.

A function of VGAM1430 is therefore inhibition of B-cell CLL/lymphoma 7B (BCL7B, Accession NM_001707), a gene which is of yet unknown fanction. Accordingly, utilities of VGAM1430 include diagnosis, prevention and treatment of diseases and clinical conditions associated with BCL7B. The function of BCL7B and its association with various diseases and clinical conditions, has been established by previous studies, as described hereinabove with reference to VGAM1189. Forkhead Box O1A (rhabdomyosarcoma) (FOXO1A, Accession NM_002015) is another VGAM1430 host target gene. FOXO1A BINDING SITE is HOST TARGET binding site found in the 3' untranslated region of mRNA encoded by FOXO1A, corresponding to a HOST TARGET binding site such as BINDING SITE I, BINDING SITE II or BINDING SITE III. Table 2 illustrates the complementarity of the nucleotide sequences of FOXO1A BINDING SITE, designated SEQ ID:7759, to the nucleotide sequence of VGAM1430 RNA, herein designated VGAM RNA, also designated SEQ ID:4141.

Another function of VGAM1430 is therefore inhibition of Forkhead Box O1A (rhabdomyosarcoma) (FOXO1A, Accession NM_002015), a gene which is a probable transcription factor. Accordingly, utilities of VGAM1430 include diagnosis, prevention and treatment of diseases and clinical conditions associated with FOXO1A. The function of FOXO1A and its association with various diseases and clinical conditions, has been established by previous studies, as described hereinabove with reference to VGAM228. Kruppel-like Factor 7 (ubiquitous) (KLF7, Accession NM_003709) is another VGAM1430 host target gene. KLF7 BINDING SITE is HOST TARGET binding site found in the 5' untranslated region of mRNA encoded by KLF7, corresponding to a HOST TARGET binding site such as BINDING SITE I, BINDING SITE II or BINDING SITE III. Table 2 illustrates the complementarity of the nucleotide sequences of KLF7 BINDING SITE, designated SEQ ID:9810, to the nucleotide sequence of VGAM1430 RNA, herein designated VGAM RNA, also designated SEQ ID:4141.

Another function of VGAM1430 is therefore inhibition of Kruppel-like Factor 7 (ubiquitous) (KLF7, Accession NM_003709), a gene which is a transcriptional activator. Accordingly, utilities of VGAM1430 include diagnosis, prevention and treatment of diseases and clinical conditions associated with KLF7. The function of KLF7 has been established by previous studies. Shields et al. (1996) cloned a mouse cDNA, which they named gut-enriched Kruppel-like factor (Gklf), that encodes a member of the Kruppel family of transcription factors. Immunofluorescence revealed that Gklf is localized to the nucleus and is found at highest levels in growth-arrested cells. Shields et al. (1996) found that transfection of Gklf into COS-1 cells causes an inhibition of DNA synthesis. In the mouse, the authors found that Gklf mRNA is most abundant in the colon and is also expressed in the testis, lung, and small intestine. Garrett-Sinha et al. (1996) identified a novel zinc finger protein whose mRNA is expressed at high levels in the epidermal layer of the skin and in epithelial cells in the tongue, palate, esophagus, stomach, and colon of newborn mice. They named the protein EZF for 'epithelial zinc finger.' By screening a human umbilical vein endothelial cell cDNA library with a cDNA encoding the C-terminal zinc finger region of EKLF (KLF1; 600599), Yet et al. (1998) isolated a cDNA encoding KLF4, which they called EZF. The predicted 470-amino acid KLF4 protein has a proline- and serine-rich N terminus and contains 3 C2H2 Kruppel-type zinc fingers at the C terminus. KLF4 also contains a potential nuclear localization signal. The human KLF4 protein shares 91% sequence identity with mouse Ezf. Recombinant KLF4 bound specifically to a probe containing the CACCC core sequence in gel mobility shift assays. In contrast to other members of the EKLF family, which are transcriptional activators, KLF4 functioned as a transcriptional repressor in transient transfection studies. The authors identified both the repression domain and the activation domain within KLF4. Northern blot analysis detected a 3.5-kb KLF4 transcript in RNA from both human umbilical vein endothelial cells and human aortic endothelial cells. By radiation hybrid mapping, Yet et al. (1998) mapped the human KLF4 gene to 9q31. Garrett-Sinha et al. (1996) mapped the mouse EZF gene to chromosome 4, in close proximity to the thioredoxin gene (OMIM Ref. No. 187700). Animal model experiments lend further support to the function of KLF7. Located at the interface between body and environment, the epidermis must protect the body against toxic agents and dehydration, and protect itself against physical and mechanical stresses. Acquired just before birth and at the last stage of epidermal differentiation, the skin's proteinaceous/lipid barrier creates a surface seal essential for protecting animals against microbial infections and dehydration. Segre et al. (1999) showed that Kruppel-like factor-4 (KLF4), highly expressed in the differentiating layers of epidermis, is both vital to and selective for barrier acquisition. Klf4 -/- mice die shortly after birth due to loss of skin barrier function, as measured by penetration of external dyes and rapid loss of body fluids. The defect was not corrected by grafting of Klf4 -/- skin onto nude mice. Loss of the barrier occurred without morphologic or biochemical alterations to the well-known structural features of epidermis that are essential for mechanical integrity. Instead, late-stage differentiation structures were selectively perturbed, including the cornified envelope, a likely scaffold for lipid organization. Using suppressive hybridization, Segre et al. (1999) identified 3 transcripts encoding cornified envelope proteins with altered expression in the absence of Klf4. Sprr2a (OMIM Ref. No. 182267) was one, this being the only epidermal gene whose promoter is known to possess a functional Klf4 binding site. These studies provide a new insight into transcriptional governance of barrier function, and pave the way for unraveling the molecular events that orchestrate this essential process It is appreciated that the abovementioned animal model for KLF7 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Garrett-Sinha, L. A.; Eberspaecher, H.; Seldin, M. F.; de Crombrugghe, B.: A gene for a novel zinc-finger protein expressed in differentiated epithelial cells and transiently in certain mesenchymal cells. J. Biol. Chem. 271:31384-31390, 1996; and Segre, J. A.; Bauer, C.; Fuchs, E.: Klf4 is a transcription factor required for establishing the barrier function of the skin. Nature Genet. 22:356-360, 1999.

Further studies establishing the function and utilities of KLF7 are found in John Hopkins OMIM database record ID 604865, and in sited publications numbered 2313 listed in the bibliography section hereinbelow, which are also hereby incorporated by reference. Mitogen-activated Protein Kinase 4 (MAPK4, Accession NM_002747) is another VGAM1430 host target gene. MAPK4 BINDING SITE is HOST TARGET binding site found in the 3' untranslated region of mRNA encoded by MAPK4, corresponding to a HOST TARGET binding site such as BINDING SITE I, BINDING SITE II or BINDING SITE III. Table 2 illustrates the complementarity of the nucleotide sequences of MAPK4 BINDING SITE, designated SEQ ID:8624, to the nucleotide sequence of VGAM1430 RNA, herein designated VGAM RNA, also designated SEQ ID:4141.

Another function of VGAM1430 is therefore inhibition of Mitogen-activated Protein Kinase 4 (MAPK4, Accession NM_002747), a gene which phosphorylates microtubule-associated protein-2 may promote entry into the cell cycle. Accordingly, utilities of VGAM1430 include diagnosis, prevention and treatment of diseases and clinical conditions associated with MAPK4. The function of MAPK4 and its association with various diseases and clinical conditions, has been established by previous studies, as described hereinabove with reference to VGAM655. FLJ12221 (Accession XM_031342) is another VGAM1430 host target gene. FLJ12221 BINDING SITE is HOST TARGET binding site found in the 3' untranslated region of mRNA encoded by FLJ12221, corresponding to a HOST TARGET binding site such as BINDING SITE I, BINDING SITE II or BINDING SITE III. Table 2 illustrates the complementarity of the nucleotide sequences of FLJ12221 BINDING SITE, designated SEQ ID:31345, to the nucleotide sequence of VGAM1430 RNA, herein designated VGAM RNA, also designated SEQ ID:4141.

Another function of VGAM1430 is therefore inhibition of FLJ12221 (Accession XM_031342). Accordingly, utilities of VGAM1430 include diagnosis, prevention and treatment of diseases and clinical conditions associated with FLJ12221. FLJ13110 (Accession NM_022912) is another VGAM1430 host target gene. FLJ13110 BINDING SITE is HOST TARGET binding site found in the 3' untranslated region of mRNA encoded by FLJ13110, corresponding to a HOST TARGET binding site such as BINDING SITE I, BINDING SITE II or BINDING SITE III. Table 2 illustrates the complementarity of the nucleotide sequences of FLJ13110 BINDING SITE, designated SEQ ID:23218, to the nucleotide sequence of VGAM1430 RNA, herein designated VGAM RNA, also designated SEQ ID:4141.

Another function of VGAM1430 is therefore inhibition of FLJ13110 (Accession NM_022912). Accordingly, utilities of VGAM1430 include diagnosis, prevention and treatment of diseases and clinical conditions associated with FLJ13110. KIAA0350 (Accession XM_028332) is another VGAM1430 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30669, to the nucleotide sequence of VGAM1430 RNA, herein designated VGAM RNA, also designated SEQ ID:4141.

Another function of VGAM1430 is therefore inhibition of KIAA0350 (Accession XM_028332). Accordingly, utilities of VGAM1430 include diagnosis, prevention and treatment of diseases and clinical conditions associated with KIAA0350. KIAA1209 (Accession XM_027307) is another VGAM1430 host target gene. KIAA1209 BINDING SITE is HOST TARGET binding site found in the 3' untranslated region of mRNA encoded by KIAA1209, corresponding to a HOST TARGET binding site such as BINDING SITE I, BINDING SITE II or BINDING SITE III. Table 2 illustrates the complementarity of the nucleotide sequences of KIAA1209 BINDING SITE, designated SEQ ID:30473, to the nucleotide sequence of VGAM1430 RNA, herein designated VGAM RNA, also designated SEQ ID:4141.

Another function of VGAM1430 is therefore inhibition of KIAA1209 (Accession XM_027307). Accordingly, utilities of VGAM1430 include diagnosis, prevention and treatment of diseases and clinical conditions associated with KIAA1209. Mitochondrial Ribosomal Protein L48 (MRPL48, Accession NM_016055) is another VGAM1430 host target gene. MRPL48 BINDING SITE is HOST TARGET binding site found in the 5' untranslated region of mRNA encoded by MRPL48, corresponding to a HOST TARGET binding site such as BINDING SITE I, BINDING SITE II or BINDING SITE III. Table 2 illustrates the complementarity of the nucleotide sequences of MRPL48 BINDING SITE, designated SEQ ID:18128, to the nucleotide sequence of VGAM1430 RNA, herein designated VGAM RNA, also designated SEQ ID:4141.

Another function of VGAM1430 is therefore inhibition of Mitochondrial Ribosomal Protein L48 (MRPL48, Accession NM_016055). Accordingly, utilities of VGAM1430 include diagnosis, prevention and treatment of diseases and clinical conditions associated with MRPL48. LOC204084 (Accession XM_115181) is another VGAM1430 host target gene. LOC204084 BINDING SITE is HOST TARGET binding site found in the 5' untranslated region of mRNA encoded by LOC204084, corresponding to a HOST TARGET binding site such as BINDING SITE I, BINDING SITE II or BINDING SITE III. Table 2 illustrates the complementarity of the nucleotide sequences of LOC204084 BINDING SITE, designated SEQ ID:43089, to the nucleotide sequence of VGAM1430 RNA, herein designated VGAM RNA, also designated SEQ ID:4141.

Another function of VGAM1430 is therefore inhibition of LOC204084 (Accession XM_115181). Accordingly, utilities of VGAM1430 include diagnosis, prevention and treatment of diseases and clinical conditions associated with LOC204084. LOC221964 (Accession XM_168342) is another VGAM1430 host target gene. LOC221964 BINDING SITE is HOST TARGET binding site found in the 3' untranslated region of mRNA encoded by LOC221964, corresponding to a HOST TARGET binding site such as BINDING SITE I, BINDING SITE II or BINDING SITE III. Table 2 illustrates the complementarity of the nucleotide sequences of LOC221964 BINDING SITE, designated SEQ ID:45110, to the nucleotide sequence of VGAM1430 RNA, herein designated VGAM RNA, also designated SEQ ID:4141.

Another function of VGAM1430 is therefore inhibition of LOC221964 (Accession XM_168342). Accordingly, utilities of VGAM1430 include diagnosis, prevention and treatment of diseases and clinical conditions associated with LOC221964. LOC51107 (Accession NM_016022) is another VGAM1430 host target gene. LOC51107 BINDING SITE is HOST TARGET binding site found in the 3' untranslated region of mRNA encoded by LOC51107, corresponding to a HOST TARGET binding site such as BINDING SITE I, BINDING SITE II or BINDING SITE III. Table 2 illustrates the complementarity of the nucleotide sequences of LOC51107 BINDING SITE, designated SEQ ID:18099, to the nucleotide sequence of VGAM1430 RNA, herein designated VGAM RNA, also designated SEQ ID:4141.

Another function of VGAM1430 is therefore inhibition of LOC51107 (Accession NM_016022). Accordingly, utilities of VGAM1430 include diagnosis, prevention and treatment of diseases and clinical conditions associated with LOC51107. FIG. 1 further provides a conceptual description of a novel bioinformatically detected viral gene of the present invention, referred to here as Viral Genomic Address Messenger 1431 (VGAM1431) viral gene, which modulates expression of respective host target genes thereof, the function and utility of which host target genes is known in the art.

VGAM1431 is a novel bioinformatically detected regulatory, non protein coding, viral micro RNA (miRNA) gene. The method by which VGAM1431 was detected is described hereinabove with reference to FIGS. 1-8.

VGAM1431 gene, herein designated VGAM GENE, is a viral gene contained in the genome of Potato Virus A. VGAM1431 host target gene, herein designated VGAM HOST TARGET GENE, is a human gene contained in the human genome.

VGAM1431 gene encodes a VGAM1431 precursor RNA, herein designated VGAM PRECURSOR RNA. Similar to other miRNA genes, and unlike most ordinary genes, VGAM1431 precursor RNA does not encode a protein. A nucleotide sequence identical or highly similar to the nucleotide sequence of VGAM1431 precursor RNA is designated SEQ ID:1417, and is provided hereinbelow with reference to the sequence listing part. Nucleotide sequence SEQ ID:1417 is located at position 4277 relative to the genome of Potato Virus A.

VGAM1431 precursor RNA folds onto itself, forming VGAM1431 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1431 folded precursor RNA into VGAM1431 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM1431 RNA is designated SEQ ID:4142, and is provided hereinbelow with reference to the sequence listing part.

VGAM1431 host target gene, herein designated VGAM HOST TARGET GENE, encodes a corresponding messenger RNA, VGAM1431 host target RNA, herein designated VGAM HOST TARGET RNA. VGAM1431 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1431 RNA, herein designated VGAM RNA, binds complementarily to one or more host target binding sites located in untranslated regions of VGAM1431 host target RNA, herein designated VGAM HOST TARGET RNA. This complementary binding is due to the fact that the nucleotide sequence of VGAM1431 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1431 RNA, herein designated VGAM RNA, may have a different number of host target binding sites in untranslated regions of a VGAM1431 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1431 RNA, herein designated VGAM RNA, to host target binding sites on VGAM1431 host target RNA, herein designated VGAM HOST TARGET RNA, such as BINDING SITE I, BINDING SITE II and BINDING SITE III, inhibits translation of VGAM1431 host target RNA into VGAM1431 host target protein, herein designated VGAM HOST TARGET PROTEIN. VGAM host target protein is therefore outlined by a broken line.

It is appreciated that VGAM1431 host target gene, herein designated VGAM HOST TARGET GENE, in fact represents a plurality of VGAM1431 host target genes. The mRNA of each one of this plurality of VGAM1431 host target genes comprises one or more host target binding sites, each having a nucleotide sequence which is at least partly complementary to VGAM1431 RNA, herein designated VGAM RNA, and which when bound by VGAM1431 RNA causes inhibition of translation of respective one or more VGAM1431 host target proteins.

It is further appreciated by one skilled in the art that the mode of translational inhibition illustrated by FIG. 1 with specific reference to translational inhibition exerted by VGAM1431 gene, herein designated VGAM GENE, on one or more VGAM1431 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1431 is inhibition of expression of host target genes, as part of a novel viral mechanism of attacking a host. Accordingly, utilities of VGAM1431 include diagnosis, prevention and treatment of viral infection by Potato Virus A. Specific functions, and accordingly utilities, of VGAM1431 correlate with, and may be deduced from, the identity of the host target genes which VGAM1431 binds and inhibits, and the function of these host target genes, as elaborated hereinbelow.

Nucleotide sequences of the VGAM1431 precursor RNA, herein designated VGAM PRECURSOR RNA, and of the 'diced' VGAM1431 RNA, herein designated VGAM RNA, and a schematic representation of the secondary folding of VGAM1431 folded precursor RNA, herein designated VGAM FOLDED PRECURSOR RNA, of VGAM1431 are further described hereinbelow with reference to Table 1.

Nucleotide sequences of host target binding sites, such as BINDING SITE-I, BINDING SITE-II and BINDING SITE-III of FIG. 1, found on VGAM1431 host target RNA, and schematic representation of the complementarity of each of these host target binding sites to VGAM1431 RNA, herein designated VGAM RNA, are described hereinbelow with reference to Table 2.

As mentioned hereinabove with reference to FIG. 1, a function of VGAM1431 gene, herein designated VGAM is inhibition of expression of VGAM1431 target genes. It is appreciated that specific functions, and accordingly utilities, of VGAM1431 correlate with, and may be deduced from, the identity of the target genes which VGAM1431 binds and inhibits, and the function of these target genes, as elaborated hereinbelow.

CDC7 Cell Division Cycle 7-like 1 (S. cerevisiae) (CDC7L1, Accession NM_003503) is a VGAM1431 host target gene. CDC7L1 BINDING SITE is HOST TARGET binding site found in the 3' untranslated region of mRNA encoded by CDC7L1, corresponding to a HOST TARGET binding site such as BINDING SITE I, BINDING SITE II or BINDING SITE III. Table 2 illustrates the complementarity of the nucleotide sequences of CDC7L1 BINDING SITE, designated SEQ ID:9592, to the nucleotide sequence of VGAM1431 RNA, herein designated VGAM RNA, also designated SEQ ID:4142.

A function of VGAM1431 is therefore inhibition of CDC7 Cell Division Cycle 7-like 1 (S. cerevisiae) (CDC7L1, Accession NM_003503), a gene which may phosphorylate critical substrates that regulate the G1/S phase transition and/or DNA replication in mammalian cells. Accordingly, utilities of VGAM1431 include diagnosis, prevention and treatment of diseases and clinical conditions associated with CDC7L1. The function of CDC7L1 has been established by previous studies. The Cdc7 protein kinase is essential for the G1/S transition and initiation of DNA replication during the cell division cycle in S. cerevisiae. Hsk1 is the S. pombe Cdc7 homolog. By searching EST databases for sequences similar to those of Cdc7 and Hsk1, Jiang and Hunter (1997) identified a partial CDC7L1 cDNA. They used the partial cDNA to isolate a full-length cDNA from a HeLa cell library. The predicted 574-amino acid human CDC7L1 protein contains the 11 conserved subdomains found in all protein serine/threonine kinases as well as 3 additional sequences (kinase inserts) between subdomains I and II, VII and VIII, and X and XI. The kinase domains of CDC7L1 and Cdc7 share 44% protein sequence identity. CDC7L1 has a molecular mass of 64 kD by SDS-PAGE. Using immunofluorescence, the authors demonstrated that CDC7L1 was predominantly localized in the nucleus. Immune complexes of epitope-tagged CDC7L1 from mammalian cell lysates phosphorylated histone H1 in vitro. Although the expression levels of CDC7L1 protein appeared to be constant throughout the cell cycle, the protein kinase activity of CDC7L1 increased during S phase. Jiang and Hunter (1997) suggested that CDC7L1 may phosphorylate critical substrate (s) that regulate the G1/S phase transition and/or DNA replication in mammalian cells. Sato et al. (1997) isolated cDNAs encoding Xenopus and human Cdc7 homologs. Northern blot analysis revealed that CDC7L1 is expressed as 2.4-, 3.5-, and 4.4-kb mRNAs. The 3.5-kb transcript was detected in all tissues tested, while the 2.4-kb mRNA was testis-specific. Sato et al. (1997) determined that CDC7L1 phosphorylates the MCM2 (OMIM Ref. No. 116945) and MCM3 (OMIM Ref. No. 602693) proteins in vitro, suggesting that CDC7L1 may regulate DNA replication by modulating MCM functions. Using Northern blot and dot blot analyses, Hess et al. (1998) found that CDC7L1 was expressed in many normal tissues, but was overexpressed in all transformed cell lines tested and in certain tumor types.

Full details of the abovementioned studies are described in the following publications, the disclosure of which are hereby incorporated by reference:

Jiang, W.; Hunter, T.: Identification and characterization of a human protein kinase related to budding yeast Cdc7p. Proc. Nat. Acad. Sci. 94:14320-14325, 1997; and Hess, G. F.; Drong, R. F.; Weiland, K. L.; Slightom, J. L.; Sclafani, R. A.; Hollingsworth, R. E.: A human homolog of the yeast CDC7 gene is overexpressed in some tumors and transformed.

Further studies establishing the function and utilities of CDC7L1 are found in John Hopkins OMIM database record ID 603311, and in sited publications numbered 2447-2448, 528 and 5832 listed in the bibliography section hereinbelow, which are also hereby incorporated by reference. Chromosome 20 Open Reading Frame 30 (C20orf30, Accession NM_014145) is another VGAM1431 host target gene. C20orf30 BINDING SITE is HOST TARGET binding site found in the 3' untranslated region of mRNA encoded by C20orf30, corresponding to a HOST TARGET binding site such as BINDING SITE I, BINDING SITE II or BINDING SITE III. Table 2 illustrates the complementarity of the nucleotide sequences of C20orf30 BINDING SITE, designated SEQ ID:15429, to the nucleotide sequence of VGAM1431 RNA, herein designated VGAM RNA, also designated SEQ ID:4142.

Another function of VGAM1431 is therefore inhibition of Chromosome 20 Open Reading Frame 30 (C20orf30, Accession NM_014145). Accordingly, utilities of VGAM1431 include diagnosis, prevention and treatment of diseases and clinical conditions associated with C20orf30. MGC12335 (Accession NM_032744) is another VGAM1431 host target gene. MGC12335 BINDING SITE is HOST TARGET binding site found in the 3' untranslated region of mRNA encoded by MGC12335, corresponding to a HOST TARGET binding site such as BINDING SITE I, BINDING SITE II or BINDING SITE III. Table 2 illustrates the complementarity of the nucleotide sequences of MGC12335 BINDING SITE, designated SEQ ID:26475, to the nucleotide sequence of VGAM1431 RNA, herein designated VGAM RNA, also designated SEQ ID:4142.

Another function of VGAM1431 is therefore inhibition of MGC12335 (Accession NM_032744). Accordingly, utilities of VGAM1431 include diagnosis, prevention and treatment of diseases and clinical conditions associated with MGC12335. LOC92305 (Accession NM_138385) is another VGAM1431 host target gene. LOC92305 BINDING SITE is HOST TARGET binding site found in the 3' untranslated region of mRNA encoded by LOC92305, corresponding to a HOST TARGET binding site such as BINDING SITE I, BINDING SITE II or BINDING SITE III. Table 2 illustrates the complementarity of the nucleotide sequences of LOC92305 BINDING SITE, designated SEQ ID:28760, to the nucleotide sequence of VGAM1431 RNA, herein designated VGAM RNA, also designated SEQ ID:4142.

Another function of VGAM1431 is therefore inhibition of LOC92305 (Accession NM_138385). Accordingly, utilities of VGAM1431 include diagnosis, prevention and treatment of diseases and clinical conditions associated with LOC92305. FIG. 1 further provides a conceptual description of a novel bioinformatically detected viral gene of the present invention, referred to here as Viral Genomic Address Messenger 1432 (VGAM1432) viral gene, which modulates expression of respective host target genes thereof, the function and utility of which host target genes is known in the art.

VGAM1432 is a novel bioinformatically detected regulatory, non protein coding, viral micro RNA (miRNA) gene. The method by which VGAM1432 was detected is described hereinabove with reference to FIGS. 1-8.

VGAM1432 gene, herein designated VGAM GENE, is a viral gene contained in the genome of Potato Virus A. VGAM1432 host target gene, herein designated VGAM HOST TARGET GENE, is a human gene contained in the human genome.

VGAM1432 gene encodes a VGAM1432 precursor RNA, herein designated VGAM PRECURSOR RNA. Similar to other miRNA genes, and unlike most ordinary genes, VGAM1432 precursor RNA does not encode a protein. A nucleotide sequence identical or highly similar to the nucleotide sequence of VGAM1432 precursor RNA is designated SEQ ID:1418, and is provided hereinbelow with reference to the sequence listing part. Nucleotide sequence SEQ ID:1418 is located at position 462 relative to the genome of Potato Virus A.

VGAM1432 precursor RNA folds onto itself, forming VGAM1432 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1432 folded precursor RNA into VGAM1432 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1432 RNA is designated SEQ ID:4143, and is provided hereinbelow with reference to the sequence listing part.

VGAM1432 host target gene, herein designated VGAM HOST TARGET GENE, encodes a corresponding messenger RNA, VGAM1432 host target RNA, herein designated VGAM HOST TARGET RNA. VGAM1432 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1432 RNA, herein designated VGAM RNA, binds complementarily to one or more host target binding sites located in untranslated regions of VGAM1432 host target RNA, herein designated VGAM HOST TARGET RNA. This complementary binding is due to the fact that the nucleotide sequence of VGAM1432 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1432 RNA, herein designated VGAM RNA, may have a different number of host target binding sites in untranslated regions of a VGAM1432 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1432 RNA, herein designated VGAM RNA, to host target binding sites on VGAM1432 host target RNA, herein designated VGAM HOST TARGET RNA, such as BINDING SITE I, BINDING SITE II and BINDING SITE III, inhibits translation of VGAM1432 host target RNA into VGAM1432 host target protein, herein designated VGAM HOST TARGET PROTEIN. VGAM host target protein is therefore outlined by a broken line.

It is appreciated that VGAM1432 host target gene, herein designated VGAM HOST TARGET GENE, in fact represents a plurality of VGAM1432 host target genes. The mRNA of each one of this plurality of VGAM1432 host target genes comprises one or more host target binding sites, each having a nucleotide sequence which is at least partly complementary to VGAM1432 RNA, herein designated VGAM RNA, and which when bound by VGAM1432 RNA causes inhibition of translation of respective one or more VGAM1432 host target proteins.

It is further appreciated by one skilled in the art that the mode of translational inhibition illustrated by FIG. 1 with specific reference to translational inhibition exerted by VGAM1432 gene, herein designated VGAM GENE, on one or more VGAM1432 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1432 is inhibition of expression of host target genes, as part of a novel viral mechanism of attacking a host. Accordingly, utilities of VGAM1432 include diagnosis, prevention and treatment of viral infection by Potato Virus A. Specific functions, and accordingly utilities, of VGAM1432 correlate with, and may be deduced from, the identity of the host target genes which VGAM1432 binds and inhibits, and the function of these host target genes, as elaborated hereinbelow.

Nucleotide sequences of the VGAM1432 precursor RNA, herein designated VGAM PRECURSOR RNA, and of the 'diced' VGAM1432 RNA, herein designated VGAM RNA, and a schematic representation of the secondary folding of VGAM1432 folded precursor RNA, herein designated VGAM FOLDED PRECURSOR RNA, of VGAM1432 are further described hereinbelow with reference to Table 1.

Nucleotide sequences of host target binding sites, such as BINDING SITE-I, BINDING SITE-II and BINDING SITE-III of FIG. 1, found on VGAM1432 host target RNA, and schematic representation of the complementarity of each of these host target binding sites to VGAM1432 RNA, herein designated VGAM RNA, are described hereinbelow with reference to Table 2.

As mentioned hereinabove with reference to FIG. 1, a function of VGAM1432 gene, herein designated VGAM is inhibition of expression of VGAM1432 target genes. It is appreciated that specific functions, and accordingly utilities, of VGAM1432 correlate with, and may be deduced from, the identity of the target genes which VGAM1432 binds and inhibits, and the function of these target genes, as elaborated hereinbelow.

Cell Division Cycle 42 (GTP binding protein, 25 kDa) (CDC42, Accession NM_001791) is a VGAM1432 host target gene. CDC42 BINDING SITE is HOST TARGET binding site found in the 3' untranslated region of mRNA encoded by CDC42, corresponding to a HOST TARGET binding site such as BINDING SITE I, BINDING SITE II or BINDING SITE III. Table 2 illustrates the complementarity of the nucleotide sequences of CDC42 BINDING SITE, designated SEQ ID:7541, to the nucleotide sequence of VGAM1432 RNA, herein designated VGAM RNA, also designated SEQ ID:4143.

A function of VGAM1432 is therefore inhibition of Cell Division Cycle 42 (GTP binding protein, 25 kDa) (CDC42, Accession NM_001791). Accordingly, utilities of VGAM1432 include diagnosis, prevention and treatment of diseases and clinical conditions associated with CDC42. Inositol Polyphosphate-5-phosphatase, 40 kDa (INPP5A, Accession NM_005539) is another VGAM1432 host target gene. INPP5A BINDING SITE is HOST TARGET binding site found in the 3' untranslated region of mRNA encoded by INPP5A, corresponding to a HOST TARGET binding site such as BINDING SITE I, BINDING SITE II or BINDING SITE III. Table 2 illustrates the complementarity of the nucleotide sequences of INPP5A BINDING SITE, designated SEQ ID:12065, to the nucleotide sequence of VGAM1432 RNA, herein designated VGAM RNA, also designated SEQ ID:4143.

Another function of VGAM1432 is therefore inhibition of Inositol Polyphosphate-5-phosphatase, 40 kDa (INPP5A, Accession NM_005539), a gene which hydrolyzes the calcium-mobilizing second messenger ins (1,4,5) p3. Accordingly, utilities of VGAM1432 include diagnosis, prevention and treatment of diseases and clinical conditions associated with INPP5A. The function of INPP5A and its association with various diseases and clinical conditions, has been established by previous studies, as described hereinabove with reference to VGAM1305. Kinesin Family Member 5C (KIF5C, Accession NM_004522) is another VGAM1432 host target gene. KIF5C BINDING SITE is HOST TARGET binding site found in the 3' untranslated region of mRNA encoded by KIF5C, corresponding to a HOST TARGET binding site such as BINDING SITE I, BINDING SITE II or BINDING SITE III. Table 2 illustrates the complementarity of the nucleotide sequences of KIF5C BINDING SITE, designated SEQ ID:10860, to the nucleotide sequence of VGAM1432 RNA, herein designated VGAM RNA, also designated SEQ ID:4143.

Another function of VGAM1432 is therefore inhibition of Kinesin Family Member 5C (KIF5C, Accession NM_004522). Accordingly, utilities of VGAM1432 include diagnosis, prevention and treatment of diseases and clinical conditions associated with KIF5C. Muscleblind-like (Drosophila) (MBNL, Accession NM_021038) is another VGAM1432 host target gene. MBNL BINDING SITE is HOST TARGET binding site found in the 3' untranslated region of mRNA encoded by MBNL, corresponding to a HOST TARGET binding site such as BINDING SITE I, BINDING SITE II or BINDING SITE III. Table 2 illustrates the complementarity of the nucleotide sequences of MBNL BINDING SITE, designated SEQ ID:22025, to the nucleotide sequence of VGAM1432 RNA, herein designated VGAM RNA, also designated SEQ ID:4143.

Another function of VGAM1432 is therefore inhibition of Muscleblind-like (Drosophila) (MBNL, Accession NM_021038), a gene which binds to cug triplet repeat expansion dsrna (by similarity). Accordingly, utilities of VGAM1432 include diagnosis, prevention and treatment of diseases and clinical conditions associated with MBNL. The function of MBNL and its association with various diseases and clinical conditions, has been established by previous studies, as described hereinabove with reference to VGAM95. Requiem, Apoptosis Response Zinc Finger Gene (REQ, Accession NM_006268) is another VGAM1432 host target gene. REQ BINDING SITE is HOST TARGET binding site found in the 3' untranslated region of mRNA encoded by REQ, corresponding to a HOST TARGET binding site such as BINDING SITE I, BINDING SITE II or BINDING SITE III. Table 2 illustrates the complementarity of the nucleotide sequences of REQ BINDING SITE, designated SEQ ID:12949, to the nucleotide sequence of VGAM1432 RNA, herein designated VGAM RNA, also designated SEQ ID:4143.

Another function of VGAM1432 is therefore inhibition of Requiem, Apoptosis Response Zinc Finger Gene (REQ, Accession NM_006268), a gene which is a putative zinc finger that is required for apoptosis in murine myeloid cell lines. Accordingly, utilities of VGAM1432 include diagnosis, prevention and treatment of diseases and clinical conditions associated with REQ. The function of REQ and its association with various diseases and clinical conditions, has been established by previous studies, as described hereinabove with reference to VGAM1224. SH3-domain Binding Protein 4 (SH3BP4, Accession NM_014521) is another VGAM1432 host target gene. SH3BP4 BINDING SITE is HOST TARGET binding site found in the 3' untranslated region of mRNA encoded by SH3BP4, corresponding to a HOST TARGET binding site such as BINDING SITE I, BINDING SITE II or BINDING SITE III. Table 2 illustrates the complementarity of the nucleotide sequences of SH3BP4 BINDING SITE, designated SEQ ID:15851, to the nucleotide sequence of VGAM1432 RNA, herein designated VGAM RNA, also designated SEQ ID:4143.

Another function of VGAM1432 is therefore inhibition of SH3-domain Binding Protein 4 (SH3BP4, Accession NM_014521), a gene which is of unknown function, contains SH3-domain binding protein 4; similar to the EH-binding protein. Accordingly, utilities of VGAM1432 include diagnosis, prevention and treatment of diseases and clinical conditions associated with SH3BP4. The function of SH3BP4 and its association with various diseases and clinical conditions, has been established by previous studies, as described hereinabove with reference to VGAM179. Transducin (beta)-like 1X-linked (TBL1X, Accession NM_005647) is another VGAM1432 host target gene. TBL1X BINDING SITE is HOST TARGET binding site found in the 3' untranslated region of mRNA encoded by TBL1X, corresponding to a HOST TARGET binding site such as BINDING SITE I, BINDING SITE II or BINDING SITE III. Table 2 illustrates the complementarity of the nucleotide sequences of TBL1X BINDING SITE, designated SEQ ID:12179, to the nucleotide sequence of VGAM1432 RNA, herein designated VGAM RNA, also designated SEQ ID:4143.

Another function of VGAM1432 is therefore inhibition of Transducin (beta)-like 1X-linked (TBL1X, Accession NM_005647), a gene which activates latent HDAC3 activity. Accordingly, utilities of VGAM1432 include diagnosis, prevention and treatment of diseases and clinical conditions associated with TBL1X. The function of TBL1X and its association with various diseases and clinical conditions, has been established by previous studies, as described hereinabove with reference to VGAM1151. Echinoderm Microtubule Associated Protein Like 4 (EML4, Accession NM_019063) is another VGAM1432 host target gene. EML4 BINDING SITE is HOST TARGET binding site found in the 3' untranslated region of mRNA encoded by EML4, corresponding to a HOST TARGET binding site such as BINDING SITE I, BINDING SITE II or BINDING SITE III. Table 2 illustrates the complementarity of the nucleotide sequences of EML4 BINDING SITE, designated SEQ ID:21142, to the nucleotide sequence of VGAM1432 RNA, herein designated VGAM RNA, also designated SEQ ID:4143.

Another function of VGAM1432 is therefore inhibition of Echinoderm Microtubule Associated Protein Like 4 (EML4, Accession NM_019063). Accordingly, utilities of VGAM1432 include diagnosis, prevention and treatment of diseases and clinical conditions associated with EML4. FLJ00007 (Accession XM_048928) is another VGAM1432 host target gene. FLJ00007 BINDING SITE is HOST TARGET binding site found in the 3' untranslated region of mRNA encoded by FLJ00007, corresponding to a HOST TARGET binding site such as BINDING SITE I, BINDING SITE II or BINDING SITE III. Table 2 illustrates the complementarity of the nucleotide sequences of FLJ00007 BINDING SITE, designated SEQ ID:35307, to the nucleotide sequence of VGAM1432 RNA, herein designated VGAM RNA, also designated SEQ ID:4143.

Another function of VGAM1432 is therefore inhibition of FLJ00007 (Accession XM_048928). Accordingly, utilities of VGAM1432 include diagnosis, prevention and treatment of diseases and clinical conditions associated with FLJ00007. FLJ21302 (Accession NM_022901) is another VGAM1432 host target gene. FLJ21302 BINDING SITE is HOST TARGET binding site found in the 3' untranslated region of mRNA encoded by FLJ21302, corresponding to a HOST TARGET binding site such as BINDING SITE I, BINDING SITE II or BINDING SITE III. Table 2 illustrates the complementarity of the nucleotide sequences of FLJ21302 BINDING SITE, designated SEQ ID:23182, to the nucleotide sequence of VGAM1432 RNA, herein designated VGAM RNA, also designated SEQ ID:4143.

Another function of VGAM1432 is therefore inhibition of FLJ21302 (Accession NM_022901). Accordingly, utilities of VGAM1432 include diagnosis, prevention and treatment of diseases and clinical conditions associated with FLJ21302. FLJ22596 (Accession NM_025086) is another VGAM1432 host target gene. FLJ22596 BINDING SITE is HOST TARGET binding site found in the 5' untranslated region of mRNA encoded by FLJ22596, corresponding to a HOST TARGET binding site such as BINDING SITE I, BINDING SITE II or BINDING SITE III. Table 2 illustrates the complementarity of the nucleotide sequences of FLJ22596 BINDING SITE, designated SEQ ID:24702, to the nucleotide sequence of VGAM1432 RNA, herein designated VGAM RNA, also designated SEQ ID:4143.

Another function of VGAM1432 is therefore inhibition of FLJ22596 (Accession NM_025086). Accordingly, utilities of VGAM1432 include diagnosis, prevention and treatment of diseases and clinical conditions associated with FLJ22596. FLJ22625 (Accession NM_024715) is another VGAM1432 host target gene. FLJ22625 BINDING SITE is HOST TARGET binding site found in the 3' untranslated region of mRNA encoded by FLJ22625, corresponding to a HOST TARGET binding site such as BINDING SITE I, BINDING SITE II or BINDING SITE III. Table 2 illustrates the complementarity of the nucleotide sequences of FLJ22625 BINDING SITE, designated SEQ ID:24041, to the nucleotide sequence of VGAM1432 RNA, herein designated VGAM RNA, also designated SEQ ID:4143.

Another function of VGAM1432 is therefore inhibition of FLJ22625 (Accession NM_024715). Accordingly, utilities of VGAM1432 include diagnosis, prevention and treatment of diseases and clinical conditions associated with FLJ22625. FLJ23462 (Accession NM_024843) is another VGAM1432 host target gene. FLJ23462 BINDING SITE is HOST TARGET binding site found in the 3' untranslated region of mRNA encoded by FLJ23462, corresponding to a HOST TARGET binding site such as BINDING SITE I, BINDING SITE II or BINDING SITE III. Table 2 illustrates the complementarity of the nucleotide sequences of FLJ23462 BINDING SITE, designated SEQ ID:24261, to the nucleotide sequence of VGAM1432 RNA, herein designated VGAM RNA, also designated SEQ ID:4143.

Another function of VGAM1432 is therefore inhibition of FLJ23462 (Accession NM_024843). Accordingly, utilities of VGAM1432 include diagnosis, prevention and treatment of diseases and clinical conditions associated with FLJ23462.

KIAA1879 (Accession XM_056635) is another VGAM1432 host target gene. KIAA1879 BINDING SITE is HOST TARGET binding site found in the 5' untranslated region of mRNA encoded by KIAA1879, corresponding to a HOST TARGET binding site such as BINDING SITE I, BINDING SITE II or BINDING SITE III. Table 2 illustrates the complementarity of the nucleotide sequences of KIAA1879 BINDING SITE, designated SEQ ID:36411, to the nucleotide sequence of VGAM1432 RNA, herein designated VGAM RNA, also designated SEQ ID:4143.

Another function of VGAM1432 is therefore inhibition of KIAA1879 (Accession XM_056635). Accordingly, utilities of VGAM1432 include diagnosis, prevention and treatment of diseases and clinical conditions associated with KIAA1879. KOC1 (Accession XM_165847) is another VGAM1432 host target gene. KOC1 BINDING SITE is HOST TARGET binding site found in the 5' untranslated region of mRNA encoded by KOC1, corresponding to a HOST TARGET binding site such as BINDING SITE I, BINDING SITE II or BINDING SITE III. Table 2 illustrates the complementarity of the nucleotide sequences of KOC1 BINDING SITE, designated SEQ ID:43778, to the nucleotide sequence of VGAM1432 RNA, herein designated VGAM RNA, also designated SEQ ID:4143.

Another function of VGAM1432 is therefore inhibition of KOC1 (Accession XM_165847). Accordingly, utilities of VGAM1432 include diagnosis, prevention and treatment of diseases and clinical conditions associated with KOC1. MYLE (Accession NM_014015) is another VGAM1432 host target gene. MYLE BINDING SITE is HOST TARGET binding site found in the 3' untranslated region of mRNA encoded by MYLE, corresponding to a HOST TARGET binding site such as BINDING SITE I, BINDING SITE II or BINDING SITE III. Table 2 illustrates the complementarity of the nucleotide sequences of MYLE BINDING SITE, designated SEQ ID:15234, to the nucleotide sequence of VGAM1432 RNA, herein designated VGAM RNA, also designated SEQ ID:4143.

Another function of VGAM1432 is therefore inhibition of MYLE (Accession NM_014015). Accordingly, utilities of VGAM1432 include diagnosis, prevention and treatment of diseases and clinical conditions associated with MYLE. RAB40B, Member RAS Oncogene Family (RAB40B, Accession NM_006822) is another VGAM1432 host target gene. RAB40B BINDING SITE is HOST TARGET binding site found in the 3' untranslated region of mRNA encoded by RAB40B, corresponding to a HOST TARGET binding site such as BINDING SITE I, BINDING SITE II or BINDING SITE III. Table 2 illustrates the complementarity of the nucleotide sequences of RAB40B BINDING SITE, designated SEQ ID:13694, to the nucleotide sequence of VGAM1432 RNA, herein designated VGAM RNA, also designated SEQ ID:4143.

Another function of VGAM1432 is therefore inhibition of RAB40B, Member RAS Oncogene Family (RAB40B, Accession NM_006822). Accordingly, utilities of VGAM1432 include diagnosis, prevention and treatment of diseases and clinical conditions associated with RAB40B. YKT6 (Accession NM_006555) is another VGAM1432 host target gene. YKT6 BINDING SITE is HOST TARGET binding site found in the 3' untranslated region of mRNA encoded by YKT6, corresponding to a HOST TARGET binding site such as BINDING SITE I, BINDING SITE II or BINDING SITE III. Table 2 illustrates the complementarity of the nucleotide sequences of YKT6 BINDING SITE, designated SEQ ID:13319, to the nucleotide sequence of VGAM1432 RNA, herein designated VGAM RNA, also designated SEQ ID:4143.

Another function of VGAM1432 is therefore inhibition of YKT6 (Accession NM_006555). Accordingly, utilities of VGAM1432 include diagnosis, prevention and treatment of diseases and clinical conditions associated with YKT6. LOC122970 (Accession XM_058672) is another VGAM1432 host target gene. LOC122970 BINDING SITE is HOST TARGET binding site found in the 3' untranslated region of mRNA encoded by LOC122970, corresponding to a HOST TARGET binding site such as BINDING SITE I, BINDING SITE II or BINDING SITE III. Table 2 illustrates the complementarity of the nucleotide sequences of LOC122970 BINDING SITE, designated SEQ ID:36714, to the nucleotide sequence of VGAM1432 RNA, herein designated VGAM RNA, also designated SEQ ID:4143.

Another function of VGAM1432 is therefore inhibition of LOC122970 (Accession XM_058672). Accordingly, utilities of VGAM1432 include diagnosis, prevention and treatment of diseases and clinical conditions associated with LOC122970. LOC149992 (Accession XM_086756) is another VGAM1432 host target gene. LOC149992 BINDING SITE is HOST TARGET binding site found in the 5' untranslated region of mRNA encoded by LOC149992, corresponding to a HOST TARGET binding site such as BINDING SITE I, BINDING SITE II or BINDING SITE III. Table 2 illustrates the complementarity of the nucleotide sequences of LOC149992 BINDING SITE, designated SEQ ID:38842, to the nucleotide sequence of VGAM1432 RNA, herein designated VGAM RNA, also designated SEQ ID:4143.

Another function of VGAM1432 is therefore inhibition of LOC149992 (Accession XM_086756). Accordingly, utilities of VGAM1432 include diagnosis, prevention and treatment of diseases and clinical conditions associated with LOC149992. LOC153339 (Accession XM_098362) is another VGAM1432 host target gene. LOC153339 BINDING SITE is HOST TARGET binding site found in the 5' untranslated region of mRNA encoded by LOC153339, corresponding to a HOST TARGET binding site such as BINDING SITE I, BINDING SITE II or BINDING SITE III. Table 2 illustrates the complementarity of the nucleotide sequences of LOC153339 BINDING SITE, designated SEQ ID:41613, to the nucleotide sequence of VGAM1432 RNA, herein designated VGAM RNA, also designated SEQ ID:4143.

Another function of VGAM1432 is therefore inhibition of LOC153339 (Accession XM_098362). Accordingly, utilities of VGAM1432 include diagnosis, prevention and treatment of diseases and clinical conditions associated with LOC153339. LOC153910 (Accession XM_087801) is another VGAM1432 host target gene. LOC153910 BINDING SITE is HOST TARGET binding site found in the 3' untranslated region of mRNA encoded by LOC153910, corresponding to a HOST TARGET binding site such as BINDING SITE I, BINDING SITE II or BINDING SITE III. Table 2 illustrates the complementarity of the nucleotide sequences of LOC153910 BINDING SITE, designated SEQ ID:39438, to the nucleotide sequence of VGAM1432 RNA, herein designated VGAM RNA, also designated SEQ ID:4143.

Another function of VGAM1432 is therefore inhibition of LOC153910 (Accession XM_087801). Accordingly, utilities of VGAM1432 include diagnosis, prevention and treatment of diseases and clinical conditions associated with LOC153910. LOC196955 (Accession XM_085210) is another VGAM1432 host target gene. LOC196955 BINDING SITE is HOST TARGET binding site found in the 3' untranslated region of mRNA encoded by LOC196955, corresponding to a HOST TARGET binding site such as BINDING- ING SITE I, BINDING SITE II or BINDING SITE III. Table 2 illustrates the complementarity of the nucleotide sequences of LOC196955 BINDING SITE, designated SEQ ID:37932, to the nucleotide sequence of VGAM1432 RNA, herein designated VGAM RNA, also designated SEQ ID:4143.

Another function of VGAM1432 is therefore inhibition of LOC196955 (Accession XM_085210). Accordingly, utilities of VGAM1432 include diagnosis, prevention and treatment of diseases and clinical conditions associated with LOC196955. LOC202347 (Accession XM_117390) is another VGAM1432 host target gene. LOC202347 BINDING SITE is HOST TARGET binding site found in the 3' untranslated region of mRNA encoded by LOC202347, corresponding to a HOST TARGET binding site such as BINDING SITE I, BINDING SITE II or BINDING SITE III. Table 2 illustrates the complementarity of the nucleotide sequences of LOC202347 BINDING SITE, designated SEQ ID:43430, to the nucleotide sequence of VGAM1432 RNA, herein designated VGAM RNA, also designated SEQ ID:4143.

Another function of VGAM1432 is therefore inhibition of LOC202347 (Accession XM_117390). Accordingly, utilities of VGAM1432 include diagnosis, prevention and treatment of diseases and clinical conditions associated with LOC202347. LOC219401 (Accession XM_166706) is another VGAM1432 host target gene. LOC219401 BINDING SITE is HOST TARGET binding site found in the 3' untranslated region of mRNA encoded by LOC219401, corresponding to a HOST TARGET binding site such as BINDING SITE I, BINDING SITE II or BINDING SITE III. Table 2 illustrates the complementarity of the nucleotide sequences of LOC219401 BINDING SITE, designated SEQ ID:44590, to the nucleotide sequence of VGAM1432 RNA, herein designated VGAM RNA, also designated SEQ ID:4143.

Another function of VGAM1432 is therefore inhibition of LOC219401 (Accession XM_166706). Accordingly, utilities of VGAM1432 include diagnosis, prevention and treatment of diseases and clinical conditions associated with LOC219401. LOC255012 (Accession XM_171369) is another VGAM1432 host target gene. LOC255012 BINDING SITE is HOST TARGET binding site found in the 5' untranslated region of mRNA encoded by LOC255012, corresponding to a HOST TARGET binding site such as BINDING SITE I, BINDING SITE II or BINDING SITE III. Table 2 illustrates the complementarity of the nucleotide sequences of LOC255012 BINDING SITE, designated SEQ ID:46043, to the nucleotide sequence of VGAM1432 RNA, herein designated VGAM RNA, also designated SEQ ID:4143.

Another function of VGAM1432 is therefore inhibition of LOC255012 (Accession XM_171369). Accordingly, utilities of VGAM1432 include diagnosis, prevention and treatment of diseases and clinical conditions associated with LOC255012. LOC255096 (Accession XM_174913) is another VGAM1432 host target gene. LOC255096 BINDING SITE is HOST TARGET binding site found in the 5' untranslated region of mRNA encoded by LOC255096, corresponding to a HOST TARGET binding site such as BINDING SITE I, BINDING SITE II or BINDING SITE III. Table 2 illustrates the complementarity of the nucleotide sequences of LOC255096 BINDING SITE, designated SEQ ID:46606, to the nucleotide sequence of VGAM1432 RNA, herein designated VGAM RNA, also designated SEQ ID:4143.

Another function of VGAM1432 is therefore inhibition of LOC255096 (Accession XM_174913). Accordingly, utilities of VGAM1432 include diagnosis, prevention and treatment of diseases and clinical conditions associated with LOC255096. LOC90309 (Accession XM_030830) is another VGAM1432 host target gene. LOC90309 BINDING SITE is HOST TARGET binding site found in the 5' untranslated region of mRNA encoded by LOC90309, corresponding to a HOST TARGET binding site such as BINDING SITE I, BINDING SITE II or BINDING SITE III. Table 2 illustrates the complementarity of the nucleotide sequences of LOC90309 BINDING SITE, designated SEQ ID:31150, to the nucleotide sequence of VGAM1432 RNA, herein designated VGAM RNA, also designated SEQ ID:4143.

Another function of VGAM1432 is therefore inhibition of LOC90309 (Accession XM_030830). Accordingly, utilities of VGAM1432 include diagnosis, prevention and treatment of diseases and clinical conditions associated with LOC90309. FIG. 1 further provides a conceptual description of a novel bioinformatically detected viral gene of the present invention, referred to here as Viral Genomic Address Messenger 1433 (VGAM1433) viral gene, which modulates expression of respective host target genes thereof, the function and utility of which host target genes is known in the art.

VGAM1433 is a novel bioinformatically detected regulatory, non protein coding, viral micro RNA (miRNA) gene. The method by which VGAM1433 was detected is described hereinabove with reference to FIGS. 1-8.

VGAM1433 gene, herein designated VGAM GENE, is a viral gene contained in the genome of Potato Virus A. VGAM1433 host target gene, herein designated VGAM HOST TARGET GENE, is a human gene contained in the human genome.

VGAM1433 gene encodes a VGAM1433 precursor RNA, herein designated VGAM PRECURSOR RNA. Similar to other miRNA genes, and unlike most ordinary genes, VGAM1433 precursor RNA does not encode a protein. A nucleotide sequence identical or highly similar to the nucleotide sequence of VGAM1433 precursor RNA is designated SEQ ID:1419, and is provided hereinbelow with reference to the sequence listing part. Nucleotide sequence SEQ ID:1419 is located at position 3612 relative to the genome of Potato Virus A.

VGAM1433 precursor RNA folds onto itself, forming VGAM1433 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1433 folded precursor RNA into VGAM1433 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1433 RNA is designated SEQ ID:4144, and is provided hereinbelow with reference to the sequence listing part.

VGAM1433 host target gene, herein designated VGAM HOST TARGET GENE, encodes a corresponding messenger RNA, VGAM1433 host target RNA, herein designated VGAM HOST TARGET RNA. VGAM1433 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1433 RNA, herein designated VGAM RNA, binds complementarily to one or more host target binding sites located in untranslated regions of VGAM1433 host target RNA, herein designated VGAM HOST TARGET RNA. This complementary binding is due to the fact that the nucleotide sequence of VGAM1433 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1433 RNA, herein designated VGAM RNA, may have a different number of host target binding sites in untranslated regions of a VGAM1433 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1433 RNA, herein designated VGAM RNA, to host target binding sites on VGAM1433 host target RNA, herein designated VGAM HOST TARGET RNA, such as BINDING SITE I, BINDING SITE II and BINDING SITE III, inhibits translation of VGAM1433 host target RNA into VGAM1433 host target protein, herein designated VGAM HOST TARGET PROTEIN. VGAM host target protein is therefore outlined by a broken line.

It is appreciated that VGAM1433 host target gene, herein designated VGAM HOST TARGET GENE, in fact represents a plurality of VGAM1433 host target genes. The mRNA of each one of this plurality of VGAM1433 host target genes comprises one or more host target binding sites, each having a nucleotide sequence which is at least partly complementary to VGAM1433 RNA, herein designated VGAM RNA, and which when bound by VGAM1433 RNA causes inhibition of translation of respective one or more VGAM1433 host target proteins.

It is further appreciated by one skilled in the art that the mode of translational inhibition illustrated by FIG. 1 with specific reference to translational inhibition exerted by VGAM1433 gene, herein designated VGAM GENE, on one or more VGAM1433 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1433 is inhibition of expression of host target genes, as part of a novel viral mechanism of attacking a host. Accordingly, utilities of VGAM1433 include diagnosis, prevention and treatment of viral infection by Potato Virus A. Specific functions, and accordingly utilities, of VGAM1433 correlate with, and may be deduced from, the identity of the host target genes which VGAM1433 binds and inhibits, and the function of these host target genes, as elaborated hereinbelow.

Nucleotide sequences of the VGAM1433 precursor RNA, herein designated VGAM PRECURSOR RNA, and of the 'diced' VGAM1433 RNA, herein designated VGAM RNA, and a schematic representation of the secondary folding of VGAM1433 folded precursor RNA, herein designated VGAM FOLDED PRECURSOR RNA, of VGAM1433 are further described hereinbelow with reference to Table 1.

Nucleotide sequences of host target binding sites, such as BINDING SITE-I, BINDING SITE-II and BINDING SITE-III of FIG. 1, found on VGAM1433 host target RNA, and schematic representation of the complementarity of each of these host target binding sites to VGAM1433 RNA, herein designated VGAM RNA, are described hereinbelow with reference to Table 2.

As mentioned hereinabove with reference to FIG. 1, a function of VGAM1433 gene, herein designated VGAM is inhibition of expression of VGAM1433 target genes. It is appreciated that specific functions, and accordingly utilities, of VGAM1433 correlate with, and may be deduced from, the identity of the target genes which VGAM1433 binds and inhibits, and the function of these target genes, as elaborated hereinbelow.

B-cell CLL/lymphoma 2 (BCL2, Accession NM_000633) is a VGAM1433 host target gene. BCL2 BINDING SITE is HOST TARGET binding site found in the 3' untranslated region of mRNA encoded by BCL2, corresponding to a HOST TARGET binding site such as BINDING SITE I, BINDING SITE II or BINDING SITE III. Table 2 illustrates the complementarity of the nucleotide sequences of BCL2 BINDING SITE, designated SEQ ID:6264, to the nucleotide sequence of VGAM1433 RNA, herein designated VGAM RNA, also designated SEQ ID:4144.

A function of VGAM1433 is therefore inhibition of B-cell CLL/lymphoma 2 (BCL2, Accession NM_000633). Accordingly, utilities of VGAM1433 include diagnosis, prevention and treatment of diseases and clinical conditions associated with BCL2. Norrie Disease (pseudoglioma) (NDP, Accession NM_000266) is another VGAM1433 host target gene. NDP BINDING SITE is HOST TARGET binding site found in the 3' untranslated region of mRNA encoded by NDP, corresponding to a HOST TARGET binding site such as BINDING SITE I, BINDING SITE II or BINDING SITE III. Table 2 illustrates the complementarity of the nucleotide sequences of NDP BINDING SITE, designated SEQ ID:5806, to the nucleotide sequence of VGAM1433 RNA, herein designated VGAM RNA, also designated SEQ ID:4144.

Another function of VGAM1433 is therefore inhibition of Norrie Disease (pseudoglioma) (NDP, Accession NM_000266), a gene which may be involved in a pathway that regulates neural cell differentiation and proliferation. Accordingly, utilities of VGAM1433 include diagnosis, prevention and treatment of diseases and clinical conditions associated with NDP. The function of NDP and its association with various diseases and clinical conditions, has been established by previous studies, as described hereinabove with reference to VGAM113. Regulatory Factor X, 5 (influences HLA class II expression) (RFX5, Accession NM_000449) is another VGAM1433 host target gene. RFX5 BINDING SITE is HOST TARGET binding site found in the 3' untranslated region of mRNA encoded by RFX5, corresponding to a HOST TARGET binding site such as BINDING SITE I, BINDING SITE II or BINDING SITE III. Table 2 illustrates the complementarity of the nucleotide sequences of RFX5 BINDING SITE, designated SEQ ID:6050, to the nucleotide sequence of VGAM1433 RNA, herein designated VGAM RNA, also designated SEQ ID:4144.

Another function of VGAM1433 is therefore inhibition of Regulatory Factor X, 5 (influences HLA class II expression) (RFX5, Accession NM_000449), a gene which activates transcription from class ii mhc promoters. Accordingly, utilities of VGAM1433 include diagnosis, prevention and treatment of diseases and clinical conditions associated with RFX5. The function of RFX5 and its association with various diseases and clinical conditions, has been established by previous studies, as described hereinabove with reference to VGAM55. FLJ21148 (Accession NM_024860) is another VGAM1433 host target gene. FLJ21148 BINDING SITE is HOST TARGET binding site found in the 3' untranslated region of mRNA encoded by FLJ21148, corresponding to a HOST TARGET binding site such as BINDING SITE I, BINDING SITE II or BINDING SITE III. Table 2 illustrates the complementarity of the nucleotide sequences of FLJ21148 BINDING SITE, designated SEQ ID:24293, to the nucleotide sequence of VGAM1433 RNA, herein designated VGAM RNA, also designated SEQ ID:4144.

Another function of VGAM1433 is therefore inhibition of FLJ21148 (Accession NM_024860). Accordingly, utilities of VGAM1433 include diagnosis, prevention and treatment of diseases and clinical conditions associated with FLJ21148. KIAA1671 (Accession XM_037809) is another VGAM1433 host target gene. KIAA1671 BINDING SITE is HOST TARGET binding site found in the 3' untranslated region of mRNA encoded by KIAA1671, corresponding to a HOST TARGET binding site such as BINDING SITE I, BINDING SITE II or BINDING SITE III. Table 2 illustrates the complementarity of the nucleotide sequences of KIAA1671 BINDING SITE, designated SEQ ID:32691, to the nucleotide sequence of VGAM1433 RNA, herein designated VGAM RNA, also designated SEQ ID:4144.

Another function of VGAM1433 is therefore inhibition of KIAA1671 (Accession XM_037809). Accordingly, utilities of VGAM1433 include diagnosis, prevention and treatment of diseases and clinical conditions associated with KIAA1671. KIAA1678 (Accession XM_051221) is another VGAM1433 host target gene. KIAA1678 BINDING SITE is HOST TARGET binding site found in the 5' untranslated region of mRNA encoded by KIAA1678, corresponding to a HOST TARGET binding site such as BINDING SITE I, BINDING SITE II or BINDING SITE III. Table 2 illustrates the complementarity of the nucleotide sequences of KIAA1678 BINDING SITE, designated SEQ ID:35789, to the nucleotide sequence of VGAM1433 RNA, herein designated VGAM RNA, also designated SEQ ID:4144.

Another function of VGAM1433 is therefore inhibition of KIAA1678 (Accession XM_051221). Accordingly, utilities of VGAM1433 include diagnosis, prevention and treatment of diseases and clinical conditions associated with KIAA1678. MGC2562 (Accession NM_032374) is another VGAM1433 host target gene. MGC2562 BINDING SITE is HOST TARGET binding site found in the 3' untranslated region of mRNA encoded by MGC2562, corresponding to a HOST TARGET binding site such as BINDING SITE I, BINDING SITE II or BINDING SITE III. Table 2 illustrates the complementarity of the nucleotide sequences of MGC2562 BINDING SITE, designated SEQ ID:26165, to the nucleotide sequence of VGAM1433 RNA, herein designated VGAM RNA, also designated SEQ ID:4144.

Another function of VGAM1433 is therefore inhibition of MGC2562 (Accession NM_032374). Accordingly, utilities of VGAM1433 include diagnosis, prevention and treatment of diseases and clinical conditions associated with MGC2562. NYD-SP25 (Accession NM_033516) is another VGAM1433 host target gene. NYD-SP25 BINDING SITE is HOST TARGET binding site found in the 3' untranslated region of mRNA encoded by NYD-SP25, corresponding to a HOST TARGET binding site such as BINDING SITE I, BINDING SITE II or BINDING SITE III. Table 2 illustrates the complementarity of the nucleotide sequences of NYD-SP25 BINDING SITE, designated SEQ ID:27293, to the nucleotide sequence of VGAM1433 RNA, herein designated VGAM RNA, also designated SEQ ID:4144.

Another function of VGAM1433 is therefore inhibition of NYD-SP25 (Accession NM_033516). Accordingly, utilities of VGAM1433 include diagnosis, prevention and treatment of diseases and clinical conditions associated with NYD-SP25. Oxysterol Binding Protein-like 3 (OSBPL3, Accession NM_015550) is another VGAM1433 host target gene. OSBPL3 BINDING SITE is HOST TARGET binding site found in the 3' untranslated region of mRNA encoded by OSBPL3, corresponding to a HOST TARGET binding site such as BINDING SITE I, BINDING SITE II or BINDING SITE III. Table 2 illustrates the complementarity of the nucleotide sequences of OSBPL3 BINDING SITE, designated SEQ ID:17814, to the nucleotide sequence of VGAM1433 RNA, herein designated VGAM RNA, also designated SEQ ID:4144.

Another function of VGAM1433 is therefore inhibition of Oxysterol Binding Protein-like 3 (OSBPL3, Accession NM_015550). Accordingly, utilities of VGAM1433 include diagnosis, prevention and treatment of diseases and clinical conditions associated with OSBPL3. PRO2958 (Accession NM_018546) is another VGAM1433 host target gene. PRO2958 BINDING SITE is HOST TARGET binding site found in the 3' untranslated region of mRNA encoded by PRO2958, corresponding to a HOST TARGET binding site such as BINDING SITE I, BINDING SITE II or BINDING SITE III. Table 2 illustrates the complementarity of the nucleotide sequences of PRO2958 BINDING SITE, designated SEQ ID:20627, to the nucleotide sequence of VGAM1433 RNA, herein designated VGAM RNA, also designated SEQ ID:4144.

Another function of VGAM1433 is therefore inhibition of PRO2958 (Accession NM_018546). Accordingly, utilities of VGAM1433 include diagnosis, prevention and treatment of diseases and clinical conditions associated with PRO2958. Retinoic Acid Induced 17 (RAI17, Accession XM_166091) is another VGAM1433 host target gene. RAI17 BINDING SITE is HOST TARGET binding site found in the 3' untranslated region of mRNA encoded by RAI17, corresponding to a HOST TARGET binding site such as BINDING SITE I, BINDING SITE II or BINDING SITE III. Table 2 illustrates the complementarity of the nucleotide sequences of RAI17 BINDING SITE, designated SEQ ID:43858, to the nucleotide sequence of VGAM1433 RNA, herein designated VGAM RNA, also designated SEQ ID:4144.

Another function of VGAM1433 is therefore inhibition of Retinoic Acid Induced 17 (RAI17, Accession XM_166091). Accordingly, utilities of VGAM1433 include diagnosis, prevention and treatment of diseases and clinical conditions associated with RAI17. LOC145508 (Accession XM_085158) is another VGAM1433 host target gene. LOC145508 BINDING SITE is HOST TARGET binding site found in the 3' untranslated region of mRNA encoded by LOC145508, corresponding to a HOST TARGET binding site such as BINDING SITE I, BINDING SITE II or BINDING SITE III. Table 2 illustrates the complementarity of the nucleotide sequences of LOC145508 BINDING SITE, designated SEQ ID:37888, to the nucleotide sequence of VGAM1433 RNA, herein designated VGAM RNA, also designated SEQ ID:4144.

Another function of VGAM1433 is therefore inhibition of LOC145508 (Accession XM_085158). Accordingly, utilities of VGAM1433 include diagnosis, prevention and treatment of diseases and clinical conditions associated with LOC145508. LOC149566 (Accession XM_097670) is another VGAM1433 host target gene. LOC149566 BINDING SITE is HOST TARGET binding site found in the 5' untranslated region of mRNA encoded by LOC149566, corresponding to a HOST TARGET binding site such as BINDING SITE I, BINDING SITE II or BINDING SITE III. Table 2 illustrates the complementarity of the nucleotide sequences of LOC149566 BINDING SITE, designated SEQ ID:41017, to the nucleotide sequence of VGAM1433 RNA, herein designated VGAM RNA, also designated SEQ ID:4144.

Another function of VGAM1433 is therefore inhibition of LOC149566 (Accession XM_097670). Accordingly, utilities of VGAM1433 include diagnosis, prevention and treatment of diseases and clinical conditions associated with LOC149566. LOC253639 (Accession XM_171060) is another VGAM1433 host target gene. LOC253639 BINDING SITE is HOST TARGET binding site found in the 3' untranslated region of mRNA encoded by LOC253639, corresponding to a HOST TARGET binding site such as BINDING SITE I, BINDING SITE II or BINDING SITE III. Table 2 illustrates the complementarity of the nucleotide sequences of LOC253639 BINDING SITE, designated SEQ ID:45856, to the nucleotide sequence of VGAM1433 RNA, herein designated VGAM RNA, also designated SEQ ID:4144.

Another function of VGAM1433 is therefore inhibition of LOC253639 (Accession XM_171060). Accordingly, utilities of VGAM1433 include diagnosis, prevention and treatment of diseases and clinical conditions associated with LOC253639. FIG. 1 further provides a conceptual description of a novel bioinformatically detected viral gene of the present invention, referred to here as Viral Genomic Address Messenger 1434 (VGAM1434) viral gene, which modulates expression of respective host target genes thereof, the function and utility of which host target genes is known in the art.

VGAM1434 is a novel bioinformatically detected regulatory, non protein coding, viral micro RNA (miRNA) gene. The method by which VGAM1434 was detected is described hereinabove with reference to FIGS. 1-8.

VGAM1434 gene, herein designated VGAM GENE, is a viral gene contained in the genome of Potato Virus A. VGAM1434 host target gene, herein designated VGAM HOST TARGET GENE, is a human gene contained in the human genome.

VGAM1434 gene encodes a VGAM1434 precursor RNA, herein designated VGAM PRECURSOR RNA. Similar to other miRNA genes, and unlike most ordinary genes, VGAM1434 precursor RNA does not encode a protein. A nucleotide sequence identical or highly similar to the nucleotide sequence of VGAM1434 precursor RNA is designated SEQ ID:1420, and is provided hereinbelow with reference to the sequence listing part. Nucleotide sequence SEQ ID:1420 is located at position 3882 relative to the genome of Potato Virus A.

VGAM1434 precursor RNA folds onto itself, forming VGAM1434 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1434 folded precursor RNA into VGAM1434 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1434 RNA is designated SEQ ID:4145, and is provided hereinbelow with reference to the sequence listing part.

VGAM1434 host target gene, herein designated VGAM HOST TARGET GENE, encodes a corresponding messenger RNA, VGAM1434 host target RNA, herein designated VGAM HOST TARGET RNA. VGAM1434 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1434 RNA, herein designated VGAM RNA, binds complementarily to one or more host target binding sites located in untranslated regions of VGAM1434 host target RNA, herein designated VGAM HOST TARGET RNA. This complementary binding is due to the fact that the nucleotide sequence of VGAM1434 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1434 RNA, herein designated VGAM RNA, may have a different number of host target binding sites in untranslated regions of a VGAM1434 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1434 RNA, herein designated VGAM RNA, to host target binding sites on VGAM1434 host target RNA, herein designated VGAM HOST TARGET RNA, such as BINDING SITE I, BINDING SITE II and BINDING SITE III, inhibits translation of VGAM1434 host target RNA into VGAM1434 host target protein, herein designated VGAM HOST TARGET PROTEIN. VGAM host target protein is therefore outlined by a broken line.

It is appreciated that VGAM1434 host target gene, herein designated VGAM HOST TARGET GENE, in fact represents a plurality of VGAM1434 host target genes. The mRNA of each one of this plurality of VGAM1434 host target genes comprises one or more host target binding sites, each having a nucleotide sequence which is at least partly complementary to VGAM1434 RNA, herein designated VGAM RNA, and which when bound by VGAM1434 RNA causes inhibition of translation of respective one or more VGAM1434 host target proteins.

It is further appreciated by one skilled in the art that the mode of translational inhibition illustrated by FIG. 1 with specific reference to translational inhibition exerted by VGAM1434 gene, herein designated VGAM GENE, on one or more VGAM1434 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1434 is inhibition of expression of host target genes, as part of a novel viral mechanism of attacking a host. Accordingly, utilities of VGAM1434 include diagnosis, prevention and treatment of viral infection by Potato Virus A. Specific functions, and accordingly utilities, of VGAM1434 correlate with, and may be deduced from, the identity of the host target genes which VGAM1434 binds and inhibits, and the function of these host target genes, as elaborated hereinbelow.

Nucleotide sequences of the VGAM1434 precursor RNA, herein designated VGAM PRECURSOR RNA, and of the 'diced' VGAM1434 RNA, herein designated VGAM RNA, and a schematic representation of the secondary folding of VGAM1434 folded precursor RNA, herein designated VGAM FOLDED PRECURSOR RNA, of VGAM1434 are further described hereinbelow with reference to Table 1.

Nucleotide sequences of host target binding sites, such as BINDING SITE-I, BINDING SITE-II and BINDING SITE-III of FIG. 1, found on VGAM1434 host target RNA, and schematic representation of the complementarity of each of these host target binding sites to VGAM1434 RNA, herein designated VGAM RNA, are described hereinbelow with reference to Table 2.

As mentioned hereinabove with reference to FIG. 1, a function of VGAM1434 gene, herein designated VGAM is inhibition of expression of VGAM1434 target genes. It is appreciated that specific functions, and accordingly utilities, of VGAM1434 correlate with, and may be deduced from, the identity of the target genes which VGAM1434 binds and inhibits, and the function of these target genes, as elaborated hereinbelow.

C-type (calcium dependent, carbohydrate-recognition domain) Lectin, Superfamily Member 5 (CLECSF5, Accession NM_013252) is a VGAM1434 host target gene. CLECSF5 BINDING SITE is HOST TARGET binding site found in the 3' untranslated region of mRNA encoded by CLECSF5, corresponding to a HOST TARGET binding site such as BINDING SITE I, BINDING SITE II or BINDING SITE III. Table 2 illustrates the complementarity of the nucleotide sequences of CLECSF5 BINDING SITE, designated SEQ ID:14916, to the nucleotide sequence of VGAM1434 RNA, herein designated VGAM RNA, also designated SEQ ID:4145.

A function of VGAM1434 is therefore inhibition of C-type (calcium dependent, carbohydrate-recognition domain) Lectin, Superfamily Member 5 (CLECSF5, Accession NM_013252). Accordingly, utilities of VGAM1434 include diagnosis, prevention and treatment of diseases and clinical conditions associated with CLECSF5. Usher Syndrome 3A (USH3A, Accession NM_052995) is another VGAM1434 host target gene. USH3A BINDING SITE is HOST TARGET binding site found in the 5' untranslated region of mRNA encoded by USH3A, corresponding to a HOST TARGET binding site such as BINDING SITE I, BINDING SITE II or BINDING SITE III. Table 2 illustrates the complementarity of the nucleotide sequences of USH3A BINDING SITE, designated SEQ ID:27563, to the nucleotide sequence of VGAM1434 RNA, herein designated VGAM RNA, also designated SEQ ID:4145.

Another function of VGAM1434 is therefore inhibition of Usher Syndrome 3A (USH3A, Accession NM_052995). Accordingly, utilities of VGAM1434 include diagnosis, prevention and treatment of diseases and clinical conditions associated with USH3A. FLJ10846 (Accession NM_018241) is another VGAM1434 host target gene. FLJ10846 BINDING SITE is HOST TARGET binding site found in the 5' untranslated region of mRNA encoded by FLJ10846, corresponding to a HOST TARGET binding site such as BINDING SITE I, BINDING SITE II or BINDING SITE III. Table 2 illustrates the complementarity of the nucleotide sequences of FLJ10846 BINDING SITE, designated SEQ ID:20197, to the nucleotide sequence of VGAM1434 RNA, herein designated VGAM RNA, also designated SEQ ID:4145.

Another function of VGAM1434 is therefore inhibition of FLJ10846 (Accession NM_018241). Accordingly, utilities of VGAM1434 include diagnosis, prevention and treatment of diseases and clinical conditions associated with FLJ10846. Mitochondrial Ribosomal Protein S35 (MRPS35, Accession NM_021821) is another VGAM1434 host target gene. MRPS35 BINDING SITE is HOST TARGET binding site found in the 3' untranslated region of mRNA encoded by MRPS35, corresponding to a HOST TARGET binding site such as BINDING SITE I, BINDING SITE II or BINDING SITE III. Table 2 illustrates the complementarity of the nucleotide sequences of MRPS35 BINDING SITE, designated SEQ ID:22400, to the nucleotide sequence of VGAM1434 RNA, herein designated VGAM RNA, also designated SEQ ID:4145.

Another function of VGAM1434 is therefore inhibition of Mitochondrial Ribosomal Protein S35 (MRPS35, Accession NM_021821). Accordingly, utilities of VGAM1434 include diagnosis, prevention and treatment of diseases and clinical conditions associated with MRPS35. Sema Domain, Immunoglobulin Domain (Ig), Transmembrane Domain (TM) and Short Cytoplasmic Domain, (semaphorin) 4F (SEMA4F, Accession NM_004263) is another VGAM1434 host target gene. SEMA4F BINDING SITE is HOST TARGET binding site found in the 3' untranslated region of mRNA encoded by SEMA4F, corresponding to a HOST TARGET binding site such as BINDING SITE I, BINDING SITE II or BINDING SITE III. Table 2 illustrates the complementarity of the nucleotide sequences of SEMA4F BINDING SITE, designated SEQ ID:10459, to the nucleotide sequence of VGAM1434 RNA, herein designated VGAM RNA, also designated SEQ ID:4145.

Another function of VGAM1434 is therefore inhibition of Sema Domain, Immunoglobulin Domain (Ig), Transmembrane Domain (TM) and Short Cytoplasmic Domain, (semaphorin) 4F (SEMA4F, Accession NM_004263). Accordingly, utilities of VGAM1434 include diagnosis, prevention and treatment of diseases and clinical conditions associated with SEMA4F. LOC90120 (Accession XM_029168) is another VGAM1434 host target gene. LOC90120 BINDING SITE is HOST TARGET binding site found in the 3' untranslated region of mRNA encoded by LOC90120, corresponding to a HOST TARGET binding site such as BINDING SITE I, BINDING SITE II or BINDING SITE III. Table 2 illustrates the complementarity of the nucleotide sequences of LOC90120 BINDING SITE, designated SEQ ID:30851, to the nucleotide sequence of VGAM1434 RNA, herein designated VGAM RNA, also designated SEQ ID:4145.

Another function of VGAM1434 is therefore inhibition of LOC90120 (Accession XM_029168). Accordingly, utilities of VGAM1434 include diagnosis, prevention and treatment of diseases and clinical conditions associated with LOC90120. FIG. 1 further provides a conceptual description of a novel bioinformatically detected viral gene of the present invention, referred to here as Viral Genomic Address Messenger 1435 (VGAM1435) viral gene, which modulates expression of respective host target genes thereof, the function and utility of which host target genes is known in the art.

VGAM1435 is a novel bioinformatically detected regulatory, non protein coding, viral micro RNA (miRNA) gene. The method by which VGAM1435 was detected is described hereinabove with reference to FIGS. 1-8.

VGAM1435 gene, herein designated VGAM GENE, is a viral gene contained in the genome of Potato Virus A. VGAM1435 host target gene, herein designated VGAM HOST TARGET GENE, is a human gene contained in the human genome.

VGAM1435 gene encodes a VGAM1435 precursor RNA, herein designated VGAM PRECURSOR RNA. Similar to other miRNA genes, and unlike most ordinary genes, VGAM1435 precursor RNA does not encode a protein. A nucleotide sequence identical or highly similar to the nucleotide sequence of VGAM1435 precursor RNA is designated SEQ ID:1421, and is provided hereinbelow with reference to the sequence listing part. Nucleotide sequence SEQ ID:1421 is located at position 7490 relative to the genome of Potato Virus A.

VGAM1435 precursor RNA folds onto itself, forming VGAM1435 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1435 folded precursor RNA into VGAM1435 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1435 RNA is designated SEQ ID:4146, and is provided hereinbelow with reference to the sequence listing part.

VGAM1435 host target gene, herein designated VGAM HOST TARGET GENE, encodes a corresponding messenger RNA, VGAM1435 host target RNA, herein designated VGAM HOST TARGET RNA. VGAM1435 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1435 RNA, herein designated VGAM RNA, binds complementarily to one or more host target binding sites located in untranslated regions of VGAM1435 host target RNA, herein designated VGAM HOST TARGET RNA. This complementary binding is due to the fact that the nucleotide sequence of VGAM1435 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1435 RNA, herein designated VGAM RNA, may have a different number of host target binding sites in untranslated regions of a VGAM1435 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1435 RNA, herein designated VGAM RNA, to host target binding sites on VGAM1435 host target RNA, herein designated VGAM HOST TARGET RNA, such as BINDING SITE I, BINDING SITE II and BINDING SITE III, inhibits translation of VGAM1435 host target RNA into VGAM1435 host target protein, herein designated VGAM HOST TARGET PROTEIN. VGAM host target protein is therefore outlined by a broken line.

It is appreciated that VGAM1435 host target gene, herein designated VGAM HOST TARGET GENE, in fact represents a plurality of VGAM1435 host target genes. The mRNA of each one of this plurality of VGAM1435 host target genes comprises one or more host target binding sites, each having a nucleotide sequence which is at least partly complementary to VGAM1435 RNA, herein designated VGAM RNA, and which when bound by VGAM1435 RNA causes inhibition of translation of respective one or more VGAM1435 host target proteins.

It is further appreciated by one skilled in the art that the mode of translational inhibition illustrated by FIG. 1 with specific reference to translational inhibition exerted by VGAM1435 gene, herein designated VGAM GENE, on one or more VGAM1435 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1435 is inhibition of expression of host target genes, as part of a novel viral mechanism of attacking a host. Accordingly, utilities of VGAM1435 include diagnosis, prevention and treatment of viral infection by Potato Virus A. Specific functions, and accordingly utilities, of VGAM1435 correlate with, and may be deduced from, the identity of the host target genes which VGAM1435 binds and inhibits, and the function of these host target genes, as elaborated hereinbelow.

Nucleotide sequences of the VGAM1435 precursor RNA, herein designated VGAM PRECURSOR RNA, and of the 'diced' VGAM1435 RNA, herein designated VGAM RNA, and a schematic representation of the secondary folding of VGAM1435 folded precursor RNA, herein designated VGAM FOLDED PRECURSOR RNA, of VGAM1435 are further described hereinbelow with reference to Table 1.

Nucleotide sequences of host target binding sites, such as BINDING SITE-I, BINDING SITE-II and BINDING SITE-III of FIG. 1, found on VGAM1435 host target RNA, and schematic representation of the complementarity of each of these host target binding sites to VGAM1435 RNA, herein designated VGAM RNA, are described hereinbelow with reference to Table 2.

As mentioned hereinabove with reference to FIG. 1, a function of VGAM1435 gene, herein designated VGAM is inhibition of expression of VGAM1435 target genes. It is appreciated that specific functions, and accordingly utilities, of VGAM1435 correlate with, and may be deduced from, the identity of the target genes which VGAM1435 binds and inhibits, and the function of these target genes, as elaborated hereinbelow.

DNA Fragmentation Factor, 40 kDa, Beta Polypeptide (caspase-activated DNase) (DFFB, Accession XM_113366) is a VGAM1435 host target gene. DFFB BINDING SITE is HOST TARGET binding site found in the 3' untranslated region of mRNA encoded by DFFB, corresponding to a HOST TARGET binding site such as BINDING SITE I, BINDING SITE II or BINDING SITE III. Table 2 illustrates the complementarity of the nucleotide sequences of DFFB BINDING SITE, designated SEQ ID:42237, to the nucleotide sequence of VGAM1435 RNA, herein designated VGAM RNA, also designated SEQ ID:4146.

A function of VGAM1435 is therefore inhibition of DNA Fragmentation Factor, 40 kDa, Beta Polypeptide (caspase-activated DNase) (DFFB, Accession XM_113366), a gene which induces DNA fragmentation and chromatin condensation during apoptosis. Accordingly, utilities of VGAM1435 include diagnosis, prevention and treatment of diseases and clinical conditions associated with DFFB. The function of DFFB and its association with various diseases and clinical conditions, has been established by previous studies, as described hereinabove with reference to VGAM74. Endothelin 3 (EDN3, Accession NM_000114) is another VGAM1435 host target gene. EDN3 BINDING SITE is HOST TARGET binding site found in the 5' untranslated region of mRNA encoded by EDN3, corresponding to a HOST TARGET binding site such as BINDING SITE I, BINDING SITE II or BINDING SITE III. Table 2 illustrates the complementarity of the nucleotide sequences of EDN3 BINDING SITE, designated SEQ ID:5581, to the nucleotide sequence of VGAM1435 RNA, herein designated VGAM RNA, also designated SEQ ID:4146.

Another function of VGAM1435 is therefore inhibition of Endothelin 3 (EDN3, Accession NM_000114). Accordingly, utilities of VGAM1435 include diagnosis, prevention and treatment of diseases and clinical conditions associated with EDN3. Butyrophilin, Subfamily 1, Member A1 (BTN1A1, Accession NM_001732) is another VGAM1435 host target gene. BTN1A1 BINDING SITE is HOST TARGET binding site found in the 3' untranslated region of mRNA encoded by BTN1A1, corresponding to a HOST TARGET binding site such as BINDING SITE I, BINDING SITE II or BINDING SITE III. Table 2 illustrates the complementarity of the nucleotide sequences of BTN1A1 BINDING SITE, designated SEQ ID:7469, to the nucleotide sequence of VGAM1435 RNA, herein designated VGAM RNA, also designated SEQ ID:4146.

Another function of VGAM1435 is therefore inhibition of Butyrophilin, Subfamily 1, Member A1 (BTN1A1, Accession NM_001732). Accordingly, utilities of VGAM1435 include diagnosis, prevention and treatment of diseases and clinical conditions associated with BTN1A1. KIAA0121 (Accession XM_052386) is another VGAM1435 host target gene. KIAA0121 BINDING SITE is HOST TARGET binding site found in the 3' untranslated region of mRNA encoded by KIAA0121, corresponding to a HOST TARGET binding site such as BINDING SITE I, BINDING SITE II or BINDING SITE III. Table 2 illustrates the complementarity of the nucleotide sequences of KIAA0121 BINDING SITE, designated SEQ ID:35965, to the nucleotide sequence of VGAM1435 RNA, herein designated VGAM RNA, also designated SEQ ID:4146.

Another function of VGAM1435 is therefore inhibition of KIAA0121 (Accession XM_052386). Accordingly, utilities of VGAM1435 include diagnosis, prevention and treatment of diseases and clinical conditions associated with KIAA0121. MGC3265 (Accession NM_024028) is another VGAM1435 host target gene. MGC3265 BINDING SITE is HOST TARGET binding site found in the 3' untranslated region of mRNA encoded by MGC3265, corresponding to a HOST TARGET binding site such as BINDING SITE I, BINDING SITE II or BINDING SITE III. Table 2 illustrates the complementarity of the nucleotide sequences of MGC3265 BINDING SITE, designated SEQ ID:23457, to the nucleotide sequence of VGAM1435 RNA, herein designated VGAM RNA, also designated SEQ ID:4146.

Another function of VGAM1435 is therefore inhibition of MGC3265 (Accession NM_024028). Accordingly, utilities of VGAM1435 include diagnosis, prevention and treatment of diseases and clinical conditions associated with MGC3265. Ubinuclein 1 (UBN1, Accession NM_016936) is another VGAM1435 host target gene. UBN1 BINDING SITE is HOST TARGET binding site found in the 3' untranslated region of mRNA encoded by UBN1, corresponding to a HOST TARGET binding site such as BINDING SITE I, BINDING SITE II or BINDING SITE III. Table 2 illustrates the complementarity of the nucleotide sequences of UBN1 BINDING SITE, designated SEQ ID:18852, to the nucleotide sequence of VGAM1435 RNA, herein designated VGAM RNA, also designated SEQ ID:4146.

Another function of VGAM1435 is therefore inhibition of Ubinuclein 1 (UBN1, Accession NM_016936). Accordingly, utilities of VGAM1435 include diagnosis, prevention and treatment of diseases and clinical conditions associated with UBN1. LOC146723 (Accession XM_085565) is another VGAM1435 host target gene. LOC146723 BINDING SITE is HOST TARGET binding site found in the 3' untranslated region of mRNA encoded by LOC146723, corresponding to a HOST TARGET binding site such as BINDING SITE I, BINDING SITE II or BINDING SITE III. Table 2 illustrates the complementarity of the nucleotide sequences of LOC146723 BINDING SITE, designated SEQ ID:38227, to the nucleotide sequence of VGAM1435 RNA, herein designated VGAM RNA, also designated SEQ ID:4146.

Another function of VGAM1435 is therefore inhibition of LOC146723 (Accession XM_085565). Accordingly, utilities of VGAM1435 include diagnosis, prevention and treatment of diseases and clinical conditions associated with LOC146723. LOC158158 (Accession XM_088494) is another VGAM1435 host target gene. LOC158158 BINDING SITE is HOST TARGET binding site found in the 3' untranslated region of mRNA encoded by LOC158158, corresponding to a HOST TARGET binding site such as BINDING SITE I, BINDING SITE II or BINDING SITE III. Table 2 illustrates the complementarity of the nucleotide sequences of LOC158158 BINDING SITE, designated SEQ ID:39732, to the nucleotide sequence of VGAM1435 RNA, herein designated VGAM RNA, also designated SEQ ID:4146.

Another function of VGAM1435 is therefore inhibition of LOC158158 (Accession XM_088494). Accordingly, utilities of VGAM1435 include diagnosis, prevention and treatment of diseases and clinical conditions associated with LOC158158. FIG. 1 further provides a conceptual description of a novel bioinformatically detected viral gene of the present invention, referred to here as Viral Genomic Address Messenger 1436 (VGAM1436) viral gene, which modulates expression of respective host target genes thereof, the function and utility of which host target genes is known in the art.

VGAM1436 is a novel bioinformatically detected regulatory, non protein coding, viral micro RNA (miRNA) gene. The method by which VGAM1436 was detected is described hereinabove with reference to FIGS. 1-8.

VGAM1436 gene, herein designated VGAM GENE, is a viral gene contained in the genome of Potato Virus A. VGAM1436 host target gene, herein designated VGAM HOST TARGET GENE, is a human gene contained in the human genome.

VGAM1436 gene encodes a VGAM1436 precursor RNA, herein designated VGAM PRECURSOR RNA. Similar to other miRNA genes, and unlike most ordinary genes, VGAM1436 precursor RNA does not encode a protein. A nucleotide sequence identical or highly similar to the nucleotide sequence of VGAM1436 precursor RNA is designated SEQ ID:1422, and is provided hereinbelow with reference to the sequence listing part. Nucleotide sequence SEQ ID:1422 is located at position 6614 relative to the genome of Potato Virus A.

VGAM1436 precursor RNA folds onto itself, forming VGAM1436 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1436 folded precursor RNA into VGAM1436 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM1436 RNA is designated SEQ ID:4147, and is provided hereinbelow with reference to the sequence listing part.

VGAM1436 host target gene, herein designated VGAM HOST TARGET GENE, encodes a corresponding messenger RNA, VGAM1436 host target RNA, herein designated VGAM HOST TARGET RNA. VGAM1436 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1436 RNA, herein designated VGAM RNA, binds complementarily to one or more host target binding sites located in untranslated regions of VGAM1436 host target RNA, herein designated VGAM HOST TARGET RNA. This complementary binding is due to the fact that the nucleotide sequence of VGAM1436 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1436 RNA, herein designated VGAM RNA, may have a different number of host target binding sites in untranslated regions of a VGAM1436 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1436 RNA, herein designated VGAM RNA, to host target binding sites on VGAM1436 host target RNA, herein designated VGAM HOST TARGET RNA, such as BINDING SITE I, BINDING SITE II and BINDING SITE III, inhibits translation of VGAM1436 host target RNA into VGAM1436 host target protein, herein designated VGAM HOST TARGET PROTEIN. VGAM host target protein is therefore outlined by a broken line.

It is appreciated that VGAM1436 host target gene, herein designated VGAM HOST TARGET GENE, in fact represents a plurality of VGAM1436 host target genes. The mRNA of each one of this plurality of VGAM1436 host target genes comprises one or more host target binding sites, each having a nucleotide sequence which is at least partly complementary to VGAM1436 RNA, herein designated VGAM RNA, and which when bound by VGAM1436 RNA causes inhibition of translation of respective one or more VGAM1436 host target proteins.

It is further appreciated by one skilled in the art that the mode of translational inhibition illustrated by FIG. 1 with specific reference to translational inhibition exerted by VGAM1436 gene, herein designated VGAM GENE, on one or more VGAM1436 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1436 is inhibition of expression of host target genes, as part of a novel viral mechanism of attacking a host. Accordingly, utilities of VGAM1436 include diagnosis, prevention and treatment of viral infection by Potato Virus A. Specific functions, and accordingly utilities, of VGAM1436 correlate with, and may be deduced from, the identity of the host target genes which VGAM1436 binds and inhibits, and the function of these host target genes, as elaborated hereinbelow.

Nucleotide sequences of the VGAM1436 precursor RNA, herein designated VGAM PRECURSOR RNA, and of the 'diced' VGAM1436 RNA, herein designated VGAM RNA, and a schematic representation of the secondary folding of VGAM1436 folded precursor RNA, herein designated VGAM FOLDED PRECURSOR RNA, of VGAM1436 are further described hereinbelow with reference to Table 1.

Nucleotide sequences of host target binding sites, such as BINDING SITE-I, BINDING SITE-II and BINDING SITE-III of FIG. 1, found on VGAM1436 host target RNA, and schematic representation of the complementarity of each of these host target binding sites to VGAM1436 RNA, herein designated VGAM RNA, are described hereinbelow with reference to Table 2.

As mentioned hereinabove with reference to FIG. 1, a function of VGAM1436 gene, herein designated VGAM is inhibition of expression of VGAM1436 target genes. It is appreciated that specific functions, and accordingly utilities, of VGAM1436 correlate with, and may be deduced from, the identity of the target genes which VGAM1436 binds and inhibits, and the function of these target genes, as elaborated hereinbelow.

Human Immunodeficiency Virus Type I Enhancer Binding Protein 2 (HIVEP2, Accession NM_006734) is a VGAM1436 host target gene. HIVEP2 BINDING SITE is HOST TARGET binding site found in the 3' untranslated region of mRNA encoded by HIVEP2, corresponding to a HOST TARGET binding site such as BINDING SITE I, BINDING SITE II or BINDING SITE III. Table 2 illustrates the complementarity of the nucleotide sequences of HIVEP2 BINDING SITE, designated SEQ ID:13586, to the nucleotide sequence of VGAM1436 RNA, herein designated VGAM RNA, also designated SEQ ID:4147.

A function of VGAM1436 is therefore inhibition of Human Immunodeficiency Virus Type I Enhancer Binding Protein 2 (HIVEP2, Accession NM_006734). Accordingly, utilities of VGAM1436 include diagnosis, prevention and treatment of diseases and clinical conditions associated with HIVEP2. Synaptotagmin I (SYT1, Accession NM_005639) is another VGAM1436 host target gene. SYT1 BINDING SITE is HOST TARGET binding site found in the 3' untranslated region of mRNA encoded by SYT1, corresponding to a HOST TARGET binding site such as BINDING SITE I, BINDING SITE II or BINDING SITE III. Table 2 illustrates the complementarity of the nucleotide sequences of SYT1 BINDING SITE, designated SEQ ID:12167, to the nucleotide sequence of VGAM1436 RNA, herein designated VGAM RNA, also designated SEQ ID:4147.

Another function of VGAM1436 is therefore inhibition of Synaptotagmin I (SYT1, Accession NM_005639), a gene which may have a regulatory role in the membrane interactions during trafficking of synaptic vesicles at the active zone of the synapse. Accordingly, utilities of VGAM1436 include diagnosis, prevention and treatment of diseases and clinical conditions associated with SYT1. The function of SYT1 and its association with various diseases and clinical conditions, has been established by previous studies, as described hereinabove with reference to VGAM739. Zinc Finger Protein 278 (ZNF278, Accession NM_014323) is another VGAM1436 host target gene. ZNF278 BINDING SITE1 through ZNF278 BINDING SITE3 are HOST TARGET binding sites found in untranslated regions of mRNA encoded by ZNF278, corresponding to HOST TARGET binding sites such as BINDING SITE I, BINDING SITE II or BINDING SITE III. Table 2 illustrates the complementarity of the nucleotide sequences of ZNF278 BINDING SITE1 through ZNF278 BINDING SITE3, designated SEQ ID:15626, SEQ ID:25775 and SEQ ID:25785 respectively, to the nucleotide sequence of VGAM1436 RNA, herein designated VGAM RNA, also designated SEQ ID:4147.

Another function of VGAM1436 is therefore inhibition of Zinc Finger Protein 278 (ZNF278, Accession NM_014323), a gene which represses basal transcription as well as RNF4-mediated activation. Accordingly, utilities of VGAM1436 include diagnosis, prevention and treatment of diseases and clinical conditions associated with ZNF278. The function of ZNF278 and its association with various diseases and clinical conditions, has been established by previous studies, as described hereinabove with reference to VGAM414. Synovial Sarcoma Translocation Gene On Chromosome 18-like 1 (SS18L1, Accession XM_037202) is another VGAM1436 host target gene. SS18L1 BINDING SITE is HOST TARGET binding site found in the 3' untranslated region of mRNA encoded by SS18L1, corresponding to a HOST TARGET binding site such as BINDING SITE I, BINDING SITE II or BINDING SITE III. Table 2 illustrates the complementarity of the nucleotide sequences of SS18L1 BINDING SITE, designated SEQ ID:32556, to the nucleotide sequence of VGAM1436 RNA, herein designated VGAM RNA, also designated SEQ ID:4147.

Another function of VGAM1436 is therefore inhibition of Synovial Sarcoma Translocation Gene On Chromosome 18-like 1 (SS18L1, Accession XM_037202). Accordingly, utilities of VGAM1436 include diagnosis, prevention and treatment of diseases and clinical conditions associated with SS18L1. LOC145815 (Accession XM_096874) is another VGAM1436 host target gene. LOC145815 BINDING SITE is HOST TARGET binding site found in the 5' untranslated region of mRNA encoded by LOC145815, corresponding to a HOST TARGET binding site such as BINDING SITE I, BINDING SITE II or BINDING SITE III. Table 2 illustrates the complementarity of the nucleotide sequences of LOC145815 BINDING SITE, designated SEQ ID:40602, to the nucleotide sequence of VGAM1436 RNA, herein designated VGAM RNA, also designated SEQ ID:4147.

Another function of VGAM1436 is therefore inhibition of LOC145815 (Accession XM_096874). Accordingly, utilities of VGAM1436 include diagnosis, prevention and treatment of diseases and clinical conditions associated with LOC145815. FIG. 1 further provides a conceptual description of a novel bioinformatically detected viral gene of the present invention, referred to here as Viral Genomic Address Messenger 1437 (VGAM1437) viral gene, which modulates expression of respective host target genes thereof, the function and utility of which host target genes is known in the art.

VGAM1437 is a novel bioinformatically detected regulatory, non protein coding, viral micro RNA (miRNA) gene. The method by which VGAM1437 was detected is described hereinabove with reference to FIGS. 1-8.

VGAM1437 gene, herein designated VGAM GENE, is a viral gene contained in the genome of Potato Virus A. VGAM1437 host target gene, herein designated VGAM HOST TARGET GENE, is a human gene contained in the human genome.

VGAM1437 gene encodes a VGAM1437 precursor RNA, herein designated VGAM PRECURSOR RNA. Similar to other miRNA genes, and unlike most ordinary genes, VGAM1437 precursor RNA does not encode a protein. A nucleotide sequence identical or highly similar to the nucleotide sequence of VGAM1437 precursor RNA is designated SEQ ID:1423, and is provided hereinbelow with reference to the sequence listing part. Nucleotide sequence SEQ ID:1423 is located at position 26 relative to the genome of Potato Virus A.

VGAM1437 precursor RNA folds onto itself, forming VGAM1437 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1437 folded precursor RNA into VGAM1437 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM1437 RNA is designated SEQ ID:4148, and is provided hereinbelow with reference to the sequence listing part.

VGAM1437 host target gene, herein designated VGAM HOST TARGET GENE, encodes a corresponding messenger RNA, VGAM1437 host target RNA, herein designated VGAM HOST TARGET RNA. VGAM1437 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1437 RNA, herein designated VGAM RNA, binds complementarily to one or more host target binding sites located in untranslated regions of VGAM1437 host target RNA, herein designated VGAM HOST TARGET RNA. This complementary binding is due to the fact that the nucleotide sequence of VGAM1437 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1437 RNA, herein designated VGAM RNA, may have a different number of host target binding sites in untranslated regions of a VGAM1437 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1437 RNA, herein designated VGAM RNA, to host target binding sites on VGAM1437 host target RNA, herein designated VGAM HOST TARGET RNA, such as BINDING SITE I, BINDING SITE II and BINDING SITE III, inhibits translation of VGAM1437 host target RNA into VGAM1437 host target protein, herein designated VGAM HOST TARGET PROTEIN. VGAM host target protein is therefore outlined by a broken line.

It is appreciated that VGAM1437 host target gene, herein designated VGAM HOST TARGET GENE, in fact represents a plurality of VGAM1437 host target genes. The mRNA of each one of this plurality of VGAM1437 host target genes comprises one or more host target binding sites, each having a nucleotide sequence which is at least partly complementary to VGAM1437 RNA, herein designated VGAM RNA, and which when bound by VGAM1437 RNA causes inhibition of translation of respective one or more VGAM1437 host target proteins.

It is further appreciated by one skilled in the art that the mode of translational inhibition illustrated by FIG. 1 with specific reference to translational inhibition exerted by VGAM1437 gene, herein designated VGAM GENE, on one or more VGAM1437 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1437 is inhibition of expression of host target genes, as part of a novel viral mechanism of attacking a host. Accordingly, utilities of VGAM1437 include diagnosis, prevention and treatment of viral infection by Potato Virus A. Specific functions, and accordingly utilities, of VGAM1437 correlate with, and may be deduced from, the identity of the host target genes which VGAM1437 binds and inhibits, and the function of these target genes, as elaborated hereinbelow.

Nucleotide sequences of the VGAM1437 precursor RNA, herein designated VGAM PRECURSOR RNA, and of the 'diced' VGAM1437 RNA, herein designated VGAM RNA, and a schematic representation of the secondary folding of VGAM1437 folded precursor RNA, herein designated VGAM FOLDED PRECURSOR RNA, of VGAM1437 are further described hereinbelow with reference to Table 1.

Nucleotide sequences of host target binding sites, such as BINDING SITE-I, BINDING SITE-II and BINDING SITE-III of FIG. 1, found on VGAM1437 host target RNA, and schematic representation of the complementarity of each of these host target binding sites to VGAM1437 RNA, herein designated VGAM RNA, are described hereinbelow with reference to Table 2.

As mentioned hereinabove with reference to FIG. 1, a function of VGAM1437 gene, herein designated VGAM is inhibition of expression of VGAM1437 target genes. It is appreciated that specific functions, and accordingly utilities, of VGAM1437 correlate with, and may be deduced from, the identity of the target genes which VGAM1437 binds and inhibits, and the function of these target genes, as elaborated hereinbelow.

Deoxyribonuclease I-like 1 (DNASE1L1, Accession NM_006730) is a VGAM1437 host target gene. DNASE1L1 BINDING SITE is HOST TARGET binding site found in the 5' untranslated region of mRNA encoded by DNASE1L1, corresponding to a HOST TARGET binding site such as BINDING SITE I, BINDING SITE II or BINDING SITE III. Table 2 illustrates the complementarity of the nucleotide sequences of DNASE1L1 BINDING SITE, designated SEQ ID:13568, to the nucleotide sequence of VGAM1437 RNA, herein designated VGAM RNA, also designated SEQ ID:4148.

A function of VGAM1437 is therefore inhibition of Deoxyribonuclease I-like 1 (DNASE1L1, Accession NM_006730), a gene which seems to be involved in cell death. Accordingly, utilities of VGAM1437 include diagnosis, prevention and treatment of diseases and clinical conditions associated with DNASE1L1. The function of DNASE1L1 and its association with various diseases and clinical conditions, has been established by previous studies, as described hereinabove with reference to VGAM885. Solute Carrier Family 6 (neurotransmitter transporter, taurine), Member 6 (SLC6A6, Accession NM_003043) is another VGAM1437 host target gene. SLC6A6 BINDING SITE is HOST TARGET binding site found in the 3' untranslated region of mRNA encoded by SLC6A6, corresponding to a HOST TARGET binding site such as BINDING SITE I, BINDING SITE II or BINDING SITE III. Table 2 illustrates the complementarity of the nucleotide sequences of SLC6A6 BINDING SITE, designated SEQ ID:9002, to the nucleotide sequence of VGAM1437 RNA, herein designated VGAM RNA, also designated SEQ ID:4148.

Another function of VGAM1437 is therefore inhibition of Solute Carrier Family 6 (neurotransmitter transporter, taurine), Member 6 (SLC6A6, Accession NM_003043), a gene which transports taurine and other beta-amino acids like beta-alanine. Accordingly, utilities of VGAM1437 include diagnosis, prevention and treatment of diseases and clinical conditions associated with SLC6A6. The function of SLC6A6 and its association with various diseases and clinical conditions, has been established by previous studies, as described hereinabove with reference to VGAM36. FIG. 1 further provides a conceptual description of a novel bioinformatically detected viral gene of the present invention, referred to here as Viral Genomic Address Messenger 1438 (VGAM1438) viral gene, which modulates expression of respective host target genes thereof, the function and utility of which host target genes is known in the art.

VGAM1438 is a novel bioinformatically detected regulatory, non protein coding, viral micro RNA (miRNA) gene. The method by which VGAM1438 was detected is described hereinabove with reference to FIGS. 1-8.

VGAM1438 gene, herein designated VGAM GENE, is a viral gene contained in the genome of Bean Common Mosaic Necrosis Virus. VGAM1438 host target gene, herein designated VGAM HOST TARGET GENE, is a human gene contained in the human genome.

VGAM1438 gene encodes a VGAM1438 precursor RNA, herein designated VGAM PRECURSOR RNA. Similar to other miRNA genes, and unlike most ordinary genes, VGAM1438 precursor RNA does not encode a protein. A nucleotide sequence identical or highly similar to the nucleotide sequence of VGAM1438 precursor RNA is designated SEQ ID:1424, and is provided hereinbelow with reference to the sequence listing part. Nucleotide sequence SEQ ID:1424 is located at position 7374 relative to the genome of Bean Common Mosaic Necrosis Virus.

VGAM1438 precursor RNA folds onto itself, forming VGAM1438 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1438 folded precursor RNA into VGAM1438 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1438 RNA is designated SEQ ID:4149, and is provided hereinbelow with reference to the sequence listing part.

VGAM1438 host target gene, herein designated VGAM HOST TARGET GENE, encodes a corresponding messenger RNA, VGAM1438 host target RNA, herein designated VGAM HOST TARGET RNA. VGAM1438 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1438 RNA, herein designated VGAM RNA, binds complementarily to one or more host target binding sites located in untranslated regions of VGAM1438 host target RNA, herein designated VGAM HOST TARGET RNA. This complementary binding is due to the fact that the nucleotide sequence of VGAM1438 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1438 RNA, herein designated VGAM RNA, may have a different number of host target binding sites in untranslated regions of a VGAM1438 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1438 RNA, herein designated VGAM RNA, to host target binding sites on VGAM1438 host target RNA, herein designated VGAM HOST TARGET RNA, such as BINDING SITE I, BINDING SITE II and BINDING SITE III, inhibits translation of VGAM1438 host target RNA into VGAM1438 host target protein, herein designated VGAM HOST TARGET PROTEIN. VGAM host target protein is therefore outlined by a broken line.

It is appreciated that VGAM1438 host target gene, herein designated VGAM HOST TARGET GENE, in fact represents a plurality of VGAM1438 host target genes. The mRNA of each one of this plurality of VGAM1438 host target genes comprises one or more host target binding sites, each having a nucleotide sequence which is at least partly complementary to VGAM1438 RNA, herein designated VGAM RNA, and which when bound by VGAM1438 RNA causes inhibition of translation of respective one or more VGAM1438 host target proteins.

It is further appreciated by one skilled in the art that the mode of translational inhibition illustrated by FIG. 1 with specific reference to translational inhibition exerted by VGAM1438 gene, herein designated VGAM GENE, on one or more VGAM1438 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1438 is inhibition of expression of host target genes, as part of a novel viral mechanism of attacking a host. Accordingly, utilities of VGAM1438 include diagnosis, prevention and treatment of viral infection by Bean Common Mosaic Necrosis Virus. Specific functions, and accordingly utilities, of VGAM1438 correlate with, and may be deduced from, the identity of the host target genes which VGAM1438 binds and inhibits, and the function of these host target genes, as elaborated hereinbelow.

Nucleotide sequences of the VGAM1438 precursor RNA, herein designated VGAM PRECURSOR RNA, and of the 'diced' VGAM1438 RNA, herein designated VGAM RNA, and a schematic representation of the secondary folding of VGAM1438 folded precursor RNA, herein designated VGAM FOLDED PRECURSOR RNA, of VGAM1438 are further described hereinbelow with reference to Table 1.

Nucleotide sequences of host target binding sites, such as BINDING SITE-I, BINDING SITE-II and BINDING SITE-III of FIG. 1, found on VGAM1438 host target RNA, and schematic representation of the complementarity of each of these host target binding sites to VGAM1438 RNA, herein designated VGAM RNA, are described hereinbelow with reference to Table 2.

As mentioned hereinabove with reference to FIG. 1, a function of VGAM1438 gene, herein designated VGAM is inhibition of expression of VGAM1438 target genes. It is appreciated that specific functions, and accordingly utilities, of VGAM1438 correlate with, and may be deduced from, the identity of the target genes which VGAM1438 binds and inhibits, and the function of these target genes, as elaborated hereinbelow.

Cockayne Syndrome 1 (classical) (CKN1, Accession NM_000082) is a VGAM1438 host target gene. CKN1 BINDING SITE is HOST TARGET binding site found in the 3' untranslated region of mRNA encoded by CKN1, corresponding to a HOST TARGET binding site such as BINDING SITE I, BINDING SITE II or BINDING SITE III. Table 2 illustrates the complementarity of the nucleotide sequences of CKN1 BINDING SITE, designated SEQ ID:5532, to the nucleotide sequence of VGAM1438 RNA, herein designated VGAM RNA, also designated SEQ ID:4149.

A function of VGAM1438 is therefore inhibition of Cockayne Syndrome 1 (classical) (CKN1, Accession NM_000082). Accordingly, utilities of VGAM1438 include diagnosis, prevention and treatment of diseases and clinical conditions associated with CKN1. GCN1 General Control of Amino-acid Synthesis 1-like 1 (yeast) (GCN1L1, Accession XM_045792) is another VGAM1438 host target gene. GCN1L1 BINDING SITE is HOST TARGET binding site found in the 3' untranslated region of mRNA encoded by GCN1L1, corresponding to a HOST TARGET binding site such as BINDING SITE I, BINDING SITE II or BINDING SITE III. Table 2 illustrates the complementarity of the nucleotide sequences of GCN1L1 BINDING SITE, designated SEQ ID:34567, to the nucleotide sequence of VGAM1438 RNA, herein designated VGAM RNA, also designated SEQ ID:4149.

Another function of VGAM1438 is therefore inhibition of GCN1 General Control of Amino-acid Synthesis 1-like 1 (yeast) (GCN1L1, Accession XM_045792), a gene which performs an EF3-related function on the ribosome by regulating GCN2 kinase activity. Accordingly, utilities of VGAM1438 include diagnosis, prevention and treatment of diseases and clinical conditions associated with GCN1L1. The function of GCN1L1 has been established by previous studies. In S. cerevisiae, amino acid starvation causes increased transcription of genes encoding enzymes involved in amino acid biosynthesis. This process, known as general amino acid control, requires the phosphorylation of translation initiation factor eIF2 (see OMIM Ref. No. 603907) by protein kinase GCN2 and subsequent derepression of GCN4, a transcriptional activator that binds to the promoter of genes subject to the general control. Two other proteins, GCN1 and GCN20, are required for the activation of GCN2 Working with yeast GCN proteins, Marton et al. (1997) found that despite the presence of multiple hydrophobic regions indicating a putative transmembrane domain, GCN1 is located throughout the cytoplasm. The N-terminal region of GCN20 interacts with an internal segment of GCN1 that shows sequence similarity to translation elongation factor EF3 (see OMIM Ref. No. 603917). Both GCN1 and GCN20 stably interact with translating 80S ribosomes. Whereas GCN1 could bind to ribosomes independently of GCN20, its functions on polysomes were largely dependent on the ATP-binding cassette of GCN20. By EST database searching for sequences related to GCN1, Marton et al. (1997) identified partial cDNAs of human GCN1L1. The portion of GCN1L1 that is highly conserved with yeast GCN1 also shows sequence similarity to yeast EF3. This conserved domain supports the hypothesis that GCN1L1 performs an EF3-related function on the ribosome by regulating GCN2 kinase activity.

Full details of the abovementioned studies are described in the following publications, the disclosure of which are hereby incorporated by reference:

Marton, M. J.; Vazquez de Aldana, C. R.; Qiu, H.; Chakraburtty, K.; Hinnebusch, A. G.: Evidence that GCN1 and GCN20, translational regulators of GCN4, function on elongating ribosomes in activation of eIF2-alpha kinase GCN2. Molec. Cell. Biol. 17:4474-4489, 1997; and Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human g.

Further studies establishing the function and utilities of GCN1L1 are found in John Hopkins OMIM database record ID 605614, and in sited publications numbered 677 and 9379 listed in the bibliography section hereinbelow, which are also hereby incorporated by reference. Tumor Necrosis Factor Receptor Superfamily, Member 10b (TNFRSF10B, Accession NM_003842) is another VGAM1438 host target gene. TNFRSF10B BINDING SITE is HOST TARGET binding site found in the 3' untranslated region of mRNA encoded by TNFRSF10B, corresponding to a HOST TARGET binding site such as BINDING SITE I, BINDING SITE II or BINDING SITE III. Table 2 illustrates the complementarity of the nucleotide sequences of TNFRSF10B BINDING SITE, designated SEQ ID:9934, to the nucleotide sequence of VGAM1438 RNA, herein designated VGAM RNA, also designated SEQ ID:4149.

Another function of VGAM1438 is therefore inhibition of Tumor Necrosis Factor Receptor Superfamily, Member 10b (TNFRSF10B, Accession NM_003842), a gene which forms complex that induces apoptosis. Accordingly, utilities of VGAM1438 include diagnosis, prevention and treatment of diseases and clinical conditions associated with TNFRSF10B. The function of TNFRSF10B and its association with various diseases and clinical conditions, has been established by previous studies, as described hereinabove with reference to VGAM400. Enabled Homolog (Drosophila) (ENAH, Accession NM_018212) is another VGAM1438 host target gene. ENAH BINDING SITE is HOST TARGET binding site found in the 3' untranslated region of mRNA encoded by ENAH, corresponding to a HOST TARGET binding site such as BINDING SITE I, BINDING SITE II or BINDING SITE III. Table 2 illustrates the complementarity of the nucleotide sequences of ENAH BINDING SITE, designated SEQ ID:20123, to the nucleotide sequence of VGAM1438 RNA, herein designated VGAM RNA, also designated SEQ ID:4149.

Another function of VGAM1438 is therefore inhibition of Enabled Homolog (Drosophila) (ENAH, Accession NM_018212). Accordingly, utilities of VGAM1438 include diagnosis, prevention and treatment of diseases and clinical conditions associated with ENAH. Solute Carrier Family 5 (choline transporter), Member 7 (SLC5A7, Accession NM_021815) is another VGAM1438 host target gene. SLC5A7 BINDING SITE is HOST TARGET binding site found in the 3' untranslated region of mRNA encoded by SLC5A7, corresponding to a HOST TARGET binding site such as BINDING SITE I, BINDING SITE II or BINDING SITE III. Table 2 illustrates the complementarity of the nucleotide sequences of SLC5A7 BINDING SITE, designated SEQ ID:22388, to the nucleotide sequence of VGAM1438 RNA, herein designated VGAM RNA, also designated SEQ ID:4149.

Another function of VGAM1438 is therefore inhibition of Solute Carrier Family 5 (choline transporter), Member 7 (SLC5A7, Accession NM_021815). Accordingly, utilities of VGAM1438 include diagnosis, prevention and treatment of diseases and clinical conditions associated with SLC5A7. FIG. 1 further provides a conceptual description of a novel bioinformatically detected viral gene of the present invention, referred to here as Viral Genomic Address Messenger 1439 (VGAM1439) viral gene, which modulates expression of respective host target genes thereof, the function and utility of which host target genes is known in the art.

VGAM1439 is a novel bioinformatically detected regulatory, non protein coding, viral micro RNA (miRNA) gene. The method by which VGAM1439 was detected is described hereinabove with reference to FIGS. 1-8.

VGAM1439 gene, herein designated VGAM GENE, is a viral gene contained in the genome of Bean Common Mosaic Necrosis Virus. VGAM1439 host target gene, herein designated VGAM HOST TARGET GENE, is a human gene contained in the human genome.

VGAM1439 gene encodes a VGAM1439 precursor RNA, herein designated VGAM PRECURSOR RNA. Similar to other miRNA genes, and unlike most ordinary genes, VGAM1439 precursor RNA does not encode a protein. A nucleotide sequence identical or highly similar to the nucleotide sequence of VGAM1439 precursor RNA is designated SEQ ID:1425, and is provided hereinbelow with reference to the sequence listing part. Nucleotide sequence SEQ ID:1425 is located at position 4013 relative to the genome of Bean Common Mosaic Necrosis Virus.

VGAM1439 precursor RNA folds onto itself, forming VGAM1439 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1439 folded precursor RNA into VGAM1439 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1439 RNA is designated SEQ ID:4150, and is provided hereinbelow with reference to the sequence listing part.

VGAM1439 host target gene, herein designated VGAM HOST TARGET GENE, encodes a corresponding messenger RNA, VGAM1439 host target RNA, herein designated VGAM HOST TARGET RNA. VGAM1439 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1439 RNA, herein designated VGAM RNA, binds complementarily to one or more host target binding sites located in untranslated regions of VGAM1439 host target RNA, herein designated VGAM HOST TARGET RNA. This complementary binding is due to the fact that the nucleotide sequence of VGAM1439 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1439 RNA, herein designated VGAM RNA, may have a different number of host target binding sites in untranslated regions of a VGAM1439 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1439 RNA, herein designated VGAM RNA, to host target binding sites on VGAM1439 host target RNA, herein designated VGAM HOST TARGET RNA, such as BINDING SITE I, BINDING SITE II and BINDING SITE III, inhibits translation of VGAM1439 host target RNA into VGAM1439 host target protein, herein designated VGAM HOST TARGET PROTEIN. VGAM host target protein is therefore outlined by a broken line.

It is appreciated that VGAM1439 host target gene, herein designated VGAM HOST TARGET GENE, in fact represents a plurality of VGAM1439 host target genes. The mRNA of each one of this plurality of VGAM1439 host target genes comprises one or more host target binding sites, each having a nucleotide sequence which is at least partly complementary to VGAM1439 RNA, herein designated VGAM RNA, and which when bound by VGAM1439 RNA causes inhibition of translation of respective one or more VGAM1439 host target proteins.

It is further appreciated by one skilled in the art that the mode of translational inhibition illustrated by FIG. 1 with specific reference to translational inhibition exerted by VGAM1439 gene, herein designated VGAM GENE, on one or more VGAM1439 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1439 is inhibition of expression of host target genes, as part of a novel viral mechanism of attacking a host. Accordingly, utilities of VGAM1439 include diagnosis, prevention and treatment of viral infection by Bean Common Mosaic Necrosis Virus. Specific functions, and accordingly utilities, of VGAM1439 correlate with, and may be deduced from, the identity of the host target genes which VGAM1439 binds and inhibits, and the function of these host target genes, as elaborated hereinbelow.

Nucleotide sequences of the VGAM1439 precursor RNA, herein designated VGAM PRECURSOR RNA, and of the 'diced' VGAM1439 RNA, herein designated VGAM RNA, and a schematic representation of the secondary folding of VGAM1439 folded precursor RNA, herein designated VGAM FOLDED PRECURSOR RNA, of VGAM1439 are further described hereinbelow with reference to Table 1.

Nucleotide sequences of host target binding sites, such as BINDING SITE-I, BINDING SITE-II and BINDING SITE-III of FIG. 1, found on VGAM1439 host target RNA, and schematic representation of the complementarity of each of these host target binding sites to VGAM1439 RNA, herein designated VGAM RNA, are described hereinbelow with reference to Table 2.

As mentioned hereinabove with reference to FIG. 1, a function of VGAM1439 gene, herein designated VGAM is inhibition of expression of VGAM1439 target genes. It is appreciated that specific functions, and accordingly utilities, of VGAM1439 correlate with, and may be deduced from, the identity of the target genes which VGAM1439 binds and inhibits, and the function of these target genes, as elaborated hereinbelow.

Ras Homolog Gene Family, Member I (ARHI, Accession NM_004675) is a VGAM1439 host target gene. ARHI BINDING SITE is HOST TARGET binding site found in the 3' untranslated region of mRNA encoded by ARHI, corresponding to a HOST TARGET binding site such as BINDING SITE I, BINDING SITE II or BINDING SITE III. Table 2 illustrates the complementarity of the nucleotide sequences of ARHI BINDING SITE, designated SEQ ID:11043, to the nucleotide sequence of VGAM1439 RNA, herein designated VGAM RNA, also designated SEQ ID:4150.

A function of VGAM1439 is therefore inhibition of Ras Homolog Gene Family, Member I (ARHI, Accession NM_004675), a gene which is a Ras-related GTP-binding protein, member I; overexpression suppresses tumors. Accordingly, utilities of VGAM1439 include diagnosis, prevention and treatment of diseases and clinical conditions associated with ARHI. The function of ARHI has been established by previous studies. The Ras (see OMIM Ref. No. HRAS; 190020) superfamily of proto-oncogenes is among the most commonly activated in a number of cancers, including breast and ovarian tumors. By differential display PCR and by screening a normal ovarian epithelial cell cDNA library, Yu et al. (1999) identified a cDNA encoding ARHI, which they termed NOEY2. Sequence analysis predicted that the 229-amino acid ARHI protein shares 54% amino acid homology with HRAS and 56 to 62% homology with RAS-related proteins (e.g., RAP1A; 179520). ARHI contains a highly conserved GTP-binding domain, a putative effector domain distinct from that of RAS and RAP proteins, and a C-terminal membrane localization motif. Northern blot analysis detected a 1.9-kb ARHI transcript in all normal breast and ovarian epithelial cell cultures tested, as well as in normal ovary, heart, liver, pancreas, and brain. Expression was absent in nearly all breast and ovarian cancer cell lines and all primary ovarian cancer cell lines tested. Western blot analysis detected a 26-kD ARHI protein in all normal breast and ovarian cell lines but not in any breast and ovarian cancer cell lines tested. Expression of ARHI in breast and ovarian cancer cell lines but not in lung cancer cell lines led to growth inhibition. Stimulation of normal cell lines with growth factors led to decreased expression of ARHI as well as the cell growth inhibition-associated protein WAF1 (CDKN1A; 116899). Genomic sequence analysis demonstrated that the ARHI gene contains 2 exons. RFLP analysis of genomic DNA of informative families showed that ARHI is expressed monoallelically and is imprinted maternally. By PCR analysis of a genomic library and by FISH, Yu et al. (1999) mapped the ARHI gene to 1p31, a region that is frequently deleted in breast and ovarian cancer due to loss of heterozygosity; see 167000. To study the biologic function of the ARHI tumor suppressor gene, Xu et al. (2000) generated ARHI transgenic mice with ARHI expression driven by the cytomegalovirus promoter. Overexpression of ARHI in transgenic mice resulted in a decrease in body size and impaired development in multiple organs. Defects were particularly evident in fertility and postpartum lactation. The data suggested that ARHI is a negative regulator of murine growth as well as of the development and function of the breast and ovary.

Full details of the abovementioned studies are described in the following publications, the disclosure of which are hereby incorporated by reference:

Xu, F.; Xia, W.; Luo, R. Z.; Peng, H.; Zhao, S.; Dai, J.; Long, Y.; Zou, L.; Le, W.; Liu, J.; Parlow, A. F.; Hung, M.-C.; Bast, R. C., Jr.; Yu, Y.: The human ARHI tumor suppressor gene inhibits lactation and growth in transgenic mice. Cancer Res. 60:4913-4920, 2000; and Yu, Y.; Xu, F.; Peng, H.; Fang, X.; Zhao, S.; Li, Y.; Cuevas, B.; Kuo, W.-L.; Gray, J. W.; Siciliano, M.; Mills, G. B.; Bast, R. C., JR.: NOEY2 (ARHI), an imprinted putative tumor sup.

Further studies establishing the function and utilities of ARHI are found in John Hopkins OMIM database record ID 605193, and in sited publications numbered 490 and 6607 listed in the bibliography section hereinbelow, which are also hereby incorporated by reference. Coagulation Factor VIII, Procoagulant Component (hemophilia A) (F8, Accession NM_000132) is another VGAM1439 host target gene. F8 BINDING SITE is HOST TARGET binding site found in the 3' untranslated region of mRNA encoded by F8, corresponding to a HOST TARGET binding site such as BINDING SITE I, BINDING SITE II or BINDING SITE III. Table 2 illustrates the complementarity of the nucleotide sequences of F8 BINDING SITE, designated SEQ ID:5614, to the nucleotide sequence of VGAM1439 RNA, herein designated VGAM RNA, also designated SEQ ID:4150.

Another function of VGAM1439 is therefore inhibition of Coagulation Factor VIII, Procoagulant Component (hemophilia A) (F8, Accession NM_000132). Accordingly, utilities of VGAM1439 include diagnosis, prevention and treatment of diseases and clinical conditions associated with F8. Galanin Receptor 1 (GALR1, Accession NM_001480) is another VGAM1439 host target gene. GALR1 BINDING SITE is HOST TARGET binding site found in the 3' untranslated region of mRNA encoded by GALR1, corresponding to a HOST TARGET binding site such as BINDING SITE I, BINDING SITE II or BINDING SITE III. Table 2 illustrates the complementarity of the nucleotide sequences of GALR1 BINDING SITE, designated SEQ ID:7218, to the nucleotide sequence of VGAM1439 RNA, herein designated VGAM RNA, also designated SEQ ID:4150.

Another function of VGAM1439 is therefore inhibition of Galanin Receptor 1 (GALR1, Accession NM_001480), a gene which plays a role in regulating ion transport. Accordingly, utilities of VGAM1439 include diagnosis, prevention and treatment of diseases and clinical conditions associated with GALR1. The function of GALR1 and its association with various diseases and clinical conditions, has been established by previous studies, as described hereinabove with reference to VGAM1245. CAPN13 (Accession NM_144575) is another VGAM1439 host target gene. CAPN13 BINDING SITE is HOST TARGET binding site found in the 3' untranslated region of mRNA encoded by CAPN13, corresponding to a HOST TARGET binding site such as BINDING SITE I, BINDING SITE II or BINDING SITE III. Table 2 illustrates the complementarity of the nucleotide sequences of CAPN13 BINDING SITE, designated SEQ ID:29379, to the nucleotide sequence of VGAM1439 RNA, herein designated VGAM RNA, also designated SEQ ID:4150.

Another function of VGAM1439 is therefore inhibition of CAPN13 (Accession NM_144575). Accordingly, utilities of VGAM1439 include diagnosis, prevention and treatment of diseases and clinical conditions associated with CAPN13. FLJ22794 (Accession XM_166220) is another VGAM1439 host target gene. FLJ22794 BINDING SITE is HOST TARGET binding site found in the 3' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44026, to the nucleotide sequence of VGAM1439 RNA, herein designated VGAM RNA, also designated SEQ ID:4150.

Another function of VGAM1439 is therefore inhibition of FLJ22794 (Accession XM_166220). Accordingly, utilities of VGAM1439 include diagnosis, prevention and treatment of diseases and clinical conditions associated with FLJ22794. KIAA0212 (Accession NM_014674) is another VGAM1439 host target gene. KIAA0212 BINDING SITE is HOST TARGET binding site found in the 3' untranslated region of mRNA encoded by KIAA0212, corresponding to a HOST TARGET binding site such as BINDING SITE I, BINDING SITE II or BINDING SITE III. Table 2 illustrates the complementarity of the nucleotide sequences of KIAA0212 BINDING SITE, designated SEQ ID:16142, to the nucleotide sequence of VGAM1439 RNA, herein designated VGAM RNA, also designated SEQ ID:4150.

Another function of VGAM1439 is therefore inhibition of KIAA0212 (Accession NM_014674). Accordingly, utilities of VGAM1439 include diagnosis, prevention and treatment of diseases and clinical conditions associated with KIAA0212. KIAA1317 (Accession XM_098368) is another VGAM1439 host target gene. KIAA1317 BINDING SITE is HOST TARGET binding site found in the 3' untranslated region of mRNA encoded by KIAA1317, corresponding to a HOST TARGET binding site such as BINDING SITE I, BINDING SITE II or BINDING SITE III. Table 2 illustrates the complementarity of the nucleotide sequences of KIAA1317 BINDING SITE, designated SEQ ID:41624, to the nucleotide sequence of VGAM1439 RNA, herein designated VGAM RNA, also designated SEQ ID:4150.

Another function of VGAM1439 is therefore inhibition of KIAA1317 (Accession XM_098368). Accordingly, utilities of VGAM1439 include diagnosis, prevention and treatment of diseases and clinical conditions associated with KIAA1317. KIAA1596 (Accession XM_048128) is another VGAM1439 host target gene. KIAA1596 BINDING SITE is HOST TARGET binding site found in the 5' untranslated region of mRNA encoded by KIAA1596, corresponding to a HOST TARGET binding site such as BINDING SITE I, BINDING SITE II or BINDING SITE III. Table 2 illustrates the complementarity of the nucleotide sequences of KIAA1596 BINDING SITE, designated SEQ ID:35120, to the nucleotide sequence of VGAM1439 RNA, herein designated VGAM RNA, also designated SEQ ID:4150.

Another function of VGAM1439 is therefore inhibition of KIAA1596 (Accession XM_048128). Accordingly, utilities of VGAM1439 include diagnosis, prevention and treatment of diseases and clinical conditions associated with KIAA1596. MGC21854 (Accession NM_052862) is another VGAM1439 host target gene. MGC21854 BINDING SITE is HOST TARGET binding site found in the 3' untranslated region of mRNA encoded by MGC21854, corresponding to a HOST TARGET binding site such as BINDING SITE I, BINDING SITE II or BINDING SITE III. Table 2 illustrates the complementarity of the nucleotide sequences of MGC21854 BINDING SITE, designated SEQ ID:27448, to the nucleotide sequence of VGAM1439 RNA, herein designated VGAM RNA, also designated SEQ ID:4150.

Another function of VGAM1439 is therefore inhibition of MGC21854 (Accession NM_052862). Accordingly, utilities of VGAM1439 include diagnosis, prevention and treatment of diseases and clinical conditions associated with MGC21854. Serine/threonine Kinase 17a (apoptosis-inducing) (STK17A, Accession NM_004760) is another VGAM1439 host target gene. STK17A BINDING SITE is HOST TARGET binding site found in the 3" untranslated region of mRNA encoded by STK17A, corresponding to a HOST TARGET binding site such as BINDING SITE I, BINDING SITE II or BINDING SITE III. Table 2 illustrates the complementarity of the nucleotide sequences of STK17A BINDING SITE, designated SEQ ID:11153, to the nucleotide sequence of VGAM1439 RNA, herein designated VGAM RNA, also designated SEQ ID:4150.

Another function of VGAM1439 is therefore inhibition of Serine/threonine Kinase 17a (apoptosis-inducing) (STK17A, Accession NM_004760). Accordingly, utilities of VGAM1439 include diagnosis, prevention and treatment of diseases and clinical conditions associated with STK17A. LOC148545 (Accession XM_086226) is another VGAM1439 host target gene. LOC148545 BINDING SITE is HOST TARGET binding site found in the 3' untranslated region of mRNA encoded by LOC148545, corresponding to a HOST TARGET binding site such as BINDING SITE I, BINDING SITE II or BINDING SITE III. Table 2 illustrates the complementarity of the nucleotide sequences of LOC148545 BINDING SITE, designated SEQ ID:38553, to the nucleotide sequence of VGAM1439 RNA, herein designated VGAM RNA, also designated SEQ ID:4150.

Another function of VGAM1439 is therefore inhibition of LOC148545 (Accession XM_086226). Accordingly, utilities of VGAM1439 include diagnosis, prevention and treatment of diseases and clinical conditions associated with LOC148545. LOC219347 (Accession XM_167564) is another VGAM1439 host target gene. LOC219347 BINDING SITE is HOST TARGET binding site found in the 5' untranslated region of mRNA encoded by LOC219347, corresponding to a HOST TARGET binding site such as BINDING SITE I, BINDING SITE II or BINDING SITE III. Table 2 illustrates the complementarity of the nucleotide sequences of LOC219347 BINDING SITE, designated SEQ ID:44679, to the nucleotide sequence of VGAM1439 RNA, herein designated VGAM RNA, also designated SEQ ID:4150.

Another function of VGAM1439 is therefore inhibition of LOC219347 (Accession XM_167564). Accordingly, utilities of VGAM1439 include diagnosis, prevention and treatment of diseases and clinical conditions associated with LOC219347. LOC51696 (Accession NM_016217) is another VGAM1439 host target gene. LOC51696 BINDING SITE is HOST TARGET binding site found in the 3' untranslated region of mRNA encoded by LOC51696, corresponding to a HOST TARGET binding site such as BINDING SITE I, BINDING SITE II or BINDING SITE III. Table 2 illustrates the complementarity of the nucleotide sequences of LOC51696 BINDING SITE, designated SEQ ID:18311, to the nucleotide sequence of VGAM1439 RNA, herein designated VGAM RNA, also designated SEQ ID:4150.

Another function of VGAM1439 is therefore inhibition of LOC51696 (Accession NM_016217). Accordingly, utilities of VGAM1439 include diagnosis, prevention and treatment of diseases and clinical conditions associated with LOC51696. FIG. 1 further provides a conceptual description of a novel bioinformatically detected viral gene of the present invention, referred to here as Viral Genomic Address Messenger 1440 (VGAM1440) viral gene, which modulates expression of respective host target genes thereof, the function and utility of which host target genes is known in the art.

VGAM1440 is a novel bioinformatically detected regulatory, non protein coding, viral micro RNA (miRNA) gene. The method by which VGAM1440 was detected is described hereinabove with reference to FIGS. 1-8.

VGAM1440 gene, herein designated VGAM GENE, is a viral gene contained in the genome of Bean Common Mosaic Necrosis Virus. VGAM1440 host target gene, herein designated VGAM HOST TARGET GENE, is a human gene contained in the human genome.

VGAM1440 gene encodes a VGAM1440 precursor RNA, herein designated VGAM PRECURSOR RNA. Similar to other miRNA genes, and unlike most ordinary genes, VGAM1440 precursor RNA does not encode a protein. A nucleotide sequence identical or highly similar to the nucleotide sequence of VGAM1440 precursor RNA is designated SEQ ID:1426, and is provided hereinbelow with reference to the sequence listing part. Nucleotide sequence SEQ ID:1426 is located at position 5334 relative to the genome of Bean Common Mosaic Necrosis Virus.

VGAM1440 precursor RNA folds onto itself, forming VGAM1440 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1440 folded precursor RNA into VGAM1440 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM1440 RNA is designated SEQ ID:4151, and is provided hereinbelow with reference to the sequence listing part.

VGAM1440 host target gene, herein designated VGAM HOST TARGET GENE, encodes a corresponding messenger RNA, VGAM1440 host target RNA, herein designated VGAM HOST TARGET RNA. VGAM1440 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1440 RNA, herein designated VGAM RNA, binds complementarily to one or more host target binding sites located in untranslated regions of VGAM1440 host target RNA, herein designated VGAM HOST TARGET RNA. This complementary binding is due to the fact that the nucleotide sequence of VGAM1440 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1440 RNA, herein designated VGAM RNA, may have a different number of host target binding sites in untranslated regions of a VGAM1440 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1440 RNA, herein designated VGAM RNA, to host target binding sites on VGAM1440 host target RNA, herein designated VGAM HOST TARGET RNA, such as BINDING SITE I, BINDING SITE II and BINDING SITE III, inhibits translation of VGAM1440 host target RNA into VGAM1440 host target protein, herein designated VGAM HOST TARGET PROTEIN. VGAM host target protein is therefore outlined by a broken line.

It is appreciated that VGAM1440 host target gene, herein designated VGAM HOST TARGET GENE, in fact represents a plurality of VGAM1440 host target genes. The mRNA of each one of this plurality of VGAM1440 host target genes comprises one or more host target binding sites, each having a nucleotide sequence which is at least partly complementary to VGAM1440 RNA, herein designated VGAM RNA, and which when bound by VGAM1440 RNA causes inhibition of translation of respective one or more VGAM1440 host target proteins.

It is further appreciated by one skilled in the art that the mode of translational inhibition illustrated by FIG. 1 with specific reference to translational inhibition exerted by VGAM1440 gene, herein designated VGAM GENE, on one or more VGAM1440 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1440 is inhibition of expression of host target genes, as part of a novel viral mechanism of attacking a host. Accordingly, utilities of VGAM1440 include diagnosis, prevention and treatment of viral infection by Bean Common Mosaic Necrosis Virus. Specific functions, and accordingly utilities, of VGAM1440 correlate with, and may be deduced from, the identity of the host target genes which VGAM1440 binds and inhibits, and the function of these host target genes, as elaborated hereinbelow.

Nucleotide sequences of the VGAM1440 precursor RNA, herein designated VGAM PRECURSOR RNA, and of the 'diced' VGAM1440 RNA, herein designated VGAM RNA, and a schematic representation of the secondary folding of VGAM1440 folded precursor RNA, herein designated VGAM FOLDED PRECURSOR RNA, of VGAM1440 are further described hereinbelow with reference to Table 1.

Nucleotide sequences of host target binding sites, such as BINDING SITE-I, BINDING SITE-II and BINDING SITE-III of FIG. 1, found on VGAM1440 host target RNA, and schematic representation of the complementarity of each of these host target binding sites to VGAM1440 RNA, herein designated VGAM RNA, are described hereinbelow with reference to Table 2.

As mentioned hereinabove with reference to FIG. 1, a function of VGAM1440 gene, herein designated VGAM is inhibition of expression of VGAM1440 target genes. It is appreciated that specific functions, and accordingly utilities, of VGAM1440 correlate with, and may be deduced from, the identity of the target genes which VGAM1440 binds and inhibits, and the function of these target genes, as elaborated hereinbelow.

Myeloma Overexpressed Gene (in a subset of t (11;14) Positive Multiple Myelomas) (MYEOV, Accession NM_138768) is a VGAM1440 host target gene. MYEOV BINDING SITE is HOST TARGET binding site found in the 5' untranslated region of mRNA encoded by MYEOV, corresponding to a HOST TARGET binding site such as BINDING SITE I, BINDING SITE II or BINDING SITE III. Table 2 illustrates the complementarity of the nucleotide sequences of MYEOV BINDING SITE, designated SEQ ID:28999, to the nucleotide sequence of VGAM1440 RNA, herein designated VGAM RNA, also designated SEQ ID:4151.

A function of VGAM1440 is therefore inhibition of Myeloma Overexpressed Gene (in a subset of t (11;14) Positive Multiple Myelomas) (MYEOV, Accession NM_138768), a gene which is encoded by MYELOMA OVEREXPRESSED GENE. Accordingly, utilities of VGAM1440 include diagnosis, prevention and treatment of diseases and clinical conditions associated with MYEOV. The function of MYEOV and its association with various diseases and clinical conditions, has been established by previous studies, as described hereinabove with reference to VGAM471. Solute Carrier Family 9 (sodium/hydrogen exchanger), Isoform 1 (antiporter, Na+/H+, amiloride sensitive) (SLC9A1, Accession XM_046881) is another VGAM1440 host target gene. SLC9A1 BINDING SITE is HOST TARGET binding site found in the 5' untranslated region of mRNA encoded by SLC9A1, corresponding to a HOST TARGET binding site such as BINDING SITE I, BINDING SITE II or BINDING SITE III. Table 2 illustrates the complementarity of the nucleotide sequences of SLC9A1 BINDING SITE, designated SEQ ID:34855, to the nucleotide sequence of VGAM1440 RNA, herein designated VGAM RNA, also designated SEQ ID:4151.

Another function of VGAM1440 is therefore inhibition of Solute Carrier Family 9 (sodium/hydrogen exchanger), Isoform 1 (antiporter, Na+/H+, amiloride sensitive) (SLC9A1, Accession XM_046881), a gene which is involved in ph regulation to eliminate acids generated by active metabolism or to counter adverse environmental conditions. Accordingly, utilities of VGAM1440 include diagnosis, prevention and treatment of diseases and clinical conditions associated with SLC9A1. The function of SLC9A1 and its association with various diseases and clinical conditions, has been established by previous studies, as described hereinabove with reference to VGAM206. DKFZP434B205 (Accession XM_059966) is another VGAM1440 host target gene. DKFZP434B205 BINDING SITE is HOST TARGET binding site found in the 3' untranslated region of mRNA encoded by DKFZP434B205, corresponding to a HOST TARGET binding site such as BINDING SITE I, BINDING SITE II or BINDING SITE III. Table 2 illustrates the complementarity of the nucleotide sequences of DKFZP434B205 BINDING SITE, designated SEQ ID:37127, to the nucleotide sequence of VGAM1440 RNA, herein designated VGAM RNA, also designated SEQ ID:4151.

Another function of VGAM1440 is therefore inhibition of DKFZP434B205 (Accession XM_059966). Accordingly, utilities of VGAM1440 include diagnosis, prevention and treatment of diseases and clinical conditions associated with DKFZP434B205. DKFZp434F142 (Accession NM_032254) is another VGAM1440 host target gene. DKFZp434F142 BINDING SITE is HOST TARGET binding site found in the 3' untranslated region of mRNA encoded by DKFZp434F142, corresponding to a HOST TARGET binding site such as BINDING SITE I, BINDING SITE II or BINDING SITE III. Table 2 illustrates the complementarity of the nucleotide sequences of DKFZp434F142 BINDING SITE, designated SEQ ID:25992, to the nucleotide sequence of VGAM1440 RNA, herein designated VGAM RNA, also designated SEQ ID:4151.

Another function of VGAM1440 is therefore inhibition of DKFZp434F142 (Accession NM_032254). Accordingly, utilities of VGAM1440 include diagnosis, prevention and treatment of diseases and clinical conditions associated with DKFZp434F142. FLJ14437 (Accession NM_032578) is another VGAM1440 host target gene. FLJ14437 BINDING SITE is HOST TARGET binding site found in the 5' untranslated region of mRNA encoded by FLJ14437, corresponding to a HOST TARGET binding site such as BINDING SITE I, BINDING SITE II or BINDING SITE III. Table 2 illustrates the complementarity of the nucleotide sequences of FLJ14437 BINDING SITE, designated SEQ ID:26310, to the nucleotide sequence of VGAM1440 RNA, herein designated VGAM RNA, also designated SEQ ID:4151.

Another function of VGAM1440 is therefore inhibition of FLJ14437 (Accession NM_032578). Accordingly, utilities of VGAM1440 include diagnosis, prevention and treatment of diseases and clinical conditions associated with FLJ14437. KIAA0522 (Accession XM_050404) is another VGAM1440 host target gene. KIAA0522 BINDING SITE is HOST TARGET binding site found in the 3' untranslated region of mRNA encoded by KIAA0522, corresponding to a HOST TARGET binding site such as BINDING SITE I, BINDING SITE II or BINDING SITE III. Table 2 illustrates the complementarity of the nucleotide sequences of KIAA0522 BINDING SITE, designated SEQ ID:35624, to the nucleotide sequence of VGAM1440 RNA, herein designated VGAM RNA, also designated SEQ ID:4151.

Another function of VGAM1440 is therefore inhibition of KIAA0522 (Accession XM_050404). Accordingly, utilities of VGAM1440 include diagnosis, prevention and treatment of diseases and clinical conditions associated with KIAA0522. MGC11287 (Accession NM_031464) is another VGAM1440 host target gene. MGC11287 BINDING SITE is HOST TARGET binding site found in the 3' untranslated region of mRNA encoded by MGC11287, corresponding to a HOST TARGET binding site such as BINDING SITE I, BINDING SITE II or BINDING SITE III. Table 2 illustrates the complementarity of the nucleotide sequences of MGC11287 BINDING SITE, designated SEQ ID:25500, to the nucleotide sequence of VGAM1440 RNA, herein designated VGAM RNA, also designated SEQ ID:4151.

Another function of VGAM1440 is therefore inhibition of MGC11287 (Accession NM_031464). Accordingly, utilities of VGAM1440 include diagnosis, prevention and treatment of diseases and clinical conditions associated with MGC11287. NPC1 (Niemann-Pick disease, type C1, gene)-like 1 (NPC1L1, Accession NM_013389) is another VGAM1440 host target gene. NPC1L1 BINDING SITE is HOST TARGET binding site found in the 3' untranslated region of mRNA encoded by NPC1L1, corresponding to a HOST TARGET binding site such as BINDING SITE I, BINDING SITE II or BINDING SITE III. Table 2 illustrates the complementarity of the nucleotide sequences of NPC1L1 BINDING SITE, designated SEQ ID:15039, to the nucleotide sequence of VGAM1440 RNA, herein designated VGAM RNA, also designated SEQ ID:4151.

Another function of VGAM1440 is therefore inhibition of NPC1 (Niemann-Pick disease, type C1, gene)-like 1 (NPC1L1, Accession NM_013389). Accordingly, utilities of VGAM1440 include diagnosis, prevention and treatment of diseases and clinical conditions associated with NPC1L1. PP3501 (Accession NM_021731) is another VGAM1440 host target gene. PP3501 BINDING SITE is HOST TARGET binding site found in the 3' untranslated region of mRNA encoded by PP3501, corresponding to a HOST TARGET binding site such as BINDING SITE I, BINDING SITE II or BINDING SITE III. Table 2 illustrates the complementarity of the nucleotide sequences of PP3501 BINDING SITE, designated SEQ ID:22330, to the nucleotide sequence of VGAM1440 RNA, herein designated VGAM RNA, also designated SEQ ID:4151.

Another function of VGAM1440 is therefore inhibition of PP3501 (Accession NM_021731). Accordingly, utilities of VGAM1440 include diagnosis, prevention and treatment of diseases and clinical conditions associated with PP3501. LOC129676 (Accession XM_065341) is another VGAM1440 host target gene. LOC129676 BINDING SITE is HOST TARGET binding site found in the 5' untranslated region of mRNA encoded by LOC129676, corresponding to a HOST TARGET binding site such as BINDING SITE I, BINDING SITE II or BINDING SITE III. Table 2 illustrates the complementarity of the nucleotide sequences of LOC129676 BINDING SITE, designated SEQ ID:37282, to the nucleotide sequence of VGAM1440 RNA, herein designated VGAM RNA, also designated SEQ ID:4151.

Another function of VGAM1440 is therefore inhibition of LOC129676 (Accession XM_065341). Accordingly, utilities of VGAM1440 include diagnosis, prevention and treatment of diseases and clinical conditions associated with LOC129676. LOC145624 (Accession XM_096824) is another VGAM1440 host target gene. LOC145624 BINDING SITE is HOST TARGET binding site found in the 5' untranslated region of mRNA encoded by LOC145624, corresponding to a HOST TARGET binding site such as BINDING SITE I, BINDING SITE II or BINDING SITE III. Table 2 illustrates the complementarity of the nucleotide sequences of LOC145624 BINDING SITE, designated SEQ ID:40549, to the nucleotide sequence of VGAM1440 RNA, herein designated VGAM RNA, also designated SEQ ID:4151.

Another function of VGAM1440 is therefore inhibition of LOC145624 (Accession XM_096824). Accordingly, utilities of VGAM1440 include diagnosis, prevention and treatment of diseases and clinical conditions associated with LOC145624. LOC146988 (Accession XM_097150) is another VGAM1440 host target gene. LOC146988 BINDING SITE is HOST TARGET binding site found in the 3' untranslated region of mRNA encoded by LOC146988, corresponding to a HOST TARGET binding site such as BINDING SITE I, BINDING SITE II or BINDING SITE III. Table 2 illustrates the complementarity of the nucleotide sequences of LOC146988 BINDING SITE, designated SEQ ID:40778, to the nucleotide sequence of VGAM1440 RNA, herein designated VGAM RNA, also designated SEQ ID:4151.

Another function of VGAM1440 is therefore inhibition of LOC146988 (Accession XM_097150). Accordingly, utilities of VGAM1440 include diagnosis, prevention and treatment of diseases and clinical conditions associated with LOC146988. LOC147004 (Accession XM_097155) is another VGAM1440 host target gene. LOC147004 BINDING SITE is HOST TARGET binding site found in the 3' untranslated region of mRNA encoded by LOC147004, corresponding to a HOST TARGET binding site such as BINDING SITE I, BINDING SITE II or BINDING SITE III. Table 2 illustrates the complementarity of the nucleotide sequences of LOC147004 BINDING SITE, designated SEQ ID:40781, to the nucleotide sequence of VGAM1440 RNA, herein designated VGAM RNA, also designated SEQ ID:4151.

Another function of VGAM1440 is therefore inhibition of LOC147004 (Accession XM_097155). Accordingly, utilities of VGAM1440 include diagnosis, prevention and treatment of diseases and clinical conditions associated with LOC147004. LOC148181 (Accession XM_086083) is another VGAM1440 host target gene. LOC148181 BINDING SITE is HOST TARGET binding site found in the 5' untranslated region of mRNA encoded by LOC148181, corresponding to a HOST TARGET binding site such as BINDING SITE I, BINDING SITE II or BINDING SITE III. Table 2 illustrates the complementarity of the nucleotide sequences of LOC148181 BINDING SITE, designated SEQ ID:38481, to the nucleotide sequence of VGAM1440 RNA, herein designated VGAM RNA, also designated SEQ ID:4151.

Another function of VGAM1440 is therefore inhibition of LOC148181 (Accession XM_086083). Accordingly, utilities of VGAM1440 include diagnosis, prevention and treatment of diseases and clinical conditions associated with LOC148181. LOC148930 (Accession XM_086369) is another VGAM1440 host target gene. LOC148930 BINDING SITE is HOST TARGET binding site found in the 3' untranslated region of mRNA encoded by LOC148930, corresponding to a HOST TARGET binding site such as BINDING SITE I, BINDING SITE II or BINDING SITE III. Table 2 illustrates the complementarity of the nucleotide sequences of LOC148930 BINDING SITE, designated SEQ ID:38622, to the nucleotide sequence of VGAM1440 RNA, herein designated VGAM RNA, also designated SEQ ID:4151.

Another function of VGAM1440 is therefore inhibition of LOC148930 (Accession XM_086369). Accordingly, utilities of VGAM1440 include diagnosis, prevention and treatment of diseases and clinical conditions associated with LOC148930. LOC150630 (Accession XM_097931) is another VGAM1440 host target gene. LOC150630 BINDING SITE is HOST TARGET binding site found in the 3' untranslated region of mRNA encoded by LOC150630, corresponding to a HOST TARGET binding site such as BINDING SITE I, BINDING SITE II or BINDING SITE III. Table 2 illustrates the complementarity of the nucleotide sequences of LOC150630 BINDING SITE, designated SEQ ID:41238, to the nucleotide sequence of VGAM1440 RNA, herein designated VGAM RNA, also designated SEQ ID:4151.

Another function of VGAM1440 is therefore inhibition of LOC150630 (Accession XM_097931). Accordingly, utilities of VGAM1440 include diagnosis, prevention and treatment of diseases and clinical conditions associated with LOC150630. LOC151445 (Accession XM_045283) is another VGAM1440 host target gene. LOC151445 BINDING SITE is HOST TARGET binding site found in the 3' untranslated region of mRNA encoded by LOC151445, corresponding to a HOST TARGET binding site such as BINDING SITE I, BINDING SITE II or BINDING SITE III. Table 2 illustrates the complementarity of the nucleotide sequences of LOC151445 BINDING SITE, designated SEQ ID:34420, to the nucleotide sequence of VGAM1440 RNA, herein designated VGAM RNA, also designated SEQ ID:4151.

Another function of VGAM1440 is therefore inhibition of LOC151445 (Accession XM_045283). Accordingly, utilities of VGAM1440 include diagnosis, prevention and treatment of diseases and clinical conditions associated with LOC151445. LOC152313 (Accession XM_098190) is another VGAM1440 host target gene. LOC152313 BINDING SITE is HOST TARGET binding site found in the 5' untranslated region of mRNA encoded by LOC152313, corresponding to a HOST TARGET binding site such as BINDING SITE I, BINDING SITE II or BINDING SITE III. Table 2 illustrates the complementarity of the nucleotide sequences of LOC152313 BINDING SITE, designated SEQ ID:41481, to the nucleotide sequence of VGAM1440 RNA, herein designated VGAM RNA, also designated SEQ ID:4151.

Another function of VGAM1440 is therefore inhibition of LOC152313 (Accession XM_098190). Accordingly, utilities of VGAM1440 include diagnosis, prevention and treatment of diseases and clinical conditions associated with LOC152313. LOC154990 (Accession XM_088109) is another VGAM1440 host target gene. LOC154990 BINDING SITE is HOST TARGET binding site found in the 5' untranslated region of mRNA encoded by LOC154990, corresponding to a HOST TARGET binding site such as BINDING SITE I, BINDING SITE II or BINDING SITE III. Table 2 illustrates the complementarity of the nucleotide sequences of LOC154990 BINDING SITE, designated SEQ ID:39521, to the nucleotide sequence of VGAM1440 RNA, herein designated VGAM RNA, also designated SEQ ID:4151.

Another function of VGAM1440 is therefore inhibition of LOC154990 (Accession XM_088109). Accordingly, utilities of VGAM1440 include diagnosis, prevention and treatment of diseases and clinical conditions associated with LOC154990. LOC158476 (Accession XM_098955) is another VGAM1440 host target gene. LOC158476 BINDING SITE is HOST TARGET binding site found in the 5' untranslated region of mRNA encoded by LOC158476, corresponding to a HOST TARGET binding site such as BINDING SITE I, BINDING SITE II or BINDING SITE III. Table 2 illustrates the complementarity of the nucleotide sequences of LOC158476 BINDING SITE, designated SEQ ID:42002, to the nucleotide sequence of VGAM1440 RNA, herein designated VGAM RNA, also designated SEQ ID:4151.

Another function of VGAM1440 is therefore inhibition of LOC158476 (Accession XM_098955). Accordingly, utilities of VGAM1440 include diagnosis, prevention and treatment of diseases and clinical conditions associated with LOC158476. LOC158835 (Accession XM_088683) is another VGAM1440 host target gene. LOC158835 BINDING SITE is HOST TARGET binding site found in the 3' untranslated region of mRNA encoded by LOC158835, corresponding to a HOST TARGET binding site such as BINDING SITE I, BINDING SITE II or BINDING SITE III. Table 2 illustrates the complementarity of the nucleotide sequences of LOC158835 BINDING SITE, designated SEQ ID:39894, to the nucleotide sequence of VGAM1440 RNA, herein designated VGAM RNA, also designated SEQ ID:4151.

Another function of VGAM1440 is therefore inhibition of LOC158835 (Accession XM_088683). Accordingly, utilities of VGAM1440 include diagnosis, prevention and treatment of diseases and clinical conditions associated with LOC158835. LOC196872 (Accession XM_113760) is another VGAM1440 host target gene. LOC196872 BINDING SITE is HOST TARGET binding site found in the 5' untranslated region of mRNA encoded by LOC196872, corresponding to a HOST TARGET binding site such as BINDING SITE I, BINDING SITE II or BINDING SITE III. Table 2 illustrates the complementarity of the nucleotide sequences of LOC196872 BINDING SITE, designated SEQ ID:42417, to the nucleotide sequence of VGAM1440 RNA, herein designated VGAM RNA, also designated SEQ ID:4151.

Another function of VGAM1440 is therefore inhibition of LOC196872 (Accession XM_113760). Accordingly, utilities of VGAM1440 include diagnosis, prevention and treatment of diseases and clinical conditions associated with LOC196872. LOC200261 (Accession XM_114172) is another VGAM1440 host target gene. LOC200261 BINDING SITE is HOST TARGET binding site found in the 3' untranslated region of mRNA encoded by LOC200261, corresponding to a HOST TARGET binding site such as BINDING SITE I, BINDING SITE II or BINDING SITE III. Table 2 illustrates the complementarity of the nucleotide sequences of LOC200261 BINDING SITE, designated SEQ ID:42753, to the nucleotide sequence of VGAM1440 RNA, herein designated VGAM RNA, also designated SEQ ID:4151.

Another function of VGAM1440 is therefore inhibition of LOC200261 (Accession XM_114172). Accordingly, utilities of VGAM1440 include diagnosis, prevention and treatment of diseases and clinical conditions associated with LOC200261. LOC222134 (Accession XM_168432) is another VGAM1440 host target gene. LOC222134 BINDING SITE is HOST TARGET binding site found in the 5' untranslated region of mRNA encoded by LOC222134, corresponding to a HOST TARGET binding site such as BINDING SITE I, BINDING SITE II or BINDING SITE III. Table 2 illustrates the complementarity of the nucleotide sequences of LOC222134 BINDING SITE, designated SEQ ID:45173, to the nucleotide sequence of VGAM1440 RNA, herein designated VGAM RNA, also designated SEQ ID:4151.

Another function of VGAM1440 is therefore inhibition of LOC222134 (Accession XM_168432). Accordingly, utilities of VGAM1440 include diagnosis, prevention and treatment of diseases and clinical conditions associated with LOC222134. LOC254173 (Accession XM_173022) is another VGAM1440 host target gene. LOC254173 BINDING SITE is HOST TARGET binding site found in the 3' untranslated region of mRNA encoded by LOC254173, corresponding to a HOST TARGET binding site such as BINDING SITE I, BINDING SITE II or BINDING SITE III. Table 2 illustrates the complementarity of the nucleotide sequences of LOC254173 BINDING SITE, designated SEQ ID:46286, to the nucleotide sequence of VGAM1440 RNA, herein designated VGAM RNA, also designated SEQ ID:4151.

Another function of VGAM1440 is therefore inhibition of LOC254173 (Accession XM_173022). Accordingly, utilities of VGAM1440 include diagnosis, prevention and treatment of diseases and clinical conditions associated with LOC254173. LOC255975 (Accession XM_171083) is another VGAM1440 host target gene. LOC255975 BINDING SITE is HOST TARGET binding site found in the 5' untranslated region of mRNA encoded by LOC255975, corresponding to a HOST TARGET binding site such as BINDING SITE I, BINDING SITE II or BINDING SITE III. Table 2 illustrates the complementarity of the nucleotide sequences of LOC255975 BINDING SITE, designated SEQ ID:45891, to the nucleotide sequence of VGAM1440 RNA, herein designated VGAM RNA, also designated SEQ ID:4151.

Another function of VGAM1440 is therefore inhibition of LOC255975 (Accession XM_171083). Accordingly, utilities of VGAM1440 include diagnosis, prevention and treatment of diseases and clinical conditions associated with LOC255975. LOC256529 (Accession XM_174314) is another VGAM1440 host target gene. LOC256529 BINDING SITE is HOST TARGET binding site found in the 5' untranslated region of mRNA encoded by LOC256529, corresponding to a HOST TARGET binding site such as BINDING SITE I, BINDING SITE II or BINDING SITE III. Table 2 illustrates the complementarity of the nucleotide sequences of LOC256529 BINDING SITE, designated SEQ ID:46589, to the nucleotide sequence of VGAM1440 RNA, herein designated VGAM RNA, also designated SEQ ID:4151.

Another function of VGAM1440 is therefore inhibition of LOC256529 (Accession XM_174314). Accordingly, utilities of VGAM1440 include diagnosis, prevention and treatment of diseases and clinical conditions associated with LOC256529. FIG. 1 further provides a conceptual description of a novel bioinformatically detected viral gene of the present invention, referred to here as Viral Genomic Address Messenger 1441 (VGAM1441) viral gene, which modulates expression of respective host target genes thereof, the function and utility of which host target genes is known in the art.

VGAM1441 is a novel bioinformatically detected regulatory, non protein coding, viral micro RNA (miRNA) gene.

The method by which VGAM1441 was detected is described hereinabove with reference to FIGS. 1-8.

VGAM1441 gene, herein designated VGAM GENE, is a viral gene contained in the genome of Bean Common Mosaic Necrosis Virus. VGAM1441 host target gene, herein designated VGAM HOST TARGET GENE, is a human gene contained in the human genome.

VGAM1441 gene encodes a VGAM1441 precursor RNA, herein designated VGAM PRECURSOR RNA. Similar to other miRNA genes, and unlike most ordinary genes, VGAM1441 precursor RNA does not encode a protein. A nucleotide sequence identical or highly similar to the nucleotide sequence of VGAM1441 precursor RNA is designated SEQ ID:1427, and is provided hereinbelow with reference to the sequence listing part. Nucleotide sequence SEQ ID:1427 is located at position 5472 relative to the genome of Bean Common Mosaic Necrosis Virus.

VGAM1441 precursor RNA folds onto itself, forming VGAM1441 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1441 folded precursor RNA into VGAM1441 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1441 RNA is designated SEQ ID:4152, and is provided hereinbelow with reference to the sequence listing part.

VGAM1441 host target gene, herein designated VGAM HOST TARGET GENE, encodes a corresponding messenger RNA, VGAM1441 host target RNA, herein designated VGAM HOST TARGET RNA. VGAM1441 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1441 RNA, herein designated VGAM RNA, binds complementarily to one or more host target binding sites located in untranslated regions of VGAM1441 host target RNA, herein designated VGAM HOST TARGET RNA. This complementary binding is due to the fact that the nucleotide sequence of VGAM1441 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1441 RNA, herein designated VGAM RNA, may have a different number of host target binding sites in untranslated regions of a VGAM1441 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1441 RNA, herein designated VGAM RNA, to host target binding sites on VGAM1441 host target RNA, herein designated VGAM HOST TARGET RNA, such as BINDING SITE I, BINDING SITE II and BINDING SITE III, inhibits translation of VGAM1441 host target RNA into VGAM1441 host target protein, herein designated VGAM HOST TARGET PROTEIN. VGAM host target protein is therefore outlined by a broken line.

It is appreciated that VGAM1441 host target gene, herein designated VGAM HOST TARGET GENE, in fact represents a plurality of VGAM1441 host target genes. The mRNA of each one of this plurality of VGAM1441 host target genes comprises one or more host target binding sites, each having a nucleotide sequence which is at least partly complementary to VGAM1441 RNA, herein designated VGAM RNA, and which when bound by VGAM1441 RNA causes inhibition of translation of respective one or more VGAM1441 host target proteins.

It is further appreciated by one skilled in the art that the mode of translational inhibition illustrated by FIG. 1 with specific reference to translational inhibition exerted by VGAM1441 gene, herein designated VGAM GENE, on one or more VGAM1441 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1441 is inhibition of expression of host target genes, as part of a novel viral mechanism of attacking a host. Accordingly, utilities of VGAM1441 include diagnosis, prevention and treatment of viral infection by Bean Common Mosaic Necrosis Virus. Specific functions, and accordingly utilities, of VGAM1441 correlate with, and may be deduced from, the identity of the host target genes which VGAM1441 binds and inhibits, and the function of these host target genes, as elaborated hereinbelow.

Nucleotide sequences of the VGAM1441 precursor RNA, herein designated VGAM PRECURSOR RNA, and of the 'diced' VGAM1441 RNA, herein designated VGAM RNA, and a schematic representation of the secondary folding of VGAM1441 folded precursor RNA, herein designated VGAM FOLDED PRECURSOR RNA, of VGAM1441 are further described hereinbelow with reference to Table 1.

Nucleotide sequences of host target binding sites, such as BINDING SITE-I, BINDING SITE-II and BINDING SITE-III of FIG. 1, found on VGAM1441 host target RNA, and schematic representation of the complementarity of each of these host target binding sites to VGAM1441 RNA, herein designated VGAM RNA, are described hereinbelow with reference to Table 2.

As mentioned hereinabove with reference to FIG. 1, a function of VGAM1441 gene, herein designated VGAM is inhibition of expression of VGAM1441 target genes. It is appreciated that specific functions, and accordingly utilities, of VGAM1441 correlate with, and may be deduced from, the identity of the target genes which VGAM1441 binds and inhibits, and the function of these target genes, as elaborated hereinbelow.

Thiopurine S-methyltransferase (TPMT, Accession NM_000367) is a VGAM1441 host target gene. TPMT BINDING SITE is HOST TARGET binding site found in the 3' untranslated region of mRNA encoded by TPMT, corresponding to a HOST TARGET binding site such as BINDING SITE I, BINDING SITE II or BINDING SITE III. Table 2 illustrates the complementarity of the nucleotide sequences of TPMT BINDING SITE, designated SEQ ID:5938, to the nucleotide sequence of VGAM1441 RNA, herein designated VGAM RNA, also designated SEQ ID:4152.

A function of VGAM1441 is therefore inhibition of Thiopurine S-methyltransferase (TPMT, Accession NM_000367), a gene which catalyzes the s-methylation of thiopurine drugs such as 6-mercaptopurine. Accordingly, utilities of VGAM1441 include diagnosis, prevention and treatment of diseases and clinical conditions associated with TPMT. The function of TPMT and its association with various diseases and clinical conditions, has been established by previous studies, as described hereinabove with reference to VGAM682. Heterogeneous Nuclear Ribonucleoprotein A3 (HNRPA3, Accession NM_005758) is another VGAM1441 host target gene. HNRPA3 BINDING SITE is HOST TARGET binding site found in the 3' untranslated region of mRNA encoded by HNRPA3, corresponding to a HOST TARGET binding site such as BINDING SITE I, BINDING SITE II or BINDING SITE III. Table 2 illustrates the complementarity of the nucleotide sequences of HNRPA3 BINDING SITE, designated SEQ ID:12323, to the nucleotide sequence of VGAM1441 RNA, herein designated VGAM RNA, also designated SEQ ID:4152.

Another function of VGAM1441 is therefore inhibition of Heterogeneous Nuclear Ribonucleoprotein A3 (HNRPA3, Accession NM_005758). Accordingly, utilities of VGAM1441 include diagnosis, prevention and treatment of diseases and clinical conditions associated with HNRPA3. LOC201564 (Accession XM_087368) is another VGAM1441 host target gene. LOC201564 BINDING SITE is HOST TARGET binding site found in the 3' untranslated region of mRNA encoded by LOC201564, corresponding to a HOST TARGET binding site such as BINDING SITE I, BINDING SITE II or BINDING SITE III. Table 2 illustrates the complementarity of the nucleotide sequences of LOC201564 BINDING SITE, designated SEQ ID:39200, to the nucleotide sequence of VGAM1441 RNA, herein designated VGAM RNA, also designated SEQ ID:4152.

Another function of VGAM1441 is therefore inhibition of LOC201564 (Accession XM_087368). Accordingly, utilities of VGAM1441 include diagnosis, prevention and treatment of diseases and clinical conditions associated with LOC201564. LOC220988 (Accession XM_165561) is another VGAM1441 host target gene. LOC220988 BINDING SITE is HOST TARGET binding site found in the 3' untranslated region of mRNA encoded by LOC220988, corresponding to a HOST TARGET binding site such as BINDING SITE I, BINDING SITE II or BINDING SITE III. Table 2 illustrates the complementarity of the nucleotide sequences of LOC220988 BINDING SITE, designated SEQ ID:43682, to the nucleotide sequence of VGAM1441 RNA, herein designated VGAM RNA, also designated SEQ ID:4152.

Another function of VGAM1441 is therefore inhibition of LOC220988 (Accession XM_165561). Accordingly, utilities of VGAM1441 include diagnosis, prevention and treatment of diseases and clinical conditions associated with LOC220988. FIG. 1 further provides a conceptual description of a novel bioinformatically detected viral gene of the present invention, referred to here as Viral Genomic Address Messenger 1442 (VGAM1442) viral gene, which modulates expression of respective host target genes thereof, the function and utility of which host target genes is known in the art.

VGAM1442 is a novel bioinformatically detected regulatory, non protein coding, viral micro RNA (miRNA) gene. The method by which VGAM1442 was detected is described hereinabove with reference to FIGS. 1-8.

VGAM1442 gene, herein designated VGAM GENE, is a viral gene contained in the genome of Bean Common Mosaic Necrosis Virus. VGAM1442 host target gene, herein designated VGAM HOST TARGET GENE, is a human gene contained in the human genome.

VGAM1442 gene encodes a VGAM1442 precursor RNA, herein designated VGAM PRECURSOR RNA. Similar to other miRNA genes, and unlike most ordinary genes, VGAM1442 precursor RNA does not encode a protein. A nucleotide sequence identical or highly similar to the nucleotide sequence of VGAM1442 precursor RNA is designated SEQ ID:1428, and is provided hereinbelow with reference to the sequence listing part. Nucleotide sequence SEQ ID:1428 is located at position 7222 relative to the genome of Bean Common Mosaic Necrosis Virus.

VGAM1442 precursor RNA folds onto itself, forming VGAM1442 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1442 folded precursor RNA into VGAM1442 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1442 RNA is designated SEQ ID:4153, and is provided hereinbelow with reference to the sequence listing part.

VGAM1442 host target gene, herein designated VGAM HOST TARGET GENE, encodes a corresponding messenger RNA, VGAM1442 host target RNA, herein designated VGAM HOST TARGET RNA. VGAM1442 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1442 RNA, herein designated VGAM RNA, binds complementarily to one or more host target binding sites located in untranslated regions of VGAM1442 host target RNA, herein designated VGAM HOST TARGET RNA. This complementary binding is due to the fact that the nucleotide sequence of VGAM1442 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1442 RNA, herein designated VGAM RNA, may have a different number of host target binding sites in untranslated regions of a VGAM1442 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1442 RNA, herein designated VGAM RNA, to host target binding sites on VGAM1442 host target RNA, herein designated VGAM HOST TARGET RNA, such as BINDING SITE I, BINDING SITE II and BINDING SITE III, inhibits translation of VGAM1442 host target RNA into VGAM1442 host target protein, herein designated VGAM HOST TARGET PROTEIN. VGAM host target protein is therefore outlined by a broken line.

It is appreciated that VGAM1442 host target gene, herein designated VGAM HOST TARGET GENE, in fact represents a plurality of VGAM1442 host target genes. The mRNA of each one of this plurality of VGAM1442 host target genes comprises one or more host target binding sites, each having a nucleotide sequence which is at least partly complementary to VGAM1442 RNA, herein designated VGAM RNA, and which when bound by VGAM1442 RNA causes inhibition of translation of respective one or more VGAM1442 host target proteins.

It is further appreciated by one skilled in the art that the mode of translational inhibition illustrated by FIG. 1 with specific reference to translational inhibition exerted by VGAM1442 gene, herein designated VGAM GENE, on one or more VGAM1442 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1442 is inhibition of expression of host target genes, as part of a novel viral mechanism of attacking a host. Accordingly, utilities of VGAM1442 include diagnosis, prevention and treatment of viral infection by Bean Common Mosaic Necrosis Virus. Specific functions, and accordingly utilities, of VGAM1442 correlate with, and may be deduced from, the identity of the host target genes which VGAM1442 binds and inhibits, and the function of these host target genes, as elaborated hereinbelow.

Nucleotide sequences of the VGAM1442 precursor RNA, herein designated VGAM PRECURSOR RNA, and of the 'diced' VGAM1442 RNA, herein designated VGAM RNA, and a schematic representation of the secondary folding of VGAM1442 folded precursor RNA, herein designated VGAM FOLDED PRECURSOR RNA, of VGAM1442 are further described hereinbelow with reference to Table 1.

Nucleotide sequences of host target binding sites, such as BINDING SITE-I, BINDING SITE-II and BINDING SITE-III of FIG. 1, found on VGAM1442 host target RNA, and schematic representation of the complementarity of each of these host target binding sites to VGAM1442 RNA, herein designated VGAM RNA, are described hereinbelow with reference to Table 2.

As mentioned hereinabove with reference to FIG. 1, a function of VGAM1442 gene, herein designated VGAM is inhibition of expression of VGAM1442 target genes. It is appreciated that specific functions, and accordingly utilities, of VGAM1442 correlate with, and may be deduced from, the identity of the target genes which VGAM1442 binds and inhibits, and the function of these target genes, as elaborated hereinbelow.

Gamma-aminobutyric Acid (GABA) A Receptor, Epsilon (GABRE, Accession NM_021990) is a VGAM1442 host target gene. GABRE BINDING SITE is HOST TARGET binding site found in the 5' untranslated region of mRNA encoded by GABRE, corresponding to a HOST TARGET binding site such as BINDING SITE I, BINDING SITE II or BINDING SITE III. Table 2 illustrates the complementarity of the nucleotide sequences of GABRE BINDING SITE, designated SEQ ID:22530, to the nucleotide sequence of VGAM1442 RNA, herein designated VGAM RNA, also designated SEQ ID:4153.

A function of VGAM1442 is therefore inhibition of Gamma-aminobutyric Acid (GABA) A Receptor, Epsilon (GABRE, Accession NM_021990), a gene which mediates neuronal inhibition by binding to the gaba/benzodiazepine receptor and opening an integral chloride channel. Accordingly, utilities of VGAM1442 include diagnosis, prevention and treatment of diseases and clinical conditions associated with GABRE. The function of GABRE and its association with various diseases and clinical conditions, has been established by previous studies, as described hereinabove with reference to VGAM259. Inducible T-cell Co-stimulator (ICOS, Accession NM_012092) is another VGAM1442 host target gene. ICOS BINDING SITE is HOST TARGET binding site found in the 3' untranslated region of mRNA encoded by ICOS, corresponding to a HOST TARGET binding site such as BINDING SITE I, BINDING SITE II or BINDING SITE III. Table 2 illustrates the complementarity of the nucleotide sequences of ICOS BINDING SITE, designated SEQ ID:14389, to the nucleotide sequence of VGAM1442 RNA, herein designated VGAM RNA, also designated SEQ ID:4153.

Another function of VGAM1442 is therefore inhibition of Inducible T-cell Co-stimulator (ICOS, Accession NM_012092), a gene which forms homodimers and functions as an inducible T-cell co-stimulator. Accordingly, utilities of VGAM1442 include diagnosis, prevention and treatment of diseases and clinical conditions associated with ICOS. The function of ICOS and its association with various diseases and clinical conditions, has been established by previous studies, as described hereinabove with reference to VGAM18. NEBL (Accession NM_006393) is another VGAM1442 host target gene. NEBL BINDING SITE is HOST TARGET binding site found in the 3' untranslated region of mRNA encoded by NEBL, corresponding to a HOST TARGET binding site such as BINDING SITE I, BINDING SITE II or BINDING SITE III. Table 2 illustrates the complementarity of the nucleotide sequences of NEBL BINDING SITE, designated SEQ ID:13101, to the nucleotide sequence of VGAM1442 RNA, herein designated VGAM RNA, also designated SEQ ID:4153.

Another function of VGAM1442 is therefore inhibition of NEBL (Accession NM_006393). Accordingly, utilities of VGAM1442 include diagnosis, prevention and treatment of diseases and clinical conditions associated with NEBL. Recombination Activating Gene 1 (RAG1, Accession NM_000448) is another VGAM1442 host target gene. RAG1 BINDING SITE is HOST TARGET binding site found in the 3' untranslated region of mRNA encoded by RAG1, corresponding to a HOST TARGET binding site such as BINDING SITE I, BINDING SITE II or BINDING SITE III. Table 2 illustrates the complementarity of the nucleotide sequences of RAG1 BINDING SITE, designated SEQ ID:6038, to the nucleotide sequence of VGAM1442 RNA, herein designated VGAM RNA, also designated SEQ ID:4153.

Another function of VGAM1442 is therefore inhibition of Recombination Activating Gene 1 (RAG1, Accession NM_000448). Accordingly, utilities of VGAM1442 include diagnosis, prevention and treatment of diseases and clinical conditions associated with RAG1. Retinoblastoma-like 2 (p130) (RBL2, Accession NM_005611) is another VGAM1442 host target gene. RBL2 BINDING SITE is HOST TARGET binding site found in the 3' untranslated region of mRNA encoded by RBL2, corresponding to a HOST TARGET binding site such as BINDING SITE I, BINDING SITE II or BINDING SITE III. Table 2 illustrates the complementarity of the nucleotide sequences of RBL2 BINDING SITE, designated SEQ ID:12132, to the nucleotide sequence of VGAM1442 RNA, herein designated VGAM RNA, also designated SEQ ID:4153.

Another function of VGAM1442 is therefore inhibition of Retinoblastoma-like 2 (p130) (RBL2, Accession NM_005611), a gene which may be a tumor suppressor. Accordingly, utilities of VGAM1442 include diagnosis, prevention and treatment of diseases and clinical conditions associated with RBL2. The function of RBL2 has been established by previous studies. Mayol et al. (1993) cloned a retinoblastoma-related human gene, referred to as RB2, on the basis of sequence homology of the E1A-binding domain of the retinoblastoma gene (RB1; 180200). Structural homology with RB1 suggested a possible function of RB2 as a tumor suppressor gene. Yeung et al. (1993) mapped the gene to human chromosome 16q12.2 and rat chromosome 19, using fluorescence in situ hybridization and somatic hybrid cell analysis, respectively. Based on known syntenic relationships among human, rat and mouse, the data suggested that the mouse homolog resides on chromosome 8. Deletions of chromosome 16q have been found in several human neoplasms, including breast, ovarian, hepatic, and prostatic cancers, which supports the involvement of RB2 in human cancer as a tumor suppressor gene. This locus is symbolized RBL2 because it was identified after the gene on chromosome 20, which is symbolized RBL1 (OMIM Ref. No. 116957). RBL1 has a molecular weight of 107 kD; RBL2 has a molecular weight of about 120 kD.

Full details of the abovementioned studies are described in the following publications, the disclosure of which are hereby incorporated by reference:

Baldi, A.; Boccia, V.; Claudio, P. P.; De Luca, A.; Giordano, A.: Genomic structure of the human retinoblastoma-related Rb2/p130 gene. Proc. Nat. Acad. Sci. 93:4629-4632, 1996; and Mayol, X.; Grana, X.; Baldi, A.; Sang, N.; Hu, Q.; Giordano, A.: Cloning of a new member of the retinoblastoma gene family (pRb2) which binds to the E1A transforming domain. Oncogene.

Further studies establishing the function and utilities of RBL2 are found in John Hopkins OMIM database record ID 180203, and in sited publications numbered 5666-5668 listed in the bibliography section hereinbelow, which are also hereby incorporated by reference. SH3-domain Binding Protein 2 (SH3BP2, Accession NM_003023) is another VGAM1442 host target gene. SH3BP2 BINDING SITE is HOST TARGET binding site found in the 3' untranslated region of mRNA encoded by SH3BP2, corresponding to a HOST TARGET binding site such as BINDING SITE I, BINDING SITE II or BINDING SITE III. Table 2 illustrates the complementarity of the nucleotide sequences of SH3BP2 BINDING SITE, designated SEQ ID:8944, to the nucleotide sequence of VGAM1442 RNA, herein designated VGAM RNA, also designated SEQ ID:4153.

Another function of VGAM1442 is therefore inhibition of SH3-domain Binding Protein 2 (SH3BP2, Accession NM_003023). Accordingly, utilities of VGAM1442 include diagnosis, prevention and treatment of diseases and clinical conditions associated with SH3BP2. Tafazzin (cardiomyopathy, dilated 3A (X-linked); Endocardial Fibroelastosis 2; Barth Syndrome) (TAZ, Accession NM_000116) is another VGAM1442 host target gene. TAZ BINDING SITE is HOST TARGET binding site found in the 3' untranslated region of mRNA encoded by TAZ, corresponding to a HOST TARGET binding site such as BINDING SITE I, BINDING SITE II or BINDING SITE III. Table 2 illustrates the complementarity of the nucleotide sequences of TAZ BINDING SITE, designated SEQ ID:5587, to the nucleotide sequence of VGAM1442 RNA, herein designated VGAM RNA, also designated SEQ ID:4153.

Another function of VGAM1442 is therefore inhibition of Tafazzin (cardiomyopathy, dilated 3A (X-linked); Endocardial Fibroelastosis 2; Barth Syndrome) (TAZ, Accession NM_000116). Accordingly, utilities of VGAM1442 include diagnosis, prevention and treatment of diseases and clinical conditions associated with TAZ. TIM3 (Accession NM_032782) is another VGAM1442 host target gene. TIM3 BINDING SITE is HOST TARGET binding site found in the 3' untranslated region of mRNA encoded by TIM3, corresponding to a HOST TARGET binding site such as BINDING SITE I, BINDING SITE II or BINDING SITE III. Table 2 illustrates the complementarity of the nucleotide sequences of TIM3 BINDING SITE, designated SEQ ID:26525, to the nucleotide sequence of VGAM1442 RNA, herein designated VGAM RNA, also designated SEQ ID:4153.

Another function of VGAM1442 is therefore inhibition of TIM3 (Accession NM_032782), a gene which regulates macrophage activation and enhances the severity of experimental autoimmune encephalomyelitis in mice. Accordingly, utilities of VGAM1442 include diagnosis, prevention and treatment of diseases and clinical conditions associated with TIM3. The function of TIM3 and its association with various diseases and clinical conditions, has been established by previous studies, as described hereinabove with reference to VGAM909. Zinc Finger Protein 10 (KOX 1) (ZNF10, Accession NM_015394) is another VGAM1442 host target gene. ZNF10 BINDING SITE is HOST TARGET binding site found in the 3' untranslated region of mRNA encoded by ZNF10, corresponding to a HOST TARGET binding site such as BINDING SITE I, BINDING SITE II or BINDING SITE III. Table 2 illustrates the complementarity of the nucleotide sequences of ZNF10 BINDING SITE, designated SEQ ID:17694, to the nucleotide sequence of VGAM1442 RNA, herein designated VGAM RNA, also designated SEQ ID:4153.

Another function of VGAM1442 is therefore inhibition of Zinc Finger Protein 10 (KOX 1) (ZNF10, Accession NM_015394), a gene which may function as a transcriptional regulator. Accordingly, utilities of VGAM1442 include diagnosis, prevention and treatment of diseases and clinical conditions associated with ZNF10. The function of ZNF10 and its association with various diseases and clinical conditions, has been established by previous studies, as described hereinabove with reference to VGAM36. Zinc Finger Protein 35 (clone HF.10) (ZNF35, Accession NM_003420) is another VGAM1442 host target gene. ZNF35 BINDING SITE is HOST TARGET binding site found in the 5' untranslated region of mRNA encoded by ZNF35, corresponding to a HOST TARGET binding site such as BINDING SITE I, BINDING SITE II or BINDING SITE III. Table 2 illustrates the complementarity of the nucleotide sequences of ZNF35 BINDING SITE, designated SEQ ID:9465, to the nucleotide sequence of VGAM1442 RNA, herein designated VGAM RNA, also designated SEQ ID:4153.

Another function of VGAM1442 is therefore inhibition of Zinc Finger Protein 35 (clone HF.10) (ZNF35, Accession NM_003420). Accordingly, utilities of VGAM1442 include diagnosis, prevention and treatment of diseases and clinical conditions associated with ZNF35. Chromosome 1 Open Reading Frame 22 (C1orf22, Accession NM_025191) is another VGAM1442 host target gene. C1orf22 BINDING SITE is HOST TARGET binding site found in the 3' untranslated region of mRNA encoded by C1orf22, corresponding to a HOST TARGET binding site such as BINDING SITE I, BINDING SITE II or BINDING SITE III. Table 2 illustrates the complementarity of the nucleotide sequences of C1orf22 BINDING SITE, designated SEQ ID:24838, to the nucleotide sequence of VGAM1442 RNA, herein designated VGAM RNA, also designated SEQ ID:4153.

Another function of VGAM1442 is therefore inhibition of Chromosome 1 Open Reading Frame 22 (C1orf22, Accession NM_025191). Accordingly, utilities of VGAM1442 include diagnosis, prevention and treatment of diseases and clinical conditions associated with C1orf22. C20orf180 (Accession NM_018431) is another VGAM1442 host target gene. C20orf180 BINDING SITE is HOST TARGET binding site found in the 3' untranslated region of mRNA encoded by C20orf180, corresponding to a HOST TARGET binding site such as BINDING SITE I, BINDING SITE II or BINDING SITE III. Table 2 illustrates the complementarity of the nucleotide sequences of C20orf180 BINDING SITE, designated SEQ ID:20495, to the nucleotide sequence of VGAM1442 RNA, herein designated VGAM RNA, also designated SEQ ID:4153.

Another function of VGAM1442 is therefore inhibition of C20orf180 (Accession NM_018431). Accordingly, utilities of VGAM1442 include diagnosis, prevention and treatment of diseases and clinical conditions associated with C20orf180. FLJ10751 (Accession NM_018205) is another VGAM1442 host target gene. FLJ10751 BINDING SITE1 and FLJ10751 BINDING SITE2 are HOST TARGET binding sites found in untranslated regions of mRNA encoded by FLJ10751, corresponding to HOST TARGET binding sites such as BINDING SITE I, BINDING SITE II or BINDING SITE III. Table 2 illustrates the complementarity of the nucleotide sequences of FLJ10751 BINDING SITE1 and FLJ10751 BINDING SITE2, designated SEQ ID:20094 and SEQ ID:20193 respectively, to the nucleotide sequence of VGAM1442 RNA, herein designated VGAM RNA, also designated SEQ ID:4153.

Another function of VGAM1442 is therefore inhibition of FLJ10751 (Accession NM_018205). Accordingly, utilities of VGAM1442 include diagnosis, prevention and treatment of diseases and clinical conditions associated with FLJ10751. Golgi Autoantigen, Golgin Subfamily A, 1 (GOLGA1, Accession NM_002077) is another VGAM1442 host target gene. GOLGA1 BINDING SITE is HOST TARGET binding site found in the 3' untranslated region of mRNA encoded by GOLGA1, corresponding to a HOST TARGET binding site such as BINDING SITE I, BINDING SITE II or BINDING SITE III. Table 2 illustrates the complementarity of the nucleotide sequences of GOLGA1 BINDING SITE, designated SEQ ID:7860, to the nucleotide sequence of VGAM1442 RNA, herein designated VGAM RNA, also designated SEQ ID:4153.

Another function of VGAM1442 is therefore inhibition of Golgi Autoantigen, Golgin Subfamily A, 1 (GOLGA1, Accession NM_002077). Accordingly, utilities of VGAM1442 include diagnosis, prevention and treatment of diseases and clinical conditions associated with GOLGA1. GS3955 (Accession NM_021643) is another VGAM1442 host target gene. GS3955 BINDING SITE is HOST TARGET binding site found in the 5' untranslated region of mRNA encoded by GS3955, corresponding to a HOST TARGET binding site such as BINDING SITE I, BINDING SITE II or BINDING SITE III. Table 2 illustrates the complementarity of the nucleotide sequences of GS3955 BINDING SITE, designated SEQ ID:22303, to the nucleotide sequence of VGAM1442 RNA, herein designated VGAM RNA, also designated SEQ ID:4153.

Another function of VGAM1442 is therefore inhibition of GS3955 (Accession NM_021643). Accordingly, utilities of VGAM1442 include diagnosis, prevention and treatment of diseases and clinical conditions associated with GS3955. KIAA0261 (Accession XM_042946) is another VGAM1442 host target gene. KIAA0261 BINDING SITE is HOST TARGET binding site found in the 3' untranslated region of mRNA encoded by KIAA0261, corresponding to a HOST TARGET binding site such as BINDING SITE I, BINDING SITE II or BINDING SITE III. Table 2 illustrates the complementarity of the nucleotide sequences of KIAA0261 BINDING SITE, designated SEQ ID:33833, to the nucleotide sequence of VGAM1442 RNA, herein designated VGAM RNA, also designated SEQ ID:4153.

Another function of VGAM1442 is therefore inhibition of KIAA0261 (Accession XM_042946). Accordingly, utilities of VGAM1442 include diagnosis, prevention and treatment of diseases and clinical conditions associated with KIAA0261. NDRG Family Member 4 (NDRG4, Accession NM_022910) is another VGAM1442 host target gene. NDRG4 BINDING SITE1 and NDRG4 BINDING SITE2 are HOST TARGET binding sites found in untranslated regions of mRNA encoded by NDRG4, corresponding to HOST TARGET binding sites such as BINDING SITE I, BINDING SITE II or BINDING SITE III. Table 2 illustrates the complementarity of the nucleotide sequences of NDRG4 BINDING SITE1 and NDRG4 BINDING SITE2, designated SEQ ID:23214 and SEQ ID:21699 respectively, to the nucleotide sequence of VGAM1442 RNA, herein designated VGAM RNA, also designated SEQ ID:4153.

Another function of VGAM1442 is therefore inhibition of NDRG Family Member 4 (NDRG4, Accession NM_022910). Accordingly, utilities of VGAM1442 include diagnosis, prevention and treatment of diseases and clinical conditions associated with NDRG4. RNAHP (Accession NM_007372) is another VGAM1442 host target gene. RNAHP BINDING SITE is HOST TARGET binding site found in the 3' untranslated region of mRNA encoded by RNAHP, corresponding to a HOST TARGET binding site such as BINDING SITE I, BINDING SITE II or BINDING SITE III. Table 2 illustrates the complementarity of the nucleotide sequences of RNAHP BINDING SITE, designated SEQ ID:14300, to the nucleotide sequence of VGAM1442 RNA, herein designated VGAM RNA, also designated SEQ ID:4153.

Another function of VGAM1442 is therefore inhibition of RNAHP (Accession NM_007372). Accordingly, utilities of VGAM1442 include diagnosis, prevention and treatment of diseases and clinical conditions associated with RNAHP. SEC15B (Accession XM_039570) is another VGAM1442 host target gene. SEC15B BINDING SITE is HOST TARGET binding site found in the 3' untranslated region of mRNA encoded by SEC15B, corresponding to a HOST TARGET binding site such as BINDING SITE I, BINDING SITE II or BINDING SITE III. Table 2 illustrates the complementarity of the nucleotide sequences of SEC15B BINDING SITE, designated SEQ ID:33124, to the nucleotide sequence of VGAM1442 RNA, herein designated VGAM RNA, also designated SEQ ID:4153.

Another function of VGAM1442 is therefore inhibition of SEC15B (Accession XM_039570). Accordingly, utilities of VGAM1442 include diagnosis, prevention and treatment of diseases and clinical conditions associated with SEC15B. Solute Carrier Family 26, Member 10 (SLC26A10, Accession NM_133489) is another VGAM1442 host target gene. SLC26A10 BINDING SITE is HOST TARGET binding site found in the 5' untranslated region of mRNA encoded by SLC26A10, corresponding to a HOST TARGET binding site such as BINDING SITE I, BINDING SITE II or BINDING SITE III. Table 2 illustrates the complementarity of the nucleotide sequences of SLC26A10 BINDING SITE, designated SEQ ID:28559, to the nucleotide sequence of VGAM1442 RNA, herein designated VGAM RNA, also designated SEQ ID:4153.

Another function of VGAM1442 is therefore inhibition of Solute Carrier Family 26, Member 10 (SLC26A10, Accession NM_133489). Accordingly, utilities of VGAM1442 include diagnosis, prevention and treatment of diseases and clinical conditions associated with SLC26A10. TU3A (Accession NM_007177) is another VGAM1442 host target gene. TU3A BINDING SITE is HOST TARGET binding site found in the 3' untranslated region of mRNA encoded by TU3A, corresponding to a HOST TARGET binding site such as BINDING SITE I, BINDING SITE II or BINDING SITE III. Table 2 illustrates the complementarity of the nucleotide sequences of TU3A BINDING SITE, designated SEQ ID:14033, to the nucleotide sequence of VGAM1442 RNA, herein designated VGAM RNA, also designated SEQ ID:4153.

Another function of VGAM1442 is therefore inhibition of TU3A (Accession NM_007177). Accordingly, utilities of VGAM1442 include diagnosis, prevention and treatment of diseases and clinical conditions associated with TU3A. Zinc Finger Protein 91 Homolog (mouse) (ZFP91, Accession NM_053023) is another VGAM1442 host target gene. ZFP91 BINDING SITE is HOST TARGET binding site found in the 3' untranslated region of mRNA encoded by ZFP91, corresponding to a HOST TARGET binding site such as BINDING SITE I, BINDING SITE II or BINDING SITE III. Table 2 illustrates the complementarity of the nucleotide sequences of ZFP91 BINDING SITE, designated SEQ ID:27576, to the nucleotide sequence of VGAM1442 RNA, herein designated VGAM RNA, also designated SEQ ID:4153.

Another function of VGAM1442 is therefore inhibition of Zinc Finger Protein 91 Homolog (mouse) (ZFP91, Accession NM_053023). Accordingly, utilities of VGAM1442 include diagnosis, prevention and treatment of diseases and clinical conditions associated with ZFP91. LOC130612 (Accession XM_059461) is another VGAM1442 host target gene. LOC130612 BINDING SITE is HOST TARGET binding site found in the 3' untranslated region of mRNA encoded by LOC130612, corresponding to a HOST TARGET binding site such as BINDING SITE I, BINDING SITE II or BINDING SITE III. Table 2 illustrates the complementarity of the nucleotide sequences of LOC130612 BINDING SITE, designated SEQ ID:36999, to the nucleotide sequence of VGAM1442 RNA, herein designated VGAM RNA, also designated SEQ ID:4153.

Another function of VGAM1442 is therefore inhibition of LOC130612 (Accession XM_059461). Accordingly, utilities of VGAM1442 include diagnosis, prevention and treatment of diseases and clinical conditions associated with LOC130612. LOC151195 (Accession XM_087125) is another VGAM1442 host target gene. LOC151195 BINDING SITE is HOST TARGET binding site found in the 5' untranslated region of mRNA encoded by LOC151195, corresponding to a HOST TARGET binding site such as BINDING SITE I, BINDING SITE II or BINDING SITE III. Table 2 illustrates the complementarity of the nucleotide sequences of LOC151195 BINDING SITE, designated SEQ ID:39076, to the nucleotide sequence of VGAM1442 RNA, herein designated VGAM RNA, also designated SEQ ID:4153.

Another function of VGAM1442 is therefore inhibition of LOC151195 (Accession XM_087125). Accordingly, utilities of VGAM1442 include diagnosis, prevention and treatment of diseases and clinical conditions associated with LOC151195. LOC152220 (Accession XM_098176) is another VGAM1442 host target gene. LOC152220 BINDING SITE is HOST TARGET binding site found in the 3' untranslated region of mRNA encoded by LOC152220, corresponding to a HOST TARGET binding site such as BINDING SITE I, BINDING SITE II or BINDING SITE III. Table 2 illustrates the complementarity of the nucleotide sequences of LOC152220 BINDING SITE, designated SEQ ID:41442, to the nucleotide sequence of VGAM1442 RNA, herein designated VGAM RNA, also designated SEQ ID:4153.

Another function of VGAM1442 is therefore inhibition of LOC152220 (Accession XM_098176). Accordingly, utilities of VGAM1442 include diagnosis, prevention and treatment of diseases and clinical conditions associated with LOC152220. LOC196527 (Accession XM_113743) is another VGAM1442 host target gene. LOC196527 BINDING SITE is HOST TARGET binding site found in the 3' untranslated region of mRNA encoded by LOC196527, corresponding to a HOST TARGET binding site such as BINDING SITE I, BINDING SITE II or BINDING SITE III. Table 2 illustrates the complementarity of the nucleotide sequences of LOC196527 BINDING SITE, designated SEQ ID:42399, to the nucleotide sequence of VGAM1442 RNA, herein designated VGAM RNA, also designated SEQ ID:4153.

Another function of VGAM1442 is therefore inhibition of LOC196527 (Accession XM_113743). Accordingly, utilities of VGAM1442 include diagnosis, prevention and treatment of diseases and clinical conditions associated with LOC196527. LOC197358 (Accession XM_113872) is another VGAM1442 host target gene. LOC197358 BINDING SITE is HOST TARGET binding site found in the 3' untranslated region of mRNA encoded by LOC197358, corresponding to a HOST TARGET binding site such as BINDING SITE I, BINDING SITE II or BINDING SITE III. Table 2 illustrates the complementarity of the nucleotide sequences of LOC197358 BINDING SITE, designated SEQ ID:42510, to the nucleotide sequence of VGAM1442 RNA, herein designated VGAM RNA, also designated SEQ ID:4153.

Another function of VGAM1442 is therefore inhibition of LOC197358 (Accession XM_113872). Accordingly, utilities of VGAM1442 include diagnosis, prevention and treatment of diseases and clinical conditions associated with LOC197358. LOC200734 (Accession XM_114286) is another VGAM1442 host target gene. LOC200734 BINDING SITE is HOST TARGET binding site found in the 3' untranslated region of mRNA encoded by LOC200734, corresponding to a HOST TARGET binding site such as BINDING SITE I, BINDING SITE II or BINDING SITE III. Table 2 illustrates the complementarity of the nucleotide sequences of LOC200734 BINDING SITE, designated SEQ ID:42840, to the nucleotide sequence of VGAM1442 RNA, herein designated VGAM RNA, also designated SEQ ID:4153.

Another function of VGAM1442 is therefore inhibition of LOC200734 (Accession XM_114286). Accordingly, utilities of VGAM1442 include diagnosis, prevention and treatment of diseases and clinical conditions associated with LOC200734. LOC201164 (Accession XM_113904) is another VGAM1442 host target gene. LOC201164 BINDING SITE is HOST TARGET binding site found in the 3' untranslated region of mRNA encoded by LOC201164, corresponding to a HOST TARGET binding site such as BINDING SITE I, BINDING SITE II or BINDING SITE III. Table 2 illustrates the complementarity of the nucleotide sequences of LOC201164 BINDING SITE, designated SEQ ID:42530, to the nucleotide sequence of VGAM1442 RNA, herein designated VGAM RNA, also designated SEQ ID:4153.

Another function of VGAM1442 is therefore inhibition of LOC201164 (Accession XM_113904). Accordingly, utilities of VGAM1442 include diagnosis, prevention and treatment of diseases and clinical conditions associated with LOC201164. LOC254085 (Accession XM_171189) is another VGAM1442 host target gene. LOC254085 BINDING SITE is HOST TARGET binding site found in the 5' untranslated region of mRNA encoded by LOC254085, corresponding to a HOST TARGET binding site such as BINDING SITE I, BINDING SITE II or BINDING SITE III. Table 2 illustrates the complementarity of the nucleotide sequences of LOC254085 BINDING SITE, designated SEQ ID:45971, to the nucleotide sequence of VGAM1442 RNA, herein designated VGAM RNA, also designated SEQ ID:4153.

Another function of VGAM1442 is therefore inhibition of LOC254085 (Accession XM_171189). Accordingly, utilities of VGAM1442 include diagnosis, prevention and treatment of diseases and clinical conditions associated with LOC254085. LOC257117 (Accession XM_171238) is another VGAM1442 host target gene. LOC257117 BINDING SITE is HOST TARGET binding site found in the 5' untranslated region of mRNA encoded by LOC257117, corresponding to a HOST TARGET binding site such as BINDING SITE I, BINDING SITE II or BINDING SITE III. Table 2 illustrates the complementarity of the nucleotide sequences of LOC257117 BINDING SITE, designated SEQ ID:46026, to the nucleotide sequence of VGAM1442 RNA, herein designated VGAM RNA, also designated SEQ ID:4153.

Another function of VGAM1442 is therefore inhibition of LOC257117 (Accession XM_171238). Accordingly, utilities of VGAM1442 include diagnosis, prevention and treatment of diseases and clinical conditions associated with LOC257117. LOC257336 (Accession XM_171216) is another VGAM1442 host target gene. LOC257336 BINDING SITE is HOST TARGET binding site found in the 5' untranslated region of mRNA encoded by LOC257336, corresponding to a HOST TARGET binding site such as BINDING SITE I, BINDING SITE II or BINDING SITE III. Table 2 illustrates the complementarity of the nucleotide sequences of LOC257336 BINDING SITE, designated SEQ ID:46003, to the nucleotide sequence of VGAM1442 RNA, herein designated VGAM RNA, also designated SEQ ID:4153.

Another function of VGAM1442 is therefore inhibition of LOC257336 (Accession XM_171216). Accordingly, utilities of VGAM1442 include diagnosis, prevention and treatment of diseases and clinical conditions associated with LOC257336. FIG. 1 further provides a conceptual description of a novel bioinformatically detected viral gene of the present invention, referred to here as Viral Genomic Address Messenger 1443 (VGAM1443) viral gene, which modulates expression of respective host target genes thereof, the function and utility of which host target genes is known in the art.

VGAM1443 is a novel bioinformatically detected regulatory, non protein coding, viral micro RNA (miRNA) gene. The method by which VGAM1443 was detected is described hereinabove with reference to FIGS. 1-8.

VGAM1443 gene, herein designated VGAM GENE, is a viral gene contained in the genome of Pepper Mottle Virus. VGAM1443 host target gene, herein designated VGAM HOST TARGET GENE, is a human gene contained in the human genome.

VGAM1443 gene encodes a VGAM1443 precursor RNA, herein designated VGAM PRECURSOR RNA. Similar to other miRNA genes, and unlike most ordinary genes, VGAM1443 precursor RNA does not encode a protein. A nucleotide sequence identical or highly similar to the nucleotide sequence of VGAM1443 precursor RNA is designated SEQ ID:1429, and is provided hereinbelow with reference to the sequence listing part. Nucleotide sequence SEQ ID:1429 is located at position 4259 relative to the genome of Pepper Mottle Virus.

VGAM1443 precursor RNA folds onto itself, forming VGAM1443 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1443 folded precursor RNA into VGAM1443 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1443 RNA is designated SEQ ID:4154, and is provided hereinbelow with reference to the sequence listing part.

VGAM1443 host target gene, herein designated VGAM HOST TARGET GENE, encodes a corresponding messenger RNA, VGAM1443 host target RNA, herein designated VGAM HOST TARGET RNA. VGAM1443 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1443 RNA, herein designated VGAM RNA, binds complementarily to one or more host target binding sites located in untranslated regions of VGAM1443 host target RNA, herein designated VGAM HOST TARGET RNA. This complementary binding is due to the fact that the nucleotide sequence of VGAM1443 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1443 RNA, herein designated VGAM RNA, may have a different number of host target binding sites in untranslated regions of a VGAM1443 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1443 RNA, herein designated VGAM RNA, to host target binding sites on VGAM1443 host target RNA, herein designated VGAM HOST TARGET RNA, such as BINDING SITE I, BINDING SITE II and BINDING SITE III, inhibits translation of VGAM1443 host target RNA into VGAM1443 host target protein, herein designated VGAM HOST TARGET PROTEIN. VGAM host target protein is therefore outlined by a broken line.

It is appreciated that VGAM1443 host target gene, herein designated VGAM HOST TARGET GENE, in fact represents a plurality of VGAM1443 host target genes. The mRNA of each one of this plurality of VGAM1443 host target genes comprises one or more host target binding sites, each having a nucleotide sequence which is at least partly complementary to VGAM1443 RNA, herein designated VGAM RNA, and which when bound by VGAM1443 RNA causes inhibition of translation of respective one or more VGAM1443 host target proteins.

It is further appreciated by one skilled in the art that the mode of translational inhibition illustrated by FIG. 1 with specific reference to translational inhibition exerted by VGAM1443 gene, herein designated VGAM GENE, on one or more VGAM1443 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1443 is inhibition of expression of host target genes, as part of a novel viral mechanism of attacking a host. Accordingly, utilities of VGAM1443 include diagnosis, prevention and treatment of viral infection by Pepper Mottle Virus. Specific functions, and accordingly utilities, of VGAM1443 correlate with, and may be deduced from, the identity of the host target genes which VGAM1443 binds and inhibits, and the function of these host target genes, as elaborated hereinbelow.

Nucleotide sequences of the VGAM1443 precursor RNA, herein designated VGAM PRECURSOR RNA, and of the 'diced' VGAM1443 RNA, herein designated VGAM RNA, and a schematic representation of the secondary folding of VGAM1443 folded precursor RNA, herein designated VGAM FOLDED PRECURSOR RNA, of VGAM1443 are further described hereinbelow with reference to Table 1.

Nucleotide sequences of host target binding sites, such as BINDING SITE-I, BINDING SITE-II and BINDING SITE-III of FIG. 1, found on VGAM1443 host target RNA, and schematic representation of the complementarity of each of these host target binding sites to VGAM1443 RNA, herein designated VGAM RNA, are described hereinbelow with reference to Table 2.

As mentioned hereinabove with reference to FIG. 1, a function of VGAM1443 gene, herein designated VGAM is inhibition of expression of VGAM1443 target genes. It is appreciated that specific functions, and accordingly utilities, of VGAM1443 correlate with, and may be deduced from, the identity of the target genes which VGAM1443 binds and inhibits, and the function of these target genes, as elaborated hereinbelow.

Nucleolar Protein Family A, Member 1 (H/ACA small nucleolar RNPs) (NOLA1, Accession NM_018983) is a VGAM1443 host target gene. NOLA1 BINDING SITE is HOST TARGET binding site found in the 5' untranslated region of mRNA encoded by NOLA1, corresponding to a HOST TARGET binding site such as BINDING SITE I, BINDING SITE II or BINDING SITE III. Table 2 illustrates the complementarity of the nucleotide sequences of NOLA1 BINDING SITE, designated SEQ ID:21053, to the nucleotide sequence of VGAM1443 RNA, herein designated VGAM RNA, also designated SEQ ID:4154.

A function of VGAM1443 is therefore inhibition of Nucleolar Protein Family A, Member 1 (H/ACA small nucleolar RNPs) (NOLA1, Accession NM_018983), a gene which associates with a only a subset of snrna's and is essential for growth. Accordingly, utilities of VGAM1443 include diagnosis, prevention and treatment of diseases and clinical conditions associated with NOLA1. The function of NOLA1 has been established by previous studies. Small nucleolar RNAs (snoRNAs) of the H/ACA class specify the sites of uridine-to-pseudouridine conversion. The H and ACA motifs are located in the hinge and tail, respectively, of a 2-domain hairpin-hinge-hairpin-tail structure. The uridine conversion process, together with the removal of the spacer region and the 2-prime-O-methylation of ribose groups, which is carried out by snoRNAs of the C/D class, is required for the generation of functional rRNAs. See Tollervey and Kiss (1997) for further information. By cell fractionation and competition assays, Dragon et al. (2000) showed that the 3-prime terminal hairpin of U17 cleavage RNA (see OMIM Ref. No. 603238) and telomerase RNA can form a ribonucleoprotein (RNP) in association with RNAs and 4 proteins (60, 29, 23, and 14 kD) of the H/ACA class. By EST database searching and probing a Burkitt lymphoma cDNA library, Dragon et al. (2000) obtained a cDNA encoding NOLA1, which they called GAR1 after its yeast homolog. The deduced 217-amino acid NOLA1 protein contains a core domain that is flanked by glycine- and arginine-rich (GAR) domains, which compose half of the sequence. Western blot analysis showed expression of a 28-kD protein, higher than the calculated mass of 23 kD. Immunoprecipitation analysis demonstrated that NOLA1 is a subunit of H/ACA snoRNPs and telomerase, but it is not required for H/ACA protein assembly. Dragon et al. (2000) proposed that the 23- and 14-kD H/ACA proteins represent the human homologs of the yeast Nhp2 (NOLA2; 606470) and Nop10 (NOLA3; 606471) proteins.

Full details of the abovementioned studies are described in the following publications, the disclosure of which are hereby incorporated by reference:

Dragon, F.; Pogacic, V.; Filipowicz, W.: In vitro assembly of human H/ACA small nucleolar RNPs reveals unique features of U17 and telomerase RNAs. Molec. Cell. Biol. 20:3037-3048, 2000; and Tollervey, D.; Kiss, T.: Function and synthesis of small nucleolar RNAs. Curr. Opin. Cell Biol. 9:337-342, 1997.

Further studies establishing the function and utilities of NOLA1 are found in John Hopkins OMIM database record ID 606468, and in sited publications numbered 4534-4535 listed in the bibliography section hereinbelow, which are also hereby incorporated by reference. Serine/arginine Repetitive Matrix 1 (SRRM1, Accession NM_005839) is another VGAM1443 host target gene. SRRM1 BINDING SITE is HOST TARGET binding site found in the 3' untranslated region of mRNA encoded by SRRM1, corresponding to a HOST TARGET binding site such as BINDING SITE I, BINDING SITE II or BINDING SITE III. Table 2 illustrates the complementarity of the nucleotide sequences of SRRM1 BINDING SITE, designated SEQ ID:12449, to the nucleotide sequence of VGAM1443 RNA, herein designated VGAM RNA, also designated SEQ ID:4154.

Another function of VGAM1443 is therefore inhibition of Serine/arginine Repetitive Matrix 1 (SRRM1, Accession NM_005839). Accordingly, utilities of VGAM1443 include diagnosis, prevention and treatment of diseases and clinical conditions associated with SRRM1. CSL4 (Accession NM_016046) is another VGAM1443 host target gene. CSL4 BINDING SITE is HOST TARGET binding site found in the 3' untranslated region of mRNA encoded by CSL4, corresponding to a HOST TARGET binding site such as BINDING SITE I, BINDING SITE II or BINDING SITE III. Table 2 illustrates the complementarity of the nucleotide sequences of CSL4 BINDING SITE, designated SEQ ID:18125, to the nucleotide sequence of VGAM1443 RNA, herein designated VGAM RNA, also designated SEQ ID:4154.

Another function of VGAM1443 is therefore inhibition of CSL4 (Accession NM_016046). Accordingly, utilities of VGAM1443 include diagnosis, prevention and treatment of diseases and clinical conditions associated with CSL4. PRMT6 (Accession NM_018137) is another VGAM1443 host target gene. PRMT6 BINDING SITE is HOST TARGET binding site found in the 3' untranslated region of mRNA encoded by PRMT6, corresponding to a HOST TARGET binding site such as BINDING SITE I, BINDING SITE II or BINDING SITE III. Table 2 illustrates the complementarity of the nucleotide sequences of PRMT6 BINDING SITE, designated SEQ ID:19935, to the nucleotide sequence of VGAM1443 RNA, herein designated VGAM RNA, also designated SEQ ID:4154.

Another function of VGAM1443 is therefore inhibition of PRMT6 (Accession NM_018137). Accordingly, utilities of VGAM1443 include diagnosis, prevention and treatment of diseases and clinical conditions associated with PRMT6. FIG. 1 further provides a conceptual description of a novel bioinformatically detected viral gene of the present invention, referred to here as Viral Genomic Address Messenger 1444 (VGAM1444) viral gene, which modulates expression of respective host target genes thereof, the function and utility of which host target genes is known in the art.

VGAM1444 is a novel bioinformatically detected regulatory, non protein coding, viral micro RNA (miRNA) gene. The method by which VGAM1444 was detected is described hereinabove with reference to FIGS. 1-8.

VGAM1444 gene, herein designated VGAM GENE, is a viral gene contained in the genome of Pepper Mottle Virus. VGAM1444 host target gene, herein designated VGAM HOST TARGET GENE, is a human gene contained in the human genome.

VGAM1444 gene encodes a VGAM1444 precursor RNA, herein designated VGAM PRECURSOR RNA. Similar to other miRNA genes, and unlike most ordinary genes, VGAM1444 precursor RNA does not encode a protein. A nucleotide sequence identical or highly similar to the nucleotide sequence of VGAM1444 precursor RNA is designated SEQ ID:1430, and is provided hereinbelow with reference to the sequence listing part. Nucleotide sequence SEQ ID:1430 is located at position 4768 relative to the genome of Pepper Mottle Virus.

VGAM1444 precursor RNA folds onto itself, forming VGAM1444 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1444 folded precursor RNA into VGAM1444 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1444 RNA is designated SEQ ID:4155, and is provided hereinbelow with reference to the sequence listing part.

VGAM1444 host target gene, herein designated VGAM HOST TARGET GENE, encodes a corresponding messenger RNA, VGAM1444 host target RNA, herein designated VGAM HOST TARGET RNA. VGAM1444 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1444 RNA, herein designated VGAM RNA, binds complementarily to one or more host target binding sites located in untranslated regions of VGAM1444 host target RNA, herein designated VGAM HOST TARGET RNA. This complementary binding is due to the fact that the nucleotide sequence of VGAM1444 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1444 RNA, herein designated VGAM RNA, may have a different number of host target binding sites in untranslated regions of a VGAM1444 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1444 RNA, herein designated VGAM RNA, to host target binding sites on VGAM1444 host target RNA, herein designated VGAM HOST TARGET RNA, such as BINDING SITE I, BINDING SITE II and BINDING SITE III, inhibits translation of VGAM1444 host target RNA into VGAM1444 host target protein, herein designated VGAM HOST TARGET PROTEIN. VGAM host target protein is therefore outlined by a broken line.

It is appreciated that VGAM1444 host target gene, herein designated VGAM HOST TARGET GENE, in fact represents a plurality of VGAM1444 host target genes. The mRNA of each one of this plurality of VGAM1444 host target genes comprises one or more host target binding sites, each having a nucleotide sequence which is at least partly complementary to VGAM1444 RNA, herein designated VGAM RNA, and which when bound by VGAM1444 RNA causes inhibition of translation of respective one or more VGAM1444 host target proteins.

It is further appreciated by one skilled in the art that the mode of translational inhibition illustrated by FIG. 1 with specific reference to translational inhibition exerted by VGAM1444 gene, herein designated VGAM GENE, on one or more VGAM1444 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1444 is inhibition of expression of host target genes, as part of a novel viral mechanism of attacking a host. Accordingly, utilities of VGAM1444 include diagnosis, prevention and treatment of viral infection by Pepper Mottle Virus. Specific functions, and accordingly utilities, of VGAM1444 correlate with, and may be deduced from, the identity of the host target genes which VGAM1444 binds and inhibits, and the function of these host target genes, as elaborated hereinbelow.

Nucleotide sequences of the VGAM1444 precursor RNA, herein designated VGAM PRECURSOR RNA, and of the 'diced' VGAM1444 RNA, herein designated VGAM RNA, and a schematic representation of the secondary folding of VGAM1444 folded precursor RNA, herein designated VGAM FOLDED PRECURSOR RNA, of VGAM1444 are further described hereinbelow with reference to Table 1.

Nucleotide sequences of host target binding sites, such as BINDING SITE-I, BINDING SITE-II and BINDING SITE-III of FIG. 1, found on VGAM1444 host target RNA, and schematic representation of the complementarity of each of these host target binding sites to VGAM1444 RNA, herein designated VGAM RNA, are described hereinbelow with reference to Table 2.

As mentioned hereinabove with reference to FIG. 1, a function of VGAM1444 gene, herein designated VGAM is inhibition of expression of VGAM1444 target genes. It is appreciated that specific functions, and accordingly utilities, of VGAM1444 correlate with, and may be deduced from, the identity of the target genes which VGAM1444 binds and inhibits, and the function of these target genes, as elaborated hereinbelow.

APG5 Autophagy 5-like (S. cerevisiae) (APG5L, Accession NM_004849) is a VGAM1444 host target gene. APG5L BINDING SITE is HOST TARGET binding site found in the 3' untranslated region of mRNA encoded by APG5L, corresponding to a HOST TARGET binding site such as BINDING SITE I, BINDING SITE II or BINDING SITE III. Table 2 illustrates the complementarity of the nucleotide sequences of APG5L BINDING SITE, designated SEQ ID:11263, to the nucleotide sequence of VGAM1444 RNA, herein designated VGAM RNA, also designated SEQ ID:4155.

A function of VGAM1444 is therefore inhibition of APG5 Autophagy 5-like (S. cerevisiae) (APG5L, Accession NM_004849), a gene which conjugates to apg12 and associates with isolation membrane to form cup-shaped isolation membrane and autophagosome. Accordingly, utilities of VGAM1444 include diagnosis, prevention and treatment of diseases and clinical conditions associated with APG5L. The function of APG5L and its association with various diseases and clinical conditions, has been established by previous studies, as described hereinabove with reference to VGAM492. Suppressor of Cytokine Signaling 5 (SOCS5, Accession NM_014011) is another VGAM1444 host target gene. SOCS5 BINDING SITE is HOST TARGET binding site found in the 3' untranslated region of mRNA encoded by SOCS5, corresponding to a HOST TARGET binding site such as BINDING SITE I, BINDING SITE II or BINDING SITE III. Table 2 illustrates the complementarity of the nucleotide sequences of SOCS5 BINDING SITE, designated SEQ ID:15226, to the nucleotide sequence of VGAM1444 RNA, herein designated VGAM RNA, also designated SEQ ID:4155.

Another function of VGAM1444 is therefore inhibition of Suppressor of Cytokine Signaling 5 (SOCS5, Accession NM_014011). Accordingly, utilities of VGAM1444 include diagnosis, prevention and treatment of diseases and clinical conditions associated with SOCS5. X-ray Repair Complementing Defective Repair In Chinese Hamster Cells 2 (XRCC2, Accession NM_005431) is another VGAM1444 host target gene. XRCC2 BINDING SITE is HOST TARGET binding site found in the 3' untranslated region of mRNA encoded by XRCC2, corresponding to a HOST TARGET binding site such as BINDING SITE I, BINDING SITE II or BINDING SITE III. Table 2 illustrates the complementarity of the nucleotide sequences of XRCC2 BINDING SITE, designated SEQ ID:11902, to the nucleotide sequence of VGAM1444 RNA, herein designated VGAM RNA, also designated SEQ ID:4155.

Another function of VGAM1444 is therefore inhibition of X-ray Repair Complementing Defective Repair In Chinese Hamster Cells 2 (XRCC2, Accession NM_005431), a gene which involves in the homologous recombination repair (hrr) pathway of double-stranded dna. Accordingly, utilities of VGAM1444 include diagnosis, prevention and treatment of diseases and clinical conditions associated with XRCC2. The function of XRCC2 and its association with various diseases and clinical conditions, has been established by previous studies, as described hereinabove with reference to VGAM241. Chromosome 21 Open Reading Frame 6 (C21orf6, Accession NM_016940) is another VGAM1444 host target gene. C21orf6 BINDING SITE is HOST TARGET binding site found in the 3' untranslated region of mRNA encoded by C21orf6, corresponding to a HOST TARGET binding site such as BINDING SITE I, BINDING SITE II or BINDING SITE III. Table 2 illustrates the complementarity of the nucleotide sequences of C21orf6 BINDING SITE, designated SEQ ID:18856, to the nucleotide sequence of VGAM1444 RNA, herein designated VGAM RNA, also designated SEQ ID:4155.

Another function of VGAM1444 is therefore inhibition of Chromosome 21 Open Reading Frame 6 (C21orf6, Accession NM_016940). Accordingly, utilities of VGAM1444 include diagnosis, prevention and treatment of diseases and clinical conditions associated with C21orf6. FLJ11259 (Accession NM_018370) is another VGAM1444 host target gene. FLJ11259 BINDING SITE is HOST TARGET binding site found in the 3' untranslated region of mRNA encoded by FLJ11259, corresponding to a HOST TARGET binding site such as BINDING SITE I, BINDING SITE II or BINDING SITE III. Table 2 illustrates the complementarity of the nucleotide sequences of FLJ11259 BINDING SITE, designated SEQ ID:20389, to the nucleotide sequence of VGAM1444 RNA, herein designated VGAM RNA, also designated SEQ ID:4155.

Another function of VGAM1444 is therefore inhibition of FLJ11259 (Accession NM_018370). Accordingly, utilities of VGAM1444 include diagnosis, prevention and treatment of diseases and clinical conditions associated with FLJ11259. KIAA0514 (Accession NM_014696) is another VGAM1444 host target gene. KIAA0514 BINDING SITE is HOST TARGET binding site found in the 5' untranslated region of mRNA encoded by KIAA0514, corresponding to a HOST TARGET binding site such as BINDING SITE I, BINDING SITE II or BINDING SITE III. Table 2 illustrates the complementarity of the nucleotide sequences of KIAA0514 BINDING SITE, designated SEQ ID:16210, to the nucleotide sequence of VGAM1444 RNA, herein designated VGAM RNA, also designated SEQ ID:4155.

Another function of VGAM1444 is therefore inhibition of KIAA0514 (Accession NM_014696). Accordingly, utilities of VGAM1444 include diagnosis, prevention and treatment of diseases and clinical conditions associated with KIAA0514. KIAA1317 (Accession XM_098368) is another VGAM1444 host target gene. KIAA1317 BINDING SITE is HOST TARGET binding site found in the 3' untranslated region of mRNA encoded by KIAA1317, corresponding to a HOST TARGET binding site such as BINDING SITE I, BINDING SITE II or BINDING SITE III. Table 2 illustrates the complementarity of the nucleotide sequences of KIAA1317 BINDING SITE, designated SEQ ID:41627, to the nucleotide sequence of VGAM1444 RNA, herein designated VGAM RNA, also designated SEQ ID:4155.

Another function of VGAM1444 is therefore inhibition of KIAA1317 (Accession XM_098368). Accordingly, utilities of VGAM1444 include diagnosis, prevention and treatment of diseases and clinical conditions associated with KIAA1317. Zinc Finger Protein 300 (ZNF300, Accession NM_052860) is another VGAM1444 host target gene. ZNF300 BINDING SITE is HOST TARGET binding site found in the 5' untranslated region of mRNA encoded by ZNF300, corresponding to a HOST TARGET binding site such as BINDING SITE I, BINDING SITE II or BINDING SITE III. Table 2 illustrates the complementarity of the nucleotide sequences of ZNF300 BINDING SITE, designated SEQ ID:27441, to the nucleotide sequence of VGAM1444 RNA, herein designated VGAM RNA, also designated SEQ ID:4155.

Another function of VGAM1444 is therefore inhibition of Zinc Finger Protein 300 (ZNF300, Accession NM_052860). Accordingly, utilities of VGAM1444 include diagnosis, prevention and treatment of diseases and clinical conditions associated with ZNF300. LOC255018 (Accession XM_173504) is another VGAM1444 host target gene. LOC255018 BINDING SITE is HOST TARGET binding site found in the 5' untranslated region of mRNA encoded by LOC255018, corresponding to a HOST TARGET binding site such as BINDING SITE I, BINDING SITE II or BINDING SITE III. Table 2 illustrates the complementarity of the nucleotide sequences of LOC255018 BINDING SITE, designated SEQ ID:46546, to the nucleotide sequence of VGAM1444 RNA, herein designated VGAM RNA, also designated SEQ ID:4155.

Another function of VGAM1444 is therefore inhibition of LOC255018 (Accession XM_173504). Accordingly, utilities of VGAM1444 include diagnosis, prevention and treatment of diseases and clinical conditions associated with LOC255018. FIG. 1 further provides a conceptual description of a novel bioinformatically detected viral gene of the present invention, referred to here as Viral Genomic Address Messenger 1445 (VGAM1445) viral gene, which modulates expression of respective host target genes thereof, the function and utility of which host target genes is known in the art.

VGAM1445 is a novel bioinformatically detected regulatory, non protein coding, viral micro RNA (miRNA) gene. The method by which VGAM1445 was detected is described hereinabove with reference to FIGS. 1-8.

VGAM1445 gene, herein designated VGAM GENE, is a viral gene contained in the genome of Pepper Mottle Virus. VGAM1445 host target gene, herein designated VGAM HOST TARGET GENE, is a human gene contained in the human genome.

VGAM1445 gene encodes a VGAM1445 precursor RNA, herein designated VGAM PRECURSOR RNA. Similar to other miRNA genes, and unlike most ordinary genes, VGAM1445 precursor RNA does not encode a protein. A nucleotide sequence identical or highly similar to the nucleotide sequence of VGAM1445 precursor RNA is designated SEQ ID:1431, and is provided hereinbelow with reference to the sequence listing part. Nucleotide sequence SEQ ID:1431 is located at position 5583 relative to the genome of Pepper Mottle Virus.

VGAM1445 precursor RNA folds onto itself, forming VGAM1445 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1445 folded precursor RNA into VGAM1445 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1445 RNA is designated SEQ ID:4156, and is provided hereinbelow with reference to the sequence listing part.

VGAM1445 host target gene, herein designated VGAM HOST TARGET GENE, encodes a corresponding messenger RNA, VGAM1445 host target RNA, herein designated VGAM HOST TARGET RNA. VGAM1445 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1445 RNA, herein designated VGAM RNA, binds complementarily to one or more host target binding sites located in untranslated regions of VGAM1445 host target RNA, herein designated VGAM HOST TARGET RNA. This complementary binding is due to the fact that the nucleotide sequence of VGAM1445 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1445 RNA, herein designated VGAM RNA, may have a different number of host target binding sites in untranslated regions of a VGAM1445 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1445 RNA, herein designated VGAM RNA, to host target binding sites on VGAM1445 host target RNA, herein designated VGAM HOST TARGET RNA, such as BINDING SITE I, BINDING SITE II and BINDING SITE III, inhibits translation of VGAM1445 host target RNA into VGAM1445 host target protein, herein designated VGAM HOST TARGET PROTEIN. VGAM host target protein is therefore outlined by a broken line.

It is appreciated that VGAM1445 host target gene, herein designated VGAM HOST TARGET GENE, in fact represents a plurality of VGAM1445 host target genes. The mRNA of each one of this plurality of VGAM1445 host target genes comprises one or more host target binding sites, each having a nucleotide sequence which is at least partly complementary to VGAM1445 RNA, herein designated VGAM RNA, and which when bound by VGAM1445 RNA causes inhibition of translation of respective one or more VGAM1445 host target proteins.

It is further appreciated by one skilled in the art that the mode of translational inhibition illustrated by FIG. 1 with specific reference to translational inhibition exerted by VGAM1445 gene, herein designated VGAM GENE, on one or more VGAM1445 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1445 is inhibition of expression of host target genes, as part of a novel viral mechanism of attacking a host. Accordingly, utilities of VGAM1445 include diagnosis, prevention and treatment of viral infection by Pepper Mottle Virus. Specific functions, and accordingly utilities, of VGAM1445 correlate with, and may be deduced from, the identity of the host target genes which VGAM1445 binds and inhibits, and the function of these host target genes, as elaborated hereinbelow.

Nucleotide sequences of the VGAM1445 precursor RNA, herein designated VGAM PRECURSOR RNA, and of the 'diced' VGAM1445 RNA, herein designated VGAM RNA, and a schematic representation of the secondary folding of VGAM1445 folded precursor RNA, herein designated VGAM FOLDED PRECURSOR RNA, of VGAM1445 are further described hereinbelow with reference to Table 1.

Nucleotide sequences of host target binding sites, such as BINDING SITE-I, BINDING SITE-II and BINDING SITE-III of FIG. 1, found on VGAM1445 host target RNA, and schematic representation of the complementarity of each of these host target binding sites to VGAM1445 RNA, herein designated VGAM RNA, are described hereinbelow with reference to Table 2.

As mentioned hereinabove with reference to FIG. 1, a function of VGAM1445 gene, herein designated VGAM is inhibition of expression of VGAM1445 target genes. It is appreciated that specific functions, and accordingly utilities, of VGAM1445 correlate with, and may be deduced from, the identity of the target genes which VGAM1445 binds and inhibits, and the function of these target genes, as elaborated hereinbelow.

Hepatocyte Growth Factor (hepapoietin A; scatter factor) (HGF, Accession XM_168542) is a VGAM1445 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45225, to the nucleotide sequence of VGAM1445 RNA, herein designated VGAM RNA, also designated SEQ ID:4156.

A function of VGAM1445 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM1445 include diagnosis, prevention and treatment of diseases and clinical conditions associated with HGF. The function of HGF and its association with various diseases and clinical conditions, has been established by previous studies, as described hereinabove with reference to VGAM174. KIAA0218 (Accession NM_014760) is another VGAM1445 host target gene. KIAA0218 BINDING SITE is HOST TARGET binding site found in the 3' untranslated region of mRNA encoded by KIAA0218, corresponding to a HOST TARGET binding site such as BINDING SITE I, BINDING SITE II or BINDING SITE III. Table 2 illustrates the complementarity of the nucleotide sequences of KIAA0218 BINDING SITE, designated SEQ ID:16515, to the nucleotide sequence of VGAM1445 RNA, herein designated VGAM RNA, also designated SEQ ID:4156.

Another function of VGAM1445 is therefore inhibition of KIAA0218 (Accession NM_014760). Accordingly, utilities of VGAM1445 include diagnosis, prevention and treatment of diseases and clinical conditions associated with KIAA0218. LOC153688 (Accession XM_098416) is another VGAM1445 host target gene. LOC153688 BINDING SITE is HOST TARGET binding site found in the 3' untranslated region of mRNA encoded by LOC153688, corresponding to a HOST TARGET binding site such as BINDING SITE I, BINDING SITE II or BINDING SITE III. Table 2 illustrates the complementarity of the nucleotide sequences of LOC153688 BINDING SITE, designated SEQ ID:41657, to the nucleotide sequence of VGAM1445 RNA, herein designated VGAM RNA, also designated SEQ ID:4156.

Another function of VGAM1445 is therefore inhibition of LOC153688 (Accession XM_098416). Accordingly, utilities of VGAM1445 include diagnosis, prevention and treatment of diseases and clinical conditions associated with LOC153688. FIG. 1 further provides a conceptual description of a novel bioinformatically detected viral gene of the present invention, referred to here as Viral Genomic Address Messenger 1446 (VGAM1446) viral gene, which modulates expression of respective host target genes thereof, the function and utility of which host target genes is known in the art.

VGAM1446 is a novel bioinformatically detected regulatory, non protein coding, viral micro RNA (miRNA) gene. The method by which VGAM1446 was detected is described hereinabove with reference to FIGS. 1-8.

VGAM1446 gene, herein designated VGAM GENE, is a viral gene contained in the genome of Pepper Mottle Virus. VGAM1446 host target gene, herein designated VGAM HOST TARGET GENE, is a human gene contained in the human genome.

VGAM1446 gene encodes a VGAM1446 precursor RNA, herein designated VGAM PRECURSOR RNA. Similar to other miRNA genes, and unlike most ordinary genes, VGAM1446 precursor RNA does not encode a protein. A nucleotide sequence identical or highly similar to the nucleotide sequence of VGAM1446 precursor RNA is designated SEQ ID:1432, and is provided hereinbelow with reference to the sequence listing part. Nucleotide sequence SEQ ID:1432 is located at position 3107 relative to the genome of Pepper Mottle Virus.

VGAM1446 precursor RNA folds onto itself, forming VGAM1446 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1446 folded precursor RNA into VGAM1446 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1446 RNA is designated SEQ ID:4157, and is provided hereinbelow with reference to the sequence listing part.

VGAM1446 host target gene, herein designated VGAM HOST TARGET GENE, encodes a corresponding messenger RNA, VGAM1446 host target RNA, herein designated VGAM HOST TARGET RNA. VGAM1446 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1446 RNA, herein designated VGAM RNA, binds complementarily to one or more host target binding sites located in untranslated regions of VGAM1446 host target RNA, herein designated VGAM HOST TARGET RNA. This complementary binding is due to the fact that the nucleotide sequence of VGAM1446 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1446 RNA, herein designated VGAM RNA, may have a different number of host target binding sites in untranslated regions of a VGAM1446 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1446 RNA, herein designated VGAM RNA, to host target binding sites on VGAM1446 host target RNA, herein designated VGAM HOST TARGET RNA, such as BINDING SITE I, BINDING SITE II and BINDING SITE III, inhibits translation of VGAM1446 host target RNA into VGAM1446 host target protein, herein designated VGAM HOST TARGET PROTEIN. VGAM host target protein is therefore outlined by a broken line.

It is appreciated that VGAM1446 host target gene, herein designated VGAM HOST TARGET GENE, in fact represents a plurality of VGAM1446 host target genes. The mRNA of each one of this plurality of VGAM1446 host target genes comprises one or more host target binding sites, each having a nucleotide sequence which is at least partly complementary to VGAM1446 RNA, herein designated VGAM RNA, and which when bound by VGAM1446 RNA causes inhibition of translation of respective one or more VGAM1446 host target proteins.

It is further appreciated by one skilled in the art that the mode of translational inhibition illustrated by FIG. 1 with specific reference to translational inhibition exerted by VGAM1446 gene, herein designated VGAM GENE, on one or more VGAM1446 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1446 is inhibition of expression of host target genes, as part of a novel viral mechanism of attacking a host. Accordingly, utilities of VGAM1446 include diagnosis, prevention and treatment of viral infection by Pepper Mottle Virus. Specific functions, and accordingly utilities, of VGAM1446 correlate with, and may be deduced from, the identity of the host target genes which VGAM1446 binds and inhibits, and the function of these host target genes, as elaborated hereinbelow.

Nucleotide sequences of the VGAM1446 precursor RNA, herein designated VGAM PRECURSOR RNA, and of the 'diced' VGAM1446 RNA, herein designated VGAM RNA, and a schematic representation of the secondary folding of VGAM1446 folded precursor RNA, herein designated VGAM FOLDED PRECURSOR RNA, of VGAM1446 are further described hereinbelow with reference to Table 1.

Nucleotide sequences of host target binding sites, such as BINDING SITE-I, BINDING SITE-II and BINDING SITE-III of FIG. 1, found on VGAM1446 host target RNA, and schematic representation of the complementarity of each of these host target binding sites to VGAM1446 RNA, herein designated VGAM RNA, are described hereinbelow with reference to Table 2.

As mentioned hereinabove with reference to FIG. 1, a function of VGAM1446 gene, herein designated VGAM is inhibition of expression of VGAM1446 target genes. It is appreciated that specific functions, and accordingly utilities, of VGAM1446 correlate with, and may be deduced from, the identity of the target genes which VGAM1446 binds and inhibits, and the function of these target genes, as elaborated hereinbelow.

Fibulin 5 (FBLN5, Accession NM_006329) is a VGAM1446 host target gene. FBLN5 BINDING SITE is HOST TARGET binding site found in the 3' untranslated region of mRNA encoded by FBLN5, corresponding to a HOST TARGET binding site such as BINDING SITE I, BINDING SITE II or BINDING SITE III. Table 2 illustrates the complementarity of the nucleotide sequences of FBLN5 BINDING SITE, designated SEQ ID:13024, to the nucleotide sequence of VGAM1446 RNA, herein designated VGAM RNA, also designated SEQ ID:4157.

A function of VGAM1446 is therefore inhibition of Fibulin 5 (FBLN5, Accession NM_006329), a gene which promotes adhesion of endothelial cells through interaction of integrins and the rgd motif. Accordingly, utilities of VGAM1446 include diagnosis, prevention and treatment of diseases and clinical conditions associated with FBLN5. The function of FBLN5 and its association with various diseases and clinical conditions, has been established by previous studies, as described hereinabove with reference to VGAM1127. Guanine Nucleotide Binding Protein (G protein), Alpha Inhibiting Activity Polypeptide 3 (GNAI3, Accession NM_006496) is another VGAM1446 host target gene. GNAI3 BINDING SITE is HOST TARGET binding site found in the 3' untranslated region of mRNA encoded by GNAI3, corresponding to a HOST TARGET binding site such as BINDING SITE I, BINDING SITE II or BINDING SITE III. Table 2 illustrates the complementarity of the nucleotide sequences of GNAI3 BINDING SITE, designated SEQ ID:13238, to the nucleotide sequence of VGAM1446 RNA, herein designated VGAM RNA, also designated SEQ ID:4157.

Another function of VGAM1446 is therefore inhibition of Guanine Nucleotide Binding Protein (G protein), Alpha Inhibiting Activity Polypeptide 3 (GNAI3, Accession NM_006496), a gene which stimulates receptor regulated K+-channels. Accordingly, utilities of VGAM1446 include diagnosis, prevention and treatment of diseases and clinical conditions associated with GNAI3. The function of GNAI3 and its association with various diseases and clinical conditions, has been established by previous studies, as described hereinabove with reference to VGAM45. Interleukin Enhancer Binding Factor 1 (ILF1, Accession NM_004514) is another VGAM1446 host target gene. ILF1 BINDING SITE is HOST TARGET binding site found in the 3' untranslated region of mRNA encoded by ILF1, corresponding to a HOST TARGET binding site such as BINDING SITE I, BINDING SITE II or BINDING SITE III. Table 2 illustrates the complementarity of the nucleotide sequences of ILF1 BINDING SITE, designated SEQ ID:10843, to the nucleotide sequence of VGAM1446 RNA, herein designated VGAM RNA, also designated SEQ ID:4157.

Another function of VGAM1446 is therefore inhibition of Interleukin Enhancer Binding Factor 1 (ILF1, Accession NM_004514), a gene which binds to nfat-like motifs (purine-rich) in the hiv-1 long terminal repeat and in the il-2 promoter. Accordingly, utilities of VGAM1446 include diagnosis, prevention and treatment of diseases and clinical conditions associated with ILF1. The function of ILF1 has been established by previous studies. Li et al. (1991) cloned a cellular factor, known as ILF (for interleukin enhancer-binding factor), from both HeLa and Jurkat cDNA libraries. ILF binds to purine-rich regulatory motifs in the HIV-1 LTR (long terminal repeat) and to interleukin-2 promoter (IL2; 147680). Further analysis of the ILF gene demonstrated the existence of 2 mRNA species, both of which encode proteins containing the 'forkhead' DNA binding domain (Li et al., 1992). By analysis of a panel of mouse/human somatic cell hybrids followed by radioactive in situ hybridization, Li et al. (1992) demonstrated that the ILF gene is located on 17q25, which is a site of chromosomal translocations in some cases of human acute myelogenous leukemia. HTLF (OMIM Ref. No. 143089) is another 'forkhead' domain DNA binding protein, which is located on 2p22-p16

Full details of the abovementioned studies are described in the following publications, the disclosure of which are hereby incorporated by reference:

Li, C.; Lai, C.; Sigman, D. S.; Gaynor, R. B.: Cloning of a cellular factor, interleukin binding factor, that binds to NFAT-like motifs in the human immunodeficiency virus long terminal repeat. Proc. Nat. Acad. Sci. 88:7739-7743, 1991; and Li, C.; Lusis, A. J.; Sparkes, R.; Nirula, A.; Gaynor, R.: Characterization and chromosomal mapping of the gene encoding the cellular DNA binding protein ILF. Genomics 13:665-671, 1992.

Further studies establishing the function and utilities of ILF1 are found in John Hopkins OMIM database record ID 147685, and in sited publications numbered 5246-5247 listed in the bibliography section hereinbelow, which are also hereby incorporated by reference. Membrane Protein, Palmitoylated 2 (MAGUK p55 subfamily member 2) (MPP2, Accession XM_008355) is another VGAM1446 host target gene. MPP2 BINDING SITE is HOST TARGET binding site found in the 3' untranslated region of mRNA encoded by MPP2, corresponding to a HOST TARGET binding site such as BINDING SITE I, BINDING SITE II or BINDING SITE III. Table 2 illustrates the complementarity of the nucleotide sequences of MPP2 BINDING SITE, designated SEQ ID:30080, to the nucleotide sequence of VGAM1446 RNA, herein designated VGAM RNA, also designated SEQ ID:4157.

Another function of VGAM1446 is therefore inhibition of Membrane Protein, Palmitoylated 2 (MAGUK p55 subfamily member 2) (MPP2, Accession XM_008355). Accordingly, utilities of VGAM1446 include diagnosis, prevention and treatment of diseases and clinical conditions associated with MPP2. Myotubular Myopathy 1 (MTM1, Accession NM_000252) is another VGAM1446 host target gene. MTM1 BINDING SITE is HOST TARGET binding site found in the 3' untranslated region of mRNA encoded by MTM1, corresponding to a HOST TARGET binding site such as BINDING SITE I, BINDING SITE II or BINDING SITE III. Table 2 illustrates the complementarity of the nucleotide sequences of MTM1 BINDING SITE, designated SEQ ID:5790, to the nucleotide sequence of VGAM1446 RNA, herein designated VGAM RNA, also designated SEQ ID:4157.

Another function of VGAM1446 is therefore inhibition of Myotubular Myopathy 1 (MTM1, Accession NM_000252). Accordingly, utilities of VGAM1446 include diagnosis, prevention and treatment of diseases and clinical conditions associated with MTM1. Dynein, Cytoplasmic, Light Intermediate Polypeptide 1 (DNCLI1, Accession XM_003119) is another VGAM1446 host target gene. DNCLI1 BINDING SITE is HOST TARGET binding site found in the 3' untranslated region of mRNA encoded by DNCLI1, corresponding to a HOST TARGET binding site such as BINDING SITE I, BINDING SITE II or BINDING SITE III. Table 2 illustrates the complementarity of the nucleotide sequences of DNCLI1 BINDING SITE, designated SEQ ID:29927, to the nucleotide sequence of VGAM1446 RNA, herein designated VGAM RNA, also designated SEQ ID:4157.

Another function of VGAM1446 is therefore inhibition of Dynein, Cytoplasmic, Light Intermediate Polypeptide 1 (DNCLI1, Accession XM_003119). Accordingly, utilities of VGAM1446 include diagnosis, prevention and treatment of diseases and clinical conditions associated with DNCLI1. F-box Only Protein 21 (FBXO21, Accession NM_033624) is another VGAM1446 host target gene. FBXO21 BINDING SITE is HOST TARGET binding site found in the 3' untranslated region of mRNA encoded by FBXO21, corresponding to a HOST TARGET binding site such as BINDING SITE I, BINDING SITE II or BINDING SITE III. Table 2 illustrates the complementarity of the nucleotide sequences of FBXO21 BINDING SITE, designated SEQ ID:27325, to the nucleotide sequence of VGAM1446 RNA, herein designated VGAM RNA, also designated SEQ ID:4157.

Another function of VGAM1446 is therefore inhibition of F-box Only Protein 21 (FBXO21, Accession NM_033624). Accordingly, utilities of VGAM1446 include diagnosis, prevention and treatment of diseases and clinical conditions associated with FBXO21. KIAA1615 (Accession XM_044021) is another VGAM1446 host target gene. KIAA1615 BINDING SITE is HOST TARGET binding site found in the 3' untranslated region of mRNA encoded by KIAA1615, corresponding to a HOST TARGET binding site such as BINDING SITE I, BINDING SITE II or BINDING SITE III. Table 2 illustrates the complementarity of the nucleotide sequences of KIAA1615 BINDING SITE, designated SEQ ID:34086, to the nucleotide sequence of VGAM1446 RNA, herein designated VGAM RNA, also designated SEQ ID:4157.

Another function of VGAM1446 is therefore inhibition of KIAA1615 (Accession XM_044021). Accordingly, utilities of VGAM1446 include diagnosis, prevention and treatment of diseases and clinical conditions associated with KIAA1615. Paternally Expressed 10 (PEG10, Accession NM_015068) is another VGAM1446 host target gene. PEG10 BINDING SITE is HOST TARGET binding site found in the 3' untranslated region of mRNA encoded by PEG10, corresponding to a HOST TARGET binding site such as BINDING SITE I, BINDING SITE II or BINDING SITE III. Table 2 illustrates the complementarity of the nucleotide sequences of PEG10 BINDING SITE, designated SEQ ID:17432, to the nucleotide sequence of VGAM1446 RNA, herein designated VGAM RNA, also designated SEQ ID:4157.

Another function of VGAM1446 is therefore inhibition of Paternally Expressed 10 (PEG10, Accession NM_015068). Accordingly, utilities of VGAM1446 include diagnosis, prevention and treatment of diseases and clinical conditions associated with PEG10. LOC155435 (Accession XM_088257) is another VGAM1446 host target gene. LOC155435 BINDING SITE is HOST TARGET binding site found in the 3' untranslated region of mRNA encoded by LOC155435, corresponding to a HOST TARGET binding site such as BINDING SITE I, BINDING SITE II or BINDING SITE III. Table 2 illustrates the complementarity of the nucleotide sequences of LOC155435 BINDING SITE, designated SEQ ID:39568, to the nucleotide sequence of VGAM1446 RNA, herein designated VGAM RNA, also designated SEQ ID:4157.

Another function of VGAM1446 is therefore inhibition of LOC155435 (Accession XM_088257). Accordingly, utilities of VGAM1446 include diagnosis, prevention and treatment of diseases and clinical conditions associated with LOC155435. LOC160717 (Accession XM_090457) is another VGAM1446 host target gene. LOC160717 BINDING SITE is HOST TARGET binding site found in the 5' untranslated region of mRNA encoded by LOC160717, corresponding to a HOST TARGET binding site such as BINDING SITE I, BINDING SITE II or BINDING SITE III. Table 2 illustrates the complementarity of the nucleotide sequences of LOC160717 BINDING SITE, designated SEQ ID:40008, to the nucleotide sequence of VGAM1446 RNA, herein designated VGAM RNA, also designated SEQ ID:4157.

Another function of VGAM1446 is therefore inhibition of LOC160717 (Accession XM_090457). Accordingly, utilities of VGAM1446 include diagnosis, prevention and treatment of diseases and clinical conditions associated with LOC160717. LOC222865 (Accession XM_167242) is another VGAM1446 host target gene. LOC222865 BINDING SITE is HOST TARGET binding site found in the 3' untranslated region of mRNA encoded by LOC222865, corresponding to a HOST TARGET binding site such as BINDING SITE I, BINDING SITE II or BINDING SITE III. Table 2 illustrates the complementarity of the nucleotide sequences of LOC222865 BINDING SITE, designated SEQ ID:44621, to the nucleotide sequence of VGAM1446 RNA, herein designated VGAM RNA, also designated SEQ ID:4157.

Another function of VGAM1446 is therefore inhibition of LOC222865 (Accession XM_167242). Accordingly, utilities of VGAM1446 include diagnosis, prevention and treatment of diseases and clinical conditions associated with LOC222865. FIG. 1 further provides a conceptual description of a novel bioinformatically detected viral gene of the present invention, referred to here as Viral Genomic Address Messenger 1447 (VGAM1447) viral gene, which modulates expression of respective host target genes thereof, the function and utility of which host target genes is known in the art.

VGAM1447 is a novel bioinformatically detected regulatory, non protein coding, viral micro RNA (miRNA) gene. The method by which VGAM1447 was detected is described hereinabove with reference to FIGS. 1-8.

VGAM1447 gene, herein designated VGAM GENE, is a viral gene contained in the genome of Pepper Mottle Virus. VGAM1447 host target gene, herein designated VGAM HOST TARGET GENE, is a human gene contained in the human genome.

VGAM1447 gene encodes a VGAM1447 precursor RNA, herein designated VGAM PRECURSOR RNA. Similar to other miRNA genes, and unlike most ordinary genes, VGAM1447 precursor RNA does not encode a protein. A nucleotide sequence identical or highly similar to the nucleotide sequence of VGAM1447 precursor RNA is designated SEQ ID:1433, and is provided hereinbelow with reference to the sequence listing part. Nucleotide sequence SEQ ID:1433 is located at position 1681 relative to the genome of Pepper Mottle Virus.

VGAM1447 precursor RNA folds onto itself, forming VGAM1447 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1447 folded precursor RNA into VGAM1447 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1447 RNA is designated SEQ ID:4158, and is provided hereinbelow with reference to the sequence listing part.

VGAM1447 host target gene, herein designated VGAM HOST TARGET GENE, encodes a corresponding messenger RNA, VGAM1447 host target RNA, herein designated VGAM HOST TARGET RNA. VGAM1447 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1447 RNA, herein designated VGAM RNA, binds complementarily to one or more host target binding sites located in untranslated regions of VGAM1447 host target RNA, herein designated VGAM HOST TARGET RNA. This complementary binding is due to the fact that the nucleotide sequence of VGAM1447 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1447 RNA, herein designated VGAM RNA, may have a different number of host target binding sites in untranslated regions of a VGAM1447 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1447 RNA, herein designated VGAM RNA, to host target binding sites on VGAM1447 host target RNA, herein designated VGAM HOST TARGET RNA, such as BINDING SITE I, BINDING SITE II and BINDING SITE III, inhibits translation of VGAM1447 host target RNA into VGAM1447 host target protein, herein designated VGAM HOST TARGET PROTEIN. VGAM host target protein is therefore outlined by a broken line.

It is appreciated that VGAM1447 host target gene, herein designated VGAM HOST TARGET GENE, in fact represents a plurality of VGAM1447 host target genes. The mRNA of each one of this plurality of VGAM1447 host target genes comprises one or more host target binding sites, each having a nucleotide sequence which is at least partly complementary to VGAM1447 RNA, herein designated VGAM RNA, and which when bound by VGAM1447 RNA causes inhibition of translation of respective one or more VGAM1447 host target proteins.

It is further appreciated by one skilled in the art that the mode of translational inhibition illustrated by FIG. 1 with specific reference to translational inhibition exerted by VGAM1447 gene, herein designated VGAM GENE, on one or more VGAM1447 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1447 is inhibition of expression of host target genes, as part of a novel viral mechanism of attacking a host. Accordingly, utilities of VGAM1447 include diagnosis, prevention and treatment of viral infection by Pepper Mottle Virus. Specific functions, and accordingly utilities, of VGAM1447 correlate with, and may be deduced from, the identity of the host target genes which VGAM1447 binds and inhibits, and the function of these target genes, as elaborated hereinbelow.

Nucleotide sequences of the VGAM1447 precursor RNA, herein designated VGAM PRECURSOR RNA, and of the 'diced' VGAM1447 RNA, herein designated VGAM RNA, and a schematic representation of the secondary folding of VGAM1447 folded precursor RNA, herein designated VGAM FOLDED PRECURSOR RNA, of VGAM1447 are further described hereinbelow with reference to Table 1.

Nucleotide sequences of host target binding sites, such as BINDING SITE-I, BINDING SITE-II and BINDING SITE-III of FIG. 1, found on VGAM1447 host target RNA, and schematic representation of the complementarity of each of these host target binding sites to VGAM1447 RNA, herein designated VGAM RNA, are described hereinbelow with reference to Table 2.

As mentioned hereinabove with reference to FIG. 1, a function of VGAM1447 gene, herein designated VGAM is inhibition of expression of VGAM1447 target genes. It is appreciated that specific functions, and accordingly utilities, of VGAM1447 correlate with, and may be deduced from, the identity of the target genes which VGAM1447 binds and inhibits, and the function of these target genes, as elaborated hereinbelow.

A Disintegrin-like and Metalloprotease (reprolysin type) with Thrombospondin Type 1 Motif, 1 (ADAMTS1, Accession NM_006988) is a VGAM1447 host target gene. ADAMTS1 BINDING SITE is HOST TARGET binding site found in the 5' untranslated region of mRNA encoded by ADAMTS1, corresponding to a HOST TARGET binding site such as BINDING SITE I, BINDING SITE II or BINDING SITE III. Table 2 illustrates the complementarity of the nucleotide sequences of ADAMTS1 BINDING SITE, designated SEQ ID:13853, to the nucleotide sequence of VGAM1447 RNA, herein designated VGAM RNA, also designated SEQ ID:4158.

A function of VGAM1447 is therefore inhibition of A Disintegrin-like and Metalloprotease (reprolysin type) with Thrombospondin Type 1 Motif, 1 (ADAMTS1, Accession NM_006988). Accordingly, utilities of VGAM1447 include diagnosis, prevention and treatment of diseases and clinical conditions associated with ADAMTS1. Aquaporin 6, Kidney Specific (AQP6, Accession NM_053286) is another VGAM1447 host target gene. AQP6 BINDING SITE is HOST TARGET binding site found in the 3' untranslated region of mRNA encoded by AQP6, corresponding to a HOST TARGET binding site such as BINDING SITE I, BINDING SITE II or BINDING SITE III. Table 2 illustrates the complementarity of the nucleotide sequences of AQP6 BINDING SITE, designated SEQ ID:27618, to the nucleotide sequence of VGAM1447 RNA, herein designated VGAM RNA, also designated SEQ ID:4158.

Another function of VGAM1447 is therefore inhibition of Aquaporin 6, Kidney Specific (AQP6, Accession NM_053286), a gene which participates in distinct physiologic function such as glomerular filtration, tubular endocytosis, and acid-base metabolism. Accordingly, utilities of VGAM1447 include diagnosis, prevention and treatment of diseases and clinical conditions associated with AQP6. The function of AQP6 and its association with various diseases and clinical conditions, has been established by previous studies, as described hereinabove with reference to VGAM340. Dystrophin (muscular dystrophy, Duchenne and Becker types) (DMD, Accession NM_004007) is another VGAM1447 host target gene. DMD BINDING SITE1 and DMD BINDING SITE2 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 and DMD BINDING SITE2, designated SEQ ID:10160 and SEQ ID:10174 respectively, to the nucleotide sequence of VGAM1447 RNA, herein designated VGAM RNA, also designated SEQ ID:4158.

Another function of VGAM1447 is therefore inhibition of Dystrophin (muscular dystrophy, Duchenne and Becker types) (DMD, Accession NM_004007), a gene which muscular dystrophy. Accordingly, utilities of VGAM1447 include diagnosis, prevention and treatment of diseases and clinical conditions associated with DMD. The function of DMD and its association with various diseases and clinical conditions, has been established by previous studies, as described hereinabove with reference to VGAM218. Epidermal Growth Factor Receptor (erythroblastic leukemia viral (v-erb-b) Oncogene Homolog, Avian) (EGFR, Accession NM_005228) is another VGAM1447 host target gene. EGFR BINDING SITE is HOST TARGET binding site found in the 3' untranslated region of mRNA encoded by EGFR, corresponding to a HOST TARGET binding site such as BINDING SITE I, BINDING SITE II or BINDING SITE III. Table 2 illustrates the complementarity of the nucleotide sequences of EGFR BINDING SITE, designated SEQ ID:11727, to the nucleotide sequence of VGAM1447 RNA, herein designated VGAM RNA, also designated SEQ ID:4158.

Another function of VGAM1447 is therefore inhibition of Epidermal Growth Factor Receptor (erythroblastic leukemia viral (v-erb-b) Oncogene Homolog, Avian) (EGFR, Accession NM_005228), a gene which is a receptor for egf, but also for other members of the egf family. Accordingly, utilities of VGAM1447 include diagnosis, prevention and treatment of diseases and clinical conditions associated with EGFR. The function of EGFR and its association with various diseases and clinical conditions, has been established by previous studies, as described hereinabove with reference to VGAM229. Fatty-acid-Coenzyme A Ligase, Long-chain 5 (FACL5, Accession XM_034424) is another VGAM1447 host target gene. FACL5 BINDING SITE is HOST TARGET binding site found in the 3' untranslated region of mRNA encoded by FACL5, corresponding to a HOST TARGET binding site such as BINDING SITE I, BINDING SITE II or BINDING SITE III. Table 2 illustrates the complementarity of the nucleotide sequences of FACL5 BINDING SITE, designated SEQ ID:32108, to the nucleotide sequence of VGAM1447 RNA, herein designated VGAM RNA, also designated SEQ ID:4158.

Another function of VGAM1447 is therefore inhibition of Fatty-acid-Coenzyme A Ligase, Long-chain 5 (FACL5, Accession XM_034424), a gene which may be involved in fatty acid metabolism; contains an AMP-binding domain. Accordingly, utilities of VGAM1447 include diagnosis, prevention and treatment of diseases and clinical conditions associated with FACL5. The function of FACL5 and its association with various diseases and clinical conditions, has been established by previous studies, as described hereinabove with reference to VGAM357. GRB2-associated Binding Protein 2 (GAB2, Accession NM_080491) is another VGAM1447 host target gene. GAB2 BINDING SITE1 and GAB2 BINDING SITE2 are HOST TARGET binding sites found in untranslated regions of mRNA encoded by GAB2, corresponding to HOST TARGET binding sites such as BINDING SITE I, BINDING SITE II or BINDING SITE III. Table 2 illustrates the complementarity of the nucleotide sequences of GAB2 BINDING SITE1 and GAB2 BINDING SITE2, designated SEQ ID:27843 and SEQ ID:14647 respectively, to the nucleotide sequence of VGAM1447 RNA, herein designated VGAM RNA, also designated SEQ ID:4158.

Another function of VGAM1447 is therefore inhibition of GRB2-associated Binding Protein 2 (GAB2, Accession NM_080491), a gene which act as adapters for transmitting various signals. Accordingly, utilities of VGAM1447 include diagnosis, prevention and treatment of diseases and clinical conditions associated with GAB2. The function of GAB2 and its association with various diseases and clinical conditions, has been established by previous studies, as described hereinabove with reference to VGAM53. IMP (inosine monophosphate) Dehydrogenase 1 (IMPDH1, Accession NM_000883) is another VGAM1447 host target gene. IMPDH1 BINDING SITE is HOST TARGET binding site found in the 3' untranslated region of mRNA encoded by IMPDH1, corresponding to a HOST TARGET binding site such as BINDING SITE I, BINDING SITE II or BINDING SITE III. Table 2 illustrates the complementarity of the nucleotide sequences of IMPDH1 BINDING SITE, designated SEQ ID:6578, to the nucleotide sequence of VGAM1447 RNA, herein designated VGAM RNA, also designated SEQ ID:4158.

Another function of VGAM1447 is therefore inhibition of IMP (inosine monophosphate) Dehydrogenase 1 (IMPDH1, Accession NM_000883). Accordingly, utilities of VGAM1447 include diagnosis, prevention and treatment of diseases and clinical conditions associated with IMPDH1. Potassium Inwardly-rectifying Channel, Subfamily J, Member 16 (KCNJ16, Accession NM_018658) is another VGAM1447 host target gene. KCNJ16 BINDING SITE is HOST TARGET binding site found in the 3' untranslated region of mRNA encoded by KCNJ16, corresponding to a HOST TARGET binding site such as BINDING SITE I, BINDING SITE II or BINDING SITE III. Table 2 illustrates the complementarity of the nucleotide sequences of KCNJ16 BINDING SITE, designated SEQ ID:20730, to the nucleotide sequence of VGAM1447 RNA, herein designated VGAM RNA, also designated SEQ ID:4158.

Another function of VGAM1447 is therefore inhibition of Potassium Inwardly-rectifying Channel, Subfamily J, Member 16 (KCNJ16, Accession NM_018658). Accordingly, utilities of VGAM1447 include diagnosis, prevention and treatment of diseases and clinical conditions associated with KCNJ16. N-acetylgalactosaminidase, Alpha- (NAGA, Accession NM_000262) is another VGAM1447 host target gene. NAGA BINDING SITE is HOST TARGET binding site found in the 3' untranslated region of mRNA encoded by NAGA, corresponding to a HOST TARGET binding site such as BINDING SITE I, BINDING SITE II or BINDING SITE III. Table 2 illustrates the complementarity of the nucleotide sequences of NAGA BINDING SITE, designated SEQ ID:5801, to the nucleotide sequence of VGAM1447 RNA, herein designated VGAM RNA, also designated SEQ ID:4158.

Another function of VGAM1447 is therefore inhibition of N-acetylgalactosaminidase, Alpha- (NAGA, Accession NM_000262). Accordingly, utilities of VGAM1447 include diagnosis, prevention and treatment of diseases and clinical conditions associated with NAGA. Nuclear Receptor Interacting Protein 1 (NRIP1, Accession XM_009699) is another VGAM1447 host target gene. NRIP1 BINDING SITE is HOST TARGET binding site found in the 3' untranslated region of mRNA encoded by NRIP1, corresponding to a HOST TARGET binding site such as BINDING SITE I, BINDING SITE II or BINDING SITE III. Table 2 illustrates the complementarity of the nucleotide sequences of NRIP1 BINDING SITE, designated SEQ ID:30120, to the nucleotide sequence of VGAM1447 RNA, herein designated VGAM RNA, also designated SEQ ID:4158.

Another function of VGAM1447 is therefore inhibition of Nuclear Receptor Interacting Protein 1 (NRIP1, Accession XM_009699), a gene which modulates transcriptional activation by the estrogen receptor. Accordingly, utilities of VGAM1447 include diagnosis, prevention and treatment of diseases and clinical conditions associated with NRIP1. The function of NRIP1 and its association with various diseases and clinical conditions, has been established by previous studies, as described hereinabove with reference to VGAM276. POU Domain, Class 4, Transcription Factor 1

(POU4F1, Accession NM_006237) is another VGAM1447 host target gene. POU4F1 BINDING SITE is HOST TARGET binding site found in the 3' untranslated region of mRNA encoded by POU4F1, corresponding to a HOST TARGET binding site such as BINDING SITE I, BINDING SITE II or BINDING SITE III. Table 2 illustrates the complementarity of the nucleotide sequences of POU4F1 BINDING SITE, designated SEQ ID:12901, to the nucleotide sequence of VGAM1447 RNA, herein designated VGAM RNA, also designated SEQ ID:4158.

Another function of VGAM1447 is therefore inhibition of POU Domain, Class 4, Transcription Factor 1 (POU4F1, Accession NM_006237), a gene which plays a role in the regulation of specific gene expression within a subset of neuronal lineages. Accordingly, utilities of VGAM1447 include diagnosis, prevention and treatment of diseases and clinical conditions associated with POU4F1. The function of POU4F1 and its association with various diseases and clinical conditions, has been established by previous studies, as described hereinabove with reference to VGAM1026. Spondin 1, (f-spondin) Extracellular Matrix Protein (SPON1, Accession XM_031184) is another VGAM1447 host target gene. SPON1 BINDING SITE is HOST TARGET binding site found in the 3' untranslated region of mRNA encoded by SPON1, corresponding to a HOST TARGET binding site such as BINDING SITE I, BINDING SITE II or BINDING SITE III. Table 2 illustrates the complementarity of the nucleotide sequences of SPON1 BINDING SITE, designated SEQ ID:31299, to the nucleotide sequence of VGAM1447 RNA, herein designated VGAM RNA, also designated SEQ ID:4158.

Another function of VGAM1447 is therefore inhibition of Spondin 1, (f-spondin) Extracellular Matrix Protein (SPON1, Accession XM_031184). Accordingly, utilities of VGAM1447 include diagnosis, prevention and treatment of diseases and clinical conditions associated with SPON1. BMF (Accession NM_033503) is another VGAM1447 host target gene. BMF BINDING SITE is HOST TARGET binding site found in the 3' untranslated region of mRNA encoded by BMF, corresponding to a HOST TARGET binding site such as BINDING SITE I, BINDING SITE II or BINDING SITE III. Table 2 illustrates the complementarity of the nucleotide sequences of BMF BINDING SITE, designated SEQ ID:27277, to the nucleotide sequence of VGAM1447 RNA, herein designated VGAM RNA, also designated SEQ ID:4158.

Another function of VGAM1447 is therefore inhibition of BMF (Accession NM_033503). Accordingly, utilities of VGAM1447 include diagnosis, prevention and treatment of diseases and clinical conditions associated with BMF. Caspase 9, Apoptosis-related Cysteine Protease (CASP9, Accession NM_001229) is another VGAM1447 host target gene. CASP9 BINDING SITE is HOST TARGET binding site found in the 3' untranslated region of mRNA encoded by CASP9, corresponding to a HOST TARGET binding site such as BINDING SITE I, BINDING SITE II or BINDING SITE III. Table 2 illustrates the complementarity of the nucleotide sequences of CASP9 BINDING SITE, designated SEQ ID:6901, to the nucleotide sequence of VGAM1447 RNA, herein designated VGAM RNA, also designated SEQ ID:4158.

Another function of VGAM1447 is therefore inhibition of Caspase 9, Apoptosis-related Cysteine Protease (CASP9, Accession NM_001229). Accordingly, utilities of VGAM1447 include diagnosis, prevention and treatment of diseases and clinical conditions associated with CASP9. Cat Eye Syndrome Chromosome Region, Candidate 7 (CECR7, Accession XM_086803) is another VGAM1447 host target gene. CECR7 BINDING SITE is HOST TARGET binding site found in the 5' untranslated region of mRNA encoded by CECR7, corresponding to a HOST TARGET binding site such as BINDING SITE I, BINDING SITE II or BINDING SITE III. Table 2 illustrates the complementarity of the nucleotide sequences of CECR7 BINDING SITE, designated SEQ ID:38881, to the nucleotide sequence of VGAM1447 RNA, herein designated VGAM RNA, also designated SEQ ID:4158.

Another function of VGAM1447 is therefore inhibition of Cat Eye Syndrome Chromosome Region, Candidate 7 (CECR7, Accession XM_086803). Accordingly, utilities of VGAM1447 include diagnosis, prevention and treatment of diseases and clinical conditions associated with CECR7. C-type (calcium dependent, carbohydrate-recognition domain) Lectin, Superfamily Member 9 (CLECSF9, Accession NM_014358) is another VGAM1447 host target gene. CLECSF9 BINDING SITE is HOST TARGET binding site found in the 5' untranslated region of mRNA encoded by CLECSF9, corresponding to a HOST TARGET binding site such as BINDING SITE I, BINDING SITE II or BINDING SITE III. Table 2 illustrates the complementarity of the nucleotide sequences of CLECSF9 BINDING SITE, designated SEQ ID:15688, to the nucleotide sequence of VGAM1447 RNA, herein designated VGAM RNA, also designated SEQ ID:4158.

Another function of VGAM1447 is therefore inhibition of C-type (calcium dependent, carbohydrate-recognition domain) Lectin, Superfamily Member 9 (CLECSF9, Accession NM_014358). Accordingly, utilities of VGAM1447 include diagnosis, prevention and treatment of diseases and clinical conditions associated with CLECSF9. CCR4-NOT Transcription Complex, Subunit 8 (CNOT8, Accession NM_004779) is another VGAM1447 host target gene. CNOT8 BINDING SITE is HOST TARGET binding site found in the 3' untranslated region of mRNA encoded by CNOT8, corresponding to a HOST TARGET binding site such as BINDING SITE I, BINDING SITE II or BINDING SITE III. Table 2 illustrates the complementarity of the nucleotide sequences of CNOT8 BINDING SITE, designated SEQ ID:11177, to the nucleotide sequence of VGAM1447 RNA, herein designated VGAM RNA, also designated SEQ ID:4158.

Another function of VGAM1447 is therefore inhibition of CCR4-NOT Transcription Complex, Subunit 8 (CNOT8, Accession NM_004779). Accordingly, utilities of VGAM1447 include diagnosis, prevention and treatment of diseases and clinical conditions associated with CNOT8. DCOHM (Accession NM_032151) is another VGAM1447 host target gene. DCOHM BINDING SITE is HOST TARGET binding site found in the 3' untranslated region of mRNA encoded by DCOHM, corresponding to a HOST TARGET binding site such as BINDING SITE I, BINDING SITE II or BINDING SITE III. Table 2 illustrates the complementarity of the nucleotide sequences of DCOHM BINDING SITE, designated SEQ ID:25850, to the nucleotide sequence of VGAM1447 RNA, herein designated VGAM RNA, also designated SEQ ID:4158.

Another function of VGAM1447 is therefore inhibition of DCOHM (Accession NM_032151). Accordingly, utilities of VGAM1447 include diagnosis, prevention and treatment of diseases and clinical conditions associated with DCOHM. DEAD/H (Asp-Glu-Ala-Asp/His) Box Polypeptide 17, 72 kDa (DDX17, Accession NM_030881) is another VGAM1447 host target gene. DDX17 BINDING SITE is HOST TARGET binding site found in the 5' untranslated region of mRNA encoded by DDX17, corresponding to a HOST TARGET binding site such as BINDING SITE I, BINDING SITE II or BINDING SITE III. Table 2 illustrates the complementarity of the nucleotide sequences of DDX17 BINDING SITE, designated SEQ ID:25155, to the nucleotide sequence of VGAM1447 RNA, herein designated VGAM RNA, also designated SEQ ID:4158.

Another function of VGAM1447 is therefore inhibition of DEAD/H (Asp-Glu-Ala-Asp/His) Box Polypeptide 17, 72 kDa (DDX17, Accession NM_030881). Accordingly, utilities of VGAM1447 include diagnosis, prevention and treatment of diseases and clinical conditions associated with DDX17. FLJ10242 (Accession NM_018036) is another VGAM1447 host target gene. FLJ10242 BINDING SITE is HOST TARGET binding site found in the 5' untranslated region of mRNA encoded by FLJ10242, corresponding to a HOST TARGET binding site such as BINDING SITE I, BINDING SITE II or BINDING SITE III. Table 2 illustrates the complementarity of the nucleotide sequences of FLJ10242 BINDING SITE, designated SEQ ID:19777, to the nucleotide sequence of VGAM1447 RNA, herein designated VGAM RNA, also designated SEQ ID:4158.

Another function of VGAM1447 is therefore inhibition of FLJ10242 (Accession NM_018036). Accordingly, utilities of VGAM1447 include diagnosis, prevention and treatment of diseases and clinical conditions associated with FLJ10242. FLJ10936 (Accession NM_018279) is another VGAM1447 host target gene. FLJ10936 BINDING SITE is HOST TARGET binding site found in the 3' untranslated region of mRNA encoded by FLJ10936, corresponding to a HOST TARGET binding site such as BINDING SITE I, BINDING SITE II or BINDING SITE III. Table 2 illustrates the complementarity of the nucleotide sequences of FLJ10936 BINDING SITE, designated SEQ ID:20271, to the nucleotide sequence of VGAM1447 RNA, herein designated VGAM RNA, also designated SEQ ID:4158.

Another function of VGAM1447 is therefore inhibition of FLJ10936 (Accession NM_018279). Accordingly, utilities of VGAM1447 include diagnosis, prevention and treatment of diseases and clinical conditions associated with FLJ10936. FLJ13614 (Accession NM_139076) is another VGAM1447 host target gene. FLJ13614 BINDING SITE is HOST TARGET binding site found in the 3' untranslated region of mRNA encoded by FLJ13614, corresponding to a HOST TARGET binding site such as BINDING SITE I, BINDING SITE II or BINDING SITE III. Table 2 illustrates the complementarity of the nucleotide sequences of FLJ13614 BINDING SITE, designated SEQ ID:29149, to the nucleotide sequence of VGAM1447 RNA, herein designated VGAM RNA, also designated SEQ ID:4158.

Another function of VGAM1447 is therefore inhibition of FLJ13614 (Accession NM_139076). Accordingly, utilities of VGAM1447 include diagnosis, prevention and treatment of diseases and clinical conditions associated with FLJ13614. FLJ13881 (Accession NM_024729) is another VGAM1447 host target gene. FLJ13881 BINDING SITE is HOST TARGET binding site found in the 3' untranslated region of mRNA encoded by FLJ13881, corresponding to a HOST TARGET binding site such as BINDING SITE I, BINDING SITE II or BINDING SITE III. Table 2 illustrates the complementarity of the nucleotide sequences of FLJ13881 BINDING SITE, designated SEQ ID:24067, to the nucleotide sequence of VGAM1447 RNA, herein designated VGAM RNA, also designated SEQ ID:4158.

Another function of VGAM1447 is therefore inhibition of FLJ13881 (Accession NM_024729). Accordingly, utilities of VGAM1447 include diagnosis, prevention and treatment of diseases and clinical conditions associated with FLJ13881. FLJ14082 (Accession NM_025024) is another VGAM1447 host target gene. FLJ14082 BINDING SITE is HOST TARGET binding site found in the 5' untranslated region of mRNA encoded by FLJ14082, corresponding to a HOST TARGET binding site such as BINDING SITE I, BINDING SITE II or BINDING SITE III. Table 2 illustrates the complementarity of the nucleotide sequences of FLJ14082 BINDING SITE, designated SEQ ID:24609, to the nucleotide sequence of VGAM1447 RNA, herein designated VGAM RNA, also designated SEQ ID:4158.

Another function of VGAM1447 is therefore inhibition of FLJ14082 (Accession NM_025024). Accordingly, utilities of VGAM1447 include diagnosis, prevention and treatment of diseases and clinical conditions associated with FLJ14082. FLJ14117 (Accession NM_022777) is another VGAM1447 host target gene. FLJ14117 BINDING SITE is HOST TARGET binding site found in the 3' untranslated region of mRNA encoded by FLJ14117, corresponding to a HOST TARGET binding site such as BINDING SITE I, BINDING SITE II or BINDING SITE III. Table 2 illustrates the complementarity of the nucleotide sequences of FLJ14117 BINDING SITE, designated SEQ ID:23049, to the nucleotide sequence of VGAM1447 RNA, herein designated VGAM RNA, also designated SEQ ID:4158.

Another function of VGAM1447 is therefore inhibition of FLJ14117 (Accession NM_022777). Accordingly, utilities of VGAM1447 include diagnosis, prevention and treatment of diseases and clinical conditions associated with FLJ14117. FLJ21106 (Accession NM_025097) is another VGAM1447 host target gene. FLJ21106 BINDING SITE is HOST TARGET binding site found in the 5' untranslated region of mRNA encoded by FLJ21106, corresponding to a HOST TARGET binding site such as BINDING SITE I, BINDING SITE II or BINDING SITE III. Table 2 illustrates the complementarity of the nucleotide sequences of FLJ21106 BINDING SITE, designated SEQ ID:24734, to the nucleotide sequence of VGAM1447 RNA, herein designated VGAM RNA, also designated SEQ ID:4158.

Another function of VGAM1447 is therefore inhibition of FLJ21106 (Accession NM_025097). Accordingly, utilities of VGAM1447 include diagnosis, prevention and treatment of diseases and clinical conditions associated with FLJ21106. FLJ32389 (Accession NM_144617) is another VGAM1447 host target gene. FLJ32389 BINDING SITE is HOST TARGET binding site found in the 3' untranslated region of mRNA encoded by FLJ32389, corresponding to a HOST TARGET binding site such as BINDING SITE I, BINDING SITE II or BINDING SITE III. Table 2 illustrates the complementarity of the nucleotide sequences of FLJ32389 BINDING SITE, designated SEQ ID:29435, to the nucleotide sequence of VGAM1447 RNA, herein designated VGAM RNA, also designated SEQ ID:4158.

Another function of VGAM1447 is therefore inhibition of FLJ32389 (Accession NM_144617). Accordingly, utilities of VGAM1447 include diagnosis, prevention and treatment of diseases and clinical conditions associated with FLJ32389. UDP-N-acetyl-alpha-D-galactosamine:polypeptide N-acetylgalactosaminyltransferase 12 (GalNAc-T12) (GALNT12, Accession NM_024642) is another VGAM1447 host target gene. GALNT12 BINDING SITE is HOST TARGET binding site found in the 3' untranslated region of mRNA encoded by GALNT12, corresponding to a HOST TARGET binding site such as BINDING SITE I, BINDING SITE II or BINDING SITE III. Table 2 illustrates the complementarity of the nucleotide sequences of GALNT12 BINDING SITE, designated SEQ ID:23927, to the nucleotide sequence of VGAM1447 RNA, herein designated VGAM RNA, also designated SEQ ID:4158.

Another function of VGAM1447 is therefore inhibition of UDP-N-acetyl-alpha-D-galactosamine:polypeptide N-acetylgalactosaminyltransferase 12 (GalNAc-T12) (GALNT12, Accession NM_024642). Accordingly, utilities of VGAM1447 include diagnosis, prevention and treatment of diseases and clinical conditions associated with GALNT12. HPIP (Accession NM_020524) is another VGAM1447 host target gene. HPIP BINDING SITE is HOST TARGET binding site found in the 3' untranslated region of mRNA encoded by HPIP, corresponding to a HOST TARGET binding site such as BINDING SITE I, BINDING SITE II or BINDING SITE III. Table 2 illustrates the complementarity of the nucleotide sequences of HPIP BINDING SITE, designated SEQ ID:21736, to the nucleotide sequence of VGAM1447 RNA, herein designated VGAM RNA, also designated SEQ ID:4158.

Another function of VGAM1447 is therefore inhibition of HPIP (Accession NM_020524). Accordingly, utilities of VGAM1447 include diagnosis, prevention and treatment of diseases and clinical conditions associated with HPIP. HRIHFB2122 (Accession NM_007032) is another VGAM1447 host target gene. HRIHFB2122 BINDING SITE is HOST TARGET binding site found in the 3' untranslated region of mRNA encoded by HRIHFB2122, corresponding to a HOST TARGET binding site such as BINDING SITE I, BINDING SITE II or BINDING SITE III. Table 2 illustrates the complementarity of the nucleotide sequences of HRIHFB2122 BINDING SITE, designated SEQ ID:13899, to the nucleotide sequence of VGAM1447 RNA, herein designated VGAM RNA, also designated SEQ ID:4158.

Another function of VGAM1447 is therefore inhibition of HRIHFB2122 (Accession NM_007032). Accordingly, utilities of VGAM1447 include diagnosis, prevention and treatment of diseases and clinical conditions associated with HRIHFB2122. KIAA0057 (Accession NM_012288) is another VGAM1447 host target gene. KIAA0057 BINDING SITE is HOST TARGET binding site found in the 3' untranslated region of mRNA encoded by KIAA0057, corresponding to a HOST TARGET binding site such as BINDING SITE I, BINDING SITE II or BINDING SITE III. Table 2 illustrates the complementarity of the nucleotide sequences of KIAA0057 BINDING SITE, designated SEQ ID:14626, to the nucleotide sequence of VGAM1447 RNA, herein designated VGAM RNA, also designated SEQ ID:4158.

Another function of VGAM1447 is therefore inhibition of KIAA0057 (Accession NM_012288). Accordingly, utilities of VGAM1447 include diagnosis, prevention and treatment of diseases and clinical conditions associated with KIAA0057. KIAA0194 (Accession XM_038362) is another VGAM1447 host target gene. KIAA0194 BINDING SITE is HOST TARGET binding site found in the 3' untranslated region of mRNA encoded by KIAA0194, corresponding to a HOST TARGET binding site such as BINDING SITE I, BINDING SITE II or BINDING SITE III. Table 2 illustrates the complementarity of the nucleotide sequences of KIAA0194 BINDING SITE, designated SEQ ID:32823, to the nucleotide sequence of VGAM1447 RNA, herein designated VGAM RNA, also designated SEQ ID:4158.

Another function of VGAM1447 is therefore inhibition of KIAA0194 (Accession XM_038362). Accordingly, utilities of VGAM1447 include diagnosis, prevention and treatment of diseases and clinical conditions associated with KIAA0194. KIAA0444 (Accession XM_030999) is another VGAM1447 host target gene. KIAA0444 BINDING SITE is HOST TARGET binding site found in the 3' untranslated region of mRNA encoded by KIAA0444, corresponding to a HOST TARGET binding site such as BINDING SITE I, BINDING SITE II or BINDING SITE III. Table 2 illustrates the complementarity of the nucleotide sequences of KIAA0444 BINDING SITE, designated SEQ ID:31246, to the nucleotide sequence of VGAM1447 RNA, herein designated VGAM RNA, also designated SEQ ID:4158.

Another function of VGAM1447 is therefore inhibition of KIAA0444 (Accession XM_030999). Accordingly, utilities of VGAM1447 include diagnosis, prevention and treatment of diseases and clinical conditions associated with KIAA0444. KIAA0470 (Accession NM_014812) is another VGAM1447 host target gene. KIAA0470 BINDING SITE is HOST TARGET binding site found in the 3' untranslated region of mRNA encoded by KIAA0470, corresponding to a HOST TARGET binding site such as BINDING SITE I, BINDING SITE II or BINDING SITE III. Table 2 illustrates the complementarity of the nucleotide sequences of KIAA0470 BINDING SITE, designated SEQ ID:16777, to the nucleotide sequence of VGAM1447 RNA, herein designated VGAM RNA, also designated SEQ ID:4158.

Another function of VGAM1447 is therefore inhibition of KIAA0470 (Accession NM_014812). Accordingly, utilities of VGAM1447 include diagnosis, prevention and treatment of diseases and clinical conditions associated with KIAA0470. KIAA0663 (Accession NM_014827) is another VGAM1447 host target gene. KIAA0663 BINDING SITE is HOST TARGET binding site found in the 3' untranslated region of mRNA encoded by KIAA0663, corresponding to a HOST TARGET binding site such as BINDING SITE I, BINDING SITE II or BINDING SITE III. Table 2 illustrates the complementarity of the nucleotide sequences of KIAA0663 BINDING SITE, designated SEQ ID:16815, to the nucleotide sequence of VGAM1447 RNA, herein designated VGAM RNA, also designated SEQ ID:4158.

Another function of VGAM1447 is therefore inhibition of KIAA0663 (Accession NM_014827). Accordingly, utilities of VGAM1447 include diagnosis, prevention and treatment of diseases and clinical conditions associated with KIAA0663. KIAA1155 (Accession XM_030864) is another VGAM1447 host target gene. KIAA1155 BINDING SITE is HOST TARGET binding site found in the 3' untranslated region of mRNA encoded by KIAA1155, corresponding to a HOST TARGET binding site such as BINDING SITE I, BINDING SITE II or BINDING SITE III. Table 2 illustrates the complementarity of the nucleotide sequences of KIAA1155 BINDING SITE, designated SEQ ID:31200, to the nucleotide sequence of VGAM1447 RNA, herein designated VGAM RNA, also designated SEQ ID:4158.

Another function of VGAM1447 is therefore inhibition of KIAA1155 (Accession XM_030864). Accordingly, utilities of VGAM1447 include diagnosis, prevention and treatment of diseases and clinical conditions associated with KIAA1155. KIAA1416 (Accession XM_098762) is another VGAM1447 host target gene. KIAA1416 BINDING SITE is HOST TARGET binding site found in the 5' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41803, to the nucleotide sequence of VGAM1447 RNA, herein designated VGAM RNA, also designated SEQ ID:4158.

Another function of VGAM1447 is therefore inhibition of KIAA1416 (Accession XM_098762). Accordingly, utilities of VGAM1447 include diagnosis, prevention and treatment of diseases and clinical conditions associated with KIAA1416. KIAA1656 (Accession XM_038022) is another VGAM1447 host target gene. KIAA1656 BINDING SITE is HOST TARGET binding site found in the 3' untranslated region of mRNA encoded by KIAA1656, corresponding to a HOST TARGET binding site such as BINDING SITE I, BINDING SITE II or BINDING SITE III. Table 2 illustrates the complementarity of the nucleotide sequences of KIAA1656 BINDING SITE, designated SEQ ID:32729, to the nucleotide sequence of VGAM1447 RNA, herein designated VGAM RNA, also designated SEQ ID:4158.

Another function of VGAM1447 is therefore inhibition of KIAA1656 (Accession XM_038022). Accordingly, utilities of VGAM1447 include diagnosis, prevention and treatment of diseases and clinical conditions associated with KIAA1656. MGC20253 (Accession NM_144583) is another VGAM1447 host target gene. MGC20253 BINDING SITE is HOST TARGET binding site found in the 3' untranslated region of mRNA encoded by MGC20253, corresponding to a HOST TARGET binding site such as BINDING SITE I, BINDING SITE II or BINDING SITE III. Table 2 illustrates the complementarity of the nucleotide sequences of MGC20253 BINDING SITE, designated SEQ ID:29398, to the nucleotide sequence of VGAM1447 RNA, herein designated VGAM RNA, also designated SEQ ID:4158.

Another function of VGAM1447 is therefore inhibition of MGC20253 (Accession NM_144583). Accordingly, utilities of VGAM1447 include diagnosis, prevention and treatment of diseases and clinical conditions associated with MGC20253. MGC4655 (Accession NM_033309) is another VGAM1447 host target gene. MGC4655 BINDING SITE is HOST TARGET binding site found in the 3' untranslated region of mRNA encoded by MGC4655, corresponding to a HOST TARGET binding site such as BINDING SITE I, BINDING SITE II or BINDING SITE III. Table 2 illustrates the complementarity of the nucleotide sequences of MGC4655 BINDING SITE, designated SEQ ID:27149, to the nucleotide sequence of VGAM1447 RNA, herein designated VGAM RNA, also designated SEQ ID:4158.

Another function of VGAM1447 is therefore inhibition of MGC4655 (Accession NM_033309). Accordingly, utilities of VGAM1447 include diagnosis, prevention and treatment of diseases and clinical conditions associated with MGC4655. Solute Carrier Family 39 (zinc transporter), Member 3 (SLC39A3, Accession NM_144564) is another VGAM1447 host target gene. SLC39A3 BINDING SITE is HOST TARGET binding site found in the 3' untranslated region of mRNA encoded by SLC39A3, corresponding to a HOST TARGET binding site such as BINDING SITE I, BINDING SITE II or BINDING SITE III. Table 2 illustrates the complementarity of the nucleotide sequences of SLC39A3 BINDING SITE, designated SEQ ID:29358, to the nucleotide sequence of VGAM1447 RNA, herein designated VGAM RNA, also designated SEQ ID:4158.

Another function of VGAM1447 is therefore inhibition of Solute Carrier Family 39 (zinc transporter), Member 3 (SLC39A3, Accession NM_144564). Accordingly, utilities of VGAM1447 include diagnosis, prevention and treatment of diseases and clinical conditions associated with SLC39A3. Synaptosomal-associated Protein, 29 kDa (SNAP29, Accession NM_004782) is another VGAM1447 host target gene. SNAP29 BINDING SITE is HOST TARGET binding site found in the 3' untranslated region of mRNA encoded by SNAP29, corresponding to a HOST TARGET binding site such as BINDING SITE I, BINDING SITE II or BINDING SITE III. Table 2 illustrates the complementarity of the nucleotide sequences of SNAP29 BINDING SITE, designated SEQ ID:11186, to the nucleotide sequence of VGAM1447 RNA, herein designated VGAM RNA, also designated SEQ ID:4158.

Another function of VGAM1447 is therefore inhibition of Synaptosomal-associated Protein, 29 kDa (SNAP29, Accession NM_004782). Accordingly, utilities of VGAM1447 include diagnosis, prevention and treatment of diseases and clinical conditions associated with SNAP29. Serum Response Factor (c-fos serum response element-binding transcription factor) (SRF, Accession NM_003131) is another VGAM1447 host target gene. SRF BINDING SITE is HOST TARGET binding site found in the 3' untranslated region of mRNA encoded by SRF, corresponding to a HOST TARGET binding site such as BINDING SITE I, BINDING SITE II or BINDING SITE III. Table 2 illustrates the complementarity of the nucleotide sequences of SRF BINDING SITE, designated SEQ ID:9105, to the nucleotide sequence of VGAM1447 RNA, herein designated VGAM RNA, also designated SEQ ID:4158.

Another function of VGAM1447 is therefore inhibition of Serum Response Factor (c-fos serum response element-binding transcription factor) (SRF, Accession NM_003131). Accordingly, utilities of VGAM1447 include diagnosis, prevention and treatment of diseases and clinical conditions associated with SRF. Synovial Sarcoma Translocation Gene On Chromosome 18-like 1 (SS18L1, Accession XM_037202) is another VGAM1447 host target gene. SS18L1 BINDING SITE is HOST TARGET binding site found in the 3' untranslated region of mRNA encoded by SS18L1, corresponding to a HOST TARGET binding site such as BINDING SITE I, BINDING SITE II or BINDING SITE III. Table 2 illustrates the complementarity of the nucleotide sequences of SS18L1 BINDING SITE, designated SEQ ID:32561, to the nucleotide sequence of VGAM1447 RNA, herein designated VGAM RNA, also designated SEQ ID:4158.

Another function of VGAM1447 is therefore inhibition of Synovial Sarcoma Translocation Gene On Chromosome 18-like 1 (SS18L1, Accession XM_037202). Accordingly, utilities of VGAM1447 include diagnosis, prevention and treatment of diseases and clinical conditions associated with SS18L1. SYNE-1 (Accession NM_015293) is another VGAM1447 host target gene. SYNE-1 BINDING SITE is HOST TARGET binding site found in the 3' untranslated region of mRNA encoded by SYNE-1, corresponding to a HOST TARGET binding site such as BINDING SITE I, BINDING SITE II or BINDING SITE III. Table 2 illustrates the complementarity of the nucleotide sequences of SYNE-1 BINDING SITE, designated SEQ ID:17614, to the nucleotide sequence of VGAM1447 RNA, herein designated VGAM RNA, also designated SEQ ID:4158.

Another function of VGAM1447 is therefore inhibition of SYNE-1 (Accession NM_015293). Accordingly, utilities of VGAM1447 include diagnosis, prevention and treatment of diseases and clinical conditions associated with SYNE-1. TED (Accession NM_015686) is another VGAM1447 host target gene. TED BINDING SITE is HOST TARGET binding site found in the 3' untranslated region of mRNA encoded by TED, corresponding to a HOST TARGET binding site such as BINDING SITE I, BINDING SITE II or BINDING SITE III. Table 2 illustrates the complementarity of the nucleotide sequences of TED BINDING SITE, designated SEQ ID:17913, to the nucleotide sequence of VGAM1447 RNA, herein designated VGAM RNA, also designated SEQ ID:4158.

Another function of VGAM1447 is therefore inhibition of TED (Accession NM_015686). Accordingly, utilities of VGAM1447 include diagnosis, prevention and treatment of diseases and clinical conditions associated with TED. Unc-5 Homolog D (C. elegans) (UNC5D, Accession NM_080872) is another VGAM1447 host target gene. UNC5D BINDING SITE is HOST TARGET binding site found in the 3' untranslated region of mRNA encoded by UNC5D, corresponding to a HOST TARGET binding site such as BINDING SITE I, BINDING SITE II or BINDING SITE III. Table 2 illustrates the complementarity of the nucleotide sequences of UNC5D BINDING SITE, designated SEQ ID:28115, to the nucleotide sequence of VGAM1447 RNA, herein designated VGAM RNA, also designated SEQ ID:4158.

Another function of VGAM1447 is therefore inhibition of Unc-5 Homolog D (C. elegans) (UNC5D, Accession NM_080872). Accordingly, utilities of VGAM1447 include diagnosis, prevention and treatment of diseases and clinical conditions associated with UNC5D. Zinc Finger Protein 91 Homolog (mouse) (ZFP91, Accession NM_053023) is another VGAM1447 host target gene. ZFP91 BINDING SITE is HOST TARGET binding site found in the 3' untranslated region of mRNA encoded by ZFP91, corresponding to a HOST TARGET binding site such as BINDING SITE I, BINDING SITE II or BINDING SITE III. Table 2 illustrates the complementarity of the nucleotide sequences of ZFP91 BINDING SITE, designated SEQ ID:27579, to the nucleotide sequence of VGAM1447 RNA, herein designated VGAM RNA, also designated SEQ ID:4158.

Another function of VGAM1447 is therefore inhibition of Zinc Finger Protein 91 Homolog (mouse) (ZFP91, Accession NM_053023). Accordingly, utilities of VGAM1447 include diagnosis, prevention and treatment of diseases and clinical conditions associated with ZFP91. LOC116437 (Accession XM_058185) is another VGAM1447 host target gene. LOC116437 BINDING SITE is HOST TARGET binding site found in the 3' untranslated region of mRNA encoded by LOC116437, corresponding to a HOST TARGET binding site such as BINDING SITE I, BINDING SITE II or BINDING SITE III. Table 2 illustrates the complementarity of the nucleotide sequences of LOC116437 BINDING SITE, designated SEQ ID:36579, to the nucleotide sequence of VGAM1447 RNA, herein designated VGAM RNA, also designated SEQ ID:4158.

Another function of VGAM1447 is therefore inhibition of LOC116437 (Accession XM_058185). Accordingly, utilities of VGAM1447 include diagnosis, prevention and treatment of diseases and clinical conditions associated with LOC116437. LOC118987 (Accession XM_058361) is another VGAM1447 host target gene. LOC118987 BINDING SITE is HOST TARGET binding site found in the 3' untranslated region of mRNA encoded by LOC118987, corresponding to a HOST TARGET binding site such as BINDING SITE I, BINDING SITE II or BINDING SITE III. Table 2 illustrates the complementarity of the nucleotide sequences of LOC118987 BINDING SITE, designated SEQ ID:36608, to the nucleotide sequence of VGAM1447 RNA, herein designated VGAM RNA, also designated SEQ ID:4158.

Another function of VGAM1447 is therefore inhibition of LOC118987 (Accession XM_058361). Accordingly, utilities of VGAM1447 include diagnosis, prevention and treatment of diseases and clinical conditions associated with LOC118987. LOC121219 (Accession XM_058544) is another VGAM1447 host target gene. LOC121219 BINDING SITE is HOST TARGET binding site found in the 5' untranslated region of mRNA encoded by LOC121219, corresponding to a HOST TARGET binding site such as BINDING SITE I, BINDING SITE II or BINDING SITE III. Table 2 illustrates the complementarity of the nucleotide sequences of LOC121219 BINDING SITE, designated SEQ ID:36652, to the nucleotide sequence of VGAM1447 RNA, herein designated VGAM RNA, also designated SEQ ID:4158.

Another function of VGAM1447 is therefore inhibition of LOC121219 (Accession XM_058544). Accordingly, utilities of VGAM1447 include diagnosis, prevention and treatment of diseases and clinical conditions associated with LOC121219. LOC121506 (Accession XM_058570) is another VGAM1447 host target gene. LOC121506 BINDING SITE is HOST TARGET binding site found in the 3' untranslated region of mRNA encoded by LOC121506, corresponding to a HOST TARGET binding site such as BINDING SITE I, BINDING SITE II or BINDING SITE III. Table 2 illustrates the complementarity of the nucleotide sequences of LOC121506 BINDING SITE, designated SEQ ID:36668, to the nucleotide sequence of VGAM1447 RNA, herein designated VGAM RNA, also designated SEQ ID:4158.

Another function of VGAM1447 is therefore inhibition of LOC121506 (Accession XM_058570). Accordingly, utilities of VGAM1447 include diagnosis, prevention and treatment of diseases and clinical conditions associated with LOC121506. LOC145225 (Accession XM_096741) is another VGAM1447 host target gene. LOC145225 BINDING SITE is HOST TARGET binding site found in the 3' untranslated region of mRNA encoded by LOC145225, corresponding to a HOST TARGET binding site such as BINDING SITE I, BINDING SITE II or BINDING SITE III. Table 2 illustrates the complementarity of the nucleotide sequences of LOC145225 BINDING SITE, designated SEQ ID:40524, to the nucleotide sequence of VGAM1447 RNA, herein designated VGAM RNA, also designated SEQ ID:4158.

Another function of VGAM1447 is therefore inhibition of LOC145225 (Accession XM_096741). Accordingly, utilities of VGAM1447 include diagnosis, prevention and treatment of diseases and clinical conditions associated with LOC145225. LOC150054 (Accession XM_097797) is another VGAM1447 host target gene. LOC150054 BINDING SITE is HOST TARGET binding site found in the 5' untranslated region of mRNA encoded by LOC150054, corresponding to a HOST TARGET binding site such as BINDING SITE I, BINDING SITE II or BINDING SITE III. Table 2 illustrates the complementarity of the nucleotide sequences of LOC150054 BINDING SITE, designated SEQ ID:41125, to the nucleotide sequence of VGAM1447 RNA, herein designated VGAM RNA, also designated SEQ ID:4158.

Another function of VGAM1447 is therefore inhibition of LOC150054 (Accession XM_097797). Accordingly, utilities of VGAM1447 include diagnosis, prevention and treatment of diseases and clinical conditions associated with LOC150054. LOC151521 (Accession XM_098076) is another VGAM1447 host target gene. LOC151521 BINDING SITE is HOST TARGET binding site found in the 3' untranslated region of mRNA encoded by LOC151521, corresponding to a HOST TARGET binding site such as BINDING SITE I, BINDING SITE II or BINDING SITE III. Table 2 illustrates the complementarity of the nucleotide sequences of LOC151521 BINDING SITE, designated SEQ ID:41368, to the nucleotide sequence of VGAM1447 RNA, herein designated VGAM RNA, also designated SEQ ID:4158.

Another function of VGAM1447 is therefore inhibition of LOC151521 (Accession XM_098076). Accordingly, utilities of VGAM1447 include diagnosis, prevention and treatment of diseases and clinical conditions associated with LOC151521. LOC219673 (Accession XM_167567) is another VGAM1447 host target gene. LOC219673 BINDING SITE is HOST TARGET binding site found in the 5' untranslated region of mRNA encoded by LOC219673, corresponding to a HOST TARGET binding site such as BIND- ING SITE I, BINDING SITE II or BINDING SITE III. Table 2 illustrates the complementarity of the nucleotide sequences of LOC219673 BINDING SITE, designated SEQ ID:44694, to the nucleotide sequence of VGAM1447 RNA, herein designated VGAM RNA, also designated SEQ ID:4158.

Another function of VGAM1447 is therefore inhibition of LOC219673 (Accession XM_167567). Accordingly, utilities of VGAM1447 include diagnosis, prevention and treatment of diseases and clinical conditions associated with LOC219673. LOC220766 (Accession XM_165471) is another VGAM1447 host target gene. LOC220766 BINDING SITE is HOST TARGET binding site found in the 3' untranslated region of mRNA encoded by LOC220766, corresponding to a HOST TARGET binding site such as BINDING SITE I, BINDING SITE II or BINDING SITE III. Table 2 illustrates the complementarity of the nucleotide sequences of LOC220766 BINDING SITE, designated SEQ ID:43656, to the nucleotide sequence of VGAM1447 RNA, herein designated VGAM RNA, also designated SEQ ID:4158.

Another function of VGAM1447 is therefore inhibition of LOC220766 (Accession XM_165471). Accordingly, utilities of VGAM1447 include diagnosis, prevention and treatment of diseases and clinical conditions associated with LOC220766. LOC253350 (Accession XM_174261) is another VGAM1447 host target gene. LOC253350 BINDING SITE is HOST TARGET binding site found in the 5' untranslated region of mRNA encoded by LOC253350, corresponding to a HOST TARGET binding site such as BINDING SITE I, BINDING SITE II or BINDING SITE III. Table 2 illustrates the complementarity of the nucleotide sequences of LOC253350 BINDING SITE, designated SEQ ID:46586, to the nucleotide sequence of VGAM1447 RNA, herein designated VGAM RNA, also designated SEQ ID:4158.

Another function of VGAM1447 is therefore inhibition of LOC253350 (Accession XM_174261). Accordingly, utilities of VGAM1447 include diagnosis, prevention and treatment of diseases and clinical conditions associated with LOC253350. LOC257336 (Accession XM_171216) is another VGAM1447 host target gene. LOC257336 BINDING SITE is HOST TARGET binding site found in the 5' untranslated region of mRNA encoded by LOC257336, corresponding to a HOST TARGET binding site such as BINDING SITE I, BINDING SITE II or BINDING SITE III. Table 2 illustrates the complementarity of the nucleotide sequences of LOC257336 BINDING SITE, designated SEQ ID:46002, to the nucleotide sequence of VGAM1447 RNA, herein designated VGAM RNA, also designated SEQ ID:4158.

Another function of VGAM1447 is therefore inhibition of LOC257336 (Accession XM_171216). Accordingly, utilities of VGAM1447 include diagnosis, prevention and treatment of diseases and clinical conditions associated with LOC257336. LOC257358 (Accession XM_173138) is another VGAM1447 host target gene. LOC257358 BINDING SITE is HOST TARGET binding site found in the 3' untranslated region of mRNA encoded by LOC257358, corresponding to a HOST TARGET binding site such as BINDING SITE I, BINDING SITE II or BINDING SITE III. Table 2 illustrates the complementarity of the nucleotide sequences of LOC257358 BINDING SITE, designated SEQ ID:46390, to the nucleotide sequence of VGAM1447 RNA, herein designated VGAM RNA, also designated SEQ ID:4158.

Another function of VGAM1447 is therefore inhibition of LOC257358 (Accession XM_173138). Accordingly, utilities of VGAM1447 include diagnosis, prevention and treatment of diseases and clinical conditions associated with LOC257358. LOC51634 (Accession NM_016024) is another VGAM1447 host target gene. LOC51634 BINDING SITE is HOST TARGET binding site found in the 3' untranslated region of mRNA encoded by LOC51634, corresponding to a HOST TARGET binding site such as BINDING SITE I, BINDING SITE II or BINDING SITE III. Table 2 illustrates the complementarity of the nucleotide sequences of LOC51634 BINDING SITE, designated SEQ ID:18102, to the nucleotide sequence of VGAM1447 RNA, herein designated VGAM RNA, also designated SEQ ID:4158.

Another function of VGAM1447 is therefore inhibition of LOC51634 (Accession NM_016024). Accordingly, utilities of VGAM1447 include diagnosis, prevention and treatment of diseases and clinical conditions associated with LOC51634. LOC91133 (Accession XM_036372) is another VGAM1447 host target gene. LOC91133 BINDING SITE is HOST TARGET binding site found in the 3' untranslated region of mRNA encoded by LOC91133, corresponding to a HOST TARGET binding site such as BINDING SITE I, BINDING SITE II or BINDING SITE III. Table 2 illustrates the complementarity of the nucleotide sequences of LOC91133 BINDING SITE, designated SEQ ID:32430, to the nucleotide sequence of VGAM1447 RNA, herein designated VGAM RNA, also designated SEQ ID:4158.

Another function of VGAM1447 is therefore inhibition of LOC91133 (Accession XM_036372). Accordingly, utilities of VGAM1447 include diagnosis, prevention and treatment of diseases and clinical conditions associated with LOC91133. LOC92344 (Accession XM_044455) is another VGAM1447 host target gene. LOC92344 BINDING SITE is HOST TARGET binding site found in the 3' untranslated region of mRNA encoded by LOC92344, corresponding to a HOST TARGET binding site such as BINDING SITE I, BINDING SITE II or BINDING SITE III. Table 2 illustrates the complementarity of the nucleotide sequences of LOC92344 BINDING SITE, designated SEQ ID:34209, to the nucleotide sequence of VGAM1447 RNA, herein designated VGAM RNA, also designated SEQ ID:4158.

Another function of VGAM1447 is therefore inhibition of LOC92344 (Accession XM_044455). Accordingly, utilities of VGAM1447 include diagnosis, prevention and treatment of diseases and clinical conditions associated with LOC92344. LOC93070 (Accession XM_049046) is another VGAM1447 host target gene. LOC93070 BINDING SITE is HOST TARGET binding site found in the 3' untranslated region of mRNA encoded by LOC93070, corresponding to a HOST TARGET binding site such as BINDING SITE I, BINDING SITE II or BINDING SITE III. Table 2 illustrates the complementarity of the nucleotide sequences of LOC93070 BINDING SITE, designated SEQ ID:35326, to the nucleotide sequence of VGAM1447 RNA, herein designated VGAM RNA, also designated SEQ ID:4158.

Another function of VGAM1447 is therefore inhibition of LOC93070 (Accession XM_049046). Accordingly, utilities of VGAM1447 include diagnosis, prevention and treatment of diseases and clinical conditions associated with LOC93070. LOC93259 (Accession XM_050105) is another VGAM1447 host target gene. LOC93259 BINDING SITE is HOST TARGET binding site found in the 5' untranslated region of mRNA encoded by LOC93259, corresponding to a HOST TARGET binding site such as BINDING SITE I, BINDING SITE II or BINDING SITE III. Table 2 illustrates the complementarity of the nucleotide sequences of LOC93259 BINDING SITE, designated SEQ ID:35561, to the nucleotide sequence of VGAM1447 RNA, herein designated VGAM RNA, also designated SEQ ID:4158.

Another function of VGAM1447 is therefore inhibition of LOC93259 (Accession XM_050105). Accordingly, utilities of VGAM1447 include diagnosis, prevention and treatment of diseases and clinical conditions associated with LOC93259. FIG. 1 further provides a conceptual description of a novel bioinformatically detected viral gene of the present invention, referred to here as Viral Genomic Address Messenger 1448 (VGAM1448) viral gene, which modulates expression of respective host target genes thereof, the function and utility of which host target genes is known in the art.

VGAM1448 is a novel bioinformatically detected regulatory, non protein coding, viral micro RNA (miRNA) gene. The method by which VGAM1448 was detected is described hereinabove with reference to FIGS. 1-8.

VGAM1448 gene, herein designated VGAM GENE, is a viral gene contained in the genome of Pepper Mottle Virus. VGAM1448 host target gene, herein designated VGAM HOST TARGET GENE, is a human gene contained in the human genome.

VGAM1448 gene encodes a VGAM1448 precursor RNA, herein designated VGAM PRECURSOR RNA. Similar to other miRNA genes, and unlike most ordinary genes, VGAM1448 precursor RNA does not encode a protein. A nucleotide sequence identical or highly similar to the nucleotide sequence of VGAM1448 precursor RNA is designated SEQ ID:1434, and is provided hereinbelow with reference to the sequence listing part. Nucleotide sequence SEQ ID:1434 is located at position 8114 relative to the genome of Pepper Mottle Virus.

VGAM1448 precursor RNA folds onto itself, forming VGAM1448 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1448 folded precursor RNA into VGAM1448 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1448 RNA is designated SEQ ID:4159, and is provided hereinbelow with reference to the sequence listing part.

VGAM1448 host target gene, herein designated VGAM HOST TARGET GENE, encodes a corresponding messenger RNA, VGAM1448 host target RNA, herein designated VGAM HOST TARGET RNA. VGAM1448 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1448 RNA, herein designated VGAM RNA, binds complementarily to one or more host target binding sites located in untranslated regions of VGAM1448 host target RNA, herein designated VGAM HOST TARGET RNA. This complementary binding is due to the fact that the nucleotide sequence of VGAM1448 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1448 RNA, herein designated VGAM RNA, may have a different number of host target binding sites in untranslated regions of a VGAM1448 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1448 RNA, herein designated VGAM RNA, to host target binding sites on VGAM1448 host target RNA, herein designated VGAM HOST TARGET RNA, such as BINDING SITE I, BINDING SITE II and BINDING SITE III, inhibits translation of VGAM1448 host target RNA into VGAM1448 host target protein, herein designated VGAM HOST TARGET PROTEIN. VGAM host target protein is therefore outlined by a broken line.

It is appreciated that VGAM1448 host target gene, herein designated VGAM HOST TARGET GENE, in fact represents a plurality of VGAM1448 host target genes. The mRNA of each one of this plurality of VGAM1448 host target genes comprises one or more host target binding sites, each having a nucleotide sequence which is at least partly complementary to VGAM1448 RNA, herein designated VGAM RNA, and which when bound by VGAM1448 RNA causes inhibition of translation of respective one or more VGAM1448 host target proteins.

It is further appreciated by one skilled in the art that the mode of translational inhibition illustrated by FIG. 1 with specific reference to translational inhibition exerted by VGAM1448 gene, herein designated VGAM GENE, on one or more VGAM1448 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1448 is inhibition of expression of host target genes, as part of a novel viral mechanism of attacking a host. Accordingly, utilities of VGAM1448 include diagnosis, prevention and treatment of viral infection by Pepper Mottle Virus. Specific functions, and accordingly utilities, of VGAM1448 correlate with, and may be deduced from, the identity of the host target genes which VGAM1448 binds and inhibits, and the function of these host target genes, as elaborated hereinbelow.

Nucleotide sequences of the VGAM1448 precursor RNA, herein designated VGAM PRECURSOR RNA, and of the 'diced' VGAM1448 RNA, herein designated VGAM RNA, and a schematic representation of the secondary folding of VGAM1448 folded precursor RNA, herein designated VGAM FOLDED PRECURSOR RNA, of VGAM1448 are further described hereinbelow with reference to Table 1.

Nucleotide sequences of host target binding sites, such as BINDING SITE-I, BINDING SITE-II and BINDING SITE-III of FIG. 1, found on VGAM1448 host target RNA, and schematic representation of the complementarity of each of these host target binding sites to VGAM1448 RNA, herein designated VGAM RNA, are described hereinbelow with reference to Table 2.

As mentioned hereinabove with reference to FIG. 1, a function of VGAM1448 gene, herein designated VGAM is inhibition of expression of VGAM1448 target genes. It is appreciated that specific functions, and accordingly utilities, of VGAM1448 correlate with, and may be deduced from, the identity of the target genes which VGAM1448 binds and inhibits, and the function of these target genes, as elaborated hereinbelow.

M-phase Phosphoprotein 9 (MPHOSPH9, Accession NM_022782) is a VGAM1448 host target gene. MPHOSPH9 BINDING SITE is HOST TARGET binding site found in the 3' untranslated region of mRNA encoded by MPHOSPH9, corresponding to a HOST TARGET binding site such as BINDING SITE I, BINDING SITE II or BINDING SITE III. Table 2 illustrates the complementarity of the nucleotide sequences of MPHOSPH9 BINDING SITE, designated SEQ ID:23065, to the nucleotide sequence of VGAM1448 RNA, herein designated VGAM RNA, also designated SEQ ID:4159.

A function of VGAM1448 is therefore inhibition of M-phase Phosphoprotein 9 (MPHOSPH9, Accession NM_022782). Accordingly, utilities of VGAM1448 include diagnosis, prevention and treatment of diseases and clinical conditions associated with MPHOSPH9. DKFZP566J2046 (Accession NM_031208) is another VGAM1448 host target gene. DKFZP566J2046 BINDING SITE is HOST TARGET binding site found in the 3' untranslated region of mRNA encoded by DKFZP566J2046, corresponding to a HOST TARGET binding site such as BINDING SITE I, BINDING SITE II or BINDING SITE III. Table 2 illustrates the complementarity of the nucleotide sequences of DKFZP566J2046 BINDING SITE, designated SEQ ID:25251, to the nucleotide sequence of VGAM1448 RNA, herein designated VGAM RNA, also designated SEQ ID:4159.

Another function of VGAM1448 is therefore inhibition of DKFZP566J2046 (Accession NM_031208). Accordingly, utilities of VGAM1448 include diagnosis, prevention and treatment of diseases and clinical conditions associated with DKFZP566J2046. NY-REN-60 (Accession XM_040506) is another VGAM1448 host target gene. NY-REN-60 BINDING SITE is HOST TARGET binding site found in the 3' untranslated region of mRNA encoded by NY-REN-60, corresponding to a HOST TARGET binding site such as BINDING SITE I, BINDING SITE II or BINDING SITE III. Table 2 illustrates the complementarity of the nucleotide sequences of NY-REN-60 BINDING SITE, designated SEQ ID:33317, to the nucleotide sequence of VGAM1448 RNA, herein designated VGAM RNA, also designated SEQ ID:4159.

Another function of VGAM1448 is therefore inhibition of NY-REN-60 (Accession XM_040506). Accordingly, utilities of VGAM1448 include diagnosis, prevention and treatment of diseases and clinical conditions associated with NY-REN-60. Zinc Finger, DHHC Domain Containing 5 (ZDHHC5, Accession XM_166204) is another VGAM1448 host target gene. ZDHHC5 BINDING SITE is HOST TARGET binding site found in the 5' untranslated region of mRNA encoded by ZDHHC5, corresponding to a HOST TARGET binding site such as BINDING SITE I, BINDING SITE II or BINDING SITE III. Table 2 illustrates the complementarity of the nucleotide sequences of ZDHHC5 BINDING SITE, designated SEQ ID:44009, to the nucleotide sequence of VGAM1448 RNA, herein designated VGAM RNA, also designated SEQ ID:4159.

Another function of VGAM1448 is therefore inhibition of Zinc Finger, DHHC Domain Containing 5 (ZDHHC5, Accession XM_166204). Accordingly, utilities of VGAM1448 include diagnosis, prevention and treatment of diseases and clinical conditions associated with ZDHHC5. LOC196549 (Accession NM_145293) is another VGAM1448 host target gene. LOC196549 BINDING SITE is HOST TARGET binding site found in the 5' untranslated region of mRNA encoded by LOC196549, corresponding to a HOST TARGET binding site such as BINDING SITE I, BINDING SITE II or BINDING SITE III. Table 2 illustrates the complementarity of the nucleotide sequences of LOC196549 BINDING SITE, designated SEQ ID:29808, to the nucleotide sequence of VGAM1448 RNA, herein designated VGAM RNA, also designated SEQ ID:4159.

Another function of VGAM1448 is therefore inhibition of LOC196549 (Accession NM_145293). Accordingly, utilities of VGAM1448 include diagnosis, prevention and treatment of diseases and clinical conditions associated with LOC196549. LOC205327 (Accession XM_115788) is another VGAM1448 host target gene. LOC205327 BINDING SITE is HOST TARGET binding site found in the 3' untranslated region of mRNA encoded by LOC205327, corresponding to a HOST TARGET binding site such as BINDING SITE I, BINDING SITE II or BINDING SITE III. Table 2 illustrates the complementarity of the nucleotide sequences of LOC205327 BINDING SITE, designated SEQ ID:43104, to the nucleotide sequence of VGAM1448 RNA, herein designated VGAM RNA, also designated SEQ ID:4159.

Another function of VGAM1448 is therefore inhibition of LOC205327 (Accession XM_115788). Accordingly, utilities of VGAM1448 include diagnosis, prevention and treatment of diseases and clinical conditions associated with LOC205327. FIG. 1 further provides a conceptual description of a novel bioinformatically detected viral gene of the present invention, referred to here as Viral Genomic Address Messenger 1449 (VGAM1449) viral gene, which modulates expression of respective host target genes thereof, the function and utility of which host target genes is known in the art.

VGAM1449 is a novel bioinformatically detected regulatory, non protein coding, viral micro RNA (miRNA) gene. The method by which VGAM1449 was detected is described hereinabove with reference to FIGS. 1-8.

VGAM1449 gene, herein designated VGAM GENE, is a viral gene contained in the genome of Equine Herpesvirus 2. VGAM1449 host target gene, herein designated VGAM HOST TARGET GENE, is a human gene contained in the human genome.

VGAM1449 gene encodes a VGAM1449 precursor RNA, herein designated VGAM PRECURSOR RNA. Similar to other miRNA genes, and unlike most ordinary genes, VGAM1449 precursor RNA does not encode a protein. A nucleotide sequence identical or highly similar to the nucleotide sequence of VGAM1449 precursor RNA is designated SEQ ID:1435, and is provided hereinbelow with reference to the sequence listing part. Nucleotide sequence SEQ ID:1435 is located at position 38531 relative to the genome of Equine Herpesvirus 2.

VGAM1449 precursor RNA folds onto itself, forming VGAM1449 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1449 folded precursor RNA into VGAM1449 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 92%) nucleotide sequence of VGAM1449 RNA is designated SEQ ID:4160, and is provided hereinbelow with reference to the sequence listing part.

VGAM1449 host target gene, herein designated VGAM HOST TARGET GENE, encodes a corresponding messenger RNA, VGAM1449 host target RNA, herein designated VGAM HOST TARGET RNA. VGAM1449 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1449 RNA, herein designated VGAM RNA, binds complementarily to one or more host target binding sites located in untranslated regions of VGAM1449 host target RNA, herein designated VGAM HOST TARGET RNA. This complementary binding is due to the fact that the nucleotide sequence of VGAM1449 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1449 RNA, herein designated VGAM RNA, may have a different number of host target binding sites in untranslated regions of a VGAM1449 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1449 RNA, herein designated VGAM RNA, to host target binding sites on VGAM1449 host target RNA, herein designated VGAM HOST TARGET RNA, such as BINDING SITE I, BINDING SITE II and BINDING SITE III, inhibits translation of VGAM1449 host target RNA into VGAM1449 host target protein, herein designated VGAM HOST TARGET PROTEIN. VGAM host target protein is therefore outlined by a broken line.

It is appreciated that VGAM1449 host target gene, herein designated VGAM HOST TARGET GENE, in fact represents a plurality of VGAM1449 host target genes. The mRNA of each one of this plurality of VGAM1449 host target genes comprises one or more host target binding sites, each having a nucleotide sequence which is at least partly complementary to VGAM1449 RNA, herein designated VGAM RNA, and which when bound by VGAM1449 RNA causes inhibition of translation of respective one or more VGAM1449 host target proteins.

It is further appreciated by one skilled in the art that the mode of translational inhibition illustrated by FIG. 1 with specific reference to translational inhibition exerted by VGAM1449 gene, herein designated VGAM GENE, on one or more VGAM1449 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1449 is inhibition of expression of host target genes, as part of a novel viral mechanism of attacking a host. Accordingly, utilities of VGAM1449 include diagnosis, prevention and treatment of viral infection by Equine Herpesvirus 2. Specific functions, and accordingly utilities, of VGAM1449 correlate with, and may be deduced from, the identity of the host target genes which VGAM1449 binds and inhibits, and the function of these host target genes, as elaborated hereinbelow.

Nucleotide sequences of the VGAM1449 precursor RNA, herein designated VGAM PRECURSOR RNA, and of the 'diced' VGAM1449 RNA, herein designated VGAM RNA, and a schematic representation of the secondary folding of VGAM1449 folded precursor RNA, herein designated VGAM FOLDED PRECURSOR RNA, of VGAM1449 are further described hereinbelow with reference to Table 1.

Nucleotide sequences of host target binding sites, such as BINDING SITE-I, BINDING SITE-II and BINDING SITE-III of FIG. 1, found on VGAM1449 host target RNA, and schematic representation of the complementarity of each of these host target binding sites to VGAM1449 RNA, herein designated VGAM RNA, are described hereinbelow with reference to Table 2.

As mentioned hereinabove with reference to FIG. 1, a function of VGAM1449 gene, herein designated VGAM is inhibition of expression of VGAM1449 target genes. It is appreciated that specific functions, and accordingly utilities, of VGAM1449 correlate with, and may be deduced from, the identity of the target genes which VGAM1449 binds and inhibits, and the function of these target genes, as elaborated hereinbelow.

ALEX2 (Accession NM_014782) is a VGAM1449 host target gene. ALEX2 BINDING SITE is HOST TARGET binding site found in the 5' untranslated region of mRNA encoded by ALEX2, corresponding to a HOST TARGET binding site such as BINDING SITE I, BINDING SITE II or BINDING SITE III. Table 2 illustrates the complementarity of the nucleotide sequences of ALEX2 BINDING SITE, designated SEQ ID:16634, to the nucleotide sequence of VGAM1449 RNA, herein designated VGAM RNA, also designated SEQ ID:4160.

A function of VGAM1449 is therefore inhibition of ALEX2 (Accession NM_014782), a gene which play a role in tumor suppression, possibly by being involved in the regulation of normal cell growth. Accordingly, utilities of VGAM1449 include diagnosis, prevention and treatment of diseases and clinical conditions associated with ALEX2. The function of ALEX2 has been established by previous studies. Armadillo (arm) repeat proteins (e.g., beta-catenin; 116806), are involved in development, maintenance of tissue integrity, and tumorigenesis. Their common feature is a 42-amino acid motif, the arm repeat. Using a yeast 2-hybrid screen of a brain cDNA library to identify proteins interacting with the peroxisome protease PP110, Kurochkin et al. (2001) identified a cDNA encoding ALEX1. They also cloned a cDNA encoding ALEX1 by screening a testis cDNA library. By searching sequence databases for homologs of ALEX1, they identified cDNAs encoding ALEX2 (OMIM Ref. No. 300363) and ALEX3 (OMIM Ref. No. 300364). Sequence analysis predicted that the 453-amino acid ALEX1 protein contains a potential N-terminal transmembrane domain, 2 arm repeats, an ATP/GTP-binding site, and multiple phosphorylation sites. Northern blot and RT-PCR analyses revealed wide expression of a 2.2-kb ALEX1 transcript in normal tissues and cancer cell lines; no expression was detected in carcinomas. Kurochkin et al. (2001) proposed that the specific loss of expression in epithelial tissue tumors suggests that the ALEX proteins play a role in tumor suppression, possibly by being involved in the regulation of normal cell growth.

Full details of the abovementioned studies are described in the following publications, the disclosure of which are hereby incorporated by reference:

Kurochkin, I. V.; Yonemitsu, N.; Funahashi, S.; Nomura, H.: ALEX1, a novel human armadillo repeat protein that is expressed differentially in normal tissues and carcinomas. Biochem. Biophys. Res. Commun. 280:340-347, 2001; and CREATION DATE.

Further studies establishing the function and utilities of ALEX2 are found in John Hopkins OMIM database record ID 300363, and in sited publications numbered 6734-6735 listed in the bibliography section hereinbelow, which are also hereby incorporated by reference. Forkhead Box E1 (thyroid transcription factor 2) (FOXE1, Accession NM_004473) is another VGAM1449 host target gene. FOXE1 BINDING SITE is HOST TARGET binding site found in the 5' untranslated region of mRNA encoded by FOXE1, corresponding to a HOST TARGET binding site such as BINDING SITE I, BINDING SITE II or BINDING SITE III. Table 2 illustrates the complementarity of the nucleotide sequences of FOXE1 BINDING SITE, designated SEQ ID:10780, to the nucleotide sequence of VGAM1449 RNA, herein designated VGAM RNA, also designated SEQ ID:4160.

Another function of VGAM1449 is therefore inhibition of Forkhead Box E1 (thyroid transcription factor 2) (FOXE1, Accession NM_004473). Accordingly, utilities of VGAM1449 include diagnosis, prevention and treatment of diseases and clinical conditions associated with FOXE1. Low Density Lipoprotein Receptor-related Protein 4 (LRP4, Accession XM_035037) is another VGAM1449 host target gene. LRP4 BINDING SITE is HOST TARGET binding site found in the 3' untranslated region of mRNA encoded by LRP4, corresponding to a HOST TARGET binding site such as BINDING SITE I, BINDING SITE II or BINDING SITE III. Table 2 illustrates the complementarity of the nucleotide sequences of LRP4 BINDING SITE, designated SEQ ID:32201, to the nucleotide sequence of VGAM1449 RNA, herein designated VGAM RNA, also designated SEQ ID:4160.

Another function of VGAM1449 is therefore inhibition of Low Density Lipoprotein Receptor-related Protein 4 (LRP4, Accession XM_035037). Accordingly, utilities of VGAM1449 include diagnosis, prevention and treatment of diseases and clinical conditions associated with LRP4. Sorting Nexin 5 (SNX5, Accession NM_014426) is another VGAM1449 host target gene. SNX5 BINDING SITE is HOST TARGET binding site found in the 3' untranslated region of mRNA encoded by SNX5, corresponding to a HOST TARGET binding site such as BINDING SITE I, BINDING SITE II or BINDING SITE III. Table 2 illustrates the complementarity of the nucleotide sequences of SNX5 BINDING SITE, designated SEQ ID:15785, to the nucleotide sequence of VGAM1449 RNA, herein designated VGAM RNA, also designated SEQ ID:4160.

Another function of VGAM1449 is therefore inhibition of Sorting Nexin 5 (SNX5, Accession NM_014426). Accordingly, utilities of VGAM1449 include diagnosis, prevention and treatment of diseases and clinical conditions associated with SNX5. Transcription Factor Dp-1 (TFDP1, Accession NM_007111) is another VGAM1449 host target gene. TFDP1 BINDING SITE is HOST TARGET binding site found in the 3' untranslated region of mRNA encoded by TFDP1, corresponding to a HOST TARGET binding site such as BINDING SITE I, BINDING SITE II or BINDING SITE III. Table 2 illustrates the complementarity of the nucleotide sequences of TFDP1 BINDING SITE, designated SEQ ID:13976, to the nucleotide sequence of VGAM1449 RNA, herein designated VGAM RNA, also designated SEQ ID:4160.

Another function of VGAM1449 is therefore inhibition of Transcription Factor Dp-1 (TFDP1, Accession NM_007111). Accordingly, utilities of VGAM1449 include diagnosis, prevention and treatment of diseases and clinical conditions associated with TFDP1. Chromosome 5 Open Reading Frame 5 (C5orf5, Accession NM_016603) is another VGAM1449 host target gene. C5orf5 BINDING SITE is HOST TARGET binding site found in the 3' untranslated region of mRNA encoded by C5orf5, corresponding to a HOST TARGET binding site such as BINDING SITE I, BINDING SITE II or BINDING SITE III. Table 2 illustrates the complementarity of the nucleotide sequences of C5orf5 BINDING SITE, designated SEQ ID:18698, to the nucleotide sequence of VGAM1449 RNA, herein designated VGAM RNA, also designated SEQ ID:4160.

Another function of VGAM1449 is therefore inhibition of Chromosome 5 Open Reading Frame 5 (C5orf5, Accession NM_016603). Accordingly, utilities of VGAM1449 include diagnosis, prevention and treatment of diseases and clinical conditions associated with C5orf5. FLJ20552 (Accession NM_017876) is another VGAM1449 host target gene. FLJ20552 BINDING SITE is HOST TARGET binding site found in the 3' untranslated region of mRNA encoded by FLJ20552, corresponding to a HOST TARGET binding site such as BINDING SITE I, BINDING SITE II or BINDING SITE III. Table 2 illustrates the complementarity of the nucleotide sequences of FLJ20552 BINDING SITE, designated SEQ ID:19548, to the nucleotide sequence of VGAM1449 RNA, herein designated VGAM RNA, also designated SEQ ID:4160.

Another function of VGAM1449 is therefore inhibition of FLJ20552 (Accession NM_017876). Accordingly, utilities of VGAM1449 include diagnosis, prevention and treatment of diseases and clinical conditions associated with FLJ20552. P114-RHO-GEF (Accession NM_015318) is another VGAM1449 host target gene. P114-RHO-GEF BINDING SITE is HOST TARGET binding site found in the 3' untranslated region of mRNA encoded by P114-RHO-GEF, corresponding to a HOST TARGET binding site such as BINDING SITE I, BINDING SITE II or BINDING SITE III. Table 2 illustrates the complementarity of the nucleotide sequences of P114-RHO-GEF BINDING SITE, designated SEQ ID:17640, to the nucleotide sequence of VGAM1449 RNA, herein designated VGAM RNA, also designated SEQ ID:4160.

Another function of VGAM1449 is therefore inhibition of P114-RHO-GEF (Accession NM_015318). Accordingly, utilities of VGAM1449 include diagnosis, prevention and treatment of diseases and clinical conditions associated with P114-RHO-GEF. LOC118851 (Accession XM_061180) is another VGAM1449 host target gene. LOC118851 BINDING SITE is HOST TARGET binding site found in the 3' untranslated region of mRNA encoded by LOC118851, corresponding to a HOST TARGET binding site such as BINDING SITE I, BINDING SITE II or BINDING SITE III. Table 2 illustrates the complementarity of the nucleotide sequences of LOC118851 BINDING SITE, designated SEQ ID:37201, to the nucleotide sequence of VGAM1449 RNA, herein designated VGAM RNA, also designated SEQ ID:4160.

Another function of VGAM1449 is therefore inhibition of LOC118851 (Accession XM_061180). Accordingly, utilities of VGAM1449 include diagnosis, prevention and treatment of diseases and clinical conditions associated with LOC118851. FIG. 1 further provides a conceptual description of a novel bioinformatically detected viral gene of the present invention, referred to here as Viral Genomic Address Messenger 1450 (VGAM1450) viral gene, which modulates expression of respective host target genes thereof, the function and utility of which host target genes is known in the art.

VGAM1450 is a novel bioinformatically detected regulatory, non protein coding, viral micro RNA (miRNA) gene. The method by which VGAM1450 was detected is described hereinabove with reference to FIGS. 1-8.

VGAM1450 gene, herein designated VGAM GENE, is a viral gene contained in the genome of Equine Herpesvirus 2. VGAM1450 host target gene, herein designated VGAM HOST TARGET GENE, is a human gene contained in the human genome.

VGAM1450 gene encodes a VGAM1450 precursor RNA, herein designated VGAM PRECURSOR RNA. Similar to other miRNA genes, and unlike most ordinary genes, VGAM1450 precursor RNA does not encode a protein. A nucleotide sequence identical or highly similar to the nucleotide sequence of VGAM1450 precursor RNA is designated SEQ ID:1436, and is provided hereinbelow with reference to the sequence listing part. Nucleotide sequence SEQ ID:1436 is located at position 40972 relative to the genome of Equine Herpesvirus 2.

VGAM1450 precursor RNA folds onto itself, forming VGAM1450 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1450 folded precursor RNA into VGAM1450 RNA, herein designated VGAM RNA, a single stranded ~22 nt long RNA segment. As is known in the art, 'dicing' of a hairpin structured RNA precursor product into a short ~22 nt RNA segment is catalyzed by an enzyme called Dicer together with other necessary proteins. A probable (over 43%) nucleotide sequence of VGAM1450 RNA is designated SEQ ID:4161, and is provided hereinbelow with reference to the sequence listing part.

VGAM1450 host target gene, herein designated VGAM HOST TARGET GENE, encodes a corresponding messenger RNA, VGAM1450 host target RNA, herein designated VGAM HOST TARGET RNA. VGAM1450 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1450 RNA, herein designated VGAM RNA, binds complementarily to one or more host target binding sites located in untranslated regions of VGAM1450 host target RNA, herein designated VGAM HOST TARGET RNA. This complementary binding is due to the fact that the nucleotide sequence of VGAM1450 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1450 RNA, herein designated VGAM RNA, may have a different number of host target binding sites in untranslated regions of a VGAM1450 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1450 RNA, herein designated VGAM RNA, to host target binding sites on VGAM1450 host target RNA, herein designated VGAM HOST TARGET RNA, such as BINDING SITE I, BINDING SITE II and BINDING SITE III, inhibits translation of VGAM1450 host target RNA into VGAM1450 host target protein, herein designated VGAM HOST TARGET PROTEIN. VGAM host target protein is therefore outlined by a broken line.

It is appreciated that VGAM1450 host target gene, herein designated VGAM HOST TARGET GENE, in fact represents a plurality of VGAM1450 host target genes. The mRNA of each one of this plurality of VGAM1450 host target genes comprises one or more host target binding sites, each having a nucleotide sequence which is at least partly complementary to VGAM1450 RNA, herein designated VGAM RNA, and which when bound by VGAM1450 RNA causes inhibition of translation of respective one or more VGAM1450 host target proteins.

It is further appreciated by one skilled in the art that the mode of translational inhibition illustrated by FIG. 1 with specific reference to translational inhibition exerted by VGAM1450 gene, herein designated VGAM GENE, on one or more VGAM1450 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1450 is inhibition of expression of host target genes, as part of a novel viral mechanism of attacking a host. Accordingly, utilities of VGAM1450 include diagnosis, prevention and treatment of viral infection by Equine Herpesvirus 2. Specific functions, and accordingly utilities, of VGAM1450 correlate with, and may be deduced from, the identity of the host target genes which VGAM1450 binds and inhibits, and the function of these host target genes, as elaborated hereinbelow.

Nucleotide sequences of the VGAM1450 precursor RNA, herein designated VGAM PRECURSOR RNA, and of the 'diced' VGAM1450 RNA, herein designated VGAM RNA, and a schematic representation of the secondary folding of VGAM1450 folded precursor RNA, herein designated VGAM FOLDED PRECURSOR RNA, of VGAM1450 are further described hereinbelow with reference to Table 1.

Nucleotide sequences of host target binding sites, such as BINDING SITE-I, BINDING SITE-II and BINDING SITE-III of FIG. 1, found on VGAM1450 host target RNA, and schematic representation of the complementarity of each of these host target binding sites to VGAM1450 RNA, herein designated VGAM RNA, are described hereinbelow with reference to Table 2.

As mentioned hereinabove with reference to FIG. 1, a function of VGAM1450 gene, herein designated VGAM is inhibition of expression of VGAM1450 target genes. It is appreciated that specific functions, and accordingly utilities, of VGAM1450 correlate with, and may be deduced from, the identity of the target genes which VGAM1450 binds and inhibits, and the function of these target genes, as elaborated hereinbelow.

KIAA1128 (Accession XM_043596) is a VGAM1450 host target gene. KIAA1128 BINDING SITE is HOST TARGET binding site found in the 3' untranslated region of mRNA encoded by KIAA1128, corresponding to a HOST TARGET binding site such as BINDING SITE I, BINDING SITE II or BINDING SITE III. Table 2 illustrates the complementarity of the nucleotide sequences of KIAA1128 BINDING SITE, designated SEQ ID:33969, to the nucleotide sequence of VGAM1450 RNA, herein designated VGAM RNA, also designated SEQ ID:4161.

A function of VGAM1450 is therefore inhibition of KIAA1128 (Accession XM_043596). Accordingly, utilities of VGAM1450 include diagnosis, prevention and treatment of diseases and clinical conditions associated with KIAA1128. LOC150225 (Accession XM_097870) is another VGAM1450 host target gene. LOC150225 BINDING SITE is HOST TARGET binding site found in the 3' untranslated region of mRNA encoded by LOC150225, corresponding to a HOST TARGET binding site such as BINDING SITE I, BINDING SITE II or BINDING SITE III. Table 2 illustrates the complementarity of the nucleotide sequences of LOC150225 BINDING SITE, designated SEQ ID:41184, to the nucleotide sequence of VGAM1450 RNA, herein designated VGAM RNA, also designated SEQ ID:4161.

Another function of VGAM1450 is therefore inhibition of LOC150225 (Accession XM_097870). Accordingly, utilities of VGAM1450 include diagnosis, prevention and treatment of diseases and clinical conditions associated with LOC150225. FIG. 1 further provides a conceptual description of a novel bioinformatically detected viral gene of the present invention, referred to here as Viral Genomic Address Messenger 1451 (VGAM1451) viral gene, which modulates expression of respective host target genes thereof, the function and utility of which host target genes is known in the art.

VGAM1451 is a novel bioinformatically detected regulatory, non protein coding, viral micro RNA (miRNA) gene. The method by which VGAM1451 was detected is described hereinabove with reference to FIGS. 1-8.

VGAM1451 gene, herein designated VGAM GENE, is a viral gene contained in the genome of Equine Herpesvirus 2. VGAM1451 host target gene, herein designated VGAM HOST TARGET GENE, is a human gene contained in the human genome.

VGAM1451 gene encodes a VGAM1451 precursor RNA, herein designated VGAM PRECURSOR RNA. Similar to other miRNA genes, and unlike most ordinary genes, VGAM1451 precursor RNA does not encode a protein. A nucleotide sequence identical or highly similar to the nucleotide sequence of VGAM1451 precursor RNA is designated SEQ ID:1437, and is provided hereinbelow with reference to the sequence listing part. Nucleotide sequence SEQ ID:1437 is located at position 40488 relative to the genome of Equine Herpesvirus 2.

VGAM1451 precursor RNA folds onto itself, forming VGAM1451 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1451 folded precursor RNA into VGAM1451 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1451 RNA is designated SEQ ID:4162, and is provided hereinbelow with reference to the sequence listing part.

VGAM1451 host target gene, herein designated VGAM HOST TARGET GENE, encodes a corresponding messenger RNA, VGAM1451 host target RNA, herein designated VGAM HOST TARGET RNA. VGAM1451 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1451 RNA, herein designated VGAM RNA, binds complementarily to one or more host target binding sites located in untranslated regions of VGAM1451 host target RNA, herein designated VGAM HOST TARGET RNA. This complementary binding is due to the fact that the nucleotide sequence of VGAM1451 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1451 RNA, herein designated VGAM RNA, may have a different number of host target binding sites in untranslated regions of a VGAM1451 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1451 RNA, herein designated VGAM RNA, to host target binding sites on VGAM1451 host target RNA, herein designated VGAM HOST TARGET RNA, such as BINDING SITE I, BINDING SITE II and BINDING SITE III, inhibits translation of VGAM1451 host target RNA into VGAM1451 host target protein, herein designated VGAM HOST TARGET PROTEIN. VGAM host target protein is therefore outlined by a broken line.

It is appreciated that VGAM1451 host target gene, herein designated VGAM HOST TARGET GENE, in fact represents a plurality of VGAM1451 host target genes. The mRNA of each one of this plurality of VGAM1451 host target genes comprises one or more host target binding sites, each having a nucleotide sequence which is at least partly complementary to VGAM1451 RNA, herein designated VGAM RNA, and which when bound by VGAM1451 RNA causes inhibition of translation of respective one or more VGAM1451 host target proteins.

It is further appreciated by one skilled in the art that the mode of translational inhibition illustrated by FIG. 1 with specific reference to translational inhibition exerted by VGAM1451 gene, herein designated VGAM GENE, on one or more VGAM1451 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1451 is inhibition of expression of host target genes, as part of a novel viral mechanism of attacking a host. Accordingly, utilities of VGAM1451 include diagnosis, prevention and treatment of viral infection by Equine Herpesvirus 2. Specific functions, and accordingly utilities, of VGAM1451 correlate with, and may be deduced from, the identity of the host target genes which VGAM1451 binds and inhibits, and the function of these host target genes, as elaborated hereinbelow.

Nucleotide sequences of the VGAM1451 precursor RNA, herein designated VGAM PRECURSOR RNA, and of the 'diced' VGAM1451 RNA, herein designated VGAM RNA, and a schematic representation of the secondary folding of VGAM1451 folded precursor RNA, herein designated VGAM FOLDED PRECURSOR RNA, of VGAM1451 are further described hereinbelow with reference to Table 1.

Nucleotide sequences of host target binding sites, such as BINDING SITE-I, BINDING SITE-II and BINDING SITE-III of FIG. 1, found on VGAM1451 host target RNA, and schematic representation of the complementarity of each of these host target binding sites to VGAM1451 RNA, herein designated VGAM RNA, are described hereinbelow with reference to Table 2.

As mentioned hereinabove with reference to FIG. 1, a function of VGAM1451 gene, herein designated VGAM is inhibition of expression of VGAM1451 target genes. It is appreciated that specific functions, and accordingly utilities, of VGAM1451 correlate with, and may be deduced from, the identity of the target genes which VGAM1451 binds and inhibits, and the function of these target genes, as elaborated hereinbelow.

Cyclin T2 (CCNT2, Accession NM_058241) is a VGAM1451 host target gene. CCNT2 BINDING SITE is HOST TARGET binding site found in the 3' untranslated region of mRNA encoded by CCNT2, corresponding to a HOST TARGET binding site such as BINDING SITE I, BINDING SITE II or BINDING SITE III. Table 2 illustrates the complementarity of the nucleotide sequences of CCNT2 BINDING SITE, designated SEQ ID:27769, to the nucleotide sequence of VGAM1451 RNA, herein designated VGAM RNA, also designated SEQ ID:4162.

A function of VGAM1451 is therefore inhibition of Cyclin T2 (CCNT2, Accession NM_058241), a gene which is a regulatory subunit of the cyclin-dependent kinase pair (cdk9/cyclin t) complex. Accordingly, utilities of VGAM1451 include diagnosis, prevention and treatment of diseases and clinical conditions associated with CCNT2. The function of CCNT2 and its association with various diseases and clinical conditions, has been established by previous studies, as described hereinabove with reference to VGAM159. KIAA1161 (Accession XM_088501) is another VGAM1451 host target gene. KIAA1161 BINDING SITE is HOST TARGET binding site found in the 5' untranslated region of mRNA encoded by KIAA1161, corresponding to a HOST TARGET binding site such as BINDING SITE I, BINDING SITE II or BINDING SITE III. Table 2 illustrates the complementarity of the nucleotide sequences of KIAA1161 BINDING SITE, designated SEQ ID:39744, to the nucleotide sequence of VGAM1451 RNA, herein VGAM RNA, also designated SEQ ID:4162.

Another function of VGAM1451 is therefore inhibition of KIAA1161 (Accession XM_088501). Accordingly, utilities of VGAM1451 include diagnosis, prevention and treatment of diseases and clinical conditions associated with KIAA1161. KIAA1274 (Accession XM_166125) is another VGAM1451 host target gene. KIAA1274 BINDING SITE is HOST TARGET binding site found in the 3' untranslated region of mRNA encoded by KIAA1274, corresponding to a HOST TARGET binding site such as BINDING SITE I, BINDING SITE II or BINDING SITE III. Table 2 illustrates the complementarity of the nucleotide sequences of KIAA1274 BINDING SITE, designated SEQ ID:43907, to the nucleotide sequence of VGAM1451 RNA, herein designated VGAM RNA, also designated SEQ ID:4162.

Another function of VGAM1451 is therefore inhibition of KIAA1274 (Accession XM_166125). Accordingly, utilities of VGAM1451 include diagnosis, prevention and treatment of diseases and clinical conditions associated with KIAA1274. FIG. 1 further provides a conceptual description of a novel bioinformatically detected viral gene of the present invention, referred to here as Viral Genomic Address Messenger 1452 (VGAM1452) viral gene, which modulates expression of respective host target genes thereof, the function and utility of which host target genes is known in the art.

VGAM1452 is a novel bioinformatically detected regulatory, non protein coding, viral micro RNA (miRNA) gene. The method by which VGAM1452 was detected is described hereinabove with reference to FIGS. 1-8.

VGAM1452 gene, herein designated VGAM GENE, is a viral gene contained in the genome of Equine Herpesvirus 2. VGAM1452 host target gene, herein designated VGAM HOST TARGET GENE, is a human gene contained in the human genome.

VGAM1452 gene encodes a VGAM1452 precursor RNA, herein designated VGAM PRECURSOR RNA. Similar to other miRNA genes, and unlike most ordinary genes, VGAM1452 precursor RNA does not encode a protein. A nucleotide sequence identical or highly similar to the nucleotide sequence of VGAM1452 precursor RNA is designated SEQ ID:1438, and is provided hereinbelow with reference to the sequence listing part. Nucleotide sequence SEQ ID:1438 is located at position 42439 relative to the genome of Equine Herpesvirus 2.

VGAM1452 precursor RNA folds onto itself, forming VGAM1452 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1452 folded precursor RNA into VGAM1452 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM1452 RNA is designated SEQ ID:4163, and is provided hereinbelow with reference to the sequence listing part.

VGAM1452 host target gene, herein designated VGAM HOST TARGET GENE, encodes a corresponding messenger RNA, VGAM1452 host target RNA, herein designated VGAM HOST TARGET RNA. VGAM1452 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1452 RNA, herein designated VGAM RNA, binds complementarily to one or more host target binding sites located in untranslated regions of VGAM1452 host target RNA, herein designated VGAM HOST TARGET RNA. This complementary binding is due to the fact that the nucleotide sequence of VGAM1452 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1452 RNA, herein designated VGAM RNA, may have a different number of host target binding sites in untranslated regions of a VGAM1452 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1452 RNA, herein designated VGAM RNA, to host target binding sites on VGAM1452 host target RNA, herein designated VGAM HOST TARGET RNA, such as BINDING SITE I, BINDING SITE II and BINDING SITE III, inhibits translation of VGAM1452 host target RNA into VGAM1452 host target protein, herein designated VGAM HOST TARGET PROTEIN. VGAM host target protein is therefore outlined by a broken line.

It is appreciated that VGAM1452 host target gene, herein designated VGAM HOST TARGET GENE, in fact represents a plurality of VGAM1452 host target genes. The mRNA of each one of this plurality of VGAM1452 host target genes comprises one or more host target binding sites, each having a nucleotide sequence which is at least partly complementary to VGAM1452 RNA, herein designated VGAM RNA, and which when bound by VGAM1452 RNA causes inhibition of translation of respective one or more VGAM1452 host target proteins.

It is further appreciated by one skilled in the art that the mode of translational inhibition illustrated by FIG. 1 with specific reference to translational inhibition exerted by VGAM1452 gene, herein designated VGAM GENE, on one or more VGAM1452 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1452 is inhibition of expression of host target genes, as part of a novel viral mechanism of attacking a host. Accordingly, utilities of VGAM1452 include diagnosis, prevention and treatment of viral infection by Equine Herpesvirus 2. Specific functions, and accordingly utilities, of VGAM1452 correlate with, and may be deduced from, the identity of the host target genes which VGAM1452 binds and inhibits, and the function of these host target genes, as elaborated hereinbelow.

Nucleotide sequences of the VGAM1452 precursor RNA, herein designated VGAM PRECURSOR RNA, and of the 'diced' VGAM1452 RNA, herein designated VGAM RNA, and a schematic representation of the secondary folding of VGAM1452 folded precursor RNA, herein designated VGAM FOLDED PRECURSOR RNA, of VGAM1452 are further described hereinbelow with reference to Table 1.

Nucleotide sequences of host target binding sites, such as BINDING SITE-I, BINDING SITE-II and BINDING SITE-III of FIG. 1, found on VGAM1452 host target RNA, and schematic representation of the complementarity of each of these host target binding sites to VGAM1452 RNA, herein designated VGAM RNA, are described hereinbelow with reference to Table 2.

As mentioned hereinabove with reference to FIG. 1, a function of VGAM1452 gene, herein designated VGAM is inhibition of expression of VGAM1452 target genes. It is appreciated that specific functions, and accordingly utilities, of VGAM1452 correlate with, and may be deduced from, the identity of the target genes which VGAM1452 binds and inhibits, and the function of these target genes, as elaborated hereinbelow.

Cytoplasmic FMR1 Interacting Protein 2 (CYFIP2, Accession XM_056963) is a VGAM1452 host target gene. CYFIP2 BINDING SITE is HOST TARGET binding site found in the 5' untranslated region of mRNA encoded by CYFIP2, corresponding to a HOST TARGET binding site such as BINDING SITE I, BINDING SITE II or BINDING SITE III. Table 2 illustrates the complementarity of the nucleotide sequences of CYFIP2 BINDING SITE, designated SEQ ID:36440, to the nucleotide sequence of VGAM1452 RNA, herein designated VGAM RNA, also designated SEQ ID:4163.

A function of VGAM1452 is therefore inhibition of Cytoplasmic FMR1 Interacting Protein 2 (CYFIP2, Accession XM_056963). Accordingly, utilities of VGAM1452 include diagnosis, prevention and treatment of diseases and clinical conditions associated with CYFIP2. ELL (Accession NM_006532) is another VGAM1452 host target gene. ELL BINDING SITE is HOST TARGET binding site found in the 3' untranslated region of mRNA encoded by ELL, corresponding to a HOST TARGET binding site such as BINDING SITE I, BINDING SITE II or BINDING SITE III. Table 2 illustrates the complementarity of the nucleotide sequences of ELL BINDING SITE, designated SEQ ID:13279, to the nucleotide sequence of VGAM1452 RNA, herein designated VGAM RNA, also designated SEQ ID:4163.

Another function of VGAM1452 is therefore inhibition of ELL (Accession NM_006532). Accordingly, utilities of VGAM1452 include diagnosis, prevention and treatment of diseases and clinical conditions associated with ELL. GNAS Complex Locus (GNAS, Accession NM_016592) is another VGAM1452 host target gene. GNAS BINDING SITE is HOST TARGET binding site found in the 5" untranslated region of mRNA encoded by GNAS, corresponding to a HOST TARGET binding site such as BINDING SITE I, BINDING SITE II or BINDING SITE III. Table 2 illustrates the complementarity of the nucleotide sequences of GNAS BINDING SITE, designated SEQ ID:18680, to the nucleotide sequence of VGAM1452 RNA, herein designated VGAM RNA, also designated SEQ ID:4163.

Another function of VGAM1452 is therefore inhibition of GNAS Complex Locus (GNAS, Accession NM_016592), a gene which transduces signals from G protein-coupled receptors and activates adenylyl cyclase. Accordingly, utilities of VGAM1452 include diagnosis, prevention and treatment of diseases and clinical conditions associated with GNAS. The function of GNAS and its association with various diseases and clinical conditions, has been established by previous studies, as described hereinabove with reference to VGAM1205. Growth Factor Receptor-bound Protein 10 (GRB10, Accession NM_005311) is another VGAM1452 host target gene. GRB10 BINDING SITE is HOST TARGET binding site found in the 5' untranslated region of mRNA encoded by GRB10, corresponding to a HOST TARGET binding site such as BINDING SITE I, BINDING SITE II or BINDING SITE III. Table 2 illustrates the complementarity of the nucleotide sequences of GRB10 BINDING SITE, designated SEQ ID:11784, to the nucleotide sequence of VGAM1452 RNA, herein designated VGAM RNA, also designated SEQ ID:4163.

Another function of VGAM1452 is therefore inhibition of Growth Factor Receptor-bound Protein 10 (GRB10, Accession NM_005311), a gene which plays a functional role in insulin and IGF-I signaling. Accordingly, utilities of VGAM1452 include diagnosis, prevention and treatment of diseases and clinical conditions associated with GRB10. The function of GRB10 and its association with various diseases and clinical conditions, has been established by previous studies, as described hereinabove with reference to VGAM441. SET Binding Factor 1 (SBF1, Accession XM_037447) is another VGAM1452 host target gene. SBF1 BINDING SITE is HOST TARGET binding site found in the 5' untranslated region of mRNA encoded by SBF1, corresponding to a HOST TARGET binding site such as BINDING SITE I, BINDING SITE II or BINDING SITE III. Table 2 illustrates the complementarity of the nucleotide sequences of SBF1 BINDING SITE, designated SEQ ID:32625, to the nucleotide sequence of VGAM1452 RNA, herein designated VGAM RNA, also designated SEQ ID:4163.

Another function of VGAM1452 is therefore inhibition of SET Binding Factor 1 (SBF1, Accession XM_037447), a gene which is of unknown function, could be a tyrosine-phosphatase. Accordingly, utilities of VGAM1452 include diagnosis, prevention and treatment of diseases and clinical conditions associated with SBF1. The function of SBF1 has been established by previous studies. Mutations in the myotubularin (MTM1; 310400) dual-specific phosphatase (DSP) gene cause X-linked myotubular myopathy. By searching an EST database for sequences related to MTM1, Laporte et al. (1998) identified a partial MTMR5 (myotubularin-related protein-5) cDNA and cDNAs encoding 3 other novel members of the myotubularin (MTM) protein family. They noted that the predicted protein lacks catalytically essential residues in the tyrosine phosphatase/DSP active site. Northern blot analysis revealed that the 6-kb MTMR5 mRNA was expressed in all tissues tested but testis. The SET (Suvar3-9, Enhancer of zeste, trithorax) domain was originally identified as a characteristic motif in several Drosophila proteins that contribute to epigenetic mechanisms of gene regulation. The human protooncoprotein HRX (OMIM Ref. No. 159555) also contains a SET domain. Using a yeast 2-hybrid assay with the SET domain of HRX as bait, Cui et al. (1998) isolated cDNAs encoding MTMR5, or SBF1 (SET-binding factor 1). Both SBF1 and MTM1 interacted with HRX in vitro and in vivo. This interaction was abrogated in an oncogenic form of HRX lacking the SET domain. Like HRX, both SBF1 and MTM1 localized to the nucleus of mammalian cells. The authors found that the SET interaction domain (SID) of the SBF1 protein displays a paired amphipathic helix secondary structure. The SID is highly conserved in the myotubularin-related family of proteins. In contrast with MTM1, SBF1 lacked dual-specificity phosphatase activity in vitro, suggesting that SBF1 acts as a protective factor that prevents substrate dephosphorylation. Ectopic expression of SBF1 induced NIH 3T3 cell transformation, leading Cui et al. (1998) to propose that displacement or exclusion of endogenous, catalytically active phosphatases from SET-domain proteins is a critical molecular event underlying loss of growth control. Similarly, ectopic expression of SBF1 impaired the in vitro differentiation of myoblast cells, implying that interactions of SET-domain proteins with catalytically active members of the MTM family are essential for execution of the myogenic program. The authors concluded that MTM-type phosphatases link SET domain-containing components of the epigenetic regulatory machinery with signaling pathways involved in growth and differentiation.

Full details of the abovementioned studies are described in the following publications, the disclosure of which are hereby incorporated by reference:

Cui, X.; De Vivo, I.; Slany, R.; Miyamoto, A.; Firestein, R.; Cleary, M. L.: Association of SET domain and myotubularin-related proteins modulates growth control. Nature Genet. 18:331-337, 1998; and Laporte, J.; Blondeau, F.; Buj-Bello, A.; Tentler, D.; Kretz, C.; Dahl, N.; Mandel, J.-L.: Characterization of the myotubularin dual specificity phosphatase gene family from yeast to h.

Further studies establishing the function and utilities of SBF1 are found in John Hopkins OMIM database record ID 603560, and in sited publications numbered 500 and 7254 listed in the bibliography section hereinbelow, which are also hereby incorporated by reference. Tripartite Motif-containing 14 (TRIM14, Accession NM_014788) is another VGAM1452 host target gene. TRIM14 BINDING SITE is HOST TARGET binding site found in the 3' untranslated region of mRNA encoded by TRIM14, corresponding to a HOST TARGET binding site such as BINDING SITE I, BINDING SITE II or BINDING SITE III. Table 2 illustrates the complementarity of the nucleotide sequences of TRIM14 BINDING SITE, designated SEQ ID:16665, to the nucleotide sequence of VGAM1452 RNA, herein designated VGAM RNA, also designated SEQ ID:4163.

Another function of VGAM1452 is therefore inhibition of Tripartite Motif-containing 14 (TRIM14, Accession NM_014788), a gene which is composed of 3 zinc-binding domains and is involved in development and cell growth. Accordingly, utilities of VGAM1452 include diagnosis, prevention and treatment of diseases and clinical conditions associated with TRIM14. The function of TRIM14 and its association with various diseases and clinical conditions, has been established by previous studies, as described hereinabove with reference to VGAM180. Chromosome 11 Open Reading Frame 9 (C11orf9, Accession NM_013279) is another VGAM1452 host target gene. C11orf9 BINDING SITE is HOST TARGET binding site found in the 3' untranslated region of mRNA encoded by C11orf9, corresponding to a HOST TARGET binding site such as BINDING SITE I, BINDING SITE II or BINDING SITE III. Table 2 illustrates the complementarity of the nucleotide sequences of C11orf9 BINDING SITE, designated SEQ ID:14947, to the nucleotide sequence of VGAM1452 RNA, herein designated VGAM RNA, also designated SEQ ID:4163.

Another function of VGAM1452 is therefore inhibition of Chromosome 11 Open Reading Frame 9 (C11orf9, Accession NM_013279). Accordingly, utilities of VGAM1452 include diagnosis, prevention and treatment of diseases and clinical conditions associated with C11orf9. Chromosome 5 Open Reading Frame 7 (C5orf7, Accession XM_033576) is another VGAM1452 host target gene. C5orf7 BINDING SITE is HOST TARGET binding site found in the 3' untranslated region of mRNA encoded by C5orf7, corresponding to a HOST TARGET binding site such as BINDING SITE I, BINDING SITE II or BINDING SITE III. Table 2 illustrates the complementarity of the nucleotide sequences of C5orf7 BINDING SITE, designated SEQ ID:31940, to the nucleotide sequence of VGAM1452 RNA, herein designated VGAM RNA, also designated SEQ ID:4163.

Another function of VGAM1452 is therefore inhibition of Chromosome 5 Open Reading Frame 7 (C5orf7, Accession XM_033576). Accordingly, utilities of VGAM1452 include diagnosis, prevention and treatment of diseases and clinical conditions associated with C5orf7. CXYorf1 (Accession XM_088704) is another VGAM1452 host target gene. CXYorf1 BINDING SITE is HOST TARGET binding site found in the 5' untranslated region of mRNA encoded by CXYorf1, corresponding to a HOST TARGET binding site such as BINDING SITE I, BINDING SITE II or BINDING SITE III. Table 2 illustrates the complementarity of the nucleotide sequences of CXYorf1 BINDING SITE, designated SEQ ID:39911, to the nucleotide sequence of VGAM1452 RNA, herein designated VGAM RNA, also designated SEQ ID:4163.

Another function of VGAM1452 is therefore inhibition of CXYorf1 (Accession XM_088704). Accordingly, utilities of VGAM1452 include diagnosis, prevention and treatment of diseases and clinical conditions associated with CXYorf1. FLJ10743 (Accession NM_018201) is another VGAM1452 host target gene. FLJ10743 BINDING SITE is HOST TARGET binding site found in the 3' untranslated region of mRNA encoded by FLJ10743, corresponding to a HOST TARGET binding site such as BINDING SITE I, BINDING SITE II or BINDING SITE III. Table 2 illustrates the complementarity of the nucleotide sequences of FLJ10743 BINDING SITE, designated SEQ ID:20080, to the nucleotide sequence of VGAM1452 RNA, herein designated VGAM RNA, also designated SEQ ID:4163.

Another function of VGAM1452 is therefore inhibition of FLJ10743 (Accession NM_018201). Accordingly, utilities of VGAM1452 include diagnosis, prevention and treatment of diseases and clinical conditions associated with FLJ10743. FLJ22593 (Accession NM_024703) is another VGAM1452 host target gene. FLJ22593 BINDING SITE is HOST TARGET binding site found in the 5' untranslated region of mRNA encoded by FLJ22593, corresponding to a HOST TARGET binding site such as BINDING SITE I, BINDING SITE II or BINDING SITE III. Table 2 illustrates the complementarity of the nucleotide sequences of FLJ22593 BINDING SITE, designated SEQ ID:24017, to the nucleotide sequence of VGAM1452 RNA, herein designated VGAM RNA, also designated SEQ ID:4163.

Another function of VGAM1452 is therefore inhibition of FLJ22593 (Accession NM_024703). Accordingly, utilities of VGAM1452 include diagnosis, prevention and treatment of diseases and clinical conditions associated with FLJ22593. FLJ22944 (Accession NM_025145) is another VGAM1452 host target gene. FLJ22944 BINDING SITE is HOST TARGET binding site found in the 3' untranslated region of mRNA encoded by FLJ22944, corresponding to a HOST TARGET binding site such as BINDING SITE I, BINDING SITE II or BINDING SITE III. Table 2 illustrates the complementarity of the nucleotide sequences of FLJ22944 BINDING SITE, designated SEQ ID:24782, to the nucleotide sequence of VGAM1452 RNA, herein designated VGAM RNA, also designated SEQ ID:4163.

Another function of VGAM1452 is therefore inhibition of FLJ22944 (Accession NM_025145). Accordingly, utilities of VGAM1452 include diagnosis, prevention and treatment of diseases and clinical conditions associated with FLJ22944. KIAA0620 (Accession XM_030707) is another VGAM1452 host target gene. KIAA0620 BINDING SITE is HOST TARGET binding site found in the 3' untranslated region of mRNA encoded by KIAA0620, corresponding to a HOST TARGET binding site such as BINDING SITE I, BINDING SITE II or BINDING SITE III. Table 2 illustrates the complementarity of the nucleotide sequences of KIAA0620 BINDING SITE, designated SEQ ID:31119, to the nucleotide sequence of VGAM1452 RNA, herein designated VGAM RNA, also designated SEQ ID:4163.

Another function of VGAM1452 is therefore inhibition of KIAA0620 (Accession XM_030707). Accordingly, utilities of VGAM1452 include diagnosis, prevention and treatment of diseases and clinical conditions associated with KIAA0620. KIAA0864 (Accession XM_032630) is another VGAM1452 host target gene. KIAA0864 BINDING SITE is HOST TARGET binding site found in the 5' untranslated region of mRNA encoded by KIAA0864, corresponding to a HOST TARGET binding site such as BINDING SITE I, BINDING SITE II or BINDING SITE III. Table 2 illustrates the complementarity of the nucleotide sequences of KIAA0864 BINDING SITE, designated SEQ ID:31683, to the nucleotide sequence of VGAM1452 RNA, herein designated VGAM RNA, also designated SEQ ID:4163.

Another function of VGAM1452 is therefore inhibition of KIAA0864 (Accession XM_032630). Accordingly, utilities of VGAM1452 include diagnosis, prevention and treatment of diseases and clinical conditions associated with KIAA0864. KIAA1432 (Accession XM_039698) is another VGAM1452 host target gene. KIAA1432 BINDING SITE is HOST TARGET binding site found in the 5' untranslated region of mRNA encoded by KIAA1432, corresponding to a HOST TARGET binding site such as BINDING SITE I, BINDING SITE II or BINDING SITE III. Table 2 illustrates the complementarity of the nucleotide sequences of KIAA1432 BINDING SITE, designated SEQ ID:33151, to the nucleotide sequence of VGAM1452 RNA, herein designated VGAM RNA, also designated SEQ ID:4163.

Another function of VGAM1452 is therefore inhibition of KIAA1432 (Accession XM_039698). Accordingly, utilities of VGAM1452 include diagnosis, prevention and treatment of diseases and clinical conditions associated with KIAA1432. KIAA1719 (Accession XM_042936) is another VGAM1452 host target gene. KIAA1719 BINDING SITE is HOST TARGET binding site found in the 3' untranslated region of mRNA encoded by KIAA1719, corresponding to a HOST TARGET binding site such as BINDING SITE I, BINDING SITE II or BINDING SITE III. Table 2 illustrates the complementarity of the nucleotide sequences of KIAA1719 BINDING SITE, designated SEQ ID:33822, to the nucleotide sequence of VGAM1452 RNA, herein designated VGAM RNA, also designated SEQ ID:4163.

Another function of VGAM1452 is therefore inhibition of KIAA1719 (Accession XM_042936). Accordingly, utilities of VGAM1452 include diagnosis, prevention and treatment of diseases and clinical conditions associated with KIAA1719. LOC129607 (Accession XM_059368) is another VGAM1452 host target gene. LOC129607 BIND- ING SITE is HOST TARGET binding site found in the 3' untranslated region of mRNA encoded by LOC129607, corresponding to a HOST TARGET binding site such as BINDING SITE I, BINDING SITE II or BINDING SITE III. Table 2 illustrates the complementarity of the nucleotide sequences of LOC129607 BINDING SITE, designated SEQ ID:36974, to the nucleotide sequence of VGAM1452 RNA, herein designated VGAM RNA, also designated SEQ ID:4163.

Another function of VGAM1452 is therefore inhibition of LOC129607 (Accession XM_059368). Accordingly, utilities of VGAM1452 include diagnosis, prevention and treatment of diseases and clinical conditions associated with LOC129607. LOC154089 (Accession XM_087846) is another VGAM1452 host target gene. LOC154089 BINDING SITE is HOST TARGET binding site found in the 3' untranslated region of mRNA encoded by LOC154089, corresponding to a HOST TARGET binding site such as BINDING SITE I, BINDING SITE II or BINDING SITE III. Table 2 illustrates the complementarity of the nucleotide sequences of LOC154089 BINDING SITE, designated SEQ ID:39463, to the nucleotide sequence of VGAM1452 RNA, herein designated VGAM RNA, also designated SEQ ID:4163.

Another function of VGAM1452 is therefore inhibition of LOC154089 (Accession XM_087846). Accordingly, utilities of VGAM1452 include diagnosis, prevention and treatment of diseases and clinical conditions associated with LOC154089. LOC200093 (Accession XM_032184) is another VGAM1452 host target gene. LOC200093 BINDING SITE is HOST TARGET binding site found in the 5' untranslated region of mRNA encoded by LOC200093, corresponding to a HOST TARGET binding site such as BINDING SITE I, BINDING SITE II or BINDING SITE III. Table 2 illustrates the complementarity of the nucleotide sequences of LOC200093 BINDING SITE, designated SEQ ID:31603, to the nucleotide sequence of VGAM1452 RNA, herein designated VGAM RNA, also designated SEQ ID:4163.

Another function of VGAM1452 is therefore inhibition of LOC200093 (Accession XM_032184). Accordingly, utilities of VGAM1452 include diagnosis, prevention and treatment of diseases and clinical conditions associated with LOC200093. LOC221876 (Accession XM_168220) is another VGAM1452 host target gene. LOC221876 BINDING SITE is HOST TARGET binding site found in the 5' untranslated region of mRNA encoded by LOC221876, corresponding to a HOST TARGET binding site such as BINDING SITE I, BINDING SITE II or BINDING SITE III. Table 2 illustrates the complementarity of the nucleotide sequences of LOC221876 BINDING SITE, designated SEQ ID:45076, to the nucleotide sequence of VGAM1452 RNA, herein designated VGAM RNA, also designated SEQ ID:4163.

Another function of VGAM1452 is therefore inhibition of LOC221876 (Accession XM_168220). Accordingly, utilities of VGAM1452 include diagnosis, prevention and treatment of diseases and clinical conditions associated with LOC221876. LOC91040 (Accession XM_035641) is another VGAM1452 host target gene. LOC91040 BINDING SITE is HOST TARGET binding site found in the 5' untranslated region of mRNA encoded by LOC91040, corresponding to a HOST TARGET binding site such as BINDING SITE I, BINDING SITE II or BINDING SITE III. Table 2 illustrates the complementarity of the nucleotide sequences of LOC91040 BINDING SITE, designated SEQ ID:32320, to the nucleotide sequence of VGAM1452 RNA, herein designated VGAM RNA, also designated SEQ ID:4163.

Another function of VGAM1452 is therefore inhibition of LOC91040 (Accession XM_035641). Accordingly, utilities of VGAM1452 include diagnosis, prevention and treatment of diseases and clinical conditions associated with LOC91040. FIG. 1 further provides a conceptual description of a novel bioinformatically detected viral gene of the present invention, referred to here as Viral Genomic Address Messenger 1453 (VGAM1453) viral gene, which modulates expression of respective host target genes thereof, the function and utility of which host target genes is known in the art.

VGAM1453 is a novel bioinformatically detected regulatory, non protein coding, viral micro RNA (miRNA) gene. The method by which VGAM1453 was detected is described hereinabove with reference to FIGS. 1-8.

VGAM1453 gene, herein designated VGAM GENE, is a viral gene contained in the genome of Equine Herpesvirus 2. VGAM1453 host target gene, herein designated VGAM HOST TARGET GENE, is a human gene contained in the human genome.

VGAM1453 gene encodes a VGAM1453 precursor RNA, herein designated VGAM PRECURSOR RNA. Similar to other miRNA genes, and unlike most ordinary genes, VGAM1453 precursor RNA does not encode a protein. A nucleotide sequence identical or highly similar to the nucleotide sequence of VGAM1453 precursor RNA is designated SEQ ID:1439, and is provided hereinbelow with reference to the sequence listing part. Nucleotide sequence SEQ ID:1439 is located at position 41504 relative to the genome of Equine Herpesvirus 2.

VGAM1453 precursor RNA folds onto itself, forming VGAM1453 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1453 folded precursor RNA into VGAM1453 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1453 RNA is designated SEQ ID:4164, and is provided hereinbelow with reference to the sequence listing part.

VGAM1453 host target gene, herein designated VGAM HOST TARGET GENE, encodes a corresponding messenger RNA, VGAM1453 host target RNA, herein designated VGAM HOST TARGET RNA. VGAM1453 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1453 RNA, herein designated VGAM RNA, binds complementarily to one or more host target binding sites located in untranslated regions of VGAM1453 host target RNA, herein designated VGAM HOST TARGET RNA. This complementary binding is due to the fact that the nucleotide sequence of VGAM1453 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1453 RNA, herein designated VGAM RNA, may have a different number of host target binding sites in untranslated regions of a VGAM1453 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1453 RNA, herein designated VGAM RNA, to host target binding sites on VGAM1453 host target RNA, herein designated VGAM HOST TARGET RNA, such as BINDING SITE I, BINDING SITE II and BINDING SITE III, inhibits translation of VGAM1453 host target RNA into VGAM1453 host target protein, herein designated VGAM HOST TARGET PROTEIN. VGAM host target protein is therefore outlined by a broken line.

It is appreciated that VGAM1453 host target gene, herein designated VGAM HOST TARGET GENE, in fact represents a plurality of VGAM1453 host target genes. The mRNA of each one of this plurality of VGAM1453 host target genes comprises one or more host target binding sites, each having a nucleotide sequence which is at least partly complementary to VGAM1453 RNA, herein designated VGAM RNA, and which when bound by VGAM1453 RNA causes inhibition of translation of respective one or more VGAM1453 host target proteins.

It is further appreciated by one skilled in the art that the mode of translational inhibition illustrated by FIG. 1 with specific reference to translational inhibition exerted by VGAM1453 gene, herein designated VGAM GENE, on one or more VGAM1453 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1453 is inhibition of expression of host target genes, as part of a novel viral mechanism of attacking a host. Accordingly, utilities of VGAM1453 include diagnosis, prevention and treatment of viral infection by Equine Herpesvirus 2. Specific functions, and accordingly utilities, of VGAM1453 correlate with, and may be deduced from, the identity of the host target genes which VGAM1453 binds and inhibits, and the function of these host target genes, as elaborated hereinbelow.

Nucleotide sequences of the VGAM1453 precursor RNA, herein designated VGAM PRECURSOR RNA, and of the 'diced' VGAM1453 RNA, herein designated VGAM RNA, and a schematic representation of the secondary folding of VGAM1453 folded precursor RNA, herein designated VGAM FOLDED PRECURSOR RNA, of VGAM1453 are further described hereinbelow with reference to Table 1.

Nucleotide sequences of host target binding sites, such as BINDING SITE-I, BINDING SITE-II and BINDING SITE-III of FIG. 1, found on VGAM1453 host target RNA, and schematic representation of the complementarity of each of these host target binding sites to VGAM1453 RNA, herein designated VGAM RNA, are described hereinbelow with reference to Table 2.

As mentioned hereinabove with reference to FIG. 1, a function of VGAM1453 gene, herein designated VGAM is inhibition of expression of VGAM1453 target genes. It is appreciated that specific functions, and accordingly utilities, of VGAM1453 correlate with, and may be deduced from, the identity of the target genes which VGAM1453 binds and inhibits, and the function of these target genes, as elaborated hereinbelow.

CERD4 (Accession NM_012074) is a VGAM1453 host target gene. CERD4 BINDING SITE is HOST TARGET binding site found in the 3' untranslated region of mRNA encoded by CERD4, corresponding to a HOST TARGET binding site such as BINDING SITE I, BINDING SITE II or BINDING SITE III. Table 2 illustrates the complementarity of the nucleotide sequences of CERD4 BINDING SITE, designated SEQ ID:14341, to the nucleotide sequence of VGAM1453 RNA, herein designated VGAM RNA, also designated SEQ ID:4164.

A function of VGAM1453 is therefore inhibition of CERD4 (Accession NM_012074). Accordingly, utilities of VGAM1453 include diagnosis, prevention and treatment of diseases and clinical conditions associated with CERD4. Chorea Acanthocytosis (CHAC, Accession NM_033305) is another VGAM1453 host target gene. CHAC BINDING SITE is HOST TARGET binding site found in the 3' untranslated region of mRNA encoded by CHAC, corresponding to a HOST TARGET binding site such as BINDING SITE I, BINDING SITE II or BINDING SITE III. Table 2 illustrates the complementarity of the nucleotide sequences of CHAC BINDING SITE, designated SEQ ID:27139, to the nucleotide sequence of VGAM1453 RNA, herein designated VGAM RNA, also designated SEQ ID:4164.

Another function of VGAM1453 is therefore inhibition of Chorea Acanthocytosis (CHAC, Accession NM_033305), a gene which may regulate the cycling of proteins. Accordingly, utilities of VGAM1453 include diagnosis, prevention and treatment of diseases and clinical conditions associated with CHAC. The function of CHAC and its association with various diseases and clinical conditions, has been established by previous studies, as described hereinabove with reference to VGAM650. Corticotropin Releasing Hormone (CRH, Accession NM_000756) is another VGAM1453 host target gene. CRH BINDING SITE is HOST TARGET binding site found in the 5' untranslated region of mRNA encoded by CRH, corresponding to a HOST TARGET binding site such as BINDING SITE I, BINDING SITE II or BINDING SITE III. Table 2 illustrates the complementarity of the nucleotide sequences of CRH BINDING SITE, designated SEQ ID:6409, to the nucleotide sequence of VGAM1453 RNA, herein designated VGAM RNA, also designated SEQ ID:4164.

Another function of VGAM1453 is therefore inhibition of Corticotropin Releasing Hormone (CRH, Accession NM_000756), a gene which regulates the release of corticotropin from pituitary gland. Accordingly, utilities of VGAM1453 include diagnosis, prevention and treatment of diseases and clinical conditions associated with CRH. The function of CRH has been established by previous studies. Response to stress in mammals requires an intact hypothalamic-pituitary-adrenal axis. The proximal part of the response is mediated by secretion of corticotropin-releasing hormone (CRH) by the paraventricular nucleus of the hypothalamus. CRH is a 41-amino acid peptide derived by enzymatic cleavage from a 191-amino acid preprohormone. Shibahara et al. (1983) cloned and sequenced the human CRH gene. Arbiser et al. (1988) assigned the gene for CRH to 8q13 by somatic cell hybrid and in situ hybridization studies. The absence of secondary hybridization strongly suggested that hypothalamic and placental CRH are transcribed from the same gene. Kellogg et al. (1989) corroborated the assignment to 8q13 by in situ hybridization. Knapp et al. (1993) showed that the homologous gene is located on mouse chromosome 3 Sebaceous glands may be involved in a pathway conceptually similar to that of the hypothalamic-pituitary-adrenal (HPA) axis. CRH is the most proximal element of the HPA axis, and it acts as a central coordinator for neuroendocrine and behavioral responses to stress. To examine the probability of an HPA equivalent pathway in sebaceous glands, Zouboulis et al. (2002) investigated the expression of CRH, CRH-binding protein, CRHBP (OMIM Ref. No. 122559), and CRH receptors (CRHR1, 122561 and CRHR2, 602034) in sebocytes in vitro and their regulation by CRH and several other hormones. CRHR1 was the predominant type, being twice as abundant as CRHR2. CRH was biologically active on human sebocytes; it induced biphasic increase in synthesis of sebaceous lipids, although it did not affect cell viability, cell proliferation, or IL1B (OMIM Ref. No. 147720)-induced IL8 (OMIM Ref. No. 146930) release. Zouboulis et al. (2002) interpreted these and other findings as indicating that CRH may be an autocrine hormone for human sebocytes that exerts homeostatic lipogenic activity, whereas testosterone and growth hormone induced CRH negative feedback. The findings implicated CRH in the clinical development of acne, seborrhea, androgenetic alopecia, skin aging, xerosis, and other skin disorders associated with alterations in lipid formation of sebaceous origin Animal model experiments lend further support to the function of CRH. In adult male rhesus macaques, Habib et al. (2000) evaluated the effects of a lipophilic nonpeptide antagonist to CRH type 1 receptor, antalarmin, on the behavioral, neuroendocrine, and autonomic components of the stress response. After oral administration, significant antalarmin concentrations were detected in the systemic circulation and the cerebrospinal fluid. The monkeys were exposed to an intense social stressor, namely, placement of 2 unfamiliar males in adjacent cages separated only by a transparent Plexiglas screen. Antalarmin significantly inhibited a repertoire of behaviors associated with anxiety and fear, such as body tremors, grimacing, teeth gnashing, urination, and defecation. In contrast, antalarmin increased exploratory and sexual behaviors that are normally suppressed during stress. Moreover, antalarmin significantly diminished the increases in cerebrospinal fluid CRH as well as the pituitary-adrenal, sympathetic, and adrenal medullary responses to stress. Habib et al. (2000) suggested that a CRH type 1 receptor antagonist may be of therapeutic value in human psychiatric, reproductive, and cardiovascular disorders associated with CRH system hyperactivity.

It is appreciated that the abovementioned animal model for CRH is acknowledged by those skilled in the art as a scientifically valid animal model, as can be further appreciated from the publications sited hereinbelow.

Full details of the abovementioned studies are described in the following publications, the disclosure of which are hereby incorporated by reference:

Knapp, L. T.; Keegan, C. E.; Seasholtz, A. F.; Camper, S. A.: Corticotropin-releasing hormone (Crh) maps to mouse chromosome 3. Mammalian Genome 4:615-617, 1993; and Habib, K. E.; Weld, K. P.; Rice, K. C.; Pushkas, J.; Champoux, M.; Listwak, S.; Webster, E. L.; Atkinson, A. J.; Schulkin, J.; Contoreggi, C.; Chrousos, G. P.; McCann, S. M.; Suomi, S. J.

Further studies establishing the function and utilities of CRH are found in John Hopkins OMIM database record ID 122560, and in sited publications numbered 196 and 2034-1983 listed in the bibliography section hereinbelow, which are also hereby incorporated by reference. Development and Differentiation Enhancing Factor 1 (DDEF1, Accession XM_005169) is another VGAM1453 host target gene. DDEF1 BINDING SITE is HOST TARGET binding site found in the 3' untranslated region of mRNA encoded by DDEF1, corresponding to a HOST TARGET binding site such as BINDING SITE I, BINDING SITE II or BINDING SITE III. Table 2 illustrates the complementarity of the nucleotide sequences of DDEF1 BINDING SITE, designated SEQ ID:29963, to the nucleotide sequence of VGAM1453 RNA, herein designated VGAM RNA, also designated SEQ ID:4164.

Another function of VGAM1453 is therefore inhibition of Development and Differentiation Enhancing Factor 1 (DDEF1, Accession XM_005169). Accordingly, utilities of VGAM1453 include diagnosis, prevention and treatment of diseases and clinical conditions associated with DDEF1. Deoxyribonuclease II, Lysosomal (DNASE2, Accession NM_001375) is another VGAM1453 host target gene. DNASE2 BINDING SITE is HOST TARGET binding site found in the 3' untranslated region of mRNA encoded by DNASE2, corresponding to a HOST TARGET binding site such as BINDING SITE I, BINDING SITE II or BINDING SITE III. Table 2 illustrates the complementarity of the nucleotide sequences of DNASE2 BINDING SITE, designated SEQ ID:7048, to the nucleotide sequence of VGAM1453 RNA, herein designated VGAM RNA, also designated SEQ ID:4164.

Another function of VGAM1453 is therefore inhibition of Deoxyribonuclease II, Lysosomal (DNASE2, Accession NM_001375), a gene which has a possible role in apoptosis. Accordingly, utilities of VGAM1453 include diagnosis, prevention and treatment of diseases and clinical conditions associated with DNASE2. The function of DNASE2 and its association with various diseases and clinical conditions, has been established by previous studies, as described hereinabove with reference to VGAM885. Solute Carrier Family 9 (sodium/hydrogen exchanger), Isoform 5 (SLC9A5, Accession XM_007868) is another VGAM1453 host target gene. SLC9A5 BINDING SITE is HOST TARGET binding site found in the 3' untranslated region of mRNA encoded by SLC9A5, corresponding to a HOST TARGET binding site such as BINDING SITE I, BINDING SITE II or BINDING SITE III. Table 2 illustrates the complementarity of the nucleotide sequences of SLC9A5 BINDING SITE, designated SEQ ID:30062, to the nucleotide sequence of VGAM1453 RNA, herein designated VGAM RNA, also designated SEQ ID:4164.

Another function of VGAM1453 is therefore inhibition of Solute Carrier Family 9 (sodium/hydrogen exchanger), Isoform 5 (SLC9A5, Accession XM_007868). Accordingly, utilities of VGAM1453 include diagnosis, prevention and treatment of diseases and clinical conditions associated with SLC9A5. Von Hippel-Lindau Syndrome (VHL, Accession NM_000551) is another VGAM1453 host target gene. VHL BINDING SITE is HOST TARGET binding site found in the 3' untranslated region of mRNA encoded by VHL, corresponding to a HOST TARGET binding site such as BINDING SITE I, BINDING SITE II or BINDING SITE III. Table 2 illustrates the complementarity of the nucleotide sequences of VHL BINDING SITE, designated SEQ ID:6159, to the nucleotide sequence of VGAM1453 RNA, herein designated VGAM RNA, also designated SEQ ID:4164.

Another function of VGAM1453 is therefore inhibition of Von Hippel-Lindau Syndrome (VHL, Accession NM_000551), a gene which may control rna stability through the selective degradation of rna-bound proteins. Accordingly, utilities of VGAM1453 include diagnosis, prevention and treatment of diseases and clinical conditions associated with VHL. The function of VHL and its association with various diseases and clinical conditions, has been established by previous studies, as described hereinabove with reference to VGAM197. ADP-ribosylation Factor GTPase Activating Protein 1 (ARFGAP1, Accession NM_018209) is another VGAM1453 host target gene. ARFGAP1 BINDING SITE is HOST TARGET binding site found in the 3' untranslated region of mRNA encoded by ARFGAP1, corresponding to a HOST TARGET binding site such as BINDING SITE I, BINDING SITE II or BINDING SITE III. Table 2 illustrates the complementarity of the nucleotide sequences of ARFGAP1 BINDING SITE, designated SEQ ID:20107, to the nucleotide sequence of VGAM1453 RNA, herein designated VGAM RNA, also designated SEQ ID:4164.

Another function of VGAM1453 is therefore inhibition of ADP-ribosylation Factor GTPase Activating Protein 1 (ARFGAP1, Accession NM_018209). Accordingly, utilities of VGAM1453 include diagnosis, prevention and treatment of diseases and clinical conditions associated with ARFGAP1. Cyclin M2 (CNNM2, Accession NM_017649) is another VGAM1453 host target gene. CNNM2 BINDING SITE is HOST TARGET binding site found in the 3' untranslated region of mRNA encoded by CNNM2, corresponding to a HOST TARGET binding site such as BINDING SITE I, BINDING SITE II or BINDING SITE III. Table 2 illustrates the complementarity of the nucleotide sequences of CNNM2 BINDING SITE, designated SEQ ID:19153, to the nucleotide sequence of VGAM1453 RNA, herein designated VGAM RNA, also designated SEQ ID:4164.

Another function of VGAM1453 is therefore inhibition of Cyclin M2 (CNNM2, Accession NM_017649). Accordingly, utilities of VGAM1453 include diagnosis, prevention and treatment of diseases and clinical conditions associated with CNNM2. DKFZp547D155 (Accession XM_046977) is another VGAM1453 host target gene. DKFZp547D155 BINDING SITE is HOST TARGET binding site found in the 3' untranslated region of mRNA encoded by DKFZp547D155, corresponding to a HOST TARGET binding site such as BINDING SITE I, BINDING SITE II or BINDING SITE III. Table 2 illustrates the complementarity of the nucleotide sequences of DKFZp547D155 BINDING SITE, designated SEQ ID:34868, to the nucleotide sequence of VGAM1453 RNA, herein designated VGAM RNA, also designated SEQ ID:4164.

Another function of VGAM1453 is therefore inhibition of DKFZp547D155 (Accession XM_046977). Accordingly, utilities of VGAM1453 include diagnosis, prevention and treatment of diseases and clinical conditions associated with DKFZp547D155. DKFZP564B1023 (Accession NM_031306) is another VGAM1453 host target gene. DKFZP564B1023 BINDING SITE is HOST TARGET binding site found in the 3' untranslated region of mRNA encoded by DKFZP564B1023, corresponding to a HOST TARGET binding site such as BINDING SITE I, BINDING SITE II or BINDING SITE III. Table 2 illustrates the complementarity of the nucleotide sequences of DKFZP564B1023 BINDING SITE, designated SEQ ID:25341, to the nucleotide sequence of VGAM1453 RNA, herein designated VGAM RNA, also designated SEQ ID:4164.

Another function of VGAM1453 is therefore inhibition of DKFZP564B1023 (Accession NM_031306). Accordingly, utilities of VGAM1453 include diagnosis, prevention and treatment of diseases and clinical conditions associated with DKFZP564B1023. FLJ12428 (Accession NM_022783) is another VGAM1453 host target gene. FLJ12428 BINDING SITE is HOST TARGET binding site found in the 3' untranslated region of mRNA encoded by FLJ12428, corresponding to a HOST TARGET binding site such as BINDING SITE I, BINDING SITE II or BINDING SITE III. Table 2 illustrates the complementarity of the nucleotide sequences of FLJ12428 BINDING SITE, designated SEQ ID:23066, to the nucleotide sequence of VGAM1453 RNA, herein designated VGAM RNA, also designated SEQ ID:4164.

Another function of VGAM1453 is therefore inhibition of FLJ12428 (Accession NM_022783). Accordingly, utilities of VGAM1453 include diagnosis, prevention and treatment of diseases and clinical conditions associated with FLJ12428. FLJ20694 (Accession NM_017928) is another VGAM1453 host target gene. FLJ20694 BINDING SITE is HOST TARGET binding site found in the 3' untranslated region of mRNA encoded by FLJ20694, corresponding to a HOST TARGET binding site such as BINDING SITE I, BINDING SITE II or BINDING SITE III. Table 2 illustrates the complementarity of the nucleotide sequences of FLJ20694 BINDING SITE, designated SEQ ID:19607, to the nucleotide sequence of VGAM1453 RNA, herein designated VGAM RNA, also designated SEQ ID:4164.

Another function of VGAM1453 is therefore inhibition of FLJ20694 (Accession NM_017928). Accordingly, utilities of VGAM1453 include diagnosis, prevention and treatment of diseases and clinical conditions associated with FLJ20694. FLJ22693 (Accession NM_022750) is another VGAM1453 host target gene. FLJ22693 BINDING SITE is HOST TARGET binding site found in the 5' untranslated region of mRNA encoded by FLJ22693, corresponding to a HOST TARGET binding site such as BINDING SITE I, BINDING SITE II or BINDING SITE III. Table 2 illustrates the complementarity of the nucleotide sequences of FLJ22693 BINDING SITE, designated SEQ ID:22974, to the nucleotide sequence of VGAM1453 RNA, herein designated VGAM RNA, also designated SEQ ID:4164.

Another function of VGAM1453 is therefore inhibition of FLJ22693 (Accession NM_022750). Accordingly, utilities of VGAM1453 include diagnosis, prevention and treatment of diseases and clinical conditions associated with FLJ22693. KIAA0972 (Accession NM_014930) is another VGAM1453 host target gene. KIAA0972 BINDING SITE is HOST TARGET binding site found in the 5' untranslated region of mRNA encoded by KIAA0972, corresponding to a HOST TARGET binding site such as BINDING SITE I, BINDING SITE II or BINDING SITE III. Table 2 illustrates the complementarity of the nucleotide sequences of KIAA0972 BINDING SITE, designated SEQ ID:17226, to the nucleotide sequence of VGAM1453 RNA, herein designated VGAM RNA, also designated SEQ ID:4164.

Another function of VGAM1453 is therefore inhibition of KIAA0972 (Accession NM_014930). Accordingly, utilities of VGAM1453 include diagnosis, prevention and treatment of diseases and clinical conditions associated with KIAA0972. KIAA1056 (Accession NM_014894) is another VGAM1453 host target gene. KIAA1056 BINDING SITE is HOST TARGET binding site found in the 3' untranslated region of mRNA encoded by KIAA1056, corresponding to a HOST TARGET binding site such as BINDING SITE I, BINDING SITE II or BINDING SITE III. Table 2 illustrates the complementarity of the nucleotide sequences of KIAA1056 BINDING SITE, designated SEQ ID:17047, to the nucleotide sequence of VGAM1453 RNA, herein designated VGAM RNA, also designated SEQ ID:4164.

Another function of VGAM1453 is therefore inhibition of KIAA1056 (Accession NM_014894). Accordingly, utilities of VGAM1453 include diagnosis, prevention and treatment of diseases and clinical conditions associated with KIAA1056. KIAA1871 (Accession XM_028409) is another VGAM1453 host target gene. KIAA1871 BINDING SITE is HOST TARGET binding site found in the 3' untranslated region of mRNA encoded by KIAA1871, corresponding to a HOST TARGET binding site such as BINDING SITE I, BINDING SITE II or BINDING SITE III. Table 2 illustrates the complementarity of the nucleotide sequences of KIAA1871 BINDING SITE, designated SEQ ID:30704, to the nucleotide sequence of VGAM1453 RNA, herein designated VGAM RNA, also designated SEQ ID:4164.

Another function of VGAM1453 is therefore inhibition of KIAA1871 (Accession XM_028409). Accordingly, utilities of VGAM1453 include diagnosis, prevention and treatment of diseases and clinical conditions associated with KIAA1871. MAN1 (Accession NM_014319) is another VGAM1453 host target gene. MAN1 BINDING SITE is HOST TARGET binding site found in the 3' untranslated region of mRNA encoded by MAN1, corresponding to a HOST TARGET binding site such as BINDING SITE I, BINDING SITE II or BINDING SITE III. Table 2 illustrates the complementarity of the nucleotide sequences of MAN1 BINDING SITE, designated SEQ ID:15616, to the nucleotide sequence of VGAM1453 RNA, herein designated VGAM RNA, also designated SEQ ID:4164.

Another function of VGAM1453 is therefore inhibition of MAN1 (Accession NM_014319). Accordingly, utilities of VGAM1453 include diagnosis, prevention and treatment of diseases and clinical conditions associated with MAN1. Mitochondrial Ribosomal Protein S18B (MRPS18B, Accession NM_014046) is another VGAM1453 host target gene. MRPS18B BINDING SITE is HOST TARGET binding site found in the 3' untranslated region of mRNA encoded by MRPS18B, corresponding to a HOST TARGET binding site such as BINDING SITE I, BINDING SITE II or BINDING SITE III. Table 2 illustrates the complementarity of the nucleotide sequences of MRPS18B BINDING SITE, designated SEQ ID:15274, to the nucleotide sequence of VGAM1453 RNA, herein designated VGAM RNA, also designated SEQ ID:4164.

Another function of VGAM1453 is therefore inhibition of Mitochondrial Ribosomal Protein S18B (MRPS18B, Accession NM_014046). Accordingly, utilities of VGAM1453 include diagnosis, prevention and treatment of diseases and clinical conditions associated with MRPS18B. ZAK (Accession NM_133646) is another VGAM1453 host target gene. ZAK BINDING SITE is HOST TARGET binding site found in the 3' untranslated region of mRNA encoded by ZAK, corresponding to a HOST TARGET binding site such as BINDING SITE I, BINDING SITE II or BINDING SITE III. Table 2 illustrates the complementarity of the nucleotide sequences of ZAK BINDING SITE, designated SEQ ID:28605, to the nucleotide sequence of VGAM1453 RNA, herein designated VGAM RNA, also designated SEQ ID:4164.

Another function of VGAM1453 is therefore inhibition of ZAK (Accession NM_133646). Accordingly, utilities of VGAM1453 include diagnosis, prevention and treatment of diseases and clinical conditions associated with ZAK. LOC142779 (Accession XM_084337) is another VGAM1453 host target gene. LOC142779 BINDING SITE is HOST TARGET binding site found in the 3' untranslated region of mRNA encoded by LOC142779, corresponding to a HOST TARGET binding site such as BINDING SITE I, BINDING SITE II or BINDING SITE III. Table 2 illustrates the complementarity of the nucleotide sequences of LOC142779 BINDING SITE, designated SEQ ID:37559, to the nucleotide sequence of VGAM1453 RNA, herein designated VGAM RNA, also designated SEQ ID:4164.

Another function of VGAM1453 is therefore inhibition of LOC142779 (Accession XM_084337). Accordingly, utilities of VGAM1453 include diagnosis, prevention and treatment of diseases and clinical conditions associated with LOC142779. LOC143381 (Accession XM_084501) is another VGAM1453 host target gene. LOC143381 BINDING SITE is HOST TARGET binding site found in the 3' untranslated region of mRNA encoded by LOC143381, corresponding to a HOST TARGET binding site such as BINDING SITE I, BINDING SITE II or BINDING SITE III. Table 2 illustrates the complementarity of the nucleotide sequences of LOC143381 BINDING SITE, designated SEQ ID:37613, to the nucleotide sequence of VGAM1453 RNA, herein designated VGAM RNA, also designated SEQ ID:4164.

Another function of VGAM1453 is therefore inhibition of LOC143381 (Accession XM_084501). Accordingly, utilities of VGAM1453 include diagnosis, prevention and treatment of diseases and clinical conditions associated with LOC143381. LOC148823 (Accession NM_145278) is another VGAM1453 host target gene. LOC148823 BINDING SITE is HOST TARGET binding site found in the 3' untranslated region of mRNA encoded by LOC148823, corresponding to a HOST TARGET binding site such as BINDING SITE I, BINDING SITE II or BINDING SITE III. Table 2 illustrates the complementarity of the nucleotide sequences of LOC148823 BINDING SITE, designated SEQ ID:29793, to the nucleotide sequence of VGAM1453 RNA, herein designated VGAM RNA, also designated SEQ ID:4164.

Another function of VGAM1453 is therefore inhibition of LOC148823 (Accession NM_145278). Accordingly, utilities of VGAM1453 include diagnosis, prevention and treatment of diseases and clinical conditions associated with LOC148823. LOC159036 (Accession XM_099018) is another VGAM1453 host target gene. LOC159036 BINDING SITE is HOST TARGET binding site found in the 3' untranslated region of mRNA encoded by LOC159036, corresponding to a HOST TARGET binding site such as BINDING SITE I, BINDING SITE II or BINDING SITE III. Table 2 illustrates the complementarity of the nucleotide sequences of LOC159036 BINDING SITE, designated SEQ ID:42052, to the nucleotide sequence of VGAM1453 RNA, herein designated VGAM RNA, also designated SEQ ID:4164.

Another function of VGAM1453 is therefore inhibition of LOC159036 (Accession XM_099018). Accordingly, utilities of VGAM1453 include diagnosis, prevention and treatment of diseases and clinical conditions associated with LOC159036. LOC161823 (Accession XM_091156) is another VGAM1453 host target gene. LOC161823 BINDING SITE is HOST TARGET binding site found in the 3' untranslated region of mRNA encoded by LOC161823, corresponding to a HOST TARGET binding site such as BINDING SITE I, BINDING SITE II or BINDING SITE III. Table 2 illustrates the complementarity of the nucleotide sequences of LOC161823 BINDING SITE, designated SEQ ID:40033, to the nucleotide sequence of VGAM1453 RNA, herein designated VGAM RNA, also designated SEQ ID:4164.

Another function of VGAM1453 is therefore inhibition of LOC161823 (Accession XM_091156). Accordingly, utilities of VGAM1453 include diagnosis, prevention and treatment of diseases and clinical conditions associated with LOC161823. LOC203350 (Accession XM_117536) is another VGAM1453 host target gene. LOC203350 BINDING SITE is HOST TARGET binding site found in the 3' untranslated region of mRNA encoded by LOC203350, corresponding to a HOST TARGET binding site such as BINDING SITE I, BINDING SITE II or BINDING SITE III. Table 2 illustrates the complementarity of the nucleotide sequences of LOC203350 BINDING SITE, designated SEQ ID:43532, to the nucleotide sequence of VGAM1453 RNA, herein designated VGAM RNA, also designated SEQ ID:4164.

Another function of VGAM1453 is therefore inhibition of LOC203350 (Accession XM_117536). Accordingly, utilities of VGAM1453 include diagnosis, prevention and treatment of diseases and clinical conditions associated with LOC203350. LOC257464 (Accession XM_116972) is another VGAM1453 host target gene. LOC257464 BINDING SITE is HOST TARGET binding site found in the 3' untranslated region of mRNA encoded by LOC257464, corresponding to a HOST TARGET binding site such as BINDING SITE I, BINDING SITE II or BINDING SITE III. Table 2 illustrates the complementarity of the nucleotide sequences of LOC257464 BINDING SITE, designated SEQ ID:43165, to the nucleotide sequence of VGAM1453 RNA, herein designated VGAM RNA, also designated SEQ ID:4164.

Another function of VGAM1453 is therefore inhibition of LOC257464 (Accession XM_116972). Accordingly, utilities of VGAM1453 include diagnosis, prevention and treatment of diseases and clinical conditions associated with LOC257464. LOC257482 (Accession XM_168544) is another VGAM1453 host target gene. LOC257482 BINDING SITE is HOST TARGET binding site found in the 3' untranslated region of mRNA encoded by LOC257482, corresponding to a HOST TARGET binding site such as BINDING SITE I, BINDING SITE II or BINDING SITE III. Table 2 illustrates the complementarity of the nucleotide sequences of LOC257482 BINDING SITE, designated SEQ ID:45235, to the nucleotide sequence of VGAM1453 RNA, herein designated VGAM RNA, also designated SEQ ID:4164.

Another function of VGAM1453 is therefore inhibition of LOC257482 (Accession XM_168544). Accordingly, utilities of VGAM1453 include diagnosis, prevention and treatment of diseases and clinical conditions associated with LOC257482. LOC90288 (Accession XM_030669) is another VGAM1453 host target gene. LOC90288 BINDING SITE is HOST TARGET binding site found in the 3' untranslated region of mRNA encoded by LOC90288, corresponding to a HOST TARGET binding site such as BINDING SITE I, BINDING SITE II or BINDING SITE III. Table 2 illustrates the complementarity of the nucleotide sequences of LOC90288 BINDING SITE, designated SEQ ID:31113, to the nucleotide sequence of VGAM1453 RNA, herein designated VGAM RNA, also designated SEQ ID:4164.

Another function of VGAM1453 is therefore inhibition of LOC90288 (Accession XM_030669). Accordingly, utilities of VGAM1453 include diagnosis, prevention and treatment of diseases and clinical conditions associated with LOC90288. LOC92228 (Accession XM_043731) is another VGAM1453 host target gene. LOC92228 BINDING SITE is HOST TARGET binding site found in the 3' untranslated region of mRNA encoded by LOC92228, corresponding to a HOST TARGET binding site such as BINDING SITE I, BINDING SITE II or BINDING SITE III. Table 2 illustrates the complementarity of the nucleotide sequences of LOC92228 BINDING SITE, designated SEQ ID:34003, to the nucleotide sequence of VGAM1453 RNA, herein designated VGAM RNA, also designated SEQ ID:4164.

Another function of VGAM1453 is therefore inhibition of LOC92228 (Accession XM_043731). Accordingly, utilities of VGAM1453 include diagnosis, prevention and treatment of diseases and clinical conditions associated with LOC92228. FIG. 1 further provides a conceptual description of a novel bioinformatically detected viral gene of the present invention, referred to here as Viral Genomic Address Messenger 1454 (VGAM1454) viral gene, which modulates expression of respective host target genes thereof, the function and utility of which host target genes is known in the art.

VGAM1454 is a novel bioinformatically detected regulatory, non protein coding, viral micro RNA (miRNA) gene. The method by which VGAM1454 was detected is described hereinabove with reference to FIGS. 1-8.

VGAM1454 gene, herein designated VGAM GENE, is a viral gene contained in the genome of Equine Herpesvirus 2. VGAM1454 host target gene, herein designated VGAM HOST TARGET GENE, is a human gene contained in the human genome.

VGAM1454 gene encodes a VGAM1454 precursor RNA, herein designated VGAM PRECURSOR RNA. Similar to other miRNA genes, and unlike most ordinary genes, VGAM1454 precursor RNA does not encode a protein. A nucleotide sequence identical or highly similar to the nucleotide sequence of VGAM1454 precursor RNA is designated SEQ ID:1440, and is provided hereinbelow with reference to the sequence listing part. Nucleotide sequence SEQ ID:1440 is located at position 41662 relative to the genome of Equine Herpesvirus 2.

VGAM1454 precursor RNA folds onto itself, forming VGAM1454 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1454 folded precursor RNA into VGAM1454 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM1454 RNA is designated SEQ ID:4165, and is provided hereinbelow with reference to the sequence listing part.

VGAM1454 host target gene, herein designated VGAM HOST TARGET GENE, encodes a corresponding messenger RNA, VGAM1454 host target RNA, herein designated VGAM HOST TARGET RNA. VGAM1454 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1454 RNA, herein designated VGAM RNA, binds complementarily to one or more host target binding sites located in untranslated regions of VGAM1454 host target RNA, herein designated VGAM HOST TARGET RNA. This complementary binding is due to the fact that the nucleotide sequence of VGAM1454 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1454 RNA, herein designated VGAM RNA, may have a different number of host target binding sites in untranslated regions of a VGAM1454 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1454 RNA, herein designated VGAM RNA, to host target binding sites on VGAM1454 host target RNA, herein designated VGAM HOST TARGET RNA, such as BINDING SITE I, BINDING SITE II and BINDING SITE III, inhibits translation of VGAM1454 host target RNA into VGAM1454 host target protein, herein designated VGAM HOST TARGET PROTEIN. VGAM host target protein is therefore outlined by a broken line.

It is appreciated that VGAM1454 host target gene, herein designated VGAM HOST TARGET GENE, in fact represents a plurality of VGAM1454 host target genes. The mRNA of each one of this plurality of VGAM1454 host target genes comprises one or more host target binding sites, each having a nucleotide sequence which is at least partly complementary to VGAM1454 RNA, herein designated VGAM RNA, and which when bound by VGAM1454 RNA causes inhibition of translation of respective one or more VGAM1454 host target proteins.

It is further appreciated by one skilled in the art that the mode of translational inhibition illustrated by FIG. 1 with specific reference to translational inhibition exerted by VGAM1454 gene, herein designated VGAM GENE, on one or more VGAM1454 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1454 is inhibition of expression of host target genes, as part of a novel viral mechanism of attacking a host. Accordingly, utilities of VGAM1454 include diagnosis, prevention and treatment of viral infection by Equine Herpesvirus 2. Specific functions, and accordingly utilities, of VGAM1454 correlate with, and may be deduced from, the identity of the host target genes which VGAM1454 binds and inhibits, and the function of these host target genes, as elaborated hereinbelow.

Nucleotide sequences of the VGAM1454 precursor RNA, herein designated VGAM PRECURSOR RNA, and of the 'diced' VGAM1454 RNA, herein designated VGAM RNA, and a schematic representation of the secondary folding of VGAM1454 folded precursor RNA, herein designated VGAM FOLDED PRECURSOR RNA, of VGAM1454 are further described hereinbelow with reference to Table 1.

Nucleotide sequences of host target binding sites, such as BINDING SITE-I, BINDING SITE-II and BINDING SITE-III of FIG. 1, found on VGAM1454 host target RNA, and schematic representation of the complementarity of each of these host target binding sites to VGAM1454 RNA, herein designated VGAM RNA, are described hereinbelow with reference to Table 2.

As mentioned hereinabove with reference to FIG. 1, a function of VGAM1454 gene, herein designated VGAM is inhibition of expression of VGAM1454 target genes. It is appreciated that specific functions, and accordingly utilities, of VGAM1454 correlate with, and may be deduced from, the identity of the target genes which VGAM1454 binds and inhibits, and the function of these target genes, as elaborated hereinbelow.

CD244 (Accession NM_016382) is a VGAM1454 host target gene. CD244 BINDING SITE is HOST TARGET binding site found in the 3' untranslated region of mRNA encoded by CD244, corresponding to a HOST TARGET binding site such as BINDING SITE I, BINDING SITE II or BINDING SITE III. Table 2 illustrates the complementarity of the nucleotide sequences of CD244 BINDING SITE, designated SEQ ID:18524, to the nucleotide sequence of VGAM1454 RNA, herein designated VGAM RNA, also designated SEQ ID:4165.

A function of VGAM1454 is therefore inhibition of CD244 (Accession NM_016382), a gene which can interfere with a step as proximal as phosphorylation of an activation receptor. Accordingly, utilities of VGAM1454 include diagnosis, prevention and treatment of diseases and clinical conditions associated with CD244. The function of CD244 and its association with various diseases and clinical conditions, has been established by previous studies, as described hereinabove with reference to VGAM1224. Heparan Sulfate (glucosamine) 3-O-sulfotransferase 3A1 (HS3ST3A1, Accession NM_006042) is another VGAM1454 host target gene. HS3ST3A1 BINDING SITE is HOST TARGET binding site found in the 5' untranslated region of mRNA encoded by HS3ST3A1, corresponding to a HOST TARGET binding site such as BINDING SITE I, BINDING SITE II or BINDING SITE III. Table 2 illustrates the complementarity of the nucleotide sequences of HS3ST3A1 BINDING SITE, designated SEQ ID:12679, to the nucleotide sequence of VGAM1454 RNA, herein designated VGAM RNA, also designated SEQ ID:4165.

Another function of VGAM1454 is therefore inhibition of Heparan Sulfate (glucosamine) 3-O-sulfotransferase 3A1 (HS3ST3A1, Accession NM_006042), a gene which plays a role in the generation of heparan sulfate proteoglycan. Accordingly, utilities of VGAM1454 include diagnosis, prevention and treatment of diseases and clinical conditions associated with HS3ST3A1. The function of HS3ST3A1 has been established by previous studies. Heparan sulfate biosynthetic enzymes are key components in generating a myriad of distinct heparan sulfate fine structures that carry out multiple biologic activities. The heparan sulfate D-glucosaminyl 3-O-sulfotransferases (3OSTs) place the rare 3-O-sulfate group in various sequence contexts. See 3OST2 (OMIM Ref. No. 604056). Shworak et al. (1999) isolated cDNAs encoding 3OST2, 3OST3A1, 3OST3B1 (OMIM Ref. No. 604058), and 3OST4 (OMIM Ref. No. 604059). Like 3OST2 and 3OST3B1, the predicted 406-amino acid 3OST3A1 protein is a predicted type II integral membrane protein. Although the 3OST2 and 3OST3 enzymes have a similar regional organization, the only region of significant sequence homology occurs in the sulfotransferase domains. On the DNA level, the coding regions for the 3OST3A1 and 3OST3B1 sulfotransferase domains are nearly identical, and they share approximately 72% identity with those of 3OST2 and 3OST4. Southern blot analysis revealed that the human genome contains 2 copies of the 3OST3A and 3OST3B genes. The authors stated that they were unable to assess the functionality of the duplicate genes, which they named 3OST3A2 and 3OST3B2. Northern blot analysis revealed that the 3OST3A gene was widely expressed as multiple transcripts, with the most abundant expression in heart and placenta. In a companion paper, Liu et al. (1999) demonstrated that while the 3OST1, 3OST2, and 3OST3 isoforms each generate unique 3-O-sulfated structures, the 3OST3A and 3OST3B isoforms sulfate an identical disaccharide. Shworak et al. (1999) concluded that the 3OST multigene family encodes key enzymes that regulate the production of many distinct heparan sulfate fine structures. By inclusion within mapped clones, Shworak et al. (1999) mapped the 3OST3A1 and 3OST3B1 genes to 17p12-p11.2. Using interspecific backcross analysis, they mapped the mouse 3Ost3A and 3Ost3B genes to chromosome 11. Shworak et al. (1999) stated that the tight linkage between the 2 genes in the mouse genome suggests that they arose by a tandem duplication.

Full details of the abovementioned studies are described in the following publications, the disclosure of which are hereby incorporated by reference:

Liu, J.; Shworak, N. W.; Sinay, P.; Schwartz, J. J.; Zhang, L.; Fritze, L. M.; Rosenberg, R. D.: Expression of heparan sulfate D-glucosaminyl 3-O-sulfotransferase isoforms reveals novel substrate specificities. J. Biol. Chem. 274:5185-5192, 1999; and Shworak, N. W.; Liu, J.; Petros, L. M.; Zhang, L.; Kobayashi, M.; Copeland, N. G.; Jenkins, N. A.; Rosenberg, R. D.: Multiple isoforms of heparan sulfate D-glucosaminyl 3-O-sulfotransfera.

Further studies establishing the function and utilities of HS3ST3A1 are found in John Hopkins OMIM database record ID 604057, and in sited publications numbered 5054-5055 listed in the bibliography section hereinbelow, which are also hereby incorporated by reference. Periaxin (PRX, Accession NM_020956) is another VGAM1454 host target gene. PRX BINDING SITE is HOST TARGET binding site found in the 3' untranslated region of mRNA encoded by PRX, corresponding to a HOST TARGET binding site such as BINDING SITE I, BINDING SITE II or BINDING SITE III. Table 2 illustrates the complementarity of the nucleotide sequences of PRX BINDING SITE, designated SEQ ID:21933, to the nucleotide sequence of VGAM1454 RNA, herein designated VGAM RNA, also designated SEQ ID:4165.

Another function of VGAM1454 is therefore inhibition of Periaxin (PRX, Accession NM_020956), a gene which seems to be required for maintenance of peripheral nerve myelin sheath. may have a role in axon-glial interactions, possibly by interacting with the cytoplasmic domains of integral membrane proteins such as myelin-associated glycoprotein in the periaxonal regions of the schwann cell plasma membrane. may have a role in the early phases of myelin deposition. Accordingly, utilities of VGAM1454 include diagnosis, prevention and treatment of diseases and clinical conditions associated with PRX. The function of PRX and its association with various diseases and clinical conditions, has been established by previous studies, as described hereinabove with reference to VGAM476. RAS, Dexamethasone-induced 1 (RASD1, Accession NM_016084) is another VGAM1454 host target gene. RASD1 BINDING SITE is HOST TARGET binding site found in the 5' untranslated region of mRNA encoded by RASD1, corresponding to a HOST TARGET binding site such as BINDING SITE I, BINDING SITE II or BINDING SITE III. Table 2 illustrates the complementarity of the nucleotide sequences of RASD1 BINDING SITE, designated SEQ ID:18168, to the nucleotide sequence of VGAM1454 RNA, herein designated VGAM RNA, also designated SEQ ID:4165.

Another function of VGAM1454 is therefore inhibition of RAS, Dexamethasone-induced 1 (RASD1, Accession NM_016084), a gene which is a novel physiologic NO effector. Accordingly, utilities of VGAM1454 include diagnosis, prevention and treatment of diseases and clinical conditions associated with RASD1. The function of RASD1 and its association with various diseases and clinical conditions, has been established by previous studies, as described hereinabove with reference to VGAM168. Solute Carrier Family 4, Sodium Bicarbonate Transporter-like, Member 10 (SLC4A10, Accession NM_022058) is another VGAM1454 host target gene. SLC4A10 BINDING SITE is HOST TARGET binding site found in the 3' untranslated region of mRNA encoded by SLC4A10, corresponding to a HOST TARGET binding site such as BINDING SITE I, BINDING SITE II or BINDING SITE III. Table 2 illustrates the complementarity of the nucleotide sequences of SLC4A10 BINDING SITE, designated SEQ ID:22594, to the nucleotide sequence of VGAM1454 RNA, herein designated VGAM RNA, also designated SEQ ID:4165.

Another function of VGAM1454 is therefore inhibition of Solute Carrier Family 4, Sodium Bicarbonate Transporter-like, Member 10 (SLC4A10, Accession NM_022058). Accordingly, utilities of VGAM1454 include diagnosis, prevention and treatment of diseases and clinical conditions associated with SLC4A10. Sphingosine Kinase 2 (SPHK2, Accession NM_020126) is another VGAM1454 host target gene. SPHK2 BINDING SITE is HOST TARGET binding site found in the 3' untranslated region of mRNA encoded by SPHK2, corresponding to a HOST TARGET binding site such as BINDING SITE I, BINDING SITE II or BINDING SITE III. Table 2 illustrates the complementarity of the nucleotide sequences of SPHK2 BINDING SITE, designated SEQ ID:21312, to the nucleotide sequence of VGAM1454 RNA, herein designated VGAM RNA, also designated SEQ ID:4165.

Another function of VGAM1454 is therefore inhibition of Sphingosine Kinase 2 (SPHK2, Accession NM_020126). Accordingly, utilities of VGAM1454 include diagnosis, prevention and treatment of diseases and clinical conditions associated with SPHK2. Transglutaminase 2 (C polypeptide, protein-glutamine-gamma-glutamyltransferase) (TGM2, Accession NM_004613) is another VGAM1454 host target gene. TGM2 BINDING SITE is HOST TARGET binding site found in the 3' untranslated region of mRNA encoded by TGM2, corresponding to a HOST TARGET binding site such as BINDING SITE I, BINDING SITE II or BINDING SITE III. Table 2 illustrates the complementarity of the nucleotide sequences of TGM2 BINDING SITE, designated SEQ ID:10952, to the nucleotide sequence of VGAM1454 RNA, herein designated VGAM RNA, also designated SEQ ID:4165.

Another function of VGAM1454 is therefore inhibition of Transglutaminase 2 (C polypeptide, protein-glutamine-gamma-glutamyltransferase) (TGM2, Accession NM_004613), a gene which catalyzes the cross-linking of proteins and the conjugation of polyamines to proteins. Accordingly, utilities of VGAM1454 include diagnosis, prevention and treatment of diseases and clinical conditions associated with TGM2. The function of TGM2 and its association with various diseases and clinical conditions, has been established by previous studies, as described hereinabove with reference to VGAM899. Zinc Finger Protein 278 (ZNF278, Accession NM_032052) is another VGAM1454 host target gene. ZNF278 BINDING SITE is HOST TARGET binding site found in the 3' untranslated region of mRNA encoded by ZNF278, corresponding to a HOST TARGET binding site such as BINDING SITE I, BINDING SITE II or BINDING SITE III. Table 2 illustrates the complementarity of the nucleotide sequences of ZNF278 BINDING SITE, designated SEQ ID:25783, to the nucleotide sequence of VGAM1454 RNA, herein designated VGAM RNA, also designated SEQ ID:4165.

Another function of VGAM1454 is therefore inhibition of Zinc Finger Protein 278 (ZNF278, Accession NM_032052), a gene which represses basal transcription as well as RNF4-mediated activation. Accordingly, utilities of VGAM1454 include diagnosis, prevention and treatment of diseases and clinical conditions associated with ZNF278. The function of ZNF278 and its association with various diseases and clinical conditions, has been established by previous studies, as described hereinabove with reference to VGAM414. APCL (Accession NM_005883) is another VGAM1454 host target gene. APCL BINDING SITE is HOST TARGET binding site found in the 3' untranslated region of mRNA encoded by APCL, corresponding to a HOST TARGET binding site such as BINDING SITE I, BINDING SITE II or BINDING SITE III. Table 2 illustrates the complementarity of the nucleotide sequences of APCL BINDING SITE, designated SEQ ID:12497, to the nucleotide sequence of VGAM1454 RNA, herein designated VGAM RNA, also designated SEQ ID:4165.

Another function of VGAM1454 is therefore inhibition of APCL (Accession NM_005883). Accordingly, utilities of VGAM1454 include diagnosis, prevention and treatment of diseases and clinical conditions associated with APCL. CGRP-RCP (Accession NM_014478) is another VGAM1454 host target gene. CGRP-RCP BINDING SITE is HOST TARGET binding site found in the 3' untranslated region of mRNA encoded by CGRP-RCP, corresponding to a HOST TARGET binding site such as BINDING SITE I, BINDING SITE II or BINDING SITE III. Table 2 illustrates the complementarity of the nucleotide sequences of CGRP-RCP BINDING SITE, designated SEQ ID:15822, to the nucleotide sequence of VGAM1454 RNA, herein designated VGAM RNA, also designated SEQ ID:4165.

Another function of VGAM1454 is therefore inhibition of CGRP-RCP (Accession NM_014478). Accordingly, utilities of VGAM1454 include diagnosis, prevention and treatment of diseases and clinical conditions associated with CGRP-RCP. DKFZP564M182 (Accession XM_085525) is another VGAM1454 host target gene. DKFZP564M182 BINDING SITE is HOST TARGET binding site found in the 3' untranslated region of mRNA encoded by DKFZP564M182, corresponding to a HOST TARGET binding site such as BINDING SITE I, BINDING SITE II or BINDING SITE III. Table 2 illustrates the complementarity of the nucleotide sequences of DKFZP564M182 BINDING SITE, designated SEQ ID:38218, to the nucleotide sequence of VGAM1454 RNA, herein designated VGAM RNA, also designated SEQ ID:4165.

Another function of VGAM1454 is therefore inhibition of DKFZP564M182 (Accession XM_085525). Accordingly, utilities of VGAM1454 include diagnosis, prevention and treatment of diseases and clinical conditions associated with DKFZP564M182. KIAA1171 (Accession XM_113868) is another VGAM1454 host target gene. KIAA1171 BINDING SITE is HOST TARGET binding site found in the 3' untranslated region of mRNA encoded by KIAA1171, corresponding to a HOST TARGET binding site such as BINDING SITE I, BINDING SITE II or BINDING SITE III. Table 2 illustrates the complementarity of the nucleotide sequences of KIAA1171 BINDING SITE, designated SEQ ID:42482, to the nucleotide sequence of VGAM1454 RNA, herein designated VGAM RNA, also designated SEQ ID:4165.

Another function of VGAM1454 is therefore inhibition of KIAA1171 (Accession XM_113868). Accordingly, utilities of VGAM1454 include diagnosis, prevention and treatment of diseases and clinical conditions associated with KIAA1171. Lipase, Endothelial (LIPG, Accession NM_006033) is another VGAM1454 host target gene. LIPG BINDING SITE is HOST TARGET binding site found in the 3' untranslated region of mRNA encoded by LIPG, corresponding to a HOST TARGET binding site such as BINDING SITE I, BINDING SITE II or BINDING SITE III. Table 2 illustrates the complementarity of the nucleotide sequences of LIPG BINDING SITE, designated SEQ ID:12654, to the nucleotide sequence of VGAM1454 RNA, herein designated VGAM RNA, also designated SEQ ID:4165.

Another function of VGAM1454 is therefore inhibition of Lipase, Endothelial (LIPG, Accession NM_006033). Accordingly, utilities of VGAM1454 include diagnosis, prevention and treatment of diseases and clinical conditions associated with LIPG. MGC10715 (Accession NM_024325) is another VGAM1454 host target gene. MGC10715 BINDING SITE is HOST TARGET binding site found in the 5' untranslated region of mRNA encoded by MGC10715, corresponding to a HOST TARGET binding site such as BINDING SITE I, BINDING SITE II or BINDING SITE III. Table 2 illustrates the complementarity of the nucleotide sequences of MGC10715 BINDING SITE, designated SEQ ID:23615, to the nucleotide sequence of VGAM1454 RNA, herein designated VGAM RNA, also designated SEQ ID:4165.

Another function of VGAM1454 is therefore inhibition of MGC10715 (Accession NM_024325). Accordingly, utilities of VGAM1454 include diagnosis, prevention and treatment of diseases and clinical conditions associated with MGC10715. MGC4504 (Accession NM_024111) is another VGAM1454 host target gene. MGC4504 BINDING SITE is HOST TARGET binding site found in the 3' untranslated region of mRNA encoded by MGC4504, corresponding to a HOST TARGET binding site such as BINDING SITE I, BINDING SITE II or BINDING SITE III. Table 2 illustrates the complementarity of the nucleotide sequences of MGC4504 BINDING SITE, designated SEQ ID:23560, to the nucleotide sequence of VGAM1454 RNA, herein designated VGAM RNA, also designated SEQ ID:4165.

Another function of VGAM1454 is therefore inhibition of MGC4504 (Accession NM_024111). Accordingly, utilities of VGAM1454 include diagnosis, prevention and treatment of diseases and clinical conditions associated with MGC4504. LOC142955 (Accession XM_084389) is another VGAM1454 host target gene. LOC142955 BINDING SITE is HOST TARGET binding site found in the 5' untranslated region of mRNA encoded by LOC142955, corresponding to a HOST TARGET binding site such as BINDING SITE I, BINDING SITE II or BINDING SITE III. Table 2 illustrates the complementarity of the nucleotide sequences of LOC142955 BINDING SITE, designated SEQ ID:37572, to the nucleotide sequence of VGAM1454 RNA, herein designated VGAM RNA, also designated SEQ ID:4165.

Another function of VGAM1454 is therefore inhibition of LOC142955 (Accession XM_084389). Accordingly, utilities of VGAM1454 include diagnosis, prevention and treatment of diseases and clinical conditions associated with LOC142955. LOC165257 (Accession XM_092478) is another VGAM1454 host target gene. LOC165257 BINDING SITE is HOST TARGET binding site found in the 5' untranslated region of mRNA encoded by LOC165257, corresponding to a HOST TARGET binding site such as BINDING SITE I, BINDING SITE II or BINDING SITE III. Table 2 illustrates the complementarity of the nucleotide sequences of LOC165257 BINDING SITE, designated SEQ ID:40128, to the nucleotide sequence of VGAM1454 RNA, herein designated VGAM RNA, also designated SEQ ID:4165.

Another function of VGAM1454 is therefore inhibition of LOC165257 (Accession XM_092478). Accordingly, utilities of VGAM1454 include diagnosis, prevention and treatment of diseases and clinical conditions associated with LOC165257. LOC91266 (Accession XM_037268) is another VGAM1454 host target gene. LOC91266 BINDING SITE is HOST TARGET binding site found in the 5' untranslated region of mRNA encoded by LOC91266, corresponding to a HOST TARGET binding site such as BINDING SITE I, BINDING SITE II or BINDING SITE III. Table 2 illustrates the complementarity of the nucleotide sequences of LOC91266 BINDING SITE, designated SEQ ID:32601, to the nucleotide sequence of VGAM1454 RNA, herein designated VGAM RNA, also designated SEQ ID:4165.

Another function of VGAM1454 is therefore inhibition of LOC91266 (Accession XM_037268). Accordingly, utilities of VGAM1454 include diagnosis, prevention and treatment of diseases and clinical conditions associated with LOC91266. FIG. 1 further provides a conceptual description of a novel bioinformatically detected viral gene of the present invention, referred to here as Viral Genomic Address Messenger 1455 (VGAM1455) viral gene, which modulates expression of respective host target genes thereof, the function and utility of which host target genes is known in the art.

VGAM1455 is a novel bioinformatically detected regulatory, non protein coding, viral micro RNA (miRNA) gene. The method by which VGAM1455 was detected is described hereinabove with reference to FIGS. 1-8.

VGAM1455 gene, herein designated VGAM GENE, is a viral gene contained in the genome of Equine Herpesvirus 2. VGAM1455 host target gene, herein designated VGAM HOST TARGET GENE, is a human gene contained in the human genome.

VGAM1455 gene encodes a VGAM1455 precursor RNA, herein designated VGAM PRECURSOR RNA. Similar to other miRNA genes, and unlike most ordinary genes, VGAM1455 precursor RNA does not encode a protein. A nucleotide sequence identical or highly similar to the nucleotide sequence of VGAM1455 precursor RNA is designated SEQ ID:1441, and is provided hereinbelow with reference to the sequence listing part. Nucleotide sequence SEQ ID:1441 is located at position 42997 relative to the genome of Equine Herpesvirus 2.

VGAM1455 precursor RNA folds onto itself, forming VGAM1455 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1455 folded precursor RNA into VGAM1455 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM1455 RNA is designated SEQ ID:4166, and is provided hereinbelow with reference to the sequence listing part.

VGAM1455 host target gene, herein designated VGAM HOST TARGET GENE, encodes a corresponding messenger RNA, VGAM1455 host target RNA, herein designated VGAM HOST TARGET RNA. VGAM1455 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1455 RNA, herein designated VGAM RNA, binds complementarily to one or more host target binding sites located in untranslated regions of VGAM1455 host target RNA, herein designated VGAM HOST TARGET RNA. This complementary binding is due to the fact that the nucleotide sequence of VGAM1455 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1455 RNA, herein designated VGAM RNA, may have a different number of host target binding sites in untranslated regions of a VGAM1455 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1455 RNA, herein designated VGAM RNA, to host target binding sites on VGAM1455 host target RNA, herein designated VGAM HOST TARGET RNA, such as BINDING SITE I, BINDING SITE II and BINDING SITE III, inhibits translation of VGAM1455 host target RNA into VGAM1455 host target protein, herein designated VGAM HOST TARGET PROTEIN. VGAM host target protein is therefore outlined by a broken line.

It is appreciated that VGAM1455 host target gene, herein designated VGAM HOST TARGET GENE, in fact represents a plurality of VGAM1455 host target genes. The mRNA of each one of this plurality of VGAM1455 host target genes comprises one or more host target binding sites, each having a nucleotide sequence which is at least partly complementary to VGAM1455 RNA, herein designated VGAM RNA, and which when bound by VGAM1455 RNA causes inhibition of translation of respective one or more VGAM1455 host target proteins.

It is further appreciated by one skilled in the art that the mode of translational inhibition illustrated by FIG. 1 with specific reference to translational inhibition exerted by VGAM1455 gene, herein designated VGAM GENE, on one or more VGAM1455 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1455 is inhibition of expression of host target genes, as part of a novel viral mechanism of attacking a host. Accordingly, utilities of VGAM1455 include diagnosis, prevention and treatment of viral infection by Equine Herpesvirus 2. Specific functions, and accordingly utilities, of VGAM1455 correlate with, and may be deduced from, the identity of the host target genes which VGAM1455 binds and inhibits, and the function of these host target genes, as elaborated hereinbelow.

Nucleotide sequences of the VGAM1455 precursor RNA, herein designated VGAM PRECURSOR RNA, and of the 'diced' VGAM1455 RNA, herein designated VGAM RNA, and a schematic representation of the secondary folding of VGAM1455 folded precursor RNA, herein designated VGAM FOLDED PRECURSOR RNA, of VGAM1455 are further described hereinbelow with reference to Table 1.

Nucleotide sequences of host target binding sites, such as BINDING SITE-I, BINDING SITE-II and BINDING SITE-III of FIG. 1, found on VGAM1455 host target RNA, and schematic representation of the complementarity of each of these host target binding sites to VGAM1455 RNA, herein designated VGAM RNA, are described hereinbelow with reference to Table 2.

As mentioned hereinabove with reference to FIG. 1, a function of VGAM1455 gene, herein designated VGAM is inhibition of expression of VGAM1455 target genes. It is appreciated that specific functions, and accordingly utilities, of VGAM1455 correlate with, and may be deduced from, the identity of the target genes which VGAM1455 binds and inhibits, and the function of these target genes, as elaborated hereinbelow.

Vitamin D (1,25- dihydroxyvitamin D3) Receptor (VDR, Accession NM_000376) is a VGAM1455 host target gene. VDR BINDING SITE is HOST TARGET binding site found in the 3' untranslated region of mRNA encoded by VDR, corresponding to a HOST TARGET binding site such as BINDING SITE I, BINDING SITE II or BINDING SITE III. Table 2 illustrates the complementarity of the nucleotide sequences of VDR BINDING SITE, designated SEQ ID:5946, to the nucleotide sequence of VGAM1455 RNA, herein designated VGAM RNA, also designated SEQ ID:4166.

A function of VGAM1455 is therefore inhibition of Vitamin D (1,25- dihydroxyvitamin D3) Receptor (VDR, Accession NM_000376). Accordingly, utilities of VGAM1455 include diagnosis, prevention and treatment of diseases and clinical conditions associated with VDR. FLJ20281 (Accession XM_165663) is another VGAM1455 host target gene. FLJ20281 BINDING SITE is HOST TARGET binding site found in the 5' untranslated region of mRNA encoded by FLJ20281, corresponding to a HOST TARGET binding site such as BINDING SITE I, BINDING SITE II or BINDING SITE III. Table 2 illustrates the complementarity of the nucleotide sequences of FLJ20281 BINDING SITE, designated SEQ ID:43726, to the nucleotide sequence of VGAM1455 RNA, herein designated VGAM RNA, also designated SEQ ID:4166.

Another function of VGAM1455 is therefore inhibition of FLJ20281 (Accession XM_165663). Accordingly, utilities of VGAM1455 include diagnosis, prevention and treatment of diseases and clinical conditions associated with FLJ20281. Solute Carrier Family 26, Member 7 (SLC26A7, Accession NM_052832) is another VGAM1455 host target gene. SLC26A7 BINDING SITE is HOST TARGET binding site found in the 3' untranslated region of mRNA encoded by SLC26A7, corresponding to a HOST TARGET binding site such as BINDING SITE I, BINDING SITE II or BINDING SITE III. Table 2 illustrates the complementarity of the nucleotide sequences of SLC26A7 BINDING SITE, designated SEQ ID:27416, to the nucleotide sequence of VGAM1455 RNA, herein designated VGAM RNA, also designated SEQ ID:4166.

Another function of VGAM1455 is therefore inhibition of Solute Carrier Family 26, Member 7 (SLC26A7, Accession NM_052832). Accordingly, utilities of VGAM1455 include diagnosis, prevention and treatment of diseases and clinical conditions associated with SLC26A7. LOC134266 (Accession XM_059701) is another VGAM1455 host target gene. LOC134266 BINDING SITE is HOST TARGET binding site found in the 3' untranslated region of mRNA encoded by LOC134266, corresponding to a HOST TARGET binding site such as BINDING SITE I, BINDING SITE II or BINDING SITE III. Table 2 illustrates the complementarity of the nucleotide sequences of LOC134266 BINDING SITE, designated SEQ ID:37067, to the nucleotide sequence of VGAM1455 RNA, herein designated VGAM RNA, also designated SEQ ID:4166.

Another function of VGAM1455 is therefore inhibition of LOC134266 (Accession XM_059701). Accordingly, utilities of VGAM1455 include diagnosis, prevention and treatment of diseases and clinical conditions associated with LOC134266. LOC144438 (Accession XM_084860) is another VGAM1455 host target gene. LOC144438 BINDING SITE is HOST TARGET binding site found in the 3' untranslated region of mRNA encoded by LOC144438, corresponding to a HOST TARGET binding site such as BINDING SITE I, BINDING SITE II or BINDING SITE III. Table 2 illustrates the complementarity of the nucleotide sequences of LOC144438 BINDING SITE, designated SEQ ID:37736, to the nucleotide sequence of VGAM1455 RNA, herein designated VGAM RNA, also designated SEQ ID:4166.

Another function of VGAM1455 is therefore inhibition of LOC144438 (Accession XM_084860). Accordingly, utilities of VGAM1455 include diagnosis, prevention and treatment of diseases and clinical conditions associated with LOC144438. FIG. 1 further provides a conceptual description of a novel bioinformatically detected viral gene of the present invention, referred to here as Viral Genomic Address Messenger 1456 (VGAM1456) viral gene, which modulates expression of respective host target genes thereof, the function and utility of which host target genes is known in the art.

VGAM1456 is a novel bioinformatically detected regulatory, non protein coding, viral micro RNA (miRNA) gene. The method by which VGAM1456 was detected is described hereinabove with reference to FIGS. 1-8.

VGAM1456 gene, herein designated VGAM GENE, is a viral gene contained in the genome of Equine Herpesvirus 2. VGAM1456 host target gene, herein designated VGAM HOST TARGET GENE, is a human gene contained in the human genome.

VGAM1456 gene encodes a VGAM1456 precursor RNA, herein designated VGAM PRECURSOR RNA. Similar to other miRNA genes, and unlike most ordinary genes, VGAM1456 precursor RNA does not encode a protein. A nucleotide sequence identical or highly similar to the nucleotide sequence of VGAM1456 precursor RNA is designated SEQ ID:1442, and is provided hereinbelow with reference to the sequence listing part. Nucleotide sequence SEQ ID:1442 is located at position 39288 relative to the genome of Equine Herpesvirus 2.

VGAM1456 precursor RNA folds onto itself, forming VGAM1456 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1456 folded precursor RNA into VGAM1456 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1456 RNA is designated SEQ ID:4167, and is provided hereinbelow with reference to the sequence listing part.

VGAM1456 host target gene, herein designated VGAM HOST TARGET GENE, encodes a corresponding messenger RNA, VGAM1456 host target RNA, herein designated VGAM HOST TARGET RNA. VGAM1456 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1456 RNA, herein designated VGAM RNA, binds complementarily to one or more host target binding sites located in untranslated regions of VGAM1456 host target RNA, herein designated VGAM HOST TARGET RNA. This complementary binding is due to the fact that the nucleotide sequence of VGAM1456 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1456 RNA, herein designated VGAM RNA, may have a different number of host target binding sites in untranslated regions of a VGAM1456 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1456 RNA, herein designated VGAM RNA, to host target binding sites on VGAM1456 host target RNA, herein designated VGAM HOST TARGET RNA, such as BINDING SITE I, BINDING SITE II and BINDING SITE III, inhibits translation of VGAM1456 host target RNA into VGAM1456 host target protein, herein designated VGAM HOST TARGET PROTEIN. VGAM host target protein is therefore outlined by a broken line.

It is appreciated that VGAM1456 host target gene, herein designated VGAM HOST TARGET GENE, in fact represents a plurality of VGAM1456 host target genes. The mRNA of each one of this plurality of VGAM1456 host target genes comprises one or more host target binding sites, each having a nucleotide sequence which is at least partly complementary to VGAM1456 RNA, herein designated VGAM RNA, and which when bound by VGAM1456 RNA causes inhibition of translation of respective one or more VGAM1456 host target proteins.

It is further appreciated by one skilled in the art that the mode of translational inhibition illustrated by FIG. 1 with specific reference to translational inhibition exerted by VGAM1456 gene, herein designated VGAM GENE, on one or more VGAM1456 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1456 is inhibition of expression of host target genes, as part of a novel viral mechanism of attacking a host. Accordingly, utilities of VGAM1456 include diagnosis, prevention and treatment of viral infection by Equine Herpesvirus 2. Specific functions, and accordingly utilities, of VGAM1456 correlate with, and may be deduced from, the identity of the host target genes which VGAM1456 binds and inhibits, and the function of these host target genes, as elaborated hereinbelow.

Nucleotide sequences of the VGAM1456 precursor RNA, herein designated VGAM PRECURSOR RNA, and of the 'diced' VGAM1456 RNA, herein designated VGAM RNA, and a schematic representation of the secondary folding of VGAM1456 folded precursor RNA, herein designated VGAM FOLDED PRECURSOR RNA, of VGAM1456 are further described hereinbelow with reference to Table 1.

Nucleotide sequences of host target binding sites, such as BINDING SITE-I, BINDING SITE-II and BINDING SITE-III of FIG. 1, found on VGAM1456 host target RNA, and schematic representation of the complementarity of each of these host target binding sites to VGAM1456 RNA, herein designated VGAM RNA, are described hereinbelow with reference to Table 2.

As mentioned hereinabove with reference to FIG. 1, a function of VGAM1456 gene, herein designated VGAM is inhibition of expression of VGAM1456 target genes. It is appreciated that specific functions, and accordingly utilities, of VGAM1456 correlate with, and may be deduced from, the identity of the target genes which VGAM1456 binds and inhibits, and the function of these target genes, as elaborated hereinbelow.

Fatty-acid-Coenzyme A Ligase, Long-chain 2 (FACL2, Accession NM_021122) is a VGAM1456 host target gene. FACL2 BINDING SITE is HOST TARGET binding site found in the 3' untranslated region of mRNA encoded by FACL2, corresponding to a HOST TARGET binding site such as BINDING SITE I, BINDING SITE II or BINDING SITE III. Table 2 illustrates the complementarity of the nucleotide sequences of FACL2 BINDING SITE, designated SEQ ID:22096, to the nucleotide sequence of VGAM1456 RNA, herein designated VGAM RNA, also designated SEQ ID:4167.

A function of VGAM1456 is therefore inhibition of Fatty-acid-Coenzyme A Ligase, Long-chain 2 (FACL2, Accession NM_021122), a gene which activates long-chain fatty acids for both synthesis of cellular lipids. Accordingly, utilities of VGAM1456 include diagnosis, prevention and treatment of diseases and clinical conditions associated with FACL2. The function of FACL2 and its association with various diseases and clinical conditions, has been established by previous studies, as described hereinabove with reference to VGAM172. Polycystic Kidney and Hepatic Disease 1 (autosomal recessive) (PKHD1, Accession NM_138694) is another VGAM1456 host target gene. PKHD1 BINDING SITE is HOST TARGET binding site found in the 3' untranslated region of mRNA encoded by PKHD1, corresponding to a HOST TARGET binding site such as BINDING SITE I, BINDING SITE II or BINDING SITE III. Table 2 illustrates the complementarity of the nucleotide sequences of PKHD1 BINDING SITE, designated SEQ ID:28936, to the nucleotide sequence of VGAM1456 RNA, herein designated VGAM RNA, also designated SEQ ID:4167.

Another function of VGAM1456 is therefore inhibition of Polycystic Kidney and Hepatic Disease 1 (autosomal recessive) (PKHD1, Accession NM_138694). Accordingly, utilities of VGAM1456 include diagnosis, prevention and treatment of diseases and clinical conditions associated with PKHD1. ARL8 (Accession XM_167671) is another VGAM1456 host target gene. ARL8 BINDING SITE is HOST TARGET binding site found in the 3' untranslated region of mRNA encoded by ARL8, corresponding to a HOST TARGET binding site such as BINDING SITE I, BINDING SITE II or BINDING SITE III. Table 2 illustrates the complementarity of the nucleotide sequences of ARL8 BINDING SITE, designated SEQ ID:44760, to the nucleotide sequence of VGAM1456 RNA, herein designated VGAM RNA, also designated SEQ ID:4167.

Another function of VGAM1456 is therefore inhibition of ARL8 (Accession XM_167671). Accordingly, utilities of VGAM1456 include diagnosis, prevention and treatment of diseases and clinical conditions associated with ARL8. DKFZp547H025 (Accession NM_020161) is another VGAM1456 host target gene. DKFZp547H025 BINDING SITE is HOST TARGET binding site found in the 3' untranslated region of mRNA encoded by DKFZp547H025, corresponding to a HOST TARGET binding site such as BINDING SITE I, BINDING SITE II or BINDING SITE III. Table 2 illustrates the complementarity of the nucleotide sequences of DKFZp547H025 BINDING SITE, designated SEQ ID:21370, to the nucleotide sequence of VGAM1456 RNA, herein designated VGAM RNA, also designated SEQ ID:4167.

Another function of VGAM1456 is therefore inhibition of DKFZp547H025 (Accession NM_020161). Accordingly, utilities of VGAM1456 include diagnosis, prevention and treatment of diseases and clinical conditions associated with DKFZp547H025. DKFZP761F241 (Accession NM_031455) is another VGAM1456 host target gene. DKFZP761F241 BINDING SITE is HOST TARGET binding site found in the 3' untranslated region of mRNA encoded by DKFZP761F241, corresponding to a HOST TARGET binding site such as BINDING SITE I, BINDING SITE II or BINDING SITE III. Table 2 illustrates the complementarity of the nucleotide sequences of DKFZP761F241 BINDING SITE, designated SEQ ID:25476, to the nucleotide sequence of VGAM1456 RNA, herein designated VGAM RNA, also designated SEQ ID:4167.

Another function of VGAM1456 is therefore inhibition of DKFZP761F241 (Accession NM_031455). Accordingly, utilities of VGAM1456 include diagnosis, prevention and treatment of diseases and clinical conditions associated with DKFZP761F241. FLJ13881 (Accession NM_024729) is another VGAM1456 host target gene. FLJ13881 BINDING SITE is HOST TARGET binding site found in the 3' untranslated region of mRNA encoded by FLJ13881, corresponding to a HOST TARGET binding site such as BINDING SITE I, BINDING SITE II or BINDING SITE III. Table 2 illustrates the complementarity of the nucleotide sequences of FLJ13881 BINDING SITE, designated SEQ ID:24068, to the nucleotide sequence of VGAM1456 RNA, herein designated VGAM RNA, also designated SEQ ID:4167.

Another function of VGAM1456 is therefore inhibition of FLJ13881 (Accession NM_024729). Accordingly, utilities of VGAM1456 include diagnosis, prevention and treatment of diseases and clinical conditions associated with FLJ13881. FLJ22644 (Accession NM_025098) is another VGAM1456 host target gene. FLJ22644 BINDING SITE is HOST TARGET binding site found in the 3' untranslated region of mRNA encoded by FLJ22644, corresponding to a HOST TARGET binding site such as BINDING SITE I, BINDING SITE II or BINDING SITE III. Table 2 illustrates the complementarity of the nucleotide sequences of FLJ22644 BINDING SITE, designated SEQ ID:24740, to the nucleotide sequence of VGAM1456 RNA, herein designated VGAM RNA, also designated SEQ ID:4167.

Another function of VGAM1456 is therefore inhibition of FLJ22644 (Accession NM_025098). Accordingly, utilities of VGAM1456 include diagnosis, prevention and treatment of diseases and clinical conditions associated with FLJ22644. KIAA0258 (Accession NM_014785) is another VGAM1456 host target gene. KIAA0258 BINDING SITE is HOST TARGET binding site found in the 3' untranslated region of mRNA encoded by KIAA0258, corresponding to a HOST TARGET binding site such as BINDING SITE I, BINDING SITE II or BINDING SITE III. Table 2 illustrates the complementarity of the nucleotide sequences of KIAA0258 BINDING SITE, designated SEQ ID:16644, to the nucleotide sequence of VGAM1456 RNA, herein designated VGAM RNA, also designated SEQ ID:4167.

Another function of VGAM1456 is therefore inhibition of KIAA0258 (Accession NM_014785). Accordingly, utilities of VGAM1456 include diagnosis, prevention and treatment of diseases and clinical conditions associated with KIAA0258. KIAA0296 (Accession NM_014699) is another VGAM1456 host target gene. KIAA0296 BINDING SITE is HOST TARGET binding site found in the 3' untranslated region of mRNA encoded by KIAA0296, corresponding to a HOST TARGET binding site such as BINDING SITE I, BINDING SITE II or BINDING SITE III. Table 2 illustrates the complementarity of the nucleotide sequences of KIAA0296 BINDING SITE, designated SEQ ID:16217, to the nucleotide sequence of VGAM1456 RNA, herein designated VGAM RNA, also designated SEQ ID:4167.

Another function of VGAM1456 is therefore inhibition of KIAA0296 (Accession NM_014699). Accordingly, utilities of VGAM1456 include diagnosis, prevention and treatment of diseases and clinical conditions associated with KIAA0296. KIAA1100 (Accession NM_014901) is another VGAM1456 host target gene. KIAA1100 BINDING SITE is HOST TARGET binding site found in the 3' untranslated region of mRNA encoded by KIAA1100, corresponding to a HOST TARGET binding site such as BINDING SITE I, BINDING SITE II or BINDING SITE III. Table 2 illustrates the complementarity of the nucleotide sequences of KIAA1100 BINDING SITE, designated SEQ ID:17083, to the nucleotide sequence of VGAM1456 RNA, herein designated VGAM RNA, also designated SEQ ID:4167.

Another function of VGAM1456 is therefore inhibition of KIAA1100 (Accession NM_014901). Accordingly, utilities of VGAM1456 include diagnosis, prevention and treatment of diseases and clinical conditions associated with KIAA1100. Solute Carrier Family 25 (mitochondrial oxodicarboxylate carrier), Member 21 (SLC25A21, Accession NM_030631) is another VGAM1456 host target gene. SLC25A21 BINDING SITE is HOST TARGET binding site found in the 3' untranslated region of mRNA encoded by SLC25A21, corresponding to a HOST TARGET binding site such as BINDING SITE I, BINDING SITE II or BINDING SITE III. Table 2 illustrates the complementarity of the nucleotide sequences of SLC25A21 BINDING SITE, designated SEQ ID:24966, to the nucleotide sequence of VGAM1456 RNA, herein designated VGAM RNA, also designated SEQ ID:4167.

Another function of VGAM1456 is therefore inhibition of Solute Carrier Family 25 (mitochondrial oxodicarboxylate carrier), Member 21 (SLC25A21, Accession NM_030631). Accordingly, utilities of VGAM1456 include diagnosis, prevention and treatment of diseases and clinical conditions associated with SLC25A21. LOC149372 (Accession XM_086509) is another VGAM1456 host target gene. LOC149372 BINDING SITE is HOST TARGET binding site found in the 3' untranslated region of mRNA encoded by LOC149372, corresponding to a HOST TARGET binding site such as BINDING SITE I, BINDING SITE II or BINDING SITE III. Table 2 illustrates the complementarity of the nucleotide sequences of LOC149372 BINDING SITE, designated SEQ ID:38729, to the nucleotide sequence of VGAM1456 RNA, herein designated VGAM RNA, also designated SEQ ID:4167.

Another function of VGAM1456 is therefore inhibition of LOC149372 (Accession XM_086509). Accordingly, utilities of VGAM1456 include diagnosis, prevention and treatment of diseases and clinical conditions associated with LOC149372. LOC154860 (Accession XM_098623) is another VGAM1456 host target gene. LOC154860 BINDING SITE is HOST TARGET binding site found in the 5' untranslated region of mRNA encoded by LOC154860, corresponding to a HOST TARGET binding site such as BINDING SITE I, BINDING SITE II or BINDING SITE III. Table 2 illustrates the complementarity of the nucleotide sequences of LOC154860 BINDING SITE, designated SEQ ID:41735, to the nucleotide sequence of VGAM1456 RNA, herein designated VGAM RNA, also designated SEQ ID:4167.

Another function of VGAM1456 is therefore inhibition of LOC154860 (Accession XM_098623). Accordingly, utilities of VGAM1456 include diagnosis, prevention and treatment of diseases and clinical conditions associated with LOC154860. LOC197358 (Accession XM_113872) is another VGAM1456 host target gene. LOC197358 BINDING SITE is HOST TARGET binding site found in the 5' untranslated region of mRNA encoded by LOC197358, corresponding to a HOST TARGET binding site such as BINDING SITE I, BINDING SITE II or BINDING SITE III. Table 2 illustrates the complementarity of the nucleotide sequences of LOC197358 BINDING SITE, designated SEQ ID:42505, to the nucleotide sequence of VGAM1456 RNA, herein designated VGAM RNA, also designated SEQ ID:4167.

Another function of VGAM1456 is therefore inhibition of LOC197358 (Accession XM_113872). Accordingly, utilities of VGAM1456 include diagnosis, prevention and treatment of diseases and clinical conditions associated with LOC197358. LOC257177 (Accession XM_170909) is another VGAM1456 host target gene. LOC257177 BINDING SITE is HOST TARGET binding site found in the 5' untranslated region of mRNA encoded by LOC257177, corresponding to a HOST TARGET binding site such as BINDING SITE I, BINDING SITE II or BINDING SITE III. Table 2 illustrates the complementarity of the nucleotide sequences of LOC257177 BINDING SITE, designated SEQ ID:45675, to the nucleotide sequence of VGAM1456 RNA, herein designated VGAM RNA, also designated SEQ ID:4167.

Another function of VGAM1456 is therefore inhibition of LOC257177 (Accession XM_170909). Accordingly, utilities of VGAM1456 include diagnosis, prevention and treatment of diseases and clinical conditions associated with LOC257177. FIG. 1 further provides a conceptual description of a novel bioinformatically detected viral gene of the present invention, referred to here as Viral Genomic Address Messenger 1457 (VGAM1457) viral gene, which modulates expression of respective host target genes thereof, the function and utility of which host target genes is known in the art.

VGAM1457 is a novel bioinformatically detected regulatory, non protein coding, viral micro RNA (miRNA) gene. The method by which VGAM1457 was detected is described hereinabove with reference to FIGS. 1-8.

VGAM1457 gene, herein designated VGAM GENE, is a viral gene contained in the genome of Equine Herpesvirus 2. VGAM1457 host target gene, herein designated VGAM HOST TARGET GENE, is a human gene contained in the human genome.

VGAM1457 gene encodes a VGAM1457 precursor RNA, herein designated VGAM PRECURSOR RNA. Similar to other miRNA genes, and unlike most ordinary genes, VGAM1457 precursor RNA does not encode a protein. A nucleotide sequence identical or highly similar to the nucleotide sequence of VGAM1457 precursor RNA is designated SEQ ID:1443, and is provided hereinbelow with reference to the sequence listing part. Nucleotide sequence SEQ ID:1443 is located at position 43126 relative to the genome of Equine Herpesvirus 2.

VGAM1457 precursor RNA folds onto itself, forming VGAM1457 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1457 folded precursor RNA into VGAM1457 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1457 RNA is designated SEQ ID:4168, and is provided hereinbelow with reference to the sequence listing part.

VGAM1457 host target gene, herein designated VGAM HOST TARGET GENE, encodes a corresponding messenger RNA, VGAM1457 host target RNA, herein designated VGAM HOST TARGET RNA. VGAM1457 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1457 RNA, herein designated VGAM RNA, binds complementarily to one or more host target binding sites located in untranslated regions of VGAM1457 host target RNA, herein designated VGAM HOST TARGET RNA. This complementary binding is due to the fact that the nucleotide sequence of VGAM1457 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1457 RNA, herein designated VGAM RNA, may have a different number of host target binding sites in untranslated regions of a VGAM1457 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1457 RNA, herein designated VGAM RNA, to host target binding sites on VGAM1457 host target RNA, herein designated VGAM HOST TARGET RNA, such as BINDING SITE I, BINDING SITE II and BINDING SITE III, inhibits translation of VGAM1457 host target RNA into VGAM1457 host target protein, herein designated VGAM HOST TARGET PROTEIN. VGAM host target protein is therefore outlined by a broken line.

It is appreciated that VGAM1457 host target gene, herein designated VGAM HOST TARGET GENE, in fact represents a plurality of VGAM1457 host target genes. The mRNA of each one of this plurality of VGAM1457 host target genes comprises one or more host target binding sites, each having a nucleotide sequence which is at least partly complementary to VGAM1457 RNA, herein designated VGAM RNA, and which when bound by VGAM1457 RNA causes inhibition of translation of respective one or more VGAM1457 host target proteins.

It is further appreciated by one skilled in the art that the mode of translational inhibition illustrated by FIG. 1 with specific reference to translational inhibition exerted by VGAM1457 gene, herein designated VGAM GENE, on one or more VGAM1457 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1457 is inhibition of expression of host target genes, as part of a novel viral mechanism of attacking a host. Accordingly, utilities of VGAM1457 include diagnosis, prevention and treatment of viral infection by Equine Herpesvirus 2. Specific functions, and accordingly utilities, of VGAM1457 correlate with, and may be deduced from, the identity of the host target genes which VGAM1457 binds and inhibits, and the function of these host target genes, as elaborated hereinbelow.

Nucleotide sequences of the VGAM1457 precursor RNA, herein designated VGAM PRECURSOR RNA, and of the 'diced' VGAM1457 RNA, herein designated VGAM RNA, and a schematic representation of the secondary folding of VGAM1457 folded precursor RNA, herein designated VGAM FOLDED PRECURSOR RNA, of VGAM1457 are further described hereinbelow with reference to Table 1.

Nucleotide sequences of host target binding sites, such as BINDING SITE-I, BINDING SITE-II and BINDING SITE-III of FIG. 1, found on VGAM1457 host target RNA, and schematic representation of the complementarity of each of these host target binding sites to VGAM1457 RNA, herein designated VGAM RNA, are described hereinbelow with reference to Table 2.

As mentioned hereinabove with reference to FIG. 1, a function of VGAM1457 gene, herein designated VGAM is inhibition of expression of VGAM1457 target genes. It is appreciated that specific functions, and accordingly utilities, of VGAM1457 correlate with, and may be deduced from, the identity of the target genes which VGAM1457 binds and inhibits, and the function of these target genes, as elaborated hereinbelow.

Zinc Finger Protein 146 (ZNF146, Accession NM_007145) is a VGAM1457 host target gene. ZNF146 BINDING SITE is HOST TARGET binding site found in the 5' untranslated region of mRNA encoded by ZNF146, corresponding to a HOST TARGET binding site such as BINDING SITE I, BINDING SITE II or BINDING SITE III. Table 2 illustrates the complementarity of the nucleotide sequences of ZNF146 BINDING SITE, designated SEQ ID:13993, to the nucleotide sequence of VGAM1457 RNA, herein designated VGAM RNA, also designated SEQ ID:4168.

A function of VGAM1457 is therefore inhibition of Zinc Finger Protein 146 (ZNF146, Accession NM_007145), a gene which binds zinc ions, DNA, and heparin. Accordingly, utilities of VGAM1457 include diagnosis, prevention and treatment of diseases and clinical conditions associated with ZNF146. The function of ZNF146 and its association with various diseases and clinical conditions, has been established by previous studies, as described hereinabove with reference to VGAM192. KIAA0063 (Accession NM_014876) is another VGAM1457 host target gene. KIAA0063 BINDING SITE is HOST TARGET binding site found in the 3' untranslated region of mRNA encoded by KIAA0063, corresponding to a HOST TARGET binding site such as BINDING SITE I, BINDING SITE II or BINDING SITE III. Table 2 illustrates the complementarity of the nucleotide sequences of KIAA0063 BINDING SITE, designated SEQ ID:17015, to the nucleotide sequence of VGAM1457 RNA, herein designated VGAM RNA, also designated SEQ ID:4168.

Another function of VGAM1457 is therefore inhibition of KIAA0063 (Accession NM_014876). Accordingly, utilities of VGAM1457 include diagnosis, prevention and treatment of diseases and clinical conditions associated with KIAA0063. KIAA0676 (Accession NM_015043) is another VGAM1457 host target gene. KIAA0676 BINDING SITE is HOST TARGET binding site found in the 3' untranslated region of mRNA encoded by KIAA0676, corresponding to a HOST TARGET binding site such as BINDING SITE I, BINDING SITE II or BINDING SITE III. Table 2 illustrates the complementarity of the nucleotide sequences of KIAA0676 BINDING SITE, designated SEQ ID:17391, to the nucleotide sequence of VGAM1457 RNA, herein designated VGAM RNA, also designated SEQ ID:4168.

Another function of VGAM1457 is therefore inhibition of KIAA0676 (Accession NM_015043). Accordingly, utilities of VGAM1457 include diagnosis, prevention and treatment of diseases and clinical conditions associated with KIAA0676. Neurexophilin 3 (NXPH3, Accession XM_037847) is another VGAM1457 host target gene. NXPH3 BINDING SITE is HOST TARGET binding site found in the 3' untranslated region of mRNA encoded by NXPH3, corresponding to a HOST TARGET binding site such as BINDING SITE I, BINDING SITE II or BINDING SITE III. Table 2 illustrates the complementarity of the nucleotide sequences of NXPH3 BINDING SITE, designated SEQ ID:32711, to the nucleotide sequence of VGAM1457 RNA, herein designated VGAM RNA, also designated SEQ ID:4168.

Another function of VGAM1457 is therefore inhibition of Neurexophilin 3 (NXPH3, Accession XM_037847). Accordingly, utilities of VGAM1457 include diagnosis, prevention and treatment of diseases and clinical conditions associated with NXPH3. FIG. 1 further provides a conceptual description of a novel bioinformatically detected viral gene of the present invention, referred to here as Viral Genomic Address Messenger 1458 (VGAM1458) viral gene, which modulates expression of respective host target genes thereof, the function and utility of which host target genes is known in the art.

VGAM1458 is a novel bioinformatically detected regulatory, non protein coding, viral micro RNA (miRNA) gene. The method by which VGAM1458 was detected is described hereinabove with reference to FIGS. 1-8.

VGAM1458 gene, herein designated VGAM GENE, is a viral gene contained in the genome of Equine Herpesvirus 2. VGAM1458 host target gene, herein designated VGAM HOST TARGET GENE, is a human gene contained in the human genome.

VGAM1458 gene encodes a VGAM1458 precursor RNA, herein designated VGAM PRECURSOR RNA. Similar to other miRNA genes, and unlike most ordinary genes, VGAM1458 precursor RNA does not encode a protein. A nucleotide sequence identical or highly similar to the nucleotide sequence of VGAM1458 precursor RNA is designated SEQ ID:1444, and is provided hereinbelow with reference to the sequence listing part. Nucleotide sequence SEQ ID:1444 is located at position 39736 relative to the genome of Equine Herpesvirus 2.

VGAM1458 precursor RNA folds onto itself, forming VGAM1458 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1458 folded precursor RNA into VGAM1458 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1458 RNA is designated SEQ ID:4169, and is provided hereinbelow with reference to the sequence listing part.

VGAM1458 host target gene, herein designated VGAM HOST TARGET GENE, encodes a corresponding messenger RNA, VGAM1458 host target RNA, herein designated VGAM HOST TARGET RNA. VGAM1458 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1458 RNA, herein designated VGAM RNA, binds complementarily to one or more host target binding sites located in untranslated regions of VGAM1458 host target RNA, herein designated VGAM HOST TARGET RNA. This complementary binding is due to the fact that the nucleotide sequence of VGAM1458 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1458 RNA, herein designated VGAM RNA, may have a different number of host target binding sites in untranslated regions of a VGAM1458 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1458 RNA, herein designated VGAM RNA, to host target binding sites on VGAM1458 host target RNA, herein designated VGAM HOST TARGET RNA, such as BINDING SITE I, BINDING SITE II and BINDING SITE III, inhibits translation of VGAM1458 host target RNA into VGAM1458 host target protein, herein designated VGAM HOST TARGET PROTEIN. VGAM host target protein is therefore outlined by a broken line.

It is appreciated that VGAM1458 host target gene, herein designated VGAM HOST TARGET GENE, in fact represents a plurality of VGAM1458 host target genes. The mRNA of each one of this plurality of VGAM1458 host target genes comprises one or more host target binding sites, each having a nucleotide sequence which is at least partly complementary to VGAM1458 RNA, herein designated VGAM RNA, and which when bound by VGAM1458 RNA causes inhibition of translation of respective one or more VGAM1458 host target proteins.

It is further appreciated by one skilled in the art that the mode of translational inhibition illustrated by FIG. 1 with specific reference to translational inhibition exerted by VGAM1458 gene, herein designated VGAM GENE, on one or more VGAM1458 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1458 is inhibition of expression of host target genes, as part of a novel viral mechanism of attacking a host. Accordingly, utilities of VGAM1458 include diagnosis, prevention and treatment of viral infection by Equine Herpesvirus 2. Specific functions, and accordingly utilities, of VGAM1458 correlate with, and may be deduced from, the identity of the host target genes which VGAM1458 binds and inhibits, and the function of these host target genes, as elaborated hereinbelow.

Nucleotide sequences of the VGAM1458 precursor RNA, herein designated VGAM PRECURSOR RNA, and of the 'diced' VGAM1458 RNA, herein designated VGAM RNA, and a schematic representation of the secondary folding of VGAM1458 folded precursor RNA, herein designated VGAM FOLDED PRECURSOR RNA, of VGAM1458 are further described hereinbelow with reference to Table 1.

Nucleotide sequences of host target binding sites, such as BINDING SITE-I, BINDING SITE-II and BINDING SITE-III of FIG. 1, found on VGAM1458 host target RNA, and schematic representation of the complementarity of each of these host target binding sites to VGAM1458 RNA, herein designated VGAM RNA, are described hereinbelow with reference to Table 2.

As mentioned hereinabove with reference to FIG. 1, a function of VGAM1458 gene, herein designated VGAM is inhibition of expression of VGAM1458 target genes. It is appreciated that specific functions, and accordingly utilities, of VGAM1458 correlate with, and may be deduced from, the identity of the target genes which VGAM1458 binds and inhibits, and the function of these target genes, as elaborated hereinbelow.

Calcitonin Receptor-like (CALCRL, Accession NM_005795) is a VGAM1458 host target gene. CALCRL BINDING SITE is HOST TARGET binding site found in the 3' untranslated region of mRNA encoded by CALCRL, corresponding to a HOST TARGET binding site such as BINDING SITE I, BINDING SITE II or BINDING SITE III. Table 2 illustrates the complementarity of the nucleotide sequences of CALCRL BINDING SITE, designated SEQ ID:12375, to the nucleotide sequence of VGAM1458 RNA, herein designated VGAM RNA, also designated SEQ ID:4169.

A function of VGAM1458 is therefore inhibition of Calcitonin Receptor-like (CALCRL, Accession NM_005795), a gene which is a receptor for calcitonin gene-related peptide type 1. Accordingly, utilities of VGAM1458 include diagnosis, prevention and treatment of diseases and clinical conditions associated with CALCRL. The function of CALCRL and its association with various diseases and clinical conditions, has been established by previous studies, as described hereinabove with reference to VGAM995. Cyclin-dependent Kinase (CDC2-like) 10 (CDK10, Accession NM_052988) is another VGAM1458 host target gene. CDK10 BINDING SITE is HOST TARGET binding site found in the 3' untranslated region of mRNA encoded by CDK10, corresponding to a HOST TARGET binding site such as BINDING SITE I, BINDING SITE II or BINDING SITE III. Table 2 illustrates the complementarity of the nucleotide sequences of CDK10 BINDING SITE, designated SEQ ID:27553, to the nucleotide sequence of VGAM1458 RNA, herein designated VGAM RNA, also designated SEQ ID:4169.

Another function of VGAM1458 is therefore inhibition of Cyclin-dependent Kinase (CDC2-like) 10 (CDK10, Accession NM_052988), a gene which plays a pivotal role in the regulation of the eukaryotic cell cycle. Accordingly, utilities of VGAM1458 include diagnosis, prevention and treatment of diseases and clinical conditions associated with CDK10. The function of CDK10 and its association with various diseases and clinical conditions, has been established by previous studies, as described hereinabove with reference to VGAM193. A Disintegrin and Metalloproteinase Domain 9 (meltrin gamma) (ADAM9, Accession NM_003816) is another VGAM1458 host target gene. ADAM9 BINDING SITE is HOST TARGET binding site found in the 3' untranslated region of mRNA encoded by ADAM9, corresponding to a HOST TARGET binding site such as BINDING SITE I, BINDING SITE II or BINDING SITE III. Table 2 illustrates the complementarity of the nucleotide sequences of ADAM9 BINDING SITE, designated SEQ ID:9905, to the nucleotide sequence of VGAM1458 RNA, herein designated VGAM RNA, also designated SEQ ID:4169.

Another function of VGAM1458 is therefore inhibition of A Disintegrin and Metalloproteinase Domain 9 (meltrin gamma) (ADAM9, Accession NM_003816). Accordingly, utilities of VGAM1458 include diagnosis, prevention and treatment of diseases and clinical conditions associated with ADAM9. KIAA1164 (Accession XM_045358) is another VGAM1458 host target gene. KIAA1164 BINDING SITE is HOST TARGET binding site found in the 3' untranslated region of mRNA encoded by KIAA1164, corresponding to a HOST TARGET binding site such as BINDING SITE I, BINDING SITE II or BINDING SITE III. Table 2 illustrates the complementarity of the nucleotide sequences of KIAA1164 BINDING SITE, designated SEQ ID:34439, to the nucleotide sequence of VGAM1458 RNA, herein designated VGAM RNA, also designated SEQ ID:4169.

Another function of VGAM1458 is therefore inhibition of KIAA1164 (Accession XM_045358). Accordingly, utilities of VGAM1458 include diagnosis, prevention and treatment of diseases and clinical conditions associated with KIAA1164. KIAA1211 (Accession XM_044178) is another VGAM1458 host target gene. KIAA1211 BINDING SITE is HOST TARGET binding site found in the 3' untranslated region of mRNA encoded by KIAA1211, corresponding to a HOST TARGET binding site such as BINDING SITE I, BINDING SITE II or BINDING SITE III. Table 2 illustrates the complementarity of the nucleotide sequences of KIAA1211 BINDING SITE, designated SEQ ID:34158, to the nucleotide sequence of VGAM1458 RNA, herein designated VGAM RNA, also designated SEQ ID:4169.

Another function of VGAM1458 is therefore inhibition of KIAA1211 (Accession XM_044178). Accordingly, utilities of VGAM1458 include diagnosis, prevention and treatment of diseases and clinical conditions associated with KIAA1211. KIAA1458 (Accession XM_044434) is another VGAM1458 host target gene. KIAA1458 BINDING SITE is HOST TARGET binding site found in the 3' untranslated region of mRNA encoded by KIAA1458, corresponding to a HOST TARGET binding site such as BINDING SITE I, BINDING SITE II or BINDING SITE III. Table 2 illustrates the complementarity of the nucleotide sequences of KIAA1458 BINDING SITE, designated SEQ ID:34202, to the nucleotide sequence of VGAM1458 RNA, herein designated VGAM RNA, also designated SEQ ID:4169.

Another function of VGAM1458 is therefore inhibition of KIAA1458 (Accession XM_044434). Accordingly, utilities of VGAM1458 include diagnosis, prevention and treatment of diseases and clinical conditions associated with KIAA1458. MGC5566 (Accession NM_024049) is another VGAM1458 host target gene. MGC5566 BINDING SITE is HOST TARGET binding site found in the 3' untranslated region of mRNA encoded by MGC5566, corresponding to a HOST TARGET binding site such as BINDING SITE I, BINDING SITE II or BINDING SITE III. Table 2 illustrates the complementarity of the nucleotide sequences of MGC5566 BINDING SITE, designated SEQ ID:23485, to the nucleotide sequence of VGAM1458 RNA, herein designated VGAM RNA, also designated SEQ ID:4169.

Another function of VGAM1458 is therefore inhibition of MGC5566 (Accession NM_024049). Accordingly, utilities of VGAM1458 include diagnosis, prevention and treatment of diseases and clinical conditions associated with MGC5566. PANK (Accession NM_138316) is another VGAM1458 host target gene. PANK BINDING SITE is HOST TARGET binding site found in the 3' untranslated region of mRNA encoded by PANK, corresponding to a HOST TARGET binding site such as BINDING SITE I, BINDING SITE II or BINDING SITE III. Table 2 illustrates the complementarity of the nucleotide sequences of PANK BINDING SITE, designated SEQ ID:28714, to the nucleotide sequence of VGAM1458 RNA, herein designated VGAM RNA, also designated SEQ ID:4169.

Another function of VGAM1458 is therefore inhibition of PANK (Accession NM_138316). Accordingly, utilities of VGAM1458 include diagnosis, prevention and treatment of diseases and clinical conditions associated with PANK. LOC146667 (Accession XM_097044) is another VGAM1458 host target gene. LOC146667 BINDING SITE is HOST TARGET binding site found in the 5' untranslated region of mRNA encoded by LOC146667, corresponding to a HOST TARGET binding site such as BINDING SITE I, BINDING SITE II or BINDING SITE III. Table 2 illustrates the complementarity of the nucleotide sequences of LOC146667 BINDING SITE, designated SEQ ID:40710, to the nucleotide sequence of VGAM1458 RNA, herein designated VGAM RNA, also designated SEQ ID:4169.

Another function of VGAM1458 is therefore inhibition of LOC146667 (Accession XM_097044). Accordingly, utilities of VGAM1458 include diagnosis, prevention and treatment of diseases and clinical conditions associated with LOC146667. LOC147184 (Accession NM_145274) is another VGAM1458 host target gene. LOC147184 BINDING SITE is HOST TARGET binding site found in the 5' untranslated region of mRNA encoded by LOC147184, corresponding to a HOST TARGET binding site such as BINDING SITE I, BINDING SITE II or BINDING SITE III. Table 2 illustrates the complementarity of the nucleotide sequences of LOC147184 BINDING SITE, designated SEQ ID:29786, to the nucleotide sequence of VGAM1458 RNA, herein designated VGAM RNA, also designated SEQ ID:4169.

Another function of VGAM1458 is therefore inhibition of LOC147184 (Accession NM_145274). Accordingly, utilities of VGAM1458 include diagnosis, prevention and treatment of diseases and clinical conditions associated with LOC147184. LOC149448 (Accession XM_097642) is another VGAM1458 host target gene. LOC149448 BINDING SITE is HOST TARGET binding site found in the 3' untranslated region of mRNA encoded by LOC149448, corresponding to a HOST TARGET binding site such as BINDING SITE I, BINDING SITE II or BINDING SITE III. Table 2 illustrates the complementarity of the nucleotide sequences of LOC149448 BINDING SITE, designated SEQ ID:40989, to the nucleotide sequence of VGAM1458 RNA, herein designated VGAM RNA, also designated SEQ ID:4169.

Another function of VGAM1458 is therefore inhibition of LOC149448 (Accession XM_097642). Accordingly, utilities of VGAM1458 include diagnosis, prevention and treatment of diseases and clinical conditions associated with LOC149448. LOC200531 (Accession XM_114244) is another VGAM1458 host target gene. LOC200531 BINDING SITE is HOST TARGET binding site found in the 5' untranslated region of mRNA encoded by LOC200531, corresponding to a HOST TARGET binding site such as BINDING SITE I, BINDING SITE II or BINDING SITE III. Table 2 illustrates the complementarity of the nucleotide sequences of LOC200531 BINDING SITE, designated SEQ ID:42817, to the nucleotide sequence of VGAM1458 RNA, herein designated VGAM RNA, also designated SEQ ID:4169.

Another function of VGAM1458 is therefore inhibition of LOC200531 (Accession XM_114244). Accordingly, utilities of VGAM1458 include diagnosis, prevention and treatment of diseases and clinical conditions associated with LOC200531. LOC257443 (Accession XM_171072) is another VGAM1458 host target gene. LOC257443 BINDING SITE is HOST TARGET binding site found in the 3' untranslated region of mRNA encoded by LOC257443, corresponding to a HOST TARGET binding site such as BINDING SITE I, BINDING SITE II or BINDING SITE III. Table 2 illustrates the complementarity of the nucleotide sequences of LOC257443 BINDING SITE, designated SEQ ID:45871, to the nucleotide sequence of VGAM1458 RNA, herein designated VGAM RNA, also designated SEQ ID:4169.

Another function of VGAM1458 is therefore inhibition of LOC257443 (Accession XM_171072). Accordingly, utilities of VGAM1458 include diagnosis, prevention and treatment of diseases and clinical conditions associated with LOC257443. LOC51301 (Accession NM_016591) is another VGAM1458 host target gene. LOC51301 BINDING SITE is HOST TARGET binding site found in the 5' untranslated region of mRNA encoded by LOC51301, corresponding to a HOST TARGET binding site such as BINDING SITE I, BINDING SITE II or BINDING SITE III. Table 2 illustrates the complementarity of the nucleotide sequences of LOC51301 BINDING SITE, designated SEQ ID:18669, to the nucleotide sequence of VGAM1458 RNA, herein designated VGAM RNA, also designated SEQ ID:4169.

Another function of VGAM1458 is therefore inhibition of LOC51301 (Accession NM_016591). Accordingly, utilities of VGAM1458 include diagnosis, prevention and treatment of diseases and clinical conditions associated with LOC51301. LOC90110 (Accession XM_029046) is another VGAM1458 host target gene. LOC90110 BINDING SITE is HOST TARGET binding site found in the 5' untranslated region of mRNA encoded by LOC90110, corresponding to a HOST TARGET binding site such as BINDING SITE I, BINDING SITE II or BINDING SITE III. Table 2 illustrates the complementarity of the nucleotide sequences of LOC90110 BINDING SITE, designated SEQ ID:30840, to the nucleotide sequence of VGAM1458 RNA, herein designated VGAM RNA, also designated SEQ ID:4169.

Another function of VGAM1458 is therefore inhibition of LOC90110 (Accession XM_029046). Accordingly, utilities of VGAM1458 include diagnosis, prevention and treatment of diseases and clinical conditions associated with LOC90110. FIG. 1 further provides a conceptual description of a novel bioinformatically detected viral gene of the present invention, referred to here as Viral Genomic Address Messenger 1459 (VGAM1459) viral gene, which modulates expression of respective host target genes thereof, the function and utility of which host target genes is known in the art.

VGAM1459 is a novel bioinformatically detected regulatory, non protein coding, viral micro RNA (miRNA) gene. The method by which VGAM1459 was detected is described hereinabove with reference to FIGS. 1-8.

VGAM1459 gene, herein designated VGAM GENE, is a viral gene contained in the genome of Equine Herpesvirus 2. VGAM1459 host target gene, herein designated VGAM HOST TARGET GENE, is a human gene contained in the human genome.

VGAM1459 gene encodes a VGAM1459 precursor RNA, herein designated VGAM PRECURSOR RNA. Similar to other miRNA genes, and unlike most ordinary genes, VGAM1459 precursor RNA does not encode a protein. A nucleotide sequence identical or highly similar to the nucleotide sequence of VGAM1459 precursor RNA is designated SEQ ID:1445, and is provided hereinbelow with reference to the sequence listing part. Nucleotide sequence SEQ ID:1445 is located at position 39156 relative to the genome of Equine Herpesvirus 2.

VGAM1459 precursor RNA folds onto itself, forming VGAM1459 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1459 folded precursor RNA into VGAM1459 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1459 RNA is designated SEQ ID:4170, and is provided hereinbelow with reference to the sequence listing part.

VGAM1459 host target gene, herein designated VGAM HOST TARGET GENE, encodes a corresponding messenger RNA, VGAM1459 host target RNA, herein designated VGAM HOST TARGET RNA. VGAM1459 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1459 RNA, herein designated VGAM RNA, binds complementarily to one or more host target binding sites located in untranslated regions of VGAM1459 host target RNA, herein designated VGAM HOST TARGET RNA. This complementary binding is due to the fact that the nucleotide sequence of VGAM1459 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1459 RNA, herein designated VGAM RNA, may have a different number of host target binding sites in untranslated regions of a VGAM1459 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1459 RNA, herein designated VGAM RNA, to host target binding sites on VGAM1459 host target RNA, herein designated VGAM HOST TARGET RNA, such as BINDING SITE I, BINDING SITE II and BINDING SITE III, inhibits translation of VGAM1459 host target RNA into VGAM1459 host target protein, herein designated VGAM HOST TARGET PROTEIN. VGAM host target protein is therefore outlined by a broken line.

It is appreciated that VGAM1459 host target gene, herein designated VGAM HOST TARGET GENE, in fact represents a plurality of VGAM1459 host target genes. The mRNA of each one of this plurality of VGAM1459 host target genes comprises one or more host target binding sites, each having a nucleotide sequence which is at least partly complementary to VGAM1459 RNA, herein designated VGAM RNA, and which when bound by VGAM1459 RNA causes inhibition of translation of respective one or more VGAM1459 host target proteins.

It is further appreciated by one skilled in the art that the mode of translational inhibition illustrated by FIG. 1 with specific reference to translational inhibition exerted by VGAM1459 gene, herein designated VGAM GENE, on one or more VGAM1459 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1459 is inhibition of expression of host target genes, as part of a novel viral mechanism of attacking a host. Accordingly, utilities of VGAM1459 include diagnosis, prevention and treatment of viral infection by Equine Herpesvirus 2. Specific functions, and accordingly utilities, of VGAM1459 correlate with, and may be deduced from, the identity of the host target genes which VGAM1459 binds and inhibits, and the function of these host target genes, as elaborated hereinbelow.

Nucleotide sequences of the VGAM1459 precursor RNA, herein designated VGAM PRECURSOR RNA, and of the 'diced' VGAM1459 RNA, herein designated VGAM RNA, and a schematic representation of the secondary folding of VGAM1459 folded precursor RNA, herein designated VGAM FOLDED PRECURSOR RNA, of VGAM1459 are further described hereinbelow with reference to Table 1.

Nucleotide sequences of host target binding sites, such as BINDING SITE-I, BINDING SITE-II and BINDING SITE-III of FIG. 1, found on VGAM1459 host target RNA, and schematic representation of the complementarity of each of these host target binding sites to VGAM1459 RNA, herein designated VGAM RNA, are described hereinbelow with reference to Table 2.

As mentioned hereinabove with reference to FIG. 1, a function of VGAM1459 gene, herein designated VGAM is inhibition of expression of VGAM1459 target genes. It is appreciated that specific functions, and accordingly utilities, of VGAM1459 correlate with, and may be deduced from, the identity of the target genes which VGAM1459 binds and inhibits, and the function of these target genes, as elaborated hereinbelow.

Cytochrome P450, Subfamily I (aromatic compound-inducible), Polypeptide 1 (CYP1A1, Accession NM_000499) is a VGAM1459 host target gene. CYP1A1 BINDING SITE is HOST TARGET binding site found in the 3' untranslated region of mRNA encoded by CYP1A1, corresponding to a HOST TARGET binding site such as BINDING SITE I, BINDING SITE II or BINDING SITE III. Table 2 illustrates the complementarity of the nucleotide sequences of CYP1A1 BINDING SITE, designated SEQ ID:6111, to the nucleotide sequence of VGAM1459 RNA, herein designated VGAM RNA, also designated SEQ ID:4170.

A function of VGAM1459 is therefore inhibition of Cytochrome P450, Subfamily I (aromatic compound-inducible), Polypeptide 1 (CYP1A1, Accession NM_000499), a gene which intervenes in an NADPH-dependent electron transport pathway. Accordingly, utilities of VGAM1459 include diagnosis, prevention and treatment of diseases and clinical conditions associated with CYP1A1. The function of CYP1A1 and its association with various diseases and clinical conditions, has been established by previous studies, as described hereinabove with reference to VGAM335. Ladinin 1 (LAD1, Accession NM_005558) is another VGAM1459 host target gene. LAD1 BINDING SITE is HOST TARGET binding site found in the 3' untranslated region of mRNA encoded by LAD1, corresponding to a HOST TARGET binding site such as BINDING SITE I, BINDING SITE II or BINDING SITE III. Table 2 illustrates the complementarity of the nucleotide sequences of LAD1 BINDING SITE, designated SEQ ID:12084, to the nucleotide sequence of VGAM1459 RNA, herein designated VGAM RNA, also designated SEQ ID:4170.

Another function of VGAM1459 is therefore inhibition of Ladinin 1 (LAD1, Accession NM_005558). Accordingly, utilities of VGAM1459 include diagnosis, prevention and treatment of diseases and clinical conditions associated with LAD1. Lipase, Hormone-sensitive (LIPE, Accession NM_005357) is another VGAM1459 host target gene. LIPE BINDING SITE is HOST TARGET binding site found in the 5' untranslated region of mRNA encoded by LIPE, corresponding to a HOST TARGET binding site such as BINDING SITE I, BINDING SITE II or BINDING SITE III. Table 2 illustrates the complementarity of the nucleotide sequences of LIPE BINDING SITE, designated SEQ ID:11825, to the nucleotide sequence of VGAM1459 RNA, herein designated VGAM RNA, also designated SEQ ID:4170.

Another function of VGAM1459 is therefore inhibition of Lipase, Hormone-sensitive (LIPE, Accession NM_005357), a gene which primarily hydrolyzes stored triglycerides to free fatty acids. Accordingly, utilities of VGAM1459 include diagnosis, prevention and treatment of diseases and clinical conditions associated with LIPE. The function of LIPE has been established by previous studies. Free fatty acids (FFA) derived from adipose tissue triglycerides are the most important fuel in mammals and provide more than half the caloric needs during fasting. Hormone-sensitive lipase (HSL) has a vital role in the mobilization of FFA from adipose tissue by controlling the rate of lipolysis of the stored triglycerides. HSL regulates energy homeostasis by catalyzing the rate-limiting step in adipose tissue lipolysis. Like glycogen phosphorylase (OMIM Ref. No. 232700), the corresponding enzyme in carbohydrate metabolism, HSL is under acute neuronal and hormonal control. In both cases activation by catecholamines occurs through the cyclic AMP-mediated phosphorylation of a single serine residue. The dephosphorylation of HSL by insulin is responsible for the antilipolytic effect of this hormone, one of its most important actions. Holm et al. (1988) cloned the gene for hormone-sensitive lipase from the rat adipocyte and found that the 757-amino acid sequence predicted by the cDNA shows no homology with any other known lipase or protein. The activity-controlling phosphorylation site was localized to serine-563 in a markedly hydrophilic domain, and a lipid-binding consensus site was tentatively identified. They used the rat clone to map the human HSL gene to 19cen-q13.3 by Southern analysis of DNA from human-rodent somatic cell hybrids. By hybridization studies using a panel of somatic cell hybrids with sub-chromosomal segments of 19q, Schonk et al. (1990) localized the HSL gene, symbolized LIPE, to 19q13.1. By fluorescence in situ hybridization, Levitt et al. (1995) mapped the LIPE gene to 19q13.1-q13.2 Li et al. (1994) found that the gene encoding mouse Hsl spans approximately 10.4 kb and comprises 9 exons interrupted by 8 introns. The deduced amino acid sequence predicted a protein that shows 94% identity with the previously determined rat sequence and 85% identity with the human sequence. Despite the high degree of similarity, the 3 species diverge significantly for a stretch of 16 amino acid residues upstream of the phosphorylation site. Wang et al. (1994) demonstrated that the homologous gene is on proximal chromosome 7 in the mouse. The mouse locus, symbolized Lipe, was found to be distinct from the Tub and Ad loci, which are associated with obesity in the mouse Full details of the abovementioned studies are described in the following publications, the disclosure of which are hereby incorporated by reference:

Schonk, D.; van Dijk, P.; Riegmann, P.; Trapman, J.; Holm, C.; Willcocks, T. C.; Sillekens, P.; van Venrooij, W.; Wimmer, E.; Geurts van Kessel, A.; Ropers, H.-H.; Wieringa, B.: Assignment of seven genes to distinct intervals on the midportion of human chromosome 19q surrounding the myotonic dystrophy gene region. Cytogenet. Cell Genet. 54:15-19, 1990; and Levitt, R. C.; Liu, Z.; Nouri, N.; Meyers, D. A.; Brandriff, B.; Mohrenweiser, H. M.: Mapping of the gene for hormone sensitive lipase (LIPE) to chromosome 19q13.1-q13.2. Cytogenet. Cell G.

Further studies establishing the function and utilities of LIPE are found in John Hopkins OMIM database record ID 151750, and in sited publications numbered and 3788-3793 listed in the bibliography section hereinbelow, which are also hereby incorporated by reference. Supervillin (SVIL, Accession NM_003174) is another VGAM1459 host target gene. SVIL BINDING SITE1 and SVIL BINDING SITE2 are HOST TARGET binding sites found in untranslated regions of mRNA encoded by SVIL, corresponding to HOST TARGET binding sites such as BINDING SITE I, BINDING SITE II or BINDING SITE III. Table 2 illustrates the complementarity of the nucleotide sequences of SVIL BINDING SITE1 and SVIL BINDING SITE2, designated SEQ ID:9149 and SEQ ID:22346 respectively, to the nucleotide sequence of VGAM1459 RNA, herein designated VGAM RNA, also designated SEQ ID:4170.

Another function of VGAM1459 is therefore inhibition of Supervillin (SVIL, Accession NM_003174), a gene which binds actin, links filamentous actin with the plasma membrane; and contains putative nuclear localization signals. Accordingly, utilities of VGAM1459 include diagnosis, prevention and treatment of diseases and clinical conditions associated with SVIL. The function of SVIL has been established by previous studies. Pope et al. (1998) used PCR with primers based on bovine sequence to clone human supervillin. The human gene encodes a 1,788-amino acid polypeptide that contains 3 predicted nuclear localization signals, several consensus phosphorylation sites, 1 ATP/GTP-binding motif, 1 potential RNP-binding site, and 3 potential actin-binding sites. The region containing the actin-binding sites is similar to the 'headpiece' of villin (OMIM Ref. No. 193040). Dot blots showed that many tissues express supervillin, with the highest expression in muscle tissues. Northern blot analysis revealed a 7.5-kb mRNA that is abundant in some human cancer cell lines. Southern blot analysis revealed that supervillin is a single-copy gene. Activation of androgen receptor (AR; 313700) via androgen in muscle cells is closely linked to their growth and differentiation. Ting et al. (2002) cloned and characterized supervillin as an AR coregulator from a skeletal muscle cDNA library. They identified a domain within supervillin (amino acids 594 to 1,268) that could interact with the AR N terminus and DNA-binding domain-ligand-binding domain in a ligand-enhanced manner. Subcellular colocalization studies with fluorescence staining indicated that supervillin colocalized with AR in the presence of 5-alpha-dihydrotestosterone in COS-1 cells. Furthermore, supervillin could enhance expression of the endogenous AR target gene p27(KIP1) (OMIM Ref. No. 600778) in prostate cells. Thus, supervillin is an AR coregulator that can enhance AR transactivation in muscle and other cells.

Full details of the abovementioned studies are described in the following publications, the disclosure of which are hereby incorporated by reference:

Pope, R. K.; Pestonjamasp, K. N.; Smith, K. P.; Wulfkuhle, J. D.; Strassel, C. P.; Lawrence, J. B.; Luna, E. J.: Cloning, characterization, and chromosomal localization of human supervillin (SVIL). Genomics 52:342-351, 1998; and Ting, H.-J.; Yeh, S.; Nishimura, K.; Chang, C.: Supervillin associates with androgen receptor and modulates its transcriptional activity. Proc. Nat. Acad. Sci. 99: 661-666, 2002.

Further studies establishing the function and utilities of SVIL are found in John Hopkins OMIM database record ID 604126, and in sited publications numbered 7410-7411 listed in the bibliography section hereinbelow, which are also hereby incorporated by reference. Nudix (nucleoside diphosphate linked moiety X)-type Motif 11 (NUDT11, Accession XM_010230) is another VGAM1459 host target gene. NUDT11 BINDING SITE is HOST TARGET binding site found in the 3' untranslated region of mRNA encoded by NUDT11, corresponding to a HOST TARGET binding site such as BINDING SITE I, BINDING SITE II or BINDING SITE III. Table 2 illustrates the complementarity of the nucleotide sequences of NUDT11 BINDING SITE, designated SEQ ID:30136, to the nucleotide sequence of VGAM1459 RNA, herein designated VGAM RNA, also designated SEQ ID:4170.

Another function of VGAM1459 is therefore inhibition of Nudix (nucleoside diphosphate linked moiety X)-type Motif 11 (NUDT11, Accession XM_010230). Accordingly, utilities of VGAM1459 include diagnosis, prevention and treatment of diseases and clinical conditions associated with NUDT11. Pleiomorphic Adenoma Gene-like 2 (PLAGL2, Accession XM_047007) is another VGAM1459 host target gene. PLAGL2 BINDING SITE is HOST TARGET binding site found in the 3' untranslated region of mRNA encoded by PLAGL2, corresponding to a HOST TARGET binding site such as BINDING SITE I, BINDING SITE II or BINDING SITE III. Table 2 illustrates the complementarity of the nucleotide sequences of PLAGL2 BINDING SITE, designated SEQ ID:34873, to the nucleotide sequence of VGAM1459 RNA, herein designated VGAM RNA, also designated SEQ ID:4170.

Another function of VGAM1459 is therefore inhibition of Pleiomorphic Adenoma Gene-like 2 (PLAGL2, Accession XM_047007). Accordingly, utilities of VGAM1459 include diagnosis, prevention and treatment of diseases and clinical conditions associated with PLAGL2. PRO2958 (Accession NM_018546) is another VGAM1459 host target gene. PRO2958 BINDING SITE is HOST TARGET binding site found in the 3' untranslated region of mRNA encoded by PRO2958, corresponding to a HOST TARGET binding site such as BINDING SITE I, BINDING SITE II or BINDING SITE III. Table 2 illustrates the complementarity of the nucleotide sequences of PRO2958 BINDING SITE, designated SEQ ID:20625, to the nucleotide sequence of VGAM1459 RNA, herein designated VGAM RNA, also designated SEQ ID:4170.

Another function of VGAM1459 is therefore inhibition of PRO2958 (Accession NM_018546). Accordingly, utilities of VGAM1459 include diagnosis, prevention and treatment of diseases and clinical conditions associated with PRO2958. LOC154790 (Accession XM_088044) is another VGAM1459 host target gene. LOC154790 BINDING SITE is HOST TARGET binding site found in the 5' untranslated region of mRNA encoded by LOC154790, corresponding to a HOST TARGET binding site such as BINDING SITE I, BINDING SITE II or BINDING SITE III. Table 2 illustrates the complementarity of the nucleotide sequences of LOC154790 BINDING SITE, designated SEQ ID:39489, to the nucleotide sequence of VGAM1459 RNA, herein designated VGAM RNA, also designated SEQ ID:4170.

Another function of VGAM1459 is therefore inhibition of LOC154790 (Accession XM_088044). Accordingly, utilities of VGAM1459 include diagnosis, prevention and treatment of diseases and clinical conditions associated with LOC154790. LOC203197 (Accession XM_114645) is another VGAM1459 host target gene. LOC203197 BINDING SITE is HOST TARGET binding site found in the 3' untranslated region of mRNA encoded by LOC203197, corresponding to a HOST TARGET binding site such as BINDING SITE I, BINDING SITE II or BINDING SITE III. Table 2 illustrates the complementarity of the nucleotide sequences of LOC203197 BINDING SITE, designated SEQ ID:43008, to the nucleotide sequence of VGAM1459 RNA, herein designated VGAM RNA, also designated SEQ ID:4170.

Another function of VGAM1459 is therefore inhibition of LOC203197 (Accession XM_114645). Accordingly, utilities of VGAM1459 include diagnosis, prevention and treatment of diseases and clinical conditions associated with LOC203197. LOC254249 (Accession XM_170931) is another VGAM1459 host target gene. LOC254249 BINDING SITE is HOST TARGET binding site found in the 5' untranslated region of mRNA encoded by LOC254249, corresponding to a HOST TARGET binding site such as BINDING SITE I, BINDING SITE II or BINDING SITE III. Table 2 illustrates the complementarity of the nucleotide sequences of LOC254249 BINDING SITE, designated SEQ ID:45711, to the nucleotide sequence of VGAM1459 RNA, herein designated VGAM RNA, also designated SEQ ID:4170.

Another function of VGAM1459 is therefore inhibition of LOC254249 (Accession XM_170931). Accordingly, utilities of VGAM1459 include diagnosis, prevention and treatment of diseases and clinical conditions associated with LOC254249. FIG. 1 further provides a conceptual description of a novel bioinformatically detected viral gene of the present invention, referred to here as Viral Genomic Address Messenger 1460 (VGAM1460) viral gene, which modulates expression of respective host target genes thereof, the function and utility of which host target genes is known in the art.

VGAM1460 is a novel bioinformatically detected regulatory, non protein coding, viral micro RNA (miRNA) gene. The method by which VGAM1460 was detected is described hereinabove with reference to FIGS. 1-8.

VGAM1460 gene, herein designated VGAM GENE, is a viral gene contained in the genome of Equine Herpesvirus 2. VGAM1460 host target gene, herein designated VGAM HOST TARGET GENE, is a human gene contained in the human genome.

VGAM1460 gene encodes a VGAM1460 precursor RNA, herein designated VGAM PRECURSOR RNA. Similar to other miRNA genes, and unlike most ordinary genes, VGAM1460 precursor RNA does not encode a protein. A nucleotide sequence identical or highly similar to the nucleotide sequence of VGAM1460 precursor RNA is designated SEQ ID:1446, and is provided hereinbelow with reference to the sequence listing part. Nucleotide sequence SEQ ID:1446 is located at position 39460 relative to the genome of Equine Herpesvirus 2.

VGAM1460 precursor RNA folds onto itself, forming VGAM1460 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1460 folded precursor RNA into VGAM1460 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM1460 RNA is designated SEQ ID:4171, and is provided hereinbelow with reference to the sequence listing part.

VGAM1460 host target gene, herein designated VGAM HOST TARGET GENE, encodes a corresponding messenger RNA, VGAM1460 host target RNA, herein designated VGAM HOST TARGET RNA. VGAM1460 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1460 RNA, herein designated VGAM RNA, binds complementarily to one or more host target binding sites located in untranslated regions of VGAM1460 host target RNA, herein designated VGAM HOST TARGET RNA. This complementary binding is due to the fact that the nucleotide sequence of VGAM1460 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1460 RNA, herein designated VGAM RNA, may have a different number of host target binding sites in untranslated regions of a VGAM1460 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1460 RNA, herein designated VGAM RNA, to host target binding sites on VGAM1460 host target RNA, herein designated VGAM HOST TARGET RNA, such as BINDING SITE I, BINDING SITE II and BINDING SITE III, inhibits translation of VGAM1460 host target RNA into VGAM1460 host target protein, herein designated VGAM HOST TARGET PROTEIN. VGAM host target protein is therefore outlined by a broken line.

It is appreciated that VGAM1460 host target gene, herein designated VGAM HOST TARGET GENE, in fact represents a plurality of VGAM1460 host target genes. The mRNA of each one of this plurality of VGAM1460 host target genes comprises one or more host target binding sites, each having a nucleotide sequence which is at least partly complementary to VGAM1460 RNA, herein designated VGAM RNA, and which when bound by VGAM1460 RNA causes inhibition of translation of respective one or more VGAM1460 host target proteins.

It is further appreciated by one skilled in the art that the mode of translational inhibition illustrated by FIG. 1 with specific reference to translational inhibition exerted by VGAM1460 gene, herein designated VGAM GENE, on one or more VGAM1460 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1460 is inhibition of expression of host target genes, as part of a novel viral mechanism of attacking a host. Accordingly, utilities of VGAM1460 include diagnosis, prevention and treatment of viral infection by Equine Herpesvirus 2. Specific functions, and accordingly utilities, of VGAM1460 correlate with, and may be deduced from, the identity of the host target genes which VGAM1460 binds and inhibits, and the function of these host target genes, as elaborated hereinbelow.

Nucleotide sequences of the VGAM1460 precursor RNA, herein designated VGAM PRECURSOR RNA, and of the 'diced' VGAM1460 RNA, herein designated VGAM RNA, and a schematic representation of the secondary folding of VGAM1460 folded precursor RNA, herein designated VGAM FOLDED PRECURSOR RNA, of VGAM1460 are further described hereinbelow with reference to Table 1.

Nucleotide sequences of host target binding sites, such as BINDING SITE-I, BINDING SITE-II and BINDING SITE-III of FIG. 1, found on VGAM1460 host target RNA, and schematic representation of the complementarity of each of these host target binding sites to VGAM1460 RNA, herein designated VGAM RNA, are described hereinbelow with reference to Table 2.

As mentioned hereinabove with reference to FIG. 1, a function of VGAM1460 gene, herein designated VGAM is inhibition of expression of VGAM1460 target genes. It is appreciated that specific functions, and accordingly utilities, of VGAM1460 correlate with, and may be deduced from, the identity of the target genes which VGAM1460 binds and inhibits, and the function of these target genes, as elaborated hereinbelow.

KIAA0237 (Accession NM_014747) is a VGAM1460 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16441, to the nucleotide sequence of VGAM1460 RNA, herein designated VGAM RNA, also designated SEQ ID:4171.

A function of VGAM1460 is therefore inhibition of KIAA0237 (Accession NM_014747). Accordingly, utilities of VGAM1460 include diagnosis, prevention and treatment of diseases and clinical conditions associated with KIAA0237. KIAA0453 (Accession XM_044546) is another VGAM1460 host target gene. KIAA0453 BINDING SITE is HOST TARGET binding site found in the 3' untranslated region of mRNA encoded by KIAA0453, corresponding to a HOST TARGET binding site such as BINDING SITE I, BINDING SITE II or BINDING SITE III. Table 2 illustrates the complementarity of the nucleotide sequences of KIAA0453 BINDING SITE, designated SEQ ID:34229, to the nucleotide sequence of VGAM1460 RNA, herein designated VGAM RNA, also designated SEQ ID:4171.

Another function of VGAM1460 is therefore inhibition of KIAA0453 (Accession XM_044546). Accordingly, utilities of VGAM1460 include diagnosis, prevention and treatment of diseases and clinical conditions associated with KIAA0453. MGC10812 (Accession NM_031425) is another VGAM1460 host target gene. MGC10812 BINDING SITE is HOST TARGET binding site found in the 3' untranslated region of mRNA encoded by MGC10812, corresponding to a HOST TARGET binding site such as BINDING SITE I, BINDING SITE II or BINDING SITE III. Table 2 illustrates the complementarity of the nucleotide sequences of MGC10812 BINDING SITE, designated SEQ ID:25411, to the nucleotide sequence of VGAM1460 RNA, herein designated VGAM RNA, also designated SEQ ID:4171.

Another function of VGAM1460 is therefore inhibition of MGC10812 (Accession NM_031425). Accordingly, utilities of VGAM1460 include diagnosis, prevention and treatment of diseases and clinical conditions associated with MGC10812. LOC219397 (Accession XM_167889) is another VGAM1460 host target gene. LOC219397 BINDING SITE is HOST TARGET binding site found in the 3' untranslated region of mRNA encoded by LOC219397, corresponding to a HOST TARGET binding site such as BINDING SITE I, BINDING SITE II or BINDING SITE III. Table 2 illustrates the complementarity of the nucleotide sequences of LOC219397 BINDING SITE, designated SEQ ID:44899, to the nucleotide sequence of VGAM1460 RNA, herein designated VGAM RNA, also designated SEQ ID:4171.

Another function of VGAM1460 is therefore inhibition of LOC219397 (Accession XM_167889). Accordingly, utilities of VGAM1460 include diagnosis, prevention and treatment of diseases and clinical conditions associated with LOC219397. FIG. 1 further provides a conceptual description of a novel bioinformatically detected viral gene of the present invention, referred to here as Viral Genomic Address Messenger 1461 (VGAM1461) viral gene, which modulates expression of respective host target genes thereof, the function and utility of which host target genes is known in the art.

VGAM1461 is a novel bioinformatically detected regulatory, non protein coding, viral micro RNA (miRNA) gene. The method by which VGAM1461 was detected is described hereinabove with reference to FIGS. 1-8.

VGAM1461 gene, herein designated VGAM GENE, is a viral gene contained in the genome of Equine Herpesvirus 2. VGAM1461 host target gene, herein designated VGAM HOST TARGET GENE, is a human gene contained in the human genome.

VGAM1461 gene encodes a VGAM1461 precursor RNA, herein designated VGAM PRECURSOR RNA. Similar to other miRNA genes, and unlike most ordinary genes, VGAM1461 precursor RNA does not encode a protein. A nucleotide sequence identical or highly similar to the nucleotide sequence of VGAM1461 precursor RNA is designated SEQ ID:1447, and is provided hereinbelow with reference to the sequence listing part. Nucleotide sequence SEQ ID:1447 is located at position 44627 relative to the genome of Equine Herpesvirus 2.

VGAM1461 precursor RNA folds onto itself, forming VGAM1461 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1461 folded precursor RNA into VGAM1461 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1461 RNA is designated SEQ ID:4172, and is provided hereinbelow with reference to the sequence listing part.

VGAM1461 host target gene, herein designated VGAM HOST TARGET GENE, encodes a corresponding messenger RNA, VGAM1461 host target RNA, herein designated VGAM HOST TARGET RNA. VGAM1461 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1461 RNA, herein designated VGAM RNA, binds complementarily to one or more host target binding sites located in untranslated regions of VGAM1461 host target RNA, herein designated VGAM HOST TARGET RNA. This complementary binding is due to the fact that the nucleotide sequence of VGAM1461 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1461 RNA, herein designated VGAM RNA, may have a different number of host target binding sites in untranslated regions of a VGAM1461 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1461 RNA, herein designated VGAM RNA, to host target binding sites on VGAM1461 host target RNA, herein designated VGAM HOST TARGET RNA, such as BINDING SITE I, BINDING SITE II and BINDING SITE III, inhibits translation of VGAM1461 host target RNA into VGAM1461 host target protein, herein designated VGAM HOST TARGET PROTEIN. VGAM host target protein is therefore outlined by a broken line.

It is appreciated that VGAM1461 host target gene, herein designated VGAM HOST TARGET GENE, in fact represents a plurality of VGAM1461 host target genes. The mRNA of each one of this plurality of VGAM1461 host target genes comprises one or more host target binding sites, each having a nucleotide sequence which is at least partly complementary to VGAM1461 RNA, herein designated VGAM RNA, and which when bound by VGAM1461 RNA causes inhibition of translation of respective one or more VGAM1461 host target proteins.

It is further appreciated by one skilled in the art that the mode of translational inhibition illustrated by FIG. 1 with specific reference to translational inhibition exerted by VGAM1461 gene, herein designated VGAM GENE, on one or more VGAM1461 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1461 is inhibition of expression of host target genes, as part of a novel viral mechanism of attacking a host. Accordingly, utilities of VGAM1461 include diagnosis, prevention and treatment of viral infection by Equine Herpesvirus 2. Specific functions, and accordingly utilities, of VGAM1461 correlate with, and may be deduced from, the identity of the host target genes which VGAM1461 binds and inhibits, and the function of these host target genes, as elaborated hereinbelow.

Nucleotide sequences of the VGAM1461 precursor RNA, herein designated VGAM PRECURSOR RNA, and of the 'diced' VGAM1461 RNA, herein designated VGAM RNA, and a schematic representation of the secondary folding of VGAM1461 folded precursor RNA, herein designated VGAM FOLDED PRECURSOR RNA, of VGAM1461 are further described hereinbelow with reference to Table 1.

Nucleotide sequences of host target binding sites, such as BINDING SITE-I, BINDING SITE-II and BINDING SITE-III of FIG. 1, found on VGAM1461 host target RNA, and schematic representation of the complementarity of each of these host target binding sites to VGAM1461 RNA, herein designated VGAM RNA, are described hereinbelow with reference to Table 2.

As mentioned hereinabove with reference to FIG. 1, a function of VGAM1461 gene, herein designated VGAM is inhibition of expression of VGAM1461 target genes. It is appreciated that specific functions, and accordingly utilities, of VGAM1461 correlate with, and may be deduced from, the identity of the target genes which VGAM1461 binds and inhibits, and the function of these target genes, as elaborated hereinbelow.

Membrane-spanning 4-domains, Subfamily A, Member 3 (hematopoietic cell-specific) (MS4A3, Accession NM_006138) is a VGAM1461 host target gene. MS4A3 BINDING SITE is HOST TARGET binding site found in the 3' untranslated region of mRNA encoded by MS4A3, corresponding to a HOST TARGET binding site such as BINDING SITE I, BINDING SITE II or BINDING SITE III. Table 2 illustrates the complementarity of the nucleotide sequences of MS4A3 BINDING SITE, designated SEQ ID:12777, to the nucleotide sequence of VGAM1461 RNA, herein designated VGAM RNA, also designated SEQ ID:4172.

A function of VGAM1461 is therefore inhibition of Membrane-spanning 4-domains, Subfamily A, Member 3 (hematopoietic cell-specific) (MS4A3, Accession NM_006138). Accordingly, utilities of VGAM1461 include diagnosis, prevention and treatment of diseases and clinical conditions associated with MS4A3. FIG. 1 further provides a conceptual description of a novel bioinformatically detected viral gene of the present invention, referred to here as Viral Genomic Address Messenger 1462 (VGAM1462) viral gene, which modulates expression of respective host target genes thereof, the function and utility of which host target genes is known in the art.

VGAM1462 is a novel bioinformatically detected regulatory, non protein coding, viral micro RNA (miRNA) gene. The method by which VGAM1462 was detected is described hereinabove with reference to FIGS. 1-8.

VGAM1462 gene, herein designated VGAM GENE, is a viral gene contained in the genome of Equine Herpesvirus 2. VGAM1462 host target gene, herein designated VGAM HOST TARGET GENE, is a human gene contained in the human genome.

VGAM1462 gene encodes a VGAM1462 precursor RNA, herein designated VGAM PRECURSOR RNA. Similar to other miRNA genes, and unlike most ordinary genes, VGAM1462 precursor RNA does not encode a protein. A nucleotide sequence identical or highly similar to the nucleotide sequence of VGAM1462 precursor RNA is designated SEQ ID:1448, and is provided hereinbelow with reference to the sequence listing part. Nucleotide sequence SEQ ID:1448 is located at position 40327 relative to the genome of Equine Herpesvirus 2.

VGAM1462 precursor RNA folds onto itself, forming VGAM1462 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1462 folded precursor RNA into VGAM1462 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1462 RNA is designated SEQ ID:4173, and is provided hereinbelow with reference to the sequence listing part.

VGAM1462 host target gene, herein designated VGAM HOST TARGET GENE, encodes a corresponding messenger RNA, VGAM1462 host target RNA, herein designated VGAM HOST TARGET RNA. VGAM1462 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1462 RNA, herein designated VGAM RNA, binds complementarily to one or more host target binding sites located in untranslated regions of VGAM1462 host target RNA, herein designated VGAM HOST TARGET RNA. This complementary binding is due to the fact that the nucleotide sequence of VGAM1462 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1462 RNA, herein designated VGAM RNA, may have a different number of host target binding sites in untranslated regions of a VGAM1462 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1462 RNA, herein designated VGAM RNA, to host target binding sites on VGAM1462 host target RNA, herein designated VGAM HOST TARGET RNA, such as BINDING SITE I, BINDING SITE II and BINDING SITE III, inhibits translation of VGAM1462 host target RNA into VGAM1462 host target protein, herein designated VGAM HOST TARGET PROTEIN. VGAM host target protein is therefore outlined by a broken line.

It is appreciated that VGAM1462 host target gene, herein designated VGAM HOST TARGET GENE, in fact represents a plurality of VGAM1462 host target genes. The mRNA of each one of this plurality of VGAM1462 host target genes comprises one or more host target binding sites, each having a nucleotide sequence which is at least partly complementary to VGAM1462 RNA, herein designated VGAM RNA, and which when bound by VGAM1462 RNA causes inhibition of translation of respective one or more VGAM1462 host target proteins.

It is further appreciated by one skilled in the art that the mode of translational inhibition illustrated by FIG. 1 with specific reference to translational inhibition exerted by VGAM1462 gene, herein designated VGAM GENE, on one or more VGAM1462 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1462 is inhibition of expression of host target genes, as part of a novel viral mechanism of attacking a host. Accordingly, utilities of VGAM1462 include diagnosis, prevention and treatment of viral infection by Equine Herpesvirus 2. Specific functions, and accordingly utilities, of VGAM1462 correlate with, and may be deduced from, the identity of the host target genes which VGAM1462 binds and inhibits, and the function of these host target genes, as elaborated hereinbelow.

Nucleotide sequences of the VGAM1462 precursor RNA, herein designated VGAM PRECURSOR RNA, and of the 'diced' VGAM1462 RNA, herein designated VGAM RNA, and a schematic representation of the secondary folding of VGAM1462 folded precursor RNA, herein designated VGAM FOLDED PRECURSOR RNA, of VGAM1462 are further described hereinbelow with reference to Table 1.

Nucleotide sequences of host target binding sites, such as BINDING SITE-I, BINDING SITE-II and BINDING SITE-III of FIG. 1, found on VGAM1462 host target RNA, and schematic representation of the complementarity of each of these host target binding sites to VGAM1462 RNA, herein designated VGAM RNA, are described hereinbelow with reference to Table 2.

As mentioned hereinabove with reference to FIG. 1, a function of VGAM1462 gene, herein designated VGAM is inhibition of expression of VGAM1462 target genes. It is appreciated that specific functions, and accordingly utilities, of VGAM1462 correlate with, and may be deduced from, the identity of the target genes which VGAM1462 binds and inhibits, and the function of these target genes, as elaborated hereinbelow.

Phosphodiesterase 4D, CAMP-specific (phosphodiesterase E3 dunce homolog, Drosophila) (PDE4D, Accession XM_056815) is a VGAM1462 host target gene. PDE4D BINDING SITE is HOST TARGET binding site found in the 3' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36437, to the nucleotide sequence of VGAM1462 RNA, herein designated VGAM RNA, also designated SEQ ID:4173.

A function of VGAM1462 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM1462 include diagnosis, prevention and treatment of diseases and clinical conditions associated with PDE4D. The function of PDE4D and its association with various diseases and clinical conditions, has been established by previous studies, as described hereinabove with reference to VGAM180. Protein Phosphatase 1, Regulatory (inhibitor) Subunit 8 (PPP1R8, Accession NM_138558) is another VGAM1462 host target gene. PPP1R8 BINDING SITE1 through PPP1R8 BINDING SITE3 are HOST TARGET binding sites found in untranslated regions of mRNA encoded by PPP1R8, corresponding to HOST TARGET binding sites such as BINDING SITE I, BINDING SITE II or BINDING SITE III. Table 2 illustrates the complementarity of the nucleotide sequences of PPP1R8 BINDING SITE1 through PPP1R8 BINDING SITE3, designated SEQ ID:28855, SEQ ID:8569 and SEQ ID:15339 respectively, to the nucleotide sequence of VGAM1462 RNA, herein designated VGAM RNA, also designated SEQ ID:4173.

Another function of VGAM1462 is therefore inhibition of Protein Phosphatase 1, Regulatory (inhibitor) Subunit 8 (PPP1R8, Accession NM_138558), a gene which is an inhibitor subunit of the major nuclear protein phosphatase-1 (pp-1). Accordingly, utilities of VGAM1462 include diagnosis, prevention and treatment of diseases and clinical conditions associated with PPP1R8. The function of PPP1R8 and its association with various diseases and clinical conditions, has been established by previous studies, as described hereinabove with reference to VGAM101. KIAA0603 (Accession NM_014832) is another VGAM1462 host target gene. KIAA0603 BINDING SITE is HOST TARGET binding site found in the 3' untranslated region of mRNA encoded by KIAA0603, corresponding to a HOST TARGET binding site such as BINDING SITE I, BINDING SITE II or BINDING SITE III. Table 2 illustrates the complementarity of the nucleotide sequences of KIAA0603 BINDING SITE, designated SEQ ID:16828, to the nucleotide sequence of VGAM1462 RNA, herein designated VGAM RNA, also designated SEQ ID:4173.

Another function of VGAM1462 is therefore inhibition of KIAA0603 (Accession NM_014832). Accordingly, utilities of VGAM1462 include diagnosis, prevention and treatment of diseases and clinical conditions associated with KIAA0603. MEGF10 (Accession NM_032446) is another VGAM1462 host target gene. MEGF10 BINDING SITE is HOST TARGET binding site found in the 3' untranslated region of mRNA encoded by MEGF10, corresponding to a HOST TARGET binding site such as BINDING SITE I, BINDING SITE II or BINDING SITE III. Table 2 illustrates the complementarity of the nucleotide sequences of MEGF10 BINDING SITE, designated SEQ ID:26208, to the nucleotide sequence of VGAM1462 RNA, herein designated VGAM RNA, also designated SEQ ID:4173.

Another function of VGAM1462 is therefore inhibition of MEGF10 (Accession NM_032446). Accordingly, utilities of VGAM1462 include diagnosis, prevention and treatment of diseases and clinical conditions associated with MEGF10. MGC13008 (Accession NM_032686) is another VGAM1462 host target gene. MGC13008 BINDING SITE is HOST TARGET binding site found in the 5' untranslated region of mRNA encoded by MGC13008, corresponding to a HOST TARGET binding site such as BINDING SITE I, BINDING SITE II or BINDING SITE III. Table 2 illustrates the complementarity of the nucleotide sequences of MGC13008 BINDING SITE, designated SEQ ID:26406, to the nucleotide sequence of VGAM1462 RNA, herein designated VGAM RNA, also designated SEQ ID:4173.

Another function of VGAM1462 is therefore inhibition of MGC13008 (Accession NM_032686). Accordingly, utilities of VGAM1462 include diagnosis, prevention and treatment of diseases and clinical conditions associated with MGC13008. MGC14156 (Accession NM_032906) is another VGAM1462 host target gene. MGC14156 BINDING SITE is HOST TARGET binding site found in the 3' untranslated region of mRNA encoded by MGC14156, corresponding to a HOST TARGET binding site such as BINDING SITE I, BINDING SITE II or BINDING SITE III. Table 2 illustrates the complementarity of the nucleotide sequences of MGC14156 BINDING SITE, designated SEQ ID:26727, to the nucleotide sequence of VGAM1462 RNA, herein designated VGAM RNA, also designated SEQ ID:4173.

Another function of VGAM1462 is therefore inhibition of MGC14156 (Accession NM_032906). Accordingly, utilities of VGAM1462 include diagnosis, prevention and treatment of diseases and clinical conditions associated with MGC14156. Protocadherin 10 (PCDH10, Accession NM_032961) is another VGAM1462 host target gene. PCDH10 BINDING SITE1 and PCDH10 BINDING SITE2 are HOST TARGET binding sites found in untranslated regions of mRNA encoded by PCDH10, corresponding to HOST TARGET binding sites such as BINDING SITE I, BINDING SITE II or BINDING SITE III. Table 2 illustrates the complementarity of the nucleotide sequences of PCDH10 BINDING SITE1 and PCDH10 BINDING SITE2, designated SEQ ID:26768 and SEQ ID:21883 respectively, to the nucleotide sequence of VGAM1462 RNA, herein designated VGAM RNA, also designated SEQ ID:4173.

Another function of VGAM1462 is therefore inhibition of Protocadherin 10 (PCDH10, Accession NM_032961). Accordingly, utilities of VGAM1462 include diagnosis, prevention and treatment of diseases and clinical conditions associated with PCDH10. LOC142893 (Accession XM_096354) is another VGAM1462 host target gene. LOC142893 BINDING SITE is HOST TARGET binding site found in the 5' untranslated region of mRNA encoded by LOC142893, corresponding to a HOST TARGET binding site such as BINDING SITE I, BINDING SITE II or BINDING SITE III. Table 2 illustrates the complementarity of the nucleotide sequences of LOC142893 BINDING SITE, designated SEQ ID:40321, to the nucleotide sequence of VGAM1462 RNA, herein designated VGAM RNA, also designated SEQ ID:4173.

Another function of VGAM1462 is therefore inhibition of LOC142893 (Accession XM_096354). Accordingly, utilities of VGAM1462 include diagnosis, prevention and treatment of diseases and clinical conditions associated with LOC142893. LOC148545 (Accession XM_086226) is another VGAM1462 host target gene. LOC148545 BINDING SITE is HOST TARGET binding site found in the 3' untranslated region of mRNA encoded by LOC148545, corresponding to a HOST TARGET binding site such as BINDING SITE I, BINDING SITE II or BINDING SITE III. Table 2 illustrates the complementarity of the nucleotide sequences of LOC148545 BINDING SITE, designated SEQ ID:38554, to the nucleotide sequence of VGAM1462 RNA, herein designated VGAM RNA, also designated SEQ ID:4173.

Another function of VGAM1462 is therefore inhibition of LOC148545 (Accession XM_086226). Accordingly, utilities of VGAM1462 include diagnosis, prevention and treatment of diseases and clinical conditions associated with LOC148545. LOC150170 (Accession XM_086799) is another VGAM1462 host target gene. LOC150170 BINDING SITE is HOST TARGET binding site found in the 5' untranslated region of mRNA encoded by LOC150170, corresponding to a HOST TARGET binding site such as BINDING SITE I, BINDING SITE II or BINDING SITE III. Table 2 illustrates the complementarity of the nucleotide sequences of LOC150170 BINDING SITE, designated SEQ ID:38862, to the nucleotide sequence of VGAM1462 RNA, herein designated VGAM RNA, also designated SEQ ID:4173.

Another function of VGAM1462 is therefore inhibition of LOC150170 (Accession XM_086799). Accordingly, utilities of VGAM1462 include diagnosis, prevention and treatment of diseases and clinical conditions associated with LOC150170. LOC150175 (Accession XM_086806) is another VGAM1462 host target gene. LOC150175 BINDING SITE is HOST TARGET binding site found in the 5' untranslated region of mRNA encoded by LOC150175, corresponding to a HOST TARGET binding site such as BINDING SITE I, BINDING SITE II or BINDING SITE III. Table 2 illustrates the complementarity of the nucleotide sequences of LOC150175 BINDING SITE, designated SEQ ID:38884, to the nucleotide sequence of VGAM1462 RNA, herein designated VGAM RNA, also designated SEQ ID:4173.

Another function of VGAM1462 is therefore inhibition of LOC150175 (Accession XM_086806). Accordingly, utilities of VGAM1462 include diagnosis, prevention and treatment of diseases and clinical conditions associated with LOC150175. LOC150215 (Accession XM_086813) is another VGAM1462 host target gene. LOC150215 BINDING SITE is HOST TARGET binding site found in the 5' untranslated region of mRNA encoded by LOC150215, corresponding to a HOST TARGET binding site such as BINDING SITE I, BINDING SITE II or BINDING SITE III. Table 2 illustrates the complementarity of the nucleotide sequences of LOC150215 BINDING SITE, designated SEQ ID:38888, to the nucleotide sequence of VGAM1462 RNA, herein designated VGAM RNA, also designated SEQ ID:4173.

Another function of VGAM1462 is therefore inhibition of LOC150215 (Accession XM_086813). Accordingly, utilities of VGAM1462 include diagnosis, prevention and treatment of diseases and clinical conditions associated with LOC150215. LOC150218 (Accession XM_086850) is another VGAM1462 host target gene. LOC150218 BINDING SITE is HOST TARGET binding site found in the 5' untranslated region of mRNA encoded by LOC150218, corresponding to a HOST TARGET binding site such as BINDING SITE I, BINDING SITE II or BINDING SITE III. Table 2 illustrates the complementarity of the nucleotide sequences of LOC150218 BINDING SITE, designated SEQ ID:38915, to the nucleotide sequence of VGAM1462 RNA, herein designated VGAM RNA, also designated SEQ ID:4173.

Another function of VGAM1462 is therefore inhibition of LOC150218 (Accession XM_086850). Accordingly, utilities of VGAM1462 include diagnosis, prevention and treatment of diseases and clinical conditions associated with LOC150218. FIG. 1 further provides a conceptual description of a novel bioinformatically detected viral gene of the present invention, referred to here as Viral Genomic Address Messenger 1463 (VGAM1463) viral gene, which modulates expression of respective host target genes thereof, the function and utility of which host target genes is known in the art.

VGAM1463 is a novel bioinformatically detected regulatory, non protein coding, viral micro RNA (miRNA) gene. The method by which VGAM1463 was detected is described hereinabove with reference to FIGS. 1-8.

VGAM1463 gene, herein designated VGAM GENE, is a viral gene contained in the genome of Equine Herpesvirus 2. VGAM1463 host target gene, herein designated VGAM HOST TARGET GENE, is a human gene contained in the human genome.

VGAM1463 gene encodes a VGAM1463 precursor RNA, herein designated VGAM PRECURSOR RNA. Similar to other miRNA genes, and unlike most ordinary genes, VGAM1463 precursor RNA does not encode a protein. A nucleotide sequence identical or highly similar to the nucleotide sequence of VGAM1463 precursor RNA is designated SEQ ID:1449, and is provided hereinbelow with reference to the sequence listing part. Nucleotide sequence SEQ ID:1449 is located at position 38131 relative to the genome of Equine Herpesvirus 2.

VGAM1463 precursor RNA folds onto itself, forming VGAM1463 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1463 folded precursor RNA into VGAM1463 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1463 RNA is designated SEQ ID:4174, and is provided hereinbelow with reference to the sequence listing part.

VGAM1463 host target gene, herein designated VGAM HOST TARGET GENE, encodes a corresponding messenger RNA, VGAM1463 host target RNA, herein designated VGAM HOST TARGET RNA. VGAM1463 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1463 RNA, herein designated VGAM RNA, binds complementarily to one or more host target binding sites located in untranslated regions of VGAM1463 host target RNA, herein designated VGAM HOST TARGET RNA. This complementary binding is due to the fact that the nucleotide sequence of VGAM1463 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1463 RNA, herein designated VGAM RNA, may have a different number of host target binding sites in untranslated regions of a VGAM1463 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1463 RNA, herein designated VGAM RNA, to host target binding sites on VGAM1463 host target RNA, herein designated VGAM HOST TARGET RNA, such as BINDING SITE I, BINDING SITE II and BINDING SITE III, inhibits translation of VGAM1463 host target RNA into VGAM1463 host target protein, herein designated VGAM HOST TARGET PROTEIN. VGAM host target protein is therefore outlined by a broken line.

It is appreciated that VGAM1463 host target gene, herein designated VGAM HOST TARGET GENE, in fact represents a plurality of VGAM1463 host target genes. The mRNA of each one of this plurality of VGAM1463 host target genes comprises one or more host target binding sites, each having a nucleotide sequence which is at least partly complementary to VGAM1463 RNA, herein designated VGAM RNA, and which when bound by VGAM1463 RNA causes inhibition of translation of respective one or more VGAM1463 host target proteins.

It is further appreciated by one skilled in the art that the mode of translational inhibition illustrated by FIG. 1 with specific reference to translational inhibition exerted by VGAM1463 gene, herein designated VGAM GENE, on one or more VGAM1463 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1463 is inhibition of expression of host target genes, as part of a novel viral mechanism of attacking a host. Accordingly, utilities of VGAM1463 include diagnosis, prevention and treatment of viral infection by Equine Herpesvirus 2. Specific functions, and accordingly utilities, of VGAM1463 correlate with, and may be deduced from, the identity of the host target genes which VGAM1463 binds and inhibits, and the function of these host target genes, as elaborated hereinbelow.

Nucleotide sequences of the VGAM1463 precursor RNA, herein designated VGAM PRECURSOR RNA, and of the 'diced' VGAM1463 RNA, herein designated VGAM RNA, and a schematic representation of the secondary folding of VGAM1463 folded precursor RNA, herein designated VGAM FOLDED PRECURSOR RNA, of VGAM1463 are further described hereinbelow with reference to Table 1.

Nucleotide sequences of host target binding sites, such as BINDING SITE-I, BINDING SITE-II and BINDING SITE-III of FIG. 1, found on VGAM1463 host target RNA, and schematic representation of the complementarity of each of these host target binding sites to VGAM1463 RNA, herein designated VGAM RNA, are described hereinbelow with reference to Table 2.

As mentioned hereinabove with reference to FIG. 1, a function of VGAM1463 gene, herein designated VGAM is inhibition of expression of VGAM1463 target genes. It is appreciated that specific functions, and accordingly utilities, of VGAM1463 correlate with, and may be deduced from, the identity of the target genes which VGAM1463 binds and inhibits, and the function of these target genes, as elaborated hereinbelow.

Death Associated Transcription Factor 1 (DATF1, Accession NM_022105) is a VGAM1463 host target gene. DATF1 BINDING SITE1 and DATF1 BINDING SITE2 are HOST TARGET binding sites found in untranslated regions of mRNA encoded by DATF1, corresponding to HOST TARGET binding sites such as BINDING SITE I, BINDING SITE II or BINDING SITE III. Table 2 illustrates the complementarity of the nucleotide sequences of DATF1 BINDING SITE1 and DATF1 BINDING SITE2, designated SEQ ID:22650 and SEQ ID:28061 respectively, to the nucleotide sequence of VGAM1463 RNA, herein designated VGAM RNA, also designated SEQ ID:4174.

A function of VGAM1463 is therefore inhibition of Death Associated Transcription Factor 1 (DATF1, Accession NM_022105). Accordingly, utilities of VGAM1463 include diagnosis, prevention and treatment of diseases and clinical conditions associated with DATF1. KIAA0014 (Accession NM_014665) is another VGAM1463 host target gene. KIAA0014 BINDING SITE is HOST TARGET binding site found in the 3' untranslated region of mRNA encoded by KIAA0014, corresponding to a HOST TARGET binding site such as BINDING SITE I, BINDING SITE II or BINDING SITE III. Table 2 illustrates the complementarity of the nucleotide sequences of KIAA0014 BINDING SITE, designated SEQ ID:16112, to the nucleotide sequence of VGAM1463 RNA, herein designated VGAM RNA, also designated SEQ ID:4174.

Another function of VGAM1463 is therefore inhibition of KIAA0014 (Accession NM_014665). Accordingly, utilities of VGAM1463 include diagnosis, prevention and treatment of diseases and clinical conditions associated with KIAA0014. LOC158156 (Accession XM_088496) is another VGAM1463 host target gene. LOC158156 BINDING SITE is HOST TARGET binding site found in the 3' untranslated region of mRNA encoded by LOC158156, corresponding to a HOST TARGET binding site such as BINDING SITE I, BINDING SITE II or BINDING SITE III. Table 2 illustrates the complementarity of the nucleotide sequences of LOC158156 BINDING SITE, designated SEQ ID:39736, to the nucleotide sequence of VGAM1463 RNA, herein designated VGAM RNA, also designated SEQ ID:4174.

Another function of VGAM1463 is therefore inhibition of LOC158156 (Accession XM_088496). Accordingly, utilities of VGAM1463 include diagnosis, prevention and treatment of diseases and clinical conditions associated with LOC158156. FIG. 1 further provides a conceptual description of a novel bioinformatically detected viral gene of the present invention, referred to here as Viral Genomic Address Messenger 1464 (VGAM1464) viral gene, which modulates expression of respective host target genes thereof, the function and utility of which host target genes is known in the art.

VGAM1464 is a novel bioinformatically detected regulatory, non protein coding, viral micro RNA (miRNA) gene. The method by which VGAM1464 was detected is described hereinabove with reference to FIGS. 1-8.

VGAM1464 gene, herein designated VGAM GENE, is a viral gene contained in the genome of Equine Herpesvirus 2. VGAM1464 host target gene, herein designated VGAM HOST TARGET GENE, is a human gene contained in the human genome.

VGAM1464 gene encodes a VGAM1464 precursor RNA, herein designated VGAM PRECURSOR RNA. Similar to other miRNA genes, and unlike most ordinary genes, VGAM1464 precursor RNA does not encode a protein. A nucleotide sequence identical or highly similar to the nucleotide sequence of VGAM1464 precursor RNA is designated SEQ ID:1450, and is provided hereinbelow with reference to the sequence listing part. Nucleotide sequence SEQ ID:1450 is located at position 42592 relative to the genome of Equine Herpesvirus 2.

VGAM1464 precursor RNA folds onto itself, forming VGAM1464 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1464 folded precursor RNA into VGAM1464 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM1464 RNA is designated SEQ ID:4175, and is provided hereinbelow with reference to the sequence listing part.

VGAM1464 host target gene, herein designated VGAM HOST TARGET GENE, encodes a corresponding messenger RNA, VGAM1464 host target RNA, herein designated VGAM HOST TARGET RNA. VGAM1464 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1464 RNA, herein designated VGAM RNA, binds complementarily to one or more host target binding sites located in untranslated regions of VGAM1464 host target RNA, herein designated VGAM HOST TARGET RNA. This complementary binding is due to the fact that the nucleotide sequence of VGAM1464 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1464 RNA, herein designated VGAM RNA, may have a different number of host target binding sites in untranslated regions of a VGAM1464 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1464 RNA, herein designated VGAM RNA, to host target binding sites on VGAM1464 host target RNA, herein designated VGAM HOST TARGET RNA, such as BINDING SITE I, BINDING SITE II and BINDING SITE III, inhibits translation of VGAM1464 host target RNA into VGAM1464 host target protein, herein designated VGAM HOST TARGET PROTEIN. VGAM host target protein is therefore outlined by a broken line.

It is appreciated that VGAM1464 host target gene, herein designated VGAM HOST TARGET GENE, in fact represents a plurality of VGAM1464 host target genes. The mRNA of each one of this plurality of VGAM1464 host target genes comprises one or more host target binding sites, each having a nucleotide sequence which is at least partly complementary to VGAM1464 RNA, herein designated VGAM RNA, and which when bound by VGAM1464 RNA causes inhibition of translation of respective one or more VGAM1464 host target proteins.

It is further appreciated by one skilled in the art that the mode of translational inhibition illustrated by FIG. 1 with specific reference to translational inhibition exerted by VGAM1464 gene, herein designated VGAM GENE, on one or more VGAM1464 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1464 is inhibition of expression of host target genes, as part of a novel viral mechanism of attacking a host. Accordingly, utilities of VGAM1464 include diagnosis, prevention and treatment of viral infection by Equine Herpesvirus 2. Specific functions, and accordingly utilities, of VGAM1464 correlate with, and may be deduced from, the identity of the host target genes which VGAM1464 binds and inhibits, and the function of these host target genes, as elaborated hereinbelow.

Nucleotide sequences of the VGAM1464 precursor RNA, herein designated VGAM PRECURSOR RNA, and of the 'diced' VGAM1464 RNA, herein designated VGAM RNA, and a schematic representation of the secondary folding of VGAM1464 folded precursor RNA, herein designated VGAM FOLDED PRECURSOR RNA, of VGAM1464 are further described hereinbelow with reference to Table 1.

Nucleotide sequences of host target binding sites, such as BINDING SITE-I, BINDING SITE-II and BINDING SITE-III of FIG. 1, found on VGAM1464 host target RNA, and schematic representation of the complementarity of each of these host target binding sites to VGAM1464 RNA, herein designated VGAM RNA, are described hereinbelow with reference to Table 2.

As mentioned hereinabove with reference to FIG. 1, a function of VGAM1464 gene, herein designated VGAM is inhibition of expression of VGAM1464 target genes. It is appreciated that specific functions, and accordingly utilities, of VGAM1464 correlate with, and may be deduced from, the identity of the target genes which VGAM1464 binds and inhibits, and the function of these target genes, as elaborated hereinbelow.

Citron (rho-interacting, serine/threonine kinase 21) (CIT, Accession XM_045786) is a VGAM1464 host target gene. CIT BINDING SITE is HOST TARGET binding site found in the 3' untranslated region of mRNA encoded by CIT, corresponding to a HOST TARGET binding site such as BINDING SITE I, BINDING SITE II or BINDING SITE III. Table 2 illustrates the complementarity of the nucleotide sequences of CIT BINDING SITE, designated SEQ ID:34566, to the nucleotide sequence of VGAM1464 RNA, herein designated VGAM RNA, also designated SEQ ID:4175.

A function of VGAM1464 is therefore inhibition of Citron (rho-interacting, serine/threonine kinase 21) (CIT, Accession XM_045786), a gene which is increased several-fold by coexpression of constitutively active Rho . Accordingly, utilities of VGAM1464 include diagnosis, prevention and treatment of diseases and clinical conditions associated with CIT. The function of CIT and its association with various diseases and clinical conditions, has been established by previous studies, as described hereinabove with reference to VGAM393. Death Effector Domain Containing (DEDD, Accession NM_032998) is another VGAM1464 host target gene. DEDD BINDING SITE is HOST TARGET binding site found in the 3' untranslated region of mRNA encoded by DEDD, corresponding to a HOST TARGET binding site such as BINDING SITE I, BINDING SITE II or BINDING SITE III. Table 2 illustrates the complementarity of the nucleotide sequences of DEDD BINDING SITE, designated SEQ ID:26880, to the nucleotide sequence of VGAM1464 RNA, herein designated VGAM RNA, also designated SEQ ID:4175.

Another function of VGAM1464 is therefore inhibition of Death Effector Domain Containing (DEDD, Accession NM_032998), a gene which intervenes in apoptosis. Accordingly, utilities of VGAM1464 include diagnosis, prevention and treatment of diseases and clinical conditions associated with DEDD. The function of DEDD and its association with various diseases and clinical conditions, has been established by previous studies, as described hereinabove with reference to VGAM1189. Nuclear Mitotic Apparatus Protein 1 (NUMA1, Accession XM_167853) is another VGAM1464 host target gene. NUMA1 BINDING SITE is HOST TARGET binding site found in the 3' untranslated region of mRNA encoded by NUMA1, corresponding to a HOST TARGET binding site such as BINDING SITE I, BINDING SITE II or BINDING SITE III. Table 2 illustrates the complementarity of the nucleotide sequences of NUMA1 BINDING SITE, designated SEQ ID:44882, to the nucleotide sequence of VGAM1464 RNA, herein designated VGAM RNA, also designated SEQ ID:4175.

Another function of VGAM1464 is therefore inhibition of Nuclear Mitotic Apparatus Protein 1 (NUMA1, Accession XM_167853), a gene which is nuclear mitotic apparatus protein. Accordingly, utilities of VGAM1464 include diagnosis, prevention and treatment of diseases and clinical conditions associated with NUMA1. The function of NUMA1 and its association with various diseases and clinical conditions, has been established by previous studies, as described hereinabove with reference to VGAM192. FLJ10916 (Accession NM_018271) is another VGAM1464 host target gene. FLJ10916 BINDING SITE is HOST TARGET binding site found in the 5' untranslated region of mRNA encoded by FLJ10916, corresponding to a HOST TARGET binding site such as BINDING SITE I, BINDING SITE II or BINDING SITE III. Table 2 illustrates the complementarity of the nucleotide sequences of FLJ10916 BINDING SITE, designated SEQ ID:20249, to the nucleotide sequence of VGAM1464 RNA, herein designated VGAM RNA, also designated SEQ ID:4175.

Another function of VGAM1464 is therefore inhibition of FLJ10916 (Accession NM_018271). Accordingly, utilities of VGAM1464 include diagnosis, prevention and treatment of diseases and clinical conditions associated with FLJ10916. FLJ20584 (Accession NM_017891) is another VGAM1464 host target gene. FLJ20584 BINDING SITE is HOST TARGET binding site found in the 3' untranslated region of mRNA encoded by FLJ20584, corresponding to a HOST TARGET binding site such as BINDING SITE I, BINDING SITE II or BINDING SITE III. Table 2 illustrates the complementarity of the nucleotide sequences of FLJ20584 BINDING SITE, designated SEQ ID:19559, to the nucleotide sequence of VGAM1464 RNA, herein designated VGAM RNA, also designated SEQ ID:4175.

Another function of VGAM1464 is therefore inhibition of FLJ20584 (Accession NM_017891). Accordingly, utilities of VGAM1464 include diagnosis, prevention and treatment of diseases and clinical conditions associated with FLJ20584. KIAA1508 (Accession XM_030209) is another VGAM1464 host target gene. KIAA1508 BINDING SITE is HOST TARGET binding site found in the 3' untranslated region of mRNA encoded by KIAA1508, corresponding to a HOST TARGET binding site such as BINDING SITE I, BINDING SITE II or BINDING SITE III. Table 2 illustrates the complementarity of the nucleotide sequences of KIAA1508 BIND- ING SITE, designated SEQ ID:30995, to the nucleotide sequence of VGAM1464 RNA, herein designated VGAM RNA, also designated SEQ ID:4175.

Another function of VGAM1464 is therefore inhibition of KIAA1508 (Accession XM_030209). Accordingly, utilities of VGAM1464 include diagnosis, prevention and treatment of diseases and clinical conditions associated with KIAA1508. MGC2705 (Accession NM_032701) is another VGAM1464 host target gene. MGC2705 BINDING SITE is HOST TARGET binding site found in the 5' untranslated region of mRNA encoded by MGC2705, corresponding to a HOST TARGET binding site such as BINDING SITE I, BINDING SITE II or BINDING SITE III. Table 2 illustrates the complementarity of the nucleotide sequences of MGC2705 BINDING SITE, designated SEQ ID:26414, to the nucleotide sequence of VGAM1464 RNA, herein designated VGAM RNA, also designated SEQ ID:4175.

Another function of VGAM1464 is therefore inhibition of MGC2705 (Accession NM_032701). Accordingly, utilities of VGAM1464 include diagnosis, prevention and treatment of diseases and clinical conditions associated with MGC2705. Placenta-specific 3 (PLAC3, Accession XM_045115) is another VGAM1464 host target gene. PLAC3 BINDING SITE is HOST TARGET binding site found in the 5' untranslated region of mRNA encoded by PLAC3, corresponding to a HOST TARGET binding site such as BINDING SITE I, BINDING SITE II or BINDING SITE III. Table 2 illustrates the complementarity of the nucleotide sequences of PLAC3 BINDING SITE, designated SEQ ID:34364, to the nucleotide sequence of VGAM1464 RNA, herein designated VGAM RNA, also designated SEQ ID:4175.

Another function of VGAM1464 is therefore inhibition of Placenta-specific 3 (PLAC3, Accession XM_045115). Accordingly, utilities of VGAM1464 include diagnosis, prevention and treatment of diseases and clinical conditions associated with PLAC3. LOC149837 (Accession XM_097747) is another VGAM1464 host target gene. LOC149837 BINDING SITE is HOST TARGET binding site found in the 3' untranslated region of mRNA encoded by LOC149837, corresponding to a HOST TARGET binding site such as BINDING SITE I, BINDING SITE II or BINDING SITE III. Table 2 illustrates the complementarity of the nucleotide sequences of LOC149837 BINDING SITE, designated SEQ ID:41098, to the nucleotide sequence of VGAM1464 RNA, herein designated VGAM RNA, also designated SEQ ID:4175.

Another function of VGAM1464 is therefore inhibition of LOC149837 (Accession XM_097747). Accordingly, utilities of VGAM1464 include diagnosis, prevention and treatment of diseases and clinical conditions associated with LOC149837. LOC51292 (Accession NM_016576) is another VGAM1464 host target gene. LOC51292 BINDING SITE is HOST TARGET binding site found in the 5' untranslated region of mRNA encoded by LOC51292, corresponding to a HOST TARGET binding site such as BINDING SITE I, BINDING SITE II or BINDING SITE III. Table 2 illustrates the complementarity of the nucleotide sequences of LOC51292 BINDING SITE, designated SEQ ID:18652, to the nucleotide sequence of VGAM1464 RNA, herein designated VGAM RNA, also designated SEQ ID:4175.

Another function of VGAM1464 is therefore inhibition of LOC51292 (Accession NM_016576). Accordingly, utilities of VGAM1464 include diagnosis, prevention and treatment of diseases and clinical conditions associated with LOC51292. FIG. 1 further provides a conceptual description of a novel bioinformatically detected viral gene of the present invention, referred to here as Viral Genomic Address Messenger 1465 (VGAM1465) viral gene, which modulates expression of respective host target genes thereof, the function and utility of which host target genes is known in the art.

VGAM1465 is a novel bioinformatically detected regulatory, non protein coding, viral micro RNA (miRNA) gene. The method by which VGAM1465 was detected is described hereinabove with reference to FIGS. 1-8.

VGAM1465 gene, herein designated VGAM GENE, is a viral gene contained in the genome of Equine Herpesvirus 2. VGAM1465 host target gene, herein designated VGAM HOST TARGET GENE, is a human gene contained in the human genome.

VGAM1465 gene encodes a VGAM1465 precursor RNA, herein designated VGAM PRECURSOR RNA. Similar to other miRNA genes, and unlike most ordinary genes, VGAM1465 precursor RNA does not encode a protein. A nucleotide sequence identical or highly similar to the nucleotide sequence of VGAM1465 precursor RNA is designated SEQ ID:1451, and is provided hereinbelow with reference to the sequence listing part. Nucleotide sequence SEQ ID:1451 is located at position 40669 relative to the genome of Equine Herpesvirus 2.

VGAM1465 precursor RNA folds onto itself, forming VGAM1465 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1465 folded precursor RNA into VGAM1465 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1465 RNA is designated SEQ ID:4176, and is provided hereinbelow with reference to the sequence listing part.

VGAM1465 host target gene, herein designated VGAM HOST TARGET GENE, encodes a corresponding messenger RNA, VGAM1465 host target RNA, herein designated VGAM HOST TARGET RNA. VGAM1465 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1465 RNA, herein designated VGAM RNA, binds complementarily to one or more host target binding sites located in untranslated regions of VGAM1465 host target RNA, herein designated VGAM HOST TARGET RNA. This complementary binding is due to the fact that the nucleotide sequence of VGAM1465 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1465 RNA, herein designated VGAM RNA, may have a different number of host target binding sites in untranslated regions of a VGAM1465 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1465 RNA, herein designated VGAM RNA, to host target binding sites on VGAM1465 host target RNA, herein designated VGAM HOST TARGET RNA, such as BINDING SITE I, BINDING SITE II and BINDING SITE III, inhibits translation of VGAM1465 host target RNA into VGAM1465 host target protein, herein designated VGAM HOST TARGET PROTEIN. VGAM host target protein is therefore outlined by a broken line.

It is appreciated that VGAM1465 host target gene, herein designated VGAM HOST TARGET GENE, in fact represents a plurality of VGAM1465 host target genes. The mRNA of each one of this plurality of VGAM1465 host target genes comprises one or more host target binding sites, each having a nucleotide sequence which is at least partly complementary to VGAM1465 RNA, herein designated VGAM RNA, and which when bound by VGAM1465 RNA causes inhibition of translation of respective one or more VGAM1465 host target proteins.

It is further appreciated by one skilled in the art that the mode of translational inhibition illustrated by FIG. 1 with specific reference to translational inhibition exerted by VGAM1465 gene, herein designated VGAM GENE, on one or more VGAM1465 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1465 is inhibition of expression of host target genes, as part of a novel viral mechanism of attacking a host. Accordingly, utilities of VGAM1465 include diagnosis, prevention and treatment of viral infection by Equine Herpesvirus 2. Specific functions, and accordingly utilities, of VGAM1465 correlate with, and may be deduced from, the identity of the host target genes which VGAM1465 binds and inhibits, and the function of these host target genes, as elaborated hereinbelow.

Nucleotide sequences of the VGAM1465 precursor RNA, herein designated VGAM PRECURSOR RNA, and of the 'diced' VGAM1465 RNA, herein designated VGAM RNA, and a schematic representation of the secondary folding of VGAM1465 folded precursor RNA, herein designated VGAM FOLDED PRECURSOR RNA, of VGAM1465 are further described hereinbelow with reference to Table 1.

Nucleotide sequences of host target binding sites, such as BINDING SITE-I, BINDING SITE-II and BINDING SITE-III of FIG. 1, found on VGAM1465 host target RNA, and schematic representation of the complementarity of each of these host target binding sites to VGAM1465 RNA, herein designated VGAM RNA, are described hereinbelow with reference to Table 2.

As mentioned hereinabove with reference to FIG. 1, a function of VGAM1465 gene, herein designated VGAM is inhibition of expression of VGAM1465 target genes. It is appreciated that specific functions, and accordingly utilities, of VGAM1465 correlate with, and may be deduced from, the identity of the target genes which VGAM1465 binds and inhibits, and the function of these target genes, as elaborated hereinbelow.

Early Growth Response 2 (Krox-20 homolog, Drosophila) (EGR2, Accession NM_000399) is a VGAM1465 host target gene. EGR2 BINDING SITE is HOST TARGET binding site found in the 3' untranslated region of mRNA encoded by EGR2, corresponding to a HOST TARGET binding site such as BINDING SITE I, BINDING SITE II or BINDING SITE III. Table 2 illustrates the complementarity of the nucleotide sequences of EGR2 BINDING SITE, designated SEQ ID:5973, to the nucleotide sequence of VGAM1465 RNA, herein designated VGAM RNA, also designated SEQ ID:4176.

A function of VGAM1465 is therefore inhibition of Early Growth Response 2 (Krox-20 homolog, Drosophila) (EGR2, Accession NM_000399), a gene which binds to two specific dna sites located in the promoter region of hox-1.4. Accordingly, utilities of VGAM1465 include diagnosis, prevention and treatment of diseases and clinical conditions associated with EGR2. The function of EGR2 and its association with various diseases and clinical conditions, has been established by previous studies, as described hereinabove with reference to VGAM234. Inhibin, Beta B (activin AB beta polypeptide) (INHBB, Accession NM_002193) is another VGAM1465 host target gene. INHBB BINDING SITE is HOST TARGET binding site found in the 3' untranslated region of mRNA encoded by INHBB, corresponding to a HOST TARGET binding site such as BINDING SITE I, BINDING SITE II or BINDING SITE III. Table 2 illustrates the complementarity of the nucleotide sequences of INHBB BINDING SITE, designated SEQ ID:7948, to the nucleotide sequence of VGAM1465 RNA, herein designated VGAM RNA, also designated SEQ ID:4176.

Another function of VGAM1465 is therefore inhibition of Inhibin, Beta B (activin AB beta polypeptide) (INHBB, Accession NM_002193), a gene which inhibins inhibit the secretion of follitropin by the pituitary gland. Accordingly, utilities of VGAM1465 include diagnosis, prevention and treatment of diseases and clinical conditions associated with INHBB. The function of INHBB has been established by previous studies. The activins, dimers of beta-A or beta-B subunits encoded by the genes Inhba (OMIM Ref. No. 147290) and Inhbb, respectively, are TGF-beta (see OMIM Ref. No. 190180) superfamily members that have roles in reproduction and development (Brown et al., 2000). Activin ligands act as growth and differentiation factors in many cells and tissues. Mellor et al. (2000) examined the localization of and dimerization among activin subunits. The results demonstrated that activin beta-C (see OMIM Ref. No. 601233) can form dimers with activin beta-A and beta-B in vitro, but not with the inhibin alpha subunit (OMIM Ref. No. 147380). Using a specific antibody, activin beta-C protein was localized to human liver and prostate and colocalized with beta-A and beta-B subunits to specific cell types in benign and malignant prostate tissues. The capacity to form novel activin heterodimers (but not inhibin C) appears to reside in the human liver and prostate. The authors concluded that formation of activin AC or BC heterodimers may have significant implications in the regulation of levels and/or biologic activity of other activins in these tissues. Malignancy of pheochromocytomas is difficult to estimate on the basis of histopathologic features. In a search for new markers to differentiate malignant pheochromocytomas from benign ones, Salmenkivi et al. (2001) tested the value of inhibin/activin subunit expression. Inhibins are heterodimeric glycoproteins consisting of an alpha subunit and either a beta-A or a beta-B subunit. Activins are composed of beta subunits only. Immunohistochemically, inhibin/activin beta-B subunit was strongly positive in the normal adrenal medulla, but the cortex was negative. A striking difference was found in inhibin/activin beta-B expression between benign and malignant pheochromocytomas. The majority of benign adrenal tumors (27 of 30) showed strong or moderate immunoreactivity, whereas all 7 malignant tumors were negative or only weakly positive for inhibin/activin beta-B subunit. Salmenkivi et al. (2001) suggested that inhibin/activin beta-B subunit is expressed in normal adrenal medullary cells. Strong staining was found in most benign adrenal pheochromocytomas, whereas malignant tumors were almost negative. They concluded that loss of inhibin/activin beta-B subunit expression in pheochromocytomas may be used as an indicator of malignant potential. Animal model experiments lend further support to the function of INHBB. Whereas mice homozygous for the Inhba-null allele demonstrate disruption of whisker, palate, and tooth development leading to neonatal lethality, homozygous Inhbb-null mice are viable, fertile, and have eye defects. To determine if these phenotypes were due to spatiotemporal expression differences of the ligands or disruption of specific ligand-receptor interactions, Brown et al. (2000) replaced the region of Inhba encoding the mature protein with Inhbb, creating the allele designated Inhba (BK). Although the craniofacial phenotypes of the Inhba-null mutation were rescued by the Inhba (BK) allele, somatic, testicular, genital, and hair growth were grossly affected and influenced by the dosage and bioactivity of the allele. Thus, Brown et al. (2000) concluded that functional compensation within the TGF-beta superfamily can occur if the replacement gene is expressed appropriately. The novel phenotypes in these mice further illustrate the usefulness of insertion strategies for defining protein function. The structural organization of the testes of adult Inhba (BK/BK) mice was normal; however, the differentiation of the seminiferous tubules of Inhba (BK/-) mice was delayed. The testicular volumes of both Inhba (BK/BK) and Inhba (BK/-) mice were less than those of controls, and the dosage of the Inhba (BK) allele correlated positively with testicular size. Inhba (+/BK) males had normal onset of fertility, whereas Inhba (BK/BK) males had delayed onset of fertility similar to Acvr2 (OMIM Ref. No. 102581) -/- mice. Only 1 in 6 Inhba (BK/BK) females produced litters, whereas Inhba (+/BK) females were normally fertile. The ovaries of Inhba (BK/-) mice were smaller and contained fewer large preantral follicles than those of controls. Inhba (BK/BK) and Inhba (BK/-) mice were identified by their smaller size, slower hair growth, the rough appearance of their fur, and sunken eyes. Approximately 50% of Inhba (BK/BK) mice died by 26 weeks, whereas Inhba (BK/-) mice invariably became cachectic and died between 3 and 4 weeks. The summary of phenotypic findings of Inhba (BK/-) mice includes short whiskers, normal tooth development, no cleft palate, symmetric growth deficiency (OMIM Ref. No. severe), enlargement of external genitalia, hypogonadism (OMIM Ref. No. severe), delayed hair growth (moderate), hypoglycemia (mild), decreased life expectancy (OMIM Ref. No. severe), and anemia It is appreciated that the abovementioned animal model for INHBB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Salmenkivi, K.; Arola, J.; Voutilainen, R.; Ilvesmaki, V.; Haglund, C.; Kahri, A. I.; Heikkila, P.; Liu, J.: Inhibin/activin beta-B-subunit expression in pheochromocytomas favors benign diagnosis. J. Clin. Endocr. Metab. 86:2231-2235, 2001; and Brown, C. W.; Houston-Hawkins, D. E.; Woodruff, T. K.; Matzuk, M. M.: Insertion of Inhbb into the Inhba locus rescues the Inhba-null phenotype and reveals new activin functions. Nature.

Further studies establishing the function and utilities of INHBB are found in John Hopkins OMIM database record ID 147390, and in sited publications numbered 5241, 11328-524 and 11329-11330 listed in the bibliography section hereinbelow, which are also hereby incorporated by reference. Paired Basic Amino Acid Cleaving System 4 (PACE4, Accession NM_002570) is another VGAM1465 host target gene. PACE4 BINDING SITE1 and PACE4 BINDING SITE2 are HOST TARGET binding sites found in untranslated regions of mRNA encoded by PACE4, corresponding to HOST TARGET binding sites such as BINDING SITE I, BINDING SITE II or BINDING SITE III. Table 2 illustrates the complementarity of the nucleotide sequences of PACE4 BINDING SITE1 and PACE4 BINDING SITE2, designated SEQ ID:8432 and SEQ ID:28721 respectively, to the nucleotide sequence of VGAM1465 RNA, herein designated VGAM RNA, also designated SEQ ID:4176.

Another function of VGAM1465 is therefore inhibition of Paired Basic Amino Acid Cleaving System 4 (PACE4, Accession NM_002570), a gene which processes hormone precursors by cleaving paired basic amino acids. Accordingly, utilities of VGAM1465 include diagnosis, prevention and treatment of diseases and clinical conditions associated with PACE4. The function of PACE4 and its association with various diseases and clinical conditions, has been established by previous studies, as described hereinabove with reference to VGAM1194. Potassium Voltage-gated Channel, Delayed-rectifier, Subfamily S, Member 1 (KCNS1, Accession NM_002251) is another VGAM1465 host target gene. KCNS1 BINDING SITE is HOST TARGET binding site found in the 3' untranslated region of mRNA encoded by KCNS1, corresponding to a HOST TARGET binding site such as BINDING SITE I, BINDING SITE II or BINDING SITE III. Table 2 illustrates the complementarity of the nucleotide sequences of KCNS1 BINDING SITE, designated SEQ ID:8048, to the nucleotide sequence of VGAM1465 RNA, herein designated VGAM RNA, also designated SEQ ID:4176.

Another function of VGAM1465 is therefore inhibition of Potassium Voltage-gated Channel, Delayed-rectifier, Subfamily S, Member 1 (KCNS1, Accession NM_002251). Accordingly, utilities of VGAM1465 include diagnosis, prevention and treatment of diseases and clinical conditions associated with KCNS1. KIAA1045 (Accession XM_048592) is another VGAM1465 host target gene. KIAA1045 BINDING SITE is HOST TARGET binding site found in the 3' untranslated region of mRNA encoded by KIAA1045, corresponding to a HOST TARGET binding site such as BINDING SITE I, BINDING SITE II or BINDING SITE III. Table 2 illustrates the complementarity of the nucleotide sequences of KIAA1045 BINDING SITE, designated SEQ ID:35195, to the nucleotide sequence of VGAM1465 RNA, herein designated VGAM RNA, also designated SEQ ID:4176.

Another function of VGAM1465 is therefore inhibition of KIAA1045 (Accession XM_048592). Accordingly, utilities of VGAM1465 include diagnosis, prevention and treatment of diseases and clinical conditions associated with KIAA1045. LOC152195 (Accession XM_098172) is another VGAM1465 host target gene. LOC152195 BINDING SITE is HOST TARGET binding site found in the 3' untranslated region of mRNA encoded by LOC152195, corresponding to a HOST TARGET binding site such as BINDING SITE I, BINDING SITE II or BINDING SITE III. Table 2 illustrates the complementarity of the nucleotide sequences of LOC152195 BINDING SITE, designated SEQ ID:41434, to the nucleotide sequence of VGAM1465 RNA, herein designated VGAM RNA, also designated SEQ ID:4176.

Another function of VGAM1465 is therefore inhibition of LOC152195 (Accession XM_098172). Accordingly, utilities of VGAM1465 include diagnosis, prevention and treatment of diseases and clinical conditions associated with LOC152195. LOC199990 (Accession XM_114083) is another VGAM1465 host target gene. LOC199990 BINDING SITE is HOST TARGET binding site found in the 3' untranslated region of mRNA encoded by LOC199990, corresponding to a HOST TARGET binding site such as BINDING SITE I, BINDING SITE II or BINDING SITE III. Table 2 illustrates the complementarity of the nucleotide sequences of LOC199990 BINDING SITE, designated SEQ ID:42685, to the nucleotide sequence of VGAM1465 RNA, herein designated VGAM RNA, also designated SEQ ID:4176.

Another function of VGAM1465 is therefore inhibition of LOC199990 (Accession XM_114083). Accordingly, utilities of VGAM1465 include diagnosis, prevention and treatment of diseases and clinical conditions associated with LOC199990. FIG. 1 further provides a conceptual description of a novel bioinformatically detected viral gene of the present invention, referred to here as Viral Genomic Address Messenger 1466 (VGAM1466) viral gene, which modulates expression of respective host target genes thereof, the function and utility of which host target genes is known in the art.

VGAM1466 is a novel bioinformatically detected regulatory, non protein coding, viral micro RNA (miRNA) gene. The method by which VGAM1466 was detected is described hereinabove with reference to FIGS. 1-8.

VGAM1466 gene, herein designated VGAM GENE, is a viral gene contained in the genome of Equine Herpesvirus 2. VGAM1466 host target gene, herein designated VGAM HOST TARGET GENE, is a human gene contained in the human genome.

VGAM1466 gene encodes a VGAM1466 precursor RNA, herein designated VGAM PRECURSOR RNA. Similar to other miRNA genes, and unlike most ordinary genes, VGAM1466 precursor RNA does not encode a protein. A nucleotide sequence identical or highly similar to the nucleotide sequence of VGAM1466 precursor RNA is designated SEQ ID:1452, and is provided hereinbelow with reference to the sequence listing part. Nucleotide sequence SEQ ID:1452 is located at position 39035 relative to the genome of Equine Herpesvirus 2.

VGAM1466 precursor RNA folds onto itself, forming VGAM1466 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1466 folded precursor RNA into VGAM1466 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1466 RNA is designated SEQ ID:4177, and is provided hereinbelow with reference to the sequence listing part.

VGAM1466 host target gene, herein designated VGAM HOST TARGET GENE, encodes a corresponding messenger RNA, VGAM1466 host target RNA, herein designated VGAM HOST TARGET RNA. VGAM1466 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1466 RNA, herein designated VGAM RNA, binds complementarily to one or more host target binding sites located in untranslated regions of VGAM1466 host target RNA, herein designated VGAM HOST TARGET RNA. This complementary binding is due to the fact that the nucleotide sequence of VGAM1466 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1466 RNA, herein designated VGAM RNA, may have a different number of host target binding sites in untranslated regions of a VGAM1466 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1466 RNA, herein designated VGAM RNA, to host target binding sites on VGAM1466 host target RNA, herein designated VGAM HOST TARGET RNA, such as BINDING SITE I, BINDING SITE II and BINDING SITE III, inhibits translation of VGAM1466 host target RNA into VGAM1466 host target protein, herein designated VGAM HOST TARGET PROTEIN. VGAM host target protein is therefore outlined by a broken line.

It is appreciated that VGAM1466 host target gene, herein designated VGAM HOST TARGET GENE, in fact represents a plurality of VGAM1466 host target genes. The mRNA of each one of this plurality of VGAM1466 host target genes comprises one or more host target binding sites, each having a nucleotide sequence which is at least partly complementary to VGAM1466 RNA, herein designated VGAM RNA, and which when bound by VGAM1466 RNA causes inhibition of translation of respective one or more VGAM1466 host target proteins.

It is further appreciated by one skilled in the art that the mode of translational inhibition illustrated by FIG. 1 with specific reference to translational inhibition exerted by VGAM1466 gene, herein designated VGAM GENE, on one or more VGAM1466 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1466 is inhibition of expression of host target genes, as part of a novel viral mechanism of attacking a host. Accordingly, utilities of VGAM1466 include diagnosis, prevention and treatment of viral infection by Equine Herpesvirus 2. Specific functions, and accordingly utilities, of VGAM1466 correlate with, and may be deduced from, the identity of the host target genes which VGAM1466 binds and inhibits, and the function of these host target genes, as elaborated hereinbelow.

Nucleotide sequences of the VGAM1466 precursor RNA, herein designated VGAM PRECURSOR RNA, and of the 'diced' VGAM1466 RNA, herein designated VGAM RNA, and a schematic representation of the secondary folding of VGAM1466 folded precursor RNA, herein designated VGAM FOLDED PRECURSOR RNA, of VGAM1466 are further described hereinbelow with reference to Table 1.

Nucleotide sequences of host target binding sites, such as BINDING SITE-I, BINDING SITE-II and BINDING SITE-III of FIG. 1, found on VGAM1466 host target RNA, and schematic representation of the complementarity of each of these host target binding sites to VGAM1466 RNA, herein designated VGAM RNA, are described hereinbelow with reference to Table 2.

As mentioned hereinabove with reference to FIG. 1, a function of VGAM1466 gene, herein designated VGAM is inhibition of expression of VGAM1466 target genes. It is appreciated that specific functions, and accordingly utilities, of VGAM1466 correlate with, and may be deduced from, the identity of the target genes which VGAM1466 binds and inhibits, and the function of these target genes, as elaborated hereinbelow.

Adenylate Cyclase 6 (ADCY6, Accession NM_015270) is a VGAM1466 host target gene. ADCY6 BINDING SITE is HOST TARGET binding site found in the 5' untranslated region of mRNA encoded by ADCY6, corresponding to a HOST TARGET binding site such as BINDING SITE I, BINDING SITE II or BINDING SITE III. Table 2 illustrates the complementarity of the nucleotide sequences of ADCY6 BINDING SITE, designated SEQ ID:17593, to the nucleotide sequence of VGAM1466 RNA, herein designated VGAM RNA, also designated SEQ ID:4177.

A function of VGAM1466 is therefore inhibition of Adenylate Cyclase 6 (ADCY6, Accession NM_015270), a gene which this a membrane-bound, ca (2+)-inhibitable adenylyl cyclase (by similarity). Accordingly, utilities of VGAM1466 include diagnosis, prevention and treatment of diseases and clinical conditions associated with ADCY6. The function of ADCY6 and its association with various diseases and clinical conditions, has been established by previous studies, as described hereinabove with reference to VGAM22. B-cell CLL/lymphoma 10 (BCL10, Accession NM_003921) is another VGAM1466 host target gene. BCL10 BINDING SITE is HOST TARGET binding site found in the 3' untranslated region of mRNA encoded by BCL10, corresponding to a HOST TARGET binding site such as BINDING SITE I, BINDING SITE II or BINDING SITE III. Table 2 illustrates the complementarity of the nucleotide sequences of BCL10 BINDING SITE, designated SEQ ID:10010, to the nucleotide sequence of VGAM1466 RNA, herein designated VGAM RNA, also designated SEQ ID:4177.

Another function of VGAM1466 is therefore inhibition of B-cell CLL/lymphoma 10 (BCL10, Accession NM_003921), a gene which is a positive regulator of lymphocyte proliferation, NF-kappaB activator. Accordingly, utilities of VGAM1466 include diagnosis, prevention and treatment of diseases and clinical conditions associated with BCL10. The function of BCL10 and its association with various diseases and clinical conditions, has been established by previous studies, as described hereinabove with reference to VGAM433. Caspase Recruitment Domain Family, Member 15 (CARD15, Accession NM_022162) is another VGAM1466 host target gene. CARD15 BINDING SITE is HOST TARGET binding site found in the 3' untranslated region of mRNA encoded by CARD15, corresponding to a HOST TARGET binding site such as BINDING SITE I, BINDING SITE II or BINDING SITE III. Table 2 illustrates the complementarity of the nucleotide sequences of CARD15 BINDING SITE, designated SEQ ID:22720, to the nucleotide sequence of VGAM1466 RNA, herein designated VGAM RNA, also designated SEQ ID:4177.

Another function of VGAM1466 is therefore inhibition of Caspase Recruitment Domain Family, Member 15 (CARD15, Accession NM_022162), a gene which serves as an intracellular receptor for bacterial products in monocytes and transduces signals leading to NFKB activation. Accordingly, utilities of VGAM1466 include diagnosis, prevention and treatment of diseases and clinical conditions associated with CARD15. The function of CARD15 and its association with various diseases and clinical conditions, has been established by previous studies, as described hereinabove with reference to VGAM126. CDC6 Cell Division Cycle 6 Homolog (S. cerevisiae) (CDC6, Accession NM_001254) is another VGAM1466 host target gene. CDC6 BINDING SITE is HOST TARGET binding site found in the 3' untranslated region of mRNA encoded by CDC6, corresponding to a HOST TARGET binding site such as BINDING SITE I, BINDING SITE II or BINDING SITE III. Table 2 illustrates the complementarity of the nucleotide sequences of CDC6 BINDING SITE, designated SEQ ID:6924, to the nucleotide sequence of VGAM1466 RNA, herein designated VGAM RNA, also designated SEQ ID:4177.

Another function of VGAM1466 is therefore inhibition of CDC6 Cell Division Cycle 6 Homolog (S. cerevisiae) (CDC6, Accession NM_001254), a gene which is a component of the origin recognition complex (orc) that binds origins of replication. Accordingly, utilities of VGAM1466 include diagnosis, prevention and treatment of diseases and clinical conditions associated with CDC6. The function of CDC6 has been established by previous studies. In yeasts, Cdc6 (Saccharomyces cerevisiae) and Cdc18 (Schizosaccharomyces pombe) associate with the origin recognition complex (ORC) proteins to render cells competent for DNA replication. Thus, Cdc6 has a critical regulatory role in the initiation of DNA replication in yeast. Williams et al. (1997) isolated cDNAs encoding Xenopus and human homologs of yeast CDC6. They designated the human and Xenopus proteins p62(cdc6). Independently, in a yeast 2-hybrid assay using PCNA (OMIM Ref. No. 176740) as bait, Saha et al. (1998) isolated cDNAs encoding the human CDC6/Cdc18 homolog. These authors reported that the predicted 560-amino acid human protein shares approximately 33% sequence identity with the 2 yeast proteins. On Western blots of HeLa cell extracts, human CDC6/cdc18 migrates as a 66-kD protein. Although Northern blots indicated that CDC6/Cdc18 mRNA levels peak at the onset of S phase and diminish at the onset of mitosis in HeLa cells, the authors found that total CDC6/Cdc18 protein level is unchanged throughout the cell cycle. Immunofluorescent analysis of epitope-tagged protein revealed that human CDC6/Cdc18 is nuclear in G1- and cytoplasmic in S-phase cells, suggesting that DNA replication may be regulated by either the translocation of this protein between the nucleus and cytoplasm or by selective degradation of the protein in the nucleus. Immunoprecipitation studies showed that human CDC6/Cdc18 associates in vivo with cyclin A (OMIM Ref. No. 123835), CDK2 (OMIM Ref. No. 116953), and ORC1 (OMIM Ref. No. 601902). The association of cyclin-CDK2 with CDC6/Cdc18 was specifically inhibited by a factor present in mitotic cell extracts. Saha et al. (1998) suggested that if the interaction between CDC6/Cdc18 with the S phase-promoting factor cyclin-CDK2 is essential for the initiation of DNA replication, the mitotic inhibitor of this interaction could prevent a premature interaction until the appropriate time in G1.

Full details of the abovementioned studies are described in the following publications, the disclosure of which are hereby incorporated by reference:

Williams, R. S.; Shohet, R. V.; Stillman, B.: A human protein related to yeast Cdc6p. Proc. Nat. Acad. Sci. 94:142-147, 1997; and Saha, P.; Chen, J.; Thome, K. C.; Lawlis, S. J.; Hou, Z.-H.; Hendricks, M.; Parvin, J. D.; Dutta, A.: Human CDC6/Cdc18 associates with Orc1 and cyclin-cdk and is selectively eliminated.

Further studies establishing the function and utilities of CDC6 are found in John Hopkins OMIM database record ID 602627, and in sited publications numbered 8565-856 and 9449 listed in the bibliography section hereinbelow, which are also hereby incorporated by reference. Cadherin 17, LI Cadherin (liver-intestine) (CDH17, Accession NM_004063) is another VGAM1466 host target gene. CDH17 BINDING SITE is HOST TARGET binding site found in the 3' untranslated region of mRNA encoded by CDH17, corresponding to a HOST TARGET binding site such as BINDING SITE I, BINDING SITE II or BINDING SITE III. Table 2 illustrates the complementarity of the nucleotide sequences of CDH17 BINDING SITE, designated SEQ ID:10271, to the nucleotide sequence of VGAM1466 RNA, herein designated VGAM RNA, also designated SEQ ID:4177.

Another function of VGAM1466 is therefore inhibition of Cadherin 17, LI Cadherin (liver-intestine) (CDH17, Accession NM_004063), a gene which may have a role in the morphological organization of liver and intestine and involved in intestinal peptide transport. Accordingly, utilities of VGAM1466 include diagnosis, prevention and treatment of diseases and clinical conditions associated with CDH17. The function of CDH17 and its association with various diseases and clinical conditions, has been established by previous studies, as described hereinabove with reference to VGAM795. Cholinergic Receptor, Muscarinic 1 (CHRM1, Accession XM_170669) is another VGAM1466 host target gene. CHRM1 BINDING SITE is HOST TARGET binding site found in the 3' untranslated region of mRNA encoded by CHRM1, corresponding to a HOST TARGET binding site such as BINDING SITE I, BINDING SITE II or BINDING SITE III. Table 2 illustrates the complementarity of the nucleotide sequences of CHRM1 BINDING SITE, designated SEQ ID:45442, to the nucleotide sequence of VGAM1466 RNA, herein designated VGAM RNA, also designated SEQ ID:4177.

Another function of VGAM1466 is therefore inhibition of Cholinergic Receptor, Muscarinic 1 (CHRM1, Accession XM_170669), a gene which mediates various cellular responses. Accordingly, utilities of VGAM1466 include diagnosis, prevention and treatment of diseases and clinical conditions associated with CHRM1. The function of CHRM1 and its association with various diseases and clinical conditions, has been established by previous studies, as described hereinabove with reference to VGAM302. COX15 Homolog, Cytochrome C Oxidase Assembly Protein (yeast) (COX15, Accession NM_078470) is another VGAM1466 host target gene. COX15 BINDING SITE is HOST TARGET binding site found in the 3' untranslated region of mRNA encoded by COX15, corresponding to a HOST TARGET binding site such as BINDING SITE I, BINDING SITE II or BINDING SITE III. Table 2 illustrates the complementarity of the nucleotide sequences of COX15 BINDING SITE, designated SEQ ID:27792, to the nucleotide sequence of VGAM1466 RNA, herein designated VGAM RNA, also designated SEQ ID:4177.

Another function of VGAM1466 is therefore inhibition of COX15 Homolog, Cytochrome C Oxidase Assembly Protein (yeast) (COX15, Accession NM_078470). Accordingly, utilities of VGAM1466 include diagnosis, prevention and treatment of diseases and clinical conditions associated with COX15. Down Syndrome Critical Region Gene 3 (DSCR3, Accession NM_006052) is another VGAM1466 host target gene. DSCR3 BINDING SITE is HOST TARGET binding site found in the 3' untranslated region of mRNA encoded by DSCR3, corresponding to a HOST TARGET binding site such as BINDING SITE I, BINDING SITE II or BINDING SITE III. Table 2 illustrates the complementarity of the nucleotide sequences of DSCR3 BINDING SITE, designated SEQ ID:12689, to the nucleotide sequence of VGAM1466 RNA, herein designated VGAM RNA, also designated SEQ ID:4177.

Another function of VGAM1466 is therefore inhibition of Down Syndrome Critical Region Gene 3 (DSCR3, Accession NM_006052). Accordingly, utilities of VGAM1466 include diagnosis, prevention and treatment of diseases and clinical conditions associated with DSCR3. Fibulin 5 (FBLN5, Accession NM_006329) is another VGAM1466 host target gene. FBLN5 BINDING SITE is HOST TARGET binding site found in the 3' untranslated region of mRNA encoded by FBLN5, corresponding to a HOST TARGET binding site such as BINDING SITE I, BINDING SITE II or BINDING SITE III. Table 2 illustrates the complementarity of the nucleotide sequences of FBLN5 BINDING SITE, designated SEQ ID:13025, to the nucleotide sequence of VGAM1466 RNA, herein designated VGAM RNA, also designated SEQ ID:4177.

Another function of VGAM1466 is therefore inhibition of Fibulin 5 (FBLN5, Accession NM_006329), a gene which promotes adhesion of endothelial cells through interaction of integrins and the rgd motif. Accordingly, utilities of VGAM1466 include diagnosis, prevention and treatment of diseases and clinical conditions associated with FBLN5. The function of FBLN5 and its association with various diseases and clinical conditions, has been established by previous studies, as described hereinabove with reference to VGAM1127. Fibronectin Leucine Rich Transmembrane Protein 2 (FLRT2, Accession NM_013231) is another VGAM1466 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14883, to the nucleotide sequence of VGAM1466 RNA, herein designated VGAM RNA, also designated SEQ ID:4177.

Another function of VGAM1466 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM1466 include diagnosis, prevention and treatment of diseases and clinical conditions associated with FLRT2. The function of FLRT2 and its association with various diseases and clinical conditions, has been established by previous studies, as described hereinabove with reference to VGAM247. GNE (Accession NM_005476) is another VGAM1466 host target gene. GNE BINDING SITE is HOST TARGET binding site found in the 3' untranslated region of mRNA encoded by GNE, corresponding to a HOST TARGET binding site such as BINDING SITE I, BINDING SITE II or BINDING SITE III. Table 2 illustrates the complementarity of the nucleotide sequences of GNE BINDING SITE, designated SEQ ID:11977, to the nucleotide sequence of VGAM1466 RNA, herein designated VGAM RNA, also designated SEQ ID:4177.

Another function of VGAM1466 is therefore inhibition of GNE (Accession NM_005476), a gene which has roles in sialic acid biosynthesis and regulates cell surface sialylation. Accordingly, utilities of VGAM1466 include diagnosis, prevention and treatment of diseases and clinical conditions associated with GNE. The function of GNE and its association with various diseases and clinical conditions, has been established by previous studies, as described hereinabove with reference to VGAM362. GRAF (Accession NM_015071) is another VGAM1466 host target gene. GRAF BINDING SITE is HOST TARGET binding site found in the 3' untranslated region of mRNA encoded by GRAF, corresponding to a HOST TARGET binding site such as BINDING SITE I, BINDING SITE II or BINDING SITE III. Table 2 illustrates the complementarity of the nucleotide sequences of GRAF BINDING SITE, designated SEQ ID:17444, to the nucleotide sequence of VGAM1466 RNA, herein designated VGAM RNA, also designated SEQ ID:4177.

Another function of VGAM1466 is therefore inhibition of GRAF (Accession NM_015071), a gene which ia a GTPase activating protein for p21-rac. Accordingly, utilities of VGAM1466 include diagnosis, prevention and treatment of diseases and clinical conditions associated with GRAF. The function of GRAF and its association with various diseases and clinical conditions, has been established by previous studies, as described hereinabove with reference to VGAM430. Glutamate Receptor, Ionotropic, Kainate 3 (GRIK3, Accession NM_000831) is another VGAM1466 host target gene. GRIK3 BINDING SITE is HOST TARGET binding site found in the 3' untranslated region of mRNA encoded by GRIK3, corresponding to a HOST TARGET binding site such as BINDING SITE I, BINDING SITE II or BINDING SITE III. Table 2 illustrates the complementarity of the nucleotide sequences of GRIK3 BINDING SITE, designated SEQ ID:6487, to the nucleotide sequence of VGAM1466 RNA, herein designated VGAM RNA, also designated SEQ ID:4177.

Another function of VGAM1466 is therefore inhibition of Glutamate Receptor, Ionotropic, Kainate 3 (GRIK3, Accession NM_000831). Accordingly, utilities of VGAM1466 include diagnosis, prevention and treatment of diseases and clinical conditions associated with GRIK3. Kinesin Heavy Chain Member 2 (KIF2, Accession NM_004520) is another VGAM1466 host target gene. KIF2 BINDING SITE is HOST TARGET binding site found in the 3' untranslated region of mRNA encoded by KIF2, corresponding to a HOST TARGET binding site such as BINDING SITE I, BINDING SITE II or BINDING SITE III. Table 2 illustrates the complementarity of the nucleotide sequences of KIF2 BINDING SITE, designated SEQ ID:10849, to the nucleotide sequence of VGAM1466 RNA, herein designated VGAM RNA, also designated SEQ ID:4177.

Another function of VGAM1466 is therefore inhibition of Kinesin Heavy Chain Member 2 (KIF2, Accession NM_004520). Accordingly, utilities of VGAM1466 include diagnosis, prevention and treatment of diseases and clinical conditions associated with KIF2. LENG4 (Accession NM_024298) is another VGAM1466 host target gene. LENG4 BINDING SITE is HOST TARGET binding site found in the 3' untranslated region of mRNA encoded by LENG4, corresponding to a HOST TARGET binding site such as BINDING SITE I, BINDING SITE II or BINDING SITE III. Table 2 illustrates the complementarity of the nucleotide sequences of LENG4 BINDING SITE, designated SEQ ID:23588, to the nucleotide sequence of VGAM1466 RNA, herein designated VGAM RNA, also designated SEQ ID:4177.

Another function of VGAM1466 is therefore inhibition of LENG4 (Accession NM_024298), a gene which may be a transmembrane protein. Accordingly, utilities of VGAM1466 include diagnosis, prevention and treatment of diseases and clinical conditions associated with LENG4. The function of LENG4 and its association with various diseases and clinical conditions, has been established by previous studies, as described hereinabove with reference to VGAM259. V-myb Myeloblastosis Viral Oncogene Homolog (avian) (MYB, Accession XM_004256) is another VGAM1466 host target gene. MYB BINDING SITE is HOST TARGET binding site found in the 3' untranslated region of mRNA encoded by MYB, corresponding to a HOST TARGET binding site such as BINDING SITE I, BINDING SITE II or BINDING SITE III. Table 2 illustrates the complementarity of the nucleotide sequences of MYB BINDING SITE, designated SEQ ID:29944, to the nucleotide sequence of VGAM1466 RNA, herein designated VGAM RNA, also designated SEQ ID:4177.

Another function of VGAM1466 is therefore inhibition of V-myb Myeloblastosis Viral Oncogene Homolog (avian) (MYB, Accession XM_004256). Accordingly, utilities of VGAM1466 include diagnosis, prevention and treatment of diseases and clinical conditions associated with MYB. Neurocalcin Delta (NCALD, Accession NM_032041) is another VGAM1466 host target gene. NCALD BINDING SITE is HOST TARGET binding site found in the 3' untranslated region of mRNA encoded by NCALD, corresponding to a HOST TARGET binding site such as BINDING SITE I, BINDING SITE II or BINDING SITE III. Table 2 illustrates the complementarity of the nucleotide sequences of NCALD BINDING SITE, designated SEQ ID:25747, to the nucleotide sequence of VGAM1466 RNA, herein designated VGAM RNA, also designated SEQ ID:4177.

Another function of VGAM1466 is therefore inhibition of Neurocalcin Delta (NCALD, Accession NM_032041). Accordingly, utilities of VGAM1466 include diagnosis, prevention and treatment of diseases and clinical conditions associated with NCALD. Protocadherin Alpha 9 (PCDHA9, Accession NM_014005) is another VGAM1466 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:15213, to the nucleotide sequence of VGAM1466 RNA, herein designated VGAM RNA, also designated SEQ ID:4177.

Another function of VGAM1466 is therefore inhibition of Protocadherin Alpha 9 (PCDHA9, Accession NM_014005), a gene which is a calcium-dependent cell-adhesion protein.

Accordingly, utilities of VGAM1466 include diagnosis, prevention and treatment of diseases and clinical conditions associated with PCDHA9. The function of PCDHA9 and its association with various diseases and clinical conditions, has been established by previous studies, as described hereinabove with reference to VGAM71. Platelet-derived Growth Factor Receptor, Alpha Polypeptide (PDGFRA, Accession NM_006206) is another VGAM1466 host target gene. PDGFRA BINDING SITE is HOST TARGET binding site found in the 3' untranslated region of mRNA encoded by PDGFRA, corresponding to a HOST TARGET binding site such as BINDING SITE I, BINDING SITE II or BINDING SITE III. Table 2 illustrates the complementarity of the nucleotide sequences of PDGFRA BINDING SITE, designated SEQ ID:12886, to the nucleotide sequence of VGAM1466 RNA, herein designated VGAM RNA, also designated SEQ ID:4177.

Another function of VGAM1466 is therefore inhibition of Platelet-derived Growth Factor Receptor, Alpha Polypeptide (PDGFRA, Accession NM_006206), a gene which this receptor binds platelet-derived growth factor and has a tyrosine-protein kinase activity. Accordingly, utilities of VGAM1466 include diagnosis, prevention and treatment of diseases and clinical conditions associated with PDGFRA. The function of PDGFRA and its association with various diseases and clinical conditions, has been established by previous studies, as described hereinabove with reference to VGAM117. Phosphoprotein Enriched In Astrocytes 15 (PEA15, Accession NM_003768) is another VGAM1466 host target gene. PEA15 BINDING SITE is HOST TARGET binding site found in the 3' untranslated region of mRNA encoded by PEA15, corresponding to a HOST TARGET binding site such as BINDING SITE I, BINDING SITE II or BINDING SITE III. Table 2 illustrates the complementarity of the nucleotide sequences of PEA15 BINDING SITE, designated SEQ ID:9853, to the nucleotide sequence of VGAM1466 RNA, herein designated VGAM RNA, also designated SEQ ID:4177.

Another function of VGAM1466 is therefore inhibition of Phosphoprotein Enriched In Astrocytes 15 (PEA15, Accession NM_003768), a gene which is a phosphoprotein and involved in glucose uptake. Accordingly, utilities of VGAM1466 include diagnosis, prevention and treatment of diseases and clinical conditions associated with PEA15. The function of PEA15 and its association with various diseases and clinical conditions, has been established by previous studies, as described hereinabove with reference to VGAM949. Phosphoinositide-3-kinase, Regulatory Subunit, Polypeptide 1 (p85 alpha) (PIK3R1, Accession XM_043865) is another VGAM1466 host target gene. PIK3R1 BINDING SITE is HOST TARGET binding site found in the 3' untranslated region of mRNA encoded by PIK3R1, corresponding to a HOST TARGET binding site such as BINDING SITE I, BINDING SITE II or BINDING SITE III. Table 2 illustrates the complementarity of the nucleotide sequences of PIK3R1 BINDING SITE, designated SEQ ID:34038, to the nucleotide sequence of VGAM1466 RNA, herein designated VGAM RNA, also designated SEQ ID:4177.

Another function of VGAM1466 is therefore inhibition of Phosphoinositide-3-kinase, Regulatory Subunit, Polypeptide 1 (p85 alpha) (PIK3R1, Accession XM_043865), a gene which acts as an adapter, for the insulin-stimulated increase in glucose uptake and glycogen synthesis. Accordingly, utilities of VGAM1466 include diagnosis, prevention and treatment of diseases and clinical conditions associated with PIK3R1. The function of PIK3R1 and its association with various diseases and clinical conditions, has been established by previous studies, as described hereinabove with reference to VGAM826. Protein Phosphatase, EF Hand Calcium-binding Domain 2 (PPEF2, Accession NM_006239) is another VGAM1466 host target gene. PPEF2 BINDING SITE is HOST TARGET binding site found in the 3' untranslated region of mRNA encoded by PPEF2, corresponding to a HOST TARGET binding site such as BINDING SITE I, BINDING SITE II or BINDING SITE III. Table 2 illustrates the complementarity of the nucleotide sequences of PPEF2 BINDING SITE, designated SEQ ID:12905, to the nucleotide sequence of VGAM1466 RNA, herein designated VGAM RNA, also designated SEQ ID:4177.

Another function of VGAM1466 is therefore inhibition of Protein Phosphatase, EF Hand Calcium-binding Domain 2 (PPEF2, Accession NM_006239), a gene which is a homolog of Drosophila rdgC. Accordingly, utilities of VGAM1466 include diagnosis, prevention and treatment of diseases and clinical conditions associated with PPEF2. The function of PPEF2 has been established by previous studies. During random sequencing of human retina cDNAs, Sherman et al. (1997) identified a homolog of Drosophila rdgC. Full-length cDNAs of the gene, termed PPEF2, predicted a 753-amino acid protein that is 39% identical to that of Drosophila rdgC and has a domain structure similar to that of rdgC and PPEF1 (OMIM Ref. No. 300109). Sherman et al. (1997) noted the existence of a shorter alternatively spliced form of PPEF2, termed PPEF2(S), that uses alternative splice acceptor sites in exons 5 and 14 and predicts a 598-amino acid protein lacking EF-hand domains. Northern blot analysis of rat tissues revealed a 3.7-kb PPEF2 mRNA in retina. In situ hybridization and cell fractionation experiments further revealed that the gene is expressed exclusively in the inner segments of the photoreceptor cells of the retina and in the pineal gland. Sherman et al. (1997) stated that the inner segment localization implies that PPEF2 probably does not dephosphorylate rhodopsin and is probably not directly involved in phototransduction. Animal model experiments lend further support to the function of PPEF2. Ramulu et al. (2001) produced mice carrying targeted disruptions in the Ppef1 and Ppef2 genes. By analyzing both single and double mutant mice, they observed that rod light responses and rhodopsin dephosphorylation kinetics were normal. Furthermore, there was no evidence of retinal degeneration in the PPEF mutant mice. Ramulu et al. (2001) concluded that in contrast to loss of rdgC function in Drosophila, elimination of PPEF function does not cause retinal degeneration in vertebrates.

It is appreciated that the abovementioned animal model for PPEF2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ramulu, P.; Kennedy, M.; Xiong, W.-H.; Williams, J.; Cowan, M.; Blesh, D.; Yau, K.-W.; Hurley, J. B.; Nathans, J.: Normal light response, photoreceptor integrity, and rhodopsin dephosphorylation in mice lacking both protein phosphatases with EF hands (PPEF-1 and PPEF-2). Molec. Cell. Biol. 21:8605-8614, 2001; and Sherman, P. M.; Sun, H.; Macke, J. P.; Williams, J.; Smallwood, P. M.; Nathans, J.: Identification and characterization of a conserved family of protein serine/threonine phosphatases h.

Further studies establishing the function and utilities of PPEF2 are found in John Hopkins OMIM database record ID 602256, and in sited publications numbered 10627 listed in the bibliography section hereinbelow, which are also hereby incorporated by reference. Rabphilin 3A-like (without C2 domains) (RPH3AL, Accession NM_006987) is another VGAM1466 host target gene. RPH3AL BINDING SITE is HOST TARGET binding site found in the 3' untranslated region of mRNA encoded by RPH3AL, corresponding to a HOST TARGET binding site such as BINDING SITE I, BINDING SITE II or BINDING SITE III. Table 2 illustrates the complementarity of the nucleotide sequences of RPH3AL BINDING SITE, designated SEQ ID:13849, to the nucleotide sequence of VGAM1466 RNA, herein designated VGAM RNA, also designated SEQ ID:4177.

Another function of VGAM1466 is therefore inhibition of Rabphilin 3A-like (without C2 domains) (RPH3AL, Accession NM_006987), a gene which is a protein transporter. could play a role in neurotransmitter release by regulating membrane flow in the nerve terminal. Accordingly, utilities of VGAM1466 include diagnosis, prevention and treatment of diseases and clinical conditions associated with RPH3AL. The function of RPH3AL and its association with various diseases and clinical conditions, has been established by previous studies, as described hereinabove with reference to VGAM923. Spondyloepiphyseal Dysplasia, Late (SEDL, Accession NM_014563) is another VGAM1466 host target gene. SEDL BINDING SITE1 and SEDL BINDING SITE2 are HOST TARGET binding sites found in untranslated regions of mRNA encoded by SEDL, corresponding to HOST TARGET binding sites such as BINDING SITE I, BINDING SITE II or BINDING SITE III. Table 2 illustrates the complementarity of the nucleotide sequences of SEDL BINDING SITE1 and SEDL BINDING SITE2, designated SEQ ID:15915 and SEQ ID:15916 respectively, to the nucleotide sequence of VGAM1466 RNA, herein designated VGAM RNA, also designated SEQ ID:4177.

Another function of VGAM1466 is therefore inhibition of Spondyloepiphyseal Dysplasia, Late (SEDL, Accession NM_014563), a gene which may play role in vesicular transport from endoplasmic reticulum to golgi. Accordingly, utilities of VGAM1466 include diagnosis, prevention and treatment of diseases and clinical conditions associated with SEDL. The function of SEDL and its association with various diseases and clinical conditions, has been established by previous studies, as described hereinabove with reference to VGAM74. Solute Carrier Family 22 (organic anion/cation transporter), Member 12 (SLC22A12, Accession NM_144585) is another VGAM1466 host target gene. SLC22A12 BINDING SITE is HOST TARGET binding site found in the 5' untranslated region of mRNA encoded by SLC22A12, corresponding to a HOST TARGET binding site such as BINDING SITE I, BINDING SITE II or BINDING SITE III. Table 2 illustrates the complementarity of the nucleotide sequences of SLC22A12 BINDING SITE, designated SEQ ID:29405, to the nucleotide sequence of VGAM1466 RNA, herein designated VGAM RNA, also designated SEQ ID:4177.

Another function of VGAM1466 is therefore inhibition of Solute Carrier Family 22 (organic anion/cation transporter), Member 12 (SLC22A12, Accession NM_144585), a gene which is a urate -anion exchanger regulating blood yrate levels. Accordingly, utilities of VGAM1466 include diagnosis, prevention and treatment of diseases and clinical conditions associated with SLC22A12. The function of SLC22A12 and its association with various diseases and clinical conditions, has been established by previous studies, as described hereinabove with reference to VGAM1034. Thromboxane A2 Receptor (TBXA2R, Accession NM_001060) is another VGAM1466 host target gene. TBXA2R BINDING SITE is HOST TARGET binding site found in the 3" untranslated region of mRNA encoded by TBXA2R, corresponding to a HOST TARGET binding site such as BINDING SITE I, BINDING SITE II or BINDING SITE III. Table 2 illustrates the complementarity of the nucleotide sequences of TBXA2R BINDING SITE, designated SEQ ID:6731, to the nucleotide sequence of VGAM1466 RNA, herein designated VGAM RNA, also designated SEQ ID:4177.

Another function of VGAM1466 is therefore inhibition of Thromboxane A2 Receptor (TBXA2R, Accession NM_001060), a gene which activates Ca2+-activated chloride channels; stimulates platelet aggregation and smooth muscle constriction. Accordingly, utilities of VGAM1466 include diagnosis, prevention and treatment of diseases and clinical conditions associated with TBXA2R. The function of TBXA2R and its association with various diseases and clinical conditions, has been established by previous studies, as described hereinabove with reference to VGAM433. Tec Protein Tyrosine Kinase (TEC, Accession NM_003215) is another VGAM1466 host target gene. TEC BINDING SITE is HOST TARGET binding site found in the 3' untranslated region of mRNA encoded by TEC, corresponding to a HOST TARGET binding site such as BINDING SITE I, BINDING SITE II or BINDING SITE III. Table 2 illustrates the complementarity of the nucleotide sequences of TEC BINDING SITE, designated SEQ ID:9219, to the nucleotide sequence of VGAM1466 RNA, herein designated VGAM RNA, also designated SEQ ID:4177.

Another function of VGAM1466 is therefore inhibition of Tec Protein Tyrosine Kinase (TEC, Accession NM_003215). Accordingly, utilities of VGAM1466 include diagnosis, prevention and treatment of diseases and clinical conditions associated with TEC. Trichorhinophalangeal Syndrome I (TRPS1, Accession NM_014112) is another VGAM1466 host target gene. TRPS1 BINDING SITE is HOST TARGET binding site found in the 3' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15357, to the nucleotide sequence of VGAM1466 RNA, herein designated VGAM RNA, also designated SEQ ID:4177.

Another function of VGAM1466 is therefore inhibition of Trichorhinophalangeal Syndrome I (TRPS1, Accession NM_014112), a gene which may function as a transcriptional activator protein. Accordingly, utilities of VGAM1466 include diagnosis, prevention and treatment of diseases and clinical conditions associated with TRPS1. The function of TRPS1 and its association with various diseases and clinical conditions, has been established by previous studies, as described hereinabove with reference to VGAM172. Ubiquitin Specific Protease 9, Y Chromosome (fat facets-like Drosophila) (USP9Y, Accession XM_034147) is another VGAM1466 host target gene. USP9Y BINDING SITE is HOST TARGET binding site found in the 3' untranslated region of mRNA encoded by USP9Y, corresponding to a HOST TARGET binding site such as BINDING SITE I, BINDING SITE II or BINDING SITE III. Table 2 illustrates the complementarity of the nucleotide sequences of USP9Y BINDING SITE, designated SEQ ID:32018, to the nucleotide sequence of VGAM1466 RNA, herein designated VGAM RNA, also designated SEQ ID:4177.

Another function of VGAM1466 is therefore inhibition of Ubiquitin Specific Protease 9, Y Chromosome (fat facets-like Drosophila) (USP9Y, Accession XM_034147), a gene which removes ubiquitin from ubiquitin-conjugated proteins and has a role in spermatogenesis. Accordingly, utilities of VGAM1466 include diagnosis, prevention and treatment of diseases and clinical conditions associated with USP9Y. The function of USP9Y and its association with various diseases and clinical conditions, has been established by previous studies, as described hereinabove with reference to VGAM894. Wolf-Hirschhorn Syndrome Candidate 1 (WHSC1, Accession NM_014919) is another VGAM1466 host target gene. WHSC1 BINDING SITE1 through WHSC1 BINDING SITE3 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE3, designated SEQ ID:17185, SEQ ID:28449 and SEQ ID:28466 respectively, to the nucleotide sequence of VGAM1466 RNA, herein designated VGAM RNA, also designated SEQ ID:4177.

Another function of VGAM1466 is therefore inhibition of Wolf-Hirschhorn Syndrome Candidate 1 (WHSC1, Accession NM_014919), a gene which binds covalently to and repairs g/t mismatches. Accordingly, utilities of VGAM1466 include diagnosis, prevention and treatment of diseases and clinical conditions associated with WHSC1. The function of WHSC1 and its association with various diseases and clinical conditions, has been established by previous studies, as described hereinabove with reference to VGAM200. Ras Homolog Gene Family, Member F (in filopodia) (ARHF, Accession NM_019034) is another VGAM1466 host target gene. ARHF BINDING SITE is HOST TARGET binding site found in the 3' untranslated region of mRNA encoded by ARHF, corresponding to a HOST TARGET binding site such as BINDING SITE I, BINDING SITE II or BINDING SITE III. Table 2 illustrates the complementarity of the nucleotide sequences of ARHF BINDING SITE, designated SEQ ID:21122, to the nucleotide sequence of VGAM1466 RNA, herein designated VGAM RNA, also designated SEQ ID:4177.

Another function of VGAM1466 is therefore inhibition of Ras Homolog Gene Family, Member F (in filopodia) (ARHF, Accession NM_019034). Accordingly, utilities of VGAM1466 include diagnosis, prevention and treatment of diseases and clinical conditions associated with ARHF. ARPP-19 (Accession NM_006628) is another VGAM1466 host target gene. ARPP-19 BINDING SITE is HOST TARGET binding site found in the 3' untranslated region of mRNA encoded by ARPP-19, corresponding to a HOST TARGET binding site such as BINDING SITE I, BINDING SITE II or BINDING SITE III. Table 2 illustrates the complementarity of the nucleotide sequences of ARPP-19 BINDING SITE, designated SEQ ID:13425, to the nucleotide sequence of VGAM1466 RNA, herein designated VGAM RNA, also designated SEQ ID:4177.

Another function of VGAM1466 is therefore inhibition of ARPP-19 (Accession NM_006628). Accordingly, utilities of VGAM1466 include diagnosis, prevention and treatment of diseases and clinical conditions associated with ARPP-19. Chromosome 11 Open Reading Frame 25 (C11orf25, Accession NM_031418) is another VGAM1466 host target gene. C11orf25 BINDING SITE is HOST TARGET binding site found in the 3' untranslated region of mRNA encoded by C11orf25, corresponding to a HOST TARGET binding site such as BINDING SITE I, BINDING SITE II or BINDING SITE III. Table 2 illustrates the complementarity of the nucleotide sequences of C11orf25 BINDING SITE, designated SEQ ID:25401, to the nucleotide sequence of VGAM1466 RNA, herein designated VGAM RNA, also designated SEQ ID:4177.

Another function of VGAM1466 is therefore inhibition of Chromosome 11 Open Reading Frame 25 (C11orf25, Accession NM_031418). Accordingly, utilities of VGAM1466 include diagnosis, prevention and treatment of diseases and clinical conditions associated with C11orf25. C1q and Tumor Necrosis Factor Related Protein 6 (C1QTNF6, Accession NM_031910) is another VGAM1466 host target gene. C1QTNF6 BINDING SITE is HOST TARGET binding site found in the 3" untranslated region of mRNA encoded by C1QTNF6, corresponding to a HOST TARGET binding site such as BINDING SITE I, BINDING SITE II or BINDING SITE III. Table 2 illustrates the complementarity of the nucleotide sequences of C1QTNF6 BINDING SITE, designated SEQ ID:25660, to the nucleotide sequence of VGAM1466 RNA, herein designated VGAM RNA, also designated SEQ ID:4177.

Another function of VGAM1466 is therefore inhibition of C1q and Tumor Necrosis Factor Related Protein 6 (C1QTNF6, Accession NM_031910). Accordingly, utilities of VGAM1466 include diagnosis, prevention and treatment of diseases and clinical conditions associated with C1QTNF6. Chromosome 9 Open Reading Frame 9 (C9orf9, Accession NM_018956) is another VGAM1466 host target gene. C9orf9 BINDING SITE is HOST TARGET binding site found in the 3' untranslated region of mRNA encoded by C9orf9, corresponding to a HOST TARGET binding site such as BINDING SITE I, BINDING SITE II or BINDING SITE III. Table 2 illustrates the complementarity of the nucleotide sequences of C9orf9 BINDING SITE, designated SEQ ID:21030, to the nucleotide sequence of VGAM1466 RNA, herein designated VGAM RNA, also designated SEQ ID:4177.

Another function of VGAM1466 is therefore inhibition of Chromosome 9 Open Reading Frame 9 (C9orf9, Accession NM_018956). Accordingly, utilities of VGAM1466 include diagnosis, prevention and treatment of diseases and clinical conditions associated with C9orf9. Calneuron 1 (CALN1, Accession NM_031468) is another VGAM1466 host target gene. CALN1 BINDING SITE is HOST TARGET binding site found in the 3' untranslated region of mRNA encoded by CALN1, corresponding to a HOST TARGET binding site such as BINDING SITE I, BINDING SITE II or BINDING SITE III. Table 2 illustrates the complementarity of the nucleotide sequences of CALN1 BINDING SITE, designated SEQ ID:25520, to the nucleotide sequence of VGAM1466 RNA, herein designated VGAM RNA, also designated SEQ ID:4177.

Another function of VGAM1466 is therefore inhibition of Calneuron 1 (CALN1, Accession NM_031468). Accordingly, utilities of VGAM1466 include diagnosis, prevention and treatment of diseases and clinical conditions associated with CALN1. Caspase Recruitment Domain Family, Member 6 (CARD6, Accession NM_032587) is another VGAM1466 host target gene. CARD6 BINDING SITE is HOST TARGET binding site found in the 3' untranslated region of mRNA encoded by CARD6, corresponding to a HOST TARGET binding site such as BINDING SITE I, BINDING SITE II or BINDING SITE III. Table 2 illustrates the complementarity of the nucleotide sequences of CARD6 BINDING SITE, designated SEQ ID:26323, to the nucleotide sequence of VGAM1466 RNA, herein designated VGAM RNA, also designated SEQ ID:4177.

Another function of VGAM1466 is therefore inhibition of Caspase Recruitment Domain Family, Member 6 (CARD6, Accession NM_032587). Accordingly, utilities of VGAM1466 include diagnosis, prevention and treatment of diseases and clinical conditions associated with CARD6. Chromobox Homolog 6 (CBX6, Accession NM_014292) is another VGAM1466 host target gene. CBX6 BINDING SITE is HOST TARGET binding site found in the 3' untranslated region of mRNA encoded by CBX6, corresponding to a HOST TARGET binding site such as BINDING SITE I, BINDING SITE II or BINDING SITE III. Table 2 illustrates the complementarity of the nucleotide sequences of CBX6 BINDING SITE, designated SEQ ID:15579, to the nucleotide sequence of VGAM1466 RNA, herein designated VGAM RNA, also designated SEQ ID:4177.

Another function of VGAM1466 is therefore inhibition of Chromobox Homolog 6 (CBX6, Accession NM_014292). Accordingly, utilities of VGAM1466 include diagnosis, prevention and treatment of diseases and clinical conditions associated with CBX6. CDC14 Cell Division Cycle 14 Homolog A (S. cerevisiae) (CDC14A, Accession NM_003672) is another VGAM1466 host target gene. CDC14A BINDING SITE is HOST TARGET binding site found in the 3' untranslated region of mRNA encoded by CDC14A, corresponding to a HOST TARGET binding site such as BINDING SITE I, BINDING SITE II or BINDING SITE III. Table 2 illustrates the complementarity of the nucleotide sequences of CDC14A BINDING SITE, designated SEQ ID:9766, to the nucleotide sequence of VGAM1466 RNA, herein designated VGAM RNA, also designated SEQ ID:4177.

Another function of VGAM1466 is therefore inhibition of CDC14 Cell Division Cycle 14 Homolog A (S. cerevisiae) (CDC14A, Accession NM_003672). Accordingly, utilities of VGAM1466 include diagnosis, prevention and treatment of diseases and clinical conditions associated with CDC14A. Chromatin Accessibility Complex 1 (CHRAC1, Accession NM_017444) is another VGAM1466 host target gene. CHRAC1 BINDING SITE is HOST TARGET binding site found in the 3' untranslated region of mRNA encoded by CHRAC1, corresponding to a HOST TARGET binding site such as BINDING SITE I, BINDING SITE II or BINDING SITE III. Table 2 illustrates the complementarity of the nucleotide sequences of CHRAC1 BINDING SITE, designated SEQ ID:18906, to the nucleotide sequence of VGAM1466 RNA, herein designated VGAM RNA, also designated SEQ ID:4177.

Another function of VGAM1466 is therefore inhibition of Chromatin Accessibility Complex 1 (CHRAC1, Accession NM_017444). Accordingly, utilities of VGAM1466 include diagnosis, prevention and treatment of diseases and clinical conditions associated with CHRAC1. DKFZP434F0318 (Accession NM_030817) is another VGAM1466 host target gene. DKFZP434F0318 BINDING SITE is HOST TARGET binding site found in the 3' untranslated region of mRNA encoded by DKFZP434F0318, corresponding to a HOST TARGET binding site such as BINDING SITE I, BINDING SITE II or BINDING SITE III. Table 2 illustrates the complementarity of the nucleotide sequences of DKFZP434F0318 BINDING SITE, designated SEQ ID:25144, to the nucleotide sequence of VGAM1466 RNA, herein designated VGAM RNA, also designated SEQ ID:4177.

Another function of VGAM1466 is therefore inhibition of DKFZP434F0318 (Accession NM_030817). Accordingly, utilities of VGAM1466 include diagnosis, prevention and treatment of diseases and clinical conditions associated with DKFZP434F0318. DKFZP564G092 (Accession NM_015601) is another VGAM1466 host target gene. DKFZP564G092 BINDING SITE is HOST TARGET binding site found in the 5' untranslated region of mRNA encoded by DKFZP564G092, corresponding to a HOST TARGET binding site such as BINDING SITE I, BINDING SITE II or BINDING SITE III. Table 2 illustrates the complementarity of the nucleotide sequences of DKFZP564G092 BINDING SITE, designated SEQ ID:17878, to the nucleotide sequence of VGAM1466 RNA, herein designated VGAM RNA, also designated SEQ ID:4177.

Another function of VGAM1466 is therefore inhibition of DKFZP564G092 (Accession NM_015601). Accordingly, utilities of VGAM1466 include diagnosis, prevention and treatment of diseases and clinical conditions associated with DKFZP564G092. DKFZP564O0463 (Accession NM_014156) is another VGAM1466 host target gene. DKFZP564O0463 BINDING SITE is HOST TARGET binding site found in the 3' untranslated region of mRNA encoded by DKFZP564O0463, corresponding to a HOST TARGET binding site such as BINDING SITE I, BINDING SITE II or BINDING SITE III. Table 2 illustrates the complementarity of the nucleotide sequences of DKFZP564O0463 BINDING SITE, designated SEQ ID:15446, to the nucleotide sequence of VGAM1466 RNA, herein designated VGAM RNA, also designated SEQ ID:4177.

Another function of VGAM1466 is therefore inhibition of DKFZP564O0463 (Accession NM_014156). Accordingly, utilities of VGAM1466 include diagnosis, prevention and treatment of diseases and clinical conditions associated with DKFZP564O0463. DKFZp761O0113 (Accession NM_018409) is another VGAM1466 host target gene. DKFZp761O0113 BINDING SITE is HOST TARGET binding site found in the 5' untranslated region of mRNA encoded by DKFZp761O0113, corresponding to a HOST TARGET binding site such as BINDING SITE I, BINDING SITE II or BINDING SITE III. Table 2 illustrates the complementarity of the nucleotide sequences of DKFZp761O0113 BINDING SITE, designated SEQ ID:20449, to the nucleotide sequence of VGAM1466 RNA, herein designated VGAM RNA, also designated SEQ ID:4177.

Another function of VGAM1466 is therefore inhibition of DKFZp761O0113 (Accession NM_018409). Accordingly, utilities of VGAM1466 include diagnosis, prevention and treatment of diseases and clinical conditions associated with DKFZp761O0113. Eukaryotic Translation Initiation Factor 2C, 2 (EIF2C2, Accession XM_050334) is another VGAM1466 host target gene. EIF2C2 BINDING SITE is HOST TARGET binding site found in the 3' untranslated region of mRNA encoded by EIF2C2, corresponding to a HOST TARGET binding site such as BINDING SITE I, BINDING SITE II or BINDING SITE III. Table 2 illustrates the complementarity of the nucleotide sequences of EIF2C2 BINDING SITE, designated SEQ ID:35614, to the nucleotide sequence of VGAM1466 RNA, herein designated VGAM RNA, also designated SEQ ID:4177.

Another function of VGAM1466 is therefore inhibition of Eukaryotic Translation Initiation Factor 2C, 2 (EIF2C2, Accession XM_050334). Accordingly, utilities of VGAM1466 include diagnosis, prevention and treatment of diseases and clinical conditions associated with EIF2C2. FLJ12903 (Accession NM_022753) is another VGAM1466 host target gene. FLJ12903 BINDING SITE is HOST TARGET binding site found in the 3' untranslated region of mRNA encoded by FLJ12903, corresponding to a HOST TARGET binding site such as BINDING SITE I, BINDING SITE II or BINDING SITE III. Table 2 illustrates the complementarity of the nucleotide sequences of FLJ12903 BINDING SITE, designated SEQ ID:22984, to the nucleotide sequence of VGAM1466 RNA, herein designated VGAM RNA, also designated SEQ ID:4177.

Another function of VGAM1466 is therefore inhibition of FLJ12903 (Accession NM_022753). Accordingly, utilities of VGAM1466 include diagnosis, prevention and treatment of diseases and clinical conditions associated with FLJ12903.

FLJ13188 (Accession NM_022063) is another VGAM1466 host target gene. FLJ13188 BINDING SITE is HOST TARGET binding site found in the 3' untranslated region of mRNA encoded by FLJ13188, corresponding to a HOST TARGET binding site such as BINDING SITE I, BINDING SITE II or BINDING SITE III. Table 2 illustrates the complementarity of the nucleotide sequences of FLJ13188 BINDING SITE, designated SEQ ID:22607, to the nucleotide sequence of VGAM1466 RNA, herein designated VGAM RNA, also designated SEQ ID:4177.

Another function of VGAM1466 is therefore inhibition of FLJ13188 (Accession NM_022063). Accordingly, utilities of VGAM1466 include diagnosis, prevention and treatment of diseases and clinical conditions associated with FLJ13188.

FLJ13197 (Accession NM_024614) is another VGAM1466 host target gene. FLJ13197 BINDING SITE is HOST TARGET binding site found in the 3' untranslated region of mRNA encoded by FLJ13197, corresponding to a HOST TARGET binding site such as BINDING SITE I, BINDING SITE II or BINDING SITE III. Table 2 illustrates the complementarity of the nucleotide sequences of FLJ13197 BINDING SITE, designated SEQ ID:23875, to the nucleotide sequence of VGAM1466 RNA, herein designated VGAM RNA, also designated SEQ ID:4177.

Another function of VGAM1466 is therefore inhibition of FLJ13197 (Accession NM_024614). Accordingly, utilities of VGAM1466 include diagnosis, prevention and treatment of diseases and clinical conditions associated with FLJ13197.

FLJ14084 (Accession NM_021637) is another VGAM1466 host target gene. FLJ14084 BINDING SITE is HOST TARGET binding site found in the 3' untranslated region of mRNA encoded by FLJ14084, corresponding to a HOST TARGET binding site such as BINDING SITE I, BINDING SITE II or BINDING SITE III. Table 2 illustrates the complementarity of the nucleotide sequences of FLJ14084 BINDING SITE, designated SEQ ID:22285, to the nucleotide sequence of VGAM1466 RNA, herein designated VGAM RNA, also designated SEQ ID:4177.

Another function of VGAM1466 is therefore inhibition of FLJ14084 (Accession NM_021637). Accordingly, utilities of VGAM1466 include diagnosis, prevention and treatment of diseases and clinical conditions associated with FLJ14084.

FLJ14950 (Accession NM_032865) is another VGAM1466 host target gene. FLJ14950 BINDING SITE is HOST TARGET binding site found in the 3' untranslated region of mRNA encoded by FLJ14950, corresponding to a HOST TARGET binding site such as BINDING SITE I, BINDING SITE II or BINDING SITE III. Table 2 illustrates the complementarity of the nucleotide sequences of FLJ14950 BINDING SITE, designated SEQ ID:26678, to the nucleotide sequence of VGAM1466 RNA, herein designated VGAM RNA, also designated SEQ ID:4177.

Another function of VGAM1466 is therefore inhibition of FLJ14950 (Accession NM_032865). Accordingly, utilities of VGAM1466 include diagnosis, prevention and treatment of diseases and clinical conditions associated with FLJ14950.

FLJ14957 (Accession NM_032866) is another VGAM1466 host target gene. FLJ14957 BINDING SITE is HOST TARGET binding site found in the 3' untranslated region of mRNA encoded by FLJ14957, corresponding to a HOST TARGET binding site such as BINDING SITE I, BINDING SITE II or BINDING SITE III. Table 2 illustrates the complementarity of the nucleotide sequences of FLJ14957 BINDING SITE, designated SEQ ID:26685, to the nucleotide sequence of VGAM1466 RNA, herein designated VGAM RNA, also designated SEQ ID:4177.

Another function of VGAM1466 is therefore inhibition of FLJ14957 (Accession NM_032866). Accordingly, utilities of VGAM1466 include diagnosis, prevention and treatment of diseases and clinical conditions associated with FLJ14957.

FLJ20010 (Accession NM_019021) is another VGAM1466 host target gene. FLJ20010 BINDING SITE is HOST TARGET binding site found in the 3' untranslated region of mRNA encoded by FLJ20010, corresponding to a HOST TARGET binding site such as BINDING SITE I, BINDING SITE II or BINDING SITE III. Table 2 illustrates the complementarity of the nucleotide sequences of FLJ20010 BINDING SITE, designated SEQ ID:21110, to the nucleotide sequence of VGAM1466 RNA, herein designated VGAM RNA, also designated SEQ ID:4177.

Another function of VGAM1466 is therefore inhibition of FLJ20010 (Accession NM_019021). Accordingly, utilities of VGAM1466 include diagnosis, prevention and treatment of diseases and clinical conditions associated with FLJ20010.

FLJ20695 (Accession NM_017929) is another VGAM1466 host target gene. FLJ20695 BINDING SITE is HOST TARGET binding site found in the 3' untranslated region of mRNA encoded by FLJ20695, corresponding to a HOST TARGET binding site such as BINDING SITE I, BINDING SITE II or BINDING SITE III. Table 2 illustrates the complementarity of the nucleotide sequences of FLJ20695 BINDING SITE, designated SEQ ID:19615, to the nucleotide sequence of VGAM1466 RNA, herein designated VGAM RNA, also designated SEQ ID:4177.

Another function of VGAM1466 is therefore inhibition of FLJ20695 (Accession NM_017929). Accordingly, utilities of VGAM1466 include diagnosis, prevention and treatment of diseases and clinical conditions associated with FLJ20695.

FLJ22944 (Accession NM_025145) is another VGAM1466 host target gene. FLJ22944 BINDING SITE is HOST TARGET binding site found in the 3' untranslated region of mRNA encoded by FLJ22944, corresponding to a HOST TARGET binding site such as BINDING SITE I, BINDING SITE II or BINDING SITE III. Table 2 illustrates the complementarity of the nucleotide sequences of FLJ22944 BINDING SITE, designated SEQ ID:24784, to the nucleotide sequence of VGAM1466 RNA, herein designated VGAM RNA, also designated SEQ ID:4177.

Another function of VGAM1466 is therefore inhibition of FLJ22944 (Accession NM_025145). Accordingly, utilities of VGAM1466 include diagnosis, prevention and treatment of diseases and clinical conditions associated with FLJ22944.

FLJ23519 (Accession NM_032240) is another VGAM1466 host target gene. FLJ23519 BINDING SITE is HOST TARGET binding site found in the 3' untranslated region of mRNA encoded by FLJ23519, corresponding to a HOST TARGET binding site such as BINDING SITE I, BINDING SITE II or BINDING SITE III. Table 2 illustrates the complementarity of the nucleotide sequences of FLJ23519 BINDING SITE, designated SEQ ID:25978, to the nucleotide sequence of VGAM1466 RNA, herein designated VGAM RNA, also designated SEQ ID:4177.

Another function of VGAM1466 is therefore inhibition of FLJ23519 (Accession NM_032240). Accordingly, utilities of VGAM1466 include diagnosis, prevention and treatment of diseases and clinical conditions associated with FLJ23519.

FLJ31101 (Accession NM_017964) is another VGAM1466 host target gene. FLJ31101 BINDING SITE is HOST TARGET binding site found in the 3' untranslated region of mRNA encoded by FLJ31101, corresponding to a HOST TARGET binding site such as BINDING SITE I, BINDING SITE II or BINDING SITE III. Table 2 illustrates the complementarity of the nucleotide sequences of FLJ31101 BINDING SITE, designated SEQ ID:19687, to the nucleotide sequence of VGAM1466 RNA, herein designated VGAM RNA, also designated SEQ ID:4177.

Another function of VGAM1466 is therefore inhibition of FLJ31101 (Accession NM_017964). Accordingly, utilities of VGAM1466 include diagnosis, prevention and treatment of diseases and clinical conditions associated with FLJ31101. FLJ31153 (Accession NM_144600) is another VGAM1466 host target gene. FLJ31153 BINDING SITE is HOST TARGET binding site found in the 3' untranslated region of mRNA encoded by FLJ31153, corresponding to a HOST TARGET binding site such as BINDING SITE I, BINDING SITE II or BINDING SITE III. Table 2 illustrates the complementarity of the nucleotide sequences of FLJ31153 BINDING SITE, designated SEQ ID:29415, to the nucleotide sequence of VGAM1466 RNA, herein designated VGAM RNA, also designated SEQ ID:4177.

Another function of VGAM1466 is therefore inhibition of FLJ31153 (Accession NM_144600). Accordingly, utilities of VGAM1466 include diagnosis, prevention and treatment of diseases and clinical conditions associated with FLJ31153. GREB1 (Accession NM_014668) is another VGAM1466 host target gene. GREB1 BINDING SITE is HOST TARGET binding site found in the 3' untranslated region of mRNA encoded by GREB1, corresponding to a HOST TARGET binding site such as BINDING SITE I, BINDING SITE II or BINDING SITE III. Table 2 illustrates the complementarity of the nucleotide sequences of GREB1 BINDING SITE, designated SEQ ID:16126, to the nucleotide sequence of VGAM1466 RNA, herein designated VGAM RNA, also designated SEQ ID:4177.

Another function of VGAM1466 is therefore inhibition of GREB1 (Accession NM_014668). Accordingly, utilities of VGAM1466 include diagnosis, prevention and treatment of diseases and clinical conditions associated with GREB1. GRP3 (Accession NM_015376) is another VGAM1466 host target gene. GRP3 BINDING SITE is HOST TARGET binding site found in the 3' untranslated region of mRNA encoded by GRP3, corresponding to a HOST TARGET binding site such as BINDING SITE I, BINDING SITE II or BINDING SITE III. Table 2 illustrates the complementarity of the nucleotide sequences of GRP3 BINDING SITE, designated SEQ ID:17674, to the nucleotide sequence of VGAM1466 RNA, herein designated VGAM RNA, also designated SEQ ID:4177.

Another function of VGAM1466 is therefore inhibition of GRP3 (Accession NM_015376). Accordingly, utilities of VGAM1466 include diagnosis, prevention and treatment of diseases and clinical conditions associated with GRP3. HSMPP8 (Accession XM_167894) is another VGAM1466 host target gene. HSMPP8 BINDING SITE is HOST TARGET binding site found in the 3' untranslated region of mRNA encoded by HSMPP8, corresponding to a HOST TARGET binding site such as BINDING SITE I, BINDING SITE II or BINDING SITE III. Table 2 illustrates the complementarity of the nucleotide sequences of HSMPP8 BINDING SITE, designated SEQ ID:44905, to the nucleotide sequence of VGAM1466 RNA, herein designated VGAM RNA, also designated SEQ ID:4177.

Another function of VGAM1466 is therefore inhibition of HSMPP8 (Accession XM_167894). Accordingly, utilities of VGAM1466 include diagnosis, prevention and treatment of diseases and clinical conditions associated with HSMPP8. JM11 (Accession NM_033626) is another VGAM1466 host target gene. JM11 BINDING SITE is HOST TARGET binding site found in the 3' untranslated region of mRNA encoded by JM11, corresponding to a HOST TARGET binding site such as BINDING SITE I, BINDING SITE II or BINDING SITE III. Table 2 illustrates the complementarity of the nucleotide sequences of JM11 BINDING SITE, designated SEQ ID:27333, to the nucleotide sequence of VGAM1466 RNA, herein designated VGAM RNA, also designated SEQ ID:4177.

Another function of VGAM1466 is therefore inhibition of JM11 (Accession NM_033626). Accordingly, utilities of VGAM1466 include diagnosis, prevention and treatment of diseases and clinical conditions associated with JM11. KIAA0087 (Accession NM_014769) is another VGAM1466 host target gene. KIAA0087 BINDING SITE is HOST TARGET binding site found in the 3' untranslated region of mRNA encoded by KIAA0087, corresponding to a HOST TARGET binding site such as BINDING SITE I, BINDING SITE II or BINDING SITE III. Table 2 illustrates the complementarity of the nucleotide sequences of KIAA0087 BINDING SITE, designated SEQ ID:16561, to the nucleotide sequence of VGAM1466 RNA, herein designated VGAM RNA, also designated SEQ ID:4177.

Another function of VGAM1466 is therefore inhibition of KIAA0087 (Accession NM_014769). Accordingly, utilities of VGAM1466 include diagnosis, prevention and treatment of diseases and clinical conditions associated with KIAA0087. KIAA0352 (Accession NM_014830) is another VGAM1466 host target gene. KIAA0352 BINDING SITE is HOST TARGET binding site found in the 3' untranslated region of mRNA encoded by KIAA0352, corresponding to a HOST TARGET binding site such as BINDING SITE I, BINDING SITE II or BINDING SITE III. Table 2 illustrates the complementarity of the nucleotide sequences of KIAA0352 BINDING SITE, designated SEQ ID:16826, to the nucleotide sequence of VGAM1466 RNA, herein designated VGAM RNA, also designated SEQ ID:4177.

Another function of VGAM1466 is therefore inhibition of KIAA0352 (Accession NM_014830). Accordingly, utilities of VGAM1466 include diagnosis, prevention and treatment of diseases and clinical conditions associated with KIAA0352. KIAA0449 (Accession NM_017596) is another VGAM1466 host target gene. KIAA0449 BINDING SITE is HOST TARGET binding site found in the 3' untranslated region of mRNA encoded by KIAA0449, corresponding to a HOST TARGET binding site such as BINDING SITE I, BINDING SITE II or BINDING SITE III. Table 2 illustrates the complementarity of the nucleotide sequences of KIAA0449 BINDING SITE, designated SEQ ID:19054, to the nucleotide sequence of VGAM1466 RNA, herein designated VGAM RNA, also designated SEQ ID:4177.

Another function of VGAM1466 is therefore inhibition of KIAA0449 (Accession NM_017596). Accordingly, utilities of VGAM1466 include diagnosis, prevention and treatment of diseases and clinical conditions associated with KIAA0449. KIAA0472 (Accession XM_050147) is another VGAM1466 host target gene. KIAA0472 BINDING SITE is HOST TARGET binding site found in the 5' untranslated region of mRNA encoded by KIAA0472, corresponding to a HOST TARGET binding site such as BINDING SITE I, BINDING SITE II or BINDING SITE III. Table 2 illustrates the complementarity of the nucleotide sequences of KIAA0472 BINDING SITE, designated SEQ ID:35584, to the nucleotide sequence of VGAM1466 RNA, herein designated VGAM RNA, also designated SEQ ID:4177.

Another function of VGAM1466 is therefore inhibition of KIAA0472 (Accession XM_050147). Accordingly, utilities of VGAM1466 include diagnosis, prevention and treatment of diseases and clinical conditions associated with KIAA0472. KIAA0513 (Accession NM_014732) is another VGAM1466 host target gene. KIAA0513 BINDING SITE is HOST TARGET binding site found in the 5' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16364, to the nucleotide sequence of VGAM1466 RNA, herein designated VGAM RNA, also designated SEQ ID:4177.

Another function of VGAM1466 is therefore inhibition of KIAA0513 (Accession NM_014732). Accordingly, utilities of VGAM1466 include diagnosis, prevention and treatment of diseases and clinical conditions associated with KIAA0513. KIAA0557 (Accession XM_085507) is another VGAM1466 host target gene. KIAA0557 BINDING SITE is HOST TARGET binding site found in the 3' untranslated region of mRNA encoded by KIAA0557, corresponding to a HOST TARGET binding site such as BINDING SITE I, BINDING SITE II or BINDING SITE III. Table 2 illustrates the complementarity of the nucleotide sequences of KIAA0557 BINDING SITE, designated SEQ ID:38213, to the nucleotide sequence of VGAM1466 RNA, herein designated VGAM RNA, also designated SEQ ID:4177.

Another function of VGAM1466 is therefore inhibition of KIAA0557 (Accession XM_085507). Accordingly, utilities of VGAM1466 include diagnosis, prevention and treatment of diseases and clinical conditions associated with KIAA0557. KIAA0828 (Accession XM_088105) is another VGAM1466 host target gene. KIAA0828 BINDING SITE is HOST TARGET binding site found in the 3' untranslated region of mRNA encoded by KIAA0828, corresponding to a HOST TARGET binding site such as BINDING SITE I, BINDING SITE II or BINDING SITE III. Table 2 illustrates the complementarity of the nucleotide sequences of KIAA0828 BINDING SITE, designated SEQ ID:39516, to the nucleotide sequence of VGAM1466 RNA, herein designated VGAM RNA, also designated SEQ ID:4177.

Another function of VGAM1466 is therefore inhibition of KIAA0828 (Accession XM_088105). Accordingly, utilities of VGAM1466 include diagnosis, prevention and treatment of diseases and clinical conditions associated with KIAA0828. KIAA0831 (Accession NM_014924) is another VGAM1466 host target gene. KIAA0831 BINDING SITE is HOST TARGET binding site found in the 3' untranslated region of mRNA encoded by KIAA0831, corresponding to a HOST TARGET binding site such as BINDING SITE I, BINDING SITE II or BINDING SITE III. Table 2 illustrates the complementarity of the nucleotide sequences of KIAA0831 BINDING SITE, designated SEQ ID:17210, to the nucleotide sequence of VGAM1466 RNA, herein designated VGAM RNA, also designated SEQ ID:4177.

Another function of VGAM1466 is therefore inhibition of KIAA0831 (Accession NM_014924). Accordingly, utilities of VGAM1466 include diagnosis, prevention and treatment of diseases and clinical conditions associated with KIAA0831. KIAA1198 (Accession XM_032674) is another VGAM1466 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31719, to the nucleotide sequence of VGAM1466 RNA, herein designated VGAM RNA, also designated SEQ ID:4177.

Another function of VGAM1466 is therefore inhibition of KIAA1198 (Accession XM_032674). Accordingly, utilities of VGAM1466 include diagnosis, prevention and treatment of diseases and clinical conditions associated with KIAA1198. KIAA1257 (Accession XM_031577) is another VGAM1466 host target gene. KIAA1257 BINDING SITE is HOST TARGET binding site found in the 3' untranslated region of mRNA encoded by KIAA1257, corresponding to a HOST TARGET binding site such as BINDING SITE I, BINDING SITE II or BINDING SITE III. Table 2 illustrates the complementarity of the nucleotide sequences of KIAA1257 BINDING SITE, designated SEQ ID:31443, to the nucleotide sequence of VGAM1466 RNA, herein designated VGAM RNA, also designated SEQ ID:4177.

Another function of VGAM1466 is therefore inhibition of KIAA1257 (Accession XM_031577). Accordingly, utilities of VGAM1466 include diagnosis, prevention and treatment of diseases and clinical conditions associated with KIAA1257. KIAA1430 (Accession XM_087593) is another VGAM1466 host target gene. KIAA1430 BINDING SITE is HOST TARGET binding site found in the 3' untranslated region of mRNA encoded by KIAA1430, corresponding to a HOST TARGET binding site such as BINDING SITE I, BINDING SITE II or BINDING SITE III. Table 2 illustrates the complementarity of the nucleotide sequences of KIAA1430 BINDING SITE, designated SEQ ID:39358, to the nucleotide sequence of VGAM1466 RNA, herein designated VGAM RNA, also designated SEQ ID:4177.

Another function of VGAM1466 is therefore inhibition of KIAA1430 (Accession XM_087593). Accordingly, utilities of VGAM1466 include diagnosis, prevention and treatment of diseases and clinical conditions associated with KIAA1430. KIAA1500 (Accession XM_034353) is another VGAM1466 host target gene. KIAA1500 BINDING SITE is HOST TARGET binding site found in the 3' untranslated region of mRNA encoded by KIAA1500, corresponding to a HOST TARGET binding site such as BINDING SITE I, BINDING SITE II or BINDING SITE III. Table 2 illustrates the complementarity of the nucleotide sequences of KIAA1500 BINDING SITE, designated SEQ ID:32070, to the nucleotide sequence of VGAM1466 RNA, herein designated VGAM RNA, also designated SEQ ID:4177.

Another function of VGAM1466 is therefore inhibition of KIAA1500 (Accession XM_034353). Accordingly, utilities of VGAM1466 include diagnosis, prevention and treatment of diseases and clinical conditions associated with KIAA1500. KIAA1655 (Accession XM_039442) is another VGAM1466 host target gene. KIAA1655 BINDING SITE is HOST TARGET binding site found in the 3' untranslated region of mRNA encoded by KIAA1655, corresponding to a HOST TARGET binding site such as BINDING SITE I, BINDING SITE II or BINDING SITE III. Table 2 illustrates the complementarity of the nucleotide sequences of KIAA1655 BINDING SITE, designated SEQ ID:33092, to the nucleotide sequence of VGAM1466 RNA, herein designated VGAM RNA, also designated SEQ ID:4177.

Another function of VGAM1466 is therefore inhibition of KIAA1655 (Accession XM_039442). Accordingly, utilities of VGAM1466 include diagnosis, prevention and treatment of diseases and clinical conditions associated with KIAA1655. KIAA1727 (Accession XM_034262) is another VGAM1466 host target gene. KIAA1727 BINDING SITE is HOST TARGET binding site found in the 3' untranslated region of mRNA encoded by KIAA1727, corresponding to a HOST TARGET binding site such as BINDING SITE I, BINDING SITE II or BINDING SITE III. Table 2 illustrates the complementarity of the nucleotide sequences of KIAA1727 BINDING SITE, designated SEQ ID:32037, to the nucleotide sequence of VGAM1466 RNA, herein designated VGAM RNA, also designated SEQ ID:4177.

Another function of VGAM1466 is therefore inhibition of KIAA1727 (Accession XM_034262). Accordingly, utilities of VGAM1466 include diagnosis, prevention and treatment of diseases and clinical conditions associated with KIAA1727. KIAA1971 (Accession XM_058720) is another VGAM1466 host target gene. KIAA1971 BINDING SITE is HOST TARGET binding site found in the 3' untranslated region of mRNA encoded by KIAA1971, corresponding to a HOST TARGET binding site such as BINDING SITE I, BINDING SITE II or BINDING SITE III. Table 2 illustrates the complementarity of the nucleotide sequences of KIAA1971 BINDING SITE, designated SEQ ID:36732, to the nucleotide sequence of VGAM1466 RNA, herein designated VGAM RNA, also designated SEQ ID:4177.

Another function of VGAM1466 is therefore inhibition of KIAA1971 (Accession XM_058720). Accordingly, utilities of VGAM1466 include diagnosis, prevention and treatment of diseases and clinical conditions associated with KIAA1971. Kallikrein 7 (chymotryptic, stratum corneum) (KLK7, Accession NM_139277) is another VGAM1466 host target gene. KLK7 BINDING SITE1 and KLK7 BINDING SITE2 are HOST TARGET binding sites found in untranslated regions of mRNA encoded by KLK7, corresponding to HOST TARGET binding sites such as BINDING SITE I, BINDING SITE II or BINDING SITE III. Table 2 illustrates the complementarity of the nucleotide sequences of KLK7 BINDING SITE1 and KLK7 BINDING SITE2, designated SEQ ID:29275 and SEQ ID:11478 respectively, to the nucleotide sequence of VGAM1466 RNA, herein designated VGAM RNA, also designated SEQ ID:4177.

Another function of VGAM1466 is therefore inhibition of Kallikrein 7 (chymotryptic, stratum corneum) (KLK7, Accession NM_139277). Accordingly, utilities of VGAM1466 include diagnosis, prevention and treatment of diseases and clinical conditions associated with KLK7. MGC21675 (Accession NM_052861) is another VGAM1466 host target gene. MGC21675 BINDING SITE is HOST TARGET binding site found in the 3' untranslated region of mRNA encoded by MGC21675, corresponding to a HOST TARGET binding site such as BINDING SITE I, BINDING SITE II or BINDING SITE III. Table 2 illustrates the complementarity of the nucleotide sequences of MGC21675 BINDING SITE, designated SEQ ID:27446, to the nucleotide sequence of VGAM1466 RNA, herein designated VGAM RNA, also designated SEQ ID:4177.

Another function of VGAM1466 is therefore inhibition of MGC21675 (Accession NM_052861). Accordingly, utilities of VGAM1466 include diagnosis, prevention and treatment of diseases and clinical conditions associated with MGC21675. MGC4707 (Accession NM_024113) is another VGAM1466 host target gene. MGC4707 BINDING SITE is HOST TARGET binding site found in the 3' untranslated region of mRNA encoded by MGC4707, corresponding to a HOST TARGET binding site such as BINDING SITE I, BINDING SITE II or BINDING SITE III. Table 2 illustrates the complementarity of the nucleotide sequences of MGC4707 BINDING SITE, designated SEQ ID:23565, to the nucleotide sequence of VGAM1466 RNA, herein designated VGAM RNA, also designated SEQ ID:4177.

Another function of VGAM1466 is therefore inhibition of MGC4707 (Accession NM_024113). Accordingly, utilities of VGAM1466 include diagnosis, prevention and treatment of diseases and clinical conditions associated with MGC4707. Ninjurin 2 (NINJ2, Accession NM_016533) is another VGAM1466 host target gene. NINJ2 BINDING SITE is HOST TARGET binding site found in the 3' untranslated region of mRNA encoded by NINJ2, corresponding to a HOST TARGET binding site such as BINDING SITE I, BINDING SITE II or BINDING SITE III. Table 2 illustrates the complementarity of the nucleotide sequences of NINJ2 BINDING SITE, designated SEQ ID:18606, to the nucleotide sequence of VGAM1466 RNA, herein designated VGAM RNA, also designated SEQ ID:4177.

Another function of VGAM1466 is therefore inhibition of Ninjurin 2 (NINJ2, Accession NM_016533). Accordingly, utilities of VGAM1466 include diagnosis, prevention and treatment of diseases and clinical conditions associated with NINJ2. Nup43 (Accession NM_024647) is another VGAM1466 host target gene. Nup43 BINDING SITE is HOST TARGET binding site found in the 3' untranslated region of mRNA encoded by Nup43, corresponding to a HOST TARGET binding site such as BINDING SITE I, BINDING SITE II or BINDING SITE III. Table 2 illustrates the complementarity of the nucleotide sequences of Nup43 BINDING SITE, designated SEQ ID:23938, to the nucleotide sequence of VGAM1466 RNA, herein designated VGAM RNA, also designated SEQ ID:4177.

Another function of VGAM1466 is therefore inhibition of Nup43 (Accession NM_024647). Accordingly, utilities of VGAM1466 include diagnosis, prevention and treatment of diseases and clinical conditions associated with Nup43. OCT11 (Accession NM_014352) is another VGAM1466 host target gene. OCT11 BINDING SITE is HOST TARGET binding site found in the 3' untranslated region of mRNA encoded by OCT11, corresponding to a HOST TARGET binding site such as BINDING SITE I, BINDING SITE II or BINDING SITE III. Table 2 illustrates the complementarity of the nucleotide sequences of OCT11 BINDING SITE, designated SEQ ID:15680, to the nucleotide sequence of VGAM1466 RNA, herein designated VGAM RNA, also designated SEQ ID:4177.

Another function of VGAM1466 is therefore inhibition of OCT11 (Accession NM_014352). Accordingly, utilities of VGAM1466 include diagnosis, prevention and treatment of diseases and clinical conditions associated with OCT11. PAI-RBP1 (Accession NM_015640) is another VGAM1466 host target gene. PAI-RBP1 BINDING SITE is HOST TARGET binding site found in the 3' untranslated region of mRNA encoded by PAI-RBP1, corresponding to a HOST TARGET binding site such as BINDING SITE I, BINDING SITE II or BINDING SITE III. Table 2 illustrates the complementarity of the nucleotide sequences of PAI-RBP1 BINDING SITE, designated SEQ ID:17894, to the nucleotide sequence of VGAM1466 RNA, herein designated VGAM RNA, also designated SEQ ID:4177.

Another function of VGAM1466 is therefore inhibition of PAI-RBP1 (Accession NM_015640). Accordingly, utilities of VGAM1466 include diagnosis, prevention and treatment of diseases and clinical conditions associated with PAI-RBP1. Pellino Homolog 1 (Drosophila) (PELI1, Accession NM_020651) is another VGAM1466 host target gene. PELI1 BINDING SITE is HOST TARGET binding site found in the 5' untranslated region of mRNA encoded by PELI1, corresponding to a HOST TARGET binding site such as BINDING SITE I, BINDING SITE II or BINDING SITE III. Table 2 illustrates the complementarity of the nucleotide sequences of PELI1 BINDING SITE, designated SEQ ID:21818, to the nucleotide sequence of VGAM1466 RNA, herein designated VGAM RNA, also designated SEQ ID:4177.

Another function of VGAM1466 is therefore inhibition of Pellino Homolog 1 (Drosophila) (PELI1, Accession NM_020651). Accordingly, utilities of VGAM1466 include diagnosis, prevention and treatment of diseases and clinical conditions associated with PELI1. PIP3-E (Accession XM_039749) is another VGAM1466 host target gene. PIP3-E BINDING SITE is HOST TARGET binding site found in the 3' untranslated region of mRNA encoded by PIP3-E, corresponding to a HOST TARGET binding site such as BINDING SITE I, BINDING SITE II or BINDING SITE III. Table 2 illustrates the complementarity of the nucleotide sequences of PIP3-E BINDING SITE, designated SEQ ID:33181, to the nucleotide sequence of VGAM1466 RNA, herein designated VGAM RNA, also designated SEQ ID:4177.

Another function of VGAM1466 is therefore inhibition of PIP3-E (Accession XM_039749). Accordingly, utilities of VGAM1466 include diagnosis, prevention and treatment of diseases and clinical conditions associated with PIP3-E. Protein Phosphatase 1, Regulatory (inhibitor) Subunit 3B (PPP1R3B, Accession NM_024607) is another VGAM1466 host target gene. PPP1R3B BINDING SITE is HOST TARGET binding site found in the 3' untranslated region of mRNA encoded by PPP1R3B, corresponding to a HOST TARGET binding site such as BINDING SITE I, BINDING SITE II or BINDING SITE III. Table 2 illustrates the complementarity of the nucleotide sequences of PPP1R3B BINDING SITE, designated SEQ ID:23858, to the nucleotide sequence of VGAM1466 RNA, herein designated VGAM RNA, also designated SEQ ID:4177.

Another function of VGAM1466 is therefore inhibition of Protein Phosphatase 1, Regulatory (inhibitor) Subunit 3B (PPP1R3B, Accession NM_024607). Accordingly, utilities of VGAM1466 include diagnosis, prevention and treatment of diseases and clinical conditions associated with PPP1R3B. PRO2198 (Accession NM_018621) is another VGAM1466 host target gene. PRO2198 BINDING SITE is HOST TARGET binding site found in the 3' untranslated region of mRNA encoded by PRO2198, corresponding to a HOST TARGET binding site such as BINDING SITE I, BINDING SITE II or BINDING SITE III. Table 2 illustrates the complementarity of the nucleotide sequences of PRO2198 BINDING SITE, designated SEQ ID:20695, to the nucleotide sequence of VGAM1466 RNA, herein designated VGAM RNA, also designated SEQ ID:4177.

Another function of VGAM1466 is therefore inhibition of PRO2198 (Accession NM_018621). Accordingly, utilities of VGAM1466 include diagnosis, prevention and treatment of diseases and clinical conditions associated with PRO2198. Ras Association (RalGDS/AF-6) Domain Family 2 (RASSF2, Accession NM_014737) is another VGAM1466 host target gene. RASSF2 BINDING SITE is HOST TARGET binding site found in the 3' untranslated region of mRNA encoded by RASSF2, corresponding to a HOST TARGET binding site such as BINDING SITE I, BINDING SITE II or BINDING SITE III. Table 2 illustrates the complementarity of the nucleotide sequences of RASSF2 BINDING SITE, designated SEQ ID:16398, to the nucleotide sequence of VGAM1466 RNA, herein designated VGAM RNA, also designated SEQ ID:4177.

Another function of VGAM1466 is therefore inhibition of Ras Association (RalGDS/AF-6) Domain Family 2 (RASSF2, Accession NM_014737). Accordingly, utilities of VGAM1466 include diagnosis, prevention and treatment of diseases and clinical conditions associated with RASSF2. RGPR (Accession NM_033127) is another VGAM1466 host target gene. RGPR BINDING SITE is HOST TARGET binding site found in the 3' untranslated region of mRNA encoded by RGPR, corresponding to a HOST TARGET binding site such as BINDING SITE I, BINDING SITE II or BINDING SITE III. Table 2 illustrates the complementarity of the nucleotide sequences of RGPR BINDING SITE, designated SEQ ID:26971, to the nucleotide sequence of VGAM1466 RNA, herein designated VGAM RNA, also designated SEQ ID:4177.

Another function of VGAM1466 is therefore inhibition of RGPR (Accession NM_033127). Accordingly, utilities of VGAM1466 include diagnosis, prevention and treatment of diseases and clinical conditions associated with RGPR. SCYA22 (Accession XM_165651) is another VGAM1466 host target gene. SCYA22 BINDING SITE is HOST TARGET binding site found in the 3' untranslated region of mRNA encoded by SCYA22, corresponding to a HOST TARGET binding site such as BINDING SITE I, BINDING SITE II or BINDING SITE III. Table 2 illustrates the complementarity of the nucleotide sequences of SCYA22 BINDING SITE, designated SEQ ID:43717, to the nucleotide sequence of VGAM1466 RNA, herein designated VGAM RNA, also designated SEQ ID:4177.

Another function of VGAM1466 is therefore inhibition of SCYA22 (Accession XM_165651). Accordingly, utilities of VGAM1466 include diagnosis, prevention and treatment of diseases and clinical conditions associated with SCYA22. Sema Domain, Immunoglobulin Domain (Ig), Transmembrane Domain (TM) and Short Cytoplasmic Domain, (semaphorin) 4F (SEMA4F, Accession NM_004263) is another VGAM1466 host target gene. SEMA4F BINDING SITE is HOST TARGET binding site found in the 3' untranslated region of mRNA encoded by SEMA4F, corresponding to a HOST TARGET binding site such as BINDING SITE I, BINDING SITE II or BINDING SITE III. Table 2 illustrates the complementarity of the nucleotide sequences of SEMA4F BINDING SITE, designated SEQ ID:10461, to the nucleotide sequence of VGAM1466 RNA, herein designated VGAM RNA, also designated SEQ ID:4177.

Another function of VGAM1466 is therefore inhibition of Sema Domain, Immunoglobulin Domain (Ig), Transmembrane Domain (TM) and Short Cytoplasmic Domain, (semaphorin) 4F (SEMA4F, Accession NM_004263). Accordingly, utilities of VGAM1466 include diagnosis, prevention and treatment of diseases and clinical conditions associated with SEMA4F. Solute Carrier Family 6 (neurotransmitter transporter), Member 14 (SLC6A14, Accession NM_007231) is another VGAM1466 host target gene. SLC6A14 BINDING SITE is HOST TARGET binding site found in the 3' untranslated region of mRNA encoded by SLC6A14, corresponding to a HOST TARGET binding site such as BINDING SITE I, BINDING SITE II or BINDING SITE III. Table 2 illustrates the complementarity of the nucleotide sequences of SLC6A14 BINDING SITE, designated SEQ ID:14105, to the nucleotide sequence of VGAM1466 RNA, herein designated VGAM RNA, also designated SEQ ID:4177.

Another function of VGAM1466 is therefore inhibition of Solute Carrier Family 6 (neurotransmitter transporter), Member 14 (SLC6A14, Accession NM_007231). Accordingly, utilities of VGAM1466 include diagnosis, prevention and treatment of diseases and clinical conditions associated with SLC6A14. T-cell Leukemia/lymphoma 6 (TCL6, Accession NM_014418) is another VGAM1466 host target gene. TCL6 BINDING SITE1 through TCL6 BINDING SITE4 are HOST TARGET binding sites found in untranslated regions of mRNA encoded by TCL6, corresponding to HOST TARGET binding sites such as BINDING SITE I, BINDING SITE II or BINDING SITE III. Table 2 illustrates the complementarity of the nucleotide sequences of TCL6 BINDING SITE1 through TCL6 BINDING SITE4, designated SEQ ID:15771, SEQ ID:21764, SEQ ID:21773 and SEQ ID:14847 respectively, to the nucleotide sequence of VGAM1466 RNA, herein designated VGAM RNA, also designated SEQ ID:4177.

Another function of VGAM1466 is therefore inhibition of T-cell Leukemia/lymphoma 6 (TCL6, Accession NM_014418). Accordingly, utilities of VGAM1466 include diagnosis, prevention and treatment of diseases and clinical conditions associated with TCL6. TUSP (Accession NM_020245) is another VGAM1466 host target gene. TUSP BINDING SITE is HOST TARGET binding site found in the 3' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21537, to the nucleotide sequence of VGAM1466 RNA, herein designated VGAM RNA, also designated SEQ ID:4177.

Another function of VGAM1466 is therefore inhibition of TUSP (Accession NM_020245). Accordingly, utilities of VGAM1466 include diagnosis, prevention and treatment of diseases and clinical conditions associated with TUSP. Wingless-type MMTV Integration Site Family, Member 10A (WNT10A, Accession NM_025216) is another VGAM1466 host target gene. WNT10A BINDING SITE is HOST TARGET binding site found in the 5' untranslated region of mRNA encoded by WNT10A, corresponding to a HOST TARGET binding site such as BINDING SITE I, BINDING SITE II or BINDING SITE III. Table 2 illustrates the complementarity of the nucleotide sequences of WNT10A BINDING SITE, designated SEQ ID:24895, to the nucleotide sequence of VGAM1466 RNA, herein designated VGAM RNA, also designated SEQ ID:4177.

Another function of VGAM1466 is therefore inhibition of Wingless-type MMTV Integration Site Family, Member 10A (WNT10A, Accession NM_025216). Accordingly, utilities of VGAM1466 include diagnosis, prevention and treatment of diseases and clinical conditions associated with WNT10A. ZF5128 (Accession NM_014347) is another VGAM1466 host target gene. ZF5128 BINDING SITE is HOST TARGET binding site found in the 3' untranslated region of mRNA encoded by ZF5128, corresponding to a HOST TARGET binding site such as BINDING SITE I, BINDING SITE II or BINDING SITE III. Table 2 illustrates the complementarity of the nucleotide sequences of ZF5128 BINDING SITE, designated SEQ ID:15672, to the nucleotide sequence of VGAM1466 RNA, herein designated VGAM RNA, also designated SEQ ID:4177.

Another function of VGAM1466 is therefore inhibition of ZF5128 (Accession NM_014347). Accordingly, utilities of VGAM1466 include diagnosis, prevention and treatment of diseases and clinical conditions associated with ZF5128. ZFP106 (Accession NM_022473) is another VGAM1466 host target gene. ZFP106 BINDING SITE is HOST TARGET binding site found in the 3' untranslated region of mRNA encoded by ZFP106, corresponding to a HOST TARGET binding site such as BINDING SITE I, BINDING SITE II or BINDING SITE III. Table 2 illustrates the complementarity of the nucleotide sequences of ZFP106 BINDING SITE, designated SEQ ID:22837, to the nucleotide sequence of VGAM1466 RNA, herein designated VGAM RNA, also designated SEQ ID:4177.

Another function of VGAM1466 is therefore inhibition of ZFP106 (Accession NM_022473). Accordingly, utilities of VGAM1466 include diagnosis, prevention and treatment of diseases and clinical conditions associated with ZFP106. LOC112817 (Accession NM_138413) is another VGAM1466 host target gene. LOC112817 BINDING SITE is HOST TARGET binding site found in the 3' untranslated region of mRNA encoded by LOC112817, corresponding to a HOST TARGET binding site such as BINDING SITE I, BINDING SITE II or BINDING SITE III. Table 2 illustrates the complementarity of the nucleotide sequences of LOC112817 BINDING SITE, designated SEQ ID:28783, to the nucleotide sequence of VGAM1466 RNA, herein designated VGAM RNA, also designated SEQ ID:4177.

Another function of VGAM1466 is therefore inhibition of LOC112817 (Accession NM_138413). Accordingly, utilities of VGAM1466 include diagnosis, prevention and treatment of diseases and clinical conditions associated with LOC112817. LOC121504 (Accession XM_058571) is another VGAM1466 host target gene. LOC121504 BINDING SITE is HOST TARGET binding site found in the 3' untranslated region of mRNA encoded by LOC121504, corresponding to a HOST TARGET binding site such as BINDING SITE I, BINDING SITE II or BINDING SITE III. Table 2 illustrates the complementarity of the nucleotide sequences of LOC121504 BINDING SITE, designated SEQ ID:36671, to the nucleotide sequence of VGAM1466 RNA, herein designated VGAM RNA, also designated SEQ ID:4177.

Another function of VGAM1466 is therefore inhibition of LOC121504 (Accession XM_058571). Accordingly, utilities of VGAM1466 include diagnosis, prevention and treatment of diseases and clinical conditions associated with LOC121504. LOC128989 (Accession XM_059310) is another VGAM1466 host target gene. LOC128989 BINDING SITE is HOST TARGET binding site found in the 3' untranslated region of mRNA encoded by LOC128989, corresponding to a HOST TARGET binding site such as BINDING SITE I, BINDING SITE II or BINDING SITE III. Table 2 illustrates the complementarity of the nucleotide sequences of LOC128989 BINDING SITE, designated SEQ ID:36947, to the nucleotide sequence of VGAM1466 RNA, herein designated VGAM RNA, also designated SEQ ID:4177.

Another function of VGAM1466 is therefore inhibition of LOC128989 (Accession XM_059310). Accordingly, utilities of VGAM1466 include diagnosis, prevention and treatment of diseases and clinical conditions associated with LOC128989. LOC135818 (Accession XM_059804) is another VGAM1466 host target gene. LOC135818 BINDING SITE is HOST TARGET binding site found in the 3' untranslated region of mRNA encoded by LOC135818, corresponding to a HOST TARGET binding site such as BINDING SITE I, BINDING SITE II or BINDING SITE III. Table 2 illustrates the complementarity of the nucleotide sequences of LOC135818 BINDING SITE, designated SEQ ID:37097, to the nucleotide sequence of VGAM1466 RNA, herein designated VGAM RNA, also designated SEQ ID:4177.

Another function of VGAM1466 is therefore inhibition of LOC135818 (Accession XM_059804). Accordingly, utilities of VGAM1466 include diagnosis, prevention and treatment of diseases and clinical conditions associated with LOC135818. LOC145371 (Accession XM_085123) is another VGAM1466 host target gene. LOC145371 BINDING SITE is HOST TARGET binding site found in the 3' untranslated region of mRNA encoded by LOC145371, corresponding to a HOST TARGET binding site such as BINDING SITE I, BINDING SITE II or BINDING SITE III. Table 2 illustrates the complementarity of the nucleotide sequences of LOC145371 BINDING SITE, designated SEQ ID:37850, to the nucleotide sequence of VGAM1466 RNA, herein designated VGAM RNA, also designated SEQ ID:4177.

Another function of VGAM1466 is therefore inhibition of LOC145371 (Accession XM_085123). Accordingly, utilities of VGAM1466 include diagnosis, prevention and treatment of diseases and clinical conditions associated with LOC145371. LOC145678 (Accession XM_096832) is another VGAM1466 host target gene. LOC145678 BINDING SITE is HOST TARGET binding site found in the 3' untranslated region of mRNA encoded by LOC145678, corresponding to a HOST TARGET binding site such as BINDING SITE I, BINDING SITE II or BINDING SITE III. Table 2 illustrates the complementarity of the nucleotide sequences of LOC145678 BINDING SITE, designated SEQ ID:40556, to the nucleotide sequence of VGAM1466 RNA, herein designated VGAM RNA, also designated SEQ ID:4177.

Another function of VGAM1466 is therefore inhibition of LOC145678 (Accession XM_096832). Accordingly, utilities of VGAM1466 include diagnosis, prevention and treatment of diseases and clinical conditions associated with LOC145678. LOC145813 (Accession XM_096873) is another VGAM1466 host target gene. LOC145813 BINDING SITE is HOST TARGET binding site found in the 5' untranslated region of mRNA encoded by LOC145813, corresponding to a HOST TARGET binding site such as BINDING SITE I, BINDING SITE II or BINDING SITE III. Table 2 illustrates the complementarity of the nucleotide sequences of LOC145813 BINDING SITE, designated SEQ ID:40599, to the nucleotide sequence of VGAM1466 RNA, herein designated VGAM RNA, also designated SEQ ID:4177.

Another function of VGAM1466 is therefore inhibition of LOC145813 (Accession XM_096873). Accordingly, utilities of VGAM1466 include diagnosis, prevention and treatment of diseases and clinical conditions associated with LOC145813. LOC146894 (Accession NM_145273) is another VGAM1466 host target gene. LOC146894 BINDING SITE is HOST TARGET binding site found in the 3' untranslated region of mRNA encoded by LOC146894, corresponding to a HOST TARGET binding site such as BINDING SITE I, BINDING SITE II or BINDING SITE III. Table 2 illustrates the complementarity of the nucleotide sequences of LOC146894 BINDING SITE, designated SEQ ID:29785, to the nucleotide sequence of VGAM1466 RNA, herein designated VGAM RNA, also designated SEQ ID:4177.

Another function of VGAM1466 is therefore inhibition of LOC146894 (Accession NM_145273). Accordingly, utilities of VGAM1466 include diagnosis, prevention and treatment of diseases and clinical conditions associated with LOC146894. LOC146909 (Accession XM_085634) is another VGAM1466 host target gene. LOC146909 BINDING SITE is HOST TARGET binding site found in the 3' untranslated region of mRNA encoded by LOC146909, corresponding to a HOST TARGET binding site such as BINDING SITE I, BINDING SITE II or BINDING SITE III. Table 2 illustrates the complementarity of the nucleotide sequences of LOC146909 BINDING SITE, designated SEQ ID:38271, to the nucleotide sequence of VGAM1466 RNA, herein designated VGAM RNA, also designated SEQ ID:4177.

Another function of VGAM1466 is therefore inhibition of LOC146909 (Accession XM_085634). Accordingly, utilities of VGAM1466 include diagnosis, prevention and treatment of diseases and clinical conditions associated with LOC146909. LOC148887 (Accession XM_097537) is another VGAM1466 host target gene. LOC148887 BINDING SITE is HOST TARGET binding site found in the 5' untranslated region of mRNA encoded by LOC148887, corresponding to a HOST TARGET binding site such as BINDING SITE I, BINDING SITE II or BINDING SITE III. Table 2 illustrates the complementarity of the nucleotide sequences of LOC148887 BINDING SITE, designated SEQ ID:40913, to the nucleotide sequence of VGAM1466 RNA, herein designated VGAM RNA, also designated SEQ ID:4177.

Another function of VGAM1466 is therefore inhibition of LOC148887 (Accession XM_097537). Accordingly, utilities of VGAM1466 include diagnosis, prevention and treatment of diseases and clinical conditions associated with LOC148887. LOC152018 (Accession XM_098156) is another VGAM1466 host target gene. LOC152018 BINDING SITE is HOST TARGET binding site found in the 5' untranslated region of mRNA encoded by LOC152018, corresponding to a HOST TARGET binding site such as BINDING SITE I, BINDING SITE II or BINDING SITE III. Table 2 illustrates the complementarity of the nucleotide sequences of LOC152018 BINDING SITE, designated SEQ ID:41424, to the nucleotide sequence of VGAM1466 RNA, herein designated VGAM RNA, also designated SEQ ID:4177.

Another function of VGAM1466 is therefore inhibition of LOC152018 (Accession XM_098156). Accordingly, utilities of VGAM1466 include diagnosis, prevention and treatment of diseases and clinical conditions associated with LOC152018. LOC153077 (Accession XM_098307) is another VGAM1466 host target gene. LOC153077 BINDING SITE is HOST TARGET binding site found in the 3' untranslated region of mRNA encoded by LOC153077, corresponding to a HOST TARGET binding site such as BINDING SITE I, BINDING SITE II or BINDING SITE III. Table 2 illustrates the complementarity of the nucleotide sequences of LOC153077 BINDING SITE, designated SEQ ID:41571, to the nucleotide sequence of VGAM1466 RNA, herein designated VGAM RNA, also designated SEQ ID:4177.

Another function of VGAM1466 is therefore inhibition of LOC153077 (Accession XM_098307). Accordingly, utilities of VGAM1466 include diagnosis, prevention and treatment of diseases and clinical conditions associated with LOC153077. LOC153454 (Accession XM_087672) is another VGAM1466 host target gene. LOC153454 BINDING SITE is HOST TARGET binding site found in the 5' untranslated region of mRNA encoded by LOC153454, corresponding to a HOST TARGET binding site such as BINDING SITE I, BINDING SITE II or BINDING SITE III. Table 2 illustrates the complementarity of the nucleotide sequences of LOC153454 BINDING SITE, designated SEQ ID:39377, to the nucleotide sequence of VGAM1466 RNA, herein designated VGAM RNA, also designated SEQ ID:4177.

Another function of VGAM1466 is therefore inhibition of LOC153454 (Accession XM_087672). Accordingly, utilities of VGAM1466 include diagnosis, prevention and treatment of diseases and clinical conditions associated with LOC153454. LOC154877 (Accession XM_098626) is another VGAM1466 host target gene. LOC154877 BINDING SITE is HOST TARGET binding site found in the 5' untranslated region of mRNA encoded by LOC154877, corresponding to a HOST TARGET binding site such as BINDING SITE I, BINDING SITE II or BINDING SITE III. Table 2 illustrates the complementarity of the nucleotide sequences of LOC154877 BINDING SITE, designated SEQ ID:41747, to the nucleotide sequence of VGAM1466 RNA, herein designated VGAM RNA, also designated SEQ ID:4177.

Another function of VGAM1466 is therefore inhibition of LOC154877 (Accession XM_098626). Accordingly, utilities of VGAM1466 include diagnosis, prevention and treatment of diseases and clinical conditions associated with LOC154877. LOC158476 (Accession XM_098955) is another VGAM1466 host target gene. LOC158476 BINDING SITE is HOST TARGET binding site found in the 3' untranslated region of mRNA encoded by LOC158476, corresponding to a HOST TARGET binding site such as BINDING SITE I, BINDING SITE II or BINDING SITE III. Table 2 illustrates the complementarity of the nucleotide sequences of LOC158476 BINDING SITE, designated SEQ ID:42001, to the nucleotide sequence of VGAM1466 RNA, herein designated VGAM RNA, also designated SEQ ID:4177.

Another function of VGAM1466 is therefore inhibition of LOC158476 (Accession XM_098955). Accordingly, utilities of VGAM1466 include diagnosis, prevention and treatment of diseases and clinical conditions associated with LOC158476. LOC158865 (Accession XM_099000) is another VGAM1466 host target gene. LOC158865 BINDING SITE is HOST TARGET binding site found in the 5' untranslated region of mRNA encoded by LOC158865, corresponding to a HOST TARGET binding site such as BINDING SITE I, BINDING SITE II or BINDING SITE III. Table 2 illustrates the complementarity of the nucleotide sequences of LOC158865 BINDING SITE, designated SEQ ID:42039, to the nucleotide sequence of VGAM1466 RNA, herein designated VGAM RNA, also designated SEQ ID:4177.

Another function of VGAM1466 is therefore inhibition of LOC158865 (Accession XM_099000). Accordingly, utilities of VGAM1466 include diagnosis, prevention and treatment of diseases and clinical conditions associated with LOC158865. LOC162333 (Accession XM_102591) is another VGAM1466 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42138, to the nucleotide sequence of VGAM1466 RNA, herein designated VGAM RNA, also designated SEQ ID:4177.

Another function of VGAM1466 is therefore inhibition of LOC162333 (Accession XM_102591). Accordingly, utilities of VGAM1466 include diagnosis, prevention and treatment of diseases and clinical conditions associated with LOC162333. LOC164955 (Accession XM_092265) is another VGAM1466 host target gene. LOC164955 BINDING SITE is HOST TARGET binding site found in the 3' untranslated region of mRNA encoded by LOC164955, corresponding to a HOST TARGET binding site such as BINDING SITE I, BINDING SITE II or BINDING SITE III. Table 2 illustrates the complementarity of the nucleotide sequences of LOC164955 BINDING SITE, designated SEQ ID:40113, to the nucleotide sequence of VGAM1466 RNA, herein designated VGAM RNA, also designated SEQ ID:4177.

Another function of VGAM1466 is therefore inhibition of LOC164955 (Accession XM_092265). Accordingly, utilities of VGAM1466 include diagnosis, prevention and treatment of diseases and clinical conditions associated with LOC164955. LOC169225 (Accession XM_108531) is another VGAM1466 host target gene. LOC169225 BINDING SITE is HOST TARGET binding site found in the 5' untranslated region of mRNA encoded by LOC169225, corresponding to a HOST TARGET binding site such as BINDING SITE I, BINDING SITE II or BINDING SITE III. Table 2 illustrates the complementarity of the nucleotide sequences of LOC169225 BINDING SITE, designated SEQ ID:42205, to the nucleotide sequence of VGAM1466 RNA, herein designated VGAM RNA, also designated SEQ ID:4177.

Another function of VGAM1466 is therefore inhibition of LOC169225 (Accession XM_108531). Accordingly, utilities of VGAM1466 include diagnosis, prevention and treatment of diseases and clinical conditions associated with LOC169225. LOC196529 (Accession XM_113746) is another VGAM1466 host target gene. LOC196529 BINDING SITE is HOST TARGET binding site found in the 3' untranslated region of mRNA encoded by LOC196529, corresponding to a HOST TARGET binding site such as BINDING SITE I, BINDING SITE II or BINDING SITE III. Table 2 illustrates the complementarity of the nucleotide sequences of LOC196529 BINDING SITE, designated SEQ ID:42412, to the nucleotide sequence of VGAM1466 RNA, herein designated VGAM RNA, also designated SEQ ID:4177.

Another function of VGAM1466 is therefore inhibition of LOC196529 (Accession XM_113746). Accordingly, utilities of VGAM1466 include diagnosis, prevention and treatment of diseases and clinical conditions associated with LOC196529. LOC199786 (Accession XM_114021) is another VGAM1466 host target gene. LOC199786 BINDING SITE is HOST TARGET binding site found in the 3' untranslated region of mRNA encoded by LOC199786, corresponding to a HOST TARGET binding site such as BINDING SITE I, BINDING SITE II or BINDING SITE III. Table 2 illustrates the complementarity of the nucleotide sequences of LOC199786 BINDING SITE, designated SEQ ID:42623, to the nucleotide sequence of VGAM1466 RNA, herein designated VGAM RNA, also designated SEQ ID:4177.

Another function of VGAM1466 is therefore inhibition of LOC199786 (Accession XM_114021). Accordingly, utilities of VGAM1466 include diagnosis, prevention and treatment of diseases and clinical conditions associated with LOC199786. LOC200316 (Accession XM_114205) is another VGAM1466 host target gene. LOC200316 BINDING SITE is HOST TARGET binding site found in the 3' untranslated region of mRNA encoded by LOC200316, corresponding to a HOST TARGET binding site such as BINDING SITE I, BINDING SITE II or BINDING SITE III. Table 2 illustrates the complementarity of the nucleotide sequences of LOC200316 BINDING SITE, designated SEQ ID:42796, to the nucleotide sequence of VGAM1466 RNA, herein designated VGAM RNA, also designated SEQ ID:4177.

Another function of VGAM1466 is therefore inhibition of LOC200316 (Accession XM_114205). Accordingly, utilities of VGAM1466 include diagnosis, prevention and treatment of diseases and clinical conditions associated with LOC200316. LOC200982 (Accession XM_117305) is another VGAM1466 host target gene. LOC200982 BINDING SITE is HOST TARGET binding site found in the 3' untranslated region of mRNA encoded by LOC200982, corresponding to a HOST TARGET binding site such as BINDING SITE I, BINDING SITE II or BINDING SITE III. Table 2 illustrates the complementarity of the nucleotide sequences of LOC200982 BINDING SITE, designated SEQ ID:43379, to the nucleotide sequence of VGAM1466 RNA, herein designated VGAM RNA, also designated SEQ ID:4177.

Another function of VGAM1466 is therefore inhibition of LOC200982 (Accession XM_117305). Accordingly, utilities of VGAM1466 include diagnosis, prevention and treatment of diseases and clinical conditions associated with LOC200982. LOC201626 (Accession XM_114349) is another VGAM1466 host target gene. LOC201626 BINDING SITE is HOST TARGET binding site found in the 3' untranslated region of mRNA encoded by LOC201626, corresponding to a HOST TARGET binding site such as BINDING SITE I, BINDING SITE II or BINDING SITE III. Table 2 illustrates the complementarity of the nucleotide sequences of LOC201626 BINDING SITE, designated SEQ ID:42892, to the nucleotide sequence of VGAM1466 RNA, herein designated VGAM RNA, also designated SEQ ID:4177.

Another function of VGAM1466 is therefore inhibition of LOC201626 (Accession XM_114349). Accordingly, utilities of VGAM1466 include diagnosis, prevention and treatment of diseases and clinical conditions associated with LOC201626. LOC203197 (Accession XM_114645) is another VGAM1466 host target gene. LOC203197 BINDING SITE is HOST TARGET binding site found in the 3' untranslated region of mRNA encoded by LOC203197, corresponding to a HOST TARGET binding site such as BINDING SITE I, BINDING SITE II or BINDING SITE III. Table 2 illustrates the complementarity of the nucleotide sequences of LOC203197 BINDING SITE, designated SEQ ID:43013, to the nucleotide sequence of VGAM1466 RNA, herein designated VGAM RNA, also designated SEQ ID:4177.

Another function of VGAM1466 is therefore inhibition of LOC203197 (Accession XM_114645). Accordingly, utilities of VGAM1466 include diagnosis, prevention and treatment of diseases and clinical conditions associated with LOC203197. LOC220064 (Accession XM_167827) is another VGAM1466 host target gene. LOC220064 BINDING SITE is HOST TARGET binding site found in the 3' untranslated region of mRNA encoded by LOC220064, corresponding to a HOST TARGET binding site such as BINDING SITE I, BINDING SITE II or BINDING SITE III. Table 2 illustrates the complementarity of the nucleotide sequences of LOC220064 BINDING SITE, designated SEQ ID:44870, to the nucleotide sequence of VGAM1466 RNA, herein designated VGAM RNA, also designated SEQ ID:4177.

Another function of VGAM1466 is therefore inhibition of LOC220064 (Accession XM_167827). Accordingly, utilities of VGAM1466 include diagnosis, prevention and treatment of diseases and clinical conditions associated with LOC220064. LOC220074 (Accession NM_145309) is another VGAM1466 host target gene. LOC220074 BINDING SITE is HOST TARGET binding site found in the 3' untranslated region of mRNA encoded by LOC220074, corresponding to a HOST TARGET binding site such as BINDING SITE I, BINDING SITE II or BINDING SITE III. Table 2 illustrates the complementarity of the nucleotide sequences of LOC220074 BINDING SITE, designated SEQ ID:29825, to the nucleotide sequence of VGAM1466 RNA, herein designated VGAM RNA, also designated SEQ ID:4177.

Another function of VGAM1466 is therefore inhibition of LOC220074 (Accession NM_145309). Accordingly, utilities of VGAM1466 include diagnosis, prevention and treatment of diseases and clinical conditions associated with LOC220074. LOC221964 (Accession XM_168342) is another VGAM1466 host target gene. LOC221964 BINDING SITE is HOST TARGET binding site found in the 3' untranslated region of mRNA encoded by LOC221964, corresponding to a HOST TARGET binding site such as BINDING SITE I, BINDING SITE II or BINDING SITE III. Table 2 illustrates the complementarity of the nucleotide sequences of LOC221964 BINDING SITE, designated SEQ ID:45114, to the nucleotide sequence of VGAM1466 RNA, herein designated VGAM RNA, also designated SEQ ID:4177.

Another function of VGAM1466 is therefore inhibition of LOC221964 (Accession XM_168342). Accordingly, utilities of VGAM1466 include diagnosis, prevention and treatment of diseases and clinical conditions associated with LOC221964. LOC222031 (Accession XM_168371) is another VGAM1466 host target gene. LOC222031 BINDING SITE is HOST TARGET binding site found in the 3' untranslated region of mRNA encoded by LOC222031, corresponding to a HOST TARGET binding site such as BINDING SITE I, BINDING SITE II or BINDING SITE III. Table 2 illustrates the complementarity of the nucleotide sequences of LOC222031 BINDING SITE, designated SEQ ID:45138, to the nucleotide sequence of VGAM1466 RNA, herein designated VGAM RNA, also designated SEQ ID:4177.

Another function of VGAM1466 is therefore inhibition of LOC222031 (Accession XM_168371). Accordingly, utilities of VGAM1466 include diagnosis, prevention and treatment of diseases and clinical conditions associated with LOC222031. LOC222224 (Accession XM_168473) is another VGAM1466 host target gene. LOC222224 BINDING SITE is HOST TARGET binding site found in the 5' untranslated region of mRNA encoded by LOC222224, corresponding to a HOST TARGET binding site such as BINDING SITE I, BINDING SITE II or BINDING SITE III. Table 2 illustrates the complementarity of the nucleotide sequences of LOC222224 BINDING SITE, designated SEQ ID:45198, to the nucleotide sequence of VGAM1466 RNA, herein designated VGAM RNA, also designated SEQ ID:4177.

Another function of VGAM1466 is therefore inhibition of LOC222224 (Accession XM_168473). Accordingly, utilities of VGAM1466 include diagnosis, prevention and treatment of diseases and clinical conditions associated with LOC222224. LOC253981 (Accession XM_171064) is another VGAM1466 host target gene. LOC253981 BINDING SITE is HOST TARGET binding site found in the 3' untranslated region of mRNA encoded by LOC253981, corresponding to a HOST TARGET binding site such as BINDING SITE I, BINDING SITE II or BINDING SITE III. Table 2 illustrates the complementarity of the nucleotide sequences of LOC253981 BINDING SITE, designated SEQ ID:45868, to the nucleotide sequence of VGAM1466 RNA, herein designated VGAM RNA, also designated SEQ ID:4177.

Another function of VGAM1466 is therefore inhibition of LOC253981 (Accession XM_171064). Accordingly, utilities of VGAM1466 include diagnosis, prevention and treatment of diseases and clinical conditions associated with LOC253981. LOC254057 (Accession XM_173085) is another VGAM1466 host target gene. LOC254057 BINDING SITE is HOST TARGET binding site found in the 5' untranslated region of mRNA encoded by LOC254057, corresponding to a HOST TARGET binding site such as BINDING SITE I, BINDING SITE II or BINDING SITE III. Table 2 illustrates the complementarity of the nucleotide sequences of LOC254057 BINDING SITE, designated SEQ ID:46351, to the nucleotide sequence of VGAM1466 RNA, herein designated VGAM RNA, also designated SEQ ID:4177.

Another function of VGAM1466 is therefore inhibition of LOC254057 (Accession XM_173085). Accordingly, utilities of VGAM1466 include diagnosis, prevention and treatment of diseases and clinical conditions associated with LOC254057. LOC256306 (Accession XM_172976) is another VGAM1466 host target gene. LOC256306 BINDING SITE is HOST TARGET binding site found in the 3' untranslated region of mRNA encoded by LOC256306, corresponding to a HOST TARGET binding site such as BINDING SITE I, BINDING SITE II or BINDING SITE III. Table 2 illustrates the complementarity of the nucleotide sequences of LOC256306 BINDING SITE, designated SEQ ID:46240, to the nucleotide sequence of VGAM1466 RNA, herein designated VGAM RNA, also designated SEQ ID:4177.

Another function of VGAM1466 is therefore inhibition of LOC256306 (Accession XM_172976). Accordingly, utilities of VGAM1466 include diagnosis, prevention and treatment of diseases and clinical conditions associated with LOC256306. LOC257127 (Accession XM_172975) is another VGAM1466 host target gene. LOC257127 BINDING SITE is HOST TARGET binding site found in the 5' untranslated region of mRNA encoded by LOC257127, corresponding to a HOST TARGET binding site such as BIND- ING SITE I, BINDING SITE II or BINDING SITE III. Table 2 illustrates the complementarity of the nucleotide sequences of LOC257127 BINDING SITE, designated SEQ ID:46232, to the nucleotide sequence of VGAM1466 RNA, herein designated VGAM RNA, also designated SEQ ID:4177.

Another function of VGAM1466 is therefore inhibition of LOC257127 (Accession XM_172975). Accordingly, utilities of VGAM1466 include diagnosis, prevention and treatment of diseases and clinical conditions associated with LOC257127. LOC51008 (Accession NM_015947) is another VGAM1466 host target gene. LOC51008 BINDING SITE is HOST TARGET binding site found in the 5' untranslated region of mRNA encoded by LOC51008, corresponding to a HOST TARGET binding site such as BINDING SITE I, BINDING SITE II or BINDING SITE III. Table 2 illustrates the complementarity of the nucleotide sequences of LOC51008 BINDING SITE, designated SEQ ID:18065, to the nucleotide sequence of VGAM1466 RNA, herein designated VGAM RNA, also designated SEQ ID:4177.

Another function of VGAM1466 is therefore inhibition of LOC51008 (Accession NM_015947). Accordingly, utilities of VGAM1466 include diagnosis, prevention and treatment of diseases and clinical conditions associated with LOC51008. LOC90288 (Accession XM_030669) is another VGAM1466 host target gene. LOC90288 BINDING SITE is HOST TARGET binding site found in the 3' untranslated region of mRNA encoded by LOC90288, corresponding to a HOST TARGET binding site such as BINDING SITE I, BINDING SITE II or BINDING SITE III. Table 2 illustrates the complementarity of the nucleotide sequences of LOC90288 BINDING SITE, designated SEQ ID:31117, to the nucleotide sequence of VGAM1466 RNA, herein designated VGAM RNA, also designated SEQ ID:4177.

Another function of VGAM1466 is therefore inhibition of LOC90288 (Accession XM_030669). Accordingly, utilities of VGAM1466 include diagnosis, prevention and treatment of diseases and clinical conditions associated with LOC90288. LOC90459 (Accession XM_031826) is another VGAM1466 host target gene. LOC90459 BINDING SITE is HOST TARGET binding site found in the 3' untranslated region of mRNA encoded by LOC90459, corresponding to a HOST TARGET binding site such as BINDING SITE I, BINDING SITE II or BINDING SITE III. Table 2 illustrates the complementarity of the nucleotide sequences of LOC90459 BINDING SITE, designated SEQ ID:31494, to the nucleotide sequence of VGAM1466 RNA, herein designated VGAM RNA, also designated SEQ ID:4177.

Another function of VGAM1466 is therefore inhibition of LOC90459 (Accession XM_031826). Accordingly, utilities of VGAM1466 include diagnosis, prevention and treatment of diseases and clinical conditions associated with LOC90459. LOC96597 (Accession XM_039922) is another VGAM1466 host target gene. LOC96597 BINDING SITE is HOST TARGET binding site found in the 3' untranslated region of mRNA encoded by LOC96597, corresponding to a HOST TARGET binding site such as BINDING SITE I, BINDING SITE II or BINDING SITE III. Table 2 illustrates the complementarity of the nucleotide sequences of LOC96597 BINDING SITE, designated SEQ ID:33231, to the nucleotide sequence of VGAM1466 RNA, herein designated VGAM RNA, also designated SEQ ID:4177.

Another function of VGAM1466 is therefore inhibition of LOC96597 (Accession XM_039922). Accordingly, utilities of VGAM1466 include diagnosis, prevention and treatment of diseases and clinical conditions associated with LOC96597. FIG. 1 further provides a conceptual description of a novel bioinformatically detected viral gene of the present invention, referred to here as Viral Genomic Address Messenger 1467 (VGAM1467) viral gene, which modulates expression of respective host target genes thereof, the function and utility of which host target genes is known in the art.

VGAM1467 is a novel bioinformatically detected regulatory, non protein coding, viral micro RNA (miRNA) gene. The method by which VGAM1467 was detected is described hereinabove with reference to FIGS. 1-8.

VGAM1467 gene, herein designated VGAM GENE, is a viral gene contained in the genome of Equine Herpesvirus 2. VGAM1467 host target gene, herein designated VGAM HOST TARGET GENE, is a human gene contained in the human genome.

VGAM1467 gene encodes a VGAM1467 precursor RNA, herein designated VGAM PRECURSOR RNA. Similar to other miRNA genes, and unlike most ordinary genes, VGAM1467 precursor RNA does not encode a protein. A nucleotide sequence identical or highly similar to the nucleotide sequence of VGAM1467 precursor RNA is designated SEQ ID:1453, and is provided hereinbelow with reference to the sequence listing part. Nucleotide sequence SEQ ID:1453 is located at position 40183 relative to the genome of Equine Herpesvirus 2.

VGAM1467 precursor RNA folds onto itself, forming VGAM1467 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1467 folded precursor RNA into VGAM1467 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1467 RNA is designated SEQ ID:4178, and is provided hereinbelow with reference to the sequence listing part.

VGAM1467 host target gene, herein designated VGAM HOST TARGET GENE, encodes a corresponding messenger RNA, VGAM1467 host target RNA, herein designated VGAM HOST TARGET RNA. VGAM1467 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1467 RNA, herein designated VGAM RNA, binds complementarily to one or more host target binding sites located in untranslated regions of VGAM1467 host target RNA, herein designated VGAM HOST TARGET RNA. This complementary binding is due to the fact that the nucleotide sequence of VGAM1467 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1467 RNA, herein designated VGAM RNA, may have a different number of host target binding sites in untranslated regions of a VGAM1467 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1467 RNA, herein designated VGAM RNA, to host target binding sites on VGAM1467 host target RNA, herein designated VGAM HOST TARGET RNA, such as BINDING SITE I, BINDING SITE II and BINDING SITE III, inhibits translation of VGAM1467 host target RNA into VGAM1467 host target protein, herein designated VGAM HOST TARGET PROTEIN. VGAM host target protein is therefore outlined by a broken line.

It is appreciated that VGAM1467 host target gene, herein designated VGAM HOST TARGET GENE, in fact represents a plurality of VGAM1467 host target genes. The mRNA of each one of this plurality of VGAM1467 host target genes comprises one or more host target binding sites, each having a nucleotide sequence which is at least partly complementary to VGAM1467 RNA, herein designated VGAM RNA, and which when bound by VGAM1467 RNA causes inhibition of translation of respective one or more VGAM1467 host target proteins.

It is further appreciated by one skilled in the art that the mode of translational inhibition illustrated by FIG. 1 with specific reference to translational inhibition exerted by VGAM1467 gene, herein designated VGAM GENE, on one or more VGAM1467 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1467 is inhibition of expression of host target genes, as part of a novel viral mechanism of attacking a host. Accordingly, utilities of VGAM1467 include diagnosis, prevention and treatment of viral infection by Equine Herpesvirus 2. Specific functions, and accordingly utilities, of VGAM1467 correlate with, and may be deduced from, the identity of the host target genes which VGAM1467 binds and inhibits, and the function of these host target genes, as elaborated hereinbelow.

Nucleotide sequences of the VGAM1467 precursor RNA, herein designated VGAM PRECURSOR RNA, and of the 'diced' VGAM1467 RNA, herein designated VGAM RNA, and a schematic representation of the secondary folding of VGAM1467 folded precursor RNA, herein designated VGAM FOLDED PRECURSOR RNA, of VGAM1467 are further described hereinbelow with reference to Table 1.

Nucleotide sequences of host target binding sites, such as BINDING SITE-I, BINDING SITE-II and BINDING SITE-III of FIG. 1, found on VGAM1467 host target RNA, and schematic representation of the complementarity of each of these host target binding sites to VGAM1467 RNA, herein designated VGAM RNA, are described hereinbelow with reference to Table 2.

As mentioned hereinabove with reference to FIG. 1, a function of VGAM1467 gene, herein designated VGAM is inhibition of expression of VGAM1467 target genes. It is appreciated that specific functions, and accordingly utilities, of VGAM1467 correlate with, and may be deduced from, the identity of the target genes which VGAM1467 binds and inhibits, and the function of these target genes, as elaborated hereinbelow.

BCL2-like 2 (BCL2L2, Accession NM_004050) is a VGAM1467 host target gene. BCL2L2 BINDING SITE is HOST TARGET binding site found in the 3' untranslated region of mRNA encoded by BCL2L2, corresponding to a HOST TARGET binding site such as BINDING SITE I, BINDING SITE II or BINDING SITE III. Table 2 illustrates the complementarity of the nucleotide sequences of BCL2L2 BINDING SITE, designated SEQ ID:10259, to the nucleotide sequence of VGAM1467 RNA, herein designated VGAM RNA, also designated SEQ ID:4178.

A function of VGAM1467 is therefore inhibition of BCL2-like 2 (BCL2L2, Accession NM_004050), a gene which promotes cell survival. Accordingly, utilities of VGAM1467 include diagnosis, prevention and treatment of diseases and clinical conditions associated with BCL2L2. The function of BCL2L2 and its association with various diseases and clinical conditions, has been established by previous studies, as described hereinabove with reference to VGAM431. Cyclin-dependent Kinase 2 (CDK2, Accession NM_001798) is another VGAM1467 host target gene. CDK2 BINDING SITE is HOST TARGET binding site found in the 3' untranslated region of mRNA encoded by CDK2, corresponding to a HOST TARGET binding site such as BINDING SITE I, BINDING SITE II or BINDING SITE III. Table 2 illustrates the complementarity of the nucleotide sequences of CDK2 BINDING SITE, designated SEQ ID:7551, to the nucleotide sequence of VGAM1467 RNA, herein designated VGAM RNA, also designated SEQ ID:4178.

Another function of VGAM1467 is therefore inhibition of Cyclin-dependent Kinase 2 (CDK2, Accession NM_001798), a gene which plays a unique role in cell cycle regulation of vertebrate cells. Accordingly, utilities of VGAM1467 include diagnosis, prevention and treatment of diseases and clinical conditions associated with CDK2. The function of CDK2 has been established by previous studies. The complex formed of p34(cdc2) (OMIM Ref. No. 116940) and cyclin B (OMIM Ref. No. 176740) is required for the G2-to-M transition in cell division. Human cyclin A (OMIM Ref. No. 123835) binds independently to 2 kinases, p34 (cdc2) or p33. In adenovirus-transformed cells, the viral E1A oncoprotein seems to associate with p33/cyclin A but not with p34(cdc2)/cyclin A. Tsai et al. (1991) isolated the gene for p33, which shares 65% sequence identity with p34(cdc2). They suggested that p33(cdk2) plays a unique role in cell cycle regulation of vertebrate cells. CDK (e.g., CDK2) activation requires association with cyclins (e.g., CCNE1; 123837) and phosphorylation by CAK (CCNH; 601953), and leads to cell proliferation. Inhibition of cellular proliferation occurs upon association of CDK inhibitor (e.g., CDKN1B; 600778) with a cyclin-CDK complex. Sheaff et al. (1997) showed that expression of CCNE1-CDK2 at physiologic levels of ATP results in phosphorylation of CDKN1B at thr187, leading to elimination of CDKN1B from the cell and progression of the cell cycle from G1 to S phase. At low ATP levels, the inhibitory functions of CDKN1B are enhanced, thereby arresting cell proliferation.

Full details of the abovementioned studies are described in the following publications, the disclosure of which are hereby incorporated by reference:

Sheaff, R. J.; Groudine, M.; Gordon, M.; Roberts, J. M.; Clurman, B. E.: Cyclin E-CDK2 is a regulator of p27(Kip1). Genes Dev. 11:1464-1478, 1997; and Tsai, L.-H.; Harlow, E.; Meyerson, M.: Isolation of the human cdk2 gene that encodes the cyclin A- and adenovirus E1A-associated p33 kinase. Nature 353:174-177, 1991.

Further studies establishing the function and utilities of CDK2 are found in John Hopkins OMIM database record ID 116953, and in sited publications numbered 335, 12055-12056, 159, 1496, 4704, 712 and 4705-368 listed in the bibliography section hereinbelow, which are also hereby incorporated by reference. Cytochrome P450, Subfamily VIIIB (sterol 12-alpha-hydroxylase), Polypeptide 1 (CYP8B1, Accession NM_004391) is another VGAM1467 host target gene. CYP8B1 BINDING SITE is HOST TARGET binding site found in the 3' untranslated region of mRNA encoded by CYP8B1, corresponding to a HOST TARGET binding site such as BINDING SITE I, BINDING SITE II or BINDING SITE III. Table 2 illustrates the complementarity of the nucleotide sequences of CYP8B1 BINDING SITE, designated SEQ ID:10628, to the nucleotide sequence of VGAM1467 RNA, herein designated VGAM RNA, also designated SEQ ID:4178.

Another function of VGAM1467 is therefore inhibition of Cytochrome P450, Subfamily VIIIB (sterol 12-alpha-hydroxylase), Polypeptide 1 (CYP8B1, Accession NM_004391), a gene which functions in bile acid biosynthesis. Accordingly, utilities of VGAM1467 include diagnosis, prevention and treatment of diseases and clinical conditions associated with CYP8B1. The function of CYP8B1 and its association with various diseases and clinical conditions, has been established by previous studies, as described hereinabove with reference to VGAM923. Giant Axonal Neuropathy (gigaxonin) (GAN, Accession NM_022041) is another VGAM1467 host target gene. GAN BINDING SITE is HOST TARGET binding site found in the 3' untranslated region of mRNA encoded by GAN, corresponding to a HOST TARGET binding site such as BINDING SITE I, BINDING SITE II or BINDING SITE III. Table 2 illustrates the complementarity of the nucleotide sequences of GAN BINDING SITE, designated SEQ ID:22563, to the nucleotide sequence of VGAM1467 RNA, herein designated VGAM RNA, also designated SEQ ID:4178.

Another function of VGAM1467 is therefore inhibition of Giant Axonal Neuropathy (gigaxonin) (GAN, Accession NM_022041), a gene which plays an important role in neurofilament architecture. Accordingly, utilities of VGAM1467 include diagnosis, prevention and treatment of diseases and clinical conditions associated with GAN. The function of GAN and its association with various diseases and clinical conditions, has been established by previous studies, as described hereinabove with reference to VGAM606. Kinesin Family Member C3 (KIFC3, Accession NM_005550) is another VGAM1467 host target gene. KIFC3 BINDING SITE is HOST TARGET binding site found in the 3' untranslated region of mRNA encoded by KIFC3, corresponding to a HOST TARGET binding site such as BINDING SITE I, BINDING SITE II or BINDING SITE III. Table 2 illustrates the complementarity of the nucleotide sequences of KIFC3 BINDING SITE, designated SEQ ID:12080, to the nucleotide sequence of VGAM1467 RNA, herein designated VGAM RNA, also designated SEQ ID:4178.

Another function of VGAM1467 is therefore inhibition of Kinesin Family Member C3 (KIFC3, Accession NM_005550), a gene which may function in intracellular transport and mitosis. Accordingly, utilities of VGAM1467 include diagnosis, prevention and treatment of diseases and clinical conditions associated with KIFC3. The function of KIFC3 and its association with various diseases and clinical conditions, has been established by previous studies, as described hereinabove with reference to VGAM1006. Nyctalopin (NYX, Accession NM_022567) is another VGAM1467 host target gene. NYX BINDING SITE1 and NYX BINDING SITE2 are HOST TARGET binding sites found in untranslated regions of mRNA encoded by NYX, corresponding to HOST TARGET binding sites such as BINDING SITE I, BINDING SITE II or BINDING SITE III. Table 2 illustrates the complementarity of the nucleotide sequences of NYX BINDING SITE1 and NYX BINDING SITE2, designated SEQ ID:22887 and SEQ ID:22888 respectively, to the nucleotide sequence of VGAM1467 RNA, herein designated VGAM RNA, also designated SEQ ID:4178.

Another function of VGAM1467 is therefore inhibition of Nyctalopin (NYX, Accession NM_022567), a gene which functions as the von willebrand factor receptor and mediates von willebrand factor-dependent platelet adhesion to blood vessels. the adhesion of platelets to injured vascular surfaces in the arterial circulation is a critical initiating event in hemostasis (by similarity). Accordingly, utilities of VGAM1467 include diagnosis, prevention and treatment of diseases and clinical conditions associated with NYX. The function of NYX and its association with various diseases and clinical conditions, has been established by previous studies, as described hereinabove with reference to VGAM206. Promyelocytic Leukemia (PML, Accession NM_033240) is another VGAM1467 host target gene. PML BINDING SITE1 and PML BINDING SITE2 are HOST TARGET binding sites found in untranslated regions of mRNA encoded by PML, corresponding to HOST TARGET binding sites such as BINDING SITE I, BINDING SITE II or BINDING SITE III. Table 2 illustrates the complementarity of the nucleotide sequences of PML BINDING SITE1 and PML BINDING SITE2, designated SEQ ID:27082 and SEQ ID:27086 respectively, to the nucleotide sequence of VGAM1467 RNA, herein designated VGAM RNA, also designated SEQ ID:4178.

Another function of VGAM1467 is therefore inhibition of Promyelocytic Leukemia (PML, Accession NM_033240). Accordingly, utilities of VGAM1467 include diagnosis, prevention and treatment of diseases and clinical conditions associated with PML. Paired Mesoderm Homeo Box 1 (PMX1, Accession NM_006902) is another VGAM1467 host target gene. PMX1 BINDING SITE1 and PMX1 BINDING SITE2 are HOST TARGET binding sites found in untranslated regions of mRNA encoded by PMX1, corresponding to HOST TARGET binding sites such as BINDING SITE I, BINDING SITE II or BINDING SITE III. Table 2 illustrates the complementarity of the nucleotide sequences of PMX1 BINDING SITE1 and PMX1 BINDING SITE2, designated SEQ ID:13778 and SEQ ID:12907 respectively, to the nucleotide sequence of VGAM1467 RNA, herein designated VGAM RNA, also designated SEQ ID:4178.

Another function of VGAM1467 is therefore inhibition of Paired Mesoderm Homeo Box 1 (PMX1, Accession NM_006902), a gene which acts as a transcriptional regulator of muscle creatine kinase. Accordingly, utilities of VGAM1467 include diagnosis, prevention and treatment of diseases and clinical conditions associated with PMX1. The function of PMX1 and its association with various diseases and clinical conditions, has been established by previous studies, as described hereinabove with reference to VGAM381. FLJ13189 (Accession NM_024882) is another VGAM1467 host target gene. FLJ13189 BINDING SITE is HOST TARGET binding site found in the 5' untranslated region of mRNA encoded by FLJ13189, corresponding to a HOST TARGET binding site such as BINDING SITE I, BINDING SITE II or BINDING SITE III. Table 2 illustrates the complementarity of the nucleotide sequences of FLJ13189 BINDING SITE, designated SEQ ID:24330, to the nucleotide sequence of VGAM1467 RNA, herein designated VGAM RNA, also designated SEQ ID:4178.

Another function of VGAM1467 is therefore inhibition of FLJ13189 (Accession NM_024882). Accordingly, utilities of VGAM1467 include diagnosis, prevention and treatment of diseases and clinical conditions associated with FLJ13189. Glycoprotein V (platelet) (GP5, Accession NM_004488) is another VGAM1467 host target gene. GP5 BINDING SITE is HOST TARGET binding site found in the 3' untranslated region of mRNA encoded by GP5, corresponding to a HOST TARGET binding site such as BINDING SITE I, BINDING SITE II or BINDING SITE III. Table 2 illustrates the complementarity of the nucleotide sequences of GP5 BINDING SITE, designated SEQ ID:10815, to the nucleotide sequence of VGAM1467 RNA, herein designated VGAM RNA, also designated SEQ ID:4178.

Another function of VGAM1467 is therefore inhibition of Glycoprotein V (platelet) (GP5, Accession NM_004488). Accordingly, utilities of VGAM1467 include diagnosis, prevention and treatment of diseases and clinical conditions associated with GP5. Interleukin 1 Family, Member 10 (theta) (IL1F10, Accession NM_032556) is another VGAM1467 host target gene. IL1F10 BINDING SITE is HOST TARGET binding site found in the 5' untranslated region of mRNA encoded by IL1F10, corresponding to a HOST TARGET binding site such as BINDING SITE I, BINDING SITE II or BINDING SITE III. Table 2 illustrates the complementarity of the nucleotide sequences of IL1F10 BINDING SITE, designated SEQ ID:26283, to the nucleotide sequence of VGAM1467 RNA, herein designated VGAM RNA, also designated SEQ ID:4178.

Another function of VGAM1467 is therefore inhibition of Interleukin 1 Family, Member 10 (theta) (IL1F10, Accession NM_032556). Accordingly, utilities of VGAM1467 include diagnosis, prevention and treatment of diseases and clinical conditions associated with IL1F10. KIAA0935 (Accession XM_052620) is another VGAM1467 host target gene. KIAA0935 BINDING SITE is HOST TARGET binding site found in the 3' untranslated region of mRNA encoded by KIAA0935, corresponding to a HOST TARGET binding site such as BINDING SITE I, BINDING SITE II or BINDING SITE III. Table 2 illustrates the complementarity of the nucleotide sequences of KIAA0935 BINDING SITE, designated SEQ ID:36009, to the nucleotide sequence of VGAM1467 RNA, herein designated VGAM RNA, also designated SEQ ID:4178.

Another function of VGAM1467 is therefore inhibition of KIAA0935 (Accession XM_052620). Accordingly, utilities of VGAM1467 include diagnosis, prevention and treatment of diseases and clinical conditions associated with KIAA0935. KIAA1388 (Accession XM_168030) is another VGAM1467 host target gene. KIAA1388 BINDING SITE is HOST TARGET binding site found in the 5' untranslated region of mRNA encoded by KIAA1388, corresponding to a HOST TARGET binding site such as BINDING SITE I, BINDING SITE II or BINDING SITE III. Table 2 illustrates the complementarity of the nucleotide sequences of KIAA1388 BINDING SITE, designated SEQ ID:44951, to the nucleotide sequence of VGAM1467 RNA, herein designated VGAM RNA, also designated SEQ ID:4178.

Another function of VGAM1467 is therefore inhibition of KIAA1388 (Accession XM_168030). Accordingly, utilities of VGAM1467 include diagnosis, prevention and treatment of diseases and clinical conditions associated with KIAA1388. KIAA1674 (Accession XM_044065) is another VGAM1467 host target gene. KIAA1674 BINDING SITE is HOST TARGET binding site found in the 3' untranslated region of mRNA encoded by KIAA1674, corresponding to a HOST TARGET binding site such as BINDING SITE I, BINDING SITE II or BINDING SITE III. Table 2 illustrates the complementarity of the nucleotide sequences of KIAA1674 BINDING SITE, designated SEQ ID:34103, to the nucleotide sequence of VGAM1467 RNA, herein designated VGAM RNA, also designated SEQ ID:4178.

Another function of VGAM1467 is therefore inhibition of KIAA1674 (Accession XM_044065). Accordingly, utilities of VGAM1467 include diagnosis, prevention and treatment of diseases and clinical conditions associated with KIAA1674. Neuroblastoma, Suppression of Tumorigenicity 1 (NBL1, Accession XM_001434) is another VGAM1467 host target gene. NBL1 BINDING SITE is HOST TARGET binding site found in the 3' untranslated region of mRNA encoded by NBL1, corresponding to a HOST TARGET binding site such as BINDING SITE I, BINDING SITE II or BINDING SITE III. Table 2 illustrates the complementarity of the nucleotide sequences of NBL1 BINDING SITE, designated SEQ ID:29837, to the nucleotide sequence of VGAM1467 RNA, herein designated VGAM RNA, also designated SEQ ID:4178.

Another function of VGAM1467 is therefore inhibition of Neuroblastoma, Suppression of Tumorigenicity 1 (NBL1, Accession XM_001434). Accordingly, utilities of VGAM1467 include diagnosis, prevention and treatment of diseases and clinical conditions associated with NBL1. Nei Like 2 (E. coli) (NEIL2, Accession NM_145043) is another VGAM1467 host target gene. NEIL2 BINDING SITE is HOST TARGET binding site found in the 5' untranslated region of mRNA encoded by NEIL2, corresponding to a HOST TARGET binding site such as BINDING SITE I, BINDING SITE II or BINDING SITE III. Table 2 illustrates the complementarity of the nucleotide sequences of NEIL2 BINDING SITE, designated SEQ ID:29672, to the nucleotide sequence of VGAM1467 RNA, herein designated VGAM RNA, also designated SEQ ID:4178.

Another function of VGAM1467 is therefore inhibition of Nei Like 2 (E. coli) (NEIL2, Accession NM_145043). Accordingly, utilities of VGAM1467 include diagnosis, prevention and treatment of diseases and clinical conditions associated with NEIL2. PTK6 Protein Tyrosine Kinase 6 (PTK6, Accession NM_005975) is another VGAM1467 host target gene. PTK6 BINDING SITE is HOST TARGET binding site found in the 5' untranslated region of mRNA encoded by PTK6, corresponding to a HOST TARGET binding site such as BINDING SITE I, BINDING SITE II or BINDING SITE III. Table 2 illustrates the complementarity of the nucleotide sequences of PTK6 BINDING SITE, designated SEQ ID:12600, to the nucleotide sequence of VGAM1467 RNA, herein designated VGAM RNA, also designated SEQ ID:4178.

Another function of VGAM1467 is therefore inhibition of PTK6 Protein Tyrosine Kinase 6 (PTK6, Accession NM_005975). Accordingly, utilities of VGAM1467 include diagnosis, prevention and treatment of diseases and clinical conditions associated with PTK6. RAB3A Interacting Protein (rabin3)-like 1 (RAB3IL1, Accession NM_013401) is another VGAM1467 host target gene. RAB3IL1 BINDING SITE is HOST TARGET binding site found in the 3' untranslated region of mRNA encoded by RAB3IL1, corresponding to a HOST TARGET binding site such as BINDING SITE I, BINDING SITE II or BINDING SITE III. Table 2 illustrates the complementarity of the nucleotide sequences of RAB3IL1 BINDING SITE, designated SEQ ID:15061, to the nucleotide sequence of VGAM1467 RNA, herein designated VGAM RNA, also designated SEQ ID:4178.

Another function of VGAM1467 is therefore inhibition of RAB3A Interacting Protein (rabin3)-like 1 (RAB3IL1, Accession NM_013401). Accordingly, utilities of VGAM1467 include diagnosis, prevention and treatment of diseases and clinical conditions associated with RAB3IL1. SEC24 Related Gene Family, Member A (S. cerevisiae) (SEC24A, Accession XM_094581) is another VGAM1467 host target gene. SEC24A BINDING SITE is HOST TARGET binding site found in the 5' untranslated region of mRNA encoded by SEC24A, corresponding to a HOST TARGET binding site such as BINDING SITE I, BINDING SITE II or BINDING SITE III. Table 2 illustrates the complementarity of the nucleotide sequences of SEC24A BINDING SITE, designated SEQ ID:40234, to the nucleotide sequence of VGAM1467 RNA, herein designated VGAM RNA, also designated SEQ ID:4178.

Another function of VGAM1467 is therefore inhibition of SEC24 Related Gene Family, Member A (S. cerevisiae) (SEC24A, Accession XM_094581). Accordingly, utilities of VGAM1467 include diagnosis, prevention and treatment of diseases and clinical conditions associated with SEC24A. Solute Carrier Family 1 (glutamate transporter), Member 7 (SLC1A7, Accession NM_006671) is another VGAM1467 host target gene. SLC1A7 BINDING SITE is HOST TARGET binding site found in the 3' untranslated region of mRNA encoded by SLC1A7, corresponding to a HOST TARGET binding site such as BINDING SITE I, BINDING SITE II or BINDING SITE III. Table 2 illustrates the complementarity of the nucleotide sequences of SLC1A7 BINDING SITE, designated SEQ ID:13488, to the nucleotide sequence of VGAM1467 RNA, herein designated VGAM RNA, also designated SEQ ID:4178.

Another function of VGAM1467 is therefore inhibition of Solute Carrier Family 1 (glutamate transporter), Member 7 (SLC1A7, Accession NM_006671). Accordingly, utilities of VGAM1467 include diagnosis, prevention and treatment of diseases and clinical conditions associated with SLC1A7. STRAIT11499 (Accession NM_021242) is another VGAM1467 host target gene. STRAIT11499 BINDING SITE is HOST TARGET binding site found in the 5' untranslated region of mRNA encoded by STRAIT11499, corresponding to a HOST TARGET binding site such as BINDING SITE I, BINDING SITE II or BINDING SITE III. Table 2 illustrates the complementarity of the nucleotide sequences of STRAIT11499 BINDING SITE, designated SEQ ID:22208, to the nucleotide sequence of VGAM1467 RNA, herein designated VGAM RNA, also designated SEQ ID:4178.

Another function of VGAM1467 is therefore inhibition of STRAIT11499 (Accession NM_021242). Accordingly, utilities of VGAM1467 include diagnosis, prevention and treatment of diseases and clinical conditions associated with STRAIT11499. LOC145988 (Accession XM_085290) is another VGAM1467 host target gene. LOC145988 BINDING SITE is HOST TARGET binding site found in the 5' untranslated region of mRNA encoded by LOC145988, corresponding to a HOST TARGET binding site such as BINDING SITE I, BINDING SITE II or BINDING SITE III. Table 2 illustrates the complementarity of the nucleotide sequences of LOC145988 BINDING SITE, designated SEQ ID:38035, to the nucleotide sequence of VGAM1467 RNA, herein designated VGAM RNA, also designated SEQ ID:4178.

Another function of VGAM1467 is therefore inhibition of LOC145988 (Accession XM_085290). Accordingly, utilities of VGAM1467 include diagnosis, prevention and treatment of diseases and clinical conditions associated with LOC145988. LOC148529 (Accession XM_097481) is another VGAM1467 host target gene. LOC148529 BINDING SITE is HOST TARGET binding site found in the 5' untranslated region of mRNA encoded by LOC148529, corresponding to a HOST TARGET binding site such as BINDING SITE I, BINDING SITE II or BINDING SITE III. Table 2 illustrates the complementarity of the nucleotide sequences of LOC148529 BINDING SITE, designated SEQ ID:40889, to the nucleotide sequence of VGAM1467 RNA, herein designated VGAM RNA, also designated SEQ ID:4178.

Another function of VGAM1467 is therefore inhibition of LOC148529 (Accession XM_097481). Accordingly, utilities of VGAM1467 include diagnosis, prevention and treatment of diseases and clinical conditions associated with LOC148529. LOC150407 (Accession XM_086906) is another VGAM1467 host target gene. LOC150407 BINDING SITE is HOST TARGET binding site found in the 3' untranslated region of mRNA encoded by LOC150407, corresponding to a HOST TARGET binding site such as BINDING SITE I, BINDING SITE II or BINDING SITE III. Table 2 illustrates the complementarity of the nucleotide sequences of LOC150407 BINDING SITE, designated SEQ ID:38951, to the nucleotide sequence of VGAM1467 RNA, herein designated VGAM RNA, also designated SEQ ID:4178.

Another function of VGAM1467 is therefore inhibition of LOC150407 (Accession XM_086906). Accordingly, utilities of VGAM1467 include diagnosis, prevention and treatment of diseases and clinical conditions associated with LOC150407. LOC157567 (Accession XM_088328) is another VGAM1467 host target gene. LOC157567 BINDING SITE is HOST TARGET binding site found in the 5' untranslated region of mRNA encoded by LOC157567, corresponding to a HOST TARGET binding site such as BINDING SITE I, BINDING SITE II or BINDING SITE III. Table 2 illustrates the complementarity of the nucleotide sequences of LOC157567 BINDING SITE, designated SEQ ID:39613, to the nucleotide sequence of VGAM1467 RNA, herein designated VGAM RNA, also designated SEQ ID:4178.

Another function of VGAM1467 is therefore inhibition of LOC157567 (Accession XM_088328). Accordingly, utilities of VGAM1467 include diagnosis, prevention and treatment of diseases and clinical conditions associated with LOC157567. LOC159121 (Accession XM_099028) is another VGAM1467 host target gene. LOC159121 BINDING SITE is HOST TARGET binding site found in the 3' untranslated region of mRNA encoded by LOC159121, corresponding to a HOST TARGET binding site such as BINDING SITE I, BINDING SITE II or BINDING SITE III. Table 2 illustrates the complementarity of the nucleotide sequences of LOC159121 BINDING SITE, designated SEQ ID:42064, to the nucleotide sequence of VGAM1467 RNA, herein designated VGAM RNA, also designated SEQ ID:4178.

Another function of VGAM1467 is therefore inhibition of LOC159121 (Accession XM_099028). Accordingly, utilities of VGAM1467 include diagnosis, prevention and treatment of diseases and clinical conditions associated with LOC159121. LOC196812 (Accession XM_116868) is another VGAM1467 host target gene. LOC196812 BINDING SITE is HOST TARGET binding site found in the 3' untranslated region of mRNA encoded by LOC196812, corresponding to a HOST TARGET binding site such as BINDING SITE I, BINDING SITE II or BINDING SITE III. Table 2 illustrates the complementarity of the nucleotide sequences of LOC196812 BINDING SITE, designated SEQ ID:43137, to the nucleotide sequence of VGAM1467 RNA, herein designated VGAM RNA, also designated SEQ ID:4178.

Another function of VGAM1467 is therefore inhibition of LOC196812 (Accession XM_116868). Accordingly, utilities of VGAM1467 include diagnosis, prevention and treatment of diseases and clinical conditions associated with LOC196812. LOC199923 (Accession XM_114057) is another VGAM1467 host target gene. LOC199923 BINDING SITE is HOST TARGET binding site found in the 5' untranslated region of mRNA encoded by LOC199923, corresponding to a HOST TARGET binding site such as BINDING SITE I, BINDING SITE II or BINDING SITE III. Table 2 illustrates the complementarity of the nucleotide sequences of LOC199923 BINDING SITE, designated SEQ ID:42666, to the nucleotide sequence of VGAM1467 RNA, herein designated VGAM RNA, also designated SEQ ID:4178.

Another function of VGAM1467 is therefore inhibition of LOC199923 (Accession XM_114057). Accordingly, utilities of VGAM1467 include diagnosis, prevention and treatment of diseases and clinical conditions associated with LOC199923. LOC92465 (Accession XM_045250) is another VGAM1467 host target gene. LOC92465 BINDING SITE is HOST TARGET binding site found in the 5' untranslated region of mRNA encoded by LOC92465, corresponding to a HOST TARGET binding site such as BINDING SITE I, BINDING SITE II or BINDING SITE III. Table 2 illustrates the complementarity of the nucleotide sequences of LOC92465 BINDING SITE, designated SEQ ID:34391, to the nucleotide sequence of VGAM1467 RNA, herein designated VGAM RNA, also designated SEQ ID:4178.

Another function of VGAM1467 is therefore inhibition of LOC92465 (Accession XM_045250). Accordingly, utilities of VGAM1467 include diagnosis, prevention and treatment of diseases and clinical conditions associated with LOC92465. FIG. 1 further provides a conceptual description of a novel bioinformatically detected viral gene of the present invention, referred to here as Viral Genomic Address Messenger 1468 (VGAM1468) viral gene, which modulates expression of respective host target genes thereof, the function and utility of which host target genes is known in the art.

VGAM1468 is a novel bioinformatically detected regulatory, non protein coding, viral micro RNA (miRNA) gene. The method by which VGAM1468 was detected is described hereinabove with reference to FIGS. 1-8.

VGAM1468 gene, herein designated VGAM GENE, is a viral gene contained in the genome of Infectious Flacherie Virus. VGAM1468 host target gene, herein designated VGAM HOST TARGET GENE, is a human gene contained in the human genome.

VGAM1468 gene encodes a VGAM1468 precursor RNA, herein designated VGAM PRECURSOR RNA. Similar to other miRNA genes, and unlike most ordinary genes, VGAM1468 precursor RNA does not encode a protein. A nucleotide sequence identical or highly similar to the nucleotide sequence of VGAM1468 precursor RNA is designated SEQ ID:1454, and is provided hereinbelow with reference to the sequence listing part. Nucleotide sequence SEQ ID:1454 is located at position 4200 relative to the genome of Infectious Flacherie Virus.

VGAM1468 precursor RNA folds onto itself, forming VGAM1468 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1468 folded precursor RNA into VGAM1468 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1468 RNA is designated SEQ ID:4179, and is provided hereinbelow with reference to the sequence listing part.

VGAM1468 host target gene, herein designated VGAM HOST TARGET GENE, encodes a corresponding messenger RNA, VGAM1468 host target RNA, herein designated VGAM HOST TARGET RNA. VGAM1468 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1468 RNA, herein designated VGAM RNA, binds complementarily to one or more host target binding sites located in untranslated regions of VGAM1468 host target RNA, herein designated VGAM HOST TARGET RNA. This complementary binding is due to the fact that the nucleotide sequence of VGAM1468 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1468 RNA, herein designated VGAM RNA, may have a different number of host target binding sites in untranslated regions of a VGAM1468 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1468 RNA, herein designated VGAM RNA, to host target binding sites on VGAM1468 host target RNA, herein designated VGAM HOST TARGET RNA, such as BINDING SITE I, BINDING SITE II and BINDING SITE III, inhibits translation of VGAM1468 host target RNA into VGAM1468 host target protein, herein designated VGAM HOST TARGET PROTEIN. VGAM host target protein is therefore outlined by a broken line.

It is appreciated that VGAM1468 host target gene, herein designated VGAM HOST TARGET GENE, in fact represents a plurality of VGAM1468 host target genes. The mRNA of each one of this plurality of VGAM1468 host target genes comprises one or more host target binding sites, each having a nucleotide sequence which is at least partly complementary to VGAM1468 RNA, herein designated VGAM RNA, and which when bound by VGAM1468 RNA causes inhibition of translation of respective one or more VGAM1468 host target proteins.

It is further appreciated by one skilled in the art that the mode of translational inhibition illustrated by FIG. 1 with specific reference to translational inhibition exerted by VGAM1468 gene, herein designated VGAM GENE, on one or more VGAM1468 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1468 is inhibition of expression of host target genes, as part of a novel viral mechanism of attacking a host. Accordingly, utilities of VGAM1468 include diagnosis, prevention and treatment of viral infection by Infectious Flacherie Virus. Specific functions, and accordingly utilities, of VGAM1468 correlate with, and may be deduced from, the identity of the host target genes which VGAM1468 binds and inhibits, and the function of these host target genes, as elaborated hereinbelow.

Nucleotide sequences of the VGAM1468 precursor RNA, herein designated VGAM PRECURSOR RNA, and of the 'diced' VGAM1468 RNA, herein designated VGAM RNA, and a schematic representation of the secondary folding of VGAM1468 folded precursor RNA, herein designated VGAM FOLDED PRECURSOR RNA, of VGAM1468 are further described hereinbelow with reference to Table 1.

Nucleotide sequences of host target binding sites, such as BINDING SITE-I, BINDING SITE-II and BINDING SITE-III of FIG. 1, found on VGAM1468 host target RNA, and schematic representation of the complementarity of each of these host target binding sites to VGAM1468 RNA, herein designated VGAM RNA, are described hereinbelow with reference to Table 2.

As mentioned hereinabove with reference to FIG. 1, a function of VGAM1468 gene, herein designated VGAM is inhibition of expression of VGAM1468 target genes. It is appreciated that specific functions, and accordingly utilities, of VGAM1468 correlate with, and may be deduced from, the identity of the target genes which VGAM1468 binds and inhibits, and the function of these target genes, as elaborated hereinbelow.

Ankyrin Repeat Domain 6 (ANKRD6, Accession NM_014942) is a VGAM1468 host target gene. ANKRD6 BINDING SITE is HOST TARGET binding site found in the 3' untranslated region of mRNA encoded by ANKRD6, corresponding to a HOST TARGET binding site such as BINDING SITE I, BINDING SITE II or BINDING SITE III. Table 2 illustrates the complementarity of the nucleotide sequences of ANKRD6 BINDING SITE, designated SEQ ID:17251, to the nucleotide sequence of VGAM1468 RNA, herein designated VGAM RNA, also designated SEQ ID:4179.

A function of VGAM1468 is therefore inhibition of Ankyrin Repeat Domain 6 (ANKRD6, Accession NM_014942). Accordingly, utilities of VGAM1468 include diagnosis, prevention and treatment of diseases and clinical conditions associated with ANKRD6. FLJ10853 (Accession NM_018246) is another VGAM1468 host target gene. FLJ10853 BINDING SITE is HOST TARGET binding site found in the 3' untranslated region of mRNA encoded by FLJ10853, corresponding to a HOST TARGET binding site such as BINDING SITE I, BINDING SITE II or BINDING SITE III. Table 2 illustrates the complementarity of the nucleotide sequences of FLJ10853 BINDING SITE, designated SEQ ID:20212, to the nucleotide sequence of VGAM1468 RNA, herein designated VGAM RNA, also designated SEQ ID:4179.

Another function of VGAM1468 is therefore inhibition of FLJ10853 (Accession NM_018246). Accordingly, utilities of VGAM1468 include diagnosis, prevention and treatment of diseases and clinical conditions associated with FLJ10853. FLJ22625 (Accession NM_024715) is another VGAM1468 host target gene. FLJ22625 BINDING SITE is HOST TARGET binding site found in the 3' untranslated region of mRNA encoded by FLJ22625, corresponding to a HOST TARGET binding site such as BINDING SITE I, BINDING SITE II or BINDING SITE III. Table 2 illustrates the complementarity of the nucleotide sequences of FLJ22625 BINDING SITE, designated SEQ ID:24040, to the nucleotide sequence of VGAM1468 RNA, herein designated VGAM RNA, also designated SEQ ID:4179.

Another function of VGAM1468 is therefore inhibition of FLJ22625 (Accession NM_024715). Accordingly, utilities of VGAM1468 include diagnosis, prevention and treatment of diseases and clinical conditions associated with FLJ22625. KIAA0446 (Accession XM_044155) is another VGAM1468 host target gene. KIAA0446 BINDING SITE is HOST TARGET binding site found in the 5' untranslated region of mRNA encoded by KIAA0446, corresponding to a HOST TARGET binding site such as BINDING SITE I, BINDING SITE II or BINDING SITE III. Table 2 illustrates the complementarity of the nucleotide sequences of KIAA0446 BINDING SITE, designated SEQ ID:34152, to the nucleotide sequence of VGAM1468 RNA, herein designated VGAM RNA, also designated SEQ ID:4179.

Another function of VGAM1468 is therefore inhibition of KIAA0446 (Accession XM_044155). Accordingly, utilities of VGAM1468 include diagnosis, prevention and treatment of diseases and clinical conditions associated with KIAA0446. LOC126964 (Accession XM_059100) is another VGAM1468 host target gene. LOC126964 BINDING SITE is HOST TARGET binding site found in the 3' untranslated region of mRNA encoded by LOC126964, corresponding to a HOST TARGET binding site such as BINDING SITE I, BINDING SITE II or BINDING SITE III. Table 2 illustrates the complementarity of the nucleotide sequences of LOC126964 BINDING SITE, designated SEQ ID:36881, to the nucleotide sequence of VGAM1468 RNA, herein designated VGAM RNA, also designated SEQ ID:4179.

Another function of VGAM1468 is therefore inhibition of LOC126964 (Accession XM_059100). Accordingly, utilities of VGAM1468 include diagnosis, prevention and treatment of diseases and clinical conditions associated with LOC126964. LOC158476 (Accession XM_098955) is another VGAM1468 host target gene. LOC158476 BINDING SITE is HOST TARGET binding site found in the 3' untranslated region of mRNA encoded by LOC158476, corresponding to a HOST TARGET binding site such as BINDING SITE I, BINDING SITE II or BINDING SITE III. Table 2 illustrates the complementarity of the nucleotide sequences of LOC158476 BINDING SITE, designated SEQ ID:41994, to the nucleotide sequence of VGAM1468 RNA, herein designated VGAM RNA, also designated SEQ ID:4179.

Another function of VGAM1468 is therefore inhibition of LOC158476 (Accession XM_098955). Accordingly, utilities of VGAM1468 include diagnosis, prevention and treatment of diseases and clinical conditions associated with LOC158476. FIG. 1 further provides a conceptual description of a novel bioinformatically detected viral gene of the present invention, referred to here as Viral Genomic Address Messenger 1469 (VGAM1469) viral gene, which modulates expression of respective host target genes thereof, the function and utility of which host target genes is known in the art.

VGAM1469 is a novel bioinformatically detected regulatory, non protein coding, viral micro RNA (miRNA) gene. The method by which VGAM1469 was detected is described hereinabove with reference to FIGS. 1-8.

VGAM1469 gene, herein designated VGAM GENE, is a viral gene contained in the genome of Infectious Flacherie Virus. VGAM1469 host target gene, herein designated VGAM HOST TARGET GENE, is a human gene contained in the human genome.

VGAM1469 gene encodes a VGAM1469 precursor RNA, herein designated VGAM PRECURSOR RNA. Similar to other miRNA genes, and unlike most ordinary genes, VGAM1469 precursor RNA does not encode a protein. A nucleotide sequence identical or highly similar to the nucleotide sequence of VGAM1469 precursor RNA is designated SEQ ID:1455, and is provided hereinbelow with reference to the sequence listing part. Nucleotide sequence SEQ ID:1455 is located at position 916 relative to the genome of Infectious Flacherie Virus.

VGAM1469 precursor RNA folds onto itself, forming VGAM1469 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1469 folded precursor RNA into VGAM1469 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM1469 RNA is designated SEQ ID:4180, and is provided hereinbelow with reference to the sequence listing part.

VGAM1469 host target gene, herein designated VGAM HOST TARGET GENE, encodes a corresponding messenger RNA, VGAM1469 host target RNA, herein designated VGAM HOST TARGET RNA. VGAM1469 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1469 RNA, herein designated VGAM RNA, binds complementarily to one or more host target binding sites located in untranslated regions of VGAM1469 host target RNA, herein designated VGAM HOST TARGET RNA. This complementary binding is due to the fact that the nucleotide sequence of VGAM1469 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1469 RNA, herein designated VGAM RNA, may have a different number of host target binding sites in untranslated regions of a VGAM1469 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1469 RNA, herein designated VGAM RNA, to host target binding sites on VGAM1469 host target RNA, herein designated VGAM HOST TARGET RNA, such as BINDING SITE I, BINDING SITE II and BINDING SITE III, inhibits translation of VGAM1469 host target RNA into VGAM1469 host target protein, herein designated VGAM HOST TARGET PROTEIN. VGAM host target protein is therefore outlined by a broken line.

It is appreciated that VGAM1469 host target gene, herein designated VGAM HOST TARGET GENE, in fact represents a plurality of VGAM1469 host target genes. The mRNA of each one of this plurality of VGAM1469 host target genes comprises one or more host target binding sites, each having a nucleotide sequence which is at least partly complementary to VGAM1469 RNA, herein designated VGAM RNA, and which when bound by VGAM1469 RNA causes inhibition of translation of respective one or more VGAM1469 host target proteins.

It is further appreciated by one skilled in the art that the mode of translational inhibition illustrated by FIG. 1 with specific reference to translational inhibition exerted by VGAM1469 gene, herein designated VGAM GENE, on one or more VGAM1469 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1469 is inhibition of expression of host target genes, as part of a novel viral mechanism of attacking a host. Accordingly, utilities of VGAM1469 include diagnosis, prevention and treatment of viral infection by Infectious Flacherie Virus. Specific functions, and accordingly utilities, of VGAM1469 correlate with, and may be deduced from, the identity of the host target genes which VGAM1469 binds and inhibits, and the function of these host target genes, as elaborated hereinbelow.

Nucleotide sequences of the VGAM1469 precursor RNA, herein designated VGAM PRECURSOR RNA, and of the 'diced' VGAM1469 RNA, herein designated VGAM RNA, and a schematic representation of the secondary folding of VGAM1469 folded precursor RNA, herein designated VGAM FOLDED PRECURSOR RNA, of VGAM1469 are further described hereinbelow with reference to Table 1.

Nucleotide sequences of host target binding sites, such as BINDING SITE-I, BINDING SITE-II and BINDING SITE-III of FIG. 1, found on VGAM1469 host target RNA, and schematic representation of the complementarity of each of these host target binding sites to VGAM1469 RNA, herein designated VGAM RNA, are described hereinbelow with reference to Table 2.

As mentioned hereinabove with reference to FIG. 1, a function of VGAM1469 gene, herein designated VGAM is inhibition of expression of VGAM1469 target genes. It is appreciated that specific functions, and accordingly utilities, of VGAM1469 correlate with, and may be deduced from, the identity of the target genes which VGAM1469 binds and inhibits, and the function of these target genes, as elaborated hereinbelow.

Vacuolar Protein Sorting 41 (yeast) (VPS41, Accession NM_014396) is a VGAM1469 host target gene. VPS41 BINDING SITE is HOST TARGET binding site found in the 3' untranslated region of mRNA encoded by VPS41, corresponding to a HOST TARGET binding site such as BINDING SITE I, BINDING SITE II or BINDING SITE III. Table 2 illustrates the complementarity of the nucleotide sequences of VPS41 BINDING SITE, designated SEQ ID:15735, to the nucleotide sequence of VGAM1469 RNA, herein designated VGAM RNA, also designated SEQ ID:4180.

A function of VGAM1469 is therefore inhibition of Vacuolar Protein Sorting 41 (yeast) (VPS41, Accession NM_014396). Accordingly, utilities of VGAM1469 include diagnosis, prevention and treatment of diseases and clinical conditions associated with VPS41. DKFZp547I224 (Accession NM_020221) is another VGAM1469 host target gene. DKFZp547I224 BINDING SITE is HOST TARGET binding site found in the 3' untranslated region of mRNA encoded by DKFZp547I224, corresponding to a HOST TARGET binding site such as BINDING SITE I, BINDING SITE II or BINDING SITE III. Table 2 illustrates the complementarity of the nucleotide sequences of DKFZp547I224 BINDING SITE, designated SEQ ID:21472, to the nucleotide sequence of VGAM1469 RNA, herein designated VGAM RNA, also designated SEQ ID:4180.

Another function of VGAM1469 is therefore inhibition of DKFZp547I224 (Accession NM_020221). Accordingly, utilities of VGAM1469 include diagnosis, prevention and treatment of diseases and clinical conditions associated with DKFZp547I224. KIAA0916 (Accession NM_015057) is another VGAM1469 host target gene. KIAA0916 BINDING SITE is HOST TARGET binding site found in the 3' untranslated region of mRNA encoded by KIAA0916, corresponding to a HOST TARGET binding site such as BINDING SITE I, BINDING SITE II or BINDING SITE III. Table 2 illustrates the complementarity of the nucleotide sequences of KIAA0916 BINDING SITE, designated SEQ ID:17415, to the nucleotide sequence of VGAM1469 RNA, herein designated VGAM RNA, also designated SEQ ID:4180.

Another function of VGAM1469 is therefore inhibition of KIAA0916 (Accession NM_015057). Accordingly, utilities of VGAM1469 include diagnosis, prevention and treatment of diseases and clinical conditions associated with KIAA0916. PAI-RBP1 (Accession NM_015640) is another VGAM1469 host target gene. PAI-RBP1 BINDING SITE is HOST TARGET binding site found in the 3' untranslated region of mRNA encoded by PAI-RBP1, corresponding to a HOST TARGET binding site such as BINDING SITE I, BINDING SITE II or BINDING SITE III. Table 2 illustrates the complementarity of the nucleotide sequences of PAI-RBP1 BINDING SITE, designated SEQ ID:17892, to the nucleotide sequence of VGAM1469 RNA, herein designated VGAM RNA, also designated SEQ ID:4180.

Another function of VGAM1469 is therefore inhibition of PAI-RBP1 (Accession NM_015640). Accordingly, utilities of VGAM1469 include diagnosis, prevention and treatment of diseases and clinical conditions associated with PAI-RBP1. PRO1992 (Accession NM_014107) is another VGAM1469 host target gene. PRO1992 BINDING SITE is HOST TARGET binding site found in the 3' untranslated region of mRNA encoded by PRO1992, corresponding to a HOST TARGET binding site such as BINDING SITE I, BINDING SITE II or BINDING SITE III. Table 2 illustrates the complementarity of the nucleotide sequences of PRO1992 BINDING SITE, designated SEQ ID:15332, to the nucleotide sequence of VGAM1469 RNA, herein designated VGAM RNA, also designated SEQ ID:4180.

Another function of VGAM1469 is therefore inhibition of PRO1992 (Accession NM_014107). Accordingly, utilities of VGAM1469 include diagnosis, prevention and treatment of diseases and clinical conditions associated with PRO1992. LOC112476 (Accession NM_145239) is another VGAM1469 host target gene. LOC112476 BINDING SITE is HOST TARGET binding site found in the 3' untranslated region of mRNA encoded by LOC112476, corresponding to a HOST TARGET binding site such as BINDING SITE I, BINDING SITE II or BINDING SITE III. Table 2 illustrates the complementarity of the nucleotide sequences of LOC112476 BINDING SITE, designated SEQ ID:29750, to the nucleotide sequence of VGAM1469 RNA, herein designated VGAM RNA, also designated SEQ ID:4180.

Another function of VGAM1469 is therefore inhibition of LOC112476 (Accession NM_145239). Accordingly, utilities of VGAM1469 include diagnosis, prevention and treatment of diseases and clinical conditions associated with LOC112476. LOC147219 (Accession XM_097214) is another VGAM1469 host target gene. LOC147219 BINDING SITE is HOST TARGET binding site found in the 3' untranslated region of mRNA encoded by LOC147219, corresponding to a HOST TARGET binding site such as BINDING SITE I, BINDING SITE II or BINDING SITE III. Table 2 illustrates the complementarity of the nucleotide sequences of LOC147219 BINDING SITE, designated SEQ ID:40822, to the nucleotide sequence of VGAM1469 RNA, herein designated VGAM RNA, also designated SEQ ID:4180.

Another function of VGAM1469 is therefore inhibition of LOC147219 (Accession XM_097214). Accordingly, utilities of VGAM1469 include diagnosis, prevention and treatment of diseases and clinical conditions associated with LOC147219. LOC150139 (Accession XM_086794) is another VGAM1469 host target gene. LOC150139 BINDING SITE is HOST TARGET binding site found in the 3' untranslated region of mRNA encoded by LOC150139, corresponding to a HOST TARGET binding site such as BINDING SITE I, BINDING SITE II or BINDING SITE III. Table 2 illustrates the complementarity of the nucleotide sequences of LOC150139 BINDING SITE, designated SEQ ID:38856, to the nucleotide sequence of VGAM1469 RNA, herein designated VGAM RNA, also designated SEQ ID:4180.

Another function of VGAM1469 is therefore inhibition of LOC150139 (Accession XM_086794). Accordingly, utilities of VGAM1469 include diagnosis, prevention and treatment of diseases and clinical conditions associated with LOC150139. LOC150157 (Accession XM_097823) is another VGAM1469 host target gene. LOC150157 BINDING SITE is HOST TARGET binding site found in the 3' untranslated region of mRNA encoded by LOC150157, corresponding to a HOST TARGET binding site such as BINDING SITE I, BINDING SITE II or BINDING SITE III. Table 2 illustrates the complementarity of the nucleotide sequences of LOC150157 BINDING SITE, designated SEQ ID:41139, to the nucleotide sequence of VGAM1469 RNA, herein designated VGAM RNA, also designated SEQ ID:4180.

Another function of VGAM1469 is therefore inhibition of LOC150157 (Accession XM_097823). Accordingly, utilities of VGAM1469 include diagnosis, prevention and treatment of diseases and clinical conditions associated with LOC150157. LOC152502 (Accession XM_001389) is another VGAM1469 host target gene. LOC152502 BINDING SITE is HOST TARGET binding site found in the 3' untranslated region of mRNA encoded by LOC152502, corresponding to a HOST TARGET binding site such as BIND- ING SITE I, BINDING SITE II or BINDING SITE III. Table 2 illustrates the complementarity of the nucleotide sequences of LOC152502 BINDING SITE, designated SEQ ID:29834, to the nucleotide sequence of VGAM1469 RNA, herein designated VGAM RNA, also designated SEQ ID:4180.

Another function of VGAM1469 is therefore inhibition of LOC152502 (Accession XM_001389). Accordingly, utilities of VGAM1469 include diagnosis, prevention and treatment of diseases and clinical conditions associated with LOC152502. LOC196890 (Accession XM_116951) is another VGAM1469 host target gene. LOC196890 BINDING SITE is HOST TARGET binding site found in the 3' untranslated region of mRNA encoded by LOC196890, corresponding to a HOST TARGET binding site such as BINDING SITE I, BINDING SITE II or BINDING SITE III. Table 2 illustrates the complementarity of the nucleotide sequences of LOC196890 BINDING SITE, designated SEQ ID:43154, to the nucleotide sequence of VGAM1469 RNA, herein designated VGAM RNA, also designated SEQ ID:4180.

Another function of VGAM1469 is therefore inhibition of LOC196890 (Accession XM_116951). Accordingly, utilities of VGAM1469 include diagnosis, prevention and treatment of diseases and clinical conditions associated with LOC196890. FIG. 1 further provides a conceptual description of a novel bioinformatically detected viral gene of the present invention, referred to here as Viral Genomic Address Messenger 1470 (VGAM1470) viral gene, which modulates expression of respective host target genes thereof, the function and utility of which host target genes is known in the art.

VGAM1470 is a novel bioinformatically detected regulatory, non protein coding, viral micro RNA (miRNA) gene. The method by which VGAM1470 was detected is described hereinabove with reference to FIGS. 1-8.

VGAM1470 gene, herein designated VGAM GENE, is a viral gene contained in the genome of Cocksfoot Streak Virus (CSV). VGAM1470 host target gene, herein designated VGAM HOST TARGET GENE, is a human gene contained in the human genome.

VGAM1470 gene encodes a VGAM1470 precursor RNA, herein designated VGAM PRECURSOR RNA. Similar to other miRNA genes, and unlike most ordinary genes, VGAM1470 precursor RNA does not encode a protein. A nucleotide sequence identical or highly similar to the nucleotide sequence of VGAM1470 precursor RNA is designated SEQ ID:1456, and is provided hereinbelow with reference to the sequence listing part. Nucleotide sequence SEQ ID:1456 is located at position 5947 relative to the genome of Cocksfoot Streak Virus (CSV).

VGAM1470 precursor RNA folds onto itself, forming VGAM1470 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1470 folded precursor RNA into VGAM1470 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1470 RNA is designated SEQ ID:4181, and is provided hereinbelow with reference to the sequence listing part.

VGAM1470 host target gene, herein designated VGAM HOST TARGET GENE, encodes a corresponding messenger RNA, VGAM1470 host target RNA, herein designated VGAM HOST TARGET RNA. VGAM1470 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1470 RNA, herein designated VGAM RNA, binds complementarily to one or more host target binding sites located in untranslated regions of VGAM1470 host target RNA, herein designated VGAM HOST TARGET RNA. This complementary binding is due to the fact that the nucleotide sequence of VGAM1470 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1470 RNA, herein designated VGAM RNA, may have a different number of host target binding sites in untranslated regions of a VGAM1470 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1470 RNA, herein designated VGAM RNA, to host target binding sites on VGAM1470 host target RNA, herein designated VGAM HOST TARGET RNA, such as BINDING SITE I, BINDING SITE II and BINDING SITE III, inhibits translation of VGAM1470 host target RNA into VGAM1470 host target protein, herein designated VGAM HOST TARGET PROTEIN. VGAM host target protein is therefore outlined by a broken line.

It is appreciated that VGAM1470 host target gene, herein designated VGAM HOST TARGET GENE, in fact represents a plurality of VGAM1470 host target genes. The mRNA of each one of this plurality of VGAM1470 host target genes comprises one or more host target binding sites, each having a nucleotide sequence which is at least partly complementary to VGAM1470 RNA, herein designated VGAM RNA, and which when bound by VGAM1470 RNA causes inhibition of translation of respective one or more VGAM1470 host target proteins.

It is further appreciated by one skilled in the art that the mode of translational inhibition illustrated by FIG. 1 with specific reference to translational inhibition exerted by VGAM1470 gene, herein designated VGAM GENE, on one or more VGAM1470 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1470 is inhibition of expression of host target genes, as part of a novel viral mechanism of attacking a host. Accordingly, utilities of VGAM1470 include diagnosis, prevention and treatment of viral infection by Cocksfoot Streak Virus (CSV). Specific functions, and accordingly utilities, of VGAM1470 correlate with, and may be deduced from, the identity of the host target genes which VGAM1470 binds and inhibits, and the function of these host target genes, as elaborated hereinbelow.

Nucleotide sequences of the VGAM1470 precursor RNA, herein designated VGAM PRECURSOR RNA, and of the 'diced' VGAM1470 RNA, herein designated VGAM RNA, and a schematic representation of the secondary folding of VGAM1470 folded precursor RNA, herein designated VGAM FOLDED PRECURSOR RNA, of VGAM1470 are further described hereinbelow with reference to Table 1.

Nucleotide sequences of host target binding sites, such as BINDING SITE-I, BINDING SITE-II and BINDING SITE-III of FIG. 1, found on VGAM1470 host target RNA, and schematic representation of the complementarity of each of these host target binding sites to VGAM1470 RNA, herein designated VGAM RNA, are described hereinbelow with reference to Table 2.

As mentioned hereinabove with reference to FIG. 1, a function of VGAM1470 gene, herein designated VGAM is inhibition of expression of VGAM1470 target genes. It is appreciated that specific functions, and accordingly utilities, of VGAM1470 correlate with, and may be deduced from, the identity of the target genes which VGAM1470 binds and inhibits, and the function of these target genes, as elaborated hereinbelow.

Fms-related Tyrosine Kinase 1 (vascular endothelial growth factor/vascular permeability factor receptor) (FLT1, Accession NM_002019) is a VGAM1470 host target gene. FLT1 BINDING SITE is HOST TARGET binding site found in the 3' untranslated region of mRNA encoded by FLT1, corresponding to a HOST TARGET binding site such as BINDING SITE I, BINDING SITE II or BINDING SITE III. Table 2 illustrates the complementarity of the nucleotide sequences of FLT1 BINDING SITE, designated SEQ ID:7764, to the nucleotide sequence of VGAM1470 RNA, herein designated VGAM RNA, also designated SEQ ID:4181.

A function of VGAM1470 is therefore inhibition of Fms-related Tyrosine Kinase 1 (vascular endothelial growth factor/ vascular permeability factor receptor) (FLT1, Accession NM_002019). Accordingly, utilities of VGAM1470 include diagnosis, prevention and treatment of diseases and clinical conditions associated with FLT1. Transcriptional Intermediary Factor 1 (TIF1, Accession XM_016701) is another VGAM1470 host target gene. TIF1 BINDING SITE is HOST TARGET binding site found in the 3' untranslated region of mRNA encoded by TIF1, corresponding to a HOST TARGET binding site such as BINDING SITE I, BINDING SITE II or BINDING SITE III. Table 2 illustrates the complementarity of the nucleotide sequences of TIF1 BINDING SITE, designated SEQ ID:30275, to the nucleotide sequence of VGAM1470 RNA, herein designated VGAM RNA, also designated SEQ ID:4181.

Another function of VGAM1470 is therefore inhibition of Transcriptional Intermediary Factor 1 (TIF1, Accession XM_016701), a gene which mediates the activation function (AF-2) of nuclear estrogen receptor. Accordingly, utilities of VGAM1470 include diagnosis, prevention and treatment of diseases and clinical conditions associated with TIF1. The function of TIF1 and its association with various diseases and clinical conditions, has been established by previous studies, as described hereinabove with reference to VGAM108. FLJ14600 (Accession NM_032810) is another VGAM1470 host target gene. FLJ14600 BINDING SITE is HOST TARGET binding site found in the 3' untranslated region of mRNA encoded by FLJ14600, corresponding to a HOST TARGET binding site such as BINDING SITE I, BINDING SITE II or BINDING SITE III. Table 2 illustrates the complementarity of the nucleotide sequences of FLJ14600 BINDING SITE, designated SEQ ID:26575, to the nucleotide sequence of VGAM1470 RNA, herein designated VGAM RNA, also designated SEQ ID:4181.

Another function of VGAM1470 is therefore inhibition of FLJ14600 (Accession NM_032810). Accordingly, utilities of VGAM1470 include diagnosis, prevention and treatment of diseases and clinical conditions associated with FLJ14600. FIG. 1 further provides a conceptual description of a novel bioinformatically detected viral gene of the present invention, referred to here as Viral Genomic Address Messenger 1471 (VGAM1471) viral gene, which modulates expression of respective host target genes thereof, the function and utility of which host target genes is known in the art.

VGAM1471 is a novel bioinformatically detected regulatory, non protein coding, viral micro RNA (miRNA) gene. The method by which VGAM1471 was detected is described hereinabove with reference to FIGS. 1-8.

VGAM1471 gene, herein designated VGAM GENE, is a viral gene contained in the genome of Cocksfoot Streak Virus (CSV). VGAM1471 host target gene, herein designated VGAM HOST TARGET GENE, is a human gene contained in the human genome.

VGAM1471 gene encodes a VGAM1471 precursor RNA, herein designated VGAM PRECURSOR RNA. Similar to other miRNA genes, and unlike most ordinary genes, VGAM1471 precursor RNA does not encode a protein. A nucleotide sequence identical or highly similar to the nucleotide sequence of VGAM1471 precursor RNA is designated SEQ ID:1457, and is provided hereinbelow with reference to the sequence listing part. Nucleotide sequence SEQ ID:1457 is located at position 4782 relative to the genome of Cocksfoot Streak Virus (CSV).

VGAM1471 precursor RNA folds onto itself, forming VGAM1471 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1471 folded precursor RNA into VGAM1471 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1471 RNA is designated SEQ ID:4182, and is provided hereinbelow with reference to the sequence listing part.

VGAM1471 host target gene, herein designated VGAM HOST TARGET GENE, encodes a corresponding messenger RNA, VGAM1471 host target RNA, herein designated VGAM HOST TARGET RNA. VGAM1471 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1471 RNA, herein designated VGAM RNA, binds complementarily to one or more host target binding sites located in untranslated regions of VGAM1471 host target RNA, herein designated VGAM HOST TARGET RNA. This complementary binding is due to the fact that the nucleotide sequence of VGAM1471 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1471 RNA, herein designated VGAM RNA, may have a different number of host target binding sites in untranslated regions of a VGAM1471 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1471 RNA, herein designated VGAM RNA, to host target binding sites on VGAM1471 host target RNA, herein designated VGAM HOST TARGET RNA, such as BINDING SITE I, BINDING SITE II and BINDING SITE III, inhibits translation of VGAM1471 host target RNA into VGAM1471 host target protein, herein designated VGAM HOST TARGET PROTEIN. VGAM host target protein is therefore outlined by a broken line.

It is appreciated that VGAM1471 host target gene, herein designated VGAM HOST TARGET GENE, in fact represents a plurality of VGAM1471 host target genes. The mRNA of each one of this plurality of VGAM1471 host target genes comprises one or more host target binding sites, each having a nucleotide sequence which is at least partly complementary to VGAM1471 RNA, herein designated VGAM RNA, and which when bound by VGAM1471 RNA causes inhibition of translation of respective one or more VGAM1471 host target proteins.

It is further appreciated by one skilled in the art that the mode of translational inhibition illustrated by FIG. 1 with specific reference to translational inhibition exerted by VGAM1471 gene, herein designated VGAM GENE, on one or more VGAM1471 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1471 is inhibition of expression of host target genes, as part of a novel viral mechanism of attacking a host. Accordingly, utilities of VGAM1471 include diagnosis, prevention and treatment of viral infection by Cocksfoot Streak Virus (CSV). Specific functions, and accordingly utilities, of VGAM1471 correlate with, and may be deduced from, the identity of the host target genes which VGAM1471 binds and inhibits, and the function of these host target genes, as elaborated hereinbelow.

Nucleotide sequences of the VGAM1471 precursor RNA, herein designated VGAM PRECURSOR RNA, and of the 'diced' VGAM1471 RNA, herein designated VGAM RNA, and a schematic representation of the secondary folding of VGAM1471 folded precursor RNA, herein designated VGAM FOLDED PRECURSOR RNA, of VGAM1471 are further described hereinbelow with reference to Table 1.

Nucleotide sequences of host target binding sites, such as BINDING SITE-I, BINDING SITE-II and BINDING SITE-III of FIG. 1, found on VGAM1471 host target RNA, and schematic representation of the complementarity of each of these host target binding sites to VGAM1471 RNA, herein designated VGAM RNA, are described hereinbelow with reference to Table 2.

As mentioned hereinabove with reference to FIG. 1, a function of VGAM1471 gene, herein designated VGAM is inhibition of expression of VGAM1471 target genes. It is appreciated that specific functions, and accordingly utilities, of VGAM1471 correlate with, and may be deduced from, the identity of the target genes which VGAM1471 binds and inhibits, and the function of these target genes, as elaborated hereinbelow.

Nuclear Factor of Activated T-cells, Cytoplasmic, Calcineurin-dependent 1 (NFATC1, Accession NM_006162) is a VGAM1471 host target gene. NFATC1 BINDING SITE is HOST TARGET binding site found in the 3' untranslated region of mRNA encoded by NFATC1, corresponding to a HOST TARGET binding site such as BINDING SITE I, BINDING SITE II or BINDING SITE III. Table 2 illustrates the complementarity of the nucleotide sequences of NFATC1 BINDING SITE, designated SEQ ID:12814, to the nucleotide sequence of VGAM1471 RNA, herein designated VGAM RNA, also designated SEQ ID:4182.

A function of VGAM1471 is therefore inhibition of Nuclear Factor of Activated T-cells, Cytoplasmic, Calcineurin-dependent 1 (NFATC1, Accession NM_006162), a gene which regulates he activation, proliferation, differentiation and programmed death of ymphoid and nonlymphoid cells. Accordingly, utilities of VGAM1471 include diagnosis, prevention and treatment of diseases and clinical conditions associated with NFATC1. The function of NFATC1 and its association with various diseases and clinical conditions, has been established by previous studies, as described hereinabove with reference to VGAM123. BTB (POZ) Domain Containing 3 (BTBD3, Accession NM_014962) is another VGAM1471 host target gene. BTBD3 BINDING SITE is HOST TARGET binding site found in the 3' untranslated region of mRNA encoded by BTBD3, corresponding to a HOST TARGET binding site such as BINDING SITE I, BINDING SITE II or BINDING SITE III. Table 2 illustrates the complementarity of the nucleotide sequences of BTBD3 BINDING SITE, designated SEQ ID:17337, to the nucleotide sequence of VGAM1471 RNA, herein designated VGAM RNA, also designated SEQ ID:4182.

Another function of VGAM1471 is therefore inhibition of BTB (POZ) Domain Containing 3 (BTBD3, Accession NM_014962). Accordingly, utilities of VGAM1471 include diagnosis, prevention and treatment of diseases and clinical conditions associated with BTBD3. DKFZp761N0624 (Accession NM_032295) is another VGAM1471 host target gene. DKFZp761N0624 BINDING SITE is HOST TARGET binding site found in the 3' untranslated region of mRNA encoded by DKFZp761N0624, corresponding to a HOST TARGET binding site such as BINDING SITE I, BINDING SITE II or BINDING SITE III. Table 2 illustrates the complementarity of the nucleotide sequences of DKFZp761N0624 BINDING SITE, designated SEQ ID:26074, to the nucleotide sequence of VGAM1471 RNA, herein designated VGAM RNA, also designated SEQ ID:4182.

Another function of VGAM1471 is therefore inhibition of DKFZp761N0624 (Accession NM_032295). Accordingly, utilities of VGAM1471 include diagnosis, prevention and treatment of diseases and clinical conditions associated with DKFZp761N0624. FLJ21709 (Accession XM_085480) is another VGAM1471 host target gene. FLJ21709 BINDING SITE is HOST TARGET binding site found in the 3' untranslated region of mRNA encoded by FLJ21709, corresponding to a HOST TARGET binding site such as BINDING SITE I, BINDING SITE II or BINDING SITE III. Table 2 illustrates the complementarity of the nucleotide sequences of FLJ21709 BINDING SITE, designated SEQ ID:38169, to the nucleotide sequence of VGAM1471 RNA, herein designated VGAM RNA, also designated SEQ ID:4182.

Another function of VGAM1471 is therefore inhibition of FLJ21709 (Accession XM_085480). Accordingly, utilities of VGAM1471 include diagnosis, prevention and treatment of diseases and clinical conditions associated with FLJ21709. GTP Binding Protein 5 (putative) (GTPBP5, Accession XM_037206) is another VGAM1471 host target gene. GTPBP5 BINDING SITE is HOST TARGET binding site found in the 3' untranslated region of mRNA encoded by GTPBP5, corresponding to a HOST TARGET binding site such as BINDING SITE I, BINDING SITE II or BINDING SITE III. Table 2 illustrates the complementarity of the nucleotide sequences of GTPBP5 BINDING SITE, designated SEQ ID:32574, to the nucleotide sequence of VGAM1471 RNA, herein designated VGAM RNA, also designated SEQ ID:4182.

Another function of VGAM1471 is therefore inhibition of GTP Binding Protein 5 (putative) (GTPBP5, Accession XM_037206). Accordingly, utilities of VGAM1471 include diagnosis, prevention and treatment of diseases and clinical conditions associated with GTPBP5. MGC21675 (Accession NM_052861) is another VGAM1471 host target gene. MGC21675 BINDING SITE is HOST TARGET binding site found in the 5' untranslated region of mRNA encoded by MGC21675, corresponding to a HOST TARGET binding site such as BINDING SITE I, BINDING SITE II or BINDING SITE III. Table 2 illustrates the complementarity of the nucleotide sequences of MGC21675 BINDING SITE, designated SEQ ID:27444, to the nucleotide sequence of VGAM1471 RNA, herein designated VGAM RNA, also designated SEQ ID:4182.

Another function of VGAM1471 is therefore inhibition of MGC21675 (Accession NM_052861). Accordingly, utilities of VGAM1471 include diagnosis, prevention and treatment of diseases and clinical conditions associated with MGC21675. U5-100K (Accession XM_006784) is another VGAM1471 host target gene. U5-100K BINDING SITE is HOST TARGET binding site found in the 3' untranslated region of mRNA encoded by U5-100K, corresponding to a HOST TARGET binding site such as BINDING SITE I, BINDING SITE II or BINDING SITE III. Table 2 illustrates the complementarity of the nucleotide sequences of U5-100K BINDING SITE, designated SEQ ID:30011, to the nucleotide sequence of VGAM1471 RNA, herein designated VGAM RNA, also designated SEQ ID:4182.

Another function of VGAM1471 is therefore inhibition of U5-100K (Accession XM_006784). Accordingly, utilities of VGAM1471 include diagnosis, prevention and treatment of diseases and clinical conditions associated with U5-100K. LOC150407 (Accession XM_086906) is another VGAM1471 host target gene. LOC150407 BINDING SITE is HOST TARGET binding site found in the 3' untranslated region of mRNA encoded by LOC150407, corresponding to a HOST TARGET binding site such as BINDING SITE I, BINDING SITE II or BINDING SITE III. Table 2 illustrates the complementarity of the nucleotide sequences of LOC150407 BINDING SITE, designated SEQ ID:38954, to the nucleotide sequence of VGAM1471 RNA, herein designated VGAM RNA, also designated SEQ ID:4182.

Another function of VGAM1471 is therefore inhibition of LOC150407 (Accession XM_086906). Accordingly, utilities of VGAM1471 include diagnosis, prevention and treatment of diseases and clinical conditions associated with LOC150407. FIG. 1 further provides a conceptual description of a novel bioinformatically detected viral gene of the present invention, referred to here as Viral Genomic Address Messenger 1472 (VGAM1472) viral gene, which modulates expression of respective host target genes thereof, the function and utility of which host target genes is known in the art.

VGAM1472 is a novel bioinformatically detected regulatory, non protein coding, viral micro RNA (miRNA) gene. The method by which VGAM1472 was detected is described hereinabove with reference to FIGS. 1-8.

VGAM1472 gene, herein designated VGAM GENE, is a viral gene contained in the genome of Cocksfoot Streak Virus (CSV). VGAM1472 host target gene, herein designated VGAM HOST TARGET GENE, is a human gene contained in the human genome.

VGAM1472 gene encodes a VGAM1472 precursor RNA, herein designated VGAM PRECURSOR RNA. Similar to other miRNA genes, and unlike most ordinary genes, VGAM1472 precursor RNA does not encode a protein. A nucleotide sequence identical or highly similar to the nucleotide sequence of VGAM1472 precursor RNA is designated SEQ ID:1458, and is provided hereinbelow with reference to the sequence listing part. Nucleotide sequence SEQ ID:1458 is located at position 4423 relative to the genome of Cocksfoot Streak Virus (CSV).

VGAM1472 precursor RNA folds onto itself, forming VGAM1472 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1472 folded precursor RNA into VGAM1472 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1472 RNA is designated SEQ ID:4183, and is provided hereinbelow with reference to the sequence listing part.

VGAM1472 host target gene, herein designated VGAM HOST TARGET GENE, encodes a corresponding messenger RNA, VGAM1472 host target RNA, herein designated VGAM HOST TARGET RNA. VGAM1472 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1472 RNA, herein designated VGAM RNA, binds complementarily to one or more host target binding sites located in untranslated regions of VGAM1472 host target RNA, herein designated VGAM HOST TARGET RNA. This complementary binding is due to the fact that the nucleotide sequence of VGAM1472 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1472 RNA, herein designated VGAM RNA, may have a different number of host target binding sites in untranslated regions of a VGAM1472 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1472 RNA, herein designated VGAM RNA, to host target binding sites on VGAM1472 host target RNA, herein designated VGAM HOST TARGET RNA, such as BINDING SITE I, BINDING SITE II and BINDING SITE III, inhibits translation of VGAM1472 host target RNA into VGAM1472 host target protein, herein designated VGAM HOST TARGET PROTEIN. VGAM host target protein is therefore outlined by a broken line.

It is appreciated that VGAM1472 host target gene, herein designated VGAM HOST TARGET GENE, in fact represents a plurality of VGAM1472 host target genes. The mRNA of each one of this plurality of VGAM1472 host target genes comprises one or more host target binding sites, each having a nucleotide sequence which is at least partly complementary to VGAM1472 RNA, herein designated VGAM RNA, and which when bound by VGAM1472 RNA causes inhibition of translation of respective one or more VGAM1472 host target proteins.

It is further appreciated by one skilled in the art that the mode of translational inhibition illustrated by FIG. 1 with specific reference to translational inhibition exerted by VGAM1472 gene, herein designated VGAM GENE, on one or more VGAM1472 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1472 is inhibition of expression of host target genes, as part of a novel viral mechanism of attacking a host. Accordingly, utilities of VGAM1472 include diagnosis, prevention and treatment of viral infection by Cocksfoot Streak Virus (CSV). Specific functions, and accordingly utilities, of VGAM1472 correlate with, and may be deduced from, the identity of the host target genes which VGAM1472 binds and inhibits, and the function of these host target genes, as elaborated hereinbelow.

Nucleotide sequences of the VGAM1472 precursor RNA, herein designated VGAM PRECURSOR RNA, and of the 'diced' VGAM1472 RNA, herein designated VGAM RNA, and a schematic representation of the secondary folding of VGAM1472 folded precursor RNA, herein designated VGAM FOLDED PRECURSOR RNA, of VGAM1472 are further described hereinbelow with reference to Table 1.

Nucleotide sequences of host target binding sites, such as BINDING SITE-I, BINDING SITE-II and BINDING SITE-III of FIG. 1, found on VGAM1472 host target RNA, and schematic representation of the complementarity of each of these host target binding sites to VGAM1472 RNA, herein designated VGAM RNA, are described hereinbelow with reference to Table 2.

As mentioned hereinabove with reference to FIG. 1, a function of VGAM1472 gene, herein designated VGAM is inhibition of expression of VGAM1472 target genes. It is appreciated that specific functions, and accordingly utilities, of VGAM1472 correlate with, and may be deduced from, the identity of the target genes which VGAM1472 binds and inhibits, and the function of these target genes, as elaborated hereinbelow.

Protein Kinase, CAMP-dependent, Catalytic, Beta (PRKACB, Accession NM_002731) is a VGAM1472 host target gene. PRKACB BINDING SITE is HOST TARGET binding site found in the 3' untranslated region of mRNA encoded by PRKACB, corresponding to a HOST TARGET binding site such as BINDING SITE I, BINDING SITE II or BINDING SITE III. Table 2 illustrates the complementarity of the nucleotide sequences of PRKACB BINDING SITE, designated SEQ ID:8602, to the nucleotide sequence of VGAM1472 RNA, herein designated VGAM RNA, also designated SEQ ID:4183.

A function of VGAM1472 is therefore inhibition of Protein Kinase, CAMP-dependent, Catalytic, Beta (PRKACB, Accession NM_002731), a gene which is the catalytic beta subunit of cAMP-dependent protein kinase (PKA). Accordingly, utilities of VGAM1472 include diagnosis, prevention and treatment of diseases and clinical conditions associated with PRKACB. The function of PRKACB and its association with various diseases and clinical conditions, has been established by previous studies, as described hereinabove with reference to VGAM795. Spondyloepiphyseal Dysplasia, Late (SEDL, Accession NM_014563) is another VGAM1472 host target gene. SEDL BINDING SITE is HOST TARGET binding site found in the 3' untranslated region of mRNA encoded by SEDL, corresponding to a HOST TARGET binding site such as BINDING SITE I, BINDING SITE II or BINDING SITE III. Table 2 illustrates the complementarity of the nucleotide sequences of SEDL BINDING SITE, designated SEQ ID:15909, to the nucleotide sequence of VGAM1472 RNA, herein designated VGAM RNA, also designated SEQ ID:4183.

Another function of VGAM1472 is therefore inhibition of Spondyloepiphyseal Dysplasia, Late (SEDL, Accession NM_014563), a gene which may play role in vesicular transport from endoplasmic reticulum to golgi. Accordingly, utilities of VGAM1472 include diagnosis, prevention and treatment of diseases and clinical conditions associated with SEDL. The function of SEDL and its association with various diseases and clinical conditions, has been established by previous studies, as described hereinabove with reference to VGAM74. Solute Carrier Family 35 (CMP-sialic acid transporter), Member 1 (SLC35A1, Accession NM_006416) is another VGAM1472 host target gene. SLC35A1 BINDING SITE is HOST TARGET binding site found in the 3' untranslated region of mRNA encoded by SLC35A1, corresponding to a HOST TARGET binding site such as BINDING SITE I, BINDING SITE II or BINDING SITE III. Table 2 illustrates the complementarity of the nucleotide sequences of SLC35A1 BINDING SITE, designated SEQ ID:13127, to the nucleotide sequence of VGAM1472 RNA, herein designated VGAM RNA, also designated SEQ ID:4183.

Another function of VGAM1472 is therefore inhibition of Solute Carrier Family 35 (CMP-sialic acid transporter), Member 1 (SLC35A1, Accession NM_006416), a gene which transports cmp-sialic acid from the cytosol into golgi vesicles. Accordingly, utilities of VGAM1472 include diagnosis, prevention and treatment of diseases and clinical conditions associated with SLC35A1. The function of SLC35A1 and its association with various diseases and clinical conditions, has been established by previous studies, as described hereinabove with reference to VGAM152. Steroid-5-alpha-reductase, Alpha Polypeptide 1 (3-oxo-5 alpha-steroid delta 4-dehydrogenase alpha 1) (SRD5A1, Accession NM_001047) is another VGAM1472 host target gene. SRD5A1 BINDING SITE is HOST TARGET binding site found in the 3' untranslated region of mRNA encoded by SRD5A1, corresponding to a HOST TARGET binding site such as BINDING SITE I, BINDING SITE II or BINDING SITE III. Table 2 illustrates the complementarity of the nucleotide sequences of SRD5A1 BINDING SITE, designated SEQ ID:6716, to the nucleotide sequence of VGAM1472 RNA, herein designated VGAM RNA, also designated SEQ ID:4183.

Another function of VGAM1472 is therefore inhibition of Steroid-5-alpha-reductase, Alpha Polypeptide 1 (3-oxo-5 alpha-steroid delta 4-dehydrogenase alpha 1) (SRD5A1, Accession NM_001047), a gene which catalyzes the conversion of testosterone into 5-alpha-dihydrotestosterone and progesterone. Accordingly, utilities of VGAM1472 include diagnosis, prevention and treatment of diseases and clinical conditions associated with SRD5A1. The function of SRD5A1 and its association with various diseases and clinical conditions, has been established by previous studies, as described hereinabove with reference to VGAM749. ADMP (Accession NM_145035) is another VGAM1472 host target gene. ADMP BINDING SITE is HOST TARGET binding site found in the 3' untranslated region of mRNA encoded by ADMP, corresponding to a HOST TARGET binding site such as BINDING SITE I, BINDING SITE II or BINDING SITE III. Table 2 illustrates the complementarity of the nucleotide sequences of ADMP BINDING SITE, designated SEQ ID:29657, to the nucleotide sequence of VGAM1472 RNA, herein designated VGAM RNA, also designated SEQ ID:4183.

Another function of VGAM1472 is therefore inhibition of ADMP (Accession NM_145035). Accordingly, utilities of VGAM1472 include diagnosis, prevention and treatment of diseases and clinical conditions associated with ADMP. KIAA0872 (Accession NM_014940) is another VGAM1472 host target gene. KIAA0872 BINDING SITE is HOST TARGET binding site found in the 3" untranslated region of mRNA encoded by KIAA0872, corresponding to a HOST TARGET binding site such as BINDING SITE I, BINDING SITE II or BINDING SITE III. Table 2 illustrates the complementarity of the nucleotide sequences of KIAA0872 BINDING SITE, designated SEQ ID:17246, to the nucleotide sequence of VGAM1472 RNA, herein designated VGAM RNA, also designated SEQ ID:4183.

Another function of VGAM1472 is therefore inhibition of KIAA0872 (Accession NM_014940). Accordingly, utilities of VGAM1472 include diagnosis, prevention and treatment of diseases and clinical conditions associated with KIAA0872. LOC148137 (Accession NM_144692) is another VGAM1472 host target gene. LOC148137 BINDING SITE is HOST TARGET binding site found in the 3' untranslated region of mRNA encoded by LOC148137, corresponding to a HOST TARGET binding site such as BINDING SITE I, BINDING SITE II or BINDING SITE III. Table 2 illustrates the complementarity of the nucleotide sequences of LOC148137 BINDING SITE, designated SEQ ID:29516, to the nucleotide sequence of VGAM1472 RNA, herein designated VGAM RNA, also designated SEQ ID:4183.

Another function of VGAM1472 is therefore inhibition of LOC148137 (Accession NM_144692). Accordingly, utilities of VGAM1472 include diagnosis, prevention and treatment of diseases and clinical conditions associated with LOC148137. LOC162333 (Accession XM_102591) is another VGAM1472 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42127, to the nucleotide sequence of VGAM1472 RNA, herein designated VGAM RNA, also designated SEQ ID:4183.

Another function of VGAM1472 is therefore inhibition of LOC162333 (Accession XM_102591). Accordingly, utilities of VGAM1472 include diagnosis, prevention and treatment of diseases and clinical conditions associated with LOC162333. FIG. 1 further provides a conceptual description of a novel bioinformatically detected viral gene of the present invention, referred to here as Viral Genomic Address Messenger 1473 (VGAM1473) viral gene, which modulates expression of respective host target genes thereof, the function and utility of which host target genes is known in the art.

VGAM1473 is a novel bioinformatically detected regulatory, non protein coding, viral micro RNA (miRNA) gene. The method by which VGAM1473 was detected is described hereinabove with reference to FIGS. 1-8.

VGAM1473 gene, herein designated VGAM GENE, is a viral gene contained in the genome of Cocksfoot Streak Virus (CSV). VGAM1473 host target gene, herein designated VGAM HOST TARGET GENE, is a human gene contained in the human genome.

VGAM1473 gene encodes a VGAM1473 precursor RNA, herein designated VGAM PRECURSOR RNA. Similar to other miRNA genes, and unlike most ordinary genes, VGAM1473 precursor RNA does not encode a protein. A nucleotide sequence identical or highly similar to the nucleotide sequence of VGAM1473 precursor RNA is designated SEQ ID:1459, and is provided hereinbelow with reference to the sequence listing part. Nucleotide sequence SEQ ID:1459 is located at position 8361 relative to the genome of Cocksfoot Streak Virus (CSV).

VGAM1473 precursor RNA folds onto itself, forming VGAM1473 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1473 folded precursor RNA into VGAM1473 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM1473 RNA is designated SEQ ID:4184, and is provided hereinbelow with reference to the sequence listing part.

VGAM1473 host target gene, herein designated VGAM HOST TARGET GENE, encodes a corresponding messenger RNA, VGAM1473 host target RNA, herein designated VGAM HOST TARGET RNA. VGAM1473 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1473 RNA, herein designated VGAM RNA, binds complementarily to one or more host target binding sites located in untranslated regions of VGAM1473 host target RNA, herein designated VGAM HOST TARGET RNA. This complementary binding is due to the fact that the nucleotide sequence of VGAM1473 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1473 RNA, herein designated VGAM RNA, may have a different number of host target binding sites in untranslated regions of a VGAM1473 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1473 RNA, herein designated VGAM RNA, to host target binding sites on VGAM1473 host target RNA, herein designated VGAM HOST TARGET RNA, such as BINDING SITE I, BINDING SITE II and BINDING SITE III, inhibits translation of VGAM1473 host target RNA into VGAM1473 host target protein, herein designated VGAM HOST TARGET PROTEIN. VGAM host target protein is therefore outlined by a broken line.

It is appreciated that VGAM1473 host target gene, herein designated VGAM HOST TARGET GENE, in fact represents a plurality of VGAM1473 host target genes. The mRNA of each one of this plurality of VGAM1473 host target genes comprises one or more host target binding sites, each having a nucleotide sequence which is at least partly complementary to VGAM1473 RNA, herein designated VGAM RNA, and which when bound by VGAM1473 RNA causes inhibition of translation of respective one or more VGAM1473 host target proteins.

It is further appreciated by one skilled in the art that the mode of translational inhibition illustrated by FIG. 1 with specific reference to translational inhibition exerted by VGAM1473 gene, herein designated VGAM GENE, on one or more VGAM1473 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1473 is inhibition of expression of host target genes, as part of a novel viral mechanism of attacking a host. Accordingly, utilities of VGAM1473 include diagnosis, prevention and treatment of viral infection by Cocksfoot Streak Virus (CSV). Specific functions, and accordingly utilities, of VGAM1473 correlate with, and may be deduced from, the identity of the host target genes which VGAM1473 binds and inhibits, and the function of these host target genes, as elaborated hereinbelow.

Nucleotide sequences of the VGAM1473 precursor RNA, herein designated VGAM PRECURSOR RNA, and of the 'diced' VGAM1473 RNA, herein designated VGAM RNA, and a schematic representation of the secondary folding of VGAM1473 folded precursor RNA, herein designated VGAM FOLDED PRECURSOR RNA, of VGAM1473 are further described hereinbelow with reference to Table 1.

Nucleotide sequences of host target binding sites, such as BINDING SITE-I, BINDING SITE-II and BINDING SITE-III of FIG. 1, found on VGAM1473 host target RNA, and schematic representation of the complementarity of each of these host target binding sites to VGAM1473 RNA, herein designated VGAM RNA, are described hereinbelow with reference to Table 2.

As mentioned hereinabove with reference to FIG. 1, a function of VGAM1473 gene, herein designated VGAM is inhibition of expression of VGAM1473 target genes. It is appreciated that specific functions, and accordingly utilities, of VGAM1473 correlate with, and may be deduced from, the identity of the target genes which VGAM1473 binds and inhibits, and the function of these target genes, as elaborated hereinbelow.

FLJ20345 (Accession NM_017777) is a VGAM1473 host target gene. FLJ20345 BINDING SITE is HOST TARGET binding site found in the 3' untranslated region of mRNA encoded by FLJ20345, corresponding to a HOST TARGET binding site such as BINDING SITE I, BINDING SITE II or BINDING SITE III. Table 2 illustrates the complementarity of the nucleotide sequences of FLJ20345 BINDING SITE, designated SEQ ID:19407, to the nucleotide sequence of VGAM1473 RNA, herein designated VGAM RNA, also designated SEQ ID:4184.

A function of VGAM1473 is therefore inhibition of FLJ20345 (Accession NM_017777). Accordingly, utilities of VGAM1473 include diagnosis, prevention and treatment of diseases and clinical conditions associated with FLJ20345. FYVE and Coiled-coil Domain Containing 1 (FYCO1, Accession NM_024513) is another VGAM1473 host target gene. FYCO1 BINDING SITE is HOST TARGET binding site found in the 3' untranslated region of mRNA encoded by FYCO1, corresponding to a HOST TARGET binding site such as BINDING SITE I, BINDING SITE II or BINDING SITE III. Table 2 illustrates the complementarity of the nucleotide sequences of FYCO1 BINDING SITE, designated SEQ ID:23711, to the nucleotide sequence of VGAM1473 RNA, herein designated VGAM RNA, also designated SEQ ID:4184.

Another function of VGAM1473 is therefore inhibition of FYVE and Coiled-coil Domain Containing 1 (FYCO1, Accession NM_024513). Accordingly, utilities of VGAM1473 include diagnosis, prevention and treatment of diseases and clinical conditions associated with FYCO1. KIAA1061 (Accession XM_048786) is another VGAM1473 host target gene. KIAA1061 BINDING SITE is HOST TAR- GET binding site found in the 3' untranslated region of mRNA encoded by KIAA1061, corresponding to a HOST TARGET binding site such as BINDING SITE I, BINDING SITE II or BINDING SITE III. Table 2 illustrates the complementarity of the nucleotide sequences of KIAA1061 BINDING SITE, designated SEQ ID:35268, to the nucleotide sequence of VGAM1473 RNA, herein designated VGAM RNA, also designated SEQ ID:4184.

Another function of VGAM1473 is therefore inhibition of KIAA1061 (Accession XM_048786). Accordingly, utilities of VGAM1473 include diagnosis, prevention and treatment of diseases and clinical conditions associated with KIAA1061. KIAA1300 (Accession XM_031744) is another VGAM1473 host target gene. KIAA1300 BINDING SITE is HOST TARGET binding site found in the 5' untranslated region of mRNA encoded by KIAA1300, corresponding to a HOST TARGET binding site such as BINDING SITE I, BINDING SITE II or BINDING SITE III. Table 2 illustrates the complementarity of the nucleotide sequences of KIAA1300 BINDING SITE, designated SEQ ID:31482, to the nucleotide sequence of VGAM1473 RNA, herein designated VGAM RNA, also designated SEQ ID:4184.

Another function of VGAM1473 is therefore inhibition of KIAA1300 (Accession XM_031744). Accordingly, utilities of VGAM1473 include diagnosis, prevention and treatment of diseases and clinical conditions associated with KIAA1300. PRO1386 (Accession NM_031269) is another VGAM1473 host target gene. PRO1386 BINDING SITE is HOST TARGET binding site found in the 3' untranslated region of mRNA encoded by PRO1386, corresponding to a HOST TARGET binding site such as BINDING SITE I, BINDING SITE II or BINDING SITE III. Table 2 illustrates the complementarity of the nucleotide sequences of PRO1386 BINDING SITE, designated SEQ ID:25291, to the nucleotide sequence of VGAM1473 RNA, herein designated VGAM RNA, also designated SEQ ID:4184.

Another function of VGAM1473 is therefore inhibition of PRO1386 (Accession NM_031269). Accordingly, utilities of VGAM1473 include diagnosis, prevention and treatment of diseases and clinical conditions associated with PRO1386. Translocase of Outer Mitochondrial Membrane 70 Homolog A (yeast) (TOMM70A, Accession NM_014820) is another VGAM1473 host target gene. TOMM70A BINDING SITE is HOST TARGET binding site found in the 3' untranslated region of mRNA encoded by TOMM70A, corresponding to a HOST TARGET binding site such as BINDING SITE I, BINDING SITE II or BINDING SITE III. Table 2 illustrates the complementarity of the nucleotide sequences of TOMM70A BINDING SITE, designated SEQ ID:16790, to the nucleotide sequence of VGAM1473 RNA, herein designated VGAM RNA, also designated SEQ ID:4184.

Another function of VGAM1473 is therefore inhibition of Translocase of Outer Mitochondrial Membrane 70 Homolog A (yeast) (TOMM70A, Accession NM_014820). Accordingly, utilities of VGAM1473 include diagnosis, prevention and treatment of diseases and clinical conditions associated with TOMM70A. LOC157931 (Accession XM_098845) is another VGAM1473 host target gene. LOC157931 BINDING SITE is HOST TARGET binding site found in the 5' untranslated region of mRNA encoded by LOC157931, corresponding to a HOST TARGET binding site such as BINDING SITE I, BINDING SITE II or BINDING SITE III. Table 2 illustrates the complementarity of the nucleotide sequences of LOC157931 BINDING SITE, designated SEQ ID:41903, to the nucleotide sequence of VGAM1473 RNA, herein designated VGAM RNA, also designated SEQ ID:4184.

Another function of VGAM1473 is therefore inhibition of LOC157931 (Accession XM_098845). Accordingly, utilities of VGAM1473 include diagnosis, prevention and treatment of diseases and clinical conditions associated with LOC157931. LOC222166 (Accession XM_168425) is another VGAM1473 host target gene. LOC222166 BINDING SITE is HOST TARGET binding site found in the 3' untranslated region of mRNA encoded by LOC222166, corresponding to a HOST TARGET binding site such as BINDING SITE I, BINDING SITE II or BINDING SITE III. Table 2 illustrates the complementarity of the nucleotide sequences of LOC222166 BINDING SITE, designated SEQ ID:45154, to the nucleotide sequence of VGAM1473 RNA, herein designated VGAM RNA, also designated SEQ ID:4184.

Another function of VGAM1473 is therefore inhibition of LOC222166 (Accession XM_168425). Accordingly, utilities of VGAM1473 include diagnosis, prevention and treatment of diseases and clinical conditions associated with LOC222166. FIG. 1 further provides a conceptual description of a novel bioinformatically detected viral gene of the present invention, referred to here as Viral Genomic Address Messenger 1474 (VGAM1474) viral gene, which modulates expression of respective host target genes thereof, the function and utility of which host target genes is known in the art.

VGAM1474 is a novel bioinformatically detected regulatory, non protein coding, viral micro RNA (miRNA) gene. The method by which VGAM1474 was detected is described hereinabove with reference to FIGS. 1-8.

VGAM1474 gene, herein designated VGAM GENE, is a viral gene contained in the genome of Cocksfoot Streak Virus (CSV). VGAM1474 host target gene, herein designated VGAM HOST TARGET GENE, is a human gene contained in the human genome.

VGAM1474 gene encodes a VGAM1474 precursor RNA, herein designated VGAM PRECURSOR RNA. Similar to other miRNA genes, and unlike most ordinary genes, VGAM1474 precursor RNA does not encode a protein. A nucleotide sequence identical or highly similar to the nucleotide sequence of VGAM1474 precursor RNA is designated SEQ ID:1460, and is provided hereinbelow with reference to the sequence listing part. Nucleotide sequence SEQ ID:1460 is located at position 761 relative to the genome of Cocksfoot Streak Virus (CSV).

VGAM1474 precursor RNA folds onto itself, forming VGAM1474 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1474 folded precursor RNA into VGAM1474 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1474 RNA is designated SEQ ID:4185, and is provided hereinbelow with reference to the sequence listing part.

VGAM1474 host target gene, herein designated VGAM HOST TARGET GENE, encodes a corresponding messenger RNA, VGAM1474 host target RNA, herein designated VGAM HOST TARGET RNA. VGAM1474 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1474 RNA, herein designated VGAM RNA, binds complementarily to one or more host target binding sites located in untranslated regions of VGAM1474 host target RNA, herein designated VGAM HOST TARGET RNA. This complementary binding is due to the fact that the nucleotide sequence of VGAM1474 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1474 RNA, herein designated VGAM RNA, may have a different number of host target binding sites in untranslated regions of a VGAM1474 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1474 RNA, herein designated VGAM RNA, to host target binding sites on VGAM1474 host target RNA, herein designated VGAM HOST TARGET RNA, such as BINDING SITE I, BINDING SITE II and BINDING SITE III, inhibits translation of VGAM1474 host target RNA into VGAM1474 host target protein, herein designated VGAM HOST TARGET PROTEIN. VGAM host target protein is therefore outlined by a broken line.

It is appreciated that VGAM1474 host target gene, herein designated VGAM HOST TARGET GENE, in fact represents a plurality of VGAM1474 host target genes. The mRNA of each one of this plurality of VGAM1474 host target genes comprises one or more host target binding sites, each having a nucleotide sequence which is at least partly complementary to VGAM1474 RNA, herein designated VGAM RNA, and which when bound by VGAM1474 RNA causes inhibition of translation of respective one or more VGAM1474 host target proteins.

It is further appreciated by one skilled in the art that the mode of translational inhibition illustrated by FIG. 1 with specific reference to translational inhibition exerted by VGAM1474 gene, herein designated VGAM GENE, on one or more VGAM1474 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1474 is inhibition of expression of host target genes, as part of a novel viral mechanism of attacking a host. Accordingly, utilities of VGAM1474 include diagnosis, prevention and treatment of viral infection by Cocksfoot Streak Virus (CSV). Specific functions, and accordingly utilities, of VGAM1474 correlate with, and may be deduced from, the identity of the host target genes which VGAM1474 binds and inhibits, and the function of these host target genes, as elaborated hereinbelow.

Nucleotide sequences of the VGAM1474 precursor RNA, herein designated VGAM PRECURSOR RNA, and of the 'diced' VGAM1474 RNA, herein designated VGAM RNA, and a schematic representation of the secondary folding of VGAM1474 folded precursor RNA, herein designated VGAM FOLDED PRECURSOR RNA, of VGAM1474 are further described hereinbelow with reference to Table 1.

Nucleotide sequences of host target binding sites, such as BINDING SITE-I, BINDING SITE-II and BINDING SITE-III of FIG. 1, found on VGAM1474 host target RNA, and schematic representation of the complementarity of each of these host target binding sites to VGAM1474 RNA, herein designated VGAM RNA, are described hereinbelow with reference to Table 2.

As mentioned hereinabove with reference to FIG. 1, a function of VGAM1474 gene, herein designated VGAM is inhibition of expression of VGAM1474 target genes. It is appreciated that specific functions, and accordingly utilities, of VGAM1474 correlate with, and may be deduced from, the identity of the target genes which VGAM1474 binds and inhibits, and the function of these target genes, as elaborated hereinbelow.

Chondroitin Sulfate Proteoglycan 3 (neurocan) (CSPG3, Accession NM_004386) is a VGAM1474 host target gene. CSPG3 BINDING SITE is HOST TARGET binding site found in the 3' untranslated region of mRNA encoded by CSPG3, corresponding to a HOST TARGET binding site such as BINDING SITE I, BINDING SITE II or BINDING SITE III. Table 2 illustrates the complementarity of the nucleotide sequences of CSPG3 BINDING SITE, designated SEQ ID:10615, to the nucleotide sequence of VGAM1474 RNA, herein designated VGAM RNA, also designated SEQ ID:4185.

A function of VGAM1474 is therefore inhibition of Chondroitin Sulfate Proteoglycan 3 (neurocan) (CSPG3, Accession NM_004386), a gene which may play a role in modulating cell adhesion and migrationn. Accordingly, utilities of VGAM1474 include diagnosis, prevention and treatment of diseases and clinical conditions associated with CSPG3. The function of CSPG3 and its association with various diseases and clinical conditions, has been established by previous studies, as described hereinabove with reference to VGAM634. Protocadherin Alpha 1 (PCDHA1, Accession NM_018900) is another VGAM1474 host target gene. PCDHA1 BINDING SITE1 and PCDHA1 BINDING SITE2 are HOST TARGET binding sites found in untranslated regions of mRNA encoded by PCDHA1, corresponding to HOST TARGET binding sites such as BINDING SITE I, BINDING SITE II or BINDING SITE III. Table 2 illustrates the complementarity of the nucleotide sequences of PCDHA1 BINDING SITE1 and PCDHA1 BINDING SITE2, designated SEQ ID:20867 and SEQ ID:25386 respectively, to the nucleotide sequence of VGAM1474 RNA, herein designated VGAM RNA, also designated SEQ ID:4185.

Another function of VGAM1474 is therefore inhibition of Protocadherin Alpha 1 (PCDHA1, Accession NM_018900). Accordingly, utilities of VGAM1474 include diagnosis, prevention and treatment of diseases and clinical conditions associated with PCDHA1. Protocadherin Alpha 10 (PCDHA10, Accession NM_018901) is another VGAM1474 host target gene. PCDHA10 BINDING SITE1 and PCDHA10 BINDING SITE2 are HOST TARGET binding sites found in untranslated regions of mRNA encoded by PCDHA10, corresponding to HOST TARGET binding sites such as BINDING SITE I, BINDING SITE II or BINDING SITE III. Table 2 illustrates the complementarity of the nucleotide sequences of PCDHA10 BINDING SITE1 and PCDHA10 BINDING SITE2, designated SEQ ID:20877 and SEQ ID:20888 respectively, to the nucleotide sequence of VGAM1474 RNA, herein designated VGAM RNA, also designated SEQ ID:4185.

Another function of VGAM1474 is therefore inhibition of Protocadherin Alpha 10 (PCDHA10, Accession NM_018901). Accordingly, utilities of VGAM1474 include diagnosis, prevention and treatment of diseases and clinical conditions associated with PCDHA10. Protocadherin Alpha 13 (PCDHA13, Accession NM_018904) is another VGAM1474 host target gene. PCDHA13 BINDING SITE is HOST TARGET binding site found in the 3' untranslated region of mRNA encoded by PCDHA13, corresponding to a HOST TARGET binding site such as BINDING SITE I, BINDING SITE II or BINDING SITE III. Table 2 illustrates the complementarity of the nucleotide sequences of PCDHA13 BINDING SITE, designated SEQ ID:20908, to the nucleotide sequence of VGAM1474 RNA, herein designated VGAM RNA, also designated SEQ ID:4185.

Another function of VGAM1474 is therefore inhibition of Protocadherin Alpha 13 (PCDHA13, Accession NM_018904). Accordingly, utilities of VGAM1474 include diagnosis, prevention and treatment of diseases and clinical conditions associated with PCDHA13. Protocadherin Alpha 2 (PCDHA2, Accession NM_018905) is another VGAM1474 host target gene. PCDHA2 BINDING SITE is HOST TARGET binding site found in the 3' untranslated region of mRNA encoded by PCDHA2, corresponding to a HOST TARGET binding site such as BINDING SITE I, BINDING SITE II or BINDING SITE III. Table 2 illustrates the complementarity of the nucleotide sequences of PCDHA2 BINDING SITE, designated SEQ ID:20918, to the nucleotide sequence of VGAM1474 RNA, herein designated VGAM RNA, also designated SEQ ID:4185.

Another function of VGAM1474 is therefore inhibition of Protocadherin Alpha 2 (PCDHA2, Accession NM_018905). Accordingly, utilities of VGAM1474 include diagnosis, prevention and treatment of diseases and clinical conditions associated with PCDHA2. Protocadherin Alpha 3 (PCDHA3, Accession NM_018906) is another VGAM1474 host target gene. PCDHA3 BINDING SITE is HOST TARGET binding site found in the 3' untranslated region of mRNA encoded by PCDHA3, corresponding to a HOST TARGET binding site such as BINDING SITE I, BINDING SITE II or BINDING SITE III. Table 2 illustrates the complementarity of the nucleotide sequences of PCDHA3 BINDING SITE, designated SEQ ID:20928, to the nucleotide sequence of VGAM1474 RNA, herein designated VGAM RNA, also designated SEQ ID:4185.

Another function of VGAM1474 is therefore inhibition of Protocadherin Alpha 3 (PCDHA3, Accession NM_018906). Accordingly, utilities of VGAM1474 include diagnosis, prevention and treatment of diseases and clinical conditions associated with PCDHA3. Protocadherin Alpha 4 (PCDHA4, Accession NM_018907) is another VGAM1474 host target gene. PCDHA4 BINDING SITE is HOST TARGET binding site found in the 3' untranslated region of mRNA encoded by PCDHA4, corresponding to a HOST TARGET binding site such as BINDING SITE I, BINDING SITE II or BINDING SITE III. Table 2 illustrates the complementarity of the nucleotide sequences of PCDHA4 BINDING SITE, designated SEQ ID:20938, to the nucleotide sequence of VGAM1474 RNA, herein designated VGAM RNA, also designated SEQ ID:4185.

Another function of VGAM1474 is therefore inhibition of Protocadherin Alpha 4 (PCDHA4, Accession NM_018907). Accordingly, utilities of VGAM1474 include diagnosis, prevention and treatment of diseases and clinical conditions associated with PCDHA4. Protocadherin Alpha 5 (PCDHA5, Accession NM_018908) is another VGAM1474 host target gene. PCDHA5 BINDING SITE is HOST TARGET binding site found in the 3' untranslated region of mRNA encoded by PCDHA5, corresponding to a HOST TARGET binding site such as BINDING SITE I, BINDING SITE II or BINDING SITE III. Table 2 illustrates the complementarity of the nucleotide sequences of PCDHA5 BINDING SITE, designated SEQ ID:20948, to the nucleotide sequence of VGAM1474 RNA, herein designated VGAM RNA, also designated SEQ ID:4185.

Another function of VGAM1474 is therefore inhibition of Protocadherin Alpha 5 (PCDHA5, Accession NM_018908). Accordingly, utilities of VGAM1474 include diagnosis, prevention and treatment of diseases and clinical conditions associated with PCDHA5. Protocadherin Alpha 6 (PCDHA6, Accession NM_018909) is another VGAM1474 host target gene. PCDHA6 BINDING SITE1 and PCDHA6 BINDING SITE2 are HOST TARGET binding sites found in untranslated regions of mRNA encoded by PCDHA6, corresponding to HOST TARGET binding sites such as BINDING SITE I, BINDING SITE II or BINDING SITE III. Table 2 illustrates the complementarity of the nucleotide sequences of PCDHA6 BINDING SITE1 and PCDHA6 BINDING SITE2, designated SEQ ID:20958 and SEQ ID:25590 respectively, to the nucleotide sequence of VGAM1474 RNA, herein designated VGAM RNA, also designated SEQ ID:4185.

Another function of VGAM1474 is therefore inhibition of Protocadherin Alpha 6 (PCDHA6, Accession NM_018909). Accordingly, utilities of VGAM1474 include diagnosis, prevention and treatment of diseases and clinical conditions associated with PCDHA6. Protocadherin Alpha 8 (PCDHA8, Accession NM_018911) is another VGAM1474 host target gene. PCDHA8 BINDING SITE is HOST TARGET binding site found in the 3' untranslated region of mRNA encoded by PCDHA8, corresponding to a HOST TARGET binding site such as BINDING SITE I, BINDING SITE II or BINDING SITE III. Table 2 illustrates the complementarity of the nucleotide sequences of PCDHA8 BINDING SITE, designated SEQ ID:20978, to the nucleotide sequence of VGAM1474 RNA, herein designated VGAM RNA, also designated SEQ ID:4185.

Another function of VGAM1474 is therefore inhibition of Protocadherin Alpha 8 (PCDHA8, Accession NM_018911). Accordingly, utilities of VGAM1474 include diagnosis, prevention and treatment of diseases and clinical conditions associated with PCDHA8. Protocadherin Alpha 9 (PCDHA9, Accession NM_031857) is another VGAM1474 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:25604, to the nucleotide sequence of VGAM1474 RNA, herein designated VGAM RNA, also designated SEQ ID:4185.

Another function of VGAM1474 is therefore inhibition of Protocadherin Alpha 9 (PCDHA9, Accession NM_031857), a gene which is a calcium-dependent cell-adhesion protein.

Accordingly, utilities of VGAM1474 include diagnosis, prevention and treatment of diseases and clinical conditions associated with PCDHA9. The function of PCDHA9 and its association with various diseases and clinical conditions, has been established by previous studies, as described hereinabove with reference to VGAM71. Protocadherin Alpha Subfamily C, 1 (PCDHAC1, Accession NM_018898) is another VGAM1474 host target gene. PCDHAC1 BINDING SITE is HOST TARGET binding site found in the 3' untranslated region of mRNA encoded by PCDHAC1, corresponding to a HOST TARGET binding site such as BINDING SITE I, BINDING SITE II or BINDING SITE III. Table 2 illustrates the complementarity of the nucleotide sequences of PCDHAC1 BINDING SITE, designated SEQ ID:20847, to the nucleotide sequence of VGAM1474 RNA, herein designated VGAM RNA, also designated SEQ ID:4185.

Another function of VGAM1474 is therefore inhibition of Protocadherin Alpha Subfamily C, 1 (PCDHAC1, Accession NM_018898). Accordingly, utilities of VGAM1474 include diagnosis, prevention and treatment of diseases and clinical conditions associated with PCDHAC1. Protocadherin Alpha Subfamily C, 2 (PCDHAC2, Accession NM_018899) is another VGAM1474 host target gene. PCDHAC2 BINDING SITE is HOST TARGET binding site found in the 3' untranslated region of mRNA encoded by PCDHAC2, corresponding to a HOST TARGET binding site such as BINDING SITE I, BINDING SITE II or BINDING SITE III. Table 2 illustrates the complementarity of the nucleotide sequences of PCDHAC2 BINDING SITE, designated SEQ ID:20857, to the nucleotide sequence of VGAM1474 RNA, herein designated VGAM RNA, also designated SEQ ID:4185.

Another function of VGAM1474 is therefore inhibition of Protocadherin Alpha Subfamily C, 2 (PCDHAC2, Accession NM_018899). Accordingly, utilities of VGAM1474 include diagnosis, prevention and treatment of diseases and clinical conditions associated with PCDHAC2. CUG Triplet Repeat, RNA Binding Protein 2 (CUGBP2, Accession NM_006561) is another VGAM1474 host target gene. CUGBP2 BINDING SITE is HOST TARGET binding site found in the 3' untranslated region of mRNA encoded by CUGBP2, corresponding to a HOST TARGET binding site such as BINDING SITE I, BINDING SITE II or BINDING SITE III. Table 2 illustrates the complementarity of the nucleotide sequences of CUGBP2 BINDING SITE, designated SEQ ID:13332, to the nucleotide sequence of VGAM1474 RNA, herein designated VGAM RNA, also designated SEQ ID:4185.

Another function of VGAM1474 is therefore inhibition of CUG Triplet Repeat, RNA Binding Protein 2 (CUGBP2, Accession NM_006561). Accordingly, utilities of VGAM1474 include diagnosis, prevention and treatment of diseases and clinical conditions associated with CUGBP2. PRO2831 (Accession NM_018540) is another VGAM1474 host target gene. PRO2831 BINDING SITE is HOST TARGET binding site found in the 3' untranslated region of mRNA encoded by PRO2831, corresponding to a HOST TARGET binding site such as BINDING SITE I, BINDING SITE II or BINDING SITE III. Table 2 illustrates the complementarity of the nucleotide sequences of PRO2831 BINDING SITE, designated SEQ ID:20611, to the nucleotide sequence of VGAM1474 RNA, herein designated VGAM RNA, also designated SEQ ID:4185.

Another function of VGAM1474 is therefore inhibition of PRO2831 (Accession NM_018540). Accordingly, utilities of VGAM1474 include diagnosis, prevention and treatment of diseases and clinical conditions associated with PRO2831. LOC150577 (Accession XM_097918) is another VGAM1474 host target gene. LOC150577 BINDING SITE is HOST TARGET binding site found in the 3' untranslated region of mRNA encoded by LOC150577, corresponding to a HOST TARGET binding site such as BINDING SITE I, BINDING SITE II or BINDING SITE III. Table 2 illustrates the complementarity of the nucleotide sequences of LOC150577 BINDING SITE, designated SEQ ID:41220, to the nucleotide sequence of VGAM1474 RNA, herein designated VGAM RNA, also designated SEQ ID:4185.

Another function of VGAM1474 is therefore inhibition of LOC150577 (Accession XM_097918). Accordingly, utilities of VGAM1474 include diagnosis, prevention and treatment of diseases and clinical conditions associated with LOC150577. FIG. 1 further provides a conceptual description of a novel bioinformatically detected viral gene of the present invention, referred to here as Viral Genomic Address Messenger 1475 (VGAM1475) viral gene, which modulates expression of respective host target genes thereof, the function and utility of which host target genes is known in the art.

VGAM1475 is a novel bioinformatically detected regulatory, non protein coding, viral micro RNA (miRNA) gene. The method by which VGAM1475 was detected is described hereinabove with reference to FIGS. 1-8.

VGAM1475 gene, herein designated VGAM GENE, is a viral gene contained in the genome of Cocksfoot Streak Virus (CSV). VGAM1475 host target gene, herein designated VGAM HOST TARGET GENE, is a human gene contained in the human genome.

VGAM1475 gene encodes a VGAM1475 precursor RNA, herein designated VGAM PRECURSOR RNA. Similar to other miRNA genes, and unlike most ordinary genes, VGAM1475 precursor RNA does not encode a protein. A nucleotide sequence identical or highly similar to the nucleotide sequence of VGAM1475 precursor RNA is designated SEQ ID:1461, and is provided hereinbelow with reference to the sequence listing part. Nucleotide sequence SEQ ID:1461 is located at position 3422 relative to the genome of Cocksfoot Streak Virus (CSV).

VGAM1475 precursor RNA folds onto itself, forming VGAM1475 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1475 folded precursor RNA into VGAM1475 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1475 RNA is designated SEQ ID:4186, and is provided hereinbelow with reference to the sequence listing part.

VGAM1475 host target gene, herein designated VGAM HOST TARGET GENE, encodes a corresponding messenger RNA, VGAM1475 host target RNA, herein designated VGAM HOST TARGET RNA. VGAM1475 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1475 RNA, herein designated VGAM RNA, binds complementarily to one or more host target binding sites located in untranslated regions of VGAM1475 host target RNA, herein designated VGAM HOST TARGET RNA. This complementary binding is due to the fact that the nucleotide sequence of VGAM1475 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1475 RNA, herein designated VGAM RNA, may have a different number of host target binding sites in untranslated regions of a VGAM1475 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1475 RNA, herein designated VGAM RNA, to host target binding sites on VGAM1475 host target RNA, herein designated VGAM HOST TARGET RNA, such as BINDING SITE I, BINDING SITE II and BINDING SITE III, inhibits translation of VGAM1475 host target RNA into VGAM1475 host target protein, herein designated VGAM HOST TARGET PROTEIN. VGAM host target protein is therefore outlined by a broken line.

It is appreciated that VGAM1475 host target gene, herein designated VGAM HOST TARGET GENE, in fact represents a plurality of VGAM1475 host target genes. The mRNA of each one of this plurality of VGAM1475 host target genes comprises one or more host target binding sites, each having a nucleotide sequence which is at least partly complementary to VGAM1475 RNA, herein designated VGAM RNA, and which when bound by VGAM1475 RNA causes inhibition of translation of respective one or more VGAM1475 host target proteins.

It is further appreciated by one skilled in the art that the mode of translational inhibition illustrated by FIG. 1 with specific reference to translational inhibition exerted by VGAM1475 gene, herein designated VGAM GENE, on one or more VGAM1475 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1475 is inhibition of expression of host target genes, as part of a novel viral mechanism of attacking a host. Accordingly, utilities of VGAM1475 include diagnosis, prevention and treatment of viral infection by Cocksfoot Streak Virus (CSV). Specific functions, and accordingly utilities, of VGAM1475 correlate with, and may be deduced from, the identity of the host target genes which VGAM1475 binds and inhibits, and the function of these target genes, as elaborated hereinbelow.

Nucleotide sequences of the VGAM1475 precursor RNA, herein designated VGAM PRECURSOR RNA, and of the 'diced' VGAM1475 RNA, herein designated VGAM RNA, and a schematic representation of the secondary folding of VGAM1475 folded precursor RNA, herein designated VGAM FOLDED PRECURSOR RNA, of VGAM1475 are further described hereinbelow with reference to Table 1.

Nucleotide sequences of host target binding sites, such as BINDING SITE-I, BINDING SITE-II and BINDING SITE-III of FIG. 1, found on VGAM1475 host target RNA, and schematic representation of the complementarity of each of these host target binding sites to VGAM1475 RNA, herein designated VGAM RNA, are described hereinbelow with reference to Table 2.

As mentioned hereinabove with reference to FIG. 1, a function of VGAM1475 gene, herein designated VGAM is inhibition of expression of VGAM1475 target genes. It is appreciated that specific functions, and accordingly utilities, of VGAM1475 correlate with, and may be deduced from, the identity of the target genes which VGAM1475 binds and inhibits, and the function of these target genes, as elaborated hereinbelow.

Thioredoxin Interacting Protein (TXNIP, Accession NM_006472) is a VGAM1475 host target gene. TXNIP BINDING SITE is HOST TARGET binding site found in the 3' untranslated region of mRNA encoded by TXNIP, corresponding to a HOST TARGET binding site such as BINDING SITE I, BINDING SITE II or BINDING SITE III. Table 2 illustrates the complementarity of the nucleotide sequences of TXNIP BINDING SITE, designated SEQ ID:13197, to the nucleotide sequence of VGAM1475 RNA, herein designated VGAM RNA, also designated SEQ ID:4186.

A function of VGAM1475 is therefore inhibition of Thioredoxin Interacting Protein (TXNIP, Accession NM_006472), a gene which binds and inhibits thioredoxin, a major regulator of cellular redox state. Accordingly, utilities of VGAM1475 include diagnosis, prevention and treatment of diseases and clinical conditions associated with TXNIP. The function of TXNIP and its association with various diseases and clinical conditions, has been established by previous studies, as described hereinabove with reference to VGAM737. Zinc Finger Protein 215 (ZNF215, Accession NM_013250) is another VGAM1475 host target gene. ZNF215 BINDING SITE is HOST TARGET binding site found in the 3' untranslated region of mRNA encoded by ZNF215, corresponding to a HOST TARGET binding site such as BINDING SITE I, BINDING SITE II or BINDING SITE III. Table 2 illustrates the complementarity of the nucleotide sequences of ZNF215 BINDING SITE, designated SEQ ID:14913, to the nucleotide sequence of VGAM1475 RNA, herein designated VGAM RNA, also designated SEQ ID:4186.

Another function of VGAM1475 is therefore inhibition of Zinc Finger Protein 215 (ZNF215, Accession NM_013250). Accordingly, utilities of VGAM1475 include diagnosis, prevention and treatment of diseases and clinical conditions associated with ZNF215. ARNTL2 (Accession NM_020183) is another VGAM1475 host target gene. ARNTL2 BINDING SITE is HOST TARGET binding site found in the 5' untranslated region of mRNA encoded by ARNTL2, corresponding to a HOST TARGET binding site such as BINDING SITE I, BINDING SITE II or BINDING SITE III. Table 2 illustrates the complementarity of the nucleotide sequences of ARNTL2 BINDING SITE, designated SEQ ID:21415, to the nucleotide sequence of VGAM1475 RNA, herein designated VGAM RNA, also designated SEQ ID:4186.

Another function of VGAM1475 is therefore inhibition of ARNTL2 (Accession NM_020183). Accordingly, utilities of VGAM1475 include diagnosis, prevention and treatment of diseases and clinical conditions associated with ARNTL2.

BNIP-S (Accession NM_138278) is another VGAM1475 host target gene. BNIP-S BINDING SITE is HOST TARGET binding site found in the 3' untranslated region of mRNA encoded by BNIP-S, corresponding to a HOST TARGET binding site such as BINDING SITE I, BINDING SITE II or BINDING SITE III. Table 2 illustrates the complementarity of the nucleotide sequences of BNIP-S BINDING SITE, designated SEQ ID:28691, to the nucleotide sequence of VGAM1475 RNA, herein designated VGAM RNA, also designated SEQ ID:4186.

Another function of VGAM1475 is therefore inhibition of BNIP-S (Accession NM_138278). Accordingly, utilities of VGAM1475 include diagnosis, prevention and treatment of diseases and clinical conditions associated with BNIP-S. DKFZP564D0764 (Accession XM_113964) is another VGAM1475 host target gene. DKFZP564D0764 BINDING SITE is HOST TARGET binding site found in the 3' untranslated region of mRNA encoded by DKFZP564D0764, corresponding to a HOST TARGET binding site such as BINDING SITE I, BINDING SITE II or BINDING SITE III. Table 2 illustrates the complementarity of the nucleotide sequences of DKFZP564D0764 BINDING SITE, designated SEQ ID:42575, to the nucleotide sequence of VGAM1475 RNA, herein designated VGAM RNA, also designated SEQ ID:4186.

Another function of VGAM1475 is therefore inhibition of DKFZP564D0764 (Accession XM_113964). Accordingly, utilities of VGAM1475 include diagnosis, prevention and treatment of diseases and clinical conditions associated with DKFZP564D0764. FLJ10352 (Accession NM_032142) is another VGAM1475 host target gene. FLJ10352 BINDING SITE is HOST TARGET binding site found in the 3' untranslated region of mRNA encoded by FLJ10352, corresponding to a HOST TARGET binding site such as BINDING SITE I, BINDING SITE II or BINDING SITE III. Table 2 illustrates the complementarity of the nucleotide sequences of FLJ10352 BINDING SITE, designated SEQ ID:25825, to the nucleotide sequence of VGAM1475 RNA, herein designated VGAM RNA, also designated SEQ ID:4186.

Another function of VGAM1475 is therefore inhibition of FLJ10352 (Accession NM_032142). Accordingly, utilities of VGAM1475 include diagnosis, prevention and treatment of diseases and clinical conditions associated with FLJ10352. LOC120772 (Accession XM_058505) is another VGAM1475 host target gene. LOC120772 BINDING SITE is HOST TARGET binding site found in the 5' untranslated region of mRNA encoded by LOC120772, corresponding to a HOST TARGET binding site such as BINDING SITE I, BINDING SITE II or BINDING SITE III. Table 2 illustrates the complementarity of the nucleotide sequences of LOC120772 BINDING SITE, designated SEQ ID:36629, to the nucleotide sequence of VGAM1475 RNA, herein designated VGAM RNA, also designated SEQ ID:4186.

Another function of VGAM1475 is therefore inhibition of LOC120772 (Accession XM_058505). Accordingly, utilities of VGAM1475 include diagnosis, prevention and treatment of diseases and clinical conditions associated with LOC120772. LOC139767 (Accession XM_066883) is another VGAM1475 host target gene. LOC139767 BINDING SITE is HOST TARGET binding site found in the 5' untranslated region of mRNA encoded by LOC139767, corresponding to a HOST TARGET binding site such as BINDING SITE I, BINDING SITE II or BINDING SITE III. Table 2 illustrates the complementarity of the nucleotide sequences of LOC139767 BINDING SITE, designated SEQ ID:37346, to the nucleotide sequence of VGAM1475 RNA, herein designated VGAM RNA, also designated SEQ ID:4186.

Another function of VGAM1475 is therefore inhibition of LOC139767 (Accession XM_066883). Accordingly, utilities of VGAM1475 include diagnosis, prevention and treatment of diseases and clinical conditions associated with LOC139767. LOC154007 (Accession XM_087824) is another VGAM1475 host target gene. LOC154007 BINDING SITE is HOST TARGET binding site found in the 3' untranslated region of mRNA encoded by LOC154007, corresponding to a HOST TARGET binding site such as BINDING SITE I, BINDING SITE II or BINDING SITE III. Table 2 illustrates the complementarity of the nucleotide sequences of LOC154007 BINDING SITE, designated SEQ ID:39454, to the nucleotide sequence of VGAM1475 RNA, herein designated VGAM RNA, also designated SEQ ID:4186.

Another function of VGAM1475 is therefore inhibition of LOC154007 (Accession XM_087824). Accordingly, utilities of VGAM1475 include diagnosis, prevention and treatment of diseases and clinical conditions associated with LOC154007. LOC256867 (Accession XM_170694) is another VGAM1475 host target gene. LOC256867 BINDING SITE is HOST TARGET binding site found in the 5' untranslated region of mRNA encoded by LOC256867, corresponding to a HOST TARGET binding site such as BINDING SITE I, BINDING SITE II or BINDING SITE III. Table 2 illustrates the complementarity of the nucleotide sequences of LOC256867 BINDING SITE, designated SEQ ID:45475, to the nucleotide sequence of VGAM1475 RNA, herein designated VGAM RNA, also designated SEQ ID:4186.

Another function of VGAM1475 is therefore inhibition of LOC256867 (Accession XM_170694). Accordingly, utilities of VGAM1475 include diagnosis, prevention and treatment of diseases and clinical conditions associated with LOC256867. FIG. 1 further provides a conceptual description of a novel bioinformatically detected viral gene of the present invention, referred to here as Viral Genomic Address Messenger 1476 (VGAM1476) viral gene, which modulates expression of respective host target genes thereof, the function and utility of which host target genes is known in the art.

VGAM1476 is a novel bioinformatically detected regulatory, non protein coding, viral micro RNA (miRNA) gene. The method by which VGAM1476 was detected is described hereinabove with reference to FIGS. 1-8.

VGAM1476 gene, herein designated VGAM GENE, is a viral gene contained in the genome of Cocksfoot Streak Virus (CSV). VGAM1476 host target gene, herein designated VGAM HOST TARGET GENE, is a human gene contained in the human genome.

VGAM1476 gene encodes a VGAM1476 precursor RNA, herein designated VGAM PRECURSOR RNA. Similar to other miRNA genes, and unlike most ordinary genes, VGAM1476 precursor RNA does not encode a protein. A nucleotide sequence identical or highly similar to the nucleotide sequence of VGAM1476 precursor RNA is designated SEQ ID:1462, and is provided hereinbelow with reference to the sequence listing part. Nucleotide sequence SEQ ID:1462 is located at position 7485 relative to the genome of Cocksfoot Streak Virus (CSV).

VGAM1476 precursor RNA folds onto itself, forming VGAM1476 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1476 folded precursor RNA into VGAM1476 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1476 RNA is designated SEQ ID:4187, and is provided hereinbelow with reference to the sequence listing part.

VGAM1476 host target gene, herein designated VGAM HOST TARGET GENE, encodes a corresponding messenger RNA, VGAM1476 host target RNA, herein designated VGAM HOST TARGET RNA. VGAM1476 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1476 RNA, herein designated VGAM RNA, binds complementarily to one or more host target binding sites located in untranslated regions of VGAM1476 host target RNA, herein designated VGAM HOST TARGET RNA. This complementary binding is due to the fact that the nucleotide sequence of VGAM1476 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1476 RNA, herein designated VGAM RNA, may have a different number of host target binding sites in untranslated regions of a VGAM1476 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1476 RNA, herein designated VGAM RNA, to host target binding sites on VGAM1476 host target RNA, herein designated VGAM HOST TARGET RNA, such as BINDING SITE I, BINDING SITE II and BINDING SITE III, inhibits translation of VGAM1476 host target RNA into VGAM1476 host target protein, herein designated VGAM HOST TARGET PROTEIN. VGAM host target protein is therefore outlined by a broken line.

It is appreciated that VGAM1476 host target gene, herein designated VGAM HOST TARGET GENE, in fact represents a plurality of VGAM1476 host target genes. The mRNA of each one of this plurality of VGAM1476 host target genes comprises one or more host target binding sites, each having a nucleotide sequence which is at least partly complementary to VGAM1476 RNA, herein designated VGAM RNA, and which when bound by VGAM1476 RNA causes inhibition of translation of respective one or more VGAM1476 host target proteins.

It is further appreciated by one skilled in the art that the mode of translational inhibition illustrated by FIG. 1 with specific reference to translational inhibition exerted by VGAM1476 gene, herein designated VGAM GENE, on one or more VGAM1476 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1476 is inhibition of expression of host target genes, as part of a novel viral mechanism of attacking a host. Accordingly, utilities of VGAM1476 include diagnosis, prevention and treatment of viral infection by Cocksfoot Streak Virus (CSV). Specific functions, and accordingly utilities, of VGAM1476 correlate with, and may be deduced from, the identity of the host target genes which VGAM1476 binds and inhibits, and the function of these host target genes, as elaborated hereinbelow.

Nucleotide sequences of the VGAM1476 precursor RNA, herein designated VGAM PRECURSOR RNA, and of the 'diced' VGAM1476 RNA, herein designated VGAM RNA, and a schematic representation of the secondary folding of VGAM1476 folded precursor RNA, herein designated VGAM FOLDED PRECURSOR RNA, of VGAM1476 are further described hereinbelow with reference to Table 1.

Nucleotide sequences of host target binding sites, such as BINDING SITE-I, BINDING SITE-II and BINDING SITE-III of FIG. 1, found on VGAM1476 host target RNA, and schematic representation of the complementarity of each of these host target binding sites to VGAM1476 RNA, herein designated VGAM RNA, are described hereinbelow with reference to Table 2.

As mentioned hereinabove with reference to FIG. 1, a function of VGAM1476 gene, herein designated VGAM is inhibition of expression of VGAM1476 target genes. It is appreciated that specific functions, and accordingly utilities, of VGAM1476 correlate with, and may be deduced from, the identity of the target genes which VGAM1476 binds and inhibits, and the function of these target genes, as elaborated hereinbelow.

Chromosome 8 Open Reading Frame 14 (C8orf14, Accession NM_054029) is a VGAM1476 host target gene. C8orf14 BINDING SITE is HOST TARGET binding site found in the 5' untranslated region of mRNA encoded by C8orf14, corresponding to a HOST TARGET binding site such as BINDING SITE I, BINDING SITE II or BINDING SITE III. Table 2 illustrates the complementarity of the nucleotide sequences of C8orf14 BINDING SITE, designated SEQ ID:27640, to the nucleotide sequence of VGAM1476 RNA, herein designated VGAM RNA, also designated SEQ ID:4187.

A function of VGAM1476 is therefore inhibition of Chromosome 8 Open Reading Frame 14 (C8orf14, Accession NM_054029). Accordingly, utilities of VGAM1476 include diagnosis, prevention and treatment of diseases and clinical conditions associated with C8orf14. CXYorf1 (Accession XM_088704) is another VGAM1476 host target gene. CXYorf1 BINDING SITE is HOST TARGET binding site found in the 5' untranslated region of mRNA encoded by CXYorf1, corresponding to a HOST TARGET binding site such as BINDING SITE I, BINDING SITE II or BINDING SITE III. Table 2 illustrates the complementarity of the nucleotide sequences of CXYorf1 BINDING SITE, designated SEQ ID:39916, to the nucleotide sequence of VGAM1476 RNA, herein designated VGAM RNA, also designated SEQ ID:4187.

Another function of VGAM1476 is therefore inhibition of CXYorf1 (Accession XM_088704). Accordingly, utilities of VGAM1476 include diagnosis, prevention and treatment of diseases and clinical conditions associated with CXYorf1. FLJ31709 (Accession NM_144636) is another VGAM1476 host target gene. FLJ31709 BINDING SITE is HOST TARGET binding site found in the 3' untranslated region of mRNA encoded by FLJ31709, corresponding to a HOST TARGET binding site such as BINDING SITE I, BINDING SITE II or BINDING SITE III. Table 2 illustrates the complementarity of the nucleotide sequences of FLJ31709 BINDING SITE, designated SEQ ID:29458, to the nucleotide sequence of VGAM1476 RNA, herein designated VGAM RNA, also designated SEQ ID:4187.

Another function of VGAM1476 is therefore inhibition of FLJ31709 (Accession NM_144636). Accordingly, utilities of VGAM1476 include diagnosis, prevention and treatment of diseases and clinical conditions associated with FLJ31709. Histidyl-tRNA Synthetase-like (HARSL, Accession NM_012208) is another VGAM1476 host target gene. HARSL BINDING SITE is HOST TARGET binding site found in the 3' untranslated region of mRNA encoded by HARSL, corresponding to a HOST TARGET binding site such as BINDING SITE I, BINDING SITE II or BINDING SITE III. Table 2 illustrates the complementarity of the nucleotide sequences of HARSL BINDING SITE, designated SEQ ID:14510, to the nucleotide sequence of VGAM1476 RNA, herein designated VGAM RNA, also designated SEQ ID:4187.

Another function of VGAM1476 is therefore inhibition of Histidyl-tRNA Synthetase-like (HARSL, Accession NM_012208). Accordingly, utilities of VGAM1476 include diagnosis, prevention and treatment of diseases and clinical conditions associated with HARSL. KIAA0513 (Accession NM_014732) is another VGAM1476 host target gene. KIAA0513 BINDING SITE is HOST TARGET binding site found in the 3' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16356, to the nucleotide sequence of VGAM1476 RNA, herein designated VGAM RNA, also designated SEQ ID:4187.

Another function of VGAM1476 is therefore inhibition of KIAA0513 (Accession NM_014732). Accordingly, utilities of VGAM1476 include diagnosis, prevention and treatment of diseases and clinical conditions associated with KIAA0513. LOC166042 (Accession XM_093623) is another VGAM1476 host target gene. LOC166042 BINDING SITE is HOST TARGET binding site found in the 5' untranslated region of mRNA encoded by LOC166042, corresponding to a HOST TARGET binding site such as BINDING SITE I, BINDING SITE II or BINDING SITE III. Table 2 illustrates the complementarity of the nucleotide sequences of LOC166042 BINDING SITE, designated SEQ ID:40198, to the nucleotide sequence of VGAM1476 RNA, herein designated VGAM RNA, also designated SEQ ID:4187.

Another function of VGAM1476 is therefore inhibition of LOC166042 (Accession XM_093623). Accordingly, utilities of VGAM1476 include diagnosis, prevention and treatment of diseases and clinical conditions associated with LOC166042. LOC200093 (Accession XM_032184) is another VGAM1476 host target gene. LOC200093 BINDING SITE is HOST TARGET binding site found in the 5' untranslated region of mRNA encoded by LOC200093, corresponding to a HOST TARGET binding site such as BINDING SITE I, BINDING SITE II or BINDING SITE III. Table 2 illustrates the complementarity of the nucleotide sequences of LOC200093 BINDING SITE, designated SEQ ID:31607, to the nucleotide sequence of VGAM1476 RNA, herein designated VGAM RNA, also designated SEQ ID:4187.

Another function of VGAM1476 is therefore inhibition of LOC200093 (Accession XM_032184). Accordingly, utilities of VGAM1476 include diagnosis, prevention and treatment of diseases and clinical conditions associated with LOC200093. LOC91040 (Accession XM_035641) is another VGAM1476 host target gene. LOC91040 BINDING SITE is HOST TARGET binding site found in the 5' untranslated region of mRNA encoded by LOC91040, corresponding to a HOST TARGET binding site such as BINDING SITE I, BINDING SITE II or BINDING SITE III. Table 2 illustrates the complementarity of the nucleotide sequences of LOC91040 BINDING SITE, designated SEQ ID:32326, to the nucleotide sequence of VGAM1476 RNA, herein designated VGAM RNA, also designated SEQ ID:4187.

Another function of VGAM1476 is therefore inhibition of LOC91040 (Accession XM_035641). Accordingly, utilities of VGAM1476 include diagnosis, prevention and treatment of diseases and clinical conditions associated with LOC91040. FIG. 1 further provides a conceptual description of a novel bioinformatically detected viral gene of the present invention, referred to here as Viral Genomic Address Messenger 1477 (VGAM1477) viral gene, which modulates expression of respective host target genes thereof, the function and utility of which host target genes is known in the art.

VGAM1477 is a novel bioinformatically detected regulatory, non protein coding, viral micro RNA (miRNA) gene. The method by which VGAM1477 was detected is described hereinabove with reference to FIGS. 1-8.

VGAM1477 gene, herein designated VGAM GENE, is a viral gene contained in the genome of Cocksfoot Streak Virus (CSV). VGAM1477 host target gene, herein designated VGAM HOST TARGET GENE, is a human gene contained in the human genome.

VGAM1477 gene encodes a VGAM1477 precursor RNA, herein designated VGAM PRECURSOR RNA. Similar to other miRNA genes, and unlike most ordinary genes, VGAM1477 precursor RNA does not encode a protein. A nucleotide sequence identical or highly similar to the nucleotide sequence of VGAM1477 precursor RNA is designated SEQ ID:1463, and is provided hereinbelow with reference to the sequence listing part. Nucleotide sequence SEQ ID:1463 is located at position 5489 relative to the genome of Cocksfoot Streak Virus (CSV).

VGAM1477 precursor RNA folds onto itself, forming VGAM1477 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1477 folded precursor RNA into VGAM1477 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 90%) nucleotide sequence of VGAM1477 RNA is designated SEQ ID:4188, and is provided hereinbelow with reference to the sequence listing part.

VGAM1477 host target gene, herein designated VGAM HOST TARGET GENE, encodes a corresponding messenger RNA, VGAM1477 host target RNA, herein designated VGAM HOST TARGET RNA. VGAM1477 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1477 RNA, herein designated VGAM RNA, binds complementarily to one or more host target binding sites located in untranslated regions of VGAM1477 host target RNA, herein designated VGAM HOST TARGET RNA. This complementary binding is due to the fact that the nucleotide sequence of VGAM1477 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1477 RNA, herein designated VGAM RNA, may have a different number of host target binding sites in untranslated regions of a VGAM1477 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1477 RNA, herein designated VGAM RNA, to host target binding sites on VGAM1477 host target RNA, herein designated VGAM HOST TARGET RNA, such as BINDING SITE I, BINDING SITE II and BINDING SITE III, inhibits translation of VGAM1477 host target RNA into VGAM1477 host target protein, herein designated VGAM HOST TARGET PROTEIN. VGAM host target protein is therefore outlined by a broken line.

It is appreciated that VGAM1477 host target gene, herein designated VGAM HOST TARGET GENE, in fact represents a plurality of VGAM1477 host target genes. The mRNA of each one of this plurality of VGAM1477 host target genes comprises one or more host target binding sites, each having a nucleotide sequence which is at least partly complementary to VGAM1477 RNA, herein designated VGAM RNA, and which when bound by VGAM1477 RNA causes inhibition of translation of respective one or more VGAM1477 host target proteins.

It is further appreciated by one skilled in the art that the mode of translational inhibition illustrated by FIG. 1 with specific reference to translational inhibition exerted by VGAM1477 gene, herein designated VGAM GENE, on one or more VGAM1477 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1477 is inhibition of expression of host target genes, as part of a novel viral mechanism of attacking a host. Accordingly, utilities of VGAM1477 include diagnosis, prevention and treatment of viral infection by Cocksfoot Streak Virus (CSV). Specific functions, and accordingly utilities, of VGAM1477 correlate with, and may be deduced from, the identity of the host target genes which VGAM1477 binds and inhibits, and the function of these host target genes, as elaborated hereinbelow.

Nucleotide sequences of the VGAM1477 precursor RNA, herein designated VGAM PRECURSOR RNA, and of the 'diced' VGAM1477 RNA, herein designated VGAM RNA, and a schematic representation of the secondary folding of VGAM1477 folded precursor RNA, herein designated VGAM FOLDED PRECURSOR RNA, of VGAM1477 are further described hereinbelow with reference to Table 1.

Nucleotide sequences of host target binding sites, such as BINDING SITE-I, BINDING SITE-II and BINDING SITE-III of FIG. 1, found on VGAM1477 host target RNA, and schematic representation of the complementarity of each of these host target binding sites to VGAM1477 RNA, herein designated VGAM RNA, are described hereinbelow with reference to Table 2.

As mentioned hereinabove with reference to FIG. 1, a function of VGAM1477 gene, herein designated VGAM is inhibition of expression of VGAM1477 target genes. It is appreciated that specific functions, and accordingly utilities, of VGAM1477 correlate with, and may be deduced from, the identity of the target genes which VGAM1477 binds and inhibits, and the function of these target genes, as elaborated hereinbelow.

LAG1 Longevity Assurance Homolog 2 (S. cerevisiae) (LASS2, Accession XM_041889) is a VGAM1477 host target gene. LASS2 BINDING SITE is HOST TARGET binding site found in the 3' untranslated region of mRNA encoded by LASS2, corresponding to a HOST TARGET binding site such as BINDING SITE I, BINDING SITE II or BINDING SITE III. Table 2 illustrates the complementarity of the nucleotide sequences of LASS2 BINDING SITE, designated SEQ ID:33621, to the nucleotide sequence of VGAM1477 RNA, herein designated VGAM RNA, also designated SEQ ID:4188.

A function of VGAM1477 is therefore inhibition of LAG1 Longevity Assurance Homolog 2 (S. cerevisiae) (LASS2, Accession XM_041889). Accordingly, utilities of VGAM1477 include diagnosis, prevention and treatment of diseases and clinical conditions associated with LASS2. HEMK (Accession NM_016173) is another VGAM1477 host target gene. HEMK BINDING SITE is HOST TARGET binding site found in the 3' untranslated region of mRNA encoded by HEMK, corresponding to a HOST TARGET binding site such as BINDING SITE I, BINDING SITE II or BINDING SITE III. Table 2 illustrates the complementarity of the nucleotide sequences of HEMK BINDING SITE, designated SEQ ID:18263, to the nucleotide sequence of VGAM1477 RNA, herein designated VGAM RNA, also designated SEQ ID:4188.

Another function of VGAM1477 is therefore inhibition of HEMK (Accession NM_016173). Accordingly, utilities of VGAM1477 include diagnosis, prevention and treatment of diseases and clinical conditions associated with HEMK. LOC145623 (Accession XM_096822) is another VGAM1477 host target gene. LOC145623 BINDING SITE is HOST TARGET binding site found in the 3' untranslated region of mRNA encoded by LOC145623, corresponding to a HOST TARGET binding site such as BINDING SITE I, BINDING SITE II or BINDING SITE III. Table 2 illustrates the complementarity of the nucleotide sequences of LOC145623 BINDING SITE, designated SEQ ID:40543, to the nucleotide sequence of VGAM1477 RNA, herein designated VGAM RNA, also designated SEQ ID:4188.

Another function of VGAM1477 is therefore inhibition of LOC145623 (Accession XM_096822). Accordingly, utilities of VGAM1477 include diagnosis, prevention and treatment of diseases and clinical conditions associated with LOC145623. FIG. 1 further provides a conceptual description of a novel bioinformatically detected viral gene of the present invention, referred to here as Viral Genomic Address Messenger 1478 (VGAM1478) viral gene, which modulates expression of respective host target genes thereof, the function and utility of which host target genes is known in the art.

VGAM1478 is a novel bioinformatically detected regulatory, non protein coding, viral micro RNA (miRNA) gene. The method by which VGAM1478 was detected is described hereinabove with reference to FIGS. 1-8.

VGAM1478 gene, herein designated VGAM GENE, is a viral gene contained in the genome of Brome Streak Mosaic Virus. VGAM1478 host target gene, herein designated VGAM HOST TARGET GENE, is a human gene contained in the human genome.

VGAM1478 gene encodes a VGAM1478 precursor RNA, herein designated VGAM PRECURSOR RNA. Similar to other miRNA genes, and unlike most ordinary genes, VGAM1478 precursor RNA does not encode a protein. A nucleotide sequence identical or highly similar to the nucleotide sequence of VGAM1478 precursor RNA is designated SEQ ID:1464, and is provided hereinbelow with reference to the sequence listing part. Nucleotide sequence SEQ ID:1464 is located at position 7727 relative to the genome of Brome Streak Mosaic Virus.

VGAM1478 precursor RNA folds onto itself, forming VGAM1478 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1478 folded precursor RNA into VGAM1478 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1478 RNA is designated SEQ ID:4189, and is provided hereinbelow with reference to the sequence listing part.

VGAM1478 host target gene, herein designated VGAM HOST TARGET GENE, encodes a corresponding messenger RNA, VGAM1478 host target RNA, herein designated VGAM HOST TARGET RNA. VGAM1478 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1478 RNA, herein designated VGAM RNA, binds complementarily to one or more host target binding sites located in untranslated regions of VGAM1478 host target RNA, herein designated VGAM HOST TARGET RNA. This complementary binding is due to the fact that the nucleotide sequence of VGAM1478 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1478 RNA, herein designated VGAM RNA, may have a different number of host target binding sites in untranslated regions of a VGAM1478 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1478 RNA, herein designated VGAM RNA, to host target binding sites on VGAM1478 host target RNA, herein designated VGAM HOST TARGET RNA, such as BINDING SITE I, BINDING SITE II and BINDING SITE III, inhibits translation of VGAM1478 host target RNA into VGAM1478 host target protein, herein designated VGAM HOST TARGET PROTEIN. VGAM host target protein is therefore outlined by a broken line.

It is appreciated that VGAM1478 host target gene, herein designated VGAM HOST TARGET GENE, in fact represents a plurality of VGAM1478 host target genes. The mRNA of each one of this plurality of VGAM1478 host target genes comprises one or more host target binding sites, each having a nucleotide sequence which is at least partly complementary to VGAM1478 RNA, herein designated VGAM RNA, and which when bound by VGAM1478 RNA causes inhibition of translation of respective one or more VGAM1478 host target proteins.

It is further appreciated by one skilled in the art that the mode of translational inhibition illustrated by FIG. 1 with specific reference to translational inhibition exerted by VGAM1478 gene, herein designated VGAM GENE, on one or more VGAM1478 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1478 is inhibition of expression of host target genes, as part of a novel viral mechanism of attacking a host. Accordingly, utilities of VGAM1478 include diagnosis, prevention and treatment of viral infection by Brome Streak Mosaic Virus. Specific functions, and accordingly utilities, of VGAM1478 correlate with, and may be deduced from, the identity of the host target genes which VGAM1478 binds and inhibits, and the function of these host target genes, as elaborated hereinbelow.

Nucleotide sequences of the VGAM1478 precursor RNA, herein designated VGAM PRECURSOR RNA, and of the 'diced' VGAM1478 RNA, herein designated VGAM RNA, and a schematic representation of the secondary folding of VGAM1478 folded precursor RNA, herein designated VGAM FOLDED PRECURSOR RNA, of VGAM1478 are further described hereinbelow with reference to Table 1.

Nucleotide sequences of host target binding sites, such as BINDING SITE-I, BINDING SITE-II and BINDING SITE- III of FIG. 1, found on VGAM1478 host target RNA, and schematic representation of the complementarity of each of these host target binding sites to VGAM1478 RNA, herein designated VGAM RNA, are described hereinbelow with reference to Table 2.

As mentioned hereinabove with reference to FIG. 1, a function of VGAM1478 gene, herein designated VGAM is inhibition of expression of VGAM1478 target genes. It is appreciated that specific functions, and accordingly utilities, of VGAM1478 correlate with, and may be deduced from, the identity of the target genes which VGAM1478 binds and inhibits, and the function of these target genes, as elaborated hereinbelow.

FLJ12704 (Accession NM_024998) is a VGAM1478 host target gene. FLJ12704 BINDING SITE is HOST TARGET binding site found in the 3' untranslated region of mRNA encoded by FLJ12704, corresponding to a HOST TARGET binding site such as BINDING SITE I, BINDING SITE II or BINDING SITE III. Table 2 illustrates the complementarity of the nucleotide sequences of FLJ12704 BINDING SITE, designated SEQ ID:24563, to the nucleotide sequence of VGAM1478 RNA, herein designated VGAM RNA, also designated SEQ ID:4189.

A function of VGAM1478 is therefore inhibition of FLJ12704 (Accession NM_024998). Accordingly, utilities of VGAM1478 include diagnosis, prevention and treatment of diseases and clinical conditions associated with FLJ12704. MEGF10 (Accession NM_032446) is another VGAM1478 host target gene. MEGF10 BINDING SITE is HOST TARGET binding site found in the 3' untranslated region of mRNA encoded by MEGF10, corresponding to a HOST TARGET binding site such as BINDING SITE I, BINDING SITE II or BINDING SITE III. Table 2 illustrates the complementarity of the nucleotide sequences of MEGF10 BINDING SITE, designated SEQ ID:26212, to the nucleotide sequence of VGAM1478 RNA, herein designated VGAM RNA, also designated SEQ ID:4189.

Another function of VGAM1478 is therefore inhibition of MEGF10 (Accession NM_032446). Accordingly, utilities of VGAM1478 include diagnosis, prevention and treatment of diseases and clinical conditions associated with MEGF10. LOC90133 (Accession XM_029323) is another VGAM1478 host target gene. LOC90133 BINDING SITE is HOST TARGET binding site found in the 3' untranslated region of mRNA encoded by LOC90133, corresponding to a HOST TARGET binding site such as BINDING SITE I, BINDING SITE II or BINDING SITE III. Table 2 illustrates the complementarity of the nucleotide sequences of LOC90133 BINDING SITE, designated SEQ ID:30867, to the nucleotide sequence of VGAM1478 RNA, herein designated VGAM RNA, also designated SEQ ID:4189.

Another function of VGAM1478 is therefore inhibition of LOC90133 (Accession XM_029323). Accordingly, utilities of VGAM1478 include diagnosis, prevention and treatment of diseases and clinical conditions associated with LOC90133. FIG. 1 further provides a conceptual description of a novel bioinformatically detected viral gene of the present invention, referred to here as Viral Genomic Address Messenger 1479 (VGAM1479) viral gene, which modulates expression of respective host target genes thereof, the function and utility of which host target genes is known in the art.

VGAM1479 is a novel bioinformatically detected regulatory, non protein coding, viral micro RNA (miRNA) gene. The method by which VGAM1479 was detected is described hereinabove with reference to FIGS. 1-8.

VGAM1479 gene, herein designated VGAM GENE, is a viral gene contained in the genome of Brome Streak Mosaic Virus. VGAM1479 host target gene, herein designated VGAM HOST TARGET GENE, is a human gene contained in the human genome.

VGAM1479 gene encodes a VGAM1479 precursor RNA, herein designated VGAM PRECURSOR RNA. Similar to other miRNA genes, and unlike most ordinary genes, VGAM1479 precursor RNA does not encode a protein. A nucleotide sequence identical or highly similar to the nucleotide sequence of VGAM1479 precursor RNA is designated SEQ ID:1465, and is provided hereinbelow with reference to the sequence listing part. Nucleotide sequence SEQ ID:1465 is located at position 2629 relative to the genome of Brome Streak Mosaic Virus.

VGAM1479 precursor RNA folds onto itself, forming VGAM1479 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1479 folded precursor RNA into VGAM1479 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1479 RNA is designated SEQ ID:4190, and is provided hereinbelow with reference to the sequence listing part.

VGAM1479 host target gene, herein designated VGAM HOST TARGET GENE, encodes a corresponding messenger RNA, VGAM1479 host target RNA, herein designated VGAM HOST TARGET RNA. VGAM1479 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1479 RNA, herein designated VGAM RNA, binds complementarily to one or more host target binding sites located in untranslated regions of VGAM1479 host target RNA, herein designated VGAM HOST TARGET RNA. This complementary binding is due to the fact that the nucleotide sequence of VGAM1479 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1479 RNA, herein designated VGAM RNA, may have a different number of host target binding sites in untranslated regions of a VGAM1479 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1479 RNA, herein designated VGAM RNA, to host target binding sites on VGAM1479 host target RNA, herein designated VGAM HOST TARGET RNA, such as BINDING SITE I, BINDING SITE II and BINDING SITE III, inhibits translation of VGAM1479 host target RNA into VGAM1479 host target protein, herein designated VGAM HOST TARGET PROTEIN. VGAM host target protein is therefore outlined by a broken line.

It is appreciated that VGAM1479 host target gene, herein designated VGAM HOST TARGET GENE, in fact represents a plurality of VGAM1479 host target genes. The mRNA of each one of this plurality of VGAM1479 host target genes comprises one or more host target binding sites, each having a nucleotide sequence which is at least partly complementary to VGAM1479 RNA, herein designated VGAM RNA, and which when bound by VGAM1479 RNA causes inhibition of translation of respective one or more VGAM1479 host target proteins.

It is further appreciated by one skilled in the art that the mode of translational inhibition illustrated by FIG. 1 with specific reference to translational inhibition exerted by VGAM1479 gene, herein designated VGAM GENE, on one or more VGAM1479 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1479 is inhibition of expression of host target genes, as part of a novel viral mechanism of attacking a host. Accordingly, utilities of VGAM1479 include diagnosis, prevention and treatment of viral infection by Brome Streak Mosaic Virus. Specific functions, and accordingly utilities, of VGAM1479 correlate with, and may be deduced from, the identity of the host target genes which VGAM1479 binds and inhibits, and the function of these host target genes, as elaborated hereinbelow.

Nucleotide sequences of the VGAM1479 precursor RNA, herein designated VGAM PRECURSOR RNA, and of the 'diced' VGAM1479 RNA, herein designated VGAM RNA, and a schematic representation of the secondary folding of VGAM1479 folded precursor RNA, herein designated VGAM FOLDED PRECURSOR RNA, of VGAM1479 are further described hereinbelow with reference to Table 1.

Nucleotide sequences of host target binding sites, such as BINDING SITE-I, BINDING SITE-II and BINDING SITE-III of FIG. 1, found on VGAM1479 host target RNA, and schematic representation of the complementarity of each of these host target binding sites to VGAM1479 RNA, herein designated VGAM RNA, are described hereinbelow with reference to Table 2.

As mentioned hereinabove with reference to FIG. 1, a function of VGAM1479 gene, herein designated VGAM is inhibition of expression of VGAM1479 target genes. It is appreciated that specific functions, and accordingly utilities, of VGAM1479 correlate with, and may be deduced from, the identity of the target genes which VGAM1479 binds and inhibits, and the function of these target genes, as elaborated hereinbelow.

FIBL-6 (Accession XM_053531) is a VGAM1479 host target gene. FIBL-6 BINDING SITE is HOST TARGET binding site found in the 3' untranslated region of mRNA encoded by FIBL-6, corresponding to a HOST TARGET binding site such as BINDING SITE I, BINDING SITE II or BINDING SITE III. Table 2 illustrates the complementarity of the nucleotide sequences of FIBL-6 BINDING SITE, designated SEQ ID:36100, to the nucleotide sequence of VGAM1479 RNA, herein designated VGAM RNA, also designated SEQ ID:4190.

A function of VGAM1479 is therefore inhibition of FIBL-6 (Accession XM_053531). Accordingly, utilities of VGAM1479 include diagnosis, prevention and treatment of diseases and clinical conditions associated with FIBL-6. KIAA1795 (Accession XM_050988) is another VGAM1479 host target gene. KIAA1795 BINDING SITE is HOST TARGET binding site found in the 3' untranslated region of mRNA encoded by KIAA1795, corresponding to a HOST TARGET binding site such as BINDING SITE I, BINDING SITE II or BINDING SITE III. Table 2 illustrates the complementarity of the nucleotide sequences of KIAA1795 BINDING SITE, designated SEQ ID:35697, to the nucleotide sequence of VGAM1479 RNA, herein designated VGAM RNA, also designated SEQ ID:4190.

Another function of VGAM1479 is therefore inhibition of KIAA1795 (Accession XM_050988). Accordingly, utilities of VGAM1479 include diagnosis, prevention and treatment of diseases and clinical conditions associated with KIAA1795. LOC91263 (Accession XM_037264) is another VGAM1479 host target gene. LOC91263 BINDING SITE is HOST TARGET binding site found in the 5' untranslated region of mRNA encoded by LOC91263, corresponding to a HOST TARGET binding site such as BINDING SITE I, BINDING SITE II or BINDING SITE III. Table 2 illustrates the complementarity of the nucleotide sequences of LOC91263 BINDING SITE, designated SEQ ID:32594, to the nucleotide sequence of VGAM1479 RNA, herein designated VGAM RNA, also designated SEQ ID:4190.

Another function of VGAM1479 is therefore inhibition of LOC91263 (Accession XM_037264). Accordingly, utilities of VGAM1479 include diagnosis, prevention and treatment of diseases and clinical conditions associated with LOC91263. LOC92391 (Accession XM_044793) is another VGAM1479 host target gene. LOC92391 BINDING SITE is HOST TARGET binding site found in the 3' untranslated region of mRNA encoded by LOC92391, corresponding to a HOST TARGET binding site such as BINDING SITE I, BINDING SITE II or BINDING SITE III. Table 2 illustrates the complementarity of the nucleotide sequences of LOC92391 BINDING SITE, designated SEQ ID:34270, to the nucleotide sequence of VGAM1479 RNA, herein designated VGAM RNA, also designated SEQ ID:4190.

Another function of VGAM1479 is therefore inhibition of LOC92391 (Accession XM_044793). Accordingly, utilities of VGAM1479 include diagnosis, prevention and treatment of diseases and clinical conditions associated with LOC92391. FIG. 1 further provides a conceptual description of a novel bioinformatically detected viral gene of the present invention, referred to here as Viral Genomic Address Messenger 1480 (VGAM1480) viral gene, which modulates expression of respective host target genes thereof, the function and utility of which host target genes is known in the art.

VGAM1480 is a novel bioinformatically detected regulatory, non protein coding, viral micro RNA (miRNA) gene. The method by which VGAM1480 was detected is described hereinabove with reference to FIGS. 1-8.

VGAM1480 gene, herein designated VGAM GENE, is a viral gene contained in the genome of Brome Streak Mosaic Virus. VGAM1480 host target gene, herein designated VGAM HOST TARGET GENE, is a human gene contained in the human genome.

VGAM1480 gene encodes a VGAM1480 precursor RNA, herein designated VGAM PRECURSOR RNA. Similar to other miRNA genes, and unlike most ordinary genes, VGAM1480 precursor RNA does not encode a protein. A nucleotide sequence identical or highly similar to the nucleotide sequence of VGAM1480 precursor RNA is designated SEQ ID:1466, and is provided hereinbelow with reference to the sequence listing part. Nucleotide sequence SEQ ID:1466 is located at position 9535 relative to the genome of Brome Streak Mosaic Virus.

VGAM1480 precursor RNA folds onto itself, forming VGAM1480 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1480 folded precursor RNA into VGAM1480 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 86%) nucleotide sequence of VGAM1480 RNA is designated SEQ ID:4191, and is provided hereinbelow with reference to the sequence listing part.

VGAM1480 host target gene, herein designated VGAM HOST TARGET GENE, encodes a corresponding messenger RNA, VGAM1480 host target RNA, herein designated VGAM HOST TARGET RNA. VGAM1480 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1480 RNA, herein designated VGAM RNA, binds complementarily to one or more host target binding sites located in untranslated regions of VGAM1480 host target RNA, herein designated VGAM HOST TARGET RNA. This complementary binding is due to the fact that the nucleotide sequence of VGAM1480 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1480 RNA, herein designated VGAM RNA, may have a different number of host target binding sites in untranslated regions of a VGAM1480 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1480 RNA, herein designated VGAM RNA, to host target binding sites on VGAM1480 host target RNA, herein designated VGAM HOST TARGET RNA, such as BINDING SITE I, BINDING SITE II and BINDING SITE III, inhibits translation of VGAM1480 host target RNA into VGAM1480 host target protein, herein designated VGAM HOST TARGET PROTEIN. VGAM host target protein is therefore outlined by a broken line.

It is appreciated that VGAM1480 host target gene, herein designated VGAM HOST TARGET GENE, in fact represents a plurality of VGAM1480 host target genes. The mRNA of each one of this plurality of VGAM1480 host target genes comprises one or more host target binding sites, each having a nucleotide sequence which is at least partly complementary to VGAM1480 RNA, herein designated VGAM RNA, and which when bound by VGAM1480 RNA causes inhibition of translation of respective one or more VGAM1480 host target proteins.

It is further appreciated by one skilled in the art that the mode of translational inhibition illustrated by FIG. 1 with specific reference to translational inhibition exerted by VGAM1480 gene, herein designated VGAM GENE, on one or more VGAM1480 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1480 is inhibition of expression of host target genes, as part of a novel viral mechanism of attacking a host. Accordingly, utilities of VGAM1480 include diagnosis, prevention and treatment of viral infection by Brome Streak Mosaic Virus. Specific functions, and accordingly utilities, of VGAM1480 correlate with, and may be deduced from, the identity of the host target genes which VGAM1480 binds and inhibits, and the function of these host target genes, as elaborated hereinbelow.

Nucleotide sequences of the VGAM1480 precursor RNA, herein designated VGAM PRECURSOR RNA, and of the 'diced' VGAM1480 RNA, herein designated VGAM RNA, and a schematic representation of the secondary folding of VGAM1480 folded precursor RNA, herein designated VGAM FOLDED PRECURSOR RNA, of VGAM1480 are further described hereinbelow with reference to Table 1.

Nucleotide sequences of host target binding sites, such as BINDING SITE-I, BINDING SITE-II and BINDING SITE-III of FIG. 1, found on VGAM1480 host target RNA, and schematic representation of the complementarity of each of these host target binding sites to VGAM1480 RNA, herein designated VGAM RNA, are described hereinbelow with reference to Table 2.

As mentioned hereinabove with reference to FIG. 1, a function of VGAM1480 gene, herein designated VGAM is inhibition of expression of VGAM1480 target genes. It is appreciated that specific functions, and accordingly utilities, of VGAM1480 correlate with, and may be deduced from, the identity of the target genes which VGAM1480 binds and inhibits, and the function of these target genes, as elaborated hereinbelow.

Dual Specificity Phosphatase 4 (DUSP4, Accession NM_057158) is a VGAM1480 host target gene. DUSP4 BINDING SITE is HOST TARGET binding site found in the 5' untranslated region of mRNA encoded by DUSP4, corresponding to a HOST TARGET binding site such as BINDING SITE I, BINDING SITE II or BINDING SITE III. Table 2 illustrates the complementarity of the nucleotide sequences of DUSP4 BINDING SITE, designated SEQ ID:27666, to the nucleotide sequence of VGAM1480 RNA, herein designated VGAM RNA, also designated SEQ ID:4191.

A function of VGAM1480 is therefore inhibition of Dual Specificity Phosphatase 4 (DUSP4, Accession NM_057158), a gene which regulates mitogenic signal transduction. Accordingly, utilities of VGAM1480 include diagnosis, prevention and treatment of diseases and clinical conditions associated with DUSP4. The function of DUSP4 and its association with various diseases and clinical conditions, has been established by previous studies, as described hereinabove with reference to VGAM110. Neurexin 2 (NRXN2, Accession NM_138732) is another VGAM1480 host target gene. NRXN2 BINDING SITE1 through NRXN2 BINDING SITE3 are HOST TARGET binding sites found in untranslated regions of mRNA encoded by NRXN2, corresponding to HOST TARGET binding sites such as BINDING SITE I, BINDING SITE II or BINDING SITE III. Table 2 illustrates the complementarity of the nucleotide sequences of NRXN2 BINDING SITE1 through NRXN2 BINDING SITE3, designated SEQ ID:28982, SEQ ID:28988 and SEQ ID:17466 respectively, to the nucleotide sequence of VGAM1480 RNA, herein designated VGAM RNA, also designated SEQ ID:4191.

Another function of VGAM1480 is therefore inhibition of Neurexin 2 (NRXN2, Accession NM_138732), a gene which may be involved in cell recognition, cell adhesion, and may mediate intracellular signaling. Accordingly, utilities of VGAM1480 include diagnosis, prevention and treatment of diseases and clinical conditions associated with NRXN2. The function of NRXN2 and its association with various diseases and clinical conditions, has been established by previous studies, as described hereinabove with reference to VGAM178. POM (POM121 homolog, rat) and ZP3 Fusion (POMZP3, Accession NM_012230) is another VGAM1480 host target gene. POMZP3 BINDING SITE is HOST TARGET binding site found in the 5' untranslated region of mRNA encoded by POMZP3, corresponding to a HOST TARGET binding site such as BINDING SITE I, BINDING SITE II or BINDING SITE III. Table 2 illustrates the complementarity of the nucleotide sequences of POMZP3 BINDING SITE, designated SEQ ID:14528, to the nucleotide sequence of VGAM1480 RNA, herein designated VGAM RNA, also designated SEQ ID:4191.

Another function of VGAM1480 is therefore inhibition of POM (POM121 homolog, rat) and ZP3 Fusion (POMZP3, Accession NM_012230). Accordingly, utilities of VGAM1480 include diagnosis, prevention and treatment of diseases and clinical conditions associated with POMZP3. DKFZp434I099 (Accession NM_032269) is another VGAM1480 host target gene. DKFZp434I099 BINDING SITE is HOST TARGET binding site found in the 5' untranslated region of mRNA encoded by DKFZp434I099, corresponding to a HOST TARGET binding site such as BINDING SITE I, BINDING SITE II or BINDING SITE III. Table 2 illustrates the complementarity of the nucleotide sequences of DKFZp434I099 BINDING SITE, designated SEQ ID:26016, to the nucleotide sequence of VGAM1480 RNA, herein designated VGAM RNA, also designated SEQ ID:4191.

Another function of VGAM1480 is therefore inhibition of DKFZp434I099 (Accession NM_032269). Accordingly, utilities of VGAM1480 include diagnosis, prevention and treatment of diseases and clinical conditions associated with DKFZp434I099. KIAA0828 (Accession XM_088105) is another VGAM1480 host target gene. KIAA0828 BINDING SITE is HOST TARGET binding site found in the 3' untranslated region of mRNA encoded by KIAA0828, corresponding to a HOST TARGET binding site such as BINDING SITE I, BINDING SITE II or BINDING SITE III. Table 2 illustrates the complementarity of the nucleotide sequences of KIAA0828 BINDING SITE, designated SEQ ID:39511, to the nucleotide sequence of VGAM1480 RNA, herein designated VGAM RNA, also designated SEQ ID:4191.

Another function of VGAM1480 is therefore inhibition of KIAA0828 (Accession XM_088105). Accordingly, utilities of VGAM1480 include diagnosis, prevention and treatment of diseases and clinical conditions associated with KIAA0828. MGC2452 (Accession NM_032644) is another VGAM1480 host target gene. MGC2452 BINDING SITE is HOST TARGET binding site found in the 3' untranslated region of mRNA encoded by MGC2452, corresponding to a HOST TARGET binding site such as BINDING SITE I, BINDING SITE II or BINDING SITE III. Table 2 illustrates the complementarity of the nucleotide sequences of MGC2452 BINDING SITE, designated SEQ ID:26365, to the nucleotide sequence of VGAM1480 RNA, herein designated VGAM RNA, also designated SEQ ID:4191.

Another function of VGAM1480 is therefore inhibition of MGC2452 (Accession NM_032644). Accordingly, utilities of VGAM1480 include diagnosis, prevention and treatment of diseases and clinical conditions associated with MGC2452. MGC4655 (Accession NM_033309) is another VGAM1480 host target gene. MGC4655 BINDING SITE is HOST TARGET binding site found in the 5' untranslated region of mRNA encoded by MGC4655, corresponding to a HOST TARGET binding site such as BINDING SITE I, BINDING SITE II or BINDING SITE III. Table 2 illustrates the complementarity of the nucleotide sequences of MGC4655 BINDING SITE, designated SEQ ID:27147, to the nucleotide sequence of VGAM1480 RNA, herein designated VGAM RNA, also designated SEQ ID:4191.

Another function of VGAM1480 is therefore inhibition of MGC4655 (Accession NM_033309). Accordingly, utilities of VGAM1480 include diagnosis, prevention and treatment of diseases and clinical conditions associated with MGC4655. LOC145945 (Accession XM_096908) is another VGAM1480 host target gene. LOC145945 BINDING SITE is HOST TARGET binding site found in the 5' untranslated region of mRNA encoded by LOC145945, corresponding to a HOST TARGET binding site such as BINDING SITE I, BINDING SITE II or BINDING SITE III. Table 2 illustrates the complementarity of the nucleotide sequences of LOC145945 BINDING SITE, designated SEQ ID:40630, to the nucleotide sequence of VGAM1480 RNA, herein designated VGAM RNA, also designated SEQ ID:4191.

Another function of VGAM1480 is therefore inhibition of LOC145945 (Accession XM_096908). Accordingly, utilities of VGAM1480 include diagnosis, prevention and treatment of diseases and clinical conditions associated with LOC145945. LOC219513 (Accession XM_169166) is another VGAM1480 host target gene. LOC219513 BINDING SITE is HOST TARGET binding site found in the 3' untranslated region of mRNA encoded by LOC219513, corresponding to a HOST TARGET binding site such as BINDING SITE I, BINDING SITE II or BINDING SITE III. Table 2 illustrates the complementarity of the nucleotide sequences of LOC219513 BINDING SITE, designated SEQ ID:45290, to the nucleotide sequence of VGAM1480 RNA, herein designated VGAM RNA, also designated SEQ ID:4191.

Another function of VGAM1480 is therefore inhibition of LOC219513 (Accession XM_169166). Accordingly, utilities of VGAM1480 include diagnosis, prevention and treatment of diseases and clinical conditions associated with LOC219513. LOC220021 (Accession XM_167814) is another VGAM1480 host target gene. LOC220021 BINDING SITE is HOST TARGET binding site found in the 3' untranslated region of mRNA encoded by LOC220021, corresponding to a HOST TARGET binding site such as BINDING SITE I, BINDING SITE II or BINDING SITE III. Table 2 illustrates the complementarity of the nucleotide sequences of LOC220021 BINDING SITE, designated SEQ ID:44849, to the nucleotide sequence of VGAM1480 RNA, herein designated VGAM RNA, also designated SEQ ID:4191.

Another function of VGAM1480 is therefore inhibition of LOC220021 (Accession XM_167814). Accordingly, utilities of VGAM1480 include diagnosis, prevention and treatment of diseases and clinical conditions associated with LOC220021. LOC90918 (Accession XM_034863) is another VGAM1480 host target gene. LOC90918 BINDING SITE is HOST TARGET binding site found in the 5' untranslated region of mRNA encoded by LOC90918, corresponding to a HOST TARGET binding site such as BINDING SITE I, BINDING SITE II or BINDING SITE III. Table 2 illustrates the complementarity of the nucleotide sequences of LOC90918 BINDING SITE, designated SEQ ID:32176, to the nucleotide sequence of VGAM1480 RNA, herein designated VGAM RNA, also designated SEQ ID:4191.

Another function of VGAM1480 is therefore inhibition of LOC90918 (Accession XM_034863). Accordingly, utilities of VGAM1480 include diagnosis, prevention and treatment of diseases and clinical conditions associated with LOC90918. LOC92340 (Accession XM_044426) is another VGAM1480 host target gene. LOC92340 BINDING SITE is HOST TARGET binding site found in the 3' untranslated region of mRNA encoded by LOC92340, corresponding to a HOST TARGET binding site such as BINDING SITE I, BINDING SITE II or BINDING SITE III. Table 2 illustrates the complementarity of the nucleotide sequences of LOC92340 BINDING SITE, designated SEQ ID:34197, to the nucleotide sequence of VGAM1480 RNA, herein designated VGAM RNA, also designated SEQ ID:4191.

Another function of VGAM1480 is therefore inhibition of LOC92340 (Accession XM_044426). Accordingly, utilities of VGAM1480 include diagnosis, prevention and treatment of diseases and clinical conditions associated with LOC92340. LOC93166 (Accession XM_049619) is another VGAM1480 host target gene. LOC93166 BINDING SITE is HOST TARGET binding site found in the 5' untranslated region of mRNA encoded by LOC93166, corresponding to a HOST TARGET binding site such as BINDING SITE I, BINDING SITE II or BINDING SITE III. Table 2 illustrates the complementarity of the nucleotide sequences of LOC93166 BINDING SITE, designated SEQ ID:35461, to the nucleotide sequence of VGAM1480 RNA, herein designated VGAM RNA, also designated SEQ ID:4191.

Another function of VGAM1480 is therefore inhibition of LOC93166 (Accession XM_049619). Accordingly, utilities of VGAM1480 include diagnosis, prevention and treatment of diseases and clinical conditions associated with LOC93166. FIG. 1 further provides a conceptual description of a novel bioinformatically detected viral gene of the present invention, referred to here as Viral Genomic Address Messenger 1481 (VGAM1481) viral gene, which modulates expression of respective host target genes thereof, the function and utility of which host target genes is known in the art.

VGAM1481 is a novel bioinformatically detected regulatory, non protein coding, viral micro RNA (miRNA) gene. The method by which VGAM1481 was detected is described hereinabove with reference to FIGS. 1-8.

VGAM1481 gene, herein designated VGAM GENE, is a viral gene contained in the genome of Brome Streak Mosaic Virus. VGAM1481 host target gene, herein designated VGAM HOST TARGET GENE, is a human gene contained in the human genome.

VGAM1481 gene encodes a VGAM1481 precursor RNA, herein designated VGAM PRECURSOR RNA. Similar to other miRNA genes, and unlike most ordinary genes, VGAM1481 precursor RNA does not encode a protein. A nucleotide sequence identical or highly similar to the nucleotide sequence of VGAM1481 precursor RNA is designated SEQ ID:1467, and is provided hereinbelow with reference to the sequence listing part. Nucleotide sequence SEQ ID:1467 is located at position 953 relative to the genome of Brome Streak Mosaic Virus.

VGAM1481 precursor RNA folds onto itself, forming VGAM1481 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1481 folded precursor RNA into VGAM1481 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1481 RNA is designated SEQ ID:4192, and is provided hereinbelow with reference to the sequence listing part.

VGAM1481 host target gene, herein designated VGAM HOST TARGET GENE, encodes a corresponding messenger RNA, VGAM1481 host target RNA, herein designated VGAM HOST TARGET RNA. VGAM1481 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1481 RNA, herein designated VGAM RNA, binds complementarily to one or more host target binding sites located in untranslated regions of VGAM1481 host target RNA, herein designated VGAM HOST TARGET RNA. This complementary binding is due to the fact that the nucleotide sequence of VGAM1481 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1481 RNA, herein designated VGAM RNA, may have a different number of host target binding sites in untranslated regions of a VGAM1481 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1481 RNA, herein designated VGAM RNA, to host target binding sites on VGAM1481 host target RNA, herein designated VGAM HOST TARGET RNA, such as BINDING SITE I, BINDING SITE II and BINDING SITE III, inhibits translation of VGAM1481 host target RNA into VGAM1481 host target protein, herein designated VGAM HOST TARGET PROTEIN. VGAM host target protein is therefore outlined by a broken line.

It is appreciated that VGAM1481 host target gene, herein designated VGAM HOST TARGET GENE, in fact represents a plurality of VGAM1481 host target genes. The mRNA of each one of this plurality of VGAM1481 host target genes comprises one or more host target binding sites, each having a nucleotide sequence which is at least partly complementary to VGAM1481 RNA, herein designated VGAM RNA, and which when bound by VGAM1481 RNA causes inhibition of translation of respective one or more VGAM1481 host target proteins.

It is further appreciated by one skilled in the art that the mode of translational inhibition illustrated by FIG. 1 with specific reference to translational inhibition exerted by VGAM1481 gene, herein designated VGAM GENE, on one or more VGAM1481 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1481 is inhibition of expression of host target genes, as part of a novel viral mechanism of attacking a host. Accordingly, utilities of VGAM1481 include diagnosis, prevention and treatment of viral infection by Brome Streak Mosaic Virus. Specific functions, and accordingly utilities, of VGAM1481 correlate with, and may be deduced from, the identity of the host target genes which VGAM1481 binds and inhibits, and the function of these host target genes, as elaborated hereinbelow.

Nucleotide sequences of the VGAM1481 precursor RNA, herein designated VGAM PRECURSOR RNA, and of the 'diced' VGAM1481 RNA, herein designated VGAM RNA, and a schematic representation of the secondary folding of VGAM1481 folded precursor RNA, herein designated VGAM FOLDED PRECURSOR RNA, of VGAM1481 are further described hereinbelow with reference to Table 1.

Nucleotide sequences of host target binding sites, such as BINDING SITE-I, BINDING SITE-II and BINDING SITE-III of FIG. 1, found on VGAM1481 host target RNA, and schematic representation of the complementarity of each of these host target binding sites to VGAM1481 RNA, herein designated VGAM RNA, are described hereinbelow with reference to Table 2.

As mentioned hereinabove with reference to FIG. 1, a function of VGAM1481 gene, herein designated VGAM is inhibition of expression of VGAM1481 target genes. It is appreciated that specific functions, and accordingly utilities, of VGAM1481 correlate with, and may be deduced from, the identity of the target genes which VGAM1481 binds and inhibits, and the function of these target genes, as elaborated hereinbelow.

Melanoma Antigen, Family A, 10 (MAGEA10, Accession NM_021048) is a VGAM1481 host target gene. MAGEA10 BINDING SITE is HOST TARGET binding site found in the 5' untranslated region of mRNA encoded by MAGEA10, corresponding to a HOST TARGET binding site such as BINDING SITE I, BINDING SITE II or BINDING SITE III. Table 2 illustrates the complementarity of the nucleotide sequences of MAGEA10 BINDING SITE, designated SEQ ID:22033, to the nucleotide sequence of VGAM1481 RNA, herein designated VGAM RNA, also designated SEQ ID:4192.

A function of VGAM1481 is therefore inhibition of Melanoma Antigen, Family A, 10 (MAGEA10, Accession NM_021048), a gene which may play a role in embryonal development and tumor transformation or aspects of tumor progression. Accordingly, utilities of VGAM1481 include diagnosis, prevention and treatment of diseases and clinical conditions associated with MAGEA10. The function of MAGEA10 and its association with various diseases and clinical conditions, has been established by previous studies, as described hereinabove with reference to VGAM125. Phosphoribosyl Pyrophosphate Synthetase 2 (PRPS2, Accession NM_002765) is another VGAM1481 host target gene. PRPS2 BINDING SITE is HOST TARGET binding site found in the 3' untranslated region of mRNA encoded by PRPS2, corresponding to a HOST TARGET binding site such as BINDING SITE I, BINDING SITE II or BINDING SITE III. Table 2 illustrates the complementarity of the nucleotide sequences of PRPS2 BINDING SITE, designated SEQ ID:8654, to the nucleotide sequence of VGAM1481 RNA, herein designated VGAM RNA, also designated SEQ ID:4192.

Another function of VGAM1481 is therefore inhibition of Phosphoribosyl Pyrophosphate Synthetase 2 (PRPS2, Accession NM_002765), a gene which generates the PRPP needed for initiation of purine biosynthesis. Accordingly, utilities of VGAM1481 include diagnosis, prevention and treatment of diseases and clinical conditions associated with PRPS2. The function of PRPS2 and its association with various diseases and clinical conditions, has been established by previous studies, as described hereinabove with reference to VGAM828. Dickkopf Homolog 2 (Xenopus laevis) (DKK2, Accession NM_014421) is another VGAM1481 host target gene. DKK2 BINDING SITE is HOST TARGET binding site found in the 3' untranslated region of mRNA encoded by DKK2, corresponding to a HOST TARGET binding site such as BINDING SITE I, BINDING SITE II or BINDING SITE III. Table 2 illustrates the complementarity of the nucleotide sequences of DKK2 BINDING SITE, designated SEQ ID:15774, to the nucleotide sequence of VGAM1481 RNA, herein designated VGAM RNA, also designated SEQ ID:4192.

Another function of VGAM1481 is therefore inhibition of Dickkopf Homolog 2 (Xenopus laevis) (DKK2, Accession NM_014421). Accordingly, utilities of VGAM1481 include diagnosis, prevention and treatment of diseases and clinical conditions associated with DKK2. FLJ12838 (Accession NM_024641) is another VGAM1481 host target gene. FLJ12838 BINDING SITE is HOST TARGET binding site found in the 5' untranslated region of mRNA encoded by FLJ12838, corresponding to a HOST TARGET binding site such as BINDING SITE I, BINDING SITE II or BINDING SITE III. Table 2 illustrates the complementarity of the nucleotide sequences of FLJ12838 BINDING SITE, designated SEQ ID:23925, to the nucleotide sequence of VGAM1481 RNA, herein designated VGAM RNA, also designated SEQ ID:4192.

Another function of VGAM1481 is therefore inhibition of FLJ12838 (Accession NM_024641). Accordingly, utilities of VGAM1481 include diagnosis, prevention and treatment of diseases and clinical conditions associated with FLJ12838. KIAA0781 (Accession XM_041314) is another VGAM1481 host target gene. KIAA0781 BINDING SITE is HOST TARGET binding site found in the 3' untranslated region of mRNA encoded by KIAA0781, corresponding to a HOST TARGET binding site such as BINDING SITE I, BINDING SITE II or BINDING SITE III. Table 2 illustrates the complementarity of the nucleotide sequences of KIAA0781 BINDING SITE, designated SEQ ID:33498, to the nucleotide sequence of VGAM1481 RNA, herein designated VGAM RNA, also designated SEQ ID:4192.

Another function of VGAM1481 is therefore inhibition of KIAA0781 (Accession XM_041314). Accordingly, utilities of VGAM1481 include diagnosis, prevention and treatment of diseases and clinical conditions associated with KIAA0781. SEC8 (Accession NM_021807) is another VGAM1481 host target gene. SEC8 BINDING SITE is HOST TARGET binding site found in the 3' untranslated region of mRNA encoded by SEC8, corresponding to a HOST TARGET binding site such as BINDING SITE I, BINDING SITE II or BINDING SITE III. Table 2 illustrates the complementarity of the nucleotide sequences of SEC8 BINDING SITE, designated SEQ ID:22358, to the nucleotide sequence of VGAM1481 RNA, herein designated VGAM RNA, also designated SEQ ID:4192.

Another function of VGAM1481 is therefore inhibition of SEC8 (Accession NM_021807). Accordingly, utilities of VGAM1481 include diagnosis, prevention and treatment of diseases and clinical conditions associated with SEC8. SOX30 (Accession NM_007017) is another VGAM1481 host target gene. SOX30 BINDING SITE is HOST TARGET binding site found in the 3' untranslated region of mRNA encoded by SOX30, corresponding to a HOST TARGET binding site such as BINDING SITE I, BINDING SITE II or BINDING SITE III. Table 2 illustrates the complementarity of the nucleotide sequences of SOX30 BINDING SITE, designated SEQ ID:13873, to the nucleotide sequence of VGAM1481 RNA, herein designated VGAM RNA, also designated SEQ ID:4192.

Another function of VGAM1481 is therefore inhibition of SOX30 (Accession NM_007017). Accordingly, utilities of VGAM1481 include diagnosis, prevention and treatment of diseases and clinical conditions associated with SOX30. LOC144455 (Accession XM_084871) is another VGAM1481 host target gene. LOC144455 BINDING SITE is HOST TARGET binding site found in the 3' untranslated region of mRNA encoded by LOC144455, corresponding to a HOST TARGET binding site such as BINDING SITE I, BINDING SITE II or BINDING SITE III. Table 2 illustrates the complementarity of the nucleotide sequences of LOC144455 BINDING SITE, designated SEQ ID:37750, to the nucleotide sequence of VGAM1481 RNA, herein designated VGAM RNA, also designated SEQ ID:4192.

Another function of VGAM1481 is therefore inhibition of LOC144455 (Accession XM_084871). Accordingly, utilities of VGAM1481 include diagnosis, prevention and treatment of diseases and clinical conditions associated with LOC144455. LOC145644 (Accession XM_035608) is another VGAM1481 host target gene. LOC145644 BINDING SITE is HOST TARGET binding site found in the 5' untranslated region of mRNA encoded by LOC145644, corresponding to a HOST TARGET binding site such as BINDING SITE I, BINDING SITE II or BINDING SITE III. Table 2 illustrates the complementarity of the nucleotide sequences of LOC145644 BINDING SITE, designated SEQ ID:32290, to the nucleotide sequence of VGAM1481 RNA, herein designated VGAM RNA, also designated SEQ ID:4192.

Another function of VGAM1481 is therefore inhibition of LOC145644 (Accession XM_035608). Accordingly, utilities of VGAM1481 include diagnosis, prevention and treatment of diseases and clinical conditions associated with LOC145644. LOC200953 (Accession XM_117302) is another VGAM1481 host target gene. LOC200953 BINDING SITE is HOST TARGET binding site found in the 5' untranslated region of mRNA encoded by LOC200953, corresponding to a HOST TARGET binding site such as BINDING SITE I, BINDING SITE II or BINDING SITE III. Table 2 illustrates the complementarity of the nucleotide sequences of LOC200953 BINDING SITE, designated SEQ ID:43367, to the nucleotide sequence of VGAM1481 RNA, herein designated VGAM RNA, also designated SEQ ID:4192.

Another function of VGAM1481 is therefore inhibition of LOC200953 (Accession XM_117302). Accordingly, utilities of VGAM1481 include diagnosis, prevention and treatment of diseases and clinical conditions associated with LOC200953. FIG. 1 further provides a conceptual description of a novel bioinformatically detected viral gene of the present invention, referred to here as Viral Genomic Address Messenger 1482 (VGAM1482) viral gene, which modulates expression of respective host target genes thereof, the function and utility of which host target genes is known in the art.

VGAM1482 is a novel bioinformatically detected regulatory, non protein coding, viral micro RNA (miRNA) gene. The method by which VGAM1482 was detected is described hereinabove with reference to FIGS. 1-8.

VGAM1482 gene, herein designated VGAM GENE, is a viral gene contained in the genome of Brome Streak Mosaic Virus. VGAM1482 host target gene, herein designated VGAM HOST TARGET GENE, is a human gene contained in the human genome.

VGAM1482 gene encodes a VGAM1482 precursor RNA, herein designated VGAM PRECURSOR RNA. Similar to other miRNA genes, and unlike most ordinary genes, VGAM1482 precursor RNA does not encode a protein. A nucleotide sequence identical or highly similar to the nucleotide sequence of VGAM1482 precursor RNA is designated SEQ ID:1468, and is provided hereinbelow with reference to the sequence listing part. Nucleotide sequence SEQ ID:1468 is located at position 40 relative to the genome of Brome Streak Mosaic Virus.

VGAM1482 precursor RNA folds onto itself, forming VGAM1482 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1482 folded precursor RNA into VGAM1482 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1482 RNA is designated SEQ ID:4193, and is provided hereinbelow with reference to the sequence listing part.

VGAM1482 host target gene, herein designated VGAM HOST TARGET GENE, encodes a corresponding messenger RNA, VGAM1482 host target RNA, herein designated VGAM HOST TARGET RNA. VGAM1482 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1482 RNA, herein designated VGAM RNA, binds complementarily to one or more host target binding sites located in untranslated regions of VGAM1482 host target RNA, herein designated VGAM HOST TARGET RNA. This complementary binding is due to the fact that the nucleotide sequence of VGAM1482 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1482 RNA, herein designated VGAM RNA, may have a different number of host target binding sites in untranslated regions of a VGAM1482 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1482 RNA, herein designated VGAM RNA, to host target binding sites on VGAM1482 host target RNA, herein designated VGAM HOST TARGET RNA, such as BINDING SITE I, BINDING SITE II and BINDING SITE III, inhibits translation of VGAM1482 host target RNA into VGAM1482 host target protein, herein designated VGAM HOST TARGET PROTEIN. VGAM host target protein is therefore outlined by a broken line.

It is appreciated that VGAM1482 host target gene, herein designated VGAM HOST TARGET GENE, in fact represents a plurality of VGAM1482 host target genes. The mRNA of each one of this plurality of VGAM1482 host target genes comprises one or more host target binding sites, each having a nucleotide sequence which is at least partly complementary to VGAM1482 RNA, herein designated VGAM RNA, and which when bound by VGAM1482 RNA causes inhibition of translation of respective one or more VGAM1482 host target proteins.

It is further appreciated by one skilled in the art that the mode of translational inhibition illustrated by FIG. 1 with specific reference to translational inhibition exerted by VGAM1482 gene, herein designated VGAM GENE, on one or more VGAM1482 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1482 is inhibition of expression of host target genes, as part of a novel viral mechanism of attacking a host. Accordingly, utilities of VGAM1482 include diagnosis, prevention and treatment of viral infection by Brome Streak Mosaic Virus. Specific functions, and accordingly utilities, of VGAM1482 correlate with, and may be deduced from, the identity of the host target genes which VGAM1482 binds and inhibits, and the function of these host target genes, as elaborated hereinbelow.

Nucleotide sequences of the VGAM1482 precursor RNA, herein designated VGAM PRECURSOR RNA, and of the 'diced' VGAM1482 RNA, herein designated VGAM RNA, and a schematic representation of the secondary folding of VGAM1482 folded precursor RNA, herein designated VGAM FOLDED PRECURSOR RNA, of VGAM1482 are further described hereinbelow with reference to Table 1.

Nucleotide sequences of host target binding sites, such as BINDING SITE-I, BINDING SITE-II and BINDING SITE-III of FIG. 1, found on VGAM1482 host target RNA, and schematic representation of the complementarity of each of these host target binding sites to VGAM1482 RNA, herein designated VGAM RNA, are described hereinbelow with reference to Table 2.

As mentioned hereinabove with reference to FIG. 1, a function of VGAM1482 gene, herein designated VGAM is inhibition of expression of VGAM1482 target genes. It is appreciated that specific functions, and accordingly utilities, of VGAM1482 correlate with, and may be deduced from, the identity of the target genes which VGAM1482 binds and inhibits, and the function of these target genes, as elaborated hereinbelow.

Centaurin, Gamma 1 (CENTG1, Accession NM_014770) is a VGAM1482 host target gene. CENTG1 BINDING SITE is HOST TARGET binding site found in the 3' untranslated region of mRNA encoded by CENTG1, corresponding to a HOST TARGET binding site such as BINDING SITE I, BINDING SITE II or BINDING SITE III. Table 2 illustrates the complementarity of the nucleotide sequences of CENTG1 BINDING SITE, designated SEQ ID:16565, to the nucleotide sequence of VGAM1482 RNA, herein designated VGAM RNA, also designated SEQ ID:4193.

A function of VGAM1482 is therefore inhibition of Centaurin, Gamma 1 (CENTG1, Accession NM_014770). Accordingly, utilities of VGAM1482 include diagnosis, prevention and treatment of diseases and clinical conditions associated with CENTG1. FLJ11726 (Accession NM_024971) is another VGAM1482 host target gene. FLJ11726 BINDING SITE is HOST TARGET binding site found in the 3' untranslated region of mRNA encoded by FLJ11726, corresponding to a HOST TARGET binding site such as BINDING SITE I, BINDING SITE II or BINDING SITE III. Table 2 illustrates the complementarity of the nucleotide sequences of FLJ11726 BINDING SITE, designated SEQ ID:24524, to the nucleotide sequence of VGAM1482 RNA, herein designated VGAM RNA, also designated SEQ ID:4193.

Another function of VGAM1482 is therefore inhibition of FLJ11726 (Accession NM_024971). Accordingly, utilities of VGAM1482 include diagnosis, prevention and treatment of diseases and clinical conditions associated with FLJ11726. LOC219731 (Accession XM_167596) is another VGAM1482 host target gene. LOC219731 BINDING SITE is HOST TARGET binding site found in the 5' untranslated region of mRNA encoded by LOC219731, corresponding to a HOST TARGET binding site such as BINDING SITE I, BINDING SITE II or BINDING SITE III. Table 2 illustrates the complementarity of the nucleotide sequences of LOC219731 BINDING SITE, designated SEQ ID:44716, to the nucleotide sequence of VGAM1482 RNA, herein designated VGAM RNA, also designated SEQ ID:4193.

Another function of VGAM1482 is therefore inhibition of LOC219731 (Accession XM_167596). Accordingly, utilities of VGAM1482 include diagnosis, prevention and treatment of diseases and clinical conditions associated with LOC219731. FIG. 1 further provides a conceptual description of a novel bioinformatically detected viral gene of the present invention, referred to here as Viral Genomic Address Messenger 1483 (VGAM1483) viral gene, which modulates expression of respective host target genes thereof, the function and utility of which host target genes is known in the art.

VGAM1483 is a novel bioinformatically detected regulatory, non protein coding, viral micro RNA (miRNA) gene. The method by which VGAM1483 was detected is described hereinabove with reference to FIGS. 1-8.

VGAM1483 gene, herein designated VGAM GENE, is a viral gene contained in the genome of Brome Streak Mosaic Virus. VGAM1483 host target gene, herein designated VGAM HOST TARGET GENE, is a human gene contained in the human genome.

VGAM1483 gene encodes a VGAM1483 precursor RNA, herein designated VGAM PRECURSOR RNA. Similar to other miRNA genes, and unlike most ordinary genes, VGAM1483 precursor RNA does not encode a protein. A nucleotide sequence identical or highly similar to the nucleotide sequence of VGAM1483 precursor RNA is designated SEQ ID:1469, and is provided hereinbelow with reference to the sequence listing part. Nucleotide sequence SEQ ID:1469 is located at position 7435 relative to the genome of Brome Streak Mosaic Virus.

VGAM1483 precursor RNA folds onto itself, forming VGAM1483 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1483 folded precursor RNA into VGAM1483 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1483 RNA is designated SEQ ID:4194, and is provided hereinbelow with reference to the sequence listing part.

VGAM1483 host target gene, herein designated VGAM HOST TARGET GENE, encodes a corresponding messenger RNA, VGAM1483 host target RNA, herein designated VGAM HOST TARGET RNA. VGAM1483 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1483 RNA, herein designated VGAM RNA, binds complementarily to one or more host target binding sites located in untranslated regions of VGAM1483 host target RNA, herein designated VGAM HOST TARGET RNA. This complementary binding is due to the fact that the nucleotide sequence of VGAM1483 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1483 RNA, herein designated VGAM RNA, may have a different number of host target binding sites in untranslated regions of a VGAM1483 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1483 RNA, herein designated VGAM RNA, to host target binding sites on VGAM1483 host target RNA, herein designated VGAM HOST TARGET RNA, such as BINDING SITE I, BINDING SITE II and BINDING SITE III, inhibits translation of VGAM1483 host target RNA into VGAM1483 host target protein, herein designated VGAM HOST TARGET PROTEIN. VGAM host target protein is therefore outlined by a broken line.

It is appreciated that VGAM1483 host target gene, herein designated VGAM HOST TARGET GENE, in fact represents a plurality of VGAM1483 host target genes. The mRNA of each one of this plurality of VGAM1483 host target genes comprises one or more host target binding sites, each having a nucleotide sequence which is at least partly complementary to VGAM1483 RNA, herein designated VGAM RNA, and which when bound by VGAM1483 RNA causes inhibition of translation of respective one or more VGAM1483 host target proteins.

It is further appreciated by one skilled in the art that the mode of translational inhibition illustrated by FIG. 1 with specific reference to translational inhibition exerted by VGAM1483 gene, herein designated VGAM GENE, on one or more VGAM1483 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1483 is inhibition of expression of host target genes, as part of a novel viral mechanism of attacking a host. Accordingly, utilities of VGAM1483 include diagnosis, prevention and treatment of viral infection by Brome Streak Mosaic Virus. Specific functions, and accordingly utilities, of VGAM1483 correlate with, and may be deduced from, the identity of the host target genes which VGAM1483 binds and inhibits, and the function of these host target genes, as elaborated hereinbelow.

Nucleotide sequences of the VGAM1483 precursor RNA, herein designated VGAM PRECURSOR RNA, and of the 'diced' VGAM1483 RNA, herein designated VGAM RNA, and a schematic representation of the secondary folding of VGAM1483 folded precursor RNA, herein designated VGAM FOLDED PRECURSOR RNA, of VGAM1483 are further described hereinbelow with reference to Table 1.

Nucleotide sequences of host target binding sites, such as BINDING SITE-I, BINDING SITE-II and BINDING SITE-III of FIG. 1, found on VGAM1483 host target RNA, and schematic representation of the complementarity of each of these host target binding sites to VGAM1483 RNA, herein designated VGAM RNA, are described hereinbelow with reference to Table 2.

As mentioned hereinabove with reference to FIG. 1, a function of VGAM1483 gene, herein designated VGAM is inhibition of expression of VGAM1483 target genes. It is appreciated that specific functions, and accordingly utilities, of VGAM1483 correlate with, and may be deduced from, the identity of the target genes which VGAM1483 binds and inhibits, and the function of these target genes, as elaborated hereinbelow.

Tumor Necrosis Factor (ligand) Superfamily, Member 15 (TNFSF15, Accession NM_005118) is a VGAM1483 host target gene. TNFSF15 BINDING SITE is HOST TARGET binding site found in the 3' untranslated region of mRNA encoded by TNFSF15, corresponding to a HOST TARGET binding site such as BINDING SITE I, BINDING SITE II or BINDING SITE III. Table 2 illustrates the complementarity of the nucleotide sequences of TNFSF15 BINDING SITE, designated SEQ ID:11598, to the nucleotide sequence of VGAM1483 RNA, herein designated VGAM RNA, also designated SEQ ID:4194.

A function of VGAM1483 is therefore inhibition of Tumor Necrosis Factor (ligand) Superfamily, Member 15 (TNFSF15, Accession NM_005118), a gene which acts as an autocrine factor to induce apoptosis in endothelial cells. Accordingly, utilities of VGAM1483 include diagnosis, prevention and treatment of diseases and clinical conditions associated with TNFSF15. The function of TNFSF15 and its association with various diseases and clinical conditions, has been established by previous studies, as described hereinabove with reference to VGAM350. Von Hippel-Lindau Syndrome (VHL, Accession NM_000551) is another VGAM1483 host target gene. VHL BINDING SITE is HOST TARGET binding site found in the 3' untranslated region of mRNA encoded by VHL, corresponding to a HOST TARGET binding site such as BINDING SITE I, BINDING SITE II or BINDING SITE III. Table 2 illustrates the complementarity of the nucleotide sequences of VHL BINDING SITE, designated SEQ ID:6156, to the nucleotide sequence of VGAM1483 RNA, herein designated VGAM RNA, also designated SEQ ID:4194.

Another function of VGAM1483 is therefore inhibition of Von Hippel-Lindau Syndrome (VHL, Accession NM_000551), a gene which may control rna stability through the selective degradation of rna-bound proteins. Accordingly, utilities of VGAM1483 include diagnosis, prevention and treatment of diseases and clinical conditions associated with VHL. The function of VHL and its association with various diseases and clinical conditions, has been established by previous studies, as described hereinabove with reference to VGAM197. FLJ00060 (Accession XM_028154) is another VGAM1483 host target gene. FLJ00060 BINDING SITE is HOST TARGET binding site found in the 3' untranslated region of mRNA encoded by FLJ00060, corresponding to a HOST TARGET binding site such as BINDING SITE I, BINDING SITE II or BINDING SITE III. Table 2 illustrates the complementarity of the nucleotide sequences of FLJ00060 BINDING SITE, designated SEQ ID:30625, to the nucleotide sequence of VGAM1483 RNA, herein designated VGAM RNA, also designated SEQ ID:4194.

Another function of VGAM1483 is therefore inhibition of FLJ00060 (Accession XM_028154). Accordingly, utilities of VGAM1483 include diagnosis, prevention and treatment of diseases and clinical conditions associated with FLJ00060. KIAA1678 (Accession XM_051221) is another VGAM1483 host target gene. KIAA1678 BINDING SITE is HOST TARGET binding site found in the 3' untranslated region of mRNA encoded by KIAA1678, corresponding to a HOST TARGET binding site such as BINDING SITE I, BINDING SITE II or BINDING SITE III. Table 2 illustrates the complementarity of the nucleotide sequences of KIAA1678 BINDING SITE, designated SEQ ID:35786, to the nucleotide sequence of VGAM1483 RNA, herein designated VGAM RNA, also designated SEQ ID:4194.

Another function of VGAM1483 is therefore inhibition of KIAA1678 (Accession XM_051221). Accordingly, utilities of VGAM1483 include diagnosis, prevention and treatment of diseases and clinical conditions associated with KIAA1678. LOC148508 (Accession XM_097478) is another VGAM1483 host target gene. LOC148508 BINDING SITE is HOST TARGET binding site found in the 3' untranslated region of mRNA encoded by LOC148508, corresponding to a HOST TARGET binding site such as BINDING SITE I, BINDING SITE II or BINDING SITE III. Table 2 illustrates the complementarity of the nucleotide sequences of LOC148508 BINDING SITE, designated SEQ ID:40884, to the nucleotide sequence of VGAM1483 RNA, herein designated VGAM RNA, also designated SEQ ID:4194.

Another function of VGAM1483 is therefore inhibition of LOC148508 (Accession XM_097478). Accordingly, utilities of VGAM1483 include diagnosis, prevention and treatment of diseases and clinical conditions associated with LOC148508. LOC222681 (Accession XM_167116) is another VGAM1483 host target gene. LOC222681 BINDING SITE1 through LOC222681 BINDING SITE6 are HOST TARGET binding sites found in untranslated regions of mRNA encoded by LOC222681, corresponding to HOST TARGET binding sites such as BINDING SITE I, BINDING SITE II or BINDING SITE III. Table 2 illustrates the complementarity of the nucleotide sequences of LOC222681 BINDING SITE1 through LOC222681 BINDING SITE6, designated SEQ ID:44608, SEQ ID:44609, SEQ ID:44610, SEQ ID:44611, SEQ ID:44612 and SEQ ID:44613 respectively, to the nucleotide sequence of VGAM1483 RNA, herein designated VGAM RNA, also designated SEQ ID:4194.

Another function of VGAM1483 is therefore inhibition of LOC222681 (Accession XM_167116). Accordingly, utilities of VGAM1483 include diagnosis, prevention and treatment of diseases and clinical conditions associated with LOC222681. LOC257507 (Accession XM_175204) is another VGAM1483 host target gene. LOC257507 BINDING SITE1 through LOC257507 BINDING SITE6 are HOST TARGET binding sites found in untranslated regions of mRNA encoded by LOC257507, corresponding to HOST TARGET binding sites such as BINDING SITE I, BINDING SITE II or BINDING SITE III. Table 2 illustrates the complementarity of the nucleotide sequences of LOC257507 BINDING SITE1 through LOC257507 BINDING SITE6, designated SEQ ID:46675, SEQ ID:46676, SEQ ID:46677, SEQ ID:46678, SEQ ID:46679 and SEQ ID:46730 respectively, to the nucleotide sequence of VGAM1483 RNA, herein designated VGAM RNA, also designated SEQ ID:4194.

Another function of VGAM1483 is therefore inhibition of LOC257507 (Accession XM_175204). Accordingly, utilities of VGAM1483 include diagnosis, prevention and treatment of diseases and clinical conditions associated with LOC257507. LOC257625 (Accession XM_175267) is another VGAM1483 host target gene. LOC257625 BINDING SITE1 through LOC257625 BINDING SITE6 are HOST TARGET binding sites found in untranslated regions of mRNA encoded by LOC257625, corresponding to HOST TARGET binding sites such as BINDING SITE I, BINDING SITE II or BINDING SITE III. Table 2 illustrates the complementarity of the nucleotide sequences of LOC257625 BINDING SITE1 through LOC257625 BINDING SITE6, designated SEQ ID:46732, SEQ ID:46733, SEQ ID:46734, SEQ ID:46735, SEQ ID:8980 and SEQ ID:21253 respectively, to the nucleotide sequence of VGAM1483 RNA, herein designated VGAM RNA, also designated SEQ ID:4194.

Another function of VGAM1483 is therefore inhibition of LOC257625 (Accession XM_175267). Accordingly, utilities of VGAM1483 include diagnosis, prevention and treatment of diseases and clinical conditions associated with LOC257625. DiGeorge Syndrome Critical Region Gene 2 (DGCR2, Accession NM_005137) is another VGAM1485 host target gene. DGCR2 BINDING SITE is HOST TARGET binding site found in the 3' untranslated region of mRNA encoded by DGCR2, corresponding to a HOST TARGET binding site such as BINDING SITE I, BINDING SITE II or BINDING SITE III. Table 2 illustrates the complementarity of the nucleotide sequences of DGCR2 BINDING SITE, designated SEQ ID:11611, to the nucleotide sequence of VGAM1485 RNA, herein designated VGAM RNA, also designated SEQ ID:4196.

Another function of VGAM1485 is therefore inhibition of DiGeorge Syndrome Critical Region Gene 2 (DGCR2, Accession NM_005137), a gene which could intervene in cell-cell or cell-matrix interactions. Accordingly, utilities of VGAM1485 include diagnosis, prevention and treatment of diseases and clinical conditions associated with DGCR2. The function of DGCR2 has been established by previous studies. The DiGeorge syndrome (DGS; 188400) and velocardiofacial syndrome (VCFS; 192430) may present many clinical problems, including cardiac defects, hypoparathyroidism, T-cell immunodeficiency, and facial dysmorphism. They are frequently associated with deletions within 22q11.2 (accounting in part for the designation CATCH22), but a number of cases have no detectable molecular defect of this region. Daw et al. (1996) stated that a number of single case reports with deletions of 10p suggested genetic heterogeneity of DGS. They compared the regions of hemizygosity in 4 patients with terminal deletions of 10p (1 patient with hypoparathyroidism and 3 with DGS) and 1 patient with VCFS and a large interstitial deletion. Fluorescence in situ hybridization (FISH) analysis demonstrated that these patients had overlapping deletions at the 10p13/10p14 boundary. A YAC contig spanning the shortest region of deletion overlap (SRO) was assembled and allowed the size of the SRO to be approximated to 2 Mb. As with deletions of 22q11, phenotypes varied considerably between affected patients. Daw et al. (1996) concluded that the results strongly support the hypothesis that haploinsufficiency of a gene or genes within 10p (DGS2 locus) can cause the DGS/VCFS spectrum of malformations. Lichtner et al. (2000) reported clinical and molecular deletion analysis of a patient described by Hasegawa et al. (1997) and a new case, both with the HDR phenotype: hypoparathyroidism, deafness, and renal dysplasia (OMIM Ref. No. 146255). They were found to have partial monosomy for 10p due to terminal deletions with breakpoints between D10S585 and D10S1720. By comparison with data previously published on patients with DiGeorge/velocardiofacial syndrome associated with 10p monosomy, Lichtner et al. (2000) concluded that this is a contiguous gene syndrome. Hemizygosity for a proximal region can cause cardiac defects and T cell deficiency; hemizygosity for a more distal region can cause hypoparathyroidism, sensorineural deafness, and renal dysplasia.

Full details of the abovementioned studies are described in the following publications, the disclosure of which are hereby incorporated by reference:

Daw, S. C. M.; Taylor, C.; Kraman, M.; Call, K.; Mao, J.; Schuffenhauer, S.; Meitinger, T.; Lipson, T.; Goodship, J.; Scambler, P.: A common region of 10p deleted in DiGeorge and velocardiofacial syndromes. Nature Genet. 13:458-461, 1996; and Lichtner, P.; Konig, R.; Hasegawa, T.; Van Esch, H.; Meitinger, T.; Schuffenhauer, S.: An HDR (hypoparathyroidism, deafness, renal dysplasia) syndrome locus maps distal to the DiGeorg.

Further studies establishing the function and utilities of DGCR2 are found in John Hopkins OMIM database record ID 601362, and in sited publications numbered 9515-9516, 481 and 9517 listed in the bibliography section hereinbelow, which are also hereby incorporated by reference. Glutaminase (GLS, Accession NM_014905) is another VGAM1485 host target gene. GLS BINDING SITE is HOST TARGET binding site found in the 3' untranslated region of mRNA encoded by GLS, corresponding to a HOST TARGET binding site such as BINDING SITE I, BINDING SITE II or BINDING SITE III. Table 2 illustrates the complementarity of the nucleotide sequences of GLS BINDING SITE, designated SEQ ID:17107, to the nucleotide sequence of VGAM1485 RNA, herein designated VGAM RNA, also designated SEQ ID:4196.

Another function of VGAM1485 is therefore inhibition of Glutaminase (GLS, Accession NM_014905). Accordingly, utilities of VGAM1485 include diagnosis, prevention and treatment of diseases and clinical conditions associated with GLS. Indolethylamine N-methyltransferase (INMT, Accession NM_006774) is another VGAM1485 host target gene. INMT BINDING SITE is HOST TARGET binding site found in the 3' untranslated region of mRNA encoded by INMT, corresponding to a HOST TARGET binding site such as BINDING SITE I, BINDING SITE II or BINDING SITE III. Table 2 illustrates the complementarity of the nucleotide sequences of INMT BINDING SITE, designated SEQ ID:13647, to the nucleotide sequence of VGAM1485 RNA, herein designated VGAM RNA, also designated SEQ ID:4196.

Another function of VGAM1485 is therefore inhibition of Indolethylamine N-methyltransferase (INMT, Accession NM_006774). Accordingly, utilities of VGAM1485 include diagnosis, prevention and treatment of diseases and clinical conditions associated with INMT. Protein Phosphatase 1, Regulatory (inhibitor) Subunit 12B (PPP1R12B, Accession NM_032104) is another VGAM1485 host target gene. PPP1R12B BINDING SITE is HOST TARGET binding site found in the 3' untranslated region of mRNA encoded by PPP1R12B, corresponding to a HOST TARGET binding site such as BINDING SITE I, BINDING SITE II or BINDING SITE III. Table 2 illustrates the complementarity of the nucleotide sequences of PPP1R12B BINDING SITE, designated SEQ ID:25795, to the nucleotide sequence of VGAM1485 RNA, herein designated VGAM RNA, also designated SEQ ID:4196.

Another function of VGAM1485 is therefore inhibition of Protein Phosphatase 1, Regulatory (inhibitor) Subunit 12B (PPP1R12B, Accession NM_032104). Accordingly, utilities of VGAM1485 include diagnosis, prevention and treatment of diseases and clinical conditions associated with PPP1R12B. Signal Transducing Adaptor Molecule (SH3 domain and ITAM motif) 1 (STAM, Accession NM_003473) is another VGAM1485 host target gene. STAM BINDING SITE is HOST TARGET binding site found in the 3' untranslated region of mRNA encoded by STAM, corresponding to a HOST TARGET binding site such as BINDING SITE I, BINDING SITE II or BINDING SITE III. Table 2 illustrates the complementarity of the nucleotide sequences of STAM BINDING SITE, designated SEQ ID:9540, to the nucleotide sequence of VGAM1485 RNA, herein designated VGAM RNA, also designated SEQ ID:4196.

Another function of VGAM1485 is therefore inhibition of Signal Transducing Adaptor Molecule (SH3 domain and ITAM motif) 1 (STAM, Accession NM_003473), a gene which is as an adaptor molecule involved in the downstream signaling of cytokine receptors. Accordingly, utilities of VGAM1485 include diagnosis, prevention and treatment of diseases and clinical conditions associated with STAM. The function of STAM and its association with various diseases and clinical conditions, has been established by previous studies, as described hereinabove with reference to VGAM927. WTAP (Accession NM_004906) is another VGAM1485 host target gene. WTAP BINDING SITE is HOST TARGET binding site found in the 3' untranslated region of mRNA encoded by WTAP, corresponding to a HOST TARGET binding site such as BINDING SITE I, BINDING SITE II or BINDING SITE III. Table 2 illustrates the complementarity of the nucleotide sequences of WTAP BINDING SITE, designated SEQ ID:11343, to the nucleotide sequence of VGAM1485 RNA, herein designated VGAM RNA, also designated SEQ ID:4196.

Another function of VGAM1485 is therefore inhibition of WTAP (Accession NM_004906), a gene which plays a role in both transcriptional and posttranscriptional regulation of certain cellular genes. Accordingly, utilities of VGAM1485 include diagnosis, prevention and treatment of diseases and clinical conditions associated with WTAP. The function of WTAP and its association with various diseases and clinical conditions, has been established by previous studies, as described hereinabove with reference to VGAM874. KIAA0121 (Accession XM_052386) is another VGAM1485 host target gene. KIAA0121 BINDING SITE is HOST TARGET binding site found in the 3' untranslated region of mRNA encoded by KIAA0121, corresponding to a HOST TARGET binding site such as BINDING SITE I, BINDING SITE II or BINDING SITE III. Table 2 illustrates the complementarity of the nucleotide sequences of KIAA0121 BINDING SITE, designated SEQ ID:35966, to the nucleotide sequence of VGAM1485 RNA, herein designated VGAM RNA, also designated SEQ ID:4196.

Another function of VGAM1485 is therefore inhibition of KIAA0121 (Accession XM_052386). Accordingly, utilities of VGAM1485 include diagnosis, prevention and treatment of diseases and clinical conditions associated with KIAA0121. KIAA0546 (Accession XM_049055) is another VGAM1485 host target gene. KIAA0546 BINDING SITE is HOST TARGET binding site found in the 3' untranslated region of mRNA encoded by KIAA0546, corresponding to a HOST TARGET binding site such as BINDING SITE I, BINDING SITE II or BINDING SITE III. Table 2 illustrates the complementarity of the nucleotide sequences of KIAA0546 BINDING SITE, designated SEQ ID:35328, to the nucleotide sequence of VGAM1485 RNA, herein designated VGAM RNA, also designated SEQ ID:4196.

Another function of VGAM1485 is therefore inhibition of KIAA0546 (Accession XM_049055). Accordingly, utilities of VGAM1485 include diagnosis, prevention and treatment of diseases and clinical conditions associated with KIAA0546. KIAA0903 (Accession XM_049251) is another VGAM1485 host target gene. KIAA0903 BINDING SITE is HOST TARGET binding site found in the 3' untranslated region of mRNA encoded by KIAA0903, corresponding to a HOST TARGET binding site such as BINDING SITE I, BINDING SITE II or BINDING SITE III. Table 2 illustrates the complementarity of the nucleotide sequences of KIAA0903 BINDING SITE, designated SEQ ID:35368, to the nucleotide sequence of VGAM1485 RNA, herein designated VGAM RNA, also designated SEQ ID:4196.

Another function of VGAM1485 is therefore inhibition of KIAA0903 (Accession XM_049251). Accordingly, utilities of VGAM1485 include diagnosis, prevention and treatment of diseases and clinical conditions associated with KIAA0903. KIAA1580 (Accession XM_045271) is another VGAM1485 host target gene. KIAA1580 BINDING SITE is HOST TARGET binding site found in the 5' untranslated region of mRNA encoded by KIAA1580, corresponding to a HOST TARGET binding site such as BINDING SITE I, BINDING SITE II or BINDING SITE III. Table 2 illustrates the complementarity of the nucleotide sequences of KIAA1580 BINDING SITE, designated SEQ ID:34406, to the nucleotide sequence of VGAM1485 RNA, herein designated VGAM RNA, also designated SEQ ID:4196.

Another function of VGAM1485 is therefore inhibition of KIAA1580 (Accession XM_045271). Accordingly, utilities of VGAM1485 include diagnosis, prevention and treatment of diseases and clinical conditions associated with KIAA1580. LOC131000 (Accession XM_067145) is another VGAM1485 host target gene. LOC131000 BINDING SITE is HOST TARGET binding site found in the 5' untranslated region of mRNA encoded by LOC131000, corresponding to a HOST TARGET binding site such as BINDING SITE I, BINDING SITE II or BINDING SITE III. Table 2 illustrates the complementarity of the nucleotide sequences of LOC131000 BINDING SITE, designated SEQ ID:37348, to the nucleotide sequence of VGAM1485 RNA, herein designated VGAM RNA, also designated SEQ ID:4196.

Another function of VGAM1485 is therefore inhibition of LOC131000 (Accession XM_067145). Accordingly, utilities of VGAM1485 include diagnosis, prevention and treatment of diseases and clinical conditions associated with LOC131000. LOC158434 (Accession XM_098939) is another VGAM1485 host target gene. LOC158434 BINDING SITE is HOST TARGET binding site found in the 5' untranslated region of mRNA encoded by LOC158434, corresponding to a HOST TARGET binding site such as BINDING SITE I, BINDING SITE II or BINDING SITE III. Table 2 illustrates the complementarity of the nucleotide sequences of LOC158434 BINDING SITE, designated SEQ ID:41982, to the nucleotide sequence of VGAM1485 RNA, herein designated VGAM RNA, also designated SEQ ID:4196.

Another function of VGAM1485 is therefore inhibition of LOC158434 (Accession XM_098939). Accordingly, utilities of VGAM1485 include diagnosis, prevention and treatment of diseases and clinical conditions associated with LOC158434. LOC90643 (Accession XM_033145) is another VGAM1485 host target gene. LOC90643 BINDING SITE is HOST TARGET binding site found in the 3' untranslated region of mRNA encoded by LOC90643, corresponding to a HOST TARGET binding site such as BINDING SITE I, BINDING SITE II or BINDING SITE III. Table 2 illustrates the complementarity of the nucleotide sequences of LOC90643 BINDING SITE, designated SEQ ID:31851, to the nucleotide sequence of VGAM1485 RNA, herein designated VGAM RNA, also designated SEQ ID:4196.

Another function of VGAM1485 is therefore inhibition of LOC90643 (Accession XM_033145). Accordingly, utilities of VGAM1485 include diagnosis, prevention and treatment of diseases and clinical conditions associated with LOC90643. LOC91813 (Accession XM_040862) is another VGAM1485 host target gene. LOC91813 BINDING SITE is HOST TARGET binding site found in the 5' untranslated region of mRNA encoded by LOC91813, corresponding to a HOST TARGET binding site such as BINDING SITE I, BINDING SITE II or BINDING SITE III. Table 2 illustrates the complementarity of the nucleotide sequences of LOC91813 BINDING SITE, designated SEQ ID:33395, to the nucleotide sequence of VGAM1485 RNA, herein designated VGAM RNA, also designated SEQ ID:4196.

Another function of VGAM1485 is therefore inhibition of LOC91813 (Accession XM_040862). Accordingly, utilities of VGAM1485 include diagnosis, prevention and treatment of diseases and clinical conditions associated with LOC91813. FIG. 1 further provides a conceptual description of a novel bioinformatically detected viral gene of the present invention, referred to here as Viral Genomic Address Messenger 1486 (VGAM1486) viral gene, which modulates expression of respective host target genes thereof, the function and utility of which host target genes is known in the art.

VGAM1486 is a novel bioinformatically detected regulatory, non protein coding, viral micro RNA (miRNA) gene. The method by which VGAM1486 was detected is described hereinabove with reference to FIGS. 1-8.

VGAM1486 gene, herein designated VGAM GENE, is a viral gene contained in the genome of Gallid Herpesvirus 2. VGAM1486 host target gene, herein designated VGAM HOST TARGET GENE, is a human gene contained in the human genome.

VGAM1486 gene encodes a VGAM1486 precursor RNA, herein designated VGAM PRECURSOR RNA. Similar to other miRNA genes, and unlike most ordinary genes, VGAM1486 precursor RNA does not encode a protein. A nucleotide sequence identical or highly similar to the nucleotide sequence of VGAM1486 precursor RNA is designated SEQ ID:1472, and is provided hereinbelow with reference to the sequence listing part. Nucleotide sequence SEQ ID:1472 is located at position 82050 relative to the genome of Gallid Herpesvirus 2.

VGAM1486 precursor RNA folds onto itself, forming VGAM1486 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1486 folded precursor RNA into VGAM1486 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM1486 RNA is designated SEQ ID:4197, and is provided hereinbelow with reference to the sequence listing part.

VGAM1486 host target gene, herein designated VGAM HOST TARGET GENE, encodes a corresponding messenger RNA, VGAM1486 host target RNA, herein designated VGAM HOST TARGET RNA. VGAM1486 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1486 RNA, herein designated VGAM RNA, binds complementarily to one or more host target binding sites located in untranslated regions of VGAM1486 host target RNA, herein designated VGAM HOST TARGET RNA. This complementary binding is due to the fact that the nucleotide sequence of VGAM1486 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1486 RNA, herein designated VGAM RNA, may have a different number of host target binding sites in untranslated regions of a VGAM1486 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1486 RNA, herein designated VGAM RNA, to host target binding sites on VGAM1486 host target RNA, herein designated VGAM HOST TARGET RNA, such as BINDING SITE I, BINDING SITE II and BINDING SITE III, inhibits translation of VGAM1486 host target RNA into VGAM1486 host target protein, herein designated VGAM HOST TARGET PROTEIN. VGAM host target protein is therefore outlined by a broken line.

It is appreciated that VGAM1486 host target gene, herein designated VGAM HOST TARGET GENE, in fact represents a plurality of VGAM1486 host target genes. The mRNA of each one of this plurality of VGAM1486 host target genes comprises one or more host target binding sites, each having a nucleotide sequence which is at least partly complementary to VGAM1486 RNA, herein designated VGAM RNA, and which when bound by VGAM1486 RNA causes inhibition of translation of respective one or more VGAM1486 host target proteins.

It is further appreciated by one skilled in the art that the mode of translational inhibition illustrated by FIG. 1 with specific reference to translational inhibition exerted by VGAM1486 gene, herein designated VGAM GENE, on one or more VGAM1486 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1486 is inhibition of expression of host target genes, as part of a novel viral mechanism of attacking a host. Accordingly, utilities of VGAM1486 include diagnosis, prevention and treatment of viral infection by Gallid Herpesvirus 2. Specific functions, and accordingly utilities, of VGAM1486 correlate with, and may be deduced from, the identity of the host target genes which VGAM1486 binds and inhibits, and the function of these host target genes, as elaborated hereinbelow.

Nucleotide sequences of the VGAM1486 precursor RNA, herein designated VGAM PRECURSOR RNA, and of the 'diced' VGAM1486 RNA, herein designated VGAM RNA, and a schematic representation of the secondary folding of VGAM1486 folded precursor RNA, herein designated VGAM FOLDED PRECURSOR RNA, of VGAM1486 are further described hereinbelow with reference to Table 1.

Nucleotide sequences of host target binding sites, such as BINDING SITE-I, BINDING SITE-II and BINDING SITE-III of FIG. 1, found on VGAM1486 host target RNA, and schematic representation of the complementarity of each of these host target binding sites to VGAM1486 RNA, herein designated VGAM RNA, are described hereinbelow with reference to Table 2.

As mentioned hereinabove with reference to FIG. 1, a function of VGAM1486 gene, herein designated VGAM is inhibition of expression of VGAM1486 target genes. It is appreciated that specific functions, and accordingly utilities, of VGAM1486 correlate with, and may be deduced from, the identity of the target genes which VGAM1486 binds and inhibits, and the function of these target genes, as elaborated hereinbelow.

Promyelocytic Leukemia (PML, Accession NM_033238) is a VGAM1486 host target gene. PML BINDING SITE is HOST TARGET binding site found in the 3" untranslated region of mRNA encoded by PML, corresponding to a HOST TARGET binding site such as BINDING SITE I, BINDING SITE II or BINDING SITE III. Table 2 illustrates the complementarity of the nucleotide sequences of PML BINDING SITE, designated SEQ ID:27077, to the nucleotide sequence of VGAM1486 RNA, herein designated VGAM RNA, also designated SEQ ID:4197.

A function of VGAM1486 is therefore inhibition of Promyelocytic Leukemia (PML, Accession NM_033238). Accordingly, utilities of VGAM1486 include diagnosis, prevention and treatment of diseases and clinical conditions associated with PML. Zinc Finger Protein 192 (ZNF192, Accession NM_006298) is another VGAM1486 host target gene. ZNF192 BINDING SITE is HOST TARGET binding site found in the 3' untranslated region of mRNA encoded by ZNF192, corresponding to a HOST TARGET binding site such as BINDING SITE I, BINDING SITE II or BINDING SITE III. Table 2 illustrates the complementarity of the nucleotide sequences of ZNF192 BINDING SITE, designated SEQ ID:12987, to the nucleotide sequence of VGAM1486 RNA, herein designated VGAM RNA, also designated SEQ ID:4197.

Another function of VGAM1486 is therefore inhibition of Zinc Finger Protein 192 (ZNF192, Accession NM_006298). Accordingly, utilities of VGAM1486 include diagnosis, prevention and treatment of diseases and clinical conditions associated with ZNF192. MGC14161 (Accession NM_032892) is another VGAM1486 host target gene. MGC14161 BINDING SITE is HOST TARGET binding site found in the 5' untranslated region of mRNA encoded by MGC14161, corresponding to a HOST TARGET binding site such as BINDING SITE I, BINDING SITE II or BINDING SITE III. Table 2 illustrates the complementarity of the nucleotide sequences of MGC14161 BINDING SITE, designated SEQ ID:26721, to the nucleotide sequence of VGAM1486 RNA, herein designated VGAM RNA, also designated SEQ ID:4197.

Another function of VGAM1486 is therefore inhibition of MGC14161 (Accession NM_032892). Accordingly, utilities of VGAM1486 include diagnosis, prevention and treatment of diseases and clinical conditions associated with MGC14161. FIG. 1 further provides a conceptual description of a novel bioinformatically detected viral gene of the present invention, referred to here as Viral Genomic Address Messenger 1487 (VGAM1487) viral gene, which modulates expression of respective host target genes thereof, the function and utility of which host target genes is known in the art.

VGAM1487 is a novel bioinformatically detected regulatory, non protein coding, viral micro RNA (miRNA) gene.

The method by which VGAM1487 was detected is described hereinabove with reference to FIGS. 1-8.

VGAM1487 gene, herein designated VGAM GENE, is a viral gene contained in the genome of Gallid Herpesvirus 2. VGAM1487 host target gene, herein designated VGAM HOST TARGET GENE, is a human gene contained in the human genome.

VGAM1487 gene encodes a VGAM1487 precursor RNA, herein designated VGAM PRECURSOR RNA. Similar to other miRNA genes, and unlike most ordinary genes, VGAM1487 precursor RNA does not encode a protein. A nucleotide sequence identical or highly similar to the nucleotide sequence of VGAM1487 precursor RNA is designated SEQ ID:1473, and is provided hereinbelow with reference to the sequence listing part. Nucleotide sequence SEQ ID:1473 is located at position 80281 relative to the genome of Gallid Herpesvirus 2.

VGAM1487 precursor RNA folds onto itself, forming VGAM1487 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1487 folded precursor RNA into VGAM1487 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1487 RNA is designated SEQ ID:4198, and is provided hereinbelow with reference to the sequence listing part.

VGAM1487 host target gene, herein designated VGAM HOST TARGET GENE, encodes a corresponding messenger RNA, VGAM1487 host target RNA, herein designated VGAM HOST TARGET RNA. VGAM1487 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1487 RNA, herein designated VGAM RNA, binds complementarily to one or more host target binding sites located in untranslated regions of VGAM1487 host target RNA, herein designated VGAM HOST TARGET RNA. This complementary binding is due to the fact that the nucleotide sequence of VGAM1487 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1487 RNA, herein designated VGAM RNA, may have a different number of host target binding sites in untranslated regions of a VGAM1487 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1487 RNA, herein designated VGAM RNA, to host target binding sites on VGAM1487 host target RNA, herein designated VGAM HOST TARGET RNA, such as BINDING SITE I, BINDING SITE II and BINDING SITE III, inhibits translation of VGAM1487 host target RNA into VGAM1487 host target protein, herein designated VGAM HOST TARGET PROTEIN. VGAM host target protein is therefore outlined by a broken line.

It is appreciated that VGAM1487 host target gene, herein designated VGAM HOST TARGET GENE, in fact represents a plurality of VGAM1487 host target genes. The mRNA of each one of this plurality of VGAM1487 host target genes comprises one or more host target binding sites, each having a nucleotide sequence which is at least partly complementary to VGAM1487 RNA, herein designated VGAM RNA, and which when bound by VGAM1487 RNA causes inhibition of translation of respective one or more VGAM1487 host target proteins.

It is further appreciated by one skilled in the art that the mode of translational inhibition illustrated by FIG. 1 with specific reference to translational inhibition exerted by VGAM1487 gene, herein designated VGAM GENE, on one or more VGAM1487 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1487 is inhibition of expression of host target genes, as part of a novel viral mechanism of attacking a host. Accordingly, utilities of VGAM1487 include diagnosis, prevention and treatment of viral infection by Gallid Herpesvirus 2. Specific functions, and accordingly utilities, of VGAM1487 correlate with, and may be deduced from, the identity of the host target genes which VGAM1487 binds and inhibits, and the function of these host target genes, as elaborated hereinbelow.

Nucleotide sequences of the VGAM1487 precursor RNA, herein designated VGAM PRECURSOR RNA, and of the 'diced' VGAM1487 RNA, herein designated VGAM RNA, and a schematic representation of the secondary folding of VGAM1487 folded precursor RNA, herein designated VGAM FOLDED PRECURSOR RNA, of VGAM1487 are further described hereinbelow with reference to Table 1.

Nucleotide sequences of host target binding sites, such as BINDING SITE-I, BINDING SITE-II and BINDING SITE-III of FIG. 1, found on VGAM1487 host target RNA, and schematic representation of the complementarity of each of these host target binding sites to VGAM1487 RNA, herein designated VGAM RNA, are described hereinbelow with reference to Table 2.

As mentioned hereinabove with reference to FIG. 1, a function of VGAM1487 gene, herein designated VGAM is inhibition of expression of VGAM1487 target genes. It is appreciated that specific functions, and accordingly utilities, of VGAM1487 correlate with, and may be deduced from, the identity of the target genes which VGAM1487 binds and inhibits, and the function of these target genes, as elaborated hereinbelow.

Development and Differentiation Enhancing Factor 2 (DDEF2, Accession NM_003887) is a VGAM1487 host target gene. DDEF2 BINDING SITE is HOST TARGET binding site found in the 3' untranslated region of mRNA encoded by DDEF2, corresponding to a HOST TARGET binding site such as BINDING SITE I, BINDING SITE II or BINDING SITE III. Table 2 illustrates the complementarity of the nucleotide sequences of DDEF2 BINDING SITE, designated SEQ ID:9965, to the nucleotide sequence of VGAM1487 RNA, herein designated VGAM RNA, also designated SEQ ID:4198.

A function of VGAM1487 is therefore inhibition of Development and Differentiation Enhancing Factor 2 (DDEF2, Accession NM_003887), a gene which interacts with members of the Arf and Src family. Accordingly, utilities of VGAM1487 include diagnosis, prevention and treatment of diseases and clinical conditions associated with DDEF2. The function of DDEF2 and its association with various diseases and clinical conditions, has been established by previous studies, as described hereinabove with reference to VGAM464. Protein Tyrosine Phosphatase, Receptor Type, O (PTPRO, Accession NM_002848) is another VGAM1487 host target gene. PTPRO BINDING SITE1 through PTPRO BINDING SITE5 are HOST TARGET binding sites found in untranslated regions of mRNA encoded by PTPRO, corresponding to HOST TARGET binding sites such as BINDING SITE I, BINDING SITE II or BINDING SITE III. Table 2 illustrates the complementarity of the nucleotide sequences of PTPRO BINDING SITE1 through PTPRO BINDING SITE5, designated SEQ ID:8738, SEQ ID:25018, SEQ ID:25027, SEQ ID:25003 and SEQ ID:25009 respectively, to the nucleotide sequence of VGAM1487 RNA, herein designated VGAM RNA, also designated SEQ ID:4198.

Another function of VGAM1487 is therefore inhibition of Protein Tyrosine Phosphatase, Receptor Type, O (PTPRO, Accession NM_002848), a gene which may function as a cell contact receptor that mediates and controls cell-cell signals. Accordingly, utilities of VGAM1487 include diagnosis, prevention and treatment of diseases and clinical conditions associated with PTPRO. The function of PTPRO and its association with various diseases and clinical conditions, has been established by previous studies, as described hereinabove with reference to VGAM140. DKFZp762K2015 (Accession XM_051791) is another VGAM1487 host target gene. DKFZp762K2015 BINDING SITE is HOST TARGET binding site found in the 3' untranslated region of mRNA encoded by DKFZp762K2015, corresponding to a HOST TARGET binding site such as BINDING SITE I, BINDING SITE II or BINDING SITE III. Table 2 illustrates the complementarity of the nucleotide sequences of DKFZp762K2015 BINDING SITE, designated SEQ ID:35883, to the nucleotide sequence of VGAM1487 RNA, herein designated VGAM RNA, also designated SEQ ID:4198.

Another function of VGAM1487 is therefore inhibition of DKFZp762K2015 (Accession XM_051791). Accordingly, utilities of VGAM1487 include diagnosis, prevention and treatment of diseases and clinical conditions associated with DKFZp762K2015. FLJ21290 (Accession NM_025034) is another VGAM1487 host target gene. FLJ21290 BINDING SITE is HOST TARGET binding site found in the 3' untranslated region of mRNA encoded by FLJ21290, corresponding to a HOST TARGET binding site such as BINDING SITE I, BINDING SITE II or BINDING SITE III. Table 2 illustrates the complementarity of the nucleotide sequences of FLJ21290 BINDING SITE, designated SEQ ID:24631, to the nucleotide sequence of VGAM1487 RNA, herein designated VGAM RNA, also designated SEQ ID:4198.

Another function of VGAM1487 is therefore inhibition of FLJ21290 (Accession NM_025034). Accordingly, utilities of VGAM1487 include diagnosis, prevention and treatment of diseases and clinical conditions associated with FLJ21290. IPLA2(GAMMA) (Accession XM_027224) is another VGAM1487 host target gene. IPLA2(GAMMA) BINDING SITE is HOST TARGET binding site found in the 5' untranslated region of mRNA encoded by IPLA2(GAMMA), corresponding to a HOST TARGET binding site such as BINDING SITE I, BINDING SITE II or BINDING SITE III. Table 2 illustrates the complementarity of the nucleotide sequences of IPLA2(GAMMA) BINDING SITE, designated SEQ ID:30443, to the nucleotide sequence of VGAM1487 RNA, herein designated VGAM RNA, also designated SEQ ID:4198.

Another function of VGAM1487 is therefore inhibition of IPLA2(GAMMA) (Accession XM_027224). Accordingly, utilities of VGAM1487 include diagnosis, prevention and treatment of diseases and clinical conditions associated with IPLA2(GAMMA). MGC11349 (Accession NM_025112) is another VGAM1487 host target gene. MGC11349 BINDING SITE is HOST TARGET binding site found in the 5' untranslated region of mRNA encoded by MGC11349, corresponding to a HOST TARGET binding site such as BINDING SITE I, BINDING SITE II or BINDING SITE III. Table 2 illustrates the complementarity of the nucleotide sequences of MGC11349 BINDING SITE, designated SEQ ID:24759, to the nucleotide sequence of VGAM1487 RNA, herein designated VGAM RNA, also designated SEQ ID:4198.

Another function of VGAM1487 is therefore inhibition of MGC11349 (Accession NM_025112). Accordingly, utilities of VGAM1487 include diagnosis, prevention and treatment of diseases and clinical conditions associated with MGC11349. LOC219686 (Accession XM_165544) is another VGAM1487 host target gene. LOC219686 BINDING SITE is HOST TARGET binding site found in the 3' untranslated region of mRNA encoded by LOC219686, corresponding to a HOST TARGET binding site such as BINDING SITE I, BINDING SITE II or BINDING SITE III. Table 2 illustrates the complementarity of the nucleotide sequences of LOC219686 BINDING SITE, designated SEQ ID:43672, to the nucleotide sequence of VGAM1487 RNA, herein designated VGAM RNA, also designated SEQ ID:4198.

Another function of VGAM1487 is therefore inhibition of LOC219686 (Accession XM_165544). Accordingly, utilities of VGAM1487 include diagnosis, prevention and treatment of diseases and clinical conditions associated with LOC219686. FIG. 1 further provides a conceptual description of a novel bioinformatically detected viral gene of the present invention, referred to here as Viral Genomic Address Messenger 1488 (VGAM1488) viral gene, which modulates expression of respective host target genes thereof, the function and utility of which host target genes is known in the art.

VGAM1488 is a novel bioinformatically detected regulatory, non protein coding, viral micro RNA (miRNA) gene. The method by which VGAM1488 was detected is described hereinabove with reference to FIGS. 1-8.

VGAM1488 gene, herein designated VGAM GENE, is a viral gene contained in the genome of Plum Pox Virus. VGAM1488 host target gene, herein designated VGAM HOST TARGET GENE, is a human gene contained in the human genome.

VGAM1488 gene encodes a VGAM1488 precursor RNA, herein designated VGAM PRECURSOR RNA. Similar to other miRNA genes, and unlike most ordinary genes, VGAM1488 precursor RNA does not encode a protein. A nucleotide sequence identical or highly similar to the nucleotide sequence of VGAM1488 precursor RNA is designated SEQ ID:1474, and is provided hereinbelow with reference to the sequence listing part. Nucleotide sequence SEQ ID:1474 is located at position 7567 relative to the genome of Plum Pox Virus.

VGAM1488 precursor RNA folds onto itself, forming VGAM1488 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1488 folded precursor RNA into VGAM1488 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1488 RNA is designated SEQ ID:4199, and is provided hereinbelow with reference to the sequence listing part.

VGAM1488 host target gene, herein designated VGAM HOST TARGET GENE, encodes a corresponding messenger RNA, VGAM1488 host target RNA, herein designated VGAM HOST TARGET RNA. VGAM1488 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1488 RNA, herein designated VGAM RNA, binds complementarily to one or more host target binding sites located in untranslated regions of VGAM1488 host target RNA, herein designated VGAM HOST TARGET RNA. This complementary binding is due to the fact that the nucleotide sequence of VGAM1488 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1488 RNA, herein designated VGAM RNA, may have a different number of host target binding sites in untranslated regions of a VGAM1488 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1488 RNA, herein designated VGAM RNA, to host target binding sites on VGAM1488 host target RNA, herein designated VGAM HOST TARGET RNA, such as BINDING SITE I, BINDING SITE II and BINDING SITE III, inhibits translation of VGAM1488 host target RNA into VGAM1488 host target protein, herein designated VGAM HOST TARGET PROTEIN. VGAM host target protein is therefore outlined by a broken line.

It is appreciated that VGAM1488 host target gene, herein designated VGAM HOST TARGET GENE, in fact represents a plurality of VGAM1488 host target genes. The mRNA of each one of this plurality of VGAM1488 host target genes comprises one or more host target binding sites, each having a nucleotide sequence which is at least partly complementary to VGAM1488 RNA, herein designated VGAM RNA, and which when bound by VGAM1488 RNA causes inhibition of translation of respective one or more VGAM1488 host target proteins.

It is further appreciated by one skilled in the art that the mode of translational inhibition illustrated by FIG. 1 with specific reference to translational inhibition exerted by VGAM1488 gene, herein designated VGAM GENE, on one or more VGAM1488 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1488 is inhibition of expression of host target genes, as part of a novel viral mechanism of attacking a host. Accordingly, utilities of VGAM1488 include diagnosis, prevention and treatment of viral infection by Plum Pox Virus. Specific functions, and accordingly utilities, of VGAM1488 correlate with, and may be deduced from, the identity of the host target genes which VGAM1488 binds and inhibits, and the function of these host target genes, as elaborated hereinbelow.

Nucleotide sequences of the VGAM1488 precursor RNA, herein designated VGAM PRECURSOR RNA, and of the 'diced' VGAM1488 RNA, herein designated VGAM RNA, and a schematic representation of the secondary folding of VGAM1488 folded precursor RNA, herein designated VGAM FOLDED PRECURSOR RNA, of VGAM1488 are further described hereinbelow with reference to Table 1.

Nucleotide sequences of host target binding sites, such as BINDING SITE-I, BINDING SITE-II and BINDING SITE-III of FIG. 1, found on VGAM1488 host target RNA, and schematic representation of the complementarity of each of these host target binding sites to VGAM1488 RNA, herein designated VGAM RNA, are described hereinbelow with reference to Table 2.

As mentioned hereinabove with reference to FIG. 1, a function of VGAM1488 gene, herein designated VGAM is inhibition of expression of VGAM1488 target genes. It is appreciated that specific functions, and accordingly utilities, of VGAM1488 correlate with, and may be deduced from, the identity of the target genes which VGAM1488 binds and inhibits, and the function of these target genes, as elaborated hereinbelow.

A Kinase (PRKA) Anchor Protein 1 (AKAP1, Accession NM_139275) is a VGAM1488 host target gene. AKAP1 BINDING SITE1 and AKAP1 BINDING SITE2 are HOST TARGET binding sites found in untranslated regions of mRNA encoded by AKAP1, corresponding to HOST TARGET binding sites such as BINDING SITE I, BINDING SITE II or BINDING SITE III. Table 2 illustrates the complementarity of the nucleotide sequences of AKAP1 BINDING SITE1 and AKAP1 BINDING SITE2, designated SEQ ID:29267 and SEQ ID:9581 respectively, to the nucleotide sequence of VGAM1488 RNA, herein designated VGAM RNA, also designated SEQ ID:4199.

A function of VGAM1488 is therefore inhibition of A Kinase (PRKA) Anchor Protein 1 (AKAP1, Accession NM_139275), a gene which binds to type i and ii regulatory subunits of protein kinase a. Accordingly, utilities of VGAM1488 include diagnosis, prevention and treatment of diseases and clinical conditions associated with AKAP1. The function of AKAP1 and its association with various diseases and clinical conditions, has been established by previous studies, as described hereinabove with reference to VGAM1392. Cysteine-rich, Angiogenic Inducer, 61 (CYR61, Accession NM_001554) is another VGAM1488 host target gene. CYR61 BINDING SITE is HOST TARGET binding site found in the 3' untranslated region of mRNA encoded by CYR61, corresponding to a HOST TARGET binding site such as BINDING SITE I, BINDING SITE II or BINDING SITE III. Table 2 illustrates the complementarity of the nucleotide sequences of CYR61 BINDING SITE, designated SEQ ID:7277, to the nucleotide sequence of VGAM1488 RNA, herein designated VGAM RNA, also designated SEQ ID:4199.

Another function of VGAM1488 is therefore inhibition of Cysteine-rich, Angiogenic Inducer, 61 (CYR61, Accession NM_001554), a gene which promotes the adhesion of endothelial cells. Accordingly, utilities of VGAM1488 include diagnosis, prevention and treatment of diseases and clinical conditions associated with CYR61. The function of CYR61 and its association with various diseases and clinical conditions, has been established by previous studies, as described hereinabove with reference to VGAM1229. F-box and Leucine-rich Repeat Protein 3A (FBXL3A, Accession NM_012158) is another VGAM1488 host target gene. FBXL3A BINDING SITE is HOST TARGET binding site found in the 3' untranslated region of mRNA encoded by FBXL3A, corresponding to a HOST TARGET binding site such as BINDING SITE I, BINDING SITE II or BINDING SITE III. Table 2 illustrates the complementarity of the nucleotide sequences of FBXL3A BINDING SITE, designated SEQ ID:14457, to the nucleotide sequence of VGAM1488 RNA, herein designated VGAM RNA, also designated SEQ ID:4199.

Another function of VGAM1488 is therefore inhibition of F-box and Leucine-rich Repeat Protein 3A (FBXL3A, Accession NM_012158), a gene which is a putative SCF ubiquitin ligase subunit involved in protein degradation. Accordingly, utilities of VGAM1488 include diagnosis, prevention and treatment of diseases and clinical conditions associated with FBXL3A. The function of FBXL3A and its association with various diseases and clinical conditions, has been established by previous studies, as described hereinabove with reference to VGAM1172. Roundabout, Axon Guidance Receptor, Homolog 1 (Drosophila) (ROBO1, Accession NM_002941) is another VGAM1488 host target gene. ROBO1 BINDING SITE1 and ROBO1 BINDING SITE2 are HOST TARGET binding sites found in untranslated regions of mRNA encoded by ROBO1, corresponding to HOST TARGET binding sites such as BINDING SITE I, BINDING SITE II or BINDING SITE III. Table 2 illustrates the complementarity of the nucleotide sequences of ROBO1 BINDING SITE1 and ROBO1 BINDING SITE2, designated SEQ ID:8847 and SEQ ID:28582 respectively, to the nucleotide sequence of VGAM1488 RNA, herein designated VGAM RNA, also designated SEQ ID:4199.

Another function of VGAM1488 is therefore inhibition of Roundabout, Axon Guidance Receptor, Homolog 1 (Drosophila) (ROBO1, Accession NM_002941), a gene which is an axon guidance receptor. Accordingly, utilities of VGAM1488 include diagnosis, prevention and treatment of diseases and clinical conditions associated with ROBO1. The function of ROBO1 and its association with various diseases and clinical conditions, has been established by previous studies, as described hereinabove with reference to VGAM37. T-complex-associated-testis-expressed 1-like (TCTE1L, Accession XM_048205) is another VGAM1488 host target gene. TCTE1L BINDING SITE is HOST TARGET binding site found in the 3' untranslated region of mRNA encoded by TCTE1L, corresponding to a HOST TARGET binding site such as BINDING SITE I, BINDING SITE II or BINDING SITE III. Table 2 illustrates the complementarity of the nucleotide sequences of TCTE1L BINDING SITE, designated SEQ ID:35144, to the nucleotide sequence of VGAM1488 RNA, herein designated VGAM RNA, also designated SEQ ID:4199.

Another function of VGAM1488 is therefore inhibition of T-complex-associated-testis-expressed 1-like (TCTE1L, Accession XM_048205). Accordingly, utilities of VGAM1488 include diagnosis, prevention and treatment of diseases and clinical conditions associated with TCTE1L. Adaptor-related Protein Complex 1, Sigma 2 Subunit (AP1S2, Accession NM_003916) is another VGAM1488 host target gene. AP1S2 BINDING SITE is HOST TARGET binding site found in the 3' untranslated region of mRNA encoded by AP1S2, corresponding to a HOST TARGET binding site such as BINDING SITE I, BINDING SITE II or BINDING SITE III. Table 2 illustrates the complementarity of the nucleotide sequences of AP1S2 BINDING SITE, designated SEQ ID:10004, to the nucleotide sequence of VGAM1488 RNA, herein designated VGAM RNA, also designated SEQ ID:4199.

Another function of VGAM1488 is therefore inhibition of Adaptor-related Protein Complex 1, Sigma 2 Subunit (AP1S2, Accession NM_003916). Accordingly, utilities of VGAM1488 include diagnosis, prevention and treatment of diseases and clinical conditions associated with AP1S2. Apoptosis Inhibitor 5 (API5, Accession NM_006595) is another VGAM1488 host target gene. API5 BINDING SITE is HOST TARGET binding site found in the 3' untranslated region of mRNA encoded by API5, corresponding to a HOST TARGET binding site such as BINDING SITE I, BINDING SITE II or BINDING SITE III. Table 2 illustrates the complementarity of the nucleotide sequences of API5 BINDING SITE, designated SEQ ID:13364, to the nucleotide sequence of VGAM1488 RNA, herein designated VGAM RNA, also designated SEQ ID:4199.

Another function of VGAM1488 is therefore inhibition of Apoptosis Inhibitor 5 (API5, Accession NM_006595). Accordingly, utilities of VGAM1488 include diagnosis, prevention and treatment of diseases and clinical conditions associated with API5. CGI-57 (Accession XM_058098) is another VGAM1488 host target gene. CGI-57 BINDING SITE is HOST TARGET binding site found in the 3' untranslated region of mRNA encoded by CGI-57, corresponding to a HOST TARGET binding site such as BINDING SITE I, BINDING SITE II or BINDING SITE III. Table 2 illustrates the complementarity of the nucleotide sequences of CGI-57 BINDING SITE, designated SEQ ID:36575, to the nucleotide sequence of VGAM1488 RNA, herein designated VGAM RNA, also designated SEQ ID:4199.

Another function of VGAM1488 is therefore inhibition of CGI-57 (Accession XM_058098). Accordingly, utilities of VGAM1488 include diagnosis, prevention and treatment of diseases and clinical conditions associated with CGI-57. DKFZp434A2417 (Accession XM_038526) is another VGAM1488 host target gene. DKFZp434A2417 BINDING SITE is HOST TARGET binding site found in the 3' untranslated region of mRNA encoded by DKFZp434A2417, corresponding to a HOST TARGET binding site such as BINDING SITE I, BINDING SITE II or BINDING SITE III. Table 2 illustrates the complementarity of the nucleotide sequences of DKFZp434A2417 BINDING SITE, designated SEQ ID:32864, to the nucleotide sequence of VGAM1488 RNA, herein designated VGAM RNA, also designated SEQ ID:4199.

Another function of VGAM1488 is therefore inhibition of DKFZp434A2417 (Accession XM_038526). Accordingly, utilities of VGAM1488 include diagnosis, prevention and treatment of diseases and clinical conditions associated with DKFZp434A2417. FLJ12488 (Accession NM_031218) is another VGAM1488 host target gene. FLJ12488 BINDING SITE is HOST TARGET binding site found in the 3' untranslated region of mRNA encoded by FLJ12488, corresponding to a HOST TARGET binding site such as BINDING SITE I, BINDING SITE II or BINDING SITE III. Table 2 illustrates the complementarity of the nucleotide sequences of FLJ12488 BINDING SITE, designated SEQ ID:25265, to the nucleotide sequence of VGAM1488 RNA, herein designated VGAM RNA, also designated SEQ ID:4199.

Another function of VGAM1488 is therefore inhibition of FLJ12488 (Accession NM_031218). Accordingly, utilities of VGAM1488 include diagnosis, prevention and treatment of diseases and clinical conditions associated with FLJ12488. KIAA0633 (Accession XM_168380) is another VGAM1488 host target gene. KIAA0633 BINDING SITE is HOST TARGET binding site found in the 3' untranslated region of mRNA encoded by KIAA0633, corresponding to a HOST TARGET binding site such as BINDING SITE I, BINDING SITE II or BINDING SITE III. Table 2 illustrates the complementarity of the nucleotide sequences of KIAA0633 BINDING SITE, designated SEQ ID:45142, to the nucleotide sequence of VGAM1488 RNA, herein designated VGAM RNA, also designated SEQ ID:4199.

Another function of VGAM1488 is therefore inhibition of KIAA0633 (Accession XM_168380). Accordingly, utilities of VGAM1488 include diagnosis, prevention and treatment of diseases and clinical conditions associated with KIAA0633. KIAA0794 (Accession XM_087353) is another VGAM1488 host target gene. KIAA0794 BINDING SITE is HOST TARGET binding site found in the 3' untranslated region of mRNA encoded by KIAA0794, corresponding to a HOST TARGET binding site such as BINDING SITE I, BINDING SITE II or BINDING SITE III. Table 2 illustrates the complementarity of the nucleotide sequences of KIAA0794 BINDING SITE, designated SEQ ID:39188, to the nucleotide sequence of VGAM1488 RNA, herein designated VGAM RNA, also designated SEQ ID:4199.

Another function of VGAM1488 is therefore inhibition of KIAA0794 (Accession XM_087353). Accordingly, utilities of VGAM1488 include diagnosis, prevention and treatment of diseases and clinical conditions associated with KIAA0794. KIAA0924 (Accession NM_014897) is another VGAM1488 host target gene. KIAA0924 BINDING SITE is HOST TARGET binding site found in the 3' untranslated region of mRNA encoded by KIAA0924, corresponding to a HOST TARGET binding site such as BINDING SITE I, BINDING SITE II or BINDING SITE III. Table 2 illustrates the complementarity of the nucleotide sequences of KIAA0924 BINDING SITE, designated SEQ ID:17068, to the nucleotide sequence of VGAM1488 RNA, herein designated VGAM RNA, also designated SEQ ID:4199.

Another function of VGAM1488 is therefore inhibition of KIAA0924 (Accession NM_014897). Accordingly, utilities of VGAM1488 include diagnosis, prevention and treatment of diseases and clinical conditions associated with KIAA0924. KIAA1430 (Accession XM_087593) is another VGAM1488 host target gene. KIAA1430 BINDING SITE is HOST TARGET binding site found in the 3' untranslated region of mRNA encoded by KIAA1430, corresponding to a HOST TARGET binding site such as BINDING SITE I, BINDING SITE II or BINDING SITE III. Table 2 illustrates the complementarity of the nucleotide sequences of KIAA1430 BINDING SITE, designated SEQ ID:39359, to the nucleotide sequence of VGAM1488 RNA, herein designated VGAM RNA, also designated SEQ ID:4199.

Another function of VGAM1488 is therefore inhibition of KIAA1430 (Accession XM_087593). Accordingly, utilities of VGAM1488 include diagnosis, prevention and treatment of diseases and clinical conditions associated with KIAA1430. KIAA1495 (Accession XM_055080) is another VGAM1488 host target gene. KIAA1495 BINDING SITE is HOST TARGET binding site found in the 3' untranslated region of mRNA encoded by KIAA1495, corresponding to a HOST TARGET binding site such as BINDING SITE I, BINDING SITE II or BINDING SITE III. Table 2 illustrates the complementarity of the nucleotide sequences of KIAA1495 BINDING SITE, designated SEQ ID:36226, to the nucleotide sequence of VGAM1488 RNA, herein designated VGAM RNA, also designated SEQ ID:4199.

Another function of VGAM1488 is therefore inhibition of KIAA1495 (Accession XM_055080). Accordingly, utilities of VGAM1488 include diagnosis, prevention and treatment of diseases and clinical conditions associated with KIAA1495. PGR1 (Accession NM_033296) is another VGAM1488 host target gene. PGR1 BINDING SITE is HOST TARGET binding site found in the 3' untranslated region of mRNA encoded by PGR1, corresponding to a HOST TARGET binding site such as BINDING SITE I, BINDING SITE II or BINDING SITE III. Table 2 illustrates the complementarity of the nucleotide sequences of PGR1 BINDING SITE, designated SEQ ID:27125, to the nucleotide sequence of VGAM1488 RNA, herein designated VGAM RNA, also designated SEQ ID:4199.

Another function of VGAM1488 is therefore inhibition of PGR1 (Accession NM_033296). Accordingly, utilities of VGAM1488 include diagnosis, prevention and treatment of diseases and clinical conditions associated with PGR1. PRO1635 (Accession NM_018589) is another VGAM1488 host target gene. PRO1635 BINDING SITE is HOST TARGET binding site found in the 3' untranslated region of mRNA encoded by PRO1635, corresponding to a HOST TARGET binding site such as BINDING SITE I, BINDING SITE II or BINDING SITE III. Table 2 illustrates the complementarity of the nucleotide sequences of PRO1635 BINDING SITE, designated SEQ ID:20668, to the nucleotide sequence of VGAM1488 RNA, herein designated VGAM RNA, also designated SEQ ID:4199.

Another function of VGAM1488 is therefore inhibition of PRO1635 (Accession NM_018589). Accordingly, utilities of VGAM1488 include diagnosis, prevention and treatment of diseases and clinical conditions associated with PRO1635. SMAP1 (Accession NM_021940) is another VGAM1488 host target gene. SMAP1 BINDING SITE is HOST TARGET binding site found in the 3' untranslated region of mRNA encoded by SMAP1, corresponding to a HOST TARGET binding site such as BINDING SITE I, BINDING SITE II or BINDING SITE III. Table 2 illustrates the complementarity of the nucleotide sequences of SMAP1 BINDING SITE, designated SEQ ID:22456, to the nucleotide sequence of VGAM1488 RNA, herein designated VGAM RNA, also designated SEQ ID:4199.

Another function of VGAM1488 is therefore inhibition of SMAP1 (Accession NM_021940). Accordingly, utilities of VGAM1488 include diagnosis, prevention and treatment of diseases and clinical conditions associated with SMAP1. LOC158427 (Accession NM_139246) is another VGAM1488 host target gene. LOC158427 BINDING SITE is HOST TARGET binding site found in the 3' untranslated region of mRNA encoded by LOC158427, corresponding to a HOST TARGET binding site such as BINDING SITE I, BINDING SITE II or BINDING SITE III. Table 2 illustrates the complementarity of the nucleotide sequences of LOC158427 BINDING SITE, designated SEQ ID:29245, to the nucleotide sequence of VGAM1488 RNA, herein designated VGAM RNA, also designated SEQ ID:4199.

Another function of VGAM1488 is therefore inhibition of LOC158427 (Accession NM_139246). Accordingly, utilities of VGAM1488 include diagnosis, prevention and treatment of diseases and clinical conditions associated with LOC158427. LOC163231 (Accession XM_092094) is another VGAM1488 host target gene. LOC163231 BINDING SITE is HOST TARGET binding site found in the 5' untranslated region of mRNA encoded by LOC163231, corresponding to a HOST TARGET binding site such as BINDING SITE I, BINDING SITE II or BINDING SITE III. Table 2 illustrates the complementarity of the nucleotide sequences of LOC163231 BINDING SITE, designated SEQ ID:40097, to the nucleotide sequence of VGAM1488 RNA, herein designated VGAM RNA, also designated SEQ ID:4199.

Another function of VGAM1488 is therefore inhibition of LOC163231 (Accession XM_092094). Accordingly, utilities of VGAM1488 include diagnosis, prevention and treatment of diseases and clinical conditions associated with LOC163231. LOC205251 (Accession XM_119554) is another VGAM1488 host target gene. LOC205251 BINDING SITE is HOST TARGET binding site found in the 5' untranslated region of mRNA encoded by LOC205251, corresponding to a HOST TARGET binding site such as BINDING SITE I, BINDING SITE II or BINDING SITE III. Table 2 illustrates the complementarity of the nucleotide sequences of LOC205251 BINDING SITE, designated SEQ ID:43588, to the nucleotide sequence of VGAM1488 RNA, herein designated VGAM RNA, also designated SEQ ID:4199.

Another function of VGAM1488 is therefore inhibition of LOC205251 (Accession XM_119554). Accordingly, utilities of VGAM1488 include diagnosis, prevention and treatment of diseases and clinical conditions associated with LOC205251. LOC220018 (Accession XM_167816) is another VGAM1488 host target gene. LOC220018 BINDING SITE is HOST TARGET binding site found in the 5' untranslated region of mRNA encoded by LOC220018, corresponding to a HOST TARGET binding site such as BINDING SITE I, BINDING SITE II or BINDING SITE III. Table 2 illustrates the complementarity of the nucleotide sequences of LOC220018 BINDING SITE, designated SEQ ID:44858, to the nucleotide sequence of VGAM1488 RNA, herein designated VGAM RNA, also designated SEQ ID:4199.

Another function of VGAM1488 is therefore inhibition of LOC220018 (Accession XM_167816). Accordingly, utilities of VGAM1488 include diagnosis, prevention and treatment of diseases and clinical conditions associated with LOC220018. LOC51336 (Accession NM_016646) is another VGAM1488 host target gene. LOC51336 BINDING SITE is HOST TARGET binding site found in the 3' untranslated region of mRNA encoded by LOC51336, corresponding to a HOST TARGET binding site such as BINDING SITE I, BINDING SITE II or BINDING SITE III. Table 2 illustrates the complementarity of the nucleotide sequences of LOC51336 BINDING SITE, designated SEQ ID:18759, to the nucleotide sequence of VGAM1488 RNA, herein designated VGAM RNA, also designated SEQ ID:4199.

Another function of VGAM1488 is therefore inhibition of LOC51336 (Accession NM_016646). Accordingly, utilities of VGAM1488 include diagnosis, prevention and treatment of diseases and clinical conditions associated with LOC51336. LOC91266 (Accession XM_037268) is another VGAM1488 host target gene. LOC91266 BINDING SITE is HOST TARGET binding site found in the 5' untranslated region of mRNA encoded by LOC91266, corresponding to a HOST TARGET binding site such as BINDING SITE I, BINDING SITE II or BINDING SITE III. Table 2 illustrates the complementarity of the nucleotide sequences of LOC91266 BINDING SITE, designated SEQ ID:32603, to the nucleotide sequence of VGAM1488 RNA, herein designated VGAM RNA, also designated SEQ ID:4199.

Another function of VGAM1488 is therefore inhibition of LOC91266 (Accession XM_037268). Accordingly, utilities of VGAM1488 include diagnosis, prevention and treatment of diseases and clinical conditions associated with LOC91266. FIG. 1 further provides a conceptual description of a novel bioinformatically detected viral gene of the present invention, referred to here as Viral Genomic Address Messenger 1489 (VGAM1489) viral gene, which modulates expression of respective host target genes thereof, the function and utility of which host target genes is known in the art.

VGAM1489 is a novel bioinformatically detected regulatory, non protein coding, viral micro RNA (miRNA) gene. The method by which VGAM1489 was detected is described hereinabove with reference to FIGS. 1-8.

VGAM1489 gene, herein designated VGAM GENE, is a viral gene contained in the genome of Plum Pox Virus. VGAM1489 host target gene, herein designated VGAM HOST TARGET GENE, is a human gene contained in the human genome.

VGAM1489 gene encodes a VGAM1489 precursor RNA, herein designated VGAM PRECURSOR RNA. Similar to other miRNA genes, and unlike most ordinary genes, VGAM1489 precursor RNA does not encode a protein. A nucleotide sequence identical or highly similar to the nucleotide sequence of VGAM1489 precursor RNA is designated SEQ ID:1475, and is provided hereinbelow with reference to the sequence listing part. Nucleotide sequence SEQ ID:1475 is located at position 8790 relative to the genome of Plum Pox Virus.

VGAM1489 precursor RNA folds onto itself, forming VGAM1489 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1489 folded precursor RNA into VGAM1489 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 78%) nucleotide sequence of VGAM1489 RNA is designated SEQ ID:4200, and is provided hereinbelow with reference to the sequence listing part.

VGAM1489 host target gene, herein designated VGAM HOST TARGET GENE, encodes a corresponding messenger RNA, VGAM1489 host target RNA, herein designated VGAM HOST TARGET RNA. VGAM1489 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1489 RNA, herein designated VGAM RNA, binds complementarily to one or more host target binding sites located in untranslated regions of VGAM1489 host target RNA, herein designated VGAM HOST TARGET RNA. This complementary binding is due to the fact that the nucleotide sequence of VGAM1489 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1489 RNA, herein designated VGAM RNA, may have a different number of host target binding sites in untranslated regions of a VGAM1489 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1489 RNA, herein designated VGAM RNA, to host target binding sites on VGAM1489 host target RNA, herein designated VGAM HOST TARGET RNA, such as BINDING SITE I, BINDING SITE II and BINDING SITE III, inhibits translation of VGAM1489 host target RNA into VGAM1489 host target protein, herein designated VGAM HOST TARGET PROTEIN. VGAM host target protein is therefore outlined by a broken line.

It is appreciated that VGAM1489 host target gene, herein designated VGAM HOST TARGET GENE, in fact represents a plurality of VGAM1489 host target genes. The mRNA of each one of this plurality of VGAM1489 host target genes comprises one or more host target binding sites, each having a nucleotide sequence which is at least partly complementary to VGAM1489 RNA, herein designated VGAM RNA, and which when bound by VGAM1489 RNA causes inhibition of translation of respective one or more VGAM1489 host target proteins.

It is further appreciated by one skilled in the art that the mode of translational inhibition illustrated by FIG. 1 with specific reference to translational inhibition exerted by VGAM1489 gene, herein designated VGAM GENE, on one or more VGAM1489 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1489 is inhibition of expression of host target genes, as part of a novel viral mechanism of attacking a host. Accordingly, utilities of VGAM1489 include diagnosis, prevention and treatment of viral infection by Plum Pox Virus. Specific functions, and accordingly utilities, of VGAM1489 correlate with, and may be deduced from, the identity of the host target genes which VGAM1489 binds and inhibits, and the function of these host target genes, as elaborated hereinbelow.

Nucleotide sequences of the VGAM1489 precursor RNA, herein designated VGAM PRECURSOR RNA, and of the 'diced' VGAM1489 RNA, herein designated VGAM RNA, and a schematic representation of the secondary folding of VGAM1489 folded precursor RNA, herein designated VGAM FOLDED PRECURSOR RNA, of VGAM1489 are further described hereinbelow with reference to Table 1.

Nucleotide sequences of host target binding sites, such as BINDING SITE-I, BINDING SITE-II and BINDING SITE-III of FIG. 1, found on VGAM1489 host target RNA, and schematic representation of the complementarity of each of these host target binding sites to VGAM1489 RNA, herein designated VGAM RNA, are described hereinbelow with reference to Table 2.

As mentioned hereinabove with reference to FIG. 1, a function of VGAM1489 gene, herein designated VGAM is inhibition of expression of VGAM1489 target genes. It is appreciated that specific functions, and accordingly utilities, of VGAM1489 correlate with, and may be deduced from, the identity of the target genes which VGAM1489 binds and inhibits, and the function of these target genes, as elaborated hereinbelow.

IL2-inducible T-cell Kinase (ITK, Accession NM_005546) is a VGAM1489 host target gene. ITK BINDING SITE is HOST TARGET binding site found in the 3' untranslated region of mRNA encoded by ITK, corresponding to a HOST TARGET binding site such as BINDING SITE I, BINDING SITE II or BINDING SITE III. Table 2 illustrates the complementarity of the nucleotide sequences of ITK BINDING SITE, designated SEQ ID:12077, to the nucleotide sequence of VGAM1489 RNA, herein designated VGAM RNA, also designated SEQ ID:4200.

A function of VGAM1489 is therefore inhibition of IL2-inducible T-cell Kinase (ITK, Accession NM_005546), a gene which plays a role in t cell proliferation and differentiation. Accordingly, utilities of VGAM1489 include diagnosis, prevention and treatment of diseases and clinical conditions associated with ITK. The function of ITK and its association with various diseases and clinical conditions, has been established by previous studies, as described hereinabove with reference to VGAM288. Keratin, Hair, Acidic, 8 (KRTHA8, Accession NM_006771) is another VGAM1489 host target gene. KRTHA8 BINDING SITE is HOST TARGET binding site found in the 3' untranslated region of mRNA encoded by KRTHA8, corresponding to a HOST TARGET binding site such as BINDING SITE I, BINDING SITE II or BINDING SITE III. Table 2 illustrates the complementarity of the nucleotide sequences of KRTHA8 BINDING SITE, designated SEQ ID:13645, to the nucleotide sequence of VGAM1489 RNA, herein designated VGAM RNA, also designated SEQ ID:4200.

Another function of VGAM1489 is therefore inhibition of Keratin, Hair, Acidic, 8 (KRTHA8, Accession NM_006771), a gene which a type I keratin that may form intermediate filaments. Accordingly, utilities of VGAM1489 include diagnosis, prevention and treatment of diseases and clinical conditions associated with KRTHA8. The function of KRTHA8 and its association with various diseases and clinical conditions, has been established by previous studies, as described hereinabove with reference to VGAM910. TEM8 (Accession NM_032208) is another VGAM1489 host target gene. TEM8 BINDING SITE is HOST TARGET binding site found in the 3' untranslated region of mRNA encoded by TEM8, corresponding to a HOST TARGET binding site such as BINDING SITE I, BINDING SITE II or BINDING SITE III. Table 2 illustrates the complementarity of the nucleotide sequences of TEM8 BINDING SITE, designated SEQ ID:25918, to the nucleotide sequence of VGAM1489 RNA, herein designated VGAM RNA, also designated SEQ ID:4200.

Another function of VGAM1489 is therefore inhibition of TEM8 (Accession NM_032208), a gene which is a tumor-specific endothelial marker. Accordingly, utilities of VGAM1489 include diagnosis, prevention and treatment of diseases and clinical conditions associated with TEM8. The function of TEM8 has been established by previous studies. St. Croix et al. (2000) compared gene expression patterns of endothelial cells derived from blood vessels of normal and malignant colorectal tissues to identify genes involved in tumor angiogenesis. Among the genes they identified was TEM8, which encodes a 564-amino acid protein. Bradley et al. (2001) isolated a cDNA encoding ATR and determined that the first 364 amino acids of the 368-amino acid ATR protein are identical to those of TEM8. The C-terminal ends of the ATR and TEM8 proteins then diverge, presumably due to alternative splicing, such that ATR has a cytoplasmic tail of only 25 amino acids, whereas TEM8 has a cytoplasmic tail of 221 amino acids. (Bradley et al. (2001) noted in proof that another apparently full-length ATR/TEM8-related cDNA clone (GenBank BC01207) encodes a protein with yet another C-terminal end.) The ATR protein contains a 27-amino acid signal peptide; a 293-amino acid extracellular domain with 3 putative end-length glycosylation sites; and a 23-amino acid putative transmembrane region followed by the short cytoplasmic tail. An extracellular von Willebrand factor type A (VWA) domain is located between residues 44 and 216 of the ATR protein. The cytoplasmic tail of ATR contains an acidic cluster (EESEE) similar to a motif in the cytoplasmic tail of furin (OMIM Ref. No. 136950) that specifies basolateral sorting of this protease in polarized epithelial cells. The mouse homolog of ATR/TEM8 is highly related to the human clones, showing more than 98% sequence identity in the extracellular domain. ATR and/or TEM8 is expressed in a number of different tissues, including central nervous system, heart, lung, and lymphocytes. Bradley et al. (2001) confirmed that the VWA domain of ATR binds directly to the protective antigen of anthrax, suggesting that ATR may also function as a protective antigen receptor. They suggested that the finding that the soluble VWA domain of ATR inhibits toxin action, coupled with the use of the cloned receptor as a tool for identifying inhibitors of the protective antigen-receptor interaction, holds promise for the development of novel approaches for the treatment of anthrax.

Full details of the abovementioned studies are described in the following publications, the disclosure of which are hereby incorporated by reference:

St. Croix, B.; Rago, C.; Velculescu, V.; Traverso, G.; Romans, K. E.; Montgomery, E.; Lal, A.; Riggins, G. J.; Lengauer, C.; Vogelstein, B.; Kinzler, K. W.: Genes expressed in human tumor endothelium. Science 289:1197-1202, 2000; and Bradley, K. A.; Mogridge, J.; Mourez, M.; Collier, R. J.; Young, J. A. T.: Identification of the cellular receptor for anthrax toxin. Nature 414:160-161, 2001.

Further studies establishing the function and utilities of TEM8 are found in John Hopkins OMIM database record ID 606410, and in sited publications numbered 4533, 689 and 6907 listed in the bibliography section hereinbelow, which are also hereby incorporated by reference. BC022889 (Accession XM_096964) is another VGAM1489 host target gene. BC022889 BINDING SITE is HOST TARGET binding site found in the 3' untranslated region of mRNA encoded by BC022889, corresponding to a HOST TARGET binding site such as BINDING SITE I, BINDING SITE II or BINDING SITE III. Table 2 illustrates the complementarity of the nucleotide sequences of BC022889 BINDING SITE, designated SEQ ID:40684, to the nucleotide sequence of VGAM1489 RNA, herein designated VGAM RNA, also designated SEQ ID:4200.

Another function of VGAM1489 is therefore inhibition of BC022889 (Accession XM_096964). Accordingly, utilities of VGAM1489 include diagnosis, prevention and treatment of diseases and clinical conditions associated with BC022889. FLJ20546 (Accession NM_017872) is another VGAM1489 host target gene. FLJ20546 BINDING SITE is HOST TARGET binding site found in the 3' untranslated region of mRNA encoded by FLJ20546, corresponding to a HOST TARGET binding site such as BINDING SITE I, BINDING SITE II or BINDING SITE III. Table 2 illustrates the complementarity of the nucleotide sequences of FLJ20546 BINDING SITE, designated SEQ ID:19544, to the nucleotide sequence of VGAM1489 RNA, herein designated VGAM RNA, also designated SEQ ID:4200.

Another function of VGAM1489 is therefore inhibition of FLJ20546 (Accession NM_017872). Accordingly, utilities of VGAM1489 include diagnosis, prevention and treatment of diseases and clinical conditions associated with FLJ20546. FLJ20671 (Accession NM_017924) is another VGAM1489 host target gene. FLJ20671 BINDING SITE is HOST TARGET binding site found in the 3' untranslated region of mRNA encoded by FLJ20671, corresponding to a HOST TARGET binding site such as BINDING SITE I, BINDING SITE II or BINDING SITE III. Table 2 illustrates the complementarity of the nucleotide sequences of FLJ20671 BINDING SITE, designated SEQ ID:19592, to the nucleotide sequence of VGAM1489 RNA, herein designated VGAM RNA, also designated SEQ ID:4200.

Another function of VGAM1489 is therefore inhibition of FLJ20671 (Accession NM_017924). Accordingly, utilities of VGAM1489 include diagnosis, prevention and treatment of diseases and clinical conditions associated with FLJ20671. FLJ23121 (Accession NM_024694) is another VGAM1489 host target gene. FLJ23121 BINDING SITE is HOST TARGET binding site found in the 3' untranslated region of mRNA encoded by FLJ23121, corresponding to a HOST TARGET binding site such as BINDING SITE I, BINDING SITE II or BINDING SITE III. Table 2 illustrates the complementarity of the nucleotide sequences of FLJ23121 BINDING SITE, designated SEQ ID:24002, to the nucleotide sequence of VGAM1489 RNA, herein designated VGAM RNA, also designated SEQ ID:4200.

Another function of VGAM1489 is therefore inhibition of FLJ23121 (Accession NM_024694). Accordingly, utilities of VGAM1489 include diagnosis, prevention and treatment of diseases and clinical conditions associated with FLJ23121. KIAA1877 (Accession XM_038616) is another VGAM1489 host target gene. KIAA1877 BINDING SITE is HOST TARGET binding site found in the 3' untranslated region of mRNA encoded by KIAA1877, corresponding to a HOST TARGET binding site such as BINDING SITE I, BINDING SITE II or BINDING SITE III. Table 2 illustrates the complementarity of the nucleotide sequences of KIAA1877 BINDING SITE, designated SEQ ID:32882, to the nucleotide sequence of VGAM1489 RNA, herein designated VGAM RNA, also designated SEQ ID:4200.

Another function of VGAM1489 is therefore inhibition of KIAA1877 (Accession XM_038616). Accordingly, utilities of VGAM1489 include diagnosis, prevention and treatment of diseases and clinical conditions associated with KIAA1877. MGC20470 (Accession NM_145053) is another VGAM1489 host target gene. MGC20470 BINDING SITE is HOST TARGET binding site found in the 5' untranslated region of mRNA encoded by MGC20470, corresponding to a HOST TARGET binding site such as BINDING SITE I, BINDING SITE II or BINDING SITE III. Table 2 illustrates the complementarity of the nucleotide sequences of MGC20470 BINDING SITE, designated SEQ ID:29686, to the nucleotide sequence of VGAM1489 RNA, herein designated VGAM RNA, also designated SEQ ID:4200.

Another function of VGAM1489 is therefore inhibition of MGC20470 (Accession NM_145053). Accordingly, utilities of VGAM1489 include diagnosis, prevention and treatment of diseases and clinical conditions associated with MGC20470. MGC4400 (Accession NM_032679) is another VGAM1489 host target gene. MGC4400 BINDING SITE is HOST TARGET binding site found in the 3' untranslated region of mRNA encoded by MGC4400, corresponding to a HOST TARGET binding site such as BINDING SITE I, BINDING SITE II or BINDING SITE III. Table 2 illustrates the complementarity of the nucleotide sequences of MGC4400 BINDING SITE, designated SEQ ID:26400, to the nucleotide sequence of VGAM1489 RNA, herein designated VGAM RNA, also designated SEQ ID:4200.

Another function of VGAM1489 is therefore inhibition of MGC4400 (Accession NM_032679). Accordingly, utilities of VGAM1489 include diagnosis, prevention and treatment of diseases and clinical conditions associated with MGC4400. NLI-IF (Accession NM_021198) is another VGAM1489 host target gene. NLI-IF BINDING SITE is HOST TARGET binding site found in the 3' untranslated region of mRNA encoded by NLI-IF, corresponding to a HOST TARGET binding site such as BINDING SITE I, BINDING SITE II or BINDING SITE III. Table 2 illustrates the complementarity of the nucleotide sequences of NLI-IF BINDING SITE, designated SEQ ID:22174, to the nucleotide sequence of VGAM1489 RNA, herein designated VGAM RNA, also designated SEQ ID:4200.

Another function of VGAM1489 is therefore inhibition of NLI-IF (Accession NM_021198). Accordingly, utilities of VGAM1489 include diagnosis, prevention and treatment of diseases and clinical conditions associated with NLI-IF. Spir-2 (Accession XM_047462) is another VGAM1489 host target gene. Spir-2 BINDING SITE is HOST TARGET binding site found in the 3' untranslated region of mRNA encoded by Spir-2, corresponding to a HOST TARGET binding site such as BINDING SITE I, BINDING SITE II or BINDING SITE III. Table 2 illustrates the complementarity of the nucleotide sequences of Spir-2 BINDING SITE, designated SEQ ID:34964, to the nucleotide sequence of VGAM1489 RNA, herein designated VGAM RNA, also designated SEQ ID:4200.

Another function of VGAM1489 is therefore inhibition of Spir-2 (Accession XM_047462). Accordingly, utilities of VGAM1489 include diagnosis, prevention and treatment of diseases and clinical conditions associated with Spir-2. LOC120856 (Accession XM_058509) is another VGAM1489 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36640, to the nucleotide sequence of VGAM1489 RNA, herein designated VGAM RNA, also designated SEQ ID:4200.

Another function of VGAM1489 is therefore inhibition of LOC120856 (Accession XM_058509). Accordingly, utilities of VGAM1489 include diagnosis, prevention and treatment of diseases and clinical conditions associated with LOC120856. LOC143916 (Accession XM_084664) is another VGAM1489 host target gene. LOC143916 BINDING SITE is HOST TARGET binding site found in the 3' untranslated region of mRNA encoded by LOC143916, corresponding to a HOST TARGET binding site such as BINDING SITE I, BINDING SITE II or BINDING SITE III. Table 2 illustrates the complementarity of the nucleotide sequences of LOC143916 BINDING SITE, designated SEQ ID:37651, to the nucleotide sequence of VGAM1489 RNA, herein designated VGAM RNA, also designated SEQ ID:4200.

Another function of VGAM1489 is therefore inhibition of LOC143916 (Accession XM_084664). Accordingly, utilities of VGAM1489 include diagnosis, prevention and treatment of diseases and clinical conditions associated with LOC143916. LOC146506 (Accession XM_085489) is another VGAM1489 host target gene. LOC146506 BINDING SITE is HOST TARGET binding site found in the 3' untranslated region of mRNA encoded by LOC146506, corresponding to a HOST TARGET binding site such as BINDING SITE I, BINDING SITE II or BINDING SITE III. Table 2 illustrates the complementarity of the nucleotide sequences of LOC146506 BINDING SITE, designated SEQ ID:38180, to the nucleotide sequence of VGAM1489 RNA, herein designated VGAM RNA, also designated SEQ ID:4200.

Another function of VGAM1489 is therefore inhibition of LOC146506 (Accession XM_085489). Accordingly, utilities of VGAM1489 include diagnosis, prevention and treatment of diseases and clinical conditions associated with LOC146506. LOC152316 (Accession XM_098185) is another VGAM1489 host target gene. LOC152316 BINDING SITE is HOST TARGET binding site found in the 3' untranslated region of mRNA encoded by LOC152316, corresponding to a HOST TARGET binding site such as BINDING SITE I, BINDING SITE II or BINDING SITE III. Table 2 illustrates the complementarity of the nucleotide sequences of LOC152316 BINDING SITE, designated SEQ ID:41453, to the nucleotide sequence of VGAM1489 RNA, herein designated VGAM RNA, also designated SEQ ID:4200.

Another function of VGAM1489 is therefore inhibition of LOC152316 (Accession XM_098185). Accordingly, utilities of VGAM1489 include diagnosis, prevention and treatment of diseases and clinical conditions associated with LOC152316. LOC169026 (Accession XM_095471) is another VGAM1489 host target gene. LOC169026 BINDING SITE is HOST TARGET binding site found in the 3' untranslated region of mRNA encoded by LOC169026, corresponding to a HOST TARGET binding site such as BINDING SITE I, BINDING SITE II or BINDING SITE III. Table 2 illustrates the complementarity of the nucleotide sequences of LOC169026 BINDING SITE, designated SEQ ID:40266, to the nucleotide sequence of VGAM1489 RNA, herein designated VGAM RNA, also designated SEQ ID:4200.

Another function of VGAM1489 is therefore inhibition of LOC169026 (Accession XM_095471). Accordingly, utilities of VGAM1489 include diagnosis, prevention and treatment of diseases and clinical conditions associated with LOC169026. LOC221876 (Accession XM_168220) is another VGAM1489 host target gene. LOC221876 BINDING SITE is HOST TARGET binding site found in the 5' untranslated region of mRNA encoded by LOC221876, corresponding to a HOST TARGET binding site such as BINDING SITE I, BINDING SITE II or BINDING SITE III. Table 2 illustrates the complementarity of the nucleotide sequences of LOC221876 BINDING SITE, designated SEQ ID:45078, to the nucleotide sequence of VGAM1489 RNA, herein designated VGAM RNA, also designated SEQ ID:4200.

Another function of VGAM1489 is therefore inhibition of LOC221876 (Accession XM_168220). Accordingly, utilities of VGAM1489 include diagnosis, prevention and treatment of diseases and clinical conditions associated with LOC221876. FIG. 1 further provides a conceptual description of a novel bioinformatically detected viral gene of the present invention, referred to here as Viral Genomic Address Messenger 1490 (VGAM1490) viral gene, which modulates expression of respective host target genes thereof, the function and utility of which host target genes is known in the art.

VGAM1490 is a novel bioinformatically detected regulatory, non protein coding, viral micro RNA (miRNA) gene. The method by which VGAM1490 was detected is described hereinabove with reference to FIGS. 1-8.

VGAM1490 gene, herein designated VGAM GENE, is a viral gene contained in the genome of Plum Pox Virus. VGAM1490 host target gene, herein designated VGAM HOST TARGET GENE, is a human gene contained in the human genome.

VGAM1490 gene encodes a VGAM1490 precursor RNA, herein designated VGAM PRECURSOR RNA. Similar to other miRNA genes, and unlike most ordinary genes, VGAM1490 precursor RNA does not encode a protein. A nucleotide sequence identical or highly similar to the nucleotide sequence of VGAM1490 precursor RNA is designated SEQ ID:1476, and is provided hereinbelow with reference to the sequence listing part. Nucleotide sequence SEQ ID:1476 is located at position 5866 relative to the genome of Plum Pox Virus.

VGAM1490 precursor RNA folds onto itself, forming VGAM1490 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1490 folded precursor RNA into VGAM1490 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1490 RNA is designated SEQ ID:4201, and is provided hereinbelow with reference to the sequence listing part.

VGAM1490 host target gene, herein designated VGAM HOST TARGET GENE, encodes a corresponding messenger RNA, VGAM1490 host target RNA, herein designated VGAM HOST TARGET RNA. VGAM1490 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1490 RNA, herein designated VGAM RNA, binds complementarily to one or more host target binding sites located in untranslated regions of VGAM1490 host target RNA, herein designated VGAM HOST TARGET RNA. This complementary binding is due to the fact that the nucleotide sequence of VGAM1490 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1490 RNA, herein designated VGAM RNA, may have a different number of host target binding sites in untranslated regions of a VGAM1490 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1490 RNA, herein designated VGAM RNA, to host target binding sites on VGAM1490 host target RNA, herein designated VGAM HOST TARGET RNA, such as BINDING SITE I, BINDING SITE II and BINDING SITE III, inhibits translation of VGAM1490 host target RNA into VGAM1490 host target protein, herein designated VGAM HOST TARGET PROTEIN. VGAM host target protein is therefore outlined by a broken line.

It is appreciated that VGAM1490 host target gene, herein designated VGAM HOST TARGET GENE, in fact represents a plurality of VGAM1490 host target genes. The mRNA of each one of this plurality of VGAM1490 host target genes comprises one or more host target binding sites, each having a nucleotide sequence which is at least partly complementary to VGAM1490 RNA, herein designated VGAM RNA, and which when bound by VGAM1490 RNA causes inhibition of translation of respective one or more VGAM1490 host target proteins.

It is further appreciated by one skilled in the art that the mode of translational inhibition illustrated by FIG. 1 with specific reference to translational inhibition exerted by VGAM1490 gene, herein designated VGAM GENE, on one or more VGAM1490 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1490 is inhibition of expression of host target genes, as part of a novel viral mechanism of attacking a host. Accordingly, utilities of VGAM1490 include diagnosis, prevention and treatment of viral infection by Plum Pox Virus. Specific functions, and accordingly utilities, of VGAM1490 correlate with, and may be deduced from, the identity of the host target genes which VGAM1490 binds and inhibits, and the function of these host target genes, as elaborated hereinbelow.

Nucleotide sequences of the VGAM1490 precursor RNA, herein designated VGAM PRECURSOR RNA, and of the 'diced' VGAM1490 RNA, herein designated VGAM RNA, and a schematic representation of the secondary folding of VGAM1490 folded precursor RNA, herein designated VGAM FOLDED PRECURSOR RNA, of VGAM1490 are further described hereinbelow with reference to Table 1.

Nucleotide sequences of host target binding sites, such as BINDING SITE-I, BINDING SITE-II and BINDING SITE-III of FIG. 1, found on VGAM1490 host target RNA, and schematic representation of the complementarity of each of these host target binding sites to VGAM1490 RNA, herein designated VGAM RNA, are described hereinbelow with reference to Table 2.

As mentioned hereinabove with reference to FIG. 1, a function of VGAM1490 gene, herein designated VGAM is inhibition of expression of VGAM1490 target genes. It is appreciated that specific functions, and accordingly utilities, of VGAM1490 correlate with, and may be deduced from, the identity of the target genes which VGAM1490 binds and inhibits, and the function of these target genes, as elaborated hereinbelow.

FLJ13187 (Accession NM_024613) is a VGAM1490 host target gene. FLJ13187 BINDING SITE is HOST TARGET binding site found in the 3' untranslated region of mRNA encoded by FLJ13187, corresponding to a HOST TARGET binding site such as BINDING SITE I, BINDING SITE II or BINDING SITE III. Table 2 illustrates the complementarity of the nucleotide sequences of FLJ13187 BINDING SITE, designated SEQ ID:23869, to the nucleotide sequence of VGAM1490 RNA, herein designated VGAM RNA, also designated SEQ ID:4201.

A function of VGAM1490 is therefore inhibition of FLJ13187 (Accession NM_024613). Accordingly, utilities of VGAM1490 include diagnosis, prevention and treatment of diseases and clinical conditions associated with FLJ13187. PLU-1 (Accession NM_006618) is another VGAM1490 host target gene. PLU-1 BINDING SITE1 and PLU-1 BINDING SITE2 are HOST TARGET binding sites found in untranslated regions of mRNA encoded by PLU-1, corresponding to HOST TARGET binding sites such as BINDING SITE I, BINDING SITE II or BINDING SITE III. Table 2 illustrates the complementarity of the nucleotide sequences of PLU-1 BINDING SITE1 and PLU-1 BINDING SITE2, designated SEQ ID:13400 and SEQ ID:42249 respectively, to the nucleotide sequence of VGAM1490 RNA, herein designated VGAM RNA, also designated SEQ ID:4201.

Another function of VGAM1490 is therefore inhibition of PLU-1 (Accession NM_006618). Accordingly, utilities of VGAM1490 include diagnosis, prevention and treatment of diseases and clinical conditions associated with PLU-1. FIG. 1 further provides a conceptual description of a novel bioinformatically detected viral gene of the present invention, referred to here as Viral Genomic Address Messenger 1491 (VGAM1491) viral gene, which modulates expression of respective host target genes thereof, the function and utility of which host target genes is known in the art.

VGAM1491 is a novel bioinformatically detected regulatory, non protein coding, viral micro RNA (miRNA) gene. The method by which VGAM1491 was detected is described hereinabove with reference to FIGS. 1-8.

VGAM1491 gene, herein designated VGAM GENE, is a viral gene contained in the genome of Plum Pox Virus. VGAM1491 host target gene, herein designated VGAM HOST TARGET GENE, is a human gene contained in the human genome.

VGAM1491 gene encodes a VGAM1491 precursor RNA, herein designated VGAM PRECURSOR RNA. Similar to other miRNA genes, and unlike most ordinary genes, VGAM1491 precursor RNA does not encode a protein. A nucleotide sequence identical or highly similar to the nucleotide sequence of VGAM1491 precursor RNA is designated SEQ ID:1477, and is provided hereinbelow with reference to the sequence listing part. Nucleotide sequence SEQ ID:1477 is located at position 5456 relative to the genome of Plum Pox Virus.

VGAM1491 precursor RNA folds onto itself, forming VGAM1491 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1491 folded precursor RNA into VGAM1491 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1491 RNA is designated SEQ ID:4202, and is provided hereinbelow with reference to the sequence listing part.

VGAM1491 host target gene, herein designated VGAM HOST TARGET GENE, encodes a corresponding messenger RNA, VGAM1491 host target RNA, herein designated VGAM HOST TARGET RNA. VGAM1491 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1491 RNA, herein designated VGAM RNA, binds complementarily to one or more host target binding sites located in untranslated regions of VGAM1491 host target RNA, herein designated VGAM HOST TARGET RNA. This complementary binding is due to the fact that the nucleotide sequence of VGAM1491 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1491 RNA, herein designated VGAM RNA, may have a different number of host target binding sites in untranslated regions of a VGAM1491 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1491 RNA, herein designated VGAM RNA, to host target binding sites on VGAM1491 host target RNA, herein designated VGAM HOST TARGET RNA, such as BINDING SITE I, BINDING SITE II and BINDING SITE III, inhibits translation of VGAM1491 host target RNA into VGAM1491 host target protein, herein designated VGAM HOST TARGET PROTEIN. VGAM host target protein is therefore outlined by a broken line.

It is appreciated that VGAM1491 host target gene, herein designated VGAM HOST TARGET GENE, in fact represents a plurality of VGAM1491 host target genes. The mRNA of each one of this plurality of VGAM1491 host target genes comprises one or more host target binding sites, each having a nucleotide sequence which is at least partly complementary to VGAM1491 RNA, herein designated VGAM RNA, and which when bound by VGAM1491 RNA causes inhibition of translation of respective one or more VGAM1491 host target proteins.

It is further appreciated by one skilled in the art that the mode of translational inhibition illustrated by FIG. 1 with specific reference to translational inhibition exerted by VGAM1491 gene, herein designated VGAM GENE, on one or more VGAM1491 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1491 is inhibition of expression of host target genes, as part of a novel viral mechanism of attacking a host. Accordingly, utilities of VGAM1491 include diagnosis, prevention and treatment of viral infection by Plum Pox Virus. Specific functions, and accordingly utilities, of VGAM1491 correlate with, and may be deduced from, the identity of the host target genes which VGAM1491 binds and inhibits, and the function of these host target genes, as elaborated hereinbelow.

Nucleotide sequences of the VGAM1491 precursor RNA, herein designated VGAM PRECURSOR RNA, and of the 'diced' VGAM1491 RNA, herein designated VGAM RNA, and a schematic representation of the secondary folding of VGAM1491 folded precursor RNA, herein designated VGAM FOLDED PRECURSOR RNA, of VGAM1491 are further described hereinbelow with reference to Table 1.

Nucleotide sequences of host target binding sites, such as BINDING SITE-I, BINDING SITE-II and BINDING SITE-III of FIG. 1, found on VGAM1491 host target RNA, and schematic representation of the complementarity of each of these host target binding sites to VGAM1491 RNA, herein designated VGAM RNA, are described hereinbelow with reference to Table 2.

As mentioned hereinabove with reference to FIG. 1, a function of VGAM1491 gene, herein designated VGAM is inhibition of expression of VGAM1491 target genes. It is appreciated that specific functions, and accordingly utilities, of VGAM1491 correlate with, and may be deduced from, the identity of the target genes which VGAM1491 binds and inhibits, and the function of these target genes, as elaborated hereinbelow.

Immunoglobulin Superfamily Containing Leucine-rich Repeat (ISLR, Accession NM_005545) is a VGAM1491 host target gene. ISLR BINDING SITE is HOST TARGET binding site found in the 3' untranslated region of mRNA encoded by ISLR, corresponding to a HOST TARGET binding site such as BINDING SITE I, BINDING SITE II or BINDING SITE III. Table 2 illustrates the complementarity of the nucleotide sequences of ISLR BINDING SITE, designated SEQ ID:12072, to the nucleotide sequence of VGAM1491 RNA, herein designated VGAM RNA, also designated SEQ ID:4202.

A function of VGAM1491 is therefore inhibition of Immunoglobulin Superfamily Containing Leucine-rich Repeat (ISLR, Accession NM_005545). Accordingly, utilities of VGAM1491 include diagnosis, prevention and treatment of diseases and clinical conditions associated with ISLR. SON DNA Binding Protein (SON, Accession NM_058183) is another VGAM1491 host target gene. SON BINDING SITE1 through SON BINDING SITE3 are HOST TARGET binding sites found in untranslated regions of mRNA encoded by SON, corresponding to HOST TARGET binding sites such as BINDING SITE I, BINDING SITE II or BINDING SITE III. Table 2 illustrates the complementarity of the nucleotide sequences of SON BINDING SITE1 through SON BINDING SITE3, designated SEQ ID:27743, SEQ ID:29039 and SEQ ID:29044 respectively, to the nucleotide sequence of VGAM1491 RNA, herein designated VGAM RNA, also designated SEQ ID:4202.

Another function of VGAM1491 is therefore inhibition of SON DNA Binding Protein (SON, Accession NM_058183). Accordingly, utilities of VGAM1491 include diagnosis, prevention and treatment of diseases and clinical conditions associated with SON. DKFZP572C163 (Accession XM_028314) is another VGAM1491 host target gene. DKFZP572C163 BINDING SITE is HOST TARGET binding site found in the 5' untranslated region of mRNA encoded by DKFZP572C163, corresponding to a HOST TARGET binding site such as BINDING SITE I, BINDING SITE II or BINDING SITE III. Table 2 illustrates the complementarity of the nucleotide sequences of DKFZP572C163 BINDING SITE, designated SEQ ID:30655, to the nucleotide sequence of VGAM1491 RNA, herein designated VGAM RNA, also designated SEQ ID:4202.

Another function of VGAM1491 is therefore inhibition of DKFZP572C163 (Accession XM_028314). Accordingly, utilities of VGAM1491 include diagnosis, prevention and treatment of diseases and clinical conditions associated with DKFZP572C163. KIAA0416 (Accession NM_015564) is another VGAM1491 host target gene. KIAA0416 BINDING SITE is HOST TARGET binding site found in the 3' untranslated region of mRNA encoded by KIAA0416, corresponding to a HOST TARGET binding site such as BINDING SITE I, BINDING SITE II or BINDING SITE III. Table 2 illustrates the complementarity of the nucleotide sequences of KIAA0416 BINDING SITE, designated SEQ ID:17829, to the nucleotide sequence of VGAM1491 RNA, herein designated VGAM RNA, also designated SEQ ID:4202.

Another function of VGAM1491 is therefore inhibition of KIAA0416 (Accession NM_015564). Accordingly, utilities of VGAM1491 include diagnosis, prevention and treatment of diseases and clinical conditions associated with KIAA0416. MASA (Accession XM_035994) is another VGAM1491 host target gene. MASA BINDING SITE is HOST TARGET binding site found in the 3' untranslated region of mRNA encoded by MASA, corresponding to a HOST TARGET binding site such as BINDING SITE I, BINDING SITE II or BINDING SITE III. Table 2 illustrates the complementarity of the nucleotide sequences of MASA BINDING SITE, designated SEQ ID:32372, to the nucleotide sequence of VGAM1491 RNA, herein designated VGAM RNA, also designated SEQ ID:4202.

Another function of VGAM1491 is therefore inhibition of MASA (Accession XM_035994). Accordingly, utilities of VGAM1491 include diagnosis, prevention and treatment of diseases and clinical conditions associated with MASA. LOC152065 (Accession XM_098159) is another VGAM1491 host target gene. LOC152065 BINDING SITE is HOST TARGET binding site found in the 5' untranslated region of mRNA encoded by LOC152065, corresponding to a HOST TARGET binding site such as BINDING SITE I, BINDING SITE II or BINDING SITE III. Table 2 illustrates the complementarity of the nucleotide sequences of LOC152065 BINDING SITE, designated SEQ ID:41430, to the nucleotide sequence of VGAM1491 RNA, herein designated VGAM RNA, also designated SEQ ID:4202.

Another function of VGAM1491 is therefore inhibition of LOC152065 (Accession XM_098159). Accordingly, utilities of VGAM1491 include diagnosis, prevention and treatment of diseases and clinical conditions associated with LOC152065. LOC220766 (Accession XM_165471) is another VGAM1491 host target gene. LOC220766 BINDING SITE is HOST TARGET binding site found in the 5' untranslated region of mRNA encoded by LOC220766, corresponding to a HOST TARGET binding site such as BINDING SITE I, BINDING SITE II or BINDING SITE III. Table 2 illustrates the complementarity of the nucleotide sequences of LOC220766 BINDING SITE, designated SEQ ID:43652, to the nucleotide sequence of VGAM1491 RNA, herein designated VGAM RNA, also designated SEQ ID:4202.

Another function of VGAM1491 is therefore inhibition of LOC220766 (Accession XM_165471). Accordingly, utilities of VGAM1491 include diagnosis, prevention and treatment of diseases and clinical conditions associated with LOC220766. FIG. 1 further provides a conceptual description of a novel bioinformatically detected viral gene of the present invention, referred to here as Viral Genomic Address Messenger 1492 (VGAM1492) viral gene, which modulates expression of respective host target genes thereof, the function and utility of which host target genes is known in the art.

VGAM1492 is a novel bioinformatically detected regulatory, non protein coding, viral micro RNA (miRNA) gene. The method by which VGAM1492 was detected is described hereinabove with reference to FIGS. 1-8.

VGAM1492 gene, herein designated VGAM GENE, is a viral gene contained in the genome of Johnsongrass Mosaic Virus. VGAM1492 host target gene, herein designated VGAM HOST TARGET GENE, is a human gene contained in the human genome.

VGAM1492 gene encodes a VGAM1492 precursor RNA, herein designated VGAM PRECURSOR RNA. Similar to other miRNA genes, and unlike most ordinary genes, VGAM1492 precursor RNA does not encode a protein. A nucleotide sequence identical or highly similar to the nucleotide sequence of VGAM1492 precursor RNA is designated SEQ ID:1478, and is provided hereinbelow with reference to the sequence listing part. Nucleotide sequence SEQ ID:1478 is located at position 2047 relative to the genome of Johnsongrass Mosaic Virus.

VGAM1492 precursor RNA folds onto itself, forming VGAM1492 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1492 folded precursor RNA into VGAM1492 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 73%) nucleotide sequence of VGAM1492 RNA is designated SEQ ID:4203, and is provided hereinbelow with reference to the sequence listing part.

VGAM1492 host target gene, herein designated VGAM HOST TARGET GENE, encodes a corresponding messenger RNA, VGAM1492 host target RNA, herein designated VGAM HOST TARGET RNA. VGAM1492 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1492 RNA, herein designated VGAM RNA, binds complementarily to one or more host target binding sites located in untranslated regions of VGAM1492 host target RNA, herein designated VGAM HOST TARGET RNA. This complementary binding is due to the fact that the nucleotide sequence of VGAM1492 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1492 RNA, herein designated VGAM RNA, may have a different number of host target binding sites in untranslated regions of a VGAM1492 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1492 RNA, herein designated VGAM RNA, to host target binding sites on VGAM1492 host target RNA, herein designated VGAM HOST TARGET RNA, such as BINDING SITE I, BINDING SITE II and BINDING SITE III, inhibits translation of VGAM1492 host target RNA into VGAM1492 host target protein, herein designated VGAM HOST TARGET PROTEIN. VGAM host target protein is therefore outlined by a broken line.

It is appreciated that VGAM1492 host target gene, herein designated VGAM HOST TARGET GENE, in fact represents a plurality of VGAM1492 host target genes. The mRNA of each one of this plurality of VGAM1492 host target genes comprises one or more host target binding sites, each having a nucleotide sequence which is at least partly complementary to VGAM1492 RNA, herein designated VGAM RNA, and which when bound by VGAM1492 RNA causes inhibition of translation of respective one or more VGAM1492 host target proteins.

It is further appreciated by one skilled in the art that the mode of translational inhibition illustrated by FIG. 1 with specific reference to translational inhibition exerted by VGAM1492 gene, herein designated VGAM GENE, on one or more VGAM1492 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1492 is inhibition of expression of host target genes, as part of a novel viral mechanism of attacking a host. Accordingly, utilities of VGAM1492 include diagnosis, prevention and treatment of viral infection by Johnsongrass Mosaic Virus. Specific functions, and accordingly utilities, of VGAM1492 correlate with, and may be deduced from, the identity of the host target genes which VGAM1492 binds and inhibits, and the function of these host target genes, as elaborated hereinbelow.

Nucleotide sequences of the VGAM1492 precursor RNA, herein designated VGAM PRECURSOR RNA, and of the 'diced' VGAM1492 RNA, herein designated VGAM RNA, and a schematic representation of the secondary folding of VGAM1492 folded precursor RNA, herein designated VGAM FOLDED PRECURSOR RNA, of VGAM1492 are further described hereinbelow with reference to Table 1.

Nucleotide sequences of host target binding sites, such as BINDING SITE-I, BINDING SITE-II and BINDING SITE-III of FIG. 1, found on VGAM1492 host target RNA, and schematic representation of the complementarity of each of these host target binding sites to VGAM1492 RNA, herein designated VGAM RNA, are described hereinbelow with reference to Table 2.

As mentioned hereinabove with reference to FIG. 1, a function of VGAM1492 gene, herein designated VGAM is inhibition of expression of VGAM1492 target genes. It is appreciated that specific functions, and accordingly utilities, of VGAM1492 correlate with, and may be deduced from, the identity of the target genes which VGAM1492 binds and inhibits, and the function of these target genes, as elaborated hereinbelow.

CDC23 (cell division cycle 23, yeast, homolog) (CDC23, Accession NM_004661) is a VGAM1492 host target gene. CDC23 BINDING SITE is HOST TARGET binding site found in the 3' untranslated region of mRNA encoded by CDC23, corresponding to a HOST TARGET binding site such as BINDING SITE I, BINDING SITE II or BINDING SITE III. Table 2 illustrates the complementarity of the nucleotide sequences of CDC23 BINDING SITE, designated SEQ ID:11031, to the nucleotide sequence of VGAM1492 RNA, herein designated VGAM RNA, also designated SEQ ID:4203.

A function of VGAM1492 is therefore inhibition of CDC23 (cell division cycle 23, yeast, homolog) (CDC23, Accession NM_004661), a gene which is the cell cycle-regulated component of the mitotic cyclin degradation system. Accordingly, utilities of VGAM1492 include diagnosis, prevention and treatment of diseases and clinical conditions associated with CDC23. The function of CDC23 has been established by previous studies. is the cell cycle-regulated component of the mitotic cyclin degradation system.

Full details of the abovementioned studies are described in the following publications, the disclosure of which are hereby incorporated by reference:

Yu, H.; Peters, J.-M.; King, R. W.; Page, A. M.; Hieter, P.; Kirschner, M. W.: Identification of a cullin homology region in a subunit of the anaphase-promoting complex. Science 279:1219-1222, 1998; and Zhao, N.; Lai, F.; Fernald, A. A.; Eisenbart, J. D.; Espinosa, R., III.; Wang, P. W.; Le Beau, M. M.: Human CDC23: cDNA cloning, mapping to 5q31, genomic structure, and evaluation as a.

Further studies establishing the function and utilities of CDC23 are found in John Hopkins OMIM database record ID 603462, and in sited publications numbered 2878-2879 listed in the bibliography section hereinbelow, which are also hereby incorporated by reference. Egl Nine Homolog 3 (C. elegans) (EGLN3, Accession NM_022073) is another VGAM1492 host target gene. EGLN3 BINDING SITE is HOST TARGET binding site found in the 3' untranslated region of mRNA encoded by EGLN3, corresponding to a HOST TARGET binding site such as BINDING SITE I, BINDING SITE II or BINDING SITE III. Table 2 illustrates the complementarity of the nucleotide sequences of EGLN3 BINDING SITE, designated SEQ ID:22617, to the nucleotide sequence of VGAM1492 RNA, herein designated VGAM RNA, also designated SEQ ID:4203.

Another function of VGAM1492 is therefore inhibition of Egl Nine Homolog 3 (C. elegans) (EGLN3, Accession NM_022073), a gene which is an essential component of the pathway. Accordingly, utilities of VGAM1492 include diagnosis, prevention and treatment of diseases and clinical conditions associated with EGLN3. The function of EGLN3 and its association with various diseases and clinical conditions, has been established by previous studies, as described hereinabove with reference to VGAM206. Peroxisomal Farnesylated Protein (PXF, Accession NM_002857) is another VGAM1492 host target gene. PXF BINDING SITE is HOST TARGET binding site found in the 3' untranslated region of mRNA encoded by PXF, corresponding to a HOST TARGET binding site such as BINDING SITE I, BINDING SITE II or BINDING SITE III. Table 2 illustrates the complementarity of the nucleotide sequences of PXF BINDING SITE, designated SEQ ID:8749, to the nucleotide sequence of VGAM1492 RNA, herein designated VGAM RNA, also designated SEQ ID:4203.

Another function of VGAM1492 is therefore inhibition of Peroxisomal Farnesylated Protein (PXF, Accession NM_002857), a gene which may function in peroxisomal biogenesis or assembly. Accordingly, utilities of VGAM1492 include diagnosis, prevention and treatment of diseases and clinical conditions associated with PXF. The function of PXF and its association with various diseases and clinical conditions, has been established by previous studies, as described hereinabove with reference to VGAM193. Sodium Channel, Voltage-gated, Type I, Alpha Polypeptide (SCN1A, Accession XM_114281) is another VGAM1492 host target gene. SCN1A BINDING SITE is HOST TARGET binding site found in the 5" untranslated region of mRNA encoded by SCN1A, corresponding to a HOST TARGET binding site such as BINDING SITE I, BINDING SITE II or BINDING SITE III. Table 2 illustrates the complementarity of the nucleotide sequences of SCN1A BINDING SITE, designated SEQ ID:42829, to the nucleotide sequence of VGAM1492 RNA, herein designated VGAM RNA, also designated SEQ ID:4203.

Another function of VGAM1492 is therefore inhibition of Sodium Channel, Voltage-gated, Type I, Alpha Polypeptide (SCN1A, Accession XM_114281). Accordingly, utilities of VGAM1492 include diagnosis, prevention and treatment of diseases and clinical conditions associated with SCN1A. KIAA1260 (Accession XM_010461) is another VGAM1492 host target gene. KIAA1260 BINDING SITE is HOST TARGET binding site found in the 3' untranslated region of mRNA encoded by KIAA1260, corresponding to a HOST TARGET binding site such as BINDING SITE I, BINDING SITE II or BINDING SITE III. Table 2 illustrates the complementarity of the nucleotide sequences of KIAA1260 BINDING SITE, designated SEQ ID:30156, to the nucleotide sequence of VGAM1492 RNA, herein designated VGAM RNA, also designated SEQ ID:4203.

Another function of VGAM1492 is therefore inhibition of KIAA1260 (Accession XM_010461). Accordingly, utilities of VGAM1492 include diagnosis, prevention and treatment of diseases and clinical conditions associated with KIAA1260. LIM and SH3 Protein 1 (LASP1, Accession NM_006148) is another VGAM1492 host target gene. LASP1 BINDING SITE is HOST TARGET binding site found in the 3' untranslated region of mRNA encoded by LASP1, corresponding to a HOST TARGET binding site such as BINDING SITE I, BINDING SITE II or BINDING SITE III. Table 2 illustrates the complementarity of the nucleotide sequences of LASP1 BINDING SITE, designated SEQ ID:12799, to the nucleotide sequence of VGAM1492 RNA, herein designated VGAM RNA, also designated SEQ ID:4203.

Another function of VGAM1492 is therefore inhibition of LIM and SH3 Protein 1 (LASP1, Accession NM_006148). Accordingly, utilities of VGAM1492 include diagnosis, prevention and treatment of diseases and clinical conditions associated with LASP1. Nuclear Receptor Coactivator 2 (NCOA2, Accession NM_006540) is another VGAM1492 host target gene. NCOA2 BINDING SITE is HOST TARGET binding site found in the 3' untranslated region of mRNA encoded by NCOA2, corresponding to a HOST TARGET binding site such as BINDING SITE I, BINDING SITE II or BINDING SITE III. Table 2 illustrates the complementarity of the nucleotide sequences of NCOA2 BINDING SITE, designated SEQ ID:13293, to the nucleotide sequence of VGAM1492 RNA, herein designated VGAM RNA, also designated SEQ ID:4203.

Another function of VGAM1492 is therefore inhibition of Nuclear Receptor Coactivator 2 (NCOA2, Accession NM_006540). Accordingly, utilities of VGAM1492 include diagnosis, prevention and treatment of diseases and clinical conditions associated with NCOA2. SNRK (Accession NM_017719) is another VGAM1492 host target gene. SNRK BINDING SITE is HOST TARGET binding site found in the 3' untranslated region of mRNA encoded by SNRK, corresponding to a HOST TARGET binding site such as BINDING SITE I, BINDING SITE II or BINDING SITE III. Table 2 illustrates the complementarity of the nucleotide sequences of SNRK BINDING SITE, designated SEQ ID:19306, to the nucleotide sequence of VGAM1492 RNA, herein designated VGAM RNA, also designated SEQ ID:4203.

Another function of VGAM1492 is therefore inhibition of SNRK (Accession NM_017719). Accordingly, utilities of VGAM1492 include diagnosis, prevention and treatment of diseases and clinical conditions associated with SNRK. LOC145662 (Accession XM_085194) is another VGAM1492 host target gene. LOC145662 BINDING SITE is HOST TARGET binding site found in the 3' untranslated region of mRNA encoded by LOC145662, corresponding to a HOST TARGET binding site such as BINDING SITE I, BINDING SITE II or BINDING SITE III. Table 2 illustrates the complementarity of the nucleotide sequences of LOC145662 BINDING SITE, designated SEQ ID:37917, to the nucleotide sequence of VGAM1492 RNA, herein designated VGAM RNA, also designated SEQ ID:4203.

Another function of VGAM1492 is therefore inhibition of LOC145662 (Accession XM_085194). Accordingly, utilities of VGAM1492 include diagnosis, prevention and treatment of diseases and clinical conditions associated with LOC145662. LOC203350 (Accession XM_117536) is another VGAM1492 host target gene. LOC203350 BINDING SITE is HOST TARGET binding site found in the 3' untranslated region of mRNA encoded by LOC203350, corresponding to a HOST TARGET binding site such as BINDING SITE I, BINDING SITE II or BINDING SITE III. Table 2 illustrates the complementarity of the nucleotide sequences of LOC203350 BINDING SITE, designated SEQ ID:43530, to the nucleotide sequence of VGAM1492 RNA, herein designated VGAM RNA, also designated SEQ ID:4203.

Another function of VGAM1492 is therefore inhibition of LOC203350 (Accession XM_117536). Accordingly, utilities of VGAM1492 include diagnosis, prevention and treatment of diseases and clinical conditions associated with LOC203350. FIG. 1 further provides a conceptual description of a novel bioinformatically detected viral gene of the present invention, referred to here as Viral Genomic Address Messenger 1493 (VGAM1493) viral gene, which modulates expression of respective host target genes thereof, the function and utility of which host target genes is known in the art.

VGAM1493 is a novel bioinformatically detected regulatory, non protein coding, viral micro RNA (miRNA) gene. The method by which VGAM1493 was detected is described hereinabove with reference to FIGS. 1-8.

VGAM1493 gene, herein designated VGAM GENE, is a viral gene contained in the genome of Johnsongrass Mosaic Virus. VGAM1493 host target gene, herein designated VGAM HOST TARGET GENE, is a human gene contained in the human genome.

VGAM1493 gene encodes a VGAM1493 precursor RNA, herein designated VGAM PRECURSOR RNA. Similar to other miRNA genes, and unlike most ordinary genes, VGAM1493 precursor RNA does not encode a protein. A nucleotide sequence identical or highly similar to the nucleotide sequence of VGAM1493 precursor RNA is designated SEQ ID:1479, and is provided hereinbelow with reference to the sequence listing part. Nucleotide sequence SEQ ID:1479 is located at position 7469 relative to the genome of Johnsongrass Mosaic Virus.

VGAM1493 precursor RNA folds onto itself, forming VGAM1493 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1493 folded precursor RNA into VGAM1493 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1493 RNA is designated SEQ ID:4204, and is provided hereinbelow with reference to the sequence listing part.

VGAM1493 host target gene, herein designated VGAM HOST TARGET GENE, encodes a corresponding messenger RNA, VGAM1493 host target RNA, herein designated VGAM HOST TARGET RNA. VGAM1493 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1493 RNA, herein designated VGAM RNA, binds complementarily to one or more host target binding sites located in untranslated regions of VGAM1493 host target RNA, herein designated VGAM HOST TARGET RNA. This complementary binding is due to the fact that the nucleotide sequence of VGAM1493 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1493 RNA, herein designated VGAM RNA, may have a different number of host target binding sites in untranslated regions of a VGAM1493 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1493 RNA, herein designated VGAM RNA, to host target binding sites on VGAM1493 host target RNA, herein designated VGAM HOST TARGET RNA, such as BINDING SITE I, BINDING SITE II and BINDING SITE III, inhibits translation of VGAM1493 host target RNA into VGAM1493 host target protein, herein designated VGAM HOST TARGET PROTEIN. VGAM host target protein is therefore outlined by a broken line.

It is appreciated that VGAM1493 host target gene, herein designated VGAM HOST TARGET GENE, in fact represents a plurality of VGAM1493 host target genes. The mRNA of each one of this plurality of VGAM1493 host target genes comprises one or more host target binding sites, each having a nucleotide sequence which is at least partly complementary to VGAM1493 RNA, herein designated VGAM RNA, and which when bound by VGAM1493 RNA causes inhibition of translation of respective one or more VGAM1493 host target proteins.

It is further appreciated by one skilled in the art that the mode of translational inhibition illustrated by FIG. 1 with specific reference to translational inhibition exerted by VGAM1493 gene, herein designated VGAM GENE, on one or more VGAM1493 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1493 is inhibition of expression of host target genes, as part of a novel viral mechanism of attacking a host. Accordingly, utilities of VGAM1493 include diagnosis, prevention and treatment of viral infection by Johnsongrass Mosaic Virus. Specific functions, and accordingly utilities, of VGAM1493 correlate with, and may be deduced from, the identity of the host target genes which VGAM1493 binds and inhibits, and the function of these host target genes, as elaborated hereinbelow.

Nucleotide sequences of the VGAM1493 precursor RNA, herein designated VGAM PRECURSOR RNA, and of the 'diced' VGAM1493 RNA, herein designated VGAM RNA, and a schematic representation of the secondary folding of VGAM1493 folded precursor RNA, herein designated VGAM FOLDED PRECURSOR RNA, of VGAM1493 are further described hereinbelow with reference to Table 1.

Nucleotide sequences of host target binding sites, such as BINDING SITE-I, BINDING SITE-II and BINDING SITE-III of FIG. 1, found on VGAM1493 host target RNA, and schematic representation of the complementarity of each of these host target binding sites to VGAM1493 RNA, herein designated VGAM RNA, are described hereinbelow with reference to Table 2.

As mentioned hereinabove with reference to FIG. 1, a function of VGAM1493 gene, herein designated VGAM is inhibition of expression of VGAM1493 target genes. It is appreciated that specific functions, and accordingly utilities, of VGAM1493 correlate with, and may be deduced from, the identity of the target genes which VGAM1493 binds and inhibits, and the function of these target genes, as elaborated hereinbelow.

LIM Domain Kinase 1 (LIMK1, Accession NM_002314) is a VGAM1493 host target gene. LIMK1 BINDING SITE1 and LIMK1 BINDING SITE2 are HOST TARGET binding sites found in untranslated regions of mRNA encoded by LIMK1, corresponding to HOST TARGET binding sites such as BINDING SITE I, BINDING SITE II or BINDING SITE III. Table 2 illustrates the complementarity of the nucleotide sequences of LIMK1 BINDING SITE1 and LIMK1 BINDING SITE2, designated SEQ ID:8123 and SEQ ID:18794 respectively, to the nucleotide sequence of VGAM1493 RNA, herein designated VGAM RNA, also designated SEQ ID:4204.

A function of VGAM1493 is therefore inhibition of LIM Domain Kinase 1 (LIMK1, Accession NM_002314). Accordingly, utilities of VGAM1493 include diagnosis, prevention and treatment of diseases and clinical conditions associated with LIMK1. Nidogen (enactin) (NID, Accession NM_002508) is another VGAM1493 host target gene. NID BINDING SITE is HOST TARGET binding site found in the 3' untranslated region of mRNA encoded by NID, corresponding to a HOST TARGET binding site such as BINDING SITE I, BINDING SITE II or BINDING SITE III. Table 2 illustrates the complementarity of the nucleotide sequences of NID BINDING SITE, designated SEQ ID:8339, to the nucleotide sequence of VGAM1493 RNA, herein designated VGAM RNA, also designated SEQ ID:4204.

Another function of VGAM1493 is therefore inhibition of Nidogen (enactin) (NID, Accession NM_002508). Accordingly, utilities of VGAM1493 include diagnosis, prevention and treatment of diseases and clinical conditions associated with NID. PDGFA Associated Protein 1 (PDAP1, Accession XM_166484) is another VGAM1493 host target gene. PDAP1 BINDING SITE is HOST TARGET binding site found in the 3' untranslated region of mRNA encoded by PDAP1, corresponding to a HOST TARGET binding site such as BINDING SITE I, BINDING SITE II or BINDING SITE III. Table 2 illustrates the complementarity of the nucleotide sequences of PDAP1 BINDING SITE, designated SEQ ID:44421, to the nucleotide sequence of VGAM1493 RNA, herein designated VGAM RNA, also designated SEQ ID:4204.

Another function of VGAM1493 is therefore inhibition of PDGFA Associated Protein 1 (PDAP1, Accession XM_166484). Accordingly, utilities of VGAM1493 include diagnosis, prevention and treatment of diseases and clinical conditions associated with PDAP1. Ribosomal Protein L17 (RPL17, Accession NM_000985) is another VGAM1493 host target gene. RPL17 BINDING SITE is HOST TARGET binding site found in the 5' untranslated region of mRNA encoded by RPL17, corresponding to a HOST TARGET binding site such as BINDING SITE I, BINDING SITE II or BINDING SITE III. Table 2 illustrates the complementarity of the nucleotide sequences of RPL17 BINDING SITE, designated SEQ ID:6695, to the nucleotide sequence of VGAM1493 RNA, herein designated VGAM RNA, also designated SEQ ID:4204.

Another function of VGAM1493 is therefore inhibition of Ribosomal Protein L17 (RPL17, Accession NM_000985). Accordingly, utilities of VGAM1493 include diagnosis, prevention and treatment of diseases and clinical conditions associated with RPL17. TEM8 (Accession NM_032208) is another VGAM1493 host target gene. TEM8 BINDING SITE is HOST TARGET binding site found in the 3' untranslated region of mRNA encoded by TEM8, corresponding to a HOST TARGET binding site such as BINDING SITE I, BINDING SITE II or BINDING SITE III. Table 2 illustrates the complementarity of the nucleotide sequences of TEM8 BINDING SITE, designated SEQ ID:25916, to the nucleotide sequence of VGAM1493 RNA, herein designated VGAM RNA, also designated SEQ ID:4204.

Another function of VGAM1493 is therefore inhibition of TEM8 (Accession NM_032208), a gene which is a tumor-specific endothelial marker. Accordingly, utilities of VGAM1493 include diagnosis, prevention and treatment of diseases and clinical conditions associated with TEM8. The function of TEM8 and its association with various diseases and clinical conditions, has been established by previous studies, as described hereinabove with reference to VGAM1489. Zinc Finger Protein 264 (ZNF264, Accession NM_003417) is another VGAM1493 host target gene. ZNF264 BINDING SITE is HOST TARGET binding site found in the 3' untranslated region of mRNA encoded by ZNF264, corresponding to a HOST TARGET binding site such as BINDING SITE I, BINDING SITE II or BINDING SITE III. Table 2 illustrates the complementarity of the nucleotide sequences of ZNF264 BINDING SITE, designated SEQ ID:9454, to the nucleotide sequence of VGAM1493 RNA, herein designated VGAM RNA, also designated SEQ ID:4204.

Another function of VGAM1493 is therefore inhibition of Zinc Finger Protein 264 (ZNF264, Accession NM_003417). Accordingly, utilities of VGAM1493 include diagnosis, prevention and treatment of diseases and clinical conditions associated with ZNF264. Rho Guanine Exchange Factor (GEF) 16 (ARHGEF16, Accession NM_014448) is another VGAM1493 host target gene. ARHGEF16 BINDING SITE is HOST TARGET binding site found in the 5' untranslated region of mRNA encoded by ARHGEF16, corresponding to a HOST TARGET binding site such as BINDING SITE I, BINDING SITE II or BINDING SITE III. Table 2 illustrates the complementarity of the nucleotide sequences of ARHGEF16 BINDING SITE, designated SEQ ID:15799, to the nucleotide sequence of VGAM1493 RNA, herein designated VGAM RNA, also designated SEQ ID:4204.

Another function of VGAM1493 is therefore inhibition of Rho Guanine Exchange Factor (GEF) 16 (ARHGEF16, Accession NM_014448). Accordingly, utilities of VGAM1493 include diagnosis, prevention and treatment of diseases and clinical conditions associated with ARHGEF16. DKFZp761J139 (Accession NM_032280) is another VGAM1493 host target gene. DKFZp761J139 BINDING SITE is HOST TARGET binding site found in the 5' untranslated region of mRNA encoded by DKFZp761J139, corresponding to a HOST TARGET binding site such as BINDING SITE I, BINDING SITE II or BINDING SITE III. Table 2 illustrates the complementarity of the nucleotide sequences of DKFZp761J139 BINDING SITE, designated SEQ ID:26033, to the nucleotide sequence of VGAM1493 RNA, herein designated VGAM RNA, also designated SEQ ID:4204.

Another function of VGAM1493 is therefore inhibition of DKFZp761J139 (Accession NM_032280). Accordingly, utilities of VGAM1493 include diagnosis, prevention and treatment of diseases and clinical conditions associated with DKFZp761J139. DKFZp761N0624 (Accession NM_032295) is another VGAM1493 host target gene.

DKFZp761N0624 BINDING SITE is HOST TARGET binding site found in the 3' untranslated region of mRNA encoded by DKFZp761N0624, corresponding to a HOST TARGET binding site such as BINDING SITE I, BINDING SITE II or BINDING SITE III. Table 2 illustrates the complementarity of the nucleotide sequences of DKFZp761N0624 BINDING SITE, designated SEQ ID:26073, to the nucleotide sequence of VGAM1493 RNA, herein designated VGAM RNA, also designated SEQ ID:4204.

Another function of VGAM1493 is therefore inhibition of DKFZp761N0624 (Accession NM_032295). Accordingly, utilities of VGAM1493 include diagnosis, prevention and treatment of diseases and clinical conditions associated with DKFZp761N0624. DKFZp762E1511 (Accession XM_003460) is another VGAM1493 host target gene. DKFZp762E1511 BINDING SITE is HOST TARGET binding site found in the 3' untranslated region of mRNA encoded by DKFZp762E1511, corresponding to a HOST TARGET binding site such as BINDING SITE I, BINDING SITE II or BINDING SITE III. Table 2 illustrates the complementarity of the nucleotide sequences of DKFZp762E1511 BINDING SITE, designated SEQ ID:29932, to the nucleotide sequence of VGAM1493 RNA, herein designated VGAM RNA, also designated SEQ ID:4204.

Another function of VGAM1493 is therefore inhibition of DKFZp762E1511 (Accession XM_003460). Accordingly, utilities of VGAM1493 include diagnosis, prevention and treatment of diseases and clinical conditions associated with DKFZp762E1511. FLJ14917 (Accession NM_032861) is another VGAM1493 host target gene. FLJ14917 BINDING SITE is HOST TARGET binding site found in the 3' untranslated region of mRNA encoded by FLJ14917, corresponding to a HOST TARGET binding site such as BINDING SITE I, BINDING SITE II or BINDING SITE III. Table 2 illustrates the complementarity of the nucleotide sequences of FLJ14917 BINDING SITE, designated SEQ ID:26666, to the nucleotide sequence of VGAM1493 RNA, herein designated VGAM RNA, also designated SEQ ID:4204.

Another function of VGAM1493 is therefore inhibition of FLJ14917 (Accession NM_032861). Accordingly, utilities of VGAM1493 include diagnosis, prevention and treatment of diseases and clinical conditions associated with FLJ14917. KIAA1237 (Accession XM_087386) is another VGAM1493 host target gene. KIAA1237 BINDING SITE is HOST TARGET binding site found in the 3' untranslated region of mRNA encoded by KIAA1237, corresponding to a HOST TARGET binding site such as BINDING SITE I, BINDING SITE II or BINDING SITE III. Table 2 illustrates the complementarity of the nucleotide sequences of KIAA1237 BINDING SITE, designated SEQ ID:39219, to the nucleotide sequence of VGAM1493 RNA, herein designated VGAM RNA, also designated SEQ ID:4204.

Another function of VGAM1493 is therefore inhibition of KIAA1237 (Accession XM_087386). Accordingly, utilities of VGAM1493 include diagnosis, prevention and treatment of diseases and clinical conditions associated with KIAA1237. Neuropilin (NRP) and Tolloid (TLL)-like 2 (NETO2, Accession NM_018092) is another VGAM1493 host target gene. NETO2 BINDING SITE is HOST TARGET binding site found in the 3' untranslated region of mRNA encoded by NETO2, corresponding to a HOST TARGET binding site such as BINDING SITE I, BINDING SITE II or BINDING SITE III. Table 2 illustrates the complementarity of the nucleotide sequences of NETO2 BINDING SITE, designated SEQ ID:19861, to the nucleotide sequence of VGAM1493 RNA, herein designated VGAM RNA, also designated SEQ ID:4204.

Another function of VGAM1493 is therefore inhibition of Neuropilin (NRP) and Tolloid (TLL)-like 2 (NETO2, Accession NM_018092). Accordingly, utilities of VGAM1493 include diagnosis, prevention and treatment of diseases and clinical conditions associated with NETO2. Transient Receptor Potential Cation Channel, Subfamily M, Member 3 (TRPM3, Accession XM_036123) is another VGAM1493 host target gene. TRPM3 BINDING SITE is HOST TARGET binding site found in the 3' untranslated region of mRNA encoded by TRPM3, corresponding to a HOST TARGET binding site such as BINDING SITE I, BINDING SITE II or BINDING SITE III. Table 2 illustrates the complementarity of the nucleotide sequences of TRPM3 BINDING SITE, designated SEQ ID:32391, to the nucleotide sequence of VGAM1493 RNA, herein designated VGAM RNA, also designated SEQ ID:4204.

Another function of VGAM1493 is therefore inhibition of Transient Receptor Potential Cation Channel, Subfamily M, Member 3 (TRPM3, Accession XM_036123). Accordingly, utilities of VGAM1493 include diagnosis, prevention and treatment of diseases and clinical conditions associated with TRPM3. LOC142820 (Accession XM_084353) is another VGAM1493 host target gene. LOC142820 BINDING SITE is HOST TARGET binding site found in the 3' untranslated region of mRNA encoded by LOC142820, corresponding to a HOST TARGET binding site such as BINDING SITE I, BINDING SITE II or BINDING SITE III. Table 2 illustrates the complementarity of the nucleotide sequences of LOC142820 BINDING SITE, designated SEQ ID:37561, to the nucleotide sequence of VGAM1493 RNA, herein designated VGAM RNA, also designated SEQ ID:4204.

Another function of VGAM1493 is therefore inhibition of LOC142820 (Accession XM_084353). Accordingly, utilities of VGAM1493 include diagnosis, prevention and treatment of diseases and clinical conditions associated with LOC142820. LOC163682 (Accession XM_099402) is another VGAM1493 host target gene. LOC163682 BINDING SITE is HOST TARGET binding site found in the 5' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42088, to the nucleotide sequence of VGAM1493 RNA, herein designated VGAM RNA, also designated SEQ ID:4204.

Another function of VGAM1493 is therefore inhibition of LOC163682 (Accession XM_099402). Accordingly, utilities of VGAM1493 include diagnosis, prevention and treatment of diseases and clinical conditions associated with LOC163682. LOC51312 (Accession NM_018579) is another VGAM1493 host target gene. LOC51312 BINDING SITE is HOST TARGET binding site found in the 3' untranslated region of mRNA encoded by LOC51312, corresponding to a HOST TARGET binding site such as BINDING SITE I, BINDING SITE II or BINDING SITE III. Table 2 illustrates the complementarity of the nucleotide sequences of LOC51312 BINDING SITE, designated SEQ ID:20658, to the nucleotide sequence of VGAM1493 RNA, herein designated VGAM RNA, also designated SEQ ID:4204.

Another function of VGAM1493 is therefore inhibition of LOC51312 (Accession NM_018579). Accordingly, utilities of VGAM1493 include diagnosis, prevention and treatment of diseases and clinical conditions associated with LOC51312. FIG. 1 further provides a conceptual description of a novel bioinformatically detected viral gene of the present invention, referred to here as Viral Genomic Address Messenger 1494 (VGAM1494) viral gene, which modulates expression of respective host target genes thereof, the function and utility of which host target genes is known in the art.

VGAM1494 is a novel bioinformatically detected regulatory, non protein coding, viral micro RNA (miRNA) gene. The method by which VGAM1494 was detected is described hereinabove with reference to FIGS. 1-8.

VGAM1494 gene, herein designated VGAM GENE, is a viral gene contained in the genome of Johnsongrass Mosaic Virus. VGAM1494 host target gene, herein designated VGAM HOST TARGET GENE, is a human gene contained in the human genome.

VGAM1494 gene encodes a VGAM1494 precursor RNA, herein designated VGAM PRECURSOR RNA. Similar to other miRNA genes, and unlike most ordinary genes, VGAM1494 precursor RNA does not encode a protein. A nucleotide sequence identical or highly similar to the nucleotide sequence of VGAM1494 precursor RNA is designated SEQ ID:1480, and is provided hereinbelow with reference to the sequence listing part. Nucleotide sequence SEQ ID:1480 is located at position 656 relative to the genome of Johnsongrass Mosaic Virus.

VGAM1494 precursor RNA folds onto itself, forming VGAM1494 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1494 folded precursor RNA into VGAM1494 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1494 RNA is designated SEQ ID:4205, and is provided hereinbelow with reference to the sequence listing part.

VGAM1494 host target gene, herein designated VGAM HOST TARGET GENE, encodes a corresponding messenger RNA, VGAM1494 host target RNA, herein designated VGAM HOST TARGET RNA. VGAM1494 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1494 RNA, herein designated VGAM RNA, binds complementarily to one or more host target binding sites located in untranslated regions of VGAM1494 host target RNA, herein designated VGAM HOST TARGET RNA. This complementary binding is due to the fact that the nucleotide sequence of VGAM1494 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1494 RNA, herein designated VGAM RNA, may have a different number of host target binding sites in untranslated regions of a VGAM1494 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1494 RNA, herein designated VGAM RNA, to host target binding sites on VGAM1494 host target RNA, herein designated VGAM HOST TARGET RNA, such as BINDING SITE I, BINDING SITE II and BINDING SITE III, inhibits translation of VGAM1494 host target RNA into VGAM1494 host target protein, herein designated VGAM HOST TARGET PROTEIN. VGAM host target protein is therefore outlined by a broken line.

It is appreciated that VGAM1494 host target gene, herein designated VGAM HOST TARGET GENE, in fact represents a plurality of VGAM1494 host target genes. The mRNA of each one of this plurality of VGAM1494 host target genes comprises one or more host target binding sites, each having a nucleotide sequence which is at least partly complementary to VGAM1494 RNA, herein designated VGAM RNA, and which when bound by VGAM1494 RNA causes inhibition of translation of respective one or more VGAM1494 host target proteins.

It is further appreciated by one skilled in the art that the mode of translational inhibition illustrated by FIG. 1 with specific reference to translational inhibition exerted by VGAM1494 gene, herein designated VGAM GENE, on one or more VGAM1494 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1494 is inhibition of expression of host target genes, as part of a novel viral mechanism of attacking a host. Accordingly, utilities of VGAM1494 include diagnosis, prevention and treatment of viral infection by Johnsongrass Mosaic Virus. Specific functions, and accordingly utilities, of VGAM1494 correlate with, and may be deduced from, the identity of the host target genes which VGAM1494 binds and inhibits, and the function of these host target genes, as elaborated hereinbelow.

Nucleotide sequences of the VGAM1494 precursor RNA, herein designated VGAM PRECURSOR RNA, and of the 'diced' VGAM1494 RNA, herein designated VGAM RNA, and a schematic representation of the secondary folding of VGAM1494 folded precursor RNA, herein designated VGAM FOLDED PRECURSOR RNA, of VGAM1494 are further described hereinbelow with reference to Table 1.

Nucleotide sequences of host target binding sites, such as BINDING SITE-I, BINDING SITE-II and BINDING SITE-III of FIG. 1, found on VGAM1494 host target RNA, and schematic representation of the complementarity of each of these host target binding sites to VGAM1494 RNA, herein designated VGAM RNA, are described hereinbelow with reference to Table 2.

As mentioned hereinabove with reference to FIG. 1, a function of VGAM1494 gene, herein designated VGAM is inhibition of expression of VGAM1494 target genes. It is appreciated that specific functions, and accordingly utilities, of VGAM1494 correlate with, and may be deduced from, the identity of the target genes which VGAM1494 binds and inhibits, and the function of these target genes, as elaborated hereinbelow.

Calcium Channel, Voltage-dependent, Alpha 2/delta 3 Subunit (CACNA2D3, Accession NM_018398) is a VGAM1494 host target gene. CACNA2D3 BINDING SITE is HOST TARGET binding site found in the 5' untranslated region of mRNA encoded by CACNA2D3, corresponding to a HOST TARGET binding site such as BINDING SITE I, BINDING SITE II or BINDING SITE III. Table 2 illustrates the complementarity of the nucleotide sequences of CACNA2D3 BINDING SITE, designated SEQ ID:20434, to the nucleotide sequence of VGAM1494 RNA, herein designated VGAM RNA, also designated SEQ ID:4205.

A function of VGAM1494 is therefore inhibition of Calcium Channel, Voltage-dependent, Alpha 2/delta 3 Subunit (CACNA2D3, Accession NM_018398). Accordingly, utilities of VGAM1494 include diagnosis, prevention and treatment of diseases and clinical conditions associated with CACNA2D3. Folate Receptor 1 (adult) (FOLR1, Accession NM_016730) is another VGAM1494 host target gene. FOLR1 BINDING SITE is HOST TARGET binding site found in the 5' untranslated region of mRNA encoded by FOLR1, corresponding to a HOST TARGET binding site such as BINDING SITE I, BINDING SITE II or BINDING SITE III. Table 2 illustrates the complementarity of the nucleotide sequences of FOLR1 BINDING SITE, designated SEQ ID:18781, to the nucleotide sequence of VGAM1494 RNA, herein designated VGAM RNA, also designated SEQ ID:4205.

Another function of VGAM1494 is therefore inhibition of Folate Receptor 1 (adult) (FOLR1, Accession NM_016730), a gene which binds and initiates transport of folate and methotrexate. Accordingly, utilities of VGAM1494 include diagnosis, prevention and treatment of diseases and clinical conditions associated with FOLR1. The function of FOLR1 and its association with various diseases and clinical conditions, has been established by previous studies, as described hereinabove with reference to VGAM399. Sp3 Transcription Factor (SP3, Accession XM_092672) is another VGAM1494 host target gene. SP3 BINDING SITE is HOST TARGET binding site found in the 3' untranslated region of mRNA encoded by SP3, corresponding to a HOST TARGET binding site such as BINDING SITE I, BINDING SITE II or BINDING SITE III. Table 2 illustrates the complementarity of the nucleotide sequences of SP3 BINDING SITE, designated SEQ ID:40135, to the nucleotide sequence of VGAM1494 RNA, herein designated VGAM RNA, also designated SEQ ID:4205.

Another function of VGAM1494 is therefore inhibition of Sp3 Transcription Factor (SP3, Accession XM_092672), a gene which binds to gt and gc boxes promoters elements. Accordingly, utilities of VGAM1494 include diagnosis, prevention and treatment of diseases and clinical conditions associated with SP3. The function of SP3 and its association with various diseases and clinical conditions, has been established by previous studies, as described hereinabove with reference to VGAM861. COP9 (Accession NM_006710) is another VGAM1494 host target gene. COP9 BINDING SITE is HOST TARGET binding site found in the 3' untranslated region of mRNA encoded by COP9, corresponding to a HOST TARGET binding site such as BINDING SITE I, BINDING SITE II or BINDING SITE III. Table 2 illustrates the complementarity of the nucleotide sequences of COP9 BINDING SITE, designated SEQ ID:13533, to the nucleotide sequence of VGAM1494 RNA, herein designated VGAM RNA, also designated SEQ ID:4205.

Another function of VGAM1494 is therefore inhibition of COP9 (Accession NM_006710). Accordingly, utilities of VGAM1494 include diagnosis, prevention and treatment of diseases and clinical conditions associated with COP9. KIAA0303 (Accession XM_045292) is another VGAM1494 host target gene. KIAA0303 BINDING SITE is HOST TARGET binding site found in the 5' untranslated region of mRNA encoded by KIAA0303, corresponding to a HOST TARGET binding site such as BINDING SITE I, BINDING SITE II or BINDING SITE III. Table 2 illustrates the complementarity of the nucleotide sequences of KIAA0303 BINDING SITE, designated SEQ ID:34423, to the nucleotide sequence of VGAM1494 RNA, herein designated VGAM RNA, also designated SEQ ID:4205.

Another function of VGAM1494 is therefore inhibition of KIAA0303 (Accession XM_045292). Accordingly, utilities of VGAM1494 include diagnosis, prevention and treatment of diseases and clinical conditions associated with KIAA0303. KIAA1007 (Accession XM_168026) is another VGAM1494 host target gene. KIAA1007 BINDING SITE is HOST TARGET binding site found in the 5' untranslated region of mRNA encoded by KIAA1007, corresponding to a HOST TARGET binding site such as BINDING SITE I, BINDING SITE II or BINDING SITE III. Table 2 illustrates the complementarity of the nucleotide sequences of KIAA1007 BINDING SITE, designated SEQ ID:44947, to the nucleotide sequence of VGAM1494 RNA, herein designated VGAM RNA, also designated SEQ ID:4205.

Another function of VGAM1494 is therefore inhibition of KIAA1007 (Accession XM_168026). Accordingly, utilities of VGAM1494 include diagnosis, prevention and treatment of diseases and clinical conditions associated with KIAA1007. KIAA1336 (Accession XM_051306) is another VGAM1494 host target gene. KIAA1336 BINDING SITE is HOST TARGET binding site found in the 3' untranslated region of mRNA encoded by KIAA1336, corresponding to a HOST TARGET binding site such as BINDING SITE I, BINDING SITE II or BINDING SITE III. Table 2 illustrates the complementarity of the nucleotide sequences of KIAA1336 BINDING SITE, designated SEQ ID:35798, to the nucleotide sequence of VGAM1494 RNA, herein designated VGAM RNA, also designated SEQ ID:4205.

Another function of VGAM1494 is therefore inhibition of KIAA1336 (Accession XM_051306). Accordingly, utilities of VGAM1494 include diagnosis, prevention and treatment of diseases and clinical conditions associated with KIAA1336. NY-REN-60 (Accession XM_040506) is another VGAM1494 host target gene. NY-REN-60 BINDING SITE is HOST TARGET binding site found in the 3' untranslated region of mRNA encoded by NY-REN-60, corresponding to a HOST TARGET binding site such as BINDING SITE I, BINDING SITE II or BINDING SITE III. Table 2 illustrates the complementarity of the nucleotide sequences of NY-REN-60 BINDING SITE, designated SEQ ID:33318, to the nucleotide sequence of VGAM1494 RNA, herein designated VGAM RNA, also designated SEQ ID:4205.

Another function of VGAM1494 is therefore inhibition of NY-REN-60 (Accession XM_040506). Accordingly, utilities of VGAM1494 include diagnosis, prevention and treatment of diseases and clinical conditions associated with NY-REN-60. LOC152190 (Accession XM_045692) is another VGAM1494 host target gene. LOC152190 BINDING SITE is HOST TARGET binding site found in the 5' untranslated region of mRNA encoded by LOC152190, corresponding to a HOST TARGET binding site such as BINDING SITE I, BINDING SITE II or BINDING SITE III. Table 2 illustrates the complementarity of the nucleotide sequences of LOC152190 BINDING SITE, designated SEQ ID:34523, to the nucleotide sequence of VGAM1494 RNA, herein designated VGAM RNA, also designated SEQ ID:4205.

Another function of VGAM1494 is therefore inhibition of LOC152190 (Accession XM_045692). Accordingly, utilities of VGAM1494 include diagnosis, prevention and treatment of diseases and clinical conditions associated with LOC152190. LOC257471 (Accession XM_171020) is another VGAM1494 host target gene. LOC257471 BINDING SITE is HOST TARGET binding site found in the 3' untranslated region of mRNA encoded by LOC257471, corresponding to a HOST TARGET binding site such as BINDING SITE I, BINDING SITE II or BINDING SITE III. Table 2 illustrates the complementarity of the nucleotide sequences of LOC257471 BINDING SITE, designated SEQ ID:45787, to the nucleotide sequence of VGAM1494 RNA, herein designated VGAM RNA, also designated SEQ ID:4205.

Another function of VGAM1494 is therefore inhibition of LOC257471 (Accession XM_171020). Accordingly, utilities of VGAM1494 include diagnosis, prevention and treatment of diseases and clinical conditions associated with LOC257471. FIG. 1 further provides a conceptual description of a novel bioinformatically detected viral gene of the present invention, referred to here as Viral Genomic Address Messenger 1495 (VGAM1495) viral gene, which modulates expression of respective host target genes thereof, the function and utility of which host target genes is known in the art.

VGAM1495 is a novel bioinformatically detected regulatory, non protein coding, viral micro RNA (miRNA) gene. The method by which VGAM1495 was detected is described hereinabove with reference to FIGS. 1-8.

VGAM1495 gene, herein designated VGAM GENE, is a viral gene contained in the genome of Johnsongrass Mosaic Virus. VGAM1495 host target gene, herein designated VGAM HOST TARGET GENE, is a human gene contained in the human genome.

VGAM1495 gene encodes a VGAM1495 precursor RNA, herein designated VGAM PRECURSOR RNA. Similar to other miRNA genes, and unlike most ordinary genes, VGAM1495 precursor RNA does not encode a protein. A nucleotide sequence identical or highly similar to the nucleotide sequence of VGAM1495 precursor RNA is designated SEQ ID:1481, and is provided hereinbelow with reference to the sequence listing part. Nucleotide sequence SEQ ID:1481 is located at position 5140 relative to the genome of Johnsongrass Mosaic Virus.

VGAM1495 precursor RNA folds onto itself, forming VGAM1495 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1495 folded precursor RNA into VGAM1495 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM1495 RNA is designated SEQ ID:4206, and is provided hereinbelow with reference to the sequence listing part.

VGAM1495 host target gene, herein designated VGAM HOST TARGET GENE, encodes a corresponding messenger RNA, VGAM1495 host target RNA, herein designated VGAM HOST TARGET RNA. VGAM1495 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1495 RNA, herein designated VGAM RNA, binds complementarily to one or more host target binding sites located in untranslated regions of VGAM1495 host target RNA, herein designated VGAM HOST TARGET RNA. This complementary binding is due to the fact that the nucleotide sequence of VGAM1495 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1495 RNA, herein designated VGAM RNA, may have a different number of host target binding sites in untranslated regions of a VGAM1495 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1495 RNA, herein designated VGAM RNA, to host target binding sites on VGAM1495 host target RNA, herein designated VGAM HOST TARGET RNA, such as BINDING SITE I, BINDING SITE II and BINDING SITE III, inhibits translation of VGAM1495 host target RNA into VGAM1495 host target protein, herein designated VGAM HOST TARGET PROTEIN. VGAM host target protein is therefore outlined by a broken line.

It is appreciated that VGAM1495 host target gene, herein designated VGAM HOST TARGET GENE, in fact represents a plurality of VGAM1495 host target genes. The mRNA of each one of this plurality of VGAM1495 host target genes comprises one or more host target binding sites, each having a nucleotide sequence which is at least partly complementary to VGAM1495 RNA, herein designated VGAM RNA, and which when bound by VGAM1495 RNA causes inhibition of translation of respective one or more VGAM1495 host target proteins.

It is further appreciated by one skilled in the art that the mode of translational inhibition illustrated by FIG. 1 with specific reference to translational inhibition exerted by VGAM1495 gene, herein designated VGAM GENE, on one or more VGAM1495 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world’, Science 294,779 (2001)).

It is yet further appreciated that a function of VGAM1495 is inhibition of expression of host target genes, as part of a novel viral mechanism of attacking a host. Accordingly, utilities of VGAM1495 include diagnosis, prevention and treatment of viral infection by Johnsongrass Mosaic Virus. Specific functions, and accordingly utilities, of VGAM1495 correlate with, and may be deduced from, the identity of the host target genes which VGAM1495 binds and inhibits, and the function of these host target genes, as elaborated hereinbelow.

Nucleotide sequences of the VGAM1495 precursor RNA, herein designated VGAM PRECURSOR RNA, and of the 'diced' VGAM1495 RNA, herein designated VGAM RNA, and a schematic representation of the secondary folding of VGAM1495 folded precursor RNA, herein designated VGAM FOLDED PRECURSOR RNA, of VGAM1495 are further described hereinbelow with reference to Table 1.

Nucleotide sequences of host target binding sites, such as BINDING SITE-I, BINDING SITE-II and BINDING SITE-III of FIG. 1, found on VGAM1495 host target RNA, and schematic representation of the complementarity of each of these host target binding sites to VGAM1495 RNA, herein designated VGAM RNA, are described hereinbelow with reference to Table 2.

As mentioned hereinabove with reference to FIG. 1, a function of VGAM1495 gene, herein designated VGAM is inhibition of expression of VGAM1495 target genes. It is appreciated that specific functions, and accordingly utilities, of VGAM1495 correlate with, and may be deduced from, the identity of the target genes which VGAM1495 binds and inhibits, and the function of these target genes, as elaborated hereinbelow.

G Protein-coupled Receptor Kinase 7 (GPRK7, Accession NM_139209) is a VGAM1495 host target gene. GPRK7 BINDING SITE is HOST TARGET binding site found in the 3' untranslated region of mRNA encoded by GPRK7, corresponding to a HOST TARGET binding site such as BINDING SITE I, BINDING SITE II or BINDING SITE III. Table 2 illustrates the complementarity of the nucleotide sequences of GPRK7 BINDING SITE, designated SEQ ID:29229, to the nucleotide sequence of VGAM1495 RNA, herein designated VGAM RNA, also designated SEQ ID:4206.

A function of VGAM1495 is therefore inhibition of G Protein-coupled Receptor Kinase 7 (GPRK7, Accession NM_139209), a gene which may play a role in signal transduction pathways that involve calcium as a second messenger. Accordingly, utilities of VGAM1495 include diagnosis, prevention and treatment of diseases and clinical conditions associated with GPRK7. The function of GPRK7 and its association with various diseases and clinical conditions, has been established by previous studies, as described hereinabove with reference to VGAM640. CAGE (Accession XM_095071) is another VGAM1495 host target gene. CAGE BINDING SITE is HOST TARGET binding site found in the 5' untranslated region of mRNA encoded by CAGE, corresponding to a HOST TARGET binding site such as BINDING SITE I, BINDING SITE II or BINDING SITE III. Table 2 illustrates the complementarity of the nucleotide sequences of CAGE BINDING SITE, designated SEQ ID:40245, to the nucleotide sequence of VGAM1495 RNA, herein designated VGAM RNA, also designated SEQ ID:4206.

Another function of VGAM1495 is therefore inhibition of CAGE (Accession XM_095071). Accordingly, utilities of VGAM1495 include diagnosis, prevention and treatment of diseases and clinical conditions associated with CAGE. FLJ20079 (Accession NM_017656) is another VGAM1495 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19169, to the nucleotide sequence of VGAM1495 RNA, herein designated VGAM RNA, also designated SEQ ID:4206.

Another function of VGAM1495 is therefore inhibition of FLJ20079 (Accession NM_017656). Accordingly, utilities of VGAM1495 include diagnosis, prevention and treatment of diseases and clinical conditions associated with FLJ20079. HSA250839 (Accession NM_018401) is another VGAM1495 host target gene. HSA250839 BINDING SITE is HOST TARGET binding site found in the 3' untranslated region of mRNA encoded by HSA250839, corresponding to a HOST TARGET binding site such as BINDING SITE I, BINDING SITE II or BINDING SITE III. Table 2 illustrates the complementarity of the nucleotide sequences of HSA250839 BINDING SITE, designated SEQ ID:20437, to the nucleotide sequence of VGAM1495 RNA, herein designated VGAM RNA, also designated SEQ ID:4206.

Another function of VGAM1495 is therefore inhibition of HSA250839 (Accession NM_018401). Accordingly, utilities of VGAM1495 include diagnosis, prevention and treatment of diseases and clinical conditions associated with HSA250839. KIAA0376 (Accession XM_037759) is another VGAM1495 host target gene. KIAA0376 BINDING SITE is HOST TARGET binding site found in the 3' untranslated region of mRNA encoded by KIAA0376, corresponding to a HOST TARGET binding site such as BINDING SITE I, BINDING SITE II or BINDING SITE III. Table 2 illustrates the complementarity of the nucleotide sequences of KIAA0376 BINDING SITE, designated SEQ ID:32672, to the nucleotide sequence of VGAM1495 RNA, herein designated VGAM RNA, also designated SEQ ID:4206.

Another function of VGAM1495 is therefore inhibition of KIAA0376 (Accession XM_037759). Accordingly, utilities of VGAM1495 include diagnosis, prevention and treatment of diseases and clinical conditions associated with KIAA0376. pcnp (Accession NM_020357) is another VGAM1495 host target gene. pcnp BINDING SITE is HOST TARGET binding site found in the 3' untranslated region of mRNA encoded by pcnp, corresponding to a HOST TARGET binding site such as BINDING SITE I, BINDING SITE II or BINDING SITE III. Table 2 illustrates the complementarity of the nucleotide sequences of pcnp BINDING SITE, designated SEQ ID:21626, to the nucleotide sequence of VGAM1495 RNA, herein designated VGAM RNA, also designated SEQ ID:4206.

Another function of VGAM1495 is therefore inhibition of pcnp (Accession NM_020357). Accordingly, utilities of VGAM1495 include diagnosis, prevention and treatment of diseases and clinical conditions associated with pcnp. LOC145854 (Accession XM_085259) is another VGAM1495 host target gene. LOC145854 BINDING SITE is HOST TARGET binding site found in the 3' untranslated region of mRNA encoded by LOC145854, corresponding to a HOST TARGET binding site such as BINDING SITE I, BINDING SITE II or BINDING SITE III. Table 2 illustrates the complementarity of the nucleotide sequences of LOC145854 BINDING SITE, designated SEQ ID:38006, to the nucleotide sequence of VGAM1495 RNA, herein designated VGAM RNA, also designated SEQ ID:4206.

Another function of VGAM1495 is therefore inhibition of LOC145854 (Accession XM_085259). Accordingly, utilities of VGAM1495 include diagnosis, prevention and treatment of diseases and clinical conditions associated with LOC145854. LOC152271 (Accession XM_087419) is another VGAM1495 host target gene. LOC152271 BIND- ING SITE is HOST TARGET binding site found in the 5' untranslated region of mRNA encoded by LOC152271, corresponding to a HOST TARGET binding site such as BINDING SITE I, BINDING SITE II or BINDING SITE III. Table 2 illustrates the complementarity of the nucleotide sequences of LOC152271 BINDING SITE, designated SEQ ID:39238, to the nucleotide sequence of VGAM1495 RNA, herein designated VGAM RNA, also designated SEQ ID:4206.

Another function of VGAM1495 is therefore inhibition of LOC152271 (Accession XM_087419). Accordingly, utilities of VGAM1495 include diagnosis, prevention and treatment of diseases and clinical conditions associated with LOC152271. LOC152315 (Accession XM_087440) is another VGAM1495 host target gene. LOC152315 BINDING SITE is HOST TARGET binding site found in the 5' untranslated region of mRNA encoded by LOC152315, corresponding to a HOST TARGET binding site such as BINDING SITE I, BINDING SITE II or BINDING SITE III. Table 2 illustrates the complementarity of the nucleotide sequences of LOC152315 BINDING SITE, designated SEQ ID:39256, to the nucleotide sequence of VGAM1495 RNA, herein designated VGAM RNA, also designated SEQ ID:4206.

Another function of VGAM1495 is therefore inhibition of LOC152315 (Accession XM_087440). Accordingly, utilities of VGAM1495 include diagnosis, prevention and treatment of diseases and clinical conditions associated with LOC152315. LOC219919 (Accession XM_167785) is another VGAM1495 host target gene. LOC219919 BINDING SITE is HOST TARGET binding site found in the 5' untranslated region of mRNA encoded by LOC219919, corresponding to a HOST TARGET binding site such as BINDING SITE I, BINDING SITE II or BINDING SITE III. Table 2 illustrates the complementarity of the nucleotide sequences of LOC219919 BINDING SITE, designated SEQ ID:44799, to the nucleotide sequence of VGAM1495 RNA, herein designated VGAM RNA, also designated SEQ ID:4206.

Another function of VGAM1495 is therefore inhibition of LOC219919 (Accession XM_167785). Accordingly, utilities of VGAM1495 include diagnosis, prevention and treatment of diseases and clinical conditions associated with LOC219919. FIG. 1 further provides a conceptual description of a novel bioinformatically detected viral gene of the present invention, referred to here as Viral Genomic Address Messenger 1496 (VGAM1496) viral gene, which modulates expression of respective host target genes thereof, the function and utility of which host target genes is known in the art.

VGAM1496 is a novel bioinformatically detected regulatory, non protein coding, viral micro RNA (miRNA) gene. The method by which VGAM1496 was detected is described hereinabove with reference to FIGS. 1-8.

VGAM1496 gene, herein designated VGAM GENE, is a viral gene contained in the genome of Alcelaphine Herpesvirus 1. VGAM1496 host target gene, herein designated VGAM HOST TARGET GENE, is a human gene contained in the human genome.

VGAM1496 gene encodes a VGAM1496 precursor RNA, herein designated VGAM PRECURSOR RNA. Similar to other miRNA genes, and unlike most ordinary genes, VGAM1496 precursor RNA does not encode a protein. A nucleotide sequence identical or highly similar to the nucleotide sequence of VGAM1496 precursor RNA is designated SEQ ID:1482, and is provided hereinbelow with reference to the sequence listing part. Nucleotide sequence SEQ ID:1482 is located at position 110360 relative to the genome of Alcelaphine Herpesvirus 1.

VGAM1496 precursor RNA folds onto itself, forming VGAM1496 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1496 folded precursor RNA into VGAM1496 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1496 RNA is designated SEQ ID:4207, and is provided hereinbelow with reference to the sequence listing part.

VGAM1496 host target gene, herein designated VGAM HOST TARGET GENE, encodes a corresponding messenger RNA, VGAM1496 host target RNA, herein designated VGAM HOST TARGET RNA. VGAM1496 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1496 RNA, herein designated VGAM RNA, binds complementarily to one or more host target binding sites located in untranslated regions of VGAM1496 host target RNA, herein designated VGAM HOST TARGET RNA. This complementary binding is due to the fact that the nucleotide sequence of VGAM1496 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1496 RNA, herein designated VGAM RNA, may have a different number of host target binding sites in untranslated regions of a VGAM1496 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1496 RNA, herein designated VGAM RNA, to host target binding sites on VGAM1496 host target RNA, herein designated VGAM HOST TARGET RNA, such as BINDING SITE I, BINDING SITE II and BINDING SITE III, inhibits translation of VGAM1496 host target RNA into VGAM1496 host target protein, herein designated VGAM HOST TARGET PROTEIN. VGAM host target protein is therefore outlined by a broken line.

It is appreciated that VGAM1496 host target gene, herein designated VGAM HOST TARGET GENE, in fact represents a plurality of VGAM1496 host target genes. The mRNA of each one of this plurality of VGAM1496 host target genes comprises one or more host target binding sites, each having a nucleotide sequence which is at least partly complementary to VGAM1496 RNA, herein designated VGAM RNA, and which when bound by VGAM1496 RNA causes inhibition of translation of respective one or more VGAM1496 host target proteins.

It is further appreciated by one skilled in the art that the mode of translational inhibition illustrated by FIG. 1 with specific reference to translational inhibition exerted by VGAM1496 gene, herein designated VGAM GENE, on one or more VGAM1496 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1496 is inhibition of expression of host target genes, as part of a novel viral mechanism of attacking a host. Accordingly, utilities of VGAM1496 include diagnosis, prevention and treatment of viral infection by Alcelaphine Herpesvirus 1. Specific functions, and accordingly utilities, of VGAM1496 correlate with, and may be deduced from, the identity of the host target genes which VGAM1496 binds and inhibits, and the function of these host target genes, as elaborated hereinbelow.

Nucleotide sequences of the VGAM1496 precursor RNA, herein designated VGAM PRECURSOR RNA, and of the 'diced' VGAM1496 RNA, herein designated VGAM RNA, and a schematic representation of the secondary folding of VGAM1496 folded precursor RNA, herein designated VGAM FOLDED PRECURSOR RNA, of VGAM1496 are further described hereinbelow with reference to Table 1.

Nucleotide sequences of host target binding sites, such as BINDING SITE-I, BINDING SITE-II and BINDING SITE-III of FIG. 1, found on VGAM1496 host target RNA, and schematic representation of the complementarity of each of these host target binding sites to VGAM1496 RNA, herein designated VGAM RNA, are described hereinbelow with reference to Table 2.

As mentioned hereinabove with reference to FIG. 1, a function of VGAM1496 gene, herein designated VGAM is inhibition of expression of VGAM1496 target genes. It is appreciated that specific functions, and accordingly utilities, of VGAM1496 correlate with, and may be deduced from, the identity of the target genes which VGAM1496 binds and inhibits, and the function of these target genes, as elaborated hereinbelow.

Cyclin-dependent Kinase Inhibitor 2B (p15, inhibits CDK4) (CDKN2B, Accession NM_078487) is a VGAM1496 host target gene. CDKN2B BINDING SITE is HOST TARGET binding site found in the 3' untranslated region of mRNA encoded by CDKN2B, corresponding to a HOST TARGET binding site such as BINDING SITE I, BINDING SITE II or BINDING SITE III. Table 2 illustrates the complementarity of the nucleotide sequences of CDKN2B BINDING SITE, designated SEQ ID:27807, to the nucleotide sequence of VGAM1496 RNA, herein designated VGAM RNA, also designated SEQ ID:4207.

A function of VGAM1496 is therefore inhibition of Cyclin-dependent Kinase Inhibitor 2B (p15, inhibits CDK4) (CDKN2B, Accession NM_078487). Accordingly, utilities of VGAM1496 include diagnosis, prevention and treatment of diseases and clinical conditions associated with CDKN2B. ATIP1 (Accession NM_020749) is another VGAM1496 target gene. ATIP1 BINDING SITE is HOST TARGET binding site found in the 3' untranslated region of mRNA encoded by ATIP1, corresponding to a HOST TARGET binding site such as BINDING SITE I, BINDING SITE II or BINDING SITE III. Table 2 illustrates the complementarity of the nucleotide sequences of ATIP1 BINDING SITE, designated SEQ ID:21860, to the nucleotide sequence of VGAM1496 RNA, herein designated VGAM RNA, also designated SEQ ID:4207.

Another function of VGAM1496 is therefore inhibition of ATIP1 (Accession NM_020749). Accordingly, utilities of VGAM1496 include diagnosis, prevention and treatment of diseases and clinical conditions associated with ATIP1. DKFZp761D221 (Accession NM_032291) is another VGAM1496 host target gene. DKFZp761D221 BINDING SITE is HOST TARGET binding site found in the 3' untranslated region of mRNA encoded by DKFZp761D221, corresponding to a HOST TARGET binding site such as BINDING SITE I, BINDING SITE II or BINDING SITE III. Table 2 illustrates the complementarity of the nucleotide sequences of DKFZp761D221 BINDING SITE, designated SEQ ID:26054, to the nucleotide sequence of VGAM1496 RNA, herein designated VGAM RNA, also designated SEQ ID:4207.

Another function of VGAM1496 is therefore inhibition of DKFZp761D221 (Accession NM_032291). Accordingly, utilities of VGAM1496 include diagnosis, prevention and treatment of diseases and clinical conditions associated with DKFZp761D221. FLJ00026 (Accession XM_036307) is another VGAM1496 host target gene. FLJ00026 BINDING SITE is HOST TARGET binding site found in the 3' untranslated region of mRNA encoded by FLJ00026, corresponding to a HOST TARGET binding site such as BINDING SITE I, BINDING SITE II or BINDING SITE III. Table 2 illustrates the complementarity of the nucleotide sequences of FLJ00026 BINDING SITE, designated SEQ ID:32425, to the nucleotide sequence of VGAM1496 RNA, herein designated VGAM RNA, also designated SEQ ID:4207.

Another function of VGAM1496 is therefore inhibition of FLJ00026 (Accession XM_036307). Accordingly, utilities of VGAM1496 include diagnosis, prevention and treatment of diseases and clinical conditions associated with FLJ00026. HCA127 (Accession NM_018684) is another VGAM1496 host target gene. HCA127 BINDING SITE is HOST TARGET binding site found in the 3' untranslated region of mRNA encoded by HCA127, corresponding to a HOST TARGET binding site such as BINDING SITE I, BINDING SITE II or BINDING SITE III. Table 2 illustrates the complementarity of the nucleotide sequences of HCA127 BINDING SITE, designated SEQ ID:20755, to the nucleotide sequence of VGAM1496 RNA, herein designated VGAM RNA, also designated SEQ ID:4207.

Another function of VGAM1496 is therefore inhibition of HCA127 (Accession NM_018684). Accordingly, utilities of VGAM1496 include diagnosis, prevention and treatment of diseases and clinical conditions associated with HCA127. Tumor Protein D52 (TPD52, Accession NM_005079) is another VGAM1496 host target gene. TPD52 BINDING SITE is HOST TARGET binding site found in the 3' untranslated region of mRNA encoded by TPD52, corresponding to a HOST TARGET binding site such as BINDING SITE I, BINDING SITE II or BINDING SITE III. Table 2 illustrates the complementarity of the nucleotide sequences of TPD52 BINDING SITE, designated SEQ ID:11529, to the nucleotide sequence of VGAM1496 RNA, herein designated VGAM RNA, also designated SEQ ID:4207.

Another function of VGAM1496 is therefore inhibition of Tumor Protein D52 (TPD52, Accession NM_005079). Accordingly, utilities of VGAM1496 include diagnosis, prevention and treatment of diseases and clinical conditions associated with TPD52. LOC115073 (Accession XM_055193) is another VGAM1496 host target gene. LOC115073 BINDING SITE is HOST TARGET binding site found in the 3' untranslated region of mRNA encoded by LOC115073, corresponding to a HOST TARGET binding site such as BINDING SITE I, BINDING SITE II or BINDING SITE III. Table 2 illustrates the complementarity of the nucleotide sequences of LOC115073 BINDING SITE, designated SEQ ID:36235, to the nucleotide sequence of VGAM1496 RNA, herein designated VGAM RNA, also designated SEQ ID:4207.

Another function of VGAM1496 is therefore inhibition of LOC115073 (Accession XM_055193). Accordingly, utilities of VGAM1496 include diagnosis, prevention and treatment of diseases and clinical conditions associated with LOC115073. LOC221641 (Accession XM_168090) is another VGAM1496 host target gene. LOC221641 BINDING SITE is HOST TARGET binding site found in the 5' untranslated region of mRNA encoded by LOC221641, corresponding to a HOST TARGET binding site such as BINDING SITE I, BINDING SITE II or BINDING SITE III. Table 2 illustrates the complementarity of the nucleotide sequences of LOC221641 BINDING SITE, designated SEQ ID:45007, to the nucleotide sequence of VGAM1496 RNA, herein designated VGAM RNA, also designated SEQ ID:4207.

Another function of VGAM1496 is therefore inhibition of LOC221641 (Accession XM_168090). Accordingly, utilities of VGAM1496 include diagnosis, prevention and treatment of diseases and clinical conditions associated with LOC221641. LOC91250 (Accession XM_037135) is another VGAM1496 host target gene. LOC91250 BINDING SITE is HOST TARGET binding site found in the 5' untranslated region of mRNA encoded by LOC91250, corresponding to a HOST TARGET binding site such as BINDING SITE I, BINDING SITE II or BINDING SITE III. Table 2 illustrates the complementarity of the nucleotide sequences of LOC91250 BINDING SITE, designated SEQ ID:32545, to the nucleotide sequence of VGAM1496 RNA, herein designated VGAM RNA, also designated SEQ ID:4207.

Another function of VGAM1496 is therefore inhibition of LOC91250 (Accession XM_037135). Accordingly, utilities of VGAM1496 include diagnosis, prevention and treatment of diseases and clinical conditions associated with LOC91250. FIG. 1 further provides a conceptual description of a novel bioinformatically detected viral gene of the present invention, referred to here as Viral Genomic Address Messenger 1497 (VGAM1497) viral gene, which modulates expression of respective host target genes thereof, the function and utility of which host target genes is known in the art.

VGAM1497 is a novel bioinformatically detected regulatory, non protein coding, viral micro RNA (miRNA) gene. The method by which VGAM1497 was detected is described hereinabove with reference to FIGS. 1-8.

VGAM1497 gene, herein designated VGAM GENE, is a viral gene contained in the genome of Alcelaphine Herpesvirus 1. VGAM1497 host target gene, herein designated VGAM HOST TARGET GENE, is a human gene contained in the human genome.

VGAM1497 gene encodes a VGAM1497 precursor RNA, herein designated VGAM PRECURSOR RNA. Similar to other miRNA genes, and unlike most ordinary genes, VGAM1497 precursor RNA does not encode a protein. A nucleotide sequence identical or highly similar to the nucleotide sequence of VGAM1497 precursor RNA is designated SEQ ID:1483, and is provided hereinbelow with reference to the sequence listing part. Nucleotide sequence SEQ ID:1483 is located at position 108884 relative to the genome of Alcelaphine Herpesvirus 1.

VGAM1497 precursor RNA folds onto itself, forming VGAM1497 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1497 folded precursor RNA into VGAM1497 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1497 RNA is designated SEQ ID:4208, and is provided hereinbelow with reference to the sequence listing part.

VGAM1497 host target gene, herein designated VGAM HOST TARGET GENE, encodes a corresponding messenger RNA, VGAM1497 host target RNA, herein designated VGAM HOST TARGET RNA. VGAM1497 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1497 RNA, herein designated VGAM RNA, binds complementarily to one or more host target binding sites located in untranslated regions of VGAM1497 host target RNA, herein designated VGAM HOST TARGET RNA. This complementary binding is due to the fact that the nucleotide sequence of VGAM1497 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1497 RNA, herein designated VGAM RNA, may have a different number of host target binding sites in untranslated regions of a VGAM1497 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1497 RNA, herein designated VGAM RNA, to host target binding sites on VGAM1497 host target RNA, herein designated VGAM HOST TARGET RNA, such as BINDING SITE I, BINDING SITE II and BINDING SITE III, inhibits translation of VGAM1497 host target RNA into VGAM1497 host target protein, herein designated VGAM HOST TARGET PROTEIN. VGAM host target protein is therefore outlined by a broken line.

It is appreciated that VGAM1497 host target gene, herein designated VGAM HOST TARGET GENE, in fact represents a plurality of VGAM1497 host target genes. The mRNA of each one of this plurality of VGAM1497 host target genes comprises one or more host target binding sites, each having a nucleotide sequence which is at least partly complementary to VGAM1497 RNA, herein designated VGAM RNA, and which when bound by VGAM1497 RNA causes inhibition of translation of respective one or more VGAM1497 host target proteins.

It is further appreciated by one skilled in the art that the mode of translational inhibition illustrated by FIG. 1 with specific reference to translational inhibition exerted by VGAM1497 gene, herein designated VGAM GENE, on one or more VGAM1497 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1497 is inhibition of expression of host target genes, as part of a novel viral mechanism of attacking a host. Accordingly, utilities of VGAM1497 include diagnosis, prevention and treatment of viral infection by Alcelaphine Herpesvirus 1. Specific functions, and accordingly utilities, of VGAM1497 correlate with, and may be deduced from, the identity of the host target genes which VGAM1497 binds and inhibits, and the function of these host target genes, as elaborated hereinbelow.

Nucleotide sequences of the VGAM1497 precursor RNA, herein designated VGAM PRECURSOR RNA, and of the 'diced' VGAM1497 RNA, herein designated VGAM RNA, and a schematic representation of the secondary folding of VGAM1497 folded precursor RNA, herein designated VGAM FOLDED PRECURSOR RNA, of VGAM1497 are further described hereinbelow with reference to Table 1.

Nucleotide sequences of host target binding sites, such as BINDING SITE-I, BINDING SITE-II and BINDING SITE-III of FIG. 1, found on VGAM1497 host target RNA, and schematic representation of the complementarity of each of these host target binding sites to VGAM1497 RNA, herein designated VGAM RNA, are described hereinbelow with reference to Table 2.

As mentioned hereinabove with reference to FIG. 1, a function of VGAM1497 gene, herein designated VGAM is inhibition of expression of VGAM1497 target genes. It is appreciated that specific functions, and accordingly utilities, of VGAM1497 correlate with, and may be deduced from, the identity of the target genes which VGAM1497 binds and inhibits, and the function of these target genes, as elaborated hereinbelow.

B-cell CLL/lymphoma 7B (BCL7B, Accession NM_001707) is a VGAM1497 host target gene. BCL7B BINDING SITE is HOST TARGET binding site found in the 3' untranslated region of mRNA encoded by BCL7B, corresponding to a HOST TARGET binding site such as BINDING SITE I, BINDING SITE II or BINDING SITE III. Table 2 illustrates the complementarity of the nucleotide sequences of BCL7B BINDING SITE, designated SEQ ID:7434, to the nucleotide sequence of VGAM1497 RNA, herein designated VGAM RNA, also designated SEQ ID:4208.

A function of VGAM1497 is therefore inhibition of B-cell CLL/lymphoma 7B (BCL7B, Accession NM_001707), a gene which is of yet unknown function. Accordingly, utilities of VGAM1497 include diagnosis, prevention and treatment of diseases and clinical conditions associated with BCL7B. The function of BCL7B and its association with various diseases and clinical conditions, has been established by previous studies, as described hereinabove with reference to VGAM1189. Transcription Factor 12 (HTF4, helix-loop-helix transcription factors 4) (TCF12, Accession NM_003205) is another VGAM1497 host target gene. TCF12 BINDING SITE is HOST TARGET binding site found in the 3' untranslated region of mRNA encoded by TCF12, corresponding to a HOST TARGET binding site such as BINDING SITE I, BINDING SITE II or BINDING SITE III. Table 2 illustrates the complementarity of the nucleotide sequences of TCF12 BINDING SITE, designated SEQ ID:9200, to the nucleotide sequence of VGAM1497 RNA, herein designated VGAM RNA, also designated SEQ ID:4208.

Another function of VGAM1497 is therefore inhibition of Transcription Factor 12 (HTF4, helix-loop-helix transcription factors 4) (TCF12, Accession NM_003205), a gene which may play important roles during development of the nervous system as well as in other organ systems. Accordingly, utilities of VGAM1497 include diagnosis, prevention and treatment of diseases and clinical conditions associated with TCF12. The function of TCF12 and its association with various diseases and clinical conditions, has been established by previous studies, as described hereinabove with reference to VGAM308. DKFZP564O043 (Accession XM_166502) is another VGAM1497 host target gene. DKFZP564O043 BINDING SITE is HOST TARGET binding site found in the 3' untranslated region of mRNA encoded by DKFZP564O043, corresponding to a HOST TARGET binding site such as BINDING SITE I, BINDING SITE II or BINDING SITE III. Table 2 illustrates the complementarity of the nucleotide sequences of DKFZP564O043 BINDING SITE, designated SEQ ID:44429, to the nucleotide sequence of VGAM1497 RNA, herein designated VGAM RNA, also designated SEQ ID:4208.

Another function of VGAM1497 is therefore inhibition of DKFZP564O043 (Accession XM_166502). Accordingly, utilities of VGAM1497 include diagnosis, prevention and treatment of diseases and clinical conditions associated with DKFZP564O043. HYA22 (Accession NM_005808) is another VGAM1497 host target gene. HYA22 BINDING SITE is HOST TARGET binding site found in the 3' untranslated region of mRNA encoded by HYA22, corresponding to a HOST TARGET binding site such as BINDING SITE I, BINDING SITE II or BINDING SITE III. Table 2 illustrates the complementarity of the nucleotide sequences of HYA22 BINDING SITE, designated SEQ ID:12386, to the nucleotide sequence of VGAM1497 RNA, herein designated VGAM RNA, also designated SEQ ID:4208.

Another function of VGAM1497 is therefore inhibition of HYA22 (Accession NM_005808). Accordingly, utilities of VGAM1497 include diagnosis, prevention and treatment of diseases and clinical conditions associated with HYA22. KIAA0652 (Accession NM_014741) is another VGAM1497 host target gene. KIAA0652 BINDING SITE is HOST TARGET binding site found in the 3' untranslated region of mRNA encoded by KIAA0652, corresponding to a HOST TARGET binding site such as BINDING SITE I, BINDING SITE II or BINDING SITE III. Table 2 illustrates the complementarity of the nucleotide sequences of KIAA0652 BINDING SITE, designated SEQ ID:16407, to the nucleotide sequence of VGAM1497 RNA, herein designated VGAM RNA, also designated SEQ ID:4208.

Another function of VGAM1497 is therefore inhibition of KIAA0652 (Accession NM_014741). Accordingly, utilities of VGAM1497 include diagnosis, prevention and treatment of diseases and clinical conditions associated with KIAA0652. KIAA0836 (Accession XM_035390) is another VGAM1497 host target gene. KIAA0836 BINDING SITE is HOST TARGET binding site found in the 3' untranslated region of mRNA encoded by KIAA0836, corresponding to a HOST TARGET binding site such as BINDING SITE I, BINDING SITE II or BINDING SITE III. Table 2 illustrates the complementarity of the nucleotide sequences of KIAA0836 BINDING SITE, designated SEQ ID:32245, to the nucleotide sequence of VGAM1497 RNA, herein designated VGAM RNA, also designated SEQ ID:4208.

Another function of VGAM1497 is therefore inhibition of KIAA0836 (Accession XM_035390). Accordingly, utilities of VGAM1497 include diagnosis, prevention and treatment of diseases and clinical conditions associated with KIAA0836. RCD-8 (Accession NM_014329) is another VGAM1497 host target gene. RCD-8 BINDING SITE is HOST TARGET binding site found in the 3' untranslated region of mRNA encoded by RCD-8, corresponding to a HOST TARGET binding site such as BINDING SITE I, BINDING SITE II or BINDING SITE III. Table 2 illustrates the complementarity of the nucleotide sequences of RCD-8 BINDING SITE, designated SEQ ID:15642, to the nucleotide sequence of VGAM1497 RNA, herein designated VGAM RNA, also designated SEQ ID:4208.

Another function of VGAM1497 is therefore inhibition of RCD-8 (Accession NM_014329). Accordingly, utilities of VGAM1497 include diagnosis, prevention and treatment of diseases and clinical conditions associated with RCD-8. Syntaxin 3A (STX3A, Accession NM_004177) is another VGAM1497 host target gene. STX3A BINDING SITE is HOST TARGET binding site found in the 3' untranslated region of mRNA encoded by STX3A, corresponding to a HOST TARGET binding site such as BINDING SITE I, BINDING SITE II or BINDING SITE III. Table 2 illustrates the complementarity of the nucleotide sequences of STX3A BINDING SITE, designated SEQ ID:10389, to the nucleotide sequence of VGAM1497 RNA, herein designated VGAM RNA, also designated SEQ ID:4208.

Another function of VGAM1497 is therefore inhibition of Syntaxin 3A (STX3A, Accession NM_004177). Accordingly, utilities of VGAM1497 include diagnosis, prevention and treatment of diseases and clinical conditions associated with STX3A. LOC149134 (Accession XM_097594) is another VGAM1497 host target gene. LOC149134 BINDING SITE is HOST TARGET binding site found in the 5' untranslated region of mRNA encoded by LOC149134, corresponding to a HOST TARGET binding site such as BINDING SITE I, BINDING SITE II or BINDING SITE III. Table 2 illustrates the complementarity of the nucleotide sequences of LOC149134 BINDING SITE, designated SEQ ID:40958, to the nucleotide sequence of VGAM1497 RNA, herein designated VGAM RNA, also designated SEQ ID:4208.

Another function of VGAM1497 is therefore inhibition of LOC149134 (Accession XM_097594). Accordingly, utilities of VGAM1497 include diagnosis, prevention and treatment of diseases and clinical conditions associated with LOC149134. LOC197335 (Accession XM_113866) is another VGAM1497 host target gene. LOC197335 BINDING SITE is HOST TARGET binding site found in the 5' untranslated region of mRNA encoded by LOC197335, corresponding to a HOST TARGET binding site such as BINDING SITE I, BINDING SITE II or BINDING SITE III. Table 2 illustrates the complementarity of the nucleotide sequences of LOC197335 BINDING SITE, designated SEQ ID:42480, to the nucleotide sequence of VGAM1497 RNA, herein designated VGAM RNA, also designated SEQ ID:4208.

Another function of VGAM1497 is therefore inhibition of LOC197335 (Accession XM_113866). Accordingly, utilities of VGAM1497 include diagnosis, prevention and treatment of diseases and clinical conditions associated with LOC197335. LOC220522 (Accession XM_018306) is another VGAM1497 host target gene. LOC220522 BINDING SITE is HOST TARGET binding site found in the 3' untranslated region of mRNA encoded by LOC220522, corresponding to a HOST TARGET binding site such as BINDING SITE I, BINDING SITE II or BINDING SITE III. Table 2 illustrates the complementarity of the nucleotide sequences of LOC220522 BINDING SITE, designated SEQ ID:30352, to the nucleotide sequence of VGAM1497 RNA, herein designated VGAM RNA, also designated SEQ ID:4208.

Another function of VGAM1497 is therefore inhibition of LOC220522 (Accession XM_018306). Accordingly, utilities of VGAM1497 include diagnosis, prevention and treatment of diseases and clinical conditions associated with LOC220522. LOC92573 (Accession XM_045884) is another VGAM1497 host target gene. LOC92573 BINDING SITE is HOST TARGET binding site found in the 5' untranslated region of mRNA encoded by LOC92573, corresponding to a HOST TARGET binding site such as BINDING SITE I, BINDING SITE II or BINDING SITE III. Table 2 illustrates the complementarity of the nucleotide sequences of LOC92573 BINDING SITE, designated SEQ ID:34593, to the nucleotide sequence of VGAM1497 RNA, herein designated VGAM RNA, also designated SEQ ID:4208.

Another function of VGAM1497 is therefore inhibition of LOC92573 (Accession XM_045884). Accordingly, utilities of VGAM1497 include diagnosis, prevention and treatment of diseases and clinical conditions associated with LOC92573. FIG. 1 further provides a conceptual description of a novel bioinformatically detected viral gene of the present invention, referred to here as Viral Genomic Address Messenger 1498 (VGAM1498) viral gene, which modulates expression of respective host target genes thereof, the function and utility of which host target genes is known in the art.

VGAM1498 is a novel bioinformatically detected regulatory, non protein coding, viral micro RNA (miRNA) gene. The method by which VGAM1498 was detected is described hereinabove with reference to FIGS. 1-8.

VGAM1498 gene, herein designated VGAM GENE, is a viral gene contained in the genome of Alcelaphine Herpesvirus 1. VGAM1498 host target gene, herein designated VGAM HOST TARGET GENE, is a human gene contained in the human genome.

VGAM1498 gene encodes a VGAM1498 precursor RNA, herein designated VGAM PRECURSOR RNA. Similar to other miRNA genes, and unlike most ordinary genes, VGAM1498 precursor RNA does not encode a protein. A nucleotide sequence identical or highly similar to the nucleotide sequence of VGAM1498 precursor RNA is designated SEQ ID:1484, and is provided hereinbelow with reference to the sequence listing part. Nucleotide sequence SEQ ID:1484 is located at position 112274 relative to the genome of Alcelaphine Herpesvirus 1.

VGAM1498 precursor RNA folds onto itself, forming VGAM1498 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1498 folded precursor RNA into VGAM1498 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM1498 RNA is designated SEQ ID:4209, and is provided hereinbelow with reference to the sequence listing part.

VGAM1498 host target gene, herein designated VGAM HOST TARGET GENE, encodes a corresponding messenger RNA, VGAM1498 host target RNA, herein designated VGAM HOST TARGET RNA. VGAM1498 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1498 RNA, herein designated VGAM RNA, binds complementarily to one or more host target binding sites located in untranslated regions of VGAM1498 host target RNA, herein designated VGAM HOST TARGET RNA. This complementary binding is due to the fact that the nucleotide sequence of VGAM1498 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1498 RNA, herein designated VGAM RNA, may have a different number of host target binding sites in untranslated regions of a VGAM1498 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1498 RNA, herein designated VGAM RNA, to host target binding sites on VGAM1498 host target RNA, herein designated VGAM HOST TARGET RNA, such as BINDING SITE I, BINDING SITE II and BINDING SITE III, inhibits translation of VGAM1498 host target RNA into VGAM1498 host target protein, herein designated VGAM HOST TARGET PROTEIN. VGAM host target protein is therefore outlined by a broken line.

It is appreciated that VGAM1498 host target gene, herein designated VGAM HOST TARGET GENE, in fact represents a plurality of VGAM1498 host target genes. The mRNA of each one of this plurality of VGAM1498 host target genes comprises one or more host target binding sites, each having a nucleotide sequence which is at least partly complementary to VGAM1498 RNA, herein designated VGAM RNA, and which when bound by VGAM1498 RNA causes inhibition of translation of respective one or more VGAM1498 host target proteins.

It is further appreciated by one skilled in the art that the mode of translational inhibition illustrated by FIG. 1 with specific reference to translational inhibition exerted by VGAM1498 gene, herein designated VGAM GENE, on one or more VGAM1498 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1498 is inhibition of expression of host target genes, as part of a novel viral mechanism of attacking a host. Accordingly, utilities of VGAM1498 include diagnosis, prevention and treatment of viral infection by Alcelaphine Herpesvirus 1. Specific functions, and accordingly utilities, of VGAM1498 correlate with, and may be deduced from, the identity of the host target genes which VGAM1498 binds and inhibits, and the function of these host target genes, as elaborated hereinbelow.

Nucleotide sequences of the VGAM1498 precursor RNA, herein designated VGAM PRECURSOR RNA, and of the 'diced' VGAM1498 RNA, herein designated VGAM RNA, and a schematic representation of the secondary folding of VGAM1498 folded precursor RNA, herein designated VGAM FOLDED PRECURSOR RNA, of VGAM1498 are further described hereinbelow with reference to Table 1.

Nucleotide sequences of host target binding sites, such as BINDING SITE-I, BINDING SITE-II and BINDING SITE-III of FIG. 1, found on VGAM1498 host target RNA, and schematic representation of the complementarity of each of these host target binding sites to VGAM1498 RNA, herein designated VGAM RNA, are described hereinbelow with reference to Table 2.

As mentioned hereinabove with reference to FIG. 1, a function of VGAM1498 gene, herein designated VGAM is inhibition of expression of VGAM1498 target genes. It is appreciated that specific functions, and accordingly utilities, of VGAM1498 correlate with, and may be deduced from, the identity of the target genes which VGAM1498 binds and inhibits, and the function of these target genes, as elaborated hereinbelow.

CARP (Accession NM_014391) is a VGAM1498 host target gene. CARP BINDING SITE is HOST TARGET binding site found in the 3' untranslated region of mRNA encoded by CARP, corresponding to a HOST TARGET binding site such as BINDING SITE I, BINDING SITE II or BINDING SITE III. Table 2 illustrates the complementarity of the nucleotide sequences of CARP BINDING SITE, designated SEQ ID:15720, to the nucleotide sequence of VGAM1498 RNA, herein designated VGAM RNA, also designated SEQ ID:4209.

A function of VGAM1498 is therefore inhibition of CARP (Accession NM_014391). Accordingly, utilities of VGAM1498 include diagnosis, prevention and treatment of diseases and clinical conditions associated with CARP. CGTHBA (Accession NM_012075) is another VGAM1498 host target gene. CGTHBA BINDING SITE is HOST TARGET binding site found in the 3' untranslated region of mRNA encoded by CGTHBA, corresponding to a HOST TARGET binding site such as BINDING SITE I, BINDING SITE II or BINDING SITE III. Table 2 illustrates the complementarity of the nucleotide sequences of CGTHBA BINDING SITE, designated SEQ ID:14359, to the nucleotide sequence of VGAM1498 RNA, herein designated VGAM RNA, also designated SEQ ID:4209.

Another function of VGAM1498 is therefore inhibition of CGTHBA (Accession NM_012075). Accordingly, utilities of VGAM1498 include diagnosis, prevention and treatment of diseases and clinical conditions associated with CGTHBA. Calponin 2 (CNN2, Accession NM_004368) is another VGAM1498 host target gene. CNN2 BINDING SITE is HOST TARGET binding site found in the 3' untranslated region of mRNA encoded by CNN2, corresponding to a HOST TARGET binding site such as BINDING SITE I, BINDING SITE II or BINDING SITE III. Table 2 illustrates the complementarity of the nucleotide sequences of CNN2 BINDING SITE, designated SEQ ID:10584, to the nucleotide sequence of VGAM1498 RNA, herein designated VGAM RNA, also designated SEQ ID:4209.

Another function of VGAM1498 is therefore inhibition of Calponin 2 (CNN2, Accession NM_004368), a gene which may be involved in the structural organization and/or anchorage of actin filaments. Accordingly, utilities of VGAM1498 include diagnosis, prevention and treatment of diseases and clinical conditions associated with CNN2. The function of CNN2 has been established by previous studies. Masuda et al. (1996) cloned a cDNA encoding calponin-2 (CNN2) by screening a human heart cDNA library with a CNN1 (OMIM Ref. No. 600806) cDNA. The CNN2 protein is 94.8% identical to mouse calponin h2 (see OMIM Ref. No. 600806), indicating that these proteins are homologs. The predicted CNN2 protein has 309 amino acids and a pI of 7.1. It contains motifs that are present in CNN1 and CNN3 (OMIM Ref. No. 602374):3 tandem repeats of 29 amino acids, an actin-binding domain, a VAV (OMIM Ref. No. 164875)-homologous region, and 2 consensus phosphorylation sites for tyrosine kinase at the C terminus. The 3-prime untranslated region of the CNN2 mRNA contains an Alu repetitive sequence in the antisense direction. RT-PCR detected CNN2 transcripts in both cultured smooth muscle and nonmuscle cells and showed that mouse calponin h2 is expressed in embryonic and adult heart. CNN2 protein localizes to the cell-to-cell junctions of cardiomyocytes and codistributes with vinculin (OMIM Ref. No. 193065). Masuda et al. (1996) suggested that CNN2 may be involved in the structural organization and/or anchorage of actin filaments and may function in the cell adhesion mechanism Cheng et al. (1994) mapped the CNN2 gene to 21q11.1 by hybridization to chromosome 21q-specific YACs.

Full details of the abovementioned studies are described in the following publications, the disclosure of which are hereby incorporated by reference:

Masuda, H.; Tanaka, K.; Takagi, M.; Ohgami, K.; Sakamaki, T.; Shibata, N.; Takahashi, K.: Molecular cloning and characterization of human non-smooth muscle calponin. J. Biochem. 120:415-424, 1996; and Cheng, J.-F.; Boyartchuk, V.; Zhu, Y.: Isolation and mapping of human chromosome 21 cDNA: progress in constructing a chromosome 21 expression map. Genomics 23:75-84, 1994.

Further studies establishing the function and utilities of CNN2 are found in John Hopkins OMIM database record ID 602373, and in sited publications numbered 8674 listed in the bibliography section hereinbelow, which are also hereby incorporated by reference. Collagen, Type XV, Alpha 1 (COL15A1, Accession NM_001855) is another VGAM1498 host target gene. COL15A1 BINDING SITE is HOST TARGET binding site found in the 3' untranslated region of mRNA encoded by COL15A1, corresponding to a HOST TARGET binding site such as BINDING SITE I, BINDING SITE II or BINDING SITE III. Table 2 illustrates the complementarity of the nucleotide sequences of COL15A1 BINDING SITE, designated SEQ ID:7589, to the nucleotide sequence of VGAM1498 RNA, herein designated VGAM RNA, also designated SEQ ID:4209.

Another function of VGAM1498 is therefore inhibition of Collagen, Type XV, Alpha 1 (COL15A1, Accession NM_001855), a gene which may be involved in maintaining the structure of connective tissue. Accordingly, utilities of VGAM1498 include diagnosis, prevention and treatment of diseases and clinical conditions associated with COL15A1. The function of COL15A1 and its association with various diseases and clinical conditions, has been established by previous studies, as described hereinabove with reference to VGAM304. Exostoses (multiple)-like 1 (EXTL1, Accession NM_004455) is another VGAM1498 host target gene. EXTL1 BINDING SITE is HOST TARGET binding site found in the 5' untranslated region of mRNA encoded by EXTL1, corresponding to a HOST TARGET binding site such as BINDING SITE I, BINDING SITE II or BINDING SITE III. Table 2 illustrates the complementarity of the nucleotide sequences of EXTL1 BINDING SITE, designated SEQ ID:10755, to the nucleotide sequence of VGAM1498 RNA, herein designated VGAM RNA, also designated SEQ ID:4209.

Another function of VGAM1498 is therefore inhibition of Exostoses (multiple)-like 1 (EXTL1, Accession NM_004455), a gene which probably contribute to the synthesis of heparan sulfate and heparin. Accordingly, utilities of VGAM1498 include diagnosis, prevention and treatment of diseases and clinical conditions associated with EXTL1. The function of EXTL1 and its association with various diseases and clinical conditions, has been established by previous studies, as described hereinabove with reference to VGAM806. Laminin, Gamma 1 (formerly LAMB2) (LAMC1, Accession NM_002293) is another VGAM1498 host target gene. LAMC1 BINDING SITE is HOST TARGET binding site found in the 3' untranslated region of mRNA encoded by LAMC1, corresponding to a HOST TARGET binding site such as BINDING SITE I, BINDING SITE II or BINDING SITE III. Table 2 illustrates the complementarity of the nucleotide sequences of LAMC1 BINDING SITE, designated SEQ ID:8073, to the nucleotide sequence of VGAM1498 RNA, herein designated VGAM RNA, also designated SEQ ID:4209.

Another function of VGAM1498 is therefore inhibition of Laminin, Gamma 1 (formerly LAMB2) (LAMC1, Accession NM_002293), a gene which may mediate the attachment, migration, and organization of cells into tissues. Accordingly, utilities of VGAM1498 include diagnosis, prevention and treatment of diseases and clinical conditions associated with LAMC1. The function of LAMC1 and its association with various diseases and clinical conditions, has been established by previous studies, as described hereinabove with reference to VGAM812.2'-5'-oligoadenylate Synthetase 2, 69/71 kDa (OAS2, Accession NM_002535) is another VGAM1498 host target gene. OAS2 BINDING SITE is HOST TARGET binding site found in the 3' untranslated region of mRNA encoded by OAS2, corresponding to a HOST TARGET binding site such as BINDING SITE I, BINDING SITE II or BINDING SITE III. Table 2 illustrates the complementarity of the nucleotide sequences of OAS2 BINDING SITE, designated SEQ ID:8373, to the nucleotide sequence of VGAM1498 RNA, herein designated VGAM RNA, also designated SEQ ID:4209.

Another function of VGAM1498 is therefore inhibition of 2'-5'-oligoadenylate Synthetase 2, 69/71 kDa (OAS2, Accession NM_002535), a gene which may play a role in mediating resistance to virus infection, control of cell growth, differentiation, and apoptosis. Accordingly, utilities of VGAM1498 include diagnosis, prevention and treatment of diseases and clinical conditions associated with OAS2. The function of OAS2 has been established by previous studies. The 2-prime, 5-prime oligoadenylate synthetases (OASs) are interferon-induced proteins characterized by their capacity to catalyze the synthesis of 2-prime,5-prime oligomers of adenosine (2-5As). See OAS1 (OMIM Ref. No. 164350). Hovanessian et al. (1987) found that interferon-treated human cells contain several OASs corresponding to proteins of 40 (OAS1), 46 (OAS1), 69, and 100 (OMIM Ref. No. 603351) kD. Marie et al. (1989) generated highly specific polyclonal antibodies against p69, the 69-kD OAS. By screening an interferon-treated human cell expression library with the anti-p69 antibodies, Marie and Hovanessian (1992) isolated a partial OAS2 cDNA. They screened additional libraries with the partial cDNA and recovered cDNAs encoding 2 OAS2 isoforms. The smaller isoform is encoded by 2 mRNAs that differ in the length of the 3-prime untranslated region. Northern blot analysis revealed that OAS2 is expressed as 4 interferon-induced mRNAs in human cells. The predicted OAS2 proteins have a common 683-amino acid sequence and different 3-prime termini. By SDS-PAGE of in vitro transcription/translation products, the authors showed that 2 isoforms have molecular masses of 69 and 71 kD. Both isoforms exhibited OAS activity in vitro. Sequence analysis indicated that OAS2 contains 2 OAS1-homologous domains separated by a proline-rich putative linker region. The N- and C-terminal domains are 41% and 53% identical to OAS1, respectively. Marie and Hovanessian (1992) suggested that the OAS2 gene derived from the fusion of 2 ancestral genes analogous to OAS1. By fluorescence in situ hybridization and by inclusion within mapped clones, Hovnanian et al. (1998) determined that the OAS1, OAS2, and OAS3 genes are clustered with a 130-kb region on 12q24.2.

Full details of the abovementioned studies are described in the following publications, the disclosure of which are hereby incorporated by reference:

Hovnanian, A.; Rebouillat, D.; Mattei, M.-G.; Levy, E. R.; Marie, I.; Monaco, A. P.; Hovanessian, A. G.: The human 2-prime,5-prime-oligoadenylate synthetase locus is composed of three distinct genes clustered on chromosome 12q24.2 encoding the 100-, 69-, and 40-kDa forms. Genomics 52: 267-277, 1998; and Marie, I.; Hovanessian, A. G.: The 69-kDa 2-5A synthetase is composed of two homologous and adjacent functional domains. J. Biol. Chem. 267: 9933-9939, 1992.

Further studies establishing the function and utilities of OAS2 are found in John Hopkins OMIM database record ID 603350, and in sited publications numbered 800 and 8010-8011 listed in the bibliography section hereinbelow, which are also hereby incorporated by reference. PBX/knotted 1 Homeobox 1 (PKNOX1, Accession NM_004571) is another VGAM1498 host target gene. PKNOX1 BINDING SITE is HOST TARGET binding site found in the 3' untranslated region of mRNA encoded by PKNOX1, corresponding to a HOST TARGET binding site such as BINDING SITE I, BINDING SITE II or BINDING SITE III. Table 2 illustrates the complementarity of the nucleotide sequences of PKNOX1 BINDING SITE, designated SEQ ID:10912, to the nucleotide sequence of VGAM1498 RNA, herein designated VGAM RNA, also designated SEQ ID:4209.

Another function of VGAM1498 is therefore inhibition of PBX/knotted 1 Homeobox 1 (PKNOX1, Accession NM_004571), a gene which may regulate gene expression and control cell differentiation. Accordingly, utilities of VGAM1498 include diagnosis, prevention and treatment of diseases and clinical conditions associated with PKNOX1. The function of PKNOX1 and its association with various diseases and clinical conditions, has been established by previous studies, as described hereinabove with reference to VGAM276. Proteasome (prosome, macropain) Activator Subunit 3 (PA28 gamma; Ki) (PSME3, Accession NM_005789) is another VGAM1498 host target gene. PSME3 BINDING SITE is HOST TARGET binding site found in the 3' untranslated region of mRNA encoded by PSME3, corresponding to a HOST TARGET binding site such as BINDING SITE I, BINDING SITE II or BINDING SITE III. Table 2 illustrates the complementarity of the nucleotide sequences of PSME3 BINDING SITE, designated SEQ ID:12370, to the nucleotide sequence of VGAM1498 RNA, herein designated VGAM RNA, also designated SEQ ID:4209.

Another function of VGAM1498 is therefore inhibition of Proteasome (prosome, macropain) Activator Subunit 3 (PA28 gamma; Ki) (PSME3, Accession NM_005789), a gene which is the activator subunit of the proteasome (prosome macropain). Accordingly, utilities of VGAM1498 include diagnosis, prevention and treatment of diseases and clinical conditions associated with PSME3. The function of PSME3 has been established by previous studies. Patients with systemic lupus erythematosus (SLE; 152700) produce autoantibodies against a number of nuclear antigens, including SNRP70 (OMIM Ref. No. 180740), PCNA (OMIM Ref. No. 176740), CDR1 (OMIM Ref. No. 302650), and Ki. By screening a human placenta cDNA library with a probe obtained by screening a bovine retina cDNA library with anti-Ki sera from an SLE patient, Nikaido et al. (1990) isolated a cDNA encoding PSME3, which they called Ki. Sequence analysis predicted that the 254-amino acid, hydrophilic PSME3 protein contains a nuclear localization signal and has a molecular mass of approximately 30 kD, close to the 32 kD observed by Western blot analysis. PSME3 shares over 99% amino acid identity with the bovine sequence. RNA blot analysis of human placenta, bovine brain, and mouse embryos detected 3.0- and 1.5-kb PSME3 transcripts. By analysis of overlapping YAC contigs and by FISH, Albertsen et al. (1994) mapped the PSME3 gene to 17q12-q21. Kandil et al. (1997) mapped the mouse Psme3 gene to chromosome 14 using interspecific backcross analysis.

Full details of the abovementioned studies are described in the following publications, the disclosure of which are hereby incorporated by reference:

Nikaido, T.; Shimada, K.; Shibata, M.; Hata, M.; Sakamoto, M.; Takasaki, Y.; Sato, C.; Takahashi, T.; Nishida, Y.: Cloning and nucleotide sequence of cDNA for Ki antigen, a highly conserved nuclear protein detected with sera from patients with systemic lupus erythematosus. Clin. Exp. Immun. 79:209-214, 1990; and Albertsen, H. M.; Smith, S. A.; Mazoyer, S.; Fujimoto, E.; Stevens, J.; Williams, B.; Rodriguez, P.; Cropp, C. S.; Slijepcevic, P.; Carlson, M.; Robertson, M.; Bradley, P.; Lawrence, E.

Further studies establishing the function and utilities of PSME3 are found in John Hopkins OMIM database record ID 605129, and in sited publications numbered 12201-7083 listed in the bibliography section hereinbelow, which are also hereby incorporated by reference. Solute Carrier Family 31 (copper transporters), Member 1 (SLC31A1, Accession NM_001859) is another VGAM1498 host target gene. SLC31A1 BINDING SITE is HOST TARGET binding site found in the 3' untranslated region of mRNA encoded by SLC31A1, corresponding to a HOST TARGET binding site such as BINDING SITE I, BINDING SITE II or BINDING SITE III. Table 2 illustrates the complementarity of the nucleotide sequences of SLC31A1 BINDING SITE, designated SEQ ID:7601, to the nucleotide sequence of VGAM1498 RNA, herein designated VGAM RNA, also designated SEQ ID:4209.

Another function of VGAM1498 is therefore inhibition of Solute Carrier Family 31 (copper transporters), Member 1 (SLC31A1, Accession NM_001859), a gene which is involved in high-affinity copper uptake. Accordingly, utilities of VGAM1498 include diagnosis, prevention and treatment of diseases and clinical conditions associated with SLC31A1. The function of SLC31A1 has been established by previous studies. Moller et al. (2000) found that cells expressing CTR1 but not those expressing CTR2 showed a dramatic hyperaccumulation of radioactive copper, comparable to that seen in fibroblasts from Menkes disease patients. However, in contrast to the Menkes syndrome fibroblasts, the CTR1-expressing fibroblasts had an efflux rate similar to normal fibroblasts. Animal model experiments lend further support to the function of SLC31A1. To test the hypothesis that CTR1 is required for copper delivery to mammalian cells, Kuo et al. (2001) inactivated the Ctr1 gene in mice by targeted mutagenesis. They observed early embryonic lethality in homozygous mutant embryos and a deficiency in copper uptake in the brains of heterozygous animals. A study of the spatial and temporal expression pattern of Ctr1 during mouse development and adulthood further showed that Ctr1 is ubiquitously transcribed with highest expression observed in the specialized epithelia of the choroid plexus and renal tubules and in connective tissues of the eye, ovary, and testis. Similarly, Lee et al. (2001) showed that the mouse Ctr1 gene encodes a component of the copper transport machinery and that mice heterozygous for Ctr1 exhibit tissue-specific defects in copper accumulation and in the activities of copper-dependent enzymes. Mice completely deficient for Ctr1 exhibited profound growth and developmental defects and died in utero in midgestation It is appreciated that the abovementioned animal model for SLC31A1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lee, J.; Prohaska, J. R.; Thiele, D. J.: Essential role for mammalian copper transporter Ctr1 in copper homeostasis and embryonic development. Proc. Nat. Acad. Sci. 98:6842-6847, 2001; and Moller, L. B.; Petersen, C.; Lund, C.; Horn, N.: Characterization of the hCTR1 gene: genomic organization, functional expression, and identification of a highly homologous processed gen.

Further studies establishing the function and utilities of SLC31A1 are found in John Hopkins OMIM database record ID 603085, and in sited publications numbered 1071-1077 listed in the bibliography section hereinbelow, which are also hereby incorporated by reference. C16orf5 (Accession NM_013399) is another VGAM1498 host target gene. C16orf5 BINDING SITE is HOST TARGET binding site found in the 3" untranslated region of mRNA encoded by C16orf5, corresponding to a HOST TARGET binding site such as BINDING SITE I, BINDING SITE II or BINDING SITE III. Table 2 illustrates the complementarity of the nucleotide sequences of C16orf5 BINDING SITE, designated SEQ ID:15054, to the nucleotide sequence of VGAM1498 RNA, herein designated VGAM RNA, also designated SEQ ID:4209.

Another function of VGAM1498 is therefore inhibition of C16orf5 (Accession NM_013399). Accordingly, utilities of VGAM1498 include diagnosis, prevention and treatment of diseases and clinical conditions associated with C16orf5. DKFZP586G1122 (Accession XM_028643) is another VGAM1498 host target gene. DKFZP586G1122 BINDING SITE is HOST TARGET binding site found in the 3' untranslated region of mRNA encoded by DKFZP586G1122, corresponding to a HOST TARGET binding site such as BINDING SITE I, BINDING SITE II or BINDING SITE III. Table 2 illustrates the complementarity of the nucleotide sequences of DKFZP586G1122 BINDING SITE, designated SEQ ID:30725, to the nucleotide sequence of VGAM1498 RNA, herein designated VGAM RNA, also designated SEQ ID:4209.

Another function of VGAM1498 is therefore inhibition of DKFZP586G1122 (Accession XM_028643). Accordingly, utilities of VGAM1498 include diagnosis, prevention and treatment of diseases and clinical conditions associated with DKFZP586G1122. Dihydropyrimidinase-like 4 (DPYSL4, Accession NM_006426) is another VGAM1498 host target gene. DPYSL4 BINDING SITE is HOST TARGET binding site found in the 3' untranslated region of mRNA encoded by DPYSL4, corresponding to a HOST TARGET binding site such as BINDING SITE I, BINDING SITE II or BINDING SITE III. Table 2 illustrates the complementarity of the nucleotide sequences of DPYSL4 BINDING SITE, designated SEQ ID:13142, to the nucleotide sequence of VGAM1498 RNA, herein designated VGAM RNA, also designated SEQ ID:4209.

Another function of VGAM1498 is therefore inhibition of Dihydropyrimidinase-like 4 (DPYSL4, Accession NM_006426). Accordingly, utilities of VGAM1498 include diagnosis, prevention and treatment of diseases and clinical conditions associated with DPYSL4. FLJ13848 (Accession NM_024771) is another VGAM1498 host target gene. FLJ13848 BINDING SITE is HOST TARGET binding site found in the 3' untranslated region of mRNA encoded by FLJ13848, corresponding to a HOST TARGET binding site such as BINDING SITE I, BINDING SITE II or BINDING SITE III. Table 2 illustrates the complementarity of the nucleotide sequences of FLJ13848 BINDING SITE, designated SEQ ID:24134, to the nucleotide sequence of VGAM1498 RNA, herein designated VGAM RNA, also designated SEQ ID:4209.

Another function of VGAM1498 is therefore inhibition of FLJ13848 (Accession NM_024771). Accordingly, utilities of VGAM1498 include diagnosis, prevention and treatment of diseases and clinical conditions associated with FLJ13848. FLJ14775 (Accession NM_032837) is another VGAM1498 host target gene. FLJ14775 BINDING SITE is HOST TARGET binding site found in the 3' untranslated region of mRNA encoded by FLJ14775, corresponding to a HOST TARGET binding site such as BINDING SITE I, BINDING SITE II or BINDING SITE III. Table 2 illustrates the complementarity of the nucleotide sequences of FLJ14775 BINDING SITE, designated SEQ ID:26617, to the nucleotide sequence of VGAM1498 RNA, herein designated VGAM RNA, also designated SEQ ID:4209.

Another function of VGAM1498 is therefore inhibition of FLJ14775 (Accession NM_032837). Accordingly, utilities of VGAM1498 include diagnosis, prevention and treatment of diseases and clinical conditions associated with FLJ14775. FLJ20254 (Accession NM_017727) is another VGAM1498 host target gene. FLJ20254 BINDING SITE is HOST TARGET binding site found in the 3' untranslated region of mRNA encoded by FLJ20254, corresponding to a HOST TARGET binding site such as BINDING SITE I, BINDING SITE II or BINDING SITE III. Table 2 illustrates the complementarity of the nucleotide sequences of FLJ20254 BINDING SITE, designated SEQ ID:19316, to the nucleotide sequence of VGAM1498 RNA, herein designated VGAM RNA, also designated SEQ ID:4209.

Another function of VGAM1498 is therefore inhibition of FLJ20254 (Accession NM_017727). Accordingly, utilities of VGAM1498 include diagnosis, prevention and treatment of diseases and clinical conditions associated with FLJ20254. FLJ32752 (Accession NM_144666) is another VGAM1498 host target gene. FLJ32752 BINDING SITE is HOST TARGET binding site found in the 5' untranslated region of mRNA encoded by FLJ32752, corresponding to a HOST TARGET binding site such as BINDING SITE I, BINDING SITE II or BINDING SITE III. Table 2 illustrates the complementarity of the nucleotide sequences of FLJ32752 BINDING SITE, designated SEQ ID:29483, to the nucleotide sequence of VGAM1498 RNA, herein designated VGAM RNA, also designated SEQ ID:4209.

Another function of VGAM1498 is therefore inhibition of FLJ32752 (Accession NM_144666). Accordingly, utilities of VGAM1498 include diagnosis, prevention and treatment of diseases and clinical conditions associated with FLJ32752. KIAA0738 (Accession NM_014719) is another VGAM1498 host target gene. KIAA0738 BINDING SITE is HOST TARGET binding site found in the 3' untranslated region of mRNA encoded by KIAA0738, corresponding to a HOST TARGET binding site such as BINDING SITE I, BINDING SITE II or BINDING SITE III. Table 2 illustrates the complementarity of the nucleotide sequences of KIAA0738 BINDING SITE, designated SEQ ID:16276, to the nucleotide sequence of VGAM1498 RNA, herein designated VGAM RNA, also designated SEQ ID:4209.

Another function of VGAM1498 is therefore inhibition of KIAA0738 (Accession NM_014719). Accordingly, utilities of VGAM1498 include diagnosis, prevention and treatment of diseases and clinical conditions associated with KIAA0738. KIAA0953 (Accession XM_039733) is another VGAM1498 host target gene. KIAA0953 BINDING SITE is HOST TARGET binding site found in the 3' untranslated region of mRNA encoded by KIAA0953, corresponding to a HOST TARGET binding site such as BINDING SITE I, BINDING SITE II or BINDING SITE III. Table 2 illustrates the complementarity of the nucleotide sequences of KIAA0953 BINDING SITE, designated SEQ ID:33169, to the nucleotide sequence of VGAM1498 RNA, herein designated VGAM RNA, also designated SEQ ID:4209.

Another function of VGAM1498 is therefore inhibition of KIAA0953 (Accession XM_039733). Accordingly, utilities of VGAM1498 include diagnosis, prevention and treatment of diseases and clinical conditions associated with KIAA0953. KIAA1867 (Accession XM_170675) is another VGAM1498 host target gene. KIAA1867 BINDING SITE is HOST TARGET binding site found in the 3' untranslated region of mRNA encoded by KIAA1867, corresponding to a HOST TARGET binding site such as BINDING SITE I, BINDING SITE II or BINDING SITE III. Table 2 illustrates the complementarity of the nucleotide sequences of KIAA1867 BINDING SITE, designated SEQ ID:45452, to the nucleotide sequence of VGAM1498 RNA, herein designated VGAM RNA, also designated SEQ ID:4209.

Another function of VGAM1498 is therefore inhibition of KIAA1867 (Accession XM_170675). Accordingly, utilities of VGAM1498 include diagnosis, prevention and treatment of diseases and clinical conditions associated with KIAA1867. Karyopherin (importin) Beta 3 (KPNB3, Accession NM_002271) is another VGAM1498 host target gene. KPNB3 BINDING SITE is HOST TARGET binding site found in the 3' untranslated region of mRNA encoded by KPNB3, corresponding to a HOST TARGET binding site such as BINDING SITE I, BINDING SITE II or BINDING SITE III. Table 2 illustrates the complementarity of the nucleotide sequences of KPNB3 BINDING SITE, designated SEQ ID:8063, to the nucleotide sequence of VGAM1498 RNA, herein designated VGAM RNA, also designated SEQ ID:4209.

Another function of VGAM1498 is therefore inhibition of Karyopherin (importin) Beta 3 (KPNB3, Accession NM_002271). Accordingly, utilities of VGAM1498 include diagnosis, prevention and treatment of diseases and clinical conditions associated with KPNB3. Praja 1 (PJA1, Accession NM_022368) is another VGAM1498 host target gene. PJA1 BINDING SITE is HOST TARGET binding site found in the 5' untranslated region of mRNA encoded by PJA1, corresponding to a HOST TARGET binding site such as BINDING SITE I, BINDING SITE II or BINDING SITE III. Table 2 illustrates the complementarity of the nucleotide sequences of PJA1 BINDING SITE, designated SEQ ID:22756, to the nucleotide sequence of VGAM1498 RNA, herein designated VGAM RNA, also designated SEQ ID:4209.

Another function of VGAM1498 is therefore inhibition of Praja 1 (PJA1, Accession NM_022368). Accordingly, utilities of VGAM1498 include diagnosis, prevention and treatment of diseases and clinical conditions associated with PJA1. RAB3A Interacting Protein (rabin3)-like 1 (RAB3IL1, Accession NM_013401) is another VGAM1498 host target gene. RAB3IL1 BINDING SITE is HOST TARGET binding site found in the 3' untranslated region of mRNA encoded by RAB3IL1, corresponding to a HOST TARGET binding site such as BINDING SITE I, BINDING SITE II or BINDING SITE III. Table 2 illustrates the complementarity of the nucleotide sequences of RAB3IL1 BINDING SITE, designated SEQ ID:15060, to the nucleotide sequence of VGAM1498 RNA, herein designated VGAM RNA, also designated SEQ ID:4209.

Another function of VGAM1498 is therefore inhibition of RAB3A Interacting Protein (rabin3)-like 1 (RAB3IL1, Accession NM_013401). Accordingly, utilities of VGAM1498 include diagnosis, prevention and treatment of diseases and clinical conditions associated with RAB3IL1. SEC61A1 (Accession NM_013336) is another VGAM1498 host target gene. SEC61A1 BINDING SITE is HOST TARGET binding site found in the 3' untranslated region of mRNA encoded by SEC61A1, corresponding to a HOST TARGET binding site such as BINDING SITE I, BINDING SITE II or BINDING SITE III. Table 2 illustrates the complementarity of the nucleotide sequences of SEC61A1 BINDING SITE, designated SEQ ID:14982, to the nucleotide sequence of VGAM1498 RNA, herein designated VGAM RNA, also designated SEQ ID:4209.

Another function of VGAM1498 is therefore inhibition of SEC61A1 (Accession NM_013336). Accordingly, utilities of VGAM1498 include diagnosis, prevention and treatment of diseases and clinical conditions associated with SEC61A1. SKIP (Accession NM_016532) is another VGAM1498 host target gene. SKIP BINDING SITE1 and SKIP BINDING SITE2 are HOST TARGET binding sites found in untranslated regions of mRNA encoded by SKIP, corresponding to HOST TARGET binding sites such as BINDING SITE I, BINDING SITE II or BINDING SITE III. Table 2 illustrates the complementarity of the nucleotide sequences of SKIP BINDING SITE1 and SKIP BINDING SITE2, designated SEQ ID:18599 and SEQ ID:28262 respectively, to the nucleotide sequence of VGAM1498 RNA, herein designated VGAM RNA, also designated SEQ ID:4209.

Another function of VGAM1498 is therefore inhibition of SKIP (Accession NM_016532). Accordingly, utilities of VGAM1498 include diagnosis, prevention and treatment of diseases and clinical conditions associated with SKIP. LOC146890 (Accession XM_097128) is another VGAM1498 host target gene. LOC146890 BINDING SITE is HOST TARGET binding site found in the 5' untranslated region of mRNA encoded by LOC146890, corresponding to a HOST TARGET binding site such as BINDING SITE I, BINDING SITE II or BINDING SITE III. Table 2 illustrates the complementarity of the nucleotide sequences of LOC146890 BINDING SITE, designated SEQ ID:40765, to the nucleotide sequence of VGAM1498 RNA, herein designated VGAM RNA, also designated SEQ ID:4209.

Another function of VGAM1498 is therefore inhibition of LOC146890 (Accession XM_097128). Accordingly, utilities of VGAM1498 include diagnosis, prevention and treatment of diseases and clinical conditions associated with LOC146890. LOC148758 (Accession XM_086301) is another VGAM1498 host target gene. LOC148758 BINDING SITE is HOST TARGET binding site found in the 3' untranslated region of mRNA encoded by LOC148758, corresponding to a HOST TARGET binding site such as BINDING SITE I, BINDING SITE II or BINDING SITE III. Table 2 illustrates the complementarity of the nucleotide sequences of LOC148758 BINDING SITE, designated SEQ ID:38586, to the nucleotide sequence of VGAM1498 RNA, herein designated VGAM RNA, also designated SEQ ID:4209.

Another function of VGAM1498 is therefore inhibition of LOC148758 (Accession XM_086301). Accordingly, utilities of VGAM1498 include diagnosis, prevention and treatment of diseases and clinical conditions associated with LOC148758. LOC149113 (Accession XM_086425) is another VGAM1498 host target gene. LOC149113 BINDING SITE is HOST TARGET binding site found in the 3' untranslated region of mRNA encoded by LOC149113, corresponding to a HOST TARGET binding site such as BINDING SITE I, BINDING SITE II or BINDING SITE III. Table 2 illustrates the complementarity of the nucleotide sequences of LOC149113 BINDING SITE, designated SEQ ID:38640, to the nucleotide sequence of VGAM1498 RNA, herein designated VGAM RNA, also designated SEQ ID:4209.

Another function of VGAM1498 is therefore inhibition of LOC149113 (Accession XM_086425). Accordingly, utilities of VGAM1498 include diagnosis, prevention and treatment of diseases and clinical conditions associated with LOC149113. LOC154403 (Accession XM_087919) is another VGAM1498 host target gene. LOC154403 BINDING SITE is HOST TARGET binding site found in the 3' untranslated region of mRNA encoded by LOC154403, corresponding to a HOST TARGET binding site such as BINDING SITE I, BINDING SITE II or BINDING SITE III. Table 2 illustrates the complementarity of the nucleotide sequences of LOC154403 BINDING SITE, designated SEQ ID:39468, to the nucleotide sequence of VGAM1498 RNA, herein designated VGAM RNA, also designated SEQ ID:4209.

Another function of VGAM1498 is therefore inhibition of LOC154403 (Accession XM_087919). Accordingly, utilities of VGAM1498 include diagnosis, prevention and treatment of diseases and clinical conditions associated with LOC154403. LOC154992 (Accession XM_088106) is another VGAM1498 host target gene. LOC154992 BINDING SITE is HOST TARGET binding site found in the 3' untranslated region of mRNA encoded by LOC154992, corresponding to a HOST TARGET binding site such as BINDING SITE I, BINDING SITE II or BINDING SITE III. Table 2 illustrates the complementarity of the nucleotide sequences of LOC154992 BINDING SITE, designated SEQ ID:39518, to the nucleotide sequence of VGAM1498 RNA, herein designated VGAM RNA, also designated SEQ ID:4209.

Another function of VGAM1498 is therefore inhibition of LOC154992 (Accession XM_088106). Accordingly, utilities of VGAM1498 include diagnosis, prevention and treatment of diseases and clinical conditions associated with LOC154992. LOC201868 (Accession XM_114393) is another VGAM1498 host target gene. LOC201868 BINDING SITE is HOST TARGET binding site found in the 3' untranslated region of mRNA encoded by LOC201868, corresponding to a HOST TARGET binding site such as BINDING SITE I, BINDING SITE II or BINDING SITE III. Table 2 illustrates the complementarity of the nucleotide sequences of LOC201868 BINDING SITE, designated SEQ ID:42921, to the nucleotide sequence of VGAM1498 RNA, herein designated VGAM RNA, also designated SEQ ID:4209.

Another function of VGAM1498 is therefore inhibition of LOC201868 (Accession XM_114393). Accordingly, utilities of VGAM1498 include diagnosis, prevention and treatment of diseases and clinical conditions associated with LOC201868. LOC222068 (Accession XM_166556) is another VGAM1498 host target gene. LOC222068 BINDING SITE is HOST TARGET binding site found in the 3' untranslated region of mRNA encoded by LOC222068, corresponding to a HOST TARGET binding site such as BINDING SITE I, BINDING SITE II or BINDING SITE III. Table 2 illustrates the complementarity of the nucleotide sequences of LOC222068 BINDING SITE, designated SEQ ID:44537, to the nucleotide sequence of VGAM1498 RNA, herein designated VGAM RNA, also designated SEQ ID:4209.

Another function of VGAM1498 is therefore inhibition of LOC222068 (Accession XM_166556). Accordingly, utilities of VGAM1498 include diagnosis, prevention and treatment of diseases and clinical conditions associated with LOC222068. LOC93052 (Accession XM_048905) is another VGAM1498 host target gene. LOC93052 BINDING SITE is HOST TARGET binding site found in the 5' untranslated region of mRNA encoded by LOC93052, corresponding to a HOST TARGET binding site such as BINDING SITE I, BINDING SITE II or BINDING SITE III. Table 2 illustrates the complementarity of the nucleotide sequences of LOC93052 BINDING SITE, designated SEQ ID:35300, to the nucleotide sequence of VGAM1498 RNA, herein designated VGAM RNA, also designated SEQ ID:4209.

Another function of VGAM1498 is therefore inhibition of LOC93052 (Accession XM_048905). Accordingly, utilities of VGAM1498 include diagnosis, prevention and treatment of diseases and clinical conditions associated with LOC93052. FIG. 1 further provides a conceptual description of a novel bioinformatically detected viral gene of the present invention, referred to here as Viral Genomic Address Messenger 1499 (VGAM1499) viral gene, which modulates expression of respective host target genes thereof, the function and utility of which host target genes is known in the art.

VGAM1499 is a novel bioinformatically detected regulatory, non protein coding, viral micro RNA (miRNA) gene. The method by which VGAM1499 was detected is described hereinabove with reference to FIGS. 1-8.

VGAM1499 gene, herein designated VGAM GENE, is a viral gene contained in the genome of Alcelaphine Herpesvirus 1. VGAM1499 host target gene, herein designated VGAM HOST TARGET GENE, is a human gene contained in the human genome.

VGAM1499 gene encodes a VGAM1499 precursor RNA, herein designated VGAM PRECURSOR RNA. Similar to other miRNA genes, and unlike most ordinary genes, VGAM1499 precursor RNA does not encode a protein. A nucleotide sequence identical or highly similar to the nucleotide sequence of VGAM1499 precursor RNA is designated SEQ ID:1485, and is provided hereinbelow with reference to the sequence listing part. Nucleotide sequence SEQ ID:1485 is located at position 110926 relative to the genome of Alcelaphine Herpesvirus 1.

VGAM1499 precursor RNA folds onto itself, forming VGAM1499 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1499 folded precursor RNA into VGAM1499 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM1499 RNA is designated SEQ ID:4210, and is provided hereinbelow with reference to the sequence listing part.

VGAM1499 host target gene, herein designated VGAM HOST TARGET GENE, encodes a corresponding messenger RNA, VGAM1499 host target RNA, herein designated VGAM HOST TARGET RNA. VGAM1499 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1499 RNA, herein designated VGAM RNA, binds complementarily to one or more host target binding sites located in untranslated regions of VGAM1499 host target RNA, herein designated VGAM HOST TARGET RNA. This complementary binding is due to the fact that the nucleotide sequence of VGAM1499 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1499 RNA, herein designated VGAM RNA, may have a different number of host target binding sites in untranslated regions of a VGAM1499 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1499 RNA, herein designated VGAM RNA, to host target binding sites on VGAM1499 host target RNA, herein designated VGAM HOST TARGET RNA, such as BINDING SITE I, BINDING SITE II and BINDING SITE III, inhibits translation of VGAM1499 host target RNA into VGAM1499 host target protein, herein designated VGAM HOST TARGET PROTEIN. VGAM host target protein is therefore outlined by a broken line.

It is appreciated that VGAM1499 host target gene, herein designated VGAM HOST TARGET GENE, in fact represents a plurality of VGAM1499 host target genes. The mRNA of each one of this plurality of VGAM1499 host target genes comprises one or more host target binding sites, each having a nucleotide sequence which is at least partly complementary to VGAM1499 RNA, herein designated VGAM RNA, and which when bound by VGAM1499 RNA causes inhibition of translation of respective one or more VGAM1499 host target proteins.

It is further appreciated by one skilled in the art that the mode of translational inhibition illustrated by FIG. 1 with specific reference to translational inhibition exerted by VGAM1499 gene, herein designated VGAM GENE, on one or more VGAM1499 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1499 is inhibition of expression of host target genes, as part of a novel viral mechanism of attacking a host. Accordingly, utilities of VGAM1499 include diagnosis, prevention and treatment of viral infection by Alcelaphine Herpesvirus 1. Specific functions, and accordingly utilities, of VGAM1499 correlate with, and may be deduced from, the identity of the host target genes which VGAM1499 binds and inhibits, and the function of these host target genes, as elaborated hereinbelow.

Nucleotide sequences of the VGAM1499 precursor RNA, herein designated VGAM PRECURSOR RNA, and of the 'diced' VGAM1499 RNA, herein designated VGAM RNA, and a schematic representation of the secondary folding of VGAM1499 folded precursor RNA, herein designated VGAM FOLDED PRECURSOR RNA, of VGAM1499 are further described hereinbelow with reference to Table 1.

Nucleotide sequences of host target binding sites, such as BINDING SITE-I, BINDING SITE-II and BINDING SITE-III of FIG. 1, found on VGAM1499 host target RNA, and schematic representation of the complementarity of each of these host target binding sites to VGAM1499 RNA, herein designated VGAM RNA, are described hereinbelow with reference to Table 2.

As mentioned hereinabove with reference to FIG. 1, a function of VGAM1499 gene, herein designated VGAM is inhibition of expression of VGAM1499 target genes. It is appreciated that specific functions, and accordingly utilities, of VGAM1499 correlate with, and may be deduced from, the identity of the target genes which VGAM1499 binds and inhibits, and the function of these target genes, as elaborated hereinbelow.

Cyclin-dependent Kinase Inhibitor 1B (p27, Kip1) (CDKN1B, Accession NM_004064) is a VGAM1499 host target gene. CDKN1B BINDING SITE is HOST TARGET binding site found in the 3' untranslated region of mRNA encoded by CDKN1B, corresponding to a HOST TARGET binding site such as BINDING SITE I, BINDING SITE II or BINDING SITE III. Table 2 illustrates the complementarity of the nucleotide sequences of CDKN1B BINDING SITE, designated SEQ ID:10272, to the nucleotide sequence of VGAM1499 RNA, herein designated VGAM RNA, also designated SEQ ID:4210.

A function of VGAM1499 is therefore inhibition of Cyclin-dependent Kinase Inhibitor 1B (p27, Kip1) (CDKN1B, Accession NM_004064), a gene which is involved in g1 arrest and may mediate tgf beta-induced g1 arrest. Accordingly, utilities of VGAM1499 include diagnosis, prevention and treatment of diseases and clinical conditions associated with CDKN1B. The function of CDKN1B and its association with various diseases and clinical conditions, has been established by previous studies, as described hereinabove with reference to VGAM592. Empty Spiracles Homolog 2 (Drosophila) (EMX2, Accession XM_113640) is another VGAM1499 host target gene. EMX2 BINDING SITE is HOST TARGET binding site found in the 3' untranslated region of mRNA encoded by EMX2, corresponding to a HOST TARGET binding site such as BINDING SITE I, BINDING SITE II or BINDING SITE III. Table 2 illustrates the complementarity of the nucleotide sequences of EMX2 BINDING SITE, designated SEQ ID:42314, to the nucleotide sequence of VGAM1499 RNA, herein designated VGAM RNA, also designated SEQ ID:4210.

Another function of VGAM1499 is therefore inhibition of Empty Spiracles Homolog 2 (Drosophila) (EMX2, Accession XM_113640), a gene which may function in combinations with otx1/2 to specify cell fates in the developing central nervous system. Accordingly, utilities of VGAM1499 include diagnosis, prevention and treatment of diseases and clinical conditions associated with EMX2. The function of EMX2 and its association with various diseases and clinical conditions, has been established by previous studies, as described hereinabove with reference to VGAM510. Lysosomal-associated Membrane Protein 2 (LAMP2, Accession NM_013995) is another VGAM1499 host target gene. LAMP2 BINDING SITE is HOST TARGET binding site found in the 3' untranslated region of mRNA encoded by LAMP2, corresponding to a HOST TARGET binding site such as BINDING SITE I, BINDING SITE II or BINDING SITE III. Table 2 illustrates the complementarity of the nucleotide sequences of LAMP2 BINDING SITE, designated SEQ ID:15183, to the nucleotide sequence of VGAM1499 RNA, herein designated VGAM RNA, also designated SEQ ID:4210.

Another function of VGAM1499 is therefore inhibition of Lysosomal-associated Membrane Protein 2 (LAMP2, Accession NM_013995). Accordingly, utilities of VGAM1499 include diagnosis, prevention and treatment of diseases and clinical conditions associated with LAMP2. Paired Box Gene 6 (aniridia, keratitis) (PAX6, Accession NM_000280) is another VGAM1499 host target gene. PAX6 BINDING SITE1 and PAX6 BINDING SITE2 are HOST TARGET binding sites found in untranslated regions of mRNA encoded by PAX6, corresponding to HOST TARGET binding sites such as BINDING SITE I, BINDING SITE II or BINDING SITE III. Table 2 illustrates the complementarity of the nucleotide sequences of PAX6 BINDING SITE1 and PAX6 BINDING SITE2, designated SEQ ID:5825 and SEQ ID:7309 respectively, to the nucleotide sequence of VGAM1499 RNA, herein designated VGAM RNA, also designated SEQ ID:4210.

Another function of VGAM1499 is therefore inhibition of Paired Box Gene 6 (aniridia, keratitis) (PAX6, Accession NM_000280), a gene which involves in oculogenesis. Accordingly, utilities of VGAM1499 include diagnosis, prevention and treatment of diseases and clinical conditions associated with PAX6. The function of PAX6 has been established by previous studies. PAX6 is a member of the paired box gene family and encodes a transcriptional regulator involved in oculogenesis, pancreatic, pituitary and central nervous system development. Hanson and Van Heyningen (1995) reviewed the work on PAX6 in man, mouse, and Drosophila. A chronology was provided, beginning with identification of the 'paired' gene as a key regulator of segmentation in Drosophila in 1980 to the discovery by Halder et al. (1995) that ectopic expression of Drosophila Pax6 induces ectopic eye development. Wawersik and Maas (2000) reviewed the role of Pax6 and other genes in vertebrate and fly oculogenesis. Animal model experiments lend further support to the function of PAX6. Lyon (1988) suggested that 'small eye' (Sey) in the mouse, which is on chromosome 2, may be homologous to aniridia type II (OMIM Ref. No. 106210) inasmuch as there is a region of conserved homology of synteny between human 11p and mouse chromosome 2. This suggestion was corroborated by van der Meer-de Jong et al. (1990) who found through interspecies backcrosses for linkage mapping that the Sey gene lies between Fshb and Cas-1. In the human, AN2 lies between the 2 cognate genes, FSHB and CAT. Glaser et al. (1990) studied the Sey mutation by localizing in an interspecies backcross between Mus musculus/domesticus and Mus spretus, the region on mouse chromosome 2 carrying 9 evolutionarily conserved DNA clones from proximal human 11p. In Dickie's small eye, they found deletion of 3 clones that encompass the aniridia (AN2) and Wilms tumor susceptibility genes in man. Unlike their human counterparts, the heterozygous Dickie's small eye mice do not develop nephroblastomas. The homology of Sey and AN2 was established by the cloning of the AN2 gene in the human and its homolog in the mouse, and the demonstration of mutations in 3 independent Sey alleles (Hill et al., 1991). The mutations would predictably disrupt the function of the gene, which belongs to the Pax multigene family. This family of developmental genes was first described in Drosophila. A Pax gene referred to as Pax6 is identical to the mouse homolog of the candidate aniridia gene. Matsuo et al. (1993) found an internal deletion of about 600 bp in the Pax6 gene in rats homozygous for the small eye mutation. Deletion was due to a single base insertion that generated an abnormal 5-prime donor splice site. They showed that anterior midbrain crest cells in the homozygous embryos reached the eye rudiments but did not migrate any further to the nasal rudiments, suggesting that the Pax6 gene is involved in conducting migration of neural crest cells from the anterior midbrain.

It is appreciated that the abovementioned animal model for PAX6 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Wawersik, S.; Maas, R. L.: Vertebrate eye development as modeled in Drosophila. Hum. Molec. Genet. 9:917-925, 2000; and Glaser, T.; Lane, J.; Housman, D.: A mouse model of the aniridia-Wilms tumor deletion syndrome. Science 250:823-827, 1990.

Further studies establishing the function and utilities of PAX6 are found in John Hopkins OMIM database record ID 607108, and in sited publications numbered 5548, 12160, 8112, 12161, 12310-12313, 5586-5588, 11658-5590, 12314, 12315, 12316-12317, 5593-5595, 12318, 12319-12320, 6139, 12162, 12321-12323, 5575, 12324, 12325-5497, 10763, 12326, 12329, 12327-550 and 1 listed in the bibliography section hereinbelow, which are also hereby incorporated by reference. Down Syndrome Critical Region Gene 1-like 1 (DSCR1L1, Accession NM_005822) is another VGAM1499 host target gene. DSCR1L1 BINDING SITE is HOST TARGET binding site found in the 3' untranslated region of mRNA encoded by DSCR1L1, corresponding to a HOST TARGET binding site such as BINDING SITE I, BINDING SITE II or BINDING SITE III. Table 2 illustrates the complementarity of the nucleotide sequences of DSCR1L1 BINDING SITE, designated SEQ ID:12427, to the nucleotide sequence of VGAM1499 RNA, herein designated VGAM RNA, also designated SEQ ID:4210.

Another function of VGAM1499 is therefore inhibition of Down Syndrome Critical Region Gene 1-like 1 (DSCR1L1, Accession NM_005822). Accordingly, utilities of VGAM1499 include diagnosis, prevention and treatment of diseases and clinical conditions associated with DSCR1L1. FLJ14906 (Accession NM_032859) is another VGAM1499 host target gene. FLJ14906 BINDING SITE is HOST TARGET binding site found in the 3' untranslated region of mRNA encoded by FLJ14906, corresponding to a HOST TARGET binding site such as BINDING SITE I, BINDING SITE II or BINDING SITE III. Table 2 illustrates the complementarity of the nucleotide sequences of FLJ14906 BINDING SITE, designated SEQ ID:26663, to the nucleotide sequence of VGAM1499 RNA, herein designated VGAM RNA, also designated SEQ ID:4210.

Another function of VGAM1499 is therefore inhibition of FLJ14906 (Accession NM_032859). Accordingly, utilities of VGAM1499 include diagnosis, prevention and treatment of diseases and clinical conditions associated with FLJ14906. FLJ22794 (Accession XM_166220) is another VGAM1499 host target gene. FLJ22794 BINDING SITE is HOST TARGET binding site found in the 5' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44029, to the nucleotide sequence of VGAM1499 RNA, herein designated VGAM RNA, also designated SEQ ID:4210.

Another function of VGAM1499 is therefore inhibition of FLJ22794 (Accession XM_166220). Accordingly, utilities of VGAM1499 include diagnosis, prevention and treatment of diseases and clinical conditions associated with FLJ22794. KIAA0471 (Accession NM_014857) is another VGAM1499 host target gene. KIAA0471 BINDING SITE is HOST TARGET binding site found in the 3' untranslated region of mRNA encoded by KIAA0471, corresponding to a HOST TARGET binding site such as BINDING SITE I, BINDING SITE II or BINDING SITE III. Table 2 illustrates the complementarity of the nucleotide sequences of KIAA0471 BINDING SITE, designated SEQ ID:16911, to the nucleotide sequence of VGAM1499 RNA, herein designated VGAM RNA, also designated SEQ ID:4210.

Another function of VGAM1499 is therefore inhibition of KIAA0471 (Accession NM_014857). Accordingly, utilities of VGAM1499 include diagnosis, prevention and treatment of diseases and clinical conditions associated with KIAA0471. KIAA1456 (Accession XM_040100) is another VGAM1499 host target gene. KIAA1456 BINDING SITE is HOST TARGET binding site found in the 3' untranslated region of mRNA encoded by KIAA1456, corresponding to a HOST TARGET binding site such as BINDING SITE I, BINDING SITE II or BINDING SITE III. Table 2 illustrates the complementarity of the nucleotide sequences of KIAA1456 BINDING SITE, designated SEQ ID:33263, to the nucleotide sequence of VGAM1499 RNA, herein designated VGAM RNA, also designated SEQ ID:4210.

Another function of VGAM1499 is therefore inhibition of KIAA1456 (Accession XM_040100). Accordingly, utilities of VGAM1499 include diagnosis, prevention and treatment of diseases and clinical conditions associated with KIAA1456. PRO1768 (Accession NM_014099) is another VGAM1499 host target gene. PRO1768 BINDING SITE is HOST TARGET binding site found in the 5' untranslated region of mRNA encoded by PRO1768, corresponding to a HOST TARGET binding site such as BINDING SITE I, BINDING SITE II or BINDING SITE III. Table 2 illustrates the complementarity of the nucleotide sequences of PRO1768 BINDING SITE, designated SEQ ID:15322, to the nucleotide sequence of VGAM1499 RNA, herein designated VGAM RNA, also designated SEQ ID:4210.

Another function of VGAM1499 is therefore inhibition of PRO1768 (Accession NM_014099). Accordingly, utilities of VGAM1499 include diagnosis, prevention and treatment of diseases and clinical conditions associated with PRO1768. S164 (Accession XM_027330) is another VGAM1499 host target gene. S164 BINDING SITE is HOST TARGET binding site found in the 3' untranslated region of mRNA encoded by S164, corresponding to a HOST TARGET binding site such as BINDING SITE I, BINDING SITE II or BINDING SITE III. Table 2 illustrates the complementarity of the nucleotide sequences of S164 BINDING SITE, designated SEQ ID:30481, to the nucleotide sequence of VGAM1499 RNA, herein designated VGAM RNA, also designated SEQ ID:4210.

Another function of VGAM1499 is therefore inhibition of S164 (Accession XM_027330). Accordingly, utilities of VGAM1499 include diagnosis, prevention and treatment of diseases and clinical conditions associated with S164. SP329 (Accession NM_030793) is another VGAM1499 host target gene. SP329 BINDING SITE is HOST TARGET binding site found in the 5' untranslated region of mRNA encoded by SP329, corresponding to a HOST TARGET binding site such as BINDING SITE I, BINDING SITE II or BINDING SITE III. Table 2 illustrates the complementarity of the nucleotide sequences of SP329 BINDING SITE, designated SEQ ID:25097, to the nucleotide sequence of VGAM1499 RNA, herein designated VGAM RNA, also designated SEQ ID:4210.

Another function of VGAM1499 is therefore inhibition of SP329 (Accession NM_030793). Accordingly, utilities of VGAM1499 include diagnosis, prevention and treatment of diseases and clinical conditions associated with SP329. LOC123443 (Accession XM_058707) is another VGAM1499 host target gene. LOC123443 BINDING SITE is HOST TARGET binding site found in the 5' untranslated region of mRNA encoded by LOC123443, corresponding to a HOST TARGET binding site such as BINDING SITE I, BINDING SITE II or BINDING SITE III. Table 2 illustrates the complementarity of the nucleotide sequences of LOC123443 BINDING SITE, designated SEQ ID:36725, to the nucleotide sequence of VGAM1499 RNA, herein designated VGAM RNA, also designated SEQ ID:4210.

Another function of VGAM1499 is therefore inhibition of LOC123443 (Accession XM_058707). Accordingly, utilities of VGAM1499 include diagnosis, prevention and treatment of diseases and clinical conditions associated with LOC123443. LOC130535 (Accession XM_072244) is another VGAM1499 host target gene. LOC130535 BINDING SITE is HOST TARGET binding site found in the 3' untranslated region of mRNA encoded by LOC130535, corresponding to a HOST TARGET binding site such as BINDING SITE I, BINDING SITE II or BINDING SITE III. Table 2 illustrates the complementarity of the nucleotide sequences of LOC130535 BINDING SITE, designated SEQ ID:37476, to the nucleotide sequence of VGAM1499 RNA, herein designated VGAM RNA, also designated SEQ ID:4210.

Another function of VGAM1499 is therefore inhibition of LOC130535 (Accession XM_072244). Accordingly, utilities of VGAM1499 include diagnosis, prevention and treatment of diseases and clinical conditions associated with LOC130535. LOC130813 (Accession XM_065904) is another VGAM1499 host target gene. LOC130813 BINDING SITE is HOST TARGET binding site found in the 3' untranslated region of mRNA encoded by LOC130813, corresponding to a HOST TARGET binding site such as BINDING SITE I, BINDING SITE II or BINDING SITE III. Table 2 illustrates the complementarity of the nucleotide sequences of LOC130813 BINDING SITE, designated SEQ ID:37311, to the nucleotide sequence of VGAM1499 RNA, herein designated VGAM RNA, also designated SEQ ID:4210.

Another function of VGAM1499 is therefore inhibition of LOC130813 (Accession XM_065904). Accordingly, utilities of VGAM1499 include diagnosis, prevention and treatment of diseases and clinical conditions associated with LOC130813. LOC149301 (Accession XM_086480) is another VGAM1499 host target gene. LOC149301 BINDING SITE is HOST TARGET binding site found in the 3' untranslated region of mRNA encoded by LOC149301, corresponding to a HOST TARGET binding site such as BINDING SITE I, BINDING SITE II or BINDING SITE III. Table 2 illustrates the complementarity of the nucleotide sequences of LOC149301 BINDING SITE, designated SEQ ID:38686, to the nucleotide sequence of VGAM1499 RNA, herein designated VGAM RNA, also designated SEQ ID:4210.

Another function of VGAM1499 is therefore inhibition of LOC149301 (Accession XM_086480). Accordingly, utilities of VGAM1499 include diagnosis, prevention and treatment of diseases and clinical conditions associated with LOC149301. LOC164382 (Accession XM_104390) is another VGAM1499 host target gene. LOC164382 BINDING SITE is HOST TARGET binding site found in the 3' untranslated region of mRNA encoded by LOC164382, corresponding to a HOST TARGET binding site such as BINDING SITE I, BINDING SITE II or BINDING SITE III. Table 2 illustrates the complementarity of the nucleotide sequences of LOC164382 BINDING SITE, designated SEQ ID:42159, to the nucleotide sequence of VGAM1499 RNA, herein designated VGAM RNA, also designated SEQ ID:4210.

Another function of VGAM1499 is therefore inhibition of LOC164382 (Accession XM_104390). Accordingly, utilities of VGAM1499 include diagnosis, prevention and treatment of diseases and clinical conditions associated with LOC164382. LOC203523 (Accession XM_114713) is another VGAM1499 host target gene. LOC203523 BINDING SITE is HOST TARGET binding site found in the 3' untranslated region of mRNA encoded by LOC203523, corresponding to a HOST TARGET binding site such as BINDING SITE I, BINDING SITE II or BINDING SITE III. Table 2 illustrates the complementarity of the nucleotide sequences of LOC203523 BINDING SITE, designated SEQ ID:43053, to the nucleotide sequence of VGAM1499 RNA, herein designated VGAM RNA, also designated SEQ ID:4210.

Another function of VGAM1499 is therefore inhibition of LOC203523 (Accession XM_114713). Accordingly, utilities of VGAM1499 include diagnosis, prevention and treatment of diseases and clinical conditions associated with LOC203523. LOC85479 (Accession NM_033105) is another VGAM1499 host target gene. LOC85479 BINDING SITE is HOST TARGET binding site found in the 5' untranslated region of mRNA encoded by LOC85479, corresponding to a HOST TARGET binding site such as BINDING SITE I, BINDING SITE II or BINDING SITE III. Table 2 illustrates the complementarity of the nucleotide sequences of LOC85479 BINDING SITE, designated SEQ ID:26958, to the nucleotide sequence of VGAM1499 RNA, herein designated VGAM RNA, also designated SEQ ID:4210.

Another function of VGAM1499 is therefore inhibition of LOC85479 (Accession NM_033105). Accordingly, utilities of VGAM1499 include diagnosis, prevention and treatment of diseases and clinical conditions associated with LOC85479. FIG. 1 further provides a conceptual description of a novel bioinformatically detected viral gene of the present invention, referred to here as Viral Genomic Address Messenger 1500 (VGAM1500) viral gene, which modulates expression of respective host target genes thereof, the function and utility of which host target genes is known in the art.

VGAM1500 is a novel bioinformatically detected regulatory, non protein coding, viral micro RNA (miRNA) gene. The method by which VGAM1500 was detected is described hereinabove with reference to FIGS. 1-8.

VGAM1500 gene, herein designated VGAM GENE, is a viral gene contained in the genome of Aphid Lethal Paralysis Virus. VGAM1500 host target gene, herein designated VGAM HOST TARGET GENE, is a human gene contained in the human genome.

VGAM1500 gene encodes a VGAM1500 precursor RNA, herein designated VGAM PRECURSOR RNA. Similar to other miRNA genes, and unlike most ordinary genes, VGAM1500 precursor RNA does not encode a protein. A nucleotide sequence identical or highly similar to the nucleotide sequence of VGAM1500 precursor RNA is designated SEQ ID:1486, and is provided hereinbelow with reference to the sequence listing part. Nucleotide sequence SEQ ID:1486 is located at position 3755 relative to the genome of Aphid Lethal Paralysis Virus.

VGAM1500 precursor RNA folds onto itself, forming VGAM1500 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1500 folded precursor RNA into VGAM1500 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM1500 RNA is designated SEQ ID:4211, and is provided hereinbelow with reference to the sequence listing part.

VGAM1500 host target gene, herein designated VGAM HOST TARGET GENE, encodes a corresponding messenger RNA, VGAM1500 host target RNA, herein designated VGAM HOST TARGET RNA. VGAM1500 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1500 RNA, herein designated VGAM RNA, binds complementarily to one or more host target binding sites located in untranslated regions of VGAM1500 host target RNA, herein designated VGAM HOST TARGET RNA. This complementary binding is due to the fact that the nucleotide sequence of VGAM1500 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1500 RNA, herein designated VGAM RNA, may have a different number of host target binding sites in untranslated regions of a VGAM1500 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1500 RNA, herein designated VGAM RNA, to host target binding sites on VGAM1500 host target RNA, herein designated VGAM HOST TARGET RNA, such as BINDING SITE I, BINDING SITE II and BINDING SITE III, inhibits translation of VGAM1500 host target RNA into VGAM1500 host target protein, herein designated VGAM HOST TARGET PROTEIN. VGAM host target protein is therefore outlined by a broken line.

It is appreciated that VGAM1500 host target gene, herein designated VGAM HOST TARGET GENE, in fact represents a plurality of VGAM1500 host target genes. The mRNA of each one of this plurality of VGAM1500 host target genes comprises one or more host target binding sites, each having a nucleotide sequence which is at least partly complementary to VGAM1500 RNA, herein designated VGAM RNA, and which when bound by VGAM1500 RNA causes inhibition of translation of respective one or more VGAM1500 host target proteins.

It is further appreciated by one skilled in the art that the mode of translational inhibition illustrated by FIG. 1 with specific reference to translational inhibition exerted by VGAM1500 gene, herein designated VGAM GENE, on one or more VGAM1500 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1500 is inhibition of expression of host target genes, as part of a novel viral mechanism of attacking a host. Accordingly, utilities of VGAM1500 include diagnosis, prevention and treatment of viral infection by Aphid Lethal Paralysis Virus. Specific functions, and accordingly utilities, of VGAM1500 correlate with, and may be deduced from, the identity of the host target genes which VGAM1500 binds and inhibits, and the function of these host target genes, as elaborated hereinbelow.

Nucleotide sequences of the VGAM1500 precursor RNA, herein designated VGAM PRECURSOR RNA, and of the 'diced' VGAM1500 RNA, herein designated VGAM RNA, and a schematic representation of the secondary folding of VGAM1500 folded precursor RNA, herein designated VGAM FOLDED PRECURSOR RNA, of VGAM1500 are further described hereinbelow with reference to Table 1.

Nucleotide sequences of host target binding sites, such as BINDING SITE-I, BINDING SITE-II and BINDING SITE-III of FIG. 1, found on VGAM1500 host target RNA, and schematic representation of the complementarity of each of these host target binding sites to VGAM1500 RNA, herein designated VGAM RNA, are described hereinbelow with reference to Table 2.

As mentioned hereinabove with reference to FIG. 1, a function of VGAM1500 gene, herein designated VGAM is inhibition of expression of VGAM1500 target genes. It is appreciated that specific functions, and accordingly utilities, of VGAM1500 correlate with, and may be deduced from, the identity of the target genes which VGAM1500 binds and inhibits, and the function of these target genes, as elaborated hereinbelow.

Chromosome Condensation 1-like (CHC1L, Accession NM_001268) is a VGAM1500 host target gene. CHC1L BINDING SITE is HOST TARGET binding site found in the 3' untranslated region of mRNA encoded by CHC1L, corresponding to a HOST TARGET binding site such as BINDING SITE I, BINDING SITE II or BINDING SITE III. Table 2 illustrates the complementarity of the nucleotide sequences of CHC1L BINDING SITE, designated SEQ ID:6932, to the nucleotide sequence of VGAM1500 RNA, herein designated VGAM RNA, also designated SEQ ID:4211.

A function of VGAM1500 is therefore inhibition of Chromosome Condensation 1-like (CHC1L, Accession NM_001268). Accordingly, utilities of VGAM1500 include diagnosis, prevention and treatment of diseases and clinical conditions associated with CHC1L. Dystroglycan 1 (dystrophin-associated glycoprotein 1) (DAG1, Accession NM_004393) is another VGAM1500 host target gene. DAG1 BINDING SITE is HOST TARGET binding site found in the 3' untranslated region of mRNA encoded by DAG1, corresponding to a HOST TARGET binding site such as BINDING SITE I, BINDING SITE II or BINDING SITE III. Table 2 illustrates the complementarity of the nucleotide sequences of DAG1 BINDING SITE, designated SEQ ID:10632, to the nucleotide sequence of VGAM1500 RNA, herein designated VGAM RNA, also designated SEQ ID:4211.

Another function of VGAM1500 is therefore inhibition of Dystroglycan 1 (dystrophin-associated glycoprotein 1) (DAG1, Accession NM_004393), a gene which may provide linkage between the sarcolemma and extracellular matrix (ECM). Accordingly, utilities of VGAM1500 include diagnosis, prevention and treatment of diseases and clinical conditions associated with DAG1. The function of DAG1 and its association with various diseases and clinical conditions, has been established by previous studies, as described hereinabove with reference to VGAM1095. F-box and Leucine-rich Repeat Protein 11 (FBXL11, Accession NM_012308) is another VGAM1500 host target gene. FBXL11 BINDING SITE is HOST TARGET binding site found in the 3' untranslated region of mRNA encoded by FBXL11, corresponding to a HOST TARGET binding site such as BINDING SITE I, BINDING SITE II or BINDING SITE III. Table 2 illustrates the complementarity of the nucleotide sequences of FBXL11 BINDING SITE, designated SEQ ID:14681, to the nucleotide sequence of VGAM1500 RNA, herein designated VGAM RNA, also designated SEQ ID:4211.

Another function of VGAM1500 is therefore inhibition of F-box and Leucine-rich Repeat Protein 11 (FBXL11, Accession NM_012308), a gene which are BTB/POZ domain-containing zinc finger proteins implicated in oncogenesis. Accordingly, utilities of VGAM1500 include diagnosis, prevention and treatment of diseases and clinical conditions associated with FBXL11. The function of FBXL11 and its association with various diseases and clinical conditions, has been established by previous studies, as described hereinabove with reference to VGAM404. Vacuolar Protein Sorting 26 (yeast) (VPS26, Accession NM_004896) is another VGAM1500 host target gene. VPS26 BINDING SITE is HOST TARGET binding site found in the 3' untranslated region of mRNA encoded by VPS26, corresponding to a HOST TARGET binding site such as BINDING SITE I, BINDING SITE II or BINDING SITE III. Table 2 illustrates the complementarity of the nucleotide sequences of VPS26 BINDING SITE, designated SEQ ID:11327, to the nucleotide sequence of VGAM1500 RNA, herein designated VGAM RNA, also designated SEQ ID:4211.

Another function of VGAM1500 is therefore inhibition of Vacuolar Protein Sorting 26 (yeast) (VPS26, Accession NM_004896), a gene which is a sorting protein- ensures the proper delivery of organelle-specific proteins. Accordingly, utilities of VGAM1500 include diagnosis, prevention and treatment of diseases and clinical conditions associated with VPS26. The function of VPS26 and its association with various diseases and clinical conditions, has been established by previous studies, as described hereinabove with reference to VGAM315. KIAA0555 (Accession NM_014790) is another VGAM1500 host target gene. KIAA0555 BINDING SITE is HOST TARGET binding site found in the 3' untranslated region of mRNA encoded by KIAA0555, corresponding to a HOST TARGET binding site such as BINDING SITE I, BINDING SITE II or BINDING SITE III. Table 2 illustrates the complementarity of the nucleotide sequences of KIAA0555 BINDING SITE, designated SEQ ID:16684, to the nucleotide sequence of VGAM1500 RNA, herein designated VGAM RNA, also designated SEQ ID:4211.

Another function of VGAM1500 is therefore inhibition of KIAA0555 (Accession NM_014790). Accordingly, utilities of VGAM1500 include diagnosis, prevention and treatment of diseases and clinical conditions associated with KIAA0555. Zinc Finger Protein 185 (LIM domain) (ZNF185, Accession NM_007150) is another VGAM1500 host target gene. ZNF185 BINDING SITE is HOST TARGET binding site found in the 3' untranslated region of mRNA encoded by ZNF185, corresponding to a HOST TARGET binding site such as BINDING SITE I, BINDING SITE II or BINDING SITE III. Table 2 illustrates the complementarity of the nucleotide sequences of ZNF185 BINDING SITE, designated SEQ ID:14003, to the nucleotide sequence of VGAM1500 RNA, herein designated VGAM RNA, also designated SEQ ID:4211.

Another function of VGAM1500 is therefore inhibition of Zinc Finger Protein 185 (LIM domain) (ZNF185, Accession NM_007150). Accordingly, utilities of VGAM1500 include diagnosis, prevention and treatment of diseases and clinical conditions associated with ZNF185. LOC115265 (Accession XM_055596) is another VGAM1500 host target gene. LOC115265 BINDING SITE is HOST TARGET binding site found in the 3' untranslated region of mRNA encoded by LOC115265, corresponding to a HOST TARGET binding site such as BINDING SITE I, BINDING SITE II or BINDING SITE III. Table 2 illustrates the complementarity of the nucleotide sequences of LOC115265 BINDING SITE, designated SEQ ID:36309, to the nucleotide sequence of VGAM1500 RNA, herein designated VGAM RNA, also designated SEQ ID:4211.

Another function of VGAM1500 is therefore inhibition of LOC115265 (Accession XM_055596). Accordingly, utilities of VGAM1500 include diagnosis, prevention and treatment of diseases and clinical conditions associated with LOC115265. LOC257407 (Accession XM_173078) is another VGAM1500 host target gene. LOC257407 BINDING SITE is HOST TARGET binding site found in the 5' untranslated region of mRNA encoded by LOC257407, corresponding to a HOST TARGET binding site such as BINDING SITE I, BINDING SITE II or BINDING SITE III. Table 2 illustrates the complementarity of the nucleotide sequences of LOC257407 BINDING SITE, designated SEQ ID:46337, to the nucleotide sequence of VGAM1500 RNA, herein designated VGAM RNA, also designated SEQ ID:4211.

Another function of VGAM1500 is therefore inhibition of LOC257407 (Accession XM_173078). Accordingly, utilities of VGAM1500 include diagnosis, prevention and treatment of diseases and clinical conditions associated with LOC257407. FIG. 1 further provides a conceptual description of a novel bioinformatically detected viral gene of the present invention, referred to here as Viral Genomic Address Messenger 1501 (VGAM1501) viral gene, which modulates expression of respective host target genes thereof, the function and utility of which host target genes is known in the art.

VGAM1501 is a novel bioinformatically detected regulatory, non protein coding, viral micro RNA (miRNA) gene. The method by which VGAM1501 was detected is described hereinabove with reference to FIGS. 1-8.

VGAM1501 gene, herein designated VGAM GENE, is a viral gene contained in the genome of Aphid Lethal Paralysis Virus. VGAM1501 host target gene, herein designated VGAM HOST TARGET GENE, is a human gene contained in the human genome.

VGAM1501 gene encodes a VGAM1501 precursor RNA, herein designated VGAM PRECURSOR RNA. Similar to other miRNA genes, and unlike most ordinary genes, VGAM1501 precursor RNA does not encode a protein. A nucleotide sequence identical or highly similar to the nucleotide sequence of VGAM1501 precursor RNA is designated SEQ ID:1487, and is provided hereinbelow with reference to the sequence listing part. Nucleotide sequence SEQ ID:1487 is located at position 1260 relative to the genome of Aphid Lethal Paralysis Virus.

VGAM1501 precursor RNA folds onto itself, forming VGAM1501 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1501 folded precursor RNA into VGAM1501 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM1501 RNA is designated SEQ ID:4212, and is provided hereinbelow with reference to the sequence listing part.

VGAM1501 host target gene, herein designated VGAM HOST TARGET GENE, encodes a corresponding messenger RNA, VGAM1501 host target RNA, herein designated VGAM HOST TARGET RNA. VGAM1501 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1501 RNA, herein designated VGAM RNA, binds complementarily to one or more host target binding sites located in untranslated regions of VGAM1501 host target RNA, herein designated VGAM HOST TARGET RNA. This complementary binding is due to the fact that the nucleotide sequence of VGAM1501 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1501 RNA, herein designated VGAM RNA, may have a different number of host target binding sites in untranslated regions of a VGAM1501 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1501 RNA, herein designated VGAM RNA, to host target binding sites on VGAM1501 host target RNA, herein designated VGAM HOST TARGET RNA, such as BINDING SITE I, BINDING SITE II and BINDING SITE III, inhibits translation of VGAM1501 host target RNA into VGAM1501 host target protein, herein designated VGAM HOST TARGET PROTEIN. VGAM host target protein is therefore outlined by a broken line.

It is appreciated that VGAM1501 host target gene, herein designated VGAM HOST TARGET GENE, in fact represents a plurality of VGAM1501 host target genes. The mRNA of each one of this plurality of VGAM1501 host target genes comprises one or more host target binding sites, each having a nucleotide sequence which is at least partly complementary to VGAM1501 RNA, herein designated VGAM RNA, and which when bound by VGAM1501 RNA causes inhibition of translation of respective one or more VGAM1501 host target proteins.

It is further appreciated by one skilled in the art that the mode of translational inhibition illustrated by FIG. 1 with specific reference to translational inhibition exerted by VGAM1501 gene, herein designated VGAM GENE, on one or more VGAM1501 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1501 is inhibition of expression of host target genes, as part of a novel viral mechanism of attacking a host. Accordingly, utilities of VGAM1501 include diagnosis, prevention and treatment of viral infection by Aphid Lethal Paralysis Virus. Specific functions, and accordingly utilities, of VGAM1501 correlate with, and may be deduced from, the identity of the host target genes which VGAM1501 binds and inhibits, and the function of these host target genes, as elaborated hereinbelow.

Nucleotide sequences of the VGAM1501 precursor RNA, herein designated VGAM PRECURSOR RNA, and of the 'diced' VGAM1501 RNA, herein designated VGAM RNA, and a schematic representation of the secondary folding of VGAM1501 folded precursor RNA, herein designated VGAM FOLDED PRECURSOR RNA, of VGAM1501 are further described hereinbelow with reference to Table 1.

Nucleotide sequences of host target binding sites, such as BINDING SITE-I, BINDING SITE-II and BINDING SITE-III of FIG. 1, found on VGAM1501 host target RNA, and schematic representation of the complementarity of each of these host target binding sites to VGAM1501 RNA, herein designated VGAM RNA, are described hereinbelow with reference to Table 2.

As mentioned hereinabove with reference to FIG. 1, a function of VGAM1501 gene, herein designated VGAM is inhibition of expression of VGAM1501 target genes. It is appreciated that specific functions, and accordingly utilities, of VGAM1501 correlate with, and may be deduced from, the identity of the target genes which VGAM1501 binds and inhibits, and the function of these target genes, as elaborated hereinbelow.

Chromosome 20 Open Reading Frame 12 (C20orf12, Accession NM_018152) is a VGAM1501 host target gene. C20orf12 BINDING SITE is HOST TARGET binding site found in the 5' untranslated region of mRNA encoded by C20orf12, corresponding to a HOST TARGET binding site such as BINDING SITE I, BINDING SITE II or BINDING SITE III. Table 2 illustrates the complementarity of the nucleotide sequences of C20orf12 BINDING SITE, designated SEQ ID:19955, to the nucleotide sequence of VGAM1501 RNA, herein designated VGAM RNA, also designated SEQ ID:4212.

A function of VGAM1501 is therefore inhibition of Chromosome 20 Open Reading Frame 12 (C20orf12, Accession NM_018152). Accordingly, utilities of VGAM1501 include diagnosis, prevention and treatment of diseases and clinical conditions associated with C20orf12. FIG. 1 further provides a conceptual description of a novel bioinformatically detected viral gene of the present invention, referred to here as Viral Genomic Address Messenger 1502 (VGAM1502) viral gene, which modulates expression of respective host target genes thereof, the function and utility of which host target genes is known in the art.

VGAM1502 is a novel bioinformatically detected regulatory, non protein coding, viral micro RNA (miRNA) gene. The method by which VGAM1502 was detected is described hereinabove with reference to FIGS. 1-8.

VGAM1502 gene, herein designated VGAM GENE, is a viral gene contained in the genome of Aphid Lethal Paralysis Virus. VGAM1502 host target gene, herein designated VGAM HOST TARGET GENE, is a human gene contained in the human genome.

VGAM1502 gene encodes a VGAM1502 precursor RNA, herein designated VGAM PRECURSOR RNA. Similar to other miRNA genes, and unlike most ordinary genes, VGAM1502 precursor RNA does not encode a protein. A nucleotide sequence identical or highly similar to the nucleotide sequence of VGAM1502 precursor RNA is designated SEQ ID:1488, and is provided hereinbelow with reference to the sequence listing part. Nucleotide sequence SEQ ID:1488 is located at position 1441 relative to the genome of Aphid Lethal Paralysis Virus.

VGAM1502 precursor RNA folds onto itself, forming VGAM1502 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1502 folded precursor RNA into VGAM1502 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM1502 RNA is designated SEQ ID:4213, and is provided hereinbelow with reference to the sequence listing part.

VGAM1502 host target gene, herein designated VGAM HOST TARGET GENE, encodes a corresponding messenger RNA, VGAM1502 host target RNA, herein designated VGAM HOST TARGET RNA. VGAM1502 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1502 RNA, herein designated VGAM RNA, binds complementarily to one or more host target binding sites located in untranslated regions of VGAM1502 host target RNA, herein designated VGAM HOST TARGET RNA. This complementary binding is due to the fact that the nucleotide sequence of VGAM1502 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1502 RNA, herein designated VGAM RNA, may have a different number of host target binding sites in untranslated regions of a VGAM1502 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1502 RNA, herein designated VGAM RNA, to host target binding sites on VGAM1502 host target RNA, herein designated VGAM HOST TARGET RNA, such as BINDING SITE I, BINDING SITE II and BINDING SITE III, inhibits translation of VGAM1502 host target RNA into VGAM1502 host target protein, herein designated VGAM HOST TARGET PROTEIN. VGAM host target protein is therefore outlined by a broken line.

It is appreciated that VGAM1502 host target gene, herein designated VGAM HOST TARGET GENE, in fact represents a plurality of VGAM1502 host target genes. The mRNA of each one of this plurality of VGAM1502 host target genes comprises one or more host target binding sites, each having a nucleotide sequence which is at least partly complementary to VGAM1502 RNA, herein designated VGAM RNA, and which when bound by VGAM1502 RNA causes inhibition of translation of respective one or more VGAM1502 host target proteins.

It is further appreciated by one skilled in the art that the mode of translational inhibition illustrated by FIG. 1 with specific reference to translational inhibition exerted by VGAM1502 gene, herein designated VGAM GENE, on one or more VGAM1502 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1502 is inhibition of expression of host target genes, as part of a novel viral mechanism of attacking a host. Accordingly, utilities of VGAM1502 include diagnosis, prevention and treatment of viral infection by Aphid Lethal Paralysis Virus. Specific functions, and accordingly utilities, of VGAM1502 correlate with, and may be deduced from, the identity of the host target genes which VGAM1502 binds and inhibits, and the function of these host target genes, as elaborated hereinbelow.

Nucleotide sequences of the VGAM1502 precursor RNA, herein designated VGAM PRECURSOR RNA, and of the 'diced' VGAM1502 RNA, herein designated VGAM RNA, and a schematic representation of the secondary folding of VGAM1502 folded precursor RNA, herein designated VGAM FOLDED PRECURSOR RNA, of VGAM1502 are further described hereinbelow with reference to Table 1.

Nucleotide sequences of host target binding sites, such as BINDING SITE-I, BINDING SITE-II and BINDING SITE-III of FIG. 1, found on VGAM1502 host target RNA, and schematic representation of the complementarity of each of these host target binding sites to VGAM1502 RNA, herein designated VGAM RNA, are described hereinbelow with reference to Table 2.

As mentioned hereinabove with reference to FIG. 1, a function of VGAM1502 gene, herein designated VGAM is inhibition of expression of VGAM1502 target genes. It is appreciated that specific functions, and accordingly utilities, of VGAM1502 correlate with, and may be deduced from, the identity of the target genes which VGAM1502 binds and inhibits, and the function of these target genes, as elaborated hereinbelow.

Desmocollin 1 (DSC1, Accession NM_024421) is a VGAM1502 host target gene. DSC1 BINDING SITE1 and DSC1 BINDING SITE2 are HOST TARGET binding sites found in untranslated regions of mRNA encoded by DSC1, corresponding to HOST TARGET binding sites such as BINDING SITE I, BINDING SITE II or BINDING SITE III. Table 2 illustrates the complementarity of the nucleotide sequences of DSC1 BINDING SITE1 and DSC1 BINDING SITE2, designated SEQ ID:23660 and SEQ ID:11390 respectively, to the nucleotide sequence of VGAM1502 RNA, herein designated VGAM RNA, also designated SEQ ID:4213.

A function of VGAM1502 is therefore inhibition of Desmocollin 1 (DSC1, Accession NM_024421), a gene which is a component of intercellular desmosome junctions. Accordingly, utilities of VGAM1502 include diagnosis, prevention and treatment of diseases and clinical conditions associated with DSC1. The function of DSC1 has been established by previous studies. The desmosome is a complex adhesive structure that plays a fundamental role in maintaining the strength and integrity of epithelial tissues. Central to this role are transmembrane glycoproteins that mediate cell-cell adhesion at the extracellular surface and interact with the cytoskeleton (via components of the desmosomal plaque), thus linking the intermediate filament networks of adjacent cells. Desmosomal glycoproteins comprise 2 distinct groups, the desmogleins and the desmocollins, both of which are members of the cadherin superfamily of Ca (2+)-dependent cell adhesion molecules. In the human, 2 types of desmocollins had been identified, symbolized DSC1 and DSC2 (OMIM Ref. No. 125645), and each occurs in 2 alternatively spliced forms (variants a and b) that have different cytoplasmic domains reflecting different interactions with components of the desmosomal plaque (Troyanovsky et al., 1993). King et al. (1993) isolated cDNA clones encoding a human desmocollin that is expressed in the more differentiated layers of human epidermis. This isoform has 53% amino acid identity with the previously isolated type 3 desmocollin, which is expressed in the basal layers of the epidermis. However, the N and C termini of the mature proteins are more highly conserved. Using a panel of somatic cell hybrids, King et al. (1993) assigned the DSC1 gene to chromosome 18, where the DSC2 gene and the 3 desmoglein genes (DSG1, 125670; DSG2, 125671; DSG3, 169615) had previously been mapped.

Full details of the abovementioned studies are described in the following publications, the disclosure of which are hereby incorporated by reference:

King, I. A.; Arnemann, J.; Spurr, N. K.; Buxton, R. S.: Cloning of the cDNA (DSC1) coding for human type 1 desmocollin and its assignment to chromosome 18. Genomics 18:185-194, 1993; and Troyanovsky, S. M.; Eshkind, L. G.; Troyanovsky, R. B.; Leube, R. E.; Franke, W. W.: Contributions of cytoplasmic domains of desmosomal cadherins to desmosome assembly and intermediate.

Further studies establishing the function and utilities of DSC1 are found in John Hopkins OMIM database record ID 125643, and in sited publications numbered 359-360 listed in the bibliography section hereinbelow, which are also hereby incorporated by reference. Replication Protein A1, 70 kDa (RPA1, Accession NM_002945) is another VGAM1502 host target gene. RPA1 BINDING SITE is HOST TARGET binding site found in the 3' untranslated region of mRNA encoded by RPA1, corresponding to a HOST TARGET binding site such as BINDING SITE I, BINDING SITE II or BINDING SITE III. Table 2 illustrates the complementarity of the nucleotide sequences of RPA1 BINDING SITE, designated SEQ ID:8856, to the nucleotide sequence of VGAM1502 RNA, herein designated VGAM RNA, also designated SEQ ID:4213.

Another function of VGAM1502 is therefore inhibition of Replication Protein A1, 70 kDa (RPA1, Accession NM_002945), a gene which is required for simian virus 40 dna replication in vitro. it participates in a very early step in initiation. rp-a is a single-stranded dna-binding protein. Accordingly, utilities of VGAM1502 include diagnosis, prevention and treatment of diseases and clinical conditions associated with RPA1. The function of RPA1 and its association with various diseases and clinical conditions, has been established by previous studies, as described hereinabove with reference to VGAM180. Tumor Necrosis Factor (ligand) Superfamily, Member 8 (TNFSF8, Accession NM_001244) is another VGAM1502 host target gene. TNFSF8 BINDING SITE is HOST TARGET binding site found in the 3' untranslated region of mRNA encoded by TNFSF8, corresponding to a HOST TARGET binding site such as BINDING SITE I, BINDING SITE II or BINDING SITE III. Table 2 illustrates the complementarity of the nucleotide sequences of TNFSF8 BINDING SITE, designated SEQ ID:6916, to the nucleotide sequence of VGAM1502 RNA, herein designated VGAM RNA, also designated SEQ ID:4213.

Another function of VGAM1502 is therefore inhibition of Tumor Necrosis Factor (ligand) Superfamily, Member 8 (TNFSF8, Accession NM_001244), a gene which cytokine that binds to tnfrsf8/cd30. induces proliferation of t cells. Accordingly, utilities of VGAM1502 include diagnosis, prevention and treatment of diseases and clinical conditions associated with TNFSF8. The function of TNFSF8 and its association with various diseases and clinical conditions, has been established by previous studies, as described hereinabove with reference to VGAM655. BRAL1 (Accession NM_021817) is another VGAM1502 host target gene. BRAL1 BINDING SITE is HOST TARGET binding site found in the 5' untranslated region of mRNA encoded by BRAL1, corresponding to a HOST TARGET binding site such as BINDING SITE I, BINDING SITE II or BINDING SITE III. Table 2 illustrates the complementarity of the nucleotide sequences of BRAL1 BINDING SITE, designated SEQ ID:22395, to the nucleotide sequence of VGAM1502 RNA, herein designated VGAM RNA, also designated SEQ ID:4213.

Another function of VGAM1502 is therefore inhibition of BRAL1 (Accession NM_021817). Accordingly, utilities of VGAM1502 include diagnosis, prevention and treatment of diseases and clinical conditions associated with BRAL1. FLJ12838 (Accession NM_024641) is another VGAM1502 host target gene. FLJ12838 BINDING SITE is HOST TARGET binding site found in the 3' untranslated region of mRNA encoded by FLJ12838, corresponding to a HOST TARGET binding site such as BINDING SITE I, BINDING SITE II or BINDING SITE III. Table 2 illustrates the complementarity of the nucleotide sequences of FLJ12838 BINDING SITE, designated SEQ ID:23926, to the nucleotide sequence of VGAM1502 RNA, herein designated VGAM RNA, also designated SEQ ID:4213.

Another function of VGAM1502 is therefore inhibition of FLJ12838 (Accession NM_024641). Accordingly, utilities of VGAM1502 include diagnosis, prevention and treatment of diseases and clinical conditions associated with FLJ12838. HSPC067 (Accession NM_014158) is another VGAM1502 host target gene. HSPC067 BINDING SITE is HOST TARGET binding site found in the 5' untranslated region of mRNA encoded by HSPC067, corresponding to a HOST TARGET binding site such as BINDING SITE I, BINDING SITE II or BINDING SITE III. Table 2 illustrates the complementarity of the nucleotide sequences of HSPC067 BINDING SITE, designated SEQ ID:15459, to the nucleotide sequence of VGAM1502 RNA, herein designated VGAM RNA, also designated SEQ ID:4213.

Another function of VGAM1502 is therefore inhibition of HSPC067 (Accession NM_014158). Accordingly, utilities of VGAM1502 include diagnosis, prevention and treatment of diseases and clinical conditions associated with HSPC067. KIAA1210 (Accession XM_172801) is another VGAM1502 host target gene. KIAA1210 BINDING SITE is HOST TARGET binding site found in the 3' untranslated region of mRNA encoded by KIAA1210, corresponding to a HOST TARGET binding site such as BINDING SITE I, BINDING SITE II or BINDING SITE III. Table 2 illustrates the complementarity of the nucleotide sequences of KIAA1210 BINDING SITE, designated SEQ ID:46089, to the nucleotide sequence of VGAM1502 RNA, herein designated VGAM RNA, also designated SEQ ID:4213.

Another function of VGAM1502 is therefore inhibition of KIAA1210 (Accession XM_172801). Accordingly, utilities of VGAM1502 include diagnosis, prevention and treatment of diseases and clinical conditions associated with KIAA1210. KIAA1676 (Accession XM_167612) is another VGAM1502 host target gene. KIAA1676 BINDING SITE is HOST TARGET binding site found in the 3' untranslated region of mRNA encoded by KIAA1676, corresponding to a HOST TARGET binding site such as BINDING SITE I, BINDING SITE II or BINDING SITE III. Table 2 illustrates the complementarity of the nucleotide sequences of KIAA1676 BINDING SITE, designated SEQ ID:44730, to the nucleotide sequence of VGAM1502 RNA, herein designated VGAM RNA, also designated SEQ ID:4213.

Another function of VGAM1502 is therefore inhibition of KIAA1676 (Accession XM_167612). Accordingly, utilities of VGAM1502 include diagnosis, prevention and treatment of diseases and clinical conditions associated with KIAA1676. Meis1, Myeloid Ecotropic Viral Integration Site 1 Homolog 3 (mouse) (MEIS3, Accession XM_085721) is another VGAM1502 host target gene. MEIS3 BINDING SITE is HOST TARGET binding site found in the 3' untranslated region of mRNA encoded by MEIS3, corresponding to a HOST TARGET binding site such as BINDING SITE I, BINDING SITE II or BINDING SITE III. Table 2 illustrates the complementarity of the nucleotide sequences of MEIS3 BINDING SITE, designated SEQ ID:38310, to the nucleotide sequence of VGAM1502 RNA, herein designated VGAM RNA, also designated SEQ ID:4213.

Another function of VGAM1502 is therefore inhibition of Meis1, Myeloid Ecotropic Viral Integration Site 1 Homolog 3 (mouse) (MEIS3, Accession XM_085721). Accordingly, utilities of VGAM1502 include diagnosis, prevention and treatment of diseases and clinical conditions associated with MEIS3. poly (rC) Binding Protein 4 (PCBP4, Accession NM_020418) is another VGAM1502 host target gene. PCBP4 BINDING SITE1 through PCBP4 BINDING SITE3 are HOST TARGET binding sites found in untranslated regions of mRNA encoded by PCBP4, corresponding to HOST TARGET binding sites such as BINDING SITE I, BINDING SITE II or BINDING SITE III. Table 2 illustrates the complementarity of the nucleotide sequences of PCBP4 BINDING SITE1 through PCBP4 BINDING SITE3, designated SEQ ID:21679, SEQ ID:26894 and SEQ ID:26896 respectively, to the nucleotide sequence of VGAM1502 RNA, herein designated VGAM RNA, also designated SEQ ID:4213.

Another function of VGAM1502 is therefore inhibition of poly (rC) Binding Protein 4 (PCBP4, Accession NM_020418). Accordingly, utilities of VGAM1502 include diagnosis, prevention and treatment of diseases and clinical conditions associated with PCBP4. Solute Carrier Family 1 (glutamate transporter), Member 7 (SLC1A7, Accession NM_006671) is another VGAM1502 host target gene. SLC1A7 BINDING SITE is HOST TARGET binding site found in the 3' untranslated region of mRNA encoded by SLC1A7, corresponding to a HOST TARGET binding site such as BINDING SITE I, BINDING SITE II or BINDING SITE III. Table 2 illustrates the complementarity of the nucleotide sequences of SLC1A7 BINDING SITE, designated SEQ ID:13492, to the nucleotide sequence of VGAM1502 RNA, herein designated VGAM RNA, also designated SEQ ID:4213.

Another function of VGAM1502 is therefore inhibition of Solute Carrier Family 1 (glutamate transporter), Member 7 (SLC1A7, Accession NM_006671). Accordingly, utilities of VGAM1502 include diagnosis, prevention and treatment of diseases and clinical conditions associated with SLC1A7. Zinc Finger, DHHC Domain Containing 3 (ZDHHC3, Accession NM_016598) is another VGAM1502 host target gene. ZDHHC3 BINDING SITE is HOST TARGET binding site found in the 3' untranslated region of mRNA encoded by ZDHHC3, corresponding to a HOST TARGET binding site such as BINDING SITE I, BINDING SITE II or BINDING SITE III. Table 2 illustrates the complementarity of the nucleotide sequences of ZDHHC3 BINDING SITE, designated SEQ ID:18690, to the nucleotide sequence of VGAM1502 RNA, herein designated VGAM RNA, also designated SEQ ID:4213.

Another function of VGAM1502 is therefore inhibition of Zinc Finger, DHHC Domain Containing 3 (ZDHHC3, Accession NM_016598). Accordingly, utilities of VGAM1502 include diagnosis, prevention and treatment of diseases and clinical conditions associated with ZDHHC3. LOC157918 (Accession XM_098842) is another VGAM1502 host target gene. LOC157918 BINDING SITE is HOST TARGET binding site found in the 3' untranslated region of mRNA encoded by LOC157918, corresponding to a HOST TARGET binding site such as BINDING SITE I, BINDING SITE II or BINDING SITE III. Table 2 illustrates the complementarity of the nucleotide sequences of LOC157918 BINDING SITE, designated SEQ ID:41901, to the nucleotide sequence of VGAM1502 RNA, herein designated VGAM RNA, also designated SEQ ID:4213.

Another function of VGAM1502 is therefore inhibition of LOC157918 (Accession XM_098842). Accordingly, utilities of VGAM1502 include diagnosis, prevention and treatment of diseases and clinical conditions associated with LOC157918. LOC257468 (Accession XM_170838) is another VGAM1502 host target gene. LOC257468 BINDING SITE is HOST TARGET binding site found in the 3' untranslated region of mRNA encoded by LOC257468, corresponding to a HOST TARGET binding site such as BINDING SITE I, BINDING SITE II or BINDING SITE III. Table 2 illustrates the complementarity of the nucleotide sequences of LOC257468 BINDING SITE, designated SEQ ID:45625, to the nucleotide sequence of VGAM1502 RNA, herein designated VGAM RNA, also designated SEQ ID:4213.

Another function of VGAM1502 is therefore inhibition of LOC257468 (Accession XM_170838). Accordingly, utilities of VGAM1502 include diagnosis, prevention and treatment of diseases and clinical conditions associated with LOC257468. LOC257486 (Accession XM_045029) is another VGAM1502 host target gene. LOC257486 BINDING SITE is HOST TARGET binding site found in the 3' untranslated region of mRNA encoded by LOC257486, corresponding to a HOST TARGET binding site such as BINDING SITE I, BINDING SITE II or BINDING SITE III. Table 2 illustrates the complementarity of the nucleotide sequences of LOC257486 BINDING SITE, designated SEQ ID:34327, to the nucleotide sequence of VGAM1502 RNA, herein designated VGAM RNA, also designated SEQ ID:4213.

Another function of VGAM1502 is therefore inhibition of LOC257486 (Accession XM_045029). Accordingly, utilities of VGAM1502 include diagnosis, prevention and treatment of diseases and clinical conditions associated with LOC257486. FIG. 1 further provides a conceptual description of a novel bioinformatically detected viral gene of the present invention, referred to here as Viral Genomic Address Messenger 1503 (VGAM1503) viral gene, which modulates expression of respective host target genes thereof, the function and utility of which host target genes is known in the art.

VGAM1503 is a novel bioinformatically detected regulatory, non protein coding, viral micro RNA (miRNA) gene. The method by which VGAM1503 was detected is described hereinabove with reference to FIGS. 1-8.

VGAM1503 gene, herein designated VGAM GENE, is a viral gene contained in the genome of Aphid Lethal Paralysis Virus. VGAM1503 host target gene, herein designated VGAM HOST TARGET GENE, is a human gene contained in the human genome.

VGAM1503 gene encodes a VGAM1503 precursor RNA, herein designated VGAM PRECURSOR RNA. Similar to other miRNA genes, and unlike most ordinary genes, VGAM1503 precursor RNA does not encode a protein. A nucleotide sequence identical or highly similar to the nucleotide sequence of VGAM1503 precursor RNA is designated SEQ ID:1489, and is provided hereinbelow with reference to the sequence listing part. Nucleotide sequence SEQ ID:1489 is located at position 9098 relative to the genome of Aphid Lethal Paralysis Virus.

VGAM1503 precursor RNA folds onto itself, forming VGAM1503 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1503 folded precursor RNA into VGAM1503 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM1503 RNA is designated SEQ ID:4214, and is provided hereinbelow with reference to the sequence listing part.

VGAM1503 host target gene, herein designated VGAM HOST TARGET GENE, encodes a corresponding messenger RNA, VGAM1503 host target RNA, herein designated VGAM HOST TARGET RNA. VGAM1503 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1503 RNA, herein designated VGAM RNA, binds complementarily to one or more host target binding sites located in untranslated regions of VGAM1503 host target RNA, herein designated VGAM HOST TARGET RNA. This complementary binding is due to the fact that the nucleotide sequence of VGAM1503 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1503 RNA, herein designated VGAM RNA, may have a different number of host target binding sites in untranslated regions of a VGAM1503 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1503 RNA, herein designated VGAM RNA, to host target binding sites on VGAM1503 host target RNA, herein designated VGAM HOST TARGET RNA, such as BINDING SITE I, BINDING SITE II and BINDING SITE III, inhibits translation of VGAM1503 host target RNA into VGAM1503 host target protein, herein designated VGAM HOST TARGET PROTEIN. VGAM host target protein is therefore outlined by a broken line.

It is appreciated that VGAM1503 host target gene, herein designated VGAM HOST TARGET GENE, in fact represents a plurality of VGAM1503 host target genes. The mRNA of each one of this plurality of VGAM1503 host target genes comprises one or more host target binding sites, each having a nucleotide sequence which is at least partly complementary to VGAM1503 RNA, herein designated VGAM RNA, and which when bound by VGAM1503 RNA causes inhibition of translation of respective one or more VGAM1503 host target proteins.

It is further appreciated by one skilled in the art that the mode of translational inhibition illustrated by FIG. 1 with specific reference to translational inhibition exerted by VGAM1503 gene, herein designated VGAM GENE, on one or more VGAM1503 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1503 is inhibition of expression of host target genes, as part of a novel viral mechanism of attacking a host. Accordingly, utilities of VGAM1503 include diagnosis, prevention and treatment of viral infection by Aphid Lethal Paralysis Virus. Specific functions, and accordingly utilities, of VGAM1503 correlate with, and may be deduced from, the identity of the host target genes which VGAM1503 binds and inhibits, and the function of these host target genes, as elaborated hereinbelow.

Nucleotide sequences of the VGAM1503 precursor RNA, herein designated VGAM PRECURSOR RNA, and of the 'diced' VGAM1503 RNA, herein designated VGAM RNA, and a schematic representation of the secondary folding of VGAM1503 folded precursor RNA, herein designated VGAM FOLDED PRECURSOR RNA, of VGAM1503 are further described hereinbelow with reference to Table 1.

Nucleotide sequences of host target binding sites, such as BINDING SITE-I, BINDING SITE-II and BINDING SITE-III of FIG. 1, found on VGAM1503 host target RNA, and schematic representation of the complementarity of each of these host target binding sites to VGAM1503 RNA, herein designated VGAM RNA, are described hereinbelow with reference to Table 2.

As mentioned hereinabove with reference to FIG. 1, a function of VGAM1503 gene, herein designated VGAM is inhibition of expression of VGAM1503 target genes. It is appreciated that specific functions, and accordingly utilities, of VGAM1503 correlate with, and may be deduced from, the identity of the target genes which VGAM1503 binds and inhibits, and the function of these target genes, as elaborated hereinbelow.

Polycystic Kidney and Hepatic Disease 1 (autosomal recessive) (PKHD1, Accession NM_138694) is a VGAM1503 host target gene. PKHD1 BINDING SITE is HOST TARGET binding site found in the 3' untranslated region of mRNA encoded by PKHD1, corresponding to a HOST TARGET binding site such as BINDING SITE I, BINDING SITE II or BINDING SITE III. Table 2 illustrates the complementarity of the nucleotide sequences of PKHD1 BINDING SITE, designated SEQ ID:28937, to the nucleotide sequence of VGAM1503 RNA, herein designated VGAM RNA, also designated SEQ ID:4214.

A function of VGAM1503 is therefore inhibition of Polycystic Kidney and Hepatic Disease 1 (autosomal recessive) (PKHD1, Accession NM_138694). Accordingly, utilities of VGAM1503 include diagnosis, prevention and treatment of diseases and clinical conditions associated with PKHD1. Suppressor of Cytokine Signaling 5 (SOCS5, Accession NM_014011) is another VGAM1503 host target gene. SOCS5 BINDING SITE is HOST TARGET binding site found in the 3' untranslated region of mRNA encoded by SOCS5, corresponding to a HOST TARGET binding site such as BINDING SITE I, BINDING SITE II or BINDING SITE III. Table 2 illustrates the complementarity of the nucleotide sequences of SOCS5 BINDING SITE, designated SEQ ID:15231, to the nucleotide sequence of VGAM1503 RNA, herein designated VGAM RNA, also designated SEQ ID:4214.

Another function of VGAM1503 is therefore inhibition of Suppressor of Cytokine Signaling 5 (SOCS5, Accession NM_014011). Accordingly, utilities of VGAM1503 include diagnosis, prevention and treatment of diseases and clinical conditions associated with SOCS5. ATPase, Class II, Type 9A (ATP9A, Accession XM_030577) is another VGAM1503 host target gene. ATP9A BINDING SITE is HOST TARGET binding site found in the 3' untranslated region of mRNA encoded by ATP9A, corresponding to a HOST TARGET binding site such as BINDING SITE I, BINDING SITE II or BINDING SITE III. Table 2 illustrates the complementarity of the nucleotide sequences of ATP9A BINDING SITE, designated SEQ ID:31075, to the nucleotide sequence of VGAM1503 RNA, herein designated VGAM RNA, also designated SEQ ID:4214.

Another function of VGAM1503 is therefore inhibition of ATPase, Class II, Type 9A (ATP9A, Accession XM_030577). Accordingly, utilities of VGAM1503 include diagnosis, prevention and treatment of diseases and clinical conditions associated with ATP9A. DKFZP434P0721 (Accession XM_033181) is another VGAM1503 host target gene. DKFZP434P0721 BINDING SITE is HOST TARGET binding site found in the 3' untranslated region of mRNA encoded by DKFZP434P0721, corresponding to a HOST TARGET binding site such as BINDING SITE I, BINDING SITE II or BINDING SITE III. Table 2 illustrates the complementarity of the nucleotide sequences of DKFZP434P0721 BINDING SITE, designated SEQ ID:31869, to the nucleotide sequence of VGAM1503 RNA, herein designated VGAM RNA, also designated SEQ ID:4214.

Another function of VGAM1503 is therefore inhibition of DKFZP434P0721 (Accession XM_033181). Accordingly, utilities of VGAM1503 include diagnosis, prevention and treatment of diseases and clinical conditions associated with DKFZP434P0721. KIAA1255 (Accession XM_040626) is another VGAM1503 host target gene. KIAA1255 BINDING SITE is HOST TARGET binding site found in the 3' untranslated region of mRNA encoded by KIAA1255, corresponding to a HOST TARGET binding site such as BINDING SITE I, BINDING SITE II or BINDING SITE III. Table 2 illustrates the complementarity of the nucleotide sequences of KIAA1255 BINDING SITE, designated SEQ ID:33347, to the nucleotide sequence of VGAM1503 RNA, herein designated VGAM RNA, also designated SEQ ID:4214.

Another function of VGAM1503 is therefore inhibition of KIAA1255 (Accession XM_040626). Accordingly, utilities of VGAM1503 include diagnosis, prevention and treatment of diseases and clinical conditions associated with KIAA1255. RAB22A, Member RAS Oncogene Family (RAB22A, Accession XM_009454) is another VGAM1503 host target gene. RAB22A BINDING SITE is HOST TARGET binding site found in the 3' untranslated region of mRNA encoded by RAB22A, corresponding to a HOST TARGET binding site such as BINDING SITE I, BINDING SITE II or BINDING SITE III. Table 2 illustrates the complementarity of the nucleotide sequences of RAB22A BINDING SITE, designated SEQ ID:30110, to the nucleotide sequence of VGAM1503 RNA, herein designated VGAM RNA, also designated SEQ ID:4214.

Another function of VGAM1503 is therefore inhibition of RAB22A, Member RAS Oncogene Family (RAB22A, Accession XM_009454). Accordingly, utilities of VGAM1503 include diagnosis, prevention and treatment of diseases and clinical conditions associated with RAB22A. LOC129607 (Accession XM_059368) is another VGAM1503 host target gene. LOC129607 BINDING SITE is HOST TARGET binding site found in the 3' untranslated region of mRNA encoded by LOC129607, corresponding to a HOST TARGET binding site such as BINDING SITE I, BINDING SITE II or BINDING SITE III. Table 2 illustrates the complementarity of the nucleotide sequences of LOC129607 BINDING SITE, designated SEQ ID:36975, to the nucleotide sequence of VGAM1503 RNA, herein designated VGAM RNA, also designated SEQ ID:4214.

Another function of VGAM1503 is therefore inhibition of LOC129607 (Accession XM_059368). Accordingly, utilities of VGAM1503 include diagnosis, prevention and treatment of diseases and clinical conditions associated with LOC129607. LOC157918 (Accession XM_098842) is another VGAM1503 host target gene. LOC157918 BINDING SITE is HOST TARGET binding site found in the 3' untranslated region of mRNA encoded by LOC157918, corresponding to a HOST TARGET binding site such as BINDING SITE I, BINDING SITE II or BINDING SITE III. Table 2 illustrates the complementarity of the nucleotide sequences of LOC157918 BINDING SITE, designated SEQ ID:41893, to the nucleotide sequence of VGAM1503 RNA, herein designated VGAM RNA, also designated SEQ ID:4214.

Another function of VGAM1503 is therefore inhibition of LOC157918 (Accession XM_098842). Accordingly, utilities of VGAM1503 include diagnosis, prevention and treatment of diseases and clinical conditions associated with LOC157918. LOC157919 (Accession XM_088420) is another VGAM1503 host target gene. LOC157919 BINDING SITE is HOST TARGET binding site found in the 5' untranslated region of mRNA encoded by LOC157919, corresponding to a HOST TARGET binding site such as BINDING SITE I, BINDING SITE II or BINDING SITE III. Table 2 illustrates the complementarity of the nucleotide sequences of LOC157919 BINDING SITE, designated SEQ ID:39680, to the nucleotide sequence of VGAM1503 RNA, herein designated VGAM RNA, also designated SEQ ID:4214.

Another function of VGAM1503 is therefore inhibition of LOC157919 (Accession XM_088420). Accordingly, utilities of VGAM1503 include diagnosis, prevention and treatment of diseases and clinical conditions associated with LOC157919. LOC219623 (Accession XM_166143) is another VGAM1503 host target gene. LOC219623 BINDING SITE is HOST TARGET binding site found in the 5' untranslated region of mRNA encoded by LOC219623, corresponding to a HOST TARGET binding site such as BINDING SITE I, BINDING SITE II or BINDING SITE III. Table 2 illustrates the complementarity of the nucleotide sequences of LOC219623 BINDING SITE, designated SEQ ID:43947, to the nucleotide sequence of VGAM1503 RNA, herein designated VGAM RNA, also designated SEQ ID:4214.

Another function of VGAM1503 is therefore inhibition of LOC219623 (Accession XM_166143). Accordingly, utilities of VGAM1503 include diagnosis, prevention and treatment of diseases and clinical conditions associated with LOC219623. FIG. 1 further provides a conceptual description of a novel bioinformatically detected viral gene of the present invention, referred to here as Viral Genomic Address Messenger 1504 (VGAM1504) viral gene, which modulates expression of respective host target genes thereof, the function and utility of which host target genes is known in the art.

VGAM1504 is a novel bioinformatically detected regulatory, non protein coding, viral micro RNA (miRNA) gene. The method by which VGAM1504 was detected is described hereinabove with reference to FIGS. 1-8.

VGAM1504 gene, herein designated VGAM GENE, is a viral gene contained in the genome of Aphid Lethal Paralysis Virus. VGAM1504 host target gene, herein designated VGAM HOST TARGET GENE, is a human gene contained in the human genome.

VGAM1504 gene encodes a VGAM1504 precursor RNA, herein designated VGAM PRECURSOR RNA. Similar to other miRNA genes, and unlike most ordinary genes, VGAM1504 precursor RNA does not encode a protein. A nucleotide sequence identical or highly similar to the nucleotide sequence of VGAM1504 precursor RNA is designated SEQ ID:1490, and is provided hereinbelow with reference to the sequence listing part. Nucleotide sequence SEQ ID:1490 is located at position 8300 relative to the genome of Aphid Lethal Paralysis Virus.

VGAM1504 precursor RNA folds onto itself, forming VGAM1504 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1504 folded precursor RNA into VGAM1504 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 57%) nucleotide sequence of VGAM1504 RNA is designated SEQ ID:4215, and is provided hereinbelow with reference to the sequence listing part.

VGAM1504 host target gene, herein designated VGAM HOST TARGET GENE, encodes a corresponding messenger RNA, VGAM1504 host target RNA, herein designated VGAM HOST TARGET RNA. VGAM1504 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1504 RNA, herein designated VGAM RNA, binds complementarily to one or more host target binding sites located in untranslated regions of VGAM1504 host target RNA, herein designated VGAM HOST TARGET RNA. This complementary binding is due to the fact that the nucleotide sequence of VGAM1504 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1504 RNA, herein designated VGAM RNA, may have a different number of host target binding sites in untranslated regions of a VGAM1504 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1504 RNA, herein designated VGAM RNA, to host target binding sites on VGAM1504 host target RNA, herein designated VGAM HOST TARGET RNA, such as BINDING SITE I, BINDING SITE II and BINDING SITE III, inhibits translation of VGAM1504 host target RNA into VGAM1504 host target protein, herein designated VGAM HOST TARGET PROTEIN. VGAM host target protein is therefore outlined by a broken line.

It is appreciated that VGAM1504 host target gene, herein designated VGAM HOST TARGET GENE, in fact represents a plurality of VGAM1504 host target genes. The mRNA of each one of this plurality of VGAM1504 host target genes comprises one or more host target binding sites, each having a nucleotide sequence which is at least partly complementary to VGAM1504 RNA, herein designated VGAM RNA, and which when bound by VGAM1504 RNA causes inhibition of translation of respective one or more VGAM1504 host target proteins.

It is further appreciated by one skilled in the art that the mode of translational inhibition illustrated by FIG. 1 with specific reference to translational inhibition exerted by VGAM1504 gene, herein designated VGAM GENE, on one or more VGAM1504 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1504 is inhibition of expression of host target genes, as part of a novel viral mechanism of attacking a host. Accordingly, utilities of VGAM1504 include diagnosis, prevention and treatment of viral infection by Aphid Lethal Paralysis Virus. Specific functions, and accordingly utilities, of VGAM1504 correlate with, and may be deduced from, the identity of the host target genes which VGAM1504 binds and inhibits, and the function of these host target genes, as elaborated hereinbelow.

Nucleotide sequences of the VGAM1504 precursor RNA, herein designated VGAM PRECURSOR RNA, and of the ‘diced’ VGAM1504 RNA, herein designated VGAM RNA, and a schematic representation of the secondary folding of VGAM1504 folded precursor RNA, herein designated VGAM FOLDED PRECURSOR RNA, of VGAM1504 are further described hereinbelow with reference to Table 1.

Nucleotide sequences of host target binding sites, such as BINDING SITE-I, BINDING SITE-II and BINDING SITE-III of FIG. 1, found on VGAM1504 host target RNA, and schematic representation of the complementarity of each of these host target binding sites to VGAM1504 RNA, herein designated VGAM RNA, are described hereinbelow with reference to Table 2.

As mentioned hereinabove with reference to FIG. 1, a function of VGAM1504 gene, herein designated VGAM is inhibition of expression of VGAM1504 target genes. It is appreciated that specific functions, and accordingly utilities, of VGAM1504 correlate with, and may be deduced from, the identity of the target genes which VGAM1504 binds and inhibits, and the function of these target genes, as elaborated hereinbelow.

GATA Binding Protein 2 (GATA2, Accession NM_002050) is a VGAM1504 host target gene. GATA2 BINDING SITE is HOST TARGET binding site found in the 3' untranslated region of mRNA encoded by GATA2, corresponding to a HOST TARGET binding site such as BINDING SITE I, BINDING SITE II or BINDING SITE III. Table 2 illustrates the complementarity of the nucleotide sequences of GATA2 BINDING SITE, designated SEQ ID:7805, to the nucleotide sequence of VGAM1504 RNA, herein designated VGAM RNA, also designated SEQ ID:4215.

A function of VGAM1504 is therefore inhibition of GATA Binding Protein 2 (GATA2, Accession NM_002050). Accordingly, utilities of VGAM1504 include diagnosis, prevention and treatment of diseases and clinical conditions associated with GATA2. MGC2306 (Accession NM_032638) is another VGAM1504 host target gene. MGC2306 BINDING SITE is HOST TARGET binding site found in the 3' untranslated region of mRNA encoded by MGC2306, corresponding to a HOST TARGET binding site such as BINDING SITE I, BINDING SITE II or BINDING SITE III. Table 2 illustrates the complementarity of the nucleotide sequences of MGC2306 BINDING SITE, designated SEQ ID:26355, to the nucleotide sequence of VGAM1504 RNA, herein designated VGAM RNA, also designated SEQ ID:4215.

Another function of VGAM1504 is therefore inhibition of MGC2306 (Accession NM_032638). Accordingly, utilities of VGAM1504 include diagnosis, prevention and treatment of diseases and clinical conditions associated with MGC2306. Serine Palmitoyltransferase, Long Chain Base Subunit 2 (SPTLC2, Accession NM_004863) is another VGAM1504 host target gene. SPTLC2 BINDING SITE is HOST TARGET binding site found in the 3' untranslated region of mRNA encoded by SPTLC2, corresponding to a HOST TARGET binding site such as BINDING SITE I, BINDING SITE II or BINDING SITE III. Table 2 illustrates the complementarity of the nucleotide sequences of SPTLC2 BINDING SITE, designated SEQ ID:11278, to the nucleotide sequence of VGAM1504 RNA, herein designated VGAM RNA, also designated SEQ ID:4215.

Another function of VGAM1504 is therefore inhibition of Serine Palmitoyltransferase, Long Chain Base Subunit 2 (SPTLC2, Accession NM_004863). Accordingly, utilities of VGAM1504 include diagnosis, prevention and treatment of diseases and clinical conditions associated with SPTLC2. LOC51014 (Accession XM_038077) is another VGAM1504 host target gene. LOC51014 BINDING SITE is HOST TARGET binding site found in the 3' untranslated region of mRNA encoded by LOC51014, corresponding to a HOST TARGET binding site such as BINDING SITE I, BINDING SITE II or BINDING SITE III. Table 2 illustrates the complementarity of the nucleotide sequences of LOC51014 BINDING SITE, designated SEQ ID:32752, to the nucleotide sequence of VGAM1504 RNA, herein designated VGAM RNA, also designated SEQ ID:4215.

Another function of VGAM1504 is therefore inhibition of LOC51014 (Accession XM_038077). Accordingly, utilities of VGAM1504 include diagnosis, prevention and treatment of diseases and clinical conditions associated with LOC51014. LOC51213 (Accession NM_016383) is another VGAM1504 host target gene. LOC51213 BINDING SITE is HOST TARGET binding site found in the 3' untranslated region of mRNA encoded by LOC51213, corresponding to a HOST TARGET binding site such as BINDING SITE I, BINDING SITE II or BINDING SITE III. Table 2 illustrates the complementarity of the nucleotide sequences of LOC51213 BINDING SITE, designated SEQ ID:18527, to the nucleotide sequence of VGAM1504 RNA, herein designated VGAM RNA, also designated SEQ ID:4215.

Another function of VGAM1504 is therefore inhibition of LOC51213 (Accession NM_016383). Accordingly, utilities of VGAM1504 include diagnosis, prevention and treatment of diseases and clinical conditions associated with LOC51213. LOC92399 (Accession NM_138777) is another VGAM1504 host target gene. LOC92399 BINDING SITE is HOST TARGET binding site found in the 3' untranslated region of mRNA encoded by LOC92399, corresponding to a HOST TARGET binding site such as BINDING SITE I, BINDING SITE II or BINDING SITE III. Table 2 illustrates the complementarity of the nucleotide sequences of LOC92399 BINDING SITE, designated SEQ ID:29011, to the nucleotide sequence of VGAM1504 RNA, herein designated VGAM RNA, also designated SEQ ID:4215.

Another function of VGAM1504 is therefore inhibition of LOC92399 (Accession NM_138777). Accordingly, utilities of VGAM1504 include diagnosis, prevention and treatment of diseases and clinical conditions associated with LOC92399. FIG. 1 further provides a conceptual description of a novel bioinformatically detected viral gene of the present invention, referred to here as Viral Genomic Address Messenger 1505 (VGAM1505) viral gene, which modulates expression of respective host target genes thereof, the function and utility of which host target genes is known in the art.

VGAM1505 is a novel bioinformatically detected regulatory, non protein coding, viral micro RNA (miRNA) gene. The method by which VGAM1505 was detected is described hereinabove with reference to FIGS. 1-8.

VGAM1505 gene, herein designated VGAM GENE, is a viral gene contained in the genome of Aphid Lethal Paralysis Virus. VGAM1505 host target gene, herein designated VGAM HOST TARGET GENE, is a human gene contained in the human genome.

VGAM1505 gene encodes a VGAM1505 precursor RNA, herein designated VGAM PRECURSOR RNA. Similar to other miRNA genes, and unlike most ordinary genes, VGAM1505 precursor RNA does not encode a protein. A nucleotide sequence identical or highly similar to the nucleotide sequence of VGAM1505 precursor RNA is designated SEQ ID:1491, and is provided hereinbelow with reference to the sequence listing part. Nucleotide sequence SEQ ID:1491 is located at position 8120 relative to the genome of Aphid Lethal Paralysis Virus.

VGAM1505 precursor RNA folds onto itself, forming VGAM1505 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1505 folded precursor RNA into VGAM1505 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1505 RNA is designated SEQ ID:4216, and is provided hereinbelow with reference to the sequence listing part.

VGAM1505 host target gene, herein designated VGAM HOST TARGET GENE, encodes a corresponding messenger RNA, VGAM1505 host target RNA, herein designated VGAM HOST TARGET RNA. VGAM1505 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1505 RNA, herein designated VGAM RNA, binds complementarily to one or more host target binding sites located in untranslated regions of VGAM1505 host target RNA, herein designated VGAM HOST TARGET RNA. This complementary binding is due to the fact that the nucleotide sequence of VGAM1505 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1505 RNA, herein designated VGAM RNA, may have a different number of host target binding sites in untranslated regions of a VGAM1505 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1505 RNA, herein designated VGAM RNA, to host target binding sites on VGAM1505 host target RNA, herein designated VGAM HOST TARGET RNA, such as BINDING SITE I, BINDING SITE II and BINDING SITE III, inhibits translation of VGAM1505 host target RNA into VGAM1505 host target protein, herein designated VGAM HOST TARGET PROTEIN. VGAM host target protein is therefore outlined by a broken line.

It is appreciated that VGAM1505 host target gene, herein designated VGAM HOST TARGET GENE, in fact represents a plurality of VGAM1505 host target genes. The mRNA of each one of this plurality of VGAM1505 host target genes comprises one or more host target binding sites, each having a nucleotide sequence which is at least partly complementary to VGAM1505 RNA, herein designated VGAM RNA, and which when bound by VGAM1505 RNA causes inhibition of translation of respective one or more VGAM1505 host target proteins.

It is further appreciated by one skilled in the art that the mode of translational inhibition illustrated by FIG. 1 with specific reference to translational inhibition exerted by VGAM1505 gene, herein designated VGAM GENE, on one or more VGAM1505 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1505 is inhibition of expression of host target genes, as part of a novel viral mechanism of attacking a host. Accordingly, utilities of VGAM1505 include diagnosis, prevention and treatment of viral infection by Aphid Lethal Paralysis Virus. Specific functions, and accordingly utilities, of VGAM1505 correlate with, and may be deduced from, the identity of the host target genes which VGAM1505 binds and inhibits, and the function of these host target genes, as elaborated hereinbelow.

Nucleotide sequences of the VGAM1505 precursor RNA, herein designated VGAM PRECURSOR RNA, and of the 'diced' VGAM1505 RNA, herein designated VGAM RNA, and a schematic representation of the secondary folding of VGAM1505 folded precursor RNA, herein designated VGAM FOLDED PRECURSOR RNA, of VGAM1505 are further described hereinbelow with reference to Table 1.

Nucleotide sequences of host target binding sites, such as BINDING SITE-I, BINDING SITE-II and BINDING SITE-III of FIG. 1, found on VGAM1505 host target RNA, and schematic representation of the complementarity of each of these host target binding sites to VGAM1505 RNA, herein designated VGAM RNA, are described hereinbelow with reference to Table 2.

As mentioned hereinabove with reference to FIG. 1, a function of VGAM1505 gene, herein designated VGAM is inhibition of expression of VGAM1505 target genes. It is appreciated that specific functions, and accordingly utilities, of VGAM1505 correlate with, and may be deduced from, the identity of the target genes which VGAM1505 binds and inhibits, and the function of these target genes, as elaborated hereinbelow.

UDP-Gal:betaGlcNAc Beta 1,3-galactosyltransferase, Polypeptide 3 (B3GALT3, Accession NM_033167) is a VGAM1505 host target gene. B3GALT3 BINDING SITE1 and B3GALT3 BINDING SITE2 are HOST TARGET binding sites found in untranslated regions of mRNA encoded by B3GALT3, corresponding to HOST TARGET binding sites such as BINDING SITE I, BINDING SITE II or BINDING SITE III. Table 2 illustrates the complementarity of the nucleotide sequences of B3GALT3 BINDING SITE1 and B3GALT3 BINDING SITE2, designated SEQ ID:27017 and SEQ ID:27020 respectively, to the nucleotide sequence of VGAM1505 RNA, herein designated VGAM RNA, also designated SEQ ID:4216.

A function of VGAM1505 is therefore inhibition of UDP-Gal:betaGlcNAc Beta 1,3-galactosyltransferase, Polypeptide 3 (B3GALT3, Accession NM_033167). Accordingly, utilities of VGAM1505 include diagnosis, prevention and treatment of diseases and clinical conditions associated with B3GALT3. Fukuyama Type Congenital Muscular Dystrophy (fukutin) (FCMD, Accession NM_006731) is another VGAM1505 host target gene. FCMD BINDING SITE is HOST TARGET binding site found in the 3' untranslated region of mRNA encoded by FCMD, corresponding to a HOST TARGET binding site such as BINDING SITE I, BINDING SITE II or BINDING SITE III. Table 2 illustrates the complementarity of the nucleotide sequences of FCMD BINDING SITE, designated SEQ ID:13572, to the nucleotide sequence of VGAM1505 RNA, herein designated VGAM RNA, also designated SEQ ID:4216.

Another function of VGAM1505 is therefore inhibition of Fukuyama Type Congenital Muscular Dystrophy (fukutin) (FCMD, Accession NM_006731). Accordingly, utilities of VGAM1505 include diagnosis, prevention and treatment of diseases and clinical conditions associated with FCMD. V-maf Musculoaponeurotic Fibrosarcoma Oncogene Homolog K (avian) (MAFK, Accession NM_002360) is another VGAM1505 host target gene. MAFK BINDING SITE is HOST TARGET binding site found in the 5' untranslated region of mRNA encoded by MAFK, corresponding to a HOST TARGET binding site such as BINDING SITE I, BINDING SITE II or BINDING SITE III. Table 2 illustrates the complementarity of the nucleotide sequences of MAFK BINDING SITE, designated SEQ ID:8173, to the nucleotide sequence of VGAM1505 RNA, herein designated VGAM RNA, also designated SEQ ID:4216.

Another function of VGAM1505 is therefore inhibition of V-maf Musculoaponeurotic Fibrosarcoma Oncogene Homolog K (avian) (MAFK, Accession NM_002360), a gene which is involved in regulation of transcription at NEF2 sites. Accordingly, utilities of VGAM1505 include diagnosis, prevention and treatment of diseases and clinical conditions associated with MAFK. The function of MAFK has been established by previous studies. The developmentally regulated expression of the globin genes depends on upstream regulatory elements termed locus control regions (LCRs). LCRs are associated with powerful enhancer activity that is mediated by the transcription factor NFE2 (nuclear factor erythroid-2). NFE2 recognition sites are also present in the gene promoters of 2 heme biosynthetic enzymes, porphobilinogen deaminase (PBGD; 176000) and ferrochelatase (FECH; 177000). NFE2 DNA-binding activity consists of a heterodimer containing an 18-kD Maf protein (MafF, MafG (OMIM Ref. No. 602020), or MafK) and p45 (OMIM Ref. No. 601490). Both subunits are members of the activator protein-1 superfamily of basic leucine zipper (bZip) proteins (see OMIM Ref. No. 165160). Maf homodimers suppress transcription at NFE2 sites. Toki et al. (1997) isolated a cDNA encoding human MAFK. The MAFK gene encodes a 156-amino acid polypeptide which is widely expressed, with highest levels seen in heart, placenta, skeletal muscle, and kidney. Toki et al. (1997) showed that MAFK could heterodimerize not only with p45, but also with NFE2-related factor 1 (NRF1; 163260) and NFE2-related factor 2 (OMIM Ref. No. 600492); these heterodimers bound to NFE2 sites in vitro. In vivo, MAFK/p45 and MAFK/NRF1 heterodimers stimulated transcription from NFE2 sites. Similar results were found with MAFG. Iwata et al. (1998) showed that MAFK is encoded by 3 exons spanning approximately 10 kb By use of 2 DNA mapping panels isolated from mice of a recombinant inbred strain set, Peters and Eicher (1994) demonstrated that the ubiquitous subunit is located on mouse chromosome 5. Since this region of the mouse genome shares linkage homology with human chromosome 7q, Peters and Eicher (1994) suggested that human NFE2U is probably located on 7q. Iwata et al. (1998) used FISH to map the MAFK gene to human chromosome 7p22. Motohashi et al. (2000) found that mouse embryos expressing abundant transgene-derived Mafk died of severe anemia, while lines expressing lower levels of small Maf lived to adulthood. Megakaryocytes from the latter overexpressing lines exhibited reduced proplatelet formation and MARE (Maf recognition element)-dependent transcription, phenocopying Mafg null mice (see OMIM Ref. No. Shavit et al. (1998)). When the Mafg null mice were bred to small Maf-overexpressing transgenic animals, both loss- and gain-of-function phenotypes were reversed Full details of the abovementioned studies are described in the following publications, the disclosure of which are hereby incorporated by reference:

Toki, T.; Itoh, J.; Kitazawa, J.; Arai, K.; Hatakeyama, K.; Akasaka, J.; Igarashi, K.; Nomura, N.; Yokoyama, M.; Yamamoto, M.; Ito, E.: Human small Maf proteins form heterodimers with CNC family transcription factors and recognize the NF-E2 motif. Oncogene 14:1901-1910, 1997; and Motohashi, H.; Katsuoka, F.; Shavit, J. A.; Engel, J. D.; Yamamoto, M.: Positive or negative MARE-dependent transcriptional regulation is determined by the abundance of small Maf proteins.

Further studies establishing the function and utilities of MAFK are found in John Hopkins OMIM database record ID 600197, and in sited publications numbered 10206-10210 listed in the bibliography section hereinbelow, which are also hereby incorporated by reference. PBX/knotted 1 Homeobox 1 (PKNOX1, Accession NM_004571) is another VGAM1505 host target gene. PKNOX1 BINDING SITE is HOST TARGET binding site found in the 3' untranslated region of mRNA encoded by PKNOX1, corresponding to a HOST TARGET binding site such as BINDING SITE I, BINDING SITE II or BINDING SITE III. Table 2 illustrates the complementarity of the nucleotide sequences of PKNOX1 BINDING SITE, designated SEQ ID:10914, to the nucleotide sequence of VGAM1505 RNA, herein designated VGAM RNA, also designated SEQ ID:4216.

Another function of VGAM1505 is therefore inhibition of PBX/knotted 1 Homeobox 1 (PKNOX1, Accession NM_004571), a gene which may regulate gene expression and control cell differentiation. Accordingly, utilities of VGAM1505 include diagnosis, prevention and treatment of diseases and clinical conditions associated with PKNOX1. The function of PKNOX1 and its association with various diseases and clinical conditions, has been established by previous studies, as described hereinabove with reference to VGAM276. RAP1, GTPase Activating Protein 1 (RAP1GA1, Accession NM_002885) is another VGAM1505 host target gene. RAP1GA1 BINDING SITE is HOST TARGET binding site found in the 3' untranslated region of mRNA encoded by RAP1GA1, corresponding to a HOST TARGET binding site such as BINDING SITE I, BINDING SITE II or BINDING SITE III. Table 2 illustrates the complementarity of the nucleotide sequences of RAP1GA1 BINDING SITE, designated SEQ ID:8795, to the nucleotide sequence of VGAM1505 RNA, herein designated VGAM RNA, also designated SEQ ID:4216.

Another function of VGAM1505 is therefore inhibition of RAP1, GTPase Activating Protein 1 (RAP1GA1, Accession NM_002885). Accordingly, utilities of VGAM1505 include diagnosis, prevention and treatment of diseases and clinical conditions associated with RAP1GA1. Retinal Degeneration, Slow (retinitis pigmentosa 7) (RDS, Accession NM_000322) is another VGAM1505 host target gene. RDS BINDING SITE is HOST TARGET binding site found in the 3' untranslated region of mRNA encoded by RDS, corresponding to a HOST TARGET binding site such as BINDING SITE I, BINDING SITE II or BINDING SITE III. Table 2 illustrates the complementarity of the nucleotide sequences of RDS BINDING SITE, designated SEQ ID:5865, to the nucleotide sequence of VGAM1505 RNA, herein designated VGAM RNA, also designated SEQ ID:4216.

Another function of VGAM1505 is therefore inhibition of Retinal Degeneration, Slow (retinitis pigmentosa 7) (RDS, Accession NM_000322), a gene which may function as an adhesion molecule involved in stabilization and compaction of outer segment disks or in the maintenance of the curvature of the rim. Accordingly, utilities of VGAM1505 include diagnosis, prevention and treatment of diseases and clinical conditions associated with RDS. The function of RDS and its association with various diseases and clinical conditions, has been established by previous studies, as described hereinabove with reference to VGAM341. Sodium Channel, Voltage-gated, Type I, Alpha Polypeptide (SCN1A, Accession XM_114281) is another VGAM1505 host target gene. SCN1A BINDING SITE is HOST TARGET binding site found in the 3' untranslated region of mRNA encoded by SCN1A, corresponding to a HOST TARGET binding site such as BINDING SITE I, BINDING SITE II or BINDING SITE III. Table 2 illustrates the complementarity of the nucleotide sequences of SCN1A BINDING SITE, designated SEQ ID:42831, to the nucleotide sequence of VGAM1505 RNA, herein designated VGAM RNA, also designated SEQ ID:4216.

Another function of VGAM1505 is therefore inhibition of Sodium Channel, Voltage-gated, Type I, Alpha Polypeptide (SCN1A, Accession XM_114281). Accordingly, utilities of VGAM1505 include diagnosis, prevention and treatment of diseases and clinical conditions associated with SCN1A. T-cell Leukemia, Homeobox 1 (TLX1, Accession NM_005521) is another VGAM1505 host target gene. TLX1 BINDING SITE is HOST TARGET binding site found in the 5' untranslated region of mRNA encoded by TLX1, corresponding to a HOST TARGET binding site such as BINDING SITE I, BINDING SITE II or BINDING SITE III. Table 2 illustrates the complementarity of the nucleotide sequences of TLX1 BINDING SITE, designated SEQ ID:12046, to the nucleotide sequence of VGAM1505 RNA, herein designated VGAM RNA, also designated SEQ ID:4216.

Another function of VGAM1505 is therefore inhibition of T-cell Leukemia, Homeobox 1 (TLX1, Accession NM_005521), a gene which controls the spleen development. Accordingly, utilities of VGAM1505 include diagnosis, prevention and treatment of diseases and clinical conditions associated with TLX1. The function of TLX1 has been established by previous studies. Kagan et al. (1987) fused human leukemic T cells carrying a t (10;14)(q24; q11) translocation with mouse leukemic T cells and examined the hybrids for genetic markers of human chromosomes 10 and 14. Hybrids containing the human 10q+ chromosome had the human genes for terminal deoxynucleotidyltransferase (TDT; 187410), which had been mapped to 10q23-q25, and for the constant region of TCRA (OMIM Ref. No. 186880). Hybrids containing the human 14q- chromosome retained the variable components of the TCRA gene. Thus the 14q11 breakpoint split the TCRA locus in a region between the variable and constant genes. These results suggested to Kagan et al. (1987) that the leukemic process resulted from translocation of the C(alpha) locus to a putative cellular proto-oncogene located proximal to the breakpoint at 10q24, with resulting deregulation of said oncogene, for which they proposed the name TCL3. Since the 10q+ chromosome retained the TDT gene, they concluded that the TDT locus is proximal to the TCL3 gene, confirming the location to band 10q23-q24. Zutter et al. (1990) cloned the t (10;14) breakpoint from CD3-negative T-cell acute lymphoblastic leukemia (T-ALL) cells. They identified a locus distinct from TDT at 10q24; this locus was not active in a variety of normal or other neoplastic T cells, but recognized an abundant 2.9-kb RNA in a t (10;14) T-cell leukemia. The authors speculated that this locus is a candidate for the putative TCL3 proto-oncogene. Kennedy et al. (1991) showed that the 10q24 region encodes a homeo box gene closely related to the developmentally regulated homeotic genes of flies and mammals. The coding capacity of this activated gene, designated HOX11, was undisturbed in a T-cell line carrying the translocation t (7;10)(q35; q24). Hatano et al. (1991) identified the HOX11 gene adjacent to the breakpoint on 10q24 in the t (10;14) translocation of T-ALL. Dube et al. (1991) also implicated the HOX11 gene in the translocation t (10;14)(q24; q11) that occurs in T-ALL. The translocation juxtaposes the TCRD gene in chromosome 14q11 with a breakpoint that lies immediately centromeric of the HOX11 gene. The translocation is presumably catalyzed by recombinases normally involved in the generation of immunoglobulin and TCR diversity. Dube et al. (1991) suggested that this was the first example of a human cancer in which deregulated expression of an unaltered homeo box gene is involved in tumorigenesis. Lu et al. (1991) cloned the TCL3 gene and found that its expression was elevated in leukemic cells harboring the t (10;14) translocation. Sequence analysis confirmed that TCL3 is a homeo box-containing gene. Animal model experiments lend further support to the function of TLX1. HOX11 is an orphan homeobox gene since it is located at a site outside the 4 mammalian HOX clusters. Whereas the orthodox HOX genes encode a combinatorial system of positional specification along the anterior-posterior axis of the embryo, the function of orphan homeobox genes is less well understood. As indicated by the findings in the translocation t (10;14), juxtaposition of HOX11 to the T-cell receptor gene redirects the expression of the normal HOX11 product to thymocytes. Transgenic mice in which HOX11 is redirected to the thymus develop T-cell lymphoblastic lymphoma-leukemia. Roberts et al. (1994) isolated a mouse Hox11 genomic clone and found that the homeodomain shared complete amino acid identity with human HOX11. The homologous mouse gene also mapped to the syntenic region within mouse chromosome 19. To assess the functional role of Hox11 in the mouse, Roberts et al. (1994) generated Hox11-deficient mice through gene targeting. Homozygous deficient mice had no spleen, but otherwise appeared normal. Hox11 is normally expressed in the splanchnic anlage arising from the splanchnic mesoderm. The homozygous deficient embryos had no cellular organization at the site of the splanchnic development, but all other splanchnic derivatives developed normally. Roberts et al. (1994) concluded that Hox11 controls the genesis of a single organ; their finding provided new insight into the genetic regulation of morphogenesis. Dear et al. (1995) performed similar studies in 'knockout' mice and found that, in homozygous Hox11-null embryos, spleen formation commences normally up to a specific stage of embryogenesis, at which point the spleen anlage undergoes rapid and complete resorption. Dying spleen cells exhibited characteristics of apoptosis. The authors concluded that Hox11 is not required to initiate spleen development but is essential for the survival of splenic precursors during organogenesis.

It is appreciated that the abovementioned animal model for TLX1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hatano, M.; Roberts, C. W. M.; Minden, M.; Crist, W. M.; Korsmeyer, S. J.: Deregulation of a homeobox gene, HOX11, by the t (10;14) in T cell leukemia. Science 253:79-82, 1991; and Roberts, C. W. M.; Shutter, J. R.; Korsmeyer, S. J.: Hox11 controls the genesis of the spleen. Nature 368:747-750, 1994.

Further studies establishing the function and utilities of TLX1 are found in John Hopkins OMIM database record ID 186770, and in sited publications numbered 5678-5686 listed in the bibliography section hereinbelow, which are also hereby incorporated by reference. Centaurin, Gamma 2 (CENTG2, Accession NM_014914) is another VGAM1505 host target gene. CENTG2 BINDING SITE is HOST TARGET binding site found in the 3' untranslated region of mRNA encoded by CENTG2, corresponding to a HOST TARGET binding site such as BINDING SITE I, BINDING SITE II or BINDING SITE III. Table 2 illustrates the complementarity of the nucleotide sequences of CENTG2 BINDING SITE, designated SEQ ID:17155, to the nucleotide sequence of VGAM1505 RNA, herein designated VGAM RNA, also designated SEQ ID:4216.

Another function of VGAM1505 is therefore inhibition of Centaurin, Gamma 2 (CENTG2, Accession NM_014914). Accordingly, utilities of VGAM1505 include diagnosis, prevention and treatment of diseases and clinical conditions associated with CENTG2. DC-TM4F2 (Accession NM_030927) is another VGAM1505 host target gene. DC-TM4F2 BINDING SITE is HOST TARGET binding site found in the 3' untranslated region of mRNA encoded by DC-TM4F2, corresponding to a HOST TARGET binding site such as BINDING SITE I, BINDING SITE II or BINDING SITE III. Table 2 illustrates the complementarity of the nucleotide sequences of DC-TM4F2 BINDING SITE, designated SEQ ID:25196, to the nucleotide sequence of VGAM1505 RNA, herein designated VGAM RNA, also designated SEQ ID:4216.

Another function of VGAM1505 is therefore inhibition of DC-TM4F2 (Accession NM_030927). Accordingly, utilities of VGAM1505 include diagnosis, prevention and treatment of diseases and clinical conditions associated with DC-TM4F2. DKFZP566K0524 (Accession XM_045128) is another VGAM1505 host target gene. DKFZP566K0524 BINDING SITE is HOST TARGET binding site found in the 3' untranslated region of mRNA encoded by DKFZP566K0524, corresponding to a HOST TARGET binding site such as BINDING SITE I, BINDING SITE II or BINDING SITE III. Table 2 illustrates the complementarity of the nucleotide sequences of DKFZP566K0524 BINDING SITE, designated SEQ ID:34372, to the nucleotide sequence of VGAM1505 RNA, herein designated VGAM RNA, also designated SEQ ID:4216.

Another function of VGAM1505 is therefore inhibition of DKFZP566K0524 (Accession XM_045128). Accordingly, utilities of VGAM1505 include diagnosis, prevention and treatment of diseases and clinical conditions associated with DKFZP566K0524. KIAA0062 (Accession XM_046677) is another VGAM1505 host target gene. KIAA0062 BINDING SITE is HOST TARGET binding site found in the 3' untranslated region of mRNA encoded by KIAA0062, corresponding to a HOST TARGET binding site such as BINDING SITE I, BINDING SITE II or BINDING SITE III. Table 2 illustrates the complementarity of the nucleotide sequences of KIAA0062 BINDING SITE, designated SEQ ID:34792, to the nucleotide sequence of VGAM1505 RNA, herein designated VGAM RNA, also designated SEQ ID:4216.

Another function of VGAM1505 is therefore inhibition of KIAA0062 (Accession XM_046677). Accordingly, utilities of VGAM1505 include diagnosis, prevention and treatment of diseases and clinical conditions associated with KIAA0062. KIAA0153 (Accession NM_015140) is another VGAM1505 host target gene. KIAA0153 BINDING SITE is HOST TARGET binding site found in the 3' untranslated region of mRNA encoded by KIAA0153, corresponding to a HOST TARGET binding site such as BINDING SITE I, BINDING SITE II or BINDING SITE III. Table 2 illustrates the complementarity of the nucleotide sequences of KIAA0153 BINDING SITE, designated SEQ ID:17496, to the nucleotide sequence of VGAM1505 RNA, herein designated VGAM RNA, also designated SEQ ID:4216.

Another function of VGAM1505 is therefore inhibition of KIAA0153 (Accession NM_015140). Accordingly, utilities of VGAM1505 include diagnosis, prevention and treatment of diseases and clinical conditions associated with KIAA0153. KIAA0825 (Accession XM_027906) is another VGAM1505 host target gene. KIAA0825 BINDING SITE is HOST TARGET binding site found in the 3' untranslated region of mRNA encoded by KIAA0825, corresponding to a HOST TARGET binding site such as BINDING SITE I, BINDING SITE II or BINDING SITE III. Table 2 illustrates the complementarity of the nucleotide sequences of KIAA0825 BINDING SITE, designated SEQ ID:30589, to the nucleotide sequence of VGAM1505 RNA, herein designated VGAM RNA, also designated SEQ ID:4216.

Another function of VGAM1505 is therefore inhibition of KIAA0825 (Accession XM_027906). Accordingly, utilities of VGAM1505 include diagnosis, prevention and treatment of diseases and clinical conditions associated with KIAA0825. KIAA1036 (Accession NM_014909) is another VGAM1505 host target gene. KIAA1036 BINDING SITE is HOST TARGET binding site found in the 3' untranslated region of mRNA encoded by KIAA1036, corresponding to a HOST TARGET binding site such as BINDING SITE I, BINDING SITE II or BINDING SITE III. Table 2 illustrates the complementarity of the nucleotide sequences of KIAA1036 BINDING SITE, designated SEQ ID:17131, to the nucleotide sequence of VGAM1505 RNA, herein designated VGAM RNA, also designated SEQ ID:4216.

Another function of VGAM1505 is therefore inhibition of KIAA1036 (Accession NM_014909). Accordingly, utilities of VGAM1505 include diagnosis, prevention and treatment of diseases and clinical conditions associated with KIAA1036. KIAA1437 (Accession XM_026998) is another VGAM1505 host target gene. KIAA1437 BINDING SITE is HOST TARGET binding site found in the 3' untranslated region of mRNA encoded by KIAA1437, corresponding to a HOST TARGET binding site such as BINDING SITE I, BINDING SITE II or BINDING SITE III. Table 2 illustrates the complementarity of the nucleotide sequences of KIAA1437 BINDING SITE, designated SEQ ID:30382, to the nucleotide sequence of VGAM1505 RNA, herein designated VGAM RNA, also designated SEQ ID:4216.

Another function of VGAM1505 is therefore inhibition of KIAA1437 (Accession XM_026998). Accordingly, utilities of VGAM1505 include diagnosis, prevention and treatment of diseases and clinical conditions associated with KIAA1437. KIAA1854 (Accession XM_049884) is another VGAM1505 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35523, to the nucleotide sequence of VGAM1505 RNA, herein designated VGAM RNA, also designated SEQ ID:4216.

Another function of VGAM1505 is therefore inhibition of KIAA1854 (Accession XM_049884). Accordingly, utilities of VGAM1505 include diagnosis, prevention and treatment of diseases and clinical conditions associated with KIAA1854. MGC11352 (Accession XM_035941) is another VGAM1505 host target gene. MGC11352 BINDING SITE is HOST TARGET binding site found in the 5' untranslated region of mRNA encoded by MGC11352, corresponding to a HOST TARGET binding site such as BINDING SITE I, BINDING SITE II or BINDING SITE III. Table 2 illustrates the complementarity of the nucleotide sequences of MGC11352 BINDING SITE, designated SEQ ID:32354, to the nucleotide sequence of VGAM1505 RNA, herein designated VGAM RNA, also designated SEQ ID:4216.

Another function of VGAM1505 is therefore inhibition of MGC11352 (Accession XM_035941). Accordingly, utilities of VGAM1505 include diagnosis, prevention and treatment of diseases and clinical conditions associated with MGC11352. MGC26954 (Accession NM_145025) is another VGAM1505 host target gene. MGC26954 BINDING SITE is HOST TARGET binding site found in the 3' untranslated region of mRNA encoded by MGC26954, corresponding to a HOST TARGET binding site such as BINDING SITE I, BINDING SITE II or BINDING SITE III. Table 2 illustrates the complementarity of the nucleotide sequences of MGC26954 BINDING SITE, designated SEQ ID:29639, to the nucleotide sequence of VGAM1505 RNA, herein designated VGAM RNA, also designated SEQ ID:4216.

Another function of VGAM1505 is therefore inhibition of MGC26954 (Accession NM_145025). Accordingly, utilities of VGAM1505 include diagnosis, prevention and treatment of diseases and clinical conditions associated with MGC26954. Protein Phosphatase 1, Regulatory (inhibitor) Subunit 16B (PPP1R16B, Accession XM_028840) is another VGAM1505 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30763, to the nucleotide sequence of VGAM1505 RNA, herein designated VGAM RNA, also designated SEQ ID:4216.

Another function of VGAM1505 is therefore inhibition of Protein Phosphatase 1, Regulatory (inhibitor) Subunit 16B (PPP1R16B, Accession XM_028840). Accordingly, utilities of VGAM1505 include diagnosis, prevention and treatment of diseases and clinical conditions associated with PPP1R16B. RAB17, Member RAS Oncogene Family (RAB17, Accession NM_022449) is another VGAM1505 host target gene. RAB17 BINDING SITE is HOST TARGET binding site found in the 3' untranslated region of mRNA encoded by RAB17, corresponding to a HOST TARGET binding site such as BINDING SITE I, BINDING SITE II or BINDING SITE III. Table 2 illustrates the complementarity of the nucleotide sequences of RAB17 BINDING SITE, designated SEQ ID:22785, to the nucleotide sequence of VGAM1505 RNA, herein designated VGAM RNA, also designated SEQ ID:4216.

Another function of VGAM1505 is therefore inhibition of RAB17, Member RAS Oncogene Family (RAB17, Accession NM_022449). Accordingly, utilities of VGAM1505 include diagnosis, prevention and treatment of diseases and clinical conditions associated with RAB17. Ring Finger Protein 38 (RNF38, Accession NM_022781) is another VGAM1505 host target gene. RNF38 BINDING SITE is HOST TARGET binding site found in the 3' untranslated region of mRNA encoded by RNF38, corresponding to a HOST TARGET binding site such as BINDING SITE I, BINDING SITE II or BINDING SITE III. Table 2 illustrates the complementarity of the nucleotide sequences of RNF38 BINDING SITE, designated SEQ ID:23063, to the nucleotide sequence of VGAM1505 RNA, herein designated VGAM RNA, also designated SEQ ID:4216.

Another function of VGAM1505 is therefore inhibition of Ring Finger Protein 38 (RNF38, Accession NM_022781). Accordingly, utilities of VGAM1505 include diagnosis, prevention and treatment of diseases and clinical conditions associated with RNF38. SEC22C (Accession NM_004206) is another VGAM1505 host target gene. SEC22C BINDING SITE is HOST TARGET binding site found in the 3' untranslated region of mRNA encoded by SEC22C, corresponding to a HOST TARGET binding site such as BINDING SITE I, BINDING SITE II or BINDING SITE III. Table 2 illustrates the complementarity of the nucleotide sequences of SEC22C BINDING SITE, designated SEQ ID:10403, to the nucleotide sequence of VGAM1505 RNA, herein designated VGAM RNA, also designated SEQ ID:4216.

Another function of VGAM1505 is therefore inhibition of SEC22C (Accession NM_004206). Accordingly, utilities of VGAM1505 include diagnosis, prevention and treatment of diseases and clinical conditions associated with SEC22C. LOC146520 (Accession XM_085492) is another VGAM1505 host target gene. LOC146520 BINDING SITE is HOST TARGET binding site found in the 3' untranslated region of mRNA encoded by LOC146520, corresponding to a HOST TARGET binding site such as BINDING SITE I, BINDING SITE II or BINDING SITE III. Table 2 illustrates the complementarity of the nucleotide sequences of LOC146520 BINDING SITE, designated SEQ ID:38190, to the nucleotide sequence of VGAM1505 RNA, herein designated VGAM RNA, also designated SEQ ID:4216.

Another function of VGAM1505 is therefore inhibition of LOC146520 (Accession XM_085492). Accordingly, utilities of VGAM1505 include diagnosis, prevention and treatment of diseases and clinical conditions associated with LOC146520. LOC154930 (Accession XM_088080) is another VGAM1505 host target gene. LOC154930 BINDING SITE is HOST TARGET binding site found in the 3' untranslated region of mRNA encoded by LOC154930, corresponding to a HOST TARGET binding site such as BINDING SITE I, BINDING SITE II or BINDING SITE III. Table 2 illustrates the complementarity of the nucleotide sequences of LOC154930 BINDING SITE, designated SEQ ID:39503, to the nucleotide sequence of VGAM1505 RNA, herein designated VGAM RNA, also designated SEQ ID:4216.

Another function of VGAM1505 is therefore inhibition of LOC154930 (Accession XM_088080). Accordingly, utilities of VGAM1505 include diagnosis, prevention and treatment of diseases and clinical conditions associated with LOC154930. LOC197285 (Accession XM_113752) is another VGAM1505 host target gene. LOC197285 BINDING SITE is HOST TARGET binding site found in the 3' untranslated region of mRNA encoded by LOC197285, corresponding to a HOST TARGET binding site such as BINDING SITE I, BINDING SITE II or BINDING SITE III. Table 2 illustrates the complementarity of the nucleotide sequences of LOC197285 BINDING SITE, designated SEQ ID:42414, to the nucleotide sequence of VGAM1505 RNA, herein designated VGAM RNA, also designated SEQ ID:4216.

Another function of VGAM1505 is therefore inhibition of LOC197285 (Accession XM_113752). Accordingly, utilities of VGAM1505 include diagnosis, prevention and treatment of diseases and clinical conditions associated with LOC197285. LOC221584 (Accession XM_168132) is another VGAM1505 host target gene. LOC221584 BINDING SITE is HOST TARGET binding site found in the 5' untranslated region of mRNA encoded by LOC221584, corresponding to a HOST TARGET binding site such as BINDING SITE I, BINDING SITE II or BINDING SITE III. Table 2 illustrates the complementarity of the nucleotide sequences of LOC221584 BINDING SITE, designated SEQ ID:45041, to the nucleotide sequence of VGAM1505 RNA, herein designated VGAM RNA, also designated SEQ ID:4216.

Another function of VGAM1505 is therefore inhibition of LOC221584 (Accession XM_168132). Accordingly, utilities of VGAM1505 include diagnosis, prevention and treatment of diseases and clinical conditions associated with LOC221584. LOC253782 (Accession XM_171023) is another VGAM1505 host target gene. LOC253782 BINDING SITE is HOST TARGET binding site found in the 3' untranslated region of mRNA encoded by LOC253782, corresponding to a HOST TARGET binding site such as BINDING SITE I, BINDING SITE II or BINDING SITE III. Table 2 illustrates the complementarity of the nucleotide sequences of LOC253782 BINDING SITE, designated SEQ ID:45796, to the nucleotide sequence of VGAM1505 RNA, herein designated VGAM RNA, also designated SEQ ID:4216.

Another function of VGAM1505 is therefore inhibition of LOC253782 (Accession XM_171023). Accordingly, utilities of VGAM1505 include diagnosis, prevention and treatment of diseases and clinical conditions associated with LOC253782. FIG. 1 further provides a conceptual description of a novel bioinformatically detected viral gene of the present invention, referred to here as Viral Genomic Address Messenger 1506 (VGAM1506) viral gene, which modulates expression of respective host target genes thereof, the function and utility of which host target genes is known in the art.

VGAM1506 is a novel bioinformatically detected regulatory, non protein coding, viral micro RNA (miRNA) gene. The method by which VGAM1506 was detected is described hereinabove with reference to FIGS. 1-8.

VGAM1506 gene, herein designated VGAM GENE, is a viral gene contained in the genome of Aphid Lethal Paralysis Virus. VGAM1506 host target gene, herein designated VGAM HOST TARGET GENE, is a human gene contained in the human genome.

VGAM1506 gene encodes a VGAM1506 precursor RNA, herein designated VGAM PRECURSOR RNA. Similar to other miRNA genes, and unlike most ordinary genes, VGAM1506 precursor RNA does not encode a protein. A nucleotide sequence identical or highly similar to the nucleotide sequence of VGAM1506 precursor RNA is designated SEQ ID:1492, and is provided hereinbelow with reference to the sequence listing part. Nucleotide sequence SEQ ID:1492 is located at position 8885 relative to the genome of Aphid Lethal Paralysis Virus.

VGAM1506 precursor RNA folds onto itself, forming VGAM1506 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1506 folded precursor RNA into VGAM1506 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1506 RNA is designated SEQ ID:4217, and is provided hereinbelow with reference to the sequence listing part.

VGAM1506 host target gene, herein designated VGAM HOST TARGET GENE, encodes a corresponding messenger RNA, VGAM1506 host target RNA, herein designated VGAM HOST TARGET RNA. VGAM1506 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1506 RNA, herein designated VGAM RNA, binds complementarily to one or more host target binding sites located in untranslated regions of VGAM1506 host target RNA, herein designated VGAM HOST TARGET RNA. This complementary binding is due to the fact that the nucleotide sequence of VGAM1506 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1506 RNA, herein designated VGAM RNA, may have a different number of host target binding sites in untranslated regions of a VGAM1506 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1506 RNA, herein designated VGAM RNA, to host target binding sites on VGAM1506 host target RNA, herein designated VGAM HOST TARGET RNA, such as BINDING SITE I, BINDING SITE II and BINDING SITE III, inhibits translation of VGAM1506 host target RNA into VGAM1506 host target protein, herein designated VGAM HOST TARGET PROTEIN. VGAM host target protein is therefore outlined by a broken line.

It is appreciated that VGAM1506 host target gene, herein designated VGAM HOST TARGET GENE, in fact represents a plurality of VGAM1506 host target genes. The mRNA of each one of this plurality of VGAM1506 host target genes comprises one or more host target binding sites, each having a nucleotide sequence which is at least partly complementary to VGAM1506 RNA, herein designated VGAM RNA, and which when bound by VGAM1506 RNA causes inhibition of translation of respective one or more VGAM1506 host target proteins.

It is further appreciated by one skilled in the art that the mode of translational inhibition illustrated by FIG. 1 with specific reference to translational inhibition exerted by VGAM1506 gene, herein designated VGAM GENE, on one or more VGAM1506 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1506 is inhibition of expression of host target genes, as part of a novel viral mechanism of attacking a host. Accordingly, utilities of VGAM1506 include diagnosis, prevention and treatment of viral infection by Aphid Lethal Paralysis Virus. Specific functions, and accordingly utilities, of VGAM1506 correlate with, and may be deduced from, the identity of the host target genes which VGAM1506 binds and inhibits, and the function of these host target genes, as elaborated hereinbelow.

Nucleotide sequences of the VGAM1506 precursor RNA, herein designated VGAM PRECURSOR RNA, and of the 'diced' VGAM1506 RNA, herein designated VGAM RNA, and a schematic representation of the secondary folding of VGAM1506 folded precursor RNA, herein designated VGAM FOLDED PRECURSOR RNA, of VGAM1506 are further described hereinbelow with reference to Table 1.

Nucleotide sequences of host target binding sites, such as BINDING SITE-I, BINDING SITE-II and BINDING SITE-III of FIG. 1, found on VGAM1506 host target RNA, and schematic representation of the complementarity of each of these host target binding sites to VGAM1506 RNA, herein designated VGAM RNA, are described hereinbelow with reference to Table 2.

As mentioned hereinabove with reference to FIG. 1, a function of VGAM1506 gene, herein designated VGAM is inhibition of expression of VGAM1506 target genes. It is appreciated that specific functions, and accordingly utilities, of VGAM1506 correlate with, and may be deduced from, the identity of the target genes which VGAM1506 binds and inhibits, and the function of these target genes, as elaborated hereinbelow.

Chloride Channel 3 (CLCN3, Accession NM_001829) is a VGAM1506 host target gene. CLCN3 BINDING SITE is HOST TARGET binding site found in the 5' untranslated region of mRNA encoded by CLCN3, corresponding to a HOST TARGET binding site such as BINDING SITE I, BINDING SITE II or BINDING SITE III. Table 2 illustrates the complementarity of the nucleotide sequences of CLCN3 BINDING SITE, designated SEQ ID:7567, to the nucleotide sequence of VGAM1506 RNA, herein designated VGAM RNA, also designated SEQ ID:4217.

A function of VGAM1506 is therefore inhibition of Chloride Channel 3 (CLCN3, Accession NM_001829), a gene which play a role in the neural cell function through regulation of membrane excitability. Accordingly, utilities of VGAM1506 include diagnosis, prevention and treatment of diseases and clinical conditions associated with CLCN3. The function of CLCN3 and its association with various diseases and clinical conditions, has been established by previous studies, as described hereinabove with reference to VGAM1332. CAMP Responsive Element Binding Protein-like 2 (CREBL2, Accession NM_001310) is another VGAM1506 host target gene. CREBL2 BINDING SITE is HOST TARGET binding site found in the 3' untranslated region of mRNA encoded by CREBL2, corresponding to a HOST TARGET binding site such as BINDING SITE I, BINDING SITE II or BINDING SITE III. Table 2 illustrates the complementarity of the nucleotide sequences of CREBL2 BINDING SITE, designated SEQ ID:6995, to the nucleotide sequence of VGAM1506 RNA, herein designated VGAM RNA, also designated SEQ ID:4217.

Another function of VGAM1506 is therefore inhibition of CAMP Responsive Element Binding Protein-like 2 (CREBL2, Accession NM_001310). Accordingly, utilities of VGAM1506 include diagnosis, prevention and treatment of diseases and clinical conditions associated with CREBL2. CRIPT (Accession XM_057669) is another VGAM1506 host target gene. CRIPT BINDING SITE is HOST TARGET binding site found in the 3' untranslated region of mRNA encoded by CRIPT, corresponding to a HOST TARGET binding site such as BINDING SITE I, BINDING SITE II or BINDING SITE III. Table 2 illustrates the complementarity of the nucleotide sequences of CRIPT BINDING SITE, designated SEQ ID:36539, to the nucleotide sequence of VGAM1506 RNA, herein designated VGAM RNA, also designated SEQ ID:4217.

Another function of VGAM1506 is therefore inhibition of CRIPT (Accession XM_057669). Accordingly, utilities of VGAM1506 include diagnosis, prevention and treatment of diseases and clinical conditions associated with CRIPT. FLJ10989 (Accession NM_018292) is another VGAM1506 host target gene. FLJ10989 BINDING SITE is HOST TARGET binding site found in the 3' untranslated region of mRNA encoded by FLJ10989, corresponding to a HOST TARGET binding site such as BINDING SITE I, BINDING SITE II or BINDING SITE III. Table 2 illustrates the complementarity of the nucleotide sequences of FLJ10989 BINDING SITE, designated SEQ ID:20282, to the nucleotide sequence of VGAM1506 RNA, herein designated VGAM RNA, also designated SEQ ID:4217.

Another function of VGAM1506 is therefore inhibition of FLJ10989 (Accession NM_018292). Accordingly, utilities of VGAM1506 include diagnosis, prevention and treatment of diseases and clinical conditions associated with FLJ10989. FLJ22794 (Accession XM_166220) is another VGAM1506 host target gene. FLJ22794 BINDING SITE is HOST TARGET binding site found in the 5' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44025, to the nucleotide sequence of VGAM1506 RNA, herein designated VGAM RNA, also designated SEQ ID:4217.

Another function of VGAM1506 is therefore inhibition of FLJ22794 (Accession XM_166220). Accordingly, utilities of VGAM1506 include diagnosis, prevention and treatment of diseases and clinical conditions associated with FLJ22794. KIAA0445 (Accession NM_014675) is another VGAM1506 host target gene. KIAA0445 BINDING SITE is HOST TARGET binding site found in the 5' untranslated region of mRNA encoded by KIAA0445, corresponding to a HOST TARGET binding site such as BINDING SITE I, BINDING SITE II or BINDING SITE III. Table 2 illustrates the complementarity of the nucleotide sequences of KIAA0445 BINDING SITE, designated SEQ ID:16145, to the nucleotide sequence of VGAM1506 RNA, herein designated VGAM RNA, also designated SEQ ID:4217.

Another function of VGAM1506 is therefore inhibition of KIAA0445 (Accession NM_014675). Accordingly, utilities of VGAM1506 include diagnosis, prevention and treatment of diseases and clinical conditions associated with KIAA0445. MGC12760 (Accession NM_032723) is another VGAM1506 host target gene. MGC12760 BINDING SITE is HOST TARGET binding site found in the 5' untranslated region of mRNA encoded by MGC12760, corresponding to a HOST TARGET binding site such as BINDING SITE I, BINDING SITE II or BINDING SITE III. Table 2 illustrates the complementarity of the nucleotide sequences of MGC12760 BINDING SITE, designated SEQ ID:26447, to the nucleotide sequence of VGAM1506 RNA, herein designated VGAM RNA, also designated SEQ ID:4217.

Another function of VGAM1506 is therefore inhibition of MGC12760 (Accession NM_032723). Accordingly, utilities of VGAM1506 include diagnosis, prevention and treatment of diseases and clinical conditions associated with MGC12760. Protein-O-mannosyltransferase 1 (POMT1, Accession NM_007171) is another VGAM1506 host target gene. POMT1 BINDING SITE is HOST TARGET binding site found in the 3' untranslated region of mRNA encoded by POMT1, corresponding to a HOST TARGET binding site such as BINDING SITE I, BINDING SITE II or BINDING SITE III. Table 2 illustrates the complementarity of the nucleotide sequences of POMT1 BINDING SITE, designated SEQ ID:14019, to the nucleotide sequence of VGAM1506 RNA, herein designated VGAM RNA, also designated SEQ ID:4217.

Another function of VGAM1506 is therefore inhibition of Protein-O-mannosyltransferase 1 (POMT1, Accession NM_007171). Accordingly, utilities of VGAM1506 include diagnosis, prevention and treatment of diseases and clinical conditions associated with POMT1. LOC144266 (Accession XM_084795) is another VGAM1506 host target gene. LOC144266 BINDING SITE is HOST TARGET binding site found in the 5' untranslated region of mRNA encoded by LOC144266, corresponding to a HOST TARGET binding site such as BINDING SITE I, BINDING SITE II or BINDING SITE III. Table 2 illustrates the complementarity of the nucleotide sequences of LOC144266 BINDING SITE, designated SEQ ID:37711, to the nucleotide sequence of VGAM1506 RNA, herein designated VGAM RNA, also designated SEQ ID:4217.

Another function of VGAM1506 is therefore inhibition of LOC144266 (Accession XM_084795). Accordingly, utilities of VGAM1506 include diagnosis, prevention and treatment of diseases and clinical conditions associated with LOC144266. LOC149579 (Accession XM_048743) is another VGAM1506 host target gene. LOC149579 BINDING SITE is HOST TARGET binding site found in the 5' untranslated region of mRNA encoded by LOC149579, corresponding to a HOST TARGET binding site such as BINDING SITE I, BINDING SITE II or BINDING SITE III. Table 2 illustrates the complementarity of the nucleotide sequences of LOC149579 BINDING SITE, designated SEQ ID:35241, to the nucleotide sequence of VGAM1506 RNA, herein designated VGAM RNA, also designated SEQ ID:4217.

Another function of VGAM1506 is therefore inhibition of LOC149579 (Accession XM_048743). Accordingly, utilities of VGAM1506 include diagnosis, prevention and treatment of diseases and clinical conditions associated with LOC149579. FIG. 1 further provides a conceptual description of a novel bioinformatically detected viral gene of the present invention, referred to here as Viral Genomic Address Messenger 1507 (VGAM1507) viral gene, which modulates expression of respective host target genes thereof, the function and utility of which host target genes is known in the art.

VGAM1507 is a novel bioinformatically detected regulatory, non protein coding, viral micro RNA (miRNA) gene. The method by which VGAM1507 was detected is described hereinabove with reference to FIGS. 1-8.

VGAM1507 gene, herein designated VGAM GENE, is a viral gene contained in the genome of Aphid Lethal Paralysis Virus. VGAM1507 host target gene, herein designated VGAM HOST TARGET GENE, is a human gene contained in the human genome.

VGAM1507 gene encodes a VGAM1507 precursor RNA, herein designated VGAM PRECURSOR RNA. Similar to other miRNA genes, and unlike most ordinary genes, VGAM1507 precursor RNA does not encode a protein. A nucleotide sequence identical or highly similar to the nucleotide sequence of VGAM1507 precursor RNA is designated SEQ ID:1493, and is provided hereinbelow with reference to the sequence listing part. Nucleotide sequence SEQ ID:1493 is located at position 4389 relative to the genome of Aphid Lethal Paralysis Virus.

VGAM1507 precursor RNA folds onto itself, forming VGAM1507 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1507 folded precursor RNA into VGAM1507 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1507 RNA is designated SEQ ID:4218, and is provided hereinbelow with reference to the sequence listing part.

VGAM1507 host target gene, herein designated VGAM HOST TARGET GENE, encodes a corresponding messenger RNA, VGAM1507 host target RNA, herein designated VGAM HOST TARGET RNA. VGAM1507 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1507 RNA, herein designated VGAM RNA, binds complementarily to one or more host target binding sites located in untranslated regions of VGAM1507 host target RNA, herein designated VGAM HOST TARGET RNA. This complementary binding is due to the fact that the nucleotide sequence of VGAM1507 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1507 RNA, herein designated VGAM RNA, may have a different number of host target binding sites in untranslated regions of a VGAM1507 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1507 RNA, herein designated VGAM RNA, to host target binding sites on VGAM1507 host target RNA, herein designated VGAM HOST TARGET RNA, such as BINDING SITE I, BINDING SITE II and BINDING SITE III, inhibits translation of VGAM1507 host target RNA into VGAM1507 host target protein, herein designated VGAM HOST TARGET PROTEIN. VGAM host target protein is therefore outlined by a broken line.

It is appreciated that VGAM1507 host target gene, herein designated VGAM HOST TARGET GENE, in fact represents a plurality of VGAM1507 host target genes. The mRNA of each one of this plurality of VGAM1507 host target genes comprises one or more host target binding sites, each having a nucleotide sequence which is at least partly complementary to VGAM1507 RNA, herein designated VGAM RNA, and which when bound by VGAM1507 RNA causes inhibition of translation of respective one or more VGAM1507 host target proteins.

It is further appreciated by one skilled in the art that the mode of translational inhibition illustrated by FIG. 1 with specific reference to translational inhibition exerted by VGAM1507 gene, herein designated VGAM GENE, on one or more VGAM1507 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1507 is inhibition of expression of host target genes, as part of a novel viral mechanism of attacking a host. Accordingly, utilities of VGAM1507 include diagnosis, prevention and treatment of viral infection by Aphid Lethal Paralysis Virus. Specific functions, and accordingly utilities, of VGAM1507 correlate with, and may be deduced from, the identity of the host target genes which VGAM1507 binds and inhibits, and the function of these host target genes, as elaborated hereinbelow.

Nucleotide sequences of the VGAM1507 precursor RNA, herein designated VGAM PRECURSOR RNA, and of the 'diced' VGAM1507 RNA, herein designated VGAM RNA, and a schematic representation of the secondary folding of VGAM1507 folded precursor RNA, herein designated VGAM FOLDED PRECURSOR RNA, of VGAM1507 are further described hereinbelow with reference to Table 1.

Nucleotide sequences of host target binding sites, such as BINDING SITE-I, BINDING SITE-II and BINDING SITE-III of FIG. 1, found on VGAM1507 host target RNA, and schematic representation of the complementarity of each of these host target binding sites to VGAM1507 RNA, herein designated VGAM RNA, are described hereinbelow with reference to Table 2.

As mentioned hereinabove with reference to FIG. 1, a function of VGAM1507 gene, herein designated VGAM is inhibition of expression of VGAM1507 target genes. It is appreciated that specific functions, and accordingly utilities, of VGAM1507 correlate with, and may be deduced from, the identity of the target genes which VGAM1507 binds and inhibits, and the function of these target genes, as elaborated hereinbelow.

C-type (calcium dependent, carbohydrate-recognition domain) Lectin, Superfamily Member 5 (CLECSF5, Accession NM_013252) is a VGAM1507 host target gene. CLECSF5 BINDING SITE is HOST TARGET binding site found in the 3' untranslated region of mRNA encoded by CLECSF5, corresponding to a HOST TARGET binding site such as BINDING SITE I, BINDING SITE II or BINDING SITE III. Table 2 illustrates the complementarity of the nucleotide sequences of CLECSF5 BINDING SITE, designated SEQ ID:14921, to the nucleotide sequence of VGAM1507 RNA, herein designated VGAM RNA, also designated SEQ ID:4218.

A function of VGAM1507 is therefore inhibition of C-type (calcium dependent, carbohydrate-recognition domain) Lectin, Superfamily Member 5 (CLECSF5, Accession NM_013252). Accordingly, utilities of VGAM1507 include diagnosis, prevention and treatment of diseases and clinical conditions associated with CLECSF5. F-box and Leucine-rich Repeat Protein 5 (FBXL5, Accession NM_033535) is another VGAM1507 host target gene. FBXL5 BINDING SITE1 and FBXL5 BINDING SITE2 are HOST TARGET binding sites found in untranslated regions of mRNA encoded by FBXL5, corresponding to HOST TARGET binding sites such as BINDING SITE I, BINDING SITE II or BINDING SITE III. Table 2 illustrates the complementarity of the nucleotide sequences of FBXL5 BINDING SITE1 and FBXL5 BINDING SITE2, designated SEQ ID:27302 and SEQ ID:14460 respectively, to the nucleotide sequence of VGAM1507 RNA, herein designated VGAM RNA, also designated SEQ ID:4218.

Another function of VGAM1507 is therefore inhibition of F-box and Leucine-rich Repeat Protein 5 (FBXL5, Accession NM_033535), a gene which is a putative SCF ubiquitin ligase subunit involved in protein degradation. Accordingly, utilities of VGAM1507 include diagnosis, prevention and treatment of diseases and clinical conditions associated with FBXL5. The function of FBXL5 and its association with various diseases and clinical conditions, has been established by previous studies, as described hereinabove with reference to VGAM61. Deiodinase, Iodothyronine, Type II (DIO2, Accession NM_000793) is another VGAM1507 host target gene. DIO2 BINDING SITE1 and DIO2 BINDING SITE2 are HOST TARGET binding sites found in untranslated regions of mRNA encoded by DIO2, corresponding to HOST TARGET binding sites such as BINDING SITE I, BINDING SITE II or BINDING SITE III. Table 2 illustrates the complementarity of the nucleotide sequences of DIO2 BINDING SITE1 and DIO2 BINDING SITE2, designated SEQ ID:6453 and SEQ ID:15163 respectively, to the nucleotide sequence of VGAM1507 RNA, herein designated VGAM RNA, also designated SEQ ID:4218.

Another function of VGAM1507 is therefore inhibition of Deiodinase, Iodothyronine, Type II (DIO2, Accession NM_000793). Accordingly, utilities of VGAM1507 include diagnosis, prevention and treatment of diseases and clinical conditions associated with DIO2. RAB40A, Member RAS Oncogene Family (RAB40A, Accession XM_088733) is another VGAM1507 host target gene. RAB40A BINDING SITE is HOST TARGET binding site found in the 5' untranslated region of mRNA encoded by RAB40A, corresponding to a HOST TARGET binding site such as BINDING SITE I, BINDING SITE II or BINDING SITE III. Table 2 illustrates the complementarity of the nucleotide sequences of RAB40A BINDING SITE, designated SEQ ID:39926, to the nucleotide sequence of VGAM1507 RNA, herein designated VGAM RNA, also designated SEQ ID:4218.

Another function of VGAM1507 is therefore inhibition of RAB40A, Member RAS Oncogene Family (RAB40A, Accession XM_088733). Accordingly, utilities of VGAM1507 include diagnosis, prevention and treatment of diseases and clinical conditions associated with RAB40A. FIG. 1 further provides a conceptual description of a novel bioinformatically detected viral gene of the present invention, referred to here as Viral Genomic Address Messenger 1508 (VGAM1508) viral gene, which modulates expression of respective host target genes thereof, the function and utility of which host target genes is known in the art.

VGAM1508 is a novel bioinformatically detected regulatory, non protein coding, viral micro RNA (miRNA) gene. The method by which VGAM1508 was detected is described hereinabove with reference to FIGS. 1-8.

VGAM1508 gene, herein designated VGAM GENE, is a viral gene contained in the genome of Potato Virus V.

VGAM1508 host target gene, herein designated VGAM HOST TARGET GENE, is a human gene contained in the human genome.

VGAM1508 gene encodes a VGAM1508 precursor RNA, herein designated VGAM PRECURSOR RNA. Similar to other miRNA genes, and unlike most ordinary genes, VGAM1508 precursor RNA does not encode a protein. A nucleotide sequence identical or highly similar to the nucleotide sequence of VGAM1508 precursor RNA is designated SEQ ID:1494, and is provided hereinbelow with reference to the sequence listing part. Nucleotide sequence SEQ ID:1494 is located at position 7772 relative to the genome of Potato Virus V.

VGAM1508 precursor RNA folds onto itself, forming VGAM1508 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1508 folded precursor RNA into VGAM1508 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1508 RNA is designated SEQ ID:4219, and is provided hereinbelow with reference to the sequence listing part.

VGAM1508 host target gene, herein designated VGAM HOST TARGET GENE, encodes a corresponding messenger RNA, VGAM1508 host target RNA, herein designated VGAM HOST TARGET RNA. VGAM1508 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1508 RNA, herein designated VGAM RNA, binds complementarily to one or more host target binding sites located in untranslated regions of VGAM1508 host target RNA, herein designated VGAM HOST TARGET RNA. This complementary binding is due to the fact that the nucleotide sequence of VGAM1508 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1508 RNA, herein designated VGAM RNA, may have a different number of host target binding sites in untranslated regions of a VGAM1508 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1508 RNA, herein designated VGAM RNA, to host target binding sites on VGAM1508 host target RNA, herein designated VGAM HOST TARGET RNA, such as BINDING SITE I, BINDING SITE II and BINDING SITE III, inhibits translation of VGAM1508 host target RNA into VGAM1508 host target protein, herein designated VGAM HOST TARGET PROTEIN. VGAM host target protein is therefore outlined by a broken line.

It is appreciated that VGAM1508 host target gene, herein designated VGAM HOST TARGET GENE, in fact represents a plurality of VGAM1508 host target genes. The mRNA of each one of this plurality of VGAM1508 host target genes comprises one or more host target binding sites, each having a nucleotide sequence which is at least partly complementary to VGAM1508 RNA, herein designated VGAM RNA, and which when bound by VGAM1508 RNA causes inhibition of translation of respective one or more VGAM1508 host target proteins.

It is further appreciated by one skilled in the art that the mode of translational inhibition illustrated by FIG. 1 with specific reference to translational inhibition exerted by VGAM1508 gene, herein designated VGAM GENE, on one or more VGAM1508 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1508 is inhibition of expression of host target genes, as part of a novel viral mechanism of attacking a host. Accordingly, utilities of VGAM1508 include diagnosis, prevention and treatment of viral infection by Potato Virus V. Specific functions, and accordingly utilities, of VGAM1508 correlate with, and may be deduced from, the identity of the host target genes which VGAM1508 binds and inhibits, and the function of these host target genes, as elaborated hereinbelow.

Nucleotide sequences of the VGAM1508 precursor RNA, herein designated VGAM PRECURSOR RNA, and of the 'diced' VGAM1508 RNA, herein designated VGAM RNA, and a schematic representation of the secondary folding of VGAM1508 folded precursor RNA, herein designated VGAM FOLDED PRECURSOR RNA, of VGAM1508 are further described hereinbelow with reference to Table 1.

Nucleotide sequences of host target binding sites, such as BINDING SITE-I, BINDING SITE-II and BINDING SITE-III of FIG. 1, found on VGAM1508 host target RNA, and schematic representation of the complementarity of each of these host target binding sites to VGAM1508 RNA, herein designated VGAM RNA, are described hereinbelow with reference to Table 2.

As mentioned hereinabove with reference to FIG. 1, a function of VGAM1508 gene, herein designated VGAM is inhibition of expression of VGAM1508 target genes. It is appreciated that specific functions, and accordingly utilities, of VGAM1508 correlate with, and may be deduced from, the identity of the target genes which VGAM1508 binds and inhibits, and the function of these target genes, as elaborated hereinbelow.

Beta-site APP-cleaving Enzyme (BACE, Accession NM_012104) is a VGAM1508 host target gene. BACE BINDING SITE1 and BACE BINDING SITE2 are HOST TARGET binding sites found in untranslated regions of mRNA encoded by BACE, corresponding to HOST TARGET binding sites such as BINDING SITE I, BINDING SITE II or BINDING SITE III. Table 2 illustrates the complementarity of the nucleotide sequences of BACE BINDING SITE1 and BACE BINDING SITE2, designated SEQ ID:14419 and SEQ ID:29087 respectively, to the nucleotide sequence of VGAM1508 RNA, herein designated VGAM RNA, also designated SEQ ID:4219.

A function of VGAM1508 is therefore inhibition of Beta-site APP-cleaving Enzyme (BACE, Accession NM_012104), a gene which is responsible for the proteolytic processing of the amyloid precursor protein. Accordingly, utilities of VGAM1508 include diagnosis, prevention and treatment of diseases and clinical conditions associated with BACE. The function of BACE and its association with various diseases and clinical conditions, has been established by previous studies, as described hereinabove with reference to VGAM173. DNA (cytosine-5-)-methyltransferase 3 Beta (DNMT3B, Accession NM_006892) is another VGAM1508 host target gene. DNMT3B BINDING SITE is HOST TARGET binding site found in the 3' untranslated region of mRNA encoded by DNMT3B, corresponding to a HOST TARGET binding site such as BINDING SITE I, BINDING SITE II or BINDING SITE III. Table 2 illustrates the complementarity of the nucleotide sequences of DNMT3B BINDING SITE, designated SEQ ID:13762, to the nucleotide sequence of VGAM1508 RNA, herein designated VGAM RNA, also designated SEQ ID:4219.

Another function of VGAM1508 is therefore inhibition of DNA (cytosine-5-)-methyltransferase 3 Beta (DNMT3B, Accession NM_006892), a gene which is required for genome wide de novo methylation. Accordingly, utilities of VGAM1508 include diagnosis, prevention and treatment of diseases and clinical conditions associated with DNMT3B. The function of DNMT3B and its association with various diseases and clinical conditions, has been established by previous studies, as described hereinabove with reference to VGAM280. Fibromodulin (FMOD, Accession NM_002023) is another VGAM1508 host target gene. FMOD BINDING SITE is HOST TARGET binding site found in the 3' untranslated region of mRNA encoded by FMOD, corresponding to a HOST TARGET binding site such as BINDING SITE I, BINDING SITE II or BINDING SITE III. Table 2 illustrates the complementarity of the nucleotide sequences of FMOD BINDING SITE, designated SEQ ID:7770, to the nucleotide sequence of VGAM1508 RNA, herein designated VGAM RNA, also designated SEQ ID:4219.

Another function of VGAM1508 is therefore inhibition of Fibromodulin (FMOD, Accession NM_002023), a gene which affects the rate of fibrils formation. Accordingly, utilities of VGAM1508 include diagnosis, prevention and treatment of diseases and clinical conditions associated with FMOD. The function of FMOD and its association with various diseases and clinical conditions, has been established by previous studies, as described hereinabove with reference to VGAM39. Growth Arrest-specific 1 (GAS1, Accession NM_002048) is another VGAM1508 host target gene. GAS1 BINDING SITE is HOST TARGET binding site found in the 5' untranslated region of mRNA encoded by GAS1, corresponding to a HOST TARGET binding site such as BINDING SITE I, BINDING SITE II or BINDING SITE III. Table 2 illustrates the complementarity of the nucleotide sequences of GAS1 BINDING SITE, designated SEQ ID:7799, to the nucleotide sequence of VGAM1508 RNA, herein designated VGAM RNA, also designated SEQ ID:4219.

Another function of VGAM1508 is therefore inhibition of Growth Arrest-specific 1 (GAS1, Accession NM_002048), a gene which blocks entry to S phase and prevents cycling of normal and transformed cells and thereby is a putative tumor suppressor gene. Accordingly, utilities of VGAM1508 include diagnosis, prevention and treatment of diseases and clinical conditions associated with GAS1. The function of GAS1 has been established by previous studies. Growth arrest-specific genes were cloned from mRNAs unique to quiescent, serum-starved NIH 3T3 mouse fibroblasts (Schneider et al., 1988). Webb et al. (1992) mapped the Gas-1 gene to mouse chromosome 13 by in situ hybridization. Colombo et al. (1992) showed linkage of Gas-1 to markers on mouse chromosome 13 in a region that contains 8 loci that are conserved in human 5q, mainly 5q11-q14. Gas-1 is close to the IL9 gene (OMIM Ref. No. 146931), for example. On this basis, Webb et al. (1992) predicted that the GAS1 gene in man is located on 5q. However, the prediction proved not to be true. Evdokiou et al. (1993) localized the human GAS1 gene to 9q21.3-q22 by tritium-labeled in situ hybridization. DNA from human-rodent somatic cell hybrids was used to verify the location of GAS1 to human chromosome 9. They stated that GAS1 was the first gene to be mapped to both human chromosome 9 and mouse chromosome 13. The location of GAS1 at a site of deletion in myeloid malignancies, together with the demonstration that GAS1 suppresses DNA synthesis, suggested that it is a tumor suppressor gene. Del Sal et al. (1994) demonstrated that overexpression of the human GAS1 gene is able to block cell proliferation in lung and bladder carcinoma cell lines, but not in an osteosarcoma cell line or in an adenovirus-type-5 transformed cell line. Del Sal et al. (1992) had previously shown that simian virus 40-transformed NIH 3T3 cells are also refractory to murine GAS1 overexpression, suggesting that the retinoblastoma and/or p53 gene products have an active role in mediating the growth-suppressing effect of GAS1. By in situ hybridization, Del Sal et al. (1994) mapped the GAS1 gene to 9q21.3-q22.1 in a region considered to be a fragile site. Observations suggesting involvement of this area in bladder carcinoma were cited.

Full details of the abovementioned studies are described in the following publications, the disclosure of which are hereby incorporated by reference:

Del Sal, G.; Ruaro, M. E.; Philipson, L.; Schneider, C.: The growth arrest-specific gene, gas1, is involved in growth suppression. Cell 70:595-607, 1992; and Schneider, C.; King, R. M.; Philipson, L.: Genes specifically expressed at growth arrest of mammalian cells. Cell 54:787-793, 1988.

Further studies establishing the function and utilities of GAS1 are found in John Hopkins OMIM database record ID 139185, and in sited publications numbered 2188-2193 listed in the bibliography section hereinbelow, which are also hereby incorporated by reference. Guanine Nucleotide Binding Protein (G protein), Alpha Z Polypeptide (GNAZ, Accession NM_002073) is another VGAM1508 host target gene. GNAZ BINDING SITE is HOST TARGET binding site found in the 3" untranslated region of mRNA encoded by GNAZ, corresponding to a HOST TARGET binding site such as BINDING SITE I, BINDING SITE II or BINDING SITE III. Table 2 illustrates the complementarity of the nucleotide sequences of GNAZ BINDING SITE, designated SEQ ID:7846, to the nucleotide sequence of VGAM1508 RNA, herein designated VGAM RNA, also designated SEQ ID:4219.

Another function of VGAM1508 is therefore inhibition of Guanine Nucleotide Binding Protein (G protein), Alpha Z Polypeptide (GNAZ, Accession NM_002073), a gene which functions as modulator or transducer in various transmembrane signaling systems. Accordingly, utilities of VGAM1508 include diagnosis, prevention and treatment of diseases and clinical conditions associated with GNAZ. The function of GNAZ has been established by previous studies. By cDNA cloning, Blatt et al. (1988) identified a G protein-encoding gene which they called G(z-alpha) and symbolized GNAZ. The corresponding protein was found to differ strikingly from other G-alpha subunits in amino acid sequence in a number of regions, and it appeared to be highly enriched in neural tissue (Fong et al., 1988; Matsuoka et al., 1988). Blatt et al. (1988) assigned the GNAZ locus to chromosome 22 by hybridization to the DNA from a panel of rodent-human cell hybrids. By in situ hybridization, Wilkie et al. (1992) demonstrated that the GNAZ gene is located in band 22q11. By the analysis of RFLVs in an interspecific backcross, they showed that the corresponding gene is located on mouse chromosome 10. Budarf et al. (1991) further narrowed the localization to 22q11.2 by fluorescence in situ hybridization on reverse banded metaphase chromosomes. They confirmed the localization by means of a regional mapping panel of somatic cell hybrids.

Full details of the abovementioned studies are described in the following publications, the disclosure of which are hereby incorporated by reference:

Blatt, C.; Eversole-Cire, P.; Cohn, V. H.; Zollman, S.; Fournier, R. E. K.; Mohandas, L. T.; Nesbitt, M.; Lugo, T.; Jones, D. T.; Reed, R. R.; Weiner, L. P.; Sparkes, R. S.; Simon, M. I.: Chromosomal localization of genes encoding guanine nucleotide-binding protein subunits in mouse and human. Proc. Nat. Acad. Sci. 85:7642-7646, 1988; and Wilkie, T. M.; Gilbert, D. J.; Olsen, A. S.; Chen, X.-N.; Amatruda, T. T.; Korenberg, J. R.; Trask, B. J.; de Jong, P.; Reed, R. R.; Simon, M. I.; Jenkins, N. A.; Copeland, N. G.: Evolu.

Further studies establishing the function and utilities of GNAZ are found in John Hopkins OMIM database record ID 139160, and in sited publications numbered 474 and 2184-2186 listed in the bibliography section hereinbelow, which are also hereby incorporated by reference. Acetyl-Coenzyme A Acyltransferase 2 (mitochondrial 3-oxoacyl-Coenzyme A thiolase) (ACAA2, Accession XM_166287) is another VGAM1508 host target gene. ACAA2 BINDING SITE is HOST TARGET binding site found in the 5' untranslated region of mRNA encoded by ACAA2, corresponding to a HOST TARGET binding site such as BINDING SITE I, BINDING SITE II or BINDING SITE III. Table 2 illustrates the complementarity of the nucleotide sequences of ACAA2 BINDING SITE, designated SEQ ID:44095, to the nucleotide sequence of VGAM1508 RNA, herein designated VGAM RNA, also designated SEQ ID:4219.

Another function of VGAM1508 is therefore inhibition of Acetyl-Coenzyme A Acyltransferase 2 (mitochondrial 3-oxoacyl-Coenzyme A thiolase) (ACAA2, Accession XM_166287). Accordingly, utilities of VGAM1508 include diagnosis, prevention and treatment of diseases and clinical conditions associated with ACAA2. Chemokine (C-C motif) Receptor 6 (CCR6, Accession NM_031409) is another VGAM1508 host target gene. CCR6 BINDING SITE1 and CCR6 BINDING SITE2 are HOST TARGET binding sites found in untranslated regions of mRNA encoded by CCR6, corresponding to HOST TARGET binding sites such as BINDING SITE I, BINDING SITE II or BINDING SITE III. Table 2 illustrates the complementarity of the nucleotide sequences of CCR6 BINDING SITE1 and CCR6 BINDING SITE2, designated SEQ ID:25369 and SEQ ID:10576 respectively, to the nucleotide sequence of VGAM1508 RNA, herein designated VGAM RNA, also designated SEQ ID:4219.

Another function of VGAM1508 is therefore inhibition of Chemokine (C-C motif) Receptor 6 (CCR6, Accession NM_031409). Accordingly, utilities of VGAM1508 include diagnosis, prevention and treatment of diseases and clinical conditions associated with CCR6. FLJ20034 (Accession NM_017630) is another VGAM1508 host target gene. FLJ20034 BINDING SITE is HOST TARGET binding site found in the 3' untranslated region of mRNA encoded by FLJ20034, corresponding to a HOST TARGET binding site such as BINDING SITE I, BINDING SITE II or BINDING SITE III. Table 2 illustrates the complementarity of the nucleotide sequences of FLJ20034 BINDING SITE, designated SEQ ID:19133, to the nucleotide sequence of VGAM1508 RNA, herein designated VGAM RNA, also designated SEQ ID:4219.

Another function of VGAM1508 is therefore inhibition of FLJ20034 (Accession NM_017630). Accordingly, utilities of VGAM1508 include diagnosis, prevention and treatment of diseases and clinical conditions associated with FLJ20034. Mitogen-activated Protein Kinase Kinase 4 (MAP2K4, Accession NM_003010) is another VGAM1508 host target gene. MAP2K4 BINDING SITE is HOST TARGET binding site found in the 3' untranslated region of mRNA encoded by MAP2K4, corresponding to a HOST TARGET binding site such as BINDING SITE I, BINDING SITE II or BINDING SITE III. Table 2 illustrates the complementarity of the nucleotide sequences of MAP2K4 BINDING SITE, designated SEQ ID:8915, to the nucleotide sequence of VGAM1508 RNA, herein designated VGAM RNA, also designated SEQ ID:4219.

Another function of VGAM1508 is therefore inhibition of Mitogen-activated Protein Kinase Kinase 4 (MAP2K4, Accession NM_003010). Accordingly, utilities of VGAM1508 include diagnosis, prevention and treatment of diseases and clinical conditions associated with MAP2K4. MGC35558 (Accession NM_145013) is another VGAM1508 host target gene. MGC35558 BINDING SITE is HOST TARGET binding site found in the 3' untranslated region of mRNA encoded by MGC35558, corresponding to a HOST TARGET binding site such as BINDING SITE I, BINDING SITE II or BINDING SITE III. Table 2 illustrates the complementarity of the nucleotide sequences of MGC35558 BINDING SITE, designated SEQ ID:29616, to the nucleotide sequence of VGAM1508 RNA, herein designated VGAM RNA, also designated SEQ ID:4219.

Another function of VGAM1508 is therefore inhibition of MGC35558 (Accession NM_145013). Accordingly, utilities of VGAM1508 include diagnosis, prevention and treatment of diseases and clinical conditions associated with MGC35558. Serum/glucocorticoid Regulated Kinase-like (SGKL, Accession NM_013257) is another VGAM1508 host target gene. SGKL BINDING SITE is HOST TARGET binding site found in the 3' untranslated region of mRNA encoded by SGKL, corresponding to a HOST TARGET binding site such as BINDING SITE I, BINDING SITE II or BINDING SITE III. Table 2 illustrates the complementarity of the nucleotide sequences of SGKL BINDING SITE, designated SEQ ID:14926, to the nucleotide sequence of VGAM1508 RNA, herein designated VGAM RNA, also designated SEQ ID:4219.

Another function of VGAM1508 is therefore inhibition of Serum/glucocorticoid Regulated Kinase-like (SGKL, Accession NM_013257). Accordingly, utilities of VGAM1508 include diagnosis, prevention and treatment of diseases and clinical conditions associated with SGKL. Synaptotagmin XIII (SYT13, Accession XM_167880) is another VGAM1508 host target gene. SYT13 BINDING SITE is HOST TARGET binding site found in the 3' untranslated region of mRNA encoded by SYT13, corresponding to a HOST TARGET binding site such as BINDING SITE I, BINDING SITE II or BINDING SITE III. Table 2 illustrates the complementarity of the nucleotide sequences of SYT13 BINDING SITE, designated SEQ ID:44890, to the nucleotide sequence of VGAM1508 RNA, herein designated VGAM RNA, also designated SEQ ID:4219.

Another function of VGAM1508 is therefore inhibition of Synaptotagmin XIII (SYT13, Accession XM_167880). Accordingly, utilities of VGAM1508 include diagnosis, prevention and treatment of diseases and clinical conditions associated with SYT13. LOC197358 (Accession XM_113872) is another VGAM1508 host target gene. LOC197358 BINDING SITE is HOST TARGET binding site found in the 3' untranslated region of mRNA encoded by LOC197358, corresponding to a HOST TARGET binding site such as BINDING SITE I, BINDING SITE II or BINDING SITE III. Table 2 illustrates the complementarity of the nucleotide sequences of LOC197358 BINDING SITE, designated SEQ ID:42512, to the nucleotide sequence of VGAM1508 RNA, herein designated VGAM RNA, also designated SEQ ID:4219.

Another function of VGAM1508 is therefore inhibition of LOC197358 (Accession XM_113872). Accordingly, utilities of VGAM1508 include diagnosis, prevention and treatment of diseases and clinical conditions associated with LOC197358. LOC256230 (Accession XM_173371) is another VGAM1508 host target gene. LOC256230 BINDING SITE is HOST TARGET binding site found in the 5' untranslated region of mRNA encoded by LOC256230, corresponding to a HOST TARGET binding site such as BINDING SITE I, BINDING SITE II or BINDING SITE III. Table 2 illustrates the complementarity of the nucleotide sequences of LOC256230 BINDING SITE, designated SEQ ID:46540, to the nucleotide sequence of VGAM1508 RNA, herein designated VGAM RNA, also designated SEQ ID:4219.

Another function of VGAM1508 is therefore inhibition of LOC256230 (Accession XM_173371). Accordingly, utilities of VGAM1508 include diagnosis, prevention and treatment of diseases and clinical conditions associated with LOC256230. LOC256231 (Accession XM_173372) is another VGAM1508 host target gene. LOC256231 BINDING SITE is HOST TARGET binding site found in the 5' untranslated region of mRNA encoded by LOC256231, corresponding to a HOST TARGET binding site such as BINDING SITE I, BINDING SITE II or BINDING SITE III. Table 2 illustrates the complementarity of the nucleotide sequences of LOC256231 BINDING SITE, designated SEQ ID:46542, to the nucleotide sequence of VGAM1508 RNA, herein designated VGAM RNA, also designated SEQ ID:4219.

Another function of VGAM1508 is therefore inhibition of LOC256231 (Accession XM_173372). Accordingly, utilities of VGAM1508 include diagnosis, prevention and treatment of diseases and clinical conditions associated with LOC256231. LOC92539 (Accession XM_045632) is another VGAM1508 host target gene. LOC92539 BINDING SITE is HOST TARGET binding site found in the 5' untranslated region of mRNA encoded by LOC92539, corresponding to a HOST TARGET binding site such as BINDING SITE I, BINDING SITE II or BINDING SITE III. Table 2 illustrates the complementarity of the nucleotide sequences of LOC92539 BINDING SITE, designated SEQ ID:34501, to the nucleotide sequence of VGAM1508 RNA, herein designated VGAM RNA, also designated SEQ ID:4219.

Another function of VGAM1508 is therefore inhibition of LOC92539 (Accession XM_045632). Accordingly, utilities of VGAM1508 include diagnosis, prevention and treatment of diseases and clinical conditions associated with LOC92539. FIG. 1 further provides a conceptual description of a novel bioinformatically detected viral gene of the present invention, referred to here as Viral Genomic Address Messenger 1509 (VGAM1509) viral gene, which modulates expression of respective host target genes thereof, the function and utility of which host target genes is known in the art.

VGAM1509 is a novel bioinformatically detected regulatory, non protein coding, viral micro RNA (miRNA) gene. The method by which VGAM1509 was detected is described hereinabove with reference to FIGS. 1-8.

VGAM1509 gene, herein designated VGAM GENE, is a viral gene contained in the genome of Potato Virus V. VGAM1509 host target gene, herein designated VGAM HOST TARGET GENE, is a human gene contained in the human genome.

VGAM1509 gene encodes a VGAM1509 precursor RNA, herein designated VGAM PRECURSOR RNA. Similar to other miRNA genes, and unlike most ordinary genes, VGAM1509 precursor RNA does not encode a protein. A nucleotide sequence identical or highly similar to the nucleotide sequence of VGAM1509 precursor RNA is designated SEQ ID:1495, and is provided hereinbelow with reference to the sequence listing part. Nucleotide sequence SEQ ID:1495 is located at position 8444 relative to the genome of Potato Virus V.

VGAM1509 precursor RNA folds onto itself, forming VGAM1509 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1509 folded precursor RNA into VGAM1509 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1509 RNA is designated SEQ ID:4220, and is provided hereinbelow with reference to the sequence listing part.

VGAM1509 host target gene, herein designated VGAM HOST TARGET GENE, encodes a corresponding messenger RNA, VGAM1509 host target RNA, herein designated VGAM HOST TARGET RNA. VGAM1509 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1509 RNA, herein designated VGAM RNA, binds complementarily to one or more host target binding sites located in untranslated regions of VGAM1509 host target RNA, herein designated VGAM HOST TARGET RNA. This complementary binding is due to the fact that the nucleotide sequence of VGAM1509 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1509 RNA, herein designated VGAM RNA, may have a different number of host target binding sites in untranslated regions of a VGAM1509 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1509 RNA, herein designated VGAM RNA, to host target binding sites on VGAM1509 host target RNA, herein designated VGAM HOST TARGET RNA, such as BINDING SITE I, BINDING SITE II and BINDING SITE III, inhibits translation of VGAM1509 host target RNA into VGAM1509 host target protein, herein designated VGAM HOST TARGET PROTEIN. VGAM host target protein is therefore outlined by a broken line.

It is appreciated that VGAM1509 host target gene, herein designated VGAM HOST TARGET GENE, in fact represents a plurality of VGAM1509 host target genes. The mRNA of each one of this plurality of VGAM1509 host target genes comprises one or more host target binding sites, each having a nucleotide sequence which is at least partly complementary to VGAM1509 RNA, herein designated VGAM RNA, and which when bound by VGAM1509 RNA causes inhibition of translation of respective one or more VGAM1509 host target proteins.

It is further appreciated by one skilled in the art that the mode of translational inhibition illustrated by FIG. 1 with specific reference to translational inhibition exerted by VGAM1509 gene, herein designated VGAM GENE, on one or more VGAM1509 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1509 is inhibition of expression of host target genes, as part of a novel viral mechanism of attacking a host. Accordingly, utilities of VGAM1509 include diagnosis, prevention and treatment of viral infection by Potato Virus V. Specific functions, and accordingly utilities, of VGAM1509 correlate with, and may be deduced from, the identity of the host target genes which VGAM1509 binds and inhibits, and the function of these target genes, as elaborated hereinbelow.

Nucleotide sequences of the VGAM1509 precursor RNA, herein designated VGAM PRECURSOR RNA, and of the 'diced' VGAM1509 RNA, herein designated VGAM RNA, and a schematic representation of the secondary folding of VGAM1509 folded precursor RNA, herein designated VGAM FOLDED PRECURSOR RNA, of VGAM1509 are further described hereinbelow with reference to Table 1.

Nucleotide sequences of host target binding sites, such as BINDING SITE-I, BINDING SITE-II and BINDING SITE-III of FIG. 1, found on VGAM1509 host target RNA, and schematic representation of the complementarity of each of these host target binding sites to VGAM1509 RNA, herein designated VGAM RNA, are described hereinbelow with reference to Table 2.

As mentioned hereinabove with reference to FIG. 1, a function of VGAM1509 gene, herein designated VGAM is inhibition of expression of VGAM1509 target genes. It is appreciated that specific functions, and accordingly utilities, of VGAM1509 correlate with, and may be deduced from, the identity of the target genes which VGAM1509 binds and inhibits, and the function of these target genes, as elaborated hereinbelow.

Protein Kinase, CAMP-dependent, Catalytic, Beta (PRKACB, Accession NM_002731) is a VGAM1509 host target gene. PRKACB BINDING SITE is HOST TARGET binding site found in the 3' untranslated region of mRNA encoded by PRKACB, corresponding to a HOST TARGET binding site such as BINDING SITE I, BINDING SITE II or BINDING SITE III. Table 2 illustrates the complementarity of the nucleotide sequences of PRKACB BINDING SITE, designated SEQ ID:8601, to the nucleotide sequence of VGAM1509 RNA, herein designated VGAM RNA, also designated SEQ ID:4220.

A function of VGAM1509 is therefore inhibition of Protein Kinase, CAMP-dependent, Catalytic, Beta (PRKACB, Accession NM_002731), a gene which is the catalytic beta subunit of cAMP-dependent protein kinase (PKA). Accordingly, utilities of VGAM1509 include diagnosis, prevention and treatment of diseases and clinical conditions associated with PRKACB. The function of PRKACB and its association with various diseases and clinical conditions, has been established by previous studies, as described hereinabove with reference to VGAM795. FIG. 1 further provides a conceptual description of a novel bioinformatically detected viral gene of the present invention, referred to here as Viral Genomic Address Messenger 1510 (VGAM1510) viral gene, which modulates expression of respective host target genes thereof, the function and utility of which host target genes is known in the art.

VGAM1510 is a novel bioinformatically detected regulatory, non protein coding, viral micro RNA (miRNA) gene. The method by which VGAM1510 was detected is described hereinabove with reference to FIGS. 1-8.

VGAM1510 gene, herein designated VGAM GENE, is a viral gene contained in the genome of Potato Virus V. VGAM1510 host target gene, herein designated VGAM HOST TARGET GENE, is a human gene contained in the human genome.

VGAM1510 gene encodes a VGAM1510 precursor RNA, herein designated VGAM PRECURSOR RNA. Similar to other miRNA genes, and unlike most ordinary genes, VGAM1510 precursor RNA does not encode a protein. A nucleotide sequence identical or highly similar to the nucleotide sequence of VGAM1510 precursor RNA is designated SEQ ID:1496, and is provided hereinbelow with reference to the sequence listing part. Nucleotide sequence SEQ ID:1496 is located at position 6444 relative to the genome of Potato Virus V.

VGAM1510 precursor RNA folds onto itself, forming VGAM1510 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1510 folded precursor RNA into VGAM1510 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1510 RNA is designated SEQ ID:4221, and is provided hereinbelow with reference to the sequence listing part.

VGAM1510 host target gene, herein designated VGAM HOST TARGET GENE, encodes a corresponding messenger RNA, VGAM1510 host target RNA, herein designated VGAM HOST TARGET RNA. VGAM1510 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1510 RNA, herein designated VGAM RNA, binds complementarily to one or more host target binding sites located in untranslated regions of VGAM1510 host target RNA, herein designated VGAM HOST TARGET RNA. This complementary binding is due to the fact that the nucleotide sequence of VGAM1510 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1510 RNA, herein designated VGAM RNA, may have a different number of host target binding sites in untranslated regions of a VGAM1510 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1510 RNA, herein designated VGAM RNA, to host target binding sites on VGAM1510 host target RNA, herein designated VGAM HOST TARGET RNA, such as BINDING SITE I, BINDING SITE II and BINDING SITE III, inhibits translation of VGAM1510 host target RNA into VGAM1510 host target protein, herein designated VGAM HOST TARGET PROTEIN. VGAM host target protein is therefore outlined by a broken line.

It is appreciated that VGAM1510 host target gene, herein designated VGAM HOST TARGET GENE, in fact represents a plurality of VGAM1510 host target genes. The mRNA of each one of this plurality of VGAM1510 host target genes comprises one or more host target binding sites, each having a nucleotide sequence which is at least partly complementary to VGAM1510 RNA, herein designated VGAM RNA, and which when bound by VGAM1510 RNA causes inhibition of translation of respective one or more VGAM1510 host target proteins.

It is further appreciated by one skilled in the art that the mode of translational inhibition illustrated by FIG. 1 with specific reference to translational inhibition exerted by VGAM1510 gene, herein designated VGAM GENE, on one or more VGAM1510 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1510 is inhibition of expression of host target genes, as part of a novel viral mechanism of attacking a host. Accordingly, utilities of VGAM1510 include diagnosis, prevention and treatment of viral infection by Potato Virus V. Specific functions, and accordingly utilities, of VGAM1510 correlate with, and may be deduced from, the identity of the host target genes which VGAM1510 binds and inhibits, and the function of these host target genes, as elaborated hereinbelow.

Nucleotide sequences of the VGAM1510 precursor RNA, herein designated VGAM PRECURSOR RNA, and of the 'diced' VGAM1510 RNA, herein designated VGAM RNA, and a schematic representation of the secondary folding of VGAM1510 folded precursor RNA, herein designated VGAM FOLDED PRECURSOR RNA, of VGAM1510 are further described hereinbelow with reference to Table 1.

Nucleotide sequences of host target binding sites, such as BINDING SITE-I, BINDING SITE-II and BINDING SITE-III of FIG. 1, found on VGAM1510 host target RNA, and schematic representation of the complementarity of each of these host target binding sites to VGAM1510 RNA, herein designated VGAM RNA, are described hereinbelow with reference to Table 2.

As mentioned hereinabove with reference to FIG. 1, a function of VGAM1510 gene, herein designated VGAM is inhibition of expression of VGAM1510 target genes. It is appreciated that specific functions, and accordingly utilities, of VGAM1510 correlate with, and may be deduced from, the identity of the target genes which VGAM1510 binds and inhibits, and the function of these target genes, as elaborated hereinbelow.

Calcium Channel, Voltage-dependent, Beta 1 Subunit (CACNB1, Accession NM_000723) is a VGAM1510 host target gene. CACNB1 BINDING SITE is HOST TARGET binding site found in the 3' untranslated region of mRNA encoded by CACNB1, corresponding to a HOST TARGET binding site such as BINDING SITE I, BINDING SITE II or BINDING SITE III. Table 2 illustrates the complementarity of the nucleotide sequences of CACNB1 BINDING SITE, designated SEQ ID:6387, to the nucleotide sequence of VGAM1510 RNA, herein designated VGAM RNA, also designated SEQ ID:4221.

A function of VGAM1510 is therefore inhibition of Calcium Channel, Voltage-dependent, Beta 1 Subunit (CACNB1, Accession NM_000723), a gene which may not only play an important role in the transport/insertion of the alpha-1S subunit into the membrane. Accordingly, utilities of VGAM1510 include diagnosis, prevention and treatment of diseases and clinical conditions associated with CACNB1. The function of CACNB1 and its association with various diseases and clinical conditions, has been established by previous studies, as described hereinabove with reference to VGAM114.inositol (myo)-1(or 4)-monophosphatase 1 (IMPA1, Accession NM_005536) is another VGAM1510 host target gene. IMPA1 BINDING SITE is HOST TARGET binding site found in the 3' untranslated region of mRNA encoded by IMPA1, corresponding to a HOST TARGET binding site such as BINDING SITE I, BINDING SITE II or BINDING SITE III. Table 2 illustrates the complementarity of the nucleotide sequences of IMPA1 BINDING SITE, designated SEQ ID:12055, to the nucleotide sequence of VGAM1510 RNA, herein designated VGAM RNA, also designated SEQ ID:4221.

Another function of VGAM1510 is therefore inhibition of inositol (myo)-1(or 4)-monophosphatase 1 (IMPA1, Accession NM_005536), a gene which is responsible for the provision of inositol required for synthesis of phosphatidylinositol and polyphosphoinositides. Accordingly, utilities of VGAM1510 include diagnosis, prevention and treatment of diseases and clinical conditions associated with IMPA1. The function of IMPA1 and its association with various diseases and clinical conditions, has been established by previous studies, as described hereinabove with reference to VGAM134. Tuftelin 1 (TUFT1, Accession NM_020127) is another VGAM1510 host target gene. TUFT1 BINDING SITE is HOST TARGET binding site found in the 3' untranslated region of mRNA encoded by TUFT1, corresponding to a HOST TARGET binding site such as BINDING SITE I, BINDING SITE II or BINDING SITE III. Table 2 illustrates the complementarity of the nucleotide sequences of TUFT1 BINDING SITE, designated SEQ ID:21319, to the nucleotide sequence of VGAM1510 RNA, herein designated VGAM RNA, also designated SEQ ID:4221.

Another function of VGAM1510 is therefore inhibition of Tuftelin 1 (TUFT1, Accession NM_020127), a gene which appears to play a role in cytokinesis, cell shape, and specialized functions such as secretion and capping. Accordingly, utilities of VGAM1510 include diagnosis, prevention and treatment of diseases and clinical conditions associated with TUFT1. The function of TUFT1 and its association with various diseases and clinical conditions, has been established by previous studies, as described hereinabove with reference to VGAM1152. MGC13138 (Accession NM_033410) is another VGAM1510 host target gene. MGC13138 BINDING SITE is HOST TARGET binding site found in the 3' untranslated region of mRNA encoded by MGC13138, corresponding to a HOST TARGET binding site such as BINDING SITE I, BINDING SITE II or BINDING SITE III. Table 2 illustrates the complementarity of the nucleotide sequences of MGC13138 BINDING SITE, designated SEQ ID:27233, to the nucleotide sequence of VGAM1510 RNA, herein designated VGAM RNA, also designated SEQ ID:4221.

Another function of VGAM1510 is therefore inhibition of MGC13138 (Accession NM_033410). Accordingly, utilities of VGAM1510 include diagnosis, prevention and treatment of diseases and clinical conditions associated with MGC13138. RAB3A Interacting Protein (rabin3)-like 1 (RAB3IL1, Accession NM_013401) is another VGAM1510 host target gene. RAB3IL1 BINDING SITE is HOST TARGET binding site found in the 3' untranslated region of mRNA encoded by RAB3IL1, corresponding to a HOST TARGET binding site such as BINDING SITE I, BINDING SITE II or BINDING SITE III. Table 2 illustrates the complementarity of the nucleotide sequences of RAB3IL1 BINDING SITE, designated SEQ ID:15065, to the nucleotide sequence of VGAM1510 RNA, herein designated VGAM RNA, also designated SEQ ID:4221.

Another function of VGAM1510 is therefore inhibition of RAB3A Interacting Protein (rabin3)-like 1 (RAB3IL1, Accession NM_013401). Accordingly, utilities of VGAM1510 include diagnosis, prevention and treatment of diseases and clinical conditions associated with RAB3IL1. Ring Finger Protein (C3HC4 type) 8 (RNF8, Accession NM_003958) is another VGAM1510 host target gene. RNF8 BINDING SITE is HOST TARGET binding site found in the 3' untranslated region of mRNA encoded by RNF8, corresponding to a HOST TARGET binding site such as BINDING SITE I, BINDING SITE II or BINDING SITE III. Table 2 illustrates the complementarity of the nucleotide sequences of RNF8 BINDING SITE, designated SEQ ID:10099, to the nucleotide sequence of VGAM1510 RNA, herein designated VGAM RNA, also designated SEQ ID:4221.

Another function of VGAM1510 is therefore inhibition of Ring Finger Protein (C3HC4 type) 8 (RNF8, Accession NM_003958). Accordingly, utilities of VGAM1510 include diagnosis, prevention and treatment of diseases and clinical conditions associated with RNF8. Zinc Finger Protein 323 (ZNF323, Accession NM_030899) is another VGAM1510 host target gene. ZNF323 BINDING SITE is HOST TARGET binding site found in the 5' untranslated region of mRNA encoded by ZNF323, corresponding to a HOST TARGET binding site such as BINDING SITE I, BINDING SITE II or BINDING SITE III. Table 2 illustrates the complementarity of the nucleotide sequences of ZNF323 BINDING SITE, designated SEQ ID:25170, to the nucleotide sequence of VGAM1510 RNA, herein designated VGAM RNA, also designated SEQ ID:4221.

Another function of VGAM1510 is therefore inhibition of Zinc Finger Protein 323 (ZNF323, Accession NM_030899). Accordingly, utilities of VGAM1510 include diagnosis, prevention and treatment of diseases and clinical conditions associated with ZNF323. LOC201965 (Accession XM_114412) is another VGAM1510 host target gene. LOC201965 BINDING SITE is HOST TARGET binding site found in the 3' untranslated region of mRNA encoded by LOC201965, corresponding to a HOST TARGET binding site such as BINDING SITE I, BINDING SITE II or BINDING SITE III. Table 2 illustrates the complementarity of the nucleotide sequences of LOC201965 BINDING SITE, designated SEQ ID:42935, to the nucleotide sequence of VGAM1510 RNA, herein designated VGAM RNA, also designated SEQ ID:4221.

Another function of VGAM1510 is therefore inhibition of LOC201965 (Accession XM_114412). Accordingly, utilities of VGAM1510 include diagnosis, prevention and treatment of diseases and clinical conditions associated with LOC201965. LOC51696 (Accession NM_016217) is another VGAM1510 host target gene. LOC51696 BINDING SITE is HOST TARGET binding site found in the 3' untranslated region of mRNA encoded by LOC51696, corresponding to a HOST TARGET binding site such as BINDING SITE I, BINDING SITE II or BINDING SITE III. Table 2 illustrates the complementarity of the nucleotide sequences of LOC51696 BINDING SITE, designated SEQ ID:18315, to the nucleotide sequence of VGAM1510 RNA, herein designated VGAM RNA, also designated SEQ ID:4221.

Another function of VGAM1510 is therefore inhibition of LOC51696 (Accession NM_016217). Accordingly, utilities of VGAM1510 include diagnosis, prevention and treatment of diseases and clinical conditions associated with LOC51696. LOC93349 (Accession NM_138402) is another VGAM1510 host target gene. LOC93349 BINDING SITE is HOST TARGET binding site found in the 3' untranslated region of mRNA encoded by LOC93349, corresponding to a HOST TARGET binding site such as BINDING SITE I, BINDING SITE II or BINDING SITE III. Table 2 illustrates the complementarity of the nucleotide sequences of LOC93349 BINDING SITE, designated SEQ ID:28771, to the nucleotide sequence of VGAM1510 RNA, herein designated VGAM RNA, also designated SEQ ID:4221.

Another function of VGAM1510 is therefore inhibition of LOC93349 (Accession NM_138402). Accordingly, utilities of VGAM1510 include diagnosis, prevention and treatment of diseases and clinical conditions associated with LOC93349. FIG. 1 further provides a conceptual description of a novel bioinformatically detected viral gene of the present invention, referred to here as Viral Genomic Address Messenger 1511 (VGAM1511) viral gene, which modulates expression of respective host target genes thereof, the function and utility of which host target genes is known in the art.

VGAM1511 is a novel bioinformatically detected regulatory, non protein coding, viral micro RNA (miRNA) gene. The method by which VGAM1511 was detected is described hereinabove with reference to FIGS. 1-8.

VGAM1511 gene, herein designated VGAM GENE, is a viral gene contained in the genome of Potato Virus V. VGAM1511 host target gene, herein designated VGAM HOST TARGET GENE, is a human gene contained in the human genome.

VGAM1511 gene encodes a VGAM1511 precursor RNA, herein designated VGAM PRECURSOR RNA. Similar to other miRNA genes, and unlike most ordinary genes, VGAM1511 precursor RNA does not encode a protein. A nucleotide sequence identical or highly similar to the nucleotide sequence of VGAM1511 precursor RNA is designated SEQ ID:1497, and is provided hereinbelow with reference to the sequence listing part. Nucleotide sequence SEQ ID:1497 is located at position 4177 relative to the genome of Potato Virus V.

VGAM1511 precursor RNA folds onto itself, forming VGAM1511 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1511 folded precursor RNA into VGAM1511 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM1511 RNA is designated SEQ ID:4222, and is provided hereinbelow with reference to the sequence listing part.

VGAM1511 host target gene, herein designated VGAM HOST TARGET GENE, encodes a corresponding messenger RNA, VGAM1511 host target RNA, herein designated VGAM HOST TARGET RNA. VGAM1511 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1511 RNA, herein designated VGAM RNA, binds complementarily to one or more host target binding sites located in untranslated regions of VGAM1511 host target RNA, herein designated VGAM HOST TARGET RNA. This complementary binding is due to the fact that the nucleotide sequence of VGAM1511 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1511 RNA, herein designated VGAM RNA, may have a different number of host target binding sites in untranslated regions of a VGAM1511 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1511 RNA, herein designated VGAM RNA, to host target binding sites on VGAM1511 host target RNA, herein designated VGAM HOST TARGET RNA, such as BINDING SITE I, BINDING SITE II and BINDING SITE III, inhibits translation of VGAM1511 host target RNA into VGAM1511 host target protein, herein designated VGAM HOST TARGET PROTEIN. VGAM host target protein is therefore outlined by a broken line.

It is appreciated that VGAM1511 host target gene, herein designated VGAM HOST TARGET GENE, in fact represents a plurality of VGAM1511 host target genes. The mRNA of each one of this plurality of VGAM1511 host target genes comprises one or more host target binding sites, each having a nucleotide sequence which is at least partly complementary to VGAM1511 RNA, herein designated VGAM RNA, and which when bound by VGAM1511 RNA causes inhibition of translation of respective one or more VGAM1511 host target proteins.

It is further appreciated by one skilled in the art that the mode of translational inhibition illustrated by FIG. 1 with specific reference to translational inhibition exerted by VGAM1511 gene, herein designated VGAM GENE, on one or more VGAM1511 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1511 is inhibition of expression of host target genes, as part of a novel viral mechanism of attacking a host. Accordingly, utilities of VGAM1511 include diagnosis, prevention and treatment of viral infection by Potato Virus V. Specific functions, and accordingly utilities, of VGAM1511 correlate with, and may be deduced from, the identity of the host target genes which VGAM1511 binds and inhibits, and the function of these host target genes, as elaborated hereinbelow.

Nucleotide sequences of the VGAM1511 precursor RNA, herein designated VGAM PRECURSOR RNA, and of the 'diced' VGAM1511 RNA, herein designated VGAM RNA, and a schematic representation of the secondary folding of VGAM1511 folded precursor RNA, herein designated VGAM FOLDED PRECURSOR RNA, of VGAM1511 are further described hereinbelow with reference to Table 1.

Nucleotide sequences of host target binding sites, such as BINDING SITE-I, BINDING SITE-II and BINDING SITE-III of FIG. 1, found on VGAM1511 host target RNA, and schematic representation of the complementarity of each of these host target binding sites to VGAM1511 RNA, herein designated VGAM RNA, are described hereinbelow with reference to Table 2.

As mentioned hereinabove with reference to FIG. 1, a function of VGAM1511 gene, herein designated VGAM is inhibition of expression of VGAM1511 target genes. It is appreciated that specific functions, and accordingly utilities, of VGAM1511 correlate with, and may be deduced from, the identity of the target genes which VGAM1511 binds and inhibits, and the function of these target genes, as elaborated hereinbelow.

Natural Killer-tumor Recognition Sequence (NKTR, Accession NM_005385) is a VGAM1511 host target gene. NKTR BINDING SITE is HOST TARGET binding site found in the 3' untranslated region of mRNA encoded by NKTR, corresponding to a HOST TARGET binding site such as BINDING SITE I, BINDING SITE II or BINDING SITE III. Table 2 illustrates the complementarity of the nucleotide sequences of NKTR BINDING SITE, designated SEQ ID:11864, to the nucleotide sequence of VGAM1511 RNA, herein designated VGAM RNA, also designated SEQ ID:4222.

A function of VGAM1511 is therefore inhibition of Natural Killer-tumor Recognition Sequence (NKTR, Accession NM_005385), a gene which is involved in the function of nk cells. Accordingly, utilities of VGAM1511 include diagnosis, prevention and treatment of diseases and clinical conditions associated with NKTR. The function of NKTR and its association with various diseases and clinical conditions, has been established by previous studies, as described hereinabove with reference to VGAM133. Oxytocin Receptor (OXTR, Accession NM_000916) is another VGAM1511 host target gene. OXTR BINDING SITE is HOST TARGET binding site found in the 3' untranslated region of mRNA encoded by OXTR, corresponding to a HOST TARGET binding site such as BINDING SITE I, BINDING SITE II or BINDING SITE III. Table 2 illustrates the complementarity of the nucleotide sequences of OXTR BINDING SITE, designated SEQ ID:6621, to the nucleotide sequence of VGAM1511 RNA, herein designated VGAM RNA, also designated SEQ ID:4222.

Another function of VGAM1511 is therefore inhibition of Oxytocin Receptor (OXTR, Accession NM_000916), a gene which induces inward ion currents. Accordingly, utilities of VGAM1511 include diagnosis, prevention and treatment of diseases and clinical conditions associated with OXTR. The function of OXTR and its association with various diseases and clinical conditions, has been established by previous studies, as described hereinabove with reference to VGAM636. Cerebellin 1 Precursor (CBLN1, Accession NM_004352) is another VGAM1511 host target gene. CBLN1 BINDING SITE is HOST TARGET binding site found in the 3' untranslated region of mRNA encoded by CBLN1, corresponding to a HOST TARGET binding site such as BINDING SITE I, BINDING SITE II or BINDING SITE III. Table 2 illustrates the complementarity of the nucleotide sequences of CBLN1 BINDING SITE, designated SEQ ID:10554, to the nucleotide sequence of VGAM1511 RNA, herein designated VGAM RNA, also designated SEQ ID:4222.

Another function of VGAM1511 is therefore inhibition of Cerebellin 1 Precursor (CBLN1, Accession NM_004352). Accordingly, utilities of VGAM1511 include diagnosis, prevention and treatment of diseases and clinical conditions associated with CBLN1. HSPC063 (Accession NM_014155) is another VGAM1511 host target gene. HSPC063 BINDING SITE is HOST TARGET binding site found in the 3' untranslated region of mRNA encoded by HSPC063, corresponding to a HOST TARGET binding site such as BINDING SITE I, BINDING SITE II or BINDING SITE III. Table 2 illustrates the complementarity of the nucleotide sequences of HSPC063 BINDING SITE, designated SEQ ID:15437, to the nucleotide sequence of VGAM1511 RNA, herein designated VGAM RNA, also designated SEQ ID:4222.

Another function of VGAM1511 is therefore inhibition of HSPC063 (Accession NM_014155). Accordingly, utilities of VGAM1511 include diagnosis, prevention and treatment of diseases and clinical conditions associated with HSPC063. KIAA1871 (Accession XM_028409) is another VGAM1511 host target gene. KIAA1871 BINDING SITE is HOST TARGET binding site found in the 3' untranslated region of mRNA encoded by KIAA1871, corresponding to a HOST TARGET binding site such as BINDING SITE I, BINDING SITE II or BINDING SITE III. Table 2 illustrates the complementarity of the nucleotide sequences of KIAA1871 BINDING SITE, designated SEQ ID:30699, to the nucleotide sequence of VGAM1511 RNA, herein designated VGAM RNA, also designated SEQ ID:4222.

Another function of VGAM1511 is therefore inhibition of KIAA1871 (Accession XM_028409). Accordingly, utilities of VGAM1511 include diagnosis, prevention and treatment of diseases and clinical conditions associated with KIAA1871. Rab11-FIP2 (Accession NM_014904) is another VGAM1511 host target gene. Rab11-FIP2 BINDING SITE is HOST TARGET binding site found in the 3' untranslated region of mRNA encoded by Rab11-FIP2, corresponding to a HOST TARGET binding site such as BINDING SITE I, BINDING SITE II or BINDING SITE III. Table 2 illustrates the complementarity of the nucleotide sequences of Rab11-FIP2 BINDING SITE, designated SEQ ID:17098, to the nucleotide sequence of VGAM1511 RNA, herein designated VGAM RNA, also designated SEQ ID:4222.

Another function of VGAM1511 is therefore inhibition of Rab11-FIP2 (Accession NM_014904). Accordingly, utilities of VGAM1511 include diagnosis, prevention and treatment of diseases and clinical conditions associated with Rab11-FIP2. FIG. 1 further provides a conceptual description of a novel bioinformatically detected viral gene of the present invention, referred to here as Viral Genomic Address Messenger 1512 (VGAM1512) viral gene, which modulates expression of respective host target genes thereof, the function and utility of which host target genes is known in the art.

VGAM1512 is a novel bioinformatically detected regulatory, non protein coding, viral micro RNA (miRNA) gene. The method by which VGAM1512 was detected is described hereinabove with reference to FIGS. 1-8.

VGAM1512 gene, herein designated VGAM GENE, is a viral gene contained in the genome of Parsnip Yellow Fleck Virus. VGAM1512 host target gene, herein designated VGAM HOST TARGET GENE, is a human gene contained in the human genome.

VGAM1512 gene encodes a VGAM1512 precursor RNA, herein designated VGAM PRECURSOR RNA. Similar to other miRNA genes, and unlike most ordinary genes, VGAM1512 precursor RNA does not encode a protein. A nucleotide sequence identical or highly similar to the nucleotide sequence of VGAM1512 precursor RNA is designated SEQ ID:1498, and is provided hereinbelow with reference to the sequence listing part. Nucleotide sequence SEQ ID:1498 is located at position 7608 relative to the genome of Parsnip Yellow Fleck Virus.

VGAM1512 precursor RNA folds onto itself, forming VGAM1512 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1512 folded precursor RNA into VGAM1512 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1512 RNA is designated SEQ ID:4223, and is provided hereinbelow with reference to the sequence listing part.

VGAM1512 host target gene, herein designated VGAM HOST TARGET GENE, encodes a corresponding messenger RNA, VGAM1512 host target RNA, herein designated VGAM HOST TARGET RNA. VGAM1512 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1512 RNA, herein designated VGAM RNA, binds complementarily to one or more host target binding sites located in untranslated regions of VGAM1512 host target RNA, herein designated VGAM HOST TARGET RNA. This complementary binding is due to the fact that the nucleotide sequence of VGAM1512 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1512 RNA, herein designated VGAM RNA, may have a different number of host target binding sites in untranslated regions of a VGAM1512 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1512 RNA, herein designated VGAM RNA, to host target binding sites on VGAM1512 host target RNA, herein designated VGAM HOST TARGET RNA, such as BINDING SITE I, BINDING SITE II and BINDING SITE III, inhibits translation of VGAM1512 host target RNA into VGAM1512 host target protein, herein designated VGAM HOST TARGET PROTEIN. VGAM host target protein is therefore outlined by a broken line.

It is appreciated that VGAM1512 host target gene, herein designated VGAM HOST TARGET GENE, in fact represents a plurality of VGAM1512 host target genes. The mRNA of each one of this plurality of VGAM1512 host target genes comprises one or more host target binding sites, each having a nucleotide sequence which is at least partly complementary to VGAM1512 RNA, herein designated VGAM RNA, and which when bound by VGAM1512 RNA causes inhibition of translation of respective one or more VGAM1512 host target proteins.

It is further appreciated by one skilled in the art that the mode of translational inhibition illustrated by FIG. 1 with specific reference to translational inhibition exerted by VGAM1512 gene, herein designated VGAM GENE, on one or more VGAM1512 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1512 is inhibition of expression of host target genes, as part of a novel viral mechanism of attacking a host. Accordingly, utilities of VGAM1512 include diagnosis, prevention and treatment of viral infection by Parsnip Yellow Fleck Virus. Specific functions, and accordingly utilities, of VGAM1512 correlate with, and may be deduced from, the identity of the host target genes which VGAM1512 binds and inhibits, and the function of these host target genes, as elaborated hereinbelow.

Nucleotide sequences of the VGAM1512 precursor RNA, herein designated VGAM PRECURSOR RNA, and of the 'diced' VGAM1512 RNA, herein designated VGAM RNA, and a schematic representation of the secondary folding of VGAM1512 folded precursor RNA, herein designated VGAM FOLDED PRECURSOR RNA, of VGAM1512 are further described hereinbelow with reference to Table 1.

Nucleotide sequences of host target binding sites, such as BINDING SITE-I, BINDING SITE-II and BINDING SITE-III of FIG. 1, found on VGAM1512 host target RNA, and schematic representation of the complementarity of each of these host target binding sites to VGAM1512 RNA, herein designated VGAM RNA, are described hereinbelow with reference to Table 2.

As mentioned hereinabove with reference to FIG. 1, a function of VGAM1512 gene, herein designated VGAM is inhibition of expression of VGAM1512 target genes. It is appreciated that specific functions, and accordingly utilities, of VGAM1512 correlate with, and may be deduced from, the identity of the target genes which VGAM1512 binds and inhibits, and the function of these target genes, as elaborated hereinbelow.

Dual-specificity tyrosine-(Y)-phosphorylation Regulated Kinase 1A (DYRK1A, Accession NM_130436) is a VGAM1512 host target gene. DYRK1A BINDING SITE is HOST TARGET binding site found in the 5' untranslated region of mRNA encoded by DYRK1A, corresponding to a HOST TARGET binding site such as BINDING SITE I, BINDING SITE II or BINDING SITE III. Table 2 illustrates the complementarity of the nucleotide sequences of DYRK1A BINDING SITE, designated SEQ ID:28184, to the nucleotide sequence of VGAM1512 RNA, herein designated VGAM RNA, also designated SEQ ID:4223.

A function of VGAM1512 is therefore inhibition of Dual-specificity tyrosine-(Y)-phosphorylation Regulated Kinase 1A (DYRK1A, Accession NM_130436), a gene which regulates cell proliferation and may be involved in brain development. Accordingly, utilities of VGAM1512 include diagnosis, prevention and treatment of diseases and clinical conditions associated with DYRK1A. The function of DYRK1A and its association with various diseases and clinical conditions, has been established by previous studies, as described hereinabove with reference to VGAM42. Leucine Zipper Transcription Factor-like 1 (LZTFL1, Accession NM_020347) is another VGAM1512 host target gene. LZTFL1 BINDING SITE is HOST TARGET binding site found in the 3' untranslated region of mRNA encoded by LZTFL1, corresponding to a HOST TARGET binding site such as BINDING SITE I, BINDING SITE II or BINDING SITE III. Table 2 illustrates the complementarity of the nucleotide sequences of LZTFL1 BINDING SITE, designated SEQ ID:21600, to the nucleotide sequence of VGAM1512 RNA, herein designated VGAM RNA, also designated SEQ ID:4223.

Another function of VGAM1512 is therefore inhibition of Leucine Zipper Transcription Factor-like 1 (LZTFL1, Accession NM_020347). Accordingly, utilities of VGAM1512 include diagnosis, prevention and treatment of diseases and clinical conditions associated with LZTFL1. Syndecan 4 (amphiglycan, ryudocan) (SDC4, Accession NM_002999) is another VGAM1512 host target gene. SDC4 BINDING SITE is HOST TARGET binding site found in the 3' untranslated region of mRNA encoded by SDC4, corresponding to a HOST TARGET binding site such as BINDING SITE I, BINDING SITE II or BINDING SITE III. Table 2 illustrates the complementarity of the nucleotide sequences of SDC4 BINDING SITE, designated SEQ ID:8889, to the nucleotide sequence of VGAM1512 RNA, herein designated VGAM RNA, also designated SEQ ID:4223.

Another function of VGAM1512 is therefore inhibition of Syndecan 4 (amphiglycan, ryudocan) (SDC4, Accession NM_002999), a gene which is a cell surface proteoglycan. Accordingly, utilities of VGAM1512 include diagnosis, prevention and treatment of diseases and clinical conditions associated with SDC4. The function of SDC4 and its association with various diseases and clinical conditions, has been established by previous studies, as described hereinabove with reference to VGAM552. Serum Deprivation Response (phosphatidylserine binding protein) (SDPR, Accession NM_004657) is another VGAM1512 host target gene. SDPR BINDING SITE is HOST TARGET binding site found in the 3' untranslated region of mRNA encoded by SDPR, corresponding to a HOST TARGET binding site such as BINDING SITE I, BINDING SITE II or BINDING SITE III. Table 2 illustrates the complementarity of the nucleotide sequences of SDPR BINDING SITE, designated SEQ ID:11024, to the nucleotide sequence of VGAM1512 RNA, herein designated VGAM RNA, also designated SEQ ID:4223.

Another function of VGAM1512 is therefore inhibition of Serum Deprivation Response (phosphatidylserine binding protein) (SDPR, Accession NM_004657), a gene which substrate for protein_kinase_C ( assists in localizing PKC to invaginations of the plasma membrane. Accordingly, utilities of VGAM1512 include diagnosis, prevention and treatment of diseases and clinical conditions associated with SDPR. The function of SDPR has been established by previous studies. Gustincich et al. (1999) cloned SDPR from a human liver cDNA library using the murine homolog cloned by Gustincich and Schneider (1993) as probe. The SDPR cDNA encodes a deduced 425-amino acid peptide with a calculated molecular mass of 47.2 kD. The human and mouse proteins share 84% sequence identity; both contain a leucine zipper-like domain with 7 repeats and 2 putative protein kinase C phosphorylation sites. Northern blot analysis of various human tissues showed nearly ubiquitous expression of a 3.1-kb transcript, which was always coexpressed with a shorter transcript. Highest expression was detected in heart and lung. Gustincich et al. (1999) also found that SDPR mRNA was detectable in asynchronously growing human fibroblast cells and was significantly upregulated after serum deprivation but not after density-dependent growth inhibition. Gustincich et al. (1999) determined that SDPR is the same as PS-p68, a phosphatidylserine-binding protein purified from human platelets by Burgener et al. (1990). SDPR localizes to the cytoplasm (Burgener et al., 1990; Gustincich et al., 1999). Using in vitro translation of histidine-tagged recombinant SDPR, Gustincich et al. (1999) found that SDPR is able to bind PS liposomes in a calcium-independent manner. Burgener et al. (1990) identified SDPR as the major PS-binding protein in platelets. They also found that SDPR was able to bind PKC in a cell-free assay in the presence of PS and calcium, resulting in SDPR phosphorylation.

Full details of the abovementioned studies are described in the following publications, the disclosure of which are hereby incorporated by reference:

Burgener, R.; Wolf, M.; Ganz, T.; Baggiolini, M.: Purification and characterization of a major phosphatidylserine-binding phosphoprotein from human platelets. Biochem. J. 269:729-734, 1990; and Gustincich, S.; Vatta, P.; Goruppi, S.; Wolf, M.; Saccone, S.; Della Valle, G.; Baggiolini, M.; Schneider, C.: The human serum deprivation response gene (SDPR) maps to 2q32-q33 and cod.

Further studies establishing the function and utilities of SDPR are found in John Hopkins OMIM database record ID 606728, and in sited publications numbered 742-744 listed in the bibliography section hereinbelow, which are also hereby incorporated by reference. Calpain 6 (CAPN6, Accession NM_014289) is another VGAM1512 host target gene. CAPN6 BINDING SITE is HOST TARGET binding site found in the 3' untranslated region of mRNA encoded by CAPN6, corresponding to a HOST TARGET binding site such as BINDING SITE I, BINDING SITE II or BINDING SITE III. Table 2 illustrates the complementarity of the nucleotide sequences of CAPN6 BINDING SITE, designated SEQ ID:15568, to the nucleotide sequence of VGAM1512 RNA, herein designated VGAM RNA, also designated SEQ ID:4223.

Another function of VGAM1512 is therefore inhibition of Calpain 6 (CAPN6, Accession NM_014289). Accordingly, utilities of VGAM1512 include diagnosis, prevention and treatment of diseases and clinical conditions associated with CAPN6. HERV-H LTR-associating 2 (HHLA2, Accession NM_007072) is another VGAM1512 host target gene. HHLA2 BINDING SITE is HOST TARGET binding site found in the 3' untranslated region of mRNA encoded by HHLA2, corresponding to a HOST TARGET binding site such as BINDING SITE I, BINDING SITE II or BINDING SITE III. Table 2 illustrates the complementarity of the nucleotide sequences of HHLA2 BINDING SITE, designated SEQ ID:13935, to the nucleotide sequence of VGAM1512 RNA, herein designated VGAM RNA, also designated SEQ ID:4223.

Another function of VGAM1512 is therefore inhibition of HERV-H LTR-associating 2 (HHLA2, Accession NM_007072). Accordingly, utilities of VGAM1512 include diagnosis, prevention and treatment of diseases and clinical conditions associated with HHLA2. Integrin, Alpha 10 (ITGA10, Accession XM_002097) is another VGAM1512 host target gene. ITGA10 BINDING SITE is HOST TARGET binding site found in the 3' untranslated region of mRNA encoded by ITGA10, corresponding to a HOST TARGET binding site such as BINDING SITE I, BINDING SITE II or BINDING SITE III. Table 2 illustrates the complementarity of the nucleotide sequences of ITGA10 BINDING SITE, designated SEQ ID:29863, to the nucleotide sequence of VGAM1512 RNA, herein designated VGAM RNA, also designated SEQ ID:4223.

Another function of VGAM1512 is therefore inhibition of Integrin, Alpha 10 (ITGA10, Accession XM_002097). Accordingly, utilities of VGAM1512 include diagnosis, prevention and treatment of diseases and clinical conditions associated with ITGA10. SIMRP7 (Accession XM_166462)

is another VGAM1512 host target gene. SIMRP7 BINDING SITE is HOST TARGET binding site found in the 3' untranslated region of mRNA encoded by SIMRP7, corresponding to a HOST TARGET binding site such as BINDING SITE I, BINDING SITE II or BINDING SITE III. Table 2 illustrates the complementarity of the nucleotide sequences of SIMRP7 BINDING SITE, designated SEQ ID:44370, to the nucleotide sequence of VGAM1512 RNA, herein designated VGAM RNA, also designated SEQ ID:4223.

Another function of VGAM1512 is therefore inhibition of SIMRP7 (Accession XM_166462). Accordingly, utilities of VGAM1512 include diagnosis, prevention and treatment of diseases and clinical conditions associated with SIMRP7. LOC145497 (Accession XM_085150) is another VGAM1512 host target gene. LOC145497 BINDING SITE is HOST TARGET binding site found in the 5' untranslated region of mRNA encoded by LOC145497, corresponding to a HOST TARGET binding site such as BINDING SITE I, BINDING SITE II or BINDING SITE III. Table 2 illustrates the complementarity of the nucleotide sequences of LOC145497 BINDING SITE, designated SEQ ID:37873, to the nucleotide sequence of VGAM1512 RNA, herein designated VGAM RNA, also designated SEQ ID:4223.

Another function of VGAM1512 is therefore inhibition of LOC145497 (Accession XM_085150). Accordingly, utilities of VGAM1512 include diagnosis, prevention and treatment of diseases and clinical conditions associated with LOC145497. LOC153469 (Accession XM_087681) is another VGAM1512 host target gene. LOC153469 BINDING SITE is HOST TARGET binding site found in the 3' untranslated region of mRNA encoded by LOC153469, corresponding to a HOST TARGET binding site such as BINDING SITE I, BINDING SITE II or BINDING SITE III. Table 2 illustrates the complementarity of the nucleotide sequences of LOC153469 BINDING SITE, designated SEQ ID:39378, to the nucleotide sequence of VGAM1512 RNA, herein designated VGAM RNA, also designated SEQ ID:4223.

Another function of VGAM1512 is therefore inhibition of LOC153469 (Accession XM_087681). Accordingly, utilities of VGAM1512 include diagnosis, prevention and treatment of diseases and clinical conditions associated with LOC153469. LOC220766 (Accession XM_165471) is another VGAM1512 host target gene. LOC220766 BINDING SITE is HOST TARGET binding site found in the 5' untranslated region of mRNA encoded by LOC220766, corresponding to a HOST TARGET binding site such as BINDING SITE I, BINDING SITE II or BINDING SITE III. Table 2 illustrates the complementarity of the nucleotide sequences of LOC220766 BINDING SITE, designated SEQ ID:43654, to the nucleotide sequence of VGAM1512 RNA, herein designated VGAM RNA, also designated SEQ ID:4223.

Another function of VGAM1512 is therefore inhibition of LOC220766 (Accession XM_165471). Accordingly, utilities of VGAM1512 include diagnosis, prevention and treatment of diseases and clinical conditions associated with LOC220766. LOC221431 (Accession XM_166380) is another VGAM1512 host target gene. LOC221431 BINDING SITE is HOST TARGET binding site found in the 3' untranslated region of mRNA encoded by LOC221431, corresponding to a HOST TARGET binding site such as BINDING SITE I, BINDING SITE II or BINDING SITE III. Table 2 illustrates the complementarity of the nucleotide sequences of LOC221431 BINDING SITE, designated SEQ ID:44222, to the nucleotide sequence of VGAM1512 RNA, herein designated VGAM RNA, also designated SEQ ID:4223.

Another function of VGAM1512 is therefore inhibition of LOC221431 (Accession XM_166380). Accordingly, utilities of VGAM1512 include diagnosis, prevention and treatment of diseases and clinical conditions associated with LOC221431. LOC222787 (Accession XM_169879) is another VGAM1512 host target gene. LOC222787 BINDING SITE is HOST TARGET binding site found in the 5' untranslated region of mRNA encoded by LOC222787, corresponding to a HOST TARGET binding site such as BINDING SITE I, BINDING SITE II or BINDING SITE III. Table 2 illustrates the complementarity of the nucleotide sequences of LOC222787 BINDING SITE, designated SEQ ID:45304, to the nucleotide sequence of VGAM1512 RNA, herein designated VGAM RNA, also designated SEQ ID:4223.

Another function of VGAM1512 is therefore inhibition of LOC222787 (Accession XM_169879). Accordingly, utilities of VGAM1512 include diagnosis, prevention and treatment of diseases and clinical conditions associated with LOC222787. LOC257396 (Accession XM_173148) is another VGAM1512 host target gene. LOC257396 BINDING SITE is HOST TARGET binding site found in the 5' untranslated region of mRNA encoded by LOC257396, corresponding to a HOST TARGET binding site such as BINDING SITE I, BINDING SITE II or BINDING SITE III. Table 2 illustrates the complementarity of the nucleotide sequences of LOC257396 BINDING SITE, designated SEQ ID:46406, to the nucleotide sequence of VGAM1512 RNA, herein designated VGAM RNA, also designated SEQ ID:4223.

Another function of VGAM1512 is therefore inhibition of LOC257396 (Accession XM_173148). Accordingly, utilities of VGAM1512 include diagnosis, prevention and treatment of diseases and clinical conditions associated with LOC257396. FIG. 1 further provides a conceptual description of a novel bioinformatically detected viral gene of the present invention, referred to here as Viral Genomic Address Messenger 1513 (VGAM1513) viral gene, which modulates expression of respective host target genes thereof, the function and utility of which host target genes is known in the art.

VGAM1513 is a novel bioinformatically detected regulatory, non protein coding, viral micro RNA (miRNA) gene. The method by which VGAM1513 was detected is described hereinabove with reference to FIGS. 1-8.

VGAM1513 gene, herein designated VGAM GENE, is a viral gene contained in the genome of Parsnip Yellow Fleck Virus. VGAM1513 host target gene, herein designated VGAM HOST TARGET GENE, is a human gene contained in the human genome.

VGAM1513 gene encodes a VGAM1513 precursor RNA, herein designated VGAM PRECURSOR RNA. Similar to other miRNA genes, and unlike most ordinary genes, VGAM1513 precursor RNA does not encode a protein. A nucleotide sequence identical or highly similar to the nucleotide sequence of VGAM1513 precursor RNA is designated SEQ ID:1499, and is provided hereinbelow with reference to the sequence listing part. Nucleotide sequence SEQ ID:1499 is located at position 3 relative to the genome of Parsnip Yellow Fleck Virus.

VGAM1513 precursor RNA folds onto itself, forming VGAM1513 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1513 folded precursor RNA into VGAM1513 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM1513 RNA is designated SEQ ID:4224, and is provided hereinbelow with reference to the sequence listing part.

VGAM1513 host target gene, herein designated VGAM HOST TARGET GENE, encodes a corresponding messenger RNA, VGAM1513 host target RNA, herein designated VGAM HOST TARGET RNA. VGAM1513 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1513 RNA, herein designated VGAM RNA, binds complementarily to one or more host target binding sites located in untranslated regions of VGAM1513 host target RNA, herein designated VGAM HOST TARGET RNA. This complementary binding is due to the fact that the nucleotide sequence of VGAM1513 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1513 RNA, herein designated VGAM RNA, may have a different number of host target binding sites in untranslated regions of a VGAM1513 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1513 RNA, herein designated VGAM RNA, to host target binding sites on VGAM1513 host target RNA, herein designated VGAM HOST TARGET RNA, such as BINDING SITE I, BINDING SITE II and BINDING SITE III, inhibits translation of VGAM1513 host target RNA into VGAM1513 host target protein, herein designated VGAM HOST TARGET PROTEIN. VGAM host target protein is therefore outlined by a broken line.

It is appreciated that VGAM1513 host target gene, herein designated VGAM HOST TARGET GENE, in fact represents a plurality of VGAM1513 host target genes. The mRNA of each one of this plurality of VGAM1513 host target genes comprises one or more host target binding sites, each having a nucleotide sequence which is at least partly complementary to VGAM1513 RNA, herein designated VGAM RNA, and which when bound by VGAM1513 RNA causes inhibition of translation of respective one or more VGAM1513 host target proteins.

It is further appreciated by one skilled in the art that the mode of translational inhibition illustrated by FIG. 1 with specific reference to translational inhibition exerted by VGAM1513 gene, herein designated VGAM GENE, on one or more VGAM1513 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1513 is inhibition of expression of host target genes, as part of a novel viral mechanism of attacking a host. Accordingly, utilities of VGAM1513 include diagnosis, prevention and treatment of viral infection by Parsnip Yellow Fleck Virus. Specific functions, and accordingly utilities, of VGAM1513 correlate with, and may be deduced from, the identity of the host target genes which VGAM1513 binds and inhibits, and the function of these host target genes, as elaborated hereinbelow.

Nucleotide sequences of the VGAM1513 precursor RNA, herein designated VGAM PRECURSOR RNA, and of the 'diced' VGAM1513 RNA, herein designated VGAM RNA, and a schematic representation of the secondary folding of VGAM1513 folded precursor RNA, herein designated VGAM FOLDED PRECURSOR RNA, of VGAM1513 are further described hereinbelow with reference to Table 1.

Nucleotide sequences of host target binding sites, such as BINDING SITE-I, BINDING SITE-II and BINDING SITE-III of FIG. 1, found on VGAM1513 host target RNA, and schematic representation of the complementarity of each of these host target binding sites to VGAM1513 RNA, herein designated VGAM RNA, are described hereinbelow with reference to Table 2.

As mentioned hereinabove with reference to FIG. 1, a function of VGAM1513 gene, herein designated VGAM is inhibition of expression of VGAM1513 target genes. It is appreciated that specific functions, and accordingly utilities, of VGAM1513 correlate with, and may be deduced from, the identity of the target genes which VGAM1513 binds and inhibits, and the function of these target genes, as elaborated hereinbelow.

UDP-Gal:betaGlcNAc Beta 1,3-galactosyltransferase, Polypeptide 2 (B3GALT2, Accession NM_003783) is a VGAM1513 host target gene. B3GALT2 BINDING SITE is HOST TARGET binding site found in the 5' untranslated region of mRNA encoded by B3GALT2, corresponding to a HOST TARGET binding site such as BINDING SITE I, BINDING SITE II or BINDING SITE III. Table 2 illustrates the complementarity of the nucleotide sequences of B3GALT2 BINDING SITE, designated SEQ ID:9868, to the nucleotide sequence of VGAM1513 RNA, herein designated VGAM RNA, also designated SEQ ID:4224.

A function of VGAM1513 is therefore inhibition of UDP-Gal:betaGlcNAc Beta 1,3-galactosyltransferase, Polypeptide 2 (B3GALT2, Accession NM_003783). Accordingly, utilities of VGAM1513 include diagnosis, prevention and treatment of diseases and clinical conditions associated with B3GALT2. DXS1283E (Accession XM_047871) is another VGAM1513 host target gene. DXS1283E BINDING SITE is HOST TARGET binding site found in the 3' untranslated region of mRNA encoded by DXS1283E, corresponding to a HOST TARGET binding site such as BINDING SITE I, BINDING SITE II or BINDING SITE III. Table 2 illustrates the complementarity of the nucleotide sequences of DXS1283E BINDING SITE, designated SEQ ID:35059, to the nucleotide sequence of VGAM1513 RNA, herein designated VGAM RNA, also designated SEQ ID:4224.

Another function of VGAM1513 is therefore inhibition of DXS1283E (Accession XM_047871). Accordingly, utilities of VGAM1513 include diagnosis, prevention and treatment of diseases and clinical conditions associated with DXS1283E. DKFZp434N074 (Accession XM_031481) is another VGAM1513 host target gene. DKFZp434N074 BINDING SITE is HOST TARGET binding site found in the 5' untranslated region of mRNA encoded by DKFZp434N074, corresponding to a HOST TARGET binding site such as BINDING SITE I, BINDING SITE II or BINDING SITE III. Table 2 illustrates the complementarity of the nucleotide sequences of DKFZp434N074 BINDING SITE, designated SEQ ID:31388, to the nucleotide sequence of VGAM1513 RNA, herein designated VGAM RNA, also designated SEQ ID:4224.

Another function of VGAM1513 is therefore inhibition of DKFZp434N074 (Accession XM_031481). Accordingly, utilities of VGAM1513 include diagnosis, prevention and treatment of diseases and clinical conditions associated with DKFZp434N074. FLJ10759 (Accession NM_018207) is another VGAM1513 host target gene. FLJ10759 BINDING SITE is HOST TARGET binding site found in the 3' untranslated region of mRNA encoded by FLJ10759, corresponding to a HOST TARGET binding site such as BINDING SITE I, BINDING SITE II or BINDING SITE III. Table 2 illustrates the complementarity of the nucleotide sequences of FLJ10759 BINDING SITE, designated SEQ ID:20098, to the nucleotide sequence of VGAM1513 RNA, herein designated VGAM RNA, also designated SEQ ID:4224.

Another function of VGAM1513 is therefore inhibition of FLJ10759 (Accession NM_018207). Accordingly, utilities of VGAM1513 include diagnosis, prevention and treatment of diseases and clinical conditions associated with FLJ10759. LOC153561 (Accession XM_087708) is another VGAM1513 host target gene. LOC153561 BINDING SITE is HOST TARGET binding site found in the 3' untranslated region of mRNA encoded by LOC153561, corresponding to a HOST TARGET binding site such as BINDING SITE I, BINDING SITE II or BINDING SITE III. Table 2 illustrates the complementarity of the nucleotide sequences of LOC153561 BINDING SITE, designated SEQ ID:39400, to the nucleotide sequence of VGAM1513 RNA, herein designated VGAM RNA, also designated SEQ ID:4224.

Another function of VGAM1513 is therefore inhibition of LOC153561 (Accession XM_087708). Accordingly, utilities of VGAM1513 include diagnosis, prevention and treatment of diseases and clinical conditions associated with LOC153561. FIG. 1 further provides a conceptual description of a novel bioinformatically detected viral gene of the present invention, referred to here as Viral Genomic Address Messenger 1514 (VGAM1514) viral gene, which modulates expression of respective host target genes thereof, the function and utility of which host target genes is known in the art.

VGAM1514 is a novel bioinformatically detected regulatory, non protein coding, viral micro RNA (miRNA) gene. The method by which VGAM1514 was detected is described hereinabove with reference to FIGS. 1-8.

VGAM1514 gene, herein designated VGAM GENE, is a viral gene contained in the genome of Parsnip Yellow Fleck Virus. VGAM1514 host target gene, herein designated VGAM HOST TARGET GENE, is a human gene contained in the human genome.

VGAM1514 gene encodes a VGAM1514 precursor RNA, herein designated VGAM PRECURSOR RNA. Similar to other miRNA genes, and unlike most ordinary genes, VGAM1514 precursor RNA does not encode a protein. A nucleotide sequence identical or highly similar to the nucleotide sequence of VGAM1514 precursor RNA is designated SEQ ID:1500, and is provided hereinbelow with reference to the sequence listing part. Nucleotide sequence SEQ ID:1500 is located at position 9392 relative to the genome of Parsnip Yellow Fleck Virus.

VGAM1514 precursor RNA folds onto itself, forming VGAM1514 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1514 folded precursor RNA into VGAM1514 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 51%) nucleotide sequence of VGAM1514 RNA is designated SEQ ID:4225, and is provided hereinbelow with reference to the sequence listing part.

VGAM1514 host target gene, herein designated VGAM HOST TARGET GENE, encodes a corresponding messenger RNA, VGAM1514 host target RNA, herein designated VGAM HOST TARGET RNA. VGAM1514 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1514 RNA, herein designated VGAM RNA, binds complementarily to one or more host target binding sites located in untranslated regions of VGAM1514 host target RNA, herein designated VGAM HOST TARGET RNA. This complementary binding is due to the fact that the nucleotide sequence of VGAM1514 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1514 RNA, herein designated VGAM RNA, may have a different number of host target binding sites in untranslated regions of a VGAM1514 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1514 RNA, herein designated VGAM RNA, to host target binding sites on VGAM1514 host target RNA, herein designated VGAM HOST TARGET RNA, such as BINDING SITE I, BINDING SITE II and BINDING SITE III, inhibits translation of VGAM1514 host target RNA into VGAM1514 host target protein, herein designated VGAM HOST TARGET PROTEIN. VGAM host target protein is therefore outlined by a broken line.

It is appreciated that VGAM1514 host target gene, herein designated VGAM HOST TARGET GENE, in fact represents a plurality of VGAM1514 host target genes. The mRNA of each one of this plurality of VGAM1514 host target genes comprises one or more host target binding sites, each having a nucleotide sequence which is at least partly complementary to VGAM1514 RNA, herein designated VGAM RNA, and which when bound by VGAM1514 RNA causes inhibition of translation of respective one or more VGAM1514 host target proteins.

It is further appreciated by one skilled in the art that the mode of translational inhibition illustrated by FIG. 1 with specific reference to translational inhibition exerted by VGAM1514 gene, herein designated VGAM GENE, on one or more VGAM1514 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1514 is inhibition of expression of host target genes, as part of a novel viral mechanism of attacking a host. Accordingly, utilities of VGAM1514 include diagnosis, prevention and treatment of viral infection by Parsnip Yellow Fleck Virus. Specific functions, and accordingly utilities, of VGAM1514 correlate with, and may be deduced from, the identity of the host target genes which VGAM1514 binds and inhibits, and the function of these host target genes, as elaborated hereinbelow.

Nucleotide sequences of the VGAM1514 precursor RNA, herein designated VGAM PRECURSOR RNA, and of the 'diced' VGAM1514 RNA, herein designated VGAM RNA, and a schematic representation of the secondary folding of VGAM1514 folded precursor RNA, herein designated VGAM FOLDED PRECURSOR RNA, of VGAM1514 are further described hereinbelow with reference to Table 1.

Nucleotide sequences of host target binding sites, such as BINDING SITE-I, BINDING SITE-II and BINDING SITE-III of FIG. 1, found on VGAM1514 host target RNA, and schematic representation of the complementarity of each of these host target binding sites to VGAM1514 RNA, herein designated VGAM RNA, are described hereinbelow with reference to Table 2.

As mentioned hereinabove with reference to FIG. 1, a function of VGAM1514 gene, herein designated VGAM is inhibition of expression of VGAM1514 target genes. It is appreciated that specific functions, and accordingly utilities, of VGAM1514 correlate with, and may be deduced from, the identity of the target genes which VGAM1514 binds and inhibits, and the function of these target genes, as elaborated hereinbelow.

Basonuclin (BNC, Accession NM_001717) is a VGAM1514 host target gene. BNC BINDING SITE is HOST TARGET binding site found in the 3' untranslated region of mRNA encoded by BNC, corresponding to a HOST TARGET binding site such as BINDING SITE I, BINDING SITE II or BINDING SITE III. Table 2 illustrates the complementarity of the nucleotide sequences of BNC BINDING SITE, designated SEQ ID:7450, to the nucleotide sequence of VGAM1514 RNA, herein designated VGAM RNA, also designated SEQ ID:4225.

A function of VGAM1514 is therefore inhibition of Basonuclin (BNC, Accession NM_001717), a gene which plays a role in the maintenance of proliferative capacity and prevention of terminal differentiation of keratinocytes. Accordingly, utilities of VGAM1514 include diagnosis, prevention and treatment of diseases and clinical conditions associated with BNC. The function of BNC has been established by previous studies. Basonuclin (BNC) is a protein found mainly in cells of the basal layer of stratified squamous epithelia. Tseng and Green (1992) isolated a cDNA encoding this protein from mRNA of cultural human keratinocytes. The basonuclin cDNA encodes a 993-amino acid polypeptide that is located in the nucleus and contains 6 zinc finger motifs of the C2H2 class, as in known transcription factors. Basonuclin is expressed in cells that are able to undergo division but are not necessarily in the division cycle; the protein is not found in terminally differentiated cells (Tseng and Green, 1994). These properties suggested that basonuclin performs a transcriptional regulatory function related to promotion of keratinocyte growth or suppression of keratinocyte differentiation. Teumer et al. (1997) cloned and sequenced the basonuclin gene from a human genomic library. By analysis of human/rodent hybrid cells, they mapped it to chromosome 15. The transcription unit spans nearly 29 kb of sequence. The coding region is distributed over 5 exons and the 3 pairs of zinc fingers encoded by the last 2 exons. The 5-prime flanking sequence and first exon are unusually rich in GC content and in CpG dinucleotides. This sequence region contains numerous binding sites for the transcription factor Sp1 (OMIM Ref. No. 189906).

Full details of the abovementioned studies are described in the following publications, the disclosure of which are hereby incorporated by reference:

Tseng, H.; Green, H.: Basonuclin: a keratinocyte protein with multiple paired zinc fingers. Proc. Nat. Acad. Sci. 89:10311-10315, 1992; and Tseng, H.; Green, H.: Association of basonuclin with ability of keratinocytes to multiply and with absence of terminal differentiation. J. Cell Biol. 126:495-506, 1994.

Further studies establishing the function and utilities of BNC are found in John Hopkins OMIM database record ID 601930, and in sited publications numbered 6253-6255 listed in the bibliography section hereinbelow, which are also hereby incorporated by reference. Necdin Homolog (mouse) (NDN, Accession NM_002487) is another VGAM1514 host target gene. NDN BINDING SITE is HOST TARGET binding site found in the 3' untranslated region of mRNA encoded by NDN, corresponding to a HOST TARGET binding site such as BINDING SITE I, BINDING SITE II or BINDING SITE III. Table 2 illustrates the complementarity of the nucleotide sequences of NDN BINDING SITE, designated SEQ ID:8312, to the nucleotide sequence of VGAM1514 RNA, herein designated VGAM RNA, also designated SEQ ID:4225.

Another function of VGAM1514 is therefore inhibition of Necdin Homolog (mouse) (NDN, Accession NM_002487), a gene which facilitates the entry of the cell into cell cycle arrest. Accordingly, utilities of VGAM1514 include diagnosis, prevention and treatment of diseases and clinical conditions associated with NDN. The function of NDN has been established by previous studies. Reasoning that additional imprinted genes may lie within the Prader-Willi syndrome (PWS; 176270) deletion interval 15q11-q13, MacDonald and Wevrick (1997) searched for transcribed sequences in the region between the 2 imprinted genes ZNF127 (MKRN3; 603856) and SNRPN (OMIM Ref. No. 182279). An expressed sequence tag (EST) showed 99% sequence identity to the 3-prime end of a GenBank sequence (OMIM Ref. No. U35139), defined as 'a human necdin-related protein mRNA.' They concluded that the putative necdin-encoding gene is a single locus in proximal 15q, as determined by radiation hybrid mapping, localization of the appropriate PCR-amplified fragments to overlapping YACs, and absence in other YACs from the PWS deletion region. Mouse necdin (gene locus Ndn) was originally identified by Maruyama et al. (1991) as a protein encoded by a neural differentiation-specific mRNA, derived from embryonal carcinoma cells. The necdin protein is localized to the nuclei of postmitotic neurons and is expressed in almost all postmitotic neurons in the CNS from the beginning of neural differentiation and into adult life. The Ndn locus is present as a single exon in the mouse genome and was mapped to mouse chromosome 7 in a region of conserved synteny with human 15q11-q13 by MacDonald and Wevrick (1997) using genetic mapping in an interspecific backcross panel. They demonstrated, furthermore, that expression of the Ndn mouse gene and the NDN human gene is limited to the paternal allele, with highest levels of expression in brain and placenta. Consistent with the observation that imprinted genes have few and small introns (Hurst et al., 1996), human NDN is contained within a single exon, like its mouse ortholog. They suggested that loss of necdin gene expression may contribute to the disorder of brain development in individuals with PWS. Jay et al. (1997) likewise cloned a human cDNA with close similarities to the mouse necdin gene. They mapped the NDN gene to 15q11-q13 by fluorescence in situ hybridization (FISH), and confirmed the location by PCR analysis of DNA extracted from a panel of hamster/human somatic cell hybrids. Both approaches suggested that the NDN gene maps to 15q11-q13 but that a homologous gene or pseudogene maps to 12q21. Jay et al. (1997) also mapped NDN by hybridization to a YAC contig covering the PWS critical region. They suggested that NDN is located approximately 100 kb distal to ZNF127 and 1 to 1.5 Mb proximal to SNRPN. NDN displayed several characteristics of an imprinted locus, including allelic DNA methylation and an asynchronous DNA replication. Jay et al. (1997) found a complete lack of NDN expression in PWS brain and fibroblasts, indicating that the gene is expressed exclusively from the paternal allele in these tissues and suggesting a possible role of this gene in PWS.

Full details of the abovementioned studies are described in the following publications, the disclosure of which are hereby incorporated by reference:

Hurst, L. D.; McVean, G.; Moore, T.: Imprinted genes have few and small introns. (Letter) Nature Genet. 12:234-237, 1996; and Jay, P.; Rougeulle, C.; Massacrier, A.; Moncla, A.; Mattei, M.-G.; Malzac, P.; Roeckel, N.; Taviaux, S.; Lefranc, J.-L. B.; Cau, P.; Berta, P.; Lalande, M.; Muscatelli, F.: The human n.

Further studies establishing the function and utilities of NDN are found in John Hopkins OMIM database record ID 602117, and in sited publications numbered 8921-8930 listed in the bibliography section hereinbelow, which are also hereby incorporated by reference. Oligodendrocyte Lineage Transcription Factor 2 (OLIG2, Accession NM_005806) is another VGAM1514 host target gene. OLIG2 BINDING SITE is HOST TARGET binding site found in the 3' untranslated region of mRNA encoded by OLIG2, corresponding to a HOST TARGET binding site such as BINDING SITE I, BINDING SITE II or BINDING SITE III. Table 2 illustrates the complementarity of the nucleotide sequences of OLIG2 BINDING SITE, designated SEQ ID:12382, to the nucleotide sequence of VGAM1514 RNA, herein designated VGAM RNA, also designated SEQ ID:4225.

Another function of VGAM1514 is therefore inhibition of Oligodendrocyte Lineage Transcription Factor 2 (OLIG2, Accession NM_005806), a gene which may bind DNA and contains a helix-loop-helix DNA-binding domain. Accordingly, utilities of VGAM1514 include diagnosis, prevention and treatment of diseases and clinical conditions associated with OLIG2. The function of OLIG2 has been established by previous studies. The oligodendrocyte lineage transcription factors OLIG1 (OMIM Ref. No. 606385) and OLIG2, originally identified in rodents, encode basic helix-loop-helix transcription factors. In the rodent central nervous system, they are expressed exclusively in oligodendrocytes and oligodendrocyte precursors (Lu et al., 2000; Zhou et al., 2000). Pursuing the suggestion that novel molecular markers might be found among factors that have roles in glial development (Raff et al., 1983), Lu et al. (2001) found that the human OLIG1/2 genes are expressed strongly in oligodendroglioma, contrasting absent or low expression in astrocytoma. Their study provided evidence that neoplastic cells of oligodendroglioma resemble oligodendrocytes or their progenitor cells and may derive from cells of this lineage. Animal model experiments lend further support to the function of OLIG2. In Olig1/2 double-mutant mice, Zhou and Anderson (2002) found that motoneurons were largely eliminated, and oligodendrocyte differentiation was abolished. Lineage tracing data suggested that Olig1/2 -/- pMN progenitors instead generated V2 interneurons and then astrocytes. This apparent conversion likely reflects independent roles for OLIG1/2 in specifying motoneuron and oligodendrocyte fates. OLIG genes therefore couple neuronal and glial subtype specification, unlike proneural bHLH factors that control the neuron versus glia decision. The authors concluded that, in the spinal cord, OLIG and proneural genes comprise a combinatorial code for the specification of neurons, astrocytes, and oligodendrocytes, the 3 fundamental cell types of the central nervous system.

It is appreciated that the abovementioned animal model for OLIG2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lu, Q. R.; Park, J. K.; Noll, E.; Chan, J. A.; Alberta, J.; Yuk, D.; Alzamora, M. G.; Louis, D. N.; Stiles, C. D.; Rowitch, D. H.; Black, P. M.: Oligodendrocyte lineage genes (OLIG) as molecular markers for human glial brain tumors. Proc. Nat. Acad. Sci. 98:10851-10856, 2001; and Zhou, Q.; Anderson, D. J.: The bHLH transcription factors OLIG2 and OLIG1 couple neuronal and glial subtype specification. Cell 109:61-73, 2002.

Further studies establishing the function and utilities of OLIG2 are found in John Hopkins OMIM database record ID 606386, and in sited publications numbered 647 and 6585-6589 listed in the bibliography section hereinbelow, which are also hereby incorporated by reference. RAS Guanyl Releasing Protein 1 (calcium and DAG-regulated) (RASGRP1, Accession NM_005739) is another VGAM1514 host target gene. RASGRP1 BINDING SITE is HOST TARGET binding site found in the 3' untranslated region of mRNA encoded by RASGRP1, corresponding to a HOST TARGET binding site such as BINDING SITE I, BINDING SITE II or BINDING SITE III. Table 2 illustrates the complementarity of the nucleotide sequences of RASGRP1 BINDING SITE, designated SEQ ID:12302, to the nucleotide sequence of VGAM1514 RNA, herein designated VGAM RNA, also designated SEQ ID:4225.

Another function of VGAM1514 is therefore inhibition of RAS Guanyl Releasing Protein 1 (calcium and DAG-regulated) (RASGRP1, Accession NM_005739). Accordingly, utilities of VGAM1514 include diagnosis, prevention and treatment of diseases and clinical conditions associated with RASGRP1. SNL (Accession NM_003088) is another VGAM1514 host target gene. SNL BINDING SITE is HOST TARGET binding site found in the 3' untranslated region of mRNA encoded by SNL, corresponding to a HOST TARGET binding site such as BINDING SITE I, BINDING SITE II or BINDING SITE III. Table 2 illustrates the complementarity of the nucleotide sequences of SNL BINDING SITE, designated SEQ ID:9064, to the nucleotide sequence of VGAM1514 RNA, herein designated VGAM RNA, also designated SEQ ID:4225.

Another function of VGAM1514 is therefore inhibition of SNL (Accession NM_003088), a gene which organizes filamentous actin into bundles with a minimum of 4.1:1 actin/fascin ratio. Accordingly, utilities of VGAM1514 include diagnosis, prevention and treatment of diseases and clinical conditions associated with SNL. The function of SNL and its association with various diseases and clinical conditions, has been established by previous studies, as described hereinabove with reference to VGAM675. Wingless-type MMTV Integration Site Family, Member 5A (WNT5A, Accession NM_003392) is another VGAM1514 host target gene. WNT5A BINDING SITE is HOST TARGET binding site found in the 5' untranslated region of mRNA encoded by WNT5A, corresponding to a HOST TARGET binding site such as BINDING SITE I, BINDING SITE II or BINDING SITE III. Table 2 illustrates the complementarity of the nucleotide sequences of WNT5A BINDING SITE, designated SEQ ID:9429, to the nucleotide sequence of VGAM1514 RNA, herein designated VGAM RNA, also designated SEQ ID:4225.

Another function of VGAM1514 is therefore inhibition of Wingless-type MMTV Integration Site Family, Member 5A (WNT5A, Accession NM_003392), a gene which is a ligand for members of the frizzled family of seven transmembrane receptors and is probablely a developmental protein. Accordingly, utilities of VGAM1514 include diagnosis, prevention and treatment of diseases and clinical conditions associated with WNT5A. The function of WNT5A and its association with various diseases and clinical conditions, has been established by previous studies, as described hereinabove with reference to VGAM996. Butyrophilin, Subfamily 2, Member A2 (BTN2A2, Accession NM_006995) is another VGAM1514 host target gene. BTN2A2 BINDING SITE is HOST TARGET binding site found in the 3' untranslated region of mRNA encoded by BTN2A2, corresponding to a HOST TARGET binding site such as BINDING SITE I, BINDING SITE II or BINDING SITE III. Table 2 illustrates the complementarity of the nucleotide sequences of BTN2A2 BINDING SITE, designated SEQ ID:13859, to the nucleotide sequence of VGAM1514 RNA, herein designated VGAM RNA, also designated SEQ ID:4225.

Another function of VGAM1514 is therefore inhibition of Butyrophilin, Subfamily 2, Member A2 (BTN2A2, Accession NM_006995). Accordingly, utilities of VGAM1514 include diagnosis, prevention and treatment of diseases and clinical conditions associated with BTN2A2. Chromosome 17 Open Reading Frame 1A (C17orf1A, Accession NM_006382) is another VGAM1514 host target gene. C17orf1A BINDING SITE is HOST TARGET binding site found in the 5' untranslated region of mRNA encoded by C17orf1A, corresponding to a HOST TARGET binding site such as BINDING SITE I, BINDING SITE II or BINDING SITE III. Table 2 illustrates the complementarity of the nucleotide sequences of C17orf1A BINDING SITE, designated SEQ ID:13086, to the nucleotide sequence of VGAM1514 RNA, herein designated VGAM RNA, also designated SEQ ID:4225.

Another function of VGAM1514 is therefore inhibition of Chromosome 17 Open Reading Frame 1A (C17orf1A, Accession NM_006382). Accordingly, utilities of VGAM1514 include diagnosis, prevention and treatment of diseases and clinical conditions associated with C17orf1A. Calcium-binding tyrosine-(Y)-phosphorylation Regulated (fibrousheathin 2) (CABYR, Accession NM_012189) is another VGAM1514 host target gene. CABYR BINDING SITE is HOST TARGET binding site found in the 3' untranslated region of mRNA encoded by CABYR, corresponding to a HOST TARGET binding site such as BINDING SITE I, BINDING SITE II or BINDING SITE III. Table 2 illustrates the complementarity of the nucleotide sequences of CABYR BINDING SITE, designated SEQ ID:14477, to the nucleotide sequence of VGAM1514 RNA, herein designated VGAM RNA, also designated SEQ ID:4225.

Another function of VGAM1514 is therefore inhibition of Calcium-binding tyrosine-(Y)-phosphorylation Regulated (fibrousheathin 2) (CABYR, Accession NM_012189). Accordingly, utilities of VGAM1514 include diagnosis, prevention and treatment of diseases and clinical conditions associated with CABYR. CD36L1 (Accession NM_005505) is another VGAM1514 host target gene. CD36L1 BINDING SITE is HOST TARGET binding site found in the 3' untranslated region of mRNA encoded by CD36L1, corresponding to a HOST TARGET binding site such as BINDING SITE I, BINDING SITE II or BINDING SITE III. Table 2 illustrates the complementarity of the nucleotide sequences of CD36L1 BINDING SITE, designated SEQ ID:12019, to the nucleotide sequence of VGAM1514 RNA, herein designated VGAM RNA, also designated SEQ ID:4225.

Another function of VGAM1514 is therefore inhibition of CD36L1 (Accession NM_005505). Accordingly, utilities of VGAM1514 include diagnosis, prevention and treatment of diseases and clinical conditions associated with CD36L1. CGI-01 (Accession NM_015935) is another VGAM1514 host target gene. CGI-01 BINDING SITE is HOST TARGET binding site found in the 3' untranslated region of mRNA encoded by CGI-01, corresponding to a HOST TARGET binding site such as BINDING SITE I, BINDING SITE II or BINDING SITE III. Table 2 illustrates the complementarity of the nucleotide sequences of CGI-01 BINDING SITE, designated SEQ ID:18055, to the nucleotide sequence of VGAM1514 RNA, herein designated VGAM RNA, also designated SEQ ID:4225.

Another function of VGAM1514 is therefore inhibition of CGI-01 (Accession NM_015935). Accordingly, utilities of VGAM1514 include diagnosis, prevention and treatment of diseases and clinical conditions associated with CGI-01. DKFZp434C0328 (Accession NM_017577) is another VGAM1514 host target gene. DKFZp434C0328 BINDING SITE is HOST TARGET binding site found in the 5' untranslated region of mRNA encoded by DKFZp434C0328, corresponding to a HOST TARGET binding site such as BINDING SITE I, BINDING SITE II or BINDING SITE III. Table 2 illustrates the complementarity of the nucleotide sequences of DKFZp434C0328 BINDING SITE, designated SEQ ID:19014, to the nucleotide sequence of VGAM1514 RNA, herein designated VGAM RNA, also designated SEQ ID:4225.

Another function of VGAM1514 is therefore inhibition of DKFZp434C0328 (Accession NM_017577). Accordingly, utilities of VGAM1514 include diagnosis, prevention and treatment of diseases and clinical conditions associated with DKFZp434C0328. FLJ11588 (Accession NM_024603) is another VGAM1514 host target gene. FLJ11588 BINDING SITE is HOST TARGET binding site found in the 5' untranslated region of mRNA encoded by FLJ11588, corresponding to a HOST TARGET binding site such as BINDING SITE I, BINDING SITE II or BINDING SITE III. Table 2 illustrates the complementarity of the nucleotide sequences of FLJ11588 BINDING SITE, designated SEQ ID:23853, to the nucleotide sequence of VGAM1514 RNA, herein designated VGAM RNA, also designated SEQ ID:4225.

Another function of VGAM1514 is therefore inhibition of FLJ11588 (Accession NM_024603). Accordingly, utilities of VGAM1514 include diagnosis, prevention and treatment of diseases and clinical conditions associated with FLJ11588. FLJ12838 (Accession NM_024641) is another VGAM1514 host target gene. FLJ12838 BINDING SITE is HOST TARGET binding site found in the 3' untranslated region of mRNA encoded by FLJ12838, corresponding to a HOST TARGET binding site such as BINDING SITE I, BINDING SITE II or BINDING SITE III. Table 2 illustrates the complementarity of the nucleotide sequences of FLJ12838 BINDING SITE, designated SEQ ID:23923, to the nucleotide sequence of VGAM1514 RNA, herein designated VGAM RNA, also designated SEQ ID:4225.

Another function of VGAM1514 is therefore inhibition of FLJ12838 (Accession NM_024641). Accordingly, utilities of VGAM1514 include diagnosis, prevention and treatment of diseases and clinical conditions associated with FLJ12838. FLJ20400 (Accession XM_039306) is another VGAM1514 host target gene. FLJ20400 BINDING SITE is HOST TARGET binding site found in the 3' untranslated region of mRNA encoded by FLJ20400, corresponding to a HOST TARGET binding site such as BINDING SITE I, BINDING SITE II or BINDING SITE III. Table 2 illustrates the complementarity of the nucleotide sequences of FLJ20400 BINDING SITE, designated SEQ ID:33044, to the nucleotide sequence of VGAM1514 RNA, herein designated VGAM RNA, also designated SEQ ID:4225.

Another function of VGAM1514 is therefore inhibition of FLJ20400 (Accession XM_039306). Accordingly, utilities of VGAM1514 include diagnosis, prevention and treatment of diseases and clinical conditions associated with FLJ20400. KIAA0638 (Accession XM_051489) is another VGAM1514 host target gene. KIAA0638 BINDING SITE is HOST TARGET binding site found in the 3' untranslated region of mRNA encoded by KIAA0638, corresponding to a HOST TARGET binding site such as BINDING SITE I, BINDING SITE II or BINDING SITE III. Table 2 illustrates the complementarity of the nucleotide sequences of KIAA0638 BINDING SITE, designated SEQ ID:35846, to the nucleotide sequence of VGAM1514 RNA, herein designated VGAM RNA, also designated SEQ ID:4225.

Another function of VGAM1514 is therefore inhibition of KIAA0638 (Accession XM_051489). Accordingly, utilities of VGAM1514 include diagnosis, prevention and treatment of diseases and clinical conditions associated with KIAA0638. KIAA0894 (Accession NM_014896) is another VGAM1514 host target gene. KIAA0894 BINDING SITE is HOST TARGET binding site found in the 3' untranslated region of mRNA encoded by KIAA0894, corresponding to a HOST TARGET binding site such as BINDING SITE I, BINDING SITE II or BINDING SITE III. Table 2 illustrates the complementarity of the nucleotide sequences of KIAA0894 BINDING SITE, designated SEQ ID:17057, to the nucleotide sequence of VGAM1514 RNA, herein designated VGAM RNA, also designated SEQ ID:4225.

Another function of VGAM1514 is therefore inhibition of KIAA0894 (Accession NM_014896). Accordingly, utilities of VGAM1514 include diagnosis, prevention and treatment of diseases and clinical conditions associated with KIAA0894. KIAA1204 (Accession XM_045011) is another VGAM1514 host target gene. KIAA1204 BINDING SITE is HOST TARGET binding site found in the 5' untranslated region of mRNA encoded by KIAA1204, corresponding to a HOST TARGET binding site such as BINDING SITE I, BINDING SITE II or BINDING SITE III. Table 2 illustrates the complementarity of the nucleotide sequences of KIAA1204 BINDING SITE, designated SEQ ID:34315, to the nucleotide sequence of VGAM1514 RNA, herein designated VGAM RNA, also designated SEQ ID:4225.

Another function of VGAM1514 is therefore inhibition of KIAA1204 (Accession XM_045011). Accordingly, utilities of VGAM1514 include diagnosis, prevention and treatment of diseases and clinical conditions associated with KIAA1204. Leucine-rich Repeat LGI Family, Member 4 (LGI4, Accession NM_139284) is another VGAM1514 host target gene. LGI4 BINDING SITE is HOST TARGET binding site found in the 3' untranslated region of mRNA encoded by LGI4, corresponding to a HOST TARGET binding site such as BINDING SITE I, BINDING SITE II or BINDING SITE III. Table 2 illustrates the complementarity of the nucleotide sequences of LGI4 BINDING SITE, designated SEQ ID:29288, to the nucleotide sequence of VGAM1514 RNA, herein designated VGAM RNA, also designated SEQ ID:4225.

Another function of VGAM1514 is therefore inhibition of Leucine-rich Repeat LGI Family, Member 4 (LGI4, Accession NM_139284). Accordingly, utilities of VGAM1514 include diagnosis, prevention and treatment of diseases and clinical conditions associated with LGI4. MGC4172 (Accession NM_024308) is another VGAM1514 host target gene. MGC4172 BINDING SITE is HOST TARGET binding site found in the 3' untranslated region of mRNA encoded by MGC4172, corresponding to a HOST TARGET binding site such as BINDING SITE I, BINDING SITE II or BINDING SITE III. Table 2 illustrates the complementarity of the nucleotide sequences of MGC4172 BINDING SITE, designated SEQ ID:23598, to the nucleotide sequence of VGAM1514 RNA, herein designated VGAM RNA, also designated SEQ ID:4225.

Another function of VGAM1514 is therefore inhibition of MGC4172 (Accession NM_024308). Accordingly, utilities of VGAM1514 include diagnosis, prevention and treatment of diseases and clinical conditions associated with MGC4172. MIDORI (Accession XM_057651) is another VGAM1514 host target gene. MIDORI BINDING SITE is HOST TARGET binding site found in the 3' untranslated region of mRNA encoded by MIDORI, corresponding to a HOST TARGET binding site such as BINDING SITE I, BINDING SITE II or BINDING SITE III. Table 2 illustrates the complementarity of the nucleotide sequences of MIDORI BINDING SITE, designated SEQ ID:36529, to the nucleotide sequence of VGAM1514 RNA, herein designated VGAM RNA, also designated SEQ ID:4225.

Another function of VGAM1514 is therefore inhibition of MIDORI (Accession XM_057651). Accordingly, utilities of VGAM1514 include diagnosis, prevention and treatment of diseases and clinical conditions associated with MIDORI. ZF5128 (Accession NM_014347) is another VGAM1514 host target gene. ZF5128 BINDING SITE is HOST TARGET binding site found in the 3' untranslated region of mRNA encoded by ZF5128, corresponding to a HOST TARGET binding site such as BINDING SITE I, BINDING SITE II or BINDING SITE III. Table 2 illustrates the complementarity of the nucleotide sequences of ZF5128 BINDING SITE, designated SEQ ID:15671, to the nucleotide sequence of VGAM1514 RNA, herein designated VGAM RNA, also designated SEQ ID:4225.

Another function of VGAM1514 is therefore inhibition of ZF5128 (Accession NM_014347). Accordingly, utilities of VGAM1514 include diagnosis, prevention and treatment of diseases and clinical conditions associated with ZF5128. LOC145989 (Accession XM_004815) is another VGAM1514 host target gene. LOC145989 BINDING SITE is HOST TARGET binding site found in the 3' untranslated region of mRNA encoded by LOC145989, corresponding to a HOST TARGET binding site such as BINDING SITE I, BINDING SITE II or BINDING SITE III. Table 2 illustrates the complementarity of the nucleotide sequences of LOC145989 BINDING SITE, designated SEQ ID:29952, to the nucleotide sequence of VGAM1514 RNA, herein designated VGAM RNA, also designated SEQ ID:4225.

Another function of VGAM1514 is therefore inhibition of LOC145989 (Accession XM_004815). Accordingly, utilities of VGAM1514 include diagnosis, prevention and treatment of diseases and clinical conditions associated with LOC145989. LOC148195 (Accession XM_097419) is another VGAM1514 host target gene. LOC148195 BINDING SITE is HOST TARGET binding site found in the 5' untranslated region of mRNA encoded by LOC148195, corresponding to a HOST TARGET binding site such as BINDING SITE I, BINDING SITE II or BINDING SITE III. Table 2 illustrates the complementarity of the nucleotide sequences of LOC148195 BINDING SITE, designated SEQ ID:40877, to the nucleotide sequence of VGAM1514 RNA, herein designated VGAM RNA, also designated SEQ ID:4225.

Another function of VGAM1514 is therefore inhibition of LOC148195 (Accession XM_097419). Accordingly, utilities of VGAM1514 include diagnosis, prevention and treatment of diseases and clinical conditions associated with LOC148195. LOC158714 (Accession XM_088650) is another VGAM1514 host target gene. LOC158714 BINDING SITE is HOST TARGET binding site found in the 5' untranslated region of mRNA encoded by LOC158714, corresponding to a HOST TARGET binding site such as BINDING SITE I, BINDING SITE II or BINDING SITE III. Table 2 illustrates the complementarity of the nucleotide sequences of LOC158714 BINDING SITE, designated SEQ ID:39885, to the nucleotide sequence of VGAM1514 RNA, herein designated VGAM RNA, also designated SEQ ID:4225.

Another function of VGAM1514 is therefore inhibition of LOC158714 (Accession XM_088650). Accordingly, utilities of VGAM1514 include diagnosis, prevention and treatment of diseases and clinical conditions associated with LOC158714. LOC257407 (Accession XM_173078) is another VGAM1514 host target gene. LOC257407 BINDING SITE is HOST TARGET binding site found in the 5' untranslated region of mRNA encoded by LOC257407, corresponding to a HOST TARGET binding site such as BINDING SITE I, BINDING SITE II or BINDING SITE III. Table 2 illustrates the complementarity of the nucleotide sequences of LOC257407 BINDING SITE, designated SEQ ID:46336, to the nucleotide sequence of VGAM1514 RNA, herein designated VGAM RNA, also designated SEQ ID:4225.

Another function of VGAM1514 is therefore inhibition of LOC257407 (Accession XM_173078). Accordingly, utilities of VGAM1514 include diagnosis, prevention and treatment of diseases and clinical conditions associated with LOC257407. LOC91115 (Accession XM_036218) is another VGAM1514 host target gene. LOC91115 BINDING SITE is HOST TARGET binding site found in the 3' untranslated region of mRNA encoded by LOC91115, corresponding to a HOST TARGET binding site such as BINDING SITE I, BINDING SITE II or BINDING SITE III. Table 2 illustrates the complementarity of the nucleotide sequences of LOC91115 BINDING SITE, designated SEQ ID:32397, to the nucleotide sequence of VGAM1514 RNA, herein designated VGAM RNA, also designated SEQ ID:4225.

Another function of VGAM1514 is therefore inhibition of LOC91115 (Accession XM_036218). Accordingly, utilities of VGAM1514 include diagnosis, prevention and treatment of diseases and clinical conditions associated with LOC91115. LOC92305 (Accession NM_138385) is another VGAM1514 host target gene. LOC92305 BINDING SITE is HOST TARGET binding site found in the 3' untranslated region of mRNA encoded by LOC92305, corresponding to a HOST TARGET binding site such as BINDING SITE I, BINDING SITE II or BINDING SITE III. Table 2 illustrates the complementarity of the nucleotide sequences of LOC92305 BINDING SITE, designated SEQ ID:28759, to the nucleotide sequence of VGAM1514 RNA, herein designated VGAM RNA, also designated SEQ ID:4225.

Another function of VGAM1514 is therefore inhibition of LOC92305 (Accession NM_138385). Accordingly, utilities of VGAM1514 include diagnosis, prevention and treatment of diseases and clinical conditions associated with LOC92305. LOC92997 (Accession XM_048690) is another VGAM1514 host target gene. LOC92997 BINDING SITE is HOST TARGET binding site found in the 3' untranslated region of mRNA encoded by LOC92997, corresponding to a HOST TARGET binding site such as BINDING SITE I, BINDING SITE II or BINDING SITE III. Table 2 illustrates the complementarity of the nucleotide sequences of LOC92997 BINDING SITE, designated SEQ ID:35221, to the nucleotide sequence of VGAM1514 RNA, herein designated VGAM RNA, also designated SEQ ID:4225.

Another function of VGAM1514 is therefore inhibition of LOC92997 (Accession XM_048690). Accordingly, utilities of VGAM1514 include diagnosis, prevention and treatment of diseases and clinical conditions associated with LOC92997. FIG. 1 further provides a conceptual description of a novel bioinformatically detected viral gene of the present invention, referred to here as Viral Genomic Address Messenger 1515 (VGAM1515) viral gene, which modulates expression of respective host target genes thereof, the function and utility of which host target genes is known in the art.

VGAM1515 is a novel bioinformatically detected regulatory, non protein coding, viral micro RNA (miRNA) gene. The method by which VGAM1515 was detected is described hereinabove with reference to FIGS. 1-8.

VGAM1515 gene, herein designated VGAM GENE, is a viral gene contained in the genome of Parsnip Yellow Fleck Virus. VGAM1515 host target gene, herein designated VGAM HOST TARGET GENE, is a human gene contained in the human genome.

VGAM1515 gene encodes a VGAM1515 precursor RNA, herein designated VGAM PRECURSOR RNA. Similar to other miRNA genes, and unlike most ordinary genes, VGAM1515 precursor RNA does not encode a protein. A nucleotide sequence identical or highly similar to the nucleotide sequence of VGAM1515 precursor RNA is designated SEQ ID:1501, and is provided hereinbelow with reference to the sequence listing part. Nucleotide sequence SEQ ID:1501 is located at position 2895 relative to the genome of Parsnip Yellow Fleck Virus.

VGAM1515 precursor RNA folds onto itself, forming VGAM1515 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1515 folded precursor RNA into VGAM1515 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1515 RNA is designated SEQ ID:4226, and is provided hereinbelow with reference to the sequence listing part.

VGAM1515 host target gene, herein designated VGAM HOST TARGET GENE, encodes a corresponding messenger RNA, VGAM1515 host target RNA, herein designated VGAM HOST TARGET RNA. VGAM1515 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1515 RNA, herein designated VGAM RNA, binds complementarily to one or more host target binding sites located in untranslated regions of VGAM1515 host target RNA, herein designated VGAM HOST TARGET RNA. This complementary binding is due to the fact that the nucleotide sequence of VGAM1515 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1515 RNA, herein designated VGAM RNA, may have a different number of host target binding sites in untranslated regions of a VGAM1515 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1515 RNA, herein designated VGAM RNA, to host target binding sites on VGAM1515 host target RNA, herein designated VGAM HOST TARGET RNA, such as BINDING SITE I, BINDING SITE II and BINDING SITE III, inhibits translation of VGAM1515 host target RNA into VGAM1515 host target protein, herein designated VGAM HOST TARGET PROTEIN. VGAM host target protein is therefore outlined by a broken line.

It is appreciated that VGAM1515 host target gene, herein designated VGAM HOST TARGET GENE, in fact represents a plurality of VGAM1515 host target genes. The mRNA of each one of this plurality of VGAM1515 host target genes comprises one or more host target binding sites, each having a nucleotide sequence which is at least partly complementary to VGAM1515 RNA, herein designated VGAM RNA, and which when bound by VGAM1515 RNA causes inhibition of translation of respective one or more VGAM1515 host target proteins.

It is further appreciated by one skilled in the art that the mode of translational inhibition illustrated by FIG. 1 with specific reference to translational inhibition exerted by VGAM1515 gene, herein designated VGAM GENE, on one or more VGAM1515 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1515 is inhibition of expression of host target genes, as part of a novel viral mechanism of attacking a host. Accordingly, utilities of VGAM1515 include diagnosis, prevention and treatment of viral infection by Parsnip Yellow Fleck Virus. Specific functions, and accordingly utilities, of VGAM1515 correlate with, and may be deduced from, the identity of the host target genes which VGAM1515 binds and inhibits, and the function of these host target genes, as elaborated hereinbelow.

Nucleotide sequences of the VGAM1515 precursor RNA, herein designated VGAM PRECURSOR RNA, and of the 'diced' VGAM1515 RNA, herein designated VGAM RNA, and a schematic representation of the secondary folding of VGAM1515 folded precursor RNA, herein designated VGAM FOLDED PRECURSOR RNA, of VGAM1515 are further described hereinbelow with reference to Table 1.

Nucleotide sequences of host target binding sites, such as BINDING SITE-I, BINDING SITE-II and BINDING SITE-III of FIG. 1, found on VGAM1515 host target RNA, and schematic representation of the complementarity of each of these host target binding sites to VGAM1515 RNA, herein designated VGAM RNA, are described hereinbelow with reference to Table 2.

As mentioned hereinabove with reference to FIG. 1, a function of VGAM1515 gene, herein designated VGAM is inhibition of expression of VGAM1515 target genes. It is appreciated that specific functions, and accordingly utilities, of VGAM1515 correlate with, and may be deduced from, the identity of the target genes which VGAM1515 binds and inhibits, and the function of these target genes, as elaborated hereinbelow.

Junctional Adhesion Molecule 3 (JAM3, Accession NM_032801) is a VGAM1515 host target gene. JAM3 BINDING SITE is HOST TARGET binding site found in the 3' untranslated region of mRNA encoded by JAM3, corresponding to a HOST TARGET binding site such as BINDING SITE I, BINDING SITE II or BINDING SITE III. Table 2 illustrates the complementarity of the nucleotide sequences of JAM3 BINDING SITE, designated SEQ ID:26557, to the nucleotide sequence of VGAM1515 RNA, herein designated VGAM RNA, also designated SEQ ID:4226.

A function of VGAM1515 is therefore inhibition of Junctional Adhesion Molecule 3 (JAM3, Accession NM_032801), a gene which is a member of the junctional adhesion molecule protein family. Accordingly, utilities of VGAM1515 include diagnosis, prevention and treatment of diseases and clinical conditions associated with JAM3. The function of JAM3 and its association with various diseases and clinical conditions, has been established by previous studies, as described hereinabove with reference to VGAM200. Matrilin 3 (MATN3, Accession NM_002381) is another VGAM1515 host target gene. MATN3 BINDING SITE is HOST TARGET binding site found in the 3' untranslated region of mRNA encoded by MATN3, corresponding to a HOST TARGET binding site such as BINDING SITE I, BINDING SITE II or BINDING SITE III. Table 2 illustrates the complementarity of the nucleotide sequences of MATN3 BINDING SITE, designated SEQ ID:8198, to the nucleotide sequence of VGAM1515 RNA, herein designated VGAM RNA, also designated SEQ ID:4226.

Another function of VGAM1515 is therefore inhibition of Matrilin 3 (MATN3, Accession NM_002381). Accordingly, utilities of VGAM1515 include diagnosis, prevention and treatment of diseases and clinical conditions associated with MATN3. Zinc Finger Protein 278 (ZNF278, Accession NM_014323) is another VGAM1515 host target gene. ZNF278 BINDING SITE1 through ZNF278 BINDING SITE3 are HOST TARGET binding sites found in untranslated regions of mRNA encoded by ZNF278, corresponding to HOST TARGET binding sites such as BINDING SITE I, BINDING SITE II or BINDING SITE III. Table 2 illustrates the complementarity of the nucleotide sequences of ZNF278 BINDING SITE1 through ZNF278 BINDING SITE3, designated SEQ ID:15623, SEQ ID:25772 and SEQ ID:25781 respectively, to the nucleotide sequence of VGAM1515 RNA, herein designated VGAM RNA, also designated SEQ ID:4226.

Another function of VGAM1515 is therefore inhibition of Zinc Finger Protein 278 (ZNF278, Accession NM_014323), a gene which represses basal transcription as well as RNF4-mediated activation. Accordingly, utilities of VGAM1515 include diagnosis, prevention and treatment of diseases and clinical conditions associated with ZNF278. The function of ZNF278 and its association with various diseases and clinical conditions, has been established by previous studies, as described hereinabove with reference to VGAM414. HSMPP8 (Accession XM_167894) is another VGAM1515 host target gene. HSMPP8 BINDING SITE is HOST TARGET binding site found in the 3' untranslated region of mRNA encoded by HSMPP8, corresponding to a HOST TARGET binding site such as BINDING SITE I, BINDING SITE II or BINDING SITE III. Table 2 illustrates the complementarity of the nucleotide sequences of HSMPP8 BINDING SITE, designated SEQ ID:44902, to the nucleotide sequence of VGAM1515 RNA, herein designated VGAM RNA, also designated SEQ ID:4226.

Another function of VGAM1515 is therefore inhibition of HSMPP8 (Accession XM_167894). Accordingly, utilities of VGAM1515 include diagnosis, prevention and treatment of diseases and clinical conditions associated with HSMPP8. TERF1 (TRF1)-interacting Nuclear Factor 2 (TINF2, Accession NM_012461) is another VGAM1515 host target gene. TINF2 BINDING SITE is HOST TARGET binding site found in the 3' untranslated region of mRNA encoded by TINF2, corresponding to a HOST TARGET binding site such as BINDING SITE I, BINDING SITE II or BINDING SITE III. Table 2 illustrates the complementarity of the nucleotide sequences of TINF2 BINDING SITE, designated SEQ ID:14834, to the nucleotide sequence of VGAM1515 RNA, herein designated VGAM RNA, also designated SEQ ID:4226.

Another function of VGAM1515 is therefore inhibition of TERF1 (TRF1)-interacting Nuclear Factor 2 (TINF2, Accession NM_012461). Accordingly, utilities of VGAM1515 include diagnosis, prevention and treatment of diseases and clinical conditions associated with TINF2. LOC154386 (Accession XM_087920) is another VGAM1515 host target gene. LOC154386 BINDING SITE is HOST TARGET binding site found in the 3' untranslated region of mRNA encoded by LOC154386, corresponding to a HOST TARGET binding site such as BINDING SITE I, BINDING SITE II or BINDING SITE III. Table 2 illustrates the complementarity of the nucleotide sequences of LOC154386 BINDING SITE, designated SEQ ID:39473, to the nucleotide sequence of VGAM1515 RNA, herein designated VGAM RNA, also designated SEQ ID:4226.

Another function of VGAM1515 is therefore inhibition of LOC154386 (Accession XM_087920). Accordingly, utilities of VGAM1515 include diagnosis, prevention and treatment of diseases and clinical conditions associated with LOC154386. LOC256158 (Accession XM_175125) is another VGAM1515 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46637, to the nucleotide sequence of VGAM1515 RNA, herein designated VGAM RNA, also designated SEQ ID:4226.

Another function of VGAM1515 is therefore inhibition of LOC256158 (Accession XM_175125). Accordingly, utilities of VGAM1515 include diagnosis, prevention and treatment of diseases and clinical conditions associated with LOC256158. FIG. 1 further provides a conceptual description of a novel bioinformatically detected viral gene of the present invention, referred to here as Viral Genomic Address Messenger 1516 (VGAM1516) viral gene, which modulates expression of respective host target genes thereof, the function and utility of which host target genes is known in the art.

VGAM1516 is a novel bioinformatically detected regulatory, non protein coding, viral micro RNA (miRNA) gene. The method by which VGAM1516 was detected is described hereinabove with reference to FIGS. 1-8.

VGAM1516 gene, herein designated VGAM GENE, is a viral gene contained in the genome of Parsnip Yellow Fleck Virus. VGAM1516 host target gene, herein designated VGAM HOST TARGET GENE, is a human gene contained in the human genome.

VGAM1516 gene encodes a VGAM1516 precursor RNA, herein designated VGAM PRECURSOR RNA. Similar to other miRNA genes, and unlike most ordinary genes, VGAM1516 precursor RNA does not encode a protein. A nucleotide sequence identical or highly similar to the nucleotide sequence of VGAM1516 precursor RNA is designated SEQ ID:1502, and is provided hereinbelow with reference to the sequence listing part. Nucleotide sequence SEQ ID:1502 is located at position 1828 relative to the genome of Parsnip Yellow Fleck Virus.

VGAM1516 precursor RNA folds onto itself, forming VGAM1516 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1516 folded precursor RNA into VGAM1516 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM1516 RNA is designated SEQ ID:4227, and is provided hereinbelow with reference to the sequence listing part.

VGAM1516 host target gene, herein designated VGAM HOST TARGET GENE, encodes a corresponding messenger RNA, VGAM1516 host target RNA, herein designated VGAM HOST TARGET RNA. VGAM1516 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1516 RNA, herein designated VGAM RNA, binds complementarily to one or more host target binding sites located in untranslated regions of VGAM1516 host target RNA, herein designated VGAM HOST TARGET RNA. This complementary binding is due to the fact that the nucleotide sequence of VGAM1516 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1516 RNA, herein designated VGAM RNA, may have a different number of host target binding sites in untranslated regions of a VGAM1516 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1516 RNA, herein designated VGAM RNA, to host target binding sites on VGAM1516 host target RNA, herein designated VGAM HOST TARGET RNA, such as BINDING SITE I, BINDING SITE II and BINDING SITE III, inhibits translation of VGAM1516 host target RNA into VGAM1516 host target protein, herein designated VGAM HOST TARGET PROTEIN. VGAM host target protein is therefore outlined by a broken line.

It is appreciated that VGAM1516 host target gene, herein designated VGAM HOST TARGET GENE, in fact represents a plurality of VGAM1516 host target genes. The mRNA of each one of this plurality of VGAM1516 host target genes comprises one or more host target binding sites, each having a nucleotide sequence which is at least partly complementary to VGAM1516 RNA, herein designated VGAM RNA, and which when bound by VGAM1516 RNA causes inhibition of translation of respective one or more VGAM1516 host target proteins.

It is further appreciated by one skilled in the art that the mode of translational inhibition illustrated by FIG. 1 with specific reference to translational inhibition exerted by VGAM1516 gene, herein designated VGAM GENE, on one or more VGAM1516 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1516 is inhibition of expression of host target genes, as part of a novel viral mechanism of attacking a host. Accordingly, utilities of VGAM1516 include diagnosis, prevention and treatment of viral infection by Parsnip Yellow Fleck Virus. Specific functions, and accordingly utilities, of VGAM1516 correlate with, and may be deduced from, the identity of the host target genes which VGAM1516 binds and inhibits, and the function of these host target genes, as elaborated hereinbelow.

Nucleotide sequences of the VGAM1516 precursor RNA, herein designated VGAM PRECURSOR RNA, and of the 'diced' VGAM1516 RNA, herein designated VGAM RNA, and a schematic representation of the secondary folding of VGAM1516 folded precursor RNA, herein designated VGAM FOLDED PRECURSOR RNA, of VGAM1516 are further described hereinbelow with reference to Table 1.

Nucleotide sequences of host target binding sites, such as BINDING SITE-I, BINDING SITE-II and BINDING SITE-III of FIG. 1, found on VGAM1516 host target RNA, and schematic representation of the complementarity of each of these host target binding sites to VGAM1516 RNA, herein designated VGAM RNA, are described hereinbelow with reference to Table 2.

As mentioned hereinabove with reference to FIG. 1, a function of VGAM1516 gene, herein designated VGAM is inhibition of expression of VGAM1516 target genes. It is appreciated that specific functions, and accordingly utilities, of VGAM1516 correlate with, and may be deduced from, the identity of the target genes which VGAM1516 binds and inhibits, and the function of these target genes, as elaborated hereinbelow.

Transient Receptor Potential Cation Channel, Subfamily C, Member 6 (TRPC6, Accession NM_004621) is a VGAM1516 host target gene. TRPC6 BINDING SITE is HOST TARGET binding site found in the 5' untranslated region of mRNA encoded by TRPC6, corresponding to a HOST TARGET binding site such as BINDING SITE I, BINDING SITE II or BINDING SITE III. Table 2 illustrates the complementarity of the nucleotide sequences of TRPC6 BINDING SITE, designated SEQ ID:10979, to the nucleotide sequence of VGAM1516 RNA, herein designated VGAM RNA, also designated SEQ ID:4227.

A function of VGAM1516 is therefore inhibition of Transient Receptor Potential Cation Channel, Subfamily C, Member 6 (TRPC6, Accession NM_004621), a gene which has calcium channel activity. Accordingly, utilities of VGAM1516 include diagnosis, prevention and treatment of diseases and clinical conditions associated with TRPC6. The function of TRPC6 and its association with various diseases and clinical conditions, has been established by previous studies, as described hereinabove with reference to VGAM25. Ankyrin Repeat and SOCS Box-containing 13 (ASB13, Accession NM_024701) is another VGAM1516 host target gene. ASB13 BINDING SITE is HOST TARGET binding site found in the 3' untranslated region of mRNA encoded by ASB13, corresponding to a HOST TARGET binding site such as BINDING SITE I, BINDING SITE II or BINDING SITE III. Table 2 illustrates the complementarity of the nucleotide sequences of ASB13 BINDING SITE, designated SEQ ID:24014, to the nucleotide sequence of VGAM1516 RNA, herein designated VGAM RNA, also designated SEQ ID:4227.

Another function of VGAM1516 is therefore inhibition of Ankyrin Repeat and SOCS Box-containing 13 (ASB13, Accession NM_024701). Accordingly, utilities of VGAM1516 include diagnosis, prevention and treatment of diseases and clinical conditions associated with ASB13. CUB and Sushi Multiple Domains 1 (CSMD1, Accession NM_033225) is another VGAM1516 host target gene. CSMD1 BINDING SITE1 and CSMD1 BINDING SITE2 are HOST TARGET binding sites found in untranslated regions of mRNA encoded by CSMD1, corresponding to HOST TARGET binding sites such as BINDING SITE I, BINDING SITE II or BINDING SITE III. Table 2 illustrates the complementarity of the nucleotide sequences of CSMD1 BINDING SITE1 and CSMD1 BINDING SITE2, designated SEQ ID:27071 and SEQ ID:36194 respectively, to the nucleotide sequence of VGAM1516 RNA, herein designated VGAM RNA, also designated SEQ ID:4227.

Another function of VGAM1516 is therefore inhibition of CUB and Sushi Multiple Domains 1 (CSMD1, Accession NM_033225). Accordingly, utilities of VGAM1516 include diagnosis, prevention and treatment of diseases and clinical conditions associated with CSMD1. Hairy/enhancer-of-split Related with YRPW Motif 2 (HEY2, Accession NM_012259) is another VGAM1516 host target gene. HEY2 BINDING SITE is HOST TARGET binding site found in the 3' untranslated region of mRNA encoded by HEY2, corresponding to a HOST TARGET binding site such as BINDING SITE I, BINDING SITE II or BINDING SITE III. Table 2 illustrates the complementarity of the nucleotide sequences of HEY2 BINDING SITE, designated SEQ ID:14566, to the nucleotide sequence of VGAM1516 RNA, herein designated VGAM RNA, also designated SEQ ID:4227.

Another function of VGAM1516 is therefore inhibition of Hairy/enhancer-of-split Related with YRPW Motif 2 (HEY2, Accession NM_012259). Accordingly, utilities of VGAM1516 include diagnosis, prevention and treatment of diseases and clinical conditions associated with HEY2. KIAA1944 (Accession XM_062545) is another VGAM1516 host target gene. KIAA1944 BINDING SITE is HOST TARGET binding site found in the 3' untranslated region of mRNA encoded by KIAA1944, corresponding to a HOST TARGET binding site such as BINDING SITE I, BINDING SITE II or BINDING SITE III. Table 2 illustrates the complementarity of the nucleotide sequences of KIAA1944 BINDING SITE, designated SEQ ID:37230, to the nucleotide sequence of VGAM1516 RNA, herein designated VGAM RNA, also designated SEQ ID:4227.

Another function of VGAM1516 is therefore inhibition of KIAA1944 (Accession XM_062545). Accordingly, utilities of VGAM1516 include diagnosis, prevention and treatment of diseases and clinical conditions associated with KIAA1944. KIAA1956 (Accession XM_085836) is another VGAM1516 host target gene. KIAA1956 BINDING SITE is HOST TARGET binding site found in the 3' untranslated region of mRNA encoded by KIAA1956, corresponding to a HOST TARGET binding site such as BINDING SITE I, BINDING SITE II or BINDING SITE III. Table 2 illustrates the complementarity of the nucleotide sequences of KIAA1956 BINDING SITE, designated SEQ ID:38362, to the nucleotide sequence of VGAM1516 RNA, herein designated VGAM RNA, also designated SEQ ID:4227.

Another function of VGAM1516 is therefore inhibition of KIAA1956 (Accession XM_085836). Accordingly, utilities of VGAM1516 include diagnosis, prevention and treatment of diseases and clinical conditions associated with KIAA1956. Protein Phosphatase 4, Regulatory Subunit 2 (PPP4R2, Accession NM_019853) is another VGAM1516 host target gene. PPP4R2 BINDING SITE is HOST TARGET binding site found in the 5' untranslated region of mRNA encoded by PPP4R2, corresponding to a HOST TARGET binding site such as BINDING SITE I, BINDING SITE II or BINDING SITE III. Table 2 illustrates the complementarity of the nucleotide sequences of PPP4R2 BINDING SITE, designated SEQ ID:21257, to the nucleotide sequence of VGAM1516 RNA, herein designated VGAM RNA, also designated SEQ ID:4227.

Another function of VGAM1516 is therefore inhibition of Protein Phosphatase 4, Regulatory Subunit 2 (PPP4R2, Accession NM_019853). Accordingly, utilities of VGAM1516 include diagnosis, prevention and treatment of diseases and clinical conditions associated with PPP4R2. LOC155438 (Accession XM_098722) is another VGAM1516 host target gene. LOC155438 BINDING SITE is HOST TARGET binding site found in the 3' untranslated region of mRNA encoded by LOC155438, corresponding to a HOST TARGET binding site such as BINDING SITE I, BINDING SITE II or BINDING SITE III. Table 2 illustrates the complementarity of the nucleotide sequences of LOC155438 BINDING SITE, designated SEQ ID:41769, to the nucleotide sequence of VGAM1516 RNA, herein designated VGAM RNA, also designated SEQ ID:4227.

Another function of VGAM1516 is therefore inhibition of LOC155438 (Accession XM_098722). Accordingly, utilities of VGAM1516 include diagnosis, prevention and treatment of diseases and clinical conditions associated with LOC155438. LOC200854 (Accession XM_113396) is another VGAM1516 host target gene. LOC200854 BINDING SITE is HOST TARGET binding site found in the 5' untranslated region of mRNA encoded by LOC200854, corresponding to a HOST TARGET binding site such as BINDING SITE I, BINDING SITE II or BINDING SITE III. Table 2 illustrates the complementarity of the nucleotide sequences of LOC200854 BINDING SITE, designated SEQ ID:42253, to the nucleotide sequence of VGAM1516 RNA, herein designated VGAM RNA, also designated SEQ ID:4227.

Another function of VGAM1516 is therefore inhibition of LOC200854 (Accession XM_113396). Accordingly, utilities of VGAM1516 include diagnosis, prevention and treatment of diseases and clinical conditions associated with LOC200854. FIG. 1 further provides a conceptual description of a novel bioinformatically detected viral gene of the present invention, referred to here as Viral Genomic Address Messenger 1517 (VGAM1517) viral gene, which modulates expression of respective host target genes thereof, the function and utility of which host target genes is known in the art.

VGAM1517 is a novel bioinformatically detected regulatory, non protein coding, viral micro RNA (miRNA) gene. The method by which VGAM1517 was detected is described hereinabove with reference to FIGS. 1-8.

VGAM1517 gene, herein designated VGAM GENE, is a viral gene contained in the genome of Pea Seed-borne Mosaic Virus. VGAM1517 host target gene, herein designated VGAM HOST TARGET GENE, is a human gene contained in the human genome.

VGAM1517 gene encodes a VGAM1517 precursor RNA, herein designated VGAM PRECURSOR RNA. Similar to other miRNA genes, and unlike most ordinary genes, VGAM1517 precursor RNA does not encode a protein. A nucleotide sequence identical or highly similar to the nucleotide sequence of VGAM1517 precursor RNA is designated SEQ ID:1503, and is provided hereinbelow with reference to the sequence listing part. Nucleotide sequence SEQ ID:1503 is located at position 6741 relative to the genome of Pea Seed-borne Mosaic Virus.

VGAM1517 precursor RNA folds onto itself, forming VGAM1517 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1517 folded precursor RNA into VGAM1517 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1517 RNA is designated SEQ ID:4228, and is provided hereinbelow with reference to the sequence listing part.

VGAM1517 host target gene, herein designated VGAM HOST TARGET GENE, encodes a corresponding messenger RNA, VGAM1517 host target RNA, herein designated VGAM HOST TARGET RNA. VGAM1517 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1517 RNA, herein designated VGAM RNA, binds complementarily to one or more host target binding sites located in untranslated regions of VGAM1517 host target RNA, herein designated VGAM HOST TARGET RNA. This complementary binding is due to the fact that the nucleotide sequence of VGAM1517 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1517 RNA, herein designated VGAM RNA, may have a different number of host target binding sites in untranslated regions of a VGAM1517 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1517 RNA, herein designated VGAM RNA, to host target binding sites on VGAM1517 host target RNA, herein designated VGAM HOST TARGET RNA, such as BINDING SITE I, BINDING SITE II and BINDING SITE III, inhibits translation of VGAM1517 host target RNA into VGAM1517 host target protein, herein designated VGAM HOST TARGET PROTEIN. VGAM host target protein is therefore outlined by a broken line.

It is appreciated that VGAM1517 host target gene, herein designated VGAM HOST TARGET GENE, in fact represents a plurality of VGAM1517 host target genes. The mRNA of each one of this plurality of VGAM1517 host target genes comprises one or more host target binding sites, each having a nucleotide sequence which is at least partly complementary to VGAM1517 RNA, herein designated VGAM RNA, and which when bound by VGAM1517 RNA causes inhibition of translation of respective one or more VGAM1517 host target proteins.

It is further appreciated by one skilled in the art that the mode of translational inhibition illustrated by FIG. 1 with specific reference to translational inhibition exerted by VGAM1517 gene, herein designated VGAM GENE, on one or more VGAM1517 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1517 is inhibition of expression of host target genes, as part of a novel viral mechanism of attacking a host. Accordingly, utilities of VGAM1517 include diagnosis, prevention and treatment of viral infection by Pea Seed-borne Mosaic Virus. Specific functions, and accordingly utilities, of VGAM1517 correlate with, and may be deduced from, the identity of the host target genes which VGAM1517 binds and inhibits, and the function of these host target genes, as elaborated hereinbelow.

Nucleotide sequences of the VGAM1517 precursor RNA, herein designated VGAM PRECURSOR RNA, and of the 'diced' VGAM1517 RNA, herein designated VGAM RNA, and a schematic representation of the secondary folding of VGAM1517 folded precursor RNA, herein designated VGAM FOLDED PRECURSOR RNA, of VGAM1517 are further described hereinbelow with reference to Table 1.

Nucleotide sequences of host target binding sites, such as BINDING SITE-I, BINDING SITE-II and BINDING SITE-III of FIG. 1, found on VGAM1517 host target RNA, and schematic representation of the complementarity of each of these host target binding sites to VGAM1517 RNA, herein designated VGAM RNA, are described hereinbelow with reference to Table 2.

As mentioned hereinabove with reference to FIG. 1, a function of VGAM1517 gene, herein designated VGAM is inhibition of expression of VGAM1517 target genes. It is appreciated that specific functions, and accordingly utilities, of VGAM1517 correlate with, and may be deduced from, the identity of the target genes which VGAM1517 binds and inhibits, and the function of these target genes, as elaborated hereinbelow.

Keratin 16 (focal non-epidermolytic palmoplantar keratoderma) (KRT16, Accession XM_170845) is a VGAM1517 host target gene. KRT16 BINDING SITE is HOST TARGET binding site found in the 5' untranslated region of mRNA encoded by KRT16, corresponding to a HOST TARGET binding site such as BINDING SITE I, BINDING SITE II or BINDING SITE III. Table 2 illustrates the complementarity of the nucleotide sequences of KRT16 BINDING SITE, designated SEQ ID:45627, to the nucleotide sequence of VGAM1517 RNA, herein designated VGAM RNA, also designated SEQ ID:4228.

A function of VGAM1517 is therefore inhibition of Keratin 16 (focal non-epidermolytic palmoplantar keratoderma) (KRT16, Accession XM_170845). Accordingly, utilities of VGAM1517 include diagnosis, prevention and treatment of diseases and clinical conditions associated with KRT16. MGC3248 (Accession NM_032486) is another VGAM1517 host target gene. MGC3248 BINDING SITE is HOST TARGET binding site found in the 3" untranslated region of mRNA encoded by MGC3248, corresponding to a HOST TARGET binding site such as BINDING SITE I, BINDING SITE II or BINDING SITE III. Table 2 illustrates the complementarity of the nucleotide sequences of MGC3248 BINDING SITE, designated SEQ ID:26234, to the nucleotide sequence of VGAM1517 RNA, herein designated VGAM RNA, also designated SEQ ID:4228.

Another function of VGAM1517 is therefore inhibition of MGC3248 (Accession NM_032486). Accordingly, utilities of VGAM1517 include diagnosis, prevention and treatment of diseases and clinical conditions associated with MGC3248. LOC146515 (Accession XM_085493) is another VGAM1517 host target gene. LOC146515 BINDING SITE is HOST TARGET binding site found in the 5' untranslated region of mRNA encoded by LOC146515, corresponding to a HOST TARGET binding site such as BINDING SITE I, BINDING SITE II or BINDING SITE III. Table 2 illustrates the complementarity of the nucleotide sequences of LOC146515 BINDING SITE, designated SEQ ID:38192, to the nucleotide sequence of VGAM1517 RNA, herein designated VGAM RNA, also designated SEQ ID:4228.

Another function of VGAM1517 is therefore inhibition of LOC146515 (Accession XM_085493). Accordingly, utilities of VGAM1517 include diagnosis, prevention and treatment of diseases and clinical conditions associated with LOC146515. LOC158301 (Accession XM_088543) is another VGAM1517 host target gene. LOC158301 BINDING SITE is HOST TARGET binding site found in the 3' untranslated region of mRNA encoded by LOC158301, corresponding to a HOST TARGET binding site such as BINDING SITE I, BINDING SITE II or BINDING SITE III. Table 2 illustrates the complementarity of the nucleotide sequences of LOC158301 BINDING SITE, designated SEQ ID:39809, to the nucleotide sequence of VGAM1517 RNA, herein designated VGAM RNA, also designated SEQ ID:4228.

Another function of VGAM1517 is therefore inhibition of LOC158301 (Accession XM_088543). Accordingly, utilities of VGAM1517 include diagnosis, prevention and treatment of diseases and clinical conditions associated with LOC158301. FIG. 1 further provides a conceptual description of a novel bioinformatically detected viral gene of the present invention, referred to here as Viral Genomic Address Messenger 1518 (VGAM1518) viral gene, which modulates expression of respective host target genes thereof, the function and utility of which host target genes is known in the art.

VGAM1518 is a novel bioinformatically detected regulatory, non protein coding, viral micro RNA (miRNA) gene. The method by which VGAM1518 was detected is described hereinabove with reference to FIGS. 1-8.

VGAM1518 gene, herein designated VGAM GENE, is a viral gene contained in the genome of Pea Seed-borne Mosaic Virus. VGAM1518 host target gene, herein designated VGAM HOST TARGET GENE, is a human gene contained in the human genome.

VGAM1518 gene encodes a VGAM1518 precursor RNA, herein designated VGAM PRECURSOR RNA. Similar to other miRNA genes, and unlike most ordinary genes, VGAM1518 precursor RNA does not encode a protein. A nucleotide sequence identical or highly similar to the nucleotide sequence of VGAM1518 precursor RNA is designated SEQ ID:1504, and is provided hereinbelow with reference to the sequence listing part. Nucleotide sequence SEQ ID:1504 is located at position 9398 relative to the genome of Pea Seed-borne Mosaic Virus.

VGAM1518 precursor RNA folds onto itself, forming VGAM1518 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1518 folded precursor RNA into VGAM1518 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM1518 RNA is designated SEQ ID:4229, and is provided hereinbelow with reference to the sequence listing part.

VGAM1518 host target gene, herein designated VGAM HOST TARGET GENE, encodes a corresponding messenger RNA, VGAM1518 host target RNA, herein designated VGAM HOST TARGET RNA. VGAM1518 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1518 RNA, herein designated VGAM RNA, binds complementarily to one or more host target binding sites located in untranslated regions of VGAM1518 host target RNA, herein designated VGAM HOST TARGET RNA. This complementary binding is due to the fact that the nucleotide sequence of VGAM1518 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1518 RNA, herein designated VGAM RNA, may have a different number of host target binding sites in untranslated regions of a VGAM1518 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1518 RNA, herein designated VGAM RNA, to host target binding sites on VGAM1518 host target RNA, herein designated VGAM HOST TARGET RNA, such as BINDING SITE I, BINDING SITE II and BINDING SITE III, inhibits translation of VGAM1518 host target RNA into VGAM1518 host target protein, herein designated VGAM HOST TARGET PROTEIN. VGAM host target protein is therefore outlined by a broken line.

It is appreciated that VGAM1518 host target gene, herein designated VGAM HOST TARGET GENE, in fact represents a plurality of VGAM1518 host target genes. The mRNA of each one of this plurality of VGAM1518 host target genes comprises one or more host target binding sites, each having a nucleotide sequence which is at least partly complementary to VGAM1518 RNA, herein designated VGAM RNA, and which when bound by VGAM1518 RNA causes inhibition of translation of respective one or more VGAM1518 host target proteins.

It is further appreciated by one skilled in the art that the mode of translational inhibition illustrated by FIG. 1 with specific reference to translational inhibition exerted by VGAM1518 gene, herein designated VGAM GENE, on one or more VGAM1518 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1518 is inhibition of expression of host target genes, as part of a novel viral mechanism of attacking a host. Accordingly, utilities of VGAM1518 include diagnosis, prevention and treatment of viral infection by Pea Seed-borne Mosaic Virus. Specific functions, and accordingly utilities, of VGAM1518 correlate with, and may be deduced from, the identity of the host target genes which VGAM1518 binds and inhibits, and the function of these host target genes, as elaborated hereinbelow.

Nucleotide sequences of the VGAM1518 precursor RNA, herein designated VGAM PRECURSOR RNA, and of the 'diced' VGAM1518 RNA, herein designated VGAM RNA, and a schematic representation of the secondary folding of VGAM1518 folded precursor RNA, herein designated VGAM FOLDED PRECURSOR RNA, of VGAM1518 are further described hereinbelow with reference to Table 1.

Nucleotide sequences of host target binding sites, such as BINDING SITE-I, BINDING SITE-II and BINDING SITE-III of FIG. 1, found on VGAM1518 host target RNA, and schematic representation of the complementarity of each of these host target binding sites to VGAM1518 RNA, herein designated VGAM RNA, are described hereinbelow with reference to Table 2.

As mentioned hereinabove with reference to FIG. 1, a function of VGAM1518 gene, herein designated VGAM is inhibition of expression of VGAM1518 target genes. It is appreciated that specific functions, and accordingly utilities, of VGAM1518 correlate with, and may be deduced from, the identity of the target genes which VGAM1518 binds and inhibits, and the function of these target genes, as elaborated hereinbelow.

DNA (cytosine-5-)-methyltransferase 3 Beta (DNMT3B, Accession NM_006892) is a VGAM1518 host target gene. DNMT3B BINDING SITE is HOST TARGET binding site found in the 3' untranslated region of mRNA encoded by DNMT3B, corresponding to a HOST TARGET binding site such as BINDING SITE I, BINDING SITE II or BINDING SITE III. Table 2 illustrates the complementarity of the nucleotide sequences of DNMT3B BINDING SITE, designated SEQ ID:13761, to the nucleotide sequence of VGAM1518 RNA, herein designated VGAM RNA, also designated SEQ ID:4229.

A function of VGAM1518 is therefore inhibition of DNA (cytosine-5-)-methyltransferase 3 Beta (DNMT3B, Accession NM_006892), a gene which is required for genome wide de novo methylation. Accordingly, utilities of VGAM1518 include diagnosis, prevention and treatment of diseases and clinical conditions associated with DNMT3B. The function of DNMT3B and its association with various diseases and clinical conditions, has been established by previous studies, as described hereinabove with reference to VGAM280. Sialyltransferase 8C (alpha2,3Galbeta1,4GlcNAcalpha 2,8-sialyl transferase) (SIAT8C, Accession NM_015879) is another VGAM1518 host target gene. SIAT8C BINDING SITE is HOST TARGET binding site found in the 5' untranslated region of mRNA encoded by SIAT8C, corresponding to a HOST TARGET binding site such as BINDING SITE I, BINDING SITE II or BINDING SITE III. Table 2 illustrates the complementarity of the nucleotide sequences of SIAT8C BINDING SITE, designated SEQ ID:18025, to the nucleotide sequence of VGAM1518 RNA, herein designated VGAM RNA, also designated SEQ ID:4229.

Another function of VGAM1518 is therefore inhibition of Sialyltransferase 8C (alpha2,3Galbeta1,4GlcNAcalpha 2,8-sialyl transferase) (SIAT8C, Accession NM_015879). Accordingly, utilities of VGAM1518 include diagnosis, prevention and treatment of diseases and clinical conditions associated with SIAT8C. LOC149301 (Accession XM_086480) is another VGAM1518 host target gene. LOC149301 BINDING SITE is HOST TARGET binding site found in the 3' untranslated region of mRNA encoded by LOC149301, corresponding to a HOST TARGET binding site such as BINDING SITE I, BINDING SITE II or BINDING SITE III. Table 2 illustrates the complementarity of the nucleotide sequences of LOC149301 BINDING SITE, designated SEQ ID:38691, to the nucleotide sequence of VGAM1518 RNA, herein designated VGAM RNA, also designated SEQ ID:4229.

Another function of VGAM1518 is therefore inhibition of LOC149301 (Accession XM_086480). Accordingly, utilities of VGAM1518 include diagnosis, prevention and treatment of diseases and clinical conditions associated with LOC149301. FIG. 1 further provides a conceptual description of a novel bioinformatically detected viral gene of the present invention, referred to here as Viral Genomic Address Messenger 1519 (VGAM1519) viral gene, which modulates expression of respective host target genes thereof, the function and utility of which host target genes is known in the art.

VGAM1519 is a novel bioinformatically detected regulatory, non protein coding, viral micro RNA (miRNA) gene. The method by which VGAM1519 was detected is described hereinabove with reference to FIGS. 1-8.

VGAM1519 gene, herein designated VGAM GENE, is a viral gene contained in the genome of Pea Seed-borne Mosaic Virus. VGAM1519 host target gene, herein designated VGAM HOST TARGET GENE, is a human gene contained in the human genome.

VGAM1519 gene encodes a VGAM1519 precursor RNA, herein designated VGAM PRECURSOR RNA. Similar to other miRNA genes, and unlike most ordinary genes, VGAM1519 precursor RNA does not encode a protein. A nucleotide sequence identical or highly similar to the nucleotide sequence of VGAM1519 precursor RNA is designated SEQ ID:1505, and is provided hereinbelow with reference to the sequence listing part. Nucleotide sequence SEQ ID:1505 is located at position 3823 relative to the genome of Pea Seed-borne Mosaic Virus.

VGAM1519 precursor RNA folds onto itself, forming VGAM1519 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1519 folded precursor RNA into VGAM1519 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1519 RNA is designated SEQ ID:4230, and is provided hereinbelow with reference to the sequence listing part.

VGAM1519 host target gene, herein designated VGAM HOST TARGET GENE, encodes a corresponding messenger RNA, VGAM1519 host target RNA, herein designated VGAM HOST TARGET RNA. VGAM1519 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1519 RNA, herein designated VGAM RNA, binds complementarily to one or more host target binding sites located in untranslated regions of VGAM1519 host target RNA, herein designated VGAM HOST TARGET RNA. This complementary binding is due to the fact that the nucleotide sequence of VGAM1519 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1519 RNA, herein designated VGAM RNA, may have a different number of host target binding sites in untranslated regions of a VGAM1519 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1519 RNA, herein designated VGAM RNA, to host target binding sites on VGAM1519 host target RNA, herein designated VGAM HOST TARGET RNA, such as BINDING SITE I, BINDING SITE II and BINDING SITE III, inhibits translation of VGAM1519 host target RNA into VGAM1519 host target protein, herein designated VGAM HOST TARGET PROTEIN. VGAM host target protein is therefore outlined by a broken line.

It is appreciated that VGAM1519 host target gene, herein designated VGAM HOST TARGET GENE, in fact represents a plurality of VGAM1519 host target genes. The mRNA of each one of this plurality of VGAM1519 host target genes comprises one or more host target binding sites, each having a nucleotide sequence which is at least partly complementary to VGAM1519 RNA, herein designated VGAM RNA, and which when bound by VGAM1519 RNA causes inhibition of translation of respective one or more VGAM1519 host target proteins.

It is further appreciated by one skilled in the art that the mode of translational inhibition illustrated by FIG. 1 with specific reference to translational inhibition exerted by VGAM1519 gene, herein designated VGAM GENE, on one or more VGAM1519 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1519 is inhibition of expression of host target genes, as part of a novel viral mechanism of attacking a host. Accordingly, utilities of VGAM1519 include diagnosis, prevention and treatment of viral infection by Pea Seed-borne Mosaic Virus. Specific functions, and accordingly utilities, of VGAM1519 correlate with, and may be deduced from, the identity of the host target genes which VGAM1519 binds and inhibits, and the function of these host target genes, as elaborated hereinbelow.

Nucleotide sequences of the VGAM1519 precursor RNA, herein designated VGAM PRECURSOR RNA, and of the 'diced' VGAM1519 RNA, herein designated VGAM RNA, and a schematic representation of the secondary folding of VGAM1519 folded precursor RNA, herein designated VGAM FOLDED PRECURSOR RNA, of VGAM1519 are further described hereinbelow with reference to Table 1.

Nucleotide sequences of host target binding sites, such as BINDING SITE-I, BINDING SITE-II and BINDING SITE-III of FIG. 1, found on VGAM1519 host target RNA, and schematic representation of the complementarity of each of these host target binding sites to VGAM1519 RNA, herein designated VGAM RNA, are described hereinbelow with reference to Table 2.

As mentioned hereinabove with reference to FIG. 1, a function of VGAM1519 gene, herein designated VGAM is inhibition of expression of VGAM1519 target genes. It is appreciated that specific functions, and accordingly utilities, of VGAM1519 correlate with, and may be deduced from, the identity of the target genes which VGAM1519 binds and inhibits, and the function of these target genes, as elaborated hereinbelow.

Amyloid Beta Precursor Protein (cytoplasmic tail) Binding Protein 2 (APPBP2, Accession NM_006380) is a VGAM1519 host target gene. APPBP2 BINDING SITE is HOST TARGET binding site found in the 3' untranslated region of mRNA encoded by APPBP2, corresponding to a HOST TARGET binding site such as BINDING SITE I, BINDING SITE II or BINDING SITE III. Table 2 illustrates the complementarity of the nucleotide sequences of APPBP2 BINDING SITE, designated SEQ ID:13082, to the nucleotide sequence of VGAM1519 RNA, herein designated VGAM RNA, also designated SEQ ID:4230.

A function of VGAM1519 is therefore inhibition of Amyloid Beta Precursor Protein (cytoplasmic tail) Binding Protein 2 (APPBP2, Accession NM_006380), a gene which interacts with the basolateral sorting signal of amyloid precursor protein. Accordingly, utilities of VGAM1519 include diagnosis, prevention and treatment of diseases and clinical conditions associated with APPBP2. The function of APPBP2 and its association with various diseases and clinical conditions, has been established by previous studies, as described hereinabove with reference to VGAM525. Dedicator of Cyto-kinesis 1 (DOCK1, Accession NM_001380) is another VGAM1519 host target gene. DOCK1 BINDING SITE is HOST TARGET binding site found in the 3' untranslated region of mRNA encoded by DOCK1, corresponding to a HOST TARGET binding site such as BINDING SITE I, BINDING SITE II or BINDING SITE III. Table 2 illustrates the complementarity of the nucleotide sequences of DOCK1 BINDING SITE, designated SEQ ID:7051, to the nucleotide sequence of VGAM1519 RNA, herein designated VGAM RNA, also designated SEQ ID:4230.

Another function of VGAM1519 is therefore inhibition of Dedicator of Cyto-kinesis 1 (DOCK1, Accession NM_001380), a gene which may function in the extension of cell surfaces. Accordingly, utilities of VGAM1519 include diagnosis, prevention and treatment of diseases and clinical conditions associated with DOCK1. The function of DOCK1 and its association with various diseases and clinical conditions, has been established by previous studies, as described hereinabove with reference to VGAM564. Fucosyltransferase 5 (alpha (1,3) Fucosyltransferase) (FUT5, Accession NM_002034) is another VGAM1519 host target gene. FUT5 BINDING SITE is HOST TARGET binding site found in the 3' untranslated region of mRNA encoded by FUT5, corresponding to a HOST TARGET binding site such as BINDING SITE I, BINDING SITE II or BINDING SITE III. Table 2 illustrates the complementarity of the nucleotide sequences of FUT5 BINDING SITE, designated SEQ ID:7788, to the nucleotide sequence of VGAM1519 RNA, herein designated VGAM RNA, also designated SEQ ID:4230.

Another function of VGAM1519 is therefore inhibition of Fucosyltransferase 5 (alpha (1,3) Fucosyltransferase) (FUT5, Accession NM_002034), a gene which may catalyse alpha-1,3 glycosidic linkages involved in the expression of vim-2, lewis x/ssea-1 and sialyl lewis x antigens. Accordingly, utilities of VGAM1519 include diagnosis, prevention and treatment of diseases and clinical conditions associated with FUT5. The function of FUT5 has been established by previous studies. Weston et al. (1992) isolated a human alpha-3-fucosyltransferase gene homologous to but distinct from 2 previously reported fucosyltransferase genes: alpha-3,4-fucosyltransferase, thought to represent the human Lewis blood group locus (FUT3; 111100), and an alpha-3-fucosyltransferase expressed in the myeloid lineage (FUT4; 104230). The new enzyme shared 91% amino acid sequence identity with the Lewis blood group fucosyltransferase, yet exhibited only trace amounts of alpha-4-fucosyltransferase activity. By PCR analysis of somatic cell hybrid DNAs, Weston et al. (1992) demonstrated that the gene is located on chromosome 19. They concluded that the gene encodes a 'plasma type' of alpha-3-fucosyltransferase. McCurley et al. (1995) mapped FUT5 to 19p13.3 by fluorescence in situ hybridization using cosmids containing FUT6 (OMIM Ref. No. 136836) and FUT5. The results indicated that FUT6 lies approximately 70 kb telomeric of FUT5. McCurley et al. (1995) used conventional and pulsed field gel electrophoresis mapping to total genomic DNA and large genomic clones in order to generate a fine map of the cluster of 19p FUT genes. A P1 clone indicated the gene order: cen--FUT5--FUT3--FUT6--tel. FUT5 and FUT3 are separated by 23 kb and FUT3 and FUT6 are separated by 14 kb; these data placed FUT5 and FUT6 closer together than was estimated by fluorescence in situ hybridization. The close proximity and tandem orientation of the 3 genes suggests coordinate regulation. The direction of transcription is toward the telomere in the case of all 3 genes Full details of the abovementioned studies are described in the following publications, the disclosure of which are hereby incorporated by reference:

McCurley, R. S.; Recinos, A., III; Olsen, A. S.; Gingrich, J. C.; Szczepaniak, D.; Cameron, H. S.; Krauss, R.; Weston, B. W.: Physical maps of human alpha (1,3) fucosyltransferase genes FUT3-FUT6 on chromosomes 19p13.3 and 11q21. Genomics 26:142-146, 1995; and Weston, B. W.; Nair, R. P.; Larsen, R. D.; Lowe, J. B.: Isolation of a novel human alpha (1,3) fucosyltransferase gene and molecular comparison to the human Lewis blood group alpha (1,3/1.

Further studies establishing the function and utilities of FUT5 are found in John Hopkins OMIM database record ID 136835, and in sited publications numbered 2177-2179 listed in the bibliography section hereinbelow, which are also hereby incorporated by reference. Protocadherin Beta 16 (PCDHB16, Accession NM_020957) is another VGAM1519 host target gene. PCDHB16 BINDING SITE is HOST TARGET binding site found in the 5' untranslated region of mRNA encoded by PCDHB16, corresponding to a HOST TARGET binding site such as BINDING SITE I, BINDING SITE II or BINDING SITE III. Table 2 illustrates the complementarity of the nucleotide sequences of PCDHB16 BINDING SITE, designated SEQ ID:21947, to the nucleotide sequence of VGAM1519 RNA, herein designated VGAM RNA, also designated SEQ ID:4230.

Another function of VGAM1519 is therefore inhibition of Protocadherin Beta 16 (PCDHB16, Accession NM_020957), a gene which is a potential calcium-dependent cell-adhesion protein. Accordingly, utilities of VGAM1519 include diagnosis, prevention and treatment of diseases and clinical conditions associated with PCDHB16. The function of PCDHB16 and its association with various diseases and clinical conditions, has been established by previous studies, as described hereinabove with reference to VGAM931. Peptidylprolyl Isomerase (cyclophilin)-like 1 (PPIL1, Accession NM_016059) is another VGAM1519 host target gene. PPIL1 BINDING SITE is HOST TARGET binding site found in the 3' untranslated region of mRNA encoded by PPIL1, corresponding to a HOST TARGET binding site such as BINDING SITE I, BINDING SITE II or BINDING SITE III. Table 2 illustrates the complementarity of the nucleotide sequences of PPIL1 BINDING SITE, designated SEQ ID:18134, to the nucleotide sequence of VGAM1519 RNA, herein designated VGAM RNA, also designated SEQ ID:4230.

Another function of VGAM1519 is therefore inhibition of Peptidylprolyl Isomerase (cyclophilin)-like 1 (PPIL1, Accession NM_016059), a gene which catalyzes the cis-trans isomerization of proline imidic peptide bonds in oligopeptides. Accordingly, utilities of VGAM1519 include diagnosis, prevention and treatment of diseases and clinical conditions associated with PPIL1. The function of PPIL1 and its association with various diseases and clinical conditions, has been established by previous studies, as described hereinabove with reference to VGAM1135. Ret Proto-oncogene (multiple endocrine neoplasia and medullary thyroid carcinoma 1, Hirschsprung disease) (RET, Accession NM_020630) is another VGAM1519 host target gene. RET BINDING SITE1 and RET BINDING SITE2 are HOST TARGET binding sites found in untranslated regions of mRNA encoded by RET, corresponding to HOST TARGET binding sites such as BINDING SITE I, BINDING SITE II or BINDING SITE III. Table 2 illustrates the complementarity of the nucleotide sequences of RET BINDING SITE1 and RET BINDING SITE2, designated SEQ ID:21788 and SEQ ID:21962 respectively, to the nucleotide sequence of VGAM1519 RNA, herein designated VGAM RNA, also designated SEQ ID:4230.

Another function of VGAM1519 is therefore inhibition of Ret Proto-oncogene (multiple endocrine neoplasia and medullary thyroid carcinoma 1, Hirschsprung disease) (RET, Accession NM_020630), a gene which transduces signals for cell growth and differentiation. Accordingly, utilities of VGAM1519 include diagnosis, prevention and treatment of diseases and clinical conditions associated with RET. The function of RET and its association with various diseases and clinical conditions, has been established by previous studies, as described hereinabove with reference to VGAM381. DKFZp762A227 (Accession NM_014096) is another VGAM1519 host target gene. DKFZp762A227 BINDING SITE1 and DKFZp762A227 BINDING SITE2 are HOST TARGET binding sites found in untranslated regions of mRNA encoded by DKFZp762A227, corresponding to HOST TARGET binding sites such as BINDING SITE I, BINDING SITE II or BINDING SITE III. Table 2 illustrates the complementarity of the nucleotide sequences of DKFZp762A227 BINDING SITE1 and DKFZp762A227 BINDING SITE2, designated SEQ ID:15320 and SEQ ID:19108 respectively, to the nucleotide sequence of VGAM1519 RNA, herein designated VGAM RNA, also designated SEQ ID:4230.

Another function of VGAM1519 is therefore inhibition of DKFZp762A227 (Accession NM_014096). Accordingly, utilities of VGAM1519 include diagnosis, prevention and treatment of diseases and clinical conditions associated with DKFZp762A227. FLJ14146 (Accession NM_024709) is another VGAM1519 host target gene. FLJ14146 BINDING SITE is HOST TARGET binding site found in the 3' untranslated region of mRNA encoded by FLJ14146, corresponding to a HOST TARGET binding site such as BINDING SITE I, BINDING SITE II or BINDING SITE III. Table 2 illustrates the complementarity of the nucleotide sequences of FLJ14146 BINDING SITE, designated SEQ ID:24031, to the nucleotide sequence of VGAM1519 RNA, herein designated VGAM RNA, also designated SEQ ID:4230.

Another function of VGAM1519 is therefore inhibition of FLJ14146 (Accession NM_024709). Accordingly, utilities of VGAM1519 include diagnosis, prevention and treatment of diseases and clinical conditions associated with FLJ14146. FLJ20449 (Accession NM_017826) is another VGAM1519 host target gene. FLJ20449 BINDING SITE is HOST TARGET binding site found in the 3' untranslated region of mRNA encoded by FLJ20449, corresponding to a HOST TARGET binding site such as BINDING SITE I, BINDING SITE II or BINDING SITE III. Table 2 illustrates the complementarity of the nucleotide sequences of FLJ20449 BINDING SITE, designated SEQ ID:19488, to the nucleotide sequence of VGAM1519 RNA, herein designated VGAM RNA, also designated SEQ ID:4230.

Another function of VGAM1519 is therefore inhibition of FLJ20449 (Accession NM_017826). Accordingly, utilities of VGAM1519 include diagnosis, prevention and treatment of diseases and clinical conditions associated with FLJ20449. FLJ23548 (Accession NM_024590) is another VGAM1519 host target gene. FLJ23548 BINDING SITE is HOST TARGET binding site found in the 3' untranslated region of mRNA encoded by FLJ23548, corresponding to a HOST TARGET binding site such as BINDING SITE I, BINDING SITE II or BINDING SITE III. Table 2 illustrates the complementarity of the nucleotide sequences of FLJ23548 BINDING SITE, designated SEQ ID:23824, to the nucleotide sequence of VGAM1519 RNA, herein designated VGAM RNA, also designated SEQ ID:4230.

Another function of VGAM1519 is therefore inhibition of FLJ23548 (Accession NM_024590). Accordingly, utilities of VGAM1519 include diagnosis, prevention and treatment of diseases and clinical conditions associated with FLJ23548. KIAA0016 (Accession NM_014765) is another VGAM1519 host target gene. KIAA0016 BINDING SITE is HOST TARGET binding site found in the 3' untranslated region of mRNA encoded by KIAA0016, corresponding to a HOST TARGET binding site such as BINDING SITE I, BINDING SITE II or BINDING SITE III. Table 2 illustrates the complementarity of the nucleotide sequences of KIAA0016 BINDING SITE, designated SEQ ID:16531, to the nucleotide sequence of VGAM1519 RNA, herein designated VGAM RNA, also designated SEQ ID:4230.

Another function of VGAM1519 is therefore inhibition of KIAA0016 (Accession NM_014765). Accordingly, utilities of VGAM1519 include diagnosis, prevention and treatment of diseases and clinical conditions associated with KIAA0016. KIAA1600 (Accession XM_049351) is another VGAM1519 host target gene. KIAA1600 BINDING SITE is HOST TARGET binding site found in the 3' untranslated region of mRNA encoded by KIAA1600, corresponding to a HOST TARGET binding site such as BINDING SITE I, BINDING SITE II or BINDING SITE III. Table 2 illustrates the complementarity of the nucleotide sequences of KIAA1600 BINDING SITE, designated SEQ ID:35394, to the nucleotide sequence of VGAM1519 RNA, herein designated VGAM RNA, also designated SEQ ID:4230.

Another function of VGAM1519 is therefore inhibition of KIAA1600 (Accession XM_049351). Accordingly, utilities of VGAM1519 include diagnosis, prevention and treatment of diseases and clinical conditions associated with KIAA1600. MGC11287 (Accession NM_031464) is another VGAM1519 host target gene. MGC11287 BINDING SITE is HOST TARGET binding site found in the 3' untranslated region of mRNA encoded by MGC11287, corresponding to a HOST TARGET binding site such as BINDING SITE I, BINDING SITE II or BINDING SITE III. Table 2 illustrates the complementarity of the nucleotide sequences of MGC11287 BINDING SITE, designated SEQ ID:25501, to the nucleotide sequence of VGAM1519 RNA, herein designated VGAM RNA, also designated SEQ ID:4230.

Another function of VGAM1519 is therefore inhibition of MGC11287 (Accession NM_031464). Accordingly, utilities of VGAM1519 include diagnosis, prevention and treatment of diseases and clinical conditions associated with MGC11287. MGC17330 (Accession NM_052880) is another VGAM1519 host target gene. MGC17330 BINDING SITE is HOST TARGET binding site found in the 3' untranslated region of mRNA encoded by MGC17330, corresponding to a HOST TARGET binding site such as BINDING SITE I, BINDING SITE II or BINDING SITE III. Table 2 illustrates the complementarity of the nucleotide sequences of MGC17330 BINDING SITE, designated SEQ ID:27461, to the nucleotide sequence of VGAM1519 RNA, herein designated VGAM RNA, also designated SEQ ID:4230.

Another function of VGAM1519 is therefore inhibition of MGC17330 (Accession NM_052880). Accordingly, utilities of VGAM1519 include diagnosis, prevention and treatment of diseases and clinical conditions associated with MGC17330. LOC116068 (Accession XM_057302) is another VGAM1519 host target gene. LOC116068 BINDING SITE is HOST TARGET binding site found in the 3' untranslated region of mRNA encoded by LOC116068, corresponding to a HOST TARGET binding site such as BINDING SITE I, BINDING SITE II or BINDING SITE III. Table 2 illustrates the complementarity of the nucleotide sequences of LOC116068 BINDING SITE, designated SEQ ID:36502, to the nucleotide sequence of VGAM1519 RNA, herein designated VGAM RNA, also designated SEQ ID:4230.

Another function of VGAM1519 is therefore inhibition of LOC116068 (Accession XM_057302). Accordingly, utilities of VGAM1519 include diagnosis, prevention and treatment of diseases and clinical conditions associated with LOC116068. LOC202754 (Accession XM_095123) is another VGAM1519 host target gene. LOC202754 BINDING SITE is HOST TARGET binding site found in the 3' untranslated region of mRNA encoded by LOC202754, corresponding to a HOST TARGET binding site such as BINDING SITE I, BINDING SITE II or BINDING SITE III. Table 2 illustrates the complementarity of the nucleotide sequences of LOC202754 BINDING SITE, designated SEQ ID:40248, to the nucleotide sequence of VGAM1519 RNA, herein designated VGAM RNA, also designated SEQ ID:4230.

Another function of VGAM1519 is therefore inhibition of LOC202754 (Accession XM_095123). Accordingly, utilities of VGAM1519 include diagnosis, prevention and treatment of diseases and clinical conditions associated with LOC202754. LOC90826 (Accession XM_034321) is another VGAM1519 host target gene. LOC90826 BINDING SITE is HOST TARGET binding site found in the 5' untranslated region of mRNA encoded by LOC90826, corresponding to a HOST TARGET binding site such as BINDING SITE I, BINDING SITE II or BINDING SITE III. Table 2 illustrates the complementarity of the nucleotide sequences of LOC90826 BINDING SITE, designated SEQ ID:32052, to the nucleotide sequence of VGAM1519 RNA, herein designated VGAM RNA, also designated SEQ ID:4230.

Another function of VGAM1519 is therefore inhibition of LOC90826 (Accession XM_034321). Accordingly, utilities of VGAM1519 include diagnosis, prevention and treatment of diseases and clinical conditions associated with LOC90826. FIG. 1 further provides a conceptual description of a novel bioinformatically detected viral gene of the present invention, referred to here as Viral Genomic Address Messenger 1520 (VGAM1520) viral gene, which modulates expression of respective host target genes thereof, the function and utility of which host target genes is known in the art.

VGAM1520 is a novel bioinformatically detected regulatory, non protein coding, viral micro RNA (miRNA) gene. The method by which VGAM1520 was detected is described hereinabove with reference to FIGS. 1-8.

VGAM1520 gene, herein designated VGAM GENE, is a viral gene contained in the genome of Ectromelia Virus. VGAM1520 host target gene, herein designated VGAM HOST TARGET GENE, is a human gene contained in the human genome.

VGAM1520 gene encodes a VGAM1520 precursor RNA, herein designated VGAM PRECURSOR RNA. Similar to other miRNA genes, and unlike most ordinary genes, VGAM1520 precursor RNA does not encode a protein. A nucleotide sequence identical or highly similar to the nucleotide sequence of VGAM1520 precursor RNA is designated SEQ ID:1506, and is provided hereinbelow with reference to the sequence listing part. Nucleotide sequence SEQ ID:1506 is located at position 74844 relative to the genome of Ectromelia Virus.

VGAM1520 precursor RNA folds onto itself, forming VGAM1520 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1520 folded precursor RNA into VGAM1520 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1520 RNA is designated SEQ ID:4231, and is provided hereinbelow with reference to the sequence listing part.

VGAM1520 host target gene, herein designated VGAM HOST TARGET GENE, encodes a corresponding messenger RNA, VGAM1520 host target RNA, herein designated VGAM HOST TARGET RNA. VGAM1520 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1520 RNA, herein designated VGAM RNA, binds complementarily to one or more host target binding sites located in untranslated regions of VGAM1520 host target RNA, herein designated VGAM HOST TARGET RNA. This complementary binding is due to the fact that the nucleotide sequence of VGAM1520 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1520 RNA, herein designated VGAM RNA, may have a different number of host target binding sites in untranslated regions of a VGAM1520 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1520 RNA, herein designated VGAM RNA, to host target binding sites on VGAM1520 host target RNA, herein designated VGAM HOST TARGET RNA, such as BINDING SITE I, BINDING SITE II and BINDING SITE III, inhibits translation of VGAM1520 host target RNA into VGAM1520 host target protein, herein designated VGAM HOST TARGET PROTEIN. VGAM host target protein is therefore outlined by a broken line.

It is appreciated that VGAM1520 host target gene, herein designated VGAM HOST TARGET GENE, in fact represents a plurality of VGAM1520 host target genes. The mRNA of each one of this plurality of VGAM1520 host target genes comprises one or more host target binding sites, each having a nucleotide sequence which is at least partly complementary to VGAM1520 RNA, herein designated VGAM RNA, and which when bound by VGAM1520 RNA causes inhibition of translation of respective one or more VGAM1520 host target proteins.

It is further appreciated by one skilled in the art that the mode of translational inhibition illustrated by FIG. 1 with specific reference to translational inhibition exerted by VGAM1520 gene, herein designated VGAM GENE, on one or more VGAM1520 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1520 is inhibition of expression of host target genes, as part of a novel viral mechanism of attacking a host. Accordingly, utilities of VGAM1520 include diagnosis, prevention and treatment of viral infection by Ectromelia Virus. Specific functions, and accordingly utilities, of VGAM1520 correlate with, and may be deduced from, the identity of the host target genes which VGAM1520 binds and inhibits, and the function of these host target genes, as elaborated hereinbelow.

Nucleotide sequences of the VGAM1520 precursor RNA, herein designated VGAM PRECURSOR RNA, and of the 'diced' VGAM1520 RNA, herein designated VGAM RNA, and a schematic representation of the secondary folding of VGAM1520 folded precursor RNA, herein designated VGAM FOLDED PRECURSOR RNA, of VGAM1520 are further described hereinbelow with reference to Table 1.

Nucleotide sequences of host target binding sites, such as BINDING SITE-I, BINDING SITE-II and BINDING SITE-III of FIG. 1, found on VGAM1520 host target RNA, and schematic representation of the complementarity of each of these host target binding sites to VGAM1520 RNA, herein designated VGAM RNA, are described hereinbelow with reference to Table 2.

As mentioned hereinabove with reference to FIG. 1, a function of VGAM1520 gene, herein designated VGAM is inhibition of expression of VGAM1520 target genes. It is appreciated that specific functions, and accordingly utilities, of VGAM1520 correlate with, and may be deduced from, the identity of the target genes which VGAM1520 binds and inhibits, and the function of these target genes, as elaborated hereinbelow.

High-mobility Group Box 3 (HMGB3, Accession NM_005342) is a VGAM1520 host target gene. HMGB3 BINDING SITE is HOST TARGET binding site found in the 3' untranslated region of mRNA encoded by HMGB3, corresponding to a HOST TARGET binding site such as BINDING SITE I, BINDING SITE II or BINDING SITE III. Table 2 illustrates the complementarity of the nucleotide sequences of HMGB3 BINDING SITE, designated SEQ ID:11816, to the nucleotide sequence of VGAM1520 RNA, herein designated VGAM RNA, also designated SEQ ID:4231.

A function of VGAM1520 is therefore inhibition of High-mobility Group Box 3 (HMGB3, Accession NM_005342), a gene which plays a fundamental role in DNA replication, nucleosome assembly, and transcription. Accordingly, utilities of VGAM1520 include diagnosis, prevention and treatment of diseases and clinical conditions associated with HMGB3. The function of HMGB3 and its association with various diseases and clinical conditions, has been established by previous studies, as described hereinabove with reference to VGAM1272. SMAC (Accession NM_138930) is another VGAM1520 host target gene. SMAC BINDING SITE is HOST TARGET binding site found in the 5' untranslated region of mRNA encoded by SMAC, corresponding to a HOST TARGET binding site such as BINDING SITE I, BINDING SITE II or BINDING SITE III. Table 2 illustrates the complementarity of the nucleotide sequences of SMAC BINDING SITE, designated SEQ ID:29054, to the nucleotide sequence of VGAM1520 RNA, herein designated VGAM RNA, also designated SEQ ID:4231.

Another function of VGAM1520 is therefore inhibition of SMAC (Accession NM_138930), a gene which promotes apoptosis via caspase activation. Accordingly, utilities of VGAM1520 include diagnosis, prevention and treatment of diseases and clinical conditions associated with SMAC. The function of SMAC and its association with various diseases and clinical conditions, has been established by previous studies, as described hereinabove with reference to VGAM74. DKFZp547D155 (Accession XM_046977) is another VGAM1520 host target gene. DKFZp547D155 BINDING SITE is HOST TARGET binding site found in the 3' untranslated region of mRNA encoded by DKFZp547D155, corresponding to a HOST TARGET binding site such as BINDING SITE I, BINDING SITE II or BINDING SITE III. Table 2 illustrates the complementarity of the nucleotide sequences of DKFZp547D155 BINDING SITE, designated SEQ ID:34865, to the nucleotide sequence of VGAM1520 RNA, herein designated VGAM RNA, also designated SEQ ID:4231.

Another function of VGAM1520 is therefore inhibition of DKFZp547D155 (Accession XM_046977). Accordingly, utilities of VGAM1520 include diagnosis, prevention and treatment of diseases and clinical conditions associated with DKFZp547D155. FLJ11126 (Accession NM_018332) is another VGAM1520 host target gene. FLJ11126 BINDING SITE is HOST TARGET binding site found in the 3' untranslated region of mRNA encoded by FLJ11126, corresponding to a HOST TARGET binding site such as BINDING SITE I, BINDING SITE II or BINDING SITE III. Table 2 illustrates the complementarity of the nucleotide sequences of FLJ11126 BINDING SITE, designated SEQ ID:20333, to the nucleotide sequence of VGAM1520 RNA, herein designated VGAM RNA, also designated SEQ ID:4231.

Another function of VGAM1520 is therefore inhibition of FLJ11126 (Accession NM_018332). Accordingly, utilities of VGAM1520 include diagnosis, prevention and treatment of diseases and clinical conditions associated with FLJ11126. FLJ12704 (Accession NM_024998) is another VGAM1520 host target gene. FLJ12704 BINDING SITE is HOST TARGET binding site found in the 3' untranslated region of mRNA encoded by FLJ12704, corresponding to a HOST TARGET binding site such as BINDING SITE I, BINDING SITE II or BINDING SITE III. Table 2 illustrates the complementarity of the nucleotide sequences of FLJ12704 BINDING SITE, designated SEQ ID:24560, to the nucleotide sequence of VGAM1520 RNA, herein designated VGAM RNA, also designated SEQ ID:4231.

Another function of VGAM1520 is therefore inhibition of FLJ12704 (Accession NM_024998). Accordingly, utilities of VGAM1520 include diagnosis, prevention and treatment of diseases and clinical conditions associated with FLJ12704. FLJ20309 (Accession NM_017759) is another VGAM1520 host target gene. FLJ20309 BINDING SITE is HOST TARGET binding site found in the 3' untranslated region of mRNA encoded by FLJ20309, corresponding to a HOST TARGET binding site such as BINDING SITE I, BINDING SITE II or BINDING SITE III. Table 2 illustrates the complementarity of the nucleotide sequences of FLJ20309 BINDING SITE, designated SEQ ID:19370, to the nucleotide sequence of VGAM1520 RNA, herein designated VGAM RNA, also designated SEQ ID:4231.

Another function of VGAM1520 is therefore inhibition of FLJ20309 (Accession NM_017759). Accordingly, utilities of VGAM1520 include diagnosis, prevention and treatment of diseases and clinical conditions associated with FLJ20309. LOC148696 (Accession XM_097505) is another VGAM1520 host target gene. LOC148696 BINDING SITE is HOST TARGET binding site found in the 5' untranslated region of mRNA encoded by LOC148696, corresponding to a HOST TARGET binding site such as BINDING SITE I, BINDING SITE II or BINDING SITE III. Table 2 illustrates the complementarity of the nucleotide sequences of LOC148696 BINDING SITE, designated SEQ ID:40892, to the nucleotide sequence of VGAM1520 RNA, herein designated VGAM RNA, also designated SEQ ID:4231.

Another function of VGAM1520 is therefore inhibition of LOC148696 (Accession XM_097505). Accordingly, utilities of VGAM1520 include diagnosis, prevention and treatment of diseases and clinical conditions associated with LOC148696. LOC149276 (Accession XM_097621) is another VGAM1520 host target gene. LOC149276 BINDING SITE is HOST TARGET binding site found in the 5' untranslated region of mRNA encoded by LOC149276, corresponding to a HOST TARGET binding site such as BINDING SITE I, BINDING SITE II or BINDING SITE III. Table 2 illustrates the complementarity of the nucleotide sequences of LOC149276 BINDING SITE, designated SEQ ID:40973, to the nucleotide sequence of VGAM1520 RNA, herein designated VGAM RNA, also designated SEQ ID:4231.

Another function of VGAM1520 is therefore inhibition of LOC149276 (Accession XM_097621). Accordingly, utilities of VGAM1520 include diagnosis, prevention and treatment of diseases and clinical conditions associated with LOC149276. FIG. 1 further provides a conceptual description of a novel bioinformatically detected viral gene of the present invention, referred to here as Viral Genomic Address Messenger 1521 (VGAM1521) viral gene, which modulates expression of respective host target genes thereof, the function and utility of which host target genes is known in the art.

VGAM1521 is a novel bioinformatically detected regulatory, non protein coding, viral micro RNA (miRNA) gene. The method by which VGAM1521 was detected is described hereinabove with reference to FIGS. 1-8.

VGAM1521 gene, herein designated VGAM GENE, is a viral gene contained in the genome of Ectromelia Virus. VGAM1521 host target gene, herein designated VGAM HOST TARGET GENE, is a human gene contained in the human genome.

VGAM1521 gene encodes a VGAM1521 precursor RNA, herein designated VGAM PRECURSOR RNA. Similar to other miRNA genes, and unlike most ordinary genes, VGAM1521 precursor RNA does not encode a protein. A nucleotide sequence identical or highly similar to the nucleotide sequence of VGAM1521 precursor RNA is designated SEQ ID:1507, and is provided hereinbelow with reference to the sequence listing part. Nucleotide sequence SEQ ID:1507 is located at position 67798 relative to the genome of Ectromelia Virus.

VGAM1521 precursor RNA folds onto itself, forming VGAM1521 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1521 folded precursor RNA into VGAM1521 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1521 RNA is designated SEQ ID:4232, and is provided hereinbelow with reference to the sequence listing part.

VGAM1521 host target gene, herein designated VGAM HOST TARGET GENE, encodes a corresponding messenger RNA, VGAM1521 host target RNA, herein designated VGAM HOST TARGET RNA. VGAM1521 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1521 RNA, herein designated VGAM RNA, binds complementarily to one or more host target binding sites located in untranslated regions of VGAM1521 host target RNA, herein designated VGAM HOST TARGET RNA. This complementary binding is due to the fact that the nucleotide sequence of VGAM1521 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1521 RNA, herein designated VGAM RNA, may have a different number of host target binding sites in untranslated regions of a VGAM1521 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1521 RNA, herein designated VGAM RNA, to host target binding sites on VGAM1521 host target RNA, herein designated VGAM HOST TARGET RNA, such as BINDING SITE I, BINDING SITE II and BINDING SITE III, inhibits translation of VGAM1521 host target RNA into VGAM1521 host target protein, herein designated VGAM HOST TARGET PROTEIN. VGAM host target protein is therefore outlined by a broken line.

It is appreciated that VGAM1521 host target gene, herein designated VGAM HOST TARGET GENE, in fact represents a plurality of VGAM1521 host target genes. The mRNA of each one of this plurality of VGAM1521 host target genes comprises one or more host target binding sites, each having a nucleotide sequence which is at least partly complementary to VGAM1521 RNA, herein designated VGAM RNA, and which when bound by VGAM1521 RNA causes inhibition of translation of respective one or more VGAM1521 host target proteins.

It is further appreciated by one skilled in the art that the mode of translational inhibition illustrated by FIG. 1 with specific reference to translational inhibition exerted by VGAM1521 gene, herein designated VGAM GENE, on one or more VGAM1521 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1521 is inhibition of expression of host target genes, as part of a novel viral mechanism of attacking a host. Accordingly, utilities of VGAM1521 include diagnosis, prevention and treatment of viral infection by Ectromelia Virus. Specific functions, and accordingly utilities, of VGAM1521 correlate with, and may be deduced from, the identity of the host target genes which VGAM1521 binds and inhibits, and the function of these host target genes, as elaborated hereinbelow.

Nucleotide sequences of the VGAM1521 precursor RNA, herein designated VGAM PRECURSOR RNA, and of the 'diced' VGAM1521 RNA, herein designated VGAM RNA, and a schematic representation of the secondary folding of VGAM1521 folded precursor RNA, herein designated VGAM FOLDED PRECURSOR RNA, of VGAM1521 are further described hereinbelow with reference to Table 1.

Nucleotide sequences of host target binding sites, such as BINDING SITE-I, BINDING SITE-II and BINDING SITE-III of FIG. 1, found on VGAM1521 host target RNA, and schematic representation of the complementarity of each of these host target binding sites to VGAM1521 RNA, herein designated VGAM RNA, are described hereinbelow with reference to Table 2.

As mentioned hereinabove with reference to FIG. 1, a function of VGAM1521 gene, herein designated VGAM is inhibition of expression of VGAM1521 target genes. It is appreciated that specific functions, and accordingly utilities, of VGAM1521 correlate with, and may be deduced from, the identity of the target genes which VGAM1521 binds and inhibits, and the function of these target genes, as elaborated hereinbelow.

TRIM (Accession NM_016388) is a VGAM1521 host target gene. TRIM BINDING SITE is HOST TARGET binding site found in the 3' untranslated region of mRNA encoded by TRIM, corresponding to a HOST TARGET binding site such as BINDING SITE I, BINDING SITE II or BINDING SITE III. Table 2 illustrates the complementarity of the nucleotide sequences of TRIM BINDING SITE, designated SEQ ID:18528, to the nucleotide sequence of VGAM1521 RNA, herein designated VGAM RNA, also designated SEQ ID:4232.

A function of VGAM1521 is therefore inhibition of TRIM (Accession NM_016388), a gene which plays a role in recruiting signaling proteins to the plasma membrane upon T-cell receptor (TCR) complex activation in T cells. Accordingly, utilities of VGAM1521 include diagnosis, prevention and treatment of diseases and clinical conditions associated with TRIM. The function of TRIM and its association with various diseases and clinical conditions, has been established by previous studies, as described hereinabove with reference to VGAM227. PRO2037 (Accession NM_018616) is another VGAM1521 host target gene. PRO2037 BINDING SITE is HOST TARGET binding site found in the 5' untranslated region of mRNA encoded by PRO2037, corresponding to a HOST TARGET binding site such as BINDING SITE I, BINDING SITE II or BINDING SITE III. Table 2 illustrates the complementarity of the nucleotide sequences of PRO2037 BINDING SITE, designated SEQ ID:20687, to the nucleotide sequence of VGAM1521 RNA, herein designated VGAM RNA, also designated SEQ ID:4232.

Another function of VGAM1521 is therefore inhibition of PRO2037 (Accession NM_018616). Accordingly, utilities of VGAM1521 include diagnosis, prevention and treatment of diseases and clinical conditions associated with PRO2037. FIG. 1 further provides a conceptual description of a novel bioinformatically detected viral gene of the present invention, referred to here as Viral Genomic Address Messenger 1522 (VGAM1522) viral gene, which modulates expression of respective host target genes thereof, the function and utility of which host target genes is known in the art.

VGAM1522 is a novel bioinformatically detected regulatory, non protein coding, viral micro RNA (miRNA) gene. The method by which VGAM1522 was detected is described hereinabove with reference to FIGS. 1-8.

VGAM1522 gene, herein designated VGAM GENE, is a viral gene contained in the genome of Ectromelia Virus. VGAM1522 host target gene, herein designated VGAM HOST TARGET GENE, is a human gene contained in the human genome.

VGAM1522 gene encodes a VGAM1522 precursor RNA, herein designated VGAM PRECURSOR RNA. Similar to other miRNA genes, and unlike most ordinary genes, VGAM1522 precursor RNA does not encode a protein. A nucleotide sequence identical or highly similar to the nucleotide sequence of VGAM1522 precursor RNA is designated SEQ ID:1508, and is provided hereinbelow with reference to the sequence listing part. Nucleotide sequence SEQ ID:1508 is located at position 72179 relative to the genome of Ectromelia Virus.

VGAM1522 precursor RNA folds onto itself, forming VGAM1522 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1522 folded precursor RNA into VGAM1522 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1522 RNA is designated SEQ ID:4233, and is provided hereinbelow with reference to the sequence listing part.

VGAM1522 host target gene, herein designated VGAM HOST TARGET GENE, encodes a corresponding messenger RNA, VGAM1522 host target RNA, herein designated VGAM HOST TARGET RNA. VGAM1522 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1522 RNA, herein designated VGAM RNA, binds complementarily to one or more host target binding sites located in untranslated regions of VGAM1522 host target RNA, herein designated VGAM HOST TARGET RNA. This complementary binding is due to the fact that the nucleotide sequence of VGAM1522 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1522 RNA, herein designated VGAM RNA, may have a different number of host target binding sites in untranslated regions of a VGAM1522 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1522 RNA, herein designated VGAM RNA, to host target binding sites on VGAM1522 host target RNA, herein designated VGAM HOST TARGET RNA, such as BINDING SITE I, BINDING SITE II and BINDING SITE III, inhibits translation of VGAM1522 host target RNA into VGAM1522 host target protein, herein designated VGAM HOST TARGET PROTEIN. VGAM host target protein is therefore outlined by a broken line.

It is appreciated that VGAM1522 host target gene, herein designated VGAM HOST TARGET GENE, in fact represents a plurality of VGAM1522 host target genes. The mRNA of each one of this plurality of VGAM1522 host target genes comprises one or more host target binding sites, each having a nucleotide sequence which is at least partly complementary to VGAM1522 RNA, herein designated VGAM RNA, and which when bound by VGAM1522 RNA causes inhibition of translation of respective one or more VGAM1522 host target proteins.

It is further appreciated by one skilled in the art that the mode of translational inhibition illustrated by FIG. 1 with specific reference to translational inhibition exerted by VGAM1522 gene, herein designated VGAM GENE, on one or more VGAM1522 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1522 is inhibition of expression of host target genes, as part of a novel viral mechanism of attacking a host. Accordingly, utilities of VGAM1522 include diagnosis, prevention and treatment of viral infection by Ectromelia Virus. Specific functions, and accordingly utilities, of VGAM1522 correlate with, and may be deduced from, the identity of the host target genes which VGAM1522 binds and inhibits, and the function of these host target genes, as elaborated hereinbelow.

Nucleotide sequences of the VGAM1522 precursor RNA, herein designated VGAM PRECURSOR RNA, and of the 'diced' VGAM1522 RNA, herein designated VGAM RNA, and a schematic representation of the secondary folding of VGAM1522 folded precursor RNA, herein designated VGAM FOLDED PRECURSOR RNA, of VGAM1522 are further described hereinbelow with reference to Table 1.

Nucleotide sequences of host target binding sites, such as BINDING SITE-I, BINDING SITE-II and BINDING SITE-III of FIG. 1, found on VGAM1522 host target RNA, and schematic representation of the complementarity of each of these host target binding sites to VGAM1522 RNA, herein designated VGAM RNA, are described hereinbelow with reference to Table 2.

As mentioned hereinabove with reference to FIG. 1, a function of VGAM1522 gene, herein designated VGAM is inhibition of expression of VGAM1522 target genes. It is appreciated that specific functions, and accordingly utilities, of VGAM1522 correlate with, and may be deduced from, the identity of the target genes which VGAM1522 binds and inhibits, and the function of these target genes, as elaborated hereinbelow.

KIAA1691 (Accession XM_166523) is a VGAM1522 host target gene. KIAA1691 BINDING SITE is HOST TARGET binding site found in the 3' untranslated region of mRNA encoded by KIAA1691, corresponding to a HOST TARGET binding site such as BINDING SITE I, BINDING SITE II or BINDING SITE III. Table 2 illustrates the complementarity of the nucleotide sequences of KIAA1691 BINDING SITE, designated SEQ ID:44464, to the nucleotide sequence of VGAM1522 RNA, herein designated VGAM RNA, also designated SEQ ID:4233.

A function of VGAM1522 is therefore inhibition of KIAA1691 (Accession XM_166523). Accordingly, utilities of VGAM1522 include diagnosis, prevention and treatment of diseases and clinical conditions associated with KIAA1691. LOC154813 (Accession XM_088051) is another VGAM1522 host target gene. LOC154813 BINDING SITE is HOST TARGET binding site found in the 5' untranslated region of mRNA encoded by LOC154813, corresponding to a HOST TARGET binding site such as BINDING SITE I, BINDING SITE II or BINDING SITE III. Table 2 illustrates the complementarity of the nucleotide sequences of LOC154813 BINDING SITE, designated SEQ ID:39492, to the nucleotide sequence of VGAM1522 RNA, herein designated VGAM RNA, also designated SEQ ID:4233.

Another function of VGAM1522 is therefore inhibition of LOC154813 (Accession XM_088051). Accordingly, utilities of VGAM1522 include diagnosis, prevention and treatment of diseases and clinical conditions associated with LOC154813. FIG. 1 further provides a conceptual description of a novel bioinformatically detected viral gene of the present invention, referred to here as Viral Genomic Address Messenger 1523 (VGAM1523) viral gene, which modulates expression of respective host target genes thereof, the function and utility of which host target genes is known in the art.

VGAM1523 is a novel bioinformatically detected regulatory, non protein coding, viral micro RNA (miRNA) gene. The method by which VGAM1523 was detected is described hereinabove with reference to FIGS. 1-8.

VGAM1523 gene, herein designated VGAM GENE, is a viral gene contained in the genome of Cowpox Virus. VGAM1523 host target gene, herein designated VGAM HOST TARGET GENE, is a human gene contained in the human genome.

VGAM1523 gene encodes a VGAM1523 precursor RNA, herein designated VGAM PRECURSOR RNA. Similar to other miRNA genes, and unlike most ordinary genes, VGAM1523 precursor RNA does not encode a protein. A nucleotide sequence identical or highly similar to the nucleotide sequence of VGAM1523 precursor RNA is designated SEQ ID:1509, and is provided hereinbelow with reference to the sequence listing part. Nucleotide sequence SEQ ID:1509 is located at position 79940 relative to the genome of Cowpox Virus.

VGAM1523 precursor RNA folds onto itself, forming VGAM1523 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1523 folded precursor RNA into VGAM1523 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1523 RNA is designated SEQ ID:4234, and is provided hereinbelow with reference to the sequence listing part.

VGAM1523 host target gene, herein designated VGAM HOST TARGET GENE, encodes a corresponding messenger RNA, VGAM1523 host target RNA, herein designated VGAM HOST TARGET RNA. VGAM1523 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1523 RNA, herein designated VGAM RNA, binds complementarily to one or more host target binding sites located in untranslated regions of VGAM1523 host target RNA, herein designated VGAM HOST TARGET RNA. This complementary binding is due to the fact that the nucleotide sequence of VGAM1523 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1523 RNA, herein designated VGAM RNA, may have a different number of host target binding sites in untranslated regions of a VGAM1523 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1523 RNA, herein designated VGAM RNA, to host target binding sites on VGAM1523 host target RNA, herein designated VGAM HOST TARGET RNA, such as BINDING SITE I, BINDING SITE II and BINDING SITE III, inhibits translation of VGAM1523 host target RNA into VGAM1523 host target protein, herein designated VGAM HOST TARGET PROTEIN. VGAM host target protein is therefore outlined by a broken line.

It is appreciated that VGAM1523 host target gene, herein designated VGAM HOST TARGET GENE, in fact represents a plurality of VGAM1523 host target genes. The mRNA of each one of this plurality of VGAM1523 host target genes comprises one or more host target binding sites, each having a nucleotide sequence which is at least partly complementary to VGAM1523 RNA, herein designated VGAM RNA, and which when bound by VGAM1523 RNA causes inhibition of translation of respective one or more VGAM1523 host target proteins.

It is further appreciated by one skilled in the art that the mode of translational inhibition illustrated by FIG. 1 with specific reference to translational inhibition exerted by VGAM1523 gene, herein designated VGAM GENE, on one or more VGAM1523 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1523 is inhibition of expression of host target genes, as part of a novel viral mechanism of attacking a host. Accordingly, utilities of VGAM1523 include diagnosis, prevention and treatment of viral infection by Cowpox Virus. Specific functions, and accordingly utilities, of VGAM1523 correlate with, and may be deduced from, the identity of the host target genes which VGAM1523 binds and inhibits, and the function of these host target genes, as elaborated hereinbelow.

Nucleotide sequences of the VGAM1523 precursor RNA, herein designated VGAM PRECURSOR RNA, and of the ‘diced’ VGAM1523 RNA, herein designated VGAM RNA, and a schematic representation of the secondary folding of VGAM1523 folded precursor RNA, herein designated VGAM FOLDED PRECURSOR RNA, of VGAM1523 are further described hereinbelow with reference to Table 1.

Nucleotide sequences of host target binding sites, such as BINDING SITE-I, BINDING SITE-II and BINDING SITE-III of FIG. 1, found on VGAM1523 host target RNA, and schematic representation of the complementarity of each of these host target binding sites to VGAM1523 RNA, herein designated VGAM RNA, are described hereinbelow with reference to Table 2.

As mentioned hereinabove with reference to FIG. 1, a function of VGAM1523 gene, herein designated VGAM is inhibition of expression of VGAM1523 target genes. It is appreciated that specific functions, and accordingly utilities, of VGAM1523 correlate with, and may be deduced from, the identity of the target genes which VGAM1523 binds and inhibits, and the function of these target genes, as elaborated hereinbelow.

ATP-binding Cassette, Sub-family B (MDR/TAP), Member 10 (ABCB10, Accession NM_012089) is a VGAM1523 host target gene. ABCB10 BINDING SITE is HOST TARGET binding site found in the 3' untranslated region of mRNA encoded by ABCB10, corresponding to a HOST TARGET binding site such as BINDING SITE I, BINDING SITE II or BINDING SITE III. Table 2 illustrates the complementarity of the nucleotide sequences of ABCB10 BINDING SITE, designated SEQ ID:14374, to the nucleotide sequence of VGAM1523 RNA, herein designated VGAM RNA, also designated SEQ ID:4234.

A function of VGAM1523 is therefore inhibition of ATP-binding Cassette, Sub-family B (MDR/TAP), Member 10 (ABCB10, Accession NM_012089), a gene which a member of the superfamily of ATP-binding cassette (ABC) transporters. Accordingly, utilities of VGAM1523 include diagnosis, prevention and treatment of diseases and clinical conditions associated with ABCB10. The function of ABCB10 has been established by previous studies. For background information on the ATP-binding cassette (ABC) family of transporter proteins, see ABCA4 (OMIM Ref. No. 601691). In addition to the ‘full’ ABC transporters with 2 transmembrane domains and 2 nucleotide-binding domains, there are ‘half’ proteins that contain only 1 of each domain (e.g., ABCB1; 171050). Allikmets et al. (1995) mapped a partial EST corresponding to the ABCB10 gene to 1q42. However, using FISH, Zhang et al. (2000) mapped the full-length ABCB10 gene to 15q13-q14. PCR and Southern blot analysis of genomic DNA showed that the chromosome 15 localization represents a pseudogene.

Full details of the abovementioned studies are described in the following publications, the disclosure of which are hereby incorporated by reference:

Allikmets, R.; Gerrard, B.; Glavac, D.; Ravnik-Glavac, M.; Jenkins, N. A.; Gilbert, D. J.; Copeland, N. G.; Modi, W.; Dean, M.: Characterization and mapping of three new mammalian ATP-binding transporter genes from an EST database. Mammalian Genome 6: 114-117, 1995; and Zhang, F.; Hogue, D. L.; Liu, L.; Fisher, C. L.; Hui, D.; Childs, S.; Ling, V.: M-ABC2, a new human mitochondrial ATP-binding cassette membrane protein. FEBS Lett. 478:89-94, 2000.

Further studies establishing the function and utilities of ABCB10 are found in John Hopkins OMIM database record ID 605454, and in sited publications numbered 963-964 listed in the bibliography section hereinbelow, which are also hereby incorporated by reference. Adducin 1 (alpha) (ADD1, Accession NM_014189) is another VGAM1523 host target gene. ADD1 BINDING SITE1 and ADD1 BINDING SITE2 are HOST TARGET binding sites found in untranslated regions of mRNA encoded by ADD1, corresponding to HOST TARGET binding sites such as BINDING SITE I, BINDING SITE II or BINDING SITE III. Table 2 illustrates the complementarity of the nucleotide sequences of ADD1 BINDING SITE1 and ADD1 BINDING SITE2, designated SEQ ID:15470 and SEQ ID:15474 respectively, to the nucleotide sequence of VGAM1523 RNA, herein designated VGAM RNA, also designated SEQ ID:4234.

Another function of VGAM1523 is therefore inhibition of Adducin 1 (alpha) (ADD1, Accession NM_014189), a gene which membrane-cytoskeleton- protein that promotes the assembly of the spectrin-actin network. Accordingly, utilities of VGAM1523 include diagnosis, prevention and treatment of diseases and clinical conditions associated with ADD1. The function of ADD1 and its association with various diseases and clinical conditions, has been established by previous studies, as described hereinabove with reference to VGAM474. Chemokine (C-C motif) Receptor 9 (CCR9, Accession NM_006641) is another VGAM1523 host target gene. CCR9 BINDING SITE1 and CCR9 BINDING SITE2 are HOST TARGET binding sites found in untranslated regions of mRNA encoded by CCR9, corresponding to HOST TARGET binding sites such as BINDING SITE I, BINDING SITE II or BINDING SITE III. Table 2 illustrates the complementarity of the nucleotide sequences of CCR9 BINDING SITE1 and CCR9 BINDING SITE2, designated SEQ ID:13432 and SEQ ID:22412 respectively, to the nucleotide sequence of VGAM1523 RNA, herein designated VGAM RNA, also designated SEQ ID:4234.

Another function of VGAM1523 is therefore inhibition of Chemokine (C-C motif) Receptor 9 (CCR9, Accession NM_006641), a gene which binds beta-chemokine family and subsequently transduces a signal by increasing the intracellular calcium ions level. Accordingly, utilities of VGAM1523 include diagnosis, prevention and treatment of diseases and clinical conditions associated with CCR9. The function of CCR9 and its association with various diseases and clinical conditions, has been established by previous studies, as described hereinabove with reference to VGAM1324. CGTHBA (Accession NM_012075) is another VGAM1523 host target gene. CGTHBA BINDING SITE is HOST TARGET binding site found in the 3' untranslated region of mRNA encoded by CGTHBA, corresponding to a HOST TARGET binding site such as BINDING SITE I, BINDING SITE II or BINDING SITE III. Table 2 illustrates the complementarity of the nucleotide sequences of CGTHBA BINDING SITE, designated SEQ ID:14364, to the nucleotide sequence of VGAM1523 RNA, herein designated VGAM RNA, also designated SEQ ID:4234.

Another function of VGAM1523 is therefore inhibition of CGTHBA (Accession NM_012075). Accordingly, utilities of VGAM1523 include diagnosis, prevention and treatment of diseases and clinical conditions associated with CGTHBA. Eukaryotic Translation Initiation Factor 1A (EIF1A, Accession XM_114147) is another VGAM1523 host target gene. EIF1A BINDING SITE is HOST TARGET binding site found in the 3' untranslated region of mRNA encoded by EIF1A, corresponding to a HOST TARGET binding site such as BINDING SITE I, BINDING SITE II or BINDING SITE III. Table 2 illustrates the complementarity of the nucleotide sequences of EIF1A BINDING SITE, designated SEQ ID:42721, to the nucleotide sequence of VGAM1523 RNA, herein designated VGAM RNA, also designated SEQ ID:4234.

Another function of VGAM1523 is therefore inhibition of Eukaryotic Translation Initiation Factor 1A (EIF1A, Accession XM_114147), a gene which seems to be required for maximal rate of protein biosynthesis. Accordingly, utilities of VGAM1523 include diagnosis, prevention and treatment of diseases and clinical conditions associated with EIF1A. The function of EIF1A and its association with various diseases and clinical conditions, has been established by previous studies, as described hereinabove with reference to VGAM120. Exostoses (multiple)-like 3 (EXTL3, Accession NM_001440) is another VGAM1523 host target gene. EXTL3 BINDING SITE is HOST TARGET binding site found in the 3' untranslated region of mRNA encoded by EXTL3, corresponding to a HOST TARGET binding site such as BINDING SITE I, BINDING SITE II or BINDING SITE III. Table 2 illustrates the complementarity of the nucleotide sequences of EXTL3 BINDING SITE, designated SEQ ID:7171, to the nucleotide sequence of VGAM1523 RNA, herein designated VGAM RNA, also designated SEQ ID:4234.

Another function of VGAM1523 is therefore inhibition of Exostoses (multiple)-like 3 (EXTL3, Accession NM_001440), a gene which a member of the multiple exostoses gene family. Accordingly, utilities of VGAM1523 include diagnosis, prevention and treatment of diseases and clinical conditions associated with EXTL3. The function of EXTL3 and its association with various diseases and clinical conditions, has been established by previous studies, as described hereinabove with reference to VGAM95. Growth Hormone Receptor (GHR, Accession NM_000163) is another VGAM1523 host target gene. GHR BINDING SITE is HOST TARGET binding site found in the 3' untranslated region of mRNA encoded by GHR, corresponding to a HOST TARGET binding site such as BINDING SITE I, BINDING SITE II or BINDING SITE III. Table 2 illustrates the complementarity of the nucleotide sequences of GHR BINDING SITE, designated SEQ ID:5671, to the nucleotide sequence of VGAM1523 RNA, herein designated VGAM RNA, also designated SEQ ID:4234.

Another function of VGAM1523 is therefore inhibition of Growth Hormone Receptor (GHR, Accession NM_000163). Accordingly, utilities of VGAM1523 include diagnosis, prevention and treatment of diseases and clinical conditions associated with GHR. Heparan Sulfate 2-O-sulfotransferase 1 (HS2ST1, Accession NM_012262) is another VGAM1523 host target gene. HS2ST1 BINDING SITE is HOST TARGET binding site found in the 3' untranslated region of mRNA encoded by HS2ST1, corresponding to a HOST TARGET binding site such as BINDING SITE I, BINDING SITE II or BINDING SITE III. Table 2 illustrates the complementarity of the nucleotide sequences of HS2ST1 BINDING SITE, designated SEQ ID:14576, to the nucleotide sequence of VGAM1523 RNA, herein designated VGAM RNA, also designated SEQ ID:4234.

Another function of VGAM1523 is therefore inhibition of Heparan Sulfate 2-O-sulfotransferase 1 (HS2ST1, Accession NM_012262). Accordingly, utilities of VGAM1523 include diagnosis, prevention and treatment of diseases and clinical conditions associated with HS2ST1. Nucleobindin 1 (NUCB1, Accession NM_006184) is another VGAM1523 host target gene. NUCB1 BINDING SITE is HOST TARGET binding site found in the 3' untranslated region of mRNA encoded by NUCB1, corresponding to a HOST TARGET binding site such as BINDING SITE I, BINDING SITE II or BINDING SITE III. Table 2 illustrates the complementarity of the nucleotide sequences of NUCB1 BINDING SITE, designated SEQ ID:12851, to the nucleotide sequence of VGAM1523 RNA, herein designated VGAM RNA, also designated SEQ ID:4234.

Another function of VGAM1523 is therefore inhibition of Nucleobindin 1 (NUCB1, Accession NM_006184), a gene which may have a role in calcium homeostasis. Accordingly, utilities of VGAM1523 include diagnosis, prevention and treatment of diseases and clinical conditions associated with NUCB1. The function of NUCB1 has been established by previous studies. Lupus-prone mice with the lymphoproliferation (lpr) mutation produced large amounts of antibody against both single-stranded and double-stranded DNA (Theofilopoulos and Dixon, 1985). The primary defect is a deficiency in expression of the Fas gene (OMIM Ref. No. 134637). Nucleobindin (Nuc) was first identified as a secreted protein of 55 kD that promotes production of DNA-specific antibodies in these mice (Kanai et al., 1993). Analysis of cDNA that encodes mouse Nuc demonstrated that the protein is composed of a signal peptide, a DNA-binding site, 2 calcium-binding motifs, and a leucine zipper (Miura et al., 1992). Miura et al. (1996) analyzed the organization of the human NUC gene. It consists of 13 exons that are distributed in a region of 32 kb. The gene encodes a 461-amino acid polypeptide. The functional motifs identified in the murine protein are encoded in corresponding human exons. A 2.4-kb NUC transcript was expressed in all organs examined. Comparison of nucleotide sequences in the promoter regions between human and mouse NUC genes revealed several conserved sequences. The promoter is of the TATA-less type, and transcription starts at multiple sites in both the human and the mouse genes. These features suggested to them that NUC may play a role as a housekeeping gene. By PCR analysis of human/hamster somatic cell hybrids and by fluorescence in situ hybridization, Miura et al. (1996) mapped the NUC gene to 19q13.2-q13.4.

Full details of the abovementioned studies are described in the following publications, the disclosure of which are hereby incorporated by reference:

Kanai, Y.; Miura, K.; Uehara, T.; Amagai, M.; Takeda, O.; Tanuma, S.; Kurosawa, Y.: Natural occurrence of Nuc in the sera of autoimmune-prone MRL/lpr mice. Biochem. Biophys. Res. Commun. 196:729-736, 1993; and Miura, K.; Hirai, M.; Kanai, Y.; Kurosawa, Y.: Organization of the human gene for nucleobindin (NUC) and its chromosomal assignment to 19q13.2-q13.4. Genomics 34:181-186, 1996.

Further studies establishing the function and utilities of NUCB1 are found in John Hopkins OMIM database record ID 601323, and in sited publications numbered 9385-938 and 10961 listed in the bibliography section hereinbelow, which are also hereby incorporated by reference. CDC42 Binding Protein Kinase Beta (DMPK-like) (CDC42BPB, Accession NM_006035) is another VGAM1523 host target gene. CDC42BPB BINDING SITE is HOST TARGET binding site found in the 3' untranslated region of mRNA encoded by CDC42BPB, corresponding to a HOST TARGET binding site such as BINDING SITE I, BINDING SITE II or BINDING SITE III. Table 2 illustrates the complementarity of the nucleotide sequences of CDC42BPB BINDING SITE, designated SEQ ID:12658, to the nucleotide sequence of VGAM1523 RNA, herein designated VGAM RNA, also designated SEQ ID:4234.

Another function of VGAM1523 is therefore inhibition of CDC42 Binding Protein Kinase Beta (DMPK-like) (CDC42BPB, Accession NM_006035). Accordingly, utilities of VGAM1523 include diagnosis, prevention and treatment of diseases and clinical conditions associated with CDC42BPB. DKFZP566B183 (Accession NM_015509) is another VGAM1523 host target gene. DKFZP566B183 BINDING SITE is HOST TARGET binding site found in the 3' untranslated region of mRNA encoded by DKFZP566B183, corresponding to a HOST TARGET binding site such as BINDING SITE I, BINDING SITE II or BINDING SITE III. Table 2 illustrates the complementarity of the nucleotide sequences of DKFZP566B183 BINDING SITE, designated SEQ ID:17769, to the nucleotide sequence of VGAM1523 RNA, herein designated VGAM RNA, also designated SEQ ID:4234.

Another function of VGAM1523 is therefore inhibition of DKFZP566B183 (Accession NM_015509). Accordingly, utilities of VGAM1523 include diagnosis, prevention and treatment of diseases and clinical conditions associated with DKFZP566B183. DKFZP566I1024 (Accession XM_046506) is another VGAM1523 host target gene. DKFZP566I1024 BINDING SITE is HOST TARGET binding site found in the 3' untranslated region of mRNA encoded by DKFZP566I1024, corresponding to a HOST TARGET binding site such as BINDING SITE I, BINDING SITE II or BINDING SITE III. Table 2 illustrates the complementarity of the nucleotide sequences of DKFZP566I1024 BINDING SITE, designated SEQ ID:34735, to the nucleotide sequence of VGAM1523 RNA, herein designated VGAM RNA, also designated SEQ ID:4234.

Another function of VGAM1523 is therefore inhibition of DKFZP566I1024 (Accession XM_046506). Accordingly, utilities of VGAM1523 include diagnosis, prevention and treatment of diseases and clinical conditions associated with DKFZP566I1024. DKFZp761B0514 (Accession NM_032289) is another VGAM1523 host target gene. DKFZp761B0514 BINDING SITE is HOST TARGET binding site found in the 3' untranslated region of mRNA encoded by DKFZp761B0514, corresponding to a HOST TARGET binding site such as BINDING SITE I, BINDING SITE II or BINDING SITE III. Table 2 illustrates the complementarity of the nucleotide sequences of DKFZp761B0514 BINDING SITE, designated SEQ ID:26053, to the nucleotide sequence of VGAM1523 RNA, herein designated VGAM RNA, also designated SEQ ID:4234.

Another function of VGAM1523 is therefore inhibition of DKFZp761B0514 (Accession NM_032289). Accordingly, utilities of VGAM1523 include diagnosis, prevention and treatment of diseases and clinical conditions associated with DKFZp761B0514. FLJ13305 (Accession XM_117270) is another VGAM1523 host target gene. FLJ13305 BINDING SITE is HOST TARGET binding site found in the 5' untranslated region of mRNA encoded by FLJ13305, corresponding to a HOST TARGET binding site such as BINDING SITE I, BINDING SITE II or BINDING SITE III. Table 2 illustrates the complementarity of the nucleotide sequences of FLJ13305 BINDING SITE, designated SEQ ID:43345, to the nucleotide sequence of VGAM1523 RNA, herein designated VGAM RNA, also designated SEQ ID:4234.

Another function of VGAM1523 is therefore inhibition of FLJ13305 (Accession XM_117270). Accordingly, utilities of VGAM1523 include diagnosis, prevention and treatment of diseases and clinical conditions associated with FLJ13305.

KIAA0265 (Accession XM_045954) is another VGAM1523 host target gene. KIAA0265 BINDING SITE is HOST TARGET binding site found in the 3' untranslated region of mRNA encoded by KIAA0265, corresponding to a HOST TARGET binding site such as BINDING SITE I, BINDING SITE II or BINDING SITE III. Table 2 illustrates the complementarity of the nucleotide sequences of KIAA0265 BINDING SITE, designated SEQ ID:34620, to the nucleotide sequence of VGAM1523 RNA, herein designated VGAM RNA, also designated SEQ ID:4234.

Another function of VGAM1523 is therefore inhibition of KIAA0265 (Accession XM_045954). Accordingly, utilities of VGAM1523 include diagnosis, prevention and treatment of diseases and clinical conditions associated with KIAA0265. KIAA1117 (Accession XM_028219) is another VGAM1523 host target gene. KIAA1117 BINDING SITE is HOST TARGET binding site found in the 3' untranslated region of mRNA encoded by KIAA1117, corresponding to a HOST TARGET binding site such as BINDING SITE I, BINDING SITE II or BINDING SITE III. Table 2 illustrates the complementarity of the nucleotide sequences of KIAA1117 BINDING SITE, designated SEQ ID:30632, to the nucleotide sequence of VGAM1523 RNA, herein designated VGAM RNA, also designated SEQ ID:4234.

Another function of VGAM1523 is therefore inhibition of KIAA1117 (Accession XM_028219). Accordingly, utilities of VGAM1523 include diagnosis, prevention and treatment of diseases and clinical conditions associated with KIAA1117. KIAA1319 (Accession NM_020770) is another VGAM1523 host target gene. KIAA1319 BINDING SITE is HOST TARGET binding site found in the 3' untranslated region of mRNA encoded by KIAA1319, corresponding to a HOST TARGET binding site such as BINDING SITE I, BINDING SITE II or BINDING SITE III. Table 2 illustrates the complementarity of the nucleotide sequences of KIAA1319 BINDING SITE, designated SEQ ID:21870, to the nucleotide sequence of VGAM1523 RNA, herein designated VGAM RNA, also designated SEQ ID:4234.

Another function of VGAM1523 is therefore inhibition of KIAA1319 (Accession NM_020770). Accordingly, utilities of VGAM1523 include diagnosis, prevention and treatment of diseases and clinical conditions associated with KIAA1319. Nudix (nucleoside diphosphate linked moiety X)-type Motif 13 (NUDT13, Accession XM_032512) is another VGAM1523 host target gene. NUDT13 BINDING SITE is HOST TARGET binding site found in the 3' untranslated region of mRNA encoded by NUDT13, corresponding to a HOST TARGET binding site such as BINDING SITE I, BINDING SITE II or BINDING SITE III. Table 2 illustrates the complementarity of the nucleotide sequences of NUDT13 BINDING SITE, designated SEQ ID:31664, to the nucleotide sequence of VGAM1523 RNA, herein designated VGAM RNA, also designated SEQ ID:4234.

Another function of VGAM1523 is therefore inhibition of Nudix (nucleoside diphosphate linked moiety X)-type Motif 13 (NUDT13, Accession XM_032512). Accordingly, utilities of VGAM1523 include diagnosis, prevention and treatment of diseases and clinical conditions associated with NUDT13. SSH2 (Accession XM_030846) is another VGAM1523 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31176, to the nucleotide sequence of VGAM1523 RNA, herein designated VGAM RNA, also designated SEQ ID:4234.

Another function of VGAM1523 is therefore inhibition of SSH2 (Accession XM_030846). Accordingly, utilities of VGAM1523 include diagnosis, prevention and treatment of diseases and clinical conditions associated with SSH2. Signal Sequence Receptor, Alpha (translocon-associated protein alpha) (SSR1, Accession NM_003144) is another VGAM1523 host target gene. SSR1 BINDING SITE is HOST TARGET binding site found in the 3' untranslated region of mRNA encoded by SSR1, corresponding to a HOST TARGET binding site such as BINDING SITE I, BINDING SITE II or BINDING SITE III. Table 2 illustrates the complementarity of the nucleotide sequences of SSR1 BINDING SITE, designated SEQ ID:9113, to the nucleotide sequence of VGAM1523 RNA, herein designated VGAM RNA, also designated SEQ ID:4234.

Another function of VGAM1523 is therefore inhibition of Signal Sequence Receptor, Alpha (translocon-associated protein alpha) (SSR1, Accession NM_003144). Accordingly, utilities of VGAM1523 include diagnosis, prevention and treatment of diseases and clinical conditions associated with SSR1. TAF9-like RNA Polymerase II, TATA Box Binding Protein (TBP)-associated Factor, 31 kDa (TAF9L, Accession NM_015975) is another VGAM1523 host target gene. TAF9L BINDING SITE is HOST TARGET binding site found in the 3' untranslated region of mRNA encoded by TAF9L, corresponding to a HOST TARGET binding site such as BINDING SITE I, BINDING SITE II or BINDING SITE III. Table 2 illustrates the complementarity of the nucleotide sequences of TAF9L BINDING SITE, designated SEQ ID:18072, to the nucleotide sequence of VGAM1523 RNA, herein designated VGAM RNA, also designated SEQ ID:4234.

Another function of VGAM1523 is therefore inhibition of TAF9-like RNA Polymerase II, TATA Box Binding Protein (TBP)-associated Factor, 31 kDa (TAF9L, Accession NM_015975). Accordingly, utilities of VGAM1523 include diagnosis, prevention and treatment of diseases and clinical conditions associated with TAF9L. LOC115294 (Accession XM_054302) is another VGAM1523 host target gene. LOC115294 BINDING SITE is HOST TARGET binding site found in the 3' untranslated region of mRNA encoded by LOC115294, corresponding to a HOST TARGET binding site such as BINDING SITE I, BINDING SITE II or BINDING SITE III. Table 2 illustrates the complementarity of the nucleotide sequences of LOC115294 BINDING SITE, designated SEQ ID:36145, to the nucleotide sequence of VGAM1523 RNA, herein designated VGAM RNA, also designated SEQ ID:4234.

Another function of VGAM1523 is therefore inhibition of LOC115294 (Accession XM_054302). Accordingly, utilities of VGAM1523 include diagnosis, prevention and treatment of diseases and clinical conditions associated with LOC115294. LOC150271 (Accession XM_097859) is another VGAM1523 host target gene. LOC150271 BINDING SITE is HOST TARGET binding site found in the 5' untranslated region of mRNA encoded by LOC150271, corresponding to a HOST TARGET binding site such as BINDING SITE I, BINDING SITE II or BINDING SITE III. Table 2 illustrates the complementarity of the nucleotide sequences of LOC150271 BINDING SITE, designated SEQ ID:41166, to the nucleotide sequence of VGAM1523 RNA, herein designated VGAM RNA, also designated SEQ ID:4234.

Another function of VGAM1523 is therefore inhibition of LOC150271 (Accession XM_097859). Accordingly, utilities of VGAM1523 include diagnosis, prevention and treatment of diseases and clinical conditions associated with LOC150271. LOC151877 (Accession XM_098132) is another VGAM1523 host target gene. LOC151877 BINDING SITE is HOST TARGET binding site found in the 3' untranslated region of mRNA encoded by LOC151877, corresponding to a HOST TARGET binding site such as BINDING SITE I, BINDING SITE II or BINDING SITE III. Table 2 illustrates the complementarity of the nucleotide sequences of LOC151877 BINDING SITE, designated SEQ ID:41398, to the nucleotide sequence of VGAM1523 RNA, herein designated VGAM RNA, also designated SEQ ID:4234.

Another function of VGAM1523 is therefore inhibition of LOC151877 (Accession XM_098132). Accordingly, utilities of VGAM1523 include diagnosis, prevention and treatment of diseases and clinical conditions associated with LOC151877. LOC152300 (Accession XM_087432) is another VGAM1523 host target gene. LOC152300 BINDING SITE is HOST TARGET binding site found in the 5' untranslated region of mRNA encoded by LOC152300, corresponding to a HOST TARGET binding site such as BINDING SITE I, BINDING SITE II or BINDING SITE III. Table 2 illustrates the complementarity of the nucleotide sequences of LOC152300 BINDING SITE, designated SEQ ID:39248, to the nucleotide sequence of VGAM1523 RNA, herein designated VGAM RNA, also designated SEQ ID:4234.

Another function of VGAM1523 is therefore inhibition of LOC152300 (Accession XM_087432). Accordingly, utilities of VGAM1523 include diagnosis, prevention and treatment of diseases and clinical conditions associated with LOC152300. LOC154084 (Accession XM_098468) is another VGAM1523 host target gene. LOC154084 BINDING SITE is HOST TARGET binding site found in the 5' untranslated region of mRNA encoded by LOC154084, corresponding to a HOST TARGET binding site such as BINDING SITE I, BINDING SITE II or BINDING SITE III. Table 2 illustrates the complementarity of the nucleotide sequences of LOC154084 BINDING SITE, designated SEQ ID:41685, to the nucleotide sequence of VGAM1523 RNA, herein designated VGAM RNA, also designated SEQ ID:4234.

Another function of VGAM1523 is therefore inhibition of LOC154084 (Accession XM_098468). Accordingly, utilities of VGAM1523 include diagnosis, prevention and treatment of diseases and clinical conditions associated with LOC154084. LOC158402 (Accession XM_098936) is another VGAM1523 host target gene. LOC158402 BINDING SITE is HOST TARGET binding site found in the 5' untranslated region of mRNA encoded by LOC158402, corresponding to a HOST TARGET binding site such as BINDING SITE I, BINDING SITE II or BINDING SITE III. Table 2 illustrates the complementarity of the nucleotide sequences of LOC158402 BINDING SITE, designated SEQ ID:41976, to the nucleotide sequence of VGAM1523 RNA, herein designated VGAM RNA, also designated SEQ ID:4234.

Another function of VGAM1523 is therefore inhibition of LOC158402 (Accession XM_098936). Accordingly, utilities of VGAM1523 include diagnosis, prevention and treatment of diseases and clinical conditions associated with LOC158402. LOC162333 (Accession XM_102591) is another VGAM1523 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42124, to the nucleotide sequence of VGAM1523 RNA, herein designated VGAM RNA, also designated SEQ ID:4234.

Another function of VGAM1523 is therefore inhibition of LOC162333 (Accession XM_102591). Accordingly, utilities of VGAM1523 include diagnosis, prevention and treatment of diseases and clinical conditions associated with LOC162333. FIG. 1 further provides a conceptual description of a novel bioinformatically detected viral gene of the present invention, referred to here as Viral Genomic Address Messenger 1524 (VGAM1524) viral gene, which modulates expression of respective host target genes thereof, the function and utility of which host target genes is known in the art.

VGAM1524 is a novel bioinformatically detected regulatory, non protein coding, viral micro RNA (miRNA) gene. The method by which VGAM1524 was detected is described hereinabove with reference to FIGS. 1-8.

VGAM1524 gene, herein designated VGAM GENE, is a viral gene contained in the genome of Cowpox Virus. VGAM1524 host target gene, herein designated VGAM HOST TARGET GENE, is a human gene contained in the human genome.

VGAM1524 gene encodes a VGAM1524 precursor RNA, herein designated VGAM PRECURSOR RNA. Similar to other miRNA genes, and unlike most ordinary genes, VGAM1524 precursor RNA does not encode a protein. A nucleotide sequence identical or highly similar to the nucleotide sequence of VGAM1524 precursor RNA is designated SEQ ID:1510, and is provided hereinbelow with reference to the sequence listing part. Nucleotide sequence SEQ ID:1510 is located at position 76982 relative to the genome of Cowpox Virus.

VGAM1524 precursor RNA folds onto itself, forming VGAM1524 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1524 folded precursor RNA into VGAM1524 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1524 RNA is designated SEQ ID:4235, and is provided hereinbelow with reference to the sequence listing part.

VGAM1524 host target gene, herein designated VGAM HOST TARGET GENE, encodes a corresponding messenger RNA, VGAM1524 host target RNA, herein designated VGAM HOST TARGET RNA. VGAM1524 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1524 RNA, herein designated VGAM RNA, binds complementarily to one or more host target binding sites located in untranslated regions of VGAM1524 host target RNA, herein designated VGAM HOST TARGET RNA. This complementary binding is due to the fact that the nucleotide sequence of VGAM1524 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1524 RNA, herein designated VGAM RNA, may have a different number of host target binding sites in untranslated regions of a VGAM1524 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1524 RNA, herein designated VGAM RNA, to host target binding sites on VGAM1524 host target RNA, herein designated VGAM HOST TARGET RNA, such as BINDING SITE I, BINDING SITE II and BINDING SITE III, inhibits translation of VGAM1524 host target RNA into VGAM1524 host target protein, herein designated VGAM HOST TARGET PROTEIN. VGAM host target protein is therefore outlined by a broken line.

It is appreciated that VGAM1524 host target gene, herein designated VGAM HOST TARGET GENE, in fact represents a plurality of VGAM1524 host target genes. The mRNA of each one of this plurality of VGAM1524 host target genes comprises one or more host target binding sites, each having a nucleotide sequence which is at least partly complementary to VGAM1524 RNA, herein designated VGAM RNA, and which when bound by VGAM1524 RNA causes inhibition of translation of respective one or more VGAM1524 host target proteins.

It is further appreciated by one skilled in the art that the mode of translational inhibition illustrated by FIG. 1 with specific reference to translational inhibition exerted by VGAM1524 gene, herein designated VGAM GENE, on one or more VGAM1524 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1524 is inhibition of expression of host target genes, as part of a novel viral mechanism of attacking a host. Accordingly, utilities of VGAM1524 include diagnosis, prevention and treatment of viral infection by Cowpox Virus. Specific functions, and accordingly utilities, of VGAM1524 correlate with, and may be deduced from, the identity of the host target genes which VGAM1524 binds and inhibits, and the function of these host target genes, as elaborated hereinbelow.

Nucleotide sequences of the VGAM1524 precursor RNA, herein designated VGAM PRECURSOR RNA, and of the 'diced' VGAM1524 RNA, herein designated VGAM RNA, and a schematic representation of the secondary folding of VGAM1524 folded precursor RNA, herein designated VGAM FOLDED PRECURSOR RNA, of VGAM1524 are further described hereinbelow with reference to Table 1.

Nucleotide sequences of host target binding sites, such as BINDING SITE-I, BINDING SITE-II and BINDING SITE-III of FIG. 1, found on VGAM1524 host target RNA, and schematic representation of the complementarity of each of these host target binding sites to VGAM1524 RNA, herein designated VGAM RNA, are described hereinbelow with reference to Table 2.

As mentioned hereinabove with reference to FIG. 1, a function of VGAM1524 gene, herein designated VGAM is inhibition of expression of VGAM1524 target genes. It is appreciated that specific functions, and accordingly utilities, of VGAM1524 correlate with, and may be deduced from, the identity of the target genes which VGAM1524 binds and inhibits, and the function of these target genes, as elaborated hereinbelow.

Transmembrane, Cochlear Expressed, 1 (TMC1, Accession NM_138691) is a VGAM1524 host target gene. TMC1 BINDING SITE is HOST TARGET binding site found in the 5' untranslated region of mRNA encoded by TMC1, corresponding to a HOST TARGET binding site such as BINDING SITE I, BINDING SITE II or BINDING SITE III. Table 2 illustrates the complementarity of the nucleotide sequences of TMC1 BINDING SITE, designated SEQ ID:28931, to the nucleotide sequence of VGAM1524 RNA, herein designated VGAM RNA, also designated SEQ ID:4235.

A function of VGAM1524 is therefore inhibition of Transmembrane, Cochlear Expressed, 1 (TMC1, Accession NM_138691), a gene which is required for normal function of cochlear hair cells. Accordingly, utilities of VGAM1524 include diagnosis, prevention and treatment of diseases and clinical conditions associated with TMC1. The function of TMC1 and its association with various diseases and clinical conditions, has been established by previous studies, as described hereinabove with reference to VGAM554. KIAA0546 (Accession XM_049055) is another VGAM1524 host target gene. KIAA0546 BINDING SITE is HOST TARGET binding site found in the 3' untranslated region of mRNA encoded by KIAA0546, corresponding to a HOST TARGET binding site such as BINDING SITE I, BINDING SITE II or BINDING SITE III. Table 2 illustrates the complementarity of the nucleotide sequences of KIAA0546 BINDING SITE, designated SEQ ID:35332, to the nucleotide sequence of VGAM1524 RNA, herein designated VGAM RNA, also designated SEQ ID:4235.

Another function of VGAM1524 is therefore inhibition of KIAA0546 (Accession XM_049055). Accordingly, utilities of VGAM1524 include diagnosis, prevention and treatment of diseases and clinical conditions associated with KIAA0546. LOC143879 (Accession XM_084666) is another VGAM1524 host target gene. LOC143879 BINDING SITE is HOST TARGET binding site found in the 3' untranslated region of mRNA encoded by LOC143879, corresponding to a HOST TARGET binding site such as BINDING SITE I, BINDING SITE II or BINDING SITE III. Table 2 illustrates the complementarity of the nucleotide sequences of LOC143879 BINDING SITE, designated SEQ ID:37656, to the nucleotide sequence of VGAM1524 RNA, herein designated VGAM RNA, also designated SEQ ID:4235.

Another function of VGAM1524 is therefore inhibition of LOC143879 (Accession XM_084666). Accordingly, utilities of VGAM1524 include diagnosis, prevention and treatment of diseases and clinical conditions associated with LOC143879. LOC153222 (Accession XM_087631) is another VGAM1524 host target gene. LOC153222 BINDING SITE is HOST TARGET binding site found in the 5' untranslated region of mRNA encoded by LOC153222, corresponding to a HOST TARGET binding site such as BINDING SITE I, BINDING SITE II or BINDING SITE III. Table 2 illustrates the complementarity of the nucleotide sequences of LOC153222 BINDING SITE, designated SEQ ID:39366, to the nucleotide sequence of VGAM1524 RNA, herein designated VGAM RNA, also designated SEQ ID:4235.

Another function of VGAM1524 is therefore inhibition of LOC153222 (Accession XM_087631). Accordingly, utilities of VGAM1524 include diagnosis, prevention and treatment of diseases and clinical conditions associated with LOC153222. LOC219988 (Accession XM_166223) is another VGAM1524 host target gene. LOC219988 BINDING SITE is HOST TARGET binding site found in the 5' untranslated region of mRNA encoded by LOC219988, corresponding to a HOST TARGET binding site such as BINDING SITE I, BINDING SITE II or BINDING SITE III. Table 2 illustrates the complementarity of the nucleotide sequences of LOC219988 BINDING SITE, designated SEQ ID:44041, to the nucleotide sequence of VGAM1524 RNA, herein designated VGAM RNA, also designated SEQ ID:4235.

Another function of VGAM1524 is therefore inhibition of LOC219988 (Accession XM_166223). Accordingly, utilities of VGAM1524 include diagnosis, prevention and treatment of diseases and clinical conditions associated with LOC219988. FIG. 1 further provides a conceptual description of a novel bioinformatically detected viral gene of the present invention, referred to here as Viral Genomic Address Messenger 1525 (VGAM1525) viral gene, which modulates expression of respective host target genes thereof, the function and utility of which host target genes is known in the art.

VGAM1525 is a novel bioinformatically detected regulatory, non protein coding, viral micro RNA (miRNA) gene. The method by which VGAM1525 was detected is described hereinabove with reference to FIGS. 1-8.

VGAM1525 gene, herein designated VGAM GENE, is a viral gene contained in the genome of Camelpox Virus. VGAM1525 host target gene, herein designated VGAM HOST TARGET GENE, is a human gene contained in the human genome.

VGAM1525 gene encodes a VGAM1525 precursor RNA, herein designated VGAM PRECURSOR RNA. Similar to other miRNA genes, and unlike most ordinary genes, VGAM1525 precursor RNA does not encode a protein. A nucleotide sequence identical or highly similar to the nucleotide sequence of VGAM1525 precursor RNA is designated SEQ ID:1511, and is provided hereinbelow with reference to the sequence listing part. Nucleotide sequence SEQ ID:1511 is located at position 62387 relative to the genome of Camelpox Virus.

VGAM1525 precursor RNA folds onto itself, forming VGAM1525 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1525 folded precursor RNA into VGAM1525 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1525 RNA is designated SEQ ID:4236, and is provided hereinbelow with reference to the sequence listing part.

VGAM1525 host target gene, herein designated VGAM HOST TARGET GENE, encodes a corresponding messenger RNA, VGAM1525 host target RNA, herein designated VGAM HOST TARGET RNA. VGAM1525 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1525 RNA, herein designated VGAM RNA, binds complementarily to one or more host target binding sites located in untranslated regions of VGAM1525 host target RNA, herein designated VGAM HOST TARGET RNA. This complementary binding is due to the fact that the nucleotide sequence of VGAM1525 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1525 RNA, herein designated VGAM RNA, may have a different number of host target binding sites in untranslated regions of a VGAM1525 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1525 RNA, herein designated VGAM RNA, to host target binding sites on VGAM1525 host target RNA, herein designated VGAM HOST TARGET RNA, such as BINDING SITE I, BINDING SITE II and BINDING SITE III, inhibits translation of VGAM1525 host target RNA into VGAM1525 host target protein, herein designated VGAM HOST TARGET PROTEIN. VGAM host target protein is therefore outlined by a broken line.

It is appreciated that VGAM1525 host target gene, herein designated VGAM HOST TARGET GENE, in fact represents a plurality of VGAM1525 host target genes. The mRNA of each one of this plurality of VGAM1525 host target genes comprises one or more host target binding sites, each having a nucleotide sequence which is at least partly complementary to VGAM1525 RNA, herein designated VGAM RNA, and which when bound by VGAM1525 RNA causes inhibition of translation of respective one or more VGAM1525 host target proteins.

It is further appreciated by one skilled in the art that the mode of translational inhibition illustrated by FIG. 1 with specific reference to translational inhibition exerted by VGAM1525 gene, herein designated VGAM GENE, on one or more VGAM1525 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1525 is inhibition of expression of host target genes, as part of a novel viral mechanism of attacking a host. Accordingly, utilities of VGAM1525 include diagnosis, prevention and treatment of viral infection by Camelpox Virus. Specific functions, and accordingly utilities, of VGAM1525 correlate with, and may be deduced from, the identity of the host target genes which VGAM1525 binds and inhibits, and the function of these host target genes, as elaborated hereinbelow.

Nucleotide sequences of the VGAM1525 precursor RNA, herein designated VGAM PRECURSOR RNA, and of the 'diced' VGAM1525 RNA, herein designated VGAM RNA, and a schematic representation of the secondary folding of VGAM1525 folded precursor RNA, herein designated VGAM FOLDED PRECURSOR RNA, of VGAM1525 are further described hereinbelow with reference to Table 1.

Nucleotide sequences of host target binding sites, such as BINDING SITE-I, BINDING SITE-II and BINDING SITE-III of FIG. 1, found on VGAM1525 host target RNA, and schematic representation of the complementarity of each of these host target binding sites to VGAM1525 RNA, herein designated VGAM RNA, are described hereinbelow with reference to Table 2.

As mentioned hereinabove with reference to FIG. 1, a function of VGAM1525 gene, herein designated VGAM is inhibition of expression of VGAM1525 target genes. It is appreciated that specific functions, and accordingly utilities, of VGAM1525 correlate with, and may be deduced from, the identity of the target genes which VGAM1525 binds and inhibits, and the function of these target genes, as elaborated hereinbelow.

LOC170409 (Accession XM_096330) is a VGAM1525 host target gene. LOC170409 BINDING SITE is HOST TARGET binding site found in the 3' untranslated region of mRNA encoded by LOC170409, corresponding to a HOST TARGET binding site such as BINDING SITE I, BINDING SITE II or BINDING SITE III. Table 2 illustrates the complementarity of the nucleotide sequences of LOC170409 BINDING SITE, designated SEQ ID:40314, to the nucleotide sequence of VGAM1525 RNA, herein designated VGAM RNA, also designated SEQ ID:4236.

A function of VGAM1525 is therefore inhibition of LOC170409 (Accession XM_096330). Accordingly, utilities of VGAM1525 include diagnosis, prevention and treatment of diseases and clinical conditions associated with LOC170409. FIG. 1 further provides a conceptual description of a novel bioinformatically detected viral gene of the present invention, referred to here as Viral Genomic Address Messenger 1526 (VGAM1526) viral gene, which modulates expression of respective host target genes thereof, the function and utility of which host target genes is known in the art.

VGAM1526 is a novel bioinformatically detected regulatory, non protein coding, viral micro RNA (miRNA) gene. The method by which VGAM1526 was detected is described hereinabove with reference to FIGS. 1-8.

VGAM1526 gene, herein designated VGAM GENE, is a viral gene contained in the genome of Ectromelia Virus. VGAM1526 host target gene, herein designated VGAM HOST TARGET GENE, is a human gene contained in the human genome.

VGAM1526 gene encodes a VGAM1526 precursor RNA, herein designated VGAM PRECURSOR RNA. Similar to other miRNA genes, and unlike most ordinary genes, VGAM1526 precursor RNA does not encode a protein. A nucleotide sequence identical or highly similar to the nucleotide sequence of VGAM1526 precursor RNA is designated SEQ ID:1512, and is provided hereinbelow with reference to the sequence listing part. Nucleotide sequence SEQ ID:1512 is located at position 71872 relative to the genome of Ectromelia Virus.

VGAM1526 precursor RNA folds onto itself, forming VGAM1526 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1526 folded precursor RNA into VGAM1526 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1526 RNA is designated SEQ ID:4237, and is provided hereinbelow with reference to the sequence listing part.

VGAM1526 host target gene, herein designated VGAM HOST TARGET GENE, encodes a corresponding messenger RNA, VGAM1526 host target RNA, herein designated VGAM HOST TARGET RNA. VGAM1526 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1526 RNA, herein designated VGAM RNA, binds complementarily to one or more host target binding sites located in untranslated regions of VGAM1526 host target RNA, herein designated VGAM HOST TARGET RNA. This complementary binding is due to the fact that the nucleotide sequence of VGAM1526 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1526 RNA, herein designated VGAM RNA, may have a different number of host target binding sites in untranslated regions of a VGAM1526 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1526 RNA, herein designated VGAM RNA, to host target binding sites on VGAM1526 host target RNA, herein designated VGAM HOST TARGET RNA, such as BINDING SITE I, BINDING SITE II and BINDING SITE III, inhibits translation of VGAM1526 host target RNA into VGAM1526 host target protein, herein designated VGAM HOST TARGET PROTEIN. VGAM host target protein is therefore outlined by a broken line.

It is appreciated that VGAM1526 host target gene, herein designated VGAM HOST TARGET GENE, in fact represents a plurality of VGAM1526 host target genes. The mRNA of each one of this plurality of VGAM1526 host target genes comprises one or more host target binding sites, each having a nucleotide sequence which is at least partly complementary to VGAM1526 RNA, herein designated VGAM RNA, and which when bound by VGAM1526 RNA causes inhibition of translation of respective one or more VGAM1526 host target proteins.

It is further appreciated by one skilled in the art that the mode of translational inhibition illustrated by FIG. 1 with specific reference to translational inhibition exerted by VGAM1526 gene, herein designated VGAM GENE, on one or more VGAM1526 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1526 is inhibition of expression of host target genes, as part of a novel viral mechanism of attacking a host. Accordingly, utilities of VGAM1526 include diagnosis, prevention and treatment of viral infection by Ectromelia Virus. Specific functions, and accordingly utilities, of VGAM1526 correlate with, and may be deduced from, the identity of the host target genes which VGAM1526 binds and inhibits, and the function of these host target genes, as elaborated hereinbelow.

Nucleotide sequences of the VGAM1526 precursor RNA, herein designated VGAM PRECURSOR RNA, and of the 'diced' VGAM1526 RNA, herein designated VGAM RNA, and a schematic representation of the secondary folding of VGAM1526 folded precursor RNA, herein designated VGAM FOLDED PRECURSOR RNA, of VGAM1526 are further described hereinbelow with reference to Table 1.

Nucleotide sequences of host target binding sites, such as BINDING SITE-I, BINDING SITE-II and BINDING SITE-III of FIG. 1, found on VGAM1526 host target RNA, and schematic representation of the complementarity of each of these host target binding sites to VGAM1526 RNA, herein designated VGAM RNA, are described hereinbelow with reference to Table 2.

As mentioned hereinabove with reference to FIG. 1, a function of VGAM1526 gene, herein designated VGAM is inhibition of expression of VGAM1526 target genes. It is appreciated that specific functions, and accordingly utilities, of VGAM1526 correlate with, and may be deduced from, the identity of the target genes which VGAM1526 binds and inhibits, and the function of these target genes, as elaborated hereinbelow.

Ets Variant Gene 5 (ets-related molecule) (ETV5, Accession NM_004454) is a VGAM1526 host target gene. ETV5 BINDING SITE is HOST TARGET binding site found in the 3' untranslated region of mRNA encoded by ETV5, corresponding to a HOST TARGET binding site such as BINDING SITE I, BINDING SITE II or BINDING SITE III. Table 2 illustrates the complementarity of the nucleotide sequences of ETV5 BINDING SITE, designated SEQ ID:10749, to the nucleotide sequence of VGAM1526 RNA, herein designated VGAM RNA, also designated SEQ ID:4237.

A function of VGAM1526 is therefore inhibition of Ets Variant Gene 5 (ets-related molecule) (ETV5, Accession NM_004454), a gene which DNA binding protein of the Ets oncoprotein family. Accordingly, utilities of VGAM1526 include diagnosis, prevention and treatment of diseases and clinical conditions associated with ETV5. The function of ETV5 and its association with various diseases and clinical conditions, has been established by previous studies, as described hereinabove with reference to VGAM1171. WW Domain Containing Oxidoreductase (WWOX, Accession NM_016373) is another VGAM1526 host target gene. WWOX BINDING SITE is HOST TARGET binding site found in the 3" untranslated region of mRNA encoded by WWOX, corresponding to a HOST TARGET binding site such as BINDING SITE I, BINDING SITE II or BINDING SITE III. Table 2 illustrates the complementarity of the nucleotide sequences of WWOX BINDING SITE, designated SEQ ID:18507, to the nucleotide sequence of VGAM1526 RNA, herein designated VGAM RNA, also designated SEQ ID:4237.

Another function of VGAM1526 is therefore inhibition of WW Domain Containing Oxidoreductase (WWOX, Accession NM_016373), a gene which involves in in protein-protein interactions and may contribute to the biologic consequences of DNA instability. Accordingly, utilities of VGAM1526 include diagnosis, prevention and treatment of diseases and clinical conditions associated with WWOX. The function of WWOX and its association with various diseases and clinical conditions, has been established by previous studies, as described hereinabove with reference to VGAM644. Cab45 (Accession NM_016547) is another VGAM1526 host target gene. Cab45 BINDING SITE is HOST TARGET binding site found in the 3' untranslated region of mRNA encoded by Cab45, corresponding to a HOST TARGET binding site such as BINDING SITE I, BINDING SITE II or BINDING SITE III. Table 2 illustrates the complementarity of the nucleotide sequences of Cab45 BINDING SITE, designated SEQ ID:18620, to the nucleotide sequence of VGAM1526 RNA, herein designated VGAM RNA, also designated SEQ ID:4237.

Another function of VGAM1526 is therefore inhibition of Cab45 (Accession NM_016547). Accordingly, utilities of VGAM1526 include diagnosis, prevention and treatment of diseases and clinical conditions associated with Cab45. FIG. 1 further provides a conceptual description of a novel bioinformatically detected viral gene of the present invention, referred to here as Viral Genomic Address Messenger 1527 (VGAM1527) viral gene, which modulates expression of respective host target genes thereof, the function and utility of which host target genes is known in the art.

VGAM1527 is a novel bioinformatically detected regulatory, non protein coding, viral micro RNA (miRNA) gene. The method by which VGAM1527 was detected is described hereinabove with reference to FIGS. 1-8.

VGAM1527 gene, herein designated VGAM GENE, is a viral gene contained in the genome of Camelpox Virus. VGAM1527 host target gene, herein designated VGAM HOST TARGET GENE, is a human gene contained in the human genome.

VGAM1527 gene encodes a VGAM1527 precursor RNA, herein designated VGAM PRECURSOR RNA. Similar to other miRNA genes, and unlike most ordinary genes, VGAM1527 precursor RNA does not encode a protein. A nucleotide sequence identical or highly similar to the nucleotide sequence of VGAM1527 precursor RNA is designated SEQ ID:1513, and is provided hereinbelow with reference to the sequence listing part. Nucleotide sequence SEQ ID:1513 is located at position 68087 relative to the genome of Camelpox Virus.

VGAM1527 precursor RNA folds onto itself, forming VGAM1527 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1527 folded precursor RNA into VGAM1527 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 88%) nucleotide sequence of VGAM1527 RNA is designated SEQ ID:4238, and is provided hereinbelow with reference to the sequence listing part.

VGAM1527 host target gene, herein designated VGAM HOST TARGET GENE, encodes a corresponding messenger RNA, VGAM1527 host target RNA, herein designated VGAM HOST TARGET RNA. VGAM1527 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1527 RNA, herein designated VGAM RNA, binds complementarily to one or more host target binding sites located in untranslated regions of VGAM1527 host target RNA, herein designated VGAM HOST TARGET RNA. This complementary binding is due to the fact that the nucleotide sequence of VGAM1527 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1527 RNA, herein designated VGAM RNA, may have a different number of host target binding sites in untranslated regions of a VGAM1527 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1527 RNA, herein designated VGAM RNA, to host target binding sites on VGAM1527 host target RNA, herein designated VGAM HOST TARGET RNA, such as BINDING SITE I, BINDING SITE II and BINDING SITE III, inhibits translation of VGAM1527 host target RNA into VGAM1527 host target protein, herein designated VGAM HOST TARGET PROTEIN. VGAM host target protein is therefore outlined by a broken line.

It is appreciated that VGAM1527 host target gene, herein designated VGAM HOST TARGET GENE, in fact represents a plurality of VGAM1527 host target genes. The mRNA of each one of this plurality of VGAM1527 host target genes comprises one or more host target binding sites, each having a nucleotide sequence which is at least partly complementary to VGAM1527 RNA, herein designated VGAM RNA, and which when bound by VGAM1527 RNA causes inhibition of translation of respective one or more VGAM1527 host target proteins.

It is further appreciated by one skilled in the art that the mode of translational inhibition illustrated by FIG. 1 with specific reference to translational inhibition exerted by VGAM1527 gene, herein designated VGAM GENE, on one or more VGAM1527 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1527 is inhibition of expression of host target genes, as part of a novel viral mechanism of attacking a host. Accordingly, utilities of VGAM1527 include diagnosis, prevention and treatment of viral infection by Camelpox Virus. Specific functions, and accordingly utilities, of VGAM1527 correlate with, and may be deduced from, the identity of the host target genes which VGAM1527 binds and inhibits, and the function of these host target genes, as elaborated hereinbelow.

Nucleotide sequences of the VGAM1527 precursor RNA, herein designated VGAM PRECURSOR RNA, and of the 'diced' VGAM1527 RNA, herein designated VGAM RNA, and a schematic representation of the secondary folding of VGAM1527 folded precursor RNA, herein designated VGAM FOLDED PRECURSOR RNA, of VGAM1527 are further described hereinbelow with reference to Table 1.

Nucleotide sequences of host target binding sites, such as BINDING SITE-I, BINDING SITE-II and BINDING SITE-III of FIG. 1, found on VGAM1527 host target RNA, and schematic representation of the complementarity of each of these host target binding sites to VGAM1527 RNA, herein designated VGAM RNA, are described hereinbelow with reference to Table 2.

As mentioned hereinabove with reference to FIG. 1, a function of VGAM1527 gene, herein designated VGAM is inhibition of expression of VGAM1527 target genes. It is appreciated that specific functions, and accordingly utilities, of VGAM1527 correlate with, and may be deduced from, the identity of the target genes which VGAM1527 binds and inhibits, and the function of these target genes, as elaborated hereinbelow.

Ankyrin 3, Node of Ranvier (ankyrin G) (ANK3, Accession NM_020987) is a VGAM1527 host target gene. ANK3 BINDING SITE is HOST TARGET binding site found in the 3' untranslated region of mRNA encoded by ANK3, corresponding to a HOST TARGET binding site such as BINDING SITE I, BINDING SITE II or BINDING SITE III. Table 2 illustrates the complementarity of the nucleotide sequences of ANK3 BINDING SITE, designated SEQ ID:21980, to the nucleotide sequence of VGAM1527 RNA, herein designated VGAM RNA, also designated SEQ ID:4238.

A function of VGAM1527 is therefore inhibition of Ankyrin 3, Node of Ranvier (ankyrin G) (ANK3, Accession NM_020987), a gene which plays key roles in activities such as cell motility, activation, proliferation. Accordingly, utilities of VGAM1527 include diagnosis, prevention and treatment of diseases and clinical conditions associated with ANK3. The function of ANK3 has been established by previous studies. Tse et al. (1991) studied immunoreactive isoforms of erythrocyte ankyrin found in nonerythroid tissues. Using an erythrocyte ankyrin cDNA clone as a hybridization probe, they isolated a clone from a human genomic library that hybridized at low but not at high stringency. Further studies suggested that the clone represented part of a gene for nonerythroid ankyrin, which they designated ANK2. By analysis of somatic cell hybrids and by fluorescence in situ hybridization, they assigned ANK2 to 4q25-q27. Otto et al. (1991) isolated and sequenced cDNAs related to 2 brain ankyrin isoforms and showed that they are produced through alternative splicing of the mRNA from a single gene. By analysis of human/rodent cell hybrids, Otto et al. (1991) assigned the brain ankyrin gene to chromosome 4.

Full details of the abovementioned studies are described in the following publications, the disclosure of which are hereby incorporated by reference:

Otto, E.; Kunimoto, M.; McLaughlin, T.; Bennett, V.: Isolation and characterization of cDNAs encoding human brain ankyrins reveal a family of alternatively spliced genes. J. Cell Biol. 114:241-253, 1991; and Tse, W. T.; Menninger, J. C.; Yang-Feng, T. L.; Francke, U.; Sahr, K. E.; Lux, S. E.; Ward, D. C.; Forget, B. G.: Isolation and chromosomal localization of a novel non-erythroid ankyri.

Further studies establishing the function and utilities of ANK3 are found in John Hopkins OMIM database record ID 600465, and in sited publications numbered 1607, 672 and 7731 listed in the bibliography section hereinbelow, which are also hereby incorporated by reference. FLJ22029 (Accession NM_024949) is another VGAM1527 host target gene. FLJ22029 BINDING SITE is HOST TARGET binding site found in the 3' untranslated region of mRNA encoded by FLJ22029, corresponding to a HOST TARGET binding site such as BINDING SITE I, BINDING SITE II or BINDING SITE III. Table 2 illustrates the complementarity of the nucleotide sequences of FLJ22029 BINDING SITE, designated SEQ ID:24503, to the nucleotide sequence of VGAM1527 RNA, herein designated VGAM RNA, also designated SEQ ID:4238.

Another function of VGAM1527 is therefore inhibition of FLJ22029 (Accession NM_024949). Accordingly, utilities of VGAM1527 include diagnosis, prevention and treatment of diseases and clinical conditions associated with FLJ22029. KIAA1579 (Accession NM_018211) is another VGAM1527 host target gene. KIAA1579 BINDING SITE is HOST TARGET binding site found in the 3' untranslated region of mRNA encoded by KIAA1579, corresponding to a HOST TARGET binding site such as BINDING SITE I, BINDING SITE II or BINDING SITE III. Table 2 illustrates the complementarity of the nucleotide sequences of KIAA1579 BINDING SITE, designated SEQ ID:20115, to the nucleotide sequence of VGAM1527 RNA, herein designated VGAM RNA, also designated SEQ ID:4238.

Another function of VGAM1527 is therefore inhibition of KIAA1579 (Accession NM_018211). Accordingly, utilities of VGAM1527 include diagnosis, prevention and treatment of diseases and clinical conditions associated with KIAA1579. LOC149153 (Accession XM_097599) is another VGAM1527 host target gene. LOC149153 BINDING SITE is HOST TARGET binding site found in the 3' untranslated region of mRNA encoded by LOC149153, corresponding to a HOST TARGET binding site such as BINDING SITE I, BINDING SITE II or BINDING SITE III. Table 2 illustrates the complementarity of the nucleotide sequences of LOC149153 BINDING SITE, designated SEQ ID:40961, to the nucleotide sequence of VGAM1527 RNA, herein designated VGAM RNA, also designated SEQ ID:4238.

Another function of VGAM1527 is therefore inhibition of LOC149153 (Accession XM_097599). Accordingly, utilities of VGAM1527 include diagnosis, prevention and treatment of diseases and clinical conditions associated with LOC149153. FIG. 1 further provides a conceptual description of a novel bioinformatically detected viral gene of the present invention, referred to here as Viral Genomic Address Messenger 1528 (VGAM1528) viral gene, which modulates expression of respective host target genes thereof, the function and utility of which host target genes is known in the art.

VGAM1528 is a novel bioinformatically detected regulatory, non protein coding, viral micro RNA (miRNA) gene. The method by which VGAM1528 was detected is described hereinabove with reference to FIGS. 1-8.

VGAM1528 gene, herein designated VGAM GENE, is a viral gene contained in the genome of Ectromelia Virus. VGAM1528 host target gene, herein designated VGAM HOST TARGET GENE, is a human gene contained in the human genome.

VGAM1528 gene encodes a VGAM1528 precursor RNA, herein designated VGAM PRECURSOR RNA. Similar to other miRNA genes, and unlike most ordinary genes, VGAM1528 precursor RNA does not encode a protein. A nucleotide sequence identical or highly similar to the nucleotide sequence of VGAM1528 precursor RNA is designated SEQ ID:1514, and is provided hereinbelow with reference to the sequence listing part. Nucleotide sequence SEQ ID:1514 is located at position 72786 relative to the genome of Ectromelia Virus.

VGAM1528 precursor RNA folds onto itself, forming VGAM1528 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1528 folded precursor RNA into VGAM1528 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1528 RNA is designated SEQ ID:4239, and is provided hereinbelow with reference to the sequence listing part.

VGAM1528 host target gene, herein designated VGAM HOST TARGET GENE, encodes a corresponding messenger RNA, VGAM1528 host target RNA, herein designated VGAM HOST TARGET RNA. VGAM1528 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1528 RNA, herein designated VGAM RNA, binds complementarily to one or more host target binding sites located in untranslated regions of VGAM1528 host target RNA, herein designated VGAM HOST TARGET RNA. This complementary binding is due to the fact that the nucleotide sequence of VGAM1528 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1528 RNA, herein designated VGAM RNA, may have a different number of host target binding sites in untranslated regions of a VGAM1528 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1528 RNA, herein designated VGAM RNA, to host target binding sites on VGAM1528 host target RNA, herein designated VGAM HOST TARGET RNA, such as BINDING SITE I, BINDING SITE II and BINDING SITE III, inhibits translation of VGAM1528 host target RNA into VGAM1528 host target protein, herein designated VGAM HOST TARGET PROTEIN. VGAM host target protein is therefore outlined by a broken line.

It is appreciated that VGAM1528 host target gene, herein designated VGAM HOST TARGET GENE, in fact represents a plurality of VGAM1528 host target genes. The mRNA of each one of this plurality of VGAM1528 host target genes comprises one or more host target binding sites, each having a nucleotide sequence which is at least partly complementary to VGAM1528 RNA, herein designated VGAM RNA, and which when bound by VGAM1528 RNA causes inhibition of translation of respective one or more VGAM1528 host target proteins.

It is further appreciated by one skilled in the art that the mode of translational inhibition illustrated by FIG. 1 with specific reference to translational inhibition exerted by VGAM1528 gene, herein designated VGAM GENE, on one or more VGAM1528 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1528 is inhibition of expression of host target genes, as part of a novel viral mechanism of attacking a host. Accordingly, utilities of VGAM1528 include diagnosis, prevention and treatment of viral infection by Ectromelia Virus. Specific functions, and accordingly utilities, of VGAM1528 correlate with, and may be deduced from, the identity of the host target genes which VGAM1528 binds and inhibits, and the function of these host target genes, as elaborated hereinbelow.

Nucleotide sequences of the VGAM1528 precursor RNA, herein designated VGAM PRECURSOR RNA, and of the 'diced' VGAM1528 RNA, herein designated VGAM RNA, and a schematic representation of the secondary folding of VGAM1528 folded precursor RNA, herein designated VGAM FOLDED PRECURSOR RNA, of VGAM1528 are further described hereinbelow with reference to Table 1.

Nucleotide sequences of host target binding sites, such as BINDING SITE-I, BINDING SITE-II and BINDING SITE-III of FIG. 1, found on VGAM1528 host target RNA, and schematic representation of the complementarity of each of these host target binding sites to VGAM1528 RNA, herein designated VGAM RNA, are described hereinbelow with reference to Table 2.

As mentioned hereinabove with reference to FIG. 1, a function of VGAM1528 gene, herein designated VGAM, is inhibition of expression of VGAM1528 target genes. It is appreciated that specific functions, and accordingly utilities, of VGAM1528 correlate with, and may be deduced from, the identity of the target genes which VGAM1528 binds and inhibits, and the function of these target genes, as elaborated hereinbelow.

Membrane Component, Chromosome 11, Surface Marker 1 (M11S1, Accession NM_005898) is a VGAM1528 host target gene. M11S1 BINDING SITE is HOST TARGET binding site found in the 3' untranslated region of mRNA encoded by M11S1, corresponding to a HOST TARGET binding site such as BINDING SITE I, BINDING SITE II or BINDING SITE III. Table 2 illustrates the complementarity of the nucleotide sequences of M11S1 BINDING SITE, designated SEQ ID:12516, to the nucleotide sequence of VGAM1528 RNA, herein designated VGAM RNA, also designated SEQ ID:4239.

A function of VGAM1528 is therefore inhibition of Membrane Component, Chromosome 11, Surface Marker 1 (M11S1, Accession NM_005898), a gene which may play a role in transporting nutrients from the gut lumen across the gutlining epithelial cell layer. Accordingly, utilities of VGAM1528 include diagnosis, prevention and treatment of diseases and clinical conditions associated with M11S1. The function of M11S1 and its association with various diseases and clinical conditions, has been established by previous studies, as described hereinabove with reference to VGAM131. Placenta-specific 1 (PLAC1, Accession NM_021796) is another VGAM1528 host target gene. PLAC1 BINDING SITE is HOST TARGET binding site found in the 5' untranslated region of mRNA encoded by PLAC1, corresponding to a HOST TARGET binding site such as BINDING SITE I, BINDING SITE II or BINDING SITE III. Table 2 illustrates the complementarity of the nucleotide sequences of PLAC1 BINDING SITE, designated SEQ ID:22352, to the nucleotide sequence of VGAM1528 RNA, herein designated VGAM RNA, also designated SEQ ID:4239.

Another function of VGAM1528 is therefore inhibition of Placenta-specific 1 (PLAC1, Accession NM_021796). Accordingly, utilities of VGAM1528 include diagnosis, prevention and treatment of diseases and clinical conditions associated with PLAC1. Ubiquitin Protein Ligase E3A (human papilloma virus E6-associated protein, Angelman syndrome) (UBE3A, Accession NM_130838) is another VGAM1528 host target gene. UBE3A BINDING SITE1 through UBE3A BINDING SITE3 are HOST TARGET binding sites found in untranslated regions of mRNA encoded by UBE3A, corresponding to HOST TARGET binding sites such as BINDING SITE I, BINDING SITE II or BINDING SITE III. Table 2 illustrates the complementarity of the nucleotide sequences of UBE3A BINDING SITE1 through UBE3A BINDING SITE3, designated SEQ ID:28360, SEQ ID:28364 and SEQ ID:6079 respectively, to the nucleotide sequence of VGAM1528 RNA, herein designated VGAM RNA, also designated SEQ ID:4239.

Another function of VGAM1528 is therefore inhibition of Ubiquitin Protein Ligase E3A (human papilloma virus E6-associated protein, Angelman syndrome) (UBE3A, Accession NM_130838). Accordingly, utilities of VGAM1528 include diagnosis, prevention and treatment of diseases and clinical conditions associated with UBE3A. LOC91250 (Accession XM_037135) is another VGAM1528 host target gene. LOC91250 BINDING SITE is HOST TARGET binding site found in the 5' untranslated region of mRNA encoded by LOC91250, corresponding to a HOST TARGET binding site such as BINDING SITE I, BINDING SITE II or BINDING SITE III. Table 2 illustrates the complementarity of the nucleotide sequences of LOC91250 BINDING SITE, designated SEQ ID:32548, to the nucleotide sequence of VGAM1528

RNA, herein designated VGAM RNA, also designated SEQ ID:4239.

Another function of VGAM1528 is therefore inhibition of LOC91250 (Accession XM_037135). Accordingly, utilities of VGAM1528 include diagnosis, prevention and treatment of diseases and clinical conditions associated with LOC91250. FIG. 1 further provides a conceptual description of a novel bioinformatically detected viral gene of the present invention, referred to here as Viral Genomic Address Messenger 1529 (VGAM1529) viral gene, which modulates expression of respective host target genes thereof, the function and utility of which host target genes is known in the art.

VGAM1529 is a novel bioinformatically detected regulatory, non protein coding, viral micro RNA (miRNA) gene. The method by which VGAM1529 was detected is described hereinabove with reference to FIGS. 1-8.

VGAM1529 gene, herein designated VGAM GENE, is a viral gene contained in the genome of Ectromelia Virus. VGAM1529 host target gene, herein designated VGAM HOST TARGET GENE, is a human gene contained in the human genome.

VGAM1529 gene encodes a VGAM1529 precursor RNA, herein designated VGAM PRECURSOR RNA. Similar to other miRNA genes, and unlike most ordinary genes, VGAM1529 precursor RNA does not encode a protein. A nucleotide sequence identical or highly similar to the nucleotide sequence of VGAM1529 precursor RNA is designated SEQ ID:1515, and is provided hereinbelow with reference to the sequence listing part. Nucleotide sequence SEQ ID:1515 is located at position 69246 relative to the genome of Ectromelia Virus.

VGAM1529 precursor RNA folds onto itself, forming VGAM1529 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1529 folded precursor RNA into VGAM1529 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1529 RNA is designated SEQ ID:4240, and is provided hereinbelow with reference to the sequence listing part.

VGAM1529 host target gene, herein designated VGAM HOST TARGET GENE, encodes a corresponding messenger RNA, VGAM1529 host target RNA, herein designated VGAM HOST TARGET RNA. VGAM1529 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1529 RNA, herein designated VGAM RNA, binds complementarily to one or more host target binding sites located in untranslated regions of VGAM1529 host target RNA, herein designated VGAM HOST TARGET RNA. This complementary binding is due to the fact that the nucleotide sequence of VGAM1529 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1529 RNA, herein designated VGAM RNA, may have a different number of host target binding sites in untranslated regions of a VGAM1529 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1529 RNA, herein designated VGAM RNA, to host target binding sites on VGAM1529 host target RNA, herein designated VGAM HOST TARGET RNA, such as BINDING SITE I, BINDING SITE II and BINDING SITE III, inhibits translation of VGAM1529 host target RNA into VGAM1529 host target protein, herein designated VGAM HOST TARGET PROTEIN. VGAM host target protein is therefore outlined by a broken line.

It is appreciated that VGAM1529 host target gene, herein designated VGAM HOST TARGET GENE, in fact represents a plurality of VGAM1529 host target genes. The mRNA of each one of this plurality of VGAM1529 host target genes comprises one or more host target binding sites, each having a nucleotide sequence which is at least partly complementary to VGAM1529 RNA, herein designated VGAM RNA, and which when bound by VGAM1529 RNA causes inhibition of translation of respective one or more VGAM1529 host target proteins.

It is further appreciated by one skilled in the art that the mode of translational inhibition illustrated by FIG. 1 with specific reference to translational inhibition exerted by VGAM1529 gene, herein designated VGAM GENE, on one or more VGAM1529 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1529 is inhibition of expression of host target genes, as part of a novel viral mechanism of attacking a host. Accordingly, utilities of VGAM1529 include diagnosis, prevention and treatment of viral infection by Ectromelia Virus. Specific functions, and accordingly utilities, of VGAM1529 correlate with, and may be deduced from, the identity of the host target genes which VGAM1529 binds and inhibits, and the function of these host target genes, as elaborated hereinbelow.

Nucleotide sequences of the VGAM1529 precursor RNA, herein designated VGAM PRECURSOR RNA, and of the 'diced' VGAM1529 RNA, herein designated VGAM RNA, and a schematic representation of the secondary folding of VGAM1529 folded precursor RNA, herein designated VGAM FOLDED PRECURSOR RNA, of VGAM1529 are further described hereinbelow with reference to Table 1.

Nucleotide sequences of host target binding sites, such as BINDING SITE-I, BINDING SITE-II and BINDING SITE-III of FIG. 1, found on VGAM1529 host target RNA, and schematic representation of the complementarity of each of these host target binding sites to VGAM1529 RNA, herein designated VGAM RNA, are described hereinbelow with reference to Table 2.

As mentioned hereinabove with reference to FIG. 1, a function of VGAM1529 gene, herein designated VGAM is inhibition of expression of VGAM1529 target genes. It is appreciated that specific functions, and accordingly utilities, of VGAM1529 correlate with, and may be deduced from, the identity of the target genes which VGAM1529 binds and inhibits, and the function of these target genes, as elaborated hereinbelow.

Hepatocyte Growth Factor (hepapoietin A; scatter factor) (HGF, Accession XM_168542) is a VGAM1529 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45216, to the nucleotide sequence of VGAM1529 RNA, herein designated VGAM RNA, also designated SEQ ID:4240.

A function of VGAM1529 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM1529 include diagnosis, prevention and treatment of diseases and clinical conditions associated with HGF. The function of HGF and its association with various diseases and clinical conditions, has been established by previous studies, as described hereinabove with reference to VGAM174. Chromosome 20 Open Reading Frame 43 (C20orf43, Accession XM_009549) is another VGAM1529 host target gene. C20orf43 BINDING SITE is HOST TARGET binding site found in the 3" untranslated region of mRNA encoded by C20orf43, corresponding to a HOST TARGET binding site such as BINDING SITE I, BINDING SITE II or BINDING SITE III. Table 2 illustrates the complementarity of the nucleotide sequences of C20orf43 BINDING SITE, designated SEQ ID:30113, to the nucleotide sequence of VGAM1529 RNA, herein designated VGAM RNA, also designated SEQ ID:4240.

Another function of VGAM1529 is therefore inhibition of Chromosome 20 Open Reading Frame 43 (C20orf43, Accession XM_009549). Accordingly, utilities of VGAM1529 include diagnosis, prevention and treatment of diseases and clinical conditions associated with C20orf43. KIAA1559 (Accession XM_054472) is another VGAM1529 host target gene. KIAA1559 BINDING SITE is HOST TARGET binding site found in the 3' untranslated region of mRNA encoded by KIAA1559, corresponding to a HOST TARGET binding site such as BINDING SITE I, BINDING SITE II or BINDING SITE III. Table 2 illustrates the complementarity of the nucleotide sequences of KIAA1559 BINDING SITE, designated SEQ ID:36160, to the nucleotide sequence of VGAM1529 RNA, herein designated VGAM RNA, also designated SEQ ID:4240.

Another function of VGAM1529 is therefore inhibition of KIAA1559 (Accession XM_054472). Accordingly, utilities of VGAM1529 include diagnosis, prevention and treatment of diseases and clinical conditions associated with KIAA1559. LOC152179 (Accession XM_098170) is another VGAM1529 host target gene. LOC152179 BINDING SITE is HOST TARGET binding site found in the 5' untranslated region of mRNA encoded by LOC152179, corresponding to a HOST TARGET binding site such as BINDING SITE I, BINDING SITE II or BINDING SITE III. Table 2 illustrates the complementarity of the nucleotide sequences of LOC152179 BINDING SITE, designated SEQ ID:41431, to the nucleotide sequence of VGAM1529 RNA, herein designated VGAM RNA, also designated SEQ ID:4240.

Another function of VGAM1529 is therefore inhibition of LOC152179 (Accession XM_098170). Accordingly, utilities of VGAM1529 include diagnosis, prevention and treatment of diseases and clinical conditions associated with LOC152179. FIG. 1 further provides a conceptual description of a novel bioinformatically detected viral gene of the present invention, referred to here as Viral Genomic Address Messenger 1530 (VGAM1530) viral gene, which modulates expression of respective host target genes thereof, the function and utility of which host target genes is known in the art.

VGAM1530 is a novel bioinformatically detected regulatory, non protein coding, viral micro RNA (miRNA) gene. The method by which VGAM1530 was detected is described hereinabove with reference to FIGS. 1-8.

VGAM1530 gene, herein designated VGAM GENE, is a viral gene contained in the genome of Ectromelia Virus. VGAM1530 host target gene, herein designated VGAM HOST TARGET GENE, is a human gene contained in the human genome.

VGAM1530 gene encodes a VGAM1530 precursor RNA, herein designated VGAM PRECURSOR RNA. Similar to other miRNA genes, and unlike most ordinary genes, VGAM1530 precursor RNA does not encode a protein. A nucleotide sequence identical or highly similar to the nucleotide sequence of VGAM1530 precursor RNA is designated SEQ ID:1516, and is provided hereinbelow with reference to the sequence listing part. Nucleotide sequence SEQ ID:1516 is located at position 73081 relative to the genome of Ectromelia Virus.

VGAM1530 precursor RNA folds onto itself, forming VGAM1530 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1530 folded precursor RNA into VGAM1530 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1530 RNA is designated SEQ ID:4241, and is provided hereinbelow with reference to the sequence listing part.

VGAM1530 host target gene, herein designated VGAM HOST TARGET GENE, encodes a corresponding messenger RNA, VGAM1530 host target RNA, herein designated VGAM HOST TARGET RNA. VGAM1530 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1530 RNA, herein designated VGAM RNA, binds complementarily to one or more host target binding sites located in untranslated regions of VGAM1530 host target RNA, herein designated VGAM HOST TARGET RNA. This complementary binding is due to the fact that the nucleotide sequence of VGAM1530 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1530 RNA, herein designated VGAM RNA, may have a different number of host target binding sites in untranslated regions of a VGAM1530 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1530 RNA, herein designated VGAM RNA, to host target binding sites on VGAM1530 host target RNA, herein designated VGAM HOST TARGET RNA, such as BINDING SITE I, BINDING SITE II and BINDING SITE III, inhibits translation of VGAM1530 host target RNA into VGAM1530 host target protein, herein designated VGAM HOST TARGET PROTEIN. VGAM host target protein is therefore outlined by a broken line.

It is appreciated that VGAM1530 host target gene, herein designated VGAM HOST TARGET GENE, in fact represents a plurality of VGAM1530 host target genes. The mRNA of each one of this plurality of VGAM1530 host target genes comprises one or more host target binding sites, each having a nucleotide sequence which is at least partly complementary to VGAM1530 RNA, herein designated VGAM RNA, and which when bound by VGAM1530 RNA causes inhibition of translation of respective one or more VGAM1530 host target proteins.

It is further appreciated by one skilled in the art that the mode of translational inhibition illustrated by FIG. 1 with specific reference to translational inhibition exerted by VGAM1530 gene, herein designated VGAM GENE, on one or more VGAM1530 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1530 is inhibition of expression of host target genes, as part of a novel viral mechanism of attacking a host. Accordingly, utilities of VGAM1530 include diagnosis, prevention and treatment of viral infection by Ectromelia Virus. Specific functions, and accordingly utilities, of VGAM1530 correlate with, and may be deduced from, the identity of the host target genes which VGAM1530 binds and inhibits, and the function of these host target genes, as elaborated hereinbelow.

Nucleotide sequences of the VGAM1530 precursor RNA, herein designated VGAM PRECURSOR RNA, and of the 'diced' VGAM1530 RNA, herein designated VGAM RNA, and a schematic representation of the secondary folding of VGAM1530 folded precursor RNA, herein designated VGAM FOLDED PRECURSOR RNA, of VGAM1530 are further described hereinbelow with reference to Table 1.

Nucleotide sequences of host target binding sites, such as BINDING SITE-I, BINDING SITE-II and BINDING SITE-III of FIG. 1, found on VGAM1530 host target RNA, and schematic representation of the complementarity of each of these host target binding sites to VGAM1530 RNA, herein designated VGAM RNA, are described hereinbelow with reference to Table 2.

As mentioned hereinabove with reference to FIG. 1, a function of VGAM1530 gene, herein designated VGAM is inhibition of expression of VGAM1530 target genes. It is appreciated that specific functions, and accordingly utilities, of VGAM1530 correlate with, and may be deduced from, the identity of the target genes which VGAM1530 binds and inhibits, and the function of these target genes, as elaborated hereinbelow.

KIAA0429 (Accession NM_014751) is a VGAM1530 host target gene. KIAA0429 BINDING SITE is HOST TARGET binding site found in the 5' untranslated region of mRNA encoded by KIAA0429, corresponding to a HOST TARGET binding site such as BINDING SITE I, BINDING SITE II or BINDING SITE III. Table 2 illustrates the complementarity of the nucleotide sequences of KIAA0429 BINDING SITE, designated SEQ ID:16467, to the nucleotide sequence of VGAM1530 RNA, herein designated VGAM RNA, also designated SEQ ID:4241.

A function of VGAM1530 is therefore inhibition of KIAA0429 (Accession NM_014751). Accordingly, utilities of VGAM1530 include diagnosis, prevention and treatment of diseases and clinical conditions associated with KIAA0429. Protocadherin 17 (PCDH17, Accession NM_014459) is another VGAM1530 host target gene. PCDH17 BINDING SITE is HOST TARGET binding site found in the 3' untranslated region of mRNA encoded by PCDH17, corresponding to a HOST TARGET binding site such as BINDING SITE I, BINDING SITE II or BINDING SITE III. Table 2 illustrates the complementarity of the nucleotide sequences of PCDH17 BINDING SITE, designated SEQ ID:15812, to the nucleotide sequence of VGAM1530 RNA, herein designated VGAM RNA, also designated SEQ ID:4241.

Another function of VGAM1530 is therefore inhibition of Protocadherin 17 (PCDH17, Accession NM_014459). Accordingly, utilities of VGAM1530 include diagnosis, prevention and treatment of diseases and clinical conditions associated with PCDH17. LOC256806 (Accession XM_172865) is another VGAM1530 host target gene. LOC256806 BINDING SITE is HOST TARGET binding site found in the 5' untranslated region of mRNA encoded by LOC256806, corresponding to a HOST TARGET binding site such as BINDING SITE I, BINDING SITE II or BINDING SITE III. Table 2 illustrates the complementarity of the nucleotide sequences of LOC256806 BINDING SITE, designated SEQ ID:46143, to the nucleotide sequence of VGAM1530 RNA, herein designated VGAM RNA, also designated SEQ ID:4241.

Another function of VGAM1530 is therefore inhibition of LOC256806 (Accession XM_172865). Accordingly, utilities of VGAM1530 include diagnosis, prevention and treatment of diseases and clinical conditions associated with LOC256806. FIG. 1 further provides a conceptual description of a novel bioinformatically detected viral gene of the present invention, referred to here as Viral Genomic Address Messenger 1531 (VGAM1531) viral gene, which modulates expression of respective host target genes thereof, the function and utility of which host target genes is known in the art.

VGAM1531 is a novel bioinformatically detected regulatory, non protein coding, viral micro RNA (miRNA) gene. The method by which VGAM1531 was detected is described hereinabove with reference to FIGS. 1-8.

VGAM1531 gene, herein designated VGAM GENE, is a viral gene contained in the genome of Ectromelia Virus. VGAM1531 host target gene, herein designated VGAM HOST TARGET GENE, is a human gene contained in the human genome.

VGAM1531 gene encodes a VGAM1531 precursor RNA, herein designated VGAM PRECURSOR RNA. Similar to other miRNA genes, and unlike most ordinary genes, VGAM1531 precursor RNA does not encode a protein. A nucleotide sequence identical or highly similar to the nucleotide sequence of VGAM1531 precursor RNA is designated SEQ ID:1517, and is provided hereinbelow with reference to the sequence listing part. Nucleotide sequence SEQ ID:1517 is located at position 66901 relative to the genome of Ectromelia Virus.

VGAM1531 precursor RNA folds onto itself, forming VGAM1531 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1531 folded precursor RNA into VGAM1531 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM1531 RNA is designated SEQ ID:4242, and is provided hereinbelow with reference to the sequence listing part.

VGAM1531 host target gene, herein designated VGAM HOST TARGET GENE, encodes a corresponding messenger RNA, VGAM1531 host target RNA, herein designated VGAM HOST TARGET RNA. VGAM1531 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1531 RNA, herein designated VGAM RNA, binds complementarily to one or more host target binding sites located in untranslated regions of VGAM1531 host target RNA, herein designated VGAM HOST TARGET RNA. This complementary binding is due to the fact that the nucleotide sequence of VGAM1531 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1531 RNA, herein designated VGAM RNA, may have a different number of host target binding sites in untranslated regions of a VGAM1531 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1531 RNA, herein designated VGAM RNA, to host target binding sites on VGAM1531 host target RNA, herein designated VGAM HOST TARGET RNA, such as BINDING SITE I, BINDING SITE II and BINDING SITE III, inhibits translation of VGAM1531 host target RNA into VGAM1531 host target protein, herein designated VGAM HOST TARGET PROTEIN. VGAM host target protein is therefore outlined by a broken line.

It is appreciated that VGAM1531 host target gene, herein designated VGAM HOST TARGET GENE, in fact represents a plurality of VGAM1531 host target genes. The mRNA of each one of this plurality of VGAM1531 host target genes comprises one or more host target binding sites, each having a nucleotide sequence which is at least partly complementary to VGAM1531 RNA, herein designated VGAM RNA, and which when bound by VGAM1531 RNA causes inhibition of translation of respective one or more VGAM1531 host target proteins.

It is further appreciated by one skilled in the art that the mode of translational inhibition illustrated by FIG. 1 with specific reference to translational inhibition exerted by VGAM1531 gene, herein designated VGAM GENE, on one or more VGAM1531 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1531 is inhibition of expression of host target genes, as part of a novel viral mechanism of attacking a host. Accordingly, utilities of VGAM1531 include diagnosis, prevention and treatment of viral infection by Ectromelia Virus. Specific functions, and accordingly utilities, of VGAM1531 correlate with, and may be deduced from, the identity of the host target genes which VGAM1531 binds and inhibits, and the function of these host target genes, as elaborated hereinbelow.

Nucleotide sequences of the VGAM1531 precursor RNA, herein designated VGAM PRECURSOR RNA, and of the 'diced' VGAM1531 RNA, herein designated VGAM RNA, and a schematic representation of the secondary folding of VGAM1531 folded precursor RNA, herein designated VGAM FOLDED PRECURSOR RNA, of VGAM1531 are further described hereinbelow with reference to Table 1.

Nucleotide sequences of host target binding sites, such as BINDING SITE-I, BINDING SITE-II and BINDING SITE-III of FIG. 1, found on VGAM1531 host target RNA, and schematic representation of the complementarity of each of these host target binding sites to VGAM1531 RNA, herein designated VGAM RNA, are described hereinbelow with reference to Table 2.

As mentioned hereinabove with reference to FIG. 1, a function of VGAM1531 gene, herein designated VGAM is inhibition of expression of VGAM1531 target genes. It is appreciated that specific functions, and accordingly utilities, of VGAM1531 correlate with, and may be deduced from, the identity of the target genes which VGAM1531 binds and inhibits, and the function of these target genes, as elaborated hereinbelow.

Ubiquitin-conjugating Enzyme E2L 3 (UBE2L3, Accession NM_003347) is a VGAM1531 host target gene. UBE2L3 BINDING SITE is HOST TARGET binding site found in the 3' untranslated region of mRNA encoded by UBE2L3, corresponding to a HOST TARGET binding site such as BINDING SITE I, BINDING SITE II or BINDING SITE III. Table 2 illustrates the complementarity of the nucleotide sequences of UBE2L3 BINDING SITE, designated SEQ ID:9361, to the nucleotide sequence of VGAM1531 RNA, herein designated VGAM RNA, also designated SEQ ID:4242.

A function of VGAM1531 is therefore inhibition of Ubiquitin-conjugating Enzyme E2L 3 (UBE2L3, Accession NM_003347), a gene which catalyzes the covalent attachment of ubiquitin to other proteins. Accordingly, utilities of VGAM1531 include diagnosis, prevention and treatment of diseases and clinical conditions associated with UBE2L3. The function of UBE2L3 and its association with various diseases and clinical conditions, has been established by previous studies, as described hereinabove with reference to VGAM215. ATP-binding Cassette, Sub-family A (ABC1), Member 5 (ABCA5, Accession NM_018672) is another VGAM1531 host target gene. ABCA5 BINDING SITE is HOST TARGET binding site found in the 5' untranslated region of mRNA encoded by ABCA5, corresponding to a HOST TARGET binding site such as BINDING SITE I, BINDING SITE II or BINDING SITE III. Table 2 illustrates the complementarity of the nucleotide sequences of ABCA5 BINDING SITE, designated SEQ ID:20745, to the nucleotide sequence of VGAM1531 RNA, herein designated VGAM RNA, also designated SEQ ID:4242.

Another function of VGAM1531 is therefore inhibition of ATP-binding Cassette, Sub-family A (ABC1), Member 5 (ABCA5, Accession NM_018672). Accordingly, utilities of VGAM1531 include diagnosis, prevention and treatment of diseases and clinical conditions associated with ABCA5. DKFZP434B103 (Accession NM_015644) is another VGAM1531 host target gene. DKFZP434B103 BINDING SITE is HOST TARGET binding site found in the 5' untranslated region of mRNA encoded by DKFZP434B103, corresponding to a HOST TARGET binding site such as BINDING SITE I, BINDING SITE II or BINDING SITE III. Table 2 illustrates the complementarity of the nucleotide sequences of DKFZP434B103 BINDING SITE, designated SEQ ID:17895, to the nucleotide sequence of VGAM1531 RNA, herein designated VGAM RNA, also designated SEQ ID:4242.

Another function of VGAM1531 is therefore inhibition of DKFZP434B103 (Accession NM_015644). Accordingly, utilities of VGAM1531 include diagnosis, prevention and treatment of diseases and clinical conditions associated with DKFZP434B103. FLJ13693 (Accession NM_024807) is another VGAM1531 host target gene. FLJ13693 BINDING SITE is HOST TARGET binding site found in the 3' untranslated region of mRNA encoded by FLJ13693, corresponding to a HOST TARGET binding site such as BINDING SITE I, BINDING SITE II or BINDING SITE III. Table 2 illustrates the complementarity of the nucleotide sequences of FLJ13693 BINDING SITE, designated SEQ ID:24188, to the nucleotide sequence of VGAM1531 RNA, herein designated VGAM RNA, also designated SEQ ID:4242.

Another function of VGAM1531 is therefore inhibition of FLJ13693 (Accession NM_024807). Accordingly, utilities of VGAM1531 include diagnosis, prevention and treatment of diseases and clinical conditions associated with FLJ13693.

FLJ20699 (Accession NM_017931) is another VGAM1531 host target gene. FLJ20699 BINDING SITE is HOST TARGET binding site found in the 3' untranslated region of mRNA encoded by FLJ20699, corresponding to a HOST TARGET binding site such as BINDING SITE I, BINDING SITE II or BINDING SITE III. Table 2 illustrates the complementarity of the nucleotide sequences of FLJ20699 BINDING SITE, designated SEQ ID:19619, to the nucleotide sequence of VGAM1531 RNA, herein designated VGAM RNA, also designated SEQ ID:4242.

Another function of VGAM1531 is therefore inhibition of FLJ20699 (Accession NM_017931). Accordingly, utilities of VGAM1531 include diagnosis, prevention and treatment of diseases and clinical conditions associated with FLJ20699. Potassium Voltage-gated Channel, Isk-related Family, Member 4 (KCNE4, Accession NM_080671) is another VGAM1531 host target gene. KCNE4 BINDING SITE is HOST TARGET binding site found in the 3' untranslated region of mRNA encoded by KCNE4, corresponding to a HOST TARGET binding site such as BINDING SITE I, BINDING SITE II or BINDING SITE III. Table 2 illustrates the complementarity of the nucleotide sequences of KCNE4 BINDING SITE, designated SEQ ID:27968, to the nucleotide sequence of VGAM1531 RNA, herein designated VGAM RNA, also designated SEQ ID:4242.

Another function of VGAM1531 is therefore inhibition of Potassium Voltage-gated Channel, Isk-related Family, Member 4 (KCNE4, Accession NM_080671). Accordingly, utilities of VGAM1531 include diagnosis, prevention and treatment of diseases and clinical conditions associated with KCNE4. LOC147976 (Accession XM_085980) is another VGAM1531 host target gene. LOC147976 BINDING SITE is HOST TARGET binding site found in the 3' untranslated region of mRNA encoded by LOC147976, corresponding to a HOST TARGET binding site such as BINDING SITE I, BINDING SITE II or BINDING SITE III. Table 2 illustrates the complementarity of the nucleotide sequences of LOC147976 BINDING SITE, designated SEQ ID:38431, to the nucleotide sequence of VGAM1531 RNA, herein designated VGAM RNA, also designated SEQ ID:4242.

Another function of VGAM1531 is therefore inhibition of LOC147976 (Accession XM_085980). Accordingly, utilities of VGAM1531 include diagnosis, prevention and treatment of diseases and clinical conditions associated with LOC147976. LOC51236 (Accession NM_016458) is another VGAM1531 host target gene. LOC51236 BINDING SITE is HOST TARGET binding site found in the 3' untranslated region of mRNA encoded by LOC51236, corresponding to a HOST TARGET binding site such as BINDING SITE I, BINDING SITE II or BINDING SITE III. Table 2 illustrates the complementarity of the nucleotide sequences of LOC51236 BINDING SITE, designated SEQ ID:18575, to the nucleotide sequence of VGAM1531 RNA, herein designated VGAM RNA, also designated SEQ ID:4242.

Another function of VGAM1531 is therefore inhibition of LOC51236 (Accession NM_016458). Accordingly, utilities of VGAM1531 include diagnosis, prevention and treatment of diseases and clinical conditions associated with LOC51236. FIG. 1 further provides a conceptual description of a novel bioinformatically detected viral gene of the present invention, referred to here as Viral Genomic Address Messenger 1532 (VGAM1532) viral gene, which modulates expression of respective host target genes thereof, the function and utility of which host target genes is known in the art.

VGAM1532 is a novel bioinformatically detected regulatory, non protein coding, viral micro RNA (miRNA) gene.

The method by which VGAM1532 was detected is described hereinabove with reference to FIGS. 1-8.

VGAM1532 gene, herein designated VGAM GENE, is a viral gene contained in the genome of Cowpox Virus. VGAM1532 host target gene, herein designated VGAM HOST TARGET GENE, is a human gene contained in the human genome.

VGAM1532 gene encodes a VGAM1532 precursor RNA, herein designated VGAM PRECURSOR RNA. Similar to other miRNA genes, and unlike most ordinary genes, VGAM1532 precursor RNA does not encode a protein. A nucleotide sequence identical or highly similar to the nucleotide sequence of VGAM1532 precursor RNA is designated SEQ ID:1518, and is provided hereinbelow with reference to the sequence listing part. Nucleotide sequence SEQ ID:1518 is located at position 83358 relative to the genome of Cowpox Virus.

VGAM1532 precursor RNA folds onto itself, forming VGAM1532 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1532 folded precursor RNA into VGAM1532 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1532 RNA is designated SEQ ID:4243, and is provided hereinbelow with reference to the sequence listing part.

VGAM1532 host target gene, herein designated VGAM HOST TARGET GENE, encodes a corresponding messenger RNA, VGAM1532 host target RNA, herein designated VGAM HOST TARGET RNA. VGAM1532 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1532 RNA, herein designated VGAM RNA, binds complementarily to one or more host target binding sites located in untranslated regions of VGAM1532 host target RNA, herein designated VGAM HOST TARGET RNA. This complementary binding is due to the fact that the nucleotide sequence of VGAM1532 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1532 RNA, herein designated VGAM RNA, may have a different number of host target binding sites in untranslated regions of a VGAM1532 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1532 RNA, herein designated VGAM RNA, to host target binding sites on VGAM1532 host target RNA, herein designated VGAM HOST TARGET RNA, such as BINDING SITE I, BINDING SITE II and BINDING SITE III, inhibits translation of VGAM1532 host target RNA into VGAM1532 host target protein, herein designated VGAM HOST TARGET PROTEIN. VGAM host target protein is therefore outlined by a broken line.

It is appreciated that VGAM1532 host target gene, herein designated VGAM HOST TARGET GENE, in fact represents a plurality of VGAM1532 host target genes. The mRNA of each one of this plurality of VGAM1532 host target genes comprises one or more host target binding sites, each having a nucleotide sequence which is at least partly complementary to VGAM1532 RNA, herein designated VGAM RNA, and which when bound by VGAM1532 RNA causes inhibition of translation of respective one or more VGAM1532 host target proteins.

It is further appreciated by one skilled in the art that the mode of translational inhibition illustrated by FIG. 1 with specific reference to translational inhibition exerted by VGAM1532 gene, herein designated VGAM GENE, on one or more VGAM1532 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1532 is inhibition of expression of host target genes, as part of a novel viral mechanism of attacking a host. Accordingly, utilities of VGAM1532 include diagnosis, prevention and treatment of viral infection by Cowpox Virus. Specific functions, and accordingly utilities, of VGAM1532 correlate with, and may be deduced from, the identity of the host target genes which VGAM1532 binds and inhibits, and the function of these host target genes, as elaborated hereinbelow.

Nucleotide sequences of the VGAM1532 precursor RNA, herein designated VGAM PRECURSOR RNA, and of the 'diced' VGAM1532 RNA, herein designated VGAM RNA, and a schematic representation of the secondary folding of VGAM1532 folded precursor RNA, herein designated VGAM FOLDED PRECURSOR RNA, of VGAM1532 are further described hereinbelow with reference to Table 1.

Nucleotide sequences of host target binding sites, such as BINDING SITE-I, BINDING SITE-II and BINDING SITE-III of FIG. 1, found on VGAM1532 host target RNA, and schematic representation of the complementarity of each of these host target binding sites to VGAM1532 RNA, herein designated VGAM RNA, are described hereinbelow with reference to Table 2.

As mentioned hereinabove with reference to FIG. 1, a function of VGAM1532 gene, herein designated VGAM is inhibition of expression of VGAM1532 target genes. It is appreciated that specific functions, and accordingly utilities, of VGAM1532 correlate with, and may be deduced from, the identity of the target genes which VGAM1532 binds and inhibits, and the function of these target genes, as elaborated hereinbelow.

Dual Specificity Phosphatase 10 (DUSP10, Accession NM_007207) is a VGAM1532 host target gene. DUSP10 BINDING SITE1 and DUSP10 BINDING SITE2 are HOST TARGET binding sites found in untranslated regions of mRNA encoded by DUSP10, corresponding to HOST TARGET binding sites such as BINDING SITE I, BINDING SITE II or BINDING SITE III. Table 2 illustrates the complementarity of the nucleotide sequences of DUSP10 BINDING SITE1 and DUSP10 BINDING SITE2, designated SEQ ID:14071 and SEQ ID:29555 respectively, to the nucleotide sequence of VGAM1532 RNA, herein designated VGAM RNA, also designated SEQ ID:4243.

A function of VGAM1532 is therefore inhibition of Dual Specificity Phosphatase 10 (DUSP10, Accession NM_007207). Accordingly, utilities of VGAM1532 include diagnosis, prevention and treatment of diseases and clinical conditions associated with DUSP10. FIG. 1 further provides a conceptual description of a novel bioinformatically detected viral gene of the present invention, referred to here as Viral Genomic Address Messenger 1533 (VGAM1533) viral gene, which modulates expression of respective host target genes thereof, the function and utility of which host target genes is known in the art.

VGAM1533 is a novel bioinformatically detected regulatory, non protein coding, viral micro RNA (miRNA) gene. The method by which VGAM1533 was detected is described hereinabove with reference to FIGS. 1-8.

VGAM1533 gene, herein designated VGAM GENE, is a viral gene contained in the genome of Cowpox Virus. VGAM1533 host target gene, herein designated VGAM HOST TARGET GENE, is a human gene contained in the human genome.

VGAM1533 gene encodes a VGAM1533 precursor RNA, herein designated VGAM PRECURSOR RNA. Similar to other miRNA genes, and unlike most ordinary genes, VGAM1533 precursor RNA does not encode a protein. A nucleotide sequence identical or highly similar to the nucleotide sequence of VGAM1533 precursor RNA is designated SEQ ID:1519, and is provided hereinbelow with reference to the sequence listing part. Nucleotide sequence SEQ ID:1519 is located at position 82024 relative to the genome of Cowpox Virus.

VGAM1533 precursor RNA folds onto itself, forming VGAM1533 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1533 folded precursor RNA into VGAM1533 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1533 RNA is designated SEQ ID:4244, and is provided hereinbelow with reference to the sequence listing part.

VGAM1533 host target gene, herein designated VGAM HOST TARGET GENE, encodes a corresponding messenger RNA, VGAM1533 host target RNA, herein designated VGAM HOST TARGET RNA. VGAM1533 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1533 RNA, herein designated VGAM RNA, binds complementarily to one or more host target binding sites located in untranslated regions of VGAM1533 host target RNA, herein designated VGAM HOST TARGET RNA. This complementary binding is due to the fact that the nucleotide sequence of VGAM1533 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1533 RNA, herein designated VGAM RNA, may have a different number of host target binding sites in untranslated regions of a VGAM1533 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1533 RNA, herein designated VGAM RNA, to host target binding sites on VGAM1533 host target RNA, herein designated VGAM HOST TARGET RNA, such as BINDING SITE I, BINDING SITE II and BINDING SITE III, inhibits translation of VGAM1533 host target RNA into VGAM1533 host target protein, herein designated VGAM HOST TARGET PROTEIN. VGAM host target protein is therefore outlined by a broken line.

It is appreciated that VGAM1533 host target gene, herein designated VGAM HOST TARGET GENE, in fact represents a plurality of VGAM1533 host target genes. The mRNA of each one of this plurality of VGAM1533 host target genes comprises one or more host target binding sites, each having a nucleotide sequence which is at least partly complementary to VGAM1533 RNA, herein designated VGAM RNA, and which when bound by VGAM1533 RNA causes inhibition of translation of respective one or more VGAM1533 host target proteins.

It is further appreciated by one skilled in the art that the mode of translational inhibition illustrated by FIG. 1 with specific reference to translational inhibition exerted by VGAM1533 gene, herein designated VGAM GENE, on one or more VGAM1533 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1533 is inhibition of expression of host target genes, as part of a novel viral mechanism of attacking a host. Accordingly, utilities of VGAM1533 include diagnosis, prevention and treatment of viral infection by Cowpox Virus. Specific functions, and accordingly utilities, of VGAM1533 correlate with, and may be deduced from, the identity of the host target genes which VGAM1533 binds and inhibits, and the function of these host target genes, as elaborated hereinbelow.

Nucleotide sequences of the VGAM1533 precursor RNA, herein designated VGAM PRECURSOR RNA, and of the 'diced' VGAM1533 RNA, herein designated VGAM RNA, and a schematic representation of the secondary folding of VGAM1533 folded precursor RNA, herein designated VGAM FOLDED PRECURSOR RNA, of VGAM1533 are further described hereinbelow with reference to Table 1.

Nucleotide sequences of host target binding sites, such as BINDING SITE-I, BINDING SITE-II and BINDING SITE-III of FIG. 1, found on VGAM1533 host target RNA, and schematic representation of the complementarity of each of these host target binding sites to VGAM1533 RNA, herein designated VGAM RNA, are described hereinbelow with reference to Table 2.

As mentioned hereinabove with reference to FIG. 1, a function of VGAM1533 gene, herein designated VGAM is inhibition of expression of VGAM1533 target genes. It is appreciated that specific functions, and accordingly utilities, of VGAM1533 correlate with, and may be deduced from, the identity of the target genes which VGAM1533 binds and inhibits, and the function of these target genes, as elaborated hereinbelow.

Ceroid-lipofuscinosis, Neuronal 2, Late Infantile (Jansky-Bielschowsky disease) (CLN2, Accession NM_000391) is a VGAM1533 host target gene. CLN2 BINDING SITE is HOST TARGET binding site found in the 3' untranslated region of mRNA encoded by CLN2, corresponding to a HOST TARGET binding site such as BINDING SITE I, BINDING SITE II or BINDING SITE III. Table 2 illustrates the complementarity of the nucleotide sequences of CLN2 BINDING SITE, designated SEQ ID:5964, to the nucleotide sequence of VGAM1533 RNA, herein designated VGAM RNA, also designated SEQ ID:4244.

A function of VGAM1533 is therefore inhibition of Ceroid-lipofuscinosis, Neuronal 2, Late Infantile (Jansky-Bielschowsky disease) (CLN2, Accession NM_000391). Accordingly, utilities of VGAM1533 include diagnosis, prevention and treatment of diseases and clinical conditions associated with CLN2. DEAD/H (Asp-Glu-Ala-Asp/His) Box Polypeptide 11 (CHL1-like helicase homolog, S. cerevisiae) (DDX11, Accession NM_030655) is another VGAM1533 host target gene. DDX11 BINDING SITE1 and DDX11 BINDING SITE2 are HOST TARGET binding sites found in untranslated regions of mRNA encoded by DDX11, corresponding to HOST TARGET binding sites such as BINDING SITE I, BINDING SITE II or BINDING SITE III. Table 2 illustrates the complementarity of the nucleotide sequences of DDX11 BINDING SITE1 and DDX11 BINDING SITE2, designated SEQ ID:24983 and SEQ ID:10651 respectively, to the nucleotide sequence of VGAM1533 RNA, herein designated VGAM RNA, also designated SEQ ID:4244.

Another function of VGAM1533 is therefore inhibition of DEAD/H (Asp-Glu-Ala-Asp/His) Box Polypeptide 11 (CHL1-like helicase homolog, S. cerevisiae) (DDX11, Accession NM_030655), a gene which could be an ATP-dependent DNA-binding helicase and may intervene in cell cycle regulation. Accordingly, utilities of VGAM1533 include diagnosis, prevention and treatment of diseases and clinical conditions associated with DDX11. The function of DDX11 has been established by previous studies. Helicases are essential components of a number of multiprotein complexes, including those that regulate transcription, splicing, translation, and DNA repair. These enzymes assist in the unwinding of double-stranded DNA and RNA as an essential part of their function. DEAD box proteins are putative RNA helicases that have a characteristic Asp-Glu-Ala-Asp (DEAD) box as 1 of 8 highly conserved sequence motifs. See 600396. The yeast Chl1 gene encodes a putative helicase that appears to be essential for normal chromosome transmission. Amann et al. (1996) studied 2 human genes related to the Chl1 gene of Saccharomyces cerevisiae: CHLR1 and CHLR2 (OMIM Ref. No. 601151). The open reading frames (ORFs) of these genes encode proteins with a predicted molecular weight of 102 kD, and the in vitro transcribed and translated products bind efficiently to single-stranded DNA. The predicted ORFs of these 2 genes are more than 98% identical, suggesting that they may have redundant functions. The genes were localized to 12p11 and 12p13 by analysis of somatic cell hybrids and fluorescence in situ hybridization. Fluorescence in situ hybridization indicated that the 2 CHLR gene loci are physically distinct and separated by 8 to 12 Mb. Others had reported the duplication of this region of 12p involving a human expressed sequence tag (EST) and 2 previously uncharacterized cDNAs, which Amann et al. (1996) showed were, in fact, the CHLR genes. A comparison of the CHLR gene sequences with available databases indicated that a large proportion of these genes, including exons encoding 2 functional domains of the carboxyl-terminal region, had been duplicated as part of a large human telomeric repeat sequence found on many human chromosomes. The results suggested to the authors that duplication of a relatively large region of chromosome 12p containing this putative helicase gene has resulted in the creation of numerous pseudogenes as part of a subtelomeric repeat. Amann et al. (1996) stated that the presence of these helicase pseudogenes, as well as pseudogenes for other genes such as the interleukin-9 receptor (OMIM Ref. No. 300007), within many subtelomeric regions supported the possibility that the spread of this region is subject to exchange between different chromosomes and may have implications for elucidation of the mechanism of intra- and interchromosomal duplication events. Frank and Werner (1996) used differential display PCR to identify novel cDNAs in keratinocytes whose expression is regulated by keratinocyte growth factor (KGF; 148180). One such clone, termed KRG2 by the authors, was identified, and a full-length cDNA was cloned from a KGF-stimulated keratinocyte cDNA library. Southern blot analysis suggested that KRG2 is a member of a multigene family. Northern blot analysis revealed a single 4.3-kb mRNA whose expression is upregulated by KGF. The authors used RNase protection assays to determine that serum, EGF, and cytokine IL-1-beta (OMIM Ref. No. 147720) had no effect on KRG2 expression, while inhibitors of keratinocyte proliferation, such as TGF-beta-1 (OMIM Ref. No. 190180) and TNF-alpha (OMIM Ref. No. 191160), caused a slight reduction in KRG2 expression. Sequence analysis indicated that the KRG2 cDNA encodes an 856-amino acid protein that is 32% identical to the yeast gene CHL1. Frank and Werner (1996) hypothesized that KRG2 may be involved in cell cycle regulation.

Full details of the abovementioned studies are described in the following publications, the disclosure of which are hereby incorporated by reference:

Amann, J.; Kidd, V. J.; Lahti, J. M.: Characterization of putative human homologues of the yeast chromosome transmission fidelity gene, CHL1. J. Biol. Chem. 272:3823-3832, 1997; and Frank, S.; Werner, S.: The human homologue of the yeast CHL1 gene is a novel keratinocyte growth factor-regulated gene. J. Biol. Chem. 271:24337-24340, 1996.

Further studies establishing the function and utilities of DDX11 are found in John Hopkins OMIM database record ID 601150, and in sited publications numbered 7541-7543 listed in the bibliography section hereinbelow, which are also hereby incorporated by reference. Epidermal Growth Factor Receptor Pathway Substrate 8 (EPS8, Accession NM_004447) is another VGAM1533 host target gene. EPS8 BINDING SITE is HOST TARGET binding site found in the 5' untranslated region of mRNA encoded by EPS8, corresponding to a HOST TARGET binding site such as BINDING SITE I, BINDING SITE II or BINDING SITE III. Table 2 illustrates the complementarity of the nucleotide sequences of EPS8 BINDING SITE, designated SEQ ID:10743, to the nucleotide sequence of VGAM1533 RNA, herein designated VGAM RNA, also designated SEQ ID:4244.

Another function of VGAM1533 is therefore inhibition of Epidermal Growth Factor Receptor Pathway Substrate 8 (EPS8, Accession NM_004447), a gene which has a role in normal and neoplastic cell proliferation; contains an SH3 motif. Accordingly, utilities of VGAM1533 include diagnosis, prevention and treatment of diseases and clinical conditions associated with EPS8. The function of EPS8 has been established by previous studies. Using an expression cloning approach for the study of epidermal growth factor (EGF) receptor (EGFR; 131550)-activated signaling, Wong et al. (1994) found a number of murine cDNA clones referred to as eps, for egfr-pathway-substrate. (See 600051 for one of these, EPS15.) One of the clones encoded a protein of 97 kD, designated eps8, which was phosphorylated in vivo by several receptor tyrosine kinases (Fazioli et al., 1993). In addition to a previously identified SH3 domain, Wong et al. (1994) found that the predicted amino acid sequence of human EPS8 showed a nonrandom distribution of prolines, clustered in a way to suggest SH3-binding sites and a putative PH domain. EPS8 was expressed in all epithelial and fibroblast cell lines examined and in some, but not all, hematopoietic cells. An essential function of EPS8 in cell growth regulation was underscored by its conservation during evolution where EPS8-related sequences were detected as early as in S. cerevisiae. EGFR signaling involves small GTPases of the Rho family, and EGFR trafficking involves small GTPases of the Rab family. Lanzetti et al. (2000) reported that the EPS8 protein connects these signaling pathways. EPS8 is a substrate of EGFR that is held in a complex with SOS1 by the adaptor protein E3B1, thereby mediating activation of RAC. Through its SH3 domain, EPS8 interacts with RNTRE (OMIM Ref. No. 605405). Lanzetti et al. (2000) showed that RNTRE is a RAB5 (OMIM Ref. No. 179512) GTPase-activating protein whose activity is regulated by EGFR. By entering in a complex with EPS8, RNTRE acts on RAB5 and inhibits internalization of the EGFR. Furthermore, RNTRE diverts EPS8 from its RAC-activating function, resulting in the attenuation of RAC signaling. Thus, depending on its state of association with E3B1 or RNTRE, EPS8 participates in both EGFR signaling through RAC and EGFR trafficking through RAB5. Wong et al. (1994) mapped the human EPS8 locus to 12q23-q24 by study of human-rodent somatic cell hybrid DNAs and by fluorescence in situ hybridization. In an study of candidate genes for Noonan syndrome (OMIM Ref. No. 163950), Ion et al. (2000) reassigned the map position of EPS8 to 12q13 using FISH.

Full details of the abovementioned studies are described in the following publications, the disclosure of which are hereby incorporated by reference:

Wong, W. T.; Carlomagno, F.; Druck, T.; Barletta, C.; Croce, C. M.; Huebner, K.; Kraus, M. H.; Di Fiore, P. P.: Evolutionary conservation of the EPS8 gene and its mapping to human chromosome 12q23-q24. Oncogene 9:3057-3061, 1994; and Lanzetti, L.; Rybin, V.; Malabarba, M. G.; Christoforidis, S.; Scita, G.; Zerial, M.; Di Fiore, P. P.: The Eps8 protein coordinates EGF receptor signalling through Rac and trafficking t.

Further studies establishing the function and utilities of EPS8 are found in John Hopkins OMIM database record ID 600206, and in sited publications numbered 1591, 199 and 2125 listed in the bibliography section hereinbelow, which are also hereby incorporated by reference. Coagulation Factor VII (serum prothrombin conversion accelerator) (F7, Accession NM_019616) is another VGAM1533 host target gene. F7 BINDING SITE1 and F7 BINDING SITE2 are HOST TARGET binding sites found in untranslated regions of mRNA encoded by F7, corresponding to HOST TARGET binding sites such as BINDING SITE I, BINDING SITE II or BINDING SITE III. Table 2 illustrates the complementarity of the nucleotide sequences of F7 BINDING SITE1 and F7 BINDING SITE2, designated SEQ ID:21237 and SEQ ID:5608 respectively, to the nucleotide sequence of VGAM1533 RNA, herein designated VGAM RNA, also designated SEQ ID:4244.

Another function of VGAM1533 is therefore inhibition of Coagulation Factor VII (serum prothrombin conversion accelerator) (F7, Accession NM_019616). Accordingly, utilities of VGAM1533 include diagnosis, prevention and treatment of diseases and clinical conditions associated with F7. Fragile X Mental Retardation 1 (FMR1, Accession NM_002024) is another VGAM1533 host target gene. FMR1 BINDING SITE is HOST TARGET binding site found in the 3' untranslated region of mRNA encoded by FMR1, corresponding to a HOST TARGET binding site such as BINDING SITE I, BINDING SITE II or BINDING SITE III. Table 2 illustrates the complementarity of the nucleotide sequences of FMR1 BINDING SITE, designated SEQ ID:7775, to the nucleotide sequence of VGAM1533 RNA, herein designated VGAM RNA, also designated SEQ ID:4244.

Another function of VGAM1533 is therefore inhibition of Fragile X Mental Retardation 1 (FMR1, Accession NM_002024). Accordingly, utilities of VGAM1533 include diagnosis, prevention and treatment of diseases and clinical conditions associated with FMR1. LFG (Accession XM_084780) is another VGAM1533 host target gene. LFG BINDING SITE is HOST TARGET binding site found in the 3' untranslated region of mRNA encoded by LFG, corresponding to a HOST TARGET binding site such as BINDING SITE I, BINDING SITE II or BINDING SITE III. Table 2 illustrates the complementarity of the nucleotide sequences of LFG BINDING SITE, designated SEQ ID:37687, to the nucleotide sequence of VGAM1533 RNA, herein designated VGAM RNA, also designated SEQ ID:4244.

Another function of VGAM1533 is therefore inhibition of LFG (Accession XM_084780). Accordingly, utilities of VGAM1533 include diagnosis, prevention and treatment of diseases and clinical conditions associated with LFG. Orthodenticle Homolog 1 (Drosophila) (OTX1, Accession NM_014562) is another VGAM1533 host target gene. OTX1 BINDING SITE is HOST TARGET binding site found in the 5' untranslated region of mRNA encoded by OTX1, corresponding to a HOST TARGET binding site such as BINDING SITE I, BINDING SITE II or BINDING SITE III. Table 2 illustrates the complementarity of the nucleotide sequences of OTX1 BINDING SITE, designated SEQ ID:15898, to the nucleotide sequence of VGAM1533 RNA, herein designated VGAM RNA, also designated SEQ ID:4244.

Another function of VGAM1533 is therefore inhibition of Orthodenticle Homolog 1 (Drosophila) (OTX1, Accession NM_014562), a gene which plays a role in the development of the brain and the sense organs. Accordingly, utilities of VGAM1533 include diagnosis, prevention and treatment of diseases and clinical conditions associated with OTX1. The function of OTX1 has been established by previous studies. OTX1 is a homeobox family gene related to a gene expressed in the developing Drosophila head termed 'orthodenticle.' Simeone et al. (1992) identified rodent OTX2 (OMIM Ref. No. 600037). A homolog is also found in the zebrafish. Tissue expression of OTX1 is similar to that of OTX2 but is more restricted (Boncinelli et al., 1993). Frantz et al. (1994) showed that Otx1 mRNA was expressed by precursors of deep-layer neurons within cortical layers 5 and 6 of the rat brain during both postnatal and adult life. Using a cosmid containing the gene, Kastury et al. (1994) mapped human OTX1 to 2p13 by fluorescence in situ hybridization, near the locus for EMX1 (OMIM Ref. No. 600034). Animal model experiments lend further support to the function of OTX1. Acampora et al. (1996) produced null mice by replacing Otx1 with the lacZ gene. Otx -/- mice exhibited epileptic behavior with the characteristics of both focal and generalized seizures. Anatomic and histologic analyses of brains from 2-4-month-old Otx -/- mice revealed multiple abnormalities affecting mainly the telencephalic, temporal, and perirhinal areas, the hippocampus, mesencephalon, and cerebellum, and the acoustic and visual sense organs. Acampora et al. (1996) reported that in older Otx -/- mice the epileptic behavior and frequency of seizures were somewhat reduced, although they never disappeared. They detected neither epileptic behavior nor electrical seizures in Otx+(/-) mice. The authors stated that this study provides the first evidence that loss of function of a homeobox-containing gene affects brain development and induces spontaneous epilepsy.

It is appreciated that the abovementioned animal model for OTX1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Frantz, G. D.; Weimann, J. M.; Levin, M. E.; McConnell, S. K.: Otx1 and Otx2 define layers and regions in developing cerebral cortex and cerebellum. J. Neurosci. 14:5725-5740, 1994; and Acampora, D.; Mazan, S.; Avantaggiato, V.; Barone, P.; Tuorto, F.; Lallemand, Y.; Brulet, P.; Simeone, A.: Epilepsy and brain abnormalities in mice lacking the Otx1 gene. Nature Genet.

Further studies establishing the function and utilities of OTX1 are found in John Hopkins OMIM database record ID 600036, and in sited publications numbered 8116-811 and 8110-8111 listed in the bibliography section hereinbelow, which are also hereby incorporated by reference. Synaptosomal-associated Protein, 23 kDa (SNAP23, Accession NM_003825) is another VGAM1533 host target gene. SNAP23 BINDING SITE1 and SNAP23 BINDING SITE2 are HOST TARGET binding sites found in untranslated regions of mRNA encoded by SNAP23, corresponding to HOST TARGET binding sites such as BINDING SITE I, BINDING SITE II or BINDING SITE III. Table 2 illustrates the complementarity of the nucleotide sequences of SNAP23 BINDING SITE1 and SNAP23 BINDING SITE2, designated SEQ ID:9919 and SEQ ID:28284 respectively, to the nucleotide sequence of VGAM1533 RNA, herein designated VGAM RNA, also designated SEQ ID:4244.

Another function of VGAM1533 is therefore inhibition of Synaptosomal-associated Protein, 23 kDa (SNAP23, Accession NM_003825), a gene which is essential component of the high affinity receptor for the general membrane fusion machinery. Accordingly, utilities of VGAM1533 include diagnosis, prevention and treatment of diseases and clinical conditions associated with SNAP23. The function of SNAP23 has been established by previous studies. Synaptosomal-associated proteins (SNAPs) are involved in the process of membrane fusion in intracellular vesicle traffic. By fluorescence in situ hybridization, Lazo et al. (2001) mapped the SNAP23 gene to chromosome 15q21-q22. Lazo et al. (2001) suggested that alterations in the SNAP23 gene may be involved in neurologic and other diseases with defects in vesicle-membrane fusion processes that map to 15q15-q21.

Full details of the abovementioned studies are described in the following publications, the disclosure of which are hereby incorporated by reference:

Lazo, P. A.; Nadal, M.; Ferrer, M.; Area, E.; Hernandez-Torres, J.; Nabokina, S. M.; Mollinedo, F.; Estivill, X.: Genomic organization, chromosomal localization, alternative splicing, and isoforms of the human synaptosome-associated protein-23 gene implicated in vesicle-membrane fusion processes. Hum. Genet. 108:211-215, 2001; and Mollinedo, F.; Lazo, P. A.: Identification of two isoforms of the vesicle-membrane fusion protein SNAP-23 in human neutrophils and HL-60 cells. Biochem. Biophys. Res. Commun. 231:808.

Further studies establishing the function and utilities of SNAP23 are found in John Hopkins OMIM database record ID 602534, and in sited publications numbered 8872-8876 listed in the bibliography section hereinbelow, which are also hereby incorporated by reference. A Kinase (PRKA) Anchor Protein (gravin) 12 (AKAP12, Accession NM_005100) is another VGAM1533 host target gene. AKAP12 BINDING SITE1 and AKAP12 BINDING SITE2 are HOST TARGET binding sites found in untranslated regions of mRNA encoded by AKAP12, corresponding to HOST TARGET binding sites such as BINDING SITE I, BINDING SITE II or BINDING SITE III. Table 2 illustrates the complementarity of the nucleotide sequences of AKAP12 BINDING SITE1 and AKAP12 BINDING SITE2, designated SEQ ID:11572 and SEQ ID:29312 respectively, to the nucleotide sequence of VGAM1533 RNA, herein designated VGAM RNA, also designated SEQ ID:4244.

Another function of VGAM1533 is therefore inhibition of A Kinase (PRKA) Anchor Protein (gravin) 12 (AKAP12, Accession NM_005100). Accordingly, utilities of VGAM1533 include diagnosis, prevention and treatment of diseases and clinical conditions associated with AKAP12. DEAD/H (Asp-Glu-Ala-Asp/His) Box Polypeptide 12 (CHL1-like helicase homolog, S. cerevisiae) (DDX12, Accession XM_006936) is another VGAM1533 host target gene. DDX12 BINDING SITE is HOST TARGET binding site found in the 3' untranslated region of mRNA encoded by DDX12, corresponding to a HOST TARGET binding site such as BINDING SITE I, BINDING SITE II or BINDING SITE III. Table 2 illustrates the complementarity of the nucleotide sequences of DDX12 BINDING SITE, designated SEQ ID:30021, to the nucleotide sequence of VGAM1533 RNA, herein designated VGAM RNA, also designated SEQ ID:4244.

Another function of VGAM1533 is therefore inhibition of DEAD/H (Asp-Glu-Ala-Asp/His) Box Polypeptide 12 (CHL1-like helicase homolog, S. cerevisiae) (DDX12, Accession XM_006936). Accordingly, utilities of VGAM1533 include diagnosis, prevention and treatment of diseases and clinical conditions associated with DDX12. ERO1-like (S. cerevisiae) (ERO1L, Accession NM_014584) is another VGAM1533 host target gene. ERO1L BINDING SITE is HOST TARGET binding site found in the 3' untranslated region of mRNA encoded by ERO1L, corresponding to a HOST TARGET binding site such as BINDING SITE I, BINDING SITE II or BINDING SITE III. Table 2 illustrates the complementarity of the nucleotide sequences of ERO1L BINDING SITE, designated SEQ ID:15940, to the nucleotide sequence of VGAM1533 RNA, herein designated VGAM RNA, also designated SEQ ID:4244.

Another function of VGAM1533 is therefore inhibition of ERO1-like (S. cerevisiae) (ERO1L, Accession NM_014584). Accordingly, utilities of VGAM1533 include diagnosis, prevention and treatment of diseases and clinical conditions associated with ERO1L. FLJ11413 (Accession NM_024554) is another VGAM1533 host target gene. FLJ11413 BINDING SITE is HOST TARGET binding site found in the 3' untranslated region of mRNA encoded by FLJ11413, corresponding to a HOST TARGET binding site such as BINDING SITE I, BINDING SITE II or BINDING SITE III. Table 2 illustrates the complementarity of the nucleotide sequences of FLJ11413 BINDING SITE, designated SEQ ID:23772, to the nucleotide sequence of VGAM1533 RNA, herein designated VGAM RNA, also designated SEQ ID:4244.

Another function of VGAM1533 is therefore inhibition of FLJ11413 (Accession NM_024554). Accordingly, utilities of VGAM1533 include diagnosis, prevention and treatment of diseases and clinical conditions associated with FLJ11413. FLJ20040 (Accession NM_018992) is another VGAM1533 host target gene. FLJ20040 BINDING SITE is HOST TARGET binding site found in the 3' untranslated region of mRNA encoded by FLJ20040, corresponding to a HOST TARGET binding site such as BINDING SITE I, BINDING SITE II or BINDING SITE III. Table 2 illustrates the complementarity of the nucleotide sequences of FLJ20040 BINDING SITE, designated SEQ ID:21066, to the nucleotide sequence of VGAM1533 RNA, herein designated VGAM RNA, also designated SEQ ID:4244.

Another function of VGAM1533 is therefore inhibition of FLJ20040 (Accession NM_018992). Accordingly, utilities of VGAM1533 include diagnosis, prevention and treatment of diseases and clinical conditions associated with FLJ20040. FLJ20772 (Accession NM_017956) is another VGAM1533 host target gene. FLJ20772 BINDING SITE is HOST TARGET binding site found in the 3' untranslated region of mRNA encoded by FLJ20772, corresponding to a HOST TARGET binding site such as BINDING SITE I, BINDING SITE II or BINDING SITE III. Table 2 illustrates the complementarity of the nucleotide sequences of FLJ20772 BINDING SITE, designated SEQ ID:19665, to the nucleotide sequence of VGAM1533 RNA, herein designated VGAM RNA, also designated SEQ ID:4244.

Another function of VGAM1533 is therefore inhibition of FLJ20772 (Accession NM_017956). Accordingly, utilities of VGAM1533 include diagnosis, prevention and treatment of diseases and clinical conditions associated with FLJ20772. FLJ30574 (Accession NM_144629) is another VGAM1533 host target gene. FLJ30574 BINDING SITE is HOST TARGET binding site found in the 3' untranslated region of mRNA encoded by FLJ30574, corresponding to a HOST TARGET binding site such as BINDING SITE I, BINDING SITE II or BINDING SITE III. Table 2 illustrates the complementarity of the nucleotide sequences of FLJ30574 BINDING SITE, designated SEQ ID:29447, to the nucleotide sequence of VGAM1533 RNA, herein designated VGAM RNA, also designated SEQ ID:4244.

Another function of VGAM1533 is therefore inhibition of FLJ30574 (Accession NM_144629). Accordingly, utilities of VGAM1533 include diagnosis, prevention and treatment of diseases and clinical conditions associated with FLJ30574. FLJ31168 (Accession NM_144712) is another VGAM1533 host target gene. FLJ31168 BINDING SITE is HOST TARGET binding site found in the 3' untranslated region of mRNA encoded by FLJ31168, corresponding to a HOST TARGET binding site such as BINDING SITE I, BINDING SITE II or BINDING SITE III. Table 2 illustrates the complementarity of the nucleotide sequences of FLJ31168 BINDING SITE, designated SEQ ID:29536, to the nucleotide sequence of VGAM1533 RNA, herein designated VGAM RNA, also designated SEQ ID:4244.

Another function of VGAM1533 is therefore inhibition of FLJ31168 (Accession NM_144712). Accordingly, utilities of VGAM1533 include diagnosis, prevention and treatment of diseases and clinical conditions associated with FLJ31168. G Antigen, Family D, 3 (GAGED3, Accession NM_130777) is another VGAM1533 host target gene. GAGED3 BINDING SITE is HOST TARGET binding site found in the 5' untranslated region of mRNA encoded by GAGED3, corresponding to a HOST TARGET binding site such as BINDING SITE I, BINDING SITE II or BINDING SITE III. Table 2 illustrates the complementarity of the nucleotide sequences of GAGED3 BINDING SITE, designated SEQ ID:28268, to the nucleotide sequence of VGAM1533 RNA, herein designated VGAM RNA, also designated SEQ ID:4244.

Another function of VGAM1533 is therefore inhibition of G Antigen, Family D, 3 (GAGED3, Accession NM_130777). Accordingly, utilities of VGAM1533 include diagnosis, prevention and treatment of diseases and clinical conditions associated with GAGED3. IDI2 (Accession NM_033261) is another VGAM1533 host target gene. IDI2 BINDING SITE is HOST TARGET binding site found in the 3' untranslated region of mRNA encoded by IDI2, corresponding to a HOST TARGET binding site such as BINDING SITE I, BINDING SITE II or BINDING SITE III. Table 2 illustrates the complementarity of the nucleotide sequences of IDI2 BINDING SITE, designated SEQ ID:27091, to the nucleotide sequence of VGAM1533 RNA, herein designated VGAM RNA, also designated SEQ ID:4244.

Another function of VGAM1533 is therefore inhibition of IDI2 (Accession NM_033261). Accordingly, utilities of VGAM1533 include diagnosis, prevention and treatment of diseases and clinical conditions associated with IDI2. IPLA2 (GAMMA) (Accession XM_027224) is another VGAM1533 host target gene. IPLA2(GAMMA) BINDING SITE is HOST TARGET binding site found in the 3' untranslated region of mRNA encoded by IPLA2(GAMMA), corresponding to a HOST TARGET binding site such as BINDING SITE I, BINDING SITE II or BINDING SITE III. Table 2 illustrates the complementarity of the nucleotide sequences of IPLA2(GAMMA) BINDING SITE, designated SEQ ID:30444, to the nucleotide sequence of VGAM1533 RNA, herein designated VGAM RNA, also designated SEQ ID:4244.

Another function of VGAM1533 is therefore inhibition of IPLA2(GAMMA) (Accession XM_027224). Accordingly, utilities of VGAM1533 include diagnosis, prevention and treatment of diseases and clinical conditions associated with IPLA2(GAMMA). KIAA0737 (Accession NM_014828) is another VGAM1533 host target gene. KIAA0737 BINDING SITE is HOST TARGET binding site found in the 3' untranslated region of mRNA encoded by KIAA0737, corresponding to a HOST TARGET binding site such as BINDING SITE I, BINDING SITE II or BINDING SITE III. Table 2 illustrates the complementarity of the nucleotide sequences of KIAA0737 BINDING SITE, designated SEQ ID:16820, to the nucleotide sequence of VGAM1533 RNA, herein designated VGAM RNA, also designated SEQ ID:4244.

Another function of VGAM1533 is therefore inhibition of KIAA0737 (Accession NM_014828). Accordingly, utilities of VGAM1533 include diagnosis, prevention and treatment of diseases and clinical conditions associated with KIAA0737. KIAA0870 (Accession XM_088315) is another VGAM1533 host target gene. KIAA0870 BINDING SITE is HOST TARGET binding site found in the 3' untranslated region of mRNA encoded by KIAA0870, corresponding to a HOST TARGET binding site such as BINDING SITE I, BINDING SITE II or BINDING SITE III. Table 2 illustrates the complementarity of the nucleotide sequences of KIAA0870 BINDING SITE, designated SEQ ID:39609, to the nucleotide sequence of VGAM1533 RNA, herein designated VGAM RNA, also designated SEQ ID:4244.

Another function of VGAM1533 is therefore inhibition of KIAA0870 (Accession XM_088315). Accordingly, utilities of VGAM1533 include diagnosis, prevention and treatment of diseases and clinical conditions associated with KIAA0870. KIAA1028 (Accession XM_166324) is another VGAM1533 host target gene. KIAA1028 BINDING SITE is HOST TARGET binding site found in the 3' untranslated region of mRNA encoded by KIAA1028, corresponding to a HOST TARGET binding site such as BINDING SITE I, BINDING SITE II or BINDING SITE III. Table 2 illustrates the complementarity of the nucleotide sequences of KIAA1028 BINDING SITE, designated SEQ ID:44160, to the nucleotide sequence of VGAM1533 RNA, herein designated VGAM RNA, also designated SEQ ID:4244.

Another function of VGAM1533 is therefore inhibition of KIAA1028 (Accession XM_166324). Accordingly, utilities of VGAM1533 include diagnosis, prevention and treatment of diseases and clinical conditions associated with KIAA1028. KIAA1357 (Accession XM_050421) is another VGAM1533 host target gene. KIAA1357 BINDING SITE is HOST TARGET binding site found in the 3' untranslated region of mRNA encoded by KIAA1357, corresponding to a HOST TARGET binding site such as BINDING SITE I, BINDING SITE II or BINDING SITE III. Table 2 illustrates the complementarity of the nucleotide sequences of KIAA1357 BINDING SITE, designated SEQ ID:35629, to the nucleotide sequence of VGAM1533 RNA, herein designated VGAM RNA, also designated SEQ ID:4244.

Another function of VGAM1533 is therefore inhibition of KIAA1357 (Accession XM_050421). Accordingly, utilities of VGAM1533 include diagnosis, prevention and treatment of diseases and clinical conditions associated with KIAA1357. KIAA1617 (Accession XM_166140) is another VGAM1533 host target gene. KIAA1617 BINDING SITE is HOST TARGET binding site found in the 3' untranslated region of mRNA encoded by KIAA1617, corresponding to a HOST TARGET binding site such as BINDING SITE I, BINDING SITE II or BINDING SITE III. Table 2 illustrates the complementarity of the nucleotide sequences of KIAA1617 BINDING SITE, designated SEQ ID:43941, to the nucleotide sequence of VGAM1533 RNA, herein designated VGAM RNA, also designated SEQ ID:4244.

Another function of VGAM1533 is therefore inhibition of KIAA1617 (Accession XM_166140). Accordingly, utilities of VGAM1533 include diagnosis, prevention and treatment of diseases and clinical conditions associated with KIAA1617. Lipoma HMGIC Fusion Partner-like 2 (LHFPL2, Accession XM_046054) is another VGAM1533 host target gene. LHFPL2 BINDING SITE is HOST TARGET binding site found in the 3' untranslated region of mRNA encoded by LHFPL2, corresponding to a HOST TARGET binding site such as BINDING SITE I, BINDING SITE II or BINDING SITE III. Table 2 illustrates the complementarity of the nucleotide sequences of LHFPL2 BINDING SITE, designated SEQ ID:34660, to the nucleotide sequence of VGAM1533 RNA, herein designated VGAM RNA, also designated SEQ ID:4244.

Another function of VGAM1533 is therefore inhibition of Lipoma HMGIC Fusion Partner-like 2 (LHFPL2, Accession XM_046054). Accordingly, utilities of VGAM1533 include diagnosis, prevention and treatment of diseases and clinical conditions associated with LHFPL2. Mitogen-activated Protein Kinase Kinase 4 (MAP2K4, Accession NM_003010) is another VGAM1533 host target gene. MAP2K4 BINDING SITE is HOST TARGET binding site found in the 3' untranslated region of mRNA encoded by MAP2K4, corresponding to a HOST TARGET binding site such as BINDING SITE I, BINDING SITE II or BINDING SITE III. Table 2 illustrates the complementarity of the nucleotide sequences of MAP2K4 BINDING SITE, designated SEQ ID:8914, to the nucleotide sequence of VGAM1533 RNA, herein designated VGAM RNA, also designated SEQ ID:4244.

Another function of VGAM1533 is therefore inhibition of Mitogen-activated Protein Kinase Kinase 4 (MAP2K4, Accession NM_003010). Accordingly, utilities of VGAM1533 include diagnosis, prevention and treatment of diseases and clinical conditions associated with MAP2K4. PC2 (positive cofactor 2, multiprotein complex) Glutamine/Q-rich-associated Protein (PCQAP, Accession NM_015889) is another VGAM1533 host target gene. PCQAP BINDING SITE is HOST TARGET binding site found in the 3' untranslated region of mRNA encoded by PCQAP, corresponding to a HOST TARGET binding site such as BINDING SITE I, BINDING SITE II or BINDING SITE III. Table 2 illustrates the complementarity of the nucleotide sequences of PCQAP BINDING SITE, designated SEQ ID:18031, to the nucleotide sequence of VGAM1533 RNA, herein designated VGAM RNA, also designated SEQ ID:4244.

Another function of VGAM1533 is therefore inhibition of PC2 (positive cofactor 2, multiprotein complex) Glutamine/Q-rich-associated Protein (PCQAP, Accession NM_015889). Accordingly, utilities of VGAM1533 include diagnosis, prevention and treatment of diseases and clinical conditions associated with PCQAP. PTK6 Protein Tyrosine Kinase 6 (PTK6, Accession NM_005975) is another VGAM1533 host target gene. PTK6 BINDING SITE is HOST TARGET binding site found in the 3' untranslated region of mRNA encoded by PTK6, corresponding to a HOST TARGET binding site such as BINDING SITE I, BINDING SITE II or BINDING SITE III. Table 2 illustrates the complementarity of the nucleotide sequences of PTK6 BINDING SITE, designated SEQ ID:12597, to the nucleotide sequence of VGAM1533 RNA, herein designated VGAM RNA, also designated SEQ ID:4244.

Another function of VGAM1533 is therefore inhibition of PTK6 Protein Tyrosine Kinase 6 (PTK6, Accession NM_005975). Accordingly, utilities of VGAM1533 include diagnosis, prevention and treatment of diseases and clinical conditions associated with PTK6. RODH-4 (Accession NM_003708) is another VGAM1533 host target gene. RODH-4 BINDING SITE is HOST TARGET binding site found in the 3' untranslated region of mRNA encoded by RODH-4, corresponding to a HOST TARGET binding site such as BINDING SITE I, BINDING SITE II or BINDING SITE III. Table 2 illustrates the complementarity of the nucleotide sequences of RODH-4 BINDING SITE, designated SEQ ID:9809, to the nucleotide sequence of VGAM1533

RNA, herein designated VGAM RNA, also designated SEQ ID:4244.

Another function of VGAM1533 is therefore inhibition of RODH-4 (Accession NM_003708). Accordingly, utilities of VGAM1533 include diagnosis, prevention and treatment of diseases and clinical conditions associated with RODH-4. Testis Specific, 14 (TSGA14, Accession NM_018718) is another VGAM1533 host target gene. TSGA14 BINDING SITE is HOST TARGET binding site found in the 3' untranslated region of mRNA encoded by TSGA14, corresponding to a HOST TARGET binding site such as BINDING SITE I, BINDING SITE II or BINDING SITE III. Table 2 illustrates the complementarity of the nucleotide sequences of TSGA14 BINDING SITE, designated SEQ ID:20794, to the nucleotide sequence of VGAM1533 RNA, herein designated VGAM RNA, also designated SEQ ID:4244.

Another function of VGAM1533 is therefore inhibition of Testis Specific, 14 (TSGA14, Accession NM_018718). Accordingly, utilities of VGAM1533 include diagnosis, prevention and treatment of diseases and clinical conditions associated with TSGA14. Wingless-type MMTV Integration Site Family, Member 16 (WNT16, Accession NM_057168) is another VGAM1533 host target gene. WNT16 BINDING SITE1 and WNT16 BINDING SITE2 are HOST TARGET binding sites found in untranslated regions of mRNA encoded by WNT16, corresponding to HOST TARGET binding sites such as BINDING SITE I, BINDING SITE II or BINDING SITE III. Table 2 illustrates the complementarity of the nucleotide sequences of WNT16 BINDING SITE1 and WNT16 BINDING SITE2, designated SEQ ID:27674 and SEQ ID:18170 respectively, to the nucleotide sequence of VGAM1533 RNA, herein designated VGAM RNA, also designated SEQ ID:4244.

Another function of VGAM1533 is therefore inhibition of Wingless-type MMTV Integration Site Family, Member 16 (WNT16, Accession NM_057168). Accordingly, utilities of VGAM1533 include diagnosis, prevention and treatment of diseases and clinical conditions associated with WNT16. LOC144373 (Accession XM_084841) is another VGAM1533 host target gene. LOC144373 BINDING SITE is HOST TARGET binding site found in the 3' untranslated region of mRNA encoded by LOC144373, corresponding to a HOST TARGET binding site such as BINDING SITE I, BINDING SITE II or BINDING SITE III. Table 2 illustrates the complementarity of the nucleotide sequences of LOC144373 BINDING SITE, designated SEQ ID:37726, to the nucleotide sequence of VGAM1533 RNA, herein designated VGAM RNA, also designated SEQ ID:4244.

Another function of VGAM1533 is therefore inhibition of LOC144373 (Accession XM_084841). Accordingly, utilities of VGAM1533 include diagnosis, prevention and treatment of diseases and clinical conditions associated with LOC144373. LOC146728 (Accession XM_097074) is another VGAM1533 host target gene. LOC146728 BINDING SITE is HOST TARGET binding site found in the 5' untranslated region of mRNA encoded by LOC146728, corresponding to a HOST TARGET binding site such as BINDING SITE I, BINDING SITE II or BINDING SITE III. Table 2 illustrates the complementarity of the nucleotide sequences of LOC146728 BINDING SITE, designated SEQ ID:40723, to the nucleotide sequence of VGAM1533 RNA, herein designated VGAM RNA, also designated SEQ ID:4244.

Another function of VGAM1533 is therefore inhibition of LOC146728 (Accession XM_097074). Accordingly, utilities of VGAM1533 include diagnosis, prevention and treatment of diseases and clinical conditions associated with LOC146728. LOC149566 (Accession XM_097670) is another VGAM1533 host target gene. LOC149566 BINDING SITE is HOST TARGET binding site found in the 3' untranslated region of mRNA encoded by LOC149566, corresponding to a HOST TARGET binding site such as BINDING SITE I, BINDING SITE II or BINDING SITE III. Table 2 illustrates the complementarity of the nucleotide sequences of LOC149566 BINDING SITE, designated SEQ ID:41016, to the nucleotide sequence of VGAM1533 RNA, herein designated VGAM RNA, also designated SEQ ID:4244.

Another function of VGAM1533 is therefore inhibition of LOC149566 (Accession XM_097670). Accordingly, utilities of VGAM1533 include diagnosis, prevention and treatment of diseases and clinical conditions associated with LOC149566. LOC150113 (Accession XM_104532) is another VGAM1533 host target gene. LOC150113 BINDING SITE is HOST TARGET binding site found in the 5' untranslated region of mRNA encoded by LOC150113, corresponding to a HOST TARGET binding site such as BINDING SITE I, BINDING SITE II or BINDING SITE III. Table 2 illustrates the complementarity of the nucleotide sequences of LOC150113 BINDING SITE, designated SEQ ID:42167, to the nucleotide sequence of VGAM1533 RNA, herein designated VGAM RNA, also designated SEQ ID:4244.

Another function of VGAM1533 is therefore inhibition of LOC150113 (Accession XM_104532). Accordingly, utilities of VGAM1533 include diagnosis, prevention and treatment of diseases and clinical conditions associated with LOC150113. LOC151414 (Accession XM_087197) is another VGAM1533 host target gene. LOC151414 BINDING SITE is HOST TARGET binding site found in the 3' untranslated region of mRNA encoded by LOC151414, corresponding to a HOST TARGET binding site such as BINDING SITE I, BINDING SITE II or BINDING SITE III. Table 2 illustrates the complementarity of the nucleotide sequences of LOC151414 BINDING SITE, designated SEQ ID:39109, to the nucleotide sequence of VGAM1533 RNA, herein designated VGAM RNA, also designated SEQ ID:4244.

Another function of VGAM1533 is therefore inhibition of LOC151414 (Accession XM_087197). Accordingly, utilities of VGAM1533 include diagnosis, prevention and treatment of diseases and clinical conditions associated with LOC151414. LOC158427 (Accession NM_139246) is another VGAM1533 host target gene. LOC158427 BINDING SITE is HOST TARGET binding site found in the 3' untranslated region of mRNA encoded by LOC158427, corresponding to a HOST TARGET binding site such as BINDING SITE I, BINDING SITE II or BINDING SITE III. Table 2 illustrates the complementarity of the nucleotide sequences of LOC158427 BINDING SITE, designated SEQ ID:29246, to the nucleotide sequence of VGAM1533 RNA, herein designated VGAM RNA, also designated SEQ ID:4244.

Another function of VGAM1533 is therefore inhibition of LOC158427 (Accession NM_139246). Accordingly, utilities of VGAM1533 include diagnosis, prevention and treatment of diseases and clinical conditions associated with LOC158427. LOC197196 (Accession XM_117003) is another VGAM1533 host target gene. LOC197196 BINDING SITE is HOST TARGET binding site found in the 3' untranslated region of mRNA encoded by LOC197196, corresponding to a HOST TARGET binding site such as BINDING SITE I, BINDING SITE II or BINDING SITE III. Table 2 illustrates the complementarity of the nucleotide sequences of LOC197196 BINDING SITE, designated SEQ ID:43199, to the nucleotide sequence of VGAM1533 RNA, herein designated VGAM RNA, also designated SEQ ID:4244.

Another function of VGAM1533 is therefore inhibition of LOC197196 (Accession XM_117003). Accordingly, utilities of VGAM1533 include diagnosis, prevention and treatment of diseases and clinical conditions associated with LOC197196. LOC199699 (Accession XM_113990) is another VGAM1533 host target gene. LOC199699 BINDING SITE is HOST TARGET binding site found in the 3' untranslated region of mRNA encoded by LOC199699, corresponding to a HOST TARGET binding site such as BINDING SITE I, BINDING SITE II or BINDING SITE III. Table 2 illustrates the complementarity of the nucleotide sequences of LOC199699 BINDING SITE, designated SEQ ID:42594, to the nucleotide sequence of VGAM1533 RNA, herein designated VGAM RNA, also designated SEQ ID:4244.

Another function of VGAM1533 is therefore inhibition of LOC199699 (Accession XM_113990). Accordingly, utilities of VGAM1533 include diagnosis, prevention and treatment of diseases and clinical conditions associated with LOC199699. LOC219401 (Accession XM_166706) is another VGAM1533 host target gene. LOC219401 BINDING SITE is HOST TARGET binding site found in the 3' untranslated region of mRNA encoded by LOC219401, corresponding to a HOST TARGET binding site such as BINDING SITE I, BINDING SITE II or BINDING SITE III. Table 2 illustrates the complementarity of the nucleotide sequences of LOC219401 BINDING SITE, designated SEQ ID:44591, to the nucleotide sequence of VGAM1533 RNA, herein designated VGAM RNA, also designated SEQ ID:4244.

Another function of VGAM1533 is therefore inhibition of LOC219401 (Accession XM_166706). Accordingly, utilities of VGAM1533 include diagnosis, prevention and treatment of diseases and clinical conditions associated with LOC219401. LOC256112 (Accession XM_172829) is another VGAM1533 host target gene. LOC256112 BINDING SITE is HOST TARGET binding site found in the 3' untranslated region of mRNA encoded by LOC256112, corresponding to a HOST TARGET binding site such as BINDING SITE I, BINDING SITE II or BINDING SITE III. Table 2 illustrates the complementarity of the nucleotide sequences of LOC256112 BINDING SITE, designated SEQ ID:46103, to the nucleotide sequence of VGAM1533 RNA, herein designated VGAM RNA, also designated SEQ ID:4244.

Another function of VGAM1533 is therefore inhibition of LOC256112 (Accession XM_172829). Accordingly, utilities of VGAM1533 include diagnosis, prevention and treatment of diseases and clinical conditions associated with LOC256112. LOC91464 (Accession XM_038589) is another VGAM1533 host target gene. LOC91464 BINDING SITE is HOST TARGET binding site found in the 5' untranslated region of mRNA encoded by LOC91464, corresponding to a HOST TARGET binding site such as BINDING SITE I, BINDING SITE II or BINDING SITE III. Table 2 illustrates the complementarity of the nucleotide sequences of LOC91464 BINDING SITE, designated SEQ ID:32876, to the nucleotide sequence of VGAM1533 RNA, herein designated VGAM RNA, also designated SEQ ID:4244.

Another function of VGAM1533 is therefore inhibition of LOC91464 (Accession XM_038589). Accordingly, utilities of VGAM1533 include diagnosis, prevention and treatment of diseases and clinical conditions associated with LOC91464. FIG. 1 further provides a conceptual description of a novel bioinformatically detected viral gene of the present invention, referred to here as Viral Genomic Address Messenger 1534 (VGAM1534) viral gene, which modulates expression of respective host target genes thereof, the function and utility of which host target genes is known in the art.

VGAM1534 is a novel bioinformatically detected regulatory, non protein coding, viral micro RNA (miRNA) gene. The method by which VGAM1534 was detected is described hereinabove with reference to FIGS. 1-8.

VGAM1534 gene, herein designated VGAM GENE, is a viral gene contained in the genome of Cowpox Virus. VGAM1534 host target gene, herein designated VGAM HOST TARGET GENE, is a human gene contained in the human genome.

VGAM1534 gene encodes a VGAM1534 precursor RNA, herein designated VGAM PRECURSOR RNA. Similar to other miRNA genes, and unlike most ordinary genes, VGAM1534 precursor RNA does not encode a protein. A nucleotide sequence identical or highly similar to the nucleotide sequence of VGAM1534 precursor RNA is designated SEQ ID:1520, and is provided hereinbelow with reference to the sequence listing part. Nucleotide sequence SEQ ID:1520 is located at position 80718 relative to the genome of Cowpox Virus.

VGAM1534 precursor RNA folds onto itself, forming VGAM1534 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1534 folded precursor RNA into VGAM1534 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM1534 RNA is designated SEQ ID:4245, and is provided hereinbelow with reference to the sequence listing part.

VGAM1534 host target gene, herein designated VGAM HOST TARGET GENE, encodes a corresponding messenger RNA, VGAM1534 host target RNA, herein designated VGAM HOST TARGET RNA. VGAM1534 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1534 RNA, herein designated VGAM RNA, binds complementarily to one or more host target binding sites located in untranslated regions of VGAM1534 host target RNA, herein designated VGAM HOST TARGET RNA. This complementary binding is due to the fact that the nucleotide sequence of VGAM1534 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1534 RNA, herein designated VGAM RNA, may have a different number of host target binding sites in untranslated regions of a VGAM1534 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1534 RNA, herein designated VGAM RNA, to host target binding sites on VGAM1534 host target RNA, herein designated VGAM HOST TARGET RNA, such as BINDING SITE I, BINDING SITE II and BINDING SITE III, inhibits translation of VGAM1534 host target RNA into VGAM1534 host target protein, herein designated VGAM HOST TARGET PROTEIN. VGAM host target protein is therefore outlined by a broken line.

It is appreciated that VGAM1534 host target gene, herein designated VGAM HOST TARGET GENE, in fact represents a plurality of VGAM1534 host target genes. The mRNA of each one of this plurality of VGAM1534 host target genes comprises one or more host target binding sites, each having a nucleotide sequence which is at least partly complementary to VGAM1534 RNA, herein designated VGAM RNA, and which when bound by VGAM1534 RNA causes inhibition of translation of respective one or more VGAM1534 host target proteins.

It is further appreciated by one skilled in the art that the mode of translational inhibition illustrated by FIG. 1 with specific reference to translational inhibition exerted by VGAM1534 gene, herein designated VGAM GENE, on one or more VGAM1534 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1534 is inhibition of expression of host target genes, as part of a novel viral mechanism of attacking a host. Accordingly, utilities of VGAM1534 include diagnosis, prevention and treatment of viral infection by Cowpox Virus. Specific functions, and accordingly utilities, of VGAM1534 correlate with, and may be deduced from, the identity of the host target genes which VGAM1534 binds and inhibits, and the function of these host target genes, as elaborated hereinbelow.

Nucleotide sequences of the VGAM1534 precursor RNA, herein designated VGAM PRECURSOR RNA, and of the 'diced' VGAM1534 RNA, herein designated VGAM RNA, and a schematic representation of the secondary folding of VGAM1534 folded precursor RNA, herein designated VGAM FOLDED PRECURSOR RNA, of VGAM1534 are further described hereinbelow with reference to Table 1.

Nucleotide sequences of host target binding sites, such as BINDING SITE-I, BINDING SITE-II and BINDING SITE-III of FIG. 1, found on VGAM1534 host target RNA, and schematic representation of the complementarity of each of these host target binding sites to VGAM1534 RNA, herein designated VGAM RNA, are described hereinbelow with reference to Table 2.

As mentioned hereinabove with reference to FIG. 1, a function of VGAM1534 gene, herein designated VGAM is inhibition of expression of VGAM1534 target genes. It is appreciated that specific functions, and accordingly utilities, of VGAM1534 correlate with, and may be deduced from, the identity of the target genes which VGAM1534 binds and inhibits, and the function of these target genes, as elaborated hereinbelow.

Microtubule-associated Protein 1A (MAP1A, Accession NM_002373) is a VGAM1534 host target gene. MAP1A BINDING SITE is HOST TARGET binding site found in the 3' untranslated region of mRNA encoded by MAP1A, corresponding to a HOST TARGET binding site such as BINDING SITE I, BINDING SITE II or BINDING SITE III. Table 2 illustrates the complementarity of the nucleotide sequences of MAP1A BINDING SITE, designated SEQ ID:8181, to the nucleotide sequence of VGAM1534 RNA, herein designated VGAM RNA, also designated SEQ ID:4245.

A function of VGAM1534 is therefore inhibition of Microtubule-associated Protein 1A (MAP1A, Accession NM_002373), a gene which is a structural protein involved in the filamentous cross- bridging between microtubules and other skeletal elements. Accordingly, utilities of VGAM1534 include diagnosis, prevention and treatment of diseases and clinical conditions associated with MAP1A. The function of MAP1A and its association with various diseases and clinical conditions, has been established by previous studies, as described hereinabove with reference to VGAM315. MGC20253 (Accession NM_144583) is another VGAM1534 host target gene. MGC20253 BINDING SITE is HOST TARGET binding site found in the 3' untranslated region of mRNA encoded by MGC20253, corresponding to a HOST TARGET binding site such as BINDING SITE I, BINDING SITE II or BINDING SITE III. Table 2 illustrates the complementarity of the nucleotide sequences of MGC20253 BINDING SITE, designated SEQ ID:29394, to the nucleotide sequence of VGAM1534 RNA, herein designated VGAM RNA, also designated SEQ ID:4245.

Another function of VGAM1534 is therefore inhibition of MGC20253 (Accession NM_144583). Accordingly, utilities of VGAM1534 include diagnosis, prevention and treatment of diseases and clinical conditions associated with MGC20253. LOC120856 (Accession XM_058509) is another VGAM1534 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36635, to the nucleotide sequence of VGAM1534 RNA, herein designated VGAM RNA, also designated SEQ ID:4245.

Another function of VGAM1534 is therefore inhibition of LOC120856 (Accession XM_058509). Accordingly, utilities of VGAM1534 include diagnosis, prevention and treatment of diseases and clinical conditions associated with LOC120856. LOC143425 (Accession XM_113695) is another VGAM1534 host target gene. LOC143425 BINDING SITE is HOST TARGET binding site found in the 3' untranslated region of mRNA encoded by LOC143425, corresponding to a HOST TARGET binding site such as BINDING SITE I, BINDING SITE II or BINDING SITE III. Table 2 illustrates the complementarity of the nucleotide sequences of LOC143425 BINDING SITE, designated SEQ ID:42347, to the nucleotide sequence of VGAM1534 RNA, herein designated VGAM RNA, also designated SEQ ID:4245.

Another function of VGAM1534 is therefore inhibition of LOC143425 (Accession XM_113695). Accordingly, utilities of VGAM1534 include diagnosis, prevention and treatment of diseases and clinical conditions associated with LOC143425. LOC201685 (Accession XM_117325) is another VGAM1534 host target gene. LOC201685 BINDING SITE is HOST TARGET binding site found in the 3' untranslated region of mRNA encoded by LOC201685, corresponding to a HOST TARGET binding site such as BIND- ING SITE I, BINDING SITE II or BINDING SITE III. Table 2 illustrates the complementarity of the nucleotide sequences of LOC201685 BINDING SITE, designated SEQ ID:43385, to the nucleotide sequence of VGAM1534 RNA, herein designated VGAM RNA, also designated SEQ ID:4245.

Another function of VGAM1534 is therefore inhibition of LOC201685 (Accession XM_117325). Accordingly, utilities of VGAM1534 include diagnosis, prevention and treatment of diseases and clinical conditions associated with LOC201685. FIG. 1 further provides a conceptual description of a novel bioinformatically detected viral gene of the present invention, referred to here as Viral Genomic Address Messenger 1535 (VGAM1535) viral gene, which modulates expression of respective host target genes thereof, the function and utility of which host target genes is known in the art.

VGAM1535 is a novel bioinformatically detected regulatory, non protein coding, viral micro RNA (miRNA) gene. The method by which VGAM1535 was detected is described hereinabove with reference to FIGS. 1-8.

VGAM1535 gene, herein designated VGAM GENE, is a viral gene contained in the genome of Cowpox Virus. VGAM1535 host target gene, herein designated VGAM HOST TARGET GENE, is a human gene contained in the human genome.

VGAM1535 gene encodes a VGAM1535 precursor RNA, herein designated VGAM PRECURSOR RNA. Similar to other miRNA genes, and unlike most ordinary genes, VGAM1535 precursor RNA does not encode a protein. A nucleotide sequence identical or highly similar to the nucleotide sequence of VGAM1535 precursor RNA is designated SEQ ID:1521, and is provided hereinbelow with reference to the sequence listing part. Nucleotide sequence SEQ ID:1521 is located at position 80457 relative to the genome of Cowpox Virus.

VGAM1535 precursor RNA folds onto itself, forming VGAM1535 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1535 folded precursor RNA into VGAM1535 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM1535 RNA is designated SEQ ID:4246, and is provided hereinbelow with reference to the sequence listing part.

VGAM1535 host target gene, herein designated VGAM HOST TARGET GENE, encodes a corresponding messenger RNA, VGAM1535 host target RNA, herein designated VGAM HOST TARGET RNA. VGAM1535 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1535 RNA, herein designated VGAM RNA, binds complementarily to one or more host target binding sites located in untranslated regions of VGAM1535 host target RNA, herein designated VGAM HOST TARGET RNA. This complementary binding is due to the fact that the nucleotide sequence of VGAM1535 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1535 RNA, herein designated VGAM RNA, may have a different number of host target binding sites in untranslated regions of a VGAM1535 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1535 RNA, herein designated VGAM RNA, to host target binding sites on VGAM1535 host target RNA, herein designated VGAM HOST TARGET RNA, such as BINDING SITE I, BINDING SITE II and BINDING SITE III, inhibits translation of VGAM1535 host target RNA into VGAM1535 host target protein, herein designated VGAM HOST TARGET PROTEIN. VGAM host target protein is therefore outlined by a broken line.

It is appreciated that VGAM1535 host target gene, herein designated VGAM HOST TARGET GENE, in fact represents a plurality of VGAM1535 host target genes. The mRNA of each one of this plurality of VGAM1535 host target genes comprises one or more host target binding sites, each having a nucleotide sequence which is at least partly complementary to VGAM1535 RNA, herein designated VGAM RNA, and which when bound by VGAM1535 RNA causes inhibition of translation of respective one or more VGAM1535 host target proteins.

It is further appreciated by one skilled in the art that the mode of translational inhibition illustrated by FIG. 1 with specific reference to translational inhibition exerted by VGAM1535 gene, herein designated VGAM GENE, on one or more VGAM1535 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1535 is inhibition of expression of host target genes, as part of a novel viral mechanism of attacking a host. Accordingly, utilities of VGAM1535 include diagnosis, prevention and treatment of viral infection by Cowpox Virus. Specific functions, and accordingly utilities, of VGAM1535 correlate with, and may be deduced from, the identity of the host target genes which VGAM1535 binds and inhibits, and the function of these host target genes, as elaborated hereinbelow.

Nucleotide sequences of the VGAM1535 precursor RNA, herein designated VGAM PRECURSOR RNA, and of the 'diced' VGAM1535 RNA, herein designated VGAM RNA, and a schematic representation of the secondary folding of VGAM1535 folded precursor RNA, herein designated VGAM FOLDED PRECURSOR RNA, of VGAM1535 are further described hereinbelow with reference to Table 1.

Nucleotide sequences of host target binding sites, such as BINDING SITE-I, BINDING SITE-II and BINDING SITE-III of FIG. 1, found on VGAM1535 host target RNA, and schematic representation of the complementarity of each of these host target binding sites to VGAM1535 RNA, herein designated VGAM RNA, are described hereinbelow with reference to Table 2.

As mentioned hereinabove with reference to FIG. 1, a function of VGAM1535 gene, herein designated VGAM is inhibition of expression of VGAM1535 target genes. It is appreciated that specific functions, and accordingly utilities, of VGAM1535 correlate with, and may be deduced from, the identity of the target genes which VGAM1535 binds and inhibits, and the function of these target genes, as elaborated hereinbelow.

Potassium Voltage-gated Channel, Shal-related Subfamily, Member 2 (KCND2, Accession NM_012281) is a VGAM1535 host target gene. KCND2 BINDING SITE is HOST TARGET binding site found in the 3' untranslated region of mRNA encoded by KCND2, corresponding to a HOST TARGET binding site such as BINDING SITE I, BINDING SITE II or BINDING SITE III. Table 2 illustrates the complementarity of the nucleotide sequences of KCND2 BINDING SITE, designated SEQ ID:14605, to the nucleotide sequence of VGAM1535 RNA, herein designated VGAM RNA, also designated SEQ ID:4246.

A function of VGAM1535 is therefore inhibition of Potassium Voltage-gated Channel, Shal-related Subfamily, Member 2 (KCND2, Accession NM_012281), a gene which is prominent in the repolarization phase of the action potential. Accordingly, utilities of VGAM1535 include diagnosis, prevention and treatment of diseases and clinical conditions associated with KCND2. The function of KCND2 and its association with various diseases and clinical conditions, has been established by previous studies, as described hereinabove with reference to VGAM449. Peripheral Myelin Protein 2 (PMP2, Accession NM_002677) is another VGAM1535 host target gene. PMP2 BINDING SITE is HOST TARGET binding site found in the 3' untranslated region of mRNA encoded by PMP2, corresponding to a HOST TARGET binding site such as BINDING SITE I, BINDING SITE II or BINDING SITE III. Table 2 illustrates the complementarity of the nucleotide sequences of PMP2 BINDING SITE, designated SEQ ID:8542, to the nucleotide sequence of VGAM1535 RNA, herein designated VGAM RNA, also designated SEQ ID:4246.

Another function of VGAM1535 is therefore inhibition of Peripheral Myelin Protein 2 (PMP2, Accession NM_002677), a gene which is a lipid transport protein in schwann cells. Accordingly, utilities of VGAM1535 include diagnosis, prevention and treatment of diseases and clinical conditions associated with PMP2. The function of PMP2 and its association with various diseases and clinical conditions, has been established by previous studies, as described hereinabove with reference to VGAM55. KIAA1229 (Accession XM_030665) is another VGAM1535 host target gene. KIAA1229 BINDING SITE is HOST TARGET binding site found in the 3' untranslated region of mRNA encoded by KIAA1229, corresponding to a HOST TARGET binding site such as BINDING SITE I, BINDING SITE II or BINDING SITE III. Table 2 illustrates the complementarity of the nucleotide sequences of KIAA1229 BINDING SITE, designated SEQ ID:31093, to the nucleotide sequence of VGAM1535 RNA, herein designated VGAM RNA, also designated SEQ ID:4246.

Another function of VGAM1535 is therefore inhibition of KIAA1229 (Accession XM_030665). Accordingly, utilities of VGAM1535 include diagnosis, prevention and treatment of diseases and clinical conditions associated with KIAA1229. FIG. 1 further provides a conceptual description of a novel bioinformatically detected viral gene of the present invention, referred to here as Viral Genomic Address Messenger 1536 (VGAM1536) viral gene, which modulates expression of respective host target genes thereof, the function and utility of which host target genes is known in the art.

VGAM1536 is a novel bioinformatically detected regulatory, non protein coding, viral micro RNA (miRNA) gene. The method by which VGAM1536 was detected is described hereinabove with reference to FIGS. 1-8.

VGAM1536 gene, herein designated VGAM GENE, is a viral gene contained in the genome of Cowpox Virus. VGAM1536 host target gene, herein designated VGAM HOST TARGET GENE, is a human gene contained in the human genome.

VGAM1536 gene encodes a VGAM1536 precursor RNA, herein designated VGAM PRECURSOR RNA. Similar to other miRNA genes, and unlike most ordinary genes, VGAM1536 precursor RNA does not encode a protein. A nucleotide sequence identical or highly similar to the nucleotide sequence of VGAM1536 precursor RNA is designated SEQ ID:1522, and is provided hereinbelow with reference to the sequence listing part. Nucleotide sequence SEQ ID:1522 is located at position 77166 relative to the genome of Cowpox Virus.

VGAM1536 precursor RNA folds onto itself, forming VGAM1536 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1536 folded precursor RNA into VGAM1536 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1536 RNA is designated SEQ ID:4247, and is provided hereinbelow with reference to the sequence listing part.

VGAM1536 host target gene, herein designated VGAM HOST TARGET GENE, encodes a corresponding messenger RNA, VGAM1536 host target RNA, herein designated VGAM HOST TARGET RNA. VGAM1536 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1536 RNA, herein designated VGAM RNA, binds complementarily to one or more host target binding sites located in untranslated regions of VGAM1536 host target RNA, herein designated VGAM HOST TARGET RNA. This complementary binding is due to the fact that the nucleotide sequence of VGAM1536 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1536 RNA, herein designated VGAM RNA, may have a different number of host target binding sites in untranslated regions of a VGAM1536 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1536 RNA, herein designated VGAM RNA, to host target binding sites on VGAM1536 host target RNA, herein designated VGAM HOST TARGET RNA, such as BINDING SITE I, BINDING SITE II and BINDING SITE III, inhibits translation of VGAM1536 host target RNA into VGAM1536 host target protein, herein designated VGAM HOST TARGET PROTEIN. VGAM host target protein is therefore outlined by a broken line.

It is appreciated that VGAM1536 host target gene, herein designated VGAM HOST TARGET GENE, in fact represents a plurality of VGAM1536 host target genes. The mRNA of each one of this plurality of VGAM1536 host target genes comprises one or more host target binding sites, each having a nucleotide sequence which is at least partly complementary to VGAM1536 RNA, herein designated VGAM RNA, and which when bound by VGAM1536 RNA causes inhibition of translation of respective one or more VGAM1536 host target proteins.

It is further appreciated by one skilled in the art that the mode of translational inhibition illustrated by FIG. 1 with specific reference to translational inhibition exerted by VGAM1536 gene, herein designated VGAM GENE, on one or more VGAM1536 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1536 is inhibition of expression of host target genes, as part of a novel viral mechanism of attacking a host. Accordingly, utilities of VGAM1536 include diagnosis, prevention and treatment of viral infection by Cowpox Virus. Specific functions, and accordingly utilities, of VGAM1536 correlate with, and may be deduced from, the identity of the host target genes which VGAM1536 binds and inhibits, and the function of these host target genes, as elaborated hereinbelow.

Nucleotide sequences of the VGAM1536 precursor RNA, herein designated VGAM PRECURSOR RNA, and of the 'diced' VGAM1536 RNA, herein designated VGAM RNA, and a schematic representation of the secondary folding of VGAM1536 folded precursor RNA, herein designated VGAM FOLDED PRECURSOR RNA, of VGAM1536 are further described hereinbelow with reference to Table 1.

Nucleotide sequences of host target binding sites, such as BINDING SITE-I, BINDING SITE-II and BINDING SITE-III of FIG. 1, found on VGAM1536 host target RNA, and schematic representation of the complementarity of each of these host target binding sites to VGAM1536 RNA, herein designated VGAM RNA, are described hereinbelow with reference to Table 2.

As mentioned hereinabove with reference to FIG. 1, a function of VGAM1536 gene, herein designated VGAM is inhibition of expression of VGAM1536 target genes. It is appreciated that specific functions, and accordingly utilities, of VGAM1536 correlate with, and may be deduced from, the identity of the target genes which VGAM1536 binds and inhibits, and the function of these target genes, as elaborated hereinbelow.

Hepatocyte Growth Factor (hepapoietin A; scatter factor) (HGF, Accession XM_168542) is a VGAM1536 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45216, to the nucleotide sequence of VGAM1536 RNA, herein designated VGAM RNA, also designated SEQ ID:4247.

A function of VGAM1536 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM1536 include diagnosis, prevention and treatment of diseases and clinical conditions associated with HGF. The function of HGF and its association with various diseases and clinical conditions, has been established by previous studies, as described hereinabove with reference to VGAM174. Chromosome 20 Open Reading Frame 43 (C20orf43, Accession XM_009549) is another VGAM1536 host target gene. C20orf43 BINDING SITE is HOST TARGET binding site found in the 3" untranslated region of mRNA encoded by C20orf43, corresponding to a HOST TARGET binding site such as BINDING SITE I, BINDING SITE II or BINDING SITE III. Table 2 illustrates the complementarity of the nucleotide sequences of C20orf43 BINDING SITE, designated SEQ ID:30113, to the nucleotide sequence of VGAM1536 RNA, herein designated VGAM RNA, also designated SEQ ID:4247.

Another function of VGAM1536 is therefore inhibition of Chromosome 20 Open Reading Frame 43 (C20orf43, Accession XM_009549). Accordingly, utilities of VGAM1536 include diagnosis, prevention and treatment of diseases and clinical conditions associated with C20orf43. KIAA1559 (Accession XM_054472) is another VGAM1536 host target gene. KIAA1559 BINDING SITE is HOST TARGET binding site found in the 3' untranslated region of mRNA encoded by KIAA1559, corresponding to a HOST TARGET binding site such as BINDING SITE I, BINDING SITE II or BINDING SITE III. Table 2 illustrates the complementarity of the nucleotide sequences of KIAA1559 BINDING SITE, designated SEQ ID:36160, to the nucleotide sequence of VGAM1536 RNA, herein designated VGAM RNA, also designated SEQ ID:4247.

Another function of VGAM1536 is therefore inhibition of KIAA1559 (Accession XM_054472). Accordingly, utilities of VGAM1536 include diagnosis, prevention and treatment of diseases and clinical conditions associated with KIAA1559. LOC152179 (Accession XM_098170) is another VGAM1536 host target gene. LOC152179 BINDING SITE is HOST TARGET binding site found in the 5' untranslated region of mRNA encoded by LOC152179, corresponding to a HOST TARGET binding site such as BINDING SITE I, BINDING SITE II or BINDING SITE III. Table 2 illustrates the complementarity of the nucleotide sequences of LOC152179 BINDING SITE, designated SEQ ID:41431, to the nucleotide sequence of VGAM1536 RNA, herein designated VGAM RNA, also designated SEQ ID:4247.

Another function of VGAM1536 is therefore inhibition of LOC152179 (Accession XM_098170). Accordingly, utilities of VGAM1536 include diagnosis, prevention and treatment of diseases and clinical conditions associated with LOC152179. FIG. 1 further provides a conceptual description of a novel bioinformatically detected viral gene of the present invention, referred to here as Viral Genomic Address Messenger 1537 (VGAM1537) viral gene, which modulates expression of respective host target genes thereof, the function and utility of which host target genes is known in the art.

VGAM1537 is a novel bioinformatically detected regulatory, non protein coding, viral micro RNA (miRNA) gene. The method by which VGAM1537 was detected is described hereinabove with reference to FIGS. 1-8.

VGAM1537 gene, herein designated VGAM GENE, is a viral gene contained in the genome of Cowpox Virus. VGAM1537 host target gene, herein designated VGAM HOST TARGET GENE, is a human gene contained in the human genome.

VGAM1537 gene encodes a VGAM1537 precursor RNA, herein designated VGAM PRECURSOR RNA. Similar to other miRNA genes, and unlike most ordinary genes, VGAM1537 precursor RNA does not encode a protein. A nucleotide sequence identical or highly similar to the nucleotide sequence of VGAM1537 precursor RNA is designated SEQ ID:1523, and is provided hereinbelow with reference to the sequence listing part. Nucleotide sequence SEQ ID:1523 is located at position 78285 relative to the genome of Cowpox Virus.

VGAM1537 precursor RNA folds onto itself, forming VGAM1537 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1537 folded precursor RNA into VGAM1537 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1537 RNA is designated SEQ ID:4248, and is provided hereinbelow with reference to the sequence listing part.

VGAM1537 host target gene, herein designated VGAM HOST TARGET GENE, encodes a corresponding messenger RNA, VGAM1537 host target RNA, herein designated VGAM HOST TARGET RNA. VGAM1537 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1537 RNA, herein designated VGAM RNA, binds complementarily to one or more host target binding sites located in untranslated regions of VGAM1537 host target RNA, herein designated VGAM HOST TARGET RNA. This complementary binding is due to the fact that the nucleotide sequence of VGAM1537 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1537 RNA, herein designated VGAM RNA, may have a different number of host target binding sites in untranslated regions of a VGAM1537 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1537 RNA, herein designated VGAM RNA, to host target binding sites on VGAM1537 host target RNA, herein designated VGAM HOST TARGET RNA, such as BINDING SITE I, BINDING SITE II and BINDING SITE III, inhibits translation of VGAM1537 host target RNA into VGAM1537 host target protein, herein designated VGAM HOST TARGET PROTEIN. VGAM host target protein is therefore outlined by a broken line.

It is appreciated that VGAM1537 host target gene, herein designated VGAM HOST TARGET GENE, in fact represents a plurality of VGAM1537 host target genes. The mRNA of each one of this plurality of VGAM1537 host target genes comprises one or more host target binding sites, each having a nucleotide sequence which is at least partly complementary to VGAM1537 RNA, herein designated VGAM RNA, and which when bound by VGAM1537 RNA causes inhibition of translation of respective one or more VGAM1537 host target proteins.

It is further appreciated by one skilled in the art that the mode of translational inhibition illustrated by FIG. 1 with specific reference to translational inhibition exerted by VGAM1537 gene, herein designated VGAM GENE, on one or more VGAM1537 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1537 is inhibition of expression of host target genes, as part of a novel viral mechanism of attacking a host. Accordingly, utilities of VGAM1537 include diagnosis, prevention and treatment of viral infection by Cowpox Virus. Specific functions, and accordingly utilities, of VGAM1537 correlate with, and may be deduced from, the identity of the host target genes which VGAM1537 binds and inhibits, and the function of these host target genes, as elaborated hereinbelow.

Nucleotide sequences of the VGAM1537 precursor RNA, herein designated VGAM PRECURSOR RNA, and of the 'diced' VGAM1537 RNA, herein designated VGAM RNA, and a schematic representation of the secondary folding of VGAM1537 folded precursor RNA, herein designated VGAM FOLDED PRECURSOR RNA, of VGAM1537 are further described hereinbelow with reference to Table 1.

Nucleotide sequences of host target binding sites, such as BINDING SITE-I, BINDING SITE-II and BINDING SITE-III of FIG. 1, found on VGAM1537 host target RNA, and schematic representation of the complementarity of each of these host target binding sites to VGAM1537 RNA, herein designated VGAM RNA, are described hereinbelow with reference to Table 2.

As mentioned hereinabove with reference to FIG. 1, a function of VGAM1537 gene, herein designated VGAM is inhibition of expression of VGAM1537 target genes. It is appreciated that specific functions, and accordingly utilities, of VGAM1537 correlate with, and may be deduced from, the identity of the target genes which VGAM1537 binds and inhibits, and the function of these target genes, as elaborated hereinbelow.

Apical Protein-like (Xenopus laevis) (APXL, Accession NM_001649) is a VGAM1537 host target gene. APXL BINDING SITE is HOST TARGET binding site found in the 3' untranslated region of mRNA encoded by APXL, corresponding to a HOST TARGET binding site such as BINDING SITE I, BINDING SITE II or BINDING SITE III. Table 2 illustrates the complementarity of the nucleotide sequences of APXL BINDING SITE, designated SEQ ID:7352, to the nucleotide sequence of VGAM1537 RNA, herein designated VGAM RNA, also designated SEQ ID:4248.

A function of VGAM1537 is therefore inhibition of Apical Protein-like (Xenopus laevis) (APXL, Accession NM_001649), a gene which is implicated in amiloride-sensitive sodium channel activity. Accordingly, utilities of VGAM1537 include diagnosis, prevention and treatment of diseases and clinical conditions associated with APXL. The function of APXL and its association with various diseases and clinical conditions, has been established by previous studies, as described hereinabove with reference to VGAM152. Cockayne Syndrome 1 (classical) (CKN1, Accession NM_000082) is another VGAM1537 host target gene. CKN1 BINDING SITE is HOST TARGET binding site found in the 3' untranslated region of mRNA encoded by CKN1, corresponding to a HOST TARGET binding site such as BINDING SITE I, BINDING SITE II or BINDING SITE III. Table 2 illustrates the complementarity of the nucleotide sequences of CKN1 BINDING SITE, designated SEQ ID:5529, to the nucleotide sequence of VGAM1537 RNA, herein designated VGAM RNA, also designated SEQ ID:4248.

Another function of VGAM1537 is therefore inhibition of Cockayne Syndrome 1 (classical) (CKN1, Accession NM_000082). Accordingly, utilities of VGAM1537 include diagnosis, prevention and treatment of diseases and clinical conditions associated with CKN1. High Mobility Group AT-hook 2 (HMGA2, Accession NM_003483) is another VGAM1537 host target gene. HMGA2 BINDING SITE is HOST TARGET binding site found in the 3' untranslated region of mRNA encoded by HMGA2, corresponding to a HOST TARGET binding site such as BINDING SITE I, BINDING SITE II or BINDING SITE III. Table 2 illustrates the complementarity of the nucleotide sequences of HMGA2 BINDING SITE, designated SEQ ID:9561, to the nucleotide sequence of VGAM1537 RNA, herein designated VGAM RNA, also designated SEQ ID:4248.

Another function of VGAM1537 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM1537 include diagnosis, prevention and treatment of diseases and clinical conditions associated with HMGA2. The function of HMGA2 and its association with various diseases and clinical conditions, has been established by previous studies, as described hereinabove with reference to VGAM552. Zinc Finger Protein 36 (KOX 18) (ZNF36, Accession XM_168302) is another VGAM1537 host target gene. ZNF36 BINDING SITE is HOST TARGET binding site found in the 3' untranslated region of mRNA encoded by ZNF36, corresponding to a HOST TARGET binding site such as BINDING SITE I, BINDING SITE II or BINDING SITE III. Table 2 illustrates the complementarity of the nucleotide sequences of ZNF36 BINDING SITE, designated SEQ ID:45101, to the nucleotide sequence of VGAM1537 RNA, herein designated VGAM RNA, also designated SEQ ID:4248.

Another function of VGAM1537 is therefore inhibition of Zinc Finger Protein 36 (KOX 18) (ZNF36, Accession XM_168302), a gene which may be involved in transcriptional regulation. Accordingly, utilities of VGAM1537 include diagnosis, prevention and treatment of diseases and clinical conditions associated with ZNF36. The function of ZNF36 and its association with various diseases and clinical conditions, has been established by previous studies, as described hereinabove with reference to VGAM804. FLJ23191 (Accession NM_024574) is another VGAM1537 host target gene. FLJ23191 BINDING SITE is HOST TARGET binding site found in the 3' untranslated region of mRNA encoded by FLJ23191, corresponding to a HOST TARGET binding site such as BINDING SITE I, BINDING SITE II or BINDING SITE III. Table 2 illustrates the complementarity of the nucleotide sequences of FLJ23191 BINDING SITE, designated SEQ ID:23803, to the nucleotide sequence of VGAM1537 RNA, herein designated VGAM RNA, also designated SEQ ID:4248.

Another function of VGAM1537 is therefore inhibition of FLJ23191 (Accession NM_024574). Accordingly, utilities of VGAM1537 include diagnosis, prevention and treatment of diseases and clinical conditions associated with FLJ23191. KIAA0841 (Accession XM_049237) is another VGAM1537 host target gene. KIAA0841 BINDING SITE is HOST TARGET binding site found in the 3' untranslated region of mRNA encoded by KIAA0841, corresponding to a HOST TARGET binding site such as BINDING SITE I, BINDING SITE II or BINDING SITE III. Table 2 illustrates the complementarity of the nucleotide sequences of KIAA0841 BINDING SITE, designated SEQ ID:35359, to the nucleotide sequence of VGAM1537 RNA, herein designated VGAM RNA, also designated SEQ ID:4248.

Another function of VGAM1537 is therefore inhibition of KIAA0841 (Accession XM_049237). Accordingly, utilities of VGAM1537 include diagnosis, prevention and treatment of diseases and clinical conditions associated with KIAA0841. Ring Finger Protein 20 (RNF20, Accession NM_019592) is another VGAM1537 host target gene. RNF20 BINDING SITE is HOST TARGET binding site found in the 3' untranslated region of mRNA encoded by RNF20, corresponding to a HOST TARGET binding site such as BINDING SITE I, BINDING SITE II or BINDING SITE III. Table 2 illustrates the complementarity of the nucleotide sequences of RNF20 BINDING SITE, designated SEQ ID:21213, to the nucleotide sequence of VGAM1537 RNA, herein designated VGAM RNA, also designated SEQ ID:4248.

Another function of VGAM1537 is therefore inhibition of Ring Finger Protein 20 (RNF20, Accession NM_019592). Accordingly, utilities of VGAM1537 include diagnosis, prevention and treatment of diseases and clinical conditions associated with RNF20. LOC118851 (Accession XM_061180) is another VGAM1537 host target gene. LOC118851 BINDING SITE is HOST TARGET binding site found in the 3' untranslated region of mRNA encoded by LOC118851, corresponding to a HOST TARGET binding site such as BINDING SITE I, BINDING SITE II or BINDING SITE III. Table 2 illustrates the complementarity of the nucleotide sequences of LOC118851 BINDING SITE, designated SEQ ID:37199, to the nucleotide sequence of VGAM1537 RNA, herein designated VGAM RNA, also designated SEQ ID:4248.

Another function of VGAM1537 is therefore inhibition of LOC118851 (Accession XM_061180). Accordingly, utilities of VGAM1537 include diagnosis, prevention and treatment of diseases and clinical conditions associated with LOC118851. LOC150005 (Accession XM_097795) is another VGAM1537 host target gene. LOC150005 BINDING SITE is HOST TARGET binding site found in the 3' untranslated region of mRNA encoded by LOC150005, corresponding to a HOST TARGET binding site such as BINDING SITE I, BINDING SITE II or BINDING SITE III. Table 2 illustrates the complementarity of the nucleotide sequences of LOC150005 BINDING SITE, designated SEQ ID:41122, to the nucleotide sequence of VGAM1537 RNA, herein designated VGAM RNA, also designated SEQ ID:4248.

Another function of VGAM1537 is therefore inhibition of LOC150005 (Accession XM_097795). Accordingly, utilities of VGAM1537 include diagnosis, prevention and treatment of diseases and clinical conditions associated with LOC150005. FIG. 1 further provides a conceptual description of a novel bioinformatically detected viral gene of the present invention, referred to here as Viral Genomic Address Messenger 1538 (VGAM1538) viral gene, which modulates expression of respective host target genes thereof, the function and utility of which host target genes is known in the art.

VGAM1538 is a novel bioinformatically detected regulatory, non protein coding, viral micro RNA (miRNA) gene. The method by which VGAM1538 was detected is described hereinabove with reference to FIGS. 1-8.

VGAM1538 gene, herein designated VGAM GENE, is a viral gene contained in the genome of Monkeypox Virus. VGAM1538 host target gene, herein designated VGAM HOST TARGET GENE, is a human gene contained in the human genome.

VGAM1538 gene encodes a VGAM1538 precursor RNA, herein designated VGAM PRECURSOR RNA. Similar to other miRNA genes, and unlike most ordinary genes, VGAM1538 precursor RNA does not encode a protein. A nucleotide sequence identical or highly similar to the nucleotide sequence of VGAM1538 precursor RNA is designated SEQ ID:1524, and is provided hereinbelow with reference to the sequence listing part. Nucleotide sequence SEQ ID:1524 is located at position 59766 relative to the genome of Monkeypox Virus.

VGAM1538 precursor RNA folds onto itself, forming VGAM1538 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1538 folded precursor RNA into VGAM1538 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1538 RNA is designated SEQ ID:4249, and is provided hereinbelow with reference to the sequence listing part.

VGAM1538 host target gene, herein designated VGAM HOST TARGET GENE, encodes a corresponding messenger RNA, VGAM1538 host target RNA, herein designated VGAM HOST TARGET RNA. VGAM1538 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1538 RNA, herein designated VGAM RNA, binds complementarily to one or more host target binding sites located in untranslated regions of VGAM1538 host target RNA, herein designated VGAM HOST TARGET RNA. This complementary binding is due to the fact that the nucleotide sequence of VGAM1538 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1538 RNA, herein designated VGAM RNA, may have a different number of host target binding sites in untranslated regions of a VGAM1538 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1538 RNA, herein designated VGAM RNA, to host target binding sites on VGAM1538 host target RNA, herein designated VGAM HOST TARGET RNA, such as BINDING SITE I, BINDING SITE II and BINDING SITE III, inhibits translation of VGAM1538 host target RNA into VGAM1538 host target protein, herein designated VGAM HOST TARGET PROTEIN. VGAM host target protein is therefore outlined by a broken line.

It is appreciated that VGAM1538 host target gene, herein designated VGAM HOST TARGET GENE, in fact represents a plurality of VGAM1538 host target genes. The mRNA of each one of this plurality of VGAM1538 host target genes comprises one or more host target binding sites, each having a nucleotide sequence which is at least partly complementary to VGAM1538 RNA, herein designated VGAM RNA, and which when bound by VGAM1538 RNA causes inhibition of translation of respective one or more VGAM1538 host target proteins.

It is further appreciated by one skilled in the art that the mode of translational inhibition illustrated by FIG. 1 with specific reference to translational inhibition exerted by VGAM1538 gene, herein designated VGAM GENE, on one or more VGAM1538 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1538 is inhibition of expression of host target genes, as part of a novel viral mechanism of attacking a host. Accordingly, utilities of VGAM1538 include diagnosis, prevention and treatment of viral infection by Monkeypox Virus. Specific functions, and accordingly utilities, of VGAM1538 correlate with, and may be deduced from, the identity of the host target genes which VGAM1538 binds and inhibits, and the function of these host target genes, as elaborated hereinbelow.

Nucleotide sequences of the VGAM1538 precursor RNA, herein designated VGAM PRECURSOR RNA, and of the 'diced' VGAM1538 RNA, herein designated VGAM RNA, and a schematic representation of the secondary folding of VGAM1538 folded precursor RNA, herein designated VGAM FOLDED PRECURSOR RNA, of VGAM1538 are further described hereinbelow with reference to Table 1.

Nucleotide sequences of host target binding sites, such as BINDING SITE-I, BINDING SITE-II and BINDING SITE-III of FIG. 1, found on VGAM1538 host target RNA, and schematic representation of the complementarity of each of these host target binding sites to VGAM1538 RNA, herein designated VGAM RNA, are described hereinbelow with reference to Table 2.

As mentioned hereinabove with reference to FIG. 1, a function of VGAM1538 gene, herein designated VGAM is inhibition of expression of VGAM1538 target genes. It is appreciated that specific functions, and accordingly utilities, of VGAM1538 correlate with, and may be deduced from, the identity of the target genes which VGAM1538 binds and inhibits, and the function of these target genes, as elaborated hereinbelow.

Chloride Channel 4 (CLCN4, Accession NM_001830) is a VGAM1538 host target gene. CLCN4 BINDING SITE is HOST TARGET binding site found in the 3' untranslated region of mRNA encoded by CLCN4, corresponding to a HOST TARGET binding site such as BINDING SITE I, BINDING SITE II or BINDING SITE III. Table 2 illustrates the complementarity of the nucleotide sequences of CLCN4 BINDING SITE, designated SEQ ID:7569, to the nucleotide sequence of VGAM1538 RNA, herein designated VGAM RNA, also designated SEQ ID:4249.

A function of VGAM1538 is therefore inhibition of Chloride Channel 4 (CLCN4, Accession NM_001830), a gene which is regulation of cell volume; membrane potential stabilization, signal transduction and transepithelial transport. Accordingly, utilities of VGAM1538 include diagnosis, prevention and treatment of diseases and clinical conditions associated with CLCN4. The function of CLCN4 and its association with various diseases and clinical conditions, has been established by previous studies, as described hereinabove with reference to VGAM558. Hydroxyprostaglandin Dehydrogenase 15-(NAD) (HPGD, Accession NM_000860) is another VGAM1538 host target gene. HPGD BINDING SITE is HOST TARGET binding site found in the 3' untranslated region of mRNA encoded by HPGD, corresponding to a HOST TARGET binding site such as BINDING SITE I, BINDING SITE II or BINDING SITE III. Table 2 illustrates the complementarity of the nucleotide sequences of HPGD BINDING SITE, designated SEQ ID:6522, to the nucleotide sequence of VGAM1538 RNA, herein designated VGAM RNA, also designated SEQ ID:4249.

Another function of VGAM1538 is therefore inhibition of Hydroxyprostaglandin Dehydrogenase 15-(NAD) (HPGD, Accession NM_000860), a gene which converts cortisol to cortisone. Accordingly, utilities of VGAM1538 include diagnosis, prevention and treatment of diseases and clinical conditions associated with HPGD. The function of HPGD has been established by previous studies. Prostaglandins are involved in many physiologic and cellular processes, such as inflammation. Pichaud et al. (1997) noted that the NAD(+)-dependent 15-hydroxyprostaglandin dehydrogenase (15-PGDH, type I) is the main enzyme of prostaglandin degradation. By catalyzing the conversion of the 15-hydroxyl group of prostaglandins into a keto group, this ubiquitous enzyme strongly reduces the biologic activity of these molecules. The nucleotide sequence coding for PGDH1 was established by Ensor et al. (1990) who found a 801-bp open reading frame coding for a protein with 266 amino acids identical to the amino acid sequence established by Krook et al. (1990). Cortisol reduces the activity of PGDH in human placental cells. 11-beta hydroxysteroid dehydrogenase type II (HSD11B2; 218030) converts cortisol to cortisone. Schoof et al. (2001) investigated a possible correlation between HSD11B2 and PGDH gene expression in the placenta of patients with preeclampsia. They concluded that, in preeclampsia, HSD11B2 mRNA expression is reduced, leading to a decrease of HSD11B2 activity. Furthermore, by means of an autocrine or paracrine mechanism, the diminished conversion of placental cortisol may lead to reduced PGDH mRNA expression. Animal model experiments lend further support to the function of HPGD. Coggins et al. (2002) generated mice deficient in Pgdh by targeted disruption. The Pgdh -/- pups died between 12 and 48 hours of life because of patent ductus arteriosus leading to congestive heart failure. Treatment with indomethacin rescued the phenotype. Coggins et al. (2002) concluded that alterations in PGE2 metabolism by PGDH during the perinatal period is essential for the permanent closure of the ductus arteriosus.

It is appreciated that the abovementioned animal model for HPGD is acknowledged by those skilled in the art as a scientifically valid animal model, as can be further appreciated from the publications sited hereinbelow.

Full details of the abovementioned studies are described in the following publications, the disclosure of which are hereby incorporated by reference:

Schoof, E.; Girstl, M.; Frobenius, W.; Kirschbaum, M.; Dorr, H. G.; Rascher, W.; Dotsch, J.: Decreased gene expression of 11-beta-hydroxysteroid dehydrogenase type 2 and 15-hydroxyprostaglandin dehydrogenase in human placenta of patients with preeclampsia. J. Clin. Endocr. Metab. 86:1313-1317, 2001; and Pichaud, F.; Delage-Mourroux, R.; Pidoux, E.; Jullienne, A.; Rousseau-Merck, M.-F. : Chromosomal localization of the type-I 15-PGDH gene to 4q34-q35. Hum. Genet. 99:279-281, 1997.

Further studies establishing the function and utilities of HPGD are found in John Hopkins OMIM database record ID 601688, and in sited publications numbered 6229-623 and 2793 listed in the bibliography section hereinbelow, which are also hereby incorporated by reference. Timeless Homolog (Drosophila) (TIMELESS, Accession NM_003920) is another VGAM1538 host target gene. TIMELESS BINDING SITE is HOST TARGET binding site found in the 3' untranslated region of mRNA encoded by TIMELESS, corresponding to a HOST TARGET binding site such as BINDING SITE I, BINDING SITE II or BINDING SITE III. Table 2 illustrates the complementarity of the nucleotide sequences of TIMELESS BINDING SITE, designated SEQ ID:10006, to the nucleotide sequence of VGAM1538 RNA, herein designated VGAM RNA, also designated SEQ ID:4249.

Another function of VGAM1538 is therefore inhibition of Timeless Homolog (Drosophila) (TIMELESS, Accession NM_003920), a gene which involves in circadian oscillation autoregulation. Accordingly, utilities of VGAM1538 include diagnosis, prevention and treatment of diseases and clinical conditions associated with TIMELESS. The function of TIMELESS and its association with various diseases and clinical conditions, has been established by previous studies, as described hereinabove with reference to VGAM409. Toll-like Receptor 5 (TLR5, Accession XM_086576) is another VGAM1538 host target gene. TLR5 BINDING SITE is HOST TARGET binding site found in the 5' untranslated region of mRNA encoded by TLR5, corresponding to a HOST TARGET binding site such as BINDING SITE I, BINDING SITE II or BINDING SITE III. Table 2 illustrates the complementarity of the nucleotide sequences of TLR5 BINDING SITE, designated SEQ ID:38774, to the nucleotide sequence of VGAM1538 RNA, herein designated VGAM RNA, also designated SEQ ID:4249.

Another function of VGAM1538 is therefore inhibition of Toll-like Receptor 5 (TLR5, Accession XM_086576), a gene which participates in the innate immune response to bacterial flagellins. Accordingly, utilities of VGAM1538 include diagnosis, prevention and treatment of diseases and clinical conditions associated with TLR5. The function of TLR5 and its association with various diseases and clinical conditions, has been established by previous studies, as described hereinabove with reference to VGAM1126. KIAA1557 (Accession XM_028289) is another VGAM1538 host target gene. KIAA1557 BINDING SITE is HOST TARGET binding site found in the 3' untranslated region of mRNA encoded by KIAA1557, corresponding to a HOST TARGET binding site such as BINDING SITE I, BINDING SITE II or BINDING SITE III. Table 2 illustrates the complementarity of the nucleotide sequences of KIAA1557 BINDING SITE, designated SEQ ID:30641, to the nucleotide sequence of VGAM1538 RNA, herein designated VGAM RNA, also designated SEQ ID:4249.

Another function of VGAM1538 is therefore inhibition of KIAA1557 (Accession XM_028289). Accordingly, utilities of VGAM1538 include diagnosis, prevention and treatment of diseases and clinical conditions associated with KIAA1557. Pleckstrin Homology Domain Containing, Family A (phosphoinositide binding specific) Member 3 (PLEKHA3, Accession NM_019091) is another VGAM1538 host target gene. PLEKHA3 BINDING SITE is HOST TARGET binding site found in the 3' untranslated region of mRNA encoded by PLEKHA3, corresponding to a HOST TARGET binding site such as BINDING SITE I, BINDING SITE II or BINDING SITE III. Table 2 illustrates the complementarity of the nucleotide sequences of PLEKHA3 BINDING SITE, designated SEQ ID:21167, to the nucleotide sequence of VGAM1538 RNA, herein designated VGAM RNA, also designated SEQ ID:4249.

Another function of VGAM1538 is therefore inhibition of Pleckstrin Homology Domain Containing, Family A (phosphoinositide binding specific) Member 3 (PLEKHA3, Accession NM_019091). Accordingly, utilities of VGAM1538 include diagnosis, prevention and treatment of diseases and clinical conditions associated with PLEKHA3. LOC133022 (Accession XM_068144) is another VGAM1538 host target gene. LOC133022 BINDING SITE is HOST TARGET binding site found in the 3' untranslated region of mRNA encoded by LOC133022, corresponding to a HOST TARGET binding site such as BINDING SITE I, BINDING SITE II or BINDING SITE III. Table 2 illustrates the complementarity of the nucleotide sequences of LOC133022 BINDING SITE, designated SEQ ID:37375, to the nucleotide sequence of VGAM1538 RNA, herein designated VGAM RNA, also designated SEQ ID:4249.

Another function of VGAM1538 is therefore inhibition of LOC133022 (Accession XM_068144). Accordingly, utilities of VGAM1538 include diagnosis, prevention and treatment of diseases and clinical conditions associated with LOC133022. FIG. 1 further provides a conceptual description of a novel bioinformatically detected viral gene of the present invention, referred to here as Viral Genomic Address Messenger 1539 (VGAM1539) viral gene, which modulates expression of respective host target genes thereof, the function and utility of which host target genes is known in the art.

VGAM1539 is a novel bioinformatically detected regulatory, non protein coding, viral micro RNA (miRNA) gene. The method by which VGAM1539 was detected is described hereinabove with reference to FIGS. 1-8.

VGAM1539 gene, herein designated VGAM GENE, is a viral gene contained in the genome of Monkeypox Virus. VGAM1539 host target gene, herein designated VGAM HOST TARGET GENE, is a human gene contained in the human genome.

VGAM1539 gene encodes a VGAM1539 precursor RNA, herein designated VGAM PRECURSOR RNA. Similar to other miRNA genes, and unlike most ordinary genes, VGAM1539 precursor RNA does not encode a protein. A nucleotide sequence identical or highly similar to the nucleotide sequence of VGAM1539 precursor RNA is designated SEQ ID:1525, and is provided hereinbelow with reference to the sequence listing part. Nucleotide sequence SEQ ID:1525 is located at position 60492 relative to the genome of Monkeypox Virus.

VGAM1539 precursor RNA folds onto itself, forming VGAM1539 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1539 folded precursor RNA into VGAM1539 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1539 RNA is designated SEQ ID:4250, and is provided hereinbelow with reference to the sequence listing part.

VGAM1539 host target gene, herein designated VGAM HOST TARGET GENE, encodes a corresponding messenger RNA, VGAM1539 host target RNA, herein designated VGAM HOST TARGET RNA. VGAM1539 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1539 RNA, herein designated VGAM RNA, binds complementarily to one or more host target binding sites located in untranslated regions of VGAM1539 host target RNA, herein designated VGAM HOST TARGET RNA. This complementary binding is due to the fact that the nucleotide sequence of VGAM1539 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1539 RNA, herein designated VGAM RNA, may have a different number of host target binding sites in untranslated regions of a VGAM1539 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1539 RNA, herein designated VGAM RNA, to host target binding sites on VGAM1539 host target RNA, herein designated VGAM HOST TARGET RNA, such as BINDING SITE I, BINDING SITE II and BINDING SITE III, inhibits translation of VGAM1539 host target RNA into VGAM1539 host target protein, herein designated VGAM HOST TARGET PROTEIN. VGAM host target protein is therefore outlined by a broken line.

It is appreciated that VGAM1539 host target gene, herein designated VGAM HOST TARGET GENE, in fact represents a plurality of VGAM1539 host target genes. The mRNA of each one of this plurality of VGAM1539 host target genes comprises one or more host target binding sites, each having a nucleotide sequence which is at least partly complementary to VGAM1539 RNA, herein designated VGAM RNA, and which when bound by VGAM1539 RNA causes inhibition of translation of respective one or more VGAM1539 host target proteins.

It is further appreciated by one skilled in the art that the mode of translational inhibition illustrated by FIG. 1 with specific reference to translational inhibition exerted by VGAM1539 gene, herein designated VGAM GENE, on one or more VGAM1539 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1539 is inhibition of expression of host target genes, as part of a novel viral mechanism of attacking a host. Accordingly, utilities of VGAM1539 include diagnosis, prevention and treatment of viral infection by Monkeypox Virus. Specific functions, and accordingly utilities, of VGAM1539 correlate with, and may be deduced from, the identity of the host target genes which VGAM1539 binds and inhibits, and the function of these host target genes, as elaborated hereinbelow.

Nucleotide sequences of the VGAM1539 precursor RNA, herein designated VGAM PRECURSOR RNA, and of the 'diced' VGAM1539 RNA, herein designated VGAM RNA, and a schematic representation of the secondary folding of VGAM1539 folded precursor RNA, herein designated VGAM FOLDED PRECURSOR RNA, of VGAM1539 are further described hereinbelow with reference to Table 1.

Nucleotide sequences of host target binding sites, such as BINDING SITE-I, BINDING SITE-II and BINDING SITE-III of FIG. 1, found on VGAM1539 host target RNA, and schematic representation of the complementarity of each of these host target binding sites to VGAM1539 RNA, herein designated VGAM RNA, are described hereinbelow with reference to Table 2.

As mentioned hereinabove with reference to FIG. 1, a function of VGAM1539 gene, herein designated VGAM is inhibition of expression of VGAM1539 target genes. It is appreciated that specific functions, and accordingly utilities, of VGAM1539 correlate with, and may be deduced from, the identity of the target genes which VGAM1539 binds and inhibits, and the function of these target genes, as elaborated hereinbelow.

Hepatocyte Growth Factor (hepapoietin A; scatter factor) (HGF, Accession XM_168542) is a VGAM1539 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45216, to the nucleotide sequence of VGAM1539 RNA, herein designated VGAM RNA, also designated SEQ ID:4250.

A function of VGAM1539 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM1539 include diagnosis, prevention and treatment of diseases and clinical conditions associated with HGF. The function of HGF and its association with various diseases and clinical conditions, has been established by previous studies, as described hereinabove with reference to VGAM174. Chromosome 20 Open Reading Frame 43 (C20orf43, Accession XM_009549) is another VGAM1539 host target gene. C20orf43 BINDING SITE is HOST TARGET binding site found in the 3" untranslated region of mRNA encoded by C20orf43, corresponding to a HOST TARGET binding site such as BINDING SITE I, BINDING SITE II or BINDING SITE III. Table 2 illustrates the complementarity of the nucleotide sequences of C20orf43 BINDING SITE, designated SEQ ID:30113, to the nucleotide sequence of VGAM1539 RNA, herein designated VGAM RNA, also designated SEQ ID:4250.

Another function of VGAM1539 is therefore inhibition of Chromosome 20 Open Reading Frame 43 (C20orf43, Accession XM_009549). Accordingly, utilities of VGAM1539 include diagnosis, prevention and treatment of diseases and clinical conditions associated with C20orf43. KIAA1559 (Accession XM_054472) is another VGAM1539 host target gene. KIAA1559 BINDING SITE is HOST TARGET binding site found in the 3' untranslated region of mRNA encoded by KIAA1559, corresponding to a HOST TARGET binding site such as BINDING SITE I, BINDING SITE II or BINDING SITE III. Table 2 illustrates the complementarity of the nucleotide sequences of KIAA1559 BINDING SITE, designated SEQ ID:36160, to the nucleotide sequence of VGAM1539 RNA, herein designated VGAM RNA, also designated SEQ ID:4250.

Another function of VGAM1539 is therefore inhibition of KIAA1559 (Accession XM_054472). Accordingly, utilities of VGAM1539 include diagnosis, prevention and treatment of diseases and clinical conditions associated with KIAA1559. LOC152179 (Accession XM_098170) is another VGAM1539 host target gene. LOC152179 BINDING SITE is HOST TARGET binding site found in the 5' untranslated region of mRNA encoded by LOC152179, corresponding to a HOST TARGET binding site such as BINDING SITE I, BINDING SITE II or BINDING SITE III. Table 2 illustrates the complementarity of the nucleotide sequences of LOC152179 BINDING SITE, designated SEQ ID:41431, to the nucleotide sequence of VGAM1539 RNA, herein designated VGAM RNA, also designated SEQ ID:4250.

Another function of VGAM1539 is therefore inhibition of LOC152179 (Accession XM_098170). Accordingly, utilities of VGAM1539 include diagnosis, prevention and treatment of diseases and clinical conditions associated with LOC152179. FIG. 1 further provides a conceptual description of a novel bioinformatically detected viral gene of the present invention, referred to here as Viral Genomic Address Messenger 1540 (VGAM1540) viral gene, which modulates expression of respective host target genes thereof, the function and utility of which host target genes is known in the art.

VGAM1540 is a novel bioinformatically detected regulatory, non protein coding, viral micro RNA (miRNA) gene. The method by which VGAM1540 was detected is described hereinabove with reference to FIGS. 1-8.

VGAM1540 gene, herein designated VGAM GENE, is a viral gene contained in the genome of Monkeypox Virus. VGAM1540 host target gene, herein designated VGAM HOST TARGET GENE, is a human gene contained in the human genome.

VGAM1540 gene encodes a VGAM1540 precursor RNA, herein designated VGAM PRECURSOR RNA. Similar to other miRNA genes, and unlike most ordinary genes, VGAM1540 precursor RNA does not encode a protein. A nucleotide sequence identical or highly similar to the nucleotide sequence of VGAM1540 precursor RNA is designated SEQ ID:1526, and is provided hereinbelow with reference to the sequence listing part. Nucleotide sequence SEQ ID:1526 is located at position 61618 relative to the genome of Monkeypox Virus.

VGAM1540 precursor RNA folds onto itself, forming VGAM1540 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1540 folded precursor RNA into VGAM1540 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1540 RNA is designated SEQ ID:4251, and is provided hereinbelow with reference to the sequence listing part.

VGAM1540 host target gene, herein designated VGAM HOST TARGET GENE, encodes a corresponding messenger RNA, VGAM1540 host target RNA, herein designated VGAM HOST TARGET RNA. VGAM1540 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1540 RNA, herein designated VGAM RNA, binds complementarily to one or more host target binding sites located in untranslated regions of VGAM1540 host target RNA, herein designated VGAM HOST TARGET RNA. This complementary binding is due to the fact that the nucleotide sequence of VGAM1540 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1540 RNA, herein designated VGAM RNA, may have a different number of host target binding sites in untranslated regions of a VGAM1540 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1540 RNA, herein designated VGAM RNA, to host target binding sites on VGAM1540 host target RNA, herein designated VGAM HOST TARGET RNA, such as BINDING SITE I, BINDING SITE II and BINDING SITE III, inhibits translation of VGAM1540 host target RNA into VGAM1540 host target protein, herein designated VGAM HOST TARGET PROTEIN. VGAM host target protein is therefore outlined by a broken line.

It is appreciated that VGAM1540 host target gene, herein designated VGAM HOST TARGET GENE, in fact represents a plurality of VGAM1540 host target genes. The mRNA of each one of this plurality of VGAM1540 host target genes comprises one or more host target binding sites, each having a nucleotide sequence which is at least partly complementary to VGAM1540 RNA, herein designated VGAM RNA, and which when bound by VGAM1540 RNA causes inhibition of translation of respective one or more VGAM1540 host target proteins.

It is further appreciated by one skilled in the art that the mode of translational inhibition illustrated by FIG. 1 with specific reference to translational inhibition exerted by VGAM1540 gene, herein designated VGAM GENE, on one or more VGAM1540 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1540 is inhibition of expression of host target genes, as part of a novel viral mechanism of attacking a host. Accordingly, utilities of VGAM1540 include diagnosis, prevention and treatment of viral infection by Monkeypox Virus. Specific functions, and accordingly utilities, of VGAM1540 correlate with, and may be deduced from, the identity of the host target genes which VGAM1540 binds and inhibits, and the function of these host target genes, as elaborated hereinbelow.

Nucleotide sequences of the VGAM1540 precursor RNA, herein designated VGAM PRECURSOR RNA, and of the 'diced' VGAM1540 RNA, herein designated VGAM RNA, and a schematic representation of the secondary folding of VGAM1540 folded precursor RNA, herein designated VGAM FOLDED PRECURSOR RNA, of VGAM1540 are further described hereinbelow with reference to Table 1.

Nucleotide sequences of host target binding sites, such as BINDING SITE-I, BINDING SITE-II and BINDING SITE-III of FIG. 1, found on VGAM1540 host target RNA, and schematic representation of the complementarity of each of these host target binding sites to VGAM1540 RNA, herein designated VGAM RNA, are described hereinbelow with reference to Table 2.

As mentioned hereinabove with reference to FIG. 1, a function of VGAM1540 gene, herein designated VGAM is inhibition of expression of VGAM1540 target genes. It is appreciated that specific functions, and accordingly utilities, of VGAM1540 correlate with, and may be deduced from, the identity of the target genes which VGAM1540 binds and inhibits, and the function of these target genes, as elaborated hereinbelow.

Apical Protein-like (Xenopus laevis) (APXL, Accession NM_001649) is a VGAM1540 host target gene. APXL BINDING SITE is HOST TARGET binding site found in the 3' untranslated region of mRNA encoded by APXL, corresponding to a HOST TARGET binding site such as BINDING SITE I, BINDING SITE II or BINDING SITE III. Table 2 illustrates the complementarity of the nucleotide sequences of APXL BINDING SITE, designated SEQ ID:7352, to the nucleotide sequence of VGAM1540 RNA, herein designated VGAM RNA, also designated SEQ ID:4251.

A function of VGAM1540 is therefore inhibition of Apical Protein-like (Xenopus laevis) (APXL, Accession NM_001649), a gene which is implicated in amiloride-sensitive sodium channel activity. Accordingly, utilities of VGAM1540 include diagnosis, prevention and treatment of diseases and clinical conditions associated with APXL. The function of APXL and its association with various diseases and clinical conditions, has been established by previous studies, as described hereinabove with reference to VGAM152. Cockayne Syndrome 1 (classical) (CKN1, Accession NM_000082) is another VGAM1540 host target gene. CKN1 BINDING SITE is HOST TARGET binding site found in the 3' untranslated region of mRNA encoded by CKN1, corresponding to a HOST TARGET binding site such as BINDING SITE I, BINDING SITE II or BINDING SITE III. Table 2 illustrates the complementarity of the nucleotide sequences of CKN1 BINDING SITE, designated SEQ ID:5529, to the nucleotide sequence of VGAM1540 RNA, herein designated VGAM RNA, also designated SEQ ID:4251.

Another function of VGAM1540 is therefore inhibition of Cockayne Syndrome 1 (classical) (CKN1, Accession NM_000082). Accordingly, utilities of VGAM1540 include diagnosis, prevention and treatment of diseases and clinical conditions associated with CKN1. High Mobility Group AT-hook 2 (HMGA2, Accession NM_003483) is another VGAM1540 host target gene. HMGA2 BINDING SITE is HOST TARGET binding site found in the 3' untranslated region of mRNA encoded by HMGA2, corresponding to a HOST TARGET binding site such as BINDING SITE I, BINDING SITE II or BINDING SITE III. Table 2 illustrates the complementarity of the nucleotide sequences of HMGA2 BINDING SITE, designated SEQ ID:9561, to the nucleotide sequence of VGAM1540 RNA, herein designated VGAM RNA, also designated SEQ ID:4251.

Another function of VGAM1540 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM1540 include diagnosis, prevention and treatment of diseases and clinical conditions associated with HMGA2. The function of HMGA2 and its association with various diseases and clinical conditions, has been established by previous studies, as described hereinabove with reference to VGAM552. Zinc Finger Protein 36 (KOX 18) (ZNF36, Accession XM_168302) is another VGAM1540 host target gene. ZNF36 BINDING SITE is HOST TARGET binding site found in the 3' untranslated region of mRNA encoded by ZNF36, corresponding to a HOST TARGET binding site such as BINDING SITE I, BINDING SITE II or BINDING SITE III. Table 2 illustrates the complementarity of the nucleotide sequences of ZNF36 BINDING SITE, designated SEQ ID:45101, to the nucleotide sequence of VGAM1540 RNA, herein designated VGAM RNA, also designated SEQ ID:4251.

Another function of VGAM1540 is therefore inhibition of Zinc Finger Protein 36 (KOX 18) (ZNF36, Accession XM_168302), a gene which may be involved in transcriptional regulation. Accordingly, utilities of VGAM1540 include diagnosis, prevention and treatment of diseases and clinical conditions associated with ZNF36. The function of ZNF36 and its association with various diseases and clinical conditions, has been established by previous studies, as described hereinabove with reference to VGAM804. FLJ23191 (Accession NM_024574) is another VGAM1540 host target gene. FLJ23191 BINDING SITE is HOST TARGET binding site found in the 3' untranslated region of mRNA encoded by FLJ23191, corresponding to a HOST TARGET binding site such as BINDING SITE I, BINDING SITE II or BINDING SITE III. Table 2 illustrates the complementarity of the nucleotide sequences of FLJ23191 BINDING SITE, designated SEQ ID:23803, to the nucleotide sequence of VGAM1540 RNA, herein designated VGAM RNA, also designated SEQ ID:4251.

Another function of VGAM1540 is therefore inhibition of FLJ23191 (Accession NM_024574). Accordingly, utilities of VGAM1540 include diagnosis, prevention and treatment of diseases and clinical conditions associated with FLJ23191. KIAA0841 (Accession XM_049237) is another VGAM1540 host target gene. KIAA0841 BINDING SITE is HOST TARGET binding site found in the 3' untranslated region of mRNA encoded by KIAA0841, corresponding to a HOST TARGET binding site such as BINDING SITE I, BINDING SITE II or BINDING SITE III. Table 2 illustrates the complementarity of the nucleotide sequences of KIAA0841 BINDING SITE, designated SEQ ID:35359, to the nucleotide sequence of VGAM1540 RNA, herein designated VGAM RNA, also designated SEQ ID:4251.

Another function of VGAM1540 is therefore inhibition of KIAA0841 (Accession XM_049237). Accordingly, utilities of VGAM1540 include diagnosis, prevention and treatment of diseases and clinical conditions associated with KIAA0841. Ring Finger Protein 20 (RNF20, Accession NM_019592) is another VGAM1540 host target gene. RNF20 BINDING SITE is HOST TARGET binding site found in the 3' untranslated region of mRNA encoded by RNF20, corresponding to a HOST TARGET binding site such as BINDING SITE I, BINDING SITE II or BINDING SITE III. Table 2 illustrates the complementarity of the nucleotide sequences of RNF20 BINDING SITE, designated SEQ ID:21213, to the nucleotide sequence of VGAM1540 RNA, herein designated VGAM RNA, also designated SEQ ID:4251.

Another function of VGAM1540 is therefore inhibition of Ring Finger Protein 20 (RNF20, Accession NM_019592). Accordingly, utilities of VGAM1540 include diagnosis, prevention and treatment of diseases and clinical conditions associated with RNF20. LOC118851 (Accession XM_061180) is another VGAM1540 host target gene. LOC118851 BINDING SITE is HOST TARGET binding site found in the 3' untranslated region of mRNA encoded by LOC118851, corresponding to a HOST TARGET binding site such as BINDING SITE I, BINDING SITE II or BINDING SITE III. Table 2 illustrates the complementarity of the nucleotide sequences of LOC118851 BINDING SITE, designated SEQ ID:37199, to the nucleotide sequence of VGAM1540 RNA, herein designated VGAM RNA, also designated SEQ ID:4251.

Another function of VGAM1540 is therefore inhibition of LOC118851 (Accession XM_061180). Accordingly, utilities of VGAM1540 include diagnosis, prevention and treatment of diseases and clinical conditions associated with LOC118851. LOC150005 (Accession XM_097795) is another VGAM1540 host target gene. LOC150005 BINDING SITE is HOST TARGET binding site found in the 3' untranslated region of mRNA encoded by LOC150005, corresponding to a HOST TARGET binding site such as BINDING SITE I, BINDING SITE II or BINDING SITE III. Table 2 illustrates the complementarity of the nucleotide sequences of LOC150005 BINDING SITE, designated SEQ ID:41122, to the nucleotide sequence of VGAM1540 RNA, herein designated VGAM RNA, also designated SEQ ID:4251.

Another function of VGAM1540 is therefore inhibition of LOC150005 (Accession XM_097795). Accordingly, utilities of VGAM1540 include diagnosis, prevention and treatment of diseases and clinical conditions associated with LOC150005. FIG. 1 further provides a conceptual description of a novel bioinformatically detected viral gene of the present invention, referred to here as Viral Genomic Address Messenger 1541 (VGAM1541) viral gene, which modulates expression of respective host target genes thereof, the function and utility of which host target genes is known in the art.

VGAM1541 is a novel bioinformatically detected regulatory, non protein coding, viral micro RNA (miRNA) gene. The method by which VGAM1541 was detected is described hereinabove with reference to FIGS. 1-8.

VGAM1541 gene, herein designated VGAM GENE, is a viral gene contained in the genome of Monkeypox Virus. VGAM1541 host target gene, herein designated VGAM HOST TARGET GENE, is a human gene contained in the human genome.

VGAM1541 gene encodes a VGAM1541 precursor RNA, herein designated VGAM PRECURSOR RNA. Similar to other miRNA genes, and unlike most ordinary genes, VGAM1541 precursor RNA does not encode a protein. A nucleotide sequence identical or highly similar to the nucleotide sequence of VGAM1541 precursor RNA is designated SEQ ID:1527, and is provided hereinbelow with reference to the sequence listing part. Nucleotide sequence SEQ ID:1527 is located at position 63264 relative to the genome of Monkeypox Virus.

VGAM1541 precursor RNA folds onto itself, forming VGAM1541 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1541 folded precursor RNA into VGAM1541 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1541 RNA is designated SEQ ID:4252, and is provided hereinbelow with reference to the sequence listing part.

VGAM1541 host target gene, herein designated VGAM HOST TARGET GENE, encodes a corresponding messenger RNA, VGAM1541 host target RNA, herein designated VGAM HOST TARGET RNA. VGAM1541 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1541 RNA, herein designated VGAM RNA, binds complementarily to one or more host target binding sites located in untranslated regions of VGAM1541 host target RNA, herein designated VGAM HOST TARGET RNA. This complementary binding is due to the fact that the nucleotide sequence of VGAM1541 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1541 RNA, herein designated VGAM RNA, may have a different number of host target binding sites in untranslated regions of a VGAM1541 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1541 RNA, herein designated VGAM RNA, to host target binding sites on VGAM1541 host target RNA, herein designated VGAM HOST TARGET RNA, such as BINDING SITE I, BINDING SITE II and BINDING SITE III, inhibits translation of VGAM1541 host target RNA into VGAM1541 host target protein, herein designated VGAM HOST TARGET PROTEIN. VGAM host target protein is therefore outlined by a broken line.

It is appreciated that VGAM1541 host target gene, herein designated VGAM HOST TARGET GENE, in fact represents a plurality of VGAM1541 host target genes. The mRNA of each one of this plurality of VGAM1541 host target genes comprises one or more host target binding sites, each having a nucleotide sequence which is at least partly complementary to VGAM1541 RNA, herein designated VGAM RNA, and which when bound by VGAM1541 RNA causes inhibition of translation of respective one or more VGAM1541 host target proteins.

It is further appreciated by one skilled in the art that the mode of translational inhibition illustrated by FIG. 1 with specific reference to translational inhibition exerted by VGAM1541 gene, herein designated VGAM GENE, on one or more VGAM1541 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1541 is inhibition of expression of host target genes, as part of a novel viral mechanism of attacking a host. Accordingly, utilities of VGAM1541 include diagnosis, prevention and treatment of viral infection by Monkeypox Virus. Specific functions, and accordingly utilities, of VGAM1541 correlate with, and may be deduced from, the identity of the host target genes which VGAM1541 binds and inhibits, and the function of these host target genes, as elaborated hereinbelow.

Nucleotide sequences of the VGAM1541 precursor RNA, herein designated VGAM PRECURSOR RNA, and of the 'diced' VGAM1541 RNA, herein designated VGAM RNA, and a schematic representation of the secondary folding of VGAM1541 folded precursor RNA, herein designated VGAM FOLDED PRECURSOR RNA, of VGAM1541 are further described hereinbelow with reference to Table 1.

Nucleotide sequences of host target binding sites, such as BINDING SITE-I, BINDING SITE-II and BINDING SITE-III of FIG. 1, found on VGAM1541 host target RNA, and schematic representation of the complementarity of each of these host target binding sites to VGAM1541 RNA, herein designated VGAM RNA, are described hereinbelow with reference to Table 2.

As mentioned hereinabove with reference to FIG. 1, a function of VGAM1541 gene, herein designated VGAM is inhibition of expression of VGAM1541 target genes. It is appreciated that specific functions, and accordingly utilities, of VGAM1541 correlate with, and may be deduced from, the identity of the target genes which VGAM1541 binds and inhibits, and the function of these target genes, as elaborated hereinbelow.

ATP-binding Cassette, Sub-family B (MDR/TAP), Member 10 (ABCB10, Accession NM_012089) is a VGAM1541 host target gene. ABCB10 BINDING SITE is HOST TARGET binding site found in the 3' untranslated region of mRNA encoded by ABCB10, corresponding to a HOST TARGET binding site such as BINDING SITE I, BINDING SITE II or BINDING SITE III. Table 2 illustrates the complementarity of the nucleotide sequences of ABCB10 BINDING SITE, designated SEQ ID:14374, to the nucleotide sequence of VGAM1541 RNA, herein designated VGAM RNA, also designated SEQ ID:4252.

A function of VGAM1541 is therefore inhibition of ATP-binding Cassette, Sub-family B (MDR/TAP), Member 10 (ABCB10, Accession NM_012089), a gene which a member of the superfamily of ATP-binding cassette (ABC) transporters. Accordingly, utilities of VGAM1541 include diagnosis, prevention and treatment of diseases and clinical conditions associated with ABCB10. The function of ABCB10 and its association with various diseases and clinical conditions, has been established by previous studies, as described hereinabove with reference to VGAM1523. Adducin 1 (alpha) (ADD1, Accession NM_014190) is another VGAM1541 host target gene. ADD1 BINDING SITE1 and ADD1 BINDING SITE2 are HOST TARGET binding sites found in untranslated regions of mRNA encoded by ADD1, corresponding to HOST TARGET binding sites such as BINDING SITE I, BINDING SITE II or BINDING SITE III. Table 2 illustrates the complementarity of the nucleotide sequences of ADD1 BINDING SITE1 and ADD1 BINDING SITE2, designated SEQ ID:15474 and SEQ ID:15470 respectively, to the nucleotide sequence of VGAM1541 RNA, herein designated VGAM RNA, also designated SEQ ID:4252.

Another function of VGAM1541 is therefore inhibition of Adducin 1 (alpha) (ADD1, Accession NM_014190), a gene which membrane-cytoskeleton- protein that promotes the assembly of the spectrin-actin network. Accordingly, utilities of VGAM1541 include diagnosis, prevention and treatment of diseases and clinical conditions associated with ADD1. The function of ADD1 and its association with various diseases and clinical conditions, has been established by previous studies, as described hereinabove with reference to VGAM474. Chemokine (C-C motif) Receptor 9 (CCR9, Accession NM_006641) is another VGAM1541 host target gene. CCR9 BINDING SITE1 and CCR9 BINDING SITE2 are HOST TARGET binding sites found in untranslated regions of mRNA encoded by CCR9, corresponding to HOST TARGET binding sites such as BINDING SITE I, BINDING SITE II or BINDING SITE III. Table 2 illustrates the complementarity of the nucleotide sequences of CCR9 BINDING SITE1 and CCR9 BINDING SITE2, designated SEQ ID:13432 and SEQ ID:22412 respectively, to the nucleotide sequence of VGAM1541 RNA, herein designated VGAM RNA, also designated SEQ ID:4252.

Another function of VGAM1541 is therefore inhibition of Chemokine (C-C motif) Receptor 9 (CCR9, Accession NM_006641), a gene which binds beta-chemokine family and subsequently transduces a signal by increasing the intracellular calcium ions level. Accordingly, utilities of VGAM1541 include diagnosis, prevention and treatment of diseases and clinical conditions associated with CCR9. The function of CCR9 and its association with various diseases and clinical conditions, has been established by previous studies, as described hereinabove with reference to VGAM1324. CGTHBA (Accession NM_012075) is another VGAM1541 host target gene. CGTHBA BINDING SITE is HOST TARGET binding site found in the 3' untranslated region of mRNA encoded by CGTHBA, corresponding to a HOST TARGET binding site such as BINDING SITE I, BINDING SITE II or BINDING SITE III. Table 2 illustrates the complementarity of the nucleotide sequences of CGTHBA BINDING SITE, designated SEQ ID:14364, to the nucleotide sequence of VGAM1541 RNA, herein designated VGAM RNA, also designated SEQ ID:4252.

Another function of VGAM1541 is therefore inhibition of CGTHBA (Accession NM_012075). Accordingly, utilities of VGAM1541 include diagnosis, prevention and treatment of diseases and clinical conditions associated with CGTHBA. Eukaryotic Translation Initiation Factor 1A (EIF1A, Accession XM_114147) is another VGAM1541 host target gene. EIF1A BINDING SITE is HOST TARGET binding site found in the 3' untranslated region of mRNA encoded by EIF1A, corresponding to a HOST TARGET binding site such as BINDING SITE I, BINDING SITE II or BINDING SITE III. Table 2 illustrates the complementarity of the nucleotide sequences of EIF1A BINDING SITE, designated SEQ ID:42721, to the nucleotide sequence of VGAM1541 RNA, herein designated VGAM RNA, also designated SEQ ID:4252.

Another function of VGAM1541 is therefore inhibition of Eukaryotic Translation Initiation Factor 1A (EIF1A, Accession XM_114147), a gene which seems to be required for maximal rate of protein biosynthesis. Accordingly, utilities of VGAM1541 include diagnosis, prevention and treatment of diseases and clinical conditions associated with EIF1A. The function of EIF1A and its association with various diseases and clinical conditions, has been established by previous studies, as described hereinabove with reference to VGAM120. Exostoses (multiple)-like 3 (EXTL3, Accession NM_001440) is another VGAM1541 host target gene.

EXTL3 BINDING SITE is HOST TARGET binding site found in the 3' untranslated region of mRNA encoded by EXTL3, corresponding to a HOST TARGET binding site such as BINDING SITE I, BINDING SITE II or BINDING SITE III. Table 2 illustrates the complementarity of the nucleotide sequences of EXTL3 BINDING SITE, designated SEQ ID:7171, to the nucleotide sequence of VGAM1541 RNA, herein designated VGAM RNA, also designated SEQ ID:4252.

Another function of VGAM1541 is therefore inhibition of Exostoses (multiple)-like 3 (EXTL3, Accession NM_001440), a gene which a member of the multiple exostoses gene family. Accordingly, utilities of VGAM1541 include diagnosis, prevention and treatment of diseases and clinical conditions associated with EXTL3. The function of EXTL3 and its association with various diseases and clinical conditions, has been established by previous studies, as described hereinabove with reference to VGAM95. Growth Hormone Receptor (GHR, Accession NM_000163) is another VGAM1541 host target gene. GHR BINDING SITE is HOST TARGET binding site found in the 3' untranslated region of mRNA encoded by GHR, corresponding to a HOST TARGET binding site such as BINDING SITE I, BINDING SITE II or BINDING SITE III. Table 2 illustrates the complementarity of the nucleotide sequences of GHR BINDING SITE, designated SEQ ID:5671, to the nucleotide sequence of VGAM1541 RNA, herein designated VGAM RNA, also designated SEQ ID:4252.

Another function of VGAM1541 is therefore inhibition of Growth Hormone Receptor (GHR, Accession NM_000163). Accordingly, utilities of VGAM1541 include diagnosis, prevention and treatment of diseases and clinical conditions associated with GHR. Heparan Sulfate 2-O-sulfotransferase 1 (HS2ST1, Accession NM_012262) is another VGAM1541 host target gene. HS2ST1 BINDING SITE is HOST TARGET binding site found in the 3' untranslated region of mRNA encoded by HS2ST1, corresponding to a HOST TARGET binding site such as BINDING SITE I, BINDING SITE II or BINDING SITE III. Table 2 illustrates the complementarity of the nucleotide sequences of HS2ST1 BINDING SITE, designated SEQ ID:14576, to the nucleotide sequence of VGAM1541 RNA, herein designated VGAM RNA, also designated SEQ ID:4252.

Another function of VGAM1541 is therefore inhibition of Heparan Sulfate 2-O-sulfotransferase 1 (HS2ST1, Accession NM_012262). Accordingly, utilities of VGAM1541 include diagnosis, prevention and treatment of diseases and clinical conditions associated with HS2ST1. Nucleobindin 1 (NUCB1, Accession NM_006184) is another VGAM1541 host target gene. NUCB1 BINDING SITE is HOST TARGET binding site found in the 3' untranslated region of mRNA encoded by NUCB1, corresponding to a HOST TARGET binding site such as BINDING SITE I, BINDING SITE II or BINDING SITE III. Table 2 illustrates the complementarity of the nucleotide sequences of NUCB1 BINDING SITE, designated SEQ ID:12851, to the nucleotide sequence of VGAM1541 RNA, herein designated VGAM RNA, also designated SEQ ID:4252.

Another function of VGAM1541 is therefore inhibition of Nucleobindin 1 (NUCB1, Accession NM_006184), a gene which may have a role in calcium homeostasis. Accordingly, utilities of VGAM1541 include diagnosis, prevention and treatment of diseases and clinical conditions associated with NUCB1. The function of NUCB1 and its association with various diseases and clinical conditions, has been established by previous studies, as described hereinabove with reference to VGAM1523. CDC42 Binding Protein Kinase Beta (DMPK-like) (CDC42BPB, Accession NM_006035) is another VGAM1541 host target gene. CDC42BPB BINDING SITE is HOST TARGET binding site found in the 3' untranslated region of mRNA encoded by CDC42BPB, corresponding to a HOST TARGET binding site such as BINDING SITE I, BINDING SITE II or BINDING SITE III. Table 2 illustrates the complementarity of the nucleotide sequences of CDC42BPB BINDING SITE, designated SEQ ID:12658, to the nucleotide sequence of VGAM1541 RNA, herein designated VGAM RNA, also designated SEQ ID:4252.

Another function of VGAM1541 is therefore inhibition of CDC42 Binding Protein Kinase Beta (DMPK-like) (CDC42BPB, Accession NM_006035). Accordingly, utilities of VGAM1541 include diagnosis, prevention and treatment of diseases and clinical conditions associated with CDC42BPB. DKFZP566B183 (Accession NM_015509) is another VGAM1541 host target gene. DKFZP566B183 BINDING SITE is HOST TARGET binding site found in the 3' untranslated region of mRNA encoded by DKFZP566B183, corresponding to a HOST TARGET binding site such as BINDING SITE I, BINDING SITE II or BINDING SITE III. Table 2 illustrates the complementarity of the nucleotide sequences of DKFZP566B183 BINDING SITE, designated SEQ ID:17769, to the nucleotide sequence of VGAM1541 RNA, herein designated VGAM RNA, also designated SEQ ID:4252.

Another function of VGAM1541 is therefore inhibition of DKFZP566B183 (Accession NM_015509). Accordingly, utilities of VGAM1541 include diagnosis, prevention and treatment of diseases and clinical conditions associated with DKFZP566B183. DKFZP566I1024 (Accession XM_046506) is another VGAM1541 host target gene. DKFZP566I1024 BINDING SITE is HOST TARGET binding site found in the 3' untranslated region of mRNA encoded by DKFZP566I1024, corresponding to a HOST TARGET binding site such as BINDING SITE I, BINDING SITE II or BINDING SITE III. Table 2 illustrates the complementarity of the nucleotide sequences of DKFZP566I1024 BINDING SITE, designated SEQ ID:34735, to the nucleotide sequence of VGAM1541 RNA, herein designated VGAM RNA, also designated SEQ ID:4252.

Another function of VGAM1541 is therefore inhibition of DKFZP566I1024 (Accession XM_046506). Accordingly, utilities of VGAM1541 include diagnosis, prevention and treatment of diseases and clinical conditions associated with DKFZP566I1024. DKFZp761B0514 (Accession NM_032289) is another VGAM1541 host target gene. DKFZp761B0514 BINDING SITE is HOST TARGET binding site found in the 3' untranslated region of mRNA encoded by DKFZp761B0514, corresponding to a HOST TARGET binding site such as BINDING SITE I, BINDING SITE II or BINDING SITE III. Table 2 illustrates the complementarity of the nucleotide sequences of DKFZp761B0514 BINDING SITE, designated SEQ ID:26053, to the nucleotide sequence of VGAM1541 RNA, herein designated VGAM RNA, also designated SEQ ID:4252.

Another function of VGAM1541 is therefore inhibition of DKFZp761B0514 (Accession NM_032289). Accordingly, utilities of VGAM1541 include diagnosis, prevention and treatment of diseases and clinical conditions associated with DKFZp761B0514. FLJ13305 (Accession XM_117270) is another VGAM1541 host target gene. FLJ13305 BINDING SITE is HOST TARGET binding site found in the 5' untranslated region of mRNA encoded by FLJ13305, corresponding to a HOST TARGET binding site such as BINDING SITE I, BINDING SITE II or BINDING SITE III. Table 2 illustrates the complementarity of the nucleotide sequences of FLJ13305 BINDING SITE, designated SEQ ID:43345, to the nucleotide sequence of VGAM1541 RNA, herein designated VGAM RNA, also designated SEQ ID:4252.

Another function of VGAM1541 is therefore inhibition of FLJ13305 (Accession XM_117270). Accordingly, utilities of VGAM1541 include diagnosis, prevention and treatment of diseases and clinical conditions associated with FLJ13305. KIAA0265 (Accession XM_045954) is another VGAM1541 host target gene. KIAA0265 BINDING SITE is HOST TARGET binding site found in the 3' untranslated region of mRNA encoded by KIAA0265, corresponding to a HOST TARGET binding site such as BINDING SITE I, BINDING SITE II or BINDING SITE III. Table 2 illustrates the complementarity of the nucleotide sequences of KIAA0265 BINDING SITE, designated SEQ ID:34620, to the nucleotide sequence of VGAM1541 RNA, herein designated VGAM RNA, also designated SEQ ID:4252.

Another function of VGAM1541 is therefore inhibition of KIAA0265 (Accession XM_045954). Accordingly, utilities of VGAM1541 include diagnosis, prevention and treatment of diseases and clinical conditions associated with KIAA0265. KIAA1117 (Accession XM_028219) is another VGAM1541 host target gene. KIAA1117 BINDING SITE is HOST TARGET binding site found in the 3' untranslated region of mRNA encoded by KIAA1117, corresponding to a HOST TARGET binding site such as BINDING SITE I, BINDING SITE II or BINDING SITE III. Table 2 illustrates the complementarity of the nucleotide sequences of KIAA1117 BINDING SITE, designated SEQ ID:30632, to the nucleotide sequence of VGAM1541 RNA, herein designated VGAM RNA, also designated SEQ ID:4252.

Another function of VGAM1541 is therefore inhibition of KIAA1117 (Accession XM_028219). Accordingly, utilities of VGAM1541 include diagnosis, prevention and treatment of diseases and clinical conditions associated with KIAA1117. KIAA1319 (Accession NM_020770) is another VGAM1541 host target gene. KIAA1319 BINDING SITE is HOST TARGET binding site found in the 3' untranslated region of mRNA encoded by KIAA1319, corresponding to a HOST TARGET binding site such as BINDING SITE I, BINDING SITE II or BINDING SITE III. Table 2 illustrates the complementarity of the nucleotide sequences of KIAA1319 BINDING SITE, designated SEQ ID:21870, to the nucleotide sequence of VGAM1541 RNA, herein designated VGAM RNA, also designated SEQ ID:4252.

Another function of VGAM1541 is therefore inhibition of KIAA1319 (Accession NM_020770). Accordingly, utilities of VGAM1541 include diagnosis, prevention and treatment of diseases and clinical conditions associated with KIAA1319. Nudix (nucleoside diphosphate linked moiety X)-type Motif 13 (NUDT13, Accession XM_032512) is another VGAM1541 host target gene. NUDT13 BINDING SITE is HOST TARGET binding site found in the 3' untranslated region of mRNA encoded by NUDT13, corresponding to a HOST TARGET binding site such as BINDING SITE I, BINDING SITE II or BINDING SITE III. Table 2 illustrates the complementarity of the nucleotide sequences of NUDT13 BINDING SITE, designated SEQ ID:31664, to the nucleotide sequence of VGAM1541 RNA, herein designated VGAM RNA, also designated SEQ ID:4252.

Another function of VGAM1541 is therefore inhibition of Nudix (nucleoside diphosphate linked moiety X)-type Motif 13 (NUDT13, Accession XM_032512). Accordingly, utilities of VGAM1541 include diagnosis, prevention and treatment of diseases and clinical conditions associated with NUDT13. SSH2 (Accession XM_030846) is another VGAM1541 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31176, to the nucleotide sequence of VGAM1541 RNA, herein designated VGAM RNA, also designated SEQ ID:4252.

Another function of VGAM1541 is therefore inhibition of SSH2 (Accession XM_030846). Accordingly, utilities of VGAM1541 include diagnosis, prevention and treatment of diseases and clinical conditions associated with SSH2. Signal Sequence Receptor, Alpha (translocon-associated protein alpha) (SSR1, Accession NM_003144) is another VGAM1541 host target gene. SSR1 BINDING SITE is HOST TARGET binding site found in the 3' untranslated region of mRNA encoded by SSR1, corresponding to a HOST TARGET binding site such as BINDING SITE I, BINDING SITE II or BINDING SITE III. Table 2 illustrates the complementarity of the nucleotide sequences of SSR1 BINDING SITE, designated SEQ ID:9113, to the nucleotide sequence of VGAM1541 RNA, herein designated VGAM RNA, also designated SEQ ID:4252.

Another function of VGAM1541 is therefore inhibition of Signal Sequence Receptor, Alpha (translocon-associated protein alpha) (SSR1, Accession NM_003144). Accordingly, utilities of VGAM1541 include diagnosis, prevention and treatment of diseases and clinical conditions associated with SSR1. TAF9-like RNA Polymerase II, TATA Box Binding Protein (TBP)-associated Factor, 31 kDa (TAF9L, Accession NM_015975) is another VGAM1541 host target gene. TAF9L BINDING SITE is HOST TARGET binding site found in the 3' untranslated region of mRNA encoded by TAF9L, corresponding to a HOST TARGET binding site such as BINDING SITE I, BINDING SITE II or BINDING SITE III. Table 2 illustrates the complementarity of the nucleotide sequences of TAF9L BINDING SITE, designated SEQ ID:18072, to the nucleotide sequence of VGAM1541 RNA, herein designated VGAM RNA, also designated SEQ ID:4252.

Another function of VGAM1541 is therefore inhibition of TAF9-like RNA Polymerase II, TATA Box Binding Protein (TBP)-associated Factor, 31 kDa (TAF9L, Accession NM_015975). Accordingly, utilities of VGAM1541 include diagnosis, prevention and treatment of diseases and clinical conditions associated with TAF9L. LOC115294 (Accession XM_054302) is another VGAM1541 host target gene. LOC115294 BINDING SITE is HOST TARGET binding site found in the 3' untranslated region of mRNA encoded by LOC115294, corresponding to a HOST TARGET binding site such as BINDING SITE I, BINDING SITE II or BINDING SITE III. Table 2 illustrates the complementarity of the nucleotide sequences of LOC115294 BINDING SITE, designated SEQ ID:36145, to the nucleotide sequence of VGAM1541 RNA, herein designated VGAM RNA, also designated SEQ ID:4252.

Another function of VGAM1541 is therefore inhibition of LOC115294 (Accession XM_054302). Accordingly, utilities of VGAM1541 include diagnosis, prevention and treatment of diseases and clinical conditions associated with LOC115294. LOC150271 (Accession XM_097859) is another VGAM1541 host target gene. LOC150271 BINDING SITE is HOST TARGET binding site found in the 5' untranslated region of mRNA encoded by LOC150271, corresponding to a HOST TARGET binding site such as BINDING SITE I, BINDING SITE II or BINDING SITE III. Table 2 illustrates the complementarity of the nucleotide sequences of LOC150271 BINDING SITE, designated SEQ ID:41166, to the nucleotide sequence of VGAM1541 RNA, herein designated VGAM RNA, also designated SEQ ID:4252.

Another function of VGAM1541 is therefore inhibition of LOC150271 (Accession XM_097859). Accordingly, utilities of VGAM1541 include diagnosis, prevention and treatment of diseases and clinical conditions associated with LOC150271. LOC151877 (Accession XM_098132) is another VGAM1541 host target gene. LOC151877 BINDING SITE is HOST TARGET binding site found in the 3' untranslated region of mRNA encoded by LOC151877, corresponding to a HOST TARGET binding site such as BINDING SITE I, BINDING SITE II or BINDING SITE III. Table 2 illustrates the complementarity of the nucleotide sequences of LOC151877 BINDING SITE, designated SEQ ID:41398, to the nucleotide sequence of VGAM1541 RNA, herein designated VGAM RNA, also designated SEQ ID:4252.

Another function of VGAM1541 is therefore inhibition of LOC151877 (Accession XM_098132). Accordingly, utilities of VGAM1541 include diagnosis, prevention and treatment of diseases and clinical conditions associated with LOC151877. LOC152300 (Accession XM_087432) is another VGAM1541 host target gene. LOC152300 BINDING SITE is HOST TARGET binding site found in the 5' untranslated region of mRNA encoded by LOC152300, corresponding to a HOST TARGET binding site such as BINDING SITE I, BINDING SITE II or BINDING SITE III. Table 2 illustrates the complementarity of the nucleotide sequences of LOC152300 BINDING SITE, designated SEQ ID:39248, to the nucleotide sequence of VGAM1541 RNA, herein designated VGAM RNA, also designated SEQ ID:4252.

Another function of VGAM1541 is therefore inhibition of LOC152300 (Accession XM_087432). Accordingly, utilities of VGAM1541 include diagnosis, prevention and treatment of diseases and clinical conditions associated with LOC152300. LOC154084 (Accession XM_098468) is another VGAM1541 host target gene. LOC154084 BINDING SITE is HOST TARGET binding site found in the 5' untranslated region of mRNA encoded by LOC154084, corresponding to a HOST TARGET binding site such as BINDING SITE I, BINDING SITE II or BINDING SITE III. Table 2 illustrates the complementarity of the nucleotide sequences of LOC154084 BINDING SITE, designated SEQ ID:41685, to the nucleotide sequence of VGAM1541 RNA, herein designated VGAM RNA, also designated SEQ ID:4252.

Another function of VGAM1541 is therefore inhibition of LOC154084 (Accession XM_098468). Accordingly, utilities of VGAM1541 include diagnosis, prevention and treatment of diseases and clinical conditions associated with LOC154084. LOC158402 (Accession XM_098936) is another VGAM1541 host target gene. LOC158402 BINDING SITE is HOST TARGET binding site found in the 5' untranslated region of mRNA encoded by LOC158402, corresponding to a HOST TARGET binding site such as BINDING SITE I, BINDING SITE II or BINDING SITE III. Table 2 illustrates the complementarity of the nucleotide sequences of LOC158402 BINDING SITE, designated SEQ ID:41976, to the nucleotide sequence of VGAM1541 RNA, herein designated VGAM RNA, also designated SEQ ID:4252.

Another function of VGAM1541 is therefore inhibition of LOC158402 (Accession XM_098936). Accordingly, utilities of VGAM1541 include diagnosis, prevention and treatment of diseases and clinical conditions associated with LOC158402. LOC162333 (Accession XM_102591) is another VGAM1541 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42124, to the nucleotide sequence of VGAM1541 RNA, herein designated VGAM RNA, also designated SEQ ID:4252.

Another function of VGAM1541 is therefore inhibition of LOC162333 (Accession XM_102591). Accordingly, utilities of VGAM1541 include diagnosis, prevention and treatment of diseases and clinical conditions associated with LOC162333. FIG. 1 further provides a conceptual description of a novel bioinformatically detected viral gene of the present invention, referred to here as Viral Genomic Address Messenger 1542 (VGAM1542) viral gene, which modulates expression of respective host target genes thereof, the function and utility of which host target genes is known in the art.

VGAM1542 is a novel bioinformatically detected regulatory, non protein coding, viral micro RNA (miRNA) gene. The method by which VGAM1542 was detected is described hereinabove with reference to FIGS. 1-8.

VGAM1542 gene, herein designated VGAM GENE, is a viral gene contained in the genome of Variola Virus. VGAM1542 host target gene, herein designated VGAM HOST TARGET GENE, is a human gene contained in the human genome.

VGAM1542 gene encodes a VGAM1542 precursor RNA, herein designated VGAM PRECURSOR RNA. Similar to other miRNA genes, and unlike most ordinary genes, VGAM1542 precursor RNA does not encode a protein. A nucleotide sequence identical or highly similar to the nucleotide sequence of VGAM1542 precursor RNA is designated SEQ ID:1528, and is provided hereinbelow with reference to the sequence listing part. Nucleotide sequence SEQ ID:1528 is located at position 56199 relative to the genome of Variola Virus.

VGAM1542 precursor RNA folds onto itself, forming VGAM1542 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1542 folded precursor RNA into VGAM1542 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1542 RNA is designated SEQ ID:4253, and is provided hereinbelow with reference to the sequence listing part.

VGAM1542 host target gene, herein designated VGAM HOST TARGET GENE, encodes a corresponding messenger RNA, VGAM1542 host target RNA, herein designated VGAM HOST TARGET RNA. VGAM1542 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1542 RNA, herein designated VGAM RNA, binds complementarily to one or more host target binding sites located in untranslated regions of VGAM1542 host target RNA, herein designated VGAM HOST TARGET RNA. This complementary binding is due to the fact that the nucleotide sequence of VGAM1542 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1542 RNA, herein designated VGAM RNA, may have a different number of host target binding sites in untranslated regions of a VGAM1542 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1542 RNA, herein designated VGAM RNA, to host target binding sites on VGAM1542 host target RNA, herein designated VGAM HOST TARGET RNA, such as BINDING SITE I, BINDING SITE II and BINDING SITE III, inhibits translation of VGAM1542 host target RNA into VGAM1542 host target protein, herein designated VGAM HOST TARGET PROTEIN. VGAM host target protein is therefore outlined by a broken line.

It is appreciated that VGAM1542 host target gene, herein designated VGAM HOST TARGET GENE, in fact represents a plurality of VGAM1542 host target genes. The mRNA of each one of this plurality of VGAM1542 host target genes comprises one or more host target binding sites, each having a nucleotide sequence which is at least partly complementary to VGAM1542 RNA, herein designated VGAM RNA, and which when bound by VGAM1542 RNA causes inhibition of translation of respective one or more VGAM1542 host target proteins.

It is further appreciated by one skilled in the art that the mode of translational inhibition illustrated by FIG. 1 with specific reference to translational inhibition exerted by VGAM1542 gene, herein designated VGAM GENE, on one or more VGAM1542 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1542 is inhibition of expression of host target genes, as part of a novel viral mechanism of attacking a host. Accordingly, utilities of VGAM1542 include diagnosis, prevention and treatment of viral infection by Variola Virus. Specific functions, and accordingly utilities, of VGAM1542 correlate with, and may be deduced from, the identity of the host target genes which VGAM1542 binds and inhibits, and the function of these host target genes, as elaborated hereinbelow.

Nucleotide sequences of the VGAM1542 precursor RNA, herein designated VGAM PRECURSOR RNA, and of the 'diced' VGAM1542 RNA, herein designated VGAM RNA, and a schematic representation of the secondary folding of VGAM1542 folded precursor RNA, herein designated VGAM FOLDED PRECURSOR RNA, of VGAM1542 are further described hereinbelow with reference to Table 1.

Nucleotide sequences of host target binding sites, such as BINDING SITE-I, BINDING SITE-II and BINDING SITE-III of FIG. 1, found on VGAM1542 host target RNA, and schematic representation of the complementarity of each of these host target binding sites to VGAM1542 RNA, herein designated VGAM RNA, are described hereinbelow with reference to Table 2.

As mentioned hereinabove with reference to FIG. 1, a function of VGAM1542 gene, herein designated VGAM is inhibition of expression of VGAM1542 target genes. It is appreciated that specific functions, and accordingly utilities, of VGAM1542 correlate with, and may be deduced from, the identity of the target genes which VGAM1542 binds and inhibits, and the function of these target genes, as elaborated hereinbelow.

LOC147057 (Accession XM_097166) is a VGAM1542 host target gene. LOC147057 BINDING SITE is HOST TARGET binding site found in the 3' untranslated region of mRNA encoded by LOC147057, corresponding to a HOST TARGET binding site such as BINDING SITE I, BINDING SITE II or BINDING SITE III. Table 2 illustrates the complementarity of the nucleotide sequences of LOC147057 BINDING SITE, designated SEQ ID:40782, to the nucleotide sequence of VGAM1542 RNA, herein designated VGAM RNA, also designated SEQ ID:4253.

A function of VGAM1542 is therefore inhibition of LOC147057 (Accession XM_097166). Accordingly, utilities of VGAM1542 include diagnosis, prevention and treatment of diseases and clinical conditions associated with LOC147057. LOC154739 (Accession XM_098602) is another VGAM1542 host target gene. LOC154739 BINDING SITE is HOST TARGET binding site found in the 5' untranslated region of mRNA encoded by LOC154739, corresponding to a HOST TARGET binding site such as BINDING SITE I, BINDING SITE II or BINDING SITE III. Table 2 illustrates the complementarity of the nucleotide sequences of LOC154739 BINDING SITE, designated SEQ ID:41716, to the nucleotide sequence of VGAM1542 RNA, herein designated VGAM RNA, also designated SEQ ID:4253.

Another function of VGAM1542 is therefore inhibition of LOC154739 (Accession XM_098602). Accordingly, utilities of VGAM1542 include diagnosis, prevention and treatment of diseases and clinical conditions associated with LOC154739. LOC203276 (Accession XM_117523) is another VGAM1542 host target gene. LOC203276 BINDING SITE is HOST TARGET binding site found in the 3' untranslated region of mRNA encoded by LOC203276, corresponding to a HOST TARGET binding site such as BINDING SITE I, BINDING SITE II or BINDING SITE III. Table 2 illustrates the complementarity of the nucleotide sequences of LOC203276 BINDING SITE, designated SEQ ID:43483, to the nucleotide sequence of VGAM1542 RNA, herein designated VGAM RNA, also designated SEQ ID:4253.

Another function of VGAM1542 is therefore inhibition of LOC203276 (Accession XM_117523). Accordingly, utilities of VGAM1542 include diagnosis, prevention and treatment of diseases and clinical conditions associated with LOC203276. LOC203305 (Accession XM_117529) is another VGAM1542 host target gene. LOC203305 BINDING SITE is HOST TARGET binding site found in the 3' untranslated region of mRNA encoded by LOC203305, corresponding to a HOST TARGET binding site such as BINDING SITE I, BINDING SITE II or BINDING SITE III. Table 2 illustrates the complementarity of the nucleotide sequences of LOC203305 BINDING SITE, designated SEQ ID:43507, to the nucleotide sequence of VGAM1542 RNA, herein designated VGAM RNA, also designated SEQ ID:4253.

Another function of VGAM1542 is therefore inhibition of LOC203305 (Accession XM_117529). Accordingly, utilities of VGAM1542 include diagnosis, prevention and treatment of diseases and clinical conditions associated with LOC203305. LOC254243 (Accession XM_173233) is another VGAM1542 host target gene. LOC254243 BINDING SITE is HOST TARGET binding site found in the 3' untranslated region of mRNA encoded by LOC254243, corresponding to a HOST TARGET binding site such as BINDING SITE I, BINDING SITE II or BINDING SITE III. Table 2 illustrates the complementarity of the nucleotide sequences of LOC254243 BINDING SITE, designated SEQ ID:46509, to the nucleotide sequence of VGAM1542 RNA, herein designated VGAM RNA, also designated SEQ ID:4253.

Another function of VGAM1542 is therefore inhibition of LOC254243 (Accession XM_173233). Accordingly, utilities of VGAM1542 include diagnosis, prevention and treatment of diseases and clinical conditions associated with LOC254243. LOC90038 (Accession XM_028305) is another VGAM1542 host target gene. LOC90038 BINDING SITE is HOST TARGET binding site found in the 3' untranslated region of mRNA encoded by LOC90038, corresponding to a HOST TARGET binding site such as BINDING SITE I, BINDING SITE II or BINDING SITE III. Table 2 illustrates the complementarity of the nucleotide sequences of LOC90038 BINDING SITE, designated SEQ ID:30646, to the nucleotide sequence of VGAM1542 RNA, herein designated VGAM RNA, also designated SEQ ID:4253.

Another function of VGAM1542 is therefore inhibition of LOC90038 (Accession XM_028305). Accordingly, utilities of VGAM1542 include diagnosis, prevention and treatment of diseases and clinical conditions associated with LOC90038. FIG. 1 further provides a conceptual description of a novel bioinformatically detected viral gene of the present invention, referred to here as Viral Genomic Address Messenger 1543 (VGAM1543) viral gene, which modulates expression of respective host target genes thereof, the function and utility of which host target genes is known in the art.

VGAM1543 is a novel bioinformatically detected regulatory, non protein coding, viral micro RNA (miRNA) gene. The method by which VGAM1543 was detected is described hereinabove with reference to FIGS. 1-8.

VGAM1543 gene, herein designated VGAM GENE, is a viral gene contained in the genome of Vaccinia Virus. VGAM1543 host target gene, herein designated VGAM HOST TARGET GENE, is a human gene contained in the human genome.

VGAM1543 gene encodes a VGAM1543 precursor RNA, herein designated VGAM PRECURSOR RNA. Similar to other miRNA genes, and unlike most ordinary genes, VGAM1543 precursor RNA does not encode a protein. A nucleotide sequence identical or highly similar to the nucleotide sequence of VGAM1543 precursor RNA is designated SEQ ID:1529, and is provided hereinbelow with reference to the sequence listing part. Nucleotide sequence SEQ ID:1529 is located at position 66348 relative to the genome of Vaccinia Virus.

VGAM1543 precursor RNA folds onto itself, forming VGAM1543 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1543 folded precursor RNA into VGAM1543 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1543 RNA is designated SEQ ID:4254, and is provided hereinbelow with reference to the sequence listing part.

VGAM1543 host target gene, herein designated VGAM HOST TARGET GENE, encodes a corresponding messenger RNA, VGAM1543 host target RNA, herein designated VGAM HOST TARGET RNA. VGAM1543 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1543 RNA, herein designated VGAM RNA, binds complementarily to one or more host target binding sites located in untranslated regions of VGAM1543 host target RNA, herein designated VGAM HOST TARGET RNA. This complementary binding is due to the fact that the nucleotide sequence of VGAM1543 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1543 RNA, herein designated VGAM RNA, may have a different number of host target binding sites in untranslated regions of a VGAM1543 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1543 RNA, herein designated VGAM RNA, to host target binding sites on VGAM1543 host target RNA, herein designated VGAM HOST TARGET RNA, such as BINDING SITE I, BINDING SITE II and BINDING SITE III, inhibits translation of VGAM1543 host target RNA into VGAM1543 host target protein, herein designated VGAM HOST TARGET PROTEIN. VGAM host target protein is therefore outlined by a broken line.

It is appreciated that VGAM1543 host target gene, herein designated VGAM HOST TARGET GENE, in fact represents a plurality of VGAM1543 host target genes. The mRNA of each one of this plurality of VGAM1543 host target genes comprises one or more host target binding sites, each having a nucleotide sequence which is at least partly complementary to VGAM1543 RNA, herein designated VGAM RNA, and which when bound by VGAM1543 RNA causes inhibition of translation of respective one or more VGAM1543 host target proteins.

It is further appreciated by one skilled in the art that the mode of translational inhibition illustrated by FIG. 1 with specific reference to translational inhibition exerted by VGAM1543 gene, herein designated VGAM GENE, on one or more VGAM1543 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1543 is inhibition of expression of host target genes, as part of a novel viral mechanism of attacking a host. Accordingly, utilities of VGAM1543 include diagnosis, prevention and treatment of viral infection by Vaccinia Virus. Specific functions, and accordingly utilities, of VGAM1543 correlate with, and may be deduced from, the identity of the host target genes which VGAM1543 binds and inhibits, and the function of these host target genes, as elaborated hereinbelow.

Nucleotide sequences of the VGAM1543 precursor RNA, herein designated VGAM PRECURSOR RNA, and of the 'diced' VGAM1543 RNA, herein designated VGAM RNA, and a schematic representation of the secondary folding of VGAM1543 folded precursor RNA, herein designated VGAM FOLDED PRECURSOR RNA, of VGAM1543 are further described hereinbelow with reference to Table 1.

Nucleotide sequences of host target binding sites, such as BINDING SITE-I, BINDING SITE-II and BINDING SITE-III of FIG. 1, found on VGAM1543 host target RNA, and schematic representation of the complementarity of each of these host target binding sites to VGAM1543 RNA, herein designated VGAM RNA, are described hereinbelow with reference to Table 2.

As mentioned hereinabove with reference to FIG. 1, a function of VGAM1543 gene, herein designated VGAM is inhibition of expression of VGAM1543 target genes. It is appreciated that specific functions, and accordingly utilities, of VGAM1543 correlate with, and may be deduced from, the identity of the target genes which VGAM1543 binds and inhibits, and the function of these target genes, as elaborated hereinbelow.

ATP-binding Cassette, Sub-family B (MDR/TAP), Member 10 (ABCB10, Accession NM_012089) is a VGAM1543 host target gene. ABCB10 BINDING SITE is HOST TARGET binding site found in the 3' untranslated region of mRNA encoded by ABCB10, corresponding to a HOST TARGET binding site such as BINDING SITE I, BINDING SITE II or BINDING SITE III. Table 2 illustrates the complementarity of the nucleotide sequences of ABCB10 BINDING SITE, designated SEQ ID:14374, to the nucleotide sequence of VGAM1543 RNA, herein designated VGAM RNA, also designated SEQ ID:4254.

A function of VGAM1543 is therefore inhibition of ATP-binding Cassette, Sub-family B (MDR/TAP), Member 10 (ABCB10, Accession NM_012089), a gene which a member of the superfamily of ATP-binding cassette (ABC) transporters. Accordingly, utilities of VGAM1543 include diagnosis, prevention and treatment of diseases and clinical conditions associated with ABCB10. The function of ABCB10 and its association with various diseases and clinical conditions, has been established by previous studies, as described hereinabove with reference to VGAM1523. Adducin 1 (alpha) (ADD1, Accession NM_014189) is another VGAM1543 host target gene. ADD1 BINDING SITE1 and ADD1 BINDING SITE2 are HOST TARGET binding sites found in untranslated regions of mRNA encoded by ADD1, corresponding to HOST TARGET binding sites such as BINDING SITE I, BINDING SITE II or BINDING SITE III. Table 2 illustrates the complementarity of the nucleotide sequences of ADD1 BINDING SITE1 and ADD1 BINDING SITE2, designated SEQ ID:15470 and SEQ ID:15474 respectively, to the nucleotide sequence of VGAM1543 RNA, herein designated VGAM RNA, also designated SEQ ID:4254.

Another function of VGAM1543 is therefore inhibition of Adducin 1 (alpha) (ADD1, Accession NM_014189), a gene which membrane-cytoskeleton- protein that promotes the assembly of the spectrin-actin network. Accordingly, utilities of VGAM1543 include diagnosis, prevention and treatment of diseases and clinical conditions associated with ADD1. The function of ADD1 and its association with various diseases and clinical conditions, has been established by previous studies, as described hereinabove with reference to VGAM474. Chemokine (C-C motif) Receptor 9 (CCR9, Accession NM_031200) is another VGAM1543 host target gene. CCR9 BINDING SITE1 and CCR9 BINDING SITE2 are HOST TARGET binding sites found in untranslated regions of mRNA encoded by CCR9, corresponding to HOST TARGET binding sites such as BINDING SITE I, BINDING SITE II or BINDING SITE III. Table 2 illustrates the complementarity of the nucleotide sequences of CCR9 BINDING SITE1 and CCR9 BINDING SITE2, designated SEQ ID:25249 and SEQ ID:22412 respectively, to the nucleotide sequence of VGAM1543 RNA, herein designated VGAM RNA, also designated SEQ ID:4254.

Another function of VGAM1543 is therefore inhibition of Chemokine (C-C motif) Receptor 9 (CCR9, Accession NM_031200), a gene which binds beta-chemokine family and subsequently transduces a signal by increasing the intracellular calcium ions level. Accordingly, utilities of VGAM1543 include diagnosis, prevention and treatment of diseases and clinical conditions associated with CCR9. The function of CCR9 and its association with various diseases and clinical conditions, has been established by previous studies, as described hereinabove with reference to VGAM1324. CGTHBA (Accession NM_012075) is another VGAM1543 host target gene. CGTHBA BINDING SITE is HOST TARGET binding site found in the 3' untranslated region of mRNA encoded by CGTHBA, corresponding to a HOST TARGET binding site such as BINDING SITE I, BINDING SITE II or BINDING SITE III. Table 2 illustrates the complementarity of the nucleotide sequences of CGTHBA BINDING SITE, designated SEQ ID:14364, to the nucleotide sequence of VGAM1543 RNA, herein designated VGAM RNA, also designated SEQ ID:4254.

Another function of VGAM1543 is therefore inhibition of CGTHBA (Accession NM_012075). Accordingly, utilities of VGAM1543 include diagnosis, prevention and treatment of diseases and clinical conditions associated with CGTHBA. Eukaryotic Translation Initiation Factor 1A (EIF1A, Accession XM_114147) is another VGAM1543 host target gene. EIF1A BINDING SITE is HOST TARGET binding site found in the 3' untranslated region of mRNA encoded by EIF1A, corresponding to a HOST TARGET binding site such as BINDING SITE I, BINDING SITE II or BINDING SITE III. Table 2 illustrates the complementarity of the nucleotide sequences of EIF1A BINDING SITE, designated SEQ ID:42721, to the nucleotide sequence of VGAM1543 RNA, herein designated VGAM RNA, also designated SEQ ID:4254.

Another function of VGAM1543 is therefore inhibition of Eukaryotic Translation Initiation Factor 1A (EIF1A, Accession XM_114147), a gene which seems to be required for maximal rate of protein biosynthesis. Accordingly, utilities of VGAM1543 include diagnosis, prevention and treatment of diseases and clinical conditions associated with EIF1A. The function of EIF1A and its association with various diseases and clinical conditions, has been established by previous studies, as described hereinabove with reference to VGAM120. Exostoses (multiple)-like 3 (EXTL3, Accession NM_001440) is another VGAM1543 host target gene. EXTL3 BINDING SITE is HOST TARGET binding site found in the 3' untranslated region of mRNA encoded by EXTL3, corresponding to a HOST TARGET binding site such as BINDING SITE I, BINDING SITE II or BINDING SITE III. Table 2 illustrates the complementarity of the nucleotide sequences of EXTL3 BINDING SITE, designated SEQ ID:7171, to the nucleotide sequence of VGAM1543 RNA, herein designated VGAM RNA, also designated SEQ ID:4254.

Another function of VGAM1543 is therefore inhibition of Exostoses (multiple)-like 3 (EXTL3, Accession NM_001440), a gene which a member of the multiple exostoses gene family. Accordingly, utilities of VGAM1543 include diagnosis, prevention and treatment of diseases and clinical conditions associated with EXTL3. The function of EXTL3 and its association with various diseases and clinical conditions, has been established by previous studies, as described hereinabove with reference to VGAM95. Growth Hormone Receptor (GHR, Accession NM_000163) is another VGAM1543 host target gene. GHR BINDING SITE is HOST TARGET binding site found in the 3' untranslated region of mRNA encoded by GHR, corresponding to a HOST TARGET binding site such as BINDING SITE I, BINDING SITE II or BINDING SITE III. Table 2 illustrates the complementarity of the nucleotide sequences of GHR BINDING SITE, designated SEQ ID:5671, to the nucleotide sequence of VGAM1543 RNA, herein designated VGAM RNA, also designated SEQ ID:4254.

Another function of VGAM1543 is therefore inhibition of Growth Hormone Receptor (GHR, Accession NM_000163). Accordingly, utilities of VGAM1543 include diagnosis, prevention and treatment of diseases and clinical conditions associated with GHR. Heparan Sulfate 2-O-sulfotransferase 1 (HS2ST1, Accession NM_012262) is another VGAM1543 host target gene. HS2ST1 BINDING SITE is HOST TARGET binding site found in the 3' untranslated region of mRNA encoded by HS2ST1, corresponding to a HOST TARGET binding site such as BINDING SITE I, BINDING SITE II or BINDING SITE III. Table 2 illustrates the complementarity of the nucleotide sequences of HS2ST1 BINDING SITE, designated SEQ ID:14576, to the nucleotide sequence of VGAM1543 RNA, herein designated VGAM RNA, also designated SEQ ID:4254.

Another function of VGAM1543 is therefore inhibition of Heparan Sulfate 2-O-sulfotransferase 1 (HS2ST1, Accession NM_012262). Accordingly, utilities of VGAM1543 include diagnosis, prevention and treatment of diseases and clinical conditions associated with HS2ST1. Nucleobindin 1 (NUCB1, Accession NM_006184) is another VGAM1543 host target gene. NUCB1 BINDING SITE is HOST TARGET binding site found in the 3' untranslated region of mRNA encoded by NUCB1, corresponding to a HOST TARGET binding site such as BINDING SITE I, BINDING SITE II or BINDING SITE III. Table 2 illustrates the complementarity of the nucleotide sequences of NUCB1 BINDING SITE, designated SEQ ID:12851, to the nucleotide sequence of VGAM1543 RNA, herein designated VGAM RNA, also designated SEQ ID:4254.

Another function of VGAM1543 is therefore inhibition of Nucleobindin 1 (NUCB1, Accession NM_006184), a gene which may have a role in calcium homeostasis. Accordingly, utilities of VGAM1543 include diagnosis, prevention and treatment of diseases and clinical conditions associated with NUCB1. The function of NUCB1 and its association with various diseases and clinical conditions, has been established by previous studies, as described hereinabove with reference to VGAM1523. CDC42 Binding Protein Kinase Beta (DMPK-like) (CDC42BPB, Accession NM_006035) is another VGAM1543 host target gene. CDC42BPB BINDING SITE is HOST TARGET binding site found in the 3' untranslated region of mRNA encoded by CDC42BPB, corresponding to a HOST TARGET binding site such as BINDING SITE I, BINDING SITE II or BINDING SITE III. Table 2 illustrates the complementarity of the nucleotide sequences of CDC42BPB BINDING SITE, designated SEQ ID:12658, to the nucleotide sequence of VGAM1543 RNA, herein designated VGAM RNA, also designated SEQ ID:4254.

Another function of VGAM1543 is therefore inhibition of CDC42 Binding Protein Kinase Beta (DMPK-like) (CDC42BPB, Accession NM_006035). Accordingly, utilities of VGAM1543 include diagnosis, prevention and treatment of diseases and clinical conditions associated with CDC42BPB. DKFZP566B183 (Accession NM_015509) is another VGAM1543 host target gene. DKFZP566B183 BINDING SITE is HOST TARGET binding site found in the 3' untranslated region of mRNA encoded by DKFZP566B183, corresponding to a HOST TARGET binding site such as BINDING SITE I, BINDING SITE II or BINDING SITE III. Table 2 illustrates the complementarity of the nucleotide sequences of DKFZP566B183 BINDING SITE, designated SEQ ID:17769, to the nucleotide sequence of VGAM1543 RNA, herein designated VGAM RNA, also designated SEQ ID:4254.

Another function of VGAM1543 is therefore inhibition of DKFZP566B183 (Accession NM_015509). Accordingly, utilities of VGAM1543 include diagnosis, prevention and treatment of diseases and clinical conditions associated with DKFZP566B183. DKFZP566I1024 (Accession XM_046506) is another VGAM1543 host target gene. DKFZP566I1024 BINDING SITE is HOST TARGET binding site found in the 3' untranslated region of mRNA encoded by DKFZP566I1024, corresponding to a HOST TARGET binding site such as BINDING SITE I, BINDING SITE II or BINDING SITE III. Table 2 illustrates the complementarity of the nucleotide sequences of DKFZP566I1024 BINDING SITE, designated SEQ ID:34735, to the nucleotide sequence of VGAM1543 RNA, herein designated VGAM RNA, also designated SEQ ID:4254.

Another function of VGAM1543 is therefore inhibition of DKFZP566I1024 (Accession XM_046506). Accordingly, utilities of VGAM1543 include diagnosis, prevention and treatment of diseases and clinical conditions associated with DKFZP566I1024. DKFZp761B0514 (Accession NM_032289) is another VGAM1543 host target gene. DKFZp761B0514 BINDING SITE is HOST TARGET binding site found in the 3' untranslated region of mRNA encoded by DKFZp761B0514, corresponding to a HOST TARGET binding site such as BINDING SITE I, BINDING SITE II or BINDING SITE III. Table 2 illustrates the complementarity of the nucleotide sequences of DKFZp761B0514 BINDING SITE, designated SEQ ID:26053, to the nucleotide sequence of VGAM1543 RNA, herein designated VGAM RNA, also designated SEQ ID:4254.

Another function of VGAM1543 is therefore inhibition of DKFZp761B0514 (Accession NM_032289). Accordingly, utilities of VGAM1543 include diagnosis, prevention and treatment of diseases and clinical conditions associated with DKFZp761B0514. FLJ13305 (Accession XM_117270) is another VGAM1543 host target gene. FLJ13305 BINDING SITE is HOST TARGET binding site found in the 5' untranslated region of mRNA encoded by FLJ13305, corresponding to a HOST TARGET binding site such as BINDING SITE I, BINDING SITE II or BINDING SITE III. Table 2 illustrates the complementarity of the nucleotide sequences of FLJ13305 BINDING SITE, designated SEQ ID:43345, to the nucleotide sequence of VGAM1543 RNA, herein designated VGAM RNA, also designated SEQ ID:4254.

Another function of VGAM1543 is therefore inhibition of FLJ13305 (Accession XM_117270). Accordingly, utilities of VGAM1543 include diagnosis, prevention and treatment of diseases and clinical conditions associated with FLJ13305. KIAA0265 (Accession XM_045954) is another VGAM1543 host target gene. KIAA0265 BINDING SITE is HOST TARGET binding site found in the 3' untranslated region of mRNA encoded by KIAA0265, corresponding to a HOST TARGET binding site such as BINDING SITE I, BINDING SITE II or BINDING SITE III. Table 2 illustrates the complementarity of the nucleotide sequences of KIAA0265 BINDING SITE, designated SEQ ID:34620, to the nucleotide sequence of VGAM1543 RNA, herein designated VGAM RNA, also designated SEQ ID:4254.

Another function of VGAM1543 is therefore inhibition of KIAA0265 (Accession XM_045954). Accordingly, utilities of VGAM1543 include diagnosis, prevention and treatment of diseases and clinical conditions associated with KIAA0265. KIAA1117 (Accession XM_028219) is another VGAM1543 host target gene. KIAA1117 BINDING SITE is HOST TARGET binding site found in the 3' untranslated region of mRNA encoded by KIAA1117, corresponding to a HOST TARGET binding site such as BINDING SITE I, BINDING SITE II or BINDING SITE III. Table 2 illustrates the complementarity of the nucleotide sequences of KIAA1117 BINDING SITE, designated SEQ ID:30632, to the nucleotide sequence of VGAM1543 RNA, herein designated VGAM RNA, also designated SEQ ID:4254.

Another function of VGAM1543 is therefore inhibition of KIAA1117 (Accession XM_028219). Accordingly, utilities of VGAM1543 include diagnosis, prevention and treatment of diseases and clinical conditions associated with KIAA1117. KIAA1319 (Accession NM_020770) is another VGAM1543 host target gene. KIAA1319 BINDING SITE is HOST TARGET binding site found in the 3' untranslated region of mRNA encoded by KIAA1319, corresponding to a HOST TARGET binding site such as BINDING SITE I, BINDING SITE II or BINDING SITE III. Table 2 illustrates the complementarity of the nucleotide sequences of KIAA1319 BINDING SITE, designated SEQ ID:21870, to the nucleotide sequence of VGAM1543 RNA, herein designated VGAM RNA, also designated SEQ ID:4254.

Another function of VGAM1543 is therefore inhibition of KIAA1319 (Accession NM_020770). Accordingly, utilities of VGAM1543 include diagnosis, prevention and treatment of diseases and clinical conditions associated with KIAA1319. Nudix (nucleoside diphosphate linked moiety X)-type Motif 13 (NUDT13, Accession XM_032512) is another VGAM1543 host target gene. NUDT13 BINDING SITE is HOST TARGET binding site found in the 3' untranslated region of mRNA encoded by NUDT13, corresponding to a HOST TARGET binding site such as BINDING SITE I, BINDING SITE II or BINDING SITE III. Table 2 illustrates the complementarity of the nucleotide sequences of NUDT13 BINDING SITE, designated SEQ ID:31664, to the nucleotide sequence of VGAM1543 RNA, herein designated VGAM RNA, also designated SEQ ID:4254.

Another function of VGAM1543 is therefore inhibition of Nudix (nucleoside diphosphate linked moiety X)-type Motif 13 (NUDT13, Accession XM_032512). Accordingly, utilities of VGAM1543 include diagnosis, prevention and treatment of diseases and clinical conditions associated with NUDT13. SSH2 (Accession XM_030846) is another VGAM1543 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31176, to the nucleotide sequence of VGAM1543 RNA, herein designated VGAM RNA, also designated SEQ ID:4254.

Another function of VGAM1543 is therefore inhibition of SSH2 (Accession XM_030846). Accordingly, utilities of VGAM1543 include diagnosis, prevention and treatment of diseases and clinical conditions associated with SSH2. Signal Sequence Receptor, Alpha (translocon-associated protein alpha) (SSR1, Accession NM_003144) is another VGAM1543 host target gene. SSR1 BINDING SITE is HOST TARGET binding site found in the 3' untranslated region of mRNA encoded by SSR1, corresponding to a HOST TARGET binding site such as BINDING SITE I, BINDING SITE II or BINDING SITE III. Table 2 illustrates the complementarity of the nucleotide sequences of SSR1 BINDING SITE, designated SEQ ID:9113, to the nucleotide sequence of VGAM1543 RNA, herein designated VGAM RNA, also designated SEQ ID:4254.

Another function of VGAM1543 is therefore inhibition of Signal Sequence Receptor, Alpha (translocon-associated protein alpha) (SSR1, Accession NM_003144). Accordingly, utilities of VGAM1543 include diagnosis, prevention and treatment of diseases and clinical conditions associated with SSR1. TAF9-like RNA Polymerase II, TATA Box Binding Protein (TBP)-associated Factor, 31 kDa (TAF9L, Accession NM_015975) is another VGAM1543 host target gene. TAF9L BINDING SITE is HOST TARGET binding site found in the 3' untranslated region of mRNA encoded by TAF9L, corresponding to a HOST TARGET binding site such as BINDING SITE I, BINDING SITE II or BINDING SITE III. Table 2 illustrates the complementarity of the nucleotide sequences of TAF9L BINDING SITE, designated SEQ ID:18072, to the nucleotide sequence of VGAM1543 RNA, herein designated VGAM RNA, also designated SEQ ID:4254.

Another function of VGAM1543 is therefore inhibition of TAF9-like RNA Polymerase II, TATA Box Binding Protein (TBP)-associated Factor, 31 kDa (TAF9L, Accession NM_015975). Accordingly, utilities of VGAM1543 include diagnosis, prevention and treatment of diseases and clinical conditions associated with TAF9L. LOC115294 (Accession XM_054302) is another VGAM1543 host target gene. LOC115294 BINDING SITE is HOST TARGET binding site found in the 3' untranslated region of mRNA encoded by LOC115294, corresponding to a HOST TARGET binding site such as BINDING SITE I, BINDING SITE II or BINDING SITE III. Table 2 illustrates the complementarity of the nucleotide sequences of LOC115294 BINDING SITE, designated SEQ ID:36145, to the nucleotide sequence of VGAM1543 RNA, herein designated VGAM RNA, also designated SEQ ID:4254.

Another function of VGAM1543 is therefore inhibition of LOC115294 (Accession XM_054302). Accordingly, utilities of VGAM1543 include diagnosis, prevention and treatment of diseases and clinical conditions associated with LOC115294. LOC150271 (Accession XM_097859) is another VGAM1543 host target gene. LOC150271 BINDING SITE is HOST TARGET binding site found in the 5' untranslated region of mRNA encoded by LOC150271, corresponding to a HOST TARGET binding site such as BINDING SITE I, BINDING SITE II or BINDING SITE III. Table 2 illustrates the complementarity of the nucleotide sequences of LOC150271 BINDING SITE, designated SEQ ID:41166, to the nucleotide sequence of VGAM1543 RNA, herein designated VGAM RNA, also designated SEQ ID:4254.

Another function of VGAM1543 is therefore inhibition of LOC150271 (Accession XM_097859). Accordingly, utilities of VGAM1543 include diagnosis, prevention and treatment of diseases and clinical conditions associated with LOC150271. LOC151877 (Accession XM_098132) is another VGAM1543 host target gene. LOC151877 BINDING SITE is HOST TARGET binding site found in the 3' untranslated region of mRNA encoded by LOC151877, corresponding to a HOST TARGET binding site such as BINDING SITE I, BINDING SITE II or BINDING SITE III. Table 2 illustrates the complementarity of the nucleotide sequences of LOC151877 BINDING SITE, designated SEQ ID:41398, to the nucleotide sequence of VGAM1543 RNA, herein designated VGAM RNA, also designated SEQ ID:4254.

Another function of VGAM1543 is therefore inhibition of LOC151877 (Accession XM_098132). Accordingly, utilities of VGAM1543 include diagnosis, prevention and treatment of diseases and clinical conditions associated with LOC151877. LOC152300 (Accession XM_087432) is another VGAM1543 host target gene. LOC152300 BINDING SITE is HOST TARGET binding site found in the 5' untranslated region of mRNA encoded by LOC152300, corresponding to a HOST TARGET binding site such as BINDING SITE I, BINDING SITE II or BINDING SITE III. Table 2 illustrates the complementarity of the nucleotide sequences of LOC152300 BINDING SITE, designated SEQ ID:39248, to the nucleotide sequence of VGAM1543 RNA, herein designated VGAM RNA, also designated SEQ ID:4254.

Another function of VGAM1543 is therefore inhibition of LOC152300 (Accession XM_087432). Accordingly, utilities of VGAM1543 include diagnosis, prevention and treatment of diseases and clinical conditions associated with LOC152300. LOC154084 (Accession XM_098468) is another VGAM1543 host target gene. LOC154084 BINDING SITE is HOST TARGET binding site found in the 5' untranslated region of mRNA encoded by LOC154084, corresponding to a HOST TARGET binding site such as BINDING SITE I, BINDING SITE II or BINDING SITE III. Table 2 illustrates the complementarity of the nucleotide sequences of LOC154084 BINDING SITE, designated SEQ ID:41685, to the nucleotide sequence of VGAM1543 RNA, herein designated VGAM RNA, also designated SEQ ID:4254.

Another function of VGAM1543 is therefore inhibition of LOC154084 (Accession XM_098468). Accordingly, utilities of VGAM1543 include diagnosis, prevention and treatment of diseases and clinical conditions associated with LOC154084. LOC158402 (Accession XM_098936) is another VGAM1543 host target gene. LOC158402 BINDING SITE is HOST TARGET binding site found in the 5' untranslated region of mRNA encoded by LOC158402, corresponding to a HOST TARGET binding site such as BINDING SITE I, BINDING SITE II or BINDING SITE III. Table 2 illustrates the complementarity of the nucleotide sequences of LOC158402 BINDING SITE, designated SEQ ID:41976, to the nucleotide sequence of VGAM1543 RNA, herein designated VGAM RNA, also designated SEQ ID:4254.

Another function of VGAM1543 is therefore inhibition of LOC158402 (Accession XM_098936). Accordingly, utilities of VGAM1543 include diagnosis, prevention and treatment of diseases and clinical conditions associated with LOC158402. LOC162333 (Accession XM_102591) is another VGAM1543 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42124, to the nucleotide sequence of VGAM1543 RNA, herein designated VGAM RNA, also designated SEQ ID:4254.

Another function of VGAM1543 is therefore inhibition of LOC162333 (Accession XM_102591). Accordingly, utilities of VGAM1543 include diagnosis, prevention and treatment of diseases and clinical conditions associated with LOC162333. FIG. 1 further provides a conceptual description of a novel bioinformatically detected viral gene of the present invention, referred to here as Viral Genomic Address Messenger 1544 (VGAM1544) viral gene, which modulates expression of respective host target genes thereof, the function and utility of which host target genes is known in the art.

VGAM1544 is a novel bioinformatically detected regulatory, non protein coding, viral micro RNA (miRNA) gene. The method by which VGAM1544 was detected is described hereinabove with reference to FIGS. 1-8.

VGAM1544 gene, herein designated VGAM GENE, is a viral gene contained in the genome of Variola Virus. VGAM1544 host target gene, herein designated VGAM HOST TARGET GENE, is a human gene contained in the human genome.

VGAM1544 gene encodes a VGAM1544 precursor RNA, herein designated VGAM PRECURSOR RNA. Similar to other miRNA genes, and unlike most ordinary genes, VGAM1544 precursor RNA does not encode a protein. A nucleotide sequence identical or highly similar to the nucleotide sequence of VGAM1544 precursor RNA is designated SEQ ID:1530, and is provided hereinbelow with reference to the sequence listing part. Nucleotide sequence SEQ ID:1530 is located at position 50463 relative to the genome of Variola Virus.

VGAM1544 precursor RNA folds onto itself, forming VGAM1544 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1544 folded precursor RNA into VGAM1544 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM1544 RNA is designated SEQ ID:4255, and is provided hereinbelow with reference to the sequence listing part.

VGAM1544 host target gene, herein designated VGAM HOST TARGET GENE, encodes a corresponding messenger RNA, VGAM1544 host target RNA, herein designated VGAM HOST TARGET RNA. VGAM1544 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1544 RNA, herein designated VGAM RNA, binds complementarily to one or more host target binding sites located in untranslated regions of VGAM1544 host target RNA, herein designated VGAM HOST TARGET RNA. This complementary binding is due to the fact that the nucleotide sequence of VGAM1544 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1544 RNA, herein designated VGAM RNA, may have a different number of host target binding sites in untranslated regions of a VGAM1544 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1544 RNA, herein designated VGAM RNA, to host target binding sites on VGAM1544 host target RNA, herein designated VGAM HOST TARGET RNA, such as BINDING SITE I, BINDING SITE II and BINDING SITE III, inhibits translation of VGAM1544 host target RNA into VGAM1544 host target protein, herein designated VGAM HOST TARGET PROTEIN. VGAM host target protein is therefore outlined by a broken line.

It is appreciated that VGAM1544 host target gene, herein designated VGAM HOST TARGET GENE, in fact represents a plurality of VGAM1544 host target genes. The mRNA of each one of this plurality of VGAM1544 host target genes comprises one or more host target binding sites, each having a nucleotide sequence which is at least partly complementary to VGAM1544 RNA, herein designated VGAM RNA, and which when bound by VGAM1544 RNA causes inhibition of translation of respective one or more VGAM1544 host target proteins.

It is further appreciated by one skilled in the art that the mode of translational inhibition illustrated by FIG. 1 with specific reference to translational inhibition exerted by VGAM1544 gene, herein designated VGAM GENE, on one or more VGAM1544 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1544 is inhibition of expression of host target genes, as part of a novel viral mechanism of attacking a host. Accordingly, utilities of VGAM1544 include diagnosis, prevention and treatment of viral infection by Variola Virus. Specific functions, and accordingly utilities, of VGAM1544 correlate with, and may be deduced from, the identity of the host target genes which VGAM1544 binds and inhibits, and the function of these host target genes, as elaborated hereinbelow.

Nucleotide sequences of the VGAM1544 precursor RNA, herein designated VGAM PRECURSOR RNA, and of the 'diced' VGAM1544 RNA, herein designated VGAM RNA, and a schematic representation of the secondary folding of VGAM1544 folded precursor RNA, herein designated VGAM FOLDED PRECURSOR RNA, of VGAM1544 are further described hereinbelow with reference to Table 1.

Nucleotide sequences of host target binding sites, such as BINDING SITE-I, BINDING SITE-II and BINDING SITE-III of FIG. 1, found on VGAM1544 host target RNA, and schematic representation of the complementarity of each of these host target binding sites to VGAM1544 RNA, herein designated VGAM RNA, are described hereinbelow with reference to Table 2.

As mentioned hereinabove with reference to FIG. 1, a function of VGAM1544 gene, herein designated VGAM is inhibition of expression of VGAM1544 target genes. It is appreciated that specific functions, and accordingly utilities, of VGAM1544 correlate with, and may be deduced from, the identity of the target genes which VGAM1544 binds and inhibits, and the function of these target genes, as elaborated hereinbelow.

ATP-binding Cassette, Sub-family A (ABC1), Member 3 (ABCA3, Accession NM_001089) is a VGAM1544 host target gene. ABCA3 BINDING SITE is HOST TARGET binding site found in the 3' untranslated region of mRNA encoded by ABCA3, corresponding to a HOST TARGET binding site such as BINDING SITE I, BINDING SITE II or BINDING SITE III. Table 2 illustrates the complementarity of the nucleotide sequences of ABCA3 BINDING SITE, designated SEQ ID:6743, to the nucleotide sequence of VGAM1544 RNA, herein designated VGAM RNA, also designated SEQ ID:4255.

A function of VGAM1544 is therefore inhibition of ATP-binding Cassette, Sub-family A (ABC1), Member 3 (ABCA3, Accession NM_001089), a gene which may be a transporter, may act as an efflux pump for chemotherapeutics drugs. Accordingly, utilities of VGAM1544 include diagnosis, prevention and treatment of diseases and clinical conditions associated with ABCA3. The function of ABCA3 and its association with various diseases and clinical conditions, has been established by previous studies, as described hereinabove with reference to VGAM336. Cathepsin B (CTSB, Accession XM_035662) is another VGAM1544 host target gene. CTSB BINDING SITE is HOST TARGET binding site found in the 3' untranslated region of mRNA encoded by CTSB, corresponding to a HOST TARGET binding site such as BINDING SITE I, BINDING SITE II or BINDING SITE III. Table 2 illustrates the complementarity of the nucleotide sequences of CTSB BINDING SITE, designated SEQ ID:32328, to the nucleotide sequence of VGAM1544 RNA, herein designated VGAM RNA, also designated SEQ ID:4255.

Another function of VGAM1544 is therefore inhibition of Cathepsin B (CTSB, Accession XM_035662). Accordingly, utilities of VGAM1544 include diagnosis, prevention and treatment of diseases and clinical conditions associated with CTSB. Oxytocin Receptor (OXTR, Accession NM_000916) is another VGAM1544 host target gene. OXTR BINDING SITE is HOST TARGET binding site found in the 3' untranslated region of mRNA encoded by OXTR, corresponding to a HOST TARGET binding site such as BINDING SITE I, BINDING SITE II or BINDING SITE III. Table 2 illustrates the complementarity of the nucleotide sequences of OXTR BINDING SITE, designated SEQ ID:6622, to the nucleotide sequence of VGAM1544 RNA, herein designated VGAM RNA, also designated SEQ ID:4255.

Another function of VGAM1544 is therefore inhibition of Oxytocin Receptor (OXTR, Accession NM_000916), a gene which induces inward ion currents. Accordingly, utilities of VGAM1544 include diagnosis, prevention and treatment of diseases and clinical conditions associated with OXTR. The function of OXTR and its association with various diseases and clinical conditions, has been established by previous studies, as described hereinabove with reference to VGAM636. Protein Kinase, AMP-activated, Alpha 2 Catalytic Subunit (PRKAA2, Accession NM_006252) is another VGAM1544 host target gene. PRKAA2 BINDING SITE is HOST TARGET binding site found in the 3' untranslated region of mRNA encoded by PRKAA2, corresponding to a HOST TARGET binding site such as BINDING SITE I, BINDING SITE II or BINDING SITE III. Table 2 illustrates the complementarity of the nucleotide sequences of PRKAA2 BINDING SITE, designated SEQ ID:12928, to the nucleotide sequence of VGAM1544 RNA, herein designated VGAM RNA, also designated SEQ ID:4255.

Another function of VGAM1544 is therefore inhibition of Protein Kinase, AMP-activated, Alpha 2 Catalytic Subunit (PRKAA2, Accession NM_006252), a gene which are responsible for the regulation of fatty acid synthesis by phosphorylation of acetyl-coa carboxylase. Accordingly, utilities of VGAM1544 include diagnosis, prevention and treatment of diseases and clinical conditions associated with PRKAA2. The function of PRKAA2 has been established by previous studies. AMP-activated protein kinase plays a key role in the regulation of fatty acid and cholesterol metabolism (Hardie, 1992; Hardie and MacKintosh, 1992). In vitro, it phosphorylates and inactivates 3-hydroxy-3-methylglutaryl-CoA reductase (HMGCR; 142910) and acetyl-CoA carboxylase (ACC; 200350), key enzymes involved in regulating de novo biosynthesis of cholesterol and fatty acids, respectively. See PRKAA1 (OMIM Ref. No. 602739) for additional background. Beri et al. (1994) used a cDNA encoding rat liver AMPK to isolate human skeletal muscle AMPK cDNA clones. The human cDNA was more than 90% homologous to the rat sequence and predicted a protein of 62.3 kD that closely agreed with the mass of human AMPK observed in Western blots of human tissue extracts. A cDNA probe was used to identify a 9.5-kb transcript in several human tissues and to isolate human genomic clones. Stapleton et al. (1997) showed that rat liver Ampk-alpha-2 is associated with Ampk-beta-1 (PRKAB1; 602740) and Ampk-gamma-1 (PRKAG1; 602742). They noted that Ampk-alpha-1 (OMIM Ref. No. PRKAA1) is also associated with these beta and gamma isoforms. Beri et al. (1994) used PCR mapping of rodent/human hybrid cell lines to localize the human AMPK gene to chromosome 1, and they sublocalized the AMPK gene to 1p31 by fluorescence in situ hybridization with a human genomic clone. (The cDNA referred to as AMPK by Beri et al. (1994) encodes the alpha-2 subunit of AMPK.) Tsujikawa et al. (1998) determined that PRKAA2 and the CDC-like kinase-2 gene (CLK2; 602989) are located in the same interval of approximately 2.6 cM between D1S2890 and D1S2801. They suggested that CLK2 and PRKAA2 are possible candidate genes for gelatinous drop-like corneal dystrophy (OMIM Ref. No. 204870). Mu et al. (2001) investigated the role of the metabolic sensor AMPK in the regulation of glucose transport in skeletal muscle. Expression in mouse muscle of a dominant inhibitory mutant of Ampk-alpha-2 completely blocked the ability of hypoxia and 5-aminoimidazole-4-carboxamide ribonucleoside (AICAR) to activate hexose uptake, while only partially reducing contraction-stimulated hexose uptake. These data indicated that AMPK transmits a portion of the signal by which muscle contraction increases glucose uptake, but other AMPK-independent pathways also contribute to the response. Minokoshi et al. (2002) demonstrated that leptin (OMIM Ref. No. 164160) selectively stimulates phosphorylation and activation of AMPK-alpha-2 in skeletal muscle, thus establishing an additional signaling pathway for leptin. Early activation of AMPK occurs by leptin acting directly on muscle, whereas later activation depends on leptin functioning through the hypothalamic-sympathetic nervous system axis. In parallel with its activation of AMPK, leptin suppresses the activity of ACC (200350, 601557), thereby stimulating the oxidation of fatty acids in muscle. Blocking AMPK activation inhibits the phosphorylation of ACC stimulated by leptin. Minokoshi et al. (2002) concluded that their data identify AMPK as a principal mediator of the effects of leptin on fatty acid metabolism in muscle.

Full details of the abovementioned studies are described in the following publications, the disclosure of which are hereby incorporated by reference:

Minokoshi, Y.; Kim, Y.-B.; Peroni, O. D.; Fryer, L. G. D.; Muller, C.; Carling, D.; Kahn, B. B.: Leptin stimulates fatty-acid oxidation by activating AMP-activated protein kinase. Nature 415:339-343, 2002; and Mu, J.; Brozinick, J. T., Jr.; Valladares, O.; Bucan, M.; Birnbaum, M. J.: A role for AMP-activated protein kinase in contraction- and hypoxia-regulated glucose transport in skel-etal m.

Further studies establishing the function and utilities of PRKAA2 are found in John Hopkins OMIM database record ID 600497, and in sited publications numbered 10692-10694, 10329, 10695-1069 and 1355 listed in the bibliography section hereinbelow, which are also hereby incorporated by reference. KIAA0970 (Accession NM_014923) is another VGAM1544 host target gene. KIAA0970 BINDING SITE is HOST TARGET binding site found in the 3' untranslated region of mRNA encoded by KIAA0970, corresponding to a HOST TARGET binding site such as BINDING SITE I, BINDING SITE II or BINDING SITE III. Table 2 illustrates the complementarity of the nucleotide sequences of KIAA0970 BINDING SITE, designated SEQ ID:17202, to the nucleotide sequence of VGAM1544 RNA, herein designated VGAM RNA, also designated SEQ ID:4255.

Another function of VGAM1544 is therefore inhibition of KIAA0970 (Accession NM_014923). Accordingly, utilities of VGAM1544 include diagnosis, prevention and treatment of diseases and clinical conditions associated with KIAA0970. LOC91694 (Accession XM_040082) is another VGAM1544 host target gene. LOC91694 BINDING SITE is HOST TARGET binding site found in the 3' untranslated region of mRNA encoded by LOC91694, corresponding to a HOST TARGET binding site such as BINDING SITE I, BINDING SITE II or BINDING SITE III. Table 2 illustrates the complementarity of the nucleotide sequences of LOC91694 BINDING SITE, designated SEQ ID:33249, to the nucleotide sequence of VGAM1544 RNA, herein designated VGAM RNA, also designated SEQ ID:4255.

Another function of VGAM1544 is therefore inhibition of LOC91694 (Accession XM_040082). Accordingly, utilities of VGAM1544 include diagnosis, prevention and treatment of diseases and clinical conditions associated with LOC91694. FIG. 1 further provides a conceptual description of a novel bioinformatically detected viral gene of the present invention, referred to here as Viral Genomic Address Messenger 1545 (VGAM1545) viral gene, which modulates expression of respective host target genes thereof, the function and utility of which host target genes is known in the art.

VGAM1545 is a novel bioinformatically detected regulatory, non protein coding, viral micro RNA (miRNA) gene. The method by which VGAM1545 was detected is described hereinabove with reference to FIGS. 1-8.

VGAM1545 gene, herein designated VGAM GENE, is a viral gene contained in the genome of Variola Virus. VGAM1545 host target gene, herein designated VGAM HOST TARGET GENE, is a human gene contained in the human genome.

VGAM1545 gene encodes a VGAM1545 precursor RNA, herein designated VGAM PRECURSOR RNA. Similar to other miRNA genes, and unlike most ordinary genes, VGAM1545 precursor RNA does not encode a protein. A nucleotide sequence identical or highly similar to the nucleotide sequence of VGAM1545 precursor RNA is designated SEQ ID:1531, and is provided hereinbelow with reference to the sequence listing part. Nucleotide sequence SEQ ID:1531 is located at position 53558 relative to the genome of Variola Virus.

VGAM1545 precursor RNA folds onto itself, forming VGAM1545 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1545 folded precursor RNA into VGAM1545 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1545 RNA is designated SEQ ID:4256, and is provided hereinbelow with reference to the sequence listing part.

VGAM1545 host target gene, herein designated VGAM HOST TARGET GENE, encodes a corresponding messenger RNA, VGAM1545 host target RNA, herein designated VGAM HOST TARGET RNA. VGAM1545 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1545 RNA, herein designated VGAM RNA, binds complementarily to one or more host target binding sites located in untranslated regions of VGAM1545 host target RNA, herein designated VGAM HOST TARGET RNA. This complementary binding is due to the fact that the nucleotide sequence of VGAM1545 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1545 RNA, herein designated VGAM RNA, may have a different number of host target binding sites in untranslated regions of a VGAM1545 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1545 RNA, herein designated VGAM RNA, to host target binding sites on VGAM1545 host target RNA, herein designated VGAM HOST TARGET RNA, such as BINDING SITE I, BINDING SITE II and BINDING SITE III, inhibits translation of VGAM1545 host target RNA into VGAM1545 host target protein, herein designated VGAM HOST TARGET PROTEIN. VGAM host target protein is therefore outlined by a broken line.

It is appreciated that VGAM1545 host target gene, herein designated VGAM HOST TARGET GENE, in fact represents a plurality of VGAM1545 host target genes. The mRNA of each one of this plurality of VGAM1545 host target genes comprises one or more host target binding sites, each having a nucleotide sequence which is at least partly complementary to VGAM1545 RNA, herein designated VGAM RNA, and which when bound by VGAM1545 RNA causes inhibition of translation of respective one or more VGAM1545 host target proteins.

It is further appreciated by one skilled in the art that the mode of translational inhibition illustrated by FIG. 1 with specific reference to translational inhibition exerted by VGAM1545 gene, herein designated VGAM GENE, on one or more VGAM1545 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1545 is inhibition of expression of host target genes, as part of a novel viral mechanism of attacking a host. Accordingly, utilities of VGAM1545 include diagnosis, prevention and treatment of viral infection by Variola Virus. Specific functions, and accordingly utilities, of VGAM1545 correlate with, and may be deduced from, the identity of the host target genes which VGAM1545 binds and inhibits, and the function of these host target genes, as elaborated hereinbelow.

Nucleotide sequences of the VGAM1545 precursor RNA, herein designated VGAM PRECURSOR RNA, and of the 'diced' VGAM1545 RNA, herein designated VGAM RNA, and a schematic representation of the secondary folding of VGAM1545 folded precursor RNA, herein designated VGAM FOLDED PRECURSOR RNA, of VGAM1545 are further described hereinbelow with reference to Table 1.

Nucleotide sequences of host target binding sites, such as BINDING SITE-I, BINDING SITE-II and BINDING SITE-III of FIG. 1, found on VGAM1545 host target RNA, and schematic representation of the complementarity of each of these host target binding sites to VGAM1545 RNA, herein designated VGAM RNA, are described hereinbelow with reference to Table 2.

As mentioned hereinabove with reference to FIG. 1, a function of VGAM1545 gene, herein designated VGAM is inhibition of expression of VGAM1545 target genes. It is appreciated that specific functions, and accordingly utilities, of VGAM1545 correlate with, and may be deduced from, the identity of the target genes which VGAM1545 binds and inhibits, and the function of these target genes, as elaborated hereinbelow.

C-type (calcium dependent, carbohydrate-recognition domain) Lectin, Superfamily Member 5 (CLECSF5, Accession NM_013252) is a VGAM1545 host target gene. CLECSF5 BINDING SITE is HOST TARGET binding site found in the 3' untranslated region of mRNA encoded by CLECSF5, corresponding to a HOST TARGET binding site such as BINDING SITE I, BINDING SITE II or BINDING SITE III. Table 2 illustrates the complementarity of the nucleotide sequences of CLECSF5 BINDING SITE, designated SEQ ID:14918, to the nucleotide sequence of VGAM1545 RNA, herein designated VGAM RNA, also designated SEQ ID:4256.

A function of VGAM1545 is therefore inhibition of C-type (calcium dependent, carbohydrate-recognition domain) Lectin, Superfamily Member 5 (CLECSF5, Accession NM_013252). Accordingly, utilities of VGAM1545 include diagnosis, prevention and treatment of diseases and clinical conditions associated with CLECSF5. Early Growth Response 3 (EGR3, Accession XM_005040) is another VGAM1545 host target gene. EGR3 BINDING SITE is HOST TARGET binding site found in the 3' untranslated region of mRNA encoded by EGR3, corresponding to a HOST TARGET binding site such as BINDING SITE I, BINDING SITE II or BINDING SITE III. Table 2 illustrates the complementarity of the nucleotide sequences of EGR3 BINDING SITE, designated SEQ ID:29956, to the nucleotide sequence of VGAM1545 RNA, herein designated VGAM RNA, also designated SEQ ID:4256.

Another function of VGAM1545 is therefore inhibition of Early Growth Response 3 (EGR3, Accession XM_005040), a gene which is a putative transcription factor. Accordingly, utilities of VGAM1545 include diagnosis, prevention and treatment of diseases and clinical conditions associated with EGR3. The function of EGR3 and its association with various diseases and clinical conditions, has been established by previous studies, as described hereinabove with reference to VGAM189. Fukuyama Type Congenital Muscular Dystrophy (fukutin) (FCMD, Accession NM_006731) is another VGAM1545 host target gene. FCMD BINDING SITE is HOST TARGET binding site found in the 3' untranslated region of mRNA encoded by FCMD, corresponding to a HOST TARGET binding site such as BINDING SITE I, BINDING SITE II or BINDING SITE III. Table 2 illustrates the complementarity of the nucleotide sequences of FCMD BINDING SITE, designated SEQ ID:13577, to the nucleotide sequence of VGAM1545 RNA, herein designated VGAM RNA, also designated SEQ ID:4256.

Another function of VGAM1545 is therefore inhibition of Fukuyama Type Congenital Muscular Dystrophy (fukutin) (FCMD, Accession NM_006731). Accordingly, utilities of VGAM1545 include diagnosis, prevention and treatment of diseases and clinical conditions associated with FCMD. Nuclear Receptor Subfamily 3, Group C, Member 1 (glucocorticoid receptor) (NR3C1, Accession NM_000176) is another VGAM1545 host target gene. NR3C1 BINDING SITE is HOST TARGET binding site found in the 3' untranslated region of mRNA encoded by NR3C1, corresponding to a HOST TARGET binding site such as BINDING SITE I, BINDING SITE II or BINDING SITE III. Table 2 illustrates the complementarity of the nucleotide sequences of NR3C1 BINDING SITE, designated SEQ ID:5686, to the nucleotide sequence of VGAM1545 RNA, herein designated VGAM RNA, also designated SEQ ID:4256.

Another function of VGAM1545 is therefore inhibition of Nuclear Receptor Subfamily 3, Group C, Member 1 (glucocorticoid receptor) (NR3C1, Accession NM_000176). Accordingly, utilities of VGAM1545 include diagnosis, prevention and treatment of diseases and clinical conditions associated with NR3C1. SWI/SNF Related, Matrix Associated, Actin Dependent Regulator of Chromatin, Subfamily A, Member 3 (SMARCA3, Accession NM_003071) is another VGAM1545 host target gene. SMARCA3 BINDING SITE is HOST TARGET binding site found in the 3' untranslated region of mRNA encoded by SMARCA3, corresponding to a HOST TARGET binding site such as BINDING SITE I, BINDING SITE II or BINDING SITE III. Table 2 illustrates the complementarity of the nucleotide sequences of SMARCA3 BINDING SITE, designated SEQ ID:9037, to the nucleotide sequence of VGAM1545 RNA, herein designated VGAM RNA, also designated SEQ ID:4256.

Another function of VGAM1545 is therefore inhibition of SWI/SNF Related, Matrix Associated, Actin Dependent Regulator of Chromatin, Subfamily A, Member 3 (SMARCA3, Accession NM_003071), a gene which is involved in chromatin assembly and remodeling. Accordingly, utilities of VGAM1545 include diagnosis, prevention and treatment of diseases and clinical conditions associated with SMARCA3. The function of SMARCA3 and its association with various diseases and clinical conditions, has been established by previous studies, as described hereinabove with reference to VGAM1330. Chromosome 12 Open Reading Frame 22 (C12orf22, Accession NM_030809) is another VGAM1545 host target gene. C12orf22 BINDING SITE is HOST TARGET binding site found in the 3' untranslated region of mRNA encoded by C12orf22, corresponding to a HOST TARGET binding site such as BINDING SITE I, BINDING SITE II or BINDING SITE III. Table 2 illustrates the complementarity of the nucleotide sequences of C12orf22 BINDING SITE, designated SEQ ID:25125, to the nucleotide sequence of VGAM1545 RNA, herein designated VGAM RNA, also designated SEQ ID:4256.

Another function of VGAM1545 is therefore inhibition of Chromosome 12 Open Reading Frame 22 (C12orf22, Accession NM_030809). Accordingly, utilities of VGAM1545 include diagnosis, prevention and treatment of diseases and clinical conditions associated with C12orf22. FLJ10687 (Accession NM_018178) is another VGAM1545 host target gene. FLJ10687 BINDING SITE is HOST TARGET binding site found in the 3' untranslated region of mRNA encoded by FLJ10687, corresponding to a HOST TARGET binding site such as BINDING SITE I, BINDING SITE II or BINDING SITE III. Table 2 illustrates the complementarity of the nucleotide sequences of FLJ10687 BINDING SITE, designated SEQ ID:20009, to the nucleotide sequence of VGAM1545 RNA, herein designated VGAM RNA, also designated SEQ ID:4256.

Another function of VGAM1545 is therefore inhibition of FLJ10687 (Accession NM_018178). Accordingly, utilities of VGAM1545 include diagnosis, prevention and treatment of diseases and clinical conditions associated with FLJ10687. FLJ21140 (Accession NM_024776) is another VGAM1545 host target gene. FLJ21140 BINDING SITE is HOST TARGET binding site found in the 5' untranslated region of mRNA encoded by FLJ21140, corresponding to a HOST TARGET binding site such as BINDING SITE I, BINDING SITE II or BINDING SITE III. Table 2 illustrates the complementarity of the nucleotide sequences of FLJ21140 BINDING SITE, designated SEQ ID:24143, to the nucleotide sequence of VGAM1545 RNA, herein designated VGAM RNA, also designated SEQ ID:4256.

Another function of VGAM1545 is therefore inhibition of FLJ21140 (Accession NM_024776). Accordingly, utilities of VGAM1545 include diagnosis, prevention and treatment of diseases and clinical conditions associated with FLJ21140. KIAA0872 (Accession NM_014940) is another VGAM1545 host target gene. KIAA0872 BINDING SITE is HOST TARGET binding site found in the 3' untranslated region of mRNA encoded by KIAA0872, corresponding to a HOST TARGET binding site such as BINDING SITE I, BINDING SITE II or BINDING SITE III. Table 2 illustrates the complementarity of the nucleotide sequences of KIAA0872 BINDING SITE, designated SEQ ID:17247, to the nucleotide sequence of VGAM1545 RNA, herein designated VGAM RNA, also designated SEQ ID:4256.

Another function of VGAM1545 is therefore inhibition of KIAA0872 (Accession NM_014940). Accordingly, utilities of VGAM1545 include diagnosis, prevention and treatment of diseases and clinical conditions associated with KIAA0872. KIAA1211 (Accession XM_044178) is another VGAM1545 host target gene. KIAA1211 BINDING SITE is HOST TARGET binding site found in the 3' untranslated region of mRNA encoded by KIAA1211, corresponding to a HOST TARGET binding site such as BINDING SITE I, BINDING SITE II or BINDING SITE III. Table 2 illustrates the complementarity of the nucleotide sequences of KIAA1211 BINDING SITE, designated SEQ ID:34161, to the nucleotide sequence of VGAM1545 RNA, herein designated VGAM RNA, also designated SEQ ID:4256.

Another function of VGAM1545 is therefore inhibition of KIAA1211 (Accession XM_044178). Accordingly, utilities of VGAM1545 include diagnosis, prevention and treatment of diseases and clinical conditions associated with KIAA1211. R3H Domain (binds single-stranded nucleic acids) Containing (R3HDM, Accession NM_015361) is another VGAM1545 host target gene. R3HDM BINDING SITE is HOST TARGET binding site found in the 3' untranslated region of mRNA encoded by R3HDM, corresponding to a HOST TARGET binding site such as BINDING SITE I, BINDING SITE II or BINDING SITE III. Table 2 illustrates the complementarity of the nucleotide sequences of R3HDM BINDING SITE, designated SEQ ID:17663, to the nucleotide sequence of VGAM1545 RNA, herein designated VGAM RNA, also designated SEQ ID:4256.

Another function of VGAM1545 is therefore inhibition of R3H Domain (binds single-stranded nucleic acids) Containing (R3HDM, Accession NM_015361). Accordingly, utilities of VGAM1545 include diagnosis, prevention and treatment of diseases and clinical conditions associated with R3HDM. LOC148946 (Accession XM_097557) is another VGAM1545 host target gene. LOC148946 BINDING SITE is HOST TARGET binding site found in the 5' untranslated region of mRNA encoded by LOC148946, corresponding to a HOST TARGET binding site such as BINDING SITE I, BINDING SITE II or BINDING SITE III. Table 2 illustrates the complementarity of the nucleotide sequences of LOC148946 BINDING SITE, designated SEQ ID:40941, to the nucleotide sequence of VGAM1545 RNA, herein designated VGAM RNA, also designated SEQ ID:4256.

Another function of VGAM1545 is therefore inhibition of LOC148946 (Accession XM_097557). Accordingly, utilities of VGAM1545 include diagnosis, prevention and treatment of diseases and clinical conditions associated with LOC148946. FIG. 1 further provides a conceptual description of a novel bioinformatically detected viral gene of the present invention, referred to here as Viral Genomic Address Messenger 1546 (VGAM1546) viral gene, which modulates expression of respective host target genes thereof, the function and utility of which host target genes is known in the art.

VGAM1546 is a novel bioinformatically detected regulatory, non protein coding, viral micro RNA (miRNA) gene. The method by which VGAM1546 was detected is described hereinabove with reference to FIGS. 1-8.

VGAM1546 gene, herein designated VGAM GENE, is a viral gene contained in the genome of Variola Virus. VGAM1546 host target gene, herein designated VGAM HOST TARGET GENE, is a human gene contained in the human genome.

VGAM1546 gene encodes a VGAM1546 precursor RNA, herein designated VGAM PRECURSOR RNA. Similar to other miRNA genes, and unlike most ordinary genes, VGAM1546 precursor RNA does not encode a protein. A nucleotide sequence identical or highly similar to the nucleotide sequence of VGAM1546 precursor RNA is designated SEQ ID:1532, and is provided hereinbelow with reference to the sequence listing part. Nucleotide sequence SEQ ID:1532 is located at position 51253 relative to the genome of Variola Virus.

VGAM1546 precursor RNA folds onto itself, forming VGAM1546 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1546 folded precursor RNA into VGAM1546 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1546 RNA is designated SEQ ID:4257, and is provided hereinbelow with reference to the sequence listing part.

VGAM1546 host target gene, herein designated VGAM HOST TARGET GENE, encodes a corresponding messenger RNA, VGAM1546 host target RNA, herein designated VGAM HOST TARGET RNA. VGAM1546 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1546 RNA, herein designated VGAM RNA, binds complementarily to one or more host target binding sites located in untranslated regions of VGAM1546 host target RNA, herein designated VGAM HOST TARGET RNA. This complementary binding is due to the fact that the nucleotide sequence of VGAM1546 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1546 RNA, herein designated VGAM RNA, may have a different number of host target binding sites in untranslated regions of a VGAM1546 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1546 RNA, herein designated VGAM RNA, to host target binding sites on VGAM1546 host target RNA, herein designated VGAM HOST TARGET RNA, such as BINDING SITE I, BINDING SITE II and BINDING SITE III, inhibits translation of VGAM1546 host target RNA into VGAM1546 host target protein, herein designated VGAM HOST TARGET PROTEIN. VGAM host target protein is therefore outlined by a broken line.

It is appreciated that VGAM1546 host target gene, herein designated VGAM HOST TARGET GENE, in fact represents a plurality of VGAM1546 host target genes. The mRNA of each one of this plurality of VGAM1546 host target genes comprises one or more host target binding sites, each having a nucleotide sequence which is at least partly complementary to VGAM1546 RNA, herein designated VGAM RNA, and which when bound by VGAM1546 RNA causes inhibition of translation of respective one or more VGAM1546 host target proteins.

It is further appreciated by one skilled in the art that the mode of translational inhibition illustrated by FIG. 1 with specific reference to translational inhibition exerted by VGAM1546 gene, herein designated VGAM GENE, on one or more VGAM1546 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1546 is inhibition of expression of host target genes, as part of a novel viral mechanism of attacking a host. Accordingly, utilities of VGAM1546 include diagnosis, prevention and treatment of viral infection by Variola Virus. Specific functions, and accordingly utilities, of VGAM1546 correlate with, and may be deduced from, the identity of the host target genes which VGAM1546 binds and inhibits, and the function of these host target genes, as elaborated hereinbelow.

Nucleotide sequences of the VGAM1546 precursor RNA, herein designated VGAM PRECURSOR RNA, and of the 'diced' VGAM1546 RNA, herein designated VGAM RNA, and a schematic representation of the secondary folding of VGAM1546 folded precursor RNA, herein designated VGAM FOLDED PRECURSOR RNA, of VGAM1546 are further described hereinbelow with reference to Table 1.

Nucleotide sequences of host target binding sites, such as BINDING SITE-I, BINDING SITE-II and BINDING SITE-III of FIG. 1, found on VGAM1546 host target RNA, and schematic representation of the complementarity of each of these host target binding sites to VGAM1546 RNA, herein designated VGAM RNA, are described hereinbelow with reference to Table 2.

As mentioned hereinabove with reference to FIG. 1, a function of VGAM1546 gene, herein designated VGAM is inhibition of expression of VGAM1546 target genes. It is appreciated that specific functions, and accordingly utilities, of VGAM1546 correlate with, and may be deduced from, the identity of the target genes which VGAM1546 binds and inhibits, and the function of these target genes, as elaborated hereinbelow.

Caveolin 3 (CAV3, Accession NM_033337) is a VGAM1546 host target gene. CAV3 BINDING SITE is HOST TARGET binding site found in the 3' untranslated region of mRNA encoded by CAV3, corresponding to a HOST TARGET binding site such as BINDING SITE I, BINDING SITE II or BINDING SITE III. Table 2 illustrates the complementarity of the nucleotide sequences of CAV3 BINDING SITE, designated SEQ ID:27190, to the nucleotide sequence of VGAM1546 RNA, herein designated VGAM RNA, also designated SEQ ID:4257.

A function of VGAM1546 is therefore inhibition of Caveolin 3 (CAV3, Accession NM_033337). Accordingly, utilities of VGAM1546 include diagnosis, prevention and treatment of diseases and clinical conditions associated with CAV3. CD1D Antigen, D Polypeptide (CD1D, Accession XM_086610) is another VGAM1546 host target gene. CD1D BINDING SITE is HOST TARGET binding site found in the 5' untranslated region of mRNA encoded by CD1D, corresponding to a HOST TARGET binding site such as BINDING SITE I, BINDING SITE II or BINDING SITE III. Table 2 illustrates the complementarity of the nucleotide sequences of CD1D BINDING SITE, designated SEQ ID:38789, to the nucleotide sequence of VGAM1546 RNA, herein designated VGAM RNA, also designated SEQ ID:4257.

Another function of VGAM1546 is therefore inhibition of CD1D Antigen, D Polypeptide (CD1D, Accession XM_086610), a gene which is a member D of the CD1 family; involved in antigen presentation. Accordingly, utilities of VGAM1546 include diagnosis, prevention and treatment of diseases and clinical conditions associated with CD1D. The function of CD1D and its association with various diseases and clinical conditions, has been established by previous studies, as described hereinabove with reference to VGAM1107. COX10 Homolog, Cytochrome C Oxidase Assembly Protein, Heme A: Farnesyltransferase (yeast) (COX10, Accession NM_001303) is another VGAM1546 host target gene. COX10 BINDING SITE is HOST TARGET binding site found in the 3' untranslated region of mRNA encoded by COX10, corresponding to a HOST TARGET binding site such as BINDING SITE I, BINDING SITE II or BINDING SITE III. Table 2 illustrates the complementarity of the nucleotide sequences of COX10 BINDING SITE, designated SEQ ID:6979, to the nucleotide sequence of VGAM1546 RNA, herein designated VGAM RNA, also designated SEQ ID:4257.

Another function of VGAM1546 is therefore inhibition of COX10 Homolog, Cytochrome C Oxidase Assembly Protein, Heme A: Farnesyltransferase (yeast) (COX10, Accession NM_001303). Accordingly, utilities of VGAM1546 include diagnosis, prevention and treatment of diseases and clinical conditions associated with COX10. Jerky Homolog-like (mouse) (JRKL, Accession NM_003772) is another VGAM1546 host target gene. JRKL BINDING SITE is HOST TARGET binding site found in the 3' untranslated region of mRNA encoded by JRKL, corresponding to a HOST TARGET binding site such as BINDING SITE I, BINDING SITE II or BINDING SITE III. Table 2 illustrates the complementarity of the nucleotide sequences of JRKL BINDING SITE, designated SEQ ID:9854, to the nucleotide sequence of VGAM1546 RNA, herein designated VGAM RNA, also designated SEQ ID:4257.

Another function of VGAM1546 is therefore inhibition of Jerky Homolog-like (mouse) (JRKL, Accession NM_003772), a gene which is a Jerky-related protein and similar to centromere binding protein-B and other nuclear regulators. Accordingly, utilities of VGAM1546 include diagnosis, prevention and treatment of diseases and clinical conditions associated with JRKL. The function of JRKL has been established by previous studies. Toth et al. (1995) found that inactivation of the mouse 'jerky' gene results in epileptic seizures. See 603210. Zeng et al. (1997) identified a human tonsil cDNA encoding a protein similar to jerky. They designated the predicted 442-amino acid protein HHMJG (human homolog of mouse jerky gene). The HHMJG and mouse jerky proteins are 35% identical. Northern blot analysis revealed that HHMJG is abundantly expressed as a 4-kb mRNA in various tissues. In testis, an additional 2-kb transcript is present. By fluorescence in situ hybridization, Zeng et al. (1997) mapped the HHMJG gene to 11q21.

Full details of the abovementioned studies are described in the following publications, the disclosure of which are hereby incorporated by reference:

Toth, M.; Grimsby, J.; Buzsaki, G.; Donovan, G. P.: Epileptic seizures caused by inactivation of a novel gene, jerky, related to centromere binding protein-B in transgenic mice. Nature Genet. 11:71-75, 1995. Note: Erratum: Nature Genet. 12:110 only, 1996; and Zeng, Z.; Kyaw, H.; Gakenheimer, K. R.; Augustus, M.; Fan, P.; Zhang, X.; Su, K.; Carter, K. C.; Li, Y.: Cloning, mapping, and tissue distribution of a human homologue of the mouse jerk.

Further studies establishing the function and utilities of JRKL are found in John Hopkins OMIM database record ID 603211, and in sited publications numbered 5438-5439 listed in the bibliography section hereinbelow, which are also hereby incorporated by reference. Microtubule-associated Protein 7 (MAP7, Accession NM_003980) is another VGAM1546 host target gene. MAP7 BINDING SITE is HOST TARGET binding site found in the 3' untranslated region of mRNA encoded by MAP7, corresponding to a HOST TARGET binding site such as BINDING SITE I, BINDING SITE II or BINDING SITE III. Table 2 illustrates the complementarity of the nucleotide sequences of MAP7 BINDING SITE, designated SEQ ID:10116, to the nucleotide sequence of VGAM1546 RNA, herein designated VGAM RNA, also designated SEQ ID:4257.

Another function of VGAM1546 is therefore inhibition of Microtubule-associated Protein 7 (MAP7, Accession NM_003980), a gene which Microtubule-associated protein 7; stabilizes microtubules, may help establish epithelial cell polarity. Accordingly, utilities of VGAM1546 include diagnosis, prevention and treatment of diseases and clinical conditions associated with MAP7. The function of MAP7 and its association with various diseases and clinical conditions, has been established by previous studies, as described hereinabove with reference to VGAM1373. Nerve Growth Factor Receptor (TNFR superfamily, member 16) (NGFR, Accession NM_002507) is another VGAM1546 host target gene. NGFR BINDING SITE is HOST TARGET binding site found in the 3' untranslated region of mRNA encoded by NGFR, corresponding to a HOST TARGET binding site such as BINDING SITE I, BINDING SITE II or BINDING SITE III. Table 2 illustrates the complementarity of the nucleotide sequences of NGFR BINDING SITE, designated SEQ ID:8329, to the nucleotide sequence of VGAM1546 RNA, herein designated VGAM RNA, also designated SEQ ID:4257.

Another function of VGAM1546 is therefore inhibition of Nerve Growth Factor Receptor (TNFR superfamily, member 16) (NGFR, Accession NM_002507), a gene which can mediate cell survival as well as cell death of neural cells. Accordingly, utilities of VGAM1546 include diagnosis, prevention and treatment of diseases and clinical conditions associated with NGFR. The function of NGFR and its association with various diseases and clinical conditions, has been established by previous studies, as described hereinabove with reference to VGAM212. CNIL (Accession NM_005776) is another VGAM1546 host target gene. CNIL BINDING SITE is HOST TARGET binding site found in the 3' untranslated region of mRNA encoded by CNIL, corresponding to a HOST TARGET binding site such as BINDING SITE I, BINDING SITE II or BINDING SITE III. Table 2 illustrates the complementarity of the nucleotide sequences of CNIL BINDING SITE, designated SEQ ID:12352, to the nucleotide sequence of VGAM1546 RNA, herein designated VGAM RNA, also designated SEQ ID:4257.

Another function of VGAM1546 is therefore inhibition of CNIL (Accession NM_005776). Accordingly, utilities of VGAM1546 include diagnosis, prevention and treatment of diseases and clinical conditions associated with CNIL. FLJ10154 (Accession NM_018011) is another VGAM1546 host target gene. FLJ10154 BINDING SITE is HOST TARGET binding site found in the 3' untranslated region of mRNA encoded by FLJ10154, corresponding to a HOST TARGET binding site such as BINDING SITE I, BINDING SITE II or BINDING SITE III. Table 2 illustrates the complementarity of the nucleotide sequences of FLJ10154 BINDING SITE, designated SEQ ID:19745, to the nucleotide sequence of VGAM1546 RNA, herein designated VGAM RNA, also designated SEQ ID:4257.

Another function of VGAM1546 is therefore inhibition of FLJ10154 (Accession NM_018011). Accordingly, utilities of VGAM1546 include diagnosis, prevention and treatment of diseases and clinical conditions associated with FLJ10154. FLJ10607 (Accession XM_085119) is another VGAM1546 host target gene. FLJ10607 BINDING SITE is HOST TARGET binding site found in the 3' untranslated region of mRNA encoded by FLJ10607, corresponding to a HOST TARGET binding site such as BINDING SITE I, BINDING SITE II or BINDING SITE III. Table 2 illustrates the complementarity of the nucleotide sequences of FLJ10607 BINDING SITE, designated SEQ ID:37834, to the nucleotide sequence of VGAM1546 RNA, herein designated VGAM RNA, also designated SEQ ID:4257.

Another function of VGAM1546 is therefore inhibition of FLJ10607 (Accession XM_085119). Accordingly, utilities of VGAM1546 include diagnosis, prevention and treatment of diseases and clinical conditions associated with FLJ10607. FLJ20189 (Accession NM_017704) is another VGAM1546 host target gene. FLJ20189 BINDING SITE is HOST TARGET binding site found in the 3' untranslated region of mRNA encoded by FLJ20189, corresponding to a HOST TARGET binding site such as BINDING SITE I, BINDING SITE II or BINDING SITE III. Table 2 illustrates the complementarity of the nucleotide sequences of FLJ20189 BINDING SITE, designated SEQ ID:19278, to the nucleotide sequence of VGAM1546 RNA, herein designated VGAM RNA, also designated SEQ ID:4257.

Another function of VGAM1546 is therefore inhibition of FLJ20189 (Accession NM_017704). Accordingly, utilities of VGAM1546 include diagnosis, prevention and treatment of diseases and clinical conditions associated with FLJ20189. KIAA1237 (Accession XM_087386) is another VGAM1546 host target gene. KIAA1237 BINDING SITE is HOST TARGET binding site found in the 3' untranslated region of mRNA encoded by KIAA1237, corresponding to a HOST TARGET binding site such as BINDING SITE I, BINDING SITE II or BINDING SITE III. Table 2 illustrates the complementarity of the nucleotide sequences of KIAA1237 BIND- ING SITE, designated SEQ ID:39217, to the nucleotide sequence of VGAM1546 RNA, herein designated VGAM RNA, also designated SEQ ID:4257.

Another function of VGAM1546 is therefore inhibition of KIAA1237 (Accession XM_087386). Accordingly, utilities of VGAM1546 include diagnosis, prevention and treatment of diseases and clinical conditions associated with KIAA1237. KIAA1573 (Accession XM_031545) is another VGAM1546 host target gene. KIAA1573 BINDING SITE is HOST TARGET binding site found in the 3' untranslated region of mRNA encoded by KIAA1573, corresponding to a HOST TARGET binding site such as BINDING SITE I, BINDING SITE II or BINDING SITE III. Table 2 illustrates the complementarity of the nucleotide sequences of KIAA1573 BINDING SITE, designated SEQ ID:31413, to the nucleotide sequence of VGAM1546 RNA, herein designated VGAM RNA, also designated SEQ ID:4257.

Another function of VGAM1546 is therefore inhibition of KIAA1573 (Accession XM_031545). Accordingly, utilities of VGAM1546 include diagnosis, prevention and treatment of diseases and clinical conditions associated with KIAA1573. KIAA1579 (Accession NM_018211) is another VGAM1546 host target gene. KIAA1579 BINDING SITE is HOST TARGET binding site found in the 3' untranslated region of mRNA encoded by KIAA1579, corresponding to a HOST TARGET binding site such as BINDING SITE I, BINDING SITE II or BINDING SITE III. Table 2 illustrates the complementarity of the nucleotide sequences of KIAA1579 BINDING SITE, designated SEQ ID:20118, to the nucleotide sequence of VGAM1546 RNA, herein designated VGAM RNA, also designated SEQ ID:4257.

Another function of VGAM1546 is therefore inhibition of KIAA1579 (Accession NM_018211). Accordingly, utilities of VGAM1546 include diagnosis, prevention and treatment of diseases and clinical conditions associated with KIAA1579. Oxysterol Binding Protein-like 8 (OSBPL8, Accession NM_020841) is another VGAM1546 host target gene. OSBPL8 BINDING SITE is HOST TARGET binding site found in the 3' untranslated region of mRNA encoded by OSBPL8, corresponding to a HOST TARGET binding site such as BINDING SITE I, BINDING SITE II or BINDING SITE III. Table 2 illustrates the complementarity of the nucleotide sequences of OSBPL8 BINDING SITE, designated SEQ ID:21903, to the nucleotide sequence of VGAM1546 RNA, herein designated VGAM RNA, also designated SEQ ID:4257.

Another function of VGAM1546 is therefore inhibition of Oxysterol Binding Protein-like 8 (OSBPL8, Accession NM_020841). Accordingly, utilities of VGAM1546 include diagnosis, prevention and treatment of diseases and clinical conditions associated with OSBPL8. P21 (CDKN1A)-activated Kinase 2 (PAK2, Accession XM_039354) is another VGAM1546 host target gene. PAK2 BINDING SITE is HOST TARGET binding site found in the 5' untranslated region of mRNA encoded by PAK2, corresponding to a HOST TARGET binding site such as BINDING SITE I, BINDING SITE II or BINDING SITE III. Table 2 illustrates the complementarity of the nucleotide sequences of PAK2 BINDING SITE, designated SEQ ID:33061, to the nucleotide sequence of VGAM1546 RNA, herein designated VGAM RNA, also designated SEQ ID:4257.

Another function of VGAM1546 is therefore inhibition of P21 (CDKN1A)-activated Kinase 2 (PAK2, Accession XM_039354). Accordingly, utilities of VGAM1546 include diagnosis, prevention and treatment of diseases and clinical conditions associated with PAK2. RAB33B, Member RAS Oncogene Family (RAB33B, Accession NM_031296) is another VGAM1546 host target gene. RAB33B BINDING SITE is HOST TARGET binding site found in the 3' untranslated region of mRNA encoded by RAB33B, corresponding to a HOST TARGET binding site such as BINDING SITE I, BINDING SITE II or BINDING SITE III. Table 2 illustrates the complementarity of the nucleotide sequences of RAB33B BINDING SITE, designated SEQ ID:25328, to the nucleotide sequence of VGAM1546 RNA, herein designated VGAM RNA, also designated SEQ ID:4257.

Another function of VGAM1546 is therefore inhibition of RAB33B, Member RAS Oncogene Family (RAB33B, Accession NM_031296). Accordingly, utilities of VGAM1546 include diagnosis, prevention and treatment of diseases and clinical conditions associated with RAB33B. Transducer of ERBB2, 2 (TOB2, Accession XM_170995) is another VGAM1546 host target gene. TOB2 BINDING SITE is HOST TARGET binding site found in the 3' untranslated region of mRNA encoded by TOB2, corresponding to a HOST TARGET binding site such as BINDING SITE I, BINDING SITE II or BINDING SITE III. Table 2 illustrates the complementarity of the nucleotide sequences of TOB2 BINDING SITE, designated SEQ ID:45760, to the nucleotide sequence of VGAM1546 RNA, herein designated VGAM RNA, also designated SEQ ID:4257.

Another function of VGAM1546 is therefore inhibition of Transducer of ERBB2, 2 (TOB2, Accession XM_170995). Accordingly, utilities of VGAM1546 include diagnosis, prevention and treatment of diseases and clinical conditions associated with TOB2. LOC158038 (Accession XM_088446) is another VGAM1546 host target gene. LOC158038 BINDING SITE is HOST TARGET binding site found in the 5' untranslated region of mRNA encoded by LOC158038, corresponding to a HOST TARGET binding site such as BINDING SITE I, BINDING SITE II or BINDING SITE III. Table 2 illustrates the complementarity of the nucleotide sequences of LOC158038 BINDING SITE, designated SEQ ID:39699, to the nucleotide sequence of VGAM1546 RNA, herein designated VGAM RNA, also designated SEQ ID:4257.

Another function of VGAM1546 is therefore inhibition of LOC158038 (Accession XM_088446). Accordingly, utilities of VGAM1546 include diagnosis, prevention and treatment of diseases and clinical conditions associated with LOC158038. LOC51141 (Accession XM_043953) is another VGAM1546 host target gene. LOC51141 BINDING SITE is HOST TARGET binding site found in the 3' untranslated region of mRNA encoded by LOC51141, corresponding to a HOST TARGET binding site such as BINDING SITE I, BINDING SITE II or BINDING SITE III. Table 2 illustrates the complementarity of the nucleotide sequences of LOC51141 BINDING SITE, designated SEQ ID:34047, to the nucleotide sequence of VGAM1546 RNA, herein designated VGAM RNA, also designated SEQ ID:4257.

Another function of VGAM1546 is therefore inhibition of LOC51141 (Accession XM_043953). Accordingly, utilities of VGAM1546 include diagnosis, prevention and treatment of diseases and clinical conditions associated with LOC51141. FIG. 1 further provides a conceptual description of a novel bioinformatically detected viral gene of the present invention, referred to here as Viral Genomic Address Messenger 1547 (VGAM1547) viral gene, which modulates expression of respective host target genes thereof, the function and utility of which host target genes is known in the art.

VGAM1547 is a novel bioinformatically detected regulatory, non protein coding, viral micro RNA (miRNA) gene. The method by which VGAM1547 was detected is described hereinabove with reference to FIGS. 1-8.

VGAM1547 gene, herein designated VGAM GENE, is a viral gene contained in the genome of Vaccinia Virus. VGAM1547 host target gene, herein designated VGAM HOST TARGET GENE, is a human gene contained in the human genome.

VGAM1547 gene encodes a VGAM1547 precursor RNA, herein designated VGAM PRECURSOR RNA. Similar to other miRNA genes, and unlike most ordinary genes, VGAM1547 precursor RNA does not encode a protein. A nucleotide sequence identical or highly similar to the nucleotide sequence of VGAM1547 precursor RNA is designated SEQ ID:1533, and is provided hereinbelow with reference to the sequence listing part. Nucleotide sequence SEQ ID:1533 is located at position 64695 relative to the genome of Vaccinia Virus.

VGAM1547 precursor RNA folds onto itself, forming VGAM1547 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1547 folded precursor RNA into VGAM1547 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1547 RNA is designated SEQ ID:4258, and is provided hereinbelow with reference to the sequence listing part.

VGAM1547 host target gene, herein designated VGAM HOST TARGET GENE, encodes a corresponding messenger RNA, VGAM1547 host target RNA, herein designated VGAM HOST TARGET RNA. VGAM1547 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1547 RNA, herein designated VGAM RNA, binds complementarily to one or more host target binding sites located in untranslated regions of VGAM1547 host target RNA, herein designated VGAM HOST TARGET RNA. This complementary binding is due to the fact that the nucleotide sequence of VGAM1547 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1547 RNA, herein designated VGAM RNA, may have a different number of host target binding sites in untranslated regions of a VGAM1547 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1547 RNA, herein designated VGAM RNA, to host target binding sites on VGAM1547 host target RNA, herein designated VGAM HOST TARGET RNA, such as BINDING SITE I, BINDING SITE II and BINDING SITE III, inhibits translation of VGAM1547 host target RNA into VGAM1547 host target protein, herein designated VGAM HOST TARGET PROTEIN. VGAM host target protein is therefore outlined by a broken line.

It is appreciated that VGAM1547 host target gene, herein designated VGAM HOST TARGET GENE, in fact represents a plurality of VGAM1547 host target genes. The mRNA of each one of this plurality of VGAM1547 host target genes comprises one or more host target binding sites, each having a nucleotide sequence which is at least partly complementary to VGAM1547 RNA, herein designated VGAM RNA, and which when bound by VGAM1547 RNA causes inhibition of translation of respective one or more VGAM1547 host target proteins.

It is further appreciated by one skilled in the art that the mode of translational inhibition illustrated by FIG. 1 with specific reference to translational inhibition exerted by VGAM1547 gene, herein designated VGAM GENE, on one or more VGAM1547 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1547 is inhibition of expression of host target genes, as part of a novel viral mechanism of attacking a host. Accordingly, utilities of VGAM1547 include diagnosis, prevention and treatment of viral infection by Vaccinia Virus. Specific functions, and accordingly utilities, of VGAM1547 correlate with, and may be deduced from, the identity of the host target genes which VGAM1547 binds and inhibits, and the function of these host target genes, as elaborated hereinbelow.

Nucleotide sequences of the VGAM1547 precursor RNA, herein designated VGAM PRECURSOR RNA, and of the 'diced' VGAM1547 RNA, herein designated VGAM RNA, and a schematic representation of the secondary folding of VGAM1547 folded precursor RNA, herein designated VGAM FOLDED PRECURSOR RNA, of VGAM1547 are further described hereinbelow with reference to Table 1.

Nucleotide sequences of host target binding sites, such as BINDING SITE-I, BINDING SITE-II and BINDING SITE-III of FIG. 1, found on VGAM1547 host target RNA, and schematic representation of the complementarity of each of these host target binding sites to VGAM1547 RNA, herein designated VGAM RNA, are described hereinbelow with reference to Table 2.

As mentioned hereinabove with reference to FIG. 1, a function of VGAM1547 gene, herein designated VGAM is inhibition of expression of VGAM1547 target genes. It is appreciated that specific functions, and accordingly utilities, of VGAM1547 correlate with, and may be deduced from, the identity of the target genes which VGAM1547 binds and inhibits, and the function of these target genes, as elaborated hereinbelow.

Apical Protein-like (Xenopus laevis) (APXL, Accession NM_001649) is a VGAM1547 host target gene. APXL BINDING SITE is HOST TARGET binding site found in the 3' untranslated region of mRNA encoded by APXL, corresponding to a HOST TARGET binding site such as BINDING SITE I, BINDING SITE II or BINDING SITE III. Table 2 illustrates the complementarity of the nucleotide sequences of APXL BINDING SITE, designated SEQ ID:7352, to the nucleotide sequence of VGAM1547 RNA, herein designated VGAM RNA, also designated SEQ ID:4258.

A function of VGAM1547 is therefore inhibition of Apical Protein-like (Xenopus laevis) (APXL, Accession NM_001649), a gene which is implicated in amiloride-sensitive sodium channel activity. Accordingly, utilities of VGAM1547 include diagnosis, prevention and treatment of diseases and clinical conditions associated with APXL. The function of APXL and its association with various diseases and clinical conditions, has been established by previous studies, as described hereinabove with reference to VGAM152. Cockayne Syndrome 1 (classical) (CKN1, Accession NM_000082) is another VGAM1547 host target gene. CKN1 BINDING SITE is HOST TARGET binding site found in the 3' untranslated region of mRNA encoded by CKN1, corresponding to a HOST TARGET binding site such as BINDING SITE I, BINDING SITE II or BINDING SITE III. Table 2 illustrates the complementarity of the nucleotide sequences of CKN1 BINDING SITE, designated SEQ ID:5529, to the nucleotide sequence of VGAM1547 RNA, herein designated VGAM RNA, also designated SEQ ID:4258.

Another function of VGAM1547 is therefore inhibition of Cockayne Syndrome 1 (classical) (CKN1, Accession NM_000082). Accordingly, utilities of VGAM1547 include diagnosis, prevention and treatment of diseases and clinical conditions associated with CKN1. High Mobility Group AT-hook 2 (HMGA2, Accession NM_003483) is another VGAM1547 host target gene. HMGA2 BINDING SITE is HOST TARGET binding site found in the 3' untranslated region of mRNA encoded by HMGA2, corresponding to a HOST TARGET binding site such as BINDING SITE I, BINDING SITE II or BINDING SITE III. Table 2 illustrates the complementarity of the nucleotide sequences of HMGA2 BINDING SITE, designated SEQ ID:9561, to the nucleotide sequence of VGAM1547 RNA, herein designated VGAM RNA, also designated SEQ ID:4258.

Another function of VGAM1547 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM1547 include diagnosis, prevention and treatment of diseases and clinical conditions associated with HMGA2. The function of HMGA2 and its association with various diseases and clinical conditions, has been established by previous studies, as described hereinabove with reference to VGAM552. Zinc Finger Protein 36 (KOX 18) (ZNF36, Accession XM_168302) is another VGAM1547 host target gene. ZNF36 BINDING SITE is HOST TARGET binding site found in the 3' untranslated region of mRNA encoded by ZNF36, corresponding to a HOST TARGET binding site such as BINDING SITE I, BINDING SITE II or BINDING SITE III. Table 2 illustrates the complementarity of the nucleotide sequences of ZNF36 BINDING SITE, designated SEQ ID:45101, to the nucleotide sequence of VGAM1547 RNA, herein designated VGAM RNA, also designated SEQ ID:4258.

Another function of VGAM1547 is therefore inhibition of Zinc Finger Protein 36 (KOX 18) (ZNF36, Accession XM_168302), a gene which may be involved in transcriptional regulation. Accordingly, utilities of VGAM1547 include diagnosis, prevention and treatment of diseases and clinical conditions associated with ZNF36. The function of ZNF36 and its association with various diseases and clinical conditions, has been established by previous studies, as described hereinabove with reference to VGAM804. FLJ23191 (Accession NM_024574) is another VGAM1547 host target gene. FLJ23191 BINDING SITE is HOST TARGET binding site found in the 3' untranslated region of mRNA encoded by FLJ23191, corresponding to a HOST TARGET binding site such as BINDING SITE I, BINDING SITE II or BINDING SITE III. Table 2 illustrates the complementarity of the nucleotide sequences of FLJ23191 BINDING SITE, designated SEQ ID:23803, to the nucleotide sequence of VGAM1547 RNA, herein designated VGAM RNA, also designated SEQ ID:4258.

Another function of VGAM1547 is therefore inhibition of FLJ23191 (Accession NM_024574). Accordingly, utilities of VGAM1547 include diagnosis, prevention and treatment of diseases and clinical conditions associated with FLJ23191. KIAA0841 (Accession XM_049237) is another VGAM1547 host target gene. KIAA0841 BINDING SITE is HOST TARGET binding site found in the 3' untranslated region of mRNA encoded by KIAA0841, corresponding to a HOST TARGET binding site such as BINDING SITE I, BINDING SITE II or BINDING SITE III. Table 2 illustrates the complementarity of the nucleotide sequences of KIAA0841 BINDING SITE, designated SEQ ID:35359, to the nucleotide sequence of VGAM1547 RNA, herein designated VGAM RNA, also designated SEQ ID:4258.

Another function of VGAM1547 is therefore inhibition of KIAA0841 (Accession XM_049237). Accordingly, utilities of VGAM1547 include diagnosis, prevention and treatment of diseases and clinical conditions associated with KIAA0841. Ring Finger Protein 20 (RNF20, Accession NM_019592) is another VGAM1547 host target gene. RNF20 BINDING SITE is HOST TARGET binding site found in the 3' untranslated region of mRNA encoded by RNF20, corresponding to a HOST TARGET binding site such as BINDING SITE I, BINDING SITE II or BINDING SITE III. Table 2 illustrates the complementarity of the nucleotide sequences of RNF20 BINDING SITE, designated SEQ ID:21213, to the nucleotide sequence of VGAM1547 RNA, herein designated VGAM RNA, also designated SEQ ID:4258.

Another function of VGAM1547 is therefore inhibition of Ring Finger Protein 20 (RNF20, Accession NM_019592). Accordingly, utilities of VGAM1547 include diagnosis, prevention and treatment of diseases and clinical conditions associated with RNF20. LOC118851 (Accession XM_061180) is another VGAM1547 host target gene. LOC118851 BINDING SITE is HOST TARGET binding site found in the 3' untranslated region of mRNA encoded by LOC118851, corresponding to a HOST TARGET binding site such as BINDING SITE I, BINDING SITE II or BINDING SITE III. Table 2 illustrates the complementarity of the nucleotide sequences of LOC118851 BINDING SITE, designated SEQ ID:37199, to the nucleotide sequence of VGAM1547 RNA, herein designated VGAM RNA, also designated SEQ ID:4258.

Another function of VGAM1547 is therefore inhibition of LOC118851 (Accession XM_061180). Accordingly, utilities of VGAM1547 include diagnosis, prevention and treatment of diseases and clinical conditions associated with LOC118851. LOC150005 (Accession XM_097795) is another VGAM1547 host target gene. LOC150005 BINDING SITE is HOST TARGET binding site found in the 3' untranslated region of mRNA encoded by LOC150005, corresponding to a HOST TARGET binding site such as BIND- ING SITE I, BINDING SITE II or BINDING SITE III. Table 2 illustrates the complementarity of the nucleotide sequences of LOC150005 BINDING SITE, designated SEQ ID:41122, to the nucleotide sequence of VGAM1547 RNA, herein designated VGAM RNA, also designated SEQ ID:4258.

Another function of VGAM1547 is therefore inhibition of LOC150005 (Accession XM_097795). Accordingly, utilities of VGAM1547 include diagnosis, prevention and treatment of diseases and clinical conditions associated with LOC150005. FIG. 1 further provides a conceptual description of a novel bioinformatically detected viral gene of the present invention, referred to here as Viral Genomic Address Messenger 1548 (VGAM1548) viral gene, which modulates expression of respective host target genes thereof, the function and utility of which host target genes is known in the art.

VGAM1548 is a novel bioinformatically detected regulatory, non protein coding, viral micro RNA (miRNA) gene. The method by which VGAM1548 was detected is described hereinabove with reference to FIGS. 1-8.

VGAM1548 gene, herein designated VGAM GENE, is a viral gene contained in the genome of Macaca Mulatta Rhadinovirus. VGAM1548 host target gene, herein designated VGAM HOST TARGET GENE, is a human gene contained in the human genome.

VGAM1548 gene encodes a VGAM1548 precursor RNA, herein designated VGAM PRECURSOR RNA. Similar to other miRNA genes, and unlike most ordinary genes, VGAM1548 precursor RNA does not encode a protein. A nucleotide sequence identical or highly similar to the nucleotide sequence of VGAM1548 precursor RNA is designated SEQ ID:1534, and is provided hereinbelow with reference to the sequence listing part. Nucleotide sequence SEQ ID:1534 is located at position 113488 relative to the genome of Macaca Mulatta Rhadinovirus.

VGAM1548 precursor RNA folds onto itself, forming VGAM1548 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1548 folded precursor RNA into VGAM1548 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1548 RNA is designated SEQ ID:4259, and is provided hereinbelow with reference to the sequence listing part.

VGAM1548 host target gene, herein designated VGAM HOST TARGET GENE, encodes a corresponding messenger RNA, VGAM1548 host target RNA, herein designated VGAM HOST TARGET RNA. VGAM1548 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1548 RNA, herein designated VGAM RNA, binds complementarily to one or more host target binding sites located in untranslated regions of VGAM1548 host target RNA, herein designated VGAM HOST TARGET RNA. This complementary binding is due to the fact that the nucleotide sequence of VGAM1548 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1548 RNA, herein designated VGAM RNA, may have a different number of host target binding sites in untranslated regions of a VGAM1548 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1548 RNA, herein designated VGAM RNA, to host target binding sites on VGAM1548 host target RNA, herein designated VGAM HOST TARGET RNA, such as BINDING SITE I, BINDING SITE II and BINDING SITE III, inhibits translation of VGAM1548 host target RNA into VGAM1548 host target protein, herein designated VGAM HOST TARGET PROTEIN. VGAM host target protein is therefore outlined by a broken line.

It is appreciated that VGAM1548 host target gene, herein designated VGAM HOST TARGET GENE, in fact represents a plurality of VGAM1548 host target genes. The mRNA of each one of this plurality of VGAM1548 host target genes comprises one or more host target binding sites, each having a nucleotide sequence which is at least partly complementary to VGAM1548 RNA, herein designated VGAM RNA, and which when bound by VGAM1548 RNA causes inhibition of translation of respective one or more VGAM1548 host target proteins.

It is further appreciated by one skilled in the art that the mode of translational inhibition illustrated by FIG. 1 with specific reference to translational inhibition exerted by VGAM1548 gene, herein designated VGAM GENE, on one or more VGAM1548 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1548 is inhibition of expression of host target genes, as part of a novel viral mechanism of attacking a host. Accordingly, utilities of VGAM1548 include diagnosis, prevention and treatment of viral infection by Macaca Mulatta Rhadinovirus. Specific functions, and accordingly utilities, of VGAM1548 correlate with, and may be deduced from, the identity of the host target genes which VGAM1548 binds and inhibits, and the function of these host target genes, as elaborated hereinbelow.

Nucleotide sequences of the VGAM1548 precursor RNA, herein designated VGAM PRECURSOR RNA, and of the 'diced' VGAM1548 RNA, herein designated VGAM RNA, and a schematic representation of the secondary folding of VGAM1548 folded precursor RNA, herein designated VGAM FOLDED PRECURSOR RNA, of VGAM1548 are further described hereinbelow with reference to Table 1.

Nucleotide sequences of host target binding sites, such as BINDING SITE-I, BINDING SITE-II and BINDING SITE-III of FIG. 1, found on VGAM1548 host target RNA, and schematic representation of the complementarity of each of these host target binding sites to VGAM1548 RNA, herein designated VGAM RNA, are described hereinbelow with reference to Table 2.

As mentioned hereinabove with reference to FIG. 1, a function of VGAM1548 gene, herein designated VGAM is inhibition of expression of VGAM1548 target genes. It is appreciated that specific functions, and accordingly utilities, of VGAM1548 correlate with, and may be deduced from, the identity of the target genes which VGAM1548 binds and inhibits, and the function of these target genes, as elaborated hereinbelow.

LOC92249 (Accession XM_043814) is a VGAM1548 host target gene. LOC92249 BINDING SITE is HOST TARGET binding site found in the 3' untranslated region of mRNA encoded by LOC92249, corresponding to a HOST TARGET binding site such as BINDING SITE I, BINDING SITE II or BINDING SITE III. Table 2 illustrates the complementarity of the nucleotide sequences of LOC92249 BINDING SITE, designated SEQ ID:34020, to the nucleotide sequence of VGAM1548 RNA, herein designated VGAM RNA, also designated SEQ ID:4259.

A function of VGAM1548 is therefore inhibition of LOC92249 (Accession XM_043814). Accordingly, utilities of VGAM1548 include diagnosis, prevention and treatment of diseases and clinical conditions associated with LOC92249. FIG. 1 further provides a conceptual description of a novel bioinformatically detected viral gene of the present invention, referred to here as Viral Genomic Address Messenger 1549 (VGAM1549) viral gene, which modulates expression of respective host target genes thereof, the function and utility of which host target genes is known in the art.

VGAM1549 is a novel bioinformatically detected regulatory, non protein coding, viral micro RNA (miRNA) gene. The method by which VGAM1549 was detected is described hereinabove with reference to FIGS. 1-8.

VGAM1549 gene, herein designated VGAM GENE, is a viral gene contained in the genome of Macaca Mulatta Rhadinovirus. VGAM1549 host target gene, herein designated VGAM HOST TARGET GENE, is a human gene contained in the human genome.

VGAM1549 gene encodes a VGAM1549 precursor RNA, herein designated VGAM PRECURSOR RNA. Similar to other miRNA genes, and unlike most ordinary genes, VGAM1549 precursor RNA does not encode a protein. A nucleotide sequence identical or highly similar to the nucleotide sequence of VGAM1549 precursor RNA is designated SEQ ID:1535, and is provided hereinbelow with reference to the sequence listing part. Nucleotide sequence SEQ ID:1535 is located at position 117267 relative to the genome of Macaca Mulatta Rhadinovirus.

VGAM1549 precursor RNA folds onto itself, forming VGAM1549 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1549 folded precursor RNA into VGAM1549 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM1549 RNA is designated SEQ ID:4260, and is provided hereinbelow with reference to the sequence listing part.

VGAM1549 host target gene, herein designated VGAM HOST TARGET GENE, encodes a corresponding messenger RNA, VGAM1549 host target RNA, herein designated VGAM HOST TARGET RNA. VGAM1549 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1549 RNA, herein designated VGAM RNA, binds complementarily to one or more host target binding sites located in untranslated regions of VGAM1549 host target RNA, herein designated VGAM HOST TARGET RNA. This complementary binding is due to the fact that the nucleotide sequence of VGAM1549 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1549 RNA, herein designated VGAM RNA, may have a different number of host target binding sites in untranslated regions of a VGAM1549 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1549 RNA, herein designated VGAM RNA, to host target binding sites on VGAM1549 host target RNA, herein designated VGAM HOST TARGET RNA, such as BINDING SITE I, BINDING SITE II and BINDING SITE III, inhibits translation of VGAM1549 host target RNA into VGAM1549 host target protein, herein designated VGAM HOST TARGET PROTEIN. VGAM host target protein is therefore outlined by a broken line.

It is appreciated that VGAM1549 host target gene, herein designated VGAM HOST TARGET GENE, in fact represents a plurality of VGAM1549 host target genes. The mRNA of each one of this plurality of VGAM1549 host target genes comprises one or more host target binding sites, each having a nucleotide sequence which is at least partly complementary to VGAM1549 RNA, herein designated VGAM RNA, and which when bound by VGAM1549 RNA causes inhibition of translation of respective one or more VGAM1549 host target proteins.

It is further appreciated by one skilled in the art that the mode of translational inhibition illustrated by FIG. 1 with specific reference to translational inhibition exerted by VGAM1549 gene, herein designated VGAM GENE, on one or more VGAM1549 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let- 7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1549 is inhibition of expression of host target genes, as part of a novel viral mechanism of attacking a host. Accordingly, utilities of VGAM1549 include diagnosis, prevention and treatment of viral infection by Macaca Mulatta Rhadinovirus. Specific functions, and accordingly utilities, of VGAM1549 correlate with, and may be deduced from, the identity of the host target genes which VGAM1549 binds and inhibits, and the function of these host target genes, as elaborated hereinbelow.

Nucleotide sequences of the VGAM1549 precursor RNA, herein designated VGAM PRECURSOR RNA, and of the 'diced' VGAM1549 RNA, herein designated VGAM RNA, and a schematic representation of the secondary folding of VGAM1549 folded precursor RNA, herein designated VGAM FOLDED PRECURSOR RNA, of VGAM1549 are further described hereinbelow with reference to Table 1.

Nucleotide sequences of host target binding sites, such as BINDING SITE-I, BINDING SITE-II and BINDING SITE-III of FIG. 1, found on VGAM1549 host target RNA, and schematic representation of the complementarity of each of these host target binding sites to VGAM1549 RNA, herein designated VGAM RNA, are described hereinbelow with reference to Table 2.

As mentioned hereinabove with reference to FIG. 1, a function of VGAM1549 gene, herein designated VGAM is inhibition of expression of VGAM1549 target genes. It is appreciated that specific functions, and accordingly utilities, of VGAM1549 correlate with, and may be deduced from, the identity of the target genes which VGAM1549 binds and inhibits, and the function of these target genes, as elaborated hereinbelow.

Msh Homeo Box Homolog 2 (Drosophila) (MSX2, Accession XM_037646) is a VGAM1549 host target gene. MSX2 BINDING SITE is HOST TARGET binding site found in the 3' untranslated region of mRNA encoded by MSX2, corresponding to a HOST TARGET binding site such as BINDING SITE I, BINDING SITE II or BINDING SITE III. Table 2 illustrates the complementarity of the nucleotide sequences of MSX2 BINDING SITE, designated SEQ ID:32660, to the nucleotide sequence of VGAM1549 RNA, herein designated VGAM RNA, also designated SEQ ID:4260.

A function of VGAM1549 is therefore inhibition of Msh Homeo Box Homolog 2 (Drosophila) (MSX2, Accession XM_037646). Accordingly, utilities of VGAM1549 include diagnosis, prevention and treatment of diseases and clinical conditions associated with MSX2. FLJ10244 (Accession NM_018037) is another VGAM1549 host target gene. FLJ10244 BINDING SITE is HOST TARGET binding site found in the 3' untranslated region of mRNA encoded by FLJ10244, corresponding to a HOST TARGET binding site such as BINDING SITE I, BINDING SITE II or BINDING SITE III. Table 2 illustrates the complementarity of the nucleotide sequences of FLJ10244 BINDING SITE, designated SEQ ID:19780, to the nucleotide sequence of VGAM1549 RNA, herein designated VGAM RNA, also designated SEQ ID:4260.

Another function of VGAM1549 is therefore inhibition of FLJ10244 (Accession NM_018037). Accordingly, utilities of VGAM1549 include diagnosis, prevention and treatment of diseases and clinical conditions associated with FLJ10244.

FIG. 1 further provides a conceptual description of a novel bioinformatically detected viral gene of the present invention, referred to here as Viral Genomic Address Messenger 1550 (VGAM1550) viral gene, which modulates expression of respective host target genes thereof, the function and utility of which host target genes is known in the art.

VGAM1550 is a novel bioinformatically detected regulatory, non protein coding, viral micro RNA (miRNA) gene. The method by which VGAM1550 was detected is described hereinabove with reference to FIGS. 1-8.

VGAM1550 gene, herein designated VGAM GENE, is a viral gene contained in the genome of Macaca Mulatta Rhadinovirus. VGAM1550 host target gene, herein designated VGAM HOST TARGET GENE, is a human gene contained in the human genome.

VGAM1550 gene encodes a VGAM1550 precursor RNA, herein designated VGAM PRECURSOR RNA. Similar to other miRNA genes, and unlike most ordinary genes, VGAM1550 precursor RNA does not encode a protein. A nucleotide sequence identical or highly similar to the nucleotide sequence of VGAM1550 precursor RNA is designated SEQ ID:1536, and is provided hereinbelow with reference to the sequence listing part. Nucleotide sequence SEQ ID:1536 is located at position 114505 relative to the genome of Macaca Mulatta Rhadinovirus.

VGAM1550 precursor RNA folds onto itself, forming VGAM1550 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1550 folded precursor RNA into VGAM1550 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1550 RNA is designated SEQ ID:4261, and is provided hereinbelow with reference to the sequence listing part.

VGAM1550 host target gene, herein designated VGAM HOST TARGET GENE, encodes a corresponding messenger RNA, VGAM1550 host target RNA, herein designated VGAM HOST TARGET RNA. VGAM1550 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1550 RNA, herein designated VGAM RNA, binds complementarily to one or more host target binding sites located in untranslated regions of VGAM1550 host target RNA, herein designated VGAM HOST TARGET RNA. This complementary binding is due to the fact that the nucleotide sequence of VGAM1550 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1550 RNA, herein designated VGAM RNA, may have a different number of host target binding sites in untranslated regions of a VGAM1550 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1550 RNA, herein designated VGAM RNA, to host target binding sites on VGAM1550 host target RNA, herein designated VGAM HOST TARGET RNA, such as BINDING SITE I, BINDING SITE II and BINDING SITE III, inhibits translation of VGAM1550 host target RNA into VGAM1550 host target protein, herein designated VGAM HOST TARGET PROTEIN. VGAM host target protein is therefore outlined by a broken line.

It is appreciated that VGAM1550 host target gene, herein designated VGAM HOST TARGET GENE, in fact represents a plurality of VGAM1550 host target genes. The mRNA of each one of this plurality of VGAM1550 host target genes comprises one or more host target binding sites, each having a nucleotide sequence which is at least partly complementary to VGAM1550 RNA, herein designated VGAM RNA, and which when bound by VGAM1550 RNA causes inhibition of translation of respective one or more VGAM1550 host target proteins.

It is further appreciated by one skilled in the art that the mode of translational inhibition illustrated by FIG. 1 with specific reference to translational inhibition exerted by VGAM1550 gene, herein designated VGAM GENE, on one or more VGAM1550 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1550 is inhibition of expression of host target genes, as part of a novel viral mechanism of attacking a host. Accordingly, utilities of VGAM1550 include diagnosis, prevention and treatment of viral infection by Macaca Mulatta Rhadinovirus. Specific functions, and accordingly utilities, of VGAM1550 correlate with, and may be deduced from, the identity of the host target genes which VGAM1550 binds and inhibits, and the function of these host target genes, as elaborated hereinbelow.

Nucleotide sequences of the VGAM1550 precursor RNA, herein designated VGAM PRECURSOR RNA, and of the 'diced' VGAM1550 RNA, herein designated VGAM RNA, and a schematic representation of the secondary folding of VGAM1550 folded precursor RNA, herein designated VGAM FOLDED PRECURSOR RNA, of VGAM1550 are further described hereinbelow with reference to Table 1.

Nucleotide sequences of host target binding sites, such as BINDING SITE-I, BINDING SITE-II and BINDING SITE-III of FIG. 1, found on VGAM1550 host target RNA, and schematic representation of the complementarity of each of these host target binding sites to VGAM1550 RNA, herein designated VGAM RNA, are described hereinbelow with reference to Table 2.

As mentioned hereinabove with reference to FIG. 1, a function of VGAM1550 gene, herein designated VGAM is inhibition of expression of VGAM1550 target genes. It is appreciated that specific functions, and accordingly utilities, of VGAM1550 correlate with, and may be deduced from, the identity of the target genes which VGAM1550 binds and inhibits, and the function of these target genes, as elaborated hereinbelow.

Vinculin (VCL, Accession NM_003373) is a VGAM1550 host target gene. VCL BINDING SITE1 and VCL BINDING SITE2 are HOST TARGET binding sites found in untranslated regions of mRNA encoded by VCL, corresponding to HOST TARGET binding sites such as BINDING SITE I, BINDING SITE II or BINDING SITE III. Table 2 illustrates the complementarity of the nucleotide sequences of VCL BINDING SITE1 and VCL BINDING SITE2, designated SEQ ID:9401 and SEQ ID:15190 respectively, to the nucleotide sequence of VGAM1550 RNA, herein designated VGAM RNA, also designated SEQ ID:4261.

A function of VGAM1550 is therefore inhibition of Vinculin (VCL, Accession NM_003373). Accordingly, utilities of VGAM1550 include diagnosis, prevention and treatment of diseases and clinical conditions associated with VCL. LOC145231 (Accession XM_096740) is another VGAM1550 host target gene. LOC145231 BINDING SITE is HOST TARGET binding site found in the 5' untranslated region of mRNA encoded by LOC145231, corresponding to a HOST TARGET binding site such as BINDING SITE I, BINDING SITE II or BINDING SITE III. Table 2 illustrates the complementarity of the nucleotide sequences of LOC145231 BINDING SITE, designated SEQ ID:40519, to the nucleotide sequence of VGAM1550 RNA, herein designated VGAM RNA, also designated SEQ ID:4261.

Another function of VGAM1550 is therefore inhibition of LOC145231 (Accession XM_096740). Accordingly, utilities of VGAM1550 include diagnosis, prevention and treatment of diseases and clinical conditions associated with LOC145231. LOC221398 (Accession XM_165762) is another VGAM1550 host target gene. LOC221398 BINDING SITE is HOST TARGET binding site found in the 3' untranslated region of mRNA encoded by LOC221398, corresponding to a HOST TARGET binding site such as BINDING SITE I, BINDING SITE II or BINDING SITE III. Table 2 illustrates the complementarity of the nucleotide sequences of LOC221398 BINDING SITE, designated SEQ ID:43750, to the nucleotide sequence of VGAM1550 RNA, herein designated VGAM RNA, also designated SEQ ID:4261.

Another function of VGAM1550 is therefore inhibition of LOC221398 (Accession XM_165762). Accordingly, utilities of VGAM1550 include diagnosis, prevention and treatment of diseases and clinical conditions associated with LOC221398. LOC90594 (Accession XM_032820) is another VGAM1550 host target gene. LOC90594 BINDING SITE is HOST TARGET binding site found in the 3' untranslated region of mRNA encoded by LOC90594, corresponding to a HOST TARGET binding site such as BINDING SITE I, BINDING SITE II or BINDING SITE III. Table 2 illustrates the complementarity of the nucleotide sequences of LOC90594 BINDING SITE, designated SEQ ID:31774, to the nucleotide sequence of VGAM1550 RNA, herein designated VGAM RNA, also designated SEQ ID:4261.

Another function of VGAM1550 is therefore inhibition of LOC90594 (Accession XM_032820). Accordingly, utilities of VGAM1550 include diagnosis, prevention and treatment of diseases and clinical conditions associated with LOC90594. FIG. 1 further provides a conceptual description of a novel bioinformatically detected viral gene of the present invention, referred to here as Viral Genomic Address Messenger 1551 (VGAM1551) viral gene, which modulates expression of respective host target genes thereof, the function and utility of which host target genes is known in the art.

VGAM1551 is a novel bioinformatically detected regulatory, non protein coding, viral micro RNA (miRNA) gene. The method by which VGAM1551 was detected is described hereinabove with reference to FIGS. 1-8.

VGAM1551 gene, herein designated VGAM GENE, is a viral gene contained in the genome of Macaca Mulatta Rhadinovirus. VGAM1551 host target gene, herein designated VGAM HOST TARGET GENE, is a human gene contained in the human genome.

VGAM1551 gene encodes a VGAM1551 precursor RNA, herein designated VGAM PRECURSOR RNA. Similar to other miRNA genes, and unlike most ordinary genes, VGAM1551 precursor RNA does not encode a protein. A nucleotide sequence identical or highly similar to the nucleotide sequence of VGAM1551 precursor RNA is designated SEQ ID:1537, and is provided hereinbelow with reference to the sequence listing part. Nucleotide sequence SEQ ID:1537 is located at position 113655 relative to the genome of Macaca Mulatta Rhadinovirus.

VGAM1551 precursor RNA folds onto itself, forming VGAM1551 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1551 folded precursor RNA into VGAM1551 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1551 RNA is designated SEQ ID:4262, and is provided hereinbelow with reference to the sequence listing part.

VGAM1551 host target gene, herein designated VGAM HOST TARGET GENE, encodes a corresponding messenger RNA, VGAM1551 host target RNA, herein designated VGAM HOST TARGET RNA. VGAM1551 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1551 RNA, herein designated VGAM RNA, binds complementarily to one or more host target binding sites located in untranslated regions of VGAM1551 host target RNA, herein designated VGAM HOST TARGET RNA. This complementary binding is due to the fact that the nucleotide sequence of VGAM1551 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1551 RNA, herein designated VGAM RNA, may have a different number of host target binding sites in untranslated regions of a VGAM1551 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1551 RNA, herein designated VGAM RNA, to host target binding sites on VGAM1551 host target RNA, herein designated VGAM HOST TARGET RNA, such as BINDING SITE I, BINDING SITE II and BINDING SITE III, inhibits translation of VGAM1551 host target RNA into VGAM1551 host target protein, herein designated VGAM HOST TARGET PROTEIN. VGAM host target protein is therefore outlined by a broken line.

It is appreciated that VGAM1551 host target gene, herein designated VGAM HOST TARGET GENE, in fact represents a plurality of VGAM1551 host target genes. The mRNA of each one of this plurality of VGAM1551 host target genes comprises one or more host target binding sites, each having a nucleotide sequence which is at least partly complementary to VGAM1551 RNA, herein designated VGAM RNA, and which when bound by VGAM1551 RNA causes inhibition of translation of respective one or more VGAM1551 host target proteins.

It is further appreciated by one skilled in the art that the mode of translational inhibition illustrated by FIG. 1 with specific reference to translational inhibition exerted by VGAM1551 gene, herein designated VGAM GENE, on one or more VGAM1551 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1551 is inhibition of expression of host target genes, as part of a novel viral mechanism of attacking a host. Accordingly, utilities of VGAM1551 include diagnosis, prevention and treatment of viral infection by Macaca Mulatta Rhadinovirus. Specific functions, and accordingly utilities, of VGAM1551 correlate with, and may be deduced from, the identity of the host target genes which VGAM1551 binds and inhibits, and the function of these host target genes, as elaborated hereinbelow.

Nucleotide sequences of the VGAM1551 precursor RNA, herein designated VGAM PRECURSOR RNA, and of the 'diced' VGAM1551 RNA, herein designated VGAM RNA, and a schematic representation of the secondary folding of VGAM1551 folded precursor RNA, herein designated VGAM FOLDED PRECURSOR RNA, of VGAM1551 are further described hereinbelow with reference to Table 1.

Nucleotide sequences of host target binding sites, such as BINDING SITE-I, BINDING SITE-II and BINDING SITE-III of FIG. 1, found on VGAM1551 host target RNA, and schematic representation of the complementarity of each of these host target binding sites to VGAM1551 RNA, herein designated VGAM RNA, are described hereinbelow with reference to Table 2.

As mentioned hereinabove with reference to FIG. 1, a function of VGAM1551 gene, herein designated VGAM is inhibition of expression of VGAM1551 target genes. It is appreciated that specific functions, and accordingly utilities, of VGAM1551 correlate with, and may be deduced from, the identity of the target genes which VGAM1551 binds and inhibits, and the function of these target genes, as elaborated hereinbelow.

Calcium Channel, Voltage-dependent, Gamma Subunit 3 (CACNG3, Accession NM_006539) is a VGAM1551 host target gene. CACNG3 BINDING SITE is HOST TARGET binding site found in the 5' untranslated region of mRNA encoded by CACNG3, corresponding to a HOST TARGET binding site such as BINDING SITE I, BINDING SITE II or BINDING SITE III. Table 2 illustrates the complementarity of the nucleotide sequences of CACNG3 BINDING SITE, designated SEQ ID:13292, to the nucleotide sequence of VGAM1551 RNA, herein designated VGAM RNA, also designated SEQ ID:4262.

A function of VGAM1551 is therefore inhibition of Calcium Channel, Voltage-dependent, Gamma Subunit 3 (CACNG3, Accession NM_006539), a gene which is thought to stabilize the calcium channel in an inactivated state. Accordingly, utilities of VGAM1551 include diagnosis, prevention and treatment of diseases and clinical conditions associated with CACNG3. The function of CACNG3 has been established by previous studies. Voltage-dependent calcium channels couple membrane depolarization in a number of cellular processes. These activities are regulated by distinct channels composed of alpha-1 (e.g., CACNA1D; 114206), beta (e.g., CACNB1; 114207), alpha-2/delta (e.g., CACNA2D1; 114204), and gamma (e.g., CACNG1; 114209) subunits. By genomic sequence analysis, Black and Lennon (1999) and Burgess et al. (1999) determined that the CACNG3 gene contains 4 exons with a large first intron.

Full details of the abovementioned studies are described in the following publications, the disclosure of which are hereby incorporated by reference:

Black, J. L., III; Lennon, V. A.: Identification and cloning of putative human neuronal voltage-gated calcium channel gamma-2 and gamma-3 subunits: neurologic implications. Mayo Clin. Proc. 74:357-361, 1999. ; and Burgess, D. L.; Davis, C. F.; Gefrides, L. A.; Noebels, J. L.: Identification of three novel Ca (2+) channel gamma subunit genes reveals molecular diversification by tandem and chromoso.

Further studies establishing the function and utilities of CACNG3 are found in John Hopkins OMIM database record ID 606403, and in sited publications numbered 6188-4526 listed in the bibliography section hereinbelow, which are also hereby incorporated by reference. Golgi Reassembly Stacking Protein 1, 65 kDa (GORASP1, Accession NM_031899) is another VGAM1551 host target gene. GORASP1 BINDING SITE is HOST TARGET binding site found in the 3' untranslated region of mRNA encoded by GORASP1, corresponding to a HOST TARGET binding site such as BINDING SITE I, BINDING SITE II or BINDING SITE III. Table 2 illustrates the complementarity of the nucleotide sequences of GORASP1 BINDING SITE, designated SEQ ID:25646, to the nucleotide sequence of VGAM1551 RNA, herein designated VGAM RNA, also designated SEQ ID:4262.

Another function of VGAM1551 is therefore inhibition of Golgi Reassembly Stacking Protein 1, 65 kDa (GORASP1, Accession NM_031899), a gene which has some funtion with the Golgi apparatus. Accordingly, utilities of VGAM1551 include diagnosis, prevention and treatment of diseases and clinical conditions associated with GORASP1. The function of GORASP1 and its association with various diseases and clinical conditions, has been established by previous studies, as described hereinabove with reference to VGAM630. Leukemia Inhibitory Factor Receptor (LIFR, Accession NM_002310) is another VGAM1551 host target gene. LIFR BINDING SITE is HOST TARGET binding site found in the 3' untranslated region of mRNA encoded by LIFR, corresponding to a HOST TARGET binding site such as BINDING SITE I, BINDING SITE II or BINDING SITE III. Table 2 illustrates the complementarity of the nucleotide sequences of LIFR BINDING SITE, designated SEQ ID:8100, to the nucleotide sequence of VGAM1551 RNA, herein designated VGAM RNA, also designated SEQ ID:4262.

Another function of VGAM1551 is therefore inhibition of Leukemia Inhibitory Factor Receptor (LIFR, Accession NM_002310). Accordingly, utilities of VGAM1551 include diagnosis, prevention and treatment of diseases and clinical conditions associated with LIFR. Protein Phosphatase 2, Regulatory Subunit B (B56), Delta Isoform (PPP2R5D, Accession NM_006245) is another VGAM1551 host target gene. PPP2R5D BINDING SITE is HOST TARGET binding site found in the 3' untranslated region of mRNA encoded by PPP2R5D, corresponding to a HOST TARGET binding site such as BINDING SITE I, BINDING SITE II or BINDING SITE III. Table 2 illustrates the complementarity of the nucleotide sequences of PPP2R5D BINDING SITE, designated SEQ ID:12918, to the nucleotide sequence of VGAM1551 RNA, herein designated VGAM RNA, also designated SEQ ID:4262.

Another function of VGAM1551 is therefore inhibition of Protein Phosphatase 2, Regulatory Subunit B (B56), Delta Isoform (PPP2R5D, Accession NM_006245), a gene which is a regulatory subunit of protein phosphatase 2A. Accordingly, utilities of VGAM1551 include diagnosis, prevention and treatment of diseases and clinical conditions associated with PPP2R5D. The function of PPP2R5D and its association with various diseases and clinical conditions, has been established by previous studies, as described hereinabove with reference to VGAM96. Chromosome 21 Open Reading Frame 108 (C21orf108, Accession XM_114191) is another VGAM1551 host target gene. C21orf108 BINDING SITE is HOST TARGET binding site found in the 3' untranslated region of mRNA encoded by C21orf108, corresponding to a HOST TARGET binding site such as BINDING SITE I, BINDING SITE II or BINDING SITE III. Table 2 illustrates the complementarity of the nucleotide sequences of C21orf108 BINDING SITE, designated SEQ ID:42772, to the nucleotide sequence of VGAM1551 RNA, herein designated VGAM RNA, also designated SEQ ID:4262.

Another function of VGAM1551 is therefore inhibition of Chromosome 21 Open Reading Frame 108 (C21orf108, Accession XM_114191). Accordingly, utilities of VGAM1551 include diagnosis, prevention and treatment of diseases and clinical conditions associated with C21orf108. KIAA1161 (Accession XM_088501) is another VGAM1551 host target gene. KIAA1161 BINDING SITE is HOST TARGET binding site found in the 5' untranslated region of mRNA encoded by KIAA1161, corresponding to a HOST TARGET binding site such as BINDING SITE I, BINDING SITE II or BINDING SITE III. Table 2 illustrates the complementarity of the nucleotide sequences of KIAA1161 BINDING SITE, designated SEQ ID:39751, to the nucleotide sequence of VGAM1551 RNA, herein designated VGAM RNA, also designated SEQ ID:4262.

Another function of VGAM1551 is therefore inhibition of KIAA1161 (Accession XM_088501). Accordingly, utilities of VGAM1551 include diagnosis, prevention and treatment of diseases and clinical conditions associated with KIAA1161. KIAA1862 (Accession XM_044212) is another VGAM1551 host target gene. KIAA1862 BINDING SITE is HOST TARGET binding site found in the 3' untranslated region of mRNA encoded by KIAA1862, corresponding to a HOST TARGET binding site such as BINDING SITE I, BINDING SITE II or BINDING SITE III. Table 2 illustrates the complementarity of the nucleotide sequences of KIAA1862 BINDING SITE, designated SEQ ID:34176, to the nucleotide sequence of VGAM1551 RNA, herein designated VGAM RNA, also designated SEQ ID:4262.

Another function of VGAM1551 is therefore inhibition of KIAA1862 (Accession XM_044212). Accordingly, utilities of VGAM1551 include diagnosis, prevention and treatment of diseases and clinical conditions associated with KIAA1862. LOC148936 (Accession XM_097556) is another VGAM1551 host target gene. LOC148936 BINDING SITE is HOST TARGET binding site found in the 5' untranslated region of mRNA encoded by LOC148936, corresponding to a HOST TARGET binding site such as BINDING SITE I, BINDING SITE II or BINDING SITE III. Table 2 illustrates the complementarity of the nucleotide sequences of LOC148936 BINDING SITE, designated SEQ ID:40930, to the nucleotide sequence of VGAM1551 RNA, herein designated VGAM RNA, also designated SEQ ID:4262.

Another function of VGAM1551 is therefore inhibition of LOC148936 (Accession XM_097556). Accordingly, utilities of VGAM1551 include diagnosis, prevention and treatment of diseases and clinical conditions associated with LOC148936. LOC148938 (Accession XM_097555) is another VGAM1551 host target gene. LOC148938 BINDING SITE is HOST TARGET binding site found in the 5' untranslated region of mRNA encoded by LOC148938, corresponding to a HOST TARGET binding site such as BINDING SITE I, BINDING SITE II or BINDING SITE III. Table 2 illustrates the complementarity of the nucleotide sequences of LOC148938 BINDING SITE, designated SEQ ID:40923, to the nucleotide sequence of VGAM1551 RNA, herein designated VGAM RNA, also designated SEQ ID:4262.

Another function of VGAM1551 is therefore inhibition of LOC148938 (Accession XM_097555). Accordingly, utilities of VGAM1551 include diagnosis, prevention and treatment of diseases and clinical conditions associated with LOC148938. LOC157273 (Accession XM_098743) is another VGAM1551 host target gene. LOC157273 BINDING SITE is HOST TARGET binding site found in the 3' untranslated region of mRNA encoded by LOC157273, corresponding to a HOST TARGET binding site such as BINDING SITE I, BINDING SITE II or BINDING SITE III. Table 2 illustrates the complementarity of the nucleotide sequences of LOC157273 BINDING SITE, designated SEQ ID:41782, to the nucleotide sequence of VGAM1551 RNA, herein designated VGAM RNA, also designated SEQ ID:4262.

Another function of VGAM1551 is therefore inhibition of LOC157273 (Accession XM_098743). Accordingly, utilities of VGAM1551 include diagnosis, prevention and treatment of diseases and clinical conditions associated with LOC157273. LOC254057 (Accession XM_173085) is another VGAM1551 host target gene. LOC254057 BINDING SITE is HOST TARGET binding site found in the 3' untranslated region of mRNA encoded by LOC254057, corresponding to a HOST TARGET binding site such as BINDING SITE I, BINDING SITE II or BINDING SITE III. Table 2 illustrates the complementarity of the nucleotide sequences of LOC254057 BINDING SITE, designated SEQ ID:46350, to the nucleotide sequence of VGAM1551 RNA, herein designated VGAM RNA, also designated SEQ ID:4262.

Another function of VGAM1551 is therefore inhibition of LOC254057 (Accession XM_173085). Accordingly, utilities of VGAM1551 include diagnosis, prevention and treatment of diseases and clinical conditions associated with LOC254057. LOC255465 (Accession XM_173206) is another VGAM1551 host target gene. LOC255465 BINDING SITE is HOST TARGET binding site found in the 5' untranslated region of mRNA encoded by LOC255465, corresponding to a HOST TARGET binding site such as BINDING SITE I, BINDING SITE II or BINDING SITE III. Table 2 illustrates the complementarity of the nucleotide sequences of LOC255465 BINDING SITE, designated SEQ ID:46449, to the nucleotide sequence of VGAM1551 RNA, herein designated VGAM RNA, also designated SEQ ID:4262.

Another function of VGAM1551 is therefore inhibition of LOC255465 (Accession XM_173206). Accordingly, utilities of VGAM1551 include diagnosis, prevention and treatment of diseases and clinical conditions associated with LOC255465. LOC91947 (Accession XM_041721) is another VGAM1551 host target gene. LOC91947 BINDING SITE is HOST TARGET binding site found in the 3' untranslated region of mRNA encoded by LOC91947, corresponding to a HOST TARGET binding site such as BINDING SITE I, BINDING SITE II or BINDING SITE III. Table 2 illustrates the complementarity of the nucleotide sequences of LOC91947 BINDING SITE, designated SEQ ID:33571, to the nucleotide sequence of VGAM1551 RNA, herein designated VGAM RNA, also designated SEQ ID:4262.

Another function of VGAM1551 is therefore inhibition of LOC91947 (Accession XM_041721). Accordingly, utilities of VGAM1551 include diagnosis, prevention and treatment of diseases and clinical conditions associated with LOC91947. FIG. 1 further provides a conceptual description of a novel bioinformatically detected viral gene of the present invention, referred to here as Viral Genomic Address Messenger 1552 (VGAM1552) viral gene, which modulates expression of respective host target genes thereof, the function and utility of which host target genes is known in the art.

VGAM1552 is a novel bioinformatically detected regulatory, non protein coding, viral micro RNA (miRNA) gene. The method by which VGAM1552 was detected is described hereinabove with reference to FIGS. 1-8.

VGAM1552 gene, herein designated VGAM GENE, is a viral gene contained in the genome of Macaca Mulatta Rhadinovirus. VGAM1552 host target gene, herein designated VGAM HOST TARGET GENE, is a human gene contained in the human genome.

VGAM1552 gene encodes a VGAM1552 precursor RNA, herein designated VGAM PRECURSOR RNA. Similar to other miRNA genes, and unlike most ordinary genes, VGAM1552 precursor RNA does not encode a protein. A nucleotide sequence identical or highly similar to the nucleotide sequence of VGAM1552 precursor RNA is designated SEQ ID:1538, and is provided hereinbelow with reference to the sequence listing part. Nucleotide sequence SEQ ID:1538 is located at position 116594 relative to the genome of Macaca Mulatta Rhadinovirus.

VGAM1552 precursor RNA folds onto itself, forming VGAM1552 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1552 folded precursor RNA into VGAM1552 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1552 RNA is designated SEQ ID:4263, and is provided hereinbelow with reference to the sequence listing part.

VGAM1552 host target gene, herein designated VGAM HOST TARGET GENE, encodes a corresponding messenger RNA, VGAM1552 host target RNA, herein designated VGAM HOST TARGET RNA. VGAM1552 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1552 RNA, herein designated VGAM RNA, binds complementarily to one or more host target binding sites located in untranslated regions of VGAM1552 host target RNA, herein designated VGAM HOST TARGET RNA. This complementary binding is due to the fact that the nucleotide sequence of VGAM1552 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1552 RNA, herein designated VGAM RNA, may have a different number of host target binding sites in untranslated regions of a VGAM1552 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1552 RNA, herein designated VGAM RNA, to host target binding sites on VGAM1552 host target RNA, herein designated VGAM HOST TARGET RNA, such as BINDING SITE I, BINDING SITE II and BINDING SITE III, inhibits translation of VGAM1552 host target RNA into VGAM1552 host target protein, herein designated VGAM HOST TARGET PROTEIN. VGAM host target protein is therefore outlined by a broken line.

It is appreciated that VGAM1552 host target gene, herein designated VGAM HOST TARGET GENE, in fact represents a plurality of VGAM1552 host target genes. The mRNA of each one of this plurality of VGAM1552 host target genes comprises one or more host target binding sites, each having a nucleotide sequence which is at least partly complementary to VGAM1552 RNA, herein designated VGAM RNA, and which when bound by VGAM1552 RNA causes inhibition of translation of respective one or more VGAM1552 host target proteins.

It is further appreciated by one skilled in the art that the mode of translational inhibition illustrated by FIG. 1 with specific reference to translational inhibition exerted by VGAM1552 gene, herein designated VGAM GENE, on one or more VGAM1552 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1552 is inhibition of expression of host target genes, as part of a novel viral mechanism of attacking a host. Accordingly, utilities of VGAM1552 include diagnosis, prevention and treatment of viral infection by Macaca Mulatta Rhadinovirus. Specific functions, and accordingly utilities, of VGAM1552 correlate with, and may be deduced from, the identity of the host target genes which VGAM1552 binds and inhibits, and the function of these host target genes, as elaborated hereinbelow.

Nucleotide sequences of the VGAM1552 precursor RNA, herein designated VGAM PRECURSOR RNA, and of the 'diced' VGAM1552 RNA, herein designated VGAM RNA, and a schematic representation of the secondary folding of VGAM1552 folded precursor RNA, herein designated VGAM FOLDED PRECURSOR RNA, of VGAM1552 are further described hereinbelow with reference to Table 1.

Nucleotide sequences of host target binding sites, such as BINDING SITE-I, BINDING SITE-II and BINDING SITE-III of FIG. 1, found on VGAM1552 host target RNA, and schematic representation of the complementarity of each of these host target binding sites to VGAM1552 RNA, herein designated VGAM RNA, are described hereinbelow with reference to Table 2.

As mentioned hereinabove with reference to FIG. 1, a function of VGAM1552 gene, herein designated VGAM is inhibition of expression of VGAM1552 target genes. It is appreciated that specific functions, and accordingly utilities, of VGAM1552 correlate with, and may be deduced from, the identity of the target genes which VGAM1552 binds and inhibits, and the function of these target genes, as elaborated hereinbelow.

Cadherin Related 23 (CDH23, Accession NM_022124) is a VGAM1552 host target gene. CDH23 BINDING SITE1 and CDH23 BINDING SITE2 are HOST TARGET binding sites found in untranslated regions of mRNA encoded by CDH23, corresponding to HOST TARGET binding sites such as BINDING SITE I, BINDING SITE II or BINDING SITE III. Table 2 illustrates the complementarity of the nucleotide sequences of CDH23 BINDING SITE1 and CDH23 BINDING SITE2, designated SEQ ID:22671 and SEQ ID:27419 respectively, to the nucleotide sequence of VGAM1552 RNA, herein designated VGAM RNA, also designated SEQ ID:4263.

A function of VGAM1552 is therefore inhibition of Cadherin Related 23 (CDH23, Accession NM_022124). Accordingly, utilities of VGAM1552 include diagnosis, prevention and treatment of diseases and clinical conditions associated with CDH23. Inositol Polyphosphate-4-phosphatase, Type I, 107 kDa (INPP4A, Accession NM_001566) is another VGAM1552 host target gene. INPP4A BINDING SITE1 and INPP4A BINDING SITE2 are HOST TARGET binding sites found in untranslated regions of mRNA encoded by INPP4A, corresponding to HOST TARGET binding sites such as BINDING SITE I, BINDING SITE II or BINDING SITE III. Table 2 illustrates the complementarity of the nucleotide sequences of INPP4A BINDING SITE1 and INPP4A BINDING SITE2, designated SEQ ID:7295 and SEQ ID:10247 respectively, to the nucleotide sequence of VGAM1552 RNA, herein designated VGAM RNA, also designated SEQ ID:4263.

Another function of VGAM1552 is therefore inhibition of Inositol Polyphosphate-4-phosphatase, Type I, 107 kDa (INPP4A, Accession NM_001566), a gene which catalyzes the hydrolysis of the 4-position phosphate of inositol 3,4-bisphosphate and inositol 1,3,4-trisphosphate. Accordingly, utilities of VGAM1552 include diagnosis, prevention and treatment of diseases and clinical conditions associated with INPP4A. The function of INPP4A has been established by previous studies. Inositol polyphosphate 4-phosphatase catalyzes the hydrolysis of the 4-position phosphate of inositol 3,4-bisphosphate and inositol 1,3,4-trisphosphate. It also catalyzes, at a much higher rate, the hydrolysis of the 4-position phosphate of phosphatidylinositol 3,4-bisphosphate. Norris et al. (1995) noted that the latter activity has been implicated in mitogenesis mediated by PDGF receptor, the oxidative burst of neutrophils, and translocation of the glucose transporter to the plasma membrane. Norris et al. (1995) purified the enzyme from rat brain and obtained partial amino acid sequence from which degenerate primers were designed. A PCR product was obtained and used to isolate a 5,607-bp composite cDNA which encodes a 939-amino acid reading frame from the rat. The authors screened a human brain cDNA library and identified a sequence that predicts a 938-amino acid protein which is 97% identical to the rat protein. Recombinant protein was shown to have the appropriate enzymatic activity. Northern blots indicated that, in the rat, the gene is widely expressed with highest levels in the brain, heart, and skeletal muscle Full details of the abovementioned studies are described in the following publications, the disclosure of which are hereby incorporated by reference:

Joseph, R. E.; Walker, J.; Norris, F. A.: Assignment of the inositol polyphosphate 4-phosphatase type I gene (INPP4A) to human chromosome band 2q11.2 by in situ hybridization. Cytogenet. Cell Genet. 87:276-277, 1999; and Norris, F. A.; Auethavekiat, V.; Majerus, P. W.: The isolation and characterization of cDNA encoding human and rat brain inositol polyphosphate 4-phosphatase. J. Biol. Chem. 270:16128.

Further studies establishing the function and utilities of INPP4A are found in John Hopkins OMIM database record ID 600916, and in sited publications numbered 9612-9613 listed in the bibliography section hereinbelow, which are also hereby incorporated by reference. Topoisomerase (DNA) III Beta (TOP3B, Accession NM_003935) is another VGAM1552 host target gene. TOP3B BINDING SITE is HOST TARGET binding site found in the 5' untranslated region of mRNA encoded by TOP3B, corresponding to a HOST TARGET binding site such as BINDING SITE I, BINDING SITE II or BINDING SITE III. Table 2 illustrates the complementarity of the nucleotide sequences of TOP3B BINDING SITE, designated SEQ ID:10038, to the nucleotide sequence of VGAM1552 RNA, herein designated VGAM RNA, also designated SEQ ID:4263.

Another function of VGAM1552 is therefore inhibition of Topoisomerase (DNA) III Beta (TOP3B, Accession NM_003935). Accordingly, utilities of VGAM1552 include diagnosis, prevention and treatment of diseases and clinical conditions associated with TOP3B. Ubiquitin Specific Protease 1 (USP1, Accession NM_003368) is another VGAM1552 host target gene. USP1 BINDING SITE is HOST TARGET binding site found in the 5' untranslated region of mRNA encoded by USP1, corresponding to a HOST TARGET binding site such as BINDING SITE I, BINDING SITE II or BINDING SITE III. Table 2 illustrates the complementarity of the nucleotide sequences of USP1 BINDING SITE, designated SEQ ID:9392, to the nucleotide sequence of VGAM1552 RNA, herein designated VGAM RNA, also designated SEQ ID:4263.

Another function of VGAM1552 is therefore inhibition of Ubiquitin Specific Protease 1 (USP1, Accession NM_003368). Accordingly, utilities of VGAM1552 include diagnosis, prevention and treatment of diseases and clinical conditions associated with USP1. XT3 (Accession NM_020208) is another VGAM1552 host target gene. XT3 BINDING SITE is HOST TARGET binding site found in the 3' untranslated region of mRNA encoded by XT3, corresponding to a HOST TARGET binding site such as BINDING SITE I, BINDING SITE II or BINDING SITE III. Table 2 illustrates the complementarity of the nucleotide sequences of XT3 BINDING SITE, designated SEQ ID:21439, to the nucleotide sequence of VGAM1552 RNA, herein designated VGAM RNA, also designated SEQ ID:4263.

Another function of VGAM1552 is therefore inhibition of XT3 (Accession NM_020208), a gene which is a Kidney-specific orphan transporter. Accordingly, utilities of VGAM1552 include diagnosis, prevention and treatment of diseases and clinical conditions associated with XT3. The function of XT3 and its association with various diseases and clinical conditions, has been established by previous studies, as described hereinabove with reference to VGAM21. Chromosome 20 Open Reading Frame 39 (C20orf39, Accession NM_024893) is another VGAM1552 host target gene. C20orf39 BINDING SITE is HOST TARGET binding site found in the 5" untranslated region of mRNA encoded by C20orf39, corresponding to a HOST TARGET binding site such as BINDING SITE I, BINDING SITE II or BINDING SITE III. Table 2 illustrates the complementarity of the nucleotide sequences of C20orf39 BINDING SITE, designated SEQ ID:24369, to the nucleotide sequence of VGAM1552 RNA, herein designated VGAM RNA, also designated SEQ ID:4263.

Another function of VGAM1552 is therefore inhibition of Chromosome 20 Open Reading Frame 39 (C20orf39, Accession NM_024893). Accordingly, utilities of VGAM1552 include diagnosis, prevention and treatment of diseases and clinical conditions associated with C20orf39. EHM2 (Accession NM_019114) is another VGAM1552 host target gene. EHM2 BINDING SITE is HOST TARGET binding site found in the 5' untranslated region of mRNA encoded by EHM2, corresponding to a HOST TARGET binding site such as BINDING SITE I, BINDING SITE II or BINDING SITE III. Table 2 illustrates the complementarity of the nucleotide sequences of EHM2 BINDING SITE, designated SEQ ID:21189, to the nucleotide sequence of VGAM1552 RNA, herein designated VGAM RNA, also designated SEQ ID:4263.

Another function of VGAM1552 is therefore inhibition of EHM2 (Accession NM_019114). Accordingly, utilities of VGAM1552 include diagnosis, prevention and treatment of diseases and clinical conditions associated with EHM2. FLJ10116 (Accession NM_018000) is another VGAM1552 host target gene. FLJ10116 BINDING SITE is HOST TARGET binding site found in the 5' untranslated region of mRNA encoded by FLJ10116, corresponding to a HOST TARGET binding site such as BINDING SITE I, BINDING SITE II or BINDING SITE III. Table 2 illustrates the complementarity of the nucleotide sequences of FLJ10116 BINDING SITE, designated SEQ ID:19727, to the nucleotide sequence of VGAM1552 RNA, herein designated VGAM RNA, also designated SEQ ID:4263.

Another function of VGAM1552 is therefore inhibition of FLJ10116 (Accession NM_018000). Accordingly, utilities of VGAM1552 include diagnosis, prevention and treatment of diseases and clinical conditions associated with FLJ10116. KIAA0217 (Accession XM_040265) is another VGAM1552 host target gene. KIAA0217 BINDING SITE is HOST TARGET binding site found in the 3' untranslated region of mRNA encoded by KIAA0217, corresponding to a HOST TARGET binding site such as BINDING SITE I, BINDING SITE II or BINDING SITE III. Table 2 illustrates the complementarity of the nucleotide sequences of KIAA0217 BINDING SITE, designated SEQ ID:33283, to the nucleotide sequence of VGAM1552 RNA, herein designated VGAM RNA, also designated SEQ ID:4263.

Another function of VGAM1552 is therefore inhibition of KIAA0217 (Accession XM_040265). Accordingly, utilities of VGAM1552 include diagnosis, prevention and treatment of diseases and clinical conditions associated with KIAA0217. KIAA0427 (Accession NM_014772) is another VGAM1552 host target gene. KIAA0427 BINDING SITE is HOST TARGET binding site found in the 5' untranslated region of mRNA encoded by KIAA0427, corresponding to a HOST TARGET binding site such as BINDING SITE I, BINDING SITE II or BINDING SITE III. Table 2 illustrates the complementarity of the nucleotide sequences of KIAA0427 BINDING SITE, designated SEQ ID:16577, to the nucleotide sequence of VGAM1552 RNA, herein designated VGAM RNA, also designated SEQ ID:4263.

Another function of VGAM1552 is therefore inhibition of KIAA0427 (Accession NM_014772). Accordingly, utilities of VGAM1552 include diagnosis, prevention and treatment of diseases and clinical conditions associated with KIAA0427. KIAA0618 (Accession NM_014833) is another VGAM1552 host target gene. KIAA0618 BINDING SITE is HOST TARGET binding site found in the 5' untranslated region of mRNA encoded by KIAA0618, corresponding to a HOST TARGET binding site such as BINDING SITE I, BINDING SITE II or BINDING SITE III. Table 2 illustrates the complementarity of the nucleotide sequences of KIAA0618 BINDING SITE, designated SEQ ID:16836, to the nucleotide sequence of VGAM1552 RNA, herein designated VGAM RNA, also designated SEQ ID:4263.

Another function of VGAM1552 is therefore inhibition of KIAA0618 (Accession NM_014833). Accordingly, utilities of VGAM1552 include diagnosis, prevention and treatment of diseases and clinical conditions associated with KIAA0618. KIAA0649 (Accession NM_014811) is another VGAM1552 host target gene. KIAA0649 BINDING SITE is HOST TARGET binding site found in the 5' untranslated region of mRNA encoded by KIAA0649, corresponding to a HOST TARGET binding site such as BINDING SITE I, BINDING SITE II or BINDING SITE III. Table 2 illustrates the complementarity of the nucleotide sequences of KIAA0649 BINDING SITE, designated SEQ ID:16774, to the nucleotide sequence of VGAM1552 RNA, herein designated VGAM RNA, also designated SEQ ID:4263.

Another function of VGAM1552 is therefore inhibition of KIAA0649 (Accession NM_014811). Accordingly, utilities of VGAM1552 include diagnosis, prevention and treatment of diseases and clinical conditions associated with KIAA0649. PC2 (positive cofactor 2, multiprotein complex) Glutamine/Q-rich-associated Protein (PCQAP, Accession NM_015889) is another VGAM1552 host target gene. PCQAP BINDING SITE is HOST TARGET binding site found in the 3' untranslated region of mRNA encoded by PCQAP, corresponding to a HOST TARGET binding site such as BINDING SITE I, BINDING SITE II or BINDING SITE III. Table 2 illustrates the complementarity of the nucleotide sequences of PCQAP BINDING SITE, designated SEQ ID:18033, to the nucleotide sequence of VGAM1552 RNA, herein designated VGAM RNA, also designated SEQ ID:4263.

Another function of VGAM1552 is therefore inhibition of PC2 (positive cofactor 2, multiprotein complex) Glutamine/Q-rich-associated Protein (PCQAP, Accession NM_015889). Accordingly, utilities of VGAM1552 include diagnosis, prevention and treatment of diseases and clinical conditions associated with PCQAP. Solute Carrier Family 16 (monocarboxylic acid transporters), Member 10 (SLC16A10, Accession NM_018593) is another VGAM1552 host target gene. SLC16A10 BINDING SITE is HOST TARGET binding site found in the 5' untranslated region of mRNA encoded by SLC16A10, corresponding to a HOST TARGET binding site such as BINDING SITE I, BINDING SITE II or BINDING SITE III. Table 2 illustrates the complementarity of the nucleotide sequences of SLC16A10 BINDING SITE, designated SEQ ID:20673, to the nucleotide sequence of VGAM1552 RNA, herein designated VGAM RNA, also designated SEQ ID:4263.

Another function of VGAM1552 is therefore inhibition of Solute Carrier Family 16 (monocarboxylic acid transporters), Member 10 (SLC16A10, Accession NM_018593). Accordingly, utilities of VGAM1552 include diagnosis, prevention and treatment of diseases and clinical conditions associated with SLC16A10. LOC125704 (Accession XM_058931) is another VGAM1552 host target gene. LOC125704 BINDING SITE is HOST TARGET binding site found in the 5' untranslated region of mRNA encoded by LOC125704, corresponding to a HOST TARGET binding site such as BINDING SITE I, BINDING SITE II or BINDING SITE III. Table 2 illustrates the complementarity of the nucleotide sequences of LOC125704 BINDING SITE, designated SEQ ID:36800, to the nucleotide sequence of VGAM1552 RNA, herein designated VGAM RNA, also designated SEQ ID:4263.

Another function of VGAM1552 is therefore inhibition of LOC125704 (Accession XM_058931). Accordingly, utilities of VGAM1552 include diagnosis, prevention and treatment of diseases and clinical conditions associated with LOC125704. LOC134121 (Accession XM_059692) is another VGAM1552 host target gene. LOC134121 BINDING SITE is HOST TARGET binding site found in the 5' untranslated region of mRNA encoded by LOC134121, corresponding to a HOST TARGET binding site such as BINDING SITE I, BINDING SITE II or BINDING SITE III. Table 2 illustrates the complementarity of the nucleotide sequences of LOC134121 BINDING SITE, designated SEQ ID:37064, to the nucleotide sequence of VGAM1552 RNA, herein designated VGAM RNA, also designated SEQ ID:4263.

Another function of VGAM1552 is therefore inhibition of LOC134121 (Accession XM_059692). Accordingly, utilities of VGAM1552 include diagnosis, prevention and treatment of diseases and clinical conditions associated with LOC134121. LOC145945 (Accession XM_096908) is another VGAM1552 host target gene. LOC145945 BINDING SITE is HOST TARGET binding site found in the 5' untranslated region of mRNA encoded by LOC145945, corresponding to a HOST TARGET binding site such as BINDING SITE I, BINDING SITE II or BINDING SITE III. Table 2 illustrates the complementarity of the nucleotide sequences of LOC145945 BINDING SITE, designated SEQ ID:40634, to the nucleotide sequence of VGAM1552 RNA, herein designated VGAM RNA, also designated SEQ ID:4263.

Another function of VGAM1552 is therefore inhibition of LOC145945 (Accession XM_096908). Accordingly, utilities of VGAM1552 include diagnosis, prevention and treatment of diseases and clinical conditions associated with LOC145945. LOC158263 (Accession XM_088530) is another VGAM1552 host target gene. LOC158263 BINDING SITE is HOST TARGET binding site found in the 5' untranslated region of mRNA encoded by LOC158263, corresponding to a HOST TARGET binding site such as BINDING SITE I, BINDING SITE II or BINDING SITE III. Table 2 illustrates the complementarity of the nucleotide sequences of LOC158263 BINDING SITE, designated SEQ ID:39799, to the nucleotide sequence of VGAM1552 RNA, herein designated VGAM RNA, also designated SEQ ID:4263.

Another function of VGAM1552 is therefore inhibition of LOC158263 (Accession XM_088530). Accordingly, utilities of VGAM1552 include diagnosis, prevention and treatment of diseases and clinical conditions associated with LOC158263. LOC253502 (Accession XM_170561) is another VGAM1552 host target gene. LOC253502 BINDING SITE is HOST TARGET binding site found in the 3' untranslated region of mRNA encoded by LOC253502, corresponding to a HOST TARGET binding site such as BINDING SITE I, BINDING SITE II or BINDING SITE III. Table 2 illustrates the complementarity of the nucleotide sequences of LOC253502 BINDING SITE, designated SEQ ID:45383, to the nucleotide sequence of VGAM1552 RNA, herein designated VGAM RNA, also designated SEQ ID:4263.

Another function of VGAM1552 is therefore inhibition of LOC253502 (Accession XM_170561). Accordingly, utilities of VGAM1552 include diagnosis, prevention and treatment of diseases and clinical conditions associated with LOC253502. FIG. 1 further provides a conceptual description of a novel bioinformatically detected viral gene of the present invention, referred to here as Viral Genomic Address Messenger 1553 (VGAM1553) viral gene, which modulates expression of respective host target genes thereof, the function and utility of which host target genes is known in the art.

VGAM1553 is a novel bioinformatically detected regulatory, non protein coding, viral micro RNA (miRNA) gene. The method by which VGAM1553 was detected is described hereinabove with reference to FIGS. 1-8.

VGAM1553 gene, herein designated VGAM GENE, is a viral gene contained in the genome of Macaca Mulatta Rhadinovirus. VGAM1553 host target gene, herein designated VGAM HOST TARGET GENE, is a human gene contained in the human genome.

VGAM1553 gene encodes a VGAM1553 precursor RNA, herein designated VGAM PRECURSOR RNA. Similar to other miRNA genes, and unlike most ordinary genes, VGAM1553 precursor RNA does not encode a protein. A nucleotide sequence identical or highly similar to the nucleotide sequence of VGAM1553 precursor RNA is designated SEQ ID:1539, and is provided hereinbelow with reference to the sequence listing part. Nucleotide sequence SEQ ID:1539 is located at position 113170 relative to the genome of Macaca Mulatta Rhadinovirus.

VGAM1553 precursor RNA folds onto itself, forming VGAM1553 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1553 folded precursor RNA into VGAM1553 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM1553 RNA is designated SEQ ID:4264, and is provided hereinbelow with reference to the sequence listing part.

VGAM1553 host target gene, herein designated VGAM HOST TARGET GENE, encodes a corresponding messenger RNA, VGAM1553 host target RNA, herein designated VGAM HOST TARGET RNA. VGAM1553 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1553 RNA, herein designated VGAM RNA, binds complementarily to one or more host target binding sites located in untranslated regions of VGAM1553 host target RNA, herein designated VGAM HOST TARGET RNA. This complementary binding is due to the fact that the nucleotide sequence of VGAM1553 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1553 RNA, herein designated VGAM RNA, may have a different number of host target binding sites in untranslated regions of a VGAM1553 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1553 RNA, herein designated VGAM RNA, to host target binding sites on VGAM1553 host target RNA, herein designated VGAM HOST TARGET RNA, such as BINDING SITE I, BINDING SITE II and BINDING SITE III, inhibits translation of VGAM1553 host target RNA into VGAM1553 host target protein, herein designated VGAM HOST TARGET PROTEIN. VGAM host target protein is therefore outlined by a broken line.

It is appreciated that VGAM1553 host target gene, herein designated VGAM HOST TARGET GENE, in fact represents a plurality of VGAM1553 host target genes. The mRNA of each one of this plurality of VGAM1553 host target genes comprises one or more host target binding sites, each having a nucleotide sequence which is at least partly complementary to VGAM1553 RNA, herein designated VGAM RNA, and which when bound by VGAM1553 RNA causes inhibition of translation of respective one or more VGAM1553 host target proteins.

It is further appreciated by one skilled in the art that the mode of translational inhibition illustrated by FIG. 1 with specific reference to translational inhibition exerted by VGAM1553 gene, herein designated VGAM GENE, on one or more VGAM1553 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1553 is inhibition of expression of host target genes, as part of a novel viral mechanism of attacking a host. Accordingly, utilities of VGAM1553 include diagnosis, prevention and treatment of viral infection by Macaca Mulatta Rhadinovirus. Specific functions, and accordingly utilities, of VGAM1553 correlate with, and may be deduced from, the identity of the host target genes which VGAM1553 binds and inhibits, and the function of these host target genes, as elaborated hereinbelow.

Nucleotide sequences of the VGAM1553 precursor RNA, herein designated VGAM PRECURSOR RNA, and of the 'diced' VGAM1553 RNA, herein designated VGAM RNA, and a schematic representation of the secondary folding of VGAM1553 folded precursor RNA, herein designated VGAM FOLDED PRECURSOR RNA, of VGAM1553 are further described hereinbelow with reference to Table 1.

Nucleotide sequences of host target binding sites, such as BINDING SITE-I, BINDING SITE-II and BINDING SITE-III of FIG. 1, found on VGAM1553 host target RNA, and schematic representation of the complementarity of each of these host target binding sites to VGAM1553 RNA, herein designated VGAM RNA, are described hereinbelow with reference to Table 2.

As mentioned hereinabove with reference to FIG. 1, a function of VGAM1553 gene, herein designated VGAM is inhibition of expression of VGAM1553 target genes. It is appreciated that specific functions, and accordingly utilities, of VGAM1553 correlate with, and may be deduced from, the identity of the target genes which VGAM1553 binds and inhibits, and the function of these target genes, as elaborated hereinbelow.

DKFZP564O0463 (Accession NM_014156) is a VGAM1553 host target gene. DKFZP564O0463 BINDING SITE is HOST TARGET binding site found in the 3' untranslated region of mRNA encoded by DKFZP564O0463, corresponding to a HOST TARGET binding site such as BINDING SITE I, BINDING SITE II or BINDING SITE III. Table 2 illustrates the complementarity of the nucleotide sequences of DKFZP564O0463 BINDING SITE, designated SEQ ID:15442, to the nucleotide sequence of VGAM1553 RNA, herein designated VGAM RNA, also designated SEQ ID:4264.

A function of VGAM1553 is therefore inhibition of DKFZP564O0463 (Accession NM_014156). Accordingly, utilities of VGAM1553 include diagnosis, prevention and treatment of diseases and clinical conditions associated with DKFZP564O0463. KIAA0987 (Accession NM_012307) is another VGAM1553 host target gene. KIAA0987 BINDING SITE is HOST TARGET binding site found in the 3' untranslated region of mRNA encoded by KIAA0987, corresponding to a HOST TARGET binding site such as BINDING SITE I, BINDING SITE II or BINDING SITE III. Table 2 illustrates the complementarity of the nucleotide sequences of KIAA0987 BINDING SITE, designated SEQ ID:14675, to the nucleotide sequence of VGAM1553 RNA, herein designated VGAM RNA, also designated SEQ ID:4264.

Another function of VGAM1553 is therefore inhibition of KIAA0987 (Accession NM_012307). Accordingly, utilities of VGAM1553 include diagnosis, prevention and treatment of diseases and clinical conditions associated with KIAA0987. LOC116411 (Accession XM_058095) is another VGAM1553 host target gene. LOC116411 BINDING SITE is HOST TARGET binding site found in the 5' untranslated region of mRNA encoded by LOC116411, corresponding to a HOST TARGET binding site such as BINDING SITE I, BINDING SITE II or BINDING SITE III. Table 2 illustrates the complementarity of the nucleotide sequences of LOC116411 BINDING SITE, designated SEQ ID:36571, to the nucleotide sequence of VGAM1553 RNA, herein designated VGAM RNA, also designated SEQ ID:4264.

Another function of VGAM1553 is therefore inhibition of LOC116411 (Accession XM_058095). Accordingly, utilities of VGAM1553 include diagnosis, prevention and treatment of diseases and clinical conditions associated with LOC116411. LOC90620 (Accession XM_032986) is another VGAM1553 host target gene. LOC90620 BINDING SITE is HOST TARGET binding site found in the 5' untranslated region of mRNA encoded by LOC90620, corresponding to a HOST TARGET binding site such as BINDING SITE I, BINDING SITE II or BINDING SITE III. Table 2 illustrates the complementarity of the nucleotide sequences of LOC90620 BINDING SITE, designated SEQ ID:31806, to the nucleotide sequence of VGAM1553 RNA, herein designated VGAM RNA, also designated SEQ ID:4264.

Another function of VGAM1553 is therefore inhibition of LOC90620 (Accession XM_032986). Accordingly, utilities of VGAM1553 include diagnosis, prevention and treatment of diseases and clinical conditions associated with LOC90620. FIG. 1 further provides a conceptual description of a novel bioinformatically detected viral gene of the present invention, referred to here as Viral Genomic Address Messenger 1554 (VGAM1554) viral gene, which modulates expression of respective host target genes thereof, the function and utility of which host target genes is known in the art.

VGAM1554 is a novel bioinformatically detected regulatory, non protein coding, viral micro RNA (miRNA) gene. The method by which VGAM1554 was detected is described hereinabove with reference to FIGS. 1-8.

VGAM1554 gene, herein designated VGAM GENE, is a viral gene contained in the genome of Macaca Mulatta Rhadinovirus. VGAM1554 host target gene, herein designated VGAM HOST TARGET GENE, is a human gene contained in the human genome.

VGAM1554 gene encodes a VGAM1554 precursor RNA, herein designated VGAM PRECURSOR RNA. Similar to other miRNA genes, and unlike most ordinary genes, VGAM1554 precursor RNA does not encode a protein. A nucleotide sequence identical or highly similar to the nucleotide sequence of VGAM1554 precursor RNA is designated SEQ ID:1540, and is provided hereinbelow with reference to the sequence listing part. Nucleotide sequence SEQ ID:1540 is located at position 118520 relative to the genome of Macaca Mulatta Rhadinovirus.

VGAM1554 precursor RNA folds onto itself, forming VGAM1554 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1554 folded precursor RNA into VGAM1554 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1554 RNA is designated SEQ ID:4265, and is provided hereinbelow with reference to the sequence listing part.

VGAM1554 host target gene, herein designated VGAM HOST TARGET GENE, encodes a corresponding messenger RNA, VGAM1554 host target RNA, herein designated VGAM HOST TARGET RNA. VGAM1554 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1554 RNA, herein designated VGAM RNA, binds complementarily to one or more host target binding sites located in untranslated regions of VGAM1554 host target RNA, herein designated VGAM HOST TARGET RNA. This complementary binding is due to the fact that the nucleotide sequence of VGAM1554 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1554 RNA, herein designated VGAM RNA, may have a different number of host target binding sites in untranslated regions of a VGAM1554 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1554 RNA, herein designated VGAM RNA, to host target binding sites on VGAM1554 host target RNA, herein designated VGAM HOST TARGET RNA, such as BINDING SITE I, BINDING SITE II and BINDING SITE III, inhibits translation of VGAM1554 host target RNA into VGAM1554 host target protein, herein designated VGAM HOST TARGET PROTEIN. VGAM host target protein is therefore outlined by a broken line.

It is appreciated that VGAM1554 host target gene, herein designated VGAM HOST TARGET GENE, in fact represents a plurality of VGAM1554 host target genes. The mRNA of each one of this plurality of VGAM1554 host target genes comprises one or more host target binding sites, each having a nucleotide sequence which is at least partly complementary to VGAM1554 RNA, herein designated VGAM RNA, and which when bound by VGAM1554 RNA causes inhibition of translation of respective one or more VGAM1554 host target proteins.

It is further appreciated by one skilled in the art that the mode of translational inhibition illustrated by FIG. 1 with specific reference to translational inhibition exerted by VGAM1554 gene, herein designated VGAM GENE, on one or more VGAM1554 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1554 is inhibition of expression of host target genes, as part of a novel viral mechanism of attacking a host. Accordingly, utilities of VGAM1554 include diagnosis, prevention and treatment of viral infection by Macaca Mulatta Rhadinovirus. Specific functions, and accordingly utilities, of VGAM1554 correlate with, and may be deduced from, the identity of the host target genes which VGAM1554 binds and inhibits, and the function of these host target genes, as elaborated hereinbelow.

Nucleotide sequences of the VGAM1554 precursor RNA, herein designated VGAM PRECURSOR RNA, and of the 'diced' VGAM1554 RNA, herein designated VGAM RNA, and a schematic representation of the secondary folding of VGAM1554 folded precursor RNA, herein designated VGAM FOLDED PRECURSOR RNA, of VGAM1554 are further described hereinbelow with reference to Table 1.

Nucleotide sequences of host target binding sites, such as BINDING SITE-I, BINDING SITE-II and BINDING SITE-III of FIG. 1, found on VGAM1554 host target RNA, and schematic representation of the complementarity of each of these host target binding sites to VGAM1554 RNA, herein designated VGAM RNA, are described hereinbelow with reference to Table 2.

As mentioned hereinabove with reference to FIG. 1, a function of VGAM1554 gene, herein designated VGAM is inhibition of expression of VGAM1554 target genes. It is appreciated that specific functions, and accordingly utilities, of VGAM1554 correlate with, and may be deduced from, the identity of the target genes which VGAM1554 binds and inhibits, and the function of these target genes, as elaborated hereinbelow.

ATPase, Aminophospholipid Transporter-like, Class I, Type 8A, Member 2 (ATP8A2, Accession XM_167916) is a VGAM1554 host target gene. ATP8A2 BINDING SITE is HOST TARGET binding site found in the 3' untranslated region of mRNA encoded by ATP8A2, corresponding to a HOST TARGET binding site such as BINDING SITE I, BINDING SITE II or BINDING SITE III. Table 2 illustrates the complementarity of the nucleotide sequences of ATP8A2 BINDING SITE, designated SEQ ID:44923, to the nucleotide sequence of VGAM1554 RNA, herein designated VGAM RNA, also designated SEQ ID:4265.

A function of VGAM1554 is therefore inhibition of ATPase, Aminophospholipid Transporter-like, Class I, Type 8A, Member 2 (ATP8A2, Accession XM_167916). Accordingly, utilities of VGAM1554 include diagnosis, prevention and treatment of diseases and clinical conditions associated with ATP8A2. Lipin 1 (LPIN1, Accession XM_041136) is another VGAM1554 host target gene. LPIN1 BINDING SITE is HOST TARGET binding site found in the 3' untranslated region of mRNA encoded by LPIN1, corresponding to a HOST TARGET binding site such as BINDING SITE I, BINDING SITE II or BINDING SITE III. Table 2 illustrates the complementarity of the nucleotide sequences of LPIN1 BINDING SITE, designated SEQ ID:33465, to the nucleotide sequence of VGAM1554 RNA, herein designated VGAM RNA, also designated SEQ ID:4265.

Another function of VGAM1554 is therefore inhibition of Lipin 1 (LPIN1, Accession XM_041136), a gene which is involved in adipocyte differenciation (by similarity). Accordingly, utilities of VGAM1554 include diagnosis, prevention and treatment of diseases and clinical conditions associated with LPIN1. The function of LPIN1 and its association with various diseases and clinical conditions, has been established by previous studies, as described hereinabove with reference to VGAM35. Claudin 15 (CLDN15, Accession NM_138429) is another VGAM1554 host target gene. CLDN15 BINDING SITE is HOST TARGET binding site found in the 3' untranslated region of mRNA encoded by CLDN15, corresponding to a HOST TARGET binding site such as BINDING SITE I, BINDING SITE II or BINDING SITE III. Table 2 illustrates the complementarity of the nucleotide sequences of CLDN15 BINDING SITE, designated SEQ ID:28793, to the nucleotide sequence of VGAM1554 RNA, herein designated VGAM RNA, also designated SEQ ID:4265.

Another function of VGAM1554 is therefore inhibition of Claudin 15 (CLDN15, Accession NM_138429). Accordingly, utilities of VGAM1554 include diagnosis, prevention and treatment of diseases and clinical conditions associated with CLDN15. DKFZp762K222 (Accession XM_048721) is another VGAM1554 host target gene. DKFZp762K222 BINDING SITE is HOST TARGET binding site found in the 5' untranslated region of mRNA encoded by DKFZp762K222, corresponding to a HOST TARGET binding site such as BINDING SITE I, BINDING SITE II or BINDING SITE III. Table 2 illustrates the complementarity of the nucleotide sequences of DKFZp762K222 BINDING SITE, designated SEQ ID:35235, to the nucleotide sequence of VGAM1554 RNA, herein designated VGAM RNA, also designated SEQ ID:4265.

Another function of VGAM1554 is therefore inhibition of DKFZp762K222 (Accession XM_048721). Accordingly, utilities of VGAM1554 include diagnosis, prevention and treatment of diseases and clinical conditions associated with DKFZp762K222. FLJ10932 (Accession NM_018277) is another VGAM1554 host target gene. FLJ10932 BINDING SITE is HOST TARGET binding site found in the 3' untranslated region of mRNA encoded by FLJ10932, corresponding to a HOST TARGET binding site such as BINDING SITE I, BINDING SITE II or BINDING SITE III. Table 2 illustrates the complementarity of the nucleotide sequences of FLJ10932 BINDING SITE, designated SEQ ID:20265, to the nucleotide sequence of VGAM1554 RNA, herein designated VGAM RNA, also designated SEQ ID:4265.

Another function of VGAM1554 is therefore inhibition of FLJ10932 (Accession NM_018277). Accordingly, utilities of VGAM1554 include diagnosis, prevention and treatment of diseases and clinical conditions associated with FLJ10932. FLJ23231 (Accession NM_025079) is another VGAM1554 host target gene. FLJ23231 BINDING SITE is HOST TARGET binding site found in the 3' untranslated region of mRNA encoded by FLJ23231, corresponding to a HOST TARGET binding site such as BINDING SITE I, BINDING SITE II or BINDING SITE III. Table 2 illustrates the complementarity of the nucleotide sequences of FLJ23231 BINDING SITE, designated SEQ ID:24680, to the nucleotide sequence of VGAM1554 RNA, herein designated VGAM RNA, also designated SEQ ID:4265.

Another function of VGAM1554 is therefore inhibition of FLJ23231 (Accession NM_025079). Accordingly, utilities of VGAM1554 include diagnosis, prevention and treatment of diseases and clinical conditions associated with FLJ23231. PIG7 (Accession NM_004862) is another VGAM1554 host target gene. PIG7 BINDING SITE is HOST TARGET binding site found in the 5' untranslated region of mRNA encoded by PIG7, corresponding to a HOST TARGET binding site such as BINDING SITE I, BINDING SITE II or BINDING SITE III. Table 2 illustrates the complementarity of the nucleotide sequences of PIG7 BINDING SITE, designated SEQ ID:11270, to the nucleotide sequence of VGAM1554 RNA, herein designated VGAM RNA, also designated SEQ ID:4265.

Another function of VGAM1554 is therefore inhibition of PIG7 (Accession NM_004862). Accordingly, utilities of VGAM1554 include diagnosis, prevention and treatment of diseases and clinical conditions associated with PIG7. LOC152317 (Accession XM_098189) is another VGAM1554 host target gene. LOC152317 BINDING SITE is HOST TARGET binding site found in the 3' untranslated region of mRNA encoded by LOC152317, corresponding to a HOST TARGET binding site such as BINDING SITE I, BINDING SITE II or BINDING SITE III. Table 2 illustrates the complementarity of the nucleotide sequences of LOC152317 BINDING SITE, designated SEQ ID:41469, to the nucleotide sequence of VGAM1554 RNA, herein designated VGAM RNA, also designated SEQ ID:4265.

Another function of VGAM1554 is therefore inhibition of LOC152317 (Accession XM_098189). Accordingly, utilities of VGAM1554 include diagnosis, prevention and treatment of diseases and clinical conditions associated with LOC152317. LOC196761 (Accession XM_116865) is another VGAM1554 host target gene. LOC196761 BINDING SITE is HOST TARGET binding site found in the 3' untranslated region of mRNA encoded by LOC196761, corresponding to a HOST TARGET binding site such as BINDING SITE I, BINDING SITE II or BINDING SITE III. Table 2 illustrates the complementarity of the nucleotide sequences of LOC196761 BINDING SITE, designated SEQ ID:43129, to the nucleotide sequence of VGAM1554 RNA, herein designated VGAM RNA, also designated SEQ ID:4265.

Another function of VGAM1554 is therefore inhibition of LOC196761 (Accession XM_116865). Accordingly, utilities of VGAM1554 include diagnosis, prevention and treatment of diseases and clinical conditions associated with LOC196761. FIG. 1 further provides a conceptual description of a novel bioinformatically detected viral gene of the present invention, referred to here as Viral Genomic Address Messenger 1555 (VGAM1555) viral gene, which modulates expression of respective host target genes thereof, the function and utility of which host target genes is known in the art.

VGAM1555 is a novel bioinformatically detected regulatory, non protein coding, viral micro RNA (miRNA) gene. The method by which VGAM1555 was detected is described hereinabove with reference to FIGS. 1-8.

VGAM1555 gene, herein designated VGAM GENE, is a viral gene contained in the genome of Macaca Mulatta Rhadinovirus. VGAM1555 host target gene, herein designated VGAM HOST TARGET GENE, is a human gene contained in the human genome.

VGAM1555 gene encodes a VGAM1555 precursor RNA, herein designated VGAM PRECURSOR RNA. Similar to other miRNA genes, and unlike most ordinary genes, VGAM1555 precursor RNA does not encode a protein. A nucleotide sequence identical or highly similar to the nucleotide sequence of VGAM1555 precursor RNA is designated SEQ ID:1541, and is provided hereinbelow with reference to the sequence listing part. Nucleotide sequence SEQ ID:1541 is located at position 118330 relative to the genome of Macaca Mulatta Rhadinovirus.

VGAM1555 precursor RNA folds onto itself, forming VGAM1555 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1555 folded precursor RNA into VGAM1555 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 78%) nucleotide sequence of VGAM1555 RNA is designated SEQ ID:4266, and is provided hereinbelow with reference to the sequence listing part.

VGAM1555 host target gene, herein designated VGAM HOST TARGET GENE, encodes a corresponding messenger RNA, VGAM1555 host target RNA, herein designated VGAM HOST TARGET RNA. VGAM1555 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1555 RNA, herein designated VGAM RNA, binds complementarily to one or more host target binding sites located in untranslated regions of VGAM1555 host target RNA, herein designated VGAM HOST TARGET RNA. This complementary binding is due to the fact that the nucleotide sequence of VGAM1555 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1555 RNA, herein designated VGAM RNA, may have a different number of host target binding sites in untranslated regions of a VGAM1555 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1555 RNA, herein designated VGAM RNA, to host target binding sites on VGAM1555 host target RNA, herein designated VGAM HOST TARGET RNA, such as BINDING SITE I, BINDING SITE II and BINDING SITE III, inhibits translation of VGAM1555 host target RNA into VGAM1555 host target protein, herein designated VGAM HOST TARGET PROTEIN. VGAM host target protein is therefore outlined by a broken line.

It is appreciated that VGAM1555 host target gene, herein designated VGAM HOST TARGET GENE, in fact represents a plurality of VGAM1555 host target genes. The mRNA of each one of this plurality of VGAM1555 host target genes comprises one or more host target binding sites, each having a nucleotide sequence which is at least partly complementary to VGAM1555 RNA, herein designated VGAM RNA, and which when bound by VGAM1555 RNA causes inhibition of translation of respective one or more VGAM1555 host target proteins.

It is further appreciated by one skilled in the art that the mode of translational inhibition illustrated by FIG. 1 with specific reference to translational inhibition exerted by VGAM1555 gene, herein designated VGAM GENE, on one or more VGAM1555 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1555 is inhibition of expression of host target genes, as part of a novel viral mechanism of attacking a host. Accordingly, utilities of VGAM1555 include diagnosis, prevention and treatment of viral infection by Macaca Mulatta Rhadinovirus. Specific functions, and accordingly utilities, of VGAM1555 correlate with, and may be deduced from, the identity of the host target genes which VGAM1555 binds and inhibits, and the function of these host target genes, as elaborated hereinbelow.

Nucleotide sequences of the VGAM1555 precursor RNA, herein designated VGAM PRECURSOR RNA, and of the 'diced' VGAM1555 RNA, herein designated VGAM RNA, and a schematic representation of the secondary folding of VGAM1555 folded precursor RNA, herein designated VGAM FOLDED PRECURSOR RNA, of VGAM1555 are further described hereinbelow with reference to Table 1.

Nucleotide sequences of host target binding sites, such as BINDING SITE-I, BINDING SITE-II and BINDING SITE-III of FIG. 1, found on VGAM1555 host target RNA, and schematic representation of the complementarity of each of these host target binding sites to VGAM1555 RNA, herein designated VGAM RNA, are described hereinbelow with reference to Table 2.

As mentioned hereinabove with reference to FIG. 1, a function of VGAM1555 gene, herein designated VGAM is inhibition of expression of VGAM1555 target genes. It is appreciated that specific functions, and accordingly utilities, of VGAM1555 correlate with, and may be deduced from, the identity of the target genes which VGAM1555 binds and inhibits, and the function of these target genes, as elaborated hereinbelow.

Colony Stimulating Factor 1 Receptor, Formerly McDonough Feline Sarcoma Viral (v-fms) Oncogene Homolog (CSF1R, Accession NM_005211) is a VGAM1555 host target gene. CSF1R BINDING SITE is HOST TARGET binding site found in the 3' untranslated region of mRNA encoded by CSF1R, corresponding to a HOST TARGET binding site such as BINDING SITE I, BINDING SITE II or BINDING SITE III. Table 2 illustrates the complementarity of the nucleotide sequences of CSF1R BINDING SITE, designated SEQ ID:11709, to the nucleotide sequence of VGAM1555 RNA, herein designated VGAM RNA, also designated SEQ ID:4266.

A function of VGAM1555 is therefore inhibition of Colony Stimulating Factor 1 Receptor, Formerly McDonough Feline Sarcoma Viral (v-fms) Oncogene Homolog (CSF1R, Accession NM_005211), a gene which is involved in regulation of growth and differentiation of myeloid cells. Accordingly, utilities of VGAM1555 include diagnosis, prevention and treatment of diseases and clinical conditions associated with CSF1R. The function of CSF1R and its association with various diseases and clinical conditions, has been established by previous studies, as described hereinabove with reference to VGAM297. Neurobeachin (NBEA, Accession XM_170732) is another VGAM1555 host target gene. NBEA BINDING SITE is HOST TARGET binding site found in the 3' untranslated region of mRNA encoded by NBEA, corresponding to a HOST TARGET binding site such as BINDING SITE I, BINDING SITE II or BINDING SITE III. Table 2 illustrates the complementarity of the nucleotide sequences of NBEA BINDING SITE, designated SEQ ID:45493, to the nucleotide sequence of VGAM1555 RNA, herein designated VGAM RNA, also designated SEQ ID:4266.

Another function of VGAM1555 is therefore inhibition of Neurobeachin (NBEA, Accession XM_170732), a gene which may mediate protein-protein interactions. Accordingly, utilities of VGAM1555 include diagnosis, prevention and treatment of diseases and clinical conditions associated with NBEA. The function of NBEA and its association with various diseases and clinical conditions, has been established by previous studies, as described hereinabove with reference to VGAM459. EDR3 (Accession XM_172303) is another VGAM1555 host target gene. EDR3 BINDING SITE is HOST TARGET binding site found in the 5' untranslated region of mRNA encoded by EDR3, corresponding to a HOST TARGET binding site such as BINDING SITE I, BINDING SITE II or BINDING SITE III. Table 2 illustrates the complementarity of the nucleotide sequences of EDR3 BINDING SITE, designated SEQ ID:46068, to the nucleotide sequence of VGAM1555 RNA, herein designated VGAM RNA, also designated SEQ ID:4266.

Another function of VGAM1555 is therefore inhibition of EDR3 (Accession XM_172303). Accordingly, utilities of VGAM1555 include diagnosis, prevention and treatment of diseases and clinical conditions associated with EDR3. FLJ14621 (Accession NM_032811) is another VGAM1555 host target gene. FLJ14621 BINDING SITE is HOST TARGET binding site found in the 3' untranslated region of mRNA encoded by FLJ14621, corresponding to a HOST TARGET binding site such as BINDING SITE I, BINDING SITE II or BINDING SITE III. Table 2 illustrates the complementarity of the nucleotide sequences of FLJ14621 BINDING SITE, designated SEQ ID:26581, to the nucleotide sequence of VGAM1555 RNA, herein designated VGAM RNA, also designated SEQ ID:4266.

Another function of VGAM1555 is therefore inhibition of FLJ14621 (Accession NM_032811). Accordingly, utilities of VGAM1555 include diagnosis, prevention and treatment of diseases and clinical conditions associated with FLJ14621. KIAA1157 (Accession XM_051093) is another VGAM1555 host target gene. KIAA1157 BINDING SITE is HOST TARGET binding site found in the 5' untranslated region of mRNA encoded by KIAA1157, corresponding to a HOST TARGET binding site such as BINDING SITE I, BINDING SITE II or BINDING SITE III. Table 2 illustrates the complementarity of the nucleotide sequences of KIAA1157 BINDING SITE, designated SEQ ID:35753, to the nucleotide sequence of VGAM1555 RNA, herein designated VGAM RNA, also designated SEQ ID:4266.

Another function of VGAM1555 is therefore inhibition of KIAA1157 (Accession XM_051093). Accordingly, utilities of VGAM1555 include diagnosis, prevention and treatment of diseases and clinical conditions associated with KIAA1157. Oxysterol Binding Protein-like 6 (OSBPL6, Accession NM_032523) is another VGAM1555 host target gene. OSBPL6 BINDING SITE is HOST TARGET binding site found in the 5' untranslated region of mRNA encoded by OSBPL6, corresponding to a HOST TARGET binding site such as BINDING SITE I, BINDING SITE II or BINDING SITE III. Table 2 illustrates the complementarity of the nucleotide sequences of OSBPL6 BINDING SITE, designated SEQ ID:26270, to the nucleotide sequence of VGAM1555 RNA, herein designated VGAM RNA, also designated SEQ ID:4266.

Another function of VGAM1555 is therefore inhibition of Oxysterol Binding Protein-like 6 (OSBPL6, Accession NM_032523). Accordingly, utilities of VGAM1555 include diagnosis, prevention and treatment of diseases and clinical conditions associated with OSBPL6. LOC221583 (Accession XM_166396) is another VGAM1555 host target gene. LOC221583 BINDING SITE is HOST TARGET binding site found in the 3' untranslated region of mRNA encoded by LOC221583, corresponding to a HOST TARGET binding site such as BINDING SITE I, BINDING SITE II or BINDING SITE III. Table 2 illustrates the complementarity of the nucleotide sequences of LOC221583 BINDING SITE, designated SEQ ID:44246, to the nucleotide sequence of VGAM1555 RNA, herein designated VGAM RNA, also designated SEQ ID:4266.

Another function of VGAM1555 is therefore inhibition of LOC221583 (Accession XM_166396). Accordingly, utilities of VGAM1555 include diagnosis, prevention and treatment of diseases and clinical conditions associated with LOC221583. LOC253943 (Accession XM_171195) is another VGAM1555 host target gene. LOC253943 BINDING SITE is HOST TARGET binding site found in the 5' untranslated region of mRNA encoded by LOC253943, corresponding to a HOST TARGET binding site such as BINDING SITE I, BINDING SITE II or BINDING SITE III. Table 2 illustrates the complementarity of the nucleotide sequences of LOC253943 BINDING SITE, designated SEQ ID:45984, to the nucleotide sequence of VGAM1555 RNA, herein designated VGAM RNA, also designated SEQ ID:4266.

Another function of VGAM1555 is therefore inhibition of LOC253943 (Accession XM_171195). Accordingly, utilities of VGAM1555 include diagnosis, prevention and treatment of diseases and clinical conditions associated with LOC253943. FIG. 1 further provides a conceptual description of a novel bioinformatically detected viral gene of the present invention, referred to here as Viral Genomic Address Messenger 1556 (VGAM1556) viral gene, which modulates expression of respective host target genes thereof, the function and utility of which host target genes is known in the art.

VGAM1556 is a novel bioinformatically detected regulatory, non protein coding, viral micro RNA (miRNA) gene. The method by which VGAM1556 was detected is described hereinabove with reference to FIGS. 1-8.

VGAM1556 gene, herein designated VGAM GENE, is a viral gene contained in the genome of Macaca Mulatta Rhadinovirus. VGAM1556 host target gene, herein designated VGAM HOST TARGET GENE, is a human gene contained in the human genome.

VGAM1556 gene encodes a VGAM1556 precursor RNA, herein designated VGAM PRECURSOR RNA. Similar to other miRNA genes, and unlike most ordinary genes, VGAM1556 precursor RNA does not encode a protein. A nucleotide sequence identical or highly similar to the nucleotide sequence of VGAM1556 precursor RNA is designated SEQ ID:1542, and is provided hereinbelow with reference to the sequence listing part. Nucleotide sequence SEQ ID:1542 is located at position 114675 relative to the genome of Macaca Mulatta Rhadinovirus.

VGAM1556 precursor RNA folds onto itself, forming VGAM1556 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1556 folded precursor RNA into VGAM1556 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM1556 RNA is designated SEQ ID:4267, and is provided hereinbelow with reference to the sequence listing part.

VGAM1556 host target gene, herein designated VGAM HOST TARGET GENE, encodes a corresponding messenger RNA, VGAM1556 host target RNA, herein designated VGAM HOST TARGET RNA. VGAM1556 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1556 RNA, herein designated VGAM RNA, binds complementarily to one or more host target binding sites located in untranslated regions of VGAM1556 host target RNA, herein designated VGAM HOST TARGET RNA. This complementary binding is due to the fact that the nucleotide sequence of VGAM1556 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1556 RNA, herein designated VGAM RNA, may have a different number of host target binding sites in untranslated regions of a VGAM1556 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1556 RNA, herein designated VGAM RNA, to host target binding sites on VGAM1556 host target RNA, herein designated VGAM HOST TARGET RNA, such as BINDING SITE I, BINDING SITE II and BINDING SITE III, inhibits translation of VGAM1556 host target RNA into VGAM1556 host target protein, herein designated VGAM HOST TARGET PROTEIN. VGAM host target protein is therefore outlined by a broken line.

It is appreciated that VGAM1556 host target gene, herein designated VGAM HOST TARGET GENE, in fact represents a plurality of VGAM1556 host target genes. The mRNA of each one of this plurality of VGAM1556 host target genes comprises one or more host target binding sites, each having a nucleotide sequence which is at least partly complementary to VGAM1556 RNA, herein designated VGAM RNA, and which when bound by VGAM1556 RNA causes inhibition of translation of respective one or more VGAM1556 host target proteins.

It is further appreciated by one skilled in the art that the mode of translational inhibition illustrated by FIG. 1 with specific reference to translational inhibition exerted by VGAM1556 gene, herein designated VGAM GENE, on one or more VGAM1556 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1556 is inhibition of expression of host target genes, as part of a novel viral mechanism of attacking a host. Accordingly, utilities of VGAM1556 include diagnosis, prevention and treatment of viral infection by Macaca Mulatta Rhadinovirus. Specific functions, and accordingly utilities, of VGAM1556 correlate with, and may be deduced from, the identity of the host target genes which VGAM1556 binds and inhibits, and the function of these host target genes, as elaborated hereinbelow.

Nucleotide sequences of the VGAM1556 precursor RNA, herein designated VGAM PRECURSOR RNA, and of the 'diced' VGAM1556 RNA, herein designated VGAM RNA, and a schematic representation of the secondary folding of VGAM1556 folded precursor RNA, herein designated VGAM FOLDED PRECURSOR RNA, of VGAM1556 are further described hereinbelow with reference to Table 1.

Nucleotide sequences of host target binding sites, such as BINDING SITE-I, BINDING SITE-II and BINDING SITE-III of FIG. 1, found on VGAM1556 host target RNA, and schematic representation of the complementarity of each of these host target binding sites to VGAM1556 RNA, herein designated VGAM RNA, are described hereinbelow with reference to Table 2.

As mentioned hereinabove with reference to FIG. 1, a function of VGAM1556 gene, herein designated VGAM is inhibition of expression of VGAM1556 target genes. It is appreciated that specific functions, and accordingly utilities, of VGAM1556 correlate with, and may be deduced from, the identity of the target genes which VGAM1556 binds and inhibits, and the function of these target genes, as elaborated hereinbelow.

Rac/Cdc42 Guanine Nucleotide Exchange Factor (GEF) 6 (ARHGEF6, Accession XM_042963) is a VGAM1556 host target gene. ARHGEF6 BINDING SITE is HOST TARGET binding site found in the 3' untranslated region of mRNA encoded by ARHGEF6, corresponding to a HOST TARGET binding site such as BINDING SITE I, BINDING SITE II or BINDING SITE III. Table 2 illustrates the complementarity of the nucleotide sequences of ARHGEF6 BINDING SITE, designated SEQ ID:33841, to the nucleotide sequence of VGAM1556 RNA, herein designated VGAM RNA, also designated SEQ ID:4267.

A function of VGAM1556 is therefore inhibition of Rac/Cdc42 Guanine Nucleotide Exchange Factor (GEF) 6 (ARHGEF6, Accession XM_042963). Accordingly, utilities of VGAM1556 include diagnosis, prevention and treatment of diseases and clinical conditions associated with ARHGEF6. Multiple Endocrine Neoplasia I (MEN1, Accession NM_130803) is another VGAM1556 host target gene. MEN1 BINDING SITE is HOST TARGET binding site found in the 5' untranslated region of mRNA encoded by MEN1, corresponding to a HOST TARGET binding site such as BINDING SITE I, BINDING SITE II or BINDING SITE III. Table 2 illustrates the complementarity of the nucleotide sequences of MEN1 BINDING SITE, designated SEQ ID:28295, to the nucleotide sequence of VGAM1556 RNA, herein designated VGAM RNA, also designated SEQ ID:4267.

Another function of VGAM1556 is therefore inhibition of Multiple Endocrine Neoplasia I (MEN1, Accession NM_130803). Accordingly, utilities of VGAM1556 include diagnosis, prevention and treatment of diseases and clinical conditions associated with MEN1. Myosin X (MYO10, Accession NM_012334) is another VGAM1556 host target gene. MYO10 BINDING SITE is HOST TARGET binding site found in the 3' untranslated region of mRNA encoded by MYO10, corresponding to a HOST TARGET binding site such as BINDING SITE I, BINDING SITE II or BINDING SITE III. Table 2 illustrates the complementarity of the nucleotide sequences of MYO10 BINDING SITE, designated SEQ ID:14728, to the nucleotide sequence of VGAM1556 RNA, herein designated VGAM RNA, also designated SEQ ID:4267.

Another function of VGAM1556 is therefore inhibition of Myosin X (MYO10, Accession NM_012334), a gene which is an unconventional myosin. Accordingly, utilities of VGAM1556 include diagnosis, prevention and treatment of diseases and clinical conditions associated with MYO10. The function of MYO10 and its association with various diseases and clinical conditions, has been established by previous studies, as described hereinabove with reference to VGAM28. Bromodomain Containing 4 (BRD4, Accession NM_058243) is another VGAM1556 host target gene. BRD4 BINDING SITE is HOST TARGET binding site found in the 3' untranslated region of mRNA encoded by BRD4, corresponding to a HOST TARGET binding site such as BINDING SITE I, BINDING SITE II or BINDING SITE III. Table 2 illustrates the complementarity of the nucleotide sequences of BRD4 BINDING SITE, designated SEQ ID:27777, to the nucleotide sequence of VGAM1556 RNA, herein designated VGAM RNA, also designated SEQ ID:4267.

Another function of VGAM1556 is therefore inhibition of Bromodomain Containing 4 (BRD4, Accession NM_058243). Accordingly, utilities of VGAM1556 include diagnosis, prevention and treatment of diseases and clinical conditions associated with BRD4. FLJ10415 (Accession NM_018089) is another VGAM1556 host target gene. FLJ10415 BINDING SITE is HOST TARGET binding site found in the 3' untranslated region of mRNA encoded by FLJ10415, corresponding to a HOST TARGET binding site such as BINDING SITE I, BINDING SITE II or BINDING SITE III. Table 2 illustrates the complementarity of the nucleotide sequences of FLJ10415 BINDING SITE, designated SEQ ID:19852, to the nucleotide sequence of VGAM1556 RNA, herein designated VGAM RNA, also designated SEQ ID:4267.

Another function of VGAM1556 is therefore inhibition of FLJ10415 (Accession NM_018089). Accordingly, utilities of VGAM1556 include diagnosis, prevention and treatment of diseases and clinical conditions associated with FLJ10415. FLJ12768 (Accession NM_025163) is another VGAM1556 host target gene. FLJ12768 BINDING SITE is HOST TARGET binding site found in the 3' untranslated region of mRNA encoded by FLJ12768, corresponding to a HOST TARGET binding site such as BINDING SITE I, BINDING SITE II or BINDING SITE III. Table 2 illustrates the complementarity of the nucleotide sequences of FLJ12768 BINDING SITE, designated SEQ ID:24802, to the nucleotide sequence of VGAM1556 RNA, herein designated VGAM RNA, also designated SEQ ID:4267.

Another function of VGAM1556 is therefore inhibition of FLJ12768 (Accession NM_025163). Accordingly, utilities of VGAM1556 include diagnosis, prevention and treatment of diseases and clinical conditions associated with FLJ12768. ISL2 Transcription Factor, LIM/homeodomain, (islet-2) (ISL2, Accession XM_047951) is another VGAM1556 host target gene. ISL2 BINDING SITE is HOST TARGET binding site found in the 3' untranslated region of mRNA encoded by ISL2, corresponding to a HOST TARGET binding site such as BINDING SITE I, BINDING SITE II or BINDING SITE III. Table 2 illustrates the complementarity of the nucleotide sequences of ISL2 BINDING SITE, designated SEQ ID:35079, to the nucleotide sequence of VGAM1556 RNA, herein designated VGAM RNA, also designated SEQ ID:4267.

Another function of VGAM1556 is therefore inhibition of ISL2 Transcription Factor, LIM/homeodomain, (islet-2) (ISL2, Accession XM_047951). Accordingly, utilities of VGAM1556 include diagnosis, prevention and treatment of diseases and clinical conditions associated with ISL2. PDEF (Accession NM_012391) is another VGAM1556 host target gene. PDEF BINDING SITE is HOST TARGET binding site found in the 5' untranslated region of mRNA encoded by PDEF, corresponding to a HOST TARGET binding site such as BINDING SITE I, BINDING SITE II or BINDING SITE III. Table 2 illustrates the complementarity of the nucleotide sequences of PDEF BINDING SITE, designated SEQ ID:14745, to the nucleotide sequence of VGAM1556 RNA, herein designated VGAM RNA, also designated SEQ ID:4267.

Another function of VGAM1556 is therefore inhibition of PDEF (Accession NM_012391). Accordingly, utilities of VGAM1556 include diagnosis, prevention and treatment of diseases and clinical conditions associated with PDEF. SCYB11 (Accession XM_113426) is another VGAM1556 host target gene. SCYB11 BINDING SITE is HOST TARGET binding site found in the 3' untranslated region of mRNA encoded by SCYB11, corresponding to a HOST TARGET binding site such as BINDING SITE I, BINDING SITE II or BINDING SITE III. Table 2 illustrates the complementarity of the nucleotide sequences of SCYB11 BINDING SITE, designated SEQ ID:42258, to the nucleotide sequence of VGAM1556 RNA, herein designated VGAM RNA, also designated SEQ ID:4267.

Another function of VGAM1556 is therefore inhibition of SCYB11 (Accession XM_113426). Accordingly, utilities of VGAM1556 include diagnosis, prevention and treatment of diseases and clinical conditions associated with SCYB11. LOC147299 (Accession XM_085763) is another VGAM1556 host target gene. LOC147299 BINDING SITE is HOST TARGET binding site found in the 3' untranslated region of mRNA encoded by LOC147299, corresponding to a HOST TARGET binding site such as BINDING SITE I, BINDING SITE II or BINDING SITE III. Table 2 illustrates the complementarity of the nucleotide sequences of LOC147299 BINDING SITE, designated SEQ ID:38328, to the nucleotide sequence of VGAM1556 RNA, herein designated VGAM RNA, also designated SEQ ID:4267.

Another function of VGAM1556 is therefore inhibition of LOC147299 (Accession XM_085763). Accordingly, utilities of VGAM1556 include diagnosis, prevention and treatment of diseases and clinical conditions associated with LOC147299. LOC93268 (Accession XM_050158) is another VGAM1556 host target gene. LOC93268 BINDING SITE is HOST TARGET binding site found in the 5' untranslated region of mRNA encoded by LOC93268, corresponding to a HOST TARGET binding site such as BINDING SITE I, BINDING SITE II or BINDING SITE III. Table 2 illustrates the complementarity of the nucleotide sequences of LOC93268 BINDING SITE, designated SEQ ID:35585, to the nucleotide sequence of VGAM1556 RNA, herein designated VGAM RNA, also designated SEQ ID:4267.

Another function of VGAM1556 is therefore inhibition of LOC93268 (Accession XM_050158). Accordingly, utilities of VGAM1556 include diagnosis, prevention and treatment of diseases and clinical conditions associated with LOC93268. FIG. 1 further provides a conceptual description of a novel bioinformatically detected viral gene of the present invention, referred to here as Viral Genomic Address Messenger 1557 (VGAM1557) viral gene, which modulates expression of respective host target genes thereof, the function and utility of which host target genes is known in the art.

VGAM1557 is a novel bioinformatically detected regulatory, non protein coding, viral micro RNA (miRNA) gene. The method by which VGAM1557 was detected is described hereinabove with reference to FIGS. 1-8.

VGAM1557 gene, herein designated VGAM GENE, is a viral gene contained in the genome of Macaca Mulatta Rhadinovirus. VGAM1557 host target gene, herein designated VGAM HOST TARGET GENE, is a human gene contained in the human genome.

VGAM1557 gene encodes a VGAM1557 precursor RNA, herein designated VGAM PRECURSOR RNA. Similar to other miRNA genes, and unlike most ordinary genes, VGAM1557 precursor RNA does not encode a protein. A nucleotide sequence identical or highly similar to the nucleotide sequence of VGAM1557 precursor RNA is designated SEQ ID:1543, and is provided hereinbelow with reference to the sequence listing part. Nucleotide sequence SEQ ID:1543 is located at position 114790 relative to the genome of Macaca Mulatta Rhadinovirus.

VGAM1557 precursor RNA folds onto itself, forming VGAM1557 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1557 folded precursor RNA into VGAM1557 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1557 RNA is designated SEQ ID:4268, and is provided hereinbelow with reference to the sequence listing part.

VGAM1557 host target gene, herein designated VGAM HOST TARGET GENE, encodes a corresponding messenger RNA, VGAM1557 host target RNA, herein designated VGAM HOST TARGET RNA. VGAM1557 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1557 RNA, herein designated VGAM RNA, binds complementarily to one or more host target binding sites located in untranslated regions of VGAM1557 host target RNA, herein designated VGAM HOST TARGET RNA. This complementary binding is due to the fact that the nucleotide sequence of VGAM1557 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1557 RNA, herein designated VGAM RNA, may have a different number of host target binding sites in untranslated regions of a VGAM1557 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1557 RNA, herein designated VGAM RNA, to host target binding sites on VGAM1557 host target RNA, herein designated VGAM HOST TARGET RNA, such as BINDING SITE I, BINDING SITE II and BINDING SITE III, inhibits translation of VGAM1557 host target RNA into VGAM1557 host target protein, herein designated VGAM HOST TARGET PROTEIN. VGAM host target protein is therefore outlined by a broken line.

It is appreciated that VGAM1557 host target gene, herein designated VGAM HOST TARGET GENE, in fact represents a plurality of VGAM1557 host target genes. The mRNA of each one of this plurality of VGAM1557 host target genes comprises one or more host target binding sites, each having a nucleotide sequence which is at least partly complementary to VGAM1557 RNA, herein designated VGAM RNA, and which when bound by VGAM1557 RNA causes inhibition of translation of respective one or more VGAM1557 host target proteins.

It is further appreciated by one skilled in the art that the mode of translational inhibition illustrated by FIG. 1 with specific reference to translational inhibition exerted by VGAM1557 gene, herein designated VGAM GENE, on one or more VGAM1557 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1557 is inhibition of expression of host target genes, as part of a novel viral mechanism of attacking a host. Accordingly, utilities of VGAM1557 include diagnosis, prevention and treatment of viral infection by Macaca Mulatta Rhadinovirus. Specific functions, and accordingly utilities, of VGAM1557 correlate with, and may be deduced from, the identity of the host target genes which VGAM1557 binds and inhibits, and the function of these host target genes, as elaborated hereinbelow.

Nucleotide sequences of the VGAM1557 precursor RNA, herein designated VGAM PRECURSOR RNA, and of the 'diced' VGAM1557 RNA, herein designated VGAM RNA, and a schematic representation of the secondary folding of VGAM1557 folded precursor RNA, herein designated VGAM FOLDED PRECURSOR RNA, of VGAM1557 are further described hereinbelow with reference to Table 1.

Nucleotide sequences of host target binding sites, such as BINDING SITE-I, BINDING SITE-II and BINDING SITE-III of FIG. 1, found on VGAM1557 host target RNA, and schematic representation of the complementarity of each of these host target binding sites to VGAM1557 RNA, herein designated VGAM RNA, are described hereinbelow with reference to Table 2.

As mentioned hereinabove with reference to FIG. 1, a function of VGAM1557 gene, herein designated VGAM is inhibition of expression of VGAM1557 target genes. It is appreciated that specific functions, and accordingly utilities, of VGAM1557 correlate with, and may be deduced from, the identity of the target genes which VGAM1557 binds and inhibits, and the function of these target genes, as elaborated hereinbelow.

Enabled Homolog (Drosophila) (ENAH, Accession NM_018212) is a VGAM1557 host target gene. ENAH BINDING SITE is HOST TARGET binding site found in the 3' untranslated region of mRNA encoded by ENAH, corresponding to a HOST TARGET binding site such as BINDING SITE I, BINDING SITE II or BINDING SITE III. Table 2 illustrates the complementarity of the nucleotide sequences of ENAH BINDING SITE, designated SEQ ID:20124, to the nucleotide sequence of VGAM1557 RNA, herein designated VGAM RNA, also designated SEQ ID:4268.

A function of VGAM1557 is therefore inhibition of Enabled Homolog (Drosophila) (ENAH, Accession NM_018212). Accordingly, utilities of VGAM1557 include diagnosis, prevention and treatment of diseases and clinical conditions associated with ENAH. FLJ12484 (Accession NM_022767) is another VGAM1557 host target gene. FLJ12484 BINDING SITE1 and FLJ12484 BINDING SITE2 are HOST TARGET binding sites found in untranslated regions of mRNA encoded by FLJ12484, corresponding to HOST TARGET binding sites such as BINDING SITE I, BINDING SITE II or BINDING SITE III. Table 2 illustrates the complementarity of the nucleotide sequences of FLJ12484 BINDING SITE1 and FLJ12484 BINDING SITE2, designated SEQ ID:23024 and SEQ ID:34522 respectively, to the nucleotide sequence of VGAM1557 RNA, herein designated VGAM RNA, also designated SEQ ID:4268.

Another function of VGAM1557 is therefore inhibition of FLJ12484 (Accession NM_022767). Accordingly, utilities of VGAM1557 include diagnosis, prevention and treatment of diseases and clinical conditions associated with FLJ12484. Zinc Finger Protein 185 (LIM domain) (ZNF185, Accession NM_007150) is another VGAM1557 host target gene. ZNF185 BINDING SITE is HOST TARGET binding site found in the 3' untranslated region of mRNA encoded by ZNF185, corresponding to a HOST TARGET binding site such as BINDING SITE I, BINDING SITE II or BINDING SITE III. Table 2 illustrates the complementarity of the nucleotide sequences of ZNF185 BINDING SITE, designated SEQ ID:14002, to the nucleotide sequence of VGAM1557 RNA, herein designated VGAM RNA, also designated SEQ ID:4268.

Another function of VGAM1557 is therefore inhibition of Zinc Finger Protein 185 (LIM domain) (ZNF185, Accession NM_007150). Accordingly, utilities of VGAM1557 include diagnosis, prevention and treatment of diseases and clinical conditions associated with ZNF185. LOC145828 (Accession XM_096879) is another VGAM1557 host target gene. LOC145828 BINDING SITE is HOST TARGET binding site found in the 5' untranslated region of mRNA encoded by LOC145828, corresponding to a HOST TARGET binding site such as BINDING SITE I, BINDING SITE II or BINDING SITE III. Table 2 illustrates the complementarity of the nucleotide sequences of LOC145828 BINDING SITE, designated SEQ ID:40612, to the nucleotide sequence of VGAM1557 RNA, herein designated VGAM RNA, also designated SEQ ID:4268.

Another function of VGAM1557 is therefore inhibition of LOC145828 (Accession XM_096879). Accordingly, utilities of VGAM1557 include diagnosis, prevention and treatment of diseases and clinical conditions associated with LOC145828. LOC152926 (Accession XM_087562) is another VGAM1557 host target gene. LOC152926 BINDING SITE is HOST TARGET binding site found in the 3' untranslated region of mRNA encoded by LOC152926, corresponding to a HOST TARGET binding site such as BINDING SITE I, BINDING SITE II or BINDING SITE III. Table 2 illustrates the complementarity of the nucleotide sequences of LOC152926 BINDING SITE, designated SEQ ID:39340, to the nucleotide sequence of VGAM1557 RNA, herein designated VGAM RNA, also designated SEQ ID:4268.

Another function of VGAM1557 is therefore inhibition of LOC152926 (Accession XM_087562). Accordingly, utilities of VGAM1557 include diagnosis, prevention and treatment of diseases and clinical conditions associated with LOC152926. LOC220662 (Accession XM_165978) is another VGAM1557 host target gene. LOC220662 BINDING SITE is HOST TARGET binding site found in the 3' untranslated region of mRNA encoded by LOC220662, corresponding to a HOST TARGET binding site such as BINDING SITE I, BINDING SITE II or BINDING SITE III. Table 2 illustrates the complementarity of the nucleotide sequences of LOC220662 BINDING SITE, designated SEQ ID:43824, to the nucleotide sequence of VGAM1557 RNA, herein designated VGAM RNA, also designated SEQ ID:4268.

Another function of VGAM1557 is therefore inhibition of LOC220662 (Accession XM_165978). Accordingly, utilities of VGAM1557 include diagnosis, prevention and treatment of diseases and clinical conditions associated with LOC220662. FIG. 1 further provides a conceptual description of a novel bioinformatically detected viral gene of the present invention, referred to here as Viral Genomic Address Messenger 1558 (VGAM1558) viral gene, which modulates expression of respective host target genes thereof, the function and utility of which host target genes is known in the art.

VGAM1558 is a novel bioinformatically detected regulatory, non protein coding, viral micro RNA (miRNA) gene. The method by which VGAM1558 was detected is described hereinabove with reference to FIGS. 1-8.

VGAM1558 gene, herein designated VGAM GENE, is a viral gene contained in the genome of Bean Common Mosaic Virus. VGAM1558 host target gene, herein designated VGAM HOST TARGET GENE, is a human gene contained in the human genome.

VGAM1558 gene encodes a VGAM1558 precursor RNA, herein designated VGAM PRECURSOR RNA. Similar to other miRNA genes, and unlike most ordinary genes, VGAM1558 precursor RNA does not encode a protein. A nucleotide sequence identical or highly similar to the nucleotide sequence of VGAM1558 precursor RNA is designated SEQ ID:1544, and is provided hereinbelow with reference to the sequence listing part. Nucleotide sequence SEQ ID:1544 is located at position 8996 relative to the genome of Bean Common Mosaic Virus.

VGAM1558 precursor RNA folds onto itself, forming VGAM1558 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1558 folded precursor RNA into VGAM1558 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1558 RNA is designated SEQ ID:4269, and is provided hereinbelow with reference to the sequence listing part.

VGAM1558 host target gene, herein designated VGAM HOST TARGET GENE, encodes a corresponding messenger RNA, VGAM1558 host target RNA, herein designated VGAM HOST TARGET RNA. VGAM1558 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1558 RNA, herein designated VGAM RNA, binds complementarily to one or more host target binding sites located in untranslated regions of VGAM1558 host target RNA, herein designated VGAM HOST TARGET RNA. This complementary binding is due to the fact that the nucleotide sequence of VGAM1558 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1558 RNA, herein designated VGAM RNA, may have a different number of host target binding sites in untranslated regions of a VGAM1558 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1558 RNA, herein designated VGAM RNA, to host target binding sites on VGAM1558 host target RNA, herein designated VGAM HOST TARGET RNA, such as BINDING SITE I, BINDING SITE II and BINDING SITE III, inhibits translation of VGAM1558 host target RNA into VGAM1558 host target protein, herein designated VGAM HOST TARGET PROTEIN. VGAM host target protein is therefore outlined by a broken line.

It is appreciated that VGAM1558 host target gene, herein designated VGAM HOST TARGET GENE, in fact represents a plurality of VGAM1558 host target genes. The mRNA of each one of this plurality of VGAM1558 host target genes comprises one or more host target binding sites, each having a nucleotide sequence which is at least partly complementary to VGAM1558 RNA, herein designated VGAM RNA, and which when bound by VGAM1558 RNA causes inhibition of translation of respective one or more VGAM1558 host target proteins.

It is further appreciated by one skilled in the art that the mode of translational inhibition illustrated by FIG. 1 with specific reference to translational inhibition exerted by VGAM1558 gene, herein designated VGAM GENE, on one or more VGAM1558 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1558 is inhibition of expression of host target genes, as part of a novel viral mechanism of attacking a host. Accordingly, utilities of VGAM1558 include diagnosis, prevention and treatment of viral infection by Bean Common Mosaic Virus. Specific functions, and accordingly utilities, of VGAM1558 correlate with, and may be deduced from, the identity of the host target genes which VGAM1558 binds and inhibits, and the function of these host target genes, as elaborated hereinbelow.

Nucleotide sequences of the VGAM1558 precursor RNA, herein designated VGAM PRECURSOR RNA, and of the 'diced' VGAM1558 RNA, herein designated VGAM RNA, and a schematic representation of the secondary folding of VGAM1558 folded precursor RNA, herein designated VGAM FOLDED PRECURSOR RNA, of VGAM1558 are further described hereinbelow with reference to Table 1.

Nucleotide sequences of host target binding sites, such as BINDING SITE-I, BINDING SITE-II and BINDING SITE-III of FIG. 1, found on VGAM1558 host target RNA, and schematic representation of the complementarity of each of these host target binding sites to VGAM1558 RNA, herein designated VGAM RNA, are described hereinbelow with reference to Table 2.

As mentioned hereinabove with reference to FIG. 1, a function of VGAM1558 gene, herein designated VGAM is inhibition of expression of VGAM1558 target genes. It is appreciated that specific functions, and accordingly utilities, of VGAM1558 correlate with, and may be deduced from, the identity of the target genes which VGAM1558 binds and inhibits, and the function of these target genes, as elaborated hereinbelow.

Ceroid-lipofuscinosis, Neuronal 6, Late Infantile, Variant (CLN6, Accession NM_017882) is a VGAM1558 host target gene. CLN6 BINDING SITE is HOST TARGET binding site found in the 3' untranslated region of mRNA encoded by CLN6, corresponding to a HOST TARGET binding site such as BINDING SITE I, BINDING SITE II or BINDING SITE III. Table 2 illustrates the complementarity of the nucleotide sequences of CLN6 BINDING SITE, designated SEQ ID:19549, to the nucleotide sequence of VGAM1558 RNA, herein designated VGAM RNA, also designated SEQ ID:4269.

A function of VGAM1558 is therefore inhibition of Ceroid-lipofuscinosis, Neuronal 6, Late Infantile, Variant (CLN6, Accession NM_017882). Accordingly, utilities of VGAM1558 include diagnosis, prevention and treatment of diseases and clinical conditions associated with CLN6. Ectodermal-neural Cortex (with BTB-like domain) (ENC1, Accession NM_003633) is another VGAM1558 host target gene. ENC1 BINDING SITE is HOST TARGET binding site found in the 3' untranslated region of mRNA encoded by ENC1, corresponding to a HOST TARGET binding site such as BINDING SITE I, BINDING SITE II or BINDING SITE III. Table 2 illustrates the complementarity of the nucleotide sequences of ENC1 BINDING SITE, designated SEQ ID:9696, to the nucleotide sequence of VGAM1558 RNA, herein designated VGAM RNA, also designated SEQ ID:4269.

Another function of VGAM1558 is therefore inhibition of Ectodermal-neural Cortex (with BTB-like domain) (ENC1, Accession NM_003633), a gene which is an actin-binding protein involved in the regulation of neuronal process formation and in differentiation of neural crest cells. Accordingly, utilities of VGAM1558 include diagnosis, prevention and treatment of diseases and clinical conditions associated with ENC1. The function of ENC1 and its association with various diseases and clinical conditions, has been established by previous studies, as described hereinabove with reference to VGAM233. Procollagen-lysine, 2-oxoglutarate 5-dioxygenase (lysine hydroxylase, Ehlers-Danlos syndrome type VI) (PLOD, Accession NM_000302) is another VGAM1558 host target gene. PLOD BINDING SITE is HOST TARGET binding site found in the 3' untranslated region of mRNA encoded by PLOD, corresponding to a HOST TARGET binding site such as BINDING SITE I, BINDING SITE II or BINDING SITE III. Table 2 illustrates the complementarity of the nucleotide sequences of PLOD BINDING SITE, designated SEQ ID:5843, to the nucleotide sequence of VGAM1558 RNA, herein designated VGAM RNA, also designated SEQ ID:4269.

Another function of VGAM1558 is therefore inhibition of Procollagen-lysine, 2-oxoglutarate 5-dioxygenase (lysine hydroxylase, Ehlers-Danlos syndrome type VI) (PLOD, Accession NM_000302). Accordingly, utilities of VGAM1558 include diagnosis, prevention and treatment of diseases and clinical conditions associated with PLOD. Pyrroline-5-carboxylate Synthetase (glutamate gamma-semialdehyde synthetase) (PYCS, Accession NM_002860) is another VGAM1558 host target gene. PYCS BINDING SITE is HOST TARGET binding site found in the 3' untranslated region of mRNA encoded by PYCS, corresponding to a HOST TARGET binding site such as BINDING SITE I, BINDING SITE II or BINDING SITE III. Table 2 illustrates the complementarity of the nucleotide sequences of PYCS BINDING SITE, designated SEQ ID:8760, to the nucleotide sequence of VGAM1558 RNA, herein designated VGAM RNA, also designated SEQ ID:4269.

Another function of VGAM1558 is therefore inhibition of Pyrroline-5-carboxylate Synthetase (glutamate gamma-semialdehyde synthetase) (PYCS, Accession NM_002860). Accordingly, utilities of VGAM1558 include diagnosis, prevention and treatment of diseases and clinical conditions associated with PYCS. CASPR3 (Accession NM_024879) is another VGAM1558 host target gene. CASPR3 BINDING SITE is HOST TARGET binding site found in the 3' untranslated region of mRNA encoded by CASPR3, corresponding to a HOST TARGET binding site such as BINDING SITE I, BINDING SITE II or BINDING SITE III. Table 2 illustrates the complementarity of the nucleotide sequences of CASPR3 BINDING SITE, designated SEQ ID:24315, to the nucleotide sequence of VGAM1558 RNA, herein designated VGAM RNA, also designated SEQ ID:4269.

Another function of VGAM1558 is therefore inhibition of CASPR3 (Accession NM_024879). Accordingly, utilities of VGAM1558 include diagnosis, prevention and treatment of diseases and clinical conditions associated with CASPR3. KIAA1040 (Accession XM_051091) is another VGAM1558 host target gene. KIAA1040 BINDING SITE is HOST TARGET binding site found in the 3' untranslated region of mRNA encoded by KIAA1040, corresponding to a HOST TARGET binding site such as BINDING SITE I, BINDING SITE II or BINDING SITE III. Table 2 illustrates the complementarity of the nucleotide sequences of KIAA1040 BINDING SITE, designated SEQ ID:35745, to the nucleotide sequence of VGAM1558 RNA, herein designated VGAM RNA, also designated SEQ ID:4269.

Another function of VGAM1558 is therefore inhibition of KIAA1040 (Accession XM_051091). Accordingly, utilities of VGAM1558 include diagnosis, prevention and treatment of diseases and clinical conditions associated with KIAA1040. KIAA1764 (Accession XM_045086) is another VGAM1558 host target gene. KIAA1764 BINDING SITE is HOST TARGET binding site found in the 5' untranslated region of mRNA encoded by KIAA1764, corresponding to a HOST TARGET binding site such as BINDING SITE I, BINDING SITE II or BINDING SITE III. Table 2 illustrates the complementarity of the nucleotide sequences of KIAA1764 BINDING SITE, designated SEQ ID:34352, to the nucleotide sequence of VGAM1558 RNA, herein designated VGAM RNA, also designated SEQ ID:4269.

Another function of VGAM1558 is therefore inhibition of KIAA1764 (Accession XM_045086). Accordingly, utilities of VGAM1558 include diagnosis, prevention and treatment of diseases and clinical conditions associated with KIAA1764. KIAA1854 (Accession XM_049884) is another VGAM1558 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35529, to the nucleotide sequence of VGAM1558 RNA, herein designated VGAM RNA, also designated SEQ ID:4269.

Another function of VGAM1558 is therefore inhibition of KIAA1854 (Accession XM_049884). Accordingly, utilities of VGAM1558 include diagnosis, prevention and treatment of diseases and clinical conditions associated with KIAA1854. LOC200197 (Accession XM_114148) is another VGAM1558 host target gene. LOC200197 BINDING SITE is HOST TARGET binding site found in the 3' untranslated region of mRNA encoded by LOC200197, corresponding to a HOST TARGET binding site such as BINDING SITE I, BINDING SITE II or BINDING SITE III. Table 2 illustrates the complementarity of the nucleotide sequences of LOC200197 BINDING SITE, designated SEQ ID:42729, to the nucleotide sequence of VGAM1558 RNA, herein designated VGAM RNA, also designated SEQ ID:4269.

Another function of VGAM1558 is therefore inhibition of LOC200197 (Accession XM_114148). Accordingly, utilities of VGAM1558 include diagnosis, prevention and treatment of diseases and clinical conditions associated with LOC200197. LOC203232 (Accession XM_049274) is another VGAM1558 host target gene. LOC203232 BINDING SITE is HOST TARGET binding site found in the 5' untranslated region of mRNA encoded by LOC203232, corresponding to a HOST TARGET binding site such as BINDING SITE I, BINDING SITE II or BINDING SITE III. Table 2 illustrates the complementarity of the nucleotide sequences of LOC203232 BINDING SITE, designated SEQ ID:35373, to the nucleotide sequence of VGAM1558 RNA, herein designated VGAM RNA, also designated SEQ ID:4269.

Another function of VGAM1558 is therefore inhibition of LOC203232 (Accession XM_049274). Accordingly, utilities of VGAM1558 include diagnosis, prevention and treatment of diseases and clinical conditions associated with LOC203232. LOC90233 (Accession NM_138347) is another VGAM1558 host target gene. LOC90233 BINDING SITE is HOST TARGET binding site found in the 3' untranslated region of mRNA encoded by LOC90233, corresponding to a HOST TARGET binding site such as BINDING SITE I, BINDING SITE II or BINDING SITE III. Table 2 illustrates the complementarity of the nucleotide sequences of LOC90233 BINDING SITE, designated SEQ ID:28742, to the nucleotide sequence of VGAM1558 RNA, herein designated VGAM RNA, also designated SEQ ID:4269.

Another function of VGAM1558 is therefore inhibition of LOC90233 (Accession NM_138347). Accordingly, utilities of VGAM1558 include diagnosis, prevention and treatment of diseases and clinical conditions associated with LOC90233. FIG. 1 further provides a conceptual description of a novel bioinformatically detected viral gene of the present invention, referred to here as Viral Genomic Address Messenger 1559 (VGAM1559) viral gene, which modulates expression of respective host target genes thereof, the function and utility of which host target genes is known in the art.

VGAM1559 is a novel bioinformatically detected regulatory, non protein coding, viral micro RNA (miRNA) gene. The method by which VGAM1559 was detected is described hereinabove with reference to FIGS. 1-8.

VGAM1559 gene, herein designated VGAM GENE, is a viral gene contained in the genome of Bean Common Mosaic Virus. VGAM1559 host target gene, herein designated VGAM HOST TARGET GENE, is a human gene contained in the human genome.

VGAM1559 gene encodes a VGAM1559 precursor RNA, herein designated VGAM PRECURSOR RNA. Similar to other miRNA genes, and unlike most ordinary genes, VGAM1559 precursor RNA does not encode a protein. A nucleotide sequence identical or highly similar to the nucleotide sequence of VGAM1559 precursor RNA is designated SEQ ID:1545, and is provided hereinbelow with reference to the sequence listing part. Nucleotide sequence SEQ ID:1545 is located at position 3572 relative to the genome of Bean Common Mosaic Virus.

VGAM1559 precursor RNA folds onto itself, forming VGAM1559 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1559 folded precursor RNA into VGAM1559 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1559 RNA is designated SEQ ID:4270, and is provided hereinbelow with reference to the sequence listing part.

VGAM1559 host target gene, herein designated VGAM HOST TARGET GENE, encodes a corresponding messenger RNA, VGAM1559 host target RNA, herein designated VGAM HOST TARGET RNA. VGAM1559 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1559 RNA, herein designated VGAM RNA, binds complementarily to one or more host target binding sites located in untranslated regions of VGAM1559 host target RNA, herein designated VGAM HOST TARGET RNA. This complementary binding is due to the fact that the nucleotide sequence of VGAM1559 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1559 RNA, herein designated VGAM RNA, may have a different number of host target binding sites in untranslated regions of a VGAM1559 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1559 RNA, herein designated VGAM RNA, to host target binding sites on VGAM1559 host target RNA, herein designated VGAM HOST TARGET RNA, such as BINDING SITE I, BINDING SITE II and BINDING SITE III, inhibits translation of VGAM1559 host target RNA into VGAM1559 host target protein, herein designated VGAM HOST TARGET PROTEIN. VGAM host target protein is therefore outlined by a broken line.

It is appreciated that VGAM1559 host target gene, herein designated VGAM HOST TARGET GENE, in fact represents a plurality of VGAM1559 host target genes. The mRNA of each one of this plurality of VGAM1559 host target genes comprises one or more host target binding sites, each having a nucleotide sequence which is at least partly complementary to VGAM1559 RNA, herein designated VGAM RNA, and which when bound by VGAM1559 RNA causes inhibition of translation of respective one or more VGAM1559 host target proteins.

It is further appreciated by one skilled in the art that the mode of translational inhibition illustrated by FIG. 1 with specific reference to translational inhibition exerted by VGAM1559 gene, herein designated VGAM GENE, on one or more VGAM1559 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1559 is inhibition of expression of host target genes, as part of a novel viral mechanism of attacking a host. Accordingly, utilities of VGAM1559 include diagnosis, prevention and treatment of viral infection by Bean Common Mosaic Virus. Specific functions, and accordingly utilities, of VGAM1559 correlate with, and may be deduced from, the identity of the host target genes which VGAM1559 binds and inhibits, and the function of these host target genes, as elaborated hereinbelow.

Nucleotide sequences of the VGAM1559 precursor RNA, herein designated VGAM PRECURSOR RNA, and of the 'diced' VGAM1559 RNA, herein designated VGAM RNA, and a schematic representation of the secondary folding of VGAM1559 folded precursor RNA, herein designated VGAM FOLDED PRECURSOR RNA, of VGAM1559 are further described hereinbelow with reference to Table 1.

Nucleotide sequences of host target binding sites, such as BINDING SITE-I, BINDING SITE-II and BINDING SITE-III of FIG. 1, found on VGAM1559 host target RNA, and schematic representation of the complementarity of each of these host target binding sites to VGAM1559 RNA, herein designated VGAM RNA, are described hereinbelow with reference to Table 2.

As mentioned hereinabove with reference to FIG. 1, a function of VGAM1559 gene, herein designated VGAM is inhibition of expression of VGAM1559 target genes. It is appreciated that specific functions, and accordingly utilities, of VGAM1559 correlate with, and may be deduced from, the identity of the target genes which VGAM1559 binds and inhibits, and the function of these target genes, as elaborated hereinbelow.

Guanine Nucleotide Binding Protein (G protein), Alpha Inhibiting Activity Polypeptide 3 (GNAI3, Accession NM_006496) is a VGAM1559 host target gene. GNAI3 BINDING SITE is HOST TARGET binding site found in the 3' untranslated region of mRNA encoded by GNAI3, corresponding to a HOST TARGET binding site such as BINDING SITE I, BINDING SITE II or BINDING SITE III. Table 2 illustrates the complementarity of the nucleotide sequences of GNAI3 BINDING SITE, designated SEQ ID:13239, to the nucleotide sequence of VGAM1559 RNA, herein designated VGAM RNA, also designated SEQ ID:4270.

A function of VGAM1559 is therefore inhibition of Guanine Nucleotide Binding Protein (G protein), Alpha Inhibiting Activity Polypeptide 3 (GNAI3, Accession NM_006496), a gene which stimulates receptor regulated K+-channels. Accordingly, utilities of VGAM1559 include diagnosis, prevention and treatment of diseases and clinical conditions associated with GNAI3. The function of GNAI3 and its association with various diseases and clinical conditions, has been established by previous studies, as described hereinabove with reference to VGAM45. Chondrolectin (CHODL, Accession NM_024944) is another VGAM1559 host target gene. CHODL BINDING SITE is HOST TARGET binding site found in the 3' untranslated region of mRNA encoded by CHODL, corresponding to a HOST TARGET binding site such as BINDING SITE I, BINDING SITE II or BINDING SITE III. Table 2 illustrates the complementarity of the nucleotide sequences of CHODL BINDING SITE, designated SEQ ID:24489, to the nucleotide sequence of VGAM1559 RNA, herein designated VGAM RNA, also designated SEQ ID:4270.

Another function of VGAM1559 is therefore inhibition of Chondrolectin (CHODL, Accession NM_024944). Accordingly, utilities of VGAM1559 include diagnosis, prevention and treatment of diseases and clinical conditions associated with CHODL. KIAA0416 (Accession NM_015564) is another VGAM1559 host target gene. KIAA0416 BINDING SITE is HOST TARGET binding site found in the 3' untranslated region of mRNA encoded by KIAA0416, corresponding to a HOST TARGET binding site such as BINDING SITE I, BINDING SITE II or BINDING SITE III. Table 2 illustrates the complementarity of the nucleotide sequences of KIAA0416 BINDING SITE, designated SEQ ID:17832, to the nucleotide sequence of VGAM1559 RNA, herein designated VGAM RNA, also designated SEQ ID:4270.

Another function of VGAM1559 is therefore inhibition of KIAA0416 (Accession NM_015564). Accordingly, utilities of VGAM1559 include diagnosis, prevention and treatment of diseases and clinical conditions associated with KIAA0416. LOC145951 (Accession XM_085283) is another VGAM1559 host target gene. LOC145951 BINDING SITE is HOST TARGET binding site found in the 5' untranslated region of mRNA encoded by LOC145951, corresponding to a HOST TARGET binding site such as BINDING SITE I, BINDING SITE II or BINDING SITE III. Table 2 illustrates the complementarity of the nucleotide sequences of LOC145951 BINDING SITE, designated SEQ ID:38016, to the nucleotide sequence of VGAM1559 RNA, herein designated VGAM RNA, also designated SEQ ID:4270.

Another function of VGAM1559 is therefore inhibition of LOC145951 (Accession XM_085283). Accordingly, utilities of VGAM1559 include diagnosis, prevention and treatment of diseases and clinical conditions associated with LOC145951. FIG. 1 further provides a conceptual description of a novel bioinformatically detected viral gene of the present invention, referred to here as Viral Genomic Address Messenger 1560 (VGAM1560) viral gene, which modulates expression of respective host target genes thereof, the function and utility of which host target genes is known in the art.

VGAM1560 is a novel bioinformatically detected regulatory, non protein coding, viral micro RNA (miRNA) gene. The method by which VGAM1560 was detected is described hereinabove with reference to FIGS. 1-8.

VGAM1560 gene, herein designated VGAM GENE, is a viral gene contained in the genome of Bean Common Mosaic Virus. VGAM1560 host target gene, herein designated VGAM HOST TARGET GENE, is a human gene contained in the human genome.

VGAM1560 gene encodes a VGAM1560 precursor RNA, herein designated VGAM PRECURSOR RNA. Similar to other miRNA genes, and unlike most ordinary genes, VGAM1560 precursor RNA does not encode a protein. A nucleotide sequence identical or highly similar to the nucleotide sequence of VGAM1560 precursor RNA is designated SEQ ID:1546, and is provided hereinbelow with reference to the sequence listing part. Nucleotide sequence SEQ ID:1546 is located at position 6352 relative to the genome of Bean Common Mosaic Virus.

VGAM1560 precursor RNA folds onto itself, forming VGAM1560 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1560 folded precursor RNA into VGAM1560 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1560 RNA is designated SEQ ID:4271, and is provided hereinbelow with reference to the sequence listing part.

VGAM1560 host target gene, herein designated VGAM HOST TARGET GENE, encodes a corresponding messenger RNA, VGAM1560 host target RNA, herein designated VGAM HOST TARGET RNA. VGAM1560 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1560 RNA, herein designated VGAM RNA, binds complementarily to one or more host target binding sites located in untranslated regions of VGAM1560 host target RNA, herein designated VGAM HOST TARGET RNA. This complementary binding is due to the fact that the nucleotide sequence of VGAM1560 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1560 RNA, herein designated VGAM RNA, may have a different number of host target binding sites in untranslated regions of a VGAM1560 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1560 RNA, herein designated VGAM RNA, to host target binding sites on VGAM1560 host target RNA, herein designated VGAM HOST TARGET RNA, such as BINDING SITE I, BINDING SITE II and BINDING SITE III, inhibits translation of VGAM1560 host target RNA into VGAM1560 host target protein, herein designated VGAM HOST TARGET PROTEIN. VGAM host target protein is therefore outlined by a broken line.

It is appreciated that VGAM1560 host target gene, herein designated VGAM HOST TARGET GENE, in fact represents a plurality of VGAM1560 host target genes. The mRNA of each one of this plurality of VGAM1560 host target genes comprises one or more host target binding sites, each having a nucleotide sequence which is at least partly complementary to VGAM1560 RNA, herein designated VGAM RNA, and which when bound by VGAM1560 RNA causes inhibition of translation of respective one or more VGAM1560 host target proteins.

It is further appreciated by one skilled in the art that the mode of translational inhibition illustrated by FIG. 1 with specific reference to translational inhibition exerted by VGAM1560 gene, herein designated VGAM GENE, on one or more VGAM1560 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1560 is inhibition of expression of host target genes, as part of a novel viral mechanism of attacking a host. Accordingly, utilities of VGAM1560 include diagnosis, prevention and treatment of viral infection by Bean Common Mosaic Virus. Specific functions, and accordingly utilities, of VGAM1560 correlate with, and may be deduced from, the identity of the host target genes which VGAM1560 binds and inhibits, and the function of these host target genes, as elaborated hereinbelow.

Nucleotide sequences of the VGAM1560 precursor RNA, herein designated VGAM PRECURSOR RNA, and of the 'diced' VGAM1560 RNA, herein designated VGAM RNA, and a schematic representation of the secondary folding of VGAM1560 folded precursor RNA, herein designated VGAM FOLDED PRECURSOR RNA, of VGAM1560 are further described hereinbelow with reference to Table 1.

Nucleotide sequences of host target binding sites, such as BINDING SITE-I, BINDING SITE-II and BINDING SITE-III of FIG. 1, found on VGAM1560 host target RNA, and schematic representation of the complementarity of each of these host target binding sites to VGAM1560 RNA, herein designated VGAM RNA, are described hereinbelow with reference to Table 2.

As mentioned hereinabove with reference to FIG. 1, a function of VGAM1560 gene, herein designated VGAM is inhibition of expression of VGAM1560 target genes. It is appreciated that specific functions, and accordingly utilities, of VGAM1560 correlate with, and may be deduced from, the identity of the target genes which VGAM1560 binds and inhibits, and the function of these target genes, as elaborated hereinbelow.

EPB72 (Accession NM_004099) is a VGAM1560 host target gene. EPB72 BINDING SITE is HOST TARGET binding site found in the 3' untranslated region of mRNA encoded by EPB72, corresponding to a HOST TARGET binding site such as BINDING SITE I, BINDING SITE II or BINDING SITE III. Table 2 illustrates the complementarity of the nucleotide sequences of EPB72 BINDING SITE, designated SEQ ID:10303, to the nucleotide sequence of VGAM1560 RNA, herein designated VGAM RNA, also designated SEQ ID:4271.

A function of VGAM1560 is therefore inhibition of EPB72 (Accession NM_004099), a gene which may regulate cation conductance. Accordingly, utilities of VGAM1560 include diagnosis, prevention and treatment of diseases and clinical conditions associated with EPB72. The function of EPB72 has been established by previous studies. Erythrocyte surface protein band 7.2 is a 29,000-kD integral membrane protein that is exposed on the cytoplasmic surface of the membrane and is susceptible to phosphorylation by a cAMP-dependent protein kinase. Deficiency of this protein in red cells is responsible for stomatocytosis (OMIM Ref. No. 185000). The same protein can be demonstrated in human cell lines of epithelial and lymphoid origin, notably in HeLa cells. Hiebl-Dirschmied et al. (1991), therefore, could screen HeLa cell cDNA expression libraries with antibodies to the protein in order to isolate cDNA clones, determine the nucleotide sequence, and study the structure of the protein. HeLa and bone marrow cell-derived sequences were identical, except for one nucleotide; the deduced sequence of 287 amino acids was confirmed by sequence identity with peptides of the erythroid protein. Structural analysis assigned band 7 protein to the type Ib transmembrane proteins. Westberg et al. (1993) used a cDNA clone coding for stomatin to determine the chromosomal localization of the EPB72 gene. They assigned the gene to human chromosome 9 by Southern blot analysis of somatic cell hybrids. By analysis of hybrid cells containing only parts of chromosome 9, they regionalized the assignment to 9q34.1, proximal to the breakpoint that creates the Philadelphia chromosome of chronic myeloid leukemia (CML; 151410) and, therefore, proximal to the Abelson oncogene (OMIM Ref. No. 189980). Using fluorescence in situ hybridization, Gallagher et al. (1993) likewise mapped the EPB72 gene to 9q33-q34. They showed that EPB72 was not translocated with the 3-prime end of the ABL gene in the Philadelphia chromosome, suggesting that the EPB72 gene is centromeric to the ABL gene. Pilz et al. (1994) demonstrated that the homologous gene is located on mouse chromosome 2. To gain additional insight into the structure and function of this protein, Gallagher et al. (1995) cloned the mouse band 7.2b cDNA and studied its tissue-specific expression. They isolated 2,873 bp of cDNA with an open reading frame of 852 bp. The predicted protein was 284 amino acids with a molecular weight of 31 kD. They detected a wide pattern of expression, with high levels of mRNA in heart, liver, skeletal muscle, and testis but low levels in lung, brain, and spleen. Using fluorescence in situ hybridization, the murine band 7.2b gene was mapped to chromosome 2, at the border of the distal region of 2B and proximal region of C1, syntenic to 9q, the location of the human homolog. Models of the predicted protein structure showed a short NH2-terminal head, a strongly hydrophobic 28-amino acid stretch presumably encoding a single membrane-spanning domain, and a large domain composed of beta sheet and alpha helix. Database searching showed no significant homology of other known proteins to either the human or the murine band 7.2b. Gallagher and Forget (1995) determined the sequence of the full-length human band 7.2b cDNA, characterized the genomic structure of the EPB72 gene, studied its pattern of expression in different tissues, and characterized the promoter of the gene. The gene is composed of 7 exons distributed over 40 kb of DNA. Its promoter was identified as lacking a TATA box and to be GC-rich. It directed high-level expression of a reporter gene in both erythroid and non-erythroid cells. Unfried et al. (1995) showed that the human EPB72 gene contains 7 exons spanning about 30 kb. Two polyadenylation signals were found in the 3-prime UTR accounting for the 3.2- and 3.3-kb RNAs that are observed in Northern blots. Animal model experiments lend further support to the function of EPB72. To examine the relationship between erythrocyte membrane protein 7.2b deficiency and the hemolytic anemia of human hereditary stomatocytosis, Zhu et al. (1999) created 7.2b knockout mice by standard gene targeting approaches. Despite a complete absence of protein 7.2b in homozygous knockout mice, there was no hemolytic anemia, and mouse red blood cells were normal in morphology, cell indices, hydration status, monovalent cation content, and ability to translocate lipids. Thus, their experiments suggested that 7.2b deficiency plays no direct role in the etiology of stomatocytosis and excluded any role of this protein as a mediator of cation transport in red blood cells.

It is appreciated that the abovementioned animal model for EPB72 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Zhu, Y.; Paszty, C.; Turetsky, T.; Tsai, S.; Kuypers, F. A.; Lee, G.; Cooper, P.; Gallagher, P. G.; Stevens, M. E.; Rubin, E.; Mohandas, N.; Mentzer, W. C.: Stomatocytosis is absent in 'stomatin'-deficient murine red blood cells. Blood 93:2404-2410, 1999; and Zhu, Y.; Paszty, C.; Turetsky, T.; Tsai, S.; Kuypers, F. A.; Lee, G.; Cooper, P.; Gallagher, P. G.; Stevens, M. E.; Rubin, E.; Mohandas, N.; Mentzer, W. C.: Stomatocytosis is absent in.

Further studies establishing the function and utilities of EPB72 are found in John Hopkins OMIM database record ID 133090, and in sited publications numbered 4369-4376 listed in the bibliography section hereinbelow, which are also hereby incorporated by reference. Hyaluronan-mediated Motility Receptor (RHAMM) (HMMR, Accession NM_012484) is another VGAM1560 host target gene. HMMR BINDING SITE1 and HMMR BINDING SITE2 are HOST TARGET binding sites found in untranslated regions of mRNA encoded by HMMR, corresponding to HOST TARGET binding sites such as BINDING SITE I, BINDING SITE II or BINDING SITE III. Table 2 illustrates the complementarity of the nucleotide sequences of HMMR BINDING SITE1 and HMMR BINDING SITE2, designated SEQ ID:14861 and SEQ ID:14863 respectively, to the nucleotide sequence of VGAM1560 RNA, herein designated VGAM RNA, also designated SEQ ID:4271.

Another function of VGAM1560 is therefore inhibition of Hyaluronan-mediated Motility Receptor (RHAMM) (HMMR, Accession NM_012484). Accordingly, utilities of VGAM1560 include diagnosis, prevention and treatment of diseases and clinical conditions associated with HMMR. KIAA0354 (Accession NM_014872) is another VGAM1560 host target gene. KIAA0354 BINDING SITE is HOST TARGET binding site found in the 3' untranslated region of mRNA encoded by KIAA0354, corresponding to a HOST TARGET binding site such as BINDING SITE I, BINDING SITE II or BINDING SITE III. Table 2 illustrates the complementarity of the nucleotide sequences of KIAA0354 BINDING SITE, designated SEQ ID:16995, to the nucleotide sequence of VGAM1560 RNA, herein designated VGAM RNA, also designated SEQ ID:4271.

Another function of VGAM1560 is therefore inhibition of KIAA0354 (Accession NM_014872). Accordingly, utilities of VGAM1560 include diagnosis, prevention and treatment of diseases and clinical conditions associated with KIAA0354. LOC144308 (Accession XM_096575) is another VGAM1560 host target gene. LOC144308 BINDING SITE is HOST TARGET binding site found in the 3' untranslated region of mRNA encoded by LOC144308, corresponding to a HOST TARGET binding site such as BINDING SITE I, BINDING SITE II or BINDING SITE III. Table 2 illustrates the complementarity of the nucleotide sequences of LOC144308 BINDING SITE, designated SEQ ID:40403, to the nucleotide sequence of VGAM1560 RNA, herein designated VGAM RNA, also designated SEQ ID:4271.

Another function of VGAM1560 is therefore inhibition of LOC144308 (Accession XM_096575). Accordingly, utilities of VGAM1560 include diagnosis, prevention and treatment of diseases and clinical conditions associated with LOC144308. FIG. 1 further provides a conceptual description of a novel bioinformatically detected viral gene of the present invention, referred to here as Viral Genomic Address Messenger 1561 (VGAM1561) viral gene, which modulates expression of respective host target genes thereof, the function and utility of which host target genes is known in the art.

VGAM1561 is a novel bioinformatically detected regulatory, non protein coding, viral micro RNA (miRNA) gene. The method by which VGAM1561 was detected is described hereinabove with reference to FIGS. 1-8.

VGAM1561 gene, herein designated VGAM GENE, is a viral gene contained in the genome of Bean Common Mosaic Virus. VGAM1561 host target gene, herein designated VGAM HOST TARGET GENE, is a human gene contained in the human genome.

VGAM1561 gene encodes a VGAM1561 precursor RNA, herein designated VGAM PRECURSOR RNA. Similar to other miRNA genes, and unlike most ordinary genes, VGAM1561 precursor RNA does not encode a protein. A nucleotide sequence identical or highly similar to the nucleotide sequence of VGAM1561 precursor RNA is designated SEQ ID:1547, and is provided hereinbelow with reference to the sequence listing part. Nucleotide sequence SEQ ID:1547 is located at position 7254 relative to the genome of Bean Common Mosaic Virus.

VGAM1561 precursor RNA folds onto itself, forming VGAM1561 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1561 folded precursor RNA into VGAM1561 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM1561 RNA is designated SEQ ID:4272, and is provided hereinbelow with reference to the sequence listing part.

VGAM1561 host target gene, herein designated VGAM HOST TARGET GENE, encodes a corresponding messenger RNA, VGAM1561 host target RNA, herein designated VGAM HOST TARGET RNA. VGAM1561 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1561 RNA, herein designated VGAM RNA, binds complementarily to one or more host target binding sites located in untranslated regions of VGAM1561 host target RNA, herein designated VGAM HOST TARGET RNA. This complementary binding is due to the fact that the nucleotide sequence of VGAM1561 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1561 RNA, herein designated VGAM RNA, may have a different number of host target binding sites in untranslated regions of a VGAM1561 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1561 RNA, herein designated VGAM RNA, to host target binding sites on VGAM1561 host target RNA, herein designated VGAM HOST TARGET RNA, such as BINDING SITE I, BINDING SITE II and BINDING SITE III, inhibits translation of VGAM1561 host target RNA into VGAM1561 host target protein, herein designated VGAM HOST TARGET PROTEIN. VGAM host target protein is therefore outlined by a broken line.

It is appreciated that VGAM1561 host target gene, herein designated VGAM HOST TARGET GENE, in fact represents a plurality of VGAM1561 host target genes. The mRNA of each one of this plurality of VGAM1561 host target genes comprises one or more host target binding sites, each having a nucleotide sequence which is at least partly complementary to VGAM1561 RNA, herein designated VGAM RNA, and which when bound by VGAM1561 RNA causes inhibition of translation of respective one or more VGAM1561 host target proteins.

It is further appreciated by one skilled in the art that the mode of translational inhibition illustrated by FIG. 1 with specific reference to translational inhibition exerted by VGAM1561 gene, herein designated VGAM GENE, on one or more VGAM1561 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1561 is inhibition of expression of host target genes, as part of a novel viral mechanism of attacking a host. Accordingly, utilities of VGAM1561 include diagnosis, prevention and treatment of viral infection by Bean Common Mosaic Virus. Specific functions, and accordingly utilities, of VGAM1561 correlate with, and may be deduced from, the identity of the host target genes which VGAM1561 binds and inhibits, and the function of these host target genes, as elaborated hereinbelow.

Nucleotide sequences of the VGAM1561 precursor RNA, herein designated VGAM PRECURSOR RNA, and of the 'diced' VGAM1561 RNA, herein designated VGAM RNA, and a schematic representation of the secondary folding of VGAM1561 folded precursor RNA, herein designated VGAM FOLDED PRECURSOR RNA, of VGAM1561 are further described hereinbelow with reference to Table 1.

Nucleotide sequences of host target binding sites, such as BINDING SITE-I, BINDING SITE-II and BINDING SITE-III of FIG. 1, found on VGAM1561 host target RNA, and schematic representation of the complementarity of each of these host target binding sites to VGAM1561 RNA, herein designated VGAM RNA, are described hereinbelow with reference to Table 2.

As mentioned hereinabove with reference to FIG. 1, a function of VGAM1561 gene, herein designated VGAM is inhibition of expression of VGAM1561 target genes. It is appreciated that specific functions, and accordingly utilities, of VGAM1561 correlate with, and may be deduced from, the identity of the target genes which VGAM1561 binds and inhibits, and the function of these target genes, as elaborated hereinbelow.

KIAA0872 (Accession NM_014940) is a VGAM1561 host target gene. KIAA0872 BINDING SITE is HOST TARGET binding site found in the 3' untranslated region of mRNA encoded by KIAA0872, corresponding to a HOST TARGET binding site such as BINDING SITE I, BINDING SITE II or BINDING SITE III. Table 2 illustrates the complementarity of the nucleotide sequences of KIAA0872 BINDING SITE, designated SEQ ID:17243, to the nucleotide sequence of VGAM1561 RNA, herein designated VGAM RNA, also designated SEQ ID:4272.

A function of VGAM1561 is therefore inhibition of KIAA0872 (Accession NM_014940). Accordingly, utilities of VGAM1561 include diagnosis, prevention and treatment of diseases and clinical conditions associated with KIAA0872. LOC219445 (Accession XM_166212) is another VGAM1561 host target gene. LOC219445 BINDING SITE is HOST TARGET binding site found in the 5' untranslated region of mRNA encoded by LOC219445, corresponding to a HOST TARGET binding site such as BINDING SITE I, BINDING SITE II or BINDING SITE III. Table 2 illustrates the complementarity of the nucleotide sequences of LOC219445 BINDING SITE, designated SEQ ID:44011, to the nucleotide sequence of VGAM1561 RNA, herein designated VGAM RNA, also designated SEQ ID:4272.

Another function of VGAM1561 is therefore inhibition of LOC219445 (Accession XM_166212). Accordingly, utilities of VGAM1561 include diagnosis, prevention and treatment of diseases and clinical conditions associated with LOC219445. LOC58525 (Accession XM_086045) is another VGAM1561 host target gene. LOC58525 BINDING SITE is HOST TARGET binding site found in the 3' untranslated region of mRNA encoded by LOC58525, corresponding to a HOST TARGET binding site such as BINDING SITE I, BINDING SITE II or BINDING SITE III. Table 2 illustrates the complementarity of the nucleotide sequences of LOC58525 BINDING SITE, designated SEQ ID:38455, to the nucleotide sequence of VGAM1561 RNA, herein designated VGAM RNA, also designated SEQ ID:4272.

Another function of VGAM1561 is therefore inhibition of LOC58525 (Accession XM_086045). Accordingly, utilities of VGAM1561 include diagnosis, prevention and treatment of diseases and clinical conditions associated with LOC58525. FIG. 1 further provides a conceptual description of a novel bioinformatically detected viral gene of the present invention, referred to here as Viral Genomic Address Messenger 1562 (VGAM1562) viral gene, which modulates expression of respective host target genes thereof, the function and utility of which host target genes is known in the art.

VGAM1562 is a novel bioinformatically detected regulatory, non protein coding, viral micro RNA (miRNA) gene. The method by which VGAM1562 was detected is described hereinabove with reference to FIGS. 1-8.

VGAM1562 gene, herein designated VGAM GENE, is a viral gene contained in the genome of Bean Common Mosaic Virus. VGAM1562 host target gene, herein designated VGAM HOST TARGET GENE, is a human gene contained in the human genome.

VGAM1562 gene encodes a VGAM1562 precursor RNA, herein designated VGAM PRECURSOR RNA. Similar to other miRNA genes, and unlike most ordinary genes, VGAM1562 precursor RNA does not encode a protein. A nucleotide sequence identical or highly similar to the nucleotide sequence of VGAM1562 precursor RNA is designated SEQ ID:1548, and is provided hereinbelow with reference to the sequence listing part. Nucleotide sequence SEQ ID:1548 is located at position 2292 relative to the genome of Bean Common Mosaic Virus.

VGAM1562 precursor RNA folds onto itself, forming VGAM1562 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1562 folded precursor RNA into VGAM1562 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1562 RNA is designated SEQ ID:4273, and is provided hereinbelow with reference to the sequence listing part.

VGAM1562 host target gene, herein designated VGAM HOST TARGET GENE, encodes a corresponding messenger RNA, VGAM1562 host target RNA, herein designated VGAM HOST TARGET RNA. VGAM1562 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1562 RNA, herein designated VGAM RNA, binds complementarily to one or more host target binding sites located in untranslated regions of VGAM1562 host target RNA, herein designated VGAM HOST TARGET RNA. This complementary binding is due to the fact that the nucleotide sequence of VGAM1562 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1562 RNA, herein designated VGAM RNA, may have a different number of host target binding sites in untranslated regions of a VGAM1562 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1562 RNA, herein designated VGAM RNA, to host target binding sites on VGAM1562 host target RNA, herein designated VGAM HOST TARGET RNA, such as BINDING SITE I, BINDING SITE II and BINDING SITE III, inhibits translation of VGAM1562 host target RNA into VGAM1562 host target protein, herein designated VGAM HOST TARGET PROTEIN. VGAM host target protein is therefore outlined by a broken line.

It is appreciated that VGAM1562 host target gene, herein designated VGAM HOST TARGET GENE, in fact represents a plurality of VGAM1562 host target genes. The mRNA of each one of this plurality of VGAM1562 host target genes comprises one or more host target binding sites, each having a nucleotide sequence which is at least partly complementary to VGAM1562 RNA, herein designated VGAM RNA, and which when bound by VGAM1562 RNA causes inhibition of translation of respective one or more VGAM1562 host target proteins.

It is further appreciated by one skilled in the art that the mode of translational inhibition illustrated by FIG. 1 with specific reference to translational inhibition exerted by VGAM1562 gene, herein designated VGAM GENE, on one or more VGAM1562 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1562 is inhibition of expression of host target genes, as part of a novel viral mechanism of attacking a host. Accordingly, utilities of VGAM1562 include diagnosis, prevention and treatment of viral infection by Bean Common Mosaic Virus. Specific functions, and accordingly utilities, of VGAM1562 correlate with, and may be deduced from, the identity of the host target genes which VGAM1562 binds and inhibits, and the function of these host target genes, as elaborated hereinbelow.

Nucleotide sequences of the VGAM1562 precursor RNA, herein designated VGAM PRECURSOR RNA, and of the 'diced' VGAM1562 RNA, herein designated VGAM RNA, and a schematic representation of the secondary folding of VGAM1562 folded precursor RNA, herein designated VGAM FOLDED PRECURSOR RNA, of VGAM1562 are further described hereinbelow with reference to Table 1.

Nucleotide sequences of host target binding sites, such as BINDING SITE-I, BINDING SITE-II and BINDING SITE-III of FIG. 1, found on VGAM1562 host target RNA, and schematic representation of the complementarity of each of these host target binding sites to VGAM1562 RNA, herein designated VGAM RNA, are described hereinbelow with reference to Table 2.

As mentioned hereinabove with reference to FIG. 1, a function of VGAM1562 gene, herein designated VGAM is inhibition of expression of VGAM1562 target genes. It is appreciated that specific functions, and accordingly utilities, of VGAM1562 correlate with, and may be deduced from, the identity of the target genes which VGAM1562 binds and inhibits, and the function of these target genes, as elaborated hereinbelow.

Chemokine (C-C motif) Receptor-like 1 (CCRL1, Accession NM_016557) is a VGAM1562 host target gene. CCRL1 BINDING SITE is HOST TARGET binding site found in the 3' untranslated region of mRNA encoded by CCRL1, corresponding to a HOST TARGET binding site such as BINDING SITE I, BINDING SITE II or BINDING SITE III. Table 2 illustrates the complementarity of the nucleotide sequences of CCRL1 BINDING SITE, designated SEQ ID:18630, to the nucleotide sequence of VGAM1562 RNA, herein designated VGAM RNA, also designated SEQ ID:4273.

A function of VGAM1562 is therefore inhibition of Chemokine (C-C motif) Receptor-like 1 (CCRL1, Accession NM_016557), a gene which is a G protein-coupled receptor that binds chemokines of the CC subfamily, especially MCP-4, ELC (SCYA19) and TECK (SCYA25). Accordingly, utilities of VGAM1562 include diagnosis, prevention and treatment of diseases and clinical conditions associated with CCRL1. The function of CCRL1 and its association with various diseases and clinical conditions, has been established by previous studies, as described hereinabove with reference to VGAM546. Solute Carrier Family 26, Member 4 (SLC26A4, Accession NM_000441) is another VGAM1562 host target gene. SLC26A4 BINDING SITE is HOST TARGET binding site found in the 3' untranslated region of mRNA encoded by SLC26A4, corresponding to a HOST TARGET binding site such as BINDING SITE I, BINDING SITE II or BINDING SITE III. Table 2 illustrates the complementarity of the nucleotide sequences of SLC26A4 BINDING SITE, designated SEQ ID:6027, to the nucleotide sequence of VGAM1562 RNA, herein designated VGAM RNA, also designated SEQ ID:4273.

Another function of VGAM1562 is therefore inhibition of Solute Carrier Family 26, Member 4 (SLC26A4, Accession NM_000441). Accordingly, utilities of VGAM1562 include diagnosis, prevention and treatment of diseases and clinical conditions associated with SLC26A4. ALK7 (Accession XM_065712) is another VGAM1562 host target gene. ALK7 BINDING SITE is HOST TARGET binding site found in the 3' untranslated region of mRNA encoded by ALK7, corresponding to a HOST TARGET binding site such as BINDING SITE I, BINDING SITE II or BINDING SITE III. Table 2 illustrates the complementarity of the nucleotide sequences of ALK7 BINDING SITE, designated SEQ ID:37296, to the nucleotide sequence of VGAM1562 RNA, herein designated VGAM RNA, also designated SEQ ID:4273.

Another function of VGAM1562 is therefore inhibition of ALK7 (Accession XM_065712). Accordingly, utilities of VGAM1562 include diagnosis, prevention and treatment of diseases and clinical conditions associated with ALK7. DKFZp761F2014 (Accession NM_020215) is another VGAM1562 host target gene. DKFZp761F2014 BINDING SITE is HOST TARGET binding site found in the 3' untranslated region of mRNA encoded by DKFZp761F2014, corresponding to a HOST TARGET binding site such as BINDING SITE I, BINDING SITE II or BINDING SITE III. Table 2 illustrates the complementarity of the nucleotide sequences of DKFZp761F2014 BINDING SITE, designated SEQ ID:21458, to the nucleotide sequence of VGAM1562 RNA, herein designated VGAM RNA, also designated SEQ ID:4273.

Another function of VGAM1562 is therefore inhibition of DKFZp761F2014 (Accession NM_020215). Accordingly, utilities of VGAM1562 include diagnosis, prevention and treatment of diseases and clinical conditions associated with DKFZp761F2014. F-box Only Protein 4 (FBXO4, Accession NM_033484) is another VGAM1562 host target gene. FBXO4 BINDING SITE is HOST TARGET binding site found in the 3' untranslated region of mRNA encoded by FBXO4, corresponding to a HOST TARGET binding site such as BINDING SITE I, BINDING SITE II or BINDING SITE III. Table 2 illustrates the complementarity of the nucleotide sequences of FBXO4 BINDING SITE, designated SEQ ID:27261, to the nucleotide sequence of VGAM1562 RNA, herein designated VGAM RNA, also designated SEQ ID:4273.

Another function of VGAM1562 is therefore inhibition of F-box Only Protein 4 (FBXO4, Accession NM_033484). Accordingly, utilities of VGAM1562 include diagnosis, prevention and treatment of diseases and clinical conditions associated with FBXO4. FLJ10619 (Accession NM_018156) is another VGAM1562 host target gene. FLJ10619 BINDING SITE is HOST TARGET binding site found in the 3' untranslated region of mRNA encoded by FLJ10619, corresponding to a HOST TARGET binding site such as BINDING SITE I, BINDING SITE II or BINDING SITE III. Table 2 illustrates the complementarity of the nucleotide sequences of FLJ10619 BINDING SITE, designated SEQ ID:19967, to the nucleotide sequence of VGAM1562 RNA, herein designated VGAM RNA, also designated SEQ ID:4273.

Another function of VGAM1562 is therefore inhibition of FLJ10619 (Accession NM_018156). Accordingly, utilities of VGAM1562 include diagnosis, prevention and treatment of diseases and clinical conditions associated with FLJ10619. FLJ11210 (Accession XM_005298) is another VGAM1562 host target gene. FLJ11210 BINDING SITE is HOST TARGET binding site found in the 3' untranslated region of mRNA encoded by FLJ11210, corresponding to a HOST TARGET binding site such as BINDING SITE I, BINDING SITE II or BINDING SITE III. Table 2 illustrates the complementarity of the nucleotide sequences of FLJ11210 BINDING SITE, designated SEQ ID:29974, to the nucleotide sequence of VGAM1562 RNA, herein designated VGAM RNA, also designated SEQ ID:4273.

Another function of VGAM1562 is therefore inhibition of FLJ11210 (Accession XM_005298). Accordingly, utilities of VGAM1562 include diagnosis, prevention and treatment of diseases and clinical conditions associated with FLJ11210.

FLJ12619 (Accession NM_030939) is another VGAM1562 host target gene. FLJ12619 BINDING SITE is HOST TARGET binding site found in the 3' untranslated region of mRNA encoded by FLJ12619, corresponding to a HOST TARGET binding site such as BINDING SITE I, BINDING SITE II or BINDING SITE III. Table 2 illustrates the complementarity of the nucleotide sequences of FLJ12619 BINDING SITE, designated SEQ ID:25210, to the nucleotide sequence of VGAM1562 RNA, herein designated VGAM RNA, also designated SEQ ID:4273.

Another function of VGAM1562 is therefore inhibition of FLJ12619 (Accession NM_030939). Accordingly, utilities of VGAM1562 include diagnosis, prevention and treatment of diseases and clinical conditions associated with FLJ12619. FLJ20086 (Accession NM_017661) is another VGAM1562 host target gene. FLJ20086 BINDING SITE is HOST TARGET binding site found in the 3' untranslated region of mRNA encoded by FLJ20086, corresponding to a HOST TARGET binding site such as BINDING SITE I, BINDING SITE II or BINDING SITE III. Table 2 illustrates the complementarity of the nucleotide sequences of FLJ20086 BINDING SITE, designated SEQ ID:19187, to the nucleotide sequence of VGAM1562 RNA, herein designated VGAM RNA, also designated SEQ ID:4273.

Another function of VGAM1562 is therefore inhibition of FLJ20086 (Accession NM_017661). Accordingly, utilities of VGAM1562 include diagnosis, prevention and treatment of diseases and clinical conditions associated with FLJ20086. FLJ21916 (Accession NM_023112) is another VGAM1562 host target gene. FLJ21916 BINDING SITE is HOST TARGET binding site found in the 3' untranslated region of mRNA encoded by FLJ21916, corresponding to a HOST TARGET binding site such as BINDING SITE I, BINDING SITE II or BINDING SITE III. Table 2 illustrates the complementarity of the nucleotide sequences of FLJ21916 BINDING SITE, designated SEQ ID:23385, to the nucleotide sequence of VGAM1562 RNA, herein designated VGAM RNA, also designated SEQ ID:4273.

Another function of VGAM1562 is therefore inhibition of FLJ21916 (Accession NM_023112). Accordingly, utilities of VGAM1562 include diagnosis, prevention and treatment of diseases and clinical conditions associated with FLJ21916. FLJ23511 (Accession NM_032239) is another VGAM1562 host target gene. FLJ23511 BINDING SITE is HOST TARGET binding site found in the 3' untranslated region of mRNA encoded by FLJ23511, corresponding to a HOST TARGET binding site such as BINDING SITE I, BINDING SITE II or BINDING SITE III. Table 2 illustrates the complementarity of the nucleotide sequences of FLJ23511 BINDING SITE, designated SEQ ID:25962, to the nucleotide sequence of VGAM1562 RNA, herein designated VGAM RNA, also designated SEQ ID:4273.

Another function of VGAM1562 is therefore inhibition of FLJ23511 (Accession NM_032239). Accordingly, utilities of VGAM1562 include diagnosis, prevention and treatment of diseases and clinical conditions associated with FLJ23511. HSAJ1454 (Accession NM_016950) is another VGAM1562 host target gene. HSAJ1454 BINDING SITE is HOST TARGET binding site found in the 3' untranslated region of mRNA encoded by HSAJ1454, corresponding to a HOST TARGET binding site such as BINDING SITE I, BINDING SITE II or BINDING SITE III. Table 2 illustrates the complementarity of the nucleotide sequences of HSAJ1454 BINDING SITE, designated SEQ ID:18866, to the nucleotide sequence of VGAM1562 RNA, herein designated VGAM RNA, also designated SEQ ID:4273.

Another function of VGAM1562 is therefore inhibition of HSAJ1454 (Accession NM_016950). Accordingly, utilities of VGAM1562 include diagnosis, prevention and treatment of diseases and clinical conditions associated with HSAJ1454. KIAA0992 (Accession NM_016081) is another VGAM1562 host target gene. KIAA0992 BINDING SITE is HOST TARGET binding site found in the 3' untranslated region of mRNA encoded by KIAA0992, corresponding to a HOST TARGET binding site such as BINDING SITE I, BINDING SITE II or BINDING SITE III. Table 2 illustrates the complementarity of the nucleotide sequences of KIAA0992 BINDING SITE, designated SEQ ID:18156, to the nucleotide sequence of VGAM1562 RNA, herein designated VGAM RNA, also designated SEQ ID:4273.

Another function of VGAM1562 is therefore inhibition of KIAA0992 (Accession NM_016081). Accordingly, utilities of VGAM1562 include diagnosis, prevention and treatment of diseases and clinical conditions associated with KIAA0992. KIAA1323 (Accession XM_032146) is another VGAM1562 host target gene. KIAA1323 BINDING SITE is HOST TARGET binding site found in the 3' untranslated region of mRNA encoded by KIAA1323, corresponding to a HOST TARGET binding site such as BINDING SITE I, BINDING SITE II or BINDING SITE III. Table 2 illustrates the complementarity of the nucleotide sequences of KIAA1323 BINDING SITE, designated SEQ ID:31562, to the nucleotide sequence of VGAM1562 RNA, herein designated VGAM RNA, also designated SEQ ID:4273.

Another function of VGAM1562 is therefore inhibition of KIAA1323 (Accession XM_032146). Accordingly, utilities of VGAM1562 include diagnosis, prevention and treatment of diseases and clinical conditions associated with KIAA1323. Ras Protein-specific Guanine Nucleotide-releasing Factor 2 (RASGRF2, Accession XM_027943) is another VGAM1562 host target gene. RASGRF2 BINDING SITE is HOST TARGET binding site found in the 3' untranslated region of mRNA encoded by RASGRF2, corresponding to a HOST TARGET binding site such as BINDING SITE I, BINDING SITE II or BINDING SITE III. Table 2 illustrates the complementarity of the nucleotide sequences of RASGRF2 BINDING SITE, designated SEQ ID:30597, to the nucleotide sequence of VGAM1562 RNA, herein designated VGAM RNA, also designated SEQ ID:4273.

Another function of VGAM1562 is therefore inhibition of Ras Protein-specific Guanine Nucleotide-releasing Factor 2 (RASGRF2, Accession XM_027943). Accordingly, utilities of VGAM1562 include diagnosis, prevention and treatment of diseases and clinical conditions associated with RASGRF2. SAM Domain, SH3 Domain and Nuclear Localisation Signals, 1 (SAMSN1, Accession NM_022136) is another VGAM1562 host target gene. SAMSN1 BINDING SITE is HOST TARGET binding site found in the 5' untranslated region of mRNA encoded by SAMSN1, corresponding to a HOST TARGET binding site such as BINDING SITE I, BINDING SITE II or BINDING SITE III. Table 2 illustrates the complementarity of the nucleotide sequences of SAMSN1 BINDING SITE, designated SEQ ID:22696, to the nucleotide sequence of VGAM1562 RNA, herein designated VGAM RNA, also designated SEQ ID:4273.

Another function of VGAM1562 is therefore inhibition of SAM Domain, SH3 Domain and Nuclear Localisation Signals, 1 (SAMSN1, Accession NM_022136). Accordingly, utilities of VGAM1562 include diagnosis, prevention and treatment of diseases and clinical conditions associated with SAMSN1. STIP-1 (Accession XM_045694) is another VGAM1562 host target gene. STIP-1 BINDING SITE is HOST TARGET binding site found in the 3' untranslated region of mRNA encoded by STIP-1, corresponding to a HOST TARGET binding site such as BINDING SITE I, BINDING SITE II or BINDING SITE III. Table 2 illustrates the complementarity of the nucleotide sequences of STIP-1 BINDING SITE, designated SEQ ID:34526, to the nucleotide sequence of VGAM1562 RNA, herein designated VGAM RNA, also designated SEQ ID:4273.

Another function of VGAM1562 is therefore inhibition of STIP-1 (Accession XM_045694). Accordingly, utilities of VGAM1562 include diagnosis, prevention and treatment of diseases and clinical conditions associated with STIP-1. TA-KRP (Accession NM_032505) is another VGAM1562 host target gene. TA-KRP BINDING SITE is HOST TARGET binding site found in the 3' untranslated region of mRNA encoded by TA-KRP, corresponding to a HOST TARGET binding site such as BINDING SITE I, BINDING SITE II or BINDING SITE III. Table 2 illustrates the complementarity of the nucleotide sequences of TA-KRP BINDING SITE, designated SEQ ID:26252, to the nucleotide sequence of VGAM1562 RNA, herein designated VGAM RNA, also designated SEQ ID:4273.

Another function of VGAM1562 is therefore inhibition of TA-KRP (Accession NM_032505). Accordingly, utilities of VGAM1562 include diagnosis, prevention and treatment of diseases and clinical conditions associated with TA-KRP. T-cell Lymphoma Invasion and Metastasis 2 (TIAM2, Accession NM_012454) is another VGAM1562 host target gene. TIAM2 BINDING SITE is HOST TARGET binding site found in the 3' untranslated region of mRNA encoded by TIAM2, corresponding to a HOST TARGET binding site such as BINDING SITE I, BINDING SITE II or BINDING SITE III. Table 2 illustrates the complementarity of the nucleotide sequences of TIAM2 BINDING SITE, designated SEQ ID:14822, to the nucleotide sequence of VGAM1562 RNA, herein designated VGAM RNA, also designated SEQ ID:4273.

Another function of VGAM1562 is therefore inhibition of T-cell Lymphoma Invasion and Metastasis 2 (TIAM2, Accession NM_012454). Accordingly, utilities of VGAM1562 include diagnosis, prevention and treatment of diseases and clinical conditions associated with TIAM2. LOC150605 (Accession XM_097927) is another VGAM1562 host target gene. LOC150605 BINDING SITE is HOST TARGET binding site found in the 5' untranslated region of mRNA encoded by LOC150605, corresponding to a HOST TARGET binding site such as BINDING SITE I, BINDING SITE II or BINDING SITE III. Table 2 illustrates the complementarity of the nucleotide sequences of LOC150605 BINDING SITE, designated SEQ ID:41228, to the nucleotide sequence of VGAM1562 RNA, herein designated VGAM RNA, also designated SEQ ID:4273.

Another function of VGAM1562 is therefore inhibition of LOC150605 (Accession XM_097927). Accordingly, utilities of VGAM1562 include diagnosis, prevention and treatment of diseases and clinical conditions associated with LOC150605. LOC152756 (Accession XM_098262) is another VGAM1562 host target gene. LOC152756 BINDING SITE is HOST TARGET binding site found in the 3' untranslated region of mRNA encoded by LOC152756, corresponding to a HOST TARGET binding site such as BINDING SITE I, BINDING SITE II or BINDING SITE III. Table 2 illustrates the complementarity of the nucleotide sequences of LOC152756 BINDING SITE, designated SEQ ID:41549, to the nucleotide sequence of VGAM1562 RNA, herein designated VGAM RNA, also designated SEQ ID:4273.

Another function of VGAM1562 is therefore inhibition of LOC152756 (Accession XM_098262). Accordingly, utilities of VGAM1562 include diagnosis, prevention and treatment of diseases and clinical conditions associated with LOC152756. FIG. 1 further provides a conceptual description of a novel bioinformatically detected viral gene of the present invention, referred to here as Viral Genomic Address Messenger 1563 (VGAM1563) viral gene, which modulates expression of respective host target genes thereof, the function and utility of which host target genes is known in the art.

VGAM1563 is a novel bioinformatically detected regulatory, non protein coding, viral micro RNA (miRNA) gene. The method by which VGAM1563 was detected is described hereinabove with reference to FIGS. 1-8.

VGAM1563 gene, herein designated VGAM GENE, is a viral gene contained in the genome of Bean Common Mosaic Virus. VGAM1563 host target gene, herein designated VGAM HOST TARGET GENE, is a human gene contained in the human genome.

VGAM1563 gene encodes a VGAM1563 precursor RNA, herein designated VGAM PRECURSOR RNA. Similar to other miRNA genes, and unlike most ordinary genes, VGAM1563 precursor RNA does not encode a protein. A nucleotide sequence identical or highly similar to the nucleotide sequence of VGAM1563 precursor RNA is designated SEQ ID:1549, and is provided hereinbelow with reference to the sequence listing part. Nucleotide sequence SEQ ID:1549 is located at position 9514 relative to the genome of Bean Common Mosaic Virus.

VGAM1563 precursor RNA folds onto itself, forming VGAM1563 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1563 folded precursor RNA into VGAM1563 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM1563 RNA is designated SEQ ID:4274, and is provided hereinbelow with reference to the sequence listing part.

VGAM1563 host target gene, herein designated VGAM HOST TARGET GENE, encodes a corresponding messenger RNA, VGAM1563 host target RNA, herein designated VGAM HOST TARGET RNA. VGAM1563 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1563 RNA, herein designated VGAM RNA, binds complementarily to one or more host target binding sites located in untranslated regions of VGAM1563 host target RNA, herein designated VGAM HOST TARGET RNA. This complementary binding is due to the fact that the nucleotide sequence of VGAM1563 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1563 RNA, herein designated VGAM RNA, may have a different number of host target binding sites in untranslated regions of a VGAM1563 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1563 RNA, herein designated VGAM RNA, to host target binding sites on VGAM1563 host target RNA, herein designated VGAM HOST TARGET RNA, such as BINDING SITE I, BINDING SITE II and BINDING SITE III, inhibits translation of VGAM1563 host target RNA into VGAM1563 host target protein, herein designated VGAM HOST TARGET PROTEIN. VGAM host target protein is therefore outlined by a broken line.

It is appreciated that VGAM1563 host target gene, herein designated VGAM HOST TARGET GENE, in fact represents a plurality of VGAM1563 host target genes. The mRNA of each one of this plurality of VGAM1563 host target genes comprises one or more host target binding sites, each having a nucleotide sequence which is at least partly complementary to VGAM1563 RNA, herein designated VGAM RNA, and which when bound by VGAM1563 RNA causes inhibition of translation of respective one or more VGAM1563 host target proteins.

It is further appreciated by one skilled in the art that the mode of translational inhibition illustrated by FIG. 1 with specific reference to translational inhibition exerted by VGAM1563 gene, herein designated VGAM GENE, on one or more VGAM1563 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1563 is inhibition of expression of host target genes, as part of a novel viral mechanism of attacking a host. Accordingly, utilities of VGAM1563 include diagnosis, prevention and treatment of viral infection by Bean Common Mosaic Virus. Specific functions, and accordingly utilities, of VGAM1563 correlate with, and may be deduced from, the identity of the host target genes which VGAM1563 binds and inhibits, and the function of these host target genes, as elaborated hereinbelow.

Nucleotide sequences of the VGAM1563 precursor RNA, herein designated VGAM PRECURSOR RNA, and of the 'diced' VGAM1563 RNA, herein designated VGAM RNA, and a schematic representation of the secondary folding of VGAM1563 folded precursor RNA, herein designated VGAM FOLDED PRECURSOR RNA, of VGAM1563 are further described hereinbelow with reference to Table 1.

Nucleotide sequences of host target binding sites, such as BINDING SITE-I, BINDING SITE-II and BINDING SITE-III of FIG. 1, found on VGAM1563 host target RNA, and schematic representation of the complementarity of each of these host target binding sites to VGAM1563 RNA, herein designated VGAM RNA, are described hereinbelow with reference to Table 2.

As mentioned hereinabove with reference to FIG. 1, a function of VGAM1563 gene, herein designated VGAM is inhibition of expression of VGAM1563 target genes. It is appreciated that specific functions, and accordingly utilities, of VGAM1563 correlate with, and may be deduced from, the identity of the target genes which VGAM1563 binds and inhibits, and the function of these target genes, as elaborated hereinbelow.

Adrenergic, Alpha-1A-, Receptor (ADRA1A, Accession NM_000680) is a VGAM1563 host target gene. ADRA1A BINDING SITE1 through ADRA1A BINDING SITE4 are HOST TARGET binding sites found in untranslated regions of mRNA encoded by ADRA1A, corresponding to HOST TARGET binding sites such as BINDING SITE I, BINDING SITE II or BINDING SITE III. Table 2 illustrates the complementarity of the nucleotide sequences of ADRA1A BINDING SITE1 through ADRA1A BINDING SITE4, designated SEQ ID:6334, SEQ ID:27135, SEQ ID:27136 and SEQ ID:27134 respectively, to the nucleotide sequence of VGAM1563 RNA, herein designated VGAM RNA, also designated SEQ ID:4274.

A function of VGAM1563 is therefore inhibition of Adrenergic, Alpha-1A-, Receptor (ADRA1A, Accession NM_000680). Accordingly, utilities of VGAM1563 include diagnosis, prevention and treatment of diseases and clinical conditions associated with ADRA1A. Hepatocyte Growth Factor (hepapoietin A; scatter factor) (HGF, Accession XM_168542) is another VGAM1563 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45228, to the nucleotide sequence of VGAM1563 RNA, herein designated VGAM RNA, also designated SEQ ID:4274.

Another function of VGAM1563 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM1563 include diagnosis, prevention and treatment of diseases and clinical conditions associated with HGF. The function of HGF and its association with various diseases and clinical conditions, has been established by previous studies, as described hereinabove with reference to VGAM174. Occludin (OCLN, Accession NM_002538) is another VGAM1563 host target gene. OCLN BINDING SITE is HOST TARGET binding site found in the 3' untranslated region of mRNA encoded by OCLN, corresponding to a HOST TARGET binding site such as BINDING SITE I, BINDING SITE II or BINDING SITE III. Table 2 illustrates the complementarity of the nucleotide sequences of OCLN BINDING SITE, designated SEQ ID:8380, to the nucleotide sequence of VGAM1563 RNA, herein designated VGAM RNA, also designated SEQ ID:4274.

Another function of VGAM1563 is therefore inhibition of Occludin (OCLN, Accession NM_002538). Accordingly, utilities of VGAM1563 include diagnosis, prevention and treatment of diseases and clinical conditions associated with OCLN. Sirtuin Silent Mating Type Information Regulation 2 Homolog 1 (S. cerevisiae) (SIRT1, Accession NM_012238) is another VGAM1563 host target gene. SIRT1 BINDING SITE is HOST TARGET binding site found in the 3' untranslated region of mRNA encoded by SIRT1, corresponding to a HOST TARGET binding site such as BINDING SITE I, BINDING SITE II or BINDING SITE III. Table 2 illustrates the complementarity of the nucleotide sequences of SIRT1 BINDING SITE, designated SEQ ID:14543, to the nucleotide sequence of VGAM1563 RNA, herein designated VGAM RNA, also designated SEQ ID:4274.

Another function of VGAM1563 is therefore inhibition of Sirtuin Silent Mating Type Information Regulation 2 Homolog 1 (S. cerevisiae) (SIRT1, Accession NM_012238), a gene which may function as intracellular regulatory protein with mono-ADP-ribosyltransferase activity. Accordingly, utilities of VGAM1563 include diagnosis, prevention and treatment of diseases and clinical conditions associated with SIRT1. The function of SIRT1 and its association with various diseases and clinical conditions, has been established by previous studies, as described hereinabove with reference to VGAM244. CMG2 (Accession NM_058172) is another VGAM1563 host target gene. CMG2 BINDING SITE is HOST TARGET binding site found in the 3' untranslated region of mRNA encoded by CMG2, corresponding to a HOST TARGET binding site such as BINDING SITE I, BINDING SITE II or BINDING SITE III. Table 2 illustrates the complementarity of the nucleotide sequences of CMG2 BINDING SITE, designated SEQ ID:27723, to the nucleotide sequence of VGAM1563 RNA, herein designated VGAM RNA, also designated SEQ ID:4274.

Another function of VGAM1563 is therefore inhibition of CMG2 (Accession NM_058172). Accordingly, utilities of VGAM1563 include diagnosis, prevention and treatment of diseases and clinical conditions associated with CMG2. DKFZp434F142 (Accession NM_032254) is another VGAM1563 host target gene. DKFZp434F142 BINDING SITE is HOST TARGET binding site found in the 3' untranslated region of mRNA encoded by DKFZp434F142, corresponding to a HOST TARGET binding site such as BINDING SITE I, BINDING SITE II or BINDING SITE III. Table 2 illustrates the complementarity of the nucleotide sequences of DKFZp434F142 BINDING SITE, designated SEQ ID:25993, to the nucleotide sequence of VGAM1563 RNA, herein designated VGAM RNA, also designated SEQ ID:4274.

Another function of VGAM1563 is therefore inhibition of DKFZp434F142 (Accession NM_032254). Accordingly, utilities of VGAM1563 include diagnosis, prevention and treatment of diseases and clinical conditions associated with DKFZp434F142. DKFZp547J036 (Accession NM_032281) is another VGAM1563 host target gene. DKFZp547J036 BINDING SITE is HOST TARGET binding site found in the 3' untranslated region of mRNA encoded by DKFZp547J036, corresponding to a HOST TARGET binding site such as BINDING SITE I, BINDING SITE II or BINDING SITE III. Table 2 illustrates the complementarity of the nucleotide sequences of DKFZp547J036 BINDING SITE, designated SEQ ID:26041, to the nucleotide sequence of VGAM1563 RNA, herein designated VGAM RNA, also designated SEQ ID:4274.

Another function of VGAM1563 is therefore inhibition of DKFZp547J036 (Accession NM_032281). Accordingly, utilities of VGAM1563 include diagnosis, prevention and treatment of diseases and clinical conditions associated with DKFZp547J036. Glutamate Receptor, Ionotropic, N-methyl-D-aspartate 3A (GRIN3A, Accession NM_133445) is another VGAM1563 host target gene. GRIN3A BINDING SITE is HOST TARGET binding site found in the 3' untranslated region of mRNA encoded by GRIN3A, corresponding to a HOST TARGET binding site such as BINDING SITE I, BINDING SITE II or BINDING SITE III. Table 2 illustrates the complementarity of the nucleotide sequences of GRIN3A BINDING SITE, designated SEQ ID:28539, to the nucleotide sequence of VGAM1563 RNA, herein designated VGAM RNA, also designated SEQ ID:4274.

Another function of VGAM1563 is therefore inhibition of Glutamate Receptor, Ionotropic, N-methyl-D-aspartate 3A (GRIN3A, Accession NM_133445). Accordingly, utilities of VGAM1563 include diagnosis, prevention and treatment of diseases and clinical conditions associated with GRIN3A. KIAA0367 (Accession XM_041018) is another VGAM1563 host target gene. KIAA0367 BINDING SITE is HOST TARGET binding site found in the 3" untranslated region of mRNA encoded by KIAA0367, corresponding to a HOST TARGET binding site such as BINDING SITE I, BINDING SITE II or BINDING SITE III. Table 2 illustrates the complementarity of the nucleotide sequences of KIAA0367 BINDING SITE, designated SEQ ID:33425, to the nucleotide sequence of VGAM1563 RNA, herein designated VGAM RNA, also designated SEQ ID:4274.

Another function of VGAM1563 is therefore inhibition of KIAA0367 (Accession XM_041018). Accordingly, utilities of VGAM1563 include diagnosis, prevention and treatment of diseases and clinical conditions associated with KIAA0367. KIAA0537 (Accession NM_014840) is another VGAM1563 host target gene. KIAA0537 BINDING SITE is HOST TARGET binding site found in the 5' untranslated region of mRNA encoded by KIAA0537, corresponding to a HOST TARGET binding site such as BINDING SITE I, BINDING SITE II or BINDING SITE III. Table 2 illustrates the complementarity of the nucleotide sequences of KIAA0537 BINDING SITE, designated SEQ ID:16866, to the nucleotide sequence of VGAM1563 RNA, herein designated VGAM RNA, also designated SEQ ID:4274.

Another function of VGAM1563 is therefore inhibition of KIAA0537 (Accession NM_014840). Accordingly, utilities of VGAM1563 include diagnosis, prevention and treatment of diseases and clinical conditions associated with KIAA0537. KIAA1713 (Accession XM_051335) is another VGAM1563 host target gene. KIAA1713 BINDING SITE is HOST TARGET binding site found in the 3' untranslated region of mRNA encoded by KIAA1713, corresponding to a HOST TARGET binding site such as BINDING SITE I, BINDING SITE II or BINDING SITE III. Table 2 illustrates the complementarity of the nucleotide sequences of KIAA1713 BINDING SITE, designated SEQ ID:35811, to the nucleotide sequence of VGAM1563 RNA, herein designated VGAM RNA, also designated SEQ ID:4274.

Another function of VGAM1563 is therefore inhibition of KIAA1713 (Accession XM_051335). Accordingly, utilities of VGAM1563 include diagnosis, prevention and treatment of diseases and clinical conditions associated with KIAA1713. MGC10818 (Accession NM_030568) is another VGAM1563 host target gene. MGC10818 BINDING SITE is HOST TARGET binding site found in the 3' untranslated region of mRNA encoded by MGC10818, corresponding to a HOST TARGET binding site such as BINDING SITE I, BINDING SITE II or BINDING SITE III. Table 2 illustrates the complementarity of the nucleotide sequences of MGC10818 BINDING SITE, designated SEQ ID:24944, to the nucleotide sequence of VGAM1563 RNA, herein designated VGAM RNA, also designated SEQ ID:4274.

Another function of VGAM1563 is therefore inhibition of MGC10818 (Accession NM_030568). Accordingly, utilities of VGAM1563 include diagnosis, prevention and treatment of diseases and clinical conditions associated with MGC10818. PDP (Accession NM_018444) is another VGAM1563 host target gene. PDP BINDING SITE is HOST TARGET binding site found in the 3' untranslated region of mRNA encoded by PDP, corresponding to a HOST TARGET binding site such as BINDING SITE I, BINDING SITE II or BINDING SITE III. Table 2 illustrates the complementarity of the nucleotide sequences of PDP BINDING SITE, designated SEQ ID:20515, to the nucleotide sequence of VGAM1563 RNA, herein designated VGAM RNA, also designated SEQ ID:4274.

Another function of VGAM1563 is therefore inhibition of PDP (Accession NM_018444). Accordingly, utilities of VGAM1563 include diagnosis, prevention and treatment of diseases and clinical conditions associated with PDP. Zinc Finger Protein 323 (ZNF323, Accession NM_030899) is another VGAM1563 host target gene. ZNF323 BINDING SITE is HOST TARGET binding site found in the 3' untranslated region of mRNA encoded by ZNF323, corresponding to a HOST TARGET binding site such as BINDING SITE I, BINDING SITE II or BINDING SITE III. Table 2 illustrates the complementarity of the nucleotide sequences of ZNF323 BINDING SITE, designated SEQ ID:25171, to the nucleotide sequence of VGAM1563 RNA, herein designated VGAM RNA, also designated SEQ ID:4274.

Another function of VGAM1563 is therefore inhibition of Zinc Finger Protein 323 (ZNF323, Accession NM_030899). Accordingly, utilities of VGAM1563 include diagnosis, prevention and treatment of diseases and clinical conditions associated with ZNF323. LOC146485 (Accession XM_007966) is another VGAM1563 host target gene. LOC146485 BINDING SITE is HOST TARGET binding site found in the 5' untranslated region of mRNA encoded by LOC146485, corresponding to a HOST TARGET binding site such as BINDING SITE I, BINDING SITE II or BINDING SITE III. Table 2 illustrates the complementarity of the nucleotide sequences of LOC146485 BINDING SITE, designated SEQ ID:30070, to the nucleotide sequence of VGAM1563 RNA, herein designated VGAM RNA, also designated SEQ ID:4274.

Another function of VGAM1563 is therefore inhibition of LOC146485 (Accession XM_007966). Accordingly, utilities of VGAM1563 include diagnosis, prevention and treatment of diseases and clinical conditions associated with LOC146485. LOC153785 (Accession XM_087763) is another VGAM1563 host target gene. LOC153785 BINDING SITE is HOST TARGET binding site found in the 5' untranslated region of mRNA encoded by LOC153785, corresponding to a HOST TARGET binding site such as BINDING SITE I, BINDING SITE II or BINDING SITE III. Table 2 illustrates the complementarity of the nucleotide sequences of LOC153785 BINDING SITE, designated SEQ ID:39409, to the nucleotide sequence of VGAM1563 RNA, herein designated VGAM RNA, also designated SEQ ID:4274.

Another function of VGAM1563 is therefore inhibition of LOC153785 (Accession XM_087763). Accordingly, utilities of VGAM1563 include diagnosis, prevention and treatment of diseases and clinical conditions associated with LOC153785. LOC157663 (Accession XM_088354) is another VGAM1563 host target gene. LOC157663 BINDING SITE is HOST TARGET binding site found in the 3' untranslated region of mRNA encoded by LOC157663, corresponding to a HOST TARGET binding site such as BINDING SITE I, BINDING SITE II or BINDING SITE III. Table 2 illustrates the complementarity of the nucleotide sequences of LOC157663 BINDING SITE, designated SEQ ID:39639, to the nucleotide sequence of VGAM1563 RNA, herein designated VGAM RNA, also designated SEQ ID:4274.

Another function of VGAM1563 is therefore inhibition of LOC157663 (Accession XM_088354). Accordingly, utilities of VGAM1563 include diagnosis, prevention and treatment of diseases and clinical conditions associated with LOC157663. LOC158377 (Accession XM_098933) is another VGAM1563 host target gene. LOC158377 BINDING SITE is HOST TARGET binding site found in the 5' untranslated region of mRNA encoded by LOC158377, corresponding to a HOST TARGET binding site such as BINDING SITE I, BINDING SITE II or BINDING SITE III. Table 2 illustrates the complementarity of the nucleotide sequences of LOC158377 BINDING SITE, designated SEQ ID:41970, to the nucleotide sequence of VGAM1563 RNA, herein designated VGAM RNA, also designated SEQ ID:4274.

Another function of VGAM1563 is therefore inhibition of LOC158377 (Accession XM_098933). Accordingly, utilities of VGAM1563 include diagnosis, prevention and treatment of diseases and clinical conditions associated with LOC158377. LOC169611 (Accession XM_095809) is another VGAM1563 host target gene. LOC169611 BINDING SITE is HOST TARGET binding site found in the 3' untranslated region of mRNA encoded by LOC169611, corresponding to a HOST TARGET binding site such as BINDING SITE I, BINDING SITE II or BINDING SITE III. Table 2 illustrates the complementarity of the nucleotide sequences of LOC169611 BINDING SITE, designated SEQ ID:40288, to the nucleotide sequence of VGAM1563 RNA, herein designated VGAM RNA, also designated SEQ ID:4274.

Another function of VGAM1563 is therefore inhibition of LOC169611 (Accession XM_095809). Accordingly, utilities of VGAM1563 include diagnosis, prevention and treatment of diseases and clinical conditions associated with LOC169611. LOC93624 (Accession XM_052624) is another VGAM1563 host target gene. LOC93624 BINDING SITE is HOST TARGET binding site found in the 5' untranslated region of mRNA encoded by LOC93624, corresponding to a HOST TARGET binding site such as BINDING SITE I, BINDING SITE II or BINDING SITE III. Table 2 illustrates the complementarity of the nucleotide sequences of LOC93624 BINDING SITE, designated SEQ ID:36017, to the nucleotide sequence of VGAM1563 RNA, herein designated VGAM RNA, also designated SEQ ID:4274.

Another function of VGAM1563 is therefore inhibition of LOC93624 (Accession XM_052624). Accordingly, utilities of VGAM1563 include diagnosis, prevention and treatment of diseases and clinical conditions associated with LOC93624. FIG. 1 further provides a conceptual description of a novel bioinformatically detected viral gene of the present invention, referred to here as Viral Genomic Address Messenger 1564 (VGAM1564) viral gene, which modulates expression of respective host target genes thereof, the function and utility of which host target genes is known in the art.

VGAM1564 is a novel bioinformatically detected regulatory, non protein coding, viral micro RNA (miRNA) gene. The method by which VGAM1564 was detected is described hereinabove with reference to FIGS. 1-8.

VGAM1564 gene, herein designated VGAM GENE, is a viral gene contained in the genome of Human Herpesvirus 5. VGAM1564 host target gene, herein designated VGAM HOST TARGET GENE, is a human gene contained in the human genome.

VGAM1564 gene encodes a VGAM1564 precursor RNA, herein designated VGAM PRECURSOR RNA. Similar to other miRNA genes, and unlike most ordinary genes, VGAM1564 precursor RNA does not encode a protein. A nucleotide sequence identical or highly similar to the nucleotide sequence of VGAM1564 precursor RNA is designated SEQ ID:1550, and is provided hereinbelow with reference to the sequence listing part. Nucleotide sequence SEQ ID:1550 is located at position 167115 relative to the genome of Human Herpesvirus 5.

VGAM1564 precursor RNA folds onto itself, forming VGAM1564 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1564 folded precursor RNA into VGAM1564 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 90%) nucleotide sequence of VGAM1564 RNA is designated SEQ ID:4275, and is provided hereinbelow with reference to the sequence listing part.

VGAM1564 host target gene, herein designated VGAM HOST TARGET GENE, encodes a corresponding messenger RNA, VGAM1564 host target RNA, herein designated VGAM HOST TARGET RNA. VGAM1564 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1564 RNA, herein designated VGAM RNA, binds complementarily to one or more host target binding sites located in untranslated regions of VGAM1564 host target RNA, herein designated VGAM HOST TARGET RNA. This complementary binding is due to the fact that the nucleotide sequence of VGAM1564 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1564 RNA, herein designated VGAM RNA, may have a different number of host target binding sites in untranslated regions of a VGAM1564 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1564 RNA, herein designated VGAM RNA, to host target binding sites on VGAM1564 host target RNA, herein designated VGAM HOST TARGET RNA, such as BINDING SITE I, BINDING SITE II and BINDING SITE III, inhibits translation of VGAM1564 host target RNA into VGAM1564 host target protein, herein designated VGAM HOST TARGET PROTEIN. VGAM host target protein is therefore outlined by a broken line.

It is appreciated that VGAM1564 host target gene, herein designated VGAM HOST TARGET GENE, in fact represents a plurality of VGAM1564 host target genes. The mRNA of each one of this plurality of VGAM1564 host target genes comprises one or more host target binding sites, each having a nucleotide sequence which is at least partly complementary to VGAM1564 RNA, herein designated VGAM RNA, and which when bound by VGAM1564 RNA causes inhibition of translation of respective one or more VGAM1564 host target proteins.

It is further appreciated by one skilled in the art that the mode of translational inhibition illustrated by FIG. 1 with specific reference to translational inhibition exerted by VGAM1564 gene, herein designated VGAM GENE, on one or more VGAM1564 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1564 is inhibition of expression of host target genes, as part of a novel viral mechanism of attacking a host. Accordingly, utilities of VGAM1564 include diagnosis, prevention and treatment of viral infection by Human Herpesvirus 5. Specific functions, and accordingly utilities, of VGAM1564 correlate with, and may be deduced from, the identity of the host target genes which VGAM1564 binds and inhibits, and the function of these host target genes, as elaborated hereinbelow.

Nucleotide sequences of the VGAM1564 precursor RNA, herein designated VGAM PRECURSOR RNA, and of the 'diced' VGAM1564 RNA, herein designated VGAM RNA, and a schematic representation of the secondary folding of VGAM1564 folded precursor RNA, herein designated VGAM FOLDED PRECURSOR RNA, of VGAM1564 are further described hereinbelow with reference to Table 1.

Nucleotide sequences of host target binding sites, such as BINDING SITE-I, BINDING SITE-II and BINDING SITE-III of FIG. 1, found on VGAM1564 host target RNA, and schematic representation of the complementarity of each of these host target binding sites to VGAM1564 RNA, herein designated VGAM RNA, are described hereinbelow with reference to Table 2.

As mentioned hereinabove with reference to FIG. 1, a function of VGAM1564 gene, herein designated VGAM is inhibition of expression of VGAM1564 target genes. It is appreciated that specific functions, and accordingly utilities, of VGAM1564 correlate with, and may be deduced from, the identity of the target genes which VGAM1564 binds and inhibits, and the function of these target genes, as elaborated hereinbelow.

BMF (Accession NM_033503) is a VGAM1564 host target gene. BMF BINDING SITE is HOST TARGET binding site found in the 3' untranslated region of mRNA encoded by BMF, corresponding to a HOST TARGET binding site such as BINDING SITE I, BINDING SITE II or BINDING SITE III. Table 2 illustrates the complementarity of the nucleotide sequences of BMF BINDING SITE, designated SEQ ID:27282, to the nucleotide sequence of VGAM1564 RNA, herein designated VGAM RNA, also designated SEQ ID:4275.

A function of VGAM1564 is therefore inhibition of BMF (Accession NM_033503). Accordingly, utilities of VGAM1564 include diagnosis, prevention and treatment of diseases and clinical conditions associated with BMF. Chromosome 4 Open Reading Frame 6 (C4orf6, Accession NM_005750) is another VGAM1564 host target gene. C4orf6 BINDING SITE is HOST TARGET binding site found in the 5' untranslated region of mRNA encoded by C4orf6, corresponding to a HOST TARGET binding site such as BINDING SITE I, BINDING SITE II or BINDING SITE III. Table 2 illustrates the complementarity of the nucleotide sequences of C4orf6 BINDING SITE, designated SEQ ID:12312, to the nucleotide sequence of VGAM1564 RNA, herein designated VGAM RNA, also designated SEQ ID:4275.

Another function of VGAM1564 is therefore inhibition of Chromosome 4 Open Reading Frame 6 (C4orf6, Accession NM_005750). Accordingly, utilities of VGAM1564 include diagnosis, prevention and treatment of diseases and clinical conditions associated with C4orf6. DKFZp434F142 (Accession NM_032254) is another VGAM1564 host target gene. DKFZp434F142 BINDING SITE is HOST TARGET binding site found in the 3' untranslated region of mRNA encoded by DKFZp434F142, corresponding to a HOST TARGET binding site such as BINDING SITE I, BINDING SITE II or BINDING SITE III. Table 2 illustrates the complementarity of the nucleotide sequences of DKFZp434F142 BINDING SITE, designated SEQ ID:25995, to the nucleotide sequence of VGAM1564 RNA, herein designated VGAM RNA, also designated SEQ ID:4275.

Another function of VGAM1564 is therefore inhibition of DKFZp434F142 (Accession NM_032254). Accordingly, utilities of VGAM1564 include diagnosis, prevention and treatment of diseases and clinical conditions associated with DKFZp434F142. GRB2-associated Binding Protein 3 (GAB3, Accession NM_080612) is another VGAM1564 host target gene. GAB3 BINDING SITE is HOST TARGET binding site found in the 3' untranslated region of mRNA encoded by GAB3, corresponding to a HOST TARGET binding site such as BINDING SITE I, BINDING SITE II or BINDING SITE III. Table 2 illustrates the complementarity of the nucleotide sequences of GAB3 BINDING SITE, designated SEQ ID:27930, to the nucleotide sequence of VGAM1564 RNA, herein designated VGAM RNA, also designated SEQ ID:4275.

Another function of VGAM1564 is therefore inhibition of GRB2-associated Binding Protein 3 (GAB3, Accession NM_080612). Accordingly, utilities of VGAM1564 include diagnosis, prevention and treatment of diseases and clinical conditions associated with GAB3. KIAA0895 (Accession XM_166573) is another VGAM1564 host target gene. KIAA0895 BINDING SITE is HOST TARGET binding site found in the 3' untranslated region of mRNA encoded by KIAA0895, corresponding to a HOST TARGET binding site such as BINDING SITE I, BINDING SITE II or BINDING SITE III. Table 2 illustrates the complementarity of the nucleotide sequences of KIAA0895 BINDING SITE, designated SEQ ID:44548, to the nucleotide sequence of VGAM1564 RNA, herein designated VGAM RNA, also designated SEQ ID:4275.

Another function of VGAM1564 is therefore inhibition of KIAA0895 (Accession XM_166573). Accordingly, utilities of VGAM1564 include diagnosis, prevention and treatment of diseases and clinical conditions associated with KIAA0895. KIAA1193 (Accession XM_041843) is another VGAM1564 host target gene. KIAA1193 BINDING SITE is HOST TARGET binding site found in the 3' untranslated region of mRNA encoded by KIAA1193, corresponding to a HOST TARGET binding site such as BINDING SITE I, BINDING SITE II or BINDING SITE III. Table 2 illustrates the complementarity of the nucleotide sequences of KIAA1193 BINDING SITE, designated SEQ ID:33578, to the nucleotide sequence of VGAM1564 RNA, herein designated VGAM RNA, also designated SEQ ID:4275.

Another function of VGAM1564 is therefore inhibition of KIAA1193 (Accession XM_041843). Accordingly, utilities of VGAM1564 include diagnosis, prevention and treatment of diseases and clinical conditions associated with KIAA1193. MGC2560 (Accession NM_031452) is another VGAM1564 host target gene. MGC2560 BINDING SITE is HOST TARGET binding site found in the 3' untranslated region of mRNA encoded by MGC2560, corresponding to a HOST TARGET binding site such as BINDING SITE I, BINDING SITE II or BINDING SITE III. Table 2 illustrates the complementarity of the nucleotide sequences of MGC2560 BINDING SITE, designated SEQ ID:25468, to the nucleotide sequence of VGAM1564 RNA, herein designated VGAM RNA, also designated SEQ ID:4275.

Another function of VGAM1564 is therefore inhibition of MGC2560 (Accession NM_031452). Accordingly, utilities of VGAM1564 include diagnosis, prevention and treatment of diseases and clinical conditions associated with MGC2560. LOC145497 (Accession XM_085150) is another VGAM1564 host target gene. LOC145497 BINDING SITE is HOST TARGET binding site found in the 5' untranslated region of mRNA encoded by LOC145497, corresponding to a HOST TARGET binding site such as BINDING SITE I, BINDING SITE II or BINDING SITE III. Table 2 illustrates the complementarity of the nucleotide sequences of LOC145497 BINDING SITE, designated SEQ ID:37875, to the nucleotide sequence of VGAM1564 RNA, herein designated VGAM RNA, also designated SEQ ID:4275.

Another function of VGAM1564 is therefore inhibition of LOC145497 (Accession XM_085150). Accordingly, utilities of VGAM1564 include diagnosis, prevention and treatment of diseases and clinical conditions associated with LOC145497. FIG. 1 further provides a conceptual description of a novel bioinformatically detected viral gene of the present invention, referred to here as Viral Genomic Address Messenger 1565 (VGAM1565) viral gene, which modulates expression of respective host target genes thereof, the function and utility of which host target genes is known in the art.

VGAM1565 is a novel bioinformatically detected regulatory, non protein coding, viral micro RNA (miRNA) gene. The method by which VGAM1565 was detected is described hereinabove with reference to FIGS. 1-8.

VGAM1565 gene, herein designated VGAM GENE, is a viral gene contained in the genome of Human Herpesvirus 5. VGAM1565 host target gene, herein designated VGAM HOST TARGET GENE, is a human gene contained in the human genome.

VGAM1565 gene encodes a VGAM1565 precursor RNA, herein designated VGAM PRECURSOR RNA. Similar to other miRNA genes, and unlike most ordinary genes, VGAM1565 precursor RNA does not encode a protein. A nucleotide sequence identical or highly similar to the nucleotide sequence of VGAM1565 precursor RNA is designated SEQ ID:1551, and is provided hereinbelow with reference to the sequence listing part. Nucleotide sequence SEQ ID:1551 is located at position 170917 relative to the genome of Human Herpesvirus 5.

VGAM1565 precursor RNA folds onto itself, forming VGAM1565 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1565 folded precursor RNA into VGAM1565 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1565 RNA is designated SEQ ID:4276, and is provided hereinbelow with reference to the sequence listing part.

VGAM1565 host target gene, herein designated VGAM HOST TARGET GENE, encodes a corresponding messenger RNA, VGAM1565 host target RNA, herein designated VGAM HOST TARGET RNA. VGAM1565 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1565 RNA, herein designated VGAM RNA, binds complementarily to one or more host target binding sites located in untranslated regions of VGAM1565 host target RNA, herein designated VGAM HOST TARGET RNA. This complementary binding is due to the fact that the nucleotide sequence of VGAM1565 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1565 RNA, herein designated VGAM RNA, may have a different number of host target binding sites in untranslated regions of a VGAM1565 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1565 RNA, herein designated VGAM RNA, to host target binding sites on VGAM1565 host target RNA, herein designated VGAM HOST TARGET RNA, such as BINDING SITE I, BINDING SITE II and BINDING SITE III, inhibits translation of VGAM1565 host target RNA into VGAM1565 host target protein, herein designated VGAM HOST TARGET PROTEIN. VGAM host target protein is therefore outlined by a broken line.

It is appreciated that VGAM1565 host target gene, herein designated VGAM HOST TARGET GENE, in fact represents a plurality of VGAM1565 host target genes. The mRNA of each one of this plurality of VGAM1565 host target genes comprises one or more host target binding sites, each having a nucleotide sequence which is at least partly complementary to VGAM1565 RNA, herein designated VGAM RNA, and which when bound by VGAM1565 RNA causes inhibition of translation of respective one or more VGAM1565 host target proteins.

It is further appreciated by one skilled in the art that the mode of translational inhibition illustrated by FIG. 1 with specific reference to translational inhibition exerted by VGAM1565 gene, herein designated VGAM GENE, on one or more VGAM1565 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1565 is inhibition of expression of host target genes, as part of a novel viral mechanism of attacking a host. Accordingly, utilities of VGAM1565 include diagnosis, prevention and treatment of viral infection by Human Herpesvirus 5. Specific functions, and accordingly utilities, of VGAM1565 correlate with, and may be deduced from, the identity of the host target genes which VGAM1565 binds and inhibits, and the function of these host target genes, as elaborated hereinbelow.

Nucleotide sequences of the VGAM1565 precursor RNA, herein designated VGAM PRECURSOR RNA, and of the 'diced' VGAM1565 RNA, herein designated VGAM RNA, and a schematic representation of the secondary folding of VGAM1565 folded precursor RNA, herein designated VGAM FOLDED PRECURSOR RNA, of VGAM1565 are further described hereinbelow with reference to Table 1.

Nucleotide sequences of host target binding sites, such as BINDING SITE-I, BINDING SITE-II and BINDING SITE-III of FIG. 1, found on VGAM1565 host target RNA, and schematic representation of the complementarity of each of these host target binding sites to VGAM1565 RNA, herein designated VGAM RNA, are described hereinbelow with reference to Table 2.

As mentioned hereinabove with reference to FIG. 1, a function of VGAM1565 gene, herein designated VGAM is inhibition of expression of VGAM1565 target genes. It is appreciated that specific functions, and accordingly utilities, of VGAM1565 correlate with, and may be deduced from, the identity of the target genes which VGAM1565 binds and inhibits, and the function of these target genes, as elaborated hereinbelow.

ATP-binding Cassette, Sub-family F (GCN20), Member 1 (ABCF1, Accession NM_001090) is a VGAM1565 host target gene. ABCF1 BINDING SITE is HOST TARGET binding site found in the 3' untranslated region of mRNA encoded by ABCF1, corresponding to a HOST TARGET binding site such as BINDING SITE I, BINDING SITE II or BINDING SITE III. Table 2 illustrates the complementarity of the nucleotide sequences of ABCF1 BINDING SITE, designated SEQ ID:6746, to the nucleotide sequence of VGAM1565 RNA, herein designated VGAM RNA, also designated SEQ ID:4276.

A function of VGAM1565 is therefore inhibition of ATP-binding Cassette, Sub-family F (GCN20), Member 1 (ABCF1, Accession NM_001090). Accordingly, utilities of VGAM1565 include diagnosis, prevention and treatment of diseases and clinical conditions associated with ABCF1. Carbohydrate Kinase-like (CARKL, Accession NM_013276) is another VGAM1565 host target gene. CARKL BINDING SITE is HOST TARGET binding site found in the 3' untranslated region of mRNA encoded by CARKL, corresponding to a HOST TARGET binding site such as BINDING SITE I, BINDING SITE II or BINDING SITE III. Table 2 illustrates the complementarity of the nucleotide sequences of CARKL BINDING SITE, designated SEQ ID:14938, to the nucleotide sequence of VGAM1565 RNA, herein designated VGAM RNA, also designated SEQ ID:4276.

Another function of VGAM1565 is therefore inhibition of Carbohydrate Kinase-like (CARKL, Accession NM_013276), a gene which is a putative carbohydrate kinase and may be a modifier for the cystinosis phenotype. Accordingly, utilities of VGAM1565 include diagnosis, prevention and treatment of diseases and clinical conditions associated with CARKL. The function of CARKL and its association with various diseases and clinical conditions, has been established by previous studies, as described hereinabove with reference to VGAM419. Cryptochrome 2 (photolyase-like) (CRY2, Accession XM_051030) is another VGAM1565 host target gene. CRY2 BINDING SITE is HOST TARGET binding site found in the 3' untranslated region of mRNA encoded by CRY2, corresponding to a HOST TARGET binding site such as BINDING SITE I, BINDING SITE II or BINDING SITE III. Table 2 illustrates the complementarity of the nucleotide sequences of CRY2 BINDING SITE, designated SEQ ID:35731, to the nucleotide sequence of VGAM1565 RNA, herein designated VGAM RNA, also designated SEQ ID:4276.

Another function of VGAM1565 is therefore inhibition of Cryptochrome 2 (photolyase-like) (CRY2, Accession XM_051030), a gene which has a role in circadian photoreception in mammals. Accordingly, utilities of VGAM1565 include diagnosis, prevention and treatment of diseases and clinical conditions associated with CRY2. The function of CRY2 and its association with various diseases and clinical conditions, has been established by previous studies, as described hereinabove with reference to VGAM1223. Diacylglycerol O-acyltransferase Homolog 2 (mouse) (DGAT2, Accession NM_032564) is another VGAM1565 host target gene. DGAT2 BINDING SITE is HOST TARGET binding site found in the 5' untranslated region of mRNA encoded by DGAT2, corresponding to a HOST TARGET binding site such as BINDING SITE I, BINDING SITE II or BINDING SITE III. Table 2 illustrates the complementarity of the nucleotide sequences of DGAT2 BINDING SITE, designated SEQ ID:26292, to the nucleotide sequence of VGAM1565 RNA, herein designated VGAM RNA, also designated SEQ ID:4276.

Another function of VGAM1565 is therefore inhibition of Diacylglycerol O-acyltransferase Homolog 2 (mouse) (DGAT2, Accession NM_032564). Accordingly, utilities of VGAM1565 include diagnosis, prevention and treatment of diseases and clinical conditions associated with DGAT2. Dystrophin (muscular dystrophy, Duchenne and Becker types) (DMD, Accession NM_004021) is another VGAM1565 host target gene. DMD BINDING SITE1 through DMD BINDING SITE3 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 through DMD BINDING SITE3, designated SEQ ID:10222, SEQ ID:10234 and SEQ ID:10195 respectively, to the nucleotide sequence of VGAM1565 RNA, herein designated VGAM RNA, also designated SEQ ID:4276.

Another function of VGAM1565 is therefore inhibition of Dystrophin (muscular dystrophy, Duchenne and Becker types) (DMD, Accession NM_004021), a gene which muscular dystrophy. Accordingly, utilities of VGAM1565 include diagnosis, prevention and treatment of diseases and clinical conditions associated with DMD. The function of DMD and its association with various diseases and clinical conditions, has been established by previous studies, as described hereinabove with reference to VGAM218. UDP-N-acetyl-alpha-D-galactosamine:polypeptide N-acetylgalactosaminyltransferase 3 (GalNAc-T3) (GALNT3, Accession NM_004482) is another VGAM1565 host target gene. GALNT3 BINDING SITE is HOST TARGET binding site found in the 3' untranslated region of mRNA encoded by GALNT3, corresponding to a HOST TARGET binding site such as BINDING SITE I, BINDING SITE II or BINDING SITE III. Table 2 illustrates the complementarity of the nucleotide sequences of GALNT3 BINDING SITE, designated SEQ ID:10802, to the nucleotide sequence of VGAM1565 RNA, herein designated VGAM RNA, also designated SEQ ID:4276.

Another function of VGAM1565 is therefore inhibition of UDP-N-acetyl-alpha-D-galactosamine:polypeptide N-acetylgalactosaminyltransferase 3 (GalNAc-T3) (GALNT3, Accession NM_004482), a gene which initiates O-glycosylation of serine and threonine residues. Accordingly, utilities of VGAM1565 include diagnosis, prevention and treatment of diseases and clinical conditions associated with GALNT3. The function of GALNT3 has been established by previous studies. GALNT3 (EC 2.4.1.41) is one of several enzymes that catalyze the reaction UDP-GalNAc + polypeptide-(Ser/Thr)-OH to GalNAc-alpha-O-Ser/Thr-polypeptide + UDP, thereby initiating O-glycosylation of serine and threonine residues on an array of glycoproteins. Bennett et al. (1996) used degenerate PCR to clone human GALNT3 using primers based on the sequences of GALNT1 (OMIM Ref. No. 602273) and GALNT2 (OMIM Ref. No. 602274). GALNT3 encodes a 633-amino acid protein which has a single membrane-spanning region and is highly homologous to GALNT1 and GALNT2. Northern blot analysis showed that GALNT3 is expressed as a 3.6-kb transcript, with highest levels in human pancreas and testis. Bennett et al. (1996) expressed the gene in insect Sf9 cells and showed that GALNT3 does have GalNAc-transferase activity, but with different substrate specificity than GALNT1 or GALNT2. The mouse ortholog of GalNAc-T3 was cloned by Zara et al. (1996). Bennett et al. (1998) found that the GALNT1, GALNT2, and GALNT3 genes contain 11, 16, and 10 exons, respectively. Several intron/exon boundaries are conserved within the 3 genes. By FISH, Bennett et al. (1998) mapped the GALNT3 gene to human chromosome 2q24-q31.

Full details of the abovementioned studies are described in the following publications, the disclosure of which are hereby incorporated by reference:

Bennett, E. P.; Hassan, H.; Clausen, H.: cDNA cloning and expression of a novel human UDP-N-acetyl-alpha-D-galactosamine. J. Biol. Chem. 271:17006-17012, 1996; and Bennett, E. P.; Weghuis, D. O.; Merkx, G.; Geurts van Kessel, A.; Eiberg, H.; Clausen, H.: Genomic organization and chromosomal localization of three members of the UDP-N-acetylgalacto.

Further studies establishing the function and utilities of GALNT3 are found in John Hopkins OMIM database record ID 601756, and in sited publications numbered 2823-2825 listed in the bibliography section hereinbelow, which are also hereby incorporated by reference. Host Cell Factor C1 (VP16-accessory protein) (HCFC1, Accession XM_048390) is another VGAM1565 host target gene. HCFC1 BINDING SITE is HOST TARGET binding site found in the 3' untranslated region of mRNA encoded by HCFC1, corresponding to a HOST TARGET binding site such as BINDING SITE I, BINDING SITE II or BINDING SITE III. Table 2 illustrates the complementarity of the nucleotide sequences of HCFC1 BINDING SITE, designated SEQ ID:35158, to the nucleotide sequence of VGAM1565 RNA, herein designated VGAM RNA, also designated SEQ ID:4276.

Another function of VGAM1565 is therefore inhibition of Host Cell Factor C1 (VP16-accessory protein) (HCFC1, Accession XM_048390), a gene which is a host cell factor, has a role in cell proliferation and can form a complex with HSV VP16. Accordingly, utilities of VGAM1565 include diagnosis, prevention and treatment of diseases and clinical conditions associated with HCFC1. The function of HCFC1 and its association with various diseases and clinical conditions, has been established by previous studies, as described hereinabove with reference to VGAM341. Homeo Box A7 (HOXA7, Accession NM_006896) is another VGAM1565 host target gene. HOXA7 BINDING SITE is HOST TARGET binding site found in the 3' untranslated region of mRNA encoded by HOXA7, corresponding to a HOST TARGET binding site such as BINDING SITE I, BINDING SITE II or BINDING SITE III. Table 2 illustrates the complementarity of the nucleotide sequences of HOXA7 BINDING SITE, designated SEQ ID:13769, to the nucleotide sequence of VGAM1565 RNA, herein designated VGAM RNA, also designated SEQ ID:4276.

Another function of VGAM1565 is therefore inhibition of Homeo Box A7 (HOXA7, Accession NM_006896), a gene which provides cells with specific positional identities on the anterior-posterior axis. Accordingly, utilities of VGAM1565 include diagnosis, prevention and treatment of diseases and clinical conditions associated with HOXA7. The function of HOXA7 and its association with various diseases and clinical conditions, has been established by previous studies, as described hereinabove with reference to VGAM206. Potassium Voltage-gated Channel, Shaker-related Subfamily, Beta Member 1 (KCNAB1, Accession XM_027634) is another VGAM1565 host target gene. KCNAB1 BINDING SITE is HOST TARGET binding site found in the 3' untranslated region of mRNA encoded by KCNAB1, corresponding to a HOST TARGET binding site such as BINDING SITE I, BINDING SITE II or BINDING SITE III. Table 2 illustrates the complementarity of the nucleotide sequences of KCNAB1 BINDING SITE, designated SEQ ID:30546, to the nucleotide sequence of VGAM1565 RNA, herein designated VGAM RNA, also designated SEQ ID:4276.

Another function of VGAM1565 is therefore inhibition of Potassium Voltage-gated Channel, Shaker-related Subfamily, Beta Member 1 (KCNAB1, Accession XM_027634), a gene which is the regulatory beta subunit for a shaker-related voltage-gated potassium channel. Accordingly, utilities of VGAM1565 include diagnosis, prevention and treatment of diseases and clinical conditions associated with KCNAB1. The function of KCNAB1 and its association with various diseases and clinical conditions, has been established by previous studies, as described hereinabove with reference to VGAM727. Lamin B Receptor (LBR, Accession XM_001795) is another VGAM1565 host target gene. LBR BINDING SITE is HOST TARGET binding site found in the 3' untranslated region of mRNA encoded by LBR, corresponding to a HOST TARGET binding site such as BINDING SITE I, BINDING SITE II or BINDING SITE III. Table 2 illustrates the complementarity of the nucleotide sequences of LBR BINDING SITE, designated SEQ ID:29852, to the nucleotide sequence of VGAM1565 RNA, herein designated VGAM RNA, also designated SEQ ID:4276.

Another function of VGAM1565 is therefore inhibition of Lamin B Receptor (LBR, Accession XM_001795). Accordingly, utilities of VGAM1565 include diagnosis, prevention and treatment of diseases and clinical conditions associated with LBR. LIM Domain Only 7 (LMO7, Accession NM_015843) is another VGAM1565 host target gene. LMO7 BINDING SITE1 and LMO7 BINDING SITE2 are HOST TARGET binding sites found in untranslated regions of mRNA encoded by LMO7, corresponding to HOST TARGET binding sites such as BINDING SITE I, BINDING SITE II or BINDING SITE III. Table 2 illustrates the complementarity of the nucleotide sequences of LMO7 BINDING SITE1 and LMO7 BINDING SITE2, designated SEQ ID:17970 and SEQ ID:11827 respectively, to the nucleotide sequence of VGAM1565 RNA, herein designated VGAM RNA, also designated SEQ ID:4276.

Another function of VGAM1565 is therefore inhibition of LIM Domain Only 7 (LMO7, Accession NM_015843). Accordingly, utilities of VGAM1565 include diagnosis, prevention and treatment of diseases and clinical conditions associated with LMO7. Ribonuclease, RNase A Family, 1 (pancreatic) (RNASE1, Accession XM_033595) is another VGAM1565 host target gene. RNASE1 BINDING SITE is HOST TARGET binding site found in the 5' untranslated region of mRNA encoded by RNASE1, corresponding to a HOST TARGET binding site such as BINDING SITE I, BINDING SITE II or BINDING SITE III. Table 2 illustrates the complementarity of the nucleotide sequences of RNASE1 BINDING SITE, designated SEQ ID:31945, to the nucleotide sequence of VGAM1565 RNA, herein designated VGAM RNA, also designated SEQ ID:4276.

Another function of VGAM1565 is therefore inhibition of Ribonuclease, RNase A Family, 1 (pancreatic) (RNASE1, Accession XM_033595), a gene which is a Pancreatic ribonuclease; a pyrimidine-specific endonuclease that generates 2',3'-cyclic phosphate products. Accordingly, utilities of VGAM1565 include diagnosis, prevention and treatment of diseases and clinical conditions associated with RNASE1. The function of RNASE1 and its association with various diseases and clinical conditions, has been established by previous studies, as described hereinabove with reference to VGAM210. RNA (guanine-7-) Methyltransferase (RNMT, Accession NM_003799) is another VGAM1565 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9889, to the nucleotide sequence of VGAM1565 RNA, herein designated VGAM RNA, also designated SEQ ID:4276.

Another function of VGAM1565 is therefore inhibition of RNA (guanine-7-) Methyltransferase (RNMT, Accession NM_003799), a gene which catalyzes the methylation of GpppN- at the guanine N7 position. Accordingly, utilities of VGAM1565 include diagnosis, prevention and treatment of diseases and clinical conditions associated with RNMT. The function of RNMT and its association with various diseases and clinical conditions, has been established by previous studies, as described hereinabove with reference to VGAM178. Runt-related Transcription Factor 1 (acute myeloid leukemia 1; aml1 oncogene) (RUNX1, Accession NM_001754) is another VGAM1565 host target gene. RUNX1 BINDING SITE is HOST TARGET binding site found in the 3' untranslated region of mRNA encoded by RUNX1, corresponding to a HOST TARGET binding site such as BINDING SITE I, BINDING SITE II or BINDING SITE III. Table 2 illustrates the complementarity of the nucleotide sequences of RUNX1 BINDING SITE, designated SEQ ID:7500, to the nucleotide sequence of VGAM1565 RNA, herein designated VGAM RNA, also designated SEQ ID:4276.

Another function of VGAM1565 is therefore inhibition of Runt-related Transcription Factor 1 (acute myeloid leukemia 1; aml1 oncogene) (RUNX1, Accession NM_001754). Accordingly, utilities of VGAM1565 include diagnosis, prevention and treatment of diseases and clinical conditions associated with RUNX1. Synuclein, Alpha (non A4 component of amyloid precursor) (SNCA, Accession NM_000345) is another VGAM1565 host target gene. SNCA BINDING SITE is HOST TARGET binding site found in the 3' untranslated region of mRNA encoded by SNCA, corresponding to a HOST TARGET binding site such as BINDING SITE I, BINDING SITE II or BINDING SITE III. Table 2 illustrates the complementarity of the nucleotide sequences of SNCA BINDING SITE, designated SEQ ID:5896, to the nucleotide sequence of VGAM1565 RNA, herein designated VGAM RNA, also designated SEQ ID:4276.

Another function of VGAM1565 is therefore inhibition of Synuclein, Alpha (non A4 component of amyloid precursor) (SNCA, Accession NM_000345). Accordingly, utilities of VGAM1565 include diagnosis, prevention and treatment of diseases and clinical conditions associated with SNCA. Ubiquitin Specific Protease 6 (Tre-2 oncogene) (USP6, Accession XM_165948) is another VGAM1565 host target gene. USP6 BINDING SITE is HOST TARGET binding site found in the 3' untranslated region of mRNA encoded by USP6, corresponding to a HOST TARGET binding site such as BINDING SITE I, BINDING SITE II or BINDING SITE III. Table 2 illustrates the complementarity of the nucleotide sequences of USP6 BINDING SITE, designated SEQ ID:43810, to the nucleotide sequence of VGAM1565 RNA, herein designated VGAM RNA, also designated SEQ ID:4276.

Another function of VGAM1565 is therefore inhibition of Ubiquitin Specific Protease 6 (Tre-2 oncogene) (USP6, Accession XM_165948), a gene which has an atp-independent isopeptidase activity, cleaving at the carboxyl terminus of the ubiquitin moiety. Accordingly, utilities of VGAM1565 include diagnosis, prevention and treatment of diseases and clinical conditions associated with USP6. The function of USP6 and its association with various diseases and clinical conditions, has been established by previous studies, as described hereinabove with reference to VGAM296. Amyotrophic Lateral Sclerosis 2 (juvenile) Chromosome Region, Candidate 3 (ALS2CR3, Accession NM_015049) is another VGAM1565 host target gene. ALS2CR3 BINDING SITE is HOST TARGET binding site found in the 3' untranslated region of mRNA encoded by ALS2CR3, corresponding to a HOST TARGET binding site such as BINDING SITE I, BINDING SITE II or BINDING SITE III. Table 2 illustrates the complementarity of the nucleotide sequences of ALS2CR3 BINDING SITE, designated SEQ ID:17412, to the nucleotide sequence of VGAM1565 RNA, herein designated VGAM RNA, also designated SEQ ID:4276.

Another function of VGAM1565 is therefore inhibition of Amyotrophic Lateral Sclerosis 2 (juvenile) Chromosome Region, Candidate 3 (ALS2CR3, Accession NM_015049). Accordingly, utilities of VGAM1565 include diagnosis, prevention and treatment of diseases and clinical conditions associated with ALS2CR3. CD36L2 (Accession NM_005506) is another VGAM1565 host target gene. CD36L2 BINDING SITE is HOST TARGET binding site found in the 3' untranslated region of mRNA encoded by CD36L2, corresponding to a HOST TARGET binding site such as BINDING SITE I, BINDING SITE II or BINDING SITE III. Table 2 illustrates the complementarity of the nucleotide sequences of CD36L2 BINDING SITE, designated SEQ ID:12020, to the nucleotide sequence of VGAM1565 RNA, herein designated VGAM RNA, also designated SEQ ID:4276.

Another function of VGAM1565 is therefore inhibition of CD36L2 (Accession NM_005506). Accordingly, utilities of VGAM1565 include diagnosis, prevention and treatment of diseases and clinical conditions associated with CD36L2. Doublecortin and CaM Kinase-like 1 (DCAMKL1, Accession NM_004734) is another VGAM1565 host target gene. DCAMKL1 BINDING SITE is HOST TARGET binding site found in the 3' untranslated region of mRNA encoded by DCAMKL1, corresponding to a HOST TARGET binding site such as BINDING SITE I, BINDING SITE II or BINDING SITE III. Table 2 illustrates the complementarity of the nucleotide sequences of DCAMKL1 BINDING SITE, designated SEQ ID:11117, to the nucleotide sequence of VGAM1565 RNA, herein designated VGAM RNA, also designated SEQ ID:4276.

Another function of VGAM1565 is therefore inhibition of Doublecortin and CaM Kinase-like 1 (DCAMKL1, Accession NM_004734). Accordingly, utilities of VGAM1565 include diagnosis, prevention and treatment of diseases and clinical conditions associated with DCAMKL1. FKSG28 (Accession NM_030929) is another VGAM1565 host target gene. FKSG28 BINDING SITE is HOST TARGET binding site found in the 3' untranslated region of mRNA encoded by FKSG28, corresponding to a HOST TARGET binding site such as BINDING SITE I, BINDING SITE II or BINDING SITE III. Table 2 illustrates the complementarity of the nucleotide sequences of FKSG28 BINDING SITE, designated SEQ ID:25202, to the nucleotide sequence of VGAM1565 RNA, herein designated VGAM RNA, also designated SEQ ID:4276.

Another function of VGAM1565 is therefore inhibition of FKSG28 (Accession NM_030929). Accordingly, utilities of VGAM1565 include diagnosis, prevention and treatment of diseases and clinical conditions associated with FKSG28. KIAA0173 (Accession NM_014640) is another VGAM1565 host target gene. KIAA0173 BINDING SITE is HOST TARGET binding site found in the 3' untranslated region of mRNA encoded by KIAA0173, corresponding to a HOST TARGET binding site such as BINDING SITE I, BINDING SITE II or BINDING SITE III. Table 2 illustrates the complementarity of the nucleotide sequences of KIAA0173 BINDING SITE, designated SEQ ID:16041, to the nucleotide sequence of VGAM1565 RNA, herein designated VGAM RNA, also designated SEQ ID:4276.

Another function of VGAM1565 is therefore inhibition of KIAA0173 (Accession NM_014640). Accordingly, utilities of VGAM1565 include diagnosis, prevention and treatment of diseases and clinical conditions associated with KIAA0173. KIAA0317 (Accession NM_014821) is another VGAM1565 host target gene. KIAA0317 BINDING SITE is HOST TARGET binding site found in the 3' untranslated region of mRNA encoded by KIAA0317, corresponding to a HOST TARGET binding site such as BINDING SITE I, BINDING SITE II or BINDING SITE III. Table 2 illustrates the complementarity of the nucleotide sequences of KIAA0317 BINDING SITE, designated SEQ ID:16793, to the nucleotide sequence of VGAM1565 RNA, herein designated VGAM RNA, also designated SEQ ID:4276.

Another function of VGAM1565 is therefore inhibition of KIAA0317 (Accession NM_014821). Accordingly, utilities of VGAM1565 include diagnosis, prevention and treatment of diseases and clinical conditions associated with KIAA0317. KIAA0663 (Accession NM_014827) is another VGAM1565 host target gene. KIAA0663 BINDING SITE is HOST TARGET binding site found in the 3' untranslated region of mRNA encoded by KIAA0663, corresponding to a HOST TARGET binding site such as BINDING SITE I, BINDING SITE II or BINDING SITE III. Table 2 illustrates the complementarity of the nucleotide sequences of KIAA0663 BINDING SITE, designated SEQ ID:16813, to the nucleotide sequence of VGAM1565 RNA, herein designated VGAM RNA, also designated SEQ ID:4276.

Another function of VGAM1565 is therefore inhibition of KIAA0663 (Accession NM_014827). Accordingly, utilities of VGAM1565 include diagnosis, prevention and treatment of diseases and clinical conditions associated with KIAA0663. KIAA1001 (Accession NM_014960) is another VGAM1565 host target gene. KIAA1001 BINDING SITE is HOST TARGET binding site found in the 3' untranslated region of mRNA encoded by KIAA1001, corresponding to a HOST TARGET binding site such as BINDING SITE I, BINDING SITE II or BINDING SITE III. Table 2 illustrates the complementarity of the nucleotide sequences of KIAA1001 BINDING SITE, designated SEQ ID:17328, to the nucleotide sequence of VGAM1565 RNA, herein designated VGAM RNA, also designated SEQ ID:4276.

Another function of VGAM1565 is therefore inhibition of KIAA1001 (Accession NM_014960). Accordingly, utilities of VGAM1565 include diagnosis, prevention and treatment of diseases and clinical conditions associated with KIAA1001. KIAA1128 (Accession XM_043596) is another VGAM1565 host target gene. KIAA1128 BINDING SITE is HOST TARGET binding site found in the 3' untranslated region of mRNA encoded by KIAA1128, corresponding to a HOST TARGET binding site such as BINDING SITE I, BINDING SITE II or BINDING SITE III. Table 2 illustrates the complementarity of the nucleotide sequences of KIAA1128 BINDING SITE, designated SEQ ID:33971, to the nucleotide sequence of VGAM1565 RNA, herein designated VGAM RNA, also designated SEQ ID:4276.

Another function of VGAM1565 is therefore inhibition of KIAA1128 (Accession XM_043596). Accordingly, utilities of VGAM1565 include diagnosis, prevention and treatment of diseases and clinical conditions associated with KIAA1128. Karyopherin Alpha 6 (importin alpha 7) (KPNA6, Accession NM_012316) is another VGAM1565 host target gene. KPNA6 BINDING SITE is HOST TARGET binding site found in the 3' untranslated region of mRNA encoded by KPNA6, corresponding to a HOST TARGET binding site such as BINDING SITE I, BINDING SITE II or BINDING SITE III. Table 2 illustrates the complementarity of the nucleotide sequences of KPNA6 BINDING SITE, designated SEQ ID:14685, to the nucleotide sequence of VGAM1565 RNA, herein designated VGAM RNA, also designated SEQ ID:4276.

Another function of VGAM1565 is therefore inhibition of Karyopherin Alpha 6 (importin alpha 7) (KPNA6, Accession NM_012316). Accordingly, utilities of VGAM1565 include diagnosis, prevention and treatment of diseases and clinical conditions associated with KPNA6. Nucleoporin 54 kDa (NUP54, Accession XM_011144) is another VGAM1565 host target gene. NUP54 BINDING SITE is HOST TARGET binding site found in the 3' untranslated region of mRNA encoded by NUP54, corresponding to a HOST TARGET binding site such as BINDING SITE I, BINDING SITE II or BINDING SITE III. Table 2 illustrates the complementarity of the nucleotide sequences of NUP54 BINDING SITE, designated SEQ ID:30179, to the nucleotide sequence of VGAM1565 RNA, herein designated VGAM RNA, also designated SEQ ID:4276.

Another function of VGAM1565 is therefore inhibition of Nucleoporin 54kDa (NUP54, Accession XM_011144). Accordingly, utilities of VGAM1565 include diagnosis, prevention and treatment of diseases and clinical conditions associated with NUP54. Tumor Necrosis Factor Receptor Superfamily, Member 21 (TNFRSF21, Accession NM_014452) is another VGAM1565 host target gene. TNFRSF21 BINDING SITE is HOST TARGET binding site found in the 3' untranslated region of mRNA encoded by TNFRSF21, corresponding to a HOST TARGET binding site such as BINDING SITE I, BINDING SITE II or BINDING SITE III. Table 2 illustrates the complementarity of the nucleotide sequences of TNFRSF21 BINDING SITE, designated SEQ ID:15803, to the nucleotide sequence of VGAM1565 RNA, herein designated VGAM RNA, also designated SEQ ID:4276.

Another function of VGAM1565 is therefore inhibition of Tumor Necrosis Factor Receptor Superfamily, Member 21 (TNFRSF21, Accession NM_014452). Accordingly, utilities of VGAM1565 include diagnosis, prevention and treatment of diseases and clinical conditions associated with TNFRSF21. LOC158527 (Accession XM_088594) is another VGAM1565 host target gene. LOC158527 BINDING SITE is HOST TARGET binding site found in the 5' untranslated region of mRNA encoded by LOC158527, corresponding to a HOST TARGET binding site such as BINDING SITE I, BINDING SITE II or BINDING SITE III. Table 2 illustrates the complementarity of the nucleotide sequences of LOC158527 BINDING SITE, designated SEQ ID:39861, to the nucleotide sequence of VGAM1565 RNA, herein designated VGAM RNA, also designated SEQ ID:4276.

Another function of VGAM1565 is therefore inhibition of LOC158527 (Accession XM_088594). Accordingly, utilities of VGAM1565 include diagnosis, prevention and treatment of diseases and clinical conditions associated with LOC158527. LOC162239 (Accession XM_091439) is another VGAM1565 host target gene. LOC162239 BINDING SITE is HOST TARGET binding site found in the 3' untranslated region of mRNA encoded by LOC162239, corresponding to a HOST TARGET binding site such as BINDING SITE I, BINDING SITE II or BINDING SITE III. Table 2 illustrates the complementarity of the nucleotide sequences of LOC162239 BINDING SITE, designated SEQ ID:40052, to the nucleotide sequence of VGAM1565 RNA, herein designated VGAM RNA, also designated SEQ ID:4276.

Another function of VGAM1565 is therefore inhibition of LOC162239 (Accession XM_091439). Accordingly, utilities of VGAM1565 include diagnosis, prevention and treatment of diseases and clinical conditions associated with LOC162239. LOC220477 (Accession XM_071675) is another VGAM1565 host target gene. LOC220477 BINDING SITE is HOST TARGET binding site found in the 5' untranslated region of mRNA encoded by LOC220477, corresponding to a HOST TARGET binding site such as BINDING SITE I, BINDING SITE II or BINDING SITE III. Table 2 illustrates the complementarity of the nucleotide sequences of LOC220477 BINDING SITE, designated SEQ ID:37409, to the nucleotide sequence of VGAM1565 RNA, herein designated VGAM RNA, also designated SEQ ID:4276.

Another function of VGAM1565 is therefore inhibition of LOC220477 (Accession XM_071675). Accordingly, utilities of VGAM1565 include diagnosis, prevention and treatment of diseases and clinical conditions associated with LOC220477. LOC220573 (Accession XM_045569) is another VGAM1565 host target gene. LOC220573 BINDING SITE is HOST TARGET binding site found in the 3' untranslated region of mRNA encoded by LOC220573, corresponding to a HOST TARGET binding site such as BINDING SITE I, BINDING SITE II or BINDING SITE III. Table 2 illustrates the complementarity of the nucleotide sequences of LOC220573 BINDING SITE, designated SEQ ID:34484, to the nucleotide sequence of VGAM1565 RNA, herein designated VGAM RNA, also designated SEQ ID:4276.

Another function of VGAM1565 is therefore inhibition of LOC220573 (Accession XM_045569). Accordingly, utilities of VGAM1565 include diagnosis, prevention and treatment of diseases and clinical conditions associated with LOC220573. LOC221337 (Accession XM_166387) is another VGAM1565 host target gene. LOC221337 BINDING SITE is HOST TARGET binding site found in the 3' untranslated region of mRNA encoded by LOC221337, corresponding to a HOST TARGET binding site such as BINDING SITE I, BINDING SITE II or BINDING SITE III. Table 2 illustrates the complementarity of the nucleotide sequences of LOC221337 BINDING SITE, designated SEQ ID:44236, to the nucleotide sequence of VGAM1565 RNA, herein designated VGAM RNA, also designated SEQ ID:4276.

Another function of VGAM1565 is therefore inhibition of LOC221337 (Accession XM_166387). Accordingly, utilities of VGAM1565 include diagnosis, prevention and treatment of diseases and clinical conditions associated with LOC221337. LOC253019 (Accession XM_170907) is another VGAM1565 host target gene. LOC253019 BINDING SITE is HOST TARGET binding site found in the 3' untranslated region of mRNA encoded by LOC253019, corresponding to a HOST TARGET binding site such as BINDING SITE I, BINDING SITE II or BINDING SITE III. Table 2 illustrates the complementarity of the nucleotide sequences of LOC253019 BINDING SITE, designated SEQ ID:45668, to the nucleotide sequence of VGAM1565 RNA, herein designated VGAM RNA, also designated SEQ ID:4276.

Another function of VGAM1565 is therefore inhibition of LOC253019 (Accession XM_170907). Accordingly, utilities of VGAM1565 include diagnosis, prevention and treatment of diseases and clinical conditions associated with LOC253019. LOC253975 (Accession XM_171130) is another VGAM1565 host target gene. LOC253975 BINDING SITE is HOST TARGET binding site found in the 3' untranslated region of mRNA encoded by LOC253975, corresponding to a HOST TARGET binding site such as BINDING SITE I, BINDING SITE II or BINDING SITE III. Table 2 illustrates the complementarity of the nucleotide sequences of LOC253975 BINDING SITE, designated SEQ ID:45935, to the nucleotide sequence of VGAM1565 RNA, herein designated VGAM RNA, also designated SEQ ID:4276.

Another function of VGAM1565 is therefore inhibition of LOC253975 (Accession XM_171130). Accordingly, utilities of VGAM1565 include diagnosis, prevention and treatment of diseases and clinical conditions associated with LOC253975. LOC51279 (Accession NM_016546) is another VGAM1565 host target gene. LOC51279 BINDING SITE is HOST TARGET binding site found in the 3' untranslated region of mRNA encoded by LOC51279, corresponding to a HOST TARGET binding site such as BINDING SITE I, BINDING SITE II or BINDING SITE III. Table 2 illustrates the complementarity of the nucleotide sequences of LOC51279 BINDING SITE, designated SEQ ID:18615, to the nucleotide sequence of VGAM1565 RNA, herein designated VGAM RNA, also designated SEQ ID:4276.

Another function of VGAM1565 is therefore inhibition of LOC51279 (Accession NM_016546). Accordingly, utilities of VGAM1565 include diagnosis, prevention and treatment of diseases and clinical conditions associated with LOC51279. LOC93190 (Accession XM_049705) is another VGAM1565 host target gene. LOC93190 BINDING SITE is HOST TARGET binding site found in the 3' untranslated region of mRNA encoded by LOC93190, corresponding to a HOST TARGET binding site such as BINDING SITE I, BINDING SITE II or BINDING SITE III. Table 2 illustrates the complementarity of the nucleotide sequences of LOC93190 BINDING SITE, designated SEQ ID:35489, to the nucleotide sequence of VGAM1565 RNA, herein designated VGAM RNA, also designated SEQ ID:4276.

Another function of VGAM1565 is therefore inhibition of LOC93190 (Accession XM_049705). Accordingly, utilities of VGAM1565 include diagnosis, prevention and treatment of diseases and clinical conditions associated with LOC93190. FIG. 1 further provides a conceptual description of a novel bioinformatically detected viral gene of the present invention, referred to here as Viral Genomic Address Messenger 1566 (VGAM1566) viral gene, which modulates expression of respective host target genes thereof, the function and utility of which host target genes is known in the art.

VGAM1566 is a novel bioinformatically detected regulatory, non protein coding, viral micro RNA (miRNA) gene. The method by which VGAM1566 was detected is described hereinabove with reference to FIGS. 1-8.

VGAM1566 gene, herein designated VGAM GENE, is a viral gene contained in the genome of Human Herpesvirus 5. VGAM1566 host target gene, herein designated VGAM HOST TARGET GENE, is a human gene contained in the human genome.

VGAM1566 gene encodes a VGAM1566 precursor RNA, herein designated VGAM PRECURSOR RNA. Similar to other miRNA genes, and unlike most ordinary genes, VGAM1566 precursor RNA does not encode a protein. A nucleotide sequence identical or highly similar to the nucleotide sequence of VGAM1566 precursor RNA is designated SEQ ID:1552, and is provided hereinbelow with reference to the sequence listing part. Nucleotide sequence SEQ ID:1552 is located at position 165653 relative to the genome of Human Herpesvirus 5.

VGAM1566 precursor RNA folds onto itself, forming VGAM1566 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1566 folded precursor RNA into VGAM1566 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM1566 RNA is designated SEQ ID:4277, and is provided hereinbelow with reference to the sequence listing part.

VGAM1566 host target gene, herein designated VGAM HOST TARGET GENE, encodes a corresponding messenger RNA, VGAM1566 host target RNA, herein designated VGAM HOST TARGET RNA. VGAM1566 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1566 RNA, herein designated VGAM RNA, binds complementarily to one or more host target binding sites located in untranslated regions of VGAM1566 host target RNA, herein designated VGAM HOST TARGET RNA. This complementary binding is due to the fact that the nucleotide sequence of VGAM1566 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1566 RNA, herein designated VGAM RNA, may have a different number of host target binding sites in untranslated regions of a VGAM1566 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1566 RNA, herein designated VGAM RNA, to host target binding sites on VGAM1566 host target RNA, herein designated VGAM HOST TARGET RNA, such as BINDING SITE I, BINDING SITE II and BINDING SITE III, inhibits translation of VGAM1566 host target RNA into VGAM1566 host target protein, herein designated VGAM HOST TARGET PROTEIN. VGAM host target protein is therefore outlined by a broken line.

It is appreciated that VGAM1566 host target gene, herein designated VGAM HOST TARGET GENE, in fact represents a plurality of VGAM1566 host target genes. The mRNA of each one of this plurality of VGAM1566 host target genes comprises one or more host target binding sites, each having a nucleotide sequence which is at least partly complementary to VGAM1566 RNA, herein designated VGAM RNA, and which when bound by VGAM1566 RNA causes inhibition of translation of respective one or more VGAM1566 host target proteins.

It is further appreciated by one skilled in the art that the mode of translational inhibition illustrated by FIG. 1 with specific reference to translational inhibition exerted by VGAM1566 gene, herein designated VGAM GENE, on one or more VGAM1566 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1566 is inhibition of expression of host target genes, as part of a novel viral mechanism of attacking a host. Accordingly, utilities of VGAM1566 include diagnosis, prevention and treatment of viral infection by Human Herpesvirus 5. Specific functions, and accordingly utilities, of VGAM1566 correlate with, and may be deduced from, the identity of the host target genes which VGAM1566 binds and inhibits, and the function of these host target genes, as elaborated hereinbelow.

Nucleotide sequences of the VGAM1566 precursor RNA, herein designated VGAM PRECURSOR RNA, and of the 'diced' VGAM1566 RNA, herein designated VGAM RNA, and a schematic representation of the secondary folding of VGAM1566 folded precursor RNA, herein designated VGAM FOLDED PRECURSOR RNA, of VGAM1566 are further described hereinbelow with reference to Table 1.

Nucleotide sequences of host target binding sites, such as BINDING SITE-I, BINDING SITE-II and BINDING SITE-III of FIG. 1, found on VGAM1566 host target RNA, and schematic representation of the complementarity of each of these host target binding sites to VGAM1566 RNA, herein designated VGAM RNA, are described hereinbelow with reference to Table 2.

As mentioned hereinabove with reference to FIG. 1, a function of VGAM1566 gene, herein designated VGAM is inhibition of expression of VGAM1566 target genes. It is appreciated that specific functions, and accordingly utilities, of VGAM1566 correlate with, and may be deduced from, the identity of the target genes which VGAM1566 binds and inhibits, and the function of these target genes, as elaborated hereinbelow.

Ankylosis, Progressive Homolog (mouse) (ANKH, Accession NM_054027) is a VGAM1566 host target gene. ANKH BINDING SITE is HOST TARGET binding site found in the 3' untranslated region of mRNA encoded by ANKH, corresponding to a HOST TARGET binding site such as BINDING SITE I, BINDING SITE II or BINDING SITE III. Table 2 illustrates the complementarity of the nucleotide sequences of ANKH BINDING SITE, designated SEQ ID:27636, to the nucleotide sequence of VGAM1566 RNA, herein designated VGAM RNA, also designated SEQ ID:4277.

A function of VGAM1566 is therefore inhibition of Ankylosis, Progressive Homolog (mouse) (ANKH, Accession NM_054027), a gene which regulates intra- and extracellular levels of inorganic pyrophosphate (ppi), probably functioning as ppi transporter. Accordingly, utilities of VGAM1566 include diagnosis, prevention and treatment of diseases and clinical conditions associated with ANKH. The function of ANKH and its association with various diseases and clinical conditions, has been established by previous studies, as described hereinabove with reference to VGAM1247. Sialic Acid Binding Ig-like Lectin 6 (SIGLEC6, Accession XM_009378) is another VGAM1566 host target gene. SIGLEC6 BINDING SITE is HOST TARGET binding site found in the 3' untranslated region of mRNA encoded by SIGLEC6, corresponding to a HOST TARGET binding site such as BINDING SITE I, BINDING SITE II or BINDING SITE III. Table 2 illustrates the complementarity of the nucleotide sequences of SIGLEC6 BINDING SITE, designated SEQ ID:30109, to the nucleotide sequence of VGAM1566 RNA, herein designated VGAM RNA, also designated SEQ ID:4277.

Another function of VGAM1566 is therefore inhibition of Sialic Acid Binding Ig-like Lectin 6 (SIGLEC6, Accession XM_009378), a gene which is a cell adhesion molecule for postnatal neural development. Accordingly, utilities of VGAM1566 include diagnosis, prevention and treatment of diseases and clinical conditions associated with SIGLEC6. The function of SIGLEC6 has been established by previous studies. Molecules belonging to the immunoglobulin (Ig) superfamily function as mediators of cell-cell interactions. The sialoadhesin family, a group of sialic acid-binding proteins, is a subgroup of the Ig superfamily. Members of the sialoadhesin family include myeloid antigen CD33 (OMIM Ref. No. 159590). By sequencing cDNAs randomly selected from a human placenta cDNA library, Takei et al. (1997) identified a partial cDNA with high sequence similarity to CD33. Using the partial cDNA, they isolated full-length placenta cDNAs. Since the predicted protein had significant similarity to CD33, they called the corresponding gene 'CD33 antigen-like' (CD33L). The deduced 442-amino acid CD33L protein contains a signal peptide, an N-terminal Ig-like V-domain, and 2 adjacent Ig C2-like domains, followed by a transmembrane region and a cytoplasmic tail. Based on its predicted structure, the authors stated that CD33L belongs to the Ig superfamily and is likely a novel member of the sialoadhesin subfamily. Takei et al. (1997) also isolated a cDNA likely representing an alternatively spliced CD33L transcript; they called this transcript CD33L2 and the aforementioned transcript CD33L1. Compared to the original cDNA, this cDNA contains a 176-bp deletion in the coding sequence, resulting in a predicted 342-amino acid protein lacking the transmembrane and cytoplasmic regions. By RT-PCR of placenta RNA, the authors detected both transcripts, although the transcript encoding the membrane-bound isoform, CD33L1, was considerably more abundant. Northern blot analysis of 16 adult tissues and 4 fetal tissues detected CD33L expression only in the placenta; transcripts of 4 distinct sizes were found, including 1 that was differentially polyadenylated. Using an expression cloning strategy to identify molecules that bind to leptin (OMIM Ref. No. 164160), Patel et al. (1999) isolated a human erythroleukemic cell line cDNA encoding OBBP1. They stated that OBBP1 is identical to CD33L (Takei et al., 1997). The deduced 441-amino acid OBBP1 protein shares 63% and 59% sequence identity with CD33 and OBBP2 (SIGLEC5; 604200), respectively. All 3 of these proteins have a cytoplasmic domain containing putative sites of tyrosine phosphorylation, including an immunoreceptor tyrosine kinase inhibitory motif and a motif found in SLAM (OMIM Ref. No. 603492) and SLAM-like proteins. In vitro studies with sialylated ligands indicated that OBBP1 selectively bound to Neu5Ac (alpha)2-6GalNAc (alpha), or sialyl-Tn, allowing its formal designation as a SIGLEC (sialic acid-binding Ig-like lectin). Recombinant OBBP1 exhibited tight and specific binding to leptin, whereas OBBP2 and CD33 bound weakly to leptin. Northern blot analysis detected high expression of OBBP1 mRNA in placenta, with moderate expression in peripheral blood leukocytes, spleen, and small intestine. Immunohistochemical analysis showed that OBBP1 is highly expressed in the cyto- and syncytiotrophoblasts of the placenta. Flow cytometric analysis on peripheral blood leukocytes found that OBBP1 is almost exclusively expressed on B cells.

Full details of the abovementioned studies are described in the following publications, the disclosure of which are hereby incorporated by reference:

Patel, N.; Brinkman-Van der Linden, E. C. M.; Altmann, S. W.; Gish, K.; Balasubramanian, S.; Timans, J. C.; Peterson, D.; Bell, M. P.; Bazan, J. F.; Varki, A.; Kastelein, R. A.: OB-BP1/Siglec-6: a leptin- and sialic acid-binding protein of the immunoglobulin superfamily. J. Biol. Chem. 274:22729-22738, 1999. Note: Erratum: J. Biol. Chem. 274:28058 only, 1999. ; and Takei, Y.; Sasaki, S.; Fujiwara, T.; Takahashi, E.; Muto, T.; Nakamura, Y.: Molecular cloning of a novel gene similar to myeloid antigen CD33 and its specific expression in placenta.

Further studies establishing the function and utilities of SIGLEC6 are found in John Hopkins OMIM database record ID 604405, and in sited publications numbered 707 and 7444 listed in the bibliography section hereinbelow, which are also hereby incorporated by reference. FLJ14596 (Accession NM_032809) is another VGAM1566 host target gene. FLJ14596 BINDING SITE is HOST TARGET binding site found in the 3' untranslated region of mRNA encoded by FLJ14596, corresponding to a HOST TARGET binding site such as BINDING SITE I, BINDING SITE II or BINDING SITE III. Table 2 illustrates the complementarity of the nucleotide sequences of FLJ14596 BINDING SITE, designated SEQ ID:26569, to the nucleotide sequence of VGAM1566 RNA, herein designated VGAM RNA, also designated SEQ ID:4277.

Another function of VGAM1566 is therefore inhibition of FLJ14596 (Accession NM_032809). Accordingly, utilities of VGAM1566 include diagnosis, prevention and treatment of diseases and clinical conditions associated with FLJ14596. LOC147276 (Accession XM_085756) is another VGAM1566 host target gene. LOC147276 BINDING SITE is HOST TARGET binding site found in the 5' untranslated region of mRNA encoded by LOC147276, corresponding to a HOST TARGET binding site such as BINDING SITE I, BINDING SITE II or BINDING SITE III. Table 2 illustrates the complementarity of the nucleotide sequences of LOC147276 BINDING SITE, designated SEQ ID:38327, to the nucleotide sequence of VGAM1566 RNA, herein designated VGAM RNA, also designated SEQ ID:4277.

Another function of VGAM1566 is therefore inhibition of LOC147276 (Accession XM_085756). Accordingly, utilities of VGAM1566 include diagnosis, prevention and treatment of diseases and clinical conditions associated with LOC147276. FIG. 1 further provides a conceptual description of a novel bioinformatically detected viral gene of the present invention, referred to here as Viral Genomic Address Messenger 1567 (VGAM1567) viral gene, which modulates expression of respective host target genes thereof, the function and utility of which host target genes is known in the art.

VGAM1567 is a novel bioinformatically detected regulatory, non protein coding, viral micro RNA (miRNA) gene. The method by which VGAM1567 was detected is described hereinabove with reference to FIGS. 1-8.

VGAM1567 gene, herein designated VGAM GENE, is a viral gene contained in the genome of Human Herpesvirus 5. VGAM1567 host target gene, herein designated VGAM HOST TARGET GENE, is a human gene contained in the human genome.

VGAM1567 gene encodes a VGAM1567 precursor RNA, herein designated VGAM PRECURSOR RNA. Similar to other miRNA genes, and unlike most ordinary genes, VGAM1567 precursor RNA does not encode a protein. A nucleotide sequence identical or highly similar to the nucleotide sequence of VGAM1567 precursor RNA is designated SEQ ID:1553, and is provided hereinbelow with reference to the sequence listing part. Nucleotide sequence SEQ ID:1553 is located at position 69308 relative to the genome of Human Herpesvirus 5.

VGAM1567 precursor RNA folds onto itself, forming VGAM1567 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1567 folded precursor RNA into VGAM1567 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1567 RNA is designated SEQ ID:4278, and is provided hereinbelow with reference to the sequence listing part.

VGAM1567 host target gene, herein designated VGAM HOST TARGET GENE, encodes a corresponding messenger RNA, VGAM1567 host target RNA, herein designated VGAM HOST TARGET RNA. VGAM1567 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1567 RNA, herein designated VGAM RNA, binds complementarily to one or more host target binding sites located in untranslated regions of VGAM1567 host target RNA, herein designated VGAM HOST TARGET RNA. This complementary binding is due to the fact that the nucleotide sequence of VGAM1567 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1567 RNA, herein designated VGAM RNA, may have a different number of host target binding sites in untranslated regions of a VGAM1567 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1567 RNA, herein designated VGAM RNA, to host target binding sites on VGAM1567 host target RNA, herein designated VGAM HOST TARGET RNA, such as BINDING SITE I, BINDING SITE II and BINDING SITE III, inhibits translation of VGAM1567 host target RNA into VGAM1567 host target protein, herein designated VGAM HOST TARGET PROTEIN. VGAM host target protein is therefore outlined by a broken line.

It is appreciated that VGAM1567 host target gene, herein designated VGAM HOST TARGET GENE, in fact represents a plurality of VGAM1567 host target genes. The mRNA of each one of this plurality of VGAM1567 host target genes comprises one or more host target binding sites, each having a nucleotide sequence which is at least partly complementary to VGAM1567 RNA, herein designated VGAM RNA, and which when bound by VGAM1567 RNA causes inhibition of translation of respective one or more VGAM1567 host target proteins.

It is further appreciated by one skilled in the art that the mode of translational inhibition illustrated by FIG. 1 with specific reference to translational inhibition exerted by VGAM1567 gene, herein designated VGAM GENE, on one or more VGAM1567 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1567 is inhibition of expression of host target genes, as part of a novel viral mechanism of attacking a host. Accordingly, utilities of VGAM1567 include diagnosis, prevention and treatment of viral infection by Human Herpesvirus 5. Specific functions, and accordingly utilities, of VGAM1567 correlate with, and may be deduced from, the identity of the host target genes which VGAM1567 binds and inhibits, and the function of these host target genes, as elaborated hereinbelow.

Nucleotide sequences of the VGAM1567 precursor RNA, herein designated VGAM PRECURSOR RNA, and of the 'diced' VGAM1567 RNA, herein designated VGAM RNA, and a schematic representation of the secondary folding of VGAM1567 folded precursor RNA, herein designated VGAM FOLDED PRECURSOR RNA, of VGAM1567 are further described hereinbelow with reference to Table 1.

Nucleotide sequences of host target binding sites, such as BINDING SITE-I, BINDING SITE-II and BINDING SITE-III of FIG. 1, found on VGAM1567 host target RNA, and schematic representation of the complementarity of each of these host target binding sites to VGAM1567 RNA, herein designated VGAM RNA, are described hereinbelow with reference to Table 2.

As mentioned hereinabove with reference to FIG. 1, a function of VGAM1567 gene, herein designated VGAM is inhibition of expression of VGAM1567 target genes. It is appreciated that specific functions, and accordingly utilities, of VGAM1567 correlate with, and may be deduced from, the identity of the target genes which VGAM1567 binds and inhibits, and the function of these target genes, as elaborated hereinbelow.

Fibroblast Activation Protein, Alpha (FAP, Accession NM_004460) is a VGAM1567 host target gene. FAP BINDING SITE is HOST TARGET binding site found in the 5' untranslated region of mRNA encoded by FAP, corresponding to a HOST TARGET binding site such as BINDING SITE I, BINDING SITE II or BINDING SITE III. Table 2 illustrates the complementarity of the nucleotide sequences of FAP BINDING SITE, designated SEQ ID:10765, to the nucleotide sequence of VGAM1567 RNA, herein designated VGAM RNA, also designated SEQ ID:4278.

A function of VGAM1567 is therefore inhibition of Fibroblast Activation Protein, Alpha (FAP, Accession NM_004460), a gene which may have a role in tissue remodeling during development and wound healing. Accordingly, utilities of VGAM1567 include diagnosis, prevention and treatment of diseases and clinical conditions associated with FAP. The function of FAP and its association with various diseases and clinical conditions, has been established by previous studies, as described hereinabove with reference to VGAM927. LOC145739 (Accession XM_085222) is another VGAM1567 host target gene. LOC145739 BINDING SITE is HOST TARGET binding site found in the 3' untranslated region of mRNA encoded by LOC145739, corresponding to a HOST TARGET binding site such as BINDING SITE I, BINDING SITE II or BINDING SITE III. Table 2 illustrates the complementarity of the nucleotide sequences of LOC145739 BINDING SITE, designated SEQ ID:37965, to the nucleotide sequence of VGAM1567 RNA, herein designated VGAM RNA, also designated SEQ ID:4278.

Another function of VGAM1567 is therefore inhibition of LOC145739 (Accession XM_085222). Accordingly, utilities of VGAM1567 include diagnosis, prevention and treatment of diseases and clinical conditions associated with LOC145739. FIG. 1 further provides a conceptual description of a novel bioinformatically detected viral gene of the present invention, referred to here as Viral Genomic Address Messenger 1568 (VGAM1568) viral gene, which modulates expression of respective host target genes thereof, the function and utility of which host target genes is known in the art.

VGAM1568 is a novel bioinformatically detected regulatory, non protein coding, viral micro RNA (miRNA) gene. The method by which VGAM1568 was detected is described hereinabove with reference to FIGS. 1-8.

VGAM1568 gene, herein designated VGAM GENE, is a viral gene contained in the genome of Human Herpesvirus 5. VGAM1568 host target gene, herein designated VGAM HOST TARGET GENE, is a human gene contained in the human genome.

VGAM1568 gene encodes a VGAM1568 precursor RNA, herein designated VGAM PRECURSOR RNA. Similar to other miRNA genes, and unlike most ordinary genes, VGAM1568 precursor RNA does not encode a protein. A nucleotide sequence identical or highly similar to the nucleotide sequence of VGAM1568 precursor RNA is designated SEQ ID:1554, and is provided hereinbelow with reference to the sequence listing part. Nucleotide sequence SEQ ID:1554 is located at position 61146 relative to the genome of Human Herpesvirus 5.

VGAM1568 precursor RNA folds onto itself, forming VGAM1568 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1568 folded precursor RNA into VGAM1568 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1568 RNA is designated SEQ ID:4279, and is provided hereinbelow with reference to the sequence listing part.

VGAM1568 host target gene, herein designated VGAM HOST TARGET GENE, encodes a corresponding messenger RNA, VGAM1568 host target RNA, herein designated VGAM HOST TARGET RNA. VGAM1568 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1568 RNA, herein designated VGAM RNA, binds complementarily to one or more host target binding sites located in untranslated regions of VGAM1568 host target RNA, herein designated VGAM HOST TARGET RNA. This complementary binding is due to the fact that the nucleotide sequence of VGAM1568 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1568 RNA, herein designated VGAM RNA, may have a different number of host target binding sites in untranslated regions of a VGAM1568 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1568 RNA, herein designated VGAM RNA, to host target binding sites on VGAM1568 host target RNA, herein designated VGAM HOST TARGET RNA, such as BINDING SITE I, BINDING SITE II and BINDING SITE III, inhibits translation of VGAM1568 host target RNA into VGAM1568 host target protein, herein designated VGAM HOST TARGET PROTEIN. VGAM host target protein is therefore outlined by a broken line.

It is appreciated that VGAM1568 host target gene, herein designated VGAM HOST TARGET GENE, in fact represents a plurality of VGAM1568 host target genes. The mRNA of each one of this plurality of VGAM1568 host target genes comprises one or more host target binding sites, each having a nucleotide sequence which is at least partly complementary to VGAM1568 RNA, herein designated VGAM RNA, and which when bound by VGAM1568 RNA causes inhibition of translation of respective one or more VGAM1568 host target proteins.

It is further appreciated by one skilled in the art that the mode of translational inhibition illustrated by FIG. 1 with specific reference to translational inhibition exerted by VGAM1568 gene, herein designated VGAM GENE, on one or more VGAM1568 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1568 is inhibition of expression of host target genes, as part of a novel viral mechanism of attacking a host. Accordingly, utilities of VGAM1568 include diagnosis, prevention and treatment of viral infection by Human Herpesvirus 5. Specific functions, and accordingly utilities, of VGAM1568 correlate with, and may be deduced from, the identity of the host target genes which VGAM1568 binds and inhibits, and the function of these host target genes, as elaborated hereinbelow.

Nucleotide sequences of the VGAM1568 precursor RNA, herein designated VGAM PRECURSOR RNA, and of the 'diced' VGAM1568 RNA, herein designated VGAM RNA, and a schematic representation of the secondary folding of VGAM1568 folded precursor RNA, herein designated VGAM FOLDED PRECURSOR RNA, of VGAM1568 are further described hereinbelow with reference to Table 1.

Nucleotide sequences of host target binding sites, such as BINDING SITE-I, BINDING SITE-II and BINDING SITE-III of FIG. 1, found on VGAM1568 host target RNA, and schematic representation of the complementarity of each of these host target binding sites to VGAM1568 RNA, herein designated VGAM RNA, are described hereinbelow with reference to Table 2.

As mentioned hereinabove with reference to FIG. 1, a function of VGAM1568 gene, herein designated VGAM is inhibition of expression of VGAM1568 target genes. It is appreciated that specific functions, and accordingly utilities, of VGAM1568 correlate with, and may be deduced from, the identity of the target genes which VGAM1568 binds and inhibits, and the function of these target genes, as elaborated hereinbelow.

Protein Kinase C and Casein Kinase Substrate In Neurons 1 (PACSIN1, Accession XM_166424) is a VGAM1568 host target gene. PACSIN1 BINDING SITE is HOST TARGET binding site found in the 3' untranslated region of mRNA encoded by PACSIN1, corresponding to a HOST TARGET binding site such as BINDING SITE I, BINDING SITE II or BINDING SITE III. Table 2 illustrates the complementarity of the nucleotide sequences of PACSIN1 BINDING SITE, designated SEQ ID:44317, to the nucleotide sequence of VGAM1568 RNA, herein designated VGAM RNA, also designated SEQ ID:4279.

A function of VGAM1568 is therefore inhibition of Protein Kinase C and Casein Kinase Substrate In Neurons 1 (PACSIN1, Accession XM_166424). Accordingly, utilities of VGAM1568 include diagnosis, prevention and treatment of diseases and clinical conditions associated with PACSIN1. FLJ22060 (Accession NM_024612) is another VGAM1568 host target gene. FLJ22060 BINDING SITE is HOST TARGET binding site found in the 3' untranslated region of mRNA encoded by FLJ22060, corresponding to a HOST TARGET binding site such as BINDING SITE I, BINDING SITE II or BINDING SITE III. Table 2 illustrates the complementarity of the nucleotide sequences of FLJ22060 BINDING SITE, designated SEQ ID:23864, to the nucleotide sequence of VGAM1568 RNA, herein designated VGAM RNA, also designated SEQ ID:4279.

Another function of VGAM1568 is therefore inhibition of FLJ22060 (Accession NM_024612). Accordingly, utilities of VGAM1568 include diagnosis, prevention and treatment of diseases and clinical conditions associated with FLJ22060. GLP (Accession NM_018652) is another VGAM1568 host target gene. GLP BINDING SITE is HOST TARGET binding site found in the 3' untranslated region of mRNA encoded by GLP, corresponding to a HOST TARGET binding site such as BINDING SITE I, BINDING SITE II or BINDING SITE III. Table 2 illustrates the complementarity of the nucleotide sequences of GLP BINDING SITE, designated SEQ ID:20724, to the nucleotide sequence of VGAM1568 RNA, herein designated VGAM RNA, also designated SEQ ID:4279.

Another function of VGAM1568 is therefore inhibition of GLP (Accession NM_018652). Accordingly, utilities of VGAM1568 include diagnosis, prevention and treatment of diseases and clinical conditions associated with GLP. GOLGIN-67 (Accession XM_170772) is another VGAM1568 host target gene. GOLGIN-67 BINDING SITE is HOST TARGET binding site found in the 3' untranslated region of mRNA encoded by GOLGIN-67, corresponding to a HOST TARGET binding site such as BINDING SITE I, BINDING SITE II or BINDING SITE III. Table 2 illustrates the complementarity of the nucleotide sequences of GOLGIN-67 BINDING SITE, designated SEQ ID:45537, to the nucleotide sequence of VGAM1568 RNA, herein designated VGAM RNA, also designated SEQ ID:4279.

Another function of VGAM1568 is therefore inhibition of GOLGIN-67 (Accession XM_170772). Accordingly, utilities of VGAM1568 include diagnosis, prevention and treatment of diseases and clinical conditions associated with GOLGIN-67. KIAA0855 (Accession NM_015003) is another VGAM1568 host target gene. KIAA0855 BINDING SITE is HOST TARGET binding site found in the 3' untranslated region of mRNA encoded by KIAA0855, corresponding to a HOST TARGET binding site such as BINDING SITE I, BINDING SITE II or BINDING SITE III. Table 2 illustrates the complementarity of the nucleotide sequences of KIAA0855 BINDING SITE, designated SEQ ID:17377, to the nucleotide sequence of VGAM1568 RNA, herein designated VGAM RNA, also designated SEQ ID:4279.

Another function of VGAM1568 is therefore inhibition of KIAA0855 (Accession NM_015003). Accordingly, utilities of VGAM1568 include diagnosis, prevention and treatment of diseases and clinical conditions associated with KIAA0855. Zinc Finger Protein 238 (ZNF238, Accession NM_006352) is another VGAM1568 host target gene. ZNF238 BINDING SITE is HOST TARGET binding site found in the 3' untranslated region of mRNA encoded by ZNF238, corresponding to a HOST TARGET binding site such as BINDING SITE I, BINDING SITE II or BINDING SITE III. Table 2 illustrates the complementarity of the nucleotide sequences of ZNF238 BINDING SITE, designated SEQ ID:13046, to the nucleotide sequence of VGAM1568 RNA, herein designated VGAM RNA, also designated SEQ ID:4279.

Another function of VGAM1568 is therefore inhibition of Zinc Finger Protein 238 (ZNF238, Accession NM_006352). Accordingly, utilities of VGAM1568 include diagnosis, prevention and treatment of diseases and clinical conditions associated with ZNF238. LOC204301 (Accession XM_115306) is another VGAM1568 host target gene. LOC204301 BINDING SITE is HOST TARGET binding site found in the 3' untranslated region of mRNA encoded by LOC204301, corresponding to a HOST TARGET binding site such as BINDING SITE I, BINDING SITE II or BINDING SITE III. Table 2 illustrates the complementarity of the nucleotide sequences of LOC204301 BINDING SITE, designated SEQ ID:43095, to the nucleotide sequence of VGAM1568 RNA, herein designated VGAM RNA, also designated SEQ ID:4279.

Another function of VGAM1568 is therefore inhibition of LOC204301 (Accession XM_115306). Accordingly, utilities of VGAM1568 include diagnosis, prevention and treatment of diseases and clinical conditions associated with LOC204301. LOC220534 (Accession XM_165405) is another VGAM1568 host target gene. LOC220534 BINDING SITE is HOST TARGET binding site found in the 3' untranslated region of mRNA encoded by LOC220534, corresponding to a HOST TARGET binding site such as BINDING SITE I, BINDING SITE II or BINDING SITE III. Table 2 illustrates the complementarity of the nucleotide sequences of LOC220534 BINDING SITE, designated SEQ ID:43618, to the nucleotide sequence of VGAM1568 RNA, herein designated VGAM RNA, also designated SEQ ID:4279.

Another function of VGAM1568 is therefore inhibition of LOC220534 (Accession XM_165405). Accordingly, utilities of VGAM1568 include diagnosis, prevention and treatment of diseases and clinical conditions associated with LOC220534. LOC220538 (Accession XM_165407) is another VGAM1568 host target gene. LOC220538 BINDING SITE is HOST TARGET binding site found in the 3' untranslated region of mRNA encoded by LOC220538, corresponding to a HOST TARGET binding site such as BINDING SITE I, BINDING SITE II or BINDING SITE III. Table 2 illustrates the complementarity of the nucleotide sequences of LOC220538 BINDING SITE, designated SEQ ID:43628, to the nucleotide sequence of VGAM1568 RNA, herein designated VGAM RNA, also designated SEQ ID:4279.

Another function of VGAM1568 is therefore inhibition of LOC220538 (Accession XM_165407). Accordingly, utilities of VGAM1568 include diagnosis, prevention and treatment of diseases and clinical conditions associated with LOC220538. LOC220963 (Accession XM_166145) is another VGAM1568 host target gene. LOC220963 BINDING SITE is HOST TARGET binding site found in the 3' untranslated region of mRNA encoded by LOC220963, corresponding to a HOST TARGET binding site such as BINDING SITE I, BINDING SITE II or BINDING SITE III. Table 2 illustrates the complementarity of the nucleotide sequences of LOC220963 BINDING SITE, designated SEQ ID:43959, to the nucleotide sequence of VGAM1568 RNA, herein designated VGAM RNA, also designated SEQ ID:4279.

Another function of VGAM1568 is therefore inhibition of LOC220963 (Accession XM_166145). Accordingly, utilities of VGAM1568 include diagnosis, prevention and treatment of diseases and clinical conditions associated with LOC220963. LOC254358 (Accession XM_170771) is another VGAM1568 host target gene. LOC254358 BINDING SITE is HOST TARGET binding site found in the 3' untranslated region of mRNA encoded by LOC254358, corresponding to a HOST TARGET binding site such as BINDING SITE I, BINDING SITE II or BINDING SITE III. Table 2 illustrates the complementarity of the nucleotide sequences of LOC254358 BINDING SITE, designated SEQ ID:45533, to the nucleotide sequence of VGAM1568 RNA, herein designated VGAM RNA, also designated SEQ ID:4279.

Another function of VGAM1568 is therefore inhibition of LOC254358 (Accession XM_170771). Accordingly, utilities of VGAM1568 include diagnosis, prevention and treatment of diseases and clinical conditions associated with LOC254358. LOC257286 (Accession XM_170549) is another VGAM1568 host target gene. LOC257286 BINDING SITE is HOST TARGET binding site found in the 3' untranslated region of mRNA encoded by LOC257286, corresponding to a HOST TARGET binding site such as BINDING SITE I, BINDING SITE II or BINDING SITE III. Table 2 illustrates the complementarity of the nucleotide sequences of LOC257286 BINDING SITE, designated SEQ ID:45375, to the nucleotide sequence of VGAM1568 RNA, herein designated VGAM RNA, also designated SEQ ID:4279.

Another function of VGAM1568 is therefore inhibition of LOC257286 (Accession XM_170549). Accordingly, utilities of VGAM1568 include diagnosis, prevention and treatment of diseases and clinical conditions associated with LOC257286. FIG. 1 further provides a conceptual description of a novel bioinformatically detected viral gene of the present invention, referred to here as Viral Genomic Address Messenger 1569 (VGAM1569) viral gene, which modulates expression of respective host target genes thereof, the function and utility of which host target genes is known in the art.

VGAM1569 is a novel bioinformatically detected regulatory, non protein coding, viral micro RNA (miRNA) gene. The method by which VGAM1569 was detected is described hereinabove with reference to FIGS. 1-8.

VGAM1569 gene, herein designated VGAM GENE, is a viral gene contained in the genome of Human Herpesvirus 5. VGAM1569 host target gene, herein designated VGAM HOST TARGET GENE, is a human gene contained in the human genome.

VGAM1569 gene encodes a VGAM1569 precursor RNA, herein designated VGAM PRECURSOR RNA. Similar to other miRNA genes, and unlike most ordinary genes, VGAM1569 precursor RNA does not encode a protein. A nucleotide sequence identical or highly similar to the nucleotide sequence of VGAM1569 precursor RNA is designated SEQ ID:1555, and is provided hereinbelow with reference to the sequence listing part. Nucleotide sequence SEQ ID:1555 is located at position 66671 relative to the genome of Human Herpesvirus 5.

VGAM1569 precursor RNA folds onto itself, forming VGAM1569 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1569 folded precursor RNA into VGAM1569 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1569 RNA is designated SEQ ID:4280, and is provided hereinbelow with reference to the sequence listing part.

VGAM1569 host target gene, herein designated VGAM HOST TARGET GENE, encodes a corresponding messenger RNA, VGAM1569 host target RNA, herein designated VGAM HOST TARGET RNA. VGAM1569 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1569 RNA, herein designated VGAM RNA, binds complementarily to one or more host target binding sites located in untranslated regions of VGAM1569 host target RNA, herein designated VGAM HOST TARGET RNA. This complementary binding is due to the fact that the nucleotide sequence of VGAM1569 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1569 RNA, herein designated VGAM RNA, may have a different number of host target binding sites in untranslated regions of a VGAM1569 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1569 RNA, herein designated VGAM RNA, to host target binding sites on VGAM1569 host target RNA, herein designated VGAM HOST TARGET RNA, such as BINDING SITE I, BINDING SITE II and BINDING SITE III, inhibits translation of VGAM1569 host target RNA into VGAM1569 host target protein, herein designated VGAM HOST TARGET PROTEIN. VGAM host target protein is therefore outlined by a broken line.

It is appreciated that VGAM1569 host target gene, herein designated VGAM HOST TARGET GENE, in fact represents a plurality of VGAM1569 host target genes. The mRNA of each one of this plurality of VGAM1569 host target genes comprises one or more host target binding sites, each having a nucleotide sequence which is at least partly complementary to VGAM1569 RNA, herein designated VGAM RNA, and which when bound by VGAM1569 RNA causes inhibition of translation of respective one or more VGAM1569 host target proteins.

It is further appreciated by one skilled in the art that the mode of translational inhibition illustrated by FIG. 1 with specific reference to translational inhibition exerted by VGAM1569 gene, herein designated VGAM GENE, on one or more VGAM1569 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1569 is inhibition of expression of host target genes, as part of a novel viral mechanism of attacking a host. Accordingly, utilities of VGAM1569 include diagnosis, prevention and treatment of viral infection by Human Herpesvirus 5. Specific functions, and accordingly utilities, of VGAM1569 correlate with, and may be deduced from, the identity of the host target genes which VGAM1569 binds and inhibits, and the function of these host target genes, as elaborated hereinbelow.

Nucleotide sequences of the VGAM1569 precursor RNA, herein designated VGAM PRECURSOR RNA, and of the 'diced' VGAM1569 RNA, herein designated VGAM RNA, and a schematic representation of the secondary folding of VGAM1569 folded precursor RNA, herein designated VGAM FOLDED PRECURSOR RNA, of VGAM1569 are further described hereinbelow with reference to Table 1.

Nucleotide sequences of host target binding sites, such as BINDING SITE-I, BINDING SITE-II and BINDING SITE-III of FIG. 1, found on VGAM1569 host target RNA, and schematic representation of the complementarity of each of these host target binding sites to VGAM1569 RNA, herein designated VGAM RNA, are described hereinbelow with reference to Table 2.

As mentioned hereinabove with reference to FIG. 1, a function of VGAM1569 gene, herein designated VGAM is inhibition of expression of VGAM1569 target genes. It is appreciated that specific functions, and accordingly utilities, of VGAM1569 correlate with, and may be deduced from, the identity of the target genes which VGAM1569 binds and inhibits, and the function of these target genes, as elaborated hereinbelow.

MAP/microtubule Affinity-regulating Kinase 3 (MARK3, Accession NM_002376) is a VGAM1569 host target gene. MARK3 BINDING SITE is HOST TARGET binding site found in the 5' untranslated region of mRNA encoded by MARK3, corresponding to a HOST TARGET binding site such as BINDING SITE I, BINDING SITE II or BINDING SITE III. Table 2 illustrates the complementarity of the nucleotide sequences of MARK3 BINDING SITE, designated SEQ ID:8189, to the nucleotide sequence of VGAM1569 RNA, herein designated VGAM RNA, also designated SEQ ID:4280.

A function of VGAM1569 is therefore inhibition of MAP/microtubule Affinity-regulating Kinase 3 (MARK3, Accession NM_002376), a gene which may be involved in cell cycle regulation. Accordingly, utilities of VGAM1569 include diagnosis, prevention and treatment of diseases and clinical conditions associated with MARK3. The function of MARK3 and its association with various diseases and clinical conditions, has been established by previous studies, as described hereinabove with reference to VGAM964. Testis Expressed Sequence 15 (TEX15, Accession NM_031271) is another VGAM1569 host target gene. TEX15 BINDING SITE is HOST TARGET binding site found in the 3' untranslated region of mRNA encoded by TEX15, corresponding to a HOST TARGET binding site such as BINDING SITE I, BINDING SITE II or BINDING SITE III. Table 2 illustrates the complementarity of the nucleotide sequences of TEX15 BINDING SITE, designated SEQ ID:25295, to the nucleotide sequence of VGAM1569 RNA, herein designated VGAM RNA, also designated SEQ ID:4280.

Another function of VGAM1569 is therefore inhibition of Testis Expressed Sequence 15 (TEX15, Accession NM_031271). Accordingly, utilities of VGAM1569 include diagnosis, prevention and treatment of diseases and clinical conditions associated with TEX15. Tumor Protein P63 (TP63, Accession NM_003722) is another VGAM1569 host target gene. TP63 BINDING SITE is HOST TARGET binding site found in the 3' untranslated region of mRNA encoded by TP63, corresponding to a HOST TARGET binding site such as BINDING SITE I, BINDING SITE II or BINDING SITE III. Table 2 illustrates the complementarity of the nucleotide sequences of TP63 BINDING SITE, designated SEQ ID:9817, to the nucleotide sequence of VGAM1569 RNA, herein designated VGAM RNA, also designated SEQ ID:4280.

Another function of VGAM1569 is therefore inhibition of Tumor Protein P63 (TP63, Accession NM_003722). Accordingly, utilities of VGAM1569 include diagnosis, prevention and treatment of diseases and clinical conditions associated with TP63. G-protein Coupled Receptor 88 (GPR88, Accession NM_022049) is another VGAM1569 host target gene. GPR88 BINDING SITE is HOST TARGET binding site found in the 3' untranslated region of mRNA encoded by GPR88, corresponding to a HOST TARGET binding site such as BINDING SITE I, BINDING SITE II or BINDING SITE III. Table 2 illustrates the complementarity of the nucleotide sequences of GPR88 BINDING SITE, designated SEQ ID:22572, to the nucleotide sequence of VGAM1569 RNA, herein designated VGAM RNA, also designated SEQ ID:4280.

Another function of VGAM1569 is therefore inhibition of G-protein Coupled Receptor 88 (GPR88, Accession NM_022049). Accordingly, utilities of VGAM1569 include diagnosis, prevention and treatment of diseases and clinical conditions associated with GPR88. LOC223009 (Accession XM_170214) is another VGAM1569 host target gene. LOC223009 BINDING SITE is HOST TARGET binding site found in the 5' untranslated region of mRNA encoded by LOC223009, corresponding to a HOST TARGET binding site such as BINDING SITE I, BINDING SITE II or BINDING SITE III. Table 2 illustrates the complementarity of the nucleotide sequences of LOC223009 BINDING SITE, designated SEQ ID:45314, to the nucleotide sequence of VGAM1569 RNA, herein designated VGAM RNA, also designated SEQ ID:4280.

Another function of VGAM1569 is therefore inhibition of LOC223009 (Accession XM_170214). Accordingly, utilities of VGAM1569 include diagnosis, prevention and treatment of diseases and clinical conditions associated with LOC223009. LOC254173 (Accession XM_173022) is another VGAM1569 host target gene. LOC254173 BINDING SITE is HOST TARGET binding site found in the 3' untranslated region of mRNA encoded by LOC254173, corresponding to a HOST TARGET binding site such as BINDING SITE I, BINDING SITE II or BINDING SITE III. Table 2 illustrates the complementarity of the nucleotide sequences of LOC254173 BINDING SITE, designated SEQ ID:46288, to the nucleotide sequence of VGAM1569 RNA, herein designated VGAM RNA, also designated SEQ ID:4280.

Another function of VGAM1569 is therefore inhibition of LOC254173 (Accession XM_173022). Accordingly, utilities of VGAM1569 include diagnosis, prevention and treatment of diseases and clinical conditions associated with LOC254173. FIG. 1 further provides a conceptual description of a novel bioinformatically detected viral gene of the present invention, referred to here as Viral Genomic Address Messenger 1570 (VGAM1570) viral gene, which modulates expression of respective host target genes thereof, the function and utility of which host target genes is known in the art.

VGAM1570 is a novel bioinformatically detected regulatory, non protein coding, viral micro RNA (miRNA) gene. The method by which VGAM1570 was detected is described hereinabove with reference to FIGS. 1-8.

VGAM1570 gene, herein designated VGAM GENE, is a viral gene contained in the genome of Human Herpesvirus 5. VGAM1570 host target gene, herein designated VGAM HOST TARGET GENE, is a human gene contained in the human genome.

VGAM1570 gene encodes a VGAM1570 precursor RNA, herein designated VGAM PRECURSOR RNA. Similar to other miRNA genes, and unlike most ordinary genes, VGAM1570 precursor RNA does not encode a protein. A nucleotide sequence identical or highly similar to the nucleotide sequence of VGAM1570 precursor RNA is designated SEQ ID:1556, and is provided hereinbelow with reference to the sequence listing part. Nucleotide sequence SEQ ID:1556 is located at position 65530 relative to the genome of Human Herpesvirus 5.

VGAM1570 precursor RNA folds onto itself, forming VGAM1570 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1570 folded precursor RNA into VGAM1570 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM1570 RNA is designated SEQ ID:4281, and is provided hereinbelow with reference to the sequence listing part.

VGAM1570 host target gene, herein designated VGAM HOST TARGET GENE, encodes a corresponding messenger RNA, VGAM1570 host target RNA, herein designated VGAM HOST TARGET RNA. VGAM1570 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1570 RNA, herein designated VGAM RNA, binds complementarily to one or more host target binding sites located in untranslated regions of VGAM1570 host target RNA, herein designated VGAM HOST TARGET RNA. This complementary binding is due to the fact that the nucleotide sequence of VGAM1570 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1570 RNA, herein designated VGAM RNA, may have a different number of host target binding sites in untranslated regions of a VGAM1570 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1570 RNA, herein designated VGAM RNA, to host target binding sites on VGAM1570 host target RNA, herein designated VGAM HOST TARGET RNA, such as BINDING SITE I, BINDING SITE II and BINDING SITE III, inhibits translation of VGAM1570 host target RNA into VGAM1570 host target protein, herein designated VGAM HOST TARGET PROTEIN. VGAM host target protein is therefore outlined by a broken line.

It is appreciated that VGAM1570 host target gene, herein designated VGAM HOST TARGET GENE, in fact represents a plurality of VGAM1570 host target genes. The mRNA of each one of this plurality of VGAM1570 host target genes comprises one or more host target binding sites, each having a nucleotide sequence which is at least partly complementary to VGAM1570 RNA, herein designated VGAM RNA, and which when bound by VGAM1570 RNA causes inhibition of translation of respective one or more VGAM1570 host target proteins.

It is further appreciated by one skilled in the art that the mode of translational inhibition illustrated by FIG. 1 with specific reference to translational inhibition exerted by VGAM1570 gene, herein designated VGAM GENE, on one or more VGAM1570 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1570 is inhibition of expression of host target genes, as part of a novel viral mechanism of attacking a host. Accordingly, utilities of VGAM1570 include diagnosis, prevention and treatment of viral infection by Human Herpesvirus 5. Specific functions, and accordingly utilities, of VGAM1570 correlate with, and may be deduced from, the identity of the host target genes which VGAM1570 binds and inhibits, and the function of these host target genes, as elaborated hereinbelow.

Nucleotide sequences of the VGAM1570 precursor RNA, herein designated VGAM PRECURSOR RNA, and of the 'diced' VGAM1570 RNA, herein designated VGAM RNA, and a schematic representation of the secondary folding of VGAM1570 folded precursor RNA, herein designated VGAM FOLDED PRECURSOR RNA, of VGAM1570 are further described hereinbelow with reference to Table 1.

Nucleotide sequences of host target binding sites, such as BINDING SITE-I, BINDING SITE-II and BINDING SITE-III of FIG. 1, found on VGAM1570 host target RNA, and schematic representation of the complementarity of each of these host target binding sites to VGAM1570 RNA, herein designated VGAM RNA, are described hereinbelow with reference to Table 2.

As mentioned hereinabove with reference to FIG. 1, a function of VGAM1570 gene, herein designated VGAM is inhibition of expression of VGAM1570 target genes. It is appreciated that specific functions, and accordingly utilities, of VGAM1570 correlate with, and may be deduced from, the identity of the target genes which VGAM1570 binds and inhibits, and the function of these target genes, as elaborated hereinbelow.

Beta-1,3-glucuronyltransferase 1 (glucuronosyltransferase P) (B3GAT1, Accession NM_018644) is a VGAM1570 host target gene. B3GAT1 BINDING SITE1 and B3GAT1 BINDING SITE2 are HOST TARGET binding sites found in untranslated regions of mRNA encoded by B3GAT1, corresponding to HOST TARGET binding sites such as BINDING SITE I, BINDING SITE II or BINDING SITE III. Table 2 illustrates the complementarity of the nucleotide sequences of B3GAT1 BINDING SITE1 and B3GAT1 BINDING SITE2, designated SEQ ID:20714 and SEQ ID:27626 respectively, to the nucleotide sequence of VGAM1570 RNA, herein designated VGAM RNA, also designated SEQ ID:4281.

A function of VGAM1570 is therefore inhibition of Beta-1,3-glucuronyltransferase 1 (glucuronosyltransferase P) (B3GAT1, Accession NM_018644). Accordingly, utilities of VGAM1570 include diagnosis, prevention and treatment of diseases and clinical conditions associated with B3GAT1. LOC144667 (Accession XM_096648) is another VGAM1570 host target gene. LOC144667 BINDING SITE is HOST TARGET binding site found in the 5' untranslated region of mRNA encoded by LOC144667, corresponding to a HOST TARGET binding site such as BINDING SITE I, BINDING SITE II or BINDING SITE III. Table 2 illustrates the complementarity of the nucleotide sequences of LOC144667 BINDING SITE, designated SEQ ID:40449, to the nucleotide sequence of VGAM1570 RNA, herein designated VGAM RNA, also designated SEQ ID:4281.

Another function of VGAM1570 is therefore inhibition of LOC144667 (Accession XM_096648). Accordingly, utilities of VGAM1570 include diagnosis, prevention and treatment of diseases and clinical conditions associated with LOC144667. FIG. 1 further provides a conceptual description of a novel bioinformatically detected viral gene of the present invention, referred to here as Viral Genomic Address Messenger 1571 (VGAM1571) viral gene, which modulates expression of respective host target genes thereof, the function and utility of which host target genes is known in the art.

VGAM1571 is a novel bioinformatically detected regulatory, non protein coding, viral micro RNA (miRNA) gene. The method by which VGAM1571 was detected is described hereinabove with reference to FIGS. 1-8.

VGAM1571 gene, herein designated VGAM GENE, is a viral gene contained in the genome of Rhopalosiphum Padi Virus. VGAM1571 host target gene, herein designated VGAM HOST TARGET GENE, is a human gene contained in the human genome.

VGAM1571 gene encodes a VGAM1571 precursor RNA, herein designated VGAM PRECURSOR RNA. Similar to other miRNA genes, and unlike most ordinary genes, VGAM1571 precursor RNA does not encode a protein. A nucleotide sequence identical or highly similar to the nucleotide sequence of VGAM1571 precursor RNA is designated SEQ ID:1557, and is provided hereinbelow with reference to the sequence listing part. Nucleotide sequence SEQ ID:1557 is located at position 4 relative to the genome of Rhopalosiphum Padi Virus.

VGAM1571 precursor RNA folds onto itself, forming VGAM1571 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1571 folded precursor RNA into VGAM1571 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1571 RNA is designated SEQ ID:4282, and is provided hereinbelow with reference to the sequence listing part.

VGAM1571 host target gene, herein designated VGAM HOST TARGET GENE, encodes a corresponding messenger RNA, VGAM1571 host target RNA, herein designated VGAM HOST TARGET RNA. VGAM1571 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1571 RNA, herein designated VGAM RNA, binds complementarily to one or more host target binding sites located in untranslated regions of VGAM1571 host target RNA, herein designated VGAM HOST TARGET RNA. This complementary binding is due to the fact that the nucleotide sequence of VGAM1571 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1571 RNA, herein designated VGAM RNA, may have a different number of host target binding sites in untranslated regions of a VGAM1571 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1571 RNA, herein designated VGAM RNA, to host target binding sites on VGAM1571 host target RNA, herein designated VGAM HOST TARGET RNA, such as BINDING SITE I, BINDING SITE II and BINDING SITE III, inhibits translation of VGAM1571 host target RNA into VGAM1571 host target protein, herein designated VGAM HOST TARGET PROTEIN. VGAM host target protein is therefore outlined by a broken line.

It is appreciated that VGAM1571 host target gene, herein designated VGAM HOST TARGET GENE, in fact represents a plurality of VGAM1571 host target genes. The mRNA of each one of this plurality of VGAM1571 host target genes comprises one or more host target binding sites, each having a nucleotide sequence which is at least partly complementary to VGAM1571 RNA, herein designated VGAM RNA, and which when bound by VGAM1571 RNA causes inhibition of translation of respective one or more VGAM1571 host target proteins.

It is further appreciated by one skilled in the art that the mode of translational inhibition illustrated by FIG. 1 with specific reference to translational inhibition exerted by VGAM1571 gene, herein designated VGAM GENE, on one or more VGAM1571 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1571 is inhibition of expression of host target genes, as part of a novel viral mechanism of attacking a host. Accordingly, utilities of VGAM1571 include diagnosis, prevention and treatment of viral infection by Rhopalosiphum Padi Virus. Specific functions, and accordingly utilities, of VGAM1571 correlate with, and may be deduced from, the identity of the host target genes which VGAM1571 binds and inhibits, and the function of these host target genes, as elaborated hereinbelow.

Nucleotide sequences of the VGAM1571 precursor RNA, herein designated VGAM PRECURSOR RNA, and of the 'diced' VGAM1571 RNA, herein designated VGAM RNA, and a schematic representation of the secondary folding of VGAM1571 folded precursor RNA, herein designated VGAM FOLDED PRECURSOR RNA, of VGAM1571 are further described hereinbelow with reference to Table 1.

Nucleotide sequences of host target binding sites, such as BINDING SITE-I, BINDING SITE-II and BINDING SITE-III of FIG. 1, found on VGAM1571 host target RNA, and schematic representation of the complementarity of each of these host target binding sites to VGAM1571 RNA, herein designated VGAM RNA, are described hereinbelow with reference to Table 2.

As mentioned hereinabove with reference to FIG. 1, a function of VGAM1571 gene, herein designated VGAM is inhibition of expression of VGAM1571 target genes. It is appreciated that specific functions, and accordingly utilities, of VGAM1571 correlate with, and may be deduced from, the identity of the target genes which VGAM1571 binds and inhibits, and the function of these target genes, as elaborated hereinbelow.

Calmodulin 1 (phosphorylase kinase, delta) (CALM1, Accession NM_006888) is a VGAM1571 host target gene. CALM1 BINDING SITE is HOST TARGET binding site found in the 3' untranslated region of mRNA encoded by CALM1, corresponding to a HOST TARGET binding site such as BINDING SITE I, BINDING SITE II or BINDING SITE III. Table 2 illustrates the complementarity of the nucleotide sequences of CALM1 BINDING SITE, designated SEQ ID:13756, to the nucleotide sequence of VGAM1571 RNA, herein designated VGAM RNA, also designated SEQ ID:4282.

A function of VGAM1571 is therefore inhibition of Calmodulin 1 (phosphorylase kinase, delta) (CALM1, Accession NM_006888), a gene which plays roles in growth and the cell cycle as well as in signal transduction and the synthesis and release of neurotransmitters. Accordingly, utilities of VGAM1571 include diagnosis, prevention and treatment of diseases and clinical conditions associated with CALM1. The function of CALM1 has been established by previous studies. Calmodulin is the archetype of the family of calcium-modulated proteins of which nearly 20 members have been found. They are identified by their occurrence in the cytosol or on membranes facing the cytosol and by a high affinity for calcium. Calmodulin contains 149 amino acids and has 4 calcium-binding domains. Its functions include roles in growth and the cell cycle as well as in signal transduction and the synthesis and release of neurotransmitters. To determine how calcium/calmodulin activates calcium/calmodulin-dependent protein kinase I (CAMK1; 604998), Chin et al. (1997) characterized CAMK1 activation by calmodulin mutants with substitutions at hydrophobic residues. They found that CAMK1 activity is dependent on met124 within the C-terminal domain of calmodulin as well as on N-terminal hydrophobic residues of calmodulin.

Full details of the abovementioned studies are described in the following publications, the disclosure of which are hereby incorporated by reference:

Rhyner, J. A.; Ottiger, M.; Wicki, R.; Greenwood, T. M.; Strehler, E. E.: Structure of the human CALM1 calmodulin gene and identification of two CALM1-related pseudogenes CALM1P1 and CALM1P2. Europ. J. Biochem. 225:71-82, 1994; and Chin, D.; Winkler, K. E.; Means, A. R.: Characterization of substrate phosphorylation and use of calmodulin mutants to address implications from the enzyme crystal structure of calmodul.

Further studies establishing the function and utilities of CALM1 are found in John Hopkins OMIM database record ID 114180, and in sited publications numbered 12573-1258 and 2 listed in the bibliography section hereinbelow, which are also hereby incorporated by reference. Fibronectin Leucine Rich Transmembrane Protein 3 (FLRT3, Accession NM_013281) is another VGAM1571 host target gene. FLRT3 BINDING SITE is HOST TARGET binding site found in the 5' untranslated region of mRNA encoded by FLRT3, corresponding to a HOST TARGET binding site such as BINDING SITE I, BINDING SITE II or BINDING SITE III. Table 2 illustrates the complementarity of the nucleotide sequences of FLRT3 BINDING SITE, designated SEQ ID:14948, to the nucleotide sequence of VGAM1571 RNA, herein designated VGAM RNA, also designated SEQ ID:4282.

Another function of VGAM1571 is therefore inhibition of Fibronectin Leucine Rich Transmembrane Protein 3 (FLRT3, Accession NM_013281). Accordingly, utilities of VGAM1571 include diagnosis, prevention and treatment of diseases and clinical conditions associated with FLRT3. Phosphoinositide-3-kinase, Regulatory Subunit, Polypeptide 2 (p85 beta) (PIK3R2, Accession NM_005027) is another VGAM1571 host target gene. PIK3R2 BINDING SITE is HOST TARGET binding site found in the 3' untranslated region of mRNA encoded by PIK3R2, corresponding to a HOST TARGET binding site such as BINDING SITE I, BINDING SITE II or BINDING SITE III. Table 2 illustrates the complementarity of the nucleotide sequences of PIK3R2 BINDING SITE, designated SEQ ID:11468, to the nucleotide sequence of VGAM1571 RNA, herein designated VGAM RNA, also designated SEQ ID:4282.

Another function of VGAM1571 is therefore inhibition of Phosphoinositide-3-kinase, Regulatory Subunit, Polypeptide 2 (p85 beta) (PIK3R2, Accession NM_005027), a gene which acts as an adapter and is regulatory subunit (p85 beta) of phosphatidylinositol 3-kinase. Accordingly, utilities of VGAM1571 include diagnosis, prevention and treatment of diseases and clinical conditions associated with PIK3R2. The function of PIK3R2 and its association with various diseases and clinical conditions, has been established by previous studies, as described hereinabove with reference to VGAM647. Protein Kinase, CGMP-dependent, Type I (PRKG1, Accession NM_006258) is another VGAM1571 host target gene. PRKG1 BINDING SITE is HOST TARGET binding site found in the 3' untranslated region of mRNA encoded by PRKG1, corresponding to a HOST TARGET binding site such as BINDING SITE I, BINDING SITE II or BINDING SITE III. Table 2 illustrates the complementarity of the nucleotide sequences of PRKG1 BINDING SITE, designated SEQ ID:12938, to the nucleotide sequence of VGAM1571 RNA, herein designated VGAM RNA, also designated SEQ ID:4282.

Another function of VGAM1571 is therefore inhibition of Protein Kinase, CGMP-dependent, Type I (PRKG1, Accession NM_006258), a gene which relaxes vascular smooth muscle and inhibits platelet aggregation. Accordingly, utilities of VGAM1571 include diagnosis, prevention and treatment of diseases and clinical conditions associated with PRKG1. The function of PRKG1 has been established by previous studies. Cyclic GMP and cyclic GMP-dependent protein kinase play important roles in physiologic processes such as relaxation of vascular smooth muscle and inhibition of platelet aggregation. Two main forms of cGK have been identified: a soluble form designated type I and an intrinsic membrane-bound form designated type II. Sandberg et al. (1989) isolated and characterized cDNA clones for the type I beta isozyme from human placenta libraries. The same group used a genomic probe for mapping the gene (Orstavik et al., 1992). By Southern blots of human/hamster somatic cell hybrids, they localized the PRKGR1B gene to chromosome 10. The gene was regionally localized to 10q11.2 by in situ hybridization. Tamura et al. (1996) cloned a human cGKI-alpha cDNA by RT-PCR of aorta RNA using primers based on the sequence of a bovine cGKI-alpha cDNA. The predicted 671-amino acid human cGKI-alpha protein is nearly identical to bovine cGKI-alpha. Based on Southern blot and sequence analyses, Tamura et al. (1996) suggested that cGKI-alpha and cGKI-beta are generated by alternative splicing of a single gene that maps to chromosome 10. By Northern blot analysis, cGKI-alpha was abundantly expressed as a 7.0-kb mRNA in aorta, heart, kidneys and adrenals; the 7.0-kb cGKI-beta mRNA was abundantly expressed only in the uterus. Orstavik et al. (1997) noted that type I cGK is a homodimer, with each monomer containing a regulatory cGMP-binding domain and a catalytic domain. They reported that the type I cGK gene consists of 19 exons spanning at least 220 kb. The first 2 exons, which the authors called 1-alpha and 1-beta, are used alternatively and encode the alpha isoform- and beta isoform-specific sequences. By Northern blot analysis, type I cGK-alpha mRNA was most abundant in lung and placenta, while type I cGK-beta was expressed at highest levels in bladder, uterus, adrenal gland, and fallopian tube. Orstavik et al. (1997) noted that 5 of the 7 splice sites in the Drosophila melanogaster DG2 gene, which encodes a cGK, are also present in the human type I cGK gene. Osborne et al. (1997) reported that levels of the DG2-encoded cGK in Drosophila affect food-search behavior and account for a naturally occurring behavioral polymorphism. Animal model experiments lend further support to the function of PRKG1. Pfeifer et al. (1998) generated mice deficient in cGKI by targeted disruption. Loss of cGKI abolished nitric oxide/cGMP-dependent relaxation of smooth muscle, resulting in severe vascular and intestinal dysfunction. However, cGKI-deficient smooth muscle responded normally to cAMP, indicating that cAMP and cGMP signal via independent pathways, with cGKI being the specific mediator of the nitric oxide/cGMP effects in murine smooth muscle.

It is appreciated that the abovementioned animal model for PRKG1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pfeifer, A.; Klatt, P.; Massberg, S.; Ny, L.; Sausbier, M.; Hirneill, C.; Wang, G.-X.; Korth, M.; Aszodi, A.; Andersson, K.-E.; Krombach, F.; Mayerhofer, A.; Ruth, P.; Fassler, R.; Hofmann, F.: Defective smooth muscle regulation in cGMP kinase I-deficient mice. EMBO J. 17:3045-3051, 1998; and Sandberg, M.; Natarajan, V.; Ronander, I.; Kalderon, D.; Walter, U.; Lohmann, S. M.; Jahnsen, T.: Molecular cloning and predicted full-length amino acid sequence of the type I beta isoz.

Further studies establishing the function and utilities of PRKG1 are found in John Hopkins OMIM database record ID 176894, and in sited publications numbered 1148-1153 listed in the bibliography section hereinbelow, which are also hereby incorporated by reference. RAB23, Member RAS Oncogene Family (RAB23, Accession NM_016277) is another VGAM1571 host target gene. RAB23 BINDING SITE is HOST TARGET binding site found in the 3' untranslated region of mRNA encoded by RAB23, corresponding to a HOST TARGET binding site such as BINDING SITE I, BINDING SITE II or BINDING SITE III. Table 2 illustrates the complementarity of the nucleotide sequences of RAB23 BINDING SITE, designated SEQ ID:18402, to the nucleotide sequence of VGAM1571 RNA, herein designated VGAM RNA, also designated SEQ ID:4282.

Another function of VGAM1571 is therefore inhibition of RAB23, Member RAS Oncogene Family (RAB23, Accession NM_016277), a gene which is involved in the regulation of intracellular membrane trafficking. Accordingly, utilities of VGAM1571 include diagnosis, prevention and treatment of diseases and clinical conditions associated with RAB23. The function of RAB23 and its association with various diseases and clinical conditions, has been established by previous studies, as described hereinabove with reference to VGAM340. Chromosome 20 Open Reading Frame 121 (C20orf121, Accession NM_024331) is another VGAM1571 host target gene. C20orf121 BINDING SITE is HOST TARGET binding site found in the 3' untranslated region of mRNA encoded by C20orf121, corresponding to a HOST TARGET binding site such as BINDING SITE I, BINDING SITE II or BINDING SITE III. Table 2 illustrates the complementarity of the nucleotide sequences of C20orf121 BINDING SITE, designated SEQ ID:23636, to the nucleotide sequence of VGAM1571 RNA, herein designated VGAM RNA, also designated SEQ ID:4282.

Another function of VGAM1571 is therefore inhibition of Chromosome 20 Open Reading Frame 121 (C20orf121, Accession NM_024331). Accordingly, utilities of VGAM1571 include diagnosis, prevention and treatment of diseases and clinical conditions associated with C20orf121. FLJ22021 (Accession NM_024535) is another VGAM1571 host target gene. FLJ22021 BINDING SITE is HOST TARGET binding site found in the 3' untranslated region of mRNA encoded by FLJ22021, corresponding to a HOST TARGET binding site such as BINDING SITE I, BINDING SITE II or BINDING SITE III. Table 2 illustrates the complementarity of the nucleotide sequences of FLJ22021 BINDING SITE, designated SEQ ID:23746, to the nucleotide sequence of VGAM1571 RNA, herein designated VGAM RNA, also designated SEQ ID:4282.

Another function of VGAM1571 is therefore inhibition of FLJ22021 (Accession NM_024535). Accordingly, utilities of VGAM1571 include diagnosis, prevention and treatment of diseases and clinical conditions associated with FLJ22021. KIAA0265 (Accession XM_045954) is another VGAM1571 host target gene. KIAA0265 BINDING SITE is HOST TARGET binding site found in the 3' untranslated region of mRNA encoded by KIAA0265, corresponding to a HOST TARGET binding site such as BINDING SITE I, BINDING SITE II or BINDING SITE III. Table 2 illustrates the complementarity of the nucleotide sequences of KIAA0265 BINDING SITE, designated SEQ ID:34630, to the nucleotide sequence of VGAM1571 RNA, herein designated VGAM RNA, also designated SEQ ID:4282.

Another function of VGAM1571 is therefore inhibition of KIAA0265 (Accession XM_045954). Accordingly, utilities of VGAM1571 include diagnosis, prevention and treatment of diseases and clinical conditions associated with KIAA0265. KIAA1483 (Accession XM_045920) is another VGAM1571 host target gene. KIAA1483 BINDING SITE is HOST TARGET binding site found in the 3' untranslated region of mRNA encoded by KIAA1483, corresponding to a HOST TARGET binding site such as BINDING SITE I, BINDING SITE II or BINDING SITE III. Table 2 illustrates the complementarity of the nucleotide sequences of KIAA1483 BINDING SITE, designated SEQ ID:34616, to the nucleotide sequence of VGAM1571 RNA, herein designated VGAM RNA, also designated SEQ ID:4282.

Another function of VGAM1571 is therefore inhibition of KIAA1483 (Accession XM_045920). Accordingly, utilities of VGAM1571 include diagnosis, prevention and treatment of diseases and clinical conditions associated with KIAA1483. KIAA1795 (Accession XM_050988) is another VGAM1571 host target gene. KIAA1795 BINDING SITE is HOST TARGET binding site found in the 3' untranslated region of mRNA encoded by KIAA1795, corresponding to a HOST TARGET binding site such as BINDING SITE I, BINDING SITE II or BINDING SITE III. Table 2 illustrates the complementarity of the nucleotide sequences of KIAA1795 BINDING SITE, designated SEQ ID:35700, to the nucleotide sequence of VGAM1571 RNA, herein designated VGAM RNA, also designated SEQ ID:4282.

Another function of VGAM1571 is therefore inhibition of KIAA1795 (Accession XM_050988). Accordingly, utilities of VGAM1571 include diagnosis, prevention and treatment of diseases and clinical conditions associated with KIAA1795. MGC13061 (Accession NM_032322) is another VGAM1571 host target gene. MGC13061 BINDING SITE is HOST TARGET binding site found in the 3' untranslated region of mRNA encoded by MGC13061, corresponding to a HOST TARGET binding site such as BINDING SITE I, BINDING SITE II or BINDING SITE III. Table 2 illustrates the complementarity of the nucleotide sequences of MGC13061 BINDING SITE, designated SEQ ID:26131, to the nucleotide sequence of VGAM1571 RNA, herein designated VGAM RNA, also designated SEQ ID:4282.

Another function of VGAM1571 is therefore inhibition of MGC13061 (Accession NM_032322). Accordingly, utilities of VGAM1571 include diagnosis, prevention and treatment of diseases and clinical conditions associated with MGC13061. SWI/SNF Related, Matrix Associated, Actin Dependent Regulator of Chromatin, Subfamily F, Member 1 (SMARCF1, Accession NM_018450) is another VGAM1571 host target gene. SMARCF1 BINDING SITE is HOST TARGET binding site found in the 3' untranslated region of mRNA encoded by SMARCF1, corresponding to a HOST TARGET binding site such as BINDING SITE I, BINDING SITE II or BINDING SITE III. Table 2 illustrates the complementarity of the nucleotide sequences of SMARCF1 BINDING SITE, designated SEQ ID:20524, to the nucleotide sequence of VGAM1571 RNA, herein designated VGAM RNA, also designated SEQ ID:4282.

Another function of VGAM1571 is therefore inhibition of SWI/SNF Related, Matrix Associated, Actin Dependent Regulator of Chromatin, Subfamily F, Member 1 (SMARCF1, Accession NM_018450). Accordingly, utilities of VGAM1571 include diagnosis, prevention and treatment of diseases and clinical conditions associated with SMARCF1. Translocase of Inner Mitochondrial Membrane 9 Homolog (yeast) (TIMM9, Accession NM_012460) is another VGAM1571 host target gene. TIMM9 BINDING SITE is HOST TARGET binding site found in the 5' untranslated region of mRNA encoded by TIMM9, corresponding to a HOST TARGET binding site such as BINDING SITE I, BINDING SITE II or BINDING SITE III. Table 2 illustrates the complementarity of the nucleotide sequences of TIMM9 BINDING SITE, designated SEQ ID:14833, to the nucleotide sequence of VGAM1571 RNA, herein designated VGAM RNA, also designated SEQ ID:4282.

Another function of VGAM1571 is therefore inhibition of Translocase of Inner Mitochondrial Membrane 9 Homolog (yeast) (TIMM9, Accession NM_012460). Accordingly, utilities of VGAM1571 include diagnosis, prevention and treatment of diseases and clinical conditions associated with TIMM9. LOC143308 (Accession XM_096411) is another VGAM1571 host target gene. LOC143308 BINDING SITE is HOST TARGET binding site found in the 5' untranslated region of mRNA encoded by LOC143308, corresponding to a HOST TARGET binding site such as BINDING SITE I, BINDING SITE II or BINDING SITE III. Table 2 illustrates the complementarity of the nucleotide sequences of LOC143308 BINDING SITE, designated SEQ ID:40348, to the nucleotide sequence of VGAM1571 RNA, herein designated VGAM RNA, also designated SEQ ID:4282.

Another function of VGAM1571 is therefore inhibition of LOC143308 (Accession XM_096411). Accordingly, utilities of VGAM1571 include diagnosis, prevention and treatment of diseases and clinical conditions associated with LOC143308. LOC51619 (Accession NM_015983) is another VGAM1571 host target gene. LOC51619 BINDING SITE is HOST TARGET binding site found in the 3' untranslated region of mRNA encoded by LOC51619, corresponding to a HOST TARGET binding site such as BINDING SITE I, BINDING SITE II or BINDING SITE III. Table 2 illustrates the complementarity of the nucleotide sequences of LOC51619 BINDING SITE, designated SEQ ID:18078, to the nucleotide sequence of VGAM1571 RNA, herein designated VGAM RNA, also designated SEQ ID:4282.

Another function of VGAM1571 is therefore inhibition of LOC51619 (Accession NM_015983). Accordingly, utilities of VGAM1571 include diagnosis, prevention and treatment of diseases and clinical conditions associated with LOC51619. FIG. 1 further provides a conceptual description of a novel bioinformatically detected viral gene of the present invention, referred to here as Viral Genomic Address Messenger 1572 (VGAM1572) viral gene, which modulates expression of respective host target genes thereof, the function and utility of which host target genes is known in the art.

VGAM1572 is a novel bioinformatically detected regulatory, non protein coding, viral micro RNA (miRNA) gene. The method by which VGAM1572 was detected is described hereinabove with reference to FIGS. 1-8.

VGAM1572 gene, herein designated VGAM GENE, is a viral gene contained in the genome of Rhopalosiphum Padi Virus. VGAM1572 host target gene, herein designated VGAM HOST TARGET GENE, is a human gene contained in the human genome.

VGAM1572 gene encodes a VGAM1572 precursor RNA, herein designated VGAM PRECURSOR RNA. Similar to other miRNA genes, and unlike most ordinary genes, VGAM1572 precursor RNA does not encode a protein. A nucleotide sequence identical or highly similar to the nucleotide sequence of VGAM1572 precursor RNA is designated SEQ ID:1558, and is provided hereinbelow with reference to the sequence listing part. Nucleotide sequence SEQ ID:1558 is located at position 3435 relative to the genome of Rhopalosiphum Padi Virus.

VGAM1572 precursor RNA folds onto itself, forming VGAM1572 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1572 folded precursor RNA into VGAM1572 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1572 RNA is designated SEQ ID:4283, and is provided hereinbelow with reference to the sequence listing part.

VGAM1572 host target gene, herein designated VGAM HOST TARGET GENE, encodes a corresponding messenger RNA, VGAM1572 host target RNA, herein designated VGAM HOST TARGET RNA. VGAM1572 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1572 RNA, herein designated VGAM RNA, binds complementarily to one or more host target binding sites located in untranslated regions of VGAM1572 host target RNA, herein designated VGAM HOST TARGET RNA. This complementary binding is due to the fact that the nucleotide sequence of VGAM1572 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1572 RNA, herein designated VGAM RNA, may have a different number of host target binding sites in untranslated regions of a VGAM1572 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1572 RNA, herein designated VGAM RNA, to host target binding sites on VGAM1572 host target RNA, herein designated VGAM HOST TARGET RNA, such as BINDING SITE I, BINDING SITE II and BINDING SITE III, inhibits translation of VGAM1572 host target RNA into VGAM1572 host target protein, herein designated VGAM HOST TARGET PROTEIN. VGAM host target protein is therefore outlined by a broken line.

It is appreciated that VGAM1572 host target gene, herein designated VGAM HOST TARGET GENE, in fact represents a plurality of VGAM1572 host target genes. The mRNA of each one of this plurality of VGAM1572 host target genes comprises one or more host target binding sites, each having a nucleotide sequence which is at least partly complementary to VGAM1572 RNA, herein designated VGAM RNA, and which when bound by VGAM1572 RNA causes inhibition of translation of respective one or more VGAM1572 host target proteins.

It is further appreciated by one skilled in the art that the mode of translational inhibition illustrated by FIG. 1 with specific reference to translational inhibition exerted by VGAM1572 gene, herein designated VGAM GENE, on one or more VGAM1572 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1572 is inhibition of expression of host target genes, as part of a novel viral mechanism of attacking a host. Accordingly, utilities of VGAM1572 include diagnosis, prevention and treatment of viral infection by Rhopalosiphum Padi Virus. Specific functions, and accordingly utilities, of VGAM1572 correlate with, and may be deduced from, the identity of the host target genes which VGAM1572 binds and inhibits, and the function of these host target genes, as elaborated hereinbelow.

Nucleotide sequences of the VGAM1572 precursor RNA, herein designated VGAM PRECURSOR RNA, and of the 'diced' VGAM1572 RNA, herein designated VGAM RNA, and a schematic representation of the secondary folding of VGAM1572 folded precursor RNA, herein designated VGAM FOLDED PRECURSOR RNA, of VGAM1572 are further described hereinbelow with reference to Table 1.

Nucleotide sequences of host target binding sites, such as BINDING SITE-I, BINDING SITE-II and BINDING SITE-III of FIG. 1, found on VGAM1572 host target RNA, and schematic representation of the complementarity of each of these host target binding sites to VGAM1572 RNA, herein designated VGAM RNA, are described hereinbelow with reference to Table 2.

As mentioned hereinabove with reference to FIG. 1, a function of VGAM1572 gene, herein designated VGAM is inhibition of expression of VGAM1572 target genes. It is appreciated that specific functions, and accordingly utilities, of VGAM1572 correlate with, and may be deduced from, the identity of the target genes which VGAM1572 binds and inhibits, and the function of these target genes, as elaborated hereinbelow.

FLJ13052 (Accession NM_023018) is a VGAM1572 host target gene. FLJ13052 BINDING SITE is HOST TARGET binding site found in the 3' untranslated region of mRNA encoded by FLJ13052, corresponding to a HOST TARGET binding site such as BINDING SITE I, BINDING SITE II or BINDING SITE III. Table 2 illustrates the complementarity of the nucleotide sequences of FLJ13052 BINDING SITE, designated SEQ ID:23285, to the nucleotide sequence of VGAM1572 RNA, herein designated VGAM RNA, also designated SEQ ID:4283.

A function of VGAM1572 is therefore inhibition of FLJ13052 (Accession NM_023018). Accordingly, utilities of VGAM1572 include diagnosis, prevention and treatment of diseases and clinical conditions associated with FLJ13052. KIAA0976 (Accession NM_014917) is another VGAM1572 host target gene. KIAA0976 BINDING SITE is HOST TARGET binding site found in the 3' untranslated region of mRNA encoded by KIAA0976, corresponding to a HOST TARGET binding site such as BINDING SITE I, BINDING SITE II or BINDING SITE III. Table 2 illustrates the complementarity of the nucleotide sequences of KIAA0976 BINDING SITE, designated SEQ ID:17161, to the nucleotide sequence of VGAM1572 RNA, herein designated VGAM RNA, also designated SEQ ID:4283.

Another function of VGAM1572 is therefore inhibition of KIAA0976 (Accession NM_014917). Accordingly, utilities of VGAM1572 include diagnosis, prevention and treatment of diseases and clinical conditions associated with KIAA0976. KIAA1387 (Accession XM_048092) is another VGAM1572 host target gene. KIAA1387 BINDING SITE is HOST TARGET binding site found in the 3' untranslated region of mRNA encoded by KIAA1387, corresponding to a HOST TARGET binding site such as BINDING SITE I, BINDING SITE II or BINDING SITE III. Table 2 illustrates the complementarity of the nucleotide sequences of KIAA1387 BINDING SITE, designated SEQ ID:35104, to the nucleotide sequence of VGAM1572 RNA, herein designated VGAM RNA, also designated SEQ ID:4283.

Another function of VGAM1572 is therefore inhibition of KIAA1387 (Accession XM_048092). Accordingly, utilities of VGAM1572 include diagnosis, prevention and treatment of diseases and clinical conditions associated with KIAA1387. FIG. 1 further provides a conceptual description of a novel bioinformatically detected viral gene of the present invention, referred to here as Viral Genomic Address Messenger 1573 (VGAM1573) viral gene, which modulates expression of respective host target genes thereof, the function and utility of which host target genes is known in the art.

VGAM1573 is a novel bioinformatically detected regulatory, non protein coding, viral micro RNA (miRNA) gene. The method by which VGAM1573 was detected is described hereinabove with reference to FIGS. 1-8.

VGAM1573 gene, herein designated VGAM GENE, is a viral gene contained in the genome of Rhopalosiphum Padi Virus. VGAM1573 host target gene, herein designated VGAM HOST TARGET GENE, is a human gene contained in the human genome.

VGAM1573 gene encodes a VGAM1573 precursor RNA, herein designated VGAM PRECURSOR RNA. Similar to other miRNA genes, and unlike most ordinary genes, VGAM1573 precursor RNA does not encode a protein. A nucleotide sequence identical or highly similar to the nucleotide sequence of VGAM1573 precursor RNA is designated SEQ ID:1559, and is provided hereinbelow with reference to the sequence listing part. Nucleotide sequence SEQ ID:1559 is located at position 3711 relative to the genome of Rhopalosiphum Padi Virus.

VGAM1573 precursor RNA folds onto itself, forming VGAM1573 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1573 folded precursor RNA into VGAM1573 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1573 RNA is designated SEQ ID:4284, and is provided hereinbelow with reference to the sequence listing part.

VGAM1573 host target gene, herein designated VGAM HOST TARGET GENE, encodes a corresponding messenger RNA, VGAM1573 host target RNA, herein designated VGAM HOST TARGET RNA. VGAM1573 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1573 RNA, herein designated VGAM RNA, binds complementarily to one or more host target binding sites located in untranslated regions of VGAM1573 host target RNA, herein designated VGAM HOST TARGET RNA. This complementary binding is due to the fact that the nucleotide sequence of VGAM1573 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1573 RNA, herein designated VGAM RNA, may have a different number of host target binding sites in untranslated regions of a VGAM1573 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1573 RNA, herein designated VGAM RNA, to host target binding sites on VGAM1573 host target RNA, herein designated VGAM HOST TARGET RNA, such as BINDING SITE I, BINDING SITE II and BINDING SITE III, inhibits translation of VGAM1573 host target RNA into VGAM1573 host target protein, herein designated VGAM HOST TARGET PROTEIN. VGAM host target protein is therefore outlined by a broken line.

It is appreciated that VGAM1573 host target gene, herein designated VGAM HOST TARGET GENE, in fact represents a plurality of VGAM1573 host target genes. The mRNA of each one of this plurality of VGAM1573 host target genes comprises one or more host target binding sites, each having a nucleotide sequence which is at least partly complementary to VGAM1573 RNA, herein designated VGAM RNA, and which when bound by VGAM1573 RNA causes inhibition of translation of respective one or more VGAM1573 host target proteins.

It is further appreciated by one skilled in the art that the mode of translational inhibition illustrated by FIG. 1 with specific reference to translational inhibition exerted by VGAM1573 gene, herein designated VGAM GENE, on one or more VGAM1573 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1573 is inhibition of expression of host target genes, as part of a novel viral mechanism of attacking a host. Accordingly, utilities of VGAM1573 include diagnosis, prevention and treatment of viral infection by Rhopalosiphum Padi Virus. Specific functions, and accordingly utilities, of VGAM1573 correlate with, and may be deduced from, the identity of the host target genes which VGAM1573 binds and inhibits, and the function of these host target genes, as elaborated hereinbelow.

Nucleotide sequences of the VGAM1573 precursor RNA, herein designated VGAM PRECURSOR RNA, and of the 'diced' VGAM1573 RNA, herein designated VGAM RNA, and a schematic representation of the secondary folding of VGAM1573 folded precursor RNA, herein designated VGAM FOLDED PRECURSOR RNA, of VGAM1573 are further described hereinbelow with reference to Table 1.

Nucleotide sequences of host target binding sites, such as BINDING SITE-I, BINDING SITE-II and BINDING SITE-III of FIG. 1, found on VGAM1573 host target RNA, and schematic representation of the complementarity of each of these host target binding sites to VGAM1573 RNA, herein designated VGAM RNA, are described hereinbelow with reference to Table 2.

As mentioned hereinabove with reference to FIG. 1, a function of VGAM1573 gene, herein designated VGAM is inhibition of expression of VGAM1573 target genes. It is appreciated that specific functions, and accordingly utilities, of VGAM1573 correlate with, and may be deduced from, the identity of the target genes which VGAM1573 binds and inhibits, and the function of these target genes, as elaborated hereinbelow.

Cell Division Cycle 25A (CDC25A, Accession NM_001789) is a VGAM1573 host target gene. CDC25A BINDING SITE is HOST TARGET binding site found in the 5' untranslated region of mRNA encoded by CDC25A, corresponding to a HOST TARGET binding site such as BINDING SITE I, BINDING SITE II or BINDING SITE III. Table 2 illustrates the complementarity of the nucleotide sequences of CDC25A BINDING SITE, designated SEQ ID:7540, to the nucleotide sequence of VGAM1573 RNA, herein designated VGAM RNA, also designated SEQ ID:4284.

A function of VGAM1573 is therefore inhibition of Cell Division Cycle 25A (CDC25A, Accession NM_001789), a gene which is a tyrosine protein phosphatase required for progression of the cell cycle. Accordingly, utilities of VGAM1573 include diagnosis, prevention and treatment of diseases and clinical conditions associated with CDC25A. The function of CDC25A has been established by previous studies. When exposed to ionizing radiation, eukaryotic cells activate checkpoint pathways to delay the progression of the cell cycle. Defects in the ionizing radiation-induced S-phase checkpoint cause 'radioresistant DNA synthesis,' a phenomenon that has been identified in cancer-prone patients suffering from ataxia-telangiectasia. The CDC25A phosphatase activates CDK2, needed for DNA synthesis, but becomes degraded in response to DNA damage or stalled replication.

Falck et al. (2001) reported a functional link between ATM (OMIM Ref. No. 208900), checkpoint signaling kinase CHK2 (OMIM Ref. No. 604373), and CDC25A, and implicated this mechanism in controlling the S-phase checkpoint. Falck et al. (2001) showed that ionizing radiation-induced destruction of CDC25A requires both ATM and the CHK2-mediated phosphorylation of CDC25A on serine-123. An ionizing radiation-induced loss of CDC25A protein prevents dephosphorylation of CDK2 and leads to a transient blockade of DNA replication. Falck et al. (2001) also showed that tumor-associated CHK2 alleles cannot bind or phosphorylate CDC25A, and that cells expressing these CHK2 alleles, elevated CDC25A, or a CDK2 mutant unable to undergo inhibitory phosphorylation (OMIM Ref. No. CDK2AF) fail to inhibit DNA synthesis when irradiated. Falck et al. (2001) concluded that their results support CHK2 as a candidate tumor suppressor, and identify the ATM--CHK2--CDC25A--CDK2 pathway as a genomic integrity checkpoint that prevents radioresistant DNA synthesis. Falck et al. (2002) demonstrated that experimental blockade of either the NBS1 (OMIM Ref. No. 602667)-MRE11 (OMIM Ref. No. 600814) function or the CHK2-triggered events leads to a partial radioresistant DNA synthesis phenotype in human cells. In contrast, concomitant interference with NBS1-MRE11 and the CHK2-CDC25A-CDK2 pathways entirely abolishes inhibition of DNA synthesis induced by ionizing radiation, resulting in complete radioresistant DNA synthesis analogous to that caused by defective ATM. In addition, CDK2-dependent loading of CDC45 (OMIM Ref. No. 603465) onto replication origins, a prerequisite for recruitment of DNA polymerase, was prevented upon irradiation of normal or NBS1/MRE11-defective cells but not cells with defective ATM. Falck et al. (2002) concluded that in response to ionizing radiation, phosphorylation of NBS1 and CHK2 by ATM triggers 2 parallel branches of the DNA damage-dependent S-phase checkpoint that cooperate by inhibiting distinct steps of DNA replication. To protect genome integrity and ensure survival, eukaryotic cells exposed to genotoxic stress cease proliferating to provide time for DNA repair. Mailand et al. (2000) demonstrated that human cells respond to ultraviolet light or ionizing radiation by rapid, ubiquitin- and proteosome-dependent protein degradation of CDC25A, a phosphatase that is required for progression from G1 to S phase of the cell cycle. This response involved activated CHK1 protein kinase (OMIM Ref. No. 603078) but not the p53 (OMIM Ref. No. 191170) pathway, and the persisting inhibitory tyrosine phosphorylation of CDK2 (OMIM Ref. No. 116953) blocked entry into S phase and DNA replication. CDC25A-dependent cell cycle arrest occurs 1 to 2 hours after ultraviolet radiation, whereas the p53-p21 axis affects the cell cycle only several hours after ultraviolet treatment. Mailand et al. (2000) thus concluded that the checkpoint response to DNA damage occurs in 2 waves. Overexpression of CDC25A bypassed the mechanism of cell cycle arrest, leading to enhanced DNA damage and decreased cell survival. Mailand et al. (2000) concluded that the results identified specific degradation of CDC25A as part of the DNA damage checkpoint mechanism and suggested how CDC25A overexpression in human cancers might contribute to tumorigenesis.

Full details of the abovementioned studies are described in the following publications, the disclosure of which are hereby incorporated by reference:

Mailand, N.; Falck, J.; Lukas, C.; Syljuasen, R. G.; Welcker, M.; Bartek, J.; Lukas, J.: Rapid destruction of human Cdc25A in response to DNA damage. Science 288:1425-1429, 2000; and Falck, J.; Mailand, N.; Syljuasen, R. G.; Bartek, J.; Lukas, J.: The ATM-Chk2-Cdc25A checkpoint pathway guards against radioresistant DNA synthesis. Nature 410:842-847, 2001.

Further studies establishing the function and utilities of CDC25A are found in John Hopkins OMIM database record ID 116947, and in sited publications numbered 1932-149 and 1933-1935 listed in the bibliography section hereinbelow, which are also hereby incorporated by reference. GRAF (Accession NM_015071) is another VGAM1573 host target gene. GRAF BINDING SITE is HOST TARGET binding site found in the 3' untranslated region of mRNA encoded by GRAF, corresponding to a HOST TARGET binding site such as BINDING SITE I, BINDING SITE II or BINDING SITE III. Table 2 illustrates the complementarity of the nucleotide sequences of GRAF BINDING SITE, designated SEQ ID:17442, to the nucleotide sequence of VGAM1573 RNA, herein designated VGAM RNA, also designated SEQ ID:4284.

Another function of VGAM1573 is therefore inhibition of GRAF (Accession NM_015071), a gene which ia a GTPase activating protein for p21-rac. Accordingly, utilities of VGAM1573 include diagnosis, prevention and treatment of diseases and clinical conditions associated with GRAF. The function of GRAF and its association with various diseases and clinical conditions, has been established by previous studies, as described hereinabove with reference to VGAM430. Potassium Voltage-gated Channel, Subfamily H (eag-related), Member 2 (KCNH2, Accession NM_000238) is another VGAM1573 host target gene. KCNH2 BINDING SITE is HOST TARGET binding site found in the 5' untranslated region of mRNA encoded by KCNH2, corresponding to a HOST TARGET binding site such as BINDING SITE I, BINDING SITE II or BINDING SITE III. Table 2 illustrates the complementarity of the nucleotide sequences of KCNH2 BINDING SITE, designated SEQ ID:5755, to the nucleotide sequence of VGAM1573 RNA, herein designated VGAM RNA, also designated SEQ ID:4284.

Another function of VGAM1573 is therefore inhibition of Potassium Voltage-gated Channel, Subfamily H (eag-related), Member 2 (KCNH2, Accession NM_000238), a gene which inwardly rectifying cardiac potassium (ikr) channel. Accordingly, utilities of VGAM1573 include diagnosis, prevention and treatment of diseases and clinical conditions associated with KCNH2. The function of KCNH2 has been established by previous studies. Sanguinetti et al. (1995) expressed the HERG gene in Xenopus laevis oocytes and studied the potassium channel's biophysical properties and its sensitivity to various pharmacological agents. Their data indicated that HERG proteins form I(Kr) channels, but that another subunit may be required for certain drug sensitivities. Since block of I(Kr) is a known mechanism for drug-induced cardiac arrhythmias, their findings provided a mechanistic link between certain types of inherited and acquired LQT. Acquired long QT syndrome occurs following treatment with certain medications and in association with reduced serum potassium levels (hypokalemia). Both acquired and inherited LQTs are associated with torsade de pointes and polymorphic ventricular tachycardia resulting from abnormal cardiac depolarization (as detected by QT prolongation on the electrocardiogram). LQT is also characterized by sinusoidal twisting of the QRS axis around the isoelectric line. Torsade de pointes can degenerate into ventricular fibrillation, which can lead to sudden death Li et al. (1997) identified a subunit interaction domain, termed the NAB domain, in the hydrophilic cytoplasmic N terminus of HERG. This domain is responsible for the oligomerization of the protein into functional tetramers. Truncated HERG proteins, including the deletion mutant at position 1261 (152427.0007), contain the NAB domain but lack the rest of the channel and thus inhibit the expression of functional tetrameric HERG channels in transfected cells. The authors suggested that LQT may be the result of decreased expression of a functional HERG potassium channel in the heart.

Full details of the abovementioned studies are described in the following publications, the disclosure of which are hereby incorporated by reference:

Priori, S. G.; Napolitano, C.; Schwartz, P. J.: Low penetrance in the long QT syndrome: clinical impact. Circulation 99:529-533, 1999; and Rajamani, S.; Anderson, C. L.; Anson, B. D.; January, C. T.: Pharmacological rescue of human K+ channel long-QT2 mutations. Circulation 105:2830-2835, 2002.

Further studies establishing the function and utilities of KCNH2 are found in John Hopkins OMIM database record ID 152427, and in sited publications numbered 3435, 354 and 2198-2223 listed in the bibliography section hereinbelow, which are also hereby incorporated by reference. Diacylglycerol Kinase, Delta 130 kDa (DGKD, Accession XM_002384) is another VGAM1573 host target gene. DGKD BINDING SITE is HOST TARGET binding site found in the 3" untranslated region of mRNA encoded by DGKD, corresponding to a HOST TARGET binding site such as BINDING SITE I, BINDING SITE II or BINDING SITE III. Table 2 illustrates the complementarity of the nucleotide sequences of DGKD BINDING SITE, designated SEQ ID:29881, to the nucleotide sequence of VGAM1573 RNA, herein designated VGAM RNA, also designated SEQ ID:4284.

Another function of VGAM1573 is therefore inhibition of Diacylglycerol Kinase, Delta 130 kDa (DGKD, Accession XM_002384). Accordingly, utilities of VGAM1573 include diagnosis, prevention and treatment of diseases and clinical conditions associated with DGKD. FLJ12484 (Accession XM_045681) is another VGAM1573 host target gene. FLJ12484 BINDING SITE1 and FLJ12484 BINDING SITE2 are HOST TARGET binding sites found in untranslated regions of mRNA encoded by FLJ12484, corresponding to HOST TARGET binding sites such as BINDING SITE I, BINDING SITE II or BINDING SITE III. Table 2 illustrates the complementarity of the nucleotide sequences of FLJ12484 BINDING SITE1 and FLJ12484 BINDING SITE2, designated SEQ ID:34516 and SEQ ID:23018 respectively, to the nucleotide sequence of VGAM1573 RNA, herein designated VGAM RNA, also designated SEQ ID:4284.

Another function of VGAM1573 is therefore inhibition of FLJ12484 (Accession XM_045681). Accordingly, utilities of VGAM1573 include diagnosis, prevention and treatment of diseases and clinical conditions associated with FLJ12484. MGC1842 (Accession XM_037797) is another VGAM1573 host target gene. MGC1842 BINDING SITE is HOST TARGET binding site found in the 3' untranslated region of mRNA encoded by MGC1842, corresponding to a HOST TARGET binding site such as BINDING SITE I, BINDING SITE II or BINDING SITE III. Table 2 illustrates the complementarity of the nucleotide sequences of MGC1842 BINDING SITE, designated SEQ ID:32687, to the nucleotide sequence of VGAM1573 RNA, herein designated VGAM RNA, also designated SEQ ID:4284.

Another function of VGAM1573 is therefore inhibition of MGC1842 (Accession XM_037797). Accordingly, utilities of VGAM1573 include diagnosis, prevention and treatment of diseases and clinical conditions associated with MGC1842. FIG. 1 further provides a conceptual description of a novel bioinformatically detected viral gene of the present invention, referred to here as Viral Genomic Address Messenger 1574 (VGAM1574) viral gene, which modulates expression of respective host target genes thereof, the function and utility of which host target genes is known in the art.

VGAM1574 is a novel bioinformatically detected regulatory, non protein coding, viral micro RNA (miRNA) gene. The method by which VGAM1574 was detected is described hereinabove with reference to FIGS. 1-8.

VGAM1574 gene, herein designated VGAM GENE, is a viral gene contained in the genome of Rhopalosiphum Padi Virus. VGAM1574 host target gene, herein designated VGAM HOST TARGET GENE, is a human gene contained in the human genome.

VGAM1574 gene encodes a VGAM1574 precursor RNA, herein designated VGAM PRECURSOR RNA. Similar to other miRNA genes, and unlike most ordinary genes, VGAM1574 precursor RNA does not encode a protein. A nucleotide sequence identical or highly similar to the nucleotide sequence of VGAM1574 precursor RNA is designated SEQ ID:1560, and is provided hereinbelow with reference to the sequence listing part. Nucleotide sequence SEQ ID:1560 is located at position 7836 relative to the genome of Rhopalosiphum Padi Virus.

VGAM1574 precursor RNA folds onto itself, forming VGAM1574 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1574 folded precursor RNA into VGAM1574 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1574 RNA is designated SEQ ID:4285, and is provided hereinbelow with reference to the sequence listing part.

VGAM1574 host target gene, herein designated VGAM HOST TARGET GENE, encodes a corresponding messenger RNA, VGAM1574 host target RNA, herein designated VGAM HOST TARGET RNA. VGAM1574 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1574 RNA, herein designated VGAM RNA, binds complementarily to one or more host target binding sites located in untranslated regions of VGAM1574 host target RNA, herein designated VGAM HOST TARGET RNA. This complementary binding is due to the fact that the nucleotide sequence of VGAM1574 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1574 RNA, herein designated VGAM RNA, may have a different number of host target binding sites in untranslated regions of a VGAM1574 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1574 RNA, herein designated VGAM RNA, to host target binding sites on VGAM1574 host target RNA, herein designated VGAM HOST TARGET RNA, such as BINDING SITE I, BINDING SITE II and BINDING SITE III, inhibits translation of VGAM1574 host target RNA into VGAM1574 host target protein, herein designated VGAM HOST TARGET PROTEIN. VGAM host target protein is therefore outlined by a broken line.

It is appreciated that VGAM1574 host target gene, herein designated VGAM HOST TARGET GENE, in fact represents a plurality of VGAM1574 host target genes. The mRNA of each one of this plurality of VGAM1574 host target genes comprises one or more host target binding sites, each having a nucleotide sequence which is at least partly complementary to VGAM1574 RNA, herein designated VGAM RNA, and which when bound by VGAM1574 RNA causes inhibition of translation of respective one or more VGAM1574 host target proteins.

It is further appreciated by one skilled in the art that the mode of translational inhibition illustrated by FIG. 1 with specific reference to translational inhibition exerted by VGAM1574 gene, herein designated VGAM GENE, on one or more VGAM1574 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1574 is inhibition of expression of host target genes, as part of a novel viral mechanism of attacking a host. Accordingly, utilities of VGAM1574 include diagnosis, prevention and treatment of viral infection by Rhopalosiphum Padi Virus. Specific functions, and accordingly utilities, of VGAM1574 correlate with, and may be deduced from, the identity of the host target genes which VGAM1574 binds and inhibits, and the function of these host target genes, as elaborated hereinbelow.

Nucleotide sequences of the VGAM1574 precursor RNA, herein designated VGAM PRECURSOR RNA, and of the 'diced' VGAM1574 RNA, herein designated VGAM RNA, and a schematic representation of the secondary folding of VGAM1574 folded precursor RNA, herein designated VGAM FOLDED PRECURSOR RNA, of VGAM1574 are further described hereinbelow with reference to Table 1.

Nucleotide sequences of host target binding sites, such as BINDING SITE-I, BINDING SITE-II and BINDING SITE-III of FIG. 1, found on VGAM1574 host target RNA, and schematic representation of the complementarity of each of these host target binding sites to VGAM1574 RNA, herein designated VGAM RNA, are described hereinbelow with reference to Table 2.

As mentioned hereinabove with reference to FIG. 1, a function of VGAM1574 gene, herein designated VGAM is inhibition of expression of VGAM1574 target genes. It is appreciated that specific functions, and accordingly utilities, of VGAM1574 correlate with, and may be deduced from, the identity of the target genes which VGAM1574 binds and inhibits, and the function of these target genes, as elaborated hereinbelow.

Dipeptidase 1 (renal) (DPEP1, Accession NM_004413) is a VGAM1574 host target gene. DPEP1 BINDING SITE is HOST TARGET binding site found in the 5' untranslated region of mRNA encoded by DPEP1, corresponding to a HOST TARGET binding site such as BINDING SITE I, BINDING SITE II or BINDING SITE III. Table 2 illustrates the complementarity of the nucleotide sequences of DPEP1 BINDING SITE, designated SEQ ID:10674, to the nucleotide sequence of VGAM1574 RNA, herein designated VGAM RNA, also designated SEQ ID:4285.

A function of VGAM1574 is therefore inhibition of Dipeptidase 1 (renal) (DPEP1, Accession NM_004413), a gene which hydrolyzes a wide range of dipeptides. Accordingly, utilities of VGAM1574 include diagnosis, prevention and treatment of diseases and clinical conditions associated with DPEP1. The function of DPEP1 has been established by previous studies. Renal dipeptidase, previously referred to as dehydropeptidase I or microsomal dipeptidase (MDP; EC 3.4.13.11), is a kidney membrane enzyme which hydrolyzes a variety of dipeptides and is implicated in the renal metabolism of glutathione and its conjugates, e.g., leukotriene D4 (Kozak and Tate, 1982). RDP is responsible for hydrolysis of the beta-lactam ring of antibiotics such as penem and carbapenem (Campbell et al., 1984). Earlier, beta-lactamase enzymes were thought to occur only in bacteria, where their probable function was in protecting the organisms against the action of beta-lactam antibiotics. These antibiotics exhibit selective toxicity against bacteria but virtual inertness against many eukaryotic cells. Adachi et al. (1990) isolated and characterized cDNA clones for human RDP. DNA and RNA blot analysis indicated the existence of a single gene. By fluorescence in situ hybridization (FISH), Nakagawa et al. (1991) mapped the RDP gene to 16q24. To isolate potential tumor/growth suppressor genes involved in Wilms tumor, Austruy et al. (1993) constructed a cDNA library by cloning a mature kidney cDNA subtracted with an excess of Wilms tumor mRNA. Clones were selected according to a differential pattern of expression, i.e., positive with RNA from mature kidney and negative with RNA from several Wilms tumors. By comparison of sequences of these clones with the GENBANK database sequences, 1 clone was identified as renal dipeptidase (DPEP1), which had previously been mapped to 16q24 by in situ hybridization. Austruy et al. (1993) used somatic cell hybrids carrying either different human chromosomes or chromosome 16 segments to confirm and refine the physical mapping of DPEP1 to 16q24.3. Two RFLPs were described and used to show linkage of DPEP1 to D16S7; maximum lod score = 5.8 at theta=0.03.

Full details of the abovementioned studies are described in the following publications, the disclosure of which are hereby incorporated by reference:

Austruy, E.; Jeanpierre, C.; Antignac, C.; Whitmore, S. A.; Van Cong, N.; Bernheim, A.; Callen, D. F.; Junien, C.: Physical and genetic mapping of the dipeptidase gene DPEP1 to 16q24.3. Genomics 15:684-687, 1993; and Nakagawa, H.; Inazawa, J.; Inoue, K.; Misawa, S.; Kashima, K.; Adachi, H.; Nakazato, H.; Abe, T.: Assignment of the human renal dipeptidase gene (DPEP1) to band q24 of chromosome 16. (A.

Further studies establishing the function and utilities of DPEP1 are found in John Hopkins OMIM database record ID 179780, and in sited publications numbered 1555-1559 listed in the bibliography section hereinbelow, which are also hereby incorporated by reference. Fibroblast Growth Factor 2 (basic) (FGF2, Accession NM_002006) is another VGAM1574 host target gene. FGF2 BINDING SITE is HOST TARGET binding site found in the 3' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7733, to the nucleotide sequence of VGAM1574 RNA, herein designated VGAM RNA, also designated SEQ ID:4285.

Another function of VGAM1574 is therefore inhibition of Fibroblast Growth Factor 2 (basic) (FGF2, Accession NM_002006), a gene which probably involved in nervous system development and function. Accordingly, utilities of VGAM1574 include diagnosis, prevention and treatment of diseases and clinical conditions associated with FGF2. The function of FGF2 and its association with various diseases and clinical conditions, has been established by previous studies, as described hereinabove with reference to VGAM51. KIAA0172 (Accession XM_036295) is another VGAM1574 host target gene. KIAA0172 BINDING SITE is HOST TARGET binding site found in the 5' untranslated region of mRNA encoded by KIAA0172, corresponding to a HOST TARGET binding site such as BINDING SITE I, BINDING SITE II or BINDING SITE III. Table 2 illustrates the complementarity of the nucleotide sequences of KIAA0172 BINDING SITE, designated SEQ ID:32411, to the nucleotide sequence of VGAM1574 RNA, herein designated VGAM RNA, also designated SEQ ID:4285.

Another function of VGAM1574 is therefore inhibition of KIAA0172 (Accession XM_036295). Accordingly, utilities of VGAM1574 include diagnosis, prevention and treatment of diseases and clinical conditions associated with KIAA0172. KIAA0316 (Accession XM_045712) is another VGAM1574 host target gene. KIAA0316 BINDING SITE is HOST TARGET binding site found in the 3' untranslated region of mRNA encoded by KIAA0316, corresponding to a HOST TARGET binding site such as BINDING SITE I, BINDING SITE II or BINDING SITE III. Table 2 illustrates the complementarity of the nucleotide sequences of KIAA0316 BINDING SITE, designated SEQ ID:34530, to the nucleotide sequence of VGAM1574 RNA, herein designated VGAM RNA, also designated SEQ ID:4285.

Another function of VGAM1574 is therefore inhibition of KIAA0316 (Accession XM_045712). Accordingly, utilities of VGAM1574 include diagnosis, prevention and treatment of diseases and clinical conditions associated with KIAA0316. KIAA0483 (Accession NM_015176) is another VGAM1574 host target gene. KIAA0483 BINDING SITE is HOST TARGET binding site found in the 3' untranslated region of mRNA encoded by KIAA0483, corresponding to a HOST TARGET binding site such as BINDING SITE I, BINDING SITE II or BINDING SITE III. Table 2 illustrates the complementarity of the nucleotide sequences of KIAA0483 BINDING SITE, designated SEQ ID:17528, to the nucleotide sequence of VGAM1574 RNA, herein designated VGAM RNA, also designated SEQ ID:4285.

Another function of VGAM1574 is therefore inhibition of KIAA0483 (Accession NM_015176). Accordingly, utilities of VGAM1574 include diagnosis, prevention and treatment of diseases and clinical conditions associated with KIAA0483. KIAA1538 (Accession XM_049474) is another VGAM1574 host target gene. KIAA1538 BINDING SITE is HOST TARGET binding site found in the 3' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35425, to the nucleotide sequence of VGAM1574 RNA, herein designated VGAM RNA, also designated SEQ ID:4285.

Another function of VGAM1574 is therefore inhibition of KIAA1538 (Accession XM_049474). Accordingly, utilities of VGAM1574 include diagnosis, prevention and treatment of diseases and clinical conditions associated with KIAA1538. LOC133088 (Accession XM_059624) is another VGAM1574 host target gene. LOC133088 BINDING SITE is HOST TARGET binding site found in the 5' untranslated region of mRNA encoded by LOC133088, corresponding to a HOST TARGET binding site such as BINDING SITE I, BINDING SITE II or BINDING SITE III. Table 2 illustrates the complementarity of the nucleotide sequences of LOC133088 BINDING SITE, designated SEQ ID:37033, to the nucleotide sequence of VGAM1574 RNA, herein designated VGAM RNA, also designated SEQ ID:4285.

Another function of VGAM1574 is therefore inhibition of LOC133088 (Accession XM_059624). Accordingly, utilities of VGAM1574 include diagnosis, prevention and treatment of diseases and clinical conditions associated with LOC133088. FIG. 1 further provides a conceptual description of a novel bioinformatically detected viral gene of the present invention, referred to here as Viral Genomic Address Messenger 1575 (VGAM1575) viral gene, which modulates expression of respective host target genes thereof, the function and utility of which host target genes is known in the art.

VGAM1575 is a novel bioinformatically detected regulatory, non protein coding, viral micro RNA (miRNA) gene. The method by which VGAM1575 was detected is described hereinabove with reference to FIGS. 1-8.

VGAM1575 gene, herein designated VGAM GENE, is a viral gene contained in the genome of Rhopalosiphum Padi Virus. VGAM1575 host target gene, herein designated VGAM HOST TARGET GENE, is a human gene contained in the human genome.

VGAM1575 gene encodes a VGAM1575 precursor RNA, herein designated VGAM PRECURSOR RNA. Similar to other miRNA genes, and unlike most ordinary genes, VGAM1575 precursor RNA does not encode a protein. A nucleotide sequence identical or highly similar to the nucleotide sequence of VGAM1575 precursor RNA is designated SEQ ID:1561, and is provided hereinbelow with reference to the sequence listing part. Nucleotide sequence SEQ ID:1561 is located at position 923 relative to the genome of Rhopalosiphum Padi Virus.

VGAM1575 precursor RNA folds onto itself, forming VGAM1575 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1575 folded precursor RNA into VGAM1575 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 71%) nucleotide sequence of VGAM1575 RNA is designated SEQ ID:4286, and is provided hereinbelow with reference to the sequence listing part.

VGAM1575 host target gene, herein designated VGAM HOST TARGET GENE, encodes a corresponding messenger RNA, VGAM1575 host target RNA, herein designated VGAM HOST TARGET RNA. VGAM1575 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1575 RNA, herein designated VGAM RNA, binds complementarily to one or more host target binding sites located in untranslated regions of VGAM1575 host target RNA, herein designated VGAM HOST TARGET RNA. This complementary binding is due to the fact that the nucleotide sequence of VGAM1575 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1575 RNA, herein designated VGAM RNA, may have a different number of host target binding sites in untranslated regions of a VGAM1575 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1575 RNA, herein designated VGAM RNA, to host target binding sites on VGAM1575 host target RNA, herein designated VGAM HOST TARGET RNA, such as BINDING SITE I, BINDING SITE II and BINDING SITE III, inhibits translation of VGAM1575 host target RNA into VGAM1575 host target protein, herein designated VGAM HOST TARGET PROTEIN. VGAM host target protein is therefore outlined by a broken line.

It is appreciated that VGAM1575 host target gene, herein designated VGAM HOST TARGET GENE, in fact represents a plurality of VGAM1575 host target genes. The mRNA of each one of this plurality of VGAM1575 host target genes comprises one or more host target binding sites, each having a nucleotide sequence which is at least partly complementary to VGAM1575 RNA, herein designated VGAM RNA, and which when bound by VGAM1575 RNA causes inhibition of translation of respective one or more VGAM1575 host target proteins.

It is further appreciated by one skilled in the art that the mode of translational inhibition illustrated by FIG. 1 with specific reference to translational inhibition exerted by VGAM1575 gene, herein designated VGAM GENE, on one or more VGAM1575 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1575 is inhibition of expression of host target genes, as part of a novel viral mechanism of attacking a host. Accordingly, utilities of VGAM1575 include diagnosis, prevention and treatment of viral infection by Rhopalosiphum Padi Virus. Specific functions, and accordingly utilities, of VGAM1575 correlate with, and may be deduced from, the identity of the host target genes which VGAM1575 binds and inhibits, and the function of these host target genes, as elaborated hereinbelow.

Nucleotide sequences of the VGAM1575 precursor RNA, herein designated VGAM PRECURSOR RNA, and of the 'diced' VGAM1575 RNA, herein designated VGAM RNA, and a schematic representation of the secondary folding of VGAM1575 folded precursor RNA, herein designated VGAM FOLDED PRECURSOR RNA, of VGAM1575 are further described hereinbelow with reference to Table 1.

Nucleotide sequences of host target binding sites, such as BINDING SITE-I, BINDING SITE-II and BINDING SITE-III of FIG. 1, found on VGAM1575 host target RNA, and schematic representation of the complementarity of each of these host target binding sites to VGAM1575 RNA, herein designated VGAM RNA, are described hereinbelow with reference to Table 2.

As mentioned hereinabove with reference to FIG. 1, a function of VGAM1575 gene, herein designated VGAM is inhibition of expression of VGAM1575 target genes. It is appreciated that specific functions, and accordingly utilities, of VGAM1575 correlate with, and may be deduced from, the identity of the target genes which VGAM1575 binds and inhibits, and the function of these target genes, as elaborated hereinbelow.

FAT Tumor Suppressor Homolog 2 (Drosophila) (FAT2, Accession NM_001447) is a VGAM1575 host target gene. FAT2 BINDING SITE is HOST TARGET binding site found in the 3' untranslated region of mRNA encoded by FAT2, corresponding to a HOST TARGET binding site such as BINDING SITE I, BINDING SITE II or BINDING SITE III. Table 2 illustrates the complementarity of the nucleotide sequences of FAT2 BINDING SITE, designated SEQ ID:7173, to the nucleotide sequence of VGAM1575 RNA, herein designated VGAM RNA, also designated SEQ ID:4286.

A function of VGAM1575 is therefore inhibition of FAT Tumor Suppressor Homolog 2 (Drosophila) (FAT2, Accession NM_001447), a gene which could function as a cell-adhesion protein. Accordingly, utilities of VGAM1575 include diagnosis, prevention and treatment of diseases and clinical conditions associated with FAT2. The function of FAT2 and its association with various diseases and clinical conditions, has been established by previous studies, as described hereinabove with reference to VGAM949. Glycosylphosphatidylinositol Specific Phospholipase D1 (GPLD1, Accession XM_166347) is another VGAM1575 host target gene. GPLD1 BINDING SITE is HOST TARGET binding site found in the 3' untranslated region of mRNA encoded by GPLD1, corresponding to a HOST TARGET binding site such as BINDING SITE I, BINDING SITE II or BINDING SITE III. Table 2 illustrates the complementarity of the nucleotide sequences of GPLD1 BINDING SITE, designated SEQ ID:44180, to the nucleotide sequence of VGAM1575 RNA, herein designated VGAM RNA, also designated SEQ ID:4286.

Another function of VGAM1575 is therefore inhibition of Glycosylphosphatidylinositol Specific Phospholipase D1 (GPLD1, Accession XM_166347), a gene which hydrolyses the inositol phosphate linkage in proteins anchored by phosphatidylinositol glycans to release these proteins from the membrane. Accordingly, utilities of VGAM1575 include diagnosis, prevention and treatment of diseases and clinical conditions associated with GPLD1. The function of GPLD1 has been established by previous studies. Many proteins are attached to the plasma membrane via a glycosylphosphatidylinositol (GPI) anchor. Phosphatidylinositol-glycan (PIG)-specific phospholipases D (PLDs) selectively hydrolyze the inositol phosphate linkage, allowing release of the protein. Scallon et al. (1991) cloned a cDNA encoding a PIGPLD from a bovine liver cDNA library. The deduced amino acid sequence contains 4 regions of internal homology that are similar to the metal ion binding domains of integrin alpha subunits (see OMIM Ref. No. ITGA2, 192974). Bovine PIG-PLD does not exhibit phosphatidylcholine-specific PLD (OMIM Ref. No. 602382) activity. By PCR and screening of a human liver cDNA library, Tsang et al. (1992) isolated a cDNA (OMIM Ref. No. L11701) encoding a PIGPLD. The protein product contains 841 amino acids, including a 24-residue signal sequence. Tsang et al. (1992) isolated a cDNA (OMIM Ref. No. L11702) encoding a related but distinct PIGPLD from a human pancreas cDNA library. The pancreas-derived PIGPLD contains 840 amino acids, including a 23-residue signal sequence. Schofield and Rademacher (2000) determined that the GPLD1 gene contains 25 exons and spans at least 80 kb. Northern blot analysis revealed expression of 5.8-kb transcript that was restricted to liver. Southern blot analysis indicated that GPLD1 is a single-copy gene.

Full details of the abovementioned studies are described in the following publications, the disclosure of which are hereby incorporated by reference:

Schofield, J. N.; Rademacher, T. W.: Structure and expression of the human glycosylphosphatidylinositol phospholipase D1 (GPLD1) gene. Biochim. Biophys. Acta 1494:189-194, 2000; and Tsang, T. C.; Fung, W.-J.; Levine, J.; Metz, C. N.; Davitz, M. A.; Burns, D. K.; Huang, K.-S.; Kochan, J. P.: Isolation and expression of two human glycosylphosphatidylinositol phospho.

Further studies establishing the function and utilities of GPLD1 are found in John Hopkins OMIM database record ID 602515, and in sited publications numbered 8549-8552 listed in the bibliography section hereinbelow, which are also hereby incorporated by reference. Phosphodiesterase 4B, CAMP-specific (phosphodiesterase E4 dunce homolog, Drosophila) (PDE4B, Accession NM_002600) is another VGAM1575 host target gene. PDE4B BINDING SITE is HOST TARGET binding site found in the 3' untranslated region of mRNA encoded by PDE4B, corresponding to a HOST TARGET binding site such as BINDING SITE I, BINDING SITE II or BINDING SITE III. Table 2 illustrates the complementarity of the nucleotide sequences of PDE4B BINDING SITE, designated SEQ ID:8466, to the nucleotide sequence of VGAM1575 RNA, herein designated VGAM RNA, also designated SEQ ID:4286.

Another function of VGAM1575 is therefore inhibition of Phosphodiesterase 4B, CAMP-specific (phosphodiesterase E4 dunce homolog, Drosophila) (PDE4B, Accession NM_002600), a gene which may be involved in mediating central nervous system effects of therapeutic agents ranging from antidepressants to antiasthmatic and anti-inflammatory agents. Accordingly, utilities of VGAM1575 include diagnosis, prevention and treatment of diseases and clinical conditions associated with PDE4B. The function of PDE4B and its association with various diseases and clinical conditions, has been established by previous studies, as described hereinabove with reference to VGAM51. Chromosome 20 Open Reading Frame 44 (C20orf44, Accession NM_018244) is another VGAM1575 host target gene. C20orf44 BINDING SITE is HOST TARGET binding site found in the 3' untranslated region of mRNA encoded by C20orf44, corresponding to a HOST TARGET binding site such as BINDING SITE I, BINDING SITE II or BINDING SITE III. Table 2 illustrates the complementarity of the nucleotide sequences of C20orf44 BINDING SITE, designated SEQ ID:20207, to the nucleotide sequence of VGAM1575 RNA, herein designated VGAM RNA, also designated SEQ ID:4286.

Another function of VGAM1575 is therefore inhibition of Chromosome 20 Open Reading Frame 44 (C20orf44, Accession NM_018244). Accordingly, utilities of VGAM1575 include diagnosis, prevention and treatment of diseases and clinical conditions associated with C20orf44. FLJ20445 (Accession NM_017824) is another VGAM1575 host target gene. FLJ20445 BINDING SITE is HOST TARGET binding site found in the 3' untranslated region of mRNA encoded by FLJ20445, corresponding to a HOST TARGET binding site such as BINDING SITE I, BINDING SITE II or BINDING SITE III. Table 2 illustrates the complementarity of the nucleotide sequences of FLJ20445 BINDING SITE, designated SEQ ID:19479, to the nucleotide sequence of VGAM1575 RNA, herein designated VGAM RNA, also designated SEQ ID:4286.

Another function of VGAM1575 is therefore inhibition of FLJ20445 (Accession NM_017824). Accordingly, utilities of VGAM1575 include diagnosis, prevention and treatment of diseases and clinical conditions associated with FLJ20445. FLJ21034 (Accession NM_024940) is another VGAM1575 host target gene. FLJ21034 BINDING SITE is HOST TARGET binding site found in the 3' untranslated region of mRNA encoded by FLJ21034, corresponding to a HOST TARGET binding site such as BINDING SITE I, BINDING SITE II or BINDING SITE III. Table 2 illustrates the complementarity of the nucleotide sequences of FLJ21034 BINDING SITE, designated SEQ ID:24483, to the nucleotide sequence of VGAM1575 RNA, herein designated VGAM RNA, also designated SEQ ID:4286.

Another function of VGAM1575 is therefore inhibition of FLJ21034 (Accession NM_024940). Accordingly, utilities of VGAM1575 include diagnosis, prevention and treatment of diseases and clinical conditions associated with FLJ21034. KIAA1272 (Accession XM_046600) is another VGAM1575 host target gene. KIAA1272 BINDING SITE is HOST TARGET binding site found in the 3' untranslated region of mRNA encoded by KIAA1272, corresponding to a HOST TARGET binding site such as BINDING SITE I, BINDING SITE II or BINDING SITE III. Table 2 illustrates the complementarity of the nucleotide sequences of KIAA1272 BINDING SITE, designated SEQ ID:34760, to the nucleotide sequence of VGAM1575 RNA, herein designated VGAM RNA, also designated SEQ ID:4286.

Another function of VGAM1575 is therefore inhibition of KIAA1272 (Accession XM_046600). Accordingly, utilities of VGAM1575 include diagnosis, prevention and treatment of diseases and clinical conditions associated with KIAA1272. KIAA1911 (Accession XM_056302) is another VGAM1575 host target gene. KIAA1911 BINDING SITE is HOST TARGET binding site found in the 3' untranslated region of mRNA encoded by KIAA1911, corresponding to a HOST TARGET binding site such as BINDING SITE I, BINDING SITE II or BINDING SITE III. Table 2 illustrates the complementarity of the nucleotide sequences of KIAA1911 BINDING SITE, designated SEQ ID:36393, to the nucleotide sequence of VGAM1575 RNA, herein designated VGAM RNA, also designated SEQ ID:4286.

Another function of VGAM1575 is therefore inhibition of KIAA1911 (Accession XM_056302). Accordingly, utilities of VGAM1575 include diagnosis, prevention and treatment of diseases and clinical conditions associated with KIAA1911. NCUBE1 (Accession NM_016021) is another VGAM1575 host target gene. NCUBE1 BINDING SITE is HOST TARGET binding site found in the 3' untranslated region of mRNA encoded by NCUBE1, corresponding to a HOST TARGET binding site such as BINDING SITE I, BINDING SITE II or BINDING SITE III. Table 2 illustrates the complementarity of the nucleotide sequences of NCUBE1 BINDING SITE, designated SEQ ID:18093, to the nucleotide sequence of VGAM1575 RNA, herein designated VGAM RNA, also designated SEQ ID:4286.

Another function of VGAM1575 is therefore inhibition of NCUBE1 (Accession NM_016021). Accordingly, utilities of VGAM1575 include diagnosis, prevention and treatment of diseases and clinical conditions associated with NCUBE1. SH3 Domain Binding Glutamic Acid-rich Protein Like 2 (SH3BGRL2, Accession NM_031469) is another VGAM1575 host target gene. SH3BGRL2 BINDING SITE is HOST TARGET binding site found in the 3' untranslated region of mRNA encoded by SH3BGRL2, corresponding to a HOST TARGET binding site such as BINDING SITE I, BINDING SITE II or BINDING SITE III. Table 2 illustrates the complementarity of the nucleotide sequences of SH3BGRL2 BINDING SITE, designated SEQ ID:25529, to the nucleotide sequence of VGAM1575 RNA, herein designated VGAM RNA, also designated SEQ ID:4286.

Another function of VGAM1575 is therefore inhibition of SH3 Domain Binding Glutamic Acid-rich Protein Like 2 (SH3BGRL2, Accession NM_031469). Accordingly, utilities of VGAM1575 include diagnosis, prevention and treatment of diseases and clinical conditions associated with SH3BGRL2. ZIC4 (Accession NM_032153) is another VGAM1575 host target gene. ZIC4 BINDING SITE is HOST TARGET binding site found in the 5' untranslated region of mRNA encoded by ZIC4, corresponding to a HOST TARGET binding site such as BINDING SITE I, BINDING SITE II or BINDING SITE III. Table 2 illustrates the complementarity of the nucleotide sequences of ZIC4 BINDING SITE, designated SEQ ID:25853, to the nucleotide sequence of VGAM1575 RNA, herein designated VGAM RNA, also designated SEQ ID:4286.

Another function of VGAM1575 is therefore inhibition of ZIC4 (Accession NM_032153). Accordingly, utilities of VGAM1575 include diagnosis, prevention and treatment of diseases and clinical conditions associated with ZIC4. LOC144017 (Accession XM_096520) is another VGAM1575 host target gene. LOC144017 BINDING SITE is HOST TARGET binding site found in the 3' untranslated region of mRNA encoded by LOC144017, corresponding to a HOST TARGET binding site such as BINDING SITE I, BINDING SITE II or BINDING SITE III. Table 2 illustrates the complementarity of the nucleotide sequences of LOC144017 BINDING SITE, designated SEQ ID:40387, to the nucleotide sequence of VGAM1575 RNA, herein designated VGAM RNA, also designated SEQ ID:4286.

Another function of VGAM1575 is therefore inhibition of LOC144017 (Accession XM_096520). Accordingly, utilities of VGAM1575 include diagnosis, prevention and treatment of diseases and clinical conditions associated with LOC144017. LOC201689 (Accession XM_040608) is another VGAM1575 host target gene. LOC201689 BINDING SITE is HOST TARGET binding site found in the 5' untranslated region of mRNA encoded by LOC201689, corresponding to a HOST TARGET binding site such as BINDING SITE I, BINDING SITE II or BINDING SITE III. Table 2 illustrates the complementarity of the nucleotide sequences of LOC201689 BINDING SITE, designated SEQ ID:33334, to the nucleotide sequence of VGAM1575 RNA, herein designated VGAM RNA, also designated SEQ ID:4286.

Another function of VGAM1575 is therefore inhibition of LOC201689 (Accession XM_040608). Accordingly, utilities of VGAM1575 include diagnosis, prevention and treatment of diseases and clinical conditions associated with LOC201689. LOC84549 (Accession NM_032509) is another VGAM1575 host target gene. LOC84549 BINDING SITE is HOST TARGET binding site found in the 3' untranslated region of mRNA encoded by LOC84549, corresponding to a HOST TARGET binding site such as BINDING SITE I, BINDING SITE II or BINDING SITE III. Table 2 illustrates the complementarity of the nucleotide sequences of LOC84549 BINDING SITE, designated SEQ ID:26260, to the nucleotide sequence of VGAM1575 RNA, herein designated VGAM RNA, also designated SEQ ID:4286.

Another function of VGAM1575 is therefore inhibition of LOC84549 (Accession NM_032509). Accordingly, utilities of VGAM1575 include diagnosis, prevention and treatment of diseases and clinical conditions associated with LOC84549. FIG. 1 further provides a conceptual description of a novel bioinformatically detected viral gene of the present invention, referred to here as Viral Genomic Address Messenger 1576 (VGAM1576) viral gene, which modulates expression of respective host target genes thereof, the function and utility of which host target genes is known in the art.

VGAM1576 is a novel bioinformatically detected regulatory, non protein coding, viral micro RNA (miRNA) gene. The method by which VGAM1576 was detected is described hereinabove with reference to FIGS. 1-8.

VGAM1576 gene, herein designated VGAM GENE, is a viral gene contained in the genome of Rhopalosiphum Padi Virus. VGAM1576 host target gene, herein designated VGAM HOST TARGET GENE, is a human gene contained in the human genome.

VGAM1576 gene encodes a VGAM1576 precursor RNA, herein designated VGAM PRECURSOR RNA. Similar to other miRNA genes, and unlike most ordinary genes, VGAM1576 precursor RNA does not encode a protein. A nucleotide sequence identical or highly similar to the nucleotide sequence of VGAM1576 precursor RNA is designated SEQ ID:1562, and is provided hereinbelow with reference to the sequence listing part. Nucleotide sequence SEQ ID:1562 is located at position 3322 relative to the genome of Rhopalosiphum Padi Virus.

VGAM1576 precursor RNA folds onto itself, forming VGAM1576 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1576 folded precursor RNA into VGAM1576 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1576 RNA is designated SEQ ID:4287, and is provided hereinbelow with reference to the sequence listing part.

VGAM1576 host target gene, herein designated VGAM HOST TARGET GENE, encodes a corresponding messenger RNA, VGAM1576 host target RNA, herein designated VGAM HOST TARGET RNA. VGAM1576 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1576 RNA, herein designated VGAM RNA, binds complementarily to one or more host target binding sites located in untranslated regions of VGAM1576 host target RNA, herein designated VGAM HOST TARGET RNA. This complementary binding is due to the fact that the nucleotide sequence of VGAM1576 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1576 RNA, herein designated VGAM RNA, may have a different number of host target binding sites in untranslated regions of a VGAM1576 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1576 RNA, herein designated VGAM RNA, to host target binding sites on VGAM1576 host target RNA, herein designated VGAM HOST TARGET RNA, such as BINDING SITE I, BINDING SITE II and BINDING SITE III, inhibits translation of VGAM1576 host target RNA into VGAM1576 host target protein, herein designated VGAM HOST TARGET PROTEIN. VGAM host target protein is therefore outlined by a broken line.

It is appreciated that VGAM1576 host target gene, herein designated VGAM HOST TARGET GENE, in fact represents a plurality of VGAM1576 host target genes. The mRNA of each one of this plurality of VGAM1576 host target genes comprises one or more host target binding sites, each having a nucleotide sequence which is at least partly complementary to VGAM1576 RNA, herein designated VGAM RNA, and which when bound by VGAM1576 RNA causes inhibition of translation of respective one or more VGAM1576 host target proteins.

It is further appreciated by one skilled in the art that the mode of translational inhibition illustrated by FIG. 1 with specific reference to translational inhibition exerted by VGAM1576 gene, herein designated VGAM GENE, on one or more VGAM1576 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1576 is inhibition of expression of host target genes, as part of a novel viral mechanism of attacking a host. Accordingly, utilities of VGAM1576 include diagnosis, prevention and treatment of viral infection by Rhopalosiphum Padi Virus. Specific functions, and accordingly utilities, of VGAM1576 correlate with, and may be deduced from, the identity of the host target genes which VGAM1576 binds and inhibits, and the function of these host target genes, as elaborated hereinbelow.

Nucleotide sequences of the VGAM1576 precursor RNA, herein designated VGAM PRECURSOR RNA, and of the 'diced' VGAM1576 RNA, herein designated VGAM RNA, and a schematic representation of the secondary folding of VGAM1576 folded precursor RNA, herein designated VGAM FOLDED PRECURSOR RNA, of VGAM1576 are further described hereinbelow with reference to Table 1.

Nucleotide sequences of host target binding sites, such as BINDING SITE-I, BINDING SITE-II and BINDING SITE-III of FIG. 1, found on VGAM1576 host target RNA, and schematic representation of the complementarity of each of these host target binding sites to VGAM1576 RNA, herein designated VGAM RNA, are described hereinbelow with reference to Table 2.

As mentioned hereinabove with reference to FIG. 1, a function of VGAM1576 gene, herein designated VGAM is inhibition of expression of VGAM1576 target genes. It is appreciated that specific functions, and accordingly utilities, of VGAM1576 correlate with, and may be deduced from, the identity of the target genes which VGAM1576 binds and inhibits, and the function of these target genes, as elaborated hereinbelow.

KIAA1350 (Accession XM_052597) is a VGAM1576 host target gene. KIAA1350 BINDING SITE is HOST TARGET binding site found in the 3' untranslated region of mRNA encoded by KIAA1350, corresponding to a HOST TARGET binding site such as BINDING SITE I, BINDING SITE II or BINDING SITE III. Table 2 illustrates the complementarity of the nucleotide sequences of KIAA1350 BINDING SITE, designated SEQ ID:36001, to the nucleotide sequence of VGAM1576 RNA, herein designated VGAM RNA, also designated SEQ ID:4287.

A function of VGAM1576 is therefore inhibition of KIAA1350 (Accession XM_052597). Accordingly, utilities of VGAM1576 include diagnosis, prevention and treatment of diseases and clinical conditions associated with KIAA1350. Protocadherin 10 (PCDH10, Accession NM_020815) is another VGAM1576 host target gene. PCDH10 BINDING SITE1 and PCDH10 BINDING SITE2 are HOST TARGET binding sites found in untranslated regions of mRNA encoded by PCDH10, corresponding to HOST TARGET binding sites such as BINDING SITE I, BINDING SITE II or BINDING SITE III. Table 2 illustrates the complementarity of the nucleotide sequences of PCDH10 BINDING SITE1 and PCDH10 BINDING SITE2, designated SEQ ID:21884 and SEQ ID:26770 respectively, to the nucleotide sequence of VGAM1576 RNA, herein designated VGAM RNA, also designated SEQ ID:4287.

Another function of VGAM1576 is therefore inhibition of Protocadherin 10 (PCDH10, Accession NM_020815). Accordingly, utilities of VGAM1576 include diagnosis, prevention and treatment of diseases and clinical conditions associated with PCDH10. TAF9-like RNA Polymerase II, TATA Box Binding Protein (TBP)-associated Factor, 31 kDa (TAF9L, Accession NM_015975) is another VGAM1576 host target gene. TAF9L BINDING SITE is HOST TARGET binding site found in the 3' untranslated region of mRNA encoded by TAF9L, corresponding to a HOST TARGET binding site such as BINDING SITE I, BINDING SITE II or BINDING SITE III. Table 2 illustrates the complementarity of the nucleotide sequences of TAF9L BINDING SITE, designated SEQ ID:18073, to the nucleotide sequence of VGAM1576 RNA, herein designated VGAM RNA, also designated SEQ ID:4287.

Another function of VGAM1576 is therefore inhibition of TAF9-like RNA Polymerase II, TATA Box Binding Protein (TBP)-associated Factor, 31 kDa (TAF9L, Accession NM_015975). Accordingly, utilities of VGAM1576 include diagnosis, prevention and treatment of diseases and clinical conditions associated with TAF9L. Trans-golgi Network Protein 2 (TGOLN2, Accession XM_034215) is another VGAM1576 host target gene. TGOLN2 BINDING SITE is HOST TARGET binding site found in the 3' untranslated region of mRNA encoded by TGOLN2, corresponding to a HOST TARGET binding site such as BINDING SITE I, BINDING SITE II or BINDING SITE III. Table 2 illustrates the complementarity of the nucleotide sequences of TGOLN2 BINDING SITE, designated SEQ ID:32024, to the nucleotide sequence of VGAM1576 RNA, herein designated VGAM RNA, also designated SEQ ID:4287.

Another function of VGAM1576 is therefore inhibition of Trans-golgi Network Protein 2 (TGOLN2, Accession XM_034215). Accordingly, utilities of VGAM1576 include diagnosis, prevention and treatment of diseases and clinical conditions associated with TGOLN2. LOC153364 (Accession XM_087657) is another VGAM1576 host target gene. LOC153364 BINDING SITE is HOST TARGET binding site found in the 5' untranslated region of mRNA encoded by LOC153364, corresponding to a HOST TARGET binding site such as BINDING SITE I, BINDING SITE II or BINDING SITE III. Table 2 illustrates the complementarity of the nucleotide sequences of LOC153364 BINDING SITE, designated SEQ ID:39370, to the nucleotide sequence of VGAM1576 RNA, herein designated VGAM RNA, also designated SEQ ID:4287.

Another function of VGAM1576 is therefore inhibition of LOC153364 (Accession XM_087657). Accordingly, utilities of VGAM1576 include diagnosis, prevention and treatment of diseases and clinical conditions associated with LOC153364. LOC155072 (Accession XM_098661) is another VGAM1576 host target gene. LOC155072 BINDING SITE is HOST TARGET binding site found in the 5' untranslated region of mRNA encoded by LOC155072, corresponding to a HOST TARGET binding site such as BINDING SITE I, BINDING SITE II or BINDING SITE III. Table 2 illustrates the complementarity of the nucleotide sequences of LOC155072 BINDING SITE, designated SEQ ID:41761, to the nucleotide sequence of VGAM1576 RNA, herein designated VGAM RNA, also designated SEQ ID:4287.

Another function of VGAM1576 is therefore inhibition of LOC155072 (Accession XM_098661). Accordingly, utilities of VGAM1576 include diagnosis, prevention and treatment of diseases and clinical conditions associated with LOC155072. LOC202868 (Accession XM_117477) is another VGAM1576 host target gene. LOC202868 BINDING SITE is HOST TARGET binding site found in the 5' untranslated region of mRNA encoded by LOC202868, corresponding to a HOST TARGET binding site such as BINDING SITE I, BINDING SITE II or BINDING SITE III. Table 2 illustrates the complementarity of the nucleotide sequences of LOC202868 BINDING SITE, designated SEQ ID:43448, to the nucleotide sequence of VGAM1576 RNA, herein designated VGAM RNA, also designated SEQ ID:4287.

Another function of VGAM1576 is therefore inhibition of LOC202868 (Accession XM_117477). Accordingly, utilities of VGAM1576 include diagnosis, prevention and treatment of diseases and clinical conditions associated with LOC202868. FIG. 1 further provides a conceptual description of a novel bioinformatically detected viral gene of the present invention, referred to here as Viral Genomic Address Messenger 1577 (VGAM1577) viral gene, which modulates expression of respective host target genes thereof, the function and utility of which host target genes is known in the art.

VGAM1577 is a novel bioinformatically detected regulatory, non protein coding, viral micro RNA (miRNA) gene. The method by which VGAM1577 was detected is described hereinabove with reference to FIGS. 1-8.

VGAM1577 gene, herein designated VGAM GENE, is a viral gene contained in the genome of Rhopalosiphum Padi Virus. VGAM1577 host target gene, herein designated VGAM HOST TARGET GENE, is a human gene contained in the human genome.

VGAM1577 gene encodes a VGAM1577 precursor RNA, herein designated VGAM PRECURSOR RNA. Similar to other miRNA genes, and unlike most ordinary genes, VGAM1577 precursor RNA does not encode a protein. A nucleotide sequence identical or highly similar to the nucleotide sequence of VGAM1577 precursor RNA is designated SEQ ID:1563, and is provided hereinbelow with reference to the sequence listing part. Nucleotide sequence SEQ ID:1563 is located at position 2545 relative to the genome of Rhopalosiphum Padi Virus.

VGAM1577 precursor RNA folds onto itself, forming VGAM1577 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1577 folded precursor RNA into VGAM1577 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 90%) nucleotide sequence of VGAM1577 RNA is designated SEQ ID:4288, and is provided hereinbelow with reference to the sequence listing part.

VGAM1577 host target gene, herein designated VGAM HOST TARGET GENE, encodes a corresponding messenger RNA, VGAM1577 host target RNA, herein designated VGAM HOST TARGET RNA. VGAM1577 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1577 RNA, herein designated VGAM RNA, binds complementarily to one or more host target binding sites located in untranslated regions of VGAM1577 host target RNA, herein designated VGAM HOST TARGET RNA. This complementary binding is due to the fact that the nucleotide sequence of VGAM1577 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1577 RNA, herein designated VGAM RNA, may have a different number of host target binding sites in untranslated regions of a VGAM1577 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1577 RNA, herein designated VGAM RNA, to host target binding sites on VGAM1577 host target RNA, herein designated VGAM HOST TARGET RNA, such as BINDING SITE I, BINDING SITE II and BINDING SITE III, inhibits translation of VGAM1577 host target RNA into VGAM1577 host target protein, herein designated VGAM HOST TARGET PROTEIN. VGAM host target protein is therefore outlined by a broken line.

It is appreciated that VGAM1577 host target gene, herein designated VGAM HOST TARGET GENE, in fact represents a plurality of VGAM1577 host target genes. The mRNA of each one of this plurality of VGAM1577 host target genes comprises one or more host target binding sites, each having a nucleotide sequence which is at least partly complementary to VGAM1577 RNA, herein designated VGAM RNA, and which when bound by VGAM1577 RNA causes inhibition of translation of respective one or more VGAM1577 host target proteins.

It is further appreciated by one skilled in the art that the mode of translational inhibition illustrated by FIG. 1 with specific reference to translational inhibition exerted by VGAM1577 gene, herein designated VGAM GENE, on one or more VGAM1577 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1577 is inhibition of expression of host target genes, as part of a novel viral mechanism of attacking a host. Accordingly, utilities of VGAM1577 include diagnosis, prevention and treatment of viral infection by Rhopalosiphum Padi Virus. Specific functions, and accordingly utilities, of VGAM1577 correlate with, and may be deduced from, the identity of the host target genes which VGAM1577 binds and inhibits, and the function of these host target genes, as elaborated hereinbelow.

Nucleotide sequences of the VGAM1577 precursor RNA, herein designated VGAM PRECURSOR RNA, and of the 'diced' VGAM1577 RNA, herein designated VGAM RNA, and a schematic representation of the secondary folding of VGAM1577 folded precursor RNA, herein designated VGAM FOLDED PRECURSOR RNA, of VGAM1577 are further described hereinbelow with reference to Table 1.

Nucleotide sequences of host target binding sites, such as BINDING SITE-I, BINDING SITE-II and BINDING SITE-III of FIG. 1, found on VGAM1577 host target RNA, and schematic representation of the complementarity of each of these host target binding sites to VGAM1577 RNA, herein designated VGAM RNA, are described hereinbelow with reference to Table 2.

As mentioned hereinabove with reference to FIG. 1, a function of VGAM1577 gene, herein designated VGAM is inhibition of expression of VGAM1577 target genes. It is appreciated that specific functions, and accordingly utilities, of VGAM1577 correlate with, and may be deduced from, the identity of the target genes which VGAM1577 binds and inhibits, and the function of these target genes, as elaborated hereinbelow.

Epidermal Growth Factor Receptor (erythroblastic leukemia viral (v-erb-b) Oncogene Homolog, Avian) (EGFR, Accession NM_005228) is a VGAM1577 host target gene. EGFR BINDING SITE is HOST TARGET binding site found in the 3' untranslated region of mRNA encoded by EGFR, corresponding to a HOST TARGET binding site such as BINDING SITE I, BINDING SITE II or BINDING SITE III. Table 2 illustrates the complementarity of the nucleotide sequences of EGFR BINDING SITE, designated SEQ ID:11724, to the nucleotide sequence of VGAM1577 RNA, herein designated VGAM RNA, also designated SEQ ID:4288.

A function of VGAM1577 is therefore inhibition of Epidermal Growth Factor Receptor (erythroblastic leukemia viral (v-erb-b) Oncogene Homolog, Avian) (EGFR, Accession NM_005228), a gene which is a receptor for egf, but also for other members of the egf family. Accordingly, utilities of VGAM1577 include diagnosis, prevention and treatment of diseases and clinical conditions associated with EGFR. The function of EGFR and its association with various diseases and clinical conditions, has been established by previous studies, as described hereinabove with reference to VGAM229. Glutamate-ammonia Ligase (glutamine synthase) (GLUL, Accession NM_002065) is another VGAM1577 host target gene. GLUL BINDING SITE is HOST TARGET binding site found in the 3' untranslated region of mRNA encoded by GLUL, corresponding to a HOST TARGET binding site such as BINDING SITE I, BINDING SITE II or BINDING SITE III. Table 2 illustrates the complementarity of the nucleotide sequences of GLUL BINDING SITE, designated SEQ ID:7833, to the nucleotide sequence of VGAM1577 RNA, herein designated VGAM RNA, also designated SEQ ID:4288.

Another function of VGAM1577 is therefore inhibition of Glutamate-ammonia Ligase (glutamine synthase) (GLUL, Accession NM_002065), a gene which catalyzes the condensation of glutamate and ammonia to form glutamine. Accordingly, utilities of VGAM1577 include diagnosis, prevention and treatment of diseases and clinical conditions associated with GLUL. The function of GLUL and its association with various diseases and clinical conditions, has been established by previous studies, as described hereinabove with reference to VGAM948. SMUG1 (Accession NM_014311) is another VGAM1577 host target gene. SMUG1 BINDING SITE is HOST TARGET binding site found in the 3' untranslated region of mRNA encoded by SMUG1, corresponding to a HOST TARGET binding site such as BINDING SITE I, BINDING SITE II or BINDING SITE III. Table 2 illustrates the complementarity of the nucleotide sequences of SMUG1 BINDING SITE, designated SEQ ID:15608, to the nucleotide sequence of VGAM1577 RNA, herein designated VGAM RNA, also designated SEQ ID:4288.

Another function of VGAM1577 is therefore inhibition of SMUG1 (Accession NM_014311). Accordingly, utilities of VGAM1577 include diagnosis, prevention and treatment of diseases and clinical conditions associated with SMUG1.

FIG. 1 further provides a conceptual description of a novel bioinformatically detected viral gene of the present invention, referred to here as Viral Genomic Address Messenger 1578 (VGAM1578) viral gene, which modulates expression of respective host target genes thereof, the function and utility of which host target genes is known in the art.

VGAM1578 is a novel bioinformatically detected regulatory, non protein coding, viral micro RNA (miRNA) gene. The method by which VGAM1578 was detected is described hereinabove with reference to FIGS. 1-8.

VGAM1578 gene, herein designated VGAM GENE, is a viral gene contained in the genome of Rhopalosiphum Padi Virus. VGAM1578 host target gene, herein designated VGAM HOST TARGET GENE, is a human gene contained in the human genome.

VGAM1578 gene encodes a VGAM1578 precursor RNA, herein designated VGAM PRECURSOR RNA. Similar to other miRNA genes, and unlike most ordinary genes, VGAM1578 precursor RNA does not encode a protein. A nucleotide sequence identical or highly similar to the nucleotide sequence of VGAM1578 precursor RNA is designated SEQ ID:1564, and is provided hereinbelow with reference to the sequence listing part. Nucleotide sequence SEQ ID:1564 is located at position 3984 relative to the genome of Rhopalosiphum Padi Virus.

VGAM1578 precursor RNA folds onto itself, forming VGAM1578 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1578 folded precursor RNA into VGAM1578 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1578 RNA is designated SEQ ID:4289, and is provided hereinbelow with reference to the sequence listing part.

VGAM1578 host target gene, herein designated VGAM HOST TARGET GENE, encodes a corresponding messenger RNA, VGAM1578 host target RNA, herein designated VGAM HOST TARGET RNA. VGAM1578 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1578 RNA, herein designated VGAM RNA, binds complementarily to one or more host target binding sites located in untranslated regions of VGAM1578 host target RNA, herein designated VGAM HOST TARGET RNA. This complementary binding is due to the fact that the nucleotide sequence of VGAM1578 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1578 RNA, herein designated VGAM RNA, may have a different number of host target binding sites in untranslated regions of a VGAM1578 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1578 RNA, herein designated VGAM RNA, to host target binding sites on VGAM1578 host target RNA, herein designated VGAM HOST TARGET RNA, such as BINDING SITE I, BINDING SITE II and BINDING SITE III, inhibits translation of VGAM1578 host target RNA into VGAM1578 host target protein, herein designated VGAM HOST TARGET PROTEIN. VGAM host target protein is therefore outlined by a broken line.

It is appreciated that VGAM1578 host target gene, herein designated VGAM HOST TARGET GENE, in fact represents a plurality of VGAM1578 host target genes. The mRNA of each one of this plurality of VGAM1578 host target genes comprises one or more host target binding sites, each having a nucleotide sequence which is at least partly complementary to VGAM1578 RNA, herein designated VGAM RNA, and which when bound by VGAM1578 RNA causes inhibition of translation of respective one or more VGAM1578 host target proteins.

It is further appreciated by one skilled in the art that the mode of translational inhibition illustrated by FIG. 1 with specific reference to translational inhibition exerted by VGAM1578 gene, herein designated VGAM GENE, on one or more VGAM1578 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1578 is inhibition of expression of host target genes, as part of a novel viral mechanism of attacking a host. Accordingly, utilities of VGAM1578 include diagnosis, prevention and treatment of viral infection by Rhopalosiphum Padi Virus. Specific functions, and accordingly utilities, of VGAM1578 correlate with, and may be deduced from, the identity of the host target genes which VGAM1578 binds and inhibits, and the function of these host target genes, as elaborated hereinbelow.

Nucleotide sequences of the VGAM1578 precursor RNA, herein designated VGAM PRECURSOR RNA, and of the ‘diced’ VGAM1578 RNA, herein designated VGAM RNA, and a schematic representation of the secondary folding of VGAM1578 folded precursor RNA, herein designated VGAM FOLDED PRECURSOR RNA, of VGAM1578 are further described hereinbelow with reference to Table 1.

Nucleotide sequences of host target binding sites, such as BINDING SITE-I, BINDING SITE-II and BINDING SITE-III of FIG. 1, found on VGAM1578 host target RNA, and schematic representation of the complementarity of each of these host target binding sites to VGAM1578 RNA, herein designated VGAM RNA, are described hereinbelow with reference to Table 2.

As mentioned hereinabove with reference to FIG. 1, a function of VGAM1578 gene, herein designated VGAM is inhibition of expression of VGAM1578 target genes. It is appreciated that specific functions, and accordingly utilities, of VGAM1578 correlate with, and may be deduced from, the identity of the target genes which VGAM1578 binds and inhibits, and the function of these target genes, as elaborated hereinbelow.

Cyclin F (CCNF, Accession NM_001761) is a VGAM1578 host target gene. CCNF BINDING SITE is HOST TARGET binding site found in the 3' untranslated region of mRNA encoded by CCNF, corresponding to a HOST TARGET binding site such as BINDING SITE I, BINDING SITE II or BINDING SITE III. Table 2 illustrates the complementarity of the nucleotide sequences of CCNF BINDING SITE, designated SEQ ID:7527, to the nucleotide sequence of VGAM1578 RNA, herein designated VGAM RNA, also designated SEQ ID:4289.

A function of VGAM1578 is therefore inhibition of Cyclin F (CCNF, Accession NM_001761), a gene which likely to be involved in the control of the cell cycle during s phase and g2. Accordingly, utilities of VGAM1578 include diagnosis, prevention and treatment of diseases and clinical conditions associated with CCNF. The function of CCNF and its association with various diseases and clinical conditions, has been established by previous studies, as described hereinabove with reference to VGAM367. Cockayne Syndrome 1 (classical) (CKN1, Accession NM_000082) is another VGAM1578 host target gene. CKN1 BINDING SITE is HOST TARGET binding site found in the 3' untranslated region of mRNA encoded by CKN1, corresponding to a HOST TARGET binding site such as BINDING SITE I, BINDING SITE II or BINDING SITE III. Table 2 illustrates the complementarity of the nucleotide sequences of CKN1 BINDING SITE, designated SEQ ID:5531, to the nucleotide sequence of VGAM1578 RNA, herein designated VGAM RNA, also designated SEQ ID:4289.

Another function of VGAM1578 is therefore inhibition of Cockayne Syndrome 1 (classical) (CKN1, Accession NM_000082). Accordingly, utilities of VGAM1578 include diagnosis, prevention and treatment of diseases and clinical conditions associated with CKN1. Collagen, Type IV, Alpha 3 (Goodpasture antigen) (COL4A3, Accession NM_000091) is another VGAM1578 host target gene. COL4A3 BINDING SITE1 through COL4A3 BINDING SITE3 are HOST TARGET binding sites found in untranslated regions of mRNA encoded by COL4A3, corresponding to HOST TARGET binding sites such as BINDING SITE I, BINDING SITE II or BINDING SITE III. Table 2 illustrates the complementarity of the nucleotide sequences of COL4A3 BINDING SITE1 through COL4A3 BINDING SITE3, designated SEQ ID:5549, SEQ ID:25356 and SEQ ID:25362 respectively, to the nucleotide sequence of VGAM1578 RNA, herein designated VGAM RNA, also designated SEQ ID:4289.

Another function of VGAM1578 is therefore inhibition of Collagen, Type IV, Alpha 3 (Goodpasture antigen) (COL4A3, Accession NM_000091). Accordingly, utilities of VGAM1578 include diagnosis, prevention and treatment of diseases and clinical conditions associated with COL4A3. Protocadherin Beta 16 (PCDHB16, Accession NM_020957) is another VGAM1578 host target gene. PCDHB16 BINDING SITE is HOST TARGET binding site found in the 3' untranslated region of mRNA encoded by PCDHB16, corresponding to a HOST TARGET binding site such as BINDING SITE I, BINDING SITE II or BINDING SITE III. Table 2 illustrates the complementarity of the nucleotide sequences of PCDHB16 BINDING SITE, designated SEQ ID:21946, to the nucleotide sequence of VGAM1578 RNA, herein designated VGAM RNA, also designated SEQ ID:4289.

Another function of VGAM1578 is therefore inhibition of Protocadherin Beta 16 (PCDHB16, Accession NM_020957), a gene which is a potential calcium-dependent cell-adhesion protein. Accordingly, utilities of VGAM1578 include diagnosis, prevention and treatment of diseases and clinical conditions associated with PCDHB16. The function of PCDHB16 and its association with various diseases and clinical conditions, has been established by previous studies, as described hereinabove with reference to VGAM931. Transforming Growth Factor, Beta Receptor II (70/80 kDa) (TGFBR2, Accession NM_003242) is another VGAM1578 host target gene. TGFBR2 BINDING SITE is HOST TARGET binding site found in the 3' untranslated region of mRNA encoded by TGFBR2, corresponding to a HOST TARGET binding site such as BINDING SITE I, BINDING SITE II or BINDING SITE III. Table 2 illustrates the complementarity of the nucleotide sequences of TGFBR2 BINDING SITE, designated SEQ ID:9243, to the nucleotide sequence of VGAM1578 RNA, herein designated VGAM RNA, also designated SEQ ID:4289.

Another function of VGAM1578 is therefore inhibition of Transforming Growth Factor, Beta Receptor II (70/80 kDa) (TGFBR2, Accession NM_003242). Accordingly, utilities of VGAM1578 include diagnosis, prevention and treatment of diseases and clinical conditions associated with TGFBR2. Zinc Finger Protein 146 (ZNF146, Accession NM_007145) is another VGAM1578 host target gene. ZNF146 BINDING SITE is HOST TARGET binding site found in the 5' untranslated region of mRNA encoded by ZNF146, corresponding to a HOST TARGET binding site such as BINDING SITE I, BINDING SITE II or BINDING SITE III. Table 2 illustrates the complementarity of the nucleotide sequences of ZNF146 BINDING SITE, designated SEQ ID:13995, to the nucleotide sequence of VGAM1578 RNA, herein designated VGAM RNA, also designated SEQ ID:4289.

Another function of VGAM1578 is therefore inhibition of Zinc Finger Protein 146 (ZNF146, Accession NM_007145), a gene which binds zinc ions, DNA, and heparin. Accordingly, utilities of VGAM1578 include diagnosis, prevention and treatment of diseases and clinical conditions associated with ZNF146. The function of ZNF146 and its association with various diseases and clinical conditions, has been established by previous studies, as described hereinabove with reference to VGAM192. Angiomotin (AMOT, Accession NM_133265) is another VGAM1578 host target gene. AMOT BINDING SITE is HOST TARGET binding site found in the 3' untranslated region of mRNA encoded by AMOT, corresponding to a HOST TARGET binding site such as BINDING SITE I, BINDING SITE II or BINDING SITE III. Table 2 illustrates the complementarity of the nucleotide sequences of AMOT BINDING SITE, designated SEQ ID:28415, to the nucleotide sequence of VGAM1578 RNA, herein designated VGAM RNA, also designated SEQ ID:4289.

Another function of VGAM1578 is therefore inhibition of Angiomotin (AMOT, Accession NM_133265). Accordingly, utilities of VGAM1578 include diagnosis, prevention and treatment of diseases and clinical conditions associated with AMOT. Chromosome 20 Open Reading Frame 20 (C20orf20, Accession NM_018270) is another VGAM1578 host target gene. C20orf20 BINDING SITE is HOST TARGET binding site found in the 3" untranslated region of mRNA encoded by C20orf20, corresponding to a HOST TARGET binding site such as BINDING SITE I, BINDING SITE II or BINDING SITE III. Table 2 illustrates the complementarity of the nucleotide sequences of C20orf20 BINDING SITE, designated SEQ ID:20246, to the nucleotide sequence of VGAM1578 RNA, herein designated VGAM RNA, also designated SEQ ID:4289.

Another function of VGAM1578 is therefore inhibition of Chromosome 20 Open Reading Frame 20 (C20orf20, Accession NM_018270). Accordingly, utilities of VGAM1578 include diagnosis, prevention and treatment of diseases and clinical conditions associated with C20orf20. Deiodinase, Iodothyronine, Type II (DIO2, Accession NM_013989) is another VGAM1578 host target gene. DIO2 BINDING SITE1 and DIO2 BINDING SITE2 are HOST TARGET binding sites found in untranslated regions of mRNA encoded by DIO2, corresponding to HOST TARGET binding sites such as BINDING SITE I, BINDING SITE II or BINDING SITE III. Table 2 illustrates the complementarity of the nucleotide sequences of DIO2 BINDING SITE1 and DIO2 BINDING SITE2, designated SEQ ID:15171 and SEQ ID:6460 respectively, to the nucleotide sequence of VGAM1578 RNA, herein designated VGAM RNA, also designated SEQ ID:4289.

Another function of VGAM1578 is therefore inhibition of Deiodinase, Iodothyronine, Type II (DIO2, Accession NM_013989). Accordingly, utilities of VGAM1578 include diagnosis, prevention and treatment of diseases and clinical conditions associated with DIO2. FLJ10120 (Accession NM_018001) is another VGAM1578 host target gene. FLJ10120 BINDING SITE is HOST TARGET binding site found in the 3' untranslated region of mRNA encoded by FLJ10120, corresponding to a HOST TARGET binding site such as BINDING SITE I, BINDING SITE II or BINDING SITE III. Table 2 illustrates the complementarity of the nucleotide sequences of FLJ10120 BINDING SITE, designated SEQ ID:19730, to the nucleotide sequence of VGAM1578 RNA, herein designated VGAM RNA, also designated SEQ ID:4289.

Another function of VGAM1578 is therefore inhibition of FLJ10120 (Accession NM_018001). Accordingly, utilities of VGAM1578 include diagnosis, prevention and treatment of diseases and clinical conditions associated with FLJ10120. FLJ11722 (Accession NM_024970) is another VGAM1578 host target gene. FLJ11722 BINDING SITE is HOST TARGET binding site found in the 3' untranslated region of mRNA encoded by FLJ11722, corresponding to a HOST TARGET binding site such as BINDING SITE I, BINDING SITE II or BINDING SITE III. Table 2 illustrates the complementarity of the nucleotide sequences of FLJ11722 BINDING SITE, designated SEQ ID:24522, to the nucleotide sequence of VGAM1578 RNA, herein designated VGAM RNA, also designated SEQ ID:4289.

Another function of VGAM1578 is therefore inhibition of FLJ11722 (Accession NM_024970). Accordingly, utilities of VGAM1578 include diagnosis, prevention and treatment of diseases and clinical conditions associated with FLJ11722. Interleukin Enhancer Binding Factor 3, 90kDa (ILF3, Accession NM_004516) is another VGAM1578 host target gene. ILF3 BINDING SITE is HOST TARGET binding site found in the 3' untranslated region of mRNA encoded by ILF3, corresponding to a HOST TARGET binding site such as BINDING SITE I, BINDING SITE II or BINDING SITE III. Table 2 illustrates the complementarity of the nucleotide sequences of ILF3 BINDING SITE, designated SEQ ID:10846, to the nucleotide sequence of VGAM1578 RNA, herein designated VGAM RNA, also designated SEQ ID:4289.

Another function of VGAM1578 is therefore inhibition of Interleukin Enhancer Binding Factor 3, 90 kDa (ILF3, Accession NM_004516). Accordingly, utilities of VGAM1578 include diagnosis, prevention and treatment of diseases and clinical conditions associated with ILF3. KIAA1005 (Accession XM_051197) is another VGAM1578 host target gene. KIAA1005 BINDING SITE is HOST TARGET binding site found in the 3' untranslated region of mRNA encoded by KIAA1005, corresponding to a HOST TARGET binding site such as BINDING SITE I, BINDING SITE II or BINDING SITE III. Table 2 illustrates the complementarity of the nucleotide sequences of KIAA1005 BINDING SITE, designated SEQ ID:35777, to the nucleotide sequence of VGAM1578 RNA, herein designated VGAM RNA, also designated SEQ ID:4289.

Another function of VGAM1578 is therefore inhibition of KIAA1005 (Accession XM_051197). Accordingly, utilities of VGAM1578 include diagnosis, prevention and treatment of diseases and clinical conditions associated with KIAA1005. KIAA1924 (Accession XM_057091) is another VGAM1578 host target gene. KIAA1924 BINDING SITE is HOST TARGET binding site found in the 3' untranslated region of mRNA encoded by KIAA1924, corresponding to a HOST TARGET binding site such as BINDING SITE I, BINDING SITE II or BINDING SITE III. Table 2 illustrates the complementarity of the nucleotide sequences of KIAA1924 BINDING SITE, designated SEQ ID:36480, to the nucleotide sequence of VGAM1578 RNA, herein designated VGAM RNA, also designated SEQ ID:4289.

Another function of VGAM1578 is therefore inhibition of KIAA1924 (Accession XM_057091). Accordingly, utilities of VGAM1578 include diagnosis, prevention and treatment of diseases and clinical conditions associated with KIAA1924. LOC150005 (Accession XM_097795) is another VGAM1578 host target gene. LOC150005 BINDING SITE is HOST TARGET binding site found in the 3' untranslated region of mRNA encoded by LOC150005, corresponding to a HOST TARGET binding site such as BINDING SITE I, BINDING SITE II or BINDING SITE III. Table 2 illustrates the complementarity of the nucleotide sequences of LOC150005 BINDING SITE, designated SEQ ID:41123, to the nucleotide sequence of VGAM1578 RNA, herein designated VGAM RNA, also designated SEQ ID:4289.

Another function of VGAM1578 is therefore inhibition of LOC150005 (Accession XM_097795). Accordingly, utilities of VGAM1578 include diagnosis, prevention and treatment of diseases and clinical conditions associated with LOC150005. LOC255231 (Accession XM_170908) is another VGAM1578 host target gene. LOC255231 BINDING SITE is HOST TARGET binding site found in the 3' untranslated region of mRNA encoded by LOC255231, corresponding to a HOST TARGET binding site such as BINDING SITE I, BINDING SITE II or BINDING SITE III. Table 2 illustrates the complementarity of the nucleotide sequences of LOC255231 BINDING SITE, designated SEQ ID:45674, to the nucleotide sequence of VGAM1578 RNA, herein designated VGAM RNA, also designated SEQ ID:4289.

Another function of VGAM1578 is therefore inhibition of LOC255231 (Accession XM_170908). Accordingly, utilities of VGAM1578 include diagnosis, prevention and treatment of diseases and clinical conditions associated with LOC255231. FIG. 1 further provides a conceptual description of a novel bioinformatically detected viral gene of the present invention, referred to here as Viral Genomic Address Messenger 1579 (VGAM1579) viral gene, which modulates expression of respective host target genes thereof, the function and utility of which host target genes is known in the art.

VGAM1579 is a novel bioinformatically detected regulatory, non protein coding, viral micro RNA (miRNA) gene. The method by which VGAM1579 was detected is described hereinabove with reference to FIGS. 1-8.

VGAM1579 gene, herein designated VGAM GENE, is a viral gene contained in the genome of Rhopalosiphum Padi Virus. VGAM1579 host target gene, herein designated VGAM HOST TARGET GENE, is a human gene contained in the human genome.

VGAM1579 gene encodes a VGAM1579 precursor RNA, herein designated VGAM PRECURSOR RNA. Similar to other miRNA genes, and unlike most ordinary genes, VGAM1579 precursor RNA does not encode a protein. A nucleotide sequence identical or highly similar to the nucleotide sequence of VGAM1579 precursor RNA is designated SEQ ID:1565, and is provided hereinbelow with reference to the sequence listing part. Nucleotide sequence SEQ ID:1565 is located at position 8880 relative to the genome of Rhopalosiphum Padi Virus.

VGAM1579 precursor RNA folds onto itself, forming VGAM1579 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1579 folded precursor RNA into VGAM1579 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1579 RNA is designated SEQ ID:4290, and is provided hereinbelow with reference to the sequence listing part.

VGAM1579 host target gene, herein designated VGAM HOST TARGET GENE, encodes a corresponding messenger RNA, VGAM1579 host target RNA, herein designated VGAM HOST TARGET RNA. VGAM1579 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1579 RNA, herein designated VGAM RNA, binds complementarily to one or more host target binding sites located in untranslated regions of VGAM1579 host target RNA, herein designated VGAM HOST TARGET RNA. This complementary binding is due to the fact that the nucleotide sequence of VGAM1579 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1579 RNA, herein designated VGAM RNA, may have a different number of host target binding sites in untranslated regions of a VGAM1579 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1579 RNA, herein designated VGAM RNA, to host target binding sites on VGAM1579 host target RNA, herein designated VGAM HOST TARGET RNA, such as BINDING SITE I, BINDING SITE II and BINDING SITE III, inhibits translation of VGAM1579 host target RNA into VGAM1579 host target protein, herein designated VGAM HOST TARGET PROTEIN. VGAM host target protein is therefore outlined by a broken line.

It is appreciated that VGAM1579 host target gene, herein designated VGAM HOST TARGET GENE, in fact represents a plurality of VGAM1579 host target genes. The mRNA of each one of this plurality of VGAM1579 host target genes comprises one or more host target binding sites, each having a nucleotide sequence which is at least partly complementary to VGAM1579 RNA, herein designated VGAM RNA, and which when bound by VGAM1579 RNA causes inhibition of translation of respective one or more VGAM1579 host target proteins.

It is further appreciated by one skilled in the art that the mode of translational inhibition illustrated by FIG. 1 with specific reference to translational inhibition exerted by VGAM1579 gene, herein designated VGAM GENE, on one or more VGAM1579 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1579 is inhibition of expression of host target genes, as part of a novel viral mechanism of attacking a host. Accordingly, utilities of VGAM1579 include diagnosis, prevention and treatment of viral infection by Rhopalosiphum Padi Virus. Specific functions, and accordingly utilities, of VGAM1579 correlate with, and may be deduced from, the identity of the host target genes which VGAM1579 binds and inhibits, and the function of these host target genes, as elaborated hereinbelow.

Nucleotide sequences of the VGAM1579 precursor RNA, herein designated VGAM PRECURSOR RNA, and of the 'diced' VGAM1579 RNA, herein designated VGAM RNA, and a schematic representation of the secondary folding of VGAM1579 folded precursor RNA, herein designated VGAM FOLDED PRECURSOR RNA, of VGAM1579 are further described hereinbelow with reference to Table 1.

Nucleotide sequences of host target binding sites, such as BINDING SITE-I, BINDING SITE-II and BINDING SITE-III of FIG. 1, found on VGAM1579 host target RNA, and schematic representation of the complementarity of each of these host target binding sites to VGAM1579 RNA, herein designated VGAM RNA, are described hereinbelow with reference to Table 2.

As mentioned hereinabove with reference to FIG. 1, a function of VGAM1579 gene, herein designated VGAM is inhibition of expression of VGAM1579 target genes. It is appreciated that specific functions, and accordingly utilities, of VGAM1579 correlate with, and may be deduced from, the identity of the target genes which VGAM1579 binds and inhibits, and the function of these target genes, as elaborated hereinbelow.

MFN1 (Accession NM_017927) is a VGAM1579 host target gene. MFN1 BINDING SITE is HOST TARGET binding site found in the 3' untranslated region of mRNA encoded by MFN1, corresponding to a HOST TARGET binding site such as BINDING SITE I, BINDING SITE II or BINDING SITE III. Table 2 illustrates the complementarity of the nucleotide sequences of MFN1 BINDING SITE, designated SEQ ID:19601, to the nucleotide sequence of VGAM1579 RNA, herein designated VGAM RNA, also designated SEQ ID:4290.

A function of VGAM1579 is therefore inhibition of MFN1 (Accession NM_017927). Accordingly, utilities of VGAM1579 include diagnosis, prevention and treatment of diseases and clinical conditions associated with MFN1. LOC148764 (Accession XM_086307) is another VGAM1579 host target gene. LOC148764 BINDING SITE is HOST TARGET binding site found in the 5' untranslated region of mRNA encoded by LOC148764, corresponding to a HOST TARGET binding site such as BINDING SITE I, BINDING SITE II or BINDING SITE III. Table 2 illustrates the complementarity of the nucleotide sequences of LOC148764 BINDING SITE, designated SEQ ID:38588, to the nucleotide sequence of VGAM1579 RNA, herein designated VGAM RNA, also designated SEQ ID:4290.

Another function of VGAM1579 is therefore inhibition of LOC148764 (Accession XM_086307). Accordingly, utilities of VGAM1579 include diagnosis, prevention and treatment of diseases and clinical conditions associated with LOC148764. FIG. 1 further provides a conceptual description of a novel bioinformatically detected viral gene of the present invention, referred to here as Viral Genomic Address Messenger 1580 (VGAM1580) viral gene, which modulates expression of respective host target genes thereof, the function and utility of which host target genes is known in the art.

VGAM1580 is a novel bioinformatically detected regulatory, non protein coding, viral micro RNA (miRNA) gene. The method by which VGAM1580 was detected is described hereinabove with reference to FIGS. 1-8.

VGAM1580 gene, herein designated VGAM GENE, is a viral gene contained in the genome of Rhopalosiphum Padi Virus. VGAM1580 host target gene, herein designated VGAM HOST TARGET GENE, is a human gene contained in the human genome.

VGAM1580 gene encodes a VGAM1580 precursor RNA, herein designated VGAM PRECURSOR RNA. Similar to other miRNA genes, and unlike most ordinary genes, VGAM1580 precursor RNA does not encode a protein. A nucleotide sequence identical or highly similar to the nucleotide sequence of VGAM1580 precursor RNA is designated SEQ ID:1566, and is provided hereinbelow with reference to the sequence listing part. Nucleotide sequence SEQ ID:1566 is located at position 8018 relative to the genome of Rhopalosiphum Padi Virus.

VGAM1580 precursor RNA folds onto itself, forming VGAM1580 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1580 folded precursor RNA into VGAM1580 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM1580 RNA is designated SEQ ID:4291, and is provided hereinbelow with reference to the sequence listing part.

VGAM1580 host target gene, herein designated VGAM HOST TARGET GENE, encodes a corresponding messenger RNA, VGAM1580 host target RNA, herein designated VGAM HOST TARGET RNA. VGAM1580 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1580 RNA, herein designated VGAM RNA, binds complementarily to one or more host target binding sites located in untranslated regions of VGAM1580 host target RNA, herein designated VGAM HOST TARGET RNA. This complementary binding is due to the fact that the nucleotide sequence of VGAM1580 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1580 RNA, herein designated VGAM RNA, may have a different number of host target binding sites in untranslated regions of a VGAM1580 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1580 RNA, herein designated VGAM RNA, to host target binding sites on VGAM1580 host target RNA, herein designated VGAM HOST TARGET RNA, such as BINDING SITE I, BINDING SITE II and BINDING SITE III, inhibits translation of VGAM1580 host target RNA into VGAM1580 host target protein, herein designated VGAM HOST TARGET PROTEIN. VGAM host target protein is therefore outlined by a broken line.

It is appreciated that VGAM1580 host target gene, herein designated VGAM HOST TARGET GENE, in fact represents a plurality of VGAM1580 host target genes. The mRNA of each one of this plurality of VGAM1580 host target genes comprises one or more host target binding sites, each having a nucleotide sequence which is at least partly complementary to VGAM1580 RNA, herein designated VGAM RNA, and which when bound by VGAM1580 RNA causes inhibition of translation of respective one or more VGAM1580 host target proteins.

It is further appreciated by one skilled in the art that the mode of translational inhibition illustrated by FIG. 1 with specific reference to translational inhibition exerted by VGAM1580 gene, herein designated VGAM GENE, on one or more VGAM1580 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1580 is inhibition of expression of host target genes, as part of a novel viral mechanism of attacking a host. Accordingly, utilities of VGAM1580 include diagnosis, prevention and treatment of viral infection by Rhopalosiphum Padi Virus. Specific functions, and accordingly utilities, of VGAM1580 correlate with, and may be deduced from, the identity of the host target genes which VGAM1580 binds and inhibits, and the function of these host target genes, as elaborated hereinbelow.

Nucleotide sequences of the VGAM1580 precursor RNA, herein designated VGAM PRECURSOR RNA, and of the 'diced' VGAM1580 RNA, herein designated VGAM RNA, and a schematic representation of the secondary folding of VGAM1580 folded precursor RNA, herein designated VGAM FOLDED PRECURSOR RNA, of VGAM1580 are further described hereinbelow with reference to Table 1.

Nucleotide sequences of host target binding sites, such as BINDING SITE-I, BINDING SITE-II and BINDING SITE-III of FIG. 1, found on VGAM1580 host target RNA, and schematic representation of the complementarity of each of these host target binding sites to VGAM1580 RNA, herein designated VGAM RNA, are described hereinbelow with reference to Table 2.

As mentioned hereinabove with reference to FIG. 1, a function of VGAM1580 gene, herein designated VGAM is inhibition of expression of VGAM1580 target genes. It is appreciated that specific functions, and accordingly utilities, of VGAM1580 correlate with, and may be deduced from, the identity of the target genes which VGAM1580 binds and inhibits, and the function of these target genes, as elaborated hereinbelow.

Period Homolog 2 (Drosophila) (PER2, Accession NM_022817) is a VGAM1580 host target gene. PER2 BINDING SITE is HOST TARGET binding site found in the 3' untranslated region of mRNA encoded by PER2, corresponding to a HOST TARGET binding site such as BINDING SITE I, BINDING SITE II or BINDING SITE III. Table 2 illustrates the complementarity of the nucleotide sequences of PER2 BINDING SITE, designated SEQ ID:23088, to the nucleotide sequence of VGAM1580 RNA, herein designated VGAM RNA, also designated SEQ ID:4291.

A function of VGAM1580 is therefore inhibition of Period Homolog 2 (Drosophila) (PER2, Accession NM_022817), a gene which Period homolog 2; putative circadian clock protein; has a PAS dimerization domain. Accordingly, utilities of VGAM1580 include diagnosis, prevention and treatment of diseases and clinical conditions associated with PER2. The function of PER2 and its association with various diseases and clinical conditions, has been established by previous studies, as described hereinabove with reference to VGAM74. AKL3L (Accession NM_016282) is another VGAM1580 host target gene. AKL3L BINDING SITE is HOST TARGET binding site found in the 3" untranslated region of mRNA encoded by AKL3L, corresponding to a HOST TARGET binding site such as BINDING SITE I, BINDING SITE II or BINDING SITE III. Table 2 illustrates the complementarity of the nucleotide sequences of AKL3L BINDING SITE, designated SEQ ID:18410, to the nucleotide sequence of VGAM1580 RNA, herein designated VGAM RNA, also designated SEQ ID:4291.

Another function of VGAM1580 is therefore inhibition of AKL3L (Accession NM_016282). Accordingly, utilities of VGAM1580 include diagnosis, prevention and treatment of diseases and clinical conditions associated with AKL3L. FLJ20793 (Accession XM_166296) is another VGAM1580 host target gene. FLJ20793 BINDING SITE is HOST TARGET binding site found in the 3' untranslated region of mRNA encoded by FLJ20793, corresponding to a HOST TARGET binding site such as BINDING SITE I, BINDING SITE II or BINDING SITE III. Table 2 illustrates the complementarity of the nucleotide sequences of FLJ20793 BINDING SITE, designated SEQ ID:44110, to the nucleotide sequence of VGAM1580 RNA, herein designated VGAM RNA, also designated SEQ ID:4291.

Another function of VGAM1580 is therefore inhibition of FLJ20793 (Accession XM_166296). Accordingly, utilities of VGAM1580 include diagnosis, prevention and treatment of diseases and clinical conditions associated with FLJ20793. KIAA1715 (Accession XM_042834) is another VGAM1580 host target gene. KIAA1715 BINDING SITE is HOST TARGET binding site found in the 3' untranslated region of mRNA encoded by KIAA1715, corresponding to a HOST TARGET binding site such as BINDING SITE I, BINDING SITE II or BINDING SITE III. Table 2 illustrates the complementarity of the nucleotide sequences of KIAA1715 BINDING SITE, designated SEQ ID:33794, to the nucleotide sequence of VGAM1580 RNA, herein designated VGAM RNA, also designated SEQ ID:4291.

Another function of VGAM1580 is therefore inhibition of KIAA1715 (Accession XM_042834). Accordingly, utilities of VGAM1580 include diagnosis, prevention and treatment of diseases and clinical conditions associated with KIAA1715. Protein Tyrosine Phosphatase, Receptor Type, N Polypeptide 2 (PTPRN2, Accession NM_130842) is another VGAM1580 host target gene. PTPRN2 BINDING SITE1 and PTPRN2 BINDING SITE2 are HOST TARGET binding sites found in untranslated regions of mRNA encoded by PTPRN2, corresponding to HOST TARGET binding sites such as BINDING SITE I, BINDING SITE II or BINDING SITE III. Table 2 illustrates the complementarity of the nucleotide sequences of PTPRN2 BINDING SITE1 and PTPRN2 BINDING SITE2, designated SEQ ID:28370 and SEQ ID:28375 respectively, to the nucleotide sequence of VGAM1580 RNA, herein designated VGAM RNA, also designated SEQ ID:4291.

Another function of VGAM1580 is therefore inhibition of Protein Tyrosine Phosphatase, Receptor Type, N Polypeptide 2 (PTPRN2, Accession NM_130842). Accordingly, utilities of VGAM1580 include diagnosis, prevention and treatment of diseases and clinical conditions associated with PTPRN2. LOC203286 (Accession XM_117526) is another VGAM1580 host target gene. LOC203286 BINDING SITE is HOST TARGET binding site found in the 5' untranslated region of mRNA encoded by LOC203286, corresponding to a HOST TARGET binding site such as BINDING SITE I, BINDING SITE II or BINDING SITE III. Table 2 illustrates the complementarity of the nucleotide sequences of LOC203286 BINDING SITE, designated SEQ ID:43498, to the nucleotide sequence of VGAM1580 RNA, herein designated VGAM RNA, also designated SEQ ID:4291.

Another function of VGAM1580 is therefore inhibition of LOC203286 (Accession XM_117526). Accordingly, utilities of VGAM1580 include diagnosis, prevention and treatment of diseases and clinical conditions associated with LOC203286. FIG. 1 further provides a conceptual description of a novel bioinformatically detected viral gene of the present invention, referred to here as Viral Genomic Address Messenger 1581 (VGAM1581) viral gene, which modulates expression of respective host target genes thereof, the function and utility of which host target genes is known in the art.

VGAM1581 is a novel bioinformatically detected regulatory, non protein coding, viral micro RNA (miRNA) gene. The method by which VGAM1581 was detected is described hereinabove with reference to FIGS. 1-8.

VGAM1581 gene, herein designated VGAM GENE, is a viral gene contained in the genome of Saimiriine Herpesvirus 2. VGAM1581 host target gene, herein designated VGAM HOST TARGET GENE, is a human gene contained in the human genome.

VGAM1581 gene encodes a VGAM1581 precursor RNA, herein designated VGAM PRECURSOR RNA. Similar to other miRNA genes, and unlike most ordinary genes, VGAM1581 precursor RNA does not encode a protein. A nucleotide sequence identical or highly similar to the nucleotide sequence of VGAM1581 precursor RNA is designated SEQ ID:1567, and is provided hereinbelow with reference to the sequence listing part. Nucleotide sequence SEQ ID:1567 is located at position 94704 relative to the genome of Saimiriine Herpesvirus 2.

VGAM1581 precursor RNA folds onto itself, forming VGAM1581 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1581 folded precursor RNA into VGAM1581 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM1581 RNA is designated SEQ ID:4292, and is provided hereinbelow with reference to the sequence listing part.

VGAM1581 host target gene, herein designated VGAM HOST TARGET GENE, encodes a corresponding messenger RNA, VGAM1581 host target RNA, herein designated VGAM HOST TARGET RNA. VGAM1581 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1581 RNA, herein designated VGAM RNA, binds complementarily to one or more host target binding sites located in untranslated regions of VGAM1581 host target RNA, herein designated VGAM HOST TARGET RNA. This complementary binding is due to the fact that the nucleotide sequence of VGAM1581 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1581 RNA, herein designated VGAM RNA, may have a different number of host target binding sites in untranslated regions of a VGAM1581 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1581 RNA, herein designated VGAM RNA, to host target binding sites on VGAM1581 host target RNA, herein designated VGAM HOST TARGET RNA, such as BINDING SITE I, BINDING SITE II and BINDING SITE III, inhibits translation of VGAM1581 host target RNA into VGAM1581 host target protein, herein designated VGAM HOST TARGET PROTEIN. VGAM host target protein is therefore outlined by a broken line.

It is appreciated that VGAM1581 host target gene, herein designated VGAM HOST TARGET GENE, in fact represents a plurality of VGAM1581 host target genes. The mRNA of each one of this plurality of VGAM1581 host target genes comprises one or more host target binding sites, each having a nucleotide sequence which is at least partly complementary to VGAM1581 RNA, herein designated VGAM RNA, and which when bound by VGAM1581 RNA causes inhibition of translation of respective one or more VGAM1581 host target proteins.

It is further appreciated by one skilled in the art that the mode of translational inhibition illustrated by FIG. 1 with specific reference to translational inhibition exerted by VGAM1581 gene, herein designated VGAM GENE, on one or more VGAM1581 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1581 is inhibition of expression of host target genes, as part of a novel viral mechanism of attacking a host. Accordingly, utilities of VGAM1581 include diagnosis, prevention and treatment of viral infection by Saimiriine Herpesvirus 2. Specific functions, and accordingly utilities, of VGAM1581 correlate with, and may be deduced from, the identity of the host target genes which VGAM1581 binds and inhibits, and the function of these host target genes, as elaborated hereinbelow.

Nucleotide sequences of the VGAM1581 precursor RNA, herein designated VGAM PRECURSOR RNA, and of the 'diced' VGAM1581 RNA, herein designated VGAM RNA, and a schematic representation of the secondary folding of VGAM1581 folded precursor RNA, herein designated VGAM FOLDED PRECURSOR RNA, of VGAM1581 are further described hereinbelow with reference to Table 1.

Nucleotide sequences of host target binding sites, such as BINDING SITE-I, BINDING SITE-II and BINDING SITE-III of FIG. 1, found on VGAM1581 host target RNA, and schematic representation of the complementarity of each of these host target binding sites to VGAM1581 RNA, herein designated VGAM RNA, are described hereinbelow with reference to Table 2.

As mentioned hereinabove with reference to FIG. 1, a function of VGAM1581 gene, herein designated VGAM is inhibition of expression of VGAM1581 target genes. It is appreciated that specific functions, and accordingly utilities, of VGAM1581 correlate with, and may be deduced from, the identity of the target genes which VGAM1581 binds and inhibits, and the function of these target genes, as elaborated hereinbelow.

Rac/Cdc42 Guanine Nucleotide Exchange Factor (GEF) 6 (ARHGEF6, Accession XM_042963) is a VGAM1581 host target gene. ARHGEF6 BINDING SITE is HOST TARGET binding site found in the 3' untranslated region of mRNA encoded by ARHGEF6, corresponding to a HOST TARGET binding site such as BINDING SITE I, BINDING SITE II or BINDING SITE III. Table 2 illustrates the complementarity of the nucleotide sequences of ARHGEF6 BINDING SITE, designated SEQ ID:33845, to the nucleotide sequence of VGAM1581 RNA, herein designated VGAM RNA, also designated SEQ ID:4292.

A function of VGAM1581 is therefore inhibition of Rac/Cdc42 Guanine Nucleotide Exchange Factor (GEF) 6 (ARHGEF6, Accession XM_042963). Accordingly, utilities of VGAM1581 include diagnosis, prevention and treatment of diseases and clinical conditions associated with ARHGEF6. D4ST-1 (Accession NM_130468) is another VGAM1581 host target gene. D4ST-1 BINDING SITE is HOST TARGET binding site found in the 3' untranslated region of mRNA encoded by D4ST-1, corresponding to a HOST TARGET binding site such as BINDING SITE I, BINDING SITE II or BINDING SITE III. Table 2 illustrates the complementarity of the nucleotide sequences of D4ST-1 BINDING SITE, designated SEQ ID:28228, to the nucleotide sequence of VGAM1581 RNA, herein designated VGAM RNA, also designated SEQ ID:4292.

Another function of VGAM1581 is therefore inhibition of D4ST-1 (Accession NM_130468). Accordingly, utilities of VGAM1581 include diagnosis, prevention and treatment of diseases and clinical conditions associated with D4ST-1. KIAA0700 (Accession XM_050561) is another VGAM1581 host target gene. KIAA0700 BINDING SITE is HOST TARGET binding site found in the 3' untranslated region of mRNA encoded by KIAA0700, corresponding to a HOST TARGET binding site such as BINDING SITE I, BINDING SITE II or BINDING SITE III. Table 2 illustrates the complementarity of the nucleotide sequences of KIAA0700 BINDING SITE, designated SEQ ID:35658, to the nucleotide sequence of VGAM1581 RNA, herein designated VGAM RNA, also designated SEQ ID:4292.

Another function of VGAM1581 is therefore inhibition of KIAA0700 (Accession XM_050561). Accordingly, utilities of VGAM1581 include diagnosis, prevention and treatment of diseases and clinical conditions associated with KIAA0700. RODH-4 (Accession NM_003708) is another VGAM1581 host target gene. RODH-4 BINDING SITE is HOST TARGET binding site found in the 5' untranslated region of mRNA encoded by RODH-4, corresponding to a HOST TARGET binding site such as BINDING SITE I, BINDING SITE II or BINDING SITE III. Table 2 illustrates the complementarity of the nucleotide sequences of RODH-4 BINDING SITE, designated SEQ ID:9808, to the nucleotide sequence of VGAM1581 RNA, herein designated VGAM RNA, also designated SEQ ID:4292.

Another function of VGAM1581 is therefore inhibition of RODH-4 (Accession NM_003708). Accordingly, utilities of VGAM1581 include diagnosis, prevention and treatment of diseases and clinical conditions associated with RODH-4. Serine Palmitoyltransferase, Long Chain Base Subunit 2 (SPTLC2, Accession NM_004863) is another VGAM1581 host target gene. SPTLC2 BINDING SITE is HOST TARGET binding site found in the 3' untranslated region of mRNA encoded by SPTLC2, corresponding to a HOST TARGET binding site such as BINDING SITE I, BINDING SITE II or BINDING SITE III. Table 2 illustrates the complementarity of the nucleotide sequences of SPTLC2 BINDING SITE, designated SEQ ID:11283, to the nucleotide sequence of VGAM1581 RNA, herein designated VGAM RNA, also designated SEQ ID:4292.

Another function of VGAM1581 is therefore inhibition of Serine Palmitoyltransferase, Long Chain Base Subunit 2 (SPTLC2, Accession NM_004863). Accordingly, utilities of VGAM1581 include diagnosis, prevention and treatment of diseases and clinical conditions associated with SPTLC2. LOC147669 (Accession XM_097262) is another VGAM1581 host target gene. LOC147669 BINDING SITE is HOST TARGET binding site found in the 5' untranslated region of mRNA encoded by LOC147669, corresponding to a HOST TARGET binding site such as BINDING SITE I, BINDING SITE II or BINDING SITE III. Table 2 illustrates the complementarity of the nucleotide sequences of LOC147669 BINDING SITE, designated SEQ ID:40856, to the nucleotide sequence of VGAM1581 RNA, herein designated VGAM RNA, also designated SEQ ID:4292.

Another function of VGAM1581 is therefore inhibition of LOC147669 (Accession XM_097262). Accordingly, utilities of VGAM1581 include diagnosis, prevention and treatment of diseases and clinical conditions associated with LOC147669. LOC151438 (Accession XM_098060) is another VGAM1581 host target gene. LOC151438 BINDING SITE is HOST TARGET binding site found in the 3' untranslated region of mRNA encoded by LOC151438, corresponding to a HOST TARGET binding site such as BINDING SITE I, BINDING SITE II or BINDING SITE III. Table 2 illustrates the complementarity of the nucleotide sequences of LOC151438 BINDING SITE, designated SEQ ID:41347, to the nucleotide sequence of VGAM1581 RNA, herein designated VGAM RNA, also designated SEQ ID:4292.

Another function of VGAM1581 is therefore inhibition of LOC151438 (Accession XM_098060). Accordingly, utilities of VGAM1581 include diagnosis, prevention and treatment of diseases and clinical conditions associated with LOC151438. FIG. 1 further provides a conceptual description of a novel bioinformatically detected viral gene of the present invention, referred to here as Viral Genomic Address Messenger 1582 (VGAM1582) viral gene, which modulates expression of respective host target genes thereof, the function and utility of which host target genes is known in the art.

VGAM1582 is a novel bioinformatically detected regulatory, non protein coding, viral micro RNA (miRNA) gene. The method by which VGAM1582 was detected is described hereinabove with reference to FIGS. 1-8.

VGAM1582 gene, herein designated VGAM GENE, is a viral gene contained in the genome of Saimiriine Herpesvirus 2. VGAM1582 host target gene, herein designated VGAM HOST TARGET GENE, is a human gene contained in the human genome.

VGAM1582 gene encodes a VGAM1582 precursor RNA, herein designated VGAM PRECURSOR RNA. Similar to other miRNA genes, and unlike most ordinary genes, VGAM1582 precursor RNA does not encode a protein. A nucleotide sequence identical or highly similar to the nucleotide sequence of VGAM1582 precursor RNA is designated SEQ ID:1568, and is provided hereinbelow with reference to the sequence listing part. Nucleotide sequence SEQ ID:1568 is located at position 90201 relative to the genome of Saimiriine Herpesvirus 2.

VGAM1582 precursor RNA folds onto itself, forming VGAM1582 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1582 folded precursor RNA into VGAM1582 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1582 RNA is designated SEQ ID:4293, and is provided hereinbelow with reference to the sequence listing part.

VGAM1582 host target gene, herein designated VGAM HOST TARGET GENE, encodes a corresponding messenger RNA, VGAM1582 host target RNA, herein designated VGAM HOST TARGET RNA. VGAM1582 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1582 RNA, herein designated VGAM RNA, binds complementarily to one or more host target binding sites located in untranslated regions of VGAM1582 host target RNA, herein designated VGAM HOST TARGET RNA. This complementary binding is due to the fact that the nucleotide sequence of VGAM1582 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1582 RNA, herein designated VGAM RNA, may have a different number of host target binding sites in untranslated regions of a VGAM1582 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1582 RNA, herein designated VGAM RNA, to host target binding sites on VGAM1582 host target RNA, herein designated VGAM HOST TARGET RNA, such as BINDING SITE I, BINDING SITE II and BINDING SITE III, inhibits translation of VGAM1582 host target RNA into VGAM1582 host target protein, herein designated VGAM HOST TARGET PROTEIN. VGAM host target protein is therefore outlined by a broken line.

It is appreciated that VGAM1582 host target gene, herein designated VGAM HOST TARGET GENE, in fact represents a plurality of VGAM1582 host target genes. The mRNA of each one of this plurality of VGAM1582 host target genes comprises one or more host target binding sites, each having a nucleotide sequence which is at least partly complementary to VGAM1582 RNA, herein designated VGAM RNA, and which when bound by VGAM1582 RNA causes inhibition of translation of respective one or more VGAM1582 host target proteins.

It is further appreciated by one skilled in the art that the mode of translational inhibition illustrated by FIG. 1 with specific reference to translational inhibition exerted by VGAM1582 gene, herein designated VGAM GENE, on one or more VGAM1582 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1582 is inhibition of expression of host target genes, as part of a novel viral mechanism of attacking a host. Accordingly, utilities of VGAM1582 include diagnosis, prevention and treatment of viral infection by Saimiriine Herpesvirus 2. Specific functions, and accordingly utilities, of VGAM1582 correlate with, and may be deduced from, the identity of the host target genes which VGAM1582 binds and inhibits, and the function of these host target genes, as elaborated hereinbelow.

Nucleotide sequences of the VGAM1582 precursor RNA, herein designated VGAM PRECURSOR RNA, and of the 'diced' VGAM1582 RNA, herein designated VGAM RNA, and a schematic representation of the secondary folding of VGAM1582 folded precursor RNA, herein designated VGAM FOLDED PRECURSOR RNA, of VGAM1582 are further described hereinbelow with reference to Table 1.

Nucleotide sequences of host target binding sites, such as BINDING SITE-I, BINDING SITE-II and BINDING SITE-III of FIG. 1, found on VGAM1582 host target RNA, and schematic representation of the complementarity of each of these host target binding sites to VGAM1582 RNA, herein designated VGAM RNA, are described hereinbelow with reference to Table 2.

As mentioned hereinabove with reference to FIG. 1, a function of VGAM1582 gene, herein designated VGAM is inhibition of expression of VGAM1582 target genes. It is appreciated that specific functions, and accordingly utilities, of VGAM1582 correlate with, and may be deduced from, the identity of the target genes which VGAM1582 binds and inhibits, and the function of these target genes, as elaborated hereinbelow.

Cyclin-dependent Kinase Inhibitor 2A (melanoma, p16, inhibits CDK4) (CDKN2A, Accession NM_058197) is a VGAM1582 host target gene. CDKN2A BINDING SITE is HOST TARGET binding site found in the 3' untranslated region of mRNA encoded by CDKN2A, corresponding to a HOST TARGET binding site such as BINDING SITE I, BINDING SITE II or BINDING SITE III. Table 2 illustrates the complementarity of the nucleotide sequences of CDKN2A BINDING SITE, designated SEQ ID:27759, to the nucleotide sequence of VGAM1582 RNA, herein designated VGAM RNA, also designated SEQ ID:4293.

A function of VGAM1582 is therefore inhibition of Cyclin-dependent Kinase Inhibitor 2A (melanoma, p16, inhibits CDK4) (CDKN2A, Accession NM_058197). Accordingly, utilities of VGAM1582 include diagnosis, prevention and treatment of diseases and clinical conditions associated with CDKN2A. Secreted Frizzled-related Protein 1 (SFRP1, Accession NM_003012) is another VGAM1582 host target gene. SFRP1 BINDING SITE is HOST TARGET binding site found in the 3' untranslated region of mRNA encoded by SFRP1, corresponding to a HOST TARGET binding site such as BINDING SITE I, BINDING SITE II or BINDING SITE III. Table 2 illustrates the complementarity of the nucleotide sequences of SFRP1 BINDING SITE, designated SEQ ID:8924, to the nucleotide sequence of VGAM1582 RNA, herein designated VGAM RNA, also designated SEQ ID:4293.

Another function of VGAM1582 is therefore inhibition of Secreted Frizzled-related Protein 1 (SFRP1, Accession NM_003012), a gene which is a receptor for wnt proteins that may have an anti-apoptotic function. Accordingly, utilities of VGAM1582 include diagnosis, prevention and treatment of diseases and clinical conditions associated with SFRP1. The function of SFRP1 and its association with various diseases and clinical conditions, has been established by previous studies, as described hereinabove with reference to VGAM250. APACD (Accession NM_005783) is another VGAM1582 host target gene. APACD BINDING SITE is HOST TARGET binding site found in the 3' untranslated region of mRNA encoded by APACD, corresponding to a HOST TARGET binding site such as BINDING SITE I, BINDING SITE II or BINDING SITE III. Table 2 illustrates the complementarity of the nucleotide sequences of APACD BINDING SITE, designated SEQ ID:12362, to the nucleotide sequence of VGAM1582 RNA, herein designated VGAM RNA, also designated SEQ ID:4293.

Another function of VGAM1582 is therefore inhibition of APACD (Accession NM_005783). Accordingly, utilities of VGAM1582 include diagnosis, prevention and treatment of diseases and clinical conditions associated with APACD. ARNTL2 (Accession NM_020183) is another VGAM1582 host target gene. ARNTL2 BINDING SITE is HOST TARGET binding site found in the 3' untranslated region of mRNA encoded by ARNTL2, corresponding to a HOST TARGET binding site such as BINDING SITE I, BINDING SITE II or BINDING SITE III. Table 2 illustrates the complementarity of the nucleotide sequences of ARNTL2 BINDING SITE, designated SEQ ID:21409, to the nucleotide sequence of VGAM1582 RNA, herein designated VGAM RNA, also designated SEQ ID:4293.

Another function of VGAM1582 is therefore inhibition of ARNTL2 (Accession NM_020183). Accordingly, utilities of VGAM1582 include diagnosis, prevention and treatment of diseases and clinical conditions associated with ARNTL2. DIS3 (Accession NM_014953) is another VGAM1582 host target gene. DIS3 BINDING SITE is HOST TARGET binding site found in the 3' untranslated region of mRNA encoded by DIS3, corresponding to a HOST TARGET binding site such as BINDING SITE I, BINDING SITE II or BINDING SITE III. Table 2 illustrates the complementarity of the nucleotide sequences of DIS3 BINDING SITE, designated SEQ ID:17304, to the nucleotide sequence of VGAM1582 RNA, herein designated VGAM RNA, also designated SEQ ID:4293.

Another function of VGAM1582 is therefore inhibition of DIS3 (Accession NM_014953). Accordingly, utilities of VGAM1582 include diagnosis, prevention and treatment of diseases and clinical conditions associated with DIS3. DKFZP564B1162 (Accession NM_031305) is another VGAM1582 host target gene. DKFZP564B1162 BINDING SITE is HOST TARGET binding site found in the 5' untranslated region of mRNA encoded by DKFZP564B1162, corresponding to a HOST TARGET binding site such as BINDING SITE I, BINDING SITE II or BINDING SITE III. Table 2 illustrates the complementarity of the nucleotide sequences of DKFZP564B1162 BINDING SITE, designated SEQ ID:25339, to the nucleotide sequence of VGAM1582 RNA, herein designated VGAM RNA, also designated SEQ ID:4293.

Another function of VGAM1582 is therefore inhibition of DKFZP564B1162 (Accession NM_031305). Accordingly, utilities of VGAM1582 include diagnosis, prevention and treatment of diseases and clinical conditions associated with DKFZP564B1162. GT650 (Accession NM_052851) is another VGAM1582 host target gene. GT650 BINDING SITE is HOST TARGET binding site found in the 3' untranslated region of mRNA encoded by GT650, corresponding to a HOST TARGET binding site such as BINDING SITE I, BINDING SITE II or BINDING SITE III. Table 2 illustrates the complementarity of the nucleotide sequences of GT650 BINDING SITE, designated SEQ ID:27433, to the nucleotide sequence of VGAM1582 RNA, herein designated VGAM RNA, also designated SEQ ID:4293.

Another function of VGAM1582 is therefore inhibition of GT650 (Accession NM_052851). Accordingly, utilities of VGAM1582 include diagnosis, prevention and treatment of diseases and clinical conditions associated with GT650. HTEX4 (Accession XM_166378) is another VGAM1582 host target gene. HTEX4 BINDING SITE1 through HTEX4 BINDING SITE3 are HOST TARGET binding sites found in untranslated regions of mRNA encoded by HTEX4, corresponding to HOST TARGET binding sites such as BINDING SITE I, BINDING SITE II or BINDING SITE III. Table 2 illustrates the complementarity of the nucleotide sequences of HTEX4 BINDING SITE1 through HTEX4 BINDING SITE3, designated SEQ ID:44218, SEQ ID:46654 and SEQ ID:46723 respectively, to the nucleotide sequence of VGAM1582 RNA, herein designated VGAM RNA, also designated SEQ ID:4293.

Another function of VGAM1582 is therefore inhibition of HTEX4 (Accession XM_166378). Accordingly, utilities of VGAM1582 include diagnosis, prevention and treatment of diseases and clinical conditions associated with HTEX4. KIAA0830 (Accession XM_045759) is another VGAM1582 host target gene. KIAA0830 BINDING SITE is HOST TARGET binding site found in the 3' untranslated region of mRNA encoded by KIAA0830, corresponding to a HOST TARGET binding site such as BINDING SITE I, BINDING SITE II or BINDING SITE III. Table 2 illustrates the complementarity of the nucleotide sequences of KIAA0830 BINDING SITE, designated SEQ ID:34544, to the nucleotide sequence of VGAM1582 RNA, herein designated VGAM RNA, also designated SEQ ID:4293.

Another function of VGAM1582 is therefore inhibition of KIAA0830 (Accession XM_045759). Accordingly, utilities of VGAM1582 include diagnosis, prevention and treatment of diseases and clinical conditions associated with KIAA0830. KIAA1254 (Accession XM_046132) is another VGAM1582 host target gene. KIAA1254 BINDING SITE is HOST TARGET binding site found in the 3' untranslated region of mRNA encoded by KIAA1254, corresponding to a HOST TARGET binding site such as BINDING SITE I, BINDING SITE II or BINDING SITE III. Table 2 illustrates the complementarity of the nucleotide sequences of KIAA1254 BINDING SITE, designated SEQ ID:34697, to the nucleotide sequence of VGAM1582 RNA, herein designated VGAM RNA, also designated SEQ ID:4293.

Another function of VGAM1582 is therefore inhibition of KIAA1254 (Accession XM_046132). Accordingly, utilities of VGAM1582 include diagnosis, prevention and treatment of diseases and clinical conditions associated with KIAA1254. MGC2827 (Accession NM_023940) is another VGAM1582 host target gene. MGC2827 BINDING SITE is HOST TARGET binding site found in the 3' untranslated region of mRNA encoded by MGC2827, corresponding to a HOST TARGET binding site such as BINDING SITE I, BINDING SITE II or BINDING SITE III. Table 2 illustrates the complementarity of the nucleotide sequences of MGC2827 BINDING SITE, designated SEQ ID:23427, to the nucleotide sequence of VGAM1582 RNA, herein designated VGAM RNA, also designated SEQ ID:4293.

Another function of VGAM1582 is therefore inhibition of MGC2827 (Accession NM_023940). Accordingly, utilities of VGAM1582 include diagnosis, prevention and treatment of diseases and clinical conditions associated with MGC2827. LOC158798 (Accession XM_088671) is another VGAM1582 host target gene. LOC158798 BINDING SITE is HOST TARGET binding site found in the 5' untranslated region of mRNA encoded by LOC158798, corresponding to a HOST TARGET binding site such as BINDING SITE I, BINDING SITE II or BINDING SITE III. Table 2 illustrates the complementarity of the nucleotide sequences of LOC158798 BINDING SITE, designated SEQ ID:39891, to the nucleotide sequence of VGAM1582 RNA, herein designated VGAM RNA, also designated SEQ ID:4293.

Another function of VGAM1582 is therefore inhibition of LOC158798 (Accession XM_088671). Accordingly, utilities of VGAM1582 include diagnosis, prevention and treatment of diseases and clinical conditions associated with LOC158798. LOC161357 (Accession XM_090827) is another VGAM1582 host target gene. LOC161357 BINDING SITE is HOST TARGET binding site found in the 3' untranslated region of mRNA encoded by LOC161357, corresponding to a HOST TARGET binding site such as BINDING SITE I, BINDING SITE II or BINDING SITE III. Table 2 illustrates the complementarity of the nucleotide sequences of LOC161357 BINDING SITE, designated SEQ ID:40017, to the nucleotide sequence of VGAM1582 RNA, herein designated VGAM RNA, also designated SEQ ID:4293.

Another function of VGAM1582 is therefore inhibition of LOC161357 (Accession XM_090827). Accordingly, utilities of VGAM1582 include diagnosis, prevention and treatment of diseases and clinical conditions associated with LOC161357. LOC199863 (Accession XM_117147) is another VGAM1582 host target gene. LOC199863 BINDING SITE is HOST TARGET binding site found in the 5' untranslated region of mRNA encoded by LOC199863, corresponding to a HOST TARGET binding site such as BINDING SITE I, BINDING SITE II or BINDING SITE III. Table 2 illustrates the complementarity of the nucleotide sequences of LOC199863 BINDING SITE, designated SEQ ID:43253, to the nucleotide sequence of VGAM1582 RNA, herein designated VGAM RNA, also designated SEQ ID:4293.

Another function of VGAM1582 is therefore inhibition of LOC199863 (Accession XM_117147). Accordingly, utilities of VGAM1582 include diagnosis, prevention and treatment of diseases and clinical conditions associated with LOC199863. LOC221895 (Accession XM_166511) is another VGAM1582 host target gene. LOC221895 BINDING SITE is HOST TARGET binding site found in the 3' untranslated region of mRNA encoded by LOC221895, corresponding to a HOST TARGET binding site such as BINDING SITE I, BINDING SITE II or BINDING SITE III. Table 2 illustrates the complementarity of the nucleotide sequences of LOC221895 BINDING SITE, designated SEQ ID:44440, to the nucleotide sequence of VGAM1582 RNA, herein designated VGAM RNA, also designated SEQ ID:4293.

Another function of VGAM1582 is therefore inhibition of LOC221895 (Accession XM_166511). Accordingly, utilities of VGAM1582 include diagnosis, prevention and treatment of diseases and clinical conditions associated with LOC221895. FIG. 1 further provides a conceptual description of a novel bioinformatically detected viral gene of the present invention, referred to here as Viral Genomic Address Messenger 1583 (VGAM1583) viral gene, which modulates expression of respective host target genes thereof, the function and utility of which host target genes is known in the art.

VGAM1583 is a novel bioinformatically detected regulatory, non protein coding, viral micro RNA (miRNA) gene. The method by which VGAM1583 was detected is described hereinabove with reference to FIGS. 1-8.

VGAM1583 gene, herein designated VGAM GENE, is a viral gene contained in the genome of Saimiriine Herpesvirus 2. VGAM1583 host target gene, herein designated VGAM HOST TARGET GENE, is a human gene contained in the human genome.

VGAM1583 gene encodes a VGAM1583 precursor RNA, herein designated VGAM PRECURSOR RNA. Similar to other miRNA genes, and unlike most ordinary genes, VGAM1583 precursor RNA does not encode a protein. A nucleotide sequence identical or highly similar to the nucleotide sequence of VGAM1583 precursor RNA is designated SEQ ID:1569, and is provided hereinbelow with reference to the sequence listing part. Nucleotide sequence SEQ ID:1569 is located at position 93157 relative to the genome of Saimiriine Herpesvirus 2.

VGAM1583 precursor RNA folds onto itself, forming VGAM1583 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1583 folded precursor RNA into VGAM1583 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM1583 RNA is designated SEQ ID:4294, and is provided hereinbelow with reference to the sequence listing part.

VGAM1583 host target gene, herein designated VGAM HOST TARGET GENE, encodes a corresponding messenger RNA, VGAM1583 host target RNA, herein designated VGAM HOST TARGET RNA. VGAM1583 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1583 RNA, herein designated VGAM RNA, binds complementarily to one or more host target binding sites located in untranslated regions of VGAM1583 host target RNA, herein designated VGAM HOST TARGET RNA. This complementary binding is due to the fact that the nucleotide sequence of VGAM1583 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1583 RNA, herein designated VGAM RNA, may have a different number of host target binding sites in untranslated regions of a VGAM1583 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1583 RNA, herein designated VGAM RNA, to host target binding sites on VGAM1583 host target RNA, herein designated VGAM HOST TARGET RNA, such as BINDING SITE I, BINDING SITE II and BINDING SITE III, inhibits translation of VGAM1583 host target RNA into VGAM1583 host target protein, herein designated VGAM HOST TARGET PROTEIN. VGAM host target protein is therefore outlined by a broken line.

It is appreciated that VGAM1583 host target gene, herein designated VGAM HOST TARGET GENE, in fact represents a plurality of VGAM1583 host target genes. The mRNA of each one of this plurality of VGAM1583 host target genes comprises one or more host target binding sites, each having a nucleotide sequence which is at least partly complementary to VGAM1583 RNA, herein designated VGAM RNA, and which when bound by VGAM1583 RNA causes inhibition of translation of respective one or more VGAM1583 host target proteins.

It is further appreciated by one skilled in the art that the mode of translational inhibition illustrated by FIG. 1 with specific reference to translational inhibition exerted by VGAM1583 gene, herein designated VGAM GENE, on one or more VGAM1583 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1583 is inhibition of expression of host target genes, as part of a novel viral mechanism of attacking a host. Accordingly, utilities of VGAM1583 include diagnosis, prevention and treatment of viral infection by Saimiriine Herpesvirus 2. Specific functions, and accordingly utilities, of VGAM1583 correlate with, and may be deduced from, the identity of the host target genes which VGAM1583 binds and inhibits, and the function of these host target genes, as elaborated hereinbelow.

Nucleotide sequences of the VGAM1583 precursor RNA, herein designated VGAM PRECURSOR RNA, and of the 'diced' VGAM1583 RNA, herein designated VGAM RNA, and a schematic representation of the secondary folding of VGAM1583 folded precursor RNA, herein designated VGAM FOLDED PRECURSOR RNA, of VGAM1583 are further described hereinbelow with reference to Table 1.

Nucleotide sequences of host target binding sites, such as BINDING SITE-I, BINDING SITE-II and BINDING SITE-III of FIG. 1, found on VGAM1583 host target RNA, and schematic representation of the complementarity of each of these host target binding sites to VGAM1583 RNA, herein designated VGAM RNA, are described hereinbelow with reference to Table 2.

As mentioned hereinabove with reference to FIG. 1, a function of VGAM1583 gene, herein designated VGAM is inhibition of expression of VGAM1583 target genes. It is appreciated that specific functions, and accordingly utilities, of VGAM1583 correlate with, and may be deduced from, the identity of the target genes which VGAM1583 binds and inhibits, and the function of these target genes, as elaborated hereinbelow.

Fibronectin Leucine Rich Transmembrane Protein 2 (FLRT2, Accession NM_013231) is a VGAM1583 host target gene. FLRT2 BINDING SITE is HOST TARGET binding site found in the 5' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14874, to the nucleotide sequence of VGAM1583 RNA, herein designated VGAM RNA, also designated SEQ ID:4294.

A function of VGAM1583 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM1583 include diagnosis, prevention and treatment of diseases and clinical conditions associated with FLRT2. The function of FLRT2 and its association with various diseases and clinical conditions, has been established by previous studies, as described hereinabove with reference to VGAM247. Phosphodiesterase 4D, CAMP-specific (phosphodiesterase E3 dunce homolog, Drosophila) (PDE4D, Accession XM_056815) is another VGAM1583 host target gene. PDE4D BINDING SITE is HOST TARGET binding site found in the 3' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36427, to the nucleotide sequence of VGAM1583 RNA, herein designated VGAM RNA, also designated SEQ ID:4294.

Another function of VGAM1583 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM1583 include diagnosis, prevention and treatment of diseases and clinical conditions associated with PDE4D. The function of PDE4D and its association with various diseases and clinical conditions, has been established by previous studies, as described hereinabove with reference to VGAM180. Tolloid-like 1 (TLL1, Accession NM_012464) is another VGAM1583 host target gene. TLL1 BINDING SITE is HOST TARGET binding site found in the 3' untranslated region of mRNA encoded by TLL1, corresponding to a HOST TARGET binding site such as BINDING SITE I, BINDING SITE II or BINDING SITE III. Table 2 illustrates the complementarity of the nucleotide sequences of TLL1 BINDING SITE, designated SEQ ID:14836, to the nucleotide sequence of VGAM1583 RNA, herein designated VGAM RNA, also designated SEQ ID:4294.

Another function of VGAM1583 is therefore inhibition of Tolloid-like 1 (TLL1, Accession NM_012464), a gene which is involved in bone morphogenesis. Accordingly, utilities of VGAM1583 include diagnosis, prevention and treatment of diseases and clinical conditions associated with TLL1. The function of TLL1 has been established by previous studies. Scott et al. (1999) compared enzymatic activities and expression domains of 4 mammalian BMP1/TLD-like proteases and found differences in their ability to process fibrillar collagen precursors and to cleave chordin (OMIM Ref. No. 603475). As previously demonstrated for BMP1 and TLD, TLL1 specifically processes procollagen C-propeptides at the physiologically relevant site, whereas TLL2 (OMIM Ref. No. 606743) lacks this activity. BMP1 and TLL1 cleave chordin, at sites similar to procollagen C-propeptide cleavage sites, and counteract dorsalizing effects of chordin upon overexpression on Xenopus embryos. Proteases TLD and TLL2 do not cleave chordin. Animal model experiments lend further support to the function of TLL1. Clark et al. (1999) used gene targeting in embryonic stem cells to produce mice with a disrupted allele for Tll1. Homozygous mutants were embryonic lethal, with death at midgestation from cardiac failure and a constellation of developmental defects confined to the heart. Constant features were incomplete formation of the muscular interventricular septum and an abnormal and novel positioning of the heart and aorta.

It is appreciated that the abovementioned animal model for TLL1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Scott, I. C.; Blitz, I. L.; Pappano, W. N.; Imamura, Y.; Clark, T. G.; Steiglitz, B. M.; Thomas, C. L.; Maas, S. A.; Takahara, K.; Cho, K. W. Y.; Greenspan, D. S.: Mammalian BMP-1/tolloid-related metalloproteinases, including novel family member mammalian tolloid-like 2, have differential enzymatic activities and distributions of expression relevant to patterning and skeletogenesis. Dev. Biol. 213:283-300, 1999; and Clark, T. G.; Conway, S. J.; Scott, I. C.; Labosky, P. A.; Winnier, G.; Bundy, J.; Hogan, B. L. M.; Greenspan, D. S.: The mammalian Tolloid-like 1 gene, Tll1, is necessary for normal s.

Further studies establishing the function and utilities of TLL1 are found in John Hopkins OMIM database record ID 606742, and in sited publications numbered 548 and 5483-5484 listed in the bibliography section hereinbelow, which are also hereby incorporated by reference. Aldo-keto Reductase Family 1, Member D1 (delta 4-3-ketosteroid-5-beta-reductase) (AKR1D1, Accession NM_005989) is another VGAM1583 host target gene. AKR1D1 BINDING SITE is HOST TARGET binding site found in the 3' untranslated region of mRNA encoded by AKR1D1, corresponding to a HOST TARGET binding site such as BINDING SITE I, BINDING SITE II or BINDING SITE III. Table 2 illustrates the complementarity of the nucleotide sequences of AKR1D1 BINDING SITE, designated SEQ ID:12609, to the nucleotide sequence of VGAM1583 RNA, herein designated VGAM RNA, also designated SEQ ID:4294.

Another function of VGAM1583 is therefore inhibition of Aldo-keto Reductase Family 1, Member D1 (delta 4-3-ketosteroid-5-beta-reductase) (AKR1D1, Accession NM_005989). Accordingly, utilities of VGAM1583 include diagnosis, prevention and treatment of diseases and clinical conditions associated with AKR1D1. FLJ14803 (Accession NM_032842) is another VGAM1583 host target gene. FLJ14803 BINDING SITE is HOST TARGET binding site found in the 3' untranslated region of mRNA encoded by FLJ14803, corresponding to a HOST TARGET binding site such as BINDING SITE I, BINDING SITE II or BINDING SITE III. Table 2 illustrates the complementarity of the nucleotide sequences of FLJ14803 BINDING SITE, designated SEQ ID:26625, to the nucleotide sequence of VGAM1583 RNA, herein designated VGAM RNA, also designated SEQ ID:4294.

Another function of VGAM1583 is therefore inhibition of FLJ14803 (Accession NM_032842). Accordingly, utilities of VGAM1583 include diagnosis, prevention and treatment of diseases and clinical conditions associated with FLJ14803. FLJ22795 (Accession NM_025084) is another VGAM1583 host target gene. FLJ22795 BINDING SITE is HOST TARGET binding site found in the 3' untranslated region of mRNA encoded by FLJ22795, corresponding to a HOST TARGET binding site such as BINDING SITE I, BINDING SITE II or BINDING SITE III. Table 2 illustrates the complementarity of the nucleotide sequences of FLJ22795 BINDING SITE, designated SEQ ID:24686, to the nucleotide sequence of VGAM1583 RNA, herein designated VGAM RNA, also designated SEQ ID:4294.

Another function of VGAM1583 is therefore inhibition of FLJ22795 (Accession NM_025084). Accordingly, utilities of VGAM1583 include diagnosis, prevention and treatment of diseases and clinical conditions associated with FLJ22795. H2A Histone Family, Member J (H2AFJ, Accession NM_018267) is another VGAM1583 host target gene. H2AFJ BINDING SITE is HOST TARGET binding site found in the 3' untranslated region of mRNA encoded by H2AFJ, corresponding to a HOST TARGET binding site such as BINDING SITE I, BINDING SITE II or BINDING SITE III. Table 2 illustrates the complementarity of the nucleotide sequences of H2AFJ BINDING SITE, designated SEQ ID:20235, to the nucleotide sequence of VGAM1583 RNA, herein designated VGAM RNA, also designated SEQ ID:4294.

Another function of VGAM1583 is therefore inhibition of H2A Histone Family, Member J (H2AFJ, Accession NM_018267). Accordingly, utilities of VGAM1583 include diagnosis, prevention and treatment of diseases and clinical conditions associated with H2AFJ. KIAA0737 (Accession NM_014828) is another VGAM1583 host target gene. KIAA0737 BINDING SITE is HOST TARGET binding site found in the 3' untranslated region of mRNA encoded by KIAA0737, corresponding to a HOST TARGET binding site such as BINDING SITE I, BINDING SITE II or BINDING SITE III. Table 2 illustrates the complementarity of the nucleotide sequences of KIAA0737 BINDING SITE, designated SEQ ID:16818, to the nucleotide sequence of VGAM1583 RNA, herein designated VGAM RNA, also designated SEQ ID:4294.

Another function of VGAM1583 is therefore inhibition of KIAA0737 (Accession NM_014828). Accordingly, utilities of VGAM1583 include diagnosis, prevention and treatment of diseases and clinical conditions associated with KIAA0737. KIAA1582 (Accession XM_037262) is another VGAM1583 host target gene. KIAA1582 BINDING SITE is HOST TARGET binding site found in the 3' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32577, to the nucleotide sequence of VGAM1583 RNA, herein designated VGAM RNA, also designated SEQ ID:4294.

Another function of VGAM1583 is therefore inhibition of KIAA1582 (Accession XM_037262). Accordingly, utilities of VGAM1583 include diagnosis, prevention and treatment of diseases and clinical conditions associated with KIAA1582. PRP8 Pre-mRNA Processing Factor 8 Homolog (yeast) (PRPF8, Accession XM_028335) is another VGAM1583 host target gene. PRPF8 BINDING SITE is HOST TARGET binding site found in the 5' untranslated region of mRNA encoded by PRPF8, corresponding to a HOST TARGET binding site such as BINDING SITE I, BINDING SITE II or BINDING SITE III. Table 2 illustrates the complementarity of the nucleotide sequences of PRPF8 BINDING SITE, designated SEQ ID:30683, to the nucleotide sequence of VGAM1583 RNA, herein designated VGAM RNA, also designated SEQ ID:4294.

Another function of VGAM1583 is therefore inhibition of PRP8 Pre-mRNA Processing Factor 8 Homolog (yeast) (PRPF8, Accession XM_028335). Accordingly, utilities of VGAM1583 include diagnosis, prevention and treatment of diseases and clinical conditions associated with PRPF8. Syntrophin, Gamma 1 (SNTG1, Accession NM_018967) is another VGAM1583 host target gene. SNTG1 BINDING SITE is HOST TARGET binding site found in the 3' untranslated region of mRNA encoded by SNTG1, corresponding to a HOST TARGET binding site such as BINDING SITE I, BINDING SITE II or BINDING SITE III. Table 2 illustrates the complementarity of the nucleotide sequences of SNTG1 BINDING SITE, designated SEQ ID:21040, to the nucleotide sequence of VGAM1583 RNA, herein designated VGAM RNA, also designated SEQ ID:4294.

Another function of VGAM1583 is therefore inhibition of Syntrophin, Gamma 1 (SNTG1, Accession NM_018967). Accordingly, utilities of VGAM1583 include diagnosis, prevention and treatment of diseases and clinical conditions associated with SNTG1. LOC143465 (Accession XM_096430) is another VGAM1583 host target gene. LOC143465 BINDING SITE is HOST TARGET binding site found in the 5' untranslated region of mRNA encoded by LOC143465, corresponding to a HOST TARGET binding site such as BINDING SITE I, BINDING SITE II or BINDING SITE III. Table 2 illustrates the complementarity of the nucleotide sequences of LOC143465 BINDING SITE, designated SEQ ID:40363, to the nucleotide sequence of VGAM1583 RNA, herein designated VGAM RNA, also designated SEQ ID:4294.

Another function of VGAM1583 is therefore inhibition of LOC143465 (Accession XM_096430). Accordingly, utilities of VGAM1583 include diagnosis, prevention and treatment of diseases and clinical conditions associated with LOC143465. LOC145717 (Accession XM_039771) is another VGAM1583 host target gene. LOC145717 BINDING SITE is HOST TARGET binding site found in the 3' untranslated region of mRNA encoded by LOC145717, corresponding to a HOST TARGET binding site such as BINDING SITE I, BINDING SITE II or BINDING SITE III. Table 2 illustrates the complementarity of the nucleotide sequences of LOC145717 BINDING SITE, designated SEQ ID:33186, to the nucleotide sequence of VGAM1583 RNA, herein designated VGAM RNA, also designated SEQ ID:4294.

Another function of VGAM1583 is therefore inhibition of LOC145717 (Accession XM_039771). Accordingly, utilities of VGAM1583 include diagnosis, prevention and treatment of diseases and clinical conditions associated with LOC145717. LOC145725 (Accession XM_085211) is another VGAM1583 host target gene. LOC145725 BINDING SITE is HOST TARGET binding site found in the 3' untranslated region of mRNA encoded by LOC145725, corresponding to a HOST TARGET binding site such as BINDING SITE I, BINDING SITE II or BINDING SITE III. Table 2 illustrates the complementarity of the nucleotide sequences of LOC145725 BINDING SITE, designated SEQ ID:37943, to the nucleotide sequence of VGAM1583 RNA, herein designated VGAM RNA, also designated SEQ ID:4294.

Another function of VGAM1583 is therefore inhibition of LOC145725 (Accession XM_085211). Accordingly, utilities of VGAM1583 include diagnosis, prevention and treatment of diseases and clinical conditions associated with LOC145725. LOC145732 (Accession XM_085218) is another VGAM1583 host target gene. LOC145732 BINDING SITE is HOST TARGET binding site found in the 3' untranslated region of mRNA encoded by LOC145732, corresponding to a HOST TARGET binding site such as BINDING SITE I, BINDING SITE II or BINDING SITE III. Table 2 illustrates the complementarity of the nucleotide sequences of LOC145732 BINDING SITE, designated SEQ ID:37952, to the nucleotide sequence of VGAM1583 RNA, herein designated VGAM RNA, also designated SEQ ID:4294.

Another function of VGAM1583 is therefore inhibition of LOC145732 (Accession XM_085218). Accordingly, utilities of VGAM1583 include diagnosis, prevention and treatment of diseases and clinical conditions associated with LOC145732. LOC196957 (Accession XM_113789) is another VGAM1583 host target gene. LOC196957 BINDING SITE is HOST TARGET binding site found in the 3' untranslated region of mRNA encoded by LOC196957, corresponding to a HOST TARGET binding site such as BINDING SITE I, BINDING SITE II or BINDING SITE III. Table 2 illustrates the complementarity of the nucleotide sequences of LOC196957 BINDING SITE, designated SEQ ID:42424, to the nucleotide sequence of VGAM1583 RNA, herein designated VGAM RNA, also designated SEQ ID:4294.

Another function of VGAM1583 is therefore inhibition of LOC196957 (Accession XM_113789). Accordingly, utilities of VGAM1583 include diagnosis, prevention and treatment of diseases and clinical conditions associated with LOC196957. LOC196961 (Accession XM_113790) is another VGAM1583 host target gene. LOC196961 BINDING SITE is HOST TARGET binding site found in the 3' untranslated region of mRNA encoded by LOC196961, corresponding to a HOST TARGET binding site such as BINDING SITE I, BINDING SITE II or BINDING SITE III. Table 2 illustrates the complementarity of the nucleotide sequences of LOC196961 BINDING SITE, designated SEQ ID:42433, to the nucleotide sequence of VGAM1583 RNA, herein designated VGAM RNA, also designated SEQ ID:4294.

Another function of VGAM1583 is therefore inhibition of LOC196961 (Accession XM_113790). Accordingly, utilities of VGAM1583 include diagnosis, prevention and treatment of diseases and clinical conditions associated with LOC196961. LOC197138 (Accession XM_113829) is another VGAM1583 host target gene. LOC197138 BINDING SITE is HOST TARGET binding site found in the 3' untranslated region of mRNA encoded by LOC197138, corresponding to a HOST TARGET binding site such as BINDING SITE I, BINDING SITE II or BINDING SITE III. Table 2 illustrates the complementarity of the nucleotide sequences of LOC197138 BINDING SITE, designated SEQ ID:42451, to the nucleotide sequence of VGAM1583 RNA, herein designated VGAM RNA, also designated SEQ ID:4294.

Another function of VGAM1583 is therefore inhibition of LOC197138 (Accession XM_113829). Accordingly, utilities of VGAM1583 include diagnosis, prevention and treatment of diseases and clinical conditions associated with LOC197138. LOC201475 (Accession XM_113967) is another VGAM1583 host target gene. LOC201475 BINDING SITE is HOST TARGET binding site found in the 5' untranslated region of mRNA encoded by LOC201475, corresponding to a HOST TARGET binding site such as BINDING SITE I, BINDING SITE II or BINDING SITE III. Table 2 illustrates the complementarity of the nucleotide sequences of LOC201475 BINDING SITE, designated SEQ ID:42577, to the nucleotide sequence of VGAM1583 RNA, herein designated VGAM RNA, also designated SEQ ID:4294.

Another function of VGAM1583 is therefore inhibition of LOC201475 (Accession XM_113967). Accordingly, utilities of VGAM1583 include diagnosis, prevention and treatment of diseases and clinical conditions associated with LOC201475. LOC220537 (Accession XM_165406) is another VGAM1583 host target gene. LOC220537 BINDING SITE is HOST TARGET binding site found in the 3' untranslated region of mRNA encoded by LOC220537, corresponding to a HOST TARGET binding site such as BINDING SITE I, BINDING SITE II or BINDING SITE III. Table 2 illustrates the complementarity of the nucleotide sequences of LOC220537 BINDING SITE, designated SEQ ID:43619, to the nucleotide sequence of VGAM1583 RNA, herein designated VGAM RNA, also designated SEQ ID:4294.

Another function of VGAM1583 is therefore inhibition of LOC220537 (Accession XM_165406). Accordingly, utilities of VGAM1583 include diagnosis, prevention and treatment of diseases and clinical conditions associated with LOC220537. LOC221806 (Accession XM_166518) is another VGAM1583 host target gene. LOC221806 BINDING SITE is HOST TARGET binding site found in the 5' untranslated region of mRNA encoded by LOC221806, corresponding to a HOST TARGET binding site such as BINDING SITE I, BINDING SITE II or BINDING SITE III. Table 2 illustrates the complementarity of the nucleotide sequences of LOC221806 BINDING SITE, designated SEQ ID:44452, to the nucleotide sequence of VGAM1583 RNA, herein designated VGAM RNA, also designated SEQ ID:4294.

Another function of VGAM1583 is therefore inhibition of LOC221806 (Accession XM_166518). Accordingly, utilities of VGAM1583 include diagnosis, prevention and treatment of diseases and clinical conditions associated with LOC221806. LOC245727 (Accession XM_165913) is another VGAM1583 host target gene. LOC245727 BINDING SITE is HOST TARGET binding site found in the 3' untranslated region of mRNA encoded by LOC245727, corresponding to a HOST TARGET binding site such as BINDING SITE I, BINDING SITE II or BINDING SITE III. Table 2 illustrates the complementarity of the nucleotide sequences of LOC245727 BINDING SITE, designated SEQ ID:43793, to the nucleotide sequence of VGAM1583 RNA, herein designated VGAM RNA, also designated SEQ ID:4294.

Another function of VGAM1583 is therefore inhibition of LOC245727 (Accession XM_165913). Accordingly, utilities of VGAM1583 include diagnosis, prevention and treatment of diseases and clinical conditions associated with LOC245727. LOC254065 (Accession XM_173239) is another VGAM1583 host target gene. LOC254065 BINDING SITE is HOST TARGET binding site found in the 5' untranslated region of mRNA encoded by LOC254065, corresponding to a HOST TARGET binding site such as BINDING SITE I, BINDING SITE II or BINDING SITE III. Table 2 illustrates the complementarity of the nucleotide sequences of LOC254065 BINDING SITE, designated SEQ ID:46524, to the nucleotide sequence of VGAM1583 RNA, herein designated VGAM RNA, also designated SEQ ID:4294.

Another function of VGAM1583 is therefore inhibition of LOC254065 (Accession XM_173239). Accordingly, utilities of VGAM1583 include diagnosis, prevention and treatment of diseases and clinical conditions associated with LOC254065. FIG. 1 further provides a conceptual description of a novel bioinformatically detected viral gene of the present invention, referred to here as Viral Genomic Address Messenger 1584 (VGAM1584) viral gene, which modulates expression of respective host target genes thereof, the function and utility of which host target genes is known in the art.

VGAM1584 is a novel bioinformatically detected regulatory, non protein coding, viral micro RNA (miRNA) gene.

The method by which VGAM1584 was detected is described hereinabove with reference to FIGS. 1-8.

VGAM1584 gene, herein designated VGAM GENE, is a viral gene contained in the genome of Saimiriine Herpesvirus 2. VGAM1584 host target gene, herein designated VGAM HOST TARGET GENE, is a human gene contained in the human genome.

VGAM1584 gene encodes a VGAM1584 precursor RNA, herein designated VGAM PRECURSOR RNA. Similar to other miRNA genes, and unlike most ordinary genes, VGAM1584 precursor RNA does not encode a protein. A nucleotide sequence identical or highly similar to the nucleotide sequence of VGAM1584 precursor RNA is designated SEQ ID:1570, and is provided hereinbelow with reference to the sequence listing part. Nucleotide sequence SEQ ID:1570 is located at position 91273 relative to the genome of Saimiriine Herpesvirus 2.

VGAM1584 precursor RNA folds onto itself, forming VGAM1584 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1584 folded precursor RNA into VGAM1584 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1584 RNA is designated SEQ ID:4295, and is provided hereinbelow with reference to the sequence listing part.

VGAM1584 host target gene, herein designated VGAM HOST TARGET GENE, encodes a corresponding messenger RNA, VGAM1584 host target RNA, herein designated VGAM HOST TARGET RNA. VGAM1584 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1584 RNA, herein designated VGAM RNA, binds complementarily to one or more host target binding sites located in untranslated regions of VGAM1584 host target RNA, herein designated VGAM HOST TARGET RNA. This complementary binding is due to the fact that the nucleotide sequence of VGAM1584 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1584 RNA, herein designated VGAM RNA, may have a different number of host target binding sites in untranslated regions of a VGAM1584 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1584 RNA, herein designated VGAM RNA, to host target binding sites on VGAM1584 host target RNA, herein designated VGAM HOST TARGET RNA, such as BINDING SITE I, BINDING SITE II and BINDING SITE III, inhibits translation of VGAM1584 host target RNA into VGAM1584 host target protein, herein designated VGAM HOST TARGET PROTEIN. VGAM host target protein is therefore outlined by a broken line.

It is appreciated that VGAM1584 host target gene, herein designated VGAM HOST TARGET GENE, in fact represents a plurality of VGAM1584 host target genes. The mRNA of each one of this plurality of VGAM1584 host target genes comprises one or more host target binding sites, each having a nucleotide sequence which is at least partly complementary to VGAM1584 RNA, herein designated VGAM RNA, and which when bound by VGAM1584 RNA causes inhibition of translation of respective one or more VGAM1584 host target proteins.

It is further appreciated by one skilled in the art that the mode of translational inhibition illustrated by FIG. 1 with specific reference to translational inhibition exerted by VGAM1584 gene, herein designated VGAM GENE, on one or more VGAM1584 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1584 is inhibition of expression of host target genes, as part of a novel viral mechanism of attacking a host. Accordingly, utilities of VGAM1584 include diagnosis, prevention and treatment of viral infection by Saimiriine Herpesvirus 2. Specific functions, and accordingly utilities, of VGAM1584 correlate with, and may be deduced from, the identity of the host target genes which VGAM1584 binds and inhibits, and the function of these host target genes, as elaborated hereinbelow.

Nucleotide sequences of the VGAM1584 precursor RNA, herein designated VGAM PRECURSOR RNA, and of the 'diced' VGAM1584 RNA, herein designated VGAM RNA, and a schematic representation of the secondary folding of VGAM1584 folded precursor RNA, herein designated VGAM FOLDED PRECURSOR RNA, of VGAM1584 are further described hereinbelow with reference to Table 1.

Nucleotide sequences of host target binding sites, such as BINDING SITE-I, BINDING SITE-II and BINDING SITE-III of FIG. 1, found on VGAM1584 host target RNA, and schematic representation of the complementarity of each of these host target binding sites to VGAM1584 RNA, herein designated VGAM RNA, are described hereinbelow with reference to Table 2.

As mentioned hereinabove with reference to FIG. 1, a function of VGAM1584 gene, herein designated VGAM is inhibition of expression of VGAM1584 target genes. It is appreciated that specific functions, and accordingly utilities, of VGAM1584 correlate with, and may be deduced from, the identity of the target genes which VGAM1584 binds and inhibits, and the function of these target genes, as elaborated hereinbelow.

FLJ20456 (Accession NM_017831) is a VGAM1584 host target gene. FLJ20456 BINDING SITE is HOST TARGET binding site found in the 3' untranslated region of mRNA encoded by FLJ20456, corresponding to a HOST TARGET binding site such as BINDING SITE I, BINDING SITE II or BINDING SITE III. Table 2 illustrates the complementarity of the nucleotide sequences of FLJ20456 BINDING SITE, designated SEQ ID:19493, to the nucleotide sequence of VGAM1584 RNA, herein designated VGAM RNA, also designated SEQ ID:4295.

A function of VGAM1584 is therefore inhibition of FLJ20456 (Accession NM_017831). Accordingly, utilities of VGAM1584 include diagnosis, prevention and treatment of diseases and clinical conditions associated with FLJ20456. KIAA1582 (Accession XM_037262) is another VGAM1584 host target gene. KIAA1582 BINDING SITE is HOST TARGET binding site found in the 3' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32578, to the nucleotide sequence of VGAM1584 RNA, herein designated VGAM RNA, also designated SEQ ID:4295.

Another function of VGAM1584 is therefore inhibition of KIAA1582 (Accession XM_037262). Accordingly, utilities of VGAM1584 include diagnosis, prevention and treatment of diseases and clinical conditions associated with KIAA1582. Tripartite Motif-containing 38 (TRIM38, Accession NM_006355) is another VGAM1584 host target gene. TRIM38 BINDING SITE is HOST TARGET binding site found in the 3' untranslated region of mRNA encoded by TRIM38, corresponding to a HOST TARGET binding site such as BINDING SITE I, BINDING SITE II or BINDING SITE III. Table 2 illustrates the complementarity of the nucleotide sequences of TRIM38 BINDING SITE, designated SEQ ID:13049, to the nucleotide sequence of VGAM1584 RNA, herein designated VGAM RNA, also designated SEQ ID:4295.

Another function of VGAM1584 is therefore inhibition of Tripartite Motif-containing 38 (TRIM38, Accession NM_006355). Accordingly, utilities of VGAM1584 include diagnosis, prevention and treatment of diseases and clinical conditions associated with TRIM38. LOC219673 (Accession XM_167567) is another VGAM1584 host target gene. LOC219673 BINDING SITE is HOST TARGET binding site found in the 5' untranslated region of mRNA encoded by LOC219673, corresponding to a HOST TARGET binding site such as BINDING SITE I, BINDING SITE II or BINDING SITE III. Table 2 illustrates the complementarity of the nucleotide sequences of LOC219673 BINDING SITE, designated SEQ ID:44691, to the nucleotide sequence of VGAM1584 RNA, herein designated VGAM RNA, also designated SEQ ID:4295.

Another function of VGAM1584 is therefore inhibition of LOC219673 (Accession XM_167567). Accordingly, utilities of VGAM1584 include diagnosis, prevention and treatment of diseases and clinical conditions associated with LOC219673. FIG. 1 further provides a conceptual description of a novel bioinformatically detected viral gene of the present invention, referred to here as Viral Genomic Address Messenger 1585 (VGAM1585) viral gene, which modulates expression of respective host target genes thereof, the function and utility of which host target genes is known in the art.

VGAM1585 is a novel bioinformatically detected regulatory, non protein coding, viral micro RNA (miRNA) gene. The method by which VGAM1585 was detected is described hereinabove with reference to FIGS. 1-8.

VGAM1585 gene, herein designated VGAM GENE, is a viral gene contained in the genome of Saimiriine Herpesvirus 2. VGAM1585 host target gene, herein designated VGAM HOST TARGET GENE, is a human gene contained in the human genome.

VGAM1585 gene encodes a VGAM1585 precursor RNA, herein designated VGAM PRECURSOR RNA. Similar to other miRNA genes, and unlike most ordinary genes, VGAM1585 precursor RNA does not encode a protein. A nucleotide sequence identical or highly similar to the nucleotide sequence of VGAM1585 precursor RNA is designated SEQ ID:1571, and is provided hereinbelow with reference to the sequence listing part. Nucleotide sequence SEQ ID:1571 is located at position 87716 relative to the genome of Saimiriine Herpesvirus 2.

VGAM1585 precursor RNA folds onto itself, forming VGAM1585 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1585 folded precursor RNA into VGAM1585 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1585 RNA is designated SEQ ID:4296, and is provided hereinbelow with reference to the sequence listing part.

VGAM1585 host target gene, herein designated VGAM HOST TARGET GENE, encodes a corresponding messenger RNA, VGAM1585 host target RNA, herein designated VGAM HOST TARGET RNA. VGAM1585 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1585 RNA, herein designated VGAM RNA, binds complementarily to one or more host target binding sites located in untranslated regions of VGAM1585 host target RNA, herein designated VGAM HOST TARGET RNA. This complementary binding is due to the fact that the nucleotide sequence of VGAM1585 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1585 RNA, herein designated VGAM RNA, may have a different number of host target binding sites in untranslated regions of a VGAM1585 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1585 RNA, herein designated VGAM RNA, to host target binding sites on VGAM1585 host target RNA, herein designated VGAM HOST TARGET RNA, such as BINDING SITE I, BINDING SITE II and BINDING SITE III, inhibits translation of VGAM1585 host target RNA into VGAM1585 host target protein, herein designated VGAM HOST TARGET PROTEIN. VGAM host target protein is therefore outlined by a broken line.

It is appreciated that VGAM1585 host target gene, herein designated VGAM HOST TARGET GENE, in fact represents a plurality of VGAM1585 host target genes. The mRNA of each one of this plurality of VGAM1585 host target genes comprises one or more host target binding sites, each having a nucleotide sequence which is at least partly complementary to VGAM1585 RNA, herein designated VGAM RNA, and which when bound by VGAM1585 RNA causes inhibition of translation of respective one or more VGAM1585 host target proteins.

It is further appreciated by one skilled in the art that the mode of translational inhibition illustrated by FIG. 1 with specific reference to translational inhibition exerted by VGAM1585 gene, herein designated VGAM GENE, on one or more VGAM1585 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1585 is inhibition of expression of host target genes, as part of a novel viral mechanism of attacking a host. Accordingly, utilities of VGAM1585 include diagnosis, prevention and treatment of viral infection by Saimiriine Herpesvirus 2. Specific functions, and accordingly utilities, of VGAM1585 correlate with, and may be deduced from, the identity of the host target genes which VGAM1585 binds and inhibits, and the function of these host target genes, as elaborated hereinbelow.

Nucleotide sequences of the VGAM1585 precursor RNA, herein designated VGAM PRECURSOR RNA, and of the 'diced' VGAM1585 RNA, herein designated VGAM RNA, and a schematic representation of the secondary folding of VGAM1585 folded precursor RNA, herein designated VGAM FOLDED PRECURSOR RNA, of VGAM1585 are further described hereinbelow with reference to Table 1.

Nucleotide sequences of host target binding sites, such as BINDING SITE-I, BINDING SITE-II and BINDING SITE-III of FIG. 1, found on VGAM1585 host target RNA, and schematic representation of the complementarity of each of these host target binding sites to VGAM1585 RNA, herein designated VGAM RNA, are described hereinbelow with reference to Table 2.

As mentioned hereinabove with reference to FIG. 1, a function of VGAM1585 gene, herein designated VGAM is inhibition of expression of VGAM1585 target genes. It is appreciated that specific functions, and accordingly utilities, of VGAM1585 correlate with, and may be deduced from, the identity of the target genes which VGAM1585 binds and inhibits, and the function of these target genes, as elaborated hereinbelow.

Chloride Channel, Calcium Activated, Family Member 3 (CLCA3, Accession NM_004921) is a VGAM1585 host target gene. CLCA3 BINDING SITE is HOST TARGET binding site found in the 3' untranslated region of mRNA encoded by CLCA3, corresponding to a HOST TARGET binding site such as BINDING SITE I, BINDING SITE II or BINDING SITE III. Table 2 illustrates the complementarity of the nucleotide sequences of CLCA3 BINDING SITE, designated SEQ ID:11353, to the nucleotide sequence of VGAM1585 RNA, herein designated VGAM RNA, also designated SEQ ID:4296.

A function of VGAM1585 is therefore inhibition of Chloride Channel, Calcium Activated, Family Member 3 (CLCA3, Accession NM_004921), a gene which is similar to calcium-activated chloride channel family. Accordingly, utilities of VGAM1585 include diagnosis, prevention and treatment of diseases and clinical conditions associated with CLCA3. The function of CLCA3 and its association with various diseases and clinical conditions, has been established by previous studies, as described hereinabove with reference to VGAM595. Epidermal Growth Factor Receptor (erythroblastic leukemia viral (v-erb-b) Oncogene Homolog, Avian) (EGFR, Accession NM_005228) is another VGAM1585 host target gene. EGFR BINDING SITE is HOST TARGET binding site found in the 3' untranslated region of mRNA encoded by EGFR, corresponding to a HOST TARGET binding site such as BINDING SITE I, BINDING SITE II or BINDING SITE III. Table 2 illustrates the complementarity of the nucleotide sequences of EGFR BINDING SITE, designated SEQ ID:11719, to the nucleotide sequence of VGAM1585 RNA, herein designated VGAM RNA, also designated SEQ ID:4296.

Another function of VGAM1585 is therefore inhibition of Epidermal Growth Factor Receptor (erythroblastic leukemia viral (v-erb-b) Oncogene Homolog, Avian) (EGFR, Accession NM_005228), a gene which is a receptor for egf, but also for other members of the egf family. Accordingly, utilities of VGAM1585 include diagnosis, prevention and treatment of diseases and clinical conditions associated with EGFR. The function of EGFR and its association with various diseases and clinical conditions, has been established by previous studies, as described hereinabove with reference to VGAM229. G Protein-coupled Receptor 48 (GPR48, Accession NM_018490) is another VGAM1585 host target gene. GPR48 BINDING SITE is HOST TARGET binding site found in the 3' untranslated region of mRNA encoded by GPR48, corresponding to a HOST TARGET binding site such as BINDING SITE I, BINDING SITE II or BINDING SITE III. Table 2 illustrates the complementarity of the nucleotide sequences of GPR48 BINDING SITE, designated SEQ ID:20552, to the nucleotide sequence of VGAM1585 RNA, herein designated VGAM RNA, also designated SEQ ID:4296.

Another function of VGAM1585 is therefore inhibition of G Protein-coupled Receptor 48 (GPR48, Accession NM_018490), a gene which binds to follicle-stimulating hormone and thyroid-stimulating hormone. Accordingly, utilities of VGAM1585 include diagnosis, prevention and treatment of diseases and clinical conditions associated with GPR48. The function of GPR48 and its association with various diseases and clinical conditions, has been established by previous studies, as described hereinabove with reference to VGAM376. Pleiomorphic Adenoma Gene 1 (PLAG1, Accession NM_002655) is another VGAM1585 host target gene. PLAG1 BINDING SITE is HOST TARGET binding site found in the 3' untranslated region of mRNA encoded by PLAG1, corresponding to a HOST TARGET binding site such as BINDING SITE I, BINDING SITE II or BINDING SITE III. Table 2 illustrates the complementarity of the nucleotide sequences of PLAG1 BINDING SITE, designated SEQ ID:8525, to the nucleotide sequence of VGAM1585 RNA, herein designated VGAM RNA, also designated SEQ ID:4296.

Another function of VGAM1585 is therefore inhibition of Pleiomorphic Adenoma Gene 1 (PLAG1, Accession NM_002655), a gene which contains a zinc finger domain. Accordingly, utilities of VGAM1585 include diagnosis, prevention and treatment of diseases and clinical conditions associated with PLAG1. The function of PLAG1 and its association with various diseases and clinical conditions, has been established by previous studies, as described hereinabove with reference to VGAM29. Deiodinase, Iodothyronine, Type II (DIO2, Accession NM_000793) is another VGAM1585 host target gene. DIO2 BINDING SITE1 and DIO2 BINDING SITE2 are HOST TARGET binding sites found in untranslated regions of mRNA encoded by DIO2, corresponding to HOST TARGET binding sites such as BINDING SITE I, BINDING SITE II or BINDING SITE III. Table 2 illustrates the complementarity of the nucleotide sequences of DIO2 BINDING SITE1 and DIO2 BINDING SITE2, designated SEQ ID:6459 and SEQ ID:15170 respectively, to the nucleotide sequence of VGAM1585 RNA, herein designated VGAM RNA, also designated SEQ ID:4296.

Another function of VGAM1585 is therefore inhibition of Deiodinase, Iodothyronine, Type II (DIO2, Accession NM_000793). Accordingly, utilities of VGAM1585 include diagnosis, prevention and treatment of diseases and clinical conditions associated with DIO2. Solute Carrier Family 7, (cationic amino acid transporter, y+ system) Member 11 (SLC7A11, Accession NM_014331) is another VGAM1585 host target gene. SLC7A11 BINDING SITE is HOST TARGET binding site found in the 3" untranslated region of mRNA encoded by SLC7A11, corresponding to a HOST TARGET binding site such as BINDING SITE I, BINDING SITE II or BINDING SITE III. Table 2 illustrates the complementarity of the nucleotide sequences of SLC7A11 BINDING SITE, designated SEQ ID:15646, to the nucleotide sequence of VGAM1585 RNA, herein designated VGAM RNA, also designated SEQ ID:4296.

Another function of VGAM1585 is therefore inhibition of Solute Carrier Family 7, (cationic amino acid transporter, y+ system) Member 11 (SLC7A11, Accession NM_014331). Accordingly, utilities of VGAM1585 include diagnosis, prevention and treatment of diseases and clinical conditions associated with SLC7A11. SRY (sex determining region Y)-box 7 (SOX7, Accession NM_031439) is another VGAM1585 host target gene. SOX7 BINDING SITE is HOST TARGET binding site found in the 3' untranslated region of mRNA encoded by SOX7, corresponding to a HOST TARGET binding site such as BINDING SITE I, BINDING SITE II or BINDING SITE III. Table 2 illustrates the complementarity of the nucleotide sequences of SOX7 BINDING SITE, designated SEQ ID:25450, to the nucleotide sequence of VGAM1585 RNA, herein designated VGAM RNA, also designated SEQ ID:4296.

Another function of VGAM1585 is therefore inhibition of SRY (sex determining region Y)-box 7 (SOX7, Accession NM_031439). Accordingly, utilities of VGAM1585 include diagnosis, prevention and treatment of diseases and clinical conditions associated with SOX7. LOC158629 (Accession XM_098972) is another VGAM1585 host target gene. LOC158629 BINDING SITE is HOST TARGET binding site found in the 5' untranslated region of mRNA encoded by LOC158629, corresponding to a HOST TARGET binding site such as BINDING SITE I, BINDING SITE II or BINDING SITE III. Table 2 illustrates the complementarity of the nucleotide sequences of LOC158629 BINDING SITE, designated SEQ ID:42017, to the nucleotide sequence of VGAM1585 RNA, herein designated VGAM RNA, also designated SEQ ID:4296.

Another function of VGAM1585 is therefore inhibition of LOC158629 (Accession XM_098972). Accordingly, utilities of VGAM1585 include diagnosis, prevention and treatment of diseases and clinical conditions associated with LOC158629. LOC168512 (Accession XM_095148) is another VGAM1585 host target gene. LOC168512 BINDING SITE is HOST TARGET binding site found in the 5' untranslated region of mRNA encoded by LOC168512, corresponding to a HOST TARGET binding site such as BINDING SITE I, BINDING SITE II or BINDING SITE III. Table 2 illustrates the complementarity of the nucleotide sequences of LOC168512 BINDING SITE, designated SEQ ID:40252, to the nucleotide sequence of VGAM1585 RNA, herein designated VGAM RNA, also designated SEQ ID:4296.

Another function of VGAM1585 is therefore inhibition of LOC168512 (Accession XM_095148). Accordingly, utilities of VGAM1585 include diagnosis, prevention and treatment of diseases and clinical conditions associated with LOC168512. LOC51205 (Accession NM_016361) is another VGAM1585 host target gene. LOC51205 BINDING SITE is HOST TARGET binding site found in the 5' untranslated region of mRNA encoded by LOC51205, corresponding to a HOST TARGET binding site such as BINDING SITE I, BINDING SITE II or BINDING SITE III. Table 2 illustrates the complementarity of the nucleotide sequences of LOC51205 BINDING SITE, designated SEQ ID:18501, to the nucleotide sequence of VGAM1585 RNA, herein designated VGAM RNA, also designated SEQ ID:4296.

Another function of VGAM1585 is therefore inhibition of LOC51205 (Accession NM_016361). Accordingly, utilities of VGAM1585 include diagnosis, prevention and treatment of diseases and clinical conditions associated with LOC51205. FIG. 1 further provides a conceptual description of a novel bioinformatically detected viral gene of the present invention, referred to here as Viral Genomic Address Messenger 1586 (VGAM1586) viral gene, which modulates expression of respective host target genes thereof, the function and utility of which host target genes is known in the art.

VGAM1586 is a novel bioinformatically detected regulatory, non protein coding, viral micro RNA (miRNA) gene. The method by which VGAM1586 was detected is described hereinabove with reference to FIGS. 1-8.

VGAM1586 gene, herein designated VGAM GENE, is a viral gene contained in the genome of Saimiriine Herpesvirus 2. VGAM1586 host target gene, herein designated VGAM HOST TARGET GENE, is a human gene contained in the human genome.

VGAM1586 gene encodes a VGAM1586 precursor RNA, herein designated VGAM PRECURSOR RNA. Similar to other miRNA genes, and unlike most ordinary genes, VGAM1586 precursor RNA does not encode a protein. A nucleotide sequence identical or highly similar to the nucleotide sequence of VGAM1586 precursor RNA is designated SEQ ID:1572, and is provided hereinbelow with reference to the sequence listing part. Nucleotide sequence SEQ ID:1572 is located at position 86610 relative to the genome of Saimiriine Herpesvirus 2.

VGAM1586 precursor RNA folds onto itself, forming VGAM1586 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1586 folded precursor RNA into VGAM1586 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM1586 RNA is designated SEQ ID:4297, and is provided hereinbelow with reference to the sequence listing part.

VGAM1586 host target gene, herein designated VGAM HOST TARGET GENE, encodes a corresponding messenger RNA, VGAM1586 host target RNA, herein designated VGAM HOST TARGET RNA. VGAM1586 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1586 RNA, herein designated VGAM RNA, binds complementarily to one or more host target binding sites located in untranslated regions of VGAM1586 host target RNA, herein designated VGAM HOST TARGET RNA. This complementary binding is due to the fact that the nucleotide sequence of VGAM1586 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1586 RNA, herein designated VGAM RNA, may have a different number of host target binding sites in untranslated regions of a VGAM1586 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1586 RNA, herein designated VGAM RNA, to host target binding sites on VGAM1586 host target RNA, herein designated VGAM HOST TARGET RNA, such as BINDING SITE I, BINDING SITE II and BINDING SITE III, inhibits translation of VGAM1586 host target RNA into VGAM1586 host target protein, herein designated VGAM HOST TARGET PROTEIN. VGAM host target protein is therefore outlined by a broken line.

It is appreciated that VGAM1586 host target gene, herein designated VGAM HOST TARGET GENE, in fact represents a plurality of VGAM1586 host target genes. The mRNA of each one of this plurality of VGAM1586 host target genes comprises one or more host target binding sites, each having a nucleotide sequence which is at least partly complementary to VGAM1586 RNA, herein designated VGAM RNA, and which when bound by VGAM1586 RNA causes inhibition of translation of respective one or more VGAM1586 host target proteins.

It is further appreciated by one skilled in the art that the mode of translational inhibition illustrated by FIG. 1 with specific reference to translational inhibition exerted by VGAM1586 gene, herein designated VGAM GENE, on one or more VGAM1586 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1586 is inhibition of expression of host target genes, as part of a novel viral mechanism of attacking a host. Accordingly, utilities of VGAM1586 include diagnosis, prevention and treatment of viral infection by Saimiriine Herpesvirus 2. Specific functions, and accordingly utilities, of VGAM1586 correlate with, and may be deduced from, the identity of the host target genes which VGAM1586 binds and inhibits, and the function of these host target genes, as elaborated hereinbelow.

Nucleotide sequences of the VGAM1586 precursor RNA, herein designated VGAM PRECURSOR RNA, and of the 'diced' VGAM1586 RNA, herein designated VGAM RNA, and a schematic representation of the secondary folding of VGAM1586 folded precursor RNA, herein designated VGAM FOLDED PRECURSOR RNA, of VGAM1586 are further described hereinbelow with reference to Table 1.

Nucleotide sequences of host target binding sites, such as BINDING SITE-I, BINDING SITE-II and BINDING SITE-III of FIG. 1, found on VGAM1586 host target RNA, and schematic representation of the complementarity of each of these host target binding sites to VGAM1586 RNA, herein designated VGAM RNA, are described hereinbelow with reference to Table 2.

As mentioned hereinabove with reference to FIG. 1, a function of VGAM1586 gene, herein designated VGAM is inhibition of expression of VGAM1586 target genes. It is appreciated that specific functions, and accordingly utilities, of VGAM1586 correlate with, and may be deduced from, the identity of the target genes which VGAM1586 binds and inhibits, and the function of these target genes, as elaborated hereinbelow.

Guanine Nucleotide Binding Protein (G protein), Gamma Transducing Activity Polypeptide 2 (GNGT2, Accession NM_031498) is a VGAM1586 host target gene. GNGT2 BINDING SITE is HOST TARGET binding site found in the 5' untranslated region of mRNA encoded by GNGT2, corresponding to a HOST TARGET binding site such as BINDING SITE I, BINDING SITE II or BINDING SITE III. Table 2 illustrates the complementarity of the nucleotide sequences of GNGT2 BINDING SITE, designated SEQ ID:25578, to the nucleotide sequence of VGAM1586 RNA, herein designated VGAM RNA, also designated SEQ ID:4297.

A function of VGAM1586 is therefore inhibition of Guanine Nucleotide Binding Protein (G protein), Gamma Transducing Activity Polypeptide 2 (GNGT2, Accession NM_031498), a gene which is involved as a modulator or transducer in various transmembrane signaling systems. Accordingly, utilities of VGAM1586 include diagnosis, prevention and treatment of diseases and clinical conditions associated with GNGT2. The function of GNGT2 has been established by previous studies. Phototransduction in the vertebrate rod and cone photoreceptors is regulated by structurally homologous but distinct groups of signaling proteins.

Ong et al. (1995) identified in bovine retinas a cone-specific G protein gamma subunit, G-gamma-c (previously named G-gamma-8), which may play a key role in coupling the cone visual pigment to phosphodiesterase. Ong et al. (1997) characterized the human homolog, which was found to share a high degree of sequence identity with the corresponding bovine isoform (85%) and human rod G-gamma-1 (63%). The protein is specifically localized in cones, as indicated by immunohistochemical staining. Nucleotide sequence analysis of the gene, designated GNGT2, showed a structure consisting of 3 exons and 2 introns, with the intron splice sites similar to those of the rod G-gamma-1 gene (GNGT1; 189970). By FISH, Ong et al. (1997) localized the GNGT2 gene to 17q21.

Full details of the abovementioned studies are described in the following publications, the disclosure of which are hereby incorporated by reference:

Ong, O. C.; Hu, K.; Rong, H.; Lee, R. H.; Fung, B. K.-K.: Gene structure and chromosome localization of the G-gamma-c subunit of human cone G-protein (GNGT2). Genomics 44:101-109, 1997; and Ong, O. C.; Yamane, H. K.; Phan, K. B.; Fong, H. K.; Bok, D.; Lee, R. H.; Fung, B. K.-K.: Molecular cloning and characterization of the G protein gamma subunit of cone photoreceptors.

Further studies establishing the function and utilities of GNGT2 are found in John Hopkins OMIM database record ID 603655, and in sited publications numbered 5859-5860 listed in the bibliography section hereinbelow, which are also hereby incorporated by reference. Golgi Complex Associated Protein 1, 60 kDa (GOCAP1, Accession NM_022735) is another VGAM1586 host target gene. GOCAP1 BINDING SITE is HOST TARGET binding site found in the 3' untranslated region of mRNA encoded by GOCAP1, corresponding to a HOST TARGET binding site such as BINDING SITE I, BINDING SITE II or BINDING SITE III. Table 2 illustrates the complementarity of the nucleotide sequences of GOCAP1 BINDING SITE, designated SEQ ID:22937, to the nucleotide sequence of VGAM1586 RNA, herein designated VGAM RNA, also designated SEQ ID:4297.

Another function of VGAM1586 is therefore inhibition of Golgi Complex Associated Protein 1, 60 kDa (GOCAP1, Accession NM_022735). Accordingly, utilities of VGAM1586 include diagnosis, prevention and treatment of diseases and clinical conditions associated with GOCAP1. LIM Domains Containing 1 (LIMD1, Accession NM_014240) is another VGAM1586 host target gene. LIMD1 BINDING SITE is HOST TARGET binding site found in the 3' untranslated region of mRNA encoded by LIMD1, corresponding to a HOST TARGET binding site such as BINDING SITE I, BINDING SITE II or BINDING SITE III. Table 2 illustrates the complementarity of the nucleotide sequences of LIMD1 BINDING SITE, designated SEQ ID:15498, to the nucleotide sequence of VGAM1586 RNA, herein designated VGAM RNA, also designated SEQ ID:4297.

Another function of VGAM1586 is therefore inhibition of LIM Domains Containing 1 (LIMD1, Accession NM_014240). Accordingly, utilities of VGAM1586 include diagnosis, prevention and treatment of diseases and clinical conditions associated with LIMD1. Neuregulin 1 (NRG1, Accession NM_013959) is another VGAM1586 host target gene. NRG1 BINDING SITE is HOST TARGET binding site found in the 5' untranslated region of mRNA encoded by NRG1, corresponding to a HOST TARGET binding site such as BINDING SITE I, BINDING SITE II or BINDING SITE III. Table 2 illustrates the complementarity of the nucleotide sequences of NRG1 BINDING SITE, designated SEQ ID:15139, to the nucleotide sequence of VGAM1586 RNA, herein designated VGAM RNA, also designated SEQ ID:4297.

Another function of VGAM1586 is therefore inhibition of Neuregulin 1 (NRG1, Accession NM_013959), a gene which is essential for neuronal development. Accordingly, utilities of VGAM1586 include diagnosis, prevention and treatment of diseases and clinical conditions associated with NRG1. The function of NRG1 and its association with various diseases and clinical conditions, has been established by previous studies, as described hereinabove with reference to VGAM1259. ADMP (Accession NM_145035) is another VGAM1586 host target gene. ADMP BINDING SITE is HOST TARGET binding site found in the 3' untranslated region of mRNA encoded by ADMP, corresponding to a HOST TARGET binding site such as BINDING SITE I, BINDING SITE II or BINDING SITE III. Table 2 illustrates the complementarity of the nucleotide sequences of ADMP BINDING SITE, designated SEQ ID:29653, to the nucleotide sequence of VGAM1586 RNA, herein designated VGAM RNA, also designated SEQ ID:4297.

Another function of VGAM1586 is therefore inhibition of ADMP (Accession NM_145035). Accordingly, utilities of VGAM1586 include diagnosis, prevention and treatment of diseases and clinical conditions associated with ADMP. BM045 (Accession XM_085509) is another VGAM1586 host target gene. BM045 BINDING SITE is HOST TARGET binding site found in the 5' untranslated region of mRNA encoded by BM045, corresponding to a HOST TARGET binding site such as BINDING SITE I, BINDING SITE II or BINDING SITE III. Table 2 illustrates the complementarity of the nucleotide sequences of BM045 BINDING SITE, designated SEQ ID:38214, to the nucleotide sequence of VGAM1586 RNA, herein designated VGAM RNA, also designated SEQ ID:4297.

Another function of VGAM1586 is therefore inhibition of BM045 (Accession XM_085509). Accordingly, utilities of VGAM1586 include diagnosis, prevention and treatment of diseases and clinical conditions associated with BM045. Chromosome 1 Open Reading Frame 24 (C1orf24, Accession NM_052966) is another VGAM1586 host target gene. C1orf24 BINDING SITE is HOST TARGET binding site found in the 3' untranslated region of mRNA encoded by C1orf24, corresponding to a HOST TARGET binding site such as BINDING SITE I, BINDING SITE II or BINDING SITE III. Table 2 illustrates the complementarity of the nucleotide sequences of C1orf24 BINDING SITE, designated SEQ ID:27526, to the nucleotide sequence of VGAM1586 RNA, herein designated VGAM RNA, also designated SEQ ID:4297.

Another function of VGAM1586 is therefore inhibition of Chromosome 1 Open Reading Frame 24 (C1orf24, Accession NM_052966). Accordingly, utilities of VGAM1586 include diagnosis, prevention and treatment of diseases and clinical conditions associated with C1orf24. FLJ20093 (Accession NM_017664) is another VGAM1586 host target gene. FLJ20093 BINDING SITE is HOST TARGET binding site found in the 3' untranslated region of mRNA encoded by FLJ20093, corresponding to a HOST TARGET binding site such as BINDING SITE I, BINDING SITE II or BINDING SITE III. Table 2 illustrates the complementarity of the nucleotide sequences of FLJ20093 BINDING SITE, designated SEQ ID:19204, to the nucleotide sequence of VGAM1586 RNA, herein designated VGAM RNA, also designated SEQ ID:4297.

Another function of VGAM1586 is therefore inhibition of FLJ20093 (Accession NM_017664). Accordingly, utilities of VGAM1586 include diagnosis, prevention and treatment of diseases and clinical conditions associated with FLJ20093. FLJ22037 (Accession XM_168215) is another VGAM1586 host target gene. FLJ22037 BINDING SITE is HOST TARGET binding site found in the 5' untranslated region of mRNA encoded by FLJ22037, corresponding to a HOST TARGET binding site such as BINDING SITE I, BINDING SITE II or BINDING SITE III. Table 2 illustrates the complementarity of the nucleotide sequences of FLJ22037 BINDING SITE, designated SEQ ID:45074, to the nucleotide sequence of VGAM1586 RNA, herein designated VGAM RNA, also designated SEQ ID:4297.

Another function of VGAM1586 is therefore inhibition of FLJ22037 (Accession XM_168215). Accordingly, utilities of VGAM1586 include diagnosis, prevention and treatment of diseases and clinical conditions associated with FLJ22037. KIAA0564 (Accession XM_038664) is another VGAM1586 host target gene. KIAA0564 BINDING SITE is HOST TARGET binding site found in the 3' untranslated region of mRNA encoded by KIAA0564, corresponding to a HOST TARGET binding site such as BINDING SITE I, BINDING SITE II or BINDING SITE III. Table 2 illustrates the complementarity of the nucleotide sequences of KIAA0564 BINDING SITE, designated SEQ ID:32899, to the nucleotide sequence of VGAM1586 RNA, herein designated VGAM RNA, also designated SEQ ID:4297.

Another function of VGAM1586 is therefore inhibition of KIAA0564 (Accession XM_038664). Accordingly, utilities of VGAM1586 include diagnosis, prevention and treatment of diseases and clinical conditions associated with KIAA0564. KIAA0694 (Accession XM_051970) is another VGAM1586 host target gene. KIAA0694 BINDING SITE is HOST TARGET binding site found in the 3' untranslated region of mRNA encoded by KIAA0694, corresponding to a HOST TARGET binding site such as BINDING SITE I, BINDING SITE II or BINDING SITE III. Table 2 illustrates the complementarity of the nucleotide sequences of KIAA0694 BINDING SITE, designated SEQ ID:35929, to the nucleotide sequence of VGAM1586 RNA, herein designated VGAM RNA, also designated SEQ ID:4297.

Another function of VGAM1586 is therefore inhibition of KIAA0694 (Accession XM_051970). Accordingly, utilities of VGAM1586 include diagnosis, prevention and treatment of diseases and clinical conditions associated with KIAA0694. P15-2 (Accession NM_018698) is another VGAM1586 host target gene. P15-2 BINDING SITE is HOST TARGET binding site found in the 3' untranslated region of mRNA encoded by P15-2, corresponding to a HOST TARGET binding site such as BINDING SITE I, BINDING SITE II or BINDING SITE III. Table 2 illustrates the complementarity of the nucleotide sequences of P15-2 BINDING SITE, designated SEQ ID:20781, to the nucleotide sequence of VGAM1586 RNA, herein designated VGAM RNA, also designated SEQ ID:4297.

Another function of VGAM1586 is therefore inhibition of P15-2 (Accession NM_018698). Accordingly, utilities of VGAM1586 include diagnosis, prevention and treatment of diseases and clinical conditions associated with P15-2. Phytoceramidase, Alkaline (PHCA, Accession NM_018367) is another VGAM1586 host target gene. PHCA BINDING SITE is HOST TARGET binding site found in the 3' untranslated region of mRNA encoded by PHCA, corresponding to a HOST TARGET binding site such as BINDING SITE I, BINDING SITE II or BINDING SITE III. Table 2 illustrates the complementarity of the nucleotide sequences of PHCA BINDING SITE, designated SEQ ID:20375, to the nucleotide sequence of VGAM1586 RNA, herein designated VGAM RNA, also designated SEQ ID:4297.

Another function of VGAM1586 is therefore inhibition of Phytoceramidase, Alkaline (PHCA, Accession NM_018367). Accordingly, utilities of VGAM1586 include diagnosis, prevention and treatment of diseases and clinical conditions associated with PHCA. LOC196549 (Accession NM_145293) is another VGAM1586 host target gene. LOC196549 BINDING SITE is HOST TARGET binding site found in the 5' untranslated region of mRNA encoded by LOC196549, corresponding to a HOST TARGET binding site such as BINDING SITE I, BINDING SITE II or BINDING SITE III. Table 2 illustrates the complementarity of the nucleotide sequences of LOC196549 BINDING SITE, designated SEQ ID:29807, to the nucleotide sequence of VGAM1586 RNA, herein designated VGAM RNA, also designated SEQ ID:4297.

Another function of VGAM1586 is therefore inhibition of LOC196549 (Accession NM_145293). Accordingly, utilities of VGAM1586 include diagnosis, prevention and treatment of diseases and clinical conditions associated with LOC196549. LOC221477 (Accession XM_166397) is another VGAM1586 host target gene. LOC221477 BINDING SITE is HOST TARGET binding site found in the 5' untranslated region of mRNA encoded by LOC221477, corresponding to a HOST TARGET binding site such as BINDING SITE I, BINDING SITE II or BINDING SITE III. Table 2 illustrates the complementarity of the nucleotide sequences of LOC221477 BINDING SITE, designated SEQ ID:44248, to the nucleotide sequence of VGAM1586 RNA, herein designated VGAM RNA, also designated SEQ ID:4297.

Another function of VGAM1586 is therefore inhibition of LOC221477 (Accession XM_166397). Accordingly, utilities of VGAM1586 include diagnosis, prevention and treatment of diseases and clinical conditions associated with LOC221477. LOC257017 (Accession XM_173227) is another VGAM1586 host target gene. LOC257017 BINDING SITE is HOST TARGET binding site found in the 5' untranslated region of mRNA encoded by LOC257017, corresponding to a HOST TARGET binding site such as BINDING SITE I, BINDING SITE II or BINDING SITE III. Table 2 illustrates the complementarity of the nucleotide sequences of LOC257017 BINDING SITE, designated SEQ ID:46490, to the nucleotide sequence of VGAM1586 RNA, herein designated VGAM RNA, also designated SEQ ID:4297.

Another function of VGAM1586 is therefore inhibition of LOC257017 (Accession XM_173227). Accordingly, utilities of VGAM1586 include diagnosis, prevention and treatment of diseases and clinical conditions associated with LOC257017. LOC257117 (Accession XM_171238) is another VGAM1586 host target gene. LOC257117 BINDING SITE is HOST TARGET binding site found in the 5' untranslated region of mRNA encoded by LOC257117, corresponding to a HOST TARGET binding site such as BINDING SITE I, BINDING SITE II or BINDING SITE III. Table 2 illustrates the complementarity of the nucleotide sequences of LOC257117 BINDING SITE, designated SEQ ID:46024, to the nucleotide sequence of VGAM1586 RNA, herein designated VGAM RNA, also designated SEQ ID:4297.

Another function of VGAM1586 is therefore inhibition of LOC257117 (Accession XM_171238). Accordingly, utilities of VGAM1586 include diagnosis, prevention and treatment of diseases and clinical conditions associated with LOC257117. LOC92973 (Accession XM_048529) is another VGAM1586 host target gene. LOC92973 BINDING SITE is HOST TARGET binding site found in the 5' untranslated region of mRNA encoded by LOC92973, corresponding to a HOST TARGET binding site such as BINDING SITE I, BINDING SITE II or BINDING SITE III. Table 2 illustrates the complementarity of the nucleotide sequences of LOC92973 BINDING SITE, designated SEQ ID:35181, to the nucleotide sequence of VGAM1586 RNA, herein designated VGAM RNA, also designated SEQ ID:4297.

Another function of VGAM1586 is therefore inhibition of LOC92973 (Accession XM_048529). Accordingly, utilities of VGAM1586 include diagnosis, prevention and treatment of diseases and clinical conditions associated with LOC92973. LOC93550 (Accession XM_051999) is another VGAM1586 host target gene. LOC93550 BINDING SITE is HOST TARGET binding site found in the 5' untranslated region of mRNA encoded by LOC93550, corresponding to a HOST TARGET binding site such as BINDING SITE I, BINDING SITE II or BINDING SITE III. Table 2 illustrates the complementarity of the nucleotide sequences of LOC93550 BINDING SITE, designated SEQ ID:35931, to the nucleotide sequence of VGAM1586 RNA, herein designated VGAM RNA, also designated SEQ ID:4297.

Another function of VGAM1586 is therefore inhibition of LOC93550 (Accession XM_051999). Accordingly, utilities of VGAM1586 include diagnosis, prevention and treatment of diseases and clinical conditions associated with LOC93550. FIG. 1 further provides a conceptual description of a novel bioinformatically detected viral gene of the present invention, referred to here as Viral Genomic Address Messenger 1587 (VGAM1587) viral gene, which modulates expression of respective host target genes thereof, the function and utility of which host target genes is known in the art.

VGAM1587 is a novel bioinformatically detected regulatory, non protein coding, viral micro RNA (miRNA) gene. The method by which VGAM1587 was detected is described hereinabove with reference to FIGS. 1-8.

VGAM1587 gene, herein designated VGAM GENE, is a viral gene contained in the genome of Saimiriine Herpesvirus 2. VGAM1587 host target gene, herein designated VGAM HOST TARGET GENE, is a human gene contained in the human genome.

VGAM1587 gene encodes a VGAM1587 precursor RNA, herein designated VGAM PRECURSOR RNA. Similar to other miRNA genes, and unlike most ordinary genes, VGAM1587 precursor RNA does not encode a protein. A nucleotide sequence identical or highly similar to the nucleotide sequence of VGAM1587 precursor RNA is designated SEQ ID:1573, and is provided hereinbelow with reference to the sequence listing part. Nucleotide sequence SEQ ID:1573 is located at position 93438 relative to the genome of Saimiriine Herpesvirus 2.

VGAM1587 precursor RNA folds onto itself, forming VGAM1587 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1587 folded precursor RNA into VGAM1587 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1587 RNA is designated SEQ ID:4298, and is provided hereinbelow with reference to the sequence listing part.

VGAM1587 host target gene, herein designated VGAM HOST TARGET GENE, encodes a corresponding messenger RNA, VGAM1587 host target RNA, herein designated VGAM HOST TARGET RNA. VGAM1587 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1587 RNA, herein designated VGAM RNA, binds complementarily to one or more host target binding sites located in untranslated regions of VGAM1587 host target RNA, herein designated VGAM HOST TARGET RNA. This complementary binding is due to the fact that the nucleotide sequence of VGAM1587 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1587 RNA, herein designated VGAM RNA, may have a different number of host target binding sites in untranslated regions of a VGAM1587 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1587 RNA, herein designated VGAM RNA, to host target binding sites on VGAM1587 host target RNA, herein designated VGAM HOST TARGET RNA, such as BINDING SITE I, BINDING SITE II and BINDING SITE III, inhibits translation of VGAM1587 host target RNA into VGAM1587 host target protein, herein designated VGAM HOST TARGET PROTEIN. VGAM host target protein is therefore outlined by a broken line.

It is appreciated that VGAM1587 host target gene, herein designated VGAM HOST TARGET GENE, in fact represents a plurality of VGAM1587 host target genes. The mRNA of each one of this plurality of VGAM1587 host target genes comprises one or more host target binding sites, each having a nucleotide sequence which is at least partly complementary to VGAM1587 RNA, herein designated VGAM RNA, and which when bound by VGAM1587 RNA causes inhibition of translation of respective one or more VGAM1587 host target proteins.

It is further appreciated by one skilled in the art that the mode of translational inhibition illustrated by FIG. 1 with specific reference to translational inhibition exerted by VGAM1587 gene, herein designated VGAM GENE, on one or more VGAM1587 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1587 is inhibition of expression of host target genes, as part of a novel viral mechanism of attacking a host. Accordingly, utilities of VGAM1587 include diagnosis, prevention and treatment of viral infection by Saimiriine Herpesvirus 2. Specific functions, and accordingly utilities, of VGAM1587 correlate with, and may be deduced from, the identity of the host target genes which VGAM1587 binds and inhibits, and the function of these host target genes, as elaborated hereinbelow.

Nucleotide sequences of the VGAM1587 precursor RNA, herein designated VGAM PRECURSOR RNA, and of the 'diced' VGAM1587 RNA, herein designated VGAM RNA, and a schematic representation of the secondary folding of VGAM1587 folded precursor RNA, herein designated VGAM FOLDED PRECURSOR RNA, of VGAM1587 are further described hereinbelow with reference to Table 1.

Nucleotide sequences of host target binding sites, such as BINDING SITE-I, BINDING SITE-II and BINDING SITE-III of FIG. 1, found on VGAM1587 host target RNA, and schematic representation of the complementarity of each of these host target binding sites to VGAM1587 RNA, herein designated VGAM RNA, are described hereinbelow with reference to Table 2.

As mentioned hereinabove with reference to FIG. 1, a function of VGAM1587 gene, herein designated VGAM is inhibition of expression of VGAM1587 target genes. It is appreciated that specific functions, and accordingly utilities, of VGAM1587 correlate with, and may be deduced from, the identity of the target genes which VGAM1587 binds and inhibits, and the function of these target genes, as elaborated hereinbelow.

Ceroid-lipofuscinosis, Neuronal 2, Late Infantile (Jansky-Bielschowsky disease) (CLN2, Accession NM_000391) is a VGAM1587 host target gene. CLN2 BINDING SITE is HOST TARGET binding site found in the 3' untranslated region of mRNA encoded by CLN2, corresponding to a HOST TARGET binding site such as BINDING SITE I, BINDING SITE II or BINDING SITE III. Table 2 illustrates the complementarity of the nucleotide sequences of CLN2 BINDING SITE, designated SEQ ID:5962, to the nucleotide sequence of VGAM1587 RNA, herein designated VGAM RNA, also designated SEQ ID:4298.

A function of VGAM1587 is therefore inhibition of Ceroid-lipofuscinosis, Neuronal 2, Late Infantile (Jansky-Bielschowsky disease) (CLN2, Accession NM_000391). Accordingly, utilities of VGAM1587 include diagnosis, prevention and treatment of diseases and clinical conditions associated with CLN2. Mannan-binding Lectin Serine Protease 1 (C4/C2 activating component of Ra-reactive factor) (MASP1, Accession NM_139125) is another VGAM1587 host target gene. MASP1 BINDING SITE is HOST TARGET binding site found in the 3' untranslated region of mRNA encoded by MASP1, corresponding to a HOST TARGET binding site such as BINDING SITE I, BINDING SITE II or BINDING SITE III. Table 2 illustrates the complementarity of the nucleotide sequences of MASP1 BINDING SITE, designated SEQ ID:29158, to the nucleotide sequence of VGAM1587 RNA, herein designated VGAM RNA, also designated SEQ ID:4298.

Another function of VGAM1587 is therefore inhibition of Mannan-binding Lectin Serine Protease 1 (C4/C2 activating component of Ra-reactive factor) (MASP1, Accession NM_139125), a gene which a complement-dependent bactericidal factor. Accordingly, utilities of VGAM1587 include diagnosis, prevention and treatment of diseases and clinical conditions associated with MASP1. The function of MASP1 and its association with various diseases and clinical conditions, has been established by previous studies, as described hereinabove with reference to VGAM566. RAS P21 Protein Activator (GTPase activating protein) 1 (RASA1, Accession NM_022650) is another VGAM1587 host target gene. RASA1 BINDING SITE is HOST TARGET binding site found in the 3' untranslated region of mRNA encoded by RASA1, corresponding to a HOST TARGET binding site such as BINDING SITE I, BINDING SITE II or BINDING SITE III. Table 2 illustrates the complementarity of the nucleotide sequences of RASA1 BINDING SITE, designated SEQ ID:22905, to the nucleotide sequence of VGAM1587 RNA, herein designated VGAM RNA, also designated SEQ ID:4298.

Another function of VGAM1587 is therefore inhibition of RAS P21 Protein Activator (GTPase activating protein) 1 (RASA1, Accession NM_022650), a gene which is involved in the control of cellular proliferation and differentiation. Accordingly, utilities of VGAM1587 include diagnosis, prevention and treatment of diseases and clinical conditions associated with RASA1. The function of RASA1 and its association with various diseases and clinical conditions, has been established by previous studies, as described hereinabove with reference to VGAM464. FXYD Domain Containing Ion Transport Regulator 3 (FXYD3, Accession NM_021910) is another VGAM1587 host target gene. FXYD3 BINDING SITE is HOST TARGET binding site found in the 5' untranslated region of mRNA encoded by FXYD3, corresponding to a HOST TARGET binding site such as BINDING SITE I, BINDING SITE II or BINDING SITE III. Table 2 illustrates the complementarity of the nucleotide sequences of FXYD3 BINDING SITE, designated SEQ ID:22434, to the nucleotide sequence of VGAM1587 RNA, herein designated VGAM RNA, also designated SEQ ID:4298.

Another function of VGAM1587 is therefore inhibition of FXYD Domain Containing Ion Transport Regulator 3 (FXYD3, Accession NM_021910). Accordingly, utilities of VGAM1587 include diagnosis, prevention and treatment of diseases and clinical conditions associated with FXYD3. KIAA0555 (Accession NM_014790) is another VGAM1587 host target gene. KIAA0555 BINDING SITE is HOST TARGET binding site found in the 3" untranslated region of mRNA encoded by KIAA0555, corresponding to a HOST TARGET binding site such as BINDING SITE I, BINDING SITE II or BINDING SITE III. Table 2 illustrates the complementarity of the nucleotide sequences of KIAA0555 BINDING SITE, designated SEQ ID:16680, to the nucleotide sequence of VGAM1587 RNA, herein designated VGAM RNA, also designated SEQ ID:4298.

Another function of VGAM1587 is therefore inhibition of KIAA0555 (Accession NM_014790). Accordingly, utilities of VGAM1587 include diagnosis, prevention and treatment of diseases and clinical conditions associated with KIAA0555. KIAA0738 (Accession NM_014719) is another VGAM1587 host target gene. KIAA0738 BINDING SITE is HOST TARGET binding site found in the 3' untranslated region of mRNA encoded by KIAA0738, corresponding to a HOST TARGET binding site such as BINDING SITE I, BINDING SITE II or BINDING SITE III. Table 2 illustrates the complementarity of the nucleotide sequences of KIAA0738 BINDING SITE, designated SEQ ID:16278, to the nucleotide sequence of VGAM1587 RNA, herein designated VGAM RNA, also designated SEQ ID:4298.

Another function of VGAM1587 is therefore inhibition of KIAA0738 (Accession NM_014719). Accordingly, utilities of VGAM1587 include diagnosis, prevention and treatment of diseases and clinical conditions associated with KIAA0738. PRO2086 (Accession NM_014111) is another VGAM1587 host target gene. PRO2086 BINDING SITE is HOST TARGET binding site found in the 5' untranslated region of mRNA encoded by PRO2086, corresponding to a HOST TARGET binding site such as BINDING SITE I, BINDING SITE II or BINDING SITE III. Table 2 illustrates the complementarity of the nucleotide sequences of PRO2086 BINDING SITE, designated SEQ ID:15345, to the nucleotide sequence of VGAM1587 RNA, herein designated VGAM RNA, also designated SEQ ID:4298.

Another function of VGAM1587 is therefore inhibition of PRO2086 (Accession NM_014111). Accordingly, utilities of VGAM1587 include diagnosis, prevention and treatment of diseases and clinical conditions associated with PRO2086. LOC253955 (Accession XM_170486) is another VGAM1587 host target gene. LOC253955 BINDING SITE is HOST TARGET binding site found in the 5' untranslated region of mRNA encoded by LOC253955, corresponding to a HOST TARGET binding site such as BINDING SITE I, BINDING SITE II or BINDING SITE III. Table 2 illustrates the complementarity of the nucleotide sequences of LOC253955 BINDING SITE, designated SEQ ID:45326, to the nucleotide sequence of VGAM1587 RNA, herein designated VGAM RNA, also designated SEQ ID:4298.

Another function of VGAM1587 is therefore inhibition of LOC253955 (Accession XM_170486). Accordingly, utilities of VGAM1587 include diagnosis, prevention and treatment of diseases and clinical conditions associated with LOC253955. LOC51696 (Accession NM_016217) is another VGAM1587 host target gene. LOC51696 BINDING SITE is HOST TARGET binding site found in the 3' untranslated region of mRNA encoded by LOC51696, corresponding to a HOST TARGET binding site such as BINDING SITE I, BINDING SITE II or BINDING SITE III. Table 2 illustrates the complementarity of the nucleotide sequences of LOC51696 BINDING SITE, designated SEQ ID:18307, to the nucleotide sequence of VGAM1587 RNA, herein designated VGAM RNA, also designated SEQ ID:4298.

Another function of VGAM1587 is therefore inhibition of LOC51696 (Accession NM_016217). Accordingly, utilities of VGAM1587 include diagnosis, prevention and treatment of diseases and clinical conditions associated with LOC51696. FIG. 1 further provides a conceptual description of a novel bioinformatically detected viral gene of the present invention, referred to here as Viral Genomic Address Messenger 1588 (VGAM1588) viral gene, which modulates expression of respective host target genes thereof, the function and utility of which host target genes is known in the art.

VGAM1588 is a novel bioinformatically detected regulatory, non protein coding, viral micro RNA (miRNA) gene. The method by which VGAM1588 was detected is described hereinabove with reference to FIGS. 1-8.

VGAM1588 gene, herein designated VGAM GENE, is a viral gene contained in the genome of Saimiriine Herpesvirus 2. VGAM1588 host target gene, herein designated VGAM HOST TARGET GENE, is a human gene contained in the human genome.

VGAM1588 gene encodes a VGAM1588 precursor RNA, herein designated VGAM PRECURSOR RNA. Similar to other miRNA genes, and unlike most ordinary genes, VGAM1588 precursor RNA does not encode a protein. A nucleotide sequence identical or highly similar to the nucleotide sequence of VGAM1588 precursor RNA is designated SEQ ID:1574, and is provided hereinbelow with reference to the sequence listing part. Nucleotide sequence SEQ ID:1574 is located at position 90393 relative to the genome of Saimiriine Herpesvirus 2.

VGAM1588 precursor RNA folds onto itself, forming VGAM1588 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1588 folded precursor RNA into VGAM1588 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1588 RNA is designated SEQ ID:4299, and is provided hereinbelow with reference to the sequence listing part.

VGAM1588 host target gene, herein designated VGAM HOST TARGET GENE, encodes a corresponding messenger RNA, VGAM1588 host target RNA, herein designated VGAM HOST TARGET RNA. VGAM1588 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1588 RNA, herein designated VGAM RNA, binds complementarily to one or more host target binding sites located in untranslated regions of VGAM1588 host target RNA, herein designated VGAM HOST TARGET RNA. This complementary binding is due to the fact that the nucleotide sequence of VGAM1588 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1588 RNA, herein designated VGAM RNA, may have a different number of host target binding sites in untranslated regions of a VGAM1588 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1588 RNA, herein designated VGAM RNA, to host target binding sites on VGAM1588 host target RNA, herein designated VGAM HOST TARGET RNA, such as BINDING SITE I, BINDING SITE II and BINDING SITE III, inhibits translation of VGAM1588 host target RNA into VGAM1588 host target protein, herein designated VGAM HOST TARGET PROTEIN. VGAM host target protein is therefore outlined by a broken line.

It is appreciated that VGAM1588 host target gene, herein designated VGAM HOST TARGET GENE, in fact represents a plurality of VGAM1588 host target genes. The mRNA of each one of this plurality of VGAM1588 host target genes comprises one or more host target binding sites, each having a nucleotide sequence which is at least partly complementary to VGAM1588 RNA, herein designated VGAM RNA, and which when bound by VGAM1588 RNA causes inhibition of translation of respective one or more VGAM1588 host target proteins.

It is further appreciated by one skilled in the art that the mode of translational inhibition illustrated by FIG. 1 with specific reference to translational inhibition exerted by a VGAM1588 gene, herein designated VGAM GENE, on one or more VGAM1588 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1588 is inhibition of expression of host target genes, as part of a novel viral mechanism of attacking a host. Accordingly, utilities of VGAM1588 include diagnosis, prevention and treatment of viral infection by Saimiriine Herpesvirus 2. Specific functions, and accordingly utilities, of VGAM1588 correlate with, and may be deduced from, the identity of the host target genes which VGAM1588 binds and inhibits, and the function of these host target genes, as elaborated hereinbelow.

Nucleotide sequences of the VGAM1588 precursor RNA, herein designated VGAM PRECURSOR RNA, and of the 'diced' VGAM1588 RNA, herein designated VGAM RNA, and a schematic representation of the secondary folding of VGAM1588 folded precursor RNA, herein designated VGAM FOLDED PRECURSOR RNA, of VGAM1588 are further described hereinbelow with reference to Table 1.

Nucleotide sequences of host target binding sites, such as BINDING SITE-I, BINDING SITE-II and BINDING SITE-III of FIG. 1, found on VGAM1588 host target RNA, and schematic representation of the complementarity of each of these host target binding sites to VGAM1588 RNA, herein designated VGAM RNA, are described hereinbelow with reference to Table 2.

As mentioned hereinabove with reference to FIG. 1, a function of VGAM1588 gene, herein designated VGAM is inhibition of expression of VGAM1588 target genes. It is appreciated that specific functions, and accordingly utilities, of VGAM1588 correlate with, and may be deduced from, the identity of the target genes which VGAM1588 binds and inhibits, and the function of these target genes, as elaborated hereinbelow.

Breast Cancer 1, Early Onset (BRCA1, Accession NM_007295) is a VGAM1588 host target gene. BRCA1 BINDING SITE1 through BRCA1 BINDING SITE10 are HOST TARGET binding sites found in untranslated regions of mRNA encoded by BRCA1, corresponding to HOST TARGET binding sites such as BINDING SITE I, BINDING SITE II or BINDING SITE III. Table 2 illustrates the complementarity of the nucleotide sequences of BRCA1 BINDING SITE1 through BRCA1 BINDING SITE10, designated SEQ ID:14169, SEQ ID:14175, SEQ ID:14181, SEQ ID:14188, SEQ ID:14194, SEQ ID:14200, SEQ ID:14208, SEQ ID:14214, SEQ ID:14220 and SEQ ID:14163 respectively, to the nucleotide sequence of VGAM1588 RNA, herein designated VGAM RNA, also designated SEQ ID:4299.

A function of VGAM1588 is therefore inhibition of Breast Cancer 1, Early Onset (BRCA1, Accession NM_007295). Accordingly, utilities of VGAM1588 include diagnosis, prevention and treatment of diseases and clinical conditions associated with BRCA1. Isoprenylcysteine Carboxyl Methyltransferase (ICMT, Accession NM_012405) is another VGAM1588 host target gene. ICMT BINDING SITE is HOST TARGET binding site found in the 3' untranslated region of mRNA encoded by ICMT, corresponding to a HOST TARGET binding site such as BINDING SITE I, BINDING SITE II or BINDING SITE III. Table 2 illustrates the complementarity of the nucleotide sequences of ICMT BINDING SITE, designated SEQ ID:14779, to the nucleotide sequence of VGAM1588 RNA, herein designated VGAM RNA, also designated SEQ ID:4299.

Another function of VGAM1588 is therefore inhibition of Isoprenylcysteine Carboxyl Methyltransferase (ICMT, Accession NM_012405). Accordingly, utilities of VGAM1588 include diagnosis, prevention and treatment of diseases and clinical conditions associated with ICMT. Interleukin 13 Receptor, Alpha 1 (IL13RA1, Accession NM_001560) is another VGAM1588 host target gene. IL13RA1 BINDING SITE is HOST TARGET binding site found in the 3' untranslated region of mRNA encoded by IL13RA1, corresponding to a HOST TARGET binding site such as BINDING SITE I, BINDING SITE II or BINDING SITE III. Table 2 illustrates the complementarity of the nucleotide sequences of IL13RA1 BINDING SITE, designated SEQ ID:7283, to the nucleotide sequence of VGAM1588 RNA, herein designated VGAM RNA, also designated SEQ ID:4299.

Another function of VGAM1588 is therefore inhibition of Interleukin 13 Receptor, Alpha 1 (IL13RA1, Accession NM_001560), a gene which binds il-13 with a low affinity. together with il-4r- alpha can form a functional receptor for il-13. Accordingly, utilities of VGAM1588 include diagnosis, prevention and treatment of diseases and clinical conditions associated with IL13RA1. The function of IL13RA1 and its association with various diseases and clinical conditions, has been established by previous studies, as described hereinabove with reference to VGAM144. IRTA2 (Accession NM_031281) is another VGAM1588 host target gene. IRTA2 BINDING SITE is HOST TARGET binding site found in the 3' untranslated region of mRNA encoded by IRTA2, corresponding to a HOST TARGET binding site such as BINDING SITE I, BINDING SITE II or BINDING SITE III. Table 2 illustrates the complementarity of the nucleotide sequences of IRTA2 BINDING SITE, designated SEQ ID:25296, to the nucleotide sequence of VGAM1588 RNA, herein designated VGAM RNA, also designated SEQ ID:4299.

Another function of VGAM1588 is therefore inhibition of IRTA2 (Accession NM_031281), a gene which binds to the fc region of immunoglobulins gamma low affinity receptor. Accordingly, utilities of VGAM1588 include diagnosis, prevention and treatment of diseases and clinical conditions associated with IRTA2. The function of IRTA2 and its association with various diseases and clinical conditions, has been established by previous studies, as described hereinabove with reference to VGAM206. Myosin Light Chain Kinase 2, Skeletal Muscle (MYLK2, Accession NM_033118) is another VGAM1588 host target gene. MYLK2 BINDING SITE is HOST TARGET binding site found in the 3' untranslated region of mRNA encoded by MYLK2, corresponding to a HOST TARGET binding site such as BINDING SITE I, BINDING SITE II or BINDING SITE III. Table 2 illustrates the complementarity of the nucleotide sequences of MYLK2 BINDING SITE, designated SEQ ID:26964, to the nucleotide sequence of VGAM1588 RNA, herein designated VGAM RNA, also designated SEQ ID:4299.

Another function of VGAM1588 is therefore inhibition of Myosin Light Chain Kinase 2, Skeletal Muscle (MYLK2, Accession NM_033118). Accordingly, utilities of VGAM1588 include diagnosis, prevention and treatment of diseases and clinical conditions associated with MYLK2. Neuropeptide Y Receptor Y1 (NPY1R, Accession NM_000909) is another VGAM1588 host target gene. NPY1R BINDING SITE is HOST TARGET binding site found in the 3' untranslated region of mRNA encoded by NPY1R, corresponding to a HOST TARGET binding site such as BINDING SITE I, BINDING SITE II or BINDING SITE III. Table 2 illustrates the complementarity of the nucleotide sequences of NPY1R BINDING SITE, designated SEQ ID:6607, to the nucleotide sequence of VGAM1588 RNA, herein designated VGAM RNA, also designated SEQ ID:4299.

Another function of VGAM1588 is therefore inhibition of Neuropeptide Y Receptor Y1 (NPY1R, Accession NM_000909), a gene which stimulates intracellular calcium flux and signals through an inhibitory G-protein. Accordingly, utilities of VGAM1588 include diagnosis, prevention and treatment of diseases and clinical conditions associated with NPY1R. The function of NPY1R has been established by previous studies. Neuropeptide Y (NPY; 162640) is one of the most abundant neuropeptides in the mammalian nervous system and exhibits a diverse range of important physiologic activities, including effects on psychomotor activity, food intake, regulation of central endocrine secretion, and potent vasoactive effects on the cardiovascular system. Two major subtypes of NPY (Y1 and Y2) have been defined by pharmacologic criteria. The NPY Y1 receptors have been identified in a variety of tissues, including brain, spleen, small intestine, kidney, testis, placenta, and aortic smooth muscle. The Y2 receptor is found mainly in the central nervous system. Herzog et al. (1992) reported cloning of a cDNA encoding a human NPY receptor which they confirmed to be a member of the G protein-coupled receptor superfamily. When expressed in Chinese hamster ovary (CHO) or human embryonic kidney cells, the receptor exhibited characteristic ligand specificity. In the kidney cell line, the receptor was coupled to a pertussis toxin-sensitive G protein that mediated the inhibition of cyclic AMP accumulation. In the CHO cell line, on the other hand, the receptor was coupled not to inhibition of adenylate cyclase but rather to the elevation of intracellular calcium. Thus the second messenger coupling of the NPY receptor was cell type specific, depending on the specific repertoire of G proteins and effector systems present in the cell type. Larhammar et al. (1992) independently cloned and characterized the neuropeptide Y receptor. Animal model experiments lend further support to the function of NPY1R. Naveilhan et al. (2001) generated mice deficient in NPY1R by targeted disruption. Npy1r -/- mice developed hyperalgesia to acute thermal, cutaneous, and visceral chemical pain, and exhibited mechanical hypersensitivity. Neuropathic pain was increased and the mice showed a complete absence of the pharmacologic analgesic effects of NPY. In the periphery, Y1 receptor activation was sufficient and required for substance P release and the subsequent development of neurogenic inflammation and plasma leakage. Naveilhan et al. (2001) concluded that the Y1 receptor is required for central physiologic and pharmacologic NPY-induced analgesia and that its activation is both sufficient and required for the release of substance P and initiation of neurogenic inflammation.

It is appreciated that the abovementioned animal model for NPY1R is acknowledged by those skilled in the art as a scientifically valid animal model, as can be further appreciated from the publications sited hereinbelow.

Full details of the abovementioned studies are described in the following publications, the disclosure of which are hereby incorporated by reference:

Herzog, H.; Hort, Y. J.; Ball, H. J.; Hayes, G.; Shine, J.; Selbie, L. A.: Cloned human neuropeptide Y receptor couples to two different second messenger systems. Proc. Nat. Acad. Sci. 89:5794-5798, 1992; and Naveilhan, P.; Hassani, H.; Lucas, G.; Blakeman, K. H.; Hao, J.-X.; Xu, X.-J.; Wiesenfeld-Hallin, Z.; Thoren, P.; Ernfors, P.: Reduced antinociception and plasma extravasation in mice.

Further studies establishing the function and utilities of NPY1R are found in John Hopkins OMIM database record ID 162641, and in sited publications numbered 3214-3219 listed in the bibliography section hereinbelow, which are also hereby incorporated by reference. RAB27A, Member RAS Oncogene Family (RAB27A, Accession NM_004580) is another VGAM1588 host target gene. RAB27A BINDING SITE is HOST TARGET binding site found in the 3' untranslated region of mRNA encoded by RAB27A, corresponding to a HOST TARGET binding site such as BINDING SITE I, BINDING SITE II or BINDING SITE III. Table 2 illustrates the complementarity of the nucleotide sequences of RAB27A BINDING SITE, designated SEQ ID:10928, to the nucleotide sequence of VGAM1588 RNA, herein designated VGAM RNA, also designated SEQ ID:4299.

Another function of VGAM1588 is therefore inhibition of RAB27A, Member RAS Oncogene Family (RAB27A, Accession NM_004580). Accordingly, utilities of VGAM1588 include diagnosis, prevention and treatment of diseases and clinical conditions associated with RAB27A. Sal-like 1 (Drosophila) (SALL1, Accession NM_002968) is another VGAM1588 host target gene. SALL1 BINDING SITE is HOST TARGET binding site found in the 3' untranslated region of mRNA encoded by SALL1, corresponding to a HOST TARGET binding site such as BINDING SITE I, BINDING SITE II or BINDING SITE III. Table 2 illustrates the complementarity of the nucleotide sequences of SALL1 BINDING SITE, designated SEQ ID:8877, to the nucleotide sequence of VGAM1588 RNA, herein designated VGAM RNA, also designated SEQ ID:4299.

Another function of VGAM1588 is therefore inhibition of Sal-like 1 (Drosophila) (SALL1, Accession NM_002968). Accordingly, utilities of VGAM1588 include diagnosis, prevention and treatment of diseases and clinical conditions associated with SALL1. Solute Carrier Family 1 (glial high affinity glutamate transporter), Member 3 (SLC1A3, Accession NM_004172) is another VGAM1588 host target gene. SLC1A3 BINDING SITE is HOST TARGET binding site found in the 5' untranslated region of mRNA encoded by SLC1A3, corresponding to a HOST TARGET binding site such as BINDING SITE I, BINDING SITE II or BINDING SITE III. Table 2 illustrates the complementarity of the nucleotide sequences of SLC1A3 BINDING SITE, designated SEQ ID:10382, to the nucleotide sequence of VGAM1588 RNA, herein designated VGAM RNA, also designated SEQ ID:4299.

Another function of VGAM1588 is therefore inhibition of Solute Carrier Family 1 (glial high affinity glutamate transporter), Member 3 (SLC1A3, Accession NM_004172), a gene which is a transporter molecule that regulates neurotransmitter concentrations at excitatory synapses of the mammalian cns. Accordingly, utilities of VGAM1588 include diagnosis, prevention and treatment of diseases and clinical conditions associated with SLC1A3. The function of SLC1A3 and its association with various diseases and clinical conditions, has been established by previous studies, as described hereinabove with reference to VGAM294. Zinc Finger Protein 134 (clone pHZ-15) (ZNF134, Accession NM_003435) is another VGAM1588 host target gene. ZNF134 BINDING SITE is HOST TARGET binding site found in the 5' untranslated region of mRNA encoded by ZNF134, corresponding to a HOST TARGET binding site such as BINDING SITE I, BINDING SITE II or BINDING SITE III. Table 2 illustrates the complementarity of the nucleotide sequences of ZNF134 BINDING SITE, designated SEQ ID:9487, to the nucleotide sequence of VGAM1588 RNA, herein designated VGAM RNA, also designated SEQ ID:4299.

Another function of VGAM1588 is therefore inhibition of Zinc Finger Protein 134 (clone pHZ-15) (ZNF134, Accession NM_003435). Accordingly, utilities of VGAM1588 include diagnosis, prevention and treatment of diseases and clinical conditions associated with ZNF134. DKFZP434D193 (Accession XM_114297) is another VGAM1588 host target gene. DKFZP434D193 BINDING SITE is HOST TARGET binding site found in the 3' untranslated region of mRNA encoded by DKFZP434D193, corresponding to a HOST TARGET binding site such as BINDING SITE I, BINDING SITE II or BINDING SITE III. Table 2 illustrates the complementarity of the nucleotide sequences of DKFZP434D193 BINDING SITE, designated SEQ ID:42850, to the nucleotide sequence of VGAM1588 RNA, herein designated VGAM RNA, also designated SEQ ID:4299.

Another function of VGAM1588 is therefore inhibition of DKFZP434D193 (Accession XM_114297). Accordingly, utilities of VGAM1588 include diagnosis, prevention and treatment of diseases and clinical conditions associated with DKFZP434D193. DKFZp547I224 (Accession NM_020221) is another VGAM1588 host target gene. DKFZp547I224 BINDING SITE is HOST TARGET binding site found in the 5' untranslated region of mRNA encoded by DKFZp547I224, corresponding to a HOST TARGET binding site such as BINDING SITE I, BINDING SITE II or BINDING SITE III. Table 2 illustrates the complementarity of the nucleotide sequences of DKFZp547I224 BINDING SITE, designated SEQ ID:21474, to the nucleotide sequence of VGAM1588 RNA, herein designated VGAM RNA, also designated SEQ ID:4299.

Another function of VGAM1588 is therefore inhibition of DKFZp547I224 (Accession NM_020221). Accordingly, utilities of VGAM1588 include diagnosis, prevention and treatment of diseases and clinical conditions associated with DKFZp547I224. FLJ20514 (Accession NM_017856) is another VGAM1588 host target gene. FLJ20514 BINDING SITE is HOST TARGET binding site found in the 3' untranslated region of mRNA encoded by FLJ20514, corresponding to a HOST TARGET binding site such as BINDING SITE I, BINDING SITE II or BINDING SITE III. Table 2 illustrates the complementarity of the nucleotide sequences of FLJ20514 BINDING SITE, designated SEQ ID:19534, to the nucleotide sequence of VGAM1588 RNA, herein designated VGAM RNA, also designated SEQ ID:4299.

Another function of VGAM1588 is therefore inhibition of FLJ20514 (Accession NM_017856). Accordingly, utilities of VGAM1588 include diagnosis, prevention and treatment of diseases and clinical conditions associated with FLJ20514. FLJ32332 (Accession NM_144641) is another VGAM1588 host target gene. FLJ32332 BINDING SITE is HOST TARGET binding site found in the 3' untranslated region of mRNA encoded by FLJ32332, corresponding to a HOST TARGET binding site such as BINDING SITE I, BINDING SITE II or BINDING SITE III. Table 2 illustrates the complementarity of the nucleotide sequences of FLJ32332 BINDING SITE, designated SEQ ID:29468, to the nucleotide sequence of VGAM1588 RNA, herein designated VGAM RNA, also designated SEQ ID:4299.

Another function of VGAM1588 is therefore inhibition of FLJ32332 (Accession NM_144641). Accordingly, utilities of VGAM1588 include diagnosis, prevention and treatment of diseases and clinical conditions associated with FLJ32332. KIAA1349 (Accession XM_047617) is another VGAM1588 host target gene. KIAA1349 BINDING SITE is HOST TARGET binding site found in the 3' untranslated region of mRNA encoded by KIAA1349, corresponding to a HOST TARGET binding site such as BINDING SITE I, BINDING SITE II or BINDING SITE III. Table 2 illustrates the complementarity of the nucleotide sequences of KIAA1349 BINDING SITE, designated SEQ ID:35013, to the nucleotide sequence of VGAM1588 RNA, herein designated VGAM RNA, also designated SEQ ID:4299.

Another function of VGAM1588 is therefore inhibition of KIAA1349 (Accession XM_047617). Accordingly, utilities of VGAM1588 include diagnosis, prevention and treatment of diseases and clinical conditions associated with KIAA1349. KIAA1918 (Accession XM_054951) is another VGAM1588 host target gene. KIAA1918 BINDING SITE is HOST TARGET binding site found in the 3' untranslated region of mRNA encoded by KIAA1918, corresponding to a HOST TARGET binding site such as BINDING SITE I, BINDING SITE II or BINDING SITE III. Table 2 illustrates the complementarity of the nucleotide sequences of KIAA1918 BINDING SITE, designated SEQ ID:36214, to the nucleotide sequence of VGAM1588 RNA, herein designated VGAM RNA, also designated SEQ ID:4299.

Another function of VGAM1588 is therefore inhibition of KIAA1918 (Accession XM_054951). Accordingly, utilities of VGAM1588 include diagnosis, prevention and treatment of diseases and clinical conditions associated with KIAA1918. Synaptotagmin-like 2 (SYTL2, Accession NM_032943) is another VGAM1588 host target gene. SYTL2 BINDING SITE1 and SYTL2 BINDING SITE2 are HOST TARGET binding sites found in untranslated regions of mRNA encoded by SYTL2, corresponding to HOST TARGET binding sites such as BINDING SITE I, BINDING SITE II or BINDING SITE III. Table 2 illustrates the complementarity of the nucleotide sequences of SYTL2 BINDING SITE1 and SYTL2 BINDING SITE2, designated SEQ ID:26758 and SEQ ID:26174 respectively, to the nucleotide sequence of VGAM1588 RNA, herein designated VGAM RNA, also designated SEQ ID:4299.

Another function of VGAM1588 is therefore inhibition of Synaptotagmin-like 2 (SYTL2, Accession NM_032943). Accordingly, utilities of VGAM1588 include diagnosis, prevention and treatment of diseases and clinical conditions associated with SYTL2. LOC125704 (Accession XM_058931) is another VGAM1588 host target gene. LOC125704 BINDING SITE is HOST TARGET binding site found in the 3' untranslated region of mRNA encoded by LOC125704, corresponding to a HOST TARGET binding site such as BINDING SITE I, BINDING SITE II or BINDING SITE III. Table 2 illustrates the complementarity of the nucleotide sequences of LOC125704 BINDING SITE, designated SEQ ID:36798, to the nucleotide sequence of VGAM1588 RNA, herein designated VGAM RNA, also designated SEQ ID:4299.

Another function of VGAM1588 is therefore inhibition of LOC125704 (Accession XM_058931). Accordingly, utilities of VGAM1588 include diagnosis, prevention and treatment of diseases and clinical conditions associated with LOC125704. LOC221738 (Accession XM_168097) is another VGAM1588 host target gene. LOC221738 BINDING SITE is HOST TARGET binding site found in the 5' untranslated region of mRNA encoded by LOC221738, corresponding to a HOST TARGET binding site such as BINDING SITE I, BINDING SITE II or BINDING SITE III. Table 2 illustrates the complementarity of the nucleotide sequences of LOC221738 BINDING SITE, designated SEQ ID:45028, to the nucleotide sequence of VGAM1588 RNA, herein designated VGAM RNA, also designated SEQ ID:4299.

Another function of VGAM1588 is therefore inhibition of LOC221738 (Accession XM_168097). Accordingly, utilities of VGAM1588 include diagnosis, prevention and treatment of diseases and clinical conditions associated with LOC221738. FIG. 1 further provides a conceptual description of a novel bioinformatically detected viral gene of the present invention, referred to here as Viral Genomic Address Messenger 1589 (VGAM1589) viral gene, which modulates expression of respective host target genes thereof, the function and utility of which host target genes is known in the art.

VGAM1589 is a novel bioinformatically detected regulatory, non protein coding, viral micro RNA (miRNA) gene. The method by which VGAM1589 was detected is described hereinabove with reference to FIGS. 1-8.

VGAM1589 gene, herein designated VGAM GENE, is a viral gene contained in the genome of Ateline Herpesvirus 3. VGAM1589 host target gene, herein designated VGAM HOST TARGET GENE, is a human gene contained in the human genome.

VGAM1589 gene encodes a VGAM1589 precursor RNA, herein designated VGAM PRECURSOR RNA. Similar to other miRNA genes, and unlike most ordinary genes, VGAM1589 precursor RNA does not encode a protein. A nucleotide sequence identical or highly similar to the nucleotide sequence of VGAM1589 precursor RNA is designated SEQ ID:1575, and is provided hereinbelow with reference to the sequence listing part. Nucleotide sequence SEQ ID:1575 is located at position 88982 relative to the genome of Ateline Herpesvirus 3.

VGAM1589 precursor RNA folds onto itself, forming VGAM1589 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1589 folded precursor RNA into VGAM1589 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM1589 RNA is designated SEQ ID:4300, and is provided hereinbelow with reference to the sequence listing part.

VGAM1589 host target gene, herein designated VGAM HOST TARGET GENE, encodes a corresponding messenger RNA, VGAM1589 host target RNA, herein designated VGAM HOST TARGET RNA. VGAM1589 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1589 RNA, herein designated VGAM RNA, binds complementarily to one or more host target binding sites located in untranslated regions of VGAM1589 host target RNA, herein designated VGAM HOST TARGET RNA. This complementary binding is due to the fact that the nucleotide sequence of VGAM1589 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1589 RNA, herein designated VGAM RNA, may have a different number of host target binding sites in untranslated regions of a VGAM1589 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1589 RNA, herein designated VGAM RNA, to host target binding sites on VGAM1589 host target RNA, herein designated VGAM HOST TARGET RNA, such as BINDING SITE I, BINDING SITE II and BINDING SITE III, inhibits translation of VGAM1589 host target RNA into VGAM1589 host target protein, herein designated VGAM HOST TARGET PROTEIN. VGAM host target protein is therefore outlined by a broken line.

It is appreciated that VGAM1589 host target gene, herein designated VGAM HOST TARGET GENE, in fact represents a plurality of VGAM1589 host target genes. The mRNA of each one of this plurality of VGAM1589 host target genes comprises one or more host target binding sites, each having a nucleotide sequence which is at least partly complementary to VGAM1589 RNA, herein designated VGAM RNA, and which when bound by VGAM1589 RNA causes inhibition of translation of respective one or more VGAM1589 host target proteins.

It is further appreciated by one skilled in the art that the mode of translational inhibition illustrated by FIG. 1 with specific reference to translational inhibition exerted by VGAM1589 gene, herein designated VGAM GENE, on one or more VGAM1589 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1589 is inhibition of expression of host target genes, as part of a novel viral mechanism of attacking a host. Accordingly, utilities of VGAM1589 include diagnosis, prevention and treatment of viral infection by Ateline Herpesvirus 3. Specific functions, and accordingly utilities, of VGAM1589 correlate with, and may be deduced from, the identity of the host target genes which VGAM1589 binds and inhibits, and the function of these host target genes, as elaborated hereinbelow.

Nucleotide sequences of the VGAM1589 precursor RNA, herein designated VGAM PRECURSOR RNA, and of the 'diced' VGAM1589 RNA, herein designated VGAM RNA, and a schematic representation of the secondary folding of VGAM1589 folded precursor RNA, herein designated VGAM FOLDED PRECURSOR RNA, of VGAM1589 are further described hereinbelow with reference to Table 1.

Nucleotide sequences of host target binding sites, such as BINDING SITE-I, BINDING SITE-II and BINDING SITE-III of FIG. 1, found on VGAM1589 host target RNA, and schematic representation of the complementarity of each of these host target binding sites to VGAM1589 RNA, herein designated VGAM RNA, are described hereinbelow with reference to Table 2.

As mentioned hereinabove with reference to FIG. 1, a function of VGAM1589 gene, herein designated VGAM is inhibition of expression of VGAM1589 target genes. It is appreciated that specific functions, and accordingly utilities, of VGAM1589 correlate with, and may be deduced from, the identity of the target genes which VGAM1589 binds and inhibits, and the function of these target genes, as elaborated hereinbelow.

Eukaryotic Translation Initiation Factor 1A (EIF1A, Accession XM_114147) is a VGAM1589 host target gene. EIF1A BINDING SITE is HOST TARGET binding site found in the 3' untranslated region of mRNA encoded by EIF1A, corresponding to a HOST TARGET binding site such as BINDING SITE I, BINDING SITE II or BINDING SITE III. Table 2 illustrates the complementarity of the nucleotide sequences of EIF1A BINDING SITE, designated SEQ ID:42715, to the nucleotide sequence of VGAM1589 RNA, herein designated VGAM RNA, also designated SEQ ID:4300.

A function of VGAM1589 is therefore inhibition of Eukaryotic Translation Initiation Factor 1A (EIF1A, Accession XM_114147), a gene which seems to be required for maximal rate of protein biosynthesis. Accordingly, utilities of VGAM1589 include diagnosis, prevention and treatment of diseases and clinical conditions associated with EIF1A. The function of EIF1A and its association with various diseases and clinical conditions, has been established by previous studies, as described hereinabove with reference to VGAM120. Lactate Dehydrogenase B (LDHB, Accession NM_002300) is another VGAM1589 host target gene. LDHB BINDING SITE is HOST TARGET binding site found in the 5' untranslated region of mRNA encoded by LDHB, corresponding to a HOST TARGET binding site such as BINDING SITE I, BINDING SITE II or BINDING SITE III. Table 2 illustrates the complementarity of the nucleotide sequences of LDHB BINDING SITE, designated SEQ ID:8084, to the nucleotide sequence of VGAM1589 RNA, herein designated VGAM RNA, also designated SEQ ID:4300.

Another function of VGAM1589 is therefore inhibition of Lactate Dehydrogenase B (LDHB, Accession NM_002300), a gene which causes dehydrogenation of lactate. Accordingly, utilities of VGAM1589 include diagnosis, prevention and treatment of diseases and clinical conditions associated with LDHB. The function of LDHB and its association with various diseases and clinical conditions, has been established by previous studies, as described hereinabove with reference to VGAM273. Neurobeachin (NBEA, Accession XM_170732) is another VGAM1589 host target gene. NBEA BINDING SITE is HOST TARGET binding site found in the 3" untranslated region of mRNA encoded by NBEA, corresponding to a HOST TARGET binding site such as BINDING SITE I, BINDING SITE II or BINDING SITE III. Table 2 illustrates the complementarity of the nucleotide sequences of NBEA BINDING SITE, designated SEQ ID:45492, to the nucleotide sequence of VGAM1589 RNA, herein designated VGAM RNA, also designated SEQ ID:4300.

Another function of VGAM1589 is therefore inhibition of Neurobeachin (NBEA, Accession XM_170732), a gene which may mediate protein-protein interactions. Accordingly, utilities of VGAM1589 include diagnosis, prevention and treatment of diseases and clinical conditions associated with NBEA. The function of NBEA and its association with various diseases and clinical conditions, has been established by previous studies, as described hereinabove with reference to VGAM459. Regenerating Islet-derived-like, Pancreatic Stone Protein-like, Pancreatic Thread Protein-like (rat) (REGL, Accession NM_006508) is another VGAM1589 host target gene. REGL BINDING SITE is HOST TARGET binding site found in the 3' untranslated region of mRNA encoded by REGL, corresponding to a HOST TARGET binding site such as BINDING SITE I, BINDING SITE II or BINDING SITE III. Table 2 illustrates the complementarity of the nucleotide sequences of REGL BINDING SITE, designated SEQ ID:13255, to the nucleotide sequence of VGAM1589 RNA, herein designated VGAM RNA, also designated SEQ ID:4300.

Another function of VGAM1589 is therefore inhibition of Regenerating Islet-derived-like, Pancreatic Stone Protein-like, Pancreatic Thread Protein-like (rat) (REGL, Accession NM_006508), a gene which is a member of REG family with unknown function. Accordingly, utilities of VGAM1589 include diagnosis, prevention and treatment of diseases and clinical conditions associated with REGL. The function of REGL and its association with various diseases and clinical conditions, has been established by previous studies, as described hereinabove with reference to VGAM200. FLJ21934 (Accession NM_024743) is another VGAM1589 host target gene. FLJ21934 BINDING SITE is HOST TARGET binding site found in the 3' untranslated region of mRNA encoded by FLJ21934, corresponding to a HOST TARGET binding site such as BINDING SITE I, BINDING SITE II or BINDING SITE III. Table 2 illustrates the complementarity of the nucleotide sequences of FLJ21934 BINDING SITE, designated SEQ ID:24079, to the nucleotide sequence of VGAM1589 RNA, herein designated VGAM RNA, also designated SEQ ID:4300.

Another function of VGAM1589 is therefore inhibition of FLJ21934 (Accession NM_024743). Accordingly, utilities of VGAM1589 include diagnosis, prevention and treatment of diseases and clinical conditions associated with FLJ21934. Tripartite Motif-containing 2 (TRIM2, Accession NM_015271) is another VGAM1589 host target gene. TRIM2 BINDING SITE is HOST TARGET binding site found in the 3' untranslated region of mRNA encoded by TRIM2, corresponding to a HOST TARGET binding site such as BINDING SITE I, BINDING SITE II or BINDING SITE III. Table 2 illustrates the complementarity of the nucleotide sequences of TRIM2 BINDING SITE, designated SEQ ID:17594, to the nucleotide sequence of VGAM1589 RNA, herein designated VGAM RNA, also designated SEQ ID:4300.

Another function of VGAM1589 is therefore inhibition of Tripartite Motif-containing 2 (TRIM2, Accession NM_015271). Accordingly, utilities of VGAM1589 include diagnosis, prevention and treatment of diseases and clinical conditions associated with TRIM2. FIG. 1 further provides a conceptual description of a novel bioinformatically detected viral gene of the present invention, referred to here as Viral Genomic Address Messenger 1590 (VGAM1590) viral gene, which modulates expression of respective host target genes thereof, the function and utility of which host target genes is known in the art.

VGAM1590 is a novel bioinformatically detected regulatory, non protein coding, viral micro RNA (miRNA) gene. The method by which VGAM1590 was detected is described hereinabove with reference to FIGS. 1-8.

VGAM1590 gene, herein designated VGAM GENE, is a viral gene contained in the genome of Ateline Herpesvirus 3. VGAM1590 host target gene, herein designated VGAM HOST TARGET GENE, is a human gene contained in the human genome.

VGAM1590 gene encodes a VGAM1590 precursor RNA, herein designated VGAM PRECURSOR RNA. Similar to other miRNA genes, and unlike most ordinary genes, VGAM1590 precursor RNA does not encode a protein. A nucleotide sequence identical or highly similar to the nucleotide sequence of VGAM1590 precursor RNA is designated SEQ ID:1576, and is provided hereinbelow with reference to the sequence listing part. Nucleotide sequence SEQ ID:1576 is located at position 91163 relative to the genome of Ateline Herpesvirus 3.

VGAM1590 precursor RNA folds onto itself, forming VGAM1590 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1590 folded precursor RNA into VGAM1590 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1590 RNA is designated SEQ ID:4301, and is provided hereinbelow with reference to the sequence listing part.

VGAM1590 host target gene, herein designated VGAM HOST TARGET GENE, encodes a corresponding messenger RNA, VGAM1590 host target RNA, herein designated VGAM HOST TARGET RNA. VGAM1590 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1590 RNA, herein designated VGAM RNA, binds complementarily to one or more host target binding sites located in untranslated regions of VGAM1590 host target RNA, herein designated VGAM HOST TARGET RNA. This complementary binding is due to the fact that the nucleotide sequence of VGAM1590 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1590 RNA, herein designated VGAM RNA, may have a different number of host target binding sites in untranslated regions of a VGAM1590 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1590 RNA, herein designated VGAM RNA, to host target binding sites on VGAM1590 host target RNA, herein designated VGAM HOST TARGET RNA, such as BINDING SITE I, BINDING SITE II and BINDING SITE III, inhibits translation of VGAM1590 host target RNA into VGAM1590 host target protein, herein designated VGAM HOST TARGET PROTEIN. VGAM host target protein is therefore outlined by a broken line.

It is appreciated that VGAM1590 host target gene, herein designated VGAM HOST TARGET GENE, in fact represents a plurality of VGAM1590 host target genes. The mRNA of each one of this plurality of VGAM1590 host target genes comprises one or more host target binding sites, each having a nucleotide sequence which is at least partly complementary to VGAM1590 RNA, herein designated VGAM RNA, and which when bound by VGAM1590 RNA causes inhibition of translation of respective one or more VGAM1590 host target proteins.

It is further appreciated by one skilled in the art that the mode of translational inhibition illustrated by FIG. 1 with specific reference to translational inhibition exerted by VGAM1590 gene, herein designated VGAM GENE, on one or more VGAM1590 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1590 is inhibition of expression of host target genes, as part of a novel viral mechanism of attacking a host. Accordingly, utilities of VGAM1590 include diagnosis, prevention and treatment of viral infection by Ateline Herpesvirus 3. Specific functions, and accordingly utilities, of VGAM1590 correlate with, and may be deduced from, the identity of the host target genes which VGAM1590 binds and inhibits, and the function of these host target genes, as elaborated hereinbelow.

Nucleotide sequences of the VGAM1590 precursor RNA, herein designated VGAM PRECURSOR RNA, and of the ‘diced’ VGAM1590 RNA, herein designated VGAM RNA, and a schematic representation of the secondary folding of VGAM1590 folded precursor RNA, herein designated VGAM FOLDED PRECURSOR RNA, of VGAM1590 are further described hereinbelow with reference to Table 1.

Nucleotide sequences of host target binding sites, such as BINDING SITE-I, BINDING SITE-II and BINDING SITE-III of FIG. 1, found on VGAM1590 host target RNA, and schematic representation of the complementarity of each of these host target binding sites to VGAM1590 RNA, herein designated VGAM RNA, are described hereinbelow with reference to Table 2.

As mentioned hereinabove with reference to FIG. 1, a function of VGAM1590 gene, herein designated VGAM is inhibition of expression of VGAM1590 target genes. It is appreciated that specific functions, and accordingly utilities, of VGAM1590 correlate with, and may be deduced from, the identity of the target genes which VGAM1590 binds and inhibits, and the function of these target genes, as elaborated hereinbelow.

EGF-like-domain, Multiple 5 (EGFL5, Accession XM_098838) is a VGAM1590 host target gene. EGFL5 BINDING SITE is HOST TARGET binding site found in the 5' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41881, to the nucleotide sequence of VGAM1590 RNA, herein designated VGAM RNA, also designated SEQ ID:4301.

A function of VGAM1590 is therefore inhibition of EGF-like-domain, Multiple 5 (EGFL5, Accession XM_098838). Accordingly, utilities of VGAM1590 include diagnosis, prevention and treatment of diseases and clinical conditions associated with EGFL5. Lectin, Mannose-binding, 1 (LMAN1, Accession NM_005570) is another VGAM1590 host target gene. LMAN1 BINDING SITE is HOST TARGET binding site found in the 3' untranslated region of mRNA encoded by LMAN1, corresponding to a HOST TARGET binding site such as BINDING SITE I, BINDING SITE II or BINDING SITE III. Table 2 illustrates the complementarity of the nucleotide sequences of LMAN1 BINDING SITE, designated SEQ ID:12098, to the nucleotide sequence of VGAM1590 RNA, herein designated VGAM RNA, also designated SEQ ID:4301.

Another function of VGAM1590 is therefore inhibition of Lectin, Mannose-binding, 1 (LMAN1, Accession NM_005570). Accordingly, utilities of VGAM1590 include diagnosis, prevention and treatment of diseases and clinical conditions associated with LMAN1. Parathyroid Hormone-like Hormone (PTHLH, Accession NM_002820) is another VGAM1590 host target gene. PTHLH BINDING SITE is HOST TARGET binding site found in the 3' untranslated region of mRNA encoded by PTHLH, corresponding to a HOST TARGET binding site such as BINDING SITE I, BINDING SITE II or BINDING SITE III. Table 2 illustrates the complementarity of the nucleotide sequences of PTHLH BINDING SITE, designated SEQ ID:8686, to the nucleotide sequence of VGAM1590 RNA, herein designated VGAM RNA, also designated SEQ ID:4301.

Another function of VGAM1590 is therefore inhibition of Parathyroid Hormone-like Hormone (PTHLH, Accession NM_002820), a gene which plays a physiological role in lactation, possibly as a hormone for the mobilization and/or transfer of calcium to the milk. Accordingly, utilities of VGAM1590 include diagnosis, prevention and treatment of diseases and clinical conditions associated with PTHLH. The function of PTHLH has been established by previous studies. PTHRP is responsible for most cases of humoral hypercalcemia of malignancy. It mimics the actions of PTH because of its structural homology with PTH and its ability to bind to and signal via the PTH/PTHRP receptor in bone and kidney. PTHRP-(1-36) appears to be one of several secretory forms of PTHRP. When this peptide was given intravenously (iv) to normal volunteers, it produced the same effects as PTH-(1-34). To determine whether PTHRP-(1-36) could be used subcutaneously (sc) in human S as a diagnostic reagent to study differences between HHM and hyperparathyroidism, Henry et al. (1997) examined whether sc PTHRP-(1-36) could affect mineral homeostasis. PTHRP-(1-36) given sc produced increases in circulating PTHRP-(1-36), reductions in serum phosphorus and the renal phosphorus threshold, increments in fractional calcium excretion and nephrogenous cAMP excretion, and increases in plasma 1,25-dihydroxyvitamin D. The authors concluded that it is feasible to use PTHRP-(1-36) in studies of HHM and hyperparathyroidism. Animal model experiments lend further support to the function of PTHLH. Philbrick et al. (1998) found that whereas PTHRP knockout mice die at birth with a chondrodystrophic phenotype, replacement of PTHRP expression in the chondrocytes of these knockout mice using a procollagen II-driven transgene resulted in the correction of the lethal skeletal abnormalities and generated animals that were effectively PTHRP-null in all sites other than cartilage. These rescued PTHRP knockout mice survived to at least 6 months of age but were small in stature and displayed a number of developmental defects, including cranial chondrodystrophy and a failure of tooth eruption. Teeth appeared to develop normally but became trapped by the surrounding bone and underwent progressive impaction. Localization of PTHRP mRNA during normal tooth development by in situ hybridization showed increasing levels of expression in the enamel epithelium before the formation of the eruption pathway. The type 1 PTH/PTHRP receptor is expressed in both the adjacent dental mesenchyme and in alveolar bone. The replacement of PTHRP expression in the enamel epithelium with a keratin 14-driven transgene corrected the defect in bone resorption and restored the normal program of tooth eruption. PTHRP therefore represents an essential signal in the formation of the eruption pathway.

It is appreciated that the abovementioned animal model for PTHLH is acknowledged by those skilled in the art as a scientifically valid animal model, as can be further appreciated from the publications sited hereinbelow.

Full details of the abovementioned studies are described in the following publications, the disclosure of which are hereby incorporated by reference:

Philbrick, W. M.; Dreyer, B. E.; Nakchbandi, I. A.; Karaplis, A. C.: Parathyroid hormone-related protein is required for tooth eruption. Proc. Nat. Acad. Sci. 95:11846-11851, 1998; and Strewler, G. J.: The physiology of parathyroid hormone-related protein. New Eng. J. Med. 342:177-185, 2000.

Further studies establishing the function and utilities of PTHLH are found in John Hopkins OMIM database record ID 168470, and in sited publications numbered 10360-10365, 1642-1643, 3914, 10359-164 and 5451-1654 listed in the bibliography section hereinbelow, which are also hereby incorporated by reference. Ribonucleotide Reductase M2 B (TP53 inducible) (RRM2B, Accession XM_042096) is another VGAM1590 host target gene. RRM2B BINDING SITE is HOST TARGET binding site found in the 3' untranslated region of mRNA encoded by RRM2B, corresponding to a HOST TARGET binding site such as BINDING SITE I, BINDING SITE II or BINDING SITE III. Table 2 illustrates the complementarity of the nucleotide sequences of RRM2B BINDING SITE, designated SEQ ID:33690, to the nucleotide sequence of VGAM1590 RNA, herein designated VGAM RNA, also designated SEQ ID:4301.

Another function of VGAM1590 is therefore inhibition of Ribonucleotide Reductase M2 B (TP53 inducible) (RRM2B, Accession XM_042096). Accordingly, utilities of VGAM1590 include diagnosis, prevention and treatment of diseases and clinical conditions associated with RRM2B. FLJ14641 (Accession NM_032817) is another VGAM1590 host target gene. FLJ14641 BINDING SITE is HOST TARGET binding site found in the 3' untranslated region of mRNA encoded by FLJ14641, corresponding to a HOST TARGET binding site such as BINDING SITE I, BINDING SITE II or BINDING SITE III. Table 2 illustrates the complementarity of the nucleotide sequences of FLJ14641 BINDING SITE, designated SEQ ID:26591, to the nucleotide sequence of VGAM1590 RNA, herein designated VGAM RNA, also designated SEQ ID:4301.

Another function of VGAM1590 is therefore inhibition of FLJ14641 (Accession NM_032817). Accordingly, utilities of VGAM1590 include diagnosis, prevention and treatment of diseases and clinical conditions associated with FLJ14641. FLJ20373 (Accession NM_017792) is another VGAM1590 host target gene. FLJ20373 BINDING SITE is HOST TARGET binding site found in the 3' untranslated region of mRNA encoded by FLJ20373, corresponding to a HOST TARGET binding site such as BINDING SITE I, BINDING SITE II or BINDING SITE III. Table 2 illustrates the complementarity of the nucleotide sequences of FLJ20373 BINDING SITE, designated SEQ ID:19427, to the nucleotide sequence of VGAM1590 RNA, herein designated VGAM RNA, also designated SEQ ID:4301.

Another function of VGAM1590 is therefore inhibition of FLJ20373 (Accession NM_017792). Accordingly, utilities of VGAM1590 include diagnosis, prevention and treatment of diseases and clinical conditions associated with FLJ20373. NP220 (Accession NM_014497) is another VGAM1590 host target gene. NP220 BINDING SITE is HOST TARGET binding site found in the 5' untranslated region of mRNA encoded by NP220, corresponding to a HOST TARGET binding site such as BINDING SITE I, BINDING SITE II or BINDING SITE III. Table 2 illustrates the complementarity of the nucleotide sequences of NP220 BINDING SITE, designated SEQ ID:15836, to the nucleotide sequence of VGAM1590 RNA, herein designated VGAM RNA, also designated SEQ ID:4301.

Another function of VGAM1590 is therefore inhibition of NP220 (Accession NM_014497). Accordingly, utilities of VGAM1590 include diagnosis, prevention and treatment of diseases and clinical conditions associated with NP220. LOC148894 (Accession XM_097542) is another VGAM1590 host target gene. LOC148894 BINDING SITE is HOST TARGET binding site found in the 3' untranslated region of mRNA encoded by LOC148894, corresponding to a HOST TARGET binding site such as BINDING SITE I, BINDING SITE II or BINDING SITE III. Table 2 illustrates the complementarity of the nucleotide sequences of LOC148894 BINDING SITE, designated SEQ ID:40916, to the nucleotide sequence of VGAM1590 RNA, herein designated VGAM RNA, also designated SEQ ID:4301.

Another function of VGAM1590 is therefore inhibition of LOC148894 (Accession XM_097542). Accordingly, utilities of VGAM1590 include diagnosis, prevention and treatment of diseases and clinical conditions associated with LOC148894. FIG. 1 further provides a conceptual description of a novel bioinformatically detected viral gene of the present invention, referred to here as Viral Genomic Address Messenger 1591 (VGAM1591) viral gene, which modulates expression of respective host target genes thereof, the function and utility of which host target genes is known in the art.

VGAM1591 is a novel bioinformatically detected regulatory, non protein coding, viral micro RNA (miRNA) gene. The method by which VGAM1591 was detected is described hereinabove with reference to FIGS. 1-8.

VGAM1591 gene, herein designated VGAM GENE, is a viral gene contained in the genome of Ateline Herpesvirus 3. VGAM1591 host target gene, herein designated VGAM HOST TARGET GENE, is a human gene contained in the human genome.

VGAM1591 gene encodes a VGAM1591 precursor RNA, herein designated VGAM PRECURSOR RNA. Similar to other miRNA genes, and unlike most ordinary genes, VGAM1591 precursor RNA does not encode a protein. A nucleotide sequence identical or highly similar to the nucleotide sequence of VGAM1591 precursor RNA is designated SEQ ID:1577, and is provided hereinbelow with reference to the sequence listing part. Nucleotide sequence SEQ ID:1577 is located at position 90226 relative to the genome of Ateline Herpesvirus 3.

VGAM1591 precursor RNA folds onto itself, forming VGAM1591 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1591 folded precursor RNA into VGAM1591 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM1591 RNA is designated SEQ ID:4302, and is provided hereinbelow with reference to the sequence listing part.

VGAM1591 host target gene, herein designated VGAM HOST TARGET GENE, encodes a corresponding messenger RNA, VGAM1591 host target RNA, herein designated VGAM HOST TARGET RNA. VGAM1591 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1591 RNA, herein designated VGAM RNA, binds complementarily to one or more host target binding sites located in untranslated regions of VGAM1591 host target RNA, herein designated VGAM HOST TARGET RNA. This complementary binding is due to the fact that the nucleotide sequence of VGAM1591 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1591 RNA, herein designated VGAM RNA, may have a different number of host target binding sites in untranslated regions of a VGAM1591 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1591 RNA, herein designated VGAM RNA, to host target binding sites on VGAM1591 host target RNA, herein designated VGAM HOST TARGET RNA, such as BINDING SITE I, BINDING SITE II and BINDING SITE III, inhibits translation of VGAM1591 host target RNA into VGAM1591 host target protein, herein designated VGAM HOST TARGET PROTEIN. VGAM host target protein is therefore outlined by a broken line.

It is appreciated that VGAM1591 host target gene, herein designated VGAM HOST TARGET GENE, in fact represents a plurality of VGAM1591 host target genes. The mRNA of each one of this plurality of VGAM1591 host target genes comprises one or more host target binding sites, each having a nucleotide sequence which is at least partly complementary to VGAM1591 RNA, herein designated VGAM RNA, and which when bound by VGAM1591 RNA causes inhibition of translation of respective one or more VGAM1591 host target proteins.

It is further appreciated by one skilled in the art that the mode of translational inhibition illustrated by FIG. 1 with specific reference to translational inhibition exerted by VGAM1591 gene, herein designated VGAM GENE, on one or more VGAM1591 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1591 is inhibition of expression of host target genes, as part of a novel viral mechanism of attacking a host. Accordingly, utilities of VGAM1591 include diagnosis, prevention and treatment of viral infection by Ateline Herpesvirus 3. Specific functions, and accordingly utilities, of VGAM1591 correlate with, and may be deduced from, the identity of the host target genes which VGAM1591 binds and inhibits, and the function of these host target genes, as elaborated hereinbelow.

Nucleotide sequences of the VGAM1591 precursor RNA, herein designated VGAM PRECURSOR RNA, and of the 'diced' VGAM1591 RNA, herein designated VGAM RNA, and a schematic representation of the secondary folding of VGAM1591 folded precursor RNA, herein designated VGAM FOLDED PRECURSOR RNA, of VGAM1591 are further described hereinbelow with reference to Table 1.

Nucleotide sequences of host target binding sites, such as BINDING SITE-I, BINDING SITE-II and BINDING SITE-III of FIG. 1, found on VGAM1591 host target RNA, and schematic representation of the complementarity of each of these host target binding sites to VGAM1591 RNA, herein designated VGAM RNA, are described hereinbelow with reference to Table 2.

As mentioned hereinabove with reference to FIG. 1, a function of VGAM1591 gene, herein designated VGAM is inhibition of expression of VGAM1591 target genes. It is appreciated that specific functions, and accordingly utilities, of VGAM1591 correlate with, and may be deduced from, the identity of the target genes which VGAM1591 binds and inhibits, and the function of these target genes, as elaborated hereinbelow.

Bagpipe Homeobox Homolog 1 (Drosophila) (BAPX1, Accession NM_001189) is a VGAM1591 host target gene. BAPX1 BINDING SITE is HOST TARGET binding site found in the 3' untranslated region of mRNA encoded by BAPX1, corresponding to a HOST TARGET binding site such as BINDING SITE I, BINDING SITE II or BINDING SITE III. Table 2 illustrates the complementarity of the nucleotide sequences of BAPX1 BINDING SITE, designated SEQ ID:6861, to the nucleotide sequence of VGAM1591 RNA, herein designated VGAM RNA, also designated SEQ ID:4302.

A function of VGAM1591 is therefore inhibition of Bagpipe Homeobox Homolog 1 (Drosophila) (BAPX1, Accession NM_001189), a gene which regulates gene expression, morphogenesis, and differentiation. Accordingly, utilities of VGAM1591 include diagnosis, prevention and treatment of diseases and clinical conditions associated with BAPX1. The function of BAPX1 has been established by previous studies. Yoshiura and Murray (1997) reported the sequence of the human homolog of BAPX1 and localized it to human 4p16.1 by linkage mapping on CEPH families with polymorphic markers identified from the genomic sequence near the gene. They suggested the human BAPX1 gene as a candidate gene for disorders of skeletal development that map to 4p16.1, such as Ellis-van Creveld syndrome (OMIM Ref. No. 225500). Tribioli and Lufkin (1997) cloned the BAPX1 gene by screening a human genomic placenta library with a genomic fragment of the mouse gene. The predicted 333-amino acid sequence of the human gene product had 85% overall identity to the product of the murine gene, with 100% identity in the homeodomain. By fluorescence in situ hybridization, they mapped the BAPX1 gene to 4p16.1 in a region of syntenic homology with mouse chromosome 5 where the mouse gene had been mapped. RT-PCR analysis demonstrated that BAPX1 is expressed in embryonic tissues, particularly the limb, and at a lower level in an embryonic lung cell line. RNA in situ hybridization showed that BAPX1 is predominantly expressed in mesenchymal condensations of the fetal limb and axial skeleton, and in lateral plate mesoderm giving rise to visceral muscle. Tribioli et al. (1997) showed that expression of Bapx1 is first detectable in embryos just before axis rotation in lateral plate mesoderm (splanchnic mesoderm) adjacent to the endodermal lining of the prospective gut, and in the most newly formed somites in the region corresponding to the presclerotome, the precursor of the vertebrae. Thus, Bapx1 is one of the earliest developmental markers for the sclerotome portion of the somite and the gut mesentery. Bapx1 continues to be expressed well into organogenesis in lateral plate mesoderm surrounding the mid- and hindgut, and in essentially all cartilaginous condensations that will subsequently undergo endochondral bone formation.

Full details of the abovementioned studies are described in the following publications, the disclosure of which are hereby incorporated by reference:

Yoshiura, K.-I.; Murray, J. C.: Sequence and chromosomal assignment of human BAPX1, a bagpipe-related gene, to 4p16.1: a candidate gene for skeletal dysplasia. Genomics 45:425-428, 1997; and Tribioli, C.; Frasch, M.; Lufkin, T.: Bapx1: an evolutionary conserved homologue of the Drosophila bagpipe homeobox gene is expressed in splanchnic mesoderm and the embryonic skeleton.

Further studies establishing the function and utilities of BAPX1 are found in John Hopkins OMIM database record ID 602183, and in sited publications numbered 8529-8531 listed in the bibliography section hereinbelow, which are also hereby incorporated by reference. Cyclin D2 (CCND2, Accession NM_001759) is another VGAM1591 host target gene. CCND2 BINDING SITE is HOST TARGET binding site found in the 3' untranslated region of mRNA encoded by CCND2, corresponding to a HOST TARGET binding site such as BINDING SITE I, BINDING SITE II or BINDING SITE III. Table 2 illustrates the complementarity of the nucleotide sequences of CCND2 BINDING SITE, designated SEQ ID:7517, to the nucleotide sequence of VGAM1591 RNA, herein designated VGAM RNA, also designated SEQ ID:4302.

Another function of VGAM1591 is therefore inhibition of Cyclin D2 (CCND2, Accession NM_001759), a gene which is essential for the control of the cell cycle at the g1/s (start) transition. Accordingly, utilities of VGAM1591 include diagnosis, prevention and treatment of diseases and clinical conditions associated with CCND2. The function of CCND2 and its association with various diseases and clinical conditions, has been established by previous studies, as described hereinabove with reference to VGAM128. DEAD/H (Asp-Glu-Ala-Asp/His) Box Polypeptide 6 (RNA helicase, 54 kDa) (DDX6, Accession NM_004397) is another VGAM1591 host target gene. DDX6 BINDING SITE is HOST TARGET binding site found in the 5' untranslated region of mRNA encoded by DDX6, corresponding to a HOST TARGET binding site such as BINDING SITE I, BINDING SITE II or BINDING SITE III. Table 2 illustrates the complementarity of the nucleotide sequences of DDX6 BINDING SITE, designated SEQ ID:10646, to the nucleotide sequence of VGAM1591 RNA, herein designated VGAM RNA, also designated SEQ ID:4302.

Another function of VGAM1591 is therefore inhibition of DEAD/H (Asp-Glu-Ala-Asp/His) Box Polypeptide 6 (RNA helicase, 54 kDa) (DDX6, Accession NM_004397), a gene which is putative RNA helicases. Accordingly, utilities of VGAM1591 include diagnosis, prevention and treatment of diseases and clinical conditions associated with DDX6. The function of DDX6 and its association with various diseases and clinical conditions, has been established by previous studies, as described hereinabove with reference to VGAM179. Deoxyribonuclease I-like 1 (DNASE1L1, Accession NM_006730) is another VGAM1591 host target gene. DNASE1L1 BINDING SITE is HOST TARGET binding site found in the 3' untranslated region of mRNA encoded by DNASE1L1, corresponding to a HOST TARGET binding site such as BINDING SITE I, BINDING SITE II or BINDING SITE III. Table 2 illustrates the complementarity of the nucleotide sequences of DNASE1L1 BINDING SITE, designated SEQ ID:13565, to the nucleotide sequence of VGAM1591 RNA, herein designated VGAM RNA, also designated SEQ ID:4302.

Another function of VGAM1591 is therefore inhibition of Deoxyribonuclease I-like 1 (DNASE1L1, Accession NM_006730), a gene which seems to be involved in cell death. Accordingly, utilities of VGAM1591 include diagnosis, prevention and treatment of diseases and clinical conditions associated with DNASE1L1. The function of DNASE1L1 and its association with various diseases and clinical conditions, has been established by previous studies, as described hereinabove with reference to VGAM885. Heterogeneous Nuclear Ribonucleoprotein D-like (HNRPDL, Accession NM_005463) is another VGAM1591 host target gene. HNRPDL BINDING SITE is HOST TARGET binding site found in the 3' untranslated region of mRNA encoded by HNRPDL, corresponding to a HOST TARGET binding site such as BINDING SITE I, BINDING SITE II or BINDING SITE III. Table 2 illustrates the complementarity of the nucleotide sequences of HNRPDL BINDING SITE, designated SEQ ID:11950, to the nucleotide sequence of VGAM1591 RNA, herein designated VGAM RNA, also designated SEQ ID:4302.

Another function of VGAM1591 is therefore inhibition of Heterogeneous Nuclear Ribonucleoprotein D-like (HNRPDL, Accession NM_005463), a gene which binds to rna molecules that contain au-rich elements. Accordingly, utilities of VGAM1591 include diagnosis, prevention and treatment of diseases and clinical conditions associated with HNRPDL. The function of HNRPDL and its association with various diseases and clinical conditions, has been established by previous studies, as described hereinabove with reference to VGAM144. Heat Shock 70 kDa Protein 8 (HSPA8, Accession NM_006597) is another VGAM1591 host target gene. HSPA8 BINDING SITE is HOST TARGET binding site found in the 5' untranslated region of mRNA encoded by HSPA8, corresponding to a HOST TARGET binding site such as BINDING SITE I, BINDING SITE II or BINDING SITE III. Table 2 illustrates the complementarity of the nucleotide sequences of HSPA8 BINDING SITE, designated SEQ ID:13370, to the nucleotide sequence of VGAM1591 RNA, herein designated VGAM RNA, also designated SEQ ID:4302.

Another function of VGAM1591 is therefore inhibition of Heat Shock 70 kDa Protein 8 (HSPA8, Accession NM_006597), a gene which acts as a chaperone.plays an important role in cells by transiently associating with nascent polypeptides to facilitate correct folding. Accordingly, utilities of VGAM1591 include diagnosis, prevention and treatment of diseases and clinical conditions associated with HSPA8. The function of HSPA8 and its association with various diseases and clinical conditions, has been established by previous studies, as described hereinabove with reference to VGAM258. Thrombomodulin (THBD, Accession NM_000361) is another VGAM1591 host target gene. THBD BINDING SITE is HOST TARGET binding site found in the 5' untranslated region of mRNA encoded by THBD, corresponding to a HOST TARGET binding site such as BINDING SITE I, BINDING SITE II or BINDING SITE III. Table 2 illustrates the complementarity of the nucleotide sequences of THBD BINDING SITE, designated SEQ ID:5920, to the nucleotide sequence of VGAM1591 RNA, herein designated VGAM RNA, also designated SEQ ID:4302.

Another function of VGAM1591 is therefore inhibition of Thrombomodulin (THBD, Accession NM_000361). Accordingly, utilities of VGAM1591 include diagnosis, prevention and treatment of diseases and clinical conditions associated with THBD. Chromosome 4 Open Reading Frame 6 (C4orf6, Accession NM_005750) is another VGAM1591 host target gene. C4orf6 BINDING SITE is HOST TARGET binding site found in the 5' untranslated region of mRNA encoded by C4orf6, corresponding to a HOST TARGET binding site such as BINDING SITE I, BINDING SITE II or BINDING SITE III. Table 2 illustrates the complementarity of the nucleotide sequences of C4orf6 BINDING SITE, designated SEQ ID:12310, to the nucleotide sequence of VGAM1591 RNA, herein designated VGAM RNA, also designated SEQ ID:4302.

Another function of VGAM1591 is therefore inhibition of Chromosome 4 Open Reading Frame 6 (C4orf6, Accession NM_005750). Accordingly, utilities of VGAM1591 include diagnosis, prevention and treatment of diseases and clinical conditions associated with C4orf6. HT002 (Accession NM_014066) is another VGAM1591 host target gene. HT002 BINDING SITE is HOST TARGET binding site found in the 3' untranslated region of mRNA encoded by HT002, corresponding to a HOST TARGET binding site such as BINDING SITE I, BINDING SITE II or BINDING SITE III. Table 2 illustrates the complementarity of the nucleotide sequences of HT002 BINDING SITE, designated SEQ ID:15283, to the nucleotide sequence of VGAM1591 RNA, herein designated VGAM RNA, also designated SEQ ID:4302.

Another function of VGAM1591 is therefore inhibition of HT002 (Accession NM_014066). Accordingly, utilities of VGAM1591 include diagnosis, prevention and treatment of diseases and clinical conditions associated with HT002. KIAA0775 (Accession NM_014726) is another VGAM1591 host target gene. KIAA0775 BINDING SITE is HOST TAR- GET binding site found in the 5' untranslated region of mRNA encoded by KIAA0775, corresponding to a HOST TARGET binding site such as BINDING SITE I, BINDING SITE II or BINDING SITE III. Table 2 illustrates the complementarity of the nucleotide sequences of KIAA0775 BINDING SITE, designated SEQ ID:16319, to the nucleotide sequence of VGAM1591 RNA, herein designated VGAM RNA, also designated SEQ ID:4302.

Another function of VGAM1591 is therefore inhibition of KIAA0775 (Accession NM_014726). Accordingly, utilities of VGAM1591 include diagnosis, prevention and treatment of diseases and clinical conditions associated with KIAA0775. KIAA0821 (Accession NM_014921) is another VGAM1591 host target gene. KIAA0821 BINDING SITE is HOST TARGET binding site found in the 3' untranslated region of mRNA encoded by KIAA0821, corresponding to a HOST TARGET binding site such as BINDING SITE I, BINDING SITE II or BINDING SITE III. Table 2 illustrates the complementarity of the nucleotide sequences of KIAA0821 BINDING SITE, designated SEQ ID:17199, to the nucleotide sequence of VGAM1591 RNA, herein designated VGAM RNA, also designated SEQ ID:4302.

Another function of VGAM1591 is therefore inhibition of KIAA0821 (Accession NM_014921). Accordingly, utilities of VGAM1591 include diagnosis, prevention and treatment of diseases and clinical conditions associated with KIAA0821. KIAA1297 (Accession XM_051005) is another VGAM1591 host target gene. KIAA1297 BINDING SITE is HOST TARGET binding site found in the 5' untranslated region of mRNA encoded by KIAA1297, corresponding to a HOST TARGET binding site such as BINDING SITE I, BINDING SITE II or BINDING SITE III. Table 2 illustrates the complementarity of the nucleotide sequences of KIAA1297 BINDING SITE, designated SEQ ID:35713, to the nucleotide sequence of VGAM1591 RNA, herein designated VGAM RNA, also designated SEQ ID:4302.

Another function of VGAM1591 is therefore inhibition of KIAA1297 (Accession XM_051005). Accordingly, utilities of VGAM1591 include diagnosis, prevention and treatment of diseases and clinical conditions associated with KIAA1297. MGC14161 (Accession NM_032892) is another VGAM1591 host target gene. MGC14161 BINDING SITE is HOST TARGET binding site found in the 3' untranslated region of mRNA encoded by MGC14161, corresponding to a HOST TARGET binding site such as BINDING SITE I, BINDING SITE II or BINDING SITE III. Table 2 illustrates the complementarity of the nucleotide sequences of MGC14161 BINDING SITE, designated SEQ ID:26720, to the nucleotide sequence of VGAM1591 RNA, herein designated VGAM RNA, also designated SEQ ID:4302.

Another function of VGAM1591 is therefore inhibition of MGC14161 (Accession NM_032892). Accordingly, utilities of VGAM1591 include diagnosis, prevention and treatment of diseases and clinical conditions associated with MGC14161. MGC4161 (Accession NM_024303) is another VGAM1591 host target gene. MGC4161 BINDING SITE is HOST TARGET binding site found in the 5' untranslated region of mRNA encoded by MGC4161, corresponding to a HOST TARGET binding site such as BINDING SITE I, BINDING SITE II or BINDING SITE III. Table 2 illustrates the complementarity of the nucleotide sequences of MGC4161 BINDING SITE, designated SEQ ID:23595, to the nucleotide sequence of VGAM1591 RNA, herein designated VGAM RNA, also designated SEQ ID:4302.

Another function of VGAM1591 is therefore inhibition of MGC4161 (Accession NM_024303). Accordingly, utilities of VGAM1591 include diagnosis, prevention and treatment of diseases and clinical conditions associated with MGC4161. Proprotein Convertase Subtilisin/kexin Type 7 (PCSK7, Accession NM_004716) is another VGAM1591 host target gene. PCSK7 BINDING SITE is HOST TARGET binding site found in the 5' untranslated region of mRNA encoded by PCSK7, corresponding to a HOST TARGET binding site such as BINDING SITE I, BINDING SITE II or BINDING SITE III. Table 2 illustrates the complementarity of the nucleotide sequences of PCSK7 BINDING SITE, designated SEQ ID:11075, to the nucleotide sequence of VGAM1591 RNA, herein designated VGAM RNA, also designated SEQ ID:4302.

Another function of VGAM1591 is therefore inhibition of Proprotein Convertase Subtilisin/kexin Type 7 (PCSK7, Accession NM_004716). Accordingly, utilities of VGAM1591 include diagnosis, prevention and treatment of diseases and clinical conditions associated with PCSK7. PRIC285 (Accession XM_028918) is another VGAM1591 host target gene. PRIC285 BINDING SITE is HOST TARGET binding site found in the 3' untranslated region of mRNA encoded by PRIC285, corresponding to a HOST TARGET binding site such as BINDING SITE I, BINDING SITE II or BINDING SITE III. Table 2 illustrates the complementarity of the nucleotide sequences of PRIC285 BINDING SITE, designated SEQ ID:30803, to the nucleotide sequence of VGAM1591 RNA, herein designated VGAM RNA, also designated SEQ ID:4302.

Another function of VGAM1591 is therefore inhibition of PRIC285 (Accession XM_028918). Accordingly, utilities of VGAM1591 include diagnosis, prevention and treatment of diseases and clinical conditions associated with PRIC285. LOC135763 (Accession NM_138572) is another VGAM1591 host target gene. LOC135763 BINDING SITE is HOST TARGET binding site found in the 3' untranslated region of mRNA encoded by LOC135763, corresponding to a HOST TARGET binding site such as BINDING SITE I, BINDING SITE II or BINDING SITE III. Table 2 illustrates the complementarity of the nucleotide sequences of LOC135763 BINDING SITE, designated SEQ ID:28882, to the nucleotide sequence of VGAM1591 RNA, herein designated VGAM RNA, also designated SEQ ID:4302.

Another function of VGAM1591 is therefore inhibition of LOC135763 (Accession NM_138572). Accordingly, utilities of VGAM1591 include diagnosis, prevention and treatment of diseases and clinical conditions associated with LOC135763. LOC149464 (Accession XM_097645) is another VGAM1591 host target gene. LOC149464 BINDING SITE is HOST TARGET binding site found in the 5' untranslated region of mRNA encoded by LOC149464, corresponding to a HOST TARGET binding site such as BINDING SITE I, BINDING SITE II or BINDING SITE III. Table 2 illustrates the complementarity of the nucleotide sequences of LOC149464 BINDING SITE, designated SEQ ID:40992, to the nucleotide sequence of VGAM1591 RNA, herein designated VGAM RNA, also designated SEQ ID:4302.

Another function of VGAM1591 is therefore inhibition of LOC149464 (Accession XM_097645). Accordingly, utilities of VGAM1591 include diagnosis, prevention and treatment of diseases and clinical conditions associated with LOC149464. LOC200531 (Accession XM_114244) is another VGAM1591 host target gene. LOC200531 BINDING SITE is HOST TARGET binding site found in the 5' untranslated region of mRNA encoded by LOC200531, corresponding to a HOST TARGET binding site such as BINDING SITE I, BINDING SITE II or BINDING SITE III. Table 2 illustrates the complementarity of the nucleotide sequences of LOC200531 BINDING SITE, designated SEQ ID:42818, to the nucleotide sequence of VGAM1591 RNA, herein designated VGAM RNA, also designated SEQ ID:4302.

Another function of VGAM1591 is therefore inhibition of LOC200531 (Accession XM_114244). Accordingly, utilities of VGAM1591 include diagnosis, prevention and treatment of diseases and clinical conditions associated with LOC200531. LOC201689 (Accession XM_040608) is another VGAM1591 host target gene. LOC201689 BINDING SITE is HOST TARGET binding site found in the 3' untranslated region of mRNA encoded by LOC201689, corresponding to a HOST TARGET binding site such as BINDING SITE I, BINDING SITE II or BINDING SITE III. Table 2 illustrates the complementarity of the nucleotide sequences of LOC201689 BINDING SITE, designated SEQ ID:33333, to the nucleotide sequence of VGAM1591 RNA, herein designated VGAM RNA, also designated SEQ ID:4302.

Another function of VGAM1591 is therefore inhibition of LOC201689 (Accession XM_040608). Accordingly, utilities of VGAM1591 include diagnosis, prevention and treatment of diseases and clinical conditions associated with LOC201689. FIG. 1 further provides a conceptual description of a novel bioinformatically detected viral gene of the present invention, referred to here as Viral Genomic Address Messenger 1592 (VGAM1592) viral gene, which modulates expression of respective host target genes thereof, the function and utility of which host target genes is known in the art.

VGAM1592 is a novel bioinformatically detected regulatory, non protein coding, viral micro RNA (miRNA) gene. The method by which VGAM1592 was detected is described hereinabove with reference to FIGS. 1-8.

VGAM1592 gene, herein designated VGAM GENE, is a viral gene contained in the genome of Ateline Herpesvirus 3. VGAM1592 host target gene, herein designated VGAM HOST TARGET GENE, is a human gene contained in the human genome.

VGAM1592 gene encodes a VGAM1592 precursor RNA, herein designated VGAM PRECURSOR RNA. Similar to other miRNA genes, and unlike most ordinary genes, VGAM1592 precursor RNA does not encode a protein. A nucleotide sequence identical or highly similar to the nucleotide sequence of VGAM1592 precursor RNA is designated SEQ ID:1578, and is provided hereinbelow with reference to the sequence listing part. Nucleotide sequence SEQ ID:1578 is located at position 89710 relative to the genome of Ateline Herpesvirus 3.

VGAM1592 precursor RNA folds onto itself, forming VGAM1592 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1592 folded precursor RNA into VGAM1592 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1592 RNA is designated SEQ ID:4303, and is provided hereinbelow with reference to the sequence listing part.

VGAM1592 host target gene, herein designated VGAM HOST TARGET GENE, encodes a corresponding messenger RNA, VGAM1592 host target RNA, herein designated VGAM HOST TARGET RNA. VGAM1592 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1592 RNA, herein designated VGAM RNA, binds complementarily to one or more host target binding sites located in untranslated regions of VGAM1592 host target RNA, herein designated VGAM HOST TARGET RNA. This complementary binding is due to the fact that the nucleotide sequence of VGAM1592 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1592 RNA, herein designated VGAM RNA, may have a different number of host target binding sites in untranslated regions of a VGAM1592 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1592 RNA, herein designated VGAM RNA, to host target binding sites on VGAM1592 host target RNA, herein designated VGAM HOST TARGET RNA, such as BINDING SITE I, BINDING SITE II and BINDING SITE III, inhibits translation of VGAM1592 host target RNA into VGAM1592 host target protein, herein designated VGAM HOST TARGET PROTEIN. VGAM host target protein is therefore outlined by a broken line.

It is appreciated that VGAM1592 host target gene, herein designated VGAM HOST TARGET GENE, in fact represents a plurality of VGAM1592 host target genes. The mRNA of each one of this plurality of VGAM1592 host target genes comprises one or more host target binding sites, each having a nucleotide sequence which is at least partly complementary to VGAM1592 RNA, herein designated VGAM RNA, and which when bound by VGAM1592 RNA causes inhibition of translation of respective one or more VGAM1592 host target proteins.

It is further appreciated by one skilled in the art that the mode of translational inhibition illustrated by FIG. 1 with specific reference to translational inhibition exerted by VGAM1592 gene, herein designated VGAM GENE, on one or more VGAM1592 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1592 is inhibition of expression of host target genes, as part of a novel viral mechanism of attacking a host. Accordingly, utilities of VGAM1592 include diagnosis, prevention and treatment of viral infection by Ateline Herpesvirus 3. Specific functions, and accordingly utilities, of VGAM1592 correlate with, and may be deduced from, the identity of the host target genes which VGAM1592 binds and inhibits, and the function of these host target genes, as elaborated hereinbelow.

Nucleotide sequences of the VGAM1592 precursor RNA, herein designated VGAM PRECURSOR RNA, and of the 'diced' VGAM1592 RNA, herein designated VGAM RNA, and a schematic representation of the secondary folding of VGAM1592 folded precursor RNA, herein designated VGAM FOLDED PRECURSOR RNA, of VGAM1592 are further described hereinbelow with reference to Table 1.

Nucleotide sequences of host target binding sites, such as BINDING SITE-I, BINDING SITE-II and BINDING SITE-III of FIG. 1, found on VGAM1592 host target RNA, and schematic representation of the complementarity of each of these host target binding sites to VGAM1592 RNA, herein designated VGAM RNA, are described hereinbelow with reference to Table 2.

As mentioned hereinabove with reference to FIG. 1, a function of VGAM1592 gene, herein designated VGAM is inhibition of expression of VGAM1592 target genes. It is appreciated that specific functions, and accordingly utilities, of VGAM1592 correlate with, and may be deduced from, the identity of the target genes which VGAM1592 binds and inhibits, and the function of these target genes, as elaborated hereinbelow.

KIAA1560 (Accession XM_034422) is a VGAM1592 host target gene. KIAA1560 BINDING SITE is HOST TARGET binding site found in the 3' untranslated region of mRNA encoded by KIAA1560, corresponding to a HOST TARGET binding site such as BINDING SITE I, BINDING SITE II or BINDING SITE III. Table 2 illustrates the complementarity of the nucleotide sequences of KIAA1560 BINDING SITE, designated SEQ ID:32102, to the nucleotide sequence of VGAM1592 RNA, herein designated VGAM RNA, also designated SEQ ID:4303.

A function of VGAM1592 is therefore inhibition of KIAA1560 (Accession XM_034422). Accordingly, utilities of VGAM1592 include diagnosis, prevention and treatment of diseases and clinical conditions associated with KIAA1560. LANO (Accession NM_025168) is another VGAM1592 host target gene. LANO BINDING SITE is HOST TARGET binding site found in the 3' untranslated region of mRNA encoded by LANO, corresponding to a HOST TARGET binding site such as BINDING SITE I, BINDING SITE II or BINDING SITE III. Table 2 illustrates the complementarity of the nucleotide sequences of LANO BINDING SITE, designated SEQ ID:24805, to the nucleotide sequence of VGAM1592 RNA, herein designated VGAM RNA, also designated SEQ ID:4303.

Another function of VGAM1592 is therefore inhibition of LANO (Accession NM_025168). Accordingly, utilities of VGAM1592 include diagnosis, prevention and treatment of diseases and clinical conditions associated with LANO. Roundabout Homolog 4, Magic Roundabout (Drosophila) (ROBO4, Accession NM_019055) is another VGAM1592 host target gene. ROBO4 BINDING SITE is HOST TARGET binding site found in the 3' untranslated region of mRNA encoded by ROBO4, corresponding to a HOST TARGET binding site such as BINDING SITE I, BINDING SITE II or BINDING SITE III. Table 2 illustrates the complementarity of the nucleotide sequences of ROBO4 BINDING SITE, designated SEQ ID:21133, to the nucleotide sequence of VGAM1592 RNA, herein designated VGAM RNA, also designated SEQ ID:4303.

Another function of VGAM1592 is therefore inhibition of Roundabout Homolog 4, Magic Roundabout (Drosophila) (ROBO4, Accession NM_019055). Accordingly, utilities of VGAM1592 include diagnosis, prevention and treatment of diseases and clinical conditions associated with ROBO4. Unc-51-like Kinase 2 (C. elegans) (ULK2, Accession NM_014683) is another VGAM1592 host target gene. ULK2 BINDING SITE is HOST TARGET binding site found in the 3' untranslated region of mRNA encoded by ULK2, corresponding to a HOST TARGET binding site such as BINDING SITE I, BINDING SITE II or BINDING SITE III. Table 2 illustrates the complementarity of the nucleotide sequences of ULK2 BINDING SITE, designated SEQ ID:16183, to the nucleotide sequence of VGAM1592 RNA, herein designated VGAM RNA, also designated SEQ ID:4303.

Another function of VGAM1592 is therefore inhibition of Unc-51-like Kinase 2 (C. elegans) (ULK2, Accession NM_014683). Accordingly, utilities of VGAM1592 include diagnosis, prevention and treatment of diseases and clinical conditions associated with ULK2. FIG. 1 further provides a conceptual description of a novel bioinformatically detected viral gene of the present invention, referred to here as Viral Genomic Address Messenger 1593 (VGAM1593) viral gene, which modulates expression of respective host target genes thereof, the function and utility of which host target genes is known in the art.

VGAM1593 is a novel bioinformatically detected regulatory, non protein coding, viral micro RNA (miRNA) gene. The method by which VGAM1593 was detected is described hereinabove with reference to FIGS. 1-8.

VGAM1593 gene, herein designated VGAM GENE, is a viral gene contained in the genome of Ateline Herpesvirus 3. VGAM1593 host target gene, herein designated VGAM HOST TARGET GENE, is a human gene contained in the human genome.

VGAM1593 gene encodes a VGAM1593 precursor RNA, herein designated VGAM PRECURSOR RNA. Similar to other miRNA genes, and unlike most ordinary genes, VGAM1593 precursor RNA does not encode a protein. A nucleotide sequence identical or highly similar to the nucleotide sequence of VGAM1593 precursor RNA is designated SEQ ID:1579, and is provided hereinbelow with reference to the sequence listing part. Nucleotide sequence SEQ ID:1579 is located at position 86183 relative to the genome of Ateline Herpesvirus 3.

VGAM1593 precursor RNA folds onto itself, forming VGAM1593 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1593 folded precursor RNA into VGAM1593 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM1593 RNA is designated SEQ ID:4304, and is provided hereinbelow with reference to the sequence listing part.

VGAM1593 host target gene, herein designated VGAM HOST TARGET GENE, encodes a corresponding messenger RNA, VGAM1593 host target RNA, herein designated VGAM HOST TARGET RNA. VGAM1593 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1593 RNA, herein designated VGAM RNA, binds complementarily to one or more host target binding sites located in untranslated regions of VGAM1593 host target RNA, herein designated VGAM HOST TARGET RNA. This complementary binding is due to the fact that the nucleotide sequence of VGAM1593 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1593 RNA, herein designated VGAM RNA, may have a different number of host target binding sites in untranslated regions of a VGAM1593 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1593 RNA, herein designated VGAM RNA, to host target binding sites on VGAM1593 host target RNA, herein designated VGAM HOST TARGET RNA, such as BINDING SITE I, BINDING SITE II and BINDING SITE III, inhibits translation of VGAM1593 host target RNA into VGAM1593 host target protein, herein designated VGAM HOST TARGET PROTEIN. VGAM host target protein is therefore outlined by a broken line.

It is appreciated that VGAM1593 host target gene, herein designated VGAM HOST TARGET GENE, in fact represents a plurality of VGAM1593 host target genes. The mRNA of each one of this plurality of VGAM1593 host target genes comprises one or more host target binding sites, each having a nucleotide sequence which is at least partly complementary to VGAM1593 RNA, herein designated VGAM RNA, and which when bound by VGAM1593 RNA causes inhibition of translation of respective one or more VGAM1593 host target proteins.

It is further appreciated by one skilled in the art that the mode of translational inhibition illustrated by FIG. 1 with specific reference to translational inhibition exerted by VGAM1593 gene, herein designated VGAM GENE, on one or more VGAM1593 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1593 is inhibition of expression of host target genes, as part of a novel viral mechanism of attacking a host. Accordingly, utilities of VGAM1593 include diagnosis, prevention and treatment of viral infection by Ateline Herpesvirus 3. Specific functions, and accordingly utilities, of VGAM1593 correlate with, and may be deduced from, the identity of the host target genes which VGAM1593 binds and inhibits, and the function of these host target genes, as elaborated hereinbelow.

Nucleotide sequences of the VGAM1593 precursor RNA, herein designated VGAM PRECURSOR RNA, and of the 'diced' VGAM1593 RNA, herein designated VGAM RNA, and a schematic representation of the secondary folding of VGAM1593 folded precursor RNA, herein designated VGAM FOLDED PRECURSOR RNA, of VGAM1593 are further described hereinbelow with reference to Table 1.

Nucleotide sequences of host target binding sites, such as BINDING SITE-I, BINDING SITE-II and BINDING SITE-III of FIG. 1, found on VGAM1593 host target RNA, and schematic representation of the complementarity of each of these host target binding sites to VGAM1593 RNA, herein designated VGAM RNA, are described hereinbelow with reference to Table 2.

As mentioned hereinabove with reference to FIG. 1, a function of VGAM1593 gene, herein designated VGAM is inhibition of expression of VGAM1593 target genes. It is appreciated that specific functions, and accordingly utilities, of VGAM1593 correlate with, and may be deduced from, the identity of the target genes which VGAM1593 binds and inhibits, and the function of these target genes, as elaborated hereinbelow.

ATPase, Cu++ Transporting, Alpha Polypeptide (Menkes syndrome) (ATP7A, Accession NM_000052) is a VGAM1593 host target gene. ATP7A BINDING SITE is HOST TARGET binding site found in the 3' untranslated region of mRNA encoded by ATP7A, corresponding to a HOST TARGET binding site such as BINDING SITE I, BINDING SITE II or BINDING SITE III. Table 2 illustrates the complementarity of the nucleotide sequences of ATP7A BINDING SITE, designated SEQ ID:5493, to the nucleotide sequence of VGAM1593 RNA, herein designated VGAM RNA, also designated SEQ ID:4304.

A function of VGAM1593 is therefore inhibition of ATPase, Cu++ Transporting, Alpha Polypeptide (Menkes syndrome) (ATP7A, Accession NM_000052). Accordingly, utilities of VGAM1593 include diagnosis, prevention and treatment of diseases and clinical conditions associated with ATP7A. Faciogenital Dysplasia (Aarskog-Scott syndrome) (FGD1, Accession NM_004463) is another VGAM1593 host target gene. FGD1 BINDING SITE is HOST TARGET binding site found in the 3' untranslated region of mRNA encoded by FGD1, corresponding to a HOST TARGET binding site such as BINDING SITE I, BINDING SITE II or BINDING SITE III. Table 2 illustrates the complementarity of the nucleotide sequences of FGD1 BINDING SITE, designated SEQ ID:10768, to the nucleotide sequence of VGAM1593 RNA, herein designated VGAM RNA, also designated SEQ ID:4304.

Another function of VGAM1593 is therefore inhibition of Faciogenital Dysplasia (Aarskog-Scott syndrome) (FGD1, Accession NM_004463), a gene which activates the ras-like family of rho- and rac proteins by exchanging bound gdp for free gtp. Accordingly, utilities of VGAM1593 include diagnosis, prevention and treatment of diseases and clinical conditions associated with FGD1. The function of FGD1 has been established by previous studies. Aarskog (1970) described an X-linked disorder characterized by ocular hypertelorism, anteverted nostrils, broad upper lip, and peculiar penoscrotal relations ('saddle-bag scrotum' or 'shawl scrotum'). Affected males can reproduce. Scott (1971) emphasized the occurrence of ligamentous laxity manifest by hyperextensibility of the fingers, genu recurvatum, and flat feet. Furthermore, hypermobility in the cervical spine with anomaly of the odontoid resulted in neurologic deficit. He studied a family with 9 affected males in 5 sibships. Sugarman et al. (1973) described a kindred with 4 affected males. They emphasized the occurrence of a 'peculiar curved linear dimple inferior to the lower lip.' This and other stigmata were present in an earlier female. They favored sex-influenced autosomal dominant inheritance. Escobar and Weaver (1978) reported a patient who had features more suggestive of the Noonan syndrome than of the Aarskog syndrome. The patient, aged 28 years, also had severe macrocytic anemia refractory to iron therapy, hepatomegaly, hemochromatosis, portal cirrhosis, and interstitial pulmonary disease. Tyrkus et al. (1980) described mother and son with Aarskog-Scott syndrome. Expression was complete in the mother. The mother and son had a reciprocal translocation between the X chromosome and chromosome 8. The breakpoint on the X was at Xq12. The mother's parents and sibs were clinically normal and the parents had normal karyotypes. Tyrkus et al. (1980) described parental exposure to ionizing radiation. They found that the Aarskog-Scott locus may be located at Xq12. The normal X chromosome in the mother was consistently inactivated. Thus the full expression in the mother was explained. Bawle et al. (1984) published definitively on the family in which a balanced X-autosome translocation was associated with Aarskog syndrome in mother and son. They placed the X chromosome breakpoint at Xq13. Noteworthy was the full expression in the mother comparable to the full expression of Duchenne muscular dystrophy (OMIM Ref. No. 310200) in women with balanced X-autosome translocations involving Xp21. The authors postulated that, as in the latter case, the break at Xq13 creating the translocation also caused a presumed de novo point mutation in the 'Aarskog gene' and that the woman had nonrandom (preferential) inactivation of her structurally normal X. By high resolution cytogenetic studies, Rafael et al. (1992) demonstrated that the X chromosome breakpoint in the patient of Bawle et al. (1984) was located in the proximal short arm of the X chromosome rather than at Xq13. The autosomal breakpoint was 8q11 rather than 8p21.1, as previously reported. By study of somatic cell hybrids containing the der (X) chromosome by a combination of fluorescence in situ hybridization and Southern blot analysis with X-chromosome probes, Glover et al. (1993) refined the localization of the breakpoint to Xp11.21. Orrico et al. (2000) analyzed 13 unrelated patients with the clinical diagnosis of Aarskog-Scott syndrome. One patient carried an arg610-to-gln mutation (305400.0002) located in 1 of the 2 pleckstrin homology (PH) domains of the FGD1 gene. It corresponded to a highly conserved residue that had been involved in phosphoinositide binding in PH domains of other proteins. Critical missense mutations within the PH domain of the Bruton tyrosine kinase gene (BTK; 300300) result in X-linked agammaglobulinemia. Using SSCP analysis of the FGD1 gene, Schwartz et al. (2000) identified a missense mutation (305400.0003) in a familial case of Aarskog-Scott syndrome and a deletion mutation (305400.0004) in a sporadic case. The authors were unable to detect alterations in the FGD1 gene in propositi from 25 other familial cases, including the families originally described by Aarskog (1970) and Scott (1971), or in 15 sporadic cases. They suggested that mutational mechanisms not detected using standard analysis of coding sequence genomic DNA may cause the disorder.

Full details of the abovementioned studies are described in the following publications, the disclosure of which are hereby incorporated by reference:

Orrico, A.; Galli, L.; Falciani, M.; Bracci, M.; Cavaliere, M. L.; Rinaldi, M. M.; Musacchio, A.; Sorrentino, V.: A mutation in the pleckstrin homology (PH) domain of the FGD1 gene in an Italian family with faciogenital dysplasia (Aarskog-Scott syndrome). FEBS Lett. 478:216-220, 2000; and Schwartz, C. E.; Gillessen-Kaesbach, G.; May, M.; Cappa, M.; Gorski, J.; Steindl, K.; Neri, G.: Two novel mutations confirm FGD1 is responsible for the Aarskog syndrome. Europ. J. Hum.

Further studies establishing the function and utilities of FGD1 are found in John Hopkins OMIM database record ID 305400, and in sited publications numbered 10641-10644, 10966-10646, 3258, 10967-10648, 3259, 10649-10656, 10968-1067 and 10822-10826 listed in the bibliography section hereinbelow, which are also hereby incorporated by reference. PAG (Accession NM_018440) is another VGAM1593 host target gene. PAG BINDING SITE is HOST TARGET binding site found in the 3' untranslated region of mRNA encoded by PAG, corresponding to a HOST TARGET binding site such as BINDING SITE I, BINDING SITE II or BINDING SITE III. Table 2 illustrates the complementarity of the nucleotide sequences of PAG BINDING SITE, designated SEQ ID:20510, to the nucleotide sequence of VGAM1593 RNA, herein designated VGAM RNA, also designated SEQ ID:4304.

Another function of VGAM1593 is therefore inhibition of PAG (Accession NM_018440). Accordingly, utilities of VGAM1593 include diagnosis, prevention and treatment of diseases and clinical conditions associated with PAG. Sialyltransferase 1 (beta-galactoside alpha-2,6-sialytransferase) (SIAT1, Accession NM_003032) is another VGAM1593 host target gene. SIAT1 BINDING SITE is HOST TARGET binding site found in the 3' untranslated region of mRNA encoded by SIAT1, corresponding to a HOST TARGET binding site such as BINDING SITE I, BINDING SITE II or BINDING SITE III. Table 2 illustrates the complementarity of the nucleotide sequences of SIAT1 BINDING SITE, designated SEQ ID:8976, to the nucleotide sequence of VGAM1593 RNA, herein designated VGAM RNA, also designated SEQ ID:4304.

Another function of VGAM1593 is therefore inhibition of Sialyltransferase 1 (beta-galactoside alpha-2,6-sialytransferase) (SIAT1, Accession NM_003032), a gene which transfers sialic acid from the donor of substrate cmp- sialic acid to galactose containing acceptor substrates. Accordingly, utilities of VGAM1593 include diagnosis, prevention and treatment of diseases and clinical conditions associated with SIAT1. The function of SIAT1 and its association with various diseases and clinical conditions, has been established by previous studies, as described hereinabove with reference to VGAM1224. Zinc Finger Protein 10 (KOX 1) (ZNF10, Accession NM_015394) is another VGAM1593 host target gene. ZNF10 BINDING SITE is HOST TARGET binding site found in the 3' untranslated region of mRNA encoded by ZNF10, corresponding to a HOST TARGET binding site such as BINDING SITE I, BINDING SITE II or BINDING SITE III. Table 2 illustrates the complementarity of the nucleotide sequences of ZNF10 BINDING SITE, designated SEQ ID:17696, to the nucleotide sequence of VGAM1593 RNA, herein designated VGAM RNA, also designated SEQ ID:4304.

Another function of VGAM1593 is therefore inhibition of Zinc Finger Protein 10 (KOX 1) (ZNF10, Accession NM_015394), a gene which may function as a transcriptional regulator. Accordingly, utilities of VGAM1593 include diagnosis, prevention and treatment of diseases and clinical conditions associated with ZNF10. The function of ZNF10 and its association with various diseases and clinical conditions, has been established by previous studies, as described hereinabove with reference to VGAM36. Calneuron 1 (CALN1, Accession NM_031468) is another VGAM1593 host target gene. CALN1 BINDING SITE is HOST TARGET binding site found in the 3' untranslated region of mRNA encoded by CALN1, corresponding to a HOST TARGET binding site such as BINDING SITE I, BINDING SITE II or BINDING SITE III. Table 2 illustrates the complementarity of the nucleotide sequences of CALN1 BINDING SITE, designated SEQ ID:25518, to the nucleotide sequence of VGAM1593 RNA, herein designated VGAM RNA, also designated SEQ ID:4304.

Another function of VGAM1593 is therefore inhibition of Calneuron 1 (CALN1, Accession NM_031468). Accordingly, utilities of VGAM1593 include diagnosis, prevention and treatment of diseases and clinical conditions associated with CALN1. Cathepsin O (CTSO, Accession NM_001334) is another VGAM1593 host target gene. CTSO BINDING SITE is HOST TARGET binding site found in the 3' untranslated region of mRNA encoded by CTSO, corresponding to a HOST TARGET binding site such as BINDING SITE I, BINDING SITE II or BINDING SITE III. Table 2 illustrates the complementarity of the nucleotide sequences of CTSO BINDING SITE, designated SEQ ID:7017, to the nucleotide sequence of VGAM1593 RNA, herein designated VGAM RNA, also designated SEQ ID:4304.

Another function of VGAM1593 is therefore inhibition of Cathepsin O (CTSO, Accession NM_001334). Accordingly, utilities of VGAM1593 include diagnosis, prevention and treatment of diseases and clinical conditions associated with CTSO. FLJ21106 (Accession NM_025097) is another VGAM1593 host target gene. FLJ21106 BINDING SITE is HOST TARGET binding site found in the 3' untranslated region of mRNA encoded by FLJ21106, corresponding to a HOST TARGET binding site such as BINDING SITE I, BINDING SITE II or BINDING SITE III. Table 2 illustrates the complementarity of the nucleotide sequences of FLJ21106 BINDING SITE, designated SEQ ID:24737, to the nucleotide sequence of VGAM1593 RNA, herein designated VGAM RNA, also designated SEQ ID:4304.

Another function of VGAM1593 is therefore inhibition of FLJ21106 (Accession NM_025097). Accordingly, utilities of VGAM1593 include diagnosis, prevention and treatment of diseases and clinical conditions associated with FLJ21106. M96 (Accession NM_007358) is another VGAM1593 host target gene. M96 BINDING SITE is HOST TARGET binding site found in the 3' untranslated region of mRNA encoded by M96, corresponding to a HOST TARGET binding site such as BINDING SITE I, BINDING SITE II or BINDING SITE III. Table 2 illustrates the complementarity of the nucleotide sequences of M96 BINDING SITE, designated SEQ ID:14289, to the nucleotide sequence of VGAM1593 RNA, herein designated VGAM RNA, also designated SEQ ID:4304.

Another function of VGAM1593 is therefore inhibition of M96 (Accession NM_007358). Accordingly, utilities of VGAM1593 include diagnosis, prevention and treatment of diseases and clinical conditions associated with M96. PRO1843 (Accession NM_018507) is another VGAM1593 host target gene. PRO1843 BINDING SITE is HOST TARGET binding site found in the 5' untranslated region of mRNA encoded by PRO1843, corresponding to a HOST TARGET binding site such as BINDING SITE I, BINDING SITE II or BINDING SITE III. Table 2 illustrates the complementarity of the nucleotide sequences of PRO1843 BINDING SITE, designated SEQ ID:20575, to the nucleotide sequence of VGAM1593 RNA, herein designated VGAM RNA, also designated SEQ ID:4304.

Another function of VGAM1593 is therefore inhibition of PRO1843 (Accession NM_018507). Accordingly, utilities of VGAM1593 include diagnosis, prevention and treatment of diseases and clinical conditions associated with PRO1843. PRO2958 (Accession NM_018546) is another VGAM1593 host target gene. PRO2958 BINDING SITE is HOST TARGET binding site found in the 3' untranslated region of mRNA encoded by PRO2958, corresponding to a HOST TARGET binding site such as BINDING SITE I, BINDING SITE II or BINDING SITE III. Table 2 illustrates the complementarity of the nucleotide sequences of PRO2958 BINDING SITE, designated SEQ ID:20628, to the nucleotide sequence of VGAM1593 RNA, herein designated VGAM RNA, also designated SEQ ID:4304.

Another function of VGAM1593 is therefore inhibition of PRO2958 (Accession NM_018546). Accordingly, utilities of VGAM1593 include diagnosis, prevention and treatment of diseases and clinical conditions associated with PRO2958. LOC129676 (Accession XM_065341) is another VGAM1593 host target gene. LOC129676 BINDING SITE is HOST TARGET binding site found in the 5' untranslated region of mRNA encoded by LOC129676, corresponding to a HOST TARGET binding site such as BINDING SITE I, BINDING SITE II or BINDING SITE III. Table 2 illustrates the complementarity of the nucleotide sequences of LOC129676 BINDING SITE, designated SEQ ID:37290, to the nucleotide sequence of VGAM1593 RNA, herein designated VGAM RNA, also designated SEQ ID:4304.

Another function of VGAM1593 is therefore inhibition of LOC129676 (Accession XM_065341). Accordingly, utilities of VGAM1593 include diagnosis, prevention and treatment of diseases and clinical conditions associated with LOC129676. LOC131583 (Accession XM_067456) is another VGAM1593 host target gene. LOC131583 BINDING SITE is HOST TARGET binding site found in the 3' untranslated region of mRNA encoded by LOC131583, corresponding to a HOST TARGET binding site such as BINDING SITE I, BINDING SITE II or BINDING SITE III. Table 2 illustrates the complementarity of the nucleotide sequences of LOC131583 BINDING SITE, designated SEQ ID:37357, to the nucleotide sequence of VGAM1593 RNA, herein designated VGAM RNA, also designated SEQ ID:4304.

Another function of VGAM1593 is therefore inhibition of LOC131583 (Accession XM_067456). Accordingly, utilities of VGAM1593 include diagnosis, prevention and treatment of diseases and clinical conditions associated with LOC131583. LOC91291 (Accession XM_037478) is another VGAM1593 host target gene. LOC91291 BINDING SITE is HOST TARGET binding site found in the 5' untranslated region of mRNA encoded by LOC91291, corresponding to a HOST TARGET binding site such as BINDING SITE I, BINDING SITE II or BINDING SITE III. Table 2 illustrates the complementarity of the nucleotide sequences of LOC91291 BINDING SITE, designated SEQ ID:32632, to the nucleotide sequence of VGAM1593 RNA, herein designated VGAM RNA, also designated SEQ ID:4304.

Another function of VGAM1593 is therefore inhibition of LOC91291 (Accession XM_037478). Accordingly, utilities of VGAM1593 include diagnosis, prevention and treatment of diseases and clinical conditions associated with LOC91291. FIG. 1 further provides a conceptual description of a novel bioinformatically detected viral gene of the present invention, referred to here as Viral Genomic Address Messenger 1594 (VGAM1594) viral gene, which modulates expression of respective host target genes thereof, the function and utility of which host target genes is known in the art.

VGAM1594 is a novel bioinformatically detected regulatory, non protein coding, viral micro RNA (miRNA) gene. The method by which VGAM1594 was detected is described hereinabove with reference to FIGS. 1-8.

VGAM1594 gene, herein designated VGAM GENE, is a viral gene contained in the genome of Leek Yellow Stripe Potyvirus. VGAM1594 host target gene, herein designated VGAM HOST TARGET GENE, is a human gene contained in the human genome.

VGAM1594 gene encodes a VGAM1594 precursor RNA, herein designated VGAM PRECURSOR RNA. Similar to other miRNA genes, and unlike most ordinary genes, VGAM1594 precursor RNA does not encode a protein. A nucleotide sequence identical or highly similar to the nucleotide sequence of VGAM1594 precursor RNA is designated SEQ ID:1580, and is provided hereinbelow with reference to the sequence listing part. Nucleotide sequence SEQ ID:1580 is located at position 10003 relative to the genome of Leek Yellow Stripe Potyvirus.

VGAM1594 precursor RNA folds onto itself, forming VGAM1594 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1594 folded precursor RNA into VGAM1594 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM1594 RNA is designated SEQ ID:4305, and is provided hereinbelow with reference to the sequence listing part.

VGAM1594 host target gene, herein designated VGAM HOST TARGET GENE, encodes a corresponding messenger RNA, VGAM1594 host target RNA, herein designated VGAM HOST TARGET RNA. VGAM1594 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1594 RNA, herein designated VGAM RNA, binds complementarily to one or more host target binding sites located in untranslated regions of VGAM1594 host target RNA, herein designated VGAM HOST TARGET RNA. This complementary binding is due to the fact that the nucleotide sequence of VGAM1594 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1594 RNA, herein designated VGAM RNA, may have a different number of host target binding sites in untranslated regions of a VGAM1594 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1594 RNA, herein designated VGAM RNA, to host target binding sites on VGAM1594 host target RNA, herein designated VGAM HOST TARGET RNA, such as BINDING SITE I, BINDING SITE II and BINDING SITE III, inhibits translation of VGAM1594 host target RNA into VGAM1594 host target protein, herein designated VGAM HOST TARGET PROTEIN. VGAM host target protein is therefore outlined by a broken line.

It is appreciated that VGAM1594 host target gene, herein designated VGAM HOST TARGET GENE, in fact represents a plurality of VGAM1594 host target genes. The mRNA of each one of this plurality of VGAM1594 host target genes comprises one or more host target binding sites, each having a nucleotide sequence which is at least partly complementary to VGAM1594 RNA, herein designated VGAM RNA, and which when bound by VGAM1594 RNA causes inhibition of translation of respective one or more VGAM1594 host target proteins.

It is further appreciated by one skilled in the art that the mode of translational inhibition illustrated by FIG. 1 with specific reference to translational inhibition exerted by VGAM1594 gene, herein designated VGAM GENE, on one or more VGAM1594 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1594 is inhibition of expression of host target genes, as part of a novel viral mechanism of attacking a host. Accordingly, utilities of VGAM1594 include diagnosis, prevention and treatment of viral infection by Leek Yellow Stripe Potyvirus. Specific functions, and accordingly utilities, of VGAM1594 correlate with, and may be deduced from, the identity of the host target genes which VGAM1594 binds and inhibits, and the function of these host target genes, as elaborated hereinbelow.

Nucleotide sequences of the VGAM1594 precursor RNA, herein designated VGAM PRECURSOR RNA, and of the 'diced' VGAM1594 RNA, herein designated VGAM RNA, and a schematic representation of the secondary folding of VGAM1594 folded precursor RNA, herein designated VGAM FOLDED PRECURSOR RNA, of VGAM1594 are further described hereinbelow with reference to Table 1.

Nucleotide sequences of host target binding sites, such as BINDING SITE-I, BINDING SITE-II and BINDING SITE-III of FIG. 1, found on VGAM1594 host target RNA, and schematic representation of the complementarity of each of these host target binding sites to VGAM1594 RNA, herein designated VGAM RNA, are described hereinbelow with reference to Table 2.

As mentioned hereinabove with reference to FIG. 1, a function of VGAM1594 gene, herein designated VGAM is inhibition of expression of VGAM1594 target genes. It is appreciated that specific functions, and accordingly utilities, of VGAM1594 correlate with, and may be deduced from, the identity of the target genes which VGAM1594 binds and inhibits, and the function of these target genes, as elaborated hereinbelow.

Protein Tyrosine Phosphatase, Receptor Type, O (PTPRO, Accession NM_030667) is a VGAM1594 host target gene. PTPRO BINDING SITE1 through PTPRO BINDING SITE5 are HOST TARGET binding sites found in untranslated regions of mRNA encoded by PTPRO, corresponding to HOST TARGET binding sites such as BINDING SITE I, BINDING SITE II or BINDING SITE III. Table 2 illustrates the complementarity of the nucleotide sequences of PTPRO BINDING SITE1 through PTPRO BINDING SITE5, designated SEQ ID:25001, SEQ ID:25025, SEQ ID:25016, SEQ ID:8736 and SEQ ID:25007 respectively, to the nucleotide sequence of VGAM1594 RNA, herein designated VGAM RNA, also designated SEQ ID:4305.

A function of VGAM1594 is therefore inhibition of Protein Tyrosine Phosphatase, Receptor Type, O (PTPRO, Accession NM_030667), a gene which may function as a cell contact receptor that mediates and controls cell-cell signals. Accordingly, utilities of VGAM1594 include diagnosis, prevention and treatment of diseases and clinical conditions associated with PTPRO. The function of PTPRO and its association with various diseases and clinical conditions, has been established by previous studies, as described hereinabove with reference to VGAM140. Peptidoglycan Recognition Protein (PGLYRP, Accession NM_052890) is another VGAM1594 host target gene. PGLYRP BINDING SITE is HOST TARGET binding site found in the 3' untranslated region of mRNA encoded by PGLYRP, corresponding to a HOST TARGET binding site such as BINDING SITE I, BINDING SITE II or BINDING SITE III. Table 2 illustrates the complementarity of the nucleotide sequences of PGLYRP BINDING SITE, designated SEQ ID:27480, to the nucleotide sequence of VGAM1594 RNA, herein designated VGAM RNA, also designated SEQ ID:4305.

Another function of VGAM1594 is therefore inhibition of Peptidoglycan Recognition Protein (PGLYRP, Accession NM_052890). Accordingly, utilities of VGAM1594 include diagnosis, prevention and treatment of diseases and clinical conditions associated with PGLYRP. Protein Tyrosine Phosphatase, Non-receptor Type Substrate 1 (PTPNS1, Accession NM_080792) is another VGAM1594 host target gene. PTPNS1 BINDING SITE is HOST TARGET binding site found in the 3' untranslated region of mRNA encoded by PTPNS1, corresponding to a HOST TARGET binding site such as BINDING SITE I, BINDING SITE II or BINDING SITE III. Table 2 illustrates the complementarity of the nucleotide sequences of PTPNS1 BINDING SITE, designated SEQ ID:28051, to the nucleotide sequence of VGAM1594 RNA, herein designated VGAM RNA, also designated SEQ ID:4305.

Another function of VGAM1594 is therefore inhibition of Protein Tyrosine Phosphatase, Non-receptor Type Substrate 1 (PTPNS1, Accession NM_080792). Accordingly, utilities of VGAM1594 include diagnosis, prevention and treatment of diseases and clinical conditions associated with PTPNS1. LOC146540 (Accession XM_085497) is another VGAM1594 host target gene. LOC146540 BINDING SITE is HOST TARGET binding site found in the 3' untranslated region of mRNA encoded by LOC146540, corresponding to a HOST TARGET binding site such as BINDING SITE I, BINDING SITE II or BINDING SITE III. Table 2 illustrates the complementarity of the nucleotide sequences of LOC146540 BINDING SITE, designated SEQ ID:38200, to the nucleotide sequence of VGAM1594 RNA, herein designated VGAM RNA, also designated SEQ ID:4305.

Another function of VGAM1594 is therefore inhibition of LOC146540 (Accession XM_085497). Accordingly, utilities of VGAM1594 include diagnosis, prevention and treatment of diseases and clinical conditions associated with LOC146540. LOC162333 (Accession XM_102591) is another VGAM1594 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42134, to the nucleotide sequence of VGAM1594 RNA, herein designated VGAM RNA, also designated SEQ ID:4305.

Another function of VGAM1594 is therefore inhibition of LOC162333 (Accession XM_102591). Accordingly, utilities of VGAM1594 include diagnosis, prevention and treatment of diseases and clinical conditions associated with LOC162333. LOC92597 (Accession XM_046066) is another VGAM1594 host target gene. LOC92597 BINDING SITE is HOST TARGET binding site found in the 3' untranslated region of mRNA encoded by LOC92597, corresponding to a HOST TARGET binding site such as BINDING SITE I, BINDING SITE II or BINDING SITE III. Table 2 illustrates the complementarity of the nucleotide sequences of LOC92597 BINDING SITE, designated SEQ ID:34672, to the nucleotide sequence of VGAM1594 RNA, herein designated VGAM RNA, also designated SEQ ID:4305.

Another function of VGAM1594 is therefore inhibition of LOC92597 (Accession XM_046066). Accordingly, utilities of VGAM1594 include diagnosis, prevention and treatment of diseases and clinical conditions associated with LOC92597. FIG. 1 further provides a conceptual description of a novel bioinformatically detected viral gene of the present invention, referred to here as Viral Genomic Address Messenger 1595 (VGAM1595) viral gene, which modulates expression of respective host target genes thereof, the function and utility of which host target genes is known in the art.

VGAM1595 is a novel bioinformatically detected regulatory, non protein coding, viral micro RNA (miRNA) gene. The method by which VGAM1595 was detected is described hereinabove with reference to FIGS. 1-8.

VGAM1595 gene, herein designated VGAM GENE, is a viral gene contained in the genome of Leek Yellow Stripe Potyvirus. VGAM1595 host target gene, herein designated VGAM HOST TARGET GENE, is a human gene contained in the human genome.

VGAM1595 gene encodes a VGAM1595 precursor RNA, herein designated VGAM PRECURSOR RNA. Similar to other miRNA genes, and unlike most ordinary genes, VGAM1595 precursor RNA does not encode a protein. A nucleotide sequence identical or highly similar to the nucleotide sequence of VGAM1595 precursor RNA is designated SEQ ID:1581, and is provided hereinbelow with reference to the sequence listing part. Nucleotide sequence SEQ ID:1581 is located at position 6252 relative to the genome of Leek Yellow Stripe Potyvirus.

VGAM1595 precursor RNA folds onto itself, forming VGAM1595 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1595 folded precursor RNA into VGAM1595 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1595 RNA is designated SEQ ID:4306, and is provided hereinbelow with reference to the sequence listing part.

VGAM1595 host target gene, herein designated VGAM HOST TARGET GENE, encodes a corresponding messenger RNA, VGAM1595 host target RNA, herein designated VGAM HOST TARGET RNA. VGAM1595 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1595 RNA, herein designated VGAM RNA, binds complementarily to one or more host target binding sites located in untranslated regions of VGAM1595 host target RNA, herein designated VGAM HOST TARGET RNA. This complementary binding is due to the fact that the nucleotide sequence of VGAM1595 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1595 RNA, herein designated VGAM RNA, may have a different number of host target binding sites in untranslated regions of a VGAM1595 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1595 RNA, herein designated VGAM RNA, to host target binding sites on VGAM1595 host target RNA, herein designated VGAM HOST TARGET RNA, such as BINDING SITE I, BINDING SITE II and BINDING SITE III, inhibits translation of VGAM1595 host target RNA into VGAM1595 host target protein, herein designated VGAM HOST TARGET PROTEIN. VGAM host target protein is therefore outlined by a broken line.

It is appreciated that VGAM1595 host target gene, herein designated VGAM HOST TARGET GENE, in fact represents a plurality of VGAM1595 host target genes. The mRNA of each one of this plurality of VGAM1595 host target genes comprises one or more host target binding sites, each having a nucleotide sequence which is at least partly complementary to VGAM1595 RNA, herein designated VGAM RNA, and which when bound by VGAM1595 RNA causes inhibition of translation of respective one or more VGAM1595 host target proteins.

It is further appreciated by one skilled in the art that the mode of translational inhibition illustrated by FIG. 1 with specific reference to translational inhibition exerted by VGAM1595 gene, herein designated VGAM GENE, on one or more VGAM1595 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1595 is inhibition of expression of host target genes, as part of a novel viral mechanism of attacking a host. Accordingly, utilities of VGAM1595 include diagnosis, prevention and treatment of viral infection by Leek Yellow Stripe Potyvirus. Specific functions, and accordingly utilities, of VGAM1595 correlate with, and may be deduced from, the identity of the host target genes which VGAM1595 binds and inhibits, and the function of these host target genes, as elaborated hereinbelow.

Nucleotide sequences of the VGAM1595 precursor RNA, herein designated VGAM PRECURSOR RNA, and of the 'diced' VGAM1595 RNA, herein designated VGAM RNA, and a schematic representation of the secondary folding of VGAM1595 folded precursor RNA, herein designated VGAM FOLDED PRECURSOR RNA, of VGAM1595 are further described hereinbelow with reference to Table 1.

Nucleotide sequences of host target binding sites, such as BINDING SITE-I, BINDING SITE-II and BINDING SITE-III of FIG. 1, found on VGAM1595 host target RNA, and schematic representation of the complementarity of each of these host target binding sites to VGAM1595 RNA, herein designated VGAM RNA, are described hereinbelow with reference to Table 2.

As mentioned hereinabove with reference to FIG. 1, a function of VGAM1595 gene, herein designated VGAM is inhibition of expression of VGAM1595 target genes. It is appreciated that specific functions, and accordingly utilities, of VGAM1595 correlate with, and may be deduced from, the identity of the target genes which VGAM1595 binds and inhibits, and the function of these target genes, as elaborated hereinbelow.

Formin Homology 2 Domain Containing 2 (FHOD2, Accession XM_057927) is a VGAM1595 host target gene. FHOD2 BINDING SITE is HOST TARGET binding site found in the 3' untranslated region of mRNA encoded by FHOD2, corresponding to a HOST TARGET binding site such as BINDING SITE I, BINDING SITE II or BINDING SITE III. Table 2 illustrates the complementarity of the nucleotide sequences of FHOD2 BINDING SITE, designated SEQ ID:36552, to the nucleotide sequence of VGAM1595 RNA, herein designated VGAM RNA, also designated SEQ ID:4306.

A function of VGAM1595 is therefore inhibition of Formin Homology 2 Domain Containing 2 (FHOD2, Accession XM_057927). Accordingly, utilities of VGAM1595 include diagnosis, prevention and treatment of diseases and clinical conditions associated with FHOD2. Protocadherin 19 (PCDH19, Accession XM_033173) is another VGAM1595 host target gene. PCDH19 BINDING SITE is HOST TARGET binding site found in the 3' untranslated region of mRNA encoded by PCDH19, corresponding to a HOST TARGET binding site such as BINDING SITE I, BINDING SITE II or BINDING SITE III. Table 2 illustrates the complementarity of the nucleotide sequences of PCDH19 BINDING SITE, designated SEQ ID:31861, to the nucleotide sequence of VGAM1595 RNA, herein designated VGAM RNA, also designated SEQ ID:4306.

Another function of VGAM1595 is therefore inhibition of Protocadherin 19 (PCDH19, Accession XM_033173). Accordingly, utilities of VGAM1595 include diagnosis, prevention and treatment of diseases and clinical conditions associated with PCDH19. LOC124222 (Accession XM_058784) is another VGAM1595 host target gene. LOC124222 BINDING SITE is HOST TARGET binding site found in the 3' untranslated region of mRNA encoded by LOC124222, corresponding to a HOST TARGET binding site such as BINDING SITE I, BINDING SITE II or BINDING SITE III. Table 2 illustrates the complementarity of the nucleotide sequences of LOC124222 BINDING SITE, designated SEQ ID:36740, to the nucleotide sequence of VGAM1595 RNA, herein designated VGAM RNA, also designated SEQ ID:4306.

Another function of VGAM1595 is therefore inhibition of LOC124222 (Accession XM_058784). Accordingly, utilities of VGAM1595 include diagnosis, prevention and treatment of diseases and clinical conditions associated with LOC124222. LOC195977 (Accession XM_113625) is another VGAM1595 host target gene. LOC195977 BINDING SITE is HOST TARGET binding site found in the 3' untranslated region of mRNA encoded by LOC195977, corresponding to a HOST TARGET binding site such as BINDING SITE I, BINDING SITE II or BINDING SITE III. Table 2 illustrates the complementarity of the nucleotide sequences of LOC195977 BINDING SITE, designated SEQ ID:42298, to the nucleotide sequence of VGAM1595 RNA, herein designated VGAM RNA, also designated SEQ ID:4306.

Another function of VGAM1595 is therefore inhibition of LOC195977 (Accession XM_113625). Accordingly, utilities of VGAM1595 include diagnosis, prevention and treatment of diseases and clinical conditions associated with LOC195977. LOC202134 (Accession XM_117365) is another VGAM1595 host target gene. LOC202134 BINDING SITE is HOST TARGET binding site found in the 3' untranslated region of mRNA encoded by LOC202134, corresponding to a HOST TARGET binding site such as BINDING SITE I, BINDING SITE II or BINDING SITE III. Table 2 illustrates the complementarity of the nucleotide sequences of LOC202134 BINDING SITE, designated SEQ ID:43413, to the nucleotide sequence of VGAM1595 RNA, herein designated VGAM RNA, also designated SEQ ID:4306.

Another function of VGAM1595 is therefore inhibition of LOC202134 (Accession XM_117365). Accordingly, utilities of VGAM1595 include diagnosis, prevention and treatment of diseases and clinical conditions associated with LOC202134. FIG. 1 further provides a conceptual description of a novel bioinformatically detected viral gene of the present invention, referred to here as Viral Genomic Address Messenger 1596 (VGAM1596) viral gene, which modulates expression of respective host target genes thereof, the function and utility of which host target genes is known in the art.

VGAM1596 is a novel bioinformatically detected regulatory, non protein coding, viral micro RNA (miRNA) gene. The method by which VGAM1596 was detected is described hereinabove with reference to FIGS. 1-8.

VGAM1596 gene, herein designated VGAM GENE, is a viral gene contained in the genome of Leek Yellow Stripe Potyvirus. VGAM1596 host target gene, herein designated VGAM HOST TARGET GENE, is a human gene contained in the human genome.

VGAM1596 gene encodes a VGAM1596 precursor RNA, herein designated VGAM PRECURSOR RNA. Similar to other miRNA genes, and unlike most ordinary genes, VGAM1596 precursor RNA does not encode a protein. A nucleotide sequence identical or highly similar to the nucleotide sequence of VGAM1596 precursor RNA is designated SEQ ID:1582, and is provided hereinbelow with reference to the sequence listing part. Nucleotide sequence SEQ ID:1582 is located at position 3823 relative to the genome of Leek Yellow Stripe Potyvirus.

VGAM1596 precursor RNA folds onto itself, forming VGAM1596 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1596 folded precursor RNA into VGAM1596 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1596 RNA is designated SEQ ID:4307, and is provided hereinbelow with reference to the sequence listing part.

VGAM1596 host target gene, herein designated VGAM HOST TARGET GENE, encodes a corresponding messenger RNA, VGAM1596 host target RNA, herein designated VGAM HOST TARGET RNA. VGAM1596 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1596 RNA, herein designated VGAM RNA, binds complementarily to one or more host target binding sites located in untranslated regions of VGAM1596 host target RNA, herein designated VGAM HOST TARGET RNA. This complementary binding is due to the fact that the nucleotide sequence of VGAM1596 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1596 RNA, herein designated VGAM RNA, may have a different number of host target binding sites in untranslated regions of a VGAM1596 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1596 RNA, herein designated VGAM RNA, to host target binding sites on VGAM1596 host target RNA, herein designated VGAM HOST TARGET RNA, such as BINDING SITE I, BINDING SITE II and BINDING SITE III, inhibits translation of VGAM1596 host target RNA into VGAM1596 host target protein, herein designated VGAM HOST TARGET PROTEIN. VGAM host target protein is therefore outlined by a broken line.

It is appreciated that VGAM1596 host target gene, herein designated VGAM HOST TARGET GENE, in fact represents a plurality of VGAM1596 host target genes. The mRNA of each one of this plurality of VGAM1596 host target genes comprises one or more host target binding sites, each having a nucleotide sequence which is at least partly complementary to VGAM1596 RNA, herein designated VGAM RNA, and which when bound by VGAM1596 RNA causes inhibition of translation of respective one or more VGAM1596 host target proteins.

It is further appreciated by one skilled in the art that the mode of translational inhibition illustrated by FIG. 1 with specific reference to translational inhibition exerted by VGAM1596 gene, herein designated VGAM GENE, on one or more VGAM1596 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1596 is inhibition of expression of host target genes, as part of a novel viral mechanism of attacking a host. Accordingly, utilities of VGAM1596 include diagnosis, prevention and treatment of viral infection by Leek Yellow Stripe Potyvirus. Specific functions, and accordingly utilities, of VGAM1596 correlate with, and may be deduced from, the identity of the host target genes which VGAM1596 binds and inhibits, and the function of these host target genes, as elaborated hereinbelow.

Nucleotide sequences of the VGAM1596 precursor RNA, herein designated VGAM PRECURSOR RNA, and of the 'diced' VGAM1596 RNA, herein designated VGAM RNA, and a schematic representation of the secondary folding of VGAM1596 folded precursor RNA, herein designated VGAM FOLDED PRECURSOR RNA, of VGAM1596 are further described hereinbelow with reference to Table 1.

Nucleotide sequences of host target binding sites, such as BINDING SITE-I, BINDING SITE-II and BINDING SITE-III of FIG. 1, found on VGAM1596 host target RNA, and schematic representation of the complementarity of each of these host target binding sites to VGAM1596 RNA, herein designated VGAM RNA, are described hereinbelow with reference to Table 2.

As mentioned hereinabove with reference to FIG. 1, a function of VGAM1596 gene, herein designated VGAM is inhibition of expression of VGAM1596 target genes. It is appreciated that specific functions, and accordingly utilities, of VGAM1596 correlate with, and may be deduced from, the identity of the target genes which VGAM1596 binds and inhibits, and the function of these target genes, as elaborated hereinbelow.

Discs, Large (Drosophila) Homolog 5 (DLG5, Accession XM_096398) is a VGAM1596 host target gene. DLG5 BINDING SITE is HOST TARGET binding site found in the 5' untranslated region of mRNA encoded by DLG5, corresponding to a HOST TARGET binding site such as BINDING SITE I, BINDING SITE II or BINDING SITE III. Table 2 illustrates the complementarity of the nucleotide sequences of DLG5 BINDING SITE, designated SEQ ID:40340, to the nucleotide sequence of VGAM1596 RNA, herein designated VGAM RNA, also designated SEQ ID:4307.

A function of VGAM1596 is therefore inhibition of Discs, Large (Drosophila) Homolog 5 (DLG5, Accession XM_096398), a gene which may transmit extracellular signals to inhibit cell proliferation. Accordingly, utilities of VGAM1596 include diagnosis, prevention and treatment of diseases and clinical conditions associated with DLG5. The function of DLG5 and its association with various diseases and clinical conditions, has been established by previous studies, as described hereinabove with reference to VGAM444. Enhancer of Zeste Homolog 1 (Drosophila) (EZH1, Accession NM_001991) is another VGAM1596 host target gene. EZH1 BINDING SITE is HOST TARGET binding site found in the 3' untranslated region of mRNA encoded by EZH1, corresponding to a HOST TARGET binding site such as BINDING SITE I, BINDING SITE II or BINDING SITE III. Table 2 illustrates the complementarity of the nucleotide sequences of EZH1 BINDING SITE, designated SEQ ID:7716, to the nucleotide sequence of VGAM1596 RNA, herein designated VGAM RNA, also designated SEQ ID:4307.

Another function of VGAM1596 is therefore inhibition of Enhancer of Zeste Homolog 1 (Drosophila) (EZH1, Accession NM_001991), a gene which may act in transcriptional regulation and heterochromatin maintenance. Accordingly, utilities of VGAM1596 include diagnosis, prevention and treatment of diseases and clinical conditions associated with EZH1. The function of EZH1 and its association with various diseases and clinical conditions, has been established by previous studies, as described hereinabove with reference to VGAM251. Aldehyde Dehydrogenase 5 Family, Member A1 (succinate-semialdehyde dehydrogenase) (ALDH5A1, Accession NM_001080) is another VGAM1596 host target gene. ALDH5A1 BINDING SITE is HOST TARGET binding site found in the 3' untranslated region of mRNA encoded by ALDH5A1, corresponding to a HOST TARGET binding site such as BINDING SITE I, BINDING SITE II or BINDING SITE III. Table 2 illustrates the complementarity of the nucleotide sequences of ALDH5A1 BINDING SITE, designated SEQ ID:6741, to the nucleotide sequence of VGAM1596 RNA, herein designated VGAM RNA, also designated SEQ ID:4307.

Another function of VGAM1596 is therefore inhibition of Aldehyde Dehydrogenase 5 Family, Member A1 (succinate-semialdehyde dehydrogenase) (ALDH5A1, Accession NM_001080). Accordingly, utilities of VGAM1596 include diagnosis, prevention and treatment of diseases and clinical conditions associated with ALDH5A1. Chromosome 20 Open Reading Frame 121 (C20orf121, Accession NM_024331) is another VGAM1596 host target gene. C20orf121 BINDING SITE is HOST TARGET binding site found in the 3' untranslated region of mRNA encoded by C20orf121, corresponding to a HOST TARGET binding site such as BINDING SITE I, BINDING SITE II or BINDING SITE III. Table 2 illustrates the complementarity of the nucleotide sequences of C20orf121 BINDING SITE, designated SEQ ID:23635, to the nucleotide sequence of VGAM1596 RNA, herein designated VGAM RNA, also designated SEQ ID:4307.

Another function of VGAM1596 is therefore inhibition of Chromosome 20 Open Reading Frame 121 (C20orf121, Accession NM_024331). Accordingly, utilities of VGAM1596 include diagnosis, prevention and treatment of diseases and clinical conditions associated with C20orf121. Solute Carrier Family 26, Member 7 (SLC26A7, Accession NM_052832) is another VGAM1596 host target gene. SLC26A7 BINDING SITE1 and SLC26A7 BINDING SITE2 are HOST TARGET binding sites found in untranslated regions of mRNA encoded by SLC26A7, corresponding to HOST TARGET binding sites such as BINDING SITE I, BINDING SITE II or BINDING SITE III. Table 2 illustrates the complementarity of the nucleotide sequences of SLC26A7 BINDING SITE1 and SLC26A7 BINDING SITE2, designated SEQ ID:27412 and SEQ ID:28624 respectively, to the nucleotide sequence of VGAM1596 RNA, herein designated VGAM RNA, also designated SEQ ID:4307.

Another function of VGAM1596 is therefore inhibition of Solute Carrier Family 26, Member 7 (SLC26A7, Accession NM_052832). Accordingly, utilities of VGAM1596 include diagnosis, prevention and treatment of diseases and clinical conditions associated with SLC26A7. FIG. 1 further provides a conceptual description of a novel bioinformatically detected viral gene of the present invention, referred to here as Viral Genomic Address Messenger 1597 (VGAM1597) viral gene, which modulates expression of respective host target genes thereof, the function and utility of which host target genes is known in the art.

VGAM1597 is a novel bioinformatically detected regulatory, non protein coding, viral micro RNA (miRNA) gene. The method by which VGAM1597 was detected is described hereinabove with reference to FIGS. 1-8.

VGAM1597 gene, herein designated VGAM GENE, is a viral gene contained in the genome of Leek Yellow Stripe Potyvirus. VGAM1597 host target gene, herein designated VGAM HOST TARGET GENE, is a human gene contained in the human genome.

VGAM1597 gene encodes a VGAM1597 precursor RNA, herein designated VGAM PRECURSOR RNA. Similar to other miRNA genes, and unlike most ordinary genes, VGAM1597 precursor RNA does not encode a protein. A nucleotide sequence identical or highly similar to the nucleotide sequence of VGAM1597 precursor RNA is designated SEQ ID:1583, and is provided hereinbelow with reference to the sequence listing part. Nucleotide sequence SEQ ID:1583 is located at position 5446 relative to the genome of Leek Yellow Stripe Potyvirus.

VGAM1597 precursor RNA folds onto itself, forming VGAM1597 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1597 folded precursor RNA into VGAM1597 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM1597 RNA is designated SEQ ID:4308, and is provided hereinbelow with reference to the sequence listing part.

VGAM1597 host target gene, herein designated VGAM HOST TARGET GENE, encodes a corresponding messenger RNA, VGAM1597 host target RNA, herein designated VGAM HOST TARGET RNA. VGAM1597 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1597 RNA, herein designated VGAM RNA, binds complementarily to one or more host target binding sites located in untranslated regions of VGAM1597 host target RNA, herein designated VGAM HOST TARGET RNA. This complementary binding is due to the fact that the nucleotide sequence of VGAM1597 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1597 RNA, herein designated VGAM RNA, may have a different number of host target binding sites in untranslated regions of a VGAM1597 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1597 RNA, herein designated VGAM RNA, to host target binding sites on VGAM1597 host target RNA, herein designated VGAM HOST TARGET RNA, such as BINDING SITE I, BINDING SITE II and BINDING SITE III, inhibits translation of VGAM1597 host target RNA into VGAM1597 host target protein, herein designated VGAM HOST TARGET PROTEIN. VGAM host target protein is therefore outlined by a broken line.

It is appreciated that VGAM1597 host target gene, herein designated VGAM HOST TARGET GENE, in fact represents a plurality of VGAM1597 host target genes. The mRNA of each one of this plurality of VGAM1597 host target genes comprises one or more host target binding sites, each having a nucleotide sequence which is at least partly complementary to VGAM1597 RNA, herein designated VGAM RNA, and which when bound by VGAM1597 RNA causes inhibition of translation of respective one or more VGAM1597 host target proteins.

It is further appreciated by one skilled in the art that the mode of translational inhibition illustrated by FIG. 1 with specific reference to translational inhibition exerted by VGAM1597 gene, herein designated VGAM GENE, on one or more VGAM1597 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1597 is inhibition of expression of host target genes, as part of a novel viral mechanism of attacking a host. Accordingly, utilities of VGAM1597 include diagnosis, prevention and treatment of viral infection by Leek Yellow Stripe Potyvirus. Specific functions, and accordingly utilities, of VGAM1597 correlate with, and may be deduced from, the identity of the host target genes which VGAM1597 binds and inhibits, and the function of these host target genes, as elaborated hereinbelow.

Nucleotide sequences of the VGAM1597 precursor RNA, herein designated VGAM PRECURSOR RNA, and of the 'diced' VGAM1597 RNA, herein designated VGAM RNA, and a schematic representation of the secondary folding of VGAM1597 folded precursor RNA, herein designated VGAM FOLDED PRECURSOR RNA, of VGAM1597 are further described hereinbelow with reference to Table 1.

Nucleotide sequences of host target binding sites, such as BINDING SITE-I, BINDING SITE-II and BINDING SITE-III of FIG. 1, found on VGAM1597 host target RNA, and schematic representation of the complementarity of each of these host target binding sites to VGAM1597 RNA, herein designated VGAM RNA, are described hereinbelow with reference to Table 2.

As mentioned hereinabove with reference to FIG. 1, a function of VGAM1597 gene, herein designated VGAM is inhibition of expression of VGAM1597 target genes. It is appreciated that specific functions, and accordingly utilities, of VGAM1597 correlate with, and may be deduced from, the identity of the target genes which VGAM1597 binds and inhibits, and the function of these target genes, as elaborated hereinbelow.

Casein Kinase 2, Alpha 1 Polypeptide (CSNK2A1, Accession NM_001895) is a VGAM1597 host target gene. CSNK2A1 BINDING SITE is HOST TARGET binding site found in the 3' untranslated region of mRNA encoded by CSNK2A1, corresponding to a HOST TARGET binding site such as BINDING SITE I, BINDING SITE II or BINDING SITE III. Table 2 illustrates the complementarity of the nucleotide sequences of CSNK2A1 BINDING SITE, designated SEQ ID:7621, to the nucleotide sequence of VGAM1597 RNA, herein designated VGAM RNA, also designated SEQ ID:4308.

A function of VGAM1597 is therefore inhibition of Casein Kinase 2, Alpha 1 Polypeptide (CSNK2A1, Accession NM_001895), a gene which cphosphorylates acidic protein such as casein. Accordingly, utilities of VGAM1597 include diagnosis, prevention and treatment of diseases and clinical conditions associated with CSNK2A1. The function of CSNK2A1 has been established by previous studies. Phosphorylation of the human p53 protein (OMIM Ref. No. 191170) at ser392 is responsive to ultraviolet (UV) but not gamma irradiation. Keller et al. (2001) identified and purified a mammalian UV-activated protein kinase complex that phosphorylates ser392 in vitro. This kinase complex contains CK2 and the chromatin transcriptional elongation factor FACT, a heterodimer of SPT16 (OMIM Ref. No. 605012) and SSRP1 (OMIM Ref. No. 604328). In vitro studies showed that FACT alters the specificity of CK2 in the complex such that it selectively phosphorylates p53 over other substrates, including casein. In addition, phosphorylation by the kinase complex was found to enhance p53 activity. These results provided a potential mechanism for p53 activation by UV irradiation Doray et al. (2002) demonstrated that the Golgi-localized, gamma-ear-containing adenosine diphosphate ribosylation factor-binding proteins (GGA1, 606004 and GGA3, 606006) and the coat protein adaptor protein-1 (AP-1) complex (see OMIM Ref. No. AP1G2, 603534) colocalize in clathrin-coated buds of the trans-Golgi networks of mouse L cells and human HeLa cells. Binding studies revealed a direct interaction between the hinge domains of the GGAs and the gamma-ear domain of AP-1. Further, AP-1 contained bound casein kinase-2 that phosphorylated GGA1 and GGA3, thereby causing autoinhibition. Doray et al. (2002) demonstrated that this autoinhibition could induce the directed transfer of mannose 6-phosphate receptors (see OMIM Ref. No. 154540) from the GGAs to AP-1. Mannose 6-phosphate receptors that were defective in binding to GGAs were poorly incorporated into adaptor protein complex containing clathrin coated vesicles. Thus, Doray et al. (2002) concluded that GGAs and the AP-1 complex interact to package mannose 6-phosphate receptors into AP-1-containing coated vesicles Full details of the abovementioned studies are described in the following publications, the disclosure of which are hereby incorporated by reference:

Keller, D. M.; Zeng, X.; Wang, Y.; Zhang, Q. H.; Kapoor, M.; Shu, H.; Goodman, R.; Lozano, G.; Zhao, Y.; Lu, H.: A DNA damage-induced p53 serine 392 kinase complex contains CK2, hSpt16, and SSRP1. Molec. Cell 283-292, 2001; and Doray, B.; Ghosh, P.; Griffith, J.; Geuze, H. J.; Kornfeld, S.: Cooperation of GGAs and AP-1 in packaging MPRs at the trans-Golgi network. Science 297: 1700-1703, 2002.

Further studies establishing the function and utilities of CSNK2A1 are found in John Hopkins OMIM database record ID 115440, and in sited publications numbered 12595-12596, 1035 and 12597-12600 listed in the bibliography section hereinbelow, which are also hereby incorporated by reference. SORCS1 (Accession NM_052918) is another VGAM1597 host target gene. SORCS1 BINDING SITE is HOST TARGET binding site found in the 3' untranslated region of mRNA encoded by SORCS1, corresponding to a HOST TARGET binding site such as BINDING SITE I, BINDING SITE II or BINDING SITE III. Table 2 illustrates the complementarity of the nucleotide sequences of SORCS1 BINDING SITE, designated SEQ ID:27484, to the nucleotide sequence of VGAM1597 RNA, herein designated VGAM RNA, also designated SEQ ID:4308.

Another function of VGAM1597 is therefore inhibition of SORCS1 (Accession NM_052918). Accordingly, utilities of VGAM1597 include diagnosis, prevention and treatment of diseases and clinical conditions associated with SORCS1. DKFZP564O0423 (Accession XM_166254) is another VGAM1597 host target gene. DKFZP564O0423 BINDING SITE is HOST TARGET binding site found in the 3' untranslated region of mRNA encoded by DKFZP564O0423, corresponding to a HOST TARGET binding site such as BINDING SITE I, BINDING SITE II or BINDING SITE III. Table 2 illustrates the complementarity of the nucleotide sequences of DKFZP564O0423 BINDING SITE, designated SEQ ID:44065, to the nucleotide sequence of VGAM1597 RNA, herein designated VGAM RNA, also designated SEQ ID:4308.

Another function of VGAM1597 is therefore inhibition of DKFZP564O0423 (Accession XM_166254). Accordingly, utilities of VGAM1597 include diagnosis, prevention and treatment of diseases and clinical conditions associated with DKFZP564O0423. DKFZP586J0619 (Accession XM_088280) is another VGAM1597 host target gene. DKFZP586J0619 BINDING SITE is HOST TARGET binding site found in the 3' untranslated region of mRNA encoded by DKFZP586J0619, corresponding to a HOST TARGET binding site such as BINDING SITE I, BINDING SITE II or BINDING SITE III. Table 2 illustrates the complementarity of the nucleotide sequences of DKFZP586J0619 BINDING SITE, designated SEQ ID:39581, to the nucleotide sequence of VGAM1597 RNA, herein designated VGAM RNA, also designated SEQ ID:4308.

Another function of VGAM1597 is therefore inhibition of DKFZP586J0619 (Accession XM_088280). Accordingly, utilities of VGAM1597 include diagnosis, prevention and treatment of diseases and clinical conditions associated with DKFZP586J0619. GFR (Accession NM_012294) is another VGAM1597 host target gene. GFR BINDING SITE is HOST TARGET binding site found in the 3' untranslated region of mRNA encoded by GFR, corresponding to a HOST TARGET binding site such as BINDING SITE I, BINDING SITE II or BINDING SITE III. Table 2 illustrates the complementarity of the nucleotide sequences of GFR BINDING SITE, designated SEQ ID:14637, to the nucleotide sequence of VGAM1597 RNA, herein designated VGAM RNA, also designated SEQ ID:4308.

Another function of VGAM1597 is therefore inhibition of GFR (Accession NM_012294). Accordingly, utilities of VGAM1597 include diagnosis, prevention and treatment of diseases and clinical conditions associated with GFR. KIAA0429 (Accession NM_014751) is another VGAM1597 host target gene. KIAA0429 BINDING SITE is HOST TARGET binding site found in the 5" untranslated region of mRNA encoded by KIAA0429, corresponding to a HOST TARGET binding site such as BINDING SITE I, BINDING SITE II or BINDING SITE III. Table 2 illustrates the complementarity of the nucleotide sequences of KIAA0429 BINDING SITE, designated SEQ ID:16466, to the nucleotide sequence of VGAM1597 RNA, herein designated VGAM RNA, also designated SEQ ID:4308.

Another function of VGAM1597 is therefore inhibition of KIAA0429 (Accession NM_014751). Accordingly, utilities of VGAM1597 include diagnosis, prevention and treatment of diseases and clinical conditions associated with KIAA0429. MGC11115 (Accession NM_032310) is another VGAM1597 host target gene. MGC11115 BINDING SITE is HOST TARGET binding site found in the 3' untranslated region of mRNA encoded by MGC11115, corresponding to a HOST TARGET binding site such as BINDING SITE I, BINDING SITE II or BINDING SITE III. Table 2 illustrates the complementarity of the nucleotide sequences of MGC11115 BINDING SITE, designated SEQ ID:26093, to the nucleotide sequence of VGAM1597 RNA, herein designated VGAM RNA, also designated SEQ ID:4308.

Another function of VGAM1597 is therefore inhibition of MGC11115 (Accession NM_032310). Accordingly, utilities of VGAM1597 include diagnosis, prevention and treatment of diseases and clinical conditions associated with MGC11115. LOC151391 (Accession XM_098050) is another VGAM1597 host target gene. LOC151391 BINDING SITE is HOST TARGET binding site found in the 3' untranslated region of mRNA encoded by LOC151391, corresponding to a HOST TARGET binding site such as BINDING SITE I, BINDING SITE II or BINDING SITE III. Table 2 illustrates the complementarity of the nucleotide sequences of LOC151391 BINDING SITE, designated SEQ ID:41336, to the nucleotide sequence of VGAM1597 RNA, herein designated VGAM RNA, also designated SEQ ID:4308.

Another function of VGAM1597 is therefore inhibition of LOC151391 (Accession XM_098050). Accordingly, utilities of VGAM1597 include diagnosis, prevention and treatment of diseases and clinical conditions associated with LOC151391. LOC163882 (Accession XM_089211) is another VGAM1597 host target gene. LOC163882 BINDING SITE is HOST TARGET binding site found in the 3' untranslated region of mRNA encoded by LOC163882, corresponding to a HOST TARGET binding site such as BINDING SITE I, BINDING SITE II or BINDING SITE III. Table 2 illustrates the complementarity of the nucleotide sequences of LOC163882 BINDING SITE, designated SEQ ID:39972, to the nucleotide sequence of VGAM1597 RNA, herein designated VGAM RNA, also designated SEQ ID:4308.

Another function of VGAM1597 is therefore inhibition of LOC163882 (Accession XM_089211). Accordingly, utilities of VGAM1597 include diagnosis, prevention and treatment of diseases and clinical conditions associated with LOC163882. FIG. 1 further provides a conceptual description of a novel bioinformatically detected viral gene of the present invention, referred to here as Viral Genomic Address Messenger 1598 (VGAM1598) viral gene, which modulates expression of respective host target genes thereof, the function and utility of which host target genes is known in the art.

VGAM1598 is a novel bioinformatically detected regulatory, non protein coding, viral micro RNA (miRNA) gene. The method by which VGAM1598 was detected is described hereinabove with reference to FIGS. 1-8.

VGAM1598 gene, herein designated VGAM GENE, is a viral gene contained in the genome of Human Adenovirus E. VGAM1598 host target gene, herein designated VGAM HOST TARGET GENE, is a human gene contained in the human genome.

VGAM1598 gene encodes a VGAM1598 precursor RNA, herein designated VGAM PRECURSOR RNA. Similar to other miRNA genes, and unlike most ordinary genes, VGAM1598 precursor RNA does not encode a protein. A nucleotide sequence identical or highly similar to the nucleotide sequence of VGAM1598 precursor RNA is designated SEQ ID:1584, and is provided hereinbelow with reference to the sequence listing part. Nucleotide sequence SEQ ID:1584 is located at position 32869 relative to the genome of Human Adenovirus E.

VGAM1598 precursor RNA folds onto itself, forming VGAM1598 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1598 folded precursor RNA into VGAM1598 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1598 RNA is designated SEQ ID:4309, and is provided hereinbelow with reference to the sequence listing part.

VGAM1598 host target gene, herein designated VGAM HOST TARGET GENE, encodes a corresponding messenger RNA, VGAM1598 host target RNA, herein designated VGAM HOST TARGET RNA. VGAM1598 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1598 RNA, herein designated VGAM RNA, binds complementarily to one or more host target binding sites located in untranslated regions of VGAM1598 host target RNA, herein designated VGAM HOST TARGET RNA. This complementary binding is due to the fact that the nucleotide sequence of VGAM1598 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1598 RNA, herein designated VGAM RNA, may have a different number of host target binding sites in untranslated regions of a VGAM1598 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1598 RNA, herein designated VGAM RNA, to host target binding sites on VGAM1598 host target RNA, herein designated VGAM HOST TARGET RNA, such as BINDING SITE I, BINDING SITE II and BINDING SITE III, inhibits translation of VGAM1598 host target RNA into VGAM1598 host target protein, herein designated VGAM HOST TARGET PROTEIN. VGAM host target protein is therefore outlined by a broken line.

It is appreciated that VGAM1598 host target gene, herein designated VGAM HOST TARGET GENE, in fact represents a plurality of VGAM1598 host target genes. The mRNA of each one of this plurality of VGAM1598 host target genes comprises one or more host target binding sites, each having a nucleotide sequence which is at least partly complementary to VGAM1598 RNA, herein designated VGAM RNA, and which when bound by VGAM1598 RNA causes inhibition of translation of respective one or more VGAM1598 host target proteins.

It is further appreciated by one skilled in the art that the mode of translational inhibition illustrated by FIG. 1 with specific reference to translational inhibition exerted by VGAM1598 gene, herein designated VGAM GENE, on one or more VGAM1598 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1598 is inhibition of expression of host target genes, as part of a novel viral mechanism of attacking a host. Accordingly, utilities of VGAM1598 include diagnosis, prevention and treatment of viral infection by Human Adenovirus E. Specific functions, and accordingly utilities, of VGAM1598 correlate with, and may be deduced from, the identity of the host target genes which VGAM1598 binds and inhibits, and the function of these target genes, as elaborated hereinbelow.

Nucleotide sequences of the VGAM1598 precursor RNA, herein designated VGAM PRECURSOR RNA, and of the 'diced' VGAM1598 RNA, herein designated VGAM RNA, and a schematic representation of the secondary folding of VGAM1598 folded precursor RNA, herein designated VGAM FOLDED PRECURSOR RNA, of VGAM1598 are further described hereinbelow with reference to Table 1.

Nucleotide sequences of host target binding sites, such as BINDING SITE-I, BINDING SITE-II and BINDING SITE-III of FIG. 1, found on VGAM1598 host target RNA, and schematic representation of the complementarity of each of these host target binding sites to VGAM1598 RNA, herein designated VGAM RNA, are described hereinbelow with reference to Table 2.

As mentioned hereinabove with reference to FIG. 1, a function of VGAM1598 gene, herein designated VGAM is inhibition of expression of VGAM1598 target genes. It is appreciated that specific functions, and accordingly utilities, of VGAM1598 correlate with, and may be deduced from, the identity of the target genes which VGAM1598 binds and inhibits, and the function of these target genes, as elaborated hereinbelow.

Sperm Associated Antigen 8 (SPAG8, Accession NM_012436) is a VGAM1598 host target gene. SPAG8 BINDING SITE is HOST TARGET binding site found in the 3' untranslated region of mRNA encoded by SPAG8, corresponding to a HOST TARGET binding site such as BINDING SITE I, BINDING SITE II or BINDING SITE III. Table 2 illustrates the complementarity of the nucleotide sequences of SPAG8 BINDING SITE, designated SEQ ID:14816, to the nucleotide sequence of VGAM1598 RNA, herein designated VGAM RNA, also designated SEQ ID:4309.

A function of VGAM1598 is therefore inhibition of Sperm Associated Antigen 8 (SPAG8, Accession NM_012436), a gene which is a Sperm plasma membrane antigens are attractive antifertility vaccine targets. Accordingly, utilities of VGAM1598 include diagnosis, prevention and treatment of diseases and clinical conditions associated with SPAG8. The function of SPAG8 and its association with various diseases and clinical conditions, has been established by previous studies, as described hereinabove with reference to VGAM129. KIAA0471 (Accession NM_014857) is another VGAM1598 host target gene. KIAA0471 BINDING SITE is HOST TARGET binding site found in the 3' untranslated region of mRNA encoded by KIAA0471, corresponding to a HOST TARGET binding site such as BINDING SITE I, BINDING SITE II or BINDING SITE III. Table 2 illustrates the complementarity of the nucleotide sequences of KIAA0471 BINDING SITE, designated SEQ ID:16912, to the nucleotide sequence of VGAM1598 RNA, herein designated VGAM RNA, also designated SEQ ID:4309.

Another function of VGAM1598 is therefore inhibition of KIAA0471 (Accession NM_014857). Accordingly, utilities of VGAM1598 include diagnosis, prevention and treatment of diseases and clinical conditions associated with KIAA0471. RAB35, Member RAS Oncogene Family (RAB35, Accession NM_006861) is another VGAM1598 host target gene. RAB35 BINDING SITE is HOST TARGET binding site found in the 3' untranslated region of mRNA encoded by RAB35, corresponding to a HOST TARGET binding site such as BINDING SITE I, BINDING SITE II or BINDING SITE III. Table 2 illustrates the complementarity of the nucleotide sequences of RAB35 BINDING SITE, designated SEQ ID:13731, to the nucleotide sequence of VGAM1598 RNA, herein designated VGAM RNA, also designated SEQ ID:4309.

Another function of VGAM1598 is therefore inhibition of RAB35, Member RAS Oncogene Family (RAB35, Accession NM_006861). Accordingly, utilities of VGAM1598 include diagnosis, prevention and treatment of diseases and clinical conditions associated with RAB35. LOC129138 (Accession NM_138797) is another VGAM1598 host target gene. LOC129138 BINDING SITE is HOST TARGET binding site found in the 3' untranslated region of mRNA encoded by LOC129138, corresponding to a HOST TARGET binding site such as BINDING SITE I, BINDING SITE II or BINDING SITE III. Table 2 illustrates the complementarity of the nucleotide sequences of LOC129138 BINDING SITE, designated SEQ ID:29018, to the nucleotide sequence of VGAM1598 RNA, herein designated VGAM RNA, also designated SEQ ID:4309.

Another function of VGAM1598 is therefore inhibition of LOC129138 (Accession NM_138797). Accordingly, utilities of VGAM1598 include diagnosis, prevention and treatment of diseases and clinical conditions associated with LOC129138. LOC164955 (Accession XM_092265) is another VGAM1598 host target gene. LOC164955 BINDING SITE is HOST TARGET binding site found in the 3' untranslated region of mRNA encoded by LOC164955, corresponding to a HOST TARGET binding site such as BINDING SITE I, BINDING SITE II or BINDING SITE III. Table 2 illustrates the complementarity of the nucleotide sequences of LOC164955 BINDING SITE, designated SEQ ID:40112, to the nucleotide sequence of VGAM1598 RNA, herein designated VGAM RNA, also designated SEQ ID:4309.

Another function of VGAM1598 is therefore inhibition of LOC164955 (Accession XM_092265). Accordingly, utilities of VGAM1598 include diagnosis, prevention and treatment of diseases and clinical conditions associated with LOC164955. FIG. 1 further provides a conceptual description of a novel bioinformatically detected viral gene of the present invention, referred to here as Viral Genomic Address Messenger 1599 (VGAM1599) viral gene, which modulates expression of respective host target genes thereof, the function and utility of which host target genes is known in the art.

VGAM1599 is a novel bioinformatically detected regulatory, non protein coding, viral micro RNA (miRNA) gene. The method by which VGAM1599 was detected is described hereinabove with reference to FIGS. 1-8.

VGAM1599 gene, herein designated VGAM GENE, is a viral gene contained in the genome of Human Adenovirus E. VGAM1599 host target gene, herein designated VGAM HOST TARGET GENE, is a human gene contained in the human genome.

VGAM1599 gene encodes a VGAM1599 precursor RNA, herein designated VGAM PRECURSOR RNA. Similar to other miRNA genes, and unlike most ordinary genes, VGAM1599 precursor RNA does not encode a protein. A nucleotide sequence identical or highly similar to the nucleotide sequence of VGAM1599 precursor RNA is designated SEQ ID:1585, and is provided hereinbelow with reference to the sequence listing part. Nucleotide sequence SEQ ID:1585 is located at position 24788 relative to the genome of Human Adenovirus E.

VGAM1599 precursor RNA folds onto itself, forming VGAM1599 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1599 folded precursor RNA into VGAM1599 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1599 RNA is designated SEQ ID:4310, and is provided hereinbelow with reference to the sequence listing part.

VGAM1599 host target gene, herein designated VGAM HOST TARGET GENE, encodes a corresponding messenger RNA, VGAM1599 host target RNA, herein designated VGAM HOST TARGET RNA. VGAM1599 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1599 RNA, herein designated VGAM RNA, binds complementarily to one or more host target binding sites located in untranslated regions of VGAM1599 host target RNA, herein designated VGAM HOST TARGET RNA. This complementary binding is due to the fact that the nucleotide sequence of VGAM1599 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1599 RNA, herein designated VGAM RNA, may have a different number of host target binding sites in untranslated regions of a VGAM1599 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1599 RNA, herein designated VGAM RNA, to host target binding sites on VGAM1599 host target RNA, herein designated VGAM HOST TARGET RNA, such as BINDING SITE I, BINDING SITE II and BINDING SITE III, inhibits translation of VGAM1599 host target RNA into VGAM1599 host target protein, herein designated VGAM HOST TARGET PROTEIN. VGAM host target protein is therefore outlined by a broken line.

It is appreciated that VGAM1599 host target gene, herein designated VGAM HOST TARGET GENE, in fact represents a plurality of VGAM1599 host target genes. The mRNA of each one of this plurality of VGAM1599 host target genes comprises one or more host target binding sites, each having a nucleotide sequence which is at least partly complementary to VGAM1599 RNA, herein designated VGAM RNA, and which when bound by VGAM1599 RNA causes inhibition of translation of respective one or more VGAM1599 host target proteins.

It is further appreciated by one skilled in the art that the mode of translational inhibition illustrated by FIG. 1 with specific reference to translational inhibition exerted by VGAM1599 gene, herein designated VGAM GENE, on one or more VGAM1599 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1599 is inhibition of expression of host target genes, as part of a novel viral mechanism of attacking a host. Accordingly, utilities of VGAM1599 include diagnosis, prevention and treatment of viral infection by Human Adenovirus E. Specific functions, and accordingly utilities, of VGAM1599 correlate with, and may be deduced from, the identity of the host target genes which VGAM1599 binds and inhibits, and the function of these host target genes, as elaborated hereinbelow.

Nucleotide sequences of the VGAM1599 precursor RNA, herein designated VGAM PRECURSOR RNA, and of the 'diced' VGAM1599 RNA, herein designated VGAM RNA, and a schematic representation of the secondary folding of VGAM1599 folded precursor RNA, herein designated VGAM FOLDED PRECURSOR RNA, of VGAM1599 are further described hereinbelow with reference to Table 1.

Nucleotide sequences of host target binding sites, such as BINDING SITE-I, BINDING SITE-II and BINDING SITE-III of FIG. 1, found on VGAM1599 host target RNA, and schematic representation of the complementarity of each of these host target binding sites to VGAM1599 RNA, herein designated VGAM RNA, are described hereinbelow with reference to Table 2.

As mentioned hereinabove with reference to FIG. 1, a function of VGAM1599 gene, herein designated VGAM is inhibition of expression of VGAM1599 target genes. It is appreciated that specific functions, and accordingly utilities, of VGAM1599 correlate with, and may be deduced from, the identity of the target genes which VGAM1599 binds and inhibits, and the function of these target genes, as elaborated hereinbelow.

Ankyrin 2, Neuronal (ANK2, Accession NM_001148) is a VGAM1599 host target gene. ANK2 BINDING SITE1 and ANK2 BINDING SITE2 are HOST TARGET binding sites found in untranslated regions of mRNA encoded by ANK2, corresponding to HOST TARGET binding sites such as BINDING SITE I, BINDING SITE II or BINDING SITE III. Table 2 illustrates the complementarity of the nucleotide sequences of ANK2 BINDING SITE1 and ANK2 BINDING SITE2, designated SEQ ID:6822 and SEQ ID:21966 respectively, to the nucleotide sequence of VGAM1599 RNA, herein designated VGAM RNA, also designated SEQ ID:4310.

A function of VGAM1599 is therefore inhibition of Ankyrin 2, Neuronal (ANK2, Accession NM_001148), a gene which attaches integral membrane proteins to cytoskeletal elements. also binds to cytoskeletal proteins. Accordingly, utilities of VGAM1599 include diagnosis, prevention and treatment of diseases and clinical conditions associated with ANK2. The function of ANK2 and its association with various diseases and clinical conditions, has been established by previous studies, as described hereinabove with reference to VGAM769. Integrin, Alpha 5 (fibronectin receptor, alpha polypeptide) (ITGA5, Accession XM_028642) is another VGAM1599 host target gene. ITGA5 BINDING SITE is HOST TARGET binding site found in the 3' untranslated region of mRNA encoded by ITGA5, corresponding to a HOST TARGET binding site such as BINDING SITE I, BINDING SITE II or BINDING SITE III. Table 2 illustrates the complementarity of the nucleotide sequences of ITGA5 BINDING SITE, designated SEQ ID:30721, to the nucleotide sequence of VGAM1599 RNA, herein designated VGAM RNA, also designated SEQ ID:4310.

Another function of VGAM1599 is therefore inhibition of Integrin, Alpha 5 (fibronectin receptor, alpha polypeptide) (ITGA5, Accession XM_028642), a gene which is receptor for fibronectin and fibrinogen and recognizes the sequence r-g-d in its ligands. Accordingly, utilities of VGAM1599 include diagnosis, prevention and treatment of diseases and clinical conditions associated with ITGA5. The function of ITGA5 and its association with various diseases and clinical conditions, has been established by previous studies, as described hereinabove with reference to VGAM1220. Potassium Inwardly-rectifying Channel, Subfamily J, Member 5 (KCNJ5, Accession NM_000890) is another VGAM1599 host target gene. KCNJ5 BINDING SITE is HOST TARGET binding site found in the 3' untranslated region of mRNA encoded by KCNJ5, corresponding to a HOST TARGET binding site such as BINDING SITE I, BINDING SITE II or BINDING SITE III. Table 2 illustrates the complementarity of the nucleotide sequences of KCNJ5 BINDING SITE, designated SEQ ID:6586, to the nucleotide sequence of VGAM1599 RNA, herein designated VGAM RNA, also designated SEQ ID:4310.

Another function of VGAM1599 is therefore inhibition of Potassium Inwardly-rectifying Channel, Subfamily J, Member 5 (KCNJ5, Accession NM_000890), a gene which is a potassium inwardly-rectifying channel. Accordingly, utilities of VGAM1599 include diagnosis, prevention and treatment of diseases and clinical conditions associated with KCNJ5. The function of KCNJ5 and its association with various diseases and clinical conditions, has been established by previous studies, as described hereinabove with reference to VGAM766. Leptin (obesity homolog, mouse) (LEP, Accession NM_000230) is another VGAM1599 host target gene. LEP BINDING SITE is HOST TARGET binding site found in the 3' untranslated region of mRNA encoded by LEP, corresponding to a HOST TARGET binding site such as BINDING SITE I, BINDING SITE II or BINDING SITE III. Table 2 illustrates the complementarity of the nucleotide sequences of LEP BINDING SITE, designated SEQ ID:5735, to the nucleotide sequence of VGAM1599 RNA, herein designated VGAM RNA, also designated SEQ ID:4310.

Another function of VGAM1599 is therefore inhibition of Leptin (obesity homolog, mouse) (LEP, Accession NM_000230). Accordingly, utilities of VGAM1599 include diagnosis, prevention and treatment of diseases and clinical conditions associated with LEP. MutS Homolog 3 (E. coli) (MSH3, Accession NM_002439) is another VGAM1599 host target gene. MSH3 BINDING SITE is HOST TARGET binding site found in the 3' untranslated region of mRNA encoded by MSH3, corresponding to a HOST TARGET binding site such as BINDING SITE I, BINDING SITE II or BINDING SITE III. Table 2 illustrates the complementarity of the nucleotide sequences of MSH3 BINDING SITE, designated SEQ ID:8282, to the nucleotide sequence of VGAM1599 RNA, herein designated VGAM RNA, also designated SEQ ID:4310.

Another function of VGAM1599 is therefore inhibition of MutS Homolog 3 (E. coli) (MSH3, Accession NM_002439), a gene which belongs to the dna mismatch repair muts family. Accordingly, utilities of VGAM1599 include diagnosis, prevention and treatment of diseases and clinical conditions associated with MSH3. The function of MSH3 has been established by previous studies. Akiyama et al. (1997) screened for somatic mutations of the MSH3 (A)8 repeat in 29 tumors from 23 hereditary nonpolyposis colorectal cancer patients. One or 2 A deletions in the (A)8 repeat were found in 11 (57.9%) of the 19 tumors that showed microsatellite instability (MI) but not in 10 MI-negative ones, indicating secondary mutations after germline mutations of other mismatch repair genes. Moreover, the MI frequency of 3 or more nucleotide repeats was higher in MSH3 (A)8-mutated tumor cells than in nonmutated ones. Their data suggested that a mutation of a mismatch repair gene enhances the frequency of another mismatch repair gene mutation, such as of MSH3, resulting in severe microsatellite instability. Yin et al. (1997) came to a similar conclusion: that DNA mismatch repair genes, such as MSH3 and MSH6 (OMIM Ref. No. 600678), are targets for the mutagenic activity of upstream mismatch repair gene mutations and that this enhanced genomic instability may accelerate the accumulation of mutations in replication/repair error positive tumors. Animal model experiments lend further support to the function of MSH3. De Wind et al. (1999)

inactivated the mouse Msh3 and Msh6 genes by targeted disruption. Msh6-deficient mice were prone to cancer. Most animals developed lymphomas or epithelial tumors originating from the skin and uterus but only rarely from the intestine. Msh3 deficiency did not cause cancer predisposition, but in an Msh6-deficient background, loss of Msh3 accelerated intestinal tumorigenesis. The frequency of lymphomas was not affected. Furthermore, mismatch-directed antirecombination and sensitivity to methylating agents required Msh2 and Msh6, but not Msh3. Thus, loss of mismatch repair functions specific to Msh2/Msh6 is sufficient for lymphoma development in mice, whereas predisposition to intestinal cancer requires loss of function of both Msh2/Msh6 and Msh2/Msh3.

It is appreciated that the abovementioned animal model for MSH3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Akiyama, Y.; Tsubouchi, N.; Yuasa, Y.: Frequent somatic mutations of hMSH3 with reference to microsatellite instability in hereditary nonpolyposis colorectal cancer. Biochem. Biophys. Res. Commun. 236:248-252, 1997; and de Wind, N.; Dekker, M.; Claij, N.; Jansen, L.; van Klink, Y.; Radman, M.; Riggins, G.; van der Valk, M.; van't Wout, K.; te Riele, H.: HNPCC-like cancer predisposition in mice through.

Further studies establishing the function and utilities of MSH3 are found in John Hopkins OMIM database record ID 600887, and in sited publications numbered 716 and 9925-7797 listed in the bibliography section hereinbelow, which are also hereby incorporated by reference. Mature T-cell Proliferation 1 (MTCP1, Accession NM_014221) is another VGAM1599 host target gene. MTCP1 BINDING SITE is HOST TARGET binding site found in the 5' untranslated region of mRNA encoded by MTCP1, corresponding to a HOST TARGET binding site such as BINDING SITE I, BINDING SITE II or BINDING SITE III. Table 2 illustrates the complementarity of the nucleotide sequences of MTCP1 BINDING SITE, designated SEQ ID:15485, to the nucleotide sequence of VGAM1599 RNA, herein designated VGAM RNA, also designated SEQ ID:4310.

Another function of VGAM1599 is therefore inhibition of Mature T-cell Proliferation 1 (MTCP1, Accession NM_014221). Accordingly, utilities of VGAM1599 include diagnosis, prevention and treatment of diseases and clinical conditions associated with MTCP1. RNA (guanine-7-) Methyltransferase (RNMT, Accession NM_003799) is another VGAM1599 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9881, to the nucleotide sequence of VGAM1599 RNA, herein designated VGAM RNA, also designated SEQ ID:4310.

Another function of VGAM1599 is therefore inhibition of RNA (guanine-7-) Methyltransferase (RNMT, Accession NM_003799), a gene which catalyzes the methylation of GpppN- at the guanine N7 position. Accordingly, utilities of VGAM1599 include diagnosis, prevention and treatment of diseases and clinical conditions associated with RNMT. The function of RNMT and its association with various diseases and clinical conditions, has been established by previous studies, as described hereinabove with reference to VGAM178. Tumor Necrosis Factor (ligand) Superfamily, Member 4 (tax-transcriptionally activated glycoprotein 1, 34 kDa) (TNFSF4, Accession NM_003326) is another VGAM1599 host target gene. TNFSF4 BINDING SITE is HOST TARGET binding site found in the 3' untranslated region of mRNA encoded by TNFSF4, corresponding to a HOST TARGET binding site such as BINDING SITE I, BINDING SITE II or BINDING SITE III. Table 2 illustrates the complementarity of the nucleotide sequences of TNFSF4 BINDING SITE, designated SEQ ID:9328, to the nucleotide sequence of VGAM1599 RNA, herein designated VGAM RNA, also designated SEQ ID:4310.

Another function of VGAM1599 is therefore inhibition of Tumor Necrosis Factor (ligand) Superfamily, Member 4 (tax-transcriptionally activated glycoprotein 1, 34 kDa) (TNFSF4, Accession NM_003326), a gene which co-stimulates t cell proliferation and cytokine production. Accordingly, utilities of VGAM1599 include diagnosis, prevention and treatment of diseases and clinical conditions associated with TNFSF4. The function of TNFSF4 and its association with various diseases and clinical conditions, has been established by previous studies, as described hereinabove with reference to VGAM463. Apolipoprotein L, 4 (APOL4, Accession NM_030643) is another VGAM1599 host target gene. APOL4 BINDING SITE is HOST TARGET binding site found in the 3' untranslated region of mRNA encoded by APOL4, corresponding to a HOST TARGET binding site such as BINDING SITE I, BINDING SITE II or BINDING SITE III. Table 2 illustrates the complementarity of the nucleotide sequences of APOL4 BINDING SITE, designated SEQ ID:24975, to the nucleotide sequence of VGAM1599 RNA, herein designated VGAM RNA, also designated SEQ ID:4310.

Another function of VGAM1599 is therefore inhibition of Apolipoprotein L, 4 (APOL4, Accession NM_030643). Accordingly, utilities of VGAM1599 include diagnosis, prevention and treatment of diseases and clinical conditions associated with APOL4. Chromosome 21 Open Reading Frame 42 (C21orf42, Accession NM_058184) is another VGAM1599 host target gene. C21orf42 BINDING SITE is HOST TARGET binding site found in the 3' untranslated region of mRNA encoded by C21orf42, corresponding to a HOST TARGET binding site such as BINDING SITE I, BINDING SITE II or BINDING SITE III. Table 2 illustrates the complementarity of the nucleotide sequences of C21orf42 BINDING SITE, designated SEQ ID:27749, to the nucleotide sequence of VGAM1599 RNA, herein designated VGAM RNA, also designated SEQ ID:4310.

Another function of VGAM1599 is therefore inhibition of Chromosome 21 Open Reading Frame 42 (C21orf42, Accession NM_058184). Accordingly, utilities of VGAM1599 include diagnosis, prevention and treatment of diseases and clinical conditions associated with C21orf42. CDC14 Cell Division Cycle 14 Homolog B (S. cerevisiae) (CDC14B, Accession NM_033331) is another VGAM1599 host target gene. CDC14B BINDING SITE1 and CDC14B BINDING SITE2 are HOST TARGET binding sites found in untranslated regions of mRNA encoded by CDC14B, corresponding to HOST TARGET binding sites such as BINDING SITE I, BINDING SITE II or BINDING SITE III. Table 2 illustrates the complementarity of the nucleotide sequences of CDC14B BINDING SITE1 and CDC14B BINDING SITE2, designated SEQ ID:27163 and SEQ ID:9759 respectively, to the nucleotide sequence of VGAM1599 RNA, herein designated VGAM RNA, also designated SEQ ID:4310.

Another function of VGAM1599 is therefore inhibition of CDC14 Cell Division Cycle 14 Homolog B (S. cerevisiae) (CDC14B, Accession NM_033331). Accordingly, utilities of VGAM1599 include diagnosis, prevention and treatment of diseases and clinical conditions associated with CDC14B. Dedicator of Cyto-kinesis 3 (DOCK3, Accession XM_039259) is another VGAM1599 host target gene. DOCK3 BINDING SITE is HOST TARGET binding site found in the 3' untranslated region of mRNA encoded by DOCK3, corresponding to a HOST TARGET binding site such as BINDING SITE I, BINDING SITE II or BINDING SITE III. Table 2 illustrates the complementarity of the nucleotide sequences of DOCK3 BINDING SITE, designated SEQ ID:33034, to the nucleotide sequence of VGAM1599 RNA, herein designated VGAM RNA, also designated SEQ ID:4310.

Another function of VGAM1599 is therefore inhibition of Dedicator of Cyto-kinesis 3 (DOCK3, Accession XM_039259). Accordingly, utilities of VGAM1599 include diagnosis, prevention and treatment of diseases and clinical conditions associated with DOCK3. FLJ11850 (Accession NM_022741) is another VGAM1599 host target gene. FLJ11850 BINDING SITE is HOST TARGET binding site found in the 3' untranslated region of mRNA encoded by FLJ11850, corresponding to a HOST TARGET binding site such as BINDING SITE I, BINDING SITE II or BINDING SITE III. Table 2 illustrates the complementarity of the nucleotide sequences of FLJ11850 BINDING SITE, designated SEQ ID:22949, to the nucleotide sequence of VGAM1599 RNA, herein designated VGAM RNA, also designated SEQ ID:4310.

Another function of VGAM1599 is therefore inhibition of FLJ11850 (Accession NM_022741). Accordingly, utilities of VGAM1599 include diagnosis, prevention and treatment of diseases and clinical conditions associated with FLJ11850. FLJ33069 (Accession NM_144649) is another VGAM1599 host target gene. FLJ33069 BINDING SITE is HOST TARGET binding site found in the 3' untranslated region of mRNA encoded by FLJ33069, corresponding to a HOST TARGET binding site such as BINDING SITE I, BINDING SITE II or BINDING SITE III. Table 2 illustrates the complementarity of the nucleotide sequences of FLJ33069 BINDING SITE, designated SEQ ID:29474, to the nucleotide sequence of VGAM1599 RNA, herein designated VGAM RNA, also designated SEQ ID:4310.

Another function of VGAM1599 is therefore inhibition of FLJ33069 (Accession NM_144649). Accordingly, utilities of VGAM1599 include diagnosis, prevention and treatment of diseases and clinical conditions associated with FLJ33069. GMPPB (Accession XM_171044) is another VGAM1599 host target gene. GMPPB BINDING SITE is HOST TARGET binding site found in the 5' untranslated region of mRNA encoded by GMPPB, corresponding to a HOST TARGET binding site such as BINDING SITE I, BINDING SITE II or BINDING SITE III. Table 2 illustrates the complementarity of the nucleotide sequences of GMPPB BINDING SITE, designated SEQ ID:45810, to the nucleotide sequence of VGAM1599 RNA, herein designated VGAM RNA, also designated SEQ ID:4310.

Another function of VGAM1599 is therefore inhibition of GMPPB (Accession XM_171044). Accordingly, utilities of VGAM1599 include diagnosis, prevention and treatment of diseases and clinical conditions associated with GMPPB. HCA4 (Accession XM_085287) is another VGAM1599 host target gene. HCA4 BINDING SITE is HOST TARGET binding site found in the 3' untranslated region of mRNA encoded by HCA4, corresponding to a HOST TARGET binding site such as BINDING SITE I, BINDING SITE II or BINDING SITE III. Table 2 illustrates the complementarity of the nucleotide sequences of HCA4 BINDING SITE, designated SEQ ID:38021, to the nucleotide sequence of VGAM1599 RNA, herein designated VGAM RNA, also designated SEQ ID:4310.

Another function of VGAM1599 is therefore inhibition of HCA4 (Accession XM_085287). Accordingly, utilities of VGAM1599 include diagnosis, prevention and treatment of diseases and clinical conditions associated with HCA4. HNK-1ST (Accession NM_004854) is another VGAM1599 host target gene. HNK-1ST BINDING SITE is HOST TARGET binding site found in the 5' untranslated region of mRNA encoded by HNK-1ST, corresponding to a HOST TARGET binding site such as BINDING SITE I, BINDING SITE II or BINDING SITE III. Table 2 illustrates the complementarity of the nucleotide sequences of HNK-1ST BINDING SITE, designated SEQ ID:11265, to the nucleotide sequence of VGAM1599 RNA, herein designated VGAM RNA, also designated SEQ ID:4310.

Another function of VGAM1599 is therefore inhibition of HNK-1ST (Accession NM_004854). Accordingly, utilities of VGAM1599 include diagnosis, prevention and treatment of diseases and clinical conditions associated with HNK-1ST. KIAA0618 (Accession NM_014833) is another VGAM1599 host target gene. KIAA0618 BINDING SITE is HOST TARGET binding site found in the 3' untranslated region of mRNA encoded by KIAA0618, corresponding to a HOST TARGET binding site such as BINDING SITE I, BINDING SITE II or BINDING SITE III. Table 2 illustrates the complementarity of the nucleotide sequences of KIAA0618 BINDING SITE, designated SEQ ID:16833, to the nucleotide sequence of VGAM1599 RNA, herein designated VGAM RNA, also designated SEQ ID:4310.

Another function of VGAM1599 is therefore inhibition of KIAA0618 (Accession NM_014833). Accordingly, utilities of VGAM1599 include diagnosis, prevention and treatment of diseases and clinical conditions associated with KIAA0618. KIAA0763 (Accession NM_014869) is another VGAM1599 host target gene. KIAA0763 BINDING SITE is HOST TARGET binding site found in the 3' untranslated region of mRNA encoded by KIAA0763, corresponding to a HOST TARGET binding site such as BINDING SITE I, BINDING SITE II or BINDING SITE III. Table 2 illustrates the complementarity of the nucleotide sequences of KIAA0763 BINDING SITE, designated SEQ ID:16965, to the nucleotide sequence of VGAM1599 RNA, herein designated VGAM RNA, also designated SEQ ID:4310.

Another function of VGAM1599 is therefore inhibition of KIAA0763 (Accession NM_014869). Accordingly, utilities of VGAM1599 include diagnosis, prevention and treatment of diseases and clinical conditions associated with KIAA0763. KIAA1884 (Accession XM_055539) is another VGAM1599 host target gene. KIAA1884 BINDING SITE is HOST TARGET binding site found in the 3' untranslated region of mRNA encoded by KIAA1884, corresponding to a HOST TARGET binding site such as BINDING SITE I, BINDING SITE II or BINDING SITE III. Table 2 illustrates the complementarity of the nucleotide sequences of KIAA1884 BINDING SITE, designated SEQ ID:36292, to the nucleotide sequence of VGAM1599 RNA, herein designated VGAM RNA, also designated SEQ ID:4310.

Another function of VGAM1599 is therefore inhibition of KIAA1884 (Accession XM_055539). Accordingly, utilities of VGAM1599 include diagnosis, prevention and treatment of diseases and clinical conditions associated with KIAA1884. MGC13017 (Accession NM_080656) is another VGAM1599 host target gene. MGC13017 BINDING SITE is HOST TARGET binding site found in the 3' untranslated region of mRNA encoded by MGC13017, corresponding to a HOST TARGET binding site such as BINDING SITE I, BINDING SITE II or BINDING SITE III. Table 2 illustrates the complementarity of the nucleotide sequences of MGC13017 BINDING SITE, designated SEQ ID:27944, to the nucleotide sequence of VGAM1599 RNA, herein designated VGAM RNA, also designated SEQ ID:4310.

Another function of VGAM1599 is therefore inhibition of MGC13017 (Accession NM_080656). Accordingly, utilities of VGAM1599 include diagnosis, prevention and treatment of diseases and clinical conditions associated with MGC13017. MGC22805 (Accession NM_144590) is another VGAM1599 host target gene. MGC22805 BINDING SITE is HOST TARGET binding site found in the 5' untranslated region of mRNA encoded by MGC22805, corresponding to a HOST TARGET binding site such as BINDING SITE I, BINDING SITE II or BINDING SITE III. Table 2 illustrates the complementarity of the nucleotide sequences of MGC22805 BINDING SITE, designated SEQ ID:29409, to the nucleotide sequence of VGAM1599 RNA, herein designated VGAM RNA, also designated SEQ ID:4310.

Another function of VGAM1599 is therefore inhibition of MGC22805 (Accession NM_144590). Accordingly, utilities of VGAM1599 include diagnosis, prevention and treatment of diseases and clinical conditions associated with MGC22805. PSR (Accession XM_036784) is another VGAM1599 host target gene. PSR BINDING SITE is HOST TARGET binding site found in the 3' untranslated region of mRNA encoded by PSR, corresponding to a HOST TARGET binding site such as BINDING SITE I, BINDING SITE II or BINDING SITE III. Table 2 illustrates the complementarity of the nucleotide sequences of PSR BINDING SITE, designated SEQ ID:32494, to the nucleotide sequence of VGAM1599 RNA, herein designated VGAM RNA, also designated SEQ ID:4310.

Another function of VGAM1599 is therefore inhibition of PSR (Accession XM_036784). Accordingly, utilities of VGAM1599 include diagnosis, prevention and treatment of diseases and clinical conditions associated with PSR. TGFB-induced Factor 2 (TALE family homeobox) (TGIF2, Accession NM_021809) is another VGAM1599 host target gene. TGIF2 BINDING SITE is HOST TARGET binding site found in the 3' untranslated region of mRNA encoded by TGIF2, corresponding to a HOST TARGET binding site such as BINDING SITE I, BINDING SITE II or BINDING SITE III. Table 2 illustrates the complementarity of the nucleotide sequences of TGIF2 BINDING SITE, designated SEQ ID:22363, to the nucleotide sequence of VGAM1599 RNA, herein designated VGAM RNA, also designated SEQ ID:4310.

Another function of VGAM1599 is therefore inhibition of TGFB-induced Factor 2 (TALE family homeobox) (TGIF2, Accession NM_021809). Accordingly, utilities of VGAM1599 include diagnosis, prevention and treatment of diseases and clinical conditions associated with TGIF2. Vav 3 Oncogene (VAV3, Accession NM_006113) is another VGAM1599 host target gene. VAV3 BINDING SITE is HOST TARGET binding site found in the 3' untranslated region of mRNA encoded by VAV3, corresponding to a HOST TARGET binding site such as BINDING SITE I, BINDING SITE II or BINDING SITE III. Table 2 illustrates the complementarity of the nucleotide sequences of VAV3 BINDING SITE, designated SEQ ID:12757, to the nucleotide sequence of VGAM1599 RNA, herein designated VGAM RNA, also designated SEQ ID:4310.

Another function of VGAM1599 is therefore inhibition of Vav 3 Oncogene (VAV3, Accession NM_006113). Accordingly, utilities of VGAM1599 include diagnosis, prevention and treatment of diseases and clinical conditions associated with VAV3. LOC139770 (Accession XM_060053) is another VGAM1599 host target gene. LOC139770 BINDING SITE is HOST TARGET binding site found in the 3' untranslated region of mRNA encoded by LOC139770, corresponding to a HOST TARGET binding site such as BINDING SITE I, BINDING SITE II or BINDING SITE III. Table 2 illustrates the complementarity of the nucleotide sequences of LOC139770 BINDING SITE, designated SEQ ID:37144, to the nucleotide sequence of VGAM1599 RNA, herein designated VGAM RNA, also designated SEQ ID:4310.

Another function of VGAM1599 is therefore inhibition of LOC139770 (Accession XM_060053). Accordingly, utilities of VGAM1599 include diagnosis, prevention and treatment of diseases and clinical conditions associated with LOC139770. LOC148413 (Accession XM_086176) is another VGAM1599 host target gene. LOC148413 BINDING SITE is HOST TARGET binding site found in the 3' untranslated region of mRNA encoded by LOC148413, corresponding to a HOST TARGET binding site such as BINDING SITE I, BINDING SITE II or BINDING SITE III. Table 2 illustrates the complementarity of the nucleotide sequences of LOC148413 BINDING SITE, designated SEQ ID:38532, to the nucleotide sequence of VGAM1599 RNA, herein designated VGAM RNA, also designated SEQ ID:4310.

Another function of VGAM1599 is therefore inhibition of LOC148413 (Accession XM_086176). Accordingly, utilities of VGAM1599 include diagnosis, prevention and treatment of diseases and clinical conditions associated with LOC148413. LOC154881 (Accession XM_088063) is another VGAM1599 host target gene. LOC154881 BINDING SITE is HOST TARGET binding site found in the 3' untranslated region of mRNA encoded by LOC154881, corresponding to a HOST TARGET binding site such as BINDING SITE I, BINDING SITE II or BINDING SITE III. Table 2 illustrates the complementarity of the nucleotide sequences of LOC154881 BINDING SITE, designated SEQ ID:39495, to the nucleotide sequence of VGAM1599 RNA, herein designated VGAM RNA, also designated SEQ ID:4310.

Another function of VGAM1599 is therefore inhibition of LOC154881 (Accession XM_088063). Accordingly, utilities of VGAM1599 include diagnosis, prevention and treatment of diseases and clinical conditions associated with LOC154881. LOC158376 (Accession XM_098934) is another VGAM1599 host target gene. LOC158376 BINDING SITE is HOST TARGET binding site found in the 5' untranslated region of mRNA encoded by LOC158376, corresponding to a HOST TARGET binding site such as BINDING SITE I, BINDING SITE II or BINDING SITE III. Table 2 illustrates the complementarity of the nucleotide sequences of LOC158376 BINDING SITE, designated SEQ ID:41971, to the nucleotide sequence of VGAM1599 RNA, herein designated VGAM RNA, also designated SEQ ID:4310.

Another function of VGAM1599 is therefore inhibition of LOC158376 (Accession XM_098934). Accordingly, utilities of VGAM1599 include diagnosis, prevention and treatment of diseases and clinical conditions associated with LOC158376. LOC168448 (Accession XM_095105) is another VGAM1599 host target gene. LOC168448 BINDING SITE is HOST TARGET binding site found in the 3' untranslated region of mRNA encoded by LOC168448, corresponding to a HOST TARGET binding site such as BINDING SITE I, BINDING SITE II or BINDING SITE III. Table 2 illustrates the complementarity of the nucleotide sequences of LOC168448 BINDING SITE, designated SEQ ID:40247, to the nucleotide sequence of VGAM1599 RNA, herein designated VGAM RNA, also designated SEQ ID:4310.

Another function of VGAM1599 is therefore inhibition of LOC168448 (Accession XM_095105). Accordingly, utilities of VGAM1599 include diagnosis, prevention and treatment of diseases and clinical conditions associated with LOC168448. LOC200772 (Accession XM_117275) is another VGAM1599 host target gene. LOC200772 BINDING SITE is HOST TARGET binding site found in the 3' untranslated region of mRNA encoded by LOC200772, corresponding to a HOST TARGET binding site such as BINDING SITE I, BINDING SITE II or BINDING SITE III. Table 2 illustrates the complementarity of the nucleotide sequences of LOC200772 BINDING SITE, designated SEQ ID:43346, to the nucleotide sequence of VGAM1599 RNA, herein designated VGAM RNA, also designated SEQ ID:4310.

Another function of VGAM1599 is therefore inhibition of LOC200772 (Accession XM_117275). Accordingly, utilities of VGAM1599 include diagnosis, prevention and treatment of diseases and clinical conditions associated with LOC200772. LOC220074 (Accession NM_145309) is another VGAM1599 host target gene. LOC220074 BINDING SITE is HOST TARGET binding site found in the 3' untranslated region of mRNA encoded by LOC220074, corresponding to a HOST TARGET binding site such as BINDING SITE I, BINDING SITE II or BINDING SITE III. Table 2 illustrates the complementarity of the nucleotide sequences of LOC220074 BINDING SITE, designated SEQ ID:29823, to the nucleotide sequence of VGAM1599 RNA, herein designated VGAM RNA, also designated SEQ ID:4310.

Another function of VGAM1599 is therefore inhibition of LOC220074 (Accession NM_145309). Accordingly, utilities of VGAM1599 include diagnosis, prevention and treatment of diseases and clinical conditions associated with LOC220074. LOC222962 (Accession XM_167291) is another VGAM1599 host target gene. LOC222962 BINDING SITE is HOST TARGET binding site found in the 3' untranslated region of mRNA encoded by LOC222962, corresponding to a HOST TARGET binding site such as BINDING SITE I, BINDING SITE II or BINDING SITE III. Table 2 illustrates the complementarity of the nucleotide sequences of LOC222962 BINDING SITE, designated SEQ ID:44630, to the nucleotide sequence of VGAM1599 RNA, herein designated VGAM RNA, also designated SEQ ID:4310.

Another function of VGAM1599 is therefore inhibition of LOC222962 (Accession XM_167291). Accordingly, utilities of VGAM1599 include diagnosis, prevention and treatment of diseases and clinical conditions associated with LOC222962. LOC256401 (Accession XM_171149) is another VGAM1599 host target gene. LOC256401 BINDING SITE is HOST TARGET binding site found in the 3' untranslated region of mRNA encoded by LOC256401, corresponding to a HOST TARGET binding site such as BINDING SITE I, BINDING SITE II or BINDING SITE III. Table 2 illustrates the complementarity of the nucleotide sequences of LOC256401 BINDING SITE, designated SEQ ID:45945, to the nucleotide sequence of VGAM1599 RNA, herein designated VGAM RNA, also designated SEQ ID:4310.

Another function of VGAM1599 is therefore inhibition of LOC256401 (Accession XM_171149). Accordingly, utilities of VGAM1599 include diagnosis, prevention and treatment of diseases and clinical conditions associated with LOC256401. LOC90408 (Accession XM_031517) is another VGAM1599 host target gene. LOC90408 BINDING SITE is HOST TARGET binding site found in the 3' untranslated region of mRNA encoded by LOC90408, corresponding to a HOST TARGET binding site such as BINDING SITE I, BINDING SITE II or BINDING SITE III. Table 2 illustrates the complementarity of the nucleotide sequences of LOC90408 BINDING SITE, designated SEQ ID:31395, to the nucleotide sequence of VGAM1599 RNA, herein designated VGAM RNA, also designated SEQ ID:4310.

Another function of VGAM1599 is therefore inhibition of LOC90408 (Accession XM_031517). Accordingly, utilities of VGAM1599 include diagnosis, prevention and treatment of diseases and clinical conditions associated with LOC90408. LOC91516 (Accession XM_038924) is another VGAM1599 host target gene. LOC91516 BINDING SITE is HOST TARGET binding site found in the 5' untranslated region of mRNA encoded by LOC91516, corresponding to a HOST TARGET binding site such as BINDING SITE I, BINDING SITE II or BINDING SITE III. Table 2 illustrates the complementarity of the nucleotide sequences of LOC91516 BINDING SITE, designated SEQ ID:32954, to the nucleotide sequence of VGAM1599 RNA, herein designated VGAM RNA, also designated SEQ ID:4310.

Another function of VGAM1599 is therefore inhibition of LOC91516 (Accession XM_038924). Accordingly, utilities of VGAM1599 include diagnosis, prevention and treatment of diseases and clinical conditions associated with LOC91516. FIG. 1 further provides a conceptual description of a novel bioinformatically detected viral gene of the present invention, referred to here as Viral Genomic Address Messenger 1600 (VGAM1600) viral gene, which modulates expression of respective host target genes thereof, the function and utility of which host target genes is known in the art.

VGAM1600 is a novel bioinformatically detected regulatory, non protein coding, viral micro RNA (miRNA) gene. The method by which VGAM1600 was detected is described hereinabove with reference to FIGS. 1-8.

VGAM1600 gene, herein designated VGAM GENE, is a viral gene contained in the genome of Human Adenovirus E. VGAM1600 host target gene, herein designated VGAM HOST TARGET GENE, is a human gene contained in the human genome.

VGAM1600 gene encodes a VGAM1600 precursor RNA, herein designated VGAM PRECURSOR RNA. Similar to other miRNA genes, and unlike most ordinary genes, VGAM1600 precursor RNA does not encode a protein. A nucleotide sequence identical or highly similar to the nucleotide sequence of VGAM1600 precursor RNA is designated SEQ ID:1586, and is provided hereinbelow with reference to the sequence listing part. Nucleotide sequence SEQ ID:1586 is located at position 23495 relative to the genome of Human Adenovirus E.

VGAM1600 precursor RNA folds onto itself, forming VGAM1600 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1600 folded precursor RNA into VGAM1600 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1600 RNA is designated SEQ ID:4311, and is provided hereinbelow with reference to the sequence listing part.

VGAM1600 host target gene, herein designated VGAM HOST TARGET GENE, encodes a corresponding messenger RNA, VGAM1600 host target RNA, herein designated VGAM HOST TARGET RNA. VGAM1600 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1600 RNA, herein designated VGAM RNA, binds complementarily to one or more host target binding sites located in untranslated regions of VGAM1600 host target RNA, herein designated VGAM HOST TARGET RNA. This complementary binding is due to the fact that the nucleotide sequence of VGAM1600 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1600 RNA, herein designated VGAM RNA, may have a different number of host target binding sites in untranslated regions of a VGAM1600 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1600 RNA, herein designated VGAM RNA, to host target binding sites on VGAM1600 host target RNA, herein designated VGAM HOST TARGET RNA, such as BINDING SITE I, BINDING SITE II and BINDING SITE III, inhibits translation of VGAM1600 host target RNA into VGAM1600 host target protein, herein designated VGAM HOST TARGET PROTEIN. VGAM host target protein is therefore outlined by a broken line.

It is appreciated that VGAM1600 host target gene, herein designated VGAM HOST TARGET GENE, in fact represents a plurality of VGAM1600 host target genes. The mRNA of each one of this plurality of VGAM1600 host target genes comprises one or more host target binding sites, each having a nucleotide sequence which is at least partly complementary to VGAM1600 RNA, herein designated VGAM RNA, and which when bound by VGAM1600 RNA causes inhibition of translation of respective one or more VGAM1600 host target proteins.

It is further appreciated by one skilled in the art that the mode of translational inhibition illustrated by FIG. 1 with specific reference to translational inhibition exerted by VGAM1600 gene, herein designated VGAM GENE, on one or more VGAM1600 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1600 is inhibition of expression of host target genes, as part of a novel viral mechanism of attacking a host. Accordingly, utilities of VGAM1600 include diagnosis, prevention and treatment of viral infection by Human Adenovirus E. Specific functions, and accordingly utilities, of VGAM1600 correlate with, and may be deduced from, the identity of the host target genes which VGAM1600 binds and inhibits, and the function of these host target genes, as elaborated hereinbelow.

Nucleotide sequences of the VGAM1600 precursor RNA, herein designated VGAM PRECURSOR RNA, and of the 'diced' VGAM1600 RNA, herein designated VGAM RNA, and a schematic representation of the secondary folding of VGAM1600 folded precursor RNA, herein designated VGAM FOLDED PRECURSOR RNA, of VGAM1600 are further described hereinbelow with reference to Table 1.

Nucleotide sequences of host target binding sites, such as BINDING SITE-I, BINDING SITE-II and BINDING SITE-III of FIG. 1, found on VGAM1600 host target RNA, and schematic representation of the complementarity of each of these host target binding sites to VGAM1600 RNA, herein designated VGAM RNA, are described hereinbelow with reference to Table 2.

As mentioned hereinabove with reference to FIG. 1, a function of VGAM1600 gene, herein designated VGAM is inhibition of expression of VGAM1600 target genes. It is appreciated that specific functions, and accordingly utilities, of VGAM1600 correlate with, and may be deduced from, the identity of the target genes which VGAM1600 binds and inhibits, and the function of these target genes, as elaborated hereinbelow.

Aquaporin 6, Kidney Specific (AQP6, Accession NM_053286) is a VGAM1600 host target gene. AQP6 BINDING SITE is HOST TARGET binding site found in the 5' untranslated region of mRNA encoded by AQP6, corresponding to a HOST TARGET binding site such as BINDING SITE I, BINDING SITE II or BINDING SITE III. Table 2 illustrates the complementarity of the nucleotide sequences of AQP6 BINDING SITE, designated SEQ ID:27613, to the nucleotide sequence of VGAM1600 RNA, herein designated VGAM RNA, also designated SEQ ID:4311.

A function of VGAM1600 is therefore inhibition of Aquaporin 6, Kidney Specific (AQP6, Accession NM_053286), a gene which participates in distinct physiologic function such as glomerular filtration, tubular endocytosis, and acid-base metabolism. Accordingly, utilities of VGAM1600 include diagnosis, prevention and treatment of diseases and clinical conditions associated with AQP6. The function of AQP6 and its association with various diseases and clinical conditions, has been established by previous studies, as described hereinabove with reference to VGAM340. Cadherin 5, Type 2, VE-cadherin (vascular epithelium) (CDH5, Accession NM_001795) is another VGAM1600 host target gene. CDH5 BINDING SITE is HOST TARGET binding site found in the 3' untranslated region of mRNA encoded by CDH5, corresponding to a HOST TARGET binding site such as BINDING SITE I, BINDING SITE II or BINDING SITE III. Table 2 illustrates the complementarity of the nucleotide sequences of CDH5 BINDING SITE, designated SEQ ID:7547, to the nucleotide sequence of VGAM1600 RNA, herein designated VGAM RNA, also designated SEQ ID:4311.

Another function of VGAM1600 is therefore inhibition of Cadherin 5, Type 2, VE-cadherin (vascular epithelium) (CDH5, Accession NM_001795), a gene which associates with alpha-catenin forming a link to the cytoskeleton. Accordingly, utilities of VGAM1600 include diagnosis, prevention and treatment of diseases and clinical conditions associated with CDH5. The function of CDH5 and its association with various diseases and clinical conditions, has been established by previous studies, as described hereinabove with reference to VGAM1342. Hormonally Upregulated Neu-associated Kinase (HUNK, Accession NM_014586) is another VGAM1600 host target gene. HUNK BINDING SITE is HOST TARGET binding site found in the 3' untranslated region of mRNA encoded by HUNK, corresponding to a HOST TARGET binding site such as BINDING SITE I, BINDING SITE II or BINDING SITE III. Table 2 illustrates the complementarity of the nucleotide sequences of HUNK BINDING SITE, designated SEQ ID:15946, to the nucleotide sequence of VGAM1600 RNA, herein designated VGAM RNA, also designated SEQ ID:4311.

Another function of VGAM1600 is therefore inhibition of Hormonally Upregulated Neu-associated Kinase (HUNK, Accession NM_014586). Accordingly, utilities of VGAM1600 include diagnosis, prevention and treatment of diseases and clinical conditions associated with HUNK. Lymphotoxin Alpha (TNF superfamily, member 1) (LTA, Accession NM_000595) is another VGAM1600 host target gene. LTA BINDING SITE is HOST TARGET binding site found in the 3' untranslated region of mRNA encoded by LTA, corresponding to a HOST TARGET binding site such as BINDING SITE I, BINDING SITE II or BINDING SITE III. Table 2 illustrates the complementarity of the nucleotide sequences of LTA BINDING SITE, designated SEQ ID:6195, to the nucleotide sequence of VGAM1600 RNA, herein designated VGAM RNA, also designated SEQ ID:4311.

Another function of VGAM1600 is therefore inhibition of Lymphotoxin Alpha (TNF superfamily, member 1) (LTA, Accession NM_000595), a gene which is a cytokine that in its homotrimeric form binds to tnfrsf1a/tnfr1, tnfrsf1b/tnfbr and tnfrsf14/hvem. Accordingly, utilities of VGAM1600 include diagnosis, prevention and treatment of diseases and clinical conditions associated with LTA. The function of LTA and its association with various diseases and clinical conditions, has been established by previous studies, as described hereinabove with reference to VGAM662. SNL (Accession NM_003088) is another VGAM1600 host target gene. SNL BINDING SITE is HOST TARGET binding site found in the 3' untranslated region of mRNA encoded by SNL, corresponding to a HOST TARGET binding site such as BINDING SITE I, BINDING SITE II or BINDING SITE III. Table 2 illustrates the complementarity of the nucleotide sequences of SNL BINDING SITE, designated SEQ ID:9063, to the nucleotide sequence of VGAM1600 RNA, herein designated VGAM RNA, also designated SEQ ID:4311.

Another function of VGAM1600 is therefore inhibition of SNL (Accession NM_003088), a gene which organizes filamentous actin into bundles with a minimum of 4.1:1 actin/fascin ratio. Accordingly, utilities of VGAM1600 include diagnosis, prevention and treatment of diseases and clinical conditions associated with SNL. The function of SNL and its association with various diseases and clinical conditions, has been established by previous studies, as described hereinabove with reference to VGAM675. SORCS3 (Accession NM_014978) is another VGAM1600 host target gene. SORCS3 BINDING SITE is HOST TARGET binding site found in the 5' untranslated region of mRNA encoded by SORCS3, corresponding to a HOST TARGET binding site such as BINDING SITE I, BINDING SITE II or BINDING SITE III. Table 2 illustrates the complementarity of the nucleotide sequences of SORCS3 BINDING SITE, designated SEQ ID:17364, to the nucleotide sequence of VGAM1600 RNA, herein designated VGAM RNA, also designated SEQ ID:4311.

Another function of VGAM1600 is therefore inhibition of SORCS3 (Accession NM_014978). Accordingly, utilities of VGAM1600 include diagnosis, prevention and treatment of diseases and clinical conditions associated with SORCS3. Vasoactive Intestinal Peptide Receptor 2 (VIPR2, Accession NM_003382) is another VGAM1600 host target gene. VIPR2 BINDING SITE is HOST TARGET binding site found in the 3' untranslated region of mRNA encoded by VIPR2, corresponding to a HOST TARGET binding site such as BINDING SITE I, BINDING SITE II or BINDING SITE III. Table 2 illustrates the complementarity of the nucleotide sequences of VIPR2 BINDING SITE, designated SEQ ID:9412, to the nucleotide sequence of VGAM1600 RNA, herein designated VGAM RNA, also designated SEQ ID:4311.

Another function of VGAM1600 is therefore inhibition of Vasoactive Intestinal Peptide Receptor 2 (VIPR2, Accession NM_003382). Accordingly, utilities of VGAM1600 include diagnosis, prevention and treatment of diseases and clinical conditions associated with VIPR2. Wingless-type MMTV Integration Site Family, Member 1 (WNT1, Accession NM_005430) is another VGAM1600 host target gene. WNT1 BINDING SITE is HOST TARGET binding site found in the 3' untranslated region of mRNA encoded by WNT1, corresponding to a HOST TARGET binding site such as BINDING SITE I, BINDING SITE II or BINDING SITE III. Table 2 illustrates the complementarity of the nucleotide sequences of WNT1 BINDING SITE, designated SEQ ID:11895, to the nucleotide sequence of VGAM1600 RNA, herein designated VGAM RNA, also designated SEQ ID:4311.

Another function of VGAM1600 is therefore inhibition of Wingless-type MMTV Integration Site Family, Member 1 (WNT1, Accession NM_005430), a gene which may have a role in development of the central nervous system. Accordingly, utilities of VGAM1600 include diagnosis, prevention and treatment of diseases and clinical conditions associated with WNT1. The function of WNT1 and its association with various diseases and clinical conditions, has been established by previous studies, as described hereinabove with reference to VGAM381. DKFZP434P0111 (Accession XM_041116) is another VGAM1600 host target gene. DKFZP434P0111 BINDING SITE is HOST TARGET binding site found in the 3' untranslated region of mRNA encoded by DKFZP434P0111, corresponding to a HOST TARGET binding site such as BINDING SITE I, BINDING SITE II or BINDING SITE III. Table 2 illustrates the complementarity of the nucleotide sequences of DKFZP434P0111 BINDING SITE, designated SEQ ID:33454, to the nucleotide sequence of VGAM1600 RNA, herein designated VGAM RNA, also designated SEQ ID:4311.

Another function of VGAM1600 is therefore inhibition of DKFZP434P0111 (Accession XM_041116). Accordingly, utilities of VGAM1600 include diagnosis, prevention and treatment of diseases and clinical conditions associated with DKFZP434P0111. DKFZp586I021 (Accession NM_032271) is another VGAM1600 host target gene. DKFZp586I021 BINDING SITE is HOST TARGET binding site found in the 3' untranslated region of mRNA encoded by DKFZp586I021, corresponding to a HOST TARGET binding site such as BINDING SITE I, BINDING SITE II or BINDING SITE III. Table 2 illustrates the complementarity of the nucleotide sequences of DKFZp586I021 BINDING SITE, designated SEQ ID:26028, to the nucleotide sequence of VGAM1600 RNA, herein designated VGAM RNA, also designated SEQ ID:4311.

Another function of VGAM1600 is therefore inhibition of DKFZp586I021 (Accession NM_032271). Accordingly, utilities of VGAM1600 include diagnosis, prevention and treatment of diseases and clinical conditions associated with DKFZp586I021. Pyruvate Dehydrogenase Kinase, Isoenzyme 2 (PDK2, Accession NM_002611) is another VGAM1600 host target gene. PDK2 BINDING SITE is HOST TARGET binding site found in the 3' untranslated region of mRNA encoded by PDK2, corresponding to a HOST TARGET binding site such as BINDING SITE I, BINDING SITE II or BINDING SITE III. Table 2 illustrates the complementarity of the nucleotide sequences of PDK2 BINDING SITE, designated SEQ ID:8475, to the nucleotide sequence of VGAM1600 RNA, herein designated VGAM RNA, also designated SEQ ID:4311.

Another function of VGAM1600 is therefore inhibition of Pyruvate Dehydrogenase Kinase, Isoenzyme 2 (PDK2, Accession NM_002611). Accordingly, utilities of VGAM1600 include diagnosis, prevention and treatment of diseases and clinical conditions associated with PDK2. REC8 (Accession NM_005132) is another VGAM1600 host target gene. REC8 BINDING SITE is HOST TARGET binding site found in the 5' untranslated region of mRNA encoded by REC8, corresponding to a HOST TARGET binding site such as BINDING SITE I, BINDING SITE II or BINDING SITE III. Table 2 illustrates the complementarity of the nucleotide sequences of REC8 BINDING SITE, designated SEQ ID:11608, to the nucleotide sequence of VGAM1600 RNA, herein designated VGAM RNA, also designated SEQ ID:4311.

Another function of VGAM1600 is therefore inhibition of REC8 (Accession NM_005132). Accordingly, utilities of VGAM1600 include diagnosis, prevention and treatment of diseases and clinical conditions associated with REC8. SIMRP7 (Accession XM_166462) is another VGAM1600 host target gene. SIMRP7 BINDING SITE is HOST TARGET binding site found in the 3' untranslated region of mRNA encoded by SIMRP7, corresponding to a HOST TARGET binding site such as BINDING SITE I, BINDING SITE II or BINDING SITE III. Table 2 illustrates the complementarity of the nucleotide sequences of SIMRP7 BINDING SITE, designated SEQ ID:44371, to the nucleotide sequence of VGAM1600 RNA, herein designated VGAM RNA, also designated SEQ ID:4311.

Another function of VGAM1600 is therefore inhibition of SIMRP7 (Accession XM_166462). Accordingly, utilities of VGAM1600 include diagnosis, prevention and treatment of diseases and clinical conditions associated with SIMRP7. Tumor Necrosis Factor (ligand) Superfamily, Member 13 (TNFSF13, Accession NM_003808) is another VGAM1600 host target gene. TNFSF13 BINDING SITE is HOST TARGET binding site found in the 5' untranslated region of mRNA encoded by TNFSF13, corresponding to a HOST TARGET binding site such as BINDING SITE I, BINDING SITE II or BINDING SITE III. Table 2 illustrates the complementarity of the nucleotide sequences of TNFSF13 BINDING SITE, designated SEQ ID:9898, to the nucleotide sequence of VGAM1600 RNA, herein designated VGAM RNA, also designated SEQ ID:4311.

Another function of VGAM1600 is therefore inhibition of Tumor Necrosis Factor (ligand) Superfamily, Member 13 (TNFSF13, Accession NM_003808). Accordingly, utilities of VGAM1600 include diagnosis, prevention and treatment of diseases and clinical conditions associated with TNFSF13. LOC145989 (Accession XM_004815) is another VGAM1600 host target gene. LOC145989 BINDING SITE is HOST TARGET binding site found in the 3' untranslated region of mRNA encoded by LOC145989, corresponding to a HOST TARGET binding site such as BINDING SITE I, BINDING SITE II or BINDING SITE III. Table 2 illustrates the complementarity of the nucleotide sequences of LOC145989 BINDING SITE, designated SEQ ID:29951, to the nucleotide sequence of VGAM1600 RNA, herein designated VGAM RNA, also designated SEQ ID:4311.

Another function of VGAM1600 is therefore inhibition of LOC145989 (Accession XM_004815). Accordingly, utilities of VGAM1600 include diagnosis, prevention and treatment of diseases and clinical conditions associated with LOC145989. FIG. 1 further provides a conceptual description of a novel bioinformatically detected viral gene of the present invention, referred to here as Viral Genomic Address Messenger 1601 (VGAM1601) viral gene, which modulates expression of respective host target genes thereof, the function and utility of which host target genes is known in the art.

VGAM1601 is a novel bioinformatically detected regulatory, non protein coding, viral micro RNA (miRNA) gene. The method by which VGAM1601 was detected is described hereinabove with reference to FIGS. 1-8.

VGAM1601 gene, herein designated VGAM GENE, is a viral gene contained in the genome of Human Adenovirus E. VGAM1601 host target gene, herein designated VGAM HOST TARGET GENE, is a human gene contained in the human genome.

VGAM1601 gene encodes a VGAM1601 precursor RNA, herein designated VGAM PRECURSOR RNA. Similar to other miRNA genes, and unlike most ordinary genes, VGAM1601 precursor RNA does not encode a protein. A nucleotide sequence identical or highly similar to the nucleotide sequence of VGAM1601 precursor RNA is designated SEQ ID:1587, and is provided hereinbelow with reference to the sequence listing part. Nucleotide sequence SEQ ID:1587 is located at position 32517 relative to the genome of Human Adenovirus E.

VGAM1601 precursor RNA folds onto itself, forming VGAM1601 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1601 folded precursor RNA into VGAM1601 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM1601 RNA is designated SEQ ID:4312, and is provided hereinbelow with reference to the sequence listing part.

VGAM1601 host target gene, herein designated VGAM HOST TARGET GENE, encodes a corresponding messenger RNA, VGAM1601 host target RNA, herein designated VGAM HOST TARGET RNA. VGAM1601 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1601 RNA, herein designated VGAM RNA, binds complementarily to one or more host target binding sites located in untranslated regions of VGAM1601 host target RNA, herein designated VGAM HOST TARGET RNA. This complementary binding is due to the fact that the nucleotide sequence of VGAM1601 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1601 RNA, herein designated VGAM RNA, may have a different number of host target binding sites in untranslated regions of a VGAM1601 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1601 RNA, herein designated VGAM RNA, to host target binding sites on VGAM1601 host target RNA, herein designated VGAM HOST TARGET RNA, such as BINDING SITE I, BINDING SITE II and BINDING SITE III, inhibits translation of VGAM1601 host target RNA into VGAM1601 host target protein, herein designated VGAM HOST TARGET PROTEIN. VGAM host target protein is therefore outlined by a broken line.

It is appreciated that VGAM1601 host target gene, herein designated VGAM HOST TARGET GENE, in fact represents a plurality of VGAM1601 host target genes. The mRNA of each one of this plurality of VGAM1601 host target genes comprises one or more host target binding sites, each having a nucleotide sequence which is at least partly complementary to VGAM1601 RNA, herein designated VGAM RNA, and which when bound by VGAM1601 RNA causes inhibition of translation of respective one or more VGAM1601 host target proteins.

It is further appreciated by one skilled in the art that the mode of translational inhibition illustrated by FIG. 1 with specific reference to translational inhibition exerted by VGAM1601 gene, herein designated VGAM GENE, on one or more VGAM1601 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1601 is inhibition of expression of host target genes, as part of a novel viral mechanism of attacking a host. Accordingly, utilities of VGAM1601 include diagnosis, prevention and treatment of viral infection by Human Adenovirus E. Specific functions, and accordingly utilities, of VGAM1601 correlate with, and may be deduced from, the identity of the host target genes which VGAM1601 binds and inhibits, and the function of these host target genes, as elaborated hereinbelow.

Nucleotide sequences of the VGAM1601 precursor RNA, herein designated VGAM PRECURSOR RNA, and of the 'diced' VGAM1601 RNA, herein designated VGAM RNA, and a schematic representation of the secondary folding of VGAM1601 folded precursor RNA, herein designated VGAM FOLDED PRECURSOR RNA, of VGAM1601 are further described hereinbelow with reference to Table 1.

Nucleotide sequences of host target binding sites, such as BINDING SITE-I, BINDING SITE-II and BINDING SITE-III of FIG. 1, found on VGAM1601 host target RNA, and schematic representation of the complementarity of each of these host target binding sites to VGAM1601 RNA, herein designated VGAM RNA, are described hereinbelow with reference to Table 2.

As mentioned hereinabove with reference to FIG. 1, a function of VGAM1601 gene, herein designated VGAM is inhibition of expression of VGAM1601 target genes. It is appreciated that specific functions, and accordingly utilities, of VGAM1601 correlate with, and may be deduced from, the identity of the target genes which VGAM1601 binds and inhibits, and the function of these target genes, as elaborated hereinbelow.

Chediak-Higashi Syndrome 1 (CHS1, Accession NM_000081) is a VGAM1601 host target gene. CHS1 BINDING SITE is HOST TARGET binding site found in the 3' untranslated region of mRNA encoded by CHS1, corresponding to a HOST TARGET binding site such as BINDING SITE I, BINDING SITE II or BINDING SITE III. Table 2 illustrates the complementarity of the nucleotide sequences of CHS1 BINDING SITE, designated SEQ ID:5527, to the nucleotide sequence of VGAM1601 RNA, herein designated VGAM RNA, also designated SEQ ID:4312.

A function of VGAM1601 is therefore inhibition of Chediak-Higashi Syndrome 1 (CHS1, Accession NM_000081), a gene which may sort endosomal resident proteins into late multivesicular endosome. Accordingly, utilities of VGAM1601 include diagnosis, prevention and treatment of diseases and clinical conditions associated with CHS1. The function of CHS1 and its association with various diseases and clinical conditions, has been established by previous studies, as described hereinabove with reference to VGAM191. Desmocollin 3 (DSC3, Accession NM_001941) is another VGAM1601 host target gene. DSC3 BINDING SITE1 and DSC3 BINDING SITE2 are HOST TARGET binding sites found in untranslated regions of mRNA encoded by DSC3, corresponding to HOST TARGET binding sites such as BINDING SITE I, BINDING SITE II or BINDING SITE III. Table 2 illustrates the complementarity of the nucleotide sequences of DSC3 BINDING SITE1 and DSC3 BINDING SITE2, designated SEQ ID:7650 and SEQ ID:23661 respectively, to the nucleotide sequence of VGAM1601 RNA, herein designated VGAM RNA, also designated SEQ ID:4312.

Another function of VGAM1601 is therefore inhibition of Desmocollin 3 (DSC3, Accession NM_001941), a gene which is a component of intercellular desmosome junctions. Accordingly, utilities of VGAM1601 include diagnosis, prevention and treatment of diseases and clinical conditions associated with DSC3. The function of DSC3 and its association with various diseases and clinical conditions, has been established by previous studies, as described hereinabove with reference to VGAM230. Mitogen-activated Protein Kinase Kinase Kinase 9 (MAP3K9, Accession XM_027237) is another VGAM1601 host target gene. MAP3K9 BINDING SITE is HOST TARGET binding site found in the 3' untranslated region of mRNA encoded by MAP3K9, corresponding to a HOST TARGET binding site such as BINDING SITE I, BINDING SITE II or BINDING SITE III. Table 2 illustrates the complementarity of the nucleotide sequences of MAP3K9 BINDING SITE, designated SEQ ID:30459, to the nucleotide sequence of VGAM1601 RNA, herein designated VGAM RNA, also designated SEQ ID:4312.

Another function of VGAM1601 is therefore inhibition of Mitogen-activated Protein Kinase Kinase Kinase 9 (MAP3K9, Accession XM_027237), a gene which is a MIXED-LINEAGE KINASE 1. Accordingly, utilities of VGAM1601 include diagnosis, prevention and treatment of diseases and clinical conditions associated with MAP3K9. The function of MAP3K9 has been established by previous studies. While protein kinases vary widely in their primary structures, each contains a catalytic domain of 250 to 300 amino acids, which includes 11 highly conserved motifs or subdomains separated by sequences of amino acids with reduced conservation. The presence of these motifs within a newly characterized sequence is, therefore, strongly predictive of PK activity. Furthermore, specificity of a PK for phosphorylation of either tyr or ser/thr can be predicted by the sequence of 2 of the motifs (VIb and VIII) in which different residues are conserved in each class. PKs with similar substrates or modes of activation cluster into families, whose members share a higher degree of catalytic-domain sequence identity with each other than with other members of the same PK specificity class. Hanks (1991) described 10 families of ser/thr PKs and 11 families of tyr PKs. Using the polymerase chain reaction to study mRNA expressed in human epithelial tumor cells, Dorow et al. (1993) identified a member of a new family of protein kinases. The catalytic domain of these kinases had amino acid sequence similarity to both the tyr-specific and the ser/thr-specific kinase classes. Dorow et al. (1993) isolated clones representing 2 members of this new family from a human colonic epithelial cDNA library. The predicted amino acid sequence revealed that, in addition to their unusual nature of the kinase catalytic domains, they contain 2 leu/ile-zipper motifs and a basic sequence near their C-termini. Because they possess domains associated with proteins from 2 distinct functional groups, these kinases were referred to as mixed-lineage kinases (MLK) 1 and 2. MLK1 mRNA was found to be expressed in epithelial tumor cell lines of colonic, breast, and esophageal origin. The similarity score with MLK1 varied from 73 down to 61 for the following tyr PKs; ROS (OMIM Ref. No. 165020), ABL (OMIM Ref. No. 189980), EGFR (OMIM Ref. No. 131550), SRC (OMIM Ref. No. 190090), TRK (OMIM Ref. No. 164970), PDGFR (173410, 173490), INSR (OMIM Ref. No. 147670). The similarity score with MLK1 was 63 for RAF (OMIM Ref. No. 164760) and 52 for MOS (OMIM Ref. No. 190060)

Full details of the abovementioned studies are described in the following publications, the disclosure of which are hereby incorporated by reference:

Dorow, D. S.; Devereux, L.; Dietzsch, E.; De Kretser, T.: Identification of a new family of human epithelial protein kinases containing two leucine/isoleucine-zipper domains. Europ. J. Biochem. 213:701-710, 1993; and Hanks, S. K.: Eukaryotic protein kinases. Curr. Opin. Struct. Biol. 1: 369-383, 1991.

Further studies establishing the function and utilities of MAP3K9 are found in John Hopkins OMIM database record ID 600136, and in sited publications numbered 1587-1588 listed in the bibliography section hereinbelow, which are also hereby incorporated by reference. Sialidase 3 (membrane sialidase) (NEU3, Accession NM_006656) is another VGAM1601 host target gene. NEU3 BINDING SITE is HOST TARGET binding site found in the 3' untranslated region of mRNA encoded by NEU3, corresponding to a HOST TARGET binding site such as BINDING SITE I, BINDING SITE II or BINDING SITE III. Table 2 illustrates the complementarity of the nucleotide sequences of NEU3 BINDING SITE, designated SEQ ID:13453, to the nucleotide sequence of VGAM1601 RNA, herein designated VGAM RNA, also designated SEQ ID:4312.

Another function of VGAM1601 is therefore inhibition of Sialidase 3 (membrane sialidase) (NEU3, Accession NM_006656). Accordingly, utilities of VGAM1601 include diagnosis, prevention and treatment of diseases and clinical conditions associated with NEU3. Nuclear Receptor Subfamily 3, Group C, Member 2 (NR3C2, Accession NM_000901) is another VGAM1601 host target gene. NR3C2 BINDING SITE is HOST TARGET binding site found in the 3' untranslated region of mRNA encoded by NR3C2, corresponding to a HOST TARGET binding site such as BINDING SITE I, BINDING SITE II or BINDING SITE III. Table 2 illustrates the complementarity of the nucleotide sequences of NR3C2 BINDING SITE, designated SEQ ID:6597, to the nucleotide sequence of VGAM1601 RNA, herein designated VGAM RNA, also designated SEQ ID:4312.

Another function of VGAM1601 is therefore inhibition of Nuclear Receptor Subfamily 3, Group C, Member 2 (NR3C2, Accession NM_000901), a gene which is to increase ion and water transport and thus raise extracellular fluid volume and blood pressure and lower potassium levels. Accordingly, utilities of VGAM1601 include diagnosis, prevention and treatment of diseases and clinical conditions associated with NR3C2. The function of NR3C2 and its association with various diseases and clinical conditions, has been established by previous studies, as described hereinabove with reference to VGAM186. Protocadherin Alpha 1 (PCDHA1, Accession NM_031411) is another VGAM1601 host target gene. PCDHA1 BINDING SITE1 and PCDHA1 BINDING SITE2 are HOST TARGET binding sites found in untranslated regions of mRNA encoded by PCDHA1, corresponding to HOST TARGET binding sites such as BINDING SITE I, BINDING SITE II or BINDING SITE III. Table 2 illustrates the complementarity of the nucleotide sequences of PCDHA1 BINDING SITE1 and PCDHA1 BINDING SITE2, designated SEQ ID:25380 and SEQ ID:20861 respectively, to the nucleotide sequence of VGAM1601 RNA, herein designated VGAM RNA, also designated SEQ ID:4312.

Another function of VGAM1601 is therefore inhibition of Protocadherin Alpha 1 (PCDHA1, Accession NM_031411). Accordingly, utilities of VGAM1601 include diagnosis, prevention and treatment of diseases and clinical conditions associated with PCDHA1. Protocadherin Alpha 10 (PCDHA10, Accession NM_031860) is another VGAM1601 host target gene. PCDHA10 BINDING SITE1 and PCDHA10 BINDING SITE2 are HOST TARGET binding sites found in untranslated regions of mRNA encoded by PCDHA10, corresponding to HOST TARGET binding sites such as BINDING SITE I, BINDING SITE II or BINDING SITE III. Table 2 illustrates the complementarity of the nucleotide sequences of PCDHA10 BINDING SITE1 and PCDHA10 BINDING SITE2, designated SEQ ID:25612 and SEQ ID:20881 respectively, to the nucleotide sequence of VGAM1601 RNA, herein designated VGAM RNA, also designated SEQ ID:4312.

Another function of VGAM1601 is therefore inhibition of Protocadherin Alpha 10 (PCDHA10, Accession NM_031860). Accordingly, utilities of VGAM1601 include diagnosis, prevention and treatment of diseases and clinical conditions associated with PCDHA10. Protocadherin Alpha 13 (PCDHA13, Accession NM_018904) is another VGAM1601 host target gene. PCDHA13 BINDING SITE is HOST TARGET binding site found in the 3' untranslated region of mRNA encoded by PCDHA13, corresponding to a HOST TARGET binding site such as BINDING SITE I, BINDING SITE II or BINDING SITE III. Table 2 illustrates the complementarity of the nucleotide sequences of PCDHA13 BINDING SITE, designated SEQ ID:20902, to the nucleotide sequence of VGAM1601 RNA, herein designated VGAM RNA, also designated SEQ ID:4312.

Another function of VGAM1601 is therefore inhibition of Protocadherin Alpha 13 (PCDHA13, Accession NM_018904). Accordingly, utilities of VGAM1601 include diagnosis, prevention and treatment of diseases and clinical conditions associated with PCDHA13. Protocadherin Alpha 2 (PCDHA2, Accession NM_018905) is another VGAM1601 host target gene. PCDHA2 BINDING SITE is HOST TARGET binding site found in the 3' untranslated region of mRNA encoded by PCDHA2, corresponding to a HOST TARGET binding site such as BINDING SITE I, BINDING SITE II or BINDING SITE III. Table 2 illustrates the complementarity of the nucleotide sequences of PCDHA2 BINDING SITE, designated SEQ ID:20912, to the nucleotide sequence of VGAM1601 RNA, herein designated VGAM RNA, also designated SEQ ID:4312.

Another function of VGAM1601 is therefore inhibition of Protocadherin Alpha 2 (PCDHA2, Accession NM_018905). Accordingly, utilities of VGAM1601 include diagnosis, prevention and treatment of diseases and clinical conditions associated with PCDHA2. Protocadherin Alpha 3 (PCDHA3, Accession NM_018906) is another VGAM1601 host target gene. PCDHA3 BINDING SITE is HOST TARGET binding site found in the 3' untranslated region of mRNA encoded by PCDHA3, corresponding to a HOST TARGET binding site such as BINDING SITE I, BINDING SITE II or BINDING SITE III. Table 2 illustrates the complementarity of the nucleotide sequences of PCDHA3 BINDING SITE, designated SEQ ID:20922, to the nucleotide sequence of VGAM1601 RNA, herein designated VGAM RNA, also designated SEQ ID:4312.

Another function of VGAM1601 is therefore inhibition of Protocadherin Alpha 3 (PCDHA3, Accession NM_018906). Accordingly, utilities of VGAM1601 include diagnosis, prevention and treatment of diseases and clinical conditions associated with PCDHA3. Protocadherin Alpha 4 (PCDHA4, Accession NM_018907) is another VGAM1601 host target gene. PCDHA4 BINDING SITE is HOST TARGET binding site found in the 3' untranslated region of mRNA encoded by PCDHA4, corresponding to a HOST TARGET binding site such as BINDING SITE I, BINDING SITE II or BINDING SITE III. Table 2 illustrates the complementarity of the nucleotide sequences of PCDHA4 BINDING SITE, designated SEQ ID:20932, to the nucleotide sequence of VGAM1601 RNA, herein designated VGAM RNA, also designated SEQ ID:4312.

Another function of VGAM1601 is therefore inhibition of Protocadherin Alpha 4 (PCDHA4, Accession NM_018907). Accordingly, utilities of VGAM1601 include diagnosis, prevention and treatment of diseases and clinical conditions associated with PCDHA4. Protocadherin Alpha 5 (PCDHA5, Accession NM_018908) is another VGAM1601 host target gene. PCDHA5 BINDING SITE is HOST TARGET binding site found in the 3' untranslated region of mRNA encoded by PCDHA5, corresponding to a HOST TARGET binding site such as BINDING SITE I, BINDING SITE II or BINDING SITE III. Table 2 illustrates the complementarity of the nucleotide sequences of PCDHA5 BINDING SITE, designated SEQ ID:20942, to the nucleotide sequence of VGAM1601 RNA, herein designated VGAM RNA, also designated SEQ ID:4312.

Another function of VGAM1601 is therefore inhibition of Protocadherin Alpha 5 (PCDHA5, Accession NM_018908). Accordingly, utilities of VGAM1601 include diagnosis, prevention and treatment of diseases and clinical conditions associated with PCDHA5. Protocadherin Alpha 6 (PCDHA6, Accession NM_018909) is another VGAM1601 host target gene. PCDHA6 BINDING SITE1 and PCDHA6 BINDING SITE2 are HOST TARGET binding sites found in untranslated regions of mRNA encoded by PCDHA6, corresponding to HOST TARGET binding sites such as BINDING SITE I, BINDING SITE II or BINDING SITE III. Table 2 illustrates the complementarity of the nucleotide sequences of PCDHA6 BINDING SITE1 and PCDHA6 BINDING SITE2, designated SEQ ID:20952 and SEQ ID:25584 respectively, to the nucleotide sequence of VGAM1601 RNA, herein designated VGAM RNA, also designated SEQ ID:4312.

Another function of VGAM1601 is therefore inhibition of Protocadherin Alpha 6 (PCDHA6, Accession NM_018909). Accordingly, utilities of VGAM1601 include diagnosis, prevention and treatment of diseases and clinical conditions associated with PCDHA6. Protocadherin Alpha 8 (PCDHA8, Accession NM_018911) is another VGAM1601 host target gene. PCDHA8 BINDING SITE is HOST TARGET binding site found in the 3' untranslated region of mRNA encoded by PCDHA8, corresponding to a HOST TARGET binding site such as BINDING SITE I, BINDING SITE II or BINDING SITE III. Table 2 illustrates the complementarity of the nucleotide sequences of PCDHA8 BINDING SITE, designated SEQ ID:20972, to the nucleotide sequence of VGAM1601 RNA, herein designated VGAM RNA, also designated SEQ ID:4312.

Another function of VGAM1601 is therefore inhibition of Protocadherin Alpha 8 (PCDHA8, Accession NM_018911). Accordingly, utilities of VGAM1601 include diagnosis, prevention and treatment of diseases and clinical conditions associated with PCDHA8. Protocadherin Alpha 9 (PCDHA9, Accession NM_031857) is another VGAM1601 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:25597, to the nucleotide sequence of VGAM1601 RNA, herein designated VGAM RNA, also designated SEQ ID:4312.

Another function of VGAM1601 is therefore inhibition of Protocadherin Alpha 9 (PCDHA9, Accession NM_031857), a gene which is a calcium-dependent cell-adhesion protein. Accordingly, utilities of VGAM1601 include diagnosis, prevention and treatment of diseases and clinical conditions associated with PCDHA9. The function of PCDHA9 and its association with various diseases and clinical conditions, has been established by previous studies, as described hereinabove with reference to VGAM71. Protocadherin Alpha Subfamily C, 1 (PCDHAC1, Accession NM_018898) is another VGAM1601 host target gene. PCDHAC1 BINDING SITE is HOST TARGET binding site found in the 3' untranslated region of mRNA encoded by PCDHAC1, corresponding to a HOST TARGET binding site such as BINDING SITE I, BINDING SITE II or BINDING SITE III. Table 2 illustrates the complementarity of the nucleotide sequences of PCDHAC1 BINDING SITE, designated SEQ ID:20841, to the nucleotide sequence of VGAM1601 RNA, herein designated VGAM RNA, also designated SEQ ID:4312.

Another function of VGAM1601 is therefore inhibition of Protocadherin Alpha Subfamily C, 1 (PCDHAC1, Accession NM_018898). Accordingly, utilities of VGAM1601 include diagnosis, prevention and treatment of diseases and clinical conditions associated with PCDHAC1. Protocadherin Alpha Subfamily C, 2 (PCDHAC2, Accession NM_018899) is another VGAM1601 host target gene. PCDHAC2 BINDING SITE is HOST TARGET binding site found in the 3' untranslated region of mRNA encoded by PCDHAC2, corresponding to a HOST TARGET binding site such as BINDING SITE I, BINDING SITE II or BINDING SITE III. Table 2 illustrates the complementarity of the nucleotide sequences of PCDHAC2 BINDING SITE, designated SEQ ID:20851, to the nucleotide sequence of VGAM1601 RNA, herein designated VGAM RNA, also designated SEQ ID:4312.

Another function of VGAM1601 is therefore inhibition of Protocadherin Alpha Subfamily C, 2 (PCDHAC2, Accession NM_018899). Accordingly, utilities of VGAM1601 include diagnosis, prevention and treatment of diseases and clinical conditions associated with PCDHAC2. HIC (Accession XM_041273) is another VGAM1601 host target gene. HIC BINDING SITE is HOST TARGET binding site found in the 3' untranslated region of mRNA encoded by HIC, corresponding to a HOST TARGET binding site such as BINDING SITE I, BINDING SITE II or BINDING SITE III. Table 2 illustrates the complementarity of the nucleotide sequences of HIC BINDING SITE, designated SEQ ID:33492, to the nucleotide sequence of VGAM1601 RNA, herein designated VGAM RNA, also designated SEQ ID:4312.

Another function of VGAM1601 is therefore inhibition of HIC (Accession XM_041273). Accordingly, utilities of VGAM1601 include diagnosis, prevention and treatment of diseases and clinical conditions associated with HIC. KIAA0648 (Accession XM_094043) is another VGAM1601 host target gene. KIAA0648 BINDING SITE is HOST TARGET binding site found in the 3" untranslated region of mRNA encoded by KIAA0648, corresponding to a HOST TARGET binding site such as BINDING SITE I, BINDING SITE II or BINDING SITE III. Table 2 illustrates the complementarity of the nucleotide sequences of KIAA0648 BINDING SITE, designated SEQ ID:40219, to the nucleotide sequence of VGAM1601 RNA, herein designated VGAM RNA, also designated SEQ ID:4312.

Another function of VGAM1601 is therefore inhibition of KIAA0648 (Accession XM_094043). Accordingly, utilities of VGAM1601 include diagnosis, prevention and treatment of diseases and clinical conditions associated with KIAA0648. SH3 Domain Binding Glutamic Acid-rich Protein Like 2 (SH3BGRL2, Accession NM_031469) is another VGAM1601 host target gene. SH3BGRL2 BINDING SITE is HOST TARGET binding site found in the 3' untranslated region of mRNA encoded by SH3BGRL2, corresponding to a HOST TARGET binding site such as BINDING SITE I, BINDING SITE II or BINDING SITE III. Table 2 illustrates the complementarity of the nucleotide sequences of SH3BGRL2 BINDING SITE, designated SEQ ID:25525, to the nucleotide sequence of VGAM1601 RNA, herein designated VGAM RNA, also designated SEQ ID:4312.

Another function of VGAM1601 is therefore inhibition of SH3 Domain Binding Glutamic Acid-rich Protein Like 2 (SH3BGRL2, Accession NM_031469). Accordingly, utilities of VGAM1601 include diagnosis, prevention and treatment of diseases and clinical conditions associated with SH3BGRL2. LOC51133 (Accession NM_016121) is another VGAM1601 host target gene. LOC51133 BINDING SITE is HOST TARGET binding site found in the 5' untranslated region of mRNA encoded by LOC51133, corresponding to a HOST TARGET binding site such as BINDING SITE I, BINDING SITE II or BINDING SITE III. Table 2 illustrates the complementarity of the nucleotide sequences of LOC51133 BINDING SITE, designated SEQ ID:18204, to the nucleotide sequence of VGAM1601 RNA, herein designated VGAM RNA, also designated SEQ ID:4312.

Another function of VGAM1601 is therefore inhibition of LOC51133 (Accession NM_016121). Accordingly, utilities of VGAM1601 include diagnosis, prevention and treatment of diseases and clinical conditions associated with LOC51133. LOC91286 (Accession XM_037444) is another VGAM1601 host target gene. LOC91286 BINDING SITE is HOST TARGET binding site found in the 5' untranslated region of mRNA encoded by LOC91286, corresponding to a HOST TARGET binding site such as BINDING SITE I, BINDING SITE II or BINDING SITE III. Table 2 illustrates the complementarity of the nucleotide sequences of LOC91286 BINDING SITE, designated SEQ ID:32622, to the nucleotide sequence of VGAM1601 RNA, herein designated VGAM RNA, also designated SEQ ID:4312.

Another function of VGAM1601 is therefore inhibition of LOC91286 (Accession XM_037444). Accordingly, utilities of VGAM1601 include diagnosis, prevention and treatment of diseases and clinical conditions associated with LOC91286. FIG. 1 further provides a conceptual description of a novel bioinformatically detected viral gene of the present invention, referred to here as Viral Genomic Address Messenger 1602 (VGAM1602) viral gene, which modulates expression of respective host target genes thereof, the function and utility of which host target genes is known in the art.

VGAM1602 is a novel bioinformatically detected regulatory, non protein coding, viral micro RNA (miRNA) gene. The method by which VGAM1602 was detected is described hereinabove with reference to FIGS. 1-8.

VGAM1602 gene, herein designated VGAM GENE, is a viral gene contained in the genome of Human Adenovirus E. VGAM1602 host target gene, herein designated VGAM HOST TARGET GENE, is a human gene contained in the human genome.

VGAM1602 gene encodes a VGAM1602 precursor RNA, herein designated VGAM PRECURSOR RNA. Similar to other miRNA genes, and unlike most ordinary genes, VGAM1602 precursor RNA does not encode a protein. A nucleotide sequence identical or highly similar to the nucleotide sequence of VGAM1602 precursor RNA is designated SEQ ID:1588, and is provided hereinbelow with reference to the sequence listing part. Nucleotide sequence SEQ ID:1588 is located at position 27497 relative to the genome of Human Adenovirus E.

VGAM1602 precursor RNA folds onto itself, forming VGAM1602 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1602 folded precursor RNA into VGAM1602 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 90%) nucleotide sequence of VGAM1602 RNA is designated SEQ ID:4313, and is provided hereinbelow with reference to the sequence listing part.

VGAM1602 host target gene, herein designated VGAM HOST TARGET GENE, encodes a corresponding messenger RNA, VGAM1602 host target RNA, herein designated VGAM HOST TARGET RNA. VGAM1602 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1602 RNA, herein designated VGAM RNA, binds complementarily to one or more host target binding sites located in untranslated regions of VGAM1602 host target RNA, herein designated VGAM HOST TARGET RNA. This complementary binding is due to the fact that the nucleotide sequence of VGAM1602 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1602 RNA, herein designated VGAM RNA, may have a different number of host target binding sites in untranslated regions of a VGAM1602 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1602 RNA, herein designated VGAM RNA, to host target binding sites on VGAM1602 host target RNA, herein designated VGAM HOST TARGET RNA, such as BINDING SITE I, BINDING SITE II and BINDING SITE III, inhibits translation of VGAM1602 host target RNA into VGAM1602 host target protein, herein designated VGAM HOST TARGET PROTEIN. VGAM host target protein is therefore outlined by a broken line.

It is appreciated that VGAM1602 host target gene, herein designated VGAM HOST TARGET GENE, in fact represents a plurality of VGAM1602 host target genes. The mRNA of each one of this plurality of VGAM1602 host target genes comprises one or more host target binding sites, each having a nucleotide sequence which is at least partly complementary to VGAM1602 RNA, herein designated VGAM RNA, and which when bound by VGAM1602 RNA causes inhibition of translation of respective one or more VGAM1602 host target proteins.

It is further appreciated by one skilled in the art that the mode of translational inhibition illustrated by FIG. 1 with specific reference to translational inhibition exerted by VGAM1602 gene, herein designated VGAM GENE, on one or more VGAM1602 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1602 is inhibition of expression of host target genes, as part of a novel viral mechanism of attacking a host. Accordingly, utilities of VGAM1602 include diagnosis, prevention and treatment of viral infection by Human Adenovirus E. Specific functions, and accordingly utilities, of VGAM1602 correlate with, and may be deduced from, the identity of the host target genes which VGAM1602 binds and inhibits, and the function of these host target genes, as elaborated hereinbelow.

Nucleotide sequences of the VGAM1602 precursor RNA, herein designated VGAM PRECURSOR RNA, and of the 'diced' VGAM1602 RNA, herein designated VGAM RNA, and a schematic representation of the secondary folding of VGAM1602 folded precursor RNA, herein designated VGAM FOLDED PRECURSOR RNA, of VGAM1602 are further described hereinbelow with reference to Table 1.

Nucleotide sequences of host target binding sites, such as BINDING SITE-I, BINDING SITE-II and BINDING SITE-III of FIG. 1, found on VGAM1602 host target RNA, and schematic representation of the complementarity of each of these host target binding sites to VGAM1602 RNA, herein designated VGAM RNA, are described hereinbelow with reference to Table 2.

As mentioned hereinabove with reference to FIG. 1, a function of VGAM1602 gene, herein designated VGAM is inhibition of expression of VGAM1602 target genes. It is appreciated that specific functions, and accordingly utilities, of VGAM1602 correlate with, and may be deduced from, the identity of the target genes which VGAM1602 binds and inhibits, and the function of these target genes, as elaborated hereinbelow.

Deoxyguanosine Kinase (DGUOK, Accession NM_080915) is a VGAM1602 host target gene. DGUOK BINDING SITE1 and DGUOK BINDING SITE2 are HOST TARGET binding sites found in untranslated regions of mRNA encoded by DGUOK, corresponding to HOST TARGET binding sites such as BINDING SITE I, BINDING SITE II or BINDING SITE III. Table 2 illustrates the complementarity of the nucleotide sequences of DGUOK BINDING SITE1 and DGUOK BINDING SITE2, designated SEQ ID:28137 and SEQ ID:28140 respectively, to the nucleotide sequence of VGAM1602 RNA, herein designated VGAM RNA, also designated SEQ ID:4313.

A function of VGAM1602 is therefore inhibition of Deoxyguanosine Kinase (DGUOK, Accession NM_080915), a gene which is deoxyguanosine kinase and mediates phosphorylation of several deoxyribonucleosides. Accordingly, utilities of VGAM1602 include diagnosis, prevention and treatment of diseases and clinical conditions associated with DGUOK. The function of DGUOK and its association with various diseases and clinical conditions, has been established by previous studies, as described hereinabove with reference to VGAM121. FLJ12505 (Accession NM_024749) is another VGAM1602 host target gene. FLJ12505 BINDING SITE is HOST TARGET binding site found in the 5' untranslated region of mRNA encoded by FLJ12505, corresponding to a HOST TARGET binding site such as BINDING SITE I, BINDING SITE II or BINDING SITE III. Table 2 illustrates the complementarity of the nucleotide sequences of FLJ12505 BINDING SITE, designated SEQ ID:24091, to the nucleotide sequence of VGAM1602 RNA, herein designated VGAM RNA, also designated SEQ ID:4313.

Another function of VGAM1602 is therefore inhibition of FLJ12505 (Accession NM_024749). Accordingly, utilities of VGAM1602 include diagnosis, prevention and treatment of diseases and clinical conditions associated with FLJ12505. LOC147639 (Accession XM_085822) is another VGAM1602 host target gene. LOC147639 BINDING SITE is HOST TARGET binding site found in the 5' untranslated region of mRNA encoded by LOC147639, corresponding to a HOST TARGET binding site such as BINDING SITE I, BINDING SITE II or BINDING SITE III. Table 2 illustrates the complementarity of the nucleotide sequences of LOC147639 BINDING SITE, designated SEQ ID:38343, to the nucleotide sequence of VGAM1602 RNA, herein designated VGAM RNA, also designated SEQ ID:4313.

Another function of VGAM1602 is therefore inhibition of LOC147639 (Accession XM_085822). Accordingly, utilities of VGAM1602 include diagnosis, prevention and treatment of diseases and clinical conditions associated with LOC147639. LOC203286 (Accession XM_117526) is another VGAM1602 host target gene. LOC203286 BINDING SITE is HOST TARGET binding site found in the 5' untranslated region of mRNA encoded by LOC203286, corresponding to a HOST TARGET binding site such as BINDING SITE I, BINDING SITE II or BINDING SITE III. Table 2 illustrates the complementarity of the nucleotide sequences of LOC203286 BINDING SITE, designated SEQ ID:43495, to the nucleotide sequence of VGAM1602 RNA, herein designated VGAM RNA, also designated SEQ ID:4313.

Another function of VGAM1602 is therefore inhibition of LOC203286 (Accession XM_117526). Accordingly, utilities of VGAM1602 include diagnosis, prevention and treatment of diseases and clinical conditions associated with LOC203286. LOC221773 (Accession XM_165802) is another VGAM1602 host target gene. LOC221773 BINDING SITE is HOST TARGET binding site found in the 3' untranslated region of mRNA encoded by LOC221773, corresponding to a HOST TARGET binding site such as BINDING SITE I, BINDING SITE II or BINDING SITE III. Table 2 illustrates the complementarity of the nucleotide sequences of LOC221773 BINDING SITE, designated SEQ ID:43766, to the nucleotide sequence of VGAM1602 RNA, herein designated VGAM RNA, also designated SEQ ID:4313.

Another function of VGAM1602 is therefore inhibition of LOC221773 (Accession XM_165802). Accordingly, utilities of VGAM1602 include diagnosis, prevention and treatment of diseases and clinical conditions associated with LOC221773. FIG. 1 further provides a conceptual description of a novel bioinformatically detected viral gene of the present invention, referred to here as Viral Genomic Address Messenger 1603 (VGAM1603) viral gene, which modulates expression of respective host target genes thereof, the function and utility of which host target genes is known in the art.

VGAM1603 is a novel bioinformatically detected regulatory, non protein coding, viral micro RNA (miRNA) gene. The method by which VGAM1603 was detected is described hereinabove with reference to FIGS. 1-8.

VGAM1603 gene, herein designated VGAM GENE, is a viral gene contained in the genome of Taura Syndrome Virus. VGAM1603 host target gene, herein designated VGAM HOST TARGET GENE, is a human gene contained in the human genome.

VGAM1603 gene encodes a VGAM1603 precursor RNA, herein designated VGAM PRECURSOR RNA. Similar to other miRNA genes, and unlike most ordinary genes, VGAM1603 precursor RNA does not encode a protein. A nucleotide sequence identical or highly similar to the nucleotide sequence of VGAM1603 precursor RNA is designated SEQ ID:1589, and is provided hereinbelow with reference to the sequence listing part. Nucleotide sequence SEQ ID:1589 is located at position 4189 relative to the genome of Taura Syndrome Virus.

VGAM1603 precursor RNA folds onto itself, forming VGAM1603 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1603 folded precursor RNA into VGAM1603 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1603 RNA is designated SEQ ID:4314, and is provided hereinbelow with reference to the sequence listing part.

VGAM1603 host target gene, herein designated VGAM HOST TARGET GENE, encodes a corresponding messenger RNA, VGAM1603 host target RNA, herein designated VGAM HOST TARGET RNA. VGAM1603 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1603 RNA, herein designated VGAM RNA, binds complementarily to one or more host target binding sites located in untranslated regions of VGAM1603 host target RNA, herein designated VGAM HOST TARGET RNA. This complementary binding is due to the fact that the nucleotide sequence of VGAM1603 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1603 RNA, herein designated VGAM RNA, may have a different number of host target binding sites in untranslated regions of a VGAM1603 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1603 RNA, herein designated VGAM RNA, to host target binding sites on VGAM1603 host target RNA, herein designated VGAM HOST TARGET RNA, such as BINDING SITE I, BINDING SITE II and BINDING SITE III, inhibits translation of VGAM1603 host target RNA into VGAM1603 host target protein, herein designated VGAM HOST TARGET PROTEIN. VGAM host target protein is therefore outlined by a broken line.

It is appreciated that VGAM1603 host target gene, herein designated VGAM HOST TARGET GENE, in fact represents a plurality of VGAM1603 host target genes. The mRNA of each one of this plurality of VGAM1603 host target genes comprises one or more host target binding sites, each having a nucleotide sequence which is at least partly complementary to VGAM1603 RNA, herein designated VGAM RNA, and which when bound by VGAM1603 RNA causes inhibition of translation of respective one or more VGAM1603 host target proteins.

It is further appreciated by one skilled in the art that the mode of translational inhibition illustrated by FIG. 1 with specific reference to translational inhibition exerted by VGAM1603 gene, herein designated VGAM GENE, on one or more VGAM1603 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1603 is inhibition of expression of host target genes, as part of a novel viral mechanism of attacking a host. Accordingly, utilities of VGAM1603 include diagnosis, prevention and treatment of viral infection by Taura Syndrome Virus. Specific functions, and accordingly utilities, of VGAM1603 correlate with, and may be deduced from, the identity of the host target genes which VGAM1603 binds and inhibits, and the function of these host target genes, as elaborated hereinbelow.

Nucleotide sequences of the VGAM1603 precursor RNA, herein designated VGAM PRECURSOR RNA, and of the 'diced' VGAM1603 RNA, herein designated VGAM RNA, and a schematic representation of the secondary folding of VGAM1603 folded precursor RNA, herein designated VGAM FOLDED PRECURSOR RNA, of VGAM1603 are further described hereinbelow with reference to Table 1.

Nucleotide sequences of host target binding sites, such as BINDING SITE-I, BINDING SITE-II and BINDING SITE-III of FIG. 1, found on VGAM1603 host target RNA, and schematic representation of the complementarity of each of these host target binding sites to VGAM1603 RNA, herein designated VGAM RNA, are described hereinbelow with reference to Table 2.

As mentioned hereinabove with reference to FIG. 1, a function of VGAM1603 gene, herein designated VGAM is inhibition of expression of VGAM1603 target genes. It is appreciated that specific functions, and accordingly utilities, of VGAM1603 correlate with, and may be deduced from, the identity of the target genes which VGAM1603 binds and inhibits, and the function of these target genes, as elaborated hereinbelow.

Microtubule-associated Protein 1B (MAP1B, Accession NM_005909) is a VGAM1603 host target gene. MAP1B BINDING SITE1 and MAP1B BINDING SITE2 are HOST TARGET binding sites found in untranslated regions of mRNA encoded by MAP1B, corresponding to HOST TARGET binding sites such as BINDING SITE I, BINDING SITE II or BINDING SITE III. Table 2 illustrates the complementarity of the nucleotide sequences of MAP1B BINDING SITE1 and MAP1B BINDING SITE2, designated SEQ ID:12536 and SEQ ID:25713 respectively, to the nucleotide sequence of VGAM1603 RNA, herein designated VGAM RNA, also designated SEQ ID:4314.

A function of VGAM1603 is therefore inhibition of Microtubule-associated Protein 1B (MAP1B, Accession NM_005909), a gene which may have a role in neuronal plasticity and brain development. Accordingly, utilities of VGAM1603 include diagnosis, prevention and treatment of diseases and clinical conditions associated with MAP1B. The function of MAP1B and its association with various diseases and clinical conditions, has been established by previous studies, as described hereinabove with reference to VGAM316. Chromosome 22 Open Reading Frame 5 (C22orf5, Accession NM_012264) is another VGAM1603 host target gene. C22orf5 BINDING SITE is HOST TARGET binding site found in the 3' untranslated region of mRNA encoded by C22orf5, corresponding to a HOST TARGET binding site such as BINDING SITE I, BINDING SITE II or BINDING SITE III. Table 2 illustrates the complementarity of the nucleotide sequences of C22orf5 BINDING SITE, designated SEQ ID:14582, to the nucleotide sequence of VGAM1603 RNA, herein designated VGAM RNA, also designated SEQ ID:4314.

Another function of VGAM1603 is therefore inhibition of Chromosome 22 Open Reading Frame 5 (C22orf5, Accession NM_012264). Accordingly, utilities of VGAM1603 include diagnosis, prevention and treatment of diseases and clinical conditions associated with C22orf5. Cell Adhesion Molecule with Homology to L1CAM (close homolog of L1) (CHL1, Accession NM_006614) is another VGAM1603 host target gene. CHL1 BINDING SITE is HOST TARGET binding site found in the 3' untranslated region of mRNA encoded by CHL1, corresponding to a HOST TARGET binding site such as BINDING SITE I, BINDING SITE II or BINDING SITE III. Table 2 illustrates the complementarity of the nucleotide sequences of CHL1 BINDING SITE, designated SEQ ID:13389, to the nucleotide sequence of VGAM1603 RNA, herein designated VGAM RNA, also designated SEQ ID:4314.

Another function of VGAM1603 is therefore inhibition of Cell Adhesion Molecule with Homology to L1CAM (close homolog of L1) (CHL1, Accession NM_006614). Accordingly, utilities of VGAM1603 include diagnosis, prevention and treatment of diseases and clinical conditions associated with CHL1. KIAA1910 (Accession XM_055514) is another VGAM1603 host target gene. KIAA1910 BINDING SITE is HOST TARGET binding site found in the 3' untranslated region of mRNA encoded by KIAA1910, corresponding to a HOST TARGET binding site such as BINDING SITE I, BINDING SITE II or BINDING SITE III. Table 2 illustrates the complementarity of the nucleotide sequences of KIAA1910 BINDING SITE, designated SEQ ID:36283, to the nucleotide sequence of VGAM1603 RNA, herein designated VGAM RNA, also designated SEQ ID:4314.

Another function of VGAM1603 is therefore inhibition of KIAA1910 (Accession XM_055514). Accordingly, utilities of VGAM1603 include diagnosis, prevention and treatment of diseases and clinical conditions associated with KIAA1910. Prostate Cancer Associated Protein 7 (PCANAP7, Accession XM_167803) is another VGAM1603 host target gene. PCANAP7 BINDING SITE is HOST TARGET binding site found in the 5' untranslated region of mRNA encoded by PCANAP7, corresponding to a HOST TARGET binding site such as BINDING SITE I, BINDING SITE II or BINDING SITE III. Table 2 illustrates the complementarity of the nucleotide sequences of PCANAP7 BINDING SITE, designated SEQ ID:44836, to the nucleotide sequence of VGAM1603 RNA, herein designated VGAM RNA, also designated SEQ ID:4314.

Another function of VGAM1603 is therefore inhibition of Prostate Cancer Associated Protein 7 (PCANAP7, Accession XM_167803). Accordingly, utilities of VGAM1603 include diagnosis, prevention and treatment of diseases and clinical conditions associated with PCANAP7. Prefoldin 1 (PFDN1, Accession NM_002622) is another VGAM1603 host target gene. PFDN1 BINDING SITE is HOST TARGET binding site found in the 3' untranslated region of mRNA encoded by PFDN1, corresponding to a HOST TARGET binding site such as BINDING SITE I, BINDING SITE II or BINDING SITE III. Table 2 illustrates the complementarity of the nucleotide sequences of PFDN1 BINDING SITE, designated SEQ ID:8485, to the nucleotide sequence of VGAM1603 RNA, herein designated VGAM RNA, also designated SEQ ID:4314.

Another function of VGAM1603 is therefore inhibition of Prefoldin 1 (PFDN1, Accession NM_002622). Accordingly, utilities of VGAM1603 include diagnosis, prevention and treatment of diseases and clinical conditions associated with PFDN1. LOC148709 (Accession XM_086281) is another VGAM1603 host target gene. LOC148709 BINDING SITE is HOST TARGET binding site found in the 3' untranslated region of mRNA encoded by LOC148709, corresponding to a HOST TARGET binding site such as BINDING SITE I, BINDING SITE II or BINDING SITE III. Table 2 illustrates the complementarity of the nucleotide sequences of LOC148709 BINDING SITE, designated SEQ ID:38577, to the nucleotide sequence of VGAM1603 RNA, herein designated VGAM RNA, also designated SEQ ID:4314.

Another function of VGAM1603 is therefore inhibition of LOC148709 (Accession XM_086281). Accordingly, utilities of VGAM1603 include diagnosis, prevention and treatment of diseases and clinical conditions associated with LOC148709. LOC257319 (Accession XM_171049) is another VGAM1603 host target gene. LOC257319 BINDING SITE is HOST TARGET binding site found in the 3' untranslated region of mRNA encoded by LOC257319, corresponding to a HOST TARGET binding site such as BINDING SITE I, BINDING SITE II or BINDING SITE III. Table 2 illustrates the complementarity of the nucleotide sequences of LOC257319 BINDING SITE, designated SEQ ID:45827, to the nucleotide sequence of VGAM1603 RNA, herein designated VGAM RNA, also designated SEQ ID:4314.

Another function of VGAM1603 is therefore inhibition of LOC257319 (Accession XM_171049). Accordingly, utilities of VGAM1603 include diagnosis, prevention and treatment of diseases and clinical conditions associated with LOC257319. FIG. 1 further provides a conceptual description of a novel bioinformatically detected viral gene of the present invention, referred to here as Viral Genomic Address Messenger 1604 (VGAM1604) viral gene, which modulates expression of respective host target genes thereof, the function and utility of which host target genes is known in the art.

VGAM1604 is a novel bioinformatically detected regulatory, non protein coding, viral micro RNA (miRNA) gene. The method by which VGAM1604 was detected is described hereinabove with reference to FIGS. 1-8.

VGAM1604 gene, herein designated VGAM GENE, is a viral gene contained in the genome of Taura Syndrome Virus. VGAM1604 host target gene, herein designated VGAM HOST TARGET GENE, is a human gene contained in the human genome.

VGAM1604 gene encodes a VGAM1604 precursor RNA, herein designated VGAM PRECURSOR RNA. Similar to other miRNA genes, and unlike most ordinary genes, VGAM1604 precursor RNA does not encode a protein. A nucleotide sequence identical or highly similar to the nucleotide sequence of VGAM1604 precursor RNA is designated SEQ ID:1590, and is provided hereinbelow with reference to the sequence listing part. Nucleotide sequence SEQ ID:1590 is located at position 2524 relative to the genome of Taura Syndrome Virus.

VGAM1604 precursor RNA folds onto itself, forming VGAM1604 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1604 folded precursor RNA into VGAM1604 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1604 RNA is designated SEQ ID:4315, and is provided hereinbelow with reference to the sequence listing part.

VGAM1604 host target gene, herein designated VGAM HOST TARGET GENE, encodes a corresponding messenger RNA, VGAM1604 host target RNA, herein designated VGAM HOST TARGET RNA. VGAM1604 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1604 RNA, herein designated VGAM RNA, binds complementarily to one or more host target binding sites located in untranslated regions of VGAM1604 host target RNA, herein designated VGAM HOST TARGET RNA. This complementary binding is due to the fact that the nucleotide sequence of VGAM1604 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1604 RNA, herein designated VGAM RNA, may have a different number of host target binding sites in untranslated regions of a VGAM1604 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1604 RNA, herein designated VGAM RNA, to host target binding sites on VGAM1604 host target RNA, herein designated VGAM HOST TARGET RNA, such as BINDING SITE I, BINDING SITE II and BINDING SITE III, inhibits translation of VGAM1604 host target RNA into VGAM1604 host target protein, herein designated VGAM HOST TARGET PROTEIN. VGAM host target protein is therefore outlined by a broken line.

It is appreciated that VGAM1604 host target gene, herein designated VGAM HOST TARGET GENE, in fact represents a plurality of VGAM1604 host target genes. The mRNA of each one of this plurality of VGAM1604 host target genes comprises one or more host target binding sites, each having a nucleotide sequence which is at least partly complementary to VGAM1604 RNA, herein designated VGAM RNA, and which when bound by VGAM1604 RNA causes inhibition of translation of respective one or more VGAM1604 host target proteins.

It is further appreciated by one skilled in the art that the mode of translational inhibition illustrated by FIG. 1 with specific reference to translational inhibition exerted by VGAM1604 gene, herein designated VGAM GENE, on one or more VGAM1604 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1604 is inhibition of expression of host target genes, as part of a novel viral mechanism of attacking a host. Accordingly, utilities of VGAM1604 include diagnosis, prevention and treatment of viral infection by Taura Syndrome Virus. Specific functions, and accordingly utilities, of VGAM1604 correlate with, and may be deduced from, the identity of the host target genes which VGAM1604 binds and inhibits, and the function of these host target genes, as elaborated hereinbelow.

Nucleotide sequences of the VGAM1604 precursor RNA, herein designated VGAM PRECURSOR RNA, and of the 'diced' VGAM1604 RNA, herein designated VGAM RNA, and a schematic representation of the secondary folding of VGAM1604 folded precursor RNA, herein designated VGAM FOLDED PRECURSOR RNA, of VGAM1604 are further described hereinbelow with reference to Table 1.

Nucleotide sequences of host target binding sites, such as BINDING SITE-I, BINDING SITE-II and BINDING SITE-III of FIG. 1, found on VGAM1604 host target RNA, and schematic representation of the complementarity of each of these host target binding sites to VGAM1604 RNA, herein designated VGAM RNA, are described hereinbelow with reference to Table 2.

As mentioned hereinabove with reference to FIG. 1, a function of VGAM1604 gene, herein designated VGAM is inhibition of expression of VGAM1604 target genes. It is appreciated that specific functions, and accordingly utilities, of VGAM1604 correlate with, and may be deduced from, the identity of the target genes which VGAM1604 binds and inhibits, and the function of these target genes, as elaborated hereinbelow.

High Mobility Group AT-hook 2 (HMGA2, Accession NM_003483) is a VGAM1604 host target gene. HMGA2 BINDING SITE is HOST TARGET binding site found in the 5' untranslated region of mRNA encoded by HMGA2, corresponding to a HOST TARGET binding site such as BINDING SITE I, BINDING SITE II or BINDING SITE III. Table 2 illustrates the complementarity of the nucleotide sequences of HMGA2 BINDING SITE, designated SEQ ID:9573, to the nucleotide sequence of VGAM1604 RNA, herein designated VGAM RNA, also designated SEQ ID:4315.

A function of VGAM1604 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM1604 include diagnosis, prevention and treatment of diseases and clinical conditions associated with HMGA2. The function of HMGA2 and its association with various diseases and clinical conditions, has been established by previous studies, as described hereinabove with reference to VGAM552. Chromosome 20 Open Reading Frame 110 (C20orf110, Accession XM_086728) is another VGAM1604 host target gene. C20orf110 BINDING SITE is HOST TARGET binding site found in the 3' untranslated region of mRNA encoded by C20orf110, corresponding to a HOST TARGET binding site such as BINDING SITE I, BINDING SITE II or BINDING SITE III. Table 2 illustrates the complementarity of the nucleotide sequences of C20orf110 BINDING SITE, designated SEQ ID:38838, to the nucleotide sequence of VGAM1604 RNA, herein designated VGAM RNA, also designated SEQ ID:4315.

Another function of VGAM1604 is therefore inhibition of Chromosome 20 Open Reading Frame 110 (C20orf110, Accession XM_086728). Accordingly, utilities of VGAM1604 include diagnosis, prevention and treatment of diseases and clinical conditions associated with C20orf110. FLJ14621 (Accession NM_032811) is another VGAM1604 host target gene. FLJ14621 BINDING SITE is HOST TARGET binding site found in the 3' untranslated region of mRNA encoded by FLJ14621, corresponding to a HOST TARGET binding site such as BINDING SITE I, BINDING SITE II or BINDING SITE III. Table 2 illustrates the complementarity of the nucleotide sequences of FLJ14621 BINDING SITE, designated SEQ ID:26577, to the nucleotide sequence of VGAM1604 RNA, herein designated VGAM RNA, also designated SEQ ID:4315.

Another function of VGAM1604 is therefore inhibition of FLJ14621 (Accession NM_032811). Accordingly, utilities of VGAM1604 include diagnosis, prevention and treatment of diseases and clinical conditions associated with FLJ14621. Mitochondrial Ribosomal Protein S27 (MRPS27, Accession NM_015084) is another VGAM1604 host target gene. MRPS27 BINDING SITE is HOST TARGET binding site found in the 3' untranslated region of mRNA encoded by MRPS27, corresponding to a HOST TARGET binding site such as BINDING SITE I, BINDING SITE II or BINDING SITE III. Table 2 illustrates the complementarity of the nucleotide sequences of MRPS27 BINDING SITE, designated SEQ ID:17472, to the nucleotide sequence of VGAM1604 RNA, herein designated VGAM RNA, also designated SEQ ID:4315.

Another function of VGAM1604 is therefore inhibition of Mitochondrial Ribosomal Protein S27 (MRPS27, Accession NM_015084). Accordingly, utilities of VGAM1604 include diagnosis, prevention and treatment of diseases and clinical conditions associated with MRPS27. LOC152766 (Accession XM_098263) is another VGAM1604 host target gene. LOC152766 BINDING SITE is HOST TARGET binding site found in the 5' untranslated region of mRNA encoded by LOC152766, corresponding to a HOST TARGET binding site such as BINDING SITE I, BINDING SITE II or BINDING SITE III. Table 2 illustrates the complementarity of the nucleotide sequences of LOC152766 BINDING SITE, designated SEQ ID:41553, to the nucleotide sequence of VGAM1604 RNA, herein designated VGAM RNA, also designated SEQ ID:4315.

Another function of VGAM1604 is therefore inhibition of LOC152766 (Accession XM_098263). Accordingly, utilities of VGAM1604 include diagnosis, prevention and treatment of diseases and clinical conditions associated with LOC152766. LOC257206 (Accession XM_173136) is another VGAM1604 host target gene. LOC257206 BINDING SITE is HOST TARGET binding site found in the 3' untranslated region of mRNA encoded by LOC257206, corresponding to a HOST TARGET binding site such as BINDING SITE I, BINDING SITE II or BINDING SITE III. Table 2 illustrates the complementarity of the nucleotide sequences of LOC257206 BINDING SITE, designated SEQ ID:46385, to the nucleotide sequence of VGAM1604 RNA, herein designated VGAM RNA, also designated SEQ ID:4315.

Another function of VGAM1604 is therefore inhibition of LOC257206 (Accession XM_173136). Accordingly, utilities of VGAM1604 include diagnosis, prevention and treatment of diseases and clinical conditions associated with LOC257206. FIG. 1 further provides a conceptual description of a novel bioinformatically detected viral gene of the present invention, referred to here as Viral Genomic Address Messenger 1605 (VGAM1605) viral gene, which modulates expression of respective host target genes thereof, the function and utility of which host target genes is known in the art.

VGAM1605 is a novel bioinformatically detected regulatory, non protein coding, viral micro RNA (miRNA) gene. The method by which VGAM1605 was detected is described hereinabove with reference to FIGS. 1-8.

VGAM1605 gene, herein designated VGAM GENE, is a viral gene contained in the genome of Taura Syndrome Virus. VGAM1605 host target gene, herein designated VGAM HOST TARGET GENE, is a human gene contained in the human genome.

VGAM1605 gene encodes a VGAM1605 precursor RNA, herein designated VGAM PRECURSOR RNA. Similar to other miRNA genes, and unlike most ordinary genes, VGAM1605 precursor RNA does not encode a protein. A nucleotide sequence identical or highly similar to the nucleotide sequence of VGAM1605 precursor RNA is designated SEQ ID:1591, and is provided hereinbelow with reference to the sequence listing part. Nucleotide sequence SEQ ID:1591 is located at position 8483 relative to the genome of Taura Syndrome Virus.

VGAM1605 precursor RNA folds onto itself, forming VGAM1605 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1605 folded precursor RNA into VGAM1605 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1605 RNA is designated SEQ ID:4316, and is provided hereinbelow with reference to the sequence listing part.

VGAM1605 host target gene, herein designated VGAM HOST TARGET GENE, encodes a corresponding messenger RNA, VGAM1605 host target RNA, herein designated VGAM HOST TARGET RNA. VGAM1605 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1605 RNA, herein designated VGAM RNA, binds complementarily to one or more host target binding sites located in untranslated regions of VGAM1605 host target RNA, herein designated VGAM HOST TARGET RNA. This complementary binding is due to the fact that the nucleotide sequence of VGAM1605 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1605 RNA, herein designated VGAM RNA, may have a different number of host target binding sites in untranslated regions of a VGAM1605 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1605 RNA, herein designated VGAM RNA, to host target binding sites on VGAM1605 host target RNA, herein designated VGAM HOST TARGET RNA, such as BINDING SITE I, BINDING SITE II and BINDING SITE III, inhibits translation of VGAM1605 host target RNA into VGAM1605 host target protein, herein designated VGAM HOST TARGET PROTEIN. VGAM host target protein is therefore outlined by a broken line.

It is appreciated that VGAM1605 host target gene, herein designated VGAM HOST TARGET GENE, in fact represents a plurality of VGAM1605 host target genes. The mRNA of each one of this plurality of VGAM1605 host target genes comprises one or more host target binding sites, each having a nucleotide sequence which is at least partly complementary to VGAM1605 RNA, herein designated VGAM RNA, and which when bound by VGAM1605 RNA causes inhibition of translation of respective one or more VGAM1605 host target proteins.

It is further appreciated by one skilled in the art that the mode of translational inhibition illustrated by FIG. 1 with specific reference to translational inhibition exerted by VGAM1605 gene, herein designated VGAM GENE, on one or more VGAM1605 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1605 is inhibition of expression of host target genes, as part of a novel viral mechanism of attacking a host. Accordingly, utilities of VGAM1605 include diagnosis, prevention and treatment of viral infection by Taura Syndrome Virus. Specific functions, and accordingly utilities, of VGAM1605 correlate with, and may be deduced from, the identity of the host target genes which VGAM1605 binds and inhibits, and the function of these host target genes, as elaborated hereinbelow.

Nucleotide sequences of the VGAM1605 precursor RNA, herein designated VGAM PRECURSOR RNA, and of the 'diced' VGAM1605 RNA, herein designated VGAM RNA, and a schematic representation of the secondary folding of VGAM1605 folded precursor RNA, herein designated VGAM FOLDED PRECURSOR RNA, of VGAM1605 are further described hereinbelow with reference to Table 1.

Nucleotide sequences of host target binding sites, such as BINDING SITE-I, BINDING SITE-II and BINDING SITE-III of FIG. 1, found on VGAM1605 host target RNA, and schematic representation of the complementarity of each of these host target binding sites to VGAM1605 RNA, herein designated VGAM RNA, are described hereinbelow with reference to Table 2.

As mentioned hereinabove with reference to FIG. 1, a function of VGAM1605 gene, herein designated VGAM is inhibition of expression of VGAM1605 target genes. It is appreciated that specific functions, and accordingly utilities, of VGAM1605 correlate with, and may be deduced from, the identity of the target genes which VGAM1605 binds and inhibits, and the function of these target genes, as elaborated hereinbelow.

Secretogranin III (SCG3, Accession NM_013243) is a VGAM1605 host target gene. SCG3 BINDING SITE is HOST TARGET binding site found in the 3' untranslated region of mRNA encoded by SCG3, corresponding to a HOST TARGET binding site such as BINDING SITE I, BINDING SITE II or BINDING SITE III. Table 2 illustrates the complementarity of the nucleotide sequences of SCG3 BINDING SITE, designated SEQ ID:14903, to the nucleotide sequence of VGAM1605 RNA, herein designated VGAM RNA, also designated SEQ ID:4316.

A function of VGAM1605 is therefore inhibition of Secretogranin III (SCG3, Accession NM_013243). Accordingly, utilities of VGAM1605 include diagnosis, prevention and treatment of diseases and clinical conditions associated with SCG3. Solute Carrier Family 21 (prostaglandin transporter), Member 2 (SLC21A2, Accession NM_005630) is another VGAM1605 host target gene. SLC21A2 BINDING SITE is HOST TARGET binding site found in the 3' untranslated region of mRNA encoded by SLC21A2, corresponding to a HOST TARGET binding site such as BINDING SITE I, BINDING SITE II or BINDING SITE III. Table 2 illustrates the complementarity of the nucleotide sequences of SLC21A2 BINDING SITE, designated SEQ ID:12159, to the nucleotide sequence of VGAM1605 RNA, herein designated VGAM RNA, also designated SEQ ID:4316.

Another function of VGAM1605 is therefore inhibition of Solute Carrier Family 21 (prostaglandin transporter), Member 2 (SLC21A2, Accession NM_005630), a gene which is a Prostaglandin transporter. Accordingly, utilities of VGAM1605 include diagnosis, prevention and treatment of diseases and clinical conditions associated with SLC21A2. The function of SLC21A2 and its association with various diseases and clinical conditions, has been established by previous studies, as described hereinabove with reference to VGAM83. Cylindromatosis (turban tumor syndrome) (CYLD, Accession NM_015247) is another VGAM1605 host target gene. CYLD BINDING SITE is HOST TARGET binding site found in the 3' untranslated region of mRNA encoded by CYLD, corresponding to a HOST TARGET binding site such as BINDING SITE I, BINDING SITE II or BINDING SITE III. Table 2 illustrates the complementarity of the nucleotide sequences of CYLD BINDING SITE, designated SEQ ID:17577, to the nucleotide sequence of VGAM1605 RNA, herein designated VGAM RNA, also designated SEQ ID:4316.

Another function of VGAM1605 is therefore inhibition of Cylindromatosis (turban tumor syndrome) (CYLD, Accession NM_015247). Accordingly, utilities of VGAM1605 include diagnosis, prevention and treatment of diseases and clinical conditions associated with CYLD. DKFZp434G179 (Accession XM_087065) is another VGAM1605 host target gene. DKFZp434G179 BINDING SITE is HOST TARGET binding site found in the 3' untranslated region of mRNA encoded by DKFZp434G179, corresponding to a HOST TARGET binding site such as BINDING SITE I, BINDING SITE II or BINDING SITE III. Table 2 illustrates the complementarity of the nucleotide sequences of DKFZp434G179 BINDING SITE, designated SEQ ID:39042, to the nucleotide sequence of VGAM1605 RNA, herein designated VGAM RNA, also designated SEQ ID:4316.

Another function of VGAM1605 is therefore inhibition of DKFZp434G179 (Accession XM_087065). Accordingly, utilities of VGAM1605 include diagnosis, prevention and treatment of diseases and clinical conditions associated with DKFZp434G179. FLJ21168 (Accession NM_025073) is another VGAM1605 host target gene. FLJ21168 BINDING SITE is HOST TARGET binding site found in the 3' untranslated region of mRNA encoded by FLJ21168, corresponding to a HOST TARGET binding site such as BINDING SITE I, BINDING SITE II or BINDING SITE III. Table 2 illustrates the complementarity of the nucleotide sequences of FLJ21168 BINDING SITE, designated SEQ ID:24673, to the nucleotide sequence of VGAM1605 RNA, herein designated VGAM RNA, also designated SEQ ID:4316.

Another function of VGAM1605 is therefore inhibition of FLJ21168 (Accession NM_025073). Accordingly, utilities of VGAM1605 include diagnosis, prevention and treatment of diseases and clinical conditions associated with FLJ21168. MGC9753 (Accession NM_033419) is another VGAM1605 host target gene. MGC9753 BINDING SITE is HOST TARGET binding site found in the 5' untranslated region of mRNA encoded by MGC9753, corresponding to a HOST TARGET binding site such as BINDING SITE I, BINDING SITE II or BINDING SITE III. Table 2 illustrates the complementarity of the nucleotide sequences of MGC9753 BINDING SITE, designated SEQ ID:27244, to the nucleotide sequence of VGAM1605 RNA, herein designated VGAM RNA, also designated SEQ ID:4316.

Another function of VGAM1605 is therefore inhibition of MGC9753 (Accession NM_033419). Accordingly, utilities of VGAM1605 include diagnosis, prevention and treatment of diseases and clinical conditions associated with MGC9753. PDZ Domain Containing 2 (PDZD2, Accession XM_087705) is another VGAM1605 host target gene. PDZD2 BINDING SITE is HOST TARGET binding site found in the 3' untranslated region of mRNA encoded by PDZD2, corresponding to a HOST TARGET binding site such as BINDING SITE I, BINDING SITE II or BINDING SITE III. Table 2 illustrates the complementarity of the nucleotide sequences of PDZD2 BINDING SITE, designated SEQ ID:39395, to the nucleotide sequence of VGAM1605 RNA, herein designated VGAM RNA, also designated SEQ ID:4316.

Another function of VGAM1605 is therefore inhibition of PDZ Domain Containing 2 (PDZD2, Accession XM_087705). Accordingly, utilities of VGAM1605 include diagnosis, prevention and treatment of diseases and clinical conditions associated with PDZD2. Solute Carrier Family 17 (sodium-dependent inorganic phosphate cotransporter), Member 6 (SLC17A6, Accession NM_020346) is another VGAM1605 host target gene. SLC17A6 BINDING SITE is HOST TARGET binding site found in the 3" untranslated region of mRNA encoded by SLC17A6, corresponding to a HOST TARGET binding site such as BINDING SITE I, BINDING SITE II or BINDING SITE III. Table 2 illustrates the complementarity of the nucleotide sequences of SLC17A6 BINDING SITE, designated SEQ ID:21597, to the nucleotide sequence of VGAM1605 RNA, herein designated VGAM RNA, also designated SEQ ID:4316.

Another function of VGAM1605 is therefore inhibition of Solute Carrier Family 17 (sodium-dependent inorganic phosphate cotransporter), Member 6 (SLC17A6, Accession NM_020346). Accordingly, utilities of VGAM1605 include diagnosis, prevention and treatment of diseases and clinical conditions associated with SLC17A6. Zinc Finger Protein 262 (ZNF262, Accession NM_005095) is another VGAM1605 host target gene. ZNF262 BINDING SITE is HOST TARGET binding site found in the 3' untranslated region of mRNA encoded by ZNF262, corresponding to a HOST TARGET binding site such as BINDING SITE I, BINDING SITE II or BINDING SITE III. Table 2 illustrates the complementarity of the nucleotide sequences of ZNF262 BINDING SITE, designated SEQ ID:11557, to the nucleotide sequence of VGAM1605 RNA, herein designated VGAM RNA, also designated SEQ ID:4316.

Another function of VGAM1605 is therefore inhibition of Zinc Finger Protein 262 (ZNF262, Accession NM_005095). Accordingly, utilities of VGAM1605 include diagnosis, prevention and treatment of diseases and clinical conditions associated with ZNF262. LOC115129 (Accession XM_055292) is another VGAM1605 host target gene. LOC115129 BINDING SITE is HOST TARGET binding site found in the 3' untranslated region of mRNA encoded by LOC115129, corresponding to a HOST TARGET binding site such as BINDING SITE I, BINDING SITE II or BINDING SITE III. Table 2 illustrates the complementarity of the nucleotide sequences of LOC115129 BINDING SITE, designated SEQ ID:36253, to the nucleotide sequence of VGAM1605 RNA, herein designated VGAM RNA, also designated SEQ ID:4316.

Another function of VGAM1605 is therefore inhibition of LOC115129 (Accession XM_055292). Accordingly, utilities of VGAM1605 include diagnosis, prevention and treatment of diseases and clinical conditions associated with LOC115129. LOC149478 (Accession XM_086536) is another VGAM1605 host target gene. LOC149478 BINDING SITE is HOST TARGET binding site found in the 3' untranslated region of mRNA encoded by LOC149478, corresponding to a HOST TARGET binding site such as BINDING SITE I, BINDING SITE II or BINDING SITE III. Table 2 illustrates the complementarity of the nucleotide sequences of LOC149478 BINDING SITE, designated SEQ ID:38756, to the nucleotide sequence of VGAM1605 RNA, herein designated VGAM RNA, also designated SEQ ID:4316.

Another function of VGAM1605 is therefore inhibition of LOC149478 (Accession XM_086536). Accordingly, utilities of VGAM1605 include diagnosis, prevention and treatment of diseases and clinical conditions associated with LOC149478. LOC158318 (Accession XM_098925) is another VGAM1605 host target gene. LOC158318 BINDING SITE is HOST TARGET binding site found in the 5' untranslated region of mRNA encoded by LOC158318, corresponding to a HOST TARGET binding site such as BINDING SITE I, BINDING SITE II or BINDING SITE III. Table 2 illustrates the complementarity of the nucleotide sequences of LOC158318 BINDING SITE, designated SEQ ID:41958, to the nucleotide sequence of VGAM1605 RNA, herein designated VGAM RNA, also designated SEQ ID:4316.

Another function of VGAM1605 is therefore inhibition of LOC158318 (Accession XM_098925). Accordingly, utilities of VGAM1605 include diagnosis, prevention and treatment of diseases and clinical conditions associated with LOC158318. LOC90784 (Accession XM_034109) is another VGAM1605 host target gene. LOC90784 BINDING SITE is HOST TARGET binding site found in the 5' untranslated region of mRNA encoded by LOC90784, corresponding to a HOST TARGET binding site such as BINDING SITE I, BINDING SITE II or BINDING SITE III. Table 2 illustrates the complementarity of the nucleotide sequences of LOC90784 BINDING SITE, designated SEQ ID:32003, to the nucleotide sequence of VGAM1605 RNA, herein designated VGAM RNA, also designated SEQ ID:4316.

Another function of VGAM1605 is therefore inhibition of LOC90784 (Accession XM_034109). Accordingly, utilities of VGAM1605 include diagnosis, prevention and treatment of diseases and clinical conditions associated with LOC90784. LOC92492 (Accession XM_045396) is another VGAM1605 host target gene. LOC92492 BINDING SITE is HOST TARGET binding site found in the 5' untranslated region of mRNA encoded by LOC92492, corresponding to a HOST TARGET binding site such as BINDING SITE I, BINDING SITE II or BINDING SITE III. Table 2 illustrates the complementarity of the nucleotide sequences of LOC92492 BINDING SITE, designated SEQ ID:34455, to the nucleotide sequence of VGAM1605 RNA, herein designated VGAM RNA, also designated SEQ ID:4316.

Another function of VGAM1605 is therefore inhibition of LOC92492 (Accession XM_045396). Accordingly, utilities of VGAM1605 include diagnosis, prevention and treatment of diseases and clinical conditions associated with LOC92492. FIG. 1 further provides a conceptual description of a novel bioinformatically detected viral gene of the present invention, referred to here as Viral Genomic Address Messenger 1606 (VGAM1606) viral gene, which modulates expression of respective host target genes thereof, the function and utility of which host target genes is known in the art.

VGAM1606 is a novel bioinformatically detected regulatory, non protein coding, viral micro RNA (miRNA) gene. The method by which VGAM1606 was detected is described hereinabove with reference to FIGS. 1-8.

VGAM1606 gene, herein designated VGAM GENE, is a viral gene contained in the genome of Taura Syndrome Virus. VGAM1606 host target gene, herein designated VGAM HOST TARGET GENE, is a human gene contained in the human genome.

VGAM1606 gene encodes a VGAM1606 precursor RNA, herein designated VGAM PRECURSOR RNA. Similar to other miRNA genes, and unlike most ordinary genes, VGAM1606 precursor RNA does not encode a protein. A nucleotide sequence identical or highly similar to the nucleotide sequence of VGAM1606 precursor RNA is designated SEQ ID:1592, and is provided hereinbelow with reference to the sequence listing part. Nucleotide sequence SEQ ID:1592 is located at position 7811 relative to the genome of Taura Syndrome Virus.

VGAM1606 precursor RNA folds onto itself, forming VGAM1606 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1606 folded precursor RNA into VGAM1606 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1606 RNA is designated SEQ ID:4317, and is provided hereinbelow with reference to the sequence listing part.

VGAM1606 host target gene, herein designated VGAM HOST TARGET GENE, encodes a corresponding messenger RNA, VGAM1606 host target RNA, herein designated VGAM HOST TARGET RNA. VGAM1606 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1606 RNA, herein designated VGAM RNA, binds complementarily to one or more host target binding sites located in untranslated regions of VGAM1606 host target RNA, herein designated VGAM HOST TARGET RNA. This complementary binding is due to the fact that the nucleotide sequence of VGAM1606 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1606 RNA, herein designated VGAM RNA, may have a different number of host target binding sites in untranslated regions of a VGAM1606 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1606 RNA, herein designated VGAM RNA, to host target binding sites on VGAM1606 host target RNA, herein designated VGAM HOST TARGET RNA, such as BINDING SITE I, BINDING SITE II and BINDING SITE III, inhibits translation of VGAM1606 host target RNA into VGAM1606 host target protein, herein designated VGAM HOST TARGET PROTEIN. VGAM host target protein is therefore outlined by a broken line.

It is appreciated that VGAM1606 host target gene, herein designated VGAM HOST TARGET GENE, in fact represents a plurality of VGAM1606 host target genes. The mRNA of each one of this plurality of VGAM1606 host target genes comprises one or more host target binding sites, each having a nucleotide sequence which is at least partly complementary to VGAM1606 RNA, herein designated VGAM RNA, and which when bound by VGAM1606 RNA causes inhibition of translation of respective one or more VGAM1606 host target proteins.

It is further appreciated by one skilled in the art that the mode of translational inhibition illustrated by FIG. 1 with specific reference to translational inhibition exerted by VGAM1606 gene, herein designated VGAM GENE, on one or more VGAM1606 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1606 is inhibition of expression of host target genes, as part of a novel viral mechanism of attacking a host. Accordingly, utilities of VGAM1606 include diagnosis, prevention and treatment of viral infection by Taura Syndrome Virus. Specific functions, and accordingly utilities, of VGAM1606 correlate with, and may be deduced from, the identity of the host target genes which VGAM1606 binds and inhibits, and the function of these host target genes, as elaborated hereinbelow.

Nucleotide sequences of the VGAM1606 precursor RNA, herein designated VGAM PRECURSOR RNA, and of the 'diced' VGAM1606 RNA, herein designated VGAM RNA, and a schematic representation of the secondary folding of VGAM1606 folded precursor RNA, herein designated VGAM FOLDED PRECURSOR RNA, of VGAM1606 are further described hereinbelow with reference to Table 1.

Nucleotide sequences of host target binding sites, such as BINDING SITE-I, BINDING SITE-II and BINDING SITE-III of FIG. 1, found on VGAM1606 host target RNA, and schematic representation of the complementarity of each of these host target binding sites to VGAM1606 RNA, herein designated VGAM RNA, are described hereinbelow with reference to Table 2.

As mentioned hereinabove with reference to FIG. 1, a function of VGAM1606 gene, herein designated VGAM is inhibition of expression of VGAM1606 target genes. It is appreciated that specific functions, and accordingly utilities, of VGAM1606 correlate with, and may be deduced from, the identity of the target genes which VGAM1606 binds and inhibits, and the function of these target genes, as elaborated hereinbelow.

ATPase, Class VI, Type 11B (ATP11B, Accession XM_087254) is a VGAM1606 host target gene. ATP11B BINDING SITE is HOST TARGET binding site found in the 3' untranslated region of mRNA encoded by ATP11B, corresponding to a HOST TARGET binding site such as BINDING SITE I, BINDING SITE II or BINDING SITE III. Table 2 illustrates the complementarity of the nucleotide sequences of ATP11B BINDING SITE, designated SEQ ID:39149, to the nucleotide sequence of VGAM1606 RNA, herein designated VGAM RNA, also designated SEQ ID:4317.

A function of VGAM1606 is therefore inhibition of ATPase, Class VI, Type 11B (ATP11B, Accession XM_087254), a gene which is phosphorylated in their intermediate state, drives uphill transport of ions across membranes. Accordingly, utilities of VGAM1606 include diagnosis, prevention and treatment of diseases and clinical conditions associated with ATP11B. The function of ATP11B and its association with various diseases and clinical conditions, has been established by previous studies, as described hereinabove with reference to VGAM665. Protein Tyrosine Phosphatase Type IVA, Member 2 (PTP4A2, Accession NM_080392) is another VGAM1606 host target gene. PTP4A2 BINDING SITE1 and PTP4A2 BINDING SITE2 are HOST TARGET binding sites found in untranslated regions of mRNA encoded by PTP4A2, corresponding to HOST TARGET binding sites such as BINDING SITE I, BINDING SITE II or BINDING SITE III. Table 2 illustrates the complementarity of the nucleotide sequences of PTP4A2 BINDING SITE1 and PTP4A2 BINDING SITE2, designated SEQ ID:27831 and SEQ ID:9554 respectively, to the nucleotide sequence of VGAM1606 RNA, herein designated VGAM RNA, also designated SEQ ID:4317.

Another function of VGAM1606 is therefore inhibition of Protein Tyrosine Phosphatase Type IVA, Member 2 (PTP4A2, Accession NM_080392), a gene which is a protein tyrosine phosphatase which has a C-terminal prenylation site. Accordingly, utilities of VGAM1606 include diagnosis, prevention and treatment of diseases and clinical conditions associated with PTP4A2. The function of PTP4A2 and its association with various diseases and clinical conditions, has been established by previous studies, as described hereinabove with reference to VGAM217. DNAM-1 (Accession NM_006566) is another VGAM1606 host target gene.

DNAM-1 BINDING SITE is HOST TARGET binding site found in the 3' untranslated region of mRNA encoded by DNAM-1, corresponding to a HOST TARGET binding site such as BINDING SITE I, BINDING SITE II or BINDING SITE III. Table 2 illustrates the complementarity of the nucleotide sequences of DNAM-1 BINDING SITE, designated SEQ ID:13340, to the nucleotide sequence of VGAM1606 RNA, herein designated VGAM RNA, also designated SEQ ID:4317.

Another function of VGAM1606 is therefore inhibition of DNAM-1 (Accession NM_006566). Accordingly, utilities of VGAM1606 include diagnosis, prevention and treatment of diseases and clinical conditions associated with DNAM-1. KIAA0426 (Accession NM_014724) is another VGAM1606 host target gene. KIAA0426 BINDING SITE is HOST TARGET binding site found in the 3' untranslated region of mRNA encoded by KIAA0426, corresponding to a HOST TARGET binding site such as BINDING SITE I, BINDING SITE II or BINDING SITE III. Table 2 illustrates the complementarity of the nucleotide sequences of KIAA0426 BINDING SITE, designated SEQ ID:16313, to the nucleotide sequence of VGAM1606 RNA, herein designated VGAM RNA, also designated SEQ ID:4317.

Another function of VGAM1606 is therefore inhibition of KIAA0426 (Accession NM_014724). Accordingly, utilities of VGAM1606 include diagnosis, prevention and treatment of diseases and clinical conditions associated with KIAA0426. KIAA1025 (Accession XM_034056) is another VGAM1606 host target gene. KIAA1025 BINDING SITE is HOST TARGET binding site found in the 3' untranslated region of mRNA encoded by KIAA1025, corresponding to a HOST TARGET binding site such as BINDING SITE I, BINDING SITE II or BINDING SITE III. Table 2 illustrates the complementarity of the nucleotide sequences of KIAA1025 BINDING SITE, designated SEQ ID:31996, to the nucleotide sequence of VGAM1606 RNA, herein designated VGAM RNA, also designated SEQ ID:4317.

Another function of VGAM1606 is therefore inhibition of KIAA1025 (Accession XM_034056). Accordingly, utilities of VGAM1606 include diagnosis, prevention and treatment of diseases and clinical conditions associated with KIAA1025. KIAA1078 (Accession XM_036589) is another VGAM1606 host target gene. KIAA1078 BINDING SITE is HOST TARGET binding site found in the 3' untranslated region of mRNA encoded by KIAA1078, corresponding to a HOST TARGET binding site such as BINDING SITE I, BINDING SITE II or BINDING SITE III. Table 2 illustrates the complementarity of the nucleotide sequences of KIAA1078 BINDING SITE, designated SEQ ID:32471, to the nucleotide sequence of VGAM1606 RNA, herein designated VGAM RNA, also designated SEQ ID:4317.

Another function of VGAM1606 is therefore inhibition of KIAA1078 (Accession XM_036589). Accordingly, utilities of VGAM1606 include diagnosis, prevention and treatment of diseases and clinical conditions associated with KIAA1078. LOC147353 (Accession XM_097227) is another VGAM1606 host target gene. LOC147353 BINDING SITE is HOST TARGET binding site found in the 3' untranslated region of mRNA encoded by LOC147353, corresponding to a HOST TARGET binding site such as BINDING SITE I, BINDING SITE II or BINDING SITE III. Table 2 illustrates the complementarity of the nucleotide sequences of LOC147353 BINDING SITE, designated SEQ ID:40836, to the nucleotide sequence of VGAM1606 RNA, herein designated VGAM RNA, also designated SEQ ID:4317.

Another function of VGAM1606 is therefore inhibition of LOC147353 (Accession XM_097227). Accordingly, utilities of VGAM1606 include diagnosis, prevention and treatment of diseases and clinical conditions associated with LOC147353. LOC91179 (Accession XM_036731) is another VGAM1606 host target gene. LOC91179 BINDING SITE is HOST TARGET binding site found in the 5' untranslated region of mRNA encoded by LOC91179, corresponding to a HOST TARGET binding site such as BINDING SITE I, BINDING SITE II or BINDING SITE III. Table 2 illustrates the complementarity of the nucleotide sequences of LOC91179 BINDING SITE, designated SEQ ID:32493, to the nucleotide sequence of VGAM1606 RNA, herein designated VGAM RNA, also designated SEQ ID:4317.

Another function of VGAM1606 is therefore inhibition of LOC91179 (Accession XM_036731). Accordingly, utilities of VGAM1606 include diagnosis, prevention and treatment of diseases and clinical conditions associated with LOC91179. FIG. 1 further provides a conceptual description of a novel bioinformatically detected viral gene of the present invention, referred to here as Viral Genomic Address Messenger 1607 (VGAM1607) viral gene, which modulates expression of respective host target genes thereof, the function and utility of which host target genes is known in the art.

VGAM1607 is a novel bioinformatically detected regulatory, non protein coding, viral micro RNA (miRNA) gene. The method by which VGAM1607 was detected is described hereinabove with reference to FIGS. 1-8.

VGAM1607 gene, herein designated VGAM GENE, is a viral gene contained in the genome of Taura Syndrome Virus. VGAM1607 host target gene, herein designated VGAM HOST TARGET GENE, is a human gene contained in the human genome.

VGAM1607 gene encodes a VGAM1607 precursor RNA, herein designated VGAM PRECURSOR RNA. Similar to other miRNA genes, and unlike most ordinary genes, VGAM1607 precursor RNA does not encode a protein. A nucleotide sequence identical or highly similar to the nucleotide sequence of VGAM1607 precursor RNA is designated SEQ ID:1593, and is provided hereinbelow with reference to the sequence listing part. Nucleotide sequence SEQ ID:1593 is located at position 567 relative to the genome of Taura Syndrome Virus.

VGAM1607 precursor RNA folds onto itself, forming VGAM1607 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1607 folded precursor RNA into VGAM1607 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 89%) nucleotide sequence of VGAM1607 RNA is designated SEQ ID:4318, and is provided hereinbelow with reference to the sequence listing part.

VGAM1607 host target gene, herein designated VGAM HOST TARGET GENE, encodes a corresponding messenger RNA, VGAM1607 host target RNA, herein designated VGAM HOST TARGET RNA. VGAM1607 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1607 RNA, herein designated VGAM RNA, binds complementarily to one or more host target binding sites located in untranslated regions of VGAM1607 host target RNA, herein designated VGAM HOST TARGET RNA. This complementary binding is due to the fact that the nucleotide sequence of VGAM1607 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1607 RNA, herein designated VGAM RNA, may have a different number of host target binding sites in untranslated regions of a VGAM1607 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1607 RNA, herein designated VGAM RNA, to host target binding sites on VGAM1607 host target RNA, herein designated VGAM HOST TARGET RNA, such as BINDING SITE I, BINDING SITE II and BINDING SITE III, inhibits translation of VGAM1607 host target RNA into VGAM1607 host target protein, herein designated VGAM HOST TARGET PROTEIN. VGAM host target protein is therefore outlined by a broken line.

It is appreciated that VGAM1607 host target gene, herein designated VGAM HOST TARGET GENE, in fact represents a plurality of VGAM1607 host target genes. The mRNA of each one of this plurality of VGAM1607 host target genes comprises one or more host target binding sites, each having a nucleotide sequence which is at least partly complementary to VGAM1607 RNA, herein designated VGAM RNA, and which when bound by VGAM1607 RNA causes inhibition of translation of respective one or more VGAM1607 host target proteins.

It is further appreciated by one skilled in the art that the mode of translational inhibition illustrated by FIG. 1 with specific reference to translational inhibition exerted by VGAM1607 gene, herein designated VGAM GENE, on one or more VGAM1607 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1607 is inhibition of expression of host target genes, as part of a novel viral mechanism of attacking a host. Accordingly, utilities of VGAM1607 include diagnosis, prevention and treatment of viral infection by Taura Syndrome Virus. Specific functions, and accordingly utilities, of VGAM1607 correlate with, and may be deduced from, the identity of the host target genes which VGAM1607 binds and inhibits, and the function of these host target genes, as elaborated hereinbelow.

Nucleotide sequences of the VGAM1607 precursor RNA, herein designated VGAM PRECURSOR RNA, and of the 'diced' VGAM1607 RNA, herein designated VGAM RNA, and a schematic representation of the secondary folding of VGAM1607 folded precursor RNA, herein designated VGAM FOLDED PRECURSOR RNA, of VGAM1607 are further described hereinbelow with reference to Table 1.

Nucleotide sequences of host target binding sites, such as BINDING SITE-I, BINDING SITE-II and BINDING SITE-III of FIG. 1, found on VGAM1607 host target RNA, and schematic representation of the complementarity of each of these host target binding sites to VGAM1607 RNA, herein designated VGAM RNA, are described hereinbelow with reference to Table 2.

As mentioned hereinabove with reference to FIG. 1, a function of VGAM1607 gene, herein designated VGAM is inhibition of expression of VGAM1607 target genes. It is appreciated that specific functions, and accordingly utilities, of VGAM1607 correlate with, and may be deduced from, the identity of the target genes which VGAM1607 binds and inhibits, and the function of these target genes, as elaborated hereinbelow.

DKFZp761G0313 (Accession XM_038026) is a VGAM1607 host target gene. DKFZp761G0313 BINDING SITE is HOST TARGET binding site found in the 3' untranslated region of mRNA encoded by DKFZp761G0313, corresponding to a HOST TARGET binding site such as BINDING SITE I, BINDING SITE II or BINDING SITE III. Table 2 illustrates the complementarity of the nucleotide sequences of DKFZp761G0313 BINDING SITE, designated SEQ ID:32740, to the nucleotide sequence of VGAM1607 RNA, herein designated VGAM RNA, also designated SEQ ID:4318.

A function of VGAM1607 is therefore inhibition of DKFZp761G0313 (Accession XM_038026). Accordingly, utilities of VGAM1607 include diagnosis, prevention and treatment of diseases and clinical conditions associated with DKFZp761G0313. HML2 (Accession NM_006344) is another VGAM1607 host target gene. HML2 BINDING SITE is HOST TARGET binding site found in the 5' untranslated region of mRNA encoded by HML2, corresponding to a HOST TARGET binding site such as BINDING SITE I, BINDING SITE II or BINDING SITE III. Table 2 illustrates the complementarity of the nucleotide sequences of HML2 BINDING SITE, designated SEQ ID:13040, to the nucleotide sequence of VGAM1607 RNA, herein designated VGAM RNA, also designated SEQ ID:4318.

Another function of VGAM1607 is therefore inhibition of HML2 (Accession NM_006344). Accordingly, utilities of VGAM1607 include diagnosis, prevention and treatment of diseases and clinical conditions associated with HML2. LOC139248 (Accession XM_066582) is another VGAM1607 host target gene. LOC139248 BINDING SITE is HOST TARGET binding site found in the 5' untranslated region of mRNA encoded by LOC139248, corresponding to a HOST TARGET binding site such as BINDING SITE I, BINDING SITE II or BINDING SITE III. Table 2 illustrates the complementarity of the nucleotide sequences of LOC139248 BINDING SITE, designated SEQ ID:37336, to the nucleotide sequence of VGAM1607 RNA, herein designated VGAM RNA, also designated SEQ ID:4318.

Another function of VGAM1607 is therefore inhibition of LOC139248 (Accession XM_066582). Accordingly, utilities of VGAM1607 include diagnosis, prevention and treatment of diseases and clinical conditions associated with LOC139248. LOC196746 (Accession XM_113595) is another VGAM1607 host target gene. LOC196746 BIND- ING SITE is HOST TARGET binding site found in the 3' untranslated region of mRNA encoded by LOC196746, corresponding to a HOST TARGET binding site such as BINDING SITE I, BINDING SITE II or BINDING SITE III. Table 2 illustrates the complementarity of the nucleotide sequences of LOC196746 BINDING SITE, designated SEQ ID:42290, to the nucleotide sequence of VGAM1607 RNA, herein designated VGAM RNA, also designated SEQ ID:4318.

Another function of VGAM1607 is therefore inhibition of LOC196746 (Accession XM_113595). Accordingly, utilities of VGAM1607 include diagnosis, prevention and treatment of diseases and clinical conditions associated with LOC196746. FIG. 1 further provides a conceptual description of a novel bioinformatically detected viral gene of the present invention, referred to here as Viral Genomic Address Messenger 1608 (VGAM1608) viral gene, which modulates expression of respective host target genes thereof, the function and utility of which host target genes is known in the art.

VGAM1608 is a novel bioinformatically detected regulatory, non protein coding, viral micro RNA (miRNA) gene. The method by which VGAM1608 was detected is described hereinabove with reference to FIGS. 1-8.

VGAM1608 gene, herein designated VGAM GENE, is a viral gene contained in the genome of Taura Syndrome Virus. VGAM1608 host target gene, herein designated VGAM HOST TARGET GENE, is a human gene contained in the human genome.

VGAM1608 gene encodes a VGAM1608 precursor RNA, herein designated VGAM PRECURSOR RNA. Similar to other miRNA genes, and unlike most ordinary genes, VGAM1608 precursor RNA does not encode a protein. A nucleotide sequence identical or highly similar to the nucleotide sequence of VGAM1608 precursor RNA is designated SEQ ID:1594, and is provided hereinbelow with reference to the sequence listing part. Nucleotide sequence SEQ ID:1594 is located at position 3052 relative to the genome of Taura Syndrome Virus.

VGAM1608 precursor RNA folds onto itself, forming VGAM1608 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1608 folded precursor RNA into VGAM1608 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1608 RNA is designated SEQ ID:4319, and is provided hereinbelow with reference to the sequence listing part.

VGAM1608 host target gene, herein designated VGAM HOST TARGET GENE, encodes a corresponding messenger RNA, VGAM1608 host target RNA, herein designated VGAM HOST TARGET RNA. VGAM1608 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1608 RNA, herein designated VGAM RNA, binds complementarily to one or more host target binding sites located in untranslated regions of VGAM1608 host target RNA, herein designated VGAM HOST TARGET RNA. This complementary binding is due to the fact that the nucleotide sequence of VGAM1608 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1608 RNA, herein designated VGAM RNA, may have a different number of host target binding sites in untranslated regions of a VGAM1608 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1608 RNA, herein designated VGAM RNA, to host target binding sites on VGAM1608 host target RNA, herein designated VGAM HOST TARGET RNA, such as BINDING SITE I, BINDING SITE II and BINDING SITE III, inhibits translation of VGAM1608 host target RNA into VGAM1608 host target protein, herein designated VGAM HOST TARGET PROTEIN. VGAM host target protein is therefore outlined by a broken line.

It is appreciated that VGAM1608 host target gene, herein designated VGAM HOST TARGET GENE, in fact represents a plurality of VGAM1608 host target genes. The mRNA of each one of this plurality of VGAM1608 host target genes comprises one or more host target binding sites, each having a nucleotide sequence which is at least partly complementary to VGAM1608 RNA, herein designated VGAM RNA, and which when bound by VGAM1608 RNA causes inhibition of translation of respective one or more VGAM1608 host target proteins.

It is further appreciated by one skilled in the art that the mode of translational inhibition illustrated by FIG. 1 with specific reference to translational inhibition exerted by VGAM1608 gene, herein designated VGAM GENE, on one or more VGAM1608 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1608 is inhibition of expression of host target genes, as part of a novel viral mechanism of attacking a host. Accordingly, utilities of VGAM1608 include diagnosis, prevention and treatment of viral infection by Taura Syndrome Virus. Specific functions, and accordingly utilities, of VGAM1608 correlate with, and may be deduced from, the identity of the host target genes which VGAM1608 binds and inhibits, and the function of these host target genes, as elaborated hereinbelow.

Nucleotide sequences of the VGAM1608 precursor RNA, herein designated VGAM PRECURSOR RNA, and of the 'diced' VGAM1608 RNA, herein designated VGAM RNA, and a schematic representation of the secondary folding of VGAM1608 folded precursor RNA, herein designated VGAM FOLDED PRECURSOR RNA, of VGAM1608 are further described hereinbelow with reference to Table 1.

Nucleotide sequences of host target binding sites, such as BINDING SITE-I, BINDING SITE-II and BINDING SITE-III of FIG. 1, found on VGAM1608 host target RNA, and schematic representation of the complementarity of each of these host target binding sites to VGAM1608 RNA, herein designated VGAM RNA, are described hereinbelow with reference to Table 2.

As mentioned hereinabove with reference to FIG. 1, a function of VGAM1608 gene, herein designated VGAM is inhibition of expression of VGAM1608 target genes. It is appreciated that specific functions, and accordingly utilities, of VGAM1608 correlate with, and may be deduced from, the identity of the target genes which VGAM1608 binds and inhibits, and the function of these target genes, as elaborated hereinbelow.

LFG (Accession XM_084780) is a VGAM1608 host target gene. LFG BINDING SITE is HOST TARGET binding site found in the 3' untranslated region of mRNA encoded by LFG, corresponding to a HOST TARGET binding site such as BINDING SITE I, BINDING SITE II or BINDING SITE III. Table 2 illustrates the complementarity of the nucleotide sequences of LFG BINDING SITE, designated SEQ ID:37689, to the nucleotide sequence of VGAM1608 RNA, herein designated VGAM RNA, also designated SEQ ID:4319.

A function of VGAM1608 is therefore inhibition of LFG (Accession XM_084780). Accordingly, utilities of VGAM1608 include diagnosis, prevention and treatment of diseases and clinical conditions associated with LFG. Myeloid/lymphoid Or Mixed-lineage Leukemia (trithorax homolog, Drosophila); Translocated To, 4 (MLLT4, Accession XM_051832) is another VGAM1608 host target gene. MLLT4 BINDING SITE is HOST TARGET binding site found in the 5' untranslated region of mRNA encoded by MLLT4, corresponding to a HOST TARGET binding site such as BINDING SITE I, BINDING SITE II or BINDING SITE III. Table 2 illustrates the complementarity of the nucleotide sequences of MLLT4 BINDING SITE, designated SEQ ID:35888, to the nucleotide sequence of VGAM1608 RNA, herein designated VGAM RNA, also designated SEQ ID:4319.

Another function of VGAM1608 is therefore inhibition of Myeloid/lymphoid Or Mixed-lineage Leukemia (trithorax homolog, Drosophila); Translocated To, 4 (MLLT4, Accession XM_051832), a gene which may act as an intracellular signaling component. Accordingly, utilities of VGAM1608 include diagnosis, prevention and treatment of diseases and clinical conditions associated with MLLT4. The function of MLLT4 has been established by previous studies. Most acute leukemias in infancy and at least 5% of acute lymphoblastic leukemias and acute myeloid leukemias of older children and adults show abnormalities of chromosome band 11q23. In these cases, translocation results in fusion of a gene at 11q23, variously called ALL1, MLL, and the human homolog of Drosophila 'trithorax' (OMIM Ref. No. 159555), with part of a gene on chromosome 4 (OMIM Ref. No. 159557), chromosome 9 (OMIM Ref. No. 159558), or chromosome 19 (OMIM Ref. No. 159556). Prasad et al. (1993) described the cloning and characterization of the 'partner gene' involved in a fourth common translocation involving 11q23, t(6;11)(q27; q23). The gene, designated AF6 by them, was found to be expressed in a variety of cell types and to encode a protein of 1,612 amino acids. The protein contains short stretches rich in proline, charged amino acids, serines, or glutamines. In addition, the AF6 protein contains the GLGF motif shared with several proteins of vertebrates and invertebrates thought to be involved in signal transduction at special cell-cell junctions. Using rapid amplification of cDNA ends (RACE) by PCR, Saha et al. (1995) confirmed the breakpoint in AF6 and identified a cDNA clone that was used as a probe to screen a chromosome 6 cosmid library. By fluorescence in situ hybridization, the single clone that was isolated was found to map distal to the critically deleted region associated with ovarian malignancies (OMIM Ref. No. 167000). AF6 is therefore distinct from and lies telomeric to that region. This gene is also symbolized MLLT4.

Full details of the abovementioned studies are described in the following publications, the disclosure of which are hereby incorporated by reference:

Prasad, R.; Gu, Y.; Alder, H.; Nakamura, T.; Canaani, O.; Saito, H.; Huebner, K.; Gale, R. P.; Nowell, P. C.; Kuriyama, K.; Miyazaki, Y.; Croce, C. M.; Canaani, E.: Cloning of the ALL-1 fusion partner, the AF-6 gene, involved in acute myeloid leukemias with the t (6;11) chromosome translocation. Cancer Res. 53:5624-5628, 1993; and Saha, V.; Lillington, D. M.; Shelling, A. N.; Chaplin, T.; Yaspo, M.-L.; Ganesan, T. S.; Young, B. D.: AF6 gene on chromosome band 6q27 maps distal to the minimal region of deletion in.

Further studies establishing the function and utilities of MLLT4 are found in John Hopkins OMIM database record ID 159559, and in sited publications numbered 1846-1847 listed in the bibliography section hereinbelow, which are also hereby incorporated by reference. Vang-like 2 (van gogh, Drosophila) (VANGL2, Accession XM_049695) is another VGAM1608 host target gene. VANGL2 BINDING SITE is HOST TARGET binding site found in the 3' untranslated region of mRNA encoded by VANGL2, corresponding to a HOST TARGET binding site such as BINDING SITE I, BINDING SITE II or BINDING SITE III. Table 2 illustrates the complementarity of the nucleotide sequences of VANGL2 BINDING SITE, designated SEQ ID:35484, to the nucleotide sequence of VGAM1608 RNA, herein designated VGAM RNA, also designated SEQ ID:4319.

Another function of VGAM1608 is therefore inhibition of Vang-like 2 (van gogh, Drosophila) (VANGL2, Accession XM_049695), a gene which may take part in defining the lateral boundary of floorplate differentiation. Accordingly, utilities of VGAM1608 include diagnosis, prevention and treatment of diseases and clinical conditions associated with VANGL2. The function of VANGL2 and its association with various diseases and clinical conditions, has been established by previous studies, as described hereinabove with reference to VGAM111. NY-REN-25 (Accession XM_027116) is another VGAM1608 host target gene. NY-REN-25 BINDING SITE is HOST TARGET binding site found in the 3' untranslated region of mRNA encoded by NY-REN-25, corresponding to a HOST TARGET binding site such as BINDING SITE I, BINDING SITE II or BINDING SITE III. Table 2 illustrates the complementarity of the nucleotide sequences of NY-REN-25 BINDING SITE, designated SEQ ID:30420, to the nucleotide sequence of VGAM1608 RNA, herein designated VGAM RNA, also designated SEQ ID:4319.

Another function of VGAM1608 is therefore inhibition of NY-REN-25 (Accession XM_027116). Accordingly, utilities of VGAM1608 include diagnosis, prevention and treatment of diseases and clinical conditions associated with NY-REN-25. LOC219333 (Accession XM_167944) is another VGAM1608 host target gene. LOC219333 BINDING SITE is HOST TARGET binding site found in the 3' untranslated region of mRNA encoded by LOC219333, corresponding to a HOST TARGET binding site such as BINDING SITE I, BINDING SITE II or BINDING SITE III. Table 2 illustrates the complementarity of the nucleotide sequences of LOC219333 BINDING SITE, designated SEQ ID:44933, to the nucleotide sequence of VGAM1608 RNA, herein designated VGAM RNA, also designated SEQ ID:4319.

Another function of VGAM1608 is therefore inhibition of LOC219333 (Accession XM_167944). Accordingly, utilities of VGAM1608 include diagnosis, prevention and treatment of diseases and clinical conditions associated with LOC219333. FIG. 1 further provides a conceptual description of a novel bioinformatically detected viral gene of the present invention, referred to here as Viral Genomic Address Messenger 1609 (VGAM1609) viral gene, which modulates expression of respective host target genes thereof, the function and utility of which host target genes is known in the art.

VGAM1609 is a novel bioinformatically detected regulatory, non protein coding, viral micro RNA (miRNA) gene. The method by which VGAM1609 was detected is described hereinabove with reference to FIGS. 1-8.

VGAM1609 gene, herein designated VGAM GENE, is a viral gene contained in the genome of Chimpanzee Cytomegalovirus. VGAM1609 host target gene, herein designated VGAM HOST TARGET GENE, is a human gene contained in the human genome.

VGAM1609 gene encodes a VGAM1609 precursor RNA, herein designated VGAM PRECURSOR RNA. Similar to other miRNA genes, and unlike most ordinary genes, VGAM1609 precursor RNA does not encode a protein. A nucleotide sequence identical or highly similar to the nucleotide sequence of VGAM1609 precursor RNA is designated SEQ ID:1595, and is provided hereinbelow with reference to the sequence listing part. Nucleotide sequence SEQ ID:1595 is located at position 8708 relative to the genome of Chimpanzee Cytomegalovirus.

VGAM1609 precursor RNA folds onto itself, forming VGAM1609 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1609 folded precursor RNA into VGAM1609 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1609 RNA is designated SEQ ID:4320, and is provided hereinbelow with reference to the sequence listing part.

VGAM1609 host target gene, herein designated VGAM HOST TARGET GENE, encodes a corresponding messenger RNA, VGAM1609 host target RNA, herein designated VGAM HOST TARGET RNA. VGAM1609 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1609 RNA, herein designated VGAM RNA, binds complementarily to one or more host target binding sites located in untranslated regions of VGAM1609 host target RNA, herein designated VGAM HOST TARGET RNA. This complementary binding is due to the fact that the nucleotide sequence of VGAM1609 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1609 RNA, herein designated VGAM RNA, may have a different number of host target binding sites in untranslated regions of a VGAM1609 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1609 RNA, herein designated VGAM RNA, to host target binding sites on VGAM1609 host target RNA, herein designated VGAM HOST TARGET RNA, such as BINDING SITE I, BINDING SITE II and BINDING SITE III, inhibits translation of VGAM1609 host target RNA into VGAM1609 host target protein, herein designated VGAM HOST TARGET PROTEIN. VGAM host target protein is therefore outlined by a broken line.

It is appreciated that VGAM1609 host target gene, herein designated VGAM HOST TARGET GENE, in fact represents a plurality of VGAM1609 host target genes. The mRNA of each one of this plurality of VGAM1609 host target genes comprises one or more host target binding sites, each having a nucleotide sequence which is at least partly complementary to VGAM1609 RNA, herein designated VGAM RNA, and which when bound by VGAM1609 RNA causes inhibition of translation of respective one or more VGAM1609 host target proteins.

It is further appreciated by one skilled in the art that the mode of translational inhibition illustrated by FIG. 1 with specific reference to translational inhibition exerted by VGAM1609 gene, herein designated VGAM GENE, on one or more VGAM1609 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1609 is inhibition of expression of host target genes, as part of a novel viral mechanism of attacking a host. Accordingly, utilities of VGAM1609 include diagnosis, prevention and treatment of viral infection by Chimpanzee Cytomegalovirus. Specific functions, and accordingly utilities, of VGAM1609 correlate with, and may be deduced from, the identity of the host target genes which VGAM1609 binds and inhibits, and the function of these host target genes, as elaborated hereinbelow.

Nucleotide sequences of the VGAM1609 precursor RNA, herein designated VGAM PRECURSOR RNA, and of the 'diced' VGAM1609 RNA, herein designated VGAM RNA, and a schematic representation of the secondary folding of VGAM1609 folded precursor RNA, herein designated VGAM FOLDED PRECURSOR RNA, of VGAM1609 are further described hereinbelow with reference to Table 1.

Nucleotide sequences of host target binding sites, such as BINDING SITE-I, BINDING SITE-II and BINDING SITE-III of FIG. 1, found on VGAM1609 host target RNA, and schematic representation of the complementarity of each of these host target binding sites to VGAM1609 RNA, herein designated VGAM RNA, are described hereinbelow with reference to Table 2.

As mentioned hereinabove with reference to FIG. 1, a function of VGAM1609 gene, herein designated VGAM is inhibition of expression of VGAM1609 target genes. It is appreciated that specific functions, and accordingly utilities, of VGAM1609 correlate with, and may be deduced from, the identity of the target genes which VGAM1609 binds and inhibits, and the function of these target genes, as elaborated hereinbelow.

C-myc Binding Protein (MYCBP, Accession NM_012333) is a VGAM1609 host target gene. MYCBP BINDING SITE is HOST TARGET binding site found in the 3' untranslated region of mRNA encoded by MYCBP, corresponding to a HOST TARGET binding site such as BINDING SITE I, BINDING SITE II or BINDING SITE III. Table 2 illustrates the complementarity of the nucleotide sequences of MYCBP BINDING SITE, designated SEQ ID:14722, to the nucleotide sequence of VGAM1609 RNA, herein designated VGAM RNA, also designated SEQ ID:4320.

A function of VGAM1609 is therefore inhibition of C-myc Binding Protein (MYCBP, Accession NM_012333), a gene which binds c-Myc stimulating the activation of E-box-dependent transcription. Accordingly, utilities of VGAM1609 include diagnosis, prevention and treatment of diseases and clinical conditions associated with MYCBP. The function of MYCBP and its association with various diseases and clinical conditions, has been established by previous studies, as described hereinabove with reference to VGAM435. Palmitoyl-protein Thioesterase 2 (PPT2, Accession NM_138934) is another VGAM1609 host target gene. PPT2 BINDING SITE is HOST TARGET binding site found in the 3' untranslated region of mRNA encoded by PPT2, corresponding to a HOST TARGET binding site such as BINDING SITE I, BINDING SITE II or BINDING SITE III. Table 2 illustrates the complementarity of the nucleotide sequences of PPT2 BINDING SITE, designated SEQ ID:29060, to the nucleotide sequence of VGAM1609 RNA, herein designated VGAM RNA, also designated SEQ ID:4320.

Another function of VGAM1609 is therefore inhibition of Palmitoyl-protein Thioesterase 2 (PPT2, Accession NM_138934), a gene which is a palmitoyl-protein thioesterase 2 which possesses a different substrate specificity than PPT1. Accordingly, utilities of VGAM1609 include diagnosis, prevention and treatment of diseases and clinical conditions associated with PPT2. The function of PPT2 and its association with various diseases and clinical conditions, has been established by previous studies, as described hereinabove with reference to VGAM120. Protein Tyrosine Phosphatase, Receptor Type, A (PTPRA, Accession NM_002836) is another VGAM1609 host target gene. PTPRA BINDING SITE is HOST TARGET binding site found in the 5' untranslated region of mRNA encoded by PTPRA, corresponding to a HOST TARGET binding site such as BINDING SITE I, BINDING SITE II or BINDING SITE III. Table 2 illustrates the complementarity of the nucleotide sequences of PTPRA BINDING SITE, designated SEQ ID:8713, to the nucleotide sequence of VGAM1609 RNA, herein designated VGAM RNA, also designated SEQ ID:4320.

Another function of VGAM1609 is therefore inhibition of Protein Tyrosine Phosphatase, Receptor Type, A (PTPRA, Accession NM_002836), a gene which is the human homolog of the murine PTPase. Accordingly, utilities of VGAM1609 include diagnosis, prevention and treatment of diseases and clinical conditions associated with PTPRA. The function of PTPRA and its association with various diseases and clinical conditions, has been established by previous studies, as described hereinabove with reference to VGAM1205. FLJ12681 (Accession NM_022773) is another VGAM1609 host target gene. FLJ12681 BINDING SITE is HOST TARGET binding site found in the 3' untranslated region of mRNA encoded by FLJ12681, corresponding to a HOST TARGET binding site such as BINDING SITE I, BINDING SITE II or BINDING SITE III. Table 2 illustrates the complementarity of the nucleotide sequences of FLJ12681 BINDING SITE, designated SEQ ID:23034, to the nucleotide sequence of VGAM1609 RNA, herein designated VGAM RNA, also designated SEQ ID:4320.

Another function of VGAM1609 is therefore inhibition of FLJ12681 (Accession NM_022773). Accordingly, utilities of VGAM1609 include diagnosis, prevention and treatment of diseases and clinical conditions associated with FLJ12681. KIAA0284 (Accession XM_032235) is another VGAM1609 host target gene. KIAA0284 BINDING SITE is HOST TARGET binding site found in the 3' untranslated region of mRNA encoded by KIAA0284, corresponding to a HOST TARGET binding site such as BINDING SITE I, BINDING SITE II or BINDING SITE III. Table 2 illustrates the complementarity of the nucleotide sequences of KIAA0284 BINDING SITE, designated SEQ ID:31615, to the nucleotide sequence of VGAM1609 RNA, herein designated VGAM RNA, also designated SEQ ID:4320.

Another function of VGAM1609 is therefore inhibition of KIAA0284 (Accession XM_032235). Accordingly, utilities of VGAM1609 include diagnosis, prevention and treatment of diseases and clinical conditions associated with KIAA0284. LOC222161 (Accession XM_166596) is another VGAM1609 host target gene. LOC222161 BINDING SITE is HOST TARGET binding site found in the 5' untranslated region of mRNA encoded by LOC222161, corresponding to a HOST TARGET binding site such as BINDING SITE I, BINDING SITE II or BINDING SITE III. Table 2 illustrates the complementarity of the nucleotide sequences of LOC222161 BINDING SITE, designated SEQ ID:44581, to the nucleotide sequence of VGAM1609 RNA, herein designated VGAM RNA, also designated SEQ ID:4320.

Another function of VGAM1609 is therefore inhibition of LOC222161 (Accession XM_166596). Accordingly, utilities of VGAM1609 include diagnosis, prevention and treatment of diseases and clinical conditions associated with LOC222161. FIG. 1 further provides a conceptual description of a novel bioinformatically detected viral gene of the present invention, referred to here as Viral Genomic Address Messenger 1610 (VGAM1610) viral gene, which modulates expression of respective host target genes thereof, the function and utility of which host target genes is known in the art.

VGAM1610 is a novel bioinformatically detected regulatory, non protein coding, viral micro RNA (miRNA) gene. The method by which VGAM1610 was detected is described hereinabove with reference to FIGS. 1-8.

VGAM1610 gene, herein designated VGAM GENE, is a viral gene contained in the genome of Chimpanzee Cytomegalovirus. VGAM1610 host target gene, herein designated VGAM HOST TARGET GENE, is a human gene contained in the human genome.

VGAM1610 gene encodes a VGAM1610 precursor RNA, herein designated VGAM PRECURSOR RNA. Similar to other miRNA genes, and unlike most ordinary genes, VGAM1610 precursor RNA does not encode a protein. A nucleotide sequence identical or highly similar to the nucleotide sequence of VGAM1610 precursor RNA is designated SEQ ID:1596, and is provided hereinbelow with reference to the sequence listing part. Nucleotide sequence SEQ ID:1596 is located at position 5615 relative to the genome of Chimpanzee Cytomegalovirus.

VGAM1610 precursor RNA folds onto itself, forming VGAM1610 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1610 folded precursor RNA into VGAM1610 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1610 RNA is designated SEQ ID:4321, and is provided hereinbelow with reference to the sequence listing part.

VGAM1610 host target gene, herein designated VGAM HOST TARGET GENE, encodes a corresponding messenger RNA, VGAM1610 host target RNA, herein designated VGAM HOST TARGET RNA. VGAM1610 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1610 RNA, herein designated VGAM RNA, binds complementarily to one or more host target binding sites located in untranslated regions of VGAM1610 host target RNA, herein designated VGAM HOST TARGET RNA. This complementary binding is due to the fact that the nucleotide sequence of VGAM1610 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1610 RNA, herein designated VGAM RNA, may have a different number of host target binding sites in untranslated regions of a VGAM1610 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1610 RNA, herein designated VGAM RNA, to host target binding sites on VGAM1610 host target RNA, herein designated VGAM HOST TARGET RNA, such as BINDING SITE I, BINDING SITE II and BINDING SITE III, inhibits translation of VGAM1610 host target RNA into VGAM1610 host target protein, herein designated VGAM HOST TARGET PROTEIN. VGAM host target protein is therefore outlined by a broken line.

It is appreciated that VGAM1610 host target gene, herein designated VGAM HOST TARGET GENE, in fact represents a plurality of VGAM1610 host target genes. The mRNA of each one of this plurality of VGAM1610 host target genes comprises one or more host target binding sites, each having a nucleotide sequence which is at least partly complementary to VGAM1610 RNA, herein designated VGAM RNA, and which when bound by VGAM1610 RNA causes inhibition of translation of respective one or more VGAM1610 host target proteins.

It is further appreciated by one skilled in the art that the mode of translational inhibition illustrated by FIG. 1 with specific reference to translational inhibition exerted by VGAM1610 gene, herein designated VGAM GENE, on one or more VGAM1610 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1610 is inhibition of expression of host target genes, as part of a novel viral mechanism of attacking a host. Accordingly, utilities of VGAM1610 include diagnosis, prevention and treatment of viral infection by Chimpanzee Cytomegalovirus. Specific functions, and accordingly utilities, of VGAM1610 correlate with, and may be deduced from, the identity of the host target genes which VGAM1610 binds and inhibits, and the function of these host target genes, as elaborated hereinbelow.

Nucleotide sequences of the VGAM1610 precursor RNA, herein designated VGAM PRECURSOR RNA, and of the 'diced' VGAM1610 RNA, herein designated VGAM RNA, and a schematic representation of the secondary folding of VGAM1610 folded precursor RNA, herein designated VGAM FOLDED PRECURSOR RNA, of VGAM1610 are further described hereinbelow with reference to Table 1.

Nucleotide sequences of host target binding sites, such as BINDING SITE-I, BINDING SITE-II and BINDING SITE-III of FIG. 1, found on VGAM1610 host target RNA, and schematic representation of the complementarity of each of these host target binding sites to VGAM1610 RNA, herein designated VGAM RNA, are described hereinbelow with reference to Table 2.

As mentioned hereinabove with reference to FIG. 1, a function of VGAM1610 gene, herein designated VGAM is inhibition of expression of VGAM1610 target genes. It is appreciated that specific functions, and accordingly utilities, of VGAM1610 correlate with, and may be deduced from, the identity of the target genes which VGAM1610 binds and inhibits, and the function of these target genes, as elaborated hereinbelow.

Cytochrome P450, Subfamily I (aromatic compound-inducible), Polypeptide 2 (CYP1A2, Accession XM_044660) is a VGAM1610 host target gene. CYP1A2 BINDING SITE is HOST TARGET binding site found in the 3' untranslated region of mRNA encoded by CYP1A2, corresponding to a HOST TARGET binding site such as BINDING SITE I, BINDING SITE II or BINDING SITE III. Table 2 illustrates the complementarity of the nucleotide sequences of CYP1A2 BINDING SITE, designated SEQ ID:34254, to the nucleotide sequence of VGAM1610 RNA, herein designated VGAM RNA, also designated SEQ ID:4321.

A function of VGAM1610 is therefore inhibition of Cytochrome P450, Subfamily I (aromatic compound-inducible), Polypeptide 2 (CYP1A2, Accession XM_044660), a gene which intervenes in an NADPH-dependent electron transport pathway. Accordingly, utilities of VGAM1610 include diagnosis, prevention and treatment of diseases and clinical conditions associated with CYP1A2. The function of CYP1A2 and its association with various diseases and clinical conditions, has been established by previous studies, as described hereinabove with reference to VGAM74. Poliovirus Receptor (PVR, Accession NM_006505) is another VGAM1610 host target gene. PVR BINDING SITE is HOST TARGET binding site found in the 3' untranslated region of mRNA encoded by PVR, corresponding to a HOST TARGET binding site such as BINDING SITE I, BINDING SITE II or BINDING SITE III. Table 2 illustrates the complementarity of the nucleotide sequences of PVR BINDING SITE, designated SEQ ID:13252, to the nucleotide sequence of VGAM1610 RNA, herein designated VGAM RNA, also designated SEQ ID:4321.

Another function of VGAM1610 is therefore inhibition of Poliovirus Receptor (PVR, Accession NM_006505), a gene which is a poliovirus receptor. Accordingly, utilities of VGAM1610 include diagnosis, prevention and treatment of diseases and clinical conditions associated with PVR. The function of PVR and its association with various diseases and clinical conditions, has been established by previous studies, as described hereinabove with reference to VGAM1411. Tumor Necrosis Factor Receptor Superfamily, Member 8 (TNFRSF8, Accession NM_001243) is another VGAM1610 host target gene. TNFRSF8 BINDING SITE is HOST TARGET binding site found in the 3' untranslated region of mRNA encoded by TNFRSF8, corresponding to a HOST TARGET binding site such as BINDING SITE I, BINDING SITE II or BINDING SITE III. Table 2 illustrates the complementarity of the nucleotide sequences of TNFRSF8 BINDING SITE, designated SEQ ID:6909, to the nucleotide sequence of VGAM1610 RNA, herein designated VGAM RNA, also designated SEQ ID:4321.

Another function of VGAM1610 is therefore inhibition of Tumor Necrosis Factor Receptor Superfamily, Member 8 (TNFRSF8, Accession NM_001243), a gene which regulates gene expression through activation of nf-kappab. Accordingly, utilities of VGAM1610 include diagnosis, prevention and treatment of diseases and clinical conditions associated with TNFRSF8. The function of TNFRSF8 and its association with various diseases and clinical conditions, has been established by previous studies, as described hereinabove with reference to VGAM154. Hyaluronan Binding Protein 4 (HABP4, Accession XM_047263) is another VGAM1610 host target gene. HABP4 BINDING SITE is HOST TARGET binding site found in the 3' untranslated region of mRNA encoded by HABP4, corresponding to a HOST TARGET binding site such as BINDING SITE I, BINDING SITE II or BINDING SITE III. Table 2 illustrates the complementarity of the nucleotide sequences of HABP4 BINDING SITE, designated SEQ ID:34924, to the nucleotide sequence of VGAM1610 RNA, herein designated VGAM RNA, also designated SEQ ID:4321.

Another function of VGAM1610 is therefore inhibition of Hyaluronan Binding Protein 4 (HABP4, Accession XM_047263). Accordingly, utilities of VGAM1610 include diagnosis, prevention and treatment of diseases and clinical conditions associated with HABP4. KIAA1280 (Accession XM_045766) is another VGAM1610 host target gene. KIAA1280 BINDING SITE is HOST TARGET binding site found in the 5' untranslated region of mRNA encoded by KIAA1280, corresponding to a HOST TARGET binding site such as BINDING SITE I, BINDING SITE II or BINDING SITE III. Table 2 illustrates the complementarity of the nucleotide sequences of KIAA1280 BINDING SITE, designated SEQ ID:34549, to the nucleotide sequence of VGAM1610 RNA, herein designated VGAM RNA, also designated SEQ ID:4321.

Another function of VGAM1610 is therefore inhibition of KIAA1280 (Accession XM_045766). Accordingly, utilities of VGAM1610 include diagnosis, prevention and treatment of diseases and clinical conditions associated with KIAA1280. Kelch-like 6 (Drosophila) (KLHL6, Accession NM_130446) is another VGAM1610 host target gene. KLHL6 BINDING SITE is HOST TARGET binding site found in the 3' untranslated region of mRNA encoded by KLHL6, corresponding to a HOST TARGET binding site such as BINDING SITE I, BINDING SITE II or BINDING SITE III. Table 2 illustrates the complementarity of the nucleotide sequences of KLHL6 BINDING SITE, designated SEQ ID:28208, to the nucleotide sequence of VGAM1610 RNA, herein designated VGAM RNA, also designated SEQ ID:4321.

Another function of VGAM1610 is therefore inhibition of Kelch-like 6 (Drosophila) (KLHL6, Accession NM_130446). Accordingly, utilities of VGAM1610 include diagnosis, prevention and treatment of diseases and clinical conditions associated with KLHL6. OS4 (Accession NM_005730) is another VGAM1610 host target gene. OS4 BINDING SITE is HOST TARGET binding site found in the 5' untranslated region of mRNA encoded by OS4, corresponding to a HOST TARGET binding site such as BINDING SITE I, BINDING SITE II or BINDING SITE III. Table 2 illustrates the complementarity of the nucleotide sequences of OS4 BINDING SITE, designated SEQ ID:12286, to the nucleotide sequence of VGAM1610 RNA, herein designated VGAM RNA, also designated SEQ ID:4321.

Another function of VGAM1610 is therefore inhibition of OS4 (Accession NM_005730). Accordingly, utilities of VGAM1610 include diagnosis, prevention and treatment of diseases and clinical conditions associated with OS4. PME-1 (Accession NM_016147) is another VGAM1610 host target gene. PME-1 BINDING SITE is HOST TARGET binding site found in the 3' untranslated region of mRNA encoded by PME-1, corresponding to a HOST TARGET binding site such as BINDING SITE I, BINDING SITE II or BINDING SITE III. Table 2 illustrates the complementarity of the nucleotide sequences of PME-1 BINDING SITE, designated SEQ ID:18230, to the nucleotide sequence of VGAM1610 RNA, herein designated VGAM RNA, also designated SEQ ID:4321.

Another function of VGAM1610 is therefore inhibition of PME-1 (Accession NM_016147). Accordingly, utilities of VGAM1610 include diagnosis, prevention and treatment of diseases and clinical conditions associated with PME-1. SARM (Accession NM_015077) is another VGAM1610 host target gene. SARM BINDING SITE is HOST TARGET binding site found in the 3' untranslated region of mRNA encoded by SARM, corresponding to a HOST TARGET binding site such as BINDING SITE I, BINDING SITE II or BINDING SITE III. Table 2 illustrates the complementarity of the nucleotide sequences of SARM BINDING SITE, designated SEQ ID:17451, to the nucleotide sequence of VGAM1610 RNA, herein designated VGAM RNA, also designated SEQ ID:4321.

Another function of VGAM1610 is therefore inhibition of SARM (Accession NM_015077). Accordingly, utilities of VGAM1610 include diagnosis, prevention and treatment of diseases and clinical conditions associated with SARM. LOC124930 (Accession XM_058867) is another VGAM1610 host target gene. LOC124930 BINDING SITE is HOST TARGET binding site found in the 3' untranslated region of mRNA encoded by LOC124930, corresponding to a HOST TARGET binding site such as BINDING SITE I, BINDING SITE II or BINDING SITE III. Table 2 illustrates the complementarity of the nucleotide sequences of LOC124930 BINDING SITE, designated SEQ ID:36765, to the nucleotide sequence of VGAM1610 RNA, herein designated VGAM RNA, also designated SEQ ID:4321.

Another function of VGAM1610 is therefore inhibition of LOC124930 (Accession XM_058867). Accordingly, utilities of VGAM1610 include diagnosis, prevention and treatment of diseases and clinical conditions associated with LOC124930. LOC149276 (Accession XM_097621) is another VGAM1610 host target gene. LOC149276 BINDING SITE is HOST TARGET binding site found in the 3' untranslated region of mRNA encoded by LOC149276, corresponding to a HOST TARGET binding site such as BINDING SITE I, BINDING SITE II or BINDING SITE III. Table 2 illustrates the complementarity of the nucleotide sequences of LOC149276 BINDING SITE, designated SEQ ID:40974, to the nucleotide sequence of VGAM1610 RNA, herein designated VGAM RNA, also designated SEQ ID:4321.

Another function of VGAM1610 is therefore inhibition of LOC149276 (Accession XM_097621). Accordingly, utilities of VGAM1610 include diagnosis, prevention and treatment of diseases and clinical conditions associated with LOC149276. LOC157848 (Accession XM_088405) is another VGAM1610 host target gene. LOC157848 BINDING SITE is HOST TARGET binding site found in the 3' untranslated region of mRNA encoded by LOC157848, corresponding to a HOST TARGET binding site such as BINDING SITE I, BINDING SITE II or BINDING SITE III. Table 2 illustrates the complementarity of the nucleotide sequences of LOC157848 BINDING SITE, designated SEQ ID:39671, to the nucleotide sequence of VGAM1610 RNA, herein designated VGAM RNA, also designated SEQ ID:4321.

Another function of VGAM1610 is therefore inhibition of LOC157848 (Accession XM_088405). Accordingly, utilities of VGAM1610 include diagnosis, prevention and treatment of diseases and clinical conditions associated with LOC157848. LOC158292 (Accession XM_098914) is another VGAM1610 host target gene. LOC158292 BINDING SITE is HOST TARGET binding site found in the 5' untranslated region of mRNA encoded by LOC158292, corresponding to a HOST TARGET binding site such as BINDING SITE I, BINDING SITE II or BINDING SITE III. Table 2 illustrates the complementarity of the nucleotide sequences of LOC158292 BINDING SITE, designated SEQ ID:41930, to the nucleotide sequence of VGAM1610 RNA, herein designated VGAM RNA, also designated SEQ ID:4321.

Another function of VGAM1610 is therefore inhibition of LOC158292 (Accession XM_098914). Accordingly, utilities of VGAM1610 include diagnosis, prevention and treatment of diseases and clinical conditions associated with LOC158292. LOC253893 (Accession XM_171188) is another VGAM1610 host target gene. LOC253893 BINDING SITE is HOST TARGET binding site found in the 3' untranslated region of mRNA encoded by LOC253893, corresponding to a HOST TARGET binding site such as BINDING SITE I, BINDING SITE II or BINDING SITE III. Table 2 illustrates the complementarity of the nucleotide sequences of LOC253893 BINDING SITE, designated SEQ ID:45970, to the nucleotide sequence of VGAM1610 RNA, herein designated VGAM RNA, also designated SEQ ID:4321.

Another function of VGAM1610 is therefore inhibition of LOC253893 (Accession XM_171188). Accordingly, utilities of VGAM1610 include diagnosis, prevention and treatment of diseases and clinical conditions associated with LOC253893. FIG. 1 further provides a conceptual description of a novel bioinformatically detected viral gene of the present invention, referred to here as Viral Genomic Address Messenger 1611 (VGAM1611) viral gene, which modulates expression of respective host target genes thereof, the function and utility of which host target genes is known in the art.

VGAM1611 is a novel bioinformatically detected regulatory, non protein coding, viral micro RNA (miRNA) gene. The method by which VGAM1611 was detected is described hereinabove with reference to FIGS. 1-8.

VGAM1611 gene, herein designated VGAM GENE, is a viral gene contained in the genome of Chimpanzee Cytomegalovirus. VGAM1611 host target gene, herein designated VGAM HOST TARGET GENE, is a human gene contained in the human genome.

VGAM1611 gene encodes a VGAM1611 precursor RNA, herein designated VGAM PRECURSOR RNA. Similar to other miRNA genes, and unlike most ordinary genes, VGAM1611 precursor RNA does not encode a protein. A nucleotide sequence identical or highly similar to the nucleotide sequence of VGAM1611 precursor RNA is designated SEQ ID:1597, and is provided hereinbelow with reference to the sequence listing part. Nucleotide sequence SEQ ID:1597 is located at position 10114 relative to the genome of Chimpanzee Cytomegalovirus.

VGAM1611 precursor RNA folds onto itself, forming VGAM1611 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1611 folded precursor RNA into VGAM1611 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1611 RNA is designated SEQ ID:4322, and is provided hereinbelow with reference to the sequence listing part.

VGAM1611 host target gene, herein designated VGAM HOST TARGET GENE, encodes a corresponding messenger RNA, VGAM1611 host target RNA, herein designated VGAM HOST TARGET RNA. VGAM1611 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1611 RNA, herein designated VGAM RNA, binds complementarily to one or more host target binding sites located in untranslated regions of VGAM1611 host target RNA, herein designated VGAM HOST TARGET RNA. This complementary binding is due to the fact that the nucleotide sequence of VGAM1611 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1611 RNA, herein designated VGAM RNA, may have a different number of host target binding sites in untranslated regions of a VGAM1611 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1611 RNA, herein designated VGAM RNA, to host target binding sites on VGAM1611 host target RNA, herein designated VGAM HOST TARGET RNA, such as BINDING SITE I, BINDING SITE II and BINDING SITE III, inhibits translation of VGAM1611 host target RNA into VGAM1611 host target protein, herein designated VGAM HOST TARGET PROTEIN. VGAM host target protein is therefore outlined by a broken line.

It is appreciated that VGAM1611 host target gene, herein designated VGAM HOST TARGET GENE, in fact represents a plurality of VGAM1611 host target genes. The mRNA of each one of this plurality of VGAM1611 host target genes comprises one or more host target binding sites, each having a nucleotide sequence which is at least partly complementary to VGAM1611 RNA, herein designated VGAM RNA, and which when bound by VGAM1611 RNA causes inhibition of translation of respective one or more VGAM1611 host target proteins.

It is further appreciated by one skilled in the art that the mode of translational inhibition illustrated by FIG. 1 with specific reference to translational inhibition exerted by VGAM1611 gene, herein designated VGAM GENE, on one or more VGAM1611 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1611 is inhibition of expression of host target genes, as part of a novel viral mechanism of attacking a host. Accordingly, utilities of VGAM1611 include diagnosis, prevention and treatment of viral infection by Chimpanzee Cytomegalovirus. Specific functions, and accordingly utilities, of VGAM1611 correlate with, and may be deduced from, the identity of the host target genes which VGAM1611 binds and inhibits, and the function of these host target genes, as elaborated hereinbelow.

Nucleotide sequences of the VGAM1611 precursor RNA, herein designated VGAM PRECURSOR RNA, and of the 'diced' VGAM1611 RNA, herein designated VGAM RNA, and a schematic representation of the secondary folding of VGAM1611 folded precursor RNA, herein designated VGAM FOLDED PRECURSOR RNA, of VGAM1611 are further described hereinbelow with reference to Table 1.

Nucleotide sequences of host target binding sites, such as BINDING SITE-I, BINDING SITE-II and BINDING SITE-III of FIG. 1, found on VGAM1611 host target RNA, and schematic representation of the complementarity of each of these host target binding sites to VGAM1611 RNA, herein designated VGAM RNA, are described hereinbelow with reference to Table 2.

As mentioned hereinabove with reference to FIG. 1, a function of VGAM1611 gene, herein designated VGAM is inhibition of expression of VGAM1611 target genes. It is appreciated that specific functions, and accordingly utilities, of VGAM1611 correlate with, and may be deduced from, the identity of the target genes which VGAM1611 binds and inhibits, and the function of these target genes, as elaborated hereinbelow.

Leukemia Inhibitory Factor Receptor (LIFR, Accession NM_002310) is a VGAM1611 host target gene. LIFR BINDING SITE is HOST TARGET binding site found in the 3' untranslated region of mRNA encoded by LIFR, corresponding to a HOST TARGET binding site such as BINDING SITE I, BINDING SITE II or BINDING SITE III. Table 2 illustrates the complementarity of the nucleotide sequences of LIFR BINDING SITE, designated SEQ ID:8102, to the nucleotide sequence of VGAM1611 RNA, herein designated VGAM RNA, also designated SEQ ID:4322.

A function of VGAM1611 is therefore inhibition of Leukemia Inhibitory Factor Receptor (LIFR, Accession NM_002310). Accordingly, utilities of VGAM1611 include diagnosis, prevention and treatment of diseases and clinical conditions associated with LIFR. BTB (POZ) Domain Containing 3 (BTBD3, Accession NM_014962) is another VGAM1611 host target gene. BTBD3 BINDING SITE is HOST TARGET binding site found in the 3' untranslated region of mRNA encoded by BTBD3, corresponding to a HOST TARGET binding site such as BINDING SITE I, BINDING SITE II or BINDING SITE III. Table 2 illustrates the complementarity of the nucleotide sequences of BTBD3 BINDING SITE, designated SEQ ID:17338, to the nucleotide sequence of VGAM1611 RNA, herein designated VGAM RNA, also designated SEQ ID:4322.

Another function of VGAM1611 is therefore inhibition of BTB (POZ) Domain Containing 3 (BTBD3, Accession NM_014962). Accordingly, utilities of VGAM1611 include diagnosis, prevention and treatment of diseases and clinical conditions associated with BTBD3. LOC149351 (Accession XM_086503) is another VGAM1611 host target gene. LOC149351 BINDING SITE is HOST TARGET binding site found in the 3' untranslated region of mRNA encoded by LOC149351, corresponding to a HOST TARGET binding site such as BINDING SITE I, BINDING SITE II or BINDING SITE III. Table 2 illustrates the complementarity of the nucleotide sequences of LOC149351 BINDING SITE, designated SEQ ID:38716, to the nucleotide sequence of VGAM1611 RNA, herein designated VGAM RNA, also designated SEQ ID:4322.

Another function of VGAM1611 is therefore inhibition of LOC149351 (Accession XM_086503). Accordingly, utilities of VGAM1611 include diagnosis, prevention and treatment of diseases and clinical conditions associated with LOC149351. FIG. 1 further provides a conceptual description of a novel bioinformatically detected viral gene of the present invention, referred to here as Viral Genomic Address Messenger 1612 (VGAM1612) viral gene, which modulates expression of respective host target genes thereof, the function and utility of which host target genes is known in the art.

VGAM1612 is a novel bioinformatically detected regulatory, non protein coding, viral micro RNA (miRNA) gene. The method by which VGAM1612 was detected is described hereinabove with reference to FIGS. 1-8.

VGAM1612 gene, herein designated VGAM GENE, is a viral gene contained in the genome of Chimpanzee Cytomegalovirus. VGAM1612 host target gene, herein designated VGAM HOST TARGET GENE, is a human gene contained in the human genome.

VGAM1612 gene encodes a VGAM1612 precursor RNA, herein designated VGAM PRECURSOR RNA. Similar to other miRNA genes, and unlike most ordinary genes, VGAM1612 precursor RNA does not encode a protein. A nucleotide sequence identical or highly similar to the nucleotide sequence of VGAM1612 precursor RNA is designated SEQ ID:1598, and is provided hereinbelow with reference to the sequence listing part. Nucleotide sequence SEQ ID:1598 is located at position 1800 relative to the genome of Chimpanzee Cytomegalovirus.

VGAM1612 precursor RNA folds onto itself, forming VGAM1612 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1612 folded precursor RNA into VGAM1612 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1612 RNA is designated SEQ ID:4323, and is provided hereinbelow with reference to the sequence listing part.

VGAM1612 host target gene, herein designated VGAM HOST TARGET GENE, encodes a corresponding messenger RNA, VGAM1612 host target RNA, herein designated VGAM HOST TARGET RNA. VGAM1612 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1612 RNA, herein designated VGAM RNA, binds complementarily to one or more host target binding sites located in untranslated regions of VGAM1612 host target RNA, herein designated VGAM HOST TARGET RNA. This complementary binding is due to the fact that the nucleotide sequence of VGAM1612 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1612 RNA, herein designated VGAM RNA, may have a different number of host target binding sites in untranslated regions of a VGAM1612 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1612 RNA, herein designated VGAM RNA, to host target binding sites on VGAM1612 host target RNA, herein designated VGAM HOST TARGET RNA, such as BINDING SITE I, BINDING SITE II and BINDING SITE III, inhibits translation of VGAM1612 host target RNA into VGAM1612 host target protein, herein designated VGAM HOST TARGET PROTEIN. VGAM host target protein is therefore outlined by a broken line.

It is appreciated that VGAM1612 host target gene, herein designated VGAM HOST TARGET GENE, in fact represents a plurality of VGAM1612 host target genes. The mRNA of each one of this plurality of VGAM1612 host target genes comprises one or more host target binding sites, each having a nucleotide sequence which is at least partly complementary to VGAM1612 RNA, herein designated VGAM RNA, and which when bound by VGAM1612 RNA causes inhibition of translation of respective one or more VGAM1612 host target proteins.

It is further appreciated by one skilled in the art that the mode of translational inhibition illustrated by FIG. 1 with specific reference to translational inhibition exerted by VGAM1612 gene, herein designated VGAM GENE, on one or more VGAM1612 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1612 is inhibition of expression of host target genes, as part of a novel viral mechanism of attacking a host. Accordingly, utilities of VGAM1612 include diagnosis, prevention and treatment of viral infection by Chimpanzee Cytomegalovirus. Specific functions, and accordingly utilities, of VGAM1612 correlate with, and may be deduced from, the identity of the host target genes which VGAM1612 binds and inhibits, and the function of these host target genes, as elaborated hereinbelow.

Nucleotide sequences of the VGAM1612 precursor RNA, herein designated VGAM PRECURSOR RNA, and of the 'diced' VGAM1612 RNA, herein designated VGAM RNA, and a schematic representation of the secondary folding of VGAM1612 folded precursor RNA, herein designated VGAM FOLDED PRECURSOR RNA, of VGAM1612 are further described hereinbelow with reference to Table 1.

Nucleotide sequences of host target binding sites, such as BINDING SITE-I, BINDING SITE-II and BINDING SITE-III of FIG. 1, found on VGAM1612 host target RNA, and schematic representation of the complementarity of each of these host target binding sites to VGAM1612 RNA, herein designated VGAM RNA, are described hereinbelow with reference to Table 2.

As mentioned hereinabove with reference to FIG. 1, a function of VGAM1612 gene, herein designated VGAM is inhibition of expression of VGAM1612 target genes. It is appreciated that specific functions, and accordingly utilities, of VGAM1612 correlate with, and may be deduced from, the identity of the target genes which VGAM1612 binds and inhibits, and the function of these target genes, as elaborated hereinbelow.

KIAA1679 (Accession XM_046570) is a VGAM1612 host target gene. KIAA1679 BINDING SITE is HOST TARGET binding site found in the 3' untranslated region of mRNA encoded by KIAA1679, corresponding to a HOST TARGET binding site such as BINDING SITE I, BINDING SITE II or BINDING SITE III. Table 2 illustrates the complementarity of the nucleotide sequences of KIAA1679 BINDING SITE, designated SEQ ID:34750, to the nucleotide sequence of VGAM1612 RNA, herein designated VGAM RNA, also designated SEQ ID:4323.

A function of VGAM1612 is therefore inhibition of KIAA1679 (Accession XM_046570). Accordingly, utilities of VGAM1612 include diagnosis, prevention and treatment of diseases and clinical conditions associated with KIAA1679. FIG. 1 further provides a conceptual description of a novel bioinformatically detected viral gene of the present invention, referred to here as Viral Genomic Address Messenger 1613 (VGAM1613) viral gene, which modulates expression of respective host target genes thereof, the function and utility of which host target genes is known in the art.

VGAM1613 is a novel bioinformatically detected regulatory, non protein coding, viral micro RNA (miRNA) gene. The method by which VGAM1613 was detected is described hereinabove with reference to FIGS. 1-8.

VGAM1613 gene, herein designated VGAM GENE, is a viral gene contained in the genome of Chimpanzee Cytomegalovirus. VGAM1613 host target gene, herein designated VGAM HOST TARGET GENE, is a human gene contained in the human genome.

VGAM1613 gene encodes a VGAM1613 precursor RNA, herein designated VGAM PRECURSOR RNA. Similar to other miRNA genes, and unlike most ordinary genes, VGAM1613 precursor RNA does not encode a protein. A nucleotide sequence identical or highly similar to the nucleotide sequence of VGAM1613 precursor RNA is designated SEQ ID:1599, and is provided hereinbelow with reference to the sequence listing part. Nucleotide sequence SEQ ID:1599 is located at position 4267 relative to the genome of Chimpanzee Cytomegalovirus.

VGAM1613 precursor RNA folds onto itself, forming VGAM1613 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1613 folded precursor RNA into VGAM1613 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM1613 RNA is designated SEQ ID:4324, and is provided hereinbelow with reference to the sequence listing part.

VGAM1613 host target gene, herein designated VGAM HOST TARGET GENE, encodes a corresponding messenger RNA, VGAM1613 host target RNA, herein designated VGAM HOST TARGET RNA. VGAM1613 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1613 RNA, herein designated VGAM RNA, binds complementarily to one or more host target binding sites located in untranslated regions of VGAM1613 host target RNA, herein designated VGAM HOST TARGET RNA. This complementary binding is due to the fact that the nucleotide sequence of VGAM1613 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1613 RNA, herein designated VGAM RNA, may have a different number of host target binding sites in untranslated regions of a VGAM1613 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1613 RNA, herein designated VGAM RNA, to host target binding sites on VGAM1613 host target RNA, herein designated VGAM HOST TARGET RNA, such as BINDING SITE I, BINDING SITE II and BINDING SITE III, inhibits translation of VGAM1613 host target RNA into VGAM1613 host target protein, herein designated VGAM HOST TARGET PROTEIN. VGAM host target protein is therefore outlined by a broken line.

It is appreciated that VGAM1613 host target gene, herein designated VGAM HOST TARGET GENE, in fact represents a plurality of VGAM1613 host target genes. The mRNA of each one of this plurality of VGAM1613 host target genes comprises one or more host target binding sites, each having a nucleotide sequence which is at least partly complementary to VGAM1613 RNA, herein designated VGAM RNA, and which when bound by VGAM1613 RNA causes inhibition of translation of respective one or more VGAM1613 host target proteins.

It is further appreciated by one skilled in the art that the mode of translational inhibition illustrated by FIG. 1 with specific reference to translational inhibition exerted by VGAM1613 gene, herein designated VGAM GENE, on one or more VGAM1613 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1613 is inhibition of expression of host target genes, as part of a novel viral mechanism of attacking a host. Accordingly, utilities of VGAM1613 include diagnosis, prevention and treatment of viral infection by Chimpanzee Cytomegalovirus. Specific functions, and accordingly utilities, of VGAM1613 correlate with, and may be deduced from, the identity of the host target genes which VGAM1613 binds and inhibits, and the function of these host target genes, as elaborated hereinbelow.

Nucleotide sequences of the VGAM1613 precursor RNA, herein designated VGAM PRECURSOR RNA, and of the 'diced' VGAM1613 RNA, herein designated VGAM RNA, and a schematic representation of the secondary folding of VGAM1613 folded precursor RNA, herein designated VGAM FOLDED PRECURSOR RNA, of VGAM1613 are further described hereinbelow with reference to Table 1.

Nucleotide sequences of host target binding sites, such as BINDING SITE-I, BINDING SITE-II and BINDING SITE-III of FIG. 1, found on VGAM1613 host target RNA, and schematic representation of the complementarity of each of these host target binding sites to VGAM1613 RNA, herein designated VGAM RNA, are described hereinbelow with reference to Table 2.

As mentioned hereinabove with reference to FIG. 1, a function of VGAM1613 gene, herein designated VGAM is inhibition of expression of VGAM1613 target genes. It is appreciated that specific functions, and accordingly utilities, of VGAM1613 correlate with, and may be deduced from, the identity of the target genes which VGAM1613 binds and inhibits, and the function of these target genes, as elaborated hereinbelow.

Cytokine Receptor-like Factor 1 (CRLF1, Accession NM_004750) is a VGAM1613 host target gene. CRLF1 BINDING SITE is HOST TARGET binding site found in the 5' untranslated region of mRNA encoded by CRLF1, corresponding to a HOST TARGET binding site such as BINDING SITE I, BINDING SITE II or BINDING SITE III. Table 2 illustrates the complementarity of the nucleotide sequences of CRLF1 BINDING SITE, designated SEQ ID:11139, to the nucleotide sequence of VGAM1613 RNA, herein designated VGAM RNA, also designated SEQ ID:4324.

A function of VGAM1613 is therefore inhibition of Cytokine Receptor-like Factor 1 (CRLF1, Accession NM_004750), a gene which is similar to cytokine type 1 receptors. Accordingly, utilities of VGAM1613 include diagnosis, prevention and treatment of diseases and clinical conditions associated with CRLF1. The function of CRLF1 has been established by previous studies. Elson et al. (1998) described the identification, cloning, and expression pattern of human cytokine-like factor-1, which they designated CLF1, as well as the identification and cloning of the mouse homolog. They were identified from expressed sequence tags using amino acid sequences from conserved regions of the cytokine type I receptor family. The human and mouse CRLF1 proteins share 96% amino acid identity and significant homology with many cytokine type I receptors. The human cDNA encodes a precursor protein of 422 amino acids with a putative signal peptide of 37 amino acids. CRLF1 is a secreted protein, suggesting that it is either a soluble subunit within a cytokine receptor complex, like the soluble form of IL6R (OMIM Ref. No. 147880) or a subunit of a multimeric cytokine, e.g., IL12B (OMIM Ref. No. 161561). The highest levels of CRLF1 mRNA were observed in lymph node, spleen, thymus, appendix, placenta, stomach, and fetal lung, with constitutive expression of CRLF1 mRNA detected in a human kidney fibroblast cell line. In fibroblast primary cell cultures, CRLF1 mRNA was upregulated by TNF-alpha (OMIM Ref. No. 191160), interleukin-6 (OMIM Ref. No. 147620), and gamma-interferon (OMIM Ref. No. 147570). Western blot analysis of recombinant forms of CRLF1 showed that the protein has the tendency to form covalently linked dimers and tetramers. These results suggested that CRLF1 is a novel soluble cytokine receptor subunit or part of a novel cytokine complex, possibly playing a regulatory role in the immune system and during fetal development Alexander et al. (1999) found that, although in situ hybridization showed Nr6 expression at multiple sites in the developing embryo, mice lacking Nr6 did not display obvious abnormalities and were born in the expected numbers. Neonatal Nr6 -/- mice failed to suckle, however, and died within 24 hours of birth, suggesting that Nr6 is necessary for the recognition of processing pheromonal signals or for the mechanics of suckling itself. In addition, Nr6 -/- mice had reduced numbers of hemopoietic progenitor cells, suggesting a potential role in the regulation of primitive hemopoiesis Full details of the abovementioned studies are described in the following publications, the disclosure of which are hereby incorporated by reference:

Elson, G. C. A.; Graber, P.; Losberger, C.; Herren, S.; Gretener, D.; Menoud, L. N.; Wells, T. N. C.; Kosco-Vilbois, M. H.; Gauchat, J.-F.: Cytokine-like factor-1, a novel soluble protein, shares homology with members of the cytokine type I receptor family. J. Immun. 161:1371-1379, 1998; and Alexander, W. S.; Rakar, S.; Robb, L.; Farley, A.; Willson, T. A.; Zhang, J.-G.; Hartley, L.; Kikuchi, Y.; Kojima, T.; Nomura, H.; Hasegawa, M.; Maeda, M.; Fabri, L.; Jachno, K.; Nash, A.

Further studies establishing the function and utilities of CRLF1 are found in John Hopkins OMIM database record ID 604237, and in sited publications numbered 5176-5177 listed in the bibliography section hereinbelow, which are also hereby incorporated by reference. Enolase 2, (gamma, neuronal) (ENO2, Accession NM_001975) is another VGAM1613 host target gene. ENO2 BINDING SITE is HOST TARGET binding site found in the 5' untranslated region of mRNA encoded by ENO2, corresponding to a HOST TARGET binding site such as BINDING SITE I, BINDING SITE II or BINDING SITE III. Table 2 illustrates the complementarity of the nucleotide sequences of ENO2 BINDING SITE, designated SEQ ID:7705, to the nucleotide sequence of VGAM1613 RNA, herein designated VGAM RNA, also designated SEQ ID:4324.

Another function of VGAM1613 is therefore inhibition of Enolase 2, (gamma, neuronal) (ENO2, Accession NM_001975), a gene which converts 2-phospho-D-glycerate to phosphoenolpyruvate in glycolysis. Accordingly, utilities of VGAM1613 include diagnosis, prevention and treatment of diseases and clinical conditions associated with ENO2. The function of ENO2 and its association with various diseases and clinical conditions, has been established by previous studies, as described hereinabove with reference to VGAM1151. Potassium Voltage-gated Channel, Delayed-rectifier, Subfamily S, Member 2 (KCNS2, Accession XM_043106) is another VGAM1613 host target gene. KCNS2 BINDING SITE is HOST TARGET binding site found in the 5' untranslated region of mRNA encoded by KCNS2, corresponding to a HOST TARGET binding site such as BINDING SITE I, BINDING SITE II or BINDING SITE III. Table 2 illustrates the complementarity of the nucleotide sequences of KCNS2 BINDING SITE, designated SEQ ID:33900, to the nucleotide sequence of VGAM1613 RNA, herein designated VGAM RNA, also designated SEQ ID:4324.

Another function of VGAM1613 is therefore inhibition of Potassium Voltage-gated Channel, Delayed-rectifier, Subfamily S, Member 2 (KCNS2, Accession XM_043106), a gene which mediates the voltage-dependent potassium ion permeability of excitable membranes. Accordingly, utilities of VGAM1613 include diagnosis, prevention and treatment of diseases and clinical conditions associated with KCNS2. The function of KCNS2 and its association with various diseases and clinical conditions, has been established by previous studies, as described hereinabove with reference to VGAM419. Matrix Metalloproteinase 14 (membrane-inserted) (MMP14, Accession NM_004995) is another VGAM1613 host target gene. MMP14 BINDING SITE is HOST TARGET binding site found in the 3' untranslated region of mRNA encoded by MMP14, corresponding to a HOST TARGET binding site such as BINDING SITE I, BINDING SITE II or BINDING SITE III. Table 2 illustrates the complementarity of the nucleotide sequences of MMP14 BINDING SITE, designated SEQ ID:11435, to the nucleotide sequence of VGAM1613 RNA, herein designated VGAM RNA, also designated SEQ ID:4324.

Another function of VGAM1613 is therefore inhibition of Matrix Metalloproteinase 14 (membrane-inserted) (MMP14, Accession NM_004995). Accordingly, utilities of VGAM1613 include diagnosis, prevention and treatment of diseases and clinical conditions associated with MMP14. FLJ14753 (Accession NM_032558) is another VGAM1613 host target gene. FLJ14753 BINDING SITE is HOST TARGET binding site found in the 3' untranslated region of mRNA encoded by FLJ14753, corresponding to a HOST TARGET binding site such as BINDING SITE I, BINDING SITE II or BINDING SITE III. Table 2 illustrates the complementarity of the nucleotide sequences of FLJ14753 BINDING SITE, designated SEQ ID:26285, to the nucleotide sequence of VGAM1613 RNA, herein designated VGAM RNA, also designated SEQ ID:4324.

Another function of VGAM1613 is therefore inhibition of FLJ14753 (Accession NM_032558). Accordingly, utilities of VGAM1613 include diagnosis, prevention and treatment of diseases and clinical conditions associated with FLJ14753. KIAA0229 (Accession XM_166478) is another VGAM1613 host target gene. KIAA0229 BINDING SITE is HOST TARGET binding site found in the 3' untranslated region of mRNA encoded by KIAA0229, corresponding to a HOST TARGET binding site such as BINDING SITE I, BINDING SITE II or BINDING SITE III. Table 2 illustrates the complementarity of the nucleotide sequences of KIAA0229 BINDING SITE, designated SEQ ID:44397, to the nucleotide sequence of VGAM1613 RNA, herein designated VGAM RNA, also designated SEQ ID:4324.

Another function of VGAM1613 is therefore inhibition of KIAA0229 (Accession XM_166478). Accordingly, utilities of VGAM1613 include diagnosis, prevention and treatment of diseases and clinical conditions associated with KIAA0229. KIAA0537 (Accession NM_014840) is another VGAM1613 host target gene. KIAA0537 BINDING SITE is HOST TARGET binding site found in the 5' untranslated region of mRNA encoded by KIAA0537, corresponding to a HOST TARGET binding site such as BINDING SITE I, BINDING SITE II or BINDING SITE III. Table 2 illustrates the complementarity of the nucleotide sequences of KIAA0537 BINDING SITE, designated SEQ ID:16865, to the nucleotide sequence of VGAM1613 RNA, herein designated VGAM RNA, also designated SEQ ID:4324.

Another function of VGAM1613 is therefore inhibition of KIAA0537 (Accession NM_014840). Accordingly, utilities of VGAM1613 include diagnosis, prevention and treatment of diseases and clinical conditions associated with KIAA0537. MGC20235 (Accession NM_145041) is another VGAM1613 host target gene. MGC20235 BINDING SITE is HOST TARGET binding site found in the 5' untranslated region of mRNA encoded by MGC20235, corresponding to a HOST TARGET binding site such as BINDING SITE I, BINDING SITE II or BINDING SITE III. Table 2 illustrates the complementarity of the nucleotide sequences of MGC20235 BINDING SITE, designated SEQ ID:29664, to the nucleotide sequence of VGAM1613 RNA, herein designated VGAM RNA, also designated SEQ ID:4324.

Another function of VGAM1613 is therefore inhibition of MGC20235 (Accession NM_145041). Accordingly, utilities of VGAM1613 include diagnosis, prevention and treatment of diseases and clinical conditions associated with MGC20235. Sema Domain, Immunoglobulin Domain (Ig), Transmembrane Domain (TM) and Short Cytoplasmic Domain, (semaphorin) 4G (SEMA4G, Accession XM_170638) is another VGAM1613 host target gene. SEMA4G BINDING SITE is HOST TARGET binding site found in the 5' untranslated region of mRNA encoded by SEMA4G, corresponding to a HOST TARGET binding site such as BINDING SITE I, BINDING SITE II or BINDING SITE III. Table 2 illustrates the complementarity of the nucleotide sequences of SEMA4G BINDING SITE, designated SEQ ID:45410, to the nucleotide sequence of VGAM1613 RNA, herein designated VGAM RNA, also designated SEQ ID:4324.

Another function of VGAM1613 is therefore inhibition of Sema Domain, Immunoglobulin Domain (Ig), Transmembrane Domain (TM) and Short Cytoplasmic Domain, (semaphorin) 4G (SEMA4G, Accession XM_170638). Accordingly, utilities of VGAM1613 include diagnosis, prevention and treatment of diseases and clinical conditions associated with SEMA4G. Vesicular Inhibitory Amino Acid Transporter (VIAAT, Accession NM_080552) is another VGAM1613 host target gene. VIAAT BINDING SITE is HOST TARGET binding site found in the 5" untranslated region of mRNA encoded by VIAAT, corresponding to a HOST TARGET binding site such as BINDING SITE I, BINDING SITE II or BINDING SITE III. Table 2 illustrates the complementarity of the nucleotide sequences of VIAAT BINDING SITE, designated SEQ ID:27884, to the nucleotide sequence of VGAM1613 RNA, herein designated VGAM RNA, also designated SEQ ID:4324.

Another function of VGAM1613 is therefore inhibition of Vesicular Inhibitory Amino Acid Transporter (VIAAT, Accession NM_080552). Accordingly, utilities of VGAM1613 include diagnosis, prevention and treatment of diseases and clinical conditions associated with VIAAT. LOC145989 (Accession XM_004815) is another VGAM1613 host target gene. LOC145989 BINDING SITE is HOST TARGET binding site found in the 5' untranslated region of mRNA encoded by LOC145989, corresponding to a HOST TARGET binding site such as BINDING SITE I, BINDING SITE II or BINDING SITE III. Table 2 illustrates the complementarity of the nucleotide sequences of LOC145989 BINDING SITE, designated SEQ ID:29948, to the nucleotide sequence of VGAM1613 RNA, herein designated VGAM RNA, also designated SEQ ID:4324.

Another function of VGAM1613 is therefore inhibition of LOC145989 (Accession XM_004815). Accordingly, utilities of VGAM1613 include diagnosis, prevention and treatment of diseases and clinical conditions associated with LOC145989. LOC148946 (Accession XM_097557) is another VGAM1613 host target gene. LOC148946 BINDING SITE is HOST TARGET binding site found in the 5' untranslated region of mRNA encoded by LOC148946, corresponding to a HOST TARGET binding site such as BINDING SITE I, BINDING SITE II or BINDING SITE III. Table 2 illustrates the complementarity of the nucleotide sequences of LOC148946 BINDING SITE, designated SEQ ID:40938, to the nucleotide sequence of VGAM1613 RNA, herein designated VGAM RNA, also designated SEQ ID:4324.

Another function of VGAM1613 is therefore inhibition of LOC148946 (Accession XM_097557). Accordingly, utilities of VGAM1613 include diagnosis, prevention and treatment of diseases and clinical conditions associated with LOC148946. LOC151127 (Accession XM_087104) is another VGAM1613 host target gene. LOC151127 BINDING SITE is HOST TARGET binding site found in the 5' untranslated region of mRNA encoded by LOC151127, corresponding to a HOST TARGET binding site such as BINDING SITE I, BINDING SITE II or BINDING SITE III. Table 2 illustrates the complementarity of the nucleotide sequences of LOC151127 BINDING SITE, designated SEQ ID:39060, to the nucleotide sequence of VGAM1613 RNA, herein designated VGAM RNA, also designated SEQ ID:4324.

Another function of VGAM1613 is therefore inhibition of LOC151127 (Accession XM_087104). Accordingly, utilities of VGAM1613 include diagnosis, prevention and treatment of diseases and clinical conditions associated with LOC151127. LOC201175 (Accession XM_113915) is another VGAM1613 host target gene. LOC201175 BINDING SITE is HOST TARGET binding site found in the 5' untranslated region of mRNA encoded by LOC201175, corresponding to a HOST TARGET binding site such as BINDING SITE I, BINDING SITE II or BINDING SITE III. Table 2 illustrates the complementarity of the nucleotide sequences of LOC201175 BINDING SITE, designated SEQ ID:42533, to the nucleotide sequence of VGAM1613 RNA, herein designated VGAM RNA, also designated SEQ ID:4324.

Another function of VGAM1613 is therefore inhibition of LOC201175 (Accession XM_113915). Accordingly, utilities of VGAM1613 include diagnosis, prevention and treatment of diseases and clinical conditions associated with LOC201175. LOC220558 (Accession XM_165930) is another VGAM1613 host target gene. LOC220558 BINDING SITE is HOST TARGET binding site found in the 5' untranslated region of mRNA encoded by LOC220558, corresponding to a HOST TARGET binding site such as BINDING SITE I, BINDING SITE II or BINDING SITE III. Table 2 illustrates the complementarity of the nucleotide sequences of LOC220558 BINDING SITE, designated SEQ ID:43804, to the nucleotide sequence of VGAM1613 RNA, herein designated VGAM RNA, also designated SEQ ID:4324.

Another function of VGAM1613 is therefore inhibition of LOC220558 (Accession XM_165930). Accordingly, utilities of VGAM1613 include diagnosis, prevention and treatment of diseases and clinical conditions associated with LOC220558. LOC221250 (Accession XM_166301) is another VGAM1613 host target gene. LOC221250 BINDING SITE1 and LOC221250 BINDING SITE2 are HOST TARGET binding sites found in untranslated regions of mRNA encoded by LOC221250, corresponding to HOST TARGET binding sites such as BINDING SITE I, BINDING SITE II or BINDING SITE III. Table 2 illustrates the complementarity of the nucleotide sequences of LOC221250 BINDING SITE1 and LOC221250 BINDING SITE2, designated SEQ ID:44118 and SEQ ID:44119 respectively, to the nucleotide sequence of VGAM1613 RNA, herein designated VGAM RNA, also designated SEQ ID:4324.

Another function of VGAM1613 is therefore inhibition of LOC221250 (Accession XM_166301). Accordingly, utilities of VGAM1613 include diagnosis, prevention and treatment of diseases and clinical conditions associated with LOC221250. FIG. 1 further provides a conceptual description of a novel bioinformatically detected viral gene of the present invention, referred to here as Viral Genomic Address Messenger 1614 (VGAM1614) viral gene, which modulates expression of respective host target genes thereof, the function and utility of which host target genes is known in the art.

VGAM1614 is a novel bioinformatically detected regulatory, non protein coding, viral micro RNA (miRNA) gene. The method by which VGAM1614 was detected is described hereinabove with reference to FIGS. 1-8.

VGAM1614 gene, herein designated VGAM GENE, is a viral gene contained in the genome of Chimpanzee Cytomegalovirus. VGAM1614 host target gene, herein designated VGAM HOST TARGET GENE, is a human gene contained in the human genome.

VGAM1614 gene encodes a VGAM1614 precursor RNA, herein designated VGAM PRECURSOR RNA. Similar to other miRNA genes, and unlike most ordinary genes, VGAM1614 precursor RNA does not encode a protein. A nucleotide sequence identical or highly similar to the nucleotide sequence of VGAM1614 precursor RNA is designated SEQ ID:1600, and is provided hereinbelow with reference to the sequence listing part. Nucleotide sequence SEQ ID:1600 is located at position 6443 relative to the genome of Chimpanzee Cytomegalovirus.

VGAM1614 precursor RNA folds onto itself, forming VGAM1614 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1614 folded precursor RNA into VGAM1614 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM1614 RNA is designated SEQ ID:4325, and is provided hereinbelow with reference to the sequence listing part.

VGAM1614 host target gene, herein designated VGAM HOST TARGET GENE, encodes a corresponding messenger RNA, VGAM1614 host target RNA, herein designated VGAM HOST TARGET RNA. VGAM1614 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1614 RNA, herein designated VGAM RNA, binds complementarily to one or more host target binding sites located in untranslated regions of VGAM1614 host target RNA, herein designated VGAM HOST TARGET RNA. This complementary binding is due to the fact that the nucleotide sequence of VGAM1614 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1614 RNA, herein designated VGAM RNA, may have a different number of host target binding sites in untranslated regions of a VGAM1614 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1614 RNA, herein designated VGAM RNA, to host target binding sites on VGAM1614 host target RNA, herein designated VGAM HOST TARGET RNA, such as BINDING SITE I, BINDING SITE II and BINDING SITE III, inhibits translation of VGAM1614 host target RNA into VGAM1614 host target protein, herein designated VGAM HOST TARGET PROTEIN. VGAM host target protein is therefore outlined by a broken line.

It is appreciated that VGAM1614 host target gene, herein designated VGAM HOST TARGET GENE, in fact represents a plurality of VGAM1614 host target genes. The mRNA of each one of this plurality of VGAM1614 host target genes comprises one or more host target binding sites, each having a nucleotide sequence which is at least partly complementary to VGAM1614 RNA, herein designated VGAM RNA, and which when bound by VGAM1614 RNA causes inhibition of translation of respective one or more VGAM1614 host target proteins.

It is further appreciated by one skilled in the art that the mode of translational inhibition illustrated by FIG. 1 with specific reference to translational inhibition exerted by VGAM1614 gene, herein designated VGAM GENE, on one or more VGAM1614 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1614 is inhibition of expression of host target genes, as part of a novel viral mechanism of attacking a host. Accordingly, utilities of VGAM1614 include diagnosis, prevention and treatment of viral infection by Chimpanzee Cytomegalovirus. Specific functions, and accordingly utilities, of VGAM1614 correlate with, and may be deduced from, the identity of the host target genes which VGAM1614 binds and inhibits, and the function of these host target genes, as elaborated hereinbelow.

Nucleotide sequences of the VGAM1614 precursor RNA, herein designated VGAM PRECURSOR RNA, and of the 'diced' VGAM1614 RNA, herein designated VGAM RNA, and a schematic representation of the secondary folding of VGAM1614 folded precursor RNA, herein designated VGAM FOLDED PRECURSOR RNA, of VGAM1614 are further described hereinbelow with reference to Table 1.

Nucleotide sequences of host target binding sites, such as BINDING SITE-I, BINDING SITE-II and BINDING SITE-III of FIG. 1, found on VGAM1614 host target RNA, and schematic representation of the complementarity of each of these host target binding sites to VGAM1614 RNA, herein designated VGAM RNA, are described hereinbelow with reference to Table 2.

As mentioned hereinabove with reference to FIG. 1, a function of VGAM1614 gene, herein designated VGAM is inhibition of expression of VGAM1614 target genes. It is appreciated that specific functions, and accordingly utilities, of VGAM1614 correlate with, and may be deduced from, the identity of the target genes which VGAM1614 binds and inhibits, and the function of these target genes, as elaborated hereinbelow.

ATPase, Class I, Type 8B, Member 2 (ATP8B2, Accession XM_036933) is a VGAM1614 host target gene. ATP8B2 BINDING SITE is HOST TARGET binding site found in the 5' untranslated region of mRNA encoded by ATP8B2, corresponding to a HOST TARGET binding site such as BINDING SITE I, BINDING SITE II or BINDING SITE III. Table 2 illustrates the complementarity of the nucleotide sequences of ATP8B2 BINDING SITE, designated SEQ ID:32514, to the nucleotide sequence of VGAM1614 RNA, herein designated VGAM RNA, also designated SEQ ID:4325.

A function of VGAM1614 is therefore inhibition of ATPase, Class I, Type 8B, Member 2 (ATP8B2, Accession XM_036933). Accordingly, utilities of VGAM1614 include diagnosis, prevention and treatment of diseases and clinical conditions associated with ATP8B2. PRV1 (Accession XM_056490) is another VGAM1614 host target gene. PRV1 BINDING SITE is HOST TARGET binding site found in the 3' untranslated region of mRNA encoded by PRV1, corresponding to a HOST TARGET binding site such as BINDING SITE I, BINDING SITE II or BINDING SITE III. Table 2 illustrates the complementarity of the nucleotide sequences of PRV1 BINDING SITE, designated SEQ ID:36398, to the nucleotide sequence of VGAM1614 RNA, herein designated VGAM RNA, also designated SEQ ID:4325.

Another function of VGAM1614 is therefore inhibition of PRV1 (Accession XM_056490), a gene which may function as a hematopoietic receptor. Accordingly, utilities of VGAM1614 include diagnosis, prevention and treatment of diseases and clinical conditions associated with PRV1. The function of PRV1 and its association with various diseases and clinical conditions, has been established by previous studies, as described hereinabove with reference to VGAM778. C1q and Tumor Necrosis Factor Related Protein 6 (C1QTNF6, Accession NM_031910) is another VGAM1614 host target gene. C1QTNF6 BINDING SITE is HOST TARGET binding site found in the 3" untranslated region of mRNA encoded by C1QTNF6, corresponding to a HOST TARGET binding site such as BINDING SITE I, BINDING SITE II or BINDING SITE III. Table 2 illustrates the complementarity of the nucleotide sequences of C1QTNF6 BINDING SITE, designated SEQ ID:25657, to the nucleotide sequence of VGAM1614 RNA, herein designated VGAM RNA, also designated SEQ ID:4325.

Another function of VGAM1614 is therefore inhibition of C1q and Tumor Necrosis Factor Related Protein 6 (C1QTNF6, Accession NM_031910). Accordingly, utilities of VGAM1614 include diagnosis, prevention and treatment of diseases and clinical conditions associated with C1QTNF6. FLJ10726 (Accession NM_018195) is another VGAM1614 host target gene. FLJ10726 BINDING SITE is HOST TARGET binding site found in the 3' untranslated region of mRNA encoded by FLJ10726, corresponding to a HOST TARGET binding site such as BINDING SITE I, BINDING SITE II or BINDING SITE III. Table 2 illustrates the complementarity of the nucleotide sequences of FLJ10726 BINDING SITE, designated SEQ ID:20057, to the nucleotide sequence of VGAM1614 RNA, herein designated VGAM RNA, also designated SEQ ID:4325.

Another function of VGAM1614 is therefore inhibition of FLJ10726 (Accession NM_018195). Accordingly, utilities of VGAM1614 include diagnosis, prevention and treatment of diseases and clinical conditions associated with FLJ10726. LOC145854 (Accession XM_085259) is another VGAM1614 host target gene. LOC145854 BINDING SITE is HOST TARGET binding site found in the 3' untranslated region of mRNA encoded by LOC145854, corresponding to a HOST TARGET binding site such as BINDING SITE I, BINDING SITE II or BINDING SITE III. Table 2 illustrates the complementarity of the nucleotide sequences of LOC145854 BINDING SITE, designated SEQ ID:38007, to the nucleotide sequence of VGAM1614 RNA, herein designated VGAM RNA, also designated SEQ ID:4325.

Another function of VGAM1614 is therefore inhibition of LOC145854 (Accession XM_085259). Accordingly, utilities of VGAM1614 include diagnosis, prevention and treatment of diseases and clinical conditions associated with LOC145854. LOC157273 (Accession XM_098743) is another VGAM1614 host target gene. LOC157273 BINDING SITE is HOST TARGET binding site found in the 3' untranslated region of mRNA encoded by LOC157273, corresponding to a HOST TARGET binding site such as BINDING SITE I, BINDING SITE II or BINDING SITE III. Table 2 illustrates the complementarity of the nucleotide sequences of LOC157273 BINDING SITE, designated SEQ ID:41783, to the nucleotide sequence of VGAM1614 RNA, herein designated VGAM RNA, also designated SEQ ID:4325.

Another function of VGAM1614 is therefore inhibition of LOC157273 (Accession XM_098743). Accordingly, utilities of VGAM1614 include diagnosis, prevention and treatment of diseases and clinical conditions associated with LOC157273. FIG. 1 further provides a conceptual description of a novel bioinformatically detected viral gene of the present invention, referred to here as Viral Genomic Address Messenger 1615 (VGAM1615) viral gene, which modulates expression of respective host target genes thereof, the function and utility of which host target genes is known in the art.

VGAM1615 is a novel bioinformatically detected regulatory, non protein coding, viral micro RNA (miRNA) gene. The method by which VGAM1615 was detected is described hereinabove with reference to FIGS. 1-8.

VGAM1615 gene, herein designated VGAM GENE, is a viral gene contained in the genome of Chimpanzee Cytomegalovirus. VGAM1615 host target gene, herein designated VGAM HOST TARGET GENE, is a human gene contained in the human genome.

VGAM1615 gene encodes a VGAM1615 precursor RNA, herein designated VGAM PRECURSOR RNA. Similar to other miRNA genes, and unlike most ordinary genes, VGAM1615 precursor RNA does not encode a protein. A nucleotide sequence identical or highly similar to the nucleotide sequence of VGAM1615 precursor RNA is designated SEQ ID:1601, and is provided hereinbelow with reference to the sequence listing part. Nucleotide sequence SEQ ID:1601 is located at position 1492 relative to the genome of Chimpanzee Cytomegalovirus.

VGAM1615 precursor RNA folds onto itself, forming VGAM1615 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1615 folded precursor RNA into VGAM1615 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1615 RNA is designated SEQ ID:4326, and is provided hereinbelow with reference to the sequence listing part.

VGAM1615 host target gene, herein designated VGAM HOST TARGET GENE, encodes a corresponding messenger RNA, VGAM1615 host target RNA, herein designated VGAM HOST TARGET RNA. VGAM1615 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1615 RNA, herein designated VGAM RNA, binds complementarily to one or more host target binding sites located in untranslated regions of VGAM1615 host target RNA, herein designated VGAM HOST TARGET RNA. This complementary binding is due to the fact that the nucleotide sequence of VGAM1615 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1615 RNA, herein designated VGAM RNA, may have a different number of host target binding sites in untranslated regions of a VGAM1615 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1615 RNA, herein designated VGAM RNA, to host target binding sites on VGAM1615 host target RNA, herein designated VGAM HOST TARGET RNA, such as BINDING SITE I, BINDING SITE II and BINDING SITE III, inhibits translation of VGAM1615 host target RNA into VGAM1615 host target protein, herein designated VGAM HOST TARGET PROTEIN. VGAM host target protein is therefore outlined by a broken line.

It is appreciated that VGAM1615 host target gene, herein designated VGAM HOST TARGET GENE, in fact represents a plurality of VGAM1615 host target genes. The mRNA of each one of this plurality of VGAM1615 host target genes comprises one or more host target binding sites, each having a nucleotide sequence which is at least partly complementary to VGAM1615 RNA, herein designated VGAM RNA, and which when bound by VGAM1615 RNA causes inhibition of translation of respective one or more VGAM1615 host target proteins.

It is further appreciated by one skilled in the art that the mode of translational inhibition illustrated by FIG. 1 with specific reference to translational inhibition exerted by VGAM1615 gene, herein designated VGAM GENE, on one or more VGAM1615 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1615 is inhibition of expression of host target genes, as part of a novel viral mechanism of attacking a host. Accordingly, utilities of VGAM1615 include diagnosis, prevention and treatment of viral infection by Chimpanzee Cytomegalovirus. Specific functions, and accordingly utilities, of VGAM1615 correlate with, and may be deduced from, the identity of the host target genes which VGAM1615 binds and inhibits, and the function of these host target genes, as elaborated hereinbelow.

Nucleotide sequences of the VGAM1615 precursor RNA, herein designated VGAM PRECURSOR RNA, and of the 'diced' VGAM1615 RNA, herein designated VGAM RNA, and a schematic representation of the secondary folding of VGAM1615 folded precursor RNA, herein designated VGAM FOLDED PRECURSOR RNA, of VGAM1615 are further described hereinbelow with reference to Table 1.

Nucleotide sequences of host target binding sites, such as BINDING SITE-I, BINDING SITE-II and BINDING SITE-III of FIG. 1, found on VGAM1615 host target RNA, and schematic representation of the complementarity of each of these host target binding sites to VGAM1615 RNA, herein designated VGAM RNA, are described hereinbelow with reference to Table 2.

As mentioned hereinabove with reference to FIG. 1, a function of VGAM1615 gene, herein designated VGAM is inhibition of expression of VGAM1615 target genes. It is appreciated that specific functions, and accordingly utilities, of VGAM1615 correlate with, and may be deduced from, the identity of the target genes which VGAM1615 binds and inhibits, and the function of these target genes, as elaborated hereinbelow.

Bone Morphogenetic Protein 6 (BMP6, Accession NM_001718) is a VGAM1615 host target gene. BMP6 BINDING SITE is HOST TARGET binding site found in the 5' untranslated region of mRNA encoded by BMP6, corresponding to a HOST TARGET binding site such as BINDING SITE I, BINDING SITE II or BINDING SITE III. Table 2 illustrates the complementarity of the nucleotide sequences of BMP6 BINDING SITE, designated SEQ ID:7453, to the nucleotide sequence of VGAM1615 RNA, herein designated VGAM RNA, also designated SEQ ID:4326.

A function of VGAM1615 is therefore inhibition of Bone Morphogenetic Protein 6 (BMP6, Accession NM_001718), a gene which induces cartilage and bone formation. Accordingly, utilities of VGAM1615 include diagnosis, prevention and treatment of diseases and clinical conditions associated with BMP6. The function of BMP6 and its association with various diseases and clinical conditions, has been established by previous studies, as described hereinabove with reference to VGAM233. Cold Shock Domain Protein A (CSDA, Accession NM_003651) is another VGAM1615 host target gene. CSDA BINDING SITE is HOST TARGET binding site found in the 5' untranslated region of mRNA encoded by CSDA, corresponding to a HOST TARGET binding site such as BINDING SITE I, BINDING SITE II or BINDING SITE III. Table 2 illustrates the complementarity of the nucleotide sequences of CSDA BINDING SITE, designated SEQ ID:9727, to the nucleotide sequence of VGAM1615 RNA, herein designated VGAM RNA, also designated SEQ ID:4326.

Another function of VGAM1615 is therefore inhibition of Cold Shock Domain Protein A (CSDA, Accession NM_003651), a gene which binds to the gm-csf promoter and seems to act as a repressor. Accordingly, utilities of VGAM1615 include diagnosis, prevention and treatment of diseases and clinical conditions associated with CSDA. The function of CSDA has been established by previous studies. To identify cDNAs encoding DNA-binding proteins (DBPs), Sakura et al. (1988) screened a human placenta cDNA expression library with DNA fragments containing either the human epidermal growth factor receptor (EGFR; 131550) enhancer or the human c-erbB2 (OMIM Ref. No. 164870) promoter. They isolated cDNAs encoding DBPA and DBPB (OMIM Ref. No. 154030). The DBPA cDNAs consisted of 2 forms that differ by an internal 207-bp deletion. Northern blot analysis of HeLa cell RNA detected a major 2.5-kb DBPA transcript and a minor 2.3-kb DBPA transcript. The deduced DBPA and DBPB proteins share a central region in which 100 of 109 amino acids are identical between the 2 proteins. Kudo et al. (1995) isolated full-length human cDNAs encoding DBPA and DBPB by screening for proteins that bind to the human leukosialin (OMIM Ref. No. 182160) promoter. The deduced 342-amino acid DBPA protein has a cold-shock domain and a DNA-binding domain. The authors isolated the DBPA genomic sequence and found that it contains 10 exons spanning 24 kb; exon 6, which encodes 69 amino acids, is alternatively spliced. Northern blot analysis of human tissues demonstrated highest levels of DBPA transcription in skeletal muscle and heart. Immunofluorescence detected DBPA protein expression in both the cytoplasm and nucleus of HeLa cells Full details of the abovementioned studies are described in the following publications, the disclosure of which are hereby incorporated by reference:

Sakura, H.; Maekawa, T.; Imamoto, F.; Yasuda, K.; Ishii, S.: Two human genes isolated by a novel method encode DNA-binding proteins containing a common region of homology. Gene 73:499-507, 1988; and Kudo, S.; Mattei, M.-G.; Fukuda, M.: Characterization of the gene for dbpA, a family member of the nucleic-acid-binding proteins containing a cold-shock domain. Europ. J. Biochem. 231.

Further studies establishing the function and utilities of CSDA are found in John Hopkins OMIM database record ID 603437, and in sited publications numbered 3794-3796 listed in the bibliography section hereinbelow, which are also hereby incorporated by reference. Engrailed Homolog 1 (EN1, Accession NM_001426) is another VGAM1615 host target gene. EN1 BINDING SITE is HOST TARGET binding site found in the 3' untranslated region of mRNA encoded by EN1, corresponding to a HOST TARGET binding site such as BINDING SITE I, BINDING SITE II or BINDING SITE III. Table 2 illustrates the complementarity of the nucleotide sequences of EN1 BINDING SITE, designated SEQ ID:7141, to the nucleotide sequence of VGAM1615 RNA, herein designated VGAM RNA, also designated SEQ ID:4326.

Another function of VGAM1615 is therefore inhibition of Engrailed Homolog 1 (EN1, Accession NM_001426), a gene which is a member of the homeodomain family of DNA binding proteins; may regulate gene expression, morphogenesis, and differentiation;. Accordingly, utilities of VGAM1615 include diagnosis, prevention and treatment of diseases and clinical conditions associated with EN1. The function of EN1 has been established by previous studies. In Drosophila, the 'engrailed' (en) gene plays an important role during development in segmentation, where it is required for the formation of posterior compartments. Expression studies have suggested that en may also function early in organizing the preblastoderm and later in neurogenesis (Logan et al., 1992). En encodes a homeodomain-containing protein that can function as a transcription factor. Logan et al. (1989) isolated the human homologs of the mouse homeo box-containing genes En1 and En2 (OMIM Ref. No. 131310), which show homology to the Drosophila en gene. Logan et al. (1992) isolated human and chicken genomic clones of the EN1 and EN2 genes. As in mouse, the predicted coding region of the human and chicken EN1 genes is interrupted by a single intron. The deduced 392-amino acid human EN1 protein is 95% identical to mouse En1. By sequence analysis, the authors determined that En proteins from various species contain 5 distinct conserved subregions. The related mouse genes En1 and En2 are expressed from the 1- and approximately 5-somite stages, respectively, in a similar presumptive midhindbrain domain. However, mutations in En1 and En2 produced different phenotypes: En1 mutant mice die at birth with a large midhindbrain deletion, whereas En2 mutants survive with cerebellar defects. To determine whether these contrasting phenotypes reflect differences in temporal expression or biochemical activity of the En proteins, Hanks et al. (1995) replaced En1 coding sequences with En2 sequences in transgenic mice by gene targeting. The En2 sequences rescued all En1 mutant defects, demonstrating that the difference between En1 and En2 stems from their divergent expression patterns. Wurst et al. (1994) generated mice homozygous for a targeted deletion of the En1 homeobox. En1 mutant mice died shortly after birth and exhibited multiple developmental defects. The pattern of defects suggested a cell-autonomous role for En1 in generation and/or survival of midhindbrain precursor cells and also a non-cell-autonomous role in signaling normal development of the limbs and possibly sternum. Loomis et al. (1996) analyzed the effects of an induced null mutation in the mouse engrailed-1 gene on ventral limb patterning. That the gene is essential was indicated by the finding that the null mice showed dorsal transformations of ventral paw structures, as well as subtle alterations along the proximal-distal limb axis. For a review of the role of this gene in limb development, see Johnson and Tabin (1997). Martin et al. (1990) mapped the En1 gene to mouse chromosome 1, approximately 0.28 cM distal to the 'dominant hemimelia' (Dh) gene, and the En2 gene to mouse chromosome 5, approximately 1.1 cM proximal to the 'hemimelic extra-toes' (Hx) gene. They excluded both of these genes as the site of the mutations responsible for Dh and Hx. They suggested that En1/Dh and En2/Hx represent paralogous linkage groups that evolved following duplication of a common ancestral chromosome segment. By Southern analysis of mouse-human somatic cell hybrids, Logan et al. (1989) mapped the human EN1 gene to chromosome 2. Using a mapping panel of rodent/human cell hybrids containing different regions of chromosome 2 and a lymphoblastoid cell line with an interstitial deletion, del (2)(q21-q23.2), Kohler et al. (1993) refined the regional assignment of EN1 to 2q13-q21. They stated that this increased to 22 the number of known genes on 2q that have homologs in the proximal region of mouse chromosome 1. By fluorescence in situ hybridization, Matsui et al. (1993) further refined the EN1 gene map position to 2q14.

Full details of the abovementioned studies are described in the following publications, the disclosure of which are hereby incorporated by reference:

Hanks, M.; Wurst, W.; Anson-Cartwright, L.; Auerbach, A. B.; Joyner, A. L.: Rescue of the En-1 mutant phenotype by replacement of En-1 with En-2. Science 269:679-682, 1995; and Johnson, R. L.; Tabin, C. J.: Molecular models for vertebrate limb development. Cell 90:979-990, 1997.

Further studies establishing the function and utilities of EN1 are found in John Hopkins OMIM database record ID 131290, and in sited publications numbered 2603-2611 listed in the bibliography section hereinbelow, which are also hereby incorporated by reference. Forkhead Box E1 (thyroid transcription factor 2) (FOXE1, Accession NM_004473) is another VGAM1615 host target gene. FOXE1 BINDING SITE is HOST TARGET binding site found in the 5' untranslated region of mRNA encoded by FOXE1, corresponding to a HOST TARGET binding site such as BINDING SITE I, BINDING SITE II or BINDING SITE III. Table 2 illustrates the complementarity of the nucleotide sequences of FOXE1 BINDING SITE, designated SEQ ID:10781, to the nucleotide sequence of VGAM1615 RNA, herein designated VGAM RNA, also designated SEQ ID:4326.

Another function of VGAM1615 is therefore inhibition of Forkhead Box E1 (thyroid transcription factor 2) (FOXE1, Accession NM_004473). Accordingly, utilities of VGAM1615 include diagnosis, prevention and treatment of diseases and clinical conditions associated with FOXE1. Regulatory Factor X, 2 (influences HLA class II expression) (RFX2, Accession NM_000635) is another VGAM1615 host target gene. RFX2 BINDING SITE is HOST TARGET binding site found in the 5' untranslated region of mRNA encoded by RFX2, corresponding to a HOST TARGET binding site such as BINDING SITE I, BINDING SITE II or BINDING SITE III. Table 2 illustrates the complementarity of the nucleotide sequences of RFX2 BINDING SITE, designated SEQ ID:6271, to the nucleotide sequence of VGAM1615 RNA, herein designated VGAM RNA, also designated SEQ ID:4326.

Another function of VGAM1615 is therefore inhibition of Regulatory Factor X, 2 (influences HLA class II expression) (RFX2, Accession NM_000635), a gene which acts as a dimer to regulate the expression of many genes. Accordingly, utilities of VGAM1615 include diagnosis, prevention and treatment of diseases and clinical conditions associated with RFX2. The function of RFX2 and its association with various diseases and clinical conditions, has been established by previous studies, as described hereinabove with reference to VGAM622. RAR-related Orphan Receptor B (RORB, Accession NM_006914) is another VGAM1615 host target gene. RORB BINDING SITE is HOST TARGET binding site found in the 3' untranslated region of mRNA encoded by RORB, corresponding to a HOST TARGET binding site such as BINDING SITE I, BINDING SITE II or BINDING SITE III. Table 2 illustrates the complementarity of the nucleotide sequences of RORB BINDING SITE, designated SEQ ID:13786, to the nucleotide sequence of VGAM1615 RNA, herein designated VGAM RNA, also designated SEQ ID:4326.

Another function of VGAM1615 is therefore inhibition of RAR-related Orphan Receptor B (RORB, Accession NM_006914), a gene which is an orphan nuclear receptor. Accordingly, utilities of VGAM1615 include diagnosis, prevention and treatment of diseases and clinical conditions associated with RORB. The function of RORB and its association with various diseases and clinical conditions, has been established by previous studies, as described hereinabove with reference to VGAM178. Sodium Channel, Voltage-gated, Type I, Alpha Polypeptide (SCN1A, Accession XM_114281) is another VGAM1615 host target gene. SCN1A BINDING SITE is HOST TARGET binding site found in the 3' untranslated region of mRNA encoded by SCN1A, corresponding to a HOST TARGET binding site such as BINDING SITE I, BINDING SITE II or BINDING SITE III. Table 2 illustrates the complementarity of the nucleotide sequences of SCN1A BINDING SITE, designated SEQ ID:42833, to the nucleotide sequence of VGAM1615 RNA, herein designated VGAM RNA, also designated SEQ ID:4326.

Another function of VGAM1615 is therefore inhibition of Sodium Channel, Voltage-gated, Type I, Alpha Polypeptide (SCN1A, Accession XM_114281). Accordingly, utilities of VGAM1615 include diagnosis, prevention and treatment of diseases and clinical conditions associated with SCN1A. Cyclin I (CCNI, Accession NM_006835) is another VGAM1615 host target gene. CCNI BINDING SITE is HOST TARGET binding site found in the 5' untranslated region of mRNA encoded by CCNI, corresponding to a HOST TARGET binding site such as BINDING SITE I, BINDING SITE II or BINDING SITE III. Table 2 illustrates the complementarity of the nucleotide sequences of CCNI BINDING SITE, designated SEQ ID:13713, to the nucleotide sequence of VGAM1615 RNA, herein designated VGAM RNA, also designated SEQ ID:4326.

Another function of VGAM1615 is therefore inhibition of Cyclin I (CCNI, Accession NM_006835). Accordingly, utilities of VGAM1615 include diagnosis, prevention and treatment of diseases and clinical conditions associated with CCNI. FLJ10099 (Accession NM_017994) is another VGAM1615 host target gene. FLJ10099 BINDING SITE is HOST TARGET binding site found in the 5' untranslated region of mRNA encoded by FLJ10099, corresponding to a HOST TARGET binding site such as BINDING SITE I, BINDING SITE II or BINDING SITE III. Table 2 illustrates the complementarity of the nucleotide sequences of FLJ10099 BINDING SITE, designated SEQ ID:19725, to the nucleotide sequence of VGAM1615 RNA, herein designated VGAM RNA, also designated SEQ ID:4326.

Another function of VGAM1615 is therefore inhibition of FLJ10099 (Accession NM_017994). Accordingly, utilities of VGAM1615 include diagnosis, prevention and treatment of diseases and clinical conditions associated with FLJ10099. FLJ10350 (Accession XM_170946) is another VGAM1615 host target gene. FLJ10350 BINDING SITE is HOST TARGET binding site found in the 5' untranslated region of mRNA encoded by FLJ10350, corresponding to a HOST TARGET binding site such as BINDING SITE I, BINDING SITE II or BINDING SITE III. Table 2 illustrates the complementarity of the nucleotide sequences of FLJ10350 BINDING SITE, designated SEQ ID:45730, to the nucleotide sequence of VGAM1615 RNA, herein designated VGAM RNA, also designated SEQ ID:4326.

Another function of VGAM1615 is therefore inhibition of FLJ10350 (Accession XM_170946). Accordingly, utilities of VGAM1615 include diagnosis, prevention and treatment of diseases and clinical conditions associated with FLJ10350. FLJ10846 (Accession NM_018241) is another VGAM1615 host target gene. FLJ10846 BINDING SITE is HOST TARGET binding site found in the 5' untranslated region of mRNA encoded by FLJ10846, corresponding to a HOST TARGET binding site such as BINDING SITE I, BINDING SITE II or BINDING SITE III. Table 2 illustrates the complementarity of the nucleotide sequences of FLJ10846 BINDING SITE, designated SEQ ID:20198, to the nucleotide sequence of VGAM1615 RNA, herein designated VGAM RNA, also designated SEQ ID:4326.

Another function of VGAM1615 is therefore inhibition of FLJ10846 (Accession NM_018241). Accordingly, utilities of VGAM1615 include diagnosis, prevention and treatment of diseases and clinical conditions associated with FLJ10846. KIAA1655 (Accession XM_039442) is another VGAM1615 host target gene. KIAA1655 BINDING SITE is HOST TARGET binding site found in the 5' untranslated region of mRNA encoded by KIAA1655, corresponding to a HOST TARGET binding site such as BINDING SITE I, BINDING SITE II or BINDING SITE III. Table 2 illustrates the complementarity of the nucleotide sequences of KIAA1655 BINDING SITE, designated SEQ ID:33086, to the nucleotide sequence of VGAM1615 RNA, herein designated VGAM RNA, also designated SEQ ID:4326.

Another function of VGAM1615 is therefore inhibition of KIAA1655 (Accession XM_039442). Accordingly, utilities of VGAM1615 include diagnosis, prevention and treatment of diseases and clinical conditions associated with KIAA1655. MAGE-E1 (Accession NM_030801) is another VGAM1615 host target gene. MAGE-E1 BINDING SITE is HOST TARGET binding site found in the 3' untranslated region of mRNA encoded by MAGE-E1, corresponding to a HOST TARGET binding site such as BINDING SITE I, BINDING SITE II or BINDING SITE III. Table 2 illustrates the complementarity of the nucleotide sequences of MAGE-E1 BINDING SITE, designated SEQ ID:25105, to the nucleotide sequence of VGAM1615 RNA, herein designated VGAM RNA, also designated SEQ ID:4326.

Another function of VGAM1615 is therefore inhibition of MAGE-E1 (Accession NM_030801). Accordingly, utilities of VGAM1615 include diagnosis, prevention and treatment of diseases and clinical conditions associated with MAGE-E1. MGC15631 (Accession NM_032753) is another VGAM1615 host target gene. MGC15631 BINDING SITE is HOST TARGET binding site found in the 3' untranslated region of mRNA encoded by MGC15631, corresponding to a HOST TARGET binding site such as BINDING SITE I, BINDING SITE II or BINDING SITE III. Table 2 illustrates the complementarity of the nucleotide sequences of MGC15631 BINDING SITE, designated SEQ ID:26492, to the nucleotide sequence of VGAM1615 RNA, herein designated VGAM RNA, also designated SEQ ID:4326.

Another function of VGAM1615 is therefore inhibition of MGC15631 (Accession NM_032753). Accordingly, utilities of VGAM1615 include diagnosis, prevention and treatment of diseases and clinical conditions associated with MGC15631. LOC143920 (Accession XM_084658) is another VGAM1615 host target gene. LOC143920 BINDING SITE is HOST TARGET binding site found in the 3' untranslated region of mRNA encoded by LOC143920, corresponding to a HOST TARGET binding site such as BINDING SITE I, BINDING SITE II or BINDING SITE III. Table 2 illustrates the complementarity of the nucleotide sequences of LOC143920 BINDING SITE, designated SEQ ID:37640, to the nucleotide sequence of VGAM1615 RNA, herein designated VGAM RNA, also designated SEQ ID:4326.

Another function of VGAM1615 is therefore inhibition of LOC143920 (Accession XM_084658). Accordingly, utilities of VGAM1615 include diagnosis, prevention and treatment of diseases and clinical conditions associated with LOC143920. LOC164397 (Accession XM_092780) is another VGAM1615 host target gene. LOC164397 BINDING SITE is HOST TARGET binding site found in the 5' untranslated region of mRNA encoded by LOC164397, corresponding to a HOST TARGET binding site such as BINDING SITE I, BINDING SITE II or BINDING SITE III. Table 2 illustrates the complementarity of the nucleotide sequences of LOC164397 BINDING SITE, designated SEQ ID:40151, to the nucleotide sequence of VGAM1615 RNA, herein designated VGAM RNA, also designated SEQ ID:4326.

Another function of VGAM1615 is therefore inhibition of LOC164397 (Accession XM_092780). Accordingly, utilities of VGAM1615 include diagnosis, prevention and treatment of diseases and clinical conditions associated with LOC164397. LOC220549 (Accession XM_167521) is another VGAM1615 host target gene. LOC220549 BINDING SITE is HOST TARGET binding site found in the 5' untranslated region of mRNA encoded by LOC220549, corresponding to a HOST TARGET binding site such as BINDING SITE I, BINDING SITE II or BINDING SITE III. Table 2 illustrates the complementarity of the nucleotide sequences of LOC220549 BINDING SITE, designated SEQ ID:44650, to the nucleotide sequence of VGAM1615 RNA, herein designated VGAM RNA, also designated SEQ ID:4326.

Another function of VGAM1615 is therefore inhibition of LOC220549 (Accession XM_167521). Accordingly, utilities of VGAM1615 include diagnosis, prevention and treatment of diseases and clinical conditions associated with LOC220549. LOC220558 (Accession XM_165930) is another VGAM1615 host target gene. LOC220558 BINDING SITE is HOST TARGET binding site found in the 5' untranslated region of mRNA encoded by LOC220558, corresponding to a HOST TARGET binding site such as BINDING SITE I, BINDING SITE II or BINDING SITE III. Table 2 illustrates the complementarity of the nucleotide sequences of LOC220558 BINDING SITE, designated SEQ ID:43805, to the nucleotide sequence of VGAM1615 RNA, herein designated VGAM RNA, also designated SEQ ID:4326.

Another function of VGAM1615 is therefore inhibition of LOC220558 (Accession XM_165930). Accordingly, utilities of VGAM1615 include diagnosis, prevention and treatment of diseases and clinical conditions associated with LOC220558. FIG. 1 further provides a conceptual description of a novel bioinformatically detected viral gene of the present invention, referred to here as Viral Genomic Address Messenger 1616 (VGAM1616) viral gene, which modulates expression of respective host target genes thereof, the function and utility of which host target genes is known in the art.

VGAM1616 is a novel bioinformatically detected regulatory, non protein coding, viral micro RNA (miRNA) gene. The method by which VGAM1616 was detected is described hereinabove with reference to FIGS. 1-8.

VGAM1616 gene, herein designated VGAM GENE, is a viral gene contained in the genome of Chimpanzee Cytomegalovirus. VGAM1616 host target gene, herein designated VGAM HOST TARGET GENE, is a human gene contained in the human genome.

VGAM1616 gene encodes a VGAM1616 precursor RNA, herein designated VGAM PRECURSOR RNA. Similar to other miRNA genes, and unlike most ordinary genes, VGAM1616 precursor RNA does not encode a protein. A nucleotide sequence identical or highly similar to the nucleotide sequence of VGAM1616 precursor RNA is designated SEQ ID:1602, and is provided hereinbelow with reference to the sequence listing part. Nucleotide sequence SEQ ID:1602 is located at position 2891 relative to the genome of Chimpanzee Cytomegalovirus.

VGAM1616 precursor RNA folds onto itself, forming VGAM1616 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1616 folded precursor RNA into VGAM1616 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 40%) nucleotide sequence of VGAM1616 RNA is designated SEQ ID:4327, and is provided hereinbelow with reference to the sequence listing part.

VGAM1616 host target gene, herein designated VGAM HOST TARGET GENE, encodes a corresponding messenger RNA, VGAM1616 host target RNA, herein designated VGAM HOST TARGET RNA. VGAM1616 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1616 RNA, herein designated VGAM RNA, binds complementarily to one or more host target binding sites located in untranslated regions of VGAM1616 host target RNA, herein designated VGAM HOST TARGET RNA. This complementary binding is due to the fact that the nucleotide sequence of VGAM1616 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1616 RNA, herein designated VGAM RNA, may have a different number of host target binding sites in untranslated regions of a VGAM1616 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1616 RNA, herein designated VGAM RNA, to host target binding sites on VGAM1616 host target RNA, herein designated VGAM HOST TARGET RNA, such as BINDING SITE I, BINDING SITE II and BINDING SITE III, inhibits translation of VGAM1616 host target RNA into VGAM1616 host target protein, herein designated VGAM HOST TARGET PROTEIN. VGAM host target protein is therefore outlined by a broken line.

It is appreciated that VGAM1616 host target gene, herein designated VGAM HOST TARGET GENE, in fact represents a plurality of VGAM1616 host target genes. The mRNA of each one of this plurality of VGAM1616 host target genes comprises one or more host target binding sites, each having a nucleotide sequence which is at least partly complementary to VGAM1616 RNA, herein designated VGAM RNA, and which when bound by VGAM1616 RNA causes inhibition of translation of respective one or more VGAM1616 host target proteins.

It is further appreciated by one skilled in the art that the mode of translational inhibition illustrated by FIG. 1 with specific reference to translational inhibition exerted by VGAM1616 gene, herein designated VGAM GENE, on one or more VGAM1616 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1616 is inhibition of expression of host target genes, as part of a novel viral mechanism of attacking a host. Accordingly, utilities of VGAM1616 include diagnosis, prevention and treatment of viral infection by Chimpanzee Cytomegalovirus. Specific functions, and accordingly utilities, of VGAM1616 correlate with, and may be deduced from, the identity of the host target genes which VGAM1616 binds and inhibits, and the function of these host target genes, as elaborated hereinbelow.

Nucleotide sequences of the VGAM1616 precursor RNA, herein designated VGAM PRECURSOR RNA, and of the 'diced' VGAM1616 RNA, herein designated VGAM RNA, and a schematic representation of the secondary folding of VGAM1616 folded precursor RNA, herein designated VGAM FOLDED PRECURSOR RNA, of VGAM1616 are further described hereinbelow with reference to Table 1.

Nucleotide sequences of host target binding sites, such as BINDING SITE-I, BINDING SITE-II and BINDING SITE-III of FIG. 1, found on VGAM1616 host target RNA, and schematic representation of the complementarity of each of these host target binding sites to VGAM1616 RNA, herein designated VGAM RNA, are described hereinbelow with reference to Table 2.

As mentioned hereinabove with reference to FIG. 1, a function of VGAM1616 gene, herein designated VGAM is inhibition of expression of VGAM1616 target genes. It is appreciated that specific functions, and accordingly utilities, of VGAM1616 correlate with, and may be deduced from, the identity of the target genes which VGAM1616 binds and inhibits, and the function of these target genes, as elaborated hereinbelow.

A Kinase (PRKA) Anchor Protein 2 (AKAP2, Accession NM_007203) is a VGAM1616 host target gene. AKAP2 BINDING SITE is HOST TARGET binding site found in the 3' untranslated region of mRNA encoded by AKAP2, corresponding to a HOST TARGET binding site such as BINDING SITE I, BINDING SITE II or BINDING SITE III. Table 2 illustrates the complementarity of the nucleotide sequences of AKAP2 BINDING SITE, designated SEQ ID:14057, to the nucleotide sequence of VGAM1616 RNA, herein designated VGAM RNA, also designated SEQ ID:4327.

A function of VGAM1616 is therefore inhibition of A Kinase (PRKA) Anchor Protein 2 (AKAP2, Accession NM_007203), a gene which binds to regulatory subunit (rii) of protein kinase a. Accordingly, utilities of VGAM1616 include diagnosis, prevention and treatment of diseases and clinical conditions associated with AKAP2. The function of AKAP2 and its association with various diseases and clinical conditions, has been established by previous studies, as described hereinabove with reference to VGAM18. Growth Hormone Receptor (GHR, Accession NM_000163) is another VGAM1616 host target gene. GHR BINDING SITE is HOST TARGET binding site found in the 3' untranslated region of mRNA encoded by GHR, corresponding to a HOST TARGET binding site such as BINDING SITE I, BINDING SITE II or BINDING SITE III. Table 2 illustrates the complementarity of the nucleotide sequences of GHR BINDING SITE, designated SEQ ID:5672, to the nucleotide sequence of VGAM1616 RNA, herein designated VGAM RNA, also designated SEQ ID:4327.

Another function of VGAM1616 is therefore inhibition of Growth Hormone Receptor (GHR, Accession NM_000163). Accordingly, utilities of VGAM1616 include diagnosis, prevention and treatment of diseases and clinical conditions associated with GHR. Inducible T-cell Co-stimulator (ICOS, Accession NM_012092) is another VGAM1616 host target gene. ICOS BINDING SITE is HOST TARGET binding site found in the 3' untranslated region of mRNA encoded by ICOS, corresponding to a HOST TARGET binding site such as BINDING SITE I, BINDING SITE II or BINDING SITE III. Table 2 illustrates the complementarity of the nucleotide sequences of ICOS BINDING SITE, designated SEQ ID:14387, to the nucleotide sequence of VGAM1616 RNA, herein designated VGAM RNA, also designated SEQ ID:4327.

Another function of VGAM1616 is therefore inhibition of Inducible T-cell Co-stimulator (ICOS, Accession NM_012092), a gene which forms homodimers and functions as an inducible T-cell co-stimulator. Accordingly, utilities of VGAM1616 include diagnosis, prevention and treatment of diseases and clinical conditions associated with ICOS. The function of ICOS and its association with various diseases and clinical conditions, has been established by previous studies, as described hereinabove with reference to VGAM18. Tight Junction Protein 1 (zona occludens 1) (TJP1, Accession NM_003257) is another VGAM1616 host target gene. TJP1 BINDING SITE is HOST TARGET binding site found in the 3' untranslated region of mRNA encoded by TJP1, corresponding to a HOST TARGET binding site such as BINDING SITE I, BINDING SITE II or BINDING SITE III. Table 2 illustrates the complementarity of the nucleotide sequences of TJP1 BINDING SITE, designated SEQ ID:9263, to the nucleotide sequence of VGAM1616 RNA, herein designated VGAM RNA, also designated SEQ ID:4327.

Another function of VGAM1616 is therefore inhibition of Tight Junction Protein 1 (zona occludens 1) (TJP1, Accession NM_003257), a gene which colocalizes and interacts with cadherins in cells lacking tight junctions. Accordingly, utilities of VGAM1616 include diagnosis, prevention and treatment of diseases and clinical conditions associated with TJP1. The function of TJP1 and its association with various diseases and clinical conditions, has been established by previous studies, as described hereinabove with reference to VGAM95. Rho GTPase Activating Protein 5 (ARHGAP5, Accession XM_085082) is another VGAM1616 host target gene. ARHGAP5 BINDING SITE is HOST TARGET binding site found in the 3' untranslated region of mRNA encoded by ARHGAP5, corresponding to a HOST TARGET binding site such as BINDING SITE I, BINDING SITE II or BINDING SITE III. Table 2 illustrates the complementarity of the nucleotide sequences of ARHGAP5 BINDING SITE, designated SEQ ID:37818, to the nucleotide sequence of VGAM1616 RNA, herein designated VGAM RNA, also designated SEQ ID:4327.

Another function of VGAM1616 is therefore inhibition of Rho GTPase Activating Protein 5 (ARHGAP5, Accession XM_085082). Accordingly, utilities of VGAM1616 include diagnosis, prevention and treatment of diseases and clinical conditions associated with ARHGAP5. FLJ12960 (Accession NM_024638) is another VGAM1616 host target gene. FLJ12960 BINDING SITE is HOST TARGET binding site found in the 3' untranslated region of mRNA encoded by FLJ12960, corresponding to a HOST TARGET binding site such as BINDING SITE I, BINDING SITE II or BINDING SITE III. Table 2 illustrates the complementarity of the nucleotide sequences of FLJ12960 BINDING SITE, designated SEQ ID:23915, to the nucleotide sequence of VGAM1616

RNA, herein designated VGAM RNA, also designated SEQ ID:4327.

Another function of VGAM1616 is therefore inhibition of FLJ12960 (Accession NM_024638). Accordingly, utilities of VGAM1616 include diagnosis, prevention and treatment of diseases and clinical conditions associated with FLJ12960. KIAA1762 (Accession XM_033370) is another VGAM1616 host target gene. KIAA1762 BINDING SITE is HOST TARGET binding site found in the 3' untranslated region of mRNA encoded by KIAA1762, corresponding to a HOST TARGET binding site such as BINDING SITE I, BINDING SITE II or BINDING SITE III. Table 2 illustrates the complementarity of the nucleotide sequences of KIAA1762 BINDING SITE, designated SEQ ID:31909, to the nucleotide sequence of VGAM1616 RNA, herein designated VGAM RNA, also designated SEQ ID:4327.

Another function of VGAM1616 is therefore inhibition of KIAA1762 (Accession XM_033370). Accordingly, utilities of VGAM1616 include diagnosis, prevention and treatment of diseases and clinical conditions associated with KIAA1762. MGC15482 (Accession NM_032875) is another VGAM1616 host target gene. MGC15482 BINDING SITE is HOST TARGET binding site found in the 3' untranslated region of mRNA encoded by MGC15482, corresponding to a HOST TARGET binding site such as BINDING SITE I, BINDING SITE II or BINDING SITE III. Table 2 illustrates the complementarity of the nucleotide sequences of MGC15482 BINDING SITE, designated SEQ ID:26695, to the nucleotide sequence of VGAM1616 RNA, herein designated VGAM RNA, also designated SEQ ID:4327.

Another function of VGAM1616 is therefore inhibition of MGC15482 (Accession NM_032875). Accordingly, utilities of VGAM1616 include diagnosis, prevention and treatment of diseases and clinical conditions associated with MGC15482. LOC124045 (Accession XM_071873) is another VGAM1616 host target gene. LOC124045 BINDING SITE is HOST TARGET binding site found in the 3' untranslated region of mRNA encoded by LOC124045, corresponding to a HOST TARGET binding site such as BINDING SITE I, BINDING SITE II or BINDING SITE III. Table 2 illustrates the complementarity of the nucleotide sequences of LOC124045 BINDING SITE, designated SEQ ID:37440, to the nucleotide sequence of VGAM1616 RNA, herein designated VGAM RNA, also designated SEQ ID:4327.

Another function of VGAM1616 is therefore inhibition of LOC124045 (Accession XM_071873). Accordingly, utilities of VGAM1616 include diagnosis, prevention and treatment of diseases and clinical conditions associated with LOC124045. LOC143465 (Accession XM_096430) is another VGAM1616 host target gene. LOC143465 BINDING SITE is HOST TARGET binding site found in the 5' untranslated region of mRNA encoded by LOC143465, corresponding to a HOST TARGET binding site such as BINDING SITE I, BINDING SITE II or BINDING SITE III. Table 2 illustrates the complementarity of the nucleotide sequences of LOC143465 BINDING SITE, designated SEQ ID:40362, to the nucleotide sequence of VGAM1616 RNA, herein designated VGAM RNA, also designated SEQ ID:4327.

Another function of VGAM1616 is therefore inhibition of LOC143465 (Accession XM_096430). Accordingly, utilities of VGAM1616 include diagnosis, prevention and treatment of diseases and clinical conditions associated with LOC143465. LOC203378 (Accession XM_117541) is another VGAM1616 host target gene. LOC203378 BINDING SITE is HOST TARGET binding site found in the 5' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43550, to the nucleotide sequence of VGAM1616 RNA, herein designated VGAM RNA, also designated SEQ ID:4327.

Another function of VGAM1616 is therefore inhibition of LOC203378 (Accession XM_117541). Accordingly, utilities of VGAM1616 include diagnosis, prevention and treatment of diseases and clinical conditions associated with LOC203378. FIG. 1 further provides a conceptual description of a novel bioinformatically detected viral gene of the present invention, referred to here as Viral Genomic Address Messenger 1617 (VGAM1617) viral gene, which modulates expression of respective host target genes thereof, the function and utility of which host target genes is known in the art.

VGAM1617 is a novel bioinformatically detected regulatory, non protein coding, viral micro RNA (miRNA) gene. The method by which VGAM1617 was detected is described hereinabove with reference to FIGS. 1-8.

VGAM1617 gene, herein designated VGAM GENE, is a viral gene contained in the genome of Fowl Adenovirus D. VGAM1617 host target gene, herein designated VGAM HOST TARGET GENE, is a human gene contained in the human genome.

VGAM1617 gene encodes a VGAM1617 precursor RNA, herein designated VGAM PRECURSOR RNA. Similar to other miRNA genes, and unlike most ordinary genes, VGAM1617 precursor RNA does not encode a protein. A nucleotide sequence identical or highly similar to the nucleotide sequence of VGAM1617 precursor RNA is designated SEQ ID:1603, and is provided hereinbelow with reference to the sequence listing part. Nucleotide sequence SEQ ID:1603 is located at position 10492 relative to the genome of Fowl Adenovirus D.

VGAM1617 precursor RNA folds onto itself, forming VGAM1617 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1617 folded precursor RNA into VGAM1617 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1617 RNA is designated SEQ ID:4328, and is provided hereinbelow with reference to the sequence listing part.

VGAM1617 host target gene, herein designated VGAM HOST TARGET GENE, encodes a corresponding messenger RNA, VGAM1617 host target RNA, herein designated VGAM HOST TARGET RNA. VGAM1617 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1617 RNA, herein designated VGAM RNA, binds complementarily to one or more host target binding sites located in untranslated regions of VGAM1617 host target RNA, herein designated VGAM HOST TARGET RNA. This complementary binding is due to the fact that the nucleotide sequence of VGAM1617 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1617 RNA, herein designated VGAM RNA, may have a different number of host target binding sites in untranslated regions of a VGAM1617 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1617 RNA, herein designated VGAM RNA, to host target binding sites on VGAM1617 host target RNA, herein designated VGAM HOST TARGET RNA, such as BINDING SITE I, BINDING SITE II and BINDING SITE III, inhibits translation of VGAM1617 host target RNA into VGAM1617 host target protein, herein designated VGAM HOST TARGET PROTEIN. VGAM host target protein is therefore outlined by a broken line.

It is appreciated that VGAM1617 host target gene, herein designated VGAM HOST TARGET GENE, in fact represents a plurality of VGAM1617 host target genes. The mRNA of each one of this plurality of VGAM1617 host target genes comprises one or more host target binding sites, each having a nucleotide sequence which is at least partly complementary to VGAM1617 RNA, herein designated VGAM RNA, and which when bound by VGAM1617 RNA causes inhibition of translation of respective one or more VGAM1617 host target proteins.

It is further appreciated by one skilled in the art that the mode of translational inhibition illustrated by FIG. 1 with specific reference to translational inhibition exerted by VGAM1617 gene, herein designated VGAM GENE, on one or more VGAM1617 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1617 is inhibition of expression of host target genes, as part of a novel viral mechanism of attacking a host. Accordingly, utilities of VGAM1617 include diagnosis, prevention and treatment of viral infection by Fowl Adenovirus D. Specific functions, and accordingly utilities, of VGAM1617 correlate with, and may be deduced from, the identity of the host target genes which VGAM1617 binds and inhibits, and the function of these host target genes, as elaborated hereinbelow.

Nucleotide sequences of the VGAM1617 precursor RNA, herein designated VGAM PRECURSOR RNA, and of the 'diced' VGAM1617 RNA, herein designated VGAM RNA, and a schematic representation of the secondary folding of VGAM1617 folded precursor RNA, herein designated VGAM FOLDED PRECURSOR RNA, of VGAM1617 are further described hereinbelow with reference to Table 1.

Nucleotide sequences of host target binding sites, such as BINDING SITE-I, BINDING SITE-II and BINDING SITE-III of FIG. 1, found on VGAM1617 host target RNA, and schematic representation of the complementarity of each of these host target binding sites to VGAM1617 RNA, herein designated VGAM RNA, are described hereinbelow with reference to Table 2.

As mentioned hereinabove with reference to FIG. 1, a function of VGAM1617 gene, herein designated VGAM is inhibition of expression of VGAM1617 target genes. It is appreciated that specific functions, and accordingly utilities, of VGAM1617 correlate with, and may be deduced from, the identity of the target genes which VGAM1617 binds and inhibits, and the function of these target genes, as elaborated hereinbelow.

LOC257463 (Accession XM_048605) is a VGAM1617 host target gene. LOC257463 BINDING SITE is HOST TARGET binding site found in the 5' untranslated region of mRNA encoded by LOC257463, corresponding to a HOST TARGET binding site such as BINDING SITE I, BINDING SITE II or BINDING SITE III. Table 2 illustrates the complementarity of the nucleotide sequences of LOC257463 BINDING SITE, designated SEQ ID:35208, to the nucleotide sequence of VGAM1617 RNA, herein designated VGAM RNA, also designated SEQ ID:4328.

A function of VGAM1617 is therefore inhibition of LOC257463 (Accession XM_048605). Accordingly, utilities of VGAM1617 include diagnosis, prevention and treatment of diseases and clinical conditions associated with LOC257463. FIG. 1 further provides a conceptual description of a novel bioinformatically detected viral gene of the present invention, referred to here as Viral Genomic Address Messenger 1618 (VGAM1618) viral gene, which modulates expression of respective host target genes thereof, the function and utility of which host target genes is known in the art.

VGAM1618 is a novel bioinformatically detected regulatory, non protein coding, viral micro RNA (miRNA) gene. The method by which VGAM1618 was detected is described hereinabove with reference to FIGS. 1-8.

VGAM1618 gene, herein designated VGAM GENE, is a viral gene contained in the genome of Fowl Adenovirus D. VGAM1618 host target gene, herein designated VGAM HOST TARGET GENE, is a human gene contained in the human genome.

VGAM1618 gene encodes a VGAM1618 precursor RNA, herein designated VGAM PRECURSOR RNA. Similar to other miRNA genes, and unlike most ordinary genes, VGAM1618 precursor RNA does not encode a protein. A nucleotide sequence identical or highly similar to the nucleotide sequence of VGAM1618 precursor RNA is designated SEQ ID:1604, and is provided hereinbelow with reference to the sequence listing part. Nucleotide sequence SEQ ID:1604 is located at position 5025 relative to the genome of Fowl Adenovirus D.

VGAM1618 precursor RNA folds onto itself, forming VGAM1618 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1618 folded precursor RNA into VGAM1618 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1618 RNA is designated SEQ ID:4329, and is provided hereinbelow with reference to the sequence listing part.

VGAM1618 host target gene, herein designated VGAM HOST TARGET GENE, encodes a corresponding messenger RNA, VGAM1618 host target RNA, herein designated VGAM HOST TARGET RNA. VGAM1618 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1618 RNA, herein designated VGAM RNA, binds complementarily to one or more host target binding sites located in untranslated regions of VGAM1618 host target RNA, herein designated VGAM HOST TARGET RNA. This complementary binding is due to the fact that the nucleotide sequence of VGAM1618 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1618 RNA, herein designated VGAM RNA, may have a different number of host target binding sites in untranslated regions of a VGAM1618 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1618 RNA, herein designated VGAM RNA, to host target binding sites on VGAM1618 host target RNA, herein designated VGAM HOST TARGET RNA, such as BINDING SITE I, BINDING SITE II and BINDING SITE III, inhibits translation of VGAM1618 host target RNA into VGAM1618 host target protein, herein designated VGAM HOST TARGET PROTEIN. VGAM host target protein is therefore outlined by a broken line.

It is appreciated that VGAM1618 host target gene, herein designated VGAM HOST TARGET GENE, in fact represents a plurality of VGAM1618 host target genes. The mRNA of each one of this plurality of VGAM1618 host target genes comprises one or more host target binding sites, each having a nucleotide sequence which is at least partly complementary to VGAM1618 RNA, herein designated VGAM RNA, and which when bound by VGAM1618 RNA causes inhibition of translation of respective one or more VGAM1618 host target proteins.

It is further appreciated by one skilled in the art that the mode of translational inhibition illustrated by FIG. 1 with specific reference to translational inhibition exerted by VGAM1618 gene, herein designated VGAM GENE, on one or more VGAM1618 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1618 is inhibition of expression of host target genes, as part of a novel viral mechanism of attacking a host. Accordingly, utilities of VGAM1618 include diagnosis, prevention and treatment of viral infection by Fowl Adenovirus D. Specific functions, and accordingly utilities, of VGAM1618 correlate with, and may be deduced from, the identity of the host target genes which VGAM1618 binds and inhibits, and the function of these host target genes, as elaborated hereinbelow.

Nucleotide sequences of the VGAM1618 precursor RNA, herein designated VGAM PRECURSOR RNA, and of the 'diced' VGAM1618 RNA, herein designated VGAM RNA, and a schematic representation of the secondary folding of VGAM1618 folded precursor RNA, herein designated VGAM FOLDED PRECURSOR RNA, of VGAM1618 are further described hereinbelow with reference to Table 1.

Nucleotide sequences of host target binding sites, such as BINDING SITE-I, BINDING SITE-II and BINDING SITE-III of FIG. 1, found on VGAM1618 host target RNA, and schematic representation of the complementarity of each of these host target binding sites to VGAM1618 RNA, herein designated VGAM RNA, are described hereinbelow with reference to Table 2.

As mentioned hereinabove with reference to FIG. 1, a function of VGAM1618 gene, herein designated VGAM is inhibition of expression of VGAM1618 target genes. It is appreciated that specific functions, and accordingly utilities, of VGAM1618 correlate with, and may be deduced from, the identity of the target genes which VGAM1618 binds and inhibits, and the function of these target genes, as elaborated hereinbelow.

Chromosome 1 Open Reading Frame 16 (C1orf16, Accession NM_014837) is a VGAM1618 host target gene. C1orf16 BINDING SITE is HOST TARGET binding site found in the 3' untranslated region of mRNA encoded by C1orf16, corresponding to a HOST TARGET binding site such as BINDING SITE I, BINDING SITE II or BINDING SITE III. Table 2 illustrates the complementarity of the nucleotide sequences of C1orf16 BINDING SITE, designated SEQ ID:16855, to the nucleotide sequence of VGAM1618 RNA, herein designated VGAM RNA, also designated SEQ ID:4329.

A function of VGAM1618 is therefore inhibition of Chromosome 1 Open Reading Frame 16 (C1orf16, Accession NM_014837). Accordingly, utilities of VGAM1618 include diagnosis, prevention and treatment of diseases and clinical conditions associated with C1orf16. Chromosome 5 Open Reading Frame 4 (C5orf4, Accession NM_032385) is another VGAM1618 host target gene. C5orf4 BINDING SITE is HOST TARGET binding site found in the 3' untranslated region of mRNA encoded by C5orf4, corresponding to a HOST TARGET binding site such as BINDING SITE I, BINDING SITE II or BINDING SITE III. Table 2 illustrates the complementarity of the nucleotide sequences of C5orf4 BINDING SITE, designated SEQ ID:26182, to the nucleotide sequence of VGAM1618 RNA, herein designated VGAM RNA, also designated SEQ ID:4329.

Another function of VGAM1618 is therefore inhibition of Chromosome 5 Open Reading Frame 4 (C5orf4, Accession NM_032385). Accordingly, utilities of VGAM1618 include diagnosis, prevention and treatment of diseases and clinical conditions associated with C5orf4. DKFZP586J0619 (Accession XM_088280) is another VGAM1618 host target gene. DKFZP586J0619 BINDING SITE is HOST TARGET binding site found in the 3' untranslated region of mRNA encoded by DKFZP586J0619, corresponding to a HOST TARGET binding site such as BINDING SITE I, BINDING SITE II or BINDING SITE III. Table 2 illustrates the complementarity of the nucleotide sequences of DKFZP586J0619 BINDING SITE, designated SEQ ID:39580, to the nucleotide sequence of VGAM1618 RNA, herein designated VGAM RNA, also designated SEQ ID:4329.

Another function of VGAM1618 is therefore inhibition of DKFZP586J0619 (Accession XM_088280). Accordingly, utilities of VGAM1618 include diagnosis, prevention and treatment of diseases and clinical conditions associated with DKFZP586J0619. LOC161244 (Accession XM_101700) is another VGAM1618 host target gene. LOC161244 BINDING SITE is HOST TARGET binding site found in the 5' untranslated region of mRNA encoded by LOC161244, corresponding to a HOST TARGET binding site such as BINDING SITE I, BINDING SITE II or BINDING SITE III. Table 2 illustrates the complementarity of the nucleotide sequences of LOC161244 BINDING SITE, designated SEQ ID:42107, to the nucleotide sequence of VGAM1618 RNA, herein designated VGAM RNA, also designated SEQ ID:4329.

Another function of VGAM1618 is therefore inhibition of LOC161244 (Accession XM_101700). Accordingly, utilities of VGAM1618 include diagnosis, prevention and treatment of diseases and clinical conditions associated with LOC161244. LOC255718 (Accession XM_174148) is another VGAM1618 host target gene. LOC255718 BINDING SITE is HOST TARGET binding site found in the 5' untranslated region of mRNA encoded by LOC255718, corresponding to a HOST TARGET binding site such as BINDING SITE I, BINDING SITE II or BINDING SITE III. Table 2 illustrates the complementarity of the nucleotide sequences of LOC255718 BINDING SITE, designated SEQ ID:46580, to the nucleotide sequence of VGAM1618 RNA, herein designated VGAM RNA, also designated SEQ ID:4329.

Another function of VGAM1618 is therefore inhibition of LOC255718 (Accession XM_174148). Accordingly, utilities of VGAM1618 include diagnosis, prevention and treatment of diseases and clinical conditions associated with LOC255718. FIG. 1 further provides a conceptual description of a novel bioinformatically detected viral gene of the present invention, referred to here as Viral Genomic Address Messenger 1619 (VGAM1619) viral gene, which modulates expression of respective host target genes thereof, the function and utility of which host target genes is known in the art.

VGAM1619 is a novel bioinformatically detected regulatory, non protein coding, viral micro RNA (miRNA) gene. The method by which VGAM1619 was detected is described hereinabove with reference to FIGS. 1-8.

VGAM1619 gene, herein designated VGAM GENE, is a viral gene contained in the genome of Fowl Adenovirus D. VGAM1619 host target gene, herein designated VGAM HOST TARGET GENE, is a human gene contained in the human genome.

VGAM1619 gene encodes a VGAM1619 precursor RNA, herein designated VGAM PRECURSOR RNA. Similar to other miRNA genes, and unlike most ordinary genes, VGAM1619 precursor RNA does not encode a protein. A nucleotide sequence identical or highly similar to the nucleotide sequence of VGAM1619 precursor RNA is designated SEQ ID:1605, and is provided hereinbelow with reference to the sequence listing part. Nucleotide sequence SEQ ID:1605 is located at position 4810 relative to the genome of Fowl Adenovirus D.

VGAM1619 precursor RNA folds onto itself, forming VGAM1619 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1619 folded precursor RNA into VGAM1619 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1619 RNA is designated SEQ ID:4330, and is provided hereinbelow with reference to the sequence listing part.

VGAM1619 host target gene, herein designated VGAM HOST TARGET GENE, encodes a corresponding messenger RNA, VGAM1619 host target RNA, herein designated VGAM HOST TARGET RNA. VGAM1619 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1619 RNA, herein designated VGAM RNA, binds complementarily to one or more host target binding sites located in untranslated regions of VGAM1619 host target RNA, herein designated VGAM HOST TARGET RNA. This complementary binding is due to the fact that the nucleotide sequence of VGAM1619 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1619 RNA, herein designated VGAM RNA, may have a different number of host target binding sites in untranslated regions of a VGAM1619 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1619 RNA, herein designated VGAM RNA, to host target binding sites on VGAM1619 host target RNA, herein designated VGAM HOST TARGET RNA, such as BINDING SITE I, BINDING SITE II and BINDING SITE III, inhibits translation of VGAM1619 host target RNA into VGAM1619 host target protein, herein designated VGAM HOST TARGET PROTEIN. VGAM host target protein is therefore outlined by a broken line.

It is appreciated that VGAM1619 host target gene, herein designated VGAM HOST TARGET GENE, in fact represents a plurality of VGAM1619 host target genes. The mRNA of each one of this plurality of VGAM1619 host target genes comprises one or more host target binding sites, each having a nucleotide sequence which is at least partly complementary to VGAM1619 RNA, herein designated VGAM RNA, and which when bound by VGAM1619 RNA causes inhibition of translation of respective one or more VGAM1619 host target proteins.

It is further appreciated by one skilled in the art that the mode of translational inhibition illustrated by FIG. 1 with specific reference to translational inhibition exerted by VGAM1619 gene, herein designated VGAM GENE, on one or more VGAM1619 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1619 is inhibition of expression of host target genes, as part of a novel viral mechanism of attacking a host. Accordingly, utilities of VGAM1619 include diagnosis, prevention and treatment of viral infection by Fowl Adenovirus D. Specific functions, and accordingly utilities, of VGAM1619 correlate with, and may be deduced from, the identity of the host target genes which VGAM1619 binds and inhibits, and the function of these host target genes, as elaborated hereinbelow.

Nucleotide sequences of the VGAM1619 precursor RNA, herein designated VGAM PRECURSOR RNA, and of the 'diced' VGAM1619 RNA, herein designated VGAM RNA, and a schematic representation of the secondary folding of VGAM1619 folded precursor RNA, herein designated VGAM FOLDED PRECURSOR RNA, of VGAM1619 are further described hereinbelow with reference to Table 1.

Nucleotide sequences of host target binding sites, such as BINDING SITE-I, BINDING SITE-II and BINDING SITE-III of FIG. 1, found on VGAM1619 host target RNA, and schematic representation of the complementarity of each of these host target binding sites to VGAM1619 RNA, herein designated VGAM RNA, are described hereinbelow with reference to Table 2.

As mentioned hereinabove with reference to FIG. 1, a function of VGAM1619 gene, herein designated VGAM is inhibition of expression of VGAM1619 target genes. It is appreciated that specific functions, and accordingly utilities, of VGAM1619 correlate with, and may be deduced from, the identity of the target genes which VGAM1619 binds and inhibits, and the function of these target genes, as elaborated hereinbelow.

Snail Homolog 1 (Drosophila) (SNAI1, Accession NM_005985) is a VGAM1619 host target gene. SNAI1 BINDING SITE is HOST TARGET binding site found in the 3' untranslated region of mRNA encoded by SNAI1, corresponding to a HOST TARGET binding site such as BINDING SITE I, BINDING SITE II or BINDING SITE III. Table 2 illustrates the complementarity of the nucleotide sequences of SNAI1 BINDING SITE, designated SEQ ID:12607, to the nucleotide sequence of VGAM1619 RNA, herein designated VGAM RNA, also designated SEQ ID:4330.

A function of VGAM1619 is therefore inhibition of Snail Homolog 1 (Drosophila) (SNAI1, Accession NM_005985). Accordingly, utilities of VGAM1619 include diagnosis, prevention and treatment of diseases and clinical conditions associated with SNAI1. PIPPIN (Accession XM_086825) is another VGAM1619 host target gene. PIPPIN BINDING SITE is HOST TARGET binding site found in the 3' untranslated region of mRNA encoded by PIPPIN, corresponding to a HOST TARGET binding site such as BINDING SITE I, BINDING SITE II or BINDING SITE III. Table 2 illustrates the complementarity of the nucleotide sequences of PIPPIN BINDING SITE, designated SEQ ID:38909, to the nucleotide sequence of VGAM1619 RNA, herein designated VGAM RNA, also designated SEQ ID:4330.

Another function of VGAM1619 is therefore inhibition of PIPPIN (Accession XM_086825). Accordingly, utilities of VGAM1619 include diagnosis, prevention and treatment of diseases and clinical conditions associated with PIPPIN. Voltage-dependent Anion Channel 3 (VDAC3, Accession NM_005662) is another VGAM1619 host target gene. VDAC3 BINDING SITE is HOST TARGET binding site found in the 3' untranslated region of mRNA encoded by VDAC3, corresponding to a HOST TARGET binding site such as BINDING SITE I, BINDING SITE II or BINDING SITE III. Table 2 illustrates the complementarity of the nucleotide sequences of VDAC3 BINDING SITE, designated SEQ ID:12203, to the nucleotide sequence of VGAM1619 RNA, herein designated VGAM RNA, also designated SEQ ID:4330.

Another function of VGAM1619 is therefore inhibition of Voltage-dependent Anion Channel 3 (VDAC3, Accession NM_005662). Accordingly, utilities of VGAM1619 include diagnosis, prevention and treatment of diseases and clinical conditions associated with VDAC3. LOC255452 (Accession XM_174088) is another VGAM1619 host target gene. LOC255452 BINDING SITE is HOST TARGET binding site found in the 3' untranslated region of mRNA encoded by LOC255452, corresponding to a HOST TARGET binding site such as BINDING SITE I, BINDING SITE II or BINDING SITE III. Table 2 illustrates the complementarity of the nucleotide sequences of LOC255452 BINDING SITE, designated SEQ ID:46572, to the nucleotide sequence of VGAM1619 RNA, herein designated VGAM RNA, also designated SEQ ID:4330.

Another function of VGAM1619 is therefore inhibition of LOC255452 (Accession XM_174088). Accordingly, utilities of VGAM1619 include diagnosis, prevention and treatment of diseases and clinical conditions associated with LOC255452. FIG. 1 further provides a conceptual description of a novel bioinformatically detected viral gene of the present invention, referred to here as Viral Genomic Address Messenger 1620 (VGAM1620) viral gene, which modulates expression of respective host target genes thereof, the function and utility of which host target genes is known in the art.

VGAM1620 is a novel bioinformatically detected regulatory, non protein coding, viral micro RNA (miRNA) gene. The method by which VGAM1620 was detected is described hereinabove with reference to FIGS. 1-8.

VGAM1620 gene, herein designated VGAM GENE, is a viral gene contained in the genome of Fowl Adenovirus D. VGAM1620 host target gene, herein designated VGAM HOST TARGET GENE, is a human gene contained in the human genome.

VGAM1620 gene encodes a VGAM1620 precursor RNA, herein designated VGAM PRECURSOR RNA. Similar to other miRNA genes, and unlike most ordinary genes, VGAM1620 precursor RNA does not encode a protein. A nucleotide sequence identical or highly similar to the nucleotide sequence of VGAM1620 precursor RNA is designated SEQ ID:1606, and is provided hereinbelow with reference to the sequence listing part. Nucleotide sequence SEQ ID:1606 is located at position 9503 relative to the genome of Fowl Adenovirus D.

VGAM1620 precursor RNA folds onto itself, forming VGAM1620 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1620 folded precursor RNA into VGAM1620 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1620 RNA is designated SEQ ID:4331, and is provided hereinbelow with reference to the sequence listing part.

VGAM1620 host target gene, herein designated VGAM HOST TARGET GENE, encodes a corresponding messenger RNA, VGAM1620 host target RNA, herein designated VGAM HOST TARGET RNA. VGAM1620 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1620 RNA, herein designated VGAM RNA, binds complementarily to one or more host target binding sites located in untranslated regions of VGAM1620 host target RNA, herein designated VGAM HOST TARGET RNA. This complementary binding is due to the fact that the nucleotide sequence of VGAM1620 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1620 RNA, herein designated VGAM RNA, may have a different number of host target binding sites in untranslated regions of a VGAM1620 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1620 RNA, herein designated VGAM RNA, to host target binding sites on VGAM1620 host target RNA, herein designated VGAM HOST TARGET RNA, such as BINDING SITE I, BINDING SITE II and BINDING SITE III, inhibits translation of VGAM1620 host target RNA into VGAM1620 host target protein, herein designated VGAM HOST TARGET PROTEIN. VGAM host target protein is therefore outlined by a broken line.

It is appreciated that VGAM1620 host target gene, herein designated VGAM HOST TARGET GENE, in fact represents a plurality of VGAM1620 host target genes. The mRNA of each one of this plurality of VGAM1620 host target genes comprises one or more host target binding sites, each having a nucleotide sequence which is at least partly complementary to VGAM1620 RNA, herein designated VGAM RNA, and which when bound by VGAM1620 RNA causes inhibition of translation of respective one or more VGAM1620 host target proteins.

It is further appreciated by one skilled in the art that the mode of translational inhibition illustrated by FIG. 1 with specific reference to translational inhibition exerted by VGAM1620 gene, herein designated VGAM GENE, on one or more VGAM1620 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1620 is inhibition of expression of host target genes, as part of a novel viral mechanism of attacking a host. Accordingly, utilities of VGAM1620 include diagnosis, prevention and treatment of viral infection by Fowl Adenovirus D. Specific functions, and accordingly utilities, of VGAM1620 correlate with, and may be deduced from, the identity of the host target genes which VGAM1620 binds and inhibits, and the function of these host target genes, as elaborated hereinbelow.

Nucleotide sequences of the VGAM1620 precursor RNA, herein designated VGAM PRECURSOR RNA, and of the 'diced' VGAM1620 RNA, herein designated VGAM RNA, and a schematic representation of the secondary folding of VGAM1620 folded precursor RNA, herein designated VGAM FOLDED PRECURSOR RNA, of VGAM1620 are further described hereinbelow with reference to Table 1.

Nucleotide sequences of host target binding sites, such as BINDING SITE-I, BINDING SITE-II and BINDING SITE-III of FIG. 1, found on VGAM1620 host target RNA, and schematic representation of the complementarity of each of these host target binding sites to VGAM1620 RNA, herein designated VGAM RNA, are described hereinbelow with reference to Table 2.

As mentioned hereinabove with reference to FIG. 1, a function of VGAM1620 gene, herein designated VGAM is inhibition of expression of VGAM1620 target genes. It is appreciated that specific functions, and accordingly utilities, of VGAM1620 correlate with, and may be deduced from, the identity of the target genes which VGAM1620 binds and inhibits, and the function of these target genes, as elaborated hereinbelow.

Isoleucine-tRNA Synthetase (IARS, Accession NM_013417) is a VGAM1620 host target gene. IARS BINDING SITE is HOST TARGET binding site found in the 5' untranslated region of mRNA encoded by IARS, corresponding to a HOST TARGET binding site such as BINDING SITE I, BINDING SITE II or BINDING SITE III. Table 2 illustrates the complementarity of the nucleotide sequences of IARS BINDING SITE, designated SEQ ID:15080, to the nucleotide sequence of VGAM1620 RNA, herein designated VGAM RNA, also designated SEQ ID:4331.

A function of VGAM1620 is therefore inhibition of Isoleucine-tRNA Synthetase (IARS, Accession NM_013417), a gene which functions in protein biosynthesis. Accordingly, utilities of VGAM1620 include diagnosis, prevention and treatment of diseases and clinical conditions associated with IARS. The function of IARS has been established by previous studies. The autoimmune diseases polymyositis and dermatomyositis are a consequence of autoantibodies directed against 1 or more of the aminoacyl-tRNA synthetases with subsequent lymphocytic destruction of myocytes. Nichols et al. (1995) cloned the cDNA for isoleucyl-tRNA synthetase (TRIS, which they referred to as IRS) by using autoantibodies from patients to purify the protein. Partial amino acid sequence was obtained from tryptic peptides and DNA probes were designed and used to screen liver and HeLa cell libraries. The cDNA has a 1,262-amino acid reading frame with significant sequence similarity to isoleucyl-tRNA synthetases from both yeast and Tetrahymena. The predicted protein contains the expected motifs of class-I hydrophobic aminoacyl-tRNA synthetases and the human protein has a C-terminal domain not seen in the lower organisms. The human gene can produce 2 alternatively spliced mRNAs based on the use of a 5-prime untranslated exon. Nichols et al. (1995) speculated that the autoantibodies produced in patients may recognize an epitope in this region. Six of 20 human aminoacyl-tRNA synthetases have been identified as targets of autoantibodies in the autoimmune disease polymyositis/dermatomyositis: histidyl-RS (OMIM Ref. No. 142810) on chromosome 5, threonyl-RS (OMIM Ref. No. 187790), also on chromosome 5, alanyl-RS (OMIM Ref. No. 601065) on chromosome 16, glycyl-RS (OMIM Ref. No. 600287) on chromosome 7, isoleucyl-RS, and lysyl-RS (OMIM Ref. No. 601421). By PCR-based analysis of a human/rodent somatic cell hybrid panel, Nichols et al. (1996) assigned IARS to chromosome 9. By fluorescence in situ hybridization analysis, they regionalized the IARS gene to 9q21.

Full details of the abovementioned studies are described in the following publications, the disclosure of which are hereby incorporated by reference:

Nichols, R. C.; Blinder, J.; Pai, S. I.; Ge, Q.; Targoff, I. N.; Plotz, P. H.; Liu, P.: Assignment of two human autoantigen genes: isoleucyl-tRNA synthetase locates to 9q21 and lysyl-tRNA synthetase locates to 16q23-q24. Genomics 36:210-213, 1996; and Nichols, R. C.; Raben, N.; Boerkoel, C. F.; Plotz, P. H.: Human isoleucyl-tRNA synthetase: sequence of the cDNA, alternative mRNA splicing, and the characteristics of an unusually long.

Further studies establishing the function and utilities of IARS are found in John Hopkins OMIM database record ID 600709, and in sited publications numbered 10047-10048 listed in the bibliography section hereinbelow, which are also hereby incorporated by reference. KIAA0795 (Accession NM_025010) is another VGAM1620 host target gene. KIAA0795 BINDING SITE is HOST TARGET binding site found in the 5' untranslated region of mRNA encoded by KIAA0795, corresponding to a HOST TARGET binding site such as BINDING SITE I, BINDING SITE II or BINDING SITE III. Table 2 illustrates the complementarity of the nucleotide sequences of KIAA0795 BINDING SITE, designated SEQ ID:24583, to the nucleotide sequence of VGAM1620 RNA, herein designated VGAM RNA, also designated SEQ ID:4331.

Another function of VGAM1620 is therefore inhibition of KIAA0795 (Accession NM_025010). Accordingly, utilities of VGAM1620 include diagnosis, prevention and treatment of diseases and clinical conditions associated with KIAA0795. LOC145693 (Accession XM_085205) is another VGAM1620 host target gene. LOC145693 BINDING SITE is HOST TARGET binding site found in the 5' untranslated region of mRNA encoded by LOC145693, corresponding to a HOST TARGET binding site such as BINDING SITE I, BINDING SITE II or BINDING SITE III. Table 2 illustrates the complementarity of the nucleotide sequences of LOC145693 BINDING SITE, designated SEQ ID:37922, to the nucleotide sequence of VGAM1620 RNA, herein designated VGAM RNA, also designated SEQ ID:4331.

Another function of VGAM1620 is therefore inhibition of LOC145693 (Accession XM_085205). Accordingly, utilities of VGAM1620 include diagnosis, prevention and treatment of diseases and clinical conditions associated with LOC145693. LOC254431 (Accession XM_173024) is another VGAM1620 host target gene. LOC254431 BINDING SITE is HOST TARGET binding site found in the 3' untranslated region of mRNA encoded by LOC254431, corresponding to a HOST TARGET binding site such as BINDING SITE I, BINDING SITE II or BINDING SITE III. Table 2 illustrates the complementarity of the nucleotide sequences of LOC254431 BINDING SITE, designated SEQ ID:46293, to the nucleotide sequence of VGAM1620 RNA, herein designated VGAM RNA, also designated SEQ ID:4331.

Another function of VGAM1620 is therefore inhibition of LOC254431 (Accession XM_173024). Accordingly, utilities of VGAM1620 include diagnosis, prevention and treatment of diseases and clinical conditions associated with LOC254431. LOC90591 (Accession XM_032811) is another VGAM1620 host target gene. LOC90591 BINDING SITE is HOST TARGET binding site found in the 3' untranslated region of mRNA encoded by LOC90591, corresponding to a HOST TARGET binding site such as BINDING SITE I, BINDING SITE II or BINDING SITE III. Table 2 illustrates the complementarity of the nucleotide sequences of LOC90591 BINDING SITE, designated SEQ ID:31760, to the nucleotide sequence of VGAM1620 RNA, herein designated VGAM RNA, also designated SEQ ID:4331.

Another function of VGAM1620 is therefore inhibition of LOC90591 (Accession XM_032811). Accordingly, utilities of VGAM1620 include diagnosis, prevention and treatment of diseases and clinical conditions associated with LOC90591. FIG. 1 further provides a conceptual description of a novel bioinformatically detected viral gene of the present invention, referred to here as Viral Genomic Address Messenger 1621 (VGAM1621) viral gene, which modulates expression of respective host target genes thereof, the function and utility of which host target genes is known in the art.

VGAM1621 is a novel bioinformatically detected regulatory, non protein coding, viral micro RNA (miRNA) gene. The method by which VGAM1621 was detected is described hereinabove with reference to FIGS. 1-8.

VGAM1621 gene, herein designated VGAM GENE, is a viral gene contained in the genome of Fowl Adenovirus D. VGAM1621 host target gene, herein designated VGAM HOST TARGET GENE, is a human gene contained in the human genome.

VGAM1621 gene encodes a VGAM1621 precursor RNA, herein designated VGAM PRECURSOR RNA. Similar to other miRNA genes, and unlike most ordinary genes, VGAM1621 precursor RNA does not encode a protein. A nucleotide sequence identical or highly similar to the nucleotide sequence of VGAM1621 precursor RNA is designated SEQ ID:1607, and is provided hereinbelow with reference to the sequence listing part. Nucleotide sequence SEQ ID:1607 is located at position 4619 relative to the genome of Fowl Adenovirus D.

VGAM1621 precursor RNA folds onto itself, forming VGAM1621 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1621 folded precursor RNA into VGAM1621 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1621 RNA is designated SEQ ID:4332, and is provided hereinbelow with reference to the sequence listing part.

VGAM1621 host target gene, herein designated VGAM HOST TARGET GENE, encodes a corresponding messenger RNA, VGAM1621 host target RNA, herein designated VGAM HOST TARGET RNA. VGAM1621 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1621 RNA, herein designated VGAM RNA, binds complementarily to one or more host target binding sites located in untranslated regions of VGAM1621 host target RNA, herein designated VGAM HOST TARGET RNA. This complementary binding is due to the fact that the nucleotide sequence of VGAM1621 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1621 RNA, herein designated VGAM RNA, may have a different number of host target binding sites in untranslated regions of a VGAM1621 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1621 RNA, herein designated VGAM RNA, to host target binding sites on VGAM1621 host target RNA, herein designated VGAM HOST TARGET RNA, such as BINDING SITE I, BINDING SITE II and BINDING SITE III, inhibits translation of VGAM1621 host target RNA into VGAM1621 host target protein, herein designated VGAM HOST TARGET PROTEIN. VGAM host target protein is therefore outlined by a broken line.

It is appreciated that VGAM1621 host target gene, herein designated VGAM HOST TARGET GENE, in fact represents a plurality of VGAM1621 host target genes. The mRNA of each one of this plurality of VGAM1621 host target genes comprises one or more host target binding sites, each having a nucleotide sequence which is at least partly complementary to VGAM1621 RNA, herein designated VGAM RNA, and which when bound by VGAM1621 RNA causes inhibition of translation of respective one or more VGAM1621 host target proteins.

It is further appreciated by one skilled in the art that the mode of translational inhibition illustrated by FIG. 1 with specific reference to translational inhibition exerted by VGAM1621 gene, herein designated VGAM GENE, on one or more VGAM1621 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1621 is inhibition of expression of host target genes, as part of a novel viral mechanism of attacking a host. Accordingly, utilities of VGAM1621 include diagnosis, prevention and treatment of viral infection by Fowl Adenovirus D. Specific functions, and accordingly utilities, of VGAM1621 correlate with, and may be deduced from, the identity of the host target genes which VGAM1621 binds and inhibits, and the function of these host target genes, as elaborated hereinbelow.

Nucleotide sequences of the VGAM1621 precursor RNA, herein designated VGAM PRECURSOR RNA, and of the 'diced' VGAM1621 RNA, herein designated VGAM RNA, and a schematic representation of the secondary folding of VGAM1621 folded precursor RNA, herein designated VGAM FOLDED PRECURSOR RNA, of VGAM1621 are further described hereinbelow with reference to Table 1.

Nucleotide sequences of host target binding sites, such as BINDING SITE-I, BINDING SITE-II and BINDING SITE-III of FIG. 1, found on VGAM1621 host target RNA, and schematic representation of the complementarity of each of these host target binding sites to VGAM1621 RNA, herein designated VGAM RNA, are described hereinbelow with reference to Table 2.

As mentioned hereinabove with reference to FIG. 1, a function of VGAM1621 gene, herein designated VGAM is inhibition of expression of VGAM1621 target genes. It is appreciated that specific functions, and accordingly utilities, of VGAM1621 correlate with, and may be deduced from, the identity of the target genes which VGAM1621 binds and inhibits, and the function of these target genes, as elaborated hereinbelow.

Citron (rho-interacting, serine/threonine kinase 21) (CIT, Accession XM_045786) is a VGAM1621 host target gene. CIT BINDING SITE is HOST TARGET binding site found in the 3' untranslated region of mRNA encoded by CIT, corresponding to a HOST TARGET binding site such as BINDING SITE I, BINDING SITE II or BINDING SITE III. Table 2 illustrates the complementarity of the nucleotide sequences of CIT BINDING SITE, designated SEQ ID:34563, to the nucleotide sequence of VGAM1621 RNA, herein designated VGAM RNA, also designated SEQ ID:4332.

A function of VGAM1621 is therefore inhibition of Citron (rho-interacting, serine/threonine kinase 21) (CIT, Accession XM_045786), a gene which is increased several-fold by coexpression of constitutively active Rho . Accordingly, utilities of VGAM1621 include diagnosis, prevention and treatment of diseases and clinical conditions associated with CIT. The function of CIT and its association with various diseases and clinical conditions, has been established by previous studies, as described hereinabove with reference to VGAM393. Carnitine Acetyltransferase (CRAT, Accession NM_004003) is another VGAM1621 host target gene. CRAT BINDING SITE1 and CRAT BINDING SITE2 are HOST TARGET binding sites found in untranslated regions of mRNA encoded by CRAT, corresponding to HOST TARGET binding sites such as BINDING SITE I, BINDING SITE II or BINDING SITE III. Table 2 illustrates the complementarity of the nucleotide sequences of CRAT BINDING SITE1 and CRAT BINDING SITE2, designated SEQ ID:10152 and SEQ ID:6407 respectively, to the nucleotide sequence of VGAM1621 RNA, herein designated VGAM RNA, also designated SEQ ID:4332.

Another function of VGAM1621 is therefore inhibition of Carnitine Acetyltransferase (CRAT, Accession NM_004003), a gene which catalyzes the reversible transfer of acyl groups from an acyl-CoA thioester to carnitine. Accordingly, utilities of VGAM1621 include diagnosis, prevention and treatment of diseases and clinical conditions associated with CRAT. The function of CRAT and its association with various diseases and clinical conditions, has been established by previous studies, as described hereinabove with reference to VGAM1189. DEAD/H (Asp-Glu-Ala-Asp/His) Box Polypeptide 3 (DDX3, Accession NM_024005) is another VGAM1621 host target gene. DDX3 BINDING SITE1 and DDX3 BINDING SITE2 are HOST TARGET binding sites found in untranslated regions of mRNA encoded by DDX3, corresponding to HOST TARGET binding sites such as BINDING SITE I, BINDING SITE II or BINDING SITE III. Table 2 illustrates the complementarity of the nucleotide sequences of DDX3 BINDING SITE1 and DDX3 BINDING SITE2, designated SEQ ID:23434 and SEQ ID:7649 respectively, to the nucleotide sequence of VGAM1621 RNA, herein designated VGAM RNA, also designated SEQ ID:4332.

Another function of VGAM1621 is therefore inhibition of DEAD/H (Asp-Glu-Ala-Asp/His) Box Polypeptide 3 (DDX3, Accession NM_024005), a gene which interacts with hepatitis c virus core protein resulting a change in intracellular location. Accordingly, utilities of VGAM1621 include diagnosis, prevention and treatment of diseases and clinical conditions associated with DDX3. The function of DDX3 and its association with various diseases and clinical conditions, has been established by previous studies, as described hereinabove with reference to VGAM232. Eukaryotic Translation Initiation Factor 4 Gamma, 1 (EIF4G1, Accession NM_004953) is another VGAM1621 host target gene. EIF4G1 BINDING SITE is HOST TARGET binding site found in the 5' untranslated region of mRNA encoded by EIF4G1, corresponding to a HOST TARGET binding site such as BINDING SITE I, BINDING SITE II or BINDING SITE III. Table 2 illustrates the complementarity of the nucleotide sequences of EIF4G1 BINDING SITE, designated SEQ ID:11397, to the nucleotide sequence of VGAM1621 RNA, herein designated VGAM RNA, also designated SEQ ID:4332.

Another function of VGAM1621 is therefore inhibition of Eukaryotic Translation Initiation Factor 4 Gamma, 1 (EIF4G1, Accession NM_004953), a gene which is a Translation initiation factor. Accordingly, utilities of VGAM1621 include diagnosis, prevention and treatment of diseases and clinical conditions associated with EIF4G1. The function of EIF4G1 and its association with various diseases and clinical conditions, has been established by previous studies, as described hereinabove with reference to VGAM1403. EphA2 (EPHA2, Accession NM_004431) is another VGAM1621 host target gene. EPHA2 BINDING SITE is HOST TARGET binding site found in the 3' untranslated region of mRNA encoded by EPHA2, corresponding to a HOST TARGET binding site such as BINDING SITE I, BINDING SITE II or BINDING SITE III. Table 2 illustrates the complementarity of the nucleotide sequences of EPHA2 BINDING SITE, designated SEQ ID:10716, to the nucleotide sequence of VGAM1621 RNA, herein designated VGAM RNA, also designated SEQ ID:4332.

Another function of VGAM1621 is therefore inhibition of EphA2 (EPHA2, Accession NM_004431), a gene which binds to ephrin-a1, -a3, -a4 and -a5. Accordingly, utilities of VGAM1621 include diagnosis, prevention and treatment of diseases and clinical conditions associated with EPHA2. The function of EPHA2 and its association with various diseases and clinical conditions, has been established by previous studies, as described hereinabove with reference to VGAM1289. Insulin-like Growth Factor Binding Protein 5 (IGFBP5, Accession NM_000599) is another VGAM1621 host target gene. IGFBP5 BINDING SITE is HOST TARGET binding site found in the 5' untranslated region of mRNA encoded by IGFBP5, corresponding to a HOST TARGET binding site such as BINDING SITE I, BINDING SITE II or BINDING SITE III. Table 2 illustrates the complementarity of the nucleotide sequences of IGFBP5 BINDING SITE, designated SEQ ID:6202, to the nucleotide sequence of VGAM1621 RNA, herein designated VGAM RNA, also designated SEQ ID:4332.

Another function of VGAM1621 is therefore inhibition of Insulin-like Growth Factor Binding Protein 5 (IGFBP5, Accession NM_000599), a gene which either inhibits or stimulates the growth promoting effects of the igfs on cell culture. Accordingly, utilities of VGAM1621 include diagnosis, prevention and treatment of diseases and clinical conditions associated with IGFBP5. The function of IGFBP5 and its association with various diseases and clinical conditions, has been established by previous studies, as described hereinabove with reference to VGAM1233. Nerve Growth Factor Receptor (TNFR superfamily, member 16) (NGFR, Accession NM_002507) is another VGAM1621 host target gene. NGFR BINDING SITE is HOST TARGET binding site found in the 3' untranslated region of mRNA encoded by NGFR, corresponding to a HOST TARGET binding site such as BINDING SITE I, BINDING SITE II or BINDING SITE III. Table 2 illustrates the complementarity of the nucleotide sequences of NGFR BINDING SITE, designated SEQ ID:8332, to the nucleotide sequence of VGAM1621 RNA, herein designated VGAM RNA, also designated SEQ ID:4332.

Another function of VGAM1621 is therefore inhibition of Nerve Growth Factor Receptor (TNFR superfamily, member 16) (NGFR, Accession NM_002507), a gene which can mediate cell survival as well as cell death of neural cells. Accordingly, utilities of VGAM1621 include diagnosis, prevention and treatment of diseases and clinical conditions associated with NGFR. The function of NGFR and its association with various diseases and clinical conditions, has been established by previous studies, as described hereinabove with reference to VGAM212. P21/Cdc42/Rac1-activated Kinase 1 (STE20 homolog, yeast) (PAK1, Accession NM_002576) is another VGAM1621 host target gene. PAK1 BINDING SITE is HOST TARGET binding site found in the 5' untranslated region of mRNA encoded by PAK1, corresponding to a HOST TARGET binding site such as BINDING SITE I, BINDING SITE II or BINDING SITE III. Table 2 illustrates the complementarity of the nucleotide sequences of PAK1 BINDING SITE, designated SEQ ID:8435, to the nucleotide sequence of VGAM1621 RNA, herein designated VGAM RNA, also designated SEQ ID:4332.

Another function of VGAM1621 is therefore inhibition of P21/Cdc42/Rac1-activated Kinase 1 (STE20 homolog, yeast) (PAK1, Accession NM_002576), a gene which activates the Jun N-terminal kinase MAP kinase pathway. Accordingly, utilities of VGAM1621 include diagnosis, prevention and treatment of diseases and clinical conditions associated with PAK1. The function of PAK1 has been established by previous studies. PAK1 protein promotes the disassembly of stress fibers and focal adhesions. Sanders et al. (1999) demonstrated that, in baby hamster kidney-21 and HeLa cells expressing constitutively active PAK1, MLCK (OMIM Ref. No. 600922) activity and myosin light-chain phosphorylation were decreased, and cell spreading was inhibited. These results indicated that MLCK is a target for PAK1, and that PAKs may regulate cytoskeletal dynamics by decreasing MLCK activity and myosin light-chain phosphorylation. Parrini et al. (2002) showed that PAK1 forms homodimers in vivo and that its dimerization is regulated by the intracellular level of GTP-CDC42 (OMIM Ref. No. 116952) or GTP-RAC1 (OMIM Ref. No. 602048). The dimerized PAK1 adopts a trans-inhibited conformation: the N-terminal inhibitory portion of one PAK1 molecule in the dimer binds and inhibits the catalytic domain of the other. One GTPase interaction can result in activation of both partners. Another ligand, beta-PIX (OMIM Ref. No. 605477), can stably associate with dimerized PAK1. Dimerization does not facilitate PAK1 trans-phosphorylation. The authors concluded that the functional significance of dimerization is to allow trans-inhibition. Vadlamudi et al. (2002) identified filamin A (FLNA; 300017) as a binding partner of PAK1 in a yeast 2-hybrid screen of a mammary gland cDNA library. By mutation analysis, they localized the PAK1-binding region in FLNA to tandem repeat 23 in the C terminus, and the FLNA-binding region in PAK1 between amino acids 52 and 132 in the conserved CDC42 (OMIM Ref. No. 116952)/RAC (OMIM Ref. No. 602048)-interacting domain. Endogenous FLNA was phosphorylated by PAK1 on ser2152 following stimulation with physiologic signaling molecules. Following stimulation, FLNA colocalized with PAK1 in membrane ruffles. The ruffle-forming activity of PAK1 was found in FLNA-expressing cells, but not in cells deficient in FLNA.

Full details of the abovementioned studies are described in the following publications, the disclosure of which are hereby incorporated by reference:

Sanders, L. C.; Matsumura, F.; Bokoch, G. M.; de Lanerolle, P.: Inhibition of myosin light chain kinase by p21-activated kinase. Science 283:2083-2085, 1999; and Vadlamudi, R. K.; Li, F.; Adam, L.; Nguyen, D.; Ohta, Y.; Stossel, T. P.; Kumar, R.: Filamin is essential in actin cytoskeletal assembly mediated by p21-activated kinase 1. Nature Cell.

Further studies establishing the function and utilities of PAK1 are found in John Hopkins OMIM database record ID 602590, and in sited publications numbered 8637-1035, 1039-104 and 7264 listed in the bibliography section hereinbelow, which are also hereby incorporated by reference. Protein Tyrosine Phosphatase, Receptor Type, O (PTPRO, Accession NM_030668) is another VGAM1621 host target gene. PTPRO BINDING SITE1 through PTPRO BINDING SITE3 are HOST TARGET binding sites found in untranslated regions of mRNA encoded by PTPRO, corresponding to HOST TARGET binding sites such as BINDING SITE I, BINDING SITE II or BINDING SITE III. Table 2 illustrates the complementarity of the nucleotide sequences of PTPRO BINDING SITE1 through PTPRO BINDING SITE3, designated SEQ ID:25010, SEQ ID:25019 and SEQ ID:25029 respectively, to the nucleotide sequence of VGAM1621 RNA, herein designated VGAM RNA, also designated SEQ ID:4332.

Another function of VGAM1621 is therefore inhibition of Protein Tyrosine Phosphatase, Receptor Type, O (PTPRO, Accession NM_030668), a gene which may function as a cell contact receptor that mediates and controls cell-cell signals. Accordingly, utilities of VGAM1621 include diagnosis, prevention and treatment of diseases and clinical conditions associated with PTPRO. The function of PTPRO and its association with various diseases and clinical conditions, has been established by previous studies, as described hereinabove with reference to VGAM140. SWI/SNF Related, Matrix Associated, Actin Dependent Regulator of Chromatin, Subfamily D, Member 1 (SMARCD1, Accession NM_139071) is another VGAM1621 host target gene. SMARCD1 BINDING SITE1 and SMARCD1 BINDING SITE2 are HOST TARGET binding sites found in untranslated regions of mRNA encoded by SMARCD1, corresponding to HOST TARGET binding sites such as BINDING SITE I, BINDING SITE II or BINDING SITE III. Table 2 illustrates the complementarity of the nucleotide sequences of SMARCD1 BINDING SITE1 and SMARCD1 BINDING SITE2, designated SEQ ID:29144 and SEQ ID:9046 respectively, to the nucleotide sequence of VGAM1621 RNA, herein designated VGAM RNA, also designated SEQ ID:4332.

Another function of VGAM1621 is therefore inhibition of SWI/SNF Related, Matrix Associated, Actin Dependent Regulator of Chromatin, Subfamily D, Member 1 (SMARCD1, Accession NM_139071), a gene which is involved in chromatin assembly and remodeling. Accordingly, utilities of VGAM1621 include diagnosis, prevention and treatment of diseases and clinical conditions associated with SMARCD1. The function of SMARCD1 and its association with various diseases and clinical conditions, has been established by previous studies, as described hereinabove with reference to VGAM152. Chromosome 11 Open Reading Frame 9 (C11orf9, Accession NM_013279) is another VGAM1621 host target gene. C11orf9 BINDING SITE is HOST TARGET binding site found in the 3' untranslated region of mRNA encoded by C11orf9, corresponding to a HOST TARGET binding site such as BINDING SITE I, BINDING SITE II or BINDING SITE III. Table 2 illustrates the complementarity of the nucleotide sequences of C11orf9 BINDING SITE, designated SEQ ID:14944, to the nucleotide sequence of VGAM1621 RNA, herein designated VGAM RNA, also designated SEQ ID:4332.

Another function of VGAM1621 is therefore inhibition of Chromosome 11 Open Reading Frame 9 (C11orf9, Accession NM_013279). Accordingly, utilities of VGAM1621 include diagnosis, prevention and treatment of diseases and clinical conditions associated with C11orf9. Centaurin, Gamma 1 (CENTG1, Accession NM_014770) is another VGAM1621 host target gene. CENTG1 BINDING SITE is HOST TARGET binding site found in the 3' untranslated region of mRNA encoded by CENTG1, corresponding to a HOST TARGET binding site such as BINDING SITE I, BINDING SITE II or BINDING SITE III. Table 2 illustrates the complementarity of the nucleotide sequences of CENTG1 BINDING SITE, designated SEQ ID:16566, to the nucleotide sequence of VGAM1621 RNA, herein designated VGAM RNA, also designated SEQ ID:4332.

Another function of VGAM1621 is therefore inhibition of Centaurin, Gamma 1 (CENTG1, Accession NM_014770). Accordingly, utilities of VGAM1621 include diagnosis, prevention and treatment of diseases and clinical conditions associated with CENTG1. Claudin 6 (CLDN6, Accession NM_021195) is another VGAM1621 host target gene. CLDN6 BINDING SITE is HOST TARGET binding site found in the 3' untranslated region of mRNA encoded by CLDN6, corresponding to a HOST TARGET binding site such as BINDING SITE I, BINDING SITE II or BINDING SITE III. Table 2 illustrates the complementarity of the nucleotide sequences of CLDN6 BINDING SITE, designated SEQ ID:22170, to the nucleotide sequence of VGAM1621 RNA, herein designated VGAM RNA, also designated SEQ ID:4332.

Another function of VGAM1621 is therefore inhibition of Claudin 6 (CLDN6, Accession NM_021195). Accordingly, utilities of VGAM1621 include diagnosis, prevention and treatment of diseases and clinical conditions associated with CLDN6. Diacylglycerol Kinase, Zeta 104 kDa (DGKZ, Accession NM_003646) is another VGAM1621 host target gene. DGKZ BINDING SITE is HOST TARGET binding site found in the 3' untranslated region of mRNA encoded by DGKZ, corresponding to a HOST TARGET binding site such as BINDING SITE I, BINDING SITE II or BINDING SITE III. Table 2 illustrates the complementarity of the nucleotide sequences of DGKZ BINDING SITE, designated SEQ ID:9719, to the nucleotide sequence of VGAM1621 RNA, herein designated VGAM RNA, also designated SEQ ID:4332.

Another function of VGAM1621 is therefore inhibition of Diacylglycerol Kinase, Zeta 104 kDa (DGKZ, Accession NM_003646). Accordingly, utilities of VGAM1621 include diagnosis, prevention and treatment of diseases and clinical conditions associated with DGKZ. DKFZP586P0123 (Accession XM_170681) is another VGAM1621 host target gene. DKFZP586P0123 BINDING SITE is HOST TARGET binding site found in the 5' untranslated region of mRNA encoded by DKFZP586P0123, corresponding to a HOST TARGET binding site such as BINDING SITE I, BINDING SITE II or BINDING SITE III. Table 2 illustrates the complementarity of the nucleotide sequences of DKFZP586P0123 BINDING SITE, designated SEQ ID:45464, to the nucleotide sequence of VGAM1621 RNA, herein designated VGAM RNA, also designated SEQ ID:4332.

Another function of VGAM1621 is therefore inhibition of DKFZP586P0123 (Accession XM_170681). Accordingly, utilities of VGAM1621 include diagnosis, prevention and treatment of diseases and clinical conditions associated with DKFZP586P0123. Erythrocyte Membrane Protein Band 4.1-like 1 (EPB41L1, Accession XM_047295) is another VGAM1621 host target gene. EPB41L1 BINDING SITE is HOST TARGET binding site found in the 3' untranslated region of mRNA encoded by EPB41L1, corresponding to a HOST TARGET binding site such as BINDING SITE I, BINDING SITE II or BINDING SITE III. Table 2 illustrates the complementarity of the nucleotide sequences of EPB41L1 BINDING SITE, designated SEQ ID:34944, to the nucleotide sequence of VGAM1621 RNA, herein designated VGAM RNA, also designated SEQ ID:4332.

Another function of VGAM1621 is therefore inhibition of Erythrocyte Membrane Protein Band 4.1-like 1 (EPB41L1, Accession XM_047295). Accordingly, utilities of VGAM1621 include diagnosis, prevention and treatment of diseases and clinical conditions associated with EPB41L1. FLJ13102 (Accession NM_024887) is another VGAM1621 host target gene. FLJ13102 BINDING SITE is HOST TARGET binding site found in the 3' untranslated region of mRNA encoded by FLJ13102, corresponding to a HOST TARGET binding site such as BINDING SITE I, BINDING SITE II or BINDING SITE III. Table 2 illustrates the complementarity of the nucleotide sequences of FLJ13102 BINDING SITE, designated SEQ ID:24343, to the nucleotide sequence of VGAM1621 RNA, herein designated VGAM RNA, also designated SEQ ID:4332.

Another function of VGAM1621 is therefore inhibition of FLJ13102 (Accession NM_024887). Accordingly, utilities of VGAM1621 include diagnosis, prevention and treatment of diseases and clinical conditions associated with FLJ13102. FLJ13840 (Accession NM_024746) is another VGAM1621 host target gene. FLJ13840 BINDING SITE is HOST TARGET binding site found in the 5' untranslated region of mRNA encoded by FLJ13840, corresponding to a HOST TARGET binding site such as BINDING SITE I, BINDING SITE II or BINDING SITE III. Table 2 illustrates the complementarity of the nucleotide sequences of FLJ13840 BINDING SITE, designated SEQ ID:24081, to the nucleotide sequence of VGAM1621 RNA, herein designated VGAM RNA, also designated SEQ ID:4332.

Another function of VGAM1621 is therefore inhibition of FLJ13840 (Accession NM_024746). Accordingly, utilities of VGAM1621 include diagnosis, prevention and treatment of diseases and clinical conditions associated with FLJ13840. FLJ23040 (Accession NM_025174) is another VGAM1621 host target gene. FLJ23040 BINDING SITE is HOST TARGET binding site found in the 3' untranslated region of mRNA encoded by FLJ23040, corresponding to a HOST TARGET binding site such as BINDING SITE I, BINDING SITE II or BINDING SITE III. Table 2 illustrates the complementarity of the nucleotide sequences of FLJ23040 BINDING SITE, designated SEQ ID:24808, to the nucleotide sequence of VGAM1621 RNA, herein designated VGAM RNA, also designated SEQ ID:4332.

Another function of VGAM1621 is therefore inhibition of FLJ23040 (Accession NM_025174). Accordingly, utilities of VGAM1621 include diagnosis, prevention and treatment of diseases and clinical conditions associated with FLJ23040. GMPPB (Accession XM_171044) is another VGAM1621 host target gene. GMPPB BINDING SITE is HOST TARGET binding site found in the 5' untranslated region of mRNA encoded by GMPPB, corresponding to a HOST TARGET binding site such as BINDING SITE I, BINDING SITE II or BINDING SITE III. Table 2 illustrates the complementarity of the nucleotide sequences of GMPPB BINDING SITE, designated SEQ ID:45813, to the nucleotide sequence of VGAM1621 RNA, herein designated VGAM RNA, also designated SEQ ID:4332.

Another function of VGAM1621 is therefore inhibition of GMPPB (Accession XM_171044). Accordingly, utilities of VGAM1621 include diagnosis, prevention and treatment of diseases and clinical conditions associated with GMPPB. Glycoprotein A33 (transmembrane) (GPA33, Accession NM_005814) is another VGAM1621 host target gene. GPA33 BINDING SITE is HOST TARGET binding site found in the 3' untranslated region of mRNA encoded by GPA33, corresponding to a HOST TARGET binding site such as BINDING SITE I, BINDING SITE II or BINDING SITE III. Table 2 illustrates the complementarity of the nucleotide sequences of GPA33 BINDING SITE, designated SEQ ID:12406, to the nucleotide sequence of VGAM1621 RNA, herein designated VGAM RNA, also designated SEQ ID:4332.

Another function of VGAM1621 is therefore inhibition of Glycoprotein A33 (transmembrane) (GPA33, Accession NM_005814). Accordingly, utilities of VGAM1621 include diagnosis, prevention and treatment of diseases and clinical conditions associated with GPA33. KIAA0720 (Accession XM_030970) is another VGAM1621 host target gene. KIAA0720 BINDING SITE is HOST TARGET binding site found in the 3' untranslated region of mRNA encoded by KIAA0720, corresponding to a HOST TARGET binding site such as BINDING SITE I, BINDING SITE II or BINDING SITE III. Table 2 illustrates the complementarity of the nucleotide sequences of KIAA0720 BINDING SITE, designated SEQ ID:31233, to the nucleotide sequence of VGAM1621 RNA, herein designated VGAM RNA, also designated SEQ ID:4332.

Another function of VGAM1621 is therefore inhibition of KIAA0720 (Accession XM_030970). Accordingly, utilities of VGAM1621 include diagnosis, prevention and treatment of diseases and clinical conditions associated with KIAA0720. KIAA1257 (Accession XM_031577) is another VGAM1621 host target gene. KIAA1257 BINDING SITE1 and KIAA1257 BINDING SITE2 are HOST TARGET binding sites found in untranslated regions of mRNA encoded by KIAA1257, corresponding to HOST TARGET binding sites such as BINDING SITE I, BINDING SITE II or BINDING SITE III. Table 2 illustrates the complementarity of the nucleotide sequences of KIAA1257 BINDING SITE1 and KIAA1257 BINDING SITE2, designated SEQ ID:31432 and SEQ ID:31434 respectively, to the nucleotide sequence of VGAM1621 RNA, herein designated VGAM RNA, also designated SEQ ID:4332.

Another function of VGAM1621 is therefore inhibition of KIAA1257 (Accession XM_031577). Accordingly, utilities of VGAM1621 include diagnosis, prevention and treatment of diseases and clinical conditions associated with KIAA1257. KIAA1649 (Accession NM_032311) is another VGAM1621 host target gene. KIAA1649 BINDING SITE is HOST TARGET binding site found in the 3' untranslated region of mRNA encoded by KIAA1649, corresponding to a HOST TARGET binding site such as BINDING SITE I, BINDING SITE II or BINDING SITE III. Table 2 illustrates the complementarity of the nucleotide sequences of KIAA1649 BINDING SITE, designated SEQ ID:26106, to the nucleotide sequence of VGAM1621 RNA, herein designated VGAM RNA, also designated SEQ ID:4332.

Another function of VGAM1621 is therefore inhibition of KIAA1649 (Accession NM_032311). Accordingly, utilities of VGAM1621 include diagnosis, prevention and treatment of diseases and clinical conditions associated with KIAA1649. KIAA1822 (Accession XM_041566) is another VGAM1621 host target gene. KIAA1822 BINDING SITE is HOST TARGET binding site found in the 3' untranslated region of mRNA encoded by KIAA1822, corresponding to a HOST TARGET binding site such as BINDING SITE I, BINDING SITE II or BINDING SITE III. Table 2 illustrates the complementarity of the nucleotide sequences of KIAA1822 BINDING SITE, designated SEQ ID:33556, to the nucleotide sequence of VGAM1621 RNA, herein designated VGAM RNA, also designated SEQ ID:4332.

Another function of VGAM1621 is therefore inhibition of KIAA1822 (Accession XM_041566). Accordingly, utilities of VGAM1621 include diagnosis, prevention and treatment of diseases and clinical conditions associated with KIAA1822. KIAA1853 (Accession XM_045184) is another VGAM1621 host target gene. KIAA1853 BINDING SITE is HOST TARGET binding site found in the 3' untranslated region of mRNA encoded by KIAA1853, corresponding to a HOST TARGET binding site such as BINDING SITE I, BINDING SITE II or BINDING SITE III. Table 2 illustrates the complementarity of the nucleotide sequences of KIAA1853 BINDING SITE, designated SEQ ID:34385, to the nucleotide sequence of VGAM1621 RNA, herein designated VGAM RNA, also designated SEQ ID:4332.

Another function of VGAM1621 is therefore inhibition of KIAA1853 (Accession XM_045184). Accordingly, utilities of VGAM1621 include diagnosis, prevention and treatment of diseases and clinical conditions associated with KIAA1853. KIAA1944 (Accession XM_062545) is another VGAM1621 host target gene. KIAA1944 BINDING SITE is HOST TARGET binding site found in the 3' untranslated region of mRNA encoded by KIAA1944, corresponding to a HOST TARGET binding site such as BINDING SITE I, BINDING SITE II or BINDING SITE III. Table 2 illustrates the complementarity of the nucleotide sequences of KIAA1944 BINDING SITE, designated SEQ ID:37228, to the nucleotide sequence of VGAM1621 RNA, herein designated VGAM RNA, also designated SEQ ID:4332.

Another function of VGAM1621 is therefore inhibition of KIAA1944 (Accession XM_062545). Accordingly, utilities of VGAM1621 include diagnosis, prevention and treatment of diseases and clinical conditions associated with KIAA1944. MGC2477 (Accession NM_024099) is another VGAM1621 host target gene. MGC2477 BINDING SITE is HOST TARGET binding site found in the 5' untranslated region of mRNA encoded by MGC2477, corresponding to a HOST TARGET binding site such as BINDING SITE I, BINDING SITE II or BINDING SITE III. Table 2 illustrates the complementarity of the nucleotide sequences of MGC2477 BINDING SITE, designated SEQ ID:23545, to the nucleotide sequence of VGAM1621 RNA, herein designated VGAM RNA, also designated SEQ ID:4332.

Another function of VGAM1621 is therefore inhibition of MGC2477 (Accession NM_024099). Accordingly, utilities of VGAM1621 include diagnosis, prevention and treatment of diseases and clinical conditions associated with MGC2477. Oxysterol Binding Protein-like 3 (OSBPL3, Accession NM_015550) is another VGAM1621 host target gene. OSBPL3 BINDING SITE is HOST TARGET binding site found in the 3' untranslated region of mRNA encoded by OSBPL3, corresponding to a HOST TARGET binding site such as BINDING SITE I, BINDING SITE II or BINDING SITE III. Table 2 illustrates the complementarity of the nucleotide sequences of OSBPL3 BINDING SITE, designated SEQ ID:17816, to the nucleotide sequence of VGAM1621 RNA, herein designated VGAM RNA, also designated SEQ ID:4332.

Another function of VGAM1621 is therefore inhibition of Oxysterol Binding Protein-like 3 (OSBPL3, Accession NM_015550). Accordingly, utilities of VGAM1621 include diagnosis, prevention and treatment of diseases and clinical conditions associated with OSBPL3. TSPAN-5 (Accession NM_005723) is another VGAM1621 host target gene. TSPAN-5 BINDING SITE is HOST TARGET binding site found in the 5' untranslated region of mRNA encoded by TSPAN-5, corresponding to a HOST TARGET binding site such as BINDING SITE I, BINDING SITE II or BINDING SITE III. Table 2 illustrates the complementarity of the nucleotide sequences of TSPAN-5 BINDING SITE, designated SEQ ID:12275, to the nucleotide sequence of VGAM1621 RNA, herein designated VGAM RNA, also designated SEQ ID:4332.

Another function of VGAM1621 is therefore inhibition of TSPAN-5 (Accession NM_005723). Accordingly, utilities of VGAM1621 include diagnosis, prevention and treatment of diseases and clinical conditions associated with TSPAN-5. VILL (Accession XM_043435) is another VGAM1621 host target gene. VILL BINDING SITE is HOST TARGET binding site found in the 3' untranslated region of mRNA encoded by VILL, corresponding to a HOST TARGET binding site such as BINDING SITE I, BINDING SITE II or BINDING SITE III. Table 2 illustrates the complementarity of the nucleotide sequences of VILL BINDING SITE, designated SEQ ID:33946, to the nucleotide sequence of VGAM1621 RNA, herein designated VGAM RNA, also designated SEQ ID:4332.

Another function of VGAM1621 is therefore inhibition of VILL (Accession XM_043435). Accordingly, utilities of VGAM1621 include diagnosis, prevention and treatment of diseases and clinical conditions associated with VILL. LOC112616 (Accession NM_138410) is another VGAM1621 host target gene. LOC112616 BINDING SITE is HOST TARGET binding site found in the 3' untranslated region of mRNA encoded by LOC112616, corresponding to a HOST TARGET binding site such as BINDING SITE I, BINDING SITE II or BINDING SITE III. Table 2 illustrates the complementarity of the nucleotide sequences of LOC112616 BINDING SITE, designated SEQ ID:28773, to the nucleotide sequence of VGAM1621 RNA, herein designated VGAM RNA, also designated SEQ ID:4332.

Another function of VGAM1621 is therefore inhibition of LOC112616 (Accession NM_138410). Accordingly, utilities of VGAM1621 include diagnosis, prevention and treatment of diseases and clinical conditions associated with LOC112616. LOC126528 (Accession XM_059052) is another VGAM1621 host target gene. LOC126528 BINDING SITE is HOST TARGET binding site found in the 5' untranslated region of mRNA encoded by LOC126528, corresponding to a HOST TARGET binding site such as BINDING SITE I, BINDING SITE II or BINDING SITE III. Table 2 illustrates the complementarity of the nucleotide sequences of LOC126528 BINDING SITE, designated SEQ ID:36843, to the nucleotide sequence of VGAM1621 RNA, herein designated VGAM RNA, also designated SEQ ID:4332.

Another function of VGAM1621 is therefore inhibition of LOC126528 (Accession XM_059052). Accordingly, utilities of VGAM1621 include diagnosis, prevention and treatment of diseases and clinical conditions associated with LOC126528. LOC146268 (Accession XM_085397) is another VGAM1621 host target gene. LOC146268 BINDING SITE is HOST TARGET binding site found in the 3' untranslated region of mRNA encoded by LOC146268, corresponding to a HOST TARGET binding site such as BINDING SITE I, BINDING SITE II or BINDING SITE III. Table 2 illustrates the complementarity of the nucleotide sequences of LOC146268 BINDING SITE, designated SEQ ID:38122, to the nucleotide sequence of VGAM1621 RNA, herein designated VGAM RNA, also designated SEQ ID:4332.

Another function of VGAM1621 is therefore inhibition of LOC146268 (Accession XM_085397). Accordingly, utilities of VGAM1621 include diagnosis, prevention and treatment of diseases and clinical conditions associated with LOC146268. LOC147165 (Accession XM_097205) is another VGAM1621 host target gene. LOC147165 BINDING SITE is HOST TARGET binding site found in the 5' untranslated region of mRNA encoded by LOC147165, corresponding to a HOST TARGET binding site such as BINDING SITE I, BINDING SITE II or BINDING SITE III. Table 2 illustrates the complementarity of the nucleotide sequences of LOC147165 BINDING SITE, designated SEQ ID:40813, to the nucleotide sequence of VGAM1621 RNA, herein designated VGAM RNA, also designated SEQ ID:4332.

Another function of VGAM1621 is therefore inhibition of LOC147165 (Accession XM_097205). Accordingly, utilities of VGAM1621 include diagnosis, prevention and treatment of diseases and clinical conditions associated with LOC147165. LOC153020 (Accession XM_087578) is another VGAM1621 host target gene. LOC153020 BINDING SITE is HOST TARGET binding site found in the 3' untranslated region of mRNA encoded by LOC153020, corresponding to a HOST TARGET binding site such as BINDING SITE I, BINDING SITE II or BINDING SITE III. Table 2 illustrates the complementarity of the nucleotide sequences of LOC153020 BINDING SITE, designated SEQ ID:39355, to the nucleotide sequence of VGAM1621 RNA, herein designated VGAM RNA, also designated SEQ ID:4332.

Another function of VGAM1621 is therefore inhibition of LOC153020 (Accession XM_087578). Accordingly, utilities of VGAM1621 include diagnosis, prevention and treatment of diseases and clinical conditions associated with LOC153020. LOC222237 (Accession XM_168592) is another VGAM1621 host target gene. LOC222237 BINDING SITE is HOST TARGET binding site found in the 3' untranslated region of mRNA encoded by LOC222237, corresponding to a HOST TARGET binding site such as BINDING SITE I, BINDING SITE II or BINDING SITE III. Table 2 illustrates the complementarity of the nucleotide sequences of LOC222237 BINDING SITE, designated SEQ ID:45268, to the nucleotide sequence of VGAM1621 RNA, herein designated VGAM RNA, also designated SEQ ID:4332.

Another function of VGAM1621 is therefore inhibition of LOC222237 (Accession XM_168592). Accordingly, utilities of VGAM1621 include diagnosis, prevention and treatment of diseases and clinical conditions associated with LOC222237. LOC253868 (Accession XM_170975) is another VGAM1621 host target gene. LOC253868 BINDING SITE is HOST TARGET binding site found in the 5' untranslated region of mRNA encoded by LOC253868, corresponding to a HOST TARGET binding site such as BINDING SITE I, BINDING SITE II or BINDING SITE III. Table 2 illustrates the complementarity of the nucleotide sequences of LOC253868 BINDING SITE, designated SEQ ID:45748, to the nucleotide sequence of VGAM1621 RNA, herein designated VGAM RNA, also designated SEQ ID:4332.

Another function of VGAM1621 is therefore inhibition of LOC253868 (Accession XM_170975). Accordingly, utilities of VGAM1621 include diagnosis, prevention and treatment of diseases and clinical conditions associated with LOC253868. LOC51246 (Accession NM_016479) is another VGAM1621 host target gene. LOC51246 BINDING SITE is HOST TARGET binding site found in the 3' untranslated region of mRNA encoded by LOC51246, corresponding to a HOST TARGET binding site such as BINDING SITE I, BINDING SITE II or BINDING SITE III. Table 2 illustrates the complementarity of the nucleotide sequences of LOC51246 BINDING SITE, designated SEQ ID:18578, to the nucleotide sequence of VGAM1621 RNA, herein designated VGAM RNA, also designated SEQ ID:4332.

Another function of VGAM1621 is therefore inhibition of LOC51246 (Accession NM_016479). Accordingly, utilities of VGAM1621 include diagnosis, prevention and treatment of diseases and clinical conditions associated with LOC51246. LOC51667 (Accession NM_016118) is another VGAM1621 host target gene. LOC51667 BINDING SITE is HOST TARGET binding site found in the 3' untranslated region of mRNA encoded by LOC51667, corresponding to a HOST TARGET binding site such as BINDING SITE I, BINDING SITE II or BINDING SITE III. Table 2 illustrates the complementarity of the nucleotide sequences of LOC51667 BINDING SITE, designated SEQ ID:18197, to the nucleotide sequence of VGAM1621 RNA, herein designated VGAM RNA, also designated SEQ ID:4332.

Another function of VGAM1621 is therefore inhibition of LOC51667 (Accession NM_016118). Accordingly, utilities of VGAM1621 include diagnosis, prevention and treatment of diseases and clinical conditions associated with LOC51667. LOC92223 (Accession XM_043674) is another VGAM1621 host target gene. LOC92223 BINDING SITE is HOST TARGET binding site found in the 5' untranslated region of mRNA encoded by LOC92223, corresponding to a HOST TARGET binding site such as BINDING SITE I, BINDING SITE II or BINDING SITE III. Table 2 illustrates the complementarity of the nucleotide sequences of LOC92223 BINDING SITE, designated SEQ ID:33993, to the nucleotide sequence of VGAM1621 RNA, herein designated VGAM RNA, also designated SEQ ID:4332.

Another function of VGAM1621 is therefore inhibition of LOC92223 (Accession XM_043674). Accordingly, utilities of VGAM1621 include diagnosis, prevention and treatment of diseases and clinical conditions associated with LOC92223. LOC93259 (Accession XM_050105) is another VGAM1621 host target gene. LOC93259 BINDING SITE is HOST TARGET binding site found in the 5' untranslated region of mRNA encoded by LOC93259, corresponding to a HOST TARGET binding site such as BINDING SITE I, BINDING SITE II or BINDING SITE III. Table 2 illustrates the complementarity of the nucleotide sequences of LOC93259 BINDING SITE, designated SEQ ID:35562, to the nucleotide sequence of VGAM1621 RNA, herein designated VGAM RNA, also designated SEQ ID:4332.

Another function of VGAM1621 is therefore inhibition of LOC93259 (Accession XM_050105). Accordingly, utilities of VGAM1621 include diagnosis, prevention and treatment of diseases and clinical conditions associated with LOC93259. LOC93512 (Accession XM_051758) is another VGAM1621 host target gene. LOC93512 BINDING SITE is HOST TARGET binding site found in the 5' untranslated region of mRNA encoded by LOC93512, corresponding to a HOST TARGET binding site such as BINDING SITE I, BINDING SITE II or BINDING SITE III. Table 2 illustrates the complementarity of the nucleotide sequences of LOC93512 BINDING SITE, designated SEQ ID:35877, to the nucleotide sequence of VGAM1621 RNA, herein designated VGAM RNA, also designated SEQ ID:4332.

Another function of VGAM1621 is therefore inhibition of LOC93512 (Accession XM_051758). Accordingly, utilities of VGAM1621 include diagnosis, prevention and treatment of diseases and clinical conditions associated with LOC93512. FIG. 1 further provides a conceptual description of a novel bioinformatically detected viral gene of the present invention, referred to here as Viral Genomic Address Messenger 1622 (VGAM1622) viral gene, which modulates expression of respective host target genes thereof, the function and utility of which host target genes is known in the art.

VGAM1622 is a novel bioinformatically detected regulatory, non protein coding, viral micro RNA (miRNA) gene. The method by which VGAM1622 was detected is described hereinabove with reference to FIGS. 1-8.

VGAM1622 gene, herein designated VGAM GENE, is a viral gene contained in the genome of Bovine Herpesvirus 4. VGAM1622 host target gene, herein designated VGAM HOST TARGET GENE, is a human gene contained in the human genome.

VGAM1622 gene encodes a VGAM1622 precursor RNA, herein designated VGAM PRECURSOR RNA. Similar to other miRNA genes, and unlike most ordinary genes, VGAM1622 precursor RNA does not encode a protein. A nucleotide sequence identical or highly similar to the nucleotide sequence of VGAM1622 precursor RNA is designated SEQ ID:1608, and is provided hereinbelow with reference to the sequence listing part. Nucleotide sequence SEQ ID:1608 is located at position 87319 relative to the genome of Bovine Herpesvirus 4.

VGAM1622 precursor RNA folds onto itself, forming VGAM1622 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1622 folded precursor RNA into VGAM1622 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1622 RNA is designated SEQ ID:4333, and is provided hereinbelow with reference to the sequence listing part.

VGAM1622 host target gene, herein designated VGAM HOST TARGET GENE, encodes a corresponding messenger RNA, VGAM1622 host target RNA, herein designated VGAM HOST TARGET RNA. VGAM1622 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1622 RNA, herein designated VGAM RNA, binds complementarily to one or more host target binding sites located in untranslated regions of VGAM1622 host target RNA, herein designated VGAM HOST TARGET RNA. This complementary binding is due to the fact that the nucleotide sequence of VGAM1622 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1622 RNA, herein designated VGAM RNA, may have a different number of host target binding sites in untranslated regions of a VGAM1622 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1622 RNA, herein designated VGAM RNA, to host target binding sites on VGAM1622 host target RNA, herein designated VGAM HOST TARGET RNA, such as BINDING SITE I, BINDING SITE II and BINDING SITE III, inhibits translation of VGAM1622 host target RNA into VGAM1622 host target protein, herein designated VGAM HOST TARGET PROTEIN. VGAM host target protein is therefore outlined by a broken line.

It is appreciated that VGAM1622 host target gene, herein designated VGAM HOST TARGET GENE, in fact represents a plurality of VGAM1622 host target genes. The mRNA of each one of this plurality of VGAM1622 host target genes comprises one or more host target binding sites, each having a nucleotide sequence which is at least partly complementary to VGAM1622 RNA, herein designated VGAM RNA, and which when bound by VGAM1622 RNA causes inhibition of translation of respective one or more VGAM1622 host target proteins.

It is further appreciated by one skilled in the art that the mode of translational inhibition illustrated by FIG. 1 with specific reference to translational inhibition exerted by VGAM1622 gene, herein designated VGAM GENE, on one or more VGAM1622 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1622 is inhibition of expression of host target genes, as part of a novel viral mechanism of attacking a host. Accordingly, utilities of VGAM1622 include diagnosis, prevention and treatment of viral infection by Bovine Herpesvirus 4. Specific functions, and accordingly utilities, of VGAM1622 correlate with, and may be deduced from, the identity of the host target genes which VGAM1622 binds and inhibits, and the function of these host target genes, as elaborated hereinbelow.

Nucleotide sequences of the VGAM1622 precursor RNA, herein designated VGAM PRECURSOR RNA, and of the 'diced' VGAM1622 RNA, herein designated VGAM RNA, and a schematic representation of the secondary folding of VGAM1622 folded precursor RNA, herein designated VGAM FOLDED PRECURSOR RNA, of VGAM1622 are further described hereinbelow with reference to Table 1.

Nucleotide sequences of host target binding sites, such as BINDING SITE-I, BINDING SITE-II and BINDING SITE-III of FIG. 1, found on VGAM1622 host target RNA, and schematic representation of the complementarity of each of these host target binding sites to VGAM1622 RNA, herein designated VGAM RNA, are described hereinbelow with reference to Table 2.

As mentioned hereinabove with reference to FIG. 1, a function of VGAM1622 gene, herein designated VGAM is inhibition of expression of VGAM1622 target genes. It is appreciated that specific functions, and accordingly utilities, of VGAM1622 correlate with, and may be deduced from, the identity of the target genes which VGAM1622 binds and inhibits, and the function of these target genes, as elaborated hereinbelow.

Calcium/calmodulin-dependent Protein Kinase IV (CAMK4, Accession NM_001744) is a VGAM1622 host target gene. CAMK4 BINDING SITE is HOST TARGET binding site found in the 3' untranslated region of mRNA encoded by CAMK4, corresponding to a HOST TARGET binding site such as BINDING SITE I, BINDING SITE II or BINDING SITE III. Table 2 illustrates the complementarity of the nucleotide sequences of CAMK4 BINDING SITE, designated SEQ ID:7483, to the nucleotide sequence of VGAM1622 RNA, herein designated VGAM RNA, also designated SEQ ID:4333.

A function of VGAM1622 is therefore inhibition of Calcium/calmodulin-dependent Protein Kinase IV (CAMK4, Accession NM_001744), a gene which is a heat-stable, acidic, calmodulin-binding protein. Accordingly, utilities of VGAM1622 include diagnosis, prevention and treatment of diseases and clinical conditions associated with CAMK4. The function of CAMK4 and its association with various diseases and clinical conditions, has been established by previous studies, as described hereinabove with reference to VGAM578. Death Effector Domain Containing (DEDD, Accession NM_032998) is another VGAM1622 host target gene. DEDD BINDING SITE is HOST TARGET binding site found in the 3' untranslated region of mRNA encoded by DEDD, corresponding to a HOST TARGET binding site such as BINDING SITE I, BINDING SITE II or BINDING SITE III. Table 2 illustrates the complementarity of the nucleotide sequences of DEDD BINDING SITE, designated SEQ ID:26882, to the nucleotide sequence of VGAM1622 RNA, herein designated VGAM RNA, also designated SEQ ID:4333.

Another function of VGAM1622 is therefore inhibition of Death Effector Domain Containing (DEDD, Accession NM_032998), a gene which intervenes in apoptosis. Accordingly, utilities of VGAM1622 include diagnosis, prevention and treatment of diseases and clinical conditions associated with DEDD. The function of DEDD and its association with various diseases and clinical conditions, has been established by previous studies, as described hereinabove with reference to VGAM1189. Mitogen-activated Protein Kinase Kinase Kinase 5 (MAP3K5, Accession NM_005923) is another VGAM1622 host target gene. MAP3K5 BINDING SITE is HOST TARGET binding site found in the 3' untranslated region of mRNA encoded by MAP3K5, corresponding to a HOST TARGET binding site such as BINDING SITE I, BINDING SITE II or BINDING SITE III. Table 2 illustrates the complementarity of the nucleotide sequences of MAP3K5 BINDING SITE, designated SEQ ID:12545, to the nucleotide sequence of VGAM1622 RNA, herein designated VGAM RNA, also designated SEQ ID:4333.

Another function of VGAM1622 is therefore inhibition of Mitogen-activated Protein Kinase Kinase Kinase 5 (MAP3K5, Accession NM_005923), a gene which phosphorylates and activates two different subgroups of map kinase kinases, mkk4/sek1 and mkk3/mapkk6 (or mkk6).overexpression induces apoptotic cell death. Accordingly, utilities of VGAM1622 include diagnosis, prevention and treatment of diseases and clinical conditions associated with MAP3K5. The function of MAP3K5 has been established by previous studies. Mitogen-activated protein kinase (MAPK) signaling cascades include MAPK or extracellular signal-regulated kinase (ERK), MAPK kinase (MAP2K, also called MKK or MEK), and MAPK kinase kinase (MAP3K, also called MAPKKK or MEKK). MAPKK kinase/MEKK phosphorylates and activates its downstream protein kinase, MAPK kinase/MEK, which in turn activates MAPK. The kinases of these signaling cascades are highly conserved, and homologs exist in yeast, Drosophila, and mammalian cells Ichijo et al. (1997) used a similar cloning strategy to identify a nearly identical MAPKKK cDNA, termed ASK1 for apoptosis signal-regulating kinase. The deduced protein contains 1,375 amino acids, and is most closely related to yeast SSK2 and SSK22, which are upstream regulators of yeast HOG1 MAPK. ASK1 expression complements a yeast mutant lacking functional SSK2 and SSK22. ASK1 also activates MKK3 (OMIM Ref. No. 602315), MKK4 (SEK1), and MKK6 (OMIM Ref. No. 601254). Overexpression of ASK1 induces apoptotic cell death, and ASK1 is activated in cells treated with tumor necrosis factor-alpha (TNFA; 191160). Nishitoh et al. (1998) showed that ASK1 interacts with members of the TRAF family and is activated by TRAF2 (OMIM Ref. No. 601895) in the TNF-signaling pathway. After activation by TRAF2, ASK1 activates MKK4, which in turn activates JNK. Thus, ASK1 is a mediator of TRAF2-induced JNK activation. Animal model experiments lend further support to the function of MAP3K5. Using a forward genetic screen of C. elegans mutants, Kim et al. (2002) showed that viable worms lacking esp2 and esp8, homologs of the mammalian MAP kinases SEK1 and ASK1, were highly susceptible to and died more rapidly from both a gram-negative bacterium, P. aeruginosa, and a gram-positive organism, E. faecalis, than wildtype worms. RNA-interference and biochemical analyses likewise implicated the p38 MAP kinase homolog, pmk1, in susceptibility to these pathogens. Kim et al. (2002) concluded that MAP kinase signaling, which is also involved in plant pathogen resistance, is a conserved element in innate metazoan immunity to diverse pathogens.

It is appreciated that the abovementioned animal model for MAP3K5 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kim, D. H.; Feinbaum, R.; Alloing, G.; Emerson, F. E.; Garsin, D. A.; Inoue, H.; Tanaka-Hino, M.; Hisamoto, N.; Matsumoto, K.; Tan, M.-W.; Ausubel, F. M.: A conserved p38 MAP kinase pathway in Caenorhabditis elegans innate immunity. Science 297:623-626, 2002; and Nishitoh, H.; Saitoh, M.; Mochida, Y.; Takeda, K.; Nakano, H.; Rothe, M.; Miyazono, K.; Ichijo, H.: ASK1 is essential for JNK/SAPK activation by TRAF2. Molec. Cell 2:389-395, 1998.

Further studies establishing the function and utilities of MAP3K5 are found in John Hopkins OMIM database record ID 602448, and in sited publications numbered 5869-5871, 10126, 12537, 10348, 1035 and 6315 listed in the bibliography section hereinbelow, which are also hereby incorporated by reference. Prolactin Receptor (PRLR, Accession NM_000949) is another VGAM1622 host target gene. PRLR BINDING SITE is HOST TARGET binding site found in the 5' untranslated region of mRNA encoded by PRLR, corresponding to a HOST TARGET binding site such as BINDING SITE I, BINDING SITE II or BINDING SITE III. Table 2 illustrates the complementarity of the nucleotide sequences of PRLR BINDING SITE, designated SEQ ID:6650, to the nucleotide sequence of VGAM1622 RNA, herein designated VGAM RNA, also designated SEQ ID:4333.

Another function of VGAM1622 is therefore inhibition of Prolactin Receptor (PRLR, Accession NM_000949), a gene which is a receptor for the anterior pituitary hormone prolactin. Accordingly, utilities of VGAM1622 include diagnosis, prevention and treatment of diseases and clinical conditions associated with PRLR. The function of PRLR and its association with various diseases and clinical conditions, has been established by previous studies, as described hereinabove with reference to VGAM80. KIAA0310 (Accession XM_088459) is another VGAM1622 host target gene. KIAA0310 BINDING SITE is HOST TARGET binding site found in the 3' untranslated region of mRNA encoded by KIAA0310, corresponding to a HOST TARGET binding site such as BINDING SITE I, BINDING SITE II or BINDING SITE III. Table 2 illustrates the complementarity of the nucleotide sequences of KIAA0310 BINDING SITE, designated SEQ ID:39711, to the nucleotide sequence of VGAM1622 RNA, herein designated VGAM RNA, also designated SEQ ID:4333.

Another function of VGAM1622 is therefore inhibition of KIAA0310 (Accession XM_088459). Accordingly, utilities of VGAM1622 include diagnosis, prevention and treatment of diseases and clinical conditions associated with KIAA0310. FIG. 1 further provides a conceptual description of a novel bioinformatically detected viral gene of the present invention, referred to here as Viral Genomic Address Messenger 1623 (VGAM1623) viral gene, which modulates expression of respective host target genes thereof, the function and utility of which host target genes is known in the art.

VGAM1623 is a novel bioinformatically detected regulatory, non protein coding, viral micro RNA (miRNA) gene. The method by which VGAM1623 was detected is described hereinabove with reference to FIGS. 1-8.

VGAM1623 gene, herein designated VGAM GENE, is a viral gene contained in the genome of Bovine Herpesvirus 4. VGAM1623 host target gene, herein designated VGAM HOST TARGET GENE, is a human gene contained in the human genome.

VGAM1623 gene encodes a VGAM1623 precursor RNA, herein designated VGAM PRECURSOR RNA. Similar to other miRNA genes, and unlike most ordinary genes, VGAM1623 precursor RNA does not encode a protein. A nucleotide sequence identical or highly similar to the nucleotide sequence of VGAM1623 precursor RNA is designated SEQ ID:1609, and is provided hereinbelow with reference to the sequence listing part. Nucleotide sequence SEQ ID:1609 is located at position 83968 relative to the genome of Bovine Herpesvirus 4.

VGAM1623 precursor RNA folds onto itself, forming VGAM1623 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1623 folded precursor RNA into VGAM1623 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1623 RNA is designated SEQ ID:4334, and is provided hereinbelow with reference to the sequence listing part.

VGAM1623 host target gene, herein designated VGAM HOST TARGET GENE, encodes a corresponding messenger RNA, VGAM1623 host target RNA, herein designated VGAM HOST TARGET RNA. VGAM1623 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1623 RNA, herein designated VGAM RNA, binds complementarily to one or more host target binding sites located in untranslated regions of VGAM1623 host target RNA, herein designated VGAM HOST TARGET RNA. This complementary binding is due to the fact that the nucleotide sequence of VGAM1623 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1623 RNA, herein designated VGAM RNA, may have a different number of host target binding sites in untranslated regions of a VGAM1623 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1623 RNA, herein designated VGAM RNA, to host target binding sites on VGAM1623 host target RNA, herein designated VGAM HOST TARGET RNA, such as BINDING SITE I, BINDING SITE II and BINDING SITE III, inhibits translation of VGAM1623 host target RNA into VGAM1623 host target protein, herein designated VGAM HOST TARGET PROTEIN. VGAM host target protein is therefore outlined by a broken line.

It is appreciated that VGAM1623 host target gene, herein designated VGAM HOST TARGET GENE, in fact represents a plurality of VGAM1623 host target genes. The mRNA of each one of this plurality of VGAM1623 host target genes comprises one or more host target binding sites, each having a nucleotide sequence which is at least partly complementary to VGAM1623 RNA, herein designated VGAM RNA, and which when bound by VGAM1623 RNA causes inhibition of translation of respective one or more VGAM1623 host target proteins.

It is further appreciated by one skilled in the art that the mode of translational inhibition illustrated by FIG. 1 with specific reference to translational inhibition exerted by VGAM1623 gene, herein designated VGAM GENE, on one or more VGAM1623 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1623 is inhibition of expression of host target genes, as part of a novel viral mechanism of attacking a host. Accordingly, utilities of VGAM1623 include diagnosis, prevention and treatment of viral infection by Bovine Herpesvirus 4. Specific functions, and accordingly utilities, of VGAM1623 correlate with, and may be deduced from, the identity of the host target genes which VGAM1623 binds and inhibits, and the function of these host target genes, as elaborated hereinbelow.

Nucleotide sequences of the VGAM1623 precursor RNA, herein designated VGAM PRECURSOR RNA, and of the 'diced' VGAM1623 RNA, herein designated VGAM RNA, and a schematic representation of the secondary folding of VGAM1623 folded precursor RNA, herein designated VGAM FOLDED PRECURSOR RNA, of VGAM1623 are further described hereinbelow with reference to Table 1.

Nucleotide sequences of host target binding sites, such as BINDING SITE-I, BINDING SITE-II and BINDING SITE-III of FIG. 1, found on VGAM1623 host target RNA, and schematic representation of the complementarity of each of these host target binding sites to VGAM1623 RNA, herein designated VGAM RNA, are described hereinbelow with reference to Table 2.

As mentioned hereinabove with reference to FIG. 1, a function of VGAM1623 gene, herein designated VGAM is inhibition of expression of VGAM1623 target genes. It is appreciated that specific functions, and accordingly utilities, of VGAM1623 correlate with, and may be deduced from, the identity of the target genes which VGAM1623 binds and inhibits, and the function of these target genes, as elaborated hereinbelow.

FLJ23323 (Accession NM_024654) is a VGAM1623 host target gene. FLJ23323 BINDING SITE is HOST TARGET binding site found in the 3' untranslated region of mRNA encoded by FLJ23323, corresponding to a HOST TARGET binding site such as BINDING SITE I, BINDING SITE II or BINDING SITE III. Table 2 illustrates the complementarity of the nucleotide sequences of FLJ23323 BINDING SITE, designated SEQ ID:23954, to the nucleotide sequence of VGAM1623 RNA, herein designated VGAM RNA, also designated SEQ ID:4334.

A function of VGAM1623 is therefore inhibition of FLJ23323 (Accession NM_024654). Accordingly, utilities of VGAM1623 include diagnosis, prevention and treatment of diseases and clinical conditions associated with FLJ23323. HSC3 (Accession NM_145174) is another VGAM1623 host target gene. HSC3 BINDING SITE is HOST TARGET binding site found in the 3' untranslated region of mRNA encoded by HSC3, corresponding to a HOST TARGET binding site such as BINDING SITE I, BINDING SITE II or BINDING SITE III. Table 2 illustrates the complementarity of the nucleotide sequences of HSC3 BINDING SITE, designated SEQ ID:29733, to the nucleotide sequence of VGAM1623 RNA, herein designated VGAM RNA, also designated SEQ ID:4334.

Another function of VGAM1623 is therefore inhibition of HSC3 (Accession NM_145174). Accordingly, utilities of VGAM1623 include diagnosis, prevention and treatment of diseases and clinical conditions associated with HSC3. LOC145623 (Accession XM_096822) is another VGAM1623 host target gene. LOC145623 BINDING SITE is HOST TARGET binding site found in the 5' untranslated region of mRNA encoded by LOC145623, corresponding to a HOST TARGET binding site such as BINDING SITE I, BINDING SITE II or BINDING SITE III. Table 2 illustrates the complementarity of the nucleotide sequences of LOC145623 BINDING SITE, designated SEQ ID:40546, to the nucleotide sequence of VGAM1623 RNA, herein designated VGAM RNA, also designated SEQ ID:4334.

Another function of VGAM1623 is therefore inhibition of LOC145623 (Accession XM_096822). Accordingly, utilities of VGAM1623 include diagnosis, prevention and treatment of diseases and clinical conditions associated with LOC145623. FIG. 1 further provides a conceptual description of a novel bioinformatically detected viral gene of the present invention, referred to here as Viral Genomic Address Messenger 1624 (VGAM1624) viral gene, which modulates expression of respective host target genes thereof, the function and utility of which host target genes is known in the art.

VGAM1624 is a novel bioinformatically detected regulatory, non protein coding, viral micro RNA (miRNA) gene. The method by which VGAM1624 was detected is described hereinabove with reference to FIGS. 1-8.

VGAM1624 gene, herein designated VGAM GENE, is a viral gene contained in the genome of Bovine Herpesvirus 4. VGAM1624 host target gene, herein designated VGAM HOST TARGET GENE, is a human gene contained in the human genome.

VGAM1624 gene encodes a VGAM1624 precursor RNA, herein designated VGAM PRECURSOR RNA. Similar to other miRNA genes, and unlike most ordinary genes, VGAM1624 precursor RNA does not encode a protein. A nucleotide sequence identical or highly similar to the nucleotide sequence of VGAM1624 precursor RNA is designated SEQ ID:1610, and is provided hereinbelow with reference to the sequence listing part. Nucleotide sequence SEQ ID:1610 is located at position 86638 relative to the genome of Bovine Herpesvirus 4.

VGAM1624 precursor RNA folds onto itself, forming VGAM1624 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1624 folded precursor RNA into VGAM1624 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM1624 RNA is designated SEQ ID:4335, and is provided hereinbelow with reference to the sequence listing part.

VGAM1624 host target gene, herein designated VGAM HOST TARGET GENE, encodes a corresponding messenger RNA, VGAM1624 host target RNA, herein designated VGAM HOST TARGET RNA. VGAM1624 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1624 RNA, herein designated VGAM RNA, binds complementarily to one or more host target binding sites located in untranslated regions of VGAM1624 host target RNA, herein designated VGAM HOST TARGET RNA. This complementary binding is due to the fact that the nucleotide sequence of VGAM1624 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1624 RNA, herein designated VGAM RNA, may have a different number of host target binding sites in untranslated regions of a VGAM1624 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1624 RNA, herein designated VGAM RNA, to host target binding sites on VGAM1624 host target RNA, herein designated VGAM HOST TARGET RNA, such as BINDING SITE I, BINDING SITE II and BINDING SITE III, inhibits translation of VGAM1624 host target RNA into VGAM1624 host target protein, herein designated VGAM HOST TARGET PROTEIN. VGAM host target protein is therefore outlined by a broken line.

It is appreciated that VGAM1624 host target gene, herein designated VGAM HOST TARGET GENE, in fact represents a plurality of VGAM1624 host target genes. The mRNA of each one of this plurality of VGAM1624 host target genes comprises one or more host target binding sites, each having a nucleotide sequence which is at least partly complementary to VGAM1624 RNA, herein designated VGAM RNA, and which when bound by VGAM1624 RNA causes inhibition of translation of respective one or more VGAM1624 host target proteins.

It is further appreciated by one skilled in the art that the mode of translational inhibition illustrated by FIG. 1 with specific reference to translational inhibition exerted by VGAM1624 gene, herein designated VGAM GENE, on one or more VGAM1624 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1624 is inhibition of expression of host target genes, as part of a novel viral mechanism of attacking a host. Accordingly, utilities of VGAM1624 include diagnosis, prevention and treatment of viral infection by Bovine Herpesvirus 4. Specific functions, and accordingly utilities, of VGAM1624 correlate with, and may be deduced from, the identity of the host target genes which VGAM1624 binds and inhibits, and the function of these host target genes, as elaborated hereinbelow.

Nucleotide sequences of the VGAM1624 precursor RNA, herein designated VGAM PRECURSOR RNA, and of the 'diced' VGAM1624 RNA, herein designated VGAM RNA, and a schematic representation of the secondary folding of VGAM1624 folded precursor RNA, herein designated VGAM FOLDED PRECURSOR RNA, of VGAM1624 are further described hereinbelow with reference to Table 1.

Nucleotide sequences of host target binding sites, such as BINDING SITE-I, BINDING SITE-II and BINDING SITE-III of FIG. 1, found on VGAM1624 host target RNA, and schematic representation of the complementarity of each of these host target binding sites to VGAM1624 RNA, herein designated VGAM RNA, are described hereinbelow with reference to Table 2.

As mentioned hereinabove with reference to FIG. 1, a function of VGAM1624 gene, herein designated VGAM is inhibition of expression of VGAM1624 target genes. It is appreciated that specific functions, and accordingly utilities, of VGAM1624 correlate with, and may be deduced from, the identity of the target genes which VGAM1624 binds and inhibits, and the function of these target genes, as elaborated hereinbelow.

B-cell CLL/lymphoma 2 (BCL2, Accession NM_000633) is a VGAM1624 host target gene. BCL2 BINDING SITE is HOST TARGET binding site found in the 3' untranslated region of mRNA encoded by BCL2, corresponding to a HOST TARGET binding site such as BINDING SITE I, BINDING SITE II or BINDING SITE III. Table 2 illustrates the complementarity of the nucleotide sequences of BCL2 BINDING SITE, designated SEQ ID:6261, to the nucleotide sequence of VGAM1624 RNA, herein designated VGAM RNA, also designated SEQ ID:4335.

A function of VGAM1624 is therefore inhibition of B-cell CLL/lymphoma 2 (BCL2, Accession NM_000633). Accordingly, utilities of VGAM1624 include diagnosis, prevention and treatment of diseases and clinical conditions associated with BCL2. Cyclic Nucleotide Gated Channel Alpha 3 (CNGA3, Accession NM_001298) is another VGAM1624 host target gene. CNGA3 BINDING SITE is HOST TARGET binding site found in the 3' untranslated region of mRNA encoded by CNGA3, corresponding to a HOST TARGET binding site such as BINDING SITE I, BINDING SITE II or BINDING SITE III. Table 2 illustrates the complementarity of the nucleotide sequences of CNGA3 BINDING SITE, designated SEQ ID:6977, to the nucleotide sequence of VGAM1624 RNA, herein designated VGAM RNA, also designated SEQ ID:4335.

Another function of VGAM1624 is therefore inhibition of Cyclic Nucleotide Gated Channel Alpha 3 (CNGA3, Accession NM_001298). Accordingly, utilities of VGAM1624 include diagnosis, prevention and treatment of diseases and clinical conditions associated with CNGA3. Potassium Voltage-gated Channel, Shaker-related Subfamily, Beta Member 2 (KCNAB2, Accession NM_003636) is another VGAM1624 host target gene. KCNAB2 BINDING SITE is HOST TARGET binding site found in the 3' untranslated region of mRNA encoded by KCNAB2, corresponding to a HOST TARGET binding site such as BINDING SITE I, BINDING SITE II or BINDING SITE III. Table 2 illustrates the complementarity of the nucleotide sequences of KCNAB2 BINDING SITE, designated SEQ ID:9710, to the nucleotide sequence of VGAM1624 RNA, herein designated VGAM RNA, also designated SEQ ID:4335.

Another function of VGAM1624 is therefore inhibition of Potassium Voltage-gated Channel, Shaker-related Subfamily, Beta Member 2 (KCNAB2, Accession NM_003636), a gene which is the beta subunit of shaker voltage-gated potassium channels. Accordingly, utilities of VGAM1624 include diagnosis, prevention and treatment of diseases and clinical conditions associated with KCNAB2. The function of KCNAB2 and its association with various diseases and clinical conditions, has been established by previous studies, as described hereinabove with reference to VGAM659. Steroidogenic Acute Regulatory Protein (STAR, Accession NM_000349) is another VGAM1624 host target gene. STAR BINDING SITE is HOST TARGET binding site found in the 3' untranslated region of mRNA encoded by STAR, corresponding to a HOST TARGET binding site such as BINDING SITE I, BINDING SITE II or BINDING SITE III. Table 2 illustrates the complementarity of the nucleotide sequences of STAR BINDING SITE, designated SEQ ID:5903, to the nucleotide sequence of VGAM1624 RNA, herein designated VGAM RNA, also designated SEQ ID:4335.

Another function of VGAM1624 is therefore inhibition of Steroidogenic Acute Regulatory Protein (STAR, Accession NM_000349). Accordingly, utilities of VGAM1624 include diagnosis, prevention and treatment of diseases and clinical conditions associated with STAR. DnaJ (Hsp40) Homolog, Subfamily B, Member 5 (DNAJB5, Accession NM_012266) is another VGAM1624 host target gene. DNAJB5 BINDING SITE is HOST TARGET binding site found in the 3' untranslated region of mRNA encoded by DNAJB5, corresponding to a HOST TARGET binding site such as BINDING SITE I, BINDING SITE II or BINDING SITE III. Table 2 illustrates the complementarity of the nucleotide sequences of DNAJB5 BINDING SITE, designated SEQ ID:14586, to the nucleotide sequence of VGAM1624 RNA, herein designated VGAM RNA, also designated SEQ ID:4335.

Another function of VGAM1624 is therefore inhibition of DnaJ (Hsp40) Homolog, Subfamily B, Member 5 (DNAJB5, Accession NM_012266). Accordingly, utilities of VGAM1624 include diagnosis, prevention and treatment of diseases and clinical conditions associated with DNAJB5. Mitogen-activated Protein Kinase Kinase Kinase 2 (MAP3K2, Accession NM_006609) is another VGAM1624 host target gene. MAP3K2 BINDING SITE is HOST TARGET binding site found in the 3' untranslated region of mRNA encoded by MAP3K2, corresponding to a HOST TARGET binding site such as BINDING SITE I, BINDING SITE II or BINDING SITE III. Table 2 illustrates the complementarity of the nucleotide sequences of MAP3K2 BINDING SITE, designated SEQ ID:13386, to the nucleotide sequence of VGAM1624 RNA, herein designated VGAM RNA, also designated SEQ ID:4335.

Another function of VGAM1624 is therefore inhibition of Mitogen-activated Protein Kinase Kinase Kinase 2 (MAP3K2, Accession NM_006609). Accordingly, utilities of VGAM1624 include diagnosis, prevention and treatment of diseases and clinical conditions associated with MAP3K2. LOC148809 (Accession XM_086325) is another VGAM1624 host target gene. LOC148809 BINDING SITE is HOST TARGET binding site found in the 3' untranslated region of mRNA encoded by LOC148809, corresponding to a HOST TARGET binding site such as BINDING SITE I, BINDING SITE II or BINDING SITE III. Table 2 illustrates the complementarity of the nucleotide sequences of LOC148809 BINDING SITE, designated SEQ ID:38596, to the nucleotide sequence of VGAM1624 RNA, herein designated VGAM RNA, also designated SEQ ID:4335.

Another function of VGAM1624 is therefore inhibition of LOC148809 (Accession XM_086325). Accordingly, utilities of VGAM1624 include diagnosis, prevention and treatment of diseases and clinical conditions associated with LOC148809. LOC149372 (Accession XM_086509) is another VGAM1624 host target gene. LOC149372 BINDING SITE is HOST TARGET binding site found in the 3' untranslated region of mRNA encoded by LOC149372, corresponding to a HOST TARGET binding site such as BINDING SITE I, BINDING SITE II or BINDING SITE III. Table 2 illustrates the complementarity of the nucleotide sequences of LOC149372 BINDING SITE, designated SEQ ID:38726, to the nucleotide sequence of VGAM1624 RNA, herein designated VGAM RNA, also designated SEQ ID:4335.

Another function of VGAM1624 is therefore inhibition of LOC149372 (Accession XM_086509). Accordingly, utilities of VGAM1624 include diagnosis, prevention and treatment of diseases and clinical conditions associated with LOC149372. LOC158428 (Accession XM_047249) is another VGAM1624 host target gene. LOC158428 BINDING SITE is HOST TARGET binding site found in the 5' untranslated region of mRNA encoded by LOC158428, corresponding to a HOST TARGET binding site such as BINDING SITE I, BINDING SITE II or BINDING SITE III. Table 2 illustrates the complementarity of the nucleotide sequences of LOC158428 BINDING SITE, designated SEQ ID:34920, to the nucleotide sequence of VGAM1624 RNA, herein designated VGAM RNA, also designated SEQ ID:4335.

Another function of VGAM1624 is therefore inhibition of LOC158428 (Accession XM_047249). Accordingly, utilities of VGAM1624 include diagnosis, prevention and treatment of diseases and clinical conditions associated with LOC158428. LOC169026 (Accession XM_095471) is another VGAM1624 host target gene. LOC169026 BINDING SITE is HOST TARGET binding site found in the 3' untranslated region of mRNA encoded by LOC169026, corresponding to a HOST TARGET binding site such as BINDING SITE I, BINDING SITE II or BINDING SITE III. Table 2 illustrates the complementarity of the nucleotide sequences of LOC169026 BINDING SITE, designated SEQ ID:40267, to the nucleotide sequence of VGAM1624 RNA, herein designated VGAM RNA, also designated SEQ ID:4335.

Another function of VGAM1624 is therefore inhibition of LOC169026 (Accession XM_095471). Accordingly, utilities of VGAM1624 include diagnosis, prevention and treatment of diseases and clinical conditions associated with LOC169026. FIG. 1 further provides a conceptual description of a novel bioinformatically detected viral gene of the present invention, referred to here as Viral Genomic Address Messenger 1625 (VGAM1625) viral gene, which modulates expression of respective host target genes thereof, the function and utility of which host target genes is known in the art.

VGAM1625 is a novel bioinformatically detected regulatory, non protein coding, viral micro RNA (miRNA) gene.

The method by which VGAM1625 was detected is described hereinabove with reference to FIGS. 1-8.

VGAM1625 gene, herein designated VGAM GENE, is a viral gene contained in the genome of Bovine Herpesvirus 4. VGAM1625 host target gene, herein designated VGAM HOST TARGET GENE, is a human gene contained in the human genome.

VGAM1625 gene encodes a VGAM1625 precursor RNA, herein designated VGAM PRECURSOR RNA. Similar to other miRNA genes, and unlike most ordinary genes, VGAM1625 precursor RNA does not encode a protein. A nucleotide sequence identical or highly similar to the nucleotide sequence of VGAM1625 precursor RNA is designated SEQ ID:1611, and is provided hereinbelow with reference to the sequence listing part. Nucleotide sequence SEQ ID:1611 is located at position 86511 relative to the genome of Bovine Herpesvirus 4.

VGAM1625 precursor RNA folds onto itself, forming VGAM1625 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1625 folded precursor RNA into VGAM1625 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1625 RNA is designated SEQ ID:4336, and is provided hereinbelow with reference to the sequence listing part.

VGAM1625 host target gene, herein designated VGAM HOST TARGET GENE, encodes a corresponding messenger RNA, VGAM1625 host target RNA, herein designated VGAM HOST TARGET RNA. VGAM1625 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1625 RNA, herein designated VGAM RNA, binds complementarily to one or more host target binding sites located in untranslated regions of VGAM1625 host target RNA, herein designated VGAM HOST TARGET RNA. This complementary binding is due to the fact that the nucleotide sequence of VGAM1625 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1625 RNA, herein designated VGAM RNA, may have a different number of host target binding sites in untranslated regions of a VGAM1625 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1625 RNA, herein designated VGAM RNA, to host target binding sites on VGAM1625 host target RNA, herein designated VGAM HOST TARGET RNA, such as BINDING SITE I, BINDING SITE II and BINDING SITE III, inhibits translation of VGAM1625 host target RNA into VGAM1625 host target protein, herein designated VGAM HOST TARGET PROTEIN. VGAM host target protein is therefore outlined by a broken line.

It is appreciated that VGAM1625 host target gene, herein designated VGAM HOST TARGET GENE, in fact represents a plurality of VGAM1625 host target genes. The mRNA of each one of this plurality of VGAM1625 host target genes comprises one or more host target binding sites, each having a nucleotide sequence which is at least partly complementary to VGAM1625 RNA, herein designated VGAM RNA, and which when bound by VGAM1625 RNA causes inhibition of translation of respective one or more VGAM1625 host target proteins.

It is further appreciated by one skilled in the art that the mode of translational inhibition illustrated by FIG. 1 with specific reference to translational inhibition exerted by VGAM1625 gene, herein designated VGAM GENE, on one or more VGAM1625 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1625 is inhibition of expression of host target genes, as part of a novel viral mechanism of attacking a host. Accordingly, utilities of VGAM1625 include diagnosis, prevention and treatment of viral infection by Bovine Herpesvirus 4. Specific functions, and accordingly utilities, of VGAM1625 correlate with, and may be deduced from, the identity of the host target genes which VGAM1625 binds and inhibits, and the function of these host target genes, as elaborated hereinbelow.

Nucleotide sequences of the VGAM1625 precursor RNA, herein designated VGAM PRECURSOR RNA, and of the 'diced' VGAM1625 RNA, herein designated VGAM RNA, and a schematic representation of the secondary folding of VGAM1625 folded precursor RNA, herein designated VGAM FOLDED PRECURSOR RNA, of VGAM1625 are further described hereinbelow with reference to Table 1.

Nucleotide sequences of host target binding sites, such as BINDING SITE-I, BINDING SITE-II and BINDING SITE-III of FIG. 1, found on VGAM1625 host target RNA, and schematic representation of the complementarity of each of these host target binding sites to VGAM1625 RNA, herein designated VGAM RNA, are described hereinbelow with reference to Table 2.

As mentioned hereinabove with reference to FIG. 1, a function of VGAM1625 gene, herein designated VGAM is inhibition of expression of VGAM1625 target genes. It is appreciated that specific functions, and accordingly utilities, of VGAM1625 correlate with, and may be deduced from, the identity of the target genes which VGAM1625 binds and inhibits, and the function of these target genes, as elaborated hereinbelow.

Synaptotagmin XIII (SYT13, Accession XM_167880) is a VGAM1625 host target gene. SYT13 BINDING SITE is HOST TARGET binding site found in the 3' untranslated region of mRNA encoded by SYT13, corresponding to a HOST TARGET binding site such as BINDING SITE I, BINDING SITE II or BINDING SITE III. Table 2 illustrates the complementarity of the nucleotide sequences of SYT13 BINDING SITE, designated SEQ ID:44885, to the nucleotide sequence of VGAM1625 RNA, herein designated VGAM RNA, also designated SEQ ID:4336.

A function of VGAM1625 is therefore inhibition of Synaptotagmin XIII (SYT13, Accession XM_167880). Accordingly, utilities of VGAM1625 include diagnosis, prevention and treatment of diseases and clinical conditions associated with SYT13. LOC148545 (Accession XM_086226) is another VGAM1625 host target gene. LOC148545 BINDING SITE is HOST TARGET binding site found in the 3' untranslated region of mRNA encoded by LOC148545, corresponding to a HOST TARGET binding site such as BINDING SITE I, BINDING SITE II or BINDING SITE III. Table 2 illustrates the complementarity of the nucleotide sequences of LOC148545 BINDING SITE, designated SEQ ID:38552, to the nucleotide sequence of VGAM1625 RNA, herein designated VGAM RNA, also designated SEQ ID:4336.

Another function of VGAM1625 is therefore inhibition of LOC148545 (Accession XM_086226). Accordingly, utilities of VGAM1625 include diagnosis, prevention and treatment of diseases and clinical conditions associated with LOC148545. FIG. 1 further provides a conceptual description of a novel bioinformatically detected viral gene of the present invention, referred to here as Viral Genomic Address Messenger 1626 (VGAM1626) viral gene, which modulates expression of respective host target genes thereof, the function and utility of which host target genes is known in the art.

VGAM1626 is a novel bioinformatically detected regulatory, non protein coding, viral micro RNA (miRNA) gene. The method by which VGAM1626 was detected is described hereinabove with reference to FIGS. 1-8.

VGAM1626 gene, herein designated VGAM GENE, is a viral gene contained in the genome of Bovine Herpesvirus 4. VGAM1626 host target gene, herein designated VGAM HOST TARGET GENE, is a human gene contained in the human genome.

VGAM1626 gene encodes a VGAM1626 precursor RNA, herein designated VGAM PRECURSOR RNA. Similar to other miRNA genes, and unlike most ordinary genes, VGAM1626 precursor RNA does not encode a protein. A nucleotide sequence identical or highly similar to the nucleotide sequence of VGAM1626 precursor RNA is designated SEQ ID:1612, and is provided hereinbelow with reference to the sequence listing part. Nucleotide sequence SEQ ID:1612 is located at position 80653 relative to the genome of Bovine Herpesvirus 4.

VGAM1626 precursor RNA folds onto itself, forming VGAM1626 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1626 folded precursor RNA into VGAM1626 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1626 RNA is designated SEQ ID:4337, and is provided hereinbelow with reference to the sequence listing part.

VGAM1626 host target gene, herein designated VGAM HOST TARGET GENE, encodes a corresponding messenger RNA, VGAM1626 host target RNA, herein designated VGAM HOST TARGET RNA. VGAM1626 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1626 RNA, herein designated VGAM RNA, binds complementarily to one or more host target binding sites located in untranslated regions of VGAM1626 host target RNA, herein designated VGAM HOST TARGET RNA. This complementary binding is due to the fact that the nucleotide sequence of VGAM1626 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1626 RNA, herein designated VGAM RNA, may have a different number of host target binding sites in untranslated regions of a VGAM1626 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1626 RNA, herein designated VGAM RNA, to host target binding sites on VGAM1626 host target RNA, herein designated VGAM HOST TARGET RNA, such as BINDING SITE I, BINDING SITE II and BINDING SITE III, inhibits translation of VGAM1626 host target RNA into VGAM1626 host target protein, herein designated VGAM HOST TARGET PROTEIN. VGAM host target protein is therefore outlined by a broken line.

It is appreciated that VGAM1626 host target gene, herein designated VGAM HOST TARGET GENE, in fact represents a plurality of VGAM1626 host target genes. The mRNA of each one of this plurality of VGAM1626 host target genes comprises one or more host target binding sites, each having a nucleotide sequence which is at least partly complementary to VGAM1626 RNA, herein designated VGAM RNA, and which when bound by VGAM1626 RNA causes inhibition of translation of respective one or more VGAM1626 host target proteins.

It is further appreciated by one skilled in the art that the mode of translational inhibition illustrated by FIG. 1 with specific reference to translational inhibition exerted by VGAM1626 gene, herein designated VGAM GENE, on one or more VGAM1626 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1626 is inhibition of expression of host target genes, as part of a novel viral mechanism of attacking a host. Accordingly, utilities of VGAM1626 include diagnosis, prevention and treatment of viral infection by Bovine Herpesvirus 4. Specific functions, and accordingly utilities, of VGAM1626 correlate with, and may be deduced from, the identity of the host target genes which VGAM1626 binds and inhibits, and the function of these host target genes, as elaborated hereinbelow.

Nucleotide sequences of the VGAM1626 precursor RNA, herein designated VGAM PRECURSOR RNA, and of the 'diced' VGAM1626 RNA, herein designated VGAM RNA, and a schematic representation of the secondary folding of VGAM1626 folded precursor RNA, herein designated VGAM FOLDED PRECURSOR RNA, of VGAM1626 are further described hereinbelow with reference to Table 1.

Nucleotide sequences of host target binding sites, such as BINDING SITE-I, BINDING SITE-II and BINDING SITE-III of FIG. 1, found on VGAM1626 host target RNA, and schematic representation of the complementarity of each of these host target binding sites to VGAM1626 RNA, herein designated VGAM RNA, are described hereinbelow with reference to Table 2.

As mentioned hereinabove with reference to FIG. 1, a function of VGAM1626 gene, herein designated VGAM is inhibition of expression of VGAM1626 target genes. It is appreciated that specific functions, and accordingly utilities, of VGAM1626 correlate with, and may be deduced from, the identity of the target genes which VGAM1626 binds and inhibits, and the function of these target genes, as elaborated hereinbelow.

Cyclin-dependent Kinase (CDC2-like) 10 (CDK10, Accession NM_052988) is a VGAM1626 host target gene. CDK10 BINDING SITE is HOST TARGET binding site found in the 3' untranslated region of mRNA encoded by CDK10, corresponding to a HOST TARGET binding site such as BINDING SITE I, BINDING SITE II or BINDING SITE III. Table 2 illustrates the complementarity of the nucleotide sequences of CDK10 BINDING SITE, designated SEQ ID:27554, to the nucleotide sequence of VGAM1626 RNA, herein designated VGAM RNA, also designated SEQ ID:4337.

A function of VGAM1626 is therefore inhibition of Cyclin-dependent Kinase (CDC2-like) 10 (CDK10, Accession NM_052988), a gene which plays a pivotal role in the regulation of the eukaryotic cell cycle. Accordingly, utilities of VGAM1626 include diagnosis, prevention and treatment of diseases and clinical conditions associated with CDK10. The function of CDK10 and its association with various diseases and clinical conditions, has been established by previous studies, as described hereinabove with reference to VGAM193. Endoglin (Osler-Rendu-Weber syndrome 1) (ENG, Accession NM_000118) is another VGAM1626 host target gene. ENG BINDING SITE is HOST TARGET binding site found in the 3' untranslated region of mRNA encoded by ENG, corresponding to a HOST TARGET binding site such as BINDING SITE I, BINDING SITE II or BINDING SITE III. Table 2 illustrates the complementarity of the nucleotide sequences of ENG BINDING SITE, designated SEQ ID:5594, to the nucleotide sequence of VGAM1626 RNA, herein designated VGAM RNA, also designated SEQ ID:4337.

Another function of VGAM1626 is therefore inhibition of Endoglin (Osler-Rendu-Weber syndrome 1) (ENG, Accession NM_000118). Accordingly, utilities of VGAM1626 include diagnosis, prevention and treatment of diseases and clinical conditions associated with ENG. FLJ21438 (Accession XM_029084) is another VGAM1626 host target gene. FLJ21438 BINDING SITE is HOST TARGET binding site found in the 3' untranslated region of mRNA encoded by FLJ21438, corresponding to a HOST TARGET binding site such as BINDING SITE I, BINDING SITE II or BINDING SITE III. Table 2 illustrates the complementarity of the nucleotide sequences of FLJ21438 BINDING SITE, designated SEQ ID:30845, to the nucleotide sequence of VGAM1626 RNA, herein designated VGAM RNA, also designated SEQ ID:4337.

Another function of VGAM1626 is therefore inhibition of FLJ21438 (Accession XM_029084). Accordingly, utilities of VGAM1626 include diagnosis, prevention and treatment of diseases and clinical conditions associated with FLJ21438. KIAA1610 (Accession XM_040622) is another VGAM1626 host target gene. KIAA1610 BINDING SITE is HOST TARGET binding site found in the 3' untranslated region of mRNA encoded by KIAA1610, corresponding to a HOST TARGET binding site such as BINDING SITE I, BINDING SITE II or BINDING SITE III. Table 2 illustrates the complementarity of the nucleotide sequences of KIAA1610 BINDING SITE, designated SEQ ID:33339, to the nucleotide sequence of VGAM1626 RNA, herein designated VGAM RNA, also designated SEQ ID:4337.

Another function of VGAM1626 is therefore inhibition of KIAA1610 (Accession XM_040622). Accordingly, utilities of VGAM1626 include diagnosis, prevention and treatment of diseases and clinical conditions associated with KIAA1610. LOC221477 (Accession XM_166397) is another VGAM1626 host target gene. LOC221477 BINDING SITE is HOST TARGET binding site found in the 3' untranslated region of mRNA encoded by LOC221477, corresponding to a HOST TARGET binding site such as BINDING SITE I, BINDING SITE II or BINDING SITE III. Table 2 illustrates the complementarity of the nucleotide sequences of LOC221477 BINDING SITE, designated SEQ ID:44253, to the nucleotide sequence of VGAM1626 RNA, herein designated VGAM RNA, also designated SEQ ID:4337.

Another function of VGAM1626 is therefore inhibition of LOC221477 (Accession XM_166397). Accordingly, utilities of VGAM1626 include diagnosis, prevention and treatment of diseases and clinical conditions associated with LOC221477. FIG. 1 further provides a conceptual description of a novel bioinformatically detected viral gene of the present invention, referred to here as Viral Genomic Address Messenger 1627 (VGAM1627) viral gene, which modulates expression of respective host target genes thereof, the function and utility of which host target genes is known in the art.

VGAM1627 is a novel bioinformatically detected regulatory, non protein coding, viral micro RNA (miRNA) gene. The method by which VGAM1627 was detected is described hereinabove with reference to FIGS. 1-8.

VGAM1627 gene, herein designated VGAM GENE, is a viral gene contained in the genome of Bovine Herpesvirus 4. VGAM1627 host target gene, herein designated VGAM HOST TARGET GENE, is a human gene contained in the human genome.

VGAM1627 gene encodes a VGAM1627 precursor RNA, herein designated VGAM PRECURSOR RNA. Similar to other miRNA genes, and unlike most ordinary genes, VGAM1627 precursor RNA does not encode a protein. A nucleotide sequence identical or highly similar to the nucleotide sequence of VGAM1627 precursor RNA is designated SEQ ID:1613, and is provided hereinbelow with reference to the sequence listing part. Nucleotide sequence SEQ ID:1613 is located at position 80799 relative to the genome of Bovine Herpesvirus 4.

VGAM1627 precursor RNA folds onto itself, forming VGAM1627 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1627 folded precursor RNA into VGAM1627 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1627 RNA is designated SEQ ID:4338, and is provided hereinbelow with reference to the sequence listing part.

VGAM1627 host target gene, herein designated VGAM HOST TARGET GENE, encodes a corresponding messenger RNA, VGAM1627 host target RNA, herein designated VGAM HOST TARGET RNA. VGAM1627 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1627 RNA, herein designated VGAM RNA, binds complementarily to one or more host target binding sites located in untranslated regions of VGAM1627 host target RNA, herein designated VGAM HOST TARGET RNA. This complementary binding is due to the fact that the nucleotide sequence of VGAM1627 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1627 RNA, herein designated VGAM RNA, may have a different number of host target binding sites in untranslated regions of a VGAM1627 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1627 RNA, herein designated VGAM RNA, to host target binding sites on VGAM1627 host target RNA, herein designated VGAM HOST TARGET RNA, such as BINDING SITE I, BINDING SITE II and BINDING SITE III, inhibits translation of VGAM1627 host target RNA into VGAM1627 host target protein, herein designated VGAM HOST TARGET PROTEIN. VGAM host target protein is therefore outlined by a broken line.

It is appreciated that VGAM1627 host target gene, herein designated VGAM HOST TARGET GENE, in fact represents a plurality of VGAM1627 host target genes. The mRNA of each one of this plurality of VGAM1627 host target genes comprises one or more host target binding sites, each having a nucleotide sequence which is at least partly complementary to VGAM1627 RNA, herein designated VGAM RNA, and which when bound by VGAM1627 RNA causes inhibition of translation of respective one or more VGAM1627 host target proteins.

It is further appreciated by one skilled in the art that the mode of translational inhibition illustrated by FIG. 1 with specific reference to translational inhibition exerted by VGAM1627 gene, herein designated VGAM GENE, on one or more VGAM1627 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1627 is inhibition of expression of host target genes, as part of a novel viral mechanism of attacking a host. Accordingly, utilities of VGAM1627 include diagnosis, prevention and treatment of viral infection by Bovine Herpesvirus 4. Specific functions, and accordingly utilities, of VGAM1627 correlate with, and may be deduced from, the identity of the host target genes which VGAM1627 binds and inhibits, and the function of these host target genes, as elaborated hereinbelow.

Nucleotide sequences of the VGAM1627 precursor RNA, herein designated VGAM PRECURSOR RNA, and of the 'diced' VGAM1627 RNA, herein designated VGAM RNA, and a schematic representation of the secondary folding of VGAM1627 folded precursor RNA, herein designated VGAM FOLDED PRECURSOR RNA, of VGAM1627 are further described hereinbelow with reference to Table 1.

Nucleotide sequences of host target binding sites, such as BINDING SITE-I, BINDING SITE-II and BINDING SITE-III of FIG. 1, found on VGAM1627 host target RNA, and schematic representation of the complementarity of each of these host target binding sites to VGAM1627 RNA, herein designated VGAM RNA, are described hereinbelow with reference to Table 2.

As mentioned hereinabove with reference to FIG. 1, a function of VGAM1627 gene, herein designated VGAM is inhibition of expression of VGAM1627 target genes. It is appreciated that specific functions, and accordingly utilities, of VGAM1627 correlate with, and may be deduced from, the identity of the target genes which VGAM1627 binds and inhibits, and the function of these target genes, as elaborated hereinbelow.

LNK (Accession NM_005475) is a VGAM1627 host target gene. LNK BINDING SITE is HOST TARGET binding site found in the 3' untranslated region of mRNA encoded by LNK, corresponding to a HOST TARGET binding site such as BINDING SITE I, BINDING SITE II or BINDING SITE III. Table 2 illustrates the complementarity of the nucleotide sequences of LNK BINDING SITE, designated SEQ ID:11970, to the nucleotide sequence of VGAM1627 RNA, herein designated VGAM RNA, also designated SEQ ID:4338.

A function of VGAM1627 is therefore inhibition of LNK (Accession NM_005475), a gene which links T-cell receptor activation signal to phospholipase c-gamma-1, grb-2 and phosphatidylinositol 3-kinase (by similarity). Accordingly, utilities of VGAM1627 include diagnosis, prevention and treatment of diseases and clinical conditions associated with LNK. The function of LNK and its association with various diseases and clinical conditions, has been established by previous studies, as described hereinabove with reference to VGAM115. Myosin IIIB (MYO3B, Accession NM_138995) is another VGAM1627 host target gene. MYO3B BINDING SITE is HOST TARGET binding site found in the 3" untranslated region of mRNA encoded by MYO3B, corresponding to a HOST TARGET binding site such as BINDING SITE I, BINDING SITE II or BINDING SITE III. Table 2 illustrates the complementarity of the nucleotide sequences of MYO3B BINDING SITE, designated SEQ ID:29094, to the nucleotide sequence of VGAM1627 RNA, herein designated VGAM RNA, also designated SEQ ID:4338.

Another function of VGAM1627 is therefore inhibition of Myosin IIIB (MYO3B, Accession NM_138995). Accordingly, utilities of VGAM1627 include diagnosis, prevention and treatment of diseases and clinical conditions associated with MYO3B. LOC219920 (Accession XM_167787) is another VGAM1627 host target gene. LOC219920 BINDING SITE is HOST TARGET binding site found in the 5' untranslated region of mRNA encoded by LOC219920, corresponding to a HOST TARGET binding site such as BINDING SITE I, BINDING SITE II or BINDING SITE III. Table 2 illustrates the complementarity of the nucleotide sequences of LOC219920 BINDING SITE, designated SEQ ID:44802, to the nucleotide sequence of VGAM1627 RNA, herein designated VGAM RNA, also designated SEQ ID:4338.

Another function of VGAM1627 is therefore inhibition of LOC219920 (Accession XM_167787). Accordingly, utilities of VGAM1627 include diagnosis, prevention and treatment of diseases and clinical conditions associated with LOC219920. LOC220279 (Accession XM_169083) is another VGAM1627 host target gene. LOC220279 BINDING SITE is HOST TARGET binding site found in the 5' untranslated region of mRNA encoded by LOC220279, corresponding to a HOST TARGET binding site such as BINDING SITE I, BINDING SITE II or BINDING SITE III. Table 2 illustrates the complementarity of the nucleotide sequences of LOC220279 BINDING SITE, designated SEQ ID:45288, to the nucleotide sequence of VGAM1627 RNA, herein designated VGAM RNA, also designated SEQ ID:4338.

Another function of VGAM1627 is therefore inhibition of LOC220279 (Accession XM_169083). Accordingly, utilities of VGAM1627 include diagnosis, prevention and treatment of diseases and clinical conditions associated with LOC220279. LOC255826 (Accession XM_173938) is another VGAM1627 host target gene. LOC255826 BINDING SITE is HOST TARGET binding site found in the 5' untranslated region of mRNA encoded by LOC255826, corresponding to a HOST TARGET binding site such as BINDING SITE I, BINDING SITE II or BINDING SITE III. Table 2 illustrates the complementarity of the nucleotide sequences of LOC255826 BINDING SITE, designated SEQ ID:46569, to the nucleotide sequence of VGAM1627 RNA, herein designated VGAM RNA, also designated SEQ ID:4338.

Another function of VGAM1627 is therefore inhibition of LOC255826 (Accession XM_173938). Accordingly, utilities of VGAM1627 include diagnosis, prevention and treatment of diseases and clinical conditions associated with LOC255826. FIG. 1 further provides a conceptual description of a novel bioinformatically detected viral gene of the present invention, referred to here as Viral Genomic Address Messenger 1628 (VGAM1628) viral gene, which modulates expression of respective host target genes thereof, the function and utility of which host target genes is known in the art.

VGAM1628 is a novel bioinformatically detected regulatory, non protein coding, viral micro RNA (miRNA) gene. The method by which VGAM1628 was detected is described hereinabove with reference to FIGS. 1-8.

VGAM1628 gene, herein designated VGAM GENE, is a viral gene contained in the genome of Bovine Herpesvirus 4. VGAM1628 host target gene, herein designated VGAM HOST TARGET GENE, is a human gene contained in the human genome.

VGAM1628 gene encodes a VGAM1628 precursor RNA, herein designated VGAM PRECURSOR RNA. Similar to other miRNA genes, and unlike most ordinary genes, VGAM1628 precursor RNA does not encode a protein. A nucleotide sequence identical or highly similar to the nucleotide sequence of VGAM1628 precursor RNA is designated SEQ ID:1614, and is provided hereinbelow with reference to the sequence listing part. Nucleotide sequence SEQ ID:1614 is located at position 83406 relative to the genome of Bovine Herpesvirus 4.

VGAM1628 precursor RNA folds onto itself, forming VGAM1628 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1628 folded precursor RNA into VGAM1628 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM1628 RNA is designated SEQ ID:4339, and is provided hereinbelow with reference to the sequence listing part.

VGAM1628 host target gene, herein designated VGAM HOST TARGET GENE, encodes a corresponding messenger RNA, VGAM1628 host target RNA, herein designated VGAM HOST TARGET RNA. VGAM1628 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1628 RNA, herein designated VGAM RNA, binds complementarily to one or more host target binding sites located in untranslated regions of VGAM1628 host target RNA, herein designated VGAM HOST TARGET RNA. This complementary binding is due to the fact that the nucleotide sequence of VGAM1628 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1628 RNA, herein designated VGAM RNA, may have a different number of host target binding sites in untranslated regions of a VGAM1628 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1628 RNA, herein designated VGAM RNA, to host target binding sites on VGAM1628 host target RNA, herein designated VGAM HOST TARGET RNA, such as BINDING SITE I, BINDING SITE II and BINDING SITE III, inhibits translation of VGAM1628 host target RNA into VGAM1628 host target protein, herein designated VGAM HOST TARGET PROTEIN. VGAM host target protein is therefore outlined by a broken line.

It is appreciated that VGAM1628 host target gene, herein designated VGAM HOST TARGET GENE, in fact represents a plurality of VGAM1628 host target genes. The mRNA of each one of this plurality of VGAM1628 host target genes comprises one or more host target binding sites, each having a nucleotide sequence which is at least partly complementary to VGAM1628 RNA, herein designated VGAM RNA, and which when bound by VGAM1628 RNA causes inhibition of translation of respective one or more VGAM1628 host target proteins.

It is further appreciated by one skilled in the art that the mode of translational inhibition illustrated by FIG. 1 with specific reference to translational inhibition exerted by VGAM1628 gene, herein designated VGAM GENE, on one or more VGAM1628 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1628 is inhibition of expression of host target genes, as part of a novel viral mechanism of attacking a host. Accordingly, utilities of VGAM1628 include diagnosis, prevention and treatment of viral infection by Bovine Herpesvirus 4. Specific functions, and accordingly utilities, of VGAM1628 correlate with, and may be deduced from, the identity of the host target genes which VGAM1628 binds and inhibits, and the function of these host target genes, as elaborated hereinbelow.

Nucleotide sequences of the VGAM1628 precursor RNA, herein designated VGAM PRECURSOR RNA, and of the 'diced' VGAM1628 RNA, herein designated VGAM RNA, and a schematic representation of the secondary folding of VGAM1628 folded precursor RNA, herein designated VGAM FOLDED PRECURSOR RNA, of VGAM1628 are further described hereinbelow with reference to Table 1.

Nucleotide sequences of host target binding sites, such as BINDING SITE-I, BINDING SITE-II and BINDING SITE-III of FIG. 1, found on VGAM1628 host target RNA, and schematic representation of the complementarity of each of these host target binding sites to VGAM1628 RNA, herein designated VGAM RNA, are described hereinbelow with reference to Table 2.

As mentioned hereinabove with reference to FIG. 1, a function of VGAM1628 gene, herein designated VGAM is inhibition of expression of VGAM1628 target genes. It is appreciated that specific functions, and accordingly utilities, of VGAM1628 correlate with, and may be deduced from, the identity of the target genes which VGAM1628 binds and inhibits, and the function of these target genes, as elaborated hereinbelow.

Down-regulator of Transcription 1, TBP-binding (negative cofactor 2) (DR1, Accession XM_002015) is a VGAM1628 host target gene. DR1 BINDING SITE is HOST TARGET binding site found in the 5' untranslated region of mRNA encoded by DR1, corresponding to a HOST TARGET binding site such as BINDING SITE I, BINDING SITE II or BINDING SITE III. Table 2 illustrates the complementarity of the nucleotide sequences of DR1 BINDING SITE, designated SEQ ID:29858, to the nucleotide sequence of VGAM1628 RNA, herein designated VGAM RNA, also designated SEQ ID:4339.

A function of VGAM1628 is therefore inhibition of Down-regulator of Transcription 1, TBP-binding (negative cofactor 2) (DR1, Accession XM_002015), a gene which influences functional repression of both activated and basal transcription of class ii genes. Accordingly, utilities of VGAM1628 include diagnosis, prevention and treatment of diseases and clinical conditions associated with DR1. The function of DR1 and its association with various diseases and clinical conditions, has been established by previous studies, as described hereinabove with reference to VGAM711. Fatty Acid Binding Protein 2, Intestinal (FABP2, Accession NM_000134) is another VGAM1628 host target gene. FABP2 BINDING SITE is HOST TARGET binding site found in the 3' untranslated region of mRNA encoded by FABP2, corresponding to a HOST TARGET binding site such as BINDING SITE I, BINDING SITE II or BINDING SITE III. Table 2 illustrates the complementarity of the nucleotide sequences of FABP2 BINDING SITE, designated SEQ ID:5625, to the nucleotide sequence of VGAM1628 RNA, herein designated VGAM RNA, also designated SEQ ID:4339.

Another function of VGAM1628 is therefore inhibition of Fatty Acid Binding Protein 2, Intestinal (FABP2, Accession NM_000134), a gene which may have a role in dietary fat uptake or processing. Accordingly, utilities of VGAM1628 include diagnosis, prevention and treatment of diseases and clinical conditions associated with FABP2. The function of FABP2 and its association with various diseases and clinical conditions, has been established by previous studies, as described hereinabove with reference to VGAM951. Lactate Dehydrogenase B (LDHB, Accession NM_002300) is another VGAM1628 host target gene. LDHB BINDING SITE is HOST TARGET binding site found in the 5' untranslated region of mRNA encoded by LDHB, corresponding to a HOST TARGET binding site such as BINDING SITE I, BINDING SITE II or BINDING SITE III. Table 2 illustrates the complementarity of the nucleotide sequences of LDHB BINDING SITE, designated SEQ ID:8088, to the nucleotide sequence of VGAM1628 RNA, herein designated VGAM RNA, also designated SEQ ID:4339.

Another function of VGAM1628 is therefore inhibition of Lactate Dehydrogenase B (LDHB, Accession NM_002300), a gene which causes dehydrogenation of lactate. Accordingly, utilities of VGAM1628 include diagnosis, prevention and treatment of diseases and clinical conditions associated with LDHB. The function of LDHB and its association with various diseases and clinical conditions, has been established by previous studies, as described hereinabove with reference to VGAM273. AUT-like 1, Cysteine Endopeptidase (S. cerevisiae) (AUTL1, Accession NM_032852) is another VGAM1628 host target gene. AUTL1 BINDING SITE is HOST TARGET binding site found in the 5' untranslated region of mRNA encoded by AUTL1, corresponding to a HOST TARGET binding site such as BINDING SITE I, BINDING SITE II or BINDING SITE III. Table 2 illustrates the complementarity of the nucleotide sequences of AUTL1 BINDING SITE, designated SEQ ID:26647, to the nucleotide sequence of VGAM1628 RNA, herein designated VGAM RNA, also designated SEQ ID:4339.

Another function of VGAM1628 is therefore inhibition of AUT-like 1, Cysteine Endopeptidase (S. cerevisiae) (AUTL1, Accession NM_032852). Accordingly, utilities of VGAM1628 include diagnosis, prevention and treatment of diseases and clinical conditions associated with AUTL1. UDP-Gal:betaGlcNAc Beta 1,3-galactosyltransferase, Polypeptide 1 (B3GALT1, Accession NM_020981) is another VGAM1628 host target gene. B3GALT1 BINDING SITE is HOST TARGET binding site found in the 3' untranslated region of mRNA encoded by B3GALT1, corresponding to a HOST TARGET binding site such as BINDING SITE I, BINDING SITE II or BINDING SITE III. Table 2 illustrates the complementarity of the nucleotide sequences of B3GALT1 BINDING SITE, designated SEQ ID:21971, to the nucleotide sequence of VGAM1628 RNA, herein designated VGAM RNA, also designated SEQ ID:4339.

Another function of VGAM1628 is therefore inhibition of UDP-Gal:betaGlcNAc Beta 1,3-galactosyltransferase, Polypeptide 1 (B3GALT1, Accession NM_020981). Accordingly, utilities of VGAM1628 include diagnosis, prevention and treatment of diseases and clinical conditions associated with B3GALT1. GNB4 (Accession NM_021629) is another VGAM1628 host target gene. GNB4 BINDING SITE is HOST TARGET binding site found in the 3' untranslated region of mRNA encoded by GNB4, corresponding to a HOST TARGET binding site such as BINDING SITE I, BINDING SITE II or BINDING SITE III. Table 2 illustrates the complementarity of the nucleotide sequences of GNB4 BINDING SITE, designated SEQ ID:22267, to the nucleotide sequence of VGAM1628 RNA, herein designated VGAM RNA, also designated SEQ ID:4339.

Another function of VGAM1628 is therefore inhibition of GNB4 (Accession NM_021629). Accordingly, utilities of VGAM1628 include diagnosis, prevention and treatment of diseases and clinical conditions associated with GNB4. OBTP (Accession NM_017601) is another VGAM1628 host target gene. OBTP BINDING SITE is HOST TARGET binding site found in the 3' untranslated region of mRNA encoded by OBTP, corresponding to a HOST TARGET binding site such as BINDING SITE I, BINDING SITE II or BINDING SITE III. Table 2 illustrates the complementarity of the nucleotide sequences of OBTP BINDING SITE, designated SEQ ID:19081, to the nucleotide sequence of VGAM1628 RNA, herein designated VGAM RNA, also designated SEQ ID:4339.

Another function of VGAM1628 is therefore inhibition of OBTP (Accession NM_017601). Accordingly, utilities of VGAM1628 include diagnosis, prevention and treatment of diseases and clinical conditions associated with OBTP. LOC157663 (Accession XM_088354) is another VGAM1628 host target gene. LOC157663 BINDING SITE is HOST TARGET binding site found in the 3' untranslated region of mRNA encoded by LOC157663, corresponding to a HOST TARGET binding site such as BINDING SITE I, BINDING SITE II or BINDING SITE III. Table 2 illustrates the complementarity of the nucleotide sequences of LOC157663 BINDING SITE, designated SEQ ID:39637, to the nucleotide sequence of VGAM1628 RNA, herein designated VGAM RNA, also designated SEQ ID:4339.

Another function of VGAM1628 is therefore inhibition of LOC157663 (Accession XM_088354). Accordingly, utilities of VGAM1628 include diagnosis, prevention and treatment of diseases and clinical conditions associated with LOC157663. LOC199926 (Accession XM_117157) is another VGAM1628 host target gene. LOC199926 BINDING SITE is HOST TARGET binding site found in the 3' untranslated region of mRNA encoded by LOC199926, corresponding to a HOST TARGET binding site such as BINDING SITE I, BINDING SITE II or BINDING SITE III. Table 2 illustrates the complementarity of the nucleotide sequences of LOC199926 BINDING SITE, designated SEQ ID:43262, to the nucleotide sequence of VGAM1628 RNA, herein designated VGAM RNA, also designated SEQ ID:4339.

Another function of VGAM1628 is therefore inhibition of LOC199926 (Accession XM_117157). Accordingly, utilities of VGAM1628 include diagnosis, prevention and treatment of diseases and clinical conditions associated with LOC199926. LOC202316 (Accession XM_117380) is another VGAM1628 host target gene. LOC202316 BINDING SITE is HOST TARGET binding site found in the 3' untranslated region of mRNA encoded by LOC202316, corresponding to a HOST TARGET binding site such as BINDING SITE I, BINDING SITE II or BINDING SITE III. Table 2 illustrates the complementarity of the nucleotide sequences of LOC202316 BINDING SITE, designated SEQ ID:43427, to the nucleotide sequence of VGAM1628 RNA, herein designated VGAM RNA, also designated SEQ ID:4339.

Another function of VGAM1628 is therefore inhibition of LOC202316 (Accession XM_117380). Accordingly, utilities of VGAM1628 include diagnosis, prevention and treatment of diseases and clinical conditions associated with LOC202316. FIG. 1 further provides a conceptual description of a novel bioinformatically detected viral gene of the present invention, referred to here as Viral Genomic Address Messenger 1629 (VGAM1629) viral gene, which modulates expression of respective host target genes thereof, the function and utility of which host target genes is known in the art.

VGAM1629 is a novel bioinformatically detected regulatory, non protein coding, viral micro RNA (miRNA) gene. The method by which VGAM1629 was detected is described hereinabove with reference to FIGS. 1-8.

VGAM1629 gene, herein designated VGAM GENE, is a viral gene contained in the genome of Bovine Herpesvirus 4. VGAM1629 host target gene, herein designated VGAM HOST TARGET GENE, is a human gene contained in the human genome.

VGAM1629 gene encodes a VGAM1629 precursor RNA, herein designated VGAM PRECURSOR RNA. Similar to other miRNA genes, and unlike most ordinary genes, VGAM1629 precursor RNA does not encode a protein. A nucleotide sequence identical or highly similar to the nucleotide sequence of VGAM1629 precursor RNA is designated SEQ ID:1615, and is provided hereinbelow with reference to the sequence listing part. Nucleotide sequence SEQ ID:1615 is located at position 88808 relative to the genome of Bovine Herpesvirus 4.

VGAM1629 precursor RNA folds onto itself, forming VGAM1629 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1629 folded precursor RNA into VGAM1629 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1629 RNA is designated SEQ ID:4340, and is provided hereinbelow with reference to the sequence listing part.

VGAM1629 host target gene, herein designated VGAM HOST TARGET GENE, encodes a corresponding messenger RNA, VGAM1629 host target RNA, herein designated VGAM HOST TARGET RNA. VGAM1629 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1629 RNA, herein designated VGAM RNA, binds complementarily to one or more host target binding sites located in untranslated regions of VGAM1629 host target RNA, herein designated VGAM HOST TARGET RNA. This complementary binding is due to the fact that the nucleotide sequence of VGAM1629 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1629 RNA, herein designated VGAM RNA, may have a different number of host target binding sites in untranslated regions of a VGAM1629 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1629 RNA, herein designated VGAM RNA, to host target binding sites on VGAM1629 host target RNA, herein designated VGAM HOST TARGET RNA, such as BINDING SITE I, BINDING SITE II and BINDING SITE III, inhibits translation of VGAM1629 host target RNA into VGAM1629 host target protein, herein designated VGAM HOST TARGET PROTEIN. VGAM host target protein is therefore outlined by a broken line.

It is appreciated that VGAM1629 host target gene, herein designated VGAM HOST TARGET GENE, in fact represents a plurality of VGAM1629 host target genes. The mRNA of each one of this plurality of VGAM1629 host target genes comprises one or more host target binding sites, each having a nucleotide sequence which is at least partly complementary to VGAM1629 RNA, herein designated VGAM RNA, and which when bound by VGAM1629 RNA causes inhibition of translation of respective one or more VGAM1629 host target proteins.

It is further appreciated by one skilled in the art that the mode of translational inhibition illustrated by FIG. 1 with specific reference to translational inhibition exerted by VGAM1629 gene, herein designated VGAM GENE, on one or more VGAM1629 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1629 is inhibition of expression of host target genes, as part of a novel viral mechanism of attacking a host. Accordingly, utilities of VGAM1629 include diagnosis, prevention and treatment of viral infection by Bovine Herpesvirus 4. Specific functions, and accordingly utilities, of VGAM1629 correlate with, and may be deduced from, the identity of the host target genes which VGAM1629 binds and inhibits, and the function of these host target genes, as elaborated hereinbelow.

Nucleotide sequences of the VGAM1629 precursor RNA, herein designated VGAM PRECURSOR RNA, and of the 'diced' VGAM1629 RNA, herein designated VGAM RNA, and a schematic representation of the secondary folding of VGAM1629 folded precursor RNA, herein designated VGAM FOLDED PRECURSOR RNA, of VGAM1629 are further described hereinbelow with reference to Table 1.

Nucleotide sequences of host target binding sites, such as BINDING SITE-I, BINDING SITE-II and BINDING SITE-III of FIG. 1, found on VGAM1629 host target RNA, and schematic representation of the complementarity of each of these host target binding sites to VGAM1629 RNA, herein designated VGAM RNA, are described hereinbelow with reference to Table 2.

As mentioned hereinabove with reference to FIG. 1, a function of VGAM1629 gene, herein designated VGAM is inhibition of expression of VGAM1629 target genes. It is appreciated that specific functions, and accordingly utilities, of VGAM1629 correlate with, and may be deduced from, the identity of the target genes which VGAM1629 binds and inhibits, and the function of these target genes, as elaborated hereinbelow.

DnaJ (Hsp40) Homolog, Subfamily B, Member 5 (DNAJB5, Accession NM_012266) is a VGAM1629 host target gene. DNAJB5 BINDING SITE is HOST TARGET binding site found in the 3' untranslated region of mRNA encoded by DNAJB5, corresponding to a HOST TARGET binding site such as BINDING SITE I, BINDING SITE II or BINDING SITE III. Table 2 illustrates the complementarity of the nucleotide sequences of DNAJB5 BINDING SITE, designated SEQ ID:14587, to the nucleotide sequence of VGAM1629 RNA, herein designated VGAM RNA, also designated SEQ ID:4340.

A function of VGAM1629 is therefore inhibition of DnaJ (Hsp40) Homolog, Subfamily B, Member 5 (DNAJB5, Accession NM_012266). Accordingly, utilities of VGAM1629 include diagnosis, prevention and treatment of diseases and clinical conditions associated with DNAJB5. KIAA1001 (Accession NM_014960) is another VGAM1629 host target gene. KIAA1001 BINDING SITE is HOST TARGET binding site found in the 5' untranslated region of mRNA encoded by KIAA1001, corresponding to a HOST TARGET binding site such as BINDING SITE I, BINDING SITE II or BINDING SITE III. Table 2 illustrates the complementarity of the nucleotide sequences of KIAA1001 BINDING SITE, designated SEQ ID:17326, to the nucleotide sequence of VGAM1629 RNA, herein designated VGAM RNA, also designated SEQ ID:4340.

Another function of VGAM1629 is therefore inhibition of KIAA1001 (Accession NM_014960). Accordingly, utilities of VGAM1629 include diagnosis, prevention and treatment of diseases and clinical conditions associated with KIAA1001. Kinase Suppressor of Ras (KSR, Accession XM_034172) is another VGAM1629 host target gene. KSR BINDING SITE is HOST TARGET binding site found in the 5' untranslated region of mRNA encoded by KSR, corresponding to a HOST TARGET binding site such as BINDING SITE I, BINDING SITE II or BINDING SITE III. Table 2 illustrates the complementarity of the nucleotide sequences of KSR BINDING SITE, designated SEQ ID:32020, to the nucleotide sequence of VGAM1629 RNA, herein designated VGAM RNA, also designated SEQ ID:4340.

Another function of VGAM1629 is therefore inhibition of Kinase Suppressor of Ras (KSR, Accession XM_034172). Accordingly, utilities of VGAM1629 include diagnosis, prevention and treatment of diseases and clinical conditions associated with KSR. PRP8 Pre-mRNA Processing Factor 8 Homolog (yeast) (PRPF8, Accession XM_028335) is another VGAM1629 host target gene. PRPF8 BINDING SITE is HOST TARGET binding site found in the 3' untranslated region of mRNA encoded by PRPF8, corresponding to a HOST TARGET binding site such as BINDING SITE I, BINDING SITE II or BINDING SITE III. Table 2 illustrates the complementarity of the nucleotide sequences of PRPF8 BINDING SITE, designated SEQ ID:30679, to the nucleotide sequence of VGAM1629 RNA, herein designated VGAM RNA, also designated SEQ ID:4340.

Another function of VGAM1629 is therefore inhibition of PRP8 Pre-mRNA Processing Factor 8 Homolog (yeast) (PRPF8, Accession XM_028335). Accordingly, utilities of VGAM1629 include diagnosis, prevention and treatment of diseases and clinical conditions associated with PRPF8. SR-BP1 (Accession NM_005866) is another VGAM1629 host target gene. SR-BP1 BINDING SITE is HOST TARGET binding site found in the 3' untranslated region of mRNA encoded by SR-BP1, corresponding to a HOST TARGET binding site such as BINDING SITE I, BINDING SITE II or BINDING SITE III. Table 2 illustrates the complementarity of the nucleotide sequences of SR-BP1 BINDING SITE, designated SEQ ID:12484, to the nucleotide sequence of VGAM1629 RNA, herein designated VGAM RNA, also designated SEQ ID:4340.

Another function of VGAM1629 is therefore inhibition of SR-BP1 (Accession NM_005866). Accordingly, utilities of VGAM1629 include diagnosis, prevention and treatment of diseases and clinical conditions associated with SR-BP1. FIG. 1 further provides a conceptual description of a novel bioinformatically detected viral gene of the present invention, referred to here as Viral Genomic Address Messenger 1630 (VGAM1630) viral gene, which modulates expression of respective host target genes thereof, the function and utility of which host target genes is known in the art.

VGAM1630 is a novel bioinformatically detected regulatory, non protein coding, viral micro RNA (miRNA) gene. The method by which VGAM1630 was detected is described hereinabove with reference to FIGS. 1-8.

VGAM1630 gene, herein designated VGAM GENE, is a viral gene contained in the genome of Bovine Herpesvirus 4. VGAM1630 host target gene, herein designated VGAM HOST TARGET GENE, is a human gene contained in the human genome.

VGAM1630 gene encodes a VGAM1630 precursor RNA, herein designated VGAM PRECURSOR RNA. Similar to other miRNA genes, and unlike most ordinary genes, VGAM1630 precursor RNA does not encode a protein. A nucleotide sequence identical or highly similar to the nucleotide sequence of VGAM1630 precursor RNA is designated SEQ ID:1616, and is provided hereinbelow with reference to the sequence listing part. Nucleotide sequence SEQ ID:1616 is located at position 84159 relative to the genome of Bovine Herpesvirus 4.

VGAM1630 precursor RNA folds onto itself, forming VGAM1630 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1630 folded precursor RNA into VGAM1630 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM1630 RNA is designated SEQ ID:4341, and is provided hereinbelow with reference to the sequence listing part.

VGAM1630 host target gene, herein designated VGAM HOST TARGET GENE, encodes a corresponding messenger RNA, VGAM1630 host target RNA, herein designated VGAM HOST TARGET RNA. VGAM1630 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1630 RNA, herein designated VGAM RNA, binds complementarily to one or more host target binding sites located in untranslated regions of VGAM1630 host target RNA, herein designated VGAM HOST TARGET RNA. This complementary binding is due to the fact that the nucleotide sequence of VGAM1630 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1630 RNA, herein designated VGAM RNA, may have a different number of host target binding sites in untranslated regions of a VGAM1630 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1630 RNA, herein designated VGAM RNA, to host target binding sites on VGAM1630 host target RNA, herein designated VGAM HOST TARGET RNA, such as BINDING SITE I, BINDING SITE II and BINDING SITE III, inhibits translation of VGAM1630 host target RNA into VGAM1630 host target protein, herein designated VGAM HOST TARGET PROTEIN. VGAM host target protein is therefore outlined by a broken line.

It is appreciated that VGAM1630 host target gene, herein designated VGAM HOST TARGET GENE, in fact represents a plurality of VGAM1630 host target genes. The mRNA of each one of this plurality of VGAM1630 host target genes comprises one or more host target binding sites, each having a nucleotide sequence which is at least partly complementary to VGAM1630 RNA, herein designated VGAM RNA, and which when bound by VGAM1630 RNA causes inhibition of translation of respective one or more VGAM1630 host target proteins.

It is further appreciated by one skilled in the art that the mode of translational inhibition illustrated by FIG. 1 with specific reference to translational inhibition exerted by VGAM1630 gene, herein designated VGAM GENE, on one or more VGAM1630 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1630 is inhibition of expression of host target genes, as part of a novel viral mechanism of attacking a host. Accordingly, utilities of VGAM1630 include diagnosis, prevention and treatment of viral infection by Bovine Herpesvirus 4. Specific functions, and accordingly utilities, of VGAM1630 correlate with, and may be deduced from, the identity of the host target genes which VGAM1630 binds and inhibits, and the function of these host target genes, as elaborated hereinbelow.

Nucleotide sequences of the VGAM1630 precursor RNA, herein designated VGAM PRECURSOR RNA, and of the 'diced' VGAM1630 RNA, herein designated VGAM RNA, and a schematic representation of the secondary folding of VGAM1630 folded precursor RNA, herein designated VGAM FOLDED PRECURSOR RNA, of VGAM1630 are further described hereinbelow with reference to Table 1.

Nucleotide sequences of host target binding sites, such as BINDING SITE-I, BINDING SITE-II and BINDING SITE-III of FIG. 1, found on VGAM1630 host target RNA, and schematic representation of the complementarity of each of these host target binding sites to VGAM1630 RNA, herein designated VGAM RNA, are described hereinbelow with reference to Table 2.

As mentioned hereinabove with reference to FIG. 1, a function of VGAM1630 gene, herein designated VGAM is inhibition of expression of VGAM1630 target genes. It is appreciated that specific functions, and accordingly utilities, of VGAM1630 correlate with, and may be deduced from, the identity of the target genes which VGAM1630 binds and inhibits, and the function of these target genes, as elaborated hereinbelow.

Fatty Acid Binding Protein 2, Intestinal (FABP2, Accession NM_000134) is a VGAM1630 host target gene. FABP2 BINDING SITE is HOST TARGET binding site found in the 3' untranslated region of mRNA encoded by FABP2, corresponding to a HOST TARGET binding site such as BINDING SITE I, BINDING SITE II or BINDING SITE III. Table 2 illustrates the complementarity of the nucleotide sequences of FABP2 BINDING SITE, designated SEQ ID:5626, to the nucleotide sequence of VGAM1630 RNA, herein designated VGAM RNA, also designated SEQ ID:4341.

A function of VGAM1630 is therefore inhibition of Fatty Acid Binding Protein 2, Intestinal (FABP2, Accession NM_000134), a gene which may have a role in dietary fat uptake or processing. Accordingly, utilities of VGAM1630 include diagnosis, prevention and treatment of diseases and clinical conditions associated with FABP2. The function of FABP2 and its association with various diseases and clinical conditions, has been established by previous studies, as described hereinabove with reference to VGAM951. Protein Kinase, AMP-activated, Alpha 2 Catalytic Subunit (PRKAA2, Accession NM_006252) is another VGAM1630 host target gene. PRKAA2 BINDING SITE is HOST TARGET binding site found in the 3' untranslated region of mRNA encoded by PRKAA2, corresponding to a HOST TARGET binding site such as BINDING SITE I, BINDING SITE II or BINDING SITE III. Table 2 illustrates the complementarity of the nucleotide sequences of PRKAA2 BINDING SITE, designated SEQ ID:12929, to the nucleotide sequence of VGAM1630 RNA, herein designated VGAM RNA, also designated SEQ ID:4341.

Another function of VGAM1630 is therefore inhibition of Protein Kinase, AMP-activated, Alpha 2 Catalytic Subunit (PRKAA2, Accession NM_006252), a gene which are responsible for the regulation of fatty acid synthesis by phosphorylation of acetyl-coa carboxylase. Accordingly, utilities of VGAM1630 include diagnosis, prevention and treatment of diseases and clinical conditions associated with PRKAA2. The function of PRKAA2 and its association with various diseases and clinical conditions, has been established by previous studies, as described hereinabove with reference to VGAM1544. G-protein Coupled Receptor 88 (GPR88, Accession NM_022049) is another VGAM1630 host target gene. GPR88 BINDING SITE is HOST TARGET binding site found in the 3' untranslated region of mRNA encoded by GPR88, corresponding to a HOST TARGET binding site such as BINDING SITE I, BINDING SITE II or BINDING SITE III. Table 2 illustrates the complementarity of the nucleotide sequences of GPR88 BINDING SITE, designated SEQ ID:22571, to the nucleotide sequence of VGAM1630 RNA, herein designated VGAM RNA, also designated SEQ ID:4341.

Another function of VGAM1630 is therefore inhibition of G-protein Coupled Receptor 88 (GPR88, Accession NM_022049). Accordingly, utilities of VGAM1630 include diagnosis, prevention and treatment of diseases and clinical conditions associated with GPR88. LOC148946 (Accession XM_097557) is another VGAM1630 host target gene. LOC148946 BINDING SITE is HOST TARGET binding site found in the 3' untranslated region of mRNA encoded by LOC148946, corresponding to a HOST TARGET binding site such as BINDING SITE I, BINDING SITE II or BINDING SITE III. Table 2 illustrates the complementarity of the nucleotide sequences of LOC148946 BINDING SITE, designated SEQ ID:40937, to the nucleotide sequence of VGAM1630 RNA, herein designated VGAM RNA, also designated SEQ ID:4341.

Another function of VGAM1630 is therefore inhibition of LOC148946 (Accession XM_097557). Accordingly, utilities of VGAM1630 include diagnosis, prevention and treatment of diseases and clinical conditions associated with LOC148946. LOC90750 (Accession XM_033868) is another VGAM1630 host target gene. LOC90750 BINDING SITE is HOST TARGET binding site found in the 3' untranslated region of mRNA encoded by LOC90750, corresponding to a HOST TARGET binding site such as BINDING SITE I, BINDING SITE II or BINDING SITE III. Table 2 illustrates the complementarity of the nucleotide sequences of LOC90750 BINDING SITE, designated SEQ ID:31966, to the nucleotide sequence of VGAM1630 RNA, herein designated VGAM RNA, also designated SEQ ID:4341.

Another function of VGAM1630 is therefore inhibition of LOC90750 (Accession XM_033868). Accordingly, utilities of VGAM1630 include diagnosis, prevention and treatment of diseases and clinical conditions associated with LOC90750. FIG. 1 further provides a conceptual description of a novel bioinformatically detected viral gene of the present invention, referred to here as Viral Genomic Address Messenger 1631 (VGAM1631) viral gene, which modulates expression of respective host target genes thereof, the function and utility of which host target genes is known in the art.

VGAM1631 is a novel bioinformatically detected regulatory, non protein coding, viral micro RNA (miRNA) gene. The method by which VGAM1631 was detected is described hereinabove with reference to FIGS. 1-8.

VGAM1631 gene, herein designated VGAM GENE, is a viral gene contained in the genome of Bovine Herpesvirus 4. VGAM1631 host target gene, herein designated VGAM HOST TARGET GENE, is a human gene contained in the human genome.

VGAM1631 gene encodes a VGAM1631 precursor RNA, herein designated VGAM PRECURSOR RNA. Similar to other miRNA genes, and unlike most ordinary genes, VGAM1631 precursor RNA does not encode a protein. A nucleotide sequence identical or highly similar to the nucleotide sequence of VGAM1631 precursor RNA is designated SEQ ID:1617, and is provided hereinbelow with reference to the sequence listing part. Nucleotide sequence SEQ ID:1617 is located at position 90442 relative to the genome of Bovine Herpesvirus 4.

VGAM1631 precursor RNA folds onto itself, forming VGAM1631 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1631 folded precursor RNA into VGAM1631 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1631 RNA is designated SEQ ID:4342, and is provided hereinbelow with reference to the sequence listing part.

VGAM1631 host target gene, herein designated VGAM HOST TARGET GENE, encodes a corresponding messenger RNA, VGAM1631 host target RNA, herein designated VGAM HOST TARGET RNA. VGAM1631 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1631 RNA, herein designated VGAM RNA, binds complementarily to one or more host target binding sites located in untranslated regions of VGAM1631 host target RNA, herein designated VGAM HOST TARGET RNA. This complementary binding is due to the fact that the nucleotide sequence of VGAM1631 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1631 RNA, herein designated VGAM RNA, may have a different number of host target binding sites in untranslated regions of a VGAM1631 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1631 RNA, herein designated VGAM RNA, to host target binding sites on VGAM1631 host target RNA, herein designated VGAM HOST TARGET RNA, such as BINDING SITE I, BINDING SITE II and BINDING SITE III, inhibits translation of VGAM1631 host target RNA into VGAM1631 host target protein, herein designated VGAM HOST TARGET PROTEIN. VGAM host target protein is therefore outlined by a broken line.

It is appreciated that VGAM1631 host target gene, herein designated VGAM HOST TARGET GENE, in fact represents a plurality of VGAM1631 host target genes. The mRNA of each one of this plurality of VGAM1631 host target genes comprises one or more host target binding sites, each having a nucleotide sequence which is at least partly complementary to VGAM1631 RNA, herein designated VGAM RNA, and which when bound by VGAM1631 RNA causes inhibition of translation of respective one or more VGAM1631 host target proteins.

It is further appreciated by one skilled in the art that the mode of translational inhibition illustrated by FIG. 1 with specific reference to translational inhibition exerted by VGAM1631 gene, herein designated VGAM GENE, on one or more VGAM1631 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1631 is inhibition of expression of host target genes, as part of a novel viral mechanism of attacking a host. Accordingly, utilities of VGAM1631 include diagnosis, prevention and treatment of viral infection by Bovine Herpesvirus 4. Specific functions, and accordingly utilities, of VGAM1631 correlate with, and may be deduced from, the identity of the host target genes which VGAM1631 binds and inhibits, and the function of these host target genes, as elaborated hereinbelow.

Nucleotide sequences of the VGAM1631 precursor RNA, herein designated VGAM PRECURSOR RNA, and of the 'diced' VGAM1631 RNA, herein designated VGAM RNA, and a schematic representation of the secondary folding of VGAM1631 folded precursor RNA, herein designated VGAM FOLDED PRECURSOR RNA, of VGAM1631 are further described hereinbelow with reference to Table 1.

Nucleotide sequences of host target binding sites, such as BINDING SITE-I, BINDING SITE-II and BINDING SITE-III of FIG. 1, found on VGAM1631 host target RNA, and schematic representation of the complementarity of each of these host target binding sites to VGAM1631 RNA, herein designated VGAM RNA, are described hereinbelow with reference to Table 2.

As mentioned hereinabove with reference to FIG. 1, a function of VGAM1631 gene, herein designated VGAM is inhibition of expression of VGAM1631 target genes. It is appreciated that specific functions, and accordingly utilities, of VGAM1631 correlate with, and may be deduced from, the identity of the target genes which VGAM1631 binds and inhibits, and the function of these target genes, as elaborated hereinbelow.

Hepatocyte Growth Factor (hepapoietin A; scatter factor) (HGF, Accession XM_168542) is a VGAM1631 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45221, to the nucleotide sequence of VGAM1631 RNA, herein designated VGAM RNA, also designated SEQ ID:4342.

A function of VGAM1631 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM1631 include diagnosis, prevention and treatment of diseases and clinical conditions associated with HGF. The function of HGF and its association with various diseases and clinical conditions, has been established by previous studies, as described hereinabove with reference to VGAM174. Muscleblind-like (Drosophila) (MBNL, Accession NM_021038) is another VGAM1631 host target gene. MBNL BINDING SITE is HOST TARGET binding site found in the 3' untranslated region of mRNA encoded by MBNL, corresponding to a HOST TARGET binding site such as BINDING SITE I, BINDING SITE II or BINDING SITE III. Table 2 illustrates the complementarity of the nucleotide sequences of MBNL BINDING SITE, designated SEQ ID:22028, to the nucleotide sequence of VGAM1631 RNA, herein designated VGAM RNA, also designated SEQ ID:4342.

Another function of VGAM1631 is therefore inhibition of Muscleblind-like (Drosophila) (MBNL, Accession NM_021038), a gene which binds to cug triplet repeat expansion dsrna (by similarity). Accordingly, utilities of VGAM1631 include diagnosis, prevention and treatment of diseases and clinical conditions associated with MBNL. The function of MBNL and its association with various diseases and clinical conditions, has been established by previous studies, as described hereinabove with reference to VGAM95. Protein Phosphatase 3 (formerly 2B), Regulatory Subunit B, 19 kDa, Alpha Isoform (calcineurin B, type I) (PPP3R1, Accession XM_084103) is another VGAM1631 host target gene. PPP3R1 BINDING SITE is HOST TARGET binding site found in the 3' untranslated region of mRNA encoded by PPP3R1, corresponding to a HOST TARGET binding site such as BINDING SITE I, BINDING SITE II or BINDING SITE III. Table 2 illustrates the complementarity of the nucleotide sequences of PPP3R1 BINDING SITE, designated SEQ ID:37530, to the nucleotide sequence of VGAM1631 RNA, herein designated VGAM RNA, also designated SEQ ID:4342.

Another function of VGAM1631 is therefore inhibition of Protein Phosphatase 3 (formerly 2B), Regulatory Subunit B, 19 kDa, Alpha Isoform (calcineurin B, type I) (PPP3R1, Accession XM_084103), a gene which is a regulatory subunit of calcineurim, a calcium-dependent, calmodulin stimulated protein phosphatase 3. Accordingly, utilities of VGAM1631 include diagnosis, prevention and treatment of diseases and clinical conditions associated with PPP3R1. The function of PPP3R1 and its association with various diseases and clinical conditions, has been established by previous studies, as described hereinabove with reference to VGAM323. LOC116068 (Accession XM_057302) is another VGAM1631 host target gene. LOC116068 BINDING SITE is HOST TARGET binding site found in the 3' untranslated region of mRNA encoded by LOC116068, corresponding to a HOST TARGET binding site such as BINDING SITE I, BINDING SITE II or BINDING SITE III. Table 2 illustrates the complementarity of the nucleotide sequences of LOC116068 BINDING SITE, designated SEQ ID:36500, to the nucleotide sequence of VGAM1631 RNA, herein designated VGAM RNA, also designated SEQ ID:4342.

Another function of VGAM1631 is therefore inhibition of LOC116068 (Accession XM_057302). Accordingly, utilities of VGAM1631 include diagnosis, prevention and treatment of diseases and clinical conditions associated with LOC116068. FIG. 1 further provides a conceptual description of a novel bioinformatically detected viral gene of the present invention, referred to here as Viral Genomic Address Messenger 1632 (VGAM1632) viral gene, which modulates expression of respective host target genes thereof, the function and utility of which host target genes is known in the art.

VGAM1632 is a novel bioinformatically detected regulatory, non protein coding, viral micro RNA (miRNA) gene. The method by which VGAM1632 was detected is described hereinabove with reference to FIGS. 1-8.

VGAM1632 gene, herein designated VGAM GENE, is a viral gene contained in the genome of Bovine Herpesvirus 4. VGAM1632 host target gene, herein designated VGAM HOST TARGET GENE, is a human gene contained in the human genome.

VGAM1632 gene encodes a VGAM1632 precursor RNA, herein designated VGAM PRECURSOR RNA. Similar to other miRNA genes, and unlike most ordinary genes, VGAM1632 precursor RNA does not encode a protein. A nucleotide sequence identical or highly similar to the nucleotide sequence of VGAM1632 precursor RNA is designated SEQ ID:1618, and is provided hereinbelow with reference to the sequence listing part. Nucleotide sequence SEQ ID:1618 is located at position 85979 relative to the genome of Bovine Herpesvirus 4.

VGAM1632 precursor RNA folds onto itself, forming VGAM1632 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1632 folded precursor RNA into VGAM1632 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1632 RNA is designated SEQ ID:4343, and is provided hereinbelow with reference to the sequence listing part.

VGAM1632 host target gene, herein designated VGAM HOST TARGET GENE, encodes a corresponding messenger RNA, VGAM1632 host target RNA, herein designated VGAM HOST TARGET RNA. VGAM1632 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1632 RNA, herein designated VGAM RNA, binds complementarily to one or more host target binding sites located in untranslated regions of VGAM1632 host target RNA, herein designated VGAM HOST TARGET RNA. This complementary binding is due to the fact that the nucleotide sequence of VGAM1632 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1632 RNA, herein designated VGAM RNA, may have a different number of host target binding sites in untranslated regions of a VGAM1632 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1632 RNA, herein designated VGAM RNA, to host target binding sites on VGAM1632 host target RNA, herein designated VGAM HOST TARGET RNA, such as BINDING SITE I, BINDING SITE II and BINDING SITE III, inhibits translation of VGAM1632 host target RNA into VGAM1632 host target protein, herein designated VGAM HOST TARGET PROTEIN. VGAM host target protein is therefore outlined by a broken line.

It is appreciated that VGAM1632 host target gene, herein designated VGAM HOST TARGET GENE, in fact represents a plurality of VGAM1632 host target genes. The mRNA of each one of this plurality of VGAM1632 host target genes comprises one or more host target binding sites, each having a nucleotide sequence which is at least partly complementary to VGAM1632 RNA, herein designated VGAM RNA, and which when bound by VGAM1632 RNA causes inhibition of translation of respective one or more VGAM1632 host target proteins.

It is further appreciated by one skilled in the art that the mode of translational inhibition illustrated by FIG. 1 with specific reference to translational inhibition exerted by VGAM1632 gene, herein designated VGAM GENE, on one or more VGAM1632 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1632 is inhibition of expression of host target genes, as part of a novel viral mechanism of attacking a host. Accordingly, utilities of VGAM1632 include diagnosis, prevention and treatment of viral infection by Bovine Herpesvirus 4. Specific functions, and accordingly utilities, of VGAM1632 correlate with, and may be deduced from, the identity of the host target genes which VGAM1632 binds and inhibits, and the function of these host target genes, as elaborated hereinbelow.

Nucleotide sequences of the VGAM1632 precursor RNA, herein designated VGAM PRECURSOR RNA, and of the 'diced' VGAM1632 RNA, herein designated VGAM RNA, and a schematic representation of the secondary folding of VGAM1632 folded precursor RNA, herein designated VGAM FOLDED PRECURSOR RNA, of VGAM1632 are further described hereinbelow with reference to Table 1.

Nucleotide sequences of host target binding sites, such as BINDING SITE-I, BINDING SITE-II and BINDING SITE-III of FIG. 1, found on VGAM1632 host target RNA, and schematic representation of the complementarity of each of these host target binding sites to VGAM1632 RNA, herein designated VGAM RNA, are described hereinbelow with reference to Table 2.

As mentioned hereinabove with reference to FIG. 1, a function of VGAM1632 gene, herein designated VGAM is inhibition of expression of VGAM1632 target genes. It is appreciated that specific functions, and accordingly utilities, of VGAM1632 correlate with, and may be deduced from, the identity of the target genes which VGAM1632 binds and inhibits, and the function of these target genes, as elaborated hereinbelow.

Rho GTPase Activating Protein 6 (ARHGAP6, Accession NM_001174) is a VGAM1632 host target gene. ARHGAP6 BINDING SITE1 and ARHGAP6 BINDING SITE2 are HOST TARGET binding sites found in untranslated regions of mRNA encoded by ARHGAP6, corresponding to HOST TARGET binding sites such as BINDING SITE I, BINDING SITE II or BINDING SITE III. Table 2 illustrates the complementarity of the nucleotide sequences of ARHGAP6 BINDING SITE1 and ARHGAP6 BINDING SITE2, designated SEQ ID:6838 and SEQ ID:15082 respectively, to the nucleotide sequence of VGAM1632 RNA, herein designated VGAM RNA, also designated SEQ ID:4343.

A function of VGAM1632 is therefore inhibition of Rho GTPase Activating Protein 6 (ARHGAP6, Accession NM_001174), a gene which activates the rho-type GTPases by converting them to an inactive GTP-bound state. Accordingly, utilities of VGAM1632 include diagnosis, prevention and treatment of diseases and clinical conditions associated with ARHGAP6. The function of ARHGAP6 and its association with various diseases and clinical conditions, has been established by previous studies, as described hereinabove with reference to VGAM55. FLJ10743 (Accession NM_018201) is another VGAM1632 host target gene. FLJ10743 BINDING SITE is HOST TARGET binding site found in the 3' untranslated region of mRNA encoded by FLJ10743, corresponding to a HOST TARGET binding site such as BINDING SITE I, BINDING SITE II or BINDING SITE III. Table 2 illustrates the complementarity of the nucleotide sequences of FLJ10743 BINDING SITE, designated SEQ ID:20075, to the nucleotide sequence of VGAM1632 RNA, herein designated VGAM RNA, also designated SEQ ID:4343.

Another function of VGAM1632 is therefore inhibition of FLJ10743 (Accession NM_018201). Accordingly, utilities of VGAM1632 include diagnosis, prevention and treatment of diseases and clinical conditions associated with FLJ10743. Homocysteine-inducible, Endoplasmic Reticulum Stress-inducible, Ubiquitin-like Domain Member 1 (HERPUD1, Accession NM_014685) is another VGAM1632 host target gene. HERPUD1 BINDING SITE is HOST TARGET binding site found in the 3' untranslated region of mRNA encoded by HERPUD1, corresponding to a HOST TARGET binding site such as BINDING SITE I, BINDING SITE II or BINDING SITE III. Table 2 illustrates the complementarity of the nucleotide sequences of HERPUD1 BINDING SITE, designated SEQ ID:16186, to the nucleotide sequence of VGAM1632 RNA, herein designated VGAM RNA, also designated SEQ ID:4343.

Another function of VGAM1632 is therefore inhibition of Homocysteine-inducible, Endoplasmic Reticulum Stress-inducible, Ubiquitin-like Domain Member 1 (HERPUD1, Accession NM_014685). Accordingly, utilities of VGAM1632 include diagnosis, prevention and treatment of diseases and clinical conditions associated with HERPUD1. Zinc Finger Protein 95 Homolog (mouse) (ZFP95, Accession NM_014569) is another VGAM1632 host target gene. ZFP95 BINDING SITE1 and ZFP95 BINDING SITE2 are HOST TARGET binding sites found in untranslated regions of mRNA encoded by ZFP95, corresponding to HOST TARGET binding sites such as BINDING SITE I, BINDING SITE II or BINDING SITE III. Table 2 illustrates the complementarity of the nucleotide sequences of ZFP95 BINDING SITE1 and ZFP95 BINDING SITE2, designated SEQ ID:15920 and SEQ ID:29710 respectively, to the nucleotide sequence of VGAM1632 RNA, herein designated VGAM RNA, also designated SEQ ID:4343.

Another function of VGAM1632 is therefore inhibition of Zinc Finger Protein 95 Homolog (mouse) (ZFP95, Accession NM_014569). Accordingly, utilities of VGAM1632 include diagnosis, prevention and treatment of diseases and clinical conditions associated with ZFP95. LOC255030 (Accession XM_173197) is another VGAM1632 host target gene. LOC255030 BINDING SITE is HOST TARGET binding site found in the 5' untranslated region of mRNA encoded by LOC255030, corresponding to a HOST TARGET binding site such as BINDING SITE I, BINDING SITE II or BINDING SITE III. Table 2 illustrates the complementarity of the nucleotide sequences of LOC255030 BINDING SITE, designated SEQ ID:46439, to the nucleotide sequence of VGAM1632 RNA, herein designated VGAM RNA, also designated SEQ ID:4343.

Another function of VGAM1632 is therefore inhibition of LOC255030 (Accession XM_173197). Accordingly, utilities of VGAM1632 include diagnosis, prevention and treatment of diseases and clinical conditions associated with LOC255030. FIG. 1 further provides a conceptual description of a novel bioinformatically detected viral gene of the present invention, referred to here as Viral Genomic Address Messenger 1633 (VGAM1633) viral gene, which modulates expression of respective host target genes thereof, the function and utility of which host target genes is known in the art.

VGAM1633 is a novel bioinformatically detected regulatory, non protein coding, viral micro RNA (miRNA) gene. The method by which VGAM1633 was detected is described hereinabove with reference to FIGS. 1-8.

VGAM1633 gene, herein designated VGAM GENE, is a viral gene contained in the genome of Bovine Herpesvirus 4. VGAM1633 host target gene, herein designated VGAM HOST TARGET GENE, is a human gene contained in the human genome.

VGAM1633 gene encodes a VGAM1633 precursor RNA, herein designated VGAM PRECURSOR RNA. Similar to other miRNA genes, and unlike most ordinary genes, VGAM1633 precursor RNA does not encode a protein. A nucleotide sequence identical or highly similar to the nucleotide sequence of VGAM1633 precursor RNA is designated SEQ ID:1619, and is provided hereinbelow with reference to the sequence listing part. Nucleotide sequence SEQ ID:1619 is located at position 85246 relative to the genome of Bovine Herpesvirus 4.

VGAM1633 precursor RNA folds onto itself, forming VGAM1633 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1633 folded precursor RNA into VGAM1633 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1633 RNA is designated SEQ ID:4344, and is provided hereinbelow with reference to the sequence listing part.

VGAM1633 host target gene, herein designated VGAM HOST TARGET GENE, encodes a corresponding messenger RNA, VGAM1633 host target RNA, herein designated VGAM HOST TARGET RNA. VGAM1633 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1633 RNA, herein designated VGAM RNA, binds complementarily to one or more host target binding sites located in untranslated regions of VGAM1633 host target RNA, herein designated VGAM HOST TARGET RNA. This complementary binding is due to the fact that the nucleotide sequence of VGAM1633 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1633 RNA, herein designated VGAM RNA, may have a different number of host target binding sites in untranslated regions of a VGAM1633 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1633 RNA, herein designated VGAM RNA, to host target binding sites on VGAM1633 host target RNA, herein designated VGAM HOST TARGET RNA, such as BINDING SITE I, BINDING SITE II and BINDING SITE III, inhibits translation of VGAM1633 host target RNA into VGAM1633 host target protein, herein designated VGAM HOST TARGET PROTEIN. VGAM host target protein is therefore outlined by a broken line.

It is appreciated that VGAM1633 host target gene, herein designated VGAM HOST TARGET GENE, in fact represents a plurality of VGAM1633 host target genes. The mRNA of each one of this plurality of VGAM1633 host target genes comprises one or more host target binding sites, each having a nucleotide sequence which is at least partly complementary to VGAM1633 RNA, herein designated VGAM RNA, and which when bound by VGAM1633 RNA causes inhibition of translation of respective one or more VGAM1633 host target proteins.

It is further appreciated by one skilled in the art that the mode of translational inhibition illustrated by FIG. 1 with specific reference to translational inhibition exerted by VGAM1633 gene, herein designated VGAM GENE, on one or more VGAM1633 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1633 is inhibition of expression of host target genes, as part of a novel viral mechanism of attacking a host. Accordingly, utilities of VGAM1633 include diagnosis, prevention and treatment of viral infection by Bovine Herpesvirus 4. Specific functions, and accordingly utilities, of VGAM1633 correlate with, and may be deduced from, the identity of the host target genes which VGAM1633 binds and inhibits, and the function of these host target genes, as elaborated hereinbelow.

Nucleotide sequences of the VGAM1633 precursor RNA, herein designated VGAM PRECURSOR RNA, and of the 'diced' VGAM1633 RNA, herein designated VGAM RNA, and a schematic representation of the secondary folding of VGAM1633 folded precursor RNA, herein designated VGAM FOLDED PRECURSOR RNA, of VGAM1633 are further described hereinbelow with reference to Table 1.

Nucleotide sequences of host target binding sites, such as BINDING SITE-I, BINDING SITE-II and BINDING SITE-III of FIG. 1, found on VGAM1633 host target RNA, and schematic representation of the complementarity of each of these host target binding sites to VGAM1633 RNA, herein designated VGAM RNA, are described hereinbelow with reference to Table 2.

As mentioned hereinabove with reference to FIG. 1, a function of VGAM1633 gene, herein designated VGAM is inhibition of expression of VGAM1633 target genes. It is appreciated that specific functions, and accordingly utilities, of VGAM1633 correlate with, and may be deduced from, the identity of the target genes which VGAM1633 binds and inhibits, and the function of these target genes, as elaborated hereinbelow.

RAB Interacting Factor (RABIF, Accession NM_002871) is a VGAM1633 host target gene. RABIF BINDING SITE is HOST TARGET binding site found in the 3' untranslated region of mRNA encoded by RABIF, corresponding to a HOST TARGET binding site such as BINDING SITE I, BINDING SITE II or BINDING SITE III. Table 2 illustrates the complementarity of the nucleotide sequences of RABIF BINDING SITE, designated SEQ ID:8779, to the nucleotide sequence of VGAM1633 RNA, herein designated VGAM RNA, also designated SEQ ID:4344.

A function of VGAM1633 is therefore inhibition of RAB Interacting Factor (RABIF, Accession NM_002871), a gene which is involved in the regulation of intracellular vesicular transport. Accordingly, utilities of VGAM1633 include diagnosis, prevention and treatment of diseases and clinical conditions associated with RABIF. The function of RABIF has been established by previous studies. The Sec4/Rab-related small GTP-binding proteins are involved in the regulation of intracellular vesicular transport. Mss4 stimulates GTP-GDP exchange in Sec4 and Rab and binds to a subset of genetically related Rab proteins. Yu and Schreiber (1995) cloned a human MSS4 cDNA. The gene encodes a 123-amino acid polypeptide that requires zinc for stability. Muller-Pillasch et al. (1997) showed by Northern blot analysis that MSS4 is expressed as 3 differently sized mRNAs, probably due to alternative polyadenylation signals. The transcripts are present at barely detectable levels in healthy pancreas, but at much higher levels in pancreatic and other cancer tissues. Muller-Pillasch et al. (1997) used fluorescence in situ hybridization to map the MSS4 gene to human chromosome 1q32-q41.

Full details of the abovementioned studies are described in the following publications, the disclosure of which are hereby incorporated by reference:

Muller-Pillasch, F.; Zimmerhackl, F.; Lacher, U.; Schultz, N.; Hameister, H.; Varga, G.; Friess, H.; Buchler, M.; Adler, G.; Gress, T. M.: Cloning of novel transcripts of the human guanine-nucleotide-exchange factor Mss4: in situ chromosomal mapping and expression in pancreatic cancer. Genomics 46:389-396, 1997; and Yu, H.; Schreiber, S. L.: Cloning, Zn (2+) binding, and structural characterization of the guanine nucleotide exchange factor human Mss4. Biochemistry 34:9103-9110, 1995.

Further studies establishing the function and utilities of RABIF are found in John Hopkins OMIM database record ID 603417, and in sited publications numbered 8184-8185 listed in the bibliography section hereinbelow, which are also hereby incorporated by reference. KIAA0596 (Accession XM_031706) is another VGAM1633 host target gene. KIAA0596 BINDING SITE is HOST TARGET binding site found in the 3' untranslated region of mRNA encoded by KIAA0596, corresponding to a HOST TARGET binding site such as BINDING SITE I, BINDING SITE II or BINDING SITE III. Table 2 illustrates the complementarity of the nucleotide sequences of KIAA0596 BINDING SITE, designated SEQ ID:31461, to the nucleotide sequence of VGAM1633 RNA, herein designated VGAM RNA, also designated SEQ ID:4344.

Another function of VGAM1633 is therefore inhibition of KIAA0596 (Accession XM_031706). Accordingly, utilities of VGAM1633 include diagnosis, prevention and treatment of diseases and clinical conditions associated with KIAA0596. LOC144501 (Accession XM_096612) is another VGAM1633 host target gene. LOC144501 BINDING SITE is HOST TARGET binding site found in the 3' untranslated region of mRNA encoded by LOC144501, corresponding to a HOST TARGET binding site such as BINDING SITE I, BINDING SITE II or BINDING SITE III. Table 2 illustrates the complementarity of the nucleotide sequences of LOC144501 BINDING SITE, designated SEQ ID:40425, to the nucleotide sequence of VGAM1633 RNA, herein designated VGAM RNA, also designated SEQ ID:4344.

Another function of VGAM1633 is therefore inhibition of LOC144501 (Accession XM_096612). Accordingly, utilities of VGAM1633 include diagnosis, prevention and treatment of diseases and clinical conditions associated with LOC144501. LOC163412 (Accession XM_088868) is another VGAM1633 host target gene. LOC163412 BINDING SITE is HOST TARGET binding site found in the 5' untranslated region of mRNA encoded by LOC163412, corresponding to a HOST TARGET binding site such as BINDING SITE I, BINDING SITE II or BINDING SITE III. Table 2 illustrates the complementarity of the nucleotide sequences of LOC163412 BINDING SITE, designated SEQ ID:39955, to the nucleotide sequence of VGAM1633 RNA, herein designated VGAM RNA, also designated SEQ ID:4344.

Another function of VGAM1633 is therefore inhibition of LOC163412 (Accession XM_088868). Accordingly, utilities of VGAM1633 include diagnosis, prevention and treatment of diseases and clinical conditions associated with LOC163412. LOC222182 (Accession XM_168471) is another VGAM1633 host target gene. LOC222182 BINDING SITE is HOST TARGET binding site found in the 3' untranslated region of mRNA encoded by LOC222182, corresponding to a HOST TARGET binding site such as BINDING SITE I, BINDING SITE II or BINDING SITE III. Table 2 illustrates the complementarity of the nucleotide sequences of LOC222182 BINDING SITE, designated SEQ ID:45197, to the nucleotide sequence of VGAM1633 RNA, herein designated VGAM RNA, also designated SEQ ID:4344.

Another function of VGAM1633 is therefore inhibition of LOC222182 (Accession XM_168471). Accordingly, utilities of VGAM1633 include diagnosis, prevention and treatment of diseases and clinical conditions associated with LOC222182. FIG. 1 further provides a conceptual description of a novel bioinformatically detected viral gene of the present invention, referred to here as Viral Genomic Address Messenger 1634 (VGAM1634) viral gene, which modulates expression of respective host target genes thereof, the function and utility of which host target genes is known in the art.

VGAM1634 is a novel bioinformatically detected regulatory, non protein coding, viral micro RNA (miRNA) gene. The method by which VGAM1634 was detected is described hereinabove with reference to FIGS. 1-8.

VGAM1634 gene, herein designated VGAM GENE, is a viral gene contained in the genome of Bovine Herpesvirus 4. VGAM1634 host target gene, herein designated VGAM HOST TARGET GENE, is a human gene contained in the human genome.

VGAM1634 gene encodes a VGAM1634 precursor RNA, herein designated VGAM PRECURSOR RNA. Similar to other miRNA genes, and unlike most ordinary genes, VGAM1634 precursor RNA does not encode a protein. A nucleotide sequence identical or highly similar to the nucleotide sequence of VGAM1634 precursor RNA is designated SEQ ID:1620, and is provided hereinbelow with reference to the sequence listing part. Nucleotide sequence SEQ ID:1620 is located at position 81295 relative to the genome of Bovine Herpesvirus 4.

VGAM1634 precursor RNA folds onto itself, forming VGAM1634 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1634 folded precursor RNA into VGAM1634 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1634 RNA is designated SEQ ID:4345, and is provided hereinbelow with reference to the sequence listing part.

VGAM1634 host target gene, herein designated VGAM HOST TARGET GENE, encodes a corresponding messenger RNA, VGAM1634 host target RNA, herein designated VGAM HOST TARGET RNA. VGAM1634 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1634 RNA, herein designated VGAM RNA, binds complementarily to one or more host target binding sites located in untranslated regions of VGAM1634 host target RNA, herein designated VGAM HOST TARGET RNA. This complementary binding is due to the fact that the nucleotide sequence of VGAM1634 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1634 RNA, herein designated VGAM RNA, may have a different number of host target binding sites in untranslated regions of a VGAM1634 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1634 RNA, herein designated VGAM RNA, to host target binding sites on VGAM1634 host target RNA, herein designated VGAM HOST TARGET RNA, such as BINDING SITE I, BINDING SITE II and BINDING SITE III, inhibits translation of VGAM1634 host target RNA into VGAM1634 host target protein, herein designated VGAM HOST TARGET PROTEIN. VGAM host target protein is therefore outlined by a broken line.

It is appreciated that VGAM1634 host target gene, herein designated VGAM HOST TARGET GENE, in fact represents a plurality of VGAM1634 host target genes. The mRNA of each one of this plurality of VGAM1634 host target genes comprises one or more host target binding sites, each having a nucleotide sequence which is at least partly complementary to VGAM1634 RNA, herein designated VGAM RNA, and which when bound by VGAM1634 RNA causes inhibition of translation of respective one or more VGAM1634 host target proteins.

It is further appreciated by one skilled in the art that the mode of translational inhibition illustrated by FIG. 1 with specific reference to translational inhibition exerted by VGAM1634 gene, herein designated VGAM GENE, on one or more VGAM1634 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1634 is inhibition of expression of host target genes, as part of a novel viral mechanism of attacking a host. Accordingly, utilities of VGAM1634 include diagnosis, prevention and treatment of viral infection by Bovine Herpesvirus 4. Specific functions, and accordingly utilities, of VGAM1634 correlate with, and may be deduced from, the identity of the host target genes which VGAM1634 binds and inhibits, and the function of these host target genes, as elaborated hereinbelow.

Nucleotide sequences of the VGAM1634 precursor RNA, herein designated VGAM PRECURSOR RNA, and of the 'diced' VGAM1634 RNA, herein designated VGAM RNA, and a schematic representation of the secondary folding of VGAM1634 folded precursor RNA, herein designated VGAM FOLDED PRECURSOR RNA, of VGAM1634 are further described hereinbelow with reference to Table 1.

Nucleotide sequences of host target binding sites, such as BINDING SITE-I, BINDING SITE-II and BINDING SITE-III of FIG. 1, found on VGAM1634 host target RNA, and schematic representation of the complementarity of each of these host target binding sites to VGAM1634 RNA, herein designated VGAM RNA, are described hereinbelow with reference to Table 2.

As mentioned hereinabove with reference to FIG. 1, a function of VGAM1634 gene, herein designated VGAM is inhibition of expression of VGAM1634 target genes. It is appreciated that specific functions, and accordingly utilities, of VGAM1634 correlate with, and may be deduced from, the identity of the target genes which VGAM1634 binds and inhibits, and the function of these target genes, as elaborated hereinbelow.

Nuclear Receptor Subfamily 5, Group A, Member 2 (NR5A2, Accession NM_003822) is a VGAM1634 host target gene. NR5A2 BINDING SITE is HOST TARGET binding site found in the 3' untranslated region of mRNA encoded by NR5A2, corresponding to a HOST TARGET binding site such as BINDING SITE I, BINDING SITE II or BINDING SITE III. Table 2 illustrates the complementarity of the nucleotide sequences of NR5A2 BINDING SITE, designated SEQ ID:9915, to the nucleotide sequence of VGAM1634 RNA, herein designated VGAM RNA, also designated SEQ ID:4345.

A function of VGAM1634 is therefore inhibition of Nuclear Receptor Subfamily 5, Group A, Member 2 (NR5A2, Accession NM_003822), a gene which is a member of nuclear receptor superfamily of trancriptional activators and activates the hepatitis B virus (HBV) promoter. Accordingly, utilities of VGAM1634 include diagnosis, prevention and treatment of diseases and clinical conditions associated with NR5A2. The function of NR5A2 and its association with various diseases and clinical conditions, has been established by previous studies, as described hereinabove with reference to VGAM375. Wingless-type MMTV Integration Site Family, Member 3A (WNT3A, Accession NM_033131) is another VGAM1634 host target gene. WNT3A BINDING SITE is HOST TARGET binding site found in the 3' untranslated region of mRNA encoded by WNT3A, corresponding to a HOST TARGET binding site such as BINDING SITE I, BINDING SITE II or BINDING SITE III. Table 2 illustrates the complementarity of the nucleotide sequences of WNT3A BINDING SITE, designated SEQ ID:26973, to the nucleotide sequence of VGAM1634 RNA, herein designated VGAM RNA, also designated SEQ ID:4345.

Another function of VGAM1634 is therefore inhibition of Wingless-type MMTV Integration Site Family, Member 3A (WNT3A, Accession NM_033131). Accordingly, utilities of VGAM1634 include diagnosis, prevention and treatment of diseases and clinical conditions associated with WNT3A. CDC14 Cell Division Cycle 14 Homolog B (S. cerevisiae) (CDC14B, Accession NM_033332) is another VGAM1634 host target gene. CDC14B BINDING SITE is HOST TARGET binding site found in the 3' untranslated region of mRNA encoded by CDC14B, corresponding to a HOST TARGET binding site such as BINDING SITE I, BINDING SITE II or BINDING SITE III. Table 2 illustrates the complementarity of the nucleotide sequences of CDC14B BINDING SITE, designated SEQ ID:27166, to the nucleotide sequence of VGAM1634 RNA, herein designated VGAM RNA, also designated SEQ ID:4345.

Another function of VGAM1634 is therefore inhibition of CDC14 Cell Division Cycle 14 Homolog B (S. cerevisiae) (CDC14B, Accession NM_033332). Accordingly, utilities of VGAM1634 include diagnosis, prevention and treatment of diseases and clinical conditions associated with CDC14B. KIAA1656 (Accession XM_038022) is another VGAM1634 host target gene. KIAA1656 BINDING SITE is HOST TARGET binding site found in the 5' untranslated region of mRNA encoded by KIAA1656, corresponding to a HOST TARGET binding site such as BINDING SITE I, BINDING SITE II or BINDING SITE III. Table 2 illustrates the complementarity of the nucleotide sequences of KIAA1656 BINDING SITE, designated SEQ ID:32727, to the nucleotide sequence of VGAM1634 RNA, herein designated VGAM RNA, also designated SEQ ID:4345.

Another function of VGAM1634 is therefore inhibition of KIAA1656 (Accession XM_038022). Accordingly, utilities of VGAM1634 include diagnosis, prevention and treatment of diseases and clinical conditions associated with KIAA1656. PRO1914 (Accession NM_014106) is another VGAM1634 host target gene. PRO1914 BINDING SITE is HOST TARGET binding site found in the 5' untranslated region of mRNA encoded by PRO1914, corresponding to a HOST TARGET binding site such as BINDING SITE I, BINDING SITE II or BINDING SITE III. Table 2 illustrates the complementarity of the nucleotide sequences of PRO1914 BINDING SITE, designated SEQ ID:15329, to the nucleotide sequence of VGAM1634 RNA, herein designated VGAM RNA, also designated SEQ ID:4345.

Another function of VGAM1634 is therefore inhibition of PRO1914 (Accession NM_014106). Accordingly, utilities of VGAM1634 include diagnosis, prevention and treatment of diseases and clinical conditions associated with PRO1914. PRO2859 (Accession NM_018543) is another VGAM1634 host target gene. PRO2859 BINDING SITE is HOST TARGET binding site found in the 5' untranslated region of mRNA encoded by PRO2859, corresponding to a HOST TARGET binding site such as BINDING SITE I, BINDING SITE II or BINDING SITE III. Table 2 illustrates the complementarity of the nucleotide sequences of PRO2859 BINDING SITE, designated SEQ ID:20616, to the nucleotide sequence of VGAM1634 RNA, herein designated VGAM RNA, also designated SEQ ID:4345.

Another function of VGAM1634 is therefore inhibition of PRO2859 (Accession NM_018543). Accordingly, utilities of VGAM1634 include diagnosis, prevention and treatment of diseases and clinical conditions associated with PRO2859. RDH-E2 (Accession NM_138969) is another VGAM1634 host target gene. RDH-E2 BINDING SITE is HOST TARGET binding site found in the 3' untranslated region of mRNA encoded by RDH-E2, corresponding to a HOST TARGET binding site such as BINDING SITE I, BINDING SITE II or BINDING SITE III. Table 2 illustrates the complementarity of the nucleotide sequences of RDH-E2 BINDING SITE, designated SEQ ID:29079, to the nucleotide sequence of VGAM1634 RNA, herein designated VGAM RNA, also designated SEQ ID:4345.

Another function of VGAM1634 is therefore inhibition of RDH-E2 (Accession NM_138969). Accordingly, utilities of VGAM1634 include diagnosis, prevention and treatment of diseases and clinical conditions associated with RDH-E2. LOC131583 (Accession XM_067456) is another VGAM1634 host target gene. LOC131583 BINDING SITE is HOST TARGET binding site found in the 5' untranslated region of mRNA encoded by LOC131583, corresponding to a HOST TARGET binding site such as BINDING SITE I, BINDING SITE II or BINDING SITE III. Table 2 illustrates the complementarity of the nucleotide sequences of LOC131583 BINDING SITE, designated SEQ ID:37356, to the nucleotide sequence of VGAM1634 RNA, herein designated VGAM RNA, also designated SEQ ID:4345.

Another function of VGAM1634 is therefore inhibition of LOC131583 (Accession XM_067456). Accordingly, utilities of VGAM1634 include diagnosis, prevention and treatment of diseases and clinical conditions associated with LOC131583. LOC204593 (Accession XM_119002) is another VGAM1634 host target gene. LOC204593 BINDING SITE is HOST TARGET binding site found in the 5' untranslated region of mRNA encoded by LOC204593, corresponding to a HOST TARGET binding site such as BINDING SITE I, BINDING SITE II or BINDING SITE III. Table 2 illustrates the complementarity of the nucleotide sequences of LOC204593 BINDING SITE, designated SEQ ID:43583, to the nucleotide sequence of VGAM1634 RNA, herein designated VGAM RNA, also designated SEQ ID:4345.

Another function of VGAM1634 is therefore inhibition of LOC204593 (Accession XM_119002). Accordingly, utilities of VGAM1634 include diagnosis, prevention and treatment of diseases and clinical conditions associated with LOC204593. LOC254042 (Accession XM_171022) is another VGAM1634 host target gene. LOC254042 BINDING SITE is HOST TARGET binding site found in the 3' untranslated region of mRNA encoded by LOC254042, corresponding to a HOST TARGET binding site such as BINDING SITE I, BINDING SITE II or BINDING SITE III. Table 2 illustrates the complementarity of the nucleotide sequences of LOC254042 BINDING SITE, designated SEQ ID:45791, to the nucleotide sequence of VGAM1634 RNA, herein designated VGAM RNA, also designated SEQ ID:4345.

Another function of VGAM1634 is therefore inhibition of LOC254042 (Accession XM_171022). Accordingly, utilities of VGAM1634 include diagnosis, prevention and treatment of diseases and clinical conditions associated with LOC254042. FIG. 1 further provides a conceptual description of a novel bioinformatically detected viral gene of the present invention, referred to here as Viral Genomic Address Messenger 1635 (VGAM1635) viral gene, which modulates expression of respective host target genes thereof, the function and utility of which host target genes is known in the art.

VGAM1635 is a novel bioinformatically detected regulatory, non protein coding, viral micro RNA (miRNA) gene. The method by which VGAM1635 was detected is described hereinabove with reference to FIGS. 1-8.

VGAM1635 gene, herein designated VGAM GENE, is a viral gene contained in the genome of Human Herpesvirus 8. VGAM1635 host target gene, herein designated VGAM HOST TARGET GENE, is a human gene contained in the human genome.

VGAM1635 gene encodes a VGAM1635 precursor RNA, herein designated VGAM PRECURSOR RNA. Similar to other miRNA genes, and unlike most ordinary genes, VGAM1635 precursor RNA does not encode a protein. A nucleotide sequence identical or highly similar to the nucleotide sequence of VGAM1635 precursor RNA is designated SEQ ID:1621, and is provided hereinbelow with reference to the sequence listing part. Nucleotide sequence SEQ ID:1621 is located at position 121659 relative to the genome of Human Herpesvirus 8.

VGAM1635 precursor RNA folds onto itself, forming VGAM1635 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1635 folded precursor RNA into VGAM1635 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1635 RNA is designated SEQ ID:4346, and is provided hereinbelow with reference to the sequence listing part.

VGAM1635 host target gene, herein designated VGAM HOST TARGET GENE, encodes a corresponding messenger RNA, VGAM1635 host target RNA, herein designated VGAM HOST TARGET RNA. VGAM1635 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1635 RNA, herein designated VGAM RNA, binds complementarily to one or more host target binding sites located in untranslated regions of VGAM1635 host target RNA, herein designated VGAM HOST TARGET RNA. This complementary binding is due to the fact that the nucleotide sequence of VGAM1635 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1635 RNA, herein designated VGAM RNA, may have a different number of host target binding sites in untranslated regions of a VGAM1635 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1635 RNA, herein designated VGAM RNA, to host target binding sites on VGAM1635 host target RNA, herein designated VGAM HOST TARGET RNA, such as BINDING SITE I, BINDING SITE II and BINDING SITE III, inhibits translation of VGAM1635 host target RNA into VGAM1635 host target protein, herein designated VGAM HOST TARGET PROTEIN. VGAM host target protein is therefore outlined by a broken line.

It is appreciated that VGAM1635 host target gene, herein designated VGAM HOST TARGET GENE, in fact represents a plurality of VGAM1635 host target genes. The mRNA of each one of this plurality of VGAM1635 host target genes comprises one or more host target binding sites, each having a nucleotide sequence which is at least partly complementary to VGAM1635 RNA, herein designated VGAM RNA, and which when bound by VGAM1635 RNA causes inhibition of translation of respective one or more VGAM1635 host target proteins.

It is further appreciated by one skilled in the art that the mode of translational inhibition illustrated by FIG. 1 with specific reference to translational inhibition exerted by VGAM1635 gene, herein designated VGAM GENE, on one or more VGAM1635 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1635 is inhibition of expression of host target genes, as part of a novel viral mechanism of attacking a host. Accordingly, utilities of VGAM1635 include diagnosis, prevention and treatment of viral infection by Human Herpesvirus 8. Specific functions, and accordingly utilities, of VGAM1635 correlate with, and may be deduced from, the identity of the host target genes which VGAM1635 binds and inhibits, and the function of these host target genes, as elaborated hereinbelow.

Nucleotide sequences of the VGAM1635 precursor RNA, herein designated VGAM PRECURSOR RNA, and of the 'diced' VGAM1635 RNA, herein designated VGAM RNA, and a schematic representation of the secondary folding of VGAM1635 folded precursor RNA, herein designated VGAM FOLDED PRECURSOR RNA, of VGAM1635 are further described hereinbelow with reference to Table 1.

Nucleotide sequences of host target binding sites, such as BINDING SITE-I, BINDING SITE-II and BINDING SITE-III of FIG. 1, found on VGAM1635 host target RNA, and schematic representation of the complementarity of each of these host target binding sites to VGAM1635 RNA, herein designated VGAM RNA, are described hereinbelow with reference to Table 2.

As mentioned hereinabove with reference to FIG. 1, a function of VGAM1635 gene, herein designated VGAM is inhibition of expression of VGAM1635 target genes. It is appreciated that specific functions, and accordingly utilities, of VGAM1635 correlate with, and may be deduced from, the identity of the target genes which VGAM1635 binds and inhibits, and the function of these target genes, as elaborated hereinbelow.

Crn, Crooked Neck-like 1 (Drosophila) (CRNKL1, Accession NM_016652) is a VGAM1635 host target gene. CRNKL1 BINDING SITE is HOST TARGET binding site found in the 3' untranslated region of mRNA encoded by CRNKL1, corresponding to a HOST TARGET binding site such as BINDING SITE I, BINDING SITE II or BINDING SITE III. Table 2 illustrates the complementarity of the nucleotide sequences of CRNKL1 BINDING SITE, designated SEQ ID:18771, to the nucleotide sequence of VGAM1635 RNA, herein designated VGAM RNA, also designated SEQ ID:4346.

A function of VGAM1635 is therefore inhibition of Crn, Crooked Neck-like 1 (Drosophila) (CRNKL1, Accession NM_016652). Accordingly, utilities of VGAM1635 include diagnosis, prevention and treatment of diseases and clinical conditions associated with CRNKL1. KIAA1190 (Accession XM_048695) is another VGAM1635 host target gene. KIAA1190 BINDING SITE is HOST TARGET binding site found in the 3' untranslated region of mRNA encoded by KIAA1190, corresponding to a HOST TARGET binding site such as BINDING SITE I, BINDING SITE II or BINDING SITE III. Table 2 illustrates the complementarity of the nucleotide sequences of KIAA1190 BINDING SITE, designated SEQ ID:35223, to the nucleotide sequence of VGAM1635 RNA, herein designated VGAM RNA, also designated SEQ ID:4346.

Another function of VGAM1635 is therefore inhibition of KIAA1190 (Accession XM_048695). Accordingly, utilities of VGAM1635 include diagnosis, prevention and treatment of diseases and clinical conditions associated with KIAA1190. FIG. 1 further provides a conceptual description of a novel bioinformatically detected viral gene of the present invention, referred to here as Viral Genomic Address Messenger 1636 (VGAM1636) viral gene, which modulates expression of respective host target genes thereof, the function and utility of which host target genes is known in the art.

VGAM1636 is a novel bioinformatically detected regulatory, non protein coding, viral micro RNA (miRNA) gene. The method by which VGAM1636 was detected is described hereinabove with reference to FIGS. 1-8.

VGAM1636 gene, herein designated VGAM GENE, is a viral gene contained in the genome of Human Herpesvirus 8. VGAM1636 host target gene, herein designated VGAM HOST TARGET GENE, is a human gene contained in the human genome.

VGAM1636 gene encodes a VGAM1636 precursor RNA, herein designated VGAM PRECURSOR RNA. Similar to other miRNA genes, and unlike most ordinary genes, VGAM1636 precursor RNA does not encode a protein. A nucleotide sequence identical or highly similar to the nucleotide sequence of VGAM1636 precursor RNA is designated SEQ ID:1622, and is provided hereinbelow with reference to the sequence listing part. Nucleotide sequence SEQ ID:1622 is located at position 119152 relative to the genome of Human Herpesvirus 8.

VGAM1636 precursor RNA folds onto itself, forming VGAM1636 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1636 folded precursor RNA into VGAM1636 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1636 RNA is designated SEQ ID:4347, and is provided hereinbelow with reference to the sequence listing part.

VGAM1636 host target gene, herein designated VGAM HOST TARGET GENE, encodes a corresponding messenger RNA, VGAM1636 host target RNA, herein designated VGAM HOST TARGET RNA. VGAM1636 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1636 RNA, herein designated VGAM RNA, binds complementarily to one or more host target binding sites located in untranslated regions of VGAM1636 host target RNA, herein designated VGAM HOST TARGET RNA. This complementary binding is due to the fact that the nucleotide sequence of VGAM1636 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1636 RNA, herein designated VGAM RNA, may have a different number of host target binding sites in untranslated regions of a VGAM1636 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1636 RNA, herein designated VGAM RNA, to host target binding sites on VGAM1636 host target RNA, herein designated VGAM HOST TARGET RNA, such as BINDING SITE I, BINDING SITE II and BINDING SITE III, inhibits translation of VGAM1636 host target RNA into VGAM1636 host target protein, herein designated VGAM HOST TARGET PROTEIN. VGAM host target protein is therefore outlined by a broken line.

It is appreciated that VGAM1636 host target gene, herein designated VGAM HOST TARGET GENE, in fact represents a plurality of VGAM1636 host target genes. The mRNA of each one of this plurality of VGAM1636 host target genes comprises one or more host target binding sites, each having a nucleotide sequence which is at least partly complementary to VGAM1636 RNA, herein designated VGAM RNA, and which when bound by VGAM1636 RNA causes inhibition of translation of respective one or more VGAM1636 host target proteins.

It is further appreciated by one skilled in the art that the mode of translational inhibition illustrated by FIG. 1 with specific reference to translational inhibition exerted by VGAM1636 gene, herein designated VGAM GENE, on one or more VGAM1636 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1636 is inhibition of expression of host target genes, as part of a novel viral mechanism of attacking a host. Accordingly, utilities of VGAM1636 include diagnosis, prevention and treatment of viral infection by Human Herpesvirus 8. Specific functions, and accordingly utilities, of VGAM1636 correlate with, and may be deduced from, the identity of the host target genes which VGAM1636 binds and inhibits, and the function of these host target genes, as elaborated hereinbelow.

Nucleotide sequences of the VGAM1636 precursor RNA, herein designated VGAM PRECURSOR RNA, and of the 'diced' VGAM1636 RNA, herein designated VGAM RNA, and a schematic representation of the secondary folding of VGAM1636 folded precursor RNA, herein designated VGAM FOLDED PRECURSOR RNA, of VGAM1636 are further described hereinbelow with reference to Table 1.

Nucleotide sequences of host target binding sites, such as BINDING SITE-I, BINDING SITE-II and BINDING SITE-III of FIG. 1, found on VGAM1636 host target RNA, and schematic representation of the complementarity of each of these host target binding sites to VGAM1636 RNA, herein designated VGAM RNA, are described hereinbelow with reference to Table 2.

As mentioned hereinabove with reference to FIG. 1, a function of VGAM1636 gene, herein designated VGAM is inhibition of expression of VGAM1636 target genes. It is appreciated that specific functions, and accordingly utilities, of VGAM1636 correlate with, and may be deduced from, the identity of the target genes which VGAM1636 binds and inhibits, and the function of these target genes, as elaborated hereinbelow.

Core-binding Factor, Runt Domain, Alpha Subunit 2; Translocated To, 2 (CBFA2T2, Accession NM_005093) is a VGAM1636 host target gene. CBFA2T2 BINDING SITE is HOST TARGET binding site found in the 3' untranslated region of mRNA encoded by CBFA2T2, corresponding to a HOST TARGET binding site such as BINDING SITE I, BINDING SITE II or BINDING SITE III. Table 2 illustrates the complementarity of the nucleotide sequences of CBFA2T2 BINDING SITE, designated SEQ ID:11545, to the nucleotide sequence of VGAM1636 RNA, herein designated VGAM RNA, also designated SEQ ID:4347.

A function of VGAM1636 is therefore inhibition of Core-binding Factor, Runt Domain, Alpha Subunit 2; Translocated To, 2 (CBFA2T2, Accession NM_005093), a gene which is a putative transcription factor. Accordingly, utilities of VGAM1636 include diagnosis, prevention and treatment of diseases and clinical conditions associated with CBFA2T2. The function of CBFA2T2 and its association with various diseases and clinical conditions, has been established by previous studies, as described hereinabove with reference to VGAM152. DNA Fragmentation Factor, 40 kDa, Beta Polypeptide (caspase-activated DNase) (DFFB, Accession XM_113366) is another VGAM1636 host target gene. DFFB BINDING SITE is HOST TARGET binding site found in the 3' untranslated region of mRNA encoded by DFFB, corresponding to a HOST TARGET binding site such as BINDING SITE I, BINDING SITE II or BINDING SITE III. Table 2 illustrates the complementarity of the nucleotide sequences of DFFB BINDING SITE, designated SEQ ID:42236, to the nucleotide sequence of VGAM1636 RNA, herein designated VGAM RNA, also designated SEQ ID:4347.

Another function of VGAM1636 is therefore inhibition of DNA Fragmentation Factor, 40 kDa, Beta Polypeptide (caspase-activated DNase) (DFFB, Accession XM_113366), a gene which induces DNA fragmentation and chromatin condensation during apoptosis. Accordingly, utilities of VGAM1636 include diagnosis, prevention and treatment of diseases and clinical conditions associated with DFFB. The function of DFFB and its association with various diseases and clinical conditions, has been established by previous studies, as described hereinabove with reference to VGAM74. Deleted In Lung and Esophageal Cancer 1 (DLEC1, Accession NM_007336) is another VGAM1636 host target gene. DLEC1 BINDING SITE1 and DLEC1 BINDING SITE2 are HOST TARGET binding sites found in untranslated regions of mRNA encoded by DLEC1, corresponding to HOST TARGET binding sites such as BINDING SITE I, BINDING SITE II or BINDING SITE III. Table 2 illustrates the complementarity of the nucleotide sequences of DLEC1 BINDING SITE1 and DLEC1 BINDING SITE2, designated SEQ ID:14261 and SEQ ID:14267 respectively, to the nucleotide sequence of VGAM1636 RNA, herein designated VGAM RNA, also designated SEQ ID:4347.

Another function of VGAM1636 is therefore inhibition of Deleted In Lung and Esophageal Cancer 1 (DLEC1, Accession NM_007336). Accordingly, utilities of VGAM1636 include diagnosis, prevention and treatment of diseases and clinical conditions associated with DLEC1. Mediterranean Fever (MEFV, Accession NM_000243) is another VGAM1636 host target gene. MEFV BINDING SITE is HOST TARGET binding site found in the 3' untranslated region of mRNA encoded by MEFV, corresponding to a HOST TARGET binding site such as BINDING SITE I, BINDING SITE II or BINDING SITE III. Table 2 illustrates the complementarity of the nucleotide sequences of MEFV BINDING SITE, designated SEQ ID:5766, to the nucleotide sequence of VGAM1636 RNA, herein designated VGAM RNA, also designated SEQ ID:4347.

Another function of VGAM1636 is therefore inhibition of Mediterranean Fever (MEFV, Accession NM_000243). Accordingly, utilities of VGAM1636 include diagnosis, prevention and treatment of diseases and clinical conditions associated with MEFV. MHC Class I Polypeptide-related Sequence B (MICB, Accession NM_005931) is another VGAM1636 host target gene. MICB BINDING SITE is HOST TARGET binding site found in the 3' untranslated region of mRNA encoded by MICB, corresponding to a HOST TARGET binding site such as BINDING SITE I, BINDING SITE II or BINDING SITE III. Table 2 illustrates the complementarity of the nucleotide sequences of MICB BINDING SITE, designated SEQ ID:12563, to the nucleotide sequence of VGAM1636 RNA, herein designated VGAM RNA, also designated SEQ ID:4347.

Another function of VGAM1636 is therefore inhibition of MHC Class I Polypeptide-related Sequence B (MICB, Accession NM_005931), a gene which involved in the presentation of foreign antigens to the immune system. Accordingly, utilities of VGAM1636 include diagnosis, prevention and treatment of diseases and clinical conditions associated with MICB. The function of MICB and its association with various diseases and clinical conditions, has been established by previous studies, as described hereinabove with reference to VGAM74. Melan-A (MLANA, Accession NM_005511) is another VGAM1636 host target gene. MLANA BINDING SITE is HOST TARGET binding site found in the 3' untranslated region of mRNA encoded by MLANA, corresponding to a HOST TARGET binding site such as BINDING SITE I, BINDING SITE II or BINDING SITE III. Table 2 illustrates the complementarity of the nucleotide sequences of MLANA BINDING SITE, designated SEQ ID:12026, to the nucleotide sequence of VGAM1636 RNA, herein designated VGAM RNA, also designated SEQ ID:4347.

Another function of VGAM1636 is therefore inhibition of Melan-A (MLANA, Accession NM_005511). Accordingly, utilities of VGAM1636 include diagnosis, prevention and treatment of diseases and clinical conditions associated with MLANA. NDRG Family Member 3 (NDRG3, Accession NM_032013) is another VGAM1636 host target gene. NDRG3 BINDING SITE is HOST TARGET binding site found in the 3' untranslated region of mRNA encoded by NDRG3, corresponding to a HOST TARGET binding site such as BINDING SITE I, BINDING SITE II or BINDING SITE III. Table 2 illustrates the complementarity of the nucleotide sequences of NDRG3 BINDING SITE, designated SEQ ID:25719, to the nucleotide sequence of VGAM1636 RNA, herein designated VGAM RNA, also designated SEQ ID:4347.

Another function of VGAM1636 is therefore inhibition of NDRG Family Member 3 (NDRG3, Accession NM_032013). Accordingly, utilities of VGAM1636 include diagnosis, prevention and treatment of diseases and clinical conditions associated with NDRG3. NAD(P)H Dehydrogenase, Quinone 1 (NQO1, Accession NM_000903) is another VGAM1636 host target gene. NQO1 BINDING SITE is HOST TARGET binding site found in the 3' untranslated region of mRNA encoded by NQO1, corresponding to a HOST TARGET binding site such as BINDING SITE I, BINDING SITE II or BINDING SITE III. Table 2 illustrates the complementarity of the nucleotide sequences of NQO1 BINDING SITE, designated SEQ ID:6604, to the nucleotide sequence of VGAM1636 RNA, herein designated VGAM RNA, also designated SEQ ID:4347.

Another function of VGAM1636 is therefore inhibition of NAD(P)H Dehydrogenase, Quinone 1 (NQO1, Accession NM_000903), a gene which is cytochrome b5 reductase which reduces redox dyes and quinones. Accordingly, utilities of VGAM1636 include diagnosis, prevention and treatment of diseases and clinical conditions associated with NQO1. The function of NQO1 and its association with various diseases and clinical conditions, has been established by previous studies, as described hereinabove with reference to VGAM923. Pre-B-cell Leukemia Transcription Factor 2 (PBX2, Accession NM_002586) is another VGAM1636 host target gene. PBX2 BINDING SITE is HOST TARGET binding site found in the 3' untranslated region of mRNA encoded by PBX2, corresponding to a HOST TARGET binding site such as BINDING SITE I, BINDING SITE II or BINDING SITE III. Table 2 illustrates the complementarity of the nucleotide sequences of PBX2 BINDING SITE, designated SEQ ID:8449, to the nucleotide sequence of VGAM1636 RNA, herein designated VGAM RNA, also designated SEQ ID:4347.

Another function of VGAM1636 is therefore inhibition of Pre-B-cell Leukemia Transcription Factor 2 (PBX2, Accession NM_002586), a gene which binds the sequence 5'-atcaatcaa-3'. Accordingly, utilities of VGAM1636 include diagnosis, prevention and treatment of diseases and clinical conditions associated with PBX2. The function of PBX2 and its association with various diseases and clinical conditions, has been established by previous studies, as described hereinabove with reference to VGAM1063. Period Homolog 2 (Drosophila) (PER2, Accession NM_022817) is another VGAM1636 host target gene. PER2 BINDING SITE is HOST TARGET binding site found in the 3' untranslated region of mRNA encoded by PER2, corresponding to a HOST TARGET binding site such as BINDING SITE I, BINDING SITE II or BINDING SITE III. Table 2 illustrates the complementarity of the nucleotide sequences of PER2 BINDING SITE, designated SEQ ID:23089, to the nucleotide sequence of VGAM1636 RNA, herein designated VGAM RNA, also designated SEQ ID:4347.

Another function of VGAM1636 is therefore inhibition of Period Homolog 2 (Drosophila) (PER2, Accession NM_022817), a gene which Period homolog 2; putative circadian clock protein; has a PAS dimerization domain. Accordingly, utilities of VGAM1636 include diagnosis, prevention and treatment of diseases and clinical conditions associated with PER2. The function of PER2 and its association with various diseases and clinical conditions, has been established by previous studies, as described hereinabove with reference to VGAM74. Palmitoyl-protein Thioesterase 1 (ceroid-lipofuscinosis, neuronal 1, infantile) (PPT1, Accession XM_029842) is another VGAM1636 host target gene. PPT1 BINDING SITE is HOST TARGET binding site found in the 3' untranslated region of mRNA encoded by PPT1, corresponding to a HOST TARGET binding site such as BINDING SITE I, BINDING SITE II or BINDING SITE III. Table 2 illustrates the complementarity of the nucleotide sequences of PPT1 BINDING SITE, designated SEQ ID:30954, to the nucleotide sequence of VGAM1636 RNA, herein designated VGAM RNA, also designated SEQ ID:4347.

Another function of VGAM1636 is therefore inhibition of Palmitoyl-protein Thioesterase 1 (ceroid-lipofuscinosis, neuronal 1, infantile) (PPT1, Accession XM_029842). Accordingly, utilities of VGAM1636 include diagnosis, prevention and treatment of diseases and clinical conditions associated with PPT1. Proteasome (prosome, macropain) 26S Subunit, Non-ATPase, 9 (PSMD9, Accession NM_002813) is another VGAM1636 host target gene. PSMD9 BINDING SITE is HOST TARGET binding site found in the 3' untranslated region of mRNA encoded by PSMD9, corresponding to a HOST TARGET binding site such as BINDING SITE I, BINDING SITE II or BINDING SITE III. Table 2 illustrates the complementarity of the nucleotide sequences of PSMD9 BINDING SITE, designated SEQ ID:8677, to the nucleotide sequence of VGAM1636 RNA, herein designated VGAM RNA, also designated SEQ ID:4347.

Another function of VGAM1636 is therefore inhibition of Proteasome (prosome, macropain) 26S Subunit, Non-ATPase, 9 (PSMD9, Accession NM_002813), a gene which acts as a regulatory subunit of the 26 proteasome. Accordingly, utilities of VGAM1636 include diagnosis, prevention and treatment of diseases and clinical conditions associated with PSMD9. The function of PSMD9 has been established by previous studies. The 26S proteasome is a eukaryotic ATP-dependent protease that selectively degrades intracellular target proteins that are modified by the covalent attachment of ubiquitin. It is composed of a central catalytic 20S proteasome, which consists of a family of small proteins, and 2 large regulatory modules, named PA700, which consist of approximately 20 heterogeneous proteins. A proteasomal modulator complex, composed of p27, p42, and p50 subunits, stimulates the association of the 20S proteasome with PA700 to form the active 26S proteasome. Watanabe et al. (1998) cloned 2 distinct human brain cDNAs encoding p27, or PSMD9. Compared with the longer cDNA, the shorter cDNA has a 65-bp deletion near the 3-prime region that results in a new inframe termination codon farther downstream. The longer cDNA encodes a deduced 209-amino acid protein with a calculated molecular mass of 22,764 Da. The shorter cDNA encodes a deduced 223-amino acid protein with a calculated molecular mass of 24,652 Da. The longer PSMD9 protein exhibits 36% sequence identity with an S. cerevisiae protein, which the authors named NAS2 for 'non-ATPase subunit 2,' and 31.9% identity with a C. elegans protein. Disruption of the yeast NAS2 gene did not affect cell viability or proliferation. Watanabe et al. (1998) demonstrated that the PSMD9 protein, along with the ATPase components TBP1 (PSMC3; 186852) and p42 (PSMC6; 602708), associated with both the modulator complex and the 26S proteasome complex. Northern blot analysis detected an approximately 1.3-kb PSMD9 transcript in all tissues examined, with highest levels in liver and kidney. E12 and E47 (see OMIM Ref. No. TCF3; 147141), members of the ubiquitous E2A protein family, function with basic helix-loop-helix (bHLH) proteins to bind and transactivate promoters via conserved sequence elements known as E boxes. By yeast 2-hybrid screening of a rat insulinoma cell cDNA library using the bHLH domain-containing C terminus of E12 as bait, Thomas et al. (1999) obtained a cDNA encoding rat Bridge-1. Sequence analysis predicted that the 222-amino acid Bridge-1 protein shares 98% amino acid similarity with human PSMD9 over the first 184 amino acids but diverges in the C terminus Bridge-1 contains a PDZ-like domain from amino acids 138 to 178, forming 3 beta sheets and 2 alpha helices. SDS-PAGE analysis showed that Bridge-1 is expressed as a 28-kD protein, close to the deduced value of 25 kD. Using Bridge-1 cDNA as probe, Northern blot analysis detected a 1.0-kb transcript in all rat and human tissues tested, with highest expression in pancreas, testis, kidney, and liver. Immunocytochemistry assessment demonstrated predominant nuclear localization of Bridge-1, with lower levels in cytoplasm. Immunoprecipitation analysis determined that anti-Bridge-1 coimmunoprecipitates E12 or E12 and E47 through their C-terminal bHLH domains, but only in the presence of the PDZ domain of Bridge-1. CAT assays indicated that Bridge-1 together with E12 or E47 coactivates insulin (OMIM Ref. No. 176730) promoter elements.

Full details of the abovementioned studies are described in the following publications, the disclosure of which are hereby incorporated by reference:

Thomas, M. K.; Yao, K.-M.; Tenser, M. S.; Wong, G. G.; Habener, J. F.: Bridge-1, a novel PDZ-domain coactivator of E2A-mediated regulation of insulin gene transcription. Molec. Cell. Biol. 19:8492-8504, 1999; and Watanabe, T. K.; Saito, A.; Suzuki, M.; Fujiwara, T.; Takahashi, E.; Slaughter, C. A.; DeMartino, G. N.; Hendil, K. B.; Chung, C. H.; Tanahashi, N.; Tanaka, K.: cDNA cloning and chara.

Further studies establishing the function and utilities of PSMD9 are found in John Hopkins OMIM database record ID 603146, and in sited publications numbered 5426-5427 listed in the bibliography section hereinbelow, which are also hereby incorporated by reference. Sex Comb On Midleg-like 2 (Drosophila) (SCML2, Accession NM_006089) is another VGAM1636 host target gene. SCML2 BINDING SITE is HOST TARGET binding site found in the 3' untranslated region of mRNA encoded by SCML2, corresponding to a HOST TARGET binding site such as BINDING SITE I, BINDING SITE II or BINDING SITE III. Table 2 illustrates the complementarity of the nucleotide sequences of SCML2 BINDING SITE, designated SEQ ID:12733, to the nucleotide sequence of VGAM1636 RNA, herein designated VGAM RNA, also designated SEQ ID:4347.

Another function of VGAM1636 is therefore inhibition of Sex Comb On Midleg-like 2 (Drosophila) (SCML2, Accession NM_006089). Accordingly, utilities of VGAM1636 include diagnosis, prevention and treatment of diseases and clinical conditions associated with SCML2. Selenoprotein X, 1 (SEPX1, Accession NM_016332) is another VGAM1636 host target gene. SEPX1 BINDING SITE is HOST TARGET binding site found in the 3' untranslated region of mRNA encoded by SEPX1, corresponding to a HOST TARGET binding site such as BINDING SITE I, BINDING SITE II or BINDING SITE III. Table 2 illustrates the complementarity of the nucleotide sequences of SEPX1 BINDING SITE, designated SEQ ID:18456, to the nucleotide sequence of VGAM1636 RNA, herein designated VGAM RNA, also designated SEQ ID:4347.

Another function of VGAM1636 is therefore inhibition of Selenoprotein X, 1 (SEPX1, Accession NM_016332). Accordingly, utilities of VGAM1636 include diagnosis, prevention and treatment of diseases and clinical conditions associated with SEPX1. Sulfotransferase Family, Cytosolic, 2B, Member 1 (SULT2B1, Accession NM_004605) is another VGAM1636 host target gene. SULT2B1 BINDING SITE is HOST TARGET binding site found in the 5' untranslated region of mRNA encoded by SULT2B1, corresponding to a HOST TARGET binding site such as BINDING SITE I, BINDING SITE II or BINDING SITE III. Table 2 illustrates the complementarity of the nucleotide sequences of SULT2B1 BINDING SITE, designated SEQ ID:10948, to the nucleotide sequence of VGAM1636 RNA, herein designated VGAM RNA, also designated SEQ ID:4347.

Another function of VGAM1636 is therefore inhibition of Sulfotransferase Family, Cytosolic, 2B, Member 1 (SULT2B1, Accession NM_004605). Accordingly, utilities of VGAM1636 include diagnosis, prevention and treatment of diseases and clinical conditions associated with SULT2B1. Von Hippel-Lindau Syndrome (VHL, Accession NM_000551) is another VGAM1636 host target gene. VHL BINDING SITE is HOST TARGET binding site found in the 3' untranslated region of mRNA encoded by VHL, corresponding to a HOST TARGET binding site such as BINDING SITE I, BINDING SITE II or BINDING SITE III. Table 2 illustrates the complementarity of the nucleotide sequences of VHL BINDING SITE, designated SEQ ID:6154, to the nucleotide sequence of VGAM1636 RNA, herein designated VGAM RNA, also designated SEQ ID:4347.

Another function of VGAM1636 is therefore inhibition of Von Hippel-Lindau Syndrome (VHL, Accession NM_000551), a gene which may control rna stability through the selective degradation of rna-bound proteins. Accordingly, utilities of VGAM1636 include diagnosis, prevention and treatment of diseases and clinical conditions associated with VHL. The function of VHL and its association with various diseases and clinical conditions, has been established by previous studies, as described hereinabove with reference to VGAM197. Activating Transcription Factor 3 (ATF3, Accession NM_004024) is another VGAM1636 host target gene. ATF3 BINDING SITE is HOST TARGET binding site found in the 3' untranslated region of mRNA encoded by ATF3, corresponding to a HOST TARGET binding site such as BINDING SITE I, BINDING SITE II or BINDING SITE III. Table 2 illustrates the complementarity of the nucleotide sequences of ATF3 BINDING SITE, designated SEQ ID:10246, to the nucleotide sequence of VGAM1636 RNA, herein designated VGAM RNA, also designated SEQ ID:4347.

Another function of VGAM1636 is therefore inhibition of Activating Transcription Factor 3 (ATF3, Accession NM_004024). Accordingly, utilities of VGAM1636 include diagnosis, prevention and treatment of diseases and clinical conditions associated with ATF3. BOP (Accession XM_097915) is another VGAM1636 host target gene. BOP BINDING SITE is HOST TARGET binding site found in the 5' untranslated region of mRNA encoded by BOP, corresponding to a HOST TARGET binding site such as BINDING SITE I, BINDING SITE II or BINDING SITE III. Table 2 illustrates the complementarity of the nucleotide sequences of BOP BINDING SITE, designated SEQ ID:41209, to the nucleotide sequence of VGAM1636 RNA, herein designated VGAM RNA, also designated SEQ ID:4347.

Another function of VGAM1636 is therefore inhibition of BOP (Accession XM_097915). Accordingly, utilities of VGAM1636 include diagnosis, prevention and treatment of diseases and clinical conditions associated with BOP. CED-6 (Accession NM_016315) is another VGAM1636 host target gene. CED-6 BINDING SITE is HOST TARGET binding site found in the 3' untranslated region of mRNA encoded by CED-6, corresponding to a HOST TARGET binding site such as BINDING SITE I, BINDING SITE II or BINDING SITE III. Table 2 illustrates the complementarity of the nucleotide sequences of CED-6 BINDING SITE, designated SEQ ID:18429, to the nucleotide sequence of VGAM1636 RNA, herein designated VGAM RNA, also designated SEQ ID:4347.

Another function of VGAM1636 is therefore inhibition of CED-6 (Accession NM_016315). Accordingly, utilities of VGAM1636 include diagnosis, prevention and treatment of diseases and clinical conditions associated with CED-6. CXYorf1 (Accession XM_088704) is another VGAM1636 host target gene. CXYorf1 BINDING SITE is HOST TARGET binding site found in the 3' untranslated region of mRNA encoded by CXYorf1, corresponding to a HOST TARGET binding site such as BINDING SITE I, BINDING SITE II or BINDING SITE III. Table 2 illustrates the complementarity of the nucleotide sequences of CXYorf1 BINDING SITE, designated SEQ ID:39912, to the nucleotide sequence of VGAM1636 RNA, herein designated VGAM RNA, also designated SEQ ID:4347.

Another function of VGAM1636 is therefore inhibition of CXYorf1 (Accession XM_088704). Accordingly, utilities of VGAM1636 include diagnosis, prevention and treatment of diseases and clinical conditions associated with CXYorf1. DEAD/H (Asp-Glu-Ala-Asp/His) Box Polypeptide 34 (DDX34, Accession NM_014681) is another VGAM1636 host target gene. DDX34 BINDING SITE is HOST TARGET binding site found in the 3' untranslated region of mRNA encoded by DDX34, corresponding to a HOST TARGET binding site such as BINDING SITE I, BINDING SITE II or BINDING SITE III. Table 2 illustrates the complementarity of the nucleotide sequences of DDX34 BINDING SITE, designated SEQ ID:16168, to the nucleotide sequence of VGAM1636 RNA, herein designated VGAM RNA, also designated SEQ ID:4347.

Another function of VGAM1636 is therefore inhibition of DEAD/H (Asp-Glu-Ala-Asp/His) Box Polypeptide 34 (DDX34, Accession NM_014681). Accordingly, utilities of VGAM1636 include diagnosis, prevention and treatment of diseases and clinical conditions associated with DDX34. Ecotropic Viral Integration Site 5 (EVI5, Accession NM_005665) is another VGAM1636 host target gene. EVI5 BINDING SITE is HOST TARGET binding site found in the 3' untranslated region of mRNA encoded by EVI5, corresponding to a HOST TARGET binding site such as BINDING SITE I, BINDING SITE II or BINDING SITE III. Table 2 illustrates the complementarity of the nucleotide sequences of EVI5 BINDING SITE, designated SEQ ID:12205, to the nucleotide sequence of VGAM1636 RNA, herein designated VGAM RNA, also designated SEQ ID:4347.

Another function of VGAM1636 is therefore inhibition of Ecotropic Viral Integration Site 5 (EVI5, Accession NM_005665). Accordingly, utilities of VGAM1636 include diagnosis, prevention and treatment of diseases and clinical conditions associated with EVI5. FBP17 (Accession XM_052666) is another VGAM1636 host target gene. FBP17 BINDING SITE is HOST TARGET binding site found in the 3' untranslated region of mRNA encoded by FBP17, corresponding to a HOST TARGET binding site such as BINDING SITE I, BINDING SITE II or BINDING SITE III. Table 2 illustrates the complementarity of the nucleotide sequences of FBP17 BINDING SITE, designated SEQ ID:36045, to the nucleotide sequence of VGAM1636 RNA, herein designated VGAM RNA, also designated SEQ ID:4347.

Another function of VGAM1636 is therefore inhibition of FBP17 (Accession XM_052666). Accordingly, utilities of VGAM1636 include diagnosis, prevention and treatment of diseases and clinical conditions associated with FBP17. FLJ10159 (Accession NM_018013) is another VGAM1636 host target gene. FLJ10159 BINDING SITE is HOST TARGET binding site found in the 3' untranslated region of mRNA encoded by FLJ10159, corresponding to a HOST TARGET binding site such as BINDING SITE I, BINDING SITE II or BINDING SITE III. Table 2 illustrates the complementarity of the nucleotide sequences of FLJ10159 BINDING SITE, designated SEQ ID:19747, to the nucleotide sequence of VGAM1636 RNA, herein designated VGAM RNA, also designated SEQ ID:4347.

Another function of VGAM1636 is therefore inhibition of FLJ10159 (Accession NM_018013). Accordingly, utilities of VGAM1636 include diagnosis, prevention and treatment of diseases and clinical conditions associated with FLJ10159. FLJ12363 (Accession NM_032167) is another VGAM1636 host target gene. FLJ12363 BINDING SITE is HOST TARGET binding site found in the 3' untranslated region of mRNA encoded by FLJ12363, corresponding to a HOST TARGET binding site such as BINDING SITE I, BINDING SITE II or BINDING SITE III. Table 2 illustrates the complementarity of the nucleotide sequences of FLJ12363 BINDING SITE, designated SEQ ID:25864, to the nucleotide sequence of VGAM1636 RNA, herein designated VGAM RNA, also designated SEQ ID:4347.

Another function of VGAM1636 is therefore inhibition of FLJ12363 (Accession NM_032167). Accordingly, utilities of VGAM1636 include diagnosis, prevention and treatment of diseases and clinical conditions associated with FLJ12363. FLJ12816 (Accession NM_022060) is another VGAM1636 host target gene. FLJ12816 BINDING SITE is HOST TARGET binding site found in the 3' untranslated region of mRNA encoded by FLJ12816, corresponding to a HOST TARGET binding site such as BINDING SITE I, BINDING SITE II or BINDING SITE III. Table 2 illustrates the complementarity of the nucleotide sequences of FLJ12816 BINDING SITE, designated SEQ ID:22605, to the nucleotide sequence of VGAM1636 RNA, herein designated VGAM RNA, also designated SEQ ID:4347.

Another function of VGAM1636 is therefore inhibition of FLJ12816 (Accession NM_022060). Accordingly, utilities of VGAM1636 include diagnosis, prevention and treatment of diseases and clinical conditions associated with FLJ12816. FLJ12891 (Accession NM_024950) is another VGAM1636 host target gene. FLJ12891 BINDING SITE is HOST TARGET binding site found in the 3' untranslated region of mRNA encoded by FLJ12891, corresponding to a HOST TARGET binding site such as BINDING SITE I, BINDING SITE II or BINDING SITE III. Table 2 illustrates the complementarity of the nucleotide sequences of FLJ12891 BINDING SITE, designated SEQ ID:24508, to the nucleotide sequence of VGAM1636 RNA, herein designated VGAM RNA, also designated SEQ ID:4347.

Another function of VGAM1636 is therefore inhibition of FLJ12891 (Accession NM_024950). Accordingly, utilities of VGAM1636 include diagnosis, prevention and treatment of diseases and clinical conditions associated with FLJ12891. FLJ20241 (Accession NM_017721) is another VGAM1636 host target gene. FLJ20241 BINDING SITE is HOST TARGET binding site found in the 5' untranslated region of mRNA encoded by FLJ20241, corresponding to a HOST TARGET binding site such as BINDING SITE I, BINDING SITE II or BINDING SITE III. Table 2 illustrates the complementarity of the nucleotide sequences of FLJ20241 BINDING SITE, designated SEQ ID:19311, to the nucleotide sequence of VGAM1636 RNA, herein designated VGAM RNA, also designated SEQ ID:4347.

Another function of VGAM1636 is therefore inhibition of FLJ20241 (Accession NM_017721). Accordingly, utilities of VGAM1636 include diagnosis, prevention and treatment of diseases and clinical conditions associated with FLJ20241. FLJ21168 (Accession NM_025073) is another VGAM1636 host target gene. FLJ21168 BINDING SITE is HOST TARGET binding site found in the 3' untranslated region of mRNA encoded by FLJ21168, corresponding to a HOST TARGET binding site such as BINDING SITE I, BINDING SITE II or BINDING SITE III. Table 2 illustrates the complementarity of the nucleotide sequences of FLJ21168 BINDING SITE, designated SEQ ID:24670, to the nucleotide sequence of VGAM1636 RNA, herein designated VGAM RNA, also designated SEQ ID:4347.

Another function of VGAM1636 is therefore inhibition of FLJ21168 (Accession NM_025073). Accordingly, utilities of VGAM1636 include diagnosis, prevention and treatment of diseases and clinical conditions associated with FLJ21168. FLJ22684 (Accession NM_025048) is another VGAM1636 host target gene. FLJ22684 BINDING SITE is HOST TARGET binding site found in the 3' untranslated region of mRNA encoded by FLJ22684, corresponding to a HOST TARGET binding site such as BINDING SITE I, BINDING SITE II or BINDING SITE III. Table 2 illustrates the complementarity of the nucleotide sequences of FLJ22684 BINDING SITE, designated SEQ ID:24642, to the nucleotide sequence of VGAM1636 RNA, herein designated VGAM RNA, also designated SEQ ID:4347.

Another function of VGAM1636 is therefore inhibition of FLJ22684 (Accession NM_025048). Accordingly, utilities of VGAM1636 include diagnosis, prevention and treatment of diseases and clinical conditions associated with FLJ22684. KIAA0161 (Accession NM_014746) is another VGAM1636 host target gene. KIAA0161 BINDING SITE is HOST TARGET binding site found in the 3' untranslated region of mRNA encoded by KIAA0161, corresponding to a HOST TARGET binding site such as BINDING SITE I, BINDING SITE II or BINDING SITE III. Table 2 illustrates the complementarity of the nucleotide sequences of KIAA0161 BINDING SITE, designated SEQ ID:16427, to the nucleotide sequence of VGAM1636 RNA, herein designated VGAM RNA, also designated SEQ ID:4347.

Another function of VGAM1636 is therefore inhibition of KIAA0161 (Accession NM_014746). Accordingly, utilities of VGAM1636 include diagnosis, prevention and treatment of diseases and clinical conditions associated with KIAA0161. KIAA0391 (Accession NM_014672) is another VGAM1636 host target gene. KIAA0391 BINDING SITE is HOST TARGET binding site found in the 3' untranslated region of mRNA encoded by KIAA0391, corresponding to a HOST TARGET binding site such as BINDING SITE I, BINDING SITE II or BINDING SITE III. Table 2 illustrates the complementarity of the nucleotide sequences of KIAA0391 BINDING SITE, designated SEQ ID:16133, to the nucleotide sequence of VGAM1636 RNA, herein designated VGAM RNA, also designated SEQ ID:4347.

Another function of VGAM1636 is therefore inhibition of KIAA0391 (Accession NM_014672). Accordingly, utilities of VGAM1636 include diagnosis, prevention and treatment of diseases and clinical conditions associated with KIAA0391. KIAA0472 (Accession XM_050147) is another VGAM1636 host target gene. KIAA0472 BINDING SITE is HOST TARGET binding site found in the 3' untranslated region of mRNA encoded by KIAA0472, corresponding to a HOST TARGET binding site such as BINDING SITE I, BINDING SITE II or BINDING SITE III. Table 2 illustrates the complementarity of the nucleotide sequences of KIAA0472 BINDING SITE, designated SEQ ID:35581, to the nucleotide sequence of VGAM1636 RNA, herein designated VGAM RNA, also designated SEQ ID:4347.

Another function of VGAM1636 is therefore inhibition of KIAA0472 (Accession XM_050147). Accordingly, utilities of VGAM1636 include diagnosis, prevention and treatment of diseases and clinical conditions associated with KIAA0472. KIAA1170 (Accession XM_045907) is another VGAM1636 host target gene. KIAA1170 BINDING SITE is HOST TARGET binding site found in the 3' untranslated region of mRNA encoded by KIAA1170, corresponding to a HOST TARGET binding site such as BINDING SITE I, BINDING SITE II or BINDING SITE III. Table 2 illustrates the complementarity of the nucleotide sequences of KIAA1170 BINDING SITE, designated SEQ ID:34609, to the nucleotide sequence of VGAM1636 RNA, herein designated VGAM RNA, also designated SEQ ID:4347.

Another function of VGAM1636 is therefore inhibition of KIAA1170 (Accession XM_045907). Accordingly, utilities of VGAM1636 include diagnosis, prevention and treatment of diseases and clinical conditions associated with KIAA1170. KIAA1198 (Accession XM_032674) is another VGAM1636 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31699, to the nucleotide sequence of VGAM1636 RNA, herein designated VGAM RNA, also designated SEQ ID:4347.

Another function of VGAM1636 is therefore inhibition of KIAA1198 (Accession XM_032674). Accordingly, utilities of VGAM1636 include diagnosis, prevention and treatment of diseases and clinical conditions associated with KIAA1198. KIAA1493 (Accession XM_034415) is another VGAM1636 host target gene. KIAA1493 BINDING SITE is HOST TARGET binding site found in the 3' untranslated region of mRNA encoded by KIAA1493, corresponding to a HOST TARGET binding site such as BINDING SITE I, BINDING SITE II or BINDING SITE III. Table 2 illustrates the complementarity of the nucleotide sequences of KIAA1493 BINDING SITE, designated SEQ ID:32085, to the nucleotide sequence of VGAM1636 RNA, herein designated VGAM RNA, also designated SEQ ID:4347.

Another function of VGAM1636 is therefore inhibition of KIAA1493 (Accession XM_034415). Accordingly, utilities of VGAM1636 include diagnosis, prevention and treatment of diseases and clinical conditions associated with KIAA1493. KIAA1712 (Accession XM_041497) is another VGAM1636 host target gene. KIAA1712 BINDING SITE is HOST TARGET binding site found in the 3' untranslated region of mRNA encoded by KIAA1712, corresponding to a HOST TARGET binding site such as BINDING SITE I, BINDING SITE II or BINDING SITE III. Table 2 illustrates the complementarity of the nucleotide sequences of KIAA1712 BINDING SITE, designated SEQ ID:33535, to the nucleotide sequence of VGAM1636 RNA, herein designated VGAM RNA, also designated SEQ ID:4347.

Another function of VGAM1636 is therefore inhibition of KIAA1712 (Accession XM_041497). Accordingly, utilities of VGAM1636 include diagnosis, prevention and treatment of diseases and clinical conditions associated with KIAA1712. MGC35558 (Accession NM_145013) is another VGAM1636 host target gene. MGC35558 BINDING SITE is HOST TARGET binding site found in the 3' untranslated region of mRNA encoded by MGC35558, corresponding to a HOST TARGET binding site such as BINDING SITE I, BINDING SITE II or BINDING SITE III. Table 2 illustrates the complementarity of the nucleotide sequences of MGC35558 BINDING SITE, designated SEQ ID:29615, to the nucleotide sequence of VGAM1636 RNA, herein designated VGAM RNA, also designated SEQ ID:4347.

Another function of VGAM1636 is therefore inhibition of MGC35558 (Accession NM_145013). Accordingly, utilities of VGAM1636 include diagnosis, prevention and treatment of diseases and clinical conditions associated with MGC35558. MGC4730 (Accession XM_034644) is another VGAM1636 host target gene. MGC4730 BINDING SITE is HOST TARGET binding site found in the 3' untranslated region of mRNA encoded by MGC4730, corresponding to a HOST TARGET binding site such as BINDING SITE I, BINDING SITE II or BINDING SITE III. Table 2 illustrates the complementarity of the nucleotide sequences of MGC4730 BINDING SITE, designated SEQ ID:32134, to the nucleotide sequence of VGAM1636 RNA, herein designated VGAM RNA, also designated SEQ ID:4347.

Another function of VGAM1636 is therefore inhibition of MGC4730 (Accession XM_034644). Accordingly, utilities of VGAM1636 include diagnosis, prevention and treatment of diseases and clinical conditions associated with MGC4730. PIP3-E (Accession XM_039749) is another VGAM1636 host target gene. PIP3-E BINDING SITE is HOST TARGET binding site found in the 3' untranslated region of mRNA encoded by PIP3-E, corresponding to a HOST TARGET binding site such as BINDING SITE I, BINDING SITE II or BINDING SITE III. Table 2 illustrates the complementarity of the nucleotide sequences of PIP3-E BINDING SITE, designated SEQ ID:33173, to the nucleotide sequence of VGAM1636 RNA, herein designated VGAM RNA, also designated SEQ ID:4347.

Another function of VGAM1636 is therefore inhibition of PIP3-E (Accession XM_039749). Accordingly, utilities of VGAM1636 include diagnosis, prevention and treatment of diseases and clinical conditions associated with PIP3-E. PRO2955 (Accession NM_018545) is another VGAM1636 host target gene. PRO2955 BINDING SITE is HOST TARGET binding site found in the 3' untranslated region of mRNA encoded by PRO2955, corresponding to a HOST TARGET binding site such as BINDING SITE I, BINDING SITE II or BINDING SITE III. Table 2 illustrates the complementarity of the nucleotide sequences of PRO2955 BINDING SITE, designated SEQ ID:20619, to the nucleotide sequence of VGAM1636 RNA, herein designated VGAM RNA, also designated SEQ ID:4347.

Another function of VGAM1636 is therefore inhibition of PRO2955 (Accession NM_018545). Accordingly, utilities of VGAM1636 include diagnosis, prevention and treatment of diseases and clinical conditions associated with PRO2955. Proline-serine-threonine Phosphatase Interacting Protein 2 (PSTPIP2, Accession NM_024430) is another VGAM1636 host target gene. PSTPIP2 BINDING SITE is HOST TARGET binding site found in the 3' untranslated region of mRNA encoded by PSTPIP2, corresponding to a HOST TARGET binding site such as BINDING SITE I, BINDING SITE II or BINDING SITE III. Table 2 illustrates the complementarity of the nucleotide sequences of PSTPIP2 BINDING SITE, designated SEQ ID:23678, to the nucleotide sequence of VGAM1636 RNA, herein designated VGAM RNA, also designated SEQ ID:4347.

Another function of VGAM1636 is therefore inhibition of Proline-serine-threonine Phosphatase Interacting Protein 2 (PSTPIP2, Accession NM_024430). Accordingly, utilities of VGAM1636 include diagnosis, prevention and treatment of diseases and clinical conditions associated with PSTPIP2. Ubiquitin-conjugating Enzyme E2 Variant 2 (UBE2V2, Accession NM_003350) is another VGAM1636 host target gene. UBE2V2 BINDING SITE is HOST TARGET binding site found in the 3' untranslated region of mRNA encoded by UBE2V2, corresponding to a HOST TARGET binding site such as BINDING SITE I, BINDING SITE II or BINDING SITE III. Table 2 illustrates the complementarity of the nucleotide sequences of UBE2V2 BINDING SITE, designated SEQ ID:9376, to the nucleotide sequence of VGAM1636 RNA, herein designated VGAM RNA, also designated SEQ ID:4347.

Another function of VGAM1636 is therefore inhibition of Ubiquitin-conjugating Enzyme E2 Variant 2 (UBE2V2, Accession NM_003350). Accordingly, utilities of VGAM1636 include diagnosis, prevention and treatment of diseases and clinical conditions associated with UBE2V2. VDU1 (Accession NM_015017) is another VGAM1636 host target gene. VDU1 BINDING SITE is HOST TARGET binding site found in the 3' untranslated region of mRNA encoded by VDU1, corresponding to a HOST TARGET binding site such as BINDING SITE I, BINDING SITE II or BINDING SITE III. Table 2 illustrates the complementarity of the nucleotide sequences of VDU1 BINDING SITE, designated SEQ ID:17380, to the nucleotide sequence of VGAM1636 RNA, herein designated VGAM RNA, also designated SEQ ID:4347.

Another function of VGAM1636 is therefore inhibition of VDU1 (Accession NM_015017). Accordingly, utilities of VGAM1636 include diagnosis, prevention and treatment of diseases and clinical conditions associated with VDU1. Vacuolar Protein Sorting 33A (yeast) (VPS33A, Accession NM_022916) is another VGAM1636 host target gene. VPS33A BINDING SITE is HOST TARGET binding site found in the 3' untranslated region of mRNA encoded by VPS33A, corresponding to a HOST TARGET binding site such as BINDING SITE I, BINDING SITE II or BINDING SITE III. Table 2 illustrates the complementarity of the nucleotide sequences of VPS33A BINDING SITE, designated SEQ ID:23229, to the nucleotide sequence of VGAM1636 RNA, herein designated VGAM RNA, also designated SEQ ID:4347.

Another function of VGAM1636 is therefore inhibition of Vacuolar Protein Sorting 33A (yeast) (VPS33A, Accession NM_022916). Accordingly, utilities of VGAM1636 include diagnosis, prevention and treatment of diseases and clinical conditions associated with VPS33A. Williams-Beuren Syndrome Chromosome Region 23 (WBSCR23, Accession NM_025042) is another VGAM1636 host target gene. WBSCR23 BINDING SITE is HOST TARGET binding site found in the 3' untranslated region of mRNA encoded by WBSCR23, corresponding to a HOST TARGET binding site such as BINDING SITE I, BINDING SITE II or BINDING SITE III. Table 2 illustrates the complementarity of the nucleotide sequences of WBSCR23 BINDING SITE, designated SEQ ID:24636, to the nucleotide sequence of VGAM1636 RNA, herein designated VGAM RNA, also designated SEQ ID:4347.

Another function of VGAM1636 is therefore inhibition of Williams-Beuren Syndrome Chromosome Region 23 (WBSCR23, Accession NM_025042). Accordingly, utilities of VGAM1636 include diagnosis, prevention and treatment of diseases and clinical conditions associated with WBSCR23. LOC133362 (Accession XM_068305) is another VGAM1636 host target gene. LOC133362 BINDING SITE is HOST TARGET binding site found in the 5' untranslated region of mRNA encoded by LOC133362, corresponding to a HOST TARGET binding site such as BINDING SITE I, BINDING SITE II or BINDING SITE III. Table 2 illustrates the complementarity of the nucleotide sequences of LOC133362 BINDING SITE, designated SEQ ID:37380, to the nucleotide sequence of VGAM1636 RNA, herein designated VGAM RNA, also designated SEQ ID:4347.

Another function of VGAM1636 is therefore inhibition of LOC133362 (Accession XM_068305). Accordingly, utilities of VGAM1636 include diagnosis, prevention and treatment of diseases and clinical conditions associated with LOC133362. LOC143916 (Accession XM_084664) is another VGAM1636 host target gene. LOC143916 BINDING SITE is HOST TARGET binding site found in the 3' untranslated region of mRNA encoded by LOC143916, corresponding to a HOST TARGET binding site such as BINDING SITE I, BINDING SITE II or BINDING SITE III. Table 2 illustrates the complementarity of the nucleotide sequences of LOC143916 BINDING SITE, designated SEQ ID:37649, to the nucleotide sequence of VGAM1636 RNA, herein designated VGAM RNA, also designated SEQ ID:4347.

Another function of VGAM1636 is therefore inhibition of LOC143916 (Accession XM_084664). Accordingly, utilities of VGAM1636 include diagnosis, prevention and treatment of diseases and clinical conditions associated with LOC143916. LOC144524 (Accession XM_096624) is another VGAM1636 host target gene. LOC144524 BINDING SITE is HOST TARGET binding site found in the 5' untranslated region of mRNA encoded by LOC144524, corresponding to a HOST TARGET binding site such as BINDING SITE I, BINDING SITE II or BINDING SITE III. Table 2 illustrates the complementarity of the nucleotide sequences of LOC144524 BINDING SITE, designated SEQ ID:40432, to the nucleotide sequence of VGAM1636 RNA, herein designated VGAM RNA, also designated SEQ ID:4347.

Another function of VGAM1636 is therefore inhibition of LOC144524 (Accession XM_096624). Accordingly, utilities of VGAM1636 include diagnosis, prevention and treatment of diseases and clinical conditions associated with LOC144524. LOC146229 (Accession XM_085387) is another VGAM1636 host target gene. LOC146229 BINDING SITE is HOST TARGET binding site found in the 3' untranslated region of mRNA encoded by LOC146229, corresponding to a HOST TARGET binding site such as BINDING SITE I, BINDING SITE II or BINDING SITE III. Table 2 illustrates the complementarity of the nucleotide sequences of LOC146229 BINDING SITE, designated SEQ ID:38103, to the nucleotide sequence of VGAM1636 RNA, herein designated VGAM RNA, also designated SEQ ID:4347.

Another function of VGAM1636 is therefore inhibition of LOC146229 (Accession XM_085387). Accordingly, utilities of VGAM1636 include diagnosis, prevention and treatment of diseases and clinical conditions associated with LOC146229. LOC149711 (Accession XM_097720) is another VGAM1636 host target gene. LOC149711 BINDING SITE is HOST TARGET binding site found in the 3' untranslated region of mRNA encoded by LOC149711, corresponding to a HOST TARGET binding site such as BINDING SITE I, BINDING SITE II or BINDING SITE III. Table 2 illustrates the complementarity of the nucleotide sequences of LOC149711 BINDING SITE, designated SEQ ID:41066, to the nucleotide sequence of VGAM1636 RNA, herein designated VGAM RNA, also designated SEQ ID:4347.

Another function of VGAM1636 is therefore inhibition of LOC149711 (Accession XM_097720). Accordingly, utilities of VGAM1636 include diagnosis, prevention and treatment of diseases and clinical conditions associated with LOC149711. LOC169611 (Accession XM_095809) is another VGAM1636 host target gene. LOC169611 BINDING SITE is HOST TARGET binding site found in the 3' untranslated region of mRNA encoded by LOC169611, corresponding to a HOST TARGET binding site such as BINDING SITE I, BINDING SITE II or BINDING SITE III. Table 2 illustrates the complementarity of the nucleotide sequences of LOC169611 BINDING SITE, designated SEQ ID:40284, to the nucleotide sequence of VGAM1636 RNA, herein designated VGAM RNA, also designated SEQ ID:4347.

Another function of VGAM1636 is therefore inhibition of LOC169611 (Accession XM_095809). Accordingly, utilities of VGAM1636 include diagnosis, prevention and treatment of diseases and clinical conditions associated with LOC169611. LOC196047 (Accession XM_116883) is another VGAM1636 host target gene. LOC196047 BINDING SITE is HOST TARGET binding site found in the 5' untranslated region of mRNA encoded by LOC196047, corresponding to a HOST TARGET binding site such as BINDING SITE I, BINDING SITE II or BINDING SITE III. Table 2 illustrates the complementarity of the nucleotide sequences of LOC196047 BINDING SITE, designated SEQ ID:43142, to the nucleotide sequence of VGAM1636 RNA, herein designated VGAM RNA, also designated SEQ ID:4347.

Another function of VGAM1636 is therefore inhibition of LOC196047 (Accession XM_116883). Accordingly, utilities of VGAM1636 include diagnosis, prevention and treatment of diseases and clinical conditions associated with LOC196047. LOC196510 (Accession XM_113738) is another VGAM1636 host target gene. LOC196510 BINDING SITE is HOST TARGET binding site found in the 3' untranslated region of mRNA encoded by LOC196510, corresponding to a HOST TARGET binding site such as BINDING SITE I, BINDING SITE II or BINDING SITE III. Table 2 illustrates the complementarity of the nucleotide sequences of LOC196510 BINDING SITE, designated SEQ ID:42392, to the nucleotide sequence of VGAM1636 RNA, herein designated VGAM RNA, also designated SEQ ID:4347.

Another function of VGAM1636 is therefore inhibition of LOC196510 (Accession XM_113738). Accordingly, utilities of VGAM1636 include diagnosis, prevention and treatment of diseases and clinical conditions associated with LOC196510. LOC199699 (Accession XM_113990) is another VGAM1636 host target gene. LOC199699 BINDING SITE is HOST TARGET binding site found in the 3' untranslated region of mRNA encoded by LOC199699, corresponding to a HOST TARGET binding site such as BINDING SITE I, BINDING SITE II or BINDING SITE III. Table 2 illustrates the complementarity of the nucleotide sequences of LOC199699 BINDING SITE, designated SEQ ID:42593, to the nucleotide sequence of VGAM1636 RNA, herein designated VGAM RNA, also designated SEQ ID:4347.

Another function of VGAM1636 is therefore inhibition of LOC199699 (Accession XM_113990). Accordingly, utilities of VGAM1636 include diagnosis, prevention and treatment of diseases and clinical conditions associated with LOC199699. LOC199958 (Accession XM_117163) is another VGAM1636 host target gene. LOC199958 BINDING SITE is HOST TARGET binding site found in the 3' untranslated region of mRNA encoded by LOC199958, corresponding to a HOST TARGET binding site such as BINDING SITE I, BINDING SITE II or BINDING SITE III. Table 2 illustrates the complementarity of the nucleotide sequences of LOC199958 BINDING SITE, designated SEQ ID:43263, to the nucleotide sequence of VGAM1636 RNA, herein designated VGAM RNA, also designated SEQ ID:4347.

Another function of VGAM1636 is therefore inhibition of LOC199958 (Accession XM_117163). Accordingly, utilities of VGAM1636 include diagnosis, prevention and treatment of diseases and clinical conditions associated with LOC199958. LOC200093 (Accession XM_032184) is another VGAM1636 host target gene. LOC200093 BINDING SITE is HOST TARGET binding site found in the 3' untranslated region of mRNA encoded by LOC200093, corresponding to a HOST TARGET binding site such as BINDING SITE I, BINDING SITE II or BINDING SITE III. Table 2 illustrates the complementarity of the nucleotide sequences of LOC200093 BINDING SITE, designated SEQ ID:31604, to the nucleotide sequence of VGAM1636 RNA, herein designated VGAM RNA, also designated SEQ ID:4347.

Another function of VGAM1636 is therefore inhibition of LOC200093 (Accession XM_032184). Accordingly, utilities of VGAM1636 include diagnosis, prevention and treatment of diseases and clinical conditions associated with LOC200093. LOC200220 (Accession XM_114157) is another VGAM1636 host target gene. LOC200220 BINDING SITE is HOST TARGET binding site found in the 3' untranslated region of mRNA encoded by LOC200220, corresponding to a HOST TARGET binding site such as BINDING SITE I, BINDING SITE II or BINDING SITE III. Table 2 illustrates the complementarity of the nucleotide sequences of LOC200220 BINDING SITE, designated SEQ ID:42741, to the nucleotide sequence of VGAM1636 RNA, herein designated VGAM RNA, also designated SEQ ID:4347.

Another function of VGAM1636 is therefore inhibition of LOC200220 (Accession XM_114157). Accordingly, utilities of VGAM1636 include diagnosis, prevention and treatment of diseases and clinical conditions associated with LOC200220. LOC220074 (Accession NM_145309) is another VGAM1636 host target gene. LOC220074 BINDING SITE is HOST TARGET binding site found in the 3' untranslated region of mRNA encoded by LOC220074, corresponding to a HOST TARGET binding site such as BINDING SITE I, BINDING SITE II or BINDING SITE III. Table 2 illustrates the complementarity of the nucleotide sequences of LOC220074 BINDING SITE, designated SEQ ID:29821, to the nucleotide sequence of VGAM1636 RNA, herein designated VGAM RNA, also designated SEQ ID:4347.

Another function of VGAM1636 is therefore inhibition of LOC220074 (Accession NM_145309). Accordingly, utilities of VGAM1636 include diagnosis, prevention and treatment of diseases and clinical conditions associated with LOC220074. LOC222160 (Accession XM_168431) is another VGAM1636 host target gene. LOC222160 BINDING SITE is HOST TARGET binding site found in the 5' untranslated region of mRNA encoded by LOC222160, corresponding to a HOST TARGET binding site such as BINDING SITE I, BINDING SITE II or BINDING SITE III. Table 2 illustrates the complementarity of the nucleotide sequences of LOC222160 BINDING SITE, designated SEQ ID:45163, to the nucleotide sequence of VGAM1636 RNA, herein designated VGAM RNA, also designated SEQ ID:4347.

Another function of VGAM1636 is therefore inhibition of LOC222160 (Accession XM_168431). Accordingly, utilities of VGAM1636 include diagnosis, prevention and treatment of diseases and clinical conditions associated with LOC222160. LOC256364 (Accession XM_170672) is another VGAM1636 host target gene. LOC256364 BINDING SITE is HOST TARGET binding site found in the 5' untranslated region of mRNA encoded by LOC256364, corresponding to a HOST TARGET binding site such as BINDING SITE I, BINDING SITE II or BINDING SITE III. Table 2 illustrates the complementarity of the nucleotide sequences of LOC256364 BINDING SITE, designated SEQ ID:45444, to the nucleotide sequence of VGAM1636 RNA, herein designated VGAM RNA, also designated SEQ ID:4347.

Another function of VGAM1636 is therefore inhibition of LOC256364 (Accession XM_170672). Accordingly, utilities of VGAM1636 include diagnosis, prevention and treatment of diseases and clinical conditions associated with LOC256364. LOC91040 (Accession XM_035641) is another VGAM1636 host target gene. LOC91040 BINDING SITE is HOST TARGET binding site found in the 3' untranslated region of mRNA encoded by LOC91040, corresponding to a HOST TARGET binding site such as BINDING SITE I, BINDING SITE II or BINDING SITE III. Table 2 illustrates the complementarity of the nucleotide sequences of LOC91040 BINDING SITE, designated SEQ ID:32321, to the nucleotide sequence of VGAM1636 RNA, herein designated VGAM RNA, also designated SEQ ID:4347.

Another function of VGAM1636 is therefore inhibition of LOC91040 (Accession XM_035641). Accordingly, utilities of VGAM1636 include diagnosis, prevention and treatment of diseases and clinical conditions associated with LOC91040. FIG. 1 further provides a conceptual description of a novel bioinformatically detected viral gene of the present invention, referred to here as Viral Genomic Address Messenger 1637 (VGAM1637) viral gene, which modulates expression of respective host target genes thereof, the function and utility of which host target genes is known in the art.

VGAM1637 is a novel bioinformatically detected regulatory, non protein coding, viral micro RNA (miRNA) gene. The method by which VGAM1637 was detected is described hereinabove with reference to FIGS. 1-8.

VGAM1637 gene, herein designated VGAM GENE, is a viral gene contained in the genome of Human Herpesvirus 8. VGAM1637 host target gene, herein designated VGAM HOST TARGET GENE, is a human gene contained in the human genome.

VGAM1637 gene encodes a VGAM1637 precursor RNA, herein designated VGAM PRECURSOR RNA. Similar to other miRNA genes, and unlike most ordinary genes, VGAM1637 precursor RNA does not encode a protein. A nucleotide sequence identical or highly similar to the nucleotide sequence of VGAM1637 precursor RNA is designated SEQ ID:1623, and is provided hereinbelow with reference to the sequence listing part. Nucleotide sequence SEQ ID:1623 is located at position 122480 relative to the genome of Human Herpesvirus 8.

VGAM1637 precursor RNA folds onto itself, forming VGAM1637 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1637 folded precursor RNA into VGAM1637 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM1637 RNA is designated SEQ ID:4348, and is provided hereinbelow with reference to the sequence listing part.

VGAM1637 host target gene, herein designated VGAM HOST TARGET GENE, encodes a corresponding messenger RNA, VGAM1637 host target RNA, herein designated VGAM HOST TARGET RNA. VGAM1637 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1637 RNA, herein designated VGAM RNA, binds complementarily to one or more host target binding sites located in untranslated regions of VGAM1637 host target RNA, herein designated VGAM HOST TARGET RNA. This complementary binding is due to the fact that the nucleotide sequence of VGAM1637 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1637 RNA, herein designated VGAM RNA, may have a different number of host target binding sites in untranslated regions of a VGAM1637 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1637 RNA, herein designated VGAM RNA, to host target binding sites on VGAM1637 host target RNA, herein designated VGAM HOST TARGET RNA, such as BINDING SITE I, BINDING SITE II and BINDING SITE III, inhibits translation of VGAM1637 host target RNA into VGAM1637 host target protein, herein designated VGAM HOST TARGET PROTEIN. VGAM host target protein is therefore outlined by a broken line.

It is appreciated that VGAM1637 host target gene, herein designated VGAM HOST TARGET GENE, in fact represents a plurality of VGAM1637 host target genes. The mRNA of each one of this plurality of VGAM1637 host target genes comprises one or more host target binding sites, each having a nucleotide sequence which is at least partly complementary to VGAM1637 RNA, herein designated VGAM RNA, and which when bound by VGAM1637 RNA causes inhibition of translation of respective one or more VGAM1637 host target proteins.

It is further appreciated by one skilled in the art that the mode of translational inhibition illustrated by FIG. 1 with specific reference to translational inhibition exerted by VGAM1637 gene, herein designated VGAM GENE, on one or more VGAM1637 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1637 is inhibition of expression of host target genes, as part of a novel viral mechanism of attacking a host. Accordingly, utilities of VGAM1637 include diagnosis, prevention and treatment of viral infection by Human Herpesvirus 8. Specific functions, and accordingly utilities, of VGAM1637 correlate with, and may be deduced from, the identity of the host target genes which VGAM1637 binds and inhibits, and the function of these host target genes, as elaborated hereinbelow.

Nucleotide sequences of the VGAM1637 precursor RNA, herein designated VGAM PRECURSOR RNA, and of the 'diced' VGAM1637 RNA, herein designated VGAM RNA, and a schematic representation of the secondary folding of VGAM1637 folded precursor RNA, herein designated VGAM FOLDED PRECURSOR RNA, of VGAM1637 are further described hereinbelow with reference to Table 1.

Nucleotide sequences of host target binding sites, such as BINDING SITE-I, BINDING SITE-II and BINDING SITE-III of FIG. 1, found on VGAM1637 host target RNA, and schematic representation of the complementarity of each of these host target binding sites to VGAM1637 RNA, herein designated VGAM RNA, are described hereinbelow with reference to Table 2.

As mentioned hereinabove with reference to FIG. 1, a function of VGAM1637 gene, herein designated VGAM is inhibition of expression of VGAM1637 target genes. It is appreciated that specific functions, and accordingly utilities, of VGAM1637 correlate with, and may be deduced from, the identity of the target genes which VGAM1637 binds and inhibits, and the function of these target genes, as elaborated hereinbelow.

Golgi Reassembly Stacking Protein 1, 65 kDa (GORASP1, Accession NM_031899) is a VGAM1637 host target gene. GORASP1 BINDING SITE is HOST TARGET binding site found in the 3' untranslated region of mRNA encoded by GORASP1, corresponding to a HOST TARGET binding site such as BINDING SITE I, BINDING SITE II or BINDING SITE III. Table 2 illustrates the complementarity of the nucleotide sequences of GORASP1 BINDING SITE, designated SEQ ID:25643, to the nucleotide sequence of VGAM1637 RNA, herein designated VGAM RNA, also designated SEQ ID:4348.

A function of VGAM1637 is therefore inhibition of Golgi Reassembly Stacking Protein 1, 65 kDa (GORASP1, Accession NM_031899), a gene which has some funtion with the Golgi apparatus. Accordingly, utilities of VGAM1637 include diagnosis, prevention and treatment of diseases and clinical conditions associated with GORASP1. The function of GORASP1 and its association with various diseases and clinical conditions, has been established by previous studies, as described hereinabove with reference to VGAM630.

KIAA0884 (Accession XM_046660) is another VGAM1637 host target gene. KIAA0884 BINDING SITE is HOST TARGET binding site found in the 5' untranslated region of mRNA encoded by KIAA0884, corresponding to a HOST TARGET binding site such as BINDING SITE I, BINDING SITE II or BINDING SITE III. Table 2 illustrates the complementarity of the nucleotide sequences of KIAA0884 BINDING SITE, designated SEQ ID:34771, to the nucleotide sequence of VGAM1637 RNA, herein designated VGAM RNA, also designated SEQ ID:4348.

Another function of VGAM1637 is therefore inhibition of KIAA0884 (Accession XM_046660). Accordingly, utilities of VGAM1637 include diagnosis, prevention and treatment of diseases and clinical conditions associated with KIAA0884. FIG. 1 further provides a conceptual description of a novel bioinformatically detected viral gene of the present invention, referred to here as Viral Genomic Address Messenger 1638 (VGAM1638) viral gene, which modulates expression of respective host target genes thereof, the function and utility of which host target genes is known in the art.

VGAM1638 is a novel bioinformatically detected regulatory, non protein coding, viral micro RNA (miRNA) gene. The method by which VGAM1638 was detected is described hereinabove with reference to FIGS. 1-8.

VGAM1638 gene, herein designated VGAM GENE, is a viral gene contained in the genome of Human Herpesvirus 8. VGAM1638 host target gene, herein designated VGAM HOST TARGET GENE, is a human gene contained in the human genome.

VGAM1638 gene encodes a VGAM1638 precursor RNA, herein designated VGAM PRECURSOR RNA. Similar to other miRNA genes, and unlike most ordinary genes, VGAM1638 precursor RNA does not encode a protein. A nucleotide sequence identical or highly similar to the nucleotide sequence of VGAM1638 precursor RNA is designated SEQ ID:1624, and is provided hereinbelow with reference to the sequence listing part. Nucleotide sequence SEQ ID:1624 is located at position 124374 relative to the genome of Human Herpesvirus 8.

VGAM1638 precursor RNA folds onto itself, forming VGAM1638 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1638 folded precursor RNA into VGAM1638 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1638 RNA is designated SEQ ID:4349, and is provided hereinbelow with reference to the sequence listing part.

VGAM1638 host target gene, herein designated VGAM HOST TARGET GENE, encodes a corresponding messenger RNA, VGAM1638 host target RNA, herein designated VGAM HOST TARGET RNA. VGAM1638 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1638 RNA, herein designated VGAM RNA, binds complementarily to one or more host target binding sites located in untranslated regions of VGAM1638 host target RNA, herein designated VGAM HOST TARGET RNA. This complementary binding is due to the fact that the nucleotide sequence of VGAM1638 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1638 RNA, herein designated VGAM RNA, may have a different number of host target binding sites in untranslated regions of a VGAM1638 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1638 RNA, herein designated VGAM RNA, to host target binding sites on VGAM1638 host target RNA, herein designated VGAM HOST TARGET RNA, such as BINDING SITE I, BINDING SITE II and BINDING SITE III, inhibits translation of VGAM1638 host target RNA into VGAM1638 host target protein, herein designated VGAM HOST TARGET PROTEIN. VGAM host target protein is therefore outlined by a broken line.

It is appreciated that VGAM1638 host target gene, herein designated VGAM HOST TARGET GENE, in fact represents a plurality of VGAM1638 host target genes. The mRNA of each one of this plurality of VGAM1638 host target genes comprises one or more host target binding sites, each having a nucleotide sequence which is at least partly complementary to VGAM1638 RNA, herein designated VGAM RNA, and which when bound by VGAM1638 RNA causes inhibition of translation of respective one or more VGAM1638 host target proteins.

It is further appreciated by one skilled in the art that the mode of translational inhibition illustrated by FIG. 1 with specific reference to translational inhibition exerted by VGAM1638 gene, herein designated VGAM GENE, on one or more VGAM1638 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1638 is inhibition of expression of host target genes, as part of a novel viral mechanism of attacking a host. Accordingly, utilities of VGAM1638 include diagnosis, prevention and treatment of viral infection by Human Herpesvirus 8. Specific functions, and accordingly utilities, of VGAM1638 correlate with, and may be deduced from, the identity of the host target genes which VGAM1638 binds and inhibits, and the function of these host target genes, as elaborated hereinbelow.

Nucleotide sequences of the VGAM1638 precursor RNA, herein designated VGAM PRECURSOR RNA, and of the 'diced' VGAM1638 RNA, herein designated VGAM RNA, and a schematic representation of the secondary folding of VGAM1638 folded precursor RNA, herein designated VGAM FOLDED PRECURSOR RNA, of VGAM1638 are further described hereinbelow with reference to Table 1.

Nucleotide sequences of host target binding sites, such as BINDING SITE-I, BINDING SITE-II and BINDING SITE-III of FIG. 1, found on VGAM1638 host target RNA, and schematic representation of the complementarity of each of these host target binding sites to VGAM1638 RNA, herein designated VGAM RNA, are described hereinbelow with reference to Table 2.

As mentioned hereinabove with reference to FIG. 1, a function of VGAM1638 gene, herein designated VGAM is inhibition of expression of VGAM1638 target genes. It is appreciated that specific functions, and accordingly utilities, of VGAM1638 correlate with, and may be deduced from, the identity of the target genes which VGAM1638 binds and inhibits, and the function of these target genes, as elaborated hereinbelow.

MLL Sep.in-like Fusion (MSF, Accession XM_113892) is a VGAM1638 host target gene. MSF BINDING SITE is HOST TARGET binding site found in the 3" untranslated region of mRNA encoded by MSF, corresponding to a HOST TARGET binding site such as BINDING SITE I, BINDING SITE II or BINDING SITE III. Table 2 illustrates the complementarity of the nucleotide sequences of MSF BINDING SITE, designated SEQ ID:42519, to the nucleotide sequence of VGAM1638 RNA, herein designated VGAM RNA, also designated SEQ ID:4349.

A function of VGAM1638 is therefore inhibition of MLL Sep.in-like Fusion (MSF, Accession XM_113892), a gene which plays a role in the cell cycle. Accordingly, utilities of VGAM1638 include diagnosis, prevention and treatment of diseases and clinical conditions associated with MSF. The function of MSF and its association with various diseases and clinical conditions, has been established by previous studies, as described hereinabove with reference to VGAM514. Phosphorylase, Glycogen; Brain (PYGB, Accession NM_002862) is another VGAM1638 host target gene. PYGB BINDING SITE is HOST TARGET binding site found in the 3' untranslated region of mRNA encoded by PYGB, corresponding to a HOST TARGET binding site such as BINDING SITE I, BINDING SITE II or BINDING SITE III. Table 2 illustrates the complementarity of the nucleotide sequences of PYGB BINDING SITE, designated SEQ ID:8763, to the nucleotide sequence of VGAM1638 RNA, herein designated VGAM RNA, also designated SEQ ID:4349.

Another function of VGAM1638 is therefore inhibition of Phosphorylase, Glycogen; Brain (PYGB, Accession NM_002862). Accordingly, utilities of VGAM1638 include diagnosis, prevention and treatment of diseases and clinical conditions associated with PYGB. Chromosome 20 Open Reading Frame 108 (C20orf108, Accession NM_080821) is another VGAM1638 host target gene. C20orf108 BINDING SITE is HOST TARGET binding site found in the 3' untranslated region of mRNA encoded by C20orf108, corresponding to a HOST TARGET binding site such as BINDING SITE I, BINDING SITE II or BINDING SITE III. Table 2 illustrates the complementarity of the nucleotide sequences of C20orf108 BINDING SITE, designated SEQ ID:28086, to the nucleotide sequence of VGAM1638 RNA, herein designated VGAM RNA, also designated SEQ ID:4349.

Another function of VGAM1638 is therefore inhibition of Chromosome 20 Open Reading Frame 108 (C20orf108, Accession NM_080821). Accordingly, utilities of VGAM1638 include diagnosis, prevention and treatment of diseases and clinical conditions associated with C20orf108. FLJ10378 (Accession NM_018078) is another VGAM1638 host target gene. FLJ10378 BINDING SITE is HOST TARGET binding site found in the 5' untranslated region of mRNA encoded by FLJ10378, corresponding to a HOST TARGET binding site such as BINDING SITE I, BINDING SITE II or BINDING SITE III. Table 2 illustrates the complementarity of the nucleotide sequences of FLJ10378 BINDING SITE, designated SEQ ID:19839, to the nucleotide sequence of VGAM1638 RNA, herein designated VGAM RNA, also designated SEQ ID:4349.

Another function of VGAM1638 is therefore inhibition of FLJ10378 (Accession NM_018078). Accordingly, utilities of VGAM1638 include diagnosis, prevention and treatment of diseases and clinical conditions associated with FLJ10378. HDCMA18P (Accession NM_016648) is another VGAM1638 host target gene. HDCMA18P BINDING SITE is HOST TARGET binding site found in the 5' untranslated region of mRNA encoded by HDCMA18P, corresponding to a HOST TARGET binding site such as BINDING SITE I, BINDING SITE II or BINDING SITE III. Table 2 illustrates the complementarity of the nucleotide sequences of HDCMA18P BINDING SITE, designated SEQ ID:18766, to the nucleotide sequence of VGAM1638 RNA, herein designated VGAM RNA, also designated SEQ ID:4349.

Another function of VGAM1638 is therefore inhibition of HDCMA18P (Accession NM_016648). Accordingly, utilities of VGAM1638 include diagnosis, prevention and treatment of diseases and clinical conditions associated with HDCMA18P. KIAA0164 (Accession NM_014739) is another VGAM1638 host target gene. KIAA0164 BINDING SITE is HOST TARGET binding site found in the 3' untranslated region of mRNA encoded by KIAA0164, corresponding to a HOST TARGET binding site such as BINDING SITE I, BINDING SITE II or BINDING SITE III. Table 2 illustrates the complementarity of the nucleotide sequences of KIAA0164 BINDING SITE, designated SEQ ID:16403, to the nucleotide sequence of VGAM1638 RNA, herein designated VGAM RNA, also designated SEQ ID:4349.

Another function of VGAM1638 is therefore inhibition of KIAA0164 (Accession NM_014739). Accordingly, utilities of VGAM1638 include diagnosis, prevention and treatment of diseases and clinical conditions associated with KIAA0164. SNF1 Sucrose Nonfermenting Like Kinase (yeast) (SLK, Accession NM_014720) is another VGAM1638 host target gene. SLK BINDING SITE is HOST TARGET binding site found in the 3' untranslated region of mRNA encoded by SLK, corresponding to a HOST TARGET binding site such as BINDING SITE I, BINDING SITE II or BINDING SITE III. Table 2 illustrates the complementarity of the nucleotide sequences of SLK BINDING SITE, designated SEQ ID:16282, to the nucleotide sequence of VGAM1638 RNA, herein designated VGAM RNA, also designated SEQ ID:4349.

Another function of VGAM1638 is therefore inhibition of SNF1 Sucrose Nonfermenting Like Kinase (yeast) (SLK, Accession NM_014720). Accordingly, utilities of VGAM1638 include diagnosis, prevention and treatment of diseases and clinical conditions associated with SLK. LOC144811 (Accession XM_096681) is another VGAM1638 host target gene. LOC144811 BINDING SITE is HOST TARGET binding site found in the 3' untranslated region of mRNA encoded by LOC144811, corresponding to a HOST TARGET binding site such as BINDING SITE I, BINDING SITE II or BINDING SITE III. Table 2 illustrates the complementarity of the nucleotide sequences of LOC144811 BINDING SITE, designated SEQ ID:40454, to the nucleotide sequence of VGAM1638 RNA, herein designated VGAM RNA, also designated SEQ ID:4349.

Another function of VGAM1638 is therefore inhibition of LOC144811 (Accession XM_096681). Accordingly, utilities of VGAM1638 include diagnosis, prevention and treatment of diseases and clinical conditions associated with LOC144811. LOC145786 (Accession XM_096860) is another VGAM1638 host target gene. LOC145786 BINDING SITE is HOST TARGET binding site found in the 5' untranslated region of mRNA encoded by LOC145786, corresponding to a HOST TARGET binding site such as BINDING SITE I, BINDING SITE II or BINDING SITE III. Table 2 illustrates the complementarity of the nucleotide sequences of LOC145786 BINDING SITE, designated SEQ ID:40592, to the nucleotide sequence of VGAM1638 RNA, herein designated VGAM RNA, also designated SEQ ID:4349.

Another function of VGAM1638 is therefore inhibition of LOC145786 (Accession XM_096860). Accordingly, utilities of VGAM1638 include diagnosis, prevention and treatment of diseases and clinical conditions associated with LOC145786. LOC158696 (Accession XM_088644) is another VGAM1638 host target gene. LOC158696 BINDING SITE is HOST TARGET binding site found in the 3' untranslated region of mRNA encoded by LOC158696, corresponding to a HOST TARGET binding site such as BINDING SITE I, BINDING SITE II or BINDING SITE III. Table 2 illustrates the complementarity of the nucleotide sequences of LOC158696 BINDING SITE, designated SEQ ID:39880, to the nucleotide sequence of VGAM1638 RNA, herein designated VGAM RNA, also designated SEQ ID:4349.

Another function of VGAM1638 is therefore inhibition of LOC158696 (Accession XM_088644). Accordingly, utilities of VGAM1638 include diagnosis, prevention and treatment of diseases and clinical conditions associated with LOC158696. LOC254556 (Accession XM_170588) is another VGAM1638 host target gene. LOC254556 BINDING SITE is HOST TARGET binding site found in the 3' untranslated region of mRNA encoded by LOC254556, corresponding to a HOST TARGET binding site such as BINDING SITE I, BINDING SITE II or BINDING SITE III. Table 2 illustrates the complementarity of the nucleotide sequences of LOC254556 BINDING SITE, designated SEQ ID:45391, to the nucleotide sequence of VGAM1638 RNA, herein designated VGAM RNA, also designated SEQ ID:4349.

Another function of VGAM1638 is therefore inhibition of LOC254556 (Accession XM_170588). Accordingly, utilities of VGAM1638 include diagnosis, prevention and treatment of diseases and clinical conditions associated with LOC254556. LOC257415 (Accession XM_171177) is another VGAM1638 host target gene. LOC257415 BINDING SITE is HOST TARGET binding site found in the 3' untranslated region of mRNA encoded by LOC257415, corresponding to a HOST TARGET binding site such as BINDING SITE I, BINDING SITE II or BINDING SITE III. Table 2 illustrates the complementarity of the nucleotide sequences of LOC257415 BINDING SITE, designated SEQ ID:45958, to the nucleotide sequence of VGAM1638 RNA, herein designated VGAM RNA, also designated SEQ ID:4349.

Another function of VGAM1638 is therefore inhibition of LOC257415 (Accession XM_171177). Accordingly, utilities of VGAM1638 include diagnosis, prevention and treatment of diseases and clinical conditions associated with LOC257415. LOC90342 (Accession XM_031009) is another VGAM1638 host target gene. LOC90342 BINDING SITE is HOST TARGET binding site found in the 5' untranslated region of mRNA encoded by LOC90342, corresponding to a HOST TARGET binding site such as BINDING SITE I, BINDING SITE II or BINDING SITE III. Table 2 illustrates the complementarity of the nucleotide sequences of LOC90342 BINDING SITE, designated SEQ ID:31254, to the nucleotide sequence of VGAM1638 RNA, herein designated VGAM RNA, also designated SEQ ID:4349.

Another function of VGAM1638 is therefore inhibition of LOC90342 (Accession XM_031009). Accordingly, utilities of VGAM1638 include diagnosis, prevention and treatment of diseases and clinical conditions associated with LOC90342. FIG. 1 further provides a conceptual description of a novel bioinformatically detected viral gene of the present invention, referred to here as Viral Genomic Address Messenger 1639 (VGAM1639) viral gene, which modulates expression of respective host target genes thereof, the function and utility of which host target genes is known in the art.

VGAM1639 is a novel bioinformatically detected regulatory, non protein coding, viral micro RNA (miRNA) gene. The method by which VGAM1639 was detected is described hereinabove with reference to FIGS. 1-8.

VGAM1639 gene, herein designated VGAM GENE, is a viral gene contained in the genome of Human Herpesvirus 8. VGAM1639 host target gene, herein designated VGAM HOST TARGET GENE, is a human gene contained in the human genome.

VGAM1639 gene encodes a VGAM1639 precursor RNA, herein designated VGAM PRECURSOR RNA. Similar to other miRNA genes, and unlike most ordinary genes, VGAM1639 precursor RNA does not encode a protein. A nucleotide sequence identical or highly similar to the nucleotide sequence of VGAM1639 precursor RNA is designated SEQ ID:1625, and is provided hereinbelow with reference to the sequence listing part. Nucleotide sequence SEQ ID:1625 is located at position 121407 relative to the genome of Human Herpesvirus 8.

VGAM1639 precursor RNA folds onto itself, forming VGAM1639 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1639 folded precursor RNA into VGAM1639 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1639 RNA is designated SEQ ID:4350, and is provided hereinbelow with reference to the sequence listing part.

VGAM1639 host target gene, herein designated VGAM HOST TARGET GENE, encodes a corresponding messenger RNA, VGAM1639 host target RNA, herein designated VGAM HOST TARGET RNA. VGAM1639 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1639 RNA, herein designated VGAM RNA, binds complementarily to one or more host target binding sites located in untranslated regions of VGAM1639 host target RNA, herein designated VGAM HOST TARGET RNA. This complementary binding is due to the fact that the nucleotide sequence of VGAM1639 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1639 RNA, herein designated VGAM RNA, may have a different number of host target binding sites in untranslated regions of a VGAM1639 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1639 RNA, herein designated VGAM RNA, to host target binding sites on VGAM1639 host target RNA, herein designated VGAM HOST TARGET RNA, such as BINDING SITE I, BINDING SITE II and BINDING SITE III, inhibits translation of VGAM1639 host target RNA into VGAM1639 host target protein, herein designated VGAM HOST TARGET PROTEIN. VGAM host target protein is therefore outlined by a broken line.

It is appreciated that VGAM1639 host target gene, herein designated VGAM HOST TARGET GENE, in fact represents a plurality of VGAM1639 host target genes. The mRNA of each one of this plurality of VGAM1639 host target genes comprises one or more host target binding sites, each having a nucleotide sequence which is at least partly complementary to VGAM1639 RNA, herein designated VGAM RNA, and which when bound by VGAM1639 RNA causes inhibition of translation of respective one or more VGAM1639 host target proteins.

It is further appreciated by one skilled in the art that the mode of translational inhibition illustrated by FIG. 1 with specific reference to translational inhibition exerted by VGAM1639 gene, herein designated VGAM GENE, on one or more VGAM1639 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1639 is inhibition of expression of host target genes, as part of a novel viral mechanism of attacking a host. Accordingly, utilities of VGAM1639 include diagnosis, prevention and treatment of viral infection by Human Herpesvirus 8. Specific functions, and accordingly utilities, of VGAM1639 correlate with, and may be deduced from, the identity of the host target genes which VGAM1639 binds and inhibits, and the function of these host target genes, as elaborated hereinbelow.

Nucleotide sequences of the VGAM1639 precursor RNA, herein designated VGAM PRECURSOR RNA, and of the 'diced' VGAM1639 RNA, herein designated VGAM RNA, and a schematic representation of the secondary folding of VGAM1639 folded precursor RNA, herein designated VGAM FOLDED PRECURSOR RNA, of VGAM1639 are further described hereinbelow with reference to Table 1.

Nucleotide sequences of host target binding sites, such as BINDING SITE-I, BINDING SITE-II and BINDING SITE-III of FIG. 1, found on VGAM1639 host target RNA, and schematic representation of the complementarity of each of these host target binding sites to VGAM1639 RNA, herein designated VGAM RNA, are described hereinbelow with reference to Table 2.

As mentioned hereinabove with reference to FIG. 1, a function of VGAM1639 gene, herein designated VGAM is inhibition of expression of VGAM1639 target genes. It is appreciated that specific functions, and accordingly utilities, of VGAM1639 correlate with, and may be deduced from, the identity of the target genes which VGAM1639 binds and inhibits, and the function of these target genes, as elaborated hereinbelow.

LOC114971 (Accession XM_054936) is a VGAM1639 host target gene. LOC114971 BINDING SITE is HOST TARGET binding site found in the 3' untranslated region of mRNA encoded by LOC114971, corresponding to a HOST TARGET binding site such as BINDING SITE I, BINDING SITE II or BINDING SITE III. Table 2 illustrates the complementarity of the nucleotide sequences of LOC114971 BIND- ING SITE, designated SEQ ID:36206, to the nucleotide sequence of VGAM1639 RNA, herein designated VGAM RNA, also designated SEQ ID:4350.

A function of VGAM1639 is therefore inhibition of LOC114971 (Accession XM_054936). Accordingly, utilities of VGAM1639 include diagnosis, prevention and treatment of diseases and clinical conditions associated with LOC114971. LOC221773 (Accession XM_165802) is another VGAM1639 host target gene. LOC221773 BINDING SITE is HOST TARGET binding site found in the 3' untranslated region of mRNA encoded by LOC221773, corresponding to a HOST TARGET binding site such as BINDING SITE I, BINDING SITE II or BINDING SITE III. Table 2 illustrates the complementarity of the nucleotide sequences of LOC221773 BINDING SITE, designated SEQ ID:43759, to the nucleotide sequence of VGAM1639 RNA, herein designated VGAM RNA, also designated SEQ ID:4350.

Another function of VGAM1639 is therefore inhibition of LOC221773 (Accession XM_165802). Accordingly, utilities of VGAM1639 include diagnosis, prevention and treatment of diseases and clinical conditions associated with LOC221773. LOC255533 (Accession XM_173073) is another VGAM1639 host target gene. LOC255533 BINDING SITE is HOST TARGET binding site found in the 5' untranslated region of mRNA encoded by LOC255533, corresponding to a HOST TARGET binding site such as BINDING SITE I, BINDING SITE II or BINDING SITE III. Table 2 illustrates the complementarity of the nucleotide sequences of LOC255533 BINDING SITE, designated SEQ ID:46326, to the nucleotide sequence of VGAM1639 RNA, herein designated VGAM RNA, also designated SEQ ID:4350.

Another function of VGAM1639 is therefore inhibition of LOC255533 (Accession XM_173073). Accordingly, utilities of VGAM1639 include diagnosis, prevention and treatment of diseases and clinical conditions associated with LOC255533. FIG. 1 further provides a conceptual description of a novel bioinformatically detected viral gene of the present invention, referred to here as Viral Genomic Address Messenger 1640 (VGAM1640) viral gene, which modulates expression of respective host target genes thereof, the function and utility of which host target genes is known in the art.

VGAM1640 is a novel bioinformatically detected regulatory, non protein coding, viral micro RNA (miRNA) gene. The method by which VGAM1640 was detected is described hereinabove with reference to FIGS. 1-8.

VGAM1640 gene, herein designated VGAM GENE, is a viral gene contained in the genome of Human Herpesvirus 8. VGAM1640 host target gene, herein designated VGAM HOST TARGET GENE, is a human gene contained in the human genome.

VGAM1640 gene encodes a VGAM1640 precursor RNA, herein designated VGAM PRECURSOR RNA. Similar to other miRNA genes, and unlike most ordinary genes, VGAM1640 precursor RNA does not encode a protein. A nucleotide sequence identical or highly similar to the nucleotide sequence of VGAM1640 precursor RNA is designated SEQ ID:1626, and is provided hereinbelow with reference to the sequence listing part. Nucleotide sequence SEQ ID:1626 is located at position 117446 relative to the genome of Human Herpesvirus 8.

VGAM1640 precursor RNA folds onto itself, forming VGAM1640 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1640 folded precursor RNA into VGAM1640 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM1640 RNA is designated SEQ ID:4351, and is provided hereinbelow with reference to the sequence listing part.

VGAM1640 host target gene, herein designated VGAM HOST TARGET GENE, encodes a corresponding messenger RNA, VGAM1640 host target RNA, herein designated VGAM HOST TARGET RNA. VGAM1640 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1640 RNA, herein designated VGAM RNA, binds complementarily to one or more host target binding sites located in untranslated regions of VGAM1640 host target RNA, herein designated VGAM HOST TARGET RNA. This complementary binding is due to the fact that the nucleotide sequence of VGAM1640 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1640 RNA, herein designated VGAM RNA, may have a different number of host target binding sites in untranslated regions of a VGAM1640 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1640 RNA, herein designated VGAM RNA, to host target binding sites on VGAM1640 host target RNA, herein designated VGAM HOST TARGET RNA, such as BINDING SITE I, BINDING SITE II and BINDING SITE III, inhibits translation of VGAM1640 host target RNA into VGAM1640 host target protein, herein designated VGAM HOST TARGET PROTEIN. VGAM host target protein is therefore outlined by a broken line.

It is appreciated that VGAM1640 host target gene, herein designated VGAM HOST TARGET GENE, in fact represents a plurality of VGAM1640 host target genes. The mRNA of each one of this plurality of VGAM1640 host target genes comprises one or more host target binding sites, each having a nucleotide sequence which is at least partly complementary to VGAM1640 RNA, herein designated VGAM RNA, and which when bound by VGAM1640 RNA causes inhibition of translation of respective one or more VGAM1640 host target proteins.

It is further appreciated by one skilled in the art that the mode of translational inhibition illustrated by FIG. 1 with specific reference to translational inhibition exerted by VGAM1640 gene, herein designated VGAM GENE, on one or more VGAM1640 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1640 is inhibition of expression of host target genes, as part of a novel viral mechanism of attacking a host. Accordingly, utilities of VGAM1640 include diagnosis, prevention and treatment of viral infection by Human Herpesvirus 8. Specific functions, and accordingly utilities, of VGAM1640 correlate with, and may be deduced from, the identity of the host target genes which VGAM1640 binds and inhibits, and the function of these host target genes, as elaborated hereinbelow.

Nucleotide sequences of the VGAM1640 precursor RNA, herein designated VGAM PRECURSOR RNA, and of the 'diced' VGAM1640 RNA, herein designated VGAM RNA, and a schematic representation of the secondary folding of VGAM1640 folded precursor RNA, herein designated VGAM FOLDED PRECURSOR RNA, of VGAM1640 are further described hereinbelow with reference to Table 1.

Nucleotide sequences of host target binding sites, such as BINDING SITE-I, BINDING SITE-II and BINDING SITE-III of FIG. 1, found on VGAM1640 host target RNA, and schematic representation of the complementarity of each of these host target binding sites to VGAM1640 RNA, herein designated VGAM RNA, are described hereinbelow with reference to Table 2.

As mentioned hereinabove with reference to FIG. 1, a function of VGAM1640 gene, herein designated VGAM is inhibition of expression of VGAM1640 target genes. It is appreciated that specific functions, and accordingly utilities, of VGAM1640 correlate with, and may be deduced from, the identity of the target genes which VGAM1640 binds and inhibits, and the function of these target genes, as elaborated hereinbelow.

Reticulon 3 (RTN3, Accession XM_058207) is a VGAM1640 host target gene. RTN3 BINDING SITE is HOST TARGET binding site found in the 3' untranslated region of mRNA encoded by RTN3, corresponding to a HOST TARGET binding site such as BINDING SITE I, BINDING SITE II or BINDING SITE III. Table 2 illustrates the complementarity of the nucleotide sequences of RTN3 BINDING SITE, designated SEQ ID:36586, to the nucleotide sequence of VGAM1640 RNA, herein designated VGAM RNA, also designated SEQ ID:4351.

A function of VGAM1640 is therefore inhibition of Reticulon 3 (RTN3, Accession XM_058207), a gene which is a member of the reticulon (neuroendocrine-specific, NSP) family. Accordingly, utilities of VGAM1640 include diagnosis, prevention and treatment of diseases and clinical conditions associated with RTN3. The function of RTN3 and its association with various diseases and clinical conditions, has been established by previous studies, as described hereinabove with reference to VGAM596. Tuftelin 1 (TUFT1, Accession NM_020127) is another VGAM1640 host target gene. TUFT1 BINDING SITE is HOST TARGET binding site found in the 3' untranslated region of mRNA encoded by TUFT1, corresponding to a HOST TARGET binding site such as BINDING SITE I, BINDING SITE II or BINDING SITE III. Table 2 illustrates the complementarity of the nucleotide sequences of TUFT1 BINDING SITE, designated SEQ ID:21320, to the nucleotide sequence of VGAM1640 RNA, herein designated VGAM RNA, also designated SEQ ID:4351.

Another function of VGAM1640 is therefore inhibition of Tuftelin 1 (TUFT1, Accession NM_020127), a gene which appears to play a role in cytokinesis, cell shape, and specialized functions such as secretion and capping. Accordingly, utilities of VGAM1640 include diagnosis, prevention and treatment of diseases and clinical conditions associated with TUFT1. The function of TUFT1 and its association with various diseases and clinical conditions, has been established by previous studies, as described hereinabove with reference to VGAM1152. Chromosome 6 Open Reading Frame 33 (C6orf33, Accession NM_133367) is another VGAM1640 host target gene. C6orf33 BINDING SITE is HOST TARGET binding site found in the 3' untranslated region of mRNA encoded by C6orf33, corresponding to a HOST TARGET binding site such as BINDING SITE I, BINDING SITE II or BINDING SITE III. Table 2 illustrates the complementarity of the nucleotide sequences of C6orf33 BINDING SITE, designated SEQ ID:28494, to the nucleotide sequence of VGAM1640 RNA, herein designated VGAM RNA, also designated SEQ ID:4351.

Another function of VGAM1640 is therefore inhibition of Chromosome 6 Open Reading Frame 33 (C6orf33, Accession NM_133367). Accordingly, utilities of VGAM1640 include diagnosis, prevention and treatment of diseases and clinical conditions associated with C6orf33. FLJ23191 (Accession NM_024574) is another VGAM1640 host target gene. FLJ23191 BINDING SITE is HOST TARGET binding site found in the 5' untranslated region of mRNA encoded by FLJ23191, corresponding to a HOST TARGET binding site such as BINDING SITE I, BINDING SITE II or BINDING SITE III. Table 2 illustrates the complementarity of the nucleotide sequences of FLJ23191 BINDING SITE, designated SEQ ID:23805, to the nucleotide sequence of VGAM1640 RNA, herein designated VGAM RNA, also designated SEQ ID:4351.

Another function of VGAM1640 is therefore inhibition of FLJ23191 (Accession NM_024574). Accordingly, utilities of VGAM1640 include diagnosis, prevention and treatment of diseases and clinical conditions associated with FLJ23191. FLJ30213 (Accession NM_145008) is another VGAM1640 host target gene. FLJ30213 BINDING SITE is HOST TARGET binding site found in the 3' untranslated region of mRNA encoded by FLJ30213, corresponding to a HOST TARGET binding site such as BINDING SITE I, BINDING SITE II or BINDING SITE III. Table 2 illustrates the complementarity of the nucleotide sequences of FLJ30213 BINDING SITE, designated SEQ ID:29610, to the nucleotide sequence of VGAM1640 RNA, herein designated VGAM RNA, also designated SEQ ID:4351.

Another function of VGAM1640 is therefore inhibition of FLJ30213 (Accession NM_145008). Accordingly, utilities of VGAM1640 include diagnosis, prevention and treatment of diseases and clinical conditions associated with FLJ30213. KIAA1184 (Accession NM_022572) is another VGAM1640 host target gene. KIAA1184 BINDING SITE is HOST TARGET binding site found in the 3' untranslated region of mRNA encoded by KIAA1184, corresponding to a HOST TARGET binding site such as BINDING SITE I, BINDING SITE II or BINDING SITE III. Table 2 illustrates the complementarity of the nucleotide sequences of KIAA1184 BINDING SITE, designated SEQ ID:22898, to the nucleotide sequence of VGAM1640 RNA, herein designated VGAM RNA, also designated SEQ ID:4351.

Another function of VGAM1640 is therefore inhibition of KIAA1184 (Accession NM_022572). Accordingly, utilities of VGAM1640 include diagnosis, prevention and treatment of diseases and clinical conditions associated with KIAA1184. NDP52 (Accession NM_005831) is another VGAM1640 host target gene. NDP52 BINDING SITE is HOST TARGET binding site found in the 3' untranslated region of mRNA encoded by NDP52, corresponding to a HOST TARGET binding site such as BINDING SITE I, BINDING SITE II or BINDING SITE III. Table 2 illustrates the complementarity of the nucleotide sequences of NDP52 BINDING SITE, designated SEQ ID:12442, to the nucleotide sequence of VGAM1640 RNA, herein designated VGAM RNA, also designated SEQ ID:4351.

Another function of VGAM1640 is therefore inhibition of NDP52 (Accession NM_005831). Accordingly, utilities of VGAM1640 include diagnosis, prevention and treatment of diseases and clinical conditions associated with NDP52. Trinucleotide Repeat Containing 6 (TNRC6, Accession XM_047123) is another VGAM1640 host target gene. TNRC6 BINDING SITE is HOST TARGET binding site found in the 3' untranslated region of mRNA encoded by TNRC6, corresponding to a HOST TARGET binding site such as BINDING SITE I, BINDING SITE II or BINDING SITE III. Table 2 illustrates the complementarity of the nucleotide sequences of TNRC6 BINDING SITE, designated SEQ ID:34901, to the nucleotide sequence of VGAM1640 RNA, herein designated VGAM RNA, also designated SEQ ID:4351.

Another function of VGAM1640 is therefore inhibition of Trinucleotide Repeat Containing 6 (TNRC6, Accession XM_047123). Accordingly, utilities of VGAM1640 include diagnosis, prevention and treatment of diseases and clinical conditions associated with TNRC6. LOC129676 (Accession XM_065341) is another VGAM1640 host target gene. LOC129676 BINDING SITE is HOST TARGET binding site found in the 5' untranslated region of mRNA encoded by LOC129676, corresponding to a HOST TARGET binding site such as BINDING SITE I, BINDING SITE II or BINDING SITE III. Table 2 illustrates the complementarity of the nucleotide sequences of LOC129676 BINDING SITE, designated SEQ ID:37287, to the nucleotide sequence of VGAM1640 RNA, herein designated VGAM RNA, also designated SEQ ID:4351.

Another function of VGAM1640 is therefore inhibition of LOC129676 (Accession XM_065341). Accordingly, utilities of VGAM1640 include diagnosis, prevention and treatment of diseases and clinical conditions associated with LOC129676. LOC152905 (Accession XM_017966) is another VGAM1640 host target gene. LOC152905 BINDING SITE is HOST TARGET binding site found in the 3' untranslated region of mRNA encoded by LOC152905, corresponding to a HOST TARGET binding site such as BINDING SITE I, BINDING SITE II or BINDING SITE III. Table 2 illustrates the complementarity of the nucleotide sequences of LOC152905 BINDING SITE, designated SEQ ID:30331, to the nucleotide sequence of VGAM1640 RNA, herein designated VGAM RNA, also designated SEQ ID:4351.

Another function of VGAM1640 is therefore inhibition of LOC152905 (Accession XM_017966). Accordingly, utilities of VGAM1640 include diagnosis, prevention and treatment of diseases and clinical conditions associated with LOC152905. LOC254402 (Accession XM_174207) is another VGAM1640 host target gene. LOC254402 BINDING SITE is HOST TARGET binding site found in the 5' untranslated region of mRNA encoded by LOC254402, corresponding to a HOST TARGET binding site such as BINDING SITE I, BINDING SITE II or BINDING SITE III. Table 2 illustrates the complementarity of the nucleotide sequences of LOC254402 BINDING SITE, designated SEQ ID:46583, to the nucleotide sequence of VGAM1640 RNA, herein designated VGAM RNA, also designated SEQ ID:4351.

Another function of VGAM1640 is therefore inhibition of LOC254402 (Accession XM_174207). Accordingly, utilities of VGAM1640 include diagnosis, prevention and treatment of diseases and clinical conditions associated with LOC254402. LOC56267 (Accession NM_019610) is another VGAM1640 host target gene. LOC56267 BINDING SITE is HOST TARGET binding site found in the 3' untranslated region of mRNA encoded by LOC56267, corresponding to a HOST TARGET binding site such as BINDING SITE I, BINDING SITE II or BINDING SITE III. Table 2 illustrates the complementarity of the nucleotide sequences of LOC56267 BINDING SITE, designated SEQ ID:21230, to the nucleotide sequence of VGAM1640 RNA, herein designated VGAM RNA, also designated SEQ ID:4351.

Another function of VGAM1640 is therefore inhibition of LOC56267 (Accession NM_019610). Accordingly, utilities of VGAM1640 include diagnosis, prevention and treatment of diseases and clinical conditions associated with LOC56267. FIG. 1 further provides a conceptual description of a novel bioinformatically detected viral gene of the present invention, referred to here as Viral Genomic Address Messenger 1641 (VGAM1641) viral gene, which modulates expression of respective host target genes thereof, the function and utility of which host target genes is known in the art.

VGAM1641 is a novel bioinformatically detected regulatory, non protein coding, viral micro RNA (miRNA) gene. The method by which VGAM1641 was detected is described hereinabove with reference to FIGS. 1-8.

VGAM1641 gene, herein designated VGAM GENE, is a viral gene contained in the genome of Cell Fusing Agent Virus. VGAM1641 host target gene, herein designated VGAM HOST TARGET GENE, is a human gene contained in the human genome.

VGAM1641 gene encodes a VGAM1641 precursor RNA, herein designated VGAM PRECURSOR RNA. Similar to other miRNA genes, and unlike most ordinary genes, VGAM1641 precursor RNA does not encode a protein. A nucleotide sequence identical or highly similar to the nucleotide sequence of VGAM1641 precursor RNA is designated SEQ ID:1627, and is provided hereinbelow with reference to the sequence listing part. Nucleotide sequence SEQ ID:1627 is located at position 9147 relative to the genome of Cell Fusing Agent Virus.

VGAM1641 precursor RNA folds onto itself, forming VGAM1641 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1641 folded precursor RNA into VGAM1641 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1641 RNA is designated SEQ ID:4352, and is provided hereinbelow with reference to the sequence listing part.

VGAM1641 host target gene, herein designated VGAM HOST TARGET GENE, encodes a corresponding messenger RNA, VGAM1641 host target RNA, herein designated VGAM HOST TARGET RNA. VGAM1641 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1641 RNA, herein designated VGAM RNA, binds complementarily to one or more host target binding sites located in untranslated regions of VGAM1641 host target RNA, herein designated VGAM HOST TARGET RNA. This complementary binding is due to the fact that the nucleotide sequence of VGAM1641 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1641 RNA, herein designated VGAM RNA, may have a different number of host target binding sites in untranslated regions of a VGAM1641 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1641 RNA, herein designated VGAM RNA, to host target binding sites on VGAM1641 host target RNA, herein designated VGAM HOST TARGET RNA, such as BINDING SITE I, BINDING SITE II and BINDING SITE III, inhibits translation of VGAM1641 host target RNA into VGAM1641 host target protein, herein designated VGAM HOST TARGET PROTEIN. VGAM host target protein is therefore outlined by a broken line.

It is appreciated that VGAM1641 host target gene, herein designated VGAM HOST TARGET GENE, in fact represents a plurality of VGAM1641 host target genes. The mRNA of each one of this plurality of VGAM1641 host target genes comprises one or more host target binding sites, each having a nucleotide sequence which is at least partly complementary to VGAM1641 RNA, herein designated VGAM RNA, and which when bound by VGAM1641 RNA causes inhibition of translation of respective one or more VGAM1641 host target proteins.

It is further appreciated by one skilled in the art that the mode of translational inhibition illustrated by FIG. 1 with specific reference to translational inhibition exerted by VGAM1641 gene, herein designated VGAM GENE, on one or more VGAM1641 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1641 is inhibition of expression of host target genes, as part of a novel viral mechanism of attacking a host. Accordingly, utilities of VGAM1641 include diagnosis, prevention and treatment of viral infection by Cell Fusing Agent Virus. Specific functions, and accordingly utilities, of VGAM1641 correlate with, and may be deduced from, the identity of the host target genes which VGAM1641 binds and inhibits, and the function of these host target genes, as elaborated hereinbelow.

Nucleotide sequences of the VGAM1641 precursor RNA, herein designated VGAM PRECURSOR RNA, and of the 'diced' VGAM1641 RNA, herein designated VGAM RNA, and a schematic representation of the secondary folding of VGAM1641 folded precursor RNA, herein designated VGAM FOLDED PRECURSOR RNA, of VGAM1641 are further described hereinbelow with reference to Table 1.

Nucleotide sequences of host target binding sites, such as BINDING SITE-I, BINDING SITE-II and BINDING SITE-III of FIG. 1, found on VGAM1641 host target RNA, and schematic representation of the complementarity of each of these host target binding sites to VGAM1641 RNA, herein designated VGAM RNA, are described hereinbelow with reference to Table 2.

As mentioned hereinabove with reference to FIG. 1, a function of VGAM1641 gene, herein designated VGAM is inhibition of expression of VGAM1641 target genes. It is appreciated that specific functions, and accordingly utilities, of VGAM1641 correlate with, and may be deduced from, the identity of the target genes which VGAM1641 binds and inhibits, and the function of these target genes, as elaborated hereinbelow.

Hepatocyte Growth Factor (hepapoietin A; scatter factor) (HGF, Accession XM_168542) is a VGAM1641 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45219, to the nucleotide sequence of VGAM1641 RNA, herein designated VGAM RNA, also designated SEQ ID:4352.

A function of VGAM1641 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM1641 include diagnosis, prevention and treatment of diseases and clinical conditions associated with HGF. The function of HGF and its association with various diseases and clinical conditions, has been established by previous studies, as described hereinabove with reference to VGAM174. FIG. 1 further provides a conceptual description of a novel bioinformatically detected viral gene of the present invention, referred to here as Viral Genomic Address Messenger 1642 (VGAM1642) viral gene, which modulates expression of respective host target genes thereof, the function and utility of which host target genes is known in the art.

VGAM1642 is a novel bioinformatically detected regulatory, non protein coding, viral micro RNA (miRNA) gene. The method by which VGAM1642 was detected is described hereinabove with reference to FIGS. 1-8.

VGAM1642 gene, herein designated VGAM GENE, is a viral gene contained in the genome of Cell Fusing Agent Virus. VGAM1642 host target gene, herein designated VGAM HOST TARGET GENE, is a human gene contained in the human genome.

VGAM1642 gene encodes a VGAM1642 precursor RNA, herein designated VGAM PRECURSOR RNA. Similar to other miRNA genes, and unlike most ordinary genes, VGAM1642 precursor RNA does not encode a protein. A nucleotide sequence identical or highly similar to the nucleotide sequence of VGAM1642 precursor RNA is designated SEQ ID:1628, and is provided hereinbelow with reference to the sequence listing part. Nucleotide sequence SEQ ID:1628 is located at position 8550 relative to the genome of Cell Fusing Agent Virus.

VGAM1642 precursor RNA folds onto itself, forming VGAM1642 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1642 folded precursor RNA into VGAM1642 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1642 RNA is designated SEQ ID:4353, and is provided hereinbelow with reference to the sequence listing part.

VGAM1642 host target gene, herein designated VGAM HOST TARGET GENE, encodes a corresponding messenger RNA, VGAM1642 host target RNA, herein designated VGAM HOST TARGET RNA. VGAM1642 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1642 RNA, herein designated VGAM RNA, binds complementarily to one or more host target binding sites located in untranslated regions of VGAM1642 host target RNA, herein designated VGAM HOST TARGET RNA. This complementary binding is due to the fact that the nucleotide sequence of VGAM1642 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1642 RNA, herein designated VGAM RNA, may have a different number of host target binding sites in untranslated regions of a VGAM1642 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1642 RNA, herein designated VGAM RNA, to host target binding sites on VGAM1642 host target RNA, herein designated VGAM HOST TARGET RNA, such as BINDING SITE I, BINDING SITE II and BINDING SITE III, inhibits translation of VGAM1642 host target RNA into VGAM1642 host target protein, herein designated VGAM HOST TARGET PROTEIN. VGAM host target protein is therefore outlined by a broken line.

It is appreciated that VGAM1642 host target gene, herein designated VGAM HOST TARGET GENE, in fact represents a plurality of VGAM1642 host target genes. The mRNA of each one of this plurality of VGAM1642 host target genes comprises one or more host target binding sites, each having a nucleotide sequence which is at least partly complementary to VGAM1642 RNA, herein designated VGAM RNA, and which when bound by VGAM1642 RNA causes inhibition of translation of respective one or more VGAM1642 host target proteins.

It is further appreciated by one skilled in the art that the mode of translational inhibition illustrated by FIG. 1 with specific reference to translational inhibition exerted by VGAM1642 gene, herein designated VGAM GENE, on one or more VGAM1642 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1642 is inhibition of expression of host target genes, as part of a novel viral mechanism of attacking a host. Accordingly, utilities of VGAM1642 include diagnosis, prevention and treatment of viral infection by Cell Fusing Agent Virus. Specific functions, and accordingly utilities, of VGAM1642 correlate with, and may be deduced from, the identity of the host target genes which VGAM1642 binds and inhibits, and the function of these host target genes, as elaborated hereinbelow.

Nucleotide sequences of the VGAM1642 precursor RNA, herein designated VGAM PRECURSOR RNA, and of the 'diced' VGAM1642 RNA, herein designated VGAM RNA, and a schematic representation of the secondary folding of VGAM1642 folded precursor RNA, herein designated VGAM FOLDED PRECURSOR RNA, of VGAM1642 are further described hereinbelow with reference to Table 1.

Nucleotide sequences of host target binding sites, such as BINDING SITE-I, BINDING SITE-II and BINDING SITE-III of FIG. 1, found on VGAM1642 host target RNA, and schematic representation of the complementarity of each of these host target binding sites to VGAM1642 RNA, herein designated VGAM RNA, are described hereinbelow with reference to Table 2.

As mentioned hereinabove with reference to FIG. 1, a function of VGAM1642 gene, herein designated VGAM is inhibition of expression of VGAM1642 target genes. It is appreciated that specific functions, and accordingly utilities, of VGAM1642 correlate with, and may be deduced from, the identity of the target genes which VGAM1642 binds and inhibits, and the function of these target genes, as elaborated hereinbelow.

LOC254122 (Accession XM_170660) is a VGAM1642 host target gene. LOC254122 BINDING SITE is HOST TARGET binding site found in the 3' untranslated region of mRNA encoded by LOC254122, corresponding to a HOST TARGET binding site such as BINDING SITE I, BINDING SITE II or BINDING SITE III. Table 2 illustrates the complementarity of the nucleotide sequences of LOC254122 BINDING SITE, designated SEQ ID:45437, to the nucleotide sequence of VGAM1642 RNA, herein designated VGAM RNA, also designated SEQ ID:4353.

A function of VGAM1642 is therefore inhibition of LOC254122 (Accession XM_170660). Accordingly, utilities of VGAM1642 include diagnosis, prevention and treatment of diseases and clinical conditions associated with LOC254122. LOC254830 (Accession XM_175118) is another VGAM1642 host target gene. LOC254830 BINDING SITE is HOST TARGET binding site found in the 5' untranslated region of mRNA encoded by LOC254830, corresponding to a HOST TARGET binding site such as BINDING SITE I, BINDING SITE II or BINDING SITE III. Table 2 illustrates the complementarity of the nucleotide sequences of LOC254830 BINDING SITE, designated SEQ ID:46612, to the nucleotide sequence of VGAM1642 RNA, herein designated VGAM RNA, also designated SEQ ID:4353.

Another function of VGAM1642 is therefore inhibition of LOC254830 (Accession XM_175118). Accordingly, utilities of VGAM1642 include diagnosis, prevention and treatment of diseases and clinical conditions associated with LOC254830. FIG. 1 further provides a conceptual description of a novel bioinformatically detected viral gene of the present invention, referred to here as Viral Genomic Address Messenger 1643 (VGAM1643) viral gene, which modulates expression of respective host target genes thereof, the function and utility of which host target genes is known in the art.

VGAM1643 is a novel bioinformatically detected regulatory, non protein coding, viral micro RNA (miRNA) gene. The method by which VGAM1643 was detected is described hereinabove with reference to FIGS. 1-8.

VGAM1643 gene, herein designated VGAM GENE, is a viral gene contained in the genome of Cell Fusing Agent Virus. VGAM1643 host target gene, herein designated VGAM HOST TARGET GENE, is a human gene contained in the human genome.

VGAM1643 gene encodes a VGAM1643 precursor RNA, herein designated VGAM PRECURSOR RNA. Similar to other miRNA genes, and unlike most ordinary genes, VGAM1643 precursor RNA does not encode a protein. A nucleotide sequence identical or highly similar to the nucleotide sequence of VGAM1643 precursor RNA is designated SEQ ID:1629, and is provided hereinbelow with reference to the sequence listing part. Nucleotide sequence SEQ ID:1629 is located at position 1340 relative to the genome of Cell Fusing Agent Virus.

VGAM1643 precursor RNA folds onto itself, forming VGAM1643 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1643 folded precursor RNA into VGAM1643 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1643 RNA is designated SEQ ID:4354, and is provided hereinbelow with reference to the sequence listing part.

VGAM1643 host target gene, herein designated VGAM HOST TARGET GENE, encodes a corresponding messenger RNA, VGAM1643 host target RNA, herein designated VGAM HOST TARGET RNA. VGAM1643 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1643 RNA, herein designated VGAM RNA, binds complementarily to one or more host target binding sites located in untranslated regions of VGAM1643 host target RNA, herein designated VGAM HOST TARGET RNA. This complementary binding is due to the fact that the nucleotide sequence of VGAM1643 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1643 RNA, herein designated VGAM RNA, may have a different number of host target binding sites in untranslated regions of a VGAM1643 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1643 RNA, herein designated VGAM RNA, to host target binding sites on VGAM1643 host target RNA, herein designated VGAM HOST TARGET RNA, such as BINDING SITE I, BINDING SITE II and BINDING SITE III, inhibits translation of VGAM1643 host target RNA into VGAM1643 host target protein, herein designated VGAM HOST TARGET PROTEIN. VGAM host target protein is therefore outlined by a broken line.

It is appreciated that VGAM1643 host target gene, herein designated VGAM HOST TARGET GENE, in fact represents a plurality of VGAM1643 host target genes. The mRNA of each one of this plurality of VGAM1643 host target genes comprises one or more host target binding sites, each having a nucleotide sequence which is at least partly complementary to VGAM1643 RNA, herein designated VGAM RNA, and which when bound by VGAM1643 RNA causes inhibition of translation of respective one or more VGAM1643 host target proteins.

It is further appreciated by one skilled in the art that the mode of translational inhibition illustrated by FIG. 1 with specific reference to translational inhibition exerted by VGAM1643 gene, herein designated VGAM GENE, on one or more VGAM1643 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1643 is inhibition of expression of host target genes, as part of a novel viral mechanism of attacking a host. Accordingly, utilities of VGAM1643 include diagnosis, prevention and treatment of viral infection by Cell Fusing Agent Virus. Specific functions, and accordingly utilities, of VGAM1643 correlate with, and may be deduced from, the identity of the host target genes which VGAM1643 binds and inhibits, and the function of these host target genes, as elaborated hereinbelow.

Nucleotide sequences of the VGAM1643 precursor RNA, herein designated VGAM PRECURSOR RNA, and of the 'diced' VGAM1643 RNA, herein designated VGAM RNA, and a schematic representation of the secondary folding of VGAM1643 folded precursor RNA, herein designated VGAM FOLDED PRECURSOR RNA, of VGAM1643 are further described hereinbelow with reference to Table 1.

Nucleotide sequences of host target binding sites, such as BINDING SITE-I, BINDING SITE-II and BINDING SITE-III of FIG. 1, found on VGAM1643 host target RNA, and schematic representation of the complementarity of each of these host target binding sites to VGAM1643 RNA, herein designated VGAM RNA, are described hereinbelow with reference to Table 2.

As mentioned hereinabove with reference to FIG. 1, a function of VGAM1643 gene, herein designated VGAM is inhibition of expression of VGAM1643 target genes. It is appreciated that specific functions, and accordingly utilities, of VGAM1643 correlate with, and may be deduced from, the identity of the target genes which VGAM1643 binds and inhibits, and the function of these target genes, as elaborated hereinbelow.

GNAS Complex Locus (GNAS, Accession NM_016592) is a VGAM1643 host target gene. GNAS BINDING SITE is HOST TARGET binding site found in the 3' untranslated region of mRNA encoded by GNAS, corresponding to a HOST TARGET binding site such as BINDING SITE I, BINDING SITE II or BINDING SITE III. Table 2 illustrates the complementarity of the nucleotide sequences of GNAS BINDING SITE, designated SEQ ID:18676, to the nucleotide sequence of VGAM1643 RNA, herein designated VGAM RNA, also designated SEQ ID:4354.

A function of VGAM1643 is therefore inhibition of GNAS Complex Locus (GNAS, Accession NM_016592), a gene which transduces signals from G protein-coupled receptors and activates adenylyl cyclase. Accordingly, utilities of VGAM1643 include diagnosis, prevention and treatment of diseases and clinical conditions associated with GNAS. The function of GNAS and its association with various diseases and clinical conditions, has been established by previous studies, as described hereinabove with reference to VGAM1205. Zinc Finger Protein 43 (HTF6) (ZNF43, Accession NM_003423) is another VGAM1643 host target gene. ZNF43 BINDING SITE is HOST TARGET binding site found in the 5' untranslated region of mRNA encoded by ZNF43, corresponding to a HOST TARGET binding site such as BINDING SITE I, BINDING SITE II or BINDING SITE III. Table 2 illustrates the complementarity of the nucleotide sequences of ZNF43 BINDING SITE, designated SEQ ID:9470, to the nucleotide sequence of VGAM1643 RNA, herein designated VGAM RNA, also designated SEQ ID:4354.

Another function of VGAM1643 is therefore inhibition of Zinc Finger Protein 43 (HTF6) (ZNF43, Accession NM_003423), a gene which may be involved in transcriptional regulation. Accordingly, utilities of VGAM1643 include diagnosis, prevention and treatment of diseases and clinical conditions associated with ZNF43. The function of ZNF43 has been established by previous studies. By screening a cDNA library derived from a human undifferentiated embryonal carcinoma cell line with the coding sequence of the ZNF85 (OMIM Ref. No. 603899) N-terminal nonfinger region, which spans the KRAB domain, Bellefroid et al. (1991) isolated cDNAs encoding 11 distinct KRAB ZNFs, including ZNF43, which they called HTF6. Lovering and Trowsdale (1991) noted that this HTF6 cDNA, which differs from the 2 ZNF43 cDNAs that they isolated, encodes a ZNF lacking the KRAB A box. Bellefroid et al. (1993) reported the characterization of a subgroup of KRAB ZNFs, named the ZNF91 family, of which ZNF43 is a member. These proteins contain a conserved linker region, called the ZNF91-related spacer region, between their N-terminal KRAB domain and their first finger unit. The authors found that members of the ZNF91 family are widely expressed in human tissues, with the highest expression in T-lymphoid cells.

Full details of the abovementioned studies are described in the following publications, the disclosure of which are hereby incorporated by reference:

Lovering, R.; Trowsdale, J.: A gene encoding 22 highly related zinc fingers is expressed in lymphoid cell lines. Nucleic Acids Res. 19:2921-2928, 1991; and Bellefroid, E. J.; Poncelet, D. A.; Lecocq, P. J.; Revelant, O.; Martial, J. A.: The evolutionarily conserved Kruppel-associated box domain defines a subfamily of eukaryotic multifingered.

Further studies establishing the function and utilities of ZNF43 are found in John Hopkins OMIM database record ID 603972, and in sited publications numbered 7425-742 and 7466 listed in the bibliography section hereinbelow, which are also hereby incorporated by reference. Leptin Receptor Overlapping Transcript-like 1 (LEPROTL1, Accession NM_015344) is another VGAM1643 host target gene. LEPROTL1 BINDING SITE is HOST TARGET binding site found in the 3' untranslated region of mRNA encoded by LEPROTL1, corresponding to a HOST TARGET binding site such as BINDING SITE I, BINDING SITE II or BINDING SITE III. Table 2 illustrates the complementarity of the nucleotide sequences of LEPROTL1 BINDING SITE, designated SEQ ID:17650, to the nucleotide sequence of VGAM1643 RNA, herein designated VGAM RNA, also designated SEQ ID:4354.

Another function of VGAM1643 is therefore inhibition of Leptin Receptor Overlapping Transcript-like 1 (LEPROTL1, Accession NM_015344). Accordingly, utilities of VGAM1643 include diagnosis, prevention and treatment of diseases and clinical conditions associated with LEPROTL1. FIG. 1 further provides a conceptual description of a novel bioinformatically detected viral gene of the present invention, referred to here as Viral Genomic Address Messenger 1644 (VGAM1644) viral gene, which modulates expression of respective host target genes thereof, the function and utility of which host target genes is known in the art.

VGAM1644 is a novel bioinformatically detected regulatory, non protein coding, viral micro RNA (miRNA) gene. The method by which VGAM1644 was detected is described hereinabove with reference to FIGS. 1-8.

VGAM1644 gene, herein designated VGAM GENE, is a viral gene contained in the genome of Dengue Virus. VGAM1644 host target gene, herein designated VGAM HOST TARGET GENE, is a human gene contained in the human genome.

VGAM1644 gene encodes a VGAM1644 precursor RNA, herein designated VGAM PRECURSOR RNA. Similar to other miRNA genes, and unlike most ordinary genes, VGAM1644 precursor RNA does not encode a protein. A nucleotide sequence identical or highly similar to the nucleotide sequence of VGAM1644 precursor RNA is designated SEQ ID:1630, and is provided hereinbelow with reference to the sequence listing part. Nucleotide sequence SEQ ID:1630 is located at position 10625 relative to the genome of Dengue Virus.

VGAM1644 precursor RNA folds onto itself, forming VGAM1644 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1644 folded precursor RNA into VGAM1644 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM1644 RNA is designated SEQ ID:4355, and is provided hereinbelow with reference to the sequence listing part.

VGAM1644 host target gene, herein designated VGAM HOST TARGET GENE, encodes a corresponding messenger RNA, VGAM1644 host target RNA, herein designated VGAM HOST TARGET RNA. VGAM1644 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1644 RNA, herein designated VGAM RNA, binds complementarily to one or more host target binding sites located in untranslated regions of VGAM1644 host target RNA, herein designated VGAM HOST TARGET RNA. This complementary binding is due to the fact that the nucleotide sequence of VGAM1644 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1644 RNA, herein designated VGAM RNA, may have a different number of host target binding sites in untranslated regions of a VGAM1644 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1644 RNA, herein designated VGAM RNA, to host target binding sites on VGAM1644 host target RNA, herein designated VGAM HOST TARGET RNA, such as BINDING SITE I, BINDING SITE II and BINDING SITE III, inhibits translation of VGAM1644 host target RNA into VGAM1644 host target protein, herein designated VGAM HOST TARGET PROTEIN. VGAM host target protein is therefore outlined by a broken line.

It is appreciated that VGAM1644 host target gene, herein designated VGAM HOST TARGET GENE, in fact represents a plurality of VGAM1644 host target genes. The mRNA of each one of this plurality of VGAM1644 host target genes comprises one or more host target binding sites, each having a nucleotide sequence which is at least partly complementary to VGAM1644 RNA, herein designated VGAM RNA, and which when bound by VGAM1644 RNA causes inhibition of translation of respective one or more VGAM1644 host target proteins.

It is further appreciated by one skilled in the art that the mode of translational inhibition illustrated by FIG. 1 with specific reference to translational inhibition exerted by VGAM1644 gene, herein designated VGAM GENE, on one or more VGAM1644 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1644 is inhibition of expression of host target genes, as part of a novel viral mechanism of attacking a host. Accordingly, utilities of VGAM1644 include diagnosis, prevention and treatment of viral infection by Dengue Virus. Specific functions, and accordingly utilities, of VGAM1644 correlate with, and may be deduced from, the identity of the host target genes which VGAM1644 binds and inhibits, and the function of these host target genes, as elaborated hereinbelow.

Nucleotide sequences of the VGAM1644 precursor RNA, herein designated VGAM PRECURSOR RNA, and of the 'diced' VGAM1644 RNA, herein designated VGAM RNA, and a schematic representation of the secondary folding of VGAM1644 folded precursor RNA, herein designated VGAM FOLDED PRECURSOR RNA, of VGAM1644 are further described hereinbelow with reference to Table 1.

Nucleotide sequences of host target binding sites, such as BINDING SITE-I, BINDING SITE-II and BINDING SITE-III of FIG. 1, found on VGAM1644 host target RNA, and schematic representation of the complementarity of each of these host target binding sites to VGAM1644 RNA, herein designated VGAM RNA, are described hereinbelow with reference to Table 2.

As mentioned hereinabove with reference to FIG. 1, a function of VGAM1644 gene, herein designated VGAM is inhibition of expression of VGAM1644 target genes. It is appreciated that specific functions, and accordingly utilities, of VGAM1644 correlate with, and may be deduced from, the identity of the target genes which VGAM1644 binds and inhibits, and the function of these target genes, as elaborated hereinbelow.

A Disintegrin-like and Metalloprotease (reprolysin type) with Thrombospondin Type 1 Motif, 5 (aggrecanase-2) (ADAMTS5, Accession NM_007038) is a VGAM1644 host target gene. ADAMTS5 BINDING SITE is HOST TARGET binding site found in the 3' untranslated region of mRNA encoded by ADAMTS5, corresponding to a HOST TARGET binding site such as BINDING SITE I, BINDING SITE II or BINDING SITE III. Table 2 illustrates the complementarity of the nucleotide sequences of ADAMTS5 BINDING SITE, designated SEQ ID:13918, to the nucleotide sequence of VGAM1644 RNA, herein designated VGAM RNA, also designated SEQ ID:4355.

A function of VGAM1644 is therefore inhibition of A Disintegrin-like and Metalloprotease (reprolysin type) with Thrombospondin Type 1 Motif, 5 (aggrecanase-2) (ADAMTS5, Accession NM_007038), a gene which cleaves aggrecan, a cartilage proteoglycan, and may be involved in its turnover. Accordingly, utilities of VGAM1644 include diagnosis, prevention and treatment of diseases and clinical conditions associated with ADAMTS5. The function of ADAMTS5 and its association with various diseases and clinical conditions, has been established by previous studies, as described hereinabove with reference to VGAM35. Alkaline Phosphatase, Intestinal (ALPI, Accession NM_001631) is another VGAM1644 host target gene. ALPI BINDING SITE is HOST TARGET binding site found in the 3' untranslated region of mRNA encoded by ALPI, corresponding to a HOST TARGET binding site such as BINDING SITE I, BINDING SITE II or BINDING SITE III. Table 2 illustrates the complementarity of the nucleotide sequences of ALPI BINDING SITE, designated SEQ ID:7345, to the nucleotide sequence of VGAM1644 RNA, herein designated VGAM RNA, also designated SEQ ID:4355.

Another function of VGAM1644 is therefore inhibition of Alkaline Phosphatase, Intestinal (ALPI, Accession NM_001631), a gene which is a glycoprotein phosphatase. Accordingly, utilities of VGAM1644 include diagnosis, prevention and treatment of diseases and clinical conditions associated with ALPI. The function of ALPI and its association with various diseases and clinical conditions, has been established by previous studies, as described hereinabove with reference to VGAM885. Dual Specificity Phosphatase 2 (DUSP2, Accession NM_004418) is another VGAM1644 host target gene. DUSP2 BINDING SITE is HOST TARGET binding site found in the 3' untranslated region of mRNA encoded by DUSP2, corresponding to a HOST TARGET binding site such as BINDING SITE I, BINDING SITE II or BINDING SITE III. Table 2 illustrates the complementarity of the nucleotide sequences of DUSP2 BINDING SITE, designated SEQ ID:10682, to the nucleotide sequence of VGAM1644 RNA, herein designated VGAM RNA, also designated SEQ ID:4355.

Another function of VGAM1644 is therefore inhibition of Dual Specificity Phosphatase 2 (DUSP2, Accession NM_004418), a gene which regulates mitogenic signal transduction. Accordingly, utilities of VGAM1644 include diagnosis, prevention and treatment of diseases and clinical conditions associated with DUSP2. The function of DUSP2 has been established by previous studies. Mitogenic stimulation of quiescent cells leads to the rapid and reversible activation of mitogen-activated protein (MAP) kinases via dual phosphorylation within a thr-glu-tyr motif. Following activation, MAP kinases translocate into the nucleus where they phosphorylate several signal transduction targets. The dual-specificity phosphatases can reverse MAP kinase activation by dephosphorylating phosphotyrosine and phosphothreonine residues. Rohan et al. (1993) isolated mouse and human cDNAs encoding PAC1, a mitogen-induced 32-kD protein that contains a sequence that is associated with enzymatic activity in previously identified protein phosphotyrosine phosphatases. The predicted human PAC1 protein has 314 amino acids. Northern blot analysis of human cell lines and mouse tissues revealed that PAC1 is expressed predominantly in hematopoietic tissues. By immunofluorescence of transfected cells and mitogen-stimulated T cells, Rohan et al. (1993) localized PAC1 to the nucleus. Ward et al. (1994) demonstrated that PAC1 is a dual-specific thr/tyr phosphatase that is a physiologically relevant MAP kinase phosphatase. Yi et al. (1995) determined that the PAC1, or DUSP2, gene contains 4 exons that span approximately 2.3 kb. By somatic cell hybrid analysis, linkage analysis, and in situ hybridization, Yi et al. (1995) mapped the PAC1 gene to 2p11.2-q11. Using fluorescence in situ hybridization, Martell et al. (1994) refined the localization of the PAC1 gene to 2q11.

Full details of the abovementioned studies are described in the following publications, the disclosure of which are hereby incorporated by reference:

Rohan, P. J.; Davis, P.; Moskaluk, C. A.; Kearns, M.; Krutzsch, H.; Siebenlist, U.; Kelly, K.: PAC-1: a mitogen-induced nuclear protein tyrosine phosphatase. Science 259: 1763-1766, 1993; and Yi, H.; Morton, C. C.; Weremowicz, S.; McBride, O. W.; Kelly, K.: Genomic organization and chromosomal localization of the DUSP2 gene, encoding a MAP kinase phosphatase, to human 2p11.

Further studies establishing the function and utilities of DUSP2 are found in John Hopkins OMIM database record ID 603068, and in sited publications numbered 10055-8849 listed in the bibliography section hereinbelow, which are also hereby incorporated by reference. FK506 Binding Protein 1B, 12.6 KDa (FKBP1B, Accession NM_054033) is another VGAM1644 host target gene. FKBP1B BINDING SITE is HOST TARGET binding site found in the 3' untranslated region of mRNA encoded by FKBP1B, corresponding to a HOST TARGET binding site such as BINDING SITE I, BINDING SITE II or BINDING SITE III. Table 2 illustrates the complementarity of the nucleotide sequences of FKBP1B BINDING SITE, designated SEQ ID:27643, to the nucleotide sequence of VGAM1644 RNA, herein designated VGAM RNA, also designated SEQ ID:4355.

Another function of VGAM1644 is therefore inhibition of FK506 Binding Protein 1B, 12.6 KDa (FKBP1B, Accession NM_054033), a gene which may play a unique physiological role in excitation-contraction coupling in cardiac muscle. Accordingly, utilities of VGAM1644 include diagnosis, prevention and treatment of diseases and clinical conditions associated with FKBP1B. The function of FKBP1B has been established by previous studies. Arakawa et al. (1994) isolated a novel gene encoding a protein closely related to the human FK506-binding proteins from a human fetal brain cDNA library. The full-length cDNA encoded an open reading frame of 108 amino acids with 88% identity in predicted amino acid sequence to FKBP12 (OMIM Ref. No. 186945). The FKBP1L gene, designated OTK4 by the authors, also had sequence similarity with other FKBPs in species ranging from prokaryotes to human S, including FKPB13 (OMIM Ref. No. 186946), FKBP25 (OMIM Ref. No. 186947), and FKBP52 (OMIM Ref. No. 600611). Recombinant FKBP1L protein produced in E. coli showed peptidyl-prolyl cis-trans isomerase activity like that of other FKBPs. The authors also found an alternatively spliced transcript that contained a 45-bp insertion which included a stop codon. Both transcripts were ubiquitously expressed in several human tissues examined by RT-PCR. The International Radiation Hybrid Mapping Consortium mapped the FKBP1B gene to chromosome 2 (SHGC-31628). Animal model experiments lend further support to the function of FKBP1B. Xin et al. (2002) generated mice deficient in FKBP12.6 by targeted disruption. Male mutant mice had cardiac hypertrophy, but not females.

It is appreciated that the abovementioned animal model for FKBP1B is acknowledged by those skilled in the art as a scientifically valid animal model, as can be further appreciated from the publications sited hereinbelow.

Full details of the abovementioned studies are described in the following publications, the disclosure of which are hereby incorporated by reference:

Arakawa, H.; Nagase, H.; Hayashi, N.; Fujiwara, T.; Ogawa, M.; Shin, S.; Nakamura, Y.: Molecular cloning and expression of a novel human gene that is highly homologous to human FK506-binding protein 12 kDa (hFKBP-12) and characterization of two alternatively spliced transcripts. Biochem. Biophys. Res. Commun. 200: 836-843, 1994; and Xin, H.-B.; Senbonmatsu, T.; Cheng, D.-S.; Wang, Y.-X. Copello, J. A.; Ji, G.-J.; Collier, M. L.; Deng, K.-Y.; Jeyakumar, L. H.; Magnuson, M. A.; Inagami, T.; Kotlikoff, M. I.; Fleische.

Further studies establishing the function and utilities of FKBP1B are found in John Hopkins OMIM database record ID 600620, and in sited publications numbered 6560-6561 listed in the bibliography section hereinbelow, which are also hereby incorporated by reference. Homeo Box B6 (HOXB6, Accession XM_008560) is another VGAM1644 host target gene. HOXB6 BINDING SITE is HOST TARGET binding site found in the 3' untranslated region of mRNA encoded by HOXB6, corresponding to a HOST TARGET binding site such as BINDING SITE I, BINDING SITE II or BINDING SITE III. Table 2 illustrates the complementarity of the nucleotide sequences of HOXB6 BINDING SITE, designated SEQ ID:30088, to the nucleotide sequence of VGAM1644 RNA, herein designated VGAM RNA, also designated SEQ ID:4355.

Another function of VGAM1644 is therefore inhibition of Homeo Box B6 (HOXB6, Accession XM_008560), a gene which participates in establishing segmentation patterns and in determining segment identities. Accordingly, utilities of VGAM1644 include diagnosis, prevention and treatment of diseases and clinical conditions associated with HOXB6. The function of HOXB6 and its association with various diseases and clinical conditions, has been established by previous studies, as described hereinabove with reference to VGAM1355. Kinesin Family Member 5C (KIF5C, Accession NM_004522) is another VGAM1644 host target gene. KIF5C BINDING SITE is HOST TARGET binding site found in the 3' untranslated region of mRNA encoded by KIF5C, corresponding to a HOST TARGET binding site such as BINDING SITE I, BINDING SITE II or BINDING SITE III. Table 2 illustrates the complementarity of the nucleotide sequences of KIF5C BINDING SITE, designated SEQ ID:10858, to the nucleotide sequence of VGAM1644 RNA, herein designated VGAM RNA, also designated SEQ ID:4355.

Another function of VGAM1644 is therefore inhibition of Kinesin Family Member 5C (KIF5C, Accession NM_004522). Accordingly, utilities of VGAM1644 include diagnosis, prevention and treatment of diseases and clinical conditions associated with KIF5C. Leucine Zipper Transcription Factor-like 1 (LZTFL1, Accession NM_020347) is another VGAM1644 host target gene. LZTFL1 BINDING SITE is HOST TARGET binding site found in the 3' untranslated region of mRNA encoded by LZTFL1, corresponding to a HOST TARGET binding site such as BINDING SITE I, BINDING SITE II or BINDING SITE III. Table 2 illustrates the complementarity of the nucleotide sequences of LZTFL1 BINDING SITE, designated SEQ ID:21599, to the nucleotide sequence of VGAM1644 RNA, herein designated VGAM RNA, also designated SEQ ID:4355.

Another function of VGAM1644 is therefore inhibition of Leucine Zipper Transcription Factor-like 1 (LZTFL1, Accession NM_020347). Accordingly, utilities of VGAM1644 include diagnosis, prevention and treatment of diseases and clinical conditions associated with LZTFL1. Phosphatidylinositol Glycan, Class A (paroxysmal nocturnal hemoglobinuria) (PIGA, Accession NM_020472) is another VGAM1644 host target gene. PIGA BINDING SITE1 through PIGA BINDING SITE3 are HOST TARGET binding sites found in untranslated regions of mRNA encoded by PIGA, corresponding to HOST TARGET binding sites such as BINDING SITE I, BINDING SITE II or BINDING SITE III. Table 2 illustrates the complementarity of the nucleotide sequences of PIGA BINDING SITE1 through PIGA BINDING SITE3, designated SEQ ID:21713, SEQ ID:21720 and SEQ ID:8500 respectively, to the nucleotide sequence of VGAM1644 RNA, herein designated VGAM RNA, also designated SEQ ID:4355.

Another function of VGAM1644 is therefore inhibition of Phosphatidylinositol Glycan, Class A (paroxysmal nocturnal hemoglobinuria) (PIGA, Accession NM_020472). Accordingly, utilities of VGAM1644 include diagnosis, prevention and treatment of diseases and clinical conditions associated with PIGA. Syntaxin Binding Protein 1 (STXBP1, Accession NM_003165) is another VGAM1644 host target gene. STXBP1 BINDING SITE is HOST TARGET binding site found in the 3' untranslated region of mRNA encoded by STXBP1, corresponding to a HOST TARGET binding site such as BINDING SITE I, BINDING SITE II or BINDING SITE III. Table 2 illustrates the complementarity of the nucleotide sequences of STXBP1 BINDING SITE, designated SEQ ID:9143, to the nucleotide sequence of VGAM1644 RNA, herein designated VGAM RNA, also designated SEQ ID:4355.

Another function of VGAM1644 is therefore inhibition of Syntaxin Binding Protein 1 (STXBP1, Accession NM_003165), a gene which may play a role in determining the specificity of intracellular fusion reactions. Accordingly, utilities of VGAM1644 include diagnosis, prevention and treatment of diseases and clinical conditions associated with STXBP1. The function of STXBP1 and its association with various diseases and clinical conditions, has been established by previous studies, as described hereinabove with reference to VGAM708. Transcription Factor Binding to IGHM Enhancer 3 (TFE3, Accession NM_006521) is another VGAM1644 host target gene. TFE3 BINDING SITE is HOST TARGET binding site found in the 3' untranslated region of mRNA encoded by TFE3, corresponding to a HOST TARGET binding site such as BINDING SITE I, BINDING SITE II or BINDING SITE III. Table 2 illustrates the complementarity of the nucleotide sequences of TFE3 BINDING SITE, designated SEQ ID:13277, to the nucleotide sequence of VGAM1644 RNA, herein designated VGAM RNA, also designated SEQ ID:4355.

Another function of VGAM1644 is therefore inhibition of Transcription Factor Binding to IGHM Enhancer 3 (TFE3, Accession NM_006521), a gene which is a positive-acting transcription factor that binds to the immunoglobulin enchancer mue3 motif. Accordingly, utilities of VGAM1644 include diagnosis, prevention and treatment of diseases and clinical conditions associated with TFE3. The function of TFE3 and its association with various diseases and clinical conditions, has been established by previous studies, as described hereinabove with reference to VGAM443. Kell Blood Group Precursor (McLeod phenotype) (XK, Accession NM_021083) is another VGAM1644 host target gene. XK BINDING SITE is HOST TARGET binding site found in the 3' untranslated region of mRNA encoded by XK, corresponding to a HOST TARGET binding site such as BINDING SITE I, BINDING SITE II or BINDING SITE III. Table 2 illustrates the complementarity of the nucleotide sequences of XK BINDING SITE, designated SEQ ID:22058, to the nucleotide sequence of VGAM1644 RNA, herein designated VGAM RNA, also designated SEQ ID:4355.

Another function of VGAM1644 is therefore inhibition of Kell Blood Group Precursor (McLeod phenotype) (XK, Accession NM_021083). Accordingly, utilities of VGAM1644 include diagnosis, prevention and treatment of diseases and clinical conditions associated with XK. Apolipoprotein A-V (APOA5, Accession NM_052968) is another VGAM1644 host target gene. APOA5 BINDING SITE is HOST TARGET binding site found in the 3' untranslated region of mRNA encoded by APOA5, corresponding to a HOST TARGET binding site such as BINDING SITE I, BINDING SITE II or BINDING SITE III. Table 2 illustrates the complementarity of the nucleotide sequences of APOA5 BINDING SITE, designated SEQ ID:27539, to the nucleotide sequence of VGAM1644 RNA, herein designated VGAM RNA, also designated SEQ ID:4355.

Another function of VGAM1644 is therefore inhibition of Apolipoprotein A-V (APOA5, Accession NM_052968). Accordingly, utilities of VGAM1644 include diagnosis, prevention and treatment of diseases and clinical conditions associated with APOA5. BANP (Accession XM_038696) is another VGAM1644 host target gene. BANP BINDING SITE is HOST TARGET binding site found in the 5' untranslated region of mRNA encoded by BANP, corresponding to a HOST TARGET binding site such as BINDING SITE I, BINDING SITE II or BINDING SITE III. Table 2 illustrates the complementarity of the nucleotide sequences of BANP BINDING SITE, designated SEQ ID:32913, to the nucleotide sequence of VGAM1644 RNA, herein designated VGAM RNA, also designated SEQ ID:4355.

Another function of VGAM1644 is therefore inhibition of BANP (Accession XM_038696). Accordingly, utilities of VGAM1644 include diagnosis, prevention and treatment of diseases and clinical conditions associated with BANP. CD109 (Accession NM_133493) is another VGAM1644 host target gene. CD109 BINDING SITE is HOST TARGET binding site found in the 3' untranslated region of mRNA encoded by CD109, corresponding to a HOST TARGET binding site such as BINDING SITE I, BINDING SITE II or BINDING SITE III. Table 2 illustrates the complementarity of the nucleotide sequences of CD109 BINDING SITE, designated SEQ ID:28573, to the nucleotide sequence of VGAM1644 RNA, herein designated VGAM RNA, also designated SEQ ID:4355.

Another function of VGAM1644 is therefore inhibition of CD109 (Accession NM_133493). Accordingly, utilities of VGAM1644 include diagnosis, prevention and treatment of diseases and clinical conditions associated with CD109. Cleavage and Polyadenylation Specific Factor 2, 100 kDa (CPSF2, Accession XM_029311) is another VGAM1644 host target gene. CPSF2 BINDING SITE is HOST TARGET binding site found in the 3' untranslated region of mRNA encoded by CPSF2, corresponding to a HOST TARGET binding site such as BINDING SITE I, BINDING SITE II or BINDING SITE III. Table 2 illustrates the complementarity of the nucleotide sequences of CPSF2 BINDING SITE, designated SEQ ID:30866, to the nucleotide sequence of VGAM1644 RNA, herein designated VGAM RNA, also designated SEQ ID:4355.

Another function of VGAM1644 is therefore inhibition of Cleavage and Polyadenylation Specific Factor 2, 100 kDa (CPSF2, Accession XM_029311). Accordingly, utilities of VGAM1644 include diagnosis, prevention and treatment of diseases and clinical conditions associated with CPSF2. FLJ12057 (Accession NM_024768) is another VGAM1644 host target gene. FLJ12057 BINDING SITE is HOST TARGET binding site found in the 3' untranslated region of mRNA encoded by FLJ12057, corresponding to a HOST TARGET binding site such as BINDING SITE I, BINDING SITE II or BINDING SITE III. Table 2 illustrates the complementarity of the nucleotide sequences of FLJ12057 BINDING SITE, designated SEQ ID:24126, to the nucleotide sequence of VGAM1644 RNA, herein designated VGAM RNA, also designated SEQ ID:4355.

Another function of VGAM1644 is therefore inhibition of FLJ12057 (Accession NM_024768). Accordingly, utilities of VGAM1644 include diagnosis, prevention and treatment of diseases and clinical conditions associated with FLJ12057. FLJ20203 (Accession NM_017710) is another VGAM1644 host target gene. FLJ20203 BINDING SITE is HOST TARGET binding site found in the 3' untranslated region of mRNA encoded by FLJ20203, corresponding to a HOST TARGET binding site such as BINDING SITE I, BINDING SITE II or BINDING SITE III. Table 2 illustrates the complementarity of the nucleotide sequences of FLJ20203 BINDING SITE, designated SEQ ID:19291, to the nucleotide sequence of VGAM1644 RNA, herein designated VGAM RNA, also designated SEQ ID:4355.

Another function of VGAM1644 is therefore inhibition of FLJ20203 (Accession NM_017710). Accordingly, utilities of VGAM1644 include diagnosis, prevention and treatment of diseases and clinical conditions associated with FLJ20203. FLJ20508 (Accession NM_017850) is another VGAM1644 host target gene. FLJ20508 BINDING SITE is HOST TARGET binding site found in the 3' untranslated region of mRNA encoded by FLJ20508, corresponding to a HOST TARGET binding site such as BINDING SITE I, BINDING SITE II or BINDING SITE III. Table 2 illustrates the complementarity of the nucleotide sequences of FLJ20508 BINDING SITE, designated SEQ ID:19518, to the nucleotide sequence of VGAM1644 RNA, herein designated VGAM RNA, also designated SEQ ID:4355.

Another function of VGAM1644 is therefore inhibition of FLJ20508 (Accession NM_017850). Accordingly, utilities of VGAM1644 include diagnosis, prevention and treatment of diseases and clinical conditions associated with FLJ20508. FLJ21140 (Accession NM_024776) is another VGAM1644 host target gene. FLJ21140 BINDING SITE is HOST TARGET binding site found in the 3' untranslated region of mRNA encoded by FLJ21140, corresponding to a HOST TARGET binding site such as BINDING SITE I, BINDING SITE II or BINDING SITE III. Table 2 illustrates the complementarity of the nucleotide sequences of FLJ21140 BINDING SITE, designated SEQ ID:24142, to the nucleotide sequence of VGAM1644 RNA, herein designated VGAM RNA, also designated SEQ ID:4355.

Another function of VGAM1644 is therefore inhibition of FLJ21140 (Accession NM_024776). Accordingly, utilities of VGAM1644 include diagnosis, prevention and treatment of diseases and clinical conditions associated with FLJ21140. FLJ21459 (Accession NM_024521) is another VGAM1644 host target gene. FLJ21459 BINDING SITE is HOST TARGET binding site found in the 3' untranslated region of mRNA encoded by FLJ21459, corresponding to a HOST TARGET binding site such as BINDING SITE I, BINDING SITE II or BINDING SITE III. Table 2 illustrates the complementarity of the nucleotide sequences of FLJ21459 BINDING SITE, designated SEQ ID:23719, to the nucleotide sequence of VGAM1644 RNA, herein designated VGAM RNA, also designated SEQ ID:4355.

Another function of VGAM1644 is therefore inhibition of FLJ21459 (Accession NM_024521). Accordingly, utilities of VGAM1644 include diagnosis, prevention and treatment of diseases and clinical conditions associated with FLJ21459. Gamma-aminobutyric Acid (GABA) B Receptor, 1 (GABBR1, Accession NM_001470) is another VGAM1644 host target gene. GABBR1 BINDING SITE1 and GABBR1 BINDING SITE2 are HOST TARGET binding sites found in untranslated regions of mRNA encoded by GABBR1, corresponding to HOST TARGET binding sites such as BINDING SITE I, BINDING SITE II or BINDING SITE III. Table 2 illustrates the complementarity of the nucleotide sequences of GABBR1 BINDING SITE1 and GABBR1 BINDING SITE2, designated SEQ ID:7206 and SEQ ID:22423 respectively, to the nucleotide sequence of VGAM1644 RNA, herein designated VGAM RNA, also designated SEQ ID:4355.

Another function of VGAM1644 is therefore inhibition of Gamma-aminobutyric Acid (GABA) B Receptor, 1 (GABBR1, Accession NM_001470). Accordingly, utilities of VGAM1644 include diagnosis, prevention and treatment of diseases and clinical conditions associated with GABBR1. KIAA1023 (Accession NM_017604) is another VGAM1644 host target gene. KIAA1023 BINDING SITE is HOST TARGET binding site found in the 3' untranslated region of mRNA encoded by KIAA1023, corresponding to a HOST TARGET binding site such as BINDING SITE I, BINDING SITE II or BINDING SITE III. Table 2 illustrates the complementarity of the nucleotide sequences of KIAA1023 BINDING SITE, designated SEQ ID:19093, to the nucleotide sequence of VGAM1644 RNA, herein designated VGAM RNA, also designated SEQ ID:4355.

Another function of VGAM1644 is therefore inhibition of KIAA1023 (Accession NM_017604). Accordingly, utilities of VGAM1644 include diagnosis, prevention and treatment of diseases and clinical conditions associated with KIAA1023. KIAA1317 (Accession XM_098368) is another VGAM1644 host target gene. KIAA1317 BINDING SITE is HOST TARGET binding site found in the 5' untranslated region of mRNA encoded by KIAA1317, corresponding to a HOST TARGET binding site such as BINDING SITE I, BINDING SITE II or BINDING SITE III. Table 2 illustrates the complementarity of the nucleotide sequences of KIAA1317 BINDING SITE, designated SEQ ID:41632, to the nucleotide sequence of VGAM1644 RNA, herein designated VGAM RNA, also designated SEQ ID:4355.

Another function of VGAM1644 is therefore inhibition of KIAA1317 (Accession XM_098368). Accordingly, utilities of VGAM1644 include diagnosis, prevention and treatment of diseases and clinical conditions associated with KIAA1317. KIAA1617 (Accession XM_166140) is another VGAM1644 host target gene. KIAA1617 BINDING SITE is HOST TARGET binding site found in the 3' untranslated region of mRNA encoded by KIAA1617, corresponding to a HOST TARGET binding site such as BINDING SITE I, BINDING SITE II or BINDING SITE III. Table 2 illustrates the complementarity of the nucleotide sequences of KIAA1617 BINDING SITE, designated SEQ ID:43942, to the nucleotide sequence of VGAM1644 RNA, herein designated VGAM RNA, also designated SEQ ID:4355.

Another function of VGAM1644 is therefore inhibition of KIAA1617 (Accession XM_166140). Accordingly, utilities of VGAM1644 include diagnosis, prevention and treatment of diseases and clinical conditions associated with KIAA1617. MGC10966 (Accession NM_031471) is another VGAM1644 host target gene. MGC10966 BINDING SITE is HOST TARGET binding site found in the 5' untranslated region of mRNA encoded by MGC10966, corresponding to a HOST TARGET binding site such as BINDING SITE I, BINDING SITE II or BINDING SITE III. Table 2 illustrates the complementarity of the nucleotide sequences of MGC10966 BINDING SITE, designated SEQ ID:25538, to the nucleotide sequence of VGAM1644 RNA, herein designated VGAM RNA, also designated SEQ ID:4355.

Another function of VGAM1644 is therefore inhibition of MGC10966 (Accession NM_031471). Accordingly, utilities of VGAM1644 include diagnosis, prevention and treatment of diseases and clinical conditions associated with MGC10966. Nuclear Receptor Subfamily 6, Group A, Member 1 (NR6A1, Accession NM_033335) is another VGAM1644 host target gene. NR6A1 BINDING SITE1 through NR6A1 BINDING SITE3 are HOST TARGET binding sites found in untranslated regions of mRNA encoded by NR6A1, corresponding to HOST TARGET binding sites such as BINDING SITE I, BINDING SITE II or BINDING SITE III. Table 2 illustrates the complementarity of the nucleotide sequences of NR6A1 BINDING SITE1 through NR6A1 BINDING SITE3, designated SEQ ID:27189, SEQ ID:27183 and SEQ ID:7235 respectively, to the nucleotide sequence of VGAM1644 RNA, herein designated VGAM RNA, also designated SEQ ID:4355.

Another function of VGAM1644 is therefore inhibition of Nuclear Receptor Subfamily 6, Group A, Member 1 (NR6A1, Accession NM_033335). Accordingly, utilities of VGAM1644 include diagnosis, prevention and treatment of diseases and clinical conditions associated with NR6A1. PME-1 (Accession NM_016147) is another VGAM1644 host target gene. PME-1 BINDING SITE is HOST TARGET binding site found in the 3' untranslated region of mRNA encoded by PME-1, corresponding to a HOST TARGET binding site such as BINDING SITE I, BINDING SITE II or BINDING SITE III. Table 2 illustrates the complementarity of the nucleotide sequences of PME-1 BINDING SITE, designated SEQ ID:18231, to the nucleotide sequence of VGAM1644 RNA, herein designated VGAM RNA, also designated SEQ ID:4355.

Another function of VGAM1644 is therefore inhibition of PME-1 (Accession NM_016147). Accordingly, utilities of VGAM1644 include diagnosis, prevention and treatment of diseases and clinical conditions associated with PME-1. Solute Carrier Family 38, Member 4 (SLC38A4, Accession NM_018018) is another VGAM1644 host target gene. SLC38A4 BINDING SITE is HOST TARGET binding site found in the 3' untranslated region of mRNA encoded by SLC38A4, corresponding to a HOST TARGET binding site such as BINDING SITE I, BINDING SITE II or BINDING SITE III. Table 2 illustrates the complementarity of the nucleotide sequences of SLC38A4 BINDING SITE, designated SEQ ID:19759, to the nucleotide sequence of VGAM1644 RNA, herein designated VGAM RNA, also designated SEQ ID:4355.

Another function of VGAM1644 is therefore inhibition of Solute Carrier Family 38, Member 4 (SLC38A4, Accession NM_018018). Accordingly, utilities of VGAM1644 include diagnosis, prevention and treatment of diseases and clinical conditions associated with SLC38A4. LOC145739 (Accession XM_085222) is another VGAM1644 host target gene. LOC145739 BINDING SITE is HOST TARGET binding site found in the 3' untranslated region of mRNA encoded by LOC145739, corresponding to a HOST TARGET binding site such as BINDING SITE I, BINDING SITE II or BINDING SITE III. Table 2 illustrates the complementarity of the nucleotide sequences of LOC145739 BINDING SITE, designated SEQ ID:37961, to the nucleotide sequence of VGAM1644 RNA, herein designated VGAM RNA, also designated SEQ ID:4355.

Another function of VGAM1644 is therefore inhibition of LOC145739 (Accession XM_085222). Accordingly, utilities of VGAM1644 include diagnosis, prevention and treatment of diseases and clinical conditions associated with LOC145739. LOC147180 (Accession XM_097207) is another VGAM1644 host target gene. LOC147180 BINDING SITE is HOST TARGET binding site found in the 5' untranslated region of mRNA encoded by LOC147180, corresponding to a HOST TARGET binding site such as BINDING SITE I, BINDING SITE II or BINDING SITE III. Table 2 illustrates the complementarity of the nucleotide sequences of LOC147180 BINDING SITE, designated SEQ ID:40818, to the nucleotide sequence of VGAM1644 RNA, herein designated VGAM RNA, also designated SEQ ID:4355.

Another function of VGAM1644 is therefore inhibition of LOC147180 (Accession XM_097207). Accordingly, utilities of VGAM1644 include diagnosis, prevention and treatment of diseases and clinical conditions associated with LOC147180. LOC148293 (Accession XM_086138) is another VGAM1644 host target gene. LOC148293 BINDING SITE is HOST TARGET binding site found in the 5' untranslated region of mRNA encoded by LOC148293, corresponding to a HOST TARGET binding site such as BINDING SITE I, BINDING SITE II or BINDING SITE III. Table 2 illustrates the complementarity of the nucleotide sequences of LOC148293 BINDING SITE, designated SEQ ID:38519, to the nucleotide sequence of VGAM1644 RNA, herein designated VGAM RNA, also designated SEQ ID:4355.

Another function of VGAM1644 is therefore inhibition of LOC148293 (Accession XM_086138). Accordingly, utilities of VGAM1644 include diagnosis, prevention and treatment of diseases and clinical conditions associated with LOC148293. LOC149535 (Accession XM_086567) is another VGAM1644 host target gene. LOC149535 BINDING SITE is HOST TARGET binding site found in the 3' untranslated region of mRNA encoded by LOC149535, corresponding to a HOST TARGET binding site such as BINDING SITE I, BINDING SITE II or BINDING SITE III. Table 2 illustrates the complementarity of the nucleotide sequences of LOC149535 BINDING SITE, designated SEQ ID:38772, to the nucleotide sequence of VGAM1644 RNA, herein designated VGAM RNA, also designated SEQ ID:4355.

Another function of VGAM1644 is therefore inhibition of LOC149535 (Accession XM_086567). Accordingly, utilities of VGAM1644 include diagnosis, prevention and treatment of diseases and clinical conditions associated with LOC149535. LOC150343 (Accession XM_086823) is another VGAM1644 host target gene. LOC150343 BINDING SITE is HOST TARGET binding site found in the 5' untranslated region of mRNA encoded by LOC150343, corresponding to a HOST TARGET binding site such as BINDING SITE I, BINDING SITE II or BINDING SITE III. Table 2 illustrates the complementarity of the nucleotide sequences of LOC150343 BINDING SITE, designated SEQ ID:38903, to the nucleotide sequence of VGAM1644 RNA, herein designated VGAM RNA, also designated SEQ ID:4355.

Another function of VGAM1644 is therefore inhibition of LOC150343 (Accession XM_086823). Accordingly, utilities of VGAM1644 include diagnosis, prevention and treatment of diseases and clinical conditions associated with LOC150343. LOC152048 (Accession XM_098158) is another VGAM1644 host target gene. LOC152048 BINDING SITE is HOST TARGET binding site found in the 3' untranslated region of mRNA encoded by LOC152048, corresponding to a HOST TARGET binding site such as BINDING SITE I, BINDING SITE II or BINDING SITE III. Table 2 illustrates the complementarity of the nucleotide sequences of LOC152048 BINDING SITE, designated SEQ ID:41426, to the nucleotide sequence of VGAM1644 RNA, herein designated VGAM RNA, also designated SEQ ID:4355.

Another function of VGAM1644 is therefore inhibition of LOC152048 (Accession XM_098158). Accordingly, utilities of VGAM1644 include diagnosis, prevention and treatment of diseases and clinical conditions associated with LOC152048. LOC155179 (Accession XM_088169) is another VGAM1644 host target gene. LOC155179 BINDING SITE is HOST TARGET binding site found in the 3' untranslated region of mRNA encoded by LOC155179, corresponding to a HOST TARGET binding site such as BINDING SITE I, BINDING SITE II or BINDING SITE III. Table 2 illustrates the complementarity of the nucleotide sequences of LOC155179 BINDING SITE, designated SEQ ID:39559, to the nucleotide sequence of VGAM1644 RNA, herein designated VGAM RNA, also designated SEQ ID:4355.

Another function of VGAM1644 is therefore inhibition of LOC155179 (Accession XM_088169). Accordingly, utilities of VGAM1644 include diagnosis, prevention and treatment of diseases and clinical conditions associated with LOC155179. LOC221466 (Accession XM_168087) is another VGAM1644 host target gene. LOC221466 BINDING SITE is HOST TARGET binding site found in the 3' untranslated region of mRNA encoded by LOC221466, corresponding to a HOST TARGET binding site such as BINDING SITE I, BINDING SITE II or BINDING SITE III. Table 2 illustrates the complementarity of the nucleotide sequences of LOC221466 BINDING SITE, designated SEQ ID:44994, to the nucleotide sequence of VGAM1644 RNA, herein designated VGAM RNA, also designated SEQ ID:4355.

Another function of VGAM1644 is therefore inhibition of LOC221466 (Accession XM_168087). Accordingly, utilities of VGAM1644 include diagnosis, prevention and treatment of diseases and clinical conditions associated with LOC221466. LOC255779 (Accession XM_171147) is another VGAM1644 host target gene. LOC255779 BINDING SITE is HOST TARGET binding site found in the 3' untranslated region of mRNA encoded by LOC255779, corresponding to a HOST TARGET binding site such as BINDING SITE I, BINDING SITE II or BINDING SITE III. Table 2 illustrates the complementarity of the nucleotide sequences of LOC255779 BINDING SITE, designated SEQ ID:45943, to the nucleotide sequence of VGAM1644 RNA, herein designated VGAM RNA, also designated SEQ ID:4355.

Another function of VGAM1644 is therefore inhibition of LOC255779 (Accession XM_171147). Accordingly, utilities of VGAM1644 include diagnosis, prevention and treatment of diseases and clinical conditions associated with LOC255779. LOC90049 (Accession XM_028387) is another VGAM1644 host target gene. LOC90049 BINDING SITE is HOST TARGET binding site found in the 3' untranslated region of mRNA encoded by LOC90049, corresponding to a HOST TARGET binding site such as BINDING SITE I, BINDING SITE II or BINDING SITE III. Table 2 illustrates the complementarity of the nucleotide sequences of LOC90049 BINDING SITE, designated SEQ ID:30698, to the nucleotide sequence of VGAM1644 RNA, herein designated VGAM RNA, also designated SEQ ID:4355.

Another function of VGAM1644 is therefore inhibition of LOC90049 (Accession XM_028387). Accordingly, utilities of VGAM1644 include diagnosis, prevention and treatment of diseases and clinical conditions associated with LOC90049. LOC91252 (Accession XM_037173) is another VGAM1644 host target gene. LOC91252 BINDING SITE is HOST TARGET binding site found in the 3' untranslated region of mRNA encoded by LOC91252, corresponding to a HOST TARGET binding site such as BINDING SITE I, BINDING SITE II or BINDING SITE III. Table 2 illustrates the complementarity of the nucleotide sequences of LOC91252 BINDING SITE, designated SEQ ID:32553, to the nucleotide sequence of VGAM1644 RNA, herein designated VGAM RNA, also designated SEQ ID:4355.

Another function of VGAM1644 is therefore inhibition of LOC91252 (Accession XM_037173). Accordingly, utilities of VGAM1644 include diagnosis, prevention and treatment of diseases and clinical conditions associated with LOC91252. FIG. 1 further provides a conceptual description of a novel bioinformatically detected viral gene of the present invention, referred to here as Viral Genomic Address Messenger 1645 (VGAM1645) viral gene, which modulates expression of respective host target genes thereof, the function and utility of which host target genes is known in the art.

VGAM1645 is a novel bioinformatically detected regulatory, non protein coding, viral micro RNA (miRNA) gene. The method by which VGAM1645 was detected is described hereinabove with reference to FIGS. 1-8.

VGAM1645 gene, herein designated VGAM GENE, is a viral gene contained in the genome of Dengue Virus. VGAM1645 host target gene, herein designated VGAM HOST TARGET GENE, is a human gene contained in the human genome.

VGAM1645 gene encodes a VGAM1645 precursor RNA, herein designated VGAM PRECURSOR RNA. Similar to other miRNA genes, and unlike most ordinary genes, VGAM1645 precursor RNA does not encode a protein. A nucleotide sequence identical or highly similar to the nucleotide sequence of VGAM1645 precursor RNA is designated SEQ ID:1631, and is provided hereinbelow with reference to the sequence listing part. Nucleotide sequence SEQ ID:1631 is located at position 5184 relative to the genome of Dengue Virus.

VGAM1645 precursor RNA folds onto itself, forming VGAM1645 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1645 folded precursor RNA into VGAM1645 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1645 RNA is designated SEQ ID:4356, and is provided hereinbelow with reference to the sequence listing part.

VGAM1645 host target gene, herein designated VGAM HOST TARGET GENE, encodes a corresponding messenger RNA, VGAM1645 host target RNA, herein designated VGAM HOST TARGET RNA. VGAM1645 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1645 RNA, herein designated VGAM RNA, binds complementarily to one or more host target binding sites located in untranslated regions of VGAM1645 host target RNA, herein designated VGAM HOST TARGET RNA. This complementary binding is due to the fact that the nucleotide sequence of VGAM1645 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1645 RNA, herein designated VGAM RNA, may have a different number of host target binding sites in untranslated regions of a VGAM1645 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1645 RNA, herein designated VGAM RNA, to host target binding sites on VGAM1645 host target RNA, herein designated VGAM HOST TARGET RNA, such as BINDING SITE I, BINDING SITE II and BINDING SITE III, inhibits translation of VGAM1645 host target RNA into VGAM1645 host target protein, herein designated VGAM HOST TARGET PROTEIN. VGAM host target protein is therefore outlined by a broken line.

It is appreciated that VGAM1645 host target gene, herein designated VGAM HOST TARGET GENE, in fact represents a plurality of VGAM1645 host target genes. The mRNA of each one of this plurality of VGAM1645 host target genes comprises one or more host target binding sites, each having a nucleotide sequence which is at least partly complementary to VGAM1645 RNA, herein designated VGAM RNA, and which when bound by VGAM1645 RNA causes inhibition of translation of respective one or more VGAM1645 host target proteins.

It is further appreciated by one skilled in the art that the mode of translational inhibition illustrated by FIG. 1 with specific reference to translational inhibition exerted by VGAM1645 gene, herein designated VGAM GENE, on one or more VGAM1645 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1645 is inhibition of expression of host target genes, as part of a novel viral mechanism of attacking a host. Accordingly, utilities of VGAM1645 include diagnosis, prevention and treatment of viral infection by Dengue Virus. Specific functions, and accordingly utilities, of VGAM1645 correlate with, and may be deduced from, the identity of the host target genes which VGAM1645 binds and inhibits, and the function of these host target genes, as elaborated hereinbelow.

Nucleotide sequences of the VGAM1645 precursor RNA, herein designated VGAM PRECURSOR RNA, and of the 'diced' VGAM1645 RNA, herein designated VGAM RNA, and a schematic representation of the secondary folding of VGAM1645 folded precursor RNA, herein designated VGAM FOLDED PRECURSOR RNA, of VGAM1645 are further described hereinbelow with reference to Table 1.

Nucleotide sequences of host target binding sites, such as BINDING SITE-I, BINDING SITE-II and BINDING SITE-III of FIG. 1, found on VGAM1645 host target RNA, and schematic representation of the complementarity of each of these host target binding sites to VGAM1645 RNA, herein designated VGAM RNA, are described hereinbelow with reference to Table 2.

As mentioned hereinabove with reference to FIG. 1, a function of VGAM1645 gene, herein designated VGAM is inhibition of expression of VGAM1645 target genes. It is appreciated that specific functions, and accordingly utilities, of VGAM1645 correlate with, and may be deduced from, the identity of the target genes which VGAM1645 binds and inhibits, and the function of these target genes, as elaborated hereinbelow.

Collagen, Type IV, Alpha 1 (COL4A1, Accession NM_001845) is a VGAM1645 host target gene. COL4A1 BINDING SITE is HOST TARGET binding site found in the 3' untranslated region of mRNA encoded by COL4A1, corresponding to a HOST TARGET binding site such as BINDING SITE I, BINDING SITE II or BINDING SITE III. Table 2 illustrates the complementarity of the nucleotide sequences of COL4A1 BINDING SITE, designated SEQ ID:7578, to the nucleotide sequence of VGAM1645 RNA, herein designated VGAM RNA, also designated SEQ ID:4356.

A function of VGAM1645 is therefore inhibition of Collagen, Type IV, Alpha 1 (COL4A1, Accession NM_001845), a gene which is a member of a subfamily of collagen extracellular matrix proteins. Accordingly, utilities of VGAM1645 include diagnosis, prevention and treatment of diseases and clinical conditions associated with COL4A1. The function of COL4A1 has been established by previous studies. Types I, II, and III collagen, the so-called interstitial collagens, are in many ways distinct from basement membrane collagen. Type IV collagen does not form ordered fibrillar structures; rather, a meshwork is formed by 4 molecules held together at the ends. Both disulfide and typical lysyl-derived collagen crosslinks are involved (Kuhn, 1982). Crouch et al. (1980) presented evidence that type IV procollagen contains 2 distinct chains. The collagen IV molecule is a heterotrimer of 2 alpha-1 chains and 1 alpha-2 chain (Mayne et al., 1984). There are presumably 2 gene loci responsible for the alpha-1 and alpha-2 chains of type IV collagen. Using a cloned gene as a probe on Southern blots of DNA from a panel of interspecies somatic cell hybrids, Solomon et al. (1985) assigned one of the collagen IV genes, COL4A1, to chromosome 13. Pihlajaniemi et al. (1985) used dual-laser sorted chromosomes and spot-blot analysis to assign genomic DNA sequences coding for COL4A1 to chromosome 13. By in situ hybridization, Boyd et al. (1986) localized the gene to the end of the long arm of chromosome 13. Southern and spot-blot hybridization showed that these genomic sequences were present only once per haploid genome. Emanuel et al. (1986) assigned COL4A1 to the telomeric region of 13q (13q34) by in situ hybridization. Bowcock et al. (1987) found that the COL4A1 locus is linked to D13S3, which in turn has been assigned to 13q33-q34 by in situ hybridization. They found a maximum lod score of 16.5 at theta=0.01. Griffin et al. (1987) showed by in situ hybridization and Southern blot analysis of DNA from somatic cell hybrids that the COL4A2 gene is also on the distal long arm of chromosome 13, apparently closely linked to the alpha-1(IV) gene. By means of pulsed-field gel electrophoresis (PFGE) and infrequently cutting restriction enzymes, Cutting et al. (1987) showed that the COL4A1 and COL4A2 genes are separated by no more than 400 kb. Using RFLPs identified within the two genes, Hebert et al. (1987) also showed that COL4A1 and COL4A2 are closely linked. Bowcock et al. (1988) found that the COL4A1 and COL4A2 genes are linked, with a maximum likelihood estimate of recombination of 0.028 at a lod score of 19.98. This and the lack of linkage disequilibrium are inconsistent with relatively high recombination between the 2 loci--higher than expected for 2 genes that lie within 650 kb of each other. Koizumi et al. (1995) used interspecific and intersubspecific mapping panels to locate the Col4a1 gene to the centromeric region of mouse chromosome 8. COL4A2 (OMIM Ref. No. 120090) and coagulation factor X (F10; 227600) mapped to the same region, thus defining a new region of homology of synteny between mouse chromosome 8 and human chromosome 13 Goodpasture syndrome (glomerulonephritis and pulmonary hemorrhage). Butkowski et al. (1987) localized the Goodpasture epitope to a novel chain of type IV collagen composed of 3 distinctive subunits--M1, M2*, and M3. The Goodpasture epitope was found to be situated exclusively on M2*. Turner et al. (1992) demonstrated that the Goodpasture antigen is the alpha-3 chain of type IV collagen (COL4A3; 120070

Full details of the abovementioned studies are described in the following publications, the disclosure of which are hereby incorporated by reference:

Pihlajaniemi, T.; Tryggvason, K.; Myers, J. C.; Kurkinen, M.; Lebo, R.; Cheung, M.-C.; Prockop, D. J.; Boyd, C. D.: cDNA clones coding for the pro-alpha-1(IV) chain of human type IV procollagen reveal an unusual homology of amino acid sequences in two halves of the carboxyl terminal domain. J. Biol. Chem. 260:7681-7687, 1985; and Turner, N.; Mason, P. J.; Brown, R.; Fox, M.; Povey, S.; Rees, A.; Pusey, C. D.: Molecular cloning of the human Goodpasture antigen demonstrates it to be the alpha-3 chain of type IV c.

Further studies establishing the function and utilities of COL4A1 are found in John Hopkins OMIM database record ID 120130, and in sited publications numbered 266-270, 346-274, 4586, 3621-282, 383, 40 and 8951-406 listed in the bibliography section hereinbelow, which are also hereby incorporated by reference. Follistatin-like 1 (FSTL1, Accession NM_007085) is another VGAM1645 host target gene. FSTL1 BINDING SITE is HOST TARGET binding site found in the 3' untranslated region of mRNA encoded by FSTL1, corresponding to a HOST TARGET binding site such as BINDING SITE I, BINDING SITE II or BINDING SITE III. Table 2 illustrates the complementarity of the nucleotide sequences of FSTL1 BINDING SITE, designated SEQ ID:13947, to the nucleotide sequence of VGAM1645 RNA, herein designated VGAM RNA, also designated SEQ ID:4356.

Another function of VGAM1645 is therefore inhibition of Follistatin-like 1 (FSTL1, Accession NM_007085), a gene which may modulate the action of some growth factors on cell proliferation and differentiation. Accordingly, utilities of VGAM1645 include diagnosis, prevention and treatment of diseases and clinical conditions associated with FSTL1. The function of FSTL1 and its association with various diseases and clinical conditions, has been established by previous studies, as described hereinabove with reference to VGAM791. Membrane Component, Chromosome 11, Surface Marker 1 (M11S1, Accession NM_005898) is another VGAM1645 host target gene. M11S1 BINDING SITE is HOST TARGET binding site found in the 3' untranslated region of mRNA encoded by M11S1, corresponding to a HOST TARGET binding site such as BINDING SITE I, BINDING SITE II or BINDING SITE III. Table 2 illustrates the complementarity of the nucleotide sequences of M11S1 BINDING SITE, designated SEQ ID:12518, to the nucleotide sequence of VGAM1645 RNA, herein designated VGAM RNA, also designated SEQ ID:4356.

Another function of VGAM1645 is therefore inhibition of Membrane Component, Chromosome 11, Surface Marker 1 (M11S1, Accession NM_005898), a gene which may play a role in transporting nutrients from the gut lumen across the gutlining epithelial cell layer. Accordingly, utilities of VGAM1645 include diagnosis, prevention and treatment of diseases and clinical conditions associated with M11S1. The function of M11S1 and its association with various diseases and clinical conditions, has been established by previous studies, as described hereinabove with reference to VGAM131. Zinc Finger Protein 124 (HZF-16) (ZNF124, Accession NM_003431) is another VGAM1645 host target gene. ZNF124 BINDING SITE is HOST TARGET binding site found in the 5' untranslated region of mRNA encoded by ZNF124, corresponding to a HOST TARGET binding site such as BINDING SITE I, BINDING SITE II or BINDING SITE III. Table 2 illustrates the complementarity of the nucleotide sequences of ZNF124 BINDING SITE, designated SEQ ID:9481, to the nucleotide sequence of VGAM1645 RNA, herein designated VGAM RNA, also designated SEQ ID:4356.

Another function of VGAM1645 is therefore inhibition of Zinc Finger Protein 124 (HZF-16) (ZNF124, Accession NM_003431). Accordingly, utilities of VGAM1645 include diagnosis, prevention and treatment of diseases and clinical conditions associated with ZNF124. DKFZP434O047 (Accession NM_015594) is another VGAM1645 host target gene. DKFZP434O047 BINDING SITE is HOST TARGET binding site found in the 5' untranslated region of mRNA encoded by DKFZP434O047, corresponding to a HOST TARGET binding site such as BINDING SITE I, BINDING SITE II or BINDING SITE III. Table 2 illustrates the complementarity of the nucleotide sequences of DKFZP434O047 BINDING SITE, designated SEQ ID:17865, to the nucleotide sequence of VGAM1645 RNA, herein designated VGAM RNA, also designated SEQ ID:4356.

Another function of VGAM1645 is therefore inhibition of DKFZP434O047 (Accession NM_015594). Accordingly, utilities of VGAM1645 include diagnosis, prevention and treatment of diseases and clinical conditions associated with DKFZP434O047. FXYD Domain Containing Ion Transport Regulator 3 (FXYD3, Accession NM_021910) is another VGAM1645 host target gene. FXYD3 BINDING SITE1 and FXYD3 BINDING SITE2 are HOST TARGET binding sites found in untranslated regions of mRNA encoded by FXYD3, corresponding to HOST TARGET binding sites such as BINDING SITE I, BINDING SITE II or BINDING SITE III. Table 2 illustrates the complementarity of the nucleotide sequences of FXYD3 BINDING SITE1 and FXYD3 BINDING SITE2, designated SEQ ID:22435 and SEQ ID:12592 respectively, to the nucleotide sequence of VGAM1645 RNA, herein designated VGAM RNA, also designated SEQ ID:4356.

Another function of VGAM1645 is therefore inhibition of FXYD Domain Containing Ion Transport Regulator 3 (FXYD3, Accession NM_021910). Accordingly, utilities of VGAM1645 include diagnosis, prevention and treatment of diseases and clinical conditions associated with FXYD3. RNA Binding Motif Protein 11 (RBM11, Accession NM_144770) is another VGAM1645 host target gene. RBM11 BINDING SITE is HOST TARGET binding site found in the 3' untranslated region of mRNA encoded by RBM11, corresponding to a HOST TARGET binding site such as BINDING SITE I, BINDING SITE II or BINDING SITE III. Table 2 illustrates the complementarity of the nucleotide sequences of RBM11 BINDING SITE, designated SEQ ID:29560, to the nucleotide sequence of VGAM1645 RNA, herein designated VGAM RNA, also designated SEQ ID:4356.

Another function of VGAM1645 is therefore inhibition of RNA Binding Motif Protein 11 (RBM11, Accession NM_144770). Accordingly, utilities of VGAM1645 include diagnosis, prevention and treatment of diseases and clinical conditions associated with RBM11. LOC203292 (Accession XM_117527) is another VGAM1645 host target gene. LOC203292 BINDING SITE is HOST TARGET binding site found in the 5' untranslated region of mRNA encoded by LOC203292, corresponding to a HOST TARGET binding site such as BINDING SITE I, BINDING SITE II or BINDING SITE III. Table 2 illustrates the complementarity of the nucleotide sequences of LOC203292 BINDING SITE, designated SEQ ID:43500, to the nucleotide sequence of VGAM1645 RNA, herein designated VGAM RNA, also designated SEQ ID:4356.

Another function of VGAM1645 is therefore inhibition of LOC203292 (Accession XM_117527). Accordingly, utilities of VGAM1645 include diagnosis, prevention and treatment of diseases and clinical conditions associated with LOC203292. FIG. 1 further provides a conceptual description of a novel bioinformatically detected viral gene of the present invention, referred to here as Viral Genomic Address Messenger 1646 (VGAM1646) viral gene, which modulates expression of respective host target genes thereof, the function and utility of which host target genes is known in the art.

VGAM1646 is a novel bioinformatically detected regulatory, non protein coding, viral micro RNA (miRNA) gene. The method by which VGAM1646 was detected is described hereinabove with reference to FIGS. 1-8.

VGAM1646 gene, herein designated VGAM GENE, is a viral gene contained in the genome of Dengue Virus. VGAM1646 host target gene, herein designated VGAM HOST TARGET GENE, is a human gene contained in the human genome.

VGAM1646 gene encodes a VGAM1646 precursor RNA, herein designated VGAM PRECURSOR RNA. Similar to other miRNA genes, and unlike most ordinary genes, VGAM1646 precursor RNA does not encode a protein. A nucleotide sequence identical or highly similar to the nucleotide sequence of VGAM1646 precursor RNA is designated SEQ ID:1632, and is provided hereinbelow with reference to the sequence listing part. Nucleotide sequence SEQ ID:1632 is located at position 9914 relative to the genome of Dengue Virus.

VGAM1646 precursor RNA folds onto itself, forming VGAM1646 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1646 folded precursor RNA into VGAM1646 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM1646 RNA is designated SEQ ID:4357, and is provided hereinbelow with reference to the sequence listing part.

VGAM1646 host target gene, herein designated VGAM HOST TARGET GENE, encodes a corresponding messenger RNA, VGAM1646 host target RNA, herein designated VGAM HOST TARGET RNA. VGAM1646 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1646 RNA, herein designated VGAM RNA, binds complementarily to one or more host target binding sites located in untranslated regions of VGAM1646 host target RNA, herein designated VGAM HOST TARGET RNA. This complementary binding is due to the fact that the nucleotide sequence of VGAM1646 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1646 RNA, herein designated VGAM RNA, may have a different number of host target binding sites in untranslated regions of a VGAM1646 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1646 RNA, herein designated VGAM RNA, to host target binding sites on VGAM1646 host target RNA, herein designated VGAM HOST TARGET RNA, such as BINDING SITE I, BINDING SITE II and BINDING SITE III, inhibits translation of VGAM1646 host target RNA into VGAM1646 host target protein, herein designated VGAM HOST TARGET PROTEIN. VGAM host target protein is therefore outlined by a broken line.

It is appreciated that VGAM1646 host target gene, herein designated VGAM HOST TARGET GENE, in fact represents a plurality of VGAM1646 host target genes. The mRNA of each one of this plurality of VGAM1646 host target genes comprises one or more host target binding sites, each having a nucleotide sequence which is at least partly complementary to VGAM1646 RNA, herein designated VGAM RNA, and which when bound by VGAM1646 RNA causes inhibition of translation of respective one or more VGAM1646 host target proteins.

It is further appreciated by one skilled in the art that the mode of translational inhibition illustrated by FIG. 1 with specific reference to translational inhibition exerted by VGAM1646 gene, herein designated VGAM GENE, on one or more VGAM1646 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1646 is inhibition of expression of host target genes, as part of a novel viral mechanism of attacking a host. Accordingly, utilities of VGAM1646 include diagnosis, prevention and treatment of viral infection by Dengue Virus. Specific functions, and accordingly utilities, of VGAM1646 correlate with, and may be deduced from, the identity of the host target genes which VGAM1646 binds and inhibits, and the function of these host target genes, as elaborated hereinbelow.

Nucleotide sequences of the VGAM1646 precursor RNA, herein designated VGAM PRECURSOR RNA, and of the 'diced' VGAM1646 RNA, herein designated VGAM RNA, and a schematic representation of the secondary folding of VGAM1646 folded precursor RNA, herein designated VGAM FOLDED PRECURSOR RNA, of VGAM1646 are further described hereinbelow with reference to Table 1.

Nucleotide sequences of host target binding sites, such as BINDING SITE-I, BINDING SITE-II and BINDING SITE-III of FIG. 1, found on VGAM1646 host target RNA, and schematic representation of the complementarity of each of these host target binding sites to VGAM1646 RNA, herein designated VGAM RNA, are described hereinbelow with reference to Table 2.

As mentioned hereinabove with reference to FIG. 1, a function of VGAM1646 gene, herein designated VGAM is inhibition of expression of VGAM1646 target genes. It is appreciated that specific functions, and accordingly utilities, of VGAM1646 correlate with, and may be deduced from, the identity of the target genes which VGAM1646 binds and inhibits, and the function of these target genes, as elaborated hereinbelow.

WW45 (Accession NM_021818) is a VGAM1646 host target gene. WW45 BINDING SITE is HOST TARGET binding site found in the 3' untranslated region of mRNA encoded by WW45, corresponding to a HOST TARGET binding site such as BINDING SITE I, BINDING SITE II or BINDING SITE III. Table 2 illustrates the complementarity of the nucleotide sequences of WW45 BINDING SITE, designated SEQ ID:22396, to the nucleotide sequence of VGAM1646 RNA, herein designated VGAM RNA, also designated SEQ ID:4357.

A function of VGAM1646 is therefore inhibition of WW45 (Accession NM_021818), a gene which is required for ubiquitination and therefore degradation of several cell surface proteins like gap1, fur4, mal61 and ste2. also acts on rbp1. Accordingly, utilities of VGAM1646 include diagnosis, prevention and treatment of diseases and clinical conditions associated with WW45. The function of WW45 has been established by previous studies. By searching an EST database using C. elegans and Drosophila WW domain-containing protein sequences as bait, followed by 5-prime and 3-prime RACE using a human heart cDNA library, Valverde (2000) obtained a full-length cDNA encoding WW45. The deduced 383-amino acid protein has a predicted molecular mass of approximately 45 kD. It contains 2 WW domains, a region rich in prolines and glutamines, and a coiled-coil region, as well as a nuclear localization signal and 2 endoplasmic reticulum retention signals. The mouse Ww45 cDNA has a different 3-prime untranslated region and encodes a protein that shares 93% identity with human WW45. Northern blot and RT-PCR analyses demonstrated that both human and mouse WW45 transcripts (1.2 and 2.7 kb, respectively) are ubiquitously expressed in adult tissues. In human, highest expression was in pancreas, while in mouse, highest expression was in testis. Northern blot analysis of whole mouse embryos showed that embryonic expression of Ww45 first occurred at 7 days postcoitum. Expression levels markedly decreased at day 11 and remained low at days 15 and 17, suggesting that WW45 expression is developmentally regulated. Accordingly, expression of human WW45 was found to be higher in fetal heart than in adult heart. By radiation hybrid analysis, Valverde (2000) mapped the WW45 gene to chromosome 14q13-q23. In a screen for Drosophila mutations that result in tissue overgrowth, Tapon et al. (2002) identified salvador (sav), a gene that promotes both cell cycle exit and cell death. Elevated cyclin E (OMIM Ref. No. 123837) and inhibitor of apoptosis-1 (Diap1) levels were found in mutant cells, resulting in delayed cell cycle exit and impaired apoptosis. Salvador contains 2 WW domains and binds to the Warts (or OMIM Ref. No. 603473) protein kinase. Because WW45 is the human ortholog of salvador, Tapon et al. (2002) sequenced the entire WW45 coding region in a panel of 52 tumor-derived cell lines, representing a broad range of tissue types. One colon cancer cell line, HCT15, had a heterozygous C-to-A mutation at nucleotide 554, resulting in an asp185-to-ala substitution. This mutation was not present in 185 population-based controls (370 chromosomes), indicating that it is not a common polymorphism. The authors noted that HCT15 carries a mutation in the mismatch repair gene MSH6 (OMIM Ref. No. 600678), which appears to enhance the frequency of point mutations in other genes. Two renal cancer cell lines, ACHN and 786-O, had deletions involving WW45. The normal allele was not present in either cell line, indicating that these cell lines were either homozygous or hemizygous for the deletion. The WW45 transcript was undetectable by RT-PCR in both cell lines, and a Southern blot using a probe derived from the 3-prime portion of the gene demonstrated that this part of the gene was absent in both cell lines. In cell line 786-O, PCR analysis of genomic DNA indicated that there was a deletion of approximately 157 kb, with the 5-prime breakpoint between exons 2 and 3 of WW45. The deletion in ACHN of approximately 138 kb encompassed the entire gene. The common region of overlap between these 2 deletions was only 21 kb, containing exons 3 to 5 of WW45. No other transcription units were identified within this 21 kb interval.

Full details of the abovementioned studies are described in the following publications, the disclosure of which are hereby incorporated by reference:

Tapon, N.; Harvey, K. F.; Bell, D. W.; Wahrer, D. C. R.; Schiripo, T. A.; Haber, D. A.; Hariharan, I. K.: salvador promotes both cell cycle exit and apoptosis in Drosophila and is mutated in human cancer cell lines. Cell 110:467-478, 2002; and Valverde, P.: Cloning, expression, and mapping of hWW45, a novel human WW domain-containing gene. Biochem. Biophys. Res. Commun. 276:990-998, 2000.

Further studies establishing the function and utilities of WW45 are found in John Hopkins OMIM database record ID 607203, and in sited publications numbered 5562-5563 listed in the bibliography section hereinbelow, which are also hereby incorporated by reference. KIAA1034 (Accession XM_031223) is another VGAM1646 host target gene. KIAA1034 BINDING SITE is HOST TARGET binding site found in the 3' untranslated region of mRNA encoded by KIAA1034, corresponding to a HOST TARGET binding site such as BINDING SITE I, BINDING SITE II or BINDING SITE III. Table 2 illustrates the complementarity of the nucleotide sequences of KIAA1034 BINDING SITE, designated SEQ ID:31310, to the nucleotide sequence of VGAM1646 RNA, herein designated VGAM RNA, also designated SEQ ID:4357.

Another function of VGAM1646 is therefore inhibition of KIAA1034 (Accession XM_031223). Accordingly, utilities of VGAM1646 include diagnosis, prevention and treatment of diseases and clinical conditions associated with KIAA1034. SV2B (Accession NM_014848) is another VGAM1646 host target gene. SV2B BINDING SITE is HOST TARGET binding site found in the 3' untranslated region of mRNA encoded by SV2B, corresponding to a HOST TARGET binding site such as BINDING SITE I, BINDING SITE II or BINDING SITE III. Table 2 illustrates the complementarity of the nucleotide sequences of SV2B BINDING SITE, designated SEQ ID:16882, to the nucleotide sequence of VGAM1646 RNA, herein designated VGAM RNA, also designated SEQ ID:4357.

Another function of VGAM1646 is therefore inhibition of SV2B (Accession NM_014848). Accordingly, utilities of VGAM1646 include diagnosis, prevention and treatment of diseases and clinical conditions associated with SV2B. LOC219738 (Accession NM_145306) is another VGAM1646 host target gene. LOC219738 BINDING SITE is HOST TARGET binding site found in the 3' untranslated region of mRNA encoded by LOC219738, corresponding to a HOST TARGET binding site such as BINDING SITE I, BINDING SITE II or BINDING SITE III. Table 2 illustrates the complementarity of the nucleotide sequences of LOC219738 BINDING SITE, designated SEQ ID:29818, to the nucleotide sequence of VGAM1646 RNA, herein designated VGAM RNA, also designated SEQ ID:4357.

Another function of VGAM1646 is therefore inhibition of LOC219738 (Accession NM_145306). Accordingly, utilities of VGAM1646 include diagnosis, prevention and treatment of diseases and clinical conditions associated with LOC219738. LOC220573 (Accession XM_045569) is another VGAM1646 host target gene. LOC220573 BINDING SITE is HOST TARGET binding site found in the 3' untranslated region of mRNA encoded by LOC220573, corresponding to a HOST TARGET binding site such as BINDING SITE I, BINDING SITE II or BINDING SITE III. Table 2 illustrates the complementarity of the nucleotide sequences of LOC220573 BINDING SITE, designated SEQ ID:34482, to the nucleotide sequence of VGAM1646 RNA, herein designated VGAM RNA, also designated SEQ ID:4357.

Another function of VGAM1646 is therefore inhibition of LOC220573 (Accession XM_045569). Accordingly, utilities of VGAM1646 include diagnosis, prevention and treatment of diseases and clinical conditions associated with LOC220573. LOC91960 (Accession XM_041872) is another VGAM1646 host target gene. LOC91960 BINDING SITE is HOST TARGET binding site found in the 3' untranslated region of mRNA encoded by LOC91960, corresponding to a HOST TARGET binding site such as BINDING SITE I, BINDING SITE II or BINDING SITE III. Table 2 illustrates the complementarity of the nucleotide sequences of LOC91960 BINDING SITE, designated SEQ ID:33611, to the nucleotide sequence of VGAM1646 RNA, herein designated VGAM RNA, also designated SEQ ID:4357.

Another function of VGAM1646 is therefore inhibition of LOC91960 (Accession XM_041872). Accordingly, utilities of VGAM1646 include diagnosis, prevention and treatment of diseases and clinical conditions associated with LOC91960. FIG. 1 further provides a conceptual description of a novel bioinformatically detected viral gene of the present invention, referred to here as Viral Genomic Address Messenger 1647 (VGAM1647) viral gene, which modulates expression of respective host target genes thereof, the function and utility of which host target genes is known in the art.

VGAM1647 is a novel bioinformatically detected regulatory, non protein coding, viral micro RNA (miRNA) gene. The method by which VGAM1647 was detected is described hereinabove with reference to FIGS. 1-8.

VGAM1647 gene, herein designated VGAM GENE, is a viral gene contained in the genome of Human Herpesvirus 8. VGAM1647 host target gene, herein designated VGAM HOST TARGET GENE, is a human gene contained in the human genome.

VGAM1647 gene encodes a VGAM1647 precursor RNA, herein designated VGAM PRECURSOR RNA. Similar to other miRNA genes, and unlike most ordinary genes, VGAM1647 precursor RNA does not encode a protein. A nucleotide sequence identical or highly similar to the nucleotide sequence of VGAM1647 precursor RNA is designated SEQ ID:1633, and is provided hereinbelow with reference to the sequence listing part. Nucleotide sequence SEQ ID:1633 is located at position 104577 relative to the genome of Human Herpesvirus 8.

VGAM1647 precursor RNA folds onto itself, forming VGAM1647 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1647 folded precursor RNA into VGAM1647 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1647 RNA is designated SEQ ID:4358, and is provided hereinbelow with reference to the sequence listing part.

VGAM1647 host target gene, herein designated VGAM HOST TARGET GENE, encodes a corresponding messenger RNA, VGAM1647 host target RNA, herein designated VGAM HOST TARGET RNA. VGAM1647 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1647 RNA, herein designated VGAM RNA, binds complementarily to one or more host target binding sites located in untranslated regions of VGAM1647 host target RNA, herein designated VGAM HOST TARGET RNA. This complementary binding is due to the fact that the nucleotide sequence of VGAM1647 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1647 RNA, herein designated VGAM RNA, may have a different number of host target binding sites in untranslated regions of a VGAM1647 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1647 RNA, herein designated VGAM RNA, to host target binding sites on VGAM1647 host target RNA, herein designated VGAM HOST TARGET RNA, such as BINDING SITE I, BINDING SITE II and BINDING SITE III, inhibits translation of VGAM1647 host target RNA into VGAM1647 host target protein, herein designated VGAM HOST TARGET PROTEIN. VGAM host target protein is therefore outlined by a broken line.

It is appreciated that VGAM1647 host target gene, herein designated VGAM HOST TARGET GENE, in fact represents a plurality of VGAM1647 host target genes. The mRNA of each one of this plurality of VGAM1647 host target genes comprises one or more host target binding sites, each having a nucleotide sequence which is at least partly complementary to VGAM1647 RNA, herein designated VGAM RNA, and which when bound by VGAM1647 RNA causes inhibition of translation of respective one or more VGAM1647 host target proteins.

It is further appreciated by one skilled in the art that the mode of translational inhibition illustrated by FIG. 1 with specific reference to translational inhibition exerted by VGAM1647 gene, herein designated VGAM GENE, on one or more VGAM1647 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1647 is inhibition of expression of host target genes, as part of a novel viral mechanism of attacking a host. Accordingly, utilities of VGAM1647 include diagnosis, prevention and treatment of viral infection by Human Herpesvirus 8. Specific functions, and accordingly utilities, of VGAM1647 correlate with, and may be deduced from, the identity of the host target genes which VGAM1647 binds and inhibits, and the function of these host target genes, as elaborated hereinbelow.

Nucleotide sequences of the VGAM1647 precursor RNA, herein designated VGAM PRECURSOR RNA, and of the 'diced' VGAM1647 RNA, herein designated VGAM RNA, and a schematic representation of the secondary folding of VGAM1647 folded precursor RNA, herein designated VGAM FOLDED PRECURSOR RNA, of VGAM1647 are further described hereinbelow with reference to Table 1.

Nucleotide sequences of host target binding sites, such as BINDING SITE-I, BINDING SITE-II and BINDING SITE-III of FIG. 1, found on VGAM1647 host target RNA, and schematic representation of the complementarity of each of these host target binding sites to VGAM1647 RNA, herein designated VGAM RNA, are described hereinbelow with reference to Table 2.

As mentioned hereinabove with reference to FIG. 1, a function of VGAM1647 gene, herein designated VGAM is inhibition of expression of VGAM1647 target genes. It is appreciated that specific functions, and accordingly utilities, of VGAM1647 correlate with, and may be deduced from, the identity of the target genes which VGAM1647 binds and inhibits, and the function of these target genes, as elaborated hereinbelow.

Calpain 1, (mu/I) Large Subunit (CAPN1, Accession NM_005186) is a VGAM1647 host target gene. CAPN1 BINDING SITE is HOST TARGET binding site found in the 3' untranslated region of mRNA encoded by CAPN1, corresponding to a HOST TARGET binding site such as BINDING SITE I, BINDING SITE II or BINDING SITE III. Table 2 illustrates the complementarity of the nucleotide sequences of CAPN1 BINDING SITE, designated SEQ ID:11686, to the nucleotide sequence of VGAM1647 RNA, herein designated VGAM RNA, also designated SEQ ID:4358.

A function of VGAM1647 is therefore inhibition of Calpain 1, (mu/I) Large Subunit (CAPN1, Accession NM_005186), a gene which is an intracellular protease that requires calcium for its catalytic activity. Accordingly, utilities of VGAM1647 include diagnosis, prevention and treatment of diseases and clinical conditions associated with CAPN1. The function of CAPN1 has been established by previous studies. Calpain (calcium-dependent protease; EC 3.4.22.17) is an intracellular protease that requires calcium for its catalytic activity. Two isozymes (CANP1 and CANP2), with different calcium requirements, have been identified. Both are heterodimers composed of L (large, catalytic, 80 kD) and S (small, regulatory, 30 kD) subunits. The isozymes share an identical S subunit (OMIM Ref. No. 114170); differences arise from the L subunits (L1 and L2). Using cDNA clones as probes, Ohno et al. (1989, 1990) mapped the CANPL1 and CANPL2 genes as well as the CANPS gene and a gene for another protein, L3, that is homologous to the other 2 L subunits; they used a combination of spot blot hybridization with sorted chromosomes and Southern hybridization with human-mouse cell hybrid DNAs. In this way they were able to assign CANPL1 to chromosome 11; CANPL2 to chromosome 1; CANPL3 to chromosome 15; and CANPS to chromosome 19. Courseaux et al. (1996) used a combination of methods to refine maps of the approximately 5-Mb region of 11q13 that includes MEN1 (OMIM Ref. No. 131100). They proposed the following gene order: cen--PGA--FTH1--UGB--AHNAK--ROM1--MDU1--CHRM1--COX8--EMK1--FKBP2--PLCB3--[PYGM, ZFM1]--FAU--CAPN1--[MLK3, RELA]--FOSL1--SEA--CFL1--tel.

Full details of the abovementioned studies are described in the following publications, the disclosure of which are hereby incorporated by reference:

Ohno, S.; Minoshima, S.; Kudoh, J.; Fukuyama, R.; Shimizu, Y.; Ohmi-Imajoh, S.; Shimizu, N.; Suzuki, K.: Four genes for the calpain family locate on four distinct human chromosomes. Cytogenet. Cell Genet. 53:225-229, 1990; and Courseaux, A.; Grosgeorge, J.; Gaudray, P.; Pannett, A. A. J.; Forbes, S. A.; Williamson, C.; Bassett, D.; Thakker, R. V.; Teh, B. T.; Farnebo, F.; Shepherd, J.; Skogseid, B.; Larsson, C.

Further studies establishing the function and utilities of CAPN1 are found in John Hopkins OMIM database record ID 114220, and in sited publications numbered 398 and 12571-12572 listed in the bibliography section hereinbelow, which are also hereby incorporated by reference. KIAA0329 (Accession NM_014844) is another VGAM1647 host target gene. KIAA0329 BINDING SITE1 and KIAA0329 BINDING SITE2 are HOST TARGET binding sites found in untranslated regions of mRNA encoded by KIAA0329, corresponding to HOST TARGET binding sites such as BINDING SITE I, BINDING SITE II or BINDING SITE III. Table 2 illustrates the complementarity of the nucleotide sequences of KIAA0329 BINDING SITE1 and KIAA0329 BINDING SITE2, designated SEQ ID:16873 and SEQ ID:16874 respectively, to the nucleotide sequence of VGAM1647 RNA, herein designated VGAM RNA, also designated SEQ ID:4358.

Another function of VGAM1647 is therefore inhibition of KIAA0329 (Accession NM_014844). Accordingly, utilities of VGAM1647 include diagnosis, prevention and treatment of diseases and clinical conditions associated with KIAA0329. FIG. 1 further provides a conceptual description of a novel bioinformatically detected viral gene of the present invention, referred to here as Viral Genomic Address Messenger 1648 (VGAM1648) viral gene, which modulates expression of respective host target genes thereof, the function and utility of which host target genes is known in the art.

VGAM1648 is a novel bioinformatically detected regulatory, non protein coding, viral micro RNA (miRNA) gene. The method by which VGAM1648 was detected is described hereinabove with reference to FIGS. 1-8.

VGAM1648 gene, herein designated VGAM GENE, is a viral gene contained in the genome of Human Herpesvirus 8. VGAM1648 host target gene, herein designated VGAM HOST TARGET GENE, is a human gene contained in the human genome.

VGAM1648 gene encodes a VGAM1648 precursor RNA, herein designated VGAM PRECURSOR RNA. Similar to other miRNA genes, and unlike most ordinary genes, VGAM1648 precursor RNA does not encode a protein. A nucleotide sequence identical or highly similar to the nucleotide sequence of VGAM1648 precursor RNA is designated SEQ ID:1634, and is provided hereinbelow with reference to the sequence listing part. Nucleotide sequence SEQ ID:1634 is located at position 111049 relative to the genome of Human Herpesvirus 8.

VGAM1648 precursor RNA folds onto itself, forming VGAM1648 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1648 folded precursor RNA into VGAM1648 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1648 RNA is designated SEQ ID:4359, and is provided hereinbelow with reference to the sequence listing part.

VGAM1648 host target gene, herein designated VGAM HOST TARGET GENE, encodes a corresponding messenger RNA, VGAM1648 host target RNA, herein designated VGAM HOST TARGET RNA. VGAM1648 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1648 RNA, herein designated VGAM RNA, binds complementarily to one or more host target binding sites located in untranslated regions of VGAM1648 host target RNA, herein designated VGAM HOST TARGET RNA. This complementary binding is due to the fact that the nucleotide sequence of VGAM1648 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1648 RNA, herein designated VGAM RNA, may have a different number of host target binding sites in untranslated regions of a VGAM1648 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1648 RNA, herein designated VGAM RNA, to host target binding sites on VGAM1648 host target RNA, herein designated VGAM HOST TARGET RNA, such as BINDING SITE I, BINDING SITE II and BINDING SITE III, inhibits translation of VGAM1648 host target RNA into VGAM1648 host target protein, herein designated VGAM HOST TARGET PROTEIN. VGAM host target protein is therefore outlined by a broken line.

It is appreciated that VGAM1648 host target gene, herein designated VGAM HOST TARGET GENE, in fact represents a plurality of VGAM1648 host target genes. The mRNA of each one of this plurality of VGAM1648 host target genes comprises one or more host target binding sites, each having a nucleotide sequence which is at least partly complementary to VGAM1648 RNA, herein designated VGAM RNA, and which when bound by VGAM1648 RNA causes inhibition of translation of respective one or more VGAM1648 host target proteins.

It is further appreciated by one skilled in the art that the mode of translational inhibition illustrated by FIG. 1 with specific reference to translational inhibition exerted by VGAM1648 gene, herein designated VGAM GENE, on one or more VGAM1648 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1648 is inhibition of expression of host target genes, as part of a novel viral mechanism of attacking a host. Accordingly, utilities of VGAM1648 include diagnosis, prevention and treatment of viral infection by Human Herpesvirus 8. Specific functions, and accordingly utilities, of VGAM1648 correlate with, and may be deduced from, the identity of the host target genes which VGAM1648 binds and inhibits, and the function of these host target genes, as elaborated hereinbelow.

Nucleotide sequences of the VGAM1648 precursor RNA, herein designated VGAM PRECURSOR RNA, and of the 'diced' VGAM1648 RNA, herein designated VGAM RNA, and a schematic representation of the secondary folding of VGAM1648 folded precursor RNA, herein designated VGAM FOLDED PRECURSOR RNA, of VGAM1648 are further described hereinbelow with reference to Table 1.

Nucleotide sequences of host target binding sites, such as BINDING SITE-I, BINDING SITE-II and BINDING SITE-III of FIG. 1, found on VGAM1648 host target RNA, and schematic representation of the complementarity of each of these host target binding sites to VGAM1648 RNA, herein designated VGAM RNA, are described hereinbelow with reference to Table 2.

As mentioned hereinabove with reference to FIG. 1, a function of VGAM1648 gene, herein designated VGAM is inhibition of expression of VGAM1648 target genes. It is appreciated that specific functions, and accordingly utilities, of VGAM1648 correlate with, and may be deduced from, the identity of the target genes which VGAM1648 binds and inhibits, and the function of these target genes, as elaborated hereinbelow.

Lactate Dehydrogenase B (LDHB, Accession NM_002300) is a VGAM1648 host target gene. LDHB BINDING SITE is HOST TARGET binding site found in the 5' untranslated region of mRNA encoded by LDHB, corresponding to a HOST TARGET binding site such as BINDING SITE I, BINDING SITE II or BINDING SITE III. Table 2 illustrates the complementarity of the nucleotide sequences of LDHB BINDING SITE, designated SEQ ID:8085, to the nucleotide sequence of VGAM1648 RNA, herein designated VGAM RNA, also designated SEQ ID:4359.

A function of VGAM1648 is therefore inhibition of Lactate Dehydrogenase B (LDHB, Accession NM_002300), a gene which causes dehydrogenation of lactate. Accordingly, utilities of VGAM1648 include diagnosis, prevention and treatment of diseases and clinical conditions associated with LDHB. The function of LDHB and its association with various diseases and clinical conditions, has been established by previous studies, as described hereinabove with reference to VGAM273. Paired Box Gene 6 (aniridia, keratitis) (PAX6, Accession NM_000280) is another VGAM1648 host target gene. PAX6 BINDING SITE1 and PAX6 BINDING SITE2 are HOST TARGET binding sites found in untranslated regions of mRNA encoded by PAX6, corresponding to HOST TARGET binding sites such as BINDING SITE I, BINDING SITE II or BINDING SITE III. Table 2 illustrates the complementarity of the nucleotide sequences of PAX6 BINDING SITE1 and PAX6 BINDING SITE2, designated SEQ ID:5826 and SEQ ID:7310 respectively, to the nucleotide sequence of VGAM1648 RNA, herein designated VGAM RNA, also designated SEQ ID:4359.

Another function of VGAM1648 is therefore inhibition of Paired Box Gene 6 (aniridia, keratitis) (PAX6, Accession NM_000280), a gene which involves in oculogenesis. Accordingly, utilities of VGAM1648 include diagnosis, prevention and treatment of diseases and clinical conditions associated with PAX6. The function of PAX6 and its association with various diseases and clinical conditions, has been established by previous studies, as described hereinabove with reference to VGAM1499. FLJ14594 (Accession NM_032808) is another VGAM1648 host target gene. FLJ14594 BINDING SITE is HOST TARGET binding site found in the 3' untranslated region of mRNA encoded by FLJ14594, corresponding to a HOST TARGET binding site such as BINDING SITE I, BINDING SITE II or BINDING SITE III. Table 2 illustrates the complementarity of the nucleotide sequences of FLJ14594 BINDING SITE, designated SEQ ID:26567, to the nucleotide sequence of VGAM1648 RNA, herein designated VGAM RNA, also designated SEQ ID:4359.

Another function of VGAM1648 is therefore inhibition of FLJ14594 (Accession NM_032808). Accordingly, utilities of VGAM1648 include diagnosis, prevention and treatment of diseases and clinical conditions associated with FLJ14594. KIAA1908 (Accession XM_055834) is another VGAM1648 host target gene. KIAA1908 BINDING SITE is HOST TARGET binding site found in the 3' untranslated region of mRNA encoded by KIAA1908, corresponding to a HOST TARGET binding site such as BINDING SITE I, BINDING SITE II or BINDING SITE III. Table 2 illustrates the complementarity of the nucleotide sequences of KIAA1908 BINDING SITE, designated SEQ ID:36331, to the nucleotide sequence of VGAM1648 RNA, herein designated VGAM RNA, also designated SEQ ID:4359.

Another function of VGAM1648 is therefore inhibition of KIAA1908 (Accession XM_055834). Accordingly, utilities of VGAM1648 include diagnosis, prevention and treatment of diseases and clinical conditions associated with KIAA1908. MGC15875 (Accession NM_032921) is another VGAM1648 host target gene. MGC15875 BINDING SITE is HOST TARGET binding site found in the 5' untranslated region of mRNA encoded by MGC15875, corresponding to a HOST TARGET binding site such as BINDING SITE I, BINDING SITE II or BINDING SITE III. Table 2 illustrates the complementarity of the nucleotide sequences of MGC15875 BINDING SITE, designated SEQ ID:26747, to the nucleotide sequence of VGAM1648 RNA, herein designated VGAM RNA, also designated SEQ ID:4359.

Another function of VGAM1648 is therefore inhibition of MGC15875 (Accession NM_032921). Accordingly, utilities of VGAM1648 include diagnosis, prevention and treatment of diseases and clinical conditions associated with MGC15875. Ras and Rab Interactor 3 (RIN3, Accession NM_024832) is another VGAM1648 host target gene. RIN3 BINDING SITE is HOST TARGET binding site found in the 3' untranslated region of mRNA encoded by RIN3, corresponding to a HOST TARGET binding site such as BINDING SITE I, BINDING SITE II or BINDING SITE III. Table 2 illustrates the complementarity of the nucleotide sequences of RIN3 BINDING SITE, designated SEQ ID:24232, to the nucleotide sequence of VGAM1648 RNA, herein designated VGAM RNA, also designated SEQ ID:4359.

Another function of VGAM1648 is therefore inhibition of Ras and Rab Interactor 3 (RIN3, Accession NM_024832). Accordingly, utilities of VGAM1648 include diagnosis, prevention and treatment of diseases and clinical conditions associated with RIN3. UREB1 (Accession NM_031407) is another VGAM1648 host target gene. UREB1 BINDING SITE is HOST TARGET binding site found in the 5' untranslated region of mRNA encoded by UREB1, corresponding to a HOST TARGET binding site such as BINDING SITE I, BINDING SITE II or BINDING SITE III. Table 2 illustrates the complementarity of the nucleotide sequences of UREB1 BINDING SITE, designated SEQ ID:25365, to the nucleotide sequence of VGAM1648 RNA, herein designated VGAM RNA, also designated SEQ ID:4359.

Another function of VGAM1648 is therefore inhibition of UREB1 (Accession NM_031407). Accordingly, utilities of VGAM1648 include diagnosis, prevention and treatment of diseases and clinical conditions associated with UREB1. FIG. 1 further provides a conceptual description of a novel bioinformatically detected viral gene of the present invention, referred to here as Viral Genomic Address Messenger 1649 (VGAM1649) viral gene, which modulates expression of respective host target genes thereof, the function and utility of which host target genes is known in the art.

VGAM1649 is a novel bioinformatically detected regulatory, non protein coding, viral micro RNA (miRNA) gene. The method by which VGAM1649 was detected is described hereinabove with reference to FIGS. 1-8.

VGAM1649 gene, herein designated VGAM GENE, is a viral gene contained in the genome of Human Herpesvirus 8. VGAM1649 host target gene, herein designated VGAM HOST TARGET GENE, is a human gene contained in the human genome.

VGAM1649 gene encodes a VGAM1649 precursor RNA, herein designated VGAM PRECURSOR RNA. Similar to other miRNA genes, and unlike most ordinary genes, VGAM1649 precursor RNA does not encode a protein. A nucleotide sequence identical or highly similar to the nucleotide sequence of VGAM1649 precursor RNA is designated SEQ ID:1635, and is provided hereinbelow with reference to the sequence listing part. Nucleotide sequence SEQ ID:1635 is located at position 105452 relative to the genome of Human Herpesvirus 8.

VGAM1649 precursor RNA folds onto itself, forming VGAM1649 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1649 folded precursor RNA into VGAM1649 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM1649 RNA is designated SEQ ID:4360, and is provided hereinbelow with reference to the sequence listing part.

VGAM1649 host target gene, herein designated VGAM HOST TARGET GENE, encodes a corresponding messenger RNA, VGAM1649 host target RNA, herein designated VGAM HOST TARGET RNA. VGAM1649 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1649 RNA, herein designated VGAM RNA, binds complementarily to one or more host target binding sites located in untranslated regions of VGAM1649 host target RNA, herein designated VGAM HOST TARGET RNA. This complementary binding is due to the fact that the nucleotide sequence of VGAM1649 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1649 RNA, herein designated VGAM RNA, may have a different number of host target binding sites in untranslated regions of a VGAM1649 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1649 RNA, herein designated VGAM RNA, to host target binding sites on VGAM1649 host target RNA, herein designated VGAM HOST TARGET RNA, such as BINDING SITE I, BINDING SITE II and BINDING SITE III, inhibits translation of VGAM1649 host target RNA into VGAM1649 host target protein, herein designated VGAM HOST TARGET PROTEIN. VGAM host target protein is therefore outlined by a broken line.

It is appreciated that VGAM1649 host target gene, herein designated VGAM HOST TARGET GENE, in fact represents a plurality of VGAM1649 host target genes. The mRNA of each one of this plurality of VGAM1649 host target genes comprises one or more host target binding sites, each having a nucleotide sequence which is at least partly complementary to VGAM1649 RNA, herein designated VGAM RNA, and which when bound by VGAM1649 RNA causes inhibition of translation of respective one or more VGAM1649 host target proteins.

It is further appreciated by one skilled in the art that the mode of translational inhibition illustrated by FIG. 1 with specific reference to translational inhibition exerted by VGAM1649 gene, herein designated VGAM GENE, on one or more VGAM1649 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1649 is inhibition of expression of host target genes, as part of a novel viral mechanism of attacking a host. Accordingly, utilities of VGAM1649 include diagnosis, prevention and treatment of viral infection by Human Herpesvirus 8. Specific functions, and accordingly utilities, of VGAM1649 correlate with, and may be deduced from, the identity of the host target genes which VGAM1649 binds and inhibits, and the function of these host target genes, as elaborated hereinbelow.

Nucleotide sequences of the VGAM1649 precursor RNA, herein designated VGAM PRECURSOR RNA, and of the 'diced' VGAM1649 RNA, herein designated VGAM RNA, and a schematic representation of the secondary folding of VGAM1649 folded precursor RNA, herein designated VGAM FOLDED PRECURSOR RNA, of VGAM1649 are further described hereinbelow with reference to Table 1.

Nucleotide sequences of host target binding sites, such as BINDING SITE-I, BINDING SITE-II and BINDING SITE-III of FIG. 1, found on VGAM1649 host target RNA, and schematic representation of the complementarity of each of these host target binding sites to VGAM1649 RNA, herein designated VGAM RNA, are described hereinbelow with reference to Table 2.

As mentioned hereinabove with reference to FIG. 1, a function of VGAM1649 gene, herein designated VGAM is inhibition of expression of VGAM1649 target genes. It is appreciated that specific functions, and accordingly utilities, of VGAM1649 correlate with, and may be deduced from, the identity of the target genes which VGAM1649 binds and inhibits, and the function of these target genes, as elaborated hereinbelow.

Cholinergic Receptor, Nicotinic, Alpha Polypeptide 4 (CHRNA4, Accession NM_000744) is a VGAM1649 host target gene. CHRNA4 BINDING SITE is HOST TARGET binding site found in the 3' untranslated region of mRNA encoded by CHRNA4, corresponding to a HOST TARGET binding site such as BINDING SITE I, BINDING SITE II or BINDING SITE III. Table 2 illustrates the complementarity of the nucleotide sequences of CHRNA4 BINDING SITE, designated SEQ ID:6397, to the nucleotide sequence of VGAM1649 RNA, herein designated VGAM RNA, also designated SEQ ID:4360.

A function of VGAM1649 is therefore inhibition of Cholinergic Receptor, Nicotinic, Alpha Polypeptide 4 (CHRNA4, Accession NM_000744), a gene which binds acetylcholine and opens an ion-conducting channel across the plasma membrane. Accordingly, utilities of VGAM1649 include diagnosis, prevention and treatment of diseases and clinical conditions associated with CHRNA4. The function of CHRNA4 has been established by previous studies. Type 1 benign neonatal epilepsy (EBN1) was shown to be caused by mutations in the KCNQ2 gene (OMIM Ref. No. 602235) (Singh et al., 1998). The finding of a presumed mutation (Beck et al., 1994) in the CHRNA4 gene, which maps to the same region, in 1 of 20 families, was presumably an error. Steinlein et al. (1995) demonstrated a missense mutation in the CHRNA4 gene (118504.0002) associated with autosomal dominant nocturnal frontal lobe epilepsy (OMIM Ref. No. 600513), which had previously been mapped to 20q. Indeed, the mutation was sought because CHRNA4 maps to the same region of 20q and the gene is expressed in all layers of the frontal cortex. Mutations in the CHRNA4 gene appear to account for only a small proportion of the cases of nocturnal frontal lobe epilepsy. In a large Australian kindred, autosomal dominant nocturnal frontal lobe epilepsy was mapped to 20q13.2-q13.3 by Phillips et al. (1995). In affected members of the same family, Steinlein et al. (1995) used single-strand conformation analysis to detect an abnormality which by direct sequencing was demonstrated to be a C-to-T transition. It resulted in replacement of the neutral serine by the complex aromatic phenylalanine (ser248-to-phe) in the sixth amino acid position of the transmembrane domain 2 (M2). They suggested that the mutation caused reduced receptor function. Forman et al. (1996) suggested an alternative mechanism for pathogenesis of epilepsy associated with this CHRNA4 mutation. From studies of the mouse muscle alpha-1 nicotinic receptor (OMIM Ref. No. 100690) noted in Forman et al. (1995), Forman et al. (1996) speculated that the mutation in CHRNA4 may cause receptor hyperactivity that could lead to epileptic activity. Animal model experiments lend further support to the function of CHRNA4. Marubio et al. (1999) disrupted the alpha-4 subunit of the neuronal nicotinic acetylcholine receptor by homologous recombination and studied homozygous alpha-4 null mice and mice lacking the beta-2 subunit of the nAChR. The homozygous alpha-4 -/- mice no longer expressed high-affinity nicotine binding sites throughout the brain. In addition, both types of mutant mice displayed a reduced antinociceptive effect of nicotine on the hot-plate test and diminished sensitivity to nicotine in the tail-flick test. Patch-clamp recordings revealed that raphe magnus and thalamic neurons no longer responded to nicotine. Marubio et al. (1999) stated that the alpha-4 nAChR subunit, thought to associate with the beta-2 nAChR subunit, is therefore crucial for nicotine-elicited antinociception.

It is appreciated that the abovementioned animal model for CHRNA4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Steinlein, O. K.; Mulley, J. C.; Propping, P.; Wallace, R. H.; Phillips, H. A.; Sutherland, G. R.; Scheffer, I. E.; Berkovic, S. F.: A missense mutation in the neuronal nicotinic acetylcholine receptor alpha-4 subunit is associated with autosomal dominant nocturnal frontal lobe epilepsy. Nature Genet. 11:201-203, 1995; and Forman, S. A.; Yellen, G.; Thiele, E. A.: Alternative mechanism for pathogenesis of an inherited epilepsy by a nicotinic AChR mutation. (Letter) Nature Genet. 13:396-397, 1996.

Further studies establishing the function and utilities of CHRNA4 are found in John Hopkins OMIM database record ID 118504, and in sited publications numbered 4452, 4662, 394-398, 7207-7208, 39 and 4663-403 listed in the bibliography section hereinbelow, which are also hereby incorporated by reference. Coagulation Factor VII (serum prothrombin conversion accelerator) (F7, Accession NM_000131) is another VGAM1649 host target gene. F7 BINDING SITE1 and F7 BINDING SITE2 are HOST TARGET binding sites found in untranslated regions of mRNA encoded by F7, corresponding to HOST TARGET binding sites such as BINDING SITE I, BINDING SITE II or BINDING SITE III. Table 2 illustrates the complementarity of the nucleotide sequences of F7 BINDING SITE1 and F7 BINDING SITE2, designated SEQ ID:5605 and SEQ ID:21234 respectively, to the nucleotide sequence of VGAM1649 RNA, herein designated VGAM RNA, also designated SEQ ID:4360.

Another function of VGAM1649 is therefore inhibition of Coagulation Factor VII (serum prothrombin conversion accelerator) (F7, Accession NM_000131). Accordingly, utilities of VGAM1649 include diagnosis, prevention and treatment of diseases and clinical conditions associated with F7. KIAA0435 (Accession NM_014801) is another VGAM1649 host target gene. KIAA0435 BINDING SITE is HOST TARGET binding site found in the 3' untranslated region of mRNA encoded by KIAA0435, corresponding to a HOST TARGET binding site such as BINDING SITE I, BINDING SITE II or BINDING SITE III. Table 2 illustrates the complementarity of the nucleotide sequences of KIAA0435 BINDING SITE, designated SEQ ID:16722, to the nucleotide sequence of VGAM1649 RNA, herein designated VGAM RNA, also designated SEQ ID:4360.

Another function of VGAM1649 is therefore inhibition of KIAA0435 (Accession NM_014801). Accordingly, utilities of VGAM1649 include diagnosis, prevention and treatment of diseases and clinical conditions associated with KIAA0435. LOC154214 (Accession XM_087876) is another VGAM1649 host target gene. LOC154214 BINDING SITE is HOST TARGET binding site found in the 3' untranslated region of mRNA encoded by LOC154214, corresponding to a HOST TARGET binding site such as BINDING SITE I, BINDING SITE II or BINDING SITE III. Table 2 illustrates the complementarity of the nucleotide sequences of LOC154214 BINDING SITE, designated SEQ ID:39466, to the nucleotide sequence of VGAM1649 RNA, herein designated VGAM RNA, also designated SEQ ID:4360.

Another function of VGAM1649 is therefore inhibition of LOC154214 (Accession XM_087876). Accordingly, utilities of VGAM1649 include diagnosis, prevention and treatment of diseases and clinical conditions associated with LOC154214. FIG. 1 further provides a conceptual description of a novel bioinformatically detected viral gene of the present invention, referred to here as Viral Genomic Address Messenger 1650 (VGAM1650) viral gene, which modulates expression of respective host target genes thereof, the function and utility of which host target genes is known in the art.

VGAM1650 is a novel bioinformatically detected regulatory, non protein coding, viral micro RNA (miRNA) gene. The method by which VGAM1650 was detected is described hereinabove with reference to FIGS. 1-8.

VGAM1650 gene, herein designated VGAM GENE, is a viral gene contained in the genome of Human Herpesvirus 8. VGAM1650 host target gene, herein designated VGAM HOST TARGET GENE, is a human gene contained in the human genome.

VGAM1650 gene encodes a VGAM1650 precursor RNA, herein designated VGAM PRECURSOR RNA. Similar to other miRNA genes, and unlike most ordinary genes, VGAM1650 precursor RNA does not encode a protein. A nucleotide sequence identical or highly similar to the nucleotide sequence of VGAM1650 precursor RNA is designated SEQ ID:1636, and is provided hereinbelow with reference to the sequence listing part. Nucleotide sequence SEQ ID:1636 is located at position 109181 relative to the genome of Human Herpesvirus 8.

VGAM1650 precursor RNA folds onto itself, forming VGAM1650 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1650 folded precursor RNA into VGAM1650 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 52%) nucleotide sequence of VGAM1650 RNA is designated SEQ ID:4361, and is provided hereinbelow with reference to the sequence listing part.

VGAM1650 host target gene, herein designated VGAM HOST TARGET GENE, encodes a corresponding messenger RNA, VGAM1650 host target RNA, herein designated VGAM HOST TARGET RNA. VGAM1650 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1650 RNA, herein designated VGAM RNA, binds complementarily to one or more host target binding sites located in untranslated regions of VGAM1650 host target RNA, herein designated VGAM HOST TARGET RNA. This complementary binding is due to the fact that the nucleotide sequence of VGAM1650 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1650 RNA, herein designated VGAM RNA, may have a different number of host target binding sites in untranslated regions of a VGAM1650 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1650 RNA, herein designated VGAM RNA, to host target binding sites on VGAM1650 host target RNA, herein designated VGAM HOST TARGET RNA, such as BINDING SITE I, BINDING SITE II and BINDING SITE III, inhibits translation of VGAM1650 host target RNA into VGAM1650 host target protein, herein designated VGAM HOST TARGET PROTEIN. VGAM host target protein is therefore outlined by a broken line.

It is appreciated that VGAM1650 host target gene, herein designated VGAM HOST TARGET GENE, in fact represents a plurality of VGAM1650 host target genes. The mRNA of each one of this plurality of VGAM1650 host target genes comprises one or more host target binding sites, each having a nucleotide sequence which is at least partly complementary to VGAM1650 RNA, herein designated VGAM RNA, and which when bound by VGAM1650 RNA causes inhibition of translation of respective one or more VGAM1650 host target proteins.

It is further appreciated by one skilled in the art that the mode of translational inhibition illustrated by FIG. 1 with specific reference to translational inhibition exerted by VGAM1650 gene, herein designated VGAM GENE, on one or more VGAM1650 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1650 is inhibition of expression of host target genes, as part of a novel viral mechanism of attacking a host. Accordingly, utilities of VGAM1650 include diagnosis, prevention and treatment of viral infection by Human Herpesvirus 8. Specific functions, and accordingly utilities, of VGAM1650 correlate with, and may be deduced from, the identity of the host target genes which VGAM1650 binds and inhibits, and the function of these host target genes, as elaborated hereinbelow.

Nucleotide sequences of the VGAM1650 precursor RNA, herein designated VGAM PRECURSOR RNA, and of the 'diced' VGAM1650 RNA, herein designated VGAM RNA, and a schematic representation of the secondary folding of VGAM1650 folded precursor RNA, herein designated VGAM FOLDED PRECURSOR RNA, of VGAM1650 are further described hereinbelow with reference to Table 1.

Nucleotide sequences of host target binding sites, such as BINDING SITE-I, BINDING SITE-II and BINDING SITE-III of FIG. 1, found on VGAM1650 host target RNA, and schematic representation of the complementarity of each of these host target binding sites to VGAM1650 RNA, herein designated VGAM RNA, are described hereinbelow with reference to Table 2.

As mentioned hereinabove with reference to FIG. 1, a function of VGAM1650 gene, herein designated VGAM is inhibition of expression of VGAM1650 target genes. It is appreciated that specific functions, and accordingly utilities, of VGAM1650 correlate with, and may be deduced from, the identity of the target genes which VGAM1650 binds and inhibits, and the function of these target genes, as elaborated hereinbelow.

SNL (Accession NM_003088) is a VGAM1650 host target gene. SNL BINDING SITE is HOST TARGET binding site found in the 3' untranslated region of mRNA encoded by SNL, corresponding to a HOST TARGET binding site such as BINDING SITE I, BINDING SITE II or BINDING SITE III. Table 2 illustrates the complementarity of the nucleotide sequences of SNL BINDING SITE, designated SEQ ID:9058, to the nucleotide sequence of VGAM1650 RNA, herein designated VGAM RNA, also designated SEQ ID:4361.

A function of VGAM1650 is therefore inhibition of SNL (Accession NM_003088), a gene which organizes filamentous actin into bundles with a minimum of 4.1:1 actin/fascin ratio. Accordingly, utilities of VGAM1650 include diagnosis, prevention and treatment of diseases and clinical conditions associated with SNL. The function of SNL and its association with various diseases and clinical conditions, has been established by previous studies, as described hereinabove with reference to VGAM675. DKFZp761A132 (Accession NM_032296) is another VGAM1650 host target gene. DKFZp761A132 BINDING SITE is HOST TARGET binding site found in the 3' untranslated region of mRNA encoded by DKFZp761A132, corresponding to a HOST TARGET binding site such as BINDING SITE I, BINDING SITE II or BINDING SITE III. Table 2 illustrates the complementarity of the nucleotide sequences of DKFZp761A132 BINDING SITE, designated SEQ ID:26076, to the nucleotide sequence of VGAM1650 RNA, herein designated VGAM RNA, also designated SEQ ID:4361.

Another function of VGAM1650 is therefore inhibition of DKFZp761A132 (Accession NM_032296). Accordingly, utilities of VGAM1650 include diagnosis, prevention and treatment of diseases and clinical conditions associated with DKFZp761A132. GMPPB (Accession XM_171044) is another VGAM1650 host target gene. GMPPB BINDING SITE is HOST TARGET binding site found in the 5' untranslated region of mRNA encoded by GMPPB, corresponding to a HOST TARGET binding site such as BINDING SITE I, BINDING SITE II or BINDING SITE III. Table 2 illustrates the complementarity of the nucleotide sequences of GMPPB BINDING SITE, designated SEQ ID:45814, to the nucleotide sequence of VGAM1650 RNA, herein designated VGAM RNA, also designated SEQ ID:4361.

Another function of VGAM1650 is therefore inhibition of GMPPB (Accession XM_171044). Accordingly, utilities of VGAM1650 include diagnosis, prevention and treatment of diseases and clinical conditions associated with GMPPB. KIAA0125 (Accession XM_018203) is another VGAM1650 host target gene. KIAA0125 BINDING SITE1 and KIAA0125 BINDING SITE2 are HOST TARGET binding sites found in untranslated regions of mRNA encoded by KIAA0125, corresponding to HOST TARGET binding sites such as BINDING SITE I, BINDING SITE II or BINDING SITE III. Table 2 illustrates the complementarity of the nucleotide sequences of KIAA0125 BINDING SITE1 and KIAA0125 BINDING SITE2, designated SEQ ID:30343 and SEQ ID:16689 respectively, to the nucleotide sequence of VGAM1650 RNA, herein designated VGAM RNA, also designated SEQ ID:4361.

Another function of VGAM1650 is therefore inhibition of KIAA0125 (Accession XM_018203). Accordingly, utilities of VGAM1650 include diagnosis, prevention and treatment of diseases and clinical conditions associated with KIAA0125. LOC143437 (Accession XM_096426) is another VGAM1650 host target gene. LOC143437 BINDING SITE is HOST TARGET binding site found in the 5' untranslated region of mRNA encoded by LOC143437, corresponding to a HOST TARGET binding site such as BINDING SITE I, BINDING SITE II or BINDING SITE III. Table 2 illustrates the complementarity of the nucleotide sequences of LOC143437 BINDING SITE, designated SEQ ID:40358, to the nucleotide sequence of VGAM1650 RNA, herein designated VGAM RNA, also designated SEQ ID:4361.

Another function of VGAM1650 is therefore inhibition of LOC143437 (Accession XM_096426). Accordingly, utilities of VGAM1650 include diagnosis, prevention and treatment of diseases and clinical conditions associated with LOC143437. LOC145989 (Accession XM_004815) is another VGAM1650 host target gene. LOC145989 BINDING SITE is HOST TARGET binding site found in the 3' untranslated region of mRNA encoded by LOC145989, corresponding to a HOST TARGET binding site such as BINDING SITE I, BINDING SITE II or BINDING SITE III. Table 2 illustrates the complementarity of the nucleotide sequences of LOC145989 BINDING SITE, designated SEQ ID:29949, to the nucleotide sequence of VGAM1650 RNA, herein designated VGAM RNA, also designated SEQ ID:4361.

Another function of VGAM1650 is therefore inhibition of LOC145989 (Accession XM_004815). Accordingly, utilities of VGAM1650 include diagnosis, prevention and treatment of diseases and clinical conditions associated with LOC145989. LOC253531 (Accession XM_172868) is another VGAM1650 host target gene. LOC253531 BINDING SITE is HOST TARGET binding site found in the 5' untranslated region of mRNA encoded by LOC253531, corresponding to a HOST TARGET binding site such as BINDING SITE I, BINDING SITE II or BINDING SITE III. Table 2 illustrates the complementarity of the nucleotide sequences of LOC253531 BINDING SITE, designated SEQ ID:46145, to the nucleotide sequence of VGAM1650 RNA, herein designated VGAM RNA, also designated SEQ ID:4361.

Another function of VGAM1650 is therefore inhibition of LOC253531 (Accession XM_172868). Accordingly, utilities of VGAM1650 include diagnosis, prevention and treatment of diseases and clinical conditions associated with LOC253531. FIG. 1 further provides a conceptual description of a novel bioinformatically detected viral gene of the present invention, referred to here as Viral Genomic Address Messenger 1651 (VGAM1651) viral gene, which modulates expression of respective host target genes thereof, the function and utility of which host target genes is known in the art.

VGAM1651 is a novel bioinformatically detected regulatory, non protein coding, viral micro RNA (miRNA) gene. The method by which VGAM1651 was detected is described hereinabove with reference to FIGS. 1-8.

VGAM1651 gene, herein designated VGAM GENE, is a viral gene contained in the genome of Human Herpesvirus 8. VGAM1651 host target gene, herein designated VGAM HOST TARGET GENE, is a human gene contained in the human genome.

VGAM1651 gene encodes a VGAM1651 precursor RNA, herein designated VGAM PRECURSOR RNA. Similar to other miRNA genes, and unlike most ordinary genes, VGAM1651 precursor RNA does not encode a protein. A nucleotide sequence identical or highly similar to the nucleotide sequence of VGAM1651 precursor RNA is designated SEQ ID:1637, and is provided hereinbelow with reference to the sequence listing part. Nucleotide sequence SEQ ID:1637 is located at position 106255 relative to the genome of Human Herpesvirus 8.

VGAM1651 precursor RNA folds onto itself, forming VGAM1651 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1651 folded precursor RNA into VGAM1651 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 78%) nucleotide sequence of VGAM1651 RNA is designated SEQ ID:4362, and is provided hereinbelow with reference to the sequence listing part.

VGAM1651 host target gene, herein designated VGAM HOST TARGET GENE, encodes a corresponding messenger RNA, VGAM1651 host target RNA, herein designated VGAM HOST TARGET RNA. VGAM1651 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1651 RNA, herein designated VGAM RNA, binds complementarily to one or more host target binding sites located in untranslated regions of VGAM1651 host target RNA, herein designated VGAM HOST TARGET RNA. This complementary binding is due to the fact that the nucleotide sequence of VGAM1651 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1651 RNA, herein designated VGAM RNA, may have a different number of host target binding sites in untranslated regions of a VGAM1651 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1651 RNA, herein designated VGAM RNA, to host target binding sites on VGAM1651 host target RNA, herein designated VGAM HOST TARGET RNA, such as BINDING SITE I, BINDING SITE II and BINDING SITE III, inhibits translation of VGAM1651 host target RNA into VGAM1651 host target protein, herein designated VGAM HOST TARGET PROTEIN. VGAM host target protein is therefore outlined by a broken line.

It is appreciated that VGAM1651 host target gene, herein designated VGAM HOST TARGET GENE, in fact represents a plurality of VGAM1651 host target genes. The mRNA of each one of this plurality of VGAM1651 host target genes comprises one or more host target binding sites, each having a nucleotide sequence which is at least partly complementary to VGAM1651 RNA, herein designated VGAM RNA, and which when bound by VGAM1651 RNA causes inhibition of translation of respective one or more VGAM1651 host target proteins.

It is further appreciated by one skilled in the art that the mode of translational inhibition illustrated by FIG. 1 with specific reference to translational inhibition exerted by VGAM1651 gene, herein designated VGAM GENE, on one or more VGAM1651 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1651 is inhibition of expression of host target genes, as part of a novel viral mechanism of attacking a host. Accordingly, utilities of VGAM1651 include diagnosis, prevention and treatment of viral infection by Human Herpesvirus 8. Specific functions, and accordingly utilities, of VGAM1651 correlate with, and may be deduced from, the identity of the host target genes which VGAM1651 binds and inhibits, and the function of these host target genes, as elaborated hereinbelow.

Nucleotide sequences of the VGAM1651 precursor RNA, herein designated VGAM PRECURSOR RNA, and of the 'diced' VGAM1651 RNA, herein designated VGAM RNA, and a schematic representation of the secondary folding of VGAM1651 folded precursor RNA, herein designated VGAM FOLDED PRECURSOR RNA, of VGAM1651 are further described hereinbelow with reference to Table 1.

Nucleotide sequences of host target binding sites, such as BINDING SITE-I, BINDING SITE-II and BINDING SITE-III of FIG. 1, found on VGAM1651 host target RNA, and schematic representation of the complementarity of each of these host target binding sites to VGAM1651 RNA, herein designated VGAM RNA, are described hereinbelow with reference to Table 2.

As mentioned hereinabove with reference to FIG. 1, a function of VGAM1651 gene, herein designated VGAM is inhibition of expression of VGAM1651 target genes. It is appreciated that specific functions, and accordingly utilities, of VGAM1651 correlate with, and may be deduced from, the identity of the target genes which VGAM1651 binds and inhibits, and the function of these target genes, as elaborated hereinbelow.

V-abl Abelson Murine Leukemia Viral Oncogene Homolog 1 (ABL1, Accession NM_005157) is a VGAM1651 host target gene. ABL1 BINDING SITE is HOST TARGET binding site found in the 5' untranslated region of mRNA encoded by ABL1, corresponding to a HOST TARGET binding site such as BINDING SITE I, BINDING SITE II or BINDING SITE III. Table 2 illustrates the complementarity of the nucleotide sequences of ABL1 BINDING SITE, designated SEQ ID:11639, to the nucleotide sequence of VGAM1651 RNA, herein designated VGAM RNA, also designated SEQ ID:4362.

A function of VGAM1651 is therefore inhibition of V-abl Abelson Murine Leukemia Viral Oncogene Homolog 1 (ABL1, Accession NM_005157). Accordingly, utilities of VGAM1651 include diagnosis, prevention and treatment of diseases and clinical conditions associated with ABL1. Chromosome 1 Open Reading Frame 17 (C1orf17, Accession XM_042965) is another VGAM1651 host target gene. C1orf17 BINDING SITE is HOST TARGET binding site found in the 5' untranslated region of mRNA encoded by C1orf17, corresponding to a HOST TARGET binding site such as BINDING SITE I, BINDING SITE II or BINDING SITE III. Table 2 illustrates the complementarity of the nucleotide sequences of C1orf17 BINDING SITE, designated SEQ ID:33854, to the nucleotide sequence of VGAM1651 RNA, herein designated VGAM RNA, also designated SEQ ID:4362.

Another function of VGAM1651 is therefore inhibition of Chromosome 1 Open Reading Frame 17 (C1orf17, Accession XM_042965). Accordingly, utilities of VGAM1651 include diagnosis, prevention and treatment of diseases and clinical conditions associated with C1orf17. Chromosome 1 Open Reading Frame 34 (C1orf34, Accession XM_027172) is another VGAM1651 host target gene. C1orf34 BINDING SITE is HOST TARGET binding site found in the 3' untranslated region of mRNA encoded by C1orf34, corresponding to a HOST TARGET binding site such as BINDING SITE I, BINDING SITE II or BINDING SITE III. Table 2 illustrates the complementarity of the nucleotide sequences of C1orf34 BINDING SITE, designated SEQ ID:30432, to the nucleotide sequence of VGAM1651 RNA, herein designated VGAM RNA, also designated SEQ ID:4362.

Another function of VGAM1651 is therefore inhibition of Chromosome 1 Open Reading Frame 34 (C1orf34, Accession XM_027172). Accordingly, utilities of VGAM1651 include diagnosis, prevention and treatment of diseases and clinical conditions associated with C1orf34. Chondrolectin (CHODL, Accession NM_024944) is another VGAM1651 host target gene. CHODL BINDING SITE is HOST TARGET binding site found in the 3' untranslated region of mRNA encoded by CHODL, corresponding to a HOST TARGET binding site such as BINDING SITE I, BINDING SITE II or BINDING SITE III. Table 2 illustrates the complementarity of the nucleotide sequences of CHODL BINDING SITE, designated SEQ ID:24493, to the nucleotide sequence of VGAM1651 RNA, herein designated VGAM RNA, also designated SEQ ID:4362.

Another function of VGAM1651 is therefore inhibition of Chondrolectin (CHODL, Accession NM_024944). Accordingly, utilities of VGAM1651 include diagnosis, prevention and treatment of diseases and clinical conditions associated with CHODL. DJ465N24.2.1 (Accession NM_020317) is another VGAM1651 host target gene. DJ465N24.2.1 BINDING SITE is HOST TARGET binding site found in the 5' untranslated region of mRNA encoded by DJ465N24.2.1, corresponding to a HOST TARGET binding site such as BINDING SITE I, BINDING SITE II or BINDING SITE III. Table 2 illustrates the complementarity of the nucleotide sequences of DJ465N24.2.1 BINDING SITE, designated SEQ ID:21580, to the nucleotide sequence of VGAM1651 RNA, herein designated VGAM RNA, also designated SEQ ID:4362.

Another function of VGAM1651 is therefore inhibition of DJ465N24.2.1 (Accession NM_020317). Accordingly, utilities of VGAM1651 include diagnosis, prevention and treatment of diseases and clinical conditions associated with DJ465N24.2.1. DKFZp547I014 (Accession NM_020217) is another VGAM1651 host target gene. DKFZp547I014 BINDING SITE is HOST TARGET binding site found in the 5' untranslated region of mRNA encoded by DKFZp547I014, corresponding to a HOST TARGET binding site such as BINDING SITE I, BINDING SITE II or BINDING SITE III. Table 2 illustrates the complementarity of the nucleotide sequences of DKFZp547I014 BINDING SITE, designated SEQ ID:21469, to the nucleotide sequence of VGAM1651 RNA, herein designated VGAM RNA, also designated SEQ ID:4362.

Another function of VGAM1651 is therefore inhibition of DKFZp547I014 (Accession NM_020217). Accordingly, utilities of VGAM1651 include diagnosis, prevention and treatment of diseases and clinical conditions associated with DKFZp547I014. FLJ13052 (Accession NM_023018) is another VGAM1651 host target gene. FLJ13052 BINDING SITE is HOST TARGET binding site found in the 3' untranslated region of mRNA encoded by FLJ13052, corresponding to a HOST TARGET binding site such as BINDING SITE I, BINDING SITE II or BINDING SITE III. Table 2 illustrates the complementarity of the nucleotide sequences of FLJ13052 BINDING SITE, designated SEQ ID:23284, to the nucleotide sequence of VGAM1651 RNA, herein designated VGAM RNA, also designated SEQ ID:4362.

Another function of VGAM1651 is therefore inhibition of FLJ13052 (Accession NM_023018). Accordingly, utilities of VGAM1651 include diagnosis, prevention and treatment of diseases and clinical conditions associated with FLJ13052. KIAA0350 (Accession XM_028332) is another VGAM1651 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30659, to the nucleotide sequence of VGAM1651 RNA, herein designated VGAM RNA, also designated SEQ ID:4362.

Another function of VGAM1651 is therefore inhibition of KIAA0350 (Accession XM_028332). Accordingly, utilities of VGAM1651 include diagnosis, prevention and treatment of diseases and clinical conditions associated with KIAA0350. KIAA0980 (Accession NM_025176) is another VGAM1651 host target gene. KIAA0980 BINDING SITE is HOST TARGET binding site found in the 3' untranslated region of mRNA encoded by KIAA0980, corresponding to a HOST TARGET binding site such as BINDING SITE I, BINDING SITE II or BINDING SITE III. Table 2 illustrates the complementarity of the nucleotide sequences of KIAA0980 BINDING SITE, designated SEQ ID:24810, to the nucleotide sequence of VGAM1651 RNA, herein designated VGAM RNA, also designated SEQ ID:4362.

Another function of VGAM1651 is therefore inhibition of KIAA0980 (Accession NM_025176). Accordingly, utilities of VGAM1651 include diagnosis, prevention and treatment of diseases and clinical conditions associated with KIAA0980. KIAA1529 (Accession XM_047336) is another VGAM1651 host target gene. KIAA1529 BINDING SITE is HOST TARGET binding site found in the 5' untranslated region of mRNA encoded by KIAA1529, corresponding to a HOST TARGET binding site such as BINDING SITE I, BINDING SITE II or BINDING SITE III. Table 2 illustrates the complementarity of the nucleotide sequences of KIAA1529 BINDING SITE, designated SEQ ID:34949, to the nucleotide sequence of VGAM1651 RNA, herein designated VGAM RNA, also designated SEQ ID:4362.

Another function of VGAM1651 is therefore inhibition of KIAA1529 (Accession XM_047336). Accordingly, utilities of VGAM1651 include diagnosis, prevention and treatment of diseases and clinical conditions associated with KIAA1529. KIAA1617 (Accession XM_166140) is another VGAM1651 host target gene. KIAA1617 BINDING SITE is HOST TARGET binding site found in the 3' untranslated region of mRNA encoded by KIAA1617, corresponding to a HOST TARGET binding site such as BINDING SITE I, BINDING SITE II or BINDING SITE III. Table 2 illustrates the complementarity of the nucleotide sequences of KIAA1617 BINDING SITE, designated SEQ ID:43943, to the nucleotide sequence of VGAM1651 RNA, herein designated VGAM RNA, also designated SEQ ID:4362.

Another function of VGAM1651 is therefore inhibition of KIAA1617 (Accession XM_166140). Accordingly, utilities of VGAM1651 include diagnosis, prevention and treatment of diseases and clinical conditions associated with KIAA1617. KIAA1729 (Accession XM_114418) is another VGAM1651 host target gene. KIAA1729 BINDING SITE is HOST TARGET binding site found in the 5' untranslated region of mRNA encoded by KIAA1729, corresponding to a HOST TARGET binding site such as BINDING SITE I, BINDING SITE II or BINDING SITE III. Table 2 illustrates the complementarity of the nucleotide sequences of KIAA1729 BINDING SITE, designated SEQ ID:42952, to the nucleotide sequence of VGAM1651 RNA, herein designated VGAM RNA, also designated SEQ ID:4362.

Another function of VGAM1651 is therefore inhibition of KIAA1729 (Accession XM_114418). Accordingly, utilities of VGAM1651 include diagnosis, prevention and treatment of diseases and clinical conditions associated with KIAA1729. V-maf Musculoaponeurotic Fibrosarcoma Oncogene Homolog B (avian) (MAFB, Accession NM_005461) is another VGAM1651 host target gene. MAFB BINDING SITE is HOST TARGET binding site found in the 3' untranslated region of mRNA encoded by MAFB, corresponding to a HOST TARGET binding site such as BINDING SITE I, BINDING SITE II or BINDING SITE III. Table 2 illustrates the complementarity of the nucleotide sequences of MAFB BINDING SITE, designated SEQ ID:11944, to the nucleotide sequence of VGAM1651 RNA, herein designated VGAM RNA, also designated SEQ ID:4362.

Another function of VGAM1651 is therefore inhibition of V-maf Musculoaponeurotic Fibrosarcoma Oncogene Homolog B (avian) (MAFB, Accession NM_005461). Accordingly, utilities of VGAM1651 include diagnosis, prevention and treatment of diseases and clinical conditions associated with MAFB. MGC13040 (Accession NM_032930) is another VGAM1651 host target gene. MGC13040 BINDING SITE is HOST TARGET binding site found in the 5' untranslated region of mRNA encoded by MGC13040, corresponding to a HOST TARGET binding site such as BINDING SITE I, BINDING SITE II or BINDING SITE III. Table 2 illustrates the complementarity of the nucleotide sequences of MGC13040 BINDING SITE, designated SEQ ID:26754, to the nucleotide sequence of VGAM1651 RNA, herein designated VGAM RNA, also designated SEQ ID:4362.

Another function of VGAM1651 is therefore inhibition of MGC13040 (Accession NM_032930). Accordingly, utilities of VGAM1651 include diagnosis, prevention and treatment of diseases and clinical conditions associated with MGC13040. MIC2 Like 1 (MIC2L1, Accession NM_031462) is another VGAM1651 host target gene. MIC2L1 BINDING SITE is HOST TARGET binding site found in the 3' untranslated region of mRNA encoded by MIC2L1, corresponding to a HOST TARGET binding site such as BINDING SITE I, BINDING SITE II or BINDING SITE III. Table 2 illustrates the complementarity of the nucleotide sequences of MIC2L1 BINDING SITE, designated SEQ ID:25487, to the nucleotide sequence of VGAM1651 RNA, herein designated VGAM RNA, also designated SEQ ID:4362.

Another function of VGAM1651 is therefore inhibition of MIC2 Like 1 (MIC2L1, Accession NM_031462). Accordingly, utilities of VGAM1651 include diagnosis, prevention and treatment of diseases and clinical conditions associated with MIC2L1. RAI (Accession NM_006663) is another VGAM1651 host target gene. RAI BINDING SITE is HOST TARGET binding site found in the 5' untranslated region of mRNA encoded by RAI, corresponding to a HOST TARGET binding site such as BINDING SITE I, BINDING SITE II or BINDING SITE III. Table 2 illustrates the complementarity of the nucleotide sequences of RAI BINDING SITE, designated SEQ ID:13473, to the nucleotide sequence of VGAM1651 RNA, herein designated VGAM RNA, also designated SEQ ID:4362.

Another function of VGAM1651 is therefore inhibition of RAI (Accession NM_006663). Accordingly, utilities of VGAM1651 include diagnosis, prevention and treatment of diseases and clinical conditions associated with RAI.

LOC152059 (Accession XM_087372) is another VGAM1651 host target gene. LOC152059 BINDING SITE is HOST TARGET binding site found in the 5' untranslated region of mRNA encoded by LOC152059, corresponding to a HOST TARGET binding site such as BINDING SITE I, BINDING SITE II or BINDING SITE III. Table 2 illustrates the complementarity of the nucleotide sequences of LOC152059 BINDING SITE, designated SEQ ID:39206, to the nucleotide sequence of VGAM1651 RNA, herein designated VGAM RNA, also designated SEQ ID:4362.

Another function of VGAM1651 is therefore inhibition of LOC152059 (Accession XM_087372). Accordingly, utilities of VGAM1651 include diagnosis, prevention and treatment of diseases and clinical conditions associated with LOC152059. LOC152404 (Accession XM_087460) is another VGAM1651 host target gene. LOC152404 BINDING SITE is HOST TARGET binding site found in the 5' untranslated region of mRNA encoded by LOC152404, corresponding to a HOST TARGET binding site such as BINDING SITE I, BINDING SITE II or BINDING SITE III. Table 2 illustrates the complementarity of the nucleotide sequences of LOC152404 BINDING SITE, designated SEQ ID:39272, to the nucleotide sequence of VGAM1651 RNA, herein designated VGAM RNA, also designated SEQ ID:4362.

Another function of VGAM1651 is therefore inhibition of LOC152404 (Accession XM_087460). Accordingly, utilities of VGAM1651 include diagnosis, prevention and treatment of diseases and clinical conditions associated with LOC152404. LOC197414 (Accession XM_113880) is another VGAM1651 host target gene. LOC197414 BINDING SITE is HOST TARGET binding site found in the 3' untranslated region of mRNA encoded by LOC197414, corresponding to a HOST TARGET binding site such as BINDING SITE I, BINDING SITE II or BINDING SITE III. Table 2 illustrates the complementarity of the nucleotide sequences of LOC197414 BINDING SITE, designated SEQ ID:42516, to the nucleotide sequence of VGAM1651 RNA, herein designated VGAM RNA, also designated SEQ ID:4362.

Another function of VGAM1651 is therefore inhibition of LOC197414 (Accession XM_113880). Accordingly, utilities of VGAM1651 include diagnosis, prevention and treatment of diseases and clinical conditions associated with LOC197414. LOC221463 (Accession XM_166374) is another VGAM1651 host target gene. LOC221463 BINDING SITE is HOST TARGET binding site found in the 3' untranslated region of mRNA encoded by LOC221463, corresponding to a HOST TARGET binding site such as BINDING SITE I, BINDING SITE II or BINDING SITE III. Table 2 illustrates the complementarity of the nucleotide sequences of LOC221463 BINDING SITE, designated SEQ ID:44197, to the nucleotide sequence of VGAM1651 RNA, herein designated VGAM RNA, also designated SEQ ID:4362.

Another function of VGAM1651 is therefore inhibition of LOC221463 (Accession XM_166374). Accordingly, utilities of VGAM1651 include diagnosis, prevention and treatment of diseases and clinical conditions associated with LOC221463. LOC256222 (Accession XM_173177) is another VGAM1651 host target gene. LOC256222 BINDING SITE is HOST TARGET binding site found in the 5' untranslated region of mRNA encoded by LOC256222, corresponding to a HOST TARGET binding site such as BINDING SITE I, BINDING SITE II or BINDING SITE III. Table 2 illustrates the complementarity of the nucleotide sequences of LOC256222 BINDING SITE, designated SEQ ID:46426, to the nucleotide sequence of VGAM1651 RNA, herein designated VGAM RNA, also designated SEQ ID:4362.

Another function of VGAM1651 is therefore inhibition of LOC256222 (Accession XM_173177). Accordingly, utilities of VGAM1651 include diagnosis, prevention and treatment of diseases and clinical conditions associated with LOC256222. LOC57109 (Accession NM_020385) is another VGAM1651 host target gene. LOC57109 BINDING SITE is HOST TARGET binding site found in the 3' untranslated region of mRNA encoded by LOC57109, corresponding to a HOST TARGET binding site such as BINDING SITE I, BINDING SITE II or BINDING SITE III. Table 2 illustrates the complementarity of the nucleotide sequences of LOC57109 BINDING SITE, designated SEQ ID:21654, to the nucleotide sequence of VGAM1651 RNA, herein designated VGAM RNA, also designated SEQ ID:4362.

Another function of VGAM1651 is therefore inhibition of LOC57109 (Accession NM_020385). Accordingly, utilities of VGAM1651 include diagnosis, prevention and treatment of diseases and clinical conditions associated with LOC57109. FIG. 1 further provides a conceptual description of a novel bioinformatically detected viral gene of the present invention, referred to here as Viral Genomic Address Messenger 1652 (VGAM1652) viral gene, which modulates expression of respective host target genes thereof, the function and utility of which host target genes is known in the art.

VGAM1652 is a novel bioinformatically detected regulatory, non protein coding, viral micro RNA (miRNA) gene. The method by which VGAM1652 was detected is described hereinabove with reference to FIGS. 1-8.

VGAM1652 gene, herein designated VGAM GENE, is a viral gene contained in the genome of Yellow Fever Virus. VGAM1652 host target gene, herein designated VGAM HOST TARGET GENE, is a human gene contained in the human genome.

VGAM1652 gene encodes a VGAM1652 precursor RNA, herein designated VGAM PRECURSOR RNA. Similar to other miRNA genes, and unlike most ordinary genes, VGAM1652 precursor RNA does not encode a protein. A nucleotide sequence identical or highly similar to the nucleotide sequence of VGAM1652 precursor RNA is designated SEQ ID:1638, and is provided hereinbelow with reference to the sequence listing part. Nucleotide sequence SEQ ID:1638 is located at position 10776 relative to the genome of Yellow Fever Virus.

VGAM1652 precursor RNA folds onto itself, forming VGAM1652 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1652 folded precursor RNA into VGAM1652 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM1652 RNA is designated SEQ ID:4363, and is provided hereinbelow with reference to the sequence listing part.

VGAM1652 host target gene, herein designated VGAM HOST TARGET GENE, encodes a corresponding messenger RNA, VGAM1652 host target RNA, herein designated VGAM HOST TARGET RNA. VGAM1652 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1652 RNA, herein designated VGAM RNA, binds complementarily to one or more host target binding sites located in untranslated regions of VGAM1652 host target RNA, herein designated VGAM HOST TARGET RNA. This complementary binding is due to the fact that the nucleotide sequence of VGAM1652 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1652 RNA, herein designated VGAM RNA, may have a different number of host target binding sites in untranslated regions of a VGAM1652 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1652 RNA, herein designated VGAM RNA, to host target binding sites on VGAM1652 host target RNA, herein designated VGAM HOST TARGET RNA, such as BINDING SITE I, BINDING SITE II and BINDING SITE III, inhibits translation of VGAM1652 host target RNA into VGAM1652 host target protein, herein designated VGAM HOST TARGET PROTEIN. VGAM host target protein is therefore outlined by a broken line.

It is appreciated that VGAM1652 host target gene, herein designated VGAM HOST TARGET GENE, in fact represents a plurality of VGAM1652 host target genes. The mRNA of each one of this plurality of VGAM1652 host target genes comprises one or more host target binding sites, each having a nucleotide sequence which is at least partly complementary to VGAM1652 RNA, herein designated VGAM RNA, and which when bound by VGAM1652 RNA causes inhibition of translation of respective one or more VGAM1652 host target proteins.

It is further appreciated by one skilled in the art that the mode of translational inhibition illustrated by FIG. 1 with specific reference to translational inhibition exerted by VGAM1652 gene, herein designated VGAM GENE, on one or more VGAM1652 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1652 is inhibition of expression of host target genes, as part of a novel viral mechanism of attacking a host. Accordingly, utilities of VGAM1652 include diagnosis, prevention and treatment of viral infection by Yellow Fever Virus. Specific functions, and accordingly utilities, of VGAM1652 correlate with, and may be deduced from, the identity of the host target genes which VGAM1652 binds and inhibits, and the function of these host target genes, as elaborated hereinbelow.

Nucleotide sequences of the VGAM1652 precursor RNA, herein designated VGAM PRECURSOR RNA, and of the 'diced' VGAM1652 RNA, herein designated VGAM RNA, and a schematic representation of the secondary folding of VGAM1652 folded precursor RNA, herein designated VGAM FOLDED PRECURSOR RNA, of VGAM1652 are further described hereinbelow with reference to Table 1.

Nucleotide sequences of host target binding sites, such as BINDING SITE-I, BINDING SITE-II and BINDING SITE-III of FIG. 1, found on VGAM1652 host target RNA, and schematic representation of the complementarity of each of these host target binding sites to VGAM1652 RNA, herein designated VGAM RNA, are described hereinbelow with reference to Table 2.

As mentioned hereinabove with reference to FIG. 1, a function of VGAM1652 gene, herein designated VGAM is inhibition of expression of VGAM1652 target genes. It is appreciated that specific functions, and accordingly utilities, of VGAM1652 correlate with, and may be deduced from, the identity of the target genes which VGAM1652 binds and inhibits, and the function of these target genes, as elaborated hereinbelow.

Aryl-hydrocarbon Receptor Nuclear Translocator 2 (ARNT2, Accession NM_014862) is a VGAM1652 host target gene. ARNT2 BINDING SITE is HOST TARGET binding site found in the 3' untranslated region of mRNA encoded by ARNT2, corresponding to a HOST TARGET binding site such as BINDING SITE I, BINDING SITE II or BINDING SITE III. Table 2 illustrates the complementarity of the nucleotide sequences of ARNT2 BINDING SITE, designated SEQ ID:16937, to the nucleotide sequence of VGAM1652 RNA, herein designated VGAM RNA, also designated SEQ ID:4363.

A function of VGAM1652 is therefore inhibition of Aryl-hydrocarbon Receptor Nuclear Translocator 2 (ARNT2, Accession NM_014862), a gene which specifically recognizes the xenobiotic response element (xre). Accordingly, utilities of VGAM1652 include diagnosis, prevention and treatment of diseases and clinical conditions associated with ARNT2. The function of ARNT2 and its association with various diseases and clinical conditions, has been established by previous studies, as described hereinabove with reference to VGAM345. Cholinergic Receptor, Nicotinic, Alpha Polypeptide 4 (CHRNA4, Accession NM_000744) is another VGAM1652 host target gene. CHRNA4 BINDING SITE is HOST TARGET binding site found in the 3' untranslated region of mRNA encoded by CHRNA4, corresponding to a HOST TARGET binding site such as BINDING SITE I, BINDING SITE II or BINDING SITE III. Table 2 illustrates the complementarity of the nucleotide sequences of CHRNA4 BINDING SITE, designated SEQ ID:6398, to the nucleotide sequence of VGAM1652 RNA, herein designated VGAM RNA, also designated SEQ ID:4363.

Another function of VGAM1652 is therefore inhibition of Cholinergic Receptor, Nicotinic, Alpha Polypeptide 4 (CHRNA4, Accession NM_000744), a gene which binds acetylcholine and opens an ion-conducting channel across the plasma membrane. Accordingly, utilities of VGAM1652 include diagnosis, prevention and treatment of diseases and clinical conditions associated with CHRNA4. The function of CHRNA4 and its association with various diseases and clinical conditions, has been established by previous studies, as described hereinabove with reference to VGAM1649. DiGeorge Syndrome Critical Region Gene 2 (DGCR2, Accession NM_005137) is another VGAM1652 host target gene. DGCR2 BINDING SITE is HOST TARGET binding site found in the 3' untranslated region of mRNA encoded by DGCR2, corresponding to a HOST TARGET binding site such as BINDING SITE I, BINDING SITE II or BINDING SITE III. Table 2 illustrates the complementarity of the nucleotide sequences of DGCR2 BINDING SITE, designated SEQ ID:11612, to the nucleotide sequence of VGAM1652 RNA, herein designated VGAM RNA, also designated SEQ ID:4363.

Another function of VGAM1652 is therefore inhibition of DiGeorge Syndrome Critical Region Gene 2 (DGCR2, Accession NM_005137), a gene which could intervene in cell-cell or cell-matrix interactions. Accordingly, utilities of VGAM1652 include diagnosis, prevention and treatment of diseases and clinical conditions associated with DGCR2. The function of DGCR2 and its association with various diseases and clinical conditions, has been established by previous studies, as described hereinabove with reference to VGAM1485. Ectodermal Dysplasia 1, Anhidrotic (ED1, Accession NM_001399) is another VGAM1652 host target gene. ED1 BINDING SITE is HOST TARGET binding site found in the 3' untranslated region of mRNA encoded by ED1, corresponding to a HOST TARGET binding site such as BINDING SITE I, BINDING SITE II or BINDING SITE III. Table 2 illustrates the complementarity of the nucleotide sequences of ED1 BINDING SITE, designated SEQ ID:7100, to the nucleotide sequence of VGAM1652 RNA, herein designated VGAM RNA, also designated SEQ ID:4363.

Another function of VGAM1652 is therefore inhibition of Ectodermal Dysplasia 1, Anhidrotic (ED1, Accession NM_001399). Accordingly, utilities of VGAM1652 include diagnosis, prevention and treatment of diseases and clinical conditions associated with ED1. Ephrin-B1 (EFNB1, Accession NM_004429) is another VGAM1652 host target gene. EFNB1 BINDING SITE is HOST TARGET binding site found in the 3' untranslated region of mRNA encoded by EFNB1, corresponding to a HOST TARGET binding site such as BINDING SITE I, BINDING SITE II or BINDING SITE III. Table 2 illustrates the complementarity of the nucleotide sequences of EFNB1 BINDING SITE, designated SEQ ID:10709, to the nucleotide sequence of VGAM1652 RNA, herein designated VGAM RNA, also designated SEQ ID:4363.

Another function of VGAM1652 is therefore inhibition of Ephrin-B1 (EFNB1, Accession NM_004429), a gene which is a transmembrane ligand of Eph-related receptor tyrosine kinases, has a role in cell adhesion. Accordingly, utilities of VGAM1652 include diagnosis, prevention and treatment of diseases and clinical conditions associated with EFNB1. The function of EFNB1 and its association with various diseases and clinical conditions, has been established by previous studies, as described hereinabove with reference to VGAM390. Glucagon-like Peptide 1 Receptor (GLP1R, Accession NM_002062) is another VGAM1652 host target gene. GLP1R BINDING SITE is HOST TARGET binding site found in the 3' untranslated region of mRNA encoded by GLP1R, corresponding to a HOST TARGET binding site such as BINDING SITE I, BINDING SITE II or BINDING SITE III. Table 2 illustrates the complementarity of the nucleotide sequences of GLP1R BINDING SITE, designated SEQ ID:7825, to the nucleotide sequence of VGAM1652 RNA, herein designated VGAM RNA, also designated SEQ ID:4363.

Another function of VGAM1652 is therefore inhibition of Glucagon-like Peptide 1 Receptor (GLP1R, Accession NM_002062), a gene which is mediated by g proteins which activate adenylyl cyclase. Accordingly, utilities of VGAM1652 include diagnosis, prevention and treatment of diseases and clinical conditions associated with GLP1R. The function of GLP1R has been established by previous studies. Glucagon-like peptide-1 (GLP1) is a hormone derived from the preproglucagon molecule (OMIM Ref. No. 138030) and is secreted by intestinal L cells. It is the most potent stimulator of glucose-induced insulin secretion and also suppresses in vivo acid secretion by gastric glands. By transient expression of a rat pancreatic islet cDNA library in COS cells, Thorens (1992) isolated a cDNA for the GLP1 receptor (GLP1R). Transfected into COS cells, the receptor bound GLP1 with high affinity and was coupled to activation of adenylate cyclase. It did not bind peptides of related structure and similar function, such as glucagon (GCG; 138030), gastric inhibitory polypeptide (GIP; 137240), vasoactive intestinal peptide (VIP; 192320), or secretin (SCT; 182099). The receptor is 463 amino acids long and contains 7 transmembrane domains. Sequence homology was found only with the receptors for secretin (SCTR; 182098), calcitonin (CALCR; 114131), and parathyroid hormone (PTHR; 168468), which together form a newly characterized family of G-coupled receptors. Dillon et al. (1993) also cloned a cDNA corresponding to the GLP1R gene. By promoter analysis and electrophoretic mobility shift analysis, Wildhage et al. (1999) showed that the GLP1R promoter binds both SP1 (OMIM Ref. No. 189906) and SP3 (OMIM Ref. No. 601804). They concluded that the basal activity of the GLP1R gene is mediated by 2 proximal SP1-binding sites and that a more distal site acts as a repressor.

Full details of the abovementioned studies are described in the following publications, the disclosure of which are hereby incorporated by reference:

Dillon, J. S.; Tanizawa, Y.; Wheeler, M. B.; Leng, X.-H.; Ligon, B. B.; Rabin, D. U.; Yoo-Warren, H.; Permutt, M. A.; Boyd, A. E., III : Cloning and functional expression of the human glucagon-like peptide-1 (GLP-1) receptor. Endocrinology 133:1907-1910, 1993; and Wildhage, I.; Trusheim, H.; Goke, B.; Lankat-Buttgereit, B.: Gene expression of the human glucagon-like peptide-1 receptor is regulated by Sp1 and Sp3. Endocrinology 140: 624-631, 1999.

Further studies establishing the function and utilities of GLP1R are found in John Hopkins OMIM database record ID 138032, and in sited publications numbered 3167-317 and 3356 listed in the bibliography section hereinbelow, which are also hereby incorporated by reference. Inositol Hexaphosphate Kinase 1 (IHPK1, Accession XM_171045) is another VGAM1652 host target gene. IHPK1 BINDING SITE is HOST TARGET binding site found in the 3' untranslated region of mRNA encoded by IHPK1, corresponding to a HOST TARGET binding site such as BINDING SITE I, BINDING SITE II or BINDING SITE III. Table 2 illustrates the complementarity of the nucleotide sequences of IHPK1 BINDING SITE, designated SEQ ID:45822, to the nucleotide sequence of VGAM1652 RNA, herein designated VGAM RNA, also designated SEQ ID:4363.

Another function of VGAM1652 is therefore inhibition of Inositol Hexaphosphate Kinase 1 (IHPK1, Accession XM_171045), a gene which is a messenger molecule that releases calcium from intracellular stores. Accordingly, utilities of VGAM1652 include diagnosis, prevention and treatment of diseases and clinical conditions associated with IHPK1. The function of IHPK1 and its association with various diseases and clinical conditions, has been established by previous studies, as described hereinabove with reference to VGAM1061. Interleukin 1 Family, Member 5 (delta) (IL1F5, Accession NM_012275) is another VGAM1652 host target gene. IL1F5 BINDING SITE is HOST TARGET binding site found in the 3' untranslated region of mRNA encoded by IL1F5, corresponding to a HOST TARGET binding site such as BINDING SITE I, BINDING SITE II or BINDING SITE III. Table 2 illustrates the complementarity of the nucleotide sequences of IL1F5 BINDING SITE, designated SEQ ID:14597, to the nucleotide sequence of VGAM1652 RNA, herein designated VGAM RNA, also designated SEQ ID:4363.

Another function of VGAM1652 is therefore inhibition of Interleukin 1 Family, Member 5 (delta) (IL1F5, Accession NM_012275), a gene which is a novel interleukin-1 receptor antagonist gene. Accordingly, utilities of VGAM1652 include diagnosis, prevention and treatment of diseases and clinical conditions associated with IL1F5. The function of IL1F5 and its association with various diseases and clinical conditions, has been established by previous studies, as described hereinabove with reference to VGAM263. Jumping Translocation Breakpoint (JTB, Accession NM_006694) is another VGAM1652 host target gene. JTB BINDING SITE is HOST TARGET binding site found in the 5' untranslated region of mRNA encoded by JTB, corresponding to a HOST TARGET binding site such as BINDING SITE I, BINDING SITE II or BINDING SITE III. Table 2 illustrates the complementarity of the nucleotide sequences of JTB BINDING SITE, designated SEQ ID:13514, to the nucleotide sequence of VGAM1652 RNA, herein designated VGAM RNA, also designated SEQ ID:4363.

Another function of VGAM1652 is therefore inhibition of Jumping Translocation Breakpoint (JTB, Accession NM_006694). Accordingly, utilities of VGAM1652 include diagnosis, prevention and treatment of diseases and clinical conditions associated with JTB. Leukemia Inhibitory Factor (cholinergic differentiation factor) (LIF, Accession NM_002309) is another VGAM1652 host target gene. LIF BINDING SITE is HOST TARGET binding site found in the 3' untranslated region of mRNA encoded by LIF, corresponding to a HOST TARGET binding site such as BINDING SITE I, BINDING SITE II or BINDING SITE III. Table 2 illustrates the complementarity of the nucleotide sequences of LIF BINDING SITE, designated SEQ ID:8096, to the nucleotide sequence of VGAM1652 RNA, herein designated VGAM RNA, also designated SEQ ID:4363.

Another function of VGAM1652 is therefore inhibition of Leukemia Inhibitory Factor (cholinergic differentiation factor) (LIF, Accession NM_002309). Accordingly, utilities of VGAM1652 include diagnosis, prevention and treatment of diseases and clinical conditions associated with LIF. Multiple Endocrine Neoplasia I (MEN1, Accession XM_167804) is another VGAM1652 host target gene. MEN1 BINDING SITE is HOST TARGET binding site found in the 5' untranslated region of mRNA encoded by MEN1, corresponding to a HOST TARGET binding site such as BINDING SITE I, BINDING SITE II or BINDING SITE III. Table 2 illustrates the complementarity of the nucleotide sequences of MEN1 BINDING SITE, designated SEQ ID:44841, to the nucleotide sequence of VGAM1652 RNA, herein designated VGAM RNA, also designated SEQ ID:4363.

Another function of VGAM1652 is therefore inhibition of Multiple Endocrine Neoplasia I (MEN1, Accession XM_167804). Accordingly, utilities of VGAM1652 include diagnosis, prevention and treatment of diseases and clinical conditions associated with MEN1. Male-specific Lethal 3-like 1 (Drosophila) (MSL3L1, Accession NM_006800) is another VGAM1652 host target gene. MSL3L1 BINDING SITE is HOST TARGET binding site found in the 5' untranslated region of mRNA encoded by MSL3L1, corresponding to a HOST TARGET binding site such as BINDING SITE I, BINDING SITE II or BINDING SITE III. Table 2 illustrates the complementarity of the nucleotide sequences of MSL3L1 BINDING SITE, designated SEQ ID:13670, to the nucleotide sequence of VGAM1652 RNA, herein designated VGAM RNA, also designated SEQ ID:4363.

Another function of VGAM1652 is therefore inhibition of Male-specific Lethal 3-like 1 (Drosophila) (MSL3L1, Accession NM_006800). Accordingly, utilities of VGAM1652 include diagnosis, prevention and treatment of diseases and clinical conditions associated with MSL3L1. Phosphoinositide-3-kinase, Class 2, Beta Polypeptide (PIK3C2B, Accession NM_002646) is another VGAM1652 host target gene. PIK3C2B BINDING SITE is HOST TARGET binding site found in the 3' untranslated region of mRNA encoded by PIK3C2B, corresponding to a HOST TARGET binding site such as BINDING SITE I, BINDING SITE II or BINDING SITE III. Table 2 illustrates the complementarity of the nucleotide sequences of PIK3C2B BINDING SITE, designated SEQ ID:8506, to the nucleotide sequence of VGAM1652 RNA, herein designated VGAM RNA, also designated SEQ ID:4363.

Another function of VGAM1652 is therefore inhibition of Phosphoinositide-3-kinase, Class 2, Beta Polypeptide (PIK3C2B, Accession NM_002646). Accordingly, utilities of VGAM1652 include diagnosis, prevention and treatment of diseases and clinical conditions associated with PIK3C2B. Phosphomannomutase 2 (PMM2, Accession XM_050755) is another VGAM1652 host target gene. PMM2 BINDING SITE is HOST TARGET binding site found in the 3' untranslated region of mRNA encoded by PMM2, corresponding to a HOST TARGET binding site such as BINDING SITE I, BINDING SITE II or BINDING SITE III. Table 2 illustrates the complementarity of the nucleotide sequences of PMM2 BINDING SITE, designated SEQ ID:35678, to the nucleotide sequence of VGAM1652 RNA, herein designated VGAM RNA, also designated SEQ ID:4363.

Another function of VGAM1652 is therefore inhibition of Phosphomannomutase 2 (PMM2, Accession XM_050755). Accordingly, utilities of VGAM1652 include diagnosis, prevention and treatment of diseases and clinical conditions associated with PMM2. Prokineticin 1 (PROK1, Accession NM_032414) is another VGAM1652 host target gene. PROK1 BINDING SITE is HOST TARGET binding site found in the 3' untranslated region of mRNA encoded by PROK1, corresponding to a HOST TARGET binding site such as BINDING SITE I, BINDING SITE II or BINDING SITE III. Table 2 illustrates the complementarity of the nucleotide sequences of PROK1 BINDING SITE, designated SEQ ID:26198, to the nucleotide sequence of VGAM1652 RNA, herein designated VGAM RNA, also designated SEQ ID:4363.

Another function of VGAM1652 is therefore inhibition of Prokineticin 1 (PROK1, Accession NM_032414), a gene which induces proliferation, migration and fenestration in capillary endothelial cells derived from endocrine glands. Accordingly, utilities of VGAM1652 include diagnosis, prevention and treatment of diseases and clinical conditions associated with PROK1. The function of PROK1 and its association with various diseases and clinical conditions, has been established by previous studies, as described hereinabove with reference to VGAM1000. SH3-domain Binding Protein 2 (SH3BP2, Accession NM_003023) is another VGAM1652 host target gene. SH3BP2 BINDING SITE is HOST TARGET binding site found in the 3' untranslated region of mRNA encoded by SH3BP2, corresponding to a HOST TARGET binding site such as BINDING SITE I, BINDING SITE II or BINDING SITE III. Table 2 illustrates the complementarity of the nucleotide sequences of SH3BP2 BINDING SITE, designated SEQ ID:8945, to the nucleotide sequence of VGAM1652 RNA, herein designated VGAM RNA, also designated SEQ ID:4363.

Another function of VGAM1652 is therefore inhibition of SH3-domain Binding Protein 2 (SH3BP2, Accession NM_003023). Accordingly, utilities of VGAM1652 include diagnosis, prevention and treatment of diseases and clinical conditions associated with SH3BP2. Solute Carrier Family 22 (organic anion/cation transporter), Member 12 (SLC22A12, Accession NM_144585) is another VGAM1652 host target gene. SLC22A12 BINDING SITE is HOST TARGET binding site found in the 5' untranslated region of mRNA encoded by SLC22A12, corresponding to a HOST TARGET binding site such as BINDING SITE I, BINDING SITE II or BINDING SITE III. Table 2 illustrates the complementarity of the nucleotide sequences of SLC22A12 BINDING SITE, designated SEQ ID:29404, to the nucleotide sequence of VGAM1652 RNA, herein designated VGAM RNA, also designated SEQ ID:4363.

Another function of VGAM1652 is therefore inhibition of Solute Carrier Family 22 (organic anion/cation transporter), Member 12 (SLC22A12, Accession NM_144585), a gene which is a urate -anion exchanger regulating blood yrate levels. Accordingly, utilities of VGAM1652 include diagnosis, prevention and treatment of diseases and clinical conditions associated with SLC22A12. The function of SLC22A12 and its association with various diseases and clinical conditions, has been established by previous studies, as described hereinabove with reference to VGAM1034. Secreted Protein, Acidic, Cysteine-rich (osteonectin) (SPARC, Accession NM_003118) is another VGAM1652 host target gene. SPARC BINDING SITE is HOST TARGET binding site found in the 3' untranslated region of mRNA encoded by SPARC, corresponding to a HOST TARGET binding site such as BINDING SITE I, BINDING SITE II or BINDING SITE III. Table 2 illustrates the complementarity of the nucleotide sequences of SPARC BINDING SITE, designated SEQ ID:9089, to the nucleotide sequence of VGAM1652 RNA, herein designated VGAM RNA, also designated SEQ ID:4363.

Another function of VGAM1652 is therefore inhibition of Secreted Protein, Acidic, Cysteine-rich (osteonectin) (SPARC, Accession NM_003118), a gene which. Appears to regulate cell growth through interactions with the extracellular matrix and cytokines. binds calcium and copper, several types of collagen, albumin, thrombospondin, pdgf and cell membranes. Accordingly, utilities of VGAM1652 include diagnosis, prevention and treatment of diseases and clinical conditions associated with SPARC. The function of SPARC has been established by previous studies. PARC is identical to osteonectin (from Latin verb nectere, to bind, bridge or link), a protein important to bone calcification which was identified by Termine et al. (1981). It is a 32,000-dalton, bone-specific phosphoprotein that binds selectively to hydroxyapatite and to collagen fibrils at distinct sites. Osteonectin accounts for the unique property of bone collagen to undergo calcification; type I collagen of bone is identical to that of skin and tendon. In bone, it is present in a concentration of 2.3 micrograms per 10 micrograms of protein. It is present also in dentin but absent from all other tissues. By comparison of protein sequences as well as investigation of the genes, Findlay et al. (1988) concluded that osteonectin is highly conserved between species. Naylor et al. (1989) demonstrated RFLPs of the ON gene which should be useful as markers on chromosome 5 and for investigating the possible role of osteonectin in bone diseases. SPARC, which can be selectively expressed by the endothelium in response to certain types of injury, induces rounding in adherent endothelial cells in vitro. From the results of studies on the influence of SPARC on endothelial permeability, Goldblum et al. (1994) concluded that SPARC regulates endothelial barrier function through F-actin-dependent changes in cell shape, coincident with the appearance of intercellular gaps, that provide a paracellular pathway for extravasation of macromolecules. Animal model experiments lend further support to the function of SPARC. Gilmour et al. (1998) generated mice deficient for SPARC by targeted disruption. SPARC-deficient mice appeared normal and fertile until around 6 months of age, when they developed severe eye pathology characterized by cataract formation and rupture of the lens capsule. The first sign of lens pathology occurred in the equatorial bow region where vacuoles gradually formed within differentiating epithelial cells and fiber cells. The lens capsule, however, showed no qualitative changes in the major basal lamina proteins laminin, collagen IV, perlecan, or entactin.

It is appreciated that the abovementioned animal model for SPARC is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gilmour, D. T.; Lyon, G. J.; Carlton, M. B. L.; Sanes, J. R.; Cunningham, J. M.; Anderson, J. R.; Hogan, B. L. M.; Evans, M. J.; Colledge, W. H.: Mice deficient for the secreted glycoprotein SPARC/osteonectin/BM40 develop normally but show severe age-onset cataract formation and disruption of the lens. EMBO J. 17: 1860-1870, 1998; and Le Beau et al. (1993) mapped the SPARC gene to 5q31.3-q32. SGoldblum, S. E.; Ding, X.; Funk, S. E.; Sage, E. H.: SPARC (secreted protein acidic and rich in cysteine) regulates endotheli.

Further studies establishing the function and utilities of SPARC are found in John Hopkins OMIM database record ID 182120, and in sited publications numbered 10706-10707, 1059 and 11667-10606 listed in the bibliography section hereinbelow, which are also hereby incorporated by reference. TH1-like (Drosophila) (TH1L, Accession NM_016397) is another VGAM1652 host target gene. TH1L BINDING SITE is HOST TARGET binding site found in the 3' untranslated region of mRNA encoded by TH1L, corresponding to a HOST TARGET binding site such as BINDING SITE I, BINDING SITE II or BINDING SITE III. Table 2 illustrates the complementarity of the nucleotide sequences of TH1L BINDING SITE, designated SEQ ID:18537, to the nucleotide sequence of VGAM1652 RNA, herein designated VGAM RNA, also designated SEQ ID:4363.

Another function of VGAM1652 is therefore inhibition of TH1-like (Drosophila) (TH1L, Accession NM_016397). Accordingly, utilities of VGAM1652 include diagnosis, prevention and treatment of diseases and clinical conditions associated with TH1L. Transient Receptor Potential Cation Channel, Subfamily C, Member 1 (TRPC1, Accession NM_003304) is another VGAM1652 host target gene. TRPC1 BINDING SITE is HOST TARGET binding site found in the 3' untranslated region of mRNA encoded by TRPC1, corresponding to a HOST TARGET binding site such as BINDING SITE I, BINDING SITE II or BINDING SITE III. Table 2 illustrates the complementarity of the nucleotide sequences of TRPC1 BINDING SITE, designated SEQ ID:9307, to the nucleotide sequence of VGAM1652 RNA, herein designated VGAM RNA, also designated SEQ ID:4363.

Another function of VGAM1652 is therefore inhibition of Transient Receptor Potential Cation Channel, Subfamily C, Member 1 (TRPC1, Accession NM_003304), a gene which acts as a non-voltage-sensitive store-operated Ca2+ channel. Accordingly, utilities of VGAM1652 include diagnosis, prevention and treatment of diseases and clinical conditions associated with TRPC1. The function of TRPC1 and its association with various diseases and clinical conditions, has been established by previous studies, as described hereinabove with reference to VGAM200. AF9Q34 (Accession NM_032552) is another VGAM1652 host target gene. AF9Q34 BINDING SITE is HOST TARGET binding site found in the 5' untranslated region of mRNA encoded by AF9Q34, corresponding to a HOST TARGET binding site such as BINDING SITE I, BINDING SITE II or BINDING SITE III. Table 2 illustrates the complementarity of the nucleotide sequences of AF9Q34 BINDING SITE, designated SEQ ID:26275, to the nucleotide sequence of VGAM1652 RNA, herein designated VGAM RNA, also designated SEQ ID:4363.

Another function of VGAM1652 is therefore inhibition of AF9Q34 (Accession NM_032552). Accordingly, utilities of VGAM1652 include diagnosis, prevention and treatment of diseases and clinical conditions associated with AF9Q34. Angiomotin Like 1 (AMOTL1, Accession XM_057045) is another VGAM1652 host target gene. AMOTL1 BINDING SITE is HOST TARGET binding site found in the 3' untranslated region of mRNA encoded by AMOTL1, corresponding to a HOST TARGET binding site such as BINDING SITE I, BINDING SITE II or BINDING SITE III. Table 2 illustrates the complementarity of the nucleotide sequences of AMOTL1 BINDING SITE, designated SEQ ID:36464, to the nucleotide sequence of VGAM1652 RNA, herein designated VGAM RNA, also designated SEQ ID:4363.

Another function of VGAM1652 is therefore inhibition of Angiomotin Like 1 (AMOTL1, Accession XM_057045). Accordingly, utilities of VGAM1652 include diagnosis, prevention and treatment of diseases and clinical conditions associated with AMOTL1. Aquaporin 9 (AQP9, Accession NM_020980) is another VGAM1652 host target gene. AQP9 BINDING SITE is HOST TARGET binding site found in the 5' untranslated region of mRNA encoded by AQP9, corresponding to a HOST TARGET binding site such as BINDING SITE I, BINDING SITE II or BINDING SITE III. Table 2 illustrates the complementarity of the nucleotide sequences of AQP9 BINDING SITE, designated SEQ ID:21970, to the nucleotide sequence of VGAM1652 RNA, herein designated VGAM RNA, also designated SEQ ID:4363.

Another function of VGAM1652 is therefore inhibition of Aquaporin 9 (AQP9, Accession NM_020980). Accordingly, utilities of VGAM1652 include diagnosis, prevention and treatment of diseases and clinical conditions associated with AQP9. ARNTL2 (Accession NM_020183) is another VGAM1652 host target gene. ARNTL2 BINDING SITE is HOST TARGET binding site found in the 3' untranslated region of mRNA encoded by ARNTL2, corresponding to a HOST TARGET binding site such as BINDING SITE I, BINDING SITE II or BINDING SITE III. Table 2 illustrates the complementarity of the nucleotide sequences of ARNTL2 BINDING SITE, designated SEQ ID:21416, to the nucleotide sequence of VGAM1652 RNA, herein designated VGAM RNA, also designated SEQ ID:4363.

Another function of VGAM1652 is therefore inhibition of ARNTL2 (Accession NM_020183). Accordingly, utilities of VGAM1652 include diagnosis, prevention and treatment of diseases and clinical conditions associated with ARNTL2. Basic Leucine Zipper Nuclear Factor 1 (JEM-1) (BLZF1, Accession NM_003666) is another VGAM1652 host target gene. BLZF1 BINDING SITE is HOST TARGET binding site found in the 5' untranslated region of mRNA encoded by BLZF1, corresponding to a HOST TARGET binding site such as BINDING SITE I, BINDING SITE II or BINDING SITE III. Table 2 illustrates the complementarity of the nucleotide sequences of BLZF1 BINDING SITE, designated SEQ ID:9750, to the nucleotide sequence of VGAM1652 RNA, herein designated VGAM RNA, also designated SEQ ID:4363.

Another function of VGAM1652 is therefore inhibition of Basic Leucine Zipper Nuclear Factor 1 (JEM-1) (BLZF1, Accession NM_003666). Accordingly, utilities of VGAM1652 include diagnosis, prevention and treatment of diseases and clinical conditions associated with BLZF1. Chromosome 20 Open Reading Frame 160 (C20orf160, Accession NM_080625) is another VGAM1652 host target gene. C20orf160 BINDING SITE is HOST TARGET binding site found in the 3' untranslated region of mRNA encoded by C20orf160, corresponding to a HOST TARGET binding site such as BINDING SITE I, BINDING SITE II or BINDING SITE III. Table 2 illustrates the complementarity of the nucleotide sequences of C20orf160 BINDING SITE, designated SEQ ID:27933, to the nucleotide sequence of VGAM1652 RNA, herein designated VGAM RNA, also designated SEQ ID:4363.

Another function of VGAM1652 is therefore inhibition of Chromosome 20 Open Reading Frame 160 (C20orf160, Accession NM_080625). Accordingly, utilities of VGAM1652 include diagnosis, prevention and treatment of diseases and clinical conditions associated with C20orf160. DKFZP547E2110 (Accession XM_165676) is another VGAM1652 host target gene. DKFZP547E2110 BINDING SITE is HOST TARGET binding site found in the 3' untranslated region of mRNA encoded by DKFZP547E2110, corresponding to a HOST TARGET binding site such as BINDING SITE I, BINDING SITE II or BINDING SITE III. Table 2 illustrates the complementarity of the nucleotide sequences of DKFZP547E2110 BINDING SITE, designated SEQ ID:43730, to the nucleotide sequence of VGAM1652 RNA, herein designated VGAM RNA, also designated SEQ ID:4363.

Another function of VGAM1652 is therefore inhibition of DKFZP547E2110 (Accession XM_165676). Accordingly, utilities of VGAM1652 include diagnosis, prevention and treatment of diseases and clinical conditions associated with DKFZP547E2110. DKFZP586F1524 (Accession NM_015584) is another VGAM1652 host target gene. DKFZP586F1524 BINDING SITE is HOST TARGET binding site found in the 3' untranslated region of mRNA encoded by DKFZP586F1524, corresponding to a HOST TARGET binding site such as BINDING SITE I, BINDING SITE II or BINDING SITE III. Table 2 illustrates the complementarity of the nucleotide sequences of DKFZP586F1524 BINDING SITE, designated SEQ ID:17855, to the nucleotide sequence of VGAM1652 RNA, herein designated VGAM RNA, also designated SEQ ID:4363.

Another function of VGAM1652 is therefore inhibition of DKFZP586F1524 (Accession NM_015584). Accordingly, utilities of VGAM1652 include diagnosis, prevention and treatment of diseases and clinical conditions associated with DKFZP586F1524. Fatty Acid Desaturase 2 (FADS2, Accession NM_004265) is another VGAM1652 host target gene. FADS2 BINDING SITE is HOST TARGET binding site found in the 3' untranslated region of mRNA encoded by FADS2, corresponding to a HOST TARGET binding site such as BINDING SITE I, BINDING SITE II or BINDING SITE III. Table 2 illustrates the complementarity of the nucleotide sequences of FADS2 BINDING SITE, designated SEQ ID:10467, to the nucleotide sequence of VGAM1652 RNA, herein designated VGAM RNA, also designated SEQ ID:4363.

Another function of VGAM1652 is therefore inhibition of Fatty Acid Desaturase 2 (FADS2, Accession NM_004265). Accordingly, utilities of VGAM1652 include diagnosis, prevention and treatment of diseases and clinical conditions associated with FADS2. FLJ00024 (Accession XM_033361) is another VGAM1652 host target gene. FLJ00024 BINDING SITE is HOST TARGET binding site found in the 3' untranslated region of mRNA encoded by FLJ00024, corresponding to a HOST TARGET binding site such as BINDING SITE I, BINDING SITE II or BINDING SITE III. Table 2 illustrates the complementarity of the nucleotide sequences of FLJ00024 BINDING SITE, designated SEQ ID:31895, to the nucleotide sequence of VGAM1652 RNA, herein designated VGAM RNA, also designated SEQ ID:4363.

Another function of VGAM1652 is therefore inhibition of FLJ00024 (Accession XM_033361). Accordingly, utilities of VGAM1652 include diagnosis, prevention and treatment of diseases and clinical conditions associated with FLJ00024. FLJ10201 (Accession NM_018023) is another VGAM1652 host target gene. FLJ10201 BINDING SITE is HOST TARGET binding site found in the 3' untranslated region of mRNA encoded by FLJ10201, corresponding to a HOST TARGET binding site such as BINDING SITE I, BINDING SITE II or BINDING SITE III. Table 2 illustrates the complementarity of the nucleotide sequences of FLJ10201 BINDING SITE, designated SEQ ID:19762, to the nucleotide sequence of VGAM1652 RNA, herein designated VGAM RNA, also designated SEQ ID:4363.

Another function of VGAM1652 is therefore inhibition of FLJ10201 (Accession NM_018023). Accordingly, utilities of VGAM1652 include diagnosis, prevention and treatment of diseases and clinical conditions associated with FLJ10201. FLJ10330 (Accession NM_018061) is another VGAM1652 host target gene. FLJ10330 BINDING SITE is HOST TARGET binding site found in the 3' untranslated region of mRNA encoded by FLJ10330, corresponding to a HOST TARGET binding site such as BINDING SITE I, BINDING SITE II or BINDING SITE III. Table 2 illustrates the complementarity of the nucleotide sequences of FLJ10330 BINDING SITE, designated SEQ ID:19831, to the nucleotide sequence of VGAM1652 RNA, herein designated VGAM RNA, also designated SEQ ID:4363.

Another function of VGAM1652 is therefore inhibition of FLJ10330 (Accession NM_018061). Accordingly, utilities of VGAM1652 include diagnosis, prevention and treatment of diseases and clinical conditions associated with FLJ10330. FLJ10604 (Accession NM_018154) is another VGAM1652 host target gene. FLJ10604 BINDING SITE is HOST TARGET binding site found in the 3' untranslated region of mRNA encoded by FLJ10604, corresponding to a HOST TARGET binding site such as BINDING SITE I, BINDING SITE II or BINDING SITE III. Table 2 illustrates the complementarity of the nucleotide sequences of FLJ10604 BINDING SITE, designated SEQ ID:19963, to the nucleotide sequence of VGAM1652 RNA, herein designated VGAM RNA, also designated SEQ ID:4363.

Another function of VGAM1652 is therefore inhibition of FLJ10604 (Accession NM_018154). Accordingly, utilities of VGAM1652 include diagnosis, prevention and treatment of diseases and clinical conditions associated with FLJ10604. FLJ13181 (Accession NM_025188) is another VGAM1652 host target gene. FLJ13181 BINDING SITE is HOST TARGET binding site found in the 5' untranslated region of mRNA encoded by FLJ13181, corresponding to a HOST TARGET binding site such as BINDING SITE I, BINDING SITE II or BINDING SITE III. Table 2 illustrates the complementarity of the nucleotide sequences of FLJ13181 BINDING SITE, designated SEQ ID:24827, to the nucleotide sequence of VGAM1652 RNA, herein designated VGAM RNA, also designated SEQ ID:4363.

Another function of VGAM1652 is therefore inhibition of FLJ13181 (Accession NM_025188). Accordingly, utilities of VGAM1652 include diagnosis, prevention and treatment of diseases and clinical conditions associated with FLJ13181. FLJ14050 (Accession XM_016361) is another VGAM1652 host target gene. FLJ14050 BINDING SITE is HOST TARGET binding site found in the 5' untranslated region of mRNA encoded by FLJ14050, corresponding to a HOST TARGET binding site such as BINDING SITE I, BINDING SITE II or BINDING SITE III. Table 2 illustrates the complementarity of the nucleotide sequences of FLJ14050 BINDING SITE, designated SEQ ID:30255, to the nucleotide sequence of VGAM1652 RNA, herein designated VGAM RNA, also designated SEQ ID:4363.

Another function of VGAM1652 is therefore inhibition of FLJ14050 (Accession XM_016361). Accordingly, utilities of VGAM1652 include diagnosis, prevention and treatment of diseases and clinical conditions associated with FLJ14050. FLJ14084 (Accession NM_021637) is another VGAM1652 host target gene. FLJ14084 BINDING SITE is HOST TARGET binding site found in the 3' untranslated region of mRNA encoded by FLJ14084, corresponding to a HOST TARGET binding site such as BINDING SITE I, BINDING SITE II or BINDING SITE III. Table 2 illustrates the complementarity of the nucleotide sequences of FLJ14084 BINDING SITE, designated SEQ ID:22283, to the nucleotide sequence of VGAM1652 RNA, herein designated VGAM RNA, also designated SEQ ID:4363.

Another function of VGAM1652 is therefore inhibition of FLJ14084 (Accession NM_021637). Accordingly, utilities of VGAM1652 include diagnosis, prevention and treatment of diseases and clinical conditions associated with FLJ14084. FLJ14346 (Accession NM_025029) is another VGAM1652 host target gene. FLJ14346 BINDING SITE is HOST TARGET binding site found in the 5' untranslated region of mRNA encoded by FLJ14346, corresponding to a HOST TARGET binding site such as BINDING SITE I, BINDING SITE II or BINDING SITE III. Table 2 illustrates the complementarity of the nucleotide sequences of FLJ14346 BINDING SITE, designated SEQ ID:24621, to the nucleotide sequence of VGAM1652 RNA, herein designated VGAM RNA, also designated SEQ ID:4363.

Another function of VGAM1652 is therefore inhibition of FLJ14346 (Accession NM_025029). Accordingly, utilities of VGAM1652 include diagnosis, prevention and treatment of diseases and clinical conditions associated with FLJ14346. FLJ14816 (Accession NM_032845) is another VGAM1652 host target gene. FLJ14816 BINDING SITE is HOST TARGET binding site found in the 3' untranslated region of mRNA encoded by FLJ14816, corresponding to a HOST TARGET binding site such as BINDING SITE I, BINDING SITE II or BINDING SITE III. Table 2 illustrates the complementarity of the nucleotide sequences of FLJ14816 BINDING SITE, designated SEQ ID:26640, to the nucleotide sequence of VGAM1652 RNA, herein designated VGAM RNA, also designated SEQ ID:4363.

Another function of VGAM1652 is therefore inhibition of FLJ14816 (Accession NM_032845). Accordingly, utilities of VGAM1652 include diagnosis, prevention and treatment of diseases and clinical conditions associated with FLJ14816. FLJ20297 (Accession NM_017951) is another VGAM1652 host target gene. FLJ20297 BINDING SITE is HOST TARGET binding site found in the 5' untranslated region of mRNA encoded by FLJ20297, corresponding to a HOST TARGET binding site such as BINDING SITE I, BINDING SITE II or BINDING SITE III. Table 2 illustrates the complementarity of the nucleotide sequences of FLJ20297 BINDING SITE, designated SEQ ID:19650, to the nucleotide sequence of VGAM1652 RNA, herein designated VGAM RNA, also designated SEQ ID:4363.

Another function of VGAM1652 is therefore inhibition of FLJ20297 (Accession NM_017951). Accordingly, utilities of VGAM1652 include diagnosis, prevention and treatment of diseases and clinical conditions associated with FLJ20297. FLJ21313 (Accession NM_023927) is another VGAM1652 host target gene. FLJ21313 BINDING SITE is HOST TARGET binding site found in the 3' untranslated region of mRNA encoded by FLJ21313, corresponding to a HOST TARGET binding site such as BINDING SITE I, BINDING SITE II or BINDING SITE III. Table 2 illustrates the complementarity of the nucleotide sequences of FLJ21313 BINDING SITE, designated SEQ ID:23409, to the nucleotide sequence of VGAM1652 RNA, herein designated VGAM RNA, also designated SEQ ID:4363.

Another function of VGAM1652 is therefore inhibition of FLJ21313 (Accession NM_023927). Accordingly, utilities of VGAM1652 include diagnosis, prevention and treatment of diseases and clinical conditions associated with FLJ21313. GOLGIN-67 (Accession XM_170772) is another VGAM1652 host target gene. GOLGIN-67 BINDING SITE is HOST TARGET binding site found in the 3' untranslated region of mRNA encoded by GOLGIN-67, corresponding to a HOST TARGET binding site such as BINDING SITE I, BINDING SITE II or BINDING SITE III. Table 2 illustrates the complementarity of the nucleotide sequences of GOLGIN-67 BINDING SITE, designated SEQ ID:45535, to the nucleotide sequence of VGAM1652 RNA, herein designated VGAM RNA, also designated SEQ ID:4363.

Another function of VGAM1652 is therefore inhibition of GOLGIN-67 (Accession XM_170772). Accordingly, utilities of VGAM1652 include diagnosis, prevention and treatment of diseases and clinical conditions associated with GOLGIN-67. KIAA0229 (Accession XM_166478) is another VGAM1652 host target gene. KIAA0229 BINDING SITE is HOST TARGET binding site found in the 3' untranslated region of mRNA encoded by KIAA0229, corresponding to a HOST TARGET binding site such as BINDING SITE I, BINDING SITE II or BINDING SITE III. Table 2 illustrates the complementarity of the nucleotide sequences of KIAA0229 BINDING SITE, designated SEQ ID:44400, to the nucleotide sequence of VGAM1652 RNA, herein designated VGAM RNA, also designated SEQ ID:4363.

Another function of VGAM1652 is therefore inhibition of KIAA0229 (Accession XM_166478). Accordingly, utilities of VGAM1652 include diagnosis, prevention and treatment of diseases and clinical conditions associated with KIAA0229. KIAA0247 (Accession NM_014734) is another VGAM1652 host target gene. KIAA0247 BINDING SITE is HOST TARGET binding site found in the 3' untranslated region of mRNA encoded by KIAA0247, corresponding to a HOST TARGET binding site such as BINDING SITE I, BINDING SITE II or BINDING SITE III. Table 2 illustrates the complementarity of the nucleotide sequences of KIAA0247 BINDING SITE, designated SEQ ID:16376, to the nucleotide sequence of VGAM1652 RNA, herein designated VGAM RNA, also designated SEQ ID:4363.

Another function of VGAM1652 is therefore inhibition of KIAA0247 (Accession NM_014734). Accordingly, utilities of VGAM1652 include diagnosis, prevention and treatment of diseases and clinical conditions associated with KIAA0247. KIAA0275 (Accession NM_014767) is another VGAM1652 host target gene. KIAA0275 BINDING SITE is HOST TARGET binding site found in the 3' untranslated region of mRNA encoded by KIAA0275, corresponding to a HOST TARGET binding site such as BINDING SITE I, BINDING SITE II or BINDING SITE III. Table 2 illustrates the complementarity of the nucleotide sequences of KIAA0275 BINDING SITE, designated SEQ ID:16550, to the nucleotide sequence of VGAM1652 RNA, herein designated VGAM RNA, also designated SEQ ID:4363.

Another function of VGAM1652 is therefore inhibition of KIAA0275 (Accession NM_014767). Accordingly, utilities of VGAM1652 include diagnosis, prevention and treatment of diseases and clinical conditions associated with KIAA0275. KIAA0596 (Accession XM_031706) is another VGAM1652 host target gene. KIAA0596 BINDING SITE is HOST TARGET binding site found in the 3' untranslated region of mRNA encoded by KIAA0596, corresponding to a HOST TARGET binding site such as BINDING SITE I, BINDING SITE II or BINDING SITE III. Table 2 illustrates the complementarity of the nucleotide sequences of KIAA0596 BINDING SITE, designated SEQ ID:31467, to the nucleotide sequence of VGAM1652 RNA, herein designated VGAM RNA, also designated SEQ ID:4363.

Another function of VGAM1652 is therefore inhibition of KIAA0596 (Accession XM_031706). Accordingly, utilities of VGAM1652 include diagnosis, prevention and treatment of diseases and clinical conditions associated with KIAA0596. KIAA0682 (Accession NM_016196) is another VGAM1652 host target gene. KIAA0682 BINDING SITE is HOST TARGET binding site found in the 3' untranslated region of mRNA encoded by KIAA0682, corresponding to a HOST TARGET binding site such as BINDING SITE I, BINDING SITE II or BINDING SITE III. Table 2 illustrates the complementarity of the nucleotide sequences of KIAA0682 BINDING SITE, designated SEQ ID:18290, to the nucleotide sequence of VGAM1652 RNA, herein designated VGAM RNA, also designated SEQ ID:4363.

Another function of VGAM1652 is therefore inhibition of KIAA0682 (Accession NM_016196). Accordingly, utilities of VGAM1652 include diagnosis, prevention and treatment of diseases and clinical conditions associated with KIAA0682. KIAA0855 (Accession NM_015003) is another VGAM1652 host target gene. KIAA0855 BINDING SITE is HOST TARGET binding site found in the 3' untranslated region of mRNA encoded by KIAA0855, corresponding to a HOST TARGET binding site such as BINDING SITE I, BINDING SITE II or BINDING SITE III. Table 2 illustrates the complementarity of the nucleotide sequences of KIAA0855 BINDING SITE, designated SEQ ID:17374, to the nucleotide sequence of VGAM1652 RNA, herein designated VGAM RNA, also designated SEQ ID:4363.

Another function of VGAM1652 is therefore inhibition of KIAA0855 (Accession NM_015003). Accordingly, utilities of VGAM1652 include diagnosis, prevention and treatment of diseases and clinical conditions associated with KIAA0855. KIAA0977 (Accession NM_014900) is another VGAM1652 host target gene. KIAA0977 BINDING SITE is HOST TARGET binding site found in the 3' untranslated region of mRNA encoded by KIAA0977, corresponding to a HOST TARGET binding site such as BINDING SITE I, BINDING SITE II or BINDING SITE III. Table 2 illustrates the complementarity of the nucleotide sequences of KIAA0977 BINDING SITE, designated SEQ ID:17082, to the nucleotide sequence of VGAM1652 RNA, herein designated VGAM RNA, also designated SEQ ID:4363.

Another function of VGAM1652 is therefore inhibition of KIAA0977 (Accession NM_014900). Accordingly, utilities of VGAM1652 include diagnosis, prevention and treatment of diseases and clinical conditions associated with KIAA0977. KIAA1014 (Accession XM_037205) is another VGAM1652 host target gene. KIAA1014 BINDING SITE is HOST TARGET binding site found in the 3' untranslated region of mRNA encoded by KIAA1014, corresponding to a HOST TARGET binding site such as BINDING SITE I, BINDING SITE II or BINDING SITE III. Table 2 illustrates the complementarity of the nucleotide sequences of KIAA1014 BINDING SITE, designated SEQ ID:32570, to the nucleotide sequence of VGAM1652 RNA, herein designated VGAM RNA, also designated SEQ ID:4363.

Another function of VGAM1652 is therefore inhibition of KIAA1014 (Accession XM_037205). Accordingly, utilities of VGAM1652 include diagnosis, prevention and treatment of diseases and clinical conditions associated with KIAA1014. KIAA1322 (Accession XM_052626) is another VGAM1652 host target gene. KIAA1322 BINDING SITE is HOST TARGET binding site found in the 3' untranslated region of mRNA encoded by KIAA1322, corresponding to a HOST TARGET binding site such as BINDING SITE I, BINDING SITE II or BINDING SITE III. Table 2 illustrates the complementarity of the nucleotide sequences of KIAA1322 BINDING SITE, designated SEQ ID:36030, to the nucleotide sequence of VGAM1652 RNA, herein designated VGAM RNA, also designated SEQ ID:4363.

Another function of VGAM1652 is therefore inhibition of KIAA1322 (Accession XM_052626). Accordingly, utilities of VGAM1652 include diagnosis, prevention and treatment of diseases and clinical conditions associated with KIAA1322. KIAA1462 (Accession XM_166132) is another VGAM1652 host target gene. KIAA1462 BINDING SITE is HOST TARGET binding site found in the 3' untranslated region of mRNA encoded by KIAA1462, corresponding to a HOST TARGET binding site such as BINDING SITE I, BINDING SITE II or BINDING SITE III. Table 2 illustrates the complementarity of the nucleotide sequences of KIAA1462 BINDING SITE, designated SEQ ID:43924, to the nucleotide sequence of VGAM1652 RNA, herein designated VGAM RNA, also designated SEQ ID:4363.

Another function of VGAM1652 is therefore inhibition of KIAA1462 (Accession XM_166132). Accordingly, utilities of VGAM1652 include diagnosis, prevention and treatment of diseases and clinical conditions associated with KIAA1462. KIAA1497 (Accession XM_041431) is another VGAM1652 host target gene. KIAA1497 BINDING SITE is HOST TARGET binding site found in the 5' untranslated region of mRNA encoded by KIAA1497, corresponding to a HOST TARGET binding site such as BINDING SITE I, BINDING SITE II or BINDING SITE III. Table 2 illustrates the complementarity of the nucleotide sequences of KIAA1497 BINDING SITE, designated SEQ ID:33529, to the nucleotide sequence of VGAM1652 RNA, herein designated VGAM RNA, also designated SEQ ID:4363.

Another function of VGAM1652 is therefore inhibition of KIAA1497 (Accession XM_041431). Accordingly, utilities of VGAM1652 include diagnosis, prevention and treatment of diseases and clinical conditions associated with KIAA1497. KIAA1553 (Accession XM_166320) is another VGAM1652 host target gene. KIAA1553 BINDING SITE is HOST TARGET binding site found in the 3' untranslated region of mRNA encoded by KIAA1553, corresponding to a HOST TARGET binding site such as BINDING SITE I, BINDING SITE II or BINDING SITE III. Table 2 illustrates the complementarity of the nucleotide sequences of KIAA1553 BINDING SITE, designated SEQ ID:44143, to the nucleotide sequence of VGAM1652 RNA, herein designated VGAM RNA, also designated SEQ ID:4363.

Another function of VGAM1652 is therefore inhibition of KIAA1553 (Accession XM_166320). Accordingly, utilities of VGAM1652 include diagnosis, prevention and treatment of diseases and clinical conditions associated with KIAA1553. KIAA1940 (Accession XM_086981) is another VGAM1652 host target gene. KIAA1940 BINDING SITE is HOST TARGET binding site found in the 3' untranslated region of mRNA encoded by KIAA1940, corresponding to a HOST TARGET binding site such as BINDING SITE I, BINDING SITE II or BINDING SITE III. Table 2 illustrates the complementarity of the nucleotide sequences of KIAA1940 BINDING SITE, designated SEQ ID:39010, to the nucleotide sequence of VGAM1652 RNA, herein designated VGAM RNA, also designated SEQ ID:4363.

Another function of VGAM1652 is therefore inhibition of KIAA1940 (Accession XM_086981). Accordingly, utilities of VGAM1652 include diagnosis, prevention and treatment of diseases and clinical conditions associated with KIAA1940. Kinesin Family Member 13B (KIF13B, Accession NM_015254) is another VGAM1652 host target gene. KIF13B BINDING SITE is HOST TARGET binding site found in the 3' untranslated region of mRNA encoded by KIF13B, corresponding to a HOST TARGET binding site such as BINDING SITE I, BINDING SITE II or BINDING SITE III. Table 2 illustrates the complementarity of the nucleotide sequences of KIF13B BINDING SITE, designated SEQ ID:17582, to the nucleotide sequence of VGAM1652 RNA, herein designated VGAM RNA, also designated SEQ ID:4363.

Another function of VGAM1652 is therefore inhibition of Kinesin Family Member 13B (KIF13B, Accession NM_015254). Accordingly, utilities of VGAM1652 include diagnosis, prevention and treatment of diseases and clinical conditions associated with KIF13B. MGC13061 (Accession NM_032322) is another VGAM1652 host target gene. MGC13061 BINDING SITE is HOST TARGET binding site found in the 3' untranslated region of mRNA encoded by MGC13061, corresponding to a HOST TARGET binding site such as BINDING SITE I, BINDING SITE II or BINDING SITE III. Table 2 illustrates the complementarity of the nucleotide sequences of MGC13061 BINDING SITE, designated SEQ ID:26127, to the nucleotide sequence of VGAM1652 RNA, herein designated VGAM RNA, also designated SEQ ID:4363.

Another function of VGAM1652 is therefore inhibition of MGC13061 (Accession NM_032322). Accordingly, utilities of VGAM1652 include diagnosis, prevention and treatment of diseases and clinical conditions associated with MGC13061. Neurogenic Differentiation 6 (NEUROD6, Accession NM_022728) is another VGAM1652 host target gene. NEUROD6 BINDING SITE is HOST TARGET binding site found in the 5' untranslated region of mRNA encoded by NEUROD6, corresponding to a HOST TARGET binding site such as BINDING SITE I, BINDING SITE II or BINDING SITE III. Table 2 illustrates the complementarity of the nucleotide sequences of NEUROD6 BINDING SITE, designated SEQ ID:22929, to the nucleotide sequence of VGAM1652 RNA, herein designated VGAM RNA, also designated SEQ ID:4363.

Another function of VGAM1652 is therefore inhibition of Neurogenic Differentiation 6 (NEUROD6, Accession NM_022728). Accordingly, utilities of VGAM1652 include diagnosis, prevention and treatment of diseases and clinical conditions associated with NEUROD6. NYD-SP29 (Accession XM_059085) is another VGAM1652 host target gene. NYD-SP29 BINDING SITE is HOST TARGET binding site found in the 5' untranslated region of mRNA encoded by NYD-SP29, corresponding to a HOST TARGET binding site such as BINDING SITE I, BINDING SITE II or BINDING SITE III. Table 2 illustrates the complementarity of the nucleotide sequences of NYD-SP29 BINDING SITE, designated SEQ ID:36862, to the nucleotide sequence of VGAM1652 RNA, herein designated VGAM RNA, also designated SEQ ID:4363.

Another function of VGAM1652 is therefore inhibition of NYD-SP29 (Accession XM_059085). Accordingly, utilities of VGAM1652 include diagnosis, prevention and treatment of diseases and clinical conditions associated with NYD-SP29. p25 (Accession NM_007030) is another VGAM1652 host target gene. p25 BINDING SITE is HOST TARGET binding site found in the 3' untranslated region of mRNA encoded by p25, corresponding to a HOST TARGET binding site such as BINDING SITE I, BINDING SITE II or BINDING SITE III. Table 2 illustrates the complementarity of the nucleotide sequences of p25 BINDING SITE, designated SEQ ID:13895, to the nucleotide sequence of VGAM1652 RNA, herein designated VGAM RNA, also designated SEQ ID:4363.

Another function of VGAM1652 is therefore inhibition of p25 (Accession NM_007030). Accordingly, utilities of VGAM1652 include diagnosis, prevention and treatment of diseases and clinical conditions associated with p25. Parvin, Alpha (PARVA, Accession NM_018222) is another VGAM1652 host target gene. PARVA BINDING SITE is HOST TARGET binding site found in the 3' untranslated region of mRNA encoded by PARVA, corresponding to a HOST TARGET binding site such as BINDING SITE I, BINDING SITE II or BINDING SITE III. Table 2 illustrates the complementarity of the nucleotide sequences of PARVA BINDING SITE, designated SEQ ID:20146, to the nucleotide sequence of VGAM1652 RNA, herein designated VGAM RNA, also designated SEQ ID:4363.

Another function of VGAM1652 is therefore inhibition of Parvin, Alpha (PARVA, Accession NM_018222). Accordingly, utilities of VGAM1652 include diagnosis, prevention and treatment of diseases and clinical conditions associated with PARVA. RAS Protein Activator Like 2 (RASAL2, Accession NM_004841) is another VGAM1652 host target gene. RASAL2 BINDING SITE is HOST TARGET binding site found in the 3' untranslated region of mRNA encoded by RASAL2, corresponding to a HOST TARGET binding site such as BINDING SITE I, BINDING SITE II or BINDING SITE III. Table 2 illustrates the complementarity of the nucleotide sequences of RASAL2 BINDING SITE, designated SEQ ID:11249, to the nucleotide sequence of VGAM1652 RNA, herein designated VGAM RNA, also designated SEQ ID:4363.

Another function of VGAM1652 is therefore inhibition of RAS Protein Activator Like 2 (RASAL2, Accession NM_004841). Accordingly, utilities of VGAM1652 include diagnosis, prevention and treatment of diseases and clinical conditions associated with RASAL2. Ring Finger Protein 38 (RNF38, Accession NM_022781) is another VGAM1652 host target gene. RNF38 BINDING SITE is HOST TARGET binding site found in the 3' untranslated region of mRNA encoded by RNF38, corresponding to a HOST TARGET binding site such as BINDING SITE I, BINDING SITE II or BINDING SITE III. Table 2 illustrates the complementarity of the nucleotide sequences of RNF38 BINDING SITE, designated SEQ ID:23060, to the nucleotide sequence of VGAM1652 RNA, herein designated VGAM RNA, also designated SEQ ID:4363.

Another function of VGAM1652 is therefore inhibition of Ring Finger Protein 38 (RNF38, Accession NM_022781). Accordingly, utilities of VGAM1652 include diagnosis, prevention and treatment of diseases and clinical conditions associated with RNF38. Ring Finger Protein (C3HC4 type) 8 (RNF8, Accession NM_003958) is another VGAM1652 host target gene. RNF8 BINDING SITE is HOST TARGET binding site found in the 3' untranslated region of mRNA encoded by RNF8, corresponding to a HOST TARGET binding site such as BINDING SITE I, BINDING SITE II or BINDING SITE III. Table 2 illustrates the complementarity of the nucleotide sequences of RNF8 BINDING SITE, designated SEQ ID:10101, to the nucleotide sequence of VGAM1652 RNA, herein designated VGAM RNA, also designated SEQ ID:4363.

Another function of VGAM1652 is therefore inhibition of Ring Finger Protein (C3HC4 type) 8 (RNF8, Accession NM_003958). Accordingly, utilities of VGAM1652 include diagnosis, prevention and treatment of diseases and clinical conditions associated with RNF8. RNA-binding Region (RNP1, RRM) Containing 2 (RNPC2, Accession NM_004902) is another VGAM1652 host target gene. RNPC2 BINDING SITE is HOST TARGET binding site found in the 3' untranslated region of mRNA encoded by RNPC2, corresponding to a HOST TARGET binding site such as BINDING SITE I, BINDING SITE II or BINDING SITE III. Table 2 illustrates the complementarity of the nucleotide sequences of RNPC2 BINDING SITE, designated SEQ ID:11336, to the nucleotide sequence of VGAM1652 RNA, herein designated VGAM RNA, also designated SEQ ID:4363.

Another function of VGAM1652 is therefore inhibition of RNA-binding Region (RNP1, RRM) Containing 2 (RNPC2, Accession NM_004902). Accordingly, utilities of VGAM1652 include diagnosis, prevention and treatment of diseases and clinical conditions associated with RNPC2. SARM (Accession NM_015077) is another VGAM1652 host target gene. SARM BINDING SITE is HOST TARGET binding site found in the 3' untranslated region of mRNA encoded by SARM, corresponding to a HOST TARGET binding site such as BINDING SITE I, BINDING SITE II or BINDING SITE III. Table 2 illustrates the complementarity of the nucleotide sequences of SARM BINDING SITE, designated SEQ ID:17460, to the nucleotide sequence of VGAM1652 RNA, herein designated VGAM RNA, also designated SEQ ID:4363.

Another function of VGAM1652 is therefore inhibition of SARM (Accession NM_015077). Accordingly, utilities of VGAM1652 include diagnosis, prevention and treatment of diseases and clinical conditions associated with SARM. SEC10-like 1 (S. cerevisiae) (SEC10L1, Accession NM_006544) is another VGAM1652 host target gene. SEC10L1 BINDING SITE is HOST TARGET binding site found in the 5' untranslated region of mRNA encoded by SEC10L1, corresponding to a HOST TARGET binding site such as BINDING SITE I, BINDING SITE II or BINDING SITE III. Table 2 illustrates the complementarity of the nucleotide sequences of SEC10L1 BINDING SITE, designated SEQ ID:13298, to the nucleotide sequence of VGAM1652

RNA, herein designated VGAM RNA, also designated SEQ ID:4363.

Another function of VGAM1652 is therefore inhibition of SEC10-like 1 (S. cerevisiae) (SEC10L1, Accession NM_006544). Accordingly, utilities of VGAM1652 include diagnosis, prevention and treatment of diseases and clinical conditions associated with SEC10L1. SWI/SNF Related, Matrix Associated, Actin Dependent Regulator of Chromatin, Subfamily F, Member 1 (SMARCF1, Accession NM_006015) is another VGAM1652 host target gene. SMARCF1 BINDING SITE1 through SMARCF1 BINDING SITE3 are HOST TARGET binding sites found in untranslated regions of mRNA encoded by SMARCF1, corresponding to HOST TARGET binding sites such as BINDING SITE I, BINDING SITE II or BINDING SITE III. Table 2 illustrates the complementarity of the nucleotide sequences of SMARCF1 BINDING SITE1 through SMARCF1 BINDING SITE3, designated SEQ ID:12626, SEQ ID:20521 and SEQ ID:29164 respectively, to the nucleotide sequence of VGAM1652 RNA, herein designated VGAM RNA, also designated SEQ ID:4363.

Another function of VGAM1652 is therefore inhibition of SWI/SNF Related, Matrix Associated, Actin Dependent Regulator of Chromatin, Subfamily F, Member 1 (SMARCF1, Accession NM_006015). Accordingly, utilities of VGAM1652 include diagnosis, prevention and treatment of diseases and clinical conditions associated with SMARCF1. T-box 4 (TBX4, Accession NM_018488) is another VGAM1652 host target gene. TBX4 BINDING SITE is HOST TARGET binding site found in the 3' untranslated region of mRNA encoded by TBX4, corresponding to a HOST TARGET binding site such as BINDING SITE I, BINDING SITE II or BINDING SITE III. Table 2 illustrates the complementarity of the nucleotide sequences of TBX4 BINDING SITE, designated SEQ ID:20545, to the nucleotide sequence of VGAM1652 RNA, herein designated VGAM RNA, also designated SEQ ID:4363.

Another function of VGAM1652 is therefore inhibition of T-box 4 (TBX4, Accession NM_018488). Accordingly, utilities of VGAM1652 include diagnosis, prevention and treatment of diseases and clinical conditions associated with TBX4. ZFP106 (Accession NM_022473) is another VGAM1652 host target gene. ZFP106 BINDING SITE is HOST TARGET binding site found in the 3' untranslated region of mRNA encoded by ZFP106, corresponding to a HOST TARGET binding site such as BINDING SITE I, BINDING SITE II or BINDING SITE III. Table 2 illustrates the complementarity of the nucleotide sequences of ZFP106 BINDING SITE, designated SEQ ID:22831, to the nucleotide sequence of VGAM1652 RNA, herein designated VGAM RNA, also designated SEQ ID:4363.

Another function of VGAM1652 is therefore inhibition of ZFP106 (Accession NM_022473). Accordingly, utilities of VGAM1652 include diagnosis, prevention and treatment of diseases and clinical conditions associated with ZFP106. LOC112868 (Accession XM_053402) is another VGAM1652 host target gene. LOC112868 BINDING SITE is HOST TARGET binding site found in the 3' untranslated region of mRNA encoded by LOC112868, corresponding to a HOST TARGET binding site such as BINDING SITE I, BINDING SITE II or BINDING SITE III. Table 2 illustrates the complementarity of the nucleotide sequences of LOC112868 BINDING SITE, designated SEQ ID:36082, to the nucleotide sequence of VGAM1652 RNA, herein designated VGAM RNA, also designated SEQ ID:4363.

Another function of VGAM1652 is therefore inhibition of LOC112868 (Accession XM_053402). Accordingly, utilities of VGAM1652 include diagnosis, prevention and treatment of diseases and clinical conditions associated with LOC112868. LOC124842 (Accession XM_064333) is another VGAM1652 host target gene. LOC124842 BINDING SITE is HOST TARGET binding site found in the 3' untranslated region of mRNA encoded by LOC124842, corresponding to a HOST TARGET binding site such as BINDING SITE I, BINDING SITE II or BINDING SITE III. Table 2 illustrates the complementarity of the nucleotide sequences of LOC124842 BINDING SITE, designated SEQ ID:37263, to the nucleotide sequence of VGAM1652 RNA, herein designated VGAM RNA, also designated SEQ ID:4363.

Another function of VGAM1652 is therefore inhibition of LOC124842 (Accession XM_064333). Accordingly, utilities of VGAM1652 include diagnosis, prevention and treatment of diseases and clinical conditions associated with LOC124842. LOC126302 (Accession XM_059020) is another VGAM1652 host target gene. LOC126302 BINDING SITE is HOST TARGET binding site found in the 3' untranslated region of mRNA encoded by LOC126302, corresponding to a HOST TARGET binding site such as BINDING SITE I, BINDING SITE II or BINDING SITE III. Table 2 illustrates the complementarity of the nucleotide sequences of LOC126302 BINDING SITE, designated SEQ ID:36823, to the nucleotide sequence of VGAM1652 RNA, herein designated VGAM RNA, also designated SEQ ID:4363.

Another function of VGAM1652 is therefore inhibition of LOC126302 (Accession XM_059020). Accordingly, utilities of VGAM1652 include diagnosis, prevention and treatment of diseases and clinical conditions associated with LOC126302. LOC126661 (Accession XM_059061) is another VGAM1652 host target gene. LOC126661 BINDING SITE is HOST TARGET binding site found in the 5' untranslated region of mRNA encoded by LOC126661, corresponding to a HOST TARGET binding site such as BINDING SITE I, BINDING SITE II or BINDING SITE III. Table 2 illustrates the complementarity of the nucleotide sequences of LOC126661 BINDING SITE, designated SEQ ID:36854, to the nucleotide sequence of VGAM1652 RNA, herein designated VGAM RNA, also designated SEQ ID:4363.

Another function of VGAM1652 is therefore inhibition of LOC126661 (Accession XM_059061). Accordingly, utilities of VGAM1652 include diagnosis, prevention and treatment of diseases and clinical conditions associated with LOC126661. LOC130355 (Accession XM_059423) is another VGAM1652 host target gene. LOC130355 BINDING SITE is HOST TARGET binding site found in the 5' untranslated region of mRNA encoded by LOC130355, corresponding to a HOST TARGET binding site such as BINDING SITE I, BINDING SITE II or BINDING SITE III. Table 2 illustrates the complementarity of the nucleotide sequences of LOC130355 BINDING SITE, designated SEQ ID:36989, to the nucleotide sequence of VGAM1652 RNA, herein designated VGAM RNA, also designated SEQ ID:4363.

Another function of VGAM1652 is therefore inhibition of LOC130355 (Accession XM_059423). Accordingly, utilities of VGAM1652 include diagnosis, prevention and treatment of diseases and clinical conditions associated with LOC130355. LOC130752 (Accession XM_059468) is another VGAM1652 host target gene. LOC130752 BINDING SITE is HOST TARGET binding site found in the 3' untranslated region of mRNA encoded by LOC130752, corresponding to a HOST TARGET binding site such as BINDING SITE I, BINDING SITE II or BINDING SITE III. Table 2 illustrates the complementarity of the nucleotide sequences of LOC130752 BINDING SITE, designated SEQ ID:37006, to the nucleotide sequence of VGAM1652 RNA, herein designated VGAM RNA, also designated SEQ ID:4363.

Another function of VGAM1652 is therefore inhibition of LOC130752 (Accession XM_059468). Accordingly, utilities of VGAM1652 include diagnosis, prevention and treatment of diseases and clinical conditions associated with LOC130752. LOC144501 (Accession XM_096612) is another VGAM1652 host target gene. LOC144501 BINDING SITE is HOST TARGET binding site found in the 3' untranslated region of mRNA encoded by LOC144501, corresponding to a HOST TARGET binding site such as BINDING SITE I, BINDING SITE II or BINDING SITE III. Table 2 illustrates the complementarity of the nucleotide sequences of LOC144501 BINDING SITE, designated SEQ ID:40423, to the nucleotide sequence of VGAM1652 RNA, herein designated VGAM RNA, also designated SEQ ID:4363.

Another function of VGAM1652 is therefore inhibition of LOC144501 (Accession XM_096612). Accordingly, utilities of VGAM1652 include diagnosis, prevention and treatment of diseases and clinical conditions associated with LOC144501. LOC145988 (Accession XM_085290) is another VGAM1652 host target gene. LOC145988 BINDING SITE is HOST TARGET binding site found in the 3' untranslated region of mRNA encoded by LOC145988, corresponding to a HOST TARGET binding site such as BINDING SITE I, BINDING SITE II or BINDING SITE III. Table 2 illustrates the complementarity of the nucleotide sequences of LOC145988 BINDING SITE, designated SEQ ID:38039, to the nucleotide sequence of VGAM1652 RNA, herein designated VGAM RNA, also designated SEQ ID:4363.

Another function of VGAM1652 is therefore inhibition of LOC145988 (Accession XM_085290). Accordingly, utilities of VGAM1652 include diagnosis, prevention and treatment of diseases and clinical conditions associated with LOC145988. LOC149603 (Accession XM_047499) is another VGAM1652 host target gene. LOC149603 BINDING SITE is HOST TARGET binding site found in the 3' untranslated region of mRNA encoded by LOC149603, corresponding to a HOST TARGET binding site such as BINDING SITE I, BINDING SITE II or BINDING SITE III. Table 2 illustrates the complementarity of the nucleotide sequences of LOC149603 BINDING SITE, designated SEQ ID:34970, to the nucleotide sequence of VGAM1652 RNA, herein designated VGAM RNA, also designated SEQ ID:4363.

Another function of VGAM1652 is therefore inhibition of LOC149603 (Accession XM_047499). Accordingly, utilities of VGAM1652 include diagnosis, prevention and treatment of diseases and clinical conditions associated with LOC149603. LOC149619 (Accession XM_097690) is another VGAM1652 host target gene. LOC149619 BINDING SITE is HOST TARGET binding site found in the 5' untranslated region of mRNA encoded by LOC149619, corresponding to a HOST TARGET binding site such as BINDING SITE I, BINDING SITE II or BINDING SITE III. Table 2 illustrates the complementarity of the nucleotide sequences of LOC149619 BINDING SITE, designated SEQ ID:41028, to the nucleotide sequence of VGAM1652 RNA, herein designated VGAM RNA, also designated SEQ ID:4363.

Another function of VGAM1652 is therefore inhibition of LOC149619 (Accession XM_097690). Accordingly, utilities of VGAM1652 include diagnosis, prevention and treatment of diseases and clinical conditions associated with LOC149619. LOC150819 (Accession XM_097954) is another VGAM1652 host target gene. LOC150819 BINDING SITE is HOST TARGET binding site found in the 3' untranslated region of mRNA encoded by LOC150819, corresponding to a HOST TARGET binding site such as BINDING SITE I, BINDING SITE II or BINDING SITE III. Table 2 illustrates the complementarity of the nucleotide sequences of LOC150819 BINDING SITE, designated SEQ ID:41247, to the nucleotide sequence of VGAM1652 RNA, herein designated VGAM RNA, also designated SEQ ID:4363.

Another function of VGAM1652 is therefore inhibition of LOC150819 (Accession XM_097954). Accordingly, utilities of VGAM1652 include diagnosis, prevention and treatment of diseases and clinical conditions associated with LOC150819. LOC151521 (Accession XM_098076) is another VGAM1652 host target gene. LOC151521 BINDING SITE is HOST TARGET binding site found in the 3' untranslated region of mRNA encoded by LOC151521, corresponding to a HOST TARGET binding site such as BINDING SITE I, BINDING SITE II or BINDING SITE III. Table 2 illustrates the complementarity of the nucleotide sequences of LOC151521 BINDING SITE, designated SEQ ID:41369, to the nucleotide sequence of VGAM1652 RNA, herein designated VGAM RNA, also designated SEQ ID:4363.

Another function of VGAM1652 is therefore inhibition of LOC151521 (Accession XM_098076). Accordingly, utilities of VGAM1652 include diagnosis, prevention and treatment of diseases and clinical conditions associated with LOC151521. LOC152765 (Accession XM_087519) is another VGAM1652 host target gene. LOC152765 BINDING SITE is HOST TARGET binding site found in the 5' untranslated region of mRNA encoded by LOC152765, corresponding to a HOST TARGET binding site such as BINDING SITE I, BINDING SITE II or BINDING SITE III. Table 2 illustrates the complementarity of the nucleotide sequences of LOC152765 BINDING SITE, designated SEQ ID:39316, to the nucleotide sequence of VGAM1652 RNA, herein designated VGAM RNA, also designated SEQ ID:4363.

Another function of VGAM1652 is therefore inhibition of LOC152765 (Accession XM_087519). Accordingly, utilities of VGAM1652 include diagnosis, prevention and treatment of diseases and clinical conditions associated with LOC152765. LOC152925 (Accession XM_087559) is another VGAM1652 host target gene. LOC152925 BINDING SITE is HOST TARGET binding site found in the 3' untranslated region of mRNA encoded by LOC152925, corresponding to a HOST TARGET binding site such as BINDING SITE I, BINDING SITE II or BINDING SITE III. Table 2 illustrates the complementarity of the nucleotide sequences of LOC152925 BINDING SITE, designated SEQ ID:39332, to the nucleotide sequence of VGAM1652 RNA, herein designated VGAM RNA, also designated SEQ ID:4363.

Another function of VGAM1652 is therefore inhibition of LOC152925 (Accession XM_087559). Accordingly, utilities of VGAM1652 include diagnosis, prevention and treatment of diseases and clinical conditions associated with LOC152925. LOC204301 (Accession XM_115306) is another VGAM1652 host target gene. LOC204301 BINDING SITE is HOST TARGET binding site found in the 3' untranslated region of mRNA encoded by LOC204301, corresponding to a HOST TARGET binding site such as BINDING SITE I, BINDING SITE II or BINDING SITE III. Table 2 illustrates the complementarity of the nucleotide sequences of LOC204301 BINDING SITE, designated SEQ ID:43093, to the nucleotide sequence of VGAM1652 RNA, herein designated VGAM RNA, also designated SEQ ID:4363.

Another function of VGAM1652 is therefore inhibition of LOC204301 (Accession XM_115306). Accordingly, utilities of VGAM1652 include diagnosis, prevention and treatment of diseases and clinical conditions associated with LOC204301. LOC205313 (Accession XM_119628) is another VGAM1652 host target gene. LOC205313 BIND- ING SITE is HOST TARGET binding site found in the 5' untranslated region of mRNA encoded by LOC205313, corresponding to a HOST TARGET binding site such as BINDING SITE I, BINDING SITE II or BINDING SITE III. Table 2 illustrates the complementarity of the nucleotide sequences of LOC205313 BINDING SITE, designated SEQ ID:43594, to the nucleotide sequence of VGAM1652 RNA, herein designated VGAM RNA, also designated SEQ ID:4363.

Another function of VGAM1652 is therefore inhibition of LOC205313 (Accession XM_119628). Accordingly, utilities of VGAM1652 include diagnosis, prevention and treatment of diseases and clinical conditions associated with LOC205313. LOC221751 (Accession XM_166370) is another VGAM1652 host target gene. LOC221751 BINDING SITE is HOST TARGET binding site found in the 5' untranslated region of mRNA encoded by LOC221751, corresponding to a HOST TARGET binding site such as BINDING SITE I, BINDING SITE II or BINDING SITE III. Table 2 illustrates the complementarity of the nucleotide sequences of LOC221751 BINDING SITE, designated SEQ ID:44192, to the nucleotide sequence of VGAM1652 RNA, herein designated VGAM RNA, also designated SEQ ID:4363.

Another function of VGAM1652 is therefore inhibition of LOC221751 (Accession XM_166370). Accordingly, utilities of VGAM1652 include diagnosis, prevention and treatment of diseases and clinical conditions associated with LOC221751. LOC253350 (Accession XM_174261) is another VGAM1652 host target gene. LOC253350 BINDING SITE is HOST TARGET binding site found in the 5' untranslated region of mRNA encoded by LOC253350, corresponding to a HOST TARGET binding site such as BINDING SITE I, BINDING SITE II or BINDING SITE III. Table 2 illustrates the complementarity of the nucleotide sequences of LOC253350 BINDING SITE, designated SEQ ID:46587, to the nucleotide sequence of VGAM1652 RNA, herein designated VGAM RNA, also designated SEQ ID:4363.

Another function of VGAM1652 is therefore inhibition of LOC253350 (Accession XM_174261). Accordingly, utilities of VGAM1652 include diagnosis, prevention and treatment of diseases and clinical conditions associated with LOC253350. LOC253981 (Accession XM_171064) is another VGAM1652 host target gene. LOC253981 BINDING SITE is HOST TARGET binding site found in the 3' untranslated region of mRNA encoded by LOC253981, corresponding to a HOST TARGET binding site such as BINDING SITE I, BINDING SITE II or BINDING SITE III. Table 2 illustrates the complementarity of the nucleotide sequences of LOC253981 BINDING SITE, designated SEQ ID:45863, to the nucleotide sequence of VGAM1652 RNA, herein designated VGAM RNA, also designated SEQ ID:4363.

Another function of VGAM1652 is therefore inhibition of LOC253981 (Accession XM_171064). Accordingly, utilities of VGAM1652 include diagnosis, prevention and treatment of diseases and clinical conditions associated with LOC253981. LOC254358 (Accession XM_170771) is another VGAM1652 host target gene. LOC254358 BINDING SITE is HOST TARGET binding site found in the 3' untranslated region of mRNA encoded by LOC254358, corresponding to a HOST TARGET binding site such as BINDING SITE I, BINDING SITE II or BINDING SITE III. Table 2 illustrates the complementarity of the nucleotide sequences of LOC254358 BINDING SITE, designated SEQ ID:45531, to the nucleotide sequence of VGAM1652 RNA, herein designated VGAM RNA, also designated SEQ ID:4363.

Another function of VGAM1652 is therefore inhibition of LOC254358 (Accession XM_170771). Accordingly, utilities of VGAM1652 include diagnosis, prevention and treatment of diseases and clinical conditions associated with LOC254358. LOC257476 (Accession XM_028610) is another VGAM1652 host target gene. LOC257476 BINDING SITE is HOST TARGET binding site found in the 3' untranslated region of mRNA encoded by LOC257476, corresponding to a HOST TARGET binding site such as BINDING SITE I, BINDING SITE II or BINDING SITE III. Table 2 illustrates the complementarity of the nucleotide sequences of LOC257476 BINDING SITE, designated SEQ ID:30714, to the nucleotide sequence of VGAM1652 RNA, herein designated VGAM RNA, also designated SEQ ID:4363.

Another function of VGAM1652 is therefore inhibition of LOC257476 (Accession XM_028610). Accordingly, utilities of VGAM1652 include diagnosis, prevention and treatment of diseases and clinical conditions associated with LOC257476. LOC64102 (Accession NM_022144) is another VGAM1652 host target gene. LOC64102 BINDING SITE is HOST TARGET binding site found in the 5' untranslated region of mRNA encoded by LOC64102, corresponding to a HOST TARGET binding site such as BINDING SITE I, BINDING SITE II or BINDING SITE III. Table 2 illustrates the complementarity of the nucleotide sequences of LOC64102 BINDING SITE, designated SEQ ID:22708, to the nucleotide sequence of VGAM1652 RNA, herein designated VGAM RNA, also designated SEQ ID:4363.

Another function of VGAM1652 is therefore inhibition of LOC64102 (Accession NM_022144). Accordingly, utilities of VGAM1652 include diagnosis, prevention and treatment of diseases and clinical conditions associated with LOC64102. FIG. 1 further provides a conceptual description of a novel bioinformatically detected viral gene of the present invention, referred to here as Viral Genomic Address Messenger 1653 (VGAM1653) viral gene, which modulates expression of respective host target genes thereof, the function and utility of which host target genes is known in the art.

VGAM1653 is a novel bioinformatically detected regulatory, non protein coding, viral micro RNA (miRNA) gene. The method by which VGAM1653 was detected is described hereinabove with reference to FIGS. 1-8.

VGAM1653 gene, herein designated VGAM GENE, is a viral gene contained in the genome of Yellow Fever Virus. VGAM1653 host target gene, herein designated VGAM HOST TARGET GENE, is a human gene contained in the human genome.

VGAM1653 gene encodes a VGAM1653 precursor RNA, herein designated VGAM PRECURSOR RNA. Similar to other miRNA genes, and unlike most ordinary genes, VGAM1653 precursor RNA does not encode a protein. A nucleotide sequence identical or highly similar to the nucleotide sequence of VGAM1653 precursor RNA is designated SEQ ID:1639, and is provided hereinbelow with reference to the sequence listing part. Nucleotide sequence SEQ ID:1639 is located at position 2036 relative to the genome of Yellow Fever Virus.

VGAM1653 precursor RNA folds onto itself, forming VGAM1653 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1653 folded precursor RNA into VGAM1653 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1653 RNA is designated SEQ ID:4364, and is provided hereinbelow with reference to the sequence listing part.

VGAM1653 host target gene, herein designated VGAM HOST TARGET GENE, encodes a corresponding messenger RNA, VGAM1653 host target RNA, herein designated VGAM HOST TARGET RNA. VGAM1653 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1653 RNA, herein designated VGAM RNA, binds complementarily to one or more host target binding sites located in untranslated regions of VGAM1653 host target RNA, herein designated VGAM HOST TARGET RNA. This complementary binding is due to the fact that the nucleotide sequence of VGAM1653 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1653 RNA, herein designated VGAM RNA, may have a different number of host target binding sites in untranslated regions of a VGAM1653 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1653 RNA, herein designated VGAM RNA, to host target binding sites on VGAM1653 host target RNA, herein designated VGAM HOST TARGET RNA, such as BINDING SITE I, BINDING SITE II and BINDING SITE III, inhibits translation of VGAM1653 host target RNA into VGAM1653 host target protein, herein designated VGAM HOST TARGET PROTEIN. VGAM host target protein is therefore outlined by a broken line.

It is appreciated that VGAM1653 host target gene, herein designated VGAM HOST TARGET GENE, in fact represents a plurality of VGAM1653 host target genes. The mRNA of each one of this plurality of VGAM1653 host target genes comprises one or more host target binding sites, each having a nucleotide sequence which is at least partly complementary to VGAM1653 RNA, herein designated VGAM RNA, and which when bound by VGAM1653 RNA causes inhibition of translation of respective one or more VGAM1653 host target proteins.

It is further appreciated by one skilled in the art that the mode of translational inhibition illustrated by FIG. 1 with specific reference to translational inhibition exerted by VGAM1653 gene, herein designated VGAM GENE, on one or more VGAM1653 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1653 is inhibition of expression of host target genes, as part of a novel viral mechanism of attacking a host. Accordingly, utilities of VGAM1653 include diagnosis, prevention and treatment of viral infection by Yellow Fever Virus. Specific functions, and accordingly utilities, of VGAM1653 correlate with, and may be deduced from, the identity of the host target genes which VGAM1653 binds and inhibits, and the function of these host target genes, as elaborated hereinbelow.

Nucleotide sequences of the VGAM1653 precursor RNA, herein designated VGAM PRECURSOR RNA, and of the 'diced' VGAM1653 RNA, herein designated VGAM RNA, and a schematic representation of the secondary folding of VGAM1653 folded precursor RNA, herein designated VGAM FOLDED PRECURSOR RNA, of VGAM1653 are further described hereinbelow with reference to Table 1.

Nucleotide sequences of host target binding sites, such as BINDING SITE-I, BINDING SITE-II and BINDING SITE-III of FIG. 1, found on VGAM1653 host target RNA, and schematic representation of the complementarity of each of these host target binding sites to VGAM1653 RNA, herein designated VGAM RNA, are described hereinbelow with reference to Table 2.

As mentioned hereinabove with reference to FIG. 1, a function of VGAM1653 gene, herein designated VGAM is inhibition of expression of VGAM1653 target genes. It is appreciated that specific functions, and accordingly utilities, of VGAM1653 correlate with, and may be deduced from, the identity of the target genes which VGAM1653 binds and inhibits, and the function of these target genes, as elaborated hereinbelow.

Inositol Hexaphosphate Kinase 3 (IHPK3, Accession NM_054111) is a VGAM1653 host target gene. IHPK3 BINDING SITE is HOST TARGET binding site found in the 3' untranslated region of mRNA encoded by IHPK3, corresponding to a HOST TARGET binding site such as BINDING SITE I, BINDING SITE II or BINDING SITE III. Table 2 illustrates the complementarity of the nucleotide sequences of IHPK3 BINDING SITE, designated SEQ ID:27653, to the nucleotide sequence of VGAM1653 RNA, herein designated VGAM RNA, also designated SEQ ID:4364.

A function of VGAM1653 is therefore inhibition of Inositol Hexaphosphate Kinase 3 (IHPK3, Accession NM_054111). Accordingly, utilities of VGAM1653 include diagnosis, prevention and treatment of diseases and clinical conditions associated with IHPK3. Retinal Degeneration, Slow (retinitis pigmentosa 7) (RDS, Accession NM_000322) is another VGAM1653 host target gene. RDS BINDING SITE is HOST TARGET binding site found in the 3' untranslated region of mRNA encoded by RDS, corresponding to a HOST TARGET binding site such as BINDING SITE I, BINDING SITE II or BINDING SITE III. Table 2 illustrates the complementarity of the nucleotide sequences of RDS BINDING SITE, designated SEQ ID:5862, to the nucleotide sequence of VGAM1653 RNA, herein designated VGAM RNA, also designated SEQ ID:4364.

Another function of VGAM1653 is therefore inhibition of Retinal Degeneration, Slow (retinitis pigmentosa 7) (RDS, Accession NM_000322), a gene which may function as an adhesion molecule involved in stabilization and compaction of outer segment disks or in the maintenance of the curvature of the rim. Accordingly, utilities of VGAM1653 include diagnosis, prevention and treatment of diseases and clinical conditions associated with RDS. The function of RDS and its association with various diseases and clinical conditions, has been established by previous studies, as described hereinabove with reference to VGAM341. Ubiquitin-conjugating Enzyme E2 Variant 1 (UBE2V1, Accession NM_003349) is another VGAM1653 host target gene. UBE2V1 BINDING SITE1 through UBE2V1 BINDING SITE3 are HOST TARGET binding sites found in untranslated regions of mRNA encoded by UBE2V1, corresponding to HOST TARGET binding sites such as BINDING SITE I, BINDING SITE II or BINDING SITE III. Table 2 illustrates the complementarity of the nucleotide sequences of UBE2V1 BINDING SITE1 through UBE2V1 BINDING SITE3, designated SEQ ID:9369, SEQ ID:22521 and SEQ ID:22768 respectively, to the nucleotide sequence of VGAM1653 RNA, herein designated VGAM RNA, also designated SEQ ID:4364.

Another function of VGAM1653 is therefore inhibition of Ubiquitin-conjugating Enzyme E2 Variant 1 (UBE2V1, Accession NM_003349), a gene which may play a role in signaling for DNA repair. Accordingly, utilities of VGAM1653 include diagnosis, prevention and treatment of diseases and clinical conditions associated with UBE2V1. The function of UBE2V1 and its association with various diseases and clinical conditions, has been established by previous studies, as described hereinabove with reference to VGAM155. FLJ12903 (Accession NM_022753) is another VGAM1653 host target gene. FLJ12903 BINDING SITE is HOST TARGET binding site found in the 3' untranslated region of mRNA encoded by FLJ12903, corresponding to a HOST TARGET binding site such as BINDING SITE I, BINDING SITE II or BINDING SITE III. Table 2 illustrates the complementarity of the nucleotide sequences of FLJ12903 BINDING SITE, designated SEQ ID:22977, to the nucleotide sequence of VGAM1653 RNA, herein designated VGAM RNA, also designated SEQ ID:4364.

Another function of VGAM1653 is therefore inhibition of FLJ12903 (Accession NM_022753). Accordingly, utilities of VGAM1653 include diagnosis, prevention and treatment of diseases and clinical conditions associated with FLJ12903. KIAA0285 (Accession NM_014807) is another VGAM1653 host target gene. KIAA0285 BINDING SITE is HOST TARGET binding site found in the 5' untranslated region of mRNA encoded by KIAA0285, corresponding to a HOST TARGET binding site such as BINDING SITE I, BINDING SITE II or BINDING SITE III. Table 2 illustrates the complementarity of the nucleotide sequences of KIAA0285 BINDING SITE, designated SEQ ID:16750, to the nucleotide sequence of VGAM1653 RNA, herein designated VGAM RNA, also designated SEQ ID:4364.

Another function of VGAM1653 is therefore inhibition of KIAA0285 (Accession NM_014807). Accordingly, utilities of VGAM1653 include diagnosis, prevention and treatment of diseases and clinical conditions associated with KIAA0285. KIAA0446 (Accession XM_044155) is another VGAM1653 host target gene. KIAA0446 BINDING SITE is HOST TARGET binding site found in the 5' untranslated region of mRNA encoded by KIAA0446, corresponding to a HOST TARGET binding site such as BINDING SITE I, BINDING SITE II or BINDING SITE III. Table 2 illustrates the complementarity of the nucleotide sequences of KIAA0446 BINDING SITE, designated SEQ ID:34149, to the nucleotide sequence of VGAM1653 RNA, herein designated VGAM RNA, also designated SEQ ID:4364.

Another function of VGAM1653 is therefore inhibition of KIAA0446 (Accession XM_044155). Accordingly, utilities of VGAM1653 include diagnosis, prevention and treatment of diseases and clinical conditions associated with KIAA0446. KIAA0630 (Accession XM_114729) is another VGAM1653 host target gene. KIAA0630 BINDING SITE is HOST TARGET binding site found in the 5' untranslated region of mRNA encoded by KIAA0630, corresponding to a HOST TARGET binding site such as BINDING SITE I, BINDING SITE II or BINDING SITE III. Table 2 illustrates the complementarity of the nucleotide sequences of KIAA0630 BINDING SITE, designated SEQ ID:43061, to the nucleotide sequence of VGAM1653 RNA, herein designated VGAM RNA, also designated SEQ ID:4364.

Another function of VGAM1653 is therefore inhibition of KIAA0630 (Accession XM_114729). Accordingly, utilities of VGAM1653 include diagnosis, prevention and treatment of diseases and clinical conditions associated with KIAA0630. KIAA0945 (Accession NM_014952) is another VGAM1653 host target gene. KIAA0945 BINDING SITE is HOST TARGET binding site found in the 3' untranslated region of mRNA encoded by KIAA0945, corresponding to a HOST TARGET binding site such as BINDING SITE I, BINDING SITE II or BINDING SITE III. Table 2 illustrates the complementarity of the nucleotide sequences of KIAA0945 BINDING SITE, designated SEQ ID:17291, to the nucleotide sequence of VGAM1653 RNA, herein designated VGAM RNA, also designated SEQ ID:4364.

Another function of VGAM1653 is therefore inhibition of KIAA0945 (Accession NM_014952). Accordingly, utilities of VGAM1653 include diagnosis, prevention and treatment of diseases and clinical conditions associated with KIAA0945. SUN1 (Accession NM_025154) is another VGAM1653 host target gene. SUN1 BINDING SITE is HOST TARGET binding site found in the 3' untranslated region of mRNA encoded by SUN1, corresponding to a HOST TARGET binding site such as BINDING SITE I, BINDING SITE II or BINDING SITE III. Table 2 illustrates the complementarity of the nucleotide sequences of SUN1 BINDING SITE, designated SEQ ID:24793, to the nucleotide sequence of VGAM1653 RNA, herein designated VGAM RNA, also designated SEQ ID:4364.

Another function of VGAM1653 is therefore inhibition of SUN1 (Accession NM_025154). Accordingly, utilities of VGAM1653 include diagnosis, prevention and treatment of diseases and clinical conditions associated with SUN1. LOC154881 (Accession XM_088063) is another VGAM1653 host target gene. LOC154881 BINDING SITE is HOST TARGET binding site found in the 3' untranslated region of mRNA encoded by LOC154881, corresponding to a HOST TARGET binding site such as BINDING SITE I, BINDING SITE II or BINDING SITE III. Table 2 illustrates the complementarity of the nucleotide sequences of LOC154881 BINDING SITE, designated SEQ ID:39494, to the nucleotide sequence of VGAM1653 RNA, herein designated VGAM RNA, also designated SEQ ID:4364.

Another function of VGAM1653 is therefore inhibition of LOC154881 (Accession XM_088063). Accordingly, utilities of VGAM1653 include diagnosis, prevention and treatment of diseases and clinical conditions associated with LOC154881. LOC254122 (Accession XM_170660) is another VGAM1653 host target gene. LOC254122 BINDING SITE is HOST TARGET binding site found in the 3' untranslated region of mRNA encoded by LOC254122, corresponding to a HOST TARGET binding site such as BINDING SITE I, BINDING SITE II or BINDING SITE III. Table 2 illustrates the complementarity of the nucleotide sequences of LOC254122 BINDING SITE, designated SEQ ID:45435, to the nucleotide sequence of VGAM1653 RNA, herein designated VGAM RNA, also designated SEQ ID:4364.

Another function of VGAM1653 is therefore inhibition of LOC254122 (Accession XM_170660). Accordingly, utilities of VGAM1653 include diagnosis, prevention and treatment of diseases and clinical conditions associated with LOC254122. FIG. 1 further provides a conceptual description of a novel bioinformatically detected viral gene of the present invention, referred to here as Viral Genomic Address Messenger 1654 (VGAM1654) viral gene, which modulates expression of respective host target genes thereof, the function and utility of which host target genes is known in the art.

VGAM1654 is a novel bioinformatically detected regulatory, non protein coding, viral micro RNA (miRNA) gene. The method by which VGAM1654 was detected is described hereinabove with reference to FIGS. 1-8.

VGAM1654 gene, herein designated VGAM GENE, is a viral gene contained in the genome of Yellow Fever Virus. VGAM1654 host target gene, herein designated VGAM HOST TARGET GENE, is a human gene contained in the human genome.

VGAM1654 gene encodes a VGAM1654 precursor RNA, herein designated VGAM PRECURSOR RNA. Similar to other miRNA genes, and unlike most ordinary genes, VGAM1654 precursor RNA does not encode a protein. A nucleotide sequence identical or highly similar to the nucleotide sequence of VGAM1654 precursor RNA is designated SEQ ID:1640, and is provided hereinbelow with reference to the sequence listing part. Nucleotide sequence SEQ ID:1640 is located at position 6577 relative to the genome of Yellow Fever Virus.

VGAM1654 precursor RNA folds onto itself, forming VGAM1654 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1654 folded precursor RNA into VGAM1654 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1654 RNA is designated SEQ ID:4365, and is provided hereinbelow with reference to the sequence listing part.

VGAM1654 host target gene, herein designated VGAM HOST TARGET GENE, encodes a corresponding messenger RNA, VGAM1654 host target RNA, herein designated VGAM HOST TARGET RNA. VGAM1654 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1654 RNA, herein designated VGAM RNA, binds complementarily to one or more host target binding sites located in untranslated regions of VGAM1654 host target RNA, herein designated VGAM HOST TARGET RNA. This complementary binding is due to the fact that the nucleotide sequence of VGAM1654 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1654 RNA, herein designated VGAM RNA, may have a different number of host target binding sites in untranslated regions of a VGAM1654 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1654 RNA, herein designated VGAM RNA, to host target binding sites on VGAM1654 host target RNA, herein designated VGAM HOST TARGET RNA, such as BINDING SITE I, BINDING SITE II and BINDING SITE III, inhibits translation of VGAM1654 host target RNA into VGAM1654 host target protein, herein designated VGAM HOST TARGET PROTEIN. VGAM host target protein is therefore outlined by a broken line.

It is appreciated that VGAM1654 host target gene, herein designated VGAM HOST TARGET GENE, in fact represents a plurality of VGAM1654 host target genes. The mRNA of each one of this plurality of VGAM1654 host target genes comprises one or more host target binding sites, each having a nucleotide sequence which is at least partly complementary to VGAM1654 RNA, herein designated VGAM RNA, and which when bound by VGAM1654 RNA causes inhibition of translation of respective one or more VGAM1654 host target proteins.

It is further appreciated by one skilled in the art that the mode of translational inhibition illustrated by FIG. 1 with specific reference to translational inhibition exerted by VGAM1654 gene, herein designated VGAM GENE, on one or more VGAM1654 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1654 is inhibition of expression of host target genes, as part of a novel viral mechanism of attacking a host. Accordingly, utilities of VGAM1654 include diagnosis, prevention and treatment of viral infection by Yellow Fever Virus. Specific functions, and accordingly utilities, of VGAM1654 correlate with, and may be deduced from, the identity of the host target genes which VGAM1654 binds and inhibits, and the function of these host target genes, as elaborated hereinbelow.

Nucleotide sequences of the VGAM1654 precursor RNA, herein designated VGAM PRECURSOR RNA, and of the 'diced' VGAM1654 RNA, herein designated VGAM RNA, and a schematic representation of the secondary folding of VGAM1654 folded precursor RNA, herein designated VGAM FOLDED PRECURSOR RNA, of VGAM1654 are further described hereinbelow with reference to Table 1.

Nucleotide sequences of host target binding sites, such as BINDING SITE-I, BINDING SITE-II and BINDING SITE-III of FIG. 1, found on VGAM1654 host target RNA, and schematic representation of the complementarity of each of these host target binding sites to VGAM1654 RNA, herein designated VGAM RNA, are described hereinbelow with reference to Table 2.

As mentioned hereinabove with reference to FIG. 1, a function of VGAM1654 gene, herein designated VGAM is inhibition of expression of VGAM1654 target genes. It is appreciated that specific functions, and accordingly utilities, of VGAM1654 correlate with, and may be deduced from, the identity of the target genes which VGAM1654 binds and inhibits, and the function of these target genes, as elaborated hereinbelow.

Desmocollin 2 (DSC2, Accession NM_004949) is a VGAM1654 host target gene. DSC2 BINDING SITE is HOST TARGET binding site found in the 3' untranslated region of mRNA encoded by DSC2, corresponding to a HOST TARGET binding site such as BINDING SITE I, BINDING SITE II or BINDING SITE III. Table 2 illustrates the complementarity of the nucleotide sequences of DSC2 BINDING SITE, designated SEQ ID:11393, to the nucleotide sequence of VGAM1654 RNA, herein designated VGAM RNA, also designated SEQ ID:4365.

A function of VGAM1654 is therefore inhibition of Desmocollin 2 (DSC2, Accession NM_004949), a gene which is a component of intercellular desmosome junctions. Accordingly, utilities of VGAM1654 include diagnosis, prevention and treatment of diseases and clinical conditions associated with DSC2. The function of DSC2 and its association with various diseases and clinical conditions, has been established by previous studies, as described hereinabove with reference to VGAM909. Ring Finger Protein 14 (RNF14, Accession NM_004290) is another VGAM1654 host target gene. RNF14 BINDING SITE is HOST TARGET binding site found in the 3' untranslated region of mRNA encoded by RNF14, corresponding to a HOST TARGET binding site such as BINDING SITE I, BINDING SITE II or BINDING SITE III. Table 2 illustrates the complementarity of the nucleotide sequences of RNF14 BINDING SITE, designated SEQ ID:10505, to the nucleotide sequence of VGAM1654 RNA, herein designated VGAM RNA, also designated SEQ ID:4365.

Another function of VGAM1654 is therefore inhibition of Ring Finger Protein 14 (RNF14, Accession NM_004290), a gene which associates with the androgen receptor (AR); functions as a transcriptional coactivator. Accordingly, utilities of VGAM1654 include diagnosis, prevention and treatment of diseases and clinical conditions associated with RNF14. The function of RNF14 and its association with various diseases and clinical conditions, has been established by previous studies, as described hereinabove with reference to VGAM827. Cat Eye Syndrome Chromosome Region, Candidate 1 (CECR1, Accession NM_017424) is another VGAM1654 host target gene. CECR1 BINDING SITE is HOST TARGET binding site found in the 3' untranslated region of mRNA encoded by CECR1, corresponding to a HOST TARGET binding site such as BINDING SITE I, BINDING SITE II or BINDING SITE III. Table 2 illustrates the complementarity of the nucleotide sequences of CECR1 BINDING SITE, designated SEQ ID:18886, to the nucleotide sequence of VGAM1654 RNA, herein designated VGAM RNA, also designated SEQ ID:4365.

Another function of VGAM1654 is therefore inhibition of Cat Eye Syndrome Chromosome Region, Candidate 1 (CECR1, Accession NM_017424). Accordingly, utilities of VGAM1654 include diagnosis, prevention and treatment of diseases and clinical conditions associated with CECR1. KIAA1877 (Accession XM_038616) is another VGAM1654 host target gene. KIAA1877 BINDING SITE is HOST TARGET binding site found in the 3' untranslated region of mRNA encoded by KIAA1877, corresponding to a HOST TARGET binding site such as BINDING SITE I, BINDING SITE II or BINDING SITE III. Table 2 illustrates the complementarity of the nucleotide sequences of KIAA1877 BINDING SITE, designated SEQ ID:32887, to the nucleotide sequence of VGAM1654 RNA, herein designated VGAM RNA, also designated SEQ ID:4365.

Another function of VGAM1654 is therefore inhibition of KIAA1877 (Accession XM_038616). Accordingly, utilities of VGAM1654 include diagnosis, prevention and treatment of diseases and clinical conditions associated with KIAA1877. LOC254848 (Accession XM_173133) is another VGAM1654 host target gene. LOC254848 BINDING SITE is HOST TARGET binding site found in the 5' untranslated region of mRNA encoded by LOC254848, corresponding to a HOST TARGET binding site such as BINDING SITE I, BINDING SITE II or BINDING SITE III. Table 2 illustrates the complementarity of the nucleotide sequences of LOC254848 BINDING SITE, designated SEQ ID:46380, to the nucleotide sequence of VGAM1654 RNA, herein designated VGAM RNA, also designated SEQ ID:4365.

Another function of VGAM1654 is therefore inhibition of LOC254848 (Accession XM_173133). Accordingly, utilities of VGAM1654 include diagnosis, prevention and treatment of diseases and clinical conditions associated with LOC254848. LOC255308 (Accession XM_170536) is another VGAM1654 host target gene. LOC255308 BINDING SITE is HOST TARGET binding site found in the 3' untranslated region of mRNA encoded by LOC255308, corresponding to a HOST TARGET binding site such as BINDING SITE I, BINDING SITE II or BINDING SITE III. Table 2 illustrates the complementarity of the nucleotide sequences of LOC255308 BINDING SITE, designated SEQ ID:45356, to the nucleotide sequence of VGAM1654 RNA, herein designated VGAM RNA, also designated SEQ ID:4365.

Another function of VGAM1654 is therefore inhibition of LOC255308 (Accession XM_170536). Accordingly, utilities of VGAM1654 include diagnosis, prevention and treatment of diseases and clinical conditions associated with LOC255308. FIG. 1 further provides a conceptual description of a novel bioinformatically detected viral gene of the present invention, referred to here as Viral Genomic Address Messenger 1655 (VGAM1655) viral gene, which modulates expression of respective host target genes thereof, the function and utility of which host target genes is known in the art.

VGAM1655 is a novel bioinformatically detected regulatory, non protein coding, viral micro RNA (miRNA) gene. The method by which VGAM1655 was detected is described hereinabove with reference to FIGS. 1-8.

VGAM1655 gene, herein designated VGAM GENE, is a viral gene contained in the genome of Yellow Fever Virus. VGAM1655 host target gene, herein designated VGAM HOST TARGET GENE, is a human gene contained in the human genome.

VGAM1655 gene encodes a VGAM1655 precursor RNA, herein designated VGAM PRECURSOR RNA. Similar to other miRNA genes, and unlike most ordinary genes, VGAM1655 precursor RNA does not encode a protein. A nucleotide sequence identical or highly similar to the nucleotide sequence of VGAM1655 precursor RNA is designated SEQ ID:1641, and is provided hereinbelow with reference to the sequence listing part. Nucleotide sequence SEQ ID:1641 is located at position 1472 relative to the genome of Yellow Fever Virus.

VGAM1655 precursor RNA folds onto itself, forming VGAM1655 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1655 folded precursor RNA into VGAM1655 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1655 RNA is designated SEQ ID:4366, and is provided hereinbelow with reference to the sequence listing part.

VGAM1655 host target gene, herein designated VGAM HOST TARGET GENE, encodes a corresponding messenger RNA, VGAM1655 host target RNA, herein designated VGAM HOST TARGET RNA. VGAM1655 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1655 RNA, herein designated VGAM RNA, binds complementarily to one or more host target binding sites located in untranslated regions of VGAM1655 host target RNA, herein designated VGAM HOST TARGET RNA. This complementary binding is due to the fact that the nucleotide sequence of VGAM1655 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1655 RNA, herein designated VGAM RNA, may have a different number of host target binding sites in untranslated regions of a VGAM1655 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1655 RNA, herein designated VGAM RNA, to host target binding sites on VGAM1655 host target RNA, herein designated VGAM HOST TARGET RNA, such as BINDING SITE I, BINDING SITE II and BINDING SITE III, inhibits translation of VGAM1655 host target RNA into VGAM1655 host target protein, herein designated VGAM HOST TARGET PROTEIN. VGAM host target protein is therefore outlined by a broken line.

It is appreciated that VGAM1655 host target gene, herein designated VGAM HOST TARGET GENE, in fact represents a plurality of VGAM1655 host target genes. The mRNA of each one of this plurality of VGAM1655 host target genes comprises one or more host target binding sites, each having a nucleotide sequence which is at least partly complementary to VGAM1655 RNA, herein designated VGAM RNA, and which when bound by VGAM1655 RNA causes inhibition of translation of respective one or more VGAM1655 host target proteins.

It is further appreciated by one skilled in the art that the mode of translational inhibition illustrated by FIG. 1 with specific reference to translational inhibition exerted by VGAM1655 gene, herein designated VGAM GENE, on one or more VGAM1655 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1655 is inhibition of expression of host target genes, as part of a novel viral mechanism of attacking a host. Accordingly, utilities of VGAM1655 include diagnosis, prevention and treatment of viral infection by Yellow Fever Virus. Specific functions, and accordingly utilities, of VGAM1655 correlate with, and may be deduced from, the identity of the host target genes which VGAM1655 binds and inhibits, and the function of these host target genes, as elaborated hereinbelow.

Nucleotide sequences of the VGAM1655 precursor RNA, herein designated VGAM PRECURSOR RNA, and of the 'diced' VGAM1655 RNA, herein designated VGAM RNA, and a schematic representation of the secondary folding of VGAM1655 folded precursor RNA, herein designated VGAM FOLDED PRECURSOR RNA, of VGAM1655 are further described hereinbelow with reference to Table 1.

Nucleotide sequences of host target binding sites, such as BINDING SITE-I, BINDING SITE-II and BINDING SITE-III of FIG. 1, found on VGAM1655 host target RNA, and schematic representation of the complementarity of each of these host target binding sites to VGAM1655 RNA, herein designated VGAM RNA, are described hereinbelow with reference to Table 2.

As mentioned hereinabove with reference to FIG. 1, a function of VGAM1655 gene, herein designated VGAM is inhibition of expression of VGAM1655 target genes. It is appreciated that specific functions, and accordingly utilities, of VGAM1655 correlate with, and may be deduced from, the identity of the target genes which VGAM1655 binds and inhibits, and the function of these target genes, as elaborated hereinbelow.

FLJ12443 (Accession NM_024830) is a VGAM1655 host target gene. FLJ12443 BINDING SITE is HOST TARGET binding site found in the 3' untranslated region of mRNA encoded by FLJ12443, corresponding to a HOST TARGET binding site such as BINDING SITE I, BINDING SITE II or BINDING SITE III. Table 2 illustrates the complementarity of the nucleotide sequences of FLJ12443 BINDING SITE, designated SEQ ID:24224, to the nucleotide sequence of VGAM1655 RNA, herein designated VGAM RNA, also designated SEQ ID:4366.

A function of VGAM1655 is therefore inhibition of FLJ12443 (Accession NM_024830). Accordingly, utilities of VGAM1655 include diagnosis, prevention and treatment of diseases and clinical conditions associated with FLJ12443.

KIAA0478 (Accession NM_014870) is another VGAM1655 host target gene. KIAA0478 BINDING SITE is HOST TARGET binding site found in the 3' untranslated region of mRNA encoded by KIAA0478, corresponding to a HOST TARGET binding site such as BINDING SITE I, BINDING SITE II or BINDING SITE III. Table 2 illustrates the complementarity of the nucleotide sequences of KIAA0478 BINDING SITE, designated SEQ ID:16980, to the nucleotide sequence of VGAM1655 RNA, herein designated VGAM RNA, also designated SEQ ID:4366.

Another function of VGAM1655 is therefore inhibition of KIAA0478 (Accession NM_014870). Accordingly, utilities of VGAM1655 include diagnosis, prevention and treatment of diseases and clinical conditions associated with KIAA0478. FIG. 1 further provides a conceptual description of a novel bioinformatically detected viral gene of the present invention, referred to here as Viral Genomic Address Messenger 1656 (VGAM1656) viral gene, which modulates expression of respective host target genes thereof, the function and utility of which host target genes is known in the art.

VGAM1656 is a novel bioinformatically detected regulatory, non protein coding, viral micro RNA (miRNA) gene. The method by which VGAM1656 was detected is described hereinabove with reference to FIGS. 1-8.

VGAM1656 gene, herein designated VGAM GENE, is a viral gene contained in the genome of Molluscum Contagiosum Virus. VGAM1656 host target gene, herein designated VGAM HOST TARGET GENE, is a human gene contained in the human genome.

VGAM1656 gene encodes a VGAM1656 precursor RNA, herein designated VGAM PRECURSOR RNA. Similar to other miRNA genes, and unlike most ordinary genes, VGAM1656 precursor RNA does not encode a protein. A nucleotide sequence identical or highly similar to the nucleotide sequence of VGAM1656 precursor RNA is designated SEQ ID:1642, and is provided hereinbelow with reference to the sequence listing part. Nucleotide sequence SEQ ID:1642 is located at position 8730 relative to the genome of Molluscum Contagiosum Virus.

VGAM1656 precursor RNA folds onto itself, forming VGAM1656 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1656 folded precursor RNA into VGAM1656 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1656 RNA is designated SEQ ID:4367, and is provided hereinbelow with reference to the sequence listing part.

VGAM1656 host target gene, herein designated VGAM HOST TARGET GENE, encodes a corresponding messenger RNA, VGAM1656 host target RNA, herein designated VGAM HOST TARGET RNA. VGAM1656 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1656 RNA, herein designated VGAM RNA, binds complementarily to one or more host target binding sites located in untranslated regions of VGAM1656 host target RNA, herein designated VGAM HOST TARGET RNA. This complementary binding is due to the fact that the nucleotide sequence of VGAM1656 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1656 RNA, herein designated VGAM RNA, may have a different number of host target binding sites in untranslated regions of a VGAM1656 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1656 RNA, herein designated VGAM RNA, to host target binding sites on VGAM1656 host target RNA, herein designated VGAM HOST TARGET RNA, such as BINDING SITE I, BINDING SITE II and BINDING SITE III, inhibits translation of VGAM1656 host target RNA into VGAM1656 host target protein, herein designated VGAM HOST TARGET PROTEIN. VGAM host target protein is therefore outlined by a broken line.

It is appreciated that VGAM1656 host target gene, herein designated VGAM HOST TARGET GENE, in fact represents a plurality of VGAM1656 host target genes. The mRNA of each one of this plurality of VGAM1656 host target genes comprises one or more host target binding sites, each having a nucleotide sequence which is at least partly complementary to VGAM1656 RNA, herein designated VGAM RNA, and which when bound by VGAM1656 RNA causes inhibition of translation of respective one or more VGAM1656 host target proteins.

It is further appreciated by one skilled in the art that the mode of translational inhibition illustrated by FIG. 1 with specific reference to translational inhibition exerted by VGAM1656 gene, herein designated VGAM GENE, on one or more VGAM1656 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1656 is inhibition of expression of host target genes, as part of a novel viral mechanism of attacking a host. Accordingly, utilities of VGAM1656 include diagnosis, prevention and treatment of viral infection by Molluscum Contagiosum Virus. Specific functions, and accordingly utilities, of VGAM1656 correlate with, and may be deduced from, the identity of the host target genes which VGAM1656 binds and inhibits, and the function of these host target genes, as elaborated hereinbelow.

Nucleotide sequences of the VGAM1656 precursor RNA, herein designated VGAM PRECURSOR RNA, and of the 'diced' VGAM1656 RNA, herein designated VGAM RNA, and a schematic representation of the secondary folding of VGAM1656 folded precursor RNA, herein designated VGAM FOLDED PRECURSOR RNA, of VGAM1656 are further described hereinbelow with reference to Table 1.

Nucleotide sequences of host target binding sites, such as BINDING SITE-I, BINDING SITE-II and BINDING SITE- III of FIG. 1, found on VGAM1656 host target RNA, and schematic representation of the complementarity of each of these host target binding sites to VGAM1656 RNA, herein designated VGAM RNA, are described hereinbelow with reference to Table 2.

As mentioned hereinabove with reference to FIG. 1, a function of VGAM1656 gene, herein designated VGAM is inhibition of expression of VGAM1656 target genes. It is appreciated that specific functions, and accordingly utilities, of VGAM1656 correlate with, and may be deduced from, the identity of the target genes which VGAM1656 binds and inhibits, and the function of these target genes, as elaborated hereinbelow.

Diacylglycerol Kinase, Iota (DGKI, Accession NM_004717) is a VGAM1656 host target gene. DGKI BINDING SITE is HOST TARGET binding site found in the 3' untranslated region of mRNA encoded by DGKI, corresponding to a HOST TARGET binding site such as BINDING SITE I, BINDING SITE II or BINDING SITE III. Table 2 illustrates the complementarity of the nucleotide sequences of DGKI BINDING SITE, designated SEQ ID:11079, to the nucleotide sequence of VGAM1656 RNA, herein designated VGAM RNA, also designated SEQ ID:4367.

A function of VGAM1656 is therefore inhibition of Diacylglycerol Kinase, Iota (DGKI, Accession NM_004717), a gene which regulates the intracellular concentration of the second messenger diacylglycerol (DAG). Accordingly, utilities of VGAM1656 include diagnosis, prevention and treatment of diseases and clinical conditions associated with DGKI. The function of DGKI and its association with various diseases and clinical conditions, has been established by previous studies, as described hereinabove with reference to VGAM1107. Hyperpolarization Activated Cyclic Nucleotide-gated Potassium Channel 2 (HCN2, Accession NM_001194) is another VGAM1656 host target gene. HCN2 BINDING SITE is HOST TARGET binding site found in the 3' untranslated region of mRNA encoded by HCN2, corresponding to a HOST TARGET binding site such as BINDING SITE I, BINDING SITE II or BINDING SITE III. Table 2 illustrates the complementarity of the nucleotide sequences of HCN2 BINDING SITE, designated SEQ ID:6863, to the nucleotide sequence of VGAM1656 RNA, herein designated VGAM RNA, also designated SEQ ID:4367.

Another function of VGAM1656 is therefore inhibition of Hyperpolarization Activated Cyclic Nucleotide-gated Potassium Channel 2 (HCN2, Accession NM_001194), a gene which is hyperpolarization-activated cyclic nucleotide-gated cation channel 2 and may act as a pacemaker channel in the brain and the heart. Accordingly, utilities of VGAM1656 include diagnosis, prevention and treatment of diseases and clinical conditions associated with HCN2. The function of HCN2 and its association with various diseases and clinical conditions, has been established by previous studies, as described hereinabove with reference to VGAM1189. Leukemia Inhibitory Factor Receptor (LIFR, Accession NM_002310) is another VGAM1656 host target gene. LIFR BINDING SITE is HOST TARGET binding site found in the 3' untranslated region of mRNA encoded by LIFR, corresponding to a HOST TARGET binding site such as BINDING SITE I, BINDING SITE II or BINDING SITE III. Table 2 illustrates the complementarity of the nucleotide sequences of LIFR BINDING SITE, designated SEQ ID:8103, to the nucleotide sequence of VGAM1656 RNA, herein designated VGAM RNA, also designated SEQ ID:4367.

Another function of VGAM1656 is therefore inhibition of Leukemia Inhibitory Factor Receptor (LIFR, Accession NM_002310). Accordingly, utilities of VGAM1656 include diagnosis, prevention and treatment of diseases and clinical conditions associated with LIFR. Solute Carrier Family 9 (sodium/hydrogen exchanger), Isoform 1 (antiporter, Na+/H+, amiloride sensitive) (SLC9A1, Accession XM_046881) is another VGAM1656 host target gene. SLC9A1 BINDING SITE is HOST TARGET binding site found in the 5' untranslated region of mRNA encoded by SLC9A1, corresponding to a HOST TARGET binding site such as BINDING SITE I, BINDING SITE II or BINDING SITE III. Table 2 illustrates the complementarity of the nucleotide sequences of SLC9A1 BINDING SITE, designated SEQ ID:34858, to the nucleotide sequence of VGAM1656 RNA, herein designated VGAM RNA, also designated SEQ ID:4367.

Another function of VGAM1656 is therefore inhibition of Solute Carrier Family 9 (sodium/hydrogen exchanger), Isoform 1 (antiporter, Na+/H+, amiloride sensitive) (SLC9A1, Accession XM_046881), a gene which is involved in ph regulation to eliminate acids generated by active metabolism or to counter adverse environmental conditions. Accordingly, utilities of VGAM1656 include diagnosis, prevention and treatment of diseases and clinical conditions associated with SLC9A1. The function of SLC9A1 and its association with various diseases and clinical conditions, has been established by previous studies, as described hereinabove with reference to VGAM206. SMAC (Accession NM_138930) is another VGAM1656 host target gene. SMAC BINDING SITE is HOST TARGET binding site found in the 5' untranslated region of mRNA encoded by SMAC, corresponding to a HOST TARGET binding site such as BINDING SITE I, BINDING SITE II or BINDING SITE III. Table 2 illustrates the complementarity of the nucleotide sequences of SMAC BINDING SITE, designated SEQ ID:29050, to the nucleotide sequence of VGAM1656 RNA, herein designated VGAM RNA, also designated SEQ ID:4367.

Another function of VGAM1656 is therefore inhibition of SMAC (Accession NM_138930), a gene which promotes apoptosis via caspase activation. Accordingly, utilities of VGAM1656 include diagnosis, prevention and treatment of diseases and clinical conditions associated with SMAC. The function of SMAC and its association with various diseases and clinical conditions, has been established by previous studies, as described hereinabove with reference to VGAM74. Tumor Suppressing Subtransferable Candidate 4 (TSSC4, Accession NM_005706) is another VGAM1656 host target gene. TSSC4 BINDING SITE is HOST TARGET binding site found in the 5' untranslated region of mRNA encoded by TSSC4, corresponding to a HOST TARGET binding site such as BINDING SITE I, BINDING SITE II or BINDING SITE III. Table 2 illustrates the complementarity of the nucleotide sequences of TSSC4 BINDING SITE, designated SEQ ID:12259, to the nucleotide sequence of VGAM1656 RNA, herein designated VGAM RNA, also designated SEQ ID:4367.

Another function of VGAM1656 is therefore inhibition of Tumor Suppressing Subtransferable Candidate 4 (TSSC4, Accession NM_005706), a gene which is of unknown function. Accordingly, utilities of VGAM1656 include diagnosis, prevention and treatment of diseases and clinical conditions associated with TSSC4. The function of TSSC4 and its association with various diseases and clinical conditions, has been established by previous studies, as described hereinabove with reference to VGAM1233. WNT1 Inducible Signaling Pathway Protein 1 (WISP1, Accession NM_003882) is another VGAM1656 host target gene. WISP1 BINDING SITE is HOST TARGET binding site found in the 3' untranslated region of mRNA encoded by WISP1, corresponding to a HOST TARGET binding site such as BINDING SITE I, BINDING SITE II or BINDING SITE III. Table 2 illustrates the complementarity of the nucleotide sequences of WISP1 BINDING SITE, designated SEQ ID:9962, to the nucleotide sequence of VGAM1656 RNA, herein designated VGAM RNA, also designated SEQ ID:4367.

Another function of VGAM1656 is therefore inhibition of WNT1 Inducible Signaling Pathway Protein 1 (WISP1, Accession NM_003882), a gene which is a member of connective tissue growth factor family. Accordingly, utilities of VGAM1656 include diagnosis, prevention and treatment of diseases and clinical conditions associated with WISP1. The function of WISP1 has been established by previous studies. WNT1 (OMIM Ref. No. 164820) is a member of a family of cysteine-rich, glycosylated signaling proteins that mediate diverse developmental processes such as the control of cell proliferation, adhesion, cell polarity, and the establishment of cell fates. This family has been referred to as CCN, for connective tissue growth factor, cysteine-rich-61, nephroblastoma overexpressed. Wnt1 was was identified as an oncogene activated by the insertion of mouse mammary tumor virus in virus-induced mammary adenocarcinomas. Although Wnt1 is not expressed in the normal mammary gland, expression of Wnt1 in transgenic mice causes mammary tumors. To identify downstream genes in the WNT signaling pathway that are relevant to the transformed cell phenotype, Pennica et al. (1998) used a PCR-based cDNA subtraction strategy, suppression subtractive hybridization. Pennica et al. (1998) reported the identification of 2 genes, WISP1 and WISP2 (OMIM Ref. No. 603399), that are upregulated in the mouse mammary epithelial cell line transformed by Wnt1, but not by Wnt4 (OMIM Ref. No. 603490). Together with a third related gene, WISP3 (OMIM Ref. No. 603399), these proteins define a subfamily of the connective tissue growth factor family. Two distinct systems demonstrated WISP induction to be associated with the expression of WNT1. WISP1 genomic DNA was amplified in colon cancer cell lines and in human colon tumors and its RNA overexpressed in 84% of the tumors examined compared with patient-matched normal mucosa. WISP3 also was overexpressed in 63% of colon tumors analyzed. In contrast, WISP2 showed reduced RNA expression in 79% of the tumors. These results suggested that WISP genes may be downstream of WNT1 signaling and that aberrant levels of WISP expression in colon cancer may play a role in colon tumorigenesis. Pennica et al. (1998) found that the WISP1 cDNA encodes a 367-amino acid protein. Mouse and human WISP1 proteins are 84% identical; both have hydrophobic N-terminal signal sequences, 38 conserved cysteine residues, and 4 potential N-linked glycosylation sites. Alignment of the 3 human WISP proteins showed that WISP1 and WISP3 are most similar (42%), whereas WISP2 had 37% identity with WISP1 and 32% identity with WISP3. Tanaka et al. (2001) used targeted differential displays to identify a novel variant of WISP1, designated WISP1v, which was overexpressed in scirrhous gastric carcinomas. The predicted protein of the variant WISP1 completely lacks a module of von Willebrand factor type C (see OMIM Ref. No. 193400) that is thought to participate in protein complex formation. Ectopic expression of the variant showed it to be a secreted oncoprotein inducing a striking cellular transformation and rapid piling-up growth. The authors noted that WISP1 transfectants enhanced the invasive phenotype of cocultured gastric carcinoma cells, while wildtype WISP1 had no such potential. By use of radiation hybrid mapping panels, Pennica et al. (1998) mapped the 3 WISP genes. WISP1 was mapped to 8q24.1-q24.3, roughly 4 Mb distal to MYC (OMIM Ref. No. 190080). WISP2 was mapped to 20q12-q13.1, and WISP3 to 6q22-q23.

Full details of the abovementioned studies are described in the following publications, the disclosure of which are hereby incorporated by reference:

Pennica, D.; Swanson, T. A.; Welsh, J. W.; Roy, M. A.; Lawrence, D. A.; Lee, J.; Brush, J.; Taneyhill, L. A.; Deuel, B.; Lew, M.; Watanabe, C.; Cohen, R. L.; Melhem, M. F.; Finley, G. G.; Quirke, P.; Goddard, A. D.; Hillan, K. J.; Gurney, A. L.; Botstein, D.; Levine, A. J.: WISP genes are members of the connective tissue growth factor family that are up-regulated in Wnt-1-transformed cells and aberrantly expressed in human colon tumors. Proc. Nat. Acad. Sci. 95:14717-14722, 1998; and Tanaka, S.; Sugimachi, K.; Saeki, H.; Kinoshita, J.; Ohga, T.; Shimada, M.; Maehara, Y.; Sugimachi, K.: A novel variant of WISP1 lacking a von Willebrand type C module overexpressed in.

Further studies establishing the function and utilities of WISP1 are found in John Hopkins OMIM database record ID 603398, and in sited publications numbered 7621-7622 listed in the bibliography section hereinbelow, which are also hereby incorporated by reference. Chromosome 22 Open Reading Frame 2 (C22orf2, Accession XM_170492) is another VGAM1656 host target gene. C22orf2 BINDING SITE is HOST TARGET binding site found in the 3' untranslated region of mRNA encoded by C22orf2, corresponding to a HOST TARGET binding site such as BINDING SITE I, BINDING SITE II or BINDING SITE III. Table 2 illustrates the complementarity of the nucleotide sequences of C22orf2 BINDING SITE, designated SEQ ID:45334, to the nucleotide sequence of VGAM1656 RNA, herein designated VGAM RNA, also designated SEQ ID:4367.

Another function of VGAM1656 is therefore inhibition of Chromosome 22 Open Reading Frame 2 (C22orf2, Accession XM_170492). Accordingly, utilities of VGAM1656 include diagnosis, prevention and treatment of diseases and clinical conditions associated with C22orf2. FLJ00001 (Accession XM_088525) is another VGAM1656 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39775, to the nucleotide sequence of VGAM1656 RNA, herein designated VGAM RNA, also designated SEQ ID:4367.

Another function of VGAM1656 is therefore inhibition of FLJ00001 (Accession XM_088525). Accordingly, utilities of VGAM1656 include diagnosis, prevention and treatment of diseases and clinical conditions associated with FLJ00001. FLJ22037 (Accession XM_168215) is another VGAM1656 host target gene. FLJ22037 BINDING SITE is HOST TARGET binding site found in the 5' untranslated region of mRNA encoded by FLJ22037, corresponding to a HOST TARGET binding site such as BINDING SITE I, BINDING SITE II or BINDING SITE III. Table 2 illustrates the complementarity of the nucleotide sequences of FLJ22037 BINDING SITE, designated SEQ ID:45075, to the nucleotide sequence of VGAM1656 RNA, herein designated VGAM RNA, also designated SEQ ID:4367.

Another function of VGAM1656 is therefore inhibition of FLJ22037 (Accession XM_168215). Accordingly, utilities of VGAM1656 include diagnosis, prevention and treatment of diseases and clinical conditions associated with FLJ22037. Potassium Channel, Subfamily T, Member 1 (KCNT1, Accession XM_029962) is another VGAM1656 host target gene. KCNT1 BINDING SITE is HOST TARGET binding site found in the 3' untranslated region of mRNA encoded by KCNT1, corresponding to a HOST TARGET binding site such as BINDING SITE I, BINDING SITE II or BINDING SITE III. Table 2 illustrates the complementarity of the nucleotide sequences of KCNT1 BINDING SITE, designated SEQ ID:30977, to the nucleotide sequence of VGAM1656 RNA, herein designated VGAM RNA, also designated SEQ ID:4367.

Another function of VGAM1656 is therefore inhibition of Potassium Channel, Subfamily T, Member 1 (KCNT1, Accession XM_029962). Accordingly, utilities of VGAM1656 include diagnosis, prevention and treatment of diseases and clinical conditions associated with KCNT1. MDS018 (Accession NM_021823) is another VGAM1656 host target gene. MDS018 BINDING SITE is HOST TARGET binding site found in the 3' untranslated region of mRNA encoded by MDS018, corresponding to a HOST TARGET binding site such as BINDING SITE I, BINDING SITE II or BINDING SITE III. Table 2 illustrates the complementarity of the nucleotide sequences of MDS018 BINDING SITE, designated SEQ ID:22401, to the nucleotide sequence of VGAM1656 RNA, herein designated VGAM RNA, also designated SEQ ID:4367.

Another function of VGAM1656 is therefore inhibition of MDS018 (Accession NM_021823). Accordingly, utilities of VGAM1656 include diagnosis, prevention and treatment of diseases and clinical conditions associated with MDS018. Syndecan 3 (N-syndecan) (SDC3, Accession NM_014654) is another VGAM1656 host target gene. SDC3 BINDING SITE is HOST TARGET binding site found in the 3' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16083, to the nucleotide sequence of VGAM1656 RNA, herein designated VGAM RNA, also designated SEQ ID:4367.

Another function of VGAM1656 is therefore inhibition of Syndecan 3 (N-syndecan) (SDC3, Accession NM_014654). Accordingly, utilities of VGAM1656 include diagnosis, prevention and treatment of diseases and clinical conditions associated with SDC3. LOC126353 (Accession XM_059034) is another VGAM1656 host target gene. LOC126353 BINDING SITE is HOST TARGET binding site found in the 3' untranslated region of mRNA encoded by LOC126353, corresponding to a HOST TARGET binding site such as BINDING SITE I, BINDING SITE II or BINDING SITE III. Table 2 illustrates the complementarity of the nucleotide sequences of LOC126353 BINDING SITE, designated SEQ ID:36829, to the nucleotide sequence of VGAM1656 RNA, herein designated VGAM RNA, also designated SEQ ID:4367.

Another function of VGAM1656 is therefore inhibition of LOC126353 (Accession XM_059034). Accordingly, utilities of VGAM1656 include diagnosis, prevention and treatment of diseases and clinical conditions associated with LOC126353. LOC128989 (Accession XM_059310) is another VGAM1656 host target gene. LOC128989 BINDING SITE is HOST TARGET binding site found in the 3' untranslated region of mRNA encoded by LOC128989, corresponding to a HOST TARGET binding site such as BINDING SITE I, BINDING SITE II or BINDING SITE III. Table 2 illustrates the complementarity of the nucleotide sequences of LOC128989 BINDING SITE, designated SEQ ID:36940, to the nucleotide sequence of VGAM1656 RNA, herein designated VGAM RNA, also designated SEQ ID:4367.

Another function of VGAM1656 is therefore inhibition of LOC128989 (Accession XM_059310). Accordingly, utilities of VGAM1656 include diagnosis, prevention and treatment of diseases and clinical conditions associated with LOC128989. LOC134265 (Accession XM_059702) is another VGAM1656 host target gene. LOC134265 BINDING SITE is HOST TARGET binding site found in the 3' untranslated region of mRNA encoded by LOC134265, corresponding to a HOST TARGET binding site such as BINDING SITE I, BINDING SITE II or BINDING SITE III. Table 2 illustrates the complementarity of the nucleotide sequences of LOC134265 BINDING SITE, designated SEQ ID:37074, to the nucleotide sequence of VGAM1656 RNA, herein designated VGAM RNA, also designated SEQ ID:4367.

Another function of VGAM1656 is therefore inhibition of LOC134265 (Accession XM_059702). Accordingly, utilities of VGAM1656 include diagnosis, prevention and treatment of diseases and clinical conditions associated with LOC134265. LOC157349 (Accession XM_088298) is another VGAM1656 host target gene. LOC157349 BINDING SITE is HOST TARGET binding site found in the 3' untranslated region of mRNA encoded by LOC157349, corresponding to a HOST TARGET binding site such as BINDING SITE I, BINDING SITE II or BINDING SITE III. Table 2 illustrates the complementarity of the nucleotide sequences of LOC157349 BINDING SITE, designated SEQ ID:39599, to the nucleotide sequence of VGAM1656 RNA, herein designated VGAM RNA, also designated SEQ ID:4367.

Another function of VGAM1656 is therefore inhibition of LOC157349 (Accession XM_088298). Accordingly, utilities of VGAM1656 include diagnosis, prevention and treatment of diseases and clinical conditions associated with LOC157349. LOC219700 (Accession XM_167570) is another VGAM1656 host target gene. LOC219700 BINDING SITE is HOST TARGET binding site found in the 5' untranslated region of mRNA encoded by LOC219700, corresponding to a HOST TARGET binding site such as BINDING SITE I, BINDING SITE II or BINDING SITE III. Table 2 illustrates the complementarity of the nucleotide sequences of LOC219700 BINDING SITE, designated SEQ ID:44701, to the nucleotide sequence of VGAM1656 RNA, herein designated VGAM RNA, also designated SEQ ID:4367.

Another function of VGAM1656 is therefore inhibition of LOC219700 (Accession XM_167570). Accordingly, utilities of VGAM1656 include diagnosis, prevention and treatment of diseases and clinical conditions associated with LOC219700. LOC221399 (Accession XM_168134) is another VGAM1656 host target gene. LOC221399 BINDING SITE is HOST TARGET binding site found in the 5' untranslated region of mRNA encoded by LOC221399, corresponding to a HOST TARGET binding site such as BINDING SITE I, BINDING SITE II or BINDING SITE III. Table 2 illustrates the complementarity of the nucleotide sequences of LOC221399 BINDING SITE, designated SEQ ID:45051, to the nucleotide sequence of VGAM1656 RNA, herein designated VGAM RNA, also designated SEQ ID:4367.

Another function of VGAM1656 is therefore inhibition of LOC221399 (Accession XM_168134). Accordingly, utilities of VGAM1656 include diagnosis, prevention and treatment of diseases and clinical conditions associated with LOC221399. LOC256158 (Accession XM_175125) is another VGAM1656 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46625, to the nucleotide sequence of VGAM1656 RNA, herein designated VGAM RNA, also designated SEQ ID:4367.

Another function of VGAM1656 is therefore inhibition of LOC256158 (Accession XM_175125). Accordingly, utilities of VGAM1656 include diagnosis, prevention and treatment of diseases and clinical conditions associated with LOC256158. LOC51337 (Accession NM_016647) is another VGAM1656 host target gene. LOC51337 BINDING SITE is HOST TARGET binding site found in the 3' untranslated region of mRNA encoded by LOC51337, corresponding to a HOST TARGET binding site such as BINDING SITE I, BINDING SITE II or BINDING SITE III. Table 2 illustrates the complementarity of the nucleotide sequences of LOC51337 BINDING SITE, designated SEQ ID:18765, to the nucleotide sequence of VGAM1656 RNA, herein designated VGAM RNA, also designated SEQ ID:4367.

Another function of VGAM1656 is therefore inhibition of LOC51337 (Accession NM_016647). Accordingly, utilities of VGAM1656 include diagnosis, prevention and treatment of diseases and clinical conditions associated with LOC51337. LOC54103 (Accession XM_168508) is another VGAM1656 host target gene. LOC54103 BINDING SITE is HOST TARGET binding site found in the 5' untranslated region of mRNA encoded by LOC54103, corresponding to a HOST TARGET binding site such as BINDING SITE I, BINDING SITE II or BINDING SITE III. Table 2 illustrates the complementarity of the nucleotide sequences of LOC54103 BINDING SITE, designated SEQ ID:45208, to the nucleotide sequence of VGAM1656 RNA, herein designated VGAM RNA, also designated SEQ ID:4367.

Another function of VGAM1656 is therefore inhibition of LOC54103 (Accession XM_168508). Accordingly, utilities of VGAM1656 include diagnosis, prevention and treatment of diseases and clinical conditions associated with LOC54103. FIG. 1 further provides a conceptual description of a novel bioinformatically detected viral gene of the present invention, referred to here as Viral Genomic Address Messenger 1657 (VGAM1657) viral gene, which modulates expression of respective host target genes thereof, the function and utility of which host target genes is known in the art.

VGAM1657 is a novel bioinformatically detected regulatory, non protein coding, viral micro RNA (miRNA) gene. The method by which VGAM1657 was detected is described hereinabove with reference to FIGS. 1-8.

VGAM1657 gene, herein designated VGAM GENE, is a viral gene contained in the genome of Molluscum Contagiosum Virus. VGAM1657 host target gene, herein designated VGAM HOST TARGET GENE, is a human gene contained in the human genome.

VGAM1657 gene encodes a VGAM1657 precursor RNA, herein designated VGAM PRECURSOR RNA. Similar to other miRNA genes, and unlike most ordinary genes, VGAM1657 precursor RNA does not encode a protein. A nucleotide sequence identical or highly similar to the nucleotide sequence of VGAM1657 precursor RNA is designated SEQ ID:1643, and is provided hereinbelow with reference to the sequence listing part. Nucleotide sequence SEQ ID:1643 is located at position 9944 relative to the genome of Molluscum Contagiosum Virus.

VGAM1657 precursor RNA folds onto itself, forming VGAM1657 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1657 folded precursor RNA into VGAM1657 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM1657 RNA is designated SEQ ID:4368, and is provided hereinbelow with reference to the sequence listing part.

VGAM1657 host target gene, herein designated VGAM HOST TARGET GENE, encodes a corresponding messenger RNA, VGAM1657 host target RNA, herein designated VGAM HOST TARGET RNA. VGAM1657 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1657 RNA, herein designated VGAM RNA, binds complementarily to one or more host target binding sites located in untranslated regions of VGAM1657 host target RNA, herein designated VGAM HOST TARGET RNA. This complementary binding is due to the fact that the nucleotide sequence of VGAM1657 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1657 RNA, herein designated VGAM RNA, may have a different number of host target binding sites in untranslated regions of a VGAM1657 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1657 RNA, herein designated VGAM RNA, to host target binding sites on VGAM1657 host target RNA, herein designated VGAM HOST TARGET RNA, such as BINDING SITE I, BINDING SITE II and BINDING SITE III, inhibits translation of VGAM1657 host target RNA into VGAM1657 host target protein, herein designated VGAM HOST TARGET PROTEIN. VGAM host target protein is therefore outlined by a broken line.

It is appreciated that VGAM1657 host target gene, herein designated VGAM HOST TARGET GENE, in fact represents a plurality of VGAM1657 host target genes. The mRNA of each one of this plurality of VGAM1657 host target genes comprises one or more host target binding sites, each having a nucleotide sequence which is at least partly complementary to VGAM1657 RNA, herein designated VGAM RNA, and which when bound by VGAM1657 RNA causes inhibition of translation of respective one or more VGAM1657 host target proteins.

It is further appreciated by one skilled in the art that the mode of translational inhibition illustrated by FIG. 1 with specific reference to translational inhibition exerted by VGAM1657 gene, herein designated VGAM GENE, on one or more VGAM1657 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1657 is inhibition of expression of host target genes, as part of a novel viral mechanism of attacking a host. Accordingly, utilities of VGAM1657 include diagnosis, prevention and treatment of viral infection by Molluscum Contagiosum Virus. Specific functions, and accordingly utilities, of VGAM1657 correlate with, and may be deduced from, the identity of the host target genes which VGAM1657 binds and inhibits, and the function of these host target genes, as elaborated hereinbelow.

Nucleotide sequences of the VGAM1657 precursor RNA, herein designated VGAM PRECURSOR RNA, and of the 'diced' VGAM1657 RNA, herein designated VGAM RNA, and a schematic representation of the secondary folding of VGAM1657 folded precursor RNA, herein designated VGAM FOLDED PRECURSOR RNA, of VGAM1657 are further described hereinbelow with reference to Table 1.

Nucleotide sequences of host target binding sites, such as BINDING SITE-I, BINDING SITE-II and BINDING SITE-III of FIG. 1, found on VGAM1657 host target RNA, and schematic representation of the complementarity of each of these host target binding sites to VGAM1657 RNA, herein designated VGAM RNA, are described hereinbelow with reference to Table 2.

As mentioned hereinabove with reference to FIG. 1, a function of VGAM1657 gene, herein designated VGAM is inhibition of expression of VGAM1657 target genes. It is appreciated that specific functions, and accordingly utilities, of VGAM1657 correlate with, and may be deduced from, the identity of the target genes which VGAM1657 binds and inhibits, and the function of these target genes, as elaborated hereinbelow.

MAP/microtubule Affinity-regulating Kinase 3 (MARK3, Accession NM_002376) is a VGAM1657 host target gene. MARK3 BINDING SITE is HOST TARGET binding site found in the 5' untranslated region of mRNA encoded by MARK3, corresponding to a HOST TARGET binding site such as BINDING SITE I, BINDING SITE II or BINDING SITE III. Table 2 illustrates the complementarity of the nucleotide sequences of MARK3 BINDING SITE, designated SEQ ID:8191, to the nucleotide sequence of VGAM1657 RNA, herein designated VGAM RNA, also designated SEQ ID:4368.

A function of VGAM1657 is therefore inhibition of MAP/microtubule Affinity-regulating Kinase 3 (MARK3, Accession NM_002376), a gene which may be involved in cell cycle regulation. Accordingly, utilities of VGAM1657 include diagnosis, prevention and treatment of diseases and clinical conditions associated with MARK3. The function of MARK3 and its association with various diseases and clinical conditions, has been established by previous studies, as described hereinabove with reference to VGAM964. FLJ21276 (Accession NM_024633) is another VGAM1657 host target gene. FLJ21276 BINDING SITE is HOST TARGET binding site found in the 3' untranslated region of mRNA encoded by FLJ21276, corresponding to a HOST TARGET binding site such as BINDING SITE I, BINDING SITE II or BINDING SITE III. Table 2 illustrates the complementarity of the nucleotide sequences of FLJ21276 BINDING SITE, designated SEQ ID:23901, to the nucleotide sequence of VGAM1657 RNA, herein designated VGAM RNA, also designated SEQ ID:4368.

Another function of VGAM1657 is therefore inhibition of FLJ21276 (Accession NM_024633). Accordingly, utilities of VGAM1657 include diagnosis, prevention and treatment of diseases and clinical conditions associated with FLJ21276. LOC92299 (Accession XM_044075) is another VGAM1657 host target gene. LOC92299 BINDING SITE is HOST TARGET binding site found in the 5' untranslated region of mRNA encoded by LOC92299, corresponding to a HOST TARGET binding site such as BINDING SITE I, BINDING SITE II or BINDING SITE III. Table 2 illustrates the complementarity of the nucleotide sequences of LOC92299 BINDING SITE, designated SEQ ID:34130, to the nucleotide sequence of VGAM1657 RNA, herein designated VGAM RNA, also designated SEQ ID:4368.

Another function of VGAM1657 is therefore inhibition of LOC92299 (Accession XM_044075). Accordingly, utilities of VGAM1657 include diagnosis, prevention and treatment of diseases and clinical conditions associated with LOC92299. FIG. 1 further provides a conceptual description of a novel bioinformatically detected viral gene of the present invention, referred to here as Viral Genomic Address Messenger 1658 (VGAM1658) viral gene, which modulates expression of respective host target genes thereof, the function and utility of which host target genes is known in the art.

VGAM1658 is a novel bioinformatically detected regulatory, non protein coding, viral micro RNA (miRNA) gene. The method by which VGAM1658 was detected is described hereinabove with reference to FIGS. 1-8.

VGAM1658 gene, herein designated VGAM GENE, is a viral gene contained in the genome of Molluscum Contagiosum Virus. VGAM1658 host target gene, herein designated VGAM HOST TARGET GENE, is a human gene contained in the human genome.

VGAM1658 gene encodes a VGAM1658 precursor RNA, herein designated VGAM PRECURSOR RNA. Similar to other miRNA genes, and unlike most ordinary genes, VGAM1658 precursor RNA does not encode a protein. A nucleotide sequence identical or highly similar to the nucleotide sequence of VGAM1658 precursor RNA is designated SEQ ID:1644, and is provided hereinbelow with reference to the sequence listing part. Nucleotide sequence SEQ ID:1644 is located at position 9453 relative to the genome of Molluscum Contagiosum Virus.

VGAM1658 precursor RNA folds onto itself, forming VGAM1658 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1658 folded precursor RNA into VGAM1658 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1658 RNA is designated SEQ ID:4369, and is provided hereinbelow with reference to the sequence listing part.

VGAM1658 host target gene, herein designated VGAM HOST TARGET GENE, encodes a corresponding messenger RNA, VGAM1658 host target RNA, herein designated VGAM HOST TARGET RNA. VGAM1658 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1658 RNA, herein designated VGAM RNA, binds complementarily to one or more host target binding sites located in untranslated regions of VGAM1658 host target RNA, herein designated VGAM HOST TARGET RNA. This complementary binding is due to the fact that the nucleotide sequence of VGAM1658 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1658 RNA, herein designated VGAM RNA, may have a different number of host target binding sites in untranslated regions of a VGAM1658 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1658 RNA, herein designated VGAM RNA, to host target binding sites on VGAM1658 host target RNA, herein designated VGAM HOST TARGET RNA, such as BINDING SITE I, BINDING SITE II and BINDING SITE III, inhibits translation of VGAM1658 host target RNA into VGAM1658 host target protein, herein designated VGAM HOST TARGET PROTEIN. VGAM host target protein is therefore outlined by a broken line.

It is appreciated that VGAM1658 host target gene, herein designated VGAM HOST TARGET GENE, in fact represents a plurality of VGAM1658 host target genes. The mRNA of each one of this plurality of VGAM1658 host target genes comprises one or more host target binding sites, each having a nucleotide sequence which is at least partly complementary to VGAM1658 RNA, herein designated VGAM RNA, and which when bound by VGAM1658 RNA causes inhibition of translation of respective one or more VGAM1658 host target proteins.

It is further appreciated by one skilled in the art that the mode of translational inhibition illustrated by FIG. 1 with specific reference to translational inhibition exerted by VGAM1658 gene, herein designated VGAM GENE, on one or more VGAM1658 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1658 is inhibition of expression of host target genes, as part of a novel viral mechanism of attacking a host. Accordingly, utilities of VGAM1658 include diagnosis, prevention and treatment of viral infection by Molluscum Contagiosum Virus. Specific functions, and accordingly utilities, of VGAM1658 correlate with, and may be deduced from, the identity of the host target genes which VGAM1658 binds and inhibits, and the function of these host target genes, as elaborated hereinbelow.

Nucleotide sequences of the VGAM1658 precursor RNA, herein designated VGAM PRECURSOR RNA, and of the 'diced' VGAM1658 RNA, herein designated VGAM RNA, and a schematic representation of the secondary folding of VGAM1658 folded precursor RNA, herein designated VGAM FOLDED PRECURSOR RNA, of VGAM1658 are further described hereinbelow with reference to Table 1.

Nucleotide sequences of host target binding sites, such as BINDING SITE-I, BINDING SITE-II and BINDING SITE-III of FIG. 1, found on VGAM1658 host target RNA, and schematic representation of the complementarity of each of these host target binding sites to VGAM1658 RNA, herein designated VGAM RNA, are described hereinbelow with reference to Table 2.

As mentioned hereinabove with reference to FIG. 1, a function of VGAM1658 gene, herein designated VGAM is inhibition of expression of VGAM1658 target genes. It is appreciated that specific functions, and accordingly utilities, of VGAM1658 correlate with, and may be deduced from, the identity of the target genes which VGAM1658 binds and inhibits, and the function of these target genes, as elaborated hereinbelow.

Ras Homolog Gene Family, Member C (ARHC, Accession NM_005167) is a VGAM1658 host target gene. ARHC BINDING SITE is HOST TARGET binding site found in the 5' untranslated region of mRNA encoded by ARHC, corresponding to a HOST TARGET binding site such as BINDING SITE I, BINDING SITE II or BINDING SITE III. Table 2 illustrates the complementarity of the nucleotide sequences of ARHC BINDING SITE, designated SEQ ID:11663, to the nucleotide sequence of VGAM1658 RNA, herein designated VGAM RNA, also designated SEQ ID:4369.

A function of VGAM1658 is therefore inhibition of Ras Homolog Gene Family, Member C (ARHC, Accession NM_005167), a gene which remodels of the actin cytoskeleton during cell morphogenesis and motility. Accordingly, utilities of VGAM1658 include diagnosis, prevention and treatment of diseases and clinical conditions associated with ARHC. The function of ARHC and its association with various diseases and clinical conditions, has been established by previous studies, as described hereinabove with reference to VGAM885. Histone Deacetylase 4 (HDAC4, Accession NM_006037) is another VGAM1658 host target gene. HDAC4 BINDING SITE is HOST TARGET binding site found in the 5' untranslated region of mRNA encoded by HDAC4, corresponding to a HOST TARGET binding site such as BINDING SITE I, BINDING SITE II or BINDING SITE III. Table 2 illustrates the complementarity of the nucleotide sequences of HDAC4 BINDING SITE, designated SEQ ID:12665, to the nucleotide sequence of VGAM1658 RNA, herein designated VGAM RNA, also designated SEQ ID:4369.

Another function of VGAM1658 is therefore inhibition of Histone Deacetylase 4 (HDAC4, Accession NM_006037), a gene which is responsible for the deacetylation of lysine residues on the n-terminal part of the core histones and may mediate transcriptional regulation. Accordingly, utilities of VGAM1658 include diagnosis, prevention and treatment of diseases and clinical conditions associated with HDAC4. The function of HDAC4 and its association with various diseases and clinical conditions, has been established by previous studies, as described hereinabove with reference to VGAM264. Inducible T-cell Co-stimulator (ICOS, Accession NM_012092) is another VGAM1658 host target gene. ICOS BINDING SITE is HOST TARGET binding site found in the 3' untranslated region of mRNA encoded by ICOS, corresponding to a HOST TARGET binding site such as BINDING SITE I, BINDING SITE II or BINDING SITE III. Table 2 illustrates the complementarity of the nucleotide sequences of ICOS BINDING SITE, designated SEQ ID:14391, to the nucleotide sequence of VGAM1658 RNA, herein designated VGAM RNA, also designated SEQ ID:4369.

Another function of VGAM1658 is therefore inhibition of Inducible T-cell Co-stimulator (ICOS, Accession NM_012092), a gene which forms homodimers and functions as an inducible T-cell co-stimulator. Accordingly, utilities of VGAM1658 include diagnosis, prevention and treatment of diseases and clinical conditions associated with ICOS. The function of ICOS and its association with various diseases and clinical conditions, has been established by previous studies, as described hereinabove with reference to VGAM18. LIM Domains Containing 1 (LIMD1, Accession NM_014240) is another VGAM1658 host target gene. LIMD1 BINDING SITE is HOST TARGET binding site found in the 3' untranslated region of mRNA encoded by LIMD1, corresponding to a HOST TARGET binding site such as BINDING SITE I, BINDING SITE II or BINDING SITE III. Table 2 illustrates the complementarity of the nucleotide sequences of LIMD1 BINDING SITE, designated SEQ ID:15501, to the nucleotide sequence of VGAM1658 RNA, herein designated VGAM RNA, also designated SEQ ID:4369.

Another function of VGAM1658 is therefore inhibition of LIM Domains Containing 1 (LIMD1, Accession NM_014240). Accordingly, utilities of VGAM1658 include diagnosis, prevention and treatment of diseases and clinical conditions associated with LIMD1. ASAH (Accession NM_004315) is another VGAM1658 host target gene. ASAH BINDING SITE is HOST TARGET binding site found in the 3' untranslated region of mRNA encoded by ASAH, corresponding to a HOST TARGET binding site such as BINDING SITE I, BINDING SITE II or BINDING SITE III. Table 2 illustrates the complementarity of the nucleotide sequences of ASAH BINDING SITE, designated SEQ ID:10518, to the nucleotide sequence of VGAM1658 RNA, herein designated VGAM RNA, also designated SEQ ID:4369.

Another function of VGAM1658 is therefore inhibition of ASAH (Accession NM_004315). Accordingly, utilities of VGAM1658 include diagnosis, prevention and treatment of diseases and clinical conditions associated with ASAH. KIAA0934 (Accession XM_034536) is another VGAM1658 host target gene. KIAA0934 BINDING SITE is HOST TARGET binding site found in the 3" untranslated region of mRNA encoded by KIAA0934, corresponding to a HOST TARGET binding site such as BINDING SITE I, BINDING SITE II or BINDING SITE III. Table 2 illustrates the complementarity of the nucleotide sequences of KIAA0934 BINDING SITE, designated SEQ ID:32121, to the nucleotide sequence of VGAM1658 RNA, herein designated VGAM RNA, also designated SEQ ID:4369.

Another function of VGAM1658 is therefore inhibition of KIAA0934 (Accession XM_034536). Accordingly, utilities of VGAM1658 include diagnosis, prevention and treatment of diseases and clinical conditions associated with KIAA0934. KIAA1904 (Accession XM_056282) is another VGAM1658 host target gene. KIAA1904 BINDING SITE is HOST TARGET binding site found in the 3' untranslated region of mRNA encoded by KIAA1904, corresponding to a HOST TARGET binding site such as BINDING SITE I, BINDING SITE II or BINDING SITE III. Table 2 illustrates the complementarity of the nucleotide sequences of KIAA1904 BINDING SITE, designated SEQ ID:36383, to the nucleotide sequence of VGAM1658 RNA, herein designated VGAM RNA, also designated SEQ ID:4369.

Another function of VGAM1658 is therefore inhibition of KIAA1904 (Accession XM_056282). Accordingly, utilities of VGAM1658 include diagnosis, prevention and treatment of diseases and clinical conditions associated with KIAA1904. LIP8 (Accession XM_113928) is another VGAM1658 host target gene. LIP8 BINDING SITE is HOST TARGET binding site found in the 5' untranslated region of mRNA encoded by LIP8, corresponding to a HOST TARGET binding site such as BINDING SITE I, BINDING SITE II or BINDING SITE III. Table 2 illustrates the complementarity of the nucleotide sequences of LIP8 BINDING SITE, designated SEQ ID:42547, to the nucleotide sequence of VGAM1658 RNA, herein designated VGAM RNA, also designated SEQ ID:4369.

Another function of VGAM1658 is therefore inhibition of LIP8 (Accession XM_113928). Accordingly, utilities of VGAM1658 include diagnosis, prevention and treatment of diseases and clinical conditions associated with LIP8. LOC149478 (Accession XM_086536) is another VGAM1658 host target gene. LOC149478 BINDING SITE is HOST TARGET binding site found in the 3' untranslated region of mRNA encoded by LOC149478, corresponding to a HOST TARGET binding site such as BINDING SITE I, BINDING SITE II or BINDING SITE III. Table 2 illustrates the complementarity of the nucleotide sequences of LOC149478 BINDING SITE, designated SEQ ID:38751, to the nucleotide sequence of VGAM1658 RNA, herein designated VGAM RNA, also designated SEQ ID:4369.

Another function of VGAM1658 is therefore inhibition of LOC149478 (Accession XM_086536). Accordingly, utilities of VGAM1658 include diagnosis, prevention and treatment of diseases and clinical conditions associated with LOC149478. LOC196477 (Accession XM_113728) is another VGAM1658 host target gene. LOC196477 BINDING SITE is HOST TARGET binding site found in the 3' untranslated region of mRNA encoded by LOC196477, corresponding to a HOST TARGET binding site such as BINDING SITE I, BINDING SITE II or BINDING SITE III. Table 2 illustrates the complementarity of the nucleotide sequences of LOC196477 BINDING SITE, designated SEQ ID:42376, to the nucleotide sequence of VGAM1658 RNA, herein designated VGAM RNA, also designated SEQ ID:4369.

Another function of VGAM1658 is therefore inhibition of LOC196477 (Accession XM_113728). Accordingly, utilities of VGAM1658 include diagnosis, prevention and treatment of diseases and clinical conditions associated with LOC196477. LOC199990 (Accession XM_114083) is another VGAM1658 host target gene. LOC199990 BINDING SITE is HOST TARGET binding site found in the 3' untranslated region of mRNA encoded by LOC199990, corresponding to a HOST TARGET binding site such as BINDING SITE I, BINDING SITE II or BINDING SITE III. Table 2 illustrates the complementarity of the nucleotide sequences of LOC199990 BINDING SITE, designated SEQ ID:42682, to the nucleotide sequence of VGAM1658 RNA, herein designated VGAM RNA, also designated SEQ ID:4369.

Another function of VGAM1658 is therefore inhibition of LOC199990 (Accession XM_114083). Accordingly, utilities of VGAM1658 include diagnosis, prevention and treatment of diseases and clinical conditions associated with LOC199990. LOC245806 (Accession XM_166309) is another VGAM1658 host target gene. LOC245806 BINDING SITE is HOST TARGET binding site found in the 3' untranslated region of mRNA encoded by LOC245806, corresponding to a HOST TARGET binding site such as BINDING SITE I, BINDING SITE II or BINDING SITE III. Table 2 illustrates the complementarity of the nucleotide sequences of LOC245806 BINDING SITE, designated SEQ ID:44132, to the nucleotide sequence of VGAM1658 RNA, herein designated VGAM RNA, also designated SEQ ID:4369.

Another function of VGAM1658 is therefore inhibition of LOC245806 (Accession XM_166309). Accordingly, utilities of VGAM1658 include diagnosis, prevention and treatment of diseases and clinical conditions associated with LOC245806. LOC91663 (Accession NM_138373) is another VGAM1658 host target gene. LOC91663 BINDING SITE is HOST TARGET binding site found in the 5' untranslated region of mRNA encoded by LOC91663, corresponding to a HOST TARGET binding site such as BINDING SITE I, BINDING SITE II or BINDING SITE III. Table 2 illustrates the complementarity of the nucleotide sequences of LOC91663 BINDING SITE, designated SEQ ID:28753, to the nucleotide sequence of VGAM1658 RNA, herein designated VGAM RNA, also designated SEQ ID:4369.

Another function of VGAM1658 is therefore inhibition of LOC91663 (Accession NM_138373). Accordingly, utilities of VGAM1658 include diagnosis, prevention and treatment of diseases and clinical conditions associated with LOC91663. FIG. 1 further provides a conceptual description of a novel bioinformatically detected viral gene of the present invention, referred to here as Viral Genomic Address Messenger 1659 (VGAM1659) viral gene, which modulates expression of respective host target genes thereof, the function and utility of which host target genes is known in the art.

VGAM1659 is a novel bioinformatically detected regulatory, non protein coding, viral micro RNA (miRNA) gene. The method by which VGAM1659 was detected is described hereinabove with reference to FIGS. 1-8.

VGAM1659 gene, herein designated VGAM GENE, is a viral gene contained in the genome of Molluscum Contagiosum Virus. VGAM1659 host target gene, herein designated VGAM HOST TARGET GENE, is a human gene contained in the human genome.

VGAM1659 gene encodes a VGAM1659 precursor RNA, herein designated VGAM PRECURSOR RNA. Similar to other miRNA genes, and unlike most ordinary genes, VGAM1659 precursor RNA does not encode a protein. A nucleotide sequence identical or highly similar to the nucleotide sequence of VGAM1659 precursor RNA is designated SEQ ID:1645, and is provided hereinbelow with reference to the sequence listing part. Nucleotide sequence SEQ ID:1645 is located at position 13023 relative to the genome of Molluscum Contagiosum Virus.

VGAM1659 precursor RNA folds onto itself, forming VGAM1659 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1659 folded precursor RNA into VGAM1659 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1659 RNA is designated SEQ ID:4370, and is provided hereinbelow with reference to the sequence listing part.

VGAM1659 host target gene, herein designated VGAM HOST TARGET GENE, encodes a corresponding messenger RNA, VGAM1659 host target RNA, herein designated VGAM HOST TARGET RNA. VGAM1659 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1659 RNA, herein designated VGAM RNA, binds complementarily to one or more host target binding sites located in untranslated regions of VGAM1659 host target RNA, herein designated VGAM HOST TARGET RNA. This complementary binding is due to the fact that the nucleotide sequence of VGAM1659 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1659 RNA, herein designated VGAM RNA, may have a different number of host target binding sites in untranslated regions of a VGAM1659 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1659 RNA, herein designated VGAM RNA, to host target binding sites on VGAM1659 host target RNA, herein designated VGAM HOST TARGET RNA, such as BINDING SITE I, BINDING SITE II and BINDING SITE III, inhibits translation of VGAM1659 host target RNA into VGAM1659 host target protein, herein designated VGAM HOST TARGET PROTEIN. VGAM host target protein is therefore outlined by a broken line.

It is appreciated that VGAM1659 host target gene, herein designated VGAM HOST TARGET GENE, in fact represents a plurality of VGAM1659 host target genes. The mRNA of each one of this plurality of VGAM1659 host target genes comprises one or more host target binding sites, each having a nucleotide sequence which is at least partly complementary to VGAM1659 RNA, herein designated VGAM RNA, and which when bound by VGAM1659 RNA causes inhibition of translation of respective one or more VGAM1659 host target proteins.

It is further appreciated by one skilled in the art that the mode of translational inhibition illustrated by FIG. 1 with specific reference to translational inhibition exerted by VGAM1659 gene, herein designated VGAM GENE, on one or more VGAM1659 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1659 is inhibition of expression of host target genes, as part of a novel viral mechanism of attacking a host. Accordingly, utilities of VGAM1659 include diagnosis, prevention and treatment of viral infection by Molluscum Contagiosum Virus. Specific functions, and accordingly utilities, of VGAM1659 correlate with, and may be deduced from, the identity of the host target genes which VGAM1659 binds and inhibits, and the function of these host target genes, as elaborated hereinbelow.

Nucleotide sequences of the VGAM1659 precursor RNA, herein designated VGAM PRECURSOR RNA, and of the 'diced' VGAM1659 RNA, herein designated VGAM RNA, and a schematic representation of the secondary folding of VGAM1659 folded precursor RNA, herein designated VGAM FOLDED PRECURSOR RNA, of VGAM1659 are further described hereinbelow with reference to Table 1.

Nucleotide sequences of host target binding sites, such as BINDING SITE-I, BINDING SITE-II and BINDING SITE-III of FIG. 1, found on VGAM1659 host target RNA, and schematic representation of the complementarity of each of these host target binding sites to VGAM1659 RNA, herein designated VGAM RNA, are described hereinbelow with reference to Table 2.

As mentioned hereinabove with reference to FIG. 1, a function of VGAM1659 gene, herein designated VGAM is inhibition of expression of VGAM1659 target genes. It is appreciated that specific functions, and accordingly utilities, of VGAM1659 correlate with, and may be deduced from, the identity of the target genes which VGAM1659 binds and inhibits, and the function of these target genes, as elaborated hereinbelow.

Egl Nine Homolog 2 (C. elegans) (EGLN2, Accession NM_080732) is a VGAM1659 host target gene. EGLN2 BINDING SITE is HOST TARGET binding site found in the 5' untranslated region of mRNA encoded by EGLN2, corresponding to a HOST TARGET binding site such as BINDING SITE I, BINDING SITE II or BINDING SITE III. Table 2 illustrates the complementarity of the nucleotide sequences of EGLN2 BINDING SITE, designated SEQ ID:28021, to the nucleotide sequence of VGAM1659 RNA, herein designated VGAM RNA, also designated SEQ ID:4370.

A function of VGAM1659 is therefore inhibition of Egl Nine Homolog 2 (C. elegans) (EGLN2, Accession NM_080732), a gene which is an essential component of the pathway. Accordingly, utilities of VGAM1659 include diagnosis, prevention and treatment of diseases and clinical conditions associated with EGLN2. The function of EGLN2 and its association with various diseases and clinical conditions, has been established by previous studies, as described hereinabove with reference to VGAM432. Early Growth Response 4 (EGR4, Accession NM_001965) is another VGAM1659 host target gene. EGR4 BINDING SITE is HOST TARGET binding site found in the 5' untranslated region of mRNA encoded by EGR4, corresponding to a HOST TARGET binding site such as BINDING SITE I, BINDING SITE II or BINDING SITE III. Table 2 illustrates the complementarity of the nucleotide sequences of EGR4 BINDING SITE, designated SEQ ID:7693, to the nucleotide sequence of VGAM1659 RNA, herein designated VGAM RNA, also designated SEQ ID:4370.

Another function of VGAM1659 is therefore inhibition of Early Growth Response 4 (EGR4, Accession NM_001965), a gene which is a Member of the early-response-gene family. Accordingly, utilities of VGAM1659 include diagnosis, prevention and treatment of diseases and clinical conditions associated with EGR4. The function of EGR4 has been established by previous studies. When eukaryotic cells are stimulated to undergo mitogenesis or differentiation, the expression of a small subset of genes, termed early response or immediate early genes, is rapidly activated. Many early response genes encode transcriptional regulators, for example, nerve growth factor-induced clones C and A, also called EGR4 and EGR1 (OMIM Ref. No. 128990), respectively. By use of fluorescence in situ hybridization, Crosby et al. (1992) localized the human EGR4 gene to 2p13. Barrow et al. (1994) demonstrated that the homologous gene in the mouse (Egr4) maps to chromosome 6 in a region of conserved homology of synteny with human chromosome 2.

Full details of the abovementioned studies are described in the following publications, the disclosure of which are hereby incorporated by reference:

Barrow, L. L.; Simin, K.; Jones, J. M.; Lee, D. C.; Meisler, M. H.: Conserved linkage of early growth response 4, annexin 4, and transforming growth factor alpha on mouse chromosome 6. Genomics 19:388-390, 1994; and Crosby, S. D.; Veile, R. A.; Donis-Keller, H.; Baraban, J. M.; Bhat, R. V.; Simburger, K. S.; Milbrandt, J.: Neural-specific expression, genomic structure, and chromosomal localization.

Further studies establishing the function and utilities of EGR4 are found in John Hopkins OMIM database record ID 128992, and in sited publications numbered 11668-11669 listed in the bibliography section hereinbelow, which are also hereby incorporated by reference. Myxovirus (influenza virus) Resistance 1, Interferon-inducible Protein P78 (mouse) (MX1, Accession NM_002462) is another VGAM1659 host target gene. MX1 BINDING SITE is HOST TARGET binding site found in the 5' untranslated region of mRNA encoded by MX1, corresponding to a HOST TARGET binding site such as BINDING SITE I, BINDING SITE II or BINDING SITE III. Table 2 illustrates the complementarity of the nucleotide sequences of MX1 BINDING SITE, designated SEQ ID:8292, to the nucleotide sequence of VGAM1659 RNA, herein designated VGAM RNA, also designated SEQ ID:4370.

Another function of VGAM1659 is therefore inhibition of Myxovirus (influenza virus) Resistance 1, Interferon-inducible Protein P78 (mouse) (MX1, Accession NM_002462), a gene which is responsible for a specific antiviral state against influenza virus infection. Accordingly, utilities of VGAM1659 include diagnosis, prevention and treatment of diseases and clinical conditions associated with MX1. The function of MX1 and its association with various diseases and clinical conditions, has been established by previous studies, as described hereinabove with reference to VGAM973. Transducin (beta)-like 1X-linked (TBL1X, Accession NM_005647) is another VGAM1659 host target gene. TBL1X BINDING SITE is HOST TARGET binding site found in the 3' untranslated region of mRNA encoded by TBL1X, corresponding to a HOST TARGET binding site such as BINDING SITE I, BINDING SITE II or BINDING SITE III. Table 2 illustrates the complementarity of the nucleotide sequences of TBL1X BINDING SITE, designated SEQ ID:12180, to the nucleotide sequence of VGAM1659 RNA, herein designated VGAM RNA, also designated SEQ ID:4370.

Another function of VGAM1659 is therefore inhibition of Transducin (beta)-like 1X-linked (TBL1X, Accession NM_005647), a gene which activates latent HDAC3 activity. Accordingly, utilities of VGAM1659 include diagnosis, prevention and treatment of diseases and clinical conditions associated with TBL1X. The function of TBL1X and its association with various diseases and clinical conditions, has been established by previous studies, as described hereinabove with reference to VGAM1151. ATPW (Accession NM_015684) is another VGAM1659 host target gene. ATPW BINDING SITE is HOST TARGET binding site found in the 5' untranslated region of mRNA encoded by ATPW, corresponding to a HOST TARGET binding site such as BINDING SITE I, BINDING SITE II or BINDING SITE III. Table 2 illustrates the complementarity of the nucleotide sequences of ATPW BINDING SITE, designated SEQ ID:17908, to the nucleotide sequence of VGAM1659 RNA, herein designated VGAM RNA, also designated SEQ ID:4370.

Another function of VGAM1659 is therefore inhibition of ATPW (Accession NM_015684). Accordingly, utilities of VGAM1659 include diagnosis, prevention and treatment of diseases and clinical conditions associated with ATPW. Chemokine (C-C motif) Receptor 1 (CCR1, Accession NM_001295) is another VGAM1659 host target gene. CCR1 BINDING SITE is HOST TARGET binding site found in the 3' untranslated region of mRNA encoded by CCR1, corresponding to a HOST TARGET binding site such as BINDING SITE I, BINDING SITE II or BINDING SITE III. Table 2 illustrates the complementarity of the nucleotide sequences of CCR1 BINDING SITE, designated SEQ ID:6974, to the nucleotide sequence of VGAM1659 RNA, herein designated VGAM RNA, also designated SEQ ID:4370.

Another function of VGAM1659 is therefore inhibition of Chemokine (C-C motif) Receptor 1 (CCR1, Accession NM_001295). Accordingly, utilities of VGAM1659 include diagnosis, prevention and treatment of diseases and clinical conditions associated with CCR1. FLJ12552 (Accession NM_022832) is another VGAM1659 host target gene. FLJ12552 BINDING SITE is HOST TARGET binding site found in the 3' untranslated region of mRNA encoded by FLJ12552, corresponding to a HOST TARGET binding site such as BINDING SITE I, BINDING SITE II or BINDING SITE III. Table 2 illustrates the complementarity of the nucleotide sequences of FLJ12552 BINDING SITE, designated SEQ ID:23115, to the nucleotide sequence of VGAM1659 RNA, herein designated VGAM RNA, also designated SEQ ID:4370.

Another function of VGAM1659 is therefore inhibition of FLJ12552 (Accession NM_022832). Accordingly, utilities of VGAM1659 include diagnosis, prevention and treatment of diseases and clinical conditions associated with FLJ12552. FLJ20306 (Accession NM_017756) is another VGAM1659 host target gene. FLJ20306 BINDING SITE is HOST TARGET binding site found in the 5' untranslated region of mRNA encoded by FLJ20306, corresponding to a HOST TARGET binding site such as BINDING SITE I, BINDING SITE II or BINDING SITE III. Table 2 illustrates the complementarity of the nucleotide sequences of FLJ20306 BINDING SITE, designated SEQ ID:19368, to the nucleotide sequence of VGAM1659 RNA, herein designated VGAM RNA, also designated SEQ ID:4370.

Another function of VGAM1659 is therefore inhibition of FLJ20306 (Accession NM_017756). Accordingly, utilities of VGAM1659 include diagnosis, prevention and treatment of diseases and clinical conditions associated with FLJ20306. FLJ32865 (Accession NM_144613) is another VGAM1659 host target gene. FLJ32865 BINDING SITE is HOST TARGET binding site found in the 3' untranslated region of mRNA encoded by FLJ32865, corresponding to a HOST TARGET binding site such as BINDING SITE I, BINDING SITE II or BINDING SITE III. Table 2 illustrates the complementarity of the nucleotide sequences of FLJ32865 BINDING SITE, designated SEQ ID:29424, to the nucleotide sequence of VGAM1659 RNA, herein designated VGAM RNA, also designated SEQ ID:4370.

Another function of VGAM1659 is therefore inhibition of FLJ32865 (Accession NM_144613). Accordingly, utilities of VGAM1659 include diagnosis, prevention and treatment of diseases and clinical conditions associated with FLJ32865. KIAA1910 (Accession XM_055514) is another VGAM1659 host target gene. KIAA1910 BINDING SITE is HOST TARGET binding site found in the 3' untranslated region of mRNA encoded by KIAA1910, corresponding to a HOST TARGET binding site such as BINDING SITE I, BINDING SITE II or BINDING SITE III. Table 2 illustrates the complementarity of the nucleotide sequences of KIAA1910 BINDING SITE, designated SEQ ID:36288, to the nucleotide sequence of VGAM1659 RNA, herein designated VGAM RNA, also designated SEQ ID:4370.

Another function of VGAM1659 is therefore inhibition of KIAA1910 (Accession XM_055514). Accordingly, utilities of VGAM1659 include diagnosis, prevention and treatment of diseases and clinical conditions associated with KIAA1910. LOC143888 (Accession XM_084669) is another VGAM1659 host target gene. LOC143888 BINDING SITE is HOST TARGET binding site found in the 3' untranslated region of mRNA encoded by LOC143888, corresponding to a HOST TARGET binding site such as BINDING SITE I, BINDING SITE II or BINDING SITE III. Table 2 illustrates the complementarity of the nucleotide sequences of LOC143888 BINDING SITE, designated SEQ ID:37668, to the nucleotide sequence of VGAM1659 RNA, herein designated VGAM RNA, also designated SEQ ID:4370.

Another function of VGAM1659 is therefore inhibition of LOC143888 (Accession XM_084669). Accordingly, utilities of VGAM1659 include diagnosis, prevention and treatment of diseases and clinical conditions associated with LOC143888. LOC157737 (Accession XM_098819) is another VGAM1659 host target gene. LOC157737 BINDING SITE is HOST TARGET binding site found in the 5' untranslated region of mRNA encoded by LOC157737, corresponding to a HOST TARGET binding site such as BINDING SITE I, BINDING SITE II or BINDING SITE III. Table 2 illustrates the complementarity of the nucleotide sequences of LOC157737 BINDING SITE, designated SEQ ID:41842, to the nucleotide sequence of VGAM1659 RNA, herein designated VGAM RNA, also designated SEQ ID:4370.

Another function of VGAM1659 is therefore inhibition of LOC157737 (Accession XM_098819). Accordingly, utilities of VGAM1659 include diagnosis, prevention and treatment of diseases and clinical conditions associated with LOC157737. LOC158310 (Accession XM_098919) is another VGAM1659 host target gene. LOC158310 BINDING SITE is HOST TARGET binding site found in the 5' untranslated region of mRNA encoded by LOC158310, corresponding to a HOST TARGET binding site such as BINDING SITE I, BINDING SITE II or BINDING SITE III. Table 2 illustrates the complementarity of the nucleotide sequences of LOC158310 BINDING SITE, designated SEQ ID:41948, to the nucleotide sequence of VGAM1659 RNA, herein designated VGAM RNA, also designated SEQ ID:4370.

Another function of VGAM1659 is therefore inhibition of LOC158310 (Accession XM_098919). Accordingly, utilities of VGAM1659 include diagnosis, prevention and treatment of diseases and clinical conditions associated with LOC158310. LOC163033 (Accession XM_091949) is another VGAM1659 host target gene. LOC163033 BINDING SITE is HOST TARGET binding site found in the 5' untranslated region of mRNA encoded by LOC163033, corresponding to a HOST TARGET binding site such as BINDING SITE I, BINDING SITE II or BINDING SITE III. Table 2 illustrates the complementarity of the nucleotide sequences of LOC163033 BINDING SITE, designated SEQ ID:40073, to the nucleotide sequence of VGAM1659 RNA, herein designated VGAM RNA, also designated SEQ ID:4370.

Another function of VGAM1659 is therefore inhibition of LOC163033 (Accession XM_091949). Accordingly, utilities of VGAM1659 include diagnosis, prevention and treatment of diseases and clinical conditions associated with LOC163033. FIG. 1 further provides a conceptual description of a novel bioinformatically detected viral gene of the present invention, referred to here as Viral Genomic Address Messenger 1660 (VGAM1660) viral gene, which modulates expression of respective host target genes thereof, the function and utility of which host target genes is known in the art.

VGAM1660 is a novel bioinformatically detected regulatory, non protein coding, viral micro RNA (miRNA) gene. The method by which VGAM1660 was detected is described hereinabove with reference to FIGS. 1-8.

VGAM1660 gene, herein designated VGAM GENE, is a viral gene contained in the genome of Molluscum Contagiosum Virus. VGAM1660 host target gene, herein designated VGAM HOST TARGET GENE, is a human gene contained in the human genome.

VGAM1660 gene encodes a VGAM1660 precursor RNA, herein designated VGAM PRECURSOR RNA. Similar to other miRNA genes, and unlike most ordinary genes, VGAM1660 precursor RNA does not encode a protein. A nucleotide sequence identical or highly similar to the nucleotide sequence of VGAM1660 precursor RNA is designated SEQ ID:1646, and is provided hereinbelow with reference to the sequence listing part. Nucleotide sequence SEQ ID:1646 is located at position 5477 relative to the genome of Molluscum Contagiosum Virus.

VGAM1660 precursor RNA folds onto itself, forming VGAM1660 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1660 folded precursor RNA into VGAM1660 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM1660 RNA is designated SEQ ID:4371, and is provided hereinbelow with reference to the sequence listing part.

VGAM1660 host target gene, herein designated VGAM HOST TARGET GENE, encodes a corresponding messenger RNA, VGAM1660 host target RNA, herein designated VGAM HOST TARGET RNA. VGAM1660 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1660 RNA, herein designated VGAM RNA, binds complementarily to one or more host target binding sites located in untranslated regions of VGAM1660 host target RNA, herein designated VGAM HOST TARGET RNA. This complementary binding is due to the fact that the nucleotide sequence of VGAM1660 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1660 RNA, herein designated VGAM RNA, may have a different number of host target binding sites in untranslated regions of a VGAM1660 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1660 RNA, herein designated VGAM RNA, to host target binding sites on VGAM1660 host target RNA, herein designated VGAM HOST TARGET RNA, such as BINDING SITE I, BINDING SITE II and BINDING SITE III, inhibits translation of VGAM1660 host target RNA into VGAM1660 host target protein, herein designated VGAM HOST TARGET PROTEIN. VGAM host target protein is therefore outlined by a broken line.

It is appreciated that VGAM1660 host target gene, herein designated VGAM HOST TARGET GENE, in fact represents a plurality of VGAM1660 host target genes. The mRNA of each one of this plurality of VGAM1660 host target genes comprises one or more host target binding sites, each having a nucleotide sequence which is at least partly complementary to VGAM1660 RNA, herein designated VGAM RNA, and which when bound by VGAM1660 RNA causes inhibition of translation of respective one or more VGAM1660 host target proteins.

It is further appreciated by one skilled in the art that the mode of translational inhibition illustrated by FIG. 1 with specific reference to translational inhibition exerted by VGAM1660 gene, herein designated VGAM GENE, on one or more VGAM1660 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1660 is inhibition of expression of host target genes, as part of a novel viral mechanism of attacking a host. Accordingly, utilities of VGAM1660 include diagnosis, prevention and treatment of viral infection by Molluscum Contagiosum Virus. Specific functions, and accordingly utilities, of VGAM1660 correlate with, and may be deduced from, the identity of the host target genes which VGAM1660 binds and inhibits, and the function of these host target genes, as elaborated hereinbelow.

Nucleotide sequences of the VGAM1660 precursor RNA, herein designated VGAM PRECURSOR RNA, and of the 'diced' VGAM1660 RNA, herein designated VGAM RNA, and a schematic representation of the secondary folding of VGAM1660 folded precursor RNA, herein designated VGAM FOLDED PRECURSOR RNA, of VGAM1660 are further described hereinbelow with reference to Table 1.

Nucleotide sequences of host target binding sites, such as BINDING SITE-I, BINDING SITE-II and BINDING SITE-III of FIG. 1, found on VGAM1660 host target RNA, and schematic representation of the complementarity of each of these host target binding sites to VGAM1660 RNA, herein designated VGAM RNA, are described hereinbelow with reference to Table 2.

As mentioned hereinabove with reference to FIG. 1, a function of VGAM1660 gene, herein designated VGAM is inhibition of expression of VGAM1660 target genes. It is appreciated that specific functions, and accordingly utilities, of VGAM1660 correlate with, and may be deduced from, the identity of the target genes which VGAM1660 binds and inhibits, and the function of these target genes, as elaborated hereinbelow.

BTG Family, Member 2 (BTG2, Accession NM_006763) is a VGAM1660 host target gene. BTG2 BINDING SITE is HOST TARGET binding site found in the 3' untranslated region of mRNA encoded by BTG2, corresponding to a HOST TARGET binding site such as BINDING SITE I, BINDING SITE II or BINDING SITE III. Table 2 illustrates the complementarity of the nucleotide sequences of BTG2 BINDING SITE, designated SEQ ID:13621, to the nucleotide sequence of VGAM1660 RNA, herein designated VGAM RNA, also designated SEQ ID:4371.

A function of VGAM1660 is therefore inhibition of BTG Family, Member 2 (BTG2, Accession NM_006763). Accordingly, utilities of VGAM1660 include diagnosis, prevention and treatment of diseases and clinical conditions associated with BTG2. Casein Kinase 1, Gamma 1 (CSNK1G1, Accession NM_022048) is another VGAM1660 host target gene. CSNK1G1 BINDING SITE is HOST TARGET binding site found in the 3' untranslated region of mRNA encoded by CSNK1G1, corresponding to a HOST TARGET binding site such as BINDING SITE I, BINDING SITE II or BINDING SITE III. Table 2 illustrates the complementarity of the nucleotide sequences of CSNK1G1 BINDING SITE, designated SEQ ID:22568, to the nucleotide sequence of VGAM1660 RNA, herein designated VGAM RNA, also designated SEQ ID:4371.

Another function of VGAM1660 is therefore inhibition of Casein Kinase 1, Gamma 1 (CSNK1G1, Accession NM_022048). Accordingly, utilities of VGAM1660 include diagnosis, prevention and treatment of diseases and clinical conditions associated with CSNK1G1. KIAA0528 (Accession XM_051454) is another VGAM1660 host target gene. KIAA0528 BINDING SITE is HOST TARGET binding site found in the 5' untranslated region of mRNA encoded by KIAA0528, corresponding to a HOST TARGET binding site such as BINDING SITE I, BINDING SITE II or BINDING SITE III. Table 2 illustrates the complementarity of the nucleotide sequences of KIAA0528 BINDING SITE, designated SEQ ID:35840, to the nucleotide sequence of VGAM1660 RNA, herein designated VGAM RNA, also designated SEQ ID:4371.

Another function of VGAM1660 is therefore inhibition of KIAA0528 (Accession XM_051454). Accordingly, utilities of VGAM1660 include diagnosis, prevention and treatment of diseases and clinical conditions associated with KIAA0528. KIAA0987 (Accession NM_012307) is another VGAM1660 host target gene. KIAA0987 BINDING SITE is HOST TARGET binding site found in the 3' untranslated region of mRNA encoded by KIAA0987, corresponding to a HOST TARGET binding site such as BINDING SITE I, BINDING SITE II or BINDING SITE III. Table 2 illustrates the complementarity of the nucleotide sequences of KIAA0987 BINDING SITE, designated SEQ ID:14674, to the nucleotide sequence of VGAM1660 RNA, herein designated VGAM RNA, also designated SEQ ID:4371.

Another function of VGAM1660 is therefore inhibition of KIAA0987 (Accession NM_012307). Accordingly, utilities of VGAM1660 include diagnosis, prevention and treatment of diseases and clinical conditions associated with KIAA0987. KIAA1117 (Accession XM_028219) is another VGAM1660 host target gene. KIAA1117 BINDING SITE is HOST TARGET binding site found in the 3' untranslated region of mRNA encoded by KIAA1117, corresponding to a HOST TARGET binding site such as BINDING SITE I, BINDING SITE II or BINDING SITE III. Table 2 illustrates the complementarity of the nucleotide sequences of KIAA1117 BINDING SITE, designated SEQ ID:30634, to the nucleotide sequence of VGAM1660 RNA, herein designated VGAM RNA, also designated SEQ ID:4371.

Another function of VGAM1660 is therefore inhibition of KIAA1117 (Accession XM_028219). Accordingly, utilities of VGAM1660 include diagnosis, prevention and treatment of diseases and clinical conditions associated with KIAA1117. LOC149146 (Accession XM_086441) is another VGAM1660 host target gene. LOC149146 BINDING SITE is HOST TARGET binding site found in the 5' untranslated region of mRNA encoded by LOC149146, corresponding to a HOST TARGET binding site such as BINDING SITE I, BINDING SITE II or BINDING SITE III. Table 2 illustrates the complementarity of the nucleotide sequences of LOC149146 BINDING SITE, designated SEQ ID:38656, to the nucleotide sequence of VGAM1660 RNA, herein designated VGAM RNA, also designated SEQ ID:4371.

Another function of VGAM1660 is therefore inhibition of LOC149146 (Accession XM_086441). Accordingly, utilities of VGAM1660 include diagnosis, prevention and treatment of diseases and clinical conditions associated with LOC149146. FIG. 1 further provides a conceptual description of a novel bioinformatically detected viral gene of the present invention, referred to here as Viral Genomic Address Messenger 1661 (VGAM1661) viral gene, which modulates expression of respective host target genes thereof, the function and utility of which host target genes is known in the art.

VGAM1661 is a novel bioinformatically detected regulatory, non protein coding, viral micro RNA (miRNA) gene. The method by which VGAM1661 was detected is described hereinabove with reference to FIGS. 1-8.

VGAM1661 gene, herein designated VGAM GENE, is a viral gene contained in the genome of Cercopithecine Herpesvirus 7. VGAM1661 host target gene, herein designated VGAM HOST TARGET GENE, is a human gene contained in the human genome.

VGAM1661 gene encodes a VGAM1661 precursor RNA, herein designated VGAM PRECURSOR RNA. Similar to other miRNA genes, and unlike most ordinary genes, VGAM1661 precursor RNA does not encode a protein. A nucleotide sequence identical or highly similar to the nucleotide sequence of VGAM1661 precursor RNA is designated SEQ ID:1647, and is provided hereinbelow with reference to the sequence listing part. Nucleotide sequence SEQ ID:1647 is located at position 100245 relative to the genome of Cercopithecine Herpesvirus 7.

VGAM1661 precursor RNA folds onto itself, forming VGAM1661 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1661 folded precursor RNA into VGAM1661 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1661 RNA is designated SEQ ID:4372, and is provided hereinbelow with reference to the sequence listing part.

VGAM1661 host target gene, herein designated VGAM HOST TARGET GENE, encodes a corresponding messenger RNA, VGAM1661 host target RNA, herein designated VGAM HOST TARGET RNA. VGAM1661 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1661 RNA, herein designated VGAM RNA, binds complementarily to one or more host target binding sites located in untranslated regions of VGAM1661 host target RNA, herein designated VGAM HOST TARGET RNA. This complementary binding is due to the fact that the nucleotide sequence of VGAM1661 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1661 RNA, herein designated VGAM RNA, may have a different number of host target binding sites in untranslated regions of a VGAM1661 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1661 RNA, herein designated VGAM RNA, to host target binding sites on VGAM1661 host target RNA, herein designated VGAM HOST TARGET RNA, such as BINDING SITE I, BINDING SITE II and BINDING SITE III, inhibits translation of VGAM1661 host target RNA into VGAM1661 host target protein, herein designated VGAM HOST TARGET PROTEIN. VGAM host target protein is therefore outlined by a broken line.

It is appreciated that VGAM1661 host target gene, herein designated VGAM HOST TARGET GENE, in fact represents a plurality of VGAM1661 host target genes. The mRNA of each one of this plurality of VGAM1661 host target genes comprises one or more host target binding sites, each having a nucleotide sequence which is at least partly complementary to VGAM1661 RNA, herein designated VGAM RNA, and which when bound by VGAM1661 RNA causes inhibition of translation of respective one or more VGAM1661 host target proteins.

It is further appreciated by one skilled in the art that the mode of translational inhibition illustrated by FIG. 1 with specific reference to translational inhibition exerted by VGAM1661 gene, herein designated VGAM GENE, on one or more VGAM1661 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1661 is inhibition of expression of host target genes, as part of a novel viral mechanism of attacking a host. Accordingly, utilities of VGAM1661 include diagnosis, prevention and treatment of viral infection by Cercopithecine Herpesvirus 7. Specific functions, and accordingly utilities, of VGAM1661 correlate with, and may be deduced from, the identity of the host target genes which VGAM1661 binds and inhibits, and the function of these host target genes, as elaborated hereinbelow.

Nucleotide sequences of the VGAM1661 precursor RNA, herein designated VGAM PRECURSOR RNA, and of the 'diced' VGAM1661 RNA, herein designated VGAM RNA, and a schematic representation of the secondary folding of VGAM1661 folded precursor RNA, herein designated VGAM FOLDED PRECURSOR RNA, of VGAM1661 are further described hereinbelow with reference to Table 1.

Nucleotide sequences of host target binding sites, such as BINDING SITE-I, BINDING SITE-II and BINDING SITE-III of FIG. 1, found on VGAM1661 host target RNA, and schematic representation of the complementarity of each of these host target binding sites to VGAM1661 RNA, herein designated VGAM RNA, are described hereinbelow with reference to Table 2.

As mentioned hereinabove with reference to FIG. 1, a function of VGAM1661 gene, herein designated VGAM is inhibition of expression of VGAM1661 target genes. It is appreciated that specific functions, and accordingly utilities, of VGAM1661 correlate with, and may be deduced from, the identity of the target genes which VGAM1661 binds and inhibits, and the function of these target genes, as elaborated hereinbelow.

Ephrin-A5 (EFNA5, Accession NM_001962) is a VGAM1661 host target gene. EFNA5 BINDING SITE is HOST TARGET binding site found in the 3' untranslated region of mRNA encoded by EFNA5, corresponding to a HOST TARGET binding site such as BINDING SITE I, BINDING SITE II or BINDING SITE III. Table 2 illustrates the complementarity of the nucleotide sequences of EFNA5 BINDING SITE, designated SEQ ID:7683, to the nucleotide sequence of VGAM1661 RNA, herein designated VGAM RNA, also designated SEQ ID:4372.

A function of VGAM1661 is therefore inhibition of Ephrin-A5 (EFNA5, Accession NM_001962). Accordingly, utilities of VGAM1661 include diagnosis, prevention and treatment of diseases and clinical conditions associated with EFNA5. LOC151445 (Accession XM_045283) is another VGAM1661 host target gene. LOC151445 BINDING SITE is HOST TARGET binding site found in the 3' untranslated region of mRNA encoded by LOC151445, corresponding to a HOST TARGET binding site such as BINDING SITE I, BINDING SITE II or BINDING SITE III. Table 2 illustrates the complementarity of the nucleotide sequences of LOC151445 BINDING SITE, designated SEQ ID:34418, to the nucleotide sequence of VGAM1661 RNA, herein designated VGAM RNA, also designated SEQ ID:4372.

Another function of VGAM1661 is therefore inhibition of LOC151445 (Accession XM_045283). Accordingly, utilities of VGAM1661 include diagnosis, prevention and treatment of diseases and clinical conditions associated with LOC151445. LOC161635 (Accession XM_172921) is another VGAM1661 host target gene. LOC161635 BINDING SITE is HOST TARGET binding site found in the 5' untranslated region of mRNA encoded by LOC161635, corresponding to a HOST TARGET binding site such as BINDING SITE I, BINDING SITE II or BINDING SITE III. Table 2 illustrates the complementarity of the nucleotide sequences of LOC161635 BINDING SITE, designated SEQ ID:46183, to the nucleotide sequence of VGAM1661 RNA, herein designated VGAM RNA, also designated SEQ ID:4372.

Another function of VGAM1661 is therefore inhibition of LOC161635 (Accession XM_172921). Accordingly, utilities of VGAM1661 include diagnosis, prevention and treatment of diseases and clinical conditions associated with LOC161635. FIG. 1 further provides a conceptual description of a novel bioinformatically detected viral gene of the present invention, referred to here as Viral Genomic Address Messenger 1662 (VGAM1662) viral gene, which modulates expression of respective host target genes thereof, the function and utility of which host target genes is known in the art.

VGAM1662 is a novel bioinformatically detected regulatory, non protein coding, viral micro RNA (miRNA) gene. The method by which VGAM1662 was detected is described hereinabove with reference to FIGS. 1-8.

VGAM1662 gene, herein designated VGAM GENE, is a viral gene contained in the genome of Cercopithecine Herpesvirus 7. VGAM1662 host target gene, herein designated VGAM HOST TARGET GENE, is a human gene contained in the human genome.

VGAM1662 gene encodes a VGAM1662 precursor RNA, herein designated VGAM PRECURSOR RNA. Similar to other miRNA genes, and unlike most ordinary genes, VGAM1662 precursor RNA does not encode a protein. A nucleotide sequence identical or highly similar to the nucleotide sequence of VGAM1662 precursor RNA is designated SEQ ID:1648, and is provided hereinbelow with reference to the sequence listing part. Nucleotide sequence SEQ ID:1648 is located at position 99606 relative to the genome of Cercopithecine Herpesvirus 7.

VGAM1662 precursor RNA folds onto itself, forming VGAM1662 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1662 folded precursor RNA into VGAM1662 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1662 RNA is designated SEQ ID:4373, and is provided hereinbelow with reference to the sequence listing part.

VGAM1662 host target gene, herein designated VGAM HOST TARGET GENE, encodes a corresponding messenger RNA, VGAM1662 host target RNA, herein designated VGAM HOST TARGET RNA. VGAM1662 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1662 RNA, herein designated VGAM RNA, binds complementarily to one or more host target binding sites located in untranslated regions of VGAM1662 host target RNA, herein designated VGAM HOST TARGET RNA. This complementary binding is due to the fact that the nucleotide sequence of VGAM1662 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1662 RNA, herein designated VGAM RNA, may have a different number of host target binding sites in untranslated regions of a VGAM1662 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1662 RNA, herein designated VGAM RNA, to host target binding sites on VGAM1662 host target RNA, herein designated VGAM HOST TARGET RNA, such as BINDING SITE I, BINDING SITE II and BINDING SITE III, inhibits translation of VGAM1662 host target RNA into VGAM1662 host target protein, herein designated VGAM HOST TARGET PROTEIN. VGAM host target protein is therefore outlined by a broken line.

It is appreciated that VGAM1662 host target gene, herein designated VGAM HOST TARGET GENE, in fact represents a plurality of VGAM1662 host target genes. The mRNA of each one of this plurality of VGAM1662 host target genes comprises one or more host target binding sites, each having a nucleotide sequence which is at least partly complementary to VGAM1662 RNA, herein designated VGAM RNA, and which when bound by VGAM1662 RNA causes inhibition of translation of respective one or more VGAM1662 host target proteins.

It is further appreciated by one skilled in the art that the mode of translational inhibition illustrated by FIG. 1 with specific reference to translational inhibition exerted by VGAM1662 gene, herein designated VGAM GENE, on one or more VGAM1662 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1662 is inhibition of expression of host target genes, as part of a novel viral mechanism of attacking a host. Accordingly, utilities of VGAM1662 include diagnosis, prevention and treatment of viral infection by Cercopithecine Herpesvirus 7. Specific functions, and accordingly utilities, of VGAM1662 correlate with, and may be deduced from, the identity of the host target genes which VGAM1662 binds and inhibits, and the function of these host target genes, as elaborated hereinbelow.

Nucleotide sequences of the VGAM1662 precursor RNA, herein designated VGAM PRECURSOR RNA, and of the 'diced' VGAM1662 RNA, herein designated VGAM RNA, and a schematic representation of the secondary folding of VGAM1662 folded precursor RNA, herein designated VGAM FOLDED PRECURSOR RNA, of VGAM1662 are further described hereinbelow with reference to Table 1.

Nucleotide sequences of host target binding sites, such as BINDING SITE-I, BINDING SITE-II and BINDING SITE-III of FIG. 1, found on VGAM1662 host target RNA, and schematic representation of the complementarity of each of these host target binding sites to VGAM1662 RNA, herein designated VGAM RNA, are described hereinbelow with reference to Table 2.

As mentioned hereinabove with reference to FIG. 1, a function of VGAM1662 gene, herein designated VGAM is inhibition of expression of VGAM1662 target genes. It is appreciated that specific functions, and accordingly utilities, of VGAM1662 correlate with, and may be deduced from, the identity of the target genes which VGAM1662 binds and inhibits, and the function of these target genes, as elaborated hereinbelow.

Dystroglycan 1 (dystrophin-associated glycoprotein 1) (DAG1, Accession NM_004393) is a VGAM1662 host target gene. DAG1 BINDING SITE is HOST TARGET binding site found in the 3' untranslated region of mRNA encoded by DAG1, corresponding to a HOST TARGET binding site such as BINDING SITE I, BINDING SITE II or BINDING SITE III. Table 2 illustrates the complementarity of the nucleotide sequences of DAG1 BINDING SITE, designated SEQ ID:10635, to the nucleotide sequence of VGAM1662 RNA, herein designated VGAM RNA, also designated SEQ ID:4373.

A function of VGAM1662 is therefore inhibition of Dystroglycan 1 (dystrophin-associated glycoprotein 1) (DAG1, Accession NM_004393), a gene which may provide linkage between the sarcolemma and extracellular matrix (ECM). Accordingly, utilities of VGAM1662 include diagnosis, prevention and treatment of diseases and clinical conditions associated with DAG1. The function of DAG1 and its association with various diseases and clinical conditions, has been established by previous studies, as described hereinabove with reference to VGAM1095. Heterogeneous Nuclear Ribonucleoprotein D-like (HNRPDL, Accession NM_005463) is another VGAM1662 host target gene. HNRPDL BINDING SITE is HOST TARGET binding site found in the 3' untranslated region of mRNA encoded by HNRPDL, corresponding to a HOST TARGET binding site such as BINDING SITE I, BINDING SITE II or BINDING SITE III. Table 2 illustrates the complementarity of the nucleotide sequences of HNRPDL BINDING SITE, designated SEQ ID:11951, to the nucleotide sequence of VGAM1662 RNA, herein designated VGAM RNA, also designated SEQ ID:4373.

Another function of VGAM1662 is therefore inhibition of Heterogeneous Nuclear Ribonucleoprotein D-like (HNRPDL, Accession NM_005463), a gene which binds to rna molecules that contain au-rich elements. Accordingly, utilities of VGAM1662 include diagnosis, prevention and treatment of diseases and clinical conditions associated with HNRPDL. The function of HNRPDL and its association with various diseases and clinical conditions, has been established by previous studies, as described hereinabove with reference to VGAM144. Phosphodiesterase 7A (PDE7A, Accession XM_037534) is another VGAM1662 host target gene. PDE7A BINDING SITE is HOST TARGET binding site found in the 3' untranslated region of mRNA encoded by PDE7A, corresponding to a HOST TARGET binding site such as BINDING SITE I, BINDING SITE II or BINDING SITE III. Table 2 illustrates the complementarity of the nucleotide sequences of PDE7A BINDING SITE, designated SEQ ID:32641, to the nucleotide sequence of VGAM1662 RNA, herein designated VGAM RNA, also designated SEQ ID:4373.

Another function of VGAM1662 is therefore inhibition of Phosphodiesterase 7A (PDE7A, Accession XM_037534), a gene which is a CAMP-specific phosphodiesterase 7A and plays a role in signal transduction. Accordingly, utilities of VGAM1662 include diagnosis, prevention and treatment of diseases and clinical conditions associated with PDE7A. The function of PDE7A has been established by previous studies. Cyclic nucleotides serve as second messengers that mediate a variety of cellular responses to extracellular signals such as hormones, light, and neurotransmitters. Cyclic nucleotide phosphodiesterases (PDEs) play a role in signal transduction by regulating the cellular concentrations of cyclic nucleotides. Mammalian cells contain multiple PDEs that are distinguished into at least 7 families based on their substrate affinity and on their selective sensitivity to cofactors and inhibitory drugs. These families are: (I) Ca (2+)/calmodulin-dependent PDEs; (II) cGMP-stimulated PDEs; (III) cGMP-inhibited PDEs; (IV) cAMP-specific PDEs; (V) cGMP-specific PDEs; (VI) photoreceptor PDEs; and (VII) high-affinity, cAMP-specific. From the amino acid sequences, it is evident that all these PDE families contain a related domain, thought to be the catalytic domain, with approximately 30% sequence identity between families. Members of the same family are more closely related; they share 60 to 80% sequence identity throughout the entire coding region. Michaeli et al. (1993) established a highly sensitive functional screen for the isolation of cDNAs encoding cAMP phosphodiesterases by complementation of defects in the Saccharomyces cerevisiae strain lacking both endogenous cAMP PDE genes, PDE1 and PDE2. Three groups of cDNAs corresponding to 3 distinct human genes encoding cAMP-specific PDEs were isolated from a human glioblastoma cDNA library using this functional screen. Two of the genes were closely related to the Drosophila 'dunce' cAMP-specific PDE. The third gene, which Michaeli et al. (1993) referred to as HCP1, encoded a novel cAMP-specific PDE. HCP1 had an amino acid sequence related to the sequences of the catalytic domains of all cyclic nucleotide PDEs. It is a high-affinity cAMP-specific PDE that does not share other properties of the cAMP-specific PDE family, however. The PDE activity of HCP1 was not sensitive to cGMP or other inhibitors of the cGMP-inhibitable PDEs. The biochemical and pharmacologic properties of HCP1 suggested to Michaeli et al. (1993) that it is a member of a previously undiscovered cyclic nucleotide PDE family, which they designated as family VII. Northern blot analysis indicated the presence of high levels of an HCP1 mRNA in human skeletal muscle.

Full details of the abovementioned studies are described in the following publications, the disclosure of which are hereby incorporated by reference:

Han, P.; Fletcher, C. F.; Copeland, N. G.; Jenkins, N. A.; Yaremko, L. M.; Michaeli, T.: Assignment of the mouse Pde7A gene to the proximal region of chromosome 3 and of the human PDE7A gene to chromosome 8q13. Genomics 48:275-276, 1998; and Michaeli, T.; Bloom, T. J.; Martins, T.; Loughney, K.; Ferguson, K.; Riggs, M.; Rodgers, L.; Beavo, J. A.; Wigler, M.: Isolation and characterization of a previously undetected human c.

Further studies establishing the function and utilities of PDE7A are found in John Hopkins OMIM database record ID 171885, and in sited publications numbered 12443-12445 listed in the bibliography section hereinbelow, which are also hereby incorporated by reference. Ret Finger Protein (RFP, Accession NM_006510) is another VGAM1662 host target gene. RFP BINDING SITE is HOST TARGET binding site found in the 3' untranslated region of mRNA encoded by RFP, corresponding to a HOST TARGET binding site such as BINDING SITE I, BINDING SITE II or BINDING SITE III. Table 2 illustrates the complementarity of the nucleotide sequences of RFP BINDING SITE, designated SEQ ID:13262, to the nucleotide sequence of VGAM1662 RNA, herein designated VGAM RNA, also designated SEQ ID:4373.

Another function of VGAM1662 is therefore inhibition of Ret Finger Protein (RFP, Accession NM_006510), a gene which involvels in transcriptional regulation and may act in male germ cell development. Accordingly, utilities of VGAM1662 include diagnosis, prevention and treatment of diseases and clinical conditions associated with RFP. The function of RFP and its association with various diseases and clinical conditions, has been established by previous studies, as described hereinabove with reference to VGAM302. DKFZp434G179 (Accession XM_087065) is another VGAM1662 host target gene. DKFZp434G179 BINDING SITE is HOST TARGET binding site found in the 3' untranslated region of mRNA encoded by DKFZp434G179, corresponding to a HOST TARGET binding site such as BINDING SITE I, BINDING SITE II or BINDING SITE III. Table 2 illustrates the complementarity of the nucleotide sequences of DKFZp434G179 BINDING SITE, designated SEQ ID:39044, to the nucleotide sequence of VGAM1662 RNA, herein designated VGAM RNA, also designated SEQ ID:4373.

Another function of VGAM1662 is therefore inhibition of DKFZp434G179 (Accession XM_087065). Accordingly, utilities of VGAM1662 include diagnosis, prevention and treatment of diseases and clinical conditions associated with DKFZp434G179. Family with Sequence Similarity 8, Member A1 (FAM8A1, Accession NM_016255) is another VGAM1662 host target gene. FAM8A1 BINDING SITE is HOST TARGET binding site found in the 3' untranslated region of mRNA encoded by FAM8A1, corresponding to a HOST TARGET binding site such as BINDING SITE I, BINDING SITE II or BINDING SITE III. Table 2 illustrates the complementarity of the nucleotide sequences of FAM8A1 BINDING SITE, designated SEQ ID:18382, to the nucleotide sequence of VGAM1662 RNA, herein designated VGAM RNA, also designated SEQ ID:4373.

Another function of VGAM1662 is therefore inhibition of Family with Sequence Similarity 8, Member A1 (FAM8A1, Accession NM_016255). Accordingly, utilities of VGAM1662 include diagnosis, prevention and treatment of diseases and clinical conditions associated with FAM8A1. FLJ13456 (Accession XM_038291) is another VGAM1662 host target gene. FLJ13456 BINDING SITE is HOST TARGET binding site found in the 3' untranslated region of mRNA encoded by FLJ13456, corresponding to a HOST TARGET binding site such as BINDING SITE I, BINDING SITE II or BINDING SITE III. Table 2 illustrates the complementarity of the nucleotide sequences of FLJ13456 BINDING SITE, designated SEQ ID:32799, to the nucleotide sequence of VGAM1662 RNA, herein designated VGAM RNA, also designated SEQ ID:4373.

Another function of VGAM1662 is therefore inhibition of FLJ13456 (Accession XM_038291). Accordingly, utilities of VGAM1662 include diagnosis, prevention and treatment of diseases and clinical conditions associated with FLJ13456. KIAA1189 (Accession XM_050508) is another VGAM1662 host target gene. KIAA1189 BINDING SITE is HOST TARGET binding site found in the 3' untranslated region of mRNA encoded by KIAA1189, corresponding to a HOST TARGET binding site such as BINDING SITE I, BINDING SITE II or BINDING SITE III. Table 2 illustrates the complementarity of the nucleotide sequences of KIAA1189 BINDING SITE, designated SEQ ID:35653, to the nucleotide sequence of VGAM1662 RNA, herein designated VGAM RNA, also designated SEQ ID:4373.

Another function of VGAM1662 is therefore inhibition of KIAA1189 (Accession XM_050508). Accordingly, utilities of VGAM1662 include diagnosis, prevention and treatment of diseases and clinical conditions associated with KIAA1189. Phospholipase A2-activating Protein (PLAA, Accession NM_004253) is another VGAM1662 host target gene. PLAA BINDING SITE is HOST TARGET binding site found in the 3' untranslated region of mRNA encoded by PLAA, corresponding to a HOST TARGET binding site such as BINDING SITE I, BINDING SITE II or BINDING SITE III. Table 2 illustrates the complementarity of the nucleotide sequences of PLAA BINDING SITE, designated SEQ ID:10441, to the nucleotide sequence of VGAM1662 RNA, herein designated VGAM RNA, also designated SEQ ID:4373.

Another function of VGAM1662 is therefore inhibition of Phospholipase A2-activating Protein (PLAA, Accession NM_004253). Accordingly, utilities of VGAM1662 include diagnosis, prevention and treatment of diseases and clinical conditions associated with PLAA. Solute Carrier Family 2 (facilitated glucose transporter), Member 13 (SLC2A13, Accession NM_052885) is another VGAM1662 host target gene. SLC2A13 BINDING SITE is HOST TARGET binding site found in the 3' untranslated region of mRNA encoded by SLC2A13, corresponding to a HOST TARGET binding site such as BINDING SITE I, BINDING SITE II or BINDING SITE III. Table 2 illustrates the complementarity of the nucleotide sequences of SLC2A13 BINDING SITE, designated SEQ ID:27466, to the nucleotide sequence of VGAM1662 RNA, herein designated VGAM RNA, also designated SEQ ID:4373.

Another function of VGAM1662 is therefore inhibition of Solute Carrier Family 2 (facilitated glucose transporter), Member 13 (SLC2A13, Accession NM_052885). Accordingly, utilities of VGAM1662 include diagnosis, prevention and treatment of diseases and clinical conditions associated with SLC2A13. Extracellular Link Domain Containing 1 (XLKD1, Accession NM_006691) is another VGAM1662 host target gene. XLKD1 BINDING SITE is HOST TARGET binding site found in the 3' untranslated region of mRNA encoded by XLKD1, corresponding to a HOST TARGET binding site such as BINDING SITE I, BINDING SITE II or BINDING SITE III. Table 2 illustrates the complementarity of the nucleotide sequences of XLKD1 BINDING SITE, designated SEQ ID:13507, to the nucleotide sequence of VGAM1662 RNA, herein designated VGAM RNA, also designated SEQ ID:4373.

Another function of VGAM1662 is therefore inhibition of Extracellular Link Domain Containing 1 (XLKD1, Accession NM_006691). Accordingly, utilities of VGAM1662 include diagnosis, prevention and treatment of diseases and clinical conditions associated with XLKD1. LOC144997 (Accession XM_096702) is another VGAM1662 host target gene. LOC144997 BINDING SITE is HOST TARGET binding site found in the 3' untranslated region of mRNA encoded by LOC144997, corresponding to a HOST TARGET binding site such as BINDING SITE I, BINDING SITE II or BINDING SITE III. Table 2 illustrates the complementarity of the nucleotide sequences of LOC144997 BINDING SITE, designated SEQ ID:40483, to the nucleotide sequence of VGAM1662 RNA, herein designated VGAM RNA, also designated SEQ ID:4373.

Another function of VGAM1662 is therefore inhibition of LOC144997 (Accession XM_096702). Accordingly, utilities of VGAM1662 include diagnosis, prevention and treatment of diseases and clinical conditions associated with LOC144997. LOC149076 (Accession XM_086415) is another VGAM1662 host target gene. LOC149076 BINDING SITE is HOST TARGET binding site found in the 3' untranslated region of mRNA encoded by LOC149076, corresponding to a HOST TARGET binding site such as BINDING SITE I, BINDING SITE II or BINDING SITE III. Table 2 illustrates the complementarity of the nucleotide sequences of LOC149076 BINDING SITE, designated SEQ ID:38638, to the nucleotide sequence of VGAM1662 RNA, herein designated VGAM RNA, also designated SEQ ID:4373.

Another function of VGAM1662 is therefore inhibition of LOC149076 (Accession XM_086415). Accordingly, utilities of VGAM1662 include diagnosis, prevention and treatment of diseases and clinical conditions associated with LOC149076. LOC152674 (Accession XM_098251) is another VGAM1662 host target gene. LOC152674 BINDING SITE is HOST TARGET binding site found in the 3' untranslated region of mRNA encoded by LOC152674, corresponding to a HOST TARGET binding site such as BINDING SITE I, BINDING SITE II or BINDING SITE III. Table 2 illustrates the complementarity of the nucleotide sequences of LOC152674 BINDING SITE, designated SEQ ID:41538, to the nucleotide sequence of VGAM1662 RNA, herein designated VGAM RNA, also designated SEQ ID:4373.

Another function of VGAM1662 is therefore inhibition of LOC152674 (Accession XM_098251). Accordingly, utilities of VGAM1662 include diagnosis, prevention and treatment of diseases and clinical conditions associated with LOC152674. LOC158038 (Accession XM_088446) is another VGAM1662 host target gene. LOC158038 BINDING SITE is HOST TARGET binding site found in the 5' untranslated region of mRNA encoded by LOC158038, corresponding to a HOST TARGET binding site such as BINDING SITE I, BINDING SITE II or BINDING SITE III. Table 2 illustrates the complementarity of the nucleotide sequences of LOC158038 BINDING SITE, designated SEQ ID:39700, to the nucleotide sequence of VGAM1662 RNA, herein designated VGAM RNA, also designated SEQ ID:4373.

Another function of VGAM1662 is therefore inhibition of LOC158038 (Accession XM_088446). Accordingly, utilities of VGAM1662 include diagnosis, prevention and treatment of diseases and clinical conditions associated with LOC158038. FIG. 1 further provides a conceptual description of a novel bioinformatically detected viral gene of the present invention, referred to here as Viral Genomic Address Messenger 1663 (VGAM1663) viral gene, which modulates expression of respective host target genes thereof, the function and utility of which host target genes is known in the art.

VGAM1663 is a novel bioinformatically detected regulatory, non protein coding, viral micro RNA (miRNA) gene. The method by which VGAM1663 was detected is described hereinabove with reference to FIGS. 1-8.

VGAM1663 gene, herein designated VGAM GENE, is a viral gene contained in the genome of Cercopithecine Herpesvirus 7. VGAM1663 host target gene, herein designated VGAM HOST TARGET GENE, is a human gene contained in the human genome.

VGAM1663 gene encodes a VGAM1663 precursor RNA, herein designated VGAM PRECURSOR RNA. Similar to other miRNA genes, and unlike most ordinary genes, VGAM1663 precursor RNA does not encode a protein. A nucleotide sequence identical or highly similar to the nucleotide sequence of VGAM1663 precursor RNA is designated SEQ ID:1649, and is provided hereinbelow with reference to the sequence listing part. Nucleotide sequence SEQ ID:1649 is located at position 98907 relative to the genome of Cercopithecine Herpesvirus 7.

VGAM1663 precursor RNA folds onto itself, forming VGAM1663 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1663 folded precursor RNA into VGAM1663 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1663 RNA is designated SEQ ID:4374, and is provided hereinbelow with reference to the sequence listing part.

VGAM1663 host target gene, herein designated VGAM HOST TARGET GENE, encodes a corresponding messenger RNA, VGAM1663 host target RNA, herein designated VGAM HOST TARGET RNA. VGAM1663 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1663 RNA, herein designated VGAM RNA, binds complementarily to one or more host target binding sites located in untranslated regions of VGAM1663 host target RNA, herein designated VGAM HOST TARGET RNA. This complementary binding is due to the fact that the nucleotide sequence of VGAM1663 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1663 RNA, herein designated VGAM RNA, may have a different number of host target binding sites in untranslated regions of a VGAM1663 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1663 RNA, herein designated VGAM RNA, to host target binding sites on VGAM1663 host target RNA, herein designated VGAM HOST TARGET RNA, such as BINDING SITE I, BINDING SITE II and BINDING SITE III, inhibits translation of VGAM1663 host target RNA into VGAM1663 host target protein, herein designated VGAM HOST TARGET PROTEIN. VGAM host target protein is therefore outlined by a broken line.

It is appreciated that VGAM1663 host target gene, herein designated VGAM HOST TARGET GENE, in fact represents a plurality of VGAM1663 host target genes. The mRNA of each one of this plurality of VGAM1663 host target genes comprises one or more host target binding sites, each having a nucleotide sequence which is at least partly complementary to VGAM1663 RNA, herein designated VGAM RNA, and which when bound by VGAM1663 RNA causes inhibition of translation of respective one or more VGAM1663 host target proteins.

It is further appreciated by one skilled in the art that the mode of translational inhibition illustrated by FIG. 1 with specific reference to translational inhibition exerted by VGAM1663 gene, herein designated VGAM GENE, on one or more VGAM1663 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1663 is inhibition of expression of host target genes, as part of a novel viral mechanism of attacking a host. Accordingly, utilities of VGAM1663 include diagnosis, prevention and treatment of viral infection by Cercopithecine Herpesvirus 7. Specific functions, and accordingly utilities, of VGAM1663 correlate with, and may be deduced from, the identity of the host target genes which VGAM1663 binds and inhibits, and the function of these host target genes, as elaborated hereinbelow.

Nucleotide sequences of the VGAM1663 precursor RNA, herein designated VGAM PRECURSOR RNA, and of the 'diced' VGAM1663 RNA, herein designated VGAM RNA, and a schematic representation of the secondary folding of VGAM1663 folded precursor RNA, herein designated VGAM FOLDED PRECURSOR RNA, of VGAM1663 are further described hereinbelow with reference to Table 1.

Nucleotide sequences of host target binding sites, such as BINDING SITE-I, BINDING SITE-II and BINDING SITE-III of FIG. 1, found on VGAM1663 host target RNA, and schematic representation of the complementarity of each of these host target binding sites to VGAM1663 RNA, herein designated VGAM RNA, are described hereinbelow with reference to Table 2.

As mentioned hereinabove with reference to FIG. 1, a function of VGAM1663 gene, herein designated VGAM is inhibition of expression of VGAM1663 target genes. It is appreciated that specific functions, and accordingly utilities, of VGAM1663 correlate with, and may be deduced from, the identity of the target genes which VGAM1663 binds and inhibits, and the function of these target genes, as elaborated hereinbelow.

EphA3 (EPHA3, Accession NM_005233) is a VGAM1663 host target gene. EPHA3 BINDING SITE is HOST TARGET binding site found in the 5' untranslated region of mRNA encoded by EPHA3, corresponding to a HOST TARGET binding site such as BINDING SITE I, BINDING SITE II or BINDING SITE III. Table 2 illustrates the complementarity of the nucleotide sequences of EPHA3 BINDING SITE, designated SEQ ID:11741, to the nucleotide sequence of VGAM1663 RNA, herein designated VGAM RNA, also designated SEQ ID:4374.

A function of VGAM1663 is therefore inhibition of EphA3 (EPHA3, Accession NM_005233), a gene which binds to ephrin-a2, -a3, -a4 and -a5. could play a role in lymphoid function. Accordingly, utilities of VGAM1663 include diagnosis, prevention and treatment of diseases and clinical conditions associated with EPHA3. The function of EPHA3 and its association with various diseases and clinical conditions, has been established by previous studies, as described hereinabove with reference to VGAM164. Natriuretic Peptide Receptor A/guanylate Cyclase A (atrionatriuretic peptide receptor A) (NPR1, Accession XM_113360) is another VGAM1663 host target gene. NPR1 BINDING SITE is HOST TARGET binding site found in the 5' untranslated region of mRNA encoded by NPR1, corresponding to a HOST TARGET binding site such as BINDING SITE I, BINDING SITE II or BINDING SITE III. Table 2 illustrates the complementarity of the nucleotide sequences of NPR1 BINDING SITE, designated SEQ ID:42234, to the nucleotide sequence of VGAM1663 RNA, herein designated VGAM RNA, also designated SEQ ID:4374.

Another function of VGAM1663 is therefore inhibition of Natriuretic Peptide Receptor A/guanylate Cyclase A (atrionatriuretic peptide receptor A) (NPR1, Accession XM_113360), a gene which has guanylate cyclase activity on binding of anf. Accordingly, utilities of VGAM1663 include diagnosis, prevention and treatment of diseases and clinical conditions associated with NPR1. The function of NPR1 and its association with various diseases and clinical conditions, has been established by previous studies, as described hereinabove with reference to VGAM719. SH3-domain Binding Protein 2 (SH3BP2, Accession NM_003023) is another VGAM1663 host target gene. SH3BP2 BINDING SITE is HOST TARGET binding site found in the 3' untranslated region of mRNA encoded by SH3BP2, corresponding to a HOST TARGET binding site such as BINDING SITE I, BINDING SITE II or BINDING SITE III. Table 2 illustrates the complementarity of the nucleotide sequences of SH3BP2 BINDING SITE, designated SEQ ID:8943, to the nucleotide sequence of VGAM1663 RNA, herein designated VGAM RNA, also designated SEQ ID:4374.

Another function of VGAM1663 is therefore inhibition of SH3-domain Binding Protein 2 (SH3BP2, Accession NM_003023). Accordingly, utilities of VGAM1663 include diagnosis, prevention and treatment of diseases and clinical conditions associated with SH3BP2. CDC14 Cell Division Cycle 14 Homolog A (S. cerevisiae) (CDC14A, Accession NM_003672) is another VGAM1663 host target gene. CDC14A BINDING SITE is HOST TARGET binding site found in the 3' untranslated region of mRNA encoded by CDC14A, corresponding to a HOST TARGET binding site such as BINDING SITE I, BINDING SITE II or BINDING SITE III. Table 2 illustrates the complementarity of the nucleotide sequences of CDC14A BINDING SITE, designated SEQ ID:9763, to the nucleotide sequence of VGAM1663 RNA, herein designated VGAM RNA, also designated SEQ ID:4374.

Another function of VGAM1663 is therefore inhibition of CDC14 Cell Division Cycle 14 Homolog A (S. cerevisiae) (CDC14A, Accession NM_003672). Accordingly, utilities of VGAM1663 include diagnosis, prevention and treatment of diseases and clinical conditions associated with CDC14A. LOC219376 (Accession XM_168147) is another VGAM1663 host target gene. LOC219376 BINDING SITE is HOST TARGET binding site found in the 3' untranslated region of mRNA encoded by LOC219376, corresponding to a HOST TARGET binding site such as BINDING SITE I, BINDING SITE II or BINDING SITE III. Table 2 illustrates the complementarity of the nucleotide sequences of LOC219376 BINDING SITE, designated SEQ ID:45068, to the nucleotide sequence of VGAM1663 RNA, herein designated VGAM RNA, also designated SEQ ID:4374.

Another function of VGAM1663 is therefore inhibition of LOC219376 (Accession XM_168147). Accordingly, utilities of VGAM1663 include diagnosis, prevention and treatment of diseases and clinical conditions associated with LOC219376. FIG. 1 further provides a conceptual description of a novel bioinformatically detected viral gene of the present invention, referred to here as Viral Genomic Address Messenger 1664 (VGAM1664) viral gene, which modulates expression of respective host target genes thereof, the function and utility of which host target genes is known in the art.

VGAM1664 is a novel bioinformatically detected regulatory, non protein coding, viral micro RNA (miRNA) gene. The method by which VGAM1664 was detected is described hereinabove with reference to FIGS. 1-8.

VGAM1664 gene, herein designated VGAM GENE, is a viral gene contained in the genome of Cercopithecine Herpesvirus 7. VGAM1664 host target gene, herein designated VGAM HOST TARGET GENE, is a human gene contained in the human genome.

VGAM1664 gene encodes a VGAM1664 precursor RNA, herein designated VGAM PRECURSOR RNA. Similar to other miRNA genes, and unlike most ordinary genes, VGAM1664 precursor RNA does not encode a protein. A nucleotide sequence identical or highly similar to the nucleotide sequence of VGAM1664 precursor RNA is designated SEQ ID:1650, and is provided hereinbelow with reference to the sequence listing part. Nucleotide sequence SEQ ID:1650 is located at position 105330 relative to the genome of Cercopithecine Herpesvirus 7.

VGAM1664 precursor RNA folds onto itself, forming VGAM1664 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1664 folded precursor RNA into VGAM1664 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 42%) nucleotide sequence of VGAM1664 RNA is designated SEQ ID:4375, and is provided hereinbelow with reference to the sequence listing part.

VGAM1664 host target gene, herein designated VGAM HOST TARGET GENE, encodes a corresponding messenger RNA, VGAM1664 host target RNA, herein designated VGAM HOST TARGET RNA. VGAM1664 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1664 RNA, herein designated VGAM RNA, binds complementarily to one or more host target binding sites located in untranslated regions of VGAM1664 host target RNA, herein designated VGAM HOST TARGET RNA. This complementary binding is due to the fact that the nucleotide sequence of VGAM1664 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1664 RNA, herein designated VGAM RNA, may have a different number of host target binding sites in untranslated regions of a VGAM1664 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1664 RNA, herein designated VGAM RNA, to host target binding sites on VGAM1664 host target RNA, herein designated VGAM HOST TARGET RNA, such as BINDING SITE I, BINDING SITE II and BINDING SITE III, inhibits translation of VGAM1664 host target RNA into VGAM1664 host target protein, herein designated VGAM HOST TARGET PROTEIN. VGAM host target protein is therefore outlined by a broken line.

It is appreciated that VGAM1664 host target gene, herein designated VGAM HOST TARGET GENE, in fact represents a plurality of VGAM1664 host target genes. The mRNA of each one of this plurality of VGAM1664 host target genes comprises one or more host target binding sites, each having a nucleotide sequence which is at least partly complementary to VGAM1664 RNA, herein designated VGAM RNA, and which when bound by VGAM1664 RNA causes inhibition of translation of respective one or more VGAM1664 host target proteins.

It is further appreciated by one skilled in the art that the mode of translational inhibition illustrated by FIG. 1 with specific reference to translational inhibition exerted by VGAM1664 gene, herein designated VGAM GENE, on one or more VGAM1664 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1664 is inhibition of expression of host target genes, as part of a novel viral mechanism of attacking a host. Accordingly, utilities of VGAM1664 include diagnosis, prevention and treatment of viral infection by Cercopithecine Herpesvirus 7. Specific functions, and accordingly utilities, of VGAM1664 correlate with, and may be deduced from, the identity of the host target genes which VGAM1664 binds and inhibits, and the function of these host target genes, as elaborated hereinbelow.

Nucleotide sequences of the VGAM1664 precursor RNA, herein designated VGAM PRECURSOR RNA, and of the 'diced' VGAM1664 RNA, herein designated VGAM RNA, and a schematic representation of the secondary folding of VGAM1664 folded precursor RNA, herein designated VGAM FOLDED PRECURSOR RNA, of VGAM1664 are further described hereinbelow with reference to Table 1.

Nucleotide sequences of host target binding sites, such as BINDING SITE-I, BINDING SITE-II and BINDING SITE-III of FIG. 1, found on VGAM1664 host target RNA, and schematic representation of the complementarity of each of these host target binding sites to VGAM1664 RNA, herein designated VGAM RNA, are described hereinbelow with reference to Table 2.

As mentioned hereinabove with reference to FIG. 1, a function of VGAM1664 gene, herein designated VGAM is inhibition of expression of VGAM1664 target genes. It is appreciated that specific functions, and accordingly utilities, of VGAM1664 correlate with, and may be deduced from, the identity of the target genes which VGAM1664 binds and inhibits, and the function of these target genes, as elaborated hereinbelow.

BLAME (Accession NM_020125) is a VGAM1664 host target gene. BLAME BINDING SITE is HOST TARGET binding site found in the 3' untranslated region of mRNA encoded by BLAME, corresponding to a HOST TARGET binding site such as BINDING SITE I, BINDING SITE II or BINDING SITE III. Table 2 illustrates the complementarity of the nucleotide sequences of BLAME BINDING SITE, designated SEQ ID:21307, to the nucleotide sequence of VGAM1664 RNA, herein designated VGAM RNA, also designated SEQ ID:4375.

A function of VGAM1664 is therefore inhibition of BLAME (Accession NM_020125). Accordingly, utilities of VGAM1664 include diagnosis, prevention and treatment of diseases and clinical conditions associated with BLAME. DXYS155E (Accession NM_005088) is another VGAM1664 host target gene. DXYS155E BINDING SITE is HOST TARGET binding site found in the 3' untranslated region of mRNA encoded by DXYS155E, corresponding to a HOST TARGET binding site such as BINDING SITE I, BINDING SITE II or BINDING SITE III. Table 2 illustrates the complementarity of the nucleotide sequences of DXYS155E BINDING SITE, designated SEQ ID:11543, to the nucleotide sequence of VGAM1664 RNA, herein designated VGAM RNA, also designated SEQ ID:4375.

Another function of VGAM1664 is therefore inhibition of DXYS155E (Accession NM_005088), a gene which may be involved in b-cell activation. may also be involved in signal transduction and gene regulation. Accordingly, utilities of VGAM1664 include diagnosis, prevention and treatment of diseases and clinical conditions associated with DXYS155E. The function of DXYS155E and its association with various diseases and clinical conditions, has been established by previous studies, as described hereinabove with reference to VGAM766. Engrailed Homolog 1 (EN1, Accession NM_001426) is another VGAM1664 host target gene. EN1 BINDING SITE is HOST TARGET binding site found in the 5' untranslated region of mRNA encoded by EN1, corresponding to a HOST TARGET binding site such as BINDING SITE I, BINDING SITE II or BINDING SITE III. Table 2 illustrates the complementarity of the nucleotide sequences of EN1 BINDING SITE, designated SEQ ID:7140, to the nucleotide sequence of VGAM1664 RNA, herein designated VGAM RNA, also designated SEQ ID:4375.

Another function of VGAM1664 is therefore inhibition of Engrailed Homolog 1 (EN1, Accession NM_001426), a gene which is a member of the homeodomain family of DNA binding proteins; may regulate gene expression, morphogenesis, and differentiation. Accordingly, utilities of VGAM1664 include diagnosis, prevention and treatment of diseases and clinical conditions associated with EN1. The function of EN1 and its association with various diseases and clinical conditions, has been established by previous studies, as described hereinabove with reference to VGAM1615. Sialyltransferase 8E (alpha-2, 8-polysialytransferase) (SIAT8E, Accession XM_008705) is another VGAM1664 host target gene. SIAT8E BINDING SITE is HOST TARGET binding site found in the 5' untranslated region of mRNA encoded by SIAT8E, corresponding to a HOST TARGET binding site such as BINDING SITE I, BINDING SITE II or BINDING SITE III. Table 2 illustrates the complementarity of the nucleotide sequences of SIAT8E BINDING SITE, designated SEQ ID:30090, to the nucleotide sequence of VGAM1664 RNA, herein designated VGAM RNA, also designated SEQ ID:4375.

Another function of VGAM1664 is therefore inhibition of Sialyltransferase 8E (alpha-2, 8-polysialytransferase) (SIAT8E, Accession XM_008705). Accordingly, utilities of VGAM1664 include diagnosis, prevention and treatment of diseases and clinical conditions associated with SIAT8E. Tumor Necrosis Factor Receptor Superfamily, Member 6b, Decoy (TNFRSF6B, Accession NM_032945) is another VGAM1664 host target gene. TNFRSF6B BINDING SITE is HOST TARGET binding site found in the 5' untranslated region of mRNA encoded by TNFRSF6B, corresponding to a HOST TARGET binding site such as BINDING SITE I, BINDING SITE II or BINDING SITE III. Table 2 illustrates the complementarity of the nucleotide sequences of TNFRSF6B BINDING SITE, designated SEQ ID:26762, to the nucleotide sequence of VGAM1664 RNA, herein designated VGAM RNA, also designated SEQ ID:4375.

Another function of VGAM1664 is therefore inhibition of Tumor Necrosis Factor Receptor Superfamily, Member 6b, Decoy (TNFRSF6B, Accession NM_032945), a gene which is decoy receptor and protects against apoptosis. Accordingly, utilities of VGAM1664 include diagnosis, prevention and treatment of diseases and clinical conditions associated with TNFRSF6B. The function of TNFRSF6B and its association with various diseases and clinical conditions, has been established by previous studies, as described hereinabove with reference to VGAM610. FLJ22246 (Accession NM_025232) is another VGAM1664 host target gene. FLJ22246 BINDING SITE is HOST TARGET binding site found in the 5' untranslated region of mRNA encoded by FLJ22246, corresponding to a HOST TARGET binding site such as BINDING SITE I, BINDING SITE II or BINDING SITE III. Table 2 illustrates the complementarity of the nucleotide sequences of FLJ22246 BINDING SITE, designated SEQ ID:24910, to the nucleotide sequence of VGAM1664 RNA, herein designated VGAM RNA, also designated SEQ ID:4375.

Another function of VGAM1664 is therefore inhibition of FLJ22246 (Accession NM_025232). Accordingly, utilities of VGAM1664 include diagnosis, prevention and treatment of diseases and clinical conditions associated with FLJ22246. KIAA1091 (Accession XM_045750) is another VGAM1664 host target gene. KIAA1091 BINDING SITE is HOST TARGET binding site found in the 3' untranslated region of mRNA encoded by KIAA1091, corresponding to a HOST TARGET binding site such as BINDING SITE I, BINDING SITE II or BINDING SITE III. Table 2 illustrates the complementarity of the nucleotide sequences of KIAA1091 BINDING SITE, designated SEQ ID:34542, to the nucleotide sequence of VGAM1664 RNA, herein designated VGAM RNA, also designated SEQ ID:4375.

Another function of VGAM1664 is therefore inhibition of KIAA1091 (Accession XM_045750). Accordingly, utilities of VGAM1664 include diagnosis, prevention and treatment of diseases and clinical conditions associated with KIAA1091. KIAA1691 (Accession XM_166523) is another VGAM1664 host target gene. KIAA1691 BINDING SITE is HOST TARGET binding site found in the 3' untranslated region of mRNA encoded by KIAA1691, corresponding to a HOST TARGET binding site such as BINDING SITE I, BINDING SITE II or BINDING SITE III. Table 2 illustrates the complementarity of the nucleotide sequences of KIAA1691 BINDING SITE, designated SEQ ID:44466, to the nucleotide sequence of VGAM1664 RNA, herein designated VGAM RNA, also designated SEQ ID:4375.

Another function of VGAM1664 is therefore inhibition of KIAA1691 (Accession XM_166523). Accordingly, utilities of VGAM1664 include diagnosis, prevention and treatment of diseases and clinical conditions associated with KIAA1691. RAB39, Member RAS Oncogene Family (RAB39, Accession XM_084662) is another VGAM1664 host target gene. RAB39 BINDING SITE is HOST TARGET binding site found in the 3' untranslated region of mRNA encoded by RAB39, corresponding to a HOST TARGET binding site such as BINDING SITE I, BINDING SITE II or BINDING SITE III. Table 2 illustrates the complementarity of the nucleotide sequences of RAB39 BINDING SITE, designated SEQ ID:37644, to the nucleotide sequence of VGAM1664 RNA, herein designated VGAM RNA, also designated SEQ ID:4375.

Another function of VGAM1664 is therefore inhibition of RAB39, Member RAS Oncogene Family (RAB39, Accession XM_084662). Accordingly, utilities of VGAM1664 include diagnosis, prevention and treatment of diseases and clinical conditions associated with RAB39. LOC150407 (Accession XM_086906) is another VGAM1664 host target gene. LOC150407 BINDING SITE is HOST TARGET binding site found in the 3' untranslated region of mRNA encoded by LOC150407, corresponding to a HOST TARGET binding site such as BINDING SITE I, BINDING SITE II or BINDING SITE III. Table 2 illustrates the complementarity of the nucleotide sequences of LOC150407 BINDING SITE, designated SEQ ID:38953, to the nucleotide sequence of VGAM1664 RNA, herein designated VGAM RNA, also designated SEQ ID:4375.

Another function of VGAM1664 is therefore inhibition of LOC150407 (Accession XM_086906). Accordingly, utilities of VGAM1664 include diagnosis, prevention and treatment of diseases and clinical conditions associated with LOC150407. LOC169026 (Accession XM_095471) is another VGAM1664 host target gene. LOC169026 BINDING SITE is HOST TARGET binding site found in the 3' untranslated region of mRNA encoded by LOC169026, corresponding to a HOST TARGET binding site such as BINDING SITE I, BINDING SITE II or BINDING SITE III. Table 2 illustrates the complementarity of the nucleotide sequences of LOC169026 BINDING SITE, designated SEQ ID:40264, to the nucleotide sequence of VGAM1664 RNA, herein designated VGAM RNA, also designated SEQ ID:4375.

Another function of VGAM1664 is therefore inhibition of LOC169026 (Accession XM_095471). Accordingly, utilities of VGAM1664 include diagnosis, prevention and treatment of diseases and clinical conditions associated with LOC169026. LOC203392 (Accession XM_114696) is another VGAM1664 host target gene. LOC203392 BINDING SITE is HOST TARGET binding site found in the 5' untranslated region of mRNA encoded by LOC203392, corresponding to a HOST TARGET binding site such as BINDING SITE I, BINDING SITE II or BINDING SITE III. Table 2 illustrates the complementarity of the nucleotide sequences of LOC203392 BINDING SITE, designated SEQ ID:43041, to the nucleotide sequence of VGAM1664 RNA, herein designated VGAM RNA, also designated SEQ ID:4375.

Another function of VGAM1664 is therefore inhibition of LOC203392 (Accession XM_114696). Accordingly, utilities of VGAM1664 include diagnosis, prevention and treatment of diseases and clinical conditions associated with LOC203392. LOC222166 (Accession XM_168425) is another VGAM1664 host target gene. LOC222166 BINDING SITE is HOST TARGET binding site found in the 5' untranslated region of mRNA encoded by LOC222166, corresponding to a HOST TARGET binding site such as BINDING SITE I, BINDING SITE II or BINDING SITE III. Table 2 illustrates the complementarity of the nucleotide sequences of LOC222166 BINDING SITE, designated SEQ ID:45152, to the nucleotide sequence of VGAM1664 RNA, herein designated VGAM RNA, also designated SEQ ID:4375.

Another function of VGAM1664 is therefore inhibition of LOC222166 (Accession XM_168425). Accordingly, utilities of VGAM1664 include diagnosis, prevention and treatment of diseases and clinical conditions associated with LOC222166. LOC93082 (Accession NM_138397) is another VGAM1664 host target gene. LOC93082 BINDING SITE is HOST TARGET binding site found in the 3' untranslated region of mRNA encoded by LOC93082, corresponding to a HOST TARGET binding site such as BINDING SITE I, BINDING SITE II or BINDING SITE III. Table 2 illustrates the complementarity of the nucleotide sequences of LOC93082 BINDING SITE, designated SEQ ID:28766, to the nucleotide sequence of VGAM1664 RNA, herein designated VGAM RNA, also designated SEQ ID:4375.

Another function of VGAM1664 is therefore inhibition of LOC93082 (Accession NM_138397). Accordingly, utilities of VGAM1664 include diagnosis, prevention and treatment of diseases and clinical conditions associated with LOC93082. FIG. 1 further provides a conceptual description of a novel bioinformatically detected viral gene of the present invention, referred to here as Viral Genomic Address Messenger 1665 (VGAM1665) viral gene, which modulates expression of respective host target genes thereof, the function and utility of which host target genes is known in the art.

VGAM1665 is a novel bioinformatically detected regulatory, non protein coding, viral micro RNA (miRNA) gene. The method by which VGAM1665 was detected is described hereinabove with reference to FIGS. 1-8.

VGAM1665 gene, herein designated VGAM GENE, is a viral gene contained in the genome of Infectious Spleen and Kidney Necrosis Virus. VGAM1665 host target gene, herein designated VGAM HOST TARGET GENE, is a human gene contained in the human genome.

VGAM1665 gene encodes a VGAM1665 precursor RNA, herein designated VGAM PRECURSOR RNA. Similar to other miRNA genes, and unlike most ordinary genes, VGAM1665 precursor RNA does not encode a protein. A nucleotide sequence identical or highly similar to the nucleotide sequence of VGAM1665 precursor RNA is designated SEQ ID:1651, and is provided hereinbelow with reference to the sequence listing part. Nucleotide sequence SEQ ID:1651 is located at position 60134 relative to the genome of Infectious Spleen and Kidney Necrosis Virus.

VGAM1665 precursor RNA folds onto itself, forming VGAM1665 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1665 folded precursor RNA into VGAM1665 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1665 RNA is designated SEQ ID:4376, and is provided hereinbelow with reference to the sequence listing part.

VGAM1665 host target gene, herein designated VGAM HOST TARGET GENE, encodes a corresponding messenger RNA, VGAM1665 host target RNA, herein designated VGAM HOST TARGET RNA. VGAM1665 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1665 RNA, herein designated VGAM RNA, binds complementarily to one or more host target binding sites located in untranslated regions of VGAM1665 host target RNA, herein designated VGAM HOST TARGET RNA. This complementary binding is due to the fact that the nucleotide sequence of VGAM1665 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1665 RNA, herein designated VGAM RNA, may have a different number of host target binding sites in untranslated regions of a VGAM1665 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1665 RNA, herein designated VGAM RNA, to host target binding sites on VGAM1665 host target RNA, herein designated VGAM HOST TARGET RNA, such as BINDING SITE I, BINDING SITE II and BINDING SITE III, inhibits translation of VGAM1665 host target RNA into VGAM1665 host target protein, herein designated VGAM HOST TARGET PROTEIN. VGAM host target protein is therefore outlined by a broken line.

It is appreciated that VGAM1665 host target gene, herein designated VGAM HOST TARGET GENE, in fact represents a plurality of VGAM1665 host target genes. The mRNA of each one of this plurality of VGAM1665 host target genes comprises one or more host target binding sites, each having a nucleotide sequence which is at least partly complementary to VGAM1665 RNA, herein designated VGAM RNA, and which when bound by VGAM1665 RNA causes inhibition of translation of respective one or more VGAM1665 host target proteins.

It is further appreciated by one skilled in the art that the mode of translational inhibition illustrated by FIG. 1 with specific reference to translational inhibition exerted by VGAM1665 gene, herein designated VGAM GENE, on one or more VGAM1665 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1665 is inhibition of expression of host target genes, as part of a novel viral mechanism of attacking a host. Accordingly, utilities of VGAM1665 include diagnosis, prevention and treatment of viral infection by Infectious Spleen and Kidney Necrosis Virus. Specific functions, and accordingly utilities, of VGAM1665 correlate with, and may be deduced from, the identity of the host target genes which VGAM1665 binds and inhibits, and the function of these host target genes, as elaborated hereinbelow.

Nucleotide sequences of the VGAM1665 precursor RNA, herein designated VGAM PRECURSOR RNA, and of the 'diced' VGAM1665 RNA, herein designated VGAM RNA, and a schematic representation of the secondary folding of VGAM1665 folded precursor RNA, herein designated VGAM FOLDED PRECURSOR RNA, of VGAM1665 are further described hereinbelow with reference to Table 1.

Nucleotide sequences of host target binding sites, such as BINDING SITE-I, BINDING SITE-II and BINDING SITE-III of FIG. 1, found on VGAM1665 host target RNA, and schematic representation of the complementarity of each of these host target binding sites to VGAM1665 RNA, herein designated VGAM RNA, are described hereinbelow with reference to Table 2.

As mentioned hereinabove with reference to FIG. 1, a function of VGAM1665 gene, herein designated VGAM is inhibition of expression of VGAM1665 target genes. It is appreciated that specific functions, and accordingly utilities, of VGAM1665 correlate with, and may be deduced from, the identity of the target genes which VGAM1665 binds and inhibits, and the function of these target genes, as elaborated hereinbelow.

Trichorhinophalangeal Syndrome I (TRPS1, Accession NM_014112) is a VGAM1665 host target gene. TRPS1 BINDING SITE is HOST TARGET binding site found in the 3' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15348, to the nucleotide sequence of VGAM1665 RNA, herein designated VGAM RNA, also designated SEQ ID:4376.

A function of VGAM1665 is therefore inhibition of Trichorhinophalangeal Syndrome I (TRPS1, Accession NM_014112), a gene which may function as a transcriptional activator protein. Accordingly, utilities of VGAM1665 include diagnosis, prevention and treatment of diseases and clinical conditions associated with TRPS1. The function of TRPS1 and its association with various diseases and clinical conditions, has been established by previous studies, as described hereinabove with reference to VGAM172. E2IG4 (Accession XM_165623) is another VGAM1665 host target gene. E2IG4 BINDING SITE is HOST TARGET binding site found in the 3' untranslated region of mRNA encoded by E2IG4, corresponding to a HOST TARGET binding site such as BINDING SITE I, BINDING SITE II or BINDING SITE III. Table 2 illustrates the complementarity of the nucleotide sequences of E2IG4 BINDING SITE, designated SEQ ID:43702, to the nucleotide sequence of VGAM1665 RNA, herein designated VGAM RNA, also designated SEQ ID:4376.

Another function of VGAM1665 is therefore inhibition of E2IG4 (Accession XM_165623). Accordingly, utilities of VGAM1665 include diagnosis, prevention and treatment of diseases and clinical conditions associated with E2IG4. FLJ13710 (Accession NM_024817) is another VGAM1665 host target gene. FLJ13710 BINDING SITE is HOST TARGET binding site found in the 3' untranslated region of mRNA encoded by FLJ13710, corresponding to a HOST TARGET binding site such as BINDING SITE I, BINDING SITE II or BINDING SITE III. Table 2 illustrates the complementarity of the nucleotide sequences of FLJ13710 BINDING SITE, designated SEQ ID:24204, to the nucleotide sequence of VGAM1665 RNA, herein designated VGAM RNA, also designated SEQ ID:4376.

Another function of VGAM1665 is therefore inhibition of FLJ13710 (Accession NM_024817). Accordingly, utilities of VGAM1665 include diagnosis, prevention and treatment of diseases and clinical conditions associated with FLJ13710. KIAA1582 (Accession XM_037262) is another VGAM1665 host target gene. KIAA1582 BINDING SITE is HOST TARGET binding site found in the 5' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32586, to the nucleotide sequence of VGAM1665 RNA, herein designated VGAM RNA, also designated SEQ ID:4376.

Another function of VGAM1665 is therefore inhibition of KIAA1582 (Accession XM_037262). Accordingly, utilities of VGAM1665 include diagnosis, prevention and treatment of diseases and clinical conditions associated with KIAA1582. KIAA1706 (Accession XM_166595) is another VGAM1665 host target gene. KIAA1706 BINDING SITE is HOST TARGET binding site found in the 3' untranslated region of mRNA encoded by KIAA1706, corresponding to a HOST TARGET binding site such as BINDING SITE I, BINDING SITE II or BINDING SITE III. Table 2 illustrates the complementarity of the nucleotide sequences of KIAA1706 BINDING SITE, designated SEQ ID:44576, to the nucleotide sequence of VGAM1665 RNA, herein designated VGAM RNA, also designated SEQ ID:4376.

Another function of VGAM1665 is therefore inhibition of KIAA1706 (Accession XM_166595). Accordingly, utilities of VGAM1665 include diagnosis, prevention and treatment of diseases and clinical conditions associated with KIAA1706. Purinergic Receptor P2X-like 1, Orphan Receptor (P2RXL1, Accession NM_005446) is another VGAM1665 host target gene. P2RXL1 BINDING SITE is HOST TARGET binding site found in the 3' untranslated region of mRNA encoded by P2RXL1, corresponding to a HOST TARGET binding site such as BINDING SITE I, BINDING SITE II or BINDING SITE III. Table 2 illustrates the complementarity of the nucleotide sequences of P2RXL1 BINDING SITE, designated SEQ ID:11928, to the nucleotide sequence of VGAM1665 RNA, herein designated VGAM RNA, also designated SEQ ID:4376.

Another function of VGAM1665 is therefore inhibition of Purinergic Receptor P2X-like 1, Orphan Receptor (P2RXL1, Accession NM_005446). Accordingly, utilities of VGAM1665 include diagnosis, prevention and treatment of diseases and clinical conditions associated with P2RXL1. FIG. 1 further provides a conceptual description of a novel bioinformatically detected viral gene of the present invention, referred to here as Viral Genomic Address Messenger 1666 (VGAM1666) viral gene, which modulates expression of respective host target genes thereof, the function and utility of which host target genes is known in the art.

VGAM1666 is a novel bioinformatically detected regulatory, non protein coding, viral micro RNA (miRNA) gene. The method by which VGAM1666 was detected is described hereinabove with reference to FIGS. 1-8.

VGAM1666 gene, herein designated VGAM GENE, is a viral gene contained in the genome of Infectious Spleen and Kidney Necrosis Virus. VGAM1666 host target gene, herein designated VGAM HOST TARGET GENE, is a human gene contained in the human genome.

VGAM1666 gene encodes a VGAM1666 precursor RNA, herein designated VGAM PRECURSOR RNA. Similar to other miRNA genes, and unlike most ordinary genes, VGAM1666 precursor RNA does not encode a protein. A nucleotide sequence identical or highly similar to the nucleotide sequence of VGAM1666 precursor RNA is designated SEQ ID:1652, and is provided hereinbelow with reference to the sequence listing part. Nucleotide sequence SEQ ID:1652 is located at position 58471 relative to the genome of Infectious Spleen and Kidney Necrosis Virus.

VGAM1666 precursor RNA folds onto itself, forming VGAM1666 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1666 folded precursor RNA into VGAM1666 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM1666 RNA is designated SEQ ID:4377, and is provided hereinbelow with reference to the sequence listing part.

VGAM1666 host target gene, herein designated VGAM HOST TARGET GENE, encodes a corresponding messenger RNA, VGAM1666 host target RNA, herein designated VGAM HOST TARGET RNA. VGAM1666 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1666 RNA, herein designated VGAM RNA, binds complementarily to one or more host target binding sites located in untranslated regions of VGAM1666 host target RNA, herein designated VGAM HOST TARGET RNA. This complementary binding is due to the fact that the nucleotide sequence of VGAM1666 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1666 RNA, herein designated VGAM RNA, may have a different number of host target binding sites in untranslated regions of a VGAM1666 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1666 RNA, herein designated VGAM RNA, to host target binding sites on VGAM1666 host target RNA, herein designated VGAM HOST TARGET RNA, such as BINDING SITE I, BINDING SITE II and BINDING SITE III, inhibits translation of VGAM1666 host target RNA into VGAM1666 host target protein, herein designated VGAM HOST TARGET PROTEIN. VGAM host target protein is therefore outlined by a broken line.

It is appreciated that VGAM1666 host target gene, herein designated VGAM HOST TARGET GENE, in fact represents a plurality of VGAM1666 host target genes. The mRNA of each one of this plurality of VGAM1666 host target genes comprises one or more host target binding sites, each having a nucleotide sequence which is at least partly complementary to VGAM1666 RNA, herein designated VGAM RNA, and which when bound by VGAM1666 RNA causes inhibition of translation of respective one or more VGAM1666 host target proteins.

It is further appreciated by one skilled in the art that the mode of translational inhibition illustrated by FIG. 1 with specific reference to translational inhibition exerted by VGAM1666 gene, herein designated VGAM GENE, on one or more VGAM1666 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1666 is inhibition of expression of host target genes, as part of a novel viral mechanism of attacking a host. Accordingly, utilities of VGAM1666 include diagnosis, prevention and treatment of viral infection by Infectious Spleen and Kidney Necrosis Virus. Specific functions, and accordingly utilities, of VGAM1666 correlate with, and may be deduced from, the identity of the host target genes which VGAM1666 binds and inhibits, and the function of these host target genes, as elaborated hereinbelow.

Nucleotide sequences of the VGAM1666 precursor RNA, herein designated VGAM PRECURSOR RNA, and of the 'diced' VGAM1666 RNA, herein designated VGAM RNA, and a schematic representation of the secondary folding of VGAM1666 folded precursor RNA, herein designated VGAM FOLDED PRECURSOR RNA, of VGAM1666 are further described hereinbelow with reference to Table 1.

Nucleotide sequences of host target binding sites, such as BINDING SITE-I, BINDING SITE-II and BINDING SITE-III of FIG. 1, found on VGAM1666 host target RNA, and schematic representation of the complementarity of each of these host target binding sites to VGAM1666 RNA, herein designated VGAM RNA, are described hereinbelow with reference to Table 2.

As mentioned hereinabove with reference to FIG. 1, a function of VGAM1666 gene, herein designated VGAM is inhibition of expression of VGAM1666 target genes. It is appreciated that specific functions, and accordingly utilities, of VGAM1666 correlate with, and may be deduced from, the identity of the target genes which VGAM1666 binds and inhibits, and the function of these target genes, as elaborated hereinbelow.

Coagulation Factor VIII, Procoagulant Component (hemophilia A) (F8, Accession NM_000132) is a VGAM1666 host target gene. F8 BINDING SITE is HOST TARGET binding site found in the 3' untranslated region of mRNA encoded by F8, corresponding to a HOST TARGET binding site such as BINDING SITE I, BINDING SITE II or BINDING SITE III. Table 2 illustrates the complementarity of the nucleotide sequences of F8 BINDING SITE, designated SEQ ID:5615, to the nucleotide sequence of VGAM1666 RNA, herein designated VGAM RNA, also designated SEQ ID:4377.

A function of VGAM1666 is therefore inhibition of Coagulation Factor VIII, Procoagulant Component (hemophilia A) (F8, Accession NM_000132). Accordingly, utilities of VGAM1666 include diagnosis, prevention and treatment of diseases and clinical conditions associated with F8. Glucocorticoid Receptor DNA Binding Factor 1 (GRLF1, Accession XM_085943) is another VGAM1666 host target gene. GRLF1 BINDING SITE is HOST TARGET binding site found in the 3' untranslated region of mRNA encoded by GRLF1, corresponding to a HOST TARGET binding site such as BINDING SITE I, BINDING SITE II or BINDING SITE III. Table 2 illustrates the complementarity of the nucleotide sequences of GRLF1 BINDING SITE, designated SEQ ID:38411, to the nucleotide sequence of VGAM1666 RNA, herein designated VGAM RNA, also designated SEQ ID:4377.

Another function of VGAM1666 is therefore inhibition of Glucocorticoid Receptor DNA Binding Factor 1 (GRLF1, Accession XM_085943), a gene which inhibits transcription of the glucocorticoid receptor gene. Accordingly, utilities of VGAM1666 include diagnosis, prevention and treatment of diseases and clinical conditions associated with GRLF1. The function of GRLF1 and its association with various diseases and clinical conditions, has been established by previous studies, as described hereinabove with reference to VGAM55. IRTA1 (Accession NM_031282) is another VGAM1666 host target gene. IRTA1 BINDING SITE is HOST TARGET binding site found in the 3' untranslated region of mRNA encoded by IRTA1, corresponding to a HOST TARGET binding site such as BINDING SITE I, BINDING SITE II or BINDING SITE III. Table 2 illustrates the complementarity of the nucleotide sequences of IRTA1 BINDING SITE, designated SEQ ID:25302, to the nucleotide sequence of VGAM1666 RNA, herein designated VGAM RNA, also designated SEQ ID:4377.

Another function of VGAM1666 is therefore inhibition of IRTA1 (Accession NM_031282). Accordingly, utilities of VGAM1666 include diagnosis, prevention and treatment of diseases and clinical conditions associated with IRTA1. PR Domain Containing 2, with ZNF Domain (PRDM2, Accession NM_012231) is another VGAM1666 host target gene. PRDM2 BINDING SITE is HOST TARGET binding site found in the 3' untranslated region of mRNA encoded by PRDM2, corresponding to a HOST TARGET binding site such as BINDING SITE I, BINDING SITE II or BINDING SITE III. Table 2 illustrates the complementarity of the nucleotide sequences of PRDM2 BINDING SITE, designated SEQ ID:14533, to the nucleotide sequence of VGAM1666 RNA, herein designated VGAM RNA, also designated SEQ ID:4377.

Another function of VGAM1666 is therefore inhibition of PR Domain Containing 2, with ZNF Domain (PRDM2, Accession NM_012231), a gene which plays a role in transcriptional regulation during neuronal differentiation and pathogenesis of retinoblastoma. Accordingly, utilities of VGAM1666 include diagnosis, prevention and treatment of diseases and clinical conditions associated with PRDM2. The function of PRDM2 and its association with various diseases and clinical conditions, has been established by previous studies, as described hereinabove with reference to VGAM120. TEM6 (Accession NM_022748) is another VGAM1666 host target gene. TEM6 BINDING SITE is HOST TARGET binding site found in the 3' untranslated region of mRNA encoded by TEM6, corresponding to a HOST TARGET binding site such as BINDING SITE I, BINDING SITE II or BINDING SITE III. Table 2 illustrates the complementarity of the nucleotide sequences of TEM6 BINDING SITE, designated SEQ ID:22963, to the nucleotide sequence of VGAM1666 RNA, herein designated VGAM RNA, also designated SEQ ID:4377.

Another function of VGAM1666 is therefore inhibition of TEM6 (Accession NM_022748), a gene which displays elevated expression during tumor angiogenesis. Accordingly, utilities of VGAM1666 include diagnosis, prevention and treatment of diseases and clinical conditions associated with TEM6. The function of TEM6 and its association with various diseases and clinical conditions, has been established by previous studies, as described hereinabove with reference to VGAM175. Tripartite Motif-containing 34 (TRIM34, Accession NM_130389) is another VGAM1666 host target gene. TRIM34 BINDING SITE1 and TRIM34 BINDING SITE2 are HOST TARGET binding sites found in untranslated regions of mRNA encoded by TRIM34, corresponding to HOST TARGET binding sites such as BINDING SITE I, BINDING SITE II or BINDING SITE III. Table 2 illustrates the complementarity of the nucleotide sequences of TRIM34 BINDING SITE1 and TRIM34 BINDING SITE2, designated SEQ ID:28174 and SEQ ID:22250 respectively, to the nucleotide sequence of VGAM1666 RNA, herein designated VGAM RNA, also designated SEQ ID:4377.

Another function of VGAM1666 is therefore inhibition of Tripartite Motif-containing 34 (TRIM34, Accession NM_130389). Accordingly, utilities of VGAM1666 include diagnosis, prevention and treatment of diseases and clinical conditions associated with TRIM34. E2IG4 (Accession XM_165623) is another VGAM1666 host target gene. E2IG4 BINDING SITE is HOST TARGET binding site found in the 3' untranslated region of mRNA encoded by E2IG4, corresponding to a HOST TARGET binding site such as BINDING SITE I, BINDING SITE II or BINDING SITE III. Table 2 illustrates the complementarity of the nucleotide sequences of E2IG4 BINDING SITE, designated SEQ ID:43701, to the nucleotide sequence of VGAM1666 RNA, herein designated VGAM RNA, also designated SEQ ID:4377.

Another function of VGAM1666 is therefore inhibition of E2IG4 (Accession XM_165623). Accordingly, utilities of VGAM1666 include diagnosis, prevention and treatment of diseases and clinical conditions associated with E2IG4. FLJ00001 (Accession XM_088525) is another VGAM1666 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39782, to the nucleotide sequence of VGAM1666 RNA, herein designated VGAM RNA, also designated SEQ ID:4377.

Another function of VGAM1666 is therefore inhibition of FLJ00001 (Accession XM_088525). Accordingly, utilities of VGAM1666 include diagnosis, prevention and treatment of diseases and clinical conditions associated with FLJ00001. KIAA0513 (Accession NM_014732) is another VGAM1666 host target gene. KIAA0513 BINDING SITE is HOST TARGET binding site found in the 3' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16353, to the nucleotide sequence of VGAM1666 RNA, herein designated VGAM RNA, also designated SEQ ID:4377.

Another function of VGAM1666 is therefore inhibition of KIAA0513 (Accession NM_014732). Accordingly, utilities of VGAM1666 include diagnosis, prevention and treatment of diseases and clinical conditions associated with KIAA0513. KIAA1061 (Accession XM_048786) is another VGAM1666 host target gene. KIAA1061 BINDING SITE is HOST TARGET binding site found in the 3' untranslated region of mRNA encoded by KIAA1061, corresponding to a HOST TARGET binding site such as BINDING SITE I, BINDING SITE II or BINDING SITE III. Table 2 illustrates the complementarity of the nucleotide sequences of KIAA1061 BINDING SITE, designated SEQ ID:35269, to the nucleotide sequence of VGAM1666 RNA, herein designated VGAM RNA, also designated SEQ ID:4377.

Another function of VGAM1666 is therefore inhibition of KIAA1061 (Accession XM_048786). Accordingly, utilities of VGAM1666 include diagnosis, prevention and treatment of diseases and clinical conditions associated with KIAA1061. KIAA1297 (Accession XM_051005) is another VGAM1666 host target gene. KIAA1297 BINDING SITE is HOST TARGET binding site found in the 3' untranslated region of mRNA encoded by KIAA1297, corresponding to a HOST TARGET binding site such as BINDING SITE I, BINDING SITE II or BINDING SITE III. Table 2 illustrates the complementarity of the nucleotide sequences of KIAA1297 BINDING SITE, designated SEQ ID:35715, to the nucleotide sequence of VGAM1666 RNA, herein designated VGAM RNA, also designated SEQ ID:4377.

Another function of VGAM1666 is therefore inhibition of KIAA1297 (Accession XM_051005). Accordingly, utilities of VGAM1666 include diagnosis, prevention and treatment of diseases and clinical conditions associated with KIAA1297. KIAA1970 (Accession XM_058808) is another VGAM1666 host target gene. KIAA1970 BINDING SITE is HOST TARGET binding site found in the 3' untranslated region of mRNA encoded by KIAA1970, corresponding to a HOST TARGET binding site such as BINDING SITE I, BINDING SITE II or BINDING SITE III. Table 2 illustrates the complementarity of the nucleotide sequences of KIAA1970 BINDING SITE, designated SEQ ID:36753, to the nucleotide sequence of VGAM1666 RNA, herein designated VGAM RNA, also designated SEQ ID:4377.

Another function of VGAM1666 is therefore inhibition of KIAA1970 (Accession XM_058808). Accordingly, utilities of VGAM1666 include diagnosis, prevention and treatment of diseases and clinical conditions associated with KIAA1970. Lectin, Galactoside-binding, Soluble, 8 (galectin 8) (LGALS8, Accession NM_006499) is another VGAM1666 host target gene. LGALS8 BINDING SITE is HOST TARGET binding site found in the 5' untranslated region of mRNA encoded by LGALS8, corresponding to a HOST TARGET binding site such as BINDING SITE I, BINDING SITE II or BINDING SITE III. Table 2 illustrates the complementarity of the nucleotide sequences of LGALS8 BINDING SITE, designated SEQ ID:13245, to the nucleotide sequence of VGAM1666 RNA, herein designated VGAM RNA, also designated SEQ ID:4377.

Another function of VGAM1666 is therefore inhibition of Lectin, Galactoside-binding, Soluble, 8 (galectin 8) (LGALS8, Accession NM_006499). Accordingly, utilities of VGAM1666 include diagnosis, prevention and treatment of diseases and clinical conditions associated with LGALS8. MAC30 (Accession XM_031536) is another VGAM1666 host target gene. MAC30 BINDING SITE is HOST TARGET binding site found in the 3' untranslated region of mRNA encoded by MAC30, corresponding to a HOST TARGET binding site such as BINDING SITE I, BINDING SITE II or BINDING SITE III. Table 2 illustrates the complementarity of the nucleotide sequences of MAC30 BINDING SITE, designated SEQ ID:31403, to the nucleotide sequence of VGAM1666 RNA, herein designated VGAM RNA, also designated SEQ ID:4377.

Another function of VGAM1666 is therefore inhibition of MAC30 (Accession XM_031536). Accordingly, utilities of VGAM1666 include diagnosis, prevention and treatment of diseases and clinical conditions associated with MAC30. MGC1136 (Accession NM_024025) is another VGAM1666 host target gene. MGC1136 BINDING SITE is HOST TARGET binding site found in the 3' untranslated region of mRNA encoded by MGC1136, corresponding to a HOST TARGET binding site such as BINDING SITE I, BINDING SITE II or BINDING SITE III. Table 2 illustrates the complementarity of the nucleotide sequences of MGC1136 BINDING SITE, designated SEQ ID:23454, to the nucleotide sequence of VGAM1666 RNA, herein designated VGAM RNA, also designated SEQ ID:4377.

Another function of VGAM1666 is therefore inhibition of MGC1136 (Accession NM_024025). Accordingly, utilities of VGAM1666 include diagnosis, prevention and treatment of diseases and clinical conditions associated with MGC1136. MGC12945 (Accession NM_032318) is another VGAM1666 host target gene. MGC12945 BINDING SITE is HOST TARGET binding site found in the 5' untranslated region of mRNA encoded by MGC12945, corresponding to a HOST TARGET binding site such as BINDING SITE I, BINDING SITE II or BINDING SITE III. Table 2 illustrates the complementarity of the nucleotide sequences of MGC12945 BINDING SITE, designated SEQ ID:26118, to the nucleotide sequence of VGAM1666 RNA, herein designated VGAM RNA, also designated SEQ ID:4377.

Another function of VGAM1666 is therefore inhibition of MGC12945 (Accession NM_032318). Accordingly, utilities of VGAM1666 include diagnosis, prevention and treatment of diseases and clinical conditions associated with MGC12945. Sialyltransferase 8C (alpha2,3Galbeta1, 4GlcNAcalpha 2,8-sialyl transferase) (SIAT8C, Accession NM_015879) is another VGAM1666 host target gene. SIAT8C BINDING SITE is HOST TARGET binding site found in the 5' untranslated region of mRNA encoded by SIAT8C, corresponding to a HOST TARGET binding site such as BINDING SITE I, BINDING SITE II or BINDING SITE III. Table 2 illustrates the complementarity of the nucleotide sequences of SIAT8C BINDING SITE, designated SEQ ID:18024, to the nucleotide sequence of VGAM1666 RNA, herein designated VGAM RNA, also designated SEQ ID:4377.

Another function of VGAM1666 is therefore inhibition of Sialyltransferase 8C (alpha2,3Galbeta1,4GlcNAcalpha 2,8-sialyl transferase) (SIAT8C, Accession NM_015879). Accordingly, utilities of VGAM1666 include diagnosis, prevention and treatment of diseases and clinical conditions associated with SIAT8C. T-cell Leukemia/lymphoma 6 (TCL6, Accession NM_020552) is another VGAM1666 host target gene. TCL6 BINDING SITE1 through TCL6 BINDING SITE4 are HOST TARGET binding sites found in untranslated regions of mRNA encoded by TCL6, corresponding to HOST TARGET binding sites such as BINDING SITE I, BINDING SITE II or BINDING SITE III. Table 2 illustrates the complementarity of the nucleotide sequences of TCL6 BINDING SITE1 through TCL6 BINDING SITE4, designated SEQ ID:21765, SEQ ID:21757, SEQ ID:15763 and SEQ ID:14840 respectively, to the nucleotide sequence of VGAM1666 RNA, herein designated VGAM RNA, also designated SEQ ID:4377.

Another function of VGAM1666 is therefore inhibition of T-cell Leukemia/lymphoma 6 (TCL6, Accession NM_020552). Accordingly, utilities of VGAM1666 include diagnosis, prevention and treatment of diseases and clinical conditions associated with TCL6. LOC199990 (Accession XM_114083) is another VGAM1666 host target gene. LOC199990 BINDING SITE is HOST TARGET binding site found in the 3' untranslated region of mRNA encoded by LOC199990, corresponding to a HOST TARGET binding site such as BINDING SITE I, BINDING SITE II or BINDING SITE III. Table 2 illustrates the complementarity of the nucleotide sequences of LOC199990 BINDING SITE, designated SEQ ID:42684, to the nucleotide sequence of VGAM1666 RNA, herein designated VGAM RNA, also designated SEQ ID:4377.

Another function of VGAM1666 is therefore inhibition of LOC199990 (Accession XM_114083). Accordingly, utilities of VGAM1666 include diagnosis, prevention and treatment of diseases and clinical conditions associated with LOC199990. LOC201229 (Accession XM_113925) is another VGAM1666 host target gene. LOC201229 BINDING SITE is HOST TARGET binding site found in the 3' untranslated region of mRNA encoded by LOC201229, corresponding to a HOST TARGET binding site such as BINDING SITE I, BINDING SITE II or BINDING SITE III. Table 2 illustrates the complementarity of the nucleotide sequences of LOC201229 BINDING SITE, designated SEQ ID:42544, to the nucleotide sequence of VGAM1666 RNA, herein designated VGAM RNA, also designated SEQ ID:4377.

Another function of VGAM1666 is therefore inhibition of LOC201229 (Accession XM_113925). Accordingly, utilities of VGAM1666 include diagnosis, prevention and treatment of diseases and clinical conditions associated with LOC201229. LOC86651 (Accession XM_044052) is another VGAM1666 host target gene. LOC86651 BINDING SITE is HOST TARGET binding site found in the 5' untranslated region of mRNA encoded by LOC86651, corresponding to a HOST TARGET binding site such as BINDING SITE I, BINDING SITE II or BINDING SITE III. Table 2 illustrates the complementarity of the nucleotide sequences of LOC86651 BINDING SITE, designated SEQ ID:34095, to the nucleotide sequence of VGAM1666 RNA, herein designated VGAM RNA, also designated SEQ ID:4377.

Another function of VGAM1666 is therefore inhibition of LOC86651 (Accession XM_044052). Accordingly, utilities of VGAM1666 include diagnosis, prevention and treatment of diseases and clinical conditions associated with LOC86651. LOC90378 (Accession XM_031299) is another VGAM1666 host target gene. LOC90378 BINDING SITE is HOST TARGET binding site found in the 5' untranslated region of mRNA encoded by LOC90378, corresponding to a HOST TARGET binding site such as BINDING SITE I, BINDING SITE II or BINDING SITE III. Table 2 illustrates the complementarity of the nucleotide sequences of LOC90378 BINDING SITE, designated SEQ ID:31335, to the nucleotide sequence of VGAM1666 RNA, herein designated VGAM RNA, also designated SEQ ID:4377.

Another function of VGAM1666 is therefore inhibition of LOC90378 (Accession XM_031299). Accordingly, utilities of VGAM1666 include diagnosis, prevention and treatment of diseases and clinical conditions associated with LOC90378. LOC91694 (Accession XM_040082) is another VGAM1666 host target gene. LOC91694 BINDING SITE is HOST TARGET binding site found in the 3' untranslated region of mRNA encoded by LOC91694, corresponding to a HOST TARGET binding site such as BINDING SITE I, BINDING SITE II or BINDING SITE III. Table 2 illustrates the complementarity of the nucleotide sequences of LOC91694 BINDING SITE, designated SEQ ID:33248, to the nucleotide sequence of VGAM1666 RNA, herein designated VGAM RNA, also designated SEQ ID:4377.

Another function of VGAM1666 is therefore inhibition of LOC91694 (Accession XM_040082). Accordingly, utilities of VGAM1666 include diagnosis, prevention and treatment of diseases and clinical conditions associated with LOC91694. FIG. 1 further provides a conceptual description of a novel bioinformatically detected viral gene of the present invention, referred to here as Viral Genomic Address Messenger 1667 (VGAM1667) viral gene, which modulates expression of respective host target genes thereof, the function and utility of which host target genes is known in the art.

VGAM1667 is a novel bioinformatically detected regulatory, non protein coding, viral micro RNA (miRNA) gene. The method by which VGAM1667 was detected is described hereinabove with reference to FIGS. 1-8.

VGAM1667 gene, herein designated VGAM GENE, is a viral gene contained in the genome of Infectious Spleen and Kidney Necrosis Virus. VGAM1667 host target gene, herein designated VGAM HOST TARGET GENE, is a human gene contained in the human genome.

VGAM1667 gene encodes a VGAM1667 precursor RNA, herein designated VGAM PRECURSOR RNA. Similar to other miRNA genes, and unlike most ordinary genes, VGAM1667 precursor RNA does not encode a protein. A nucleotide sequence identical or highly similar to the nucleotide sequence of VGAM1667 precursor RNA is designated SEQ ID:1653, and is provided hereinbelow with reference to the sequence listing part. Nucleotide sequence SEQ ID:1653 is located at position 52329 relative to the genome of Infectious Spleen and Kidney Necrosis Virus.

VGAM1667 precursor RNA folds onto itself, forming VGAM1667 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1667 folded precursor RNA into VGAM1667 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1667 RNA is designated SEQ ID:4378, and is provided hereinbelow with reference to the sequence listing part.

VGAM1667 host target gene, herein designated VGAM HOST TARGET GENE, encodes a corresponding messenger RNA, VGAM1667 host target RNA, herein designated VGAM HOST TARGET RNA. VGAM1667 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1667 RNA, herein designated VGAM RNA, binds complementarily to one or more host target binding sites located in untranslated regions of VGAM1667 host target RNA, herein designated VGAM HOST TARGET RNA. This complementary binding is due to the fact that the nucleotide sequence of VGAM1667 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1667 RNA, herein designated VGAM RNA, may have a different number of host target binding sites in untranslated regions of a VGAM1667 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1667 RNA, herein designated VGAM RNA, to host target binding sites on VGAM1667 host target RNA, herein designated VGAM HOST TARGET RNA, such as BINDING SITE I, BINDING SITE II and BINDING SITE III, inhibits translation of VGAM1667 host target RNA into VGAM1667 host target protein, herein designated VGAM HOST TARGET PROTEIN. VGAM host target protein is therefore outlined by a broken line.

It is appreciated that VGAM1667 host target gene, herein designated VGAM HOST TARGET GENE, in fact represents a plurality of VGAM1667 host target genes. The mRNA of each one of this plurality of VGAM1667 host target genes comprises one or more host target binding sites, each having a nucleotide sequence which is at least partly complementary to VGAM1667 RNA, herein designated VGAM RNA, and which when bound by VGAM1667 RNA causes inhibition of translation of respective one or more VGAM1667 host target proteins.

It is further appreciated by one skilled in the art that the mode of translational inhibition illustrated by FIG. 1 with specific reference to translational inhibition exerted by VGAM1667 gene, herein designated VGAM GENE, on one or more VGAM1667 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1667 is inhibition of expression of host target genes, as part of a novel viral mechanism of attacking a host. Accordingly, utilities of VGAM1667 include diagnosis, prevention and treatment of viral infection by Infectious Spleen and Kidney Necrosis Virus. Specific functions, and accordingly utilities, of VGAM1667 correlate with, and may be deduced from, the identity of the host target genes which VGAM1667 binds and inhibits, and the function of these host target genes, as elaborated hereinbelow.

Nucleotide sequences of the VGAM1667 precursor RNA, herein designated VGAM PRECURSOR RNA, and of the 'diced' VGAM1667 RNA, herein designated VGAM RNA, and a schematic representation of the secondary folding of VGAM1667 folded precursor RNA, herein designated VGAM FOLDED PRECURSOR RNA, of VGAM1667 are further described hereinbelow with reference to Table 1.

Nucleotide sequences of host target binding sites, such as BINDING SITE-I, BINDING SITE-II and BINDING SITE-III of FIG. 1, found on VGAM1667 host target RNA, and schematic representation of the complementarity of each of these host target binding sites to VGAM1667 RNA, herein designated VGAM RNA, are described hereinbelow with reference to Table 2.

As mentioned hereinabove with reference to FIG. 1, a function of VGAM1667 gene, herein designated VGAM is inhibition of expression of VGAM1667 target genes. It is appreciated that specific functions, and accordingly utilities, of VGAM1667 correlate with, and may be deduced from, the identity of the target genes which VGAM1667 binds and inhibits, and the function of these target genes, as elaborated hereinbelow.

Dual-specificity tyrosine-(Y)-phosphorylation Regulated Kinase 1A (DYRK1A, Accession NM_101395) is a VGAM1667 host target gene. DYRK1A BINDING SITE is HOST TARGET binding site found in the 3' untranslated region of mRNA encoded by DYRK1A, corresponding to a HOST TARGET binding site such as BINDING SITE I, BINDING SITE II or BINDING SITE III. Table 2 illustrates the complementarity of the nucleotide sequences of DYRK1A BINDING SITE, designated SEQ ID:28162, to the nucleotide sequence of VGAM1667 RNA, herein designated VGAM RNA, also designated SEQ ID:4378.

A function of VGAM1667 is therefore inhibition of Dual-specificity tyrosine-(Y)-phosphorylation Regulated Kinase 1A (DYRK1A, Accession NM_101395), a gene which regulates cell proliferation and may be involved in brain development. Accordingly, utilities of VGAM1667 include diagnosis, prevention and treatment of diseases and clinical conditions associated with DYRK1A. The function of DYRK1A and its association with various diseases and clinical conditions, has been established by previous studies, as described hereinabove with reference to VGAM42. Cat Eye Syndrome Chromosome Region, Candidate 7 (CECR7, Accession XM_086803) is another VGAM1667 host target gene. CECR7 BINDING SITE is HOST TARGET binding site found in the 5' untranslated region of mRNA encoded by CECR7, corresponding to a HOST TARGET binding site such as BINDING SITE I, BINDING SITE II or BINDING SITE III. Table 2 illustrates the complementarity of the nucleotide sequences of CECR7 BINDING SITE, designated SEQ ID:38877, to the nucleotide sequence of VGAM1667 RNA, herein designated VGAM RNA, also designated SEQ ID:4378.

Another function of VGAM1667 is therefore inhibition of Cat Eye Syndrome Chromosome Region, Candidate 7 (CECR7, Accession XM_086803). Accordingly, utilities of VGAM1667 include diagnosis, prevention and treatment of diseases and clinical conditions associated with CECR7. FLJ30058 (Accession NM_144967) is another VGAM1667 host target gene. FLJ30058 BINDING SITE is HOST TARGET binding site found in the 3' untranslated region of mRNA encoded by FLJ30058, corresponding to a HOST TARGET binding site such as BINDING SITE I, BINDING SITE II or BINDING SITE III. Table 2 illustrates the complementarity of the nucleotide sequences of FLJ30058 BINDING SITE, designated SEQ ID:29582, to the nucleotide sequence of VGAM1667 RNA, herein designated VGAM RNA, also designated SEQ ID:4378.

Another function of VGAM1667 is therefore inhibition of FLJ30058 (Accession NM_144967). Accordingly, utilities of VGAM1667 include diagnosis, prevention and treatment of diseases and clinical conditions associated with FLJ30058. LOC146138 (Accession XM_096938) is another VGAM1667 host target gene. LOC146138 BINDING SITE is HOST TARGET binding site found in the 3' untranslated region of mRNA encoded by LOC146138, corresponding to a HOST TARGET binding site such as BINDING SITE I, BINDING SITE II or BINDING SITE III. Table 2 illustrates the complementarity of the nucleotide sequences of LOC146138 BINDING SITE, designated SEQ ID:40654, to the nucleotide sequence of VGAM1667 RNA, herein designated VGAM RNA, also designated SEQ ID:4378.

Another function of VGAM1667 is therefore inhibition of LOC146138 (Accession XM_096938). Accordingly, utilities of VGAM1667 include diagnosis, prevention and treatment of diseases and clinical conditions associated with LOC146138. LOC146443 (Accession XM_085461) is another VGAM1667 host target gene. LOC146443 BINDING SITE is HOST TARGET binding site found in the 5' untranslated region of mRNA encoded by LOC146443, corresponding to a HOST TARGET binding site such as BINDING SITE I, BINDING SITE II or BINDING SITE III. Table 2 illustrates the complementarity of the nucleotide sequences of LOC146443 BINDING SITE, designated SEQ ID:38148, to the nucleotide sequence of VGAM1667 RNA, herein designated VGAM RNA, also designated SEQ ID:4378.

Another function of VGAM1667 is therefore inhibition of LOC146443 (Accession XM_085461). Accordingly, utilities of VGAM1667 include diagnosis, prevention and treatment of diseases and clinical conditions associated with LOC146443. LOC221922 (Accession XM_166555) is another VGAM1667 host target gene. LOC221922 BINDING SITE is HOST TARGET binding site found in the 5' untranslated region of mRNA encoded by LOC221922, corresponding to a HOST TARGET binding site such as BINDING SITE I, BINDING SITE II or BINDING SITE III. Table 2 illustrates the complementarity of the nucleotide sequences of LOC221922 BINDING SITE, designated SEQ ID:44531, to the nucleotide sequence of VGAM1667 RNA, herein designated VGAM RNA, also designated SEQ ID:4378.

Another function of VGAM1667 is therefore inhibition of LOC221922 (Accession XM_166555). Accordingly, utilities of VGAM1667 include diagnosis, prevention and treatment of diseases and clinical conditions associated with LOC221922. FIG. 1 further provides a conceptual description of a novel bioinformatically detected viral gene of the present invention, referred to here as Viral Genomic Address Messenger 1668 (VGAM1668) viral gene, which modulates expression of respective host target genes thereof, the function and utility of which host target genes is known in the art.

VGAM1668 is a novel bioinformatically detected regulatory, non protein coding, viral micro RNA (miRNA) gene. The method by which VGAM1668 was detected is described hereinabove with reference to FIGS. 1-8.

VGAM1668 gene, herein designated VGAM GENE, is a viral gene contained in the genome of Human Adenovirus D. VGAM1668 host target gene, herein designated VGAM HOST TARGET GENE, is a human gene contained in the human genome.

VGAM1668 gene encodes a VGAM1668 precursor RNA, herein designated VGAM PRECURSOR RNA. Similar to other miRNA genes, and unlike most ordinary genes, VGAM1668 precursor RNA does not encode a protein. A nucleotide sequence identical or highly similar to the nucleotide sequence of VGAM1668 precursor RNA is designated SEQ ID:1654, and is provided hereinbelow with reference to the sequence listing part. Nucleotide sequence SEQ ID:1654 is located at position 20850 relative to the genome of Human Adenovirus D.

VGAM1668 precursor RNA folds onto itself, forming VGAM1668 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1668 folded precursor RNA into VGAM1668 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM1668 RNA is designated SEQ ID:4379, and is provided hereinbelow with reference to the sequence listing part.

VGAM1668 host target gene, herein designated VGAM HOST TARGET GENE, encodes a corresponding messenger RNA, VGAM1668 host target RNA, herein designated VGAM HOST TARGET RNA. VGAM1668 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1668 RNA, herein designated VGAM RNA, binds complementarily to one or more host target binding sites located in untranslated regions of VGAM1668 host target RNA, herein designated VGAM HOST TARGET RNA. This complementary binding is due to the fact that the nucleotide sequence of VGAM1668 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1668 RNA, herein designated VGAM RNA, may have a different number of host target binding sites in untranslated regions of a VGAM1668 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1668 RNA, herein designated VGAM RNA, to host target binding sites on VGAM1668 host target RNA, herein designated VGAM HOST TARGET RNA, such as BINDING SITE I, BINDING SITE II and BINDING SITE III, inhibits translation of VGAM1668 host target RNA into VGAM1668 host target protein, herein designated VGAM HOST TARGET PROTEIN. VGAM host target protein is therefore outlined by a broken line.

It is appreciated that VGAM1668 host target gene, herein designated VGAM HOST TARGET GENE, in fact represents a plurality of VGAM1668 host target genes. The mRNA of each one of this plurality of VGAM1668 host target genes comprises one or more host target binding sites, each having a nucleotide sequence which is at least partly complementary to VGAM1668 RNA, herein designated VGAM RNA, and which when bound by VGAM1668 RNA causes inhibition of translation of respective one or more VGAM1668 host target proteins.

It is further appreciated by one skilled in the art that the mode of translational inhibition illustrated by FIG. 1 with specific reference to translational inhibition exerted by VGAM1668 gene, herein designated VGAM GENE, on one or more VGAM1668 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1668 is inhibition of expression of host target genes, as part of a novel viral mechanism of attacking a host. Accordingly, utilities of VGAM1668 include diagnosis, prevention and treatment of viral infection by Human Adenovirus D. Specific functions, and accordingly utilities, of VGAM1668 correlate with, and may be deduced from, the identity of the host target genes which VGAM1668 binds and inhibits, and the function of these host target genes, as elaborated hereinbelow.

Nucleotide sequences of the VGAM1668 precursor RNA, herein designated VGAM PRECURSOR RNA, and of the 'diced' VGAM1668 RNA, herein designated VGAM RNA, and a schematic representation of the secondary folding of VGAM1668 folded precursor RNA, herein designated VGAM FOLDED PRECURSOR RNA, of VGAM1668 are further described hereinbelow with reference to Table 1.

Nucleotide sequences of host target binding sites, such as BINDING SITE-I, BINDING SITE-II and BINDING SITE-III of FIG. 1, found on VGAM1668 host target RNA, and schematic representation of the complementarity of each of these host target binding sites to VGAM1668 RNA, herein designated VGAM RNA, are described hereinbelow with reference to Table 2.

As mentioned hereinabove with reference to FIG. 1, a function of VGAM1668 gene, herein designated VGAM is inhibition of expression of VGAM1668 target genes. It is appreciated that specific functions, and accordingly utilities, of VGAM1668 correlate with, and may be deduced from, the identity of the target genes which VGAM1668 binds and inhibits, and the function of these target genes, as elaborated hereinbelow.

AXL Receptor Tyrosine Kinase (AXL, Accession NM_001699) is a VGAM1668 host target gene. AXL BINDING SITE1 and AXL BINDING SITE2 are HOST TARGET binding sites found in untranslated regions of mRNA encoded by AXL, corresponding to HOST TARGET binding sites such as BINDING SITE I, BINDING SITE II or BINDING SITE III. Table 2 illustrates the complementarity of the nucleotide sequences of AXL BINDING SITE1 and AXL BINDING SITE2, designated SEQ ID:7422 and SEQ ID:22443 respectively, to the nucleotide sequence of VGAM1668 RNA, herein designated VGAM RNA, also designated SEQ ID:4379.

A function of VGAM1668 is therefore inhibition of AXL Receptor Tyrosine Kinase (AXL, Accession NM_001699). Accordingly, utilities of VGAM1668 include diagnosis, prevention and treatment of diseases and clinical conditions associated with AXL. Frizzled Homolog 4 (Drosophila) (FZD4, Accession NM_012193) is another VGAM1668 host target gene. FZD4 BINDING SITE is HOST TARGET binding site found in the 3' untranslated region of mRNA encoded by FZD4, corresponding to a HOST TARGET binding site such as BINDING SITE I, BINDING SITE II or BINDING SITE III. Table 2 illustrates the complementarity of the nucleotide sequences of FZD4 BINDING SITE, designated SEQ ID:14483, to the nucleotide sequence of VGAM1668 RNA, herein designated VGAM RNA, also designated SEQ ID:4379.

Another function of VGAM1668 is therefore inhibition of Frizzled Homolog 4 (Drosophila) (FZD4, Accession NM_012193), a gene which may function in cell polarity, cell fate specification and cancer; similar to frizzled receptor family, has seven transmembrane domains. Accordingly, utilities of VGAM1668 include diagnosis, prevention and treatment of diseases and clinical conditions associated with FZD4. The function of FZD4 and its association with various diseases and clinical conditions, has been established by previous studies, as described hereinabove with reference to VGAM309. Glucose-6-phosphatase, Transport (glucose-6-phosphate) Protein 1 (G6PT1, Accession NM_001467) is another VGAM1668 host target gene. G6PT1 BINDING SITE is HOST TARGET binding site found in the 5' untranslated region of mRNA encoded by G6PT1, corresponding to a HOST TARGET binding site such as BINDING SITE I, BINDING SITE II or BINDING SITE III. Table 2 illustrates the complementarity of the nucleotide sequences of G6PT1 BINDING SITE, designated SEQ ID:7199, to the nucleotide sequence of VGAM1668 RNA, herein designated VGAM RNA, also designated SEQ ID:4379.

Another function of VGAM1668 is therefore inhibition of Glucose-6-phosphatase, Transport (glucose-6-phosphate) Protein 1 (G6PT1, Accession NM_001467). Accordingly, utilities of VGAM1668 include diagnosis, prevention and treatment of diseases and clinical conditions associated with G6PT1. Potassium Intermediate/small Conductance Calcium-activated Channel, Subfamily N, Member 4 (KCNN4, Accession NM_002250) is another VGAM1668 host target gene. KCNN4 BINDING SITE is HOST TARGET binding site found in the 5' untranslated region of mRNA encoded by KCNN4, corresponding to a HOST TARGET binding site such as BINDING SITE I, BINDING SITE II or BINDING SITE III. Table 2 illustrates the complementarity of the nucleotide sequences of KCNN4 BINDING SITE, designated SEQ ID:8037, to the nucleotide sequence of VGAM1668 RNA, herein designated VGAM RNA, also designated SEQ ID:4379.

Another function of VGAM1668 is therefore inhibition of Potassium Intermediate/small Conductance Calcium-activated Channel, Subfamily N, Member 4 (KCNN4, Accession NM_002250), a gene which forms a voltage-independent potassium channel that is activated by intracellular calcium. Accordingly, utilities of VGAM1668 include diagnosis, prevention and treatment of diseases and clinical conditions associated with KCNN4. The function of KCNN4 and its association with various diseases and clinical conditions, has been established by previous studies, as described hereinabove with reference to VGAM152. Methionine Adenosyltransferase I, Alpha (MAT1A, Accession XM_165540) is another VGAM1668 host target gene. MAT1A BINDING SITE is HOST TARGET binding site found in the 3' untranslated region of mRNA encoded by MAT1A, corresponding to a HOST TARGET binding site such as BINDING SITE I, BINDING SITE II or BINDING SITE III. Table 2 illustrates the complementarity of the nucleotide sequences of MAT1A BINDING SITE, designated SEQ ID:43668, to the nucleotide sequence of VGAM1668 RNA, herein designated VGAM RNA, also designated SEQ ID:4379.

Another function of VGAM1668 is therefore inhibition of Methionine Adenosyltransferase I, Alpha (MAT1A, Accession XM_165540). Accordingly, utilities of VGAM1668 include diagnosis, prevention and treatment of diseases and clinical conditions associated with MAT1A. Neuroblastoma RAS Viral (v-ras) Oncogene Homolog (NRAS, Accession NM_002524) is another VGAM1668 host target gene. NRAS BINDING SITE is HOST TARGET binding site found in the 3' untranslated region of mRNA encoded by NRAS, corresponding to a HOST TARGET binding site such as BINDING SITE I, BINDING SITE II or BINDING SITE III. Table 2 illustrates the complementarity of the nucleotide sequences of NRAS BINDING SITE, designated SEQ ID:8360, to the nucleotide sequence of VGAM1668 RNA, herein designated VGAM RNA, also designated SEQ ID:4379.

Another function of VGAM1668 is therefore inhibition of Neuroblastoma RAS Viral (v-ras) Oncogene Homolog (NRAS, Accession NM_002524), a gene which ras proteins bind gdp/gtp and possess intrinsic gtpase activity. Accordingly, utilities of VGAM1668 include diagnosis, prevention and treatment of diseases and clinical conditions associated with NRAS. The function of NRAS and its association with various diseases and clinical conditions, has been established by previous studies, as described hereinabove with reference to VGAM351. Secreted Frizzled-related Protein 1 (SFRP1, Accession NM_003012) is another VGAM1668 host target gene. SFRP1 BINDING SITE is HOST TARGET binding site found in the 5' untranslated region of mRNA encoded by SFRP1, corresponding to a HOST TARGET binding site such as BINDING SITE I, BINDING SITE II or BINDING SITE III. Table 2 illustrates the complementarity of the nucleotide sequences of SFRP1 BINDING SITE, designated SEQ ID:8929, to the nucleotide sequence of VGAM1668 RNA, herein designated VGAM RNA, also designated SEQ ID:4379.

Another function of VGAM1668 is therefore inhibition of Secreted Frizzled-related Protein 1 (SFRP1, Accession NM_003012), a gene which is a receptor for wnt proteins that may have an anti-apoptotic function. Accordingly, utilities of VGAM1668 include diagnosis, prevention and treatment of diseases and clinical conditions associated with SFRP1. The function of SFRP1 and its association with various diseases and clinical conditions, has been established by previous studies, as described hereinabove with reference to VGAM250. FLJ10101 (Accession NM_024718) is another VGAM1668 host target gene. FLJ10101 BINDING SITE1 and FLJ10101 BINDING SITE2 are HOST TARGET binding sites found in untranslated regions of mRNA encoded by FLJ10101, corresponding to HOST TARGET binding sites such as BINDING SITE I, BINDING SITE II or BINDING SITE III. Table 2 illustrates the complementarity of the nucleotide sequences of FLJ10101 BINDING SITE1 and FLJ10101 BINDING SITE2, designated SEQ ID:24045 and SEQ ID:24046 respectively, to the nucleotide sequence of VGAM1668 RNA, herein designated VGAM RNA, also designated SEQ ID:4379.

Another function of VGAM1668 is therefore inhibition of FLJ10101 (Accession NM_024718). Accordingly, utilities of VGAM1668 include diagnosis, prevention and treatment of diseases and clinical conditions associated with FLJ10101. KIAA0285 (Accession NM_014807) is another VGAM1668 host target gene. KIAA0285 BINDING SITE is HOST TARGET binding site found in the 5' untranslated region of mRNA encoded by KIAA0285, corresponding to a HOST TARGET binding site such as BINDING SITE I, BINDING SITE II or BINDING SITE III. Table 2 illustrates the complementarity of the nucleotide sequences of KIAA0285 BINDING SITE, designated SEQ ID:16752, to the nucleotide sequence of VGAM1668 RNA, herein designated VGAM RNA, also designated SEQ ID:4379.

Another function of VGAM1668 is therefore inhibition of KIAA0285 (Accession NM_014807). Accordingly, utilities of VGAM1668 include diagnosis, prevention and treatment of diseases and clinical conditions associated with KIAA0285. KIAA0350 (Accession XM_028332) is another VGAM1668 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30665, to the nucleotide sequence of VGAM1668 RNA, herein designated VGAM RNA, also designated SEQ ID:4379.

Another function of VGAM1668 is therefore inhibition of KIAA0350 (Accession XM_028332). Accordingly, utilities of VGAM1668 include diagnosis, prevention and treatment of diseases and clinical conditions associated with KIAA0350. KIAA0669 (Accession NM_014779) is another VGAM1668 host target gene. KIAA0669 BINDING SITE is HOST TARGET binding site found in the 5' untranslated region of mRNA encoded by KIAA0669, corresponding to a HOST TARGET binding site such as BINDING SITE I, BINDING SITE II or BINDING SITE III. Table 2 illustrates the complementarity of the nucleotide sequences of KIAA0669 BINDING SITE, designated SEQ ID:16626, to the nucleotide sequence of VGAM1668 RNA, herein designated VGAM RNA, also designated SEQ ID:4379.

Another function of VGAM1668 is therefore inhibition of KIAA0669 (Accession NM_014779). Accordingly, utilities of VGAM1668 include diagnosis, prevention and treatment of diseases and clinical conditions associated with KIAA0669. KIAA0731 (Accession XM_039975) is another VGAM1668 host target gene. KIAA0731 BINDING SITE is HOST TARGET binding site found in the 3' untranslated region of mRNA encoded by KIAA0731, corresponding to a HOST TARGET binding site such as BINDING SITE I, BINDING SITE II or BINDING SITE III. Table 2 illustrates the complementarity of the nucleotide sequences of KIAA0731 BINDING SITE, designated SEQ ID:33239, to the nucleotide sequence of VGAM1668 RNA, herein designated VGAM RNA, also designated SEQ ID:4379.

Another function of VGAM1668 is therefore inhibition of KIAA0731 (Accession XM_039975). Accordingly, utilities of VGAM1668 include diagnosis, prevention and treatment of diseases and clinical conditions associated with KIAA0731. KIAA0872 (Accession NM_014940) is another VGAM1668 host target gene. KIAA0872 BINDING SITE is HOST TARGET binding site found in the 3' untranslated region of mRNA encoded by KIAA0872, corresponding to a HOST TARGET binding site such as BINDING SITE I, BINDING SITE II or BINDING SITE III. Table 2 illustrates the complementarity of the nucleotide sequences of KIAA0872 BINDING SITE, designated SEQ ID:17245, to the nucleotide sequence of VGAM1668 RNA, herein designated VGAM RNA, also designated SEQ ID:4379.

Another function of VGAM1668 is therefore inhibition of KIAA0872 (Accession NM_014940). Accordingly, utilities of VGAM1668 include diagnosis, prevention and treatment of diseases and clinical conditions associated with KIAA0872. KIAA1172 (Accession XM_047889) is another VGAM1668 host target gene. KIAA1172 BINDING SITE is HOST TARGET binding site found in the 5' untranslated region of mRNA encoded by KIAA1172, corresponding to a HOST TARGET binding site such as BINDING SITE I, BINDING SITE II or BINDING SITE III. Table 2 illustrates the complementarity of the nucleotide sequences of KIAA1172 BINDING SITE, designated SEQ ID:35078, to the nucleotide sequence of VGAM1668 RNA, herein designated VGAM RNA, also designated SEQ ID:4379.

Another function of VGAM1668 is therefore inhibition of KIAA1172 (Accession XM_047889). Accordingly, utilities of VGAM1668 include diagnosis, prevention and treatment of diseases and clinical conditions associated with KIAA1172. LOC116411 (Accession XM_058095) is another VGAM1668 host target gene. LOC116411 BINDING SITE1 through LOC116411 BINDING SITE3 are HOST TARGET binding sites found in untranslated regions of mRNA encoded by LOC116411, corresponding to HOST TARGET binding sites such as BINDING SITE I, BINDING SITE II or BINDING SITE III. Table 2 illustrates the complementarity of the nucleotide sequences of LOC116411 BINDING SITE1 through LOC116411 BINDING SITE3, designated SEQ ID:36566, SEQ ID:36567 and SEQ ID:36572 respectively, to the nucleotide sequence of VGAM1668 RNA, herein designated VGAM RNA, also designated SEQ ID:4379.

Another function of VGAM1668 is therefore inhibition of LOC116411 (Accession XM_058095). Accordingly, utilities of VGAM1668 include diagnosis, prevention and treatment of diseases and clinical conditions associated with LOC116411. LOC152762 (Accession XM_087518) is another VGAM1668 host target gene. LOC152762 BINDING SITE is HOST TARGET binding site found in the 3' untranslated region of mRNA encoded by LOC152762, corresponding to a HOST TARGET binding site such as BINDING SITE I, BINDING SITE II or BINDING SITE III. Table 2 illustrates the complementarity of the nucleotide sequences of LOC152762 BINDING SITE, designated SEQ ID:39305, to the nucleotide sequence of VGAM1668 RNA, herein designated VGAM RNA, also designated SEQ ID:4379.

Another function of VGAM1668 is therefore inhibition of LOC152762 (Accession XM_087518). Accordingly, utilities of VGAM1668 include diagnosis, prevention and treatment of diseases and clinical conditions associated with LOC152762. LOC200093 (Accession XM_032184) is another VGAM1668 host target gene. LOC200093 BINDING SITE is HOST TARGET binding site found in the 3' untranslated region of mRNA encoded by LOC200093, corresponding to a HOST TARGET binding site such as BINDING SITE I, BINDING SITE II or BINDING SITE III. Table 2 illustrates the complementarity of the nucleotide sequences of LOC200093 BINDING SITE, designated SEQ ID:31598, to the nucleotide sequence of VGAM1668 RNA, herein designated VGAM RNA, also designated SEQ ID:4379.

Another function of VGAM1668 is therefore inhibition of LOC200093 (Accession XM_032184). Accordingly, utilities of VGAM1668 include diagnosis, prevention and treatment of diseases and clinical conditions associated with LOC200093. LOC221468 (Accession NM_145316) is another VGAM1668 host target gene. LOC221468 BINDING SITE is HOST TARGET binding site found in the 3' untranslated region of mRNA encoded by LOC221468, corresponding to a HOST TARGET binding site such as BINDING SITE I, BINDING SITE II or BINDING SITE III. Table 2 illustrates the complementarity of the nucleotide sequences of LOC221468 BINDING SITE, designated SEQ ID:29826, to the nucleotide sequence of VGAM1668 RNA, herein designated VGAM RNA, also designated SEQ ID:4379.

Another function of VGAM1668 is therefore inhibition of LOC221468 (Accession NM_145316). Accordingly, utilities of VGAM1668 include diagnosis, prevention and treatment of diseases and clinical conditions associated with LOC221468. LOC92697 (Accession XM_046715) is another VGAM1668 host target gene. LOC92697 BINDING SITE is HOST TARGET binding site found in the 5' untranslated region of mRNA encoded by LOC92697, corresponding to a HOST TARGET binding site such as BINDING SITE I, BINDING SITE II or BINDING SITE III. Table 2 illustrates the complementarity of the nucleotide sequences of LOC92697 BINDING SITE, designated SEQ ID:34806, to the nucleotide sequence of VGAM1668 RNA, herein designated VGAM RNA, also designated SEQ ID:4379.

Another function of VGAM1668 is therefore inhibition of LOC92697 (Accession XM_046715). Accordingly, utilities of VGAM1668 include diagnosis, prevention and treatment of diseases and clinical conditions associated with LOC92697. FIG. 1 further provides a conceptual description of a novel bioinformatically detected viral gene of the present invention, referred to here as Viral Genomic Address Messenger 1669 (VGAM1669) viral gene, which modulates expression of respective host target genes thereof, the function and utility of which host target genes is known in the art.

VGAM1669 is a novel bioinformatically detected regulatory, non protein coding, viral micro RNA (miRNA) gene. The method by which VGAM1669 was detected is described hereinabove with reference to FIGS. 1-8.

VGAM1669 gene, herein designated VGAM GENE, is a viral gene contained in the genome of Human Adenovirus D. VGAM1669 host target gene, herein designated VGAM HOST TARGET GENE, is a human gene contained in the human genome.

VGAM1669 gene encodes a VGAM1669 precursor RNA, herein designated VGAM PRECURSOR RNA. Similar to other miRNA genes, and unlike most ordinary genes, VGAM1669 precursor RNA does not encode a protein. A nucleotide sequence identical or highly similar to the nucleotide sequence of VGAM1669 precursor RNA is designated SEQ ID:1655, and is provided hereinbelow with reference to the sequence listing part. Nucleotide sequence SEQ ID:1655 is located at position 18504 relative to the genome of Human Adenovirus D.

VGAM1669 precursor RNA folds onto itself, forming VGAM1669 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1669 folded precursor RNA into VGAM1669 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1669 RNA is designated SEQ ID:4380, and is provided hereinbelow with reference to the sequence listing part.

VGAM1669 host target gene, herein designated VGAM HOST TARGET GENE, encodes a corresponding messenger RNA, VGAM1669 host target RNA, herein designated VGAM HOST TARGET RNA. VGAM1669 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1669 RNA, herein designated VGAM RNA, binds complementarily to one or more host target binding sites located in untranslated regions of VGAM1669 host target RNA, herein designated VGAM HOST TARGET RNA. This complementary binding is due to the fact that the nucleotide sequence of VGAM1669 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1669 RNA, herein designated VGAM RNA, may have a different number of host target binding sites in untranslated regions of a VGAM1669 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1669 RNA, herein designated VGAM RNA, to host target binding sites on VGAM1669 host target RNA, herein designated VGAM HOST TARGET RNA, such as BINDING SITE I, BINDING SITE II and BINDING SITE III, inhibits translation of VGAM1669 host target RNA into VGAM1669 host target protein, herein designated VGAM HOST TARGET PROTEIN. VGAM host target protein is therefore outlined by a broken line.

It is appreciated that VGAM1669 host target gene, herein designated VGAM HOST TARGET GENE, in fact represents a plurality of VGAM1669 host target genes. The mRNA of each one of this plurality of VGAM1669 host target genes comprises one or more host target binding sites, each having a nucleotide sequence which is at least partly complementary to VGAM1669 RNA, herein designated VGAM RNA, and which when bound by VGAM1669 RNA causes inhibition of translation of respective one or more VGAM1669 host target proteins.

It is further appreciated by one skilled in the art that the mode of translational inhibition illustrated by FIG. 1 with specific reference to translational inhibition exerted by VGAM1669 gene, herein designated VGAM GENE, on one or more VGAM1669 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1669 is inhibition of expression of host target genes, as part of a novel viral mechanism of attacking a host. Accordingly, utilities of VGAM1669 include diagnosis, prevention and treatment of viral infection by Human Adenovirus D. Specific functions, and accordingly utilities, of VGAM1669 correlate with, and may be deduced from, the identity of the host target genes which VGAM1669 binds and inhibits, and the function of these host target genes, as elaborated hereinbelow.

Nucleotide sequences of the VGAM1669 precursor RNA, herein designated VGAM PRECURSOR RNA, and of the 'diced' VGAM1669 RNA, herein designated VGAM RNA, and a schematic representation of the secondary folding of VGAM1669 folded precursor RNA, herein designated VGAM FOLDED PRECURSOR RNA, of VGAM1669 are further described hereinbelow with reference to Table 1.

Nucleotide sequences of host target binding sites, such as BINDING SITE-I, BINDING SITE-II and BINDING SITE-III of FIG. 1, found on VGAM1669 host target RNA, and schematic representation of the complementarity of each of these host target binding sites to VGAM1669 RNA, herein designated VGAM RNA, are described hereinbelow with reference to Table 2.

As mentioned hereinabove with reference to FIG. 1, a function of VGAM1669 gene, herein designated VGAM is inhibition of expression of VGAM1669 target genes. It is appreciated that specific functions, and accordingly utilities, of VGAM1669 correlate with, and may be deduced from, the identity of the target genes which VGAM1669 binds and inhibits, and the function of these target genes, as elaborated hereinbelow.

Carnitine O-octanoyltransferase (CROT, Accession NM_021151) is a VGAM1669 host target gene. CROT BINDING SITE is HOST TARGET binding site found in the 3' untranslated region of mRNA encoded by CROT, corresponding to a HOST TARGET binding site such as BINDING SITE I, BINDING SITE II or BINDING SITE III. Table 2 illustrates the complementarity of the nucleotide sequences of CROT BINDING SITE, designated SEQ ID:22123, to the nucleotide sequence of VGAM1669 RNA, herein designated VGAM RNA, also designated SEQ ID:4380.

A function of VGAM1669 is therefore inhibition of Carnitine O-octanoyltransferase (CROT, Accession NM_021151), a gene which CROT plays a crucial role in the beta-oxidation of branched-chain fatty acids including pristanic acid. Accordingly, utilities of VGAM1669 include diagnosis, prevention and treatment of diseases and clinical conditions associated with CROT. The function of CROT and its association with various diseases and clinical conditions, has been established by previous studies, as described hereinabove with reference to VGAM70. Eukaryotic Translation Initiation Factor 4E Binding Protein 2 (EIF4EBP2, Accession NM_004096) is another VGAM1669 host target gene. EIF4EBP2 BINDING SITE is HOST TARGET binding site found in the 3' untranslated region of mRNA encoded by EIF4EBP2, corresponding to a HOST TARGET binding site such as BINDING SITE I, BINDING SITE II or BINDING SITE III. Table 2 illustrates the complementarity of the nucleotide sequences of EIF4EBP2 BINDING SITE, designated SEQ ID:10300, to the nucleotide sequence of VGAM1669 RNA, herein designated VGAM RNA, also designated SEQ ID:4380.

Another function of VGAM1669 is therefore inhibition of Eukaryotic Translation Initiation Factor 4E Binding Protein 2 (EIF4EBP2, Accession NM_004096), a gene which binds EIF4E and negatively regulates initiation of translation. Accordingly, utilities of VGAM1669 include diagnosis, prevention and treatment of diseases and clinical conditions associated with EIF4EBP2. The function of EIF4EBP2 and its association with various diseases and clinical conditions, has been established by previous studies, as described hereinabove with reference to VGAM501. G Protein-coupled Receptor 44 (GPR44, Accession NM_004778) is another VGAM1669 host target gene. GPR44 BINDING SITE is HOST TARGET binding site found in the 3' untranslated region of mRNA encoded by GPR44, corresponding to a HOST TARGET binding site such as BINDING SITE I, BINDING SITE II or BINDING SITE III. Table 2 illustrates the complementarity of the nucleotide sequences of GPR44 BINDING SITE, designated SEQ ID:11173, to the nucleotide sequence of VGAM1669 RNA, herein designated VGAM RNA, also designated SEQ ID:4380.

Another function of VGAM1669 is therefore inhibition of G Protein-coupled Receptor 44 (GPR44, Accession NM_004778), a gene which mediates signals to the interior of the cell via activation of heterotrimeric G proteins. Accordingly, utilities of VGAM1669 include diagnosis, prevention and treatment of diseases and clinical conditions associated with GPR44. The function of GPR44 has been established by previous studies. By PCR amplification of human genomic DNA using degenerate oligonucleotides corresponding to transmembrane domains 3 and 7 of the mouse delta-opioid receptor and somatostatin receptors, Marchese et al. (1999) isolated a partial cDNA for a novel G protein-coupled receptor, which they designated GPR44. They obtained a full-length clone by screening a lambda human genomic library. GPR44 encodes a 472-amino acid protein that is closely related to chemoattractant receptors. Northern blot analysis revealed a 3.5-kb GPR44 transcript primarily in thalamus, frontal cortex, pons, and hippocampus and at lower levels in hypothalamus and caudate/putamen. A 3.4-kb transcript was detected in fetal liver, leukocytes, and thymus. Prostaglandin D2 (PGD2; OMIM Ref. No. 176803) and other prostanoids are synthesized by the constitutive cyclooxygenase COX1 (PTGS1; 176805) and its inducible isoform, COX2 (PTGS2; 600262). PGD2, which is implicated in allergic disease, elicits its biologic function through interaction with the DP receptor (PTGDR; 604687). Hirai et al. (2001) showed that PGD2 produced by activated mast cells uses CRTH2 to induce intracellular calcium mobilization and chemotaxis in Th2 cells in a G-alpha (i) (GNAI1; 139310)-dependent manner. In addition, they found that CRTH2 rather than DP mediates PGD2-dependent migration of blood eosinophils and basophils. Functional analysis indicated that PGD2 signaling through DP is coupled to G-alpha (s) (GNAS; 139320) and does not induce chemotaxis.

Full details of the abovementioned studies are described in the following publications, the disclosure of which are hereby incorporated by reference:

Hirai, H.; Tanaka, K.; Yoshie, O.; Ogawa, K.; Kenmotsu, K.; Takamori, Y.; Ichimasa, M.; Sugamura, K.; Nakamura, M.; Takano, S.; Nagata, K.: Prostaglandin D2 selectively induces chemotaxis in T helper type 2 cells, eosinophils, and basophils via seven-transmembrane receptor CRTH2. J. Exp. Med. 193:255-261, 2001; and Marchese, A.; Sawzdargo, M.; Nguyen, T.; Cheng, R.; Heng, H. H. Q.; Nowak, T.; Im, D-S.; Lynch, K. R.; George, S. R.; O'Dowd, B. F.: Discovery of three novel orphan G-protein-coupled r.

Further studies establishing the function and utilities of GPR44 are found in John Hopkins OMIM database record ID 604837, and in sited publications numbered 694 and 9159 listed in the bibliography section hereinbelow, which are also hereby incorporated by reference. DKFZP434O047 (Accession NM_015594) is another VGAM1669 host target gene. DKFZP434O047 BINDING SITE is HOST TARGET binding site found in the 5' untranslated region of mRNA encoded by DKFZP434O047, corresponding to a HOST TARGET binding site such as BINDING SITE I, BINDING SITE II or BINDING SITE III. Table 2 illustrates the complementarity of the nucleotide sequences of DKFZP434O047 BINDING SITE, designated SEQ ID:17868, to the nucleotide sequence of VGAM1669 RNA, herein designated VGAM RNA, also designated SEQ ID:4380.

Another function of VGAM1669 is therefore inhibition of DKFZP434O047 (Accession NM_015594). Accordingly, utilities of VGAM1669 include diagnosis, prevention and treatment of diseases and clinical conditions associated with DKFZP434O047. FLJ20716 (Accession NM_017938) is another VGAM1669 host target gene. FLJ20716 BINDING SITE is HOST TARGET binding site found in the 3' untranslated region of mRNA encoded by FLJ20716, corresponding to a HOST TARGET binding site such as BINDING SITE I, BINDING SITE II or BINDING SITE III. Table 2 illustrates the complementarity of the nucleotide sequences of FLJ20716 BINDING SITE, designated SEQ ID:19631, to the nucleotide sequence of VGAM1669 RNA, herein designated VGAM RNA, also designated SEQ ID:4380.

Another function of VGAM1669 is therefore inhibition of FLJ20716 (Accession NM_017938). Accordingly, utilities of VGAM1669 include diagnosis, prevention and treatment of diseases and clinical conditions associated with FLJ20716. Heterogeneous Nuclear Ribonucleoprotein A3 (HNRPA3, Accession NM_005758) is another VGAM1669 host target gene. HNRPA3 BINDING SITE is HOST TARGET binding site found in the 3' untranslated region of mRNA encoded by HNRPA3, corresponding to a HOST TARGET binding site such as BINDING SITE I, BINDING SITE II or BINDING SITE III. Table 2 illustrates the complementarity of the nucleotide sequences of HNRPA3 BINDING SITE, designated SEQ ID:12322, to the nucleotide sequence of VGAM1669 RNA, herein designated VGAM RNA, also designated SEQ ID:4380.

Another function of VGAM1669 is therefore inhibition of Heterogeneous Nuclear Ribonucleoprotein A3 (HNRPA3, Accession NM_005758). Accordingly, utilities of VGAM1669 include diagnosis, prevention and treatment of diseases and clinical conditions associated with HNRPA3. MAGE-E1 (Accession NM_030801) is another VGAM1669 host target gene. MAGE-E1 BINDING SITE is HOST TARGET binding site found in the 3' untranslated region of mRNA encoded by MAGE-E1, corresponding to a HOST TARGET binding site such as BINDING SITE I, BINDING SITE II or BINDING SITE III. Table 2 illustrates the complementarity of the nucleotide sequences of MAGE-E1 BINDING SITE, designated SEQ ID:25103, to the nucleotide sequence of VGAM1669 RNA, herein designated VGAM RNA, also designated SEQ ID:4380.

Another function of VGAM1669 is therefore inhibition of MAGE-E1 (Accession NM_030801). Accordingly, utilities of VGAM1669 include diagnosis, prevention and treatment of diseases and clinical conditions associated with MAGE-E1. Mal, T-cell Differentiation Protein 2 (MAL2, Accession NM_052886) is another VGAM1669 host target gene. MAL2 BINDING SITE is HOST TARGET binding site found in the 3' untranslated region of mRNA encoded by MAL2, corresponding to a HOST TARGET binding site such as BINDING SITE I, BINDING SITE II or BINDING SITE III. Table 2 illustrates the complementarity of the nucleotide sequences of MAL2 BINDING SITE, designated SEQ ID:27469, to the nucleotide sequence of VGAM1669 RNA, herein designated VGAM RNA, also designated SEQ ID:4380.

Another function of VGAM1669 is therefore inhibition of Mal, T-cell Differentiation Protein 2 (MAL2, Accession NM_052886). Accordingly, utilities of VGAM1669 include diagnosis, prevention and treatment of diseases and clinical conditions associated with MAL2. MGC15563 (Accession NM_032876) is another VGAM1669 host target gene. MGC15563 BINDING SITE is HOST TARGET binding site found in the 3' untranslated region of mRNA encoded by MGC15563, corresponding to a HOST TARGET binding site such as BINDING SITE I, BINDING SITE II or BINDING SITE III. Table 2 illustrates the complementarity of the nucleotide sequences of MGC15563 BINDING SITE, designated SEQ ID:26699, to the nucleotide sequence of VGAM1669 RNA, herein designated VGAM RNA, also designated SEQ ID:4380.

Another function of VGAM1669 is therefore inhibition of MGC15563 (Accession NM_032876). Accordingly, utilities of VGAM1669 include diagnosis, prevention and treatment of diseases and clinical conditions associated with MGC15563. LOC204823 (Accession XM_115621) is another VGAM1669 host target gene. LOC204823 BINDING SITE is HOST TARGET binding site found in the 5' untranslated region of mRNA encoded by LOC204823, corresponding to a HOST TARGET binding site such as BINDING SITE I, BINDING SITE II or BINDING SITE III. Table 2 illustrates the complementarity of the nucleotide sequences of LOC204823 BINDING SITE, designated SEQ ID:43102, to the nucleotide sequence of VGAM1669 RNA, herein designated VGAM RNA, also designated SEQ ID:4380.

Another function of VGAM1669 is therefore inhibition of LOC204823 (Accession XM_115621). Accordingly, utilities of VGAM1669 include diagnosis, prevention and treatment of diseases and clinical conditions associated with LOC204823. LOC255654 (Accession XM_173036) is another VGAM1669 host target gene. LOC255654 BINDING SITE is HOST TARGET binding site found in the 5' untranslated region of mRNA encoded by LOC255654, corresponding to a HOST TARGET binding site such as BINDING SITE I, BINDING SITE II or BINDING SITE III. Table 2 illustrates the complementarity of the nucleotide sequences of LOC255654 BINDING SITE, designated SEQ ID:46302, to the nucleotide sequence of VGAM1669 RNA, herein designated VGAM RNA, also designated SEQ ID:4380.

Another function of VGAM1669 is therefore inhibition of LOC255654 (Accession XM_173036). Accordingly, utilities of VGAM1669 include diagnosis, prevention and treatment of diseases and clinical conditions associated with LOC255654. FIG. 1 further provides a conceptual description of a novel bioinformatically detected viral gene of the present invention, referred to here as Viral Genomic Address Messenger 1670 (VGAM1670) viral gene, which modulates expression of respective host target genes thereof, the function and utility of which host target genes is known in the art.

VGAM1670 is a novel bioinformatically detected regulatory, non protein coding, viral micro RNA (miRNA) gene. The method by which VGAM1670 was detected is described hereinabove with reference to FIGS. 1-8.

VGAM1670 gene, herein designated VGAM GENE, is a viral gene contained in the genome of Human Adenovirus D. VGAM1670 host target gene, herein designated VGAM HOST TARGET GENE, is a human gene contained in the human genome.

VGAM1670 gene encodes a VGAM1670 precursor RNA, herein designated VGAM PRECURSOR RNA. Similar to other miRNA genes, and unlike most ordinary genes, VGAM1670 precursor RNA does not encode a protein. A nucleotide sequence identical or highly similar to the nucleotide sequence of VGAM1670 precursor RNA is designated SEQ ID:1656, and is provided hereinbelow with reference to the sequence listing part. Nucleotide sequence SEQ ID:1656 is located at position 16692 relative to the genome of Human Adenovirus D.

VGAM1670 precursor RNA folds onto itself, forming VGAM1670 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1670 folded precursor RNA into VGAM1670 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1670 RNA is designated SEQ ID:4381, and is provided hereinbelow with reference to the sequence listing part.

VGAM1670 host target gene, herein designated VGAM HOST TARGET GENE, encodes a corresponding messenger RNA, VGAM1670 host target RNA, herein designated VGAM HOST TARGET RNA. VGAM1670 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1670 RNA, herein designated VGAM RNA, binds complementarily to one or more host target binding sites located in untranslated regions of VGAM1670 host target RNA, herein designated VGAM HOST TARGET RNA. This complementary binding is due to the fact that the nucleotide sequence of VGAM1670 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1670 RNA, herein designated VGAM RNA, may have a different number of host target binding sites in untranslated regions of a VGAM1670 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1670 RNA, herein designated VGAM RNA, to host target binding sites on VGAM1670 host target RNA, herein designated VGAM HOST TARGET RNA, such as BINDING SITE I, BINDING SITE II and BINDING SITE III, inhibits translation of VGAM1670 host target RNA into VGAM1670 host target protein, herein designated VGAM HOST TARGET PROTEIN. VGAM host target protein is therefore outlined by a broken line.

It is appreciated that VGAM1670 host target gene, herein designated VGAM HOST TARGET GENE, in fact represents a plurality of VGAM1670 host target genes. The mRNA of each one of this plurality of VGAM1670 host target genes comprises one or more host target binding sites, each having a nucleotide sequence which is at least partly complementary to VGAM1670 RNA, herein designated VGAM RNA, and which when bound by VGAM1670 RNA causes inhibition of translation of respective one or more VGAM1670 host target proteins.

It is further appreciated by one skilled in the art that the mode of translational inhibition illustrated by FIG. 1 with specific reference to translational inhibition exerted by VGAM1670 gene, herein designated VGAM GENE, on one or more VGAM1670 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1670 is inhibition of expression of host target genes, as part of a novel viral mechanism of attacking a host. Accordingly, utilities of VGAM1670 include diagnosis, prevention and treatment of viral infection by Human Adenovirus D. Specific functions, and accordingly utilities, of VGAM1670 correlate with, and may be deduced from, the identity of the host target genes which VGAM1670 binds and inhibits, and the function of these host target genes, as elaborated hereinbelow.

Nucleotide sequences of the VGAM1670 precursor RNA, herein designated VGAM PRECURSOR RNA, and of the 'diced' VGAM1670 RNA, herein designated VGAM RNA, and a schematic representation of the secondary folding of VGAM1670 folded precursor RNA, herein designated VGAM FOLDED PRECURSOR RNA, of VGAM1670 are further described hereinbelow with reference to Table 1.

Nucleotide sequences of host target binding sites, such as BINDING SITE-I, BINDING SITE-II and BINDING SITE-III of FIG. 1, found on VGAM1670 host target RNA, and schematic representation of the complementarity of each of these host target binding sites to VGAM1670 RNA, herein designated VGAM RNA, are described hereinbelow with reference to Table 2.

As mentioned hereinabove with reference to FIG. 1, a function of VGAM1670 gene, herein designated VGAM is inhibition of expression of VGAM1670 target genes. It is appreciated that specific functions, and accordingly utilities, of VGAM1670 correlate with, and may be deduced from, the identity of the target genes which VGAM1670 binds and inhibits, and the function of these target genes, as elaborated hereinbelow.

A Disintegrin and Metalloproteinase Domain 19 (meltrin beta) (ADAM19, Accession NM_033274) is a VGAM1670 host target gene. ADAM19 BINDING SITE is HOST TARGET binding site found in the 3' untranslated region of mRNA encoded by ADAM19, corresponding to a HOST TARGET binding site such as BINDING SITE I, BINDING SITE II or BINDING SITE III. Table 2 illustrates the complementarity of the nucleotide sequences of ADAM19 BINDING SITE, designated SEQ ID:27095, to the nucleotide sequence of VGAM1670 RNA, herein designated VGAM RNA, also designated SEQ ID:4381.

A function of VGAM1670 is therefore inhibition of A Disintegrin and Metalloproteinase Domain 19 (meltrin beta) (ADAM19, Accession NM_033274), a gene which participates in the proteolytic processing of beta-type neuregulin isoforms. Accordingly, utilities of VGAM1670 include diagnosis, prevention and treatment of diseases and clinical conditions associated with ADAM19. The function of ADAM19 and its association with various diseases and clinical conditions, has been established by previous studies, as described hereinabove with reference to VGAM179. Adaptor-related Protein Complex 2, Beta 1 Subunit (AP2B1, Accession NM_001282) is another VGAM1670 host target gene. AP2B1 BINDING SITE is HOST TARGET binding site found in the 3' untranslated region of mRNA encoded by AP2B1, corresponding to a HOST TARGET binding site such as BINDING SITE I, BINDING SITE II or BINDING SITE III. Table 2 illustrates the complementarity of the nucleotide sequences of AP2B1 BINDING SITE, designated SEQ ID:6953, to the nucleotide sequence of VGAM1670 RNA, herein designated VGAM RNA, also designated SEQ ID:4381.

Another function of VGAM1670 is therefore inhibition of Adaptor-related Protein Complex 2, Beta 1 Subunit (AP2B1, Accession NM_001282), a gene which links clathrin to receptors in coated vesicles. Accordingly, utilities of VGAM1670 include diagnosis, prevention and treatment of diseases and clinical conditions associated with AP2B1. The function of AP2B1 and its association with various diseases and clinical conditions, has been established by previous studies, as described hereinabove with reference to VGAM1126. Bone Morphogenetic Protein Receptor, Type II (serine/threonine kinase) (BMPR2, Accession NM_001204) is another VGAM1670 host target gene. BMPR2 BINDING SITE is HOST TARGET binding site found in the 5' untranslated region of mRNA encoded by BMPR2, corresponding to a HOST TARGET binding site such as BINDING SITE I, BINDING SITE II or BINDING SITE III. Table 2 illustrates the complementarity of the nucleotide sequences of BMPR2 BINDING SITE, designated SEQ ID:6869, to the nucleotide sequence of VGAM1670 RNA, herein designated VGAM RNA, also designated SEQ ID:4381.

Another function of VGAM1670 is therefore inhibition of Bone Morphogenetic Protein Receptor, Type II (serine/threonine kinase) (BMPR2, Accession NM_001204). Accordingly, utilities of VGAM1670 include diagnosis, prevention and treatment of diseases and clinical conditions associated with BMPR2. Cytochrome P450, Subfamily IVF, Polypeptide 3 (leukotriene B4 omega hydroxylase) (CYP4F3, Accession NM_000896) is another VGAM1670 host target gene. CYP4F3 BINDING SITE is HOST TARGET binding site found in the 3' untranslated region of mRNA encoded by CYP4F3, corresponding to a HOST TARGET binding site such as BINDING SITE I, BINDING SITE II or BINDING SITE III. Table 2 illustrates the complementarity of the nucleotide sequences of CYP4F3 BINDING SITE, designated SEQ ID:6592, to the nucleotide sequence of VGAM1670 RNA, herein designated VGAM RNA, also designated SEQ ID:4381.

Another function of VGAM1670 is therefore inhibition of Cytochrome P450, Subfamily IVF, Polypeptide 3 (leukotriene B4 omega hydroxylase) (CYP4F3, Accession NM_000896), a gene which converts leukotriene B4 into the less active 20-hydroxy-leukotriene B4. Accordingly, utilities of VGAM1670 include diagnosis, prevention and treatment of diseases and clinical conditions associated with CYP4F3. The function of CYP4F3 and its association with various diseases and clinical conditions, has been established by previous studies, as described hereinabove with reference to VGAM186. Exostoses (multiple)-like 1 (EXTL1, Accession NM_004455) is another VGAM1670 host target gene. EXTL1 BINDING SITE is HOST TARGET binding site found in the 5' untranslated region of mRNA encoded by EXTL1, corresponding to a HOST TARGET binding site such as BINDING SITE I, BINDING SITE II or BINDING SITE III. Table 2 illustrates the complementarity of the nucleotide sequences of EXTL1 BINDING SITE, designated SEQ ID:10752, to the nucleotide sequence of VGAM1670 RNA, herein designated VGAM RNA, also designated SEQ ID:4381.

Another function of VGAM1670 is therefore inhibition of Exostoses (multiple)-like 1 (EXTL1, Accession NM_004455), a gene which probably contribute to the synthesis of heparan sulfate and heparin. Accordingly, utilities of VGAM1670 include diagnosis, prevention and treatment of diseases and clinical conditions associated with EXTL1. The function of EXTL1 and its association with various diseases and clinical conditions, has been established by previous studies, as described hereinabove with reference to VGAM806. Interleukin 1 Family, Member 5 (delta) (IL1F5, Accession NM_012275) is another VGAM1670 host target gene. IL1F5 BINDING SITE is HOST TARGET binding site found in the 3' untranslated region of mRNA encoded by IL1F5, corresponding to a HOST TARGET binding site such as BINDING SITE I, BINDING SITE II or BINDING SITE III. Table 2 illustrates the complementarity of the nucleotide sequences of IL1F5 BINDING SITE, designated SEQ ID:14598, to the nucleotide sequence of VGAM1670 RNA, herein designated VGAM RNA, also designated SEQ ID:4381.

Another function of VGAM1670 is therefore inhibition of Interleukin 1 Family, Member 5 (delta) (IL1F5, Accession NM_012275), a gene which is a novel interleukin-1 receptor antagonist gene. Accordingly, utilities of VGAM1670 include diagnosis, prevention and treatment of diseases and clinical conditions associated with IL1F5. The function of IL1F5 and its association with various diseases and clinical conditions, has been established by previous studies, as described hereinabove with reference to VGAM263. Oligophrenin 1 (OPHN1, Accession NM_002547) is another VGAM1670 host target gene. OPHN1 BINDING SITE is HOST TARGET binding site found in the 3' untranslated region of mRNA encoded by OPHN1, corresponding to a HOST TARGET binding site such as BINDING SITE I, BINDING SITE II or BINDING SITE III. Table 2 illustrates the complementarity of the nucleotide sequences of OPHN1

BINDING SITE, designated SEQ ID:8402, to the nucleotide sequence of VGAM1670 RNA, herein designated VGAM RNA, also designated SEQ ID:4381.

Another function of VGAM1670 is therefore inhibition of Oligophrenin 1 (OPHN1, Accession NM_002547). Accordingly, utilities of VGAM1670 include diagnosis, prevention and treatment of diseases and clinical conditions associated with OPHN1. Periaxin (PRX, Accession NM_020956) is another VGAM1670 host target gene. PRX BINDING SITE is HOST TARGET binding site found in the 3' untranslated region of mRNA encoded by PRX, corresponding to a HOST TARGET binding site such as BINDING SITE I, BINDING SITE II or BINDING SITE III. Table 2 illustrates the complementarity of the nucleotide sequences of PRX BINDING SITE, designated SEQ ID:21934, to the nucleotide sequence of VGAM1670 RNA, herein designated VGAM RNA, also designated SEQ ID:4381.

Another function of VGAM1670 is therefore inhibition of Periaxin (PRX, Accession NM_020956), a gene which seems to be required for maintenance of peripheral nerve myelin sheath. may have a role in axon-glial interactions, possibly by interacting with the cytoplasmic domains of integral membrane proteins such as myelin-associated glycoprotein in the periaxonal regions of the schwann cell plasma membrane. may have a role in the early phases of myelin deposition. Accordingly, utilities of VGAM1670 include diagnosis, prevention and treatment of diseases and clinical conditions associated with PRX. The function of PRX and its association with various diseases and clinical conditions, has been established by previous studies, as described hereinabove with reference to VGAM476. Zinc Finger Protein 192 (ZNF192, Accession NM_006298) is another VGAM1670 host target gene. ZNF192 BINDING SITE is HOST TARGET binding site found in the 3' untranslated region of mRNA encoded by ZNF192, corresponding to a HOST TARGET binding site such as BINDING SITE I, BINDING SITE II or BINDING SITE III. Table 2 illustrates the complementarity of the nucleotide sequences of ZNF192 BINDING SITE, designated SEQ ID:12990, to the nucleotide sequence of VGAM1670 RNA, herein designated VGAM RNA, also designated SEQ ID:4381.

Another function of VGAM1670 is therefore inhibition of Zinc Finger Protein 192 (ZNF192, Accession NM_006298). Accordingly, utilities of VGAM1670 include diagnosis, prevention and treatment of diseases and clinical conditions associated with ZNF192. H-L(3)MBT (Accession NM_015478) is another VGAM1670 host target gene. H-L(3)MBT BINDING SITE is HOST TARGET binding site found in the 3' untranslated region of mRNA encoded by H-L(3)MBT, corresponding to a HOST TARGET binding site such as BINDING SITE I, BINDING SITE II or BINDING SITE III. Table 2 illustrates the complementarity of the nucleotide sequences of H-L(3)MBT BINDING SITE, designated SEQ ID:17755, to the nucleotide sequence of VGAM1670 RNA, herein designated VGAM RNA, also designated SEQ ID:4381.

Another function of VGAM1670 is therefore inhibition of H-L(3)MBT (Accession NM_015478). Accordingly, utilities of VGAM1670 include diagnosis, prevention and treatment of diseases and clinical conditions associated with H-L(3) MBT. KIAA1456 (Accession XM_040100) is another VGAM1670 host target gene. KIAA1456 BINDING SITE is HOST TARGET binding site found in the 3' untranslated region of mRNA encoded by KIAA1456, corresponding to a HOST TARGET binding site such as BINDING SITE I, BINDING SITE II or BINDING SITE III. Table 2 illustrates the complementarity of the nucleotide sequences of KIAA1456 BINDING SITE, designated SEQ ID:33264, to the nucleotide sequence of VGAM1670 RNA, herein designated VGAM RNA, also designated SEQ ID:4381.

Another function of VGAM1670 is therefore inhibition of KIAA1456 (Accession XM_040100). Accordingly, utilities of VGAM1670 include diagnosis, prevention and treatment of diseases and clinical conditions associated with KIAA1456. SZF1 (Accession NM_016089) is another VGAM1670 host target gene. SZF1 BINDING SITE is HOST TARGET binding site found in the 5' untranslated region of mRNA encoded by SZF1, corresponding to a HOST TARGET binding site such as BINDING SITE I, BINDING SITE II or BINDING SITE III. Table 2 illustrates the complementarity of the nucleotide sequences of SZF1 BINDING SITE, designated SEQ ID:18175, to the nucleotide sequence of VGAM1670 RNA, herein designated VGAM RNA, also designated SEQ ID:4381.

Another function of VGAM1670 is therefore inhibition of SZF1 (Accession NM_016089). Accordingly, utilities of VGAM1670 include diagnosis, prevention and treatment of diseases and clinical conditions associated with SZF1. LOC146243 (Accession XM_096956) is another VGAM1670 host target gene. LOC146243 BINDING SITE is HOST TARGET binding site found in the 3' untranslated region of mRNA encoded by LOC146243, corresponding to a HOST TARGET binding site such as BINDING SITE I, BINDING SITE II or BINDING SITE III. Table 2 illustrates the complementarity of the nucleotide sequences of LOC146243 BINDING SITE, designated SEQ ID:40679, to the nucleotide sequence of VGAM1670 RNA, herein designated VGAM RNA, also designated SEQ ID:4381.

Another function of VGAM1670 is therefore inhibition of LOC146243 (Accession XM_096956). Accordingly, utilities of VGAM1670 include diagnosis, prevention and treatment of diseases and clinical conditions associated with LOC146243. LOC257117 (Accession XM_171238) is another VGAM1670 host target gene. LOC257117 BINDING SITE is HOST TARGET binding site found in the 5' untranslated region of mRNA encoded by LOC257117, corresponding to a HOST TARGET binding site such as BINDING SITE I, BINDING SITE II or BINDING SITE III. Table 2 illustrates the complementarity of the nucleotide sequences of LOC257117 BINDING SITE, designated SEQ ID:46025, to the nucleotide sequence of VGAM1670 RNA, herein designated VGAM RNA, also designated SEQ ID:4381.

Another function of VGAM1670 is therefore inhibition of LOC257117 (Accession XM_171238). Accordingly, utilities of VGAM1670 include diagnosis, prevention and treatment of diseases and clinical conditions associated with LOC257117. FIG. 1 further provides a conceptual description of a novel bioinformatically detected viral gene of the present invention, referred to here as Viral Genomic Address Messenger 1671 (VGAM1671) viral gene, which modulates expression of respective host target genes thereof, the function and utility of which host target genes is known in the art.

VGAM1671 is a novel bioinformatically detected regulatory, non protein coding, viral micro RNA (miRNA) gene. The method by which VGAM1671 was detected is described hereinabove with reference to FIGS. 1-8.

VGAM1671 gene, herein designated VGAM GENE, is a viral gene contained in the genome of Human Adenovirus D. VGAM1671 host target gene, herein designated VGAM HOST TARGET GENE, is a human gene contained in the human genome.

VGAM1671 gene encodes a VGAM1671 precursor RNA, herein designated VGAM PRECURSOR RNA. Similar to other miRNA genes, and unlike most ordinary genes, VGAM1671 precursor RNA does not encode a protein. A nucleotide sequence identical or highly similar to the nucleotide sequence of VGAM1671 precursor RNA is designated SEQ ID:1657, and is provided hereinbelow with reference to the sequence listing part. Nucleotide sequence SEQ ID:1657 is located at position 13911 relative to the genome of Human Adenovirus D.

VGAM1671 precursor RNA folds onto itself, forming VGAM1671 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1671 folded precursor RNA into VGAM1671 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1671 RNA is designated SEQ ID:4382, and is provided hereinbelow with reference to the sequence listing part.

VGAM1671 host target gene, herein designated VGAM HOST TARGET GENE, encodes a corresponding messenger RNA, VGAM1671 host target RNA, herein designated VGAM HOST TARGET RNA. VGAM1671 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1671 RNA, herein designated VGAM RNA, binds complementarily to one or more host target binding sites located in untranslated regions of VGAM1671 host target RNA, herein designated VGAM HOST TARGET RNA. This complementary binding is due to the fact that the nucleotide sequence of VGAM1671 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1671 RNA, herein designated VGAM RNA, may have a different number of host target binding sites in untranslated regions of a VGAM1671 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1671 RNA, herein designated VGAM RNA, to host target binding sites on VGAM1671 host target RNA, herein designated VGAM HOST TARGET RNA, such as BINDING SITE I, BINDING SITE II and BINDING SITE III, inhibits translation of VGAM1671 host target RNA into VGAM1671 host target protein, herein designated VGAM HOST TARGET PROTEIN. VGAM host target protein is therefore outlined by a broken line.

It is appreciated that VGAM1671 host target gene, herein designated VGAM HOST TARGET GENE, in fact represents a plurality of VGAM1671 host target genes. The mRNA of each one of this plurality of VGAM1671 host target genes comprises one or more host target binding sites, each having a nucleotide sequence which is at least partly complementary to VGAM1671 RNA, herein designated VGAM RNA, and which when bound by VGAM1671 RNA causes inhibition of translation of respective one or more VGAM1671 host target proteins.

It is further appreciated by one skilled in the art that the mode of translational inhibition illustrated by FIG. 1 with specific reference to translational inhibition exerted by VGAM1671 gene, herein designated VGAM GENE, on one or more VGAM1671 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1671 is inhibition of expression of host target genes, as part of a novel viral mechanism of attacking a host. Accordingly, utilities of VGAM1671 include diagnosis, prevention and treatment of viral infection by Human Adenovirus D. Specific functions, and accordingly utilities, of VGAM1671 correlate with, and may be deduced from, the identity of the host target genes which VGAM1671 binds and inhibits, and the function of these host target genes, as elaborated hereinbelow.

Nucleotide sequences of the VGAM1671 precursor RNA, herein designated VGAM PRECURSOR RNA, and of the 'diced' VGAM1671 RNA, herein designated VGAM RNA, and a schematic representation of the secondary folding of VGAM1671 folded precursor RNA, herein designated VGAM FOLDED PRECURSOR RNA, of VGAM1671 are further described hereinbelow with reference to Table 1.

Nucleotide sequences of host target binding sites, such as BINDING SITE-I, BINDING SITE-II and BINDING SITE-III of FIG. 1, found on VGAM1671 host target RNA, and schematic representation of the complementarity of each of these host target binding sites to VGAM1671 RNA, herein designated VGAM RNA, are described hereinbelow with reference to Table 2.

As mentioned hereinabove with reference to FIG. 1, a function of VGAM1671 gene, herein designated VGAM is inhibition of expression of VGAM1671 target genes. It is appreciated that specific functions, and accordingly utilities, of VGAM1671 correlate with, and may be deduced from, the identity of the target genes which VGAM1671 binds and inhibits, and the function of these target genes, as elaborated hereinbelow.

CRACC (Accession NM_021181) is a VGAM1671 host target gene. CRACC BINDING SITE is HOST TARGET binding site found in the 3' untranslated region of mRNA encoded by CRACC, corresponding to a HOST TARGET binding site such as BINDING SITE I, BINDING SITE II or BINDING SITE III. Table 2 illustrates the complementarity of the nucleotide sequences of CRACC BINDING SITE, designated SEQ ID:22157, to the nucleotide sequence of VGAM1671 RNA, herein designated VGAM RNA, also designated SEQ ID:4382.

A function of VGAM1671 is therefore inhibition of CRACC (Accession NM_021181), a gene which may participate in adhesion reactions between t lymphocytes and accessory cells. Accordingly, utilities of VGAM1671 include diagnosis, prevention and treatment of diseases and clinical conditions associated with CRACC. The function of CRACC and its association with various diseases and clinical conditions, has been established by previous studies, as described hereinabove with reference to VGAM26. DEAD/H (Asp-Glu-Ala-Asp/His) Box Polypeptide 11 (CHL1-like helicase homolog, S. cerevisiae) (DDX11, Accession NM_030655) is another VGAM1671 host target gene. DDX11 BINDING SITE is HOST TARGET binding site found in the 3' untranslated region of mRNA encoded by DDX11, corresponding to a HOST TARGET binding site such as BINDING SITE I, BINDING SITE II or BINDING SITE III. Table 2 illustrates the complementarity of the nucleotide sequences of DDX11 BINDING SITE, designated SEQ ID:24987, to the nucleotide sequence of VGAM1671 RNA, herein designated VGAM RNA, also designated SEQ ID:4382.

Another function of VGAM1671 is therefore inhibition of DEAD/H (Asp-Glu-Ala-Asp/His) Box Polypeptide 11 (CHL1-like helicase homolog, S. cerevisiae) (DDX11, Accession NM_030655), a gene which could be an ATP-dependent DNA-binding helicase and may intervene in cell cycle regulation. Accordingly, utilities of VGAM1671 include diagnosis, prevention and treatment of diseases and clinical conditions associated with DDX11. The function of DDX11 and its association with various diseases and clinical conditions, has been established by previous studies, as described hereinabove with reference to VGAM1533. 24-dehydrocholesterol Reductase (DHCR24, Accession NM_014762) is another VGAM1671 host target gene. DHCR24 BINDING SITE is HOST TARGET binding site found in the 3' untranslated region of mRNA encoded by DHCR24, corresponding to a HOST TARGET binding site such as BINDING SITE I, BINDING SITE II or BINDING SITE III. Table 2 illustrates the complementarity of the nucleotide sequences of DHCR24 BINDING SITE, designated SEQ ID:16524, to the nucleotide sequence of VGAM1671 RNA, herein designated VGAM RNA, also designated SEQ ID:4382.

Another function of VGAM1671 is therefore inhibition of 24-dehydrocholesterol Reductase (DHCR24, Accession NM_014762), a gene which catalyzes the reduction of sterol intermediates. Accordingly, utilities of VGAM1671 include diagnosis, prevention and treatment of diseases and clinical conditions associated with DHCR24. The function of DHCR24 and its association with various diseases and clinical conditions, has been established by previous studies, as described hereinabove with reference to VGAM235. Dystrophia Myotonica-protein Kinase (DMPK, Accession NM_004409) is another VGAM1671 host target gene. DMPK BINDING SITE is HOST TARGET binding site found in the 5' untranslated region of mRNA encoded by DMPK, corresponding to a HOST TARGET binding site such as BINDING SITE I, BINDING SITE II or BINDING SITE III. Table 2 illustrates the complementarity of the nucleotide sequences of DMPK BINDING SITE, designated SEQ ID:10668, to the nucleotide sequence of VGAM1671 RNA, herein designated VGAM RNA, also designated SEQ ID:4382.

Another function of VGAM1671 is therefore inhibition of Dystrophia Myotonica-protein Kinase (DMPK, Accession NM_004409). Accordingly, utilities of VGAM1671 include diagnosis, prevention and treatment of diseases and clinical conditions associated with DMPK. Dual Specificity Phosphatase 4 (DUSP4, Accession NM_057158) is another VGAM1671 host target gene. DUSP4 BINDING SITE is HOST TARGET binding site found in the 5' untranslated region of mRNA encoded by DUSP4, corresponding to a HOST TARGET binding site such as BINDING SITE I, BINDING SITE II or BINDING SITE III. Table 2 illustrates the complementarity of the nucleotide sequences of DUSP4 BINDING SITE, designated SEQ ID:27668, to the nucleotide sequence of VGAM1671 RNA, herein designated VGAM RNA, also designated SEQ ID:4382.

Another function of VGAM1671 is therefore inhibition of Dual Specificity Phosphatase 4 (DUSP4, Accession NM_057158), a gene which regulates mitogenic signal transduction. Accordingly, utilities of VGAM1671 include diagnosis, prevention and treatment of diseases and clinical conditions associated with DUSP4. The function of DUSP4 and its association with various diseases and clinical conditions, has been established by previous studies, as described hereinabove with reference to VGAM110. GASC1 (Accession XM_034624) is another VGAM1671 host target gene. GASC1 BINDING SITE is HOST TARGET binding site found in the 3' untranslated region of mRNA encoded by GASC1, corresponding to a HOST TARGET binding site such as BINDING SITE I, BINDING SITE II or BINDING SITE III. Table 2 illustrates the complementarity of the nucleotide sequences of GASC1 BINDING SITE, designated SEQ ID:32125, to the nucleotide sequence of VGAM1671 RNA, herein designated VGAM RNA, also designated SEQ ID:4382.

Another function of VGAM1671 is therefore inhibition of GASC1 (Accession XM_034624), a gene which may play an important role in the development and/or progression of various types of cancer. Accordingly, utilities of VGAM1671 include diagnosis, prevention and treatment of diseases and clinical conditions associated with GASC1. The function of GASC1 has been established by previous studies. Frequent amplification of DNA copy number at chromosome 9p24-p23 has been demonstrated in cell lines derived from esophageal squamous cell carcinomas (Yang et al., 2000). Yang et al. (2000) used fluorescence in situ hybridization and Southern blot analysis to map the 9p24-p23 amplicon. They then screened target genes/transcripts present within this amplicon by Northern blot analysis. With this strategy, they cloned a novel gene, which they designated 'gene amplified in squamous cell carcinoma-1' (GASC1), that was amplified and overexpressed in several cell lines. The deduced 1,056-amino acid GASC1 protein contains 2 PHD finger motifs and a PX domain. PHD finger motifs are zinc finger-like sequences found in nuclear proteins that participate in chromatin-mediated transcriptional regulation and are present in a number of proto-oncogenes. Yang et al. (2000) suggested that overexpression of GASC1 may play an important role in the development and/or progression of various types of cancer, including esophageal squamous cell carcinoma. Nagase et al. (1998) mapped the GASC1 gene, which they designated KIAA0780, to chromosome 9 by radiation hybrid analysis.

Full details of the abovementioned studies are described in the following publications, the disclosure of which are hereby incorporated by reference:

Nagase, T.; Ishikawa, K.; Suyama, M.; Kikuno, R.; Miyajima, N.; Tanaka, A.; Kotani, H.; Nomura, N.; Ohara, O.: Prediction of the coding sequences of unidentified human genes. XI. The complete sequences of 100 new cDNA clones from brain which code for large proteins in vitro. DNA Res. 5:277-286, 1998; and Yang, Z.-Q.; Imoto, I.; Fukuda, Y.; Pimkhaokham, A.; Shimada, Y.; Imamura, M.; Sugano, S.; Nakamura, Y.; Inazawa, J.: Identification of a novel gene, GASC1, within an amplicon at 9p23.

Further studies establishing the function and utilities of GASC1 are found in John Hopkins OMIM database record ID 605469, and in sited publications numbered 7048 listed in the bibliography section hereinbelow, which are also hereby incorporated by reference. LIM Domain Only 2 (rhombotin-like 1) (LMO2, Accession NM_005574) is another VGAM1671 host target gene. LMO2 BINDING SITE is HOST TARGET binding site found in the 5' untranslated region of mRNA encoded by LMO2, corresponding to a HOST TARGET binding site such as BINDING SITE I, BINDING SITE II or BINDING SITE III. Table 2 illustrates the complementarity of the nucleotide sequences of LMO2 BINDING SITE, designated SEQ ID:12100, to the nucleotide sequence of VGAM1671 RNA, herein designated VGAM RNA, also designated SEQ ID:4382.

Another function of VGAM1671 is therefore inhibition of LIM Domain Only 2 (rhombotin-like 1) (LMO2, Accession NM_005574). Accordingly, utilities of VGAM1671 include diagnosis, prevention and treatment of diseases and clinical conditions associated with LMO2. Leucine-zipper-like Transcriptional Regulator, 1 (LZTR1, Accession NM_006767) is another VGAM1671 host target gene. LZTR1 BINDING SITE is HOST TARGET binding site found in the 3' untranslated region of mRNA encoded by LZTR1, corresponding to a HOST TARGET binding site such as BINDING SITE I, BINDING SITE II or BINDING SITE III. Table 2 illustrates the complementarity of the nucleotide sequences of LZTR1 BINDING SITE, designated SEQ ID:13641, to the nucleotide sequence of VGAM1671 RNA, herein designated VGAM RNA, also designated SEQ ID:4382.

Another function of VGAM1671 is therefore inhibition of Leucine-zipper-like Transcriptional Regulator, 1 (LZTR1, Accession NM_006767). Accordingly, utilities of VGAM1671 include diagnosis, prevention and treatment of diseases and clinical conditions associated with LZTR1. Mucin 4, Tracheobronchial (MUC4, Accession NM_138298) is another VGAM1671 host target gene. MUC4 BINDING SITE is HOST TARGET binding site found in the 3' untranslated region of mRNA encoded by MUC4, corresponding to a HOST TARGET binding site such as BINDING SITE I, BINDING SITE II or BINDING SITE III. Table 2 illustrates the complementarity of the nucleotide sequences of MUC4 BINDING SITE, designated SEQ ID:28709, to the nucleotide sequence of VGAM1671 RNA, herein designated VGAM RNA, also designated SEQ ID:4382.

Another function of VGAM1671 is therefore inhibition of Mucin 4, Tracheobronchial (MUC4, Accession NM_138298), a gene which may act as a ligand for ErbB2 mediated cell signalling. Accordingly, utilities of VGAM1671 include diagnosis, prevention and treatment of diseases and clinical conditions associated with MUC4. The function of MUC4 and its association with various diseases and clinical conditions, has been established by previous studies, as described hereinabove with reference to VGAM1290. P21/Cdc42/Rac1-activated Kinase 1 (STE20 homolog, yeast) (PAK1, Accession NM_002576) is another VGAM1671 host target gene. PAK1 BINDING SITE is HOST TARGET binding site found in the 5' untranslated region of mRNA encoded by PAK1, corresponding to a HOST TARGET binding site such as BINDING SITE I, BINDING SITE II or BINDING SITE III. Table 2 illustrates the complementarity of the nucleotide sequences of PAK1 BINDING SITE, designated SEQ ID:8434, to the nucleotide sequence of VGAM1671 RNA, herein designated VGAM RNA, also designated SEQ ID:4382.

Another function of VGAM1671 is therefore inhibition of P21/Cdc42/Rac1-activated Kinase 1 (STE20 homolog, yeast) (PAK1, Accession NM_002576), a gene which activates the Jun N-terminal kinase MAP kinase pathway. Accordingly, utilities of VGAM1671 include diagnosis, prevention and treatment of diseases and clinical conditions associated with PAK1. The function of PAK1 and its association with various diseases and clinical conditions, has been established by previous studies, as described hereinabove with reference to VGAM1621. RalA Binding Protein 1 (RALBP1, Accession NM_006788) is another VGAM1671 host target gene. RALBP1 BINDING SITE is HOST TARGET binding site found in the 3' untranslated region of mRNA encoded by RALBP1, corresponding to a HOST TARGET binding site such as BINDING SITE I, BINDING SITE II or BINDING SITE III. Table 2 illustrates the complementarity of the nucleotide sequences of RALBP1 BINDING SITE, designated SEQ ID:13666, to the nucleotide sequence of VGAM1671 RNA, herein designated VGAM RNA, also designated SEQ ID:4382.

Another function of VGAM1671 is therefore inhibition of RalA Binding Protein 1 (RALBP1, Accession NM_006788), a gene which plays a role in signal transduction and catalyzes the transport of glutathione conjugates and xenobiotics. Accordingly, utilities of VGAM1671 include diagnosis, prevention and treatment of diseases and clinical conditions associated with RALBP1. The function of RALBP1 and its association with various diseases and clinical conditions, has been established by previous studies, as described hereinabove with reference to VGAM345. Sex Comb On Midleg-like 2 (Drosophila) (SCML2, Accession NM_006089) is another VGAM1671 host target gene. SCML2 BINDING SITE is HOST TARGET binding site found in the 3' untranslated region of mRNA encoded by SCML2, corresponding to a HOST TARGET binding site such as BINDING SITE I, BINDING SITE II or BINDING SITE III. Table 2 illustrates the complementarity of the nucleotide sequences of SCML2 BINDING SITE, designated SEQ ID:12736, to the nucleotide sequence of VGAM1671 RNA, herein designated VGAM RNA, also designated SEQ ID:4382.

Another function of VGAM1671 is therefore inhibition of Sex Comb On Midleg-like 2 (Drosophila) (SCML2, Accession NM_006089). Accordingly, utilities of VGAM1671 include diagnosis, prevention and treatment of diseases and clinical conditions associated with SCML2. SH2 Domain Containing Phosphatase Anchor Protein 1 (SPAP1, Accession NM_030764) is another VGAM1671 host target gene. SPAP1 BINDING SITE is HOST TARGET binding site found in the 3' untranslated region of mRNA encoded by SPAP1, corresponding to a HOST TARGET binding site such as BINDING SITE I, BINDING SITE II or BINDING SITE III. Table 2 illustrates the complementarity of the nucleotide sequences of SPAP1 BINDING SITE, designated SEQ ID:25049, to the nucleotide sequence of VGAM1671 RNA, herein designated VGAM RNA, also designated SEQ ID:4382.

Another function of VGAM1671 is therefore inhibition of SH2 Domain Containing Phosphatase Anchor Protein 1 (SPAP1, Accession NM_030764), a gene which regulation of immunologic function. Accordingly, utilities of VGAM1671 include diagnosis, prevention and treatment of diseases and clinical conditions associated with SPAP1. The function of SPAP1 and its association with various diseases and clinical conditions, has been established by previous studies, as described hereinabove with reference to VGAM672. Chromosome 11 Open Reading Frame 15 (C11orf15, Accession NM_020644) is another VGAM1671 host target gene. C11orf15 BINDING SITE is HOST TARGET binding site found in the 3' untranslated region of mRNA encoded by C11orf15, corresponding to a HOST TARGET binding site such as BINDING SITE I, BINDING SITE II or BINDING SITE III. Table 2 illustrates the complementarity of the nucleotide sequences of C11orf15 BINDING SITE, designated SEQ ID:21807, to the nucleotide sequence of VGAM1671 RNA, herein designated VGAM RNA, also designated SEQ ID:4382.

Another function of VGAM1671 is therefore inhibition of Chromosome 11 Open Reading Frame 15 (C11orf15, Accession NM_020644). Accordingly, utilities of VGAM1671 include diagnosis, prevention and treatment of diseases and clinical conditions associated with C11orf15. Chromosome 21 Open Reading Frame 42 (C21orf42, Accession NM_058184) is another VGAM1671 host target gene. C21orf42 BINDING SITE is HOST TARGET binding site found in the 3' untranslated region of mRNA encoded by C21orf42, corresponding to a HOST TARGET binding site such as BINDING SITE I, BINDING SITE II or BINDING SITE III. Table 2 illustrates the complementarity of the nucleotide sequences of C21orf42 BINDING SITE, designated SEQ ID:27748, to the nucleotide sequence of VGAM1671 RNA, herein designated VGAM RNA, also designated SEQ ID:4382.

Another function of VGAM1671 is therefore inhibition of Chromosome 21 Open Reading Frame 42 (C21orf42, Accession NM_058184). Accordingly, utilities of VGAM1671 include diagnosis, prevention and treatment of diseases and clinical conditions associated with C21orf42. CGG Triplet Repeat Binding Protein 1 (CGGBP1, Accession NM_003663) is another VGAM1671 host target gene. CGGBP1 BINDING SITE is HOST TARGET binding site found in the 5' untranslated region of mRNA encoded by CGGBP1, corresponding to a HOST TARGET binding site such as BINDING SITE I, BINDING SITE II or BINDING SITE III. Table 2 illustrates the complementarity of the nucleotide sequences of CGGBP1 BINDING SITE, designated SEQ ID:9742, to the nucleotide sequence of VGAM1671 RNA, herein designated VGAM RNA, also designated SEQ ID:4382.

Another function of VGAM1671 is therefore inhibition of CGG Triplet Repeat Binding Protein 1 (CGGBP1, Accession NM_003663). Accordingly, utilities of VGAM1671 include diagnosis, prevention and treatment of diseases and clinical conditions associated with CGGBP1. DEAD/H (Asp-Glu-Ala-Asp/His) Box Polypeptide 12 (CHL1-like helicase homolog, S. cerevisiae) (DDX12, Accession XM_006936) is another VGAM1671 host target gene. DDX12 BINDING SITE is HOST TARGET binding site found in the 3' untranslated region of mRNA encoded by DDX12, corresponding to a HOST TARGET binding site such as BINDING SITE I, BINDING SITE II or BINDING SITE III. Table 2 illustrates the complementarity of the nucleotide sequences of DDX12 BINDING SITE, designated SEQ ID:30025, to the nucleotide sequence of VGAM1671 RNA, herein designated VGAM RNA, also designated SEQ ID:4382.

Another function of VGAM1671 is therefore inhibition of DEAD/H (Asp-Glu-Ala-Asp/His) Box Polypeptide 12 (CHL1-like helicase homolog, S. cerevisiae) (DDX12, Accession XM_006936). Accordingly, utilities of VGAM1671 include diagnosis, prevention and treatment of diseases and clinical conditions associated with DDX12. Deiodinase, Iodothyronine, Type II (DIO2, Accession NM_000793) is another VGAM1671 host target gene. DIO2 BINDING SITE1 and DIO2 BINDING SITE2 are HOST TARGET binding sites found in untranslated regions of mRNA encoded by DIO2, corresponding to HOST TARGET binding sites such as BINDING SITE I, BINDING SITE II or BINDING SITE III. Table 2 illustrates the complementarity of the nucleotide sequences of DIO2 BINDING SITE1 and DIO2 BINDING SITE2, designated SEQ ID:6457 and SEQ ID:15168 respectively, to the nucleotide sequence of VGAM1671 RNA, herein designated VGAM RNA, also designated SEQ ID:4382.

Another function of VGAM1671 is therefore inhibition of Deiodinase, Iodothyronine, Type II (DIO2, Accession NM_000793). Accordingly, utilities of VGAM1671 include diagnosis, prevention and treatment of diseases and clinical conditions associated with DIO2. FLJ10761 (Accession NM_018208) is another VGAM1671 host target gene. FLJ10761 BINDING SITE is HOST TARGET binding site found in the 3' untranslated region of mRNA encoded by FLJ10761, corresponding to a HOST TARGET binding site such as BINDING SITE I, BINDING SITE II or BINDING SITE III. Table 2 illustrates the complementarity of the nucleotide sequences of FLJ10761 BINDING SITE, designated SEQ ID:20106, to the nucleotide sequence of VGAM1671 RNA, herein designated VGAM RNA, also designated SEQ ID:4382.

Another function of VGAM1671 is therefore inhibition of FLJ10761 (Accession NM_018208). Accordingly, utilities of VGAM1671 include diagnosis, prevention and treatment of diseases and clinical conditions associated with FLJ10761. FLJ20509 (Accession NM_017851) is another VGAM1671 host target gene. FLJ20509 BINDING SITE is HOST TARGET binding site found in the 3' untranslated region of mRNA encoded by FLJ20509, corresponding to a HOST TARGET binding site such as BINDING SITE I, BINDING SITE II or BINDING SITE III. Table 2 illustrates the complementarity of the nucleotide sequences of FLJ20509 BINDING SITE, designated SEQ ID:19525, to the nucleotide sequence of VGAM1671 RNA, herein designated VGAM RNA, also designated SEQ ID:4382.

Another function of VGAM1671 is therefore inhibition of FLJ20509 (Accession NM_017851). Accordingly, utilities of VGAM1671 include diagnosis, prevention and treatment of diseases and clinical conditions associated with FLJ20509. FYVE and Coiled-coil Domain Containing 1 (FYCO1, Accession NM_024513) is another VGAM1671 host target gene. FYCO1 BINDING SITE is HOST TARGET binding site found in the 3' untranslated region of mRNA encoded by FYCO1, corresponding to a HOST TARGET binding site such as BINDING SITE I, BINDING SITE II or BINDING SITE III. Table 2 illustrates the complementarity of the nucleotide sequences of FYCO1 BINDING SITE, designated SEQ ID:23710, to the nucleotide sequence of VGAM1671 RNA, herein designated VGAM RNA, also designated SEQ ID:4382.

Another function of VGAM1671 is therefore inhibition of FYVE and Coiled-coil Domain Containing 1 (FYCO1, Accession NM_024513). Accordingly, utilities of VGAM1671 include diagnosis, prevention and treatment of diseases and clinical conditions associated with FYCO1. Glycoprotein A33 (transmembrane) (GPA33, Accession NM_005814) is another VGAM1671 host target gene. GPA33 BINDING SITE is HOST TARGET binding site found in the 3' untranslated region of mRNA encoded by GPA33, corresponding to a HOST TARGET binding site such as BINDING SITE I, BINDING SITE II or BINDING SITE III. Table 2 illustrates the complementarity of the nucleotide sequences of GPA33 BINDING SITE, designated SEQ ID:12402, to the nucleotide sequence of VGAM1671 RNA, herein designated VGAM RNA, also designated SEQ ID:4382.

Another function of VGAM1671 is therefore inhibition of Glycoprotein A33 (transmembrane) (GPA33, Accession NM_005814). Accordingly, utilities of VGAM1671 include diagnosis, prevention and treatment of diseases and clinical conditions associated with GPA33. KIAA0258 (Accession NM_014785) is another VGAM1671 host target gene. KIAA0258 BINDING SITE is HOST TARGET binding site found in the 3' untranslated region of mRNA encoded by KIAA0258, corresponding to a HOST TARGET binding site such as BINDING SITE I, BINDING SITE II or BINDING SITE III. Table 2 illustrates the complementarity of the nucleotide sequences of KIAA0258 BINDING SITE, designated SEQ ID:16649, to the nucleotide sequence of VGAM1671 RNA, herein designated VGAM RNA, also designated SEQ ID:4382.

Another function of VGAM1671 is therefore inhibition of KIAA0258 (Accession NM_014785). Accordingly, utilities of VGAM1671 include diagnosis, prevention and treatment of diseases and clinical conditions associated with KIAA0258. KIAA0326 (Accession XM_034819) is another VGAM1671 host target gene. KIAA0326 BINDING SITE is HOST TARGET binding site found in the 3' untranslated region of mRNA encoded by KIAA0326, corresponding to a HOST TARGET binding site such as BINDING SITE I, BINDING SITE II or BINDING SITE III. Table 2 illustrates the complementarity of the nucleotide sequences of KIAA0326 BINDING SITE, designated SEQ ID:32159, to the nucleotide sequence of VGAM1671 RNA, herein designated VGAM RNA, also designated SEQ ID:4382.

Another function of VGAM1671 is therefore inhibition of KIAA0326 (Accession XM_034819). Accordingly, utilities of VGAM1671 include diagnosis, prevention and treatment of diseases and clinical conditions associated with KIAA0326. KIAA0939 (Accession XM_030524) is another VGAM1671 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31068, to the nucleotide sequence of VGAM1671 RNA, herein designated VGAM RNA, also designated SEQ ID:4382.

Another function of VGAM1671 is therefore inhibition of KIAA0939 (Accession XM_030524). Accordingly, utilities of VGAM1671 include diagnosis, prevention and treatment of diseases and clinical conditions associated with KIAA0939. KIAA1853 (Accession XM_045184) is another VGAM1671 host target gene. KIAA1853 BINDING SITE is HOST TARGET binding site found in the 3' untranslated region of mRNA encoded by KIAA1853, corresponding to a HOST TARGET binding site such as BINDING SITE I, BINDING SITE II or BINDING SITE III. Table 2 illustrates the complementarity of the nucleotide sequences of KIAA1853 BINDING SITE, designated SEQ ID:34389, to the nucleotide sequence of VGAM1671 RNA, herein designated VGAM RNA, also designated SEQ ID:4382.

Another function of VGAM1671 is therefore inhibition of KIAA1853 (Accession XM_045184). Accordingly, utilities of VGAM1671 include diagnosis, prevention and treatment of diseases and clinical conditions associated with KIAA1853. MDS028 (Accession NM_018463) is another VGAM1671 host target gene. MDS028 BINDING SITE is HOST TARGET binding site found in the 3' untranslated region of mRNA encoded by MDS028, corresponding to a HOST TARGET binding site such as BINDING SITE I, BINDING SITE II or BINDING SITE III. Table 2 illustrates the complementarity of the nucleotide sequences of MDS028 BINDING SITE, designated SEQ ID:20536, to the nucleotide sequence of VGAM1671 RNA, herein designated VGAM RNA, also designated SEQ ID:4382.

Another function of VGAM1671 is therefore inhibition of MDS028 (Accession NM_018463). Accordingly, utilities of VGAM1671 include diagnosis, prevention and treatment of diseases and clinical conditions associated with MDS028. Mesoderm Development Candidate 2 (MESDC2, Accession XM_051854) is another VGAM1671 host target gene. MESDC2 BINDING SITE is HOST TARGET binding site found in the 3' untranslated region of mRNA encoded by MESDC2, corresponding to a HOST TARGET binding site such as BINDING SITE I, BINDING SITE II or BINDING SITE III. Table 2 illustrates the complementarity of the nucleotide sequences of MESDC2 BINDING SITE, designated SEQ ID:35894, to the nucleotide sequence of VGAM1671 RNA, herein designated VGAM RNA, also designated SEQ ID:4382.

Another function of VGAM1671 is therefore inhibition of Mesoderm Development Candidate 2 (MESDC2, Accession XM_051854). Accordingly, utilities of VGAM1671 include diagnosis, prevention and treatment of diseases and clinical conditions associated with MESDC2. NDRG Family Member 4 (NDRG4, Accession NM_022910) is another VGAM1671 host target gene. NDRG4 BINDING SITE1 and NDRG4 BINDING SITE2 are HOST TARGET binding sites found in untranslated regions of mRNA encoded by NDRG4, corresponding to HOST TARGET binding sites such as BINDING SITE I, BINDING SITE II or BINDING SITE III. Table 2 illustrates the complementarity of the nucleotide sequences of NDRG4 BINDING SITE1 and NDRG4 BINDING SITE2, designated SEQ ID:23216 and SEQ ID:21701 respectively, to the nucleotide sequence of VGAM1671 RNA, herein designated VGAM RNA, also designated SEQ ID:4382.

Another function of VGAM1671 is therefore inhibition of NDRG Family Member 4 (NDRG4, Accession NM_022910). Accordingly, utilities of VGAM1671 include diagnosis, prevention and treatment of diseases and clinical conditions associated with NDRG4. Rho-related BTB Domain Containing 2 (RHOBTB2, Accession XM_027679) is another VGAM1671 host target gene. RHOBTB2 BINDING SITE is HOST TARGET binding site found in the 3' untranslated region of mRNA encoded by RHOBTB2, corresponding to a HOST TARGET binding site such as BINDING SITE I, BINDING SITE II or BINDING SITE III. Table 2 illustrates the complementarity of the nucleotide sequences of RHOBTB2 BINDING SITE, designated SEQ ID:30558, to the nucleotide sequence of VGAM1671 RNA, herein designated VGAM RNA, also designated SEQ ID:4382.

Another function of VGAM1671 is therefore inhibition of Rho-related BTB Domain Containing 2 (RHOBTB2, Accession XM_027679). Accordingly, utilities of VGAM1671 include diagnosis, prevention and treatment of diseases and clinical conditions associated with RHOBTB2. Synaptotagmin-like 4 (granuphilin-a) (SYTL4, Accession NM_080737) is another VGAM1671 host target gene. SYTL4 BINDING SITE is HOST TARGET binding site found in the 5' untranslated region of mRNA encoded by SYTL4, corresponding to a HOST TARGET binding site such as BINDING SITE I, BINDING SITE II or BINDING SITE III. Table 2 illustrates the complementarity of the nucleotide sequences of SYTL4 BINDING SITE, designated SEQ ID:28024, to the nucleotide sequence of VGAM1671 RNA, herein designated VGAM RNA, also designated SEQ ID:4382.

Another function of VGAM1671 is therefore inhibition of Synaptotagmin-like 4 (granuphilin-a) (SYTL4, Accession NM_080737). Accordingly, utilities of VGAM1671 include diagnosis, prevention and treatment of diseases and clinical conditions associated with SYTL4. Tripartite Motif-containing 38 (TRIM38, Accession NM_006355) is another VGAM1671 host target gene. TRIM38 BINDING SITE is HOST TARGET binding site found in the 3' untranslated region of mRNA encoded by TRIM38, corresponding to a HOST TARGET binding site such as BINDING SITE I, BINDING SITE II or BINDING SITE III. Table 2 illustrates the complementarity of the nucleotide sequences of TRIM38 BINDING SITE, designated SEQ ID:13050, to the nucleotide sequence of VGAM1671 RNA, herein designated VGAM RNA, also designated SEQ ID:4382.

Another function of VGAM1671 is therefore inhibition of Tripartite Motif-containing 38 (TRIM38, Accession NM_006355). Accordingly, utilities of VGAM1671 include diagnosis, prevention and treatment of diseases and clinical conditions associated with TRIM38. LOC122970 (Accession XM_058672) is another VGAM1671 host target gene. LOC122970 BINDING SITE is HOST TARGET binding site found in the 3' untranslated region of mRNA encoded by LOC122970, corresponding to a HOST TARGET binding site such as BINDING SITE I, BINDING SITE II or BINDING SITE III. Table 2 illustrates the complementarity of the nucleotide sequences of LOC122970 BINDING SITE, designated SEQ ID:36715, to the nucleotide sequence of VGAM1671 RNA, herein designated VGAM RNA, also designated SEQ ID:4382.

Another function of VGAM1671 is therefore inhibition of LOC122970 (Accession XM_058672). Accordingly, utilities of VGAM1671 include diagnosis, prevention and treatment of diseases and clinical conditions associated with LOC122970. LOC126755 (Accession XM_059074) is another VGAM1671 host target gene. LOC126755 BINDING SITE is HOST TARGET binding site found in the 3' untranslated region of mRNA encoded by LOC126755, corresponding to a HOST TARGET binding site such as BINDING SITE I, BINDING SITE II or BINDING SITE III. Table 2 illustrates the complementarity of the nucleotide sequences of LOC126755 BINDING SITE, designated SEQ ID:36857, to the nucleotide sequence of VGAM1671 RNA, herein designated VGAM RNA, also designated SEQ ID:4382.

Another function of VGAM1671 is therefore inhibition of LOC126755 (Accession XM_059074). Accordingly, utilities of VGAM1671 include diagnosis, prevention and treatment of diseases and clinical conditions associated with LOC126755. LOC126782 (Accession XM_059080) is another VGAM1671 host target gene. LOC126782 BINDING SITE is HOST TARGET binding site found in the 5' untranslated region of mRNA encoded by LOC126782, corresponding to a HOST TARGET binding site such as BINDING SITE I, BINDING SITE II or BINDING SITE III. Table 2 illustrates the complementarity of the nucleotide sequences of LOC126782 BINDING SITE, designated SEQ ID:36860, to the nucleotide sequence of VGAM1671 RNA, herein designated VGAM RNA, also designated SEQ ID:4382.

Another function of VGAM1671 is therefore inhibition of LOC126782 (Accession XM_059080). Accordingly, utilities of VGAM1671 include diagnosis, prevention and treatment of diseases and clinical conditions associated with LOC126782. LOC144742 (Accession XM_084949) is another VGAM1671 host target gene. LOC144742 BINDING SITE is HOST TARGET binding site found in the 5' untranslated region of mRNA encoded by LOC144742, corresponding to a HOST TARGET binding site such as BINDING SITE I, BINDING SITE II or BINDING SITE III. Table 2 illustrates the complementarity of the nucleotide sequences of LOC144742 BINDING SITE, designated SEQ ID:37779, to the nucleotide sequence of VGAM1671 RNA, herein designated VGAM RNA, also designated SEQ ID:4382.

Another function of VGAM1671 is therefore inhibition of LOC144742 (Accession XM_084949). Accordingly, utilities of VGAM1671 include diagnosis, prevention and treatment of diseases and clinical conditions associated with LOC144742. LOC145468 (Accession XM_057874) is another VGAM1671 host target gene. LOC145468 BINDING SITE is HOST TARGET binding site found in the 3' untranslated region of mRNA encoded by LOC145468, corresponding to a HOST TARGET binding site such as BINDING SITE I, BINDING SITE II or BINDING SITE III. Table 2 illustrates the complementarity of the nucleotide sequences of LOC145468 BINDING SITE, designated SEQ ID:36548, to the nucleotide sequence of VGAM1671 RNA, herein designated VGAM RNA, also designated SEQ ID:4382.

Another function of VGAM1671 is therefore inhibition of LOC145468 (Accession XM_057874). Accordingly, utilities of VGAM1671 include diagnosis, prevention and treatment of diseases and clinical conditions associated with LOC145468. LOC150155 (Accession XM_047977) is another VGAM1671 host target gene. LOC150155 BINDING SITE is HOST TARGET binding site found in the 3' untranslated region of mRNA encoded by LOC150155, corresponding to a HOST TARGET binding site such as BINDING SITE I, BINDING SITE II or BINDING SITE III. Table 2 illustrates the complementarity of the nucleotide sequences of LOC150155 BINDING SITE, designated SEQ ID:35089, to the nucleotide sequence of VGAM1671 RNA, herein designated VGAM RNA, also designated SEQ ID:4382.

Another function of VGAM1671 is therefore inhibition of LOC150155 (Accession XM_047977). Accordingly, utilities of VGAM1671 include diagnosis, prevention and treatment of diseases and clinical conditions associated with LOC150155. LOC152503 (Accession XM_098238) is another VGAM1671 host target gene. LOC152503 BINDING SITE is HOST TARGET binding site found in the 5' untranslated region of mRNA encoded by LOC152503, corresponding to a HOST TARGET binding site such as BINDING SITE I, BINDING SITE II or BINDING SITE III. Table 2 illustrates the complementarity of the nucleotide sequences of LOC152503 BINDING SITE, designated SEQ ID:41518, to the nucleotide sequence of VGAM1671 RNA, herein designated VGAM RNA, also designated SEQ ID:4382.

Another function of VGAM1671 is therefore inhibition of LOC152503 (Accession XM_098238). Accordingly, utilities of VGAM1671 include diagnosis, prevention and treatment of diseases and clinical conditions associated with LOC152503. LOC153577 (Accession XM_098394) is another VGAM1671 host target gene. LOC153577 BINDING SITE is HOST TARGET binding site found in the 3' untranslated region of mRNA encoded by LOC153577, corresponding to a HOST TARGET binding site such as BINDING SITE I, BINDING SITE II or BINDING SITE III. Table 2 illustrates the complementarity of the nucleotide sequences of LOC153577 BINDING SITE, designated SEQ ID:41647, to the nucleotide sequence of VGAM1671 RNA, herein designated VGAM RNA, also designated SEQ ID:4382.

Another function of VGAM1671 is therefore inhibition of LOC153577 (Accession XM_098394). Accordingly, utilities of VGAM1671 include diagnosis, prevention and treatment of diseases and clinical conditions associated with LOC153577. LOC154428 (Accession XM_098528) is another VGAM1671 host target gene. LOC154428 BIND- ING SITE is HOST TARGET binding site found in the 5' untranslated region of mRNA encoded by LOC154428, corresponding to a HOST TARGET binding site such as BINDING SITE I, BINDING SITE II or BINDING SITE III. Table 2 illustrates the complementarity of the nucleotide sequences of LOC154428 BINDING SITE, designated SEQ ID:41702, to the nucleotide sequence of VGAM1671 RNA, herein designated VGAM RNA, also designated SEQ ID:4382.

Another function of VGAM1671 is therefore inhibition of LOC154428 (Accession XM_098528). Accordingly, utilities of VGAM1671 include diagnosis, prevention and treatment of diseases and clinical conditions associated with LOC154428. LOC163081 (Accession XM_091987) is another VGAM1671 host target gene. LOC163081 BINDING SITE is HOST TARGET binding site found in the 5' untranslated region of mRNA encoded by LOC163081, corresponding to a HOST TARGET binding site such as BINDING SITE I, BINDING SITE II or BINDING SITE III. Table 2 illustrates the complementarity of the nucleotide sequences of LOC163081 BINDING SITE, designated SEQ ID:40086, to the nucleotide sequence of VGAM1671 RNA, herein designated VGAM RNA, also designated SEQ ID:4382.

Another function of VGAM1671 is therefore inhibition of LOC163081 (Accession XM_091987). Accordingly, utilities of VGAM1671 include diagnosis, prevention and treatment of diseases and clinical conditions associated with LOC163081. LOC196872 (Accession XM_113760) is another VGAM1671 host target gene. LOC196872 BINDING SITE is HOST TARGET binding site found in the 3' untranslated region of mRNA encoded by LOC196872, corresponding to a HOST TARGET binding site such as BINDING SITE I, BINDING SITE II or BINDING SITE III. Table 2 illustrates the complementarity of the nucleotide sequences of LOC196872 BINDING SITE, designated SEQ ID:42418, to the nucleotide sequence of VGAM1671 RNA, herein designated VGAM RNA, also designated SEQ ID:4382.

Another function of VGAM1671 is therefore inhibition of LOC196872 (Accession XM_113760). Accordingly, utilities of VGAM1671 include diagnosis, prevention and treatment of diseases and clinical conditions associated with LOC196872. LOC199232 (Accession XM_114336) is another VGAM1671 host target gene. LOC199232 BINDING SITE is HOST TARGET binding site found in the 5' untranslated region of mRNA encoded by LOC199232, corresponding to a HOST TARGET binding site such as BINDING SITE I, BINDING SITE II or BINDING SITE III. Table 2 illustrates the complementarity of the nucleotide sequences of LOC199232 BINDING SITE, designated SEQ ID:42881, to the nucleotide sequence of VGAM1671 RNA, herein designated VGAM RNA, also designated SEQ ID:4382.

Another function of VGAM1671 is therefore inhibition of LOC199232 (Accession XM_114336). Accordingly, utilities of VGAM1671 include diagnosis, prevention and treatment of diseases and clinical conditions associated with LOC199232. LOC219401 (Accession XM_166706) is another VGAM1671 host target gene. LOC219401 BINDING SITE is HOST TARGET binding site found in the 3' untranslated region of mRNA encoded by LOC219401, corresponding to a HOST TARGET binding site such as BINDING SITE I, BINDING SITE II or BINDING SITE III. Table 2 illustrates the complementarity of the nucleotide sequences of LOC219401 BINDING SITE, designated SEQ ID:44586, to the nucleotide sequence of VGAM1671 RNA, herein designated VGAM RNA, also designated SEQ ID:4382.

Another function of VGAM1671 is therefore inhibition of LOC219401 (Accession XM_166706). Accordingly, utilities of VGAM1671 include diagnosis, prevention and treatment of diseases and clinical conditions associated with LOC219401. LOC221495 (Accession XM_168136) is another VGAM1671 host target gene. LOC221495 BINDING SITE is HOST TARGET binding site found in the 3' untranslated region of mRNA encoded by LOC221495, corresponding to a HOST TARGET binding site such as BINDING SITE I, BINDING SITE II or BINDING SITE III. Table 2 illustrates the complementarity of the nucleotide sequences of LOC221495 BINDING SITE, designated SEQ ID:45058, to the nucleotide sequence of VGAM1671 RNA, herein designated VGAM RNA, also designated SEQ ID:4382.

Another function of VGAM1671 is therefore inhibition of LOC221495 (Accession XM_168136). Accordingly, utilities of VGAM1671 include diagnosis, prevention and treatment of diseases and clinical conditions associated with LOC221495. LOC255565 (Accession XM_170811) is another VGAM1671 host target gene. LOC255565 BINDING SITE is HOST TARGET binding site found in the 3' untranslated region of mRNA encoded by LOC255565, corresponding to a HOST TARGET binding site such as BINDING SITE I, BINDING SITE II or BINDING SITE III. Table 2 illustrates the complementarity of the nucleotide sequences of LOC255565 BINDING SITE, designated SEQ ID:45588, to the nucleotide sequence of VGAM1671 RNA, herein designated VGAM RNA, also designated SEQ ID:4382.

Another function of VGAM1671 is therefore inhibition of LOC255565 (Accession XM_170811). Accordingly, utilities of VGAM1671 include diagnosis, prevention and treatment of diseases and clinical conditions associated with LOC255565. LOC51580 (Accession NM_015874) is another VGAM1671 host target gene. LOC51580 BINDING SITE is HOST TARGET binding site found in the 3' untranslated region of mRNA encoded by LOC51580, corresponding to a HOST TARGET binding site such as BINDING SITE I, BINDING SITE II or BINDING SITE III. Table 2 illustrates the complementarity of the nucleotide sequences of LOC51580 BINDING SITE, designated SEQ ID:18011, to the nucleotide sequence of VGAM1671 RNA, herein designated VGAM RNA, also designated SEQ ID:4382.

Another function of VGAM1671 is therefore inhibition of LOC51580 (Accession NM_015874). Accordingly, utilities of VGAM1671 include diagnosis, prevention and treatment of diseases and clinical conditions associated with LOC51580. LOC90010 (Accession XM_028150) is another VGAM1671 host target gene. LOC90010 BINDING SITE is HOST TARGET binding site found in the 3' untranslated region of mRNA encoded by LOC90010, corresponding to a HOST TARGET binding site such as BINDING SITE I, BINDING SITE II or BINDING SITE III. Table 2 illustrates the complementarity of the nucleotide sequences of LOC90010 BINDING SITE, designated SEQ ID:30621, to the nucleotide sequence of VGAM1671 RNA, herein designated VGAM RNA, also designated SEQ ID:4382.

Another function of VGAM1671 is therefore inhibition of LOC90010 (Accession XM_028150). Accordingly, utilities of VGAM1671 include diagnosis, prevention and treatment of diseases and clinical conditions associated with LOC90010. LOC90249 (Accession XM_030300) is another VGAM1671 host target gene. LOC90249 BINDING SITE is HOST TARGET binding site found in the 3' untranslated region of mRNA encoded by LOC90249, corresponding to a HOST TARGET binding site such as BINDING SITE I, BINDING SITE II or BINDING SITE III. Table 2 illustrates the complementarity of the nucleotide sequences of LOC90249 BINDING SITE, designated SEQ ID:31013, to the nucleotide sequence of VGAM1671 RNA, herein designated VGAM RNA, also designated SEQ ID:4382.

Another function of VGAM1671 is therefore inhibition of LOC90249 (Accession XM_030300). Accordingly, utilities of VGAM1671 include diagnosis, prevention and treatment of diseases and clinical conditions associated with LOC90249. FIG. 1 further provides a conceptual description of a novel bioinformatically detected viral gene of the present invention, referred to here as Viral Genomic Address Messenger 1672 (VGAM1672) viral gene, which modulates expression of respective host target genes thereof, the function and utility of which host target genes is known in the art.

VGAM1672 is a novel bioinformatically detected regulatory, non protein coding, viral micro RNA (miRNA) gene. The method by which VGAM1672 was detected is described hereinabove with reference to FIGS. 1-8.

VGAM1672 gene, herein designated VGAM GENE, is a viral gene contained in the genome of Tick-borne Encephalitis Virus. VGAM1672 host target gene, herein designated VGAM HOST TARGET GENE, is a human gene contained in the human genome.

VGAM1672 gene encodes a VGAM1672 precursor RNA, herein designated VGAM PRECURSOR RNA. Similar to other miRNA genes, and unlike most ordinary genes, VGAM1672 precursor RNA does not encode a protein. A nucleotide sequence identical or highly similar to the nucleotide sequence of VGAM1672 precursor RNA is designated SEQ ID:1658, and is provided hereinbelow with reference to the sequence listing part. Nucleotide sequence SEQ ID:1658 is located at position 9955 relative to the genome of Tick-borne Encephalitis Virus.

VGAM1672 precursor RNA folds onto itself, forming VGAM1672 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1672 folded precursor RNA into VGAM1672 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 89%) nucleotide sequence of VGAM1672 RNA is designated SEQ ID:4383, and is provided hereinbelow with reference to the sequence listing part.

VGAM1672 host target gene, herein designated VGAM HOST TARGET GENE, encodes a corresponding messenger RNA, VGAM1672 host target RNA, herein designated VGAM HOST TARGET RNA. VGAM1672 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1672 RNA, herein designated VGAM RNA, binds complementarily to one or more host target binding sites located in untranslated regions of VGAM1672 host target RNA, herein designated VGAM HOST TARGET RNA. This complementary binding is due to the fact that the nucleotide sequence of VGAM1672 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1672 RNA, herein designated VGAM RNA, may have a different number of host target binding sites in untranslated regions of a VGAM1672 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1672 RNA, herein designated VGAM RNA, to host target binding sites on VGAM1672 host target RNA, herein designated VGAM HOST TARGET RNA, such as BINDING SITE I, BINDING SITE II and BINDING SITE III, inhibits translation of VGAM1672 host target RNA into VGAM1672 host target protein, herein designated VGAM HOST TARGET PROTEIN. VGAM host target protein is therefore outlined by a broken line.

It is appreciated that VGAM1672 host target gene, herein designated VGAM HOST TARGET GENE, in fact represents a plurality of VGAM1672 host target genes. The mRNA of each one of this plurality of VGAM1672 host target genes comprises one or more host target binding sites, each having a nucleotide sequence which is at least partly complementary to VGAM1672 RNA, herein designated VGAM RNA, and which when bound by VGAM1672 RNA causes inhibition of translation of respective one or more VGAM1672 host target proteins.

It is further appreciated by one skilled in the art that the mode of translational inhibition illustrated by FIG. 1 with specific reference to translational inhibition exerted by VGAM1672 gene, herein designated VGAM GENE, on one or more VGAM1672 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1672 is inhibition of expression of host target genes, as part of a novel viral mechanism of attacking a host. Accordingly, utilities of VGAM1672 include diagnosis, prevention and treatment of viral infection by Tick-borne Encephalitis Virus. Specific functions, and accordingly utilities, of VGAM1672 correlate with, and may be deduced from, the identity of the host target genes which VGAM1672 binds and inhibits, and the function of these host target genes, as elaborated hereinbelow.

Nucleotide sequences of the VGAM1672 precursor RNA, herein designated VGAM PRECURSOR RNA, and of the 'diced' VGAM1672 RNA, herein designated VGAM RNA, and a schematic representation of the secondary folding of VGAM1672 folded precursor RNA, herein designated VGAM FOLDED PRECURSOR RNA, of VGAM1672 are further described hereinbelow with reference to Table 1.

Nucleotide sequences of host target binding sites, such as BINDING SITE-I, BINDING SITE-II and BINDING SITE-III of FIG. 1, found on VGAM1672 host target RNA, and schematic representation of the complementarity of each of these host target binding sites to VGAM1672 RNA, herein designated VGAM RNA, are described hereinbelow with reference to Table 2.

As mentioned hereinabove with reference to FIG. 1, a function of VGAM1672 gene, herein designated VGAM is inhibition of expression of VGAM1672 target genes. It is appreciated that specific functions, and accordingly utilities, of VGAM1672 correlate with, and may be deduced from, the identity of the target genes which VGAM1672 binds and inhibits, and the function of these target genes, as elaborated hereinbelow.

KIAA0089 (Accession XM_046056) is a VGAM1672 host target gene. KIAA0089 BINDING SITE is HOST TARGET binding site found in the 3' untranslated region of mRNA encoded by KIAA0089, corresponding to a HOST TARGET binding site such as BINDING SITE I, BINDING SITE II or BINDING SITE III. Table 2 illustrates the complementarity of the nucleotide sequences of KIAA0089 BINDING SITE, designated SEQ ID:34668, to the nucleotide sequence of VGAM1672 RNA, herein designated VGAM RNA, also designated SEQ ID:4383.

A function of VGAM1672 is therefore inhibition of KIAA0089 (Accession XM_046056). Accordingly, utilities of VGAM1672 include diagnosis, prevention and treatment of diseases and clinical conditions associated with KIAA0089. KIAA0227 (Accession XM_027236) is another VGAM1672 host target gene. KIAA0227 BINDING SITE is HOST TARGET binding site found in the 3' untranslated region of mRNA encoded by KIAA0227, corresponding to a HOST TARGET binding site such as BINDING SITE I, BINDING SITE II or BINDING SITE III. Table 2 illustrates the complementarity of the nucleotide sequences of KIAA0227 BINDING SITE, designated SEQ ID:30455, to the nucleotide sequence of VGAM1672 RNA, herein designated VGAM RNA, also designated SEQ ID:4383.

Another function of VGAM1672 is therefore inhibition of KIAA0227 (Accession XM_027236). Accordingly, utilities of VGAM1672 include diagnosis, prevention and treatment of diseases and clinical conditions associated with KIAA0227. KIAA1708 (Accession XM_040211) is another VGAM1672 host target gene. KIAA1708 BINDING SITE is HOST TARGET binding site found in the 3' untranslated region of mRNA encoded by KIAA1708, corresponding to a HOST TARGET binding site such as BINDING SITE I, BINDING SITE II or BINDING SITE III. Table 2 illustrates the complementarity of the nucleotide sequences of KIAA1708 BINDING SITE, designated SEQ ID:33272, to the nucleotide sequence of VGAM1672 RNA, herein designated VGAM RNA, also designated SEQ ID:4383.

Another function of VGAM1672 is therefore inhibition of KIAA1708 (Accession XM_040211). Accordingly, utilities of VGAM1672 include diagnosis, prevention and treatment of diseases and clinical conditions associated with KIAA1708. FIG. 1 further provides a conceptual description of a novel bioinformatically detected viral gene of the present invention, referred to here as Viral Genomic Address Messenger 1673 (VGAM1673) viral gene, which modulates expression of respective host target genes thereof, the function and utility of which host target genes is known in the art.

VGAM1673 is a novel bioinformatically detected regulatory, non protein coding, viral micro RNA (miRNA) gene. The method by which VGAM1673 was detected is described hereinabove with reference to FIGS. 1-8.

VGAM1673 gene, herein designated VGAM GENE, is a viral gene contained in the genome of Tick-borne Encephalitis Virus. VGAM1673 host target gene, herein designated VGAM HOST TARGET GENE, is a human gene contained in the human genome.

VGAM1673 gene encodes a VGAM1673 precursor RNA, herein designated VGAM PRECURSOR RNA. Similar to other miRNA genes, and unlike most ordinary genes, VGAM1673 precursor RNA does not encode a protein. A nucleotide sequence identical or highly similar to the nucleotide sequence of VGAM1673 precursor RNA is designated SEQ ID:1659, and is provided hereinbelow with reference to the sequence listing part. Nucleotide sequence SEQ ID:1659 is located at position 6145 relative to the genome of Tick-borne Encephalitis Virus.

VGAM1673 precursor RNA folds onto itself, forming VGAM1673 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1673 folded precursor RNA into VGAM1673 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1673 RNA is designated SEQ ID:4384, and is provided hereinbelow with reference to the sequence listing part.

VGAM1673 host target gene, herein designated VGAM HOST TARGET GENE, encodes a corresponding messenger RNA, VGAM1673 host target RNA, herein designated VGAM HOST TARGET RNA. VGAM1673 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1673 RNA, herein designated VGAM RNA, binds complementarily to one or more host target binding sites located in untranslated regions of VGAM1673 host target RNA, herein designated VGAM HOST TARGET RNA. This complementary binding is due to the fact that the nucleotide sequence of VGAM1673 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1673 RNA, herein designated VGAM RNA, may have a different number of host target binding sites in untranslated regions of a VGAM1673 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1673 RNA, herein designated VGAM RNA, to host target binding sites on VGAM1673 host target RNA, herein designated VGAM HOST TARGET RNA, such as BINDING SITE I, BINDING SITE II and BINDING SITE III, inhibits translation of VGAM1673 host target RNA into VGAM1673 host target protein, herein designated VGAM HOST TARGET PROTEIN. VGAM host target protein is therefore outlined by a broken line.

It is appreciated that VGAM1673 host target gene, herein designated VGAM HOST TARGET GENE, in fact represents a plurality of VGAM1673 host target genes. The mRNA of each one of this plurality of VGAM1673 host target genes comprises one or more host target binding sites, each having a nucleotide sequence which is at least partly complementary to VGAM1673 RNA, herein designated VGAM RNA, and which when bound by VGAM1673 RNA causes inhibition of translation of respective one or more VGAM1673 host target proteins.

It is further appreciated by one skilled in the art that the mode of translational inhibition illustrated by FIG. 1 with specific reference to translational inhibition exerted by VGAM1673 gene, herein designated VGAM GENE, on one or more VGAM1673 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1673 is inhibition of expression of host target genes, as part of a novel viral mechanism of attacking a host. Accordingly, utilities of VGAM1673 include diagnosis, prevention and treatment of viral infection by Tick-borne Encephalitis Virus. Specific functions, and accordingly utilities, of VGAM1673 correlate with, and may be deduced from, the identity of the host target genes which VGAM1673 binds and inhibits, and the function of these host target genes, as elaborated hereinbelow.

Nucleotide sequences of the VGAM1673 precursor RNA, herein designated VGAM PRECURSOR RNA, and of the 'diced' VGAM1673 RNA, herein designated VGAM RNA, and a schematic representation of the secondary folding of VGAM1673 folded precursor RNA, herein designated VGAM FOLDED PRECURSOR RNA, of VGAM1673 are further described hereinbelow with reference to Table 1.

Nucleotide sequences of host target binding sites, such as BINDING SITE-I, BINDING SITE-II and BINDING SITE-III of FIG. 1, found on VGAM1673 host target RNA, and schematic representation of the complementarity of each of these host target binding sites to VGAM1673 RNA, herein designated VGAM RNA, are described hereinbelow with reference to Table 2.

As mentioned hereinabove with reference to FIG. 1, a function of VGAM1673 gene, herein designated VGAM is inhibition of expression of VGAM1673 target genes. It is appreciated that specific functions, and accordingly utilities, of VGAM1673 correlate with, and may be deduced from, the identity of the target genes which VGAM1673 binds and inhibits, and the function of these target genes, as elaborated hereinbelow.

Alcohol Dehydrogenase 4 (class II), Pi Polypeptide (ADH4, Accession NM_000670) is a VGAM1673 host target gene. ADH4 BINDING SITE is HOST TARGET binding site found in the 5' untranslated region of mRNA encoded by ADH4, corresponding to a HOST TARGET binding site such as BINDING SITE I, BINDING SITE II or BINDING SITE III. Table 2 illustrates the complementarity of the nucleotide sequences of ADH4 BINDING SITE, designated SEQ ID:6321, to the nucleotide sequence of VGAM1673 RNA, herein designated VGAM RNA, also designated SEQ ID:4384.

A function of VGAM1673 is therefore inhibition of Alcohol Dehydrogenase 4 (class II), Pi Polypeptide (ADH4, Accession NM_000670). Accordingly, utilities of VGAM1673 include diagnosis, prevention and treatment of diseases and clinical conditions associated with ADH4. Ankyrin 3, Node of Ranvier (ankyrin G) (ANK3, Accession NM_020987) is another VGAM1673 host target gene. ANK3 BINDING SITE is HOST TARGET binding site found in the 3' untranslated region of mRNA encoded by ANK3, corresponding to a HOST TARGET binding site such as BINDING SITE I, BINDING SITE II or BINDING SITE III. Table 2 illustrates the complementarity of the nucleotide sequences of ANK3 BINDING SITE, designated SEQ ID:21981, to the nucleotide sequence of VGAM1673 RNA, herein designated VGAM RNA, also designated SEQ ID:4384.

Another function of VGAM1673 is therefore inhibition of Ankyrin 3, Node of Ranvier (ankyrin G) (ANK3, Accession NM_020987), a gene which plays key roles in activities such as cell motility, activation, proliferation. Accordingly, utilities of VGAM1673 include diagnosis, prevention and treatment of diseases and clinical conditions associated with ANK3. The function of ANK3 and its association with various diseases and clinical conditions, has been established by previous studies, as described hereinabove with reference to VGAM1527. Copine III (CPNE3, Accession NM_003909) is another VGAM1673 host target gene. CPNE3 BINDING SITE is HOST TARGET binding site found in the 3' untranslated region of mRNA encoded by CPNE3, corresponding to a HOST TARGET binding site such as BINDING SITE I, BINDING SITE II or BINDING SITE III. Table 2 illustrates the complementarity of the nucleotide sequences of CPNE3 BINDING SITE, designated SEQ ID:9991, to the nucleotide sequence of VGAM1673 RNA, herein designated VGAM RNA, also designated SEQ ID:4384.

Another function of VGAM1673 is therefore inhibition of Copine III (CPNE3, Accession NM_003909), a gene which may function in membrane trafficking. Accordingly, utilities of VGAM1673 include diagnosis, prevention and treatment of diseases and clinical conditions associated with CPNE3. The function of CPNE3 and its association with various diseases and clinical conditions, has been established by previous studies, as described hereinabove with reference to VGAM28. V-jun Sarcoma Virus 17 Oncogene Homolog (avian) (JUN, Accession NM_002228) is another VGAM1673 host target gene. JUN BINDING SITE is HOST TARGET binding site found in the 3' untranslated region of mRNA encoded by JUN, corresponding to a HOST TARGET binding site such as BINDING SITE I, BINDING SITE II or BINDING SITE III. Table 2 illustrates the complementarity of the nucleotide sequences of JUN BINDING SITE, designated SEQ ID:8009, to the nucleotide sequence of VGAM1673 RNA, herein designated VGAM RNA, also designated SEQ ID:4384.

Another function of VGAM1673 is therefore inhibition of V-jun Sarcoma Virus 17 Oncogene Homolog (avian) (JUN, Accession NM_002228), a gene which binds and recognizes the enhancer dna sequencetga (c/g) tca. Accordingly, utilities of VGAM1673 include diagnosis, prevention and treatment of diseases and clinical conditions associated with JUN. The function of JUN has been established by previous studies. The oncogene JUN is the putative transforming gene of avian sarcoma virus 17; it appears to be derived from a gene of the chicken genome and has homologs in several other vertebrate species. (The name JUN comes from the Japanese 'ju-nana,' meaning the number 17.) JUN was originally thought to be identical to the transcription factor AP1. However, it is now known that AP1 is not a single protein, but constitutes a group of related dimeric basic region-leucine zipper proteins that belong to the JUN, FOS (OMIM Ref. No. 164810), MAF (OMIM Ref. No. 177075), and ATF (see OMIM Ref. No. 603148) subfamilies. The various dimers recognize either 12-O-tetradecanoylphorbol-13-acetate (TPA) response elements or cAMP response elements. JUN is the most potent transcriptional activator in its group, and its transcriptional activity is attenuated and sometimes antagonized by JUNB (OMIM Ref. No. 165161). For a review of the structure and function of the AP1 transcription complexes Using a Drosophila model synapse, Sanyal et al. (2002) analyzed cellular functions and regulation of the immediate-early transcription factor AP1, a heterodimer of the basic leucine zipper proteins FOS and JUN. They observed that AP1 positively regulates synaptic strength and synapse number, thus showing a greater range of influence than CREB (OMIM Ref. No. 123810). Observations from genetic epistasis and RNA quantification experiments indicate that AP1 acts upstream of CREB, regulates levels of CREB mRNA, and functions at the top of the hierarchy of transcription factors known to regulate long-term plasticity. A JUN-kinase signaling module provided a CREB-independent route for neuronal AP1 activation; thus, CREB regulation of AP1 expression may, in some neurons, constitute a positive feedback loop rather than the primary step in AP1 activation. Mathas et al. (2002) found AP1 constitutively activated, with robust JUN and JUNB overexpression, in all cell lines derived from patients with classical Hodgkin lymphoma (OMIM Ref. No. 236000) and anaplastic large cell lymphoma (ALCL), but not in other lymphoma types. AP1 supported proliferation of Hodgkin cells, but suppressed apoptosis of ALCL cells. Mathas et al. (2002) noted that, whereas JUN is upregulated by an autoregulatory process, JUNB is under the control of nuclear factor kappa-B (NFKB; 164011). They found that AP1 and NFKB cooperate and stimulate expression of the cell cycle regulator cyclin D2 (OMIM Ref. No. 123833), the proto-oncogene MET (OMIM Ref. No. 164860), and the lymphocyte homing receptor CCR7 (OMIM Ref. No. 600242), which are all strongly expressed in primary Hodgkin/Reed-Sternberg (HRS) cells.

Full details of the abovementioned studies are described in the following publications, the disclosure of which are hereby incorporated by reference:

Sanyal, S.; Sandstrom, D. J.; Hoeffer, C. A.; Ramaswami, M.: AP-1 function upstream of CREB to control synaptic plasticity in Drosophila. Nature 416:870-874, 2002; and Mathas, S.; Hinz, M.; Anagnostopoulos, I.; Krappmann, D.; Lietz, A.; Jundt, F.; Bommert, K.; Mechta-Grigoriou, F.; Stein, H.; Dorken, B.; Scheidereit, C.: Aberrantly expressed c-Jun an.

Further studies establishing the function and utilities of JUN are found in John Hopkins OMIM database record ID 165160, and in sited publications numbered 4959, 5112-511 and 12745-5121 listed in the bibliography section hereinbelow, which are also hereby incorporated by reference. Protein Phosphatase 2 (formerly 2A), Regulatory Subunit B (PR 52), Beta Isoform (PPP2R2B, Accession NM_004576) is another VGAM1673 host target gene. PPP2R2B BINDING SITE is HOST TARGET binding site found in the 3' untranslated region of mRNA encoded by PPP2R2B, corresponding to a HOST TARGET binding site such as BINDING SITE I, BINDING SITE II or BINDING SITE III. Table 2 illustrates the complementarity of the nucleotide sequences of PPP2R2B BINDING SITE, designated SEQ ID:10921, to the nucleotide sequence of VGAM1673 RNA, herein designated VGAM RNA, also designated SEQ ID:4384.

Another function of VGAM1673 is therefore inhibition of Protein Phosphatase 2 (formerly 2A), Regulatory Subunit B (PR 52), Beta Isoform (PPP2R2B, Accession NM_004576). Accordingly, utilities of VGAM1673 include diagnosis, prevention and treatment of diseases and clinical conditions associated with PPP2R2B. Chromosome 6 Open Reading Frame 37 (C6orf37, Accession XM_041375) is another VGAM1673 host target gene. C6orf37 BINDING SITE is HOST TARGET binding site found in the 3' untranslated region of mRNA encoded by C6orf37, corresponding to a HOST TARGET binding site such as BINDING SITE I, BINDING SITE II or BINDING SITE III. Table 2 illustrates the complementarity of the nucleotide sequences of C6orf37 BINDING SITE, designated SEQ ID:33508, to the nucleotide sequence of VGAM1673 RNA, herein designated VGAM RNA, also designated SEQ ID:4384.

Another function of VGAM1673 is therefore inhibition of Chromosome 6 Open Reading Frame 37 (C6orf37, Accession XM_041375). Accordingly, utilities of VGAM1673 include diagnosis, prevention and treatment of diseases and clinical conditions associated with C6orf37. Cyclin M1 (CNNM1, Accession NM_020348) is another VGAM1673 host target gene. CNNM1 BINDING SITE is HOST TARGET binding site found in the 3' untranslated region of mRNA encoded by CNNM1, corresponding to a HOST TARGET binding site such as BINDING SITE I, BINDING SITE II or BINDING SITE III. Table 2 illustrates the complementarity of the nucleotide sequences of CNNM1 BINDING SITE, designated SEQ ID:21603, to the nucleotide sequence of VGAM1673 RNA, herein designated VGAM RNA, also designated SEQ ID:4384.

Another function of VGAM1673 is therefore inhibition of Cyclin M1 (CNNM1, Accession NM_020348). Accordingly, utilities of VGAM1673 include diagnosis, prevention and treatment of diseases and clinical conditions associated with CNNM1. Erythrocyte Membrane Protein Band 4.1-like 1 (EPB41L1, Accession XM_047295) is another VGAM1673 host target gene. EPB41L1 BINDING SITE is HOST TARGET binding site found in the 3' untranslated region of mRNA encoded by EPB41L1, corresponding to a HOST TARGET binding site such as BINDING SITE I, BINDING SITE II or BINDING SITE III. Table 2 illustrates the complementarity of the nucleotide sequences of EPB41L1 BINDING SITE, designated SEQ ID:34935, to the nucleotide sequence of VGAM1673 RNA, herein designated VGAM RNA, also designated SEQ ID:4384.

Another function of VGAM1673 is therefore inhibition of Erythrocyte Membrane Protein Band 4.1-like 1 (EPB41L1, Accession XM_047295). Accordingly, utilities of VGAM1673 include diagnosis, prevention and treatment of diseases and clinical conditions associated with EPB41L1. FLJ10350 (Accession XM_170946) is another VGAM1673 host target gene. FLJ10350 BINDING SITE is HOST TARGET binding site found in the 3' untranslated region of mRNA encoded by FLJ10350, corresponding to a HOST TARGET binding site such as BINDING SITE I, BINDING SITE II or BINDING SITE III. Table 2 illustrates the complementarity of the nucleotide sequences of FLJ10350 BINDING SITE, designated SEQ ID:45731, to the nucleotide sequence of VGAM1673 RNA, herein designated VGAM RNA, also designated SEQ ID:4384.

Another function of VGAM1673 is therefore inhibition of FLJ10350 (Accession XM_170946). Accordingly, utilities of VGAM1673 include diagnosis, prevention and treatment of diseases and clinical conditions associated with FLJ10350. FLJ10420 (Accession NM_018090) is another VGAM1673 host target gene. FLJ10420 BINDING SITE is HOST TARGET binding site found in the 3' untranslated region of mRNA encoded by FLJ10420, corresponding to a HOST TARGET binding site such as BINDING SITE I, BINDING SITE II or BINDING SITE III. Table 2 illustrates the complementarity of the nucleotide sequences of FLJ10420 BINDING SITE, designated SEQ ID:19854, to the nucleotide sequence of VGAM1673 RNA, herein designated VGAM RNA, also designated SEQ ID:4384.

Another function of VGAM1673 is therefore inhibition of FLJ10420 (Accession NM_018090). Accordingly, utilities of VGAM1673 include diagnosis, prevention and treatment of diseases and clinical conditions associated with FLJ10420. FLJ13213 (Accession NM_024755) is another VGAM1673 host target gene. FLJ13213 BINDING SITE is HOST TARGET binding site found in the 5' untranslated region of mRNA encoded by FLJ13213, corresponding to a HOST TARGET binding site such as BINDING SITE I, BINDING SITE II or BINDING SITE III. Table 2 illustrates the complementarity of the nucleotide sequences of FLJ13213 BINDING SITE, designated SEQ ID:24098, to the nucleotide sequence of VGAM1673 RNA, herein designated VGAM RNA, also designated SEQ ID:4384.

Another function of VGAM1673 is therefore inhibition of FLJ13213 (Accession NM_024755). Accordingly, utilities of VGAM1673 include diagnosis, prevention and treatment of diseases and clinical conditions associated with FLJ13213. FLJ13964 (Accession NM_032186) is another VGAM1673 host target gene. FLJ13964 BINDING SITE is HOST TARGET binding site found in the 3' untranslated region of mRNA encoded by FLJ13964, corresponding to a HOST TARGET binding site such as BINDING SITE I, BINDING SITE II or BINDING SITE III. Table 2 illustrates the complementarity of the nucleotide sequences of FLJ13964 BINDING SITE, designated SEQ ID:25900, to the nucleotide sequence of VGAM1673 RNA, herein designated VGAM RNA, also designated SEQ ID:4384.

Another function of VGAM1673 is therefore inhibition of FLJ13964 (Accession NM_032186). Accordingly, utilities of VGAM1673 include diagnosis, prevention and treatment of diseases and clinical conditions associated with FLJ13964. 5'-nucleotidase, Cytosolic IB (NT5C1B, Accession XM_048837) is another VGAM1673 host target gene. NT5C1B BINDING SITE is HOST TARGET binding site found in the 5' untranslated region of mRNA encoded by NT5C1B, corresponding to a HOST TARGET binding site such as BINDING SITE I, BINDING SITE II or BINDING SITE III. Table 2 illustrates the complementarity of the nucleotide sequences of NT5C1B BINDING SITE, designated SEQ ID:35283, to the nucleotide sequence of VGAM1673 RNA, herein designated VGAM RNA, also designated SEQ ID:4384.

Another function of VGAM1673 is therefore inhibition of 5'-nucleotidase, Cytosolic IB (NT5C1B, Accession XM_048837). Accordingly, utilities of VGAM1673 include diagnosis, prevention and treatment of diseases and clinical conditions associated with NT5C1B. PRO2133 (Accession NM_018619) is another VGAM1673 host target gene. PRO2133 BINDING SITE is HOST TARGET binding site found in the 3' untranslated region of mRNA encoded by PRO2133, corresponding to a HOST TARGET binding site such as BINDING SITE I, BINDING SITE II or BINDING SITE III. Table 2 illustrates the complementarity of the nucleotide sequences of PRO2133 BINDING SITE, designated SEQ ID:20689, to the nucleotide sequence of VGAM1673 RNA, herein designated VGAM RNA, also designated SEQ ID:4384.

Another function of VGAM1673 is therefore inhibition of PRO2133 (Accession NM_018619). Accordingly, utilities of VGAM1673 include diagnosis, prevention and treatment of diseases and clinical conditions associated with PRO2133. LOC132332 (Accession XM_072306) is another VGAM1673 host target gene. LOC132332 BINDING SITE is HOST TARGET binding site found in the 3' untranslated region of mRNA encoded by LOC132332, corresponding to a HOST TARGET binding site such as BINDING SITE I, BINDING SITE II or BINDING SITE III. Table 2 illustrates the complementarity of the nucleotide sequences of LOC132332 BINDING SITE, designated SEQ ID:37485, to the nucleotide sequence of VGAM1673 RNA, herein designated VGAM RNA, also designated SEQ ID:4384.

Another function of VGAM1673 is therefore inhibition of LOC132332 (Accession XM_072306). Accordingly, utilities of VGAM1673 include diagnosis, prevention and treatment of diseases and clinical conditions associated with LOC132332. LOC146713 (Accession XM_097071) is another VGAM1673 host target gene. LOC146713 BINDING SITE is HOST TARGET binding site found in the 3' untranslated region of mRNA encoded by LOC146713, corresponding to a HOST TARGET binding site such as BINDING SITE I, BINDING SITE II or BINDING SITE III. Table 2 illustrates the complementarity of the nucleotide sequences of LOC146713 BINDING SITE, designated SEQ ID:40713, to the nucleotide sequence of VGAM1673 RNA, herein designated VGAM RNA, also designated SEQ ID:4384.

Another function of VGAM1673 is therefore inhibition of LOC146713 (Accession XM_097071). Accordingly, utilities of VGAM1673 include diagnosis, prevention and treatment of diseases and clinical conditions associated with LOC146713. LOC146952 (Accession XM_097138) is another VGAM1673 host target gene. LOC146952 BINDING SITE is HOST TARGET binding site found in the 5' untranslated region of mRNA encoded by LOC146952, corresponding to a HOST TARGET binding site such as BINDING SITE I, BINDING SITE II or BINDING SITE III. Table 2 illustrates the complementarity of the nucleotide sequences of LOC146952 BINDING SITE, designated SEQ ID:40766, to the nucleotide sequence of VGAM1673 RNA, herein designated VGAM RNA, also designated SEQ ID:4384.

Another function of VGAM1673 is therefore inhibition of LOC146952 (Accession XM_097138). Accordingly, utilities of VGAM1673 include diagnosis, prevention and treatment of diseases and clinical conditions associated with LOC146952. LOC148166 (Accession XM_086077) is another VGAM1673 host target gene. LOC148166 BINDING SITE is HOST TARGET binding site found in the 5' untranslated region of mRNA encoded by LOC148166, corresponding to a HOST TARGET binding site such as BINDING SITE I, BINDING SITE II or BINDING SITE III. Table 2 illustrates the complementarity of the nucleotide sequences of LOC148166 BINDING SITE, designated SEQ ID:38479, to the nucleotide sequence of VGAM1673 RNA, herein designated VGAM RNA, also designated SEQ ID:4384.

Another function of VGAM1673 is therefore inhibition of LOC148166 (Accession XM_086077). Accordingly, utilities of VGAM1673 include diagnosis, prevention and treatment of diseases and clinical conditions associated with LOC148166. LOC150174 (Accession XM_086802) is another VGAM1673 host target gene. LOC150174 BINDING SITE is HOST TARGET binding site found in the 3' untranslated region of mRNA encoded by LOC150174, corresponding to a HOST TARGET binding site such as BIND- ING SITE I, BINDING SITE II or BINDING SITE III. Table 2 illustrates the complementarity of the nucleotide sequences of LOC150174 BINDING SITE, designated SEQ ID:38868, to the nucleotide sequence of VGAM1673 RNA, herein designated VGAM RNA, also designated SEQ ID:4384.

Another function of VGAM1673 is therefore inhibition of LOC150174 (Accession XM_086802). Accordingly, utilities of VGAM1673 include diagnosis, prevention and treatment of diseases and clinical conditions associated with LOC150174. LOC152620 (Accession XM_011108) is another VGAM1673 host target gene. LOC152620 BINDING SITE is HOST TARGET binding site found in the 3' untranslated region of mRNA encoded by LOC152620, corresponding to a HOST TARGET binding site such as BINDING SITE I, BINDING SITE II or BINDING SITE III. Table 2 illustrates the complementarity of the nucleotide sequences of LOC152620 BINDING SITE, designated SEQ ID:30172, to the nucleotide sequence of VGAM1673 RNA, herein designated VGAM RNA, also designated SEQ ID:4384.

Another function of VGAM1673 is therefore inhibition of LOC152620 (Accession XM_011108). Accordingly, utilities of VGAM1673 include diagnosis, prevention and treatment of diseases and clinical conditions associated with LOC152620. LOC166042 (Accession XM_093623) is another VGAM1673 host target gene. LOC166042 BINDING SITE is HOST TARGET binding site found in the 5' untranslated region of mRNA encoded by LOC166042, corresponding to a HOST TARGET binding site such as BINDING SITE I, BINDING SITE II or BINDING SITE III. Table 2 illustrates the complementarity of the nucleotide sequences of LOC166042 BINDING SITE, designated SEQ ID:40201, to the nucleotide sequence of VGAM1673 RNA, herein designated VGAM RNA, also designated SEQ ID:4384.

Another function of VGAM1673 is therefore inhibition of LOC166042 (Accession XM_093623). Accordingly, utilities of VGAM1673 include diagnosis, prevention and treatment of diseases and clinical conditions associated with LOC166042. LOC206836 (Accession XM_116750) is another VGAM1673 host target gene. LOC206836 BINDING SITE is HOST TARGET binding site found in the 5' untranslated region of mRNA encoded by LOC206836, corresponding to a HOST TARGET binding site such as BINDING SITE I, BINDING SITE II or BINDING SITE III. Table 2 illustrates the complementarity of the nucleotide sequences of LOC206836 BINDING SITE, designated SEQ ID:43124, to the nucleotide sequence of VGAM1673 RNA, herein designated VGAM RNA, also designated SEQ ID:4384.

Another function of VGAM1673 is therefore inhibition of LOC206836 (Accession XM_116750). Accordingly, utilities of VGAM1673 include diagnosis, prevention and treatment of diseases and clinical conditions associated with LOC206836. LOC90520 (Accession XM_032277) is another VGAM1673 host target gene. LOC90520 BINDING SITE is HOST TARGET binding site found in the 3' untranslated region of mRNA encoded by LOC90520, corresponding to a HOST TARGET binding site such as BINDING SITE I, BINDING SITE II or BINDING SITE III. Table 2 illustrates the complementarity of the nucleotide sequences of LOC90520 BINDING SITE, designated SEQ ID:31630, to the nucleotide sequence of VGAM1673 RNA, herein designated VGAM RNA, also designated SEQ ID:4384.

Another function of VGAM1673 is therefore inhibition of LOC90520 (Accession XM_032277). Accordingly, utilities of VGAM1673 include diagnosis, prevention and treatment of diseases and clinical conditions associated with LOC90520. FIG. 1 further provides a conceptual description of a novel bioinformatically detected viral gene of the present invention, referred to here as Viral Genomic Address Messenger 1674 (VGAM1674) viral gene, which modulates expression of respective host target genes thereof, the function and utility of which host target genes is known in the art.

VGAM1674 is a novel bioinformatically detected regulatory, non protein coding, viral micro RNA (miRNA) gene. The method by which VGAM1674 was detected is described hereinabove with reference to FIGS. 1-8.

VGAM1674 gene, herein designated VGAM GENE, is a viral gene contained in the genome of Tick-borne Encephalitis Virus. VGAM1674 host target gene, herein designated VGAM HOST TARGET GENE, is a human gene contained in the human genome.

VGAM1674 gene encodes a VGAM1674 precursor RNA, herein designated VGAM PRECURSOR RNA. Similar to other miRNA genes, and unlike most ordinary genes, VGAM1674 precursor RNA does not encode a protein. A nucleotide sequence identical or highly similar to the nucleotide sequence of VGAM1674 precursor RNA is designated SEQ ID:1660, and is provided hereinbelow with reference to the sequence listing part. Nucleotide sequence SEQ ID:1660 is located at position 4389 relative to the genome of Tick-borne Encephalitis Virus.

VGAM1674 precursor RNA folds onto itself, forming VGAM1674 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1674 folded precursor RNA into VGAM1674 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1674 RNA is designated SEQ ID:4385, and is provided hereinbelow with reference to the sequence listing part.

VGAM1674 host target gene, herein designated VGAM HOST TARGET GENE, encodes a corresponding messenger RNA, VGAM1674 host target RNA, herein designated VGAM HOST TARGET RNA. VGAM1674 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1674 RNA, herein designated VGAM RNA, binds complementarily to one or more host target binding sites located in untranslated regions of VGAM1674 host target RNA, herein designated VGAM HOST TARGET RNA. This complementary binding is due to the fact that the nucleotide sequence of VGAM1674 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1674 RNA, herein designated VGAM RNA, may have a different number of host target binding sites in untranslated regions of a VGAM1674 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1674 RNA, herein designated VGAM RNA, to host target binding sites on VGAM1674 host target RNA, herein designated VGAM HOST TARGET RNA, such as BINDING SITE I, BINDING SITE II and BINDING SITE III, inhibits translation of VGAM1674 host target RNA into VGAM1674 host target protein, herein designated VGAM HOST TARGET PROTEIN. VGAM host target protein is therefore outlined by a broken line.

It is appreciated that VGAM1674 host target gene, herein designated VGAM HOST TARGET GENE, in fact represents a plurality of VGAM1674 host target genes. The mRNA of each one of this plurality of VGAM1674 host target genes comprises one or more host target binding sites, each having a nucleotide sequence which is at least partly complementary to VGAM1674 RNA, herein designated VGAM RNA, and which when bound by VGAM1674 RNA causes inhibition of translation of respective one or more VGAM1674 host target proteins.

It is further appreciated by one skilled in the art that the mode of translational inhibition illustrated by FIG. 1 with specific reference to translational inhibition exerted by VGAM1674 gene, herein designated VGAM GENE, on one or more VGAM1674 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1674 is inhibition of expression of host target genes, as part of a novel viral mechanism of attacking a host. Accordingly, utilities of VGAM1674 include diagnosis, prevention and treatment of viral infection by Tick-borne Encephalitis Virus. Specific functions, and accordingly utilities, of VGAM1674 correlate with, and may be deduced from, the identity of the host target genes which VGAM1674 binds and inhibits, and the function of these host target genes, as elaborated hereinbelow.

Nucleotide sequences of the VGAM1674 precursor RNA, herein designated VGAM PRECURSOR RNA, and of the 'diced' VGAM1674 RNA, herein designated VGAM RNA, and a schematic representation of the secondary folding of VGAM1674 folded precursor RNA, herein designated VGAM FOLDED PRECURSOR RNA, of VGAM1674 are further described hereinbelow with reference to Table 1.

Nucleotide sequences of host target binding sites, such as BINDING SITE-I, BINDING SITE-II and BINDING SITE-III of FIG. 1, found on VGAM1674 host target RNA, and schematic representation of the complementarity of each of these host target binding sites to VGAM1674 RNA, herein designated VGAM RNA, are described hereinbelow with reference to Table 2.

As mentioned hereinabove with reference to FIG. 1, a function of VGAM1674 gene, herein designated VGAM is inhibition of expression of VGAM1674 target genes. It is appreciated that specific functions, and accordingly utilities, of VGAM1674 correlate with, and may be deduced from, the identity of the target genes which VGAM1674 binds and inhibits, and the function of these target genes, as elaborated hereinbelow.

Ephrin-B1 (EFNB1, Accession NM_004429) is a VGAM1674 host target gene. EFNB1 BINDING SITE is HOST TARGET binding site found in the 3' untranslated region of mRNA encoded by EFNB1, corresponding to a HOST TARGET binding site such as BINDING SITE I, BINDING SITE II or BINDING SITE III. Table 2 illustrates the complementarity of the nucleotide sequences of EFNB1 BINDING SITE, designated SEQ ID:10705, to the nucleotide sequence of VGAM1674 RNA, herein designated VGAM RNA, also designated SEQ ID:4385.

A function of VGAM1674 is therefore inhibition of Ephrin-B1 (EFNB1, Accession NM_004429), a gene which is a transmembrane ligand of Eph-related receptor tyrosine kinases, has a role in cell adhesion. Accordingly, utilities of VGAM1674 include diagnosis, prevention and treatment of diseases and clinical conditions associated with EFNB1. The function of EFNB1 and its association with various diseases and clinical conditions, has been established by previous studies, as described hereinabove with reference to VGAM390. Peptidylprolyl Isomerase F (cyclophilin F) (PPIF, Accession NM_005729) is another VGAM1674 host target gene. PPIF BINDING SITE is HOST TARGET binding site found in the 3' untranslated region of mRNA encoded by PPIF, corresponding to a HOST TARGET binding site such as BINDING SITE I, BINDING SITE II or BINDING SITE III. Table 2 illustrates the complementarity of the nucleotide sequences of PPIF BINDING SITE, designated SEQ ID:12284, to the nucleotide sequence of VGAM1674 RNA, herein designated VGAM RNA, also designated SEQ ID:4385.

Another function of VGAM1674 is therefore inhibition of Peptidylprolyl Isomerase F (cyclophilin F) (PPIF, Accession NM_005729), a gene which catalyzes the cis to trans isomerization of certain proline imidic peptide bonds in oligopeptides. Accordingly, utilities of VGAM1674 include diagnosis, prevention and treatment of diseases and clinical conditions associated with PPIF. The function of PPIF and its association with various diseases and clinical conditions, has been established by previous studies, as described hereinabove with reference to VGAM251. FIG. 1 further provides a conceptual description of a novel bioinformatically detected viral gene of the present invention, referred to here as Viral Genomic Address Messenger 1675 (VGAM1675) viral gene, which modulates expression of respective host target genes thereof, the function and utility of which host target genes is known in the art.

VGAM1675 is a novel bioinformatically detected regulatory, non protein coding, viral micro RNA (miRNA) gene. The method by which VGAM1675 was detected is described hereinabove with reference to FIGS. 1-8.

VGAM1675 gene, herein designated VGAM GENE, is a viral gene contained in the genome of Viral Hemorrhagic Sep.icemia Virus. VGAM1675 host target gene, herein designated VGAM HOST TARGET GENE, is a human gene contained in the human genome.

VGAM1675 gene encodes a VGAM1675 precursor RNA, herein designated VGAM PRECURSOR RNA. Similar to other miRNA genes, and unlike most ordinary genes, VGAM1675 precursor RNA does not encode a protein. A nucleotide sequence identical or highly similar to the nucleotide sequence of VGAM1675 precursor RNA is designated SEQ ID:1661, and is provided hereinbelow with reference to the sequence listing part. Nucleotide sequence SEQ ID:1661 is located at position 1531 relative to the genome of Viral Hemorrhagic Sep.icemia Virus.

VGAM1675 precursor RNA folds onto itself, forming VGAM1675 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1675 folded precursor RNA into VGAM1675 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1675 RNA is designated SEQ ID:4386, and is provided hereinbelow with reference to the sequence listing part.

VGAM1675 host target gene, herein designated VGAM HOST TARGET GENE, encodes a corresponding messenger RNA, VGAM1675 host target RNA, herein designated VGAM HOST TARGET RNA. VGAM1675 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1675 RNA, herein designated VGAM RNA, binds complementarily to one or more host target binding sites located in untranslated regions of VGAM1675 host target RNA, herein designated VGAM HOST TARGET RNA. This complementary binding is due to the fact that the nucleotide sequence of VGAM1675 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1675 RNA, herein designated VGAM RNA, may have a different number of host target binding sites in untranslated regions of a VGAM1675 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1675 RNA, herein designated VGAM RNA, to host target binding sites on VGAM1675 host target RNA, herein designated VGAM HOST TARGET RNA, such as BINDING SITE I, BINDING SITE II and BINDING SITE III, inhibits translation of VGAM1675 host target RNA into VGAM1675 host target protein, herein designated VGAM HOST TARGET PROTEIN. VGAM host target protein is therefore outlined by a broken line.

It is appreciated that VGAM1675 host target gene, herein designated VGAM HOST TARGET GENE, in fact represents a plurality of VGAM1675 host target genes. The mRNA of each one of this plurality of VGAM1675 host target genes comprises one or more host target binding sites, each having a nucleotide sequence which is at least partly complementary to VGAM1675 RNA, herein designated VGAM RNA, and which when bound by VGAM1675 RNA causes inhibition of translation of respective one or more VGAM1675 host target proteins.

It is further appreciated by one skilled in the art that the mode of translational inhibition illustrated by FIG. 1 with specific reference to translational inhibition exerted by VGAM1675 gene, herein designated VGAM GENE, on one or more VGAM1675 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1675 is inhibition of expression of host target genes, as part of a novel viral mechanism of attacking a host. Accordingly, utilities of VGAM1675 include diagnosis, prevention and treatment of viral infection by Viral Hemorrhagic Sep.icemia Virus. Specific functions, and accordingly utilities, of VGAM1675 correlate with, and may be deduced from, the identity of the host target genes which VGAM1675 binds and inhibits, and the function of these host target genes, as elaborated hereinbelow.

Nucleotide sequences of the VGAM1675 precursor RNA, herein designated VGAM PRECURSOR RNA, and of the 'diced' VGAM1675 RNA, herein designated VGAM RNA, and a schematic representation of the secondary folding of VGAM1675 folded precursor RNA, herein designated VGAM FOLDED PRECURSOR RNA, of VGAM1675 are further described hereinbelow with reference to Table 1.

Nucleotide sequences of host target binding sites, such as BINDING SITE-I, BINDING SITE-II and BINDING SITE-III of FIG. 1, found on VGAM1675 host target RNA, and schematic representation of the complementarity of each of these host target binding sites to VGAM1675 RNA, herein designated VGAM RNA, are described hereinbelow with reference to Table 2.

As mentioned hereinabove with reference to FIG. 1, a function of VGAM1675 gene, herein designated VGAM is inhibition of expression of VGAM1675 target genes. It is appreciated that specific functions, and accordingly utilities, of VGAM1675 correlate with, and may be deduced from, the identity of the target genes which VGAM1675 binds and inhibits, and the function of these target genes, as elaborated hereinbelow.

RB1-inducible Coiled-coil 1 (RB1CC1, Accession NM_014781) is a VGAM1675 host target gene. RB1CC1 BINDING SITE is HOST TARGET binding site found in the 3' untranslated region of mRNA encoded by RB1CC1, corresponding to a HOST TARGET binding site such as BINDING SITE I, BINDING SITE II or BINDING SITE III. Table 2 illustrates the complementarity of the nucleotide sequences of RB1CC1 BINDING SITE, designated SEQ ID:16630, to the nucleotide sequence of VGAM1675 RNA, herein designated VGAM RNA, also designated SEQ ID:4386.

A function of VGAM1675 is therefore inhibition of RB1-inducible Coiled-coil 1 (RB1CC1, Accession NM_014781), a gene which is likely to participate in nuclear architecture by connecting chromatin with the nuclear matrix or envelope. Accordingly, utilities of VGAM1675 include diagnosis, prevention and treatment of diseases and clinical conditions associated with RB1CC1. The function of RB1CC1 and its association with various diseases and clinical conditions, has been established by previous studies, as described hereinabove with reference to VGAM18. BCE-1 (Accession NM_007005) is another VGAM1675 host target gene. BCE-1 BINDING SITE is HOST TARGET binding site found in the 5' untranslated region of mRNA encoded by BCE-1, corresponding to a HOST TARGET binding site such as BINDING SITE I, BINDING SITE II or BINDING SITE III. Table 2 illustrates the complementarity of the nucleotide sequences of BCE-1 BINDING SITE, designated SEQ ID:13867, to the nucleotide sequence of VGAM1675 RNA, herein designated VGAM RNA, also designated SEQ ID:4386.

Another function of VGAM1675 is therefore inhibition of BCE-1 (Accession NM_007005). Accordingly, utilities of VGAM1675 include diagnosis, prevention and treatment of diseases and clinical conditions associated with BCE-1. FIG. 1 further provides a conceptual description of a novel bioinformatically detected viral gene of the present invention, referred to here as Viral Genomic Address Messenger 1676 (VGAM1676) viral gene, which modulates expression of respective host target genes thereof, the function and utility of which host target genes is known in the art.

VGAM1676 is a novel bioinformatically detected regulatory, non protein coding, viral micro RNA (miRNA) gene. The method by which VGAM1676 was detected is described hereinabove with reference to FIGS. 1-8.

VGAM1676 gene, herein designated VGAM GENE, is a viral gene contained in the genome of Viral Hemorrhagic Sep.icemia Virus. VGAM1676 host target gene, herein designated VGAM HOST TARGET GENE, is a human gene contained in the human genome.

VGAM1676 gene encodes a VGAM1676 precursor RNA, herein designated VGAM PRECURSOR RNA. Similar to other miRNA genes, and unlike most ordinary genes, VGAM1676 precursor RNA does not encode a protein. A nucleotide sequence identical or highly similar to the nucleotide sequence of VGAM1676 precursor RNA is designated SEQ ID:1662, and is provided hereinbelow with reference to the sequence listing part. Nucleotide sequence SEQ ID:1662 is located at position 7506 relative to the genome of Viral Hemorrhagic Sep.icemia Virus.

VGAM1676 precursor RNA folds onto itself, forming VGAM1676 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1676 folded precursor RNA into VGAM1676 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM1676 RNA is designated SEQ ID:4387, and is provided hereinbelow with reference to the sequence listing part.

VGAM1676 host target gene, herein designated VGAM HOST TARGET GENE, encodes a corresponding messenger RNA, VGAM1676 host target RNA, herein designated VGAM HOST TARGET RNA. VGAM1676 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1676 RNA, herein designated VGAM RNA, binds complementarily to one or more host target binding sites located in untranslated regions of VGAM1676 host target RNA, herein designated VGAM HOST TARGET RNA. This complementary binding is due to the fact that the nucleotide sequence of VGAM1676 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1676 RNA, herein designated VGAM RNA, may have a different number of host target binding sites in untranslated regions of a VGAM1676 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1676 RNA, herein designated VGAM RNA, to host target binding sites on VGAM1676 host target RNA, herein designated VGAM HOST TARGET RNA, such as BINDING SITE I, BINDING SITE II and BINDING SITE III, inhibits translation of VGAM1676 host target RNA into VGAM1676 host target protein, herein designated VGAM HOST TARGET PROTEIN. VGAM host target protein is therefore outlined by a broken line.

It is appreciated that VGAM1676 host target gene, herein designated VGAM HOST TARGET GENE, in fact represents a plurality of VGAM1676 host target genes. The mRNA of each one of this plurality of VGAM1676 host target genes comprises one or more host target binding sites, each having a nucleotide sequence which is at least partly complementary to VGAM1676 RNA, herein designated VGAM RNA, and which when bound by VGAM1676 RNA causes inhibition of translation of respective one or more VGAM1676 host target proteins.

It is further appreciated by one skilled in the art that the mode of translational inhibition illustrated by FIG. 1 with specific reference to translational inhibition exerted by VGAM1676 gene, herein designated VGAM GENE, on one or more VGAM1676 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1676 is inhibition of expression of host target genes, as part of a novel viral mechanism of attacking a host. Accordingly, utilities of VGAM1676 include diagnosis, prevention and treatment of viral infection by Viral Hemorrhagic Sep.icemia Virus. Specific functions, and accordingly utilities, of VGAM1676 correlate with, and may be deduced from, the identity of the host target genes which VGAM1676 binds and inhibits, and the function of these host target genes, as elaborated hereinbelow.

Nucleotide sequences of the VGAM1676 precursor RNA, herein designated VGAM PRECURSOR RNA, and of the 'diced' VGAM1676 RNA, herein designated VGAM RNA, and a schematic representation of the secondary folding of VGAM1676 folded precursor RNA, herein designated VGAM FOLDED PRECURSOR RNA, of VGAM1676 are further described hereinbelow with reference to Table 1.

Nucleotide sequences of host target binding sites, such as BINDING SITE-I, BINDING SITE-II and BINDING SITE-III of FIG. 1, found on VGAM1676 host target RNA, and schematic representation of the complementarity of each of these host target binding sites to VGAM1676 RNA, herein designated VGAM RNA, are described hereinbelow with reference to Table 2.

As mentioned hereinabove with reference to FIG. 1, a function of VGAM1676 gene, herein designated VGAM is inhibition of expression of VGAM1676 target genes. It is appreciated that specific functions, and accordingly utilities, of VGAM1676 correlate with, and may be deduced from, the identity of the target genes which VGAM1676 binds and inhibits, and the function of these target genes, as elaborated hereinbelow.

Glycosylphosphatidylinositol Specific Phospholipase D1 (GPLD1, Accession XM_166347) is a VGAM1676 host target gene. GPLD1 BINDING SITE is HOST TARGET binding site found in the 3' untranslated region of mRNA encoded by GPLD1, corresponding to a HOST TARGET binding site such as BINDING SITE I, BINDING SITE II or BINDING SITE III. Table 2 illustrates the complementarity of the nucleotide sequences of GPLD1 BINDING SITE, designated SEQ ID:44181, to the nucleotide sequence of VGAM1676 RNA, herein designated VGAM RNA, also designated SEQ ID:4387.

A function of VGAM1676 is therefore inhibition of Glycosylphosphatidylinositol Specific Phospholipase D1 (GPLD1, Accession XM_166347), a gene which hydrolyses the inositol phosphate linkage in proteins anchored by phosphatidylinositol glycans to release these proteins from the membrane. Accordingly, utilities of VGAM1676 include diagnosis, prevention and treatment of diseases and clinical conditions associated with GPLD1. The function of GPLD1 and its association with various diseases and clinical conditions, has been established by previous studies, as described hereinabove with reference to VGAM1575. Polymerase (DNA directed), Theta (POLQ, Accession NM_006596) is another VGAM1676 host target gene. POLQ BINDING SITE is HOST TARGET binding site found in the 3' untranslated region of mRNA encoded by POLQ, corresponding to a HOST TARGET binding site such as BINDING SITE I, BINDING SITE II or BINDING SITE III. Table 2 illustrates the complementarity of the nucleotide sequences of POLQ BINDING SITE, designated SEQ ID:13365, to the nucleotide sequence of VGAM1676 RNA, herein designated VGAM RNA, also designated SEQ ID:4387.

Another function of VGAM1676 is therefore inhibition of Polymerase (DNA directed), Theta (POLQ, Accession NM_006596), a gene which enhances untargeted mutagenesis. Accordingly, utilities of VGAM1676 include diagnosis, prevention and treatment of diseases and clinical conditions associated with POLQ. The function of POLQ and its association with various diseases and clinical conditions, has been established by previous studies, as described hereinabove with reference to VGAM922. SET Translocation (myeloid leukemia-associated) (SET, Accession NM_003011) is another VGAM1676 host target gene. SET BINDING SITE is HOST TARGET binding site found in the 3' untranslated region of mRNA encoded by SET, corresponding to a HOST TARGET binding site such as BINDING SITE I, BINDING SITE II or BINDING SITE III. Table 2 illustrates the complementarity of the nucleotide sequences of SET BINDING SITE, designated SEQ ID:8920, to the nucleotide sequence of VGAM1676 RNA, herein designated VGAM RNA, also designated SEQ ID:4387.

Another function of VGAM1676 is therefore inhibition of SET Translocation (myeloid leukemia-associated) (SET, Accession NM_003011). Accordingly, utilities of VGAM1676 include diagnosis, prevention and treatment of diseases and clinical conditions associated with SET. Transforming Growth Factor, Beta 3 (TGFB3, Accession NM_003239) is another VGAM1676 host target gene. TGFB3 BINDING SITE is HOST TARGET binding site found in the 3' untranslated region of mRNA encoded by TGFB3, corresponding to a HOST TARGET binding site such as BINDING SITE I, BINDING SITE II or BINDING SITE III. Table 2 illustrates the complementarity of the nucleotide sequences of TGFB3 BINDING SITE, designated SEQ ID:9234, to the nucleotide sequence of VGAM1676 RNA, herein designated VGAM RNA, also designated SEQ ID:4387.

Another function of VGAM1676 is therefore inhibition of Transforming Growth Factor, Beta 3 (TGFB3, Accession NM_003239), a gene which is involved in embryogenesis and cell differentiation. Accordingly, utilities of VGAM1676 include diagnosis, prevention and treatment of diseases and clinical conditions associated with TGFB3. The function of TGFB3 and its association with various diseases and clinical conditions, has been established by previous studies, as described hereinabove with reference to VGAM1126. Caspr5 (Accession NM_138996) is another VGAM1676 host target gene. caspr5 BINDING SITE1 and caspr5 BINDING SITE2 are HOST TARGET binding sites found in untranslated regions of mRNA encoded by caspr5, corresponding to HOST TARGET binding sites such as BINDING SITE I, BINDING SITE II or BINDING SITE III. Table 2 illustrates the complementarity of the nucleotide sequences of caspr5 BINDING SITE1 and caspr5 BINDING SITE2, designated SEQ ID:29095 and SEQ ID:28266 respectively, to the nucleotide sequence of VGAM1676 RNA, herein designated VGAM RNA, also designated SEQ ID:4387.

Another function of VGAM1676 is therefore inhibition of caspr5 (Accession NM_138996). Accordingly, utilities of VGAM1676 include diagnosis, prevention and treatment of diseases and clinical conditions associated with caspr5. KIAA0937 (Accession XM_166213) is another VGAM1676 host target gene. KIAA0937 BINDING SITE is HOST TARGET binding site found in the 3' untranslated region of mRNA encoded by KIAA0937, corresponding to a HOST TARGET binding site such as BINDING SITE I, BINDING SITE II or BINDING SITE III. Table 2 illustrates the complementarity of the nucleotide sequences of KIAA0937 BINDING SITE, designated SEQ ID:44015, to the nucleotide sequence of VGAM1676 RNA, herein designated VGAM RNA, also designated SEQ ID:4387.

Another function of VGAM1676 is therefore inhibition of KIAA0937 (Accession XM_166213). Accordingly, utilities of VGAM1676 include diagnosis, prevention and treatment of diseases and clinical conditions associated with KIAA0937. Lymphocyte Antigen 75 (LY75, Accession NM_002349) is another VGAM1676 host target gene. LY75 BINDING SITE is HOST TARGET binding site found in the 3' untranslated region of mRNA encoded by LY75, corresponding to a HOST TARGET binding site such as BINDING SITE I, BINDING SITE II or BINDING SITE III. Table 2 illustrates the complementarity of the nucleotide sequences of LY75 BINDING SITE, designated SEQ ID:8150, to the nucleotide sequence of VGAM1676 RNA, herein designated VGAM RNA, also designated SEQ ID:4387.

Another function of VGAM1676 is therefore inhibition of Lymphocyte Antigen 75 (LY75, Accession NM_002349). Accordingly, utilities of VGAM1676 include diagnosis, prevention and treatment of diseases and clinical conditions associated with LY75. Organic Cationic Transporter-like 3 (ORCTL3, Accession NM_004256) is another VGAM1676 host target gene. ORCTL3 BINDING SITE is HOST TARGET binding site found in the 3' untranslated region of mRNA encoded by ORCTL3, corresponding to a HOST TARGET binding site such as BINDING SITE I, BINDING SITE II or BINDING SITE III. Table 2 illustrates the complementarity of the nucleotide sequences of ORCTL3 BINDING SITE, designated SEQ ID:10444, to the nucleotide sequence of VGAM1676 RNA, herein designated VGAM RNA, also designated SEQ ID:4387.

Another function of VGAM1676 is therefore inhibition of Organic Cationic Transporter-like 3 (ORCTL3, Accession NM_004256). Accordingly, utilities of VGAM1676 include diagnosis, prevention and treatment of diseases and clinical conditions associated with ORCTL3. Tripartite Motif-containing 4 (TRIM4, Accession NM_033017) is another VGAM1676 host target gene. TRIM4 BINDING SITE is HOST TARGET binding site found in the 3' untranslated region of mRNA encoded by TRIM4, corresponding to a HOST TARGET binding site such as BINDING SITE I, BINDING SITE II or BINDING SITE III. Table 2 illustrates the complementarity of the nucleotide sequences of TRIM4 BINDING SITE, designated SEQ ID:26903, to the nucleotide sequence of VGAM1676 RNA, herein designated VGAM RNA, also designated SEQ ID:4387.

Another function of VGAM1676 is therefore inhibition of Tripartite Motif-containing 4 (TRIM4, Accession NM_033017). Accordingly, utilities of VGAM1676 include diagnosis, prevention and treatment of diseases and clinical conditions associated with TRIM4. LOC127702 (Accession XM_060619) is another VGAM1676 host target gene. LOC127702 BINDING SITE is HOST TARGET binding site found in the 3' untranslated region of mRNA encoded by LOC127702, corresponding to a HOST TARGET binding site such as BINDING SITE I, BINDING SITE II or BINDING SITE III. Table 2 illustrates the complementarity of the nucleotide sequences of LOC127702 BINDING SITE, designated SEQ ID:37182, to the nucleotide sequence of VGAM1676 RNA, herein designated VGAM RNA, also designated SEQ ID:4387.

Another function of VGAM1676 is therefore inhibition of LOC127702 (Accession XM_060619). Accordingly, utilities of VGAM1676 include diagnosis, prevention and treatment of diseases and clinical conditions associated with LOC127702. LOC143310 (Accession XM_084485) is another VGAM1676 host target gene. LOC143310 BINDING SITE is HOST TARGET binding site found in the 5' untranslated region of mRNA encoded by LOC143310, corresponding to a HOST TARGET binding site such as BINDING SITE I, BINDING SITE II or BINDING SITE III. Table 2 illustrates the complementarity of the nucleotide sequences of LOC143310 BINDING SITE, designated SEQ ID:37603, to the nucleotide sequence of VGAM1676 RNA, herein designated VGAM RNA, also designated SEQ ID:4387.

Another function of VGAM1676 is therefore inhibition of LOC143310 (Accession XM_084485). Accordingly, utilities of VGAM1676 include diagnosis, prevention and treatment of diseases and clinical conditions associated with LOC143310. LOC144262 (Accession XM_084793) is another VGAM1676 host target gene. LOC144262 BINDING SITE is HOST TARGET binding site found in the 5' untranslated region of mRNA encoded by LOC144262, corresponding to a HOST TARGET binding site such as BINDING SITE I, BINDING SITE II or BINDING SITE III. Table 2 illustrates the complementarity of the nucleotide sequences of LOC144262 BINDING SITE, designated SEQ ID:37705, to the nucleotide sequence of VGAM1676 RNA, herein designated VGAM RNA, also designated SEQ ID:4387.

Another function of VGAM1676 is therefore inhibition of LOC144262 (Accession XM_084793). Accordingly, utilities of VGAM1676 include diagnosis, prevention and treatment of diseases and clinical conditions associated with LOC144262. LOC144519 (Accession XM_084890) is another VGAM1676 host target gene. LOC144519 BINDING SITE is HOST TARGET binding site found in the 5' untranslated region of mRNA encoded by LOC144519, corresponding to a HOST TARGET binding site such as BINDING SITE I, BINDING SITE II or BINDING SITE III. Table 2 illustrates the complementarity of the nucleotide sequences of LOC144519 BINDING SITE, designated SEQ ID:37754, to the nucleotide sequence of VGAM1676 RNA, herein designated VGAM RNA, also designated SEQ ID:4387.

Another function of VGAM1676 is therefore inhibition of LOC144519 (Accession XM_084890). Accordingly, utilities of VGAM1676 include diagnosis, prevention and treatment of diseases and clinical conditions associated with LOC144519. LOC145790 (Accession XM_085234) is another VGAM1676 host target gene. LOC145790 BINDING SITE is HOST TARGET binding site found in the 3' untranslated region of mRNA encoded by LOC145790, corresponding to a HOST TARGET binding site such as BINDING SITE I, BINDING SITE II or BINDING SITE III. Table 2 illustrates the complementarity of the nucleotide sequences of LOC145790 BINDING SITE, designated SEQ ID:37978, to the nucleotide sequence of VGAM1676 RNA, herein designated VGAM RNA, also designated SEQ ID:4387.

Another function of VGAM1676 is therefore inhibition of LOC145790 (Accession XM_085234). Accordingly, utilities of VGAM1676 include diagnosis, prevention and treatment of diseases and clinical conditions associated with LOC145790. LOC164382 (Accession XM_104390) is another VGAM1676 host target gene. LOC164382 BINDING SITE is HOST TARGET binding site found in the 3' untranslated region of mRNA encoded by LOC164382, corresponding to a HOST TARGET binding site such as BINDING SITE I, BINDING SITE II or BINDING SITE III. Table 2 illustrates the complementarity of the nucleotide sequences of LOC164382 BINDING SITE, designated SEQ ID:42165, to the nucleotide sequence of VGAM1676 RNA, herein designated VGAM RNA, also designated SEQ ID:4387.

Another function of VGAM1676 is therefore inhibition of LOC164382 (Accession XM_104390). Accordingly, utilities of VGAM1676 include diagnosis, prevention and treatment of diseases and clinical conditions associated with LOC164382. LOC168346 (Accession XM_095010) is another VGAM1676 host target gene. LOC168346 BINDING SITE is HOST TARGET binding site found in the 5' untranslated region of mRNA encoded by LOC168346, corresponding to a HOST TARGET binding site such as BINDING SITE I, BINDING SITE II or BINDING SITE III. Table 2 illustrates the complementarity of the nucleotide sequences of LOC168346 BINDING SITE, designated SEQ ID:40241, to the nucleotide sequence of VGAM1676 RNA, herein designated VGAM RNA, also designated SEQ ID:4387.

Another function of VGAM1676 is therefore inhibition of LOC168346 (Accession XM_095010). Accordingly, utilities of VGAM1676 include diagnosis, prevention and treatment of diseases and clinical conditions associated with LOC168346. LOC197117 (Accession XM_116989) is another VGAM1676 host target gene. LOC197117 BINDING SITE is HOST TARGET binding site found in the 3' untranslated region of mRNA encoded by LOC197117, corresponding to a HOST TARGET binding site such as BINDING SITE I, BINDING SITE II or BINDING SITE III. Table 2 illustrates the complementarity of the nucleotide sequences of LOC197117 BINDING SITE, designated SEQ ID:43195, to the nucleotide sequence of VGAM1676 RNA, herein designated VGAM RNA, also designated SEQ ID:4387.

Another function of VGAM1676 is therefore inhibition of LOC197117 (Accession XM_116989). Accordingly, utilities of VGAM1676 include diagnosis, prevention and treatment of diseases and clinical conditions associated with LOC197117. LOC255645 (Accession XM_172967) is another VGAM1676 host target gene. LOC255645 BINDING SITE is HOST TARGET binding site found in the 3' untranslated region of mRNA encoded by LOC255645, corresponding to a HOST TARGET binding site such as BINDING SITE I, BINDING SITE II or BINDING SITE III. Table 2 illustrates the complementarity of the nucleotide sequences of LOC255645 BINDING SITE, designated SEQ ID:46223, to the nucleotide sequence of VGAM1676 RNA, herein designated VGAM RNA, also designated SEQ ID:4387.

Another function of VGAM1676 is therefore inhibition of LOC255645 (Accession XM_172967). Accordingly, utilities of VGAM1676 include diagnosis, prevention and treatment of diseases and clinical conditions associated with LOC255645. FIG. 1 further provides a conceptual description of a novel bioinformatically detected viral gene of the present invention, referred to here as Viral Genomic Address Messenger 1677 (VGAM1677) viral gene, which modulates expression of respective host target genes thereof, the function and utility of which host target genes is known in the art.

VGAM1677 is a novel bioinformatically detected regulatory, non protein coding, viral micro RNA (miRNA) gene. The method by which VGAM1677 was detected is described hereinabove with reference to FIGS. 1-8.

VGAM1677 gene, herein designated VGAM GENE, is a viral gene contained in the genome of Viral Hemorrhagic Sep.icemia Virus. VGAM1677 host target gene, herein designated VGAM HOST TARGET GENE, is a human gene contained in the human genome.

VGAM1677 gene encodes a VGAM1677 precursor RNA, herein designated VGAM PRECURSOR RNA. Similar to other miRNA genes, and unlike most ordinary genes, VGAM1677 precursor RNA does not encode a protein. A nucleotide sequence identical or highly similar to the nucleotide sequence of VGAM1677 precursor RNA is designated SEQ ID:1663, and is provided hereinbelow with reference to the sequence listing part. Nucleotide sequence SEQ ID:1663 is located at position 5586 relative to the genome of Viral Hemorrhagic Sep.icemia Virus.

VGAM1677 precursor RNA folds onto itself, forming VGAM1677 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1677 folded precursor RNA into VGAM1677 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM1677 RNA is designated SEQ ID:4388, and is provided hereinbelow with reference to the sequence listing part.

VGAM1677 host target gene, herein designated VGAM HOST TARGET GENE, encodes a corresponding messenger RNA, VGAM1677 host target RNA, herein designated VGAM HOST TARGET RNA. VGAM1677 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1677 RNA, herein designated VGAM RNA, binds complementarily to one or more host target binding sites located in untranslated regions of VGAM1677 host target RNA, herein designated VGAM HOST TARGET RNA. This complementary binding is due to the fact that the nucleotide sequence of VGAM1677 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1677 RNA, herein designated VGAM RNA, may have a different number of host target binding sites in untranslated regions of a VGAM1677 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1677 RNA, herein designated VGAM RNA, to host target binding sites on VGAM1677 host target RNA, herein designated VGAM HOST TARGET RNA, such as BINDING SITE I, BINDING SITE II and BINDING SITE III, inhibits translation of VGAM1677 host target RNA into VGAM1677 host target protein, herein designated VGAM HOST TARGET PROTEIN. VGAM host target protein is therefore outlined by a broken line.

It is appreciated that VGAM1677 host target gene, herein designated VGAM HOST TARGET GENE, in fact represents a plurality of VGAM1677 host target genes. The mRNA of each one of this plurality of VGAM1677 host target genes comprises one or more host target binding sites, each having a nucleotide sequence which is at least partly complementary to VGAM1677 RNA, herein designated VGAM RNA, and which when bound by VGAM1677 RNA causes inhibition of translation of respective one or more VGAM1677 host target proteins.

It is further appreciated by one skilled in the art that the mode of translational inhibition illustrated by FIG. 1 with specific reference to translational inhibition exerted by VGAM1677 gene, herein designated VGAM GENE, on one or more VGAM1677 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1677 is inhibition of expression of host target genes, as part of a novel viral mechanism of attacking a host. Accordingly, utilities of VGAM1677 include diagnosis, prevention and treatment of viral infection by Viral Hemorrhagic Sep.icemia Virus. Specific functions, and accordingly utilities, of VGAM1677 correlate with, and may be deduced from, the identity of the host target genes which VGAM1677 binds and inhibits, and the function of these host target genes, as elaborated hereinbelow.

Nucleotide sequences of the VGAM1677 precursor RNA, herein designated VGAM PRECURSOR RNA, and of the 'diced' VGAM1677 RNA, herein designated VGAM RNA, and a schematic representation of the secondary folding of VGAM1677 folded precursor RNA, herein designated VGAM FOLDED PRECURSOR RNA, of VGAM1677 are further described hereinbelow with reference to Table 1.

Nucleotide sequences of host target binding sites, such as BINDING SITE-I, BINDING SITE-II and BINDING SITE-III of FIG. 1, found on VGAM1677 host target RNA, and schematic representation of the complementarity of each of these host target binding sites to VGAM1677 RNA, herein designated VGAM RNA, are described hereinbelow with reference to Table 2.

As mentioned hereinabove with reference to FIG. 1, a function of VGAM1677 gene, herein designated VGAM is inhibition of expression of VGAM1677 target genes. It is appreciated that specific functions, and accordingly utilities, of VGAM1677 correlate with, and may be deduced from, the identity of the target genes which VGAM1677 binds and inhibits, and the function of these target genes, as elaborated hereinbelow.

Cytochrome P450, 51 (lanosterol 14-alpha-demethylase) (CYP51, Accession NM_000786) is a VGAM1677 host target gene. CYP51 BINDING SITE is HOST TARGET binding site found in the 5' untranslated region of mRNA encoded by CYP51, corresponding to a HOST TARGET binding site such as BINDING SITE I, BINDING SITE II or BINDING SITE III. Table 2 illustrates the complementarity of the nucleotide sequences of CYP51 BINDING SITE, designated SEQ ID:6436, to the nucleotide sequence of VGAM1677 RNA, herein designated VGAM RNA, also designated SEQ ID:4388.

A function of VGAM1677 is therefore inhibition of Cytochrome P450, 51 (lanosterol 14-alpha-demethylase) (CYP51, Accession NM_000786). Accordingly, utilities of VGAM1677 include diagnosis, prevention and treatment of diseases and clinical conditions associated with CYP51. Deoxyribonuclease I-like 1 (DNASE1L1, Accession NM_006730) is another VGAM1677 host target gene. DNASE1L1 BINDING SITE is HOST TARGET binding site found in the 3' untranslated region of mRNA encoded by DNASE1L1, corresponding to a HOST TARGET binding site such as BINDING SITE I, BINDING SITE II or BINDING SITE III. Table 2 illustrates the complementarity of the nucleotide sequences of DNASE1L1 BINDING SITE, designated SEQ ID:13566, to the nucleotide sequence of VGAM1677 RNA, herein designated VGAM RNA, also designated SEQ ID:4388.

Another function of VGAM1677 is therefore inhibition of Deoxyribonuclease I-like 1 (DNASE1L1, Accession NM_006730), a gene which seems to be involved in cell death. Accordingly, utilities of VGAM1677 include diagnosis, prevention and treatment of diseases and clinical conditions associated with DNASE1L1. The function of DNASE1L1 and its association with various diseases and clinical conditions, has been established by previous studies, as described hereinabove with reference to VGAM885. ELK3, ETS-domain Protein (SRF accessory protein 2) (ELK3, Accession NM_005230) is another VGAM1677 host target gene. ELK3 BINDING SITE is HOST TARGET binding site found in the 5' untranslated region of mRNA encoded by ELK3, corresponding to a HOST TARGET binding site such as BINDING SITE I, BINDING SITE II or BINDING SITE III. Table 2 illustrates the complementarity of the nucleotide sequences of ELK3 BINDING SITE, designated SEQ ID:11733, to the nucleotide sequence of VGAM1677 RNA, herein designated VGAM RNA, also designated SEQ ID:4388.

Another function of VGAM1677 is therefore inhibition of ELK3, ETS-domain Protein (SRF accessory protein 2) (ELK3, Accession NM_005230), a gene which may be a negative regulator of transcription but can activate transcription when coexpressed with ras, src or mos. Accordingly, utilities of VGAM1677 include diagnosis, prevention and treatment of diseases and clinical conditions associated with ELK3. The function of ELK3 has been established by previous studies. The ETS gene family encodes a group of proteins that function as transcription factors under physiologic conditions and, if aberrantly expressed, can cause cellular transformation. Lopez et al. (1994) cloned the gene for a new ETS-related transcription factor, which they called ERP for 'ETS-related protein,' from a murine pre-B cell line and from lung tissue. The ERP protein contained a region of high homology with the ETS DNA-binding domain common to all members of the ETS transcription factor/oncoprotein family. Within the B-cell lineage, ERP is highly expressed primarily at early stages of B-lymphocyte development, and expression declines drastically upon B-cell maturation, correlating with the activity of the enhancer of immunoglobulin heavy chain. The data suggested that ERP plays a role in both B-cell development and IgH gene regulation. Giovane et al. (1994) identified the same ETS family member, which they designated Net, from Ras-transformed mouse fibroblasts using PCR primers based on the nucleotide sequence corresponding to the most conserved amino acids of the ETS domain. They subsequently obtained a complete cDNA sequence. The predicted Net protein contains an ETS domain at the amino terminus that is about 80% similar to the human ELK1 (OMIM Ref. No. 311040) and ELK4 (OMIM Ref. No. 600246) sequences. The authors noted that 2 other domains also show significant similarity to regions of these proteins, and that the 3 genes clearly belong to the ELK family. Two mRNAs of 2.5 and 4.5 kb were detected by Northern blotting. Transcripts were found, at varying levels, in a large number of transformed cell lines and tissues. The authors showed that Net protein bound to ETS DNA motifs and could form complexes with SRF (OMIM Ref. No. 600589) on the fos serum response element. Using fluorescence in situ hybridization, Shipley et al. (1994) mapped ELK4 and ELK3 to 1q32 and 12q23, respectively. (The authors referred to ELK4 as SAP1 and to ELK3 as SAP2.) Tamai et al. (1995) mapped the Elk3 gene to mouse chromosome 10 and suggested that the human homolog (ELK3) may be located on 12q in the interval between bands q21 and q24 because of established homology of synteny with the mid-distal region of mouse chromosome 10. Giovane et al. (1995) mapped ELK3 to human 12q22-q23 and to mouse 10C-D1 by in situ hybridization.

Full details of the abovementioned studies are described in the following publications, the disclosure of which are hereby incorporated by reference:

Giovane, A.; Pintzas, A.; Maira, S.-M.; Sobieszczuk, P.; Wasylyk, B.: Net, a new ets transcription factor that is activated by Ras. Genes Dev. 8:1502-1513, 1994; and Giovane, A.; Sobieszczuk, P.; Mignon, C.; Mattei, M.-G.; Wasylyk, B.: Locations of the ets subfamily members net, elk1, and sap1 (ELK3, ELK1, and ELK4) on three homologous regions of t.

Further studies establishing the function and utilities of ELK3 are found in John Hopkins OMIM database record ID 600247, and in sited publications numbered 7921, 862 and 8630 listed in the bibliography section hereinbelow, which are also hereby incorporated by reference. Ectonucleotide Pyrophosphatase/phosphodiesterase 3 (ENPP3, Accession NM_005021) is another VGAM1677 host target gene. ENPP3 BINDING SITE is HOST TARGET binding site found in the 3' untranslated region of mRNA encoded by ENPP3, corresponding to a HOST TARGET binding site such as BINDING SITE I, BINDING SITE II or BINDING SITE III. Table 2 illustrates the complementarity of the nucleotide sequences of ENPP3 BINDING SITE, designated SEQ ID:11462, to the nucleotide sequence of VGAM1677 RNA, herein designated VGAM RNA, also designated SEQ ID:4388.

Another function of VGAM1677 is therefore inhibition of Ectonucleotide Pyrophosphatase/phosphodiesterase 3 (ENPP3, Accession NM_005021). Accordingly, utilities of VGAM1677 include diagnosis, prevention and treatment of diseases and clinical conditions associated with ENPP3. Glucagon Receptor (GCGR, Accession NM_000160) is another VGAM1677 host target gene. GCGR BINDING SITE is HOST TARGET binding site found in the 5' untranslated region of mRNA encoded by GCGR, corresponding to a HOST TARGET binding site such as BINDING SITE I, BINDING SITE II or BINDING SITE III. Table 2 illustrates the complementarity of the nucleotide sequences of GCGR BINDING SITE, designated SEQ ID:5664, to the nucleotide sequence of VGAM1677 RNA, herein designated VGAM RNA, also designated SEQ ID:4388.

Another function of VGAM1677 is therefore inhibition of Glucagon Receptor (GCGR, Accession NM_000160), a gene which controls the rate of hepatic glucose production and insulin secretion. Accordingly, utilities of VGAM1677 include diagnosis, prevention and treatment of diseases and clinical conditions associated with GCGR. The function of GCGR has been established by previous studies. Hager et al. (1995) reported the association of a single heterozygous gly-to-ser missense mutation in the glucagon receptor gene with late-onset noninsulin-dependent diabetes mellitus (OMIM Ref. No. 125853). In a pooled set of French and Sardinian patients, the gly40-to-ser mutation showed association with NIDDM (chi square=14.4, P=0.0001). In 18 sibships from 9 French pedigrees, some evidence for linkage to diabetes was found. Receptor binding studies using cultured cells expressing the gly40-to-ser mutation demonstrated that this mutation results in a receptor that binds glucagon with a 3-fold lower affinity compared to the wildtype receptor. The physiologic effects of glucagon (GCG; 138030) are mediated through the glucagon receptor, a 480-amino acid protein that is a member of the superfamily of receptors characterized by a 7 transmembrane domain structure and by their coupling via GTP-binding proteins (G-proteins) to adenyl cyclase. Menzel et al. (1994) cloned human glucagon receptor cDNA and demonstrated 85% nucleotide and 91% amino acid identity with the rat sequence. By fluorescence in situ hybridization, they localized the GCGR gene to 17q25. An Alu variable poly (A) DNA polymorphism was identified in the gene. Use of the polymorphism in a study of CEPH families showed linkage between the polymorphism and markers localized to distal 17q. The receptor for glucagon-like peptide-1 (GLP1R; 138032), which is derived from the same preproglucagon molecule, has structural similarities but does not bind peptides of related structure and similar function, such as glucagon. Lok et al. (1994) isolated a cDNA encoding a complete functional human glucagon receptor from a liver cDNA library by a combination of polymerase chain reaction and colony hybridization. The cDNA encoded a protein that had 80% identity to rat glucagon receptor, bound (125-I)-labeled glucagon, and transduced a signal leading to increases in the concentration of intracellular cyclic AMP. Southern blot analysis of human DNA suggested the presence of a single GCGR locus. By in situ hybridization, Lok et al. (1994) mapped the GCGR locus to 17q25. Analysis of the genomic sequence showed that the coding region spans over 5.5 kb and is interrupted by 12 introns.

Full details of the abovementioned studies are described in the following publications, the disclosure of which are hereby incorporated by reference:

Hager, J.; Hansen, L.; Vaisse, C.; Vionnet, N.; Philippi, A.; Poller, W.; Velho, G.; Carcassi, C.; Contu, L.; Julier, C.; Cambien, F.; Passa, P.; Lathrop, M.; Kindsvogel, W.; Demenais, F.; Nishimura, E.; Froguel, P.: A missense mutation in the glucagon receptor gene is associated with non-insulin-dependent diabetes mellitus. Nature Genet. 9:299-304, 1995; and Lok, S.; Kuijper, J. L.; Jelinek, L. J.; Kramer, J. M.; Whitmore, T. E.; Sprecher, C. A.; Mathewes, S.; Grant, F. J.; Biggs, S. H.; Rosenberg, G. B.; Sheppard, P. O.; O'Hara, P. J.; Fos.

Further studies establishing the function and utilities of GCGR are found in John Hopkins OMIM database record ID 138033, and in sited publications numbered 335 and 3359-3361 listed in the bibliography section hereinbelow, which are also hereby incorporated by reference. Glutamate Receptor, Ionotropic, Kainate 3 (GRIK3, Accession NM_000831) is another VGAM1677 host target gene. GRIK3 BINDING SITE is HOST TARGET binding site found in the 3' untranslated region of mRNA encoded by GRIK3, corresponding to a HOST TARGET binding site such as BINDING SITE I, BINDING SITE II or BINDING SITE III. Table 2 illustrates the complementarity of the nucleotide sequences of GRIK3 BINDING SITE, designated SEQ ID:6485, to the nucleotide sequence of VGAM1677 RNA, herein designated VGAM RNA, also designated SEQ ID:4388.

Another function of VGAM1677 is therefore inhibition of Glutamate Receptor, Ionotropic, Kainate 3 (GRIK3, Accession NM_000831). Accordingly, utilities of VGAM1677 include diagnosis, prevention and treatment of diseases and clinical conditions associated with GRIK3. Intercellular Adhesion Molecule 1 (CD54), Human Rhinovirus Receptor (ICAM1, Accession XM_049518) is another VGAM1677 host target gene. ICAM1 BINDING SITE is HOST TARGET binding site found in the 3' untranslated region of mRNA encoded by ICAM1, corresponding to a HOST TARGET binding site such as BINDING SITE I, BINDING SITE II or BINDING SITE III. Table 2 illustrates the complementarity of the nucleotide sequences of ICAM1 BINDING SITE, designated SEQ ID:35442, to the nucleotide sequence of VGAM1677 RNA, herein designated VGAM RNA, also designated SEQ ID:4388.

Another function of VGAM1677 is therefore inhibition of Intercellular Adhesion Molecule 1 (CD54), Human Rhinovirus Receptor (ICAM1, Accession XM_049518), a gene which binds the integrin LFA-1 (ITGB2) and promotes adhesion; member of the immunoglobulin superfamily. Accordingly, utilities of VGAM1677 include diagnosis, prevention and treatment of diseases and clinical conditions associated with ICAM1. The function of ICAM1 has been established by previous studies. Intercellular adhesion molecule-1 (ICAM1) is a ligand for lymphocyte-function associated (LFA) antigens (see OMIM Ref. No. 116920). Simmons et al. (1988) analyzed a cDNA clone of the ICAM1 gene and found that it showed homology to the neural cell adhesion molecule NCAM (OMIM Ref. No. 116930). Greve et al. (1989) demonstrated that the ICAM1 protein is the major human rhinovirus receptor. Bella et al. (1998) analyzed the structural features of the ICAM1 molecule that underlie its function as a receptor for the major group of human rhinoviruses and as a ligand for LFA-1. Expression of HLA-DR antigen (see OMIM Ref. No. 142860) and ICAM1 in human conjunctival epithelium is upregulated in patients with dry eyes associated with Sjogren syndrome (OMIM Ref. No. 270150). Tsubota et al. (1999) reported that this upregulation in Sjogren syndrome patients may be controlled by interferon-gamma (OMIM Ref. No. 147570) through the activation of transcription factor NFKB (nuclear OMIM Ref. No. 164011). Pisella et al. (2000) reported that a significant increase of HLA-DR and ICAM1 expression by epithelial cells was consistently found in patients with keratoconjunctivitis sicca (Sjogren syndrome) compared with expression in normal eyes. These 2 markers were well correlated with each other and correlated inversely with tear break-up time and tear production as measured by the Schirmer test. The percentage of conjunctival goblet cells was significantly decreased in dry eye patients with a significant negative correlation with both HLA-DR and ICAM1 markers. Lu and Cyster (2002) studied the mechanisms that control localization of marginal zone B cells. They demonstrated that marginal zone B cells express elevated levels of the integrins LFA-1 (see OMIM Ref. No. 153370) and alpha-4-beta-1 (see OMIM Ref. No. 192975 and 135630), and that the marginal zone B cells bind to the ligands ICAM1 and VCAM1 (OMIM Ref. No. 192225). These ligands are expressed within the marginal zone in a lymphotoxin-dependent manner. Combined inhibition of LFA-1 and alpha-4-beta-1 causes a rapid and selective release of B cells from the marginal zone. Furthermore, lipopolysaccharide-triggered marginal zone B cell relocalization involves down regulation of integrin-mediated adhesion. Lu and Cyster (2002) concluded that their studies identified key requirements for marginal zone B cell localization and established a role for integrins in peripheral lymphoid tissue compartmentalization. Animal model experiments lend further support to the function of ICAM1. To test the role of Icam1 in intact animals, Sligh et al. (1993) disrupted the gene in murine embryonic stem cells by gene targeting. Homozygous deficient animals developed normally, were fertile, and had a moderate granulocytosis. Studies were consistent with complete loss of surface expression of the protein. Deficient mice exhibited prominent abnormalities of inflammatory responses including impaired neutrophil emigration in response to chemical peritonitis and decreased contact hypersensitivity to 2,4-dinitrofluorobenzene. Mutant cells provided negligible stimulation in the mixed lymphocyte reaction, although they proliferated normally as responder cells It is appreciated that the abovementioned animal model for ICAM1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sligh, J. E., Jr.; Ballantyne, C. M.; Rich, S. S.; Hawkins, H. K.; Smith, C. W.; Bradley, A.; Beaudet, A. L.: Inflammatory and immune responses are impaired in mice deficient in intercellular adhesion molecule 1. Proc. Nat. Acad. Sci. 90: 8529-8533, 1993; and Lu, T. T.; Cyster, J. G.: Integrin-mediated long-term B cell retention in the splenic marginal zone. Science 297:409-412, 2002.

Further studies establishing the function and utilities of ICAM1 are found in John Hopkins OMIM database record ID 147840, and in sited publications numbered 3045-3054, 11448, 4813, 3912, 471 and 11450 listed in the bibliography section hereinbelow, which are also hereby incorporated by reference. MAX Binding Protein (MNT, Accession NM_020310) is another VGAM1677 host target gene. MNT BINDING SITE is HOST TARGET binding site found in the 3' untranslated region of mRNA encoded by MNT, corresponding to a HOST TARGET binding site such as BINDING SITE I, BINDING SITE II or BINDING SITE III. Table 2 illustrates the complementarity of the nucleotide sequences of MNT BINDING SITE, designated SEQ ID:21559, to the nucleotide sequence of VGAM1677 RNA, herein designated VGAM RNA, also designated SEQ ID:4388.

Another function of VGAM1677 is therefore inhibition of MAX Binding Protein (MNT, Accession NM_020310). Accordingly, utilities of VGAM1677 include diagnosis, prevention and treatment of diseases and clinical conditions associated with MNT. Nitric Oxide Synthase 1 (neuronal) (NOS1, Accession NM_000620) is another VGAM1677 host target gene. NOS1 BINDING SITE is HOST TARGET binding site found in the 3' untranslated region of mRNA encoded by NOS1, corresponding to a HOST TARGET binding site such as BINDING SITE I, BINDING SITE II or BINDING SITE III. Table 2 illustrates the complementarity of the nucleotide sequences of NOS1 BINDING SITE, designated SEQ ID:6230, to the nucleotide sequence of VGAM1677 RNA, herein designated VGAM RNA, also designated SEQ ID:4388.

Another function of VGAM1677 is therefore inhibition of Nitric Oxide Synthase 1 (neuronal) (NOS1, Accession NM_000620), a gene which produces nitric oxide (no) which is a messenger molecule with diverse functions throughout the body. Accordingly, utilities of VGAM1677 include diagnosis, prevention and treatment of diseases and clinical conditions associated with NOS1. The function of NOS1 and its association with various diseases and clinical conditions, has been established by previous studies, as described hereinabove with reference to VGAM323. Aminopeptidase Puromycin Sensitive (NPEPPS, Accession NM_006310) is another VGAM1677 host target gene. NPEPPS BINDING SITE is HOST TARGET binding site found in the 3' untranslated region of mRNA encoded by NPEPPS, corresponding to a HOST TARGET binding site such as BINDING SITE I, BINDING SITE II or BINDING SITE III. Table 2 illustrates the complementarity of the nucleotide sequences of NPEPPS BINDING SITE, designated SEQ ID:12997, to the nucleotide sequence of VGAM1677 RNA, herein designated VGAM RNA, also designated SEQ ID:4388.

Another function of VGAM1677 is therefore inhibition of Aminopeptidase Puromycin Sensitive (NPEPPS, Accession NM_006310), a gene which is puromycin-sensitive aminopeptidase and has metallopeptidase activity. Accordingly, utilities of VGAM1677 include diagnosis, prevention and treatment of diseases and clinical conditions associated with NPEPPS. The function of NPEPPS and its association with various diseases and clinical conditions, has been established by previous studies, as described hereinabove with reference to VGAM83. Neurogranin (protein kinase C substrate, RC3) (NRGN, Accession NM_006176) is another VGAM1677 host target gene. NRGN BINDING SITE is HOST TARGET binding site found in the 5' untranslated region of mRNA encoded by NRGN, corresponding to a HOST TARGET binding site such as BINDING SITE I, BINDING SITE II or BINDING SITE III. Table 2 illustrates the complementarity of the nucleotide sequences of NRGN BINDING SITE, designated SEQ ID:12835, to the nucleotide sequence of VGAM1677 RNA, herein designated VGAM RNA, also designated SEQ ID:4388.

Another function of VGAM1677 is therefore inhibition of Neurogranin (protein kinase C substrate, RC3) (NRGN, Accession NM_006176), a gene which acts as a "third messenger" substrate of protein kinase c-mediated molecular cascades during synaptic development and remodeling. Accordingly, utilities of VGAM1677 include diagnosis, prevention and treatment of diseases and clinical conditions associated with NRGN. The function of NRGN has been established by previous studies. Neurogranin is a brain-specific protein expressed in telencephalic neurons. Neurogranin was first identified by Baudier et al. (1991) from bovine forebrain. Baudier et al. (1991) showed that, like GAP43 (OMIM Ref. No. 162060), rat neurogranin, also called p17 or RC3, is phosphorylated by protein kinase C (see OMIM Ref. No. 176960) and binds calmodulin in the absence of calcium. Martinez de Arrieta et al. (1997) cloned human neurogranin by screening a placental genomic library with the homologous rat cDNA. The 78-amino acid human protein is 96% identical to rat neurogranin. On Northern blots of human tissues, Martinez de Arrieta et al. (1997) detected neurogranin expression only in brain. Martinez de Arrieta et al. (1997) localized the neurogranin gene to 11q24 based on its inclusion within a YAC from that region. In the rat brain, neurogranin is under thyroid hormone control in specific neuronal subsets in both developing and adult animals. To evaluate whether the human gene is also a target of thyroid hormone, Martinez de Arrieta et al. (1999) searched for T3-responsive elements in NRGN cloned genomic fragments spanning the whole gene. A T3 receptor-binding site was found in the first intron, 3,000 bp downstream from the origin of transcription. Further data reported by Martinez de Arrieta et al. (1999) suggested that NRGN is a direct target for thyroid hormone in human brain, and that control of expression of this gene could underlay many of the consequences of hypothyroidism on mental states during development as well as in adult subjects.

Full details of the abovementioned studies are described in the following publications, the disclosure of which are hereby incorporated by reference:

Baudier, J.; Deloulme, J. C.; Van Dorsselaer, A.; Black, D.; Matthes, H. W. D.: Purification and characterization of a brain-specific protein kinase C substrate, neurogranin (p17): identification of a consensus amino acid sequence between neurogranin and neuromodulin (GAP43) that corresponds to the protein kinase C phosphorylation site and the calmodulin-binding domain. J. Biol. Chem. 266: 229-237, 1991; and Martinez de Arrieta, C.; Morte, B.; Coloma, A.; Bernal, J.: The human RC3 gene homolog, NRGN contains a thyroid hormone-responsive element located in the first intron. Endocrinology 14.

Further studies establishing the function and utilities of NRGN are found in John Hopkins OMIM database record ID 602350, and in sited publications numbered 1017-1014 listed in the bibliography section hereinbelow, which are also hereby incorporated by reference. P53AIP1 (Accession NM_022112) is another VGAM1677 host target gene. P53AIP1 BINDING SITE is HOST TARGET binding site found in the 3' untranslated region of mRNA encoded by P53AIP1, corresponding to a HOST TARGET binding site such as BINDING SITE I, BINDING SITE II or BINDING SITE III. Table 2 illustrates the complementarity of the nucleotide sequences of P53AIP1 BINDING SITE, designated SEQ ID:22659, to the nucleotide sequence of VGAM1677 RNA, herein designated VGAM RNA, also designated SEQ ID:4388.

Another function of VGAM1677 is therefore inhibition of P53AIP1 (Accession NM_022112). Accordingly, utilities of VGAM1677 include diagnosis, prevention and treatment of diseases and clinical conditions associated with P53AIP1. Polycystic Kidney and Hepatic Disease 1 (autosomal recessive) (PKHD1, Accession NM_138694) is another VGAM1677 host target gene. PKHD1 BINDING SITE is HOST TARGET binding site found in the 3' untranslated region of mRNA encoded by PKHD1, corresponding to a HOST TARGET binding site such as BINDING SITE I, BINDING SITE II or BINDING SITE III. Table 2 illustrates the complementarity of the nucleotide sequences of PKHD1 BINDING SITE, designated SEQ ID:28940, to the nucleotide sequence of VGAM1677 RNA, herein designated VGAM RNA, also designated SEQ ID:4388.

Another function of VGAM1677 is therefore inhibition of Polycystic Kidney and Hepatic Disease 1 (autosomal recessive) (PKHD1, Accession NM_138694). Accordingly, utilities of VGAM1677 include diagnosis, prevention and treatment of diseases and clinical conditions associated with PKHD1. Vasoactive Intestinal Peptide Receptor 1 (VIPR1, Accession NM_004624) is another VGAM1677 host target gene. VIPR1 BINDING SITE is HOST TARGET binding site found in the 3' untranslated region of mRNA encoded by VIPR1, corresponding to a HOST TARGET binding site such as BINDING SITE I, BINDING SITE II or BINDING SITE III. Table 2 illustrates the complementarity of the nucleotide sequences of VIPR1 BINDING SITE, designated SEQ ID:10995, to the nucleotide sequence of VGAM1677 RNA, herein designated VGAM RNA, also designated SEQ ID:4388.

Another function of VGAM1677 is therefore inhibition of Vasoactive Intestinal Peptide Receptor 1 (VIPR1, Accession NM_004624), a gene which binds vip and is mediated by g proteins which activate adenylyl cyclase. Accordingly, utilities of VGAM1677 include diagnosis, prevention and treatment of diseases and clinical conditions associated with VIPR1. The function of VIPR1 and its association with various diseases and clinical conditions, has been established by previous studies, as described hereinabove with reference to VGAM548. Apolipoprotein L, 6 (APOL6, Accession NM_030641) is another VGAM1677 host target gene. APOL6 BINDING SITE is HOST TARGET binding site found in the 5' untranslated region of mRNA encoded by APOL6, corresponding to a HOST TARGET binding site such as BINDING SITE I, BINDING SITE II or BINDING SITE III. Table 2 illustrates the complementarity of the nucleotide sequences of APOL6 BINDING SITE, designated SEQ ID:24970, to the nucleotide sequence of VGAM1677 RNA, herein designated VGAM RNA, also designated SEQ ID:4388.

Another function of VGAM1677 is therefore inhibition of Apolipoprotein L, 6 (APOL6, Accession NM_030641). Accordingly, utilities of VGAM1677 include diagnosis, prevention and treatment of diseases and clinical conditions associated with APOL6. FLJ20435 (Accession NM_017821) is another VGAM1677 host target gene. FLJ20435 BINDING SITE is HOST TARGET binding site found in the 3' untranslated region of mRNA encoded by FLJ20435, corresponding to a HOST TARGET binding site such as BINDING SITE I, BINDING SITE II or BINDING SITE III. Table 2 illustrates the complementarity of the nucleotide sequences of FLJ20435 BINDING SITE, designated SEQ ID:19468, to the nucleotide sequence of VGAM1677 RNA, herein designated VGAM RNA, also designated SEQ ID:4388.

Another function of VGAM1677 is therefore inhibition of FLJ20435 (Accession NM_017821). Accordingly, utilities of VGAM1677 include diagnosis, prevention and treatment of diseases and clinical conditions associated with FLJ20435. KIAA0247 (Accession NM_014734) is another VGAM1677 host target gene. KIAA0247 BINDING SITE is HOST TARGET binding site found in the 3' untranslated region of mRNA encoded by KIAA0247, corresponding to a HOST TARGET binding site such as BINDING SITE I, BINDING SITE II or BINDING SITE III. Table 2 illustrates the complementarity of the nucleotide sequences of KIAA0247 BINDING SITE, designated SEQ ID:16373, to the nucleotide sequence of VGAM1677 RNA, herein designated VGAM RNA, also designated SEQ ID:4388.

Another function of VGAM1677 is therefore inhibition of KIAA0247 (Accession NM_014734). Accordingly, utilities of VGAM1677 include diagnosis, prevention and treatment of diseases and clinical conditions associated with KIAA0247. KIAA0368 (Accession XM_036708) is another VGAM1677 host target gene. KIAA0368 BINDING SITE is HOST TARGET binding site found in the 3' untranslated region of mRNA encoded by KIAA0368, corresponding to a HOST TARGET binding site such as BINDING SITE I, BINDING SITE II or BINDING SITE III. Table 2 illustrates the complementarity of the nucleotide sequences of KIAA0368 BINDING SITE, designated SEQ ID:32490, to the nucleotide sequence of VGAM1677 RNA, herein designated VGAM RNA, also designated SEQ ID:4388.

Another function of VGAM1677 is therefore inhibition of KIAA0368 (Accession XM_036708). Accordingly, utilities of VGAM1677 include diagnosis, prevention and treatment of diseases and clinical conditions associated with KIAA0368. MGC11115 (Accession NM_032310) is another VGAM1677 host target gene. MGC11115 BINDING SITE is HOST TARGET binding site found in the 3' untranslated region of mRNA encoded by MGC11115, corresponding to a HOST TARGET binding site such as BINDING SITE I, BINDING SITE II or BINDING SITE III. Table 2 illustrates the complementarity of the nucleotide sequences of MGC11115 BINDING SITE, designated SEQ ID:26099, to the nucleotide sequence of VGAM1677 RNA, herein designated VGAM RNA, also designated SEQ ID:4388.

Another function of VGAM1677 is therefore inhibition of MGC11115 (Accession NM_032310). Accordingly, utilities of VGAM1677 include diagnosis, prevention and treatment of diseases and clinical conditions associated with MGC11115. Nucleoredoxin (NXN, Accession NM_022463) is another VGAM1677 host target gene. NXN BINDING SITE is HOST TARGET binding site found in the 3' untranslated region of mRNA encoded by NXN, corresponding to a HOST TARGET binding site such as BINDING SITE I, BINDING SITE II or BINDING SITE III. Table 2 illustrates the complementarity of the nucleotide sequences of NXN BINDING SITE, designated SEQ ID:22807, to the nucleotide sequence of VGAM1677 RNA, herein designated VGAM RNA, also designated SEQ ID:4388.

Another function of VGAM1677 is therefore inhibition of Nucleoredoxin (NXN, Accession NM_022463). Accordingly, utilities of VGAM1677 include diagnosis, prevention and treatment of diseases and clinical conditions associated with NXN. Neurexophilin 3 (NXPH3, Accession XM_037847) is another VGAM1677 host target gene. NXPH3 BINDING SITE is HOST TARGET binding site found in the 3' untranslated region of mRNA encoded by NXPH3, corresponding to a HOST TARGET binding site such as BINDING SITE I, BINDING SITE II or BINDING SITE III. Table 2 illustrates the complementarity of the nucleotide sequences of NXPH3 BINDING SITE, designated SEQ ID:32717, to the nucleotide sequence of VGAM1677 RNA, herein designated VGAM RNA, also designated SEQ ID:4388.

Another function of VGAM1677 is therefore inhibition of Neurexophilin 3 (NXPH3, Accession XM_037847). Accordingly, utilities of VGAM1677 include diagnosis, prevention and treatment of diseases and clinical conditions associated with NXPH3. poly (rC) Binding Protein 3 (PCBP3, Accession NM_020528) is another VGAM1677 host target gene. PCBP3 BINDING SITE is HOST TARGET binding site found in the 3' untranslated region of mRNA encoded by PCBP3, corresponding to a HOST TARGET binding site such as BINDING SITE I, BINDING SITE II or BINDING SITE III. Table 2 illustrates the complementarity of the nucleotide sequences of PCBP3 BINDING SITE, designated SEQ ID:21751, to the nucleotide sequence of VGAM1677 RNA, herein designated VGAM RNA, also designated SEQ ID:4388.

Another function of VGAM1677 is therefore inhibition of poly (rC) Binding Protein 3 (PCBP3, Accession NM_020528). Accordingly, utilities of VGAM1677 include diagnosis, prevention and treatment of diseases and clinical conditions associated with PCBP3. Retinoic Acid Induced 15 (RAI15, Accession XM_039548) is another VGAM1677 host target gene. RAI15 BINDING SITE is HOST TARGET binding site found in the 3' untranslated region of mRNA encoded by RAI15, corresponding to a HOST TARGET binding site such as BINDING SITE I, BINDING SITE II or BINDING SITE III. Table 2 illustrates the complementarity of the nucleotide sequences of RAI15 BINDING SITE, designated SEQ ID:33119, to the nucleotide sequence of VGAM1677 RNA, herein designated VGAM RNA, also designated SEQ ID:4388.

Another function of VGAM1677 is therefore inhibition of Retinoic Acid Induced 15 (RAI15, Accession XM_039548). Accordingly, utilities of VGAM1677 include diagnosis, prevention and treatment of diseases and clinical conditions associated with RAI15. Sideroflexin 5 (SFXN5, Accession NM_144579) is another VGAM1677 host target gene. SFXN5 BINDING SITE is HOST TARGET binding site found in the 3' untranslated region of mRNA encoded by SFXN5, corresponding to a HOST TARGET binding site such as BINDING SITE I, BINDING SITE II or BINDING SITE III. Table 2 illustrates the complementarity of the nucleotide sequences of SFXN5 BINDING SITE, designated SEQ ID:29388, to the nucleotide sequence of VGAM1677 RNA, herein designated VGAM RNA, also designated SEQ ID:4388.

Another function of VGAM1677 is therefore inhibition of Sideroflexin 5 (SFXN5, Accession NM_144579). Accordingly, utilities of VGAM1677 include diagnosis, prevention and treatment of diseases and clinical conditions associated with SFXN5. SMOC1 (Accession NM_022137) is another VGAM1677 host target gene. SMOC1 BINDING SITE is HOST TARGET binding site found in the 3' untranslated region of mRNA encoded by SMOC1, corresponding to a HOST TARGET binding site such as BINDING SITE I, BINDING SITE II or BINDING SITE III. Table 2 illustrates the complementarity of the nucleotide sequences of SMOC1 BINDING SITE, designated SEQ ID:22700, to the nucleotide sequence of VGAM1677 RNA, herein designated VGAM RNA, also designated SEQ ID:4388.

Another function of VGAM1677 is therefore inhibition of SMOC1 (Accession NM_022137). Accordingly, utilities of VGAM1677 include diagnosis, prevention and treatment of diseases and clinical conditions associated with SMOC1. LOC144519 (Accession XM_084890) is another VGAM1677 host target gene. LOC144519 BINDING SITE is HOST TARGET binding site found in the 5' untranslated region of mRNA encoded by LOC144519, corresponding to a HOST TARGET binding site such as BINDING SITE I, BINDING SITE II or BINDING SITE III. Table 2 illustrates the complementarity of the nucleotide sequences of LOC144519 BINDING SITE, designated SEQ ID:37759, to the nucleotide sequence of VGAM1677 RNA, herein designated VGAM RNA, also designated SEQ ID:4388.

Another function of VGAM1677 is therefore inhibition of LOC144519 (Accession XM_084890). Accordingly, utilities of VGAM1677 include diagnosis, prevention and treatment of diseases and clinical conditions associated with LOC144519. LOC144866 (Accession XM_096699) is another VGAM1677 host target gene. LOC144866 BINDING SITE is HOST TARGET binding site found in the 5' untranslated region of mRNA encoded by LOC144866, corresponding to a HOST TARGET binding site such as BINDING SITE I, BINDING SITE II or BINDING SITE III. Table 2 illustrates the complementarity of the nucleotide sequences of LOC144866 BINDING SITE, designated SEQ ID:40477, to the nucleotide sequence of VGAM1677 RNA, herein designated VGAM RNA, also designated SEQ ID:4388.

Another function of VGAM1677 is therefore inhibition of LOC144866 (Accession XM_096699). Accordingly, utilities of VGAM1677 include diagnosis, prevention and treatment of diseases and clinical conditions associated with LOC144866. LOC149302 (Accession XM_086489) is another VGAM1677 host target gene. LOC149302 BINDING SITE is HOST TARGET binding site found in the 5' untranslated region of mRNA encoded by LOC149302, corresponding to a HOST TARGET binding site such as BINDING SITE I, BINDING SITE II or BINDING SITE III. Table 2 illustrates the complementarity of the nucleotide sequences of LOC149302 BINDING SITE, designated SEQ ID:38706, to the nucleotide sequence of VGAM1677 RNA, herein designated VGAM RNA, also designated SEQ ID:4388.

Another function of VGAM1677 is therefore inhibition of LOC149302 (Accession XM_086489). Accordingly, utilities of VGAM1677 include diagnosis, prevention and treatment of diseases and clinical conditions associated with LOC149302. LOC149373 (Accession XM_086507) is another VGAM1677 host target gene. LOC149373 BINDING SITE is HOST TARGET binding site found in the 3' untranslated region of mRNA encoded by LOC149373, corresponding to a HOST TARGET binding site such as BINDING SITE I, BINDING SITE II or BINDING SITE III. Table 2 illustrates the complementarity of the nucleotide sequences of LOC149373 BINDING SITE, designated SEQ ID:38719, to the nucleotide sequence of VGAM1677 RNA, herein designated VGAM RNA, also designated SEQ ID:4388.

Another function of VGAM1677 is therefore inhibition of LOC149373 (Accession XM_086507). Accordingly, utilities of VGAM1677 include diagnosis, prevention and treatment of diseases and clinical conditions associated with LOC149373. LOC150685 (Accession XM_103563) is another VGAM1677 host target gene. LOC150685 BINDING SITE is HOST TARGET binding site found in the 5' untranslated region of mRNA encoded by LOC150685, corresponding to a HOST TARGET binding site such as BINDING SITE I, BINDING SITE II or BINDING SITE III. Table 2 illustrates the complementarity of the nucleotide sequences of LOC150685 BINDING SITE, designated SEQ ID:42155, to the nucleotide sequence of VGAM1677 RNA, herein designated VGAM RNA, also designated SEQ ID:4388.

Another function of VGAM1677 is therefore inhibition of LOC150685 (Accession XM_103563). Accordingly, utilities of VGAM1677 include diagnosis, prevention and treatment of diseases and clinical conditions associated with LOC150685. LOC152274 (Accession XM_087418) is another VGAM1677 host target gene. LOC152274 BINDING SITE is HOST TARGET binding site found in the 3' untranslated region of mRNA encoded by LOC152274, corresponding to a HOST TARGET binding site such as BINDING SITE I, BINDING SITE II or BINDING SITE III. Table 2 illustrates the complementarity of the nucleotide sequences of LOC152274 BINDING SITE, designated SEQ ID:39235, to the nucleotide sequence of VGAM1677 RNA, herein designated VGAM RNA, also designated SEQ ID:4388.

Another function of VGAM1677 is therefore inhibition of LOC152274 (Accession XM_087418). Accordingly, utilities of VGAM1677 include diagnosis, prevention and treatment of diseases and clinical conditions associated with LOC152274. LOC163682 (Accession XM_099402) is another VGAM1677 host target gene. LOC163682 BINDING SITE is HOST TARGET binding site found in the 5' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42089, to the nucleotide sequence of VGAM1677 RNA, herein designated VGAM RNA, also designated SEQ ID:4388.

Another function of VGAM1677 is therefore inhibition of LOC163682 (Accession XM_099402). Accordingly, utilities of VGAM1677 include diagnosis, prevention and treatment of diseases and clinical conditions associated with LOC163682. LOC90906 (Accession XM_034809) is another VGAM1677 host target gene. LOC90906 BINDING SITE is HOST TARGET binding site found in the 5' untranslated region of mRNA encoded by LOC90906, corresponding to a HOST TARGET binding site such as BINDING SITE I, BINDING SITE II or BINDING SITE III. Table 2 illustrates the complementarity of the nucleotide sequences of LOC90906 BINDING SITE, designated SEQ ID:32148, to the nucleotide sequence of VGAM1677 RNA, herein designated VGAM RNA, also designated SEQ ID:4388.

Another function of VGAM1677 is therefore inhibition of LOC90906 (Accession XM_034809). Accordingly, utilities of VGAM1677 include diagnosis, prevention and treatment of diseases and clinical conditions associated with LOC90906. LOC91445 (Accession XM_018516) is another VGAM1677 host target gene. LOC91445 BINDING SITE is HOST TARGET binding site found in the 3' untranslated region of mRNA encoded by LOC91445, corresponding to a HOST TARGET binding site such as BINDING SITE I, BINDING SITE II or BINDING SITE III. Table 2 illustrates the complementarity of the nucleotide sequences of LOC91445 BINDING SITE, designated SEQ ID:30367, to the nucleotide sequence of VGAM1677 RNA, herein designated VGAM RNA, also designated SEQ ID:4388.

Another function of VGAM1677 is therefore inhibition of LOC91445 (Accession XM_018516). Accordingly, utilities of VGAM1677 include diagnosis, prevention and treatment of diseases and clinical conditions associated with LOC91445. FIG. 1 further provides a conceptual description of a novel bioinformatically detected viral gene of the present invention, referred to here as Viral Genomic Address Messenger 1678 (VGAM1678) viral gene, which modulates expression of respective host target genes thereof, the function and utility of which host target genes is known in the art.

VGAM1678 is a novel bioinformatically detected regulatory, non protein coding, viral micro RNA (miRNA) gene. The method by which VGAM1678 was detected is described hereinabove with reference to FIGS. 1-8.

VGAM1678 gene, herein designated VGAM GENE, is a viral gene contained in the genome of Viral Hemorrhagic Sep.icemia Virus. VGAM1678 host target gene, herein designated VGAM HOST TARGET GENE, is a human gene contained in the human genome.

VGAM1678 gene encodes a VGAM1678 precursor RNA, herein designated VGAM PRECURSOR RNA. Similar to other miRNA genes, and unlike most ordinary genes, VGAM1678 precursor RNA does not encode a protein. A nucleotide sequence identical or highly similar to the nucleotide sequence of VGAM1678 precursor RNA is designated SEQ ID:1664, and is provided hereinbelow with reference to the sequence listing part. Nucleotide sequence SEQ ID:1664 is located at position 10783 relative to the genome of Viral Hemorrhagic Sep.icemia Virus.

VGAM1678 precursor RNA folds onto itself, forming VGAM1678 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1678 folded precursor RNA into VGAM1678 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 87%) nucleotide sequence of VGAM1678 RNA is designated SEQ ID:4389, and is provided hereinbelow with reference to the sequence listing part.

VGAM1678 host target gene, herein designated VGAM HOST TARGET GENE, encodes a corresponding messenger RNA, VGAM1678 host target RNA, herein designated VGAM HOST TARGET RNA. VGAM1678 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1678 RNA, herein designated VGAM RNA, binds complementarily to one or more host target binding sites located in untranslated regions of VGAM1678 host target RNA, herein designated VGAM HOST TARGET RNA. This complementary binding is due to the fact that the nucleotide sequence of VGAM1678 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1678 RNA, herein designated VGAM RNA, may have a different number of host target binding sites in untranslated regions of a VGAM1678 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1678 RNA, herein designated VGAM RNA, to host target binding sites on VGAM1678 host target RNA, herein designated VGAM HOST TARGET RNA, such as BINDING SITE I, BINDING SITE II and BINDING SITE III, inhibits translation of VGAM1678 host target RNA into VGAM1678 host target protein, herein designated VGAM HOST TARGET PROTEIN. VGAM host target protein is therefore outlined by a broken line.

It is appreciated that VGAM1678 host target gene, herein designated VGAM HOST TARGET GENE, in fact represents a plurality of VGAM1678 host target genes. The mRNA of each one of this plurality of VGAM1678 host target genes comprises one or more host target binding sites, each having a nucleotide sequence which is at least partly complementary to VGAM1678 RNA, herein designated VGAM RNA, and which when bound by VGAM1678 RNA causes inhibition of translation of respective one or more VGAM1678 host target proteins.

It is further appreciated by one skilled in the art that the mode of translational inhibition illustrated by FIG. 1 with specific reference to translational inhibition exerted by VGAM1678 gene, herein designated VGAM GENE, on one or more VGAM1678 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1678 is inhibition of expression of host target genes, as part of a novel viral mechanism of attacking a host. Accordingly, utilities of VGAM1678 include diagnosis, prevention and treatment of viral infection by Viral Hemorrhagic Sep.icemia Virus. Specific functions, and accordingly utilities, of VGAM1678 correlate with, and may be deduced from, the identity of the host target genes which VGAM1678 binds and inhibits, and the function of these host target genes, as elaborated hereinbelow.

Nucleotide sequences of the VGAM1678 precursor RNA, herein designated VGAM PRECURSOR RNA, and of the 'diced' VGAM1678 RNA, herein designated VGAM RNA, and a schematic representation of the secondary folding of VGAM1678 folded precursor RNA, herein designated VGAM FOLDED PRECURSOR RNA, of VGAM1678 are further described hereinbelow with reference to Table 1.

Nucleotide sequences of host target binding sites, such as BINDING SITE-I, BINDING SITE-II and BINDING SITE-III of FIG. 1, found on VGAM1678 host target RNA, and schematic representation of the complementarity of each of these host target binding sites to VGAM1678 RNA, herein designated VGAM RNA, are described hereinbelow with reference to Table 2.

As mentioned hereinabove with reference to FIG. 1, a function of VGAM1678 gene, herein designated VGAM is inhibition of expression of VGAM1678 target genes. It is appreciated that specific functions, and accordingly utilities, of VGAM1678 correlate with, and may be deduced from, the identity of the target genes which VGAM1678 binds and inhibits, and the function of these target genes, as elaborated hereinbelow.

Phospholipase A2, Group IVC (cytosolic, calcium-independent) (PLA2G4C, Accession XM_055864) is a VGAM1678 host target gene. PLA2G4C BINDING SITE is HOST TARGET binding site found in the 5' untranslated region of mRNA encoded by PLA2G4C, corresponding to a HOST TARGET binding site such as BINDING SITE I, BINDING SITE II or BINDING SITE III. Table 2 illustrates the complementarity of the nucleotide sequences of PLA2G4C BINDING SITE, designated SEQ ID:36342, to the nucleotide sequence of VGAM1678 RNA, herein designated VGAM RNA, also designated SEQ ID:4389.

A function of VGAM1678 is therefore inhibition of Phospholipase A2, Group IVC (cytosolic, calcium-independent) (PLA2G4C, Accession XM_055864), a gene which hydrolyzes the phospholipid sn-2 ester bond. Accordingly, utilities of VGAM1678 include diagnosis, prevention and treatment of diseases and clinical conditions associated with PLA2G4C. The function of PLA2G4C has been established by previous studies. The cytosolic phospholipases A2 (OMIM Ref. No. cPLA2s) catalyze the release of certain fatty acids from phospholipids and play a role in a wide range of physiologic functions. By searching an EST database to identify sequences similar to cPLA2-alpha (OMIM Ref. No. 600522), Underwood et al. (1998) identified a novel PLA2 homolog, which they named cPLA2-gamma. They cloned the corresponding cDNA from a human skeletal muscle library. The cPLA2-gamma sequence predicts a 541-amino acid polypeptide with 28% identity to cPLA2-alpha. Expression studies showed that cPLA2-gamma liberates arachidonate from phospholipid, cleaving at either sn-1 or sn-2 sites. cPLA2-gamma is prenylated, membrane-associated, and calcium-independent. Northern blot analysis revealed that cPLA2-gamma is expressed as a 3-kb mRNA most abundantly in skeletal muscle and heart, with lower levels in several other tissues. Using STS analysis, Pickard et al. (1999) mapped the PLA2G4C gene to chromosome 19.

Full details of the abovementioned studies are described in the following publications, the disclosure of which are hereby incorporated by reference:

Pickard, R. T.; Strifler, B. A.; Kramer, R. M.; Sharp, J. D.: Molecular cloning of two new human paralogs of 85-kDa cytosolic phospholipase A2. J. Biol. Chem. 274:8823-8831, 1999; and Underwood, K. W.; Song, C.; Kriz, R. W.; Chang, X. J.; Knopf, J. L.; Lin, L.-L.: A novel calcium-independent phospholipase A(2), cPLA(2)-gamma, that is prenylated and contains homolog.

Further studies establishing the function and utilities of PLA2G4C are found in John Hopkins OMIM database record ID 603602, and in sited publications numbered 4893 listed in the bibliography section hereinbelow, which are also hereby incorporated by reference. Sel-1 Suppressor of Lin-12-like (C. elegans) (SEL1L, Accession NM_005065) is another VGAM1678 host target gene. SEL1L BINDING SITE is HOST TARGET binding site found in the 3' untranslated region of mRNA encoded by SEL1L, corresponding to a HOST TARGET binding site such as BINDING SITE I, BINDING SITE II or BINDING SITE III. Table 2 illustrates the complementarity of the nucleotide sequences of SEL1L BINDING SITE, designated SEQ ID:11503, to the nucleotide sequence of VGAM1678 RNA, herein designated VGAM RNA, also designated SEQ ID:4389.

Another function of VGAM1678 is therefore inhibition of Sel-1 Suppressor of Lin-12-like (C. elegans) (SEL1L, Accession NM_005065), a gene which may play a role in notch signaling (by similarity). Accordingly, utilities of VGAM1678 include diagnosis, prevention and treatment of diseases and clinical conditions associated with SEL1L. The function of SEL1L and its association with various diseases and clinical conditions, has been established by previous studies, as described hereinabove with reference to VGAM245. Baculoviral IAP Repeat-containing 8 (BIRC8, Accession NM_033341) is another VGAM1678 host target gene. BIRC8 BINDING SITE is HOST TARGET binding site found in the 5' untranslated region of mRNA encoded by BIRC8, corresponding to a HOST TARGET binding site such as BINDING SITE I, BINDING SITE II or BINDING SITE III. Table 2 illustrates the complementarity of the nucleotide sequences of BIRC8 BINDING SITE, designated SEQ ID:27194, to the nucleotide sequence of VGAM1678 RNA, herein designated VGAM RNA, also designated SEQ ID:4389.

Another function of VGAM1678 is therefore inhibition of Baculoviral IAP Repeat-containing 8 (BIRC8, Accession NM_033341). Accordingly, utilities of VGAM1678 include diagnosis, prevention and treatment of diseases and clinical conditions associated with BIRC8. C1q and Tumor Necrosis Factor Related Protein 7 (C1QTNF7, Accession NM_031911) is another VGAM1678 host target gene. C1QTNF7 BINDING SITE is HOST TARGET binding site found in the 3' untranslated region of mRNA encoded by C1QTNF7, corresponding to a HOST TARGET binding site such as BINDING SITE I, BINDING SITE II or BINDING SITE III. Table 2 illustrates the complementarity of the nucleotide sequences of C1QTNF7 BINDING SITE, designated SEQ ID:25666, to the nucleotide sequence of VGAM1678 RNA, herein designated VGAM RNA, also designated SEQ ID:4389.

Another function of VGAM1678 is therefore inhibition of C1q and Tumor Necrosis Factor Related Protein 7 (C1QTNF7, Accession NM_031911). Accordingly, utilities of VGAM1678 include diagnosis, prevention and treatment of diseases and clinical conditions associated with C1QTNF7. DKFZp547I224 (Accession NM_020221) is another VGAM1678 host target gene. DKFZp547I224 BINDING SITE is HOST TARGET binding site found in the 3' untranslated region of mRNA encoded by DKFZp547I224, corresponding to a HOST TARGET binding site such as BINDING SITE I, BINDING SITE II or BINDING SITE III. Table 2 illustrates the complementarity of the nucleotide sequences of DKFZp547I224 BINDING SITE, designated SEQ ID:21478, to the nucleotide sequence of VGAM1678 RNA, herein designated VGAM RNA, also designated SEQ ID:4389.

Another function of VGAM1678 is therefore inhibition of DKFZp547I224 (Accession NM_020221). Accordingly, utilities of VGAM1678 include diagnosis, prevention and treatment of diseases and clinical conditions associated with DKFZp547I224. FLJ10120 (Accession NM_018001) is another VGAM1678 host target gene. FLJ10120 BINDING SITE is HOST TARGET binding site found in the 3' untranslated region of mRNA encoded by FLJ10120, corresponding to a HOST TARGET binding site such as BINDING SITE I, BINDING SITE II or BINDING SITE III. Table 2 illustrates the complementarity of the nucleotide sequences of FLJ10120 BINDING SITE, designated SEQ ID:19729, to the nucleotide sequence of VGAM1678 RNA, herein designated VGAM RNA, also designated SEQ ID:4389.

Another function of VGAM1678 is therefore inhibition of FLJ10120 (Accession NM_018001). Accordingly, utilities of VGAM1678 include diagnosis, prevention and treatment of diseases and clinical conditions associated with FLJ10120. FLJ11783 (Accession NM_024891) is another VGAM1678 host target gene. FLJ11783 BINDING SITE is HOST TARGET binding site found in the 3' untranslated region of mRNA encoded by FLJ11783, corresponding to a HOST TARGET binding site such as BINDING SITE I, BINDING SITE II or BINDING SITE III. Table 2 illustrates the complementarity of the nucleotide sequences of FLJ11783 BINDING SITE, designated SEQ ID:24365, to the nucleotide sequence of VGAM1678 RNA, herein designated VGAM RNA, also designated SEQ ID:4389.

Another function of VGAM1678 is therefore inhibition of FLJ11783 (Accession NM_024891). Accordingly, utilities of VGAM1678 include diagnosis, prevention and treatment of diseases and clinical conditions associated with FLJ11783. FLJ22174 (Accession NM_021945) is another VGAM1678 host target gene. FLJ22174 BINDING SITE is HOST TARGET binding site found in the 5' untranslated region of mRNA encoded by FLJ22174, corresponding to a HOST TARGET binding site such as BINDING SITE I, BINDING SITE II or BINDING SITE III. Table 2 illustrates the complementarity of the nucleotide sequences of FLJ22174 BINDING SITE, designated SEQ ID:22467, to the nucleotide sequence of VGAM1678 RNA, herein designated VGAM RNA, also designated SEQ ID:4389.

Another function of VGAM1678 is therefore inhibition of FLJ22174 (Accession NM_021945). Accordingly, utilities of VGAM1678 include diagnosis, prevention and treatment of diseases and clinical conditions associated with FLJ22174. FLJ23499 (Accession NM_022761) is another VGAM1678 host target gene. FLJ23499 BINDING SITE is HOST TARGET binding site found in the 3' untranslated region of mRNA encoded by FLJ23499, corresponding to a HOST TARGET binding site such as BINDING SITE I, BINDING SITE II or BINDING SITE III. Table 2 illustrates the complementarity of the nucleotide sequences of FLJ23499 BINDING SITE, designated SEQ ID:23005, to the nucleotide sequence of VGAM1678 RNA, herein designated VGAM RNA, also designated SEQ ID:4389.

Another function of VGAM1678 is therefore inhibition of FLJ23499 (Accession NM_022761). Accordingly, utilities of VGAM1678 include diagnosis, prevention and treatment of diseases and clinical conditions associated with FLJ23499. IKKE (Accession NM_014002) is another VGAM1678 host target gene. IKKE BINDING SITE is HOST TARGET binding site found in the 5' untranslated region of mRNA encoded by IKKE, corresponding to a HOST TARGET binding site such as BINDING SITE I, BINDING SITE II or BINDING SITE III. Table 2 illustrates the complementarity of the nucleotide sequences of IKKE BINDING SITE, designated SEQ ID:15203, to the nucleotide sequence of VGAM1678 RNA, herein designated VGAM RNA, also designated SEQ ID:4389.

Another function of VGAM1678 is therefore inhibition of IKKE (Accession NM_014002). Accordingly, utilities of VGAM1678 include diagnosis, prevention and treatment of diseases and clinical conditions associated with IKKE. KIAA0323 (Accession XM_032634) is another VGAM1678 host target gene. KIAA0323 BINDING SITE is HOST TARGET binding site found in the 3" untranslated region of mRNA encoded by KIAA0323, corresponding to a HOST TARGET binding site such as BINDING SITE I, BINDING SITE II or BINDING SITE III. Table 2 illustrates the complementarity of the nucleotide sequences of KIAA0323 BINDING SITE, designated SEQ ID:31695, to the nucleotide sequence of VGAM1678 RNA, herein designated VGAM RNA, also designated SEQ ID:4389.

Another function of VGAM1678 is therefore inhibition of KIAA0323 (Accession XM_032634). Accordingly, utilities of VGAM1678 include diagnosis, prevention and treatment of diseases and clinical conditions associated with KIAA0323. KIAA1161 (Accession XM_088501) is another VGAM1678 host target gene. KIAA1161 BINDING SITE is HOST TARGET binding site found in the 5' untranslated region of mRNA encoded by KIAA1161, corresponding to a HOST TARGET binding site such as BINDING SITE I, BINDING SITE II or BINDING SITE III. Table 2 illustrates the complementarity of the nucleotide sequences of KIAA1161 BINDING SITE, designated SEQ ID:39754, to the nucleotide sequence of VGAM1678 RNA, herein designated VGAM RNA, also designated SEQ ID:4389.

Another function of VGAM1678 is therefore inhibition of KIAA1161 (Accession XM_088501). Accordingly, utilities of VGAM1678 include diagnosis, prevention and treatment of diseases and clinical conditions associated with KIAA1161. KIAA1727 (Accession XM_034262) is another VGAM1678 host target gene. KIAA1727 BINDING SITE is HOST TARGET binding site found in the 3' untranslated region of mRNA encoded by KIAA1727, corresponding to a HOST TARGET binding site such as BINDING SITE I, BINDING SITE II or BINDING SITE III. Table 2 illustrates the complementarity of the nucleotide sequences of KIAA1727 BINDING SITE, designated SEQ ID:32033, to the nucleotide sequence of VGAM1678 RNA, herein designated VGAM RNA, also designated SEQ ID:4389.

Another function of VGAM1678 is therefore inhibition of KIAA1727 (Accession XM_034262). Accordingly, utilities of VGAM1678 include diagnosis, prevention and treatment of diseases and clinical conditions associated with KIAA1727. MGC4415 (Accession NM_031484) is another VGAM1678 host target gene. MGC4415 BINDING SITE is HOST TARGET binding site found in the 3' untranslated region of mRNA encoded by MGC4415, corresponding to a HOST TARGET binding site such as BINDING SITE I, BINDING SITE II or BINDING SITE III. Table 2 illustrates the complementarity of the nucleotide sequences of MGC4415 BINDING SITE, designated SEQ ID:25570, to the nucleotide sequence of VGAM1678 RNA, herein designated VGAM RNA, also designated SEQ ID:4389.

Another function of VGAM1678 is therefore inhibition of MGC4415 (Accession NM_031484). Accordingly, utilities of VGAM1678 include diagnosis, prevention and treatment of diseases and clinical conditions associated with MGC4415. Netrin 4 (NTN4, Accession XM_031896) is another VGAM1678 host target gene. NTN4 BINDING SITE is HOST TARGET binding site found in the 3' untranslated region of mRNA encoded by NTN4, corresponding to a HOST TARGET binding site such as BINDING SITE I, BINDING SITE II or BINDING SITE III. Table 2 illustrates the complementarity of the nucleotide sequences of NTN4 BINDING SITE, designated SEQ ID:31513, to the nucleotide sequence of VGAM1678 RNA, herein designated VGAM RNA, also designated SEQ ID:4389.

Another function of VGAM1678 is therefore inhibition of Netrin 4 (NTN4, Accession XM_031896). Accordingly, utilities of VGAM1678 include diagnosis, prevention and treatment of diseases and clinical conditions associated with NTN4. RNA-binding Region (RNP1, RRM) Containing 1 (RNPC1, Accession NM_017495) is another VGAM1678 host target gene. RNPC1 BINDING SITE is HOST TARGET binding site found in the 3' untranslated region of mRNA encoded by RNPC1, corresponding to a HOST TARGET binding site such as BINDING SITE I, BINDING SITE II or BINDING SITE III. Table 2 illustrates the complementarity of the nucleotide sequences of RNPC1 BINDING SITE, designated SEQ ID:18958, to the nucleotide sequence of VGAM1678 RNA, herein designated VGAM RNA, also designated SEQ ID:4389.

Another function of VGAM1678 is therefore inhibition of RNA-binding Region (RNP1, RRM) Containing 1 (RNPC1, Accession NM_017495). Accordingly, utilities of VGAM1678 include diagnosis, prevention and treatment of diseases and clinical conditions associated with RNPC1. Synovial Sarcoma Translocation Gene On Chromosome 18-like 1 (SS18L1, Accession XM_037202) is another VGAM1678 host target gene. SS18L1 BINDING SITE is HOST TARGET binding site found in the 3' untranslated region of mRNA encoded by SS18L1, corresponding to a HOST TARGET binding site such as BINDING SITE I, BINDING SITE II or BINDING SITE III. Table 2 illustrates the complementarity of the nucleotide sequences of SS18L1 BINDING SITE, designated SEQ ID:32562, to the nucleotide sequence of VGAM1678 RNA, herein designated VGAM RNA, also designated SEQ ID:4389.

Another function of VGAM1678 is therefore inhibition of Synovial Sarcoma Translocation Gene On Chromosome 18-like 1 (SS18L1, Accession XM_037202). Accordingly, utilities of VGAM1678 include diagnosis, prevention and treatment of diseases and clinical conditions associated with SS18L1. LOC114932 (Accession XM_052614) is another VGAM1678 host target gene. LOC114932 BINDING SITE is HOST TARGET binding site found in the 3' untranslated region of mRNA encoded by LOC114932, corresponding to a HOST TARGET binding site such as BINDING SITE I, BINDING SITE II or BINDING SITE III. Table 2 illustrates the complementarity of the nucleotide sequences of LOC114932 BINDING SITE, designated SEQ ID:36005, to the nucleotide sequence of VGAM1678 RNA, herein designated VGAM RNA, also designated SEQ ID:4389.

Another function of VGAM1678 is therefore inhibition of LOC114932 (Accession XM_052614). Accordingly, utilities of VGAM1678 include diagnosis, prevention and treatment of diseases and clinical conditions associated with LOC114932. LOC145497 (Accession XM_085150) is another VGAM1678 host target gene. LOC145497 BINDING SITE is HOST TARGET binding site found in the 5' untranslated region of mRNA encoded by LOC145497, corresponding to a HOST TARGET binding site such as BINDING SITE I, BINDING SITE II or BINDING SITE III. Table 2 illustrates the complementarity of the nucleotide sequences of LOC145497 BINDING SITE, designated SEQ ID:37871, to the nucleotide sequence of VGAM1678 RNA, herein designated VGAM RNA, also designated SEQ ID:4389.

Another function of VGAM1678 is therefore inhibition of LOC145497 (Accession XM_085150). Accordingly, utilities of VGAM1678 include diagnosis, prevention and treatment of diseases and clinical conditions associated with LOC145497. LOC145978 (Accession XM_085288) is another VGAM1678 host target gene. LOC145978 BINDING SITE is HOST TARGET binding site found in the 3' untranslated region of mRNA encoded by LOC145978, corresponding to a HOST TARGET binding site such as BINDING SITE I, BINDING SITE II or BINDING SITE III. Table 2 illustrates the complementarity of the nucleotide sequences of LOC145978 BINDING SITE, designated SEQ ID:38033, to the nucleotide sequence of VGAM1678 RNA, herein designated VGAM RNA, also designated SEQ ID:4389.

Another function of VGAM1678 is therefore inhibition of LOC145978 (Accession XM_085288). Accordingly, utilities of VGAM1678 include diagnosis, prevention and treatment of diseases and clinical conditions associated with LOC145978. LOC146429 (Accession XM_096998) is another VGAM1678 host target gene. LOC146429 BINDING SITE is HOST TARGET binding site found in the 5' untranslated region of mRNA encoded by LOC146429, corresponding to a HOST TARGET binding site such as BINDING SITE I, BINDING SITE II or BINDING SITE III. Table 2 illustrates the complementarity of the nucleotide sequences of LOC146429 BINDING SITE, designated SEQ ID:40696, to the nucleotide sequence of VGAM1678 RNA, herein designated VGAM RNA, also designated SEQ ID:4389.

Another function of VGAM1678 is therefore inhibition of LOC146429 (Accession XM_096998). Accordingly, utilities of VGAM1678 include diagnosis, prevention and treatment of diseases and clinical conditions associated with LOC146429. LOC149386 (Accession XM_097631) is another VGAM1678 host target gene. LOC149386 BINDING SITE is HOST TARGET binding site found in the 3' untranslated region of mRNA encoded by LOC149386, corresponding to a HOST TARGET binding site such as BINDING SITE I, BINDING SITE II or BINDING SITE III. Table 2 illustrates the complementarity of the nucleotide sequences of LOC149386 BINDING SITE, designated SEQ ID:40987, to the nucleotide sequence of VGAM1678 RNA, herein designated VGAM RNA, also designated SEQ ID:4389.

Another function of VGAM1678 is therefore inhibition of LOC149386 (Accession XM_097631). Accordingly, utilities of VGAM1678 include diagnosis, prevention and treatment of diseases and clinical conditions associated with LOC149386. LOC158581 (Accession XM_098968) is another VGAM1678 host target gene. LOC158581 BINDING SITE is HOST TARGET binding site found in the 5' untranslated region of mRNA encoded by LOC158581, corresponding to a HOST TARGET binding site such as BINDING SITE I, BINDING SITE II or BINDING SITE III. Table 2 illustrates the complementarity of the nucleotide sequences of LOC158581 BINDING SITE, designated SEQ ID:42015, to the nucleotide sequence of VGAM1678 RNA, herein designated VGAM RNA, also designated SEQ ID:4389.

Another function of VGAM1678 is therefore inhibition of LOC158581 (Accession XM_098968). Accordingly, utilities of VGAM1678 include diagnosis, prevention and treatment of diseases and clinical conditions associated with LOC158581. LOC202460 (Accession XM_114493) is another VGAM1678 host target gene. LOC202460 BINDING SITE is HOST TARGET binding site found in the 5' untranslated region of mRNA encoded by LOC202460, corresponding to a HOST TARGET binding site such as BINDING SITE I, BINDING SITE II or BINDING SITE III. Table 2 illustrates the complementarity of the nucleotide sequences of LOC202460 BINDING SITE, designated SEQ ID:42984, to the nucleotide sequence of VGAM1678 RNA, herein designated VGAM RNA, also designated SEQ ID:4389.

Another function of VGAM1678 is therefore inhibition of LOC202460 (Accession XM_114493). Accordingly, utilities of VGAM1678 include diagnosis, prevention and treatment of diseases and clinical conditions associated with LOC202460. LOC219894 (Accession XM_167782) is another VGAM1678 host target gene. LOC219894 BINDING SITE is HOST TARGET binding site found in the 3' untranslated region of mRNA encoded by LOC219894, corresponding to a HOST TARGET binding site such as BINDING SITE I, BINDING SITE II or BINDING SITE III. Table 2 illustrates the complementarity of the nucleotide sequences of LOC219894 BINDING SITE, designated SEQ ID:44792, to the nucleotide sequence of VGAM1678 RNA, herein designated VGAM RNA, also designated SEQ ID:4389.

Another function of VGAM1678 is therefore inhibition of LOC219894 (Accession XM_167782). Accordingly, utilities of VGAM1678 include diagnosis, prevention and treatment of diseases and clinical conditions associated with LOC219894. LOC221751 (Accession XM_166370) is another VGAM1678 host target gene. LOC221751 BINDING SITE is HOST TARGET binding site found in the 5' untranslated region of mRNA encoded by LOC221751, corresponding to a HOST TARGET binding site such as BINDING SITE I, BINDING SITE II or BINDING SITE III. Table 2 illustrates the complementarity of the nucleotide sequences of LOC221751 BINDING SITE, designated SEQ ID:44190, to the nucleotide sequence of VGAM1678 RNA, herein designated VGAM RNA, also designated SEQ ID:4389.

Another function of VGAM1678 is therefore inhibition of LOC221751 (Accession XM_166370). Accordingly, utilities of VGAM1678 include diagnosis, prevention and treatment of diseases and clinical conditions associated with LOC221751. LOC254268 (Accession XM_170913) is another VGAM1678 host target gene. LOC254268 BINDING SITE is HOST TARGET binding site found in the 3' untranslated region of mRNA encoded by LOC254268, corresponding to a HOST TARGET binding site such as BINDING SITE I, BINDING SITE II or BINDING SITE III. Table 2 illustrates the complementarity of the nucleotide sequences of LOC254268 BINDING SITE, designated SEQ ID:45691, to the nucleotide sequence of VGAM1678 RNA, herein designated VGAM RNA, also designated SEQ ID:4389.

Another function of VGAM1678 is therefore inhibition of LOC254268 (Accession XM_170913). Accordingly, utilities of VGAM1678 include diagnosis, prevention and treatment of diseases and clinical conditions associated with LOC254268. LOC255252 (Accession XM_170779) is another VGAM1678 host target gene. LOC255252 BINDING SITE is HOST TARGET binding site found in the 3' untranslated region of mRNA encoded by LOC255252, corresponding to a HOST TARGET binding site such as BINDING SITE I, BINDING SITE II or BINDING SITE III. Table 2 illustrates the complementarity of the nucleotide sequences of LOC255252 BINDING SITE, designated SEQ ID:45546, to the nucleotide sequence of VGAM1678 RNA, herein designated VGAM RNA, also designated SEQ ID:4389.

Another function of VGAM1678 is therefore inhibition of LOC255252 (Accession XM_170779). Accordingly, utilities of VGAM1678 include diagnosis, prevention and treatment of diseases and clinical conditions associated with LOC255252. LOC90499 (Accession XM_032170) is another VGAM1678 host target gene. LOC90499 BINDING SITE is HOST TARGET binding site found in the 3' untranslated region of mRNA encoded by LOC90499, corresponding to a HOST TARGET binding site such as BINDING SITE I, BINDING SITE II or BINDING SITE III. Table 2 illustrates the complementarity of the nucleotide sequences of LOC90499 BINDING SITE, designated SEQ ID:31581, to the nucleotide sequence of VGAM1678 RNA, herein designated VGAM RNA, also designated SEQ ID:4389.

Another function of VGAM1678 is therefore inhibition of LOC90499 (Accession XM_032170). Accordingly, utilities of VGAM1678 include diagnosis, prevention and treatment of diseases and clinical conditions associated with LOC90499. FIG. 1 further provides a conceptual description of a novel bioinformatically detected viral gene of the present invention, referred to here as Viral Genomic Address Messenger 1679 (VGAM1679) viral gene, which modulates expression of respective host target genes thereof, the function and utility of which host target genes is known in the art.

VGAM1679 is a novel bioinformatically detected regulatory, non protein coding, viral micro RNA (miRNA) gene. The method by which VGAM1679 was detected is described hereinabove with reference to FIGS. 1-8.

VGAM1679 gene, herein designated VGAM GENE, is a viral gene contained in the genome of Viral Hemorrhagic Sep.icemia Virus. VGAM1679 host target gene, herein designated VGAM HOST TARGET GENE, is a human gene contained in the human genome.

VGAM1679 gene encodes a VGAM1679 precursor RNA, herein designated VGAM PRECURSOR RNA. Similar to other miRNA genes, and unlike most ordinary genes, VGAM1679 precursor RNA does not encode a protein. A nucleotide sequence identical or highly similar to the nucleotide sequence of VGAM1679 precursor RNA is designated SEQ ID:1665, and is provided hereinbelow with reference to the sequence listing part. Nucleotide sequence SEQ ID:1665 is located at position 1372 relative to the genome of Viral Hemorrhagic Sep.icemia Virus.

VGAM1679 precursor RNA folds onto itself, forming VGAM1679 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1679 folded precursor RNA into VGAM1679 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1679 RNA is designated SEQ ID:4390, and is provided hereinbelow with reference to the sequence listing part.

VGAM1679 host target gene, herein designated VGAM HOST TARGET GENE, encodes a corresponding messenger RNA, VGAM1679 host target RNA, herein designated VGAM HOST TARGET RNA. VGAM1679 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1679 RNA, herein designated VGAM RNA, binds complementarily to one or more host target binding sites located in untranslated regions of VGAM1679 host target RNA, herein designated VGAM HOST TARGET RNA. This complementary binding is due to the fact that the nucleotide sequence of VGAM1679 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1679 RNA, herein designated VGAM RNA, may have a different number of host target binding sites in untranslated regions of a VGAM1679 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1679 RNA, herein designated VGAM RNA, to host target binding sites on VGAM1679 host target RNA, herein designated VGAM HOST TARGET RNA, such as BINDING SITE I, BINDING SITE II and BINDING SITE III, inhibits translation of VGAM1679 host target RNA into VGAM1679 host target protein, herein designated VGAM HOST TARGET PROTEIN. VGAM host target protein is therefore outlined by a broken line.

It is appreciated that VGAM1679 host target gene, herein designated VGAM HOST TARGET GENE, in fact represents a plurality of VGAM1679 host target genes. The mRNA of each one of this plurality of VGAM1679 host target genes comprises one or more host target binding sites, each having a nucleotide sequence which is at least partly complementary to VGAM1679 RNA, herein designated VGAM RNA, and which when bound by VGAM1679 RNA causes inhibition of translation of respective one or more VGAM1679 host target proteins.

It is further appreciated by one skilled in the art that the mode of translational inhibition illustrated by FIG. 1 with specific reference to translational inhibition exerted by VGAM1679 gene, herein designated VGAM GENE, on one or more VGAM1679 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1679 is inhibition of expression of host target genes, as part of a novel viral mechanism of attacking a host. Accordingly, utilities of VGAM1679 include diagnosis, prevention and treatment of viral infection by Viral Hemorrhagic Sep.icemia Virus. Specific functions, and accordingly utilities, of VGAM1679 correlate with, and may be deduced from, the identity of the host target genes which VGAM1679 binds and inhibits, and the function of these host target genes, as elaborated hereinbelow.

Nucleotide sequences of the VGAM1679 precursor RNA, herein designated VGAM PRECURSOR RNA, and of the 'diced' VGAM1679 RNA, herein designated VGAM RNA, and a schematic representation of the secondary folding of VGAM1679 folded precursor RNA, herein designated VGAM FOLDED PRECURSOR RNA, of VGAM1679 are further described hereinbelow with reference to Table 1.

Nucleotide sequences of host target binding sites, such as BINDING SITE-I, BINDING SITE-II and BINDING SITE-III of FIG. 1, found on VGAM1679 host target RNA, and schematic representation of the complementarity of each of these host target binding sites to VGAM1679 RNA, herein designated VGAM RNA, are described hereinbelow with reference to Table 2.

As mentioned hereinabove with reference to FIG. 1, a function of VGAM1679 gene, herein designated VGAM is inhibition of expression of VGAM1679 target genes. It is appreciated that specific functions, and accordingly utilities, of VGAM1679 correlate with, and may be deduced from, the identity of the target genes which VGAM1679 binds and inhibits, and the function of these target genes, as elaborated hereinbelow.

Cyclin-dependent Kinase 5, Regulatory Subunit 2 (p39) (CDK5R2, Accession NM_003936) is a VGAM1679 host target gene. CDK5R2 BINDING SITE is HOST TARGET binding site found in the 3' untranslated region of mRNA encoded by CDK5R2, corresponding to a HOST TARGET binding site such as BINDING SITE I, BINDING SITE II or BINDING SITE III. Table 2 illustrates the complementarity of the nucleotide sequences of CDK5R2 BINDING SITE, designated SEQ ID:10042, to the nucleotide sequence of VGAM1679 RNA, herein designated VGAM RNA, also designated SEQ ID:4390.

A function of VGAM1679 is therefore inhibition of Cyclin-dependent Kinase 5, Regulatory Subunit 2 (p39) (CDK5R2, Accession NM_003936), a gene which acts as a regulatory subunit for the cyclin-dependent CDK5. Accordingly, utilities of VGAM1679 include diagnosis, prevention and treatment of diseases and clinical conditions associated with CDK5R2. The function of CDK5R2 and its association with various diseases and clinical conditions, has been established by previous studies, as described hereinabove with reference to VGAM403. Paired Basic Amino Acid Cleaving System 4 (PACE4, Accession NM_138319) is another VGAM1679 host target gene. PACE4 BINDING SITE1 and PACE4 BINDING SITE2 are HOST TARGET binding sites found in untranslated regions of mRNA encoded by PACE4, corresponding to HOST TARGET binding sites such as BINDING SITE I, BINDING SITE II or BINDING SITE III. Table 2 illustrates the complementarity of the nucleotide sequences of PACE4 BINDING SITE1 and PACE4 BINDING SITE2, designated SEQ ID:28720 and SEQ ID:8431 respectively, to the nucleotide sequence of VGAM1679 RNA, herein designated VGAM RNA, also designated SEQ ID:4390.

Another function of VGAM1679 is therefore inhibition of Paired Basic Amino Acid Cleaving System 4 (PACE4, Accession NM_138319), a gene which processes hormone precursors by cleaving paired basic amino acids. Accordingly, utilities of VGAM1679 include diagnosis, prevention and treatment of diseases and clinical conditions associated with PACE4. The function of PACE4 and its association with various diseases and clinical conditions, has been established by previous studies, as described hereinabove with reference to VGAM1194. ARL8 (Accession XM_167671) is another VGAM1679 host target gene. ARL8 BINDING SITE is HOST TARGET binding site found in the 3' untranslated region of mRNA encoded by ARL8, corresponding to a HOST TARGET binding site such as BINDING SITE I, BINDING SITE II or BINDING SITE III. Table 2 illustrates the complementarity of the nucleotide sequences of ARL8 BINDING SITE, designated SEQ ID:44763, to the nucleotide sequence of VGAM1679 RNA, herein designated VGAM RNA, also designated SEQ ID:4390.

Another function of VGAM1679 is therefore inhibition of ARL8 (Accession XM_167671). Accordingly, utilities of VGAM1679 include diagnosis, prevention and treatment of diseases and clinical conditions associated with ARL8. FLJ13659 (Accession NM_025189) is another VGAM1679 host target gene. FLJ13659 BINDING SITE is HOST TARGET binding site found in the 3' untranslated region of mRNA encoded by FLJ13659, corresponding to a HOST TARGET binding site such as BINDING SITE I, BINDING SITE II or BINDING SITE III. Table 2 illustrates the complementarity of the nucleotide sequences of FLJ13659 BINDING SITE, designated SEQ ID:24830, to the nucleotide sequence of VGAM1679 RNA, herein designated VGAM RNA, also designated SEQ ID:4390.

Another function of VGAM1679 is therefore inhibition of FLJ13659 (Accession NM_025189). Accordingly, utilities of VGAM1679 include diagnosis, prevention and treatment of diseases and clinical conditions associated with FLJ13659. Guanine Nucleotide Binding Protein (G protein), Gamma 4 (GNG4, Accession NM_004485) is another VGAM1679 host target gene. GNG4 BINDING SITE is HOST TARGET binding site found in the 5' untranslated region of mRNA encoded by GNG4, corresponding to a HOST TARGET binding site such as BINDING SITE I, BINDING SITE II or BINDING SITE III. Table 2 illustrates the complementarity of the nucleotide sequences of GNG4 BINDING SITE, designated SEQ ID:10811, to the nucleotide sequence of VGAM1679 RNA, herein designated VGAM RNA, also designated SEQ ID:4390.

Another function of VGAM1679 is therefore inhibition of Guanine Nucleotide Binding Protein (G protein), Gamma 4 (GNG4, Accession NM_004485). Accordingly, utilities of VGAM1679 include diagnosis, prevention and treatment of diseases and clinical conditions associated with GNG4. HTCD37 (Accession XM_041884) is another VGAM1679 host target gene. HTCD37 BINDING SITE is HOST TARGET binding site found in the 3' untranslated region of mRNA encoded by HTCD37, corresponding to a HOST TARGET binding site such as BINDING SITE I, BINDING SITE II or BINDING SITE III. Table 2 illustrates the complementarity of the nucleotide sequences of HTCD37 BINDING SITE, designated SEQ ID:33620, to the nucleotide sequence of VGAM1679 RNA, herein designated VGAM RNA, also designated SEQ ID:4390.

Another function of VGAM1679 is therefore inhibition of HTCD37 (Accession XM_041884). Accordingly, utilities of VGAM1679 include diagnosis, prevention and treatment of diseases and clinical conditions associated with HTCD37. KIAA0451 (Accession NM_014826) is another VGAM1679 host target gene. KIAA0451 BINDING SITE is HOST TARGET binding site found in the 3' untranslated region of mRNA encoded by KIAA0451, corresponding to a HOST TARGET binding site such as BINDING SITE I, BINDING SITE II or BINDING SITE III. Table 2 illustrates the complementarity of the nucleotide sequences of KIAA0451 BINDING SITE, designated SEQ ID:16803, to the nucleotide sequence of VGAM1679 RNA, herein designated VGAM RNA, also designated SEQ ID:4390.

Another function of VGAM1679 is therefore inhibition of KIAA0451 (Accession NM_014826). Accordingly, utilities of VGAM1679 include diagnosis, prevention and treatment of diseases and clinical conditions associated with KIAA0451. MGC2562 (Accession NM_032374) is another VGAM1679 host target gene. MGC2562 BINDING SITE is HOST TARGET binding site found in the 3' untranslated region of mRNA encoded by MGC2562, corresponding to a HOST TARGET binding site such as BINDING SITE I, BINDING SITE II or BINDING SITE III. Table 2 illustrates the complementarity of the nucleotide sequences of MGC2562 BINDING SITE, designated SEQ ID:26163, to the nucleotide sequence of VGAM1679 RNA, herein designated VGAM RNA, also designated SEQ ID:4390.

Another function of VGAM1679 is therefore inhibition of MGC2562 (Accession NM_032374). Accordingly, utilities of VGAM1679 include diagnosis, prevention and treatment of diseases and clinical conditions associated with MGC2562. Transducer of ERBB2, 2 (TOB2, Accession XM_170995) is another VGAM1679 host target gene. TOB2 BINDING SITE is HOST TARGET binding site found in the 3' untranslated region of mRNA encoded by TOB2, corresponding to a HOST TARGET binding site such as BINDING SITE I, BINDING SITE II or BINDING SITE III. Table 2 illustrates the complementarity of the nucleotide sequences of TOB2 BINDING SITE, designated SEQ ID:45770, to the nucleotide sequence of VGAM1679 RNA, herein designated VGAM RNA, also designated SEQ ID:4390.

Another function of VGAM1679 is therefore inhibition of Transducer of ERBB2, 2 (TOB2, Accession XM_170995). Accordingly, utilities of VGAM1679 include diagnosis, prevention and treatment of diseases and clinical conditions associated with TOB2. LOC149576 (Accession XM_086580) is another VGAM1679 host target gene. LOC149576 BINDING SITE is HOST TARGET binding site found in the 5' untranslated region of mRNA encoded by LOC149576, corresponding to a HOST TARGET binding site such as BINDING SITE I, BINDING SITE II or BINDING SITE III. Table 2 illustrates the complementarity of the nucleotide sequences of LOC149576 BINDING SITE, designated SEQ ID:38775, to the nucleotide sequence of VGAM1679 RNA, herein designated VGAM RNA, also designated SEQ ID:4390.

Another function of VGAM1679 is therefore inhibition of LOC149576 (Accession XM_086580). Accordingly, utilities of VGAM1679 include diagnosis, prevention and treatment of diseases and clinical conditions associated with LOC149576. LOC151278 (Accession XM_087156) is another VGAM1679 host target gene. LOC151278 BINDING SITE is HOST TARGET binding site found in the 3' untranslated region of mRNA encoded by LOC151278, corresponding to a HOST TARGET binding site such as BINDING SITE I, BINDING SITE II or BINDING SITE III. Table 2 illustrates the complementarity of the nucleotide sequences of LOC151278 BINDING SITE, designated SEQ ID:39097, to the nucleotide sequence of VGAM1679 RNA, herein designated VGAM RNA, also designated SEQ ID:4390.

Another function of VGAM1679 is therefore inhibition of LOC151278 (Accession XM_087156). Accordingly, utilities of VGAM1679 include diagnosis, prevention and treatment of diseases and clinical conditions associated with LOC151278. LOC91565 (Accession XM_039231) is another VGAM1679 host target gene. LOC91565 BINDING SITE is HOST TARGET binding site found in the 5' untranslated region of mRNA encoded by LOC91565, corresponding to a HOST TARGET binding site such as BINDING SITE I, BINDING SITE II or BINDING SITE III. Table 2 illustrates the complementarity of the nucleotide sequences of LOC91565 BINDING SITE, designated SEQ ID:33024, to the nucleotide sequence of VGAM1679 RNA, herein designated VGAM RNA, also designated SEQ ID:4390.

Another function of VGAM1679 is therefore inhibition of LOC91565 (Accession XM_039231). Accordingly, utilities of VGAM1679 include diagnosis, prevention and treatment of diseases and clinical conditions associated with LOC91565. FIG. 1 further provides a conceptual description of a novel bioinformatically detected viral gene of the present invention, referred to here as Viral Genomic Address Messenger 1680 (VGAM1680) viral gene, which modulates expression of respective host target genes thereof, the function and utility of which host target genes is known in the art.

VGAM1680 is a novel bioinformatically detected regulatory, non protein coding, viral micro RNA (miRNA) gene. The method by which VGAM1680 was detected is described hereinabove with reference to FIGS. 1-8.

VGAM1680 gene, herein designated VGAM GENE, is a viral gene contained in the genome of Viral Hemorrhagic Sep.icemia Virus. VGAM1680 host target gene, herein designated VGAM HOST TARGET GENE, is a human gene contained in the human genome.

VGAM1680 gene encodes a VGAM1680 precursor RNA, herein designated VGAM PRECURSOR RNA. Similar to other miRNA genes, and unlike most ordinary genes, VGAM1680 precursor RNA does not encode a protein. A nucleotide sequence identical or highly similar to the nucleotide sequence of VGAM1680 precursor RNA is designated SEQ ID:1666, and is provided hereinbelow with reference to the sequence listing part. Nucleotide sequence SEQ ID:1666 is located at position 10244 relative to the genome of Viral Hemorrhagic Sep.icemia Virus.

VGAM1680 precursor RNA folds onto itself, forming VGAM1680 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1680 folded precursor RNA into VGAM1680 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1680 RNA is designated SEQ ID:4391, and is provided hereinbelow with reference to the sequence listing part.

VGAM1680 host target gene, herein designated VGAM HOST TARGET GENE, encodes a corresponding messenger RNA, VGAM1680 host target RNA, herein designated VGAM HOST TARGET RNA. VGAM1680 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1680 RNA, herein designated VGAM RNA, binds complementarily to one or more host target binding sites located in untranslated regions of VGAM1680 host target RNA, herein designated VGAM HOST TARGET RNA. This complementary binding is due to the fact that the nucleotide sequence of VGAM1680 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1680 RNA, herein designated VGAM RNA, may have a different number of host target binding sites in untranslated regions of a VGAM1680 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1680 RNA, herein designated VGAM RNA, to host target binding sites on VGAM1680 host target RNA, herein designated VGAM HOST TARGET RNA, such as BINDING SITE I, BINDING SITE II and BINDING SITE III, inhibits translation of VGAM1680 host target RNA into VGAM1680 host target protein, herein designated VGAM HOST TARGET PROTEIN. VGAM host target protein is therefore outlined by a broken line.

It is appreciated that VGAM1680 host target gene, herein designated VGAM HOST TARGET GENE, in fact represents a plurality of VGAM1680 host target genes. The mRNA of each one of this plurality of VGAM1680 host target genes comprises one or more host target binding sites, each having a nucleotide sequence which is at least partly complementary to VGAM1680 RNA, herein designated VGAM RNA, and which when bound by VGAM1680 RNA causes inhibition of translation of respective one or more VGAM1680 host target proteins.

It is further appreciated by one skilled in the art that the mode of translational inhibition illustrated by FIG. 1 with specific reference to translational inhibition exerted by VGAM1680 gene, herein designated VGAM GENE, on one or more VGAM1680 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1680 is inhibition of expression of host target genes, as part of a novel viral mechanism of attacking a host. Accordingly, utilities of VGAM1680 include diagnosis, prevention and treatment of viral infection by Viral Hemorrhagic Sep.icemia Virus. Specific functions, and accordingly utilities, of VGAM1680 correlate with, and may be deduced from, the identity of the host target genes which VGAM1680 binds and inhibits, and the function of these host target genes, as elaborated hereinbelow.

Nucleotide sequences of the VGAM1680 precursor RNA, herein designated VGAM PRECURSOR RNA, and of the 'diced' VGAM1680 RNA, herein designated VGAM RNA, and a schematic representation of the secondary folding of VGAM1680 folded precursor RNA, herein designated VGAM FOLDED PRECURSOR RNA, of VGAM1680 are further described hereinbelow with reference to Table 1.

Nucleotide sequences of host target binding sites, such as BINDING SITE-I, BINDING SITE-II and BINDING SITE-III of FIG. 1, found on VGAM1680 host target RNA, and schematic representation of the complementarity of each of these host target binding sites to VGAM1680 RNA, herein designated VGAM RNA, are described hereinbelow with reference to Table 2.

As mentioned hereinabove with reference to FIG. 1, a function of VGAM1680 gene, herein designated VGAM is inhibition of expression of VGAM1680 target genes. It is appreciated that specific functions, and accordingly utilities, of VGAM1680 correlate with, and may be deduced from, the identity of the target genes which VGAM1680 binds and inhibits, and the function of these target genes, as elaborated hereinbelow.

Collagen, Type XIII, Alpha 1 (COL13A1, Accession NM_080799) is a VGAM1680 host target gene. COL13A1 BINDING SITE1 through COL13A1 BINDING SITE7 are HOST TARGET binding sites found in untranslated regions of mRNA encoded by COL13A1, corresponding to HOST TARGET binding sites such as BINDING SITE I, BINDING SITE II or BINDING SITE III. Table 2 illustrates the complementarity of the nucleotide sequences of COL13A1 BINDING SITE1 through COL13A1 BINDING SITE7, designated SEQ ID:28066, SEQ ID:28068, SEQ ID:28070, SEQ ID:28072, SEQ ID:28074, SEQ ID:28076 and SEQ ID:11703 respectively, to the nucleotide sequence of VGAM1680 RNA, herein designated VGAM RNA, also designated SEQ ID:4391.

A function of VGAM1680 is therefore inhibition of Collagen, Type XIII, Alpha 1 (COL13A1, Accession NM_080799), a gene which is specific for basement membranes. Accordingly, utilities of VGAM1680 include diagnosis, prevention and treatment of diseases and clinical conditions associated with COL13A1. The function of COL13A1 has been established by previous studies. Tikka et al. (1988) isolated and partially characterized the gene for the alpha-1 chain of type XIII collagen. Some of the features resembled those of genes for fibrillar collagens, but other features were distinctly different. Analysis of overlapping cDNA clones and nuclease S1 mapping of mRNAs indicated 1 alternative splicing site causing a deletion of 36 bp from the mature mRNA. The 36 bp represented a single exon. Furthermore, a 45-bp exon was also subject to alternative splicing. Of the 3 major groups of collagens--the fibrillar collagens, the large nonfibrillar collagens, and the short-chain collagens--type XIII collagen belongs to the third group. Shows et al. (1989) mapped the COL13A1 gene to 10q22 by a combination of somatic cell hybrid study and in situ hybridization. Pajunen et al. (1989) assigned the COL13A1 gene to 10q11-qter by Southern blot hybridization of DNA from human/rodent somatic cell hybrids The gene for type XIII collagen (COL13A1) and that for the alpha-1 subunit of prolyl 4-hydroxylase (P4HA1; 176710) had been assigned to 10q22 and 10q21.3-q23.1 by isotopic in situ hybridization. Horelli-Kuitunen et al. (1997) applied fluorescence in situ hybridization (FISH) combined with targets representing different levels of resolution to determine the order of these genes along chromosome 10, their transcriptional orientation, and the distance between them. Using mechanically stretched chromosomes they determined the order to be cen-COL13A1-P4HA1-tel. By combining the data from stretched chromosomes and interphase nuclei, they found that the transcriptional orientation was tail-to-tail. The distance between the genes was measured by fiber FISH to be approximately 550 kb.

Full details of the abovementioned studies are described in the following publications, the disclosure of which are hereby incorporated by reference:

Tikka, L.; Pihlajaniemi, T.; Henttu, P.; Prockop, D. J.; Tryggvason, K.: Gene structure for the alpha-1 chain of a human short-chain collagen (type XIII) with alternatively spliced transcripts and translation termination codon at the 5-prime end of the last exon. Proc. Nat. Acad. Sci. 85:7491-7495, 1988; and Horelli-Kuitunen, N.; Kvist, A.-P.; Helaakoski, T.; Kivirikko, K.; Pihlajaniemi, T.; Palotie, A.: The order and transcriptional orientation of the human COL13A1 and P4HA genes on chrom.

Further studies establishing the function and utilities of COL13A1 are found in John Hopkins OMIM database record ID 120350, and in sited publications numbered 12045-12048 listed in the bibliography section hereinbelow, which are also hereby incorporated by reference. Hippocalcin-like 1 (HPCAL1, Accession NM_002149) is another VGAM1680 host target gene. HPCAL1 BINDING SITE1 and HPCAL1 BINDING SITE2 are HOST TARGET binding sites found in untranslated regions of mRNA encoded by HPCAL1, corresponding to HOST TARGET binding sites such as BINDING SITE I, BINDING SITE II or BINDING SITE III. Table 2 illustrates the complementarity of the nucleotide sequences of HPCAL1 BINDING SITE1 and HPCAL1 BINDING SITE2, designated SEQ ID:7931 and SEQ ID:36465 respectively, to the nucleotide sequence of VGAM1680 RNA, herein designated VGAM RNA, also designated SEQ ID:4391.

Another function of VGAM1680 is therefore inhibition of Hippocalcin-like 1 (HPCAL1, Accession NM_002149). Accordingly, utilities of VGAM1680 include diagnosis, prevention and treatment of diseases and clinical conditions associated with HPCAL1. KIAA1910 (Accession XM_055514) is another VGAM1680 host target gene. KIAA1910 BINDING SITE is HOST TARGET binding site found in the 3' untranslated region of mRNA encoded by KIAA1910, corresponding to a HOST TARGET binding site such as BINDING SITE I, BINDING SITE II or BINDING SITE III. Table 2 illustrates the complementarity of the nucleotide sequences of KIAA1910 BINDING SITE, designated SEQ ID:36285, to the nucleotide sequence of VGAM1680 RNA, herein designated VGAM RNA, also designated SEQ ID:4391.

Another function of VGAM1680 is therefore inhibition of KIAA1910 (Accession XM_055514). Accordingly, utilities of VGAM1680 include diagnosis, prevention and treatment of diseases and clinical conditions associated with KIAA1910. MGC10818 (Accession NM_030568) is another VGAM1680 host target gene. MGC10818 BINDING SITE is HOST TARGET binding site found in the 5' untranslated region of mRNA encoded by MGC10818, corresponding to a HOST TARGET binding site such as BINDING SITE I, BINDING SITE II or BINDING SITE III. Table 2 illustrates the complementarity of the nucleotide sequences of MGC10818 BINDING SITE, designated SEQ ID:24940, to the nucleotide sequence of VGAM1680 RNA, herein designated VGAM RNA, also designated SEQ ID:4391.

Another function of VGAM1680 is therefore inhibition of MGC10818 (Accession NM_030568). Accordingly, utilities of VGAM1680 include diagnosis, prevention and treatment of diseases and clinical conditions associated with MGC10818. RAB40C, Member RAS Oncogene Family (RAB40C, Accession NM_021168) is another VGAM1680 host target gene. RAB40C BINDING SITE is HOST TARGET binding site found in the 3' untranslated region of mRNA encoded by RAB40C, corresponding to a HOST TARGET binding site such as BINDING SITE I, BINDING SITE II or BINDING SITE III. Table 2 illustrates the complementarity of the nucleotide sequences of RAB40C BINDING SITE, designated SEQ ID:22145, to the nucleotide sequence of VGAM1680 RNA, herein designated VGAM RNA, also designated SEQ ID:4391.

Another function of VGAM1680 is therefore inhibition of RAB40C, Member RAS Oncogene Family (RAB40C, Accession NM_021168). Accordingly, utilities of VGAM1680 include diagnosis, prevention and treatment of diseases and clinical conditions associated with RAB40C. SCAMP-4 (Accession NM_079834) is another VGAM1680 host target gene. SCAMP-4 BINDING SITE is HOST TARGET binding site found in the 3' untranslated region of mRNA encoded by SCAMP-4, corresponding to a HOST TARGET binding site such as BINDING SITE I, BINDING SITE II or BINDING SITE III. Table 2 illustrates the complementarity of the nucleotide sequences of SCAMP-4 BINDING SITE, designated SEQ ID:27822, to the nucleotide sequence of VGAM1680 RNA, herein designated VGAM RNA, also designated SEQ ID:4391.

Another function of VGAM1680 is therefore inhibition of SCAMP-4 (Accession NM_079834). Accordingly, utilities of VGAM1680 include diagnosis, prevention and treatment of diseases and clinical conditions associated with SCAMP-4. LOC221288 (Accession XM_168058) is another VGAM1680 host target gene. LOC221288 BINDING SITE is HOST TARGET binding site found in the 3' untranslated region of mRNA encoded by LOC221288, corresponding to a HOST TARGET binding site such as BINDING SITE I, BINDING SITE II or BINDING SITE III. Table 2 illustrates the complementarity of the nucleotide sequences of LOC221288 BINDING SITE, designated SEQ ID:44969, to the nucleotide sequence of VGAM1680 RNA, herein designated VGAM RNA, also designated SEQ ID:4391.

Another function of VGAM1680 is therefore inhibition of LOC221288 (Accession XM_168058). Accordingly, utilities of VGAM1680 include diagnosis, prevention and treatment of diseases and clinical conditions associated with LOC221288. FIG. 1 further provides a conceptual description of a novel bioinformatically detected viral gene of the present invention, referred to here as Viral Genomic Address Messenger 1681 (VGAM1681) viral gene, which modulates expression of respective host target genes thereof, the function and utility of which host target genes is known in the art.

VGAM1681 is a novel bioinformatically detected regulatory, non protein coding, viral micro RNA (miRNA) gene. The method by which VGAM1681 was detected is described hereinabove with reference to FIGS. 1-8.

VGAM1681 gene, herein designated VGAM GENE, is a viral gene contained in the genome of Vesicular Stomatitis Indiana Virus. VGAM1681 host target gene, herein designated VGAM HOST TARGET GENE, is a human gene contained in the human genome.

VGAM1681 gene encodes a VGAM1681 precursor RNA, herein designated VGAM PRECURSOR RNA. Similar to other miRNA genes, and unlike most ordinary genes, VGAM1681 precursor RNA does not encode a protein. A nucleotide sequence identical or highly similar to the nucleotide sequence of VGAM1681 precursor RNA is designated SEQ ID:1667, and is provided hereinbelow with reference to the sequence listing part. Nucleotide sequence SEQ ID:1667 is located at position 3549 relative to the genome of Vesicular Stomatitis Indiana Virus.

VGAM1681 precursor RNA folds onto itself, forming VGAM1681 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1681 folded precursor RNA into VGAM1681 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1681 RNA is designated SEQ ID:4392, and is provided hereinbelow with reference to the sequence listing part.

VGAM1681 host target gene, herein designated VGAM HOST TARGET GENE, encodes a corresponding messenger RNA, VGAM1681 host target RNA, herein designated VGAM HOST TARGET RNA. VGAM1681 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1681 RNA, herein designated VGAM RNA, binds complementarily to one or more host target binding sites located in untranslated regions of VGAM1681 host target RNA, herein designated VGAM HOST TARGET RNA. This complementary binding is due to the fact that the nucleotide sequence of VGAM1681 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1681 RNA, herein designated VGAM RNA, may have a different number of host target binding sites in untranslated regions of a VGAM1681 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1681 RNA, herein designated VGAM RNA, to host target binding sites on VGAM1681 host target RNA, herein designated VGAM HOST TARGET RNA, such as BINDING SITE I, BINDING SITE II and BINDING SITE III, inhibits translation of VGAM1681 host target RNA into VGAM1681 host target protein, herein designated VGAM HOST TARGET PROTEIN. VGAM host target protein is therefore outlined by a broken line.

It is appreciated that VGAM1681 host target gene, herein designated VGAM HOST TARGET GENE, in fact represents a plurality of VGAM1681 host target genes. The mRNA of each one of this plurality of VGAM1681 host target genes comprises one or more host target binding sites, each having a nucleotide sequence which is at least partly complementary to VGAM1681 RNA, herein designated VGAM RNA, and which when bound by VGAM1681 RNA causes inhibition of translation of respective one or more VGAM1681 host target proteins.

It is further appreciated by one skilled in the art that the mode of translational inhibition illustrated by FIG. 1 with specific reference to translational inhibition exerted by VGAM1681 gene, herein designated VGAM GENE, on one or more VGAM1681 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1681 is inhibition of expression of host target genes, as part of a novel viral mechanism of attacking a host. Accordingly, utilities of VGAM1681 include diagnosis, prevention and treatment of viral infection by Vesicular Stomatitis Indiana Virus. Specific functions, and accordingly utilities, of VGAM1681 correlate with, and may be deduced from, the identity of the host target genes which VGAM1681 binds and inhibits, and the function of these host target genes, as elaborated hereinbelow.

Nucleotide sequences of the VGAM1681 precursor RNA, herein designated VGAM PRECURSOR RNA, and of the 'diced' VGAM1681 RNA, herein designated VGAM RNA, and a schematic representation of the secondary folding of VGAM1681 folded precursor RNA, herein designated VGAM FOLDED PRECURSOR RNA, of VGAM1681 are further described hereinbelow with reference to Table 1.

Nucleotide sequences of host target binding sites, such as BINDING SITE-I, BINDING SITE-II and BINDING SITE-III of FIG. 1, found on VGAM1681 host target RNA, and schematic representation of the complementarity of each of these host target binding sites to VGAM1681 RNA, herein designated VGAM RNA, are described hereinbelow with reference to Table 2.

As mentioned hereinabove with reference to FIG. 1, a function of VGAM1681 gene, herein designated VGAM is inhibition of expression of VGAM1681 target genes. It is appreciated that specific functions, and accordingly utilities, of VGAM1681 correlate with, and may be deduced from, the identity of the target genes which VGAM1681 binds and inhibits, and the function of these target genes, as elaborated hereinbelow.

Cystic Fibrosis Transmembrane Conductance Regulator, ATP-binding Cassette (sub-family C, member 7) (CFTR, Accession NM_000492) is a VGAM1681 host target gene. CFTR BINDING SITE is HOST TARGET binding site found in the 3" untranslated region of mRNA encoded by CFTR, corresponding to a HOST TARGET binding site such as BINDING SITE I, BINDING SITE II or BINDING SITE III. Table 2 illustrates the complementarity of the nucleotide sequences of CFTR BINDING SITE, designated SEQ ID:6103, to the nucleotide sequence of VGAM1681 RNA, herein designated VGAM RNA, also designated SEQ ID:4392.

A function of VGAM1681 is therefore inhibition of Cystic Fibrosis Transmembrane Conductance Regulator, ATP-binding Cassette (sub-family C, member 7) (CFTR, Accession NM_000492). Accordingly, utilities of VGAM1681 include diagnosis, prevention and treatment of diseases and clinical conditions associated with CFTR. Steroid Sulfatase (microsomal), Arylsulfatase C, Isozyme S (STS, Accession NM_000351) is another VGAM1681 host target gene. STS BINDING SITE is HOST TARGET binding site found in the 3' untranslated region of mRNA encoded by STS, corresponding to a HOST TARGET binding site such as BINDING SITE I, BINDING SITE II or BINDING SITE III. Table 2 illustrates the complementarity of the nucleotide sequences of STS BINDING SITE, designated SEQ ID:5911, to the nucleotide sequence of VGAM1681 RNA, herein designated VGAM RNA, also designated SEQ ID:4392.

Another function of VGAM1681 is therefore inhibition of Steroid Sulfatase (microsomal), Arylsulfatase C, Isozyme S (STS, Accession NM_000351). Accordingly, utilities of VGAM1681 include diagnosis, prevention and treatment of diseases and clinical conditions associated with STS. FLJ11286 (Accession NM_018381) is another VGAM1681 host target gene. FLJ11286 BINDING SITE is HOST TARGET binding site found in the 3' untranslated region of mRNA encoded by FLJ11286, corresponding to a HOST TARGET binding site such as BINDING SITE I, BINDING SITE II or BINDING SITE III. Table 2 illustrates the complementarity of the nucleotide sequences of FLJ11286 BINDING SITE, designated SEQ ID:20414, to the nucleotide sequence of VGAM1681 RNA, herein designated VGAM RNA, also designated SEQ ID:4392.

Another function of VGAM1681 is therefore inhibition of FLJ11286 (Accession NM_018381). Accordingly, utilities of VGAM1681 include diagnosis, prevention and treatment of diseases and clinical conditions associated with FLJ11286. KIAA0747 (Accession NM_015292) is another VGAM1681 host target gene. KIAA0747 BINDING SITE is HOST TARGET binding site found in the 3' untranslated region of mRNA encoded by KIAA0747, corresponding to a HOST TARGET binding site such as BINDING SITE I, BINDING SITE II or BINDING SITE III. Table 2 illustrates the complementarity of the nucleotide sequences of KIAA0747 BINDING SITE, designated SEQ ID:17612, to the nucleotide sequence of VGAM1681 RNA, herein designated VGAM RNA, also designated SEQ ID:4392.

Another function of VGAM1681 is therefore inhibition of KIAA0747 (Accession NM_015292). Accordingly, utilities of VGAM1681 include diagnosis, prevention and treatment of diseases and clinical conditions associated with KIAA0747. MGC13061 (Accession NM_032322) is another VGAM1681 host target gene. MGC13061 BINDING SITE is HOST TARGET binding site found in the 3' untranslated region of mRNA encoded by MGC13061, corresponding to a HOST TARGET binding site such as BINDING SITE I, BINDING SITE II or BINDING SITE III. Table 2 illustrates the complementarity of the nucleotide sequences of MGC13061 BINDING SITE, designated SEQ ID:26132, to the nucleotide sequence of VGAM1681 RNA, herein designated VGAM RNA, also designated SEQ ID:4392.

Another function of VGAM1681 is therefore inhibition of MGC13061 (Accession NM_032322). Accordingly, utilities of VGAM1681 include diagnosis, prevention and treatment of diseases and clinical conditions associated with MGC13061. Talin 2 (TLN2, Accession XM_029473) is another VGAM1681 host target gene. TLN2 BINDING SITE is HOST TARGET binding site found in the 3' untranslated region of mRNA encoded by TLN2, corresponding to a HOST TARGET binding site such as BINDING SITE I, BINDING SITE II or BINDING SITE III. Table 2 illustrates the complementarity of the nucleotide sequences of TLN2 BINDING SITE, designated SEQ ID:30897, to the nucleotide sequence of VGAM1681 RNA, herein designated VGAM RNA, also designated SEQ ID:4392.

Another function of VGAM1681 is therefore inhibition of Talin 2 (TLN2, Accession XM_029473). Accordingly, utilities of VGAM1681 include diagnosis, prevention and treatment of diseases and clinical conditions associated with TLN2. LOC151361 (Accession XM_098048) is another VGAM1681 host target gene. LOC151361 BINDING SITE is HOST TARGET binding site found in the 3' untranslated region of mRNA encoded by LOC151361, corresponding to a HOST TARGET binding site such as BINDING SITE I, BINDING SITE II or BINDING SITE III. Table 2 illustrates the complementarity of the nucleotide sequences of LOC151361 BINDING SITE, designated SEQ ID:41334, to the nucleotide sequence of VGAM1681 RNA, herein designated VGAM RNA, also designated SEQ ID:4392.

Another function of VGAM1681 is therefore inhibition of LOC151361 (Accession XM_098048). Accordingly, utilities of VGAM1681 include diagnosis, prevention and treatment of diseases and clinical conditions associated with LOC151361. LOC158314 (Accession XM_098920) is another VGAM1681 host target gene. LOC158314 BINDING SITE is HOST TARGET binding site found in the 5' untranslated region of mRNA encoded by LOC158314, corresponding to a HOST TARGET binding site such as BINDING SITE I, BINDING SITE II or BINDING SITE III. Table 2 illustrates the complementarity of the nucleotide sequences of LOC158314 BINDING SITE, designated SEQ ID:41952, to the nucleotide sequence of VGAM1681 RNA, herein designated VGAM RNA, also designated SEQ ID:4392.

Another function of VGAM1681 is therefore inhibition of LOC158314 (Accession XM_098920). Accordingly, utilities of VGAM1681 include diagnosis, prevention and treatment of diseases and clinical conditions associated with LOC158314. FIG. 1 further provides a conceptual description of a novel bioinformatically detected viral gene of the present invention, referred to here as Viral Genomic Address Messenger 1682 (VGAM1682) viral gene, which modulates expression of respective host target genes thereof, the function and utility of which host target genes is known in the art.

VGAM1682 is a novel bioinformatically detected regulatory, non protein coding, viral micro RNA (miRNA) gene. The method by which VGAM1682 was detected is described hereinabove with reference to FIGS. 1-8.

VGAM1682 gene, herein designated VGAM GENE, is a viral gene contained in the genome of Vesicular Stomatitis Indiana Virus. VGAM1682 host target gene, herein designated VGAM HOST TARGET GENE, is a human gene contained in the human genome.

VGAM1682 gene encodes a VGAM1682 precursor RNA, herein designated VGAM PRECURSOR RNA. Similar to other miRNA genes, and unlike most ordinary genes, VGAM1682 precursor RNA does not encode a protein. A nucleotide sequence identical or highly similar to the nucleotide sequence of VGAM1682 precursor RNA is designated SEQ ID:1668, and is provided hereinbelow with reference to the sequence listing part. Nucleotide sequence SEQ ID:1668 is located at position 10245 relative to the genome of Vesicular Stomatitis Indiana Virus.

VGAM1682 precursor RNA folds onto itself, forming VGAM1682 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1682 folded precursor RNA into VGAM1682 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1682 RNA is designated SEQ ID:4393, and is provided hereinbelow with reference to the sequence listing part.

VGAM1682 host target gene, herein designated VGAM HOST TARGET GENE, encodes a corresponding messenger RNA, VGAM1682 host target RNA, herein designated VGAM HOST TARGET RNA. VGAM1682 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1682 RNA, herein designated VGAM RNA, binds complementarily to one or more host target binding sites located in untranslated regions of VGAM1682 host target RNA, herein designated VGAM HOST TARGET RNA. This complementary binding is due to the fact that the nucleotide sequence of VGAM1682 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1682 RNA, herein designated VGAM RNA, may have a different number of host target binding sites in untranslated regions of a VGAM1682 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1682 RNA, herein designated VGAM RNA, to host target binding sites on VGAM1682 host target RNA, herein designated VGAM HOST TARGET RNA, such as BINDING SITE I, BINDING SITE II and BINDING SITE III, inhibits translation of VGAM1682 host target RNA into VGAM1682 host target protein, herein designated VGAM HOST TARGET PROTEIN. VGAM host target protein is therefore outlined by a broken line.

It is appreciated that VGAM1682 host target gene, herein designated VGAM HOST TARGET GENE, in fact represents a plurality of VGAM1682 host target genes. The mRNA of each one of this plurality of VGAM1682 host target genes comprises one or more host target binding sites, each having a nucleotide sequence which is at least partly complementary to VGAM1682 RNA, herein designated VGAM RNA, and which when bound by VGAM1682 RNA causes inhibition of translation of respective one or more VGAM1682 host target proteins.

It is further appreciated by one skilled in the art that the mode of translational inhibition illustrated by FIG. 1 with specific reference to translational inhibition exerted by VGAM1682 gene, herein designated VGAM GENE, on one or more VGAM1682 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1682 is inhibition of expression of host target genes, as part of a novel viral mechanism of attacking a host. Accordingly, utilities of VGAM1682 include diagnosis, prevention and treatment of viral infection by Vesicular Stomatitis Indiana Virus. Specific functions, and accordingly utilities, of VGAM1682 correlate with, and may be deduced from, the identity of the host target genes which VGAM1682 binds and inhibits, and the function of these host target genes, as elaborated hereinbelow.

Nucleotide sequences of the VGAM1682 precursor RNA, herein designated VGAM PRECURSOR RNA, and of the 'diced' VGAM1682 RNA, herein designated VGAM RNA, and a schematic representation of the secondary folding of VGAM1682 folded precursor RNA, herein designated VGAM FOLDED PRECURSOR RNA, of VGAM1682 are further described hereinbelow with reference to Table 1.

Nucleotide sequences of host target binding sites, such as BINDING SITE-I, BINDING SITE-II and BINDING SITE-III of FIG. 1, found on VGAM1682 host target RNA, and schematic representation of the complementarity of each of these host target binding sites to VGAM1682 RNA, herein designated VGAM RNA, are described hereinbelow with reference to Table 2.

As mentioned hereinabove with reference to FIG. 1, a function of VGAM1682 gene, herein designated VGAM is inhibition of expression of VGAM1682 target genes. It is appreciated that specific functions, and accordingly utilities, of VGAM1682 correlate with, and may be deduced from, the identity of the target genes which VGAM1682 binds and inhibits, and the function of these target genes, as elaborated hereinbelow.

UDP-Gal:betaGlcNAc Beta 1,3-galactosyltransferase, Polypeptide 3 (B3GALT3, Accession NM_003781) is a VGAM1682 host target gene. B3GALT3 BINDING SITE1 through B3GALT3 BINDING SITE3 are HOST TARGET binding sites found in untranslated regions of mRNA encoded by B3GALT3, corresponding to HOST TARGET binding sites such as BINDING SITE I, BINDING SITE II or BINDING SITE III. Table 2 illustrates the complementarity of the nucleotide sequences of B3GALT3 BINDING SITE1 through B3GALT3 BINDING SITE3, designated SEQ ID:9867, SEQ ID:27016 and SEQ ID:27019 respectively, to the nucleotide sequence of VGAM1682 RNA, herein designated VGAM RNA, also designated SEQ ID:4393.

A function of VGAM1682 is therefore inhibition of UDP-Gal:betaGlcNAc Beta 1,3-galactosyltransferase, Polypeptide 3 (B3GALT3, Accession NM_003781). Accordingly, utilities of VGAM1682 include diagnosis, prevention and treatment of diseases and clinical conditions associated with B3GALT3. DEAD/H (Asp-Glu-Ala-Asp/His) Box Polypeptide 28 (DDX28, Accession NM_018380) is another VGAM1682 host target gene. DDX28 BINDING SITE is HOST TARGET binding site found in the 5' untranslated region of mRNA encoded by DDX28, corresponding to a HOST TARGET binding site such as BINDING SITE I, BINDING SITE II or BINDING SITE III. Table 2 illustrates the complementarity of the nucleotide sequences of DDX28 BINDING SITE, designated SEQ ID:20406, to the nucleotide sequence of VGAM1682 RNA, herein designated VGAM RNA, also designated SEQ ID:4393.

Another function of VGAM1682 is therefore inhibition of DEAD/H (Asp-Glu-Ala-Asp/His) Box Polypeptide 28 (DDX28, Accession NM_018380). Accordingly, utilities of VGAM1682 include diagnosis, prevention and treatment of diseases and clinical conditions associated with DDX28. KIAA1323 (Accession XM_032146) is another VGAM1682 host target gene. KIAA1323 BINDING SITE is HOST TARGET binding site found in the 5" untranslated region of mRNA encoded by KIAA1323, corresponding to a HOST TARGET binding site such as BINDING SITE I, BINDING SITE II or BINDING SITE III. Table 2 illustrates the complementarity of the nucleotide sequences of KIAA1323 BINDING SITE, designated SEQ ID:31572, to the nucleotide sequence of VGAM1682 RNA, herein designated VGAM RNA, also designated SEQ ID:4393.

Another function of VGAM1682 is therefore inhibition of KIAA1323 (Accession XM_032146). Accordingly, utilities of VGAM1682 include diagnosis, prevention and treatment of diseases and clinical conditions associated with KIAA1323. MGC5306 (Accession NM_024116) is another VGAM1682 host target gene. MGC5306 BINDING SITE is HOST TARGET binding site found in the 3' untranslated region of mRNA encoded by MGC5306, corresponding to a HOST TARGET binding site such as BINDING SITE I, BINDING SITE II or BINDING SITE III. Table 2 illustrates the complementarity of the nucleotide sequences of MGC5306 BINDING SITE, designated SEQ ID:23570, to the nucleotide sequence of VGAM1682 RNA, herein designated VGAM RNA, also designated SEQ ID:4393.

Another function of VGAM1682 is therefore inhibition of MGC5306 (Accession NM_024116). Accordingly, utilities of VGAM1682 include diagnosis, prevention and treatment of diseases and clinical conditions associated with MGC5306. PRO1386 (Accession NM_031269) is another VGAM1682 host target gene. PRO1386 BINDING SITE is HOST TARGET binding site found in the 5' untranslated region of mRNA encoded by PRO1386, corresponding to a HOST TARGET binding site such as BINDING SITE I, BINDING SITE II or BINDING SITE III. Table 2 illustrates the complementarity of the nucleotide sequences of PRO1386 BINDING SITE, designated SEQ ID:25292, to the nucleotide sequence of VGAM1682 RNA, herein designated VGAM RNA, also designated SEQ ID:4393.

Another function of VGAM1682 is therefore inhibition of PRO1386 (Accession NM_031269). Accordingly, utilities of VGAM1682 include diagnosis, prevention and treatment of diseases and clinical conditions associated with PRO1386. Testis-specific Transcript, Y-linked 9 (TTTY9, Accession NM_031927) is another VGAM1682 host target gene. TTTY9 BINDING SITE is HOST TARGET binding site found in the 5' untranslated region of mRNA encoded by TTTY9, corresponding to a HOST TARGET binding site such as BINDING SITE I, BINDING SITE II or BINDING SITE III. Table 2 illustrates the complementarity of the nucleotide sequences of TTTY9 BINDING SITE, designated SEQ ID:25681, to the nucleotide sequence of VGAM1682 RNA, herein designated VGAM RNA, also designated SEQ ID:4393.

Another function of VGAM1682 is therefore inhibition of Testis-specific Transcript, Y-linked 9 (TTTY9, Accession NM_031927). Accordingly, utilities of VGAM1682 include diagnosis, prevention and treatment of diseases and clinical conditions associated with TTTY9. LOC143286 (Accession XM_096412) is another VGAM1682 host target gene. LOC143286 BINDING SITE is HOST TARGET binding site found in the 5' untranslated region of mRNA encoded by LOC143286, corresponding to a HOST TARGET binding site such as BINDING SITE I, BINDING SITE II or BINDING SITE III. Table 2 illustrates the complementarity of the nucleotide sequences of LOC143286 BINDING SITE, designated SEQ ID:40351, to the nucleotide sequence of VGAM1682 RNA, herein designated VGAM RNA, also designated SEQ ID:4393.

Another function of VGAM1682 is therefore inhibition of LOC143286 (Accession XM_096412). Accordingly, utilities of VGAM1682 include diagnosis, prevention and treatment of diseases and clinical conditions associated with LOC143286. LOC150519 (Accession XM_086937) is another VGAM1682 host target gene. LOC150519 BINDING SITE is HOST TARGET binding site found in the 3' untranslated region of mRNA encoded by LOC150519, corresponding to a HOST TARGET binding site such as BINDING SITE I, BINDING SITE II or BINDING SITE III. Table 2 illustrates the complementarity of the nucleotide sequences of LOC150519 BINDING SITE, designated SEQ ID:38989, to the nucleotide sequence of VGAM1682 RNA, herein designated VGAM RNA, also designated SEQ ID:4393.

Another function of VGAM1682 is therefore inhibition of LOC150519 (Accession XM_086937). Accordingly, utilities of VGAM1682 include diagnosis, prevention and treatment of diseases and clinical conditions associated with LOC150519. LOC222128 (Accession XM_166560) is another VGAM1682 host target gene. LOC222128 BINDING SITE is HOST TARGET binding site found in the 5' untranslated region of mRNA encoded by LOC222128, corresponding to a HOST TARGET binding site such as BINDING SITE I, BINDING SITE II or BINDING SITE III. Table 2 illustrates the complementarity of the nucleotide sequences of LOC222128 BINDING SITE, designated SEQ ID:44543, to the nucleotide sequence of VGAM1682 RNA, herein designated VGAM RNA, also designated SEQ ID:4393.

Another function of VGAM1682 is therefore inhibition of LOC222128 (Accession XM_166560). Accordingly, utilities of VGAM1682 include diagnosis, prevention and treatment of diseases and clinical conditions associated with LOC222128. LOC57795 (Accession XM_045110) is another VGAM1682 host target gene. LOC57795 BINDING SITE is HOST TARGET binding site found in the 5' untranslated region of mRNA encoded by LOC57795, corresponding to a HOST TARGET binding site such as BINDING SITE I, BINDING SITE II or BINDING SITE III. Table 2 illustrates the complementarity of the nucleotide sequences of LOC57795 BINDING SITE, designated SEQ ID:34360, to the nucleotide sequence of VGAM1682 RNA, herein designated VGAM RNA, also designated SEQ ID:4393.

Another function of VGAM1682 is therefore inhibition of LOC57795 (Accession XM_045110). Accordingly, utilities of VGAM1682 include diagnosis, prevention and treatment of diseases and clinical conditions associated with LOC57795. LOC85479 (Accession NM_033105) is another VGAM1682 host target gene. LOC85479 BINDING SITE is HOST TARGET binding site found in the 5' untranslated region of mRNA encoded by LOC85479, corresponding to a HOST TARGET binding site such as BINDING SITE I, BINDING SITE II or BINDING SITE III. Table 2 illustrates the complementarity of the nucleotide sequences of LOC85479 BINDING SITE, designated SEQ ID:26959, to the nucleotide sequence of VGAM1682 RNA, herein designated VGAM RNA, also designated SEQ ID:4393.

Another function of VGAM1682 is therefore inhibition of LOC85479 (Accession NM_033105). Accordingly, utilities of VGAM1682 include diagnosis, prevention and treatment of diseases and clinical conditions associated with LOC85479. LOC92573 (Accession XM_045884) is another VGAM1682 host target gene. LOC92573 BINDING SITE is HOST TARGET binding site found in the 5' untranslated region of mRNA encoded by LOC92573, corresponding to a HOST TARGET binding site such as BINDING SITE I, BINDING SITE II or BINDING SITE III. Table 2 illustrates the complementarity of the nucleotide sequences of LOC92573 BINDING SITE, designated SEQ ID:34602, to the nucleotide sequence of VGAM1682 RNA, herein designated VGAM RNA, also designated SEQ ID:4393.

Another function of VGAM1682 is therefore inhibition of LOC92573 (Accession XM_045884). Accordingly, utilities of VGAM1682 include diagnosis, prevention and treatment of diseases and clinical conditions associated with LOC92573. LOC92973 (Accession XM_048529) is another VGAM1682 host target gene. LOC92973 BINDING SITE is HOST TARGET binding site found in the 5' untranslated region of mRNA encoded by LOC92973, corresponding to a HOST TARGET binding site such as BINDING SITE I, BINDING SITE II or BINDING SITE III. Table 2 illustrates the complementarity of the nucleotide sequences of LOC92973 BINDING SITE, designated SEQ ID:35182, to the nucleotide sequence of VGAM1682 RNA, herein designated VGAM RNA, also designated SEQ ID:4393.

Another function of VGAM1682 is therefore inhibition of LOC92973 (Accession XM_048529). Accordingly, utilities of VGAM1682 include diagnosis, prevention and treatment of diseases and clinical conditions associated with LOC92973. FIG. 1 further provides a conceptual description of a novel bioinformatically detected viral gene of the present invention, referred to here as Viral Genomic Address Messenger 1683 (VGAM1683) viral gene, which modulates expression of respective host target genes thereof, the function and utility of which host target genes is known in the art.

VGAM1683 is a novel bioinformatically detected regulatory, non protein coding, viral micro RNA (miRNA) gene. The method by which VGAM1683 was detected is described hereinabove with reference to FIGS. 1-8.

VGAM1683 gene, herein designated VGAM GENE, is a viral gene contained in the genome of Vesicular Stomatitis Indiana Virus. VGAM1683 host target gene, herein designated VGAM HOST TARGET GENE, is a human gene contained in the human genome.

VGAM1683 gene encodes a VGAM1683 precursor RNA, herein designated VGAM PRECURSOR RNA. Similar to other miRNA genes, and unlike most ordinary genes, VGAM1683 precursor RNA does not encode a protein. A nucleotide sequence identical or highly similar to the nucleotide sequence of VGAM1683 precursor RNA is designated SEQ ID:1669, and is provided hereinbelow with reference to the sequence listing part. Nucleotide sequence SEQ ID:1669 is located at position 8817 relative to the genome of Vesicular Stomatitis Indiana Virus.

VGAM1683 precursor RNA folds onto itself, forming VGAM1683 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1683 folded precursor RNA into VGAM1683 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1683 RNA is designated SEQ ID:4394, and is provided hereinbelow with reference to the sequence listing part.

VGAM1683 host target gene, herein designated VGAM HOST TARGET GENE, encodes a corresponding messenger RNA, VGAM1683 host target RNA, herein designated VGAM HOST TARGET RNA. VGAM1683 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1683 RNA, herein designated VGAM RNA, binds complementarily to one or more host target binding sites located in untranslated regions of VGAM1683 host target RNA, herein designated VGAM HOST TARGET RNA. This complementary binding is due to the fact that the nucleotide sequence of VGAM1683 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1683 RNA, herein designated VGAM RNA, may have a different number of host target binding sites in untranslated regions of a VGAM1683 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1683 RNA, herein designated VGAM RNA, to host target binding sites on VGAM1683 host target RNA, herein designated VGAM HOST TARGET RNA, such as BINDING SITE I, BINDING SITE II and BINDING SITE III, inhibits translation of VGAM1683 host target RNA into VGAM1683 host target protein, herein designated VGAM HOST TARGET PROTEIN. VGAM host target protein is therefore outlined by a broken line.

It is appreciated that VGAM1683 host target gene, herein designated VGAM HOST TARGET GENE, in fact represents a plurality of VGAM1683 host target genes. The mRNA of each one of this plurality of VGAM1683 host target genes comprises one or more host target binding sites, each having a nucleotide sequence which is at least partly complementary to VGAM1683 RNA, herein designated VGAM RNA, and which when bound by VGAM1683 RNA causes inhibition of translation of respective one or more VGAM1683 host target proteins.

It is further appreciated by one skilled in the art that the mode of translational inhibition illustrated by FIG. 1 with specific reference to translational inhibition exerted by VGAM1683 gene, herein designated VGAM GENE, on one or more VGAM1683 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1683 is inhibition of expression of host target genes, as part of a novel viral mechanism of attacking a host. Accordingly, utilities of VGAM1683 include diagnosis, prevention and treatment of viral infection by Vesicular Stomatitis Indiana Virus. Specific functions, and accordingly utilities, of VGAM1683 correlate with, and may be deduced from, the identity of the host target genes which VGAM1683 binds and inhibits, and the function of these host target genes, as elaborated hereinbelow.

Nucleotide sequences of the VGAM1683 precursor RNA, herein designated VGAM PRECURSOR RNA, and of the 'diced' VGAM1683 RNA, herein designated VGAM RNA, and a schematic representation of the secondary folding of VGAM1683 folded precursor RNA, herein designated VGAM FOLDED PRECURSOR RNA, of VGAM1683 are further described hereinbelow with reference to Table 1.

Nucleotide sequences of host target binding sites, such as BINDING SITE-I, BINDING SITE-II and BINDING SITE-III of FIG. 1, found on VGAM1683 host target RNA, and schematic representation of the complementarity of each of these host target binding sites to VGAM1683 RNA, herein designated VGAM RNA, are described hereinbelow with reference to Table 2.

As mentioned hereinabove with reference to FIG. 1, a function of VGAM1683 gene, herein designated VGAM is inhibition of expression of VGAM1683 target genes. It is appreciated that specific functions, and accordingly utilities, of VGAM1683 correlate with, and may be deduced from, the identity of the target genes which VGAM1683 binds and inhibits, and the function of these target genes, as elaborated hereinbelow.

Rac/Cdc42 Guanine Nucleotide Exchange Factor (GEF) 6 (ARHGEF6, Accession XM_042963) is a VGAM1683 host target gene. ARHGEF6 BINDING SITE is HOST TARGET binding site found in the 3' untranslated region of mRNA encoded by ARHGEF6, corresponding to a HOST TARGET binding site such as BINDING SITE I, BINDING SITE II or BINDING SITE III. Table 2 illustrates the complementarity of the nucleotide sequences of ARHGEF6 BINDING SITE, designated SEQ ID:33849, to the nucleotide sequence of VGAM1683 RNA, herein designated VGAM RNA, also designated SEQ ID:4394.

A function of VGAM1683 is therefore inhibition of Rac/Cdc42 Guanine Nucleotide Exchange Factor (GEF) 6 (ARHGEF6, Accession XM_042963). Accordingly, utilities of VGAM1683 include diagnosis, prevention and treatment of diseases and clinical conditions associated with ARHGEF6. BIG1 (Accession NM_006421) is another VGAM1683 host target gene. BIG1 BINDING SITE is HOST TARGET binding site found in the 3' untranslated region of mRNA encoded by BIG1, corresponding to a HOST TARGET binding site such as BINDING SITE I, BINDING SITE II or BINDING SITE III. Table 2 illustrates the complementarity of the nucleotide sequences of BIG1 BINDING SITE, designated SEQ ID:13137, to the nucleotide sequence of VGAM1683 RNA, herein designated VGAM RNA, also designated SEQ ID:4394.

Another function of VGAM1683 is therefore inhibition of BIG1 (Accession NM_006421), a gene which is a guanine nucleotide-exchange protein, has a role in vesicular transport. Accordingly, utilities of VGAM1683 include diagnosis, prevention and treatment of diseases and clinical conditions associated with BIG1. The function of BIG1 and its association with various diseases and clinical conditions, has been established by previous studies, as described hereinabove with reference to VGAM1190. V-raf-1 Murine Leukemia Viral Oncogene Homolog 1 (RAF1, Accession XM_087425) is another VGAM1683 host target gene. RAF1 BINDING SITE is HOST TARGET binding site found in the 3' untranslated region of mRNA encoded by RAF1, corresponding to a HOST TARGET binding site such as BINDING SITE I, BINDING SITE II or BINDING SITE III. Table 2 illustrates the complementarity of the nucleotide sequences of RAF1 BINDING SITE, designated SEQ ID:39246, to the nucleotide sequence of VGAM1683 RNA, herein designated VGAM RNA, also designated SEQ ID:4394.

Another function of VGAM1683 is therefore inhibition of V-raf-1 Murine Leukemia Viral Oncogene Homolog 1 (RAF1, Accession XM_087425). Accordingly, utilities of VGAM1683 include diagnosis, prevention and treatment of diseases and clinical conditions associated with RAF1. Sal-like 2 (Drosophila) (SALL2, Accession XM_033473) is another VGAM1683 host target gene. SALL2 BINDING SITE is HOST TARGET binding site found in the 3' untranslated region of mRNA encoded by SALL2, corresponding to a HOST TARGET binding site such as BINDING SITE I, BINDING SITE II or BINDING SITE III. Table 2 illustrates the complementarity of the nucleotide sequences of SALL2 BINDING SITE, designated SEQ ID:31938, to the nucleotide sequence of VGAM1683 RNA, herein designated VGAM RNA, also designated SEQ ID:4394.

Another function of VGAM1683 is therefore inhibition of Sal-like 2 (Drosophila) (SALL2, Accession XM_033473). Accordingly, utilities of VGAM1683 include diagnosis, prevention and treatment of diseases and clinical conditions associated with SALL2. Cysteine and Tyrosine-rich 1 (CYYR1, Accession NM_052954) is another VGAM1683 host target gene. CYYR1 BINDING SITE is HOST TARGET binding site found in the 3' untranslated region of mRNA encoded by CYYR1, corresponding to a HOST TARGET binding site such as BINDING SITE I, BINDING SITE II or BINDING SITE III. Table 2 illustrates the complementarity of the nucleotide sequences of CYYR1 BINDING SITE, designated SEQ ID:27516, to the nucleotide sequence of VGAM1683 RNA, herein designated VGAM RNA, also designated SEQ ID:4394.

Another function of VGAM1683 is therefore inhibition of Cysteine and Tyrosine-rich 1 (CYYR1, Accession NM_052954). Accordingly, utilities of VGAM1683 include diagnosis, prevention and treatment of diseases and clinical conditions associated with CYYR1. FLJ13782 (Accession NM_024915) is another VGAM1683 host target gene. FLJ13782 BINDING SITE is HOST TARGET binding site found in the 3' untranslated region of mRNA encoded by FLJ13782, corresponding to a HOST TARGET binding site such as BINDING SITE I, BINDING SITE II or BINDING SITE III. Table 2 illustrates the complementarity of the nucleotide sequences of FLJ13782 BINDING SITE, designated SEQ ID:24439, to the nucleotide sequence of VGAM1683 RNA, herein designated VGAM RNA, also designated SEQ ID:4394.

Another function of VGAM1683 is therefore inhibition of FLJ13782 (Accession NM_024915). Accordingly, utilities of VGAM1683 include diagnosis, prevention and treatment of diseases and clinical conditions associated with FLJ13782. KIAA0895 (Accession XM_166573) is another VGAM1683 host target gene. KIAA0895 BINDING SITE is HOST TARGET binding site found in the 3' untranslated region of mRNA encoded by KIAA0895, corresponding to a HOST TARGET binding site such as BINDING SITE I, BINDING SITE II or BINDING SITE III. Table 2 illustrates the complementarity of the nucleotide sequences of KIAA0895 BINDING SITE, designated SEQ ID:44547, to the nucleotide sequence of VGAM1683 RNA, herein designated VGAM RNA, also designated SEQ ID:4394.

Another function of VGAM1683 is therefore inhibition of KIAA0895 (Accession XM_166573). Accordingly, utilities of VGAM1683 include diagnosis, prevention and treatment of diseases and clinical conditions associated with KIAA0895. KIAA1255 (Accession XM_040626) is another VGAM1683 host target gene. KIAA1255 BINDING SITE is HOST TARGET binding site found in the 3' untranslated region of mRNA encoded by KIAA1255, corresponding to a HOST TARGET binding site such as BINDING SITE I, BINDING SITE II or BINDING SITE III. Table 2 illustrates the complementarity of the nucleotide sequences of KIAA1255 BINDING SITE, designated SEQ ID:33346, to the nucleotide sequence of VGAM1683 RNA, herein designated VGAM RNA, also designated SEQ ID:4394.

Another function of VGAM1683 is therefore inhibition of KIAA1255 (Accession XM_040626). Accordingly, utilities of VGAM1683 include diagnosis, prevention and treatment of diseases and clinical conditions associated with KIAA1255. KIAA1387 (Accession XM_048092) is another VGAM1683 host target gene. KIAA1387 BINDING SITE is HOST TARGET binding site found in the 3' untranslated region of mRNA encoded by KIAA1387, corresponding to a HOST TARGET binding site such as BINDING SITE I, BINDING SITE II or BINDING SITE III. Table 2 illustrates the complementarity of the nucleotide sequences of KIAA1387 BINDING SITE, designated SEQ ID:35105, to the nucleotide sequence of VGAM1683 RNA, herein designated VGAM RNA, also designated SEQ ID:4394.

Another function of VGAM1683 is therefore inhibition of KIAA1387 (Accession XM_048092). Accordingly, utilities of VGAM1683 include diagnosis, prevention and treatment of diseases and clinical conditions associated with KIAA1387. SCYB10 (Accession NM_001565) is another VGAM1683 host target gene. SCYB10 BINDING SITE is HOST TARGET binding site found in the 3' untranslated region of mRNA encoded by SCYB10, corresponding to a HOST TARGET binding site such as BINDING SITE I, BINDING SITE II or BINDING SITE III. Table 2 illustrates the complementarity of the nucleotide sequences of SCYB10 BINDING SITE, designated SEQ ID:7293, to the nucleotide sequence of VGAM1683 RNA, herein designated VGAM RNA, also designated SEQ ID:4394.

Another function of VGAM1683 is therefore inhibition of SCYB10 (Accession NM_001565). Accordingly, utilities of VGAM1683 include diagnosis, prevention and treatment of diseases and clinical conditions associated with SCYB10. Solute Carrier Family 1 (glutamate transporter), Member 7 (SLC1A7, Accession NM_006671) is another VGAM1683 host target gene. SLC1A7 BINDING SITE is HOST TARGET binding site found in the 3' untranslated region of mRNA encoded by SLC1A7, corresponding to a HOST TARGET binding site such as BINDING SITE I, BINDING SITE II or BINDING SITE III. Table 2 illustrates the complementarity of the nucleotide sequences of SLC1A7 BINDING SITE, designated SEQ ID:13490, to the nucleotide sequence of VGAM1683 RNA, herein designated VGAM RNA, also designated SEQ ID:4394.

Another function of VGAM1683 is therefore inhibition of Solute Carrier Family 1 (glutamate transporter), Member 7 (SLC1A7, Accession NM_006671). Accordingly, utilities of VGAM1683 include diagnosis, prevention and treatment of diseases and clinical conditions associated with SLC1A7. LOC203339 (Accession XM_117534) is another VGAM1683 host target gene. LOC203339 BINDING SITE is HOST TARGET binding site found in the 5' untranslated region of mRNA encoded by LOC203339, corresponding to a HOST TARGET binding site such as BINDING SITE I, BINDING SITE II or BINDING SITE III. Table 2 illustrates the complementarity of the nucleotide sequences of LOC203339 BINDING SITE, designated SEQ ID:43527, to the nucleotide sequence of VGAM1683 RNA, herein designated VGAM RNA, also designated SEQ ID:4394.

Another function of VGAM1683 is therefore inhibition of LOC203339 (Accession XM_117534). Accordingly, utilities of VGAM1683 include diagnosis, prevention and treatment of diseases and clinical conditions associated with LOC203339. LOC222234 (Accession XM_168558) is another VGAM1683 host target gene. LOC222234 BINDING SITE is HOST TARGET binding site found in the 3' untranslated region of mRNA encoded by LOC222234, corresponding to a HOST TARGET binding site such as BINDING SITE I, BINDING SITE II or BINDING SITE III. Table 2 illustrates the complementarity of the nucleotide sequences of LOC222234 BINDING SITE, designated SEQ ID:45239, to the nucleotide sequence of VGAM1683 RNA, herein designated VGAM RNA, also designated SEQ ID:4394.

Another function of VGAM1683 is therefore inhibition of LOC222234 (Accession XM_168558). Accordingly, utilities of VGAM1683 include diagnosis, prevention and treatment of diseases and clinical conditions associated with LOC222234. FIG. 1 further provides a conceptual description of a novel bioinformatically detected viral gene of the present invention, referred to here as Viral Genomic Address Messenger 1684 (VGAM1684) viral gene, which modulates expression of respective host target genes thereof, the function and utility of which host target genes is known in the art.

VGAM1684 is a novel bioinformatically detected regulatory, non protein coding, viral micro RNA (miRNA) gene. The method by which VGAM1684 was detected is described hereinabove with reference to FIGS. 1-8.

VGAM1684 gene, herein designated VGAM GENE, is a viral gene contained in the genome of Vesicular Stomatitis Indiana Virus. VGAM1684 host target gene, herein designated VGAM HOST TARGET GENE, is a human gene contained in the human genome.

VGAM1684 gene encodes a VGAM1684 precursor RNA, herein designated VGAM PRECURSOR RNA. Similar to other miRNA genes, and unlike most ordinary genes, VGAM1684 precursor RNA does not encode a protein. A nucleotide sequence identical or highly similar to the nucleotide sequence of VGAM1684 precursor RNA is designated SEQ ID:1670, and is provided hereinbelow with reference to the sequence listing part. Nucleotide sequence SEQ ID:1670 is located at position 5581 relative to the genome of Vesicular Stomatitis Indiana Virus.

VGAM1684 precursor RNA folds onto itself, forming VGAM1684 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1684 folded precursor RNA into VGAM1684 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 68%) nucleotide sequence of VGAM1684 RNA is designated SEQ ID:4395, and is provided hereinbelow with reference to the sequence listing part.

VGAM1684 host target gene, herein designated VGAM HOST TARGET GENE, encodes a corresponding messenger RNA, VGAM1684 host target RNA, herein designated VGAM HOST TARGET RNA. VGAM1684 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1684 RNA, herein designated VGAM RNA, binds complementarily to one or more host target binding sites located in untranslated regions of VGAM1684 host target RNA, herein designated VGAM HOST TARGET RNA. This complementary binding is due to the fact that the nucleotide sequence of VGAM1684 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1684 RNA, herein designated VGAM RNA, may have a different number of host target binding sites in untranslated regions of a VGAM1684 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1684 RNA, herein designated VGAM RNA, to host target binding sites on VGAM1684 host target RNA, herein designated VGAM HOST TARGET RNA, such as BINDING SITE I, BINDING SITE II and BINDING SITE III, inhibits translation of VGAM1684 host target RNA into VGAM1684 host target protein, herein designated VGAM HOST TARGET PROTEIN. VGAM host target protein is therefore outlined by a broken line.

It is appreciated that VGAM1684 host target gene, herein designated VGAM HOST TARGET GENE, in fact represents a plurality of VGAM1684 host target genes. The mRNA of each one of this plurality of VGAM1684 host target genes comprises one or more host target binding sites, each having a nucleotide sequence which is at least partly complementary to VGAM1684 RNA, herein designated VGAM RNA, and which when bound by VGAM1684 RNA causes inhibition of translation of respective one or more VGAM1684 host target proteins.

It is further appreciated by one skilled in the art that the mode of translational inhibition illustrated by FIG. 1 with specific reference to translational inhibition exerted by VGAM1684 gene, herein designated VGAM GENE, on one or more VGAM1684 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1684 is inhibition of expression of host target genes, as part of a novel viral mechanism of attacking a host. Accordingly, utilities of VGAM1684 include diagnosis, prevention and treatment of viral infection by Vesicular Stomatitis Indiana Virus. Specific functions, and accordingly utilities of VGAM1684 correlate with, and may be deduced from, the identity of the host target genes which VGAM1684 binds and inhibits, and the function of these host target genes, as elaborated hereinbelow.

Nucleotide sequences of the VGAM1684 precursor RNA, herein designated VGAM PRECURSOR RNA, and of the 'diced' VGAM1684 RNA, herein designated VGAM RNA, and a schematic representation of the secondary folding of VGAM1684 folded precursor RNA, herein designated VGAM FOLDED PRECURSOR RNA, of VGAM1684 are further described hereinbelow with reference to Table 1.

Nucleotide sequences of host target binding sites, such as BINDING SITE-I, BINDING SITE-II and BINDING SITE-III of FIG. 1, found on VGAM1684 host target RNA, and schematic representation of the complementarity of each of these host target binding sites to VGAM1684 RNA, herein designated VGAM RNA, are described hereinbelow with reference to Table 2.

As mentioned hereinabove with reference to FIG. 1, a function of VGAM1684 gene, herein designated VGAM is inhibition of expression of VGAM1684 target genes. It is appreciated that specific functions, and accordingly utilities, of VGAM1684 correlate with, and may be deduced from, the identity of the target genes which VGAM1684 binds and inhibits, and the function of these target genes, as elaborated hereinbelow.

Sorting Nexin 3 (SNX3, Accession NM_003795) is a VGAM1684 host target gene. SNX3 BINDING SITE is HOST TARGET binding site found in the 3' untranslated region of mRNA encoded by SNX3, corresponding to a HOST TARGET binding site such as BINDING SITE I, BINDING SITE II or BINDING SITE III. Table 2 illustrates the complementarity of the nucleotide sequences of SNX3 BINDING SITE, designated SEQ ID:9876, to the nucleotide sequence of VGAM1684 RNA, herein designated VGAM RNA, also designated SEQ ID:4395.

A function of VGAM1684 is therefore inhibition of Sorting Nexin 3 (SNX3, Accession NM_003795). Accordingly, utilities of VGAM1684 include diagnosis, prevention and treatment of diseases and clinical conditions associated with SNX3. LOC115265 (Accession XM_055596) is another VGAM1684 host target gene. LOC115265 BINDING SITE is HOST TARGET binding site found in the 3' untranslated region of mRNA encoded by LOC115265, corresponding to a HOST TARGET binding site such as BINDING SITE I, BINDING SITE II or BINDING SITE III. Table 2 illustrates the complementarity of the nucleotide sequences of LOC115265 BINDING SITE, designated SEQ ID:36305, to the nucleotide sequence of VGAM1684 RNA, herein designated VGAM RNA, also designated SEQ ID:4395.

Another function of VGAM1684 is therefore inhibition of LOC115265 (Accession XM_055596). Accordingly, utilities of VGAM1684 include diagnosis, prevention and treatment of diseases and clinical conditions associated with LOC115265. FIG. 1 further provides a conceptual description of a novel bioinformatically detected viral gene of the present invention, referred to here as Viral Genomic Address Messenger 1685 (VGAM1685) viral gene, which modulates expression of respective host target genes thereof, the function and utility of which host target genes is known in the art.

VGAM1685 is a novel bioinformatically detected regulatory, non protein coding, viral micro RNA (miRNA) gene. The method by which VGAM1685 was detected is described hereinabove with reference to FIGS. 1-8.

VGAM1685 gene, herein designated VGAM GENE, is a viral gene contained in the genome of Vesicular Stomatitis Indiana Virus. VGAM1685 host target gene, herein designated VGAM HOST TARGET GENE, is a human gene contained in the human genome.

VGAM1685 gene encodes a VGAM1685 precursor RNA, herein designated VGAM PRECURSOR RNA. Similar to other miRNA genes, and unlike most ordinary genes, VGAM1685 precursor RNA does not encode a protein. A nucleotide sequence identical or highly similar to the nucleotide sequence of VGAM1685 precursor RNA is designated SEQ ID:1671, and is provided hereinbelow with reference to the sequence listing part. Nucleotide sequence SEQ ID:1671 is located at position 4965 relative to the genome of Vesicular Stomatitis Indiana Virus.

VGAM1685 precursor RNA folds onto itself, forming VGAM1685 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1685 folded precursor RNA into VGAM1685 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM1685 RNA is designated SEQ ID:4396, and is provided hereinbelow with reference to the sequence listing part.

VGAM1685 host target gene, herein designated VGAM HOST TARGET GENE, encodes a corresponding messenger RNA, VGAM1685 host target RNA, herein designated VGAM HOST TARGET RNA. VGAM1685 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1685 RNA, herein designated VGAM RNA, binds complementarily to one or more host target binding sites located in untranslated regions of VGAM1685 host target RNA, herein designated VGAM HOST TARGET RNA. This complementary binding is due to the fact that the nucleotide sequence of VGAM1685 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1685 RNA, herein designated VGAM RNA, may have a different number of host target binding sites in untranslated regions of a VGAM1685 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1685 RNA, herein designated VGAM RNA, to host target binding sites on VGAM1685 host target RNA, herein designated VGAM HOST TARGET RNA, such as BINDING SITE I, BINDING SITE II and BINDING SITE III, inhibits translation of VGAM1685 host target RNA into VGAM1685 host target protein, herein designated VGAM HOST TARGET PRO- TEIN. VGAM host target protein is therefore outlined by a broken line.

It is appreciated that VGAM1685 host target gene, herein designated VGAM HOST TARGET GENE, in fact represents a plurality of VGAM1685 host target genes. The mRNA of each one of this plurality of VGAM1685 host target genes comprises one or more host target binding sites, each having a nucleotide sequence which is at least partly complementary to VGAM1685 RNA, herein designated VGAM RNA, and which when bound by VGAM1685 RNA causes inhibition of translation of respective one or more VGAM1685 host target proteins.

It is further appreciated by one skilled in the art that the mode of translational inhibition illustrated by FIG. 1 with specific reference to translational inhibition exerted by VGAM1685 gene, herein designated VGAM GENE, on one or more VGAM1685 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1685 is inhibition of expression of host target genes, as part of a novel viral mechanism of attacking a host. Accordingly, utilities of VGAM1685 include diagnosis, prevention and treatment of viral infection by Vesicular Stomatitis Indiana Virus. Specific functions, and accordingly utilities, of VGAM1685 correlate with, and may be deduced from, the identity of the host target genes which VGAM1685 binds and inhibits, and the function of these host target genes, as elaborated hereinbelow.

Nucleotide sequences of the VGAM1685 precursor RNA, herein designated VGAM PRECURSOR RNA, and of the 'diced' VGAM1685 RNA, herein designated VGAM RNA, and a schematic representation of the secondary folding of VGAM1685 folded precursor RNA, herein designated VGAM FOLDED PRECURSOR RNA, of VGAM1685 are further described hereinbelow with reference to Table 1.

Nucleotide sequences of host target binding sites, such as BINDING SITE-I, BINDING SITE-II and BINDING SITE-III of FIG. 1, found on VGAM1685 host target RNA, and schematic representation of the complementarity of each of these host target binding sites to VGAM1685 RNA, herein designated VGAM RNA, are described hereinbelow with reference to Table 2.

As mentioned hereinabove with reference to FIG. 1, a function of VGAM1685 gene, herein designated VGAM is inhibition of expression of VGAM1685 target genes. It is appreciated that specific functions, and accordingly utilities, of VGAM1685 correlate with, and may be deduced from, the identity of the target genes which VGAM1685 binds and inhibits, and the function of these target genes, as elaborated hereinbelow.

TU3A (Accession NM_007177) is a VGAM1685 host target gene. TU3A BINDING SITE is HOST TARGET binding site found in the 3' untranslated region of mRNA encoded by TU3A, corresponding to a HOST TARGET binding site such as BINDING SITE I, BINDING SITE II or BINDING SITE III. Table 2 illustrates the complementarity of the nucleotide sequences of TU3A BINDING SITE, designated SEQ ID:14035, to the nucleotide sequence of VGAM1685 RNA, herein designated VGAM RNA, also designated SEQ ID:4396.

A function of VGAM1685 is therefore inhibition of TU3A (Accession NM_007177). Accordingly, utilities of VGAM1685 include diagnosis, prevention and treatment of diseases and clinical conditions associated with TU3A. LOC257481 (Accession XM_028192) is another VGAM1685 host target gene. LOC257481 BINDING SITE is HOST TARGET binding site found in the 3' untranslated region of mRNA encoded by LOC257481, corresponding to a HOST TARGET binding site such as BINDING SITE I, BINDING SITE II or BINDING SITE III. Table 2 illustrates the complementarity of the nucleotide sequences of LOC257481 BINDING SITE, designated SEQ ID:30631, to the nucleotide sequence of VGAM1685 RNA, herein designated VGAM RNA, also designated SEQ ID:4396.

Another function of VGAM1685 is therefore inhibition of LOC257481 (Accession XM_028192). Accordingly, utilities of VGAM1685 include diagnosis, prevention and treatment of diseases and clinical conditions associated with LOC257481. FIG. 1 further provides a conceptual description of a novel bioinformatically detected viral gene of the present invention, referred to here as Viral Genomic Address Messenger 1686 (VGAM1686) viral gene, which modulates expression of respective host target genes thereof, the function and utility of which host target genes is known in the art.

VGAM1686 is a novel bioinformatically detected regulatory, non protein coding, viral micro RNA (miRNA) gene. The method by which VGAM1686 was detected is described hereinabove with reference to FIGS. 1-8.

VGAM1686 gene, herein designated VGAM GENE, is a viral gene contained in the genome of Vesicular Stomatitis Indiana Virus. VGAM1686 host target gene, herein designated VGAM HOST TARGET GENE, is a human gene contained in the human genome.

VGAM1686 gene encodes a VGAM1686 precursor RNA, herein designated VGAM PRECURSOR RNA. Similar to other miRNA genes, and unlike most ordinary genes, VGAM1686 precursor RNA does not encode a protein. A nucleotide sequence identical or highly similar to the nucleotide sequence of VGAM1686 precursor RNA is designated SEQ ID:1672, and is provided hereinbelow with reference to the sequence listing part. Nucleotide sequence SEQ ID:1672 is located at position 2116 relative to the genome of Vesicular Stomatitis Indiana Virus.

VGAM1686 precursor RNA folds onto itself, forming VGAM1686 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1686 folded precursor RNA into VGAM1686 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1686 RNA is designated SEQ ID:4397, and is provided hereinbelow with reference to the sequence listing part.

VGAM1686 host target gene, herein designated VGAM HOST TARGET GENE, encodes a corresponding messenger RNA, VGAM1686 host target RNA, herein designated VGAM HOST TARGET RNA. VGAM1686 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1686 RNA, herein designated VGAM RNA, binds complementarily to one or more host target binding sites located in untranslated regions of VGAM1686 host target RNA, herein designated VGAM HOST TARGET RNA. This complementary binding is due to the fact that the nucleotide sequence of VGAM1686 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1686 RNA, herein designated VGAM RNA, may have a different number of host target binding sites in untranslated regions of a VGAM1686 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1686 RNA, herein designated VGAM RNA, to host target binding sites on VGAM1686 host target RNA, herein designated VGAM HOST TARGET RNA, such as BINDING SITE I, BINDING SITE II and BINDING SITE III, inhibits translation of VGAM1686 host target RNA into VGAM1686 host target protein, herein designated VGAM HOST TARGET PROTEIN. VGAM host target protein is therefore outlined by a broken line.

It is appreciated that VGAM1686 host target gene, herein designated VGAM HOST TARGET GENE, in fact represents a plurality of VGAM1686 host target genes. The mRNA of each one of this plurality of VGAM1686 host target genes comprises one or more host target binding sites, each having a nucleotide sequence which is at least partly complementary to VGAM1686 RNA, herein designated VGAM RNA, and which when bound by VGAM1686 RNA causes inhibition of translation of respective one or more VGAM1686 host target proteins.

It is further appreciated by one skilled in the art that the mode of translational inhibition illustrated by FIG. 1 with specific reference to translational inhibition exerted by VGAM1686 gene, herein designated VGAM GENE, on one or more VGAM1686 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1686 is inhibition of expression of host target genes, as part of a novel viral mechanism of attacking a host. Accordingly, utilities of VGAM1686 include diagnosis, prevention and treatment of viral infection by Vesicular Stomatitis Indiana Virus. Specific functions, and accordingly utilities, of VGAM1686 correlate with, and may be deduced from, the identity of the host target genes which VGAM1686 binds and inhibits, and the function of these host target genes, as elaborated hereinbelow.

Nucleotide sequences of the VGAM1686 precursor RNA, herein designated VGAM PRECURSOR RNA, and of the 'diced' VGAM1686 RNA, herein designated VGAM RNA, and a schematic representation of the secondary folding of VGAM1686 folded precursor RNA, herein designated VGAM FOLDED PRECURSOR RNA, of VGAM1686 are further described hereinbelow with reference to Table 1.

Nucleotide sequences of host target binding sites, such as BINDING SITE-I, BINDING SITE-II and BINDING SITE-III of FIG. 1, found on VGAM1686 host target RNA, and schematic representation of the complementarity of each of these host target binding sites to VGAM1686 RNA, herein designated VGAM RNA, are described hereinbelow with reference to Table 2.

As mentioned hereinabove with reference to FIG. 1, a function of VGAM1686 gene, herein designated VGAM is inhibition of expression of VGAM1686 target genes. It is appreciated that specific functions, and accordingly utilities, of VGAM1686 correlate with, and may be deduced from, the identity of the target genes which VGAM1686 binds and inhibits, and the function of these target genes, as elaborated hereinbelow.

ATP-binding Cassette, Sub-family C (CFTR/MRP), Member 12 (ABCC12, Accession NM_033226) is a VGAM1686 host target gene. ABCC12 BINDING SITE is HOST TARGET binding site found in the 3' untranslated region of mRNA encoded by ABCC12, corresponding to a HOST TARGET binding site such as BINDING SITE I, BINDING SITE II or BINDING SITE III. Table 2 illustrates the complementarity of the nucleotide sequences of ABCC12 BINDING SITE, designated SEQ ID:27072, to the nucleotide sequence of VGAM1686 RNA, herein designated VGAM RNA, also designated SEQ ID:4397.

A function of VGAM1686 is therefore inhibition of ATP-binding Cassette, Sub-family C (CFTR/MRP), Member 12 (ABCC12, Accession NM_033226), a gene which acts as a multispecific organic anion pump which can transport nucleotide analogs (by similarity). Accordingly, utilities of VGAM1686 include diagnosis, prevention and treatment of diseases and clinical conditions associated with ABCC12. The function of ABCC12 and its association with various diseases and clinical conditions, has been established by previous studies, as described hereinabove with reference to VGAM1246. Axin 1 (AXIN1, Accession XM_027520) is another VGAM1686 host target gene. AXIN1 BINDING SITE is HOST TARGET binding site found in the 3' untranslated region of mRNA encoded by AXIN1, corresponding to a HOST TARGET binding site such as BINDING SITE I, BINDING SITE II or BINDING SITE III. Table 2 illustrates the complementarity of the nucleotide sequences of AXIN1 BINDING SITE, designated SEQ ID:30518, to the nucleotide sequence of VGAM1686 RNA, herein designated VGAM RNA, also designated SEQ ID:4397.

Another function of VGAM1686 is therefore inhibition of Axin 1 (AXIN1, Accession XM_027520). Accordingly, utilities of VGAM1686 include diagnosis, prevention and treatment of diseases and clinical conditions associated with AXIN1. Potassium Channel, Subfamily K, Member 5 (KCNK5, Accession NM_003740) is another VGAM1686 host target gene. KCNK5 BINDING SITE is HOST TAR- GET binding site found in the 3' untranslated region of mRNA encoded by KCNK5, corresponding to a HOST TARGET binding site such as BINDING SITE I, BINDING SITE II or BINDING SITE III. Table 2 illustrates the complementarity of the nucleotide sequences of KCNK5 BINDING SITE, designated SEQ ID:9828, to the nucleotide sequence of VGAM1686 RNA, herein designated VGAM RNA, also designated SEQ ID:4397.

Another function of VGAM1686 is therefore inhibition of Potassium Channel, Subfamily K, Member 5 (KCNK5, Accession NM_003740). Accordingly, utilities of VGAM1686 include diagnosis, prevention and treatment of diseases and clinical conditions associated with KCNK5. L1 Cell Adhesion Molecule (hydrocephalus, stenosis of aqueduct of Sylvius 1, MASA (mental retardation, aphasia, shuffling gait and adducted thumbs) Syndrome, Spastic Paraplegia 1) (L1CAM, Accession NM_000425) is another VGAM1686 host target gene. L1CAM BINDING SITE1 and L1CAM BINDING SITE2 are HOST TARGET binding sites found in untranslated regions of mRNA encoded by L1CAM, corresponding to HOST TARGET binding sites such as BINDING SITE I, BINDING SITE II or BINDING SITE III. Table 2 illustrates the complementarity of the nucleotide sequences of L1CAM BINDING SITE1 and L1CAM BINDING SITE2, designated SEQ ID:6003 and SEQ ID:23431 respectively, to the nucleotide sequence of VGAM1686 RNA, herein designated VGAM RNA, also designated SEQ ID:4397.

Another function of VGAM1686 is therefore inhibition of L1 Cell Adhesion Molecule (hydrocephalus, stenosis of aqueduct of Sylvius 1, MASA (mental retardation, aphasia, shuffling gait and adducted thumbs) Syndrome, Spastic Paraplegia 1) (L1CAM, Accession NM_000425). Accordingly, utilities of VGAM1686 include diagnosis, prevention and treatment of diseases and clinical conditions associated with L1CAM. Peroxisome Biogenesis Factor 10 (PEX10, Accession NM_002617) is another VGAM1686 host target gene. PEX10 BINDING SITE is HOST TARGET binding site found in the 3' untranslated region of mRNA encoded by PEX10, corresponding to a HOST TARGET binding site such as BINDING SITE I, BINDING SITE II or BINDING SITE III. Table 2 illustrates the complementarity of the nucleotide sequences of PEX10 BINDING SITE, designated SEQ ID:8479, to the nucleotide sequence of VGAM1686 RNA, herein designated VGAM RNA, also designated SEQ ID:4397.

Another function of VGAM1686 is therefore inhibition of Peroxisome Biogenesis Factor 10 (PEX10, Accession NM_002617). Accordingly, utilities of VGAM1686 include diagnosis, prevention and treatment of diseases and clinical conditions associated with PEX10. Phosphoinositide-3-kinase, Regulatory Subunit, Polypeptide 1 (p85 alpha) (PIK3R1, Accession XM_043865) is another VGAM1686 host target gene. PIK3R1 BINDING SITE is HOST TARGET binding site found in the 3' untranslated region of mRNA encoded by PIK3R1, corresponding to a HOST TARGET binding site such as BINDING SITE I, BINDING SITE II or BINDING SITE III. Table 2 illustrates the complementarity of the nucleotide sequences of PIK3R1 BINDING SITE, designated SEQ ID:34036, to the nucleotide sequence of VGAM1686 RNA, herein designated VGAM RNA, also designated SEQ ID:4397.

Another function of VGAM1686 is therefore inhibition of Phosphoinositide-3-kinase, Regulatory Subunit, Polypeptide 1 (p85 alpha) (PIK3R1, Accession XM_043865), a gene which acts as an adapter, for the insulin-stimulated increase in glucose uptake and glycogen synthesis. Accordingly, utilities of VGAM1686 include diagnosis, prevention and treatment of diseases and clinical conditions associated with PIK3R1. The function of PIK3R1 and its association with various diseases and clinical conditions, has been established by previous studies, as described hereinabove with reference to VGAM826. Serine Hydroxymethyltransferase 1 (soluble) (SHMT1, Accession NM_004169) is another VGAM1686 host target gene. SHMT1 BINDING SITE is HOST TARGET binding site found in the 3' untranslated region of mRNA encoded by SHMT1, corresponding to a HOST TARGET binding site such as BINDING SITE I, BINDING SITE II or BINDING SITE III. Table 2 illustrates the complementarity of the nucleotide sequences of SHMT1 BINDING SITE, designated SEQ ID:10374, to the nucleotide sequence of VGAM1686 RNA, herein designated VGAM RNA, also designated SEQ ID:4397.

Another function of VGAM1686 is therefore inhibition of Serine Hydroxymethyltransferase 1 (soluble) (SHMT1, Accession NM_004169), a gene which interconverts serine and glycine. Accordingly, utilities of VGAM1686 include diagnosis, prevention and treatment of diseases and clinical conditions associated with SHMT1. The function of SHMT1 and its association with various diseases and clinical conditions, has been established by previous studies, as described hereinabove with reference to VGAM475. Tumor Necrosis Factor, Alpha-induced Protein 1 (endothelial) (TNFAIP1, Accession NM_021137) is another VGAM1686 host target gene. TNFAIP1 BINDING SITE is HOST TARGET binding site found in the 3' untranslated region of mRNA encoded by TNFAIP1, corresponding to a HOST TARGET binding site such as BINDING SITE I, BINDING SITE II or BINDING SITE III. Table 2 illustrates the complementarity of the nucleotide sequences of TNFAIP1 BINDING SITE, designated SEQ ID:22113, to the nucleotide sequence of VGAM1686 RNA, herein designated VGAM RNA, also designated SEQ ID:4397.

Another function of VGAM1686 is therefore inhibition of Tumor Necrosis Factor, Alpha-induced Protein 1 (endothelial) (TNFAIP1, Accession NM_021137). Accordingly, utilities of VGAM1686 include diagnosis, prevention and treatment of diseases and clinical conditions associated with TNFAIP1. Vang-like 2 (van gogh, Drosophila) (VANGL2, Accession XM_049695) is another VGAM1686 host target gene. VANGL2 BINDING SITE is HOST TARGET binding site found in the 3' untranslated region of mRNA encoded by VANGL2, corresponding to a HOST TARGET binding site such as BINDING SITE I, BINDING SITE II or BINDING SITE III. Table 2 illustrates the complementarity of the nucleotide sequences of VANGL2 BINDING SITE, designated SEQ ID:35480, to the nucleotide sequence of VGAM1686 RNA, herein designated VGAM RNA, also designated SEQ ID:4397.

Another function of VGAM1686 is therefore inhibition of Vang-like 2 (van gogh, Drosophila) (VANGL2, Accession XM_049695), a gene which may take part in defining the lateral boundary of floorplate differentiation. Accordingly, utilities of VGAM1686 include diagnosis, prevention and treatment of diseases and clinical conditions associated with VANGL2. The function of VANGL2 and its association with various diseases and clinical conditions, has been established by previous studies, as described hereinabove with reference to VGAM111. DKFZP434J046 (Accession XM_048258) is another VGAM1686 host target gene. DKFZP434J046 BINDING SITE is HOST TARGET binding site found in the 5' untranslated region of mRNA encoded by DKFZP434J046, corresponding to a HOST TARGET binding site such as BINDING SITE I, BINDING SITE II or BINDING SITE III.

Table 2 illustrates the complementarity of the nucleotide sequences of DKFZP434J046 BINDING SITE, designated SEQ ID:35150, to the nucleotide sequence of VGAM1686 RNA, herein designated VGAM RNA, also designated SEQ ID:4397.

Another function of VGAM1686 is therefore inhibition of DKFZP434J046 (Accession XM_048258). Accordingly, utilities of VGAM1686 include diagnosis, prevention and treatment of diseases and clinical conditions associated with DKFZP434J046. FLJ10385 (Accession NM_018081) is another VGAM1686 host target gene. FLJ10385 BINDING SITE is HOST TARGET binding site found in the 5' untranslated region of mRNA encoded by FLJ10385, corresponding to a HOST TARGET binding site such as BINDING SITE I, BINDING SITE II or BINDING SITE III. Table 2 illustrates the complementarity of the nucleotide sequences of FLJ10385 BINDING SITE, designated SEQ ID:19840, to the nucleotide sequence of VGAM1686 RNA, herein designated VGAM RNA, also designated SEQ ID:4397.

Another function of VGAM1686 is therefore inhibition of FLJ10385 (Accession NM_018081). Accordingly, utilities of VGAM1686 include diagnosis, prevention and treatment of diseases and clinical conditions associated with FLJ10385. FLJ12876 (Accession NM_022754) is another VGAM1686 host target gene. FLJ12876 BINDING SITE is HOST TARGET binding site found in the 3' untranslated region of mRNA encoded by FLJ12876, corresponding to a HOST TARGET binding site such as BINDING SITE I, BINDING SITE II or BINDING SITE III. Table 2 illustrates the complementarity of the nucleotide sequences of FLJ12876 BINDING SITE, designated SEQ ID:22987, to the nucleotide sequence of VGAM1686 RNA, herein designated VGAM RNA, also designated SEQ ID:4397.

Another function of VGAM1686 is therefore inhibition of FLJ12876 (Accession NM_022754). Accordingly, utilities of VGAM1686 include diagnosis, prevention and treatment of diseases and clinical conditions associated with FLJ12876. FLJ20375 (Accession NM_017794) is another VGAM1686 host target gene. FLJ20375 BINDING SITE is HOST TARGET binding site found in the 3' untranslated region of mRNA encoded by FLJ20375, corresponding to a HOST TARGET binding site such as BINDING SITE I, BINDING SITE II or BINDING SITE III. Table 2 illustrates the complementarity of the nucleotide sequences of FLJ20375 BINDING SITE, designated SEQ ID:19433, to the nucleotide sequence of VGAM1686 RNA, herein designated VGAM RNA, also designated SEQ ID:4397.

Another function of VGAM1686 is therefore inhibition of FLJ20375 (Accession NM_017794). Accordingly, utilities of VGAM1686 include diagnosis, prevention and treatment of diseases and clinical conditions associated with FLJ20375. FLJ22625 (Accession NM_024715) is another VGAM1686 host target gene. FLJ22625 BINDING SITE is HOST TARGET binding site found in the 5' untranslated region of mRNA encoded by FLJ22625, corresponding to a HOST TARGET binding site such as BINDING SITE I, BINDING SITE II or BINDING SITE III. Table 2 illustrates the complementarity of the nucleotide sequences of FLJ22625 BINDING SITE, designated SEQ ID:24042, to the nucleotide sequence of VGAM1686 RNA, herein designated VGAM RNA, also designated SEQ ID:4397.

Another function of VGAM1686 is therefore inhibition of FLJ22625 (Accession NM_024715). Accordingly, utilities of VGAM1686 include diagnosis, prevention and treatment of diseases and clinical conditions associated with FLJ22625. GR6 (Accession NM_007354) is another VGAM1686 host target gene. GR6 BINDING SITE is HOST TARGET binding site found in the 5' untranslated region of mRNA encoded by GR6, corresponding to a HOST TARGET binding site such as BINDING SITE I, BINDING SITE II or BINDING SITE III. Table 2 illustrates the complementarity of the nucleotide sequences of GR6 BINDING SITE, designated SEQ ID:14280, to the nucleotide sequence of VGAM1686 RNA, herein designated VGAM RNA, also designated SEQ ID:4397.

Another function of VGAM1686 is therefore inhibition of GR6 (Accession NM_007354). Accordingly, utilities of VGAM1686 include diagnosis, prevention and treatment of diseases and clinical conditions associated with GR6. KIAA0451 (Accession NM_014826) is another VGAM1686 host target gene. KIAA0451 BINDING SITE is HOST TARGET binding site found in the 3' untranslated region of mRNA encoded by KIAA0451, corresponding to a HOST TARGET binding site such as BINDING SITE I, BINDING SITE II or BINDING SITE III. Table 2 illustrates the complementarity of the nucleotide sequences of KIAA0451 BINDING SITE, designated SEQ ID:16807, to the nucleotide sequence of VGAM1686 RNA, herein designated VGAM RNA, also designated SEQ ID:4397.

Another function of VGAM1686 is therefore inhibition of KIAA0451 (Accession NM_014826). Accordingly, utilities of VGAM1686 include diagnosis, prevention and treatment of diseases and clinical conditions associated with KIAA0451. KIAA0544 (Accession XM_048119) is another VGAM1686 host target gene. KIAA0544 BINDING SITE is HOST TARGET binding site found in the 3' untranslated region of mRNA encoded by KIAA0544, corresponding to a HOST TARGET binding site such as BINDING SITE I, BINDING SITE II or BINDING SITE III. Table 2 illustrates the complementarity of the nucleotide sequences of KIAA0544 BINDING SITE, designated SEQ ID:35109, to the nucleotide sequence of VGAM1686 RNA, herein designated VGAM RNA, also designated SEQ ID:4397.

Another function of VGAM1686 is therefore inhibition of KIAA0544 (Accession XM_048119). Accordingly, utilities of VGAM1686 include diagnosis, prevention and treatment of diseases and clinical conditions associated with KIAA0544. MGC12435 (Accession NM_031427) is another VGAM1686 host target gene. MGC12435 BINDING SITE is HOST TARGET binding site found in the 5' untranslated region of mRNA encoded by MGC12435, corresponding to a HOST TARGET binding site such as BINDING SITE I, BINDING SITE II or BINDING SITE III. Table 2 illustrates the complementarity of the nucleotide sequences of MGC12435 BINDING SITE, designated SEQ ID:25423, to the nucleotide sequence of VGAM1686 RNA, herein designated VGAM RNA, also designated SEQ ID:4397.

Another function of VGAM1686 is therefore inhibition of MGC12435 (Accession NM_031427). Accordingly, utilities of VGAM1686 include diagnosis, prevention and treatment of diseases and clinical conditions associated with MGC12435. MGC29643 (Accession NM_144586) is another VGAM1686 host target gene. MGC29643 BINDING SITE is HOST TARGET binding site found in the 5' untranslated region of mRNA encoded by MGC29643, corresponding to a HOST TARGET binding site such as BINDING SITE I, BINDING SITE II or BINDING SITE III. Table 2 illustrates the complementarity of the nucleotide sequences of MGC29643 BINDING SITE, designated SEQ ID:29406, to the nucleotide sequence of VGAM1686 RNA, herein designated VGAM RNA, also designated SEQ ID:4397.

Another function of VGAM1686 is therefore inhibition of MGC29643 (Accession NM_144586). Accordingly, utilities of VGAM1686 include diagnosis, prevention and treatment of diseases and clinical conditions associated with MGC29643. Oxysterol Binding Protein-like 5 (OSBPL5, Accession XM_052567) is another VGAM1686 host target gene. OSBPL5 BINDING SITE is HOST TARGET binding site found in the 3' untranslated region of mRNA encoded by OSBPL5, corresponding to a HOST TARGET binding site such as BINDING SITE I, BINDING SITE II or BINDING SITE III. Table 2 illustrates the complementarity of the nucleotide sequences of OSBPL5 BINDING SITE, designated SEQ ID:35988, to the nucleotide sequence of VGAM1686 RNA, herein designated VGAM RNA, also designated SEQ ID:4397.

Another function of VGAM1686 is therefore inhibition of Oxysterol Binding Protein-like 5 (OSBPL5, Accession XM_052567). Accordingly, utilities of VGAM1686 include diagnosis, prevention and treatment of diseases and clinical conditions associated with OSBPL5. Tubby Homolog (mouse) (TUB, Accession NM_003320) is another VGAM1686 host target gene. TUB BINDING SITE is HOST TARGET binding site found in the 3' untranslated region of mRNA encoded by TUB, corresponding to a HOST TARGET binding site such as BINDING SITE I, BINDING SITE II or BINDING SITE III. Table 2 illustrates the complementarity of the nucleotide sequences of TUB BINDING SITE, designated SEQ ID:9319, to the nucleotide sequence of VGAM1686 RNA, herein designated VGAM RNA, also designated SEQ ID:4397.

Another function of VGAM1686 is therefore inhibition of Tubby Homolog (mouse) (TUB, Accession NM_003320). Accordingly, utilities of VGAM1686 include diagnosis, prevention and treatment of diseases and clinical conditions associated with TUB. LOC119188 (Accession XM_058373) is another VGAM1686 host target gene. LOC119188 BINDING SITE is HOST TARGET binding site found in the 5' untranslated region of mRNA encoded by LOC119188, corresponding to a HOST TARGET binding site such as BINDING SITE I, BINDING SITE II or BINDING SITE III. Table 2 illustrates the complementarity of the nucleotide sequences of LOC119188 BINDING SITE, designated SEQ ID:36613, to the nucleotide sequence of VGAM1686 RNA, herein designated VGAM RNA, also designated SEQ ID:4397.

Another function of VGAM1686 is therefore inhibition of LOC119188 (Accession XM_058373). Accordingly, utilities of VGAM1686 include diagnosis, prevention and treatment of diseases and clinical conditions associated with LOC119188. LOC145717 (Accession XM_039771) is another VGAM1686 host target gene. LOC145717 BINDING SITE is HOST TARGET binding site found in the 5' untranslated region of mRNA encoded by LOC145717, corresponding to a HOST TARGET binding site such as BINDING SITE I, BINDING SITE II or BINDING SITE III. Table 2 illustrates the complementarity of the nucleotide sequences of LOC145717 BINDING SITE, designated SEQ ID:33190, to the nucleotide sequence of VGAM1686 RNA, herein designated VGAM RNA, also designated SEQ ID:4397.

Another function of VGAM1686 is therefore inhibition of LOC145717 (Accession XM_039771). Accordingly, utilities of VGAM1686 include diagnosis, prevention and treatment of diseases and clinical conditions associated with LOC145717. LOC146795 (Accession XM_085593) is another VGAM1686 host target gene. LOC146795 BINDING SITE is HOST TARGET binding site found in the 5' untranslated region of mRNA encoded by LOC146795, corresponding to a HOST TARGET binding site such as BINDING SITE I, BINDING SITE II or BINDING SITE III. Table 2 illustrates the complementarity of the nucleotide sequences of LOC146795 BINDING SITE, designated SEQ ID:38244, to the nucleotide sequence of VGAM1686 RNA, herein designated VGAM RNA, also designated SEQ ID:4397.

Another function of VGAM1686 is therefore inhibition of LOC146795 (Accession XM_085593). Accordingly, utilities of VGAM1686 include diagnosis, prevention and treatment of diseases and clinical conditions associated with LOC146795. LOC151176 (Accession XM_098016) is another VGAM1686 host target gene. LOC151176 BINDING SITE is HOST TARGET binding site found in the 5' untranslated region of mRNA encoded by LOC151176, corresponding to a HOST TARGET binding site such as BINDING SITE I, BINDING SITE II or BINDING SITE III. Table 2 illustrates the complementarity of the nucleotide sequences of LOC151176 BINDING SITE, designated SEQ ID:41317, to the nucleotide sequence of VGAM1686 RNA, herein designated VGAM RNA, also designated SEQ ID:4397.

Another function of VGAM1686 is therefore inhibition of LOC151176 (Accession XM_098016). Accordingly, utilities of VGAM1686 include diagnosis, prevention and treatment of diseases and clinical conditions associated with LOC151176. LOC152453 (Accession XM_087475) is another VGAM1686 host target gene. LOC152453 BINDING SITE is HOST TARGET binding site found in the 5' untranslated region of mRNA encoded by LOC152453, corresponding to a HOST TARGET binding site such as BINDING SITE I, BINDING SITE II or BINDING SITE III. Table 2 illustrates the complementarity of the nucleotide sequences of LOC152453 BINDING SITE, designated SEQ ID:39276, to the nucleotide sequence of VGAM1686 RNA, herein designated VGAM RNA, also designated SEQ ID:4397.

Another function of VGAM1686 is therefore inhibition of LOC152453 (Accession XM_087475). Accordingly, utilities of VGAM1686 include diagnosis, prevention and treatment of diseases and clinical conditions associated with LOC152453. LOC155061 (Accession XM_088139) is another VGAM1686 host target gene. LOC155061 BINDING SITE is HOST TARGET binding site found in the 5' untranslated region of mRNA encoded by LOC155061, corresponding to a HOST TARGET binding site such as BINDING SITE I, BINDING SITE II or BINDING SITE III. Table 2 illustrates the complementarity of the nucleotide sequences of LOC155061 BINDING SITE, designated SEQ ID:39536, to the nucleotide sequence of VGAM1686 RNA, herein designated VGAM RNA, also designated SEQ ID:4397.

Another function of VGAM1686 is therefore inhibition of LOC155061 (Accession XM_088139). Accordingly, utilities of VGAM1686 include diagnosis, prevention and treatment of diseases and clinical conditions associated with LOC155061. LOC197342 (Accession XM_113869) is another VGAM1686 host target gene. LOC197342 BINDING SITE is HOST TARGET binding site found in the 3' untranslated region of mRNA encoded by LOC197342, corresponding to a HOST TARGET binding site such as BINDING SITE I, BINDING SITE II or BINDING SITE III. Table 2 illustrates the complementarity of the nucleotide sequences of LOC197342 BINDING SITE, designated SEQ ID:42488, to the nucleotide sequence of VGAM1686 RNA, herein designated VGAM RNA, also designated SEQ ID:4397.

Another function of VGAM1686 is therefore inhibition of LOC197342 (Accession XM_113869). Accordingly, utilities of VGAM1686 include diagnosis, prevention and treatment of diseases and clinical conditions associated with LOC197342. LOC201689 (Accession XM_040608) is another VGAM1686 host target gene. LOC201689 BINDING SITE is HOST TARGET binding site found in the 3' untranslated region of mRNA encoded by LOC201689, corresponding to a HOST TARGET binding site such as BIND- ING SITE I, BINDING SITE II or BINDING SITE III. Table 2 illustrates the complementarity of the nucleotide sequences of LOC201689 BINDING SITE, designated SEQ ID:33332, to the nucleotide sequence of VGAM1686 RNA, herein designated VGAM RNA, also designated SEQ ID:4397.

Another function of VGAM1686 is therefore inhibition of LOC201689 (Accession XM_040608). Accordingly, utilities of VGAM1686 include diagnosis, prevention and treatment of diseases and clinical conditions associated with LOC201689. LOC221140 (Accession XM_167908) is another VGAM1686 host target gene. LOC221140 BINDING SITE is HOST TARGET binding site found in the 5' untranslated region of mRNA encoded by LOC221140, corresponding to a HOST TARGET binding site such as BINDING SITE I, BINDING SITE II or BINDING SITE III. Table 2 illustrates the complementarity of the nucleotide sequences of LOC221140 BINDING SITE, designated SEQ ID:44907, to the nucleotide sequence of VGAM1686 RNA, herein designated VGAM RNA, also designated SEQ ID:4397.

Another function of VGAM1686 is therefore inhibition of LOC221140 (Accession XM_167908). Accordingly, utilities of VGAM1686 include diagnosis, prevention and treatment of diseases and clinical conditions associated with LOC221140. LOC222166 (Accession XM_168425) is another VGAM1686 host target gene. LOC222166 BINDING SITE is HOST TARGET binding site found in the 3' untranslated region of mRNA encoded by LOC222166, corresponding to a HOST TARGET binding site such as BINDING SITE I, BINDING SITE II or BINDING SITE III. Table 2 illustrates the complementarity of the nucleotide sequences of LOC222166 BINDING SITE, designated SEQ ID:45151, to the nucleotide sequence of VGAM1686 RNA, herein designated VGAM RNA, also designated SEQ ID:4397.

Another function of VGAM1686 is therefore inhibition of LOC222166 (Accession XM_168425). Accordingly, utilities of VGAM1686 include diagnosis, prevention and treatment of diseases and clinical conditions associated with LOC222166. LOC254431 (Accession XM_173024) is another VGAM1686 host target gene. LOC254431 BINDING SITE is HOST TARGET binding site found in the 5' untranslated region of mRNA encoded by LOC254431, corresponding to a HOST TARGET binding site such as BINDING SITE I, BINDING SITE II or BINDING SITE III. Table 2 illustrates the complementarity of the nucleotide sequences of LOC254431 BINDING SITE, designated SEQ ID:46290, to the nucleotide sequence of VGAM1686 RNA, herein designated VGAM RNA, also designated SEQ ID:4397.

Another function of VGAM1686 is therefore inhibition of LOC254431 (Accession XM_173024). Accordingly, utilities of VGAM1686 include diagnosis, prevention and treatment of diseases and clinical conditions associated with LOC254431. LOC91974 (Accession XM_041974) is another VGAM1686 host target gene. LOC91974 BINDING SITE is HOST TARGET binding site found in the 5' untranslated region of mRNA encoded by LOC91974, corresponding to a HOST TARGET binding site such as BINDING SITE I, BINDING SITE II or BINDING SITE III. Table 2 illustrates the complementarity of the nucleotide sequences of LOC91974 BINDING SITE, designated SEQ ID:33653, to the nucleotide sequence of VGAM1686 RNA, herein designated VGAM RNA, also designated SEQ ID:4397.

Another function of VGAM1686 is therefore inhibition of LOC91974 (Accession XM_041974). Accordingly, utilities of VGAM1686 include diagnosis, prevention and treatment of diseases and clinical conditions associated with LOC91974. FIG. 1 further provides a conceptual description of a novel bioinformatically detected viral gene of the present invention, referred to here as Viral Genomic Address Messenger 1687 (VGAM1687) viral gene, which modulates expression of respective host target genes thereof, the function and utility of which host target genes is known in the art.

VGAM1687 is a novel bioinformatically detected regulatory, non protein coding, viral micro RNA (miRNA) gene. The method by which VGAM1687 was detected is described hereinabove with reference to FIGS. 1-8.

VGAM1687 gene, herein designated VGAM GENE, is a viral gene contained in the genome of Chimpanzee Cytomegalovirus. VGAM1687 host target gene, herein designated VGAM HOST TARGET GENE, is a human gene contained in the human genome.

VGAM1687 gene encodes a VGAM1687 precursor RNA, herein designated VGAM PRECURSOR RNA. Similar to other miRNA genes, and unlike most ordinary genes, VGAM1687 precursor RNA does not encode a protein. A nucleotide sequence identical or highly similar to the nucleotide sequence of VGAM1687 precursor RNA is designated SEQ ID:1673, and is provided hereinbelow with reference to the sequence listing part. Nucleotide sequence SEQ ID:1673 is located at position 126333 relative to the genome of Chimpanzee Cytomegalovirus.

VGAM1687 precursor RNA folds onto itself, forming VGAM1687 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1687 folded precursor RNA into VGAM1687 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1687 RNA is designated SEQ ID:4398, and is provided hereinbelow with reference to the sequence listing part.

VGAM1687 host target gene, herein designated VGAM HOST TARGET GENE, encodes a corresponding messenger RNA, VGAM1687 host target RNA, herein designated VGAM HOST TARGET RNA. VGAM1687 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1687 RNA, herein designated VGAM RNA, binds complementarily to one or more host target binding sites located in untranslated regions of VGAM1687 host target RNA, herein designated VGAM HOST TARGET RNA. This complementary binding is due to the fact that the nucleotide sequence of VGAM1687 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1687 RNA, herein designated VGAM RNA, may have a different number of host target binding sites in untranslated regions of a VGAM1687 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1687 RNA, herein designated VGAM RNA, to host target binding sites on VGAM1687 host target RNA, herein designated VGAM HOST TARGET RNA, such as BINDING SITE I, BINDING SITE II and BINDING SITE III, inhibits translation of VGAM1687 host target RNA into VGAM1687 host target protein, herein designated VGAM HOST TARGET PROTEIN. VGAM host target protein is therefore outlined by a broken line.

It is appreciated that VGAM1687 host target gene, herein designated VGAM HOST TARGET GENE, in fact represents a plurality of VGAM1687 host target genes. The mRNA of each one of this plurality of VGAM1687 host target genes comprises one or more host target binding sites, each having a nucleotide sequence which is at least partly complementary to VGAM1687 RNA, herein designated VGAM RNA, and which when bound by VGAM1687 RNA causes inhibition of translation of respective one or more VGAM1687 host target proteins.

It is further appreciated by one skilled in the art that the mode of translational inhibition illustrated by FIG. 1 with specific reference to translational inhibition exerted by VGAM1687 gene, herein designated VGAM GENE, on one or more VGAM1687 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1687 is inhibition of expression of host target genes, as part of a novel viral mechanism of attacking a host. Accordingly, utilities of VGAM1687 include diagnosis, prevention and treatment of viral infection by Chimpanzee Cytomegalovirus. Specific functions, and accordingly utilities, of VGAM1687 correlate with, and may be deduced from, the identity of the host target genes which VGAM1687 binds and inhibits, and the function of these host target genes, as elaborated hereinbelow.

Nucleotide sequences of the VGAM1687 precursor RNA, herein designated VGAM PRECURSOR RNA, and of the 'diced' VGAM1687 RNA, herein designated VGAM RNA, and a schematic representation of the secondary folding of VGAM1687 folded precursor RNA, herein designated VGAM FOLDED PRECURSOR RNA, of VGAM1687 are further described hereinbelow with reference to Table 1.

Nucleotide sequences of host target binding sites, such as BINDING SITE-I, BINDING SITE-II and BINDING SITE-III of FIG. 1, found on VGAM1687 host target RNA, and schematic representation of the complementarity of each of these host target binding sites to VGAM1687 RNA, herein designated VGAM RNA, are described hereinbelow with reference to Table 2.

As mentioned hereinabove with reference to FIG. 1, a function of VGAM1687 gene, herein designated VGAM is inhibition of expression of VGAM1687 target genes. It is appreciated that specific functions, and accordingly utilities, of VGAM1687 correlate with, and may be deduced from, the identity of the target genes which VGAM1687 binds and inhibits, and the function of these target genes, as elaborated hereinbelow.

Cadherin, EGF LAG Seven-pass G-type Receptor 1 (flamingo homolog, Drosophila) (CELSR1, Accession NM_014246) is a VGAM1687 host target gene. CELSR1 BINDING SITE is HOST TARGET binding site found in the 3' untranslated region of mRNA encoded by CELSR1, corresponding to a HOST TARGET binding site such as BINDING SITE I, BINDING SITE II or BINDING SITE III. Table 2 illustrates the complementarity of the nucleotide sequences of CELSR1 BINDING SITE, designated SEQ ID:15516, to the nucleotide sequence of VGAM1687 RNA, herein designated VGAM RNA, also designated SEQ ID:4398.

A function of VGAM1687 is therefore inhibition of Cadherin, EGF LAG Seven-pass G-type Receptor 1 (flamingo homolog, Drosophila) (CELSR1, Accession NM_014246), a gene which is involved in contact-mediated communication. Accordingly, utilities of VGAM1687 include diagnosis, prevention and treatment of diseases and clinical conditions associated with CELSR1. The function of CELSR1 and its association with various diseases and clinical conditions, has been established by previous studies, as described hereinabove with reference to VGAM459. Solute Carrier Family 7 (cationic amino acid transporter, y+ system), Member 6 (SLC7A6, Accession NM_003983) is another VGAM1687 host target gene. SLC7A6 BINDING SITE is HOST TARGET binding site found in the 3' untranslated region of mRNA encoded by SLC7A6, corresponding to a HOST TARGET binding site such as BINDING SITE I, BINDING SITE II or BINDING SITE III. Table 2 illustrates the complementarity of the nucleotide sequences of SLC7A6 BINDING SITE, designated SEQ ID:10125, to the nucleotide sequence of VGAM1687 RNA, herein designated VGAM RNA, also designated SEQ ID:4398.

Another function of VGAM1687 is therefore inhibition of Solute Carrier Family 7 (cationic amino acid transporter, y+ system), Member 6 (SLC7A6, Accession NM_003983), a gene which is involved in mediating amino acid transport. Accordingly, utilities of VGAM1687 include diagnosis, prevention and treatment of diseases and clinical conditions associated with SLC7A6. The function of SLC7A6 and its association with various diseases and clinical conditions, has been established by previous studies, as described hereinabove with reference to VGAM87. LOC120826 (Accession XM_062302) is another VGAM1687 host target gene. LOC120826 BINDING SITE is HOST TARGET binding site found in the 5' untranslated region of mRNA encoded by LOC120826, corresponding to a HOST TARGET binding site such as BINDING SITE I, BINDING SITE II or BINDING SITE III. Table 2 illustrates the complementarity of the nucleotide sequences of LOC120826 BINDING SITE, designated SEQ ID:37223, to the nucleotide sequence of VGAM1687 RNA, herein designated VGAM RNA, also designated SEQ ID:4398.

Another function of VGAM1687 is therefore inhibition of LOC120826 (Accession XM_062302). Accordingly, utilities of VGAM1687 include diagnosis, prevention and treatment of diseases and clinical conditions associated with LOC120826. LOC160717 (Accession XM_090457) is another VGAM1687 host target gene. LOC160717 BINDING SITE is HOST TARGET binding site found in the 5' untranslated region of mRNA encoded by LOC160717, corresponding to a HOST TARGET binding site such as BINDING SITE I, BINDING SITE II or BINDING SITE III. Table 2 illustrates the complementarity of the nucleotide sequences of LOC160717 BINDING SITE, designated SEQ ID:40007, to the nucleotide sequence of VGAM1687 RNA, herein designated VGAM RNA, also designated SEQ ID:4398.

Another function of VGAM1687 is therefore inhibition of LOC160717 (Accession XM_090457). Accordingly, utilities of VGAM1687 include diagnosis, prevention and treatment of diseases and clinical conditions associated with LOC160717. FIG. 1 further provides a conceptual description of a novel bioinformatically detected viral gene of the present invention, referred to here as Viral Genomic Address Messenger 1688 (VGAM1688) viral gene, which modulates expression of respective host target genes thereof, the function and utility of which host target genes is known in the art.

VGAM1688 is a novel bioinformatically detected regulatory, non protein coding, viral micro RNA (miRNA) gene. The method by which VGAM1688 was detected is described hereinabove with reference to FIGS. 1-8.

VGAM1688 gene, herein designated VGAM GENE, is a viral gene contained in the genome of Chimpanzee Cytomegalovirus. VGAM1688 host target gene, herein designated VGAM HOST TARGET GENE, is a human gene contained in the human genome.

VGAM1688 gene encodes a VGAM1688 precursor RNA, herein designated VGAM PRECURSOR RNA. Similar to other miRNA genes, and unlike most ordinary genes, VGAM1688 precursor RNA does not encode a protein. A nucleotide sequence identical or highly similar to the nucleotide sequence of VGAM1688 precursor RNA is designated SEQ ID:1674, and is provided hereinbelow with reference to the sequence listing part. Nucleotide sequence SEQ ID:1674 is located at position 123345 relative to the genome of Chimpanzee Cytomegalovirus.

VGAM1688 precursor RNA folds onto itself, forming VGAM1688 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1688 folded precursor RNA into VGAM1688 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1688 RNA is designated SEQ ID:4399, and is provided hereinbelow with reference to the sequence listing part.

VGAM1688 host target gene, herein designated VGAM HOST TARGET GENE, encodes a corresponding messenger RNA, VGAM1688 host target RNA, herein designated VGAM HOST TARGET RNA. VGAM1688 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1688 RNA, herein designated VGAM RNA, binds complementarily to one or more host target binding sites located in untranslated regions of VGAM1688 host target RNA, herein designated VGAM HOST TARGET RNA. This complementary binding is due to the fact that the nucleotide sequence of VGAM1688 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1688 RNA, herein designated VGAM RNA, may have a different number of host target binding sites in untranslated regions of a VGAM1688 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1688 RNA, herein designated VGAM RNA, to host target binding sites on VGAM1688 host target RNA, herein designated VGAM HOST TARGET RNA, such as BINDING SITE I, BINDING SITE II and BINDING SITE III, inhibits translation of VGAM1688 host target RNA into VGAM1688 host target protein, herein designated VGAM HOST TARGET PROTEIN. VGAM host target protein is therefore outlined by a broken line.

It is appreciated that VGAM1688 host target gene, herein designated VGAM HOST TARGET GENE, in fact represents a plurality of VGAM1688 host target genes. The mRNA of each one of this plurality of VGAM1688 host target genes comprises one or more host target binding sites, each having a nucleotide sequence which is at least partly complementary to VGAM1688 RNA, herein designated VGAM RNA, and which when bound by VGAM1688 RNA causes inhibition of translation of respective one or more VGAM1688 host target proteins.

It is further appreciated by one skilled in the art that the mode of translational inhibition illustrated by FIG. 1 with specific reference to translational inhibition exerted by VGAM1688 gene, herein designated VGAM GENE, on one or more VGAM1688 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1688 is inhibition of expression of host target genes, as part of a novel viral mechanism of attacking a host. Accordingly, utilities of VGAM1688 include diagnosis, prevention and treatment of viral infection by Chimpanzee Cytomegalovirus. Specific functions, and accordingly utilities, of VGAM1688 correlate with, and may be deduced from, the identity of the host target genes which VGAM1688 binds and inhibits, and the function of these host target genes, as elaborated hereinbelow.

Nucleotide sequences of the VGAM1688 precursor RNA, herein designated VGAM PRECURSOR RNA, and of the 'diced' VGAM1688 RNA, herein designated VGAM RNA, and a schematic representation of the secondary folding of VGAM1688 folded precursor RNA, herein designated VGAM FOLDED PRECURSOR RNA, of VGAM1688 are further described hereinbelow with reference to Table 1.

Nucleotide sequences of host target binding sites, such as BINDING SITE-I, BINDING SITE-II and BINDING SITE-III of FIG. 1, found on VGAM1688 host target RNA, and schematic representation of the complementarity of each of these host target binding sites to VGAM1688 RNA, herein designated VGAM RNA, are described hereinbelow with reference to Table 2.

As mentioned hereinabove with reference to FIG. 1, a function of VGAM1688 gene, herein designated VGAM is inhibition of expression of VGAM1688 target genes. It is appreciated that specific functions, and accordingly utilities, of VGAM1688 correlate with, and may be deduced from, the identity of the target genes which VGAM1688 binds and inhibits, and the function of these target genes, as elaborated hereinbelow.

Extra Spindle Poles Like 1 (S. cerevisiae) (ESPL1, Accession NM_012291) is a VGAM1688 host target gene. ESPL1 BINDING SITE is HOST TARGET binding site found in the 5' untranslated region of mRNA encoded by ESPL1, corresponding to a HOST TARGET binding site such as BINDING SITE I, BINDING SITE II or BINDING SITE III. Table 2 illustrates the complementarity of the nucleotide sequences of ESPL1 BINDING SITE, designated SEQ ID:14630, to the nucleotide sequence of VGAM1688 RNA, herein designated VGAM RNA, also designated SEQ ID:4399.

A function of VGAM1688 is therefore inhibition of Extra Spindle Poles Like 1 (S. cerevisiae) (ESPL1, Accession NM_012291). Accordingly, utilities of VGAM1688 include diagnosis, prevention and treatment of diseases and clinical conditions associated with ESPL1. KIAA0515 (Accession XM_033380) is another VGAM1688 host target gene. KIAA0515 BINDING SITE is HOST TARGET binding site found in the 3' untranslated region of mRNA encoded by KIAA0515, corresponding to a HOST TARGET binding site such as BINDING SITE I, BINDING SITE II or BINDING SITE III. Table 2 illustrates the complementarity of the nucleotide sequences of KIAA0515 BINDING SITE, designated SEQ ID:31918, to the nucleotide sequence of VGAM1688 RNA, herein designated VGAM RNA, also designated SEQ ID:4399.

Another function of VGAM1688 is therefore inhibition of KIAA0515 (Accession XM_033380). Accordingly, utilities of VGAM1688 include diagnosis, prevention and treatment of diseases and clinical conditions associated with KIAA0515. LOC255937 (Accession XM_171129) is another VGAM1688 host target gene. LOC255937 BINDING SITE is HOST TARGET binding site found in the 3' untranslated region of mRNA encoded by LOC255937, corresponding to a HOST TARGET binding site such as BINDING SITE I, BINDING SITE II or BINDING SITE III. Table 2 illustrates the complementarity of the nucleotide sequences of LOC255937 BINDING SITE, designated SEQ ID:45931, to the nucleotide sequence of VGAM1688 RNA, herein designated VGAM RNA, also designated SEQ ID:4399.

Another function of VGAM1688 is therefore inhibition of LOC255937 (Accession XM_171129). Accordingly, utilities of VGAM1688 include diagnosis, prevention and treatment of diseases and clinical conditions associated with LOC255937. FIG. 1 further provides a conceptual description of a novel bioinformatically detected viral gene of the present invention, referred to here as Viral Genomic Address Messenger 1689 (VGAM1689) viral gene, which modulates expression of respective host target genes thereof, the function and utility of which host target genes is known in the art.

VGAM1689 is a novel bioinformatically detected regulatory, non protein coding, viral micro RNA (miRNA) gene.

The method by which VGAM1689 was detected is described hereinabove with reference to FIGS. 1-8.

VGAM1689 gene, herein designated VGAM GENE, is a viral gene contained in the genome of Chimpanzee Cytomegalovirus. VGAM1689 host target gene, herein designated VGAM HOST TARGET GENE, is a human gene contained in the human genome.

VGAM1689 gene encodes a VGAM1689 precursor RNA, herein designated VGAM PRECURSOR RNA. Similar to other miRNA genes, and unlike most ordinary genes, VGAM1689 precursor RNA does not encode a protein. A nucleotide sequence identical or highly similar to the nucleotide sequence of VGAM1689 precursor RNA is designated SEQ ID:1675, and is provided hereinbelow with reference to the sequence listing part. Nucleotide sequence SEQ ID:1675 is located at position 127857 relative to the genome of Chimpanzee Cytomegalovirus.

VGAM1689 precursor RNA folds onto itself, forming VGAM1689 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1689 folded precursor RNA into VGAM1689 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1689 RNA is designated SEQ ID:4400, and is provided hereinbelow with reference to the sequence listing part.

VGAM1689 host target gene, herein designated VGAM HOST TARGET GENE, encodes a corresponding messenger RNA, VGAM1689 host target RNA, herein designated VGAM HOST TARGET RNA. VGAM1689 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1689 RNA, herein designated VGAM RNA, binds complementarily to one or more host target binding sites located in untranslated regions of VGAM1689 host target RNA, herein designated VGAM HOST TARGET RNA. This complementary binding is due to the fact that the nucleotide sequence of VGAM1689 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1689 RNA, herein designated VGAM RNA, may have a different number of host target binding sites in untranslated regions of a VGAM1689 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1689 RNA, herein designated VGAM RNA, to host target binding sites on VGAM1689 host target RNA, herein designated VGAM HOST TARGET RNA, such as BINDING SITE I, BINDING SITE II and BINDING SITE III, inhibits translation of VGAM1689 host target RNA into VGAM1689 host target protein, herein designated VGAM HOST TARGET PROTEIN. VGAM host target protein is therefore outlined by a broken line.

It is appreciated that VGAM1689 host target gene, herein designated VGAM HOST TARGET GENE, in fact represents a plurality of VGAM1689 host target genes. The mRNA of each one of this plurality of VGAM1689 host target genes comprises one or more host target binding sites, each having a nucleotide sequence which is at least partly complementary to VGAM1689 RNA, herein designated VGAM RNA, and which when bound by VGAM1689 RNA causes inhibition of translation of respective one or more VGAM1689 host target proteins.

It is further appreciated by one skilled in the art that the mode of translational inhibition illustrated by FIG. 1 with specific reference to translational inhibition exerted by VGAM1689 gene, herein designated VGAM GENE, on one or more VGAM1689 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1689 is inhibition of expression of host target genes, as part of a novel viral mechanism of attacking a host. Accordingly, utilities of VGAM1689 include diagnosis, prevention and treatment of viral infection by Chimpanzee Cytomegalovirus. Specific functions, and accordingly utilities, of VGAM1689 correlate with, and may be deduced from, the identity of the host target genes which VGAM1689 binds and inhibits, and the function of these host target genes, as elaborated hereinbelow.

Nucleotide sequences of the VGAM1689 precursor RNA, herein designated VGAM PRECURSOR RNA, and of the ‘diced’ VGAM1689 RNA, herein designated VGAM RNA, and a schematic representation of the secondary folding of VGAM1689 folded precursor RNA, herein designated VGAM FOLDED PRECURSOR RNA, of VGAM1689 are further described hereinbelow with reference to Table 1.

Nucleotide sequences of host target binding sites, such as BINDING SITE-I, BINDING SITE-II and BINDING SITE-III of FIG. 1, found on VGAM1689 host target RNA, and schematic representation of the complementarity of each of these host target binding sites to VGAM1689 RNA, herein designated VGAM RNA, are described hereinbelow with reference to Table 2.

As mentioned hereinabove with reference to FIG. 1, a function of VGAM1689 gene, herein designated VGAM is inhibition of expression of VGAM1689 target genes. It is appreciated that specific functions, and accordingly utilities, of VGAM1689 correlate with, and may be deduced from, the identity of the target genes which VGAM1689 binds and inhibits, and the function of these target genes, as elaborated hereinbelow.

Diacylglycerol O-acyltransferase Homolog 1 (mouse) (DGAT1, Accession XM_035370) is a VGAM1689 host target gene. DGAT1 BINDING SITE is HOST TARGET binding site found in the 5' untranslated region of mRNA encoded by DGAT1, corresponding to a HOST TARGET binding site such as BINDING SITE I, BINDING SITE II or BINDING SITE III. Table 2 illustrates the complementarity of the nucleotide sequences of DGAT1 BINDING SITE, designated SEQ ID:32236, to the nucleotide sequence of VGAM1689 RNA, herein designated VGAM RNA, also designated SEQ ID:4400.

A function of VGAM1689 is therefore inhibition of Diacylglycerol O-acyltransferase Homolog 1 (mouse) (DGAT1, Accession XM_035370). Accordingly, utilities of VGAM1689 include diagnosis, prevention and treatment of diseases and clinical conditions associated with DGAT1. Protein Phosphatase 2, Regulatory Subunit B (B56), Alpha Isoform (PPP2R5A, Accession NM_006243) is another VGAM1689 host target gene. PPP2R5A BINDING SITE is HOST TARGET binding site found in the 5' untranslated region of mRNA encoded by PPP2R5A, corresponding to a HOST TARGET binding site such as BINDING SITE I, BINDING SITE II or BINDING SITE III. Table 2 illustrates the complementarity of the nucleotide sequences of PPP2R5A BINDING SITE, designated SEQ ID:12910, to the nucleotide sequence of VGAM1689 RNA, herein designated VGAM RNA, also designated SEQ ID:4400.

Another function of VGAM1689 is therefore inhibition of Protein Phosphatase 2, Regulatory Subunit B (B56), Alpha Isoform (PPP2R5A, Accession NM_006243), a gene which is a regulatory subunit of protein phosphatase 2A. Accordingly, utilities of VGAM1689 include diagnosis, prevention and treatment of diseases and clinical conditions associated with PPP2R5A. The function of PPP2R5A and its association with various diseases and clinical conditions, has been established by previous studies, as described hereinabove with reference to VGAM675. Roundabout, Axon Guidance Receptor, Homolog 1 (Drosophila) (ROBO1, Accession NM_133631) is another VGAM1689 host target gene. ROBO1 BINDING SITE is HOST TARGET binding site found in the 5' untranslated region of mRNA encoded by ROBO1, corresponding to a HOST TARGET binding site such as BINDING SITE I, BINDING SITE II or BINDING SITE III. Table 2 illustrates the complementarity of the nucleotide sequences of ROBO1 BINDING SITE, designated SEQ ID:28584, to the nucleotide sequence of VGAM1689 RNA, herein designated VGAM RNA, also designated SEQ ID:4400.

Another function of VGAM1689 is therefore inhibition of Roundabout, Axon Guidance Receptor, Homolog 1 (Drosophila) (ROBO1, Accession NM_133631), a gene which is an axon guidance receptor. Accordingly, utilities of VGAM1689 include diagnosis, prevention and treatment of diseases and clinical conditions associated with ROBO1. The function of ROBO1 and its association with various diseases and clinical conditions, has been established by previous studies, as described hereinabove with reference to VGAM37. Short Stature Homeobox (SHOX, Accession NM_000451) is another VGAM1689 host target gene. SHOX BINDING SITE is HOST TARGET binding site found in the 3' untranslated region of mRNA encoded by SHOX, corresponding to a HOST TARGET binding site such as BINDING SITE I, BINDING SITE II or BINDING SITE III. Table 2 illustrates the complementarity of the nucleotide sequences of SHOX BINDING SITE, designated SEQ ID:6058, to the nucleotide sequence of VGAM1689 RNA, herein designated VGAM RNA, also designated SEQ ID:4400.

Another function of VGAM1689 is therefore inhibition of Short Stature Homeobox (SHOX, Accession NM_000451). Accordingly, utilities of VGAM1689 include diagnosis, prevention and treatment of diseases and clinical conditions associated with SHOX. Telomeric Repeat Binding Factor 2 (TERF2, Accession NM_005652) is another VGAM1689 host target gene. TERF2 BINDING SITE is HOST TARGET binding site found in the 3' untranslated region of mRNA encoded by TERF2, corresponding to a HOST TARGET binding site such as BINDING SITE I, BINDING SITE II or BINDING SITE III. Table 2 illustrates the complementarity of the nucleotide sequences of TERF2 BINDING SITE, designated SEQ ID:12188, to the nucleotide sequence of VGAM1689 RNA, herein designated VGAM RNA, also designated SEQ ID:4400.

Another function of VGAM1689 is therefore inhibition of Telomeric Repeat Binding Factor 2 (TERF2, Accession NM_005652), a gene which plays a key role in the protective activity of telomeres. Accordingly, utilities of VGAM1689 include diagnosis, prevention and treatment of diseases and clinical conditions associated with TERF2. The function of TERF2 has been established by previous studies. Van Steensel et al. (1998) showed that the human telomeric protein TRF2 plays a key role in the protective activity of telomeres. A dominant-negative allele of TRF2 induced end-to-end chromosome fusions detectable in metaphase and anaphase cells. Telomeric DNA persisted at the fusions, demonstrating that TTAGGG repeats per se are not sufficient for telomere integrity. Molecular analysis suggested that the fusions represented ligation of telomeres that have lost their single-stranded G-tails. Van Steensel et al. (1998) concluded that TRF2 may protect chromosome ends by maintaining the correct structure at telomere termini. In addition, expression of mutant forms of TRF2 induced a growth arrest with characteristics of senescence. These results raise the possibility that chromosome end fusions and senescence in primary human cells may be caused by loss by TRF2 from shortened telomeres. Karlseder et al. (2002) reported that overexpression of TRF2 increased the rate of telomere shortening in primary cells without accelerating senescence. TRF2 reduced the senescence setpoint, defined as telomere length at senescence, from 7 to 4 kb. TRF2 protected critically short telomeres from fusion and repressed chromosome-end fusions in presenescent cultures, which explained the ability of TRF2 to delay senescence. Thus, Karlseder et al. (2002) concluded that replicative senescence is induced by a change in the protected status of shortened telomeres rather than by a complete loss of telomeric DNA.

Full details of the abovementioned studies are described in the following publications, the disclosure of which are hereby incorporated by reference:

van Steensel, B.; Smogorzewska, A.; de Lange, T.: TRF2 protects human telomeres from end-to-end fusions. Cell 92:401-413, 1998; and Karlseder, J.; Smogorzewska, A.; de Lange, T.: Senescence induced by altered telomere state, not telomere loss. Science 295:2446-2449, 2002.

Further studies establishing the function and utilities of TERF2 are found in John Hopkins OMIM database record ID 602027, and in sited publications numbered 9496-6665, 9622-9623, 6666-666 and 7146 listed in the bibliography section hereinbelow, which are also hereby incorporated by reference. X-ray Repair Complementing Defective Repair In Chinese Hamster Cells 3 (XRCC3, Accession NM_005432) is another VGAM1689 host target gene. XRCC3 BINDING SITE is HOST TARGET binding site found in the 3' untranslated region of mRNA encoded by XRCC3, corresponding to a HOST TARGET binding site such as BINDING SITE I, BINDING SITE II or BINDING SITE III. Table 2 illustrates the complementarity of the nucleotide sequences of XRCC3 BINDING SITE, designated SEQ ID:11909, to the nucleotide sequence of VGAM1689 RNA, herein designated VGAM RNA, also designated SEQ ID:4400.

Another function of VGAM1689 is therefore inhibition of X-ray Repair Complementing Defective Repair In Chinese Hamster Cells 3 (XRCC3, Accession NM_005432), a gene which is required for meiotic recombination, synaptonemal complex formation and cell cycle progression. Accordingly, utilities of VGAM1689 include diagnosis, prevention and treatment of diseases and clinical conditions associated with XRCC3. The function of XRCC3 and its association with various diseases and clinical conditions, has been established by previous studies, as described hereinabove with reference to VGAM1290. Chromosome 21 Open Reading Frame 4 (C21orf4, Accession NM_006134) is another VGAM1689 host target gene. C21orf4 BINDING SITE is HOST TARGET binding site found in the 5' untranslated region of mRNA encoded by C21orf4, corresponding to a HOST TARGET binding site such as BINDING SITE I, BINDING SITE II or BINDING SITE III. Table 2 illustrates the complementarity of the nucleotide sequences of C21orf4 BINDING SITE, designated SEQ ID:12776, to the nucleotide sequence of VGAM1689 RNA, herein designated VGAM RNA, also designated SEQ ID:4400.

Another function of VGAM1689 is therefore inhibition of Chromosome 21 Open Reading Frame 4 (C21orf4, Accession NM_006134). Accordingly, utilities of VGAM1689 include diagnosis, prevention and treatment of diseases and clinical conditions associated with C21orf4. Di-Ras2 (Accession NM_017594) is another VGAM1689 host target gene. Di-Ras2 BINDING SITE is HOST TARGET binding site found in the 3' untranslated region of mRNA encoded by Di-Ras2, corresponding to a HOST TARGET binding site such as BINDING SITE I, BINDING SITE II or BINDING SITE III. Table 2 illustrates the complementarity of the nucleotide sequences of Di-Ras2 BINDING SITE, designated SEQ ID:19043, to the nucleotide sequence of VGAM1689 RNA, herein designated VGAM RNA, also designated SEQ ID:4400.

Another function of VGAM1689 is therefore inhibition of Di-Ras2 (Accession NM_017594). Accordingly, utilities of VGAM1689 include diagnosis, prevention and treatment of diseases and clinical conditions associated with Di-Ras2. DKFZp761G2113 (Accession XM_046017) is another VGAM1689 host target gene. DKFZp761G2113 BINDING SITE is HOST TARGET binding site found in the 3' untranslated region of mRNA encoded by DKFZp761G2113, corresponding to a HOST TARGET binding site such as BINDING SITE I, BINDING SITE II or BINDING SITE III. Table 2 illustrates the complementarity of the nucleotide sequences of DKFZp761G2113 BINDING SITE, designated SEQ ID:34640, to the nucleotide sequence of VGAM1689 RNA, herein designated VGAM RNA, also designated SEQ ID:4400.

Another function of VGAM1689 is therefore inhibition of DKFZp761G2113 (Accession XM_046017). Accordingly, utilities of VGAM1689 include diagnosis, prevention and treatment of diseases and clinical conditions associated with DKFZp761G2113. FLJ14251 (Accession NM_024881) is another VGAM1689 host target gene. FLJ14251 BINDING SITE is HOST TARGET binding site found in the 5' untranslated region of mRNA encoded by FLJ14251, corresponding to a HOST TARGET binding site such as BINDING SITE I, BINDING SITE II or BINDING SITE III. Table 2 illustrates the complementarity of the nucleotide sequences of FLJ14251 BINDING SITE, designated SEQ ID:24323, to the nucleotide sequence of VGAM1689 RNA, herein designated VGAM RNA, also designated SEQ ID:4400.

Another function of VGAM1689 is therefore inhibition of FLJ14251 (Accession NM_024881). Accordingly, utilities of VGAM1689 include diagnosis, prevention and treatment of diseases and clinical conditions associated with FLJ14251. Microtubule-associated Protein 1 Light Chain 3 Alpha (MAP1LC3A, Accession NM_032514) is another VGAM1689 host target gene. MAP1LC3A BINDING SITE is HOST TARGET binding site found in the 5' untranslated region of mRNA encoded by MAP1LC3A, corresponding to a HOST TARGET binding site such as BINDING SITE I, BINDING SITE II or BINDING SITE III. Table 2 illustrates the complementarity of the nucleotide sequences of MAP1LC3A BINDING SITE, designated SEQ ID:26265, to the nucleotide sequence of VGAM1689 RNA, herein designated VGAM RNA, also designated SEQ ID:4400.

Another function of VGAM1689 is therefore inhibition of Microtubule-associated Protein 1 Light Chain 3 Alpha (MAP1LC3A, Accession NM_032514). Accordingly, utilities of VGAM1689 include diagnosis, prevention and treatment of diseases and clinical conditions associated with MAP1LC3A. RASD Family, Member 2 (RASD2, Accession NM_014310) is another VGAM1689 host target gene. RASD2 BINDING SITE is HOST TARGET binding site found in the 3' untranslated region of mRNA encoded by RASD2, corresponding to a HOST TARGET binding site such as BINDING SITE I, BINDING SITE II or BINDING SITE III. Table 2 illustrates the complementarity of the nucleotide sequences of RASD2 BINDING SITE, designated SEQ ID:15603, to the nucleotide sequence of VGAM1689 RNA, herein designated VGAM RNA, also designated SEQ ID:4400.

Another function of VGAM1689 is therefore inhibition of RASD Family, Member 2 (RASD2, Accession NM_014310). Accordingly, utilities of VGAM1689 include diagnosis, prevention and treatment of diseases and clinical conditions associated with RASD2. Sialyltransferase 8C (alpha2,3Galbeta1,4GlcNAcalpha 2,8-sialyl transferase) (SIAT8C, Accession NM_015879) is another VGAM1689 host target gene. SIAT8C BINDING SITE is HOST TARGET binding site found in the 5' untranslated region of mRNA encoded by SIAT8C, corresponding to a HOST TARGET binding site such as BINDING SITE I, BINDING SITE II or BINDING SITE III. Table 2 illustrates the complementarity of the nucleotide sequences of SIAT8C BINDING SITE, designated SEQ ID:18027, to the nucleotide sequence of VGAM1689 RNA, herein designated VGAM RNA, also designated SEQ ID:4400.

Another function of VGAM1689 is therefore inhibition of Sialyltransferase 8C (alpha2,3Galbeta1,4GlcNAcalpha 2,8-sialyl transferase) (SIAT8C, Accession NM_015879). Accordingly, utilities of VGAM1689 include diagnosis, prevention and treatment of diseases and clinical conditions associated with SIAT8C. LOC124930 (Accession XM_058867) is another VGAM1689 host target gene. LOC124930 BINDING SITE is HOST TARGET binding site found in the 3' untranslated region of mRNA encoded by LOC124930, corresponding to a HOST TARGET binding site such as BINDING SITE I, BINDING SITE II or BINDING SITE III. Table 2 illustrates the complementarity of the nucleotide sequences of LOC124930 BINDING SITE, designated SEQ ID:36767, to the nucleotide sequence of VGAM1689 RNA, herein designated VGAM RNA, also designated SEQ ID:4400.

Another function of VGAM1689 is therefore inhibition of LOC124930 (Accession XM_058867). Accordingly, utilities of VGAM1689 include diagnosis, prevention and treatment of diseases and clinical conditions associated with LOC124930. LOC127534 (Accession XM_060532) is another VGAM1689 host target gene. LOC127534 BINDING SITE is HOST TARGET binding site found in the 5' untranslated region of mRNA encoded by LOC127534, corresponding to a HOST TARGET binding site such as BINDING SITE I, BINDING SITE II or BINDING SITE III. Table 2 illustrates the complementarity of the nucleotide sequences of LOC127534 BINDING SITE, designated SEQ ID:37170, to the nucleotide sequence of VGAM1689 RNA, herein designated VGAM RNA, also designated SEQ ID:4400.

Another function of VGAM1689 is therefore inhibition of LOC127534 (Accession XM_060532). Accordingly, utilities of VGAM1689 include diagnosis, prevention and treatment of diseases and clinical conditions associated with LOC127534. LOC129566 (Accession XM_065294) is another VGAM1689 host target gene. LOC129566 BINDING SITE is HOST TARGET binding site found in the 5' untranslated region of mRNA encoded by LOC129566, corresponding to a HOST TARGET binding site such as BINDING SITE I, BINDING SITE II or BINDING SITE III. Table 2 illustrates the complementarity of the nucleotide sequences of LOC129566 BINDING SITE, designated SEQ ID:37279, to the nucleotide sequence of VGAM1689 RNA, herein designated VGAM RNA, also designated SEQ ID:4400.

Another function of VGAM1689 is therefore inhibition of LOC129566 (Accession XM_065294). Accordingly, utilities of VGAM1689 include diagnosis, prevention and treatment of diseases and clinical conditions associated with LOC129566. LOC146957 (Accession XM_085652) is another VGAM1689 host target gene. LOC146957 BINDING SITE is HOST TARGET binding site found in the 3' untranslated region of mRNA encoded by LOC146957, corresponding to a HOST TARGET binding site such as BINDING SITE I, BINDING SITE II or BINDING SITE III. Table 2 illustrates the complementarity of the nucleotide sequences of LOC146957 BINDING SITE, designated SEQ ID:38281, to the nucleotide sequence of VGAM1689 RNA, herein designated VGAM RNA, also designated SEQ ID:4400.

Another function of VGAM1689 is therefore inhibition of LOC146957 (Accession XM_085652). Accordingly, utilities of VGAM1689 include diagnosis, prevention and treatment of diseases and clinical conditions associated with LOC146957. LOC147136 (Accession XM_085716) is another VGAM1689 host target gene. LOC147136 BINDING SITE is HOST TARGET binding site found in the 5' untranslated region of mRNA encoded by LOC147136, corresponding to a HOST TARGET binding site such as BINDING SITE I, BINDING SITE II or BINDING SITE III. Table 2 illustrates the complementarity of the nucleotide sequences of LOC147136 BINDING SITE, designated SEQ ID:38301, to the nucleotide sequence of VGAM1689 RNA, herein designated VGAM RNA, also designated SEQ ID:4400.

Another function of VGAM1689 is therefore inhibition of LOC147136 (Accession XM_085716). Accordingly, utilities of VGAM1689 include diagnosis, prevention and treatment of diseases and clinical conditions associated with LOC147136. LOC153480 (Accession XM_053483) is another VGAM1689 host target gene. LOC153480 BINDING SITE is HOST TARGET binding site found in the 5' untranslated region of mRNA encoded by LOC153480, corresponding to a HOST TARGET binding site such as BINDING SITE I, BINDING SITE II or BINDING SITE III. Table 2 illustrates the complementarity of the nucleotide sequences of LOC153480 BINDING SITE, designated SEQ ID:36089, to the nucleotide sequence of VGAM1689 RNA, herein designated VGAM RNA, also designated SEQ ID:4400.

Another function of VGAM1689 is therefore inhibition of LOC153480 (Accession XM_053483). Accordingly, utilities of VGAM1689 include diagnosis, prevention and treatment of diseases and clinical conditions associated with LOC153480. LOC161635 (Accession XM_172921) is another VGAM1689 host target gene. LOC161635 BINDING SITE is HOST TARGET binding site found in the 5' untranslated region of mRNA encoded by LOC161635, corresponding to a HOST TARGET binding site such as BINDING SITE I, BINDING SITE II or BINDING SITE III. Table 2 illustrates the complementarity of the nucleotide sequences of LOC161635 BINDING SITE, designated SEQ ID:46187, to the nucleotide sequence of VGAM1689 RNA, herein designated VGAM RNA, also designated SEQ ID:4400.

Another function of VGAM1689 is therefore inhibition of LOC161635 (Accession XM_172921). Accordingly, utilities of VGAM1689 include diagnosis, prevention and treatment of diseases and clinical conditions associated with LOC161635. LOC222865 (Accession XM_167242) is another VGAM1689 host target gene. LOC222865 BINDING SITE is HOST TARGET binding site found in the 5' untranslated region of mRNA encoded by LOC222865, corresponding to a HOST TARGET binding site such as BINDING SITE I, BINDING SITE II or BINDING SITE III. Table 2 illustrates the complementarity of the nucleotide sequences of LOC222865 BINDING SITE, designated SEQ ID:44622, to the nucleotide sequence of VGAM1689 RNA, herein designated VGAM RNA, also designated SEQ ID:4400.

Another function of VGAM1689 is therefore inhibition of LOC222865 (Accession XM_167242). Accordingly, utilities of VGAM1689 include diagnosis, prevention and treatment of diseases and clinical conditions associated with LOC222865. LOC253962 (Accession XM_172968) is another VGAM1689 host target gene. LOC253962 BINDING SITE is HOST TARGET binding site found in the 5' untranslated region of mRNA encoded by LOC253962, corresponding to a HOST TARGET binding site such as BINDING SITE I, BINDING SITE II or BINDING SITE III. Table 2 illustrates the complementarity of the nucleotide sequences of LOC253962 BINDING SITE, designated SEQ ID:46225, to the nucleotide sequence of VGAM1689 RNA, herein designated VGAM RNA, also designated SEQ ID:4400.

Another function of VGAM1689 is therefore inhibition of LOC253962 (Accession XM_172968). Accordingly, utilities of VGAM1689 include diagnosis, prevention and treatment of diseases and clinical conditions associated with LOC253962. FIG. 1 further provides a conceptual description of a novel bioinformatically detected viral gene of the present invention, referred to here as Viral Genomic Address Messenger 1690 (VGAM1690) viral gene, which modulates expression of respective host target genes thereof, the function and utility of which host target genes is known in the art.

VGAM1690 is a novel bioinformatically detected regulatory, non protein coding, viral micro RNA (miRNA) gene. The method by which VGAM1690 was detected is described hereinabove with reference to FIGS. 1-8.

VGAM1690 gene, herein designated VGAM GENE, is a viral gene contained in the genome of Ectocarpus Siliculosus Virus. VGAM1690 host target gene, herein designated VGAM HOST TARGET GENE, is a human gene contained in the human genome.

VGAM1690 gene encodes a VGAM1690 precursor RNA, herein designated VGAM PRECURSOR RNA. Similar to other miRNA genes, and unlike most ordinary genes, VGAM1690 precursor RNA does not encode a protein. A nucleotide sequence identical or highly similar to the nucleotide sequence of VGAM1690 precursor RNA is designated SEQ ID:1676, and is provided hereinbelow with reference to the sequence listing part. Nucleotide sequence SEQ ID:1676 is located at position 49102 relative to the genome of Ectocarpus Siliculosus Virus.

VGAM1690 precursor RNA folds onto itself, forming VGAM1690 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1690 folded precursor RNA into VGAM1690 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1690 RNA is designated SEQ ID:4401, and is provided hereinbelow with reference to the sequence listing part.

VGAM1690 host target gene, herein designated VGAM HOST TARGET GENE, encodes a corresponding messenger RNA, VGAM1690 host target RNA, herein designated VGAM HOST TARGET RNA. VGAM1690 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1690 RNA, herein designated VGAM RNA, binds complementarily to one or more host target binding sites located in untranslated regions of VGAM1690 host target RNA, herein designated VGAM HOST TARGET RNA. This complementary binding is due to the fact that the nucleotide sequence of VGAM1690 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1690 RNA, herein designated VGAM RNA, may have a different number of host target binding sites in untranslated regions of a VGAM1690 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1690 RNA, herein designated VGAM RNA, to host target binding sites on VGAM1690 host target RNA, herein designated VGAM HOST TARGET RNA, such as BINDING SITE I, BINDING SITE II and BINDING SITE III, inhibits translation of VGAM1690 host target RNA into VGAM1690 host target protein, herein designated VGAM HOST TARGET PROTEIN. VGAM host target protein is therefore outlined by a broken line.

It is appreciated that VGAM1690 host target gene, herein designated VGAM HOST TARGET GENE, in fact represents a plurality of VGAM1690 host target genes. The mRNA of each one of this plurality of VGAM1690 host target genes comprises one or more host target binding sites, each having a nucleotide sequence which is at least partly complementary to VGAM1690 RNA, herein designated VGAM RNA, and which when bound by VGAM1690 RNA causes inhibition of translation of respective one or more VGAM1690 host target proteins.

It is further appreciated by one skilled in the art that the mode of translational inhibition illustrated by FIG. 1 with specific reference to translational inhibition exerted by VGAM1690 gene, herein designated VGAM GENE, on one or more VGAM1690 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1690 is inhibition of expression of host target genes, as part of a novel viral mechanism of attacking a host. Accordingly, utilities of VGAM1690 include diagnosis, prevention and treatment of viral infection by Ectocarpus Siliculosus Virus. Specific functions, and accordingly utilities, of VGAM1690 correlate with, and may be deduced from, the identity of the host target genes which VGAM1690 binds and inhibits, and the function of these host target genes, as elaborated hereinbelow.

Nucleotide sequences of the VGAM1690 precursor RNA, herein designated VGAM PRECURSOR RNA, and of the 'diced' VGAM1690 RNA, herein designated VGAM RNA, and a schematic representation of the secondary folding of VGAM1690 folded precursor RNA, herein designated VGAM FOLDED PRECURSOR RNA, of VGAM1690 are further described hereinbelow with reference to Table 1.

Nucleotide sequences of host target binding sites, such as BINDING SITE-I, BINDING SITE-II and BINDING SITE-III of FIG. 1, found on VGAM1690 host target RNA, and schematic representation of the complementarity of each of these host target binding sites to VGAM1690 RNA, herein designated VGAM RNA, are described hereinbelow with reference to Table 2.

As mentioned hereinabove with reference to FIG. 1, a function of VGAM1690 gene, herein designated VGAM is inhibition of expression of VGAM1690 target genes. It is appreciated that specific functions, and accordingly utilities, of VGAM1690 correlate with, and may be deduced from, the identity of the target genes which VGAM1690 binds and inhibits, and the function of these target genes, as elaborated hereinbelow.

Myosin, Heavy Polypeptide 11, Smooth Muscle (MYH11, Accession NM_002474) is a VGAM1690 host target gene. MYH11 BINDING SITE1 and MYH11 BINDING SITE2 are HOST TARGET binding sites found in untranslated regions of mRNA encoded by MYH11, corresponding to HOST TARGET binding sites such as BINDING SITE I, BINDING SITE II or BINDING SITE III. Table 2 illustrates the complementarity of the nucleotide sequences of MYH11 BINDING SITE1 and MYH11 BINDING SITE2, designated SEQ ID:8299 and SEQ ID:23141 respectively, to the nucleotide sequence of VGAM1690 RNA, herein designated VGAM RNA, also designated SEQ ID:4401.

A function of VGAM1690 is therefore inhibition of Myosin, Heavy Polypeptide 11, Smooth Muscle (MYH11, Accession NM_002474), a gene which is involved in muscle contraction. Accordingly, utilities of VGAM1690 include diagnosis, prevention and treatment of diseases and clinical conditions associated with MYH11. The function of MYH11 and its association with various diseases and clinical conditions, has been established by previous studies, as described hereinabove with reference to VGAM178. PANK (Accession NM_138316) is another VGAM1690 host target gene. PANK BINDING SITE is HOST TARGET binding site found in the 3' untranslated region of mRNA encoded by PANK, corresponding to a HOST TARGET binding site such as BINDING SITE I, BINDING SITE II or BINDING SITE III. Table 2 illustrates the complementarity of the nucleotide sequences of PANK BINDING SITE, designated SEQ ID:28713, to the nucleotide sequence of VGAM1690 RNA, herein designated VGAM RNA, also designated SEQ ID:4401.

Another function of VGAM1690 is therefore inhibition of PANK (Accession NM_138316). Accordingly, utilities of VGAM1690 include diagnosis, prevention and treatment of diseases and clinical conditions associated with PANK. LOC126755 (Accession XM_059074) is another VGAM1690 host target gene. LOC126755 BINDING SITE is HOST TARGET binding site found in the 3' untranslated region of mRNA encoded by LOC126755, corresponding to a HOST TARGET binding site such as BINDING SITE I, BINDING SITE II or BINDING SITE III. Table 2 illustrates the complementarity of the nucleotide sequences of LOC126755 BINDING SITE, designated SEQ ID:36859, to the nucleotide sequence of VGAM1690 RNA, herein designated VGAM RNA, also designated SEQ ID:4401.

Another function of VGAM1690 is therefore inhibition of LOC126755 (Accession XM_059074). Accordingly, utilities of VGAM1690 include diagnosis, prevention and treatment of diseases and clinical conditions associated with LOC126755. LOC164382 (Accession XM_104390) is another VGAM1690 host target gene. LOC164382 BINDING SITE is HOST TARGET binding site found in the 3' untranslated region of mRNA encoded by LOC164382, corresponding to a HOST TARGET binding site such as BINDING SITE I, BINDING SITE II or BINDING SITE III. Table 2 illustrates the complementarity of the nucleotide sequences of LOC164382 BINDING SITE, designated SEQ ID:42166, to the nucleotide sequence of VGAM1690 RNA, herein designated VGAM RNA, also designated SEQ ID:4401.

Another function of VGAM1690 is therefore inhibition of LOC164382 (Accession XM_104390). Accordingly, utilities of VGAM1690 include diagnosis, prevention and treatment of diseases and clinical conditions associated with LOC164382. FIG. 1 further provides a conceptual description of a novel bioinformatically detected viral gene of the present invention, referred to here as Viral Genomic Address Messenger 1691 (VGAM1691) viral gene, which modulates expression of respective host target genes thereof, the function and utility of which host target genes is known in the art.

VGAM1691 is a novel bioinformatically detected regulatory, non protein coding, viral micro RNA (miRNA) gene. The method by which VGAM1691 was detected is described hereinabove with reference to FIGS. 1-8.

VGAM1691 gene, herein designated VGAM GENE, is a viral gene contained in the genome of Ectocarpus Siliculosus Virus. VGAM1691 host target gene, herein designated VGAM HOST TARGET GENE, is a human gene contained in the human genome.

VGAM1691 gene encodes a VGAM1691 precursor RNA, herein designated VGAM PRECURSOR RNA. Similar to other miRNA genes, and unlike most ordinary genes, VGAM1691 precursor RNA does not encode a protein. A nucleotide sequence identical or highly similar to the nucleotide sequence of VGAM1691 precursor RNA is designated SEQ ID:1677, and is provided hereinbelow with reference to the sequence listing part. Nucleotide sequence SEQ ID:1677 is located at position 46991 relative to the genome of Ectocarpus Siliculosus Virus.

VGAM1691 precursor RNA folds onto itself, forming VGAM1691 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1691 folded precursor RNA into VGAM1691 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1691 RNA is designated SEQ ID:4402, and is provided hereinbelow with reference to the sequence listing part.

VGAM1691 host target gene, herein designated VGAM HOST TARGET GENE, encodes a corresponding messenger RNA, VGAM1691 host target RNA, herein designated VGAM HOST TARGET RNA. VGAM1691 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1691 RNA, herein designated VGAM RNA, binds complementarily to one or more host target binding sites located in untranslated regions of VGAM1691 host target RNA, herein designated VGAM HOST TARGET RNA. This complementary binding is due to the fact that the nucleotide sequence of VGAM1691 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1691 RNA, herein designated VGAM RNA, may have a different number of host target binding sites in untranslated regions of a VGAM1691 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1691 RNA, herein designated VGAM RNA, to host target binding sites on VGAM1691 host target RNA, herein designated VGAM HOST TARGET RNA, such as BINDING SITE I, BINDING SITE II and BINDING SITE III, inhibits translation of VGAM1691 host target RNA into VGAM1691 host target protein, herein designated VGAM HOST TARGET PROTEIN. VGAM host target protein is therefore outlined by a broken line.

It is appreciated that VGAM1691 host target gene, herein designated VGAM HOST TARGET GENE, in fact represents a plurality of VGAM1691 host target genes. The mRNA of each one of this plurality of VGAM1691 host target genes comprises one or more host target binding sites, each having a nucleotide sequence which is at least partly complementary to VGAM1691 RNA, herein designated VGAM RNA, and which when bound by VGAM1691 RNA causes inhibition of translation of respective one or more VGAM1691 host target proteins.

It is further appreciated by one skilled in the art that the mode of translational inhibition illustrated by FIG. 1 with specific reference to translational inhibition exerted by VGAM1691 gene, herein designated VGAM GENE, on one or more VGAM1691 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1691 is inhibition of expression of host target genes, as part of a novel viral mechanism of attacking a host. Accordingly, utilities of VGAM1691 include diagnosis, prevention and treatment of viral infection by Ectocarpus Siliculosus Virus. Specific functions, and accordingly utilities, of VGAM1691 correlate with, and may be deduced from, the identity of the host target genes which VGAM1691 binds and inhibits, and the function of these host target genes, as elaborated hereinbelow.

Nucleotide sequences of the VGAM1691 precursor RNA, herein designated VGAM PRECURSOR RNA, and of the 'diced' VGAM1691 RNA, herein designated VGAM RNA, and a schematic representation of the secondary folding of VGAM1691 folded precursor RNA, herein designated VGAM FOLDED PRECURSOR RNA, of VGAM1691 are further described hereinbelow with reference to Table 1.

Nucleotide sequences of host target binding sites, such as BINDING SITE-I, BINDING SITE-II and BINDING SITE-III of FIG. 1, found on VGAM1691 host target RNA, and schematic representation of the complementarity of each of these host target binding sites to VGAM1691 RNA, herein designated VGAM RNA, are described hereinbelow with reference to Table 2.

As mentioned hereinabove with reference to FIG. 1, a function of VGAM1691 gene, herein designated VGAM is inhibition of expression of VGAM1691 target genes. It is appreciated that specific functions, and accordingly utilities, of VGAM1691 correlate with, and may be deduced from, the identity of the target genes which VGAM1691 binds and inhibits, and the function of these target genes, as elaborated hereinbelow.

ABH (Accession XM_007409) is a VGAM1691 host target gene. ABH BINDING SITE is HOST TARGET binding site found in the 3' untranslated region of mRNA encoded by ABH, corresponding to a HOST TARGET binding site such as BINDING SITE I, BINDING SITE II or BINDING SITE III. Table 2 illustrates the complementarity of the nucleotide sequences of ABH BINDING SITE, designated SEQ ID:30053, to the nucleotide sequence of VGAM1691 RNA, herein designated VGAM RNA, also designated SEQ ID:4402.

A function of VGAM1691 is therefore inhibition of ABH (Accession XM_007409). Accordingly, utilities of VGAM1691 include diagnosis, prevention and treatment of diseases and clinical conditions associated with ABH. CD244 (Accession NM_016382) is another VGAM1691 host target gene. CD244 BINDING SITE is HOST TARGET binding site found in the 3' untranslated region of mRNA encoded by CD244, corresponding to a HOST TARGET binding site such as BINDING SITE I, BINDING SITE II or BINDING SITE III. Table 2 illustrates the complementarity of the nucleotide sequences of CD244 BINDING SITE, designated SEQ ID:18523, to the nucleotide sequence of VGAM1691 RNA, herein designated VGAM RNA, also designated SEQ ID:4402.

Another function of VGAM1691 is therefore inhibition of CD244 (Accession NM_016382), a gene which can interfere with a step as proximal as phosphorylation of an activation receptor. Accordingly, utilities of VGAM1691 include diagnosis, prevention and treatment of diseases and clinical conditions associated with CD244. The function of CD244 and its association with various diseases and clinical conditions, has been established by previous studies, as described hereinabove with reference to VGAM1224. Cleavage and Polyadenylation Specific Factor 4, 30 kDa (CPSF4, Accession NM_006693) is another VGAM1691 host target gene. CPSF4 BINDING SITE is HOST TARGET binding site found in the 3' untranslated region of mRNA encoded by CPSF4, corresponding to a HOST TARGET binding site such as BINDING SITE I, BINDING SITE II or BINDING SITE III. Table 2 illustrates the complementarity of the nucleotide sequences of CPSF4 BINDING SITE, designated SEQ ID:13513, to the nucleotide sequence of VGAM1691 RNA, herein designated VGAM RNA, also designated SEQ ID:4402.

Another function of VGAM1691 is therefore inhibition of Cleavage and Polyadenylation Specific Factor 4, 30 kDa (CPSF4, Accession NM_006693), a gene which may bind DNA. Accordingly, utilities of VGAM1691 include diagnosis, prevention and treatment of diseases and clinical conditions associated with CPSF4. The function of CPSF4 and its association with various diseases and clinical conditions, has been established by previous studies, as described hereinabove with reference to VGAM998. IL2-inducible T-cell Kinase (ITK, Accession NM_005546) is another VGAM1691 host target gene. ITK BINDING SITE is HOST TARGET binding site found in the 3' untranslated region of mRNA encoded by ITK, corresponding to a HOST TARGET binding site such as BINDING SITE I, BINDING SITE II or BINDING SITE III. Table 2 illustrates the complementarity of the nucleotide sequences of ITK BINDING SITE, designated SEQ ID:12074, to the nucleotide sequence of VGAM1691 RNA, herein designated VGAM RNA, also designated SEQ ID:4402.

Another function of VGAM1691 is therefore inhibition of IL2-inducible T-cell Kinase (ITK, Accession NM_005546), a gene which plays a role in t cell proliferation and differentiation. Accordingly, utilities of VGAM1691 include diagnosis, prevention and treatment of diseases and clinical conditions associated with ITK. The function of ITK and its association with various diseases and clinical conditions, has been established by previous studies, as described hereinabove with reference to VGAM288. Calsyntenin 2 (CLSTN2, Accession NM_022131) is another VGAM1691 host target gene. CLSTN2 BINDING SITE is HOST TARGET binding site found in the 3' untranslated region of mRNA encoded by CLSTN2, corresponding to a HOST TARGET binding site such as BINDING SITE I, BINDING SITE II or BINDING SITE III. Table 2 illustrates the complementarity of the nucleotide sequences of CLSTN2 BINDING SITE, designated SEQ ID:22692, to the nucleotide sequence of VGAM1691 RNA, herein designated VGAM RNA, also designated SEQ ID:4402.

Another function of VGAM1691 is therefore inhibition of Calsyntenin 2 (CLSTN2, Accession NM_022131). Accordingly, utilities of VGAM1691 include diagnosis, prevention and treatment of diseases and clinical conditions associated with CLSTN2. CMG2 (Accession NM_058172) is another VGAM1691 host target gene. CMG2 BINDING SITE is HOST TARGET binding site found in the 3' untranslated region of mRNA encoded by CMG2, corresponding to a HOST TARGET binding site such as BINDING SITE I, BINDING SITE II or BINDING SITE III. Table 2 illustrates the complementarity of the nucleotide sequences of CMG2 BINDING SITE, designated SEQ ID:27717, to the nucleotide sequence of VGAM1691 RNA, herein designated VGAM RNA, also designated SEQ ID:4402.

Another function of VGAM1691 is therefore inhibition of CMG2 (Accession NM_058172). Accordingly, utilities of VGAM1691 include diagnosis, prevention and treatment of diseases and clinical conditions associated with CMG2. FLJ23186 (Accession XM_017088) is another VGAM1691 host target gene. FLJ23186 BINDING SITE is HOST TARGET binding site found in the 3' untranslated region of mRNA encoded by FLJ23186, corresponding to a HOST TARGET binding site such as BINDING SITE I, BINDING SITE II or BINDING SITE III. Table 2 illustrates the complementarity of the nucleotide sequences of FLJ23186 BINDING SITE, designated SEQ ID:30296, to the nucleotide sequence of VGAM1691 RNA, herein designated VGAM RNA, also designated SEQ ID:4402.

Another function of VGAM1691 is therefore inhibition of FLJ23186 (Accession XM_017088). Accordingly, utilities of VGAM1691 include diagnosis, prevention and treatment of diseases and clinical conditions associated with FLJ23186. KIAA0367 (Accession XM_041018) is another VGAM1691 host target gene. KIAA0367 BINDING SITE is HOST TARGET binding site found in the 3' untranslated region of mRNA encoded by KIAA0367, corresponding to a HOST TARGET binding site such as BINDING SITE I, BINDING SITE II or BINDING SITE III. Table 2 illustrates the complementarity of the nucleotide sequences of KIAA0367 BINDING SITE, designated SEQ ID:33416, to the nucleotide sequence of VGAM1691 RNA, herein designated VGAM RNA, also designated SEQ ID:4402.

Another function of VGAM1691 is therefore inhibition of KIAA0367 (Accession XM_041018). Accordingly, utilities of VGAM1691 include diagnosis, prevention and treatment of diseases and clinical conditions associated with KIAA0367. Solute Carrier Family 21 (organic anion transporter), Member 14 (SLC21A14, Accession NM_017435) is another VGAM1691 host target gene. SLC21A14 BINDING SITE is HOST TARGET binding site found in the 3' untranslated region of mRNA encoded by SLC21A14, corresponding to a HOST TARGET binding site such as BINDING SITE I, BINDING SITE II or BINDING SITE III. Table 2 illustrates the complementarity of the nucleotide sequences of SLC21A14 BINDING SITE, designated SEQ ID:18890, to the nucleotide sequence of VGAM1691 RNA, herein designated VGAM RNA, also designated SEQ ID:4402.

Another function of VGAM1691 is therefore inhibition of Solute Carrier Family 21 (organic anion transporter), Member 14 (SLC21A14, Accession NM_017435). Accordingly, utilities of VGAM1691 include diagnosis, prevention and treatment of diseases and clinical conditions associated with SLC21A14. LOC116411 (Accession XM_058095) is another VGAM1691 host target gene. LOC116411 BINDING SITE is HOST TARGET binding site found in the 5' untranslated region of mRNA encoded by LOC116411, corresponding to a HOST TARGET binding site such as BINDING SITE I, BINDING SITE II or BINDING SITE III. Table 2 illustrates the complementarity of the nucleotide sequences of LOC116411 BINDING SITE, designated SEQ ID:36573, to the nucleotide sequence of VGAM1691 RNA, herein designated VGAM RNA, also designated SEQ ID:4402.

Another function of VGAM1691 is therefore inhibition of LOC116411 (Accession XM_058095). Accordingly, utilities of VGAM1691 include diagnosis, prevention and treatment of diseases and clinical conditions associated with LOC116411. LOC157349 (Accession XM_088298) is another VGAM1691 host target gene. LOC157349 BINDING SITE is HOST TARGET binding site found in the 3' untranslated region of mRNA encoded by LOC157349, corresponding to a HOST TARGET binding site such as BINDING SITE I, BINDING SITE II or BINDING SITE III. Table 2 illustrates the complementarity of the nucleotide sequences of LOC157349 BINDING SITE, designated SEQ ID:39587, to the nucleotide sequence of VGAM1691 RNA, herein designated VGAM RNA, also designated SEQ ID:4402.

Another function of VGAM1691 is therefore inhibition of LOC157349 (Accession XM_088298). Accordingly, utilities of VGAM1691 include diagnosis, prevention and treatment of diseases and clinical conditions associated with LOC157349. FIG. 1 further provides a conceptual description of a novel bioinformatically detected viral gene of the present invention, referred to here as Viral Genomic Address Messenger 1692 (VGAM1692) viral gene, which modulates expression of respective host target genes thereof, the function and utility of which host target genes is known in the art.

VGAM1692 is a novel bioinformatically detected regulatory, non protein coding, viral micro RNA (miRNA) gene. The method by which VGAM1692 was detected is described hereinabove with reference to FIGS. 1-8.

VGAM1692 gene, herein designated VGAM GENE, is a viral gene contained in the genome of Ectocarpus Siliculosus Virus. VGAM1692 host target gene, herein designated VGAM HOST TARGET GENE, is a human gene contained in the human genome.

VGAM1692 gene encodes a VGAM1692 precursor RNA, herein designated VGAM PRECURSOR RNA. Similar to other miRNA genes, and unlike most ordinary genes, VGAM1692 precursor RNA does not encode a protein. A nucleotide sequence identical or highly similar to the nucleotide sequence of VGAM1692 precursor RNA is designated SEQ ID:1678, and is provided hereinbelow with reference to the sequence listing part. Nucleotide sequence SEQ ID:1678 is located at position 52063 relative to the genome of Ectocarpus Siliculosus Virus.

VGAM1692 precursor RNA folds onto itself, forming VGAM1692 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1692 folded precursor RNA into VGAM1692 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1692 RNA is designated SEQ ID:4403, and is provided hereinbelow with reference to the sequence listing part.

VGAM1692 host target gene, herein designated VGAM HOST TARGET GENE, encodes a corresponding messenger RNA, VGAM1692 host target RNA, herein designated VGAM HOST TARGET RNA. VGAM1692 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1692 RNA, herein designated VGAM RNA, binds complementarily to one or more host target binding sites located in untranslated regions of VGAM1692 host target RNA, herein designated VGAM HOST TARGET RNA. This complementary binding is due to the fact that the nucleotide sequence of VGAM1692 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1692 RNA, herein designated VGAM RNA, may have a different number of host target binding sites in untranslated regions of a VGAM1692 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1692 RNA, herein designated VGAM RNA, to host target binding sites on VGAM1692 host target RNA, herein designated VGAM HOST TARGET RNA, such as BINDING SITE I, BINDING SITE II and BINDING SITE III, inhibits translation of VGAM1692 host target RNA into VGAM1692 host target protein, herein designated VGAM HOST TARGET PROTEIN. VGAM host target protein is therefore outlined by a broken line.

It is appreciated that VGAM1692 host target gene, herein designated VGAM HOST TARGET GENE, in fact represents a plurality of VGAM1692 host target genes. The mRNA of each one of this plurality of VGAM1692 host target genes comprises one or more host target binding sites, each having a nucleotide sequence which is at least partly complementary to VGAM1692 RNA, herein designated VGAM RNA, and which when bound by VGAM1692 RNA causes inhibition of translation of respective one or more VGAM1692 host target proteins.

It is further appreciated by one skilled in the art that the mode of translational inhibition illustrated by FIG. 1 with specific reference to translational inhibition exerted by VGAM1692 gene, herein designated VGAM GENE, on one or more VGAM1692 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let- 7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1692 is inhibition of expression of host target genes, as part of a novel viral mechanism of attacking a host. Accordingly, utilities of VGAM1692 include diagnosis, prevention and treatment of viral infection by Ectocarpus Siliculosus Virus. Specific functions, and accordingly utilities, of VGAM1692 correlate with, and may be deduced from, the identity of the host target genes which VGAM1692 binds and inhibits, and the function of these host target genes, as elaborated hereinbelow.

Nucleotide sequences of the VGAM1692 precursor RNA, herein designated VGAM PRECURSOR RNA, and of the 'diced' VGAM1692 RNA, herein designated VGAM RNA, and a schematic representation of the secondary folding of VGAM1692 folded precursor RNA, herein designated VGAM FOLDED PRECURSOR RNA, of VGAM1692 are further described hereinbelow with reference to Table 1.

Nucleotide sequences of host target binding sites, such as BINDING SITE-I, BINDING SITE-II and BINDING SITE-III of FIG. 1, found on VGAM1692 host target RNA, and schematic representation of the complementarity of each of these host target binding sites to VGAM1692 RNA, herein designated VGAM RNA, are described hereinbelow with reference to Table 2.

As mentioned hereinabove with reference to FIG. 1, a function of VGAM1692 gene, herein designated VGAM is inhibition of expression of VGAM1692 target genes. It is appreciated that specific functions, and accordingly utilities, of VGAM1692 correlate with, and may be deduced from, the identity of the target genes which VGAM1692 binds and inhibits, and the function of these target genes, as elaborated hereinbelow.

Protein Kinase C, Nu (PRKCN, Accession NM_005813) is a VGAM1692 host target gene. PRKCN BINDING SITE is HOST TARGET binding site found in the 3' untranslated region of mRNA encoded by PRKCN, corresponding to a HOST TARGET binding site such as BINDING SITE I, BINDING SITE II or BINDING SITE III. Table 2 illustrates the complementarity of the nucleotide sequences of PRKCN BINDING SITE, designated SEQ ID:12400, to the nucleotide sequence of VGAM1692 RNA, herein designated VGAM RNA, also designated SEQ ID:4403.

A function of VGAM1692 is therefore inhibition of Protein Kinase C, Nu (PRKCN, Accession NM_005813). Accordingly, utilities of VGAM1692 include diagnosis, prevention and treatment of diseases and clinical conditions associated with PRKCN. WAS Protein Family, Member 3 (WASF3, Accession NM_006646) is another VGAM1692 host target gene. WASF3 BINDING SITE is HOST TARGET binding site found in the 3' untranslated region of mRNA encoded by WASF3, corresponding to a HOST TARGET binding site such as BINDING SITE I, BINDING SITE II or BINDING SITE III. Table 2 illustrates the complementarity of the nucleotide sequences of WASF3 BINDING SITE, designated SEQ ID:13443, to the nucleotide sequence of VGAM1692 RNA, herein designated VGAM RNA, also designated SEQ ID:4403.

Another function of VGAM1692 is therefore inhibition of WAS Protein Family, Member 3 (WASF3, Accession NM_006646), a gene which stimulates actin polymerization. Accordingly, utilities of VGAM1692 include diagnosis, prevention and treatment of diseases and clinical conditions associated with WASF3. The function of WASF3 has been established by previous studies. The actin cytoskeleton plays critical roles in cell morphologic changes and motility. Rho family small GTPases such as Rho (see OMIM Ref. No. 165370), RAC (see OMIM Ref. No. 602048), and CDC42 (OMIM Ref. No. 116952) organize the actin cytoskeleton. Other major players in actin-based motility are the 7 members of the ARP2/3 complex (see OMIM Ref. No. 604221). The Wiskott-Aldrich syndrome protein (WASP; 301000) and WASP-like (WASL; 605056) are among the downstream effector molecules involved in the transmission of signals from tyrosine kinase receptors and small GTPases to the actin cytoskeleton. WASF1 (OMIM Ref. No. 605035) is also involved in actin reorganization, but its expression is restricted to brain. By searching an EST database for homologs of WASF1 and by screening cDNA libraries, Suetsugu et al. (1999) identified WASF2 (OMIM Ref. No. 605068) and WASF3, which they termed WAVE2 and WAVE3, respectively. The predicted 502-amino acid WASF3 protein shares 48% amino acid identity with WASF1. Northern blot analysis revealed that, like WASF1, WASF3 expression is strongest in brain, although weak expression was detected in kidney and liver. SDS-PAGE analysis showed that, like other WASP family members, WASF3 binds actin through its C-terminal verprolin homology (VPH) domain. Immunofluorescence microscopy demonstrated that ectopically expressed WASF3 induces abnormal actin clusters. These actin cluster formations were suppressed by deletion of the VPH domain of WASF3.

Full details of the abovementioned studies are described in the following publications, the disclosure of which are hereby incorporated by reference:

Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human genes. XII. The complete sequences of 100 new cDNA clones from brain which code for large proteins in vitro. DNA Res. 5:355-364, 1998; and Suetsugu, S.; Miki, H.; Takenawa, T.: Identification of two human WAVE/SCAR homologues as general actin regulatory molecules which associate with the Arp2/3 complex. Biochem. Biophys.

Further studies establishing the function and utilities of WASF3 are found in John Hopkins OMIM database record ID 605068, and in sited publications numbered 493 and 6593 listed in the bibliography section hereinbelow, which are also hereby incorporated by reference. Calcium/calmodulin-dependent Protein Kinase Kinase 1, Alpha (CAMKK1, Accession NM_032294) is another VGAM1692 host target gene. CAMKK1 BINDING SITE is HOST TARGET binding site found in the 3' untranslated region of mRNA encoded by CAMKK1, corresponding to a HOST TARGET binding site such as BINDING SITE I, BINDING SITE II or BINDING SITE III. Table 2 illustrates the complementarity of the nucleotide sequences of CAMKK1 BINDING SITE, designated SEQ ID:26063, to the nucleotide sequence of VGAM1692 RNA, herein designated VGAM RNA, also designated SEQ ID:4403.

Another function of VGAM1692 is therefore inhibition of Calcium/calmodulin-dependent Protein Kinase Kinase 1, Alpha (CAMKK1, Accession NM_032294). Accordingly, utilities of VGAM1692 include diagnosis, prevention and treatment of diseases and clinical conditions associated with CAMKK1. FIG. 1 further provides a conceptual description of a novel bioinformatically detected viral gene of the present invention, referred to here as Viral Genomic Address Messenger 1693 (VGAM1693) viral gene, which modulates expression of respective host target genes thereof, the function and utility of which host target genes is known in the art.

VGAM1693 is a novel bioinformatically detected regulatory, non protein coding, viral micro RNA (miRNA) gene. The method by which VGAM1693 was detected is described hereinabove with reference to FIGS. 1-8.

VGAM1693 gene, herein designated VGAM GENE, is a viral gene contained in the genome of Ectocarpus Siliculosus Virus. VGAM1693 host target gene, herein designated VGAM HOST TARGET GENE, is a human gene contained in the human genome.

VGAM1693 gene encodes a VGAM1693 precursor RNA, herein designated VGAM PRECURSOR RNA. Similar to other miRNA genes, and unlike most ordinary genes, VGAM1693 precursor RNA does not encode a protein. A nucleotide sequence identical or highly similar to the nucleotide sequence of VGAM1693 precursor RNA is designated SEQ ID:1679, and is provided hereinbelow with reference to the sequence listing part. Nucleotide sequence SEQ ID:1679 is located at position 54673 relative to the genome of Ectocarpus Siliculosus Virus.

VGAM1693 precursor RNA folds onto itself, forming VGAM1693 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1693 folded precursor RNA into VGAM1693 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1693 RNA is designated SEQ ID:4404, and is provided hereinbelow with reference to the sequence listing part.

VGAM1693 host target gene, herein designated VGAM HOST TARGET GENE, encodes a corresponding messenger RNA, VGAM1693 host target RNA, herein designated VGAM HOST TARGET RNA. VGAM1693 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1693 RNA, herein designated VGAM RNA, binds complementarily to one or more host target binding sites located in untranslated regions of VGAM1693 host target RNA, herein designated VGAM HOST TARGET RNA. This complementary binding is due to the fact that the nucleotide sequence of VGAM1693 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1693 RNA, herein designated VGAM RNA, may have a different number of host target binding sites in untranslated regions of a VGAM1693 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1693 RNA, herein designated VGAM RNA, to host target binding sites on VGAM1693 host target RNA, herein designated VGAM HOST TARGET RNA, such as BINDING SITE I, BINDING SITE II and BINDING SITE III, inhibits translation of VGAM1693 host target RNA into VGAM1693 host target protein, herein designated VGAM HOST TARGET PROTEIN. VGAM host target protein is therefore outlined by a broken line.

It is appreciated that VGAM1693 host target gene, herein designated VGAM HOST TARGET GENE, in fact represents a plurality of VGAM1693 host target genes. The mRNA of each one of this plurality of VGAM1693 host target genes comprises one or more host target binding sites, each having a nucleotide sequence which is at least partly complementary to VGAM1693 RNA, herein designated VGAM RNA, and which when bound by VGAM1693 RNA causes inhibition of translation of respective one or more VGAM1693 host target proteins.

It is further appreciated by one skilled in the art that the mode of translational inhibition illustrated by FIG. 1 with specific reference to translational inhibition exerted by VGAM1693 gene, herein designated VGAM GENE, on one or more VGAM1693 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1693 is inhibition of expression of host target genes, as part of a novel viral mechanism of attacking a host. Accordingly, utilities of VGAM1693 include diagnosis, prevention and treatment of viral infection by Ectocarpus Siliculosus Virus. Specific functions, and accordingly utilities, of VGAM1693 correlate with, and may be deduced from, the identity of the host target genes which VGAM1693 binds and inhibits, and the function of these host target genes, as elaborated hereinbelow.

Nucleotide sequences of the VGAM1693 precursor RNA, herein designated VGAM PRECURSOR RNA, and of the 'diced' VGAM1693 RNA, herein designated VGAM RNA, and a schematic representation of the secondary folding of VGAM1693 folded precursor RNA, herein designated VGAM FOLDED PRECURSOR RNA, of VGAM1693 are further described hereinbelow with reference to Table 1.

Nucleotide sequences of host target binding sites, such as BINDING SITE-I, BINDING SITE-II and BINDING SITE-III of FIG. 1, found on VGAM1693 host target RNA, and schematic representation of the complementarity of each of these host target binding sites to VGAM1693 RNA, herein designated VGAM RNA, are described hereinbelow with reference to Table 2.

As mentioned hereinabove with reference to FIG. 1, a function of VGAM1693 gene, herein designated VGAM is inhibition of expression of VGAM1693 target genes. It is appreciated that specific functions, and accordingly utilities, of VGAM1693 correlate with, and may be deduced from, the identity of the target genes which VGAM1693 binds and inhibits, and the function of these target genes, as elaborated hereinbelow.

Inositol Polyphosphate-5-phosphatase, 145 kDa (INPP5D, Accession XM_096169) is a VGAM1693 host target gene. INPP5D BINDING SITE is HOST TARGET binding site found in the 3' untranslated region of mRNA encoded by INPP5D, corresponding to a HOST TARGET binding site such as BINDING SITE I, BINDING SITE II or BINDING SITE III. Table 2 illustrates the complementarity of the nucleotide sequences of INPP5D BINDING SITE, designated SEQ ID:40302, to the nucleotide sequence of VGAM1693 RNA, herein designated VGAM RNA, also designated SEQ ID:4404.

A function of VGAM1693 is therefore inhibition of Inositol Polyphosphate-5-phosphatase, 145 kDa (INPP5D, Accession XM_096169), a gene which hydrolyzes Ins (1,3,4,5)P4 and PtdIns (3,4,5)P3; contains an SH2-domain. Accordingly, utilities of VGAM1693 include diagnosis, prevention and treatment of diseases and clinical conditions associated with INPP5D. The function of INPP5D and its association with various diseases and clinical conditions, has been established by previous studies, as described hereinabove with reference to VGAM64. FIG. 1 further provides a conceptual description of a novel bioinformatically detected viral gene of the present invention, referred to here as Viral Genomic Address Messenger 1694 (VGAM1694) viral gene, which modulates expression of respective host target genes thereof, the function and utility of which host target genes is known in the art.

VGAM1694 is a novel bioinformatically detected regulatory, non protein coding, viral micro RNA (miRNA) gene. The method by which VGAM1694 was detected is described hereinabove with reference to FIGS. 1-8.

VGAM1694 gene, herein designated VGAM GENE, is a viral gene contained in the genome of Ectocarpus Siliculosus Virus. VGAM1694 host target gene, herein designated VGAM HOST TARGET GENE, is a human gene contained in the human genome.

VGAM1694 gene encodes a VGAM1694 precursor RNA, herein designated VGAM PRECURSOR RNA. Similar to other miRNA genes, and unlike most ordinary genes, VGAM1694 precursor RNA does not encode a protein. A nucleotide sequence identical or highly similar to the nucleotide sequence of VGAM1694 precursor RNA is designated SEQ ID:1680, and is provided hereinbelow with reference to the sequence listing part. Nucleotide sequence SEQ ID:1680 is located at position 50970 relative to the genome of Ectocarpus Siliculosus Virus.

VGAM1694 precursor RNA folds onto itself, forming VGAM1694 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1694 folded precursor RNA into VGAM1694 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1694 RNA is designated SEQ ID:4405, and is provided hereinbelow with reference to the sequence listing part.

VGAM1694 host target gene, herein designated VGAM HOST TARGET GENE, encodes a corresponding messenger RNA, VGAM1694 host target RNA, herein designated VGAM HOST TARGET RNA. VGAM1694 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1694 RNA, herein designated VGAM RNA, binds complementarily to one or more host target binding sites located in untranslated regions of VGAM1694 host target RNA, herein designated VGAM HOST TARGET RNA. This complementary binding is due to the fact that the nucleotide sequence of VGAM1694 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1694 RNA, herein designated VGAM RNA, may have a different number of host target binding sites in untranslated regions of a VGAM1694 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1694 RNA, herein designated VGAM RNA, to host target binding sites on VGAM1694 host target RNA, herein designated VGAM HOST TARGET RNA, such as BINDING SITE I, BINDING SITE II and BINDING SITE III, inhibits translation of VGAM1694 host target RNA into VGAM1694 host target protein, herein designated VGAM HOST TARGET PROTEIN. VGAM host target protein is therefore outlined by a broken line.

It is appreciated that VGAM1694 host target gene, herein designated VGAM HOST TARGET GENE, in fact represents a plurality of VGAM1694 host target genes. The mRNA of each one of this plurality of VGAM1694 host target genes comprises one or more host target binding sites, each having a nucleotide sequence which is at least partly complementary to VGAM1694 RNA, herein designated VGAM RNA, and which when bound by VGAM1694 RNA causes inhibition of translation of respective one or more VGAM1694 host target proteins.

It is further appreciated by one skilled in the art that the mode of translational inhibition illustrated by FIG. 1 with specific reference to translational inhibition exerted by VGAM1694 gene, herein designated VGAM GENE, on one or more VGAM1694 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1694 is inhibition of expression of host target genes, as part of a novel viral mechanism of attacking a host. Accordingly, utilities of VGAM1694 include diagnosis, prevention and treatment of viral infection by Ectocarpus Siliculosus Virus. Specific functions, and accordingly utilities, of VGAM1694 correlate with, and may be deduced from, the identity of the host target genes which VGAM1694 binds and inhibits, and the function of these host target genes, as elaborated hereinbelow.

Nucleotide sequences of the VGAM1694 precursor RNA, herein designated VGAM PRECURSOR RNA, and of the 'diced' VGAM1694 RNA, herein designated VGAM RNA, and a schematic representation of the secondary folding of VGAM1694 folded precursor RNA, herein designated VGAM FOLDED PRECURSOR RNA, of VGAM1694 are further described hereinbelow with reference to Table 1.

Nucleotide sequences of host target binding sites, such as BINDING SITE-I, BINDING SITE-II and BINDING SITE-III of FIG. 1, found on VGAM1694 host target RNA, and schematic representation of the complementarity of each of these host target binding sites to VGAM1694 RNA, herein designated VGAM RNA, are described hereinbelow with reference to Table 2.

As mentioned hereinabove with reference to FIG. 1, a function of VGAM1694 gene, herein designated VGAM is inhibition of expression of VGAM1694 target genes. It is appreciated that specific functions, and accordingly utilities, of VGAM1694 correlate with, and may be deduced from, the identity of the target genes which VGAM1694 binds and inhibits, and the function of these target genes, as elaborated hereinbelow.

Inositol Polyphosphate-5-phosphatase, 145 kDa (INPP5D, Accession XM_096169) is a VGAM1694 host target gene. INPP5D BINDING SITE is HOST TARGET binding site found in the 3' untranslated region of mRNA encoded by INPP5D, corresponding to a HOST TARGET binding site such as BINDING SITE I, BINDING SITE II or BINDING SITE III. Table 2 illustrates the complementarity of the nucleotide sequences of INPP5D BINDING SITE, designated SEQ ID:40302, to the nucleotide sequence of VGAM1694 RNA, herein designated VGAM RNA, also designated SEQ ID:4405.

A function of VGAM1694 is therefore inhibition of Inositol Polyphosphate-5-phosphatase, 145 kDa (INPP5D, Accession XM_096169), a gene which hydrolyzes Ins (1,3,4,5)P4 and PtdIns (3,4,5)P3; contains an SH2-domain. Accordingly, utilities of VGAM1694 include diagnosis, prevention and treatment of diseases and clinical conditions associated with INPP5D. The function of INPP5D and its association with various diseases and clinical conditions, has been established by previous studies, as described hereinabove with reference to VGAM64. FIG. 1 further provides a conceptual description of a novel bioinformatically detected viral gene of the present invention, referred to here as Viral Genomic Address Messenger 1695 (VGAM1695) viral gene, which modulates expression of respective host target genes thereof, the function and utility of which host target genes is known in the art.

VGAM1695 is a novel bioinformatically detected regulatory, non protein coding, viral micro RNA (miRNA) gene. The method by which VGAM1695 was detected is described hereinabove with reference to FIGS. 1-8.

VGAM1695 gene, herein designated VGAM GENE, is a viral gene contained in the genome of Ectocarpus Siliculosus Virus. VGAM1695 host target gene, herein designated VGAM HOST TARGET GENE, is a human gene contained in the human genome.

VGAM1695 gene encodes a VGAM1695 precursor RNA, herein designated VGAM PRECURSOR RNA. Similar to other miRNA genes, and unlike most ordinary genes, VGAM1695 precursor RNA does not encode a protein. A nucleotide sequence identical or highly similar to the nucleotide sequence of VGAM1695 precursor RNA is designated SEQ ID:1681, and is provided hereinbelow with reference to the sequence listing part. Nucleotide sequence SEQ ID:1681 is located at position 51375 relative to the genome of Ectocarpus Siliculosus Virus.

VGAM1695 precursor RNA folds onto itself, forming VGAM1695 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1695 folded precursor RNA into VGAM1695 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1695 RNA is designated SEQ ID:4406, and is provided hereinbelow with reference to the sequence listing part.

VGAM1695 host target gene, herein designated VGAM HOST TARGET GENE, encodes a corresponding messenger RNA, VGAM1695 host target RNA, herein designated VGAM HOST TARGET RNA. VGAM1695 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1695 RNA, herein designated VGAM RNA, binds complementarily to one or more host target binding sites located in untranslated regions of VGAM1695 host target RNA, herein designated VGAM HOST TARGET RNA. This complementary binding is due to the fact that the nucleotide sequence of VGAM1695 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1695 RNA, herein designated VGAM RNA, may have a different number of host target binding sites in untranslated regions of a VGAM1695 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1695 RNA, herein designated VGAM RNA, to host target binding sites on VGAM1695 host target RNA, herein designated VGAM HOST TARGET RNA, such as BINDING SITE I, BINDING SITE II and BINDING SITE III, inhibits translation of VGAM1695 host target RNA into VGAM1695 host target protein, herein designated VGAM HOST TARGET PRO- TEIN. VGAM host target protein is therefore outlined by a broken line.

It is appreciated that VGAM1695 host target gene, herein designated VGAM HOST TARGET GENE, in fact represents a plurality of VGAM1695 host target genes. The mRNA of each one of this plurality of VGAM1695 host target genes comprises one or more host target binding sites, each having a nucleotide sequence which is at least partly complementary to VGAM1695 RNA, herein designated VGAM RNA, and which when bound by VGAM1695 RNA causes inhibition of translation of respective one or more VGAM1695 host target proteins.

It is further appreciated by one skilled in the art that the mode of translational inhibition illustrated by FIG. 1 with specific reference to translational inhibition exerted by VGAM1695 gene, herein designated VGAM GENE, on one or more VGAM1695 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1695 is inhibition of expression of host target genes, as part of a novel viral mechanism of attacking a host. Accordingly, utilities of VGAM1695 include diagnosis, prevention and treatment of viral infection by Ectocarpus Siliculosus Virus. Specific functions, and accordingly utilities, of VGAM1695 correlate with, and may be deduced from, the identity of the host target genes which VGAM1695 binds and inhibits, and the function of these host target genes, as elaborated hereinbelow.

Nucleotide sequences of the VGAM1695 precursor RNA, herein designated VGAM PRECURSOR RNA, and of the 'diced' VGAM1695 RNA, herein designated VGAM RNA, and a schematic representation of the secondary folding of VGAM1695 folded precursor RNA, herein designated VGAM FOLDED PRECURSOR RNA, of VGAM1695 are further described hereinbelow with reference to Table 1.

Nucleotide sequences of host target binding sites, such as BINDING SITE-I, BINDING SITE-II and BINDING SITE-III of FIG. 1, found on VGAM1695 host target RNA, and schematic representation of the complementarity of each of these host target binding sites to VGAM1695 RNA, herein designated VGAM RNA, are described hereinbelow with reference to Table 2.

As mentioned hereinabove with reference to FIG. 1, a function of VGAM1695 gene, herein designated VGAM is inhibition of expression of VGAM1695 target genes. It is appreciated that specific functions, and accordingly utilities, of VGAM1695 correlate with, and may be deduced from, the identity of the target genes which VGAM1695 binds and inhibits, and the function of these target genes, as elaborated hereinbelow.

Inositol Polyphosphate-5-phosphatase, 145 kDa (INPP5D, Accession XM_096169) is a VGAM1695 host target gene. INPP5D BINDING SITE is HOST TARGET binding site found in the 3' untranslated region of mRNA encoded by INPP5D, corresponding to a HOST TARGET binding site such as BINDING SITE I, BINDING SITE II or BINDING SITE III. Table 2 illustrates the complementarity of the nucleotide sequences of INPP5D BINDING SITE, designated SEQ ID:40302, to the nucleotide sequence of VGAM1695 RNA, herein designated VGAM RNA, also designated SEQ ID:4406.

A function of VGAM1695 is therefore inhibition of Inositol Polyphosphate-5-phosphatase, 145 kDa (INPP5D, Accession XM_096169), a gene which hydrolyzes Ins (1,3,4,5)P4 and PtdIns (3,4,5)P3; contains an SH2-domain. Accordingly, utilities of VGAM1695 include diagnosis, prevention and treatment of diseases and clinical conditions associated with INPP5D. The function of INPP5D and its association with various diseases and clinical conditions, has been established by previous studies, as described hereinabove with reference to VGAM64. FIG. 1 further provides a conceptual description of a novel bioinformatically detected viral gene of the present invention, referred to here as Viral Genomic Address Messenger 1696 (VGAM1696) viral gene, which modulates expression of respective host target genes thereof, the function and utility of which host target genes is known in the art.

VGAM1696 is a novel bioinformatically detected regulatory, non protein coding, viral micro RNA (miRNA) gene. The method by which VGAM1696 was detected is described hereinabove with reference to FIGS. 1-8.

VGAM1696 gene, herein designated VGAM GENE, is a viral gene contained in the genome of Ectocarpus Siliculosus Virus. VGAM1696 host target gene, herein designated VGAM HOST TARGET GENE, is a human gene contained in the human genome.

VGAM1696 gene encodes a VGAM1696 precursor RNA, herein designated VGAM PRECURSOR RNA. Similar to other miRNA genes, and unlike most ordinary genes, VGAM1696 precursor RNA does not encode a protein. A nucleotide sequence identical or highly similar to the nucleotide sequence of VGAM1696 precursor RNA is designated SEQ ID:1682, and is provided hereinbelow with reference to the sequence listing part. Nucleotide sequence SEQ ID:1682 is located at position 52738 relative to the genome of Ectocarpus Siliculosus Virus.

VGAM1696 precursor RNA folds onto itself, forming VGAM1696 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1696 folded precursor RNA into VGAM1696 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1696 RNA is designated SEQ ID:4407, and is provided hereinbelow with reference to the sequence listing part.

VGAM1696 host target gene, herein designated VGAM HOST TARGET GENE, encodes a corresponding messenger RNA, VGAM1696 host target RNA, herein designated VGAM HOST TARGET RNA. VGAM1696 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1696 RNA, herein designated VGAM RNA, binds complementarily to one or more host target binding sites located in untranslated regions of VGAM1696 host target RNA, herein designated VGAM HOST TARGET RNA. This complementary binding is due to the fact that the nucleotide sequence of VGAM1696 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1696 RNA, herein designated VGAM RNA, may have a different number of host target binding sites in untranslated regions of a VGAM1696 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1696 RNA, herein designated VGAM RNA, to host target binding sites on VGAM1696 host target RNA, herein designated VGAM HOST TARGET RNA, such as BINDING SITE I, BINDING SITE II and BINDING SITE III, inhibits translation of VGAM1696 host target RNA into VGAM1696 host target protein, herein designated VGAM HOST TARGET PROTEIN. VGAM host target protein is therefore outlined by a broken line.

It is appreciated that VGAM1696 host target gene, herein designated VGAM HOST TARGET GENE, in fact represents a plurality of VGAM1696 host target genes. The mRNA of each one of this plurality of VGAM1696 host target genes comprises one or more host target binding sites, each having a nucleotide sequence which is at least partly complementary to VGAM1696 RNA, herein designated VGAM RNA, and which when bound by VGAM1696 RNA causes inhibition of translation of respective one or more VGAM1696 host target proteins.

It is further appreciated by one skilled in the art that the mode of translational inhibition illustrated by FIG. 1 with specific reference to translational inhibition exerted by VGAM1696 gene, herein designated VGAM GENE, on one or more VGAM1696 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1696 is inhibition of expression of host target genes, as part of a novel viral mechanism of attacking a host. Accordingly, utilities of VGAM1696 include diagnosis, prevention and treatment of viral infection by Ectocarpus Siliculosus Virus. Specific functions, and accordingly utilities, of VGAM1696 correlate with, and may be deduced from, the identity of the host target genes which VGAM1696 binds and inhibits, and the function of these host target genes, as elaborated hereinbelow.

Nucleotide sequences of the VGAM1696 precursor RNA, herein designated VGAM PRECURSOR RNA, and of the 'diced' VGAM1696 RNA, herein designated VGAM RNA, and a schematic representation of the secondary folding of VGAM1696 folded precursor RNA, herein designated VGAM FOLDED PRECURSOR RNA, of VGAM1696 are further described hereinbelow with reference to Table 1.

Nucleotide sequences of host target binding sites, such as BINDING SITE-I, BINDING SITE-II and BINDING SITE-III of FIG. 1, found on VGAM1696 host target RNA, and schematic representation of the complementarity of each of these host target binding sites to VGAM1696 RNA, herein designated VGAM RNA, are described hereinbelow with reference to Table 2.

As mentioned hereinabove with reference to FIG. 1, a function of VGAM1696 gene, herein designated VGAM is inhibition of expression of VGAM1696 target genes. It is appreciated that specific functions, and accordingly utilities, of VGAM1696 correlate with, and may be deduced from, the identity of the target genes which VGAM1696 binds and inhibits, and the function of these target genes, as elaborated hereinbelow.

5-hydroxytryptamine (serotonin) Receptor 2C (HTR2C, Accession NM_000868) is a VGAM1696 host target gene. HTR2C BINDING SITE is HOST TARGET binding site found in the 5' untranslated region of mRNA encoded by HTR2C, corresponding to a HOST TARGET binding site such as BINDING SITE I, BINDING SITE II or BINDING SITE III. Table 2 illustrates the complementarity of the nucleotide sequences of HTR2C BINDING SITE, designated SEQ ID:6534, to the nucleotide sequence of VGAM1696 RNA, herein designated VGAM RNA, also designated SEQ ID:4407.

A function of VGAM1696 is therefore inhibition of 5-hydroxytryptamine (serotonin) Receptor 2C (HTR2C, Accession NM_000868), a gene which activates phospholipase C and regulates intracellular calcium flux. Accordingly, utilities of VGAM1696 include diagnosis, prevention and treatment of diseases and clinical conditions associated with HTR2C. The function of HTR2C and its association with various diseases and clinical conditions, has been established by previous studies, as described hereinabove with reference to VGAM1052. Inositol 1,4,5-triphosphate Receptor, Type 3 (ITPR3, Accession NM_002224) is another VGAM1696 host target gene. ITPR3 BINDING SITE is HOST TARGET binding site found in the 3' untranslated region of mRNA encoded by ITPR3, corresponding to a HOST TARGET binding site such as BINDING SITE I, BINDING SITE II or BINDING SITE III. Table 2 illustrates the complementarity of the nucleotide sequences of ITPR3 BINDING SITE, designated SEQ ID:7998, to the nucleotide sequence of VGAM1696 RNA, herein designated VGAM RNA, also designated SEQ ID:4407.

Another function of VGAM1696 is therefore inhibition of Inositol 1,4,5-triphosphate Receptor, Type 3 (ITPR3, Accession NM_002224), a gene which may be responsible for calcium release from intracellular stores. Accordingly, utilities of VGAM1696 include diagnosis, prevention and treatment of diseases and clinical conditions associated with ITPR3. The function of ITPR3 and its association with various diseases and clinical conditions, has been established by previous studies, as described hereinabove with reference to VGAM310. Calcium/calmodulin-dependent Protein Kinase Kinase 1, Alpha (CAMKK1, Accession NM_032294) is another VGAM1696 host target gene. CAMKK1 BINDING SITE is HOST TARGET binding site found in the 3' untranslated region of mRNA encoded by CAMKK1, corresponding to a HOST TARGET binding site such as BINDING SITE I, BINDING SITE II or BINDING SITE III. Table 2 illustrates the complementarity of the nucleotide sequences of CAMKK1 BINDING SITE, designated SEQ ID:26067, to the nucleotide sequence of VGAM1696 RNA, herein designated VGAM RNA, also designated SEQ ID:4407.

Another function of VGAM1696 is therefore inhibition of Calcium/calmodulin-dependent Protein Kinase Kinase 1, Alpha (CAMKK1, Accession NM_032294). Accordingly, utilities of VGAM1696 include diagnosis, prevention and treatment of diseases and clinical conditions associated with CAMKK1. FLJ21432 (Accession NM_024551) is another VGAM1696 host target gene. FLJ21432 BINDING SITE is HOST TARGET binding site found in the 3' untranslated region of mRNA encoded by FLJ21432, corresponding to a HOST TARGET binding site such as BINDING SITE I, BINDING SITE II or BINDING SITE III. Table 2 illustrates the complementarity of the nucleotide sequences of FLJ21432 BINDING SITE, designated SEQ ID:23769, to the nucleotide sequence of VGAM1696 RNA, herein designated VGAM RNA, also designated SEQ ID:4407.

Another function of VGAM1696 is therefore inhibition of FLJ21432 (Accession NM_024551). Accordingly, utilities of VGAM1696 include diagnosis, prevention and treatment of diseases and clinical conditions associated with FLJ21432. LGP1 (Accession NM_032484) is another VGAM1696 host target gene. LGP1 BINDING SITE is HOST TARGET binding site found in the 5' untranslated region of mRNA encoded by LGP1, corresponding to a HOST TARGET binding site such as BINDING SITE I, BINDING SITE II or BINDING SITE III. Table 2 illustrates the complementarity of the nucleotide sequences of LGP1 BINDING SITE, designated SEQ ID:26231, to the nucleotide sequence of VGAM1696 RNA, herein designated VGAM RNA, also designated SEQ ID:4407.

Another function of VGAM1696 is therefore inhibition of LGP1 (Accession NM_032484). Accordingly, utilities of VGAM1696 include diagnosis, prevention and treatment of diseases and clinical conditions associated with LGP1. Mitogen-activated Protein Kinase Kinase 4 (MAP2K4, Accession NM_003010) is another VGAM1696 host target gene. MAP2K4 BINDING SITE is HOST TARGET binding site found in the 3' untranslated region of mRNA encoded by MAP2K4, corresponding to a HOST TARGET binding site such as BINDING SITE I, BINDING SITE II or BINDING SITE III. Table 2 illustrates the complementarity of the nucleotide sequences of MAP2K4 BINDING SITE, designated SEQ ID:8918, to the nucleotide sequence of VGAM1696 RNA, herein designated VGAM RNA, also designated SEQ ID:4407.

Another function of VGAM1696 is therefore inhibition of Mitogen-activated Protein Kinase Kinase 4 (MAP2K4, Accession NM_003010). Accordingly, utilities of VGAM1696 include diagnosis, prevention and treatment of diseases and clinical conditions associated with MAP2K4. MGC14161 (Accession NM_032892) is another VGAM1696 host target gene. MGC14161 BINDING SITE is HOST TARGET binding site found in the 5' untranslated region of mRNA encoded by MGC14161, corresponding to a HOST TARGET binding site such as BINDING SITE I, BINDING SITE II or BINDING SITE III. Table 2 illustrates the complementarity of the nucleotide sequences of MGC14161 BINDING SITE, designated SEQ ID:26718, to the nucleotide sequence of VGAM1696 RNA, herein designated VGAM RNA, also designated SEQ ID:4407.

Another function of VGAM1696 is therefore inhibition of MGC14161 (Accession NM_032892). Accordingly, utilities of VGAM1696 include diagnosis, prevention and treatment of diseases and clinical conditions associated with MGC14161. LOC115330 (Accession NM_138445) is another VGAM1696 host target gene. LOC115330 BINDING SITE is HOST TARGET binding site found in the 3' untranslated region of mRNA encoded by LOC115330, corresponding to a HOST TARGET binding site such as BINDING SITE I, BINDING SITE II or BINDING SITE III. Table 2 illustrates the complementarity of the nucleotide sequences of LOC115330 BINDING SITE, designated SEQ ID:28810, to the nucleotide sequence of VGAM1696 RNA, herein designated VGAM RNA, also designated SEQ ID:4407.

Another function of VGAM1696 is therefore inhibition of LOC115330 (Accession NM_138445). Accordingly, utilities of VGAM1696 include diagnosis, prevention and treatment of diseases and clinical conditions associated with LOC115330. LOC116437 (Accession XM_058185) is another VGAM1696 host target gene. LOC116437 BINDING SITE is HOST TARGET binding site found in the 3' untranslated region of mRNA encoded by LOC116437, corresponding to a HOST TARGET binding site such as BINDING SITE I, BINDING SITE II or BINDING SITE III. Table 2 illustrates the complementarity of the nucleotide sequences of LOC116437 BINDING SITE, designated SEQ ID:36581, to the nucleotide sequence of VGAM1696 RNA, herein designated VGAM RNA, also designated SEQ ID:4407.

Another function of VGAM1696 is therefore inhibition of LOC116437 (Accession XM_058185). Accordingly, utilities of VGAM1696 include diagnosis, prevention and treatment of diseases and clinical conditions associated with LOC116437. LOC131873 (Accession XM_067585) is another VGAM1696 host target gene. LOC131873 BINDING SITE is HOST TARGET binding site found in the 3' untranslated region of mRNA encoded by LOC131873, corresponding to a HOST TARGET binding site such as BINDING SITE I, BINDING SITE II or BINDING SITE III. Table 2 illustrates the complementarity of the nucleotide sequences of LOC131873 BINDING SITE, designated SEQ ID:37366, to the nucleotide sequence of VGAM1696 RNA, herein designated VGAM RNA, also designated SEQ ID:4407.

Another function of VGAM1696 is therefore inhibition of LOC131873 (Accession XM_067585). Accordingly, utilities of VGAM1696 include diagnosis, prevention and treatment of diseases and clinical conditions associated with LOC131873. LOC58489 (Accession XM_051862) is another VGAM1696 host target gene. LOC58489 BINDING SITE is HOST TARGET binding site found in the 3' untranslated region of mRNA encoded by LOC58489, corresponding to a HOST TARGET binding site such as BINDING SITE I, BINDING SITE II or BINDING SITE III. Table 2 illustrates the complementarity of the nucleotide sequences of LOC58489 BINDING SITE, designated SEQ ID:35907, to the nucleotide sequence of VGAM1696 RNA, herein designated VGAM RNA, also designated SEQ ID:4407.

Another function of VGAM1696 is therefore inhibition of LOC58489 (Accession XM_051862). Accordingly, utilities of VGAM1696 include diagnosis, prevention and treatment of diseases and clinical conditions associated with LOC58489. FIG. 1 further provides a conceptual description of a novel bioinformatically detected viral gene of the present invention, referred to here as Viral Genomic Address Messenger 1697 (VGAM1697) viral gene, which modulates expression of respective host target genes thereof, the function and utility of which host target genes is known in the art.

VGAM1697 is a novel bioinformatically detected regulatory, non protein coding, viral micro RNA (miRNA) gene.

The method by which VGAM1697 was detected is described hereinabove with reference to FIGS. 1-8.

VGAM1697 gene, herein designated VGAM GENE, is a viral gene contained in the genome of Ectocarpus Siliculosus Virus. VGAM1697 host target gene, herein designated VGAM HOST TARGET GENE, is a human gene contained in the human genome.

VGAM1697 gene encodes a VGAM1697 precursor RNA, herein designated VGAM PRECURSOR RNA. Similar to other miRNA genes, and unlike most ordinary genes, VGAM1697 precursor RNA does not encode a protein. A nucleotide sequence identical or highly similar to the nucleotide sequence of VGAM1697 precursor RNA is designated SEQ ID:1683, and is provided hereinbelow with reference to the sequence listing part. Nucleotide sequence SEQ ID:1683 is located at position 50957 relative to the genome of Ectocarpus Siliculosus Virus.

VGAM1697 precursor RNA folds onto itself, forming VGAM1697 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1697 folded precursor RNA into VGAM1697 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1697 RNA is designated SEQ ID:4408, and is provided hereinbelow with reference to the sequence listing part.

VGAM1697 host target gene, herein designated VGAM HOST TARGET GENE, encodes a corresponding messenger RNA, VGAM1697 host target RNA, herein designated VGAM HOST TARGET RNA. VGAM1697 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1697 RNA, herein designated VGAM RNA, binds complementarily to one or more host target binding sites located in untranslated regions of VGAM1697 host target RNA, herein designated VGAM HOST TARGET RNA. This complementary binding is due to the fact that the nucleotide sequence of VGAM1697 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1697 RNA, herein designated VGAM RNA, may have a different number of host target binding sites in untranslated regions of a VGAM1697 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1697 RNA, herein designated VGAM RNA, to host target binding sites on VGAM1697 host target RNA, herein designated VGAM HOST TARGET RNA, such as BINDING SITE I, BINDING SITE II and BINDING SITE III, inhibits translation of VGAM1697 host target RNA into VGAM1697 host target protein, herein designated VGAM HOST TARGET PROTEIN. VGAM host target protein is therefore outlined by a broken line.

It is appreciated that VGAM1697 host target gene, herein designated VGAM HOST TARGET GENE, in fact represents a plurality of VGAM1697 host target genes. The mRNA of each one of this plurality of VGAM1697 host target genes comprises one or more host target binding sites, each having a nucleotide sequence which is at least partly complementary to VGAM1697 RNA, herein designated VGAM RNA, and which when bound by VGAM1697 RNA causes inhibition of translation of respective one or more VGAM1697 host target proteins.

It is further appreciated by one skilled in the art that the mode of translational inhibition illustrated by FIG. 1 with specific reference to translational inhibition exerted by VGAM1697 gene, herein designated VGAM GENE, on one or more VGAM1697 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1697 is inhibition of expression of host target genes, as part of a novel viral mechanism of attacking a host. Accordingly, utilities of VGAM1697 include diagnosis, prevention and treatment of viral infection by Ectocarpus Siliculosus Virus. Specific functions, and accordingly utilities, of VGAM1697 correlate with, and may be deduced from, the identity of the host target genes which VGAM1697 binds and inhibits, and the function of these host target genes, as elaborated hereinbelow.

Nucleotide sequences of the VGAM1697 precursor RNA, herein designated VGAM PRECURSOR RNA, and of the 'diced' VGAM1697 RNA, herein designated VGAM RNA, and a schematic representation of the secondary folding of VGAM1697 folded precursor RNA, herein designated VGAM FOLDED PRECURSOR RNA, of VGAM1697 are further described hereinbelow with reference to Table 1.

Nucleotide sequences of host target binding sites, such as BINDING SITE-I, BINDING SITE-II and BINDING SITE-III of FIG. 1, found on VGAM1697 host target RNA, and schematic representation of the complementarity of each of these host target binding sites to VGAM1697 RNA, herein designated VGAM RNA, are described hereinbelow with reference to Table 2.

As mentioned hereinabove with reference to FIG. 1, a function of VGAM1697 gene, herein designated VGAM is inhibition of expression of VGAM1697 target genes. It is appreciated that specific functions, and accordingly utilities, of VGAM1697 correlate with, and may be deduced from, the identity of the target genes which VGAM1697 binds and inhibits, and the function of these target genes, as elaborated hereinbelow.

Inositol Polyphosphate-5-phosphatase, 145 kDa (INPP5D, Accession XM_096169) is a VGAM1697 host target gene. INPP5D BINDING SITE is HOST TARGET binding site found in the 3' untranslated region of mRNA encoded by INPP5D, corresponding to a HOST TARGET binding site such as BINDING SITE I, BINDING SITE II or BINDING SITE III. Table 2 illustrates the complementarity of the nucleotide sequences of INPP5D BINDING SITE, designated SEQ ID:40302, to the nucleotide sequence of VGAM1697 RNA, herein designated VGAM RNA, also designated SEQ ID:4408.

A function of VGAM1697 is therefore inhibition of Inositol Polyphosphate-5-phosphatase, 145 kDa (INPP5D, Accession XM_096169), a gene which hydrolyzes Ins (1,3,4,5)P4 and PtdIns (3,4,5)P3; contains an SH2-domain. Accordingly, utilities of VGAM1697 include diagnosis, prevention and treatment of diseases and clinical conditions associated with INPP5D. The function of INPP5D and its association with various diseases and clinical conditions, has been established by previous studies, as described hereinabove with reference to VGAM64. FIG. 1 further provides a conceptual description of a novel bioinformatically detected viral gene of the present invention, referred to here as Viral Genomic Address Messenger 1698 (VGAM1698) viral gene, which modulates expression of respective host target genes thereof, the function and utility of which host target genes is known in the art.

VGAM1698 is a novel bioinformatically detected regulatory, non protein coding, viral micro RNA (miRNA) gene. The method by which VGAM1698 was detected is described hereinabove with reference to FIGS. 1-8.

VGAM1698 gene, herein designated VGAM GENE, is a viral gene contained in the genome of Ectocarpus Siliculosus Virus. VGAM1698 host target gene, herein designated VGAM HOST TARGET GENE, is a human gene contained in the human genome.

VGAM1698 gene encodes a VGAM1698 precursor RNA, herein designated VGAM PRECURSOR RNA. Similar to other miRNA genes, and unlike most ordinary genes, VGAM1698 precursor RNA does not encode a protein. A nucleotide sequence identical or highly similar to the nucleotide sequence of VGAM1698 precursor RNA is designated SEQ ID:1684, and is provided hereinbelow with reference to the sequence listing part. Nucleotide sequence SEQ ID:1684 is located at position 52499 relative to the genome of Ectocarpus Siliculosus Virus.

VGAM1698 precursor RNA folds onto itself, forming VGAM1698 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1698 folded precursor RNA into VGAM1698 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1698 RNA is designated SEQ ID:4409, and is provided hereinbelow with reference to the sequence listing part.

VGAM1698 host target gene, herein designated VGAM HOST TARGET GENE, encodes a corresponding messenger RNA, VGAM1698 host target RNA, herein designated VGAM HOST TARGET RNA. VGAM1698 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1698 RNA, herein designated VGAM RNA, binds complementarily to one or more host target binding sites located in untranslated regions of VGAM1698 host target RNA, herein designated VGAM HOST TARGET RNA. This complementary binding is due to the fact that the nucleotide sequence of VGAM1698 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1698 RNA, herein designated VGAM RNA, may have a different number of host target binding sites in untranslated regions of a VGAM1698 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1698 RNA, herein designated VGAM RNA, to host target binding sites on VGAM1698 host target RNA, herein designated VGAM HOST TARGET RNA, such as BINDING SITE I, BINDING SITE II and BINDING SITE III, inhibits translation of VGAM1698 host target RNA into VGAM1698 host target protein, herein designated VGAM HOST TARGET PROTEIN. VGAM host target protein is therefore outlined by a broken line.

It is appreciated that VGAM1698 host target gene, herein designated VGAM HOST TARGET GENE, in fact represents a plurality of VGAM1698 host target genes. The mRNA of each one of this plurality of VGAM1698 host target genes comprises one or more host target binding sites, each having a nucleotide sequence which is at least partly complementary to VGAM1698 RNA, herein designated VGAM RNA, and which when bound by VGAM1698 RNA causes inhibition of translation of respective one or more VGAM1698 host target proteins.

It is further appreciated by one skilled in the art that the mode of translational inhibition illustrated by FIG. 1 with specific reference to translational inhibition exerted by VGAM1698 gene, herein designated VGAM GENE, on one or more VGAM1698 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1698 is inhibition of expression of host target genes, as part of a novel viral mechanism of attacking a host. Accordingly, utilities of VGAM1698 include diagnosis, prevention and treatment of viral infection by Ectocarpus Siliculosus Virus. Specific functions, and accordingly utilities, of VGAM1698 correlate with, and may be deduced from, the identity of the host target genes which VGAM1698 binds and inhibits, and the function of these host target genes, as elaborated hereinbelow.

Nucleotide sequences of the VGAM1698 precursor RNA, herein designated VGAM PRECURSOR RNA, and of the 'diced' VGAM1698 RNA, herein designated VGAM RNA, and a schematic representation of the secondary folding of VGAM1698 folded precursor RNA, herein designated VGAM FOLDED PRECURSOR RNA, of VGAM1698 are further described hereinbelow with reference to Table 1.

Nucleotide sequences of host target binding sites, such as BINDING SITE-I, BINDING SITE-II and BINDING SITE-III of FIG. 1, found on VGAM1698 host target RNA, and schematic representation of the complementarity of each of these host target binding sites to VGAM1698 RNA, herein designated VGAM RNA, are described hereinbelow with reference to Table 2.

As mentioned hereinabove with reference to FIG. 1, a function of VGAM1698 gene, herein designated VGAM is inhibition of expression of VGAM1698 target genes. It is appreciated that specific functions, and accordingly utilities, of VGAM1698 correlate with, and may be deduced from, the identity of the target genes which VGAM1698 binds and inhibits, and the function of these target genes, as elaborated hereinbelow.

KIAA1126 (Accession XM_050325) is a VGAM1698 host target gene. KIAA1126 BINDING SITE is HOST TARGET binding site found in the 3' untranslated region of mRNA encoded by KIAA1126, corresponding to a HOST TARGET binding site such as BINDING SITE I, BINDING SITE II or BINDING SITE III. Table 2 illustrates the complementarity of the nucleotide sequences of KIAA1126 BINDING SITE, designated SEQ ID:35605, to the nucleotide sequence of VGAM1698 RNA, herein designated VGAM RNA, also designated SEQ ID:4409.

A function of VGAM1698 is therefore inhibition of KIAA1126 (Accession XM_050325). Accordingly, utilities of VGAM1698 include diagnosis, prevention and treatment of diseases and clinical conditions associated with KIAA1126. FIG. 1 further provides a conceptual description of a novel bioinformatically detected viral gene of the present invention, referred to here as Viral Genomic Address Messenger 1699 (VGAM1699) viral gene, which modulates expression of respective host target genes thereof, the function and utility of which host target genes is known in the art.

VGAM1699 is a novel bioinformatically detected regulatory, non protein coding, viral micro RNA (miRNA) gene. The method by which VGAM1699 was detected is described hereinabove with reference to FIGS. 1-8.

VGAM1699 gene, herein designated VGAM GENE, is a viral gene contained in the genome of Ectocarpus Siliculosus Virus. VGAM1699 host target gene, herein designated VGAM HOST TARGET GENE, is a human gene contained in the human genome.

VGAM1699 gene encodes a VGAM1699 precursor RNA, herein designated VGAM PRECURSOR RNA. Similar to other miRNA genes, and unlike most ordinary genes, VGAM1699 precursor RNA does not encode a protein. A nucleotide sequence identical or highly similar to the nucleotide sequence of VGAM1699 precursor RNA is designated SEQ ID:1685, and is provided hereinbelow with reference to the sequence listing part. Nucleotide sequence SEQ ID:1685 is located at position 53142 relative to the genome of Ectocarpus Siliculosus Virus.

VGAM1699 precursor RNA folds onto itself, forming VGAM1699 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1699 folded precursor RNA into VGAM1699 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1699 RNA is designated SEQ ID:4410, and is provided hereinbelow with reference to the sequence listing part.

VGAM1699 host target gene, herein designated VGAM HOST TARGET GENE, encodes a corresponding messenger RNA, VGAM1699 host target RNA, herein designated VGAM HOST TARGET RNA. VGAM1699 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1699 RNA, herein designated VGAM RNA, binds complementarily to one or more host target binding sites located in untranslated regions of VGAM1699 host target RNA, herein designated VGAM HOST TARGET RNA. This complementary binding is due to the fact that the nucleotide sequence of VGAM1699 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1699 RNA, herein designated VGAM RNA, may have a different number of host target binding sites in untranslated regions of a VGAM1699 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1699 RNA, herein designated VGAM RNA, to host target binding sites on VGAM1699 host target RNA, herein designated VGAM HOST TARGET RNA, such as BINDING SITE I, BINDING SITE II and BINDING SITE III, inhibits translation of VGAM1699 host target RNA into VGAM1699 host target protein, herein designated VGAM HOST TARGET PROTEIN. VGAM host target protein is therefore outlined by a broken line.

It is appreciated that VGAM1699 host target gene, herein designated VGAM HOST TARGET GENE, in fact represents a plurality of VGAM1699 host target genes. The mRNA of each one of this plurality of VGAM1699 host target genes comprises one or more host target binding sites, each having a nucleotide sequence which is at least partly complementary to VGAM1699 RNA, herein designated VGAM RNA, and which when bound by VGAM1699 RNA causes inhibition of translation of respective one or more VGAM1699 host target proteins.

It is further appreciated by one skilled in the art that the mode of translational inhibition illustrated by FIG. 1 with specific reference to translational inhibition exerted by VGAM1699 gene, herein designated VGAM GENE, on one or more VGAM1699 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1699 is inhibition of expression of host target genes, as part of a novel viral mechanism of attacking a host. Accordingly, utilities of VGAM1699 include diagnosis, prevention and treatment of viral infection by Ectocarpus Siliculosus Virus. Specific functions, and accordingly utilities, of VGAM1699 correlate with, and may be deduced from, the identity of the host target genes which VGAM1699 binds and inhibits, and the function of these host target genes, as elaborated hereinbelow.

Nucleotide sequences of the VGAM1699 precursor RNA, herein designated VGAM PRECURSOR RNA, and of the 'diced' VGAM1699 RNA, herein designated VGAM RNA, and a schematic representation of the secondary folding of VGAM1699 folded precursor RNA, herein designated VGAM FOLDED PRECURSOR RNA, of VGAM1699 are further described hereinbelow with reference to Table 1.

Nucleotide sequences of host target binding sites, such as BINDING SITE-I, BINDING SITE-II and BINDING SITE-III of FIG. 1, found on VGAM1699 host target RNA, and schematic representation of the complementarity of each of these host target binding sites to VGAM1699 RNA, herein designated VGAM RNA, are described hereinbelow with reference to Table 2.

As mentioned hereinabove with reference to FIG. 1, a function of VGAM1699 gene, herein designated VGAM is inhibition of expression of VGAM1699 target genes. It is appreciated that specific functions, and accordingly utilities, of VGAM1699 correlate with, and may be deduced from, the identity of the target genes which VGAM1699 binds and inhibits, and the function of these target genes, as elaborated hereinbelow.

Hippocalcin-like 1 (HPCAL1, Accession NM_002149) is a VGAM1699 host target gene. HPCAL1 BINDING SITE1 and HPCAL1 BINDING SITE2 are HOST TARGET binding sites found in untranslated regions of mRNA encoded by HPCAL1, corresponding to HOST TARGET binding sites such as BINDING SITE I, BINDING SITE II or BINDING SITE III. Table 2 illustrates the complementarity of the nucleotide sequences of HPCAL1 BINDING SITE1 and HPCAL1 BINDING SITE2, designated SEQ ID:7926 and SEQ ID:28633 respectively, to the nucleotide sequence of VGAM1699 RNA, herein designated VGAM RNA, also designated SEQ ID:4410.

A function of VGAM1699 is therefore inhibition of Hippocalcin-like 1 (HPCAL1, Accession NM_002149). Accordingly, utilities of VGAM1699 include diagnosis, prevention and treatment of diseases and clinical conditions associated with HPCAL1. FLJ11712 (Accession NM_024570) is another VGAM1699 host target gene. FLJ11712 BINDING SITE is HOST TARGET binding site found in the 5' untranslated region of mRNA encoded by FLJ11712, corresponding to a HOST TARGET binding site such as BINDING SITE I, BINDING SITE II or BINDING SITE III. Table 2 illustrates the complementarity of the nucleotide sequences of FLJ11712 BINDING SITE, designated SEQ ID:23795, to the nucleotide sequence of VGAM1699 RNA, herein designated VGAM RNA, also designated SEQ ID:4410.

Another function of VGAM1699 is therefore inhibition of FLJ11712 (Accession NM_024570). Accordingly, utilities of VGAM1699 include diagnosis, prevention and treatment of diseases and clinical conditions associated with FLJ11712.

FIG. 1 further provides a conceptual description of a novel bioinformatically detected viral gene of the present invention, referred to here as Viral Genomic Address Messenger 1700 (VGAM1700) viral gene, which modulates expression of respective host target genes thereof, the function and utility of which host target genes is known in the art.

VGAM1700 is a novel bioinformatically detected regulatory, non protein coding, viral micro RNA (miRNA) gene. The method by which VGAM1700 was detected is described hereinabove with reference to FIGS. 1-8.

VGAM1700 gene, herein designated VGAM GENE, is a viral gene contained in the genome of Ectocarpus Siliculosus Virus. VGAM1700 host target gene, herein designated VGAM HOST TARGET GENE, is a human gene contained in the human genome.

VGAM1700 gene encodes a VGAM1700 precursor RNA, herein designated VGAM PRECURSOR RNA. Similar to other miRNA genes, and unlike most ordinary genes, VGAM1700 precursor RNA does not encode a protein. A nucleotide sequence identical or highly similar to the nucleotide sequence of VGAM1700 precursor RNA is designated SEQ ID:1686, and is provided hereinbelow with reference to the sequence listing part. Nucleotide sequence SEQ ID:1686 is located at position 54256 relative to the genome of Ectocarpus Siliculosus Virus.

VGAM1700 precursor RNA folds onto itself, forming VGAM1700 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1700 folded precursor RNA into VGAM1700 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM1700 RNA is designated SEQ ID:4411, and is provided hereinbelow with reference to the sequence listing part.

VGAM1700 host target gene, herein designated VGAM HOST TARGET GENE, encodes a corresponding messenger RNA, VGAM1700 host target RNA, herein designated VGAM HOST TARGET RNA. VGAM1700 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1700 RNA, herein designated VGAM RNA, binds complementarily to one or more host target binding sites located in untranslated regions of VGAM1700 host target RNA, herein designated VGAM HOST TARGET RNA. This complementary binding is due to the fact that the nucleotide sequence of VGAM1700 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1700 RNA, herein designated VGAM RNA, may have a different number of host target binding sites in untranslated regions of a VGAM1700 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1700 RNA, herein designated VGAM RNA, to host target binding sites on VGAM1700 host target RNA, herein designated VGAM HOST TARGET RNA, such as BINDING SITE I, BINDING SITE II and BINDING SITE III, inhibits translation of VGAM1700 host target RNA into VGAM1700 host target protein, herein designated VGAM HOST TARGET PROTEIN. VGAM host target protein is therefore outlined by a broken line.

It is appreciated that VGAM1700 host target gene, herein designated VGAM HOST TARGET GENE, in fact represents a plurality of VGAM1700 host target genes. The mRNA of each one of this plurality of VGAM1700 host target genes comprises one or more host target binding sites, each having a nucleotide sequence which is at least partly complementary to VGAM1700 RNA, herein designated VGAM RNA, and which when bound by VGAM1700 RNA causes inhibition of translation of respective one or more VGAM1700 host target proteins.

It is further appreciated by one skilled in the art that the mode of translational inhibition illustrated by FIG. 1 with specific reference to translational inhibition exerted by VGAM1700 gene, herein designated VGAM GENE, on one or more VGAM1700 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1700 is inhibition of expression of host target genes, as part of a novel viral mechanism of attacking a host. Accordingly, utilities of VGAM1700 include diagnosis, prevention and treatment of viral infection by Ectocarpus Siliculosus Virus. Specific functions, and accordingly utilities, of VGAM1700 correlate with, and may be deduced from, the identity of the host target genes which VGAM1700 binds and inhibits, and the function of these host target genes, as elaborated hereinbelow.

Nucleotide sequences of the VGAM1700 precursor RNA, herein designated VGAM PRECURSOR RNA, and of the 'diced' VGAM1700 RNA, herein designated VGAM RNA, and a schematic representation of the secondary folding of VGAM1700 folded precursor RNA, herein designated VGAM FOLDED PRECURSOR RNA, of VGAM1700 are further described hereinbelow with reference to Table 1.

Nucleotide sequences of host target binding sites, such as BINDING SITE-I, BINDING SITE-II and BINDING SITE-III of FIG. 1, found on VGAM1700 host target RNA, and schematic representation of the complementarity of each of these host target binding sites to VGAM1700 RNA, herein designated VGAM RNA, are described hereinbelow with reference to Table 2.

As mentioned hereinabove with reference to FIG. 1, a function of VGAM1700 gene, herein designated VGAM is inhibition of expression of VGAM1700 target genes. It is appreciated that specific functions, and accordingly utilities, of VGAM1700 correlate with, and may be deduced from, the identity of the target genes which VGAM1700 binds and inhibits, and the function of these target genes, as elaborated hereinbelow.

RAD52 Homolog (S. cerevisiae) (RAD52, Accession NM_134422) is a VGAM1700 host target gene. RAD52 BINDING SITE1 through RAD52 BINDING SITE3 are HOST TARGET binding sites found in untranslated regions of mRNA encoded by RAD52, corresponding to HOST TARGET binding sites such as BINDING SITE I, BINDING SITE II or BINDING SITE III. Table 2 illustrates the complementarity of the nucleotide sequences of RAD52 BINDING SITE1 through RAD52 BINDING SITE3, designated SEQ ID:28640, SEQ ID:28650 and SEQ ID:28659 respectively, to the nucleotide sequence of VGAM1700 RNA, herein designated VGAM RNA, also designated SEQ ID:4411.

A function of VGAM1700 is therefore inhibition of RAD52 Homolog (S. cerevisiae) (RAD52, Accession NM_134422). Accordingly, utilities of VGAM1700 include diagnosis, prevention and treatment of diseases and clinical conditions associated with RAD52. FLJ21106 (Accession NM_025097) is another VGAM1700 host target gene. FLJ21106 BINDING SITE is HOST TARGET binding site found in the 5' untranslated region of mRNA encoded by FLJ21106, corresponding to a HOST TARGET binding site such as BINDING SITE I, BINDING SITE II or BINDING SITE III. Table 2 illustrates the complementarity of the nucleotide sequences of FLJ21106 BINDING SITE, designated SEQ ID:24732, to the nucleotide sequence of VGAM1700 RNA, herein designated VGAM RNA, also designated SEQ ID:4411.

Another function of VGAM1700 is therefore inhibition of FLJ21106 (Accession NM_025097). Accordingly, utilities of VGAM1700 include diagnosis, prevention and treatment of diseases and clinical conditions associated with FLJ21106. KIAA0429 (Accession NM_014751) is another VGAM1700 host target gene. KIAA0429 BINDING SITE is HOST TARGET binding site found in the 3' untranslated region of mRNA encoded by KIAA0429, corresponding to a HOST TARGET binding site such as BINDING SITE I, BINDING SITE II or BINDING SITE III. Table 2 illustrates the complementarity of the nucleotide sequences of KIAA0429 BINDING SITE, designated SEQ ID:16462, to the nucleotide sequence of VGAM1700 RNA, herein designated VGAM RNA, also designated SEQ ID:4411.

Another function of VGAM1700 is therefore inhibition of KIAA0429 (Accession NM_014751). Accordingly, utilities of VGAM1700 include diagnosis, prevention and treatment of diseases and clinical conditions associated with KIAA0429. PORIMIN (Accession NM_052932) is another VGAM1700 host target gene. PORIMIN BINDING SITE is HOST TARGET binding site found in the 3' untranslated region of mRNA encoded by PORIMIN, corresponding to a HOST TARGET binding site such as BINDING SITE I, BINDING SITE II or BINDING SITE III. Table 2 illustrates the complementarity of the nucleotide sequences of PORIMIN BINDING SITE, designated SEQ ID:27489, to the nucleotide sequence of VGAM1700 RNA, herein designated VGAM RNA, also designated SEQ ID:4411.

Another function of VGAM1700 is therefore inhibition of PORIMIN (Accession NM_052932). Accordingly, utilities of VGAM1700 include diagnosis, prevention and treatment of diseases and clinical conditions associated with PORIMIN. FIG. 1 further provides a conceptual description of a novel bioinformatically detected viral gene of the present invention, referred to here as Viral Genomic Address Messenger 1701 (VGAM1701) viral gene, which modulates expression of respective host target genes thereof, the function and utility of which host target genes is known in the art.

VGAM1701 is a novel bioinformatically detected regulatory, non protein coding, viral micro RNA (miRNA) gene. The method by which VGAM1701 was detected is described hereinabove with reference to FIGS. 1-8.

VGAM1701 gene, herein designated VGAM GENE, is a viral gene contained in the genome of Ectocarpus Siliculosus Virus. VGAM1701 host target gene, herein designated VGAM HOST TARGET GENE, is a human gene contained in the human genome.

VGAM1701 gene encodes a VGAM1701 precursor RNA, herein designated VGAM PRECURSOR RNA. Similar to other miRNA genes, and unlike most ordinary genes, VGAM1701 precursor RNA does not encode a protein. A nucleotide sequence identical or highly similar to the nucleotide sequence of VGAM1701 precursor RNA is designated SEQ ID:1687, and is provided hereinbelow with reference to the sequence listing part. Nucleotide sequence SEQ ID:1687 is located at position 53594 relative to the genome of Ectocarpus Siliculosus Virus.

VGAM1701 precursor RNA folds onto itself, forming VGAM1701 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1701 folded precursor RNA into VGAM1701 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1701 RNA is designated SEQ ID:4412, and is provided hereinbelow with reference to the sequence listing part.

VGAM1701 host target gene, herein designated VGAM HOST TARGET GENE, encodes a corresponding messenger RNA, VGAM1701 host target RNA, herein designated VGAM HOST TARGET RNA. VGAM1701 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1701 RNA, herein designated VGAM RNA, binds complementarily to one or more host target binding sites located in untranslated regions of VGAM1701 host target RNA, herein designated VGAM HOST TARGET RNA. This complementary binding is due to the fact that the nucleotide sequence of VGAM1701 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1701 RNA, herein designated VGAM RNA, may have a different number of host target binding sites in untranslated regions of a VGAM1701 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1701 RNA, herein designated VGAM RNA, to host target binding sites on VGAM1701 host target RNA, herein designated VGAM HOST TARGET RNA, such as BINDING SITE I, BINDING SITE II and BINDING SITE III, inhibits translation of VGAM1701 host target RNA into VGAM1701 host target protein, herein designated VGAM HOST TARGET PROTEIN. VGAM host target protein is therefore outlined by a broken line.

It is appreciated that VGAM1701 host target gene, herein designated VGAM HOST TARGET GENE, in fact represents a plurality of VGAM1701 host target genes. The mRNA of each one of this plurality of VGAM1701 host target genes comprises one or more host target binding sites, each having a nucleotide sequence which is at least partly complementary to VGAM1701 RNA, herein designated VGAM RNA, and which when bound by VGAM1701 RNA causes inhibition of translation of respective one or more VGAM1701 host target proteins.

It is further appreciated by one skilled in the art that the mode of translational inhibition illustrated by FIG. 1 with specific reference to translational inhibition exerted by VGAM1701 gene, herein designated VGAM GENE, on one or more VGAM1701 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1701 is inhibition of expression of host target genes, as part of a novel viral mechanism of attacking a host. Accordingly, utilities of VGAM1701 include diagnosis, prevention and treatment of viral infection by Ectocarpus Siliculosus Virus. Specific functions, and accordingly utilities, of VGAM1701 correlate with, and may be deduced from, the identity of the host target genes which VGAM1701 binds and inhibits, and the function of these host target genes, as elaborated hereinbelow.

Nucleotide sequences of the VGAM1701 precursor RNA, herein designated VGAM PRECURSOR RNA, and of the 'diced' VGAM1701 RNA, herein designated VGAM RNA, and a schematic representation of the secondary folding of VGAM1701 folded precursor RNA, herein designated VGAM FOLDED PRECURSOR RNA, of VGAM1701 are further described hereinbelow with reference to Table 1.

Nucleotide sequences of host target binding sites, such as BINDING SITE-I, BINDING SITE-II and BINDING SITE-III of FIG. 1, found on VGAM1701 host target RNA, and schematic representation of the complementarity of each of these host target binding sites to VGAM1701 RNA, herein designated VGAM RNA, are described hereinbelow with reference to Table 2.

As mentioned hereinabove with reference to FIG. 1, a function of VGAM1701 gene, herein designated VGAM is inhibition of expression of VGAM1701 target genes. It is appreciated that specific functions, and accordingly utilities, of VGAM1701 correlate with, and may be deduced from, the identity of the target genes which VGAM1701 binds and inhibits, and the function of these target genes, as elaborated hereinbelow.

ALEX2 (Accession NM_014782) is a VGAM1701 host target gene. ALEX2 BINDING SITE is HOST TARGET binding site found in the 5' untranslated region of mRNA encoded by ALEX2, corresponding to a HOST TARGET binding site such as BINDING SITE I, BINDING SITE II or BINDING SITE III. Table 2 illustrates the complementarity of the nucleotide sequences of ALEX2 BINDING SITE, designated SEQ ID:16635, to the nucleotide sequence of VGAM1701 RNA, herein designated VGAM RNA, also designated SEQ ID:4412.

A function of VGAM1701 is therefore inhibition of ALEX2 (Accession NM_014782), a gene which play a role in tumor suppression, possibly by being involved in the regulation of normal cell growth. Accordingly, utilities of VGAM1701 include diagnosis, prevention and treatment of diseases and clinical conditions associated with ALEX2. The function of ALEX2 and its association with various diseases and clinical conditions, has been established by previous studies, as described hereinabove with reference to VGAM1449. DEAD/H (Asp-Glu-Ala-Asp/His) Box Polypeptide, Y Chromosome (DBY, Accession NM_004660) is another VGAM1701 host target gene. DBY BINDING SITE is HOST TARGET binding site found in the 3' untranslated region of mRNA encoded by DBY, corresponding to a HOST TARGET binding site such as BINDING SITE I, BINDING SITE II or BINDING SITE III. Table 2 illustrates the complementarity of the nucleotide sequences of DBY BINDING SITE, designated SEQ ID:11027, to the nucleotide sequence of VGAM1701 RNA, herein designated VGAM RNA, also designated SEQ ID:4412.

Another function of VGAM1701 is therefore inhibition of DEAD/H (Asp-Glu-Ala-Asp/His) Box Polypeptide, Y Chromosome (DBY, Accession NM_004660), a gene which plays a key role in the spermatogenic process. Accordingly, utilities of VGAM1701 include diagnosis, prevention and treatment of diseases and clinical conditions associated with DBY. The function of DBY and its association with various diseases and clinical conditions, has been established by previous studies, as described hereinabove with reference to VGAM374. Inositol 1,4,5-triphosphate Receptor, Type 3 (ITPR3, Accession NM_002224) is another VGAM1701 host target gene. ITPR3 BINDING SITE is HOST TARGET binding site found in the 3' untranslated region of mRNA encoded by ITPR3, corresponding to a HOST TARGET binding site such as BINDING SITE I, BINDING SITE II or BINDING SITE III. Table 2 illustrates the complementarity of the nucleotide sequences of ITPR3 BINDING SITE, designated SEQ ID:8000, to the nucleotide sequence of VGAM1701 RNA, herein designated VGAM RNA, also designated SEQ ID:4412.

Another function of VGAM1701 is therefore inhibition of Inositol 1,4,5-triphosphate Receptor, Type 3 (ITPR3, Accession NM_002224), a gene which may be responsible for calcium release from intracellular stores. Accordingly, utilities of VGAM1701 include diagnosis, prevention and treatment of diseases and clinical conditions associated with ITPR3. The function of ITPR3 and its association with various diseases and clinical conditions, has been established by previous studies, as described hereinabove with reference to VGAM310. Ubiquitination Factor E4A (UFD2 homolog, yeast) (UBE4A, Accession NM_004788) is another VGAM1701 host target gene. UBE4A BINDING SITE is HOST TARGET binding site found in the 3' untranslated region of mRNA encoded by UBE4A, corresponding to a HOST TARGET binding site such as BINDING SITE I, BINDING SITE II or BINDING SITE III. Table 2 illustrates the complementarity of the nucleotide sequences of UBE4A BINDING SITE, designated SEQ ID:11198, to the nucleotide sequence of VGAM1701 RNA, herein designated VGAM RNA, also designated SEQ ID:4412.

Another function of VGAM1701 is therefore inhibition of Ubiquitination Factor E4A (UFD2 homolog, yeast) (UBE4A, Accession NM_004788), a gene which binds to the ubiquitin moieties of preformed conjugates and catalyzes ubiquitin chain assembly in conjunction with E1, E2, and E3. Accordingly, utilities of VGAM1701 include diagnosis, prevention and treatment of diseases and clinical conditions associated with UBE4A. The function of UBE4A and its association with various diseases and clinical conditions, has been established by previous studies, as described hereinabove with reference to VGAM60. BTB (POZ) Domain Containing 3 (BTBD3, Accession NM_014962) is another VGAM1701 host target gene. BTBD3 BINDING SITE is HOST TARGET binding site found in the 5' untranslated region of mRNA encoded by BTBD3, corresponding to a HOST TARGET binding site such as BINDING SITE I, BINDING SITE II or BINDING SITE III. Table 2 illustrates the complementarity of the nucleotide sequences of BTBD3 BINDING SITE, designated SEQ ID:17339, to the nucleotide sequence of VGAM1701 RNA, herein designated VGAM RNA, also designated SEQ ID:4412.

Another function of VGAM1701 is therefore inhibition of BTB (POZ) Domain Containing 3 (BTBD3, Accession NM_014962). Accordingly, utilities of VGAM1701 include diagnosis, prevention and treatment of diseases and clinical conditions associated with BTBD3. Calcium/calmodulin-dependent Protein Kinase Kinase 1, Alpha (CAMKK1, Accession NM_032294) is another VGAM1701 host target gene. CAMKK1 BINDING SITE is HOST TARGET binding site found in the 3' untranslated region of mRNA encoded by CAMKK1, corresponding to a HOST TARGET binding site such as BINDING SITE I, BINDING SITE II or BINDING SITE III. Table 2 illustrates the complementarity of the nucleotide sequences of CAMKK1 BINDING SITE, designated SEQ ID:26066, to the nucleotide sequence of VGAM1701 RNA, herein designated VGAM RNA, also designated SEQ ID:4412.

Another function of VGAM1701 is therefore inhibition of Calcium/calmodulin-dependent Protein Kinase Kinase 1, Alpha (CAMKK1, Accession NM_032294). Accordingly, utilities of VGAM1701 include diagnosis, prevention and treatment of diseases and clinical conditions associated with CAMKK1. DKFZp434C0923 (Accession NM_017598) is another VGAM1701 host target gene. DKFZp434C0923 BINDING SITE is HOST TARGET binding site found in the 3' untranslated region of mRNA encoded by DKFZp434C0923, corresponding to a HOST TARGET binding site such as BINDING SITE I, BINDING SITE II or BINDING SITE III. Table 2 illustrates the complementarity of the nucleotide sequences of DKFZp434C0923 BINDING SITE, designated SEQ ID:19065, to the nucleotide sequence of VGAM1701 RNA, herein designated VGAM RNA, also designated SEQ ID:4412.

Another function of VGAM1701 is therefore inhibition of DKFZp434C0923 (Accession NM_017598). Accordingly, utilities of VGAM1701 include diagnosis, prevention and treatment of diseases and clinical conditions associated with DKFZp434C0923. FLJ10292 (Accession NM_018048) is another VGAM1701 host target gene. FLJ10292 BINDING SITE is HOST TARGET binding site found in the 3' untranslated region of mRNA encoded by FLJ10292, corresponding to a HOST TARGET binding site such as BINDING SITE I, BINDING SITE II or BINDING SITE III. Table 2 illustrates the complementarity of the nucleotide sequences of FLJ10292 BINDING SITE, designated SEQ ID:19802, to the nucleotide sequence of VGAM1701 RNA, herein designated VGAM RNA, also designated SEQ ID:4412.

Another function of VGAM1701 is therefore inhibition of FLJ10292 (Accession NM_018048). Accordingly, utilities of VGAM1701 include diagnosis, prevention and treatment of diseases and clinical conditions associated with FLJ10292. FLJ11730 (Accession NM_022756) is another VGAM1701 host target gene. FLJ11730 BINDING SITE is HOST TARGET binding site found in the 3' untranslated region of mRNA encoded by FLJ11730, corresponding to a HOST TARGET binding site such as BINDING SITE I, BINDING SITE II or BINDING SITE III. Table 2 illustrates the complementarity of the nucleotide sequences of FLJ11730 BINDING SITE, designated SEQ ID:22995, to the nucleotide sequence of VGAM1701 RNA, herein designated VGAM RNA, also designated SEQ ID:4412.

Another function of VGAM1701 is therefore inhibition of FLJ11730 (Accession NM_022756). Accordingly, utilities of VGAM1701 include diagnosis, prevention and treatment of diseases and clinical conditions associated with FLJ11730. FLJ21432 (Accession NM_024551) is another VGAM1701 host target gene. FLJ21432 BINDING SITE is HOST TARGET binding site found in the 3' untranslated region of mRNA encoded by FLJ21432, corresponding to a HOST TARGET binding site such as BINDING SITE I, BINDING SITE II or BINDING SITE III. Table 2 illustrates the complementarity of the nucleotide sequences of FLJ21432 BINDING SITE, designated SEQ ID:23768, to the nucleotide sequence of VGAM1701 RNA, herein designated VGAM RNA, also designated SEQ ID:4412.

Another function of VGAM1701 is therefore inhibition of FLJ21432 (Accession NM_024551). Accordingly, utilities of VGAM1701 include diagnosis, prevention and treatment of diseases and clinical conditions associated with FLJ21432. KIAA0450 (Accession NM_014638) is another VGAM1701 host target gene. KIAA0450 BINDING SITE is HOST TARGET binding site found in the 3' untranslated region of mRNA encoded by KIAA0450, corresponding to a HOST TARGET binding site such as BINDING SITE I, BINDING SITE II or BINDING SITE III. Table 2 illustrates the complementarity of the nucleotide sequences of KIAA0450 BINDING SITE, designated SEQ ID:16036, to the nucleotide sequence of VGAM1701 RNA, herein designated VGAM RNA, also designated SEQ ID:4412.

Another function of VGAM1701 is therefore inhibition of KIAA0450 (Accession NM_014638). Accordingly, utilities of VGAM1701 include diagnosis, prevention and treatment of diseases and clinical conditions associated with KIAA0450. KIAA0544 (Accession XM_048119) is another VGAM1701 host target gene. KIAA0544 BINDING SITE is HOST TARGET binding site found in the 3' untranslated region of mRNA encoded by KIAA0544, corresponding to a HOST TARGET binding site such as BINDING SITE I, BINDING SITE II or BINDING SITE III. Table 2 illustrates the complementarity of the nucleotide sequences of KIAA0544 BINDING SITE, designated SEQ ID:35116, to the nucleotide sequence of VGAM1701 RNA, herein designated VGAM RNA, also designated SEQ ID:4412.

Another function of VGAM1701 is therefore inhibition of KIAA0544 (Accession XM_048119). Accordingly, utilities of VGAM1701 include diagnosis, prevention and treatment of diseases and clinical conditions associated with KIAA0544. MGC12966 (Accession NM_032706) is another VGAM1701 host target gene. MGC12966 BINDING SITE is HOST TARGET binding site found in the 3' untranslated region of mRNA encoded by MGC12966, corresponding to a HOST TARGET binding site such as BINDING SITE I, BINDING SITE II or BINDING SITE III. Table 2 illustrates the complementarity of the nucleotide sequences of MGC12966 BINDING SITE, designated SEQ ID:26420, to the nucleotide sequence of VGAM1701 RNA, herein designated VGAM RNA, also designated SEQ ID:4412.

Another function of VGAM1701 is therefore inhibition of MGC12966 (Accession NM_032706). Accordingly, utilities of VGAM1701 include diagnosis, prevention and treatment of diseases and clinical conditions associated with MGC12966. Phosphodiesterase 4D Interacting Protein (myomegalin) (PDE4DIP, Accession XM_170929) is another VGAM1701 host target gene. PDE4DIP BINDING SITE is HOST TARGET binding site found in the 3' untranslated region of mRNA encoded by PDE4DIP, corresponding to a HOST TARGET binding site such as BINDING SITE I, BINDING SITE II or BINDING SITE III. Table 2 illustrates the complementarity of the nucleotide sequences of PDE4DIP BINDING SITE, designated SEQ ID:45710, to the nucleotide sequence of VGAM1701 RNA, herein designated VGAM RNA, also designated SEQ ID:4412.

Another function of VGAM1701 is therefore inhibition of Phosphodiesterase 4D Interacting Protein (myomegalin) (PDE4DIP, Accession XM_170929). Accordingly, utilities of VGAM1701 include diagnosis, prevention and treatment of diseases and clinical conditions associated with PDE4DIP. LOC139221 (Accession XM_066558) is another VGAM1701 host target gene. LOC139221 BINDING SITE is HOST TARGET binding site found in the 3' untranslated region of mRNA encoded by LOC139221, corresponding to a HOST TARGET binding site such as BINDING SITE I, BINDING SITE II or BINDING SITE III. Table 2 illustrates the complementarity of the nucleotide sequences of LOC139221 BINDING SITE, designated SEQ ID:37332, to the nucleotide sequence of VGAM1701 RNA, herein designated VGAM RNA, also designated SEQ ID:4412.

Another function of VGAM1701 is therefore inhibition of LOC139221 (Accession XM_066558). Accordingly, utilities of VGAM1701 include diagnosis, prevention and treatment of diseases and clinical conditions associated with LOC139221. LOC146287 (Accession XM_096967) is another VGAM1701 host target gene. LOC146287 BINDING SITE is HOST TARGET binding site found in the 5' untranslated region of mRNA encoded by LOC146287, corresponding to a HOST TARGET binding site such as BIND- ING SITE I, BINDING SITE II or BINDING SITE III. Table 2 illustrates the complementarity of the nucleotide sequences of LOC146287 BINDING SITE, designated SEQ ID:40690, to the nucleotide sequence of VGAM1701 RNA, herein designated VGAM RNA, also designated SEQ ID:4412.

Another function of VGAM1701 is therefore inhibition of LOC146287 (Accession XM_096967). Accordingly, utilities of VGAM1701 include diagnosis, prevention and treatment of diseases and clinical conditions associated with LOC146287. LOC149296 (Accession XM_086481) is another VGAM1701 host target gene. LOC149296 BINDING SITE is HOST TARGET binding site found in the 5' untranslated region of mRNA encoded by LOC149296, corresponding to a HOST TARGET binding site such as BINDING SITE I, BINDING SITE II or BINDING SITE III. Table 2 illustrates the complementarity of the nucleotide sequences of LOC149296 BINDING SITE, designated SEQ ID:38696, to the nucleotide sequence of VGAM1701 RNA, herein designated VGAM RNA, also designated SEQ ID:4412.

Another function of VGAM1701 is therefore inhibition of LOC149296 (Accession XM_086481). Accordingly, utilities of VGAM1701 include diagnosis, prevention and treatment of diseases and clinical conditions associated with LOC149296. LOC253461 (Accession XM_172341) is another VGAM1701 host target gene. LOC253461 BINDING SITE is HOST TARGET binding site found in the 3' untranslated region of mRNA encoded by LOC253461, corresponding to a HOST TARGET binding site such as BINDING SITE I, BINDING SITE II or BINDING SITE III. Table 2 illustrates the complementarity of the nucleotide sequences of LOC253461 BINDING SITE, designated SEQ ID:46072, to the nucleotide sequence of VGAM1701 RNA, herein designated VGAM RNA, also designated SEQ ID:4412.

Another function of VGAM1701 is therefore inhibition of LOC253461 (Accession XM_172341). Accordingly, utilities of VGAM1701 include diagnosis, prevention and treatment of diseases and clinical conditions associated with LOC253461. LOC58489 (Accession XM_051862) is another VGAM1701 host target gene. LOC58489 BINDING SITE is HOST TARGET binding site found in the 3' untranslated region of mRNA encoded by LOC58489, corresponding to a HOST TARGET binding site such as BINDING SITE I, BINDING SITE II or BINDING SITE III. Table 2 illustrates the complementarity of the nucleotide sequences of LOC58489 BINDING SITE, designated SEQ ID:35906, to the nucleotide sequence of VGAM1701 RNA, herein designated VGAM RNA, also designated SEQ ID:4412.

Another function of VGAM1701 is therefore inhibition of LOC58489 (Accession XM_051862). Accordingly, utilities of VGAM1701 include diagnosis, prevention and treatment of diseases and clinical conditions associated with LOC58489. FIG. 1 further provides a conceptual description of a novel bioinformatically detected viral gene of the present invention, referred to here as Viral Genomic Address Messenger 1702 (VGAM1702) viral gene, which modulates expression of respective host target genes thereof, the function and utility of which host target genes is known in the art.

VGAM1702 is a novel bioinformatically detected regulatory, non protein coding, viral micro RNA (miRNA) gene. The method by which VGAM1702 was detected is described hereinabove with reference to FIGS. 1-8.

VGAM1702 gene, herein designated VGAM GENE, is a viral gene contained in the genome of Ectocarpus Siliculosus Virus. VGAM1702 host target gene, herein designated VGAM HOST TARGET GENE, is a human gene contained in the human genome.

VGAM1702 gene encodes a VGAM1702 precursor RNA, herein designated VGAM PRECURSOR RNA. Similar to other miRNA genes, and unlike most ordinary genes, VGAM1702 precursor RNA does not encode a protein. A nucleotide sequence identical or highly similar to the nucleotide sequence of VGAM1702 precursor RNA is designated SEQ ID:1688, and is provided hereinbelow with reference to the sequence listing part. Nucleotide sequence SEQ ID:1688 is located at position 51117 relative to the genome of Ectocarpus Siliculosus Virus.

VGAM1702 precursor RNA folds onto itself, forming VGAM1702 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1702 folded precursor RNA into VGAM1702 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1702 RNA is designated SEQ ID:4413, and is provided hereinbelow with reference to the sequence listing part.

VGAM1702 host target gene, herein designated VGAM HOST TARGET GENE, encodes a corresponding messenger RNA, VGAM1702 host target RNA, herein designated VGAM HOST TARGET RNA. VGAM1702 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1702 RNA, herein designated VGAM RNA, binds complementarily to one or more host target binding sites located in untranslated regions of VGAM1702 host target RNA, herein designated VGAM HOST TARGET RNA. This complementary binding is due to the fact that the nucleotide sequence of VGAM1702 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1702 RNA, herein designated VGAM RNA, may have a different number of host target binding sites in untranslated regions of a VGAM1702 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1702 RNA, herein designated VGAM RNA, to host target binding sites on VGAM1702 host target RNA, herein designated VGAM HOST TARGET RNA, such as BINDING SITE I, BINDING SITE II and BINDING SITE III, inhibits translation of VGAM1702 host target RNA into VGAM1702 host target protein, herein designated VGAM HOST TARGET PRO- TEIN. VGAM host target protein is therefore outlined by a broken line.

It is appreciated that VGAM1702 host target gene, herein designated VGAM HOST TARGET GENE, in fact represents a plurality of VGAM1702 host target genes. The mRNA of each one of this plurality of VGAM1702 host target genes comprises one or more host target binding sites, each having a nucleotide sequence which is at least partly complementary to VGAM1702 RNA, herein designated VGAM RNA, and which when bound by VGAM1702 RNA causes inhibition of translation of respective one or more VGAM1702 host target proteins.

It is further appreciated by one skilled in the art that the mode of translational inhibition illustrated by FIG. 1 with specific reference to translational inhibition exerted by VGAM1702 gene, herein designated VGAM GENE, on one or more VGAM1702 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1702 is inhibition of expression of host target genes, as part of a novel viral mechanism of attacking a host. Accordingly, utilities of VGAM1702 include diagnosis, prevention and treatment of viral infection by Ectocarpus Siliculosus Virus. Specific functions, and accordingly utilities, of VGAM1702 correlate with, and may be deduced from, the identity of the host target genes which VGAM1702 binds and inhibits, and the function of these host target genes, as elaborated hereinbelow.

Nucleotide sequences of the VGAM1702 precursor RNA, herein designated VGAM PRECURSOR RNA, and of the 'diced' VGAM1702 RNA, herein designated VGAM RNA, and a schematic representation of the secondary folding of VGAM1702 folded precursor RNA, herein designated VGAM FOLDED PRECURSOR RNA, of VGAM1702 are further described hereinbelow with reference to Table 1.

Nucleotide sequences of host target binding sites, such as BINDING SITE-I, BINDING SITE-II and BINDING SITE-III of FIG. 1, found on VGAM1702 host target RNA, and schematic representation of the complementarity of each of these host target binding sites to VGAM1702 RNA, herein designated VGAM RNA, are described hereinbelow with reference to Table 2.

As mentioned hereinabove with reference to FIG. 1, a function of VGAM1702 gene, herein designated VGAM is inhibition of expression of VGAM1702 target genes. It is appreciated that specific functions, and accordingly utilities, of VGAM1702 correlate with, and may be deduced from, the identity of the target genes which VGAM1702 binds and inhibits, and the function of these target genes, as elaborated hereinbelow.

ATPase, H+ Transporting, Lysosomal 42 kDa, V1 Subunit C, Isoform 1 (ATP6V1C1, Accession NM_001695) is a VGAM1702 host target gene. ATP6V1C1 BINDING SITE is HOST TARGET binding site found in the 3' untranslated region of mRNA encoded by ATP6V1C1, corresponding to a HOST TARGET binding site such as BINDING SITE I, BINDING SITE II or BINDING SITE III. Table 2 illustrates the complementarity of the nucleotide sequences of ATP6V1C1 BINDING SITE, designated SEQ ID:7416, to the nucleotide sequence of VGAM1702 RNA, herein designated VGAM RNA, also designated SEQ ID:4413.

A function of VGAM1702 is therefore inhibition of ATPase, H+ Transporting, Lysosomal 42 kDa, V1 Subunit C, Isoform 1 (ATP6V1C1, Accession NM_001695), a gene which is necessary for the assembly of the catalytic sector of the enzyme. Accordingly, utilities of VGAM1702 include diagnosis, prevention and treatment of diseases and clinical conditions associated with ATP6V1C1. The function of ATP6V1C1 has been established by previous studies. Van Hille et al. (1993) cloned subunit C from a human osteoclastoma cDNA library with probes developed by PCR from the bovine cDNA sequence (Nelson et al., 1990). The deduced 382-amino acid human ATP6C protein has a calculated molecular mass of 41,941 Da and shows 99% sequence identity with bovine ATP6C. Northern blot analysis detected ubiquitous and comparable expression of a 1.9-kb transcript and a fainter doublet of 6.0-7.0 kb.

Full details of the abovementioned studies are described in the following publications, the disclosure of which are hereby incorporated by reference:

Nelson, H.; Mandiyan, S.; Noumi, T.; Moriyama, Y.; Miedel, M. C.; Nelson, N.: Molecular cloning of cDNA encoding the C subunit of H(+)-ATPase from bovine chromaffin granules. J. Biol. Chem. 265:20390-20393, 1990; and van Hille, B.; Vanek, M.; Richener, H.; Green, J. R.; Bilbe, G.: Cloning and tissue distribution of subunits C, D, and E of the human vacuolar H(+)-ATPase. Biochem. Biophys. Res. Commu.

Further studies establishing the function and utilities of ATP6V1C1 are found in John Hopkins OMIM database record ID 603097, and in sited publications numbered 8661-8662 listed in the bibliography section hereinbelow, which are also hereby incorporated by reference. Protein Kinase C, Nu (PRKCN, Accession NM_005813) is another VGAM1702 host target gene. PRKCN BINDING SITE is HOST TARGET binding site found in the 3' untranslated region of mRNA encoded by PRKCN, corresponding to a HOST TARGET binding site such as BINDING SITE I, BINDING SITE II or BINDING SITE III. Table 2 illustrates the complementarity of the nucleotide sequences of PRKCN BINDING SITE, designated SEQ ID:12401, to the nucleotide sequence of VGAM1702 RNA, herein designated VGAM RNA, also designated SEQ ID:4413.

Another function of VGAM1702 is therefore inhibition of Protein Kinase C, Nu (PRKCN, Accession NM_005813). Accordingly, utilities of VGAM1702 include diagnosis, prevention and treatment of diseases and clinical conditions associated with PRKCN. WAS Protein Family, Member 3 (WASF3, Accession NM_006646) is another VGAM1702 host target gene. WASF3 BINDING SITE is HOST TARGET binding site found in the 3' untranslated region of mRNA encoded by WASF3, corresponding to a HOST TARGET binding site such as BINDING SITE I, BINDING SITE II or BINDING SITE III. Table 2 illustrates the complementarity of the nucleotide sequences of WASF3 BINDING SITE, designated SEQ ID:13444, to the nucleotide sequence of VGAM1702 RNA, herein designated VGAM RNA, also designated SEQ ID:4413.

Another function of VGAM1702 is therefore inhibition of WAS Protein Family, Member 3 (WASF3, Accession NM_006646), a gene which stimulates actin polymerization. Accordingly, utilities of VGAM1702 include diagnosis, prevention and treatment of diseases and clinical conditions associated with WASF3. The function of WASF3 and its association with various diseases and clinical conditions, has been established by previous studies, as described hereinabove with reference to VGAM1692. Calcium/calmodulin-dependent Protein Kinase Kinase 1, Alpha (CAMKK1, Accession NM_032294) is another VGAM1702 host target gene. CAMKK1 BINDING SITE is HOST TARGET binding site found in the 3' untranslated region of mRNA encoded by CAMKK1, corresponding to a HOST TARGET binding site such as BINDING SITE I, BINDING SITE II or BINDING SITE III. Table 2 illustrates the complementarity of the nucleotide sequences of CAMKK1 BINDING SITE, designated SEQ ID:26064, to the nucleotide sequence of VGAM1702 RNA, herein designated VGAM RNA, also designated SEQ ID:4413.

Another function of VGAM1702 is therefore inhibition of Calcium/calmodulin-dependent Protein Kinase Kinase 1, Alpha (CAMKK1, Accession NM_032294). Accordingly, utilities of VGAM1702 include diagnosis, prevention and treatment of diseases and clinical conditions associated with CAMKK1. FLJ12294 (Accession NM_025100) is another VGAM1702 host target gene. FLJ12294 BINDING SITE is HOST TARGET binding site found in the 3' untranslated region of mRNA encoded by FLJ12294, corresponding to a HOST TARGET binding site such as BINDING SITE I, BINDING SITE II or BINDING SITE III. Table 2 illustrates the complementarity of the nucleotide sequences of FLJ12294 BINDING SITE, designated SEQ ID:24747, to the nucleotide sequence of VGAM1702 RNA, herein designated VGAM RNA, also designated SEQ ID:4413.

Another function of VGAM1702 is therefore inhibition of FLJ12294 (Accession NM_025100). Accordingly, utilities of VGAM1702 include diagnosis, prevention and treatment of diseases and clinical conditions associated with FLJ12294. FLJ23598 (Accession XM_170689) is another VGAM1702 host target gene. FLJ23598 BINDING SITE is HOST TARGET binding site found in the 5' untranslated region of mRNA encoded by FLJ23598, corresponding to a HOST TARGET binding site such as BINDING SITE I, BINDING SITE II or BINDING SITE III. Table 2 illustrates the complementarity of the nucleotide sequences of FLJ23598 BINDING SITE, designated SEQ ID:45467, to the nucleotide sequence of VGAM1702 RNA, herein designated VGAM RNA, also designated SEQ ID:4413.

Another function of VGAM1702 is therefore inhibition of FLJ23598 (Accession XM_170689). Accordingly, utilities of VGAM1702 include diagnosis, prevention and treatment of diseases and clinical conditions associated with FLJ23598. T-box 4 (TBX4, Accession NM_018488) is another VGAM1702 host target gene. TBX4 BINDING SITE is HOST TARGET binding site found in the 3' untranslated region of mRNA encoded by TBX4, corresponding to a HOST TARGET binding site such as BINDING SITE I, BINDING SITE II or BINDING SITE III. Table 2 illustrates the complementarity of the nucleotide sequences of TBX4 BINDING SITE, designated SEQ ID:20547, to the nucleotide sequence of VGAM1702 RNA, herein designated VGAM RNA, also designated SEQ ID:4413.

Another function of VGAM1702 is therefore inhibition of T-box 4 (TBX4, Accession NM_018488). Accordingly, utilities of VGAM1702 include diagnosis, prevention and treatment of diseases and clinical conditions associated with TBX4. LOC148147 (Accession XM_086071) is another VGAM1702 host target gene. LOC148147 BINDING SITE is HOST TARGET binding site found in the 3' untranslated region of mRNA encoded by LOC148147, corresponding to a HOST TARGET binding site such as BINDING SITE I, BINDING SITE II or BINDING SITE III. Table 2 illustrates the complementarity of the nucleotide sequences of LOC148147 BINDING SITE, designated SEQ ID:38475, to the nucleotide sequence of VGAM1702 RNA, herein designated VGAM RNA, also designated SEQ ID:4413.

Another function of VGAM1702 is therefore inhibition of LOC148147 (Accession XM_086071). Accordingly, utilities of VGAM1702 include diagnosis, prevention and treatment of diseases and clinical conditions associated with LOC148147. FIG. 1 further provides a conceptual description of a novel bioinformatically detected viral gene of the present invention, referred to here as Viral Genomic Address Messenger 1703 (VGAM1703) viral gene, which modulates expression of respective host target genes thereof, the function and utility of which host target genes is known in the art.

VGAM1703 is a novel bioinformatically detected regulatory, non protein coding, viral micro RNA (miRNA) gene. The method by which VGAM1703 was detected is described hereinabove with reference to FIGS. 1-8.

VGAM1703 gene, herein designated VGAM GENE, is a viral gene contained in the genome of Ectocarpus Siliculosus Virus. VGAM1703 host target gene, herein designated VGAM HOST TARGET GENE, is a human gene contained in the human genome.

VGAM1703 gene encodes a VGAM1703 precursor RNA, herein designated VGAM PRECURSOR RNA. Similar to other miRNA genes, and unlike most ordinary genes, VGAM1703 precursor RNA does not encode a protein. A nucleotide sequence identical or highly similar to the nucleotide sequence of VGAM1703 precursor RNA is designated SEQ ID:1689, and is provided hereinbelow with reference to the sequence listing part. Nucleotide sequence SEQ ID:1689 is located at position 53714 relative to the genome of Ectocarpus Siliculosus Virus.

VGAM1703 precursor RNA folds onto itself, forming VGAM1703 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1703 folded precursor RNA into VGAM1703 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM1703 RNA is designated SEQ ID:4414, and is provided hereinbelow with reference to the sequence listing part.

VGAM1703 host target gene, herein designated VGAM HOST TARGET GENE, encodes a corresponding messenger RNA, VGAM1703 host target RNA, herein designated VGAM HOST TARGET RNA. VGAM1703 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1703 RNA, herein designated VGAM RNA, binds complementarily to one or more host target binding sites located in untranslated regions of VGAM1703 host target RNA, herein designated VGAM HOST TARGET RNA. This complementary binding is due to the fact that the nucleotide sequence of VGAM1703 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1703 RNA, herein designated VGAM RNA, may have a different number of host target binding sites in untranslated regions of a VGAM1703 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1703 RNA, herein designated VGAM RNA, to host target binding sites on VGAM1703 host target RNA, herein designated VGAM HOST TARGET RNA, such as BINDING SITE I, BINDING SITE II and BINDING SITE III, inhibits translation of VGAM1703 host target RNA into VGAM1703 host target protein, herein designated VGAM HOST TARGET PROTEIN. VGAM host target protein is therefore outlined by a broken line.

It is appreciated that VGAM1703 host target gene, herein designated VGAM HOST TARGET GENE, in fact represents a plurality of VGAM1703 host target genes. The mRNA of each one of this plurality of VGAM1703 host target genes comprises one or more host target binding sites, each having a nucleotide sequence which is at least partly complementary to VGAM1703 RNA, herein designated VGAM RNA, and which when bound by VGAM1703 RNA causes inhibition of translation of respective one or more VGAM1703 host target proteins.

It is further appreciated by one skilled in the art that the mode of translational inhibition illustrated by FIG. 1 with specific reference to translational inhibition exerted by VGAM1703 gene, herein designated VGAM GENE, on one or more VGAM1703 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1703 is inhibition of expression of host target genes, as part of a novel viral mechanism of attacking a host. Accordingly, utilities of VGAM1703 include diagnosis, prevention and treatment of viral infection by Ectocarpus Siliculosus Virus. Specific functions, and accordingly utilities, of VGAM1703 correlate with, and may be deduced from, the identity of the host target genes which VGAM1703 binds and inhibits, and the function of these host target genes, as elaborated hereinbelow.

Nucleotide sequences of the VGAM1703 precursor RNA, herein designated VGAM PRECURSOR RNA, and of the 'diced' VGAM1703 RNA, herein designated VGAM RNA, and a schematic representation of the secondary folding of VGAM1703 folded precursor RNA, herein designated VGAM FOLDED PRECURSOR RNA, of VGAM1703 are further described hereinbelow with reference to Table 1.

Nucleotide sequences of host target binding sites, such as BINDING SITE-I, BINDING SITE-II and BINDING SITE-III of FIG. 1, found on VGAM1703 host target RNA, and schematic representation of the complementarity of each of these host target binding sites to VGAM1703 RNA, herein designated VGAM RNA, are described hereinbelow with reference to Table 2.

As mentioned hereinabove with reference to FIG. 1, a function of VGAM1703 gene, herein designated VGAM is inhibition of expression of VGAM1703 target genes. It is appreciated that specific functions, and accordingly utilities, of VGAM1703 correlate with, and may be deduced from, the identity of the target genes which VGAM1703 binds and inhibits, and the function of these target genes, as elaborated hereinbelow.

RAD52 Homolog (S. cerevisiae) (RAD52, Accession NM_134422) is a VGAM1703 host target gene. RAD52 BINDING SITE1 through RAD52 BINDING SITE3 are HOST TARGET binding sites found in untranslated regions of mRNA encoded by RAD52, corresponding to HOST TARGET binding sites such as BINDING SITE I, BINDING SITE II or BINDING SITE III. Table 2 illustrates the complementarity of the nucleotide sequences of RAD52 BINDING SITE1 through RAD52 BINDING SITE3, designated SEQ ID:28640, SEQ ID:28650 and SEQ ID:28659 respectively, to the nucleotide sequence of VGAM1703 RNA, herein designated VGAM RNA, also designated SEQ ID:4414.

A function of VGAM1703 is therefore inhibition of RAD52 Homolog (S. cerevisiae) (RAD52, Accession NM_134422). Accordingly, utilities of VGAM1703 include diagnosis, prevention and treatment of diseases and clinical conditions associated with RAD52. ChGn (Accession NM_018371) is another VGAM1703 host target gene. ChGn BINDING SITE is HOST TARGET binding site found in the 5' untranslated region of mRNA encoded by ChGn, corresponding to a HOST TARGET binding site such as BINDING SITE I, BINDING SITE II or BINDING SITE III. Table 2 illustrates the complementarity of the nucleotide sequences of ChGn BINDING SITE, designated SEQ ID:20390, to the nucleotide sequence of VGAM1703 RNA, herein designated VGAM RNA, also designated SEQ ID:4414.

Another function of VGAM1703 is therefore inhibition of ChGn (Accession NM_018371). Accordingly, utilities of VGAM1703 include diagnosis, prevention and treatment of diseases and clinical conditions associated with ChGn. FIG. 1 further provides a conceptual description of a novel bioinformatically detected viral gene of the present invention, referred to here as Viral Genomic Address Messenger 1704 (VGAM1704) viral gene, which modulates expression of respective host target genes thereof, the function and utility of which host target genes is known in the art.

VGAM1704 is a novel bioinformatically detected regulatory, non protein coding, viral micro RNA (miRNA) gene. The method by which VGAM1704 was detected is described hereinabove with reference to FIGS. 1-8.

VGAM1704 gene, herein designated VGAM GENE, is a viral gene contained in the genome of Ectocarpus Siliculosus Virus. VGAM1704 host target gene, herein designated VGAM HOST TARGET GENE, is a human gene contained in the human genome.

VGAM1704 gene encodes a VGAM1704 precursor RNA, herein designated VGAM PRECURSOR RNA. Similar to other miRNA genes, and unlike most ordinary genes, VGAM1704 precursor RNA does not encode a protein. A nucleotide sequence identical or highly similar to the nucleotide sequence of VGAM1704 precursor RNA is designated SEQ ID:1690, and is provided hereinbelow with reference to the sequence listing part. Nucleotide sequence SEQ ID:1690 is located at position 52170 relative to the genome of Ectocarpus Siliculosus Virus.

VGAM1704 precursor RNA folds onto itself, forming VGAM1704 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1704 folded precursor RNA into VGAM1704 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1704 RNA is designated SEQ ID:4415, and is provided hereinbelow with reference to the sequence listing part.

VGAM1704 host target gene, herein designated VGAM HOST TARGET GENE, encodes a corresponding messenger RNA, VGAM1704 host target RNA, herein designated VGAM HOST TARGET RNA. VGAM1704 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1704 RNA, herein designated VGAM RNA, binds complementarily to one or more host target binding sites located in untranslated regions of VGAM1704 host target RNA, herein designated VGAM HOST TARGET RNA. This complementary binding is due to the fact that the nucleotide sequence of VGAM1704 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1704 RNA, herein designated VGAM RNA, may have a different number of host target binding sites in untranslated regions of a VGAM1704 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1704 RNA, herein designated VGAM RNA, to host target binding sites on VGAM1704 host target RNA, herein designated VGAM HOST TARGET RNA, such as BINDING SITE I, BINDING SITE II and BINDING SITE III, inhibits translation of VGAM1704 host target RNA into VGAM1704 host target protein, herein designated VGAM HOST TARGET PROTEIN. VGAM host target protein is therefore outlined by a broken line.

It is appreciated that VGAM1704 host target gene, herein designated VGAM HOST TARGET GENE, in fact represents a plurality of VGAM1704 host target genes. The mRNA of each one of this plurality of VGAM1704 host target genes comprises one or more host target binding sites, each having a nucleotide sequence which is at least partly complementary to VGAM1704 RNA, herein designated VGAM RNA, and which when bound by VGAM1704 RNA causes inhibition of translation of respective one or more VGAM1704 host target proteins.

It is further appreciated by one skilled in the art that the mode of translational inhibition illustrated by FIG. 1 with specific reference to translational inhibition exerted by VGAM1704 gene, herein designated VGAM GENE, on one or more VGAM1704 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1704 is inhibition of expression of host target genes, as part of a novel viral mechanism of attacking a host. Accordingly, utilities of VGAM1704 include diagnosis, prevention and treatment of viral infection by Ectocarpus Siliculosus Virus. Specific functions, and accordingly utilities, of VGAM1704 correlate with, and may be deduced from, the identity of the host target genes which VGAM1704 binds and inhibits, and the function of these host target genes, as elaborated hereinbelow.

Nucleotide sequences of the VGAM1704 precursor RNA, herein designated VGAM PRECURSOR RNA, and of the 'diced' VGAM1704 RNA, herein designated VGAM RNA, and a schematic representation of the secondary folding of VGAM1704 folded precursor RNA, herein designated VGAM FOLDED PRECURSOR RNA, of VGAM1704 are further described hereinbelow with reference to Table 1.

Nucleotide sequences of host target binding sites, such as BINDING SITE-I, BINDING SITE-II and BINDING SITE-III of FIG. 1, found on VGAM1704 host target RNA, and schematic representation of the complementarity of each of these host target binding sites to VGAM1704 RNA, herein designated VGAM RNA, are described hereinbelow with reference to Table 2.

As mentioned hereinabove with reference to FIG. 1, a function of VGAM1704 gene, herein designated VGAM is inhibition of expression of VGAM1704 target genes. It is appreciated that specific functions, and accordingly utilities, of VGAM1704 correlate with, and may be deduced from, the identity of the target genes which VGAM1704 binds and inhibits, and the function of these target genes, as elaborated hereinbelow.

Ephrin-B2 (EFNB2, Accession NM_004093) is a VGAM1704 host target gene. EFNB2 BINDING SITE is HOST TARGET binding site found in the 3' untranslated region of mRNA encoded by EFNB2, corresponding to a HOST TARGET binding site such as BINDING SITE I, BINDING SITE II or BINDING SITE III. Table 2 illustrates the complementarity of the nucleotide sequences of EFNB2 BINDING SITE, designated SEQ ID:10297, to the nucleotide sequence of VGAM1704 RNA, herein designated VGAM RNA, also designated SEQ ID:4415.

A function of VGAM1704 is therefore inhibition of Ephrin-B2 (EFNB2, Accession NM_004093). Accordingly, utilities of VGAM1704 include diagnosis, prevention and treatment of diseases and clinical conditions associated with EFNB2. Early Growth Response 1 (EGR1, Accession NM_001964) is another VGAM1704 host target gene. EGR1 BINDING SITE is HOST TARGET binding site found in the 5' untranslated region of mRNA encoded by EGR1, corresponding to a HOST TARGET binding site such as BINDING SITE I, BINDING SITE II or BINDING SITE III. Table 2 illustrates the complementarity of the nucleotide sequences of EGR1 BINDING SITE, designated SEQ ID:7692, to the nucleotide sequence of VGAM1704 RNA, herein designated VGAM RNA, also designated SEQ ID:4415.

Another function of VGAM1704 is therefore inhibition of Early Growth Response 1 (EGR1, Accession NM_001964). Accordingly, utilities of VGAM1704 include diagnosis, prevention and treatment of diseases and clinical conditions associated with EGR1. Fibroblast Growth Factor 2 (basic) (FGF2, Accession NM_002006) is another VGAM1704 host target gene. FGF2 BINDING SITE is HOST TARGET binding site found in the 3' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7744, to the nucleotide sequence of VGAM1704 RNA, herein designated VGAM RNA, also designated SEQ ID:4415.

Another function of VGAM1704 is therefore inhibition of Fibroblast Growth Factor 2 (basic) (FGF2, Accession NM_002006), a gene which probably involved in nervous system development and function. Accordingly, utilities of VGAM1704 include diagnosis, prevention and treatment of diseases and clinical conditions associated with FGF2. The function of FGF2 and its association with various diseases and clinical conditions, has been established by previous studies, as described hereinabove with reference to VGAM51. 5-hydroxytryptamine (serotonin) Receptor 2C (HTR2C, Accession NM_000868) is another VGAM1704 host target gene. HTR2C BINDING SITE is HOST TARGET binding site found in the 5' untranslated region of mRNA encoded by HTR2C, corresponding to a HOST TARGET binding site such as BINDING SITE I, BINDING SITE II or BINDING SITE III. Table 2 illustrates the complementarity of the nucleotide sequences of HTR2C BINDING SITE, designated SEQ ID:6535, to the nucleotide sequence of VGAM1704 RNA, herein designated VGAM RNA, also designated SEQ ID:4415.

Another function of VGAM1704 is therefore inhibition of 5-hydroxytryptamine (serotonin) Receptor 2C (HTR2C, Accession NM_000868), a gene which activates phospholipase C and regulates intracellular calcium flux. Accordingly, utilities of VGAM1704 include diagnosis, prevention and treatment of diseases and clinical conditions associated with HTR2C. The function of HTR2C and its association with various diseases and clinical conditions, has been established by previous studies, as described hereinabove with reference to VGAM1052. Inositol 1,4,5-triphosphate Receptor, Type 3 (ITPR3, Accession NM_002224) is another VGAM1704 host target gene. ITPR3 BINDING SITE is HOST TARGET binding site found in the 3' untranslated region of mRNA encoded by ITPR3, corresponding to a HOST TARGET binding site such as BINDING SITE I, BINDING SITE II or BINDING SITE III. Table 2 illustrates the complementarity of the nucleotide sequences of ITPR3 BINDING SITE, designated SEQ ID:7999, to the nucleotide sequence of VGAM1704 RNA, herein designated VGAM RNA, also designated SEQ ID:4415.

Another function of VGAM1704 is therefore inhibition of Inositol 1,4,5-triphosphate Receptor, Type 3 (ITPR3, Accession NM_002224), a gene which may be responsible for calcium release from intracellular stores. Accordingly, utilities of VGAM1704 include diagnosis, prevention and treatment of diseases and clinical conditions associated with ITPR3. The function of ITPR3 and its association with various diseases and clinical conditions, has been established by previous studies, as described hereinabove with reference to VGAM310. Proteasome (prosome, macropain) Subunit, Beta Type, 2 (PSMB2, Accession NM_002794) is another VGAM1704 host target gene. PSMB2 BINDING SITE is HOST TARGET binding site found in the 3' untranslated region of mRNA encoded by PSMB2, corresponding to a HOST TARGET binding site such as BINDING SITE I, BINDING SITE II or BINDING SITE III. Table 2 illustrates the complementarity of the nucleotide sequences of PSMB2 BINDING SITE, designated SEQ ID:8673, to the nucleotide sequence of VGAM1704 RNA, herein designated VGAM RNA, also designated SEQ ID:4415.

Another function of VGAM1704 is therefore inhibition of Proteasome (prosome, macropain) Subunit, Beta Type, 2 (PSMB2, Accession NM_002794). Accordingly, utilities of VGAM1704 include diagnosis, prevention and treatment of diseases and clinical conditions associated with PSMB2. Calneuron 1 (CALN1, Accession NM_031468) is another VGAM1704 host target gene. CALN1 BINDING SITE is HOST TARGET binding site found in the 3' untranslated region of mRNA encoded by CALN1, corresponding to a HOST TARGET binding site such as BINDING SITE I, BINDING SITE II or BINDING SITE III. Table 2 illustrates the complementarity of the nucleotide sequences of CALN1 BINDING SITE, designated SEQ ID:25519, to the nucleotide sequence of VGAM1704 RNA, herein designated VGAM RNA, also designated SEQ ID:4415.

Another function of VGAM1704 is therefore inhibition of Calneuron 1 (CALN1, Accession NM_031468). Accordingly, utilities of VGAM1704 include diagnosis, prevention and treatment of diseases and clinical conditions associated with CALN1. Calcium/calmodulin-dependent Protein Kinase Kinase 1, Alpha (CAMKK1, Accession NM_032294) is another VGAM1704 host target gene. CAMKK1 BINDING SITE is HOST TARGET binding site found in the 3' untranslated region of mRNA encoded by CAMKK1, corresponding to a HOST TARGET binding site such as BINDING SITE I, BINDING SITE II or BINDING SITE III. Table 2 illustrates the complementarity of the nucleotide sequences of CAMKK1 BINDING SITE, designated SEQ ID:26068, to the nucleotide sequence of VGAM1704 RNA, herein designated VGAM RNA, also designated SEQ ID:4415.

Another function of VGAM1704 is therefore inhibition of Calcium/calmodulin-dependent Protein Kinase Kinase 1, Alpha (CAMKK1, Accession NM_032294). Accordingly, utilities of VGAM1704 include diagnosis, prevention and treatment of diseases and clinical conditions associated with CAMKK1. DC-TM4F2 (Accession NM_030927) is another VGAM1704 host target gene. DC-TM4F2 BINDING SITE is HOST TARGET binding site found in the 3' untranslated region of mRNA encoded by DC-TM4F2, corresponding to a HOST TARGET binding site such as BINDING SITE I, BINDING SITE II or BINDING SITE III. Table 2 illustrates the complementarity of the nucleotide sequences of DC-TM4F2 BINDING SITE, designated SEQ ID:25199, to the nucleotide sequence of VGAM1704 RNA, herein designated VGAM RNA, also designated SEQ ID:4415.

Another function of VGAM1704 is therefore inhibition of DC-TM4F2 (Accession NM_030927). Accordingly, utilities of VGAM1704 include diagnosis, prevention and treatment of diseases and clinical conditions associated with DC-TM4F2. DEAD/H (Asp-Glu-Ala-Asp/His) Box Polypeptide 34 (DDX34, Accession NM_014681) is another VGAM1704 host target gene. DDX34 BINDING SITE is HOST TARGET binding site found in the 3' untranslated region of mRNA encoded by DDX34, corresponding to a HOST TARGET binding site such as BINDING SITE I, BINDING SITE II or BINDING SITE III. Table 2 illustrates the complementarity of the nucleotide sequences of DDX34 BINDING SITE, designated SEQ ID:16169, to the nucleotide sequence of VGAM1704 RNA, herein designated VGAM RNA, also designated SEQ ID:4415.

Another function of VGAM1704 is therefore inhibition of DEAD/H (Asp-Glu-Ala-Asp/His) Box Polypeptide 34 (DDX34, Accession NM_014681). Accordingly, utilities of VGAM1704 include diagnosis, prevention and treatment of diseases and clinical conditions associated with DDX34. DRIL2 (Accession NM_006465) is another VGAM1704 host target gene. DRIL2 BINDING SITE is HOST TARGET binding site found in the 3' untranslated region of mRNA encoded by DRIL2, corresponding to a HOST TARGET binding site such as BINDING SITE I, BINDING SITE II or BINDING SITE III. Table 2 illustrates the complementarity of the nucleotide sequences of DRIL2 BINDING SITE, designated SEQ ID:13188, to the nucleotide sequence of VGAM1704 RNA, herein designated VGAM RNA, also designated SEQ ID:4415.

Another function of VGAM1704 is therefore inhibition of DRIL2 (Accession NM_006465). Accordingly, utilities of VGAM1704 include diagnosis, prevention and treatment of diseases and clinical conditions associated with DRIL2. FLJ12294 (Accession NM_025100) is another VGAM1704 host target gene. FLJ12294 BINDING SITE is HOST TARGET binding site found in the 3' untranslated region of mRNA encoded by FLJ12294, corresponding to a HOST TARGET binding site such as BINDING SITE I, BINDING SITE II or BINDING SITE III. Table 2 illustrates the complementarity of the nucleotide sequences of FLJ12294 BINDING SITE, designated SEQ ID:24743, to the nucleotide sequence of VGAM1704 RNA, herein designated VGAM RNA, also designated SEQ ID:4415.

Another function of VGAM1704 is therefore inhibition of FLJ12294 (Accession NM_025100). Accordingly, utilities of VGAM1704 include diagnosis, prevention and treatment of diseases and clinical conditions associated with FLJ12294. FLJ13456 (Accession XM_038291) is another VGAM1704 host target gene. FLJ13456 BINDING SITE is HOST TARGET binding site found in the 3' untranslated region of mRNA encoded by FLJ13456, corresponding to a HOST TARGET binding site such as BINDING SITE I, BINDING SITE II or BINDING SITE III. Table 2 illustrates the complementarity of the nucleotide sequences of FLJ13456 BINDING SITE, designated SEQ ID:32800, to the nucleotide sequence of VGAM1704 RNA, herein designated VGAM RNA, also designated SEQ ID:4415.

Another function of VGAM1704 is therefore inhibition of FLJ13456 (Accession XM_038291). Accordingly, utilities of VGAM1704 include diagnosis, prevention and treatment of diseases and clinical conditions associated with FLJ13456. FLJ20489 (Accession NM_017842) is another VGAM1704 host target gene. FLJ20489 BINDING SITE is HOST TARGET binding site found in the 5' untranslated region of mRNA encoded by FLJ20489, corresponding to a HOST TARGET binding site such as BINDING SITE I, BINDING SITE II or BINDING SITE III. Table 2 illustrates the complementarity of the nucleotide sequences of FLJ20489 BINDING SITE, designated SEQ ID:19507, to the nucleotide sequence of VGAM1704 RNA, herein designated VGAM RNA, also designated SEQ ID:4415.

Another function of VGAM1704 is therefore inhibition of FLJ20489 (Accession NM_017842). Accordingly, utilities of VGAM1704 include diagnosis, prevention and treatment of diseases and clinical conditions associated with FLJ20489. FLJ21551 (Accession NM_024801) is another VGAM1704 host target gene. FLJ21551 BINDING SITE is HOST TARGET binding site found in the 3' untranslated region of mRNA encoded by FLJ21551, corresponding to a HOST TARGET binding site such as BINDING SITE I, BINDING SITE II or BINDING SITE III. Table 2 illustrates the complementarity of the nucleotide sequences of FLJ21551 BINDING SITE, designated SEQ ID:24181, to the nucleotide sequence of VGAM1704 RNA, herein designated VGAM RNA, also designated SEQ ID:4415.

Another function of VGAM1704 is therefore inhibition of FLJ21551 (Accession NM_024801). Accordingly, utilities of VGAM1704 include diagnosis, prevention and treatment of diseases and clinical conditions associated with FLJ21551. FLJ22362 (Accession NM_022823) is another VGAM1704 host target gene. FLJ22362 BINDING SITE is HOST TARGET binding site found in the 5' untranslated region of mRNA encoded by FLJ22362, corresponding to a HOST TARGET binding site such as BINDING SITE I, BINDING SITE II or BINDING SITE III. Table 2 illustrates the complementarity of the nucleotide sequences of FLJ22362 BINDING SITE, designated SEQ ID:23105, to the nucleotide sequence of VGAM1704 RNA, herein designated VGAM RNA, also designated SEQ ID:4415.

Another function of VGAM1704 is therefore inhibition of FLJ22362 (Accession NM_022823). Accordingly, utilities of VGAM1704 include diagnosis, prevention and treatment of diseases and clinical conditions associated with FLJ22362. FLJ22692 (Accession NM_025049) is another VGAM1704 host target gene. FLJ22692 BINDING SITE is HOST TARGET binding site found in the 3' untranslated region of mRNA encoded by FLJ22692, corresponding to a HOST TARGET binding site such as BINDING SITE I, BINDING SITE II or BINDING SITE III. Table 2 illustrates the complementarity of the nucleotide sequences of FLJ22692 BINDING SITE, designated SEQ ID:24644, to the nucleotide sequence of VGAM1704 RNA, herein designated VGAM RNA, also designated SEQ ID:4415.

Another function of VGAM1704 is therefore inhibition of FLJ22692 (Accession NM_025049). Accordingly, utilities of VGAM1704 include diagnosis, prevention and treatment of diseases and clinical conditions associated with FLJ22692. FLJ23598 (Accession XM_170689) is another VGAM1704 host target gene. FLJ23598 BINDING SITE is HOST TARGET binding site found in the 5' untranslated region of mRNA encoded by FLJ23598, corresponding to a HOST TARGET binding site such as BINDING SITE I, BINDING SITE II or BINDING SITE III. Table 2 illustrates the complementarity of the nucleotide sequences of FLJ23598 BINDING SITE, designated SEQ ID:45468, to the nucleotide sequence of VGAM1704 RNA, herein designated VGAM RNA, also designated SEQ ID:4415.

Another function of VGAM1704 is therefore inhibition of FLJ23598 (Accession XM_170689). Accordingly, utilities of VGAM1704 include diagnosis, prevention and treatment of diseases and clinical conditions associated with FLJ23598. KIAA0795 (Accession NM_025010) is another VGAM1704 host target gene. KIAA0795 BINDING SITE is HOST TARGET binding site found in the 3' untranslated region of mRNA encoded by KIAA0795, corresponding to a HOST TARGET binding site such as BINDING SITE I, BINDING SITE II or BINDING SITE III. Table 2 illustrates the complementarity of the nucleotide sequences of KIAA0795 BIND- ING SITE, designated SEQ ID:24588, to the nucleotide sequence of VGAM1704 RNA, herein designated VGAM RNA, also designated SEQ ID:4415.

Another function of VGAM1704 is therefore inhibition of KIAA0795 (Accession NM_025010). Accordingly, utilities of VGAM1704 include diagnosis, prevention and treatment of diseases and clinical conditions associated with KIAA0795. KIAA1872 (Accession XM_031917) is another VGAM1704 host target gene. KIAA1872 BINDING SITE is HOST TARGET binding site found in the 3' untranslated region of mRNA encoded by KIAA1872, corresponding to a HOST TARGET binding site such as BINDING SITE I, BINDING SITE II or BINDING SITE III. Table 2 illustrates the complementarity of the nucleotide sequences of KIAA1872 BINDING SITE, designated SEQ ID:31518, to the nucleotide sequence of VGAM1704 RNA, herein designated VGAM RNA, also designated SEQ ID:4415.

Another function of VGAM1704 is therefore inhibition of KIAA1872 (Accession XM_031917). Accordingly, utilities of VGAM1704 include diagnosis, prevention and treatment of diseases and clinical conditions associated with KIAA1872. LGP1 (Accession NM_032484) is another VGAM1704 host target gene. LGP1 BINDING SITE is HOST TARGET binding site found in the 5' untranslated region of mRNA encoded by LGP1, corresponding to a HOST TARGET binding site such as BINDING SITE I, BINDING SITE II or BINDING SITE III. Table 2 illustrates the complementarity of the nucleotide sequences of LGP1 BINDING SITE, designated SEQ ID:26232, to the nucleotide sequence of VGAM1704 RNA, herein designated VGAM RNA, also designated SEQ ID:4415.

Another function of VGAM1704 is therefore inhibition of LGP1 (Accession NM_032484). Accordingly, utilities of VGAM1704 include diagnosis, prevention and treatment of diseases and clinical conditions associated with LGP1. Mitogen-activated Protein Kinase Kinase 4 (MAP2K4, Accession NM_003010) is another VGAM1704 host target gene. MAP2K4 BINDING SITE is HOST TARGET binding site found in the 3' untranslated region of mRNA encoded by MAP2K4, corresponding to a HOST TARGET binding site such as BINDING SITE I, BINDING SITE II or BINDING SITE III. Table 2 illustrates the complementarity of the nucleotide sequences of MAP2K4 BINDING SITE, designated SEQ ID:8917, to the nucleotide sequence of VGAM1704 RNA, herein designated VGAM RNA, also designated SEQ ID:4415.

Another function of VGAM1704 is therefore inhibition of Mitogen-activated Protein Kinase Kinase 4 (MAP2K4, Accession NM_003010). Accordingly, utilities of VGAM1704 include diagnosis, prevention and treatment of diseases and clinical conditions associated with MAP2K4. MGC29891 (Accession NM_144618) is another VGAM1704 host target gene. MGC29891 BINDING SITE is HOST TARGET binding site found in the 3' untranslated region of mRNA encoded by MGC29891, corresponding to a HOST TARGET binding site such as BINDING SITE I, BINDING SITE II or BINDING SITE III. Table 2 illustrates the complementarity of the nucleotide sequences of MGC29891 BINDING SITE, designated SEQ ID:29438, to the nucleotide sequence of VGAM1704 RNA, herein designated VGAM RNA, also designated SEQ ID:4415.

Another function of VGAM1704 is therefore inhibition of MGC29891 (Accession NM_144618). Accordingly, utilities of VGAM1704 include diagnosis, prevention and treatment of diseases and clinical conditions associated with MGC29891. Nup43 (Accession NM_024647) is another VGAM1704 host target gene. Nup43 BINDING SITE is HOST TARGET binding site found in the 3' untranslated region of mRNA encoded by Nup43, corresponding to a HOST TARGET binding site such as BINDING SITE I, BINDING SITE II or BINDING SITE III. Table 2 illustrates the complementarity of the nucleotide sequences of Nup43 BINDING SITE, designated SEQ ID:23937, to the nucleotide sequence of VGAM1704 RNA, herein designated VGAM RNA, also designated SEQ ID:4415.

Another function of VGAM1704 is therefore inhibition of Nup43 (Accession NM_024647). Accordingly, utilities of VGAM1704 include diagnosis, prevention and treatment of diseases and clinical conditions associated with Nup43. Neurexophilin 3 (NXPH3, Accession XM_037847) is another VGAM1704 host target gene. NXPH3 BINDING SITE is HOST TARGET binding site found in the 3' untranslated region of mRNA encoded by NXPH3, corresponding to a HOST TARGET binding site such as BINDING SITE I, BINDING SITE II or BINDING SITE III. Table 2 illustrates the complementarity of the nucleotide sequences of NXPH3 BINDING SITE, designated SEQ ID:32715, to the nucleotide sequence of VGAM1704 RNA, herein designated VGAM RNA, also designated SEQ ID:4415.

Another function of VGAM1704 is therefore inhibition of Neurexophilin 3 (NXPH3, Accession XM_037847). Accordingly, utilities of VGAM1704 include diagnosis, prevention and treatment of diseases and clinical conditions associated with NXPH3. Regulator of G-protein Signalling 11 (RGS11, Accession NM_003834) is another VGAM1704 host target gene. RGS11 BINDING SITE is HOST TARGET binding site found in the 3' untranslated region of mRNA encoded by RGS11, corresponding to a HOST TARGET binding site such as BINDING SITE I, BINDING SITE II or BINDING SITE III. Table 2 illustrates the complementarity of the nucleotide sequences of RGS11 BINDING SITE, designated SEQ ID:9925, to the nucleotide sequence of VGAM1704 RNA, herein designated VGAM RNA, also designated SEQ ID:4415.

Another function of VGAM1704 is therefore inhibition of Regulator of G-protein Signalling 11 (RGS11, Accession NM_003834). Accordingly, utilities of VGAM1704 include diagnosis, prevention and treatment of diseases and clinical conditions associated with RGS11. ZAK (Accession NM_133646) is another VGAM1704 host target gene. ZAK BINDING SITE is HOST TARGET binding site found in the 3' untranslated region of mRNA encoded by ZAK, corresponding to a HOST TARGET binding site such as BINDING SITE I, BINDING SITE II or BINDING SITE III. Table 2 illustrates the complementarity of the nucleotide sequences of ZAK BINDING SITE, designated SEQ ID:28606, to the nucleotide sequence of VGAM1704 RNA, herein designated VGAM RNA, also designated SEQ ID:4415.

Another function of VGAM1704 is therefore inhibition of ZAK (Accession NM_133646). Accordingly, utilities of VGAM1704 include diagnosis, prevention and treatment of diseases and clinical conditions associated with ZAK. LOC115129 (Accession XM_055292) is another VGAM1704 host target gene. LOC115129 BINDING SITE is HOST TARGET binding site found in the 3' untranslated region of mRNA encoded by LOC115129, corresponding to a HOST TARGET binding site such as BINDING SITE I, BINDING SITE II or BINDING SITE III. Table 2 illustrates the complementarity of the nucleotide sequences of LOC115129 BINDING SITE, designated SEQ ID:36255, to the nucleotide sequence of VGAM1704 RNA, herein designated VGAM RNA, also designated SEQ ID:4415.

Another function of VGAM1704 is therefore inhibition of LOC115129 (Accession XM_055292). Accordingly, utilities of VGAM1704 include diagnosis, prevention and treatment of diseases and clinical conditions associated with LOC115129. LOC115330 (Accession NM_138445) is another VGAM1704 host target gene. LOC115330 BINDING SITE is HOST TARGET binding site found in the 3' untranslated region of mRNA encoded by LOC115330, corresponding to a HOST TARGET binding site such as BINDING SITE I, BINDING SITE II or BINDING SITE III. Table 2 illustrates the complementarity of the nucleotide sequences of LOC115330 BINDING SITE, designated SEQ ID:28811, to the nucleotide sequence of VGAM1704 RNA, herein designated VGAM RNA, also designated SEQ ID:4415.

Another function of VGAM1704 is therefore inhibition of LOC115330 (Accession NM_138445). Accordingly, utilities of VGAM1704 include diagnosis, prevention and treatment of diseases and clinical conditions associated with LOC115330. LOC116437 (Accession XM_058185) is another VGAM1704 host target gene. LOC116437 BINDING SITE is HOST TARGET binding site found in the 3' untranslated region of mRNA encoded by LOC116437, corresponding to a HOST TARGET binding site such as BINDING SITE I, BINDING SITE II or BINDING SITE III. Table 2 illustrates the complementarity of the nucleotide sequences of LOC116437 BINDING SITE, designated SEQ ID:36582, to the nucleotide sequence of VGAM1704 RNA, herein designated VGAM RNA, also designated SEQ ID:4415.

Another function of VGAM1704 is therefore inhibition of LOC116437 (Accession XM_058185). Accordingly, utilities of VGAM1704 include diagnosis, prevention and treatment of diseases and clinical conditions associated with LOC116437. LOC145955 (Accession XM_096912) is another VGAM1704 host target gene. LOC145955 BINDING SITE is HOST TARGET binding site found in the 5' untranslated region of mRNA encoded by LOC145955, corresponding to a HOST TARGET binding site such as BINDING SITE I, BINDING SITE II or BINDING SITE III. Table 2 illustrates the complementarity of the nucleotide sequences of LOC145955 BINDING SITE, designated SEQ ID:40644, to the nucleotide sequence of VGAM1704 RNA, herein designated VGAM RNA, also designated SEQ ID:4415.

Another function of VGAM1704 is therefore inhibition of LOC145955 (Accession XM_096912). Accordingly, utilities of VGAM1704 include diagnosis, prevention and treatment of diseases and clinical conditions associated with LOC145955. LOC148147 (Accession XM_086071) is another VGAM1704 host target gene. LOC148147 BINDING SITE is HOST TARGET binding site found in the 3' untranslated region of mRNA encoded by LOC148147, corresponding to a HOST TARGET binding site such as BINDING SITE I, BINDING SITE II or BINDING SITE III. Table 2 illustrates the complementarity of the nucleotide sequences of LOC148147 BINDING SITE, designated SEQ ID:38477, to the nucleotide sequence of VGAM1704 RNA, herein designated VGAM RNA, also designated SEQ ID:4415.

Another function of VGAM1704 is therefore inhibition of LOC148147 (Accession XM_086071). Accordingly, utilities of VGAM1704 include diagnosis, prevention and treatment of diseases and clinical conditions associated with LOC148147. LOC149460 (Accession XM_097652) is another VGAM1704 host target gene. LOC149460 BINDING SITE is HOST TARGET binding site found in the 3' untranslated region of mRNA encoded by LOC149460, corresponding to a HOST TARGET binding site such as BINDING SITE I, BINDING SITE II or BINDING SITE III. Table 2 illustrates the complementarity of the nucleotide sequences of LOC149460 BINDING SITE, designated SEQ ID:40998, to the nucleotide sequence of VGAM1704 RNA, herein designated VGAM RNA, also designated SEQ ID:4415.

Another function of VGAM1704 is therefore inhibition of LOC149460 (Accession XM_097652). Accordingly, utilities of VGAM1704 include diagnosis, prevention and treatment of diseases and clinical conditions associated with LOC149460. LOC158819 (Accession XM_098995) is another VGAM1704 host target gene. LOC158819 BINDING SITE is HOST TARGET binding site found in the 3' untranslated region of mRNA encoded by LOC158819, corresponding to a HOST TARGET binding site such as BINDING SITE I, BINDING SITE II or BINDING SITE III. Table 2 illustrates the complementarity of the nucleotide sequences of LOC158819 BINDING SITE, designated SEQ ID:42029, to the nucleotide sequence of VGAM1704 RNA, herein designated VGAM RNA, also designated SEQ ID:4415.

Another function of VGAM1704 is therefore inhibition of LOC158819 (Accession XM_098995). Accordingly, utilities of VGAM1704 include diagnosis, prevention and treatment of diseases and clinical conditions associated with LOC158819. LOC169026 (Accession XM_095471) is another VGAM1704 host target gene. LOC169026 BINDING SITE is HOST TARGET binding site found in the 5' untranslated region of mRNA encoded by LOC169026, corresponding to a HOST TARGET binding site such as BINDING SITE I, BINDING SITE II or BINDING SITE III. Table 2 illustrates the complementarity of the nucleotide sequences of LOC169026 BINDING SITE, designated SEQ ID:40269, to the nucleotide sequence of VGAM1704 RNA, herein designated VGAM RNA, also designated SEQ ID:4415.

Another function of VGAM1704 is therefore inhibition of LOC169026 (Accession XM_095471). Accordingly, utilities of VGAM1704 include diagnosis, prevention and treatment of diseases and clinical conditions associated with LOC169026. LOC196955 (Accession XM_085210) is another VGAM1704 host target gene. LOC196955 BINDING SITE is HOST TARGET binding site found in the 3' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37931, to the nucleotide sequence of VGAM1704 RNA, herein designated VGAM RNA, also designated SEQ ID:4415.

Another function of VGAM1704 is therefore inhibition of LOC196955 (Accession XM_085210). Accordingly, utilities of VGAM1704 include diagnosis, prevention and treatment of diseases and clinical conditions associated with LOC196955. LOC199678 (Accession XM_117111) is another VGAM1704 host target gene. LOC199678 BINDING SITE is HOST TARGET binding site found in the 3' untranslated region of mRNA encoded by LOC199678, corresponding to a HOST TARGET binding site such as BINDING SITE I, BINDING SITE II or BINDING SITE III. Table 2 illustrates the complementarity of the nucleotide sequences of LOC199678 BINDING SITE, designated SEQ ID:43227, to the nucleotide sequence of VGAM1704 RNA, herein designated VGAM RNA, also designated SEQ ID:4415.

Another function of VGAM1704 is therefore inhibition of LOC199678 (Accession XM_117111). Accordingly, utilities of VGAM1704 include diagnosis, prevention and treatment of diseases and clinical conditions associated with LOC199678. LOC58489 (Accession XM_051862) is another VGAM1704 host target gene. LOC58489 BINDING SITE is HOST TARGET binding site found in the 3' untranslated region of mRNA encoded by LOC58489, corresponding to a HOST TARGET binding site such as BINDING SITE I, BINDING SITE II or BINDING SITE III. Table 2 illustrates the complementarity of the nucleotide sequences of LOC58489 BINDING SITE, designated SEQ ID:35908, to the nucleotide sequence of VGAM1704 RNA, herein designated VGAM RNA, also designated SEQ ID:4415.

Another function of VGAM1704 is therefore inhibition of LOC58489 (Accession XM_051862). Accordingly, utilities of VGAM1704 include diagnosis, prevention and treatment of diseases and clinical conditions associated with LOC58489. LOC90538 (Accession XM_032401) is another VGAM1704 host target gene. LOC90538 BINDING SITE is HOST TARGET binding site found in the 3' untranslated region of mRNA encoded by LOC90538, corresponding to a HOST TARGET binding site such as BINDING SITE I, BINDING SITE II or BINDING SITE III. Table 2 illustrates the complementarity of the nucleotide sequences of LOC90538 BINDING SITE, designated SEQ ID:31659, to the nucleotide sequence of VGAM1704 RNA, herein designated VGAM RNA, also designated SEQ ID:4415.

Another function of VGAM1704 is therefore inhibition of LOC90538 (Accession XM_032401). Accordingly, utilities of VGAM1704 include diagnosis, prevention and treatment of diseases and clinical conditions associated with LOC90538. LOC93132 (Accession XM_049396) is another VGAM1704 host target gene. LOC93132 BINDING SITE is HOST TARGET binding site found in the 5' untranslated region of mRNA encoded by LOC93132, corresponding to a HOST TARGET binding site such as BINDING SITE I, BINDING SITE II or BINDING SITE III. Table 2 illustrates the complementarity of the nucleotide sequences of LOC93132 BINDING SITE, designated SEQ ID:35411, to the nucleotide sequence of VGAM1704 RNA, herein designated VGAM RNA, also designated SEQ ID:4415.

Another function of VGAM1704 is therefore inhibition of LOC93132 (Accession XM_049396). Accordingly, utilities of VGAM1704 include diagnosis, prevention and treatment of diseases and clinical conditions associated with LOC93132. FIG. 1 further provides a conceptual description of a novel bioinformatically detected viral gene of the present invention, referred to here as Viral Genomic Address Messenger 1705 (VGAM1705) viral gene, which modulates expression of respective host target genes thereof, the function and utility of which host target genes is known in the art.

VGAM1705 is a novel bioinformatically detected regulatory, non protein coding, viral micro RNA (miRNA) gene. The method by which VGAM1705 was detected is described hereinabove with reference to FIGS. 1-8.

VGAM1705 gene, herein designated VGAM GENE, is a viral gene contained in the genome of Ectocarpus Siliculosus Virus. VGAM1705 host target gene, herein designated VGAM HOST TARGET GENE, is a human gene contained in the human genome.

VGAM1705 gene encodes a VGAM1705 precursor RNA, herein designated VGAM PRECURSOR RNA. Similar to other miRNA genes, and unlike most ordinary genes, VGAM1705 precursor RNA does not encode a protein. A nucleotide sequence identical or highly similar to the nucleotide sequence of VGAM1705 precursor RNA is designated SEQ ID:1691, and is provided hereinbelow with reference to the sequence listing part. Nucleotide sequence SEQ ID:1691 is located at position 51223 relative to the genome of Ectocarpus Siliculosus Virus.

VGAM1705 precursor RNA folds onto itself, forming VGAM1705 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1705 folded precursor RNA into VGAM1705 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1705 RNA is designated SEQ ID:4416, and is provided hereinbelow with reference to the sequence listing part.

VGAM1705 host target gene, herein designated VGAM HOST TARGET GENE, encodes a corresponding messenger RNA, VGAM1705 host target RNA, herein designated VGAM HOST TARGET RNA. VGAM1705 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1705 RNA, herein designated VGAM RNA, binds complementarily to one or more host target binding sites located in untranslated regions of VGAM1705 host target RNA, herein designated VGAM HOST TARGET RNA. This complementary binding is due to the fact that the nucleotide sequence of VGAM1705 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1705 RNA, herein designated VGAM RNA, may have a different number of host target binding sites in untranslated regions of a VGAM1705 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1705 RNA, herein designated VGAM RNA, to host target binding sites on VGAM1705 host target RNA, herein designated VGAM HOST TARGET RNA, such as BINDING SITE I, BINDING SITE II and BINDING SITE III, inhibits translation of VGAM1705 host target RNA into VGAM1705 host target protein, herein designated VGAM HOST TARGET PROTEIN. VGAM host target protein is therefore outlined by a broken line.

It is appreciated that VGAM1705 host target gene, herein designated VGAM HOST TARGET GENE, in fact represents a plurality of VGAM1705 host target genes. The mRNA of each one of this plurality of VGAM1705 host target genes comprises one or more host target binding sites, each having a nucleotide sequence which is at least partly complementary to VGAM1705 RNA, herein designated VGAM RNA, and which when bound by VGAM1705 RNA causes inhibition of translation of respective one or more VGAM1705 host target proteins.

It is further appreciated by one skilled in the art that the mode of translational inhibition illustrated by FIG. 1 with specific reference to translational inhibition exerted by VGAM1705 gene, herein designated VGAM GENE, on one or more VGAM1705 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1705 is inhibition of expression of host target genes, as part of a novel viral mechanism of attacking a host. Accordingly, utilities of VGAM1705 include diagnosis, prevention and treatment of viral infection by Ectocarpus Siliculosus Virus. Specific functions, and accordingly utilities, of VGAM1705 correlate with, and may be deduced from, the identity of the host target genes which VGAM1705 binds and inhibits, and the function of these host target genes, as elaborated hereinbelow.

Nucleotide sequences of the VGAM1705 precursor RNA, herein designated VGAM PRECURSOR RNA, and of the 'diced' VGAM1705 RNA, herein designated VGAM RNA, and a schematic representation of the secondary folding of VGAM1705 folded precursor RNA, herein designated VGAM FOLDED PRECURSOR RNA, of VGAM1705 are further described hereinbelow with reference to Table 1.

Nucleotide sequences of host target binding sites, such as BINDING SITE-I, BINDING SITE-II and BINDING SITE-III of FIG. 1, found on VGAM1705 host target RNA, and schematic representation of the complementarity of each of these host target binding sites to VGAM1705 RNA, herein designated VGAM RNA, are described hereinbelow with reference to Table 2.

As mentioned hereinabove with reference to FIG. 1, a function of VGAM1705 gene, herein designated VGAM is inhibition of expression of VGAM1705 target genes. It is appreciated that specific functions, and accordingly utilities, of VGAM1705 correlate with, and may be deduced from, the identity of the target genes which VGAM1705 binds and inhibits, and the function of these target genes, as elaborated hereinbelow.

Cystinosis, Nephropathic (CTNS, Accession NM_004937) is a VGAM1705 host target gene. CTNS BINDING SITE is HOST TARGET binding site found in the 3' untranslated region of mRNA encoded by CTNS, corresponding to a HOST TARGET binding site such as BINDING SITE I, BINDING SITE II or BINDING SITE III. Table 2 illustrates the complementarity of the nucleotide sequences of CTNS BINDING SITE, designated SEQ ID:11383, to the nucleotide sequence of VGAM1705 RNA, herein designated VGAM RNA, also designated SEQ ID:4416.

A function of VGAM1705 is therefore inhibition of Cystinosis, Nephropathic (CTNS, Accession NM_004937). Accordingly, utilities of VGAM1705 include diagnosis, prevention and treatment of diseases and clinical conditions associated with CTNS. Protein Kinase C, Nu (PRKCN, Accession NM_005813) is another VGAM1705 host target gene. PRKCN BINDING SITE is HOST TARGET binding site found in the 3' untranslated region of mRNA encoded by PRKCN, corresponding to a HOST TARGET binding site such as BINDING SITE I, BINDING SITE II or BINDING SITE III. Table 2 illustrates the complementarity of the nucleotide sequences of PRKCN BINDING SITE, designated SEQ ID:12398, to the nucleotide sequence of VGAM1705 RNA, herein designated VGAM RNA, also designated SEQ ID:4416.

Another function of VGAM1705 is therefore inhibition of Protein Kinase C, Nu (PRKCN, Accession NM_005813). Accordingly, utilities of VGAM1705 include diagnosis, prevention and treatment of diseases and clinical conditions associated with PRKCN. Calcium/calmodulin-dependent Protein Kinase Kinase 1, Alpha (CAMKK1, Accession NM_032294) is another VGAM1705 host target gene. CAMKK1 BINDING SITE is HOST TARGET binding site found in the 3' untranslated region of mRNA encoded by CAMKK1, corresponding to a HOST TARGET binding site such as BINDING SITE I, BINDING SITE II or BINDING SITE III. Table 2 illustrates the complementarity of the nucleotide sequences of CAMKK1 BINDING SITE, designated SEQ ID:26065, to the nucleotide sequence of VGAM1705 RNA, herein designated VGAM RNA, also designated SEQ ID:4416.

Another function of VGAM1705 is therefore inhibition of Calcium/calmodulin-dependent Protein Kinase Kinase 1, Alpha (CAMKK1, Accession NM_032294). Accordingly, utilities of VGAM1705 include diagnosis, prevention and treatment of diseases and clinical conditions associated with CAMKK1. SYNE-2 (Accession NM_015180) is another VGAM1705 host target gene. SYNE-2 BINDING SITE is HOST TARGET binding site found in the 3' untranslated region of mRNA encoded by SYNE-2, corresponding to a HOST TARGET binding site such as BINDING SITE I, BINDING SITE II or BINDING SITE III. Table 2 illustrates the complementarity of the nucleotide sequences of SYNE-2 BINDING SITE, designated SEQ ID:17535, to the nucleotide sequence of VGAM1705 RNA, herein designated VGAM RNA, also designated SEQ ID:4416.

Another function of VGAM1705 is therefore inhibition of SYNE-2 (Accession NM_015180). Accordingly, utilities of VGAM1705 include diagnosis, prevention and treatment of diseases and clinical conditions associated with SYNE-2. ZF (Accession NM_021212) is another VGAM1705 host target gene. ZF BINDING SITE is HOST TARGET binding site found in the 5' untranslated region of mRNA encoded by ZF, corresponding to a HOST TARGET binding site such as BINDING SITE I, BINDING SITE II or BINDING SITE III. Table 2 illustrates the complementarity of the nucleotide sequences of ZF BINDING SITE, designated SEQ ID:22189, to the nucleotide sequence of VGAM1705 RNA, herein designated VGAM RNA, also designated SEQ ID:4416.

Another function of VGAM1705 is therefore inhibition of ZF (Accession NM_021212). Accordingly, utilities of VGAM1705 include diagnosis, prevention and treatment of diseases and clinical conditions associated with ZF. FIG. 1 further provides a conceptual description of a novel bioinformatically detected viral gene of the present invention, referred to here as Viral Genomic Address Messenger 1706 (VGAM1706) viral gene, which modulates expression of respective host target genes thereof, the function and utility of which host target genes is known in the art.

VGAM1706 is a novel bioinformatically detected regulatory, non protein coding, viral micro RNA (miRNA) gene. The method by which VGAM1706 was detected is described hereinabove with reference to FIGS. 1-8.

VGAM1706 gene, herein designated VGAM GENE, is a viral gene contained in the genome of Ectocarpus Siliculosus Virus. VGAM1706 host target gene, herein designated VGAM HOST TARGET GENE, is a human gene contained in the human genome.

VGAM1706 gene encodes a VGAM1706 precursor RNA, herein designated VGAM PRECURSOR RNA. Similar to other miRNA genes, and unlike most ordinary genes, VGAM1706 precursor RNA does not encode a protein. A nucleotide sequence identical or highly similar to the nucleotide sequence of VGAM1706 precursor RNA is designated SEQ ID:1692, and is provided hereinbelow with reference to the sequence listing part. Nucleotide sequence SEQ ID:1692 is located at position 54780 relative to the genome of Ectocarpus Siliculosus Virus.

VGAM1706 precursor RNA folds onto itself, forming VGAM1706 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1706 folded precursor RNA into VGAM1706 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1706 RNA is designated SEQ ID:4417, and is provided hereinbelow with reference to the sequence listing part.

VGAM1706 host target gene, herein designated VGAM HOST TARGET GENE, encodes a corresponding messenger RNA, VGAM1706 host target RNA, herein designated VGAM HOST TARGET RNA. VGAM1706 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1706 RNA, herein designated VGAM RNA, binds complementarily to one or more host target binding sites located in untranslated regions of VGAM1706 host target RNA, herein designated VGAM HOST TARGET RNA. This complementary binding is due to the fact that the nucleotide sequence of VGAM1706 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1706 RNA, herein designated VGAM RNA, may have a different number of host target binding sites in untranslated regions of a VGAM1706 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1706 RNA, herein designated VGAM RNA, to host target binding sites on VGAM1706 host target RNA, herein designated VGAM HOST TARGET RNA, such as BINDING SITE I, BINDING SITE II and BINDING SITE III, inhibits translation of VGAM1706 host target RNA into VGAM1706 host target protein, herein designated VGAM HOST TARGET PROTEIN. VGAM host target protein is therefore outlined by a broken line.

It is appreciated that VGAM1706 host target gene, herein designated VGAM HOST TARGET GENE, in fact represents a plurality of VGAM1706 host target genes. The mRNA of each one of this plurality of VGAM1706 host target genes comprises one or more host target binding sites, each having a nucleotide sequence which is at least partly complementary to VGAM1706 RNA, herein designated VGAM RNA, and which when bound by VGAM1706 RNA causes inhibition of translation of respective one or more VGAM1706 host target proteins.

It is further appreciated by one skilled in the art that the mode of translational inhibition illustrated by FIG. 1 with specific reference to translational inhibition exerted by VGAM1706 gene, herein designated VGAM GENE, on one or more VGAM1706 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1706 is inhibition of expression of host target genes, as part of a novel viral mechanism of attacking a host. Accordingly, utilities of VGAM1706 include diagnosis, prevention and treatment of viral infection by Ectocarpus Siliculosus Virus. Specific functions, and accordingly utilities, of VGAM1706 correlate with, and may be deduced from, the identity of the host target genes which VGAM1706 binds and inhibits, and the function of these host target genes, as elaborated hereinbelow.

Nucleotide sequences of the VGAM1706 precursor RNA, herein designated VGAM PRECURSOR RNA, and of the 'diced' VGAM1706 RNA, herein designated VGAM RNA, and a schematic representation of the secondary folding of VGAM1706 folded precursor RNA, herein designated VGAM FOLDED PRECURSOR RNA, of VGAM1706 are further described hereinbelow with reference to Table 1.

Nucleotide sequences of host target binding sites, such as BINDING SITE-I, BINDING SITE-II and BINDING SITE-III of FIG. 1, found on VGAM1706 host target RNA, and schematic representation of the complementarity of each of these host target binding sites to VGAM1706 RNA, herein designated VGAM RNA, are described hereinbelow with reference to Table 2.

As mentioned hereinabove with reference to FIG. 1, a function of VGAM1706 gene, herein designated VGAM is inhibition of expression of VGAM1706 target genes. It is appreciated that specific functions, and accordingly utilities, of VGAM1706 correlate with, and may be deduced from, the identity of the target genes which VGAM1706 binds and inhibits, and the function of these target genes, as elaborated hereinbelow.

Ephrin-B2 (EFNB2, Accession NM_004093) is a VGAM1706 host target gene. EFNB2 BINDING SITE is HOST TARGET binding site found in the 3' untranslated region of mRNA encoded by EFNB2, corresponding to a HOST TARGET binding site such as BINDING SITE I, BINDING SITE II or BINDING SITE III. Table 2 illustrates the complementarity of the nucleotide sequences of EFNB2 BINDING SITE, designated SEQ ID:10297, to the nucleotide sequence of VGAM1706 RNA, herein designated VGAM RNA, also designated SEQ ID:4417.

A function of VGAM1706 is therefore inhibition of Ephrin-B2 (EFNB2, Accession NM_004093). Accordingly, utilities of VGAM1706 include diagnosis, prevention and treatment of diseases and clinical conditions associated with EFNB2. Early Growth Response 1 (EGR1, Accession NM_001964) is another VGAM1706 host target gene. EGR1 BINDING SITE is HOST TARGET binding site found in the 5' untranslated region of mRNA encoded by EGR1, corresponding to a HOST TARGET binding site such as BINDING SITE I, BINDING SITE II or BINDING SITE III. Table 2 illustrates the complementarity of the nucleotide sequences of EGR1 BINDING SITE, designated SEQ ID:7692, to the nucleotide sequence of VGAM1706 RNA, herein designated VGAM RNA, also designated SEQ ID:4417.

Another function of VGAM1706 is therefore inhibition of Early Growth Response 1 (EGR1, Accession NM_001964). Accordingly, utilities of VGAM1706 include diagnosis, prevention and treatment of diseases and clinical conditions associated with EGR1. Fibroblast Growth Factor 2 (basic) (FGF2, Accession NM_002006) is another VGAM1706 host target gene. FGF2 BINDING SITE is HOST TARGET binding site found in the 3' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7744, to the nucleotide sequence of VGAM1706 RNA, herein designated VGAM RNA, also designated SEQ ID:4417.

Another function of VGAM1706 is therefore inhibition of Fibroblast Growth Factor 2 (basic) (FGF2, Accession NM_002006), a gene which probably involved in nervous system development and function. Accordingly, utilities of VGAM1706 include diagnosis, prevention and treatment of diseases and clinical conditions associated with FGF2. The function of FGF2 and its association with various diseases and clinical conditions, has been established by previous studies, as described hereinabove with reference to VGAM51. 5-hydroxytryptamine (serotonin) Receptor 2C (HTR2C, Accession NM_000868) is another VGAM1706 host target gene. HTR2C BINDING SITE is HOST TARGET binding site found in the 5' untranslated region of mRNA encoded by HTR2C, corresponding to a HOST TARGET binding site such as BINDING SITE I, BINDING SITE II or BINDING SITE III. Table 2 illustrates the complementarity of the nucleotide sequences of HTR2C BINDING SITE, designated SEQ ID:6535, to the nucleotide sequence of VGAM1706 RNA, herein designated VGAM RNA, also designated SEQ ID:4417.

Another function of VGAM1706 is therefore inhibition of 5-hydroxytryptamine (serotonin) Receptor 2C (HTR2C, Accession NM_000868), a gene which activates phospholipase C and regulates intracellular calcium flux. Accordingly, utilities of VGAM1706 include diagnosis, prevention and treatment of diseases and clinical conditions associated with HTR2C. The function of HTR2C and its association with various diseases and clinical conditions, has been established by previous studies, as described hereinabove with reference to VGAM1052. Inositol 1,4,5-triphosphate Receptor, Type 3 (ITPR3, Accession NM_002224) is another VGAM1706 host target gene. ITPR3 BINDING SITE is HOST TARGET binding site found in the 3' untranslated region of mRNA encoded by ITPR3, corresponding to a HOST TARGET binding site such as BINDING SITE I, BINDING SITE II or BINDING SITE III. Table 2 illustrates the complementarity of the nucleotide sequences of ITPR3 BINDING SITE, designated SEQ ID:7999, to the nucleotide sequence of VGAM1706 RNA, herein designated VGAM RNA, also designated SEQ ID:4417.

Another function of VGAM1706 is therefore inhibition of Inositol 1,4,5-triphosphate Receptor, Type 3 (ITPR3, Accession NM_002224), a gene which may be responsible for calcium release from intracellular stores. Accordingly, utilities of VGAM1706 include diagnosis, prevention and treatment of diseases and clinical conditions associated with ITPR3. The function of ITPR3 and its association with various diseases and clinical conditions, has been established by previous studies, as described hereinabove with reference to VGAM310. Proteasome (prosome, macropain) Subunit, Beta Type, 2 (PSMB2, Accession NM_002794) is another VGAM1706 host target gene. PSMB2 BINDING SITE is HOST TARGET binding site found in the 3' untranslated region of mRNA encoded by PSMB2, corresponding to a HOST TARGET binding site such as BINDING SITE I, BINDING SITE II or BINDING SITE III. Table 2 illustrates the complementarity of the nucleotide sequences of PSMB2 BINDING SITE, designated SEQ ID:8673, to the nucleotide sequence of VGAM1706 RNA, herein designated VGAM RNA, also designated SEQ ID:4417.

Another function of VGAM1706 is therefore inhibition of Proteasome (prosome, macropain) Subunit, Beta Type, 2 (PSMB2, Accession NM_002794). Accordingly, utilities of VGAM1706 include diagnosis, prevention and treatment of diseases and clinical conditions associated with PSMB2. Calneuron 1 (CALN1, Accession NM_031468) is another VGAM1706 host target gene. CALN1 BINDING SITE is HOST TARGET binding site found in the 3' untranslated region of mRNA encoded by CALN1, corresponding to a HOST TARGET binding site such as BINDING SITE I, BINDING SITE II or BINDING SITE III. Table 2 illustrates the complementarity of the nucleotide sequences of CALN1 BINDING SITE, designated SEQ ID:25519, to the nucleotide sequence of VGAM1706 RNA, herein designated VGAM RNA, also designated SEQ ID:4417.

Another function of VGAM1706 is therefore inhibition of Calneuron 1 (CALN1, Accession NM_031468). Accordingly, utilities of VGAM1706 include diagnosis, prevention and treatment of diseases and clinical conditions associated with CALN1. Calcium/calmodulin-dependent Protein Kinase Kinase 1, Alpha (CAMKK1, Accession NM_032294) is another VGAM1706 host target gene. CAMKK1 BINDING SITE is HOST TARGET binding site found in the 3' untranslated region of mRNA encoded by CAMKK1, corresponding to a HOST TARGET binding site such as BINDING SITE I, BINDING SITE II or BINDING SITE III. Table 2 illustrates the complementarity of the nucleotide sequences of CAMKK1 BINDING SITE, designated SEQ ID:26068, to the nucleotide sequence of VGAM1706 RNA, herein designated VGAM RNA, also designated SEQ ID:4417.

Another function of VGAM1706 is therefore inhibition of Calcium/calmodulin-dependent Protein Kinase Kinase 1, Alpha (CAMKK1, Accession NM_032294). Accordingly, utilities of VGAM1706 include diagnosis, prevention and treatment of diseases and clinical conditions associated with CAMKK1. DC-TM4F2 (Accession NM_030927) is another VGAM1706 host target gene. DC-TM4F2 BINDING SITE is HOST TARGET binding site found in the 3' untranslated region of mRNA encoded by DC-TM4F2, corresponding to a HOST TARGET binding site such as BINDING SITE I, BINDING SITE II or BINDING SITE III. Table 2 illustrates the complementarity of the nucleotide sequences of DC-TM4F2 BINDING SITE, designated SEQ ID:25199, to the nucleotide sequence of VGAM1706 RNA, herein designated VGAM RNA, also designated SEQ ID:4417.

Another function of VGAM1706 is therefore inhibition of DC-TM4F2 (Accession NM_030927). Accordingly, utilities of VGAM1706 include diagnosis, prevention and treatment of diseases and clinical conditions associated with DC-TM4F2. DEAD/H (Asp-Glu-Ala-Asp/His) Box Polypeptide 34 (DDX34, Accession NM_014681) is another VGAM1706 host target gene. DDX34 BINDING SITE is HOST TARGET binding site found in the 3' untranslated region of mRNA encoded by DDX34, corresponding to a HOST TARGET binding site such as BINDING SITE I, BINDING SITE II or BINDING SITE III. Table 2 illustrates the complementarity of the nucleotide sequences of DDX34 BINDING SITE, designated SEQ ID:16169, to the nucleotide sequence of VGAM1706 RNA, herein designated VGAM RNA, also designated SEQ ID:4417.

Another function of VGAM1706 is therefore inhibition of DEAD/H (Asp-Glu-Ala-Asp/His) Box Polypeptide 34 (DDX34, Accession NM_014681). Accordingly, utilities of VGAM1706 include diagnosis, prevention and treatment of diseases and clinical conditions associated with DDX34. DRIL2 (Accession NM_006465) is another VGAM1706 host target gene. DRIL2 BINDING SITE is HOST TARGET binding site found in the 3' untranslated region of mRNA encoded by DRIL2, corresponding to a HOST TARGET binding site such as BINDING SITE I, BINDING SITE II or BINDING SITE III. Table 2 illustrates the complementarity of the nucleotide sequences of DRIL2 BINDING SITE, designated SEQ ID:13188, to the nucleotide sequence of VGAM1706 RNA, herein designated VGAM RNA, also designated SEQ ID:4417.

Another function of VGAM1706 is therefore inhibition of DRIL2 (Accession NM_006465). Accordingly, utilities of VGAM1706 include diagnosis, prevention and treatment of diseases and clinical conditions associated with DRIL2. FLJ12294 (Accession NM_025100) is another VGAM1706 host target gene. FLJ12294 BINDING SITE is HOST TARGET binding site found in the 3' untranslated region of mRNA encoded by FLJ12294, corresponding to a HOST TARGET binding site such as BINDING SITE I, BINDING SITE II or BINDING SITE III. Table 2 illustrates the complementarity of the nucleotide sequences of FLJ12294 BINDING SITE, designated SEQ ID:24743, to the nucleotide sequence of VGAM1706 RNA, herein designated VGAM RNA, also designated SEQ ID:4417.

Another function of VGAM1706 is therefore inhibition of FLJ12294 (Accession NM_025100). Accordingly, utilities of VGAM1706 include diagnosis, prevention and treatment of diseases and clinical conditions associated with FLJ12294. FLJ13456 (Accession XM_038291) is another VGAM1706 host target gene. FLJ13456 BINDING SITE is HOST TARGET binding site found in the 3' untranslated region of mRNA encoded by FLJ13456, corresponding to a HOST TARGET binding site such as BINDING SITE I, BINDING SITE II or BINDING SITE III. Table 2 illustrates the complementarity of the nucleotide sequences of FLJ13456 BINDING SITE, designated SEQ ID:32800, to the nucleotide sequence of VGAM1706 RNA, herein designated VGAM RNA, also designated SEQ ID:4417.

Another function of VGAM1706 is therefore inhibition of FLJ13456 (Accession XM_038291). Accordingly, utilities of VGAM1706 include diagnosis, prevention and treatment of diseases and clinical conditions associated with FLJ13456. FLJ20489 (Accession NM_017842) is another VGAM1706 host target gene. FLJ20489 BINDING SITE is HOST TARGET binding site found in the 5' untranslated region of mRNA encoded by FLJ20489, corresponding to a HOST TARGET binding site such as BINDING SITE I, BINDING SITE II or BINDING SITE III. Table 2 illustrates the complementarity of the nucleotide sequences of FLJ20489 BINDING SITE, designated SEQ ID:19507, to the nucleotide sequence of VGAM1706 RNA, herein designated VGAM RNA, also designated SEQ ID:4417.

Another function of VGAM1706 is therefore inhibition of FLJ20489 (Accession NM_017842). Accordingly, utilities of VGAM1706 include diagnosis, prevention and treatment of diseases and clinical conditions associated with FLJ20489. FLJ21551 (Accession NM_024801) is another VGAM1706 host target gene. FLJ21551 BINDING SITE is HOST TARGET binding site found in the 3' untranslated region of mRNA encoded by FLJ21551, corresponding to a HOST TARGET binding site such as BINDING SITE I, BINDING SITE II or BINDING SITE III. Table 2 illustrates the complementarity of the nucleotide sequences of FLJ21551 BINDING SITE, designated SEQ ID:24181, to the nucleotide sequence of VGAM1706 RNA, herein designated VGAM RNA, also designated SEQ ID:4417.

Another function of VGAM1706 is therefore inhibition of FLJ21551 (Accession NM_024801). Accordingly, utilities of VGAM1706 include diagnosis, prevention and treatment of diseases and clinical conditions associated with FLJ21551. FLJ22362 (Accession NM_022823) is another VGAM1706 host target gene. FLJ22362 BINDING SITE is HOST TARGET binding site found in the 5' untranslated region of mRNA encoded by FLJ22362, corresponding to a HOST TARGET binding site such as BINDING SITE I, BINDING SITE II or BINDING SITE III. Table 2 illustrates the complementarity of the nucleotide sequences of FLJ22362 BINDING SITE, designated SEQ ID:23105, to the nucleotide sequence of VGAM1706 RNA, herein designated VGAM RNA, also designated SEQ ID:4417.

Another function of VGAM1706 is therefore inhibition of FLJ22362 (Accession NM_022823). Accordingly, utilities of VGAM1706 include diagnosis, prevention and treatment of diseases and clinical conditions associated with FLJ22362. FLJ22692 (Accession NM_025049) is another VGAM1706 host target gene. FLJ22692 BINDING SITE is HOST TARGET binding site found in the 3' untranslated region of mRNA encoded by FLJ22692, corresponding to a HOST TARGET binding site such as BINDING SITE I, BINDING SITE II or BINDING SITE III. Table 2 illustrates the complementarity of the nucleotide sequences of FLJ22692 BINDING SITE, designated SEQ ID:24644, to the nucleotide sequence of VGAM1706 RNA, herein designated VGAM RNA, also designated SEQ ID:4417.

Another function of VGAM1706 is therefore inhibition of FLJ22692 (Accession NM_025049). Accordingly, utilities of VGAM1706 include diagnosis, prevention and treatment of diseases and clinical conditions associated with FLJ22692. FLJ23598 (Accession XM_170689) is another VGAM1706 host target gene. FLJ23598 BINDING SITE is HOST TARGET binding site found in the 5' untranslated region of mRNA encoded by FLJ23598, corresponding to a HOST TARGET binding site such as BINDING SITE I, BINDING SITE II or BINDING SITE III. Table 2 illustrates the complementarity of the nucleotide sequences of FLJ23598 BINDING SITE, designated SEQ ID:45468, to the nucleotide sequence of VGAM1706 RNA, herein designated VGAM RNA, also designated SEQ ID:4417.

Another function of VGAM1706 is therefore inhibition of FLJ23598 (Accession XM_170689). Accordingly, utilities of VGAM1706 include diagnosis, prevention and treatment of diseases and clinical conditions associated with FLJ23598.

KIAA0795 (Accession NM_025010) is another VGAM1706 host target gene. KIAA0795 BINDING SITE is HOST TARGET binding site found in the 3' untranslated region of mRNA encoded by KIAA0795, corresponding to a HOST TARGET binding site such as BINDING SITE I, BINDING SITE II or BINDING SITE III. Table 2 illustrates the complementarity of the nucleotide sequences of KIAA0795 BINDING SITE, designated SEQ ID:24588, to the nucleotide sequence of VGAM1706 RNA, herein designated VGAM RNA, also designated SEQ ID:4417.

Another function of VGAM1706 is therefore inhibition of KIAA0795 (Accession NM_025010). Accordingly, utilities of VGAM1706 include diagnosis, prevention and treatment of diseases and clinical conditions associated with KIAA0795. KIAA1872 (Accession XM_031917) is another VGAM1706 host target gene. KIAA1872 BINDING SITE is HOST TARGET binding site found in the 3' untranslated region of mRNA encoded by KIAA1872, corresponding to a HOST TARGET binding site such as BINDING SITE I, BINDING SITE II or BINDING SITE III. Table 2 illustrates the complementarity of the nucleotide sequences of KIAA1872 BINDING SITE, designated SEQ ID:31518, to the nucleotide sequence of VGAM1706 RNA, herein designated VGAM RNA, also designated SEQ ID:4417.

Another function of VGAM1706 is therefore inhibition of KIAA1872 (Accession XM_031917). Accordingly, utilities of VGAM1706 include diagnosis, prevention and treatment of diseases and clinical conditions associated with KIAA1872. LGP1 (Accession NM_032484) is another VGAM1706 host target gene. LGP1 BINDING SITE is HOST TARGET binding site found in the 5' untranslated region of mRNA encoded by LGP1, corresponding to a HOST TARGET binding site such as BINDING SITE I, BINDING SITE II or BINDING SITE III. Table 2 illustrates the complementarity of the nucleotide sequences of LGP1 BINDING SITE, designated SEQ ID:26232, to the nucleotide sequence of VGAM1706 RNA, herein designated VGAM RNA, also designated SEQ ID:4417.

Another function of VGAM1706 is therefore inhibition of LGP1 (Accession NM_032484). Accordingly, utilities of VGAM1706 include diagnosis, prevention and treatment of diseases and clinical conditions associated with LGP1. Mitogen-activated Protein Kinase Kinase 4 (MAP2K4, Accession NM_003010) is another VGAM1706 host target gene. MAP2K4 BINDING SITE is HOST TARGET binding site found in the 3' untranslated region of mRNA encoded by MAP2K4, corresponding to a HOST TARGET binding site such as BINDING SITE I, BINDING SITE II or BINDING SITE III. Table 2 illustrates the complementarity of the nucleotide sequences of MAP2K4 BINDING SITE, designated SEQ ID:8917, to the nucleotide sequence of VGAM1706 RNA, herein designated VGAM RNA, also designated SEQ ID:4417.

Another function of VGAM1706 is therefore inhibition of Mitogen-activated Protein Kinase Kinase 4 (MAP2K4, Accession NM_003010). Accordingly, utilities of VGAM1706 include diagnosis, prevention and treatment of diseases and clinical conditions associated with MAP2K4. MGC29891 (Accession NM_144618) is another VGAM1706 host target gene. MGC29891 BINDING SITE is HOST TARGET binding site found in the 3' untranslated region of mRNA encoded by MGC29891, corresponding to a HOST TARGET binding site such as BINDING SITE I, BINDING SITE II or BINDING SITE III. Table 2 illustrates the complementarity of the nucleotide sequences of MGC29891 BINDING SITE, designated SEQ ID:29438, to the nucleotide sequence of VGAM1706 RNA, herein designated VGAM RNA, also designated SEQ ID:4417.

Another function of VGAM1706 is therefore inhibition of MGC29891 (Accession NM_144618). Accordingly, utilities of VGAM1706 include diagnosis, prevention and treatment of diseases and clinical conditions associated with MGC29891. Nup43 (Accession NM_024647) is another VGAM1706 host target gene. Nup43 BINDING SITE is HOST TARGET binding site found in the 3' untranslated region of mRNA encoded by Nup43, corresponding to a HOST TARGET binding site such as BINDING SITE I, BINDING SITE II or BINDING SITE III. Table 2 illustrates the complementarity of the nucleotide sequences of Nup43 BINDING SITE, designated SEQ ID:23937, to the nucleotide sequence of VGAM1706 RNA, herein designated VGAM RNA, also designated SEQ ID:4417.

Another function of VGAM1706 is therefore inhibition of Nup43 (Accession NM_024647). Accordingly, utilities of VGAM1706 include diagnosis, prevention and treatment of diseases and clinical conditions associated with Nup43. Neurexophilin 3 (NXPH3, Accession XM_037847) is another VGAM1706 host target gene. NXPH3 BINDING SITE is HOST TARGET binding site found in the 3' untranslated region of mRNA encoded by NXPH3, corresponding to a HOST TARGET binding site such as BINDING SITE I, BINDING SITE II or BINDING SITE III. Table 2 illustrates the complementarity of the nucleotide sequences of NXPH3 BINDING SITE, designated SEQ ID:32715, to the nucleotide sequence of VGAM1706 RNA, herein designated VGAM RNA, also designated SEQ ID:4417.

Another function of VGAM1706 is therefore inhibition of Neurexophilin 3 (NXPH3, Accession XM_037847). Accordingly, utilities of VGAM1706 include diagnosis, prevention and treatment of diseases and clinical conditions associated with NXPH3. Regulator of G-protein Signalling 11 (RGS11, Accession NM_003834) is another VGAM1706 host target gene. RGS11 BINDING SITE is HOST TARGET binding site found in the 3' untranslated region of mRNA encoded by RGS11, corresponding to a HOST TARGET binding site such as BINDING SITE I, BINDING SITE II or BINDING SITE III. Table 2 illustrates the complementarity of the nucleotide sequences of RGS11 BINDING SITE, designated SEQ ID:9925, to the nucleotide sequence of VGAM1706 RNA, herein designated VGAM RNA, also designated SEQ ID:4417.

Another function of VGAM1706 is therefore inhibition of Regulator of G-protein Signalling 11 (RGS11, Accession NM_003834). Accordingly, utilities of VGAM1706 include diagnosis, prevention and treatment of diseases and clinical conditions associated with RGS11. ZAK (Accession NM_133646) is another VGAM1706 host target gene. ZAK BINDING SITE is HOST TARGET binding site found in the 3' untranslated region of mRNA encoded by ZAK, corresponding to a HOST TARGET binding site such as BINDING SITE I, BINDING SITE II or BINDING SITE III. Table 2 illustrates the complementarity of the nucleotide sequences of ZAK BINDING SITE, designated SEQ ID:28606, to the nucleotide sequence of VGAM1706 RNA, herein designated VGAM RNA, also designated SEQ ID:4417.

Another function of VGAM1706 is therefore inhibition of ZAK (Accession NM_133646). Accordingly, utilities of VGAM1706 include diagnosis, prevention and treatment of diseases and clinical conditions associated with ZAK. LOC115129 (Accession XM_055292) is another VGAM1706 host target gene. LOC115129 BINDING SITE is HOST TARGET binding site found in the 3' untranslated region of mRNA encoded by LOC115129, corresponding to a HOST TARGET binding site such as BINDING SITE I, BINDING SITE II or BINDING SITE III. Table 2 illustrates the complementarity of the nucleotide sequences of LOC115129 BINDING SITE, designated SEQ ID:36255, to the nucleotide sequence of VGAM1706 RNA, herein designated VGAM RNA, also designated SEQ ID:4417.

Another function of VGAM1706 is therefore inhibition of LOC115129 (Accession XM_055292). Accordingly, utilities of VGAM1706 include diagnosis, prevention and treatment of diseases and clinical conditions associated with LOC115129. LOC115330 (Accession NM_138445) is another VGAM1706 host target gene. LOC115330 BINDING SITE is HOST TARGET binding site found in the 3' untranslated region of mRNA encoded by LOC115330, corresponding to a HOST TARGET binding site such as BINDING SITE I, BINDING SITE II or BINDING SITE III. Table 2 illustrates the complementarity of the nucleotide sequences of LOC115330 BINDING SITE, designated SEQ ID:28811, to the nucleotide sequence of VGAM1706 RNA, herein designated VGAM RNA, also designated SEQ ID:4417.

Another function of VGAM1706 is therefore inhibition of LOC115330 (Accession NM_138445). Accordingly, utilities of VGAM1706 include diagnosis, prevention and treatment of diseases and clinical conditions associated with LOC115330. LOC116437 (Accession XM_058185) is another VGAM1706 host target gene. LOC116437 BINDING SITE is HOST TARGET binding site found in the 3' untranslated region of mRNA encoded by LOC116437, corresponding to a HOST TARGET binding site such as BINDING SITE I, BINDING SITE II or BINDING SITE III. Table 2 illustrates the complementarity of the nucleotide sequences of LOC116437 BINDING SITE, designated SEQ ID:36582, to the nucleotide sequence of VGAM1706 RNA, herein designated VGAM RNA, also designated SEQ ID:4417.

Another function of VGAM1706 is therefore inhibition of LOC116437 (Accession XM_058185). Accordingly, utilities of VGAM1706 include diagnosis, prevention and treatment of diseases and clinical conditions associated with LOC116437. LOC145955 (Accession XM_096912) is another VGAM1706 host target gene. LOC145955 BINDING SITE is HOST TARGET binding site found in the 5' untranslated region of mRNA encoded by LOC145955, corresponding to a HOST TARGET binding site such as BINDING SITE I, BINDING SITE II or BINDING SITE III. Table 2 illustrates the complementarity of the nucleotide sequences of LOC145955 BINDING SITE, designated SEQ ID:40644, to the nucleotide sequence of VGAM1706 RNA, herein designated VGAM RNA, also designated SEQ ID:4417.

Another function of VGAM1706 is therefore inhibition of LOC145955 (Accession XM_096912). Accordingly, utilities of VGAM1706 include diagnosis, prevention and treatment of diseases and clinical conditions associated with LOC145955. LOC148147 (Accession XM_086071) is another VGAM1706 host target gene. LOC148147 BINDING SITE is HOST TARGET binding site found in the 3' untranslated region of mRNA encoded by LOC148147, corresponding to a HOST TARGET binding site such as BINDING SITE I, BINDING SITE II or BINDING SITE III. Table 2 illustrates the complementarity of the nucleotide sequences of LOC148147 BINDING SITE, designated SEQ ID:38477, to the nucleotide sequence of VGAM1706 RNA, herein designated VGAM RNA, also designated SEQ ID:4417.

Another function of VGAM1706 is therefore inhibition of LOC148147 (Accession XM_086071). Accordingly, utilities of VGAM1706 include diagnosis, prevention and treatment of diseases and clinical conditions associated with LOC148147. LOC149460 (Accession XM_097652) is another VGAM1706 host target gene. LOC149460 BINDING SITE is HOST TARGET binding site found in the 3' untranslated region of mRNA encoded by LOC149460, corresponding to a HOST TARGET binding site such as BINDING SITE I, BINDING SITE II or BINDING SITE III. Table 2 illustrates the complementarity of the nucleotide sequences of LOC149460 BINDING SITE, designated SEQ ID:40998, to the nucleotide sequence of VGAM1706 RNA, herein designated VGAM RNA, also designated SEQ ID:4417.

Another function of VGAM1706 is therefore inhibition of LOC149460 (Accession XM_097652). Accordingly, utilities of VGAM1706 include diagnosis, prevention and treatment of diseases and clinical conditions associated with LOC149460. LOC158819 (Accession XM_098995) is another VGAM1706 host target gene. LOC158819 BINDING SITE is HOST TARGET binding site found in the 3' untranslated region of mRNA encoded by LOC158819, corresponding to a HOST TARGET binding site such as BINDING SITE I, BINDING SITE II or BINDING SITE III. Table 2 illustrates the complementarity of the nucleotide sequences of LOC158819 BINDING SITE, designated SEQ ID:42029, to the nucleotide sequence of VGAM1706 RNA, herein designated VGAM RNA, also designated SEQ ID:4417.

Another function of VGAM1706 is therefore inhibition of LOC158819 (Accession XM_098995). Accordingly, utilities of VGAM1706 include diagnosis, prevention and treatment of diseases and clinical conditions associated with LOC158819. LOC169026 (Accession XM_095471) is another VGAM1706 host target gene. LOC169026 BINDING SITE is HOST TARGET binding site found in the 5' untranslated region of mRNA encoded by LOC169026, corresponding to a HOST TARGET binding site such as BINDING SITE I, BINDING SITE II or BINDING SITE III. Table 2 illustrates the complementarity of the nucleotide sequences of LOC169026 BINDING SITE, designated SEQ ID:40269, to the nucleotide sequence of VGAM1706 RNA, herein designated VGAM RNA, also designated SEQ ID:4417.

Another function of VGAM1706 is therefore inhibition of LOC169026 (Accession XM_095471). Accordingly, utilities of VGAM1706 include diagnosis, prevention and treatment of diseases and clinical conditions associated with LOC169026. LOC196955 (Accession XM_085210) is another VGAM1706 host target gene. LOC196955 BINDING SITE is HOST TARGET binding site found in the 3' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37931, to the nucleotide sequence of VGAM1706 RNA, herein designated VGAM RNA, also designated SEQ ID:4417.

Another function of VGAM1706 is therefore inhibition of LOC196955 (Accession XM_085210). Accordingly, utilities of VGAM1706 include diagnosis, prevention and treatment of diseases and clinical conditions associated with LOC196955. LOC199678 (Accession XM_117111) is another VGAM1706 host target gene. LOC199678 BINDING SITE is HOST TARGET binding site found in the 3' untranslated region of mRNA encoded by LOC199678, corresponding to a HOST TARGET binding site such as BINDING SITE I, BINDING SITE II or BINDING SITE III. Table 2 illustrates the complementarity of the nucleotide sequences of LOC199678 BINDING SITE, designated SEQ ID:43227, to the nucleotide sequence of VGAM1706 RNA, herein designated VGAM RNA, also designated SEQ ID:4417.

Another function of VGAM1706 is therefore inhibition of LOC199678 (Accession XM_117111). Accordingly, utilities of VGAM1706 include diagnosis, prevention and treatment of diseases and clinical conditions associated with LOC199678. LOC58489 (Accession XM_051862) is another VGAM1706 host target gene. LOC58489 BINDING SITE is HOST TARGET binding site found in the 3' untranslated region of mRNA encoded by LOC58489, corresponding to a HOST TARGET binding site such as BINDING SITE I, BINDING SITE II or BINDING SITE III. Table 2 illustrates the complementarity of the nucleotide sequences of LOC58489 BINDING SITE, designated SEQ ID:35908, to the nucleotide sequence of VGAM1706 RNA, herein designated VGAM RNA, also designated SEQ ID:4417.

Another function of VGAM1706 is therefore inhibition of LOC58489 (Accession XM_051862). Accordingly, utilities of VGAM1706 include diagnosis, prevention and treatment of diseases and clinical conditions associated with LOC58489. LOC90538 (Accession XM_032401) is another VGAM1706 host target gene. LOC90538 BINDING SITE is HOST TARGET binding site found in the 3' untranslated region of mRNA encoded by LOC90538, corresponding to a HOST TARGET binding site such as BINDING SITE I, BINDING SITE II or BINDING SITE III. Table 2 illustrates the complementarity of the nucleotide sequences of LOC90538 BINDING SITE, designated SEQ ID:31659, to the nucleotide sequence of VGAM1706 RNA, herein designated VGAM RNA, also designated SEQ ID:4417.

Another function of VGAM1706 is therefore inhibition of LOC90538 (Accession XM_032401). Accordingly, utilities of VGAM1706 include diagnosis, prevention and treatment of diseases and clinical conditions associated with LOC90538. LOC93132 (Accession XM_049396) is another VGAM1706 host target gene. LOC93132 BINDING SITE is HOST TARGET binding site found in the 5' untranslated region of mRNA encoded by LOC93132, corresponding to a HOST TARGET binding site such as BINDING SITE I, BINDING SITE II or BINDING SITE III. Table 2 illustrates the complementarity of the nucleotide sequences of LOC93132 BINDING SITE, designated SEQ ID:35411, to the nucleotide sequence of VGAM1706 RNA, herein designated VGAM RNA, also designated SEQ ID:4417.

Another function of VGAM1706 is therefore inhibition of LOC93132 (Accession XM_049396). Accordingly, utilities of VGAM1706 include diagnosis, prevention and treatment of diseases and clinical conditions associated with LOC93132. FIG. 1 further provides a conceptual description of a novel bioinformatically detected viral gene of the present invention, referred to here as Viral Genomic Address Messenger 1707 (VGAM1707) viral gene, which modulates expression of respective host target genes thereof, the function and utility of which host target genes is known in the art.

VGAM1707 is a novel bioinformatically detected regulatory, non protein coding, viral micro RNA (miRNA) gene. The method by which VGAM1707 was detected is described hereinabove with reference to FIGS. 1-8.

VGAM1707 gene, herein designated VGAM GENE, is a viral gene contained in the genome of Ectocarpus Siliculosus Virus. VGAM1707 host target gene, herein designated VGAM HOST TARGET GENE, is a human gene contained in the human genome.

VGAM1707 gene encodes a VGAM1707 precursor RNA, herein designated VGAM PRECURSOR RNA. Similar to other miRNA genes, and unlike most ordinary genes, VGAM1707 precursor RNA does not encode a protein. A nucleotide sequence identical or highly similar to the nucleotide sequence of VGAM1707 precursor RNA is designated SEQ ID:1693, and is provided hereinbelow with reference to the sequence listing part. Nucleotide sequence SEQ ID:1693 is located at position 48576 relative to the genome of Ectocarpus Siliculosus Virus.

VGAM1707 precursor RNA folds onto itself, forming VGAM1707 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1707 folded precursor RNA into VGAM1707 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 61%) nucleotide sequence of VGAM1707 RNA is designated SEQ ID:4418, and is provided hereinbelow with reference to the sequence listing part.

VGAM1707 host target gene, herein designated VGAM HOST TARGET GENE, encodes a corresponding messenger RNA, VGAM1707 host target RNA, herein designated VGAM HOST TARGET RNA. VGAM1707 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1707 RNA, herein designated VGAM RNA, binds complementarily to one or more host target binding sites located in untranslated regions of VGAM1707 host target RNA, herein designated VGAM HOST TARGET RNA. This complementary binding is due to the fact that the nucleotide sequence of VGAM1707 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1707 RNA, herein designated VGAM RNA, may have a different number of host target binding sites in untranslated regions of a VGAM1707 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1707 RNA, herein designated VGAM RNA, to host target binding sites on VGAM1707 host target RNA, herein designated VGAM HOST TARGET RNA, such as BINDING SITE I, BINDING SITE II and BINDING SITE III, inhibits translation of VGAM1707 host target RNA into VGAM1707 host target protein, herein designated VGAM HOST TARGET PROTEIN. VGAM host target protein is therefore outlined by a broken line.

It is appreciated that VGAM1707 host target gene, herein designated VGAM HOST TARGET GENE, in fact represents a plurality of VGAM1707 host target genes. The mRNA of each one of this plurality of VGAM1707 host target genes comprises one or more host target binding sites, each having a nucleotide sequence which is at least partly complementary to VGAM1707 RNA, herein designated VGAM RNA, and which when bound by VGAM1707 RNA causes inhibition of translation of respective one or more VGAM1707 host target proteins.

It is further appreciated by one skilled in the art that the mode of translational inhibition illustrated by FIG. 1 with specific reference to translational inhibition exerted by VGAM1707 gene, herein designated VGAM GENE, on one or more VGAM1707 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1707 is inhibition of expression of host target genes, as part of a novel viral mechanism of attacking a host. Accordingly, utilities of VGAM1707 include diagnosis, prevention and treatment of viral infection by Ectocarpus Siliculosus Virus. Specific functions, and accordingly utilities, of VGAM1707 correlate with, and may be deduced from, the identity of the host target genes which VGAM1707 binds and inhibits, and the function of these host target genes, as elaborated hereinbelow.

Nucleotide sequences of the VGAM1707 precursor RNA, herein designated VGAM PRECURSOR RNA, and of the 'diced' VGAM1707 RNA, herein designated VGAM RNA, and a schematic representation of the secondary folding of VGAM1707 folded precursor RNA, herein designated VGAM FOLDED PRECURSOR RNA, of VGAM1707 are further described hereinbelow with reference to Table 1.

Nucleotide sequences of host target binding sites, such as BINDING SITE-I, BINDING SITE-II and BINDING SITE-III of FIG. 1, found on VGAM1707 host target RNA, and schematic representation of the complementarity of each of these host target binding sites to VGAM1707 RNA, herein designated VGAM RNA, are described hereinbelow with reference to Table 2.

As mentioned hereinabove with reference to FIG. 1, a function of VGAM1707 gene, herein designated VGAM is inhibition of expression of VGAM1707 target genes. It is appreciated that specific functions, and accordingly utilities, of VGAM1707 correlate with, and may be deduced from, the identity of the target genes which VGAM1707 binds and inhibits, and the function of these target genes, as elaborated hereinbelow.

Amiloride-sensitive Cation Channel 2, Neuronal (ACCN2, Accession NM_020039) is a VGAM1707 host target gene. ACCN2 BINDING SITE is HOST TARGET binding site found in the 3' untranslated region of mRNA encoded by ACCN2, corresponding to a HOST TARGET binding site such as BINDING SITE I, BINDING SITE II or BINDING SITE III. Table 2 illustrates the complementarity of the nucleotide sequences of ACCN2 BINDING SITE, designated SEQ ID:21296, to the nucleotide sequence of VGAM1707 RNA, herein designated VGAM RNA, also designated SEQ ID:4418.

A function of VGAM1707 is therefore inhibition of Amiloride-sensitive Cation Channel 2, Neuronal (ACCN2, Accession NM_020039). Accordingly, utilities of VGAM1707 include diagnosis, prevention and treatment of diseases and clinical conditions associated with ACCN2. Acetylcholinesterase (YT blood group) (ACHE, Accession NM_015831) is another VGAM1707 host target gene. ACHE BINDING SITE is HOST TARGET binding site found in the 3' untranslated region of mRNA encoded by ACHE, corresponding to a HOST TARGET binding site such as BINDING SITE I, BINDING SITE II or BINDING SITE III. Table 2 illustrates the complementarity of the nucleotide sequences of ACHE BINDING SITE, designated SEQ ID:17943, to the nucleotide sequence of VGAM1707 RNA, herein designated VGAM RNA, also designated SEQ ID:4418.

Another function of VGAM1707 is therefore inhibition of Acetylcholinesterase (YT blood group) (ACHE, Accession NM_015831), a gene which rapidly hydrolyzes choline released into the synapse. Accordingly, utilities of VGAM1707 include diagnosis, prevention and treatment of diseases and clinical conditions associated with ACHE. The function of ACHE and its association with various diseases and clinical conditions, has been established by previous studies, as described hereinabove with reference to VGAM1020. Beta-1,3-glucuronyltransferase 1 (glucuronosyltransferase P) (B3GAT1, Accession NM_018644) is another VGAM1707 host target gene. B3GAT1 BINDING SITE1 and B3GAT1 BINDING SITE2 are HOST TARGET binding sites found in untranslated regions of mRNA encoded by B3GAT1, corresponding to HOST TARGET binding sites such as BINDING SITE I, BINDING SITE II or BINDING SITE III. Table 2 illustrates the complementarity of the nucleotide sequences of B3GAT1 BINDING SITE1 and B3GAT1 BINDING SITE2, designated SEQ ID:20717 and SEQ ID:27629 respectively, to the nucleotide sequence of VGAM1707 RNA, herein designated VGAM RNA, also designated SEQ ID:4418.

Another function of VGAM1707 is therefore inhibition of Beta-1,3-glucuronyltransferase 1 (glucuronosyltransferase P) (B3GAT1, Accession NM_018644). Accordingly, utilities of VGAM1707 include diagnosis, prevention and treatment of diseases and clinical conditions associated with B3GAT1. G1 to S Phase Transition 1 (GSPT1, Accession NM_002094) is another VGAM1707 host target gene. GSPT1 BINDING SITE is HOST TARGET binding site found in the 5' untranslated region of mRNA encoded by GSPT1, corresponding to a HOST TARGET binding site such as BINDING SITE I, BINDING SITE II or BINDING SITE III. Table 2 illustrates the complementarity of the nucleotide sequences of GSPT1 BINDING SITE, designated SEQ ID:7882, to the nucleotide sequence of VGAM1707 RNA, herein designated VGAM RNA, also designated SEQ ID:4418.

Another function of VGAM1707 is therefore inhibition of G1 to S Phase Transition 1 (GSPT1, Accession NM_002094), a gene which involves in regulation of mammalian cell growth. Accordingly, utilities of VGAM1707 include diagnosis, prevention and treatment of diseases and clinical conditions associated with GSPT1. The function of GSPT1 has been established by previous studies. Kikuchi et al. (1988) isolated a gene from a yeast genomic library that could complement a temperature-sensitive mutant of Saccharomyces cerevisiae. The gene, termed GST1, seemed to be essential for the G1-to-S phase transition in the yeast cell cycle. The gene product appeared to be a GTP-binding protein of molecular mass 76,565 Da, with 38% identity in amino acid sequence with the alpha subunit of elongation factor-1 (OMIM Ref. No. 130590). Hoshino et al. (1989) cloned the human equivalent from a cDNA library. By nonradioactive in situ hybridization, Ozawa et al. (1992) mapped the GSPT1 gene, the human homolog of the yeast gene GST1-Hs, to human chromosome 16p13.1. Southern blot hybridization with a panel of human-rodent somatic cells confirmed the localization of the GSPT1 gene on chromosome 16 and also showed the existence of a homologous gene on the X chromosome. They pointed out that a breakpoint for nonrandom chromosome rearrangements has been found in the region of GSPT1 in patients with acute nonlymphocytic leukemia.

Full details of the abovementioned studies are described in the following publications, the disclosure of which are hereby incorporated by reference:

Ozawa, K.; Murakami, Y.; Eki, T.; Yokoyama, K.; Soeda, E.; Hoshino, S.; Ui, M.; Hanaoka, F.: Mapping of the human GSPT1 gene, a human homolog of the yeast GST1 gene, to chromosomal band 16p13.1. Somat. Cell Molec. Genet. 18:189-194, 1992; and Hoshino, S.; Miyazawa, H.; Enomoto, T.; Hanaoka, F.; Kikuchi, Y.; Kikuchi, A.; Ui, M.: A human homologue of the yeast GST1 gene codes for a GTP-binding protein and is expressed in a pro.

Further studies establishing the function and utilities of GSPT1 are found in John Hopkins OMIM database record ID 139259, and in sited publications numbered 1883-1885 listed in the bibliography section hereinbelow, which are also hereby incorporated by reference. Potassium Channel, Subfamily K, Member 4 (KCNK4, Accession NM_016611) is another VGAM1707 host target gene. KCNK4 BINDING SITE is HOST TARGET binding site found in the 3' untranslated region of mRNA encoded by KCNK4, corresponding to a HOST TARGET binding site such as BINDING SITE I, BINDING SITE II or BINDING SITE III. Table 2 illustrates the complementarity of the nucleotide sequences of KCNK4 BINDING SITE, designated SEQ ID:18715, to the nucleotide sequence of VGAM1707 RNA, herein designated VGAM RNA, also designated SEQ ID:4418.

Another function of VGAM1707 is therefore inhibition of Potassium Channel, Subfamily K, Member 4 (KCNK4, Accession NM_016611). Accordingly, utilities of VGAM1707 include diagnosis, prevention and treatment of diseases and clinical conditions associated with KCNK4. KIP2 (Accession NM_006383) is another VGAM1707 host target gene. KIP2 BINDING SITE is HOST TARGET binding site found in the 3' untranslated region of mRNA encoded by KIP2, corresponding to a HOST TARGET binding site such as BINDING SITE I, BINDING SITE II or BINDING SITE III. Table 2 illustrates the complementarity of the nucleotide sequences of KIP2 BINDING SITE, designated SEQ ID:13088, to the nucleotide sequence of VGAM1707 RNA, herein designated VGAM RNA, also designated SEQ ID:4418.

Another function of VGAM1707 is therefore inhibition of KIP2 (Accession NM_006383). Accordingly, utilities of VGAM1707 include diagnosis, prevention and treatment of diseases and clinical conditions associated with KIP2. Mel Transforming Oncogene (derived from cell line NK14)-RAB8 Homolog (MEL, Accession NM_005370) is another VGAM1707 host target gene. MEL BINDING SITE is HOST TARGET binding site found in the 3' untranslated region of mRNA encoded by MEL, corresponding to a HOST TARGET binding site such as BINDING SITE I, BINDING SITE II or BINDING SITE III. Table 2 illustrates the complementarity of the nucleotide sequences of MEL BINDING SITE, designated SEQ ID:11844, to the nucleotide sequence of VGAM1707 RNA, herein designated VGAM RNA, also designated SEQ ID:4418.

Another function of VGAM1707 is therefore inhibition of Mel Transforming Oncogene (derived from cell line NK14)-RAB8 Homolog (MEL, Accession NM_005370), a gene which may be involved in vesicular trafficking and neurotransmitter release. Accordingly, utilities of VGAM1707 include diagnosis, prevention and treatment of diseases and clinical conditions associated with MEL. The function of MEL and its association with various diseases and clinical conditions, has been established by previous studies, as described hereinabove with reference to VGAM40. Matrix Metalloproteinase 15 (membrane-inserted) (MMP15, Accession NM_002428) is another VGAM1707 host target gene. MMP15 BINDING SITE is HOST TARGET binding site found in the 3' untranslated region of mRNA encoded by MMP15, corresponding to a HOST TARGET binding site such as BINDING SITE I, BINDING SITE II or BINDING SITE III. Table 2 illustrates the complementarity of the nucleotide sequences of MMP15 BINDING SITE, designated SEQ ID:8262, to the nucleotide sequence of VGAM1707 RNA, herein designated VGAM RNA, also designated SEQ ID:4418.

Another function of VGAM1707 is therefore inhibition of Matrix Metalloproteinase 15 (membrane-inserted) (MMP15, Accession NM_002428). Accordingly, utilities of VGAM1707 include diagnosis, prevention and treatment of diseases and clinical conditions associated with MMP15. Neurogranin (protein kinase C substrate, RC3) (NRGN, Accession NM_006176) is another VGAM1707 host target gene. NRGN BINDING SITE is HOST TARGET binding site found in the 3' untranslated region of mRNA encoded by NRGN, corresponding to a HOST TARGET binding site such as BINDING SITE I, BINDING SITE II or BINDING SITE III. Table 2 illustrates the complementarity of the nucleotide sequences of NRGN BINDING SITE, designated SEQ ID:12836, to the nucleotide sequence of VGAM1707 RNA, herein designated VGAM RNA, also designated SEQ ID:4418.

Another function of VGAM1707 is therefore inhibition of Neurogranin (protein kinase C substrate, RC3) (NRGN, Accession NM_006176), a gene which acts as a "third messenger" substrate of protein kinase c-mediated molecular cascades during synaptic development and remodeling. Accordingly, utilities of VGAM1707 include diagnosis, prevention and treatment of diseases and clinical conditions associated with NRGN. The function of NRGN and its association with various diseases and clinical conditions, has been established by previous studies, as described hereinabove with reference to VGAM1677. Neurexin 2 (NRXN2, Accession NM_015080) is another VGAM1707 host target gene. NRXN2 BINDING SITE1 through NRXN2 BINDING SITE3 are HOST TARGET binding sites found in untranslated regions of mRNA encoded by NRXN2, corresponding to HOST TARGET binding sites such as BINDING SITE I, BINDING SITE II or BINDING SITE III. Table 2 illustrates the complementarity of the nucleotide sequences of NRXN2 BINDING SITE1 through NRXN2 BINDING SITE3, designated SEQ ID:17467, SEQ ID:28983 and SEQ ID:28989 respectively, to the nucleotide sequence of VGAM1707 RNA, herein designated VGAM RNA, also designated SEQ ID:4418.

Another function of VGAM1707 is therefore inhibition of Neurexin 2 (NRXN2, Accession NM_015080), a gene which may be involved in cell recognition, cell adhesion, and may mediate intracellular signaling. Accordingly, utilities of VGAM1707 include diagnosis, prevention and treatment of diseases and clinical conditions associated with NRXN2. The function of NRXN2 and its association with various diseases and clinical conditions, has been established by previous studies, as described hereinabove with reference to VGAM178. Stearoyl-CoA Desaturase (delta-9-desaturase) (SCD, Accession NM_005063) is another VGAM1707 host target gene. SCD BINDING SITE is HOST TARGET binding site found in the 3' untranslated region of mRNA encoded by SCD, corresponding to a HOST TARGET binding site such as BINDING SITE I, BINDING SITE II or BINDING SITE III. Table 2 illustrates the complementarity of the nucleotide sequences of SCD BINDING SITE, designated SEQ ID:11496, to the nucleotide sequence of VGAM1707 RNA, herein designated VGAM RNA, also designated SEQ ID:4418.

Another function of VGAM1707 is therefore inhibition of Stearoyl-CoA Desaturase (delta-9-desaturase) (SCD, Accession NM_005063), a gene which functions in the synthesis of unsaturated fatty acids. Accordingly, utilities of VGAM1707 include diagnosis, prevention and treatment of diseases and clinical conditions associated with SCD. The function of SCD and its association with various diseases and clinical conditions, has been established by previous studies, as described hereinabove with reference to VGAM314. Staufen, RNA Binding Protein (Drosophila) (STAU, Accession NM_004602) is another VGAM1707 host target gene. STAU BINDING SITE1 through STAU BINDING SITE4 are HOST TARGET binding sites found in untranslated regions of mRNA encoded by STAU, corresponding to HOST TARGET binding sites such as BINDING SITE I, BINDING SITE II or BINDING SITE III. Table 2 illustrates the complementarity of the nucleotide sequences of STAU BINDING SITE1 through STAU BINDING SITE4, designated SEQ ID:10944, SEQ ID:18928, SEQ ID:18916 and SEQ ID:18922 respectively, to the nucleotide sequence of VGAM1707 RNA, herein designated VGAM RNA, also designated SEQ ID:4418.

Another function of VGAM1707 is therefore inhibition of Staufen, RNA Binding Protein (Drosophila) (STAU, Accession NM_004602), a gene which may play a role in specific positioning of mrnas at given sites in the cell and in stimulating their translation at the site. Accordingly, utilities of VGAM1707 include diagnosis, prevention and treatment of diseases and clinical conditions associated with STAU. The function of STAU and its association with various diseases and clinical conditions, has been established by previous studies, as described hereinabove with reference to VGAM916. Transcription Factor Binding to IGHM Enhancer 3 (TFE3, Accession NM_006521) is another VGAM1707 host target gene. TFE3 BINDING SITE is HOST TARGET binding site found in the 3' untranslated region of mRNA encoded by TFE3, corresponding to a HOST TARGET binding site such as BINDING SITE I, BINDING SITE II or BINDING SITE III. Table 2 illustrates the complementarity of the nucleotide sequences of TFE3 BINDING SITE, designated SEQ ID:13276, to the nucleotide sequence of VGAM1707 RNA, herein designated VGAM RNA, also designated SEQ ID:4418.

Another function of VGAM1707 is therefore inhibition of Transcription Factor Binding to IGHM Enhancer 3 (TFE3, Accession NM_006521), a gene which is a positive-acting transcription factor that binds to the immunoglobulin enchancer mue3 motif. Accordingly, utilities of VGAM1707 include diagnosis, prevention and treatment of diseases and clinical conditions associated with TFE3. The function of TFE3 and its association with various diseases and clinical conditions, has been established by previous studies, as described hereinabove with reference to VGAM443. Chromosome 1 Open Reading Frame 2 (C1orf2, Accession NM_006589) is another VGAM1707 host target gene. C1orf2 BINDING SITE1 and C1orf2 BINDING SITE2 are HOST TARGET binding sites found in untranslated regions of mRNA encoded by C1orf2, corresponding to HOST TARGET binding sites such as BINDING SITE I, BINDING SITE II or BINDING SITE III. Table 2 illustrates the complementarity of the nucleotide sequences of C1orf2 BINDING SITE1 and C1orf2 BINDING SITE2, designated SEQ ID:13355 and SEQ ID:45395 respectively, to the nucleotide sequence of VGAM1707 RNA, herein designated VGAM RNA, also designated SEQ ID:4418.

Another function of VGAM1707 is therefore inhibition of Chromosome 1 Open Reading Frame 2 (C1orf2, Accession NM_006589). Accordingly, utilities of VGAM1707 include diagnosis, prevention and treatment of diseases and clinical conditions associated with C1orf2. Centaurin, Beta 5 (CENTB5, Accession XM_170937) is another VGAM1707 host target gene. CENTB5 BINDING SITE is HOST TARGET binding site found in the 3' untranslated region of mRNA encoded by CENTB5, corresponding to a HOST TARGET binding site such as BINDING SITE I, BINDING SITE II or BINDING SITE III. Table 2 illustrates the complementarity of the nucleotide sequences of CENTB5 BINDING SITE, designated SEQ ID:45726, to the nucleotide sequence of VGAM1707 RNA, herein designated VGAM RNA, also designated SEQ ID:4418.

Another function of VGAM1707 is therefore inhibition of Centaurin, Beta 5 (CENTB5, Accession XM_170937). Accordingly, utilities of VGAM1707 include diagnosis, prevention and treatment of diseases and clinical conditions associated with CENTB5. Carbohydrate (chondroitin 6) Sulfotransferase 3 (CHST3, Accession NM_004273) is another VGAM1707 host target gene. CHST3 BINDING SITE is HOST TARGET binding site found in the 5' untranslated region of mRNA encoded by CHST3, corresponding to a HOST TARGET binding site such as BINDING SITE I, BINDING SITE II or BINDING SITE III. Table 2 illustrates the complementarity of the nucleotide sequences of CHST3 BINDING SITE, designated SEQ ID:10479, to the nucleotide sequence of VGAM1707 RNA, herein designated VGAM RNA, also designated SEQ ID:4418.

Another function of VGAM1707 is therefore inhibition of Carbohydrate (chondroitin 6) Sulfotransferase 3 (CHST3, Accession NM_004273). Accordingly, utilities of VGAM1707 include diagnosis, prevention and treatment of diseases and clinical conditions associated with CHST3. DKFZP586M1120 (Accession NM_031294) is another VGAM1707 host target gene. DKFZP586M1120 BINDING SITE is HOST TARGET binding site found in the 3' untranslated region of mRNA encoded by DKFZP586M1120, corresponding to a HOST TARGET binding site such as BINDING SITE I, BINDING SITE II or BINDING SITE III. Table 2 illustrates the complementarity of the nucleotide sequences of DKFZP586M1120 BINDING SITE, designated SEQ ID:25319, to the nucleotide sequence of VGAM1707 RNA, herein designated VGAM RNA, also designated SEQ ID:4418.

Another function of VGAM1707 is therefore inhibition of DKFZP586M1120 (Accession NM_031294). Accordingly, utilities of VGAM1707 include diagnosis, prevention and treatment of diseases and clinical conditions associated with DKFZP586M1120. Fatty Acid Desaturase 1 (FADS1, Accession NM_013402) is another VGAM1707 host target gene. FADS1 BINDING SITE is HOST TARGET binding site found in the 3' untranslated region of mRNA encoded by FADS1, corresponding to a HOST TARGET binding site such as BINDING SITE I, BINDING SITE II or BINDING SITE III. Table 2 illustrates the complementarity of the nucleotide sequences of FADS1 BINDING SITE, designated SEQ ID:15068, to the nucleotide sequence of VGAM1707 RNA, herein designated VGAM RNA, also designated SEQ ID:4418.

Another function of VGAM1707 is therefore inhibition of Fatty Acid Desaturase 1 (FADS1, Accession NM_013402). Accordingly, utilities of VGAM1707 include diagnosis, prevention and treatment of diseases and clinical conditions associated with FADS1. FLJ13310 (Accession NM_025118) is another VGAM1707 host target gene. FLJ13310 BINDING SITE is HOST TARGET binding site found in the 3' untranslated region of mRNA encoded by FLJ13310, corresponding to a HOST TARGET binding site such as BINDING SITE I, BINDING SITE II or BINDING SITE III. Table 2 illustrates the complementarity of the nucleotide sequences of FLJ13310 BINDING SITE, designated SEQ ID:24767, to the nucleotide sequence of VGAM1707 RNA, herein designated VGAM RNA, also designated SEQ ID:4418.

Another function of VGAM1707 is therefore inhibition of FLJ13310 (Accession NM_025118). Accordingly, utilities of VGAM1707 include diagnosis, prevention and treatment of diseases and clinical conditions associated with FLJ13310. FLJ14251 (Accession NM_024881) is another VGAM1707 host target gene. FLJ14251 BINDING SITE is HOST TARGET binding site found in the 3' untranslated region of mRNA encoded by FLJ14251, corresponding to a HOST TARGET binding site such as BINDING SITE I, BINDING SITE II or BINDING SITE III. Table 2 illustrates the complementarity of the nucleotide sequences of FLJ14251 BINDING SITE, designated SEQ ID:24326, to the nucleotide sequence of VGAM1707 RNA, herein designated VGAM RNA, also designated SEQ ID:4418.

Another function of VGAM1707 is therefore inhibition of FLJ14251 (Accession NM_024881). Accordingly, utilities of VGAM1707 include diagnosis, prevention and treatment of diseases and clinical conditions associated with FLJ14251. FLJ21839 (Accession NM_021831) is another VGAM1707 host target gene. FLJ21839 BINDING SITE is HOST TARGET binding site found in the 3' untranslated region of mRNA encoded by FLJ21839, corresponding to a HOST TARGET binding site such as BINDING SITE I, BINDING SITE II or BINDING SITE III. Table 2 illustrates the complementarity of the nucleotide sequences of FLJ21839 BINDING SITE, designated SEQ ID:22406, to the nucleotide sequence of VGAM1707 RNA, herein designated VGAM RNA, also designated SEQ ID:4418.

Another function of VGAM1707 is therefore inhibition of FLJ21839 (Accession NM_021831). Accordingly, utilities of VGAM1707 include diagnosis, prevention and treatment of diseases and clinical conditions associated with FLJ21839. HRD1 (Accession XM_045498) is another VGAM1707 host target gene. HRD1 BINDING SITE is HOST TARGET binding site found in the 3' untranslated region of mRNA encoded by HRD1, corresponding to a HOST TARGET binding site such as BINDING SITE I, BINDING SITE II or BINDING SITE III. Table 2 illustrates the complementarity of the nucleotide sequences of HRD1 BINDING SITE, designated SEQ ID:34470, to the nucleotide sequence of VGAM1707 RNA, herein designated VGAM RNA, also designated SEQ ID:4418.

Another function of VGAM1707 is therefore inhibition of HRD1 (Accession XM_045498). Accordingly, utilities of VGAM1707 include diagnosis, prevention and treatment of diseases and clinical conditions associated with HRD1. HU-K4 (Accession NM_012268) is another VGAM1707 host target gene. HU-K4 BINDING SITE is HOST TARGET binding site found in the 5' untranslated region of mRNA encoded by HU-K4, corresponding to a HOST TARGET binding site such as BINDING SITE I, BINDING SITE II or BINDING SITE III. Table 2 illustrates the complementarity of the nucleotide sequences of HU-K4 BINDING SITE, designated SEQ ID:14590, to the nucleotide sequence of VGAM1707 RNA, herein designated VGAM RNA, also designated SEQ ID:4418.

Another function of VGAM1707 is therefore inhibition of HU-K4 (Accession NM_012268). Accordingly, utilities of VGAM1707 include diagnosis, prevention and treatment of diseases and clinical conditions associated with HU-K4. KIAA0082 (Accession XM_166400) is another VGAM1707 host target gene. KIAA0082 BINDING SITE is HOST TARGET binding site found in the 3' untranslated region of mRNA encoded by KIAA0082, corresponding to a HOST TARGET binding site such as BINDING SITE I, BINDING SITE II or BINDING SITE III. Table 2 illustrates the complementarity of the nucleotide sequences of KIAA0082 BINDING SITE, designated SEQ ID:44263, to the nucleotide sequence of VGAM1707 RNA, herein designated VGAM RNA, also designated SEQ ID:4418.

Another function of VGAM1707 is therefore inhibition of KIAA0082 (Accession XM_166400). Accordingly, utilities of VGAM1707 include diagnosis, prevention and treatment of diseases and clinical conditions associated with KIAA0082. KIAA0429 (Accession NM_014751) is another VGAM1707 host target gene. KIAA0429 BINDING SITE is HOST TARGET binding site found in the 5' untranslated region of mRNA encoded by KIAA0429, corresponding to a HOST TARGET binding site such as BINDING SITE I, BINDING SITE II or BINDING SITE III. Table 2 illustrates the complementarity of the nucleotide sequences of KIAA0429 BINDING SITE, designated SEQ ID:16468, to the nucleotide sequence of VGAM1707 RNA, herein designated VGAM RNA, also designated SEQ ID:4418.

Another function of VGAM1707 is therefore inhibition of KIAA0429 (Accession NM_014751). Accordingly, utilities of VGAM1707 include diagnosis, prevention and treatment of diseases and clinical conditions associated with KIAA0429. KIAA1240 (Accession XM_039676) is another VGAM1707 host target gene. KIAA1240 BINDING SITE is HOST TARGET binding site found in the 3' untranslated region of mRNA encoded by KIAA1240, corresponding to a HOST TARGET binding site such as BINDING SITE I, BINDING SITE II or BINDING SITE III. Table 2 illustrates the complementarity of the nucleotide sequences of KIAA1240 BINDING SITE, designated SEQ ID:33142, to the nucleotide sequence of VGAM1707 RNA, herein designated VGAM RNA, also designated SEQ ID:4418.

Another function of VGAM1707 is therefore inhibition of KIAA1240 (Accession XM_039676). Accordingly, utilities of VGAM1707 include diagnosis, prevention and treatment of diseases and clinical conditions associated with KIAA1240. KIAA1719 (Accession XM_042936) is another VGAM1707 host target gene. KIAA1719 BINDING SITE is HOST TARGET binding site found in the 3' untranslated region of mRNA encoded by KIAA1719, corresponding to a HOST TARGET binding site such as BINDING SITE I, BINDING SITE II or BINDING SITE III. Table 2 illustrates the complementarity of the nucleotide sequences of KIAA1719 BINDING SITE, designated SEQ ID:33817, to the nucleotide sequence of VGAM1707 RNA, herein designated VGAM RNA, also designated SEQ ID:4418.

Another function of VGAM1707 is therefore inhibition of KIAA1719 (Accession XM_042936). Accordingly, utilities of VGAM1707 include diagnosis, prevention and treatment of diseases and clinical conditions associated with KIAA1719. KIAA1854 (Accession XM_049884) is another VGAM1707 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35528, to the nucleotide sequence of VGAM1707 RNA, herein designated VGAM RNA, also designated SEQ ID:4418.

Another function of VGAM1707 is therefore inhibition of KIAA1854 (Accession XM_049884). Accordingly, utilities of VGAM1707 include diagnosis, prevention and treatment of diseases and clinical conditions associated with KIAA1854. KIAA1855 (Accession XM_166453) is another VGAM1707 host target gene. KIAA1855 BINDING SITE is HOST TARGET binding site found in the 3' untranslated region of mRNA encoded by KIAA1855, corresponding to a HOST TARGET binding site such as BINDING SITE I, BINDING SITE II or BINDING SITE III. Table 2 illustrates the complementarity of the nucleotide sequences of KIAA1855 BINDING SITE, designated SEQ ID:44354, to the nucleotide sequence of VGAM1707 RNA, herein designated VGAM RNA, also designated SEQ ID:4418.

Another function of VGAM1707 is therefore inhibition of KIAA1855 (Accession XM_166453). Accordingly, utilities of VGAM1707 include diagnosis, prevention and treatment of diseases and clinical conditions associated with KIAA1855. MGC4796 (Accession XM_029031) is another VGAM1707 host target gene. MGC4796 BINDING SITE is HOST TARGET binding site found in the 3' untranslated region of mRNA encoded by MGC4796, corresponding to a HOST TARGET binding site such as BINDING SITE I, BINDING SITE II or BINDING SITE III. Table 2 illustrates the complementarity of the nucleotide sequences of MGC4796 BINDING SITE, designated SEQ ID:30834, to the nucleotide sequence of VGAM1707 RNA, herein designated VGAM RNA, also designated SEQ ID:4418.

Another function of VGAM1707 is therefore inhibition of MGC4796 (Accession XM_029031). Accordingly, utilities of VGAM1707 include diagnosis, prevention and treatment of diseases and clinical conditions associated with MGC4796. NET-7 (Accession NM_012339) is another VGAM1707 host target gene. NET-7 BINDING SITE is HOST TARGET binding site found in the 3' untranslated region of mRNA encoded by NET-7, corresponding to a HOST TARGET binding site such as BINDING SITE I, BINDING SITE II or BINDING SITE III. Table 2 illustrates the complementarity of the nucleotide sequences of NET-7 BINDING SITE, designated SEQ ID:14735, to the nucleotide sequence of VGAM1707 RNA, herein designated VGAM RNA, also designated SEQ ID:4418.

Another function of VGAM1707 is therefore inhibition of NET-7 (Accession NM_012339). Accordingly, utilities of VGAM1707 include diagnosis, prevention and treatment of diseases and clinical conditions associated with NET-7. Protein Kinase, Lysine Deficient 2 (PRKWNK2, Accession XM_117531) is another VGAM1707 host target gene. PRKWNK2 BINDING SITE is HOST TARGET binding site found in the 3' untranslated region of mRNA encoded by PRKWNK2, corresponding to a HOST TARGET binding site such as BINDING SITE I, BINDING SITE II or BINDING SITE III. Table 2 illustrates the complementarity of the nucleotide sequences of PRKWNK2 BINDING SITE, designated SEQ ID:43517, to the nucleotide sequence of VGAM1707 RNA, herein designated VGAM RNA, also designated SEQ ID:4418.

Another function of VGAM1707 is therefore inhibition of Protein Kinase, Lysine Deficient 2 (PRKWNK2, Accession XM_117531). Accordingly, utilities of VGAM1707 include diagnosis, prevention and treatment of diseases and clinical conditions associated with PRKWNK2. Sep.in 3 (SEPT3, Accession NM_019106) is another VGAM1707 host target gene. SEPT3 BINDING SITE is HOST TARGET binding site found in the 3' untranslated region of mRNA encoded by SEPT3, corresponding to a HOST TARGET binding site such as BINDING SITE I, BINDING SITE II or BINDING SITE III. Table 2 illustrates the complementarity of the nucleotide sequences of SEPT3 BINDING SITE, designated SEQ ID:21183, to the nucleotide sequence of VGAM1707 RNA, herein designated VGAM RNA, also designated SEQ ID:4418.

Another function of VGAM1707 is therefore inhibition of Sep.in 3 (SEPT3, Accession NM_019106). Accordingly, utilities of VGAM1707 include diagnosis, prevention and treatment of diseases and clinical conditions associated with SEPT3. LOC114932 (Accession XM_052614) is another VGAM1707 host target gene. LOC114932 BINDING SITE is HOST TARGET binding site found in the 5' untranslated region of mRNA encoded by LOC114932, corresponding to a HOST TARGET binding site such as BINDING SITE I, BINDING SITE II or BINDING SITE III. Table 2 illustrates the complementarity of the nucleotide sequences of LOC114932 BINDING SITE, designated SEQ ID:36008, to the nucleotide sequence of VGAM1707 RNA, herein designated VGAM RNA, also designated SEQ ID:4418.

Another function of VGAM1707 is therefore inhibition of LOC114932 (Accession XM_052614). Accordingly, utilities of VGAM1707 include diagnosis, prevention and treatment of diseases and clinical conditions associated with LOC114932. LOC115708 (Accession XM_056552) is another VGAM1707 host target gene. LOC115708 BINDING SITE is HOST TARGET binding site found in the 3' untranslated region of mRNA encoded by LOC115708, corresponding to a HOST TARGET binding site such as BINDING SITE I, BINDING SITE II or BINDING SITE III. Table 2 illustrates the complementarity of the nucleotide sequences of LOC115708 BINDING SITE, designated SEQ ID:36404, to the nucleotide sequence of VGAM1707 RNA, herein designated VGAM RNA, also designated SEQ ID:4418.

Another function of VGAM1707 is therefore inhibition of LOC115708 (Accession XM_056552). Accordingly, utilities of VGAM1707 include diagnosis, prevention and treatment of diseases and clinical conditions associated with LOC115708. LOC131034 (Accession NM_130808) is another VGAM1707 host target gene. LOC131034 BINDING SITE is HOST TARGET binding site found in the 5' untranslated region of mRNA encoded by LOC131034, corresponding to a HOST TARGET binding site such as BINDING SITE I, BINDING SITE II or BINDING SITE III. Table 2 illustrates the complementarity of the nucleotide sequences of LOC131034 BINDING SITE, designated SEQ ID:28315, to the nucleotide sequence of VGAM1707 RNA, herein designated VGAM RNA, also designated SEQ ID:4418.

Another function of VGAM1707 is therefore inhibition of LOC131034 (Accession NM_130808). Accordingly, utilities of VGAM1707 include diagnosis, prevention and treatment of diseases and clinical conditions associated with LOC131034. LOC145082 (Accession XM_096719) is another VGAM1707 host target gene. LOC145082 BINDING SITE is HOST TARGET binding site found in the 5' untranslated region of mRNA encoded by LOC145082, corresponding to a HOST TARGET binding site such as BINDING SITE I, BINDING SITE II or BINDING SITE III. Table 2 illustrates the complementarity of the nucleotide sequences of LOC145082 BINDING SITE, designated SEQ ID:40493, to the nucleotide sequence of VGAM1707 RNA, herein designated VGAM RNA, also designated SEQ ID:4418.

Another function of VGAM1707 is therefore inhibition of LOC145082 (Accession XM_096719). Accordingly, utilities of VGAM1707 include diagnosis, prevention and treatment of diseases and clinical conditions associated with LOC145082. LOC145371 (Accession XM_085123) is another VGAM1707 host target gene. LOC145371 BINDING SITE is HOST TARGET binding site found in the 3' untranslated region of mRNA encoded by LOC145371, corresponding to a HOST TARGET binding site such as BINDING SITE I, BINDING SITE II or BINDING SITE III. Table 2 illustrates the complementarity of the nucleotide sequences of LOC145371 BINDING SITE, designated SEQ ID:37844, to the nucleotide sequence of VGAM1707 RNA, herein designated VGAM RNA, also designated SEQ ID:4418.

Another function of VGAM1707 is therefore inhibition of LOC145371 (Accession XM_085123). Accordingly, utilities of VGAM1707 include diagnosis, prevention and treatment of diseases and clinical conditions associated with LOC145371. LOC146268 (Accession XM_085397) is another VGAM1707 host target gene. LOC146268 BINDING SITE is HOST TARGET binding site found in the 3' untranslated region of mRNA encoded by LOC146268, corresponding to a HOST TARGET binding site such as BINDING SITE I, BINDING SITE II or BINDING SITE III. Table 2 illustrates the complementarity of the nucleotide sequences of LOC146268 BINDING SITE, designated SEQ ID:38121, to the nucleotide sequence of VGAM1707 RNA, herein designated VGAM RNA, also designated SEQ ID:4418.

Another function of VGAM1707 is therefore inhibition of LOC146268 (Accession XM_085397). Accordingly, utilities of VGAM1707 include diagnosis, prevention and treatment of diseases and clinical conditions associated with LOC146268. LOC148530 (Accession XM_097480) is another VGAM1707 host target gene. LOC148530 BINDING SITE is HOST TARGET binding site found in the 5' untranslated region of mRNA encoded by LOC148530, corresponding to a HOST TARGET binding site such as BINDING SITE I, BINDING SITE II or BINDING SITE III. Table 2 illustrates the complementarity of the nucleotide sequences of LOC148530 BINDING SITE, designated SEQ ID:40888, to the nucleotide sequence of VGAM1707 RNA, herein designated VGAM RNA, also designated SEQ ID:4418.

Another function of VGAM1707 is therefore inhibition of LOC148530 (Accession XM_097480). Accordingly, utilities of VGAM1707 include diagnosis, prevention and treatment of diseases and clinical conditions associated with LOC148530. LOC150538 (Accession XM_086945) is another VGAM1707 host target gene. LOC150538 BINDING SITE is HOST TARGET binding site found in the 3' untranslated region of mRNA encoded by LOC150538, corresponding to a HOST TARGET binding site such as BINDING SITE I, BINDING SITE II or BINDING SITE III. Table 2 illustrates the complementarity of the nucleotide sequences of LOC150538 BINDING SITE, designated SEQ ID:38990, to the nucleotide sequence of VGAM1707 RNA, herein designated VGAM RNA, also designated SEQ ID:4418.

Another function of VGAM1707 is therefore inhibition of LOC150538 (Accession XM_086945). Accordingly, utilities of VGAM1707 include diagnosis, prevention and treatment of diseases and clinical conditions associated with LOC150538. LOC157922 (Accession XM_098841) is another VGAM1707 host target gene. LOC157922 BINDING SITE is HOST TARGET binding site found in the 5' untranslated region of mRNA encoded by LOC157922, corresponding to a HOST TARGET binding site such as BINDING SITE I, BINDING SITE II or BINDING SITE III. Table 2 illustrates the complementarity of the nucleotide sequences of LOC157922 BINDING SITE, designated SEQ ID:41891, to the nucleotide sequence of VGAM1707 RNA, herein designated VGAM RNA, also designated SEQ ID:4418.

Another function of VGAM1707 is therefore inhibition of LOC157922 (Accession XM_098841). Accordingly, utilities of VGAM1707 include diagnosis, prevention and treatment of diseases and clinical conditions associated with LOC157922. LOC158722 (Accession XM_088653) is another VGAM1707 host target gene. LOC158722 BINDING SITE is HOST TARGET binding site found in the 5' untranslated region of mRNA encoded by LOC158722, corresponding to a HOST TARGET binding site such as BINDING SITE I, BINDING SITE II or BINDING SITE III. Table 2 illustrates the complementarity of the nucleotide sequences of LOC158722 BINDING SITE, designated SEQ ID:39890, to the nucleotide sequence of VGAM1707 RNA, herein designated VGAM RNA, also designated SEQ ID:4418.

Another function of VGAM1707 is therefore inhibition of LOC158722 (Accession XM_088653). Accordingly, utilities of VGAM1707 include diagnosis, prevention and treatment of diseases and clinical conditions associated with LOC158722. LOC162083 (Accession XM_091339) is another VGAM1707 host target gene. LOC162083 BINDING SITE is HOST TARGET binding site found in the 5' untranslated region of mRNA encoded by LOC162083, corresponding to a HOST TARGET binding site such as BINDING SITE I, BINDING SITE II or BINDING SITE III. Table 2 illustrates the complementarity of the nucleotide sequences of LOC162083 BINDING SITE, designated SEQ ID:40048, to the nucleotide sequence of VGAM1707 RNA, herein designated VGAM RNA, also designated SEQ ID:4418.

Another function of VGAM1707 is therefore inhibition of LOC162083 (Accession XM_091339). Accordingly, utilities of VGAM1707 include diagnosis, prevention and treatment of diseases and clinical conditions associated with LOC162083. LOC201911 (Accession XM_117339) is another VGAM1707 host target gene. LOC201911 BINDING SITE is HOST TARGET binding site found in the 5' untranslated region of mRNA encoded by LOC201911, corresponding to a HOST TARGET binding site such as BINDING SITE I, BINDING SITE II or BINDING SITE III. Table 2 illustrates the complementarity of the nucleotide sequences of LOC201911 BINDING SITE, designated SEQ ID:43390, to the nucleotide sequence of VGAM1707 RNA, herein designated VGAM RNA, also designated SEQ ID:4418.

Another function of VGAM1707 is therefore inhibition of LOC201911 (Accession XM_117339). Accordingly, utilities of VGAM1707 include diagnosis, prevention and treatment of diseases and clinical conditions associated with LOC201911. LOC219653 (Accession XM_166093) is another VGAM1707 host target gene. LOC219653 BINDING SITE is HOST TARGET binding site found in the 3' untranslated region of mRNA encoded by LOC219653, corresponding to a HOST TARGET binding site such as BINDING SITE I, BINDING SITE II or BINDING SITE III. Table 2 illustrates the complementarity of the nucleotide sequences of LOC219653 BINDING SITE, designated SEQ ID:43867, to the nucleotide sequence of VGAM1707 RNA, herein designated VGAM RNA, also designated SEQ ID:4418.

Another function of VGAM1707 is therefore inhibition of LOC219653 (Accession XM_166093). Accordingly, utilities of VGAM1707 include diagnosis, prevention and treatment of diseases and clinical conditions associated with LOC219653. LOC221399 (Accession XM_168134) is another VGAM1707 host target gene. LOC221399 BINDING SITE is HOST TARGET binding site found in the 5' untranslated region of mRNA encoded by LOC221399, corresponding to a HOST TARGET binding site such as BINDING SITE I, BINDING SITE II or BINDING SITE III. Table 2 illustrates the complementarity of the nucleotide sequences of LOC221399 BINDING SITE, designated SEQ ID:45048, to the nucleotide sequence of VGAM1707 RNA, herein designated VGAM RNA, also designated SEQ ID:4418.

Another function of VGAM1707 is therefore inhibition of LOC221399 (Accession XM_168134). Accordingly, utilities of VGAM1707 include diagnosis, prevention and treatment of diseases and clinical conditions associated with LOC221399. LOC90271 (Accession XM_030445) is another VGAM1707 host target gene. LOC90271 BINDING SITE is HOST TARGET binding site found in the 5' untranslated region of mRNA encoded by LOC90271, corresponding to a HOST TARGET binding site such as BINDING SITE I, BINDING SITE II or BINDING SITE III. Table 2 illustrates the complementarity of the nucleotide sequences of LOC90271 BINDING SITE, designated SEQ ID:31045, to the nucleotide sequence of VGAM1707 RNA, herein designated VGAM RNA, also designated SEQ ID:4418.

Another function of VGAM1707 is therefore inhibition of LOC90271 (Accession XM_030445). Accordingly, utilities of VGAM1707 include diagnosis, prevention and treatment of diseases and clinical conditions associated with LOC90271. LOC90550 (Accession XM_054582) is another VGAM1707 host target gene. LOC90550 BINDING SITE is HOST TARGET binding site found in the 3' untranslated region of mRNA encoded by LOC90550, corresponding to a HOST TARGET binding site such as BINDING SITE I, BINDING SITE II or BINDING SITE III. Table 2 illustrates the complementarity of the nucleotide sequences of LOC90550 BINDING SITE, designated SEQ ID:36177, to the nucleotide sequence of VGAM1707 RNA, herein designated VGAM RNA, also designated SEQ ID:4418.

Another function of VGAM1707 is therefore inhibition of LOC90550 (Accession XM_054582). Accordingly, utilities of VGAM1707 include diagnosis, prevention and treatment of diseases and clinical conditions associated with LOC90550. FIG. 1 further provides a conceptual description of a novel bioinformatically detected viral gene of the present invention, referred to here as Viral Genomic Address Messenger 1708 (VGAM1708) viral gene, which modulates expression of respective host target genes thereof, the function and utility of which host target genes is known in the art.

VGAM1708 is a novel bioinformatically detected regulatory, non protein coding, viral micro RNA (miRNA) gene. The method by which VGAM1708 was detected is described hereinabove with reference to FIGS. 1-8.

VGAM1708 gene, herein designated VGAM GENE, is a viral gene contained in the genome of Bovine Adenovirus B. VGAM1708 host target gene, herein designated VGAM HOST TARGET GENE, is a human gene contained in the human genome.

VGAM1708 gene encodes a VGAM1708 precursor RNA, herein designated VGAM PRECURSOR RNA. Similar to other miRNA genes, and unlike most ordinary genes, VGAM1708 precursor RNA does not encode a protein. A nucleotide sequence identical or highly similar to the nucleotide sequence of VGAM1708 precursor RNA is designated SEQ ID:1694, and is provided hereinbelow with reference to the sequence listing part. Nucleotide sequence SEQ ID:1694 is located at position 17661 relative to the genome of Bovine Adenovirus B.

VGAM1708 precursor RNA folds onto itself, forming VGAM1708 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1708 folded precursor RNA into VGAM1708 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1708 RNA is designated SEQ ID:4419, and is provided hereinbelow with reference to the sequence listing part.

VGAM1708 host target gene, herein designated VGAM HOST TARGET GENE, encodes a corresponding messenger RNA, VGAM1708 host target RNA, herein designated VGAM HOST TARGET RNA. VGAM1708 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1708 RNA, herein designated VGAM RNA, binds complementarily to one or more host target binding sites located in untranslated regions of VGAM1708 host target RNA, herein designated VGAM HOST TARGET RNA. This complementary binding is due to the fact that the nucleotide sequence of VGAM1708 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1708 RNA, herein designated VGAM RNA, may have a different number of host target binding sites in untranslated regions of a VGAM1708 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1708 RNA, herein designated VGAM RNA, to host target binding sites on VGAM1708 host target RNA, herein designated VGAM HOST TARGET RNA, such as BINDING SITE I, BINDING SITE II and BINDING SITE III, inhibits translation of VGAM1708 host target RNA into VGAM1708 host target protein, herein designated VGAM HOST TARGET PROTEIN. VGAM host target protein is therefore outlined by a broken line.

It is appreciated that VGAM1708 host target gene, herein designated VGAM HOST TARGET GENE, in fact represents a plurality of VGAM1708 host target genes. The mRNA of each one of this plurality of VGAM1708 host target genes comprises one or more host target binding sites, each having a nucleotide sequence which is at least partly complementary to VGAM1708 RNA, herein designated VGAM RNA, and which when bound by VGAM1708 RNA causes inhibition of translation of respective one or more VGAM1708 host target proteins.

It is further appreciated by one skilled in the art that the mode of translational inhibition illustrated by FIG. 1 with specific reference to translational inhibition exerted by VGAM1708 gene, herein designated VGAM GENE, on one or more VGAM1708 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1708 is inhibition of expression of host target genes, as part of a novel viral mechanism of attacking a host. Accordingly, utilities of VGAM1708 include diagnosis, prevention and treatment of viral infection by Bovine Adenovirus B. Specific functions, and accordingly utilities, of VGAM1708 correlate with, and may be deduced from, the identity of the host target genes which VGAM1708 binds and inhibits, and the function of these host target genes, as elaborated hereinbelow.

Nucleotide sequences of the VGAM1708 precursor RNA, herein designated VGAM PRECURSOR RNA, and of the 'diced' VGAM1708 RNA, herein designated VGAM RNA, and a schematic representation of the secondary folding of VGAM1708 folded precursor RNA, herein designated VGAM FOLDED PRECURSOR RNA, of VGAM1708 are further described hereinbelow with reference to Table 1.

Nucleotide sequences of host target binding sites, such as BINDING SITE-I, BINDING SITE-II and BINDING SITE-III of FIG. 1, found on VGAM1708 host target RNA, and schematic representation of the complementarity of each of these host target binding sites to VGAM1708 RNA, herein designated VGAM RNA, are described hereinbelow with reference to Table 2.

As mentioned hereinabove with reference to FIG. 1, a function of VGAM1708 gene, herein designated VGAM is inhibition of expression of VGAM1708 target genes. It is appreciated that specific functions, and accordingly utilities, of VGAM1708 correlate with, and may be deduced from, the identity of the target genes which VGAM1708 binds and inhibits, and the function of these target genes, as elaborated hereinbelow.

A Disintegrin-like and Metalloprotease (reprolysin type) with Thrombospondin Type 1 Motif, 3 (ADAMTS3, Accession NM_014243) is a VGAM1708 host target gene. ADAMTS3 BINDING SITE is HOST TARGET binding site found in the 3' untranslated region of mRNA encoded by ADAMTS3, corresponding to a HOST TARGET binding site such as BINDING SITE I, BINDING SITE II or BINDING SITE III. Table 2 illustrates the complementarity of the nucleotide sequences of ADAMTS3 BINDING SITE, designated SEQ ID:15511, to the nucleotide sequence of VGAM1708 RNA, herein designated VGAM RNA, also designated SEQ ID:4419.

A function of VGAM1708 is therefore inhibition of A Disintegrin-like and Metalloprotease (reprolysin type) with Thrombospondin Type 1 Motif, 3 (ADAMTS3, Accession NM_014243), a gene which cleaves the propeptides of type ii collagen prior to fibril assembly. Accordingly, utilities of VGAM1708 include diagnosis, prevention and treatment of diseases and clinical conditions associated with ADAMTS3. The function of ADAMTS3 and its association with various diseases and clinical conditions, has been established by previous studies, as described hereinabove with reference to VGAM211. Apoptotic Protease Activating Factor (APAF1, Accession NM_013229) is another VGAM1708 host target gene. APAF1 BINDING SITE1 and APAF1 BINDING SITE2 are HOST TARGET binding sites found in untranslated regions of mRNA encoded by APAF1, corresponding to HOST TARGET binding sites such as BINDING SITE I, BINDING SITE II or BINDING SITE III. Table 2 illustrates the complementarity of the nucleotide sequences of APAF1 BINDING SITE1 and APAF1 BINDING SITE2, designated SEQ ID:14872 and SEQ ID:6833 respectively, to the nucleotide sequence of VGAM1708 RNA, herein designated VGAM RNA, also designated SEQ ID:4419.

Another function of VGAM1708 is therefore inhibition of Apoptotic Protease Activating Factor (APAF1, Accession NM_013229), a gene which functions in the mitochondrial apoptotic pathway that leads to caspase 9 dependent activation of caspase 3. Accordingly, utilities of VGAM1708 include diagnosis, prevention and treatment of diseases and clinical conditions associated with APAF1. The function of APAF1 and its association with various diseases and clinical conditions, has been established by previous studies, as described hereinabove with reference to VGAM552. Cerebellar Degeneration-related Protein 2, 62 kDa (CDR2, Accession XM_071866) is another VGAM1708 host target gene. CDR2 BINDING SITE is HOST TARGET binding site found in the 5' untranslated region of mRNA encoded by CDR2, corresponding to a HOST TARGET binding site such as BINDING SITE I, BINDING SITE II or BINDING SITE III. Table 2 illustrates the complementarity of the nucleotide sequences of CDR2 BINDING SITE, designated SEQ ID:37429, to the nucleotide sequence of VGAM1708 RNA, herein designated VGAM RNA, also designated SEQ ID:4419.

Another function of VGAM1708 is therefore inhibition of Cerebellar Degeneration-related Protein 2, 62 kDa (CDR2, Accession XM_071866), a gene which plays a role in cytokinesis, cell shape, and functions such as secretion and capping. Accordingly, utilities of VGAM1708 include diagnosis, prevention and treatment of diseases and clinical conditions associated with CDR2. The function of CDR2 and its association with various diseases and clinical conditions, has been established by previous studies, as described hereinabove with reference to VGAM128. Dihydropyrimidinase-like 2 (DPYSL2, Accession NM_001386) is another VGAM1708 host target gene. DPYSL2 BINDING SITE is HOST TARGET binding site found in the 3' untranslated region of mRNA encoded by DPYSL2, corresponding to a HOST TARGET binding site such as BINDING SITE I, BINDING SITE II or BINDING SITE III. Table 2 illustrates the complementarity of the nucleotide sequences of DPYSL2 BINDING SITE, designated SEQ ID:7067, to the nucleotide sequence of VGAM1708 RNA, herein designated VGAM RNA, also designated SEQ ID:4419.

Another function of VGAM1708 is therefore inhibition of Dihydropyrimidinase-like 2 (DPYSL2, Accession NM_001386), a gene which is a member of the dihydropyrimidinase family. Accordingly, utilities of VGAM1708 include diagnosis, prevention and treatment of diseases and clinical conditions associated with DPYSL2. The function of DPYSL2 and its association with various diseases and clinical conditions, has been established by previous studies, as described hereinabove with reference to VGAM217. Phosducin-like (PDCL, Accession NM_005388) is another VGAM1708 host target gene. PDCL BINDING SITE is HOST TARGET binding site found in the 3' untranslated region of mRNA encoded by PDCL, corresponding to a HOST TARGET binding site such as BINDING SITE I, BINDING SITE II or BINDING SITE III. Table 2 illustrates the complementarity of the nucleotide sequences of PDCL BINDING SITE, designated SEQ ID:11867, to the nucleotide sequence of VGAM1708 RNA, herein designated VGAM RNA, also designated SEQ ID:4419.

Another function of VGAM1708 is therefore inhibition of Phosducin-like (PDCL, Accession NM_005388), a gene which may regulate G-protein signaling and similar to phosducins. Accordingly, utilities of VGAM1708 include diagnosis, prevention and treatment of diseases and clinical conditions associated with PDCL. The function of PDCL has been established by previous studies. Phosducin-like protein (PDCL) is a putative modulator of heterotrimeric G proteins. It was initially isolated as the product of an ethanol-responsive gene in neural cell cultures (Miles et al., 1993). PDCL shares extensive amino acid sequence homology with phosducin (PDC; 171490), a phosphoprotein expressed in retina and pineal gland that inhibits several G protein-coupled signaling pathways by binding to the beta-gamma subunits of G proteins. By screening a human genomic library with a rat Pdcl cDNA, Thibault et al. (1999) isolated a partial PDCL genomic sequence. They also identified several PDCL ESTs. The authors derived the complete PDCL coding sequence by aligning the genomic and EST sequences. The predicted 301-amino acid PDCL protein shows homology to areas of rat Pdc that contact G protein beta-gamma subunits. The N-terminal regions of human, rat, and Drosophila PDCL are highly homologous to each other, but show little homology to the N-terminal region of rat Pdc. By somatic cell hybrid analysis, Thibault et al. (1999) mapped the PDCL gene to chromosome 9. Using a radiation hybrid mapping panel, they found that the PDCL gene is linked to markers D9S1876 and D9S1674.

Full details of the abovementioned studies are described in the following publications, the disclosure of which are hereby incorporated by reference:

Miles, M. F.; Barhite, S.; Sganga, M.; Elliott, M.: Phosducin-like protein: an ethanol-responsive potential modulator of guanine nucleotide-binding protein function. Proc. Nat. Acad. Sci. 90:10831-10835, 1993; and Thibault, C.; Wang, J. F.; Charnas, R.; Mirel, D.; Barhite, S.; Miles, M. F.: Cloning and characterization of the rat and human phosducin-like protein genes: structure, expression and.

Further studies establishing the function and utilities of PDCL are found in John Hopkins OMIM database record ID 604421, and in sited publications numbered 7403-7404 listed in the bibliography section hereinbelow, which are also hereby incorporated by reference. Requiem, Apoptosis Response Zinc Finger Gene (REQ, Accession NM_006268) is another VGAM1708 host target gene. REQ BINDING SITE is HOST TARGET binding site found in the 3' untranslated region of mRNA encoded by REQ, corresponding to a HOST TARGET binding site such as BINDING SITE I, BINDING SITE II or BINDING SITE III. Table 2 illustrates the complementarity of the nucleotide sequences of REQ BINDING SITE, designated SEQ ID:12953, to the nucleotide sequence of VGAM1708 RNA, herein designated VGAM RNA, also designated SEQ ID:4419.

Another function of VGAM1708 is therefore inhibition of Requiem, Apoptosis Response Zinc Finger Gene (REQ, Accession NM_006268), a gene which is a putative zinc finger that is required for apoptosis in murine myeloid cell lines. Accordingly, utilities of VGAM1708 include diagnosis, prevention and treatment of diseases and clinical conditions associated with REQ. The function of REQ and its association with various diseases and clinical conditions, has been established by previous studies, as described hereinabove with reference to VGAM1224. Splicing Factor Proline/glutamine Rich (polypyrimidine tract binding protein associated) (SFPQ, Accession NM_005066) is another VGAM1708 host target gene. SFPQ BINDING SITE is HOST TARGET binding site found in the 3' untranslated region of mRNA encoded by SFPQ, corresponding to a HOST TARGET binding site such as BINDING SITE I, BINDING SITE II or BINDING SITE III. Table 2 illustrates the complementarity of the nucleotide sequences of SFPQ BINDING SITE, designated SEQ ID:11505, to the nucleotide sequence of VGAM1708 RNA, herein designated VGAM RNA, also designated SEQ ID:4419.

Another function of VGAM1708 is therefore inhibition of Splicing Factor Proline/glutamine Rich (polypyrimidine tract binding protein associated) (SFPQ, Accession NM_005066), a gene which binds intronic polypyrimidine tracts. Accordingly, utilities of VGAM1708 include diagnosis, prevention and treatment of diseases and clinical conditions associated with SFPQ. The function of SFPQ has been established by previous studies. Patton et al. (1993) identified a 100-kD protein that copurified and associated with polypyrimidine tract-binding protein (PTB; 600693). By microsequence analysis and PCR, followed by screening a fetal brain cDNA library, Patton et al. (1993) isolated cDNAs encoding alternatively spliced isoforms of this protein, which they called PSF (PTB-associated splicing factor). The deduced 669- and 707-amino acid PSF isoforms contain 2 consensus RNA-binding domains and an unusual N terminus rich in proline and glutamine residues. PSF is highly basic and has a predicted molecular mass of 76 kD, which is much lower than the experimentally determined molecular mass of 100 kD. Northern blot analysis detected PSF transcripts of 2.5 and 3.0 kb, consistent with the alternative splicing. The authors found that the RNA-binding properties of PSF are identical to those of PTB and that both proteins, together and independently, bind the polypyrimidine tract of mammalian introns. Biochemical complementation, antibody inhibition, and immunodepletion experiments demonstrated that PSF is an essential pre-mRNA splicing factor required early in spliceosome formation. Bacterially synthesized PSF was able to complement immunodepleted extracts and restore splicing activity. Despite its association with PSF, complementary experiments with antibodies against PTB did not suggest an essential role for PTB in pre-mRNA splicing. Clark et al. (1997) identified cases of papillary renal cell carcinoma in which the splicing factor gene PSF was partnered with the TFE3 gene as a result of a translocation, t (X;1)(p11.2; p34).

Full details of the abovementioned studies are described in the following publications, the disclosure of which are hereby incorporated by reference:

Patton, J. G.; Porro, E. B.; Galceran, J.; Tempst, P.; Nadal-Ginard, B.: Cloning and characterization of PSF, a novel pre-mRNA splicing factor. Genes Dev. 7:393-406, 1993; and Clark, J.; Lu, Y.-J.; Sidhar, S. K.; Parker, C.; Gill, S.; Smedley, D.; Hamoudi, R.; Linehan, W. M.; Shipley, J.; Cooper, C. S.: Fusion of splicing factor genes PSF and NonO (p54-nrb) to.

Further studies establishing the function and utilities of SFPQ are found in John Hopkins OMIM database record ID 605199, and in sited publications numbered 6610-6611 listed in the bibliography section hereinbelow, which are also hereby incorporated by reference. Nuclear Antigen Sp100 (SP100, Accession NM_003113) is another VGAM1708 host target gene. SP100 BINDING SITE is HOST TARGET binding site found in the 3' untranslated region of mRNA encoded by SP100, corresponding to a HOST TARGET binding site such as BINDING SITE I, BINDING SITE II or BINDING SITE III. Table 2 illustrates the complementarity of the nucleotide sequences of SP100 BINDING SITE, designated SEQ ID:9086, to the nucleotide sequence of VGAM1708 RNA, herein designated VGAM RNA, also designated SEQ ID:4419.

Another function of VGAM1708 is therefore inhibition of Nuclear Antigen Sp100 (SP100, Accession NM_003113), a gene which may be involved in transduction of interferon action. Accordingly, utilities of VGAM1708 include diagnosis, prevention and treatment of diseases and clinical conditions associated with SP100. The function of SP100 and its association with various diseases and clinical conditions, has been established by previous studies, as described hereinabove with reference to VGAM520. Chromosome 17 Open Reading Frame 26 (C17orf26, Accession NM_139177) is another VGAM1708 host target gene. C17orf26 BINDING SITE is HOST TARGET binding site found in the 3' untranslated region of mRNA encoded by C17orf26, corresponding to a HOST TARGET binding site such as BINDING SITE I, BINDING SITE II or BINDING SITE III. Table 2 illustrates the complementarity of the nucleotide sequences of C17orf26 BINDING SITE, designated SEQ ID:29190, to the nucleotide sequence of VGAM1708 RNA, herein designated VGAM RNA, also designated SEQ ID:4419.

Another function of VGAM1708 is therefore inhibition of Chromosome 17 Open Reading Frame 26 (C17orf26, Accession NM_139177). Accordingly, utilities of VGAM1708 include diagnosis, prevention and treatment of diseases and clinical conditions associated with C17orf26. Cyclin M1 (CNNM1, Accession NM_020348) is another VGAM1708 host target gene. CNNM1 BINDING SITE is HOST TARGET binding site found in the 3' untranslated region of mRNA encoded by CNNM1, corresponding to a HOST TARGET binding site such as BINDING SITE I, BINDING SITE II or BINDING SITE III. Table 2 illustrates the complementarity of the nucleotide sequences of CNNM1 BINDING SITE, designated SEQ ID:21614, to the nucleotide sequence of VGAM1708 RNA, herein designated VGAM RNA, also designated SEQ ID:4419.

Another function of VGAM1708 is therefore inhibition of Cyclin M1 (CNNM1, Accession NM_020348). Accordingly, utilities of VGAM1708 include diagnosis, prevention and treatment of diseases and clinical conditions associated with CNNM1. DKFZp547O146 (Accession NM_020224) is another VGAM1708 host target gene. DKFZp547O146 BINDING SITE is HOST TARGET binding site found in the 5' untranslated region of mRNA encoded by DKFZp547O146, corresponding to a HOST TARGET binding site such as BINDING SITE I, BINDING SITE II or BINDING SITE III. Table 2 illustrates the complementarity of the nucleotide sequences of DKFZp547O146 BINDING SITE, designated SEQ ID:21487, to the nucleotide sequence of VGAM1708 RNA, herein designated VGAM RNA, also designated SEQ ID:4419.

Another function of VGAM1708 is therefore inhibition of DKFZp547O146 (Accession NM_020224). Accordingly, utilities of VGAM1708 include diagnosis, prevention and treatment of diseases and clinical conditions associated with DKFZp547O146. DKFZP564J157 (Accession NM_018457) is another VGAM1708 host target gene. DKFZP564J157 BINDING SITE is HOST TARGET binding site found in the 3' untranslated region of mRNA encoded by DKFZP564J157, corresponding to a HOST TARGET binding site such as BINDING SITE I, BINDING SITE II or BINDING SITE III. Table 2 illustrates the complementarity of the nucleotide sequences of DKFZP564J157 BINDING SITE, designated SEQ ID:20530, to the nucleotide sequence of VGAM1708 RNA, herein designated VGAM RNA, also designated SEQ ID:4419.

Another function of VGAM1708 is therefore inhibition of DKFZP564J157 (Accession NM_018457). Accordingly, utilities of VGAM1708 include diagnosis, prevention and treatment of diseases and clinical conditions associated with DKFZP564J157. DKFZp761K1423 (Accession NM_018422) is another VGAM1708 host target gene. DKFZp761K1423 BINDING SITE is HOST TARGET binding site found in the 5' untranslated region of mRNA encoded by DKFZp761K1423, corresponding to a HOST TARGET binding site such as BINDING SITE I, BINDING SITE II or BINDING SITE III. Table 2 illustrates the complementarity of the nucleotide sequences of DKFZp761K1423 BINDING SITE, designated SEQ ID:20476, to the nucleotide sequence of VGAM1708 RNA, herein designated VGAM RNA, also designated SEQ ID:4419.

Another function of VGAM1708 is therefore inhibition of DKFZp761K1423 (Accession NM_018422). Accordingly, utilities of VGAM1708 include diagnosis, prevention and treatment of diseases and clinical conditions associated with DKFZp761K1423. FLJ20511 (Accession NM_017853) is another VGAM1708 host target gene. FLJ20511 BINDING SITE is HOST TARGET binding site found in the 3' untranslated region of mRNA encoded by FLJ20511, corresponding to a HOST TARGET binding site such as BINDING SITE I, BINDING SITE II or BINDING SITE III. Table 2 illustrates the complementarity of the nucleotide sequences of FLJ20511 BINDING SITE, designated SEQ ID:19531, to the nucleotide sequence of VGAM1708 RNA, herein designated VGAM RNA, also designated SEQ ID:4419.

Another function of VGAM1708 is therefore inhibition of FLJ20511 (Accession NM_017853). Accordingly, utilities of VGAM1708 include diagnosis, prevention and treatment of diseases and clinical conditions associated with FLJ20511. KIAA1130 (Accession XM_031104) is another VGAM1708 host target gene. KIAA1130 BINDING SITE is HOST TARGET binding site found in the 3' untranslated region of mRNA encoded by KIAA1130, corresponding to a HOST TARGET binding site such as BINDING SITE I, BINDING SITE II or BINDING SITE III. Table 2 illustrates the complementarity of the nucleotide sequences of KIAA1130 BINDING SITE, designated SEQ ID:31290, to the nucleotide sequence of VGAM1708 RNA, herein designated VGAM RNA, also designated SEQ ID:4419.

Another function of VGAM1708 is therefore inhibition of KIAA1130 (Accession XM_031104). Accordingly, utilities of VGAM1708 include diagnosis, prevention and treatment of diseases and clinical conditions associated with KIAA1130. KIAA1238 (Accession XM_048675) is another VGAM1708 host target gene. KIAA1238 BINDING SITE is HOST TARGET binding site found in the 3' untranslated region of mRNA encoded by KIAA1238, corresponding to a HOST TARGET binding site such as BINDING SITE I, BINDING SITE II or BINDING SITE III. Table 2 illustrates the complementarity of the nucleotide sequences of KIAA1238 BINDING SITE, designated SEQ ID:35219, to the nucleotide sequence of VGAM1708 RNA, herein designated VGAM RNA, also designated SEQ ID:4419.

Another function of VGAM1708 is therefore inhibition of KIAA1238 (Accession XM_048675). Accordingly, utilities of VGAM1708 include diagnosis, prevention and treatment of diseases and clinical conditions associated with KIAA1238. KIAA1466 (Accession XM_050285) is another VGAM1708 host target gene. KIAA1466 BINDING SITE is HOST TARGET binding site found in the 5' untranslated region of mRNA encoded by KIAA1466, corresponding to a HOST TARGET binding site such as BINDING SITE I, BINDING SITE II or BINDING SITE III. Table 2 illustrates the complementarity of the nucleotide sequences of KIAA1466 BINDING SITE, designated SEQ ID:35604, to the nucleotide sequence of VGAM1708 RNA, herein designated VGAM RNA, also designated SEQ ID:4419.

Another function of VGAM1708 is therefore inhibition of KIAA1466 (Accession XM_050285). Accordingly, utilities of VGAM1708 include diagnosis, prevention and treatment of diseases and clinical conditions associated with KIAA1466. KIAA1536 (Accession NM_020898) is another VGAM1708 host target gene. KIAA1536 BINDING SITE is HOST TARGET binding site found in the 3' untranslated region of mRNA encoded by KIAA1536, corresponding to a HOST TARGET binding site such as BINDING SITE I, BINDING SITE II or BINDING SITE III. Table 2 illustrates the complementarity of the nucleotide sequences of KIAA1536 BINDING SITE, designated SEQ ID:21926, to the nucleotide sequence of VGAM1708 RNA, herein designated VGAM RNA, also designated SEQ ID:4419.

Another function of VGAM1708 is therefore inhibition of KIAA1536 (Accession NM_020898). Accordingly, utilities of VGAM1708 include diagnosis, prevention and treatment of diseases and clinical conditions associated with KIAA1536. KIAA1956 (Accession XM_085836) is another VGAM1708 host target gene. KIAA1956 BINDING SITE is HOST TARGET binding site found in the 3' untranslated region of mRNA encoded by KIAA1956, corresponding to a HOST TARGET binding site such as BINDING SITE I, BINDING SITE II or BINDING SITE III. Table 2 illustrates the complementarity of the nucleotide sequences of KIAA1956 BINDING SITE, designated SEQ ID:38365, to the nucleotide sequence of VGAM1708 RNA, herein designated VGAM RNA, also designated SEQ ID:4419.

Another function of VGAM1708 is therefore inhibition of KIAA1956 (Accession XM_085836). Accordingly, utilities of VGAM1708 include diagnosis, prevention and treatment of diseases and clinical conditions associated with KIAA1956. KOC1 (Accession XM_165847) is another VGAM1708 host target gene. KOC1 BINDING SITE is HOST TARGET binding site found in the 3' untranslated region of mRNA encoded by KOC1, corresponding to a HOST TARGET binding site such as BINDING SITE I, BINDING SITE II or BINDING SITE III. Table 2 illustrates the complementarity of the nucleotide sequences of KOC1 BINDING SITE, designated SEQ ID:43782, to the nucleotide sequence of VGAM1708 RNA, herein designated VGAM RNA, also designated SEQ ID:4419.

Another function of VGAM1708 is therefore inhibition of KOC1 (Accession XM_165847). Accordingly, utilities of VGAM1708 include diagnosis, prevention and treatment of diseases and clinical conditions associated with KOC1. MGC15619 (Accession NM_032369) is another VGAM1708 host target gene. MGC15619 BINDING SITE is HOST TARGET binding site found in the 5' untranslated region of mRNA encoded by MGC15619, corresponding to a HOST TARGET binding site such as BINDING SITE I, BINDING SITE II or BINDING SITE III. Table 2 illustrates the complementarity of the nucleotide sequences of MGC15619 BINDING SITE, designated SEQ ID:26159, to the nucleotide sequence of VGAM1708 RNA, herein designated VGAM RNA, also designated SEQ ID:4419.

Another function of VGAM1708 is therefore inhibition of MGC15619 (Accession NM_032369). Accordingly, utilities of VGAM1708 include diagnosis, prevention and treatment of diseases and clinical conditions associated with MGC15619. MGC16824 (Accession NM_020314) is another VGAM1708 host target gene. MGC16824 BINDING SITE is HOST TARGET binding site found in the 5' untranslated region of mRNA encoded by MGC16824, corresponding to a HOST TARGET binding site such as BINDING SITE I, BINDING SITE II or BINDING SITE III. Table 2 illustrates the complementarity of the nucleotide sequences of MGC16824 BINDING SITE, designated SEQ ID:21573, to the nucleotide sequence of VGAM1708 RNA, herein designated VGAM RNA, also designated SEQ ID:4419.

Another function of VGAM1708 is therefore inhibition of MGC16824 (Accession NM_020314). Accordingly, utilities of VGAM1708 include diagnosis, prevention and treatment of diseases and clinical conditions associated with MGC16824. NET-2 (Accession NM_012338) is another VGAM1708 host target gene. NET-2 BINDING SITE is HOST TARGET binding site found in the 3' untranslated region of mRNA encoded by NET-2, corresponding to a HOST TARGET binding site such as BINDING SITE I, BINDING SITE II or BINDING SITE III. Table 2 illustrates the complementarity of the nucleotide sequences of NET-2 BINDING SITE, designated SEQ ID:14734, to the nucleotide sequence of VGAM1708 RNA, herein designated VGAM RNA, also designated SEQ ID:4419.

Another function of VGAM1708 is therefore inhibition of NET-2 (Accession NM_012338). Accordingly, utilities of VGAM1708 include diagnosis, prevention and treatment of diseases and clinical conditions associated with NET-2. NY-REN-60 (Accession XM_040506) is another VGAM1708 host target gene. NY-REN-60 BINDING SITE is HOST TARGET binding site found in the 3' untranslated region of mRNA encoded by NY-REN-60, corresponding to a HOST TARGET binding site such as BINDING SITE I, BINDING SITE II or BINDING SITE III. Table 2 illustrates the complementarity of the nucleotide sequences of NY-REN-60 BINDING SITE, designated SEQ ID:33320, to the nucleotide sequence of VGAM1708 RNA, herein designated VGAM RNA, also designated SEQ ID:4419.

Another function of VGAM1708 is therefore inhibition of NY-REN-60 (Accession XM_040506). Accordingly, utilities of VGAM1708 include diagnosis, prevention and treatment of diseases and clinical conditions associated with NY-REN-60. RENT2 (Accession NM_015542) is another VGAM1708 host target gene. RENT2 BINDING SITE1 and RENT2 BINDING SITE2 are HOST TARGET binding sites found in untranslated regions of mRNA encoded by RENT2, corresponding to HOST TARGET binding sites such as BINDING SITE I, BINDING SITE II or BINDING SITE III. Table 2 illustrates the complementarity of the nucleotide sequences of RENT2 BINDING SITE1 and RENT2 BINDING SITE2, designated SEQ ID:17804 and SEQ ID:27910 respectively, to the nucleotide sequence of VGAM1708 RNA, herein designated VGAM RNA, also designated SEQ ID:4419.

Another function of VGAM1708 is therefore inhibition of RENT2 (Accession NM_015542). Accordingly, utilities of VGAM1708 include diagnosis, prevention and treatment of diseases and clinical conditions associated with RENT2. LOC146839 (Accession XM_097107) is another VGAM1708 host target gene. LOC146839 BINDING SITE is HOST TARGET binding site found in the 5' untranslated region of mRNA encoded by LOC146839, corresponding to a HOST TARGET binding site such as BINDING SITE I, BINDING SITE II or BINDING SITE III. Table 2 illustrates the complementarity of the nucleotide sequences of LOC146839 BINDING SITE, designated SEQ ID:40757, to the nucleotide sequence of VGAM1708 RNA, herein designated VGAM RNA, also designated SEQ ID:4419.

Another function of VGAM1708 is therefore inhibition of LOC146839 (Accession XM_097107). Accordingly, utilities of VGAM1708 include diagnosis, prevention and treatment of diseases and clinical conditions associated with LOC146839. LOC153205 (Accession XM_098322) is another VGAM1708 host target gene. LOC153205 BINDING SITE is HOST TARGET binding site found in the 3' untranslated region of mRNA encoded by LOC153205, corresponding to a HOST TARGET binding site such as BINDING SITE I, BINDING SITE II or BINDING SITE III. Table 2 illustrates the complementarity of the nucleotide sequences of LOC153205 BINDING SITE, designated SEQ ID:41583, to the nucleotide sequence of VGAM1708 RNA, herein designated VGAM RNA, also designated SEQ ID:4419.

Another function of VGAM1708 is therefore inhibition of LOC153205 (Accession XM_098322). Accordingly, utilities of VGAM1708 include diagnosis, prevention and treatment of diseases and clinical conditions associated with LOC153205. LOC197125 (Accession XM_113826) is another VGAM1708 host target gene. LOC197125 BINDING SITE is HOST TARGET binding site found in the 3' untranslated region of mRNA encoded by LOC197125, corresponding to a HOST TARGET binding site such as BINDING SITE I, BINDING SITE II or BINDING SITE III. Table 2 illustrates the complementarity of the nucleotide sequences of LOC197125 BINDING SITE, designated SEQ ID:42450, to the nucleotide sequence of VGAM1708 RNA, herein designated VGAM RNA, also designated SEQ ID:4419.

Another function of VGAM1708 is therefore inhibition of LOC197125 (Accession XM_113826). Accordingly, utilities of VGAM1708 include diagnosis, prevention and treatment of diseases and clinical conditions associated with LOC197125. LOC56912 (Accession NM_020153) is another VGAM1708 host target gene. LOC56912 BINDING SITE is HOST TARGET binding site found in the 5' untranslated region of mRNA encoded by LOC56912, corresponding to a HOST TARGET binding site such as BINDING SITE I, BINDING SITE II or BINDING SITE III. Table 2 illustrates the complementarity of the nucleotide sequences of LOC56912 BINDING SITE, designated SEQ ID:21366, to the nucleotide sequence of VGAM1708 RNA, herein designated VGAM RNA, also designated SEQ ID:4419.

Another function of VGAM1708 is therefore inhibition of LOC56912 (Accession NM_020153). Accordingly, utilities of VGAM1708 include diagnosis, prevention and treatment of diseases and clinical conditions associated with LOC56912. FIG. 1 further provides a conceptual description of a novel bioinformatically detected viral gene of the present invention, referred to here as Viral Genomic Address Messenger 1709 (VGAM1709) viral gene, which modulates expression of respective host target genes thereof, the function and utility of which host target genes is known in the art.

VGAM1709 is a novel bioinformatically detected regulatory, non protein coding, viral micro RNA (miRNA) gene. The method by which VGAM1709 was detected is described hereinabove with reference to FIGS. 1-8.

VGAM1709 gene, herein designated VGAM GENE, is a viral gene contained in the genome of Semliki Forest Virus. VGAM1709 host target gene, herein designated VGAM HOST TARGET GENE, is a human gene contained in the human genome.

VGAM1709 gene encodes a VGAM1709 precursor RNA, herein designated VGAM PRECURSOR RNA. Similar to other miRNA genes, and unlike most ordinary genes, VGAM1709 precursor RNA does not encode a protein. A nucleotide sequence identical or highly similar to the nucleotide sequence of VGAM1709 precursor RNA is designated SEQ ID:1695, and is provided hereinbelow with reference to the sequence listing part. Nucleotide sequence SEQ ID:1695 is located at position 4455 relative to the genome of Semliki Forest Virus.

VGAM1709 precursor RNA folds onto itself, forming VGAM1709 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1709 folded precursor RNA into VGAM1709 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1709 RNA is designated SEQ ID:4420, and is provided hereinbelow with reference to the sequence listing part.

VGAM1709 host target gene, herein designated VGAM HOST TARGET GENE, encodes a corresponding messenger RNA, VGAM1709 host target RNA, herein designated VGAM HOST TARGET RNA. VGAM1709 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1709 RNA, herein designated VGAM RNA, binds complementarily to one or more host target binding sites located in untranslated regions of VGAM1709 host target RNA, herein designated VGAM HOST TARGET RNA. This complementary binding is due to the fact that the nucleotide sequence of VGAM1709 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1709 RNA, herein designated VGAM RNA, may have a different number of host target binding sites in untranslated regions of a VGAM1709 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1709 RNA, herein designated VGAM RNA, to host target binding sites on VGAM1709 host target RNA, herein designated VGAM HOST TARGET RNA, such as BINDING SITE I, BINDING SITE II and BINDING SITE III, inhibits translation of VGAM1709 host target RNA into VGAM1709 host target protein, herein designated VGAM HOST TARGET PROTEIN. VGAM host target protein is therefore outlined by a broken line.

It is appreciated that VGAM1709 host target gene, herein designated VGAM HOST TARGET GENE, in fact represents a plurality of VGAM1709 host target genes. The mRNA of each one of this plurality of VGAM1709 host target genes comprises one or more host target binding sites, each having a nucleotide sequence which is at least partly complementary to VGAM1709 RNA, herein designated VGAM RNA, and which when bound by VGAM1709 RNA causes inhibition of translation of respective one or more VGAM1709 host target proteins.

It is further appreciated by one skilled in the art that the mode of translational inhibition illustrated by FIG. 1 with specific reference to translational inhibition exerted by VGAM1709 gene, herein designated VGAM GENE, on one or more VGAM1709 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1709 is inhibition of expression of host target genes, as part of a novel viral mechanism of attacking a host. Accordingly, utilities of VGAM1709 include diagnosis, prevention and treatment of viral infection by Semliki Forest Virus. Specific functions, and accordingly utilities, of VGAM1709 correlate with, and may be deduced from, the identity of the host target genes which VGAM1709 binds and inhibits, and the function of these host target genes, as elaborated hereinbelow.

Nucleotide sequences of the VGAM1709 precursor RNA, herein designated VGAM PRECURSOR RNA, and of the 'diced' VGAM1709 RNA, herein designated VGAM RNA, and a schematic representation of the secondary folding of VGAM1709 folded precursor RNA, herein designated VGAM FOLDED PRECURSOR RNA, of VGAM1709 are further described hereinbelow with reference to Table 1.

Nucleotide sequences of host target binding sites, such as BINDING SITE-I, BINDING SITE-II and BINDING SITE-III of FIG. 1, found on VGAM1709 host target RNA, and schematic representation of the complementarity of each of these host target binding sites to VGAM1709 RNA, herein designated VGAM RNA, are described hereinbelow with reference to Table 2.

As mentioned hereinabove with reference to FIG. 1, a function of VGAM1709 gene, herein designated VGAM is inhibition of expression of VGAM1709 target genes. It is appreciated that specific functions, and accordingly utilities, of VGAM1709 correlate with, and may be deduced from, the identity of the target genes which VGAM1709 binds and inhibits, and the function of these target genes, as elaborated hereinbelow.

Centromere Protein F, 350/400 ka (mitosin) (CENPF, Accession NM_016343) is a VGAM1709 host target gene. CENPF BINDING SITE is HOST TARGET binding site found in the 3' untranslated region of mRNA encoded by CENPF, corresponding to a HOST TARGET binding site such as BINDING SITE I, BINDING SITE II or BINDING SITE III. Table 2 illustrates the complementarity of the nucleotide sequences of CENPF BINDING SITE, designated SEQ ID:18469, to the nucleotide sequence of VGAM1709 RNA, herein designated VGAM RNA, also designated SEQ ID:4420.

A function of VGAM1709 is therefore inhibition of Centromere Protein F, 350/400 ka (mitosin) (CENPF, Accession NM_016343), a gene which is a protein of the nuclear matrix and regulates mitosis. Accordingly, utilities of VGAM1709 include diagnosis, prevention and treatment of diseases and clinical conditions associated with CENPF. The function of CENPF has been established by previous studies. Rattner et al. (1993) identified a human kinetochore protein with a molecular weight of approximately 400 kD. Designated centromeric protein F, it was only transiently associated with kinetochores from the onset of mitosis to metaphase. Liao et al. (1995) reported the cDNA sequence of CENPF, together with its expression and localization patterns at different stages of the HeLa cell cycle. CENPF is a protein of the nuclear matrix that gradually accumulates during the cell cycle until it reaches peak levels in G2 and M phase cells and is rapidly degraded upon completion of mitosis. CENPF is first detected at the prekinetochore complex during late G2, and by prophase is clearly detectable as paired foci that correspond to all the centromeres. During mitosis, CENPF is associated with kinetochores from prometaphase until early anaphase and then is detected at the spindle midzone throughout the remainder of anaphase. By telophase, CENPF is concentrated within the intracellular bridge at either side of the midbody. The predicted structure of the 367-kD CENPF protein consists of two 1,600-amino acid-long coil domains that flank a central flexible core.

Full details of the abovementioned studies are described in the following publications, the disclosure of which are hereby incorporated by reference:

Liao, H.; Winkfein, R. J.; Mack, G.; Rattner, J. B.; Yen, T. J.: CENP-F is a protein of the nuclear matrix that assembles onto kinetochores at late G2 and is rapidly degraded after mitosis. J. Cell Biol. 130:507-518, 1995; and Liao, H.; Winkfein, R. J.; Mack, G.; Rattner, J. B.; Yen, T. J.: CENP-F is a protein of the nuclear matrix that assembles onto kinetochores at late G2 and is rapidly degraded after mito.

Further studies establishing the function and utilities of CENPF are found in John Hopkins OMIM database record ID 600236, and in sited publications numbered 7865-786 and 7676 listed in the bibliography section hereinbelow, which are also hereby incorporated by reference. C-type (calcium dependent, carbohydrate-recognition domain) Lectin, Superfamily Member 5 (CLECSF5, Accession NM_013252) is another VGAM1709 host target gene. CLECSF5 BINDING SITE is HOST TARGET binding site found in the 3' untranslated region of mRNA encoded by CLECSF5, corresponding to a HOST TARGET binding site such as BINDING SITE I, BINDING SITE II or BINDING SITE III. Table 2 illustrates the complementarity of the nucleotide sequences of CLECSF5 BINDING SITE, designated SEQ ID:14920, to the nucleotide sequence of VGAM1709 RNA, herein designated VGAM RNA, also designated SEQ ID:4420.

Another function of VGAM1709 is therefore inhibition of C-type (calcium dependent, carbohydrate-recognition domain) Lectin, Superfamily Member 5 (CLECSF5, Accession NM_013252). Accordingly, utilities of VGAM1709 include diagnosis, prevention and treatment of diseases and clinical conditions associated with CLECSF5. Carboxypeptidase D (CPD, Accession NM_001304) is another VGAM1709 host target gene. CPD BINDING SITE is HOST TARGET binding site found in the 3' untranslated region of mRNA encoded by CPD, corresponding to a HOST TARGET binding site such as BINDING SITE I, BINDING SITE II or BINDING SITE III. Table 2 illustrates the complementarity of the nucleotide sequences of CPD BINDING SITE, designated SEQ ID:6982, to the nucleotide sequence of VGAM1709 RNA, herein designated VGAM RNA, also designated SEQ ID:4420.

Another function of VGAM1709 is therefore inhibition of Carboxypeptidase D (CPD, Accession NM_001304), a gene which is a membrane-bound metalloprotease. Accordingly, utilities of VGAM1709 include diagnosis, prevention and treatment of diseases and clinical conditions associated with CPD. The function of CPD and its association with various diseases and clinical conditions, has been established by previous studies, as described hereinabove with reference to VGAM596. Erythrocyte Membrane Protein Band 4.1 (elliptocytosis 1, RH-linked) (EPB41, Accession NM_004437) is another VGAM1709 host target gene. EPB41 BINDING SITE is HOST TARGET binding site found in the 5' untranslated region of mRNA encoded by EPB41, corresponding to a HOST TARGET binding site such as BINDING SITE I, BINDING SITE II or BINDING SITE III. Table 2 illustrates the complementarity of the nucleotide sequences of EPB41 BINDING SITE, designated SEQ ID:10722, to the nucleotide sequence of VGAM1709 RNA, herein designated VGAM RNA, also designated SEQ ID:4420.

Another function of VGAM1709 is therefore inhibition of Erythrocyte Membrane Protein Band 4.1 (elliptocytosis 1, RH-linked) (EPB41, Accession NM_004437), a gene which protein 4.1 is a major structural element of the erythrocyte membrane skeleton. it plays a key role in regulating membrane physical properties of mechanical stability and deformability by stabilizing spectrin-actin interaction. binds with a high affinity to glycophorin and with lower affinity to band iii protein. associates with the nuclear mitotic apparatus. Accordingly, utilities of VGAM1709 include diagnosis, prevention and treatment of diseases and clinical conditions associated with EPB41. The function of EPB41 has been established by previous studies. Conboy et al. (1986) reported the molecular cloning and characterization of human erythrocyte protein 4.1 cDNA and the complete amino acid sequence of the protein derived from the nucleotide sequence. Probes prepared from the cloned erythrocyte protein 4.1 cDNA hybridized with distinct mRNA species from a wide variety of nonerythroid tissues including brain, liver, placenta, pancreas, and intestine, implying substantial homology between erythroid and nonerythroid protein 4.1. Brain protein 4.1, also known as synapsin I (OMIM Ref. No. 313440), is the best characterized of the nonerythroid forms. It is of note that brain protein 4.1 is coded by the X chromosome, whereas erythrocyte protein 4.1 is coded by chromosome 1. Conboy et al. (1986) showed by Southern blot analysis of genomic DNA from an Algerian family that in affected members the mutant protein 4.1 gene had a DNA rearrangement upstream from the initiation codon for translation. The mRNA from the mutant gene was aberrantly spliced. They assigned the gene to 1pter-p32 by hybridization of the cDNA to a panel of chromosomes separated by fluorescence-activated cell sorter. It does not necessarily follow that all Rh-linked elliptocytosis must have hemolytic anemia. The mutation can reside in the protein 4.1 gene but be of a different type which does not lead to severe hemolytic anemia. Indeed, it is known that most Rh-linked elliptocytosis is nonhemolytic. Partial deletion was found in 1 family with elliptocytosis (Kan, 1986). Lambert et al. (1988) found an elliptocytosis family in which an apparent rearrangement of the coding region of the protein 4.1 gene led to restriction fragment length polymorphism when DNA was tested using a fragment of the cDNA that encompassed the coding region of the gene. Contrariwise, the basic defect in at least 1 form of non-Rh-linked elliptocytosis was known, namely the defect in alpha-spectrin which maps to 1q. Tang et al. (1988) compared nucleotide sequences of mRNA encoding erythroid and lymphoid protein 4.1 isoforms. The lymphoid protein 4.1 isoforms exhibited several nucleotide sequence motifs that appeared either to be inserted into or deleted from the mRNA by alternative splicing of a common mRNA precursor. One of the motifs, located within the spectrin-actin binding domain, was found only in erythroid cells and was specifically produced during erythroid cell maturation. Conboy et al. (1988) demonstrated that alternative splicing accounts for multiple isoforms of protein 4.1 in red cells. In his FIG. 2, Conboy (1993) provided a map of the alternative splicing of protein 4.1 mRNA, emphasizing the total chromosome relative to many combinatorial splicing possibilities among the exons of the EPB41 gene. There are, furthermore, 2 AUG initiation codons, 1 of which accounts for an N-terminal extension on the 80-kD gene product. By tissue screening, Baklouti et al. (1997) examined the complex pattern of alternative splicing variants of the protein 4.1 gene. They noted that many splicing variations occur in the spectrin/actin binding (SAB) domain. In particular, they found a 51-bp exon that was expressed almost exclusively in muscle. Genomic cloning revealed a total of 22 exons spanning approximately 200 kb containing the entire erythroid and nonerythroid coding sequence of the human locus Animal model experiments lend further support to the function of EPB41. The complex EPB41 gene on human 1p encodes a diverse family of protein 4.1R isoforms. The prototypical 80-kD 4.1R in mature erythrocytes is a key component of the erythroid membrane skeleton that regulates red cell morphology and mechanical stability. To study the function of 4.1R in nucleated cells, Shi et al. (1999) generated mice with complete deficiency of all 4.1R protein isoforms. These 4.1R-null mice were viable, with moderate hemolytic anemia but no gross abnormalities. Platelet morphology and function were essentially normal. Nonerythroid 4.1R expression patterns revealed focal expression in specific neurons in the brain and in select cells of other major organs, challenging the view that 4.1R expression is widespread among nonerythroid cells.

It is appreciated that the abovementioned animal model for EPB41 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Shi, Z.-T.; Afzal, V.; Coller, B.; Patel, D.; Chasis, J. A.; Parra, M.; Lee, G.; Paszty, C.; Stevens, M.; Walensky, L.; Peters, L. L.; Mohandas, N.; Rubin, E.; Conboy, J. G.: Protein 4.1R-deficient mice are viable but have erythroid membrane skeleton abnormalities. J. Clin. Invest. 103:331-340, 1999; and Baklouti, F.; Huang, S.-C.; Vulliamy, T. J.; Delaunay, J.; Benz, E. J., JR.: Organization of the human protein 4.1 genomic locus: new insights into the tissue-specific alternative splic.

Further studies establishing the function and utilities of EPB41 are found in John Hopkins OMIM database record ID 130500, and in sited publications numbered 2570-2585, 2671, 12764-1276 and 12489-12514 listed in the bibliography section hereinbelow, which are also hereby incorporated by reference. FUS1 (Accession NM_007275) is another VGAM1709 host target gene. FUS1 BINDING SITE is HOST TARGET binding site found in the 3' untranslated region of mRNA encoded by FUS1, corresponding to a HOST TARGET binding site such as BINDING SITE I, BINDING SITE II or BINDING SITE III. Table 2 illustrates the complementarity of the nucleotide sequences of FUS1 BINDING SITE, designated SEQ ID:14135, to the nucleotide sequence of VGAM1709 RNA, herein designated VGAM RNA, also designated SEQ ID:4420.

Another function of VGAM1709 is therefore inhibition of FUS1 (Accession NM_007275), a gene which may function as a tumor suppressor. Accordingly, utilities of VGAM1709 include diagnosis, prevention and treatment of diseases and clinical conditions associated with FUS1. The function of FUS1 and its association with various diseases and clinical conditions, has been established by previous studies, as described hereinabove with reference to VGAM1246. IRTA1 (Accession NM_031282) is another VGAM1709 host target gene. IRTA1 BINDING SITE is HOST TARGET binding site found in the 3' untranslated region of mRNA encoded by IRTA1, corresponding to a HOST TARGET binding site such as BINDING SITE I, BINDING SITE II or BINDING SITE III. Table 2 illustrates the complementarity of the nucleotide sequences of IRTA1 BINDING SITE, designated SEQ ID:25301, to the nucleotide sequence of VGAM1709 RNA, herein designated VGAM RNA, also designated SEQ ID:4420.

Another function of VGAM1709 is therefore inhibition of IRTA1 (Accession NM_031282). Accordingly, utilities of VGAM1709 include diagnosis, prevention and treatment of diseases and clinical conditions associated with IRTA1. Macrophage Scavenger Receptor 1 (MSR1, Accession NM_002445) is another VGAM1709 host target gene. MSR1 BINDING SITE is HOST TARGET binding site found in the 3' untranslated region of mRNA encoded by MSR1, corresponding to a HOST TARGET binding site such as BINDING SITE I, BINDING SITE II or BINDING SITE III. Table 2 illustrates the complementarity of the nucleotide sequences of MSR1 BINDING SITE, designated SEQ ID:8285, to the nucleotide sequence of VGAM1709 RNA, herein designated VGAM RNA, also designated SEQ ID:4420.

Another function of VGAM1709 is therefore inhibition of Macrophage Scavenger Receptor 1 (MSR1, Accession NM_002445), a gene which plays a role in endocytosis of macromolecules. Accordingly, utilities of VGAM1709 include diagnosis, prevention and treatment of diseases and clinical conditions associated with MSR1. The function of MSR1 and its association with various diseases and clinical conditions, has been established by previous studies, as described hereinabove with reference to VGAM176. Tolloid-like 1 (TLL1, Accession NM_012464) is another VGAM1709 host target gene. TLL1 BINDING SITE is HOST TARGET binding site found in the 3' untranslated region of mRNA encoded by TLL1, corresponding to a HOST TARGET binding site such as BINDING SITE I, BINDING SITE II or BINDING SITE III. Table 2 illustrates the complementarity of the nucleotide sequences of TLL1 BINDING SITE, designated SEQ ID:14837, to the nucleotide sequence of VGAM1709 RNA, herein designated VGAM RNA, also designated SEQ ID:4420.

Another function of VGAM1709 is therefore inhibition of Tolloid-like 1 (TLL1, Accession NM_012464), a gene which is involved in bone morphogenesis. Accordingly, utilities of VGAM1709 include diagnosis, prevention and treatment of diseases and clinical conditions associated with TLL1. The function of TLL1 and its association with various diseases and clinical conditions, has been established by previous studies, as described hereinabove with reference to VGAM1583. TOX (Accession NM_014729) is another VGAM1709 host target gene. TOX BINDING SITE is HOST TARGET binding site found in the 3' untranslated region of mRNA encoded by TOX, corresponding to a HOST TARGET binding site such as BINDING SITE I, BINDING SITE II or BINDING SITE III. Table 2 illustrates the complementarity of the nucleotide sequences of TOX BINDING SITE, designated SEQ ID:16324, to the nucleotide sequence of VGAM1709 RNA, herein designated VGAM RNA, also designated SEQ ID:4420.

Another function of VGAM1709 is therefore inhibition of TOX (Accession NM_014729). Accordingly, utilities of VGAM1709 include diagnosis, prevention and treatment of diseases and clinical conditions associated with TOX. TRIM (Accession NM_016388) is another VGAM1709 host target gene. TRIM BINDING SITE is HOST TARGET binding site found in the 3' untranslated region of mRNA encoded by TRIM, corresponding to a HOST TARGET binding site such as BINDING SITE I, BINDING SITE II or BINDING SITE III. Table 2 illustrates the complementarity of the nucleotide sequences of TRIM BINDING SITE, designated SEQ ID:18531, to the nucleotide sequence of VGAM1709 RNA, herein designated VGAM RNA, also designated SEQ ID:4420.

Another function of VGAM1709 is therefore inhibition of TRIM (Accession NM_016388), a gene which plays a role in recruiting signaling proteins to the plasma membrane upon T-cell receptor (TCR) complex activation in T cells. Accordingly, utilities of VGAM1709 include diagnosis, prevention and treatment of diseases and clinical conditions associated with TRIM. The function of TRIM and its association with various diseases and clinical conditions, has been established by previous studies, as described hereinabove with reference to VGAM227. Tripartite Motif-containing 9 (TRIM9, Accession NM_015163) is another VGAM1709 host target gene. TRIM9 BINDING SITE is HOST TARGET binding site found in the 5' untranslated region of mRNA encoded by TRIM9, corresponding to a HOST TARGET binding site such as BINDING SITE I, BINDING SITE II or BINDING SITE III. Table 2 illustrates the complementarity of the nucleotide sequences of TRIM9 BINDING SITE, designated SEQ ID:17516, to the nucleotide sequence of VGAM1709 RNA, herein designated VGAM RNA, also designated SEQ ID:4420.

Another function of VGAM1709 is therefore inhibition of Tripartite Motif-containing 9 (TRIM9, Accession NM_015163), a gene which may function as a positive regulator for mannosylphosphate transferase and is required to mediate mannosylphosphate transfer in both the core and outer chain portions of n-linked. oligosaccharides. Accordingly, utilities of VGAM1709 include diagnosis, prevention and treatment of diseases and clinical conditions associated with TRIM9. The function of TRIM9 and its association with various diseases and clinical conditions, has been established by previous studies, as described hereinabove with reference to VGAM74. AAK1 (Accession NM_014911) is another VGAM1709 host target gene. AAK1 BINDING SITE is HOST TARGET binding site found in the 5' untranslated region of mRNA encoded by AAK1, corresponding to a HOST TARGET binding site such as BINDING SITE I, BINDING SITE II or BINDING SITE III. Table 2 illustrates the complementarity of the nucleotide sequences of AAK1 BINDING SITE, designated SEQ ID:17142, to the nucleotide sequence of VGAM1709 RNA, herein designated VGAM RNA, also designated SEQ ID:4420.

Another function of VGAM1709 is therefore inhibition of AAK1 (Accession NM_014911). Accordingly, utilities of VGAM1709 include diagnosis, prevention and treatment of diseases and clinical conditions associated with AAK1. Acetyl-Coenzyme A Acyltransferase 2 (mitochondrial 3-oxoacyl-Coenzyme A thiolase) (ACAA2, Accession XM_166287) is another VGAM1709 host target gene. ACAA2 BINDING SITE is HOST TARGET binding site found in the 5' untranslated region of mRNA encoded by ACAA2, corresponding to a HOST TARGET binding site such as BINDING SITE I, BINDING SITE II or BINDING SITE III. Table 2 illustrates the complementarity of the nucleotide sequences of ACAA2 BINDING SITE, designated SEQ ID:44094, to the nucleotide sequence of VGAM1709 RNA, herein designated VGAM RNA, also designated SEQ ID:4420.

Another function of VGAM1709 is therefore inhibition of Acetyl-Coenzyme A Acyltransferase 2 (mitochondrial 3-oxoacyl-Coenzyme A thiolase) (ACAA2, Accession XM_166287). Accordingly, utilities of VGAM1709 include diagnosis, prevention and treatment of diseases and clinical conditions associated with ACAA2. DKFZP564D166 (Accession NM_030658) is another VGAM1709 host target gene. DKFZP564D166 BINDING SITE is HOST TARGET binding site found in the 3' untranslated region of mRNA encoded by DKFZP564D166, corresponding to a HOST TARGET binding site such as BINDING SITE I, BINDING SITE II or BINDING SITE III. Table 2 illustrates the complementarity of the nucleotide sequences of DKFZP564D166 BINDING SITE, designated SEQ ID:24989, to the nucleotide sequence of VGAM1709 RNA, herein designated VGAM RNA, also designated SEQ ID:4420.

Another function of VGAM1709 is therefore inhibition of DKFZP564D166 (Accession NM_030658). Accordingly, utilities of VGAM1709 include diagnosis, prevention and treatment of diseases and clinical conditions associated with DKFZP564D166. DKFZP564J102 (Accession XM_038475) is another VGAM1709 host target gene. DKFZP564J102 BINDING SITE is HOST TARGET binding site found in the 5' untranslated region of mRNA encoded by DKFZP564J102, corresponding to a HOST TARGET binding site such as BINDING SITE I, BINDING SITE II or BINDING SITE III. Table 2 illustrates the complementarity of the nucleotide sequences of DKFZP564J102 BINDING SITE, designated SEQ ID:32848, to the nucleotide sequence of VGAM1709 RNA, herein designated VGAM RNA, also designated SEQ ID:4420.

Another function of VGAM1709 is therefore inhibition of DKFZP564J102 (Accession XM_038475). Accordingly, utilities of VGAM1709 include diagnosis, prevention and treatment of diseases and clinical conditions associated with DKFZP564J102. FLJ12488 (Accession NM_031218) is another VGAM1709 host target gene. FLJ12488 BINDING SITE is HOST TARGET binding site found in the 3' untranslated region of mRNA encoded by FLJ12488, corresponding to a HOST TARGET binding site such as BINDING SITE I, BINDING SITE II or BINDING SITE III. Table 2 illustrates the complementarity of the nucleotide sequences of FLJ12488 BINDING SITE, designated SEQ ID:25263, to the nucleotide sequence of VGAM1709 RNA, herein designated VGAM RNA, also designated SEQ ID:4420.

Another function of VGAM1709 is therefore inhibition of FLJ12488 (Accession NM_031218). Accordingly, utilities of VGAM1709 include diagnosis, prevention and treatment of diseases and clinical conditions associated with FLJ12488. FLJ13593 (Accession NM_024780) is another VGAM1709 host target gene. FLJ13593 BINDING SITE is HOST TARGET binding site found in the 3' untranslated region of mRNA encoded by FLJ13593, corresponding to a HOST TARGET binding site such as BINDING SITE I, BINDING SITE II or BINDING SITE III. Table 2 illustrates the complementarity of the nucleotide sequences of FLJ13593 BINDING SITE, designated SEQ ID:24150, to the nucleotide sequence of VGAM1709 RNA, herein designated VGAM RNA, also designated SEQ ID:4420.

Another function of VGAM1709 is therefore inhibition of FLJ13593 (Accession NM_024780). Accordingly, utilities of VGAM1709 include diagnosis, prevention and treatment of diseases and clinical conditions associated with FLJ13593. FLJ20718 (Accession NM_017939) is another VGAM1709 host target gene. FLJ20718 BINDING SITE is HOST TARGET binding site found in the 3' untranslated region of mRNA encoded by FLJ20718, corresponding to a HOST TARGET binding site such as BINDING SITE I, BINDING SITE II or BINDING SITE III. Table 2 illustrates the complementarity of the nucleotide sequences of FLJ20718 BINDING SITE, designated SEQ ID:19633, to the nucleotide sequence of VGAM1709 RNA, herein designated VGAM RNA, also designated SEQ ID:4420.

Another function of VGAM1709 is therefore inhibition of FLJ20718 (Accession NM_017939). Accordingly, utilities of VGAM1709 include diagnosis, prevention and treatment of diseases and clinical conditions associated with FLJ20718. FLJ23511 (Accession NM_032239) is another VGAM1709 host target gene. FLJ23511 BINDING SITE is HOST TARGET binding site found in the 5' untranslated region of mRNA encoded by FLJ23511, corresponding to a HOST TARGET binding site such as BINDING SITE I, BINDING SITE II or BINDING SITE III. Table 2 illustrates the complementarity of the nucleotide sequences of FLJ23511 BINDING SITE, designated SEQ ID:25961, to the nucleotide sequence of VGAM1709 RNA, herein designated VGAM RNA, also designated SEQ ID:4420.

Another function of VGAM1709 is therefore inhibition of FLJ23511 (Accession NM_032239). Accordingly, utilities of VGAM1709 include diagnosis, prevention and treatment of diseases and clinical conditions associated with FLJ23511. KIAA0296 (Accession NM_014699) is another VGAM1709 host target gene. KIAA0296 BINDING SITE is HOST TARGET binding site found in the 3' untranslated region of mRNA encoded by KIAA0296, corresponding to a HOST TARGET binding site such as BINDING SITE I, BINDING SITE II or BINDING SITE III. Table 2 illustrates the complementarity of the nucleotide sequences of KIAA0296 BINDING SITE, designated SEQ ID:16221, to the nucleotide sequence of VGAM1709 RNA, herein designated VGAM RNA, also designated SEQ ID:4420.

Another function of VGAM1709 is therefore inhibition of KIAA0296 (Accession NM_014699). Accordingly, utilities of VGAM1709 include diagnosis, prevention and treatment of diseases and clinical conditions associated with KIAA0296. KIAA0869 (Accession XM_047992) is another VGAM1709 host target gene. KIAA0869 BINDING SITE is HOST TARGET binding site found in the 3' untranslated region of mRNA encoded by KIAA0869, corresponding to a HOST TARGET binding site such as BINDING SITE I, BINDING SITE II or BINDING SITE III. Table 2 illustrates the complementarity of the nucleotide sequences of KIAA0869 BINDING SITE, designated SEQ ID:35093, to the nucleotide sequence of VGAM1709 RNA, herein designated VGAM RNA, also designated SEQ ID:4420.

Another function of VGAM1709 is therefore inhibition of KIAA0869 (Accession XM_047992). Accordingly, utilities of VGAM1709 include diagnosis, prevention and treatment of diseases and clinical conditions associated with KIAA0869. KIAA1054 (Accession XM_043493) is another VGAM1709 host target gene. KIAA1054 BINDING SITE is HOST TARGET binding site found in the 3' untranslated region of mRNA encoded by KIAA1054, corresponding to a HOST TARGET binding site such as BINDING SITE I, BINDING SITE II or BINDING SITE III. Table 2 illustrates the complementarity of the nucleotide sequences of KIAA1054 BINDING SITE, designated SEQ ID:33955, to the nucleotide sequence of VGAM1709 RNA, herein designated VGAM RNA, also designated SEQ ID:4420.

Another function of VGAM1709 is therefore inhibition of KIAA1054 (Accession XM_043493). Accordingly, utilities of VGAM1709 include diagnosis, prevention and treatment of diseases and clinical conditions associated with KIAA1054. MGC22014 (Accession XM_035307) is another VGAM1709 host target gene. MGC22014 BINDING SITE is HOST TARGET binding site found in the 3' untranslated region of mRNA encoded by MGC22014, corresponding to a HOST TARGET binding site such as BINDING SITE I, BINDING SITE II or BINDING SITE III. Table 2 illustrates the complementarity of the nucleotide sequences of MGC22014 BINDING SITE, designated SEQ ID:32219, to the nucleotide sequence of VGAM1709 RNA, herein designated VGAM RNA, also designated SEQ ID:4420.

Another function of VGAM1709 is therefore inhibition of MGC22014 (Accession XM_035307). Accordingly, utilities of VGAM1709 include diagnosis, prevention and treatment of diseases and clinical conditions associated with MGC22014. MGC32104 (Accession NM_144684) is another VGAM1709 host target gene. MGC32104 BINDING SITE is HOST TARGET binding site found in the 3' untranslated region of mRNA encoded by MGC32104, corresponding to a HOST TARGET binding site such as BINDING SITE I, BINDING SITE II or BINDING SITE III. Table 2 illustrates the complementarity of the nucleotide sequences of MGC32104 BINDING SITE, designated SEQ ID:29506, to the nucleotide sequence of VGAM1709 RNA, herein designated VGAM RNA, also designated SEQ ID:4420.

Another function of VGAM1709 is therefore inhibition of MGC32104 (Accession NM_144684). Accordingly, utilities of VGAM1709 include diagnosis, prevention and treatment of diseases and clinical conditions associated with MGC32104. MGC4832 (Accession NM_145061) is another VGAM1709 host target gene. MGC4832 BINDING SITE is HOST TARGET binding site found in the 5' untranslated region of mRNA encoded by MGC4832, corresponding to a HOST TARGET binding site such as BINDING SITE I, BINDING SITE II or BINDING SITE III. Table 2 illustrates the complementarity of the nucleotide sequences of MGC4832 BINDING SITE, designated SEQ ID:29700, to the nucleotide sequence of VGAM1709 RNA, herein designated VGAM RNA, also designated SEQ ID:4420.

Another function of VGAM1709 is therefore inhibition of MGC4832 (Accession NM_145061). Accordingly, utilities of VGAM1709 include diagnosis, prevention and treatment of diseases and clinical conditions associated with MGC4832. MST4 (Accession NM_016542) is another VGAM1709 host target gene. MST4 BINDING SITE is HOST TARGET binding site found in the 3' untranslated region of mRNA encoded by MST4, corresponding to a HOST TARGET binding site such as BINDING SITE I, BINDING SITE II or BINDING SITE III. Table 2 illustrates the complementarity of the nucleotide sequences of MST4 BINDING SITE, designated SEQ ID:18608, to the nucleotide sequence of VGAM1709 RNA, herein designated VGAM RNA, also designated SEQ ID:4420.

Another function of VGAM1709 is therefore inhibition of MST4 (Accession NM_016542). Accordingly, utilities of VGAM1709 include diagnosis, prevention and treatment of diseases and clinical conditions associated with MST4. Pellino Homolog 2 (Drosophila) (PELI2, Accession NM_021255) is another VGAM1709 host target gene. PELI2 BINDING SITE is HOST TARGET binding site found in the 3' untranslated region of mRNA encoded by PELI2, corresponding to a HOST TARGET binding site such as BINDING SITE I, BINDING SITE II or BINDING SITE III. Table 2 illustrates the complementarity of the nucleotide sequences of PELI2 BINDING SITE, designated SEQ ID:22226, to the nucleotide sequence of VGAM1709 RNA, herein designated VGAM RNA, also designated SEQ ID:4420.

Another function of VGAM1709 is therefore inhibition of Pellino Homolog 2 (Drosophila) (PELI2, Accession NM_021255). Accordingly, utilities of VGAM1709 include diagnosis, prevention and treatment of diseases and clinical conditions associated with PELI2. Ras Association (RalGDS/AF-6) Domain Family 2 (RASSF2, Accession NM_014737) is another VGAM1709 host target gene. RASSF2 BINDING SITE is HOST TARGET binding site found in the 3' untranslated region of mRNA encoded by RASSF2, corresponding to a HOST TARGET binding site such as BINDING SITE I, BINDING SITE II or BINDING SITE III. Table 2 illustrates the complementarity of the nucleotide sequences of RASSF2 BINDING SITE, designated SEQ ID:16393, to the nucleotide sequence of VGAM1709 RNA, herein designated VGAM RNA, also designated SEQ ID:4420.

Another function of VGAM1709 is therefore inhibition of Ras Association (RalGDS/AF-6) Domain Family 2 (RASSF2, Accession NM_014737). Accordingly, utilities of VGAM1709 include diagnosis, prevention and treatment of diseases and clinical conditions associated with RASSF2. LOC120939 (Accession XM_073688) is another VGAM1709 host target gene. LOC120939 BINDING SITE is HOST TARGET binding site found in the 5' untranslated region of mRNA encoded by LOC120939, corresponding to a HOST TARGET binding site such as BINDING SITE I, BINDING SITE II or BINDING SITE III. Table 2 illustrates the complementarity of the nucleotide sequences of LOC120939 BINDING SITE, designated SEQ ID:37509, to the nucleotide sequence of VGAM1709 RNA, herein designated VGAM RNA, also designated SEQ ID:4420.

Another function of VGAM1709 is therefore inhibition of LOC120939 (Accession XM_073688). Accordingly, utilities of VGAM1709 include diagnosis, prevention and treatment of diseases and clinical conditions associated with LOC120939. LOC145978 (Accession XM_085288) is another VGAM1709 host target gene. LOC145978 BINDING SITE is HOST TARGET binding site found in the 3' untranslated region of mRNA encoded by LOC145978, corresponding to a HOST TARGET binding site such as BINDING SITE I, BINDING SITE II or BINDING SITE III. Table 2 illustrates the complementarity of the nucleotide sequences of LOC145978 BINDING SITE, designated SEQ ID:38032, to the nucleotide sequence of VGAM1709 RNA, herein designated VGAM RNA, also designated SEQ ID:4420.

Another function of VGAM1709 is therefore inhibition of LOC145978 (Accession XM_085288). Accordingly, utilities of VGAM1709 include diagnosis, prevention and treatment of diseases and clinical conditions associated with LOC145978. LOC147077 (Accession XM_085699) is another VGAM1709 host target gene. LOC147077 BINDING SITE is HOST TARGET binding site found in the 3' untranslated region of mRNA encoded by LOC147077, corresponding to a HOST TARGET binding site such as BINDING SITE I, BINDING SITE II or BINDING SITE III. Table 2 illustrates the complementarity of the nucleotide sequences of LOC147077 BINDING SITE, designated SEQ ID:38290, to the nucleotide sequence of VGAM1709 RNA, herein designated VGAM RNA, also designated SEQ ID:4420.

Another function of VGAM1709 is therefore inhibition of LOC147077 (Accession XM_085699). Accordingly, utilities of VGAM1709 include diagnosis, prevention and treatment of diseases and clinical conditions associated with LOC147077. LOC154930 (Accession XM_088080) is another VGAM1709 host target gene. LOC154930 BINDING SITE is HOST TARGET binding site found in the 3' untranslated region of mRNA encoded by LOC154930, corresponding to a HOST TARGET binding site such as BINDING SITE I, BINDING SITE II or BINDING SITE III. Table 2 illustrates the complementarity of the nucleotide sequences of LOC154930 BINDING SITE, designated SEQ ID:39502, to the nucleotide sequence of VGAM1709 RNA, herein designated VGAM RNA, also designated SEQ ID:4420.

Another function of VGAM1709 is therefore inhibition of LOC154930 (Accession XM_088080). Accordingly, utilities of VGAM1709 include diagnosis, prevention and treatment of diseases and clinical conditions associated with LOC154930. LOC169270 (Accession XM_095607) is another VGAM1709 host target gene. LOC169270 BINDING SITE is HOST TARGET binding site found in the 3' untranslated region of mRNA encoded by LOC169270, corresponding to a HOST TARGET binding site such as BINDING SITE I, BINDING SITE II or BINDING SITE III. Table 2 illustrates the complementarity of the nucleotide sequences of LOC169270 BINDING SITE, designated SEQ ID:40275, to the nucleotide sequence of VGAM1709 RNA, herein designated VGAM RNA, also designated SEQ ID:4420.

Another function of VGAM1709 is therefore inhibition of LOC169270 (Accession XM_095607). Accordingly, utilities of VGAM1709 include diagnosis, prevention and treatment of diseases and clinical conditions associated with LOC169270. LOC197358 (Accession XM_113872) is another VGAM1709 host target gene. LOC197358 BINDING SITE is HOST TARGET binding site found in the 3' untranslated region of mRNA encoded by LOC197358, corresponding to a HOST TARGET binding site such as BINDING SITE I, BINDING SITE II or BINDING SITE III. Table 2 illustrates the complementarity of the nucleotide sequences of LOC197358 BINDING SITE, designated SEQ ID:42508, to the nucleotide sequence of VGAM1709 RNA, herein designated VGAM RNA, also designated SEQ ID:4420.

Another function of VGAM1709 is therefore inhibition of LOC197358 (Accession XM_113872). Accordingly, utilities of VGAM1709 include diagnosis, prevention and treatment of diseases and clinical conditions associated with LOC197358. LOC199775 (Accession XM_114016) is another VGAM1709 host target gene. LOC199775 BINDING SITE is HOST TARGET binding site found in the 3' untranslated region of mRNA encoded by LOC199775, corresponding to a HOST TARGET binding site such as BINDING SITE I, BINDING SITE II or BINDING SITE III. Table 2 illustrates the complementarity of the nucleotide sequences of LOC199775 BINDING SITE, designated SEQ ID:42615, to the nucleotide sequence of VGAM1709 RNA, herein designated VGAM RNA, also designated SEQ ID:4420.

Another function of VGAM1709 is therefore inhibition of LOC199775 (Accession XM_114016). Accordingly, utilities of VGAM1709 include diagnosis, prevention and treatment of diseases and clinical conditions associated with LOC199775. LOC199863 (Accession XM_117147) is another VGAM1709 host target gene. LOC199863 BINDING SITE is HOST TARGET binding site found in the 5' untranslated region of mRNA encoded by LOC199863, corresponding to a HOST TARGET binding site such as BINDING SITE I, BINDING SITE II or BINDING SITE III. Table 2 illustrates the complementarity of the nucleotide sequences of LOC199863 BINDING SITE, designated SEQ ID:43255, to the nucleotide sequence of VGAM1709 RNA, herein designated VGAM RNA, also designated SEQ ID:4420.

Another function of VGAM1709 is therefore inhibition of LOC199863 (Accession XM_117147). Accordingly, utilities of VGAM1709 include diagnosis, prevention and treatment of diseases and clinical conditions associated with LOC199863. LOC219672 (Accession XM_166111) is another VGAM1709 host target gene. LOC219672 BINDING SITE is HOST TARGET binding site found in the 5' untranslated region of mRNA encoded by LOC219672, corresponding to a HOST TARGET binding site such as BINDING SITE I, BINDING SITE II or BINDING SITE III. Table 2 illustrates the complementarity of the nucleotide sequences of LOC219672 BINDING SITE, designated SEQ ID:43889, to the nucleotide sequence of VGAM1709 RNA, herein designated VGAM RNA, also designated SEQ ID:4420.

Another function of VGAM1709 is therefore inhibition of LOC219672 (Accession XM_166111). Accordingly, utilities of VGAM1709 include diagnosis, prevention and treatment of diseases and clinical conditions associated with LOC219672. LOC219894 (Accession XM_167782) is another VGAM1709 host target gene. LOC219894 BINDING SITE is HOST TARGET binding site found in the 3' untranslated region of mRNA encoded by LOC219894, corresponding to a HOST TARGET binding site such as BINDING SITE I, BINDING SITE II or BINDING SITE III. Table 2 illustrates the complementarity of the nucleotide sequences of LOC219894 BINDING SITE, designated SEQ ID:44796, to the nucleotide sequence of VGAM1709 RNA, herein designated VGAM RNA, also designated SEQ ID:4420.

Another function of VGAM1709 is therefore inhibition of LOC219894 (Accession XM_167782). Accordingly, utilities of VGAM1709 include diagnosis, prevention and treatment of diseases and clinical conditions associated with LOC219894. LOC220706 (Accession XM_166001) is another VGAM1709 host target gene. LOC220706 BINDING SITE is HOST TARGET binding site found in the 5' untranslated region of mRNA encoded by LOC220706, corresponding to a HOST TARGET binding site such as BINDING SITE I, BINDING SITE II or BINDING SITE III. Table 2 illustrates the complementarity of the nucleotide sequences of LOC220706 BINDING SITE, designated SEQ ID:43837, to the nucleotide sequence of VGAM1709 RNA, herein designated VGAM RNA, also designated SEQ ID:4420.

Another function of VGAM1709 is therefore inhibition of LOC220706 (Accession XM_166001). Accordingly, utilities of VGAM1709 include diagnosis, prevention and treatment of diseases and clinical conditions associated with LOC220706. LOC221103 (Accession XM_167758) is another VGAM1709 host target gene. LOC221103 BINDING SITE is HOST TARGET binding site found in the 5' untranslated region of mRNA encoded by LOC221103, corresponding to a HOST TARGET binding site such as BINDING SITE I, BINDING SITE II or BINDING SITE III. Table 2 illustrates the complementarity of the nucleotide sequences of LOC221103 BINDING SITE, designated SEQ ID:44779, to the nucleotide sequence of VGAM1709 RNA, herein designated VGAM RNA, also designated SEQ ID:4420.

Another function of VGAM1709 is therefore inhibition of LOC221103 (Accession XM_167758). Accordingly, utilities of VGAM1709 include diagnosis, prevention and treatment of diseases and clinical conditions associated with LOC221103. LOC222681 (Accession XM_167116) is another VGAM1709 host target gene. LOC222681 BINDING SITE is HOST TARGET binding site found in the 5' untranslated region of mRNA encoded by LOC222681, corresponding to a HOST TARGET binding site such as BINDING SITE I, BINDING SITE II or BINDING SITE III. Table 2 illustrates the complementarity of the nucleotide sequences of LOC222681 BINDING SITE, designated SEQ ID:44616, to the nucleotide sequence of VGAM1709 RNA, herein designated VGAM RNA, also designated SEQ ID:4420.

Another function of VGAM1709 is therefore inhibition of LOC222681 (Accession XM_167116). Accordingly, utilities of VGAM1709 include diagnosis, prevention and treatment of diseases and clinical conditions associated with LOC222681. LOC257507 (Accession XM_175204) is another VGAM1709 host target gene. LOC257507 BINDING SITE is HOST TARGET binding site found in the 5' untranslated region of mRNA encoded by LOC257507, corresponding to a HOST TARGET binding site such as BINDING SITE I, BINDING SITE II or BINDING SITE III. Table 2 illustrates the complementarity of the nucleotide sequences of LOC257507 BINDING SITE, designated SEQ ID:46682, to the nucleotide sequence of VGAM1709 RNA, herein designated VGAM RNA, also designated SEQ ID:4420.

Another function of VGAM1709 is therefore inhibition of LOC257507 (Accession XM_175204). Accordingly, utilities of VGAM1709 include diagnosis, prevention and treatment of diseases and clinical conditions associated with LOC257507. LOC257625 (Accession XM_175267) is another VGAM1709 host target gene. LOC257625 BINDING SITE is HOST TARGET binding site found in the 5' untranslated region of mRNA encoded by LOC257625, corresponding to a HOST TARGET binding site such as BINDING SITE I, BINDING SITE II or BINDING SITE III. Table 2 illustrates the complementarity of the nucleotide sequences of LOC257625 BINDING SITE, designated SEQ ID:46738, to the nucleotide sequence of VGAM1709 RNA, herein designated VGAM RNA, also designated SEQ ID:4420.

Another function of VGAM1709 is therefore inhibition of LOC257625 (Accession XM_175267). Accordingly, utilities of VGAM1709 include diagnosis, prevention and treatment of diseases and clinical conditions associated with LOC257625. LOC90019 (Accession NM_138567) is another VGAM1709 host target gene. LOC90019 BINDING SITE is HOST TARGET binding site found in the 3' untranslated region of mRNA encoded by LOC90019, corresponding to a HOST TARGET binding site such as BINDING SITE I, BINDING SITE II or BINDING SITE III. Table 2 illustrates the complementarity of the nucleotide sequences of LOC90019 BINDING SITE, designated SEQ ID:28872, to the nucleotide sequence of VGAM1709 RNA, herein designated VGAM RNA, also designated SEQ ID:4420.

Another function of VGAM1709 is therefore inhibition of LOC90019 (Accession NM_138567). Accordingly, utilities of VGAM1709 include diagnosis, prevention and treatment of diseases and clinical conditions associated with LOC90019. FIG. 1 further provides a conceptual description of a novel bioinformatically detected viral gene of the present invention, referred to here as Viral Genomic Address Messenger 1710 (VGAM1710) viral gene, which modulates expression of respective host target genes thereof, the function and utility of which host target genes is known in the art.

VGAM1710 is a novel bioinformatically detected regulatory, non protein coding, viral micro RNA (miRNA) gene. The method by which VGAM1710 was detected is described hereinabove with reference to FIGS. 1-8.

VGAM1710 gene, herein designated VGAM GENE, is a viral gene contained in the genome of Semliki Forest Virus. VGAM1710 host target gene, herein designated VGAM HOST TARGET GENE, is a human gene contained in the human genome.

VGAM1710 gene encodes a VGAM1710 precursor RNA, herein designated VGAM PRECURSOR RNA. Similar to other miRNA genes, and unlike most ordinary genes, VGAM1710 precursor RNA does not encode a protein. A nucleotide sequence identical or highly similar to the nucleotide sequence of VGAM1710 precursor RNA is designated SEQ ID:1696, and is provided hereinbelow with reference to the sequence listing part. Nucleotide sequence SEQ ID:1696 is located at position 7249 relative to the genome of Semliki Forest Virus.

VGAM1710 precursor RNA folds onto itself, forming VGAM1710 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1710 folded precursor RNA into VGAM1710 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1710 RNA is designated SEQ ID:4421, and is provided hereinbelow with reference to the sequence listing part.

VGAM1710 host target gene, herein designated VGAM HOST TARGET GENE, encodes a corresponding messenger RNA, VGAM1710 host target RNA, herein designated VGAM HOST TARGET RNA. VGAM1710 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1710 RNA, herein designated VGAM RNA, binds complementarily to one or more host target binding sites located in untranslated regions of VGAM1710 host target RNA, herein designated VGAM HOST TARGET RNA. This complementary binding is due to the fact that the nucleotide sequence of VGAM1710 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1710 RNA, herein designated VGAM RNA, may have a different number of host target binding sites in untranslated regions of a VGAM1710 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1710 RNA, herein designated VGAM RNA, to host target binding sites on VGAM1710 host target RNA, herein designated VGAM HOST TARGET RNA, such as BINDING SITE I, BINDING SITE II and BINDING SITE III, inhibits translation of VGAM1710 host target RNA into VGAM1710 host target protein, herein designated VGAM HOST TARGET PROTEIN. VGAM host target protein is therefore outlined by a broken line.

It is appreciated that VGAM1710 host target gene, herein designated VGAM HOST TARGET GENE, in fact represents a plurality of VGAM1710 host target genes. The mRNA of each one of this plurality of VGAM1710 host target genes comprises one or more host target binding sites, each having a nucleotide sequence which is at least partly complementary to VGAM1710 RNA, herein designated VGAM RNA, and which when bound by VGAM1710 RNA causes inhibition of translation of respective one or more VGAM1710 host target proteins.

It is further appreciated by one skilled in the art that the mode of translational inhibition illustrated by FIG. 1 with specific reference to translational inhibition exerted by VGAM1710 gene, herein designated VGAM GENE, on one or more VGAM1710 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1710 is inhibition of expression of host target genes, as part of a novel viral mechanism of attacking a host. Accordingly, utilities of VGAM1710 include diagnosis, prevention and treatment of viral infection by Semliki Forest Virus. Specific functions, and accordingly utilities, of VGAM1710 correlate with, and may be deduced from, the identity of the host target genes which VGAM1710 binds and inhibits, and the function of these host target genes, as elaborated hereinbelow.

Nucleotide sequences of the VGAM1710 precursor RNA, herein designated VGAM PRECURSOR RNA, and of the 'diced' VGAM1710 RNA, herein designated VGAM RNA, and a schematic representation of the secondary folding of VGAM1710 folded precursor RNA, herein designated VGAM FOLDED PRECURSOR RNA, of VGAM1710 are further described hereinbelow with reference to Table 1.

Nucleotide sequences of host target binding sites, such as BINDING SITE-I, BINDING SITE-II and BINDING SITE-III of FIG. 1, found on VGAM1710 host target RNA, and schematic representation of the complementarity of each of these host target binding sites to VGAM1710 RNA, herein designated VGAM RNA, are described hereinbelow with reference to Table 2.

As mentioned hereinabove with reference to FIG. 1, a function of VGAM1710 gene, herein designated VGAM is inhibition of expression of VGAM1710 target genes. It is appreciated that specific functions, and accordingly utilities, of VGAM1710 correlate with, and may be deduced from, the identity of the target genes which VGAM1710 binds and inhibits, and the function of these target genes, as elaborated hereinbelow.

Cytokine Inducible SH2-containing Protein (CISH, Accession NM_013324) is a VGAM1710 host target gene. CISH BINDING SITE1 and CISH BINDING SITE2 are HOST TARGET binding sites found in untranslated regions of mRNA encoded by CISH, corresponding to HOST TARGET binding sites such as BINDING SITE I, BINDING SITE II or BINDING SITE III. Table 2 illustrates the complementarity of the nucleotide sequences of CISH BINDING SITE1 and CISH BINDING SITE2, designated SEQ ID:14973 and SEQ ID:29706 respectively, to the nucleotide sequence of VGAM1710 RNA, herein designated VGAM RNA, also designated SEQ ID:4421.

A function of VGAM1710 is therefore inhibition of Cytokine Inducible SH2-containing Protein (CISH, Accession NM_013324), a gene which intervenes in the negative regulation of cytokines. Accordingly, utilities of VGAM1710 include diagnosis, prevention and treatment of diseases and clinical conditions associated with CISH. The function of CISH and its association with various diseases and clinical conditions, has been established by previous studies, as described hereinabove with reference to VGAM488. Chromosome 20 Open Reading Frame 162 (C20orf162, Accession NM_080603) is another VGAM1710 host target gene. C20orf162 BINDING SITE is HOST TARGET binding site found in the 5' untranslated region of mRNA encoded by C20orf162, corresponding to a HOST TARGET binding site such as BINDING SITE I, BINDING SITE II or BINDING SITE III. Table 2 illustrates the complementarity of the nucleotide sequences of C20orf162 BINDING SITE, designated SEQ ID:27919, to the nucleotide sequence of VGAM1710 RNA, herein designated VGAM RNA, also designated SEQ ID:4421.

Another function of VGAM1710 is therefore inhibition of Chromosome 20 Open Reading Frame 162 (C20orf162, Accession NM_080603). Accordingly, utilities of VGAM1710 include diagnosis, prevention and treatment of diseases and clinical conditions associated with C20orf162. FLJ20297 (Accession NM_017951) is another VGAM1710 host target gene. FLJ20297 BINDING SITE1 and FLJ20297 BINDING SITE2 are HOST TARGET binding sites found in untranslated regions of mRNA encoded by FLJ20297, corresponding to HOST TARGET binding sites such as BINDING SITE I, BINDING SITE II or BINDING SITE III. Table 2 illustrates the complementarity of the nucleotide sequences of FLJ20297 BINDING SITE1 and FLJ20297 BINDING SITE2, designated SEQ ID:19653 and SEQ ID:19361 respectively, to the nucleotide sequence of VGAM1710 RNA, herein designated VGAM RNA, also designated SEQ ID:4421.

Another function of VGAM1710 is therefore inhibition of FLJ20297 (Accession NM_017951). Accordingly, utilities of VGAM1710 include diagnosis, prevention and treatment of diseases and clinical conditions associated with FLJ20297. ZER6 (Accession XM_032742) is another VGAM1710 host target gene. ZER6 BINDING SITE is HOST TARGET binding site found in the 3' untranslated region of mRNA encoded by ZER6, corresponding to a HOST TARGET binding site such as BINDING SITE I, BINDING SITE II or BINDING SITE III. Table 2 illustrates the complementarity of the nucleotide sequences of ZER6 BINDING SITE, designated SEQ ID:31744, to the nucleotide sequence of VGAM1710 RNA, herein designated VGAM RNA, also designated SEQ ID:4421.

Another function of VGAM1710 is therefore inhibition of ZER6 (Accession XM_032742). Accordingly, utilities of VGAM1710 include diagnosis, prevention and treatment of diseases and clinical conditions associated with ZER6. LOC126661 (Accession XM_059061) is another VGAM1710 host target gene. LOC126661 BINDING SITE is HOST TARGET binding site found in the 3' untranslated region of mRNA encoded by LOC126661, corresponding to a HOST TARGET binding site such as BINDING SITE I, BINDING SITE II or BINDING SITE III. Table 2 illustrates the complementarity of the nucleotide sequences of LOC126661 BINDING SITE, designated SEQ ID:36848, to the nucleotide sequence of VGAM1710 RNA, herein designated VGAM RNA, also designated SEQ ID:4421.

Another function of VGAM1710 is therefore inhibition of LOC126661 (Accession XM_059061). Accordingly, utilities of VGAM1710 include diagnosis, prevention and treatment of diseases and clinical conditions associated with LOC126661. LOC144467 (Accession NM_138473) is another VGAM1710 host target gene. LOC144467 BINDING SITE is HOST TARGET binding site found in the 3' untranslated region of mRNA encoded by LOC144467, corresponding to a HOST TARGET binding site such as BINDING SITE I, BINDING SITE II or BINDING SITE III. Table 2 illustrates the complementarity of the nucleotide sequences of LOC144467 BINDING SITE, designated SEQ ID:28821, to the nucleotide sequence of VGAM1710 RNA, herein designated VGAM RNA, also designated SEQ ID:4421.

Another function of VGAM1710 is therefore inhibition of LOC144467 (Accession NM_138473). Accordingly, utilities of VGAM1710 include diagnosis, prevention and treatment of diseases and clinical conditions associated with LOC144467. LOC149830 (Accession XM_097746) is another VGAM1710 host target gene. LOC149830 BINDING SITE is HOST TARGET binding site found in the 3' untranslated region of mRNA encoded by LOC149830, corresponding to a HOST TARGET binding site such as BINDING SITE I, BINDING SITE II or BINDING SITE III. Table 2 illustrates the complementarity of the nucleotide sequences of LOC149830 BINDING SITE, designated SEQ ID:41095, to the nucleotide sequence of VGAM1710 RNA, herein designated VGAM RNA, also designated SEQ ID:4421.

Another function of VGAM1710 is therefore inhibition of LOC149830 (Accession XM_097746). Accordingly, utilities of VGAM1710 include diagnosis, prevention and treatment of diseases and clinical conditions associated with LOC149830. LOC150776 (Accession XM_032542) is another VGAM1710 host target gene. LOC150776 BINDING SITE is HOST TARGET binding site found in the 3' untranslated region of mRNA encoded by LOC150776, corresponding to a HOST TARGET binding site such as BINDING SITE I, BINDING SITE II or BINDING SITE III. Table 2 illustrates the complementarity of the nucleotide sequences of LOC150776 BINDING SITE, designated SEQ ID:31679, to the nucleotide sequence of VGAM1710 RNA, herein designated VGAM RNA, also designated SEQ ID:4421.

Another function of VGAM1710 is therefore inhibition of LOC150776 (Accession XM_032542). Accordingly, utilities of VGAM1710 include diagnosis, prevention and treatment of diseases and clinical conditions associated with LOC150776. LOC152359 (Accession XM_098213) is another VGAM1710 host target gene. LOC152359 BINDING SITE is HOST TARGET binding site found in the 3' untranslated region of mRNA encoded by LOC152359, corresponding to a HOST TARGET binding site such as BINDING SITE I, BINDING SITE II or BINDING SITE III. Table 2 illustrates the complementarity of the nucleotide sequences of LOC152359 BINDING SITE, designated SEQ ID:41491, to the nucleotide sequence of VGAM1710 RNA, herein designated VGAM RNA, also designated SEQ ID:4421.

Another function of VGAM1710 is therefore inhibition of LOC152359 (Accession XM_098213). Accordingly, utilities of VGAM1710 include diagnosis, prevention and treatment of diseases and clinical conditions associated with LOC152359. LOC154930 (Accession XM_088080) is another VGAM1710 host target gene. LOC154930 BINDING SITE is HOST TARGET binding site found in the 3' untranslated region of mRNA encoded by LOC154930, corresponding to a HOST TARGET binding site such as BINDING SITE I, BINDING SITE II or BINDING SITE III. Table 2 illustrates the complementarity of the nucleotide sequences of LOC154930 BINDING SITE, designated SEQ ID:39506, to the nucleotide sequence of VGAM1710 RNA, herein designated VGAM RNA, also designated SEQ ID:4421.

Another function of VGAM1710 is therefore inhibition of LOC154930 (Accession XM_088080). Accordingly, utilities of VGAM1710 include diagnosis, prevention and treatment of diseases and clinical conditions associated with LOC154930. LOC221103 (Accession XM_167758) is another VGAM1710 host target gene. LOC221103 BINDING SITE is HOST TARGET binding site found in the 5' untranslated region of mRNA encoded by LOC221103, corresponding to a HOST TARGET binding site such as BINDING SITE I, BINDING SITE II or BINDING SITE III. Table 2 illustrates the complementarity of the nucleotide sequences of LOC221103 BINDING SITE, designated SEQ ID:44778, to the nucleotide sequence of VGAM1710 RNA, herein designated VGAM RNA, also designated SEQ ID:4421.

Another function of VGAM1710 is therefore inhibition of LOC221103 (Accession XM_167758). Accordingly, utilities of VGAM1710 include diagnosis, prevention and treatment of diseases and clinical conditions associated with LOC221103. LOC253120 (Accession XM_172575) is another VGAM1710 host target gene. LOC253120 BINDING SITE is HOST TARGET binding site found in the 5' untranslated region of mRNA encoded by LOC253120, corresponding to a HOST TARGET binding site such as BINDING SITE I, BINDING SITE II or BINDING SITE III. Table 2 illustrates the complementarity of the nucleotide sequences of LOC253120 BINDING SITE, designated SEQ ID:46076, to the nucleotide sequence of VGAM1710 RNA, herein designated VGAM RNA, also designated SEQ ID:4421.

Another function of VGAM1710 is therefore inhibition of LOC253120 (Accession XM_172575). Accordingly, utilities of VGAM1710 include diagnosis, prevention and treatment of diseases and clinical conditions associated with LOC253120. FIG. 1 further provides a conceptual description of a novel bioinformatically detected viral gene of the present invention, referred to here as Viral Genomic Address Messenger 1711 (VGAM1711) viral gene, which modulates expression of respective host target genes thereof, the function and utility of which host target genes is known in the art.

VGAM1711 is a novel bioinformatically detected regulatory, non protein coding, viral micro RNA (miRNA) gene. The method by which VGAM1711 was detected is described hereinabove with reference to FIGS. 1-8.

VGAM1711 gene, herein designated VGAM GENE, is a viral gene contained in the genome of Semliki Forest Virus. VGAM1711 host target gene, herein designated VGAM HOST TARGET GENE, is a human gene contained in the human genome.

VGAM1711 gene encodes a VGAM1711 precursor RNA, herein designated VGAM PRECURSOR RNA. Similar to other miRNA genes, and unlike most ordinary genes, VGAM1711 precursor RNA does not encode a protein. A nucleotide sequence identical or highly similar to the nucleotide sequence of VGAM1711 precursor RNA is designated SEQ ID:1697, and is provided hereinbelow with reference to the sequence listing part. Nucleotide sequence SEQ ID:1697 is located at position 4081 relative to the genome of Semliki Forest Virus.

VGAM1711 precursor RNA folds onto itself, forming VGAM1711 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1711 folded precursor RNA into VGAM1711 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1711 RNA is designated SEQ ID:4422, and is provided hereinbelow with reference to the sequence listing part.

VGAM1711 host target gene, herein designated VGAM HOST TARGET GENE, encodes a corresponding messenger RNA, VGAM1711 host target RNA, herein designated VGAM HOST TARGET RNA. VGAM1711 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1711 RNA, herein designated VGAM RNA, binds complementarily to one or more host target binding sites located in untranslated regions of VGAM1711 host target RNA, herein designated VGAM HOST TARGET RNA. This complementary binding is due to the fact that the nucleotide sequence of VGAM1711 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1711 RNA, herein designated VGAM RNA, may have a different number of host target binding sites in untranslated regions of a VGAM1711 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1711 RNA, herein designated VGAM RNA, to host target binding sites on VGAM1711 host target RNA, herein designated VGAM HOST TARGET RNA, such as BINDING SITE I, BINDING SITE II and BINDING SITE III, inhibits translation of VGAM1711 host target RNA into VGAM1711 host target protein, herein designated VGAM HOST TARGET PROTEIN. VGAM host target protein is therefore outlined by a broken line.

It is appreciated that VGAM1711 host target gene, herein designated VGAM HOST TARGET GENE, in fact represents a plurality of VGAM1711 host target genes. The mRNA of each one of this plurality of VGAM1711 host target genes comprises one or more host target binding sites, each having a nucleotide sequence which is at least partly complementary to VGAM1711 RNA, herein designated VGAM RNA, and which when bound by VGAM1711 RNA causes inhibition of translation of respective one or more VGAM1711 host target proteins.

It is further appreciated by one skilled in the art that the mode of translational inhibition illustrated by FIG. 1 with specific reference to translational inhibition exerted by VGAM1711 gene, herein designated VGAM GENE, on one or more VGAM1711 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1711 is inhibition of expression of host target genes, as part of a novel viral mechanism of attacking a host. Accordingly, utilities of VGAM1711 include diagnosis, prevention and treatment of viral infection by Semliki Forest Virus. Specific functions, and accordingly utilities, of VGAM1711 correlate with, and may be deduced from, the identity of the host target genes which VGAM1711 binds and inhibits, and the function of these host target genes, as elaborated hereinbelow.

Nucleotide sequences of the VGAM1711 precursor RNA, herein designated VGAM PRECURSOR RNA, and of the 'diced' VGAM1711 RNA, herein designated VGAM RNA, and a schematic representation of the secondary folding of VGAM1711 folded precursor RNA, herein designated VGAM FOLDED PRECURSOR RNA, of VGAM1711 are further described hereinbelow with reference to Table 1.

Nucleotide sequences of host target binding sites, such as BINDING SITE-I, BINDING SITE-II and BINDING SITE-III of FIG. 1, found on VGAM1711 host target RNA, and schematic representation of the complementarity of each of these host target binding sites to VGAM1711 RNA, herein designated VGAM RNA, are described hereinbelow with reference to Table 2.

As mentioned hereinabove with reference to FIG. 1, a function of VGAM1711 gene, herein designated VGAM is inhibition of expression of VGAM1711 target genes. It is appreciated that specific functions, and accordingly utilities, of VGAM1711 correlate with, and may be deduced from, the identity of the target genes which VGAM1711 binds and inhibits, and the function of these target genes, as elaborated hereinbelow.

Adenylate Cyclase 2 (brain) (ADCY2, Accession XM_036383) is a VGAM1711 host target gene. ADCY2 BINDING SITE is HOST TARGET binding site found in the 3' untranslated region of mRNA encoded by ADCY2, corresponding to a HOST TARGET binding site such as BINDING SITE I, BINDING SITE II or BINDING SITE III. Table 2 illustrates the complementarity of the nucleotide sequences of ADCY2 BINDING SITE, designated SEQ ID:32434, to the nucleotide sequence of VGAM1711 RNA, herein designated VGAM RNA, also designated SEQ ID:4422.

A function of VGAM1711 is therefore inhibition of Adenylate Cyclase 2 (brain) (ADCY2, Accession XM_036383), a gene which Adenylate cyclase (type 2), an ATP-pyrophosphate lyase; converts ATP to cAMP. Accordingly, utilities of VGAM1711 include diagnosis, prevention and treatment of diseases and clinical conditions associated with ADCY2. The function of ADCY2 and its association with various diseases and clinical conditions, has been established by previous studies, as described hereinabove with reference to VGAM120. Apolipoprotein L, 1 (APOL1, Accession NM_003661) is another VGAM1711 host target gene. APOL1 BINDING SITE is HOST TARGET binding site found in the 3' untranslated region of mRNA encoded by APOL1, corresponding to a HOST TARGET binding site such as BINDING SITE I, BINDING SITE II or BINDING SITE III. Table 2 illustrates the complementarity of the nucleotide sequences of APOL1 BINDING SITE, designated SEQ ID:9733, to the nucleotide sequence of VGAM1711 RNA, herein designated VGAM RNA, also designated SEQ ID:4422.

Another function of VGAM1711 is therefore inhibition of Apolipoprotein L, 1 (APOL1, Accession NM_003661), a gene which may participate in reverse cholesterol transport from peripheral cells to the liver. Accordingly, utilities of VGAM1711 include diagnosis, prevention and treatment of diseases and clinical conditions associated with APOL1. The function of APOL1 and its association with various diseases and clinical conditions, has been established by previous studies, as described hereinabove with reference to VGAM235. Activating Transcription Factor 5 (ATF5, Accession NM_012068) is another VGAM1711 host target gene. ATF5 BINDING SITE is HOST TARGET binding site found in the 3' untranslated region of mRNA encoded by ATF5, corresponding to a HOST TARGET binding site such as BINDING SITE I, BINDING SITE II or BINDING SITE III. Table 2 illustrates the complementarity of the nucleotide sequences of ATF5 BINDING SITE, designated SEQ ID:14321, to the nucleotide sequence of VGAM1711 RNA, herein designated VGAM RNA, also designated SEQ ID:4422.

Another function of VGAM1711 is therefore inhibition of Activating Transcription Factor 5 (ATF5, Accession NM_012068), a gene which binds to cAMP-inducible promoters and is involved in gene transcription. Accordingly, utilities of VGAM1711 include diagnosis, prevention and treatment of diseases and clinical conditions associated with ATF5. The function of ATF5 and its association with various diseases and clinical conditions, has been established by previous studies, as described hereinabove with reference to VGAM588. Carbohydrate (N-acetylglucosamine 6-O) Sulfotransferase 5 (CHST5, Accession NM_012126) is another VGAM1711 host target gene. CHST5 BINDING SITE is HOST TARGET binding site found in the 3' untranslated region of mRNA encoded by CHST5, corresponding to a HOST TARGET binding site such as BINDING SITE I, BINDING SITE II or BINDING SITE III. Table 2 illustrates the complementarity of the nucleotide sequences of CHST5 BINDING SITE, designated SEQ ID:14440, to the nucleotide sequence of VGAM1711 RNA, herein designated VGAM RNA, also designated SEQ ID:4422.

Another function of VGAM1711 is therefore inhibition of Carbohydrate (N-acetylglucosamine 6-O) Sulfotransferase 5 (CHST5, Accession NM_012126), a gene which may be involved in sulfation of glycoproteins and proteoglycans. Accordingly, utilities of VGAM1711 include diagnosis, prevention and treatment of diseases and clinical conditions associated with CHST5. The function of CHST5 and its association with various diseases and clinical conditions, has been established by previous studies, as described hereinabove with reference to VGAM186. Cryptochrome 2 (photolyase-like) (CRY2, Accession XM_051030) is another VGAM1711 host target gene. CRY2 BINDING SITE is HOST TARGET binding site found in the 3' untranslated region of mRNA encoded by CRY2, corresponding to a HOST TARGET binding site such as BINDING SITE I, BINDING SITE II or BINDING SITE III. Table 2 illustrates the complementarity of the nucleotide sequences of CRY2 BINDING SITE, designated SEQ ID:35732, to the nucleotide sequence of VGAM1711 RNA, herein designated VGAM RNA, also designated SEQ ID:4422.

Another function of VGAM1711 is therefore inhibition of Cryptochrome 2 (photolyase-like) (CRY2, Accession XM_051030), a gene which has a role in circadian photoreception in mammals. Accordingly, utilities of VGAM1711 include diagnosis, prevention and treatment of diseases and clinical conditions associated with CRY2. The function of CRY2 and its association with various diseases and clinical conditions, has been established by previous studies, as described hereinabove with reference to VGAM1223. EGF-like-domain, Multiple 5 (EGFL5, Accession XM_098838) is another VGAM1711 host target gene. EGFL5 BINDING SITE is HOST TARGET binding site found in the 3' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41883, to the nucleotide sequence of VGAM1711 RNA, herein designated VGAM RNA, also designated SEQ ID:4422.

Another function of VGAM1711 is therefore inhibition of EGF-like-domain, Multiple 5 (EGFL5, Accession XM_098838). Accordingly, utilities of VGAM1711 include diagnosis, prevention and treatment of diseases and clinical conditions associated with EGFL5. Glutamine-fructose-6-phosphate Transaminase 2 (GFPT2, Accession NM_005110) is another VGAM1711 host target gene. GFPT2 BINDING SITE is HOST TARGET binding site found in the 3' untranslated region of mRNA encoded by GFPT2, corresponding to a HOST TARGET binding site such as BINDING SITE I, BINDING SITE II or BINDING SITE III. Table 2 illustrates the complementarity of the nucleotide sequences of GFPT2 BINDING SITE, designated SEQ ID:11593, to the nucleotide sequence of VGAM1711 RNA, herein designated VGAM RNA, also designated SEQ ID:4422.

Another function of VGAM1711 is therefore inhibition of Glutamine-fructose-6-phosphate Transaminase 2 (GFPT2, Accession NM_005110). Accordingly, utilities of VGAM1711 include diagnosis, prevention and treatment of diseases and clinical conditions associated with GFPT2. Glucagon-like Peptide 1 Receptor (GLP1R, Accession NM_002062) is another VGAM1711 host target gene. GLP1R BINDING SITE is HOST TARGET binding site found in the 3' untranslated region of mRNA encoded by GLP1R, corresponding to a HOST TARGET binding site such as BINDING SITE I, BINDING SITE II or BINDING SITE III. Table 2 illustrates the complementarity of the nucleotide sequences of GLP1R BINDING SITE, designated SEQ ID:7826, to the nucleotide sequence of VGAM1711 RNA, herein designated VGAM RNA, also designated SEQ ID:4422.

Another function of VGAM1711 is therefore inhibition of Glucagon-like Peptide 1 Receptor (GLP1R, Accession NM_002062), a gene which is mediated by g proteins which activate adenylyl cyclase. Accordingly, utilities of VGAM1711 include diagnosis, prevention and treatment of diseases and clinical conditions associated with GLP1R. The function of GLP1R and its association with various diseases and clinical conditions, has been established by previous studies, as described hereinabove with reference to VGAM1652. Interleukin-1 Receptor-associated Kinase 1 (IRAK1, Accession NM_001569) is another VGAM1711 host target gene. IRAK1 BINDING SITE is HOST TARGET binding site found in the 3' untranslated region of mRNA encoded by IRAK1, corresponding to a HOST TARGET binding site such as BINDING SITE I, BINDING SITE II or BINDING SITE III. Table 2 illustrates the complementarity of the nucleotide sequences of IRAK1 BINDING SITE, designated SEQ ID:7300, to the nucleotide sequence of VGAM1711 RNA, herein designated VGAM RNA, also designated SEQ ID:4422.

Another function of VGAM1711 is therefore inhibition of Interleukin-1 Receptor-associated Kinase 1 (IRAK1, Accession NM_001569). Accordingly, utilities of VGAM1711 include diagnosis, prevention and treatment of diseases and clinical conditions associated with IRAK1. Kinesin Family Member 3B (KIF3B, Accession NM_004798) is another VGAM1711 host target gene. KIF3B BINDING SITE is HOST TARGET binding site found in the 3' untranslated region of mRNA encoded by KIF3B, corresponding to a HOST TARGET binding site such as BINDING SITE I, BINDING SITE II or BINDING SITE III. Table 2 illustrates the complementarity of the nucleotide sequences of KIF3B BINDING SITE, designated SEQ ID:11217, to the nucleotide sequence of VGAM1711 RNA, herein designated VGAM RNA, also designated SEQ ID:4422.

Another function of VGAM1711 is therefore inhibition of Kinesin Family Member 3B (KIF3B, Accession NM_004798), a gene which is a microtubule-based anterograde translocator for membranous organelles. Accordingly, utilities of VGAM1711 include diagnosis, prevention and treatment of diseases and clinical conditions associated with KIF3B. The function of KIF3B and its association with various diseases and clinical conditions, has been established by previous studies, as described hereinabove with reference to VGAM1017. Leptin (obesity homolog, mouse) (LEP, Accession NM_000230) is another VGAM1711 host target gene. LEP BINDING SITE is HOST TARGET binding site found in the 3' untranslated region of mRNA encoded by LEP, corresponding to a HOST TARGET binding site such as BINDING SITE I, BINDING SITE II or BINDING SITE III. Table 2 illustrates the complementarity of the nucleotide sequences of LEP BINDING SITE, designated SEQ ID:5740, to the nucleotide sequence of VGAM1711 RNA, herein designated VGAM RNA, also designated SEQ ID:4422.

Another function of VGAM1711 is therefore inhibition of Leptin (obesity homolog, mouse) (LEP, Accession NM_000230). Accordingly, utilities of VGAM1711 include diagnosis, prevention and treatment of diseases and clinical conditions associated with LEP. LIM Homeobox Protein 1 (LHX1, Accession NM_005568) is another VGAM1711 host target gene. LHX1 BINDING SITE is HOST TARGET binding site found in the 5' untranslated region of mRNA encoded by LHX1, corresponding to a HOST TARGET binding site such as BINDING SITE I, BINDING SITE II or BINDING SITE III. Table 2 illustrates the complementarity of the nucleotide sequences of LHX1 BINDING SITE, designated SEQ ID:12093, to the nucleotide sequence of VGAM1711 RNA, herein designated VGAM RNA, also designated SEQ ID:4422.

Another function of VGAM1711 is therefore inhibition of LIM Homeobox Protein 1 (LHX1, Accession NM_005568). Accordingly, utilities of VGAM1711 include diagnosis, prevention and treatment of diseases and clinical conditions associated with LHX1. LIM Domain Only 2 (rhombotin-like 1) (LMO2, Accession NM_005574) is another VGAM1711 host target gene. LMO2 BINDING SITE is HOST TARGET binding site found in the 5' untranslated region of mRNA encoded by LMO2, corresponding to a HOST TARGET binding site such as BINDING SITE I, BINDING SITE II or BINDING SITE III. Table 2 illustrates the complementarity of the nucleotide sequences of LMO2 BINDING SITE, designated SEQ ID:12102, to the nucleotide sequence of VGAM1711 RNA, herein designated VGAM RNA, also designated SEQ ID:4422.

Another function of VGAM1711 is therefore inhibition of LIM Domain Only 2 (rhombotin-like 1) (LMO2, Accession NM_005574). Accordingly, utilities of VGAM1711 include diagnosis, prevention and treatment of diseases and clinical conditions associated with LMO2. Myelin Oligodendrocyte Glycoprotein (MOG, Accession NM_002433) is another VGAM1711 host target gene. MOG BINDING SITE is HOST TARGET binding site found in the 3' untranslated region of mRNA encoded by MOG, corresponding to a HOST TARGET binding site such as BINDING SITE I, BINDING SITE II or BINDING SITE III. Table 2 illustrates the complementarity of the nucleotide sequences of MOG BINDING SITE, designated SEQ ID:8279, to the nucleotide sequence of VGAM1711 RNA, herein designated VGAM RNA, also designated SEQ ID:4422.

Another function of VGAM1711 is therefore inhibition of Myelin Oligodendrocyte Glycoprotein (MOG, Accession NM_002433). Accordingly, utilities of VGAM1711 include diagnosis, prevention and treatment of diseases and clinical conditions associated with MOG. Paired-like Homeodomain Transcription Factor 3 (PITX3, Accession NM_005029) is another VGAM1711 host target gene. PITX3 BINDING SITE is HOST TARGET binding site found in the 5' untranslated region of mRNA encoded by PITX3, corresponding to a HOST TARGET binding site such as BINDING SITE I, BINDING SITE II or BINDING SITE III. Table 2 illustrates the complementarity of the nucleotide sequences of PITX3 BINDING SITE, designated SEQ ID:11470, to the nucleotide sequence of VGAM1711 RNA, herein designated VGAM RNA, also designated SEQ ID:4422.

Another function of VGAM1711 is therefore inhibition of Paired-like Homeodomain Transcription Factor 3 (PITX3, Accession NM_005029), a gene which may play a role in normal anterior-chamber and lens development. Accordingly, utilities of VGAM1711 include diagnosis, prevention and treatment of diseases and clinical conditions associated with PITX3. The function of PITX3 has been established by previous studies. The PITX3 gene is the human homolog of the mouse Pitx3 gene and is a member of the RIEG/PITX homeo box gene family. The protein encoded by PITX3 shows 99% amino acid identity to the mouse Pitx3 protein, with 100% identity in the homeodomain and approximately 70% overall identity to other members of this family. Semina et al. (1998) screened a collection of 80 DNA samples from individuals with various eye anomalies for mutations in the PITX3 gene. A mutation was identified in each of 2 unrelated patients. The 17-bp insertion in the 3-prime end of the coding sequence, resulting in a frameshift (602669.0001), occurred in a patient with anterior segment mesenchymal dysgenesis (ASMD; 107250) and cataracts; a G-to-A substitution in the 5-prime end of the gene, changing a codon for serine into a codon for asparagine (602669.0002), occurred in a patient with congenital cataracts. Each mutation cosegregated with the disease phenotype in families and was not found in up to 300 control individuals studied. Further expression analysis of Pitx3 in the mouse supported a unique role in early ocular development, with later expression extending to the midbrain, tongue, incisors, sternum, vertebrae, and limbs. The findings strongly suggested the role of PITX3 in ASMD and cataracts and provided new evidence of the contribution of the RIEG/PITX gene family to the developmental program underpinning normal eye formation. The PTX1 (OMIM Ref. No. 601542), PTX2 (OMIM Ref. No. 602149), and PTX3 genes define a novel family of transcription factors, the PTX subfamily, within the paired-like class of homeodomain factors. In mice, Ptx1 and Ptx2 gene expression has been detected in the area of the pituitary primordium and is maintained throughout development in the Rathke pouch and adult pituitary. Pellegrini-Bouiller et al. (1999) characterized the expression of the PTX1, PTX2, and PTX3 genes in the normal human pituitary and in the different types of human pituitary adenomas. RT-PCR analysis detected no PTX3 expression in adult and fetal normal human pituitary, although a specific band was readily amplified from fetal mesencephalon, a tissue known to express this gene. Animal model experiments lend further support to the function of PITX3. Mouse 'aphakia' (ak) is a recessive phenotype that spontaneously occurs in the 129/Sv-SlJ strain and is characterized by small eyes that lack a lens. Semina et al. (1997) determined that the Pitx3 gene is expressed in the developing lens and maps to chromosome 19, close to ak in mouse. In further studies, Semina et al. (2000) did not detect by in situ hybridization Pitx3 transcripts in ak/ak mice, either in the lens placode or at later developmental stages of the lens. Although no differences were previously found between ak/ak and wildtype sequences in the Pitx3 coding region, the authors identified a deletion of 652 bp located 2.5 kb upstream from the start point of the Pitx3 5-prime untranslated region sequence in ak/ak mice. The deletion cosegregated with the ak mutation and was not detected in 16 samples from 10 different mouse strains, including the founder strains. Analysis of the 652-bp region identified sequences similar to consensus binding sites for transcription factors AP2 (see OMIM Ref. No. 107580) and Maf (see OMIM Ref. No. 177075) that were shown to play a critical role in lens determination. The authors concluded that the abnormal ocular development in the aphakia mouse is due to the deletion upstream of the Pitx3 gene.

It is appreciated that the abovementioned animal model for PITX3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Semina, E. V.; Ferrell, R. E.; Mintz-Hittner, H. A.; Bitoun, P.; Alward, W. L. M.; Reiter, R. S.; Funkhauser, C.; Daack-Hirsch, S.; Murray, J. C.: A novel homeobox gene PITX3 is mutated in families with autosomal-dominant cataracts and ASMD. Nature Genet. 19:167-170, 1998; and Semina, E. V.; Murray, J. C.; Reiter, R.; Hrstka, R. F.; Graw, J.: Deletion in the promoter region and altered expression of Pitx3 homeobox gene in aphakia mice. Hum. Molec. Genet. 9.

Further studies establishing the function and utilities of PITX3 are found in John Hopkins OMIM database record ID 602669, and in sited publications numbered 876 and 8944-8764 listed in the bibliography section hereinbelow, which are also hereby incorporated by reference. Suppression of Tumorigenicity 5 (ST5, Accession NM_005418) is another VGAM1711 host target gene. ST5 BINDING SITE1 and ST5 BINDING SITE2 are HOST TARGET binding sites found in untranslated regions of mRNA encoded by ST5, corresponding to HOST TARGET binding sites such as BINDING SITE I, BINDING SITE II or BINDING SITE III. Table 2 illustrates the complementarity of the nucleotide sequences of ST5 BINDING SITE1 and ST5 BINDING SITE2, designated SEQ ID:11889 and SEQ ID:29169 respectively, to the nucleotide sequence of VGAM1711 RNA, herein designated VGAM RNA, also designated SEQ ID:4422.

Another function of VGAM1711 is therefore inhibition of Suppression of Tumorigenicity 5 (ST5, Accession NM_005418), a gene which preferentially binds to the SH3 domain of c-Abl kinase, and acts as a regulator of MAPK1/ERK2 kinase. Accordingly, utilities of VGAM1711 include diagnosis, prevention and treatment of diseases and clinical conditions associated with ST5. The function of ST5 has been established by previous studies. The tumorigenicity of HeLa cells in nude mice can be suppressed by the addition of a normal human chromosome 11 in somatic cell hybrids (Stanbridge, 1976; Klinger, 1980); see 191181 for description of a tumor-suppressor gene located on 11q. Lichy et al. (1992) isolated a HeLa cell line that displayed morphologic features of the nontumorigenic hybrids, demonstrated reduced tumorigenicity in nude mice, and showed an 85% reduction in alkaline phosphatase, a consistent marker of the tumorigenic phenotype in these cells. This cell line, designated F2, contained a single exogenous cDNA, which was recovered by polymerase chain reaction (PCR) and designated HTS1 because of its probable association with 'HeLa tumor suppression.' In nontumorigenic hybrids, RNA species of 2.8, 3.1, and 4.6 kb were identified. In 2 tumorigenic hybrid lines, the 2.8-kb species was markedly reduced or absent. Whereas 3 nontumorigenic human keratinocyte lines expressed all 3 RNA species, several tumorigenic cervical carcinoma cell lines lacked the 2.8-kb species. The HTS1 gene was localized to 11p15 by in situ hybridization, confirming the assignment to chromosome 11 by somatic cell hybrid analysis. Lichy et al. (1992) reviewed previous evidence indicating the presence of a tumor suppressor gene in the 11p15 region; see 194071 and 185440.

Full details of the abovementioned studies are described in the following publications, the disclosure of which are hereby incorporated by reference:

Lichy, J. H.; Modi, W. S.; Seuanez, H. N.; Howley, P. M.: Identification of a human chromosome 11 gene which is differentially regulated in tumorigenic and nontumorigenic somatic cell hybrids of HeLa cells. Cell Growth Differ. 3:541-548, 1992; and Stanbridge, E. J.: Suppression of malignancy in human cells. Nature 260:17-20, 1976.

Further studies establishing the function and utilities of ST5 are found in John Hopkins OMIM database record ID 140750, and in sited publications numbered 12003-12005 listed in the bibliography section hereinbelow, which are also hereby incorporated by reference.1-acylglycerol-3-phosphate O-acyltransferase 1 (lysophosphatidic acid acyltransferase, alpha) (AGPAT1, Accession NM_032741) is another VGAM1711 host target gene. AGPAT1 BINDING SITE is HOST TARGET binding site found in the 3' untranslated region of mRNA encoded by AGPAT1, corresponding to a HOST TARGET binding site such as BINDING SITE I, BINDING SITE II or BINDING SITE III. Table 2 illustrates the complementarity of the nucleotide sequences of AGPAT1 BINDING SITE, designated SEQ ID:26473, to the nucleotide sequence of VGAM1711 RNA, herein designated VGAM RNA, also designated SEQ ID:4422.

Another function of VGAM1711 is therefore inhibition of 1-acylglycerol-3-phosphate O-acyltransferase 1 (lysophosphatidic acid acyltransferase, alpha) (AGPAT1, Accession NM_032741). Accordingly, utilities of VGAM1711 include diagnosis, prevention and treatment of diseases and clinical conditions associated with AGPAT1. Aldo-keto Reductase Family 1, Member D1 (delta 4-3-ketosteroid-5-beta-reductase) (AKR1D1, Accession NM_005989) is another VGAM1711 host target gene. AKR1D1 BINDING SITE is HOST TARGET binding site found in the 3' untranslated region of mRNA encoded by AKR1D1, corresponding to a HOST TARGET binding site such as BINDING SITE I, BINDING SITE II or BINDING SITE III. Table 2 illustrates the complementarity of the nucleotide sequences of AKR1D1 BINDING SITE, designated SEQ ID:12611, to the nucleotide sequence of VGAM1711 RNA, herein designated VGAM RNA, also designated SEQ ID:4422.

Another function of VGAM1711 is therefore inhibition of Aldo-keto Reductase Family 1, Member D1 (delta 4-3-keto-steroid-5-beta-reductase) (AKR1D1, Accession NM_005989). Accordingly, utilities of VGAM1711 include diagnosis, prevention and treatment of diseases and clinical conditions associated with AKR1D1. Chromosome 20 Open Reading Frame 20 (C20orf20, Accession NM_018270) is another VGAM1711 host target gene. C20orf20 BINDING SITE is HOST TARGET binding site found in the 3' untranslated region of mRNA encoded by C20orf20, corresponding to a HOST TARGET binding site such as BINDING SITE I, BINDING SITE II or BINDING SITE III. Table 2 illustrates the complementarity of the nucleotide sequences of C20orf20 BINDING SITE, designated SEQ ID:20245, to the nucleotide sequence of VGAM1711 RNA, herein designated VGAM RNA, also designated SEQ ID:4422.

Another function of VGAM1711 is therefore inhibition of Chromosome 20 Open Reading Frame 20 (C20orf20, Accession NM_018270). Accordingly, utilities of VGAM1711 include diagnosis, prevention and treatment of diseases and clinical conditions associated with C20orf20. FLJ10547 (Accession NM_018134) is another VGAM1711 host target gene. FLJ10547 BINDING SITE is HOST TARGET binding site found in the 3' untranslated region of mRNA encoded by FLJ10547, corresponding to a HOST TARGET binding site such as BINDING SITE I, BINDING SITE II or BINDING SITE III. Table 2 illustrates the complementarity of the nucleotide sequences of FLJ10547 BINDING SITE, designated SEQ ID:19931, to the nucleotide sequence of VGAM1711 RNA, herein designated VGAM RNA, also designated SEQ ID:4422.

Another function of VGAM1711 is therefore inhibition of FLJ10547 (Accession NM_018134). Accordingly, utilities of VGAM1711 include diagnosis, prevention and treatment of diseases and clinical conditions associated with FLJ10547. FLJ11577 (Accession NM_025159) is another VGAM1711 host target gene. FLJ11577 BINDING SITE is HOST TARGET binding site found in the 3' untranslated region of mRNA encoded by FLJ11577, corresponding to a HOST TARGET binding site such as BINDING SITE I, BINDING SITE II or BINDING SITE III. Table 2 illustrates the complementarity of the nucleotide sequences of FLJ11577 BINDING SITE, designated SEQ ID:24800, to the nucleotide sequence of VGAM1711 RNA, herein designated VGAM RNA, also designated SEQ ID:4422.

Another function of VGAM1711 is therefore inhibition of FLJ11577 (Accession NM_025159). Accordingly, utilities of VGAM1711 include diagnosis, prevention and treatment of diseases and clinical conditions associated with FLJ11577. FLJ20079 (Accession NM_017656) is another VGAM1711 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19174, to the nucleotide sequence of VGAM1711 RNA, herein designated VGAM RNA, also designated SEQ ID:4422.

Another function of VGAM1711 is therefore inhibition of FLJ20079 (Accession NM_017656). Accordingly, utilities of VGAM1711 include diagnosis, prevention and treatment of diseases and clinical conditions associated with FLJ20079. FLJ20306 (Accession NM_017756) is another VGAM1711 host target gene. FLJ20306 BINDING SITE is HOST TARGET binding site found in the 3' untranslated region of mRNA encoded by FLJ20306, corresponding to a HOST TARGET binding site such as BINDING SITE I, BINDING SITE II or BINDING SITE III. Table 2 illustrates the complementarity of the nucleotide sequences of FLJ20306 BINDING SITE, designated SEQ ID:19369, to the nucleotide sequence of VGAM1711 RNA, herein designated VGAM RNA, also designated SEQ ID:4422.

Another function of VGAM1711 is therefore inhibition of FLJ20306 (Accession NM_017756). Accordingly, utilities of VGAM1711 include diagnosis, prevention and treatment of diseases and clinical conditions associated with FLJ20306. FLJ22167 (Accession NM_024533) is another VGAM1711 host target gene. FLJ22167 BINDING SITE is HOST TARGET binding site found in the 3' untranslated region of mRNA encoded by FLJ22167, corresponding to a HOST TARGET binding site such as BINDING SITE I, BINDING SITE II or BINDING SITE III. Table 2 illustrates the complementarity of the nucleotide sequences of FLJ22167 BINDING SITE, designated SEQ ID:23742, to the nucleotide sequence of VGAM1711 RNA, herein designated VGAM RNA, also designated SEQ ID:4422.

Another function of VGAM1711 is therefore inhibition of FLJ22167 (Accession NM_024533). Accordingly, utilities of VGAM1711 include diagnosis, prevention and treatment of diseases and clinical conditions associated with FLJ22167. FLJ22615 (Accession XM_043654) is another VGAM1711 host target gene. FLJ22615 BINDING SITE is HOST TARGET binding site found in the 3' untranslated region of mRNA encoded by FLJ22615, corresponding to a HOST TARGET binding site such as BINDING SITE I, BINDING SITE II or BINDING SITE III. Table 2 illustrates the complementarity of the nucleotide sequences of FLJ22615 BINDING SITE, designated SEQ ID:33991, to the nucleotide sequence of VGAM1711 RNA, herein designated VGAM RNA, also designated SEQ ID:4422.

Another function of VGAM1711 is therefore inhibition of FLJ22615 (Accession XM_043654). Accordingly, utilities of VGAM1711 include diagnosis, prevention and treatment of diseases and clinical conditions associated with FLJ22615. FLJ22635 (Accession NM_025092) is another VGAM1711 host target gene. FLJ22635 BINDING SITE is HOST TARGET binding site found in the 3' untranslated region of mRNA encoded by FLJ22635, corresponding to a HOST TARGET binding site such as BINDING SITE I, BINDING SITE II or BINDING SITE III. Table 2 illustrates the complementarity of the nucleotide sequences of FLJ22635 BINDING SITE, designated SEQ ID:24717, to the nucleotide sequence of VGAM1711 RNA, herein designated VGAM RNA, also designated SEQ ID:4422.

Another function of VGAM1711 is therefore inhibition of FLJ22635 (Accession NM_025092). Accordingly, utilities of VGAM1711 include diagnosis, prevention and treatment of diseases and clinical conditions associated with FLJ22635. FLJ22814 (Accession NM_024916) is another VGAM1711 host target gene. FLJ22814 BINDING SITE is HOST TARGET binding site found in the 3' untranslated region of mRNA encoded by FLJ22814, corresponding to a HOST TARGET binding site such as BINDING SITE I, BINDING SITE II or BINDING SITE III. Table 2 illustrates the complementarity of the nucleotide sequences of FLJ22814 BINDING SITE, designated SEQ ID:24442, to the nucleotide sequence of VGAM1711 RNA, herein designated VGAM RNA, also designated SEQ ID:4422.

Another function of VGAM1711 is therefore inhibition of FLJ22814 (Accession NM_024916). Accordingly, utilities of VGAM1711 include diagnosis, prevention and treatment of diseases and clinical conditions associated with FLJ22814. Glycoprotein A33 (transmembrane) (GPA33, Accession NM_005814) is another VGAM1711 host target gene. GPA33 BINDING SITE is HOST TARGET binding site found in the 3' untranslated region of mRNA encoded by GPA33, corresponding to a HOST TARGET binding site such as BINDING SITE I, BINDING SITE II or BINDING SITE III. Table 2 illustrates the complementarity of the nucleotide sequences of GPA33 BINDING SITE, designated SEQ ID:12404, to the nucleotide sequence of VGAM1711 RNA, herein designated VGAM RNA, also designated SEQ ID:4422.

Another function of VGAM1711 is therefore inhibition of Glycoprotein A33 (transmembrane) (GPA33, Accession NM_005814). Accordingly, utilities of VGAM1711 include diagnosis, prevention and treatment of diseases and clinical conditions associated with GPA33. HSRNAFEV (Accession NM_017521) is another VGAM1711 host target gene. HSRNAFEV BINDING SITE is HOST TARGET binding site found in the 5' untranslated region of mRNA encoded by HSRNAFEV, corresponding to a HOST TARGET binding site such as BINDING SITE I, BINDING SITE II or BINDING SITE III. Table 2 illustrates the complementarity of the nucleotide sequences of HSRNAFEV BINDING SITE, designated SEQ ID:18969, to the nucleotide sequence of VGAM1711 RNA, herein designated VGAM RNA, also designated SEQ ID:4422.

Another function of VGAM1711 is therefore inhibition of HSRNAFEV (Accession NM_017521). Accordingly, utilities of VGAM1711 include diagnosis, prevention and treatment of diseases and clinical conditions associated with HSRNAFEV. KIAA0057 (Accession NM_012288) is another VGAM1711 host target gene. KIAA0057 BINDING SITE is HOST TARGET binding site found in the 3' untranslated region of mRNA encoded by KIAA0057, corresponding to a HOST TARGET binding site such as BINDING SITE I, BINDING SITE II or BINDING SITE III. Table 2 illustrates the complementarity of the nucleotide sequences of KIAA0057 BINDING SITE, designated SEQ ID:14621, to the nucleotide sequence of VGAM1711 RNA, herein designated VGAM RNA, also designated SEQ ID:4422.

Another function of VGAM1711 is therefore inhibition of KIAA0057 (Accession NM_012288). Accordingly, utilities of VGAM1711 include diagnosis, prevention and treatment of diseases and clinical conditions associated with KIAA0057. KIAA0284 (Accession XM_032235) is another VGAM1711 host target gene. KIAA0284 BINDING SITE is HOST TARGET binding site found in the 3' untranslated region of mRNA encoded by KIAA0284, corresponding to a HOST TARGET binding site such as BINDING SITE I, BINDING SITE II or BINDING SITE III. Table 2 illustrates the complementarity of the nucleotide sequences of KIAA0284 BINDING SITE, designated SEQ ID:31618, to the nucleotide sequence of VGAM1711 RNA, herein designated VGAM RNA, also designated SEQ ID:4422.

Another function of VGAM1711 is therefore inhibition of KIAA0284 (Accession XM_032235). Accordingly, utilities of VGAM1711 include diagnosis, prevention and treatment of diseases and clinical conditions associated with KIAA0284. KIAA0710 (Accession NM_014871) is another VGAM1711 host target gene. KIAA0710 BINDING SITE is HOST TARGET binding site found in the 5' untranslated region of mRNA encoded by KIAA0710, corresponding to a HOST TARGET binding site such as BINDING SITE I, BINDING SITE II or BINDING SITE III. Table 2 illustrates the complementarity of the nucleotide sequences of KIAA0710 BINDING SITE, designated SEQ ID:16992, to the nucleotide sequence of VGAM1711 RNA, herein designated VGAM RNA, also designated SEQ ID:4422.

Another function of VGAM1711 is therefore inhibition of KIAA0710 (Accession NM_014871). Accordingly, utilities of VGAM1711 include diagnosis, prevention and treatment of diseases and clinical conditions associated with KIAA0710. KIAA0716 (Accession NM_014705) is another VGAM1711 host target gene. KIAA0716 BINDING SITE is HOST TARGET binding site found in the 3' untranslated region of mRNA encoded by KIAA0716, corresponding to a HOST TARGET binding site such as BINDING SITE I, BINDING SITE II or BINDING SITE III. Table 2 illustrates the complementarity of the nucleotide sequences of KIAA0716 BINDING SITE, designated SEQ ID:16247, to the nucleotide sequence of VGAM1711 RNA, herein designated VGAM RNA, also designated SEQ ID:4422.

Another function of VGAM1711 is therefore inhibition of KIAA0716 (Accession NM_014705). Accordingly, utilities of VGAM1711 include diagnosis, prevention and treatment of diseases and clinical conditions associated with KIAA0716. KIAA1228 (Accession XM_036408) is another VGAM1711 host target gene. KIAA1228 BINDING SITE is HOST TARGET binding site found in the 3' untranslated region of mRNA encoded by KIAA1228, corresponding to a HOST TARGET binding site such as BINDING SITE I, BINDING SITE II or BINDING SITE III. Table 2 illustrates the complementarity of the nucleotide sequences of KIAA1228 BINDING SITE, designated SEQ ID:32446, to the nucleotide sequence of VGAM1711 RNA, herein designated VGAM RNA, also designated SEQ ID:4422.

Another function of VGAM1711 is therefore inhibition of KIAA1228 (Accession XM_036408). Accordingly, utilities of VGAM1711 include diagnosis, prevention and treatment of diseases and clinical conditions associated with KIAA1228. KIAA1969 (Accession XM_086098) is another VGAM1711 host target gene. KIAA1969 BINDING SITE is HOST TARGET binding site found in the 3' untranslated region of mRNA encoded by KIAA1969, corresponding to a HOST TARGET binding site such as BINDING SITE I, BINDING SITE II or BINDING SITE III. Table 2 illustrates the complementarity of the nucleotide sequences of KIAA1969 BINDING SITE, designated SEQ ID:38492, to the nucleotide sequence of VGAM1711 RNA, herein designated VGAM RNA, also designated SEQ ID:4422.

Another function of VGAM1711 is therefore inhibition of KIAA1969 (Accession XM_086098). Accordingly, utilities of VGAM1711 include diagnosis, prevention and treatment of diseases and clinical conditions associated with KIAA1969. MGC2452 (Accession NM_032644) is another VGAM1711 host target gene. MGC2452 BINDING SITE is HOST TARGET binding site found in the 5' untranslated region of mRNA encoded by MGC2452, corresponding to a HOST TARGET binding site such as BINDING SITE I, BINDING SITE II or BINDING SITE III. Table 2 illustrates the complementarity of the nucleotide sequences of MGC2452 BINDING SITE, designated SEQ ID:26371, to the nucleotide sequence of VGAM1711 RNA, herein designated VGAM RNA, also designated SEQ ID:4422.

Another function of VGAM1711 is therefore inhibition of MGC2452 (Accession NM_032644). Accordingly, utilities of VGAM1711 include diagnosis, prevention and treatment of diseases and clinical conditions associated with MGC2452. Mitochondrial Ribosomal Protein 63 (MRP63, Accession NM_024026) is another VGAM1711 host target gene. MRP63 BINDING SITE is HOST TARGET binding site found in the 3' untranslated region of mRNA encoded by MRP63, corresponding to a HOST TARGET binding site such as BINDING SITE I, BINDING SITE II or BINDING SITE III. Table 2 illustrates the complementarity of the nucleotide sequences of MRP63 BINDING SITE, designated SEQ ID:23456, to the nucleotide sequence of VGAM1711 RNA, herein designated VGAM RNA, also designated SEQ ID:4422.

Another function of VGAM1711 is therefore inhibition of Mitochondrial Ribosomal Protein 63 (MRP63, Accession NM_024026). Accordingly, utilities of VGAM1711 include diagnosis, prevention and treatment of diseases and clinical conditions associated with MRP63. Mitochondrial Ribosomal Protein L20 (MRPL20, Accession NM_017971) is another VGAM1711 host target gene. MRPL20 BINDING SITE is HOST TARGET binding site found in the 3' untranslated region of mRNA encoded by MRPL20, corresponding to a HOST TARGET binding site such as BINDING SITE I, BINDING SITE II or BINDING SITE III. Table 2 illustrates the complementarity of the nucleotide sequences of MRPL20 BINDING SITE, designated SEQ ID:19697, to the nucleotide sequence of VGAM1711 RNA, herein designated VGAM RNA, also designated SEQ ID:4422.

Another function of VGAM1711 is therefore inhibition of Mitochondrial Ribosomal Protein L20 (MRPL20, Accession NM_017971). Accordingly, utilities of VGAM1711 include diagnosis, prevention and treatment of diseases and clinical conditions associated with MRPL20. Neuronal Guanine Nucleotide Exchange Factor (NGEF, Accession XM_044799) is another VGAM1711 host target gene. NGEF BINDING SITE is HOST TARGET binding site found in the 5' untranslated region of mRNA encoded by NGEF, corresponding to a HOST TARGET binding site such as BINDING SITE I, BINDING SITE II or BINDING SITE III. Table 2 illustrates the complementarity of the nucleotide sequences of NGEF BINDING SITE, designated SEQ ID:34277, to the nucleotide sequence of VGAM1711 RNA, herein designated VGAM RNA, also designated SEQ ID:4422.

Another function of VGAM1711 is therefore inhibition of Neuronal Guanine Nucleotide Exchange Factor (NGEF, Accession XM_044799). Accordingly, utilities of VGAM1711 include diagnosis, prevention and treatment of diseases and clinical conditions associated with NGEF. PRO0529 (Accession NM_014074) is another VGAM1711 host target gene. PRO0529 BINDING SITE is HOST TARGET binding site found in the 3' untranslated region of mRNA encoded by PRO0529, corresponding to a HOST TARGET binding site such as BINDING SITE I, BINDING SITE II or BINDING SITE III. Table 2 illustrates the complementarity of the nucleotide sequences of PRO0529 BINDING SITE, designated SEQ ID:15299, to the nucleotide sequence of VGAM1711 RNA, herein designated VGAM RNA, also designated SEQ ID:4422.

Another function of VGAM1711 is therefore inhibition of PRO0529 (Accession NM_014074). Accordingly, utilities of VGAM1711 include diagnosis, prevention and treatment of diseases and clinical conditions associated with PRO0529. Protein Tyrosine Phosphatase, Receptor Type, U (PTPRU, Accession NM_133177) is another VGAM1711 host target gene. PTPRU BINDING SITE1 through PTPRU BINDING SITE3 are HOST TARGET binding sites found in untranslated regions of mRNA encoded by PTPRU, corresponding to HOST TARGET binding sites such as BINDING SITE I, BINDING SITE II or BINDING SITE III. Table 2 illustrates the complementarity of the nucleotide sequences of PTPRU BINDING SITE1 through PTPRU BINDING SITE3, designated SEQ ID:28401, SEQ ID:28406 and SEQ ID:12256 respectively, to the nucleotide sequence of VGAM1711 RNA, herein designated VGAM RNA, also designated SEQ ID:4422.

Another function of VGAM1711 is therefore inhibition of Protein Tyrosine Phosphatase, Receptor Type, U (PTPRU, Accession NM_133177). Accordingly, utilities of VGAM1711 include diagnosis, prevention and treatment of diseases and clinical conditions associated with PTPRU. Polymerase I and Transcript Release Factor (PTRF, Accession XM_032852) is another VGAM1711 host target gene. PTRF BINDING SITE is HOST TARGET binding site found in the 3' untranslated region of mRNA encoded by PTRF, corresponding to a HOST TARGET binding site such as BINDING SITE I, BINDING SITE II or BINDING SITE III. Table 2 illustrates the complementarity of the nucleotide sequences of PTRF BINDING SITE, designated SEQ ID:31783, to the nucleotide sequence of VGAM1711 RNA, herein designated VGAM RNA, also designated SEQ ID:4422.

Another function of VGAM1711 is therefore inhibition of Polymerase I and Transcript Release Factor (PTRF, Accession XM_032852). Accordingly, utilities of VGAM1711 include diagnosis, prevention and treatment of diseases and clinical conditions associated with PTRF. Smith-Magenis Syndrome Chromosome Region, Candidate 5 (SMCR5, Accession NM_144774) is another VGAM1711 host target gene. SMCR5 BINDING SITE1 and SMCR5 BINDING SITE2 are HOST TARGET binding sites found in untranslated regions of mRNA encoded by SMCR5, corresponding to HOST TARGET binding sites such as BINDING SITE I, BINDING SITE II or BINDING SITE III. Table 2 illustrates the complementarity of the nucleotide sequences of SMCR5 BINDING SITE1 and SMCR5 BINDING SITE2, designated SEQ ID:29563 and SEQ ID:29564 respectively, to the nucleotide sequence of VGAM1711 RNA, herein designated VGAM RNA, also designated SEQ ID:4422.

Another function of VGAM1711 is therefore inhibition of Smith-Magenis Syndrome Chromosome Region, Candidate 5 (SMCR5, Accession NM_144774). Accordingly, utilities of VGAM1711 include diagnosis, prevention and treatment of diseases and clinical conditions associated with SMCR5. UBCE7IP5 (Accession NM_014948) is another VGAM1711 host target gene. UBCE7IP5 BINDING SITE is HOST TARGET binding site found in the 3' untranslated region of mRNA encoded by UBCE7IP5, corresponding to a HOST TARGET binding site such as BINDING SITE I, BINDING SITE II or BINDING SITE III. Table 2 illustrates the complementarity of the nucleotide sequences of UBCE7IP5 BINDING SITE, designated SEQ ID:17272, to the nucleotide sequence of VGAM1711 RNA, herein designated VGAM RNA, also designated SEQ ID:4422.

Another function of VGAM1711 is therefore inhibition of UBCE7IP5 (Accession NM_014948). Accordingly, utilities of VGAM1711 include diagnosis, prevention and treatment of diseases and clinical conditions associated with UBCE7IP5. Zinc Finger Protein 212 (ZNF212, Accession NM_012256) is another VGAM1711 host target gene. ZNF212 BINDING SITE is HOST TARGET binding site found in the 3' untranslated region of mRNA encoded by ZNF212, corresponding to a HOST TARGET binding site such as BINDING SITE I, BINDING SITE II or BINDING SITE III. Table 2 illustrates the complementarity of the nucleotide sequences of ZNF212 BINDING SITE, designated SEQ ID:14558, to the nucleotide sequence of VGAM1711 RNA, herein designated VGAM RNA, also designated SEQ ID:4422.

Another function of VGAM1711 is therefore inhibition of Zinc Finger Protein 212 (ZNF212, Accession NM_012256).

Accordingly, utilities of VGAM1711 include diagnosis, prevention and treatment of diseases and clinical conditions associated with ZNF212. LOC134147 (Accession NM_138809) is another VGAM1711 host target gene. LOC134147 BINDING SITE is HOST TARGET binding site found in the 3' untranslated region of mRNA encoded by LOC134147, corresponding to a HOST TARGET binding site such as BINDING SITE I, BINDING SITE II or BINDING SITE III. Table 2 illustrates the complementarity of the nucleotide sequences of LOC134147 BINDING SITE, designated SEQ ID:29032, to the nucleotide sequence of VGAM1711 RNA, herein designated VGAM RNA, also designated SEQ ID:4422.

Another function of VGAM1711 is therefore inhibition of LOC134147 (Accession NM_138809). Accordingly, utilities of VGAM1711 include diagnosis, prevention and treatment of diseases and clinical conditions associated with LOC134147. LOC138307 (Accession XM_059963) is another VGAM1711 host target gene. LOC138307 BINDING SITE is HOST TARGET binding site found in the 5' untranslated region of mRNA encoded by LOC138307, corresponding to a HOST TARGET binding site such as BINDING SITE I, BINDING SITE II or BINDING SITE III. Table 2 illustrates the complementarity of the nucleotide sequences of LOC138307 BINDING SITE, designated SEQ ID:37123, to the nucleotide sequence of VGAM1711 RNA, herein designated VGAM RNA, also designated SEQ ID:4422.

Another function of VGAM1711 is therefore inhibition of LOC138307 (Accession XM_059963). Accordingly, utilities of VGAM1711 include diagnosis, prevention and treatment of diseases and clinical conditions associated with LOC138307. LOC145195 (Accession XM_096731) is another VGAM1711 host target gene. LOC145195 BINDING SITE is HOST TARGET binding site found in the 3' untranslated region of mRNA encoded by LOC145195, corresponding to a HOST TARGET binding site such as BINDING SITE I, BINDING SITE II or BINDING SITE III. Table 2 illustrates the complementarity of the nucleotide sequences of LOC145195 BINDING SITE, designated SEQ ID:40513, to the nucleotide sequence of VGAM1711 RNA, herein designated VGAM RNA, also designated SEQ ID:4422.

Another function of VGAM1711 is therefore inhibition of LOC145195 (Accession XM_096731). Accordingly, utilities of VGAM1711 include diagnosis, prevention and treatment of diseases and clinical conditions associated with LOC145195. LOC146780 (Accession XM_097086) is another VGAM1711 host target gene. LOC146780 BINDING SITE is HOST TARGET binding site found in the 3' untranslated region of mRNA encoded by LOC146780, corresponding to a HOST TARGET binding site such as BINDING SITE I, BINDING SITE II or BINDING SITE III. Table 2 illustrates the complementarity of the nucleotide sequences of LOC146780 BINDING SITE, designated SEQ ID:40743, to the nucleotide sequence of VGAM1711 RNA, herein designated VGAM RNA, also designated SEQ ID:4422.

Another function of VGAM1711 is therefore inhibition of LOC146780 (Accession XM_097086). Accordingly, utilities of VGAM1711 include diagnosis, prevention and treatment of diseases and clinical conditions associated with LOC146780. LOC150935 (Accession XM_087049) is another VGAM1711 host target gene. LOC150935 BINDING SITE is HOST TARGET binding site found in the 3' untranslated region of mRNA encoded by LOC150935, corresponding to a HOST TARGET binding site such as BINDING SITE I, BINDING SITE II or BINDING SITE III. Table 2 illustrates the complementarity of the nucleotide sequences of LOC150935 BINDING SITE, designated SEQ ID:39020, to the nucleotide sequence of VGAM1711 RNA, herein designated VGAM RNA, also designated SEQ ID:4422.

Another function of VGAM1711 is therefore inhibition of LOC150935 (Accession XM_087049). Accordingly, utilities of VGAM1711 include diagnosis, prevention and treatment of diseases and clinical conditions associated with LOC150935. LOC152804 (Accession XM_098266) is another VGAM1711 host target gene. LOC152804 BINDING SITE is HOST TARGET binding site found in the 3' untranslated region of mRNA encoded by LOC152804, corresponding to a HOST TARGET binding site such as BINDING SITE I, BINDING SITE II or BINDING SITE III. Table 2 illustrates the complementarity of the nucleotide sequences of LOC152804 BINDING SITE, designated SEQ ID:41556, to the nucleotide sequence of VGAM1711 RNA, herein designated VGAM RNA, also designated SEQ ID:4422.

Another function of VGAM1711 is therefore inhibition of LOC152804 (Accession XM_098266). Accordingly, utilities of VGAM1711 include diagnosis, prevention and treatment of diseases and clinical conditions associated with LOC152804. LOC162137 (Accession XM_102426) is another VGAM1711 host target gene. LOC162137 BINDING SITE is HOST TARGET binding site found in the 3' untranslated region of mRNA encoded by LOC162137, corresponding to a HOST TARGET binding site such as BINDING SITE I, BINDING SITE II or BINDING SITE III. Table 2 illustrates the complementarity of the nucleotide sequences of LOC162137 BINDING SITE, designated SEQ ID:42115, to the nucleotide sequence of VGAM1711 RNA, herein designated VGAM RNA, also designated SEQ ID:4422.

Another function of VGAM1711 is therefore inhibition of LOC162137 (Accession XM_102426). Accordingly, utilities of VGAM1711 include diagnosis, prevention and treatment of diseases and clinical conditions associated with LOC162137. LOC166867 (Accession XM_094142) is another VGAM1711 host target gene. LOC166867 BINDING SITE is HOST TARGET binding site found in the 5' untranslated region of mRNA encoded by LOC166867, corresponding to a HOST TARGET binding site such as BINDING SITE I, BINDING SITE II or BINDING SITE III. Table 2 illustrates the complementarity of the nucleotide sequences of LOC166867 BINDING SITE, designated SEQ ID:40223, to the nucleotide sequence of VGAM1711 RNA, herein designated VGAM RNA, also designated SEQ ID:4422.

Another function of VGAM1711 is therefore inhibition of LOC166867 (Accession XM_094142). Accordingly, utilities of VGAM1711 include diagnosis, prevention and treatment of diseases and clinical conditions associated with LOC166867. LOC197201 (Accession XM_113839) is another VGAM1711 host target gene. LOC197201 BINDING SITE is HOST TARGET binding site found in the 3' untranslated region of mRNA encoded by LOC197201, corresponding to a HOST TARGET binding site such as BINDING SITE I, BINDING SITE II or BINDING SITE III. Table 2 illustrates the complementarity of the nucleotide sequences of LOC197201 BINDING SITE, designated SEQ ID:42464, to the nucleotide sequence of VGAM1711 RNA, herein designated VGAM RNA, also designated SEQ ID:4422.

Another function of VGAM1711 is therefore inhibition of LOC197201 (Accession XM_113839). Accordingly, utilities of VGAM1711 include diagnosis, prevention and treatment of diseases and clinical conditions associated with LOC197201. LOC199957 (Accession XM_114068) is another VGAM1711 host target gene. LOC199957 BINDING SITE is HOST TARGET binding site found in the 3' untranslated region of mRNA encoded by LOC199957, corresponding to a HOST TARGET binding site such as BIND- ING SITE I, BINDING SITE II or BINDING SITE III. Table 2 illustrates the complementarity of the nucleotide sequences of LOC199957 BINDING SITE, designated SEQ ID:42675, to the nucleotide sequence of VGAM1711 RNA, herein designated VGAM RNA, also designated SEQ ID:4422.

Another function of VGAM1711 is therefore inhibition of LOC199957 (Accession XM_114068). Accordingly, utilities of VGAM1711 include diagnosis, prevention and treatment of diseases and clinical conditions associated with LOC199957. LOC202052 (Accession XM_117355) is another VGAM1711 host target gene. LOC202052 BINDING SITE is HOST TARGET binding site found in the 3' untranslated region of mRNA encoded by LOC202052, corresponding to a HOST TARGET binding site such as BINDING SITE I, BINDING SITE II or BINDING SITE III. Table 2 illustrates the complementarity of the nucleotide sequences of LOC202052 BINDING SITE, designated SEQ ID:43408, to the nucleotide sequence of VGAM1711 RNA, herein designated VGAM RNA, also designated SEQ ID:4422.

Another function of VGAM1711 is therefore inhibition of LOC202052 (Accession XM_117355). Accordingly, utilities of VGAM1711 include diagnosis, prevention and treatment of diseases and clinical conditions associated with LOC202052. LOC203042 (Accession XM_117490) is another VGAM1711 host target gene. LOC203042 BINDING SITE is HOST TARGET binding site found in the 5' untranslated region of mRNA encoded by LOC203042, corresponding to a HOST TARGET binding site such as BINDING SITE I, BINDING SITE II or BINDING SITE III. Table 2 illustrates the complementarity of the nucleotide sequences of LOC203042 BINDING SITE, designated SEQ ID:43475, to the nucleotide sequence of VGAM1711 RNA, herein designated VGAM RNA, also designated SEQ ID:4422.

Another function of VGAM1711 is therefore inhibition of LOC203042 (Accession XM_117490). Accordingly, utilities of VGAM1711 include diagnosis, prevention and treatment of diseases and clinical conditions associated with LOC203042. LOC219722 (Accession XM_167593) is another VGAM1711 host target gene. LOC219722 BINDING SITE is HOST TARGET binding site found in the 3' untranslated region of mRNA encoded by LOC219722, corresponding to a HOST TARGET binding site such as BINDING SITE I, BINDING SITE II or BINDING SITE III. Table 2 illustrates the complementarity of the nucleotide sequences of LOC219722 BINDING SITE, designated SEQ ID:44709, to the nucleotide sequence of VGAM1711 RNA, herein designated VGAM RNA, also designated SEQ ID:4422.

Another function of VGAM1711 is therefore inhibition of LOC219722 (Accession XM_167593). Accordingly, utilities of VGAM1711 include diagnosis, prevention and treatment of diseases and clinical conditions associated with LOC219722. LOC221271 (Accession XM_166307) is another VGAM1711 host target gene. LOC221271 BINDING SITE is HOST TARGET binding site found in the 3' untranslated region of mRNA encoded by LOC221271, corresponding to a HOST TARGET binding site such as BINDING SITE I, BINDING SITE II or BINDING SITE III. Table 2 illustrates the complementarity of the nucleotide sequences of LOC221271 BINDING SITE, designated SEQ ID:44125, to the nucleotide sequence of VGAM1711 RNA, herein designated VGAM RNA, also designated SEQ ID:4422.

Another function of VGAM1711 is therefore inhibition of LOC221271 (Accession XM_166307). Accordingly, utilities of VGAM1711 include diagnosis, prevention and treatment of diseases and clinical conditions associated with LOC221271. LOC221410 (Accession XM_166373) is another VGAM1711 host target gene. LOC221410 BINDING SITE is HOST TARGET binding site found in the 3' untranslated region of mRNA encoded by LOC221410, corresponding to a HOST TARGET binding site such as BINDING SITE I, BINDING SITE II or BINDING SITE III. Table 2 illustrates the complementarity of the nucleotide sequences of LOC221410 BINDING SITE, designated SEQ ID:44195, to the nucleotide sequence of VGAM1711 RNA, herein designated VGAM RNA, also designated SEQ ID:4422.

Another function of VGAM1711 is therefore inhibition of LOC221410 (Accession XM_166373). Accordingly, utilities of VGAM1711 include diagnosis, prevention and treatment of diseases and clinical conditions associated with LOC221410. LOC90509 (Accession XM_032209) is another VGAM1711 host target gene. LOC90509 BINDING SITE is HOST TARGET binding site found in the 3' untranslated region of mRNA encoded by LOC90509, corresponding to a HOST TARGET binding site such as BINDING SITE I, BINDING SITE II or BINDING SITE III. Table 2 illustrates the complementarity of the nucleotide sequences of LOC90509 BINDING SITE, designated SEQ ID:31608, to the nucleotide sequence of VGAM1711 RNA, herein designated VGAM RNA, also designated SEQ ID:4422.

Another function of VGAM1711 is therefore inhibition of LOC90509 (Accession XM_032209). Accordingly, utilities of VGAM1711 include diagnosis, prevention and treatment of diseases and clinical conditions associated with LOC90509. FIG. 1 further provides a conceptual description of a novel bioinformatically detected viral gene of the present invention, referred to here as Viral Genomic Address Messenger 1712 (VGAM1712) viral gene, which modulates expression of respective host target genes thereof, the function and utility of which host target genes is known in the art.

VGAM1712 is a novel bioinformatically detected regulatory, non protein coding, viral micro RNA (miRNA) gene. The method by which VGAM1712 was detected is described hereinabove with reference to FIGS. 1-8.

VGAM1712 gene, herein designated VGAM GENE, is a viral gene contained in the genome of Sindbis Virus. VGAM1712 host target gene, herein designated VGAM HOST TARGET GENE, is a human gene contained in the human genome.

VGAM1712 gene encodes a VGAM1712 precursor RNA, herein designated VGAM PRECURSOR RNA. Similar to other miRNA genes, and unlike most ordinary genes, VGAM1712 precursor RNA does not encode a protein. A nucleotide sequence identical or highly similar to the nucleotide sequence of VGAM1712 precursor RNA is designated SEQ ID:1698, and is provided hereinbelow with reference to the sequence listing part. Nucleotide sequence SEQ ID:1698 is located at position 8817 relative to the genome of Sindbis Virus.

VGAM1712 precursor RNA folds onto itself, forming VGAM1712 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1712 folded precursor RNA into VGAM1712 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 42%) nucleotide sequence of VGAM1712 RNA is designated SEQ ID:4423, and is provided hereinbelow with reference to the sequence listing part.

VGAM1712 host target gene, herein designated VGAM HOST TARGET GENE, encodes a corresponding messenger RNA, VGAM1712 host target RNA, herein designated VGAM HOST TARGET RNA. VGAM1712 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1712 RNA, herein designated VGAM RNA, binds complementarily to one or more host target binding sites located in untranslated regions of VGAM1712 host target RNA, herein designated VGAM HOST TARGET RNA. This complementary binding is due to the fact that the nucleotide sequence of VGAM1712 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1712 RNA, herein designated VGAM RNA, may have a different number of host target binding sites in untranslated regions of a VGAM1712 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1712 RNA, herein designated VGAM RNA, to host target binding sites on VGAM1712 host target RNA, herein designated VGAM HOST TARGET RNA, such as BINDING SITE I, BINDING SITE II and BINDING SITE III, inhibits translation of VGAM1712 host target RNA into VGAM1712 host target protein, herein designated VGAM HOST TARGET PROTEIN. VGAM host target protein is therefore outlined by a broken line.

It is appreciated that VGAM1712 host target gene, herein designated VGAM HOST TARGET GENE, in fact represents a plurality of VGAM1712 host target genes. The mRNA of each one of this plurality of VGAM1712 host target genes comprises one or more host target binding sites, each having a nucleotide sequence which is at least partly complementary to VGAM1712 RNA, herein designated VGAM RNA, and which when bound by VGAM1712 RNA causes inhibition of translation of respective one or more VGAM1712 host target proteins.

It is further appreciated by one skilled in the art that the mode of translational inhibition illustrated by FIG. 1 with specific reference to translational inhibition exerted by VGAM1712 gene, herein designated VGAM GENE, on one or more VGAM1712 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1712 is inhibition of expression of host target genes, as part of a novel viral mechanism of attacking a host. Accordingly, utilities of VGAM1712 include diagnosis, prevention and treatment of viral infection by Sindbis Virus. Specific functions, and accordingly utilities, of VGAM1712 correlate with, and may be deduced from, the identity of the host target genes which VGAM1712 binds and inhibits, and the function of these host target genes, as elaborated hereinbelow.

Nucleotide sequences of the VGAM1712 precursor RNA, herein designated VGAM PRECURSOR RNA, and of the 'diced' VGAM1712 RNA, herein designated VGAM RNA, and a schematic representation of the secondary folding of VGAM1712 folded precursor RNA, herein designated VGAM FOLDED PRECURSOR RNA, of VGAM1712 are further described hereinbelow with reference to Table 1.

Nucleotide sequences of host target binding sites, such as BINDING SITE-I, BINDING SITE-II and BINDING SITE-III of FIG. 1, found on VGAM1712 host target RNA, and schematic representation of the complementarity of each of these host target binding sites to VGAM1712 RNA, herein designated VGAM RNA, are described hereinbelow with reference to Table 2.

As mentioned hereinabove with reference to FIG. 1, a function of VGAM1712 gene, herein designated VGAM is inhibition of expression of VGAM1712 target genes. It is appreciated that specific functions, and accordingly utilities, of VGAM1712 correlate with, and may be deduced from, the identity of the target genes which VGAM1712 binds and inhibits, and the function of these target genes, as elaborated hereinbelow.

EphB3 (EPHB3, Accession NM_004443) is a VGAM1712 host target gene. EPHB3 BINDING SITE is HOST TARGET binding site found in the 3' untranslated region of mRNA encoded by EPHB3, corresponding to a HOST TARGET binding site such as BINDING SITE I, BINDING SITE II or BINDING SITE III. Table 2 illustrates the complementarity of the nucleotide sequences of EPHB3 BINDING SITE, designated SEQ ID:10736, to the nucleotide sequence of VGAM1712 RNA, herein designated VGAM RNA, also designated SEQ ID:4423.

A function of VGAM1712 is therefore inhibition of EphB3 (EPHB3, Accession NM_004443), a gene which receptor for members of the ephrin-b family. binds to ephrin-b1 and -b2. Accordingly, utilities of VGAM1712 include diagnosis, prevention and treatment of diseases and clinical conditions associated with EPHB3. The function of EPHB3 and its association with various diseases and clinical conditions, has been established by previous studies, as described hereinabove with reference to VGAM455. Heat Shock 70 kDa Protein 9B (mortalin-2) (HSPA9B, Accession NM_004134) is another VGAM1712 host target gene. HSPA9B BINDING SITE is HOST TARGET binding site found in the 3' untranslated region of mRNA encoded by HSPA9B, corresponding to a HOST TARGET binding site such as BINDING SITE I, BINDING SITE II or BINDING SITE III. Table 2 illustrates the complementarity of the nucleotide sequences of HSPA9B BINDING SITE, designated SEQ ID:10347, to the nucleotide sequence of VGAM1712 RNA, herein designated VGAM RNA, also designated SEQ ID:4423.

Another function of VGAM1712 is therefore inhibition of Heat Shock 70kDa Protein 9B (mortalin-2) (HSPA9B, Accession NM_004134). Accordingly, utilities of VGAM1712 include diagnosis, prevention and treatment of diseases and clinical conditions associated with HSPA9B. Chromosome 1

Open Reading Frame 24 (C1orf24, Accession NM_052966) is another VGAM1712 host target gene. C1orf24 BINDING SITE is HOST TARGET binding site found in the 3' untranslated region of mRNA encoded by C1orf24, corresponding to a HOST TARGET binding site such as BINDING SITE I, BINDING SITE II or BINDING SITE III. Table 2 illustrates the complementarity of the nucleotide sequences of C1orf24 BINDING SITE, designated SEQ ID:27533, to the nucleotide sequence of VGAM1712 RNA, herein designated VGAM RNA, also designated SEQ ID:4423.

Another function of VGAM1712 is therefore inhibition of Chromosome 1 Open Reading Frame 24 (C1orf24, Accession NM_052966). Accordingly, utilities of VGAM1712 include diagnosis, prevention and treatment of diseases and clinical conditions associated with C1orf24. NIBAN (Accession NM_022083) is another VGAM1712 host target gene. NIBAN BINDING SITE is HOST TARGET binding site found in the 3' untranslated region of mRNA encoded by NIBAN, corresponding to a HOST TARGET binding site such as BINDING SITE I, BINDING SITE II or BINDING SITE III. Table 2 illustrates the complementarity of the nucleotide sequences of NIBAN BINDING SITE, designated SEQ ID:22630, to the nucleotide sequence of VGAM1712 RNA, herein designated VGAM RNA, also designated SEQ ID:4423.

Another function of VGAM1712 is therefore inhibition of NIBAN (Accession NM_022083). Accordingly, utilities of VGAM1712 include diagnosis, prevention and treatment of diseases and clinical conditions associated with NIBAN. Zinc Finger Protein 84 (HPF2) (ZNF84, Accession NM_003428) is another VGAM1712 host target gene. ZNF84 BINDING SITE is HOST TARGET binding site found in the 5' untranslated region of mRNA encoded by ZNF84, corresponding to a HOST TARGET binding site such as BINDING SITE I, BINDING SITE II or BINDING SITE III. Table 2 illustrates the complementarity of the nucleotide sequences of ZNF84 BINDING SITE, designated SEQ ID:9479, to the nucleotide sequence of VGAM1712 RNA, herein designated VGAM RNA, also designated SEQ ID:4423.

Another function of VGAM1712 is therefore inhibition of Zinc Finger Protein 84 (HPF2) (ZNF84, Accession NM_003428). Accordingly, utilities of VGAM1712 include diagnosis, prevention and treatment of diseases and clinical conditions associated with ZNF84. LOC256310 (Accession XM_172813) is another VGAM1712 host target gene. LOC256310 BINDING SITE is HOST TARGET binding site found in the 5' untranslated region of mRNA encoded by LOC256310, corresponding to a HOST TARGET binding site such as BINDING SITE I, BINDING SITE II or BINDING SITE III. Table 2 illustrates the complementarity of the nucleotide sequences of LOC256310 BINDING SITE, designated SEQ ID:46093, to the nucleotide sequence of VGAM1712 RNA, herein designated VGAM RNA, also designated SEQ ID:4423.

Another function of VGAM1712 is therefore inhibition of LOC256310 (Accession XM_172813). Accordingly, utilities of VGAM1712 include diagnosis, prevention and treatment of diseases and clinical conditions associated with LOC256310. FIG. 1 further provides a conceptual description of a novel bioinformatically detected viral gene of the present invention, referred to here as Viral Genomic Address Messenger 1713 (VGAM1713) viral gene, which modulates expression of respective host target genes thereof, the function and utility of which host target genes is known in the art.

VGAM1713 is a novel bioinformatically detected regulatory, non protein coding, viral micro RNA (miRNA) gene. The method by which VGAM1713 was detected is described hereinabove with reference to FIGS. 1-8.

VGAM1713 gene, herein designated VGAM GENE, is a viral gene contained in the genome of Sindbis Virus. VGAM1713 host target gene, herein designated VGAM HOST TARGET GENE, is a human gene contained in the human genome.

VGAM1713 gene encodes a VGAM1713 precursor RNA, herein designated VGAM PRECURSOR RNA. Similar to other miRNA genes, and unlike most ordinary genes, VGAM1713 precursor RNA does not encode a protein. A nucleotide sequence identical or highly similar to the nucleotide sequence of VGAM1713 precursor RNA is designated SEQ ID:1699, and is provided hereinbelow with reference to the sequence listing part. Nucleotide sequence SEQ ID:1699 is located at position 8146 relative to the genome of Sindbis Virus.

VGAM1713 precursor RNA folds onto itself, forming VGAM1713 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1713 folded precursor RNA into VGAM1713 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1713 RNA is designated SEQ ID:4424, and is provided hereinbelow with reference to the sequence listing part.

VGAM1713 host target gene, herein designated VGAM HOST TARGET GENE, encodes a corresponding messenger RNA, VGAM1713 host target RNA, herein designated VGAM HOST TARGET RNA. VGAM1713 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1713 RNA, herein designated VGAM RNA, binds complementarily to one or more host target binding sites located in untranslated regions of VGAM1713 host target RNA, herein designated VGAM HOST TARGET RNA. This complementary binding is due to the fact that the nucleotide sequence of VGAM1713 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1713 RNA, herein designated VGAM RNA, may have a different number of host target binding sites in untranslated regions of a VGAM1713 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1713 RNA, herein designated VGAM RNA, to host target binding sites on VGAM1713 host target RNA, herein designated VGAM HOST TARGET RNA, such as BINDING SITE I, BINDING SITE II and BINDING SITE III, inhibits translation of VGAM1713 host target RNA into VGAM1713 host target protein, herein designated VGAM HOST TARGET PROTEIN. VGAM host target protein is therefore outlined by a broken line.

It is appreciated that VGAM1713 host target gene, herein designated VGAM HOST TARGET GENE, in fact represents a plurality of VGAM1713 host target genes. The mRNA of each one of this plurality of VGAM1713 host target genes comprises one or more host target binding sites, each having a nucleotide sequence which is at least partly complementary to VGAM1713 RNA, herein designated VGAM RNA, and which when bound by VGAM1713 RNA causes inhibition of translation of respective one or more VGAM1713 host target proteins.

It is further appreciated by one skilled in the art that the mode of translational inhibition illustrated by FIG. 1 with specific reference to translational inhibition exerted by VGAM1713 gene, herein designated VGAM GENE, on one or more VGAM1713 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1713 is inhibition of expression of host target genes, as part of a novel viral mechanism of attacking a host. Accordingly, utilities of VGAM1713 include diagnosis, prevention and treatment of viral infection by Sindbis Virus. Specific functions, and accordingly utilities, of VGAM1713 correlate with, and may be deduced from, the identity of the host target genes which VGAM1713 binds and inhibits, and the function of these host target genes, as elaborated hereinbelow.

Nucleotide sequences of the VGAM1713 precursor RNA, herein designated VGAM PRECURSOR RNA, and of the 'diced' VGAM1713 RNA, herein designated VGAM RNA, and a schematic representation of the secondary folding of VGAM1713 folded precursor RNA, herein designated VGAM FOLDED PRECURSOR RNA, of VGAM1713 are further described hereinbelow with reference to Table 1.

Nucleotide sequences of host target binding sites, such as BINDING SITE-I, BINDING SITE-II and BINDING SITE-III of FIG. 1, found on VGAM1713 host target RNA, and schematic representation of the complementarity of each of these host target binding sites to VGAM1713 RNA, herein designated VGAM RNA, are described hereinbelow with reference to Table 2.

As mentioned hereinabove with reference to FIG. 1, a function of VGAM1713 gene, herein designated VGAM is inhibition of expression of VGAM1713 target genes. It is appreciated that specific functions, and accordingly utilities, of VGAM1713 correlate with, and may be deduced from, the identity of the target genes which VGAM1713 binds and inhibits, and the function of these target genes, as elaborated hereinbelow.

ATP10C (Accession NM_024490) is a VGAM1713 host target gene. ATP10C BINDING SITE is HOST TARGET binding site found in the 3' untranslated region of mRNA encoded by ATP10C, corresponding to a HOST TARGET binding site such as BINDING SITE I, BINDING SITE II or BINDING SITE III. Table 2 illustrates the complementarity of the nucleotide sequences of ATP10C BINDING SITE, designated SEQ ID:23687, to the nucleotide sequence of VGAM1713 RNA, herein designated VGAM RNA, also designated SEQ ID:4424.

A function of VGAM1713 is therefore inhibition of ATP10C (Accession NM_024490), a gene which is phosphorylated in their intermediate state, drives uphill transport of ions across membranes. Accordingly, utilities of VGAM1713 include diagnosis, prevention and treatment of diseases and clinical conditions associated with ATP10C. The function of ATP10C and its association with various diseases and clinical conditions, has been established by previous studies, as described hereinabove with reference to VGAM801. Phosphorylase Kinase, Beta (PHKB, Accession NM_000293) is another VGAM1713 host target gene. PHKB BINDING SITE is HOST TARGET binding site found in the 3' untranslated region of mRNA encoded by PHKB, corresponding to a HOST TARGET binding site such as BINDING SITE I, BINDING SITE II or BINDING SITE III. Table 2 illustrates the complementarity of the nucleotide sequences of PHKB BINDING SITE, designated SEQ ID:5837, to the nucleotide sequence of VGAM1713 RNA, herein designated VGAM RNA, also designated SEQ ID:4424.

Another function of VGAM1713 is therefore inhibition of Phosphorylase Kinase, Beta (PHKB, Accession NM_000293). Accordingly, utilities of VGAM1713 include diagnosis, prevention and treatment of diseases and clinical conditions associated with PHKB. Aminocarboxymuconate Semialdehyde Decarboxylase (acmsd, Accession NM_138326) is another VGAM1713 host target gene. acmsd BINDING SITE is HOST TARGET binding site found in the 5' untranslated region of mRNA encoded by acmsd, corresponding to a HOST TARGET binding site such as BINDING SITE I, BINDING SITE II or BINDING SITE III. Table 2 illustrates the complementarity of the nucleotide sequences of acmsd BINDING SITE, designated SEQ ID:28729, to the nucleotide sequence of VGAM1713 RNA, herein designated VGAM RNA, also designated SEQ ID:4424.

Another function of VGAM1713 is therefore inhibition of Aminocarboxymuconate Semialdehyde Decarboxylase (acmsd, Accession NM_138326). Accordingly, utilities of VGAM1713 include diagnosis, prevention and treatment of diseases and clinical conditions associated with acmsd. Angiomotin (AMOT, Accession NM_133265) is another VGAM1713 host target gene. AMOT BINDING SITE is HOST TARGET binding site found in the 3' untranslated region of mRNA encoded by AMOT, corresponding to a HOST TARGET binding site such as BINDING SITE I, BINDING SITE II or BINDING SITE III. Table 2 illustrates the complementarity of the nucleotide sequences of AMOT BINDING SITE, designated SEQ ID:28411, to the nucleotide sequence of VGAM1713 RNA, herein designated VGAM RNA, also designated SEQ ID:4424.

Another function of VGAM1713 is therefore inhibition of Angiomotin (AMOT, Accession NM_133265). Accordingly, utilities of VGAM1713 include diagnosis, prevention and treatment of diseases and clinical conditions associated with AMOT. Butyrophilin, Subfamily 2, Member A2 (BTN2A2, Accession NM_006995) is another VGAM1713 host target gene. BTN2A2 BINDING SITE is HOST TARGET binding site found in the 3' untranslated region of mRNA encoded by BTN2A2, corresponding to a HOST TARGET binding site such as BINDING SITE I, BINDING SITE II or BINDING SITE III. Table 2 illustrates the complementarity of the nucleotide sequences of BTN2A2 BINDING SITE, designated SEQ ID:13858, to the nucleotide sequence of VGAM1713 RNA, herein designated VGAM RNA, also designated SEQ ID:4424.

Another function of VGAM1713 is therefore inhibition of Butyrophilin, Subfamily 2, Member A2 (BTN2A2, Accession NM_006995). Accordingly, utilities of VGAM1713 include diagnosis, prevention and treatment of diseases and clinical conditions associated with BTN2A2. DKFZP564D0462 (Accession XM_047080) is another VGAM1713 host target gene. DKFZP564D0462 BINDING SITE is HOST TARGET binding site found in the 3' untranslated region of mRNA encoded by DKFZP564D0462, corresponding to a HOST TARGET binding site such as BINDING SITE I, BINDING SITE II or BINDING SITE III. Table 2 illustrates the complementarity of the nucleotide sequences of DKFZP564D0462 BINDING SITE, designated SEQ ID:34897, to the nucleotide sequence of VGAM1713 RNA, herein designated VGAM RNA, also designated SEQ ID:4424.

Another function of VGAM1713 is therefore inhibition of DKFZP564D0462 (Accession XM_047080). Accordingly, utilities of VGAM1713 include diagnosis, prevention and treatment of diseases and clinical conditions associated with DKFZP564D0462. Kv6.3 (Accession NM_133490) is another VGAM1713 host target gene. Kv6.3 BINDING SITE is HOST TARGET binding site found in the 3' untranslated region of mRNA encoded by Kv6.3, corresponding to a HOST TARGET binding site such as BINDING SITE I, BINDING SITE II or BINDING SITE III. Table 2 illustrates the complementarity of the nucleotide sequences of Kv6.3 BINDING SITE, designated SEQ ID:28565, to the nucleotide sequence of VGAM1713 RNA, herein designated VGAM RNA, also designated SEQ ID:4424.

Another function of VGAM1713 is therefore inhibition of Kv6.3 (Accession NM_133490). Accordingly, utilities of VGAM1713 include diagnosis, prevention and treatment of diseases and clinical conditions associated with Kv6.3. LOC149153 (Accession XM_097599) is another VGAM1713 host target gene. LOC149153 BINDING SITE is HOST TARGET binding site found in the 5' untranslated region of mRNA encoded by LOC149153, corresponding to a HOST TARGET binding site such as BINDING SITE I, BINDING SITE II or BINDING SITE III. Table 2 illustrates the complementarity of the nucleotide sequences of LOC149153 BINDING SITE, designated SEQ ID:40964, to the nucleotide sequence of VGAM1713 RNA, herein designated VGAM RNA, also designated SEQ ID:4424.

Another function of VGAM1713 is therefore inhibition of LOC149153 (Accession XM_097599). Accordingly, utilities of VGAM1713 include diagnosis, prevention and treatment of diseases and clinical conditions associated with LOC149153. LOC150759 (Accession XM_086995) is another VGAM1713 host target gene. LOC150759 BINDING SITE is HOST TARGET binding site found in the 3' untranslated region of mRNA encoded by LOC150759, corresponding to a HOST TARGET binding site such as BINDING SITE I, BINDING SITE II or BINDING SITE III. Table 2 illustrates the complementarity of the nucleotide sequences of LOC150759 BINDING SITE, designated SEQ ID:39012, to the nucleotide sequence of VGAM1713 RNA, herein designated VGAM RNA, also designated SEQ ID:4424.

Another function of VGAM1713 is therefore inhibition of LOC150759 (Accession XM_086995). Accordingly, utilities of VGAM1713 include diagnosis, prevention and treatment of diseases and clinical conditions associated with LOC150759. LOC151323 (Accession XM_087168) is another VGAM1713 host target gene. LOC151323 BINDING SITE is HOST TARGET binding site found in the 3' untranslated region of mRNA encoded by LOC151323, corresponding to a HOST TARGET binding site such as BINDING SITE I, BINDING SITE II or BINDING SITE III. Table 2 illustrates the complementarity of the nucleotide sequences of LOC151323 BINDING SITE, designated SEQ ID:39101, to the nucleotide sequence of VGAM1713 RNA, herein designated VGAM RNA, also designated SEQ ID:4424.

Another function of VGAM1713 is therefore inhibition of LOC151323 (Accession XM_087168). Accordingly, utilities of VGAM1713 include diagnosis, prevention and treatment of diseases and clinical conditions associated with LOC151323. LOC200399 (Accession XM_114226) is another VGAM1713 host target gene. LOC200399 BINDING SITE is HOST TARGET binding site found in the 3' untranslated region of mRNA encoded by LOC200399, corresponding to a HOST TARGET binding site such as BINDING SITE I, BINDING SITE II or BINDING SITE III. Table 2 illustrates the complementarity of the nucleotide sequences of LOC200399 BINDING SITE, designated SEQ ID:42809, to the nucleotide sequence of VGAM1713 RNA, herein designated VGAM RNA, also designated SEQ ID:4424.

Another function of VGAM1713 is therefore inhibition of LOC200399 (Accession XM_114226). Accordingly, utilities of VGAM1713 include diagnosis, prevention and treatment of diseases and clinical conditions associated with LOC200399. FIG. 1 further provides a conceptual description of a novel bioinformatically detected viral gene of the present invention, referred to here as Viral Genomic Address Messenger 1714 (VGAM1714) viral gene, which modulates expression of respective host target genes thereof, the function and utility of which host target genes is known in the art.

VGAM1714 is a novel bioinformatically detected regulatory, non protein coding, viral micro RNA (miRNA) gene. The method by which VGAM1714 was detected is described hereinabove with reference to FIGS. 1-8.

VGAM1714 gene, herein designated VGAM GENE, is a viral gene contained in the genome of Sindbis Virus. VGAM1714 host target gene, herein designated VGAM HOST TARGET GENE, is a human gene contained in the human genome.

VGAM1714 gene encodes a VGAM1714 precursor RNA, herein designated VGAM PRECURSOR RNA. Similar to other miRNA genes, and unlike most ordinary genes, VGAM1714 precursor RNA does not encode a protein. A nucleotide sequence identical or highly similar to the nucleotide sequence of VGAM1714 precursor RNA is designated SEQ ID:1700, and is provided hereinbelow with reference to the sequence listing part. Nucleotide sequence SEQ ID:1700 is located at position 9679 relative to the genome of Sindbis Virus.

VGAM1714 precursor RNA folds onto itself, forming VGAM1714 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1714 folded precursor RNA into VGAM1714 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1714 RNA is designated SEQ ID:4425, and is provided hereinbelow with reference to the sequence listing part.

VGAM1714 host target gene, herein designated VGAM HOST TARGET GENE, encodes a corresponding messenger RNA, VGAM1714 host target RNA, herein designated VGAM HOST TARGET RNA. VGAM1714 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1714 RNA, herein designated VGAM RNA, binds complementarily to one or more host target binding sites located in untranslated regions of VGAM1714 host target RNA, herein designated VGAM HOST TARGET RNA. This complementary binding is due to the fact that the nucleotide sequence of VGAM1714 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1714 RNA, herein designated VGAM RNA, may have a different number of host target binding sites in untranslated regions of a VGAM1714 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1714 RNA, herein designated VGAM RNA, to host target binding sites on VGAM1714 host target RNA, herein designated VGAM HOST TARGET RNA, such as BINDING SITE I, BINDING SITE II and BINDING SITE III, inhibits translation of VGAM1714 host target RNA into VGAM1714 host target protein, herein designated VGAM HOST TARGET PROTEIN. VGAM host target protein is therefore outlined by a broken line.

It is appreciated that VGAM1714 host target gene, herein designated VGAM HOST TARGET GENE, in fact represents a plurality of VGAM1714 host target genes. The mRNA of each one of this plurality of VGAM1714 host target genes comprises one or more host target binding sites, each having a nucleotide sequence which is at least partly complementary to VGAM1714 RNA, herein designated VGAM RNA, and which when bound by VGAM1714 RNA causes inhibition of translation of respective one or more VGAM1714 host target proteins.

It is further appreciated by one skilled in the art that the mode of translational inhibition illustrated by FIG. 1 with specific reference to translational inhibition exerted by VGAM1714 gene, herein designated VGAM GENE, on one or more VGAM1714 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1714 is inhibition of expression of host target genes, as part of a novel viral mechanism of attacking a host. Accordingly, utilities of VGAM1714 include diagnosis, prevention and treatment of viral infection by Sindbis Virus. Specific functions, and accordingly utilities, of VGAM1714 correlate with, and may be deduced from, the identity of the host target genes which VGAM1714 binds and inhibits, and the function of these host target genes, as elaborated hereinbelow.

Nucleotide sequences of the VGAM1714 precursor RNA, herein designated VGAM PRECURSOR RNA, and of the 'diced' VGAM1714 RNA, herein designated VGAM RNA, and a schematic representation of the secondary folding of VGAM1714 folded precursor RNA, herein designated VGAM FOLDED PRECURSOR RNA, of VGAM1714 are further described hereinbelow with reference to Table 1.

Nucleotide sequences of host target binding sites, such as BINDING SITE-I, BINDING SITE-II and BINDING SITE-III of FIG. 1, found on VGAM1714 host target RNA, and schematic representation of the complementarity of each of these host target binding sites to VGAM1714 RNA, herein designated VGAM RNA, are described hereinbelow with reference to Table 2.

As mentioned hereinabove with reference to FIG. 1, a function of VGAM1714 gene, herein designated VGAM is inhibition of expression of VGAM1714 target genes. It is appreciated that specific functions, and accordingly utilities, of VGAM1714 correlate with, and may be deduced from, the identity of the target genes which VGAM1714 binds and inhibits, and the function of these target genes, as elaborated hereinbelow.

Gamma-glutamyltransferase 2 (GGT2, Accession XM_057166) is a VGAM1714 host target gene. GGT2 BINDING SITE is HOST TARGET binding site found in the 5' untranslated region of mRNA encoded by GGT2, corresponding to a HOST TARGET binding site such as BINDING SITE I, BINDING SITE II or BINDING SITE III. Table 2 illustrates the complementarity of the nucleotide sequences of GGT2 BINDING SITE, designated SEQ ID:36486, to the nucleotide sequence of VGAM1714 RNA, herein designated VGAM RNA, also designated SEQ ID:4425.

A function of VGAM1714 is therefore inhibition of Gamma-glutamyltransferase 2 (GGT2, Accession XM_057166). Accordingly, utilities of VGAM1714 include diagnosis, prevention and treatment of diseases and clinical conditions associated with GGT2. Gap Junction Protein, Beta 3, 31 kDa (connexin 31) (GJB3, Accession NM_024009) is another VGAM1714 host target gene. GJB3 BINDING SITE is HOST TARGET binding site found in the 3' untranslated region of mRNA encoded by GJB3, corresponding to a HOST TARGET binding site such as BINDING SITE I, BINDING SITE II or BINDING SITE III. Table 2 illustrates the complementarity of the nucleotide sequences of GJB3 BINDING SITE, designated SEQ ID:23436, to the nucleotide sequence of VGAM1714 RNA, herein designated VGAM RNA, also designated SEQ ID:4425.

Another function of VGAM1714 is therefore inhibition of Gap Junction Protein, Beta 3, 31 kDa (connexin 31) (GJB3, Accession NM_024009). Accordingly, utilities of VGAM1714 include diagnosis, prevention and treatment of diseases and clinical conditions associated with GJB3. Potassium Channel, Subfamily T, Member 1 (KCNT1, Accession XM_029962) is another VGAM1714 host target gene. KCNT1 BINDING SITE is HOST TARGET binding site found in the 3' untranslated region of mRNA encoded by KCNT1, corresponding to a HOST TARGET binding site such as BINDING SITE I, BINDING SITE II or BINDING SITE III. Table 2 illustrates the complementarity of the nucleotide sequences of KCNT1 BINDING SITE, designated SEQ ID:30971, to the nucleotide sequence of VGAM1714 RNA, herein designated VGAM RNA, also designated SEQ ID:4425.

Another function of VGAM1714 is therefore inhibition of Potassium Channel, Subfamily T, Member 1 (KCNT1, Accession XM_029962). Accordingly, utilities of VGAM1714 include diagnosis, prevention and treatment of diseases and clinical conditions associated with KCNT1. KIAA0125 (Accession NM_014792) is another VGAM1714 host target gene. KIAA0125 BINDING SITE is HOST TARGET binding site found in the 5' untranslated region of mRNA encoded by KIAA0125, corresponding to a HOST TARGET binding site such as BINDING SITE I, BINDING SITE II or BINDING SITE III. Table 2 illustrates the complementarity of the nucleotide sequences of KIAA0125 BINDING SITE, designated SEQ ID:16688, to the nucleotide sequence of VGAM1714 RNA, herein designated VGAM RNA, also designated SEQ ID:4425.

Another function of VGAM1714 is therefore inhibition of KIAA0125 (Accession NM_014792). Accordingly, utilities of VGAM1714 include diagnosis, prevention and treatment of diseases and clinical conditions associated with KIAA0125. KIAA0628 (Accession NM_014789) is another VGAM1714 host target gene. KIAA0628 BINDING SITE is HOST TARGET binding site found in the 3' untranslated region of mRNA encoded by KIAA0628, corresponding to a HOST TARGET binding site such as BINDING SITE I, BINDING SITE II or BINDING SITE III. Table 2 illustrates the complementarity of the nucleotide sequences of KIAA0628 BINDING SITE, designated SEQ ID:16672, to the nucleotide sequence of VGAM1714 RNA, herein designated VGAM RNA, also designated SEQ ID:4425.

Another function of VGAM1714 is therefore inhibition of KIAA0628 (Accession NM_014789). Accordingly, utilities of VGAM1714 include diagnosis, prevention and treatment of diseases and clinical conditions associated with KIAA0628. SH3 Domain Binding Glutamic Acid-rich Protein Like (SH3BGRL, Accession XM_030373) is another VGAM1714 host target gene. SH3BGRL BINDING SITE is HOST TARGET binding site found in the 3' untranslated region of mRNA encoded by SH3BGRL, corresponding to a HOST TARGET binding site such as BINDING SITE I, BINDING SITE II or BINDING SITE III. Table 2 illustrates the complementarity of the nucleotide sequences of SH3BGRL BINDING SITE, designated SEQ ID:31026, to the nucleotide sequence of VGAM1714 RNA, herein designated VGAM RNA, also designated SEQ ID:4425.

Another function of VGAM1714 is therefore inhibition of SH3 Domain Binding Glutamic Acid-rich Protein Like (SH3BGRL, Accession XM_030373). Accordingly, utilities of VGAM1714 include diagnosis, prevention and treatment of diseases and clinical conditions associated with SH3BGRL. LOC124602 (Accession XM_058829) is another VGAM1714 host target gene. LOC124602 BINDING SITE is HOST TARGET binding site found in the 3' untranslated region of mRNA encoded by LOC124602, corresponding to a HOST TARGET binding site such as BINDING SITE I, BINDING SITE II or BINDING SITE III. Table 2 illustrates the complementarity of the nucleotide sequences of LOC124602 BINDING SITE, designated SEQ ID:36757, to the nucleotide sequence of VGAM1714 RNA, herein designated VGAM RNA, also designated SEQ ID:4425.

Another function of VGAM1714 is therefore inhibition of LOC124602 (Accession XM_058829). Accordingly, utilities of VGAM1714 include diagnosis, prevention and treatment of diseases and clinical conditions associated with LOC124602. LOC149319 (Accession XM_086495) is another VGAM1714 host target gene. LOC149319 BINDING SITE is HOST TARGET binding site found in the 5' untranslated region of mRNA encoded by LOC149319, corresponding to a HOST TARGET binding site such as BINDING SITE I, BINDING SITE II or BINDING SITE III. Table 2 illustrates the complementarity of the nucleotide sequences of LOC149319 BINDING SITE, designated SEQ ID:38711, to the nucleotide sequence of VGAM1714 RNA, herein designated VGAM RNA, also designated SEQ ID:4425.

Another function of VGAM1714 is therefore inhibition of LOC149319 (Accession XM_086495). Accordingly, utilities of VGAM1714 include diagnosis, prevention and treatment of diseases and clinical conditions associated with LOC149319. LOC203397 (Accession XM_114695) is another VGAM1714 host target gene. LOC203397 BINDING SITE is HOST TARGET binding site found in the 3' untranslated region of mRNA encoded by LOC203397, corresponding to a HOST TARGET binding site such as BINDING SITE I, BINDING SITE II or BINDING SITE III. Table 2 illustrates the complementarity of the nucleotide sequences of LOC203397 BINDING SITE, designated SEQ ID:43037, to the nucleotide sequence of VGAM1714 RNA, herein designated VGAM RNA, also designated SEQ ID:4425.

Another function of VGAM1714 is therefore inhibition of LOC203397 (Accession XM_114695). Accordingly, utilities of VGAM1714 include diagnosis, prevention and treatment of diseases and clinical conditions associated with LOC203397. LOC254100 (Accession XM_172851) is another VGAM1714 host target gene. LOC254100 BINDING SITE is HOST TARGET binding site found in the 5' untranslated region of mRNA encoded by LOC254100, corresponding to a HOST TARGET binding site such as BINDING SITE I, BINDING SITE II or BINDING SITE III. Table 2 illustrates the complementarity of the nucleotide sequences of LOC254100 BINDING SITE, designated SEQ ID:46126, to the nucleotide sequence of VGAM1714 RNA, herein designated VGAM RNA, also designated SEQ ID:4425.

Another function of VGAM1714 is therefore inhibition of LOC254100 (Accession XM_172851). Accordingly, utilities of VGAM1714 include diagnosis, prevention and treatment of diseases and clinical conditions associated with LOC254100. FIG. 1 further provides a conceptual description of a novel bioinformatically detected viral gene of the present invention, referred to here as Viral Genomic Address Messenger 1715 (VGAM1715) viral gene, which modulates expression of respective host target genes thereof, the function and utility of which host target genes is known in the art.

VGAM1715 is a novel bioinformatically detected regulatory, non protein coding, viral micro RNA (miRNA) gene. The method by which VGAM1715 was detected is described hereinabove with reference to FIGS. 1-8.

VGAM1715 gene, herein designated VGAM GENE, is a viral gene contained in the genome of Sindbis Virus. VGAM1715 host target gene, herein designated VGAM HOST TARGET GENE, is a human gene contained in the human genome.

VGAM1715 gene encodes a VGAM1715 precursor RNA, herein designated VGAM PRECURSOR RNA. Similar to other miRNA genes, and unlike most ordinary genes, VGAM1715 precursor RNA does not encode a protein. A nucleotide sequence identical or highly similar to the nucleotide sequence of VGAM1715 precursor RNA is designated SEQ ID:1701, and is provided hereinbelow with reference to the sequence listing part. Nucleotide sequence SEQ ID:1701 is located at position 10643 relative to the genome of Sindbis Virus.

VGAM1715 precursor RNA folds onto itself, forming VGAM1715 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1715 folded precursor RNA into VGAM1715 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1715 RNA is designated SEQ ID:4426, and is provided hereinbelow with reference to the sequence listing part.

VGAM1715 host target gene, herein designated VGAM HOST TARGET GENE, encodes a corresponding messenger RNA, VGAM1715 host target RNA, herein designated VGAM HOST TARGET RNA. VGAM1715 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1715 RNA, herein designated VGAM RNA, binds complementarily to one or more host target binding sites located in untranslated regions of VGAM1715 host target RNA, herein designated VGAM HOST TARGET RNA. This complementary binding is due to the fact that the nucleotide sequence of VGAM1715 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1715 RNA, herein designated VGAM RNA, may have a different number of host target binding sites in untranslated regions of a VGAM1715 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1715 RNA, herein designated VGAM RNA, to host target binding sites on VGAM1715 host target RNA, herein designated VGAM HOST TARGET RNA, such as BINDING SITE I, BINDING SITE II and BINDING SITE III, inhibits translation of VGAM1715 host target RNA into VGAM1715 host target protein, herein designated VGAM HOST TARGET PROTEIN. VGAM host target protein is therefore outlined by a broken line.

It is appreciated that VGAM1715 host target gene, herein designated VGAM HOST TARGET GENE, in fact represents a plurality of VGAM1715 host target genes. The mRNA of each one of this plurality of VGAM1715 host target genes comprises one or more host target binding sites, each having a nucleotide sequence which is at least partly complementary to VGAM1715 RNA, herein designated VGAM RNA, and which when bound by VGAM1715 RNA causes inhibition of translation of respective one or more VGAM1715 host target proteins.

It is further appreciated by one skilled in the art that the mode of translational inhibition illustrated by FIG. 1 with specific reference to translational inhibition exerted by VGAM1715 gene, herein designated VGAM GENE, on one or more VGAM1715 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1715 is inhibition of expression of host target genes, as part of a novel viral mechanism of attacking a host. Accordingly, utilities of VGAM1715 include diagnosis, prevention and treatment of viral infection by Sindbis Virus. Specific functions, and accordingly utilities, of VGAM1715 correlate with, and may be deduced from, the identity of the host target genes which VGAM1715 binds and inhibits, and the function of these host target genes, as elaborated hereinbelow.

Nucleotide sequences of the VGAM1715 precursor RNA, herein designated VGAM PRECURSOR RNA, and of the 'diced' VGAM1715 RNA, herein designated VGAM RNA, and a schematic representation of the secondary folding of VGAM1715 folded precursor RNA, herein designated VGAM FOLDED PRECURSOR RNA, of VGAM1715 are further described hereinbelow with reference to Table 1.

Nucleotide sequences of host target binding sites, such as BINDING SITE-I, BINDING SITE-II and BINDING SITE-III of FIG. 1, found on VGAM1715 host target RNA, and schematic representation of the complementarity of each of these host target binding sites to VGAM1715 RNA, herein designated VGAM RNA, are described hereinbelow with reference to Table 2.

As mentioned hereinabove with reference to FIG. 1, a function of VGAM1715 gene, herein designated VGAM is inhibition of expression of VGAM1715 target genes. It is appreciated that specific functions, and accordingly utilities, of VGAM1715 correlate with, and may be deduced from, the identity of the target genes which VGAM1715 binds and inhibits, and the function of these target genes, as elaborated hereinbelow.

Microtubule-associated Protein 1A (MAP1A, Accession NM_002373) is a VGAM1715 host target gene. MAP1A BINDING SITE is HOST TARGET binding site found in the 3' untranslated region of mRNA encoded by MAP1A, corresponding to a HOST TARGET binding site such as BINDING SITE I, BINDING SITE II or BINDING SITE III. Table 2 illustrates the complementarity of the nucleotide sequences of MAP1A BINDING SITE, designated SEQ ID:8183, to the nucleotide sequence of VGAM1715 RNA, herein designated VGAM RNA, also designated SEQ ID:4426.

A function of VGAM1715 is therefore inhibition of Microtubule-associated Protein 1A (MAP1A, Accession NM_002373), a gene which is a structural protein involved in the filamentous cross-bridging between microtubules and other skeletal elements. Accordingly, utilities of VGAM1715 include diagnosis, prevention and treatment of diseases and clinical conditions associated with MAP1A. The function of MAP1A and its association with various diseases and clinical conditions, has been established by previous studies, as described hereinabove with reference to VGAM315.

SORCS2 (Accession NM_020777) is another VGAM1715 host target gene. SORCS2 BINDING SITE is HOST TARGET binding site found in the 3' untranslated region of mRNA encoded by SORCS2, corresponding to a HOST TARGET binding site such as BINDING SITE I, BINDING SITE II or BINDING SITE III. Table 2 illustrates the complementarity of the nucleotide sequences of SORCS2 BINDING SITE, designated SEQ ID:21876, to the nucleotide sequence of VGAM1715 RNA, herein designated VGAM RNA, also designated SEQ ID:4426.

Another function of VGAM1715 is therefore inhibition of SORCS2 (Accession NM_020777). Accordingly, utilities of VGAM1715 include diagnosis, prevention and treatment of diseases and clinical conditions associated with SORCS2.

DEPC-1 (Accession NM_139178) is another VGAM1715 host target gene. DEPC-1 BINDING SITE is HOST TARGET binding site found in the 5' untranslated region of mRNA encoded by DEPC-1, corresponding to a HOST TARGET binding site such as BINDING SITE I, BINDING SITE II or BINDING SITE III. Table 2 illustrates the complementarity of the nucleotide sequences of DEPC-1 BINDING SITE, designated SEQ ID:29191, to the nucleotide sequence of VGAM1715 RNA, herein designated VGAM RNA, also designated SEQ ID:4426.

Another function of VGAM1715 is therefore inhibition of DEPC-1 (Accession NM_139178). Accordingly, utilities of VGAM1715 include diagnosis, prevention and treatment of diseases and clinical conditions associated with DEPC-1.

FLJ12891 (Accession NM_024950) is another VGAM1715 host target gene. FLJ12891 BINDING SITE is HOST TARGET binding site found in the 3' untranslated region of mRNA encoded by FLJ12891, corresponding to a HOST TARGET binding site such as BINDING SITE I, BINDING SITE II or BINDING SITE III. Table 2 illustrates the complementarity of the nucleotide sequences of FLJ12891 BINDING SITE, designated SEQ ID:24509, to the nucleotide sequence of VGAM1715 RNA, herein designated VGAM RNA, also designated SEQ ID:4426.

Another function of VGAM1715 is therefore inhibition of FLJ12891 (Accession NM_024950). Accordingly, utilities of VGAM1715 include diagnosis, prevention and treatment of diseases and clinical conditions associated with FLJ12891.

FLJ21977 (Accession NM_032213) is another VGAM1715 host target gene. FLJ21977 BINDING SITE is HOST TARGET binding site found in the 3' untranslated region of mRNA encoded by FLJ21977, corresponding to a HOST TARGET binding site such as BINDING SITE I, BINDING SITE II or BINDING SITE III. Table 2 illustrates the complementarity of the nucleotide sequences of FLJ21977 BINDING SITE, designated SEQ ID:25939, to the nucleotide sequence of VGAM1715 RNA, herein designated VGAM RNA, also designated SEQ ID:4426.

Another function of VGAM1715 is therefore inhibition of FLJ21977 (Accession NM_032213). Accordingly, utilities of VGAM1715 include diagnosis, prevention and treatment of diseases and clinical conditions associated with FLJ21977.

Protein Phosphatase 2 (formerly 2A), Regulatory Subunit B", Alpha (PPP2R3A, Accession NM_002718) is another VGAM1715 host target gene. PPP2R3A BINDING SITE is HOST TARGET binding site found in the 3' untranslated region of mRNA encoded by PPP2R3A, corresponding to a HOST TARGET binding site such as BINDING SITE I, BINDING SITE II or BINDING SITE III. Table 2 illustrates the complementarity of the nucleotide sequences of PPP2R3A BINDING SITE, designated SEQ ID:8585, to the nucleotide sequence of VGAM1715 RNA, herein designated VGAM RNA, also designated SEQ ID:4426.

Another function of VGAM1715 is therefore inhibition of Protein Phosphatase 2 (formerly 2A), Regulatory Subunit B", Alpha (PPP2R3A, Accession NM_002718). Accordingly, utilities of VGAM1715 include diagnosis, prevention and treatment of diseases and clinical conditions associated with PPP2R3A. LOC146108 (Accession XM_085322) is another VGAM1715 host target gene. LOC146108 BINDING SITE is HOST TARGET binding site found in the 5' untranslated region of mRNA encoded by LOC146108, corresponding to a HOST TARGET binding site such as BINDING SITE I, BINDING SITE II or BINDING SITE III. Table 2 illustrates the complementarity of the nucleotide sequences of LOC146108 BINDING SITE, designated SEQ ID:38062, to the nucleotide sequence of VGAM1715 RNA, herein designated VGAM RNA, also designated SEQ ID:4426.

Another function of VGAM1715 is therefore inhibition of LOC146108 (Accession XM_085322). Accordingly, utilities of VGAM1715 include diagnosis, prevention and treatment of diseases and clinical conditions associated with LOC146108. LOC219529 (Accession XM_167563) is another VGAM1715 host target gene. LOC219529 BINDING SITE is HOST TARGET binding site found in the 3' untranslated region of mRNA encoded by LOC219529, corresponding to a HOST TARGET binding site such as BINDING SITE I, BINDING SITE II or BINDING SITE III. Table 2 illustrates the complementarity of the nucleotide sequences of LOC219529 BINDING SITE, designated SEQ ID:44671, to the nucleotide sequence of VGAM1715 RNA, herein designated VGAM RNA, also designated SEQ ID:4426.

Another function of VGAM1715 is therefore inhibition of LOC219529 (Accession XM_167563). Accordingly, utilities of VGAM1715 include diagnosis, prevention and treatment of diseases and clinical conditions associated with LOC219529. FIG. 1 further provides a conceptual description of a novel bioinformatically detected viral gene of the present invention, referred to here as Viral Genomic Address Messenger 1716 (VGAM1716) viral gene, which modulates expression of respective host target genes thereof, the function and utility of which host target genes is known in the art.

VGAM1716 is a novel bioinformatically detected regulatory, non protein coding, viral micro RNA (miRNA) gene. The method by which VGAM1716 was detected is described hereinabove with reference to FIGS. 1-8.

VGAM1716 gene, herein designated VGAM GENE, is a viral gene contained in the genome of Sindbis Virus. VGAM1716 host target gene, herein designated VGAM HOST TARGET GENE, is a human gene contained in the human genome.

VGAM1716 gene encodes a VGAM1716 precursor RNA, herein designated VGAM PRECURSOR RNA. Similar to other miRNA genes, and unlike most ordinary genes, VGAM1716 precursor RNA does not encode a protein. A nucleotide sequence identical or highly similar to the nucleotide sequence of VGAM1716 precursor RNA is designated SEQ ID:1702, and is provided hereinbelow with reference to the sequence listing part. Nucleotide sequence SEQ ID:1702 is located at position 8996 relative to the genome of Sindbis Virus.

VGAM1716 precursor RNA folds onto itself, forming VGAM1716 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1716 folded precursor RNA into VGAM1716 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM1716 RNA is designated SEQ ID:4427, and is provided hereinbelow with reference to the sequence listing part.

VGAM1716 host target gene, herein designated VGAM HOST TARGET GENE, encodes a corresponding messenger RNA, VGAM1716 host target RNA, herein designated VGAM HOST TARGET RNA. VGAM1716 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1716 RNA, herein designated VGAM RNA, binds complementarily to one or more host target binding sites located in untranslated regions of VGAM1716 host target RNA, herein designated VGAM HOST TARGET RNA. This complementary binding is due to the fact that the nucleotide sequence of VGAM1716 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1716 RNA, herein designated VGAM RNA, may have a different number of host target binding sites in untranslated regions of a VGAM1716 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1716 RNA, herein designated VGAM RNA, to host target binding sites on VGAM1716 host target RNA, herein designated VGAM HOST TARGET RNA, such as BINDING SITE I, BINDING SITE II and BINDING SITE III, inhibits translation of VGAM1716 host target RNA into VGAM1716 host target protein, herein designated VGAM HOST TARGET PROTEIN. VGAM host target protein is therefore outlined by a broken line.

It is appreciated that VGAM1716 host target gene, herein designated VGAM HOST TARGET GENE, in fact represents a plurality of VGAM1716 host target genes. The mRNA of each one of this plurality of VGAM1716 host target genes comprises one or more host target binding sites, each having a nucleotide sequence which is at least partly complementary to VGAM1716 RNA, herein designated VGAM RNA, and which when bound by VGAM1716 RNA causes inhibition of translation of respective one or more VGAM1716 host target proteins.

It is further appreciated by one skilled in the art that the mode of translational inhibition illustrated by FIG. 1 with specific reference to translational inhibition exerted by VGAM1716 gene, herein designated VGAM GENE, on one or more VGAM1716 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1716 is inhibition of expression of host target genes, as part of a novel viral mechanism of attacking a host. Accordingly, utilities of VGAM1716 include diagnosis, prevention and treatment of viral infection by Sindbis Virus. Specific functions, and accordingly utilities, of VGAM1716 correlate with, and may be deduced from, the identity of the host target genes which VGAM1716 binds and inhibits, and the function of these host target genes, as elaborated hereinbelow.

Nucleotide sequences of the VGAM1716 precursor RNA, herein designated VGAM PRECURSOR RNA, and of the 'diced' VGAM1716 RNA, herein designated VGAM RNA, and a schematic representation of the secondary folding of VGAM1716 folded precursor RNA, herein designated VGAM FOLDED PRECURSOR RNA, of VGAM1716 are further described hereinbelow with reference to Table 1.

Nucleotide sequences of host target binding sites, such as BINDING SITE-I, BINDING SITE-II and BINDING SITE-III of FIG. 1, found on VGAM1716 host target RNA, and schematic representation of the complementarity of each of these host target binding sites to VGAM1716 RNA, herein designated VGAM RNA, are described hereinbelow with reference to Table 2.

As mentioned hereinabove with reference to FIG. 1, a function of VGAM1716 gene, herein designated VGAM is inhibition of expression of VGAM1716 target genes. It is appreciated that specific functions, and accordingly utilities, of VGAM1716 correlate with, and may be deduced from, the identity of the target genes which VGAM1716 binds and inhibits, and the function of these target genes, as elaborated hereinbelow.

Membrane Cofactor Protein (CD46, trophoblast-lymphocyte cross-reactive antigen) (MCP, Accession NM_002389) is a VGAM1716 host target gene. MCP BINDING SITE is HOST TARGET binding site found in the 3' untranslated region of mRNA encoded by MCP, corresponding to a HOST TARGET binding site such as BINDING SITE I, BINDING SITE II or BINDING SITE III. Table 2 illustrates the complementarity of the nucleotide sequences of MCP BINDING SITE, designated SEQ ID:8205, to the nucleotide sequence of VGAM1716 RNA, herein designated VGAM RNA, also designated SEQ ID:4427.

A function of VGAM1716 is therefore inhibition of Membrane Cofactor Protein (CD46, trophoblast-lymphocyte cross-reactive antigen) (MCP, Accession NM_002389), a gene which may be involved in the regulation of complement activation. Accordingly, utilities of VGAM1716 include diagnosis, prevention and treatment of diseases and clinical conditions associated with MCP. The function of MCP and its association with various diseases and clinical conditions, has been established by previous studies, as described hereinabove with reference to VGAM383. DKFZP564C196 (Accession XM_046405) is another VGAM1716 host target gene. DKFZP564C196 BINDING SITE is HOST TARGET binding site found in the 3' untranslated region of mRNA encoded by DKFZP564C196, corresponding to a HOST TARGET binding site such as BINDING SITE I, BINDING SITE II or BINDING SITE III. Table 2 illustrates the complementarity of the nucleotide sequences of DKFZP564C196 BINDING SITE, designated SEQ ID:34715, to the nucleotide sequence of VGAM1716 RNA, herein designated VGAM RNA, also designated SEQ ID:4427.

Another function of VGAM1716 is therefore inhibition of DKFZP564C196 (Accession XM_046405). Accordingly, utilities of VGAM1716 include diagnosis, prevention and treatment of diseases and clinical conditions associated with DKFZP564C196. FLJ20984 (Accession NM_024630) is another VGAM1716 host target gene. FLJ20984 BINDING SITE is HOST TARGET binding site found in the 5' untranslated region of mRNA encoded by FLJ20984, corresponding to a HOST TARGET binding site such as BINDING SITE I, BINDING SITE II or BINDING SITE III. Table 2 illustrates the complementarity of the nucleotide sequences of FLJ20984 BINDING SITE, designated SEQ ID:23895, to the nucleotide sequence of VGAM1716 RNA, herein designated VGAM RNA, also designated SEQ ID:4427.

Another function of VGAM1716 is therefore inhibition of FLJ20984 (Accession NM_024630). Accordingly, utilities of VGAM1716 include diagnosis, prevention and treatment of diseases and clinical conditions associated with FLJ20984. Zinc Finger Protein 95 Homolog (mouse) (ZFP95, Accession NM_014569) is another VGAM1716 host target gene. ZFP95 BINDING SITE1 and ZFP95 BINDING SITE2 are HOST TARGET binding sites found in untranslated regions of mRNA encoded by ZFP95, corresponding to HOST TARGET binding sites such as BINDING SITE I, BINDING SITE II or BINDING SITE III. Table 2 illustrates the complementarity of the nucleotide sequences of ZFP95 BINDING SITE1 and ZFP95 BINDING SITE2, designated SEQ ID:15918 and SEQ ID:29708 respectively, to the nucleotide sequence of VGAM1716 RNA, herein designated VGAM RNA, also designated SEQ ID:4427.

Another function of VGAM1716 is therefore inhibition of Zinc Finger Protein 95 Homolog (mouse) (ZFP95, Accession NM_014569). Accordingly, utilities of VGAM1716 include diagnosis, prevention and treatment of diseases and clinical conditions associated with ZFP95. FIG. 1 further provides a conceptual description of a novel bioinformatically detected viral gene of the present invention, referred to here as Viral Genomic Address Messenger 1717 (VGAM1717) viral gene, which modulates expression of respective host target genes thereof, the function and utility of which host target genes is known in the art.

VGAM1717 is a novel bioinformatically detected regulatory, non protein coding, viral micro RNA (miRNA) gene. The method by which VGAM1717 was detected is described hereinabove with reference to FIGS. 1-8.

VGAM1717 gene, herein designated VGAM GENE, is a viral gene contained in the genome of Molluscum Contagiosum Virus. VGAM1717 host target gene, herein designated VGAM HOST TARGET GENE, is a human gene contained in the human genome.

VGAM1717 gene encodes a VGAM1717 precursor RNA, herein designated VGAM PRECURSOR RNA. Similar to other miRNA genes, and unlike most ordinary genes, VGAM1717 precursor RNA does not encode a protein. A nucleotide sequence identical or highly similar to the nucleotide sequence of VGAM1717 precursor RNA is designated SEQ ID:1703, and is provided hereinbelow with reference to the sequence listing part. Nucleotide sequence SEQ ID:1703 is located at position 67026 relative to the genome of Molluscum Contagiosum Virus.

VGAM1717 precursor RNA folds onto itself, forming VGAM1717 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1717 folded precursor RNA into VGAM1717 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1717 RNA is designated SEQ ID:4428, and is provided hereinbelow with reference to the sequence listing part.

VGAM1717 host target gene, herein designated VGAM HOST TARGET GENE, encodes a corresponding messenger RNA, VGAM1717 host target RNA, herein designated VGAM HOST TARGET RNA. VGAM1717 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1717 RNA, herein designated VGAM RNA, binds complementarily to one or more host target binding sites located in untranslated regions of VGAM1717 host target RNA, herein designated VGAM HOST TARGET RNA. This complementary binding is due to the fact that the nucleotide sequence of VGAM1717 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1717 RNA, herein designated VGAM RNA, may have a different number of host target binding sites in untranslated regions of a VGAM1717 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1717 RNA, herein designated VGAM RNA, to host target binding sites on VGAM1717 host target RNA, herein designated VGAM HOST TARGET RNA, such as BINDING SITE I, BINDING SITE II and BINDING SITE III, inhibits translation of VGAM1717 host target RNA into VGAM1717 host target protein, herein designated VGAM HOST TARGET PROTEIN. VGAM host target protein is therefore outlined by a broken line.

It is appreciated that VGAM1717 host target gene, herein designated VGAM HOST TARGET GENE, in fact represents a plurality of VGAM1717 host target genes. The mRNA of each one of this plurality of VGAM1717 host target genes comprises one or more host target binding sites, each having a nucleotide sequence which is at least partly complementary to VGAM1717 RNA, herein designated VGAM RNA, and which when bound by VGAM1717 RNA causes inhibition of translation of respective one or more VGAM1717 host target proteins.

It is further appreciated by one skilled in the art that the mode of translational inhibition illustrated by FIG. 1 with specific reference to translational inhibition exerted by VGAM1717 gene, herein designated VGAM GENE, on one or more VGAM1717 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1717 is inhibition of expression of host target genes, as part of a novel viral mechanism of attacking a host. Accordingly, utilities of VGAM1717 include diagnosis, prevention and treatment of viral infection by Molluscum Contagiosum Virus. Specific functions, and accordingly utilities, of VGAM1717 correlate with, and may be deduced from, the identity of the host target genes which VGAM1717 binds and inhibits, and the function of these host target genes, as elaborated hereinbelow.

Nucleotide sequences of the VGAM1717 precursor RNA, herein designated VGAM PRECURSOR RNA, and of the 'diced' VGAM1717 RNA, herein designated VGAM RNA, and a schematic representation of the secondary folding of VGAM1717 folded precursor RNA, herein designated VGAM FOLDED PRECURSOR RNA, of VGAM1717 are further described hereinbelow with reference to Table 1.

Nucleotide sequences of host target binding sites, such as BINDING SITE-I, BINDING SITE-II and BINDING SITE-III of FIG. 1, found on VGAM1717 host target RNA, and schematic representation of the complementarity of each of these host target binding sites to VGAM1717 RNA, herein designated VGAM RNA, are described hereinbelow with reference to Table 2.

As mentioned hereinabove with reference to FIG. 1, a function of VGAM1717 gene, herein designated VGAM is inhibition of expression of VGAM1717 target genes. It is appreciated that specific functions, and accordingly utilities, of VGAM1717 correlate with, and may be deduced from, the identity of the target genes which VGAM1717 binds and inhibits, and the function of these target genes, as elaborated hereinbelow.

Adenosine Deaminase, RNA-specific, B1 (RED1 homolog rat) (ADARB1, Accession NM_001112) is a VGAM1717 host target gene. ADARB1 BINDING SITE1 and ADARB1 BINDING SITE2 are HOST TARGET binding sites found in untranslated regions of mRNA encoded by ADARB1, corresponding to HOST TARGET binding sites such as BINDING SITE I, BINDING SITE II or BINDING SITE III. Table 2 illustrates the complementarity of the nucleotide sequences of ADARB1 BINDING SITE1 and ADARB1 BINDING SITE2, designated SEQ ID:6777 and SEQ ID:17948 respectively, to the nucleotide sequence of VGAM1717 RNA, herein designated VGAM RNA, also designated SEQ ID:4428.

A function of VGAM1717 is therefore inhibition of Adenosine Deaminase, RNA-specific, B1 (RED1 homolog rat) (ADARB1, Accession NM_001112), a gene which RNA editing involves the deamination of adenosines at specific sites. Accordingly, utilities of VGAM1717 include diagnosis, prevention and treatment of diseases and clinical conditions associated with ADARB1. The function of ADARB1 has been established by previous studies. RNA editing involves the deamination of adenosines at specific sites, the result of which can be a change in the amino acid sequence of the protein so that it differs from that predicted by the sequence of the DNA. Editing of the glutamate receptor B (GluRB; 138247) pre-mRNA has been shown to alter a codon (referred to as the Q/R site) for a channel determinant that controls the calcium permeability of the AMPA glutamate receptors. Melcher et al. (1996) tested the candidate dsRNA adenosine deaminase DRADA (OMIM Ref. No. 601059) and showed that when coexpressed with a GluR-B minigene in HEK 293 cells, DRADA produced low-level editing at the GluR-B Q/R site. The authors then screened a rat brain cDNA library with the predicted catalytic domain of rat DRADA to identify other potential editing enzymes. A cDNA encoding a predicted 711-amino acid protein was isolated that gave about 90% of the expected activity in their editing assay. Melcher et al. (1996) designated this novel mammalian RNA editing protein RNA-editing enzyme-1 (RED1). Rat RED1 and DRADA share about 31% overall identity primarily due to their conservation in the C-terminal catalytic domain. Northern blots showed highest expression of RED1 in rat brain. Melcher et al. (1996) further observed that while RED1 was more efficient at deaminating some sites, DRADA had stronger activity at others. They speculated that a combination of these and perhaps other editing enzymes may be involved in determining the overall editing process for a given transcript. Higuchi et al. (2000) studied ADAR2-mediated RNA editing by generating mice that were homozygous for a targeted functional null allele. Editing in Adar2 -/- mice was substantially reduced at most of 25 positions in diverse transcripts; the mutant mice became prone to seizures and died young. The impaired phenotype appeared to result entirely from a single underedited position, since it reverted to normal when both alleles for the underedited transcript were substituted with alleles encoding the edited version exonically. The critical position specifies an ion channel determinant, the Q/R site, in AMPA receptor GluRB premessenger RNA. Higuchi et al. (2000) concluded that this transcript is physiologically the most important substrate of ADAR2.

Full details of the abovementioned studies are described in the following publications, the disclosure of which are hereby incorporated by reference:

Melcher, T.; Maas, S.; Herb, A.; Sprengel, R.; Seeburg, P. H.; Higuchi, M.: A mammalian RNA editing enzyme. Nature 379:460-463, 1996; and Higuchi, M.; Maas, S.; Single, F. N.; Hartner, J.; Rozov, A.; Burnashev, N.; Feldmeyer, D.; Sprengel, R.; Seeburg, P. H.: Point mutation in an AMPA receptor gene rescues lethality in mi.

Further studies establishing the function and utilities of ADARB1 are found in John Hopkins OMIM database record ID 601218, and in sited publications numbered 7167-7173 listed in the bibliography section hereinbelow, which are also hereby incorporated by reference. FLJ14566 (Accession NM_032806) is another VGAM1717 host target gene. FLJ14566 BINDING SITE is HOST TARGET binding site found in the 5' untranslated region of mRNA encoded by FLJ14566, corresponding to a HOST TARGET binding site such as BINDING SITE I, BINDING SITE II or BINDING SITE III. Table 2 illustrates the complementarity of the nucleotide sequences of FLJ14566 BINDING SITE, designated SEQ ID:26564, to the nucleotide sequence of VGAM1717 RNA, herein designated VGAM RNA, also designated SEQ ID:4428.

Another function of VGAM1717 is therefore inhibition of FLJ14566 (Accession NM_032806). Accordingly, utilities of VGAM1717 include diagnosis, prevention and treatment of diseases and clinical conditions associated with FLJ14566. KIAA1644 (Accession XM_097892) is another VGAM1717 host target gene. KIAA1644 BINDING SITE is HOST TARGET binding site found in the 3' untranslated region of mRNA encoded by KIAA1644, corresponding to a HOST TARGET binding site such as BINDING SITE I, BINDING SITE II or BINDING SITE III. Table 2 illustrates the complementarity of the nucleotide sequences of KIAA1644 BINDING SITE, designated SEQ ID:41200, to the nucleotide sequence of VGAM1717 RNA, herein designated VGAM RNA, also designated SEQ ID:4428.

Another function of VGAM1717 is therefore inhibition of KIAA1644 (Accession XM_097892). Accordingly, utilities of VGAM1717 include diagnosis, prevention and treatment of diseases and clinical conditions associated with KIAA1644. RoXaN (Accession NM_025013) is another VGAM1717 host target gene. RoXaN BINDING SITE is HOST TARGET binding site found in the 3' untranslated region of mRNA encoded by RoXaN, corresponding to a HOST TARGET binding site such as BINDING SITE I, BINDING SITE II or BINDING SITE III. Table 2 illustrates the complementarity of the nucleotide sequences of RoXaN BINDING SITE, designated SEQ ID:24600, to the nucleotide sequence of VGAM1717 RNA, herein designated VGAM RNA, also designated SEQ ID:4428.

Another function of VGAM1717 is therefore inhibition of RoXaN (Accession NM_025013). Accordingly, utilities of VGAM1717 include diagnosis, prevention and treatment of diseases and clinical conditions associated with RoXaN. LOC128989 (Accession XM_059310) is another VGAM1717 host target gene. LOC128989 BINDING SITE is HOST TARGET binding site found in the 3' untranslated region of mRNA encoded by LOC128989, corresponding to a HOST TARGET binding site such as BINDING SITE I, BINDING SITE II or BINDING SITE III. Table 2 illustrates the complementarity of the nucleotide sequences of LOC128989 BINDING SITE, designated SEQ ID:36939, to the nucleotide sequence of VGAM1717 RNA, herein designated VGAM RNA, also designated SEQ ID:4428.

Another function of VGAM1717 is therefore inhibition of LOC128989 (Accession XM_059310). Accordingly, utilities of VGAM1717 include diagnosis, prevention and treatment of diseases and clinical conditions associated with LOC128989. LOC147054 (Accession XM_097172) is another VGAM1717 host target gene. LOC147054 BINDING SITE is HOST TARGET binding site found in the 5' untranslated region of mRNA encoded by LOC147054, corresponding to a HOST TARGET binding site such as BINDING SITE I, BINDING SITE II or BINDING SITE III. Table 2 illustrates the complementarity of the nucleotide sequences of LOC147054 BINDING SITE, designated SEQ ID:40788, to the nucleotide sequence of VGAM1717 RNA, herein designated VGAM RNA, also designated SEQ ID:4428.

Another function of VGAM1717 is therefore inhibition of LOC147054 (Accession XM_097172). Accordingly, utilities of VGAM1717 include diagnosis, prevention and treatment of diseases and clinical conditions associated with LOC147054. LOC149103 (Accession XM_086434) is another VGAM1717 host target gene. LOC149103 BINDING SITE is HOST TARGET binding site found in the 3' untranslated region of mRNA encoded by LOC149103, corresponding to a HOST TARGET binding site such as BINDING SITE I, BINDING SITE II or BINDING SITE III. Table 2 illustrates the complementarity of the nucleotide sequences of LOC149103 BINDING SITE, designated SEQ ID:38651, to the nucleotide sequence of VGAM1717 RNA, herein designated VGAM RNA, also designated SEQ ID:4428.

Another function of VGAM1717 is therefore inhibition of LOC149103 (Accession XM_086434). Accordingly, utilities of VGAM1717 include diagnosis, prevention and treatment of diseases and clinical conditions associated with LOC149103. FIG. 1 further provides a conceptual description of a novel bioinformatically detected viral gene of the present invention, referred to here as Viral Genomic Address Messenger 1718 (VGAM1718) viral gene, which modulates expression of respective host target genes thereof, the function and utility of which host target genes is known in the art.

VGAM1718 is a novel bioinformatically detected regulatory, non protein coding, viral micro RNA (miRNA) gene. The method by which VGAM1718 was detected is described hereinabove with reference to FIGS. 1-8.

VGAM1718 gene, herein designated VGAM GENE, is a viral gene contained in the genome of Molluscum Contagiosum Virus. VGAM1718 host target gene, herein designated VGAM HOST TARGET GENE, is a human gene contained in the human genome.

VGAM1718 gene encodes a VGAM1718 precursor RNA, herein designated VGAM PRECURSOR RNA. Similar to other miRNA genes, and unlike most ordinary genes, VGAM1718 precursor RNA does not encode a protein. A nucleotide sequence identical or highly similar to the nucleotide sequence of VGAM1718 precursor RNA is designated SEQ ID:1704, and is provided hereinbelow with reference to the sequence listing part. Nucleotide sequence SEQ ID:1704 is located at position 64920 relative to the genome of Molluscum Contagiosum Virus.

VGAM1718 precursor RNA folds onto itself, forming VGAM1718 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1718 folded precursor RNA into VGAM1718 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1718 RNA is designated SEQ ID:4429, and is provided hereinbelow with reference to the sequence listing part.

VGAM1718 host target gene, herein designated VGAM HOST TARGET GENE, encodes a corresponding messenger RNA, VGAM1718 host target RNA, herein designated VGAM HOST TARGET RNA. VGAM1718 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1718 RNA, herein designated VGAM RNA, binds complementarily to one or more host target binding sites located in untranslated regions of VGAM1718 host target RNA, herein designated VGAM HOST TARGET RNA. This complementary binding is due to the fact that the nucleotide sequence of VGAM1718 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1718 RNA, herein designated VGAM RNA, may have a different number of host target binding sites in untranslated regions of a VGAM1718 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1718 RNA, herein designated VGAM RNA, to host target binding sites on VGAM1718 host target RNA, herein designated VGAM HOST TARGET RNA, such as BINDING SITE I, BINDING SITE II and BINDING SITE III, inhibits translation of VGAM1718 host target RNA into VGAM1718 host target protein, herein designated VGAM HOST TARGET PROTEIN. VGAM host target protein is therefore outlined by a broken line.

It is appreciated that VGAM1718 host target gene, herein designated VGAM HOST TARGET GENE, in fact represents a plurality of VGAM1718 host target genes. The mRNA of each one of this plurality of VGAM1718 host target genes comprises one or more host target binding sites, each having a nucleotide sequence which is at least partly complementary to VGAM1718 RNA, herein designated VGAM RNA, and which when bound by VGAM1718 RNA causes inhibition of translation of respective one or more VGAM1718 host target proteins.

It is further appreciated by one skilled in the art that the mode of translational inhibition illustrated by FIG. 1 with specific reference to translational inhibition exerted by VGAM1718 gene, herein designated VGAM GENE, on one or more VGAM1718 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1718 is inhibition of expression of host target genes, as part of a novel viral mechanism of attacking a host. Accordingly, utilities of VGAM1718 include diagnosis, prevention and treatment of viral infection by Molluscum Contagiosum Virus. Specific functions, and accordingly utilities, of VGAM1718 correlate with, and may be deduced from, the identity of the host target genes which VGAM1718 binds and inhibits, and the function of these host target genes, as elaborated hereinbelow.

Nucleotide sequences of the VGAM1718 precursor RNA, herein designated VGAM PRECURSOR RNA, and of the 'diced' VGAM1718 RNA, herein designated VGAM RNA, and a schematic representation of the secondary folding of VGAM1718 folded precursor RNA, herein designated VGAM FOLDED PRECURSOR RNA, of VGAM1718 are further described hereinbelow with reference to Table 1.

Nucleotide sequences of host target binding sites, such as BINDING SITE-I, BINDING SITE-II and BINDING SITE-III of FIG. 1, found on VGAM1718 host target RNA, and schematic representation of the complementarity of each of these host target binding sites to VGAM1718 RNA, herein designated VGAM RNA, are described hereinbelow with reference to Table 2.

As mentioned hereinabove with reference to FIG. 1, a function of VGAM1718 gene, herein designated VGAM is inhibition of expression of VGAM1718 target genes. It is appreciated that specific functions, and accordingly utilities, of VGAM1718 correlate with, and may be deduced from, the identity of the target genes which VGAM1718 binds and inhibits, and the function of these target genes, as elaborated hereinbelow.

Aquaporin 1 (channel-forming integral protein, 28 kDa) (AQP1, Accession NM_000385) is a VGAM1718 host target gene. AQP1 BINDING SITE is HOST TARGET binding site found in the 3' untranslated region of mRNA encoded by AQP1, corresponding to a HOST TARGET binding site such as BINDING SITE I, BINDING SITE II or BINDING SITE III. Table 2 illustrates the complementarity of the nucleotide sequences of AQP1 BINDING SITE, designated SEQ ID:5958, to the nucleotide sequence of VGAM1718 RNA, herein designated VGAM RNA, also designated SEQ ID:4429.

A function of VGAM1718 is therefore inhibition of Aquaporin 1 (channel-forming integral protein, 28 kDa) (AQP1, Accession NM_000385). Accordingly, utilities of VGAM1718 include diagnosis, prevention and treatment of diseases and clinical conditions associated with AQP1. ATPase, Aminophospholipid Transporter-like, Class I, Type 8A, Member 2 (ATP8A2, Accession XM_167916) is another VGAM1718 host target gene. ATP8A2 BINDING SITE is HOST TARGET binding site found in the 3' untranslated region of mRNA encoded by ATP8A2, corresponding to a HOST TARGET binding site such as BINDING SITE I, BINDING SITE II or BINDING SITE III. Table 2 illustrates the complementarity of the nucleotide sequences of ATP8A2 BINDING SITE, designated SEQ ID:44919, to the nucleotide sequence of VGAM1718 RNA, herein designated VGAM RNA, also designated SEQ ID:4429.

Another function of VGAM1718 is therefore inhibition of ATPase, Aminophospholipid Transporter-like, Class I, Type 8A, Member 2 (ATP8A2, Accession XM_167916). Accordingly, utilities of VGAM1718 include diagnosis, prevention and treatment of diseases and clinical conditions associated with ATP8A2. Delta-like 1 Homolog (Drosophila) (DLK1, Accession NM_003836) is another VGAM1718 host target gene. DLK1 BINDING SITE is HOST TARGET binding site found in the 5' untranslated region of mRNA encoded by DLK1, corresponding to a HOST TARGET binding site such as BINDING SITE I, BINDING SITE II or BINDING SITE III. Table 2 illustrates the complementarity of the nucleotide sequences of DLK1 BINDING SITE, designated SEQ ID:9928, to the nucleotide sequence of VGAM1718 RNA, herein designated VGAM RNA, also designated SEQ ID:4429.

Another function of VGAM1718 is therefore inhibition of Delta-like 1 Homolog (Drosophila) (DLK1, Accession NM_003836), a gene which may have a role in neuroendocrine differentiation. Accordingly, utilities of VGAM1718 include diagnosis, prevention and treatment of diseases and clinical conditions associated with DLK1. The function of DLK1 has been established by previous studies. Lee et al. (1995) reported that DLK, pG2, and PREF1 are variant products of the same gene. They noted that C. Smas and H. S. Sul acknowledged in a personal communication that the major point of divergence between mouse Dlk and Pref1 was due to sequence data misinterpretation. Sequence analysis of multiple human DLK cDNAs revealed that there are several variant forms of DLK mRNA. Dlk1 and Gtl2 (OMIM Ref. No. 605636) are reciprocally imprinted genes located 80 kb apart on mouse chromosome 12. There are similarities between this domain and that of the well-characterized Igf2/H19 locus (see OMIM Ref. No. 103280) (Wylie et al., 2000). Takada et al. (2002) described a detailed methylation analysis of the Dlk1/Gtl2 domain on both parental alleles in the mouse. Like the Igf2/H19 domain, areas of differential methylation are hypermethylated on the paternal allele and hypomethylated on the maternal allele. Three differentially methylated regions (DMRs), each with different epigenetic characteristics, were identified. One DMR is intergenic, contains tandem repeats, and is the only region that inherits a paternal methylation mark from the germline. An intronic DMR contains a conserved putative CTCF (OMIM Ref. No. 604167)-binding domain. All 3 DMRs have both unique and common features compared to those identified in the Igf2/H19 domain.

Full details of the abovementioned studies are described in the following publications, the disclosure of which are hereby incorporated by reference:

Jensen, C. H.; Krogh, T. N.; Hojrup, P.; Clausen, P. P.; Skjodt, K.; Larsson, L.-I.; Enghild, J. J.; Teisner, B.: Protein structure of fetal antigen 1 (FA1): a novel circulating human epidermal-growth-factor-like protein expressed in neuroendocrine tumors and its relation to the gene products of dlk and pG2. Europ. J. Biochem. 225:83-92, 1994; and Takada, S.; Paulsen, M.; Tevendale, M.; Tsai, C.-E.; Kelsey, G.; Cattanach, B. M.; Ferguson-Smith, A. C.: Epigenetic analysis of the Dlk1-Gtl2 imprinted domain on mouse chromosome 12: i.

Further studies establishing the function and utilities of DLK1 are found in John Hopkins OMIM database record ID 176290, and in sited publications numbered 49-50, 54, 70 and 5459-5462 listed in the bibliography section hereinbelow, which are also hereby incorporated by reference. Huntingtin (Huntington disease) (HD, Accession NM_002111) is another VGAM1718 host target gene. HD BINDING SITE is HOST TARGET binding site found in the 3' untranslated region of mRNA encoded by HD, corresponding to a HOST TARGET binding site such as BINDING SITE I, BINDING SITE II or BINDING SITE III. Table 2 illustrates the complementarity of the nucleotide sequences of HD BINDING SITE, designated SEQ ID:7892, to the nucleotide sequence of VGAM1718 RNA, herein designated VGAM RNA, also designated SEQ ID:4429.

Another function of VGAM1718 is therefore inhibition of Huntingtin (Huntington disease) (HD, Accession NM_002111). Accordingly, utilities of VGAM1718 include diagnosis, prevention and treatment of diseases and clinical conditions associated with HD. Interleukin 12 Receptor, Beta 2 (IL12RB2, Accession NM_001559) is another VGAM1718 host target gene. IL12RB2 BINDING SITE is HOST TARGET binding site found in the 3' untranslated region of mRNA encoded by IL12RB2, corresponding to a HOST TARGET binding site such as BINDING SITE I, BINDING SITE II or BINDING SITE III. Table 2 illustrates the complementarity of the nucleotide sequences of IL12RB2 BINDING SITE, designated SEQ ID:7278, to the nucleotide sequence of VGAM1718 RNA, herein designated VGAM RNA, also designated SEQ ID:4429.

Another function of VGAM1718 is therefore inhibition of Interleukin 12 Receptor, Beta 2 (IL12RB2, Accession NM_001559), a gene which is involved in il-12 transduction. binds to il-12 with a low affinity. Accordingly, utilities of VGAM1718 include diagnosis, prevention and treatment of diseases and clinical conditions associated with IL12RB2. The function of IL12RB2 and its association with various diseases and clinical conditions, has been established by previous studies, as described hereinabove with reference to VGAM326. Jagged 2 (JAG2, Accession NM_002226) is another VGAM1718 host target gene. JAG2 BINDING SITE is HOST TARGET binding site found in the 3' untranslated region of mRNA encoded by JAG2, corresponding to a HOST TARGET binding site such as BINDING SITE I, BINDING SITE II or BINDING SITE III. Table 2 illustrates the complementarity of the nucleotide sequences of JAG2 BINDING SITE, designated SEQ ID:8004, to the nucleotide sequence of VGAM1718 RNA, herein designated VGAM RNA, also designated SEQ ID:4429.

Another function of VGAM1718 is therefore inhibition of Jagged 2 (JAG2, Accession NM_002226), a gene which is a putative notch ligand involved in the mediation of notch signaling. Accordingly, utilities of VGAM1718 include diagnosis, prevention and treatment of diseases and clinical conditions associated with JAG2. The function of JAG2 and its association with various diseases and clinical conditions, has been established by previous studies, as described hereinabove with reference to VGAM136. Msh Homeo Box Homolog 1 (Drosophila) (MSX1, Accession NM_002448) is another VGAM1718 host target gene. MSX1 BINDING SITE is HOST TARGET binding site found in the 5' untranslated region of mRNA encoded by MSX1, corresponding to a HOST TARGET binding site such as BINDING SITE I, BINDING SITE II or BINDING SITE III. Table 2 illustrates the complementarity of the nucleotide sequences of MSX1 BINDING SITE, designated SEQ ID:8286, to the nucleotide sequence of VGAM1718 RNA, herein designated VGAM RNA, also designated SEQ ID:4429.

Another function of VGAM1718 is therefore inhibition of Msh Homeo Box Homolog 1 (Drosophila) (MSX1, Accession NM_002448). Accordingly, utilities of VGAM1718 include diagnosis, prevention and treatment of diseases and clinical conditions associated with MSX1. Metastasis-associated 1-like 1 (MTA1L1, Accession NM_004739) is another VGAM1718 host target gene. MTA1L1 BINDING SITE is HOST TARGET binding site found in the 5' untranslated region of mRNA encoded by MTA1L1, corresponding to a HOST TARGET binding site such as BINDING SITE I, BINDING SITE II or BINDING SITE III. Table 2 illustrates the complementarity of the nucleotide sequences of MTA1L1 BINDING SITE, designated SEQ ID:11135, to the nucleotide sequence of VGAM1718 RNA, herein designated VGAM RNA, also designated SEQ ID:4429.

Another function of VGAM1718 is therefore inhibition of Metastasis-associated 1-like 1 (MTA1L1, Accession NM_004739), a gene which regulates histone deacetylase core complex enzymatic activity. Accordingly, utilities of VGAM1718 include diagnosis, prevention and treatment of diseases and clinical conditions associated with MTA1L1. The function of MTA1L1 and its association with various diseases and clinical conditions, has been established by previous studies, as described hereinabove with reference to VGAM659. Myotubularin Related Protein 3 (MTMR3, Accession NM_021090) is another VGAM1718 host target gene. MTMR3 BINDING SITE is HOST TARGET binding site found in the 3' untranslated region of mRNA encoded by MTMR3, corresponding to a HOST TARGET binding site such as BINDING SITE I, BINDING SITE II or BINDING SITE III. Table 2 illustrates the complementarity of the nucleotide sequences of MTMR3 BINDING SITE, designated SEQ ID:22073, to the nucleotide sequence of VGAM1718 RNA, herein designated VGAM RNA, also designated SEQ ID:4429.

Another function of VGAM1718 is therefore inhibition of Myotubularin Related Protein 3 (MTMR3, Accession NM_021090), a gene which could be a tyrosine-phosphatase. Accordingly, utilities of VGAM1718 include diagnosis, prevention and treatment of diseases and clinical conditions associated with MTMR3. The function of MTMR3 has been established by previous studies. Zhao et al. (2001) showed that an isoform of MTMR3, missing exon 17, dephosphorylates para-nitrophenylphosphate and phosphatidylinositol 3-phosphate.

Full details of the abovementioned studies are described in the following publications, the disclosure of which are hereby incorporated by reference:

Nagase, T.; Ishikawa, K.; Nakajima, D.; Ohira, M.; Seki, N.; Miyajima, N.; Tanaka, A.; Kotani, H.; Nomura, N.; Ohara, O.: Prediction of the coding sequences of unidentified human genes. VII. The complete sequences of 100 new cDNA clones from brain which can code for large proteins in vitro. DNA Res. 4:141-150, 1997; and Zhao, R.; Qi, Y.; Chen, J.; Zhao, Z. J.: FYVE-DSP2, a FYVE domain-containing dual specificity protein phosphatase that dephosphorylates phosphotidylinositol (sic) 3-phosphate. Exp. Cel.

Further studies establishing the function and utilities of MTMR3 are found in John Hopkins OMIM database record ID 603558, and in sited publications numbered 725 and 5003 listed in the bibliography section hereinbelow, which are also hereby incorporated by reference. Protein Phosphatase 2 (formerly 2A), Regulatory Subunit B (PR 52), Gamma Isoform (PPP2R2C, Accession XM_029744) is another VGAM1718 host target gene. PPP2R2C BINDING SITE is HOST TARGET binding site found in the 5' untranslated region of mRNA encoded by PPP2R2C, corresponding to a HOST TARGET binding site such as BINDING SITE I, BINDING SITE II or BINDING SITE III. Table 2 illustrates the complementarity of the nucleotide sequences of PPP2R2C BINDING SITE, designated SEQ ID:30939, to the nucleotide sequence of VGAM1718 RNA, herein designated VGAM RNA, also designated SEQ ID:4429.

Another function of VGAM1718 is therefore inhibition of Protein Phosphatase 2 (formerly 2A), Regulatory Subunit B (PR 52), Gamma Isoform (PPP2R2C, Accession XM_029744). Accordingly, utilities of VGAM1718 include diagnosis, prevention and treatment of diseases and clinical conditions associated with PPP2R2C. Solute Carrier Family 19 (folate transporter), Member 1 (SLC19A1, Accession NM_003056) is another VGAM1718 host target gene. SLC19A1 BINDING SITE is HOST TARGET binding site found in the 3' untranslated region of mRNA encoded by SLC19A1, corresponding to a HOST TARGET binding site such as BINDING SITE I, BINDING SITE II or BINDING SITE III. Table 2 illustrates the complementarity of the nucleotide sequences of SLC19A1 BINDING SITE, designated SEQ ID:9020, to the nucleotide sequence of VGAM1718 RNA, herein designated VGAM RNA, also designated SEQ ID:4429.

Another function of VGAM1718 is therefore inhibition of Solute Carrier Family 19 (folate transporter), Member 1 (SLC19A1, Accession NM_003056). Accordingly, utilities of VGAM1718 include diagnosis, prevention and treatment of diseases and clinical conditions associated with SLC19A1. Tripartite Motif-containing 9 (TRIM9, Accession NM_015163) is another VGAM1718 host target gene. TRIM9 BINDING SITE is HOST TARGET binding site found in the 5' untranslated region of mRNA encoded by TRIM9, corresponding to a HOST TARGET binding site such as BINDING SITE I, BINDING SITE II or BINDING SITE III. Table 2 illustrates the complementarity of the nucleotide sequences of TRIM9 BINDING SITE, designated SEQ ID:17518, to the nucleotide sequence of VGAM1718 RNA, herein designated VGAM RNA, also designated SEQ ID:4429.

Another function of VGAM1718 is therefore inhibition of Tripartite Motif-containing 9 (TRIM9, Accession NM_015163), a gene which may function as a positive regulator for mannosylphosphate transferase and is required to mediate mannosylphosphate transfer in both the core and outer chain portions of n-linked. oligosaccharides. Accordingly, utilities of VGAM1718 include diagnosis, prevention and treatment of diseases and clinical conditions associated with TRIM9. The function of TRIM9 and its association with various diseases and clinical conditions, has been established by previous studies, as described hereinabove with reference to VGAM74. Transient Receptor Potential Cation Channel, Subfamily V, Member 2 (TRPV2, Accession NM_016113) is another VGAM1718 host target gene. TRPV2 BINDING SITE is HOST TARGET binding site found in the 5' untranslated region of mRNA encoded by TRPV2, corresponding to a HOST TARGET binding site such as BINDING SITE I, BINDING SITE II or BINDING SITE III. Table 2 illustrates the complementarity of the nucleotide sequences of TRPV2 BINDING SITE, designated SEQ ID:18195, to the nucleotide sequence of VGAM1718 RNA, herein designated VGAM RNA, also designated SEQ ID:4429.

Another function of VGAM1718 is therefore inhibition of Transient Receptor Potential Cation Channel, Subfamily V, Member 2 (TRPV2, Accession NM_016113). Accordingly, utilities of VGAM1718 include diagnosis, prevention and treatment of diseases and clinical conditions associated with TRPV2. Ubiquitin Specific Protease 6 (Tre-2 oncogene) (USP6, Accession XM_165948) is another VGAM1718 host target gene. USP6 BINDING SITE is HOST TARGET binding site found in the 5' untranslated region of mRNA encoded by USP6, corresponding to a HOST TARGET binding site such as BINDING SITE I, BINDING SITE II or BINDING SITE III. Table 2 illustrates the complementarity of the nucleotide sequences of USP6 BINDING SITE, designated SEQ ID:43807, to the nucleotide sequence of VGAM1718 RNA, herein designated VGAM RNA, also designated SEQ ID:4429.

Another function of VGAM1718 is therefore inhibition of Ubiquitin Specific Protease 6 (Tre-2 oncogene) (USP6, Accession XM_165948), a gene which has an atp-independent isopeptidase activity, cleaving at the carboxyl terminus of the ubiquitin moiety. Accordingly, utilities of VGAM1718 include diagnosis, prevention and treatment of diseases and clinical conditions associated with USP6. The function of USP6 and its association with various diseases and clinical conditions, has been established by previous studies, as described hereinabove with reference to VGAM296. C1q and Tumor Necrosis Factor Related Protein 7 (C1QTNF7, Accession NM_031911) is another VGAM1718 host target gene. C1QTNF7 BINDING SITE is HOST TARGET binding site found in the 3' untranslated region of mRNA encoded by C1QTNF7, corresponding to a HOST TARGET binding site such as BINDING SITE I, BINDING SITE II or BINDING SITE III. Table 2 illustrates the complementarity of the nucleotide sequences of C1QTNF7 BINDING SITE, designated SEQ ID:25662, to the nucleotide sequence of VGAM1718 RNA, herein designated VGAM RNA, also designated SEQ ID:4429.

Another function of VGAM1718 is therefore inhibition of C1q and Tumor Necrosis Factor Related Protein 7 (C1QTNF7, Accession NM_031911). Accordingly, utilities of VGAM1718 include diagnosis, prevention and treatment of diseases and clinical conditions associated with C1QTNF7. Chromobox Homolog 6 (CBX6, Accession NM_014292) is another VGAM1718 host target gene. CBX6 BINDING SITE is HOST TARGET binding site found in the 3' untranslated region of mRNA encoded by CBX6, corresponding to a HOST TARGET binding site such as BINDING SITE I, BINDING SITE II or BINDING SITE III. Table 2 illustrates the complementarity of the nucleotide sequences of CBX6 BINDING SITE, designated SEQ ID:15572, to the nucleotide sequence of VGAM1718 RNA, herein designated VGAM RNA, also designated SEQ ID:4429.

Another function of VGAM1718 is therefore inhibition of Chromobox Homolog 6 (CBX6, Accession NM_014292). Accordingly, utilities of VGAM1718 include diagnosis, prevention and treatment of diseases and clinical conditions associated with CBX6. DKFZP434O047 (Accession NM_015594) is another VGAM1718 host target gene. DKFZP434O047 BINDING SITE is HOST TARGET binding site found in the 5' untranslated region of mRNA encoded by DKFZP434O047, corresponding to a HOST TARGET binding site such as BINDING SITE I, BINDING SITE II or BINDING SITE III. Table 2 illustrates the complementarity of the nucleotide sequences of DKFZP434O047 BINDING SITE, designated SEQ ID:17860, to the nucleotide sequence of VGAM1718 RNA, herein designated VGAM RNA, also designated SEQ ID:4429.

Another function of VGAM1718 is therefore inhibition of DKFZP434O047 (Accession NM_015594). Accordingly, utilities of VGAM1718 include diagnosis, prevention and treatment of diseases and clinical conditions associated with DKFZP434O047. DR1-associated Protein 1 (negative cofactor 2 alpha) (DRAP1, Accession NM_006442) is another VGAM1718 host target gene. DRAP1 BINDING SITE is HOST TARGET binding site found in the 5' untranslated region of mRNA encoded by DRAP1, corresponding to a HOST TARGET binding site such as BINDING SITE I, BINDING SITE II or BINDING SITE III. Table 2 illustrates the complementarity of the nucleotide sequences of DRAP1 BINDING SITE, designated SEQ ID:13154, to the nucleotide sequence of VGAM1718 RNA, herein designated VGAM RNA, also designated SEQ ID:4429.

Another function of VGAM1718 is therefore inhibition of DR1-associated Protein 1 (negative cofactor 2 alpha) (DRAP1, Accession NM_006442). Accordingly, utilities of VGAM1718 include diagnosis, prevention and treatment of diseases and clinical conditions associated with DRAP1. FLJ00001 (Accession XM_088525) is another VGAM1718 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39779, to the nucleotide sequence of VGAM1718 RNA, herein designated VGAM RNA, also designated SEQ ID:4429.

Another function of VGAM1718 is therefore inhibition of FLJ00001 (Accession XM_088525). Accordingly, utilities of VGAM1718 include diagnosis, prevention and treatment of diseases and clinical conditions associated with FLJ00001. FLJ21562 (Accession NM_025113) is another VGAM1718 host target gene. FLJ21562 BINDING SITE is HOST TARGET binding site found in the 5' untranslated region of mRNA encoded by FLJ21562, corresponding to a HOST TARGET binding site such as BINDING SITE I, BINDING SITE II or BINDING SITE III. Table 2 illustrates the complementarity of the nucleotide sequences of FLJ21562 BINDING SITE, designated SEQ ID:24761, to the nucleotide sequence of VGAM1718 RNA, herein designated VGAM RNA, also designated SEQ ID:4429.

Another function of VGAM1718 is therefore inhibition of FLJ21562 (Accession NM_025113). Accordingly, utilities of VGAM1718 include diagnosis, prevention and treatment of diseases and clinical conditions associated with FLJ21562. KIAA0350 (Accession XM_028332) is another VGAM1718 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30658, to the nucleotide sequence of VGAM1718 RNA, herein designated VGAM RNA, also designated SEQ ID:4429.

Another function of VGAM1718 is therefore inhibition of KIAA0350 (Accession XM_028332). Accordingly, utilities of VGAM1718 include diagnosis, prevention and treatment of diseases and clinical conditions associated with KIAA0350. KIAA0513 (Accession NM_014732) is another VGAM1718 host target gene. KIAA0513 BINDING SITE is HOST TARGET binding site found in the 3' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16351, to the nucleotide sequence of VGAM1718 RNA, herein designated VGAM RNA, also designated SEQ ID:4429.

Another function of VGAM1718 is therefore inhibition of KIAA0513 (Accession NM_014732). Accordingly, utilities of VGAM1718 include diagnosis, prevention and treatment of diseases and clinical conditions associated with KIAA0513. KIAA1297 (Accession XM_051005) is another VGAM1718 host target gene. KIAA1297 BINDING SITE is HOST TARGET binding site found in the 5' untranslated region of mRNA encoded by KIAA1297, corresponding to a HOST TARGET binding site such as BINDING SITE I, BINDING SITE II or BINDING SITE III. Table 2 illustrates the complementarity of the nucleotide sequences of KIAA1297 BINDING SITE, designated SEQ ID:35714, to the nucleotide sequence of VGAM1718 RNA, herein designated VGAM RNA, also designated SEQ ID:4429.

Another function of VGAM1718 is therefore inhibition of KIAA1297 (Accession XM_051005). Accordingly, utilities of VGAM1718 include diagnosis, prevention and treatment of diseases and clinical conditions associated with KIAA1297. KIAA1813 (Accession XM_046743) is another VGAM1718 host target gene. KIAA1813 BINDING SITE is HOST TARGET binding site found in the 5' untranslated region of mRNA encoded by KIAA1813, corresponding to a HOST TARGET binding site such as BINDING SITE I, BINDING SITE II or BINDING SITE III. Table 2 illustrates the complementarity of the nucleotide sequences of KIAA1813 BINDING SITE, designated SEQ ID:34813, to the nucleotide sequence of VGAM1718 RNA, herein designated VGAM RNA, also designated SEQ ID:4429.

Another function of VGAM1718 is therefore inhibition of KIAA1813 (Accession XM_046743). Accordingly, utilities of VGAM1718 include diagnosis, prevention and treatment of diseases and clinical conditions associated with KIAA1813. KIAA1977 (Accession XM_058800) is another VGAM1718 host target gene. KIAA1977 BINDING SITE is HOST TARGET binding site found in the 5' untranslated region of mRNA encoded by KIAA1977, corresponding to a HOST TARGET binding site such as BINDING SITE I, BINDING SITE II or BINDING SITE III. Table 2 illustrates the complementarity of the nucleotide sequences of KIAA1977 BINDING SITE, designated SEQ ID:36748, to the nucleotide sequence of VGAM1718 RNA, herein designated VGAM RNA, also designated SEQ ID:4429.

Another function of VGAM1718 is therefore inhibition of KIAA1977 (Accession XM_058800). Accordingly, utilities of VGAM1718 include diagnosis, prevention and treatment of diseases and clinical conditions associated with KIAA1977. MOT8 (Accession NM_018836) is another VGAM1718 host target gene. MOT8 BINDING SITE is HOST TARGET binding site found in the 5' untranslated region of mRNA encoded by MOT8, corresponding to a HOST TARGET binding site such as BINDING SITE I, BINDING SITE II or BINDING SITE III. Table 2 illustrates the complementarity of the nucleotide sequences of MOT8 BINDING SITE, designated SEQ ID:20823, to the nucleotide sequence of VGAM1718 RNA, herein designated VGAM RNA, also designated SEQ ID:4429.

Another function of VGAM1718 is therefore inhibition of MOT8 (Accession NM_018836). Accordingly, utilities of VGAM1718 include diagnosis, prevention and treatment of diseases and clinical conditions associated with MOT8. Obscurin, Cytoskeletal Calmodulin and Titin-interacting RhoGEF (OBSCN, Accession XM_047536) is another VGAM1718 host target gene. OBSCN BINDING SITE is HOST TARGET binding site found in the 3' untranslated region of mRNA encoded by OBSCN, corresponding to a HOST TARGET binding site such as BINDING SITE I, BINDING SITE II or BINDING SITE III. Table 2 illustrates the complementarity of the nucleotide sequences of OBSCN BINDING SITE, designated SEQ ID:34990, to the nucleotide sequence of VGAM1718 RNA, herein designated VGAM RNA, also designated SEQ ID:4429.

Another function of VGAM1718 is therefore inhibition of Obscurin, Cytoskeletal Calmodulin and Titin-interacting RhoGEF (OBSCN, Accession XM_047536). Accordingly, utilities of VGAM1718 include diagnosis, prevention and treatment of diseases and clinical conditions associated with OBSCN. Retinoic Acid Induced 16 (RAI16, Accession NM_022749) is another VGAM1718 host target gene. RAI16 BINDING SITE is HOST TARGET binding site found in the 3' untranslated region of mRNA encoded by RAI16, corresponding to a HOST TARGET binding site such as BINDING SITE I, BINDING SITE II or BINDING SITE III. Table 2 illustrates the complementarity of the nucleotide sequences of RAI16 BINDING SITE, designated SEQ ID:22968, to the nucleotide sequence of VGAM1718 RNA, herein designated VGAM RNA, also designated SEQ ID:4429.

Another function of VGAM1718 is therefore inhibition of Retinoic Acid Induced 16 (RAI16, Accession NM_022749). Accordingly, utilities of VGAM1718 include diagnosis, prevention and treatment of diseases and clinical conditions associated with RAI16. RHO6 (Accession NM_014470) is another VGAM1718 host target gene. RHO6 BINDING SITE is HOST TARGET binding site found in the 3' untranslated region of mRNA encoded by RHO6, corresponding to a HOST TARGET binding site such as BINDING SITE I, BINDING SITE II or BINDING SITE III. Table 2 illustrates the complementarity of the nucleotide sequences of RHO6 BINDING SITE, designated SEQ ID:15820, to the nucleotide sequence of VGAM1718 RNA, herein designated VGAM RNA, also designated SEQ ID:4429.

Another function of VGAM1718 is therefore inhibition of RHO6 (Accession NM_014470). Accordingly, utilities of VGAM1718 include diagnosis, prevention and treatment of diseases and clinical conditions associated with RHO6. LOC125704 (Accession XM_058931) is another VGAM1718 host target gene. LOC125704 BINDING SITE is HOST TARGET binding site found in the 5' untranslated region of mRNA encoded by LOC125704, corresponding to a HOST TARGET binding site such as BINDING SITE I, BINDING SITE II or BINDING SITE III. Table 2 illustrates the complementarity of the nucleotide sequences of LOC125704 BINDING SITE, designated SEQ ID:36796, to the nucleotide sequence of VGAM1718 RNA, herein designated VGAM RNA, also designated SEQ ID:4429.

Another function of VGAM1718 is therefore inhibition of LOC125704 (Accession XM_058931). Accordingly, utilities of VGAM1718 include diagnosis, prevention and treatment of diseases and clinical conditions associated with LOC125704. LOC126917 (Accession XM_059091) is another VGAM1718 host target gene. LOC126917 BINDING SITE is HOST TARGET binding site found in the 5' untranslated region of mRNA encoded by LOC126917, corresponding to a HOST TARGET binding site such as BINDING SITE I, BINDING SITE II or BINDING SITE III. Table 2 illustrates the complementarity of the nucleotide sequences of LOC126917 BINDING SITE, designated SEQ ID:36869, to the nucleotide sequence of VGAM1718 RNA, herein designated VGAM RNA, also designated SEQ ID:4429.

Another function of VGAM1718 is therefore inhibition of LOC126917 (Accession XM_059091). Accordingly, utilities of VGAM1718 include diagnosis, prevention and treatment of diseases and clinical conditions associated with LOC126917. LOC146782 (Accession XM_083963) is another VGAM1718 host target gene. LOC146782 BINDING SITE is HOST TARGET binding site found in the 5' untranslated region of mRNA encoded by LOC146782, corresponding to a HOST TARGET binding site such as BINDING SITE I, BINDING SITE II or BINDING SITE III. Table 2 illustrates the complementarity of the nucleotide sequences of LOC146782 BINDING SITE, designated SEQ ID:37523, to the nucleotide sequence of VGAM1718 RNA, herein designated VGAM RNA, also designated SEQ ID:4429.

Another function of VGAM1718 is therefore inhibition of LOC146782 (Accession XM_083963). Accordingly, utilities of VGAM1718 include diagnosis, prevention and treatment of diseases and clinical conditions associated with LOC146782. LOC152078 (Accession XM_087376) is another VGAM1718 host target gene. LOC152078 BINDING SITE is HOST TARGET binding site found in the 5' untranslated region of mRNA encoded by LOC152078, corresponding to a HOST TARGET binding site such as BINDING SITE I, BINDING SITE II or BINDING SITE III. Table 2 illustrates the complementarity of the nucleotide sequences of LOC152078 BINDING SITE, designated SEQ ID:39212, to the nucleotide sequence of VGAM1718 RNA, herein designated VGAM RNA, also designated SEQ ID:4429.

Another function of VGAM1718 is therefore inhibition of LOC152078 (Accession XM_087376). Accordingly, utilities of VGAM1718 include diagnosis, prevention and treatment of diseases and clinical conditions associated with LOC152078. LOC200014 (Accession XM_114087) is another VGAM1718 host target gene. LOC200014 BINDING SITE is HOST TARGET binding site found in the 3' untranslated region of mRNA encoded by LOC200014, corresponding to a HOST TARGET binding site such as BINDING SITE I, BINDING SITE II or BINDING SITE III. Table 2 illustrates the complementarity of the nucleotide sequences of LOC200014 BINDING SITE, designated SEQ ID:42688, to the nucleotide sequence of VGAM1718 RNA, herein designated VGAM RNA, also designated SEQ ID:4429.

Another function of VGAM1718 is therefore inhibition of LOC200014 (Accession XM_114087). Accordingly, utilities of VGAM1718 include diagnosis, prevention and treatment of diseases and clinical conditions associated with LOC200014. LOC255397 (Accession XM_173868) is another VGAM1718 host target gene. LOC255397 BINDING SITE is HOST TARGET binding site found in the 5' untranslated region of mRNA encoded by LOC255397, corresponding to a HOST TARGET binding site such as BINDING SITE I, BINDING SITE II or BINDING SITE III. Table 2 illustrates the complementarity of the nucleotide sequences of LOC255397 BINDING SITE, designated SEQ ID:46565, to the nucleotide sequence of VGAM1718 RNA, herein designated VGAM RNA, also designated SEQ ID:4429.

Another function of VGAM1718 is therefore inhibition of LOC255397 (Accession XM_173868). Accordingly, utilities of VGAM1718 include diagnosis, prevention and treatment of diseases and clinical conditions associated with LOC255397. LOC256158 (Accession XM_175125) is another VGAM1718 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46616, to the nucleotide sequence of VGAM1718 RNA, herein designated VGAM RNA, also designated SEQ ID:4429.

Another function of VGAM1718 is therefore inhibition of LOC256158 (Accession XM_175125). Accordingly, utilities of VGAM1718 include diagnosis, prevention and treatment of diseases and clinical conditions associated with LOC256158. FIG. 1 further provides a conceptual description of a novel bioinformatically detected viral gene of the present invention, referred to here as Viral Genomic Address Messenger 1719 (VGAM1719) viral gene, which modulates expression of respective host target genes thereof, the function and utility of which host target genes is known in the art.

VGAM1719 is a novel bioinformatically detected regulatory, non protein coding, viral micro RNA (miRNA) gene. The method by which VGAM1719 was detected is described hereinabove with reference to FIGS. 1-8.

VGAM1719 gene, herein designated VGAM GENE, is a viral gene contained in the genome of Rat Cytomegalovirus. VGAM1719 host target gene, herein designated VGAM HOST TARGET GENE, is a human gene contained in the human genome.

VGAM1719 gene encodes a VGAM1719 precursor RNA, herein designated VGAM PRECURSOR RNA. Similar to other miRNA genes, and unlike most ordinary genes, VGAM1719 precursor RNA does not encode a protein. A nucleotide sequence identical or highly similar to the nucleotide sequence of VGAM1719 precursor RNA is designated SEQ ID:1705, and is provided hereinbelow with reference to the sequence listing part. Nucleotide sequence SEQ ID:1705 is located at position 110474 relative to the genome of Rat Cytomegalovirus.

VGAM1719 precursor RNA folds onto itself, forming VGAM1719 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1719 folded precursor RNA into VGAM1719 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1719 RNA is designated SEQ ID:4430, and is provided hereinbelow with reference to the sequence listing part.

VGAM1719 host target gene, herein designated VGAM HOST TARGET GENE, encodes a corresponding messenger RNA, VGAM1719 host target RNA, herein designated VGAM HOST TARGET RNA. VGAM1719 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1719 RNA, herein designated VGAM RNA, binds complementarily to one or more host target binding sites located in untranslated regions of VGAM1719 host target RNA, herein designated VGAM HOST TARGET RNA. This complementary binding is due to the fact that the nucleotide sequence of VGAM1719 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1719 RNA, herein designated VGAM RNA, may have a different number of host target binding sites in untranslated regions of a VGAM1719 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1719 RNA, herein designated VGAM RNA, to host target binding sites on VGAM1719 host target RNA, herein designated VGAM HOST TARGET RNA, such as BINDING SITE I, BINDING SITE II and BINDING SITE III, inhibits translation of VGAM1719 host target RNA into VGAM1719 host target protein, herein designated VGAM HOST TARGET PROTEIN. VGAM host target protein is therefore outlined by a broken line.

It is appreciated that VGAM1719 host target gene, herein designated VGAM HOST TARGET GENE, in fact represents a plurality of VGAM1719 host target genes. The mRNA of each one of this plurality of VGAM1719 host target genes comprises one or more host target binding sites, each having a nucleotide sequence which is at least partly complementary to VGAM1719 RNA, herein designated VGAM RNA, and which when bound by VGAM1719 RNA causes inhibition of translation of respective one or more VGAM1719 host target proteins.

It is further appreciated by one skilled in the art that the mode of translational inhibition illustrated by FIG. 1 with specific reference to translational inhibition exerted by VGAM1719 gene, herein designated VGAM GENE, on one or more VGAM1719 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1719 is inhibition of expression of host target genes, as part of a novel viral mechanism of attacking a host. Accordingly, utilities of VGAM1719 include diagnosis, prevention and treatment of viral infection by Rat Cytomegalovirus. Specific functions, and accordingly utilities, of VGAM1719 correlate with, and may be deduced from, the identity of the host target genes which VGAM1719 binds and inhibits, and the function of these host target genes, as elaborated hereinbelow.

Nucleotide sequences of the VGAM1719 precursor RNA, herein designated VGAM PRECURSOR RNA, and of the 'diced' VGAM1719 RNA, herein designated VGAM RNA, and a schematic representation of the secondary folding of VGAM1719 folded precursor RNA, herein designated VGAM FOLDED PRECURSOR RNA, of VGAM1719 are further described hereinbelow with reference to Table 1.

Nucleotide sequences of host target binding sites, such as BINDING SITE-I, BINDING SITE-II and BINDING SITE-III of FIG. 1, found on VGAM1719 host target RNA, and schematic representation of the complementarity of each of these host target binding sites to VGAM1719 RNA, herein designated VGAM RNA, are described hereinbelow with reference to Table 2.

As mentioned hereinabove with reference to FIG. 1, a function of VGAM1719 gene, herein designated VGAM is inhibition of expression of VGAM1719 target genes. It is appreciated that specific functions, and accordingly utilities, of VGAM1719 correlate with, and may be deduced from, the identity of the target genes which VGAM1719 binds and inhibits, and the function of these target genes, as elaborated hereinbelow.

PYGO2 (Accession XM_034083) is a VGAM1719 host target gene. PYGO2 BINDING SITE is HOST TARGET binding site found in the 3' untranslated region of mRNA encoded by PYGO2, corresponding to a HOST TARGET binding site such as BINDING SITE I, BINDING SITE II or BINDING SITE III. Table 2 illustrates the complementarity of the nucleotide sequences of PYGO2 BINDING SITE, designated SEQ ID:31999, to the nucleotide sequence of VGAM1719 RNA, herein designated VGAM RNA, also designated SEQ ID:4430.

A function of VGAM1719 is therefore inhibition of PYGO2 (Accession XM_034083). Accordingly, utilities of VGAM1719 include diagnosis, prevention and treatment of diseases and clinical conditions associated with PYGO2. Suppression of Tumorigenicity 7 (ST7, Accession NM_018412) is another VGAM1719 host target gene. ST7 BINDING SITE1 and ST7 BINDING SITE2 are HOST TARGET binding sites found in untranslated regions of mRNA encoded by ST7, corresponding to HOST TARGET binding sites such as BINDING SITE I, BINDING SITE II or BINDING SITE III. Table 2 illustrates the complementarity of the nucleotide sequences of ST7 BINDING SITE1 and ST7 BINDING SITE2, designated SEQ ID:20455 and SEQ ID:22431 respectively, to the nucleotide sequence of VGAM1719 RNA, herein designated VGAM RNA, also designated SEQ ID:4430.

Another function of VGAM1719 is therefore inhibition of Suppression of Tumorigenicity 7 (ST7, Accession NM_018412), a gene which has a role in regulating cell-environment or cell-cell interactions. Accordingly, utilities of VGAM1719 include diagnosis, prevention and treatment of diseases and clinical conditions associated with ST7. The function of ST7 and its association with various diseases and clinical conditions, has been established by previous studies, as described hereinabove with reference to VGAM107. DKFZp434O0515 (Accession XM_038277) is another VGAM1719 host target gene. DKFZp434O0515 BINDING SITE is HOST TARGET binding site found in the 5' untranslated region of mRNA encoded by DKFZp434O0515, corresponding to a HOST TARGET binding site such as BINDING SITE I, BINDING SITE II or BINDING SITE III. Table 2 illustrates the complementarity of the nucleotide sequences of DKFZp434O0515 BINDING SITE, designated SEQ ID:32786, to the nucleotide sequence of VGAM1719 RNA, herein designated VGAM RNA, also designated SEQ ID:4430.

Another function of VGAM1719 is therefore inhibition of DKFZp434O0515 (Accession XM_038277). Accordingly, utilities of VGAM1719 include diagnosis, prevention and treatment of diseases and clinical conditions associated with DKFZp434O0515. KIAA1161 (Accession XM_088501) is another VGAM1719 host target gene. KIAA1161 BINDING SITE is HOST TARGET binding site found in the 5' untranslated region of mRNA encoded by KIAA1161, corresponding to a HOST TARGET binding site such as BINDING SITE I, BINDING SITE II or BINDING SITE III. Table 2 illustrates the complementarity of the nucleotide sequences of KIAA1161 BINDING SITE, designated SEQ ID:39753, to the nucleotide sequence of VGAM1719 RNA, herein designated VGAM RNA, also designated SEQ ID:4430.

Another function of VGAM1719 is therefore inhibition of KIAA1161 (Accession XM_088501). Accordingly, utilities of VGAM1719 include diagnosis, prevention and treatment of diseases and clinical conditions associated with KIAA1161. MAD, Mothers Against Decapentaplegic Homolog (Drosophila) Interacting Protein, Receptor Activation Anchor (MADHIP, Accession NM_007323) is another VGAM1719 host target gene. MADHIP BINDING SITE1 through MADHIP BINDING SITE3 are HOST TARGET binding sites found in untranslated regions of mRNA encoded by MADHIP, corresponding to HOST TARGET binding sites such as BINDING SITE I, BINDING SITE II or BINDING SITE III. Table 2 illustrates the complementarity of the nucleotide sequences of MADHIP BINDING SITE1 through MADHIP BINDING SITE3, designated SEQ ID:14241, SEQ ID:14243 and SEQ ID:11220 respectively, to the nucleotide sequence of VGAM1719 RNA, herein designated VGAM RNA, also designated SEQ ID:4430.

Another function of VGAM1719 is therefore inhibition of MAD, Mothers Against Decapentaplegic Homolog (Drosophila) Interacting Protein, Receptor Activation Anchor (MADHIP, Accession NM_007323). Accordingly, utilities of VGAM1719 include diagnosis, prevention and treatment of diseases and clinical conditions associated with MADHIP. LOC124216 (Accession XM_058783) is another VGAM1719 host target gene. LOC124216 BINDING SITE is HOST TARGET binding site found in the 3' untranslated region of mRNA encoded by LOC124216, corresponding to a HOST TARGET binding site such as BINDING SITE I, BINDING SITE II or BINDING SITE III. Table 2 illustrates the complementarity of the nucleotide sequences of LOC124216 BINDING SITE, designated SEQ ID:36739, to the nucleotide sequence of VGAM1719 RNA, herein designated VGAM RNA, also designated SEQ ID:4430.

Another function of VGAM1719 is therefore inhibition of LOC124216 (Accession XM_058783). Accordingly, utilities of VGAM1719 include diagnosis, prevention and treatment of diseases and clinical conditions associated with LOC124216. LOC147071 (Accession XM_054031) is another VGAM1719 host target gene. LOC147071 BINDING SITE is HOST TARGET binding site found in the 5' untranslated region of mRNA encoded by LOC147071, corresponding to a HOST TARGET binding site such as BINDING SITE I, BINDING SITE II or BINDING SITE III. Table 2 illustrates the complementarity of the nucleotide sequences of LOC147071 BINDING SITE, designated SEQ ID:36137, to the nucleotide sequence of VGAM1719 RNA, herein designated VGAM RNA, also designated SEQ ID:4430.

Another function of VGAM1719 is therefore inhibition of LOC147071 (Accession XM_054031). Accordingly, utilities of VGAM1719 include diagnosis, prevention and treatment of diseases and clinical conditions associated with LOC147071. LOC201173 (Accession XM_113312) is another VGAM1719 host target gene. LOC201173 BINDING SITE is HOST TARGET binding site found in the 5' untranslated region of mRNA encoded by LOC201173, corresponding to a HOST TARGET binding site such as BINDING SITE I, BINDING SITE II or BINDING SITE III. Table 2 illustrates the complementarity of the nucleotide sequences of LOC201173 BINDING SITE, designated SEQ ID:42216, to the nucleotide sequence of VGAM1719 RNA, herein designated VGAM RNA, also designated SEQ ID:4430.

Another function of VGAM1719 is therefore inhibition of LOC201173 (Accession XM_113312). Accordingly, utilities of VGAM1719 include diagnosis, prevention and treatment of diseases and clinical conditions associated with LOC201173. LOC201220 (Accession XM_113321) is another VGAM1719 host target gene. LOC201220 BINDING SITE is HOST TARGET binding site found in the 5' untranslated region of mRNA encoded by LOC201220, corresponding to a HOST TARGET binding site such as BINDING SITE I, BINDING SITE II or BINDING SITE III. Table 2 illustrates the complementarity of the nucleotide sequences of LOC201220 BINDING SITE, designated SEQ ID:42223, to the nucleotide sequence of VGAM1719 RNA, herein designated VGAM RNA, also designated SEQ ID:4430.

Another function of VGAM1719 is therefore inhibition of LOC201220 (Accession XM_113321). Accordingly, utilities of VGAM1719 include diagnosis, prevention and treatment of diseases and clinical conditions associated with LOC201220. LOC203504 (Accession XM_117550) is another VGAM1719 host target gene. LOC203504 BINDING SITE is HOST TARGET binding site found in the 3' untranslated region of mRNA encoded by LOC203504, corresponding to a HOST TARGET binding site such as BINDING SITE I, BINDING SITE II or BINDING SITE III. Table 2 illustrates the complementarity of the nucleotide sequences of LOC203504 BINDING SITE, designated SEQ ID:43570, to the nucleotide sequence of VGAM1719 RNA, herein designated VGAM RNA, also designated SEQ ID:4430.

Another function of VGAM1719 is therefore inhibition of LOC203504 (Accession XM_117550). Accordingly, utilities of VGAM1719 include diagnosis, prevention and treatment of diseases and clinical conditions associated with LOC203504. LOC256682 (Accession XM_174473) is another VGAM1719 host target gene. LOC256682 BINDING SITE is HOST TARGET binding site found in the 5' untranslated region of mRNA encoded by LOC256682, corresponding to a HOST TARGET binding site such as BINDING SITE I, BINDING SITE II or BINDING SITE III. Table 2 illustrates the complementarity of the nucleotide sequences of LOC256682 BINDING SITE, designated SEQ ID:46593, to the nucleotide sequence of VGAM1719 RNA, herein designated VGAM RNA, also designated SEQ ID:4430.

Another function of VGAM1719 is therefore inhibition of LOC256682 (Accession XM_174473). Accordingly, utilities of VGAM1719 include diagnosis, prevention and treatment of diseases and clinical conditions associated with LOC256682. LOC257451 (Accession XM_170960) is another VGAM1719 host target gene. LOC257451 BINDING SITE is HOST TARGET binding site found in the 3' untranslated region of mRNA encoded by LOC257451, corresponding to a HOST TARGET binding site such as BINDING SITE I, BINDING SITE II or BINDING SITE III. Table 2 illustrates the complementarity of the nucleotide sequences of LOC257451 BINDING SITE, designated SEQ ID:45742, to the nucleotide sequence of VGAM1719 RNA, herein designated VGAM RNA, also designated SEQ ID:4430.

Another function of VGAM1719 is therefore inhibition of LOC257451 (Accession XM_170960). Accordingly, utilities of VGAM1719 include diagnosis, prevention and treatment of diseases and clinical conditions associated with LOC257451. FIG. 1 further provides a conceptual description of a novel bioinformatically detected viral gene of the present invention, referred to here as Viral Genomic Address Messenger 1720 (VGAM1720) viral gene, which modulates expression of respective host target genes thereof, the function and utility of which host target genes is known in the art.

VGAM1720 is a novel bioinformatically detected regulatory, non protein coding, viral micro RNA (miRNA) gene. The method by which VGAM1720 was detected is described hereinabove with reference to FIGS. 1-8.

VGAM1720 gene, herein designated VGAM GENE, is a viral gene contained in the genome of Rat Cytomegalovirus. VGAM1720 host target gene, herein designated VGAM HOST TARGET GENE, is a human gene contained in the human genome.

VGAM1720 gene encodes a VGAM1720 precursor RNA, herein designated VGAM PRECURSOR RNA. Similar to other miRNA genes, and unlike most ordinary genes, VGAM1720 precursor RNA does not encode a protein. A nucleotide sequence identical or highly similar to the nucleotide sequence of VGAM1720 precursor RNA is designated SEQ ID:1706, and is provided hereinbelow with reference to the sequence listing part. Nucleotide sequence SEQ ID:1706 is located at position 111844 relative to the genome of Rat Cytomegalovirus.

VGAM1720 precursor RNA folds onto itself, forming VGAM1720 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1720 folded precursor RNA into VGAM1720 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1720 RNA is designated SEQ ID:4431, and is provided hereinbelow with reference to the sequence listing part.

VGAM1720 host target gene, herein designated VGAM HOST TARGET GENE, encodes a corresponding messenger RNA, VGAM1720 host target RNA, herein designated VGAM HOST TARGET RNA. VGAM1720 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1720 RNA, herein designated VGAM RNA, binds complementarily to one or more host target binding sites located in untranslated regions of VGAM1720 host target RNA, herein designated VGAM HOST TARGET RNA. This complementary binding is due to the fact that the nucleotide sequence of VGAM1720 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1720 RNA, herein designated VGAM RNA, may have a different number of host target binding sites in untranslated regions of a VGAM1720 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1720 RNA, herein designated VGAM RNA, to host target binding sites on VGAM1720 host target RNA, herein designated VGAM HOST TARGET RNA, such as BINDING SITE I, BINDING SITE II and BINDING SITE III, inhibits translation of VGAM1720 host target RNA into VGAM1720 host target protein, herein designated VGAM HOST TARGET PROTEIN. VGAM host target protein is therefore outlined by a broken line.

It is appreciated that VGAM1720 host target gene, herein designated VGAM HOST TARGET GENE, in fact represents a plurality of VGAM1720 host target genes. The mRNA of each one of this plurality of VGAM1720 host target genes comprises one or more host target binding sites, each having a nucleotide sequence which is at least partly complementary to VGAM1720 RNA, herein designated VGAM RNA, and which when bound by VGAM1720 RNA causes inhibition of translation of respective one or more VGAM1720 host target proteins.

It is further appreciated by one skilled in the art that the mode of translational inhibition illustrated by FIG. 1 with specific reference to translational inhibition exerted by VGAM1720 gene, herein designated VGAM GENE, on one or more VGAM1720 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1720 is inhibition of expression of host target genes, as part of a novel viral mechanism of attacking a host. Accordingly, utilities of VGAM1720 include diagnosis, prevention and treatment of viral infection by Rat Cytomegalovirus. Specific functions, and accordingly utilities, of VGAM1720 correlate with, and may be deduced from, the identity of the host target genes which VGAM1720 binds and inhibits, and the function of these host target genes, as elaborated hereinbelow.

Nucleotide sequences of the VGAM1720 precursor RNA, herein designated VGAM PRECURSOR RNA, and of the 'diced' VGAM1720 RNA, herein designated VGAM RNA, and a schematic representation of the secondary folding of VGAM1720 folded precursor RNA, herein designated VGAM FOLDED PRECURSOR RNA, of VGAM1720 are further described hereinbelow with reference to Table 1.

Nucleotide sequences of host target binding sites, such as BINDING SITE-I, BINDING SITE-II and BINDING SITE-III of FIG. 1, found on VGAM1720 host target RNA, and schematic representation of the complementarity of each of these host target binding sites to VGAM1720 RNA, herein designated VGAM RNA, are described hereinbelow with reference to Table 2.

As mentioned hereinabove with reference to FIG. 1, a function of VGAM1720 gene, herein designated VGAM is inhibition of expression of VGAM1720 target genes. It is appreciated that specific functions, and accordingly utilities, of VGAM1720 correlate with, and may be deduced from, the identity of the target genes which VGAM1720 binds and inhibits, and the function of these target genes, as elaborated hereinbelow.

ACK1 (Accession NM_005781) is a VGAM1720 host target gene. ACK1 BINDING SITE is HOST TARGET binding site found in the 5' untranslated region of mRNA encoded by ACK1, corresponding to a HOST TARGET binding site such as BINDING SITE I, BINDING SITE II or BINDING SITE III. Table 2 illustrates the complementarity of the nucleotide sequences of ACK1 BINDING SITE, designated SEQ ID:12360, to the nucleotide sequence of VGAM1720 RNA, herein designated VGAM RNA, also designated SEQ ID:4431.

A function of VGAM1720 is therefore inhibition of ACK1 (Accession NM_005781). Accordingly, utilities of VGAM1720 include diagnosis, prevention and treatment of diseases and clinical conditions associated with ACK1. Ankyrin 1, Erythrocytic (ANK1, Accession XM_016774) is another VGAM1720 host target gene. ANK1 BINDING SITE is HOST TARGET binding site found in the 3' untranslated region of mRNA encoded by ANK1, corresponding to a HOST TARGET binding site such as BINDING SITE I, BINDING SITE II or BINDING SITE III. Table 2 illustrates the complementarity of the nucleotide sequences of ANK1 BINDING SITE, designated SEQ ID:30285, to the nucleotide sequence of VGAM1720 RNA, herein designated VGAM RNA, also designated SEQ ID:4431.

Another function of VGAM1720 is therefore inhibition of Ankyrin 1, Erythrocytic (ANK1, Accession XM_016774). Accordingly, utilities of VGAM1720 include diagnosis, prevention and treatment of diseases and clinical conditions associated with ANK1. Axin 1 (AXIN1, Accession XM_027520) is another VGAM1720 host target gene. AXIN1 BINDING SITE is HOST TARGET binding site found in the 5' untranslated region of mRNA encoded by AXIN1, corresponding to a HOST TARGET binding site such as BINDING SITE I, BINDING SITE II or BINDING SITE III. Table 2 illustrates the complementarity of the nucleotide sequences of AXIN1 BINDING SITE, designated SEQ ID:30515, to the nucleotide sequence of VGAM1720 RNA, herein designated VGAM RNA, also designated SEQ ID:4431.

Another function of VGAM1720 is therefore inhibition of Axin 1 (AXIN1, Accession XM_027520). Accordingly, utilities of VGAM1720 include diagnosis, prevention and treatment of diseases and clinical conditions associated with AXIN1. AXIN1 Up-regulated 1 (AXUD1, Accession NM_033027) is another VGAM1720 host target gene. AXUD1 BINDING SITE is HOST TARGET binding site found in the 5' untranslated region of mRNA encoded by AXUD1, corresponding to a HOST TARGET binding site such as BINDING SITE I, BINDING SITE II or BINDING SITE III. Table 2 illustrates the complementarity of the nucleotide sequences of AXUD1 BINDING SITE, designated SEQ ID:26920, to the nucleotide sequence of VGAM1720 RNA, herein designated VGAM RNA, also designated SEQ ID:4431.

Another function of VGAM1720 is therefore inhibition of AXIN1 Up-regulated 1 (AXUD1, Accession NM_033027). Accordingly, utilities of VGAM1720 include diagnosis, prevention and treatment of diseases and clinical conditions associated with AXUD1. Bone Morphogenetic Protein 4 (BMP4, Accession NM_130850) is another VGAM1720 host target gene. BMP4 BINDING SITE1 and BMP4 BINDING SITE2 are HOST TARGET binding sites found in untranslated regions of mRNA encoded by BMP4, corresponding to HOST TARGET binding sites such as BINDING SITE I, BINDING SITE II or BINDING SITE III. Table 2 illustrates the complementarity of the nucleotide sequences of BMP4 BINDING SITE1 and BMP4 BINDING SITE2, designated SEQ ID:28387 and SEQ ID:6866 respectively, to the nucleotide sequence of VGAM1720 RNA, herein designated VGAM RNA, also designated SEQ ID:4431.

Another function of VGAM1720 is therefore inhibition of Bone Morphogenetic Protein 4 (BMP4, Accession NM_130850), a gene which acts in mesoderm induction, tooth development, limb formation and fracture repair. Accordingly, utilities of VGAM1720 include diagnosis, prevention and treatment of diseases and clinical conditions associated with BMP4. The function of BMP4 and its association with various diseases and clinical conditions, has been established by previous studies, as described hereinabove with reference to VGAM910. Dual-specificity tyrosine-(Y)-phosphorylation Regulated Kinase 2 (DYRK2, Accession NM_006482) is another VGAM1720 host target gene. DYRK2 BINDING SITE1 and DYRK2 BINDING SITE2 are HOST TARGET binding sites found in untranslated regions of mRNA encoded by DYRK2, corresponding to HOST TARGET binding sites such as BINDING SITE I, BINDING SITE II or BINDING SITE III. Table 2 illustrates the complementarity of the nucleotide sequences of DYRK2 BINDING SITE1 and DYRK2 BINDING SITE2, designated SEQ ID:13209 and SEQ ID:9633 respectively, to the nucleotide sequence of VGAM1720 RNA, herein designated VGAM RNA, also designated SEQ ID:4431.

Another function of VGAM1720 is therefore inhibition of Dual-specificity tyrosine-(Y)-phosphorylation Regulated Kinase 2 (DYRK2, Accession NM_006482). Accordingly, utilities of VGAM1720 include diagnosis, prevention and treatment of diseases and clinical conditions associated with DYRK2. E1A Binding Protein P300 (EP300, Accession NM_001429) is another VGAM1720 host target gene. EP300 BINDING SITE is HOST TARGET binding site found in the 5' untranslated region of mRNA encoded by EP300, corresponding to a HOST TARGET binding site such as BINDING SITE I, BINDING SITE II or BINDING SITE III. Table 2 illustrates the complementarity of the nucleotide sequences of EP300 BINDING SITE, designated SEQ ID:7152, to the nucleotide sequence of VGAM1720 RNA, herein designated VGAM RNA, also designated SEQ ID:4431.

Another function of VGAM1720 is therefore inhibition of E1A Binding Protein P300 (EP300, Accession NM_001429), a gene which may have a function in cell cycle regulation. Accordingly, utilities of VGAM1720 include diagnosis, prevention and treatment of diseases and clinical conditions associated with EP300. The function of EP300 and its association with various diseases and clinical conditions, has been established by previous studies, as described hereinabove with reference to VGAM191. Frizzled Homolog 1 (Drosophila) (FZD1, Accession NM_003505) is another VGAM1720 host target gene. FZD1 BINDING SITE is HOST TARGET binding site found in the 5' untranslated region of mRNA encoded by FZD1, corresponding to a HOST TARGET binding site such as BINDING SITE I, BINDING SITE II or BINDING SITE III. Table 2 illustrates the complementarity of the nucleotide sequences of FZD1 BINDING SITE, designated SEQ ID:9593, to the nucleotide sequence of VGAM1720 RNA, herein designated VGAM RNA, also designated SEQ ID:4431.

Another function of VGAM1720 is therefore inhibition of Frizzled Homolog 1 (Drosophila) (FZD1, Accession NM_003505), a gene which may be involved in bone resorption; strongly similar to rat Fzd. Accordingly, utilities of VGAM1720 include diagnosis, prevention and treatment of diseases and clinical conditions associated with FZD1. The function of FZD1 and its association with various diseases and clinical conditions, has been established by previous studies, as described hereinabove with reference to VGAM432. UDP-N-acetyl-alpha-D-galactosamine:(N-acetylneuraminyl)-galactosylglucosylceramide N-acetylgalactosaminyltransferase (GalNAc-T) (GALGT, Accession NM_001478) is another VGAM1720 host target gene. GALGT BINDING SITE is HOST TARGET binding site found in the 5' untranslated region of mRNA encoded by GALGT, corresponding to a HOST TARGET binding site such as BINDING SITE I, BINDING SITE II or BINDING SITE III. Table 2 illustrates the complementarity of the nucleotide sequences of GALGT BINDING SITE, designated SEQ ID:7212, to the nucleotide sequence of VGAM1720 RNA, herein designated VGAM RNA, also designated SEQ ID:4431.

Another function of VGAM1720 is therefore inhibition of UDP-N-acetyl-alpha-D-galactosamine:(N-acetylneuraminyl)-galactosylglucosylceramide N-acetylgalactosaminyltransferase (GalNAc-T) (GALGT, Accession NM_001478), a gene which is involved in the biosynthesis of gangliosides gm2, gd2 and ga2. Accordingly, utilities of VGAM1720 include diagnosis, prevention and treatment of diseases and clinical conditions associated with GALGT. The function of GALGT and its association with various diseases and clinical conditions, has been established by previous studies, as described hereinabove with reference to VGAM179. Potassium Voltage-gated Channel, Shaker-related Subfamily, Member 6 (KCNA6, Accession NM_002235) is another VGAM1720 host target gene. KCNA6 BINDING SITE is HOST TARGET binding site found in the 5' untranslated region of mRNA encoded by KCNA6, corresponding to a HOST TARGET binding site such as BINDING SITE I, BINDING SITE II or BINDING SITE III. Table 2 illustrates the complementarity of the nucleotide sequences of KCNA6 BINDING SITE, designated SEQ ID:8017, to the nucleotide sequence of VGAM1720 RNA, herein designated VGAM RNA, also designated SEQ ID:4431.

Another function of VGAM1720 is therefore inhibition of Potassium Voltage-gated Channel, Shaker-related Subfamily, Member 6 (KCNA6, Accession NM_002235), a gene which mediates the voltage-dependent potassium ion permeability of excitable membranes. Accordingly, utilities of VGAM1720 include diagnosis, prevention and treatment of diseases and clinical conditions associated with KCNA6. The function of KCNA6 and its association with various diseases and clinical conditions, has been established by previous studies, as described hereinabove with reference to VGAM893. Mannosidase, Alpha, Class 2A, Member 1 (MAN2A1, Accession NM_002372) is another VGAM1720 host target gene. MAN2A1 BINDING SITE is HOST TARGET binding site found in the 5' untranslated region of mRNA encoded by MAN2A1, corresponding to a HOST TARGET binding site such as BINDING SITE I, BINDING SITE II or BINDING SITE III. Table 2 illustrates the complementarity of the nucleotide sequences of MAN2A1 BINDING SITE, designated SEQ ID:8179, to the nucleotide sequence of VGAM1720 RNA, herein designated VGAM RNA, also designated SEQ ID:4431.

Another function of VGAM1720 is therefore inhibition of Mannosidase, Alpha, Class 2A, Member 1 (MAN2A1, Accession NM_002372), a gene which catalyzes the final hydrolytic step in the asparagine-linked oligosaccharide (N-glycan) maturation pathway. Accordingly, utilities of VGAM1720 include diagnosis, prevention and treatment of diseases and clinical conditions associated with MAN2A1. The function of MAN2A1 and its association with various diseases and clinical conditions, has been established by previous studies, as described hereinabove with reference to VGAM1410. Protein Kinase, AMP-activated, Beta 1 Non-catalytic Subunit (PRKAB1, Accession NM_006253) is another VGAM1720 host target gene. PRKAB1 BINDING SITE is HOST TARGET binding site found in the 5' untranslated region of mRNA encoded by PRKAB1, corresponding to a HOST TARGET binding site such as BINDING SITE I, BINDING SITE II or BINDING SITE III. Table 2 illustrates the complementarity of the nucleotide sequences of PRKAB1 BINDING SITE, designated SEQ ID:12930, to the nucleotide sequence of VGAM1720 RNA, herein designated VGAM RNA, also designated SEQ ID:4431.

Another function of VGAM1720 is therefore inhibition of Protein Kinase, AMP-activated, Beta 1 Non-catalytic Subunit (PRKAB1, Accession NM_006253), a gene which is responsible for the regulation of fatty acid synthesis by phosphorylation of acetyl-coa carboxylase. Accordingly, utilities of VGAM1720 include diagnosis, prevention and treatment of diseases and clinical conditions associated with PRKAB1. The function of PRKAB1 and its association with various diseases and clinical conditions, has been established by previous studies, as described hereinabove with reference to VGAM1384. SORCS2 (Accession NM_020777) is another VGAM1720 host target gene. SORCS2 BINDING SITE is HOST TARGET binding site found in the 5' untranslated region of mRNA encoded by SORCS2, corresponding to a HOST TARGET binding site such as BINDING SITE I, BINDING SITE II or BINDING SITE III. Table 2 illustrates the complementarity of the nucleotide sequences of SORCS2 BINDING SITE, designated SEQ ID:21878, to the nucleotide sequence of VGAM1720 RNA, herein designated VGAM RNA, also designated SEQ ID:4431.

Another function of VGAM1720 is therefore inhibition of SORCS2 (Accession NM_020777). Accordingly, utilities of VGAM1720 include diagnosis, prevention and treatment of diseases and clinical conditions associated with SORCS2. Zinc Finger Protein 26 (KOX 20) (ZNF26, Accession XM_053907) is another VGAM1720 host target gene. ZNF26 BINDING SITE is HOST TARGET binding site found in the 5' untranslated region of mRNA encoded by ZNF26, corresponding to a HOST TARGET binding site such as BINDING SITE I, BINDING SITE II or BINDING SITE III. Table 2 illustrates the complementarity of the nucleotide sequences of ZNF26 BINDING SITE, designated SEQ ID:36130, to the nucleotide sequence of VGAM1720 RNA, herein designated VGAM RNA, also designated SEQ ID:4431.

Another function of VGAM1720 is therefore inhibition of Zinc Finger Protein 26 (KOX 20) (ZNF26, Accession XM_053907), a gene which may be involved in transcriptional regulation. Accordingly, utilities of VGAM1720 include diagnosis, prevention and treatment of diseases and clinical conditions associated with ZNF26. The function of ZNF26 and its association with various diseases and clinical conditions, has been established by previous studies, as described hereinabove with reference to VGAM1533. Chromosome 21 Open Reading Frame 93 (C21orf93, Accession NM_145179) is another VGAM1720 host target gene. C21orf93 BINDING SITE is HOST TARGET binding site found in the 5' untranslated region of mRNA encoded by C21orf93, corresponding to a HOST TARGET binding site such as BINDING SITE I, BINDING SITE II or BINDING SITE III. Table 2 illustrates the complementarity of the nucleotide sequences of C21orf93 BINDING SITE, designated SEQ ID:29742, to the nucleotide sequence of VGAM1720 RNA, herein designated VGAM RNA, also designated SEQ ID:4431.

Another function of VGAM1720 is therefore inhibition of Chromosome 21 Open Reading Frame 93 (C21orf93, Accession NM_145179). Accordingly, utilities of VGAM1720 include diagnosis, prevention and treatment of diseases and clinical conditions associated with C21orf93. Caspase Recruitment Domain Family, Member 9 (CARD9, Accession NM_022352) is another VGAM1720 host target gene. CARD9 BINDING SITE is HOST TARGET binding site found in the 3' untranslated region of mRNA encoded by CARD9, corresponding to a HOST TARGET binding site such as BINDING SITE I, BINDING SITE II or BINDING SITE III. Table 2 illustrates the complementarity of the nucleotide sequences of CARD9 BINDING SITE, designated SEQ ID:22748, to the nucleotide sequence of VGAM1720 RNA, herein designated VGAM RNA, also designated SEQ ID:4431.

Another function of VGAM1720 is therefore inhibition of Caspase Recruitment Domain Family, Member 9 (CARD9, Accession NM_022352). Accordingly, utilities of VGAM1720 include diagnosis, prevention and treatment of diseases and clinical conditions associated with CARD9. CASKIN1 (Accession NM_020764) is another VGAM1720 host target gene. CASKIN1 BINDING SITE is HOST TARGET binding site found in the 3' untranslated region of mRNA encoded by CASKIN1, corresponding to a HOST TARGET binding site such as BINDING SITE I, BINDING SITE II or BINDING SITE III. Table 2 illustrates the complementarity of the nucleotide sequences of CASKIN1 BINDING SITE, designated SEQ ID:21864, to the nucleotide sequence of VGAM1720 RNA, herein designated VGAM RNA, also designated SEQ ID:4431.

Another function of VGAM1720 is therefore inhibition of CASKIN1 (Accession NM_020764). Accordingly, utilities of VGAM1720 include diagnosis, prevention and treatment of diseases and clinical conditions associated with CASKIN1. DED (Accession NM_012138) is another VGAM1720 host target gene. DED BINDING SITE is HOST TARGET binding site found in the 5' untranslated region of mRNA encoded by DED, corresponding to a HOST TARGET binding site such as BINDING SITE I, BINDING SITE II or BINDING SITE III. Table 2 illustrates the complementarity of the nucleotide sequences of DED BINDING SITE, designated SEQ ID:14448, to the nucleotide sequence of VGAM1720 RNA, herein designated VGAM RNA, also designated SEQ ID:4431.

Another function of VGAM1720 is therefore inhibition of DED (Accession NM_012138). Accordingly, utilities of VGAM1720 include diagnosis, prevention and treatment of diseases and clinical conditions associated with DED. FLJ00001 (Accession XM_088525) is another VGAM1720 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39777, to the nucleotide sequence of VGAM1720 RNA, herein designated VGAM RNA, also designated SEQ ID:4431.

Another function of VGAM1720 is therefore inhibition of FLJ00001 (Accession XM_088525). Accordingly, utilities of VGAM1720 include diagnosis, prevention and treatment of diseases and clinical conditions associated with FLJ00001. FLJ12355 (Accession NM_024988) is another VGAM1720 host target gene. FLJ12355 BINDING SITE is HOST TARGET binding site found in the 5' untranslated region of mRNA encoded by FLJ12355, corresponding to a HOST TARGET binding site such as BINDING SITE I, BINDING SITE II or BINDING SITE III. Table 2 illustrates the complementarity of the nucleotide sequences of FLJ12355 BINDING SITE, designated SEQ ID:24543, to the nucleotide sequence of VGAM1720 RNA, herein designated VGAM RNA, also designated SEQ ID:4431.

Another function of VGAM1720 is therefore inhibition of FLJ12355 (Accession NM_024988). Accordingly, utilities of VGAM1720 include diagnosis, prevention and treatment of diseases and clinical conditions associated with FLJ12355. FLJ12895 (Accession NM_023926) is another VGAM1720 host target gene. FLJ12895 BINDING SITE is HOST TARGET binding site found in the 5' untranslated region of mRNA encoded by FLJ12895, corresponding to a HOST TARGET binding site such as BINDING SITE I, BINDING SITE II or BINDING SITE III. Table 2 illustrates the complementarity of the nucleotide sequences of FLJ12895 BINDING SITE, designated SEQ ID:23405, to the nucleotide sequence of VGAM1720 RNA, herein designated VGAM RNA, also designated SEQ ID:4431.

Another function of VGAM1720 is therefore inhibition of FLJ12895 (Accession NM_023926). Accordingly, utilities of VGAM1720 include diagnosis, prevention and treatment of diseases and clinical conditions associated with FLJ12895. FLJ13072 (Accession XM_117117) is another VGAM1720 host target gene. FLJ13072 BINDING SITE is HOST TARGET binding site found in the 5' untranslated region of mRNA encoded by FLJ13072, corresponding to a HOST TARGET binding site such as BINDING SITE I, BINDING SITE II or BINDING SITE III. Table 2 illustrates the complementarity of the nucleotide sequences of FLJ13072 BINDING SITE, designated SEQ ID:43234, to the nucleotide sequence of VGAM1720 RNA, herein designated VGAM RNA, also designated SEQ ID:4431.

Another function of VGAM1720 is therefore inhibition of FLJ13072 (Accession XM_117117). Accordingly, utilities of VGAM1720 include diagnosis, prevention and treatment of diseases and clinical conditions associated with FLJ13072. FLJ20374 (Accession NM_017793) is another VGAM1720 host target gene. FLJ20374 BINDING SITE is HOST TARGET binding site found in the 5' untranslated region of mRNA encoded by FLJ20374, corresponding to a HOST TARGET binding site such as BINDING SITE I, BINDING SITE II or BINDING SITE III. Table 2 illustrates the complementarity of the nucleotide sequences of FLJ20374 BINDING SITE, designated SEQ ID:19430, to the nucleotide sequence of VGAM1720 RNA, herein designated VGAM RNA, also designated SEQ ID:4431.

Another function of VGAM1720 is therefore inhibition of FLJ20374 (Accession NM_017793). Accordingly, utilities of VGAM1720 include diagnosis, prevention and treatment of diseases and clinical conditions associated with FLJ20374. FLJ20730 (Accession NM_017945) is another VGAM1720 host target gene. FLJ20730 BINDING SITE is HOST TARGET binding site found in the 3' untranslated region of mRNA encoded by FLJ20730, corresponding to a HOST TARGET binding site such as BINDING SITE I, BINDING SITE II or BINDING SITE III. Table 2 illustrates the complementarity of the nucleotide sequences of FLJ20730 BINDING SITE, designated SEQ ID:19640, to the nucleotide sequence of VGAM1720 RNA, herein designated VGAM RNA, also designated SEQ ID:4431.

Another function of VGAM1720 is therefore inhibition of FLJ20730 (Accession NM_017945). Accordingly, utilities of VGAM1720 include diagnosis, prevention and treatment of diseases and clinical conditions associated with FLJ20730. FLJ21596 (Accession NM_024823) is another VGAM1720 host target gene. FLJ21596 BINDING SITE is HOST TARGET binding site found in the 3' untranslated region of mRNA encoded by FLJ21596, corresponding to a HOST TARGET binding site such as BINDING SITE I, BINDING SITE II or BINDING SITE III. Table 2 illustrates the complementarity of the nucleotide sequences of FLJ21596 BINDING SITE, designated SEQ ID:24213, to the nucleotide sequence of VGAM1720 RNA, herein designated VGAM RNA, also designated SEQ ID:4431.

Another function of VGAM1720 is therefore inhibition of FLJ21596 (Accession NM_024823). Accordingly, utilities of VGAM1720 include diagnosis, prevention and treatment of diseases and clinical conditions associated with FLJ21596. HRIHFB2122 (Accession NM_007032) is another VGAM1720 host target gene. HRIHFB2122 BINDING SITE1 and HRIHFB2122 BINDING SITE2 are HOST TARGET binding sites found in untranslated regions of mRNA encoded by HRIHFB2122, corresponding to HOST TARGET binding sites such as BINDING SITE I, BINDING SITE II or BINDING SITE III. Table 2 illustrates the complementarity of the nucleotide sequences of HRIHFB2122 BINDING SITE1 and HRIHFB2122 BINDING SITE2, designated SEQ ID:13901 and SEQ ID:28904 respectively, to the nucleotide sequence of VGAM1720 RNA, herein designated VGAM RNA, also designated SEQ ID:4431.

Another function of VGAM1720 is therefore inhibition of HRIHFB2122 (Accession NM_007032). Accordingly, utilities of VGAM1720 include diagnosis, prevention and treatment of diseases and clinical conditions associated with HRIHFB2122. KIAA0844 (Accession NM_014951) is another VGAM1720 host target gene. KIAA0844 BINDING SITE is HOST TARGET binding site found in the 5' untranslated region of mRNA encoded by KIAA0844, corresponding to a HOST TARGET binding site such as BINDING SITE I, BINDING SITE II or BINDING SITE III. Table 2 illustrates the complementarity of the nucleotide sequences of KIAA0844 BINDING SITE, designated SEQ ID:17283, to the nucleotide sequence of VGAM1720 RNA, herein designated VGAM RNA, also designated SEQ ID:4431.

Another function of VGAM1720 is therefore inhibition of KIAA0844 (Accession NM_014951). Accordingly, utilities of VGAM1720 include diagnosis, prevention and treatment of diseases and clinical conditions associated with KIAA0844. KIAA1319 (Accession NM_020770) is another VGAM1720 host target gene. KIAA1319 BINDING SITE is HOST TARGET binding site found in the 5' untranslated region of mRNA encoded by KIAA1319, corresponding to a HOST TARGET binding site such as BINDING SITE I, BINDING SITE II or BINDING SITE III. Table 2 illustrates the complementarity of the nucleotide sequences of KIAA1319 BINDING SITE, designated SEQ ID:21867, to the nucleotide sequence of VGAM1720 RNA, herein designated VGAM RNA, also designated SEQ ID:4431.

Another function of VGAM1720 is therefore inhibition of KIAA1319 (Accession NM_020770). Accordingly, utilities of VGAM1720 include diagnosis, prevention and treatment of diseases and clinical conditions associated with KIAA1319. MGC15437 (Accession NM_032873) is another VGAM1720 host target gene. MGC15437 BINDING SITE is HOST TARGET binding site found in the 5' untranslated region of mRNA encoded by MGC15437, corresponding to a HOST TARGET binding site such as BINDING SITE I, BINDING SITE II or BINDING SITE III. Table 2 illustrates the complementarity of the nucleotide sequences of MGC15437 BINDING SITE, designated SEQ ID:26689, to the nucleotide sequence of VGAM1720 RNA, herein designated VGAM RNA, also designated SEQ ID:4431.

Another function of VGAM1720 is therefore inhibition of MGC15437 (Accession NM_032873). Accordingly, utilities of VGAM1720 include diagnosis, prevention and treatment of diseases and clinical conditions associated with MGC15437. MGC2705 (Accession NM_032701) is another VGAM1720 host target gene. MGC2705 BINDING SITE is HOST TARGET binding site found in the 5' untranslated region of mRNA encoded by MGC2705, corresponding to a HOST TARGET binding site such as BINDING SITE I, BINDING SITE II or BINDING SITE III. Table 2 illustrates the complementarity of the nucleotide sequences of MGC2705 BINDING SITE, designated SEQ ID:26417, to the nucleotide sequence of VGAM1720 RNA, herein designated VGAM RNA, also designated SEQ ID:4431.

Another function of VGAM1720 is therefore inhibition of MGC2705 (Accession NM_032701). Accordingly, utilities of VGAM1720 include diagnosis, prevention and treatment of diseases and clinical conditions associated with MGC2705. MOT8 (Accession NM_018836) is another VGAM1720 host target gene. MOT8 BINDING SITE is HOST TARGET binding site found in the 5' untranslated region of mRNA encoded by MOT8, corresponding to a HOST TARGET binding site such as BINDING SITE I, BINDING SITE II or BINDING SITE III. Table 2 illustrates the complementarity of the nucleotide sequences of MOT8 BINDING SITE, designated SEQ ID:20824, to the nucleotide sequence of VGAM1720 RNA, herein designated VGAM RNA, also designated SEQ ID:4431.

Another function of VGAM1720 is therefore inhibition of MOT8 (Accession NM_018836). Accordingly, utilities of VGAM1720 include diagnosis, prevention and treatment of diseases and clinical conditions associated with MOT8. Ras and Rab Interactor 3 (RIN3, Accession NM_024832) is another VGAM1720 host target gene. RIN3 BINDING SITE is HOST TARGET binding site found in the 5' untranslated region of mRNA encoded by RIN3, corresponding to a HOST TARGET binding site such as BINDING SITE I, BINDING SITE II or BINDING SITE III. Table 2 illustrates the complementarity of the nucleotide sequences of RIN3 BINDING SITE, designated SEQ ID:24231, to the nucleotide sequence of VGAM1720 RNA, herein designated VGAM RNA, also designated SEQ ID:4431.

Another function of VGAM1720 is therefore inhibition of Ras and Rab Interactor 3 (RIN3, Accession NM_024832). Accordingly, utilities of VGAM1720 include diagnosis, prevention and treatment of diseases and clinical conditions associated with RIN3. RP4-622L5 (Accession NM_019118) is another VGAM1720 host target gene. RP4-622L5 BINDING SITE is HOST TARGET binding site found in the 3' untranslated region of mRNA encoded by RP4-622L5, corresponding to a HOST TARGET binding site such as BINDING SITE I, BINDING SITE II or BINDING SITE III. Table 2 illustrates the complementarity of the nucleotide sequences of RP4-622L5 BINDING SITE, designated SEQ ID:21202, to the nucleotide sequence of VGAM1720 RNA, herein designated VGAM RNA, also designated SEQ ID:4431.

Another function of VGAM1720 is therefore inhibition of RP4-622L5 (Accession NM_019118). Accordingly, utilities of VGAM1720 include diagnosis, prevention and treatment of diseases and clinical conditions associated with RP4-622L5. Sema Domain, Immunoglobulin Domain (Ig), and GPI Membrane Anchor, (semaphorin) 7A (SEMA7A, Accession NM_003612) is another VGAM1720 host target gene. SEMA7A BINDING SITE is HOST TARGET binding site found in the 3' untranslated region of mRNA encoded by SEMA7A, corresponding to a HOST TARGET binding site such as BINDING SITE I, BINDING SITE II or BINDING SITE III. Table 2 illustrates the complementarity of the nucleotide sequences of SEMA7A BINDING SITE, designated SEQ ID:9664, to the nucleotide sequence of VGAM1720 RNA, herein designated VGAM RNA, also designated SEQ ID:4431.

Another function of VGAM1720 is therefore inhibition of Sema Domain, Immunoglobulin Domain (Ig), and GPI Membrane Anchor, (semaphorin) 7A (SEMA7A, Accession NM_003612). Accordingly, utilities of VGAM1720 include diagnosis, prevention and treatment of diseases and clinical conditions associated with SEMA7A. Syntaxin 11 (STX11, Accession NM_003764) is another VGAM1720 host target gene. STX11 BINDING SITE is HOST TARGET binding site found in the 5' untranslated region of mRNA encoded by STX11, corresponding to a HOST TARGET binding site such as BINDING SITE I, BINDING SITE II or BINDING SITE III. Table 2 illustrates the complementarity of the nucleotide sequences of STX11 BINDING SITE, designated SEQ ID:9842, to the nucleotide sequence of VGAM1720 RNA, herein designated VGAM RNA, also designated SEQ ID:4431.

Another function of VGAM1720 is therefore inhibition of Syntaxin 11 (STX11, Accession NM_003764). Accordingly, utilities of VGAM1720 include diagnosis, prevention and treatment of diseases and clinical conditions associated with STX11. T2BP (Accession XM_046111) is another VGAM1720 host target gene. T2BP BINDING SITE is HOST TARGET binding site found in the 5' untranslated region of mRNA encoded by T2BP, corresponding to a HOST TARGET binding site such as BINDING SITE I, BINDING SITE II or BINDING SITE III. Table 2 illustrates the complementarity of the nucleotide sequences of T2BP BINDING SITE, designated SEQ ID:34681, to the nucleotide sequence of VGAM1720 RNA, herein designated VGAM RNA, also designated SEQ ID:4431.

Another function of VGAM1720 is therefore inhibition of T2BP (Accession XM_046111). Accordingly, utilities of VGAM1720 include diagnosis, prevention and treatment of diseases and clinical conditions associated with T2BP. Three Prime Repair Exonuclease 2 (TREX2, Accession NM_080699) is another VGAM1720 host target gene. TREX2 BINDING SITE1 and TREX2 BINDING SITE2 are HOST TARGET binding sites found in untranslated regions of mRNA encoded by TREX2, corresponding to HOST TARGET binding sites such as BINDING SITE I, BINDING SITE II or BINDING SITE III. Table 2 illustrates the complementarity of the nucleotide sequences of TREX2 BINDING SITE1 and TREX2 BINDING SITE2, designated SEQ ID:27988 and SEQ ID:14069 respectively, to the nucleotide sequence of VGAM1720 RNA, herein designated VGAM RNA, also designated SEQ ID:4431.

Another function of VGAM1720 is therefore inhibition of Three Prime Repair Exonuclease 2 (TREX2, Accession NM_080699). Accordingly, utilities of VGAM1720 include diagnosis, prevention and treatment of diseases and clinical conditions associated with TREX2. LOC143666 (Accession XM_096465) is another VGAM1720 host target gene. LOC143666 BINDING SITE is HOST TARGET binding site found in the 3' untranslated region of mRNA encoded by LOC143666, corresponding to a HOST TARGET binding site such as BINDING SITE I, BINDING SITE II or BINDING SITE III. Table 2 illustrates the complementarity of the nucleotide sequences of LOC143666 BINDING SITE, designated SEQ ID:40370, to the nucleotide sequence of VGAM1720 RNA, herein designated VGAM RNA, also designated SEQ ID:4431.

Another function of VGAM1720 is therefore inhibition of LOC143666 (Accession XM_096465). Accordingly, utilities of VGAM1720 include diagnosis, prevention and treatment of diseases and clinical conditions associated with LOC143666. LOC146138 (Accession XM_096938) is another VGAM1720 host target gene. LOC146138 BINDING SITE is HOST TARGET binding site found in the 3' untranslated region of mRNA encoded by LOC146138, corresponding to a HOST TARGET binding site such as BINDING SITE I, BINDING SITE II or BINDING SITE III. Table 2 illustrates the complementarity of the nucleotide sequences of LOC146138 BINDING SITE, designated SEQ ID:40656, to the nucleotide sequence of VGAM1720 RNA, herein designated VGAM RNA, also designated SEQ ID:4431.

Another function of VGAM1720 is therefore inhibition of LOC146138 (Accession XM_096938). Accordingly, utilities of VGAM1720 include diagnosis, prevention and treatment of diseases and clinical conditions associated with LOC146138. LOC148132 (Accession XM_097408) is another VGAM1720 host target gene. LOC148132 BINDING SITE is HOST TARGET binding site found in the 5' untranslated region of mRNA encoded by LOC148132, corresponding to a HOST TARGET binding site such as BINDING SITE I, BINDING SITE II or BINDING SITE III. Table 2 illustrates the complementarity of the nucleotide sequences of LOC148132 BINDING SITE, designated SEQ ID:40869, to the nucleotide sequence of VGAM1720 RNA, herein designated VGAM RNA, also designated SEQ ID:4431.

Another function of VGAM1720 is therefore inhibition of LOC148132 (Accession XM_097408). Accordingly, utilities of VGAM1720 include diagnosis, prevention and treatment of diseases and clinical conditions associated with LOC148132. LOC148229 (Accession XM_086103) is another VGAM1720 host target gene. LOC148229 BINDING SITE is HOST TARGET binding site found in the 5' untranslated region of mRNA encoded by LOC148229, corresponding to a HOST TARGET binding site such as BINDING SITE I, BINDING SITE II or BINDING SITE III. Table 2 illustrates the complementarity of the nucleotide sequences of LOC148229 BINDING SITE, designated SEQ ID:38496, to the nucleotide sequence of VGAM1720 RNA, herein designated VGAM RNA, also designated SEQ ID:4431.

Another function of VGAM1720 is therefore inhibition of LOC148229 (Accession XM_086103). Accordingly, utilities of VGAM1720 include diagnosis, prevention and treatment of diseases and clinical conditions associated with LOC148229. LOC150935 (Accession XM_087049) is another VGAM1720 host target gene. LOC150935 BINDING SITE is HOST TARGET binding site found in the 3' untranslated region of mRNA encoded by LOC150935, corresponding to a HOST TARGET binding site such as BINDING SITE I, BINDING SITE II or BINDING SITE III. Table 2 illustrates the complementarity of the nucleotide sequences of LOC150935 BINDING SITE, designated SEQ ID:39019, to the nucleotide sequence of VGAM1720 RNA, herein designated VGAM RNA, also designated SEQ ID:4431.

Another function of VGAM1720 is therefore inhibition of LOC150935 (Accession XM_087049). Accordingly, utilities of VGAM1720 include diagnosis, prevention and treatment of diseases and clinical conditions associated with LOC150935. LOC151174 (Accession XM_098013) is another VGAM1720 host target gene. LOC151174 BINDING SITE is HOST TARGET binding site found in the 5' untranslated region of mRNA encoded by LOC151174, corresponding to a HOST TARGET binding site such as BINDING SITE I, BINDING SITE II or BINDING SITE III. Table 2 illustrates the complementarity of the nucleotide sequences of LOC151174 BINDING SITE, designated SEQ ID:41311, to the nucleotide sequence of VGAM1720 RNA, herein designated VGAM RNA, also designated SEQ ID:4431.

Another function of VGAM1720 is therefore inhibition of LOC151174 (Accession XM_098013). Accordingly, utilities of VGAM1720 include diagnosis, prevention and treatment of diseases and clinical conditions associated with LOC151174. LOC154101 (Accession XM_094692) is another VGAM1720 host target gene. LOC154101 BINDING SITE is HOST TARGET binding site found in the 5' untranslated region of mRNA encoded by LOC154101, corresponding to a HOST TARGET binding site such as BINDING SITE I, BINDING SITE II or BINDING SITE III. Table 2 illustrates the complementarity of the nucleotide sequences of LOC154101 BINDING SITE, designated SEQ ID:40237, to the nucleotide sequence of VGAM1720 RNA, herein designated VGAM RNA, also designated SEQ ID:4431.

Another function of VGAM1720 is therefore inhibition of LOC154101 (Accession XM_094692). Accordingly, utilities of VGAM1720 include diagnosis, prevention and treatment of diseases and clinical conditions associated with LOC154101. LOC202559 (Accession XM_114504) is another VGAM1720 host target gene. LOC202559 BINDING SITE is HOST TARGET binding site found in the 5' untranslated region of mRNA encoded by LOC202559, corresponding to a HOST TARGET binding site such as BINDING SITE I, BINDING SITE II or BINDING SITE III. Table 2 illustrates the complementarity of the nucleotide sequences of LOC202559 BINDING SITE, designated SEQ ID:42986, to the nucleotide sequence of VGAM1720 RNA, herein designated VGAM RNA, also designated SEQ ID:4431.

Another function of VGAM1720 is therefore inhibition of LOC202559 (Accession XM_114504). Accordingly, utilities of VGAM1720 include diagnosis, prevention and treatment of diseases and clinical conditions associated with LOC202559. LOC221876 (Accession XM_168220) is another VGAM1720 host target gene. LOC221876 BINDING SITE is HOST TARGET binding site found in the 5' untranslated region of mRNA encoded by LOC221876, corresponding to a HOST TARGET binding site such as BINDING SITE I, BINDING SITE II or BINDING SITE III. Table 2 illustrates the complementarity of the nucleotide sequences of LOC221876 BINDING SITE, designated SEQ ID:45077, to the nucleotide sequence of VGAM1720 RNA, herein designated VGAM RNA, also designated SEQ ID:4431.

Another function of VGAM1720 is therefore inhibition of LOC221876 (Accession XM_168220). Accordingly, utilities of VGAM1720 include diagnosis, prevention and treatment of diseases and clinical conditions associated with LOC221876. LOC253258 (Accession XM_172870) is another VGAM1720 host target gene. LOC253258 BINDING SITE is HOST TARGET binding site found in the 3' untranslated region of mRNA encoded by LOC253258, corresponding to a HOST TARGET binding site such as BINDING SITE I, BINDING SITE II or BINDING SITE III. Table 2 illustrates the complementarity of the nucleotide sequences of LOC253258 BINDING SITE, designated SEQ ID:46148, to the nucleotide sequence of VGAM1720 RNA, herein designated VGAM RNA, also designated SEQ ID:4431.

Another function of VGAM1720 is therefore inhibition of LOC253258 (Accession XM_172870). Accordingly, utilities of VGAM1720 include diagnosis, prevention and treatment of diseases and clinical conditions associated with LOC253258. LOC255146 (Accession XM_170985) is another VGAM1720 host target gene. LOC255146 BINDING SITE is HOST TARGET binding site found in the 3' untranslated region of mRNA encoded by LOC255146, corresponding to a HOST TARGET binding site such as BINDING SITE I, BINDING SITE II or BINDING SITE III. Table 2 illustrates the complementarity of the nucleotide sequences of LOC255146 BINDING SITE, designated SEQ ID:45756, to the nucleotide sequence of VGAM1720 RNA, herein designated VGAM RNA, also designated SEQ ID:4431.

Another function of VGAM1720 is therefore inhibition of LOC255146 (Accession XM_170985). Accordingly, utilities of VGAM1720 include diagnosis, prevention and treatment of diseases and clinical conditions associated with LOC255146. LOC257478 (Accession XM_054745) is another VGAM1720 host target gene. LOC257478 BINDING SITE is HOST TARGET binding site found in the 5' untranslated region of mRNA encoded by LOC257478, corresponding to a HOST TARGET binding site such as BINDING SITE I, BINDING SITE II or BINDING SITE III. Table 2 illustrates the complementarity of the nucleotide sequences of LOC257478 BINDING SITE, designated SEQ ID:36183, to the nucleotide sequence of VGAM1720 RNA, herein designated VGAM RNA, also designated SEQ ID:4431.

Another function of VGAM1720 is therefore inhibition of LOC257478 (Accession XM_054745). Accordingly, utilities of VGAM1720 include diagnosis, prevention and treatment of diseases and clinical conditions associated with LOC257478. FIG. 1 further provides a conceptual description of a novel bioinformatically detected viral gene of the present invention, referred to here as Viral Genomic Address Messenger 1721 (VGAM1721) viral gene, which modulates expression of respective host target genes thereof, the function and utility of which host target genes is known in the art.

VGAM1721 is a novel bioinformatically detected regulatory, non protein coding, viral micro RNA (miRNA) gene. The method by which VGAM1721 was detected is described hereinabove with reference to FIGS. 1-8.

VGAM1721 gene, herein designated VGAM GENE, is a viral gene contained in the genome of Myxoma Virus. VGAM1721 host target gene, herein designated VGAM HOST TARGET GENE, is a human gene contained in the human genome.

VGAM1721 gene encodes a VGAM1721 precursor RNA, herein designated VGAM PRECURSOR RNA. Similar to other miRNA genes, and unlike most ordinary genes, VGAM1721 precursor RNA does not encode a protein. A nucleotide sequence identical or highly similar to the nucleotide sequence of VGAM1721 precursor RNA is designated SEQ ID:1707, and is provided hereinbelow with reference to the sequence listing part. Nucleotide sequence SEQ ID:1707 is located at position 8494 relative to the genome of Myxoma Virus.

VGAM1721 precursor RNA folds onto itself, forming VGAM1721 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1721 folded precursor RNA into VGAM1721 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1721 RNA is designated SEQ ID:4432, and is provided hereinbelow with reference to the sequence listing part.

VGAM1721 host target gene, herein designated VGAM HOST TARGET GENE, encodes a corresponding messenger RNA, VGAM1721 host target RNA, herein designated VGAM HOST TARGET RNA. VGAM1721 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1721 RNA, herein designated VGAM RNA, binds complementarily to one or more host target binding sites located in untranslated regions of VGAM1721 host target RNA, herein designated VGAM HOST TARGET RNA. This complementary binding is due to the fact that the nucleotide sequence of VGAM1721 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1721 RNA, herein designated VGAM RNA, may have a different number of host target binding sites in untranslated regions of a VGAM1721 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1721 RNA, herein designated VGAM RNA, to host target binding sites on VGAM1721 host target RNA, herein designated VGAM HOST TARGET RNA, such as BINDING SITE I, BINDING SITE II and BINDING SITE III, inhibits translation of VGAM1721 host target RNA into VGAM1721 host target protein, herein designated VGAM HOST TARGET PROTEIN. VGAM host target protein is therefore outlined by a broken line.

It is appreciated that VGAM1721 host target gene, herein designated VGAM HOST TARGET GENE, in fact represents a plurality of VGAM1721 host target genes. The mRNA of each one of this plurality of VGAM1721 host target genes comprises one or more host target binding sites, each having a nucleotide sequence which is at least partly complementary to VGAM1721 RNA, herein designated VGAM RNA, and which when bound by VGAM1721 RNA causes inhibition of translation of respective one or more VGAM1721 host target proteins.

It is further appreciated by one skilled in the art that the mode of translational inhibition illustrated by FIG. 1 with specific reference to translational inhibition exerted by VGAM1721 gene, herein designated VGAM GENE, on one or more VGAM1721 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1721 is inhibition of expression of host target genes, as part of a novel viral mechanism of attacking a host. Accordingly, utilities of VGAM1721 include diagnosis, prevention and treatment of viral infection by Myxoma Virus. Specific functions, and accordingly utilities, of VGAM1721 correlate with, and may be deduced from, the identity of the host target genes which VGAM1721 binds and inhibits, and the function of these host target genes, as elaborated hereinbelow.

Nucleotide sequences of the VGAM1721 precursor RNA, herein designated VGAM PRECURSOR RNA, and of the 'diced' VGAM1721 RNA, herein designated VGAM RNA, and a schematic representation of the secondary folding of VGAM1721 folded precursor RNA, herein designated VGAM FOLDED PRECURSOR RNA, of VGAM1721 are further described hereinbelow with reference to Table 1.

Nucleotide sequences of host target binding sites, such as BINDING SITE-I, BINDING SITE-II and BINDING SITE-III of FIG. 1, found on VGAM1721 host target RNA, and schematic representation of the complementarity of each of these host target binding sites to VGAM1721 RNA, herein designated VGAM RNA, are described hereinbelow with reference to Table 2.

As mentioned hereinabove with reference to FIG. 1, a function of VGAM1721 gene, herein designated VGAM is inhibition of expression of VGAM1721 target genes. It is appreciated that specific functions, and accordingly utilities, of VGAM1721 correlate with, and may be deduced from, the identity of the target genes which VGAM1721 binds and inhibits, and the function of these target genes, as elaborated hereinbelow.

G Protein-coupled Receptor 30 (GPR30, Accession NM_001505) is a VGAM1721 host target gene. GPR30 BINDING SITE is HOST TARGET binding site found in the 3' untranslated region of mRNA encoded by GPR30, corresponding to a HOST TARGET binding site such as BINDING SITE I, BINDING SITE II or BINDING SITE III. Table 2 illustrates the complementarity of the nucleotide sequences of GPR30 BINDING SITE, designated SEQ ID:7250, to the nucleotide sequence of VGAM1721 RNA, herein designated VGAM RNA, also designated SEQ ID:4432.

A function of VGAM1721 is therefore inhibition of G Protein-coupled Receptor 30 (GPR30, Accession NM_001505), a gene which receives chemical signals in cell communication in both CNS and peripheral tissues. Accordingly, utilities of VGAM1721 include diagnosis, prevention and treatment of diseases and clinical conditions associated with GPR30. The function of GPR30 and its association with various diseases and clinical conditions, has been established by previous studies, as described hereinabove with reference to VGAM171. FLJ12788 (Accession NM_022492) is another VGAM1721 host target gene. FLJ12788 BINDING SITE is HOST TARGET binding site found in the 3' untranslated region of mRNA encoded by FLJ12788, corresponding to a HOST TARGET binding site such as BINDING SITE I, BINDING SITE II or BINDING SITE III. Table 2 illustrates the complementarity of the nucleotide sequences of FLJ12788 BINDING SITE, designated SEQ ID:22873, to the nucleotide sequence of VGAM1721 RNA, herein designated VGAM RNA, also designated SEQ ID:4432.

Another function of VGAM1721 is therefore inhibition of FLJ12788 (Accession NM_022492). Accordingly, utilities of VGAM1721 include diagnosis, prevention and treatment of diseases and clinical conditions associated with FLJ12788. HGC6.1.1 (Accession NM_014354) is another VGAM1721 host target gene. HGC6.1.1 BINDING SITE is HOST TARGET binding site found in the 3' untranslated region of mRNA encoded by HGC6.1.1, corresponding to a HOST TARGET binding site such as BINDING SITE I, BINDING SITE II or BINDING SITE III. Table 2 illustrates the complementarity of the nucleotide sequences of HGC6.1.1 BINDING SITE, designated SEQ ID:15684, to the nucleotide sequence of VGAM1721 RNA, herein designated VGAM RNA, also designated SEQ ID:4432.

Another function of VGAM1721 is therefore inhibition of HGC6.1.1 (Accession NM_014354). Accordingly, utilities of VGAM1721 include diagnosis, prevention and treatment of diseases and clinical conditions associated with HGC6.1.1. LOC254423 (Accession XM_173286) is another VGAM1721 host target gene. LOC254423 BINDING SITE is HOST TARGET binding site found in the 5' untranslated region of mRNA encoded by LOC254423, corresponding to a HOST TARGET binding site such as BINDING SITE I, BINDING SITE II or BINDING SITE III. Table 2 illustrates the complementarity of the nucleotide sequences of LOC254423 BINDING SITE, designated SEQ ID:46529, to the nucleotide sequence of VGAM1721 RNA, herein designated VGAM RNA, also designated SEQ ID:4432.

Another function of VGAM1721 is therefore inhibition of LOC254423 (Accession XM_173286). Accordingly, utilities of VGAM1721 include diagnosis, prevention and treatment of diseases and clinical conditions associated with LOC254423. FIG. 1 further provides a conceptual description of a novel bioinformatically detected viral gene of the present invention, referred to here as Viral Genomic Address Messenger 1722 (VGAM1722) viral gene, which modulates expression of respective host target genes thereof, the function and utility of which host target genes is known in the art.

VGAM1722 is a novel bioinformatically detected regulatory, non protein coding, viral micro RNA (miRNA) gene. The method by which VGAM1722 was detected is described hereinabove with reference to FIGS. 1-8.

VGAM1722 gene, herein designated VGAM GENE, is a viral gene contained in the genome of Myxoma Virus. VGAM1722 host target gene, herein designated VGAM HOST TARGET GENE, is a human gene contained in the human genome.

VGAM1722 gene encodes a VGAM1722 precursor RNA, herein designated VGAM PRECURSOR RNA. Similar to other miRNA genes, and unlike most ordinary genes, VGAM1722 precursor RNA does not encode a protein. A nucleotide sequence identical or highly similar to the nucleotide sequence of VGAM1722 precursor RNA is designated SEQ ID:1708, and is provided hereinbelow with reference to the sequence listing part. Nucleotide sequence SEQ ID:1708 is located at position 4765 relative to the genome of Myxoma Virus.

VGAM1722 precursor RNA folds onto itself, forming VGAM1722 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1722 folded precursor RNA into VGAM1722 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1722 RNA is designated SEQ ID:4433, and is provided hereinbelow with reference to the sequence listing part.

VGAM1722 host target gene, herein designated VGAM HOST TARGET GENE, encodes a corresponding messenger RNA, VGAM1722 host target RNA, herein designated VGAM HOST TARGET RNA. VGAM1722 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1722 RNA, herein designated VGAM RNA, binds complementarily to one or more host target binding sites located in untranslated regions of VGAM1722 host target RNA, herein designated VGAM HOST TARGET RNA. This complementary binding is due to the fact that the nucleotide sequence of VGAM1722 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1722 RNA, herein designated VGAM RNA, may have a different number of host target binding sites in untranslated regions of a VGAM1722 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1722 RNA, herein designated VGAM RNA, to host target binding sites on VGAM1722 host target RNA, herein designated VGAM HOST TARGET RNA, such as BINDING SITE I, BINDING SITE II and BINDING SITE III, inhibits translation of VGAM1722 host target RNA into VGAM1722 host target protein, herein designated VGAM HOST TARGET PROTEIN. VGAM host target protein is therefore outlined by a broken line.

It is appreciated that VGAM1722 host target gene, herein designated VGAM HOST TARGET GENE, in fact represents a plurality of VGAM1722 host target genes. The mRNA of each one of this plurality of VGAM1722 host target genes comprises one or more host target binding sites, each having a nucleotide sequence which is at least partly complementary to VGAM1722 RNA, herein designated VGAM RNA, and which when bound by VGAM1722 RNA causes inhibition of translation of respective one or more VGAM1722 host target proteins.

It is further appreciated by one skilled in the art that the mode of translational inhibition illustrated by FIG. 1 with specific reference to translational inhibition exerted by VGAM1722 gene, herein designated VGAM GENE, on one or more VGAM1722 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1722 is inhibition of expression of host target genes, as part of a novel viral mechanism of attacking a host. Accordingly, utilities of VGAM1722 include diagnosis, prevention and treatment of viral infection by Myxoma Virus. Specific functions, and accordingly utilities, of VGAM1722 correlate with, and may be deduced from, the identity of the host target genes which VGAM1722 binds and inhibits, and the function of these host target genes, as elaborated hereinbelow.

Nucleotide sequences of the VGAM1722 precursor RNA, herein designated VGAM PRECURSOR RNA, and of the 'diced' VGAM1722 RNA, herein designated VGAM RNA, and a schematic representation of the secondary folding of VGAM1722 folded precursor RNA, herein designated VGAM FOLDED PRECURSOR RNA, of VGAM1722 are further described hereinbelow with reference to Table 1.

Nucleotide sequences of host target binding sites, such as BINDING SITE-I, BINDING SITE-II and BINDING SITE-III of FIG. 1, found on VGAM1722 host target RNA, and schematic representation of the complementarity of each of these host target binding sites to VGAM1722 RNA, herein designated VGAM RNA, are described hereinbelow with reference to Table 2.

As mentioned hereinabove with reference to FIG. 1, a function of VGAM1722 gene, herein designated VGAM is inhibition of expression of VGAM1722 target genes. It is appreciated that specific functions, and accordingly utilities, of VGAM1722 correlate with, and may be deduced from, the identity of the target genes which VGAM1722 binds and inhibits, and the function of these target genes, as elaborated hereinbelow.

Coronin, Actin Binding Protein, 2B (CORO2B, Accession XM_035403) is a VGAM1722 host target gene. CORO2B BINDING SITE is HOST TARGET binding site found in the 3' untranslated region of mRNA encoded by CORO2B, corresponding to a HOST TARGET binding site such as BINDING SITE I, BINDING SITE II or BINDING SITE III. Table 2 illustrates the complementarity of the nucleotide sequences of CORO2B BINDING SITE, designated SEQ ID:32253, to the nucleotide sequence of VGAM1722 RNA, herein designated VGAM RNA, also designated SEQ ID:4433.

A function of VGAM1722 is therefore inhibition of Coronin, Actin Binding Protein, 2B (CORO2B, Accession XM_035403), a gene which may play a role in the reorganization of neuronal actin structure. Accordingly, utilities of VGAM1722 include diagnosis, prevention and treatment of diseases and clinical conditions associated with CORO2B. The function of CORO2B and its association with various diseases and clinical conditions, has been established by previous studies, as described hereinabove with reference to VGAM923. Forkhead Box E3 (FOXE3, Accession NM_012186) is another VGAM1722 host target gene. FOXE3 BINDING SITE1 and FOXE3 BINDING SITE2 are HOST TARGET binding sites found in untranslated regions of mRNA encoded by FOXE3, corresponding to HOST TARGET binding sites such as BINDING SITE I, BINDING SITE II or BINDING SITE III. Table 2 illustrates the complementarity of the nucleotide sequences of FOXE3 BINDING SITE1 and FOXE3 BINDING SITE2, designated SEQ ID:14471 and SEQ ID:14468 respectively, to the nucleotide sequence of VGAM1722 RNA, herein designated VGAM RNA, also designated SEQ ID:4433.

Another function of VGAM1722 is therefore inhibition of Forkhead Box E3 (FOXE3, Accession NM_012186), a gene which regulates embryonic development. Accordingly, utilities of VGAM1722 include diagnosis, prevention and treatment of diseases and clinical conditions associated with FOXE3. The function of FOXE3 and its association with various diseases and clinical conditions, has been established by previous studies, as described hereinabove with reference to VGAM632. FLJ22002 (Accession NM_024838) is another VGAM1722 host target gene. FLJ22002 BINDING SITE is HOST TARGET binding site found in the 3' untranslated region of mRNA encoded by FLJ22002, corresponding to a HOST TARGET binding site such as BINDING SITE I, BINDING SITE II or BINDING SITE III. Table 2 illustrates the complementarity of the nucleotide sequences of FLJ22002 BINDING SITE, designated SEQ ID:24247, to the nucleotide sequence of VGAM1722 RNA, herein designated VGAM RNA, also designated SEQ ID:4433.

Another function of VGAM1722 is therefore inhibition of FLJ22002 (Accession NM_024838). Accordingly, utilities of VGAM1722 include diagnosis, prevention and treatment of diseases and clinical conditions associated with FLJ22002. Fucosyltransferase 10 (alpha (1,3) Fucosyltransferase) (FUT10, Accession NM_032664) is another VGAM1722 host target gene. FUT10 BINDING SITE is HOST TARGET binding site found in the 3' untranslated region of mRNA encoded by FUT10, corresponding to a HOST TARGET binding site such as BINDING SITE I, BINDING SITE II or BINDING SITE III. Table 2 illustrates the complementarity of the nucleotide sequences of FUT10 BINDING SITE, designated SEQ ID:26392, to the nucleotide sequence of VGAM1722 RNA, herein designated VGAM RNA, also designated SEQ ID:4433.

Another function of VGAM1722 is therefore inhibition of Fucosyltransferase 10 (alpha (1,3) Fucosyltransferase) (FUT10, Accession NM_032664). Accordingly, utilities of VGAM1722 include diagnosis, prevention and treatment of diseases and clinical conditions associated with FUT10. KIAA0014 (Accession NM_014665) is another VGAM1722 host target gene. KIAA0014 BINDING SITE is HOST TARGET binding site found in the 3' untranslated region of mRNA encoded by KIAA0014, corresponding to a HOST TARGET binding site such as BINDING SITE I, BINDING SITE II or BINDING SITE III. Table 2 illustrates the complementarity of the nucleotide sequences of KIAA0014 BINDING SITE, designated SEQ ID:16120, to the nucleotide sequence of VGAM1722 RNA, herein designated VGAM RNA, also designated SEQ ID:4433.

Another function of VGAM1722 is therefore inhibition of KIAA0014 (Accession NM_014665). Accordingly, utilities of VGAM1722 include diagnosis, prevention and treatment of diseases and clinical conditions associated with KIAA0014. KIAA0794 (Accession XM_087353) is another VGAM1722 host target gene. KIAA0794 BINDING SITE is HOST TARGET binding site found in the 3' untranslated region of mRNA encoded by KIAA0794, corresponding to a HOST TARGET binding site such as BINDING SITE I, BINDING SITE II or BINDING SITE III. Table 2 illustrates the complementarity of the nucleotide sequences of KIAA0794 BINDING SITE, designated SEQ ID:39178, to the nucleotide sequence of VGAM1722 RNA, herein designated VGAM RNA, also designated SEQ ID:4433.

Another function of VGAM1722 is therefore inhibition of KIAA0794 (Accession XM_087353). Accordingly, utilities of VGAM1722 include diagnosis, prevention and treatment of diseases and clinical conditions associated with KIAA0794. MIL1 (Accession NM_015367) is another VGAM1722 host target gene. MIL1 BINDING SITE is HOST TARGET binding site found in the 3' untranslated region of mRNA encoded by MIL1, corresponding to a HOST TARGET binding site such as BINDING SITE I, BINDING SITE II or BINDING SITE III. Table 2 illustrates the complementarity of the nucleotide sequences of MIL1 BINDING SITE, designated SEQ ID:17667, to the nucleotide sequence of VGAM1722 RNA, herein designated VGAM RNA, also designated SEQ ID:4433.

Another function of VGAM1722 is therefore inhibition of MIL1 (Accession NM_015367). Accordingly, utilities of VGAM1722 include diagnosis, prevention and treatment of diseases and clinical conditions associated with MIL1. Prefoldin 1 (PFDN1, Accession NM_002622) is another VGAM1722 host target gene. PFDN1 BINDING SITE is HOST TARGET binding site found in the 3' untranslated region of mRNA encoded by PFDN1, corresponding to a HOST TARGET binding site such as BINDING SITE I, BINDING SITE II or BINDING SITE III. Table 2 illustrates the complementarity of the nucleotide sequences of PFDN1 BINDING SITE, designated SEQ ID:8482, to the nucleotide sequence of VGAM1722 RNA, herein designated VGAM RNA, also designated SEQ ID:4433.

Another function of VGAM1722 is therefore inhibition of Prefoldin 1 (PFDN1, Accession NM_002622). Accordingly, utilities of VGAM1722 include diagnosis, prevention and treatment of diseases and clinical conditions associated with PFDN1. LOC145195 (Accession XM_096731) is another VGAM1722 host target gene. LOC145195 BINDING SITE is HOST TARGET binding site found in the 3' untranslated region of mRNA encoded by LOC145195, corresponding to a HOST TARGET binding site such as BINDING SITE I, BINDING SITE II or BINDING SITE III. Table 2 illustrates the complementarity of the nucleotide sequences of LOC145195 BINDING SITE, designated SEQ ID:40516, to the nucleotide sequence of VGAM1722 RNA, herein designated VGAM RNA, also designated SEQ ID:4433.

Another function of VGAM1722 is therefore inhibition of LOC145195 (Accession XM_096731). Accordingly, utilities of VGAM1722 include diagnosis, prevention and treatment of diseases and clinical conditions associated with LOC145195. LOC157697 (Accession XM_088365) is another VGAM1722 host target gene. LOC157697 BINDING SITE is HOST TARGET binding site found in the 5' untranslated region of mRNA encoded by LOC157697, corresponding to a HOST TARGET binding site such as BINDING SITE I, BINDING SITE II or BINDING SITE III. Table 2 illustrates the complementarity of the nucleotide sequences of LOC157697 BINDING SITE, designated SEQ ID:39646, to the nucleotide sequence of VGAM1722 RNA, herein designated VGAM RNA, also designated SEQ ID:4433.

Another function of VGAM1722 is therefore inhibition of LOC157697 (Accession XM_088365). Accordingly, utilities of VGAM1722 include diagnosis, prevention and treatment of diseases and clinical conditions associated with LOC157697. LOC222160 (Accession XM_168431) is another VGAM1722 host target gene. LOC222160 BINDING SITE is HOST TARGET binding site found in the 3' untranslated region of mRNA encoded by LOC222160, corresponding to a HOST TARGET binding site such as BINDING SITE I, BINDING SITE II or BINDING SITE III. Table 2 illustrates the complementarity of the nucleotide sequences of LOC222160 BINDING SITE, designated SEQ ID:45165, to the nucleotide sequence of VGAM1722 RNA, herein designated VGAM RNA, also designated SEQ ID:4433.

Another function of VGAM1722 is therefore inhibition of LOC222160 (Accession XM_168431). Accordingly, utilities of VGAM1722 include diagnosis, prevention and treatment of diseases and clinical conditions associated with LOC222160. LOC257449 (Accession XM_031562) is another VGAM1722 host target gene. LOC257449 BINDING SITE is HOST TARGET binding site found in the 3' untranslated region of mRNA encoded by LOC257449, corresponding to a HOST TARGET binding site such as BINDING SITE I, BINDING SITE II or BINDING SITE III. Table 2 illustrates the complementarity of the nucleotide sequences of LOC257449 BINDING SITE, designated SEQ ID:31426, to the nucleotide sequence of VGAM1722 RNA, herein designated VGAM RNA, also designated SEQ ID:4433.

Another function of VGAM1722 is therefore inhibition of LOC257449 (Accession XM_031562). Accordingly, utilities of VGAM1722 include diagnosis, prevention and treatment of diseases and clinical conditions associated with LOC257449. FIG. 1 further provides a conceptual description of a novel bioinformatically detected viral gene of the present invention, referred to here as Viral Genomic Address Messenger 1723 (VGAM1723) viral gene, which modulates expression of respective host target genes thereof, the function and utility of which host target genes is known in the art.

VGAM1723 is a novel bioinformatically detected regulatory, non protein coding, viral micro RNA (miRNA) gene. The method by which VGAM1723 was detected is described hereinabove with reference to FIGS. 1-8.

VGAM1723 gene, herein designated VGAM GENE, is a viral gene contained in the genome of Myxoma Virus. VGAM1723 host target gene, herein designated VGAM HOST TARGET GENE, is a human gene contained in the human genome.

VGAM1723 gene encodes a VGAM1723 precursor RNA, herein designated VGAM PRECURSOR RNA. Similar to other miRNA genes, and unlike most ordinary genes, VGAM1723 precursor RNA does not encode a protein. A nucleotide sequence identical or highly similar to the nucleotide sequence of VGAM1723 precursor RNA is designated SEQ ID:1709, and is provided hereinbelow with reference to the sequence listing part. Nucleotide sequence SEQ ID:1709 is located at position 4097 relative to the genome of Myxoma Virus.

VGAM1723 precursor RNA folds onto itself, forming VGAM1723 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1723 folded precursor RNA into VGAM1723 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1723 RNA is designated SEQ ID:4434, and is provided hereinbelow with reference to the sequence listing part.

VGAM1723 host target gene, herein designated VGAM HOST TARGET GENE, encodes a corresponding messenger RNA, VGAM1723 host target RNA, herein designated VGAM HOST TARGET RNA. VGAM1723 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1723 RNA, herein designated VGAM RNA, binds complementarily to one or more host target binding sites located in untranslated regions of VGAM1723 host target RNA, herein designated VGAM HOST TARGET RNA. This complementary binding is due to the fact that the nucleotide sequence of VGAM1723 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1723 RNA, herein designated VGAM RNA, may have a different number of host target binding sites in untranslated regions of a VGAM1723 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1723 RNA, herein designated VGAM RNA, to host target binding sites on VGAM1723 host target RNA, herein designated VGAM HOST TARGET RNA, such as BINDING SITE I, BINDING SITE II and BINDING SITE III, inhibits translation of VGAM1723 host target RNA into VGAM1723 host target protein, herein designated VGAM HOST TARGET PROTEIN. VGAM host target protein is therefore outlined by a broken line.

It is appreciated that VGAM1723 host target gene, herein designated VGAM HOST TARGET GENE, in fact represents a plurality of VGAM1723 host target genes. The mRNA of each one of this plurality of VGAM1723 host target genes comprises one or more host target binding sites, each having a nucleotide sequence which is at least partly complementary to VGAM1723 RNA, herein designated VGAM RNA, and which when bound by VGAM1723 RNA causes inhibition of translation of respective one or more VGAM1723 host target proteins.

It is further appreciated by one skilled in the art that the mode of translational inhibition illustrated by FIG. 1 with specific reference to translational inhibition exerted by VGAM1723 gene, herein designated VGAM GENE, on one or more VGAM1723 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1723 is inhibition of expression of host target genes, as part of a novel viral mechanism of attacking a host. Accordingly, utilities of VGAM1723 include diagnosis, prevention and treatment of viral infection by Myxoma Virus. Specific functions, and accordingly utilities, of VGAM1723 correlate with, and may be deduced from, the identity of the host target genes which VGAM1723 binds and inhibits, and the function of these host target genes, as elaborated hereinbelow.

Nucleotide sequences of the VGAM1723 precursor RNA, herein designated VGAM PRECURSOR RNA, and of the 'diced' VGAM1723 RNA, herein designated VGAM RNA, and a schematic representation of the secondary folding of VGAM1723 folded precursor RNA, herein designated VGAM FOLDED PRECURSOR RNA, of VGAM1723 are further described hereinbelow with reference to Table 1.

Nucleotide sequences of host target binding sites, such as BINDING SITE-I, BINDING SITE-II and BINDING SITE-III of FIG. 1, found on VGAM1723 host target RNA, and schematic representation of the complementarity of each of these host target binding sites to VGAM1723 RNA, herein designated VGAM RNA, are described hereinbelow with reference to Table 2.

As mentioned hereinabove with reference to FIG. 1, a function of VGAM1723 gene, herein designated VGAM is inhibition of expression of VGAM1723 target genes. It is appreciated that specific functions, and accordingly utilities, of VGAM1723 correlate with, and may be deduced from, the identity of the target genes which VGAM1723 binds and inhibits, and the function of these target genes, as elaborated hereinbelow.

LOC122210 (Accession XM_058609) is a VGAM1723 host target gene. LOC122210 BINDING SITE is HOST TARGET binding site found in the 5' untranslated region of mRNA encoded by LOC122210, corresponding to a HOST TARGET binding site such as BINDING SITE I, BINDING SITE II or BINDING SITE III. Table 2 illustrates the complementarity of the nucleotide sequences of LOC122210 BINDING SITE, designated SEQ ID:36681, to the nucleotide sequence of VGAM1723 RNA, herein designated VGAM RNA, also designated SEQ ID:4434.

A function of VGAM1723 is therefore inhibition of LOC122210 (Accession XM_058609). Accordingly, utilities of VGAM1723 include diagnosis, prevention and treatment of diseases and clinical conditions associated with LOC122210. FIG. 1 further provides a conceptual description of a novel bioinformatically detected viral gene of the present invention, referred to here as Viral Genomic Address Messenger 1724 (VGAM1724) viral gene, which modulates expression of respective host target genes thereof, the function and utility of which host target genes is known in the art.

VGAM1724 is a novel bioinformatically detected regulatory, non protein coding, viral micro RNA (miRNA) gene. The method by which VGAM1724 was detected is described hereinabove with reference to FIGS. 1-8.

VGAM1724 gene, herein designated VGAM GENE, is a viral gene contained in the genome of Rabies Virus. VGAM1724 host target gene, herein designated VGAM HOST TARGET GENE, is a human gene contained in the human genome.

VGAM1724 gene encodes a VGAM1724 precursor RNA, herein designated VGAM PRECURSOR RNA. Similar to other miRNA genes, and unlike most ordinary genes, VGAM1724 precursor RNA does not encode a protein. A nucleotide sequence identical or highly similar to the nucleotide sequence of VGAM1724 precursor RNA is designated SEQ ID:1710, and is provided hereinbelow with reference to the sequence listing part. Nucleotide sequence SEQ ID:1710 is located at position 3898 relative to the genome of Rabies Virus.

VGAM1724 precursor RNA folds onto itself, forming VGAM1724 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1724 folded precursor RNA into VGAM1724 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1724 RNA is designated SEQ ID:4435, and is provided hereinbelow with reference to the sequence listing part.

VGAM1724 host target gene, herein designated VGAM HOST TARGET GENE, encodes a corresponding messenger RNA, VGAM1724 host target RNA, herein designated VGAM HOST TARGET RNA. VGAM1724 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1724 RNA, herein designated VGAM RNA, binds complementarily to one or more host target binding sites located in untranslated regions of VGAM1724 host target RNA, herein designated VGAM HOST TARGET RNA. This complementary binding is due to the fact that the nucleotide sequence of VGAM1724 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1724 RNA, herein designated VGAM RNA, may have a different number of host target binding sites in untranslated regions of a VGAM1724 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1724 RNA, herein designated VGAM RNA, to host target binding sites on VGAM1724 host target RNA, herein designated VGAM HOST TARGET RNA, such as BINDING SITE I, BINDING SITE II and BINDING SITE III, inhibits translation of VGAM1724 host target RNA into VGAM1724 host target protein, herein designated VGAM HOST TARGET PROTEIN. VGAM host target protein is therefore outlined by a broken line.

It is appreciated that VGAM1724 host target gene, herein designated VGAM HOST TARGET GENE, in fact represents a plurality of VGAM1724 host target genes. The mRNA of each one of this plurality of VGAM1724 host target genes comprises one or more host target binding sites, each having a nucleotide sequence which is at least partly complementary to VGAM1724 RNA, herein designated VGAM RNA, and which when bound by VGAM1724 RNA causes inhibition of translation of respective one or more VGAM1724 host target proteins.

It is further appreciated by one skilled in the art that the mode of translational inhibition illustrated by FIG. 1 with specific reference to translational inhibition exerted by VGAM1724 gene, herein designated VGAM GENE, on one or more VGAM1724 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1724 is inhibition of expression of host target genes, as part of a novel viral mechanism of attacking a host. Accordingly, utilities of VGAM1724 include diagnosis, prevention and treatment of viral infection by Rabies Virus. Specific functions, and accordingly utilities, of VGAM1724 correlate with, and may be deduced from, the identity of the host target genes which VGAM1724 binds and inhibits, and the function of these host target genes, as elaborated hereinbelow.

Nucleotide sequences of the VGAM1724 precursor RNA, herein designated VGAM PRECURSOR RNA, and of the 'diced' VGAM1724 RNA, herein designated VGAM RNA, and a schematic representation of the secondary folding of VGAM1724 folded precursor RNA, herein designated VGAM FOLDED PRECURSOR RNA, of VGAM1724 are further described hereinbelow with reference to Table 1.

Nucleotide sequences of host target binding sites, such as BINDING SITE-I, BINDING SITE-II and BINDING SITE-III of FIG. 1, found on VGAM1724 host target RNA, and schematic representation of the complementarity of each of these host target binding sites to VGAM1724 RNA, herein designated VGAM RNA, are described hereinbelow with reference to Table 2.

As mentioned hereinabove with reference to FIG. 1, a function of VGAM1724 gene, herein designated VGAM is inhibition of expression of VGAM1724 target genes. It is appreciated that specific functions, and accordingly utilities, of VGAM1724 correlate with, and may be deduced from, the identity of the target genes which VGAM1724 binds and inhibits, and the function of these target genes, as elaborated hereinbelow.

Synaptogyrin 3 (SYNGR3, Accession NM_004209) is a VGAM1724 host target gene. SYNGR3 BINDING SITE is HOST TARGET binding site found in the 3' untranslated region of mRNA encoded by SYNGR3, corresponding to a HOST TARGET binding site such as BINDING SITE I, BINDING SITE II or BINDING SITE III. Table 2 illustrates the complementarity of the nucleotide sequences of SYNGR3 BINDING SITE, designated SEQ ID:10406, to the nucleotide sequence of VGAM1724 RNA, herein designated VGAM RNA, also designated SEQ ID:4435.

A function of VGAM1724 is therefore inhibition of Synaptogyrin 3 (SYNGR3, Accession NM_004209). Accordingly, utilities of VGAM1724 include diagnosis, prevention and treatment of diseases and clinical conditions associated with SYNGR3. HSPC195 (Accession XM_087785) is another VGAM1724 host target gene. HSPC195 BINDING SITE is HOST TARGET binding site found in the 3' untranslated region of mRNA encoded by HSPC195, corresponding to a HOST TARGET binding site such as BINDING SITE I, BINDING SITE II or BINDING SITE III. Table 2 illustrates the complementarity of the nucleotide sequences of HSPC195 BINDING SITE, designated SEQ ID:39420, to the nucleotide sequence of VGAM1724 RNA, herein designated VGAM RNA, also designated SEQ ID:4435.

Another function of VGAM1724 is therefore inhibition of HSPC195 (Accession XM_087785). Accordingly, utilities of VGAM1724 include diagnosis, prevention and treatment of diseases and clinical conditions associated with HSPC195. KIAA1677 (Accession XM_040383) is another VGAM1724 host target gene. KIAA1677 BINDING SITE is HOST TARGET binding site found in the 3' untranslated region of mRNA encoded by KIAA1677, corresponding to a HOST TARGET binding site such as BINDING SITE I, BINDING SITE II or BINDING SITE III. Table 2 illustrates the complementarity of the nucleotide sequences of KIAA1677 BINDING SITE, designated SEQ ID:33290, to the nucleotide sequence of VGAM1724 RNA, herein designated VGAM RNA, also designated SEQ ID:4435.

Another function of VGAM1724 is therefore inhibition of KIAA1677 (Accession XM_040383). Accordingly, utilities of VGAM1724 include diagnosis, prevention and treatment of diseases and clinical conditions associated with KIAA1677. LOC221042 (Accession XM_167669) is another VGAM1724 host target gene. LOC221042 BINDING SITE is HOST TARGET binding site found in the 3' untranslated region of mRNA encoded by LOC221042, corresponding to a HOST TARGET binding site such as BINDING SITE I, BINDING SITE II or BINDING SITE III. Table 2 illustrates the complementarity of the nucleotide sequences of LOC221042 BINDING SITE, designated SEQ ID:44759, to the nucleotide sequence of VGAM1724 RNA, herein designated VGAM RNA, also designated SEQ ID:4435.

Another function of VGAM1724 is therefore inhibition of LOC221042 (Accession XM_167669). Accordingly, utilities of VGAM1724 include diagnosis, prevention and treatment of diseases and clinical conditions associated with LOC221042. FIG. 1 further provides a conceptual description of a novel bioinformatically detected viral gene of the present invention, referred to here as Viral Genomic Address Messenger 1725 (VGAM1725) viral gene, which modulates expression of respective host target genes thereof, the function and utility of which host target genes is known in the art.

VGAM1725 is a novel bioinformatically detected regulatory, non protein coding, viral micro RNA (miRNA) gene. The method by which VGAM1725 was detected is described hereinabove with reference to FIGS. 1-8.

VGAM1725 gene, herein designated VGAM GENE, is a viral gene contained in the genome of Rabies Virus. VGAM1725 host target gene, herein designated VGAM HOST TARGET GENE, is a human gene contained in the human genome.

VGAM1725 gene encodes a VGAM1725 precursor RNA, herein designated VGAM PRECURSOR RNA. Similar to other miRNA genes, and unlike most ordinary genes, VGAM1725 precursor RNA does not encode a protein. A nucleotide sequence identical or highly similar to the nucleotide sequence of VGAM1725 precursor RNA is designated SEQ ID:1711, and is provided hereinbelow with reference to the sequence listing part. Nucleotide sequence SEQ ID:1711 is located at position 8659 relative to the genome of Rabies Virus.

VGAM1725 precursor RNA folds onto itself, forming VGAM1725 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1725 folded precursor RNA into VGAM1725 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1725 RNA is designated SEQ ID:4436, and is provided hereinbelow with reference to the sequence listing part.

VGAM1725 host target gene, herein designated VGAM HOST TARGET GENE, encodes a corresponding messenger RNA, VGAM1725 host target RNA, herein designated VGAM HOST TARGET RNA. VGAM1725 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1725 RNA, herein designated VGAM RNA, binds complementarily to one or more host target binding sites located in untranslated regions of VGAM1725 host target RNA, herein designated VGAM HOST TARGET RNA. This complementary binding is due to the fact that the nucleotide sequence of VGAM1725 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1725 RNA, herein designated VGAM RNA, may have a different number of host target binding sites in untranslated regions of a VGAM1725 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1725 RNA, herein designated VGAM RNA, to host target binding sites on VGAM1725 host target RNA, herein designated VGAM HOST TARGET RNA, such as BINDING SITE I, BINDING SITE II and BINDING SITE III, inhibits translation of VGAM1725 host target RNA into VGAM1725 host target protein, herein designated VGAM HOST TARGET PROTEIN. VGAM host target protein is therefore outlined by a broken line.

It is appreciated that VGAM1725 host target gene, herein designated VGAM HOST TARGET GENE, in fact represents a plurality of VGAM1725 host target genes. The mRNA of each one of this plurality of VGAM1725 host target genes comprises one or more host target binding sites, each having a nucleotide sequence which is at least partly complementary to VGAM1725 RNA, herein designated VGAM RNA, and which when bound by VGAM1725 RNA causes inhibition of translation of respective one or more VGAM1725 host target proteins.

It is further appreciated by one skilled in the art that the mode of translational inhibition illustrated by FIG. 1 with specific reference to translational inhibition exerted by VGAM1725 gene, herein designated VGAM GENE, on one or more VGAM1725 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1725 is inhibition of expression of host target genes, as part of a novel viral mechanism of attacking a host. Accordingly, utilities of VGAM1725 include diagnosis, prevention and treatment of viral infection by Rabies Virus. Specific functions, and accordingly utilities, of VGAM1725 correlate with, and may be deduced from, the identity of the host target genes which VGAM1725 binds and inhibits, and the function of these host target genes, as elaborated hereinbelow.

Nucleotide sequences of the VGAM1725 precursor RNA, herein designated VGAM PRECURSOR RNA, and of the 'diced' VGAM1725 RNA, herein designated VGAM RNA, and a schematic representation of the secondary folding of VGAM1725 folded precursor RNA, herein designated VGAM FOLDED PRECURSOR RNA, of VGAM1725 are further described hereinbelow with reference to Table 1.

Nucleotide sequences of host target binding sites, such as BINDING SITE-I, BINDING SITE-II and BINDING SITE-III of FIG. 1, found on VGAM1725 host target RNA, and schematic representation of the complementarity of each of these host target binding sites to VGAM1725 RNA, herein designated VGAM RNA, are described hereinbelow with reference to Table 2.

As mentioned hereinabove with reference to FIG. 1, a function of VGAM1725 gene, herein designated VGAM is inhibition of expression of VGAM1725 target genes. It is appreciated that specific functions, and accordingly utilities, of VGAM1725 correlate with, and may be deduced from, the identity of the target genes which VGAM1725 binds and inhibits, and the function of these target genes, as elaborated hereinbelow.

ADP-ribosylation Factor 3 (ARF3, Accession NM_001659) is a VGAM1725 host target gene. ARF3 BINDING SITE is HOST TARGET binding site found in the 3' untranslated region of mRNA encoded by ARF3, corresponding to a HOST TARGET binding site such as BINDING SITE I, BINDING SITE II or BINDING SITE III. Table 2 illustrates the complementarity of the nucleotide sequences of ARF3 BINDING SITE, designated SEQ ID:7378, to the nucleotide sequence of VGAM1725 RNA, herein designated VGAM RNA, also designated SEQ ID:4436.

A function of VGAM1725 is therefore inhibition of ADP-ribosylation Factor 3 (ARF3, Accession NM_001659). Accordingly, utilities of VGAM1725 include diagnosis, prevention and treatment of diseases and clinical conditions associated with ARF3. Platelet-activating Factor Acetylhydrolase, Isoform Ib, Alpha Subunit 45 kDa (PAFAH1B1, Accession NM_000430) is another VGAM1725 host target gene. PAFAH1B1 BINDING SITE is HOST TARGET binding site found in the 3' untranslated region of mRNA encoded by PAFAH1B1, corresponding to a HOST TARGET binding site such as BINDING SITE I, BINDING SITE II or BINDING SITE III. Table 2 illustrates the complementarity of the nucleotide sequences of PAFAH1B1 BINDING SITE, designated SEQ ID:6008, to the nucleotide sequence of VGAM1725 RNA, herein designated VGAM RNA, also designated SEQ ID:4436.

Another function of VGAM1725 is therefore inhibition of Platelet-activating Factor Acetylhydrolase, Isoform Ib, Alpha Subunit 45 kDa (PAFAH1B1, Accession NM_000430). Accordingly, utilities of VGAM1725 include diagnosis, prevention and treatment of diseases and clinical conditions associated with PAFAH1B1. FLJ10697 (Accession NM_018181) is another VGAM1725 host target gene. FLJ10697 BINDING SITE is HOST TARGET binding site found in the 3' untranslated region of mRNA encoded by FLJ10697, corresponding to a HOST TARGET binding site such as BINDING SITE I, BINDING SITE II or BINDING SITE III. Table 2 illustrates the complementarity of the nucleotide sequences of FLJ10697 BINDING SITE, designated SEQ ID:20014, to the nucleotide sequence of VGAM1725 RNA, herein designated VGAM RNA, also designated SEQ ID:4436.

Another function of VGAM1725 is therefore inhibition of FLJ10697 (Accession NM_018181). Accordingly, utilities of VGAM1725 include diagnosis, prevention and treatment of diseases and clinical conditions associated with FLJ10697. FLJ22679 (Accession NM_032227) is another VGAM1725 host target gene. FLJ22679 BINDING SITE1 and FLJ22679 BINDING SITE2 are HOST TARGET binding sites found in untranslated regions of mRNA encoded by FLJ22679, corresponding to HOST TARGET binding sites such as BINDING SITE I, BINDING SITE II or BINDING SITE III. Table 2 illustrates the complementarity of the nucleotide sequences of FLJ22679 BINDING SITE1 and FLJ22679 BINDING SITE2, designated SEQ ID:25953 and SEQ ID:19266 respectively, to the nucleotide sequence of VGAM1725 RNA, herein designated VGAM RNA, also designated SEQ ID:4436.

Another function of VGAM1725 is therefore inhibition of FLJ22679 (Accession NM_032227). Accordingly, utilities of VGAM1725 include diagnosis, prevention and treatment of diseases and clinical conditions associated with FLJ22679. Suppression of Tumorigenicity 7 Like (ST7L, Accession NM_138727) is another VGAM1725 host target gene. ST7L BINDING SITE1 through ST7L BINDING SITE3 are HOST TARGET binding sites found in untranslated regions of mRNA encoded by ST7L, corresponding to HOST TARGET binding sites such as BINDING SITE I, BINDING SITE II or BINDING SITE III. Table 2 illustrates the complementarity of the nucleotide sequences of ST7L BINDING SITE1 through ST7L BINDING SITE3, designated SEQ ID:28977, SEQ ID:19335 and SEQ ID:29207 respectively, to the nucleotide sequence of VGAM1725 RNA, herein designated VGAM RNA, also designated SEQ ID:4436.

Another function of VGAM1725 is therefore inhibition of Suppression of Tumorigenicity 7 Like (ST7L, Accession NM_138727). Accordingly, utilities of VGAM1725 include diagnosis, prevention and treatment of diseases and clinical conditions associated with ST7L. LOC116028 (Accession XM_057225) is another VGAM1725 host target gene. LOC116028 BINDING SITE is HOST TARGET binding site found in the 3' untranslated region of mRNA encoded by LOC116028, corresponding to a HOST TARGET binding site such as BINDING SITE I, BINDING SITE II or BINDING SITE III. Table 2 illustrates the complementarity of the nucleotide sequences of LOC116028 BINDING SITE, designated SEQ ID:36492, to the nucleotide sequence of VGAM1725 RNA, herein designated VGAM RNA, also designated SEQ ID:4436.

Another function of VGAM1725 is therefore inhibition of LOC116028 (Accession XM_057225). Accordingly, utilities of VGAM1725 include diagnosis, prevention and treatment of diseases and clinical conditions associated with LOC116028. LOC150236 (Accession XM_086824) is another VGAM1725 host target gene. LOC150236 BINDING SITE is HOST TARGET binding site found in the 5' untranslated region of mRNA encoded by LOC150236, corresponding to a HOST TARGET binding site such as BINDING SITE I, BINDING SITE II or BINDING SITE III. Table 2 illustrates the complementarity of the nucleotide sequences of LOC150236 BINDING SITE, designated SEQ ID:38906, to the nucleotide sequence of VGAM1725 RNA, herein designated VGAM RNA, also designated SEQ ID:4436.

Another function of VGAM1725 is therefore inhibition of LOC150236 (Accession XM_086824). Accordingly, utilities of VGAM1725 include diagnosis, prevention and treatment of diseases and clinical conditions associated with LOC150236. FIG. 1 further provides a conceptual description of a novel bioinformatically detected viral gene of the present invention, referred to here as Viral Genomic Address Messenger 1726 (VGAM1726) viral gene, which modulates expression of respective host target genes thereof, the function and utility of which host target genes is known in the art.

VGAM1726 is a novel bioinformatically detected regulatory, non protein coding, viral micro RNA (miRNA) gene. The method by which VGAM1726 was detected is described hereinabove with reference to FIGS. 1-8.

VGAM1726 gene, herein designated VGAM GENE, is a viral gene contained in the genome of Rabies Virus. VGAM1726 host target gene, herein designated VGAM HOST TARGET GENE, is a human gene contained in the human genome.

VGAM1726 gene encodes a VGAM1726 precursor RNA, herein designated VGAM PRECURSOR RNA. Similar to other miRNA genes, and unlike most ordinary genes, VGAM1726 precursor RNA does not encode a protein. A nucleotide sequence identical or highly similar to the nucleotide sequence of VGAM1726 precursor RNA is designated SEQ ID:1712, and is provided hereinbelow with reference to the sequence listing part. Nucleotide sequence SEQ ID:1712 is located at position 9658 relative to the genome of Rabies Virus.

VGAM1726 precursor RNA folds onto itself, forming VGAM1726 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1726 folded precursor RNA into VGAM1726 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1726 RNA is designated SEQ ID:4437, and is provided hereinbelow with reference to the sequence listing part.

VGAM1726 host target gene, herein designated VGAM HOST TARGET GENE, encodes a corresponding messenger RNA, VGAM1726 host target RNA, herein designated VGAM HOST TARGET RNA. VGAM1726 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1726 RNA, herein designated VGAM RNA, binds complementarily to one or more host target binding sites located in untranslated regions of VGAM1726 host target RNA, herein designated VGAM HOST TARGET RNA. This complementary binding is due to the fact that the nucleotide sequence of VGAM1726 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1726 RNA, herein designated VGAM RNA, may have a different number of host target binding sites in untranslated regions of a VGAM1726 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1726 RNA, herein designated VGAM RNA, to host target binding sites on VGAM1726 host target RNA, herein designated VGAM HOST TARGET RNA, such as BINDING SITE I, BINDING SITE II and BINDING SITE III, inhibits translation of VGAM1726 host target RNA into VGAM1726 host target protein, herein designated VGAM HOST TARGET PROTEIN. VGAM host target protein is therefore outlined by a broken line.

It is appreciated that VGAM1726 host target gene, herein designated VGAM HOST TARGET GENE, in fact represents a plurality of VGAM1726 host target genes. The mRNA of each one of this plurality of VGAM1726 host target genes comprises one or more host target binding sites, each having a nucleotide sequence which is at least partly complementary to VGAM1726 RNA, herein designated VGAM RNA, and which when bound by VGAM1726 RNA causes inhibition of translation of respective one or more VGAM1726 host target proteins.

It is further appreciated by one skilled in the art that the mode of translational inhibition illustrated by FIG. 1 with specific reference to translational inhibition exerted by VGAM1726 gene, herein designated VGAM GENE, on one or more VGAM1726 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1726 is inhibition of expression of host target genes, as part of a novel viral mechanism of attacking a host. Accordingly, utilities of VGAM1726 include diagnosis, prevention and treatment of viral infection by Rabies Virus. Specific functions, and accordingly utilities, of VGAM1726 correlate with, and may be deduced from, the identity of the host target genes which VGAM1726 binds and inhibits, and the function of these host target genes, as elaborated hereinbelow.

Nucleotide sequences of the VGAM1726 precursor RNA, herein designated VGAM PRECURSOR RNA, and of the 'diced' VGAM1726 RNA, herein designated VGAM RNA, and a schematic representation of the secondary folding of VGAM1726 folded precursor RNA, herein designated VGAM FOLDED PRECURSOR RNA, of VGAM1726 are further described hereinbelow with reference to Table 1.

Nucleotide sequences of host target binding sites, such as BINDING SITE-I, BINDING SITE-II and BINDING SITE-III of FIG. 1, found on VGAM1726 host target RNA, and schematic representation of the complementarity of each of these host target binding sites to VGAM1726 RNA, herein designated VGAM RNA, are described hereinbelow with reference to Table 2.

As mentioned hereinabove with reference to FIG. 1, a function of VGAM1726 gene, herein designated VGAM is inhibition of expression of VGAM1726 target genes. It is appreciated that specific functions, and accordingly utilities, of VGAM1726 correlate with, and may be deduced from, the identity of the target genes which VGAM1726 binds and inhibits, and the function of these target genes, as elaborated hereinbelow.

G Protein-coupled Receptor, Family C, Group 5, Member B (GPRC5B, Accession NM_016235) is a VGAM1726 host target gene. GPRC5B BINDING SITE is HOST TARGET binding site found in the 3' untranslated region of mRNA encoded by GPRC5B, corresponding to a HOST TARGET binding site such as BINDING SITE I, BINDING SITE II or BINDING SITE III. Table 2 illustrates the complementarity of the nucleotide sequences of GPRC5B BINDING SITE, designated SEQ ID:18351, to the nucleotide sequence of VGAM1726 RNA, herein designated VGAM RNA, also designated SEQ ID:4437.

A function of VGAM1726 is therefore inhibition of G Protein-coupled Receptor, Family C, Group 5, Member B (GPRC5B, Accession NM_016235), a gene which belongs to G protein-coupled receptor. Accordingly, utilities of VGAM1726 include diagnosis, prevention and treatment of diseases and clinical conditions associated with GPRC5B. The function of GPRC5B and its association with various diseases and clinical conditions, has been established by previous studies, as described hereinabove with reference to VGAM131. KIAA0893 (Accession NM_014969) is another VGAM1726 host target gene. KIAA0893 BINDING SITE is HOST TARGET binding site found in the 3' untranslated region of mRNA encoded by KIAA0893, corresponding to a HOST TARGET binding site such as BINDING SITE I, BINDING SITE II or BINDING SITE III. Table 2 illustrates the complementarity of the nucleotide sequences of KIAA0893 BINDING SITE, designated SEQ ID:17361, to the nucleotide sequence of VGAM1726 RNA, herein designated VGAM RNA, also designated SEQ ID:4437.

Another function of VGAM1726 is therefore inhibition of KIAA0893 (Accession NM_014969). Accordingly, utilities of VGAM1726 include diagnosis, prevention and treatment of diseases and clinical conditions associated with KIAA0893. KIAA1596 (Accession XM_048128) is another VGAM1726 host target gene. KIAA1596 BINDING SITE is HOST TARGET binding site found in the 5' untranslated region of mRNA encoded by KIAA1596, corresponding to a HOST TARGET binding site such as BINDING SITE I, BINDING SITE II or BINDING SITE III. Table 2 illustrates the complementarity of the nucleotide sequences of KIAA1596 BINDING SITE, designated SEQ ID:35118, to the nucleotide sequence of VGAM1726 RNA, herein designated VGAM RNA, also designated SEQ ID:4437.

Another function of VGAM1726 is therefore inhibition of KIAA1596 (Accession XM_048128). Accordingly, utilities of VGAM1726 include diagnosis, prevention and treatment of diseases and clinical conditions associated with KIAA1596. MGC14836 (Accession NM_033412) is another VGAM1726 host target gene. MGC14836 BINDING SITE is HOST TARGET binding site found in the 3' untranslated region of mRNA encoded by MGC14836, corresponding to a HOST TARGET binding site such as BINDING SITE I, BINDING SITE II or BINDING SITE III. Table 2 illustrates the complementarity of the nucleotide sequences of MGC14836 BINDING SITE, designated SEQ ID:27236, to the nucleotide sequence of VGAM1726 RNA, herein designated VGAM RNA, also designated SEQ ID:4437.

Another function of VGAM1726 is therefore inhibition of MGC14836 (Accession NM_033412). Accordingly, utilities of VGAM1726 include diagnosis, prevention and treatment of diseases and clinical conditions associated with MGC14836. PRSC (Accession NM_006587) is another VGAM1726 host target gene. PRSC BINDING SITE is HOST TARGET binding site found in the 3' untranslated region of mRNA encoded by PRSC, corresponding to a HOST TARGET binding site such as BINDING SITE I, BINDING SITE II or BINDING SITE III. Table 2 illustrates the complementarity of the nucleotide sequences of PRSC BINDING SITE, designated SEQ ID:13348, to the nucleotide sequence of VGAM1726 RNA, herein designated VGAM RNA, also designated SEQ ID:4437.

Another function of VGAM1726 is therefore inhibition of PRSC (Accession NM_006587). Accordingly, utilities of VGAM1726 include diagnosis, prevention and treatment of diseases and clinical conditions associated with PRSC. LOC152627 (Accession XM_087495) is another VGAM1726 host target gene. LOC152627 BINDING SITE is HOST TARGET binding site found in the 5' untranslated region of mRNA encoded by LOC152627, corresponding to a HOST TARGET binding site such as BINDING SITE I, BINDING SITE II or BINDING SITE III. Table 2 illustrates the complementarity of the nucleotide sequences of LOC152627 BINDING SITE, designated SEQ ID:39297, to the nucleotide sequence of VGAM1726 RNA, herein designated VGAM RNA, also designated SEQ ID:4437.

Another function of VGAM1726 is therefore inhibition of LOC152627 (Accession XM_087495). Accordingly, utilities of VGAM1726 include diagnosis, prevention and treatment of diseases and clinical conditions associated with LOC152627. FIG. 1 further provides a conceptual description of a novel bioinformatically detected viral gene of the present invention, referred to here as Viral Genomic Address Messenger 1727 (VGAM1727) viral gene, which modulates expression of respective host target genes thereof, the function and utility of which host target genes is known in the art.

VGAM1727 is a novel bioinformatically detected regulatory, non protein coding, viral micro RNA (miRNA) gene. The method by which VGAM1727 was detected is described hereinabove with reference to FIGS. 1-8.

VGAM1727 gene, herein designated VGAM GENE, is a viral gene contained in the genome of Rabies Virus. VGAM1727 host target gene, herein designated VGAM HOST TARGET GENE, is a human gene contained in the human genome.

VGAM1727 gene encodes a VGAM1727 precursor RNA, herein designated VGAM PRECURSOR RNA. Similar to other miRNA genes, and unlike most ordinary genes, VGAM1727 precursor RNA does not encode a protein. A nucleotide sequence identical or highly similar to the nucleotide sequence of VGAM1727 precursor RNA is designated SEQ ID:1713, and is provided hereinbelow with reference to the sequence listing part. Nucleotide sequence SEQ ID:1713 is located at position 8962 relative to the genome of Rabies Virus.

VGAM1727 precursor RNA folds onto itself, forming VGAM1727 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1727 folded precursor RNA into VGAM1727 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1727 RNA is designated SEQ ID:4438, and is provided hereinbelow with reference to the sequence listing part.

VGAM1727 host target gene, herein designated VGAM HOST TARGET GENE, encodes a corresponding messenger RNA, VGAM1727 host target RNA, herein designated VGAM HOST TARGET RNA. VGAM1727 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1727 RNA, herein designated VGAM RNA, binds complementarily to one or more host target binding sites located in untranslated regions of VGAM1727 host target RNA, herein designated VGAM HOST TARGET RNA. This complementary binding is due to the fact that the nucleotide sequence of VGAM1727 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1727 RNA, herein designated VGAM RNA, may have a different number of host target binding sites in untranslated regions of a VGAM1727 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1727 RNA, herein designated VGAM RNA, to host target binding sites on VGAM1727 host target RNA, herein designated VGAM HOST TARGET RNA, such as BINDING SITE I, BINDING SITE II and BINDING SITE III, inhibits translation of VGAM1727 host target RNA into VGAM1727 host target protein, herein designated VGAM HOST TARGET PROTEIN. VGAM host target protein is therefore outlined by a broken line.

It is appreciated that VGAM1727 host target gene, herein designated VGAM HOST TARGET GENE, in fact represents a plurality of VGAM1727 host target genes. The mRNA of each one of this plurality of VGAM1727 host target genes comprises one or more host target binding sites, each having a nucleotide sequence which is at least partly complementary to VGAM1727 RNA, herein designated VGAM RNA, and which when bound by VGAM1727 RNA causes inhibition of translation of respective one or more VGAM1727 host target proteins.

It is further appreciated by one skilled in the art that the mode of translational inhibition illustrated by FIG. 1 with specific reference to translational inhibition exerted by VGAM1727 gene, herein designated VGAM GENE, on one or more VGAM1727 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1727 is inhibition of expression of host target genes, as part of a novel viral mechanism of attacking a host. Accordingly, utilities of VGAM1727 include diagnosis, prevention and treatment of viral infection by Rabies Virus. Specific functions, and accordingly utilities, of VGAM1727 correlate with, and may be deduced from, the identity of the host target genes which VGAM1727 binds and inhibits, and the function of these host target genes, as elaborated hereinbelow.

Nucleotide sequences of the VGAM1727 precursor RNA, herein designated VGAM PRECURSOR RNA, and of the 'diced' VGAM1727 RNA, herein designated VGAM RNA, and a schematic representation of the secondary folding of VGAM1727 folded precursor RNA, herein designated VGAM FOLDED PRECURSOR RNA, of VGAM1727 are further described hereinbelow with reference to Table 1.

Nucleotide sequences of host target binding sites, such as BINDING SITE-I, BINDING SITE-II and BINDING SITE-III of FIG. 1, found on VGAM1727 host target RNA, and schematic representation of the complementarity of each of these host target binding sites to VGAM1727 RNA, herein designated VGAM RNA, are described hereinbelow with reference to Table 2.

As mentioned hereinabove with reference to FIG. 1, a function of VGAM1727 gene, herein designated VGAM is inhibition of expression of VGAM1727 target genes. It is appreciated that specific functions, and accordingly utilities, of VGAM1727 correlate with, and may be deduced from, the identity of the target genes which VGAM1727 binds and inhibits, and the function of these target genes, as elaborated hereinbelow.

Ankyrin-like with Transmembrane Domains 1 (ANKTM1, Accession NM_007332) is a VGAM1727 host target gene. ANKTM1 BINDING SITE is HOST TARGET binding site found in the 3' untranslated region of mRNA encoded by ANKTM1, corresponding to a HOST TARGET binding site such as BINDING SITE I, BINDING SITE II or BINDING SITE III. Table 2 illustrates the complementarity of the nucleotide sequences of ANKTM1 BINDING SITE, designated SEQ ID:14256, to the nucleotide sequence of VGAM1727 RNA, herein designated VGAM RNA, also designated SEQ ID:4438.

A function of VGAM1727 is therefore inhibition of Ankyrin-like with Transmembrane Domains 1 (ANKTM1, Accession NM_007332), a gene which attaches integral membrane proteins to cytoskeletal elements. Accordingly, utilities of VGAM1727 include diagnosis, prevention and treatment of diseases and clinical conditions associated with ANKTM1. The function of ANKTM1 and its association with various diseases and clinical conditions, has been established by previous studies, as described hereinabove with reference to VGAM644. Chitinase 3-like 1 (cartilage glycoprotein-39) (CHI3L1, Accession NM_001276) is another VGAM1727 host target gene. CHI3L1 BINDING SITE is HOST TARGET binding site found in the 3' untranslated region of mRNA encoded by CHI3L1, corresponding to a HOST TARGET binding site such as BINDING SITE I, BINDING SITE II or BINDING SITE III. Table 2 illustrates the complementarity of the nucleotide sequences of CHI3L1 BINDING SITE, designated SEQ ID:6941, to the nucleotide sequence of VGAM1727 RNA, herein designated VGAM RNA, also designated SEQ ID:4438.

Another function of VGAM1727 is therefore inhibition of Chitinase 3-like 1 (cartilage glycoprotein-39) (CHI3L1, Accession NM_001276), a gene which participates in the capacity of cells to respond to and cope with changes. Accordingly, utilities of VGAM1727 include diagnosis, prevention and treatment of diseases and clinical conditions associated with CHI3L1. The function of CHI3L1 has been established by previous studies. The major function of articular chondrocytes in growing and maturing cartilage is the deposition and remodeling of the cartilage matrix. In adult cartilage, the matrix must be maintained rather than formed. Chondrocytes secrete a variety of proteins. One of the major secreted proteins of human articular chondrocytes in monolayer or explant culture is referred to as human cartilage glycoprotein-39 (HC gp-39). HC gp-39 is also known as YKL-40. The name 'YKL' refers to the sequence of the amino terminus of the protein. (See also YKL-39, 601526.) Hakala et al. (1993) purified HC gp-39 and determined the sequence of the cDNA. The protein is predicted to contain 383 amino acids, and has regions of similarity to several bacterial and fungal chitinases. HC gp-39 protein did not, however, possess any detectable chitinolytic activity. Hakala et al. (1993) found that expression of the GP39 gene by Northern blotting and RT-PCR was not restricted to chondrocytes. GP39 mRNA was detected in liver and human articular chondrocytes. Neither GP39 protein nor GP39 mRNA was detectable in normal newborn or adult human articular cartilage, but the mRNA was detected in cartilage obtained from patients with rheumatoid arthritis or at autopsy. By genomic sequence analysis, Rehli et al. (1997) determined that the CHI3L1 gene contains 10 exons and spans 8 kb. Primer extension and S1 nuclease protection analyses of the proximal promoter region identified transcriptional initiation sites 82 and 126 nucleotides upstream of the start codon.

Full details of the abovementioned studies are described in the following publications, the disclosure of which are hereby incorporated by reference:

Hakala, B. E.; White, C.; Recklies, A. D.: Human cartilage gp-39, a major secretory product of articular chondrocytes and synovial cells, is a mammalian member of a chitinase protein family. J. Biol. Chem. 268:25803-25810, 1993; and Rehli, M.; Krause, S. W.; Andreesen, R.: Molecular characterization of the gene for human cartilage gp-39 (CHI3L1), a member of the chitinase protein family and marker for late stages.

Further studies establishing the function and utilities of CHI3L1 are found in John Hopkins OMIM database record ID 601525, and in sited publications numbered 6533-6534 listed in the bibliography section hereinbelow, which are also hereby incorporated by reference. Nuclear Receptor Subfamily 2, Group E, Member 1 (NR2E1, Accession NM_003269) is another VGAM1727 host target gene. NR2E1 BINDING SITE is HOST TARGET binding site found in the 3' untranslated region of mRNA encoded by NR2E1, corresponding to a HOST TARGET binding site such as BINDING SITE I, BINDING SITE II or BINDING SITE III. Table 2 illustrates the complementarity of the nucleotide sequences of NR2E1 BINDING SITE, designated SEQ ID:9278, to the nucleotide sequence of VGAM1727 RNA, herein designated VGAM RNA, also designated SEQ ID:4438.

Another function of VGAM1727 is therefore inhibition of Nuclear Receptor Subfamily 2, Group E, Member 1 (NR2E1, Accession NM_003269), a gene which may be required for brain development and be involved in the regulation of retinal development. Accordingly, utilities of VGAM1727 include diagnosis, prevention and treatment of diseases and clinical conditions associated with NR2E1. The function of NR2E1 and its association with various diseases and clinical conditions, has been established by previous studies, as described hereinabove with reference to VGAM689. FLJ10392 (Accession NM_018084) is another VGAM1727 host target gene. FLJ10392 BINDING SITE is HOST TARGET binding site found in the 5' untranslated region of mRNA encoded by FLJ10392, corresponding to a HOST TARGET binding site such as BINDING SITE I, BINDING SITE II or BINDING SITE III. Table 2 illustrates the complementarity of the nucleotide sequences of FLJ10392 BINDING SITE, designated SEQ ID:19847, to the nucleotide sequence of VGAM1727 RNA, herein designated VGAM RNA, also designated SEQ ID:4438.

Another function of VGAM1727 is therefore inhibition of FLJ10392 (Accession NM_018084). Accordingly, utilities of VGAM1727 include diagnosis, prevention and treatment of diseases and clinical conditions associated with FLJ10392. FLJ23511 (Accession NM_032239) is another VGAM1727 host target gene. FLJ23511 BINDING SITE is HOST TARGET binding site found in the 3' untranslated region of mRNA encoded by FLJ23511, corresponding to a HOST TARGET binding site such as BINDING SITE I, BINDING SITE II or BINDING SITE III. Table 2 illustrates the complementarity of the nucleotide sequences of FLJ23511 BINDING SITE, designated SEQ ID:25963, to the nucleotide sequence of VGAM1727 RNA, herein designated VGAM RNA, also designated SEQ ID:4438.

Another function of VGAM1727 is therefore inhibition of FLJ23511 (Accession NM_032239). Accordingly, utilities of VGAM1727 include diagnosis, prevention and treatment of diseases and clinical conditions associated with FLJ23511. KIAA0527 (Accession XM_171054) is another VGAM1727 host target gene. KIAA0527 BINDING SITE is HOST TARGET binding site found in the 3' untranslated region of mRNA encoded by KIAA0527, corresponding to a HOST TARGET binding site such as BINDING SITE I, BINDING SITE II or BINDING SITE III. Table 2 illustrates the complementarity of the nucleotide sequences of KIAA0527 BINDING SITE, designated SEQ ID:45847, to the nucleotide sequence of VGAM1727 RNA, herein designated VGAM RNA, also designated SEQ ID:4438.

Another function of VGAM1727 is therefore inhibition of KIAA0527 (Accession XM_171054). Accordingly, utilities of VGAM1727 include diagnosis, prevention and treatment of diseases and clinical conditions associated with KIAA0527. FIG. 1 further provides a conceptual description of a novel bioinformatically detected viral gene of the present invention, referred to here as Viral Genomic Address Messenger 1728 (VGAM1728) viral gene, which modulates expression of respective host target genes thereof, the function and utility of which host target genes is known in the art.

VGAM1728 is a novel bioinformatically detected regulatory, non protein coding, viral micro RNA (miRNA) gene. The method by which VGAM1728 was detected is described hereinabove with reference to FIGS. 1-8.

VGAM1728 gene, herein designated VGAM GENE, is a viral gene contained in the genome of Rabies Virus. VGAM1728 host target gene, herein designated VGAM HOST TARGET GENE, is a human gene contained in the human genome.

VGAM1728 gene encodes a VGAM1728 precursor RNA, herein designated VGAM PRECURSOR RNA. Similar to other miRNA genes, and unlike most ordinary genes, VGAM1728 precursor RNA does not encode a protein. A nucleotide sequence identical or highly similar to the nucleotide sequence of VGAM1728 precursor RNA is designated SEQ ID:1714, and is provided hereinbelow with reference to the sequence listing part. Nucleotide sequence SEQ ID:1714 is located at position 4718 relative to the genome of Rabies Virus.

VGAM1728 precursor RNA folds onto itself, forming VGAM1728 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1728 folded precursor RNA into VGAM1728 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1728 RNA is designated SEQ ID:4439, and is provided hereinbelow with reference to the sequence listing part.

VGAM1728 host target gene, herein designated VGAM HOST TARGET GENE, encodes a corresponding messenger RNA, VGAM1728 host target RNA, herein designated VGAM HOST TARGET RNA. VGAM1728 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1728 RNA, herein designated VGAM RNA, binds complementarily to one or more host target binding sites located in untranslated regions of VGAM1728 host target RNA, herein designated VGAM HOST TARGET RNA. This complementary binding is due to the fact that the nucleotide sequence of VGAM1728 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1728 RNA, herein designated VGAM RNA, may have a different number of host target binding sites in untranslated regions of a VGAM1728 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1728 RNA, herein designated VGAM RNA, to host target binding sites on VGAM1728 host target RNA, herein designated VGAM HOST TARGET RNA, such as BINDING SITE I, BINDING SITE II and BINDING SITE III, inhibits translation of VGAM1728 host target RNA into VGAM1728 host target protein, herein designated VGAM HOST TARGET PROTEIN. VGAM host target protein is therefore outlined by a broken line.

It is appreciated that VGAM1728 host target gene, herein designated VGAM HOST TARGET GENE, in fact represents a plurality of VGAM1728 host target genes. The mRNA of each one of this plurality of VGAM1728 host target genes comprises one or more host target binding sites, each having a nucleotide sequence which is at least partly complementary to VGAM1728 RNA, herein designated VGAM RNA, and which when bound by VGAM1728 RNA causes inhibition of translation of respective one or more VGAM1728 host target proteins.

It is further appreciated by one skilled in the art that the mode of translational inhibition illustrated by FIG. 1 with specific reference to translational inhibition exerted by VGAM1728 gene, herein designated VGAM GENE, on one or more VGAM1728 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1728 is inhibition of expression of host target genes, as part of a novel viral mechanism of attacking a host. Accordingly, utilities of VGAM1728 include diagnosis, prevention and treatment of viral infection by Rabies Virus. Specific functions, and accordingly utilities, of VGAM1728 correlate with, and may be deduced from, the identity of the host target genes which VGAM1728 binds and inhibits, and the function of these host target genes, as elaborated hereinbelow.

Nucleotide sequences of the VGAM1728 precursor RNA, herein designated VGAM PRECURSOR RNA, and of the 'diced' VGAM1728 RNA, herein designated VGAM RNA, and a schematic representation of the secondary folding of VGAM1728 folded precursor RNA, herein designated VGAM FOLDED PRECURSOR RNA, of VGAM1728 are further described hereinbelow with reference to Table 1.

Nucleotide sequences of host target binding sites, such as BINDING SITE-I, BINDING SITE-II and BINDING SITE-III of FIG. 1, found on VGAM1728 host target RNA, and schematic representation of the complementarity of each of these host target binding sites to VGAM1728 RNA, herein designated VGAM RNA, are described hereinbelow with reference to Table 2.

As mentioned hereinabove with reference to FIG. 1, a function of VGAM1728 gene, herein designated VGAM is inhibition of expression of VGAM1728 target genes. It is appreciated that specific functions, and accordingly utilities, of VGAM1728 correlate with, and may be deduced from, the identity of the target genes which VGAM1728 binds and inhibits, and the function of these target genes, as elaborated hereinbelow.

ATPase, H+ Transporting, Lysosomal 13 kDa, V1 Subunit G Isoform 2 (ATP6V1G2, Accession NM_130463) is a VGAM1728 host target gene. ATP6V1G2 BINDING SITE1 and ATP6V1G2 BINDING SITE2 are HOST TARGET binding sites found in untranslated regions of mRNA encoded by ATP6V1G2, corresponding to HOST TARGET binding sites such as BINDING SITE I, BINDING SITE II or BINDING SITE III. Table 2 illustrates the complementarity of the nucleotide sequences of ATP6V1G2 BINDING SITE1 and ATP6V1G2 BINDING SITE2, designated SEQ ID:28223 and SEQ ID:28697 respectively, to the nucleotide sequence of VGAM1728 RNA, herein designated VGAM RNA, also designated SEQ ID:4439.

A function of VGAM1728 is therefore inhibition of ATPase, H+ Transporting, Lysosomal 13 kDa, V1 Subunit G Isoform 2 (ATP6V1G2, Accession NM_130463). Accordingly, utilities of VGAM1728 include diagnosis, prevention and treatment of diseases and clinical conditions associated with ATP6V1G2. FLJ11806 (Accession NM_024824) is another VGAM1728 host target gene. FLJ11806 BINDING SITE is HOST TARGET binding site found in the 5' untranslated region of mRNA encoded by FLJ11806, corresponding to a HOST TARGET binding site such as BINDING SITE I, BINDING SITE II or BINDING SITE III. Table 2 illustrates the complementarity of the nucleotide sequences of FLJ11806 BINDING SITE, designated SEQ ID:24215, to the nucleotide sequence of VGAM1728 RNA, herein designated VGAM RNA, also designated SEQ ID:4439.

Another function of VGAM1728 is therefore inhibition of FLJ11806 (Accession NM_024824). Accordingly, utilities of VGAM1728 include diagnosis, prevention and treatment of diseases and clinical conditions associated with FLJ11806. FLJ22055 (Accession NM_024779) is another VGAM1728 host target gene. FLJ22055 BINDING SITE is HOST TARGET binding site found in the 3' untranslated region of mRNA encoded by FLJ22055, corresponding to a HOST TARGET binding site such as BINDING SITE I, BINDING SITE II or BINDING SITE III. Table 2 illustrates the complementarity of the nucleotide sequences of FLJ22055 BIND- ING SITE, designated SEQ ID:24146, to the nucleotide sequence of VGAM1728 RNA, herein designated VGAM RNA, also designated SEQ ID:4439.

Another function of VGAM1728 is therefore inhibition of FLJ22055 (Accession NM_024779). Accordingly, utilities of VGAM1728 include diagnosis, prevention and treatment of diseases and clinical conditions associated with FLJ22055. KIAA0960 (Accession XM_166543) is another VGAM1728 host target gene. KIAA0960 BINDING SITE is HOST TARGET binding site found in the 3' untranslated region of mRNA encoded by KIAA0960, corresponding to a HOST TARGET binding site such as BINDING SITE I, BINDING SITE II or BINDING SITE III. Table 2 illustrates the complementarity of the nucleotide sequences of KIAA0960 BINDING SITE, designated SEQ ID:44515, to the nucleotide sequence of VGAM1728 RNA, herein designated VGAM RNA, also designated SEQ ID:4439.

Another function of VGAM1728 is therefore inhibition of KIAA0960 (Accession XM_166543). Accordingly, utilities of VGAM1728 include diagnosis, prevention and treatment of diseases and clinical conditions associated with KIAA0960. KIAA1922 (Accession XM_057040) is another VGAM1728 host target gene. KIAA1922 BINDING SITE is HOST TARGET binding site found in the 3' untranslated region of mRNA encoded by KIAA1922, corresponding to a HOST TARGET binding site such as BINDING SITE I, BINDING SITE II or BINDING SITE III. Table 2 illustrates the complementarity of the nucleotide sequences of KIAA1922 BINDING SITE, designated SEQ ID:36461, to the nucleotide sequence of VGAM1728 RNA, herein designated VGAM RNA, also designated SEQ ID:4439.

Another function of VGAM1728 is therefore inhibition of KIAA1922 (Accession XM_057040). Accordingly, utilities of VGAM1728 include diagnosis, prevention and treatment of diseases and clinical conditions associated with KIAA1922. MIC2 Like 1 (MIC2L1, Accession NM_031462) is another VGAM1728 host target gene. MIC2L1 BINDING SITE is HOST TARGET binding site found in the 3' untranslated region of mRNA encoded by MIC2L1, corresponding to a HOST TARGET binding site such as BINDING SITE I, BINDING SITE II or BINDING SITE III. Table 2 illustrates the complementarity of the nucleotide sequences of MIC2L1 BINDING SITE, designated SEQ ID:25492, to the nucleotide sequence of VGAM1728 RNA, herein designated VGAM RNA, also designated SEQ ID:4439.

Another function of VGAM1728 is therefore inhibition of MIC2 Like 1 (MIC2L1, Accession NM_031462). Accordingly, utilities of VGAM1728 include diagnosis, prevention and treatment of diseases and clinical conditions associated with MIC2L1. PXR2b (Accession NM_016559) is another VGAM1728 host target gene. PXR2b BINDING SITE is HOST TARGET binding site found in the 3' untranslated region of mRNA encoded by PXR2b, corresponding to a HOST TARGET binding site such as BINDING SITE I, BINDING SITE II or BINDING SITE III. Table 2 illustrates the complementarity of the nucleotide sequences of PXR2b BINDING SITE, designated SEQ ID:18634, to the nucleotide sequence of VGAM1728 RNA, herein designated VGAM RNA, also designated SEQ ID:4439.

Another function of VGAM1728 is therefore inhibition of PXR2b (Accession NM_016559). Accordingly, utilities of VGAM1728 include diagnosis, prevention and treatment of diseases and clinical conditions associated with PXR2b. LOC206426 (Accession XM_116505) is another VGAM1728 host target gene. LOC206426 BINDING SITE is HOST TARGET binding site found in the 5' untranslated region of mRNA encoded by LOC206426, corresponding to a HOST TARGET binding site such as BINDING SITE I, BINDING SITE II or BINDING SITE III. Table 2 illustrates the complementarity of the nucleotide sequences of LOC206426 BINDING SITE, designated SEQ ID:43116, to the nucleotide sequence of VGAM1728 RNA, herein designated VGAM RNA, also designated SEQ ID:4439.

Another function of VGAM1728 is therefore inhibition of LOC206426 (Accession XM_116505). Accordingly, utilities of VGAM1728 include diagnosis, prevention and treatment of diseases and clinical conditions associated with LOC206426. LOC92935 (Accession XM_048197) is another VGAM1728 host target gene. LOC92935 BINDING SITE is HOST TARGET binding site found in the 3' untranslated region of mRNA encoded by LOC92935, corresponding to a HOST TARGET binding site such as BINDING SITE I, BINDING SITE II or BINDING SITE III. Table 2 illustrates the complementarity of the nucleotide sequences of LOC92935 BINDING SITE, designated SEQ ID:35130, to the nucleotide sequence of VGAM1728 RNA, herein designated VGAM RNA, also designated SEQ ID:4439.

Another function of VGAM1728 is therefore inhibition of LOC92935 (Accession XM_048197). Accordingly, utilities of VGAM1728 include diagnosis, prevention and treatment of diseases and clinical conditions associated with LOC92935. FIG. 1 further provides a conceptual description of a novel bioinformatically detected viral gene of the present invention, referred to here as Viral Genomic Address Messenger 1729 (VGAM1729) viral gene, which modulates expression of respective host target genes thereof, the function and utility of which host target genes is known in the art.

VGAM1729 is a novel bioinformatically detected regulatory, non protein coding, viral micro RNA (miRNA) gene. The method by which VGAM1729 was detected is described hereinabove with reference to FIGS. 1-8.

VGAM1729 gene, herein designated VGAM GENE, is a viral gene contained in the genome of Rabies Virus. VGAM1729 host target gene, herein designated VGAM HOST TARGET GENE, is a human gene contained in the human genome.

VGAM1729 gene encodes a VGAM1729 precursor RNA, herein designated VGAM PRECURSOR RNA. Similar to other miRNA genes, and unlike most ordinary genes, VGAM1729 precursor RNA does not encode a protein. A nucleotide sequence identical or highly similar to the nucleotide sequence of VGAM1729 precursor RNA is designated SEQ ID:1715, and is provided hereinbelow with reference to the sequence listing part. Nucleotide sequence SEQ ID:1715 is located at position 8293 relative to the genome of Rabies Virus.

VGAM1729 precursor RNA folds onto itself, forming VGAM1729 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1729 folded precursor RNA into VGAM1729 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM1729 RNA is designated SEQ ID:4440, and is provided hereinbelow with reference to the sequence listing part.

VGAM1729 host target gene, herein designated VGAM HOST TARGET GENE, encodes a corresponding messenger RNA, VGAM1729 host target RNA, herein designated VGAM HOST TARGET RNA. VGAM1729 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1729 RNA, herein designated VGAM RNA, binds complementarily to one or more host target binding sites located in untranslated regions of VGAM1729 host target RNA, herein designated VGAM HOST TARGET RNA. This complementary binding is due to the fact that the nucleotide sequence of VGAM1729 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1729 RNA, herein designated VGAM RNA, may have a different number of host target binding sites in untranslated regions of a VGAM1729 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1729 RNA, herein designated VGAM RNA, to host target binding sites on VGAM1729 host target RNA, herein designated VGAM HOST TARGET RNA, such as BINDING SITE I, BINDING SITE II and BINDING SITE III, inhibits translation of VGAM1729 host target RNA into VGAM1729 host target protein, herein designated VGAM HOST TARGET PROTEIN. VGAM host target protein is therefore outlined by a broken line.

It is appreciated that VGAM1729 host target gene, herein designated VGAM HOST TARGET GENE, in fact represents a plurality of VGAM1729 host target genes. The mRNA of each one of this plurality of VGAM1729 host target genes comprises one or more host target binding sites, each having a nucleotide sequence which is at least partly complementary to VGAM1729 RNA, herein designated VGAM RNA, and which when bound by VGAM1729 RNA causes inhibition of translation of respective one or more VGAM1729 host target proteins.

It is further appreciated by one skilled in the art that the mode of translational inhibition illustrated by FIG. 1 with specific reference to translational inhibition exerted by VGAM1729 gene, herein designated VGAM GENE, on one or more VGAM1729 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1729 is inhibition of expression of host target genes, as part of a novel viral mechanism of attacking a host. Accordingly, utilities of VGAM1729 include diagnosis, prevention and treatment of viral infection by Rabies Virus. Specific functions, and accordingly utilities, of VGAM1729 correlate with, and may be deduced from, the identity of the host target genes which VGAM1729 binds and inhibits, and the function of these host target genes, as elaborated hereinbelow.

Nucleotide sequences of the VGAM1729 precursor RNA, herein designated VGAM PRECURSOR RNA, and of the 'diced' VGAM1729 RNA, herein designated VGAM RNA, and a schematic representation of the secondary folding of VGAM1729 folded precursor RNA, herein designated VGAM FOLDED PRECURSOR RNA, of VGAM1729 are further described hereinbelow with reference to Table 1.

Nucleotide sequences of host target binding sites, such as BINDING SITE-I, BINDING SITE-II and BINDING SITE-III of FIG. 1, found on VGAM1729 host target RNA, and schematic representation of the complementarity of each of these host target binding sites to VGAM1729 RNA, herein designated VGAM RNA, are described hereinbelow with reference to Table 2.

As mentioned hereinabove with reference to FIG. 1, a function of VGAM1729 gene, herein designated VGAM is inhibition of expression of VGAM1729 target genes. It is appreciated that specific functions, and accordingly utilities, of VGAM1729 correlate with, and may be deduced from, the identity of the target genes which VGAM1729 binds and inhibits, and the function of these target genes, as elaborated hereinbelow.

Melanoma Antigen, Family C, 1 (MAGEC1, Accession NM_005462) is a VGAM1729 host target gene. MAGEC1 BINDING SITE is HOST TARGET binding site found in the 5' untranslated region of mRNA encoded by MAGEC1, corresponding to a HOST TARGET binding site such as BINDING SITE I, BINDING SITE II or BINDING SITE III. Table 2 illustrates the complementarity of the nucleotide sequences of MAGEC1 BINDING SITE, designated SEQ ID:11945, to the nucleotide sequence of VGAM1729 RNA, herein designated VGAM RNA, also designated SEQ ID:4440.

A function of VGAM1729 is therefore inhibition of Melanoma Antigen, Family C, 1 (MAGEC1, Accession NM_005462), a gene which is a member of the MAGE family C. Accordingly, utilities of VGAM1729 include diagnosis, prevention and treatment of diseases and clinical conditions associated with MAGEC1. The function of MAGEC1 has been established by previous studies. Members of the MAGE (see OMIM Ref. No. MAGEA1, 300016), BAGE (OMIM Ref. No. 605167), and GAGE (see OMIM Ref. No. 604244) gene families are expressed in tumor cells and male germline cells and encode antigens recognized by cytotoxic T lymphocytes. These antigens are also known as CT antigens (see OMIM Ref. No. 300156) for their expression in cancer cells and testis. Lucas et al. (1998) used representational difference analysis to identify new CT antigen genes. They isolated a cDNA fragment showing homology to MAGE family genes. The fragment was used to isolate a full-length cDNA clone from an melanoma cell cDNA library. The MAGEC1 cDNA predicts a protein of 1,142 amino acids. MAGEC1 is 800 amino acids longer than other MAGE proteins due to the insertion of a large number of short repetitive sequences. RT-PCR analysis showed expression of MAGEC1 in tumors of a wide variety of histologic types, but expression was not seen in normal tissues, with the exception of testis. Lucas et al. (1998) determined that the MAGEC1 gene contains 4 exons and spans over 6 kb. Chen et al. (1998) screened an expression cDNA library constructed from a melanoma cell line with an allogeneic melanoma patient serum known to contain antibodies against CT antigens. They isolated a cDNA encoding a new CT antigen, CT7, the sequence of which was more than 99% identical to that of MAGEC1 in the coding region.

Full details of the abovementioned studies are described in the following publications, the disclosure of which are hereby incorporated by reference:

Chen, Y.-T.; Gure, A. O.; Tsang, S.; Stockert, E.; Jager, E.; Knuth, A.; Old, L. J.: Identification of multiple cancer/testis antigens by allogeneic antibody screening of a melanoma cell line library. Proc. Nat. Acad. Sci. 95:6919-6923, 1998; and Lucas, S.; De Smet, C.; Arden, K. C.; Viars, C. S.; Lethe, B.; Lurquin, C.; Boon, T.: Identification of a new MAGE gene with tumor-specific expression by representational difference ana.

Further studies establishing the function and utilities of MAGEC1 are found in John Hopkins OMIM database record ID 300223, and in sited publications numbered 8802-8803 listed in the bibliography section hereinbelow, which are also hereby incorporated by reference. Vinculin (VCL, Accession NM_003373) is another VGAM1729 host target gene. VCL BINDING SITE1 and VCL BINDING SITE2 are HOST TARGET binding sites found in untranslated regions of mRNA encoded by VCL, corresponding to HOST TARGET binding sites such as BINDING SITE I, BINDING SITE II or BINDING SITE III. Table 2 illustrates the complementarity of the nucleotide sequences of VCL BINDING SITE1 and VCL BINDING SITE2, designated SEQ ID:9405 and SEQ ID:15194 respectively, to the nucleotide sequence of VGAM1729 RNA, herein designated VGAM RNA, also designated SEQ ID:4440.

Another function of VGAM1729 is therefore inhibition of Vinculin (VCL, Accession NM_003373). Accordingly, utilities of VGAM1729 include diagnosis, prevention and treatment of diseases and clinical conditions associated with VCL. KIAA1161 (Accession XM_088501) is another VGAM1729 host target gene. KIAA1161 BINDING SITE is HOST TARGET binding site found in the 3' untranslated region of mRNA encoded by KIAA1161, corresponding to a HOST TARGET binding site such as BINDING SITE I, BINDING SITE II or BINDING SITE III. Table 2 illustrates the complementarity of the nucleotide sequences of KIAA1161 BINDING SITE, designated SEQ ID:39756, to the nucleotide sequence of VGAM1729 RNA, herein designated VGAM RNA, also designated SEQ ID:4440.

Another function of VGAM1729 is therefore inhibition of KIAA1161 (Accession XM_088501). Accordingly, utilities of VGAM1729 include diagnosis, prevention and treatment of diseases and clinical conditions associated with KIAA1161. FIG. 1 further provides a conceptual description of a novel bioinformatically detected viral gene of the present invention, referred to here as Viral Genomic Address Messenger 1730 (VGAM1730) viral gene, which modulates expression of respective host target genes thereof, the function and utility of which host target genes is known in the art.

VGAM1730 is a novel bioinformatically detected regulatory, non protein coding, viral micro RNA (miRNA) gene. The method by which VGAM1730 was detected is described hereinabove with reference to FIGS. 1-8.

VGAM1730 gene, herein designated VGAM GENE, is a viral gene contained in the genome of Rabies Virus. VGAM1730 host target gene, herein designated VGAM HOST TARGET GENE, is a human gene contained in the human genome.

VGAM1730 gene encodes a VGAM1730 precursor RNA, herein designated VGAM PRECURSOR RNA. Similar to other miRNA genes, and unlike most ordinary genes, VGAM1730 precursor RNA does not encode a protein. A nucleotide sequence identical or highly similar to the nucleotide sequence of VGAM1730 precursor RNA is designated SEQ ID:1716, and is provided hereinbelow with reference to the sequence listing part. Nucleotide sequence SEQ ID:1716 is located at position 6659 relative to the genome of Rabies Virus.

VGAM1730 precursor RNA folds onto itself, forming VGAM1730 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1730 folded precursor RNA into VGAM1730 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1730 RNA is designated SEQ ID:4441, and is provided hereinbelow with reference to the sequence listing part.

VGAM1730 host target gene, herein designated VGAM HOST TARGET GENE, encodes a corresponding messenger RNA, VGAM1730 host target RNA, herein designated VGAM HOST TARGET RNA. VGAM1730 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1730 RNA, herein designated VGAM RNA, binds complementarily to one or more host target binding sites located in untranslated regions of VGAM1730 host target RNA, herein designated VGAM HOST TARGET RNA. This complementary binding is due to the fact that the nucleotide sequence of VGAM1730 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1730 RNA, herein designated VGAM RNA, may have a different number of host target binding sites in untranslated regions of a VGAM1730 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1730 RNA, herein designated VGAM RNA, to host target binding sites on VGAM1730 host target RNA, herein designated VGAM HOST TARGET RNA, such as BINDING SITE I, BINDING SITE II and BINDING SITE III, inhibits translation of VGAM1730 host target RNA into VGAM1730 host target protein, herein designated VGAM HOST TARGET PRO- TEIN. VGAM host target protein is therefore outlined by a broken line.

It is appreciated that VGAM1730 host target gene, herein designated VGAM HOST TARGET GENE, in fact represents a plurality of VGAM1730 host target genes. The mRNA of each one of this plurality of VGAM1730 host target genes comprises one or more host target binding sites, each having a nucleotide sequence which is at least partly complementary to VGAM1730 RNA, herein designated VGAM RNA, and which when bound by VGAM1730 RNA causes inhibition of translation of respective one or more VGAM1730 host target proteins.

It is further appreciated by one skilled in the art that the mode of translational inhibition illustrated by FIG. 1 with specific reference to translational inhibition exerted by VGAM1730 gene, herein designated VGAM GENE, on one or more VGAM1730 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1730 is inhibition of expression of host target genes, as part of a novel viral mechanism of attacking a host. Accordingly, utilities of VGAM1730 include diagnosis, prevention and treatment of viral infection by Rabies Virus. Specific functions, and accordingly utilities, of VGAM1730 correlate with, and may be deduced from, the identity of the host target genes which VGAM1730 binds and inhibits, and the function of these host target genes, as elaborated hereinbelow.

Nucleotide sequences of the VGAM1730 precursor RNA, herein designated VGAM PRECURSOR RNA, and of the 'diced' VGAM1730 RNA, herein designated VGAM RNA, and a schematic representation of the secondary folding of VGAM1730 folded precursor RNA, herein designated VGAM FOLDED PRECURSOR RNA, of VGAM1730 are further described hereinbelow with reference to Table 1.

Nucleotide sequences of host target binding sites, such as BINDING SITE-I, BINDING SITE-II and BINDING SITE-III of FIG. 1, found on VGAM1730 host target RNA, and schematic representation of the complementarity of each of these host target binding sites to VGAM1730 RNA, herein designated VGAM RNA, are described hereinbelow with reference to Table 2.

As mentioned hereinabove with reference to FIG. 1, a function of VGAM1730 gene, herein designated VGAM is inhibition of expression of VGAM1730 target genes. It is appreciated that specific functions, and accordingly utilities, of VGAM1730 correlate with, and may be deduced from, the identity of the target genes which VGAM1730 binds and inhibits, and the function of these target genes, as elaborated hereinbelow.

Cadherin 18, Type 2 (CDH18, Accession NM_004934) is a VGAM1730 host target gene. CDH18 BINDING SITE is HOST TARGET binding site found in the 5' untranslated region of mRNA encoded by CDH18, corresponding to a HOST TARGET binding site such as BINDING SITE I, BINDING SITE II or BINDING SITE III. Table 2 illustrates the complementarity of the nucleotide sequences of CDH18 BINDING SITE, designated SEQ ID:11380, to the nucleotide sequence of VGAM1730 RNA, herein designated VGAM RNA, also designated SEQ ID:4441.

A function of VGAM1730 is therefore inhibition of Cadherin 18, Type 2 (CDH18, Accession NM_004934), a gene which mediates neural cell-cell interactions and may play an important role in neural development. Accordingly, utilities of VGAM1730 include diagnosis, prevention and treatment of diseases and clinical conditions associated with CDH18. The function of CDH18 has been established by previous studies. To isolate cDNAs encoding proteins that interact with beta-catenin, Shibata et al. (1997) screened a human adult brain cDNA expression library with recombinant beta-catenin protein. They identified a cDNA with high sequence homology to cadherin molecules and designated it cadherin-14 (CDH14), which has been renamed cadherin-18 (CDH18). Comparison of the deduced 790-amino acid CDH18 sequence with the sequences of other cadherins revealed that CDH18 is more closely related to type 2 cadherins than to type 1 cadherins, with the N-terminal regions of CDH18 and CDH12 (OMIM Ref. No. 600562) showing particularly high amino acid similarity. Northern blot analysis of human tissues detected 9.7-, 5.5-, and 3.9-kb CDH18 transcripts specifically in the central nervous system; CDH18 expression was also found in small-cell lung carcinoma cell lines, which have neuroectodermal cell phenotypes Full details of the abovementioned studies are described in the following publications, the disclosure of which are hereby incorporated by reference:

Chalmers, I. J.; Hofler, H.; Atkinson, M. J.: Mapping of a cadherin gene cluster to a region of chromosome 5 subject to frequent allelic loss in carcinoma. Genomics 57:160-163, 1999; and Shibata, T.; Shimoyama, Y.; Gotoh, M.; Hirohashi, S.: Identification of human cadherin-14, a novel neurally specific type II cadherin, by protein interaction cloning. J. Biol. Chem. 2.

Further studies establishing the function and utilities of CDH18 are found in John Hopkins OMIM database record ID 603019, and in sited publications numbered 587 and 8014 listed in the bibliography section hereinbelow, which are also hereby incorporated by reference. COX15 Homolog, Cytochrome C Oxidase Assembly Protein (yeast) (COX15, Accession NM_078470) is another VGAM1730 host target gene. COX15 BINDING SITE is HOST TARGET binding site found in the 3' untranslated region of mRNA encoded by COX15, corresponding to a HOST TARGET binding site such as BINDING SITE I, BINDING SITE II or BINDING SITE III. Table 2 illustrates the complementarity of the nucleotide sequences of COX15 BINDING SITE, designated SEQ ID:27794, to the nucleotide sequence of VGAM1730 RNA, herein designated VGAM RNA, also designated SEQ ID:4441.

Another function of VGAM1730 is therefore inhibition of COX15 Homolog, Cytochrome C Oxidase Assembly Protein (yeast) (COX15, Accession NM_078470). Accordingly, utilities of VGAM1730 include diagnosis, prevention and treatment of diseases and clinical conditions associated with COX15. Dihydropyrimidinase-like 3 (DPYSL3, Accession NM_001387) is another VGAM1730 host target gene. DPYSL3 BINDING SITE is HOST TARGET binding site found in the 3' untranslated region of mRNA encoded by DPYSL3, corresponding to a HOST TARGET binding site such as BINDING SITE I, BINDING SITE II or BINDING SITE III. Table 2 illustrates the complementarity of the nucleotide sequences of DPYSL3 BINDING SITE, designated SEQ ID:7074, to the nucleotide sequence of VGAM1730

RNA, herein designated VGAM RNA, also designated SEQ ID:4441.

Another function of VGAM1730 is therefore inhibition of Dihydropyrimidinase-like 3 (DPYSL3, Accession NM_001387), a gene which is a member of the dihydropyrimidinase family. Accordingly, utilities of VGAM1730 include diagnosis, prevention and treatment of diseases and clinical conditions associated with DPYSL3. The function of DPYSL3 and its association with various diseases and clinical conditions, has been established by previous studies, as described hereinabove with reference to VGAM24. Estrogen Receptor 1 (ESR1, Accession NM_000125) is another VGAM1730 host target gene. ESR1 BINDING SITE is HOST TARGET binding site found in the 3' untranslated region of mRNA encoded by ESR1, corresponding to a HOST TARGET binding site such as BINDING SITE I, BINDING SITE II or BINDING SITE III. Table 2 illustrates the complementarity of the nucleotide sequences of ESR1 BINDING SITE, designated SEQ ID:5601, to the nucleotide sequence of VGAM1730 RNA, herein designated VGAM RNA, also designated SEQ ID:4441.

Another function of VGAM1730 is therefore inhibition of Estrogen Receptor 1 (ESR1, Accession NM_000125), a gene which involved in hormone-mediated inhibition of gene expression. Accordingly, utilities of VGAM1730 include diagnosis, prevention and treatment of diseases and clinical conditions associated with ESR1. The function of ESR1 and its association with various diseases and clinical conditions, has been established by previous studies, as described hereinabove with reference to VGAM695. Klotho (KL, Accession NM_004795) is another VGAM1730 host target gene. KL BINDING SITE is HOST TARGET binding site found in the 3' untranslated region of mRNA encoded by KL, corresponding to a HOST TARGET binding site such as BINDING SITE I, BINDING SITE II or BINDING SITE III. Table 2 illustrates the complementarity of the nucleotide sequences of KL BINDING SITE, designated SEQ ID:11204, to the nucleotide sequence of VGAM1730 RNA, herein designated VGAM RNA, also designated SEQ ID:4441.

Another function of VGAM1730 is therefore inhibition of Klotho (KL, Accession NM_004795), a gene which has similarity to beta-glucosidases. Accordingly, utilities of VGAM1730 include diagnosis, prevention and treatment of diseases and clinical conditions associated with KL. The function of KL has been established by previous studies. In a population-based association study, Arking et al. (2002) determined that allele 17 of microsatellite marker 1, which is 11 kb 3-prime of the last exon of the KL gene, is significantly more prevalent in Bohemian Czech newborns than in individuals more than 75 years old, independent of sex and health status. SSCP analysis identified another KL allele, which the authors termed KL-VS, defined by the presence of 6 single-nucleotide polymorphisms (SNPs) in an 800-bp region spanning exon 2 and flanking sequence. Allele-specific oligonucleotide hybridization analysis showed complete linkage disequilibrium for the coding region mutations. Of the 3 mutations in exon 2, 1 is silent and 2 encode amino acid changes, phe352 to val (F352V) and cys370 to ser (C370S). The F352V mutation occurs at a completely conserved amino acid. Genotype analysis indicated that heterozygosity for F352V is significantly more prevalent in elderly Bohemians than in newborns, while homozygosity for V352, which is rare, is more prevalent in newborns. Kaplan-Meier survival analysis revealed that the heterozygote advantage promotes not only survival but also longevity (OMIM Ref. No. 152430) in elderly individuals more than 80 years old. Analysis of Caucasians and African Americans in Baltimore did not detect a heterozygote advantage for F352V, but did find decreased V352 homozygosity in the elderly. Western blot analysis of expression of the V352, S370, V352/S370, and wildtype alleles in HeLa cells or fibroblasts showed enhanced secretion of S370 mutant and decreased secretion of V352 variant compared with the 65-kD wildtype protein. The double mutant was secreted at intermediate levels, and the V352 mutant was most abundant intracellularly, suggesting a KL secretion defect. Functional analysis of a KL paralog, cytosolic beta-glucosidase (CBGL1; 606619), which has a known substrate, p-nitrophenyl-beta-D-glucoside, established that a mutation (F289V) at the position in CBGL1 corresponding to KL F352V results in a complete loss of ability to cleave the substrate. Arking et al. (2002) concluded that the KL-VS mutation impairs the trafficking and catalytic activity of KL, which may in turn contribute to differences in the onset and severity of age-related phenotypes. They also suggested that additional deleterious mutations remained to be identified, since KL-VS is found on multiple marker allele haplotypes and is negatively associated with marker 1 allele 17 Animal model experiments lend further support to the function of KL. Mori et al. (2000) showed that klotho mice had a barely detectable amount of white adipose tissue, whereas brown adipose tissue (BAT) was comparably preserved. Although klotho mice consumed as much food as wildtype mice when normalized for body weight, they exhibited changes in parameters for energy homeostasis similar to those found under food-restricted conditions. The klotho mice had increased glucose tolerance and insulin sensitivity, as well as increased hepatic Pepck (OMIM Ref. No. 261680) expression. Levels of uncoupling protein-1 (UCP1; 113730) and body temperature were significantly lower in klotho mice. Histologic analysis demonstrated lower glycogen, insulin, and lipid in the liver, pancreas, and BAT, respectively It is appreciated that the abovementioned animal model for KL is acknowledged by those skilled in the art as a scientifically valid animal model, as can be further appreciated from the publications sited hereinbelow.

Full details of the abovementioned studies are described in the following publications, the disclosure of which are hereby incorporated by reference:

Mori, K.; Yahata, K.; Mukoyama, M.; Suganami, T.; Makino, H.; Nagae, T.; Masuzaki, H.; Ogawa, Y.; Sugawara, A.; Nabeshima, Y.; Nakao, K.: Disruption of klotho gene causes an abnormal energy homeostasis in mice. Biochem. Biophys. Res. Commun. 278:665-670, 2000; and Arking, D. E.; Krebsova, A.; Macek, M., Sr.; Macek, M., Jr.; Arking, A.; Mian, I. S.; Fried, L.; Hamosh, A.; Dey, S.; McIntosh, I.; Dietz, H. C.: Association of human aging with a func.

Further studies establishing the function and utilities of KL are found in John Hopkins OMIM database record ID 604824, and in sited publications numbered 5019-5024 listed in the bibliography section hereinbelow, which are also hereby incorporated by reference. Myeloid Cell Leukemia Sequence 1 (BCL2-related) (MCL1, Accession NM_021960) is another VGAM1730 host target gene. MCL1 BINDING SITE is HOST TARGET binding site found in the 3' untranslated region of mRNA encoded by MCL1, corresponding to a HOST TARGET binding site such as BINDING SITE I, BINDING SITE II or BINDING SITE III. Table 2 illustrates the complementarity of the nucleotide sequences of MCL1 BINDING SITE, designated SEQ ID:22490, to the nucleotide sequence of VGAM1730 RNA, herein designated VGAM RNA, also designated SEQ ID:4441.

Another function of VGAM1730 is therefore inhibition of Myeloid Cell Leukemia Sequence 1 (BCL2-related) (MCL1, Accession NM_021960), a gene which involved in programming of differentiation and concomitant maintenance of viability. Accordingly, utilities of VGAM1730 include diagnosis, prevention and treatment of diseases and clinical conditions associated with MCL1. The function of MCL1 and its association with various diseases and clinical conditions, has been established by previous studies, as described hereinabove with reference to VGAM1083. Mannosyl (alpha-1,3-)-glycoprotein Beta-1,2-N-acetylglucosaminyltransferase (MGAT1, Accession NM_002406) is another VGAM1730 host target gene. MGAT1 BINDING SITE is HOST TARGET binding site found in the 3' untranslated region of mRNA encoded by MGAT1, corresponding to a HOST TARGET binding site such as BINDING SITE I, BINDING SITE II or BINDING SITE III. Table 2 illustrates the complementarity of the nucleotide sequences of MGAT1 BINDING SITE, designated SEQ ID:8229, to the nucleotide sequence of VGAM1730 RNA, herein designated VGAM RNA, also designated SEQ ID:4441.

Another function of VGAM1730 is therefore inhibition of Mannosyl (alpha-1,3-)-glycoprotein Beta-1,2-N-acetylglucosaminyltransferase (MGAT1, Accession NM_002406), a gene which exists as a single protein-encoding exon. Accordingly, utilities of VGAM1730 include diagnosis, prevention and treatment of diseases and clinical conditions associated with MGAT1. The function of MGAT1 and its association with various diseases and clinical conditions, has been established by previous studies, as described hereinabove with reference to VGAM165. Mannosyl (alpha-1,6-)-glycoprotein Beta-1,2-N-acetylglucosaminyltransferase (MGAT2, Accession NM_002408) is another VGAM1730 host target gene. MGAT2 BINDING SITE is HOST TARGET binding site found in the 3' untranslated region of mRNA encoded by MGAT2, corresponding to a HOST TARGET binding site such as BINDING SITE I, BINDING SITE II or BINDING SITE III. Table 2 illustrates the complementarity of the nucleotide sequences of MGAT2 BINDING SITE, designated SEQ ID:8235, to the nucleotide sequence of VGAM1730 RNA, herein designated VGAM RNA, also designated SEQ ID:4441.

Another function of VGAM1730 is therefore inhibition of Mannosyl (alpha-1,6-)-glycoprotein Beta-1,2-N-acetylglucosaminyltransferase (MGAT2, Accession NM_002408). Accordingly, utilities of VGAM1730 include diagnosis, prevention and treatment of diseases and clinical conditions associated with MGAT2. SET Translocation (myeloid leukemia-associated) (SET, Accession NM_003011) is another VGAM1730 host target gene. SET BINDING SITE is HOST TARGET binding site found in the 3' untranslated region of mRNA encoded by SET, corresponding to a HOST TARGET binding site such as BINDING SITE I, BINDING SITE II or BINDING SITE III. Table 2 illustrates the complementarity of the nucleotide sequences of SET BINDING SITE, designated SEQ ID:8923, to the nucleotide sequence of VGAM1730 RNA, herein designated VGAM RNA, also designated SEQ ID:4441.

Another function of VGAM1730 is therefore inhibition of SET Translocation (myeloid leukemia-associated) (SET, Accession NM_003011). Accordingly, utilities of VGAM1730 include diagnosis, prevention and treatment of diseases and clinical conditions associated with SET. Angiomotin Like 1 (AMOTL1, Accession XM_057045) is another VGAM1730 host target gene. AMOTL1 BINDING SITE is HOST TARGET binding site found in the 3' untranslated region of mRNA encoded by AMOTL1, corresponding to a HOST TARGET binding site such as BINDING SITE I, BINDING SITE II or BINDING SITE III. Table 2 illustrates the complementarity of the nucleotide sequences of AMOTL1 BINDING SITE, designated SEQ ID:36470, to the nucleotide sequence of VGAM1730 RNA, herein designated VGAM RNA, also designated SEQ ID:4441.

Another function of VGAM1730 is therefore inhibition of Angiomotin Like 1 (AMOTL1, Accession XM_057045). Accordingly, utilities of VGAM1730 include diagnosis, prevention and treatment of diseases and clinical conditions associated with AMOTL1. FLJ10901 (Accession NM_018265) is another VGAM1730 host target gene. FLJ10901 BINDING SITE is HOST TARGET binding site found in the 3' untranslated region of mRNA encoded by FLJ10901, corresponding to a HOST TARGET binding site such as BINDING SITE I, BINDING SITE II or BINDING SITE III. Table 2 illustrates the complementarity of the nucleotide sequences of FLJ10901 BINDING SITE, designated SEQ ID:20233, to the nucleotide sequence of VGAM1730 RNA, herein designated VGAM RNA, also designated SEQ ID:4441.

Another function of VGAM1730 is therefore inhibition of FLJ10901 (Accession NM_018265). Accordingly, utilities of VGAM1730 include diagnosis, prevention and treatment of diseases and clinical conditions associated with FLJ10901. Nuclear Transcription Factor, X-box Binding 1 (NFX1, Accession NM_002504) is another VGAM1730 host target gene. NFX1 BINDING SITE is HOST TARGET binding site found in the 3' untranslated region of mRNA encoded by NFX1, corresponding to a HOST TARGET binding site such as BINDING SITE I, BINDING SITE II or BINDING SITE III. Table 2 illustrates the complementarity of the nucleotide sequences of NFX1 BINDING SITE, designated SEQ ID:8328, to the nucleotide sequence of VGAM1730 RNA, herein designated VGAM RNA, also designated SEQ ID:4441.

Another function of VGAM1730 is therefore inhibition of Nuclear Transcription Factor, X-box Binding 1 (NFX1, Accession NM_002504). Accordingly, utilities of VGAM1730 include diagnosis, prevention and treatment of diseases and clinical conditions associated with NFX1. PRO1914 (Accession NM_014106) is another VGAM1730 host target gene. PRO1914 BINDING SITE is HOST TARGET binding site found in the 5' untranslated region of mRNA encoded by PRO1914, corresponding to a HOST TARGET binding site such as BINDING SITE I, BINDING SITE II or BINDING SITE III. Table 2 illustrates the complementarity of the nucleotide sequences of PRO1914 BINDING SITE, designated SEQ ID:15330, to the nucleotide sequence of VGAM1730 RNA, herein designated VGAM RNA, also designated SEQ ID:4441.

Another function of VGAM1730 is therefore inhibition of PRO1914 (Accession NM_014106). Accordingly, utilities of VGAM1730 include diagnosis, prevention and treatment of diseases and clinical conditions associated with PRO1914. PRO2000 (Accession NM_014109) is another VGAM1730 host target gene. PRO2000 BINDING SITE is HOST TARGET binding site found in the 5' untranslated region of mRNA encoded by PRO2000, corresponding to a HOST TARGET binding site such as BINDING SITE I, BINDING SITE II or BINDING SITE III. Table 2 illustrates the complementarity of the nucleotide sequences of PRO2000 BINDING SITE, designated SEQ ID:15338, to the nucleotide sequence of VGAM1730 RNA, herein designated VGAM RNA, also designated SEQ ID:4441.

Another function of VGAM1730 is therefore inhibition of PRO2000 (Accession NM_014109). Accordingly, utilities of VGAM1730 include diagnosis, prevention and treatment of diseases and clinical conditions associated with PRO2000.

LOC149722 (Accession XM_097709) is another VGAM1730 host target gene. LOC149722 BINDING SITE is HOST TARGET binding site found in the 5' untranslated region of mRNA encoded by LOC149722, corresponding to a HOST TARGET binding site such as BINDING SITE I, BINDING SITE II or BINDING SITE III. Table 2 illustrates the complementarity of the nucleotide sequences of LOC149722 BINDING SITE, designated SEQ ID:41046, to the nucleotide sequence of VGAM1730 RNA, herein designated VGAM RNA, also designated SEQ ID:4441.

Another function of VGAM1730 is therefore inhibition of LOC149722 (Accession XM_097709). Accordingly, utilities of VGAM1730 include diagnosis, prevention and treatment of diseases and clinical conditions associated with LOC149722. LOC152992 (Accession XM_087575) is another VGAM1730 host target gene. LOC152992 BINDING SITE is HOST TARGET binding site found in the 3' untranslated region of mRNA encoded by LOC152992, corresponding to a HOST TARGET binding site such as BINDING SITE I, BINDING SITE II or BINDING SITE III. Table 2 illustrates the complementarity of the nucleotide sequences of LOC152992 BINDING SITE, designated SEQ ID:39349, to the nucleotide sequence of VGAM1730 RNA, herein designated VGAM RNA, also designated SEQ ID:4441.

Another function of VGAM1730 is therefore inhibition of LOC152992 (Accession XM_087575). Accordingly, utilities of VGAM1730 include diagnosis, prevention and treatment of diseases and clinical conditions associated with LOC152992. LOC157663 (Accession XM_088354) is another VGAM1730 host target gene. LOC157663 BINDING SITE is HOST TARGET binding site found in the 3' untranslated region of mRNA encoded by LOC157663, corresponding to a HOST TARGET binding site such as BINDING SITE I, BINDING SITE II or BINDING SITE III. Table 2 illustrates the complementarity of the nucleotide sequences of LOC157663 BINDING SITE, designated SEQ ID:39640, to the nucleotide sequence of VGAM1730 RNA, herein designated VGAM RNA, also designated SEQ ID:4441.

Another function of VGAM1730 is therefore inhibition of LOC157663 (Accession XM_088354). Accordingly, utilities of VGAM1730 include diagnosis, prevention and treatment of diseases and clinical conditions associated with LOC157663. LOC245771 (Accession XM_167366) is another VGAM1730 host target gene. LOC245771 BINDING SITE is HOST TARGET binding site found in the 5' untranslated region of mRNA encoded by LOC245771, corresponding to a HOST TARGET binding site such as BINDING SITE I, BINDING SITE II or BINDING SITE III. Table 2 illustrates the complementarity of the nucleotide sequences of LOC245771 BINDING SITE, designated SEQ ID:44638, to the nucleotide sequence of VGAM1730 RNA, herein designated VGAM RNA, also designated SEQ ID:4441.

Another function of VGAM1730 is therefore inhibition of LOC245771 (Accession XM_167366). Accordingly, utilities of VGAM1730 include diagnosis, prevention and treatment of diseases and clinical conditions associated with LOC245771. FIG. 1 further provides a conceptual description of a novel bioinformatically detected viral gene of the present invention, referred to here as Viral Genomic Address Messenger 1731 (VGAM1731) viral gene, which modulates expression of respective host target genes thereof, the function and utility of which host target genes is known in the art.

VGAM1731 is a novel bioinformatically detected regulatory, non protein coding, viral micro RNA (miRNA) gene. The method by which VGAM1731 was detected is described hereinabove with reference to FIGS. 1-8.

VGAM1731 gene, herein designated VGAM GENE, is a viral gene contained in the genome of Rabies Virus. VGAM1731 host target gene, herein designated VGAM HOST TARGET GENE, is a human gene contained in the human genome.

VGAM1731 gene encodes a VGAM1731 precursor RNA, herein designated VGAM PRECURSOR RNA. Similar to other miRNA genes, and unlike most ordinary genes, VGAM1731 precursor RNA does not encode a protein. A nucleotide sequence identical or highly similar to the nucleotide sequence of VGAM1731 precursor RNA is designated SEQ ID:1717, and is provided hereinbelow with reference to the sequence listing part. Nucleotide sequence SEQ ID:1717 is located at position 3422 relative to the genome of Rabies Virus.

VGAM1731 precursor RNA folds onto itself, forming VGAM1731 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1731 folded precursor RNA into VGAM1731 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1731 RNA is designated SEQ ID:4442, and is provided hereinbelow with reference to the sequence listing part.

VGAM1731 host target gene, herein designated VGAM HOST TARGET GENE, encodes a corresponding messenger RNA, VGAM1731 host target RNA, herein designated VGAM HOST TARGET RNA. VGAM1731 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1731 RNA, herein designated VGAM RNA, binds complementarily to one or more host target binding sites located in untranslated regions of VGAM1731 host target RNA, herein designated VGAM HOST TARGET RNA. This complementary binding is due to the fact that the nucleotide sequence of VGAM1731 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1731 RNA, herein designated VGAM RNA, may have a different number of host target binding sites in untranslated regions of a VGAM1731 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1731 RNA, herein designated VGAM RNA, to host target binding sites on VGAM1731 host target RNA, herein designated VGAM HOST TARGET RNA, such as BINDING SITE I, BINDING SITE II and BINDING SITE III, inhibits translation of VGAM1731 host target RNA into VGAM1731 host target protein, herein designated VGAM HOST TARGET PROTEIN. VGAM host target protein is therefore outlined by a broken line.

It is appreciated that VGAM1731 host target gene, herein designated VGAM HOST TARGET GENE, in fact represents a plurality of VGAM1731 host target genes. The mRNA of each one of this plurality of VGAM1731 host target genes comprises one or more host target binding sites, each having a nucleotide sequence which is at least partly complementary to VGAM1731 RNA, herein designated VGAM RNA, and which when bound by VGAM1731 RNA causes inhibition of translation of respective one or more VGAM1731 host target proteins.

It is further appreciated by one skilled in the art that the mode of translational inhibition illustrated by FIG. 1 with specific reference to translational inhibition exerted by VGAM1731 gene, herein designated VGAM GENE, on one or more VGAM1731 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1731 is inhibition of expression of host target genes, as part of a novel viral mechanism of attacking a host. Accordingly, utilities of VGAM1731 include diagnosis, prevention and treatment of viral infection by Rabies Virus. Specific functions, and accordingly utilities, of VGAM1731 correlate with, and may be deduced from, the identity of the host target genes which VGAM1731 binds and inhibits, and the function of these host target genes, as elaborated hereinbelow.

Nucleotide sequences of the VGAM1731 precursor RNA, herein designated VGAM PRECURSOR RNA, and of the 'diced' VGAM1731 RNA, herein designated VGAM RNA, and a schematic representation of the secondary folding of VGAM1731 folded precursor RNA, herein designated VGAM FOLDED PRECURSOR RNA, of VGAM1731 are further described hereinbelow with reference to Table 1.

Nucleotide sequences of host target binding sites, such as BINDING SITE-I, BINDING SITE-II and BINDING SITE-III of FIG. 1, found on VGAM1731 host target RNA, and schematic representation of the complementarity of each of these host target binding sites to VGAM1731 RNA, herein designated VGAM RNA, are described hereinbelow with reference to Table 2.

As mentioned hereinabove with reference to FIG. 1, a function of VGAM1731 gene, herein designated VGAM is inhibition of expression of VGAM1731 target genes. It is appreciated that specific functions, and accordingly utilities, of VGAM1731 correlate with, and may be deduced from, the identity of the target genes which VGAM1731 binds and inhibits, and the function of these target genes, as elaborated hereinbelow.

Coagulation Factor VII (serum prothrombin conversion accelerator) (F7, Accession NM_000131) is a VGAM1731 host target gene. F7 BINDING SITE1 and F7 BINDING SITE2 are HOST TARGET binding sites found in untranslated regions of mRNA encoded by F7, corresponding to HOST TARGET binding sites such as BINDING SITE I, BINDING SITE II or BINDING SITE III. Table 2 illustrates the complementarity of the nucleotide sequences of F7 BINDING SITE1 and F7 BINDING SITE2, designated SEQ ID:5604 and SEQ ID:21233 respectively, to the nucleotide sequence of VGAM1731 RNA, herein designated VGAM RNA, also designated SEQ ID:4442.

A function of VGAM1731 is therefore inhibition of Coagulation Factor VII (serum prothrombin conversion accelerator) (F7, Accession NM_000131). Accordingly, utilities of VGAM1731 include diagnosis, prevention and treatment of diseases and clinical conditions associated with F7. Thiamin Pyrophosphokinase 1 (TPK1, Accession NM_022445) is another VGAM1731 host target gene. TPK1 BINDING SITE is HOST TARGET binding site found in the 3' untranslated region of mRNA encoded by TPK1, corresponding to a HOST TARGET binding site such as BINDING SITE I, BINDING SITE II or BINDING SITE III. Table 2 illustrates the complementarity of the nucleotide sequences of TPK1 BINDING SITE, designated SEQ ID:22780, to the nucleotide sequence of VGAM1731 RNA, herein designated VGAM RNA, also designated SEQ ID:4442.

Another function of VGAM1731 is therefore inhibition of Thiamin Pyrophosphokinase 1 (TPK1, Accession NM_022445), a gene which catalyzes the conversion of thiamine, a form of vitamin B1, to thiamine pyrophosphate. Accordingly, utilities of VGAM1731 include diagnosis, prevention and treatment of diseases and clinical conditions associated with TPK1. The function of TPK1 and its association with various diseases and clinical conditions, has been established by previous studies, as described hereinabove with reference to VGAM475. DKFZP564M082 (Accession NM_014042) is another VGAM1731 host target gene. DKFZP564M082 BINDING SITE is HOST TARGET binding site found in the 5' untranslated region of mRNA encoded by DKFZP564M082, corresponding to a HOST TARGET binding site such as BINDING SITE I, BINDING SITE II or BINDING SITE III. Table 2 illustrates the complementarity of the nucleotide sequences of DKFZP564M082 BINDING SITE, designated SEQ ID:15271, to the nucleotide sequence of VGAM1731 RNA, herein designated VGAM RNA, also designated SEQ ID:4442.

Another function of VGAM1731 is therefore inhibition of DKFZP564M082 (Accession NM_014042). Accordingly, utilities of VGAM1731 include diagnosis, prevention and treatment of diseases and clinical conditions associated with DKFZP564M082. FLJ13265 (Accession NM_024877) is another VGAM1731 host target gene. FLJ13265 BINDING SITE is HOST TARGET binding site found in the 3' untranslated region of mRNA encoded by FLJ13265, corresponding to a HOST TARGET binding site such as BINDING SITE I, BINDING SITE II or BINDING SITE III. Table 2 illustrates the complementarity of the nucleotide sequences of FLJ13265 BINDING SITE, designated SEQ ID:24312, to the nucleotide sequence of VGAM1731 RNA, herein designated VGAM RNA, also designated SEQ ID:4442.

Another function of VGAM1731 is therefore inhibition of FLJ13265 (Accession NM_024877). Accordingly, utilities of VGAM1731 include diagnosis, prevention and treatment of diseases and clinical conditions associated with FLJ13265. HSU79303 (Accession NM_013301) is another VGAM1731 host target gene. HSU79303 BINDING SITE is HOST TARGET binding site found in the 3' untranslated region of mRNA encoded by HSU79303, corresponding to a HOST TARGET binding site such as BINDING SITE I, BINDING SITE II or BINDING SITE III. Table 2 illustrates the complementarity of the nucleotide sequences of HSU79303 BINDING SITE, designated SEQ ID:14962, to the nucleotide sequence of VGAM1731 RNA, herein designated VGAM RNA, also designated SEQ ID:4442.

Another function of VGAM1731 is therefore inhibition of HSU79303 (Accession NM_013301). Accordingly, utilities of VGAM1731 include diagnosis, prevention and treatment of diseases and clinical conditions associated with HSU79303. KIAA0472 (Accession XM_050147) is another VGAM1731 host target gene. KIAA0472 BINDING SITE is HOST TARGET binding site found in the 3' untranslated region of mRNA encoded by KIAA0472, corresponding to a HOST TARGET binding site such as BINDING SITE I, BINDING SITE II or BINDING SITE III. Table 2 illustrates the complementarity of the nucleotide sequences of KIAA0472 BINDING SITE, designated SEQ ID:35574, to the nucleotide sequence of VGAM1731 RNA, herein designated VGAM RNA, also designated SEQ ID:4442.

Another function of VGAM1731 is therefore inhibition of KIAA0472 (Accession XM_050147). Accordingly, utilities of VGAM1731 include diagnosis, prevention and treatment of diseases and clinical conditions associated with KIAA0472. KIAA1237 (Accession XM_087386) is another VGAM1731 host target gene. KIAA1237 BINDING SITE is HOST TARGET binding site found in the 3' untranslated region of mRNA encoded by KIAA1237, corresponding to a HOST TARGET binding site such as BINDING SITE I, BINDING SITE II or BINDING SITE III. Table 2 illustrates the complementarity of the nucleotide sequences of KIAA1237 BINDING SITE, designated SEQ ID:39216, to the nucleotide sequence of VGAM1731 RNA, herein designated VGAM RNA, also designated SEQ ID:4442.

Another function of VGAM1731 is therefore inhibition of KIAA1237 (Accession XM_087386). Accordingly, utilities of VGAM1731 include diagnosis, prevention and treatment of diseases and clinical conditions associated with KIAA1237. Paralemmin (PALM, Accession NM_002579) is another VGAM1731 host target gene. PALM BINDING SITE is HOST TARGET binding site found in the 3' untranslated region of mRNA encoded by PALM, corresponding to a HOST TARGET binding site such as BINDING SITE I, BINDING SITE II or BINDING SITE III. Table 2 illustrates the complementarity of the nucleotide sequences of PALM BINDING SITE, designated SEQ ID:8439, to the nucleotide sequence of VGAM1731 RNA, herein designated VGAM RNA, also designated SEQ ID:4442.

Another function of VGAM1731 is therefore inhibition of Paralemmin (PALM, Accession NM_002579). Accordingly, utilities of VGAM1731 include diagnosis, prevention and treatment of diseases and clinical conditions associated with PALM. LOC152445 (Accession XM_098231) is another VGAM1731 host target gene. LOC152445 BINDING SITE is HOST TARGET binding site found in the 5' untranslated region of mRNA encoded by LOC152445, corresponding to a HOST TARGET binding site such as BINDING SITE I, BINDING SITE II or BINDING SITE III. Table 2 illustrates the complementarity of the nucleotide sequences of LOC152445 BINDING SITE, designated SEQ ID:41512, to the nucleotide sequence of VGAM1731 RNA, herein designated VGAM RNA, also designated SEQ ID:4442.

Another function of VGAM1731 is therefore inhibition of LOC152445 (Accession XM_098231). Accordingly, utilities of VGAM1731 include diagnosis, prevention and treatment of diseases and clinical conditions associated with LOC152445. LOC157247 (Accession XM_088275) is another VGAM1731 host target gene. LOC157247 BINDING SITE is HOST TARGET binding site found in the 5' untranslated region of mRNA encoded by LOC157247, corresponding to a HOST TARGET binding site such as BINDING SITE I, BINDING SITE II or BINDING SITE III. Table 2 illustrates the complementarity of the nucleotide sequences of LOC157247 BINDING SITE, designated SEQ ID:39578, to the nucleotide sequence of VGAM1731 RNA, herein designated VGAM RNA, also designated SEQ ID:4442.

Another function of VGAM1731 is therefore inhibition of LOC157247 (Accession XM_088275). Accordingly, utilities of VGAM1731 include diagnosis, prevention and treatment of diseases and clinical conditions associated with LOC157247. LOC219333 (Accession XM_167944) is another VGAM1731 host target gene. LOC219333 BINDING SITE is HOST TARGET binding site found in the 3' untranslated region of mRNA encoded by LOC219333, corresponding to a HOST TARGET binding site such as BINDING SITE I, BINDING SITE II or BINDING SITE III. Table 2 illustrates the complementarity of the nucleotide sequences of LOC219333 BINDING SITE, designated SEQ ID:44934, to the nucleotide sequence of VGAM1731 RNA, herein designated VGAM RNA, also designated SEQ ID:4442.

Another function of VGAM1731 is therefore inhibition of LOC219333 (Accession XM_167944). Accordingly, utilities of VGAM1731 include diagnosis, prevention and treatment of diseases and clinical conditions associated with LOC219333. LOC58489 (Accession XM_051862) is another VGAM1731 host target gene. LOC58489 BINDING SITE is HOST TARGET binding site found in the 3' untranslated region of mRNA encoded by LOC58489, corresponding to a HOST TARGET binding site such as BINDING SITE I, BINDING SITE II or BINDING SITE III. Table 2 illustrates the complementarity of the nucleotide sequences of LOC58489 BINDING SITE, designated SEQ ID:35904, to the nucleotide sequence of VGAM1731 RNA, herein designated VGAM RNA, also designated SEQ ID:4442.

Another function of VGAM1731 is therefore inhibition of LOC58489 (Accession XM_051862). Accordingly, utilities of VGAM1731 include diagnosis, prevention and treatment of diseases and clinical conditions associated with LOC58489. FIG. 1 further provides a conceptual description of a novel bioinformatically detected viral gene of the present invention, referred to here as Viral Genomic Address Messenger 1732 (VGAM1732) viral gene, which modulates expression of respective host target genes thereof, the function and utility of which host target genes is known in the art.

VGAM1732 is a novel bioinformatically detected regulatory, non protein coding, viral micro RNA (miRNA) gene. The method by which VGAM1732 was detected is described hereinabove with reference to FIGS. 1-8.

VGAM1732 gene, herein designated VGAM GENE, is a viral gene contained in the genome of Rabies Virus. VGAM1732 host target gene, herein designated VGAM HOST TARGET GENE, is a human gene contained in the human genome.

VGAM1732 gene encodes a VGAM1732 precursor RNA, herein designated VGAM PRECURSOR RNA. Similar to other miRNA genes, and unlike most ordinary genes, VGAM1732 precursor RNA does not encode a protein. A nucleotide sequence identical or highly similar to the nucleotide sequence of VGAM1732 precursor RNA is designated SEQ ID:1718, and is provided hereinbelow with reference to the sequence listing part. Nucleotide sequence SEQ ID:1718 is located at position 9788 relative to the genome of Rabies Virus.

VGAM1732 precursor RNA folds onto itself, forming VGAM1732 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1732 folded precursor RNA into VGAM1732 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1732 RNA is designated SEQ ID:4443, and is provided hereinbelow with reference to the sequence listing part.

VGAM1732 host target gene, herein designated VGAM HOST TARGET GENE, encodes a corresponding messenger RNA, VGAM1732 host target RNA, herein designated VGAM HOST TARGET RNA. VGAM1732 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1732 RNA, herein designated VGAM RNA, binds complementarily to one or more host target binding sites located in untranslated regions of VGAM1732 host target RNA, herein designated VGAM HOST TARGET RNA. This complementary binding is due to the fact that the nucleotide sequence of VGAM1732 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1732 RNA, herein designated VGAM RNA, may have a different number of host target binding sites in untranslated regions of a VGAM1732 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1732 RNA, herein designated VGAM RNA, to host target binding sites on VGAM1732 host target RNA, herein designated VGAM HOST TARGET RNA, such as BINDING SITE I, BINDING SITE II and BINDING SITE III, inhibits translation of VGAM1732 host target RNA into VGAM1732 host target protein, herein designated VGAM HOST TARGET PROTEIN. VGAM host target protein is therefore outlined by a broken line.

It is appreciated that VGAM1732 host target gene, herein designated VGAM HOST TARGET GENE, in fact represents a plurality of VGAM1732 host target genes. The mRNA of each one of this plurality of VGAM1732 host target genes comprises one or more host target binding sites, each having a nucleotide sequence which is at least partly complementary to VGAM1732 RNA, herein designated VGAM RNA, and which when bound by VGAM1732 RNA causes inhibition of translation of respective one or more VGAM1732 host target proteins.

It is further appreciated by one skilled in the art that the mode of translational inhibition illustrated by FIG. 1 with specific reference to translational inhibition exerted by VGAM1732 gene, herein designated VGAM GENE, on one or more VGAM1732 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1732 is inhibition of expression of host target genes, as part of a novel viral mechanism of attacking a host. Accordingly, utilities of VGAM1732 include diagnosis, prevention and treatment of viral infection by Rabies Virus. Specific functions, and accordingly utilities, of VGAM1732 correlate with, and may be deduced from, the identity of the host target genes which VGAM1732 binds and inhibits, and the function of these host target genes, as elaborated hereinbelow.

Nucleotide sequences of the VGAM1732 precursor RNA, herein designated VGAM PRECURSOR RNA, and of the 'diced' VGAM1732 RNA, herein designated VGAM RNA, and a schematic representation of the secondary folding of VGAM1732 folded precursor RNA, herein designated VGAM FOLDED PRECURSOR RNA, of VGAM1732 are further described hereinbelow with reference to Table 1.

Nucleotide sequences of host target binding sites, such as BINDING SITE-I, BINDING SITE-II and BINDING SITE-III of FIG. 1, found on VGAM1732 host target RNA, and schematic representation of the complementarity of each of these host target binding sites to VGAM1732 RNA, herein designated VGAM RNA, are described hereinbelow with reference to Table 2.

As mentioned hereinabove with reference to FIG. 1, a function of VGAM1732 gene, herein designated VGAM is inhibition of expression of VGAM1732 target genes. It is appreciated that specific functions, and accordingly utilities, of VGAM1732 correlate with, and may be deduced from, the identity of the target genes which VGAM1732 binds and inhibits, and the function of these target genes, as elaborated hereinbelow.

Paired Mesoderm Homeo Box 1 (PMX1, Accession NM_006902) is a VGAM1732 host target gene. PMX1 BINDING SITE1 and PMX1 BINDING SITE2 are HOST TARGET binding sites found in untranslated regions of mRNA encoded by PMX1, corresponding to HOST TARGET binding sites such as BINDING SITE I, BINDING SITE II or BINDING SITE III. Table 2 illustrates the complementarity of the nucleotide sequences of PMX1 BINDING SITE1 and PMX1 BINDING SITE2, designated SEQ ID:13776 and SEQ ID:22911 respectively, to the nucleotide sequence of VGAM1732 RNA, herein designated VGAM RNA, also designated SEQ ID:4443.

A function of VGAM1732 is therefore inhibition of Paired Mesoderm Homeo Box 1 (PMX1, Accession NM_006902), a gene which acts as a transcriptional regulator of muscle creatine kinase. Accordingly, utilities of VGAM1732 include diagnosis, prevention and treatment of diseases and clinical conditions associated with PMX1. The function of PMX1 and its association with various diseases and clinical conditions, has been established by previous studies, as described hereinabove with reference to VGAM381. CDP-diacylglycerol--inositol 3-phosphatidyltransferase (phosphatidylinositol synthase) (CDIPT, Accession NM_006319) is another VGAM1732 host target gene. CDIPT BINDING SITE is HOST TARGET binding site found in the 3' untranslated region of mRNA encoded by CDIPT, corresponding to a HOST TARGET binding site such as BINDING SITE I, BINDING SITE II or BINDING SITE III. Table 2 illustrates the complementarity of the nucleotide sequences of CDIPT BINDING SITE, designated SEQ ID:13008, to the nucleotide sequence of VGAM1732 RNA, herein designated VGAM RNA, also designated SEQ ID:4443.

Another function of VGAM1732 is therefore inhibition of CDP-diacylglycerol--inositol 3-phosphatidyltransferase (phosphatidylinositol synthase) (CDIPT, Accession NM_006319). Accordingly, utilities of VGAM1732 include diagnosis, prevention and treatment of diseases and clinical conditions associated with CDIPT. DJ328E19. C1.1 (Accession NM_015383) is another VGAM1732 host target gene. DJ328E19. C1.1 BINDING SITE is HOST TARGET binding site found in the 3' untranslated region of mRNA encoded by DJ328E19. C1.1, corresponding to a HOST TARGET binding site such as BINDING SITE I, BINDING SITE II or BINDING SITE III. Table 2 illustrates the complementarity of the nucleotide sequences of DJ328E19. C1.1 BINDING SITE, designated SEQ ID:17682, to the nucleotide sequence of VGAM1732 RNA, herein designated VGAM RNA, also designated SEQ ID:4443.

Another function of VGAM1732 is therefore inhibition of DJ328E19. C1.1 (Accession NM_015383). Accordingly, utilities of VGAM1732 include diagnosis, prevention and treatment of diseases and clinical conditions associated with DJ328E19. C1.1. KIAA0408 (Accession NM_014702) is another VGAM1732 host target gene. KIAA0408 BINDING SITE is HOST TARGET binding site found in the 3' untranslated region of mRNA encoded by KIAA0408, corresponding to a HOST TARGET binding site such as BINDING SITE I, BINDING SITE II or BINDING SITE III. Table 2 illustrates the complementarity of the nucleotide sequences of KIAA0408 BINDING SITE, designated SEQ ID:16229, to the nucleotide sequence of VGAM1732 RNA, herein designated VGAM RNA, also designated SEQ ID:4443.

Another function of VGAM1732 is therefore inhibition of KIAA0408 (Accession NM_014702). Accordingly, utilities of VGAM1732 include diagnosis, prevention and treatment of diseases and clinical conditions associated with KIAA0408. KIAA1005 (Accession XM_051197) is another VGAM1732 host target gene. KIAA1005 BINDING SITE is HOST TARGET binding site found in the 3' untranslated region of mRNA encoded by KIAA1005, corresponding to a HOST TARGET binding site such as BINDING SITE I, BINDING SITE II or BINDING SITE III. Table 2 illustrates the complementarity of the nucleotide sequences of KIAA1005 BINDING SITE, designated SEQ ID:35776, to the nucleotide sequence of VGAM1732 RNA, herein designated VGAM RNA, also designated SEQ ID:4443.

Another function of VGAM1732 is therefore inhibition of KIAA1005 (Accession XM_051197). Accordingly, utilities of VGAM1732 include diagnosis, prevention and treatment of diseases and clinical conditions associated with KIAA1005. KIAA1255 (Accession XM_040626) is another VGAM1732 host target gene. KIAA1255 BINDING SITE is HOST TARGET binding site found in the 3' untranslated region of mRNA encoded by KIAA1255, corresponding to a HOST TARGET binding site such as BINDING SITE I, BINDING SITE II or BINDING SITE III. Table 2 illustrates the complementarity of the nucleotide sequences of KIAA1255 BINDING SITE, designated SEQ ID:33344, to the nucleotide sequence of VGAM1732 RNA, herein designated VGAM RNA, also designated SEQ ID:4443.

Another function of VGAM1732 is therefore inhibition of KIAA1255 (Accession XM_040626). Accordingly, utilities of VGAM1732 include diagnosis, prevention and treatment of diseases and clinical conditions associated with KIAA1255. NBR2 (Accession NM_005821) is another VGAM1732 host target gene. NBR2 BINDING SITE is HOST TARGET binding site found in the 5' untranslated region of mRNA encoded by NBR2, corresponding to a HOST TARGET binding site such as BINDING SITE I, BINDING SITE II or BINDING SITE III. Table 2 illustrates the complementarity of the nucleotide sequences of NBR2 BINDING SITE, designated SEQ ID:12423, to the nucleotide sequence of VGAM1732 RNA, herein designated VGAM RNA, also designated SEQ ID:4443.

Another function of VGAM1732 is therefore inhibition of NBR2 (Accession NM_005821). Accordingly, utilities of VGAM1732 include diagnosis, prevention and treatment of diseases and clinical conditions associated with NBR2. RAB14, Member RAS Oncogene Family (RAB14, Accession NM_016322) is another VGAM1732 host target gene. RAB14 BINDING SITE is HOST TARGET binding site found in the 3' untranslated region of mRNA encoded by RAB14, corresponding to a HOST TARGET binding site such as BINDING SITE I, BINDING SITE II or BINDING SITE III. Table 2 illustrates the complementarity of the nucleotide sequences of RAB14 BINDING SITE, designated SEQ ID:18446, to the nucleotide sequence of VGAM1732 RNA, herein designated VGAM RNA, also designated SEQ ID:4443.

Another function of VGAM1732 is therefore inhibition of RAB14, Member RAS Oncogene Family (RAB14, Accession NM_016322). Accordingly, utilities of VGAM1732 include diagnosis, prevention and treatment of diseases and clinical conditions associated with RAB14. LOC137362 (Accession XM_059905) is another VGAM1732 host target gene. LOC137362 BINDING SITE is HOST TARGET binding site found in the 3' untranslated region of mRNA encoded by LOC137362, corresponding to a HOST TARGET binding site such as BINDING SITE I, BINDING SITE II or BINDING SITE III. Table 2 illustrates the complementarity of the nucleotide sequences of LOC137362 BINDING SITE, designated SEQ ID:37105, to the nucleotide sequence of VGAM1732 RNA, herein designated VGAM RNA, also designated SEQ ID:4443.

Another function of VGAM1732 is therefore inhibition of LOC137362 (Accession XM_059905). Accordingly, utilities of VGAM1732 include diagnosis, prevention and treatment of diseases and clinical conditions associated with LOC137362. LOC203025 (Accession XM_114610) is another VGAM1732 host target gene. LOC203025 BINDING SITE is HOST TARGET binding site found in the 3' untranslated region of mRNA encoded by LOC203025, corresponding to a HOST TARGET binding site such as BINDING SITE I, BINDING SITE II or BINDING SITE III. Table 2 illustrates the complementarity of the nucleotide sequences of LOC203025 BINDING SITE, designated SEQ ID:43000, to the nucleotide sequence of VGAM1732 RNA, herein designated VGAM RNA, also designated SEQ ID:4443.

Another function of VGAM1732 is therefore inhibition of LOC203025 (Accession XM_114610). Accordingly, utilities of VGAM1732 include diagnosis, prevention and treatment of diseases and clinical conditions associated with LOC203025. LOC90643 (Accession XM_033145) is another VGAM1732 host target gene. LOC90643 BINDING SITE is HOST TARGET binding site found in the 3' untranslated region of mRNA encoded by LOC90643, corresponding to a HOST TARGET binding site such as BINDING SITE I, BINDING SITE II or BINDING SITE III. Table 2 illustrates the complementarity of the nucleotide sequences of LOC90643 BINDING SITE, designated SEQ ID:31850, to the nucleotide sequence of VGAM1732 RNA, herein designated VGAM RNA, also designated SEQ ID:4443.

Another function of VGAM1732 is therefore inhibition of LOC90643 (Accession XM_033145). Accordingly, utilities of VGAM1732 include diagnosis, prevention and treatment of diseases and clinical conditions associated with LOC90643. FIG. 1 further provides a conceptual description of a novel bioinformatically detected viral gene of the present invention, referred to here as Viral Genomic Address Messenger 1733 (VGAM1733) viral gene, which modulates expression of respective host target genes thereof, the function and utility of which host target genes is known in the art.

VGAM1733 is a novel bioinformatically detected regulatory, non protein coding, viral micro RNA (miRNA) gene. The method by which VGAM1733 was detected is described hereinabove with reference to FIGS. 1-8.

VGAM1733 gene, herein designated VGAM GENE, is a viral gene contained in the genome of Human Herpesvirus 3. VGAM1733 host target gene, herein designated VGAM HOST TARGET GENE, is a human gene contained in the human genome.

VGAM1733 gene encodes a VGAM1733 precursor RNA, herein designated VGAM PRECURSOR RNA. Similar to other miRNA genes, and unlike most ordinary genes, VGAM1733 precursor RNA does not encode a protein. A nucleotide sequence identical or highly similar to the nucleotide sequence of VGAM1733 precursor RNA is designated SEQ ID:1719, and is provided hereinbelow with reference to the sequence listing part. Nucleotide sequence SEQ ID:1719 is located at position 40756 relative to the genome of Human Herpesvirus 3.

VGAM1733 precursor RNA folds onto itself, forming VGAM1733 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1733 folded precursor RNA into VGAM1733 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1733 RNA is designated SEQ ID:4444, and is provided hereinbelow with reference to the sequence listing part.

VGAM1733 host target gene, herein designated VGAM HOST TARGET GENE, encodes a corresponding messenger RNA, VGAM1733 host target RNA, herein designated VGAM HOST TARGET RNA. VGAM1733 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1733 RNA, herein designated VGAM RNA, binds complementarily to one or more host target binding sites located in untranslated regions of VGAM1733 host target RNA, herein designated VGAM HOST TARGET RNA. This complementary binding is due to the fact that the nucleotide sequence of VGAM1733 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1733 RNA, herein designated VGAM RNA, may have a different number of host target binding sites in untranslated regions of a VGAM1733 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1733 RNA, herein designated VGAM RNA, to host target binding sites on VGAM1733 host target RNA, herein designated VGAM HOST TARGET RNA, such as BINDING SITE I, BINDING SITE II and BINDING SITE III, inhibits translation of VGAM1733 host target RNA into VGAM1733 host target protein, herein designated VGAM HOST TARGET PROTEIN. VGAM host target protein is therefore outlined by a broken line.

It is appreciated that VGAM1733 host target gene, herein designated VGAM HOST TARGET GENE, in fact represents a plurality of VGAM1733 host target genes. The mRNA of each one of this plurality of VGAM1733 host target genes comprises one or more host target binding sites, each having a nucleotide sequence which is at least partly complementary to VGAM1733 RNA, herein designated VGAM RNA, and which when bound by VGAM1733 RNA causes inhibition of translation of respective one or more VGAM1733 host target proteins.

It is further appreciated by one skilled in the art that the mode of translational inhibition illustrated by FIG. 1 with specific reference to translational inhibition exerted by VGAM1733 gene, herein designated VGAM GENE, on one or more VGAM1733 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1733 is inhibition of expression of host target genes, as part of a novel viral mechanism of attacking a host. Accordingly, utilities of VGAM1733 include diagnosis, prevention and treatment of viral infection by Human Herpesvirus 3. Specific functions, and accordingly utilities, of VGAM1733 correlate with, and may be deduced from, the identity of the host target genes which VGAM1733 binds and inhibits, and the function of these host target genes, as elaborated hereinbelow.

Nucleotide sequences of the VGAM1733 precursor RNA, herein designated VGAM PRECURSOR RNA, and of the 'diced' VGAM1733 RNA, herein designated VGAM RNA, and a schematic representation of the secondary folding of VGAM1733 folded precursor RNA, herein designated VGAM FOLDED PRECURSOR RNA, of VGAM1733 are further described hereinbelow with reference to Table 1.

Nucleotide sequences of host target binding sites, such as BINDING SITE-I, BINDING SITE-II and BINDING SITE-III of FIG. 1, found on VGAM1733 host target RNA, and schematic representation of the complementarity of each of these host target binding sites to VGAM1733 RNA, herein designated VGAM RNA, are described hereinbelow with reference to Table 2.

As mentioned hereinabove with reference to FIG. 1, a function of VGAM1733 gene, herein designated VGAM is inhibition of expression of VGAM1733 target genes. It is appreciated that specific functions, and accordingly utilities, of VGAM1733 correlate with, and may be deduced from, the identity of the target genes which VGAM1733 binds and inhibits, and the function of these target genes, as elaborated hereinbelow.

Down-regulator of Transcription 1, TBP-binding (negative cofactor 2) (DR1, Accession XM_002015) is a VGAM1733 host target gene. DR1 BINDING SITE is HOST TARGET binding site found in the 5' untranslated region of mRNA encoded by DR1, corresponding to a HOST TARGET binding site such as BINDING SITE I, BINDING SITE II or BINDING SITE III. Table 2 illustrates the complementarity of the nucleotide sequences of DR1 BINDING SITE, designated SEQ ID:29857, to the nucleotide sequence of VGAM1733 RNA, herein designated VGAM RNA, also designated SEQ ID:4444.

A function of VGAM1733 is therefore inhibition of Down-regulator of Transcription 1, TBP-binding (negative cofactor 2) (DR1, Accession XM_002015), a gene which influences functional repression of both activated and basal transcription of class ii genes. Accordingly, utilities of VGAM1733 include diagnosis, prevention and treatment of diseases and clinical conditions associated with DR1. The function of DR1 and its association with various diseases and clinical conditions, has been established by previous studies, as described hereinabove with reference to VGAM711. Inositol Hexaphosphate Kinase 3 (IHPK3, Accession NM_054111) is another VGAM1733 host target gene. IHPK3 BINDING SITE is HOST TARGET binding site found in the 3' untranslated region of mRNA encoded by IHPK3, corresponding to a HOST TARGET binding site such as BINDING SITE I, BINDING SITE II or BINDING SITE III. Table 2 illustrates the complementarity of the nucleotide sequences of IHPK3 BINDING SITE, designated SEQ ID:27656, to the nucleotide sequence of VGAM1733 RNA, herein designated VGAM RNA, also designated SEQ ID:4444.

Another function of VGAM1733 is therefore inhibition of Inositol Hexaphosphate Kinase 3 (IHPK3, Accession NM_054111). Accordingly, utilities of VGAM1733 include diagnosis, prevention and treatment of diseases and clinical conditions associated with IHPK3. LOC123036 (Accession XM_058676) is another VGAM1733 host target gene. LOC123036 BINDING SITE is HOST TARGET binding site found in the 5' untranslated region of mRNA encoded by LOC123036, corresponding to a HOST TARGET binding site such as BINDING SITE I, BINDING SITE II or BINDING SITE III. Table 2 illustrates the complementarity of the nucleotide sequences of LOC123036 BINDING SITE, designated SEQ ID:36716, to the nucleotide sequence of VGAM1733 RNA, herein designated VGAM RNA, also designated SEQ ID:4444.

Another function of VGAM1733 is therefore inhibition of LOC123036 (Accession XM_058676). Accordingly, utilities of VGAM1733 include diagnosis, prevention and treatment of diseases and clinical conditions associated with LOC123036. LOC144962 (Accession XM_084990) is another VGAM1733 host target gene. LOC144962 BINDING SITE is HOST TARGET binding site found in the 5' untranslated region of mRNA encoded by LOC144962, corresponding to a HOST TARGET binding site such as BINDING SITE I, BINDING SITE II or BINDING SITE III. Table 2 illustrates the complementarity of the nucleotide sequences of LOC144962 BINDING SITE, designated SEQ ID:37790, to the nucleotide sequence of VGAM1733 RNA, herein designated VGAM RNA, also designated SEQ ID:4444.

Another function of VGAM1733 is therefore inhibition of LOC144962 (Accession XM_084990). Accordingly, utilities of VGAM1733 include diagnosis, prevention and treatment of diseases and clinical conditions associated with LOC144962. FIG. 1 further provides a conceptual description of a novel bioinformatically detected viral gene of the present invention, referred to here as Viral Genomic Address Messenger 1734 (VGAM1734) viral gene, which modulates expression of respective host target genes thereof, the function and utility of which host target genes is known in the art.

VGAM1734 is a novel bioinformatically detected regulatory, non protein coding, viral micro RNA (miRNA) gene. The method by which VGAM1734 was detected is described hereinabove with reference to FIGS. 1-8.

VGAM1734 gene, herein designated VGAM GENE, is a viral gene contained in the genome of Human Herpesvirus 3. VGAM1734 host target gene, herein designated VGAM HOST TARGET GENE, is a human gene contained in the human genome.

VGAM1734 gene encodes a VGAM1734 precursor RNA, herein designated VGAM PRECURSOR RNA. Similar to other miRNA genes, and unlike most ordinary genes, VGAM1734 precursor RNA does not encode a protein. A nucleotide sequence identical or highly similar to the nucleotide sequence of VGAM1734 precursor RNA is designated SEQ ID:1720, and is provided hereinbelow with reference to the sequence listing part. Nucleotide sequence SEQ ID:1720 is located at position 35482 relative to the genome of Human Herpesvirus 3.

VGAM1734 precursor RNA folds onto itself, forming VGAM1734 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1734 folded precursor RNA into VGAM1734 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1734 RNA is designated SEQ ID:4445, and is provided hereinbelow with reference to the sequence listing part.

VGAM1734 host target gene, herein designated VGAM HOST TARGET GENE, encodes a corresponding messenger RNA, VGAM1734 host target RNA, herein designated VGAM HOST TARGET RNA. VGAM1734 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1734 RNA, herein designated VGAM RNA, binds complementarily to one or more host target binding sites located in untranslated regions of VGAM1734 host target RNA, herein designated VGAM HOST TARGET RNA. This complementary binding is due to the fact that the nucleotide sequence of VGAM1734 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1734 RNA, herein designated VGAM RNA, may have a different number of host target binding sites in untranslated regions of a VGAM1734 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1734 RNA, herein designated VGAM RNA, to host target binding sites on VGAM1734 host target RNA, herein designated VGAM HOST TARGET RNA, such as BINDING SITE I, BINDING SITE II and BINDING SITE III, inhibits translation of VGAM1734 host target RNA into VGAM1734 host target protein, herein designated VGAM HOST TARGET PROTEIN. VGAM host target protein is therefore outlined by a broken line.

It is appreciated that VGAM1734 host target gene, herein designated VGAM HOST TARGET GENE, in fact represents a plurality of VGAM1734 host target genes. The mRNA of each one of this plurality of VGAM1734 host target genes comprises one or more host target binding sites, each having a nucleotide sequence which is at least partly complementary to VGAM1734 RNA, herein designated VGAM RNA, and which when bound by VGAM1734 RNA causes inhibition of translation of respective one or more VGAM1734 host target proteins.

It is further appreciated by one skilled in the art that the mode of translational inhibition illustrated by FIG. 1 with specific reference to translational inhibition exerted by VGAM1734 gene, herein designated VGAM GENE, on one or more VGAM1734 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1734 is inhibition of expression of host target genes, as part of a novel viral mechanism of attacking a host. Accordingly, utilities of VGAM1734 include diagnosis, prevention and treatment of viral infection by Human Herpesvirus 3. Specific functions, and accordingly utilities, of VGAM1734 correlate with, and may be deduced from, the identity of the host target genes which VGAM1734 binds and inhibits, and the function of these host target genes, as elaborated hereinbelow.

Nucleotide sequences of the VGAM1734 precursor RNA, herein designated VGAM PRECURSOR RNA, and of the 'diced' VGAM1734 RNA, herein designated VGAM RNA, and a schematic representation of the secondary folding of VGAM1734 folded precursor RNA, herein designated VGAM FOLDED PRECURSOR RNA, of VGAM1734 are further described hereinbelow with reference to Table 1.

Nucleotide sequences of host target binding sites, such as BINDING SITE-I, BINDING SITE-II and BINDING SITE-III of FIG. 1, found on VGAM1734 host target RNA, and schematic representation of the complementarity of each of these host target binding sites to VGAM1734 RNA, herein designated VGAM RNA, are described hereinbelow with reference to Table 2.

As mentioned hereinabove with reference to FIG. 1, a function of VGAM1734 gene, herein designated VGAM is inhibition of expression of VGAM1734 target genes. It is appreciated that specific functions, and accordingly utilities, of VGAM1734 correlate with, and may be deduced from, the identity of the target genes which VGAM1734 binds and inhibits, and the function of these target genes, as elaborated hereinbelow.

Acyl-Coenzyme A Dehydrogenase, Short/branched Chain (ACADSB, Accession NM_001609) is a VGAM1734 host target gene. ACADSB BINDING SITE is HOST TARGET binding site found in the 3' untranslated region of mRNA encoded by ACADSB, corresponding to a HOST TARGET binding site such as BINDING SITE I, BINDING SITE II or BINDING SITE III. Table 2 illustrates the complementarity of the nucleotide sequences of ACADSB BINDING SITE, designated SEQ ID:7317, to the nucleotide sequence of VGAM1734 RNA, herein designated VGAM RNA, also designated SEQ ID:4445.

A function of VGAM1734 is therefore inhibition of Acyl-Coenzyme A Dehydrogenase, Short/branched Chain (ACADSB, Accession NM_001609). Accordingly, utilities of VGAM1734 include diagnosis, prevention and treatment of diseases and clinical conditions associated with ACADSB.

FLJ20331 (Accession NM_017768) is another VGAM1734 host target gene. FLJ20331 BINDING SITE is HOST TARGET binding site found in the 3' untranslated region of mRNA encoded by FLJ20331, corresponding to a HOST TARGET binding site such as BINDING SITE I, BINDING SITE II or BINDING SITE III. Table 2 illustrates the complementarity of the nucleotide sequences of FLJ20331 BINDING SITE, designated SEQ ID:19385, to the nucleotide sequence of VGAM1734 RNA, herein designated VGAM RNA, also designated SEQ ID:4445.

Another function of VGAM1734 is therefore inhibition of FLJ20331 (Accession NM_017768). Accordingly, utilities of VGAM1734 include diagnosis, prevention and treatment of diseases and clinical conditions associated with FLJ20331.

FIG. 1 further provides a conceptual description of a novel bioinformatically detected viral gene of the present invention, referred to here as Viral Genomic Address Messenger 1735 (VGAM1735) viral gene, which modulates expression of respective host target genes thereof, the function and utility of which host target genes is known in the art.

VGAM1735 is a novel bioinformatically detected regulatory, non protein coding, viral micro RNA (miRNA) gene. The method by which VGAM1735 was detected is described hereinabove with reference to FIGS. 1-8.

VGAM1735 gene, herein designated VGAM GENE, is a viral gene contained in the genome of Human Herpesvirus 3. VGAM1735 host target gene, herein designated VGAM HOST TARGET GENE, is a human gene contained in the human genome.

VGAM1735 gene encodes a VGAM1735 precursor RNA, herein designated VGAM PRECURSOR RNA. Similar to other miRNA genes, and unlike most ordinary genes, VGAM1735 precursor RNA does not encode a protein. A nucleotide sequence identical or highly similar to the nucleotide sequence of VGAM1735 precursor RNA is designated SEQ ID:1721, and is provided hereinbelow with reference to the sequence listing part. Nucleotide sequence SEQ ID:1721 is located at position 33659 relative to the genome of Human Herpesvirus 3.

VGAM1735 precursor RNA folds onto itself, forming VGAM1735 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1735 folded precursor RNA into VGAM1735 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1735 RNA is designated SEQ ID:4446, and is provided hereinbelow with reference to the sequence listing part.

VGAM1735 host target gene, herein designated VGAM HOST TARGET GENE, encodes a corresponding messenger RNA, VGAM1735 host target RNA, herein designated VGAM HOST TARGET RNA. VGAM1735 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1735 RNA, herein designated VGAM RNA, binds complementarily to one or more host target binding sites located in untranslated regions of VGAM1735 host target RNA, herein designated VGAM HOST TARGET RNA. This complementary binding is due to the fact that the nucleotide sequence of VGAM1735 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1735 RNA, herein designated VGAM RNA, may have a different number of host target binding sites in untranslated regions of a VGAM1735 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1735 RNA, herein designated VGAM RNA, to host target binding sites on VGAM1735 host target RNA, herein designated VGAM HOST TARGET RNA, such as BINDING SITE I, BINDING SITE II and BINDING SITE III, inhibits translation of VGAM1735 host target RNA into VGAM1735 host target protein, herein designated VGAM HOST TARGET PROTEIN. VGAM host target protein is therefore outlined by a broken line.

It is appreciated that VGAM1735 host target gene, herein designated VGAM HOST TARGET GENE, in fact represents a plurality of VGAM1735 host target genes. The mRNA of each one of this plurality of VGAM1735 host target genes comprises one or more host target binding sites, each having a nucleotide sequence which is at least partly complementary to VGAM1735 RNA, herein designated VGAM RNA, and which when bound by VGAM1735 RNA causes inhibition of translation of respective one or more VGAM1735 host target proteins.

It is further appreciated by one skilled in the art that the mode of translational inhibition illustrated by FIG. 1 with specific reference to translational inhibition exerted by VGAM1735 gene, herein designated VGAM GENE, on one or more VGAM1735 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1735 is inhibition of expression of host target genes, as part of a novel viral mechanism of attacking a host. Accordingly, utilities of VGAM1735 include diagnosis, prevention and treatment of viral infection by Human Herpesvirus 3. Specific functions, and accordingly utilities, of VGAM1735 correlate with, and may be deduced from, the identity of the host target genes which VGAM1735 binds and inhibits, and the function of these host target genes, as elaborated hereinbelow.

Nucleotide sequences of the VGAM1735 precursor RNA, herein designated VGAM PRECURSOR RNA, and of the 'diced' VGAM1735 RNA, herein designated VGAM RNA, and a schematic representation of the secondary folding of VGAM1735 folded precursor RNA, herein designated VGAM FOLDED PRECURSOR RNA, of VGAM1735 are further described hereinbelow with reference to Table 1.

Nucleotide sequences of host target binding sites, such as BINDING SITE-I, BINDING SITE-II and BINDING SITE-III of FIG. 1, found on VGAM1735 host target RNA, and schematic representation of the complementarity of each of these host target binding sites to VGAM1735 RNA, herein designated VGAM RNA, are described hereinbelow with reference to Table 2.

As mentioned hereinabove with reference to FIG. 1, a function of VGAM1735 gene, herein designated VGAM is inhibition of expression of VGAM1735 target genes. It is appreciated that specific functions, and accordingly utilities, of VGAM1735 correlate with, and may be deduced from, the identity of the target genes which VGAM1735 binds and inhibits, and the function of these target genes, as elaborated hereinbelow.

MSTP032 (Accession NM_025226) is a VGAM1735 host target gene. MSTP032 BINDING SITE is HOST TARGET binding site found in the 3' untranslated region of mRNA encoded by MSTP032, corresponding to a HOST TARGET binding site such as BINDING SITE I, BINDING SITE II or BINDING SITE III. Table 2 illustrates the complementarity of the nucleotide sequences of MSTP032 BINDING SITE, designated SEQ ID:24904, to the nucleotide sequence of VGAM1735 RNA, herein designated VGAM RNA, also designated SEQ ID:4446.

A function of VGAM1735 is therefore inhibition of MSTP032 (Accession NM_025226). Accordingly, utilities of VGAM1735 include diagnosis, prevention and treatment of diseases and clinical conditions associated with MSTP032. Serum/glucocorticoid Regulated Kinase-like (SGKL, Accession NM_013257) is another VGAM1735 host target gene. SGKL BINDING SITE is HOST TARGET binding site found in the 3' untranslated region of mRNA encoded by SGKL, corresponding to a HOST TARGET binding site such as BINDING SITE I, BINDING SITE II or BINDING SITE III. Table 2 illustrates the complementarity of the nucleotide sequences of SGKL BINDING SITE, designated SEQ ID:14927, to the nucleotide sequence of VGAM1735 RNA, herein designated VGAM RNA, also designated SEQ ID:4446.

Another function of VGAM1735 is therefore inhibition of Serum/glucocorticoid Regulated Kinase-like (SGKL, Accession NM_013257). Accordingly, utilities of VGAM1735 include diagnosis, prevention and treatment of diseases and clinical conditions associated with SGKL. LOC149401 (Accession XM_086511) is another VGAM1735 host target gene. LOC149401 BINDING SITE is HOST TARGET binding site found in the 5' untranslated region of mRNA encoded by LOC149401, corresponding to a HOST TARGET binding site such as BINDING SITE I, BINDING SITE II or BINDING SITE III. Table 2 illustrates the complementarity of the nucleotide sequences of LOC149401 BINDING SITE, designated SEQ ID:38736, to the nucleotide sequence of VGAM1735 RNA, herein designated VGAM RNA, also designated SEQ ID:4446.

Another function of VGAM1735 is therefore inhibition of LOC149401 (Accession XM_086511). Accordingly, utilities of VGAM1735 include diagnosis, prevention and treatment of diseases and clinical conditions associated with LOC149401. FIG. 1 further provides a conceptual description of a novel bioinformatically detected viral gene of the present invention, referred to here as Viral Genomic Address Messenger 1736 (VGAM1736) viral gene, which modulates expression of respective host target genes thereof, the function and utility of which host target genes is known in the art.

VGAM1736 is a novel bioinformatically detected regulatory, non protein coding, viral micro RNA (miRNA) gene. The method by which VGAM1736 was detected is described hereinabove with reference to FIGS. 1-8.

VGAM1736 gene, herein designated VGAM GENE, is a viral gene contained in the genome of Human Herpesvirus 3. VGAM1736 host target gene, herein designated VGAM HOST TARGET GENE, is a human gene contained in the human genome.

VGAM1736 gene encodes a VGAM1736 precursor RNA, herein designated VGAM PRECURSOR RNA. Similar to other miRNA genes, and unlike most ordinary genes, VGAM1736 precursor RNA does not encode a protein. A nucleotide sequence identical or highly similar to the nucleotide sequence of VGAM1736 precursor RNA is designated SEQ ID:1722, and is provided hereinbelow with reference to the sequence listing part. Nucleotide sequence SEQ ID:1722 is located at position 39181 relative to the genome of Human Herpesvirus 3.

VGAM1736 precursor RNA folds onto itself, forming VGAM1736 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1736 folded precursor RNA into VGAM1736 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1736 RNA is designated SEQ ID:4447, and is provided hereinbelow with reference to the sequence listing part.

VGAM1736 host target gene, herein designated VGAM HOST TARGET GENE, encodes a corresponding messenger RNA, VGAM1736 host target RNA, herein designated VGAM HOST TARGET RNA. VGAM1736 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1736 RNA, herein designated VGAM RNA, binds complementarily to one or more host target binding sites located in untranslated regions of VGAM1736 host target RNA, herein designated VGAM HOST TARGET RNA. This complementary binding is due to the fact that the nucleotide sequence of VGAM1736 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1736 RNA, herein designated VGAM RNA, may have a different number of host target binding sites in untranslated regions of a VGAM1736 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1736 RNA, herein designated VGAM RNA, to host target binding sites on VGAM1736 host target RNA, herein designated VGAM HOST TARGET RNA, such as BINDING SITE I, BINDING SITE II and BINDING SITE III, inhibits translation of VGAM1736 host target RNA into VGAM1736 host target protein, herein designated VGAM HOST TARGET PROTEIN. VGAM host target protein is therefore outlined by a broken line.

It is appreciated that VGAM1736 host target gene, herein designated VGAM HOST TARGET GENE, in fact represents a plurality of VGAM1736 host target genes. The mRNA of each one of this plurality of VGAM1736 host target genes comprises one or more host target binding sites, each having a nucleotide sequence which is at least partly complementary to VGAM1736 RNA, herein designated VGAM RNA, and which when bound by VGAM1736 RNA causes inhibition of translation of respective one or more VGAM1736 host target proteins.

It is further appreciated by one skilled in the art that the mode of translational inhibition illustrated by FIG. 1 with specific reference to translational inhibition exerted by VGAM1736 gene, herein designated VGAM GENE, on one or more VGAM1736 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1736 is inhibition of expression of host target genes, as part of a novel viral mechanism of attacking a host. Accordingly, utilities of VGAM1736 include diagnosis, prevention and treatment of viral infection by Human Herpesvirus 3. Specific functions, and accordingly utilities, of VGAM1736 correlate with, and may be deduced from, the identity of the host target genes which VGAM1736 binds and inhibits, and the function of these host target genes, as elaborated hereinbelow.

Nucleotide sequences of the VGAM1736 precursor RNA, herein designated VGAM PRECURSOR RNA, and of the 'diced' VGAM1736 RNA, herein designated VGAM RNA, and a schematic representation of the secondary folding of VGAM1736 folded precursor RNA, herein designated VGAM FOLDED PRECURSOR RNA, of VGAM1736 are further described hereinbelow with reference to Table 1.

Nucleotide sequences of host target binding sites, such as BINDING SITE-I, BINDING SITE-II and BINDING SITE-III of FIG. 1, found on VGAM1736 host target RNA, and schematic representation of the complementarity of each of these host target binding sites to VGAM1736 RNA, herein designated VGAM RNA, are described hereinbelow with reference to Table 2.

As mentioned hereinabove with reference to FIG. 1, a function of VGAM1736 gene, herein designated VGAM is inhibition of expression of VGAM1736 target genes. It is appreciated that specific functions, and accordingly utilities, of VGAM1736 correlate with, and may be deduced from, the identity of the target genes which VGAM1736 binds and inhibits, and the function of these target genes, as elaborated hereinbelow.

F-box and Leucine-rich Repeat Protein 3A (FBXL3A, Accession NM_012158) is a VGAM1736 host target gene. FBXL3A BINDING SITE is HOST TARGET binding site found in the 3' untranslated region of mRNA encoded by FBXL3A, corresponding to a HOST TARGET binding site such as BINDING SITE I, BINDING SITE II or BINDING SITE III. Table 2 illustrates the complementarity of the nucleotide sequences of FBXL3A BINDING SITE, designated SEQ ID:14455, to the nucleotide sequence of VGAM1736 RNA, herein designated VGAM RNA, also designated SEQ ID:4447.

A function of VGAM1736 is therefore inhibition of F-box and Leucine-rich Repeat Protein 3A (FBXL3A, Accession NM_012158), a gene which is a putative SCF ubiquitin ligase subunit involved in protein degradation. Accordingly, utilities of VGAM1736 include diagnosis, prevention and treatment of diseases and clinical conditions associated with FBXL3A. The function of FBXL3A and its association with various diseases and clinical conditions, has been established by previous studies, as described hereinabove with reference to VGAM1172. Glucagon-like Peptide 1 Receptor (GLP1R, Accession NM_002062) is another VGAM1736 host target gene. GLP1R BINDING SITE is HOST TARGET binding site found in the 3' untranslated region of mRNA encoded by GLP1R, corresponding to a HOST TARGET binding site such as BINDING SITE I, BINDING SITE II or BINDING SITE III. Table 2 illustrates the complementarity of the nucleotide sequences of GLP1R BINDING SITE, designated SEQ ID:7829, to the nucleotide sequence of VGAM1736 RNA, herein designated VGAM RNA, also designated SEQ ID:4447.

Another function of VGAM1736 is therefore inhibition of Glucagon-like Peptide 1 Receptor (GLP1R, Accession NM_002062), a gene which is mediated by g proteins which activate adenylyl cyclase. Accordingly, utilities of VGAM1736 include diagnosis, prevention and treatment of diseases and clinical conditions associated with GLP1R. The function of GLP1R and its association with various diseases and clinical conditions, has been established by previous studies, as described hereinabove with reference to VGAM1652. Transcription Factor 8 (represses interleukin 2 expression) (TCF8, Accession NM_030751) is another VGAM1736 host target gene. TCF8 BINDING SITE is HOST TARGET binding site found in the 3' untranslated region of mRNA encoded by TCF8, corresponding to a HOST TARGET binding site such as BINDING SITE I, BINDING SITE II or BINDING SITE III. Table 2 illustrates the complementarity of the nucleotide sequences of TCF8 BINDING SITE, designated SEQ ID:25039, to the nucleotide sequence of VGAM1736 RNA, herein designated VGAM RNA, also designated SEQ ID:4447.

Another function of VGAM1736 is therefore inhibition of Transcription Factor 8 (represses interleukin 2 expression) (TCF8, Accession NM_030751), a gene which may be responsible for transcriptional repression of the il-2 gene and regulates the promoter activity of the atp1a1 gene. Accordingly, utilities of VGAM1736 include diagnosis, prevention and treatment of diseases and clinical conditions associated with TCF8. The function of TCF8 and its association with various diseases and clinical conditions, has been established by previous studies, as described hereinabove with reference to VGAM166. G-rich RNA Sequence Binding Factor 1 (GRSF1, Accession NM_002092) is another VGAM1736 host target gene. GRSF1 BINDING SITE is HOST TARGET binding site found in the 3' untranslated region of mRNA encoded by GRSF1, corresponding to a HOST TARGET binding site such as BINDING SITE I, BINDING SITE II or BINDING SITE III. Table 2 illustrates the complementarity of the nucleotide sequences of GRSF1 BINDING SITE, designated SEQ ID:7881, to the nucleotide sequence of VGAM1736 RNA, herein designated VGAM RNA, also designated SEQ ID:4447.

Another function of VGAM1736 is therefore inhibition of G-rich RNA Sequence Binding Factor 1 (GRSF1, Accession NM_002092). Accordingly, utilities of VGAM1736 include diagnosis, prevention and treatment of diseases and clinical conditions associated with GRSF1. KIAA0416 (Accession NM_015564) is another VGAM1736 host target gene. KIAA0416 BINDING SITE is HOST TARGET binding site found in the 3' untranslated region of mRNA encoded by KIAA0416, corresponding to a HOST TARGET binding site such as BINDING SITE I, BINDING SITE II or BINDING SITE III. Table 2 illustrates the complementarity of the nucleotide sequences of KIAA0416 BINDING SITE, designated SEQ ID:17840, to the nucleotide sequence of VGAM1736 RNA, herein designated VGAM RNA, also designated SEQ ID:4447.

Another function of VGAM1736 is therefore inhibition of KIAA0416 (Accession NM_015564). Accordingly, utilities of VGAM1736 include diagnosis, prevention and treatment of diseases and clinical conditions associated with KIAA0416. SCDGF-B (Accession NM_025208) is another VGAM1736 host target gene. SCDGF-B BINDING SITE1 and SCDGF-B BINDING SITE2 are HOST TARGET binding sites found in untranslated regions of mRNA encoded by SCDGF-B, corresponding to HOST TARGET binding sites such as BINDING SITE I, BINDING SITE II or BINDING SITE III. Table 2 illustrates the complementarity of the nucleotide sequences of SCDGF-B BINDING SITE1 and SCDGF-B BINDING SITE2, designated SEQ ID:24878 and SEQ ID:26980 respectively, to the nucleotide sequence of VGAM1736 RNA, herein designated VGAM RNA, also designated SEQ ID:4447.

Another function of VGAM1736 is therefore inhibition of SCDGF-B (Accession NM_025208). Accordingly, utilities of VGAM1736 include diagnosis, prevention and treatment of diseases and clinical conditions associated with SCDGF-B. FIG. 1 further provides a conceptual description of a novel bioinformatically detected viral gene of the present invention, referred to here as Viral Genomic Address Messenger 1737 (VGAM1737) viral gene, which modulates expression of respective host target genes thereof, the function and utility of which host target genes is known in the art.

VGAM1737 is a novel bioinformatically detected regulatory, non protein coding, viral micro RNA (miRNA) gene. The method by which VGAM1737 was detected is described hereinabove with reference to FIGS. 1-8.

VGAM1737 gene, herein designated VGAM GENE, is a viral gene contained in the genome of Human Herpesvirus 3. VGAM1737 host target gene, herein designated VGAM HOST TARGET GENE, is a human gene contained in the human genome.

VGAM1737 gene encodes a VGAM1737 precursor RNA, herein designated VGAM PRECURSOR RNA. Similar to other miRNA genes, and unlike most ordinary genes, VGAM1737 precursor RNA does not encode a protein. A nucleotide sequence identical or highly similar to the nucleotide sequence of VGAM1737 precursor RNA is designated SEQ ID:1723, and is provided hereinbelow with reference to the sequence listing part. Nucleotide sequence SEQ ID:1723 is located at position 32691 relative to the genome of Human Herpesvirus 3.

VGAM1737 precursor RNA folds onto itself, forming VGAM1737 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1737 folded precursor RNA into VGAM1737 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1737 RNA is designated SEQ ID:4448, and is provided hereinbelow with reference to the sequence listing part.

VGAM1737 host target gene, herein designated VGAM HOST TARGET GENE, encodes a corresponding messenger RNA, VGAM1737 host target RNA, herein designated VGAM HOST TARGET RNA. VGAM1737 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1737 RNA, herein designated VGAM RNA, binds complementarily to one or more host target binding sites located in untranslated regions of VGAM1737 host target RNA, herein designated VGAM HOST TARGET RNA. This complementary binding is due to the fact that the nucleotide sequence of VGAM1737 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1737 RNA, herein designated VGAM RNA, may have a different number of host target binding sites in untranslated regions of a VGAM1737 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1737 RNA, herein designated VGAM RNA, to host target binding sites on VGAM1737 host target RNA, herein designated VGAM HOST TARGET RNA, such as BINDING SITE I, BINDING SITE II and BINDING SITE III, inhibits translation of VGAM1737 host target RNA into VGAM1737 host target protein, herein designated VGAM HOST TARGET PROTEIN. VGAM host target protein is therefore outlined by a broken line.

It is appreciated that VGAM1737 host target gene, herein designated VGAM HOST TARGET GENE, in fact represents a plurality of VGAM1737 host target genes. The mRNA of each one of this plurality of VGAM1737 host target genes comprises one or more host target binding sites, each having a nucleotide sequence which is at least partly complementary to VGAM1737 RNA, herein designated VGAM RNA, and which when bound by VGAM1737 RNA causes inhibition of translation of respective one or more VGAM1737 host target proteins.

It is further appreciated by one skilled in the art that the mode of translational inhibition illustrated by FIG. 1 with specific reference to translational inhibition exerted by VGAM1737 gene, herein designated VGAM GENE, on one or more VGAM1737 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1737 is inhibition of expression of host target genes, as part of a novel viral mechanism of attacking a host. Accordingly, utilities of VGAM1737 include diagnosis, prevention and treatment of viral infection by Human Herpesvirus 3. Specific functions, and accordingly utilities, of VGAM1737 correlate with, and may be deduced from, the identity of the host target genes which VGAM1737 binds and inhibits, and the function of these host target genes, as elaborated hereinbelow.

Nucleotide sequences of the VGAM1737 precursor RNA, herein designated VGAM PRECURSOR RNA, and of the 'diced' VGAM1737 RNA, herein designated VGAM RNA, and a schematic representation of the secondary folding of VGAM1737 folded precursor RNA, herein designated VGAM FOLDED PRECURSOR RNA, of VGAM1737 are further described hereinbelow with reference to Table 1.

Nucleotide sequences of host target binding sites, such as BINDING SITE-I, BINDING SITE-II and BINDING SITE-III of FIG. 1, found on VGAM1737 host target RNA, and schematic representation of the complementarity of each of these host target binding sites to VGAM1737 RNA, herein designated VGAM RNA, are described hereinbelow with reference to Table 2.

As mentioned hereinabove with reference to FIG. 1, a function of VGAM1737 gene, herein designated VGAM is inhibition of expression of VGAM1737 target genes. It is appreciated that specific functions, and accordingly utilities, of VGAM1737 correlate with, and may be deduced from, the identity of the target genes which VGAM1737 binds and inhibits, and the function of these target genes, as elaborated hereinbelow.

Contactin Associated Protein-like 2 (CNTNAP2, Accession NM_014141) is a VGAM1737 host target gene. CNTNAP2 BINDING SITE is HOST TARGET binding site found in the 3' untranslated region of mRNA encoded by CNTNAP2, corresponding to a HOST TARGET binding site such as BINDING SITE I, BINDING SITE II or BINDING SITE III. Table 2 illustrates the complementarity of the nucleotide sequences of CNTNAP2 BINDING SITE, designated SEQ ID:15417, to the nucleotide sequence of VGAM1737 RNA, herein designated VGAM RNA, also designated SEQ ID:4448.

A function of VGAM1737 is therefore inhibition of Contactin Associated Protein-like 2 (CNTNAP2, Accession NM_014141). Accordingly, utilities of VGAM1737 include diagnosis, prevention and treatment of diseases and clinical conditions associated with CNTNAP2. F-box and Leucine-rich Repeat Protein 11 (FBXL11, Accession NM_012308) is another VGAM1737 host target gene. FBXL11 BINDING SITE is HOST TARGET binding site found in the 3' untranslated region of mRNA encoded by FBXL11, corresponding to a HOST TARGET binding site such as BINDING SITE I, BINDING SITE II or BINDING SITE III. Table 2 illustrates the complementarity of the nucleotide sequences of FBXL11 BINDING SITE, designated SEQ ID:14678, to the nucleotide sequence of VGAM1737 RNA, herein designated VGAM RNA, also designated SEQ ID:4448.

Another function of VGAM1737 is therefore inhibition of F-box and Leucine-rich Repeat Protein 11 (FBXL11, Accession NM_012308), a gene which are BTB/POZ domain-containing zinc finger proteins implicated in oncogenesis. Accordingly, utilities of VGAM1737 include diagnosis, prevention and treatment of diseases and clinical conditions associated with FBXL11. The function of FBXL11 and its association with various diseases and clinical conditions, has been established by previous studies, as described hereinabove with reference to VGAM404. Protein Kinase C and Casein Kinase Substrate In Neurons 1 (PACSIN1, Accession XM_166424) is another VGAM1737 host target gene. PACSIN1 BINDING SITE is HOST TARGET binding site found in the 3' untranslated region of mRNA encoded by PACSIN1, corresponding to a HOST TARGET binding site such as BINDING SITE I, BINDING SITE II or BINDING SITE III. Table 2 illustrates the complementarity of the nucleotide sequences of PACSIN1 BINDING SITE, designated SEQ ID:44314, to the nucleotide sequence of VGAM1737 RNA, herein designated VGAM RNA, also designated SEQ ID:4448.

Another function of VGAM1737 is therefore inhibition of Protein Kinase C and Casein Kinase Substrate In Neurons 1 (PACSIN1, Accession XM_166424). Accordingly, utilities of VGAM1737 include diagnosis, prevention and treatment of diseases and clinical conditions associated with PACSIN1. FLJ11850 (Accession NM_022741) is another VGAM1737 host target gene. FLJ11850 BINDING SITE is HOST TARGET binding site found in the 3' untranslated region of mRNA encoded by FLJ11850, corresponding to a HOST TARGET binding site such as BINDING SITE I, BINDING SITE II or BINDING SITE III. Table 2 illustrates the complementarity of the nucleotide sequences of FLJ11850 BINDING SITE, designated SEQ ID:22947, to the nucleotide sequence of VGAM1737 RNA, herein designated VGAM RNA, also designated SEQ ID:4448.

Another function of VGAM1737 is therefore inhibition of FLJ11850 (Accession NM_022741). Accordingly, utilities of VGAM1737 include diagnosis, prevention and treatment of diseases and clinical conditions associated with FLJ11850. KIAA0255 (Accession NM_014742) is another VGAM1737 host target gene. KIAA0255 BINDING SITE is HOST TARGET binding site found in the 3' untranslated region of mRNA encoded by KIAA0255, corresponding to a HOST TARGET binding site such as BINDING SITE I, BINDING SITE II or BINDING SITE III. Table 2 illustrates the complementarity of the nucleotide sequences of KIAA0255 BINDING SITE, designated SEQ ID:16415, to the nucleotide sequence of VGAM1737 RNA, herein designated VGAM RNA, also designated SEQ ID:4448.

Another function of VGAM1737 is therefore inhibition of KIAA0255 (Accession NM_014742). Accordingly, utilities of VGAM1737 include diagnosis, prevention and treatment of diseases and clinical conditions associated with KIAA0255. RAN Binding Protein 6 (RANBP6, Accession XM_029423) is another VGAM1737 host target gene. RANBP6 BINDING SITE is HOST TARGET binding site found in the 5' untranslated region of mRNA encoded by RANBP6, corresponding to a HOST TARGET binding site such as BINDING SITE I, BINDING SITE II or BINDING SITE III. Table 2 illustrates the complementarity of the nucleotide sequences of RANBP6 BINDING SITE, designated SEQ ID:30884, to the nucleotide sequence of VGAM1737 RNA, herein designated VGAM RNA, also designated SEQ ID:4448.

Another function of VGAM1737 is therefore inhibition of RAN Binding Protein 6 (RANBP6, Accession XM_029423). Accordingly, utilities of VGAM1737 include diagnosis, prevention and treatment of diseases and clinical conditions associated with RANBP6. LOC157798 (Accession XM_098827) is another VGAM1737 host target gene. LOC157798 BINDING SITE is HOST TARGET binding site found in the 5' untranslated region of mRNA encoded by LOC157798, corresponding to a HOST TARGET binding site such as BINDING SITE I, BINDING SITE II or BINDING SITE III. Table 2 illustrates the complementarity of the nucleotide sequences of LOC157798 BINDING SITE, designated SEQ ID:41847, to the nucleotide sequence of VGAM1737 RNA, herein designated VGAM RNA, also designated SEQ ID:4448.

Another function of VGAM1737 is therefore inhibition of LOC157798 (Accession XM_098827). Accordingly, utilities of VGAM1737 include diagnosis, prevention and treatment of diseases and clinical conditions associated with LOC157798. LOC221715 (Accession XM_168092) is another VGAM1737 host target gene. LOC221715 BINDING SITE is HOST TARGET binding site found in the 3' untranslated region of mRNA encoded by LOC221715, corresponding to a HOST TARGET binding site such as BINDING SITE I, BINDING SITE II or BINDING SITE III. Table 2 illustrates the complementarity of the nucleotide sequences of LOC221715 BINDING SITE, designated SEQ ID:45016, to the nucleotide sequence of VGAM1737 RNA, herein designated VGAM RNA, also designated SEQ ID:4448.

Another function of VGAM1737 is therefore inhibition of LOC221715 (Accession XM_168092). Accordingly, utilities of VGAM1737 include diagnosis, prevention and treatment of diseases and clinical conditions associated with LOC221715. LOC254659 (Accession XM_170822) is another VGAM1737 host target gene. LOC254659 BINDING SITE is HOST TARGET binding site found in the 5' untranslated region of mRNA encoded by LOC254659, corresponding to a HOST TARGET binding site such as BINDING SITE I, BINDING SITE II or BINDING SITE III. Table 2 illustrates the complementarity of the nucleotide sequences of LOC254659 BINDING SITE, designated SEQ ID:45600, to the nucleotide sequence of VGAM1737 RNA, herein designated VGAM RNA, also designated SEQ ID:4448.

Another function of VGAM1737 is therefore inhibition of LOC254659 (Accession XM_170822). Accordingly, utilities of VGAM1737 include diagnosis, prevention and treatment of diseases and clinical conditions associated with LOC254659. FIG. 1 further provides a conceptual description of a novel bioinformatically detected viral gene of the present invention, referred to here as Viral Genomic Address Messenger 1738 (VGAM1738) viral gene, which modulates expression of respective host target genes thereof, the function and utility of which host target genes is known in the art.

VGAM1738 is a novel bioinformatically detected regulatory, non protein coding, viral micro RNA (miRNA) gene. The method by which VGAM1738 was detected is described hereinabove with reference to FIGS. 1-8.

VGAM1738 gene, herein designated VGAM GENE, is a viral gene contained in the genome of Human Herpesvirus 3. VGAM1738 host target gene, herein designated VGAM HOST TARGET GENE, is a human gene contained in the human genome.

VGAM1738 gene encodes a VGAM1738 precursor RNA, herein designated VGAM PRECURSOR RNA. Similar to other miRNA genes, and unlike most ordinary genes, VGAM1738 precursor RNA does not encode a protein. A nucleotide sequence identical or highly similar to the nucleotide sequence of VGAM1738 precursor RNA is designated SEQ ID:1724, and is provided hereinbelow with reference to the sequence listing part. Nucleotide sequence SEQ ID:1724 is located at position 41710 relative to the genome of Human Herpesvirus 3.

VGAM1738 precursor RNA folds onto itself, forming VGAM1738 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1738 folded precursor RNA into VGAM1738 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1738 RNA is designated SEQ ID:4449, and is provided hereinbelow with reference to the sequence listing part.

VGAM1738 host target gene, herein designated VGAM HOST TARGET GENE, encodes a corresponding messenger RNA, VGAM1738 host target RNA, herein designated VGAM HOST TARGET RNA. VGAM1738 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1738 RNA, herein designated VGAM RNA, binds complementarily to one or more host target binding sites located in untranslated regions of VGAM1738 host target RNA, herein designated VGAM HOST TARGET RNA. This complementary binding is due to the fact that the nucleotide sequence of VGAM1738 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1738 RNA, herein designated VGAM RNA, may have a different number of host target binding sites in untranslated regions of a VGAM1738 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1738 RNA, herein designated VGAM RNA, to host target binding sites on VGAM1738 host target RNA, herein designated VGAM HOST TARGET RNA, such as BINDING SITE I, BINDING SITE II and BINDING SITE III, inhibits translation of VGAM1738 host target RNA into VGAM1738 host target protein, herein designated VGAM HOST TARGET PROTEIN. VGAM host target protein is therefore outlined by a broken line.

It is appreciated that VGAM1738 host target gene, herein designated VGAM HOST TARGET GENE, in fact represents a plurality of VGAM1738 host target genes. The mRNA of each one of this plurality of VGAM1738 host target genes comprises one or more host target binding sites, each having a nucleotide sequence which is at least partly complementary to VGAM1738 RNA, herein designated VGAM RNA, and which when bound by VGAM1738 RNA causes inhibition of translation of respective one or more VGAM1738 host target proteins.

It is further appreciated by one skilled in the art that the mode of translational inhibition illustrated by FIG. 1 with specific reference to translational inhibition exerted by VGAM1738 gene, herein designated VGAM GENE, on one or more VGAM1738 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1738 is inhibition of expression of host target genes, as part of a novel viral mechanism of attacking a host. Accordingly, utilities of VGAM1738 include diagnosis, prevention and treatment of viral infection by Human Herpesvirus 3. Specific functions, and accordingly utilities, of VGAM1738 correlate with, and may be deduced from, the identity of the host target genes which VGAM1738 binds and inhibits, and the function of these host target genes, as elaborated hereinbelow.

Nucleotide sequences of the VGAM1738 precursor RNA, herein designated VGAM PRECURSOR RNA, and of the 'diced' VGAM1738 RNA, herein designated VGAM RNA, and a schematic representation of the secondary folding of VGAM1738 folded precursor RNA, herein designated VGAM FOLDED PRECURSOR RNA, of VGAM1738 are further described hereinbelow with reference to Table 1.

Nucleotide sequences of host target binding sites, such as BINDING SITE-I, BINDING SITE-II and BINDING SITE-III of FIG. 1, found on VGAM1738 host target RNA, and schematic representation of the complementarity of each of these host target binding sites to VGAM1738 RNA, herein designated VGAM RNA, are described hereinbelow with reference to Table 2.

As mentioned hereinabove with reference to FIG. 1, a function of VGAM1738 gene, herein designated VGAM is inhibition of expression of VGAM1738 target genes. It is appreciated that specific functions, and accordingly utilities, of VGAM1738 correlate with, and may be deduced from, the identity of the target genes which VGAM1738 binds and inhibits, and the function of these target genes, as elaborated hereinbelow.

Extracellular Matrix Protein 2, Female Organ and Adipocyte Specific (ECM2, Accession NM_001393) is a VGAM1738 host target gene. ECM2 BINDING SITE is HOST TARGET binding site found in the 3' untranslated region of mRNA encoded by ECM2, corresponding to a HOST TARGET binding site such as BINDING SITE I, BINDING SITE II or BINDING SITE III. Table 2 illustrates the complementarity of the nucleotide sequences of ECM2 BINDING SITE, designated SEQ ID:7086, to the nucleotide sequence of VGAM1738 RNA, herein designated VGAM RNA, also designated SEQ ID:4449.

A function of VGAM1738 is therefore inhibition of Extracellular Matrix Protein 2, Female Organ and Adipocyte Specific (ECM2, Accession NM_001393). Accordingly, utilities of VGAM1738 include diagnosis, prevention and treatment of diseases and clinical conditions associated with ECM2. Epsin 2 (EPN2, Accession NM_014964) is another VGAM1738 host target gene. EPN2 BINDING SITE is HOST TARGET binding site found in the 3' untranslated region of mRNA encoded by EPN2, corresponding to a HOST TARGET binding site such as BINDING SITE I, BINDING SITE II or BINDING SITE III. Table 2 illustrates the complementarity of the nucleotide sequences of EPN2 BINDING SITE, designated SEQ ID:17344, to the nucleotide sequence of VGAM1738 RNA, herein designated VGAM RNA, also designated SEQ ID:4449.

Another function of VGAM1738 is therefore inhibition of Epsin 2 (EPN2, Accession NM_014964). Accordingly, utilities of VGAM1738 include diagnosis, prevention and treatment of diseases and clinical conditions associated with EPN2. RAB39, Member RAS Oncogene Family (RAB39, Accession XM_084662) is another VGAM1738 host target gene. RAB39 BINDING SITE is HOST TARGET binding site found in the 3' untranslated region of mRNA encoded by RAB39, corresponding to a HOST TARGET binding site such as BINDING SITE I, BINDING SITE II or BINDING SITE III. Table 2 illustrates the complementarity of the nucleotide sequences of RAB39 BINDING SITE, designated SEQ ID:37643, to the nucleotide sequence of VGAM1738 RNA, herein designated VGAM RNA, also designated SEQ ID:4449.

Another function of VGAM1738 is therefore inhibition of RAB39, Member RAS Oncogene Family (RAB39, Accession XM_084662). Accordingly, utilities of VGAM1738 include diagnosis, prevention and treatment of diseases and clinical conditions associated with RAB39. LOC151473 (Accession XM_087215) is another VGAM1738 host target gene. LOC151473 BINDING SITE is HOST TARGET binding site found in the 3' untranslated region of mRNA encoded by LOC151473, corresponding to a HOST TARGET binding site such as BINDING SITE I, BINDING SITE II or BINDING SITE III. Table 2 illustrates the complementarity of the nucleotide sequences of LOC151473 BINDING SITE, designated SEQ ID:39118, to the nucleotide sequence of VGAM1738 RNA, herein designated VGAM RNA, also designated SEQ ID:4449.

Another function of VGAM1738 is therefore inhibition of LOC151473 (Accession XM_087215). Accordingly, utilities of VGAM1738 include diagnosis, prevention and treatment of diseases and clinical conditions associated with LOC151473. FIG. 1 further provides a conceptual description of a novel bioinformatically detected viral gene of the present invention, referred to here as Viral Genomic Address Messenger 1739 (VGAM1739) viral gene, which modulates expression of respective host target genes thereof, the function and utility of which host target genes is known in the art.

VGAM1739 is a novel bioinformatically detected regulatory, non protein coding, viral micro RNA (miRNA) gene. The method by which VGAM1739 was detected is described hereinabove with reference to FIGS. 1-8.

VGAM1739 gene, herein designated VGAM GENE, is a viral gene contained in the genome of Human Herpesvirus 3. VGAM1739 host target gene, herein designated VGAM HOST TARGET GENE, is a human gene contained in the human genome.

VGAM1739 gene encodes a VGAM1739 precursor RNA, herein designated VGAM PRECURSOR RNA. Similar to other miRNA genes, and unlike most ordinary genes, VGAM1739 precursor RNA does not encode a protein. A nucleotide sequence identical or highly similar to the nucleotide sequence of VGAM1739 precursor RNA is designated SEQ ID:1725, and is provided hereinbelow with reference to the sequence listing part. Nucleotide sequence SEQ ID:1725 is located at position 38932 relative to the genome of Human Herpesvirus 3.

VGAM1739 precursor RNA folds onto itself, forming VGAM1739 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1739 folded precursor RNA into VGAM1739 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 62%) nucleotide sequence of VGAM1739 RNA is designated SEQ ID:4450, and is provided hereinbelow with reference to the sequence listing part.

VGAM1739 host target gene, herein designated VGAM HOST TARGET GENE, encodes a corresponding messenger RNA, VGAM1739 host target RNA, herein designated VGAM HOST TARGET RNA. VGAM1739 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1739 RNA, herein designated VGAM RNA, binds complementarily to one or more host target binding sites located in untranslated regions of VGAM1739 host target RNA, herein designated VGAM HOST TARGET RNA. This complementary binding is due to the fact that the nucleotide sequence of VGAM1739 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1739 RNA, herein designated VGAM RNA, may have a different number of host target binding sites in untranslated regions of a VGAM1739 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1739 RNA, herein designated VGAM RNA, to host target binding sites on VGAM1739 host target RNA, herein designated VGAM HOST TARGET RNA, such as BINDING SITE I, BINDING SITE II and BINDING SITE III, inhibits translation of VGAM1739 host target RNA into VGAM1739 host target protein, herein designated VGAM HOST TARGET PROTEIN. VGAM host target protein is therefore outlined by a broken line.

It is appreciated that VGAM1739 host target gene, herein designated VGAM HOST TARGET GENE, in fact represents a plurality of VGAM1739 host target genes. The mRNA of each one of this plurality of VGAM1739 host target genes comprises one or more host target binding sites, each having a nucleotide sequence which is at least partly complementary to VGAM1739 RNA, herein designated VGAM RNA, and which when bound by VGAM1739 RNA causes inhibition of translation of respective one or more VGAM1739 host target proteins.

It is further appreciated by one skilled in the art that the mode of translational inhibition illustrated by FIG. 1 with specific reference to translational inhibition exerted by VGAM1739 gene, herein designated VGAM GENE, on one or more VGAM1739 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1739 is inhibition of expression of host target genes, as part of a novel viral mechanism of attacking a host. Accordingly, utilities of VGAM1739 include diagnosis, prevention and treatment of viral infection by Human Herpesvirus 3. Specific functions, and accordingly utilities, of VGAM1739 correlate with, and may be deduced from, the identity of the host target genes which VGAM1739 binds and inhibits, and the function of these host target genes, as elaborated hereinbelow.

Nucleotide sequences of the VGAM1739 precursor RNA, herein designated VGAM PRECURSOR RNA, and of the 'diced' VGAM1739 RNA, herein designated VGAM RNA, and a schematic representation of the secondary folding of VGAM1739 folded precursor RNA, herein designated VGAM FOLDED PRECURSOR RNA, of VGAM1739 are further described hereinbelow with reference to Table 1.

Nucleotide sequences of host target binding sites, such as BINDING SITE-I, BINDING SITE-II and BINDING SITE-III of FIG. 1, found on VGAM1739 host target RNA, and schematic representation of the complementarity of each of these host target binding sites to VGAM1739 RNA, herein designated VGAM RNA, are described hereinbelow with reference to Table 2.

As mentioned hereinabove with reference to FIG. 1, a function of VGAM1739 gene, herein designated VGAM is inhibition of expression of VGAM1739 target genes. It is appreciated that specific functions, and accordingly utilities, of VGAM1739 correlate with, and may be deduced from, the identity of the target genes which VGAM1739 binds and inhibits, and the function of these target genes, as elaborated hereinbelow.

ADP-ribosylation Factor 4-like (ARF4L, Accession XM_045890) is a VGAM1739 host target gene. ARF4L BINDING SITE is HOST TARGET binding site found in the 3' untranslated region of mRNA encoded by ARF4L, corresponding to a HOST TARGET binding site such as BINDING SITE I, BINDING SITE II or BINDING SITE III. Table 2 illustrates the complementarity of the nucleotide sequences of ARF4L BINDING SITE, designated SEQ ID:34603, to the nucleotide sequence of VGAM1739 RNA, herein designated VGAM RNA, also designated SEQ ID:4450.

A function of VGAM1739 is therefore inhibition of ADP-ribosylation Factor 4-like (ARF4L, Accession XM_045890). Accordingly, utilities of VGAM1739 include diagnosis, prevention and treatment of diseases and clinical conditions associated with ARF4L. Copine III (CPNE3, Accession NM_003909) is another VGAM1739 host target gene. CPNE3 BINDING SITE is HOST TARGET binding site found in the 3' untranslated region of mRNA encoded by CPNE3, corresponding to a HOST TARGET binding site such as BINDING SITE I, BINDING SITE II or BINDING SITE III. Table 2 illustrates the complementarity of the nucleotide sequences of CPNE3 BINDING SITE, designated SEQ ID:9993, to the nucleotide sequence of VGAM1739 RNA, herein designated VGAM RNA, also designated SEQ ID:4450.

Another function of VGAM1739 is therefore inhibition of Copine III (CPNE3, Accession NM_003909), a gene which may function in membrane trafficking. Accordingly, utilities of VGAM1739 include diagnosis, prevention and treatment of diseases and clinical conditions associated with CPNE3. The function of CPNE3 and its association with various diseases and clinical conditions, has been established by previous studies, as described hereinabove with reference to VGAM28. Filamin B, Beta (actin binding protein 278) (FLNB, Accession XM_030806) is another VGAM1739 host target gene. FLNB BINDING SITE is HOST TARGET binding site found in the 3' untranslated region of mRNA encoded by FLNB, corresponding to a HOST TARGET binding site such as BINDING SITE I, BINDING SITE II or BINDING SITE III. Table 2 illustrates the complementarity of the nucleotide sequences of FLNB BINDING SITE, designated SEQ ID:31143, to the nucleotide sequence of VGAM1739 RNA, herein designated VGAM RNA, also designated SEQ ID:4450.

Another function of VGAM1739 is therefore inhibition of Filamin B, Beta (actin binding protein 278) (FLNB, Accession XM_030806), a gene which Filamin B, beta; binds actin, interacts with cytoplasmic domain of Ibalpha. Accordingly, utilities of VGAM1739 include diagnosis, prevention and treatment of diseases and clinical conditions associated with FLNB. The function of FLNB and its association with various diseases and clinical conditions, has been established by previous studies, as described hereinabove with reference to VGAM416. SMURF1 (Accession XM_166483) is another VGAM1739 host target gene. SMURF1 BINDING SITE is HOST TARGET binding site found in the 3' untranslated region of mRNA encoded by SMURF1, corresponding to a HOST TARGET binding site such as BINDING SITE I, BINDING SITE II or BINDING SITE III. Table 2 illustrates the complementarity of the nucleotide sequences of SMURF1 BINDING SITE, designated SEQ ID:44413, to the nucleotide sequence of VGAM1739 RNA, herein designated VGAM RNA, also designated SEQ ID:4450.

Another function of VGAM1739 is therefore inhibition of SMURF1 (Accession XM_166483). Accordingly, utilities of VGAM1739 include diagnosis, prevention and treatment of diseases and clinical conditions associated with SMURF1. Forkhead Box J1 (FOXJ1, Accession NM_001454) is another VGAM1739 host target gene. FOXJ1 BINDING SITE is HOST TARGET binding site found in the 5' untranslated region of mRNA encoded by FOXJ1, corresponding to a HOST TARGET binding site such as BINDING SITE I, BINDING SITE II or BINDING SITE III. Table 2 illustrates the complementarity of the nucleotide sequences of FOXJ1 BINDING SITE, designated SEQ ID:7188, to the nucleotide sequence of VGAM1739 RNA, herein designated VGAM RNA, also designated SEQ ID:4450.

Another function of VGAM1739 is therefore inhibition of Forkhead Box J1 (FOXJ1, Accession NM_001454). Accordingly, utilities of VGAM1739 include diagnosis, prevention and treatment of diseases and clinical conditions associated with FOXJ1. GRO3 (Accession XM_031287) is another VGAM1739 host target gene. GRO3 BINDING SITE is HOST TARGET binding site found in the 3' untranslated region of mRNA encoded by GRO3, corresponding to a HOST TARGET binding site such as BINDING SITE I, BINDING SITE II or BINDING SITE III. Table 2 illustrates the complementarity of the nucleotide sequences of GRO3 BINDING SITE, designated SEQ ID:31334, to the nucleotide sequence of VGAM1739 RNA, herein designated VGAM RNA, also designated SEQ ID:4450.

Another function of VGAM1739 is therefore inhibition of GRO3 (Accession XM_031287). Accordingly, utilities of VGAM1739 include diagnosis, prevention and treatment of diseases and clinical conditions associated with GRO3. Hippocalcin Like 4 (HPCAL4, Accession NM_016257) is another VGAM1739 host target gene. HPCAL4 BINDING SITE is HOST TARGET binding site found in the 3' untranslated region of mRNA encoded by HPCAL4, corresponding to a HOST TARGET binding site such as BINDING SITE I, BINDING SITE II or BINDING SITE III. Table 2 illustrates the complementarity of the nucleotide sequences of HPCAL4 BINDING SITE, designated SEQ ID:18386, to the nucleotide sequence of VGAM1739 RNA, herein designated VGAM RNA, also designated SEQ ID:4450.

Another function of VGAM1739 is therefore inhibition of Hippocalcin Like 4 (HPCAL4, Accession NM_016257). Accordingly, utilities of VGAM1739 include diagnosis, prevention and treatment of diseases and clinical conditions associated with HPCAL4. Heat Shock 27 kDa Protein Family, Member 7 (cardiovascular) (HSPB7, Accession NM_014424) is another VGAM1739 host target gene. HSPB7 BINDING SITE is HOST TARGET binding site found in the 3' untranslated region of mRNA encoded by HSPB7, corresponding to a HOST TARGET binding site such as BINDING SITE I, BINDING SITE II or BINDING SITE III. Table 2 illustrates the complementarity of the nucleotide sequences of HSPB7 BINDING SITE, designated SEQ ID:15779, to the nucleotide sequence of VGAM1739 RNA, herein designated VGAM RNA, also designated SEQ ID:4450.

Another function of VGAM1739 is therefore inhibition of Heat Shock 27 kDa Protein Family, Member 7 (cardiovascular) (HSPB7, Accession NM_014424). Accordingly, utilities of VGAM1739 include diagnosis, prevention and treatment of diseases and clinical conditions associated with HSPB7. HSPC144 (Accession NM_014174) is another VGAM1739 host target gene. HSPC144 BINDING SITE is HOST TARGET binding site found in the 5' untranslated region of mRNA encoded by HSPC144, corresponding to a HOST TARGET binding site such as BINDING SITE I, BINDING SITE II or BINDING SITE III. Table 2 illustrates the complementarity of the nucleotide sequences of HSPC144 BINDING SITE, designated SEQ ID:15462, to the nucleotide sequence of VGAM1739 RNA, herein designated VGAM RNA, also designated SEQ ID:4450.

Another function of VGAM1739 is therefore inhibition of HSPC144 (Accession NM_014174). Accordingly, utilities of VGAM1739 include diagnosis, prevention and treatment of diseases and clinical conditions associated with HSPC144. KIAA0433 (Accession NM_015216) is another VGAM1739 host target gene. KIAA0433 BINDING SITE is HOST TARGET binding site found in the 3' untranslated region of mRNA encoded by KIAA0433, corresponding to a HOST TARGET binding site such as BINDING SITE I, BINDING SITE II or BINDING SITE III. Table 2 illustrates the complementarity of the nucleotide sequences of KIAA0433 BINDING SITE, designated SEQ ID:17550, to the nucleotide sequence of VGAM1739 RNA, herein designated VGAM RNA, also designated SEQ ID:4450.

Another function of VGAM1739 is therefore inhibition of KIAA0433 (Accession NM_015216). Accordingly, utilities of VGAM1739 include diagnosis, prevention and treatment of diseases and clinical conditions associated with KIAA0433. KIAA1084 (Accession NM_014910) is another VGAM1739 host target gene. KIAA1084 BINDING SITE is HOST TARGET binding site found in the 3' untranslated region of mRNA encoded by KIAA1084, corresponding to a HOST TARGET binding site such as BINDING SITE I, BINDING SITE II or BINDING SITE III. Table 2 illustrates the complementarity of the nucleotide sequences of KIAA1084 BINDING SITE, designated SEQ ID:17137, to the nucleotide sequence of VGAM1739 RNA, herein designated VGAM RNA, also designated SEQ ID:4450.

Another function of VGAM1739 is therefore inhibition of KIAA1084 (Accession NM_014910). Accordingly, utilities of VGAM1739 include diagnosis, prevention and treatment of diseases and clinical conditions associated with KIAA1084. LOC90750 (Accession XM_033868) is another VGAM1739 host target gene. LOC90750 BINDING SITE is HOST TARGET binding site found in the 3' untranslated region of mRNA encoded by LOC90750, corresponding to a HOST TARGET binding site such as BINDING SITE I, BINDING SITE II or BINDING SITE III. Table 2 illustrates the complementarity of the nucleotide sequences of LOC90750 BINDING SITE, designated SEQ ID:31965, to the nucleotide sequence of VGAM1739 RNA, herein designated VGAM RNA, also designated SEQ ID:4450.

Another function of VGAM1739 is therefore inhibition of LOC90750 (Accession XM_033868). Accordingly, utilities of VGAM1739 include diagnosis, prevention and treatment of diseases and clinical conditions associated with LOC90750. FIG. 1 further provides a conceptual description of a novel bioinformatically detected viral gene of the present invention, referred to here as Viral Genomic Address Messenger 1740 (VGAM1740) viral gene, which modulates expression of respective host target genes thereof, the function and utility of which host target genes is known in the art.

VGAM1740 is a novel bioinformatically detected regulatory, non protein coding, viral micro RNA (miRNA) gene. The method by which VGAM1740 was detected is described hereinabove with reference to FIGS. 1-8.

VGAM1740 gene, herein designated VGAM GENE, is a viral gene contained in the genome of Human Herpesvirus 3. VGAM1740 host target gene, herein designated VGAM HOST TARGET GENE, is a human gene contained in the human genome.

VGAM1740 gene encodes a VGAM1740 precursor RNA, herein designated VGAM PRECURSOR RNA. Similar to other miRNA genes, and unlike most ordinary genes, VGAM1740 precursor RNA does not encode a protein. A nucleotide sequence identical or highly similar to the nucleotide sequence of VGAM1740 precursor RNA is designated SEQ ID:1726, and is provided hereinbelow with reference to the sequence listing part. Nucleotide sequence SEQ ID:1726 is located at position 36839 relative to the genome of Human Herpesvirus 3.

VGAM1740 precursor RNA folds onto itself, forming VGAM1740 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1740 folded precursor RNA into VGAM1740 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1740 RNA is designated SEQ ID:4451, and is provided hereinbelow with reference to the sequence listing part.

VGAM1740 host target gene, herein designated VGAM HOST TARGET GENE, encodes a corresponding messenger RNA, VGAM1740 host target RNA, herein designated VGAM HOST TARGET RNA. VGAM1740 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1740 RNA, herein designated VGAM RNA, binds complementarily to one or more host target binding sites located in untranslated regions of VGAM1740 host target RNA, herein designated VGAM HOST TARGET RNA. This complementary binding is due to the fact that the nucleotide sequence of VGAM1740 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1740 RNA, herein designated VGAM RNA, may have a different number of host target binding sites in untranslated regions of a VGAM1740 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1740 RNA, herein designated VGAM RNA, to host target binding sites on VGAM1740 host target RNA, herein designated VGAM HOST TARGET RNA, such as BINDING SITE I, BINDING SITE II and BINDING SITE III, inhibits translation of VGAM1740 host target RNA into VGAM1740 host target protein, herein designated VGAM HOST TARGET PROTEIN. VGAM host target protein is therefore outlined by a broken line.

It is appreciated that VGAM1740 host target gene, herein designated VGAM HOST TARGET GENE, in fact represents a plurality of VGAM1740 host target genes. The mRNA of each one of this plurality of VGAM1740 host target genes comprises one or more host target binding sites, each having a nucleotide sequence which is at least partly complementary to VGAM1740 RNA, herein designated VGAM RNA, and which when bound by VGAM1740 RNA causes inhibition of translation of respective one or more VGAM1740 host target proteins.

It is further appreciated by one skilled in the art that the mode of translational inhibition illustrated by FIG. 1 with specific reference to translational inhibition exerted by VGAM1740 gene, herein designated VGAM GENE, on one or more VGAM1740 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1740 is inhibition of expression of host target genes, as part of a novel viral mechanism of attacking a host. Accordingly, utilities of VGAM1740 include diagnosis, prevention and treatment of viral infection by Human Herpesvirus 3. Specific functions, and accordingly utilities, of VGAM1740 correlate with, and may be deduced from, the identity of the host target genes which VGAM1740 binds and inhibits, and the function of these host target genes, as elaborated hereinbelow.

Nucleotide sequences of the VGAM1740 precursor RNA, herein designated VGAM PRECURSOR RNA, and of the 'diced' VGAM1740 RNA, herein designated VGAM RNA, and a schematic representation of the secondary folding of VGAM1740 folded precursor RNA, herein designated VGAM FOLDED PRECURSOR RNA, of VGAM1740 are further described hereinbelow with reference to Table 1.

Nucleotide sequences of host target binding sites, such as BINDING SITE-I, BINDING SITE-II and BINDING SITE-III of FIG. 1, found on VGAM1740 host target RNA, and schematic representation of the complementarity of each of these host target binding sites to VGAM1740 RNA, herein designated VGAM RNA, are described hereinbelow with reference to Table 2.

As mentioned hereinabove with reference to FIG. 1, a function of VGAM1740 gene, herein designated VGAM is inhibition of expression of VGAM1740 target genes. It is appreciated that specific functions, and accordingly utilities, of VGAM1740 correlate with, and may be deduced from, the identity of the target genes which VGAM1740 binds and inhibits, and the function of these target genes, as elaborated hereinbelow.

Ceroid-lipofuscinosis, Neuronal 5 (CLN5, Accession NM_006493) is a VGAM1740 host target gene. CLN5 BINDING SITE is HOST TARGET binding site found in the 3' untranslated region of mRNA encoded by CLN5, corresponding to a HOST TARGET binding site such as BINDING SITE I, BINDING SITE II or BINDING SITE III. Table 2 illustrates the complementarity of the nucleotide sequences of CLN5 BINDING SITE, designated SEQ ID:13233, to the nucleotide sequence of VGAM1740 RNA, herein designated VGAM RNA, also designated SEQ ID:4451.

A function of VGAM1740 is therefore inhibition of Ceroid-lipofuscinosis, Neuronal 5 (CLN5, Accession NM_006493). Accordingly, utilities of VGAM1740 include diagnosis, prevention and treatment of diseases and clinical conditions associated with CLN5. COX11 Homolog, Cytochrome C Oxidase Assembly Protein (yeast) (COX11, Accession NM_004375) is another VGAM1740 host target gene. COX11 BINDING SITE is HOST TARGET binding site found in the 3' untranslated region of mRNA encoded by COX11, corresponding to a HOST TARGET binding site such as BINDING SITE I, BINDING SITE II or BINDING SITE III. Table 2 illustrates the complementarity of the nucleotide sequences of COX11 BINDING SITE, designated SEQ ID:10597, to the nucleotide sequence of VGAM1740 RNA, herein designated VGAM RNA, also designated SEQ ID:4451.

Another function of VGAM1740 is therefore inhibition of COX11 Homolog, Cytochrome C Oxidase Assembly Protein (yeast) (COX11, Accession NM_004375). Accordingly, utilities of VGAM1740 include diagnosis, prevention and treatment of diseases and clinical conditions associated with COX11. SON DNA Binding Protein (SON, Accession NM_138926) is another VGAM1740 host target gene. SON BINDING SITE1 through SON BINDING SITE3 are HOST TARGET binding sites found in untranslated regions of mRNA encoded by SON, corresponding to HOST TARGET binding sites such as BINDING SITE I, BINDING SITE II or BINDING SITE III. Table 2 illustrates the complementarity of the nucleotide sequences of SON BINDING SITE1 through SON BINDING SITE3, designated SEQ ID:29043, SEQ ID:27747 and SEQ ID:29047 respectively, to the nucleotide sequence of VGAM1740 RNA, herein designated VGAM RNA, also designated SEQ ID:4451.

Another function of VGAM1740 is therefore inhibition of SON DNA Binding Protein (SON, Accession NM_138926). Accordingly, utilities of VGAM1740 include diagnosis, prevention and treatment of diseases and clinical conditions associated with SON. X-box Binding Protein 1 (XBP1, Accession NM_005080) is another VGAM1740 host target gene. XBP1 BINDING SITE is HOST TARGET binding site found in the 3' untranslated region of mRNA encoded by XBP1, corresponding to a HOST TARGET binding site such as BINDING SITE I, BINDING SITE II or BINDING SITE III. Table 2 illustrates the complementarity of the nucleotide sequences of XBP1 BINDING SITE, designated SEQ ID:11532, to the nucleotide sequence of VGAM1740 RNA, herein designated VGAM RNA, also designated SEQ ID:4451.

Another function of VGAM1740 is therefore inhibition of X-box Binding Protein 1 (XBP1, Accession NM_005080), a gene which has a role in transcriptional regulation. Accordingly, utilities of VGAM1740 include diagnosis, prevention and treatment of diseases and clinical conditions associated with XBP1. The function of XBP1 and its association with various diseases and clinical conditions, has been established by previous studies, as described hereinabove with reference to VGAM746. DJ37E16.5 (Accession NM_020315) is another VGAM1740 host target gene. DJ37E16.5 BINDING SITE is HOST TARGET binding site found in the 3' untranslated region of mRNA encoded by DJ37E16.5, corresponding to a HOST TARGET binding site such as BINDING SITE I, BINDING SITE II or BINDING SITE III. Table 2 illustrates the complementarity of the nucleotide sequences of DJ37E16.5 BINDING SITE, designated SEQ ID:21574, to the nucleotide sequence of VGAM1740 RNA, herein designated VGAM RNA, also designated SEQ ID:4451.

Another function of VGAM1740 is therefore inhibition of DJ37E16.5 (Accession NM_020315). Accordingly, utilities of VGAM1740 include diagnosis, prevention and treatment of diseases and clinical conditions associated with DJ37E16.5. KIAA1456 (Accession XM_040100) is another VGAM1740 host target gene. KIAA1456 BINDING SITE is HOST TARGET binding site found in the 3' untranslated region of mRNA encoded by KIAA1456, corresponding to a HOST TARGET binding site such as BINDING SITE I, BINDING SITE II or BINDING SITE III. Table 2 illustrates the complementarity of the nucleotide sequences of KIAA1456 BINDING SITE, designated SEQ ID:33266, to the nucleotide sequence of VGAM1740 RNA, herein designated VGAM RNA, also designated SEQ ID:4451.

Another function of VGAM1740 is therefore inhibition of KIAA1456 (Accession XM_040100). Accordingly, utilities of VGAM1740 include diagnosis, prevention and treatment of diseases and clinical conditions associated with KIAA1456. TUCAN (Accession NM_014959) is another VGAM1740 host target gene. TUCAN BINDING SITE is HOST TARGET binding site found in the 3' untranslated region of mRNA encoded by TUCAN, corresponding to a HOST TARGET binding site such as BINDING SITE I, BINDING SITE II or BINDING SITE III. Table 2 illustrates the complementarity of the nucleotide sequences of TUCAN BINDING SITE, designated SEQ ID:17321, to the nucleotide sequence of VGAM1740 RNA, herein designated VGAM RNA, also designated SEQ ID:4451.

Another function of VGAM1740 is therefore inhibition of TUCAN (Accession NM_014959). Accordingly, utilities of VGAM1740 include diagnosis, prevention and treatment of diseases and clinical conditions associated with TUCAN. LOC158310 (Accession XM_098919) is another VGAM1740 host target gene. LOC158310 BINDING SITE is HOST TARGET binding site found in the 5' untranslated region of mRNA encoded by LOC158310, corresponding to a HOST TARGET binding site such as BINDING SITE I, BINDING SITE II or BINDING SITE III. Table 2 illustrates the complementarity of the nucleotide sequences of LOC158310 BINDING SITE, designated SEQ ID:41950, to the nucleotide sequence of VGAM1740 RNA, herein designated VGAM RNA, also designated SEQ ID:4451.

Another function of VGAM1740 is therefore inhibition of LOC158310 (Accession XM_098919). Accordingly, utilities of VGAM1740 include diagnosis, prevention and treatment of diseases and clinical conditions associated with LOC158310. FIG. 1 further provides a conceptual description of a novel bioinformatically detected viral gene of the present invention, referred to here as Viral Genomic Address Messenger 1741 (VGAM1741) viral gene, which modulates expression of respective host target genes thereof, the function and utility of which host target genes is known in the art.

VGAM1741 is a novel bioinformatically detected regulatory, non protein coding, viral micro RNA (miRNA) gene. The method by which VGAM1741 was detected is described hereinabove with reference to FIGS. 1-8.

VGAM1741 gene, herein designated VGAM GENE, is a viral gene contained in the genome of Cercopithecine Herpesvirus 7. VGAM1741 host target gene, herein designated VGAM HOST TARGET GENE, is a human gene contained in the human genome.

VGAM1741 gene encodes a VGAM1741 precursor RNA, herein designated VGAM PRECURSOR RNA. Similar to other miRNA genes, and unlike most ordinary genes, VGAM1741 precursor RNA does not encode a protein. A nucleotide sequence identical or highly similar to the nucleotide sequence of VGAM1741 precursor RNA is designated SEQ ID:1727, and is provided hereinbelow with reference to the sequence listing part. Nucleotide sequence SEQ ID:1727 is located at position 36070 relative to the genome of Cercopithecine Herpesvirus 7.

VGAM1741 precursor RNA folds onto itself, forming VGAM1741 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1741 folded precursor RNA into VGAM1741 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1741 RNA is designated SEQ ID:4452, and is provided hereinbelow with reference to the sequence listing part.

VGAM1741 host target gene, herein designated VGAM HOST TARGET GENE, encodes a corresponding messenger RNA, VGAM1741 host target RNA, herein designated VGAM HOST TARGET RNA. VGAM1741 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1741 RNA, herein designated VGAM RNA, binds complementarily to one or more host target binding sites located in untranslated regions of VGAM1741 host target RNA, herein designated VGAM HOST TARGET RNA. This complementary binding is due to the fact that the nucleotide sequence of VGAM1741 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1741 RNA, herein designated VGAM RNA, may have a different number of host target binding sites in untranslated regions of a VGAM1741 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1741 RNA, herein designated VGAM RNA, to host target binding sites on VGAM1741 host target RNA, herein designated VGAM HOST TARGET RNA, such as BINDING SITE I, BINDING SITE II and BINDING SITE III, inhibits translation of VGAM1741 host target RNA into VGAM1741 host target protein, herein designated VGAM HOST TARGET PROTEIN. VGAM host target protein is therefore outlined by a broken line.

It is appreciated that VGAM1741 host target gene, herein designated VGAM HOST TARGET GENE, in fact represents a plurality of VGAM1741 host target genes. The mRNA of each one of this plurality of VGAM1741 host target genes comprises one or more host target binding sites, each having a nucleotide sequence which is at least partly complementary to VGAM1741 RNA, herein designated VGAM RNA, and which when bound by VGAM1741 RNA causes inhibition of translation of respective one or more VGAM1741 host target proteins.

It is further appreciated by one skilled in the art that the mode of translational inhibition illustrated by FIG. 1 with specific reference to translational inhibition exerted by VGAM1741 gene, herein designated VGAM GENE, on one or more VGAM1741 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1741 is inhibition of expression of host target genes, as part of a novel viral mechanism of attacking a host. Accordingly, utilities of VGAM1741 include diagnosis, prevention and treatment of viral infection by Cercopithecine Herpesvirus 7. Specific functions, and accordingly utilities, of VGAM1741 correlate with, and may be deduced from, the identity of the host target genes which VGAM1741 binds and inhibits, and the function of these host target genes, as elaborated hereinbelow.

Nucleotide sequences of the VGAM1741 precursor RNA, herein designated VGAM PRECURSOR RNA, and of the 'diced' VGAM1741 RNA, herein designated VGAM RNA, and a schematic representation of the secondary folding of VGAM1741 folded precursor RNA, herein designated VGAM FOLDED PRECURSOR RNA, of VGAM1741 are further described hereinbelow with reference to Table 1.

Nucleotide sequences of host target binding sites, such as BINDING SITE-I, BINDING SITE-II and BINDING SITE- III of FIG. 1, found on VGAM1741 host target RNA, and schematic representation of the complementarity of each of these host target binding sites to VGAM1741 RNA, herein designated VGAM RNA, are described hereinbelow with reference to Table 2.

As mentioned hereinabove with reference to FIG. 1, a function of VGAM1741 gene, herein designated VGAM is inhibition of expression of VGAM1741 target genes. It is appreciated that specific functions, and accordingly utilities, of VGAM1741 correlate with, and may be deduced from, the identity of the target genes which VGAM1741 binds and inhibits, and the function of these target genes, as elaborated hereinbelow.

1-acylglycerol-3-phosphate O-acyltransferase 2 (lysophosphatidic acid acyltransferase, beta) (AGPAT2, Accession XM_038030) is a VGAM1741 host target gene. AGPAT2 BINDING SITE is HOST TARGET binding site found in the 3' untranslated region of mRNA encoded by AGPAT2, corresponding to a HOST TARGET binding site such as BINDING SITE I, BINDING SITE II or BINDING SITE III. Table 2 illustrates the complementarity of the nucleotide sequences of AGPAT2 BINDING SITE, designated SEQ ID:32744, to the nucleotide sequence of VGAM1741 RNA, herein designated VGAM RNA, also designated SEQ ID:4452.

A function of VGAM1741 is therefore inhibition of 1-acylglycerol-3-phosphate O-acyltransferase 2 (lysophosphatidic acid acyltransferase, beta) (AGPAT2, Accession XM_038030). Accordingly, utilities of VGAM1741 include diagnosis, prevention and treatment of diseases and clinical conditions associated with AGPAT2. Ectonucleoside Triphosphate Diphosphohydrolase 3 (ENTPD3, Accession NM_001248) is another VGAM1741 host target gene. ENTPD3 BINDING SITE is HOST TARGET binding site found in the 3' untranslated region of mRNA encoded by ENTPD3, corresponding to a HOST TARGET binding site such as BINDING SITE I, BINDING SITE II or BINDING SITE III. Table 2 illustrates the complementarity of the nucleotide sequences of ENTPD3 BINDING SITE, designated SEQ ID:6922, to the nucleotide sequence of VGAM1741 RNA, herein designated VGAM RNA, also designated SEQ ID:4452.

Another function of VGAM1741 is therefore inhibition of Ectonucleoside Triphosphate Diphosphohydrolase 3 (ENTPD3, Accession NM_001248). Accordingly, utilities of VGAM1741 include diagnosis, prevention and treatment of diseases and clinical conditions associated with ENTPD3. Microtubule-associated Protein, RP/EB Family, Member 2 (MAPRE2, Accession NM_014268) is another VGAM1741 host target gene. MAPRE2 BINDING SITE is HOST TARGET binding site found in the 3' untranslated region of mRNA encoded by MAPRE2, corresponding to a HOST TARGET binding site such as BINDING SITE I, BINDING SITE II or BINDING SITE III. Table 2 illustrates the complementarity of the nucleotide sequences of MAPRE2 BINDING SITE, designated SEQ ID:15548, to the nucleotide sequence of VGAM1741 RNA, herein designated VGAM RNA, also designated SEQ ID:4452.

Another function of VGAM1741 is therefore inhibition of Microtubule-associated Protein, RP/EB Family, Member 2 (MAPRE2, Accession NM_014268), a gene which The functional inactivation of the APC gene product is a key event in colorectal tumorigenesis. Accordingly, utilities of VGAM1741 include diagnosis, prevention and treatment of diseases and clinical conditions associated with MAPRE2. The function of MAPRE2 and its association with various diseases and clinical conditions, has been established by previous studies, as described hereinabove with reference to VGAM178. Syntrophin, Beta 2 (dystrophin-associated protein A1, 59 kDa, basic component 2) (SNTB2, Accession NM_130845) is another VGAM1741 host target gene. SNTB2 BINDING SITE is HOST TARGET binding site found in the 3' untranslated region of mRNA encoded by SNTB2, corresponding to a HOST TARGET binding site such as BINDING SITE I, BINDING SITE II or BINDING SITE III. Table 2 illustrates the complementarity of the nucleotide sequences of SNTB2 BINDING SITE, designated SEQ ID:28379, to the nucleotide sequence of VGAM1741 RNA, herein designated VGAM RNA, also designated SEQ ID:4452.

Another function of VGAM1741 is therefore inhibition of Syntrophin, Beta 2 (dystrophin-associated protein A1, 59 kDa, basic component 2) (SNTB2, Accession NM_130845). Accordingly, utilities of VGAM1741 include diagnosis, prevention and treatment of diseases and clinical conditions associated with SNTB2. Ankyrin Repeat and SOCS Box-containing 13 (ASB13, Accession NM_024701) is another VGAM1741 host target gene. ASB13 BINDING SITE is HOST TARGET binding site found in the 3' untranslated region of mRNA encoded by ASB13, corresponding to a HOST TARGET binding site such as BINDING SITE I, BINDING SITE II or BINDING SITE III. Table 2 illustrates the complementarity of the nucleotide sequences of ASB13 BINDING SITE, designated SEQ ID:24013, to the nucleotide sequence of VGAM1741 RNA, herein designated VGAM RNA, also designated SEQ ID:4452.

Another function of VGAM1741 is therefore inhibition of Ankyrin Repeat and SOCS Box-containing 13 (ASB13, Accession NM_024701). Accordingly, utilities of VGAM1741 include diagnosis, prevention and treatment of diseases and clinical conditions associated with ASB13. Baculoviral IAP Repeat-containing 1 (BIRC1, Accession NM_004536) is another VGAM1741 host target gene. BIRC1 BINDING SITE is HOST TARGET binding site found in the 5' untranslated region of mRNA encoded by BIRC1, corresponding to a HOST TARGET binding site such as BINDING SITE I, BINDING SITE II or BINDING SITE III. Table 2 illustrates the complementarity of the nucleotide sequences of BIRC1 BINDING SITE, designated SEQ ID:10887, to the nucleotide sequence of VGAM1741 RNA, herein designated VGAM RNA, also designated SEQ ID:4452.

Another function of VGAM1741 is therefore inhibition of Baculoviral IAP Repeat-containing 1 (BIRC1, Accession NM_004536). Accordingly, utilities of VGAM1741 include diagnosis, prevention and treatment of diseases and clinical conditions associated with BIRC1. CLIPR-59 (Accession NM_015526) is another VGAM1741 host target gene. CLIPR-59 BINDING SITE is HOST TARGET binding site found in the 3' untranslated region of mRNA encoded by CLIPR-59, corresponding to a HOST TARGET binding site such as BINDING SITE I, BINDING SITE II or BINDING SITE III. Table 2 illustrates the complementarity of the nucleotide sequences of CLIPR-59 BINDING SITE, designated SEQ ID:17787, to the nucleotide sequence of VGAM1741 RNA, herein designated VGAM RNA, also designated SEQ ID:4452.

Another function of VGAM1741 is therefore inhibition of CLIPR-59 (Accession NM_015526). Accordingly, utilities of VGAM1741 include diagnosis, prevention and treatment of diseases and clinical conditions associated with CLIPR-59. KIAA1084 (Accession NM_014910) is another VGAM1741 host target gene. KIAA1084 BINDING SITE is HOST TARGET binding site found in the 3' untranslated region of mRNA encoded by KIAA1084, corresponding to a HOST TARGET binding site such as BINDING SITE I, BINDING SITE II or BINDING SITE III. Table 2 illustrates the complementarity of the nucleotide sequences of KIAA1084 BINDING SITE, designated SEQ ID:17135, to the nucleotide sequence of VGAM1741 RNA, herein designated VGAM RNA, also designated SEQ ID:4452.

Another function of VGAM1741 is therefore inhibition of KIAA1084 (Accession NM_014910). Accordingly, utilities of VGAM1741 include diagnosis, prevention and treatment of diseases and clinical conditions associated with KIAA1084. OBTP (Accession NM_017601) is another VGAM1741 host target gene. OBTP BINDING SITE is HOST TARGET binding site found in the 3' untranslated region of mRNA encoded by OBTP, corresponding to a HOST TARGET binding site such as BINDING SITE I, BINDING SITE II or BINDING SITE III. Table 2 illustrates the complementarity of the nucleotide sequences of OBTP BINDING SITE, designated SEQ ID:19082, to the nucleotide sequence of VGAM1741 RNA, herein designated VGAM RNA, also designated SEQ ID:4452.

Another function of VGAM1741 is therefore inhibition of OBTP (Accession NM_017601). Accordingly, utilities of VGAM1741 include diagnosis, prevention and treatment of diseases and clinical conditions associated with OBTP. Rpo1-2 (Accession NM_032212) is another VGAM1741 host target gene. Rpo1-2 BINDING SITE is HOST TARGET binding site found in the 3' untranslated region of mRNA encoded by Rpo1-2, corresponding to a HOST TARGET binding site such as BINDING SITE I, BINDING SITE II or BINDING SITE III. Table 2 illustrates the complementarity of the nucleotide sequences of Rpo1-2 BINDING SITE, designated SEQ ID:25932, to the nucleotide sequence of VGAM1741 RNA, herein designated VGAM RNA, also designated SEQ ID:4452.

Another function of VGAM1741 is therefore inhibition of Rpo1-2 (Accession NM_032212). Accordingly, utilities of VGAM1741 include diagnosis, prevention and treatment of diseases and clinical conditions associated with Rpo1-2. SPBPBP (Accession NM_006692) is another VGAM1741 host target gene. SPBPBP BINDING SITE is HOST TARGET binding site found in the 5' untranslated region of mRNA encoded by SPBPBP, corresponding to a HOST TARGET binding site such as BINDING SITE I, BINDING SITE II or BINDING SITE III. Table 2 illustrates the complementarity of the nucleotide sequences of SPBPBP BINDING SITE, designated SEQ ID:13509, to the nucleotide sequence of VGAM1741 RNA, herein designated VGAM RNA, also designated SEQ ID:4452.

Another function of VGAM1741 is therefore inhibition of SPBPBP (Accession NM_006692). Accordingly, utilities of VGAM1741 include diagnosis, prevention and treatment of diseases and clinical conditions associated with SPBPBP. Testis-specific Transcript, Y-linked 9 (TTTY9, Accession NM_031927) is another VGAM1741 host target gene. TTTY9 BINDING SITE is HOST TARGET binding site found in the 3' untranslated region of mRNA encoded by TTTY9, corresponding to a HOST TARGET binding site such as BINDING SITE I, BINDING SITE II or BINDING SITE III. Table 2 illustrates the complementarity of the nucleotide sequences of TTTY9 BINDING SITE, designated SEQ ID:25678, to the nucleotide sequence of VGAM1741 RNA, herein designated VGAM RNA, also designated SEQ ID:4452.

Another function of VGAM1741 is therefore inhibition of Testis-specific Transcript, Y-linked 9 (TTTY9, Accession NM_031927). Accordingly, utilities of VGAM1741 include diagnosis, prevention and treatment of diseases and clinical conditions associated with TTTY9. LOC145216 (Accession XM_096730) is another VGAM1741 host target gene. LOC145216 BINDING SITE is HOST TARGET binding site found in the 3' untranslated region of mRNA encoded by LOC145216, corresponding to a HOST TARGET binding site such as BINDING SITE I, BINDING SITE II or BINDING SITE III. Table 2 illustrates the complementarity of the nucleotide sequences of LOC145216 BINDING SITE, designated SEQ ID:40505, to the nucleotide sequence of VGAM1741 RNA, herein designated VGAM RNA, also designated SEQ ID:4452.

Another function of VGAM1741 is therefore inhibition of LOC145216 (Accession XM_096730). Accordingly, utilities of VGAM1741 include diagnosis, prevention and treatment of diseases and clinical conditions associated with LOC145216. LOC152457 (Accession XM_087476) is another VGAM1741 host target gene. LOC152457 BINDING SITE is HOST TARGET binding site found in the 3' untranslated region of mRNA encoded by LOC152457, corresponding to a HOST TARGET binding site such as BINDING SITE I, BINDING SITE II or BINDING SITE III. Table 2 illustrates the complementarity of the nucleotide sequences of LOC152457 BINDING SITE, designated SEQ ID:39279, to the nucleotide sequence of VGAM1741 RNA, herein designated VGAM RNA, also designated SEQ ID:4452.

Another function of VGAM1741 is therefore inhibition of LOC152457 (Accession XM_087476). Accordingly, utilities of VGAM1741 include diagnosis, prevention and treatment of diseases and clinical conditions associated with LOC152457. LOC221421 (Accession XM_166428) is another VGAM1741 host target gene. LOC221421 BINDING SITE is HOST TARGET binding site found in the 3' untranslated region of mRNA encoded by LOC221421, corresponding to a HOST TARGET binding site such as BINDING SITE I, BINDING SITE II or BINDING SITE III. Table 2 illustrates the complementarity of the nucleotide sequences of LOC221421 BINDING SITE, designated SEQ ID:44323, to the nucleotide sequence of VGAM1741 RNA, herein designated VGAM RNA, also designated SEQ ID:4452.

Another function of VGAM1741 is therefore inhibition of LOC221421 (Accession XM_166428). Accordingly, utilities of VGAM1741 include diagnosis, prevention and treatment of diseases and clinical conditions associated with LOC221421. FIG. 1 further provides a conceptual description of a novel bioinformatically detected viral gene of the present invention, referred to here as Viral Genomic Address Messenger 1742 (VGAM1742) viral gene, which modulates expression of respective host target genes thereof, the function and utility of which host target genes is known in the art.

VGAM1742 is a novel bioinformatically detected regulatory, non protein coding, viral micro RNA (miRNA) gene. The method by which VGAM1742 was detected is described hereinabove with reference to FIGS. 1-8.

VGAM1742 gene, herein designated VGAM GENE, is a viral gene contained in the genome of Cercopithecine Herpesvirus 7. VGAM1742 host target gene, herein designated VGAM HOST TARGET GENE, is a human gene contained in the human genome.

VGAM1742 gene encodes a VGAM1742 precursor RNA, herein designated VGAM PRECURSOR RNA. Similar to other miRNA genes, and unlike most ordinary genes, VGAM1742 precursor RNA does not encode a protein. A nucleotide sequence identical or highly similar to the nucleotide sequence of VGAM1742 precursor RNA is designated SEQ ID:1728, and is provided hereinbelow with reference to the sequence listing part. Nucleotide sequence SEQ ID:1728 is located at position 40735 relative to the genome of Cercopithecine Herpesvirus 7.

VGAM1742 precursor RNA folds onto itself, forming VGAM1742 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1742 folded precursor RNA into VGAM1742 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1742 RNA is designated SEQ ID:4453, and is provided hereinbelow with reference to the sequence listing part.

VGAM1742 host target gene, herein designated VGAM HOST TARGET GENE, encodes a corresponding messenger RNA, VGAM1742 host target RNA, herein designated VGAM HOST TARGET RNA. VGAM1742 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1742 RNA, herein designated VGAM RNA, binds complementarily to one or more host target binding sites located in untranslated regions of VGAM1742 host target RNA, herein designated VGAM HOST TARGET RNA. This complementary binding is due to the fact that the nucleotide sequence of VGAM1742 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1742 RNA, herein designated VGAM RNA, may have a different number of host target binding sites in untranslated regions of a VGAM1742 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1742 RNA, herein designated VGAM RNA, to host target binding sites on VGAM1742 host target RNA, herein designated VGAM HOST TARGET RNA, such as BINDING SITE I, BINDING SITE II and BINDING SITE III, inhibits translation of VGAM1742 host target RNA into VGAM1742 host target protein, herein designated VGAM HOST TARGET PROTEIN. VGAM host target protein is therefore outlined by a broken line.

It is appreciated that VGAM1742 host target gene, herein designated VGAM HOST TARGET GENE, in fact represents a plurality of VGAM1742 host target genes. The mRNA of each one of this plurality of VGAM1742 host target genes comprises one or more host target binding sites, each having a nucleotide sequence which is at least partly complementary to VGAM1742 RNA, herein designated VGAM RNA, and which when bound by VGAM1742 RNA causes inhibition of translation of respective one or more VGAM1742 host target proteins.

It is further appreciated by one skilled in the art that the mode of translational inhibition illustrated by FIG. 1 with specific reference to translational inhibition exerted by VGAM1742 gene, herein designated VGAM GENE, on one or more VGAM1742 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1742 is inhibition of expression of host target genes, as part of a novel viral mechanism of attacking a host. Accordingly, utilities of VGAM1742 include diagnosis, prevention and treatment of viral infection by Cercopithecine Herpesvirus 7. Specific functions, and accordingly utilities, of VGAM1742 correlate with, and may be deduced from, the identity of the host target genes which VGAM1742 binds and inhibits, and the function of these host target genes, as elaborated hereinbelow.

Nucleotide sequences of the VGAM1742 precursor RNA, herein designated VGAM PRECURSOR RNA, and of the 'diced' VGAM1742 RNA, herein designated VGAM RNA, and a schematic representation of the secondary folding of VGAM1742 folded precursor RNA, herein designated VGAM FOLDED PRECURSOR RNA, of VGAM1742 are further described hereinbelow with reference to Table 1.

Nucleotide sequences of host target binding sites, such as BINDING SITE-I, BINDING SITE-II and BINDING SITE-III of FIG. 1, found on VGAM1742 host target RNA, and schematic representation of the complementarity of each of these host target binding sites to VGAM1742 RNA, herein designated VGAM RNA, are described hereinbelow with reference to Table 2.

As mentioned hereinabove with reference to FIG. 1, a function of VGAM1742 gene, herein designated VGAM is inhibition of expression of VGAM1742 target genes. It is appreciated that specific functions, and accordingly utilities, of VGAM1742 correlate with, and may be deduced from, the identity of the target genes which VGAM1742 binds and inhibits, and the function of these target genes, as elaborated hereinbelow.

COX10 Homolog, Cytochrome C Oxidase Assembly Protein, Heme A: Farnesyltransferase (yeast) (COX10, Accession NM_001303) is a VGAM1742 host target gene. COX10 BINDING SITE is HOST TARGET binding site found in the 5' untranslated region of mRNA encoded by COX10, corresponding to a HOST TARGET binding site such as BINDING SITE I, BINDING SITE II or BINDING SITE III. Table 2 illustrates the complementarity of the nucleotide sequences of COX10 BINDING SITE, designated SEQ ID:6980, to the nucleotide sequence of VGAM1742 RNA, herein designated VGAM RNA, also designated SEQ ID:4453.

A function of VGAM1742 is therefore inhibition of COX10 Homolog, Cytochrome C Oxidase Assembly Protein, Heme A: Farnesyltransferase (yeast) (COX10, Accession NM_001303). Accordingly, utilities of VGAM1742 include diagnosis, prevention and treatment of diseases and clinical conditions associated with COX10. FLJ22055 (Accession NM_024779) is another VGAM1742 host target gene. FLJ22055 BINDING SITE is HOST TARGET binding site found in the 3' untranslated region of mRNA encoded by FLJ22055, corresponding to a HOST TARGET binding site such as BINDING SITE I, BINDING SITE II or BINDING SITE III. Table 2 illustrates the complementarity of the nucleotide sequences of FLJ22055 BINDING SITE, designated SEQ ID:24147, to the nucleotide sequence of VGAM1742 RNA, herein designated VGAM RNA, also designated SEQ ID:4453.

Another function of VGAM1742 is therefore inhibition of FLJ22055 (Accession NM_024779). Accordingly, utilities of VGAM1742 include diagnosis, prevention and treatment of diseases and clinical conditions associated with FLJ22055. KIAA0802 (Accession XM_031357) is another VGAM1742 host target gene. KIAA0802 BINDING SITE is HOST TARGET binding site found in the 3' untranslated region of mRNA encoded by KIAA0802, corresponding to a HOST TARGET binding site such as BINDING SITE I, BINDING SITE II or BINDING SITE III. Table 2 illustrates the complementarity of the nucleotide sequences of KIAA0802 BINDING SITE, designated SEQ ID:31352, to the nucleotide sequence of VGAM1742 RNA, herein designated VGAM RNA, also designated SEQ ID:4453.

Another function of VGAM1742 is therefore inhibition of KIAA0802 (Accession XM_031357). Accordingly, utilities of VGAM1742 include diagnosis, prevention and treatment of diseases and clinical conditions associated with KIAA0802. LOC115574 (Accession XM_056240) is another VGAM1742 host target gene. LOC115574 BINDING SITE is HOST TARGET binding site found in the 3' untranslated region of mRNA encoded by LOC115574, corresponding to a HOST TARGET binding site such as BINDING SITE I, BINDING SITE II or BINDING SITE III. Table 2 illustrates the complementarity of the nucleotide sequences of LOC115574 BINDING SITE, designated SEQ ID:36367, to the nucleotide sequence of VGAM1742 RNA, herein designated VGAM RNA, also designated SEQ ID:4453.

Another function of VGAM1742 is therefore inhibition of LOC115574 (Accession XM_056240). Accordingly, utilities of VGAM1742 include diagnosis, prevention and treatment of diseases and clinical conditions associated with LOC115574. LOC221968 (Accession XM_166524) is another VGAM1742 host target gene. LOC221968 BINDING SITE is HOST TARGET binding site found in the 3' untranslated region of mRNA encoded by LOC221968, corresponding to a HOST TARGET binding site such as BINDING SITE I, BINDING SITE II or BINDING SITE III. Table 2 illustrates the complementarity of the nucleotide sequences of LOC221968 BINDING SITE, designated SEQ ID:44471, to the nucleotide sequence of VGAM1742 RNA, herein designated VGAM RNA, also designated SEQ ID:4453.

Another function of VGAM1742 is therefore inhibition of LOC221968 (Accession XM_166524). Accordingly, utilities of VGAM1742 include diagnosis, prevention and treatment of diseases and clinical conditions associated with LOC221968. LOC256021 (Accession XM_172884) is another VGAM1742 host target gene. LOC256021 BINDING SITE is HOST TARGET binding site found in the 3' untranslated region of mRNA encoded by LOC256021, corresponding to a HOST TARGET binding site such as BINDING SITE I, BINDING SITE II or BINDING SITE III. Table 2 illustrates the complementarity of the nucleotide sequences of LOC256021 BINDING SITE, designated SEQ ID:46164, to the nucleotide sequence of VGAM1742 RNA, herein designated VGAM RNA, also designated SEQ ID:4453.

Another function of VGAM1742 is therefore inhibition of LOC256021 (Accession XM_172884). Accordingly, utilities of VGAM1742 include diagnosis, prevention and treatment of diseases and clinical conditions associated with LOC256021. FIG. 1 further provides a conceptual description of a novel bioinformatically detected viral gene of the present invention, referred to here as Viral Genomic Address Messenger 1743 (VGAM1743) viral gene, which modulates expression of respective host target genes thereof, the function and utility of which host target genes is known in the art.

VGAM1743 is a novel bioinformatically detected regulatory, non protein coding, viral micro RNA (miRNA) gene. The method by which VGAM1743 was detected is described hereinabove with reference to FIGS. 1-8.

VGAM1743 gene, herein designated VGAM GENE, is a viral gene contained in the genome of Cercopithecine Herpesvirus 7. VGAM1743 host target gene, herein designated VGAM HOST TARGET GENE, is a human gene contained in the human genome.

VGAM1743 gene encodes a VGAM1743 precursor RNA, herein designated VGAM PRECURSOR RNA. Similar to other miRNA genes, and unlike most ordinary genes, VGAM1743 precursor RNA does not encode a protein. A nucleotide sequence identical or highly similar to the nucleotide sequence of VGAM1743 precursor RNA is designated SEQ ID:1729, and is provided hereinbelow with reference to the sequence listing part. Nucleotide sequence SEQ ID:1729 is located at position 41519 relative to the genome of Cercopithecine Herpesvirus 7.

VGAM1743 precursor RNA folds onto itself, forming VGAM1743 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1743 folded precursor RNA into VGAM1743 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 78%) nucleotide sequence of VGAM1743 RNA is designated SEQ ID:4454, and is provided hereinbelow with reference to the sequence listing part.

VGAM1743 host target gene, herein designated VGAM HOST TARGET GENE, encodes a corresponding messenger RNA, VGAM1743 host target RNA, herein designated VGAM HOST TARGET RNA. VGAM1743 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1743 RNA, herein designated VGAM RNA, binds complementarily to one or more host target binding sites located in untranslated regions of VGAM1743 host target RNA, herein designated VGAM HOST TARGET RNA. This complementary binding is due to the fact that the nucleotide sequence of VGAM1743 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1743 RNA, herein designated VGAM RNA, may have a different number of host target binding sites in untranslated regions of a VGAM1743 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1743 RNA, herein designated VGAM RNA, to host target binding sites on VGAM1743 host target RNA, herein designated VGAM HOST TARGET RNA, such as BINDING SITE I, BINDING SITE II and BINDING SITE III, inhibits translation of VGAM1743 host target RNA into VGAM1743 host target protein, herein designated VGAM HOST TARGET PROTEIN. VGAM host target protein is therefore outlined by a broken line.

It is appreciated that VGAM1743 host target gene, herein designated VGAM HOST TARGET GENE, in fact represents a plurality of VGAM1743 host target genes. The mRNA of each one of this plurality of VGAM1743 host target genes comprises one or more host target binding sites, each having a nucleotide sequence which is at least partly complementary to VGAM1743 RNA, herein designated VGAM RNA, and which when bound by VGAM1743 RNA causes inhibition of translation of respective one or more VGAM1743 host target proteins.

It is further appreciated by one skilled in the art that the mode of translational inhibition illustrated by FIG. 1 with specific reference to translational inhibition exerted by VGAM1743 gene, herein designated VGAM GENE, on one or more VGAM1743 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1743 is inhibition of expression of host target genes, as part of a novel viral mechanism of attacking a host. Accordingly, utilities of VGAM1743 include diagnosis, prevention and treatment of viral infection by Cercopithecine Herpesvirus 7. Specific functions, and accordingly utilities, of VGAM1743 correlate with, and may be deduced from, the identity of the host target genes which VGAM1743 binds and inhibits, and the function of these host target genes, as elaborated hereinbelow.

Nucleotide sequences of the VGAM1743 precursor RNA, herein designated VGAM PRECURSOR RNA, and of the 'diced' VGAM1743 RNA, herein designated VGAM RNA, and a schematic representation of the secondary folding of VGAM1743 folded precursor RNA, herein designated VGAM FOLDED PRECURSOR RNA, of VGAM1743 are further described hereinbelow with reference to Table 1.

Nucleotide sequences of host target binding sites, such as BINDING SITE-I, BINDING SITE-II and BINDING SITE-III of FIG. 1, found on VGAM1743 host target RNA, and schematic representation of the complementarity of each of these host target binding sites to VGAM1743 RNA, herein designated VGAM RNA, are described hereinbelow with reference to Table 2.

As mentioned hereinabove with reference to FIG. 1, a function of VGAM1743 gene, herein designated VGAM is inhibition of expression of VGAM1743 target genes. It is appreciated that specific functions, and accordingly utilities, of VGAM1743 correlate with, and may be deduced from, the identity of the target genes which VGAM1743 binds and inhibits, and the function of these target genes, as elaborated hereinbelow.

A Disintegrin and Metalloproteinase Domain 19 (meltrin beta) (ADAM19, Accession NM_033274) is a VGAM1743 host target gene. ADAM19 BINDING SITE is HOST TARGET binding site found in the 3' untranslated region of mRNA encoded by ADAM19, corresponding to a HOST TARGET binding site such as BINDING SITE I, BINDING SITE II or BINDING SITE III. Table 2 illustrates the complementarity of the nucleotide sequences of ADAM19 BINDING SITE, designated SEQ ID:27097, to the nucleotide sequence of VGAM1743 RNA, herein designated VGAM RNA, also designated SEQ ID:4454.

A function of VGAM1743 is therefore inhibition of A Disintegrin and Metalloproteinase Domain 19 (meltrin beta) (ADAM19, Accession NM_033274), a gene which participates in the proteolytic processing of beta-type neuregulin isoforms. Accordingly, utilities of VGAM1743 include diagnosis, prevention and treatment of diseases and clinical conditions associated with ADAM19. The function of ADAM19 and its association with various diseases and clinical conditions, has been established by previous studies, as described hereinabove with reference to VGAM179. Nuclear Mitotic Apparatus Protein 1 (NUMA1, Accession XM_167853) is another VGAM1743 host target gene. NUMA1 BINDING SITE is HOST TARGET binding site found in the 3' untranslated region of mRNA encoded by NUMA1, corresponding to a HOST TARGET binding site such as BINDING SITE I, BINDING SITE II or BINDING SITE III. Table 2 illustrates the complementarity of the nucleotide sequences of NUMA1 BINDING SITE, designated SEQ ID:44879, to the nucleotide sequence of VGAM1743 RNA, herein designated VGAM RNA, also designated SEQ ID:4454.

Another function of VGAM1743 is therefore inhibition of Nuclear Mitotic Apparatus Protein 1 (NUMA1, Accession XM_167853), a gene which is nuclear mitotic apparatus protein. Accordingly, utilities of VGAM1743 include diagnosis, prevention and treatment of diseases and clinical conditions associated with NUMA1. The function of NUMA1 and its association with various diseases and clinical conditions, has been established by previous studies, as described hereinabove with reference to VGAM192. ATIP1 (Accession NM_020749) is another VGAM1743 host target gene. ATIP1 BINDING SITE is HOST TARGET binding site found in the 3' untranslated region of mRNA encoded by ATIP1, corresponding to a HOST TARGET binding site such as BINDING SITE I, BINDING SITE II or BINDING SITE III. Table 2 illustrates the complementarity of the nucleotide sequences of ATIP1 BINDING SITE, designated SEQ ID:21861, to the nucleotide sequence of VGAM1743 RNA, herein designated VGAM RNA, also designated SEQ ID:4454.

Another function of VGAM1743 is therefore inhibition of ATIP1 (Accession NM_020749). Accordingly, utilities of VGAM1743 include diagnosis, prevention and treatment of diseases and clinical conditions associated with ATIP1. KIAA0295 (Accession XM_042833) is another VGAM1743 host target gene. KIAA0295 BINDING SITE is HOST TARGET binding site found in the 3' untranslated region of mRNA encoded by KIAA0295, corresponding to a HOST TARGET binding site such as BINDING SITE I, BINDING SITE II or BINDING SITE III. Table 2 illustrates the complementarity of the nucleotide sequences of KIAA0295 BINDING SITE, designated SEQ ID:33783, to the nucleotide sequence of VGAM1743 RNA, herein designated VGAM RNA, also designated SEQ ID:4454.

Another function of VGAM1743 is therefore inhibition of KIAA0295 (Accession XM_042833). Accordingly, utilities of VGAM1743 include diagnosis, prevention and treatment of diseases and clinical conditions associated with KIAA0295. Ring Finger Protein 24 (RNF24, Accession NM_007219) is another VGAM1743 host target gene. RNF24 BINDING SITE is HOST TARGET binding site found in the 3' untranslated region of mRNA encoded by RNF24, corresponding to a HOST TARGET binding site such as BINDING SITE I, BINDING SITE II or BINDING SITE III. Table 2 illustrates the complementarity of the nucleotide sequences of RNF24 BINDING SITE, designated SEQ ID:14084, to the nucleotide sequence of VGAM1743 RNA, herein designated VGAM RNA, also designated SEQ ID:4454.

Another function of VGAM1743 is therefore inhibition of Ring Finger Protein 24 (RNF24, Accession NM_007219). Accordingly, utilities of VGAM1743 include diagnosis, prevention and treatment of diseases and clinical conditions associated with RNF24. VIT1 (Accession NM_018693) is another VGAM1743 host target gene. VIT1 BINDING SITE is HOST TARGET binding site found in the 5' untranslated region of mRNA encoded by VIT1, corresponding to a HOST TARGET binding site such as BINDING SITE I, BINDING SITE II or BINDING SITE III. Table 2 illustrates the complementarity of the nucleotide sequences of VIT1 BINDING SITE, designated SEQ ID:20766, to the nucleotide sequence of VGAM1743 RNA, herein designated VGAM RNA, also designated SEQ ID:4454.

Another function of VGAM1743 is therefore inhibition of VIT1 (Accession NM_018693). Accordingly, utilities of VGAM1743 include diagnosis, prevention and treatment of diseases and clinical conditions associated with VIT1. LOC118786 (Accession XM_061147) is another VGAM1743 host target gene. LOC118786 BINDING SITE is HOST TARGET binding site found in the 5' untranslated region of mRNA encoded by LOC118786, corresponding to a HOST TARGET binding site such as BINDING SITE I, BINDING SITE II or BINDING SITE III. Table 2 illustrates the complementarity of the nucleotide sequences of LOC118786 BINDING SITE, designated SEQ ID:37197, to the nucleotide sequence of VGAM1743 RNA, herein designated VGAM RNA, also designated SEQ ID:4454.

Another function of VGAM1743 is therefore inhibition of LOC118786 (Accession XM_061147). Accordingly, utilities of VGAM1743 include diagnosis, prevention and treatment of diseases and clinical conditions associated with LOC118786. LOC121441 (Accession XM_058561) is another VGAM1743 host target gene. LOC121441 BINDING SITE is HOST TARGET binding site found in the 3' untranslated region of mRNA encoded by LOC121441, corresponding to a HOST TARGET binding site such as BINDING SITE I, BINDING SITE II or BINDING SITE III. Table 2 illustrates the complementarity of the nucleotide sequences of LOC121441 BINDING SITE, designated SEQ ID:36659, to the nucleotide sequence of VGAM1743 RNA, herein designated VGAM RNA, also designated SEQ ID:4454.

Another function of VGAM1743 is therefore inhibition of LOC121441 (Accession XM_058561). Accordingly, utilities of VGAM1743 include diagnosis, prevention and treatment of diseases and clinical conditions associated with LOC121441. FIG. 1 further provides a conceptual description of a novel bioinformatically detected viral gene of the present invention, referred to here as Viral Genomic Address Messenger 1744 (VGAM1744) viral gene, which modulates expression of respective host target genes thereof, the function and utility of which host target genes is known in the art.

VGAM1744 is a novel bioinformatically detected regulatory, non protein coding, viral micro RNA (miRNA) gene. The method by which VGAM1744 was detected is described hereinabove with reference to FIGS. 1-8.

VGAM1744 gene, herein designated VGAM GENE, is a viral gene contained in the genome of Cercopithecine Herpesvirus 7. VGAM1744 host target gene, herein designated VGAM HOST TARGET GENE, is a human gene contained in the human genome.

VGAM1744 gene encodes a VGAM1744 precursor RNA, herein designated VGAM PRECURSOR RNA. Similar to other miRNA genes, and unlike most ordinary genes, VGAM1744 precursor RNA does not encode a protein. A nucleotide sequence identical or highly similar to the nucleotide sequence of VGAM1744 precursor RNA is designated SEQ ID:1730, and is provided hereinbelow with reference to the sequence listing part. Nucleotide sequence SEQ ID:1730 is located at position 38434 relative to the genome of Cercopithecine Herpesvirus 7.

VGAM1744 precursor RNA folds onto itself, forming VGAM1744 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1744 folded precursor RNA into VGAM1744 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1744 RNA is designated SEQ ID:4455, and is provided hereinbelow with reference to the sequence listing part.

VGAM1744 host target gene, herein designated VGAM HOST TARGET GENE, encodes a corresponding messenger RNA, VGAM1744 host target RNA, herein designated VGAM HOST TARGET RNA. VGAM1744 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1744 RNA, herein designated VGAM RNA, binds complementarily to one or more host target binding sites located in untranslated regions of VGAM1744 host target RNA, herein designated VGAM HOST TARGET RNA. This complementary binding is due to the fact that the nucleotide sequence of VGAM1744 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1744 RNA, herein designated VGAM RNA, may have a different number of host target binding sites in untranslated regions of a VGAM1744 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1744 RNA, herein designated VGAM RNA, to host target binding sites on VGAM1744 host target RNA, herein designated VGAM HOST TARGET RNA, such as BINDING SITE I, BINDING SITE II and BINDING SITE III, inhibits translation of VGAM1744 host target RNA into VGAM1744 host target protein, herein designated VGAM HOST TARGET PROTEIN. VGAM host target protein is therefore outlined by a broken line.

It is appreciated that VGAM1744 host target gene, herein designated VGAM HOST TARGET GENE, in fact represents a plurality of VGAM1744 host target genes. The mRNA of each one of this plurality of VGAM1744 host target genes comprises one or more host target binding sites, each having a nucleotide sequence which is at least partly complementary to VGAM1744 RNA, herein designated VGAM RNA, and which when bound by VGAM1744 RNA causes inhibition of translation of respective one or more VGAM1744 host target proteins.

It is further appreciated by one skilled in the art that the mode of translational inhibition illustrated by FIG. 1 with specific reference to translational inhibition exerted by VGAM1744 gene, herein designated VGAM GENE, on one or more VGAM1744 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1744 is inhibition of expression of host target genes, as part of a novel viral mechanism of attacking a host. Accordingly, utilities of VGAM1744 include diagnosis, prevention and treatment of viral infection by Cercopithecine Herpesvirus 7. Specific functions, and accordingly utilities, of VGAM1744 correlate with, and may be deduced from, the identity of the host target genes which VGAM1744 binds and inhibits, and the function of these host target genes, as elaborated hereinbelow.

Nucleotide sequences of the VGAM1744 precursor RNA, herein designated VGAM PRECURSOR RNA, and of the 'diced' VGAM1744 RNA, herein designated VGAM RNA, and a schematic representation of the secondary folding of VGAM1744 folded precursor RNA, herein designated VGAM FOLDED PRECURSOR RNA, of VGAM1744 are further described hereinbelow with reference to Table 1.

Nucleotide sequences of host target binding sites, such as BINDING SITE-I, BINDING SITE-II and BINDING SITE-III of FIG. 1, found on VGAM1744 host target RNA, and schematic representation of the complementarity of each of these host target binding sites to VGAM1744 RNA, herein designated VGAM RNA, are described hereinbelow with reference to Table 2.

As mentioned hereinabove with reference to FIG. 1, a function of VGAM1744 gene, herein designated VGAM is inhibition of expression of VGAM1744 target genes. It is appreciated that specific functions, and accordingly utilities, of VGAM1744 correlate with, and may be deduced from, the identity of the target genes which VGAM1744 binds and inhibits, and the function of these target genes, as elaborated hereinbelow.

ATP-binding Cassette, Sub-family C (CFTR/MRP), Member 5 (ABCC5, Accession NM_005688) is a VGAM1744 host target gene. ABCC5 BINDING SITE is HOST TARGET binding site found in the 3' untranslated region of mRNA encoded by ABCC5, corresponding to a HOST TARGET binding site such as BINDING SITE I, BINDING SITE II or BINDING SITE III. Table 2 illustrates the complementarity of the nucleotide sequences of ABCC5 BINDING SITE, designated SEQ ID:12249, to the nucleotide sequence of VGAM1744 RNA, herein designated VGAM RNA, also designated SEQ ID:4455.

A function of VGAM1744 is therefore inhibition of ATP-binding Cassette, Sub-family C (CFTR/MRP), Member 5 (ABCC5, Accession NM_005688), a gene which acts as a multispecific organic anion pump which can transport nucleotide analogs. Accordingly, utilities of VGAM1744 include diagnosis, prevention and treatment of diseases and clinical conditions associated with ABCC5. The function of ABCC5 has been established by previous studies. Multidrug resistance (MDR) proteins (MRPs) mediate the extrusion of drugs from normal cells and tumors. MDR/ATP-binding cassette (ABC) membrane proteins are involved in energy-dependent transport of a wide variety of substrates. Allikmets et al. (1996) and Kool et al. (1997) used EST database searching to identify partial cDNAs encoding ABCC5 (see OMIM Ref. No. ABCC4, 605250). Using RT-PCR with degenerate primers, Suzuki et al. (1997) isolated a cDNA encoding short MRP, an apparent splice variant of ABCC5 (Suzuki et al., 2000). By EST database searching, followed by 5-prime RACE, Belinsky et al. (1998) obtained a cDNA encoding full-length ABCC5, which they termed MOATC (multispecific organic anion transporter C). Sequence analysis predicted that the 1,437-amino acid protein, like other ABC transporters, contains Walker A, B and C motifs, nucleotide-binding folds, and 12 transmembrane spanning helices in 2 hydrophobic domains. Kool et al. (1997), Suzuki et al. (1997), and Belinsky et al. (1998) performed Northern blot analysis which revealed ubiquitous expression of a 6.6-kb ABCC5 transcript with highest levels in skeletal muscle followed by brain, kidney, testis, and heart. Oguri et al. (2000) noted that the effectiveness of platinum drugs in lung cancer is limited by the development of drug resistance to them. Quantitative RT-PCR analysis showed that expression of ABCC5, like that of ABCC1 (OMIM Ref. No. 158343) and gamma-glutamyl-cysteine synthetase (see OMIM Ref. No. 606857), is increased in normal and tumor lung tissue from patients with previous platinum exposure. However, in vitro exposure of lung cancer cells to the platinum drug cisplatin, or of mononuclear cells to carboplatin, does not cause increased expression of ABCC5.

Full details of the abovementioned studies are described in the following publications, the disclosure of which are hereby incorporated by reference:

Suzuki, T.; Sasaki, H.; Kuh, H.-J.; Agui, M.; Tatsumi, Y.; Tanabe, S.; Terada, M.; Saijo, N.; Nishio, K.: Detailed structural analysis on both human MRP5 and mouse mrp5 transcripts. Gene 242:167-173, 2000; and Oguri, T.; Isobe, T.; Suzuki, T.; Nishio, K.; Fujiwara, Y.; Katoh, O.; Yamakido, M.: Increased expression of the MRP5 gene is associated with exposure to platinum drugs in lung cancer.

Further studies establishing the function and utilities of ABCC5 are found in John Hopkins OMIM database record ID 605251, and in sited publications numbered 282 and 5013-4401 listed in the bibliography section hereinbelow, which are also hereby incorporated by reference. FLJ21736 (Accession NM_024922) is another VGAM1744 host target gene. FLJ21736 BINDING SITE is HOST TARGET binding site found in the 3' untranslated region of mRNA encoded by FLJ21736, corresponding to a HOST TARGET binding site such as BINDING SITE I, BINDING SITE II or BINDING SITE III. Table 2 illustrates the complementarity of the nucleotide sequences of FLJ21736 BINDING SITE, designated SEQ ID:24460, to the nucleotide sequence of VGAM1744 RNA, herein designated VGAM RNA, also designated SEQ ID:4455.

Another function of VGAM1744 is therefore inhibition of FLJ21736 (Accession NM_024922). Accordingly, utilities of VGAM1744 include diagnosis, prevention and treatment of diseases and clinical conditions associated with FLJ21736. G Protein-coupled Receptor Kinase-interactor 2 (GIT2, Accession NM_139201) is another VGAM1744 host target gene. GIT2 BINDING SITE is HOST TARGET binding site found in the 3' untranslated region of mRNA encoded by GIT2, corresponding to a HOST TARGET binding site such as BINDING SITE I, BINDING SITE II or BINDING SITE III. Table 2 illustrates the complementarity of the nucleotide sequences of GIT2 BINDING SITE, designated SEQ ID:29213, to the nucleotide sequence of VGAM1744 RNA, herein designated VGAM RNA, also designated SEQ ID:4455.

Another function of VGAM1744 is therefore inhibition of G Protein-coupled Receptor Kinase-interactor 2 (GIT2, Accession NM_139201). Accordingly, utilities of VGAM1744 include diagnosis, prevention and treatment of diseases and clinical conditions associated with GIT2. KIAA1128 (Accession XM_043596) is another VGAM1744 host target gene. KIAA1128 BINDING SITE is HOST TARGET binding site found in the 3' untranslated region of mRNA encoded by KIAA1128, corresponding to a HOST TARGET binding site such as BINDING SITE I, BINDING SITE II or BINDING SITE III. Table 2 illustrates the complementarity of the nucleotide sequences of KIAA1128 BINDING SITE, designated SEQ ID:33968, to the nucleotide sequence of VGAM1744 RNA, herein designated VGAM RNA, also designated SEQ ID:4455.

Another function of VGAM1744 is therefore inhibition of KIAA1128 (Accession XM_043596). Accordingly, utilities of VGAM1744 include diagnosis, prevention and treatment of diseases and clinical conditions associated with KIAA1128. KIAA1384 (Accession XM_035405) is another VGAM1744 host target gene. KIAA1384 BINDING SITE is HOST TARGET binding site found in the 3' untranslated region of mRNA encoded by KIAA1384, corresponding to a HOST TARGET binding site such as BINDING SITE I, BINDING SITE II or BINDING SITE III. Table 2 illustrates the complementarity of the nucleotide sequences of KIAA1384 BINDING SITE, designated SEQ ID:32260, to the nucleotide sequence of VGAM1744 RNA, herein designated VGAM RNA, also designated SEQ ID:4455.

Another function of VGAM1744 is therefore inhibition of KIAA1384 (Accession XM_035405). Accordingly, utilities of VGAM1744 include diagnosis, prevention and treatment of diseases and clinical conditions associated with KIAA1384. KIAA1958 (Accession XM_088566) is another VGAM1744 host target gene. KIAA1958 BINDING SITE is HOST TARGET binding site found in the 3' untranslated region of mRNA encoded by KIAA1958, corresponding to a HOST TARGET binding site such as BINDING SITE I, BINDING SITE II or BINDING SITE III. Table 2 illustrates the complementarity of the nucleotide sequences of KIAA1958 BINDING SITE, designated SEQ ID:39831, to the nucleotide sequence of VGAM1744 RNA, herein designated VGAM RNA, also designated SEQ ID:4455.

Another function of VGAM1744 is therefore inhibition of KIAA1958 (Accession XM_088566). Accordingly, utilities of VGAM1744 include diagnosis, prevention and treatment of diseases and clinical conditions associated with KIAA1958. LOC143915 (Accession XM_096502) is another VGAM1744 host target gene. LOC143915 BINDING SITE is HOST TARGET binding site found in the 3' untranslated region of mRNA encoded by LOC143915, corresponding to a HOST TARGET binding site such as BINDING SITE I, BINDING SITE II or BINDING SITE III. Table 2 illustrates the complementarity of the nucleotide sequences of LOC143915 BINDING SITE, designated SEQ ID:40378, to the nucleotide sequence of VGAM1744 RNA, herein designated VGAM RNA, also designated SEQ ID:4455.

Another function of VGAM1744 is therefore inhibition of LOC143915 (Accession XM_096502). Accordingly, utilities of VGAM1744 include diagnosis, prevention and treatment of diseases and clinical conditions associated with LOC143915. LOC200558 (Accession XM_114258) is another VGAM1744 host target gene. LOC200558 BINDING SITE is HOST TARGET binding site found in the 3' untranslated region of mRNA encoded by LOC200558, corresponding to a HOST TARGET binding site such as BINDING SITE I, BINDING SITE II or BINDING SITE III. Table 2 illustrates the complementarity of the nucleotide sequences of LOC200558 BINDING SITE, designated SEQ ID:42819, to the nucleotide sequence of VGAM1744 RNA, herein designated VGAM RNA, also designated SEQ ID:4455.

Another function of VGAM1744 is therefore inhibition of LOC200558 (Accession XM_114258). Accordingly, utilities of VGAM1744 include diagnosis, prevention and treatment of diseases and clinical conditions associated with LOC200558. LOC202934 (Accession XM_117486) is another VGAM1744 host target gene. LOC202934 BINDING SITE is HOST TARGET binding site found in the 3' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43455, to the nucleotide sequence of VGAM1744 RNA, herein designated VGAM RNA, also designated SEQ ID:4455.

Another function of VGAM1744 is therefore inhibition of LOC202934 (Accession XM_117486). Accordingly, utilities of VGAM1744 include diagnosis, prevention and treatment of diseases and clinical conditions associated with LOC202934. FIG. 1 further provides a conceptual description of a novel bioinformatically detected viral gene of the present invention, referred to here as Viral Genomic Address Messenger 1745 (VGAM1745) viral gene, which modulates expression of respective host target genes thereof, the function and utility of which host target genes is known in the art.

VGAM1745 is a novel bioinformatically detected regulatory, non protein coding, viral micro RNA (miRNA) gene. The method by which VGAM1745 was detected is described hereinabove with reference to FIGS. 1-8.

VGAM1745 gene, herein designated VGAM GENE, is a viral gene contained in the genome of Cercopithecine Herpesvirus 7. VGAM1745 host target gene, herein designated VGAM HOST TARGET GENE, is a human gene contained in the human genome.

VGAM1745 gene encodes a VGAM1745 precursor RNA, herein designated VGAM PRECURSOR RNA. Similar to other miRNA genes, and unlike most ordinary genes, VGAM1745 precursor RNA does not encode a protein. A nucleotide sequence identical or highly similar to the nucleotide sequence of VGAM1745 precursor RNA is designated SEQ ID:1731, and is provided hereinbelow with reference to the sequence listing part. Nucleotide sequence SEQ ID:1731 is located at position 37836 relative to the genome of Cercopithecine Herpesvirus 7.

VGAM1745 precursor RNA folds onto itself, forming VGAM1745 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1745 folded precursor RNA into VGAM1745 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1745 RNA is designated SEQ ID:4456, and is provided hereinbelow with reference to the sequence listing part.

VGAM1745 host target gene, herein designated VGAM HOST TARGET GENE, encodes a corresponding messenger RNA, VGAM1745 host target RNA, herein designated VGAM HOST TARGET RNA. VGAM1745 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1745 RNA, herein designated VGAM RNA, binds complementarily to one or more host target binding sites located in untranslated regions of VGAM1745 host target RNA, herein designated VGAM HOST TARGET RNA. This complementary binding is due to the fact that the nucleotide sequence of VGAM1745 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1745 RNA, herein designated VGAM RNA, may have a different number of host target binding sites in untranslated regions of a VGAM1745 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1745 RNA, herein designated VGAM RNA, to host target binding sites on VGAM1745 host target RNA, herein designated VGAM HOST TARGET RNA, such as BINDING SITE I, BINDING SITE II and BINDING SITE III, inhibits translation of VGAM1745 host target RNA into VGAM1745 host target protein, herein designated VGAM HOST TARGET PROTEIN. VGAM host target protein is therefore outlined by a broken line.

It is appreciated that VGAM1745 host target gene, herein designated VGAM HOST TARGET GENE, in fact represents a plurality of VGAM1745 host target genes. The mRNA of each one of this plurality of VGAM1745 host target genes comprises one or more host target binding sites, each having a nucleotide sequence which is at least partly complementary to VGAM1745 RNA, herein designated VGAM RNA, and which when bound by VGAM1745 RNA causes inhibition of translation of respective one or more VGAM1745 host target proteins.

It is further appreciated by one skilled in the art that the mode of translational inhibition illustrated by FIG. 1 with specific reference to translational inhibition exerted by VGAM1745 gene, herein designated VGAM GENE, on one or more VGAM1745 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1745 is inhibition of expression of host target genes, as part of a novel viral mechanism of attacking a host. Accordingly, utilities of VGAM1745 include diagnosis, prevention and treatment of viral infection by Cercopithecine Herpesvirus 7. Specific functions, and accordingly utilities, of VGAM1745 correlate with, and may be deduced from, the identity of the host target genes which VGAM1745 binds and inhibits, and the function of these host target genes, as elaborated hereinbelow.

Nucleotide sequences of the VGAM1745 precursor RNA, herein designated VGAM PRECURSOR RNA, and of the 'diced' VGAM1745 RNA, herein designated VGAM RNA, and a schematic representation of the secondary folding of VGAM1745 folded precursor RNA, herein designated VGAM FOLDED PRECURSOR RNA, of VGAM1745 are further described hereinbelow with reference to Table 1.

Nucleotide sequences of host target binding sites, such as BINDING SITE-I, BINDING SITE-II and BINDING SITE-III of FIG. 1, found on VGAM1745 host target RNA, and schematic representation of the complementarity of each of these host target binding sites to VGAM1745 RNA, herein designated VGAM RNA, are described hereinbelow with reference to Table 2.

As mentioned hereinabove with reference to FIG. 1, a function of VGAM1745 gene, herein designated VGAM is inhibition of expression of VGAM1745 target genes. It is appreciated that specific functions, and accordingly utilities, of VGAM1745 correlate with, and may be deduced from, the identity of the target genes which VGAM1745 binds and inhibits, and the function of these target genes, as elaborated hereinbelow.

Protein Kinase C, Nu (PRKCN, Accession NM_005813) is a VGAM1745 host target gene. PRKCN BINDING SITE is HOST TARGET binding site found in the 3' untranslated region of mRNA encoded by PRKCN, corresponding to a HOST TARGET binding site such as BINDING SITE I, BINDING SITE II or BINDING SITE III. Table 2 illustrates the complementarity of the nucleotide sequences of PRKCN BINDING SITE, designated SEQ ID:12397, to the nucleotide sequence of VGAM1745 RNA, herein designated VGAM RNA, also designated SEQ ID:4456.

A function of VGAM1745 is therefore inhibition of Protein Kinase C, Nu (PRKCN, Accession NM_005813). Accordingly, utilities of VGAM1745 include diagnosis, prevention and treatment of diseases and clinical conditions associated with PRKCN. KIAA1432 (Accession XM_039698) is another VGAM1745 host target gene. KIAA1432 BINDING SITE is HOST TARGET binding site found in the 5' untranslated region of mRNA encoded by KIAA1432, corresponding to a HOST TARGET binding site such as BINDING SITE I, BINDING SITE II or BINDING SITE III. Table 2 illustrates the complementarity of the nucleotide sequences of KIAA1432 BINDING SITE, designated SEQ ID:33147, to the nucleotide sequence of VGAM1745 RNA, herein designated VGAM RNA, also designated SEQ ID:4456.

Another function of VGAM1745 is therefore inhibition of KIAA1432 (Accession XM_039698). Accordingly, utilities of VGAM1745 include diagnosis, prevention and treatment of diseases and clinical conditions associated with KIAA1432. MO25 (Accession NM_016289) is another VGAM1745 host target gene. MO25 BINDING SITE is HOST TARGET binding site found in the 3' untranslated region of mRNA encoded by MO25, corresponding to a HOST TARGET binding site such as BINDING SITE I, BINDING SITE II or BINDING SITE III. Table 2 illustrates the complementarity of the nucleotide sequences of MO25 BINDING SITE, designated SEQ ID:18414, to the nucleotide sequence of VGAM1745 RNA, herein designated VGAM RNA, also designated SEQ ID:4456.

Another function of VGAM1745 is therefore inhibition of MO25 (Accession NM_016289). Accordingly, utilities of VGAM1745 include diagnosis, prevention and treatment of diseases and clinical conditions associated with MO25. FIG. 1 further provides a conceptual description of a novel bioinformatically detected viral gene of the present invention, referred to here as Viral Genomic Address Messenger 1746 (VGAM1746) viral gene, which modulates expression of respective host target genes thereof, the function and utility of which host target genes is known in the art.

VGAM1746 is a novel bioinformatically detected regulatory, non protein coding, viral micro RNA (miRNA) gene. The method by which VGAM1746 was detected is described hereinabove with reference to FIGS. 1-8.

VGAM1746 gene, herein designated VGAM GENE, is a viral gene contained in the genome of Cercopithecine Herpesvirus 7. VGAM1746 host target gene, herein designated VGAM HOST TARGET GENE, is a human gene contained in the human genome.

VGAM1746 gene encodes a VGAM1746 precursor RNA, herein designated VGAM PRECURSOR RNA. Similar to other miRNA genes, and unlike most ordinary genes, VGAM1746 precursor RNA does not encode a protein. A nucleotide sequence identical or highly similar to the nucleotide sequence of VGAM1746 precursor RNA is designated SEQ ID:1732, and is provided hereinbelow with reference to the sequence listing part. Nucleotide sequence SEQ ID:1732 is located at position 40845 relative to the genome of Cercopithecine Herpesvirus 7.

VGAM1746 precursor RNA folds onto itself, forming VGAM1746 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1746 folded precursor RNA into VGAM1746 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM1746 RNA is designated SEQ ID:4457, and is provided hereinbelow with reference to the sequence listing part.

VGAM1746 host target gene, herein designated VGAM HOST TARGET GENE, encodes a corresponding messenger RNA, VGAM1746 host target RNA, herein designated VGAM HOST TARGET RNA. VGAM1746 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1746 RNA, herein designated VGAM RNA, binds complementarily to one or more host target binding sites located in untranslated regions of VGAM1746 host target RNA, herein designated VGAM HOST TARGET RNA. This complementary binding is due to the fact that the nucleotide sequence of VGAM1746 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1746 RNA, herein designated VGAM RNA, may have a different number of host target binding sites in untranslated regions of a VGAM1746 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1746 RNA, herein designated VGAM RNA, to host target binding sites on VGAM1746 host target RNA, herein designated VGAM HOST TARGET RNA, such as BINDING SITE I, BINDING SITE II and BINDING SITE III, inhibits translation of VGAM1746 host target RNA into VGAM1746 host target protein, herein designated VGAM HOST TARGET PROTEIN. VGAM host target protein is therefore outlined by a broken line.

It is appreciated that VGAM1746 host target gene, herein designated VGAM HOST TARGET GENE, in fact represents a plurality of VGAM1746 host target genes. The mRNA of each one of this plurality of VGAM1746 host target genes comprises one or more host target binding sites, each having a nucleotide sequence which is at least partly complementary to VGAM1746 RNA, herein designated VGAM RNA, and which when bound by VGAM1746 RNA causes inhibition of translation of respective one or more VGAM1746 host target proteins.

It is further appreciated by one skilled in the art that the mode of translational inhibition illustrated by FIG. 1 with specific reference to translational inhibition exerted by VGAM1746 gene, herein designated VGAM GENE, on one or more VGAM1746 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1746 is inhibition of expression of host target genes, as part of a novel viral mechanism of attacking a host. Accordingly, utilities of VGAM1746 include diagnosis, prevention and treatment of viral infection by Cercopithecine Herpesvirus 7. Specific functions, and accordingly utilities, of VGAM1746 correlate with, and may be deduced from, the identity of the host target genes which VGAM1746 binds and inhibits, and the function of these host target genes, as elaborated hereinbelow.

Nucleotide sequences of the VGAM1746 precursor RNA, herein designated VGAM PRECURSOR RNA, and of the 'diced' VGAM1746 RNA, herein designated VGAM RNA, and a schematic representation of the secondary folding of VGAM1746 folded precursor RNA, herein designated VGAM FOLDED PRECURSOR RNA, of VGAM1746 are further described hereinbelow with reference to Table 1.

Nucleotide sequences of host target binding sites, such as BINDING SITE-I, BINDING SITE-II and BINDING SITE-III of FIG. 1, found on VGAM1746 host target RNA, and schematic representation of the complementarity of each of these host target binding sites to VGAM1746 RNA, herein designated VGAM RNA, are described hereinbelow with reference to Table 2.

As mentioned hereinabove with reference to FIG. 1, a function of VGAM1746 gene, herein designated VGAM is inhibition of expression of VGAM1746 target genes. It is appreciated that specific functions, and accordingly utilities, of VGAM1746 correlate with, and may be deduced from, the identity of the target genes which VGAM1746 binds and inhibits, and the function of these target genes, as elaborated hereinbelow.

SNL (Accession NM_003088) is a VGAM1746 host target gene. SNL BINDING SITE is HOST TARGET binding site found in the 3' untranslated region of mRNA encoded by SNL, corresponding to a HOST TARGET binding site such as BINDING SITE I, BINDING SITE II or BINDING SITE III. Table 2 illustrates the complementarity of the nucleotide sequences of SNL BINDING SITE, designated SEQ ID:9062, to the nucleotide sequence of VGAM1746 RNA, herein designated VGAM RNA, also designated SEQ ID:4457.

A function of VGAM1746 is therefore inhibition of SNL (Accession NM_003088), a gene which organizes filamentous actin into bundles with a minimum of 4.1:1 actin/fascin ratio. Accordingly, utilities of VGAM1746 include diagnosis, prevention and treatment of diseases and clinical conditions associated with SNL. The function of SNL and its association with various diseases and clinical conditions, has been established by previous studies, as described hereinabove with reference to VGAM675. Transforming Growth Factor, Beta Receptor II (70/80kDa) (TGFBR2, Accession NM_003242) is another VGAM1746 host target gene. TGFBR2 BINDING SITE is HOST TARGET binding site found in the 3' untranslated region of mRNA encoded by TGFBR2, corresponding to a HOST TARGET binding site such as BINDING SITE I, BINDING SITE II or BINDING SITE III. Table 2 illustrates the complementarity of the nucleotide sequences of TGFBR2 BINDING SITE, designated SEQ ID:9236, to the nucleotide sequence of VGAM1746 RNA, herein designated VGAM RNA, also designated SEQ ID:4457.

Another function of VGAM1746 is therefore inhibition of Transforming Growth Factor, Beta Receptor II (70/80 kDa) (TGFBR2, Accession NM_003242). Accordingly, utilities of VGAM1746 include diagnosis, prevention and treatment of diseases and clinical conditions associated with TGFBR2. Thiamin Pyrophosphokinase 1 (TPK1, Accession NM_022445) is another VGAM1746 host target gene. TPK1 BINDING SITE is HOST TARGET binding site found in the 3' untranslated region of mRNA encoded by TPK1, corresponding to a HOST TARGET binding site such as BINDING SITE I, BINDING SITE II or BINDING SITE III. Table 2 illustrates the complementarity of the nucleotide sequences of TPK1 BINDING SITE, designated SEQ ID:22778, to the nucleotide sequence of VGAM1746 RNA, herein designated VGAM RNA, also designated SEQ ID:4457.

Another function of VGAM1746 is therefore inhibition of Thiamin Pyrophosphokinase 1 (TPK1, Accession NM_022445), a gene which catalyzes the conversion of thiamine, a form of vitamin B1, to thiamine pyrophosphate. Accordingly, utilities of VGAM1746 include diagnosis, prevention and treatment of diseases and clinical conditions associated with TPK1. The function of TPK1 and its association with various diseases and clinical conditions, has been established by previous studies, as described hereinabove with reference to VGAM475. KIAA0528 (Accession XM_051454) is another VGAM1746 host target gene. KIAA0528 BINDING SITE is HOST TARGET binding site found in the 3' untranslated region of mRNA encoded by KIAA0528, corresponding to a HOST TARGET binding site such as BINDING SITE I, BINDING SITE II or BINDING SITE III. Table 2 illustrates the complementarity of the nucleotide sequences of KIAA0528 BINDING SITE, designated SEQ ID:35839, to the nucleotide sequence of VGAM1746 RNA, herein designated VGAM RNA, also designated SEQ ID:4457.

Another function of VGAM1746 is therefore inhibition of KIAA0528 (Accession XM_051454). Accordingly, utilities of VGAM1746 include diagnosis, prevention and treatment of diseases and clinical conditions associated with KIAA0528. KIAA1128 (Accession XM_043596) is another VGAM1746 host target gene. KIAA1128 BINDING SITE is HOST TARGET binding site found in the 3' untranslated region of mRNA encoded by KIAA1128, corresponding to a HOST TARGET binding site such as BINDING SITE I, BINDING SITE II or BINDING SITE III. Table 2 illustrates the complementarity of the nucleotide sequences of KIAA1128 BINDING SITE, designated SEQ ID:33963, to the nucleotide sequence of VGAM1746 RNA, herein designated VGAM RNA, also designated SEQ ID:4457.

Another function of VGAM1746 is therefore inhibition of KIAA1128 (Accession XM_043596). Accordingly, utilities of VGAM1746 include diagnosis, prevention and treatment of diseases and clinical conditions associated with KIAA1128. Zinc Finger Protein 387 (ZNF387, Accession NM_014682) is another VGAM1746 host target gene. ZNF387 BINDING SITE is HOST TARGET binding site found in the 3' untranslated region of mRNA encoded by ZNF387, corresponding to a HOST TARGET binding site such as BINDING SITE I, BINDING SITE II or BINDING SITE III. Table 2 illustrates the complementarity of the nucleotide sequences of ZNF387 BINDING SITE, designated SEQ ID:16176, to the nucleotide sequence of VGAM1746

RNA, herein designated VGAM RNA, also designated SEQ ID:4457.

Another function of VGAM1746 is therefore inhibition of Zinc Finger Protein 387 (ZNF387, Accession NM_014682). Accordingly, utilities of VGAM1746 include diagnosis, prevention and treatment of diseases and clinical conditions associated with ZNF387. LOC197317 (Accession XM_117014) is another VGAM1746 host target gene. LOC197317 BINDING SITE is HOST TARGET binding site found in the 5' untranslated region of mRNA encoded by LOC197317, corresponding to a HOST TARGET binding site such as BINDING SITE I, BINDING SITE II or BINDING SITE III. Table 2 illustrates the complementarity of the nucleotide sequences of LOC197317 BINDING SITE, designated SEQ ID:43205, to the nucleotide sequence of VGAM1746 RNA, herein designated VGAM RNA, also designated SEQ ID:4457.

Another function of VGAM1746 is therefore inhibition of LOC197317 (Accession XM_117014). Accordingly, utilities of VGAM1746 include diagnosis, prevention and treatment of diseases and clinical conditions associated with LOC197317. LOC199926 (Accession XM_117157) is another VGAM1746 host target gene. LOC199926 BINDING SITE is HOST TARGET binding site found in the 5' untranslated region of mRNA encoded by LOC199926, corresponding to a HOST TARGET binding site such as BINDING SITE I, BINDING SITE II or BINDING SITE III. Table 2 illustrates the complementarity of the nucleotide sequences of LOC199926 BINDING SITE, designated SEQ ID:43259, to the nucleotide sequence of VGAM1746 RNA, herein designated VGAM RNA, also designated SEQ ID:4457.

Another function of VGAM1746 is therefore inhibition of LOC199926 (Accession XM_117157). Accordingly, utilities of VGAM1746 include diagnosis, prevention and treatment of diseases and clinical conditions associated with LOC199926. LOC202025 (Accession XM_117353) is another VGAM1746 host target gene. LOC202025 BINDING SITE is HOST TARGET binding site found in the 3' untranslated region of mRNA encoded by LOC202025, corresponding to a HOST TARGET binding site such as BINDING SITE I, BINDING SITE II or BINDING SITE III. Table 2 illustrates the complementarity of the nucleotide sequences of LOC202025 BINDING SITE, designated SEQ ID:43403, to the nucleotide sequence of VGAM1746 RNA, herein designated VGAM RNA, also designated SEQ ID:4457.

Another function of VGAM1746 is therefore inhibition of LOC202025 (Accession XM_117353). Accordingly, utilities of VGAM1746 include diagnosis, prevention and treatment of diseases and clinical conditions associated with LOC202025. LOC202316 (Accession XM_117380) is another VGAM1746 host target gene. LOC202316 BINDING SITE is HOST TARGET binding site found in the 5' untranslated region of mRNA encoded by LOC202316, corresponding to a HOST TARGET binding site such as BINDING SITE I, BINDING SITE II or BINDING SITE III. Table 2 illustrates the complementarity of the nucleotide sequences of LOC202316 BINDING SITE, designated SEQ ID:43423, to the nucleotide sequence of VGAM1746 RNA, herein designated VGAM RNA, also designated SEQ ID:4457.

Another function of VGAM1746 is therefore inhibition of LOC202316 (Accession XM_117380). Accordingly, utilities of VGAM1746 include diagnosis, prevention and treatment of diseases and clinical conditions associated with LOC202316. LOC90494 (Accession XM_032161) is another VGAM1746 host target gene. LOC90494 BINDING SITE is HOST TARGET binding site found in the 5' untranslated region of mRNA encoded by LOC90494, corresponding to a HOST TARGET binding site such as BINDING SITE I, BINDING SITE II or BINDING SITE III. Table 2 illustrates the complementarity of the nucleotide sequences of LOC90494 BINDING SITE, designated SEQ ID:31577, to the nucleotide sequence of VGAM1746 RNA, herein designated VGAM RNA, also designated SEQ ID:4457.

Another function of VGAM1746 is therefore inhibition of LOC90494 (Accession XM_032161). Accordingly, utilities of VGAM1746 include diagnosis, prevention and treatment of diseases and clinical conditions associated with LOC90494. FIG. 1 further provides a conceptual description of a novel bioinformatically detected viral gene of the present invention, referred to here as Viral Genomic Address Messenger 1747 (VGAM1747) viral gene, which modulates expression of respective host target genes thereof, the function and utility of which host target genes is known in the art.

VGAM1747 is a novel bioinformatically detected regulatory, non protein coding, viral micro RNA (miRNA) gene. The method by which VGAM1747 was detected is described hereinabove with reference to FIGS. 1-8.

VGAM1747 gene, herein designated VGAM GENE, is a viral gene contained in the genome of Camelpox Virus. VGAM1747 host target gene, herein designated VGAM HOST TARGET GENE, is a human gene contained in the human genome.

VGAM1747 gene encodes a VGAM1747 precursor RNA, herein designated VGAM PRECURSOR RNA. Similar to other miRNA genes, and unlike most ordinary genes, VGAM1747 precursor RNA does not encode a protein. A nucleotide sequence identical or highly similar to the nucleotide sequence of VGAM1747 precursor RNA is designated SEQ ID:1733, and is provided hereinbelow with reference to the sequence listing part. Nucleotide sequence SEQ ID:1733 is located at position 11942 relative to the genome of Camelpox Virus.

VGAM1747 precursor RNA folds onto itself, forming VGAM1747 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1747 folded precursor RNA into VGAM1747 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM1747 RNA is designated SEQ ID:4458, and is provided hereinbelow with reference to the sequence listing part.

VGAM1747 host target gene, herein designated VGAM HOST TARGET GENE, encodes a corresponding messenger RNA, VGAM1747 host target RNA, herein designated VGAM HOST TARGET RNA. VGAM1747 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1747 RNA, herein designated VGAM RNA, binds complementarily to one or more host target binding sites located in untranslated regions of VGAM1747 host target RNA, herein designated VGAM HOST TARGET RNA. This complementary binding is due to the fact that the nucleotide sequence of VGAM1747 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1747 RNA, herein designated VGAM RNA, may have a different number of host target binding sites in untranslated regions of a VGAM1747 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1747 RNA, herein designated VGAM RNA, to host target binding sites on VGAM1747 host target RNA, herein designated VGAM HOST TARGET RNA, such as BINDING SITE I, BINDING SITE II and BINDING SITE III, inhibits translation of VGAM1747 host target RNA into VGAM1747 host target protein, herein designated VGAM HOST TARGET PROTEIN. VGAM host target protein is therefore outlined by a broken line.

It is appreciated that VGAM1747 host target gene, herein designated VGAM HOST TARGET GENE, in fact represents a plurality of VGAM1747 host target genes. The mRNA of each one of this plurality of VGAM1747 host target genes comprises one or more host target binding sites, each having a nucleotide sequence which is at least partly complementary to VGAM1747 RNA, herein designated VGAM RNA, and which when bound by VGAM1747 RNA causes inhibition of translation of respective one or more VGAM1747 host target proteins.

It is further appreciated by one skilled in the art that the mode of translational inhibition illustrated by FIG. 1 with specific reference to translational inhibition exerted by VGAM1747 gene, herein designated VGAM GENE, on one or more VGAM1747 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1747 is inhibition of expression of host target genes, as part of a novel viral mechanism of attacking a host. Accordingly, utilities of VGAM1747 include diagnosis, prevention and treatment of viral infection by Camelpox Virus. Specific functions, and accordingly utilities, of VGAM1747 correlate with, and may be deduced from, the identity of the host target genes which VGAM1747 binds and inhibits, and the function of these host target genes, as elaborated hereinbelow.

Nucleotide sequences of the VGAM1747 precursor RNA, herein designated VGAM PRECURSOR RNA, and of the 'diced' VGAM1747 RNA, herein designated VGAM RNA, and a schematic representation of the secondary folding of VGAM1747 folded precursor RNA, herein designated VGAM FOLDED PRECURSOR RNA, of VGAM1747 are further described hereinbelow with reference to Table 1.

Nucleotide sequences of host target binding sites, such as BINDING SITE-I, BINDING SITE-II and BINDING SITE-III of FIG. 1, found on VGAM1747 host target RNA, and schematic representation of the complementarity of each of these host target binding sites to VGAM1747 RNA, herein designated VGAM RNA, are described hereinbelow with reference to Table 2.

As mentioned hereinabove with reference to FIG. 1, a function of VGAM1747 gene, herein designated VGAM is inhibition of expression of VGAM1747 target genes. It is appreciated that specific functions, and accordingly utilities, of VGAM1747 correlate with, and may be deduced from, the identity of the target genes which VGAM1747 binds and inhibits, and the function of these target genes, as elaborated hereinbelow.

MGC4342 (Accession NM_024329) is a VGAM1747 host target gene. MGC4342 BINDING SITE is HOST TARGET binding site found in the 3' untranslated region of mRNA encoded by MGC4342, corresponding to a HOST TARGET binding site such as BINDING SITE I, BINDING SITE II or BINDING SITE III. Table 2 illustrates the complementarity of the nucleotide sequences of MGC4342 BINDING SITE, designated SEQ ID:23623, to the nucleotide sequence of VGAM1747 RNA, herein designated VGAM RNA, also designated SEQ ID:4458.

A function of VGAM1747 is therefore inhibition of MGC4342 (Accession NM_024329). Accordingly, utilities of VGAM1747 include diagnosis, prevention and treatment of diseases and clinical conditions associated with MGC4342. FIG. 1 further provides a conceptual description of a novel bioinformatically detected viral gene of the present invention, referred to here as Viral Genomic Address Messenger 1748 (VGAM1748) viral gene, which modulates expression of respective host target genes thereof, the function and utility of which host target genes is known in the art.

VGAM1748 is a novel bioinformatically detected regulatory, non protein coding, viral micro RNA (miRNA) gene. The method by which VGAM1748 was detected is described hereinabove with reference to FIGS. 1-8.

VGAM1748 gene, herein designated VGAM GENE, is a viral gene contained in the genome of Camelpox Virus. VGAM1748 host target gene, herein designated VGAM HOST TARGET GENE, is a human gene contained in the human genome.

VGAM1748 gene encodes a VGAM1748 precursor RNA, herein designated VGAM PRECURSOR RNA. Similar to other miRNA genes, and unlike most ordinary genes, VGAM1748 precursor RNA does not encode a protein. A nucleotide sequence identical or highly similar to the nucleotide sequence of VGAM1748 precursor RNA is designated SEQ ID:1734, and is provided hereinbelow with reference to the sequence listing part. Nucleotide sequence SEQ ID:1734 is located at position 67 relative to the genome of Camelpox Virus.

VGAM1748 precursor RNA folds onto itself, forming VGAM1748 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1748 folded precursor RNA into VGAM1748 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1748 RNA is designated SEQ ID:4459, and is provided hereinbelow with reference to the sequence listing part.

VGAM1748 host target gene, herein designated VGAM HOST TARGET GENE, encodes a corresponding messenger RNA, VGAM1748 host target RNA, herein designated VGAM HOST TARGET RNA. VGAM1748 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1748 RNA, herein designated VGAM RNA, binds complementarily to one or more host target binding sites located in untranslated regions of VGAM1748 host target RNA, herein designated VGAM HOST TARGET RNA. This complementary binding is due to the fact that the nucleotide sequence of VGAM1748 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1748 RNA, herein designated VGAM RNA, may have a different number of host target binding sites in untranslated regions of a VGAM1748 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1748 RNA, herein designated VGAM RNA, to host target binding sites on VGAM1748 host target RNA, herein designated VGAM HOST TARGET RNA, such as BINDING SITE I, BINDING SITE II and BINDING SITE III, inhibits translation of VGAM1748 host target RNA into VGAM1748 host target protein, herein designated VGAM HOST TARGET PROTEIN. VGAM host target protein is therefore outlined by a broken line.

It is appreciated that VGAM1748 host target gene, herein designated VGAM HOST TARGET GENE, in fact represents a plurality of VGAM1748 host target genes. The mRNA of each one of this plurality of VGAM1748 host target genes comprises one or more host target binding sites, each having a nucleotide sequence which is at least partly complementary to VGAM1748 RNA, herein designated VGAM RNA, and which when bound by VGAM1748 RNA causes inhibition of translation of respective one or more VGAM1748 host target proteins.

It is further appreciated by one skilled in the art that the mode of translational inhibition illustrated by FIG. 1 with specific reference to translational inhibition exerted by VGAM1748 gene, herein designated VGAM GENE, on one or more VGAM1748 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1748 is inhibition of expression of host target genes, as part of a novel viral mechanism of attacking a host. Accordingly, utilities of VGAM1748 include diagnosis, prevention and treatment of viral infection by Camelpox Virus. Specific functions, and accordingly utilities, of VGAM1748 correlate with, and may be deduced from, the identity of the host target genes which VGAM1748 binds and inhibits, and the function of these host target genes, as elaborated hereinbelow.

Nucleotide sequences of the VGAM1748 precursor RNA, herein designated VGAM PRECURSOR RNA, and of the 'diced' VGAM1748 RNA, herein designated VGAM RNA, and a schematic representation of the secondary folding of VGAM1748 folded precursor RNA, herein designated VGAM FOLDED PRECURSOR RNA, of VGAM1748 are further described hereinbelow with reference to Table 1.

Nucleotide sequences of host target binding sites, such as BINDING SITE-I, BINDING SITE-II and BINDING SITE-III of FIG. 1, found on VGAM1748 host target RNA, and schematic representation of the complementarity of each of these host target binding sites to VGAM1748 RNA, herein designated VGAM RNA, are described hereinbelow with reference to Table 2.

As mentioned hereinabove with reference to FIG. 1, a function of VGAM1748 gene, herein designated VGAM is inhibition of expression of VGAM1748 target genes. It is appreciated that specific functions, and accordingly utilities, of VGAM1748 correlate with, and may be deduced from, the identity of the target genes which VGAM1748 binds and inhibits, and the function of these target genes, as elaborated hereinbelow.

FLJ11210 (Accession XM_005298) is a VGAM1748 host target gene. FLJ11210 BINDING SITE is HOST TARGET binding site found in the 3' untranslated region of mRNA encoded by FLJ11210, corresponding to a HOST TARGET binding site such as BINDING SITE I, BINDING SITE II or BINDING SITE III. Table 2 illustrates the complementarity of the nucleotide sequences of FLJ11210 BINDING SITE, designated SEQ ID:29971, to the nucleotide sequence of VGAM1748 RNA, herein designated VGAM RNA, also designated SEQ ID:4459.

A function of VGAM1748 is therefore inhibition of FLJ11210 (Accession XM_005298). Accordingly, utilities of VGAM1748 include diagnosis, prevention and treatment of diseases and clinical conditions associated with FLJ11210. HTCD37 (Accession XM_041884) is another VGAM1748 host target gene. HTCD37 BINDING SITE is HOST TARGET binding site found in the 3' untranslated region of mRNA encoded by HTCD37, corresponding to a HOST TARGET binding site such as BINDING SITE I, BINDING SITE II or BINDING SITE III. Table 2 illustrates the complementarity of the nucleotide sequences of HTCD37 BINDING SITE, designated SEQ ID:33618, to the nucleotide sequence of VGAM1748 RNA, herein designated VGAM RNA, also designated SEQ ID:4459.

Another function of VGAM1748 is therefore inhibition of HTCD37 (Accession XM_041884). Accordingly, utilities of VGAM1748 include diagnosis, prevention and treatment of diseases and clinical conditions associated with HTCD37. FIG. 1 further provides a conceptual description of a novel bioinformatically detected viral gene of the present invention, referred to here as Viral Genomic Address Messenger 1749 (VGAM1749) viral gene, which modulates expression of respective host target genes thereof, the function and utility of which host target genes is known in the art.

VGAM1749 is a novel bioinformatically detected regulatory, non protein coding, viral micro RNA (miRNA) gene. The method by which VGAM1749 was detected is described hereinabove with reference to FIGS. 1-8.

VGAM1749 gene, herein designated VGAM GENE, is a viral gene contained in the genome of Camelpox Virus. VGAM1749 host target gene, herein designated VGAM HOST TARGET GENE, is a human gene contained in the human genome.

VGAM1749 gene encodes a VGAM1749 precursor RNA, herein designated VGAM PRECURSOR RNA. Similar to other miRNA genes, and unlike most ordinary genes, VGAM1749 precursor RNA does not encode a protein. A nucleotide sequence identical or highly similar to the nucleotide sequence of VGAM1749 precursor RNA is designated SEQ ID:1735, and is provided hereinbelow with reference to the sequence listing part. Nucleotide sequence SEQ ID:1735 is located at position 4361 relative to the genome of Camelpox Virus.

VGAM1749 precursor RNA folds onto itself, forming VGAM1749 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1749 folded precursor RNA into VGAM1749 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 42%) nucleotide sequence of VGAM1749 RNA is designated SEQ ID:4460, and is provided hereinbelow with reference to the sequence listing part.

VGAM1749 host target gene, herein designated VGAM HOST TARGET GENE, encodes a corresponding messenger RNA, VGAM1749 host target RNA, herein designated VGAM HOST TARGET RNA. VGAM1749 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1749 RNA, herein designated VGAM RNA, binds complementarily to one or more host target binding sites located in untranslated regions of VGAM1749 host target RNA, herein designated VGAM HOST TARGET RNA. This complementary binding is due to the fact that the nucleotide sequence of VGAM1749 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1749 RNA, herein designated VGAM RNA, may have a different number of host target binding sites in untranslated regions of a VGAM1749 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1749 RNA, herein designated VGAM RNA, to host target binding sites on VGAM1749 host target RNA, herein designated VGAM HOST TARGET RNA, such as BINDING SITE I, BINDING SITE II and BINDING SITE III, inhibits translation of VGAM1749 host target RNA into VGAM1749 host target protein, herein designated VGAM HOST TARGET PROTEIN. VGAM host target protein is therefore outlined by a broken line.

It is appreciated that VGAM1749 host target gene, herein designated VGAM HOST TARGET GENE, in fact represents a plurality of VGAM1749 host target genes. The mRNA of each one of this plurality of VGAM1749 host target genes comprises one or more host target binding sites, each having a nucleotide sequence which is at least partly complementary to VGAM1749 RNA, herein designated VGAM RNA, and which when bound by VGAM1749 RNA causes inhibition of translation of respective one or more VGAM1749 host target proteins.

It is further appreciated by one skilled in the art that the mode of translational inhibition illustrated by FIG. 1 with specific reference to translational inhibition exerted by VGAM1749 gene, herein designated VGAM GENE, on one or more VGAM1749 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1749 is inhibition of expression of host target genes, as part of a novel viral mechanism of attacking a host. Accordingly, utilities of VGAM1749 include diagnosis, prevention and treatment of viral infection by Camelpox Virus. Specific functions, and accordingly utilities, of VGAM1749 correlate with, and may be deduced from, the identity of the host target genes which VGAM1749 binds and inhibits, and the function of these host target genes, as elaborated hereinbelow.

Nucleotide sequences of the VGAM1749 precursor RNA, herein designated VGAM PRECURSOR RNA, and of the ‘diced’ VGAM1749 RNA, herein designated VGAM RNA, and a schematic representation of the secondary folding of VGAM1749 folded precursor RNA, herein designated VGAM FOLDED PRECURSOR RNA, of VGAM1749 are further described hereinbelow with reference to Table 1.

Nucleotide sequences of host target binding sites, such as BINDING SITE-I, BINDING SITE-II and BINDING SITE-III of FIG. 1, found on VGAM1749 host target RNA, and schematic representation of the complementarity of each of these host target binding sites to VGAM1749 RNA, herein designated VGAM RNA, are described hereinbelow with reference to Table 2.

As mentioned hereinabove with reference to FIG. 1, a function of VGAM1749 gene, herein designated VGAM is inhibition of expression of VGAM1749 target genes. It is appreciated that specific functions, and accordingly utilities, of VGAM1749 correlate with, and may be deduced from, the identity of the target genes which VGAM1749 binds and inhibits, and the function of these target genes, as elaborated hereinbelow.

FLJ13614 (Accession NM_139076) is a VGAM1749 host target gene. FLJ13614 BINDING SITE is HOST TARGET binding site found in the 3' untranslated region of mRNA encoded by FLJ13614, corresponding to a HOST TARGET binding site such as BINDING SITE I, BINDING SITE II or BINDING SITE III. Table 2 illustrates the complementarity of the nucleotide sequences of FLJ13614 BINDING SITE, designated SEQ ID:29148, to the nucleotide sequence of VGAM1749 RNA, herein designated VGAM RNA, also designated SEQ ID:4460.

A function of VGAM1749 is therefore inhibition of FLJ13614 (Accession NM_139076). Accordingly, utilities of VGAM1749 include diagnosis, prevention and treatment of diseases and clinical conditions associated with FLJ13614. FLJ20508 (Accession NM_017850) is another VGAM1749 host target gene. FLJ20508 BINDING SITE is HOST TARGET binding site found in the 3' untranslated region of mRNA encoded by FLJ20508, corresponding to a HOST TARGET binding site such as BINDING SITE I, BINDING SITE II or BINDING SITE III. Table 2 illustrates the complementarity of the nucleotide sequences of FLJ20508 BINDING SITE, designated SEQ ID:19517, to the nucleotide sequence of VGAM1749 RNA, herein designated VGAM RNA, also designated SEQ ID:4460.

Another function of VGAM1749 is therefore inhibition of FLJ20508 (Accession NM_017850). Accordingly, utilities of VGAM1749 include diagnosis, prevention and treatment of diseases and clinical conditions associated with FLJ20508. KIAA1189 (Accession XM_050508) is another VGAM1749 host target gene. KIAA1189 BINDING SITE is HOST TARGET binding site found in the 3' untranslated region of mRNA encoded by KIAA1189, corresponding to a HOST TARGET binding site such as BINDING SITE I, BINDING SITE II or BINDING SITE III. Table 2 illustrates the complementarity of the nucleotide sequences of KIAA1189 BINDING SITE, designated SEQ ID:35650, to the nucleotide sequence of VGAM1749 RNA, herein designated VGAM RNA, also designated SEQ ID:4460.

Another function of VGAM1749 is therefore inhibition of KIAA1189 (Accession XM_050508). Accordingly, utilities of VGAM1749 include diagnosis, prevention and treatment of diseases and clinical conditions associated with KIAA1189. MGC10955 (Accession NM_032676) is another VGAM1749 host target gene. MGC10955 BINDING SITE is HOST TARGET binding site found in the 3' untranslated region of mRNA encoded by MGC10955, corresponding to a HOST TARGET binding site such as BINDING SITE I, BINDING SITE II or BINDING SITE III. Table 2 illustrates the complementarity of the nucleotide sequences of MGC10955 BINDING SITE, designated SEQ ID:26397, to the nucleotide sequence of VGAM1749 RNA, herein designated VGAM RNA, also designated SEQ ID:4460.

Another function of VGAM1749 is therefore inhibition of MGC10955 (Accession NM_032676). Accordingly, utilities of VGAM1749 include diagnosis, prevention and treatment of diseases and clinical conditions associated with MGC10955. PRO1163 (Accession NM_018576) is another VGAM1749 host target gene. PRO1163 BINDING SITE is HOST TARGET binding site found in the 5' untranslated region of mRNA encoded by PRO1163, corresponding to a HOST TARGET binding site such as BINDING SITE I, BINDING SITE II or BINDING SITE III. Table 2 illustrates the complementarity of the nucleotide sequences of PRO1163 BINDING SITE, designated SEQ ID:20653, to the nucleotide sequence of VGAM1749 RNA, herein designated VGAM RNA, also designated SEQ ID:4460.

Another function of VGAM1749 is therefore inhibition of PRO1163 (Accession NM_018576). Accordingly, utilities of VGAM1749 include diagnosis, prevention and treatment of diseases and clinical conditions associated with PRO1163. LOC118706 (Accession XM_058336) is another VGAM1749 host target gene. LOC118706 BINDING SITE is HOST TARGET binding site found in the 5' untranslated region of mRNA encoded by LOC118706, corresponding to a HOST TARGET binding site such as BINDING SITE I, BINDING SITE II or BINDING SITE III. Table 2 illustrates the complementarity of the nucleotide sequences of LOC118706 BINDING SITE, designated SEQ ID:36596, to the nucleotide sequence of VGAM1749 RNA, herein designated VGAM RNA, also designated SEQ ID:4460.

Another function of VGAM1749 is therefore inhibition of LOC118706 (Accession XM_058336). Accordingly, utilities of VGAM1749 include diagnosis, prevention and treatment of diseases and clinical conditions associated with LOC118706. LOC143158 (Accession XM_084445) is another VGAM1749 host target gene. LOC143158 BINDING SITE is HOST TARGET binding site found in the 5' untranslated region of mRNA encoded by LOC143158, corresponding to a HOST TARGET binding site such as BINDING SITE I, BINDING SITE II or BINDING SITE III. Table 2 illustrates the complementarity of the nucleotide sequences of LOC143158 BINDING SITE, designated SEQ ID:37591, to the nucleotide sequence of VGAM1749 RNA, herein designated VGAM RNA, also designated SEQ ID:4460.

Another function of VGAM1749 is therefore inhibition of LOC143158 (Accession XM_084445). Accordingly, utilities of VGAM1749 include diagnosis, prevention and treatment of diseases and clinical conditions associated with LOC143158. LOC150862 (Accession XM_087029) is another VGAM1749 host target gene. LOC150862 BINDING SITE is HOST TARGET binding site found in the 5' untranslated region of mRNA encoded by LOC150862, corresponding to a HOST TARGET binding site such as BINDING SITE I, BINDING SITE II or BINDING SITE III. Table 2 illustrates the complementarity of the nucleotide sequences of LOC150862 BINDING SITE, designated SEQ ID:39016, to the nucleotide sequence of VGAM1749 RNA, herein designated VGAM RNA, also designated SEQ ID:4460.

Another function of VGAM1749 is therefore inhibition of LOC150862 (Accession XM_087029). Accordingly, utilities of VGAM1749 include diagnosis, prevention and treatment of diseases and clinical conditions associated with LOC150862. LOC151826 (Accession XM_087312) is another VGAM1749 host target gene. LOC151826 BINDING SITE is HOST TARGET binding site found in the 3' untranslated region of mRNA encoded by LOC151826, corresponding to a HOST TARGET binding site such as BINDING SITE I, BINDING SITE II or BINDING SITE III. Table 2 illustrates the complementarity of the nucleotide sequences of LOC151826 BINDING SITE, designated SEQ ID:39167, to the nucleotide sequence of VGAM1749 RNA, herein designated VGAM RNA, also designated SEQ ID:4460.

Another function of VGAM1749 is therefore inhibition of LOC151826 (Accession XM_087312). Accordingly, utilities of VGAM1749 include diagnosis, prevention and treatment of diseases and clinical conditions associated with LOC151826. LOC158267 (Accession XM_088528) is another VGAM1749 host target gene. LOC158267 BINDING SITE is HOST TARGET binding site found in the 5' untranslated region of mRNA encoded by LOC158267, corresponding to a HOST TARGET binding site such as BINDING SITE I, BINDING SITE II or BINDING SITE III. Table 2 illustrates the complementarity of the nucleotide sequences of LOC158267 BINDING SITE, designated SEQ ID:39793, to the nucleotide sequence of VGAM1749 RNA, herein designated VGAM RNA, also designated SEQ ID:4460.

Another function of VGAM1749 is therefore inhibition of LOC158267 (Accession XM_088528). Accordingly, utilities of VGAM1749 include diagnosis, prevention and treatment of diseases and clinical conditions associated with LOC158267. LOC220466 (Accession XM_058363) is another VGAM1749 host target gene. LOC220466 BINDING SITE is HOST TARGET binding site found in the 5' untranslated region of mRNA encoded by LOC220466, corresponding to a HOST TARGET binding site such as BINDING SITE I, BINDING SITE II or BINDING SITE III. Table 2 illustrates the complementarity of the nucleotide sequences of LOC220466 BINDING SITE, designated SEQ ID:36610, to the nucleotide sequence of VGAM1749 RNA, herein designated VGAM RNA, also designated SEQ ID:4460.

Another function of VGAM1749 is therefore inhibition of LOC220466 (Accession XM_058363). Accordingly, utilities of VGAM1749 include diagnosis, prevention and treatment of diseases and clinical conditions associated with LOC220466. FIG. 1 further provides a conceptual description of a novel bioinformatically detected viral gene of the present invention, referred to here as Viral Genomic Address Messenger 1750 (VGAM1750) viral gene, which modulates expression of respective host target genes thereof, the function and utility of which host target genes is known in the art.

VGAM1750 is a novel bioinformatically detected regulatory, non protein coding, viral micro RNA (miRNA) gene. The method by which VGAM1750 was detected is described hereinabove with reference to FIGS. 1-8.

VGAM1750 gene, herein designated VGAM GENE, is a viral gene contained in the genome of Camelpox Virus. VGAM1750 host target gene, herein designated VGAM HOST TARGET GENE, is a human gene contained in the human genome.

VGAM1750 gene encodes a VGAM1750 precursor RNA, herein designated VGAM PRECURSOR RNA. Similar to other miRNA genes, and unlike most ordinary genes, VGAM1750 precursor RNA does not encode a protein. A nucleotide sequence identical or highly similar to the nucleotide sequence of VGAM1750 precursor RNA is designated SEQ ID:1736, and is provided hereinbelow with reference to the sequence listing part. Nucleotide sequence SEQ ID:1736 is located at position 1194 relative to the genome of Camelpox Virus.

VGAM1750 precursor RNA folds onto itself, forming VGAM1750 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1750 folded precursor RNA into VGAM1750 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1750 RNA is designated SEQ ID:4461, and is provided hereinbelow with reference to the sequence listing part.

VGAM1750 host target gene, herein designated VGAM HOST TARGET GENE, encodes a corresponding messenger RNA, VGAM1750 host target RNA, herein designated VGAM HOST TARGET RNA. VGAM1750 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1750 RNA, herein designated VGAM RNA, binds complementarily to one or more host target binding sites located in untranslated regions of VGAM1750 host target RNA, herein designated VGAM HOST TARGET RNA. This complementary binding is due to the fact that the nucleotide sequence of VGAM1750 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1750 RNA, herein designated VGAM RNA, may have a different number of host target binding sites in untranslated regions of a VGAM1750 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1750 RNA, herein designated VGAM RNA, to host target binding sites on VGAM1750 host target RNA, herein designated VGAM HOST TARGET RNA, such as BINDING SITE I, BINDING SITE II and BINDING SITE III, inhibits translation of VGAM1750 host target RNA into VGAM1750 host target protein, herein designated VGAM HOST TARGET PROTEIN. VGAM host target protein is therefore outlined by a broken line.

It is appreciated that VGAM1750 host target gene, herein designated VGAM HOST TARGET GENE, in fact represents a plurality of VGAM1750 host target genes. The mRNA of each one of this plurality of VGAM1750 host target genes comprises one or more host target binding sites, each having a nucleotide sequence which is at least partly complementary to VGAM1750 RNA, herein designated VGAM RNA, and which when bound by VGAM1750 RNA causes inhibition of translation of respective one or more VGAM1750 host target proteins.

It is further appreciated by one skilled in the art that the mode of translational inhibition illustrated by FIG. 1 with specific reference to translational inhibition exerted by VGAM1750 gene, herein designated VGAM GENE, on one or more VGAM1750 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1750 is inhibition of expression of host target genes, as part of a novel viral mechanism of attacking a host. Accordingly, utilities of VGAM1750 include diagnosis, prevention and treatment of viral infection by Camelpox Virus. Specific functions, and accordingly utilities, of VGAM1750 correlate with, and may be deduced from, the identity of the host target genes which VGAM1750 binds and inhibits, and the function of these host target genes, as elaborated hereinbelow.

Nucleotide sequences of the VGAM1750 precursor RNA, herein designated VGAM PRECURSOR RNA, and of the 'diced' VGAM1750 RNA, herein designated VGAM RNA, and a schematic representation of the secondary folding of VGAM1750 folded precursor RNA, herein designated VGAM FOLDED PRECURSOR RNA, of VGAM1750 are further described hereinbelow with reference to Table 1.

Nucleotide sequences of host target binding sites, such as BINDING SITE-I, BINDING SITE-II and BINDING SITE-III of FIG. 1, found on VGAM1750 host target RNA, and schematic representation of the complementarity of each of these host target binding sites to VGAM1750 RNA, herein designated VGAM RNA, are described hereinbelow with reference to Table 2.

As mentioned hereinabove with reference to FIG. 1, a function of VGAM1750 gene, herein designated VGAM is inhibition of expression of VGAM1750 target genes. It is appreciated that specific functions, and accordingly utilities, of VGAM1750 correlate with, and may be deduced from, the identity of the target genes which VGAM1750 binds and inhibits, and the function of these target genes, as elaborated hereinbelow.

LOC152078 (Accession XM_087376) is a VGAM1750 host target gene. LOC152078 BINDING SITE is HOST TARGET binding site found in the 3' untranslated region of mRNA encoded by LOC152078, corresponding to a HOST TARGET binding site such as BINDING SITE I, BINDING SITE II or BINDING SITE III. Table 2 illustrates the complementarity of the nucleotide sequences of LOC152078 BINDING SITE, designated SEQ ID:39213, to the nucleotide sequence of VGAM1750 RNA, herein designated VGAM RNA, also designated SEQ ID:4461.

A function of VGAM1750 is therefore inhibition of LOC152078 (Accession XM_087376). Accordingly, utilities of VGAM1750 include diagnosis, prevention and treatment of diseases and clinical conditions associated with LOC152078. FIG. 1 further provides a conceptual description of a novel bioinformatically detected viral gene of the present invention, referred to here as Viral Genomic Address Messenger 1751 (VGAM1751) viral gene, which modulates expression of respective host target genes thereof, the function and utility of which host target genes is known in the art.

VGAM1751 is a novel bioinformatically detected regulatory, non protein coding, viral micro RNA (miRNA) gene. The method by which VGAM1751 was detected is described hereinabove with reference to FIGS. 1-8.

VGAM1751 gene, herein designated VGAM GENE, is a viral gene contained in the genome of Camelpox Virus. VGAM1751 host target gene, herein designated VGAM HOST TARGET GENE, is a human gene contained in the human genome.

VGAM1751 gene encodes a VGAM1751 precursor RNA, herein designated VGAM PRECURSOR RNA. Similar to other miRNA genes, and unlike most ordinary genes, VGAM1751 precursor RNA does not encode a protein. A nucleotide sequence identical or highly similar to the nucleotide sequence of VGAM1751 precursor RNA is designated SEQ ID:1737, and is provided hereinbelow with reference to the sequence listing part. Nucleotide sequence SEQ ID:1737 is located at position 58 relative to the genome of Camelpox Virus.

VGAM1751 precursor RNA folds onto itself, forming VGAM1751 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1751 folded precursor RNA into VGAM1751 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1751 RNA is designated SEQ ID:4462, and is provided hereinbelow with reference to the sequence listing part.

VGAM1751 host target gene, herein designated VGAM HOST TARGET GENE, encodes a corresponding messenger RNA, VGAM1751 host target RNA, herein designated VGAM HOST TARGET RNA. VGAM1751 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1751 RNA, herein designated VGAM RNA, binds complementarily to one or more host target binding sites located in untranslated regions of VGAM1751 host target RNA, herein designated VGAM HOST TARGET RNA. This complementary binding is due to the fact that the nucleotide sequence of VGAM1751 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1751 RNA, herein designated VGAM RNA, may have a different number of host target binding sites in untranslated regions of a VGAM1751 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1751 RNA, herein designated VGAM RNA, to host target binding sites on VGAM1751 host target RNA, herein designated VGAM HOST TARGET RNA, such as BINDING SITE I, BINDING SITE II and BINDING SITE III, inhibits translation of VGAM1751 host target RNA into VGAM1751 host target protein, herein designated VGAM HOST TARGET PROTEIN. VGAM host target protein is therefore outlined by a broken line.

It is appreciated that VGAM1751 host target gene, herein designated VGAM HOST TARGET GENE, in fact represents a plurality of VGAM1751 host target genes. The mRNA of each one of this plurality of VGAM1751 host target genes comprises one or more host target binding sites, each having a nucleotide sequence which is at least partly complementary to VGAM1751 RNA, herein designated VGAM RNA, and which when bound by VGAM1751 RNA causes inhibition of translation of respective one or more VGAM1751 host target proteins.

It is further appreciated by one skilled in the art that the mode of translational inhibition illustrated by FIG. 1 with specific reference to translational inhibition exerted by VGAM1751 gene, herein designated VGAM GENE, on one or more VGAM1751 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1751 is inhibition of expression of host target genes, as part of a novel viral mechanism of attacking a host. Accordingly, utilities of VGAM1751 include diagnosis, prevention and treatment of viral infection by Camelpox Virus. Specific functions, and accordingly utilities, of VGAM1751 correlate with, and may be deduced from, the identity of the host target genes which VGAM1751 binds and inhibits, and the function of these host target genes, as elaborated hereinbelow.

Nucleotide sequences of the VGAM1751 precursor RNA, herein designated VGAM PRECURSOR RNA, and of the 'diced' VGAM1751 RNA, herein designated VGAM RNA, and a schematic representation of the secondary folding of VGAM1751 folded precursor RNA, herein designated VGAM FOLDED PRECURSOR RNA, of VGAM1751 are further described hereinbelow with reference to Table 1.

Nucleotide sequences of host target binding sites, such as BINDING SITE-I, BINDING SITE-II and BINDING SITE-III of FIG. 1, found on VGAM1751 host target RNA, and schematic representation of the complementarity of each of these host target binding sites to VGAM1751 RNA, herein designated VGAM RNA, are described hereinbelow with reference to Table 2.

As mentioned hereinabove with reference to FIG. 1, a function of VGAM1751 gene, herein designated VGAM is inhibition of expression of VGAM1751 target genes. It is appreciated that specific functions, and accordingly utilities, of VGAM1751 correlate with, and may be deduced from, the identity of the target genes which VGAM1751 binds and inhibits, and the function of these target genes, as elaborated hereinbelow.

LOC152078 (Accession XM_087376) is a VGAM1751 host target gene. LOC152078 BINDING SITE is HOST TARGET binding site found in the 3' untranslated region of mRNA encoded by LOC152078, corresponding to a HOST TARGET binding site such as BINDING SITE I, BINDING SITE II or BINDING SITE III. Table 2 illustrates the complementarity of the nucleotide sequences of LOC152078 BINDING SITE, designated SEQ ID:39213, to the nucleotide sequence of VGAM1751 RNA, herein designated VGAM RNA, also designated SEQ ID:4462.

A function of VGAM1751 is therefore inhibition of LOC152078 (Accession XM_087376). Accordingly, utilities of VGAM1751 include diagnosis, prevention and treatment of diseases and clinical conditions associated with LOC152078. FIG. 1 further provides a conceptual description of a novel bioinformatically detected viral gene of the present invention, referred to here as Viral Genomic Address Messenger 1752 (VGAM1752) viral gene, which modulates expression of respective host target genes thereof, the function and utility of which host target genes is known in the art.

VGAM1752 is a novel bioinformatically detected regulatory, non protein coding, viral micro RNA (miRNA) gene. The method by which VGAM1752 was detected is described hereinabove with reference to FIGS. 1-8.

VGAM1752 gene, herein designated VGAM GENE, is a viral gene contained in the genome of Camelpox Virus. VGAM1752 host target gene, herein designated VGAM HOST TARGET GENE, is a human gene contained in the human genome.

VGAM1752 gene encodes a VGAM1752 precursor RNA, herein designated VGAM PRECURSOR RNA. Similar to other miRNA genes, and unlike most ordinary genes, VGAM1752 precursor RNA does not encode a protein. A nucleotide sequence identical or highly similar to the nucleotide sequence of VGAM1752 precursor RNA is designated SEQ ID:1738, and is provided hereinbelow with reference to the sequence listing part. Nucleotide sequence SEQ ID:1738 is located at position 2927 relative to the genome of Camelpox Virus.

VGAM1752 precursor RNA folds onto itself, forming VGAM1752 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1752 folded precursor RNA into VGAM1752 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1752 RNA is designated SEQ ID:4463, and is provided hereinbelow with reference to the sequence listing part.

VGAM1752 host target gene, herein designated VGAM HOST TARGET GENE, encodes a corresponding messenger RNA, VGAM1752 host target RNA, herein designated VGAM HOST TARGET RNA. VGAM1752 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1752 RNA, herein designated VGAM RNA, binds complementarily to one or more host target binding sites located in untranslated regions of VGAM1752 host target RNA, herein designated VGAM HOST TARGET RNA. This complementary binding is due to the fact that the nucleotide sequence of VGAM1752 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1752 RNA, herein designated VGAM RNA, may have a different number of host target binding sites in untranslated regions of a VGAM1752 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1752 RNA, herein designated VGAM RNA, to host target binding sites on VGAM1752 host target RNA, herein designated VGAM HOST TARGET RNA, such as BINDING SITE I, BINDING SITE II and BINDING SITE III, inhibits translation of VGAM1752 host target RNA into VGAM1752 host target protein, herein designated VGAM HOST TARGET PROTEIN. VGAM host target protein is therefore outlined by a broken line.

It is appreciated that VGAM1752 host target gene, herein designated VGAM HOST TARGET GENE, in fact represents a plurality of VGAM1752 host target genes. The mRNA of each one of this plurality of VGAM1752 host target genes comprises one or more host target binding sites, each having a nucleotide sequence which is at least partly complementary to VGAM1752 RNA, herein designated VGAM RNA, and which when bound by VGAM1752 RNA causes inhibition of translation of respective one or more VGAM1752 host target proteins.

It is further appreciated by one skilled in the art that the mode of translational inhibition illustrated by FIG. 1 with specific reference to translational inhibition exerted by VGAM1752 gene, herein designated VGAM GENE, on one or more VGAM1752 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1752 is inhibition of expression of host target genes, as part of a novel viral mechanism of attacking a host. Accordingly, utilities of VGAM1752 include diagnosis, prevention and treatment of viral infection by Camelpox Virus. Specific functions, and accordingly utilities, of VGAM1752 correlate with, and may be deduced from, the identity of the host target genes which VGAM1752 binds and inhibits, and the function of these host target genes, as elaborated hereinbelow.

Nucleotide sequences of the VGAM1752 precursor RNA, herein designated VGAM PRECURSOR RNA, and of the 'diced' VGAM1752 RNA, herein designated VGAM RNA, and a schematic representation of the secondary folding of VGAM1752 folded precursor RNA, herein designated VGAM FOLDED PRECURSOR RNA, of VGAM1752 are further described hereinbelow with reference to Table 1.

Nucleotide sequences of host target binding sites, such as BINDING SITE-I, BINDING SITE-II and BINDING SITE-III of FIG. 1, found on VGAM1752 host target RNA, and schematic representation of the complementarity of each of these host target binding sites to VGAM1752 RNA, herein designated VGAM RNA, are described hereinbelow with reference to Table 2.

As mentioned hereinabove with reference to FIG. 1, a function of VGAM1752 gene, herein designated VGAM is inhibition of expression of VGAM1752 target genes. It is appreciated that specific functions, and accordingly utilities, of VGAM1752 correlate with, and may be deduced from, the identity of the target genes which VGAM1752 binds and inhibits, and the function of these target genes, as elaborated hereinbelow.

Chromosome 11 Open Reading Frame 23 (C11orf23, Accession NM_018312) is a VGAM1752 host target gene. C11orf23 BINDING SITE is HOST TARGET binding site found in the 3' untranslated region of mRNA encoded by C11orf23, corresponding to a HOST TARGET binding site such as BINDING SITE I, BINDING SITE II or BINDING SITE III. Table 2 illustrates the complementarity of the nucleotide sequences of C11orf23 BINDING SITE, designated SEQ ID:20298, to the nucleotide sequence of VGAM1752 RNA, herein designated VGAM RNA, also designated SEQ ID:4463.

A function of VGAM1752 is therefore inhibition of Chromosome 11 Open Reading Frame 23 (C11orf23, Accession NM_018312). Accordingly, utilities of VGAM1752 include diagnosis, prevention and treatment of diseases and clinical conditions associated with C11orf23. LOC160646 (Accession XM_090413) is another VGAM1752 host target gene. LOC160646 BINDING SITE is HOST TARGET binding site found in the 3' untranslated region of mRNA encoded by LOC160646, corresponding to a HOST TARGET binding site such as BINDING SITE I, BINDING SITE II or BINDING SITE III. Table 2 illustrates the complementarity of the nucleotide sequences of LOC160646 BINDING SITE, designated SEQ ID:40000, to the nucleotide sequence of VGAM1752 RNA, herein designated VGAM RNA, also designated SEQ ID:4463.

Another function of VGAM1752 is therefore inhibition of LOC160646 (Accession XM_090413). Accordingly, utilities of VGAM1752 include diagnosis, prevention and treatment of diseases and clinical conditions associated with LOC160646. LOC201475 (Accession XM_113967) is another VGAM1752 host target gene. LOC201475 BINDING SITE is HOST TARGET binding site found in the 5' untranslated region of mRNA encoded by LOC201475, corresponding to a HOST TARGET binding site such as BINDING SITE I, BINDING SITE II or BINDING SITE III. Table 2 illustrates the complementarity of the nucleotide sequences of LOC201475 BINDING SITE, designated SEQ ID:42576, to the nucleotide sequence of VGAM1752 RNA, herein designated VGAM RNA, also designated SEQ ID:4463.

Another function of VGAM1752 is therefore inhibition of LOC201475 (Accession XM_113967). Accordingly, utilities of VGAM1752 include diagnosis, prevention and treatment of diseases and clinical conditions associated with LOC201475. FIG. 1 further provides a conceptual description of a novel bioinformatically detected viral gene of the present invention, referred to here as Viral Genomic Address Messenger 1753 (VGAM1753) viral gene, which modulates expression of respective host target genes thereof, the function and utility of which host target genes is known in the art.

VGAM1753 is a novel bioinformatically detected regulatory, non protein coding, viral micro RNA (miRNA) gene. The method by which VGAM1753 was detected is described hereinabove with reference to FIGS. 1-8.

VGAM1753 gene, herein designated VGAM GENE, is a viral gene contained in the genome of Camelpox Virus. VGAM1753 host target gene, herein designated VGAM HOST TARGET GENE, is a human gene contained in the human genome.

VGAM1753 gene encodes a VGAM1753 precursor RNA, herein designated VGAM PRECURSOR RNA. Similar to other miRNA genes, and unlike most ordinary genes, VGAM1753 precursor RNA does not encode a protein. A nucleotide sequence identical or highly similar to the nucleotide sequence of VGAM1753 precursor RNA is designated SEQ ID:1739, and is provided hereinbelow with reference to the sequence listing part. Nucleotide sequence SEQ ID:1739 is located at position 2271 relative to the genome of Camelpox Virus.

VGAM1753 precursor RNA folds onto itself, forming VGAM1753 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1753 folded precursor RNA into VGAM1753 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1753 RNA is designated SEQ ID:4464, and is provided hereinbelow with reference to the sequence listing part.

VGAM1753 host target gene, herein designated VGAM HOST TARGET GENE, encodes a corresponding messenger RNA, VGAM1753 host target RNA, herein designated VGAM HOST TARGET RNA. VGAM1753 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1753 RNA, herein designated VGAM RNA, binds complementarily to one or more host target binding sites located in untranslated regions of VGAM1753 host target RNA, herein designated VGAM HOST TARGET RNA. This complementary binding is due to the fact that the nucleotide sequence of VGAM1753 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1753 RNA, herein designated VGAM RNA, may have a different number of host target binding sites in untranslated regions of a VGAM1753 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1753 RNA, herein designated VGAM RNA, to host target binding sites on VGAM1753 host target RNA, herein designated VGAM HOST TARGET RNA, such as BINDING SITE I, BINDING SITE II and BINDING SITE III, inhibits translation of VGAM1753 host target RNA into VGAM1753 host target protein, herein designated VGAM HOST TARGET PROTEIN. VGAM host target protein is therefore outlined by a broken line.

It is appreciated that VGAM1753 host target gene, herein designated VGAM HOST TARGET GENE, in fact represents a plurality of VGAM1753 host target genes. The mRNA of each one of this plurality of VGAM1753 host target genes comprises one or more host target binding sites, each having a nucleotide sequence which is at least partly complementary to VGAM1753 RNA, herein designated VGAM RNA, and which when bound by VGAM1753 RNA causes inhibition of translation of respective one or more VGAM1753 host target proteins.

It is further appreciated by one skilled in the art that the mode of translational inhibition illustrated by FIG. 1 with specific reference to translational inhibition exerted by VGAM1753 gene, herein designated VGAM GENE, on one or more VGAM1753 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1753 is inhibition of expression of host target genes, as part of a novel viral mechanism of attacking a host. Accordingly, utilities of VGAM1753 include diagnosis, prevention and treatment of viral infection by Camelpox Virus. Specific functions, and accordingly utilities, of VGAM1753 correlate with, and may be deduced from, the identity of the host target genes which VGAM1753 binds and inhibits, and the function of these host target genes, as elaborated hereinbelow.

Nucleotide sequences of the VGAM1753 precursor RNA, herein designated VGAM PRECURSOR RNA, and of the 'diced' VGAM1753 RNA, herein designated VGAM RNA, and a schematic representation of the secondary folding of VGAM1753 folded precursor RNA, herein designated VGAM FOLDED PRECURSOR RNA, of VGAM1753 are further described hereinbelow with reference to Table 1.

Nucleotide sequences of host target binding sites, such as BINDING SITE-I, BINDING SITE-II and BINDING SITE-III of FIG. 1, found on VGAM1753 host target RNA, and schematic representation of the complementarity of each of these host target binding sites to VGAM1753 RNA, herein designated VGAM RNA, are described hereinbelow with reference to Table 2.

As mentioned hereinabove with reference to FIG. 1, a function of VGAM1753 gene, herein designated VGAM is inhibition of expression of VGAM1753 target genes. It is appreciated that specific functions, and accordingly utilities, of VGAM1753 correlate with, and may be deduced from, the identity of the target genes which VGAM1753 binds and inhibits, and the function of these target genes, as elaborated hereinbelow.

EFG1 (Accession XM_170611) is a VGAM1753 host target gene. EFG1 BINDING SITE is HOST TARGET binding site found in the 3' untranslated region of mRNA encoded by EFG1, corresponding to a HOST TARGET binding site such as BINDING SITE I, BINDING SITE II or BINDING SITE III. Table 2 illustrates the complementarity of the nucleotide sequences of EFG1 BINDING SITE, designated SEQ ID:45397, to the nucleotide sequence of VGAM1753 RNA, herein designated VGAM RNA, also designated SEQ ID:4464.

A function of VGAM1753 is therefore inhibition of EFG1 (Accession XM_170611), a gene which promotes the gtp-dependent translocation of the nascent protein chain from the a-site to the p-site of the ribosome in the mitochondria. Accordingly, utilities of VGAM1753 include diagnosis, prevention and treatment of diseases and clinical conditions associated with EFG1. The function of EFG1 has been established by previous studies. By EST database searching with rat Efg as probe, followed by PCR of a testis cDNA library, Gao et al. (2001) obtained cDNAs encoding mouse and human EFG1, which they called GFM. EFG1 encodes a deduced 751-amino acid protein that shares 84% and 89% sequence identity with rat Efg and mouse Gfm, respectively, and contains a conserved GTP-binding elongation factor signature and a GTP-binding domain composed of 3 motifs. Northern blot analysis revealed wide expression of 3.8- and 3.4-kb transcripts, abundant in heart, skeletal muscle, and testis, as well as testis-specific expression of a 2.9-kb transcript. Independently, Hammarsund et al. (2001) identified and characterized mitochondrial elongation factor-2 (EFG2; 606544) and used information contained in public databases to identify and clone the complete coding sequence of the human EFG1 gene on chromosome 3q25.

Full details of the abovementioned studies are described in the following publications, the disclosure of which are hereby incorporated by reference:

Gao, J.; Yu, L.; Zhang, P.; Jiang, J.; Chen, J.; Peng, J.; Wei, Y.; Zhao, S.: Cloning and characterization of human and mouse mitochondrial elongation factor G, GFM and Gfm, and mapping of GFM to human chromosome 3q25.1-q26.2. Genomics 74:109-114, 2001; and Hammarsund, M.; Wilson, W.; Corcoran, M.; Merup, M.; Einhorn, S.; Grander, D.; Sangfelt, O.: Identification and characterization of two novel human mitochondrial elongation factor gene.

Further studies establishing the function and utilities of EFG1 are found in John Hopkins OMIM database record ID 606639, and in sited publications numbered 6124 listed in the bibliography section hereinbelow, which are also hereby incorporated by reference. Solute Carrier Family 6 (neurotransmitter transporter, dopamine), Member 3 (SLC6A3, Accession NM_001044) is another VGAM1753 host target gene. SLC6A3 BINDING SITE is HOST TARGET binding site found in the 3' untranslated region of mRNA encoded by SLC6A3, corresponding to a HOST TARGET binding site such as BINDING SITE I, BINDING SITE II or BINDING SITE III. Table 2 illustrates the complementarity of the nucleotide sequences of SLC6A3 BINDING SITE, designated SEQ ID:6713, to the nucleotide sequence of VGAM1753 RNA, herein designated VGAM RNA, also designated SEQ ID:4464.

Another function of VGAM1753 is therefore inhibition of Solute Carrier Family 6 (neurotransmitter transporter, dopamine), Member 3 (SLC6A3, Accession NM_001044), a gene which terminates the action of dopamine by its high affinity sodium-dependent reuptake into presynaptic terminals. Accordingly, utilities of VGAM1753 include diagnosis, prevention and treatment of diseases and clinical conditions associated with SLC6A3. The function of SLC6A3 has been established by previous studies. Giros et al. (1996) found that the disruption of the mouse dopamine transporter gene results in spontaneous hyperlocomotion despite major adaptive changes such as decreases in neurotransmitter and receptor levels. In homozygous mice, dopamine persisted at least 100 times longer in the extracellular space, providing a biochemical explanation of the hyperdopaminergic phenotype and demonstrating the critical role of the transporter in regulating neurotransmission. The authors noted that the dopamine transporter is an obligatory target of cocaine and amphetamine, as demonstrated by the fact that these psychostimulants had no effect on locomotor activity or dopamine release and uptake in mice lacking the transporter. Giros et al. (1996) stated that the DAT knockout mice should be an excellent tool for the study and development of drugs used in the management of dopaminergic dysfunction. There are similarities between the hyperdopaminergic phenotype of the knockout mice and some of the positive symptoms of schizophrenic patients. Specific blockade of the dopamine transporter with high-affinity inhibitors may be beneficial in illnesses such as Parkinson disease, where the effective levels of dopamine are markedly reduced.

Full details of the abovementioned studies are described in the following publications, the disclosure of which are hereby incorporated by reference:

Gainetdinov, R. R.; Wetsel, W. C.; Jones, S. R.; Levin, E. D.; Jaber, M.; Caron, M. G.: Role of serotonin in the paradoxical calming effect of psychostimulants on hyperactivity. Science 283:397-401, 1999; and Giros, B.; Jaber, M.; Jones, S. R.; Wightman, R. M.; Caron, M. G.: Hyperlocomotion and indifference to cocaine and amphetamine in mice lacking the dopamine receptor. Nature 370:606-612, 1.

Further studies establishing the function and utilities of SLC6A3 are found in John Hopkins OMIM database record ID 126455, and in sited publications numbered 2038-2046, 89 and 2293-2299 listed in the bibliography section hereinbelow, which are also hereby incorporated by reference. H2AV (Accession NM_138635) is another VGAM1753 host target gene. H2AV BINDING SITE is HOST TARGET binding site found in the 3' untranslated region of mRNA encoded by H2AV, corresponding to a HOST TARGET binding site such as BINDING SITE I, BINDING SITE II or BINDING SITE III. Table 2 illustrates the complementarity of the nucleotide sequences of H2AV BINDING SITE, designated SEQ ID:28912, to the nucleotide sequence of VGAM1753 RNA, herein designated VGAM RNA, also designated SEQ ID:4464.

Another function of VGAM1753 is therefore inhibition of H2AV (Accession NM_138635). Accordingly, utilities of VGAM1753 include diagnosis, prevention and treatment of diseases and clinical conditions associated with H2AV. HMP19 (Accession XM_113455) is another VGAM1753 host target gene. HMP19 BINDING SITE is HOST TARGET binding site found in the 3' untranslated region of mRNA encoded by HMP19, corresponding to a HOST TARGET binding site such as BINDING SITE I, BINDING SITE II or BINDING SITE III. Table 2 illustrates the complementarity of the nucleotide sequences of HMP19 BINDING SITE, designated SEQ ID:42273, to the nucleotide sequence of VGAM1753 RNA, herein designated VGAM RNA, also designated SEQ ID:4464.

Another function of VGAM1753 is therefore inhibition of HMP19 (Accession XM_113455). Accordingly, utilities of VGAM1753 include diagnosis, prevention and treatment of diseases and clinical conditions associated with HMP19. FIG. 1 further provides a conceptual description of a novel bioinformatically detected viral gene of the present invention, referred to here as Viral Genomic Address Messenger 1754 (VGAM1754) viral gene, which modulates expression of respective host target genes thereof, the function and utility of which host target genes is known in the art.

VGAM1754 is a novel bioinformatically detected regulatory, non protein coding, viral micro RNA (miRNA) gene. The method by which VGAM1754 was detected is described hereinabove with reference to FIGS. 1-8.

VGAM1754 gene, herein designated VGAM GENE, is a viral gene contained in the genome of Camelpox Virus.

VGAM1754 host target gene, herein designated VGAM HOST TARGET GENE, is a human gene contained in the human genome.

VGAM1754 gene encodes a VGAM1754 precursor RNA, herein designated VGAM PRECURSOR RNA. Similar to other miRNA genes, and unlike most ordinary genes, VGAM1754 precursor RNA does not encode a protein. A nucleotide sequence identical or highly similar to the nucleotide sequence of VGAM1754 precursor RNA is designated SEQ ID:1740, and is provided hereinbelow with reference to the sequence listing part. Nucleotide sequence SEQ ID:1740 is located at position 9493 relative to the genome of Camelpox Virus.

VGAM1754 precursor RNA folds onto itself, forming VGAM1754 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1754 folded precursor RNA into VGAM1754 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM1754 RNA is designated SEQ ID:4465, and is provided hereinbelow with reference to the sequence listing part.

VGAM1754 host target gene, herein designated VGAM HOST TARGET GENE, encodes a corresponding messenger RNA, VGAM1754 host target RNA, herein designated VGAM HOST TARGET RNA. VGAM1754 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1754 RNA, herein designated VGAM RNA, binds complementarily to one or more host target binding sites located in untranslated regions of VGAM1754 host target RNA, herein designated VGAM HOST TARGET RNA. This complementary binding is due to the fact that the nucleotide sequence of VGAM1754 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1754 RNA, herein designated VGAM RNA, may have a different number of host target binding sites in untranslated regions of a VGAM1754 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1754 RNA, herein designated VGAM RNA, to host target binding sites on VGAM1754 host target RNA, herein designated VGAM HOST TARGET RNA, such as BINDING SITE I, BINDING SITE II and BINDING SITE III, inhibits translation of VGAM1754 host target RNA into VGAM1754 host target protein, herein designated VGAM HOST TARGET PROTEIN. VGAM host target protein is therefore outlined by a broken line.

It is appreciated that VGAM1754 host target gene, herein designated VGAM HOST TARGET GENE, in fact represents a plurality of VGAM1754 host target genes. The mRNA of each one of this plurality of VGAM1754 host target genes comprises one or more host target binding sites, each having a nucleotide sequence which is at least partly complementary to VGAM1754 RNA, herein designated VGAM RNA, and which when bound by VGAM1754 RNA causes inhibition of translation of respective one or more VGAM1754 host target proteins.

It is further appreciated by one skilled in the art that the mode of translational inhibition illustrated by FIG. 1 with specific reference to translational inhibition exerted by VGAM1754 gene, herein designated VGAM GENE, on one or more VGAM1754 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1754 is inhibition of expression of host target genes, as part of a novel viral mechanism of attacking a host. Accordingly, utilities of VGAM1754 include diagnosis, prevention and treatment of viral infection by Camelpox Virus. Specific functions, and accordingly utilities, of VGAM1754 correlate with, and may be deduced from, the identity of the host target genes which VGAM1754 binds and inhibits, and the function of these host target genes, as elaborated hereinbelow.

Nucleotide sequences of the VGAM1754 precursor RNA, herein designated VGAM PRECURSOR RNA, and of the 'diced' VGAM1754 RNA, herein designated VGAM RNA, and a schematic representation of the secondary folding of VGAM1754 folded precursor RNA, herein designated VGAM FOLDED PRECURSOR RNA, of VGAM1754 are further described hereinbelow with reference to Table 1.

Nucleotide sequences of host target binding sites, such as BINDING SITE-I, BINDING SITE-II and BINDING SITE-III of FIG. 1, found on VGAM1754 host target RNA, and schematic representation of the complementarity of each of these host target binding sites to VGAM1754 RNA, herein designated VGAM RNA, are described hereinbelow with reference to Table 2.

As mentioned hereinabove with reference to FIG. 1, a function of VGAM1754 gene, herein designated VGAM is inhibition of expression of VGAM1754 target genes. It is appreciated that specific functions, and accordingly utilities, of VGAM1754 correlate with, and may be deduced from, the identity of the target genes which VGAM1754 binds and inhibits, and the function of these target genes, as elaborated hereinbelow.

Caveolin 1, Caveolae Protein, 22 kDa (CAV1, Accession NM_001753) is a VGAM1754 host target gene. CAV1 BINDING SITE is HOST TARGET binding site found in the 3' untranslated region of mRNA encoded by CAV1, corresponding to a HOST TARGET binding site such as BINDING SITE I, BINDING SITE II or BINDING SITE III. Table 2 illustrates the complementarity of the nucleotide sequences of CAV1 BINDING SITE, designated SEQ ID:7489, to the nucleotide sequence of VGAM1754 RNA, herein designated VGAM RNA, also designated SEQ ID:4465.

A function of VGAM1754 is therefore inhibition of Caveolin 1, Caveolae Protein, 22 kDa (CAV1, Accession NM_001753), a gene which may act as a scaffolding protein within caveolar membranes, and interacts directly with g-protein alpha subunits and can functionally regulate their activity. Accordingly, utilities of VGAM1754 include diagnosis, prevention and treatment of diseases and clinical conditions associated with CAV1. The function of CAV1 and its association with various diseases and clinical conditions, has been established by previous studies, as described hereinabove with reference to VGAM331. Inducible T-cell Co-stimulator (ICOS, Accession NM_012092) is another VGAM1754 host target gene. ICOS BINDING SITE is HOST TARGET binding site found in the 3' untranslated region of mRNA encoded by ICOS, corresponding to a HOST TARGET binding site such as BINDING SITE I, BINDING SITE II or BINDING SITE III. Table 2 illustrates the complementarity of the nucleotide sequences of ICOS BINDING SITE, designated SEQ ID:14384, to the nucleotide sequence of VGAM1754 RNA, herein designated VGAM RNA, also designated SEQ ID:4465.

Another function of VGAM1754 is therefore inhibition of Inducible T-cell Co-stimulator (ICOS, Accession NM_012092), a gene which forms homodimers and functions as an inducible T-cell co-stimulator. Accordingly, utilities of VGAM1754 include diagnosis, prevention and treatment of diseases and clinical conditions associated with ICOS. The function of ICOS and its association with various diseases and clinical conditions, has been established by previous studies, as described hereinabove with reference to VGAM18. Integrin, Alpha 11 (ITGA11, Accession NM_012211) is another VGAM1754 host target gene. ITGA11 BINDING SITE is HOST TARGET binding site found in the 3' untranslated region of mRNA encoded by ITGA11, corresponding to a HOST TARGET binding site such as BINDING SITE I, BINDING SITE II or BINDING SITE III. Table 2 illustrates the complementarity of the nucleotide sequences of ITGA11 BINDING SITE, designated SEQ ID:14513, to the nucleotide sequence of VGAM1754 RNA, herein designated VGAM RNA, also designated SEQ ID:4465.

Another function of VGAM1754 is therefore inhibition of Integrin, Alpha 11 (ITGA11, Accession NM_012211), a gene which acts as a collagen I receptor. Accordingly, utilities of VGAM1754 include diagnosis, prevention and treatment of diseases and clinical conditions associated with ITGA11. The function of ITGA11 and its association with various diseases and clinical conditions, has been established by previous studies, as described hereinabove with reference to VGAM206. MADS Box Transcription Enhancer Factor 2, Polypeptide A (myocyte enhancer factor 2A) (MEF2A, Accession NM_005587) is another VGAM1754 host target gene. MEF2A BINDING SITE is HOST TARGET binding site found in the 3' untranslated region of mRNA encoded by MEF2A, corresponding to a HOST TARGET binding site such as BINDING SITE I, BINDING SITE II or BINDING SITE III. Table 2 illustrates the complementarity of the nucleotide sequences of MEF2A BINDING SITE, designated SEQ ID:12116, to the nucleotide sequence of VGAM1754 RNA, herein designated VGAM RNA, also designated SEQ ID:4465.

Another function of VGAM1754 is therefore inhibition of MADS Box Transcription Enhancer Factor 2, Polypeptide A (myocyte enhancer factor 2A) (MEF2A, Accession NM_005587), a gene which binds a consensus sequence that regulates transcription. Accordingly, utilities of VGAM1754 include diagnosis, prevention and treatment of diseases and clinical conditions associated with MEF2A. The function of MEF2A and its association with various diseases and clinical conditions, has been established by previous studies, as described hereinabove with reference to VGAM46. Midline 1 (Opitz/BBB syndrome) (MID1, Accession NM_000381) is another VGAM1754 host target gene. MID1 BINDING SITE is HOST TARGET binding site found in the 5' untranslated region of mRNA encoded by MID1, corresponding to a HOST TARGET binding site such as BINDING SITE I, BINDING SITE II or BINDING SITE III. Table 2 illustrates the complementarity of the nucleotide sequences of MID1 BINDING SITE, designated SEQ ID:5955, to the nucleotide sequence of VGAM1754 RNA, herein designated VGAM RNA, also designated SEQ ID:4465.

Another function of VGAM1754 is therefore inhibition of Midline 1 (Opitz/BBB syndrome) (MID1, Accession NM_000381). Accordingly, utilities of VGAM1754 include diagnosis, prevention and treatment of diseases and clinical conditions associated with MID1. Mucin 3B (MUC3B, Accession XM_168578) is another VGAM1754 host target gene. MUC3B BINDING SITE is HOST TARGET binding site found in the 3' untranslated region of mRNA encoded by MUC3B, corresponding to a HOST TARGET binding site such as BINDING SITE I, BINDING SITE II or BINDING SITE III. Table 2 illustrates the complementarity of the nucleotide sequences of MUC3B BINDING SITE, designated SEQ ID:45257, to the nucleotide sequence of VGAM1754 RNA, herein designated VGAM RNA, also designated SEQ ID:4465.

Another function of VGAM1754 is therefore inhibition of Mucin 3B (MUC3B, Accession XM_168578), a gene which provides a protective, lubricating barrier against particles and infectious agents at mucosal surfaces. Accordingly, utilities of VGAM1754 include diagnosis, prevention and treatment of diseases and clinical conditions associated with MUC3B. The function of MUC3B and its association with various diseases and clinical conditions, has been established by previous studies, as described hereinabove with reference to VGAM55. Sialidase 3 (membrane sialidase) (NEU3, Accession NM_006656) is another VGAM1754 host target gene. NEU3 BINDING SITE is HOST TARGET binding site found in the 3' untranslated region of mRNA encoded by NEU3, corresponding to a HOST TARGET binding site such as BINDING SITE I, BINDING SITE II or BINDING SITE III. Table 2 illustrates the complementarity of the nucleotide sequences of NEU3 BINDING SITE, designated SEQ ID:13457, to the nucleotide sequence of VGAM1754 RNA, herein designated VGAM RNA, also designated SEQ ID:4465.

Another function of VGAM1754 is therefore inhibition of Sialidase 3 (membrane sialidase) (NEU3, Accession NM_006656). Accordingly, utilities of VGAM1754 include diagnosis, prevention and treatment of diseases and clinical conditions associated with NEU3. Plastin 3 (T isoform) (PLS3, Accession NM_005032) is another VGAM1754 host target gene. PLS3 BINDING SITE is HOST TARGET binding site found in the 3' untranslated region of mRNA encoded by PLS3, corresponding to a HOST TARGET binding site such as BINDING SITE I, BINDING SITE II or BINDING SITE III. Table 2 illustrates the complementarity of the nucleotide sequences of PLS3 BINDING SITE, designated SEQ ID:11473, to the nucleotide sequence of VGAM1754 RNA, herein designated VGAM RNA, also designated SEQ ID:4465.

Another function of VGAM1754 is therefore inhibition of Plastin 3 (T isoform) (PLS3, Accession NM_005032), a gene which binds actin. Accordingly, utilities of VGAM1754 include diagnosis, prevention and treatment of diseases and clinical conditions associated with PLS3. The function of PLS3 has been established by previous studies. Plastins are a family of actin-binding proteins that are differentially expressed in normal and malignant cells. Lin et al. (1988) isolated partial cDNAs encoding T-plastin and L-plastin (OMIM Ref. No. 153430) from a transformed human fibroblast cDNA library. The C-terminal 570 amino acids of the T-plastin and L-plastin proteins are 83% identical. By 2-dimensional gel electrophoresis of human cell extracts, Lin et al. (1988) showed that T-plastin is expressed as 2 equally abundant isoforms. Northern blot analysis revealed that T-plastin is expressed as a 3.4-kb mRNA in normal cells of solid tissues and in transformed fibroblasts. Using anchored PCR, Lin et al. (1990) identified the 5-prime end of the T-plastin mRNA. The T-plastin transcript has 2 possible translation initiation codons which would result in predicted 627- and 630-amino acid proteins. The authors constructed 2 modified T-plastin cDNAs containing either the first or the second initiation codon. Expression of these cDNAs in E. coli resulted in the synthesis of 2 distinct T-plastins with the same isoelectric points and apparent molecular weights as the 2 T-plastins present in human cells. Lin et al. (1990) found that T-plastin contains a potential calcium-binding site near the N terminus. Lin et al. (1993) reported that both the L-plastin and T-plastin genes contain 16 exons and span approximately 90 kb Full details of the abovementioned studies are described in the following publications, the disclosure of which are hereby incorporated by reference:

Lin, C.-S.; Aebersold, R. H.; Leavitt, J.: Correction of the N-terminal sequences of the human plastin isoforms by using anchored polymerase chain reaction: identification of a potential calcium-binding domain. Molec. Cell. Biol. 10:1818-1821, 1990; and Lin, C.-S.; Park, T.; Chen, Z. P.; Leavitt, J.: Human plastin genes: comparative gene structure, chromosome location, and differential expression in normal and neoplastic cells. J. Biol.

Further studies establishing the function and utilities of PLS3 are found in John Hopkins OMIM database record ID 300131, and in sited publications numbered 65 and 10989 listed in the bibliography section hereinbelow, which are also hereby incorporated by reference. SPS2 (Accession NM_012248) is another VGAM1754 host target gene. SPS2 BINDING SITE is HOST TARGET binding site found in the 3' untranslated region of mRNA encoded by SPS2, corresponding to a HOST TARGET binding site such as BINDING SITE I, BINDING SITE II or BINDING SITE III. Table 2 illustrates the complementarity of the nucleotide sequences of SPS2 BINDING SITE, designated SEQ ID:14555, to the nucleotide sequence of VGAM1754 RNA, herein designated VGAM RNA, also designated SEQ ID:4465.

Another function of VGAM1754 is therefore inhibition of SPS2 (Accession NM_012248), a gene which synthesizes selenophosphate from selenide and ATP. Accordingly, utilities of VGAM1754 include diagnosis, prevention and treatment of diseases and clinical conditions associated with SPS2. The function of SPS2 has been established by previous studies. By screening activated CD8 (see OMIM Ref. No. 186910)-positive T cells with mouse Sps2, a homolog of E. coli selD, as the probe, Guimaraes et al. (1996) isolated a cDNA encoding human SPS2. The deduced 448-amino acid SPS2 protein contains Walker A- and B-like motifs, which are characteristic of alpha/beta nucleotide-binding folds. The SPS2 Walker A-like motif is a gly-rich site that includes the sec residue. Northern blot analysis revealed preferential expression of a 2.3-kb transcript in mouse tissues that produce selenoproteins, with lower expression in sites of blood cell development. Levels of Sps2 mRNA were upregulated upon activation of CD4 (OMIM Ref. No. 186940)-positive lymphocytes. Western blot analysis showed that Sps2 levels were 20-fold higher when the 3-prime untranslated region (UTR) of Sps2 was included in the expression construct in transfected cells. Southern blot analysis indicated that SPS2 is well-conserved in mammals Full details of the abovementioned studies are described in the following publications, the disclosure of which are hereby incorporated by reference:

Guimaraes, M. J.; Peterson, D.; Vicari, A.; Cocks, B. G.; Copeland, N. G.; Gilbert, D. J.; Jenkins, N. A.; Ferrick, D. A.; Kastelein, R. A.; Bazan, J. F.; Zlotnik, A.: Identification of a novel selD homolog from eukaryotes, bacteria, and archaea: is there an autoregulatory mechanism in selenocysteine metabolism? Proc. Nat. Acad. Sci. 93:15086-15091, 1996; and Lescure, A.; Gautheret, D.; Carbon, P.; Krol, A.: Novel selenoproteins identified in silico and in vivo by using a conserved RNA structural motif. J. Biol. Chem. 274:38147-38154, 1999.

Further studies establishing the function and utilities of SPS2 are found in John Hopkins OMIM database record ID 606218, and in sited publications numbered 6590 listed in the bibliography section hereinbelow, which are also hereby incorporated by reference. TRAP240 (Accession NM_005121) is another VGAM1754 host target gene. TRAP240 BINDING SITE is HOST TARGET binding site found in the 3' untranslated region of mRNA encoded by TRAP240, corresponding to a HOST TARGET binding site such as BINDING SITE I, BINDING SITE II or BINDING SITE III. Table 2 illustrates the complementarity of the nucleotide sequences of TRAP240 BINDING SITE, designated SEQ ID:11604, to the nucleotide sequence of VGAM1754 RNA, herein designated VGAM RNA, also designated SEQ ID:4465.

Another function of VGAM1754 is therefore inhibition of TRAP240 (Accession NM_005121), a gene which Subunit of TRAP thyroid hormone receptor-associated protein complex; coactivator for nuclear receptors. Accordingly, utilities of VGAM1754 include diagnosis, prevention and treatment of diseases and clinical conditions associated with TRAP240. The function of TRAP240 has been established by previous studies. For background information on thyroid hormone receptor-associated proteins (TRAPs), see 300182. Using a HeLa cell line, Ito et al. (1999) cloned TRAP240, the gene encoding the 240-kD subunit of the TRAP complex. The TRAP240 cDNA encodes a 2,174-amino acid protein that shows a regional identity of 29% and a similarity of 46% with a hypothetical C. elegans protein (CEK08F8 and CEF07H5). It shows no obvious relationship with known consensus sequences, other than 2 ligand-dependent nuclear hormone receptor signature recognition motifs (LXXLL sequences) at positions 1188-1192 and 1279-1283, and a short leucine zipper at position 1331-1352. Northern blot analysis of multiple human tissues showed that the TRAP240 gene is ubiquitously expressed as an approximately 11.5-kb transcript. Nagase et al. (1998) also cloned the cDNA encoding TRAP240, which they referred to as KIAA0593, from a human brain cDNA library. By analysis of a human-rodent hybrid panel, Nagase et al. (1998) mapped the TRAP240 gene to chromosome 17

Full details of the abovementioned studies are described in the following publications, the disclosure of which are hereby incorporated by reference:

Ito, M.; Yuan, C.-X.; Malik, S.; Gu, W.; Fondell, J. D.; Yamamura, S.; Fu, Z.-Y.; Zhang, X.; Qin, J.; Roeder, R. G.: Identity between TRAP and SMCC complexes indicates novel pathways for the function of nuclear receptors and diverse mammalian activators. Molec. Cell 3:361-370, 1999; and Nagase, T.; Ishikawa, K.; Miyajima, N.; Tanaka, A.; Kotani, H.; Nomura, N.; Ohara, O.: Prediction of the coding sequences of unidentified human genes. IX. The complete sequences of 100.

Further studies establishing the function and utilities of TRAP240 are found in John Hopkins OMIM database record ID 603808, and in sited publications numbered 11384 listed in the bibliography section hereinbelow, which are also hereby incorporated by reference. A Kinase (PRKA) Anchor Protein 11 (AKAP11, Accession NM_016248) is another VGAM1754 host target gene. AKAP11 BINDING SITE is HOST TARGET binding site found in the 3' untranslated region of mRNA encoded by AKAP11, corresponding to a HOST TARGET binding site such as BINDING SITE I, BINDING SITE II or BINDING SITE III. Table 2 illustrates the complementarity of the nucleotide sequences of AKAP11 BINDING SITE, designated SEQ ID:18365, to the nucleotide sequence of VGAM1754 RNA, herein designated VGAM RNA, also designated SEQ ID:4465.

Another function of VGAM1754 is therefore inhibition of A Kinase (PRKA) Anchor Protein 11 (AKAP11, Accession NM_016248). Accordingly, utilities of VGAM1754 include diagnosis, prevention and treatment of diseases and clinical conditions associated with AKAP11. CAP (Accession NM_006367) is another VGAM1754 host target gene. CAP BINDING SITE is HOST TARGET binding site found in the 3' untranslated region of mRNA encoded by CAP, corresponding to a HOST TARGET binding site such as BINDING SITE I, BINDING SITE II or BINDING SITE III. Table 2 illustrates the complementarity of the nucleotide sequences of CAP BINDING SITE, designated SEQ ID:13056, to the nucleotide sequence of VGAM1754 RNA, herein designated VGAM RNA, also designated SEQ ID:4465.

Another function of VGAM1754 is therefore inhibition of CAP (Accession NM_006367). Accordingly, utilities of VGAM1754 include diagnosis, prevention and treatment of diseases and clinical conditions associated with CAP. CGI-01 (Accession NM_015935) is another VGAM1754 host target gene. CGI-01 BINDING SITE is HOST TARGET binding site found in the 5' untranslated region of mRNA encoded by CGI-01, corresponding to a HOST TARGET binding site such as BINDING SITE I, BINDING SITE II or BINDING SITE III. Table 2 illustrates the complementarity of the nucleotide sequences of CGI-01 BINDING SITE, designated SEQ ID:18054, to the nucleotide sequence of VGAM1754 RNA, herein designated VGAM RNA, also designated SEQ ID:4465.

Another function of VGAM1754 is therefore inhibition of CGI-01 (Accession NM_015935). Accordingly, utilities of VGAM1754 include diagnosis, prevention and treatment of diseases and clinical conditions associated with CGI-01. DKFZP434D1335 (Accession XM_036578) is another VGAM1754 host target gene. DKFZP434D1335 BINDING SITE is HOST TARGET binding site found in the 3' untranslated region of mRNA encoded by DKFZP434D1335, corresponding to a HOST TARGET binding site such as BINDING SITE I, BINDING SITE II or BINDING SITE III. Table 2 illustrates the complementarity of the nucleotide sequences of DKFZP434D1335 BINDING SITE, designated SEQ ID:32467, to the nucleotide sequence of VGAM1754 RNA, herein designated VGAM RNA, also designated SEQ ID:4465.

Another function of VGAM1754 is therefore inhibition of DKFZP434D1335 (Accession XM_036578). Accordingly, utilities of VGAM1754 include diagnosis, prevention and treatment of diseases and clinical conditions associated with DKFZP434D1335. FLJ10498 (Accession NM_018115) is another VGAM1754 host target gene. FLJ10498 BINDING SITE is HOST TARGET binding site found in the 3' untranslated region of mRNA encoded by FLJ10498, corresponding to a HOST TARGET binding site such as BINDING SITE I, BINDING SITE II or BINDING SITE III. Table 2 illustrates the complementarity of the nucleotide sequences of FLJ10498 BINDING SITE, designated SEQ ID:19887, to the nucleotide sequence of VGAM1754 RNA, herein designated VGAM RNA, also designated SEQ ID:4465.

Another function of VGAM1754 is therefore inhibition of FLJ10498 (Accession NM_018115). Accordingly, utilities of VGAM1754 include diagnosis, prevention and treatment of diseases and clinical conditions associated with FLJ10498. FLJ10901 (Accession NM_018265) is another VGAM1754 host target gene. FLJ10901 BINDING SITE is HOST TARGET binding site found in the 3' untranslated region of mRNA encoded by FLJ10901, corresponding to a HOST TARGET binding site such as BINDING SITE I, BINDING SITE II or BINDING SITE III. Table 2 illustrates the complementarity of the nucleotide sequences of FLJ10901 BINDING SITE, designated SEQ ID:20231, to the nucleotide sequence of VGAM1754 RNA, herein designated VGAM RNA, also designated SEQ ID:4465.

Another function of VGAM1754 is therefore inhibition of FLJ10901 (Accession NM_018265). Accordingly, utilities of VGAM1754 include diagnosis, prevention and treatment of diseases and clinical conditions associated with FLJ10901. FLJ14547 (Accession NM_032804) is another VGAM1754 host target gene. FLJ14547 BINDING SITE is HOST TARGET binding site found in the 3' untranslated region of mRNA encoded by FLJ14547, corresponding to a HOST TARGET binding site such as BINDING SITE I, BINDING SITE II or BINDING SITE III. Table 2 illustrates the complementarity of the nucleotide sequences of FLJ14547 BINDING SITE, designated SEQ ID:26561, to the nucleotide sequence of VGAM1754 RNA, herein designated VGAM RNA, also designated SEQ ID:4465.

Another function of VGAM1754 is therefore inhibition of FLJ14547 (Accession NM_032804). Accordingly, utilities of VGAM1754 include diagnosis, prevention and treatment of diseases and clinical conditions associated with FLJ14547. FLJ22693 (Accession NM_022750) is another VGAM1754 host target gene. FLJ22693 BINDING SITE is HOST TARGET binding site found in the 3' untranslated region of mRNA encoded by FLJ22693, corresponding to a HOST TARGET binding site such as BINDING SITE I, BINDING SITE II or BINDING SITE III. Table 2 illustrates the complementarity of the nucleotide sequences of FLJ22693 BINDING SITE, designated SEQ ID:22973, to the nucleotide sequence of VGAM1754 RNA, herein designated VGAM RNA, also designated SEQ ID:4465.

Another function of VGAM1754 is therefore inhibition of FLJ22693 (Accession NM_022750). Accordingly, utilities of VGAM1754 include diagnosis, prevention and treatment of diseases and clinical conditions associated with FLJ22693. HBP1 (Accession NM_012257) is another VGAM1754 host target gene. HBP1 BINDING SITE is HOST TARGET binding site found in the 3' untranslated region of mRNA encoded by HBP1, corresponding to a HOST TARGET binding site such as BINDING SITE I, BINDING SITE II or BINDING SITE III. Table 2 illustrates the complementarity of the nucleotide sequences of HBP1 BINDING SITE, designated SEQ ID:14562, to the nucleotide sequence of VGAM1754 RNA, herein designated VGAM RNA, also designated SEQ ID:4465.

Another function of VGAM1754 is therefore inhibition of HBP1 (Accession NM_012257). Accordingly, utilities of VGAM1754 include diagnosis, prevention and treatment of diseases and clinical conditions associated with HBP1. HCA3 (Accession NM_138703) is another VGAM1754 host target gene. HCA3 BINDING SITE is HOST TARGET binding site found in the 5' untranslated region of mRNA encoded by HCA3, corresponding to a HOST TARGET binding site such as BINDING SITE I, BINDING SITE II or BINDING SITE III. Table 2 illustrates the complementarity of the nucleotide sequences of HCA3 BINDING SITE, designated SEQ ID:28952, to the nucleotide sequence of VGAM1754 RNA, herein designated VGAM RNA, also designated SEQ ID:4465.

Another function of VGAM1754 is therefore inhibition of HCA3 (Accession NM_138703). Accordingly, utilities of VGAM1754 include diagnosis, prevention and treatment of diseases and clinical conditions associated with HCA3. HCNGP (Accession NM_013260) is another VGAM1754 host target gene. HCNGP BINDING SITE is HOST TARGET binding site found in the 3' untranslated region of mRNA encoded by HCNGP, corresponding to a HOST TARGET binding site such as BINDING SITE I, BINDING SITE II or BINDING SITE III. Table 2 illustrates the complementarity of the nucleotide sequences of HCNGP BINDING SITE, designated SEQ ID:14930, to the nucleotide sequence of VGAM1754 RNA, herein designated VGAM RNA, also designated SEQ ID:4465.

Another function of VGAM1754 is therefore inhibition of HCNGP (Accession NM_013260). Accordingly, utilities of VGAM1754 include diagnosis, prevention and treatment of diseases and clinical conditions associated with HCNGP. MGC15429 (Accession NM_032750) is another VGAM1754 host target gene. MGC15429 BINDING SITE is HOST TARGET binding site found in the 3' untranslated region of mRNA encoded by MGC15429, corresponding to a HOST TARGET binding site such as BINDING SITE I, BINDING SITE II or BINDING SITE III. Table 2 illustrates the complementarity of the nucleotide sequences of MGC15429 BINDING SITE, designated SEQ ID:26485, to the nucleotide sequence of VGAM1754 RNA, herein designated VGAM RNA, also designated SEQ ID:4465.

Another function of VGAM1754 is therefore inhibition of MGC15429 (Accession NM_032750). Accordingly, utilities of VGAM1754 include diagnosis, prevention and treatment of diseases and clinical conditions associated with MGC15429. Nudix (nucleoside diphosphate linked moiety X)-type Motif 11 (NUDT11, Accession XM_010230) is another VGAM1754 host target gene. NUDT11 BINDING SITE is HOST TARGET binding site found in the 3' untranslated region of mRNA encoded by NUDT11, corresponding to a HOST TARGET binding site such as BINDING SITE I, BINDING SITE II or BINDING SITE III. Table 2 illustrates the complementarity of the nucleotide sequences of NUDT11 BINDING SITE, designated SEQ ID:30138, to the nucleotide sequence of VGAM1754 RNA, herein designated VGAM RNA, also designated SEQ ID:4465.

Another function of VGAM1754 is therefore inhibition of Nudix (nucleoside diphosphate linked moiety X)-type Motif 11 (NUDT11, Accession XM_010230). Accordingly, utilities of VGAM1754 include diagnosis, prevention and treatment of diseases and clinical conditions associated with NUDT11. P5-1 (Accession NM_006674) is another VGAM1754 host target gene. P5-1 BINDING SITE is HOST TARGET binding site found in the 3' untranslated region of mRNA encoded by P5-1, corresponding to a HOST TARGET binding site such as BINDING SITE I, BINDING SITE II or BINDING SITE III. Table 2 illustrates the complementarity of the nucleotide sequences of P5-1 BINDING SITE, designated SEQ ID:13493, to the nucleotide sequence of VGAM1754 RNA, herein designated VGAM RNA, also designated SEQ ID:4465.

Another function of VGAM1754 is therefore inhibition of P5-1 (Accession NM_006674). Accordingly, utilities of VGAM1754 include diagnosis, prevention and treatment of diseases and clinical conditions associated with P5-1. Parvin, Alpha (PARVA, Accession NM_018222) is another VGAM1754 host target gene. PARVA BINDING SITE is HOST TARGET binding site found in the 3' untranslated region of mRNA encoded by PARVA, corresponding to a HOST TARGET binding site such as BINDING SITE I, BINDING SITE II or BINDING SITE III. Table 2 illustrates the complementarity of the nucleotide sequences of PARVA BINDING SITE, designated SEQ ID:20144, to the nucleotide sequence of VGAM1754 RNA, herein designated VGAM RNA, also designated SEQ ID:4465.

Another function of VGAM1754 is therefore inhibition of Parvin, Alpha (PARVA, Accession NM_018222). Accordingly, utilities of VGAM1754 include diagnosis, prevention and treatment of diseases and clinical conditions associated with PARVA. Protein Phosphatase 1, Regulatory (inhibitor) Subunit 16B (PPP1R16B, Accession XM_028840) is another VGAM1754 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30768, to the nucleotide sequence of VGAM1754 RNA, herein designated VGAM RNA, also designated SEQ ID:4465.

Another function of VGAM1754 is therefore inhibition of Protein Phosphatase 1, Regulatory (inhibitor) Subunit 16B (PPP1R16B, Accession XM_028840). Accordingly, utilities of VGAM1754 include diagnosis, prevention and treatment of diseases and clinical conditions associated with PPP1R16B. PRO0245 (Accession NM_014122) is another VGAM1754 host target gene. PRO0245 BINDING SITE is HOST TARGET binding site found in the 5' untranslated region of mRNA encoded by PRO0245, corresponding to a HOST TARGET binding site such as BINDING SITE I, BINDING SITE II or BINDING SITE III. Table 2 illustrates the complementarity of the nucleotide sequences of PRO0245 BINDING SITE, designated SEQ ID:15377, to the nucleotide sequence of VGAM1754 RNA, herein designated VGAM RNA, also designated SEQ ID:4465.

Another function of VGAM1754 is therefore inhibition of PRO0245 (Accession NM_014122). Accordingly, utilities of VGAM1754 include diagnosis, prevention and treatment of diseases and clinical conditions associated with PRO0245. LOC139174 (Accession XM_066525) is another VGAM1754 host target gene. LOC139174 BINDING SITE is HOST TARGET binding site found in the 5' untranslated region of mRNA encoded by LOC139174, corresponding to a HOST TARGET binding site such as BINDING SITE I, BINDING SITE II or BINDING SITE III. Table 2 illustrates the complementarity of the nucleotide sequences of LOC139174 BINDING SITE, designated SEQ ID:37328, to the nucleotide sequence of VGAM1754 RNA, herein designated VGAM RNA, also designated SEQ ID:4465.

Another function of VGAM1754 is therefore inhibition of LOC139174 (Accession XM_066525). Accordingly, utilities of VGAM1754 include diagnosis, prevention and treatment of diseases and clinical conditions associated with LOC139174. LOC148738 (Accession NM_145277) is another VGAM1754 host target gene. LOC148738 BINDING SITE is HOST TARGET binding site found in the 3' untranslated region of mRNA encoded by LOC148738, corresponding to a HOST TARGET binding site such as BINDING SITE I, BINDING SITE II or BINDING SITE III. Table 2 illustrates the complementarity of the nucleotide sequences of LOC148738 BINDING SITE, designated SEQ ID:29789, to the nucleotide sequence of VGAM1754 RNA, herein designated VGAM RNA, also designated SEQ ID:4465.

Another function of VGAM1754 is therefore inhibition of LOC148738 (Accession NM_145277). Accordingly, utilities of VGAM1754 include diagnosis, prevention and treatment of diseases and clinical conditions associated with LOC148738. LOC152059 (Accession XM_087372) is another VGAM1754 host target gene. LOC152059 BINDING SITE is HOST TARGET binding site found in the 3' untranslated region of mRNA encoded by LOC152059, corresponding to a HOST TARGET binding site such as BINDING SITE I, BINDING SITE II or BINDING SITE III. Table 2 illustrates the complementarity of the nucleotide sequences of LOC152059 BINDING SITE, designated SEQ ID:39205, to the nucleotide sequence of VGAM1754 RNA, herein designated VGAM RNA, also designated SEQ ID:4465.

Another function of VGAM1754 is therefore inhibition of LOC152059 (Accession XM_087372). Accordingly, utilities of VGAM1754 include diagnosis, prevention and treatment of diseases and clinical conditions associated with LOC152059. LOC154881 (Accession XM_088063) is another VGAM1754 host target gene. LOC154881 BINDING SITE is HOST TARGET binding site found in the 3' untranslated region of mRNA encoded by LOC154881, corresponding to a HOST TARGET binding site such as BINDING SITE I, BINDING SITE II or BINDING SITE III. Table 2 illustrates the complementarity of the nucleotide sequences of LOC154881 BINDING SITE, designated SEQ ID:39500, to the nucleotide sequence of VGAM1754 RNA, herein designated VGAM RNA, also designated SEQ ID:4465.

Another function of VGAM1754 is therefore inhibition of LOC154881 (Accession XM_088063). Accordingly, utilities of VGAM1754 include diagnosis, prevention and treatment of diseases and clinical conditions associated with LOC154881. LOC196759 (Accession XM_113601) is another VGAM1754 host target gene. LOC196759 BINDING SITE is HOST TARGET binding site found in the 3' untranslated region of mRNA encoded by LOC196759, corresponding to a HOST TARGET binding site such as BINDING SITE I, BINDING SITE II or BINDING SITE III. Table 2 illustrates the complementarity of the nucleotide sequences of LOC196759 BINDING SITE, designated SEQ ID:42291, to the nucleotide sequence of VGAM1754 RNA, herein designated VGAM RNA, also designated SEQ ID:4465.

Another function of VGAM1754 is therefore inhibition of LOC196759 (Accession XM_113601). Accordingly, utilities of VGAM1754 include diagnosis, prevention and treatment of diseases and clinical conditions associated with LOC196759. LOC220486 (Accession XM_165391) is another VGAM1754 host target gene. LOC220486 BINDING SITE is HOST TARGET binding site found in the 5' untranslated region of mRNA encoded by LOC220486, corresponding to a HOST TARGET binding site such as BINDING SITE I, BINDING SITE II or BINDING SITE III. Table 2 illustrates the complementarity of the nucleotide sequences of LOC220486 BINDING SITE, designated SEQ ID:43616, to the nucleotide sequence of VGAM1754 RNA, herein designated VGAM RNA, also designated SEQ ID:4465.

Another function of VGAM1754 is therefore inhibition of LOC220486 (Accession XM_165391). Accordingly, utilities of VGAM1754 include diagnosis, prevention and treatment of diseases and clinical conditions associated with LOC220486. LOC257273 (Accession XM_170970) is another VGAM1754 host target gene. LOC257273 BINDING SITE is HOST TARGET binding site found in the 5' untranslated region of mRNA encoded by LOC257273, corresponding to a HOST TARGET binding site such as BINDING SITE I, BINDING SITE II or BINDING SITE III. Table 2 illustrates the complementarity of the nucleotide sequences of LOC257273 BINDING SITE, designated SEQ ID:45745, to the nucleotide sequence of VGAM1754 RNA, herein designated VGAM RNA, also designated SEQ ID:4465.

Another function of VGAM1754 is therefore inhibition of LOC257273 (Accession XM_170970). Accordingly, utilities of VGAM1754 include diagnosis, prevention and treatment of diseases and clinical conditions associated with LOC257273. LOC92573 (Accession XM_045884) is another VGAM1754 host target gene. LOC92573 BINDING SITE is HOST TARGET binding site found in the 5' untranslated region of mRNA encoded by LOC92573, corresponding to a HOST TARGET binding site such as BINDING SITE I, BINDING SITE II or BINDING SITE III. Table 2 illustrates the complementarity of the nucleotide sequences of LOC92573 BINDING SITE, designated SEQ ID:34592, to the nucleotide sequence of VGAM1754 RNA, herein designated VGAM RNA, also designated SEQ ID:4465.

Another function of VGAM1754 is therefore inhibition of LOC92573 (Accession XM_045884). Accordingly, utilities of VGAM1754 include diagnosis, prevention and treatment of diseases and clinical conditions associated with LOC92573. LOC96597 (Accession XM_039922) is another VGAM1754 host target gene. LOC96597 BINDING SITE is HOST TARGET binding site found in the 3' untranslated region of mRNA encoded by LOC96597, corresponding to a HOST TARGET binding site such as BINDING SITE I, BINDING SITE II or BINDING SITE III. Table 2 illustrates the complementarity of the nucleotide sequences of LOC96597 BINDING SITE, designated SEQ ID:33227, to the nucleotide sequence of VGAM1754 RNA, herein designated VGAM RNA, also designated SEQ ID:4465.

Another function of VGAM1754 is therefore inhibition of LOC96597 (Accession XM_039922). Accordingly, utilities of VGAM1754 include diagnosis, prevention and treatment of diseases and clinical conditions associated with LOC96597. FIG. 1 further provides a conceptual description of a novel bioinformatically detected viral gene of the present invention, referred to here as Viral Genomic Address Messenger 1755 (VGAM1755) viral gene, which modulates expression of respective host target genes thereof, the function and utility of which host target genes is known in the art.

VGAM1755 is a novel bioinformatically detected regulatory, non protein coding, viral micro RNA (miRNA) gene. The method by which VGAM1755 was detected is described hereinabove with reference to FIGS. 1-8.

VGAM1755 gene, herein designated VGAM GENE, is a viral gene contained in the genome of Camelpox Virus.

VGAM1755 host target gene, herein designated VGAM HOST TARGET GENE, is a human gene contained in the human genome.

VGAM1755 gene encodes a VGAM1755 precursor RNA, herein designated VGAM PRECURSOR RNA. Similar to other miRNA genes, and unlike most ordinary genes, VGAM1755 precursor RNA does not encode a protein. A nucleotide sequence identical or highly similar to the nucleotide sequence of VGAM1755 precursor RNA is designated SEQ ID:1741, and is provided hereinbelow with reference to the sequence listing part. Nucleotide sequence SEQ ID:1741 is located at position 5746 relative to the genome of Camelpox Virus.

VGAM1755 precursor RNA folds onto itself, forming VGAM1755 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1755 folded precursor RNA into VGAM1755 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1755 RNA is designated SEQ ID:4466, and is provided hereinbelow with reference to the sequence listing part.

VGAM1755 host target gene, herein designated VGAM HOST TARGET GENE, encodes a corresponding messenger RNA, VGAM1755 host target RNA, herein designated VGAM HOST TARGET RNA. VGAM1755 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1755 RNA, herein designated VGAM RNA, binds complementarily to one or more host target binding sites located in untranslated regions of VGAM1755 host target RNA, herein designated VGAM HOST TARGET RNA. This complementary binding is due to the fact that the nucleotide sequence of VGAM1755 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1755 RNA, herein designated VGAM RNA, may have a different number of host target binding sites in untranslated regions of a VGAM1755 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1755 RNA, herein designated VGAM RNA, to host target binding sites on VGAM1755 host target RNA, herein designated VGAM HOST TARGET RNA, such as BINDING SITE I, BINDING SITE II and BINDING SITE III, inhibits translation of VGAM1755 host target RNA into VGAM1755 host target protein, herein designated VGAM HOST TARGET PROTEIN. VGAM host target protein is therefore outlined by a broken line.

It is appreciated that VGAM1755 host target gene, herein designated VGAM HOST TARGET GENE, in fact represents a plurality of VGAM1755 host target genes. The mRNA of each one of this plurality of VGAM1755 host target genes comprises one or more host target binding sites, each having a nucleotide sequence which is at least partly complementary to VGAM1755 RNA, herein designated VGAM RNA, and which when bound by VGAM1755 RNA causes inhibition of translation of respective one or more VGAM1755 host target proteins.

It is further appreciated by one skilled in the art that the mode of translational inhibition illustrated by FIG. 1 with specific reference to translational inhibition exerted by VGAM1755 gene, herein designated VGAM GENE, on one or more VGAM1755 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1755 is inhibition of expression of host target genes, as part of a novel viral mechanism of attacking a host. Accordingly, utilities of VGAM1755 include diagnosis, prevention and treatment of viral infection by Camelpox Virus. Specific functions, and accordingly utilities, of VGAM1755 correlate with, and may be deduced from, the identity of the host target genes which VGAM1755 binds and inhibits, and the function of these host target genes, as elaborated hereinbelow.

Nucleotide sequences of the VGAM1755 precursor RNA, herein designated VGAM PRECURSOR RNA, and of the 'diced' VGAM1755 RNA, herein designated VGAM RNA, and a schematic representation of the secondary folding of VGAM1755 folded precursor RNA, herein designated VGAM FOLDED PRECURSOR RNA, of VGAM1755 are further described hereinbelow with reference to Table 1.

Nucleotide sequences of host target binding sites, such as BINDING SITE-I, BINDING SITE-II and BINDING SITE-III of FIG. 1, found on VGAM1755 host target RNA, and schematic representation of the complementarity of each of these host target binding sites to VGAM1755 RNA, herein designated VGAM RNA, are described hereinbelow with reference to Table 2.

As mentioned hereinabove with reference to FIG. 1, a function of VGAM1755 gene, herein designated VGAM is inhibition of expression of VGAM1755 target genes. It is appreciated that specific functions, and accordingly utilities, of VGAM1755 correlate with, and may be deduced from, the identity of the target genes which VGAM1755 binds and inhibits, and the function of these target genes, as elaborated hereinbelow.

Monoamine Oxidase B (MAOB, Accession XM_010261) is a VGAM1755 host target gene. MAOB BINDING SITE is HOST TARGET binding site found in the 3' untranslated region of mRNA encoded by MAOB, corresponding to a HOST TARGET binding site such as BINDING SITE I, BINDING SITE II or BINDING SITE III. Table 2 illustrates the complementarity of the nucleotide sequences of MAOB BINDING SITE, designated SEQ ID:30147, to the nucleotide sequence of VGAM1755 RNA, herein designated VGAM RNA, also designated SEQ ID:4466.

A function of VGAM1755 is therefore inhibition of Monoamine Oxidase B (MAOB, Accession XM_010261). Accordingly, utilities of VGAM1755 include diagnosis, prevention and treatment of diseases and clinical conditions associated with MAOB. FIG. 1 further provides a conceptual description of a novel bioinformatically detected viral gene of the present invention, referred to here as Viral Genomic Address Messenger 1756 (VGAM1756) viral gene, which modulates expression of respective host target genes thereof, the function and utility of which host target genes is known in the art.

VGAM1756 is a novel bioinformatically detected regulatory, non protein coding, viral micro RNA (miRNA) gene. The method by which VGAM1756 was detected is described hereinabove with reference to FIGS. 1-8.

VGAM1756 gene, herein designated VGAM GENE, is a viral gene contained in the genome of Camelpox Virus. VGAM1756 host target gene, herein designated VGAM HOST TARGET GENE, is a human gene contained in the human genome.

VGAM1756 gene encodes a VGAM1756 precursor RNA, herein designated VGAM PRECURSOR RNA. Similar to other miRNA genes, and unlike most ordinary genes, VGAM1756 precursor RNA does not encode a protein. A nucleotide sequence identical or highly similar to the nucleotide sequence of VGAM1756 precursor RNA is designated SEQ ID:1742, and is provided hereinbelow with reference to the sequence listing part. Nucleotide sequence SEQ ID:1742 is located at position 7373 relative to the genome of Camelpox Virus.

VGAM1756 precursor RNA folds onto itself, forming VGAM1756 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1756 folded precursor RNA into VGAM1756 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1756 RNA is designated SEQ ID:4467, and is provided hereinbelow with reference to the sequence listing part.

VGAM1756 host target gene, herein designated VGAM HOST TARGET GENE, encodes a corresponding messenger RNA, VGAM1756 host target RNA, herein designated VGAM HOST TARGET RNA. VGAM1756 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1756 RNA, herein designated VGAM RNA, binds complementarily to one or more host target binding sites located in untranslated regions of VGAM1756 host target RNA, herein designated VGAM HOST TARGET RNA. This complementary binding is due to the fact that the nucleotide sequence of VGAM1756 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1756 RNA, herein designated VGAM RNA, may have a different number of host target binding sites in untranslated regions of a VGAM1756 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1756 RNA, herein designated VGAM RNA, to host target binding sites on VGAM1756 host target RNA, herein designated VGAM HOST TARGET RNA, such as BINDING SITE I, BINDING SITE II and BINDING SITE III, inhibits translation of VGAM1756 host target RNA into VGAM1756 host target protein, herein designated VGAM HOST TARGET PROTEIN. VGAM host target protein is therefore outlined by a broken line.

It is appreciated that VGAM1756 host target gene, herein designated VGAM HOST TARGET GENE, in fact represents a plurality of VGAM1756 host target genes. The mRNA of each one of this plurality of VGAM1756 host target genes comprises one or more host target binding sites, each having a nucleotide sequence which is at least partly complementary to VGAM1756 RNA, herein designated VGAM RNA, and which when bound by VGAM1756 RNA causes inhibition of translation of respective one or more VGAM1756 host target proteins.

It is further appreciated by one skilled in the art that the mode of translational inhibition illustrated by FIG. 1 with specific reference to translational inhibition exerted by VGAM1756 gene, herein designated VGAM GENE, on one or more VGAM1756 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1756 is inhibition of expression of host target genes, as part of a novel viral mechanism of attacking a host. Accordingly, utilities of VGAM1756 include diagnosis, prevention and treatment of viral infection by Camelpox Virus. Specific functions, and accordingly utilities, of VGAM1756 correlate with, and may be deduced from, the identity of the host target genes which VGAM1756 binds and inhibits, and the function of these host target genes, as elaborated hereinbelow.

Nucleotide sequences of the VGAM1756 precursor RNA, herein designated VGAM PRECURSOR RNA, and of the 'diced' VGAM1756 RNA, herein designated VGAM RNA, and a schematic representation of the secondary folding of VGAM1756 folded precursor RNA, herein designated VGAM FOLDED PRECURSOR RNA, of VGAM1756 are further described hereinbelow with reference to Table 1.

Nucleotide sequences of host target binding sites, such as BINDING SITE-I, BINDING SITE-II and BINDING SITE-III of FIG. 1, found on VGAM1756 host target RNA, and schematic representation of the complementarity of each of these host target binding sites to VGAM1756 RNA, herein designated VGAM RNA, are described hereinbelow with reference to Table 2.

As mentioned hereinabove with reference to FIG. 1, a function of VGAM1756 gene, herein designated VGAM is inhibition of expression of VGAM1756 target genes. It is appreciated that specific functions, and accordingly utilities, of VGAM1756 correlate with, and may be deduced from, the identity of the target genes which VGAM1756 binds and inhibits, and the function of these target genes, as elaborated hereinbelow.

NESG1 (Accession NM_012337) is a VGAM1756 host target gene. NESG1 BINDING SITE is HOST TARGET binding site found in the 5' untranslated region of mRNA encoded by NESG1, corresponding to a HOST TARGET binding site such as BINDING SITE I, BINDING SITE II or BINDING SITE III. Table 2 illustrates the complementarity of the nucleotide sequences of NESG1 BINDING SITE, designated SEQ ID:14733, to the nucleotide sequence of VGAM1756 RNA, herein designated VGAM RNA, also designated SEQ ID:4467.

A function of VGAM1756 is therefore inhibition of NESG1 (Accession NM_012337). Accordingly, utilities of VGAM1756 include diagnosis, prevention and treatment of diseases and clinical conditions associated with NESG1. LOC148638 (Accession XM_086259) is another VGAM1756 host target gene. LOC148638 BINDING SITE is HOST TARGET binding site found in the 5' untranslated region of mRNA encoded by LOC148638, corresponding to a HOST TARGET binding site such as BINDING SITE I, BINDING SITE II or BINDING SITE III. Table 2 illustrates the complementarity of the nucleotide sequences of LOC148638 BINDING SITE, designated SEQ ID:38569, to the nucleotide sequence of VGAM1756 RNA, herein designated VGAM RNA, also designated SEQ ID:4467.

Another function of VGAM1756 is therefore inhibition of LOC148638 (Accession XM_086259). Accordingly, utilities of VGAM1756 include diagnosis, prevention and treatment of diseases and clinical conditions associated with LOC148638. LOC152359 (Accession XM_098213) is another VGAM1756 host target gene. LOC152359 BINDING SITE is HOST TARGET binding site found in the 3' untranslated region of mRNA encoded by LOC152359, corresponding to a HOST TARGET binding site such as BINDING SITE I, BINDING SITE II or BINDING SITE III. Table 2 illustrates the complementarity of the nucleotide sequences of LOC152359 BINDING SITE, designated SEQ ID:41492, to the nucleotide sequence of VGAM1756 RNA, herein designated VGAM RNA, also designated SEQ ID:4467.

Another function of VGAM1756 is therefore inhibition of LOC152359 (Accession XM_098213). Accordingly, utilities of VGAM1756 include diagnosis, prevention and treatment of diseases and clinical conditions associated with LOC152359. FIG. 1 further provides a conceptual description of a novel bioinformatically detected viral gene of the present invention, referred to here as Viral Genomic Address Messenger 1757 (VGAM1757) viral gene, which modulates expression of respective host target genes thereof, the function and utility of which host target genes is known in the art.

VGAM1757 is a novel bioinformatically detected regulatory, non protein coding, viral micro RNA (miRNA) gene. The method by which VGAM1757 was detected is described hereinabove with reference to FIGS. 1-8.

VGAM1757 gene, herein designated VGAM GENE, is a viral gene contained in the genome of Camelpox Virus. VGAM1757 host target gene, herein designated VGAM HOST TARGET GENE, is a human gene contained in the human genome.

VGAM1757 gene encodes a VGAM1757 precursor RNA, herein designated VGAM PRECURSOR RNA. Similar to other miRNA genes, and unlike most ordinary genes, VGAM1757 precursor RNA does not encode a protein. A nucleotide sequence identical or highly similar to the nucleotide sequence of VGAM1757 precursor RNA is designated SEQ ID:1743, and is provided hereinbelow with reference to the sequence listing part. Nucleotide sequence SEQ ID:1743 is located at position 5203 relative to the genome of Camelpox Virus.

VGAM1757 precursor RNA folds onto itself, forming VGAM1757 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1757 folded precursor RNA into VGAM1757 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1757 RNA is designated SEQ ID:4468, and is provided hereinbelow with reference to the sequence listing part.

VGAM1757 host target gene, herein designated VGAM HOST TARGET GENE, encodes a corresponding messenger RNA, VGAM1757 host target RNA, herein designated VGAM HOST TARGET RNA. VGAM1757 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1757 RNA, herein designated VGAM RNA, binds complementarily to one or more host target binding sites located in untranslated regions of VGAM1757 host target RNA, herein designated VGAM HOST TARGET RNA. This complementary binding is due to the fact that the nucleotide sequence of VGAM1757 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1757 RNA, herein designated VGAM RNA, may have a different number of host target binding sites in untranslated regions of a VGAM1757 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1757 RNA, herein designated VGAM RNA, to host target binding sites on VGAM1757 host target RNA, herein designated VGAM HOST TARGET RNA, such as BINDING SITE I, BINDING SITE II and BINDING SITE III, inhibits translation of VGAM1757 host target RNA into VGAM1757 host target protein, herein designated VGAM HOST TARGET PROTEIN. VGAM host target protein is therefore outlined by a broken line.

It is appreciated that VGAM1757 host target gene, herein designated VGAM HOST TARGET GENE, in fact represents a plurality of VGAM1757 host target genes. The mRNA of each one of this plurality of VGAM1757 host target genes comprises one or more host target binding sites, each having a nucleotide sequence which is at least partly complementary to VGAM1757 RNA, herein designated VGAM RNA, and which when bound by VGAM1757 RNA causes inhibition of translation of respective one or more VGAM1757 host target proteins.

It is further appreciated by one skilled in the art that the mode of translational inhibition illustrated by FIG. 1 with specific reference to translational inhibition exerted by VGAM1757 gene, herein designated VGAM GENE, on one or more VGAM1757 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1757 is inhibition of expression of host target genes, as part of a novel viral mechanism of attacking a host. Accordingly, utilities of VGAM1757 include diagnosis, prevention and treatment of viral infection by Camelpox Virus. Specific functions, and accordingly utilities, of VGAM1757 correlate with, and may be deduced from, the identity of the host target genes which VGAM1757 binds and inhibits, and the function of these host target genes, as elaborated hereinbelow.

Nucleotide sequences of the VGAM1757 precursor RNA, herein designated VGAM PRECURSOR RNA, and of the 'diced' VGAM1757 RNA, herein designated VGAM RNA, and a schematic representation of the secondary folding of VGAM1757 folded precursor RNA, herein designated VGAM FOLDED PRECURSOR RNA, of VGAM1757 are further described hereinbelow with reference to Table 1.

Nucleotide sequences of host target binding sites, such as BINDING SITE-I, BINDING SITE-II and BINDING SITE-III of FIG. 1, found on VGAM1757 host target RNA, and schematic representation of the complementarity of each of these host target binding sites to VGAM1757 RNA, herein designated VGAM RNA, are described hereinbelow with reference to Table 2.

As mentioned hereinabove with reference to FIG. 1, a function of VGAM1757 gene, herein designated VGAM is inhibition of expression of VGAM1757 target genes. It is appreciated that specific functions, and accordingly utilities, of VGAM1757 correlate with, and may be deduced from, the identity of the target genes which VGAM1757 binds and inhibits, and the function of these target genes, as elaborated hereinbelow.

Meis1, Myeloid Ecotropic Viral Integration Site 1 Homolog 2 (mouse) (MEIS2, Accession NM_020149) is a VGAM1757 host target gene. MEIS2 BINDING SITE is HOST TARGET binding site found in the 3' untranslated region of mRNA encoded by MEIS2, corresponding to a HOST TARGET binding site such as BINDING SITE I, BINDING SITE II or BINDING SITE III. Table 2 illustrates the complementarity of the nucleotide sequences of MEIS2 BINDING SITE, designated SEQ ID:21344, to the nucleotide sequence of VGAM1757 RNA, herein designated VGAM RNA, also designated SEQ ID:4468.

A function of VGAM1757 is therefore inhibition of Meis1, Myeloid Ecotropic Viral Integration Site 1 Homolog 2 (mouse) (MEIS2, Accession NM_020149), a gene which may regulate gene expression and control cell differentiation. Accordingly, utilities of VGAM1757 include diagnosis, prevention and treatment of diseases and clinical conditions associated with MEIS2. The function of MEIS2 and its association with various diseases and clinical conditions, has been established by previous studies, as described hereinabove with reference to VGAM1244. BS69 (Accession NM_006624) is another VGAM1757 host target gene. BS69 BINDING SITE is HOST TARGET binding site found in the 5' untranslated region of mRNA encoded by BS69, corresponding to a HOST TARGET binding site such as BINDING SITE I, BINDING SITE II or BINDING SITE III. Table 2 illustrates the complementarity of the nucleotide sequences of BS69 BINDING SITE, designated SEQ ID:13405, to the nucleotide sequence of VGAM1757 RNA, herein designated VGAM RNA, also designated SEQ ID:4468.

Another function of VGAM1757 is therefore inhibition of BS69 (Accession NM_006624). Accordingly, utilities of VGAM1757 include diagnosis, prevention and treatment of diseases and clinical conditions associated with BS69. Chromosome X Open Reading Frame 1 (CXorf1, Accession NM_004709) is another VGAM1757 host target gene. CXorf1 BINDING SITE is HOST TARGET binding site found in the 3' untranslated region of mRNA encoded by CXorf1, corresponding to a HOST TARGET binding site such as BINDING SITE I, BINDING SITE II or BINDING SITE III. Table 2 illustrates the complementarity of the nucleotide sequences of CXorf1 BINDING SITE, designated SEQ ID:11053, to the nucleotide sequence of VGAM1757 RNA, herein designated VGAM RNA, also designated SEQ ID:4468.

Another function of VGAM1757 is therefore inhibition of Chromosome X Open Reading Frame 1 (CXorf1, Accession NM_004709). Accordingly, utilities of VGAM1757 include diagnosis, prevention and treatment of diseases and clinical conditions associated with CXorf1. FLJ21791 (Accession XM_028958) is another VGAM1757 host target gene. FLJ21791 BINDING SITE is HOST TARGET binding site found in the 3' untranslated region of mRNA encoded by FLJ21791, corresponding to a HOST TARGET binding site such as BINDING SITE I, BINDING SITE II or BINDING SITE III. Table 2 illustrates the complementarity of the nucleotide sequences of FLJ21791 BINDING SITE, designated SEQ ID:30807, to the nucleotide sequence of VGAM1757 RNA, herein designated VGAM RNA, also designated SEQ ID:4468.

Another function of VGAM1757 is therefore inhibition of FLJ21791 (Accession XM_028958). Accordingly, utilities of VGAM1757 include diagnosis, prevention and treatment of diseases and clinical conditions associated with FLJ21791. LANO (Accession NM_025168) is another VGAM1757 host target gene. LANO BINDING SITE is HOST TARGET binding site found in the 3' untranslated region of mRNA encoded by LANO, corresponding to a HOST TARGET binding site such as BINDING SITE I, BINDING SITE II or BINDING SITE III. Table 2 illustrates the complementarity of the nucleotide sequences of LANO BINDING SITE, designated SEQ ID:24804, to the nucleotide sequence of VGAM1757 RNA, herein designated VGAM RNA, also designated SEQ ID:4468.

Another function of VGAM1757 is therefore inhibition of LANO (Accession NM_025168). Accordingly, utilities of VGAM1757 include diagnosis, prevention and treatment of diseases and clinical conditions associated with LANO. Proteasome (prosome, macropain) Inhibitor Subunit 1 (PI31) (PSMF1, Accession NM_006814) is another VGAM1757 host target gene. PSMF1 BINDING SITE is HOST TARGET binding site found in the 3' untranslated region of mRNA encoded by PSMF1, corresponding to a HOST TARGET binding site such as BINDING SITE I, BINDING SITE II or BINDING SITE III. Table 2 illustrates the complementarity of the nucleotide sequences of PSMF1 BINDING SITE, designated SEQ ID:13686, to the nucleotide sequence of VGAM1757 RNA, herein designated VGAM RNA, also designated SEQ ID:4468.

Another function of VGAM1757 is therefore inhibition of Proteasome (prosome, macropain) Inhibitor Subunit 1 (PI31) (PSMF1, Accession NM_006814). Accordingly, utilities of VGAM1757 include diagnosis, prevention and treatment of diseases and clinical conditions associated with PSMF1. LOC115129 (Accession XM_055292) is another VGAM1757 host target gene. LOC115129 BINDING SITE is HOST TARGET binding site found in the 3' untranslated region of mRNA encoded by LOC115129, corresponding to a HOST TARGET binding site such as BINDING SITE I, BINDING SITE II or BINDING SITE III. Table 2 illustrates the complementarity of the nucleotide sequences of LOC115129 BINDING SITE, designated SEQ ID:36249, to the nucleotide sequence of VGAM1757 RNA, herein designated VGAM RNA, also designated SEQ ID:4468.

Another function of VGAM1757 is therefore inhibition of LOC115129 (Accession XM_055292). Accordingly, utilities of VGAM1757 include diagnosis, prevention and treatment of diseases and clinical conditions associated with LOC115129. FIG. 1 further provides a conceptual description of a novel bioinformatically detected viral gene of the present invention, referred to here as Viral Genomic Address Messenger 1758 (VGAM1758) viral gene, which modulates expression of respective host target genes thereof, the function and utility of which host target genes is known in the art.

VGAM1758 is a novel bioinformatically detected regulatory, non protein coding, viral micro RNA (miRNA) gene. The method by which VGAM1758 was detected is described hereinabove with reference to FIGS. 1-8.

VGAM1758 gene, herein designated VGAM GENE, is a viral gene contained in the genome of Camelpox Virus. VGAM1758 host target gene, herein designated VGAM HOST TARGET GENE, is a human gene contained in the human genome.

VGAM1758 gene encodes a VGAM1758 precursor RNA, herein designated VGAM PRECURSOR RNA. Similar to other miRNA genes, and unlike most ordinary genes, VGAM1758 precursor RNA does not encode a protein. A nucleotide sequence identical or highly similar to the nucleotide sequence of VGAM1758 precursor RNA is designated SEQ ID:1744, and is provided hereinbelow with reference to the sequence listing part. Nucleotide sequence SEQ ID:1744 is located at position 60 relative to the genome of Camelpox Virus.

VGAM1758 precursor RNA folds onto itself, forming VGAM1758 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1758 folded precursor RNA into VGAM1758 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 41%) nucleotide sequence of VGAM1758 RNA is designated SEQ ID:4469, and is provided hereinbelow with reference to the sequence listing part.

VGAM1758 host target gene, herein designated VGAM HOST TARGET GENE, encodes a corresponding messenger RNA, VGAM1758 host target RNA, herein designated VGAM HOST TARGET RNA. VGAM1758 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1758 RNA, herein designated VGAM RNA, binds complementarily to one or more host target binding sites located in untranslated regions of VGAM1758 host target RNA, herein designated VGAM HOST TARGET RNA. This complementary binding is due to the fact that the nucleotide sequence of VGAM1758 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1758 RNA, herein designated VGAM RNA, may have a different number of host target binding sites in untranslated regions of a VGAM1758 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1758 RNA, herein designated VGAM RNA, to host target binding sites on VGAM1758 host target RNA, herein designated VGAM HOST TARGET RNA, such as BINDING SITE I, BINDING SITE II and BINDING SITE III, inhibits translation of VGAM1758 host target RNA into VGAM1758 host target protein, herein designated VGAM HOST TARGET PROTEIN. VGAM host target protein is therefore outlined by a broken line.

It is appreciated that VGAM1758 host target gene, herein designated VGAM HOST TARGET GENE, in fact represents a plurality of VGAM1758 host target genes. The mRNA of each one of this plurality of VGAM1758 host target genes comprises one or more host target binding sites, each having a nucleotide sequence which is at least partly complementary to VGAM1758 RNA, herein designated VGAM RNA, and which when bound by VGAM1758 RNA causes inhibition of translation of respective one or more VGAM1758 host target proteins.

It is further appreciated by one skilled in the art that the mode of translational inhibition illustrated by FIG. 1 with specific reference to translational inhibition exerted by VGAM1758 gene, herein designated VGAM GENE, on one or more VGAM1758 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1758 is inhibition of expression of host target genes, as part of a novel viral mechanism of attacking a host. Accordingly, utilities of VGAM1758 include diagnosis, prevention and treatment of viral infection by Camelpox Virus. Specific functions, and accordingly utilities, of VGAM1758 correlate with, and may be deduced from, the identity of the host target genes which VGAM1758 binds and inhibits, and the function of these host target genes, as elaborated hereinbelow.

Nucleotide sequences of the VGAM1758 precursor RNA, herein designated VGAM PRECURSOR RNA, and of the 'diced' VGAM1758 RNA, herein designated VGAM RNA, and a schematic representation of the secondary folding of VGAM1758 folded precursor RNA, herein designated VGAM FOLDED PRECURSOR RNA, of VGAM1758 are further described hereinbelow with reference to Table 1.

Nucleotide sequences of host target binding sites, such as BINDING SITE-I, BINDING SITE-II and BINDING SITE-III of FIG. 1, found on VGAM1758 host target RNA, and schematic representation of the complementarity of each of these host target binding sites to VGAM1758 RNA, herein designated VGAM RNA, are described hereinbelow with reference to Table 2.

As mentioned hereinabove with reference to FIG. 1, a function of VGAM1758 gene, herein designated VGAM is inhibition of expression of VGAM1758 target genes. It is appreciated that specific functions, and accordingly utilities, of VGAM1758 correlate with, and may be deduced from, the identity of the target genes which VGAM1758 binds and inhibits, and the function of these target genes, as elaborated hereinbelow.

LOC152078 (Accession XM_087376) is a VGAM1758 host target gene. LOC152078 BINDING SITE is HOST TARGET binding site found in the 3' untranslated region of mRNA encoded by LOC152078, corresponding to a HOST TARGET binding site such as BINDING SITE I, BINDING SITE II or BINDING SITE III. Table 2 illustrates the complementarity of the nucleotide sequences of LOC152078 BINDING SITE, designated SEQ ID:39213, to the nucleotide sequence of VGAM1758 RNA, herein designated VGAM RNA, also designated SEQ ID:4469.

A function of VGAM1758 is therefore inhibition of LOC152078 (Accession XM_087376). Accordingly, utilities of VGAM1758 include diagnosis, prevention and treatment of diseases and clinical conditions associated with LOC152078. FIG. 1 further provides a conceptual description of a novel bioinformatically detected viral gene of the present invention, referred to here as Viral Genomic Address Messenger 1759 (VGAM1759) viral gene, which modulates expression of respective host target genes thereof, the function and utility of which host target genes is known in the art.

VGAM1759 is a novel bioinformatically detected regulatory, non protein coding, viral micro RNA (miRNA) gene. The method by which VGAM1759 was detected is described hereinabove with reference to FIGS. 1-8.

VGAM1759 gene, herein designated VGAM GENE, is a viral gene contained in the genome of Bovine Viral Diarrhea Virus Genotype 2 (BVDV-2). VGAM1759 host target gene, herein designated VGAM HOST TARGET GENE, is a human gene contained in the human genome.

VGAM1759 gene encodes a VGAM1759 precursor RNA, herein designated VGAM PRECURSOR RNA. Similar to other miRNA genes, and unlike most ordinary genes, VGAM1759 precursor RNA does not encode a protein. A nucleotide sequence identical or highly similar to the nucleotide sequence of VGAM1759 precursor RNA is designated SEQ ID:1745, and is provided hereinbelow with reference to the sequence listing part. Nucleotide sequence SEQ ID:1745 is located at position 12109 relative to the genome of Bovine Viral Diarrhea Virus Genotype 2 (BVDV-2).

VGAM1759 precursor RNA folds onto itself, forming VGAM1759 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1759 folded precursor RNA into VGAM1759 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM1759 RNA is designated SEQ ID:4470, and is provided hereinbelow with reference to the sequence listing part.

VGAM1759 host target gene, herein designated VGAM HOST TARGET GENE, encodes a corresponding messenger RNA, VGAM1759 host target RNA, herein designated VGAM HOST TARGET RNA. VGAM1759 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1759 RNA, herein designated VGAM RNA, binds complementarily to one or more host target binding sites located in untranslated regions of VGAM1759 host target RNA, herein designated VGAM HOST TARGET RNA. This complementary binding is due to the fact that the nucleotide sequence of VGAM1759 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1759 RNA, herein designated VGAM RNA, may have a different number of host target binding sites in untranslated regions of a VGAM1759 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1759 RNA, herein designated VGAM RNA, to host target binding sites on VGAM1759 host target RNA, herein designated VGAM HOST TARGET RNA, such as BINDING SITE I, BINDING SITE II and BINDING SITE III, inhibits translation of VGAM1759 host target RNA into VGAM1759 host target protein, herein designated VGAM HOST TARGET PROTEIN. VGAM host target protein is therefore outlined by a broken line.

It is appreciated that VGAM1759 host target gene, herein designated VGAM HOST TARGET GENE, in fact represents a plurality of VGAM1759 host target genes. The mRNA of each one of this plurality of VGAM1759 host target genes comprises one or more host target binding sites, each having a nucleotide sequence which is at least partly complementary to VGAM1759 RNA, herein designated VGAM RNA, and which when bound by VGAM1759 RNA causes inhibition of translation of respective one or more VGAM1759 host target proteins.

It is further appreciated by one skilled in the art that the mode of translational inhibition illustrated by FIG. 1 with specific reference to translational inhibition exerted by VGAM1759 gene, herein designated VGAM GENE, on one or more VGAM1759 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1759 is inhibition of expression of host target genes, as part of a novel viral mechanism of attacking a host. Accordingly, utilities of VGAM1759 include diagnosis, prevention and treatment of viral infection by Bovine Viral Diarrhea Virus Genotype 2 (BVDV-2). Specific functions, and accordingly utilities, of VGAM1759 correlate with, and may be deduced from, the identity of the host target genes which VGAM1759 binds and inhibits, and the function of these host target genes, as elaborated hereinbelow.

Nucleotide sequences of the VGAM1759 precursor RNA, herein designated VGAM PRECURSOR RNA, and of the 'diced' VGAM1759 RNA, herein designated VGAM RNA, and a schematic representation of the secondary folding of VGAM1759 folded precursor RNA, herein designated VGAM FOLDED PRECURSOR RNA, of VGAM1759 are further described hereinbelow with reference to Table 1.

Nucleotide sequences of host target binding sites, such as BINDING SITE-I, BINDING SITE-II and BINDING SITE-III of FIG. 1, found on VGAM1759 host target RNA, and schematic representation of the complementarity of each of these host target binding sites to VGAM1759 RNA, herein designated VGAM RNA, are described hereinbelow with reference to Table 2.

As mentioned hereinabove with reference to FIG. 1, a function of VGAM1759 gene, herein designated VGAM is inhibition of expression of VGAM1759 target genes. It is appreciated that specific functions, and accordingly utilities, of VGAM1759 correlate with, and may be deduced from, the identity of the target genes which VGAM1759 binds and inhibits, and the function of these target genes, as elaborated hereinbelow.

ADG-90 (Accession NM_033069) is a VGAM1759 host target gene. ADG-90 BINDING SITE is HOST TARGET binding site found in the 3' untranslated region of mRNA encoded by ADG-90, corresponding to a HOST TARGET binding site such as BINDING SITE I, BINDING SITE II or BINDING SITE III. Table 2 illustrates the complementarity of the nucleotide sequences of ADG-90 BINDING SITE, designated SEQ ID:26934, to the nucleotide sequence of VGAM1759 RNA, herein designated VGAM RNA, also designated SEQ ID:4470.

A function of VGAM1759 is therefore inhibition of ADG-90 (Accession NM_033069). Accordingly, utilities of VGAM1759 include diagnosis, prevention and treatment of diseases and clinical conditions associated with ADG-90. NEU4 (Accession NM_080741) is another VGAM1759 host target gene. NEU4 BINDING SITE is HOST TARGET binding site found in the 5' untranslated region of mRNA encoded by NEU4, corresponding to a HOST TARGET binding site such as BINDING SITE I, BINDING SITE II or BINDING SITE III. Table 2 illustrates the complementarity of the nucleotide sequences of NEU4 BINDING SITE, designated SEQ ID:28026, to the nucleotide sequence of VGAM1759 RNA, herein designated VGAM RNA, also designated SEQ ID:4470.

Another function of VGAM1759 is therefore inhibition of NEU4 (Accession NM_080741). Accordingly, utilities of VGAM1759 include diagnosis, prevention and treatment of diseases and clinical conditions associated with NEU4. LOC149535 (Accession XM_086567) is another VGAM1759 host target gene. LOC149535 BINDING SITE is HOST TARGET binding site found in the 5' untranslated region of mRNA encoded by LOC149535, corresponding to a HOST TARGET binding site such as BINDING SITE I, BINDING SITE II or BINDING SITE III. Table 2 illustrates the complementarity of the nucleotide sequences of LOC149535 BINDING SITE, designated SEQ ID:38771, to the nucleotide sequence of VGAM1759 RNA, herein designated VGAM RNA, also designated SEQ ID:4470.

Another function of VGAM1759 is therefore inhibition of LOC149535 (Accession XM_086567). Accordingly, utilities of VGAM1759 include diagnosis, prevention and treatment of diseases and clinical conditions associated with LOC149535. LOC200301 (Accession XM_114197) is another VGAM1759 host target gene. LOC200301 BINDING SITE is HOST TARGET binding site found in the 5' untranslated region of mRNA encoded by LOC200301, corresponding to a HOST TARGET binding site such as BINDING SITE I, BINDING SITE II or BINDING SITE III. Table 2 illustrates the complementarity of the nucleotide sequences of LOC200301 BINDING SITE, designated SEQ ID:42779, to the nucleotide sequence of VGAM1759 RNA, herein designated VGAM RNA, also designated SEQ ID:4470.

Another function of VGAM1759 is therefore inhibition of LOC200301 (Accession XM_114197). Accordingly, utilities of VGAM1759 include diagnosis, prevention and treatment of diseases and clinical conditions associated with LOC200301. FIG. 1 further provides a conceptual description of a novel bioinformatically detected viral gene of the present invention, referred to here as Viral Genomic Address Messenger 1760 (VGAM1760) viral gene, which modulates expression of respective host target genes thereof, the function and utility of which host target genes is known in the art.

VGAM1760 is a novel bioinformatically detected regulatory, non protein coding, viral micro RNA (miRNA) gene. The method by which VGAM1760 was detected is described hereinabove with reference to FIGS. 1-8.

VGAM1760 gene, herein designated VGAM GENE, is a viral gene contained in the genome of Bovine Viral Diarrhea Virus Genotype 2 (BVDV-2). VGAM1760 host target gene, herein designated VGAM HOST TARGET GENE, is a human gene contained in the human genome.

VGAM1760 gene encodes a VGAM1760 precursor RNA, herein designated VGAM PRECURSOR RNA. Similar to other miRNA genes, and unlike most ordinary genes, VGAM1760 precursor RNA does not encode a protein. A nucleotide sequence identical or highly similar to the nucleotide sequence of VGAM1760 precursor RNA is designated SEQ ID:1746, and is provided hereinbelow with reference to the sequence listing part. Nucleotide sequence SEQ ID:1746 is located at position 7567 relative to the genome of Bovine Viral Diarrhea Virus Genotype 2 (BVDV-2).

VGAM1760 precursor RNA folds onto itself, forming VGAM1760 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1760 folded precursor RNA into VGAM1760 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM1760 RNA is designated SEQ ID:4471, and is provided hereinbelow with reference to the sequence listing part.

VGAM1760 host target gene, herein designated VGAM HOST TARGET GENE, encodes a corresponding messenger RNA, VGAM1760 host target RNA, herein designated VGAM HOST TARGET RNA. VGAM1760 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1760 RNA, herein designated VGAM RNA, binds complementarily to one or more host target binding sites located in untranslated regions of VGAM1760 host target RNA, herein designated VGAM HOST TARGET RNA. This complementary binding is due to the fact that the nucleotide sequence of VGAM1760 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1760 RNA, herein designated VGAM RNA, may have a different number of host target binding sites in untranslated regions of a VGAM1760 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1760 RNA, herein designated VGAM RNA, to host target binding sites on VGAM1760 host target RNA, herein designated VGAM HOST TARGET RNA, such as BINDING SITE I, BINDING SITE II and BINDING SITE III, inhibits translation of VGAM1760 host target RNA into VGAM1760 host target protein, herein designated VGAM HOST TARGET PROTEIN. VGAM host target protein is therefore outlined by a broken line.

It is appreciated that VGAM1760 host target gene, herein designated VGAM HOST TARGET GENE, in fact represents a plurality of VGAM1760 host target genes. The mRNA of each one of this plurality of VGAM1760 host target genes comprises one or more host target binding sites, each having a nucleotide sequence which is at least partly complementary to VGAM1760 RNA, herein designated VGAM RNA, and which when bound by VGAM1760 RNA causes inhibition of translation of respective one or more VGAM1760 host target proteins.

It is further appreciated by one skilled in the art that the mode of translational inhibition illustrated by FIG. 1 with specific reference to translational inhibition exerted by VGAM1760 gene, herein designated VGAM GENE, on one or more VGAM1760 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1760 is inhibition of expression of host target genes, as part of a novel viral mechanism of attacking a host. Accordingly, utilities of VGAM1760 include diagnosis, prevention and treatment of viral infection by Bovine Viral Diarrhea Virus Genotype 2 (BVDV-2). Specific functions, and accordingly utilities, of VGAM1760 correlate with, and may be deduced from, the identity of the host target genes which VGAM1760 binds and inhibits, and the function of these host target genes, as elaborated hereinbelow.

Nucleotide sequences of the VGAM1760 precursor RNA, herein designated VGAM PRECURSOR RNA, and of the 'diced' VGAM1760 RNA, herein designated VGAM RNA, and a schematic representation of the secondary folding of VGAM1760 folded precursor RNA, herein designated VGAM FOLDED PRECURSOR RNA, of VGAM1760 are further described hereinbelow with reference to Table 1.

Nucleotide sequences of host target binding sites, such as BINDING SITE-I, BINDING SITE-II and BINDING SITE-III of FIG. 1, found on VGAM1760 host target RNA, and schematic representation of the complementarity of each of these host target binding sites to VGAM1760 RNA, herein designated VGAM RNA, are described hereinbelow with reference to Table 2.

As mentioned hereinabove with reference to FIG. 1, a function of VGAM1760 gene, herein designated VGAM is inhibition of expression of VGAM1760 target genes. It is appreciated that specific functions, and accordingly utilities, of VGAM1760 correlate with, and may be deduced from, the identity of the target genes which VGAM1760 binds and inhibits, and the function of these target genes, as elaborated hereinbelow.

Cartilage Acidic Protein 1 (CRTAC1, Accession NM_018058) is a VGAM1760 host target gene. CRTAC1 BINDING SITE is HOST TARGET binding site found in the 3' untranslated region of mRNA encoded by CRTAC1, corresponding to a HOST TARGET binding site such as BINDING SITE I, BINDING SITE II or BINDING SITE III. Table 2 illustrates the complementarity of the nucleotide sequences of CRTAC1 BINDING SITE, designated SEQ ID:19826, to the nucleotide sequence of VGAM1760 RNA, herein designated VGAM RNA, also designated SEQ ID:4471.

A function of VGAM1760 is therefore inhibition of Cartilage Acidic Protein 1 (CRTAC1, Accession NM_018058). Accordingly, utilities of VGAM1760 include diagnosis, prevention and treatment of diseases and clinical conditions associated with CRTAC1. DKFZP434J193 (Accession XM_048452) is another VGAM1760 host target gene. DKFZP434J193 BINDING SITE is HOST TARGET binding site found in the 3' untranslated region of mRNA encoded by DKFZP434J193, corresponding to a HOST TARGET binding site such as BINDING SITE I, BINDING SITE II or BINDING SITE III. Table 2 illustrates the complementarity of the nucleotide sequences of DKFZP434J193 BINDING SITE, designated SEQ ID:35160, to the nucleotide sequence of VGAM1760 RNA, herein designated VGAM RNA, also designated SEQ ID:4471.

Another function of VGAM1760 is therefore inhibition of DKFZP434J193 (Accession XM_048452). Accordingly, utilities of VGAM1760 include diagnosis, prevention and treatment of diseases and clinical conditions associated with DKFZP434J193. Methylene Tetrahydrofolate Dehydrogenase (NAD+ dependent), Methenyltetrahydrofolate Cyclohydrolase (MTHFD2, Accession NM_006636) is another VGAM1760 host target gene. MTHFD2 BINDING SITE is HOST TARGET binding site found in the 3' untranslated region of mRNA encoded by MTHFD2, corresponding to a HOST TARGET binding site such as BINDING SITE I, BINDING SITE II or BINDING SITE III. Table 2 illustrates the complementarity of the nucleotide sequences of MTHFD2 BINDING SITE, designated SEQ ID:13430, to the nucleotide sequence of VGAM1760 RNA, herein designated VGAM RNA, also designated SEQ ID:4471.

Another function of VGAM1760 is therefore inhibition of Methylene Tetrahydrofolate Dehydrogenase (NAD+ dependent), Methenyltetrahydrofolate Cyclohydrolase (MTHFD2, Accession NM_006636). Accordingly, utilities of VGAM1760 include diagnosis, prevention and treatment of diseases and clinical conditions associated with MTHFD2. SMC1 Structural Maintenance of Chromosomes 1-like 1 (yeast) (SMC1L1, Accession XM_050403) is another VGAM1760 host target gene. SMC1L1 BINDING SITE is HOST TARGET binding site found in the 3' untranslated region of mRNA encoded by SMC1L1, corresponding to a HOST TARGET binding site such as BINDING SITE I, BINDING SITE II or BINDING SITE III. Table 2 illustrates the complementarity of the nucleotide sequences of SMC1L1 BINDING SITE, designated SEQ ID:35616, to the nucleotide sequence of VGAM1760 RNA, herein designated VGAM RNA, also designated SEQ ID:4471.

Another function of VGAM1760 is therefore inhibition of SMC1 Structural Maintenance of Chromosomes 1-like 1 (yeast) (SMC1L1, Accession XM_050403). Accordingly, utilities of VGAM1760 include diagnosis, prevention and treatment of diseases and clinical conditions associated with SMC1L1. LOC145483 (Accession XM_085156) is another VGAM1760 host target gene. LOC145483 BINDING SITE is HOST TARGET binding site found in the 3' untranslated region of mRNA encoded by LOC145483, corresponding to a HOST TARGET binding site such as BINDING SITE I, BINDING SITE II or BINDING SITE III. Table 2 illustrates the complementarity of the nucleotide sequences of LOC145483 BINDING SITE, designated SEQ ID:37881, to the nucleotide sequence of VGAM1760 RNA, herein designated VGAM RNA, also designated SEQ ID:4471.

Another function of VGAM1760 is therefore inhibition of LOC145483 (Accession XM_085156). Accordingly, utilities of VGAM1760 include diagnosis, prevention and treatment of diseases and clinical conditions associated with LOC145483. LOC158476 (Accession XM_098955) is another VGAM1760 host target gene. LOC158476 BINDING SITE is HOST TARGET binding site found in the 5' untranslated region of mRNA encoded by LOC158476, corresponding to a HOST TARGET binding site such as BINDING SITE I, BINDING SITE II or BINDING SITE III. Table 2 illustrates the complementarity of the nucleotide sequences of LOC158476 BINDING SITE, designated SEQ ID:41996, to the nucleotide sequence of VGAM1760 RNA, herein designated VGAM RNA, also designated SEQ ID:4471.

Another function of VGAM1760 is therefore inhibition of LOC158476 (Accession XM_098955). Accordingly, utilities of VGAM1760 include diagnosis, prevention and treatment of diseases and clinical conditions associated with LOC158476. LOC161823 (Accession XM_091156) is another VGAM1760 host target gene. LOC161823 BINDING SITE is HOST TARGET binding site found in the 3' untranslated region of mRNA encoded by LOC161823, corresponding to a HOST TARGET binding site such as BINDING SITE I, BINDING SITE II or BINDING SITE III. Table 2 illustrates the complementarity of the nucleotide sequences of LOC161823 BINDING SITE, designated SEQ ID:40032, to the nucleotide sequence of VGAM1760 RNA, herein designated VGAM RNA, also designated SEQ ID:4471.

Another function of VGAM1760 is therefore inhibition of LOC161823 (Accession XM_091156). Accordingly, utilities of VGAM1760 include diagnosis, prevention and treatment of diseases and clinical conditions associated with LOC161823. LOC164295 (Accession XM_092767) is another VGAM1760 host target gene. LOC164295 BINDING SITE is HOST TARGET binding site found in the 5' untranslated region of mRNA encoded by LOC164295, corresponding to a HOST TARGET binding site such as BINDING SITE I, BINDING SITE II or BINDING SITE III. Table 2 illustrates the complementarity of the nucleotide sequences of LOC164295 BINDING SITE, designated SEQ ID:40140, to the nucleotide sequence of VGAM1760 RNA, herein designated VGAM RNA, also designated SEQ ID:4471.

Another function of VGAM1760 is therefore inhibition of LOC164295 (Accession XM_092767). Accordingly, utilities of VGAM1760 include diagnosis, prevention and treatment of diseases and clinical conditions associated with LOC164295. LOC92661 (Accession XM_046465) is another VGAM1760 host target gene. LOC92661 BINDING SITE is HOST TARGET binding site found in the 3' untranslated region of mRNA encoded by LOC92661, corresponding to a HOST TARGET binding site such as BINDING SITE I, BINDING SITE II or BINDING SITE III. Table 2 illustrates the complementarity of the nucleotide sequences of LOC92661 BINDING SITE, designated SEQ ID:34725, to the nucleotide sequence of VGAM1760 RNA, herein designated VGAM RNA, also designated SEQ ID:4471.

Another function of VGAM1760 is therefore inhibition of LOC92661 (Accession XM_046465). Accordingly, utilities of VGAM1760 include diagnosis, prevention and treatment of diseases and clinical conditions associated with LOC92661. FIG. 1 further provides a conceptual description of a novel bioinformatically detected viral gene of the present invention, referred to here as Viral Genomic Address Messenger 1761 (VGAM1761) viral gene, which modulates expression of respective host target genes thereof, the function and utility of which host target genes is known in the art.

VGAM1761 is a novel bioinformatically detected regulatory, non protein coding, viral micro RNA (miRNA) gene. The method by which VGAM1761 was detected is described hereinabove with reference to FIGS. 1-8.

VGAM1761 gene, herein designated VGAM GENE, is a viral gene contained in the genome of Bovine Viral Diarrhea Virus Genotype 2 (BVDV-2). VGAM1761 host target gene, herein designated VGAM HOST TARGET GENE, is a human gene contained in the human genome.

VGAM1761 gene encodes a VGAM1761 precursor RNA, herein designated VGAM PRECURSOR RNA. Similar to other miRNA genes, and unlike most ordinary genes, VGAM1761 precursor RNA does not encode a protein. A nucleotide sequence identical or highly similar to the nucleotide sequence of VGAM1761 precursor RNA is designated SEQ ID:1747, and is provided hereinbelow with reference to the sequence listing part. Nucleotide sequence SEQ ID:1747 is located at position 11998 relative to the genome of Bovine Viral Diarrhea Virus Genotype 2 (BVDV-2).

VGAM1761 precursor RNA folds onto itself, forming VGAM1761 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1761 folded precursor RNA into VGAM1761 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1761 RNA is designated SEQ ID:4472, and is provided hereinbelow with reference to the sequence listing part.

VGAM1761 host target gene, herein designated VGAM HOST TARGET GENE, encodes a corresponding messenger RNA, VGAM1761 host target RNA, herein designated VGAM HOST TARGET RNA. VGAM1761 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1761 RNA, herein designated VGAM RNA, binds complementarily to one or more host target binding sites located in untranslated regions of VGAM1761 host target RNA, herein designated VGAM HOST TARGET RNA. This complementary binding is due to the fact that the nucleotide sequence of VGAM1761 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1761 RNA, herein designated VGAM RNA, may have a different number of host target binding sites in untranslated regions of a VGAM1761 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1761 RNA, herein designated VGAM RNA, to host target binding sites on VGAM1761 host target RNA, herein designated VGAM HOST TARGET RNA, such as BINDING SITE I, BINDING SITE II and BINDING SITE III, inhibits translation of VGAM1761 host target RNA into VGAM1761 host target protein, herein designated VGAM HOST TARGET PROTEIN. VGAM host target protein is therefore outlined by a broken line.

It is appreciated that VGAM1761 host target gene, herein designated VGAM HOST TARGET GENE, in fact represents a plurality of VGAM1761 host target genes. The mRNA of each one of this plurality of VGAM1761 host target genes comprises one or more host target binding sites, each having a nucleotide sequence which is at least partly complementary to VGAM1761 RNA, herein designated VGAM RNA, and which when bound by VGAM1761 RNA causes inhibition of translation of respective one or more VGAM1761 host target proteins.

It is further appreciated by one skilled in the art that the mode of translational inhibition illustrated by FIG. 1 with specific reference to translational inhibition exerted by VGAM1761 gene, herein designated VGAM GENE, on one or more VGAM1761 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1761 is inhibition of expression of host target genes, as part of a novel viral mechanism of attacking a host. Accordingly, utilities of VGAM1761 include diagnosis, prevention and treatment of viral infection by Bovine Viral Diarrhea Virus Genotype 2 (BVDV-2). Specific functions, and accordingly utilities, of VGAM1761 correlate with, and may be deduced from, the identity of the host target genes which VGAM1761 binds and inhibits, and the function of these host target genes, as elaborated hereinbelow.

Nucleotide sequences of the VGAM1761 precursor RNA, herein designated VGAM PRECURSOR RNA, and of the 'diced' VGAM1761 RNA, herein designated VGAM RNA, and a schematic representation of the secondary folding of VGAM1761 folded precursor RNA, herein designated VGAM FOLDED PRECURSOR RNA, of VGAM1761 are further described hereinbelow with reference to Table 1.

Nucleotide sequences of host target binding sites, such as BINDING SITE-I, BINDING SITE-II and BINDING SITE-III of FIG. 1, found on VGAM1761 host target RNA, and schematic representation of the complementarity of each of these host target binding sites to VGAM1761 RNA, herein designated VGAM RNA, are described hereinbelow with reference to Table 2.

As mentioned hereinabove with reference to FIG. 1, a function of VGAM1761 gene, herein designated VGAM is inhibition of expression of VGAM1761 target genes. It is appreciated that specific functions, and accordingly utilities, of VGAM1761 correlate with, and may be deduced from, the identity of the target genes which VGAM1761 binds and inhibits, and the function of these target genes, as elaborated hereinbelow.

Absent In Melanoma 1 (AIM1, Accession XM_166300) is a VGAM1761 host target gene. AIM1 BINDING SITE is HOST TARGET binding site found in the 3' untranslated region of mRNA encoded by AIM1, corresponding to a HOST TARGET binding site such as BINDING SITE I, BINDING SITE II or BINDING SITE III. Table 2 illustrates the complementarity of the nucleotide sequences of AIM1 BINDING SITE, designated SEQ ID:44115, to the nucleotide sequence of VGAM1761 RNA, herein designated VGAM RNA, also designated SEQ ID:4472.

A function of VGAM1761 is therefore inhibition of Absent In Melanoma 1 (AIM1, Accession XM_166300), a gene which interactions with the cytoskeleton. Accordingly, utilities of VGAM1761 include diagnosis, prevention and treatment of diseases and clinical conditions associated with AIM1. The function of AIM1 and its association with various diseases and clinical conditions, has been established by previous studies, as described hereinabove with reference to VGAM808. Carbohydrate (N-acetylglucosamine 6-O) Sulfotransferase 6 (CHST6, Accession NM_021615) is another VGAM1761 host target gene. CHST6 BINDING SITE is HOST TARGET binding site found in the 3' untranslated region of mRNA encoded by CHST6, corresponding to a HOST TARGET binding site such as BINDING SITE I, BINDING SITE II or BINDING SITE III. Table 2 illustrates the complementarity of the nucleotide sequences of CHST6 BINDING SITE, designated SEQ ID:22247, to the nucleotide sequence of VGAM1761 RNA, herein designated VGAM RNA, also designated SEQ ID:4472.

Another function of VGAM1761 is therefore inhibition of Carbohydrate (N-acetylglucosamine 6-O) Sulfotransferase 6 (CHST6, Accession NM_021615). Accordingly, utilities of VGAM1761 include diagnosis, prevention and treatment of diseases and clinical conditions associated with CHST6. Epidermal Growth Factor Receptor (erythroblastic leukemia viral (v-erb-b) Oncogene Homolog, Avian) (EGFR, Accession NM_005228) is another VGAM1761 host target gene. EGFR BINDING SITE is HOST TARGET binding site found in the 3' untranslated region of mRNA encoded by EGFR, corresponding to a HOST TARGET binding site such as BINDING SITE I, BINDING SITE II or BINDING SITE III. Table 2 illustrates the complementarity of the nucleotide sequences of EGFR BINDING SITE, designated SEQ ID:11725, to the nucleotide sequence of VGAM1761 RNA, herein designated VGAM RNA, also designated SEQ ID:4472.

Another function of VGAM1761 is therefore inhibition of Epidermal Growth Factor Receptor (erythroblastic leukemia viral (v-erb-b) Oncogene Homolog, Avian) (EGFR, Accession NM_005228), a gene which is a receptor for egf, but also for other members of the egf family. Accordingly, utilities of VGAM1761 include diagnosis, prevention and treatment of diseases and clinical conditions associated with EGFR. The function of EGFR and its association with various diseases and clinical conditions, has been established by previous studies, as described hereinabove with reference to VGAM229. Growth Factor Receptor-bound Protein 14 (GRB14, Accession NM_004490) is another VGAM1761 host target gene. GRB14 BINDING SITE is HOST TARGET binding site found in the 5' untranslated region of mRNA encoded by GRB14, corresponding to a HOST TARGET binding site such as BINDING SITE I, BINDING SITE II or BINDING SITE III. Table 2 illustrates the complementarity of the nucleotide sequences of GRB14 BINDING SITE, designated SEQ ID:10829, to the nucleotide sequence of VGAM1761 RNA, herein designated VGAM RNA, also designated SEQ ID:4472.

Another function of VGAM1761 is therefore inhibition of Growth Factor Receptor-bound Protein 14 (GRB14, Accession NM_004490), a gene which may interact with platelet-derived growth factor receptor (PDGFRB). Accordingly, utilities of VGAM1761 include diagnosis, prevention and treatment of diseases and clinical conditions associated with GRB14. The function of GRB14 has been established by previous studies. Daly et al. (1996) screened a human breast epithelial cell cDNA library with the tyrosine-phosphorylated C terminus of the epidermal growth factor receptor (EGFR) and identified GRB14. GRB14 is a member of the GRB7 family, whose members include the mouse genes Grb7 (OMIM Ref. No. 601522) and Grb10 (OMIM Ref. No. 601523). GRB14, Grb7 and Grb10 all contain a C-terminal SH2 domain and a central domain with similarity to the C. elegans protein F10E9.6/mig10. Daly et al. (1996) identified a third region of similarity, an N-terminal motif, P(S/A)IPNPFPEL, which contains the consensus PXXP SH3 binding domain, suggesting that an SH3 protein may bind to these proteins. By sequence analysis, Dong et al. (1997) mapped the GRB14 gene to chromosome 2.

Full details of the abovementioned studies are described in the following publications, the disclosure of which are hereby incorporated by reference:

Daly, R. J.; Sanderson, G. M.; Janes, P. W.; Sutherland, R. L.: Cloning and characterization of GRB14, a novel member of the GRB7 gene family. J. Biol. Chem. 271:12502-12510, 1996; and Dong, L. Q.; Du, H.; Porter, S. G.; Kolakowski, L. F., Jr.; Lee, A. V.; Mandarino, J.; Fan, J.; Yee, D.; Liu, F.: Cloning, chromosome localization, expression, and characterization of.

Further studies establishing the function and utilities of GRB14 are found in John Hopkins OMIM database record ID 601524, and in sited publications numbered 6532 listed in the bibliography section hereinbelow, which are also hereby incorporated by reference. IRTA2 (Accession NM_031281) is another VGAM1761 host target gene. IRTA2 BINDING SITE is HOST TARGET binding site found in the 3' untranslated region of mRNA encoded by IRTA2, corresponding to a HOST TARGET binding site such as BINDING SITE I, BINDING SITE II or BINDING SITE III. Table 2 illustrates the complementarity of the nucleotide sequences of IRTA2 BINDING SITE, designated SEQ ID:25300, to the nucleotide sequence of VGAM1761 RNA, herein designated VGAM RNA, also designated SEQ ID:4472.

Another function of VGAM1761 is therefore inhibition of IRTA2 (Accession NM_031281), a gene which binds to the fc region of immunoglobulins gamma low affinity receptor. Accordingly, utilities of VGAM1761 include diagnosis, prevention and treatment of diseases and clinical conditions associated with IRTA2. The function of IRTA2 and its association with various diseases and clinical conditions, has been established by previous studies, as described hereinabove with reference to VGAM206. Promyelocytic Leukemia (PML, Accession NM_033238) is another VGAM1761 host target gene. PML BINDING SITE is HOST TARGET binding site found in the 3' untranslated region of mRNA encoded by PML, corresponding to a HOST TARGET binding site such as BINDING SITE I, BINDING SITE II or BINDING SITE III. Table 2 illustrates the complementarity of the nucleotide sequences of PML BINDING SITE, designated SEQ ID:27078, to the nucleotide sequence of VGAM1761 RNA, herein designated VGAM RNA, also designated SEQ ID:4472.

Another function of VGAM1761 is therefore inhibition of Promyelocytic Leukemia (PML, Accession NM_033238). Accordingly, utilities of VGAM1761 include diagnosis, prevention and treatment of diseases and clinical conditions associated with PML. Peanut-like 2 (Drosophila) (PNUTL2, Accession NM_080415) is another VGAM1761 host target gene. PNUTL2 BINDING SITE1 and PNUTL2 BINDING SITE2 are HOST TARGET binding sites found in untranslated regions of mRNA encoded by PNUTL2, corresponding to HOST TARGET binding sites such as BINDING SITE I, BINDING SITE II or BINDING SITE III. Table 2 illustrates the complementarity of the nucleotide sequences of PNUTL2 BINDING SITE1 and PNUTL2 BINDING SITE2, designated SEQ ID:27834 and SEQ ID:27838 respectively, to the nucleotide sequence of VGAM1761 RNA, herein designated VGAM RNA, also designated SEQ ID:4472.

Another function of VGAM1761 is therefore inhibition of Peanut-like 2 (Drosophila) (PNUTL2, Accession NM_080415), a gene which is involved in cytokinesis. Accordingly, utilities of VGAM1761 include diagnosis, prevention and treatment of diseases and clinical conditions associated with PNUTL2. The function of PNUTL2 and its association with various diseases and clinical conditions, has been established by previous studies, as described hereinabove with reference to VGAM95. Tumor Necrosis Factor (TNF superfamily, member 2) (TNF, Accession XM_165823) is another VGAM1761 host target gene. TNF BINDING SITE is HOST TARGET binding site found in the 3' untranslated region of mRNA encoded by TNF, corresponding to a HOST TARGET binding site such as BINDING SITE I, BINDING SITE II or BINDING SITE III. Table 2 illustrates the complementarity of the nucleotide sequences of TNF BINDING SITE, designated SEQ ID:43770, to the nucleotide sequence of VGAM1761 RNA, herein designated VGAM RNA, also designated SEQ ID:4472.

Another function of VGAM1761 is therefore inhibition of Tumor Necrosis Factor (TNF superfamily, member 2) (TNF, Accession XM_165823), a gene which mediates proinflammatory responses and apoptosis. Accordingly, utilities of VGAM1761 include diagnosis, prevention and treatment of diseases and clinical conditions associated with TNF. The function of TNF and its association with various diseases and clinical conditions, has been established by previous studies, as described hereinabove with reference to VGAM175. Tripartite Motif-containing 8 (TRIM8, Accession NM_030912) is another VGAM1761 host target gene. TRIM8 BINDING SITE is HOST TARGET binding site found in the 3' untranslated region of mRNA encoded by TRIM8, corresponding to a HOST TARGET binding site such as BINDING SITE I, BINDING SITE II or BINDING SITE III. Table 2 illustrates the complementarity of the nucleotide sequences of TRIM8 BINDING SITE, designated SEQ ID:25182, to the nucleotide sequence of VGAM1761 RNA, herein designated VGAM RNA, also designated SEQ ID:4472.

Another function of VGAM1761 is therefore inhibition of Tripartite Motif-containing 8 (TRIM8, Accession NM_030912). Accordingly, utilities of VGAM1761 include diagnosis, prevention and treatment of diseases and clinical conditions associated with TRIM8. Transient Receptor Potential Cation Channel, Subfamily M, Member 6 (TRPM6, Accession NM_017662) is another VGAM1761 host target gene. TRPM6 BINDING SITE is HOST TARGET binding site found in the 5' untranslated region of mRNA encoded by TRPM6, corresponding to a HOST TARGET binding site such as BINDING SITE I, BINDING SITE II or BINDING SITE III. Table 2 illustrates the complementarity of the nucleotide sequences of TRPM6 BINDING SITE, designated SEQ ID:19200, to the nucleotide sequence of VGAM1761 RNA, herein designated VGAM RNA, also designated SEQ ID:4472.

Another function of VGAM1761 is therefore inhibition of Transient Receptor Potential Cation Channel, Subfamily M, Member 6 (TRPM6, Accession NM_017662), a gene which contains a predicted ion channel domain and a protein kinase domain. Accordingly, utilities of VGAM1761 include diagnosis, prevention and treatment of diseases and clinical conditions associated with TRPM6. The function of TRPM6 and its association with various diseases and clinical conditions, has been established by previous studies, as described hereinabove with reference to VGAM173. Ubiquitin Specific Protease 6 (Tre-2 oncogene) (USP6, Accession XM_165948) is another VGAM1761 host target gene. USP6 BINDING SITE is HOST TARGET binding site found in the 5' untranslated region of mRNA encoded by USP6, corresponding to a HOST TARGET binding site such as BINDING SITE I, BINDING SITE II or BINDING SITE III. Table 2 illustrates the complementarity of the nucleotide sequences of USP6 BINDING SITE, designated SEQ ID:43811, to the nucleotide sequence of VGAM1761 RNA, herein designated VGAM RNA, also designated SEQ ID:4472.

Another function of VGAM1761 is therefore inhibition of Ubiquitin Specific Protease 6 (Tre-2 oncogene) (USP6, Accession XM_165948), a gene which has an atp-independent isopeptidase activity, cleaving at the carboxyl terminus of the ubiquitin moiety. Accordingly, utilities of VGAM1761 include diagnosis, prevention and treatment of diseases and clinical conditions associated with USP6. The function of USP6 and its association with various diseases and clinical conditions, has been established by previous studies, as described hereinabove with reference to VGAM296. DKFZP434L0718 (Accession NM_032139) is another VGAM1761 host target gene. DKFZP434L0718 BINDING SITE is HOST TARGET binding site found in the 3' untranslated region of mRNA encoded by DKFZP434L0718, corresponding to a HOST TARGET binding site such as BINDING SITE I, BINDING SITE II or BINDING SITE III. Table 2 illustrates the complementarity of the nucleotide sequences of DKFZP434L0718 BINDING SITE, designated SEQ ID:25822, to the nucleotide sequence of VGAM1761 RNA, herein designated VGAM RNA, also designated SEQ ID:4472.

Another function of VGAM1761 is therefore inhibition of DKFZP434L0718 (Accession NM_032139). Accordingly, utilities of VGAM1761 include diagnosis, prevention and treatment of diseases and clinical conditions associated with DKFZP434L0718. FLJ14596 (Accession NM_032809) is another VGAM1761 host target gene. FLJ14596 BINDING SITE is HOST TARGET binding site found in the 3' untranslated region of mRNA encoded by FLJ14596, corresponding to a HOST TARGET binding site such as BINDING SITE I, BINDING SITE II or BINDING SITE III. Table 2 illustrates the complementarity of the nucleotide sequences of FLJ14596 BINDING SITE, designated SEQ ID:26572, to the nucleotide sequence of VGAM1761 RNA, herein designated VGAM RNA, also designated SEQ ID:4472.

Another function of VGAM1761 is therefore inhibition of FLJ14596 (Accession NM_032809). Accordingly, utilities of VGAM1761 include diagnosis, prevention and treatment of diseases and clinical conditions associated with FLJ14596. FLJ21276 (Accession NM_024633) is another VGAM1761 host target gene. FLJ21276 BINDING SITE is HOST TARGET binding site found in the 3' untranslated region of mRNA encoded by FLJ21276, corresponding to a HOST TARGET binding site such as BINDING SITE I, BINDING SITE II or BINDING SITE III. Table 2 illustrates the complementarity of the nucleotide sequences of FLJ21276 BINDING SITE, designated SEQ ID:23905, to the nucleotide sequence of VGAM1761 RNA, herein designated VGAM RNA, also designated SEQ ID:4472.

Another function of VGAM1761 is therefore inhibition of FLJ21276 (Accession NM_024633). Accordingly, utilities of VGAM1761 include diagnosis, prevention and treatment of diseases and clinical conditions associated with FLJ21276. HSH2 (Accession NM_032855) is another VGAM1761 host target gene. HSH2 BINDING SITE is HOST TARGET binding site found in the 3' untranslated region of mRNA encoded by HSH2, corresponding to a HOST TARGET binding site such as BINDING SITE I, BINDING SITE II or BINDING SITE III. Table 2 illustrates the complementarity of the nucleotide sequences of HSH2 BINDING SITE, designated SEQ ID:26654, to the nucleotide sequence of VGAM1761 RNA, herein designated VGAM RNA, also designated SEQ ID:4472.

Another function of VGAM1761 is therefore inhibition of HSH2 (Accession NM_032855). Accordingly, utilities of VGAM1761 include diagnosis, prevention and treatment of diseases and clinical conditions associated with HSH2. KR18 (Accession NM_033288) is another VGAM1761 host target gene. KR18 BINDING SITE is HOST TARGET binding site found in the 3' untranslated region of mRNA encoded by KR18, corresponding to a HOST TARGET binding site such as BINDING SITE I, BINDING SITE II or BINDING SITE III. Table 2 illustrates the complementarity of the nucleotide sequences of KR18 BINDING SITE, designated SEQ ID:27114, to the nucleotide sequence of VGAM1761 RNA, herein designated VGAM RNA, also designated SEQ ID:4472.

Another function of VGAM1761 is therefore inhibition of KR18 (Accession NM_033288). Accordingly, utilities of VGAM1761 include diagnosis, prevention and treatment of diseases and clinical conditions associated with KR18. Mitogen-activated Protein Kinase Kinase 4 (MAP2K4, Accession NM_003010) is another VGAM1761 host target gene. MAP2K4 BINDING SITE is HOST TARGET binding site found in the 3' untranslated region of mRNA encoded by MAP2K4, corresponding to a HOST TARGET binding site such as BINDING SITE I, BINDING SITE II or BINDING SITE III. Table 2 illustrates the complementarity of the nucleotide sequences of MAP2K4 BINDING SITE, designated SEQ ID:8919, to the nucleotide sequence of VGAM1761 RNA, herein designated VGAM RNA, also designated SEQ ID:4472.

Another function of VGAM1761 is therefore inhibition of Mitogen-activated Protein Kinase Kinase 4 (MAP2K4, Accession NM_003010). Accordingly, utilities of VGAM1761 include diagnosis, prevention and treatment of diseases and clinical conditions associated with MAP2K4. NPD009 (Accession XM_170795) is another VGAM1761 host target gene. NPD009 BINDING SITE is HOST TARGET binding site found in the 3' untranslated region of mRNA encoded by NPD009, corresponding to a HOST TARGET binding site such as BINDING SITE I, BINDING SITE II or BINDING SITE III. Table 2 illustrates the complementarity of the nucleotide sequences of NPD009 BINDING SITE, designated SEQ ID:45563, to the nucleotide sequence of VGAM1761 RNA, herein designated VGAM RNA, also designated SEQ ID:4472.

Another function of VGAM1761 is therefore inhibition of NPD009 (Accession XM_170795). Accordingly, utilities of VGAM1761 include diagnosis, prevention and treatment of diseases and clinical conditions associated with NPD009. Triple Homeobox 1 (TIX1, Accession XM_029734) is another VGAM1761 host target gene. TIX1 BINDING SITE is HOST TARGET binding site found in the 3' untranslated region of mRNA encoded by TIX1, corresponding to a HOST TARGET binding site such as BINDING SITE I, BINDING SITE II or BINDING SITE III. Table 2 illustrates the complementarity of the nucleotide sequences of TIX1 BINDING SITE, designated SEQ ID:30929, to the nucleotide sequence of VGAM1761 RNA, herein designated VGAM RNA, also designated SEQ ID:4472.

Another function of VGAM1761 is therefore inhibition of Triple Homeobox 1 (TIX1, Accession XM_029734). Accordingly, utilities of VGAM1761 include diagnosis, prevention and treatment of diseases and clinical conditions associated with TIX1. LOC129198 (Accession XM_072197) is another VGAM1761 host target gene. LOC129198 BINDING SITE is HOST TARGET binding site found in the 5' untranslated region of mRNA encoded by LOC129198, corresponding to a HOST TARGET binding site such as BINDING SITE I, BINDING SITE II or BINDING SITE III. Table 2 illustrates the complementarity of the nucleotide sequences of LOC129198 BINDING SITE, designated SEQ ID:37464, to the nucleotide sequence of VGAM1761 RNA, herein designated VGAM RNA, also designated SEQ ID:4472.

Another function of VGAM1761 is therefore inhibition of LOC129198 (Accession XM_072197). Accordingly, utilities of VGAM1761 include diagnosis, prevention and treatment of diseases and clinical conditions associated with LOC129198. LOC143310 (Accession XM_084485) is another VGAM1761 host target gene. LOC143310 BINDING SITE is HOST TARGET binding site found in the 5' untranslated region of mRNA encoded by LOC143310, corresponding to a HOST TARGET binding site such as BINDING SITE I, BINDING SITE II or BINDING SITE III. Table 2 illustrates the complementarity of the nucleotide sequences of LOC143310 BINDING SITE, designated SEQ ID:37609, to the nucleotide sequence of VGAM1761 RNA, herein designated VGAM RNA, also designated SEQ ID:4472.

Another function of VGAM1761 is therefore inhibition of LOC143310 (Accession XM_084485). Accordingly, utilities of VGAM1761 include diagnosis, prevention and treatment of diseases and clinical conditions associated with LOC143310. LOC145453 (Accession XM_085120) is another VGAM1761 host target gene. LOC145453 BINDING SITE is HOST TARGET binding site found in the 3' untranslated region of mRNA encoded by LOC145453, corresponding to a HOST TARGET binding site such as BINDING SITE I, BINDING SITE II or BINDING SITE III. Table 2 illustrates the complementarity of the nucleotide sequences of LOC145453 BINDING SITE, designated SEQ ID:37837, to the nucleotide sequence of VGAM1761 RNA, herein designated VGAM RNA, also designated SEQ ID:4472.

Another function of VGAM1761 is therefore inhibition of LOC145453 (Accession XM_085120). Accordingly, utilities of VGAM1761 include diagnosis, prevention and treatment of diseases and clinical conditions associated with LOC145453. LOC150159 (Accession NM_139173) is another VGAM1761 host target gene. LOC150159 BINDING SITE is HOST TARGET binding site found in the 3' untranslated region of mRNA encoded by LOC150159, corresponding to a HOST TARGET binding site such as BINDING SITE I, BINDING SITE II or BINDING SITE III. Table 2 illustrates the complementarity of the nucleotide sequences of LOC150159 BINDING SITE, designated SEQ ID:29181, to the nucleotide sequence of VGAM1761 RNA, herein designated VGAM RNA, also designated SEQ ID:4472.

Another function of VGAM1761 is therefore inhibition of LOC150159 (Accession NM_139173). Accordingly, utilities of VGAM1761 include diagnosis, prevention and treatment of diseases and clinical conditions associated with LOC150159. LOC150967 (Accession XM_087060) is another VGAM1761 host target gene. LOC150967 BINDING SITE is HOST TARGET binding site found in the 3' untranslated region of mRNA encoded by LOC150967, corresponding to a HOST TARGET binding site such as BINDING SITE I, BINDING SITE II or BINDING SITE III. Table 2 illustrates the complementarity of the nucleotide sequences of LOC150967 BINDING SITE, designated SEQ ID:39037, to the nucleotide sequence of VGAM1761 RNA, herein designated VGAM RNA, also designated SEQ ID:4472.

Another function of VGAM1761 is therefore inhibition of LOC150967 (Accession XM_087060). Accordingly, utilities of VGAM1761 include diagnosis, prevention and treatment of diseases and clinical conditions associated with LOC150967. LOC152345 (Accession XM_087442) is another VGAM1761 host target gene. LOC152345 BINDING SITE is HOST TARGET binding site found in the 3' untranslated region of mRNA encoded by LOC152345, corresponding to a HOST TARGET binding site such as BINDING SITE I, BINDING SITE II or BINDING SITE III. Table 2 illustrates the complementarity of the nucleotide sequences of LOC152345 BINDING SITE, designated SEQ ID:39267, to the nucleotide sequence of VGAM1761 RNA, herein designated VGAM RNA, also designated SEQ ID:4472.

Another function of VGAM1761 is therefore inhibition of LOC152345 (Accession XM_087442). Accordingly, utilities of VGAM1761 include diagnosis, prevention and treatment of diseases and clinical conditions associated with LOC152345. LOC168576 (Accession XM_095191) is another VGAM1761 host target gene. LOC168576 BINDING SITE is HOST TARGET binding site found in the 5' untranslated region of mRNA encoded by LOC168576, corresponding to a HOST TARGET binding site such as BINDING SITE I, BINDING SITE II or BINDING SITE III. Table 2 illustrates the complementarity of the nucleotide sequences of LOC168576 BINDING SITE, designated SEQ ID:40253, to the nucleotide sequence of VGAM1761 RNA, herein designated VGAM RNA, also designated SEQ ID:4472.

Another function of VGAM1761 is therefore inhibition of LOC168576 (Accession XM_095191). Accordingly, utilities of VGAM1761 include diagnosis, prevention and treatment of diseases and clinical conditions associated with LOC168576. LOC200312 (Accession XM_117224) is another VGAM1761 host target gene. LOC200312 BINDING SITE is HOST TARGET binding site found in the 3' untranslated region of mRNA encoded by LOC200312, corresponding to a HOST TARGET binding site such as BINDING SITE I, BINDING SITE II or BINDING SITE III. Table 2 illustrates the complementarity of the nucleotide sequences of LOC200312 BINDING SITE, designated SEQ ID:43291, to the nucleotide sequence of VGAM1761 RNA, herein designated VGAM RNA, also designated SEQ ID:4472.

Another function of VGAM1761 is therefore inhibition of LOC200312 (Accession XM_117224). Accordingly, utilities of VGAM1761 include diagnosis, prevention and treatment of diseases and clinical conditions associated with LOC200312. LOC203350 (Accession XM_117536) is another VGAM1761 host target gene. LOC203350 BINDING SITE is HOST TARGET binding site found in the 3' untranslated region of mRNA encoded by LOC203350, corresponding to a HOST TARGET binding site such as BINDING SITE I, BINDING SITE II or BINDING SITE III. Table 2 illustrates the complementarity of the nucleotide sequences of LOC203350 BINDING SITE, designated SEQ ID:43535, to the nucleotide sequence of VGAM1761 RNA, herein designated VGAM RNA, also designated SEQ ID:4472.

Another function of VGAM1761 is therefore inhibition of LOC203350 (Accession XM_117536). Accordingly, utilities of VGAM1761 include diagnosis, prevention and treatment of diseases and clinical conditions associated with LOC203350. LOC220776 (Accession XM_043388) is another VGAM1761 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33936, to the nucleotide sequence of VGAM1761 RNA, herein designated VGAM RNA, also designated SEQ ID:4472.

Another function of VGAM1761 is therefore inhibition of LOC220776 (Accession XM_043388). Accordingly, utilities of VGAM1761 include diagnosis, prevention and treatment of diseases and clinical conditions associated with LOC220776. LOC257551 (Accession XM_175158) is another VGAM1761 host target gene. LOC257551 BINDING SITE is HOST TARGET binding site found in the 3' untranslated region of mRNA encoded by LOC257551, corresponding to a HOST TARGET binding site such as BINDING SITE I, BINDING SITE II or BINDING SITE III. Table 2 illustrates the complementarity of the nucleotide sequences of LOC257551 BINDING SITE, designated SEQ ID:46644, to the nucleotide sequence of VGAM1761 RNA, herein designated VGAM RNA, also designated SEQ ID:4472.

Another function of VGAM1761 is therefore inhibition of LOC257551 (Accession XM_175158). Accordingly, utilities of VGAM1761 include diagnosis, prevention and treatment of diseases and clinical conditions associated with LOC257551. LOC257601 (Accession XM_175231) is another VGAM1761 host target gene. LOC257601 BINDING SITE is HOST TARGET binding site found in the 3' untranslated region of mRNA encoded by LOC257601, corresponding to a HOST TARGET binding site such as BINDING SITE I, BINDING SITE II or BINDING SITE III. Table 2 illustrates the complementarity of the nucleotide sequences of LOC257601 BINDING SITE, designated SEQ ID:46695, to the nucleotide sequence of VGAM1761 RNA, herein designated VGAM RNA, also designated SEQ ID:4472.

Another function of VGAM1761 is therefore inhibition of LOC257601 (Accession XM_175231). Accordingly, utilities of VGAM1761 include diagnosis, prevention and treatment of diseases and clinical conditions associated with LOC257601. LOC91585 (Accession XM_039395) is another VGAM1761 host target gene. LOC91585 BINDING SITE is HOST TARGET binding site found in the 5' untranslated region of mRNA encoded by LOC91585, corresponding to a HOST TARGET binding site such as BINDING SITE I, BINDING SITE II or BINDING SITE III. Table 2 illustrates the complementarity of the nucleotide sequences of LOC91585 BINDING SITE, designated SEQ ID:33077, to the nucleotide sequence of VGAM1761 RNA, herein designated VGAM RNA, also designated SEQ ID:4472.

Another function of VGAM1761 is therefore inhibition of LOC91585 (Accession XM_039395). Accordingly, utilities of VGAM1761 include diagnosis, prevention and treatment of diseases and clinical conditions associated with LOC91585. LOC93624 (Accession XM_052624) is another VGAM1761 host target gene. LOC93624 BINDING SITE is HOST TARGET binding site found in the 5' untranslated region of mRNA encoded by LOC93624, corresponding to a HOST TARGET binding site such as BINDING SITE I, BINDING SITE II or BINDING SITE III. Table 2 illustrates the complementarity of the nucleotide sequences of LOC93624 BINDING SITE, designated SEQ ID:36016, to the nucleotide sequence of VGAM1761 RNA, herein designated VGAM RNA, also designated SEQ ID:4472.

Another function of VGAM1761 is therefore inhibition of LOC93624 (Accession XM_052624). Accordingly, utilities of VGAM1761 include diagnosis, prevention and treatment of diseases and clinical conditions associated with LOC93624. FIG. 1 further provides a conceptual description of a novel bioinformatically detected viral gene of the present invention, referred to here as Viral Genomic Address Messenger 1762 (VGAM1762) viral gene, which modulates expression of respective host target genes thereof, the function and utility of which host target genes is known in the art.

VGAM1762 is a novel bioinformatically detected regulatory, non protein coding, viral micro RNA (miRNA) gene. The method by which VGAM1762 was detected is described hereinabove with reference to FIGS. 1-8.

VGAM1762 gene, herein designated VGAM GENE, is a viral gene contained in the genome of Bovine Viral Diarrhea Virus Genotype 2 (BVDV-2). VGAM1762 host target gene, herein designated VGAM HOST TARGET GENE, is a human gene contained in the human genome.

VGAM1762 gene encodes a VGAM1762 precursor RNA, herein designated VGAM PRECURSOR RNA. Similar to other miRNA genes, and unlike most ordinary genes, VGAM1762 precursor RNA does not encode a protein. A nucleotide sequence identical or highly similar to the nucleotide sequence of VGAM1762 precursor RNA is designated SEQ ID:1748, and is provided hereinbelow with reference to the sequence listing part. Nucleotide sequence SEQ ID:1748 is located at position 2442 relative to the genome of Bovine Viral Diarrhea Virus Genotype 2 (BVDV-2).

VGAM1762 precursor RNA folds onto itself, forming VGAM1762 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1762 folded precursor RNA into VGAM1762 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM1762 RNA is designated SEQ ID:4473, and is provided hereinbelow with reference to the sequence listing part.

VGAM1762 host target gene, herein designated VGAM HOST TARGET GENE, encodes a corresponding messenger RNA, VGAM1762 host target RNA, herein designated VGAM HOST TARGET RNA. VGAM1762 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1762 RNA, herein designated VGAM RNA, binds complementarily to one or more host target binding sites located in untranslated regions of VGAM1762 host target RNA, herein designated VGAM HOST TARGET RNA. This complementary binding is due to the fact that the nucleotide sequence of VGAM1762 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1762 RNA, herein designated VGAM RNA, may have a different number of host target binding sites in untranslated regions of a VGAM1762 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1762 RNA, herein designated VGAM RNA, to host target binding sites on VGAM1762 host target RNA, herein designated VGAM HOST TARGET RNA, such as BINDING SITE I, BINDING SITE II and BINDING SITE III, inhibits translation of VGAM1762 host target RNA into VGAM1762 host target protein, herein designated VGAM HOST TARGET PROTEIN. VGAM host target protein is therefore outlined by a broken line.

It is appreciated that VGAM1762 host target gene, herein designated VGAM HOST TARGET GENE, in fact represents a plurality of VGAM1762 host target genes. The mRNA of each one of this plurality of VGAM1762 host target genes comprises one or more host target binding sites, each having a nucleotide sequence which is at least partly complementary to VGAM1762 RNA, herein designated VGAM RNA, and which when bound by VGAM1762 RNA causes inhibition of translation of respective one or more VGAM1762 host target proteins.

It is further appreciated by one skilled in the art that the mode of translational inhibition illustrated by FIG. 1 with specific reference to translational inhibition exerted by VGAM1762 gene, herein designated VGAM GENE, on one or more VGAM1762 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1762 is inhibition of expression of host target genes, as part of a novel viral mechanism of attacking a host. Accordingly, utilities of VGAM1762 include diagnosis, prevention and treatment of viral infection by Bovine Viral Diarrhea Virus Genotype 2 (BVDV-2). Specific functions, and accordingly utilities, of VGAM1762 correlate with, and may be deduced from, the identity of the host target genes which VGAM1762 binds and inhibits, and the function of these host target genes, as elaborated hereinbelow.

Nucleotide sequences of the VGAM1762 precursor RNA, herein designated VGAM PRECURSOR RNA, and of the 'diced' VGAM1762 RNA, herein designated VGAM RNA, and a schematic representation of the secondary folding of VGAM1762 folded precursor RNA, herein designated VGAM FOLDED PRECURSOR RNA, of VGAM1762 are further described hereinbelow with reference to Table 1.

Nucleotide sequences of host target binding sites, such as BINDING SITE-I, BINDING SITE-II and BINDING SITE-III of FIG. 1, found on VGAM1762 host target RNA, and schematic representation of the complementarity of each of these host target binding sites to VGAM1762 RNA, herein designated VGAM RNA, are described hereinbelow with reference to Table 2.

As mentioned hereinabove with reference to FIG. 1, a function of VGAM1762 gene, herein designated VGAM is inhibition of expression of VGAM1762 target genes. It is appreciated that specific functions, and accordingly utilities, of VGAM1762 correlate with, and may be deduced from, the identity of the target genes which VGAM1762 binds and inhibits, and the function of these target genes, as elaborated hereinbelow.

Adrenergic, Beta-3-, Receptor (ADRB3, Accession NM_000025) is a VGAM1762 host target gene. ADRB3 BINDING SITE is HOST TARGET binding site found in the 3' untranslated region of mRNA encoded by ADRB3, corresponding to a HOST TARGET binding site such as BINDING SITE I, BINDING SITE II or BINDING SITE III. Table 2 illustrates the complementarity of the nucleotide sequences of ADRB3 BINDING SITE, designated SEQ ID:5460, to the nucleotide sequence of VGAM1762 RNA, herein designated VGAM RNA, also designated SEQ ID:4473.

A function of VGAM1762 is therefore inhibition of Adrenergic, Beta-3-, Receptor (ADRB3, Accession NM_000025), a gene which stimulates adenylyl cyclase activity and regulates lipolysis. Accordingly, utilities of VGAM1762 include diagnosis, prevention and treatment of diseases and clinical conditions associated with ADRB3. The function of ADRB3 and its association with various diseases and clinical conditions, has been established by previous studies, as described hereinabove with reference to VGAM179. Contactin Associated Protein-like 2 (CNTNAP2, Accession NM_014141) is another VGAM1762 host target gene. CNTNAP2 BINDING SITE is HOST TARGET binding site found in the 3' untranslated region of mRNA encoded by CNTNAP2, corresponding to a HOST TARGET binding site such as BINDING SITE I, BINDING SITE II or BINDING SITE III. Table 2 illustrates the complementarity of the nucleotide sequences of CNTNAP2 BINDING SITE, designated SEQ ID:15419, to the nucleotide sequence of VGAM1762 RNA, herein designated VGAM RNA, also designated SEQ ID:4473.

Another function of VGAM1762 is therefore inhibition of Contactin Associated Protein-like 2 (CNTNAP2, Accession NM_014141). Accordingly, utilities of VGAM1762 include diagnosis, prevention and treatment of diseases and clinical conditions associated with CNTNAP2. FLJ22746 (Accession NM_024785) is another VGAM1762 host target gene. FLJ22746 BINDING SITE is HOST TARGET binding site found in the 3' untranslated region of mRNA encoded by FLJ22746, corresponding to a HOST TARGET binding site such as BINDING SITE I, BINDING SITE II or BINDING SITE III. Table 2 illustrates the complementarity of the nucleotide sequences of FLJ22746 BINDING SITE, designated SEQ ID:24165, to the nucleotide sequence of VGAM1762 RNA, herein designated VGAM RNA, also designated SEQ ID:4473.

Another function of VGAM1762 is therefore inhibition of FLJ22746 (Accession NM_024785). Accordingly, utilities of VGAM1762 include diagnosis, prevention and treatment of diseases and clinical conditions associated with FLJ22746. SQV7L (Accession XM_047287) is another VGAM1762 host target gene. SQV7L BINDING SITE is HOST TARGET binding site found in the 5' untranslated region of mRNA encoded by SQV7L, corresponding to a HOST TARGET binding site such as BINDING SITE I, BINDING SITE II or BINDING SITE III. Table 2 illustrates the complementarity of the nucleotide sequences of SQV7L BINDING SITE, designated SEQ ID:34933, to the nucleotide sequence of VGAM1762 RNA, herein designated VGAM RNA, also designated SEQ ID:4473.

Another function of VGAM1762 is therefore inhibition of SQV7L (Accession XM_047287). Accordingly, utilities of VGAM1762 include diagnosis, prevention and treatment of diseases and clinical conditions associated with SQV7L. Zinc Finger Protein 237 (ZNF237, Accession NM_014242) is another VGAM1762 host target gene. ZNF237 BINDING SITE is HOST TARGET binding site found in the 3' untranslated region of mRNA encoded by ZNF237, corresponding to a HOST TARGET binding site such as BINDING SITE I, BINDING SITE II or BINDING SITE III. Table 2 illustrates the complementarity of the nucleotide sequences of ZNF237 BINDING SITE, designated SEQ ID:15505, to the nucleotide sequence of VGAM1762 RNA, herein designated VGAM RNA, also designated SEQ ID:4473.

Another function of VGAM1762 is therefore inhibition of Zinc Finger Protein 237 (ZNF237, Accession NM_014242). Accordingly, utilities of VGAM1762 include diagnosis, prevention and treatment of diseases and clinical conditions associated with ZNF237. LOC153688 (Accession XM_098416) is another VGAM1762 host target gene. LOC153688 BINDING SITE is HOST TARGET binding site found in the 3' untranslated region of mRNA encoded by LOC153688, corresponding to a HOST TARGET binding site such as BINDING SITE I, BINDING SITE II or BINDING SITE III. Table 2 illustrates the complementarity of the nucleotide sequences of LOC153688 BINDING SITE, designated SEQ ID:41653, to the nucleotide sequence of VGAM1762 RNA, herein designated VGAM RNA, also designated SEQ ID:4473.

Another function of VGAM1762 is therefore inhibition of LOC153688 (Accession XM_098416). Accordingly, utilities of VGAM1762 include diagnosis, prevention and treatment of diseases and clinical conditions associated with LOC153688. LOC220846 (Accession XM_165515) is another VGAM1762 host target gene. LOC220846 BINDING SITE is HOST TARGET binding site found in the 3' untranslated region of mRNA encoded by LOC220846, corresponding to a HOST TARGET binding site such as BINDING SITE I, BINDING SITE II or BINDING SITE III. Table 2 illustrates the complementarity of the nucleotide sequences of LOC220846 BINDING SITE, designated SEQ ID:43662, to the nucleotide sequence of VGAM1762 RNA, herein designated VGAM RNA, also designated SEQ ID:4473.

Another function of VGAM1762 is therefore inhibition of LOC220846 (Accession XM_165515). Accordingly, utilities of VGAM1762 include diagnosis, prevention and treatment of diseases and clinical conditions associated with LOC220846. FIG. 1 further provides a conceptual description of a novel bioinformatically detected viral gene of the present invention, referred to here as Viral Genomic Address Messenger 1763 (VGAM1763) viral gene, which modulates expression of respective host target genes thereof, the function and utility of which host target genes is known in the art.

VGAM1763 is a novel bioinformatically detected regulatory, non protein coding, viral micro RNA (miRNA) gene. The method by which VGAM1763 was detected is described hereinabove with reference to FIGS. 1-8.

VGAM1763 gene, herein designated VGAM GENE, is a viral gene contained in the genome of Bovine Viral Diarrhea Virus Genotype 2 (BVDV-2). VGAM1763 host target gene, herein designated VGAM HOST TARGET GENE, is a human gene contained in the human genome.

VGAM1763 gene encodes a VGAM1763 precursor RNA, herein designated VGAM PRECURSOR RNA. Similar to other miRNA genes, and unlike most ordinary genes, VGAM1763 precursor RNA does not encode a protein. A nucleotide sequence identical or highly similar to the nucleotide sequence of VGAM1763 precursor RNA is designated SEQ ID:1749, and is provided hereinbelow with reference to the sequence listing part. Nucleotide sequence SEQ ID:1749 is located at position 11479 relative to the genome of Bovine Viral Diarrhea Virus Genotype 2 (BVDV-2).

VGAM1763 precursor RNA folds onto itself, forming VGAM1763 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1763 folded precursor RNA into VGAM1763 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1763 RNA is designated SEQ ID:4474, and is provided hereinbelow with reference to the sequence listing part.

VGAM1763 host target gene, herein designated VGAM HOST TARGET GENE, encodes a corresponding messenger RNA, VGAM1763 host target RNA, herein designated VGAM HOST TARGET RNA. VGAM1763 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1763 RNA, herein designated VGAM RNA, binds complementarily to one or more host target binding sites located in untranslated regions of VGAM1763 host target RNA, herein designated VGAM HOST TARGET RNA. This complementary binding is due to the fact that the nucleotide sequence of VGAM1763 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1763 RNA, herein designated VGAM RNA, may have a different number of host target binding sites in untranslated regions of a VGAM1763 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1763 RNA, herein designated VGAM RNA, to host target binding sites on VGAM1763 host target RNA, herein designated VGAM HOST TARGET RNA, such as BINDING SITE I, BINDING SITE II and BINDING SITE III, inhibits translation of VGAM1763 host target RNA into VGAM1763 host target protein, herein designated VGAM HOST TARGET PROTEIN. VGAM host target protein is therefore outlined by a broken line.

It is appreciated that VGAM1763 host target gene, herein designated VGAM HOST TARGET GENE, in fact represents a plurality of VGAM1763 host target genes. The mRNA of each one of this plurality of VGAM1763 host target genes comprises one or more host target binding sites, each having a nucleotide sequence which is at least partly complementary to VGAM1763 RNA, herein designated VGAM RNA, and which when bound by VGAM1763 RNA causes inhibition of translation of respective one or more VGAM1763 host target proteins.

It is further appreciated by one skilled in the art that the mode of translational inhibition illustrated by FIG. 1 with specific reference to translational inhibition exerted by VGAM1763 gene, herein designated VGAM GENE, on one or more VGAM1763 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1763 is inhibition of expression of host target genes, as part of a novel viral mechanism of attacking a host. Accordingly, utilities of VGAM1763 include diagnosis, prevention and treatment of viral infection by Bovine Viral Diarrhea Virus Genotype 2 (BVDV-2). Specific functions, and accordingly utilities, of VGAM1763 correlate with, and may be deduced from, the identity of the host target genes which VGAM1763 binds and inhibits, and the function of these host target genes, as elaborated hereinbelow.

Nucleotide sequences of the VGAM1763 precursor RNA, herein designated VGAM PRECURSOR RNA, and of the 'diced' VGAM1763 RNA, herein designated VGAM RNA, and a schematic representation of the secondary folding of VGAM1763 folded precursor RNA, herein designated VGAM FOLDED PRECURSOR RNA, of VGAM1763 are further described hereinbelow with reference to Table 1.

Nucleotide sequences of host target binding sites, such as BINDING SITE-I, BINDING SITE-II and BINDING SITE-III of FIG. 1, found on VGAM1763 host target RNA, and schematic representation of the complementarity of each of these host target binding sites to VGAM1763 RNA, herein designated VGAM RNA, are described hereinbelow with reference to Table 2.

As mentioned hereinabove with reference to FIG. 1, a function of VGAM1763 gene, herein designated VGAM is inhibition of expression of VGAM1763 target genes. It is appreciated that specific functions, and accordingly utilities, of VGAM1763 correlate with, and may be deduced from, the identity of the target genes which VGAM1763 binds and inhibits, and the function of these target genes, as elaborated hereinbelow.

Corticotropin Releasing Hormone Receptor 2 (CRHR2, Accession NM_001883) is a VGAM1763 host target gene. CRHR2 BINDING SITE is HOST TARGET binding site found in the 3' untranslated region of mRNA encoded by CRHR2, corresponding to a HOST TARGET binding site such as BINDING SITE I, BINDING SITE II or BINDING SITE III. Table 2 illustrates the complementarity of the nucleotide sequences of CRHR2 BINDING SITE, designated SEQ ID:7613, to the nucleotide sequence of VGAM1763 RNA, herein designated VGAM RNA, also designated SEQ ID:4474.

A function of VGAM1763 is therefore inhibition of Corticotropin Releasing Hormone Receptor 2 (CRHR2, Accession NM_001883), a gene which is a corticotropin releasing factor receptor type II. Accordingly, utilities of VGAM1763 include diagnosis, prevention and treatment of diseases and clinical conditions associated with CRHR2. The function of CRHR2 and its association with various diseases and clinical conditions, has been established by previous studies, as described hereinabove with reference to VGAM737. Dual Specificity Phosphatase 6 (DUSP6, Accession XM_038308) is another VGAM1763 host target gene. DUSP6 BINDING SITE is HOST TARGET binding site found in the 3' untranslated region of mRNA encoded by DUSP6, corresponding to a HOST TARGET binding site such as BINDING SITE I, BINDING SITE II or BINDING SITE III. Table 2 illustrates the complementarity of the nucleotide sequences of DUSP6 BINDING SITE, designated SEQ ID:32810, to the nucleotide sequence of VGAM1763 RNA, herein designated VGAM RNA, also designated SEQ ID:4474.

Another function of VGAM1763 is therefore inhibition of Dual Specificity Phosphatase 6 (DUSP6, Accession XM_038308), a gene which inactivates map kinases. Accordingly, utilities of VGAM1763 include diagnosis, prevention and treatment of diseases and clinical conditions associated with DUSP6. The function of DUSP6 has been established by previous studies. Members of the mitogen-activated protein (MAP) kinase family play a pivotal role in cellular signal transduction. The dual-specificity phosphatases can reverse MAP kinase activation by dephosphorylating critical phosphotyrosine and phosphothreonine residues. Muda et al. (1996) identified rat superior cervical ganglion cDNAs encoding 2 dual-specificity phosphatases that they designated MKP3 and MKPX (OMIM Ref. No. 602749). Northern analysis revealed that nerve growth factor (see OMIM Ref. No. 162030) induced MKP3 expression in PC12 cells. By in situ hybridization, Muda et al. (1996) showed that metrazole-stimulated seizure activity induced MKP3 expression, rapidly and transiently, in specific regions of the brain. When expressed in mammalian cells, MKP3 blocked both the phosphorylation and enzymatic activation of the MAP kinase ERK2 (OMIM Ref. No. 176948) by mitogens. Muda et al. (1996) concluded that MKP3 may play an important and specific role in regulating MAP kinase activities. Groom et al. (1996) identified cDNAs encoding the human MKP3 and MKPX homologs, which they called PYST1 and PYST2, respectively. Like other dual-specificity phosphatases, the N-terminal region of the predicted 381-amino acid PYST1 protein has 2 domains with significant homology to CDC25 (OMIM Ref. No. 157680). By immunofluorescence of mammalian cells expressing epitope-tagged PYST1, Groom et al. (1996) showed that the protein is localized to the cytoplasm. They found that PYST1 dephosphorylated and inactivated MAP kinase in vitro and in vivo, but displayed very low activity towards the related stress-activated protein kinases (SAPKs; OMIM Ref. No. 601158). When expressed in mammalian cells, PYST1 formed a physical complex with endogenous MAP kinase. Northern analysis revealed that PYST1 is expressed as a 3-kb mRNA in a variety of tissues, with the highest levels in heart and pancreas. By RT-PCR, Furukawa et al. (1998) found that DUSP6 was expressed as 2 differently sized transcripts in all tissues tested.

Full details of the abovementioned studies are described in the following publications, the disclosure of which are hereby incorporated by reference:

Groom, L. A.; Sneddon, A. A.; Alessi, D. R.; Dowd, S.; Keyse, S. M.: Differential regulation of the MAP, SAP and RK/p38 kinases by Pyst1, a novel cytosolic dual-specificity phosphatase. EMBO J. 15:3621-3632, 1996; and Muda, M.; Boschert, U.; Dickinson, R.; Martinou, J.-C.; Martinou, I.; Camps, M.; Schlegel, W.; Arkinstall, S.: MKP-3, a novel cytosolic protein-tyrosine phosphatase that exemplifies a.

Further studies establishing the function and utilities of DUSP6 are found in John Hopkins OMIM database record ID 602748, and in sited publications numbered 2410-241 and 2409 listed in the bibliography section hereinbelow, which are also hereby incorporated by reference. Low Density Lipoprotein Receptor-related Protein 8, Apolipoprotein E Receptor (LRP8, Accession NM_033300) is another VGAM1763 host target gene. LRP8 BINDING SITE1 and LRP8 BINDING SITE2 are HOST TARGET binding sites found in untranslated regions of mRNA encoded by LRP8, corresponding to HOST TARGET binding sites such as BINDING SITE I, BINDING SITE II or BINDING SITE III. Table 2 illustrates the complementarity of the nucleotide sequences of LRP8 BINDING SITE1 and LRP8 BINDING SITE2, designated SEQ ID:27130 and SEQ ID:11006 respectively, to the nucleotide sequence of VGAM1763 RNA, herein designated VGAM RNA, also designated SEQ ID:4474.

Another function of VGAM1763 is therefore inhibition of Low Density Lipoprotein Receptor-related Protein 8, Apolipoprotein E Receptor (LRP8, Accession NM_033300), a gene which binds vldl and transports it into cells by endocytosis. Accordingly, utilities of VGAM1763 include diagnosis, prevention and treatment of diseases and clinical conditions associated with LRP8. The function of LRP8 and its association with various diseases and clinical conditions, has been established by previous studies, as described hereinabove with reference to VGAM191. Cell Adhesion Molecule with Homology to L1CAM (close homolog of L1) (CHL1, Accession NM_006614) is another VGAM1763 host target gene. CHL1 BINDING SITE is HOST TARGET binding site found in the 3' untranslated region of mRNA encoded by CHL1, corresponding to a HOST TARGET binding site such as BINDING SITE I, BINDING SITE II or BINDING SITE III. Table 2 illustrates the complementarity of the nucleotide sequences of CHL1 BINDING SITE, designated SEQ ID:13398, to the nucleotide sequence of VGAM1763 RNA, herein designated VGAM RNA, also designated SEQ ID:4474.

Another function of VGAM1763 is therefore inhibition of Cell Adhesion Molecule with Homology to L1CAM (close homolog of L1) (CHL1, Accession NM_006614). Accordingly, utilities of VGAM1763 include diagnosis, prevention and treatment of diseases and clinical conditions associated with CHL1. DJ167A19.1 (Accession NM_018982) is another VGAM1763 host target gene. DJ167A19.1 BINDING SITE is HOST TARGET binding site found in the 3' untranslated region of mRNA encoded by DJ167A19.1, corresponding to a HOST TARGET binding site such as BINDING SITE I, BINDING SITE II or BINDING SITE III. Table 2 illustrates the complementarity of the nucleotide sequences of DJ167A19.1 BINDING SITE, designated SEQ ID:21051, to the nucleotide sequence of VGAM1763 RNA, herein designated VGAM RNA, also designated SEQ ID:4474.

Another function of VGAM1763 is therefore inhibition of DJ167A19.1 (Accession NM_018982). Accordingly, utilities of VGAM1763 include diagnosis, prevention and treatment of diseases and clinical conditions associated with DJ167A19.1. FLJ22054 (Accession XM_170478) is another VGAM1763 host target gene. FLJ22054 BINDING SITE is HOST TARGET binding site found in the 3' untranslated region of mRNA encoded by FLJ22054, corresponding to a HOST TARGET binding site such as BINDING SITE I, BINDING SITE II or BINDING SITE III. Table 2 illustrates the complementarity of the nucleotide sequences of FLJ22054 BINDING SITE, designated SEQ ID:45318, to the nucleotide sequence of VGAM1763 RNA, herein designated VGAM RNA, also designated SEQ ID:4474.

Another function of VGAM1763 is therefore inhibition of FLJ22054 (Accession XM_170478). Accordingly, utilities of VGAM1763 include diagnosis, prevention and treatment of diseases and clinical conditions associated with FLJ22054. GFR (Accession NM_012294) is another VGAM1763 host target gene. GFR BINDING SITE is HOST TARGET binding site found in the 3' untranslated region of mRNA encoded by GFR, corresponding to a HOST TARGET binding site such as BINDING SITE I, BINDING SITE II or BINDING SITE III. Table 2 illustrates the complementarity of the nucleotide sequences of GFR BINDING SITE, designated SEQ ID:14643, to the nucleotide sequence of VGAM1763 RNA, herein designated VGAM RNA, also designated SEQ ID:4474.

Another function of VGAM1763 is therefore inhibition of GFR (Accession NM_012294). Accordingly, utilities of VGAM1763 include diagnosis, prevention and treatment of diseases and clinical conditions associated with GFR. Histone Deacetylase 11 (HDAC11, Accession NM_024827) is another VGAM1763 host target gene. HDAC11 BINDING SITE is HOST TARGET binding site found in the 3' untranslated region of mRNA encoded by HDAC11, corresponding to a HOST TARGET binding site such as BINDING SITE I, BINDING SITE II or BINDING SITE III. Table 2 illustrates the complementarity of the nucleotide sequences of HDAC11 BINDING SITE, designated SEQ ID:24218, to the nucleotide sequence of VGAM1763 RNA, herein designated VGAM RNA, also designated SEQ ID:4474.

Another function of VGAM1763 is therefore inhibition of Histone Deacetylase 11 (HDAC11, Accession NM_024827). Accordingly, utilities of VGAM1763 include diagnosis, prevention and treatment of diseases and clinical conditions associated with HDAC11. KIAA0415 (Accession XM_166527) is another VGAM1763 host target gene. KIAA0415 BINDING SITE is HOST TARGET binding site found in the 3' untranslated region of mRNA encoded by KIAA0415, corresponding to a HOST TARGET binding site such as BINDING SITE I, BINDING SITE II or BINDING SITE III. Table 2 illustrates the complementarity of the nucleotide sequences of KIAA0415 BINDING SITE, designated SEQ ID:44475, to the nucleotide sequence of VGAM1763 RNA, herein designated VGAM RNA, also designated SEQ ID:4474.

Another function of VGAM1763 is therefore inhibition of KIAA0415 (Accession XM_166527). Accordingly, utilities of VGAM1763 include diagnosis, prevention and treatment of diseases and clinical conditions associated with KIAA0415. KIAA0978 (Accession XM_047013) is another VGAM1763 host target gene. KIAA0978 BINDING SITE is HOST TARGET binding site found in the 3' untranslated region of mRNA encoded by KIAA0978, corresponding to a HOST TARGET binding site such as BINDING SITE I, BINDING SITE II or BINDING SITE III. Table 2 illustrates the complementarity of the nucleotide sequences of KIAA0978 BINDING SITE, designated SEQ ID:34888, to the nucleotide sequence of VGAM1763 RNA, herein designated VGAM RNA, also designated SEQ ID:4474.

Another function of VGAM1763 is therefore inhibition of KIAA0978 (Accession XM_047013). Accordingly, utilities of VGAM1763 include diagnosis, prevention and treatment of diseases and clinical conditions associated with KIAA0978. KIAA1042 (Accession NM_014965) is another VGAM1763 host target gene. KIAA1042 BINDING SITE is HOST TARGET binding site found in the 3' untranslated region of mRNA encoded by KIAA1042, corresponding to a HOST TARGET binding site such as BINDING SITE I, BINDING SITE II or BINDING SITE III. Table 2 illustrates the complementarity of the nucleotide sequences of KIAA1042 BINDING SITE, designated SEQ ID:17354, to the nucleotide sequence of VGAM1763 RNA, herein designated VGAM RNA, also designated SEQ ID:4474.

Another function of VGAM1763 is therefore inhibition of KIAA1042 (Accession NM_014965). Accordingly, utilities of VGAM1763 include diagnosis, prevention and treatment of diseases and clinical conditions associated with KIAA1042. KIAA1045 (Accession XM_048592) is another VGAM1763 host target gene. KIAA1045 BINDING SITE is HOST TARGET binding site found in the 3' untranslated region of mRNA encoded by KIAA1045, corresponding to a HOST TARGET binding site such as BINDING SITE I, BINDING SITE II or BINDING SITE III. Table 2 illustrates the complementarity of the nucleotide sequences of KIAA1045 BINDING SITE, designated SEQ ID:35201, to the nucleotide sequence of VGAM1763 RNA, herein designated VGAM RNA, also designated SEQ ID:4474.

Another function of VGAM1763 is therefore inhibition of KIAA1045 (Accession XM_048592). Accordingly, utilities of VGAM1763 include diagnosis, prevention and treatment of diseases and clinical conditions associated with KIAA1045. MGC12760 (Accession NM_032723) is another VGAM1763 host target gene. MGC12760 BINDING SITE is HOST TARGET binding site found in the 3' untranslated region of mRNA encoded by MGC12760, corresponding to a HOST TARGET binding site such as BINDING SITE I, BINDING SITE II or BINDING SITE III. Table 2 illustrates the complementarity of the nucleotide sequences of MGC12760 BINDING SITE, designated SEQ ID:26451, to the nucleotide sequence of VGAM1763 RNA, herein designated VGAM RNA, also designated SEQ ID:4474.

Another function of VGAM1763 is therefore inhibition of MGC12760 (Accession NM_032723). Accordingly, utilities of VGAM1763 include diagnosis, prevention and treatment of diseases and clinical conditions associated with MGC12760. PRO0800 (Accession NM_018592) is another VGAM1763 host target gene. PRO0800 BINDING SITE is HOST TARGET binding site found in the 3' untranslated region of mRNA encoded by PRO0800, corresponding to a HOST TARGET binding site such as BINDING SITE I, BINDING SITE II or BINDING SITE III. Table 2 illustrates the complementarity of the nucleotide sequences of PRO0800 BINDING SITE, designated SEQ ID:20672, to the nucleotide sequence of VGAM1763 RNA, herein designated VGAM RNA, also designated SEQ ID:4474.

Another function of VGAM1763 is therefore inhibition of PRO0800 (Accession NM_018592). Accordingly, utilities of VGAM1763 include diagnosis, prevention and treatment of diseases and clinical conditions associated with PRO0800. SQV7L (Accession XM_047287) is another VGAM1763 host target gene. SQV7L BINDING SITE is HOST TARGET binding site found in the 5' untranslated region of mRNA encoded by SQV7L, corresponding to a HOST TARGET binding site such as BINDING SITE I, BINDING SITE II or BINDING SITE III. Table 2 illustrates the complementarity of the nucleotide sequences of SQV7L BINDING SITE, designated SEQ ID:34934, to the nucleotide sequence of VGAM1763 RNA, herein designated VGAM RNA, also designated SEQ ID:4474.

Another function of VGAM1763 is therefore inhibition of SQV7L (Accession XM_047287). Accordingly, utilities of VGAM1763 include diagnosis, prevention and treatment of diseases and clinical conditions associated with SQV7L. LOC170082 (Accession XM_093092) is another VGAM1763 host target gene. LOC170082 BINDING SITE is HOST TARGET binding site found in the 3' untranslated region of mRNA encoded by LOC170082, corresponding to a HOST TARGET binding site such as BINDING SITE I, BINDING SITE II or BINDING SITE III. Table 2 illustrates the complementarity of the nucleotide sequences of LOC170082 BINDING SITE, designated SEQ ID:40171, to the nucleotide sequence of VGAM1763 RNA, herein designated VGAM RNA, also designated SEQ ID:4474.

Another function of VGAM1763 is therefore inhibition of LOC170082 (Accession XM_093092). Accordingly, utilities of VGAM1763 include diagnosis, prevention and treatment of diseases and clinical conditions associated with LOC170082. LOC221687 (Accession XM_166423) is another VGAM1763 host target gene. LOC221687 BINDING SITE is HOST TARGET binding site found in the 3' untranslated region of mRNA encoded by LOC221687, corresponding to a HOST TARGET binding site such as BINDING SITE I, BINDING SITE II or BINDING SITE III. Table 2 illustrates the complementarity of the nucleotide sequences of LOC221687 BINDING SITE, designated SEQ ID:44308, to the nucleotide sequence of VGAM1763 RNA, herein designated VGAM RNA, also designated SEQ ID:4474.

Another function of VGAM1763 is therefore inhibition of LOC221687 (Accession XM_166423). Accordingly, utilities of VGAM1763 include diagnosis, prevention and treatment of diseases and clinical conditions associated with LOC221687. LOC255862 (Accession XM_170505) is another VGAM1763 host target gene. LOC255862 BINDING SITE is HOST TARGET binding site found in the 3' untranslated region of mRNA encoded by LOC255862, corresponding to a HOST TARGET binding site such as BINDING SITE I, BINDING SITE II or BINDING SITE III. Table 2 illustrates the complementarity of the nucleotide sequences of LOC255862 BINDING SITE, designated SEQ ID:45343, to the nucleotide sequence of VGAM1763 RNA, herein designated VGAM RNA, also designated SEQ ID:4474.

Another function of VGAM1763 is therefore inhibition of LOC255862 (Accession XM_170505). Accordingly, utilities of VGAM1763 include diagnosis, prevention and treatment of diseases and clinical conditions associated with LOC255862. FIG. 1 further provides a conceptual description of a novel bioinformatically detected viral gene of the present invention, referred to here as Viral Genomic Address Messenger 1764 (VGAM1764) viral gene, which modulates expression of respective host target genes thereof, the function and utility of which host target genes is known in the art.

VGAM1764 is a novel bioinformatically detected regulatory, non protein coding, viral micro RNA (miRNA) gene. The method by which VGAM1764 was detected is described hereinabove with reference to FIGS. 1-8.

VGAM1764 gene, herein designated VGAM GENE, is a viral gene contained in the genome of Bovine Viral Diarrhea Virus Genotype 2 (BVDV-2). VGAM1764 host target gene, herein designated VGAM HOST TARGET GENE, is a human gene contained in the human genome.

VGAM1764 gene encodes a VGAM1764 precursor RNA, herein designated VGAM PRECURSOR RNA. Similar to other miRNA genes, and unlike most ordinary genes, VGAM1764 precursor RNA does not encode a protein. A nucleotide sequence identical or highly similar to the nucleotide sequence of VGAM1764 precursor RNA is designated SEQ ID:1750, and is provided hereinbelow with reference to the sequence listing part. Nucleotide sequence SEQ ID:1750 is located at position 3861 relative to the genome of Bovine Viral Diarrhea Virus Genotype 2 (BVDV-2).

VGAM1764 precursor RNA folds onto itself, forming VGAM1764 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1764 folded precursor RNA into VGAM1764 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1764 RNA is designated SEQ ID:4475, and is provided hereinbelow with reference to the sequence listing part.

VGAM1764 host target gene, herein designated VGAM HOST TARGET GENE, encodes a corresponding messenger RNA, VGAM1764 host target RNA, herein designated VGAM HOST TARGET RNA. VGAM1764 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1764 RNA, herein designated VGAM RNA, binds complementarily to one or more host target binding sites located in untranslated regions of VGAM1764 host target RNA, herein designated VGAM HOST TARGET RNA. This complementary binding is due to the fact that the nucleotide sequence of VGAM1764 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1764 RNA, herein designated VGAM RNA, may have a different number of host target binding sites in untranslated regions of a VGAM1764 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1764 RNA, herein designated VGAM RNA, to host target binding sites on VGAM1764 host target RNA, herein designated VGAM HOST TARGET RNA, such as BINDING SITE I, BINDING SITE II and BINDING SITE III, inhibits translation of VGAM1764 host target RNA into VGAM1764 host target protein, herein designated VGAM HOST TARGET PROTEIN. VGAM host target protein is therefore outlined by a broken line.

It is appreciated that VGAM1764 host target gene, herein designated VGAM HOST TARGET GENE, in fact represents a plurality of VGAM1764 host target genes. The mRNA of each one of this plurality of VGAM1764 host target genes comprises one or more host target binding sites, each having a nucleotide sequence which is at least partly complementary to VGAM1764 RNA, herein designated VGAM RNA, and which when bound by VGAM1764 RNA causes inhibition of translation of respective one or more VGAM1764 host target proteins.

It is further appreciated by one skilled in the art that the mode of translational inhibition illustrated by FIG. 1 with specific reference to translational inhibition exerted by VGAM1764 gene, herein designated VGAM GENE, on one or more VGAM1764 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1764 is inhibition of expression of host target genes, as part of a novel viral mechanism of attacking a host. Accordingly, utilities of VGAM1764 include diagnosis, prevention and treatment of viral infection by Bovine Viral Diarrhea Virus Genotype 2 (BVDV-2). Specific functions, and accordingly utilities, of VGAM1764 correlate with, and may be deduced from, the identity of the host target genes which VGAM1764 binds and inhibits, and the function of these host target genes, as elaborated hereinbelow.

Nucleotide sequences of the VGAM1764 precursor RNA, herein designated VGAM PRECURSOR RNA, and of the 'diced' VGAM1764 RNA, herein designated VGAM RNA, and a schematic representation of the secondary folding of VGAM1764 folded precursor RNA, herein designated VGAM FOLDED PRECURSOR RNA, of VGAM1764 are further described hereinbelow with reference to Table 1.

Nucleotide sequences of host target binding sites, such as BINDING SITE-I, BINDING SITE-II and BINDING SITE-III of FIG. 1, found on VGAM1764 host target RNA, and schematic representation of the complementarity of each of these host target binding sites to VGAM1764 RNA, herein designated VGAM RNA, are described hereinbelow with reference to Table 2.

As mentioned hereinabove with reference to FIG. 1, a function of VGAM1764 gene, herein designated VGAM is inhibition of expression of VGAM1764 target genes. It is appreciated that specific functions, and accordingly utilities, of VGAM1764 correlate with, and may be deduced from, the identity of the target genes which VGAM1764 binds and inhibits, and the function of these target genes, as elaborated hereinbelow.

EGF-like-domain, Multiple 5 (EGFL5, Accession XM_098838) is a VGAM1764 host target gene. EGFL5 BINDING SITE is HOST TARGET binding site found in the 3' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41877, to the nucleotide sequence of VGAM1764 RNA, herein designated VGAM RNA, also designated SEQ ID:4475.

A function of VGAM1764 is therefore inhibition of EGF-like-domain, Multiple 5 (EGFL5, Accession XM_098838). Accordingly, utilities of VGAM1764 include diagnosis, prevention and treatment of diseases and clinical conditions associated with EGFL5. Protocadherin Beta 16 (PCDHB16, Accession NM_020957) is another VGAM1764 host target gene. PCDHB16 BINDING SITE is HOST TARGET binding site found in the 5' untranslated region of mRNA encoded by PCDHB16, corresponding to a HOST TARGET binding site such as BINDING SITE I, BINDING SITE II or BINDING SITE III. Table 2 illustrates the complementarity of the nucleotide sequences of PCDHB16 BINDING SITE, designated SEQ ID:21948, to the nucleotide sequence of VGAM1764 RNA, herein designated VGAM RNA, also designated SEQ ID:4475.

Another function of VGAM1764 is therefore inhibition of Protocadherin Beta 16 (PCDHB16, Accession NM_020957), a gene which is a potential calcium-dependent cell-adhesion protein. Accordingly, utilities of VGAM1764 include diagnosis, prevention and treatment of diseases and clinical conditions associated with PCDHB16. The function of PCDHB16 and its association with various diseases and clinical conditions, has been established by previous studies, as described hereinabove with reference to VGAM931. Tripartite Motif-containing 14 (TRIM14, Accession NM_014788) is another VGAM1764 host target gene. TRIM14 BINDING SITE is HOST TARGET binding site found in the 3' untranslated region of mRNA encoded by TRIM14, corresponding to a HOST TARGET binding site such as BINDING SITE I, BINDING SITE II or BINDING SITE III. Table 2 illustrates the complementarity of the nucleotide sequences of TRIM14 BINDING SITE, designated SEQ ID:16669, to the nucleotide sequence of VGAM1764 RNA, herein designated VGAM RNA, also designated SEQ ID:4475.

Another function of VGAM1764 is therefore inhibition of Tripartite Motif-containing 14 (TRIM14, Accession NM_014788), a gene which is composed of 3 zinc-binding domains and is involved in development and cell growth. Accordingly, utilities of VGAM1764 include diagnosis, prevention and treatment of diseases and clinical conditions associated with TRIM14. The function of TRIM14 and its association with various diseases and clinical conditions, has been established by previous studies, as described hereinabove with reference to VGAM180. Cyclin E2 (CCNE2, Accession NM_004702) is another VGAM1764 host target gene. CCNE2 BINDING SITE1 and CCNE2 BINDING SITE2 are HOST TARGET binding sites found in untranslated regions of mRNA encoded by CCNE2, corresponding to HOST TARGET binding sites such as BINDING SITE I, BINDING SITE II or BINDING SITE III. Table 2 illustrates the complementarity of the nucleotide sequences of CCNE2 BINDING SITE1 and CCNE2 BINDING SITE2, designated SEQ ID:11048 and SEQ ID:27709 respectively, to the nucleotide sequence of VGAM1764 RNA, herein designated VGAM RNA, also designated SEQ ID:4475.

Another function of VGAM1764 is therefore inhibition of Cyclin E2 (CCNE2, Accession NM_004702). Accordingly, utilities of VGAM1764 include diagnosis, prevention and treatment of diseases and clinical conditions associated with CCNE2. DKFZP566F2124 (Accession NM_015630) is another VGAM1764 host target gene. DKFZP566F2124 BINDING SITE is HOST TARGET binding site found in the 3' untranslated region of mRNA encoded by DKFZP566F2124, corresponding to a HOST TARGET binding site such as BINDING SITE I, BINDING SITE II or BINDING SITE III. Table 2 illustrates the complementarity of the nucleotide sequences of DKFZP566F2124 BINDING SITE, designated SEQ ID:17889, to the nucleotide sequence of VGAM1764 RNA, herein designated VGAM RNA, also designated SEQ ID:4475.

Another function of VGAM1764 is therefore inhibition of DKFZP566F2124 (Accession NM_015630). Accordingly, utilities of VGAM1764 include diagnosis, prevention and treatment of diseases and clinical conditions associated with DKFZP566F2124. Ecotropic Viral Integration Site 5 (EVI5, Accession NM_005665) is another VGAM1764 host target gene. EVI5 BINDING SITE is HOST TARGET binding site found in the 3' untranslated region of mRNA encoded by EVI5, corresponding to a HOST TARGET binding site such as BINDING SITE I, BINDING SITE II or BINDING SITE III. Table 2 illustrates the complementarity of the nucleotide sequences of EVI5 BINDING SITE, designated SEQ ID:12214, to the nucleotide sequence of VGAM1764 RNA, herein designated VGAM RNA, also designated SEQ ID:4475.

Another function of VGAM1764 is therefore inhibition of Ecotropic Viral Integration Site 5 (EVI5, Accession NM_005665). Accordingly, utilities of VGAM1764 include diagnosis, prevention and treatment of diseases and clinical conditions associated with EVI5. KIAA0368 (Accession XM_036708) is another VGAM1764 host target gene. KIAA0368 BINDING SITE is HOST TARGET binding site found in the 3' untranslated region of mRNA encoded by KIAA0368, corresponding to a HOST TARGET binding site such as BINDING SITE I, BINDING SITE II or BINDING SITE III. Table 2 illustrates the complementarity of the nucleotide sequences of KIAA0368 BINDING SITE, designated SEQ ID:32489, to the nucleotide sequence of VGAM1764 RNA, herein designated VGAM RNA, also designated SEQ ID:4475.

Another function of VGAM1764 is therefore inhibition of KIAA0368 (Accession XM_036708). Accordingly, utilities of VGAM1764 include diagnosis, prevention and treatment of diseases and clinical conditions associated with KIAA0368. KIAA1508 (Accession XM_030209) is another VGAM1764 host target gene. KIAA1508 BINDING SITE is HOST TARGET binding site found in the 3' untranslated region of mRNA encoded by KIAA1508, corresponding to a HOST TARGET binding site such as BINDING SITE I, BINDING SITE II or BINDING SITE III. Table 2 illustrates the complementarity of the nucleotide sequences of KIAA1508 BINDING SITE, designated SEQ ID:30996, to the nucleotide sequence of VGAM1764 RNA, herein designated VGAM RNA, also designated SEQ ID:4475.

Another function of VGAM1764 is therefore inhibition of KIAA1508 (Accession XM_030209). Accordingly, utilities of VGAM1764 include diagnosis, prevention and treatment of diseases and clinical conditions associated with KIAA1508. KIAA1535 (Accession XM_086565) is another VGAM1764 host target gene. KIAA1535 BINDING SITE is HOST TARGET binding site found in the 3' untranslated region of mRNA encoded by KIAA1535, corresponding to a HOST TARGET binding site such as BINDING SITE I, BINDING SITE II or BINDING SITE III. Table 2 illustrates the complementarity of the nucleotide sequences of KIAA1535 BINDING SITE, designated SEQ ID:38768, to the nucleotide sequence of VGAM1764 RNA, herein designated VGAM RNA, also designated SEQ ID:4475.

Another function of VGAM1764 is therefore inhibition of KIAA1535 (Accession XM_086565). Accordingly, utilities of VGAM1764 include diagnosis, prevention and treatment of diseases and clinical conditions associated with KIAA1535. MFN2 (Accession NM_014874) is another VGAM1764 host target gene. MFN2 BINDING SITE is HOST TARGET binding site found in the 3' untranslated region of mRNA encoded by MFN2, corresponding to a HOST TARGET binding site such as BINDING SITE I, BINDING SITE II or BINDING SITE III. Table 2 illustrates the complementarity of the nucleotide sequences of MFN2 BINDING SITE, designated SEQ ID:17012, to the nucleotide sequence of VGAM1764 RNA, herein designated VGAM RNA, also designated SEQ ID:4475.

Another function of VGAM1764 is therefore inhibition of MFN2 (Accession NM_014874). Accordingly, utilities of VGAM1764 include diagnosis, prevention and treatment of diseases and clinical conditions associated with MFN2. Nuclear Receptor Subfamily 6, Group A, Member 1 (NR6A1, Accession NM_001489) is another VGAM1764 host target gene. NR6A1 BINDING SITE1 through NR6A1 BINDING SITE3 are HOST TARGET binding sites found in untranslated regions of mRNA encoded by NR6A1, corresponding to HOST TARGET binding sites such as BINDING SITE I, BINDING SITE II or BINDING SITE III. Table 2 illustrates the complementarity of the nucleotide sequences of NR6A1 BINDING SITE1 through NR6A1 BINDING SITE3, designated SEQ ID:7230, SEQ ID:27178 and SEQ ID:27184 respectively, to the nucleotide sequence of VGAM1764 RNA, herein designated VGAM RNA, also designated SEQ ID:4475.

Another function of VGAM1764 is therefore inhibition of Nuclear Receptor Subfamily 6, Group A, Member 1 (NR6A1, Accession NM_001489). Accordingly, utilities of VGAM1764 include diagnosis, prevention and treatment of diseases and clinical conditions associated with NR6A1. NY-REN-60 (Accession XM_040506) is another VGAM1764 host target gene. NY-REN-60 BINDING SITE is HOST TARGET binding site found in the 3' untranslated region of mRNA encoded by NY-REN-60, corresponding to a HOST TARGET binding site such as BINDING SITE I, BINDING SITE II or BINDING SITE III. Table 2 illustrates the complementarity of the nucleotide sequences of NY-REN-60 BINDING SITE, designated SEQ ID:33319, to the nucleotide sequence of VGAM1764 RNA, herein designated VGAM RNA, also designated SEQ ID:4475.

Another function of VGAM1764 is therefore inhibition of NY-REN-60 (Accession XM_040506). Accordingly, utilities of VGAM1764 include diagnosis, prevention and treatment of diseases and clinical conditions associated with NY-REN-60. Paternally Expressed 10 (PEG10, Accession NM_015068) is another VGAM1764 host target gene. PEG10 BINDING SITE is HOST TARGET binding site found in the 3' untranslated region of mRNA encoded by PEG10, corresponding to a HOST TARGET binding site such as BINDING SITE I, BINDING SITE II or BINDING SITE III. Table 2 illustrates the complementarity of the nucleotide sequences of PEG10 BINDING SITE, designated SEQ ID:17431, to the nucleotide sequence of VGAM1764 RNA, herein designated VGAM RNA, also designated SEQ ID:4475.

Another function of VGAM1764 is therefore inhibition of Paternally Expressed 10 (PEG10, Accession NM_015068). Accordingly, utilities of VGAM1764 include diagnosis, prevention and treatment of diseases and clinical conditions associated with PEG10. Pellino Homolog 2 (Drosophila) (PELI2, Accession NM_021255) is another VGAM1764 host target gene. PELI2 BINDING SITE is HOST TARGET binding site found in the 3' untranslated region of mRNA encoded by PELI2, corresponding to a HOST TARGET binding site such as BINDING SITE I, BINDING SITE II or BINDING SITE III. Table 2 illustrates the complementarity of the nucleotide sequences of PELI2 BINDING SITE, designated SEQ ID:22228, to the nucleotide sequence of VGAM1764 RNA, herein designated VGAM RNA, also designated SEQ ID:4475.

Another function of VGAM1764 is therefore inhibition of Pellino Homolog 2 (Drosophila) (PELI2, Accession NM_021255). Accordingly, utilities of VGAM1764 include diagnosis, prevention and treatment of diseases and clinical conditions associated with PELI2. PRO2133 (Accession NM_018619) is another VGAM1764 host target gene. PRO2133 BINDING SITE is HOST TARGET binding site found in the 3' untranslated region of mRNA encoded by PRO2133, corresponding to a HOST TARGET binding site such as BINDING SITE I, BINDING SITE II or BINDING SITE III. Table 2 illustrates the complementarity of the nucleotide sequences of PRO2133 BINDING SITE, designated SEQ ID:20691, to the nucleotide sequence of VGAM1764 RNA, herein designated VGAM RNA, also designated SEQ ID:4475.

Another function of VGAM1764 is therefore inhibition of PRO2133 (Accession NM_018619). Accordingly, utilities of VGAM1764 include diagnosis, prevention and treatment of diseases and clinical conditions associated with PRO2133. Sulfotransferase Family, Cytosolic, 1C, Member 2 (SULT1C2, Accession NM_006588) is another VGAM1764 host target gene. SULT1C2 BINDING SITE is HOST TARGET binding site found in the 3' untranslated region of mRNA encoded by SULT1C2, corresponding to a HOST TARGET binding site such as BINDING SITE I, BINDING SITE II or BINDING SITE III. Table 2 illustrates the complementarity of the nucleotide sequences of SULT1C2 BINDING SITE, designated SEQ ID:13352, to the nucleotide sequence of VGAM1764 RNA, herein designated VGAM RNA, also designated SEQ ID:4475.

Another function of VGAM1764 is therefore inhibition of Sulfotransferase Family, Cytosolic, 1C, Member 2 (SULT1C2, Accession NM_006588). Accordingly, utilities of VGAM1764 include diagnosis, prevention and treatment of diseases and clinical conditions associated with SULT1C2. LOC143879 (Accession XM_084666) is another VGAM1764 host target gene. LOC143879 BINDING SITE is HOST TARGET binding site found in the 3' untranslated region of mRNA encoded by LOC143879, corresponding to a HOST TARGET binding site such as BINDING SITE I, BINDING SITE II or BINDING SITE III. Table 2 illustrates the complementarity of the nucleotide sequences of LOC143879 BINDING SITE, designated SEQ ID:37661, to the nucleotide sequence of VGAM1764 RNA, herein designated VGAM RNA, also designated SEQ ID:4475.

Another function of VGAM1764 is therefore inhibition of LOC143879 (Accession XM_084666). Accordingly, utilities of VGAM1764 include diagnosis, prevention and treatment of diseases and clinical conditions associated with LOC143879. LOC154007 (Accession XM_087824) is another VGAM1764 host target gene. LOC154007 BINDING SITE is HOST TARGET binding site found in the 3' untranslated region of mRNA encoded by LOC154007, corresponding to a HOST TARGET binding site such as BINDING SITE I, BINDING SITE II or BINDING SITE III. Table 2 illustrates the complementarity of the nucleotide sequences of LOC154007 BINDING SITE, designated SEQ ID:39453, to the nucleotide sequence of VGAM1764 RNA, herein designated VGAM RNA, also designated SEQ ID:4475.

Another function of VGAM1764 is therefore inhibition of LOC154007 (Accession XM_087824). Accordingly, utilities of VGAM1764 include diagnosis, prevention and treatment of diseases and clinical conditions associated with LOC154007. LOC203636 (Accession XM_114868) is another VGAM1764 host target gene. LOC203636 BINDING SITE is HOST TARGET binding site found in the 3' untranslated region of mRNA encoded by LOC203636, corresponding to a HOST TARGET binding site such as BINDING SITE I, BINDING SITE II or BINDING SITE III. Table 2 illustrates the complementarity of the nucleotide sequences of LOC203636 BINDING SITE, designated SEQ ID:43076, to the nucleotide sequence of VGAM1764 RNA, herein designated VGAM RNA, also designated SEQ ID:4475.

Another function of VGAM1764 is therefore inhibition of LOC203636 (Accession XM_114868). Accordingly, utilities of VGAM1764 include diagnosis, prevention and treatment of diseases and clinical conditions associated with LOC203636. LOC221477 (Accession XM_166397) is another VGAM1764 host target gene. LOC221477 BINDING SITE is HOST TARGET binding site found in the 3' untranslated region of mRNA encoded by LOC221477, corresponding to a HOST TARGET binding site such as BINDING SITE I, BINDING SITE II or BINDING SITE III. Table 2 illustrates the complementarity of the nucleotide sequences of LOC221477 BINDING SITE, designated SEQ ID:44252, to the nucleotide sequence of VGAM1764 RNA, herein designated VGAM RNA, also designated SEQ ID:4475.

Another function of VGAM1764 is therefore inhibition of LOC221477 (Accession XM_166397). Accordingly, utilities of VGAM1764 include diagnosis, prevention and treatment of diseases and clinical conditions associated with LOC221477. LOC51336 (Accession NM_016646) is another VGAM1764 host target gene. LOC51336 BINDING SITE is HOST TARGET binding site found in the 5' untranslated region of mRNA encoded by LOC51336, corresponding to a HOST TARGET binding site such as BINDING SITE I, BINDING SITE II or BINDING SITE III. Table 2 illustrates the complementarity of the nucleotide sequences of LOC51336 BINDING SITE, designated SEQ ID:18756, to the nucleotide sequence of VGAM1764 RNA, herein designated VGAM RNA, also designated SEQ ID:4475.

Another function of VGAM1764 is therefore inhibition of LOC51336 (Accession NM_016646). Accordingly, utilities of VGAM1764 include diagnosis, prevention and treatment of diseases and clinical conditions associated with LOC51336. FIG. 1 further provides a conceptual description of a novel bioinformatically detected viral gene of the present invention, referred to here as Viral Genomic Address Messenger 1765 (VGAM1765) viral gene, which modulates expression of respective host target genes thereof, the function and utility of which host target genes is known in the art.

VGAM1765 is a novel bioinformatically detected regulatory, non protein coding, viral micro RNA (miRNA) gene. The method by which VGAM1765 was detected is described hereinabove with reference to FIGS. 1-8.

VGAM1765 gene, herein designated VGAM GENE, is a viral gene contained in the genome of Bovine Viral Diarrhea Virus Genotype 2 (BVDV-2). VGAM1765 host target gene, herein designated VGAM HOST TARGET GENE, is a human gene contained in the human genome.

VGAM1765 gene encodes a VGAM1765 precursor RNA, herein designated VGAM PRECURSOR RNA. Similar to other miRNA genes, and unlike most ordinary genes, VGAM1765 precursor RNA does not encode a protein. A nucleotide sequence identical or highly similar to the nucleotide sequence of VGAM1765 precursor RNA is designated SEQ ID:1751, and is provided hereinbelow with reference to the sequence listing part. Nucleotide sequence SEQ ID:1751 is located at position 9624 relative to the genome of Bovine Viral Diarrhea Virus Genotype 2 (BVDV-2).

VGAM1765 precursor RNA folds onto itself, forming VGAM1765 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1765 folded precursor RNA into VGAM1765 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1765 RNA is designated SEQ ID:4476, and is provided hereinbelow with reference to the sequence listing part.

VGAM1765 host target gene, herein designated VGAM HOST TARGET GENE, encodes a corresponding messenger RNA, VGAM1765 host target RNA, herein designated VGAM HOST TARGET RNA. VGAM1765 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1765 RNA, herein designated VGAM RNA, binds complementarily to one or more host target binding sites located in untranslated regions of VGAM1765 host target RNA, herein designated VGAM HOST TARGET RNA. This complementary binding is due to the fact that the nucleotide sequence of VGAM1765 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1765 RNA, herein designated VGAM RNA, may have a different number of host target binding sites in untranslated regions of a VGAM1765 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1765 RNA, herein designated VGAM RNA, to host target binding sites on VGAM1765 host target RNA, herein designated VGAM HOST TARGET RNA, such as BINDING SITE I, BINDING SITE II and BINDING SITE III, inhibits translation of VGAM1765 host target RNA into VGAM1765 host target protein, herein designated VGAM HOST TARGET PROTEIN. VGAM host target protein is therefore outlined by a broken line.

It is appreciated that VGAM1765 host target gene, herein designated VGAM HOST TARGET GENE, in fact represents a plurality of VGAM1765 host target genes. The mRNA of each one of this plurality of VGAM1765 host target genes comprises one or more host target binding sites, each having a nucleotide sequence which is at least partly complementary to VGAM1765 RNA, herein designated VGAM RNA, and which when bound by VGAM1765 RNA causes inhibition of translation of respective one or more VGAM1765 host target proteins.

It is further appreciated by one skilled in the art that the mode of translational inhibition illustrated by FIG. 1 with specific reference to translational inhibition exerted by VGAM1765 gene, herein designated VGAM GENE, on one or more VGAM1765 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1765 is inhibition of expression of host target genes, as part of a novel viral mechanism of attacking a host. Accordingly, utilities of VGAM1765 include diagnosis, prevention and treatment of viral infection by Bovine Viral Diarrhea Virus Genotype 2 (BVDV-2). Specific functions, and accordingly utilities, of VGAM1765 correlate with, and may be deduced from, the identity of the host target genes which VGAM1765 binds and inhibits, and the function of these host target genes, as elaborated hereinbelow.

Nucleotide sequences of the VGAM1765 precursor RNA, herein designated VGAM PRECURSOR RNA, and of the 'diced' VGAM1765 RNA, herein designated VGAM RNA, and a schematic representation of the secondary folding of VGAM1765 folded precursor RNA, herein designated VGAM FOLDED PRECURSOR RNA, of VGAM1765 are further described hereinbelow with reference to Table 1.

Nucleotide sequences of host target binding sites, such as BINDING SITE-I, BINDING SITE-II and BINDING SITE-III of FIG. 1, found on VGAM1765 host target RNA, and schematic representation of the complementarity of each of these host target binding sites to VGAM1765 RNA, herein designated VGAM RNA, are described hereinbelow with reference to Table 2.

As mentioned hereinabove with reference to FIG. 1, a function of VGAM1765 gene, herein designated VGAM is inhibition of expression of VGAM1765 target genes. It is appreciated that specific functions, and accordingly utilities, of VGAM1765 correlate with, and may be deduced from, the identity of the target genes which VGAM1765 binds and inhibits, and the function of these target genes, as elaborated hereinbelow.

Cyclin D1 (PRAD1: parathyroid adenomatosis 1) (CCND1, Accession NM_053056) is a VGAM1765 host target gene. CCND1 BINDING SITE is HOST TARGET binding site found in the 3' untranslated region of mRNA encoded by CCND1, corresponding to a HOST TARGET binding site such as BINDING SITE I, BINDING SITE II or BINDING SITE III. Table 2 illustrates the complementarity of the nucleotide sequences of CCND1 BINDING SITE, designated SEQ ID:27597, to the nucleotide sequence of VGAM1765 RNA, herein designated VGAM RNA, also designated SEQ ID:4476.

A function of VGAM1765 is therefore inhibition of Cyclin D1 (PRAD1: parathyroid adenomatosis 1) (CCND1, Accession NM_053056), a gene which is involved in the control of cell cycle and is required for Schwann cell proliferation to proceed normally during Wallerian degeneration. Accordingly, utilities of VGAM1765 include diagnosis, prevention and treatment of diseases and clinical conditions associated with CCND1. The function of CCND1 and its association with various diseases and clinical conditions, has been established by previous studies, as described hereinabove with reference to VGAM220. LOC157280 (Accession XM_058301) is another VGAM1765 host target gene. LOC157280 BINDING SITE is HOST TARGET binding site found in the 5' untranslated region of mRNA encoded by LOC157280, corresponding to a HOST TARGET binding site such as BINDING SITE I, BINDING SITE II or BINDING SITE III. Table 2 illustrates the complementarity of the nucleotide sequences of LOC157280 BINDING SITE, designated SEQ ID:36591, to the nucleotide sequence of VGAM1765 RNA, herein designated VGAM RNA, also designated SEQ ID:4476.

Another function of VGAM1765 is therefore inhibition of LOC157280 (Accession XM_058301). Accordingly, utilities of VGAM1765 include diagnosis, prevention and treatment of diseases and clinical conditions associated with LOC157280. LOC255448 (Accession XM_170623) is another VGAM1765 host target gene. LOC255448 BINDING SITE is HOST TARGET binding site found in the 5' untranslated region of mRNA encoded by LOC255448, corresponding to a HOST TARGET binding site such as BINDING SITE I, BINDING SITE II or BINDING SITE III. Table 2 illustrates the complementarity of the nucleotide sequences of LOC255448 BINDING SITE, designated SEQ ID:45401, to the nucleotide sequence of VGAM1765 RNA, herein designated VGAM RNA, also designated SEQ ID:4476.

Another function of VGAM1765 is therefore inhibition of LOC255448 (Accession XM_170623). Accordingly, utilities of VGAM1765 include diagnosis, prevention and treatment of diseases and clinical conditions associated with LOC255448. LOC92661 (Accession XM_046465) is another VGAM1765 host target gene. LOC92661 BINDING SITE is HOST TARGET binding site found in the 3' untranslated region of mRNA encoded by LOC92661, corresponding to a HOST TARGET binding site such as BINDING SITE I, BINDING SITE II or BINDING SITE III. Table 2 illustrates the complementarity of the nucleotide sequences of LOC92661 BINDING SITE, designated SEQ ID:34720, to the nucleotide sequence of VGAM1765 RNA, herein designated VGAM RNA, also designated SEQ ID:4476.

Another function of VGAM1765 is therefore inhibition of LOC92661 (Accession XM_046465). Accordingly, utilities of VGAM1765 include diagnosis, prevention and treatment of diseases and clinical conditions associated with LOC92661. FIG. 1 further provides a conceptual description of a novel bioinformatically detected viral gene of the present invention, referred to here as Viral Genomic Address Messenger 1766 (VGAM1766) viral gene, which modulates expression of respective host target genes thereof, the function and utility of which host target genes is known in the art.

VGAM1766 is a novel bioinformatically detected regulatory, non protein coding, viral micro RNA (miRNA) gene. The method by which VGAM1766 was detected is described hereinabove with reference to FIGS. 1-8.

VGAM1766 gene, herein designated VGAM GENE, is a viral gene contained in the genome of Bovine Viral Diarrhea Virus Genotype 2 (BVDV-2). VGAM1766 host target gene, herein designated VGAM HOST TARGET GENE, is a human gene contained in the human genome.

VGAM1766 gene encodes a VGAM1766 precursor RNA, herein designated VGAM PRECURSOR RNA. Similar to other miRNA genes, and unlike most ordinary genes, VGAM1766 precursor RNA does not encode a protein. A nucleotide sequence identical or highly similar to the nucleotide sequence of VGAM1766 precursor RNA is designated SEQ ID:1752, and is provided hereinbelow with reference to the sequence listing part. Nucleotide sequence SEQ ID:1752 is located at position 5325 relative to the genome of Bovine Viral Diarrhea Virus Genotype 2 (BVDV-2).

VGAM1766 precursor RNA folds onto itself, forming VGAM1766 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1766 folded precursor RNA into VGAM1766 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1766 RNA is designated SEQ ID:4477, and is provided hereinbelow with reference to the sequence listing part.

VGAM1766 host target gene, herein designated VGAM HOST TARGET GENE, encodes a corresponding messenger RNA, VGAM1766 host target RNA, herein designated VGAM HOST TARGET RNA. VGAM1766 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1766 RNA, herein designated VGAM RNA, binds complementarily to one or more host target binding sites located in untranslated regions of VGAM1766 host target RNA, herein designated VGAM HOST TARGET RNA. This complementary binding is due to the fact that the nucleotide sequence of VGAM1766 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1766 RNA, herein designated VGAM RNA, may have a different number of host target binding sites in untranslated regions of a VGAM1766 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1766 RNA, herein designated VGAM RNA, to host target binding sites on VGAM1766 host target RNA, herein designated VGAM HOST TARGET RNA, such as BINDING SITE I, BINDING SITE II and BINDING SITE III, inhibits translation of VGAM1766 host target RNA into VGAM1766 host target protein, herein designated VGAM HOST TARGET PROTEIN. VGAM host target protein is therefore outlined by a broken line.

It is appreciated that VGAM1766 host target gene, herein designated VGAM HOST TARGET GENE, in fact represents a plurality of VGAM1766 host target genes. The mRNA of each one of this plurality of VGAM1766 host target genes comprises one or more host target binding sites, each having a nucleotide sequence which is at least partly complementary to VGAM1766 RNA, herein designated VGAM RNA, and which when bound by VGAM1766 RNA causes inhibition of translation of respective one or more VGAM1766 host target proteins.

It is further appreciated by one skilled in the art that the mode of translational inhibition illustrated by FIG. 1 with specific reference to translational inhibition exerted by VGAM1766 gene, herein designated VGAM GENE, on one or more VGAM1766 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1766 is inhibition of expression of host target genes, as part of a novel viral mechanism of attacking a host. Accordingly, utilities of VGAM1766 include diagnosis, prevention and treatment of viral infection by Bovine Viral Diarrhea Virus Genotype 2 (BVDV-2). Specific functions, and accordingly utilities, of VGAM1766 correlate with, and may be deduced from, the identity of the host target genes which VGAM1766 binds and inhibits, and the function of these host target genes, as elaborated hereinbelow.

Nucleotide sequences of the VGAM1766 precursor RNA, herein designated VGAM PRECURSOR RNA, and of the 'diced' VGAM1766 RNA, herein designated VGAM RNA, and a schematic representation of the secondary folding of VGAM1766 folded precursor RNA, herein designated VGAM FOLDED PRECURSOR RNA, of VGAM1766 are further described hereinbelow with reference to Table 1.

Nucleotide sequences of host target binding sites, such as BINDING SITE-I, BINDING SITE-II and BINDING SITE-III of FIG. 1, found on VGAM1766 host target RNA, and schematic representation of the complementarity of each of these host target binding sites to VGAM1766 RNA, herein designated VGAM RNA, are described hereinbelow with reference to Table 2.

As mentioned hereinabove with reference to FIG. 1, a function of VGAM1766 gene, herein designated VGAM is inhibition of expression of VGAM1766 target genes. It is appreciated that specific functions, and accordingly utilities, of VGAM1766 correlate with, and may be deduced from, the identity of the target genes which VGAM1766 binds and inhibits, and the function of these target genes, as elaborated hereinbelow.

Serine/arginine Repetitive Matrix 1 (SRRM1, Accession NM_005839) is a VGAM1766 host target gene. SRRM1 BINDING SITE is HOST TARGET binding site found in the 3' untranslated region of mRNA encoded by SRRM1, corresponding to a HOST TARGET binding site such as BINDING SITE I, BINDING SITE II or BINDING SITE III. Table 2 illustrates the complementarity of the nucleotide sequences of SRRM1 BINDING SITE, designated SEQ ID:12451, to the nucleotide sequence of VGAM1766 RNA, herein designated VGAM RNA, also designated SEQ ID:4477.

A function of VGAM1766 is therefore inhibition of Serine/arginine Repetitive Matrix 1 (SRRM1, Accession NM_005839). Accordingly, utilities of VGAM1766 include diagnosis, prevention and treatment of diseases and clinical conditions associated with SRRM1. Serine/threonine Kinase 38 (STK38, Accession NM_007271) is another VGAM1766 host target gene. STK38 BINDING SITE is HOST TARGET binding site found in the 5' untranslated region of mRNA encoded by STK38, corresponding to a HOST TARGET binding site such as BINDING SITE I, BINDING SITE II or BINDING SITE III. Table 2 illustrates the complementarity of the nucleotide sequences of STK38 BINDING SITE, designated SEQ ID:14133, to the nucleotide sequence of VGAM1766 RNA, herein designated VGAM RNA, also designated SEQ ID:4477.

Another function of VGAM1766 is therefore inhibition of Serine/threonine Kinase 38 (STK38, Accession NM_007271). Accordingly, utilities of VGAM1766 include diagnosis, prevention and treatment of diseases and clinical conditions associated with STK38. Ras Homolog Gene Family, Member U (ARHU, Accession NM_021205) is another VGAM1766 host target gene. ARHU BINDING SITE is HOST TARGET binding site found in the 3' untranslated region of mRNA encoded by ARHU, corresponding to a HOST TARGET binding site such as BINDING SITE I, BINDING SITE II or BINDING SITE III. Table 2 illustrates the complementarity of the nucleotide sequences of ARHU BINDING SITE, designated SEQ ID:22183, to the nucleotide sequence of VGAM1766 RNA, herein designated VGAM RNA, also designated SEQ ID:4477.

Another function of VGAM1766 is therefore inhibition of Ras Homolog Gene Family, Member U (ARHU, Accession NM_021205). Accordingly, utilities of VGAM1766 include diagnosis, prevention and treatment of diseases and clinical conditions associated with ARHU. Thioesterase, Adipose Associated (THEA, Accession XM_038922) is another VGAM1766 host target gene. THEA BINDING SITE is HOST TARGET binding site found in the 3' untranslated region of mRNA encoded by THEA, corresponding to a HOST TARGET binding site such as BINDING SITE I, BINDING SITE II or BINDING SITE III. Table 2 illustrates the complementarity of the nucleotide sequences of THEA BINDING SITE, designated SEQ ID:32951, to the nucleotide sequence of VGAM1766 RNA, herein designated VGAM RNA, also designated SEQ ID:4477.

Another function of VGAM1766 is therefore inhibition of Thioesterase, Adipose Associated (THEA, Accession XM_038922). Accordingly, utilities of VGAM1766 include diagnosis, prevention and treatment of diseases and clinical conditions associated with THEA. Zinc Finger Protein 347 (ZNF347, Accession NM_032584) is another VGAM1766 host target gene. ZNF347 BINDING SITE is HOST TARGET binding site found in the 3' untranslated region of mRNA encoded by ZNF347, corresponding to a HOST TARGET binding site such as BINDING SITE I, BINDING SITE II or BINDING SITE III. Table 2 illustrates the complementarity of the nucleotide sequences of ZNF347 BINDING SITE, designated SEQ ID:26318, to the nucleotide sequence of VGAM1766 RNA, herein designated VGAM RNA, also designated SEQ ID:4477.

Another function of VGAM1766 is therefore inhibition of Zinc Finger Protein 347 (ZNF347, Accession NM_032584). Accordingly, utilities of VGAM1766 include diagnosis, prevention and treatment of diseases and clinical conditions associated with ZNF347. LOC131873 (Accession XM_067585) is another VGAM1766 host target gene. LOC131873 BINDING SITE is HOST TARGET binding site found in the 5' untranslated region of mRNA encoded by LOC131873, corresponding to a HOST TARGET binding site such as BINDING SITE I, BINDING SITE II or BINDING SITE III. Table 2 illustrates the complementarity of the nucleotide sequences of LOC131873 BINDING SITE, designated SEQ ID:37364, to the nucleotide sequence of VGAM1766 RNA, herein designated VGAM RNA, also designated SEQ ID:4477.

Another function of VGAM1766 is therefore inhibition of LOC131873 (Accession XM_067585). Accordingly, utilities of VGAM1766 include diagnosis, prevention and treatment of diseases and clinical conditions associated with LOC131873. LOC143465 (Accession XM_096430) is another VGAM1766 host target gene. LOC143465 BINDING SITE is HOST TARGET binding site found in the 5' untranslated region of mRNA encoded by LOC143465, corresponding to a HOST TARGET binding site such as BINDING SITE I, BINDING SITE II or BINDING SITE III. Table 2 illustrates the complementarity of the nucleotide sequences of LOC143465 BINDING SITE, designated SEQ ID:40359, to the nucleotide sequence of VGAM1766 RNA, herein designated VGAM RNA, also designated SEQ ID:4477.

Another function of VGAM1766 is therefore inhibition of LOC143465 (Accession XM_096430). Accordingly, utilities of VGAM1766 include diagnosis, prevention and treatment of diseases and clinical conditions associated with LOC143465. LOC158927 (Accession XM_099004) is another VGAM1766 host target gene. LOC158927 BINDING SITE is HOST TARGET binding site found in the 3' untranslated region of mRNA encoded by LOC158927, corresponding to a HOST TARGET binding site such as BINDING SITE I, BINDING SITE II or BINDING SITE III. Table 2 illustrates the complementarity of the nucleotide sequences of LOC158927 BINDING SITE, designated SEQ ID:42041, to the nucleotide sequence of VGAM1766 RNA, herein designated VGAM RNA, also designated SEQ ID:4477.

Another function of VGAM1766 is therefore inhibition of LOC158927 (Accession XM_099004). Accordingly, utilities of VGAM1766 include diagnosis, prevention and treatment of diseases and clinical conditions associated with LOC158927. LOC221495 (Accession XM_168136) is another VGAM1766 host target gene. LOC221495 BINDING SITE is HOST TARGET binding site found in the 5' untranslated region of mRNA encoded by LOC221495, corresponding to a HOST TARGET binding site such as BINDING SITE I, BINDING SITE II or BINDING SITE III. Table 2 illustrates the complementarity of the nucleotide sequences of LOC221495 BINDING SITE, designated SEQ ID:45054, to the nucleotide sequence of VGAM1766 RNA, herein designated VGAM RNA, also designated SEQ ID:4477.

Another function of VGAM1766 is therefore inhibition of LOC221495 (Accession XM_168136). Accordingly, utilities of VGAM1766 include diagnosis, prevention and treatment of diseases and clinical conditions associated with LOC221495. LOC257319 (Accession XM_171049) is another VGAM1766 host target gene. LOC257319 BINDING SITE is HOST TARGET binding site found in the 3' untranslated region of mRNA encoded by LOC257319, corresponding to a HOST TARGET binding site such as BINDING SITE I, BINDING SITE II or BINDING SITE III. Table 2 illustrates the complementarity of the nucleotide sequences of LOC257319 BINDING SITE, designated SEQ ID:45832, to the nucleotide sequence of VGAM1766 RNA, herein designated VGAM RNA, also designated SEQ ID:4477.

Another function of VGAM1766 is therefore inhibition of LOC257319 (Accession XM_171049). Accordingly, utilities of VGAM1766 include diagnosis, prevention and treatment of diseases and clinical conditions associated with LOC257319. LOC51031 (Accession NM_016080) is another VGAM1766 host target gene. LOC51031 BINDING SITE is HOST TARGET binding site found in the 3' untranslated region of mRNA encoded by LOC51031, corresponding to a HOST TARGET binding site such as BINDING SITE I, BINDING SITE II or BINDING SITE III. Table 2 illustrates the complementarity of the nucleotide sequences of LOC51031 BINDING SITE, designated SEQ ID:18153, to the nucleotide sequence of VGAM1766 RNA, herein designated VGAM RNA, also designated SEQ ID:4477.

Another function of VGAM1766 is therefore inhibition of LOC51031 (Accession NM_016080). Accordingly, utilities of VGAM1766 include diagnosis, prevention and treatment of diseases and clinical conditions associated with LOC51031. FIG. 1 further provides a conceptual description of a novel bioinformatically detected viral gene of the present invention, referred to here as Viral Genomic Address Messenger 1767 (VGAM1767) viral gene, which modulates expression of respective host target genes thereof, the function and utility of which host target genes is known in the art.

VGAM1767 is a novel bioinformatically detected regulatory, non protein coding, viral micro RNA (miRNA) gene. The method by which VGAM1767 was detected is described hereinabove with reference to FIGS. 1-8.

VGAM1767 gene, herein designated VGAM GENE, is a viral gene contained in the genome of Rabbit Fibroma Virus. VGAM1767 host target gene, herein designated VGAM HOST TARGET GENE, is a human gene contained in the human genome.

VGAM1767 gene encodes a VGAM1767 precursor RNA, herein designated VGAM PRECURSOR RNA. Similar to other miRNA genes, and unlike most ordinary genes, VGAM1767 precursor RNA does not encode a protein. A nucleotide sequence identical or highly similar to the nucleotide sequence of VGAM1767 precursor RNA is designated SEQ ID:1753, and is provided hereinbelow with reference to the sequence listing part. Nucleotide sequence SEQ ID:1753 is located at position 1407 relative to the genome of Rabbit Fibroma Virus.

VGAM1767 precursor RNA folds onto itself, forming VGAM1767 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1767 folded precursor RNA into VGAM1767 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1767 RNA is designated SEQ ID:4478, and is provided hereinbelow with reference to the sequence listing part.

VGAM1767 host target gene, herein designated VGAM HOST TARGET GENE, encodes a corresponding messenger RNA, VGAM1767 host target RNA, herein designated VGAM HOST TARGET RNA. VGAM1767 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1767 RNA, herein designated VGAM RNA, binds complementarily to one or more host target binding sites located in untranslated regions of VGAM1767 host target RNA, herein designated VGAM HOST TARGET RNA. This complementary binding is due to the fact that the nucleotide sequence of VGAM1767 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1767 RNA, herein designated VGAM RNA, may have a different number of host target binding sites in untranslated regions of a VGAM1767 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1767 RNA, herein designated VGAM RNA, to host target binding sites on VGAM1767 host target RNA, herein designated VGAM HOST TARGET RNA, such as BINDING SITE I, BINDING SITE II and BINDING SITE III, inhibits translation of VGAM1767 host target RNA into VGAM1767 host target protein, herein designated VGAM HOST TARGET PROTEIN. VGAM host target protein is therefore outlined by a broken line.

It is appreciated that VGAM1767 host target gene, herein designated VGAM HOST TARGET GENE, in fact represents a plurality of VGAM1767 host target genes. The mRNA of each one of this plurality of VGAM1767 host target genes comprises one or more host target binding sites, each having a nucleotide sequence which is at least partly complementary to VGAM1767 RNA, herein designated VGAM RNA, and which when bound by VGAM1767 RNA causes inhibition of translation of respective one or more VGAM1767 host target proteins.

It is further appreciated by one skilled in the art that the mode of translational inhibition illustrated by FIG. 1 with specific reference to translational inhibition exerted by VGAM1767 gene, herein designated VGAM GENE, on one or more VGAM1767 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1767 is inhibition of expression of host target genes, as part of a novel viral mechanism of attacking a host. Accordingly, utilities of VGAM1767 include diagnosis, prevention and treatment of viral infection by Rabbit Fibroma Virus. Specific functions, and accordingly utilities, of VGAM1767 correlate with, and may be deduced from, the identity of the host target genes which VGAM1767 binds and inhibits, and the function of these host target genes, as elaborated hereinbelow.

Nucleotide sequences of the VGAM1767 precursor RNA, herein designated VGAM PRECURSOR RNA, and of the 'diced' VGAM1767 RNA, herein designated VGAM RNA, and a schematic representation of the secondary folding of VGAM1767 folded precursor RNA, herein designated VGAM FOLDED PRECURSOR RNA, of VGAM1767 are further described hereinbelow with reference to Table 1.

Nucleotide sequences of host target binding sites, such as BINDING SITE-I, BINDING SITE-II and BINDING SITE-III of FIG. 1, found on VGAM1767 host target RNA, and schematic representation of the complementarity of each of these host target binding sites to VGAM1767 RNA, herein designated VGAM RNA, are described hereinbelow with reference to Table 2.

As mentioned hereinabove with reference to FIG. 1, a function of VGAM1767 gene, herein designated VGAM is inhibition of expression of VGAM1767 target genes. It is appreciated that specific functions, and accordingly utilities, of VGAM1767 correlate with, and may be deduced from, the identity of the target genes which VGAM1767 binds and inhibits, and the function of these target genes, as elaborated hereinbelow.

Cystic Fibrosis Transmembrane Conductance Regulator, ATP-binding Cassette (sub-family C, member 7) (CFTR, Accession NM_000492) is a VGAM1767 host target gene. CFTR BINDING SITE is HOST TARGET binding site found in the 3" untranslated region of mRNA encoded by CFTR, corresponding to a HOST TARGET binding site such as BINDING SITE I, BINDING SITE II or BINDING SITE III. Table 2 illustrates the complementarity of the nucleotide sequences of CFTR BINDING SITE, designated SEQ ID:6102, to the nucleotide sequence of VGAM1767 RNA, herein designated VGAM RNA, also designated SEQ ID:4478.

A function of VGAM1767 is therefore inhibition of Cystic Fibrosis Transmembrane Conductance Regulator, ATP-binding Cassette (sub-family C, member 7) (CFTR, Accession NM_000492). Accordingly, utilities of VGAM1767 include diagnosis, prevention and treatment of diseases and clinical conditions associated with CFTR. Exostoses (multiple)-like 3 (EXTL3, Accession NM_001440) is another VGAM1767 host target gene. EXTL3 BINDING SITE is HOST TARGET binding site found in the 5' untranslated region of mRNA encoded by EXTL3, corresponding to a HOST TARGET binding site such as BINDING SITE I, BINDING SITE II or BINDING SITE III. Table 2 illustrates the complementarity of the nucleotide sequences of EXTL3 BINDING SITE, designated SEQ ID:7167, to the nucleotide sequence of VGAM1767 RNA, herein designated VGAM RNA, also designated SEQ ID:4478.

Another function of VGAM1767 is therefore inhibition of Exostoses (multiple)-like 3 (EXTL3, Accession NM_001440), a gene which a member of the multiple exostoses gene family. Accordingly, utilities of VGAM1767 include diagnosis, prevention and treatment of diseases and clinical conditions associated with EXTL3. The function of EXTL3 and its association with various diseases and clinical conditions, has been established by previous studies, as described hereinabove with reference to VGAM95. Guanine Nucleotide Binding Protein (G protein), Alpha Inhibiting Activity Polypeptide 3 (GNAI3, Accession NM_006496) is another VGAM1767 host target gene. GNAI3 BINDING SITE is HOST TARGET binding site found in the 3' untranslated region of mRNA encoded by GNAI3, corresponding to a HOST TARGET binding site such as BINDING SITE I, BINDING SITE II or BINDING SITE III. Table 2 illustrates the complementarity of the nucleotide sequences of GNAI3 BINDING SITE, designated SEQ ID:13241, to the nucleotide sequence of VGAM1767 RNA, herein designated VGAM RNA, also designated SEQ ID:4478.

Another function of VGAM1767 is therefore inhibition of Guanine Nucleotide Binding Protein (G protein), Alpha Inhibiting Activity Polypeptide 3 (GNAI3, Accession NM_006496), a gene which stimulates receptor regulated K+-channels. Accordingly, utilities of VGAM1767 include diagnosis, prevention and treatment of diseases and clinical conditions associated with GNAI3. The function of GNAI3 and its association with various diseases and clinical conditions, has been established by previous studies, as described hereinabove with reference to VGAM45. Formin Binding Protein 3 (FNBP3, Accession XM_087118) is another VGAM1767 host target gene. FNBP3 BINDING SITE is HOST TARGET binding site found in the 3' untranslated region of mRNA encoded by FNBP3, corresponding to a HOST TARGET binding site such as BINDING SITE I, BINDING SITE II or BINDING SITE III. Table 2 illustrates the complementarity of the nucleotide sequences of FNBP3 BINDING SITE, designated SEQ ID:39074, to the nucleotide sequence of VGAM1767 RNA, herein designated VGAM RNA, also designated SEQ ID:4478.

Another function of VGAM1767 is therefore inhibition of Formin Binding Protein 3 (FNBP3, Accession XM_087118). Accordingly, utilities of VGAM1767 include diagnosis, prevention and treatment of diseases and clinical conditions associated with FNBP3. KIAA0781 (Accession XM_041314) is another VGAM1767 host target gene. KIAA0781 BINDING SITE is HOST TARGET binding site found in the 3' untranslated region of mRNA encoded by KIAA0781, corresponding to a HOST TARGET binding site such as BINDING SITE I, BINDING SITE II or BINDING SITE III. Table 2 illustrates the complementarity of the nucleotide sequences of KIAA0781 BINDING SITE, designated SEQ ID:33501, to the nucleotide sequence of VGAM1767 RNA, herein designated VGAM RNA, also designated SEQ ID:4478.

Another function of VGAM1767 is therefore inhibition of KIAA0781 (Accession XM_041314). Accordingly, utilities of VGAM1767 include diagnosis, prevention and treatment of diseases and clinical conditions associated with KIAA0781. KIAA1715 (Accession XM_042834) is another VGAM1767 host target gene. KIAA1715 BINDING SITE is HOST TARGET binding site found in the 3' untranslated region of mRNA encoded by KIAA1715, corresponding to a HOST TARGET binding site such as BINDING SITE I, BINDING SITE II or BINDING SITE III. Table 2 illustrates the complementarity of the nucleotide sequences of KIAA1715 BINDING SITE, designated SEQ ID:33793, to the nucleotide sequence of VGAM1767 RNA, herein designated VGAM RNA, also designated SEQ ID:4478.

Another function of VGAM1767 is therefore inhibition of KIAA1715 (Accession XM_042834). Accordingly, utilities of VGAM1767 include diagnosis, prevention and treatment of diseases and clinical conditions associated with KIAA1715. PIP3-E (Accession XM_039749) is another VGAM1767 host target gene. PIP3-E BINDING SITE is HOST TARGET binding site found in the 3' untranslated region of mRNA encoded by PIP3-E, corresponding to a HOST TARGET binding site such as BINDING SITE I, BINDING SITE II or BINDING SITE III. Table 2 illustrates the complementarity of the nucleotide sequences of PIP3-E BINDING SITE, designated SEQ ID:33179, to the nucleotide sequence of VGAM1767 RNA, herein designated VGAM RNA, also designated SEQ ID:4478.

Another function of VGAM1767 is therefore inhibition of PIP3-E (Accession XM_039749). Accordingly, utilities of VGAM1767 include diagnosis, prevention and treatment of diseases and clinical conditions associated with PIP3-E. Splicing Factor, Arginine/serine-rich 5 (SFRS5, Accession NM_006925) is another VGAM1767 host target gene. SFRS5 BINDING SITE is HOST TARGET binding site found in the 5' untranslated region of mRNA encoded by SFRS5, corresponding to a HOST TARGET binding site such as BINDING SITE I, BINDING SITE II or BINDING SITE III. Table 2 illustrates the complementarity of the nucleotide sequences of SFRS5 BINDING SITE, designated SEQ ID:13805, to the nucleotide sequence of VGAM1767 RNA, herein designated VGAM RNA, also designated SEQ ID:4478.

Another function of VGAM1767 is therefore inhibition of Splicing Factor, Arginine/serine-rich 5 (SFRS5, Accession NM_006925). Accordingly, utilities of VGAM1767 include diagnosis, prevention and treatment of diseases and clinical conditions associated with SFRS5. LOC160414 (Accession XM_100898) is another VGAM1767 host target gene. LOC160414 BINDING SITE is HOST TARGET binding site found in the 5' untranslated region of mRNA encoded by LOC160414, corresponding to a HOST TARGET binding site such as BINDING SITE I, BINDING SITE II or BINDING SITE III. Table 2 illustrates the complementarity of the nucleotide sequences of LOC160414 BINDING SITE, designated SEQ ID:42104, to the nucleotide sequence of VGAM1767 RNA, herein designated VGAM RNA, also designated SEQ ID:4478.

Another function of VGAM1767 is therefore inhibition of LOC160414 (Accession XM_100898). Accordingly, utilities of VGAM1767 include diagnosis, prevention and treatment of diseases and clinical conditions associated with LOC160414. LOC170217 (Accession XM_093185) is another VGAM1767 host target gene. LOC170217 BINDING SITE is HOST TARGET binding site found in the 5' untranslated region of mRNA encoded by LOC170217, corresponding to a HOST TARGET binding site such as BINDING SITE I, BINDING SITE II or BINDING SITE III. Table 2 illustrates the complementarity of the nucleotide sequences of LOC170217 BINDING SITE, designated SEQ ID:40179, to the nucleotide sequence of VGAM1767 RNA, herein designated VGAM RNA, also designated SEQ ID:4478.

Another function of VGAM1767 is therefore inhibition of LOC170217 (Accession XM_093185). Accordingly, utilities of VGAM1767 include diagnosis, prevention and treatment of diseases and clinical conditions associated with LOC170217. LOC170218 (Accession XM_093186) is another VGAM1767 host target gene. LOC170218 BINDING SITE is HOST TARGET binding site found in the 5' untranslated region of mRNA encoded by LOC170218, corresponding to a HOST TARGET binding site such as BINDING SITE I, BINDING SITE II or BINDING SITE III. Table 2 illustrates the complementarity of the nucleotide sequences of LOC170218 BINDING SITE, designated SEQ ID:40181, to the nucleotide sequence of VGAM1767 RNA, herein designated VGAM RNA, also designated SEQ ID:4478.

Another function of VGAM1767 is therefore inhibition of LOC170218 (Accession XM_093186). Accordingly, utilities of VGAM1767 include diagnosis, prevention and treatment of diseases and clinical conditions associated with LOC170218. LOC206887 (Accession XM_116781) is another VGAM1767 host target gene. LOC206887 BINDING SITE is HOST TARGET binding site found in the 5' untranslated region of mRNA encoded by LOC206887, corresponding to a HOST TARGET binding site such as BINDING SITE I, BINDING SITE II or BINDING SITE III. Table 2 illustrates the complementarity of the nucleotide sequences of LOC206887 BINDING SITE, designated SEQ ID:43125, to the nucleotide sequence of VGAM1767 RNA, herein designated VGAM RNA, also designated SEQ ID:4478.

Another function of VGAM1767 is therefore inhibition of LOC206887 (Accession XM_116781). Accordingly, utilities of VGAM1767 include diagnosis, prevention and treatment of diseases and clinical conditions associated with LOC206887. FIG. 1 further provides a conceptual description of a novel bioinformatically detected viral gene of the present invention, referred to here as Viral Genomic Address Messenger 1768 (VGAM1768) viral gene, which modulates expression of respective host target genes thereof, the function and utility of which host target genes is known in the art.

VGAM1768 is a novel bioinformatically detected regulatory, non protein coding, viral micro RNA (miRNA) gene. The method by which VGAM1768 was detected is described hereinabove with reference to FIGS. 1-8.

VGAM1768 gene, herein designated VGAM GENE, is a viral gene contained in the genome of Rabbit Fibroma Virus. VGAM1768 host target gene, herein designated VGAM HOST TARGET GENE, is a human gene contained in the human genome.

VGAM1768 gene encodes a VGAM1768 precursor RNA, herein designated VGAM PRECURSOR RNA. Similar to other miRNA genes, and unlike most ordinary genes, VGAM1768 precursor RNA does not encode a protein. A nucleotide sequence identical or highly similar to the nucleotide sequence of VGAM1768 precursor RNA is designated SEQ ID:1754, and is provided hereinbelow with reference to the sequence listing part. Nucleotide sequence SEQ ID:1754 is located at position 431 relative to the genome of Rabbit Fibroma Virus.

VGAM1768 precursor RNA folds onto itself, forming VGAM1768 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1768 folded precursor RNA into VGAM1768 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1768 RNA is designated SEQ ID:4479, and is provided hereinbelow with reference to the sequence listing part.

VGAM1768 host target gene, herein designated VGAM HOST TARGET GENE, encodes a corresponding messenger RNA, VGAM1768 host target RNA, herein designated VGAM HOST TARGET RNA. VGAM1768 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1768 RNA, herein designated VGAM RNA, binds complementarily to one or more host target binding sites located in untranslated regions of VGAM1768 host target RNA, herein designated VGAM HOST TARGET RNA. This complementary binding is due to the fact that the nucleotide sequence of VGAM1768 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1768 RNA, herein designated VGAM RNA, may have a different number of host target binding sites in untranslated regions of a VGAM1768 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1768 RNA, herein designated VGAM RNA, to host target binding sites on VGAM1768 host target RNA, herein designated VGAM HOST TARGET RNA, such as BINDING SITE I, BINDING SITE II and BINDING SITE III, inhibits translation of VGAM1768 host target RNA into VGAM1768 host target protein, herein designated VGAM HOST TARGET PROTEIN. VGAM host target protein is therefore outlined by a broken line.

It is appreciated that VGAM1768 host target gene, herein designated VGAM HOST TARGET GENE, in fact represents a plurality of VGAM1768 host target genes. The mRNA of each one of this plurality of VGAM1768 host target genes comprises one or more host target binding sites, each having a nucleotide sequence which is at least partly complementary to VGAM1768 RNA, herein designated VGAM RNA, and which when bound by VGAM1768 RNA causes inhibition of translation of respective one or more VGAM1768 host target proteins.

It is further appreciated by one skilled in the art that the mode of translational inhibition illustrated by FIG. 1 with specific reference to translational inhibition exerted by VGAM1768 gene, herein designated VGAM GENE, on one or more VGAM1768 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1768 is inhibition of expression of host target genes, as part of a novel viral mechanism of attacking a host. Accordingly, utilities of VGAM1768 include diagnosis, prevention and treatment of viral infection by Rabbit Fibroma Virus. Specific functions, and accordingly utilities, of VGAM1768 correlate with, and may be deduced from, the identity of the host target genes which VGAM1768 binds and inhibits, and the function of these host target genes, as elaborated hereinbelow.

Nucleotide sequences of the VGAM1768 precursor RNA, herein designated VGAM PRECURSOR RNA, and of the 'diced' VGAM1768 RNA, herein designated VGAM RNA, and a schematic representation of the secondary folding of VGAM1768 folded precursor RNA, herein designated VGAM FOLDED PRECURSOR RNA, of VGAM1768 are further described hereinbelow with reference to Table 1.

Nucleotide sequences of host target binding sites, such as BINDING SITE-I, BINDING SITE-II and BINDING SITE-III of FIG. 1, found on VGAM1768 host target RNA, and schematic representation of the complementarity of each of these host target binding sites to VGAM1768 RNA, herein designated VGAM RNA, are described hereinbelow with reference to Table 2.

As mentioned hereinabove with reference to FIG. 1, a function of VGAM1768 gene, herein designated VGAM is inhibition of expression of VGAM1768 target genes. It is appreciated that specific functions, and accordingly utilities, of VGAM1768 correlate with, and may be deduced from, the identity of the target genes which VGAM1768 binds and inhibits, and the function of these target genes, as elaborated hereinbelow.

LOC93538 (Accession XM_051927) is a VGAM1768 host target gene. LOC93538 BINDING SITE is HOST TARGET binding site found in the 3' untranslated region of mRNA encoded by LOC93538, corresponding to a HOST TARGET binding site such as BINDING SITE I, BINDING SITE II or BINDING SITE III. Table 2 illustrates the complementarity of the nucleotide sequences of LOC93538 BINDING SITE, designated SEQ ID:35921, to the nucleotide sequence of VGAM1768 RNA, herein designated VGAM RNA, also designated SEQ ID:4479.

A function of VGAM1768 is therefore inhibition of LOC93538 (Accession XM_051927). Accordingly, utilities of VGAM1768 include diagnosis, prevention and treatment of diseases and clinical conditions associated with LOC93538. FIG. 1 further provides a conceptual description of a novel bioinformatically detected viral gene of the present invention, referred to here as Viral Genomic Address Messenger 1769 (VGAM1769) viral gene, which modulates expression of respective host target genes thereof, the function and utility of which host target genes is known in the art.

VGAM1769 is a novel bioinformatically detected regulatory, non protein coding, viral micro RNA (miRNA) gene. The method by which VGAM1769 was detected is described hereinabove with reference to FIGS. 1-8.

VGAM1769 gene, herein designated VGAM GENE, is a viral gene contained in the genome of Rabbit Fibroma Virus. VGAM1769 host target gene, herein designated VGAM HOST TARGET GENE, is a human gene contained in the human genome.

VGAM1769 gene encodes a VGAM1769 precursor RNA, herein designated VGAM PRECURSOR RNA. Similar to other miRNA genes, and unlike most ordinary genes, VGAM1769 precursor RNA does not encode a protein. A nucleotide sequence identical or highly similar to the nucleotide sequence of VGAM1769 precursor RNA is designated SEQ ID:1755, and is provided hereinbelow with reference to the sequence listing part. Nucleotide sequence SEQ ID:1755 is located at position 123 relative to the genome of Rabbit Fibroma Virus.

VGAM1769 precursor RNA folds onto itself, forming VGAM1769 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1769 folded precursor RNA into VGAM1769 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 84%) nucleotide sequence of VGAM1769 RNA is designated SEQ ID:4480, and is provided hereinbelow with reference to the sequence listing part.

VGAM1769 host target gene, herein designated VGAM HOST TARGET GENE, encodes a corresponding messenger RNA, VGAM1769 host target RNA, herein designated VGAM HOST TARGET RNA. VGAM1769 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1769 RNA, herein designated VGAM RNA, binds complementarily to one or more host target binding sites located in untranslated regions of VGAM1769 host target RNA, herein designated VGAM HOST TARGET RNA. This complementary binding is due to the fact that the nucleotide sequence of VGAM1769 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1769 RNA, herein designated VGAM RNA, may have a different number of host target binding sites in untranslated regions of a VGAM1769 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1769 RNA, herein designated VGAM RNA, to host target binding sites on VGAM1769 host target RNA, herein designated VGAM HOST TARGET RNA, such as BINDING SITE I, BINDING SITE II and BINDING SITE III, inhibits translation of VGAM1769 host target RNA into VGAM1769 host target protein, herein designated VGAM HOST TARGET PROTEIN. VGAM host target protein is therefore outlined by a broken line.

It is appreciated that VGAM1769 host target gene, herein designated VGAM HOST TARGET GENE, in fact represents a plurality of VGAM1769 host target genes. The mRNA of each one of this plurality of VGAM1769 host target genes comprises one or more host target binding sites, each having a nucleotide sequence which is at least partly complementary to VGAM1769 RNA, herein designated VGAM RNA, and which when bound by VGAM1769 RNA causes inhibition of translation of respective one or more VGAM1769 host target proteins.

It is further appreciated by one skilled in the art that the mode of translational inhibition illustrated by FIG. 1 with specific reference to translational inhibition exerted by VGAM1769 gene, herein designated VGAM GENE, on one or more VGAM1769 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let- 7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1769 is inhibition of expression of host target genes, as part of a novel viral mechanism of attacking a host. Accordingly, utilities of VGAM1769 include diagnosis, prevention and treatment of viral infection by Rabbit Fibroma Virus. Specific functions, and accordingly utilities, of VGAM1769 correlate with, and may be deduced from, the identity of the host target genes which VGAM1769 binds and inhibits, and the function of these host target genes, as elaborated hereinbelow.

Nucleotide sequences of the VGAM1769 precursor RNA, herein designated VGAM PRECURSOR RNA, and of the 'diced' VGAM1769 RNA, herein designated VGAM RNA, and a schematic representation of the secondary folding of VGAM1769 folded precursor RNA, herein designated VGAM FOLDED PRECURSOR RNA, of VGAM1769 are further described hereinbelow with reference to Table 1.

Nucleotide sequences of host target binding sites, such as BINDING SITE-I, BINDING SITE-II and BINDING SITE-III of FIG. 1, found on VGAM1769 host target RNA, and schematic representation of the complementarity of each of these host target binding sites to VGAM1769 RNA, herein designated VGAM RNA, are described hereinbelow with reference to Table 2.

As mentioned hereinabove with reference to FIG. 1, a function of VGAM1769 gene, herein designated VGAM is inhibition of expression of VGAM1769 target genes. It is appreciated that specific functions, and accordingly utilities, of VGAM1769 correlate with, and may be deduced from, the identity of the target genes which VGAM1769 binds and inhibits, and the function of these target genes, as elaborated hereinbelow.

Collagen, Type IV, Alpha 5 (Alport syndrome) (COL4A5, Accession NM_000495) is a VGAM1769 host target gene. COL4A5 BINDING SITE1 through COL4A5 BINDING SITE3 are HOST TARGET binding sites found in untranslated regions of mRNA encoded by COL4A5, corresponding to HOST TARGET binding sites such as BINDING SITE I, BINDING SITE II or BINDING SITE III. Table 2 illustrates the complementarity of the nucleotide sequences of COL4A5 BINDING SITE1 through COL4A5 BINDING SITE3, designated SEQ ID:6110, SEQ ID:27213 and SEQ ID:27216 respectively, to the nucleotide sequence of VGAM1769 RNA, herein designated VGAM RNA, also designated SEQ ID:4480.

A function of VGAM1769 is therefore inhibition of Collagen, Type IV, Alpha 5 (Alport syndrome) (COL4A5, Accession NM_000495). Accordingly, utilities of VGAM1769 include diagnosis, prevention and treatment of diseases and clinical conditions associated with COL4A5. SIP (Accession NM_014412) is another VGAM1769 host target gene. SIP BINDING SITE is HOST TARGET binding site found in the 3' untranslated region of mRNA encoded by SIP, corresponding to a HOST TARGET binding site such as BINDING SITE I, BINDING SITE II or BINDING SITE III. Table 2 illustrates the complementarity of the nucleotide sequences of SIP BINDING SITE, designated SEQ ID:15758, to the nucleotide sequence of VGAM1769 RNA, herein designated VGAM RNA, also designated SEQ ID:4480.

Another function of VGAM1769 is therefore inhibition of SIP (Accession NM_014412). Accordingly, utilities of VGAM1769 include diagnosis, prevention and treatment of diseases and clinical conditions associated with SIP. Cadherin-like 26 (CDH26, Accession NM_021810) is another VGAM1769 host target gene. CDH26 BINDING SITE is HOST TARGET binding site found in the 3' untranslated region of mRNA encoded by CDH26, corresponding to a HOST TARGET binding site such as BINDING SITE I, BINDING SITE II or BINDING SITE III. Table 2 illustrates the complementarity of the nucleotide sequences of CDH26 BINDING SITE, designated SEQ ID:22372, to the nucleotide sequence of VGAM1769 RNA, herein designated VGAM RNA, also designated SEQ ID:4480.

Another function of VGAM1769 is therefore inhibition of Cadherin-like 26 (CDH26, Accession NM_021810). Accordingly, utilities of VGAM1769 include diagnosis, prevention and treatment of diseases and clinical conditions associated with CDH26. FLJ12604 (Accession XM_035022) is another VGAM1769 host target gene. FLJ12604 BINDING SITE is HOST TARGET binding site found in the 5' untranslated region of mRNA encoded by FLJ12604, corresponding to a HOST TARGET binding site such as BINDING SITE I, BINDING SITE II or BINDING SITE III. Table 2 illustrates the complementarity of the nucleotide sequences of FLJ12604 BINDING SITE, designated SEQ ID:32193, to the nucleotide sequence of VGAM1769 RNA, herein designated VGAM RNA, also designated SEQ ID:4480.

Another function of VGAM1769 is therefore inhibition of FLJ12604 (Accession XM_035022). Accordingly, utilities of VGAM1769 include diagnosis, prevention and treatment of diseases and clinical conditions associated with FLJ12604. Hypermethylated In Cancer 2 (HIC2, Accession XM_036937) is another VGAM1769 host target gene. HIC2 BINDING SITE is HOST TARGET binding site found in the 3' untranslated region of mRNA encoded by HIC2, corresponding to a HOST TARGET binding site such as BINDING SITE I, BINDING SITE II or BINDING SITE III. Table 2 illustrates the complementarity of the nucleotide sequences of HIC2 BINDING SITE, designated SEQ ID:32534, to the nucleotide sequence of VGAM1769 RNA, herein designated VGAM RNA, also designated SEQ ID:4480.

Another function of VGAM1769 is therefore inhibition of Hypermethylated In Cancer 2 (HIC2, Accession XM_036937). Accordingly, utilities of VGAM1769 include diagnosis, prevention and treatment of diseases and clinical conditions associated with HIC2. KIAA1255 (Accession XM_040626) is another VGAM1769 host target gene. KIAA1255 BINDING SITE is HOST TARGET binding site found in the 3' untranslated region of mRNA encoded by KIAA1255, corresponding to a HOST TARGET binding site such as BINDING SITE I, BINDING SITE II or BINDING SITE III. Table 2 illustrates the complementarity of the nucleotide sequences of KIAA1255 BINDING SITE, designated SEQ ID:33348, to the nucleotide sequence of VGAM1769 RNA, herein designated VGAM RNA, also designated SEQ ID:4480.

Another function of VGAM1769 is therefore inhibition of KIAA1255 (Accession XM_040626). Accordingly, utilities of VGAM1769 include diagnosis, prevention and treatment of diseases and clinical conditions associated with KIAA1255. MGC11257 (Accession NM_032350) is another VGAM1769 host target gene. MGC11257 BINDING SITE is HOST TARGET binding site found in the 3' untranslated region of mRNA encoded by MGC11257, corresponding to a HOST TARGET binding site such as BINDING SITE I, BINDING SITE II or BINDING SITE III. Table 2 illustrates the complementarity of the nucleotide sequences of MGC11257 BINDING SITE, designated SEQ ID:26140, to the nucleotide sequence of VGAM1769 RNA, herein designated VGAM RNA, also designated SEQ ID:4480.

Another function of VGAM1769 is therefore inhibition of MGC11257 (Accession NM_032350). Accordingly, utilities of VGAM1769 include diagnosis, prevention and treatment of diseases and clinical conditions associated with MGC11257. Oxysterol Binding Protein-like 3 (OSBPL3, Accession NM_015550) is another VGAM1769 host target gene. OSBPL3 BINDING SITE is HOST TARGET binding site found in the 3' untranslated region of mRNA encoded by OSBPL3, corresponding to a HOST TARGET binding site such as BINDING SITE I, BINDING SITE II or BINDING SITE III. Table 2 illustrates the complementarity of the nucleotide sequences of OSBPL3 BINDING SITE, designated SEQ ID:17818, to the nucleotide sequence of VGAM1769 RNA, herein designated VGAM RNA, also designated SEQ ID:4480.

Another function of VGAM1769 is therefore inhibition of Oxysterol Binding Protein-like 3 (OSBPL3, Accession NM_015550). Accordingly, utilities of VGAM1769 include diagnosis, prevention and treatment of diseases and clinical conditions associated with OSBPL3. LOC113763 (Accession NM_138434) is another VGAM1769 host target gene. LOC113763 BINDING SITE is HOST TARGET binding site found in the 3' untranslated region of mRNA encoded by LOC113763, corresponding to a HOST TARGET binding site such as BINDING SITE I, BINDING SITE II or BINDING SITE III. Table 2 illustrates the complementarity of the nucleotide sequences of LOC113763 BINDING SITE, designated SEQ ID:28806, to the nucleotide sequence of VGAM1769 RNA, herein designated VGAM RNA, also designated SEQ ID:4480.

Another function of VGAM1769 is therefore inhibition of LOC113763 (Accession NM_138434). Accordingly, utilities of VGAM1769 include diagnosis, prevention and treatment of diseases and clinical conditions associated with LOC113763. LOC130595 (Accession XM_065793) is another VGAM1769 host target gene. LOC130595 BINDING SITE is HOST TARGET binding site found in the 5' untranslated region of mRNA encoded by LOC130595, corresponding to a HOST TARGET binding site such as BINDING SITE I, BINDING SITE II or BINDING SITE III. Table 2 illustrates the complementarity of the nucleotide sequences of LOC130595 BINDING SITE, designated SEQ ID:37300, to the nucleotide sequence of VGAM1769 RNA, herein designated VGAM RNA, also designated SEQ ID:4480.

Another function of VGAM1769 is therefore inhibition of LOC130595 (Accession XM_065793). Accordingly, utilities of VGAM1769 include diagnosis, prevention and treatment of diseases and clinical conditions associated with LOC130595. LOC199796 (Accession XM_058994) is another VGAM1769 host target gene. LOC199796 BINDING SITE is HOST TARGET binding site found in the 5' untranslated region of mRNA encoded by LOC199796, corresponding to a HOST TARGET binding site such as BINDING SITE I, BINDING SITE II or BINDING SITE III. Table 2 illustrates the complementarity of the nucleotide sequences of LOC199796 BINDING SITE, designated SEQ ID:36809, to the nucleotide sequence of VGAM1769 RNA, herein designated VGAM RNA, also designated SEQ ID:4480.

Another function of VGAM1769 is therefore inhibition of LOC199796 (Accession XM_058994). Accordingly, utilities of VGAM1769 include diagnosis, prevention and treatment of diseases and clinical conditions associated with LOC199796. FIG. 1 further provides a conceptual description of a novel bioinformatically detected viral gene of the present invention, referred to here as Viral Genomic Address Messenger 1770 (VGAM1770) viral gene, which modulates expression of respective host target genes thereof, the function and utility of which host target genes is known in the art.

VGAM1770 is a novel bioinformatically detected regulatory, non protein coding, viral micro RNA (miRNA) gene. The method by which VGAM1770 was detected is described hereinabove with reference to FIGS. 1-8.

VGAM1770 gene, herein designated VGAM GENE, is a viral gene contained in the genome of Rabbit Fibroma Virus. VGAM1770 host target gene, herein designated VGAM HOST TARGET GENE, is a human gene contained in the human genome.

VGAM1770 gene encodes a VGAM1770 precursor RNA, herein designated VGAM PRECURSOR RNA. Similar to other miRNA genes, and unlike most ordinary genes, VGAM1770 precursor RNA does not encode a protein. A nucleotide sequence identical or highly similar to the nucleotide sequence of VGAM1770 precursor RNA is designated SEQ ID:1756, and is provided hereinbelow with reference to the sequence listing part. Nucleotide sequence SEQ ID:1756 is located at position 8292 relative to the genome of Rabbit Fibroma Virus.

VGAM1770 precursor RNA folds onto itself, forming VGAM1770 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1770 folded precursor RNA into VGAM1770 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1770 RNA is designated SEQ ID:4481, and is provided hereinbelow with reference to the sequence listing part.

VGAM1770 host target gene, herein designated VGAM HOST TARGET GENE, encodes a corresponding messenger RNA, VGAM1770 host target RNA, herein designated VGAM HOST TARGET RNA. VGAM1770 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1770 RNA, herein designated VGAM RNA, binds complementarily to one or more host target binding sites located in untranslated regions of VGAM1770 host target RNA, herein designated VGAM HOST TARGET RNA. This complementary binding is due to the fact that the nucleotide sequence of VGAM1770 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1770 RNA, herein designated VGAM RNA, may have a different number of host target binding sites in untranslated regions of a VGAM1770 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1770 RNA, herein designated VGAM RNA, to host target binding sites on VGAM1770 host target RNA, herein designated VGAM HOST TARGET RNA, such as BINDING SITE I, BINDING SITE II and BINDING SITE III, inhibits translation of VGAM1770 host target RNA into VGAM1770 host target protein, herein designated VGAM HOST TARGET PROTEIN. VGAM host target protein is therefore outlined by a broken line.

It is appreciated that VGAM1770 host target gene, herein designated VGAM HOST TARGET GENE, in fact represents a plurality of VGAM1770 host target genes. The mRNA of each one of this plurality of VGAM1770 host target genes comprises one or more host target binding sites, each having a nucleotide sequence which is at least partly complementary to VGAM1770 RNA, herein designated VGAM RNA, and which when bound by VGAM1770 RNA causes inhibition of translation of respective one or more VGAM1770 host target proteins.

It is further appreciated by one skilled in the art that the mode of translational inhibition illustrated by FIG. 1 with specific reference to translational inhibition exerted by VGAM1770 gene, herein designated VGAM GENE, on one or more VGAM1770 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1770 is inhibition of expression of host target genes, as part of a novel viral mechanism of attacking a host. Accordingly, utilities of VGAM1770 include diagnosis, prevention and treatment of viral infection by Rabbit Fibroma Virus. Specific functions, and accordingly utilities, of VGAM1770 correlate with, and may be deduced from, the identity of the host target genes which VGAM1770 binds and inhibits, and the function of these host target genes, as elaborated hereinbelow.

Nucleotide sequences of the VGAM1770 precursor RNA, herein designated VGAM PRECURSOR RNA, and of the 'diced' VGAM1770 RNA, herein designated VGAM RNA, and a schematic representation of the secondary folding of VGAM1770 folded precursor RNA, herein designated VGAM FOLDED PRECURSOR RNA, of VGAM1770 are further described hereinbelow with reference to Table 1.

Nucleotide sequences of host target binding sites, such as BINDING SITE-I, BINDING SITE-II and BINDING SITE-III of FIG. 1, found on VGAM1770 host target RNA, and schematic representation of the complementarity of each of these host target binding sites to VGAM1770 RNA, herein designated VGAM RNA, are described hereinbelow with reference to Table 2.

As mentioned hereinabove with reference to FIG. 1, a function of VGAM1770 gene, herein designated VGAM is inhibition of expression of VGAM1770 target genes. It is appreciated that specific functions, and accordingly utilities, of VGAM1770 correlate with, and may be deduced from, the identity of the target genes which VGAM1770 binds and inhibits, and the function of these target genes, as elaborated hereinbelow.

Alpha Thalassemia/mental Retardation Syndrome X-linked (RAD54 homolog, S. cerevisiae) (ATRX, Accession NM_138271) is a VGAM1770 host target gene. ATRX BINDING SITE is HOST TARGET binding site found in the 5' untranslated region of mRNA encoded by ATRX, corresponding to a HOST TARGET binding site such as BINDING SITE I, BINDING SITE II or BINDING SITE III. Table 2 illustrates the complementarity of the nucleotide sequences of ATRX BINDING SITE, designated SEQ ID:28682, to the nucleotide sequence of VGAM1770 RNA, herein designated VGAM RNA, also designated SEQ ID:4481.

A function of VGAM1770 is therefore inhibition of Alpha Thalassemia/mental Retardation Syndrome X-linked (RAD54 homolog, S. cerevisiae) (ATRX, Accession NM_138271). Accordingly, utilities of VGAM1770 include diagnosis, prevention and treatment of diseases and clinical conditions associated with ATRX. Chromosome 1 Open Reading Frame 6 (C1orf6, Accession NM_020131) is another VGAM1770 host target gene. C1orf6 BINDING SITE is HOST TARGET binding site found in the 3' untranslated region of mRNA encoded by C1orf6, corresponding to a HOST TARGET binding site such as BINDING SITE I, BINDING SITE II or BINDING SITE III. Table 2 illustrates the complementarity of the nucleotide sequences of C1orf6 BINDING SITE, designated SEQ ID:21330, to the nucleotide sequence of VGAM1770 RNA, herein designated VGAM RNA, also designated SEQ ID:4481.

Another function of VGAM1770 is therefore inhibition of Chromosome 1 Open Reading Frame 6 (C1orf6, Accession NM_020131), a gene which may link ataxin-1 with the chaperone and ubiquitin/proteasome pathways. Accordingly, utilities of VGAM1770 include diagnosis, prevention and treatment of diseases and clinical conditions associated with C1orf6. The function of C1orf6 and its association with various diseases and clinical conditions, has been established by previous studies, as described hereinabove with reference to VGAM1286. Fibulin 1 (FBLN1, Accession NM_006485) is another VGAM1770 host target gene. FBLN1 BINDING SITE is HOST TARGET binding site found in the 3' untranslated region of mRNA encoded by FBLN1, corresponding to a HOST TARGET binding site such as BINDING SITE I, BINDING SITE II or BINDING SITE III. Table 2 illustrates the complementarity of the nucleotide sequences of FBLN1 BINDING SITE, designated SEQ ID:13213, to the nucleotide sequence of VGAM1770 RNA, herein designated VGAM RNA, also designated SEQ ID:4481.

Another function of VGAM1770 is therefore inhibition of Fibulin 1 (FBLN1, Accession NM_006485), a gene which secreted glycoprotein; has EGF-like repeats, similar to anaphylatoxins C3a, C4a, and C5a. Accordingly, utilities of VGAM1770 include diagnosis, prevention and treatment of diseases and clinical conditions associated with FBLN1. The function of FBLN1 has been established by previous studies. Fibulin-1 was first described as an integrin-binding fibulin from human placenta by Argraves et al. (1989), who found that it is a secreted glycoprotein that becomes incorporated into a fibrillar extracellular matrix when expressed in cultured cells or added exogenously to cell monolayers. Preliminary electron microscopic data suggested a rod-like structure for fibulin-1, consistent with the sequence predictions. Calcium-binding to fibulin-1 is apparently required to mediate its binding to laminin and nidogen (OMIM Ref. No. 131390). By in situ hybridization of tritium-labeled cDNA probes, Mattei et al. (1994) assigned the human FBLN1 gene to 22q13.2-q13.3 and assigned its counterpart in mouse to the E-F band of chromosome 15. Korenberg et al. (1995) assigned the FBLN1 gene to 22q13.3 by fluorescence in situ hybridization.

Full details of the abovementioned studies are described in the following publications, the disclosure of which are hereby incorporated by reference:

Korenberg, J. R.; Chen, X.-N.; Tran, H.; Argraves, W. S.: Localization of the human gene for fibulin-1 (FBLN1) to chromosome band 22q13.3. Cytogenet. Cell Genet. 68:192-193, 1995; and Mattei, M.-G.; Pan, T.-C.; Zhang, R.-Z.; Timpl, R.; Chu, M.-L.: The fibulin-1 gene (FBLN1) is located on human chromosome 22 and on mouse chromosome 15. Genomics 22:437-438, 1994.

Further studies establishing the function and utilities of FBLN1 are found in John Hopkins OMIM database record ID 135820, and in sited publications numbered 3464-3466 listed in the bibliography section hereinbelow, which are also hereby incorporated by reference. Potassium Voltage-gated Channel, Shaker-related Subfamily, Member 6 (KCNA6, Accession NM_002235) is another VGAM1770 host target gene. KCNA6 BINDING SITE is HOST TARGET binding site found in the 3' untranslated region of mRNA encoded by KCNA6, corresponding to a HOST TARGET binding site such as BINDING SITE I, BINDING SITE II or BINDING SITE III. Table 2 illustrates the complementarity of the nucleotide sequences of KCNA6 BINDING SITE, designated SEQ ID:8020, to the nucleotide sequence of VGAM1770 RNA, herein designated VGAM RNA, also designated SEQ ID:4481.

Another function of VGAM1770 is therefore inhibition of Potassium Voltage-gated Channel, Shaker-related Subfamily, Member 6 (KCNA6, Accession NM_002235), a gene which mediates the voltage-dependent potassium ion permeability of excitable membranes. Accordingly, utilities of VGAM1770 include diagnosis, prevention and treatment of diseases and clinical conditions associated with KCNA6. The function of KCNA6 and its association with various diseases and clinical conditions, has been established by previous studies, as described hereinabove with reference to VGAM893. Sodium Channel, Nonvoltage-gated 1, Gamma (SCNN1G, Accession NM_001039) is another VGAM1770 host target gene. SCNN1G BINDING SITE is HOST TARGET binding site found in the 3' untranslated region of mRNA encoded by SCNN1G, corresponding to a HOST TARGET binding site such as BINDING SITE I, BINDING SITE II or BINDING SITE III. Table 2 illustrates the complementarity of the nucleotide sequences of SCNN1G BINDING SITE, designated SEQ ID:6705, to the nucleotide sequence of VGAM1770 RNA, herein designated VGAM RNA, also designated SEQ ID:4481.

Another function of VGAM1770 is therefore inhibition of Sodium Channel, Nonvoltage-gated 1, Gamma (SCNN1G, Accession NM_001039). Accordingly, utilities of VGAM1770 include diagnosis, prevention and treatment of diseases and clinical conditions associated with SCNN1G. Chromosome 20 Open Reading Frame 121 (C20orf121, Accession NM_024331) is another VGAM1770 host target gene. C20orf121 BINDING SITE is HOST TARGET binding site found in the 3' untranslated region of mRNA encoded by C20orf121, corresponding to a HOST TARGET binding site such as BINDING SITE I, BINDING SITE II or BINDING SITE III. Table 2 illustrates the complementarity of the nucleotide sequences of C20orf121 BINDING SITE, designated SEQ ID:23637, to the nucleotide sequence of VGAM1770 RNA, herein designated VGAM RNA, also designated SEQ ID:4481.

Another function of VGAM1770 is therefore inhibition of Chromosome 20 Open Reading Frame 121 (C20orf121, Accession NM_024331). Accordingly, utilities of VGAM1770 include diagnosis, prevention and treatment of diseases and clinical conditions associated with C20orf121. FK506 Binding Protein 9, 63 KDa (FKBP9, Accession XM_168403) is another VGAM1770 host target gene. FKBP9 BINDING SITE is HOST TARGET binding site found in the 3' untranslated region of mRNA encoded by FKBP9, corresponding to a HOST TARGET binding site such as BINDING SITE I, BINDING SITE II or BINDING SITE III. Table 2 illustrates the complementarity of the nucleotide sequences of FKBP9 BINDING SITE, designated SEQ ID:45143, to the nucleotide sequence of VGAM1770 RNA, herein designated VGAM RNA, also designated SEQ ID:4481.

Another function of VGAM1770 is therefore inhibition of FK506 Binding Protein 9, 63 KDa (FKBP9, Accession XM_168403). Accordingly, utilities of VGAM1770 include diagnosis, prevention and treatment of diseases and clinical conditions associated with FKBP9. FLJ10661 (Accession NM_018172) is another VGAM1770 host target gene. FLJ10661 BINDING SITE1 and FLJ10661 BINDING SITE2 are HOST TARGET binding sites found in untranslated regions of mRNA encoded by FLJ10661, corresponding to HOST TARGET binding sites such as BINDING SITE I, BINDING SITE II or BINDING SITE III. Table 2 illustrates the complementarity of the nucleotide sequences of FLJ10661 BINDING SITE1 and FLJ10661 BINDING SITE2, designated SEQ ID:19998 and SEQ ID:19999 respectively, to the nucleotide sequence of VGAM1770 RNA, herein designated VGAM RNA, also designated SEQ ID:4481.

Another function of VGAM1770 is therefore inhibition of FLJ10661 (Accession NM_018172). Accordingly, utilities of VGAM1770 include diagnosis, prevention and treatment of diseases and clinical conditions associated with FLJ10661. ICK (Accession NM_016513) is another VGAM1770 host target gene. ICK BINDING SITE1 and ICK BINDING SITE2 are HOST TARGET binding sites found in untranslated regions of mRNA encoded by ICK, corresponding to HOST TARGET binding sites such as BINDING SITE I, BINDING SITE II or BINDING SITE III. Table 2 illustrates the complementarity of the nucleotide sequences of ICK BINDING SITE1 and ICK BINDING SITE2, designated SEQ ID:18593 and SEQ ID:17193 respectively, to the nucleotide sequence of VGAM1770 RNA, herein designated VGAM RNA, also designated SEQ ID:4481.

Another function of VGAM1770 is therefore inhibition of ICK (Accession NM_016513). Accordingly, utilities of VGAM1770 include diagnosis, prevention and treatment of diseases and clinical conditions associated with ICK. KIAA0892 (Accession XM_048457) is another VGAM1770 host target gene. KIAA0892 BINDING SITE is HOST TARGET binding site found in the 3" untranslated region of mRNA encoded by KIAA0892, corresponding to a HOST TARGET binding site such as BINDING SITE I, BINDING SITE II or BINDING SITE III. Table 2 illustrates the complementarity of the nucleotide sequences of KIAA0892 BINDING SITE, designated SEQ ID:35173, to the nucleotide sequence of VGAM1770 RNA, herein designated VGAM RNA, also designated SEQ ID:4481.

Another function of VGAM1770 is therefore inhibition of KIAA0892 (Accession XM_048457). Accordingly, utilities of VGAM1770 include diagnosis, prevention and treatment of diseases and clinical conditions associated with KIAA0892. Lipoma HMGIC Fusion Partner (LHFP, Accession NM_005780) is another VGAM1770 host target gene. LHFP BINDING SITE is HOST TARGET binding site found in the 3' untranslated region of mRNA encoded by LHFP, corresponding to a HOST TARGET binding site such as BINDING SITE I, BINDING SITE II or BINDING SITE III. Table 2 illustrates the complementarity of the nucleotide sequences of LHFP BINDING SITE, designated SEQ ID:12357, to the nucleotide sequence of VGAM1770 RNA, herein designated VGAM RNA, also designated SEQ ID:4481.

Another function of VGAM1770 is therefore inhibition of Lipoma HMGIC Fusion Partner (LHFP, Accession NM_005780). Accordingly, utilities of VGAM1770 include diagnosis, prevention and treatment of diseases and clinical conditions associated with LHFP. MAC30 (Accession XM_031536) is another VGAM1770 host target gene. MAC30 BINDING SITE is HOST TARGET binding site found in the 5' untranslated region of mRNA encoded by MAC30, corresponding to a HOST TARGET binding site such as BINDING SITE I, BINDING SITE II or BINDING SITE III. Table 2 illustrates the complementarity of the nucleotide sequences of MAC30 BINDING SITE, designated SEQ ID:31401, to the nucleotide sequence of VGAM1770 RNA, herein designated VGAM RNA, also designated SEQ ID:4481.

Another function of VGAM1770 is therefore inhibition of MAC30 (Accession XM_031536). Accordingly, utilities of VGAM1770 include diagnosis, prevention and treatment of diseases and clinical conditions associated with MAC30. Purinergic Receptor P2X, Ligand-gated Ion Channel, 5 (P2RX5, Accession NM_002561) is another VGAM1770 host target gene. P2RX5 BINDING SITE is HOST TARGET binding site found in the 3' untranslated region of mRNA encoded by P2RX5, corresponding to a HOST TARGET binding site such as BINDING SITE I, BINDING SITE II or BINDING SITE III. Table 2 illustrates the complementarity of the nucleotide sequences of P2RX5 BINDING SITE, designated SEQ ID:8409, to the nucleotide sequence of VGAM1770 RNA, herein designated VGAM RNA, also designated SEQ ID:4481.

Another function of VGAM1770 is therefore inhibition of Purinergic Receptor P2X, Ligand-gated Ion Channel, 5 (P2RX5, Accession NM_002561). Accordingly, utilities of VGAM1770 include diagnosis, prevention and treatment of diseases and clinical conditions associated with P2RX5. LOC149577 (Accession XM_097675) is another VGAM1770 host target gene. LOC149577 BINDING SITE is HOST TARGET binding site found in the 3' untranslated region of mRNA encoded by LOC149577, corresponding to a HOST TARGET binding site such as BINDING SITE I, BINDING SITE II or BINDING SITE III. Table 2 illustrates the complementarity of the nucleotide sequences of LOC149577 BINDING SITE, designated SEQ ID:41026, to the nucleotide sequence of VGAM1770 RNA, herein designated VGAM RNA, also designated SEQ ID:4481.

Another function of VGAM1770 is therefore inhibition of LOC149577 (Accession XM_097675). Accordingly, utilities of VGAM1770 include diagnosis, prevention and treatment of diseases and clinical conditions associated with LOC149577. LOC153196 (Accession XM_098323) is another VGAM1770 host target gene. LOC153196 BINDING SITE is HOST TARGET binding site found in the 5' untranslated region of mRNA encoded by LOC153196, corresponding to a HOST TARGET binding site such as BINDING SITE I, BINDING SITE II or BINDING SITE III. Table 2 illustrates the complementarity of the nucleotide sequences of LOC153196 BINDING SITE, designated SEQ ID:41594, to the nucleotide sequence of VGAM1770 RNA, herein designated VGAM RNA, also designated SEQ ID:4481.

Another function of VGAM1770 is therefore inhibition of LOC153196 (Accession XM_098323). Accordingly, utilities of VGAM1770 include diagnosis, prevention and treatment of diseases and clinical conditions associated with LOC153196. FIG. 1 further provides a conceptual description of a novel bioinformatically detected viral gene of the present invention, referred to here as Viral Genomic Address Messenger 1771 (VGAM1771) viral gene, which modulates expression of respective host target genes thereof, the function and utility of which host target genes is known in the art.

VGAM1771 is a novel bioinformatically detected regulatory, non protein coding, viral micro RNA (miRNA) gene. The method by which VGAM1771 was detected is described hereinabove with reference to FIGS. 1-8.

VGAM1771 gene, herein designated VGAM GENE, is a viral gene contained in the genome of Pestivirus Type 1. VGAM1771 host target gene, herein designated VGAM HOST TARGET GENE, is a human gene contained in the human genome.

VGAM1771 gene encodes a VGAM1771 precursor RNA, herein designated VGAM PRECURSOR RNA. Similar to other miRNA genes, and unlike most ordinary genes, VGAM1771 precursor RNA does not encode a protein. A nucleotide sequence identical or highly similar to the nucleotide sequence of VGAM1771 precursor RNA is designated SEQ ID:1757, and is provided hereinbelow with reference to the sequence listing part. Nucleotide sequence SEQ ID:1757 is located at position 3477 relative to the genome of Pestivirus Type 1.

VGAM1771 precursor RNA folds onto itself, forming VGAM1771 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1771 folded precursor RNA into VGAM1771 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1771 RNA is designated SEQ ID:4482, and is provided hereinbelow with reference to the sequence listing part.

VGAM1771 host target gene, herein designated VGAM HOST TARGET GENE, encodes a corresponding messenger RNA, VGAM1771 host target RNA, herein designated VGAM HOST TARGET RNA. VGAM1771 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1771 RNA, herein designated VGAM RNA, binds complementarily to one or more host target binding sites located in untranslated regions of VGAM1771 host target RNA, herein designated VGAM HOST TARGET RNA. This complementary binding is due to the fact that the nucleotide sequence of VGAM1771 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1771 RNA, herein designated VGAM RNA, may have a different number of host target binding sites in untranslated regions of a VGAM1771 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1771 RNA, herein designated VGAM RNA, to host target binding sites on VGAM1771 host target RNA, herein designated VGAM HOST TARGET RNA, such as BINDING SITE I, BINDING SITE II and BINDING SITE III, inhibits translation of VGAM1771 host target RNA into VGAM1771 host target protein, herein designated VGAM HOST TARGET PROTEIN. VGAM host target protein is therefore outlined by a broken line.

It is appreciated that VGAM1771 host target gene, herein designated VGAM HOST TARGET GENE, in fact represents a plurality of VGAM1771 host target genes. The mRNA of each one of this plurality of VGAM1771 host target genes comprises one or more host target binding sites, each having a nucleotide sequence which is at least partly complementary to VGAM1771 RNA, herein designated VGAM RNA, and which when bound by VGAM1771 RNA causes inhibition of translation of respective one or more VGAM1771 host target proteins.

It is further appreciated by one skilled in the art that the mode of translational inhibition illustrated by FIG. 1 with specific reference to translational inhibition exerted by VGAM1771 gene, herein designated VGAM GENE, on one or more VGAM1771 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1771 is inhibition of expression of host target genes, as part of a novel viral mechanism of attacking a host. Accordingly, utilities of VGAM1771 include diagnosis, prevention and treatment of viral infection by Pestivirus Type 1. Specific functions, and accordingly utilities, of VGAM1771 correlate with, and may be deduced from, the identity of the host target genes which VGAM1771 binds and inhibits, and the function of these host target genes, as elaborated hereinbelow.

Nucleotide sequences of the VGAM1771 precursor RNA, herein designated VGAM PRECURSOR RNA, and of the 'diced' VGAM1771 RNA, herein designated VGAM RNA, and a schematic representation of the secondary folding of VGAM1771 folded precursor RNA, herein designated VGAM FOLDED PRECURSOR RNA, of VGAM1771 are further described hereinbelow with reference to Table 1.

Nucleotide sequences of host target binding sites, such as BINDING SITE-I, BINDING SITE-II and BINDING SITE-III of FIG. 1, found on VGAM1771 host target RNA, and schematic representation of the complementarity of each of these host target binding sites to VGAM1771 RNA, herein designated VGAM RNA, are described hereinbelow with reference to Table 2.

As mentioned hereinabove with reference to FIG. 1, a function of VGAM1771 gene, herein designated VGAM is inhibition of expression of VGAM1771 target genes. It is appreciated that specific functions, and accordingly utilities, of VGAM1771 correlate with, and may be deduced from, the identity of the target genes which VGAM1771 binds and inhibits, and the function of these target genes, as elaborated hereinbelow.

Fatty Acid Binding Protein 2, Intestinal (FABP2, Accession NM_000134) is a VGAM1771 host target gene. FABP2 BINDING SITE is HOST TARGET binding site found in the 3' untranslated region of mRNA encoded by FABP2, corresponding to a HOST TARGET binding site such as BINDING SITE I, BINDING SITE II or BINDING SITE III. Table 2 illustrates the complementarity of the nucleotide sequences of FABP2 BINDING SITE, designated SEQ ID:5622, to the nucleotide sequence of VGAM1771 RNA, herein designated VGAM RNA, also designated SEQ ID:4482.

A function of VGAM1771 is therefore inhibition of Fatty Acid Binding Protein 2, Intestinal (FABP2, Accession NM_000134), a gene which may have a role in dietary fat uptake or processing. Accordingly, utilities of VGAM1771 include diagnosis, prevention and treatment of diseases and clinical conditions associated with FABP2. The function of FABP2 and its association with various diseases and clinical conditions, has been established by previous studies, as described hereinabove with reference to VGAM951. Leucine Zipper Protein 1 (LUZP1, Accession NM_033631) is another VGAM1771 host target gene. LUZP1 BINDING SITE is HOST TARGET binding site found in the 3' untranslated region of mRNA encoded by LUZP1, corresponding to a HOST TARGET binding site such as BINDING SITE I, BINDING SITE II or BINDING SITE III. Table 2 illustrates the complementarity of the nucleotide sequences of LUZP1 BINDING SITE, designated SEQ ID:27354, to the nucleotide sequence of VGAM1771 RNA, herein designated VGAM RNA, also designated SEQ ID:4482.

Another function of VGAM1771 is therefore inhibition of Leucine Zipper Protein 1 (LUZP1, Accession NM_033631). Accordingly, utilities of VGAM1771 include diagnosis, prevention and treatment of diseases and clinical conditions associated with LUZP1. Sine Oculis Homeobox Homolog 2 (Drosophila) (SIX2, Accession NM_016932) is another VGAM1771 host target gene. SIX2 BINDING SITE is HOST TARGET binding site found in the 3' untranslated region of mRNA encoded by SIX2, corresponding to a HOST TARGET binding site such as BINDING SITE I, BINDING SITE II or BINDING SITE III. Table 2 illustrates the complementarity of the nucleotide sequences of SIX2 BINDING SITE, designated SEQ ID:18849, to the nucleotide sequence of VGAM1771 RNA, herein designated VGAM RNA, also designated SEQ ID:4482.

Another function of VGAM1771 is therefore inhibition of Sine Oculis Homeobox Homolog 2 (Drosophila) (SIX2, Accession NM_016932), a gene which may be involved in limb tendon and ligament development (by similarity). Accordingly, utilities of VGAM1771 include diagnosis, prevention and treatment of diseases and clinical conditions associated with SIX2. The function of SIX2 and its association with various diseases and clinical conditions, has been established by previous studies, as described hereinabove with reference to VGAM1151. Signal Transducing Adaptor Molecule (SH3 domain and ITAM motif) 1 (STAM, Accession NM_003473) is another VGAM1771 host target gene. STAM BINDING SITE is HOST TARGET binding site found in the 3' untranslated region of mRNA encoded by STAM, corresponding to a HOST TARGET binding site such as BINDING SITE I, BINDING SITE II or BINDING SITE III. Table 2 illustrates the complementarity of the nucleotide sequences of STAM BINDING SITE, designated SEQ ID:9541, to the nucleotide sequence of VGAM1771 RNA, herein designated VGAM RNA, also designated SEQ ID:4482.

Another function of VGAM1771 is therefore inhibition of Signal Transducing Adaptor Molecule (SH3 domain and ITAM motif) 1 (STAM, Accession NM_003473), a gene which is as an adaptor molecule involved in the downstream signaling of cytokine receptors. Accordingly, utilities of VGAM1771 include diagnosis, prevention and treatment of diseases and clinical conditions associated with STAM. The function of STAM and its association with various diseases and clinical conditions, has been established by previous studies, as described hereinabove with reference to VGAM927. FLJ10724 (Accession NM_018194) is another VGAM1771 host target gene. FLJ10724 BINDING SITE is HOST TARGET binding site found in the 3' untranslated region of mRNA encoded by FLJ10724, corresponding to a HOST TARGET binding site such as BINDING SITE I, BINDING SITE II or BINDING SITE III. Table 2 illustrates the complementarity of the nucleotide sequences of FLJ10724 BINDING SITE, designated SEQ ID:20053, to the nucleotide sequence of VGAM1771 RNA, herein designated VGAM RNA, also designated SEQ ID:4482.

Another function of VGAM1771 is therefore inhibition of FLJ10724 (Accession NM_018194). Accordingly, utilities of VGAM1771 include diagnosis, prevention and treatment of diseases and clinical conditions associated with FLJ10724. FLJ13072 (Accession XM_117117) is another VGAM1771 host target gene. FLJ13072 BINDING SITE is HOST TARGET binding site found in the 5' untranslated region of mRNA encoded by FLJ13072, corresponding to a HOST TARGET binding site such as BINDING SITE I, BINDING SITE II or BINDING SITE III. Table 2 illustrates the complementarity of the nucleotide sequences of FLJ13072 BINDING SITE, designated SEQ ID:43232, to the nucleotide sequence of VGAM1771 RNA, herein designated VGAM RNA, also designated SEQ ID:4482.

Another function of VGAM1771 is therefore inhibition of FLJ13072 (Accession XM_117117). Accordingly, utilities of VGAM1771 include diagnosis, prevention and treatment of diseases and clinical conditions associated with FLJ13072. GENX-3414 (Accession NM_003943) is another VGAM1771 host target gene. GENX-3414 BINDING SITE is HOST TARGET binding site found in the 3' untranslated region of mRNA encoded by GENX-3414, corresponding to a HOST TARGET binding site such as BINDING SITE I, BINDING SITE II or BINDING SITE III. Table 2 illustrates the complementarity of the nucleotide sequences of GENX-3414 BINDING SITE, designated SEQ ID:10058, to the nucleotide sequence of VGAM1771 RNA, herein designated VGAM RNA, also designated SEQ ID:4482.

Another function of VGAM1771 is therefore inhibition of GENX-3414 (Accession NM_003943). Accordingly, utilities of VGAM1771 include diagnosis, prevention and treatment of diseases and clinical conditions associated with GENX-3414. KIAA0430 (Accession NM_019081) is another VGAM1771 host target gene. KIAA0430 BINDING SITE is HOST TARGET binding site found in the 3' untranslated region of mRNA encoded by KIAA0430, corresponding to a HOST TARGET binding site such as BINDING SITE I, BINDING SITE II or BINDING SITE III. Table 2 illustrates the complementarity of the nucleotide sequences of KIAA0430 BINDING SITE, designated SEQ ID:21150, to the nucleotide sequence of VGAM1771 RNA, herein designated VGAM RNA, also designated SEQ ID:4482.

Another function of VGAM1771 is therefore inhibition of KIAA0430 (Accession NM_019081). Accordingly, utilities of VGAM1771 include diagnosis, prevention and treatment of diseases and clinical conditions associated with KIAA0430. KIAA0992 (Accession NM_016081) is another VGAM1771 host target gene. KIAA0992 BINDING SITE is HOST TARGET binding site found in the 3' untranslated region of mRNA encoded by KIAA0992, corresponding to a HOST TARGET binding site such as BINDING SITE I, BINDING SITE II or BINDING SITE III. Table 2 illustrates the complementarity of the nucleotide sequences of KIAA0992 BINDING SITE, designated SEQ ID:18157, to the nucleotide sequence of VGAM1771 RNA, herein designated VGAM RNA, also designated SEQ ID:4482.

Another function of VGAM1771 is therefore inhibition of KIAA0992 (Accession NM_016081). Accordingly, utilities of VGAM1771 include diagnosis, prevention and treatment of diseases and clinical conditions associated with KIAA0992. KIAA1466 (Accession XM_050285) is another VGAM1771 host target gene. KIAA1466 BINDING SITE is HOST TARGET binding site found in the 3' untranslated region of mRNA encoded by KIAA1466, corresponding to a HOST TARGET binding site such as BINDING SITE I, BINDING SITE II or BINDING SITE III. Table 2 illustrates the complementarity of the nucleotide sequences of KIAA1466 BINDING SITE, designated SEQ ID:35601, to the nucleotide sequence of VGAM1771 RNA, herein designated VGAM RNA, also designated SEQ ID:4482.

Another function of VGAM1771 is therefore inhibition of KIAA1466 (Accession XM_050285). Accordingly, utilities of VGAM1771 include diagnosis, prevention and treatment of diseases and clinical conditions associated with KIAA1466. KIAA1500 (Accession XM_034353) is another VGAM1771 host target gene. KIAA1500 BINDING SITE is HOST TARGET binding site found in the 3' untranslated region of mRNA encoded by KIAA1500, corresponding to a HOST TARGET binding site such as BINDING SITE I, BINDING SITE II or BINDING SITE III. Table 2 illustrates the complementarity of the nucleotide sequences of KIAA1500 BINDING SITE, designated SEQ ID:32069, to the nucleotide sequence of VGAM1771 RNA, herein designated VGAM RNA, also designated SEQ ID:4482.

Another function of VGAM1771 is therefore inhibition of KIAA1500 (Accession XM_034353). Accordingly, utilities of VGAM1771 include diagnosis, prevention and treatment of diseases and clinical conditions associated with KIAA1500. KIAA1613 (Accession XM_035946) is another VGAM1771 host target gene. KIAA1613 BINDING SITE is HOST TARGET binding site found in the 3' untranslated region of mRNA encoded by KIAA1613, corresponding to a HOST TARGET binding site such as BINDING SITE I, BINDING SITE II or BINDING SITE III. Table 2 illustrates the complementarity of the nucleotide sequences of KIAA1613 BINDING SITE, designated SEQ ID:32360, to the nucleotide sequence of VGAM1771 RNA, herein designated VGAM RNA, also designated SEQ ID:4482.

Another function of VGAM1771 is therefore inhibition of KIAA1613 (Accession XM_035946). Accordingly, utilities of VGAM1771 include diagnosis, prevention and treatment of diseases and clinical conditions associated with KIAA1613. KIAA1977 (Accession XM_058800) is another VGAM1771 host target gene. KIAA1977 BINDING SITE is HOST TARGET binding site found in the 5' untranslated region of mRNA encoded by KIAA1977, corresponding to a HOST TARGET binding site such as BINDING SITE I, BINDING SITE II or BINDING SITE III. Table 2 illustrates the complementarity of the nucleotide sequences of KIAA1977 BINDING SITE, designated SEQ ID:36747, to the nucleotide sequence of VGAM1771 RNA, herein designated VGAM RNA, also designated SEQ ID:4482.

Another function of VGAM1771 is therefore inhibition of KIAA1977 (Accession XM_058800). Accordingly, utilities of VGAM1771 include diagnosis, prevention and treatment of diseases and clinical conditions associated with KIAA1977. LAK-4P (Accession NM_007267) is another VGAM1771 host target gene. LAK-4P BINDING SITE is HOST TARGET binding site found in the 5' untranslated region of mRNA encoded by LAK-4P, corresponding to a HOST TARGET binding site such as BINDING SITE I, BINDING SITE II or BINDING SITE III. Table 2 illustrates the complementarity of the nucleotide sequences of LAK-4P BINDING SITE, designated SEQ ID:14131, to the nucleotide sequence of VGAM1771 RNA, herein designated VGAM RNA, also designated SEQ ID:4482.

Another function of VGAM1771 is therefore inhibition of LAK-4P (Accession NM_007267). Accordingly, utilities of VGAM1771 include diagnosis, prevention and treatment of diseases and clinical conditions associated with LAK-4P. MGC35558 (Accession NM_145013) is another VGAM1771 host target gene. MGC35558 BINDING SITE is HOST TARGET binding site found in the 3' untranslated region of mRNA encoded by MGC35558, corresponding to a HOST TARGET binding site such as BINDING SITE I, BINDING SITE II or BINDING SITE III. Table 2 illustrates the complementarity of the nucleotide sequences of MGC35558 BINDING SITE, designated SEQ ID:29612, to the nucleotide sequence of VGAM1771 RNA, herein designated VGAM RNA, also designated SEQ ID:4482.

Another function of VGAM1771 is therefore inhibition of MGC35558 (Accession NM_145013). Accordingly, utilities of VGAM1771 include diagnosis, prevention and treatment of diseases and clinical conditions associated with MGC35558. Makorin, Ring Finger Protein, 1 (MKRN1, Accession NM_013446) is another VGAM1771 host target gene. MKRN1 BINDING SITE is HOST TARGET binding site found in the 3' untranslated region of mRNA encoded by MKRN1, corresponding to a HOST TARGET binding site such as BINDING SITE I, BINDING SITE II or BINDING SITE III. Table 2 illustrates the complementarity of the nucleotide sequences of MKRN1 BINDING SITE, designated SEQ ID:15112, to the nucleotide sequence of VGAM1771 RNA, herein designated VGAM RNA, also designated SEQ ID:4482.

Another function of VGAM1771 is therefore inhibition of Makorin, Ring Finger Protein, 1 (MKRN1, Accession NM_013446). Accordingly, utilities of VGAM1771 include diagnosis, prevention and treatment of diseases and clinical conditions associated with MKRN1. Protein Kinase C and Casein Kinase Substrate In Neurons 2 (PACSIN2, Accession NM_007229) is another VGAM1771 host target gene. PACSIN2 BINDING SITE is HOST TARGET binding site found in the 3' untranslated region of mRNA encoded by PACSIN2, corresponding to a HOST TARGET binding site such as BINDING SITE I, BINDING SITE II or BINDING SITE III. Table 2 illustrates the complementarity of the nucleotide sequences of PACSIN2 BINDING SITE, designated SEQ ID:14095, to the nucleotide sequence of VGAM1771 RNA, herein designated VGAM RNA, also designated SEQ ID:4482.

Another function of VGAM1771 is therefore inhibition of Protein Kinase C and Casein Kinase Substrate In Neurons 2 (PACSIN2, Accession NM_007229). Accordingly, utilities of VGAM1771 include diagnosis, prevention and treatment of diseases and clinical conditions associated with PACSIN2. RRP4 (Accession NM_014285) is another VGAM1771 host target gene. RRP4 BINDING SITE is HOST TARGET binding site found in the 3' untranslated region of mRNA encoded by RRP4, corresponding to a HOST TARGET binding site such as BINDING SITE I, BINDING SITE II or BINDING SITE III. Table 2 illustrates the complementarity of the nucleotide sequences of RRP4 BINDING SITE, designated SEQ ID:15560, to the nucleotide sequence of VGAM1771 RNA, herein designated VGAM RNA, also designated SEQ ID:4482.

Another function of VGAM1771 is therefore inhibition of RRP4 (Accession NM_014285). Accordingly, utilities of VGAM1771 include diagnosis, prevention and treatment of diseases and clinical conditions associated with RRP4. SIMRP7 (Accession XM_166462) is another VGAM1771 host target gene. SIMRP7 BINDING SITE is HOST TARGET binding site found in the 3' untranslated region of mRNA encoded by SIMRP7, corresponding to a HOST TARGET binding site such as BINDING SITE I, BINDING SITE II or BINDING SITE III. Table 2 illustrates the complementarity of the nucleotide sequences of SIMRP7 BINDING SITE, designated SEQ ID:44368, to the nucleotide sequence of VGAM1771 RNA, herein designated VGAM RNA, also designated SEQ ID:4482.

Another function of VGAM1771 is therefore inhibition of SIMRP7 (Accession XM_166462). Accordingly, utilities of VGAM1771 include diagnosis, prevention and treatment of diseases and clinical conditions associated with SIMRP7. LOC145783 (Accession XM_085231) is another VGAM1771 host target gene. LOC145783 BINDING SITE is HOST TARGET binding site found in the 3' untranslated region of mRNA encoded by LOC145783, corresponding to a HOST TARGET binding site such as BINDING SITE I, BINDING SITE II or BINDING SITE III. Table 2 illustrates the complementarity of the nucleotide sequences of LOC145783 BINDING SITE, designated SEQ ID:37976, to the nucleotide sequence of VGAM1771 RNA, herein designated VGAM RNA, also designated SEQ ID:4482.

Another function of VGAM1771 is therefore inhibition of LOC145783 (Accession XM_085231). Accordingly, utilities of VGAM1771 include diagnosis, prevention and treatment of diseases and clinical conditions associated with LOC145783. LOC220514 (Accession XM_017498) is another VGAM1771 host target gene. LOC220514 BINDING SITE is HOST TARGET binding site found in the 3' untranslated region of mRNA encoded by LOC220514, corresponding to a HOST TARGET binding site such as BINDING SITE I, BINDING SITE II or BINDING SITE III. Table 2 illustrates the complementarity of the nucleotide sequences of LOC220514 BINDING SITE, designated SEQ ID:30320, to the nucleotide sequence of VGAM1771 RNA, herein designated VGAM RNA, also designated SEQ ID:4482.

Another function of VGAM1771 is therefore inhibition of LOC220514 (Accession XM_017498). Accordingly, utilities of VGAM1771 include diagnosis, prevention and treatment of diseases and clinical conditions associated with LOC220514. LOC220930 (Accession XM_167624) is another VGAM1771 host target gene. LOC220930 BINDING SITE is HOST TARGET binding site found in the 3' untranslated region of mRNA encoded by LOC220930, corresponding to a HOST TARGET binding site such as BINDING SITE I, BINDING SITE II or BINDING SITE III. Table 2 illustrates the complementarity of the nucleotide sequences of LOC220930 BINDING SITE, designated SEQ ID:44732, to the nucleotide sequence of VGAM1771 RNA, herein designated VGAM RNA, also designated SEQ ID:4482.

Another function of VGAM1771 is therefore inhibition of LOC220930 (Accession XM_167624). Accordingly, utilities of VGAM1771 include diagnosis, prevention and treatment of diseases and clinical conditions associated with LOC220930. FIG. 1 further provides a conceptual description of a novel bioinformatically detected viral gene of the present invention, referred to here as Viral Genomic Address Messenger 1772 (VGAM1772) viral gene, which modulates expression of respective host target genes thereof, the function and utility of which host target genes is known in the art.

VGAM1772 is a novel bioinformatically detected regulatory, non protein coding, viral micro RNA (miRNA) gene. The method by which VGAM1772 was detected is described hereinabove with reference to FIGS. 1-8.

VGAM1772 gene, herein designated VGAM GENE, is a viral gene contained in the genome of Pestivirus Type 1. VGAM1772 host target gene, herein designated VGAM HOST TARGET GENE, is a human gene contained in the human genome.

VGAM1772 gene encodes a VGAM1772 precursor RNA, herein designated VGAM PRECURSOR RNA. Similar to other miRNA genes, and unlike most ordinary genes, VGAM1772 precursor RNA does not encode a protein. A nucleotide sequence identical or highly similar to the nucleotide sequence of VGAM1772 precursor RNA is designated SEQ ID:1758, and is provided hereinbelow with reference to the sequence listing part. Nucleotide sequence SEQ ID:1758 is located at position 2037 relative to the genome of Pestivirus Type 1.

VGAM1772 precursor RNA folds onto itself, forming VGAM1772 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1772 folded precursor RNA into VGAM1772 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM1772 RNA is designated SEQ ID:4483, and is provided hereinbelow with reference to the sequence listing part.

VGAM1772 host target gene, herein designated VGAM HOST TARGET GENE, encodes a corresponding messenger RNA, VGAM1772 host target RNA, herein designated VGAM HOST TARGET RNA. VGAM1772 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1772 RNA, herein designated VGAM RNA, binds complementarily to one or more host target binding sites located in untranslated regions of VGAM1772 host target RNA, herein designated VGAM HOST TARGET RNA. This complementary binding is due to the fact that the nucleotide sequence of VGAM1772 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1772 RNA, herein designated VGAM RNA, may have a different number of host target binding sites in untranslated regions of a VGAM1772 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1772 RNA, herein designated VGAM RNA, to host target binding sites on VGAM1772 host target RNA, herein designated VGAM HOST TARGET RNA, such as BINDING SITE I, BINDING SITE II and BINDING SITE III, inhibits translation of VGAM1772 host target RNA into VGAM1772 host target protein, herein designated VGAM HOST TARGET PROTEIN. VGAM host target protein is therefore outlined by a broken line.

It is appreciated that VGAM1772 host target gene, herein designated VGAM HOST TARGET GENE, in fact represents a plurality of VGAM1772 host target genes. The mRNA of each one of this plurality of VGAM1772 host target genes comprises one or more host target binding sites, each having a nucleotide sequence which is at least partly complementary to VGAM1772 RNA, herein designated VGAM RNA, and which when bound by VGAM1772 RNA causes inhibition of translation of respective one or more VGAM1772 host target proteins.

It is further appreciated by one skilled in the art that the mode of translational inhibition illustrated by FIG. 1 with specific reference to translational inhibition exerted by VGAM1772 gene, herein designated VGAM GENE, on one or more VGAM1772 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1772 is inhibition of expression of host target genes, as part of a novel viral mechanism of attacking a host. Accordingly, utilities of VGAM1772 include diagnosis, prevention and treatment of viral infection by Pestivirus Type 1. Specific functions, and accordingly utilities, of VGAM1772 correlate with, and may be deduced from, the identity of the host target genes which VGAM1772 binds and inhibits, and the function of these host target genes, as elaborated hereinbelow.

Nucleotide sequences of the VGAM1772 precursor RNA, herein designated VGAM PRECURSOR RNA, and of the 'diced' VGAM1772 RNA, herein designated VGAM RNA, and a schematic representation of the secondary folding of VGAM1772 folded precursor RNA, herein designated VGAM FOLDED PRECURSOR RNA, of VGAM1772 are further described hereinbelow with reference to Table 1.

Nucleotide sequences of host target binding sites, such as BINDING SITE-I, BINDING SITE-II and BINDING SITE-III of FIG. 1, found on VGAM1772 host target RNA, and schematic representation of the complementarity of each of these host target binding sites to VGAM1772 RNA, herein designated VGAM RNA, are described hereinbelow with reference to Table 2.

As mentioned hereinabove with reference to FIG. 1, a function of VGAM1772 gene, herein designated VGAM is inhibition of expression of VGAM1772 target genes. It is appreciated that specific functions, and accordingly utilities, of VGAM1772 correlate with, and may be deduced from, the identity of the target genes which VGAM1772 binds and inhibits, and the function of these target genes, as elaborated hereinbelow.

MHC Class II Transactivator (MHC2TA, Accession NM_000246) is a VGAM1772 host target gene. MHC2TA BINDING SITE is HOST TARGET binding site found in the 3' untranslated region of mRNA encoded by MHC2TA, corresponding to a HOST TARGET binding site such as BINDING SITE I, BINDING SITE II or BINDING SITE III. Table 2 illustrates the complementarity of the nucleotide sequences of MHC2TA BINDING SITE, designated SEQ ID:5775, to the nucleotide sequence of VGAM1772 RNA, herein designated VGAM RNA, also designated SEQ ID:4483.

A function of VGAM1772 is therefore inhibition of MHC Class II Transactivator (MHC2TA, Accession NM_000246). Accordingly, utilities of VGAM1772 include diagnosis, prevention and treatment of diseases and clinical conditions associated with MHC2TA. Rho Guanine Nucleotide Exchange Factor (GEF) 3 (ARHGEF3, Accession NM_019555) is another VGAM1772 host target gene. ARHGEF3 BINDING SITE is HOST TARGET binding site found in the 3' untranslated region of mRNA encoded by ARHGEF3, corresponding to a HOST TARGET binding site such as BINDING SITE I, BINDING SITE II or BINDING SITE III. Table 2 illustrates the complementarity of the nucleotide sequences of ARHGEF3 BINDING SITE, designated SEQ ID:21208, to the nucleotide sequence of VGAM1772 RNA, herein designated VGAM RNA, also designated SEQ ID:4483.

Another function of VGAM1772 is therefore inhibition of Rho Guanine Nucleotide Exchange Factor (GEF) 3 (ARHGEF3, Accession NM_019555). Accordingly, utilities of VGAM1772 include diagnosis, prevention and treatment of diseases and clinical conditions associated with ARHGEF3. Sema Domain, Immunoglobulin Domain (Ig), Short Basic Domain, Secreted, (semaphorin) 3C (SEMA3C, Accession NM_006379) is another VGAM1772 host target gene. SEMA3C BINDING SITE is HOST TARGET binding site found in the 3" untranslated region of mRNA encoded by SEMA3C, corresponding to a HOST TARGET binding site such as BINDING SITE I, BINDING SITE II or BINDING SITE III. Table 2 illustrates the complementarity of the nucleotide sequences of SEMA3C BINDING SITE, designated SEQ ID:13071, to the nucleotide sequence of VGAM1772 RNA, herein designated VGAM RNA, also designated SEQ ID:4483.

Another function of VGAM1772 is therefore inhibition of Sema Domain, Immunoglobulin Domain (Ig), Short Basic Domain, Secreted, (semaphorin) 3C (SEMA3C, Accession NM_006379). Accordingly, utilities of VGAM1772 include diagnosis, prevention and treatment of diseases and clinical conditions associated with SEMA3C. FIG. 1 further provides a conceptual description of a novel bioinformatically detected viral gene of the present invention, referred to here as Viral Genomic Address Messenger 1773 (VGAM1773) viral gene, which modulates expression of respective host target genes thereof, the function and utility of which host target genes is known in the art.

VGAM1773 is a novel bioinformatically detected regulatory, non protein coding, viral micro RNA (miRNA) gene. The method by which VGAM1773 was detected is described hereinabove with reference to FIGS. 1-8.

VGAM1773 gene, herein designated VGAM GENE, is a viral gene contained in the genome of Cryphonectria Hypovirus 1. VGAM1773 host target gene, herein designated VGAM HOST TARGET GENE, is a human gene contained in the human genome.

VGAM1773 gene encodes a VGAM1773 precursor RNA, herein designated VGAM PRECURSOR RNA. Similar to other miRNA genes, and unlike most ordinary genes, VGAM1773 precursor RNA does not encode a protein. A nucleotide sequence identical or highly similar to the nucleotide sequence of VGAM1773 precursor RNA is designated SEQ ID:1759, and is provided hereinbelow with reference to the sequence listing part. Nucleotide sequence SEQ ID:1759 is located at position 6368 relative to the genome of Cryphonectria Hypovirus 1.

VGAM1773 precursor RNA folds onto itself, forming VGAM1773 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1773 folded precursor RNA into VGAM1773 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1773 RNA is designated SEQ ID:4484, and is provided hereinbelow with reference to the sequence listing part.

VGAM1773 host target gene, herein designated VGAM HOST TARGET GENE, encodes a corresponding messenger RNA, VGAM1773 host target RNA, herein designated VGAM HOST TARGET RNA. VGAM1773 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1773 RNA, herein designated VGAM RNA, binds complementarily to one or more host target binding sites located in untranslated regions of VGAM1773 host target RNA, herein designated VGAM HOST TARGET RNA. This complementary binding is due to the fact that the nucleotide sequence of VGAM1773 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1773 RNA, herein designated VGAM RNA, may have a different number of host target binding sites in untranslated regions of a VGAM1773 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1773 RNA, herein designated VGAM RNA, to host target binding sites on VGAM1773 host target RNA, herein designated VGAM HOST TARGET RNA, such as BINDING SITE I, BINDING SITE II and BINDING SITE III, inhibits translation of VGAM1773 host target RNA into VGAM1773 host target protein, herein designated VGAM HOST TARGET PROTEIN. VGAM host target protein is therefore outlined by a broken line.

It is appreciated that VGAM1773 host target gene, herein designated VGAM HOST TARGET GENE, in fact represents a plurality of VGAM1773 host target genes. The mRNA of each one of this plurality of VGAM1773 host target genes comprises one or more host target binding sites, each having a nucleotide sequence which is at least partly complementary to VGAM1773 RNA, herein designated VGAM RNA, and which when bound by VGAM1773 RNA causes inhibition of translation of respective one or more VGAM1773 host target proteins.

It is further appreciated by one skilled in the art that the mode of translational inhibition illustrated by FIG. 1 with specific reference to translational inhibition exerted by VGAM1773 gene, herein designated VGAM GENE, on one or more VGAM1773 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1773 is inhibition of expression of host target genes, as part of a novel viral mechanism of attacking a host. Accordingly, utilities of VGAM1773 include diagnosis, prevention and treatment of viral infection by Cryphonectria Hypovirus 1. Specific functions, and accordingly utilities, of VGAM1773 correlate with, and may be deduced from, the identity of the host target genes which VGAM1773 binds and inhibits, and the function of these host target genes, as elaborated hereinbelow.

Nucleotide sequences of the VGAM1773 precursor RNA, herein designated VGAM PRECURSOR RNA, and of the 'diced' VGAM1773 RNA, herein designated VGAM RNA, and a schematic representation of the secondary folding of VGAM1773 folded precursor RNA, herein designated VGAM FOLDED PRECURSOR RNA, of VGAM1773 are further described hereinbelow with reference to Table 1.

Nucleotide sequences of host target binding sites, such as BINDING SITE-I, BINDING SITE-II and BINDING SITE-III of FIG. 1, found on VGAM1773 host target RNA, and schematic representation of the complementarity of each of these host target binding sites to VGAM1773 RNA, herein designated VGAM RNA, are described hereinbelow with reference to Table 2.

As mentioned hereinabove with reference to FIG. 1, a function of VGAM1773 gene, herein designated VGAM is inhibition of expression of VGAM1773 target genes. It is appreciated that specific functions, and accordingly utilities, of VGAM1773 correlate with, and may be deduced from, the identity of the target genes which VGAM1773 binds and inhibits, and the function of these target genes, as elaborated hereinbelow.

Paired Box Gene 4 (PAX4, Accession NM_006193) is a VGAM1773 host target gene. PAX4 BINDING SITE is HOST TARGET binding site found in the 3' untranslated region of mRNA encoded by PAX4, corresponding to a HOST TARGET binding site such as BINDING SITE I, BINDING SITE II or BINDING SITE III. Table 2 illustrates the complementarity of the nucleotide sequences of PAX4 BINDING SITE, designated SEQ ID:12865, to the nucleotide sequence of VGAM1773 RNA, herein designated VGAM RNA, also designated SEQ ID:4484.

A function of VGAM1773 is therefore inhibition of Paired Box Gene 4 (PAX4, Accession NM_006193), a gene which involves in the differentiation of endoderm-derived endocrine pancreas. Accordingly, utilities of VGAM1773 include diagnosis, prevention and treatment of diseases and clinical conditions associated with PAX4. The function of PAX4 has been established by previous studies. Bonthron et al. (1998) described the partial structure of PAX4, including the entire coding region. They found that the gene has 10 exons, with the paired domain and homeodomain contained in 6 exons, which they named B to G. By searching sequence databases with a mouse Pax4 cDNA, Matsushita et al. (1998) and Inoue et al. (1998) identified a human cosmid clone that maps to chromosome 7q31.3 and contains the human PAX4 sequence. The human PAX4 gene encodes a deduced 350-amino acid protein that is 80% identical to the deduced mouse Pax4 protein. RT-PCR detected mouse Pax4 expression in pancreatic islets and islet beta cell lines, but not in the other 13 adult mouse organs examined (Matsushita et al., 1998). Pilz et al. (1993) used mouse Pax4 cDNAs as probes to map the human homolog to chromosome 7 in somatic cell hybrids. By use of hybrids carrying translocated chromosomes, they showed that the human PAX4 gene is located on 7q22-qter. Animal model experiments lend further support to the function of PAX4. Sosa-Pineda et al. (1997) showed by study of knockout mice that the Pax4 gene is essential for differentiation of insulin-producing beta-cells in mammalian pancreas. See also PAX6 (OMIM Ref. No. 607108) and St-Onge et al. (1997), who concluded that both PAX4 and PAX6 genes are required for endocrine fate in the pancreas.

It is appreciated that the abovementioned animal model for PAX4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Matsushita, T.; Yamaoka, T.; Otsuka, S.; Moritani, M.; Matsumoto, T.; Itakura, M. : Molecular cloning of mouse paired-box-containing gene (Pax)-4 from an islet beta cell line and deduced sequence of human Pax-4. Biochem. Biophys. Res. Commun. 242:176-180, 1998; and Sosa-Pineda, B.; Chowdhury, K.; Torres, M.; Oliver, G.; Gruss, P.: The Pax4 gene is essential for differentiation of insulin-producing beta cells in the mammalian pancreas. Nature 386.

Further studies establishing the function and utilities of PAX4 are found in John Hopkins OMIM database record ID 167413, and in sited publications numbered 10758-10761, 10338, 10762-10763, 1071 and 10764 listed in the bibliography section hereinbelow, which are also hereby incorporated by reference. ATP-binding Cassette, Sub-family A (ABC1), Member 5 (ABCA5, Accession NM_018672) is another VGAM1773 host target gene. ABCA5 BINDING SITE is HOST TARGET binding site found in the 5' untranslated region of mRNA encoded by ABCA5, corresponding to a HOST TARGET binding site such as BINDING SITE I, BINDING SITE II or BINDING SITE III. Table 2 illustrates the complementarity of the nucleotide sequences of ABCA5 BINDING SITE, designated SEQ ID:20746, to the nucleotide sequence of VGAM1773 RNA, herein designated VGAM RNA, also designated SEQ ID:4484.

Another function of VGAM1773 is therefore inhibition of ATP-binding Cassette, Sub-family A (ABC1), Member 5 (ABCA5, Accession NM_018672). Accordingly, utilities of VGAM1773 include diagnosis, prevention and treatment of diseases and clinical conditions associated with ABCA5. Proteasome (prosome, macropain) 26S Subunit, Non-ATPase, 12 (PSMD12, Accession NM_002816) is another VGAM1773 host target gene. PSMD12 BINDING SITE is HOST TARGET binding site found in the 3' untranslated region of mRNA encoded by PSMD12, corresponding to a HOST TARGET binding site such as BINDING SITE I, BINDING SITE II or BINDING SITE III. Table 2 illustrates the complementarity of the nucleotide sequences of PSMD12 BINDING SITE, designated SEQ ID:8680, to the nucleotide sequence of VGAM1773 RNA, herein designated VGAM RNA, also designated SEQ ID:4484.

Another function of VGAM1773 is therefore inhibition of Proteasome (prosome, macropain) 26S Subunit, Non-ATPase, 12 (PSMD12, Accession NM_002816). Accordingly, utilities of VGAM1773 include diagnosis, prevention and treatment of diseases and clinical conditions associated with PSMD12. TAF2 RNA Polymerase II, TATA Box Binding Protein (TBP)-associated Factor, 150 kDa (TAF2, Accession NM_003184) is another VGAM1773 host target gene. TAF2 BINDING SITE is HOST TARGET binding site found in the 3' untranslated region of mRNA encoded by TAF2, corresponding to a HOST TARGET binding site such as BINDING SITE I, BINDING SITE II or BINDING SITE III. Table 2 illustrates the complementarity of the nucleotide sequences of TAF2 BINDING SITE, designated SEQ ID:9161, to the nucleotide sequence of VGAM1773 RNA, herein designated VGAM RNA, also designated SEQ ID:4484.

Another function of VGAM1773 is therefore inhibition of TAF2 RNA Polymerase II, TATA Box Binding Protein (TBP)-associated Factor, 150 kDa (TAF2, Accession NM_003184). Accordingly, utilities of VGAM1773 include diagnosis, prevention and treatment of diseases and clinical conditions associated with TAF2. FIG. 1 further provides a conceptual description of a novel bioinformatically detected viral gene of the present invention, referred to here as Viral Genomic Address Messenger 1774 (VGAM1774) viral gene, which modulates expression of respective host target genes thereof, the function and utility of which host target genes is known in the art.

VGAM1774 is a novel bioinformatically detected regulatory, non protein coding, viral micro RNA (miRNA) gene. The method by which VGAM1774 was detected is described hereinabove with reference to FIGS. 1-8.

VGAM1774 gene, herein designated VGAM GENE, is a viral gene contained in the genome of Cryphonectria Hypovirus 1. VGAM1774 host target gene, herein designated VGAM HOST TARGET GENE, is a human gene contained in the human genome.

VGAM1774 gene encodes a VGAM1774 precursor RNA, herein designated VGAM PRECURSOR RNA. Similar to other miRNA genes, and unlike most ordinary genes, VGAM1774 precursor RNA does not encode a protein. A nucleotide sequence identical or highly similar to the nucleotide sequence of VGAM1774 precursor RNA is designated SEQ ID:1760, and is provided hereinbelow with reference to the sequence listing part. Nucleotide sequence SEQ ID:1760 is located at position 10666 relative to the genome of Cryphonectria Hypovirus 1.

VGAM1774 precursor RNA folds onto itself, forming VGAM1774 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1774 folded precursor RNA into VGAM1774 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1774 RNA is designated SEQ ID:4485, and is provided hereinbelow with reference to the sequence listing part.

VGAM1774 host target gene, herein designated VGAM HOST TARGET GENE, encodes a corresponding messenger RNA, VGAM1774 host target RNA, herein designated VGAM HOST TARGET RNA. VGAM1774 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1774 RNA, herein designated VGAM RNA, binds complementarily to one or more host target binding sites located in untranslated regions of VGAM1774 host target RNA, herein designated VGAM HOST TARGET RNA. This complementary binding is due to the fact that the nucleotide sequence of VGAM1774 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1774 RNA, herein designated VGAM RNA, may have a different number of host target binding sites in untranslated regions of a VGAM1774 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1774 RNA, herein designated VGAM RNA, to host target binding sites on VGAM1774 host target RNA, herein designated VGAM HOST TARGET RNA, such as BINDING SITE I, BINDING SITE II and BINDING SITE III, inhibits translation of VGAM1774 host target RNA into VGAM1774 host target protein, herein designated VGAM HOST TARGET PROTEIN. VGAM host target protein is therefore outlined by a broken line.

It is appreciated that VGAM1774 host target gene, herein designated VGAM HOST TARGET GENE, in fact represents a plurality of VGAM1774 host target genes. The mRNA of each one of this plurality of VGAM1774 host target genes comprises one or more host target binding sites, each having a nucleotide sequence which is at least partly complementary to VGAM1774 RNA, herein designated VGAM RNA, and which when bound by VGAM1774 RNA causes inhibition of translation of respective one or more VGAM1774 host target proteins.

It is further appreciated by one skilled in the art that the mode of translational inhibition illustrated by FIG. 1 with specific reference to translational inhibition exerted by VGAM1774 gene, herein designated VGAM GENE, on one or more VGAM1774 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1774 is inhibition of expression of host target genes, as part of a novel viral mechanism of attacking a host. Accordingly, utilities of VGAM1774 include diagnosis, prevention and treatment of viral infection by Cryphonectria Hypovirus 1. Specific functions, and accordingly utilities, of VGAM1774 correlate with, and may be deduced from, the identity of the host target genes which VGAM1774 binds and inhibits, and the function of these host target genes, as elaborated hereinbelow.

Nucleotide sequences of the VGAM1774 precursor RNA, herein designated VGAM PRECURSOR RNA, and of the 'diced' VGAM1774 RNA, herein designated VGAM RNA, and a schematic representation of the secondary folding of VGAM1774 folded precursor RNA, herein designated VGAM FOLDED PRECURSOR RNA, of VGAM1774 are further described hereinbelow with reference to Table 1.

Nucleotide sequences of host target binding sites, such as BINDING SITE-I, BINDING SITE-II and BINDING SITE-III of FIG. 1, found on VGAM1774 host target RNA, and schematic representation of the complementarity of each of these host target binding sites to VGAM1774 RNA, herein designated VGAM RNA, are described hereinbelow with reference to Table 2.

As mentioned hereinabove with reference to FIG. 1, a function of VGAM1774 gene, herein designated VGAM is inhibition of expression of VGAM1774 target genes. It is appreciated that specific functions, and accordingly utilities, of VGAM1774 correlate with, and may be deduced from, the identity of the target genes which VGAM1774 binds and inhibits, and the function of these target genes, as elaborated hereinbelow.

Myeloid/lymphoid Or Mixed-lineage Leukemia (trithorax homolog, Drosophila); Translocated To, 3 (MLLT3, Accession NM_004529) is a VGAM1774 host target gene. MLLT3 BINDING SITE is HOST TARGET binding site found in the 3' untranslated region of mRNA encoded by MLLT3, corresponding to a HOST TARGET binding site such as BINDING SITE I, BINDING SITE II or BINDING SITE III. Table 2 illustrates the complementarity of the nucleotide sequences of MLLT3 BINDING SITE, designated SEQ ID:10867, to the nucleotide sequence of VGAM1774 RNA, herein designated VGAM RNA, also designated SEQ ID:4485.

A function of VGAM1774 is therefore inhibition of Myeloid/lymphoid Or Mixed-lineage Leukemia (trithorax homolog, Drosophila); Translocated To, 3 (MLLT3, Accession NM_004529), a gene which is Serine and proline rich protein. Accordingly, utilities of VGAM1774 include diagnosis, prevention and treatment of diseases and clinical conditions associated with MLLT3. The function of MLLT3 and its association with various diseases and clinical conditions, has been established by previous studies, as described hereinabove with reference to VGAM67. Phosphodiesterase 4D, CAMP-specific (phosphodiesterase E3 dunce homolog, Drosophila) (PDE4D, Accession XM_056815) is another VGAM1774 host target gene. PDE4D BINDING SITE is HOST TARGET binding site found in the 3' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36425, to the nucleotide sequence of VGAM1774 RNA, herein designated VGAM RNA, also designated SEQ ID:4485.

Another function of VGAM1774 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM1774 include diagnosis, prevention and treatment of diseases and clinical conditions associated with PDE4D. The function of PDE4D and its association with various diseases and clinical conditions, has been established by previous studies, as described hereinabove with reference to VGAM180. Parathyroid Hormone-like Hormone (PTHLH, Accession NM_002820) is another VGAM1774 host target gene. PTHLH BINDING SITE is HOST TARGET binding site found in the 3' untranslated region of mRNA encoded by PTHLH, corresponding to a HOST TARGET binding site such as BINDING SITE I, BINDING SITE II or BINDING SITE III. Table 2 illustrates the complementarity of the nucleotide sequences of PTHLH BINDING SITE, designated SEQ ID:8685, to the nucleotide sequence of VGAM1774 RNA, herein designated VGAM RNA, also designated SEQ ID:4485.

Another function of VGAM1774 is therefore inhibition of Parathyroid Hormone-like Hormone (PTHLH, Accession NM_002820), a gene which plays a physiological role in lactation, possibly as a hormone for the mobilization and/or transfer of calcium to the milk. Accordingly, utilities of VGAM1774 include diagnosis, prevention and treatment of diseases and clinical conditions associated with PTHLH. The function of PTHLH and its association with various diseases and clinical conditions, has been established by previous studies, as described hereinabove with reference to VGAM1590. Rho Guanine Nucleotide Exchange Factor (GEF) 3 (ARHGEF3, Accession NM_019555) is another VGAM1774 host target gene. ARHGEF3 BINDING SITE is HOST TARGET binding site found in the 3' untranslated region of mRNA encoded by ARHGEF3, corresponding to a HOST TARGET binding site such as BINDING SITE I, BINDING SITE II or BINDING SITE III. Table 2 illustrates the complementarity of the nucleotide sequences of ARHGEF3 BINDING SITE, designated SEQ ID:21210, to the nucleotide sequence of VGAM1774 RNA, herein designated VGAM RNA, also designated SEQ ID:4485.

Another function of VGAM1774 is therefore inhibition of Rho Guanine Nucleotide Exchange Factor (GEF) 3 (ARHGEF3, Accession NM_019555). Accordingly, utilities of VGAM1774 include diagnosis, prevention and treatment of diseases and clinical conditions associated with ARHGEF3. DKFZP434I0714 (Accession XM_098247) is another VGAM1774 host target gene. DKFZP434I0714 BINDING SITE is HOST TARGET binding site found in the 5' untranslated region of mRNA encoded by DKFZP434I0714, corresponding to a HOST TARGET binding site such as BINDING SITE I, BINDING SITE II or BINDING SITE III. Table 2 illustrates the complementarity of the nucleotide sequences of DKFZP434I0714 BINDING SITE, designated SEQ ID:41528, to the nucleotide sequence of VGAM1774 RNA, herein designated VGAM RNA, also designated SEQ ID:4485.

Another function of VGAM1774 is therefore inhibition of DKFZP434I0714 (Accession XM_098247). Accordingly, utilities of VGAM1774 include diagnosis, prevention and treatment of diseases and clinical conditions associated with DKFZP434I0714. DKFZP586F1524 (Accession NM_015584) is another VGAM1774 host target gene. DKFZP586F1524 BINDING SITE is HOST TARGET binding site found in the 3' untranslated region of mRNA encoded by DKFZP586F1524, corresponding to a HOST TARGET binding site such as BINDING SITE I, BINDING SITE II or BINDING SITE III. Table 2 illustrates the complementarity of the nucleotide sequences of DKFZP586F1524 BINDING SITE, designated SEQ ID:17851, to the nucleotide sequence of VGAM1774 RNA, herein designated VGAM RNA, also designated SEQ ID:4485.

Another function of VGAM1774 is therefore inhibition of DKFZP586F1524 (Accession NM_015584). Accordingly, utilities of VGAM1774 include diagnosis, prevention and treatment of diseases and clinical conditions associated with DKFZP586F1524. FLJ10815 (Accession NM_018231) is another VGAM1774 host target gene. FLJ10815 BINDING SITE is HOST TARGET binding site found in the 5' untranslated region of mRNA encoded by FLJ10815, corresponding to a HOST TARGET binding site such as BINDING SITE I, BINDING SITE II or BINDING SITE III. Table 2 illustrates the complementarity of the nucleotide sequences of FLJ10815 BINDING SITE, designated SEQ ID:20173, to the nucleotide sequence of VGAM1774 RNA, herein designated VGAM RNA, also designated SEQ ID:4485.

Another function of VGAM1774 is therefore inhibition of FLJ10815 (Accession NM_018231). Accordingly, utilities of VGAM1774 include diagnosis, prevention and treatment of diseases and clinical conditions associated with FLJ10815. FLJ22415 (Accession XM_166168) is another VGAM1774 host target gene. FLJ22415 BINDING SITE is HOST TARGET binding site found in the 3' untranslated region of mRNA encoded by FLJ22415, corresponding to a HOST TARGET binding site such as BINDING SITE I, BINDING SITE II or BINDING SITE III. Table 2 illustrates the complementarity of the nucleotide sequences of FLJ22415 BINDING SITE, designated SEQ ID:43983, to the nucleotide sequence of VGAM1774 RNA, herein designated VGAM RNA, also designated SEQ ID:4485.

Another function of VGAM1774 is therefore inhibition of FLJ22415 (Accession XM_166168). Accordingly, utilities of VGAM1774 include diagnosis, prevention and treatment of diseases and clinical conditions associated with FLJ22415. KIAA0820 (Accession XM_044463) is another VGAM1774 host target gene. KIAA0820 BINDING SITE is HOST TARGET binding site found in the 3' untranslated region of mRNA encoded by KIAA0820, corresponding to a HOST TARGET binding site such as BINDING SITE I, BINDING SITE II or BINDING SITE III. Table 2 illustrates the complementarity of the nucleotide sequences of KIAA0820 BINDING SITE, designated SEQ ID:34214, to the nucleotide sequence of VGAM1774 RNA, herein designated VGAM RNA, also designated SEQ ID:4485.

Another function of VGAM1774 is therefore inhibition of KIAA0820 (Accession XM_044463). Accordingly, utilities of VGAM1774 include diagnosis, prevention and treatment of diseases and clinical conditions associated with KIAA0820. KIAA1863 (Accession XM_036104) is another VGAM1774 host target gene. KIAA1863 BINDING SITE is HOST TARGET binding site found in the 3' untranslated region of mRNA encoded by KIAA1863, corresponding to a HOST TARGET binding site such as BINDING SITE I, BINDING SITE II or BINDING SITE III. Table 2 illustrates the complementarity of the nucleotide sequences of KIAA1863 BINDING SITE, designated SEQ ID:32379, to the nucleotide sequence of VGAM1774 RNA, herein designated VGAM RNA, also designated SEQ ID:4485.

Another function of VGAM1774 is therefore inhibition of KIAA1863 (Accession XM_036104). Accordingly, utilities of VGAM1774 include diagnosis, prevention and treatment of diseases and clinical conditions associated with KIAA1863. LIG-1 (Accession XM_033712) is another VGAM1774 host target gene. LIG-1 BINDING SITE is HOST TARGET binding site found in the 3' untranslated region of mRNA encoded by LIG-1, corresponding to a HOST TARGET binding site such as BINDING SITE I, BINDING SITE II or BINDING SITE III. Table 2 illustrates the complementarity of the nucleotide sequences of LIG-1 BINDING SITE, designated SEQ ID:31952, to the nucleotide sequence of VGAM1774 RNA, herein designated VGAM RNA, also designated SEQ ID:4485.

Another function of VGAM1774 is therefore inhibition of LIG-1 (Accession XM_033712). Accordingly, utilities of VGAM1774 include diagnosis, prevention and treatment of diseases and clinical conditions associated with LIG-1. NCE2 (Accession NM_080678) is another VGAM1774 host target gene. NCE2 BINDING SITE is HOST TARGET binding site found in the 3' untranslated region of mRNA encoded by NCE2, corresponding to a HOST TARGET binding site such as BINDING SITE I, BINDING SITE II or BINDING SITE III. Table 2 illustrates the complementarity of the nucleotide sequences of NCE2 BINDING SITE, designated SEQ ID:27971, to the nucleotide sequence of VGAM1774 RNA, herein designated VGAM RNA, also designated SEQ ID:4485.

Another function of VGAM1774 is therefore inhibition of NCE2 (Accession NM_080678). Accordingly, utilities of VGAM1774 include diagnosis, prevention and treatment of diseases and clinical conditions associated with NCE2. Protocadherin 19 (PCDH19, Accession XM_033173) is another VGAM1774 host target gene. PCDH19 BINDING SITE is HOST TARGET binding site found in the 3' untranslated region of mRNA encoded by PCDH19, corresponding to a HOST TARGET binding site such as BINDING SITE I, BINDING SITE II or BINDING SITE III. Table 2 illustrates the complementarity of the nucleotide sequences of PCDH19 BINDING SITE, designated SEQ ID:31857, to the nucleotide sequence of VGAM1774 RNA, herein designated VGAM RNA, also designated SEQ ID:4485.

Another function of VGAM1774 is therefore inhibition of Protocadherin 19 (PCDH19, Accession XM_033173). Accordingly, utilities of VGAM1774 include diagnosis, prevention and treatment of diseases and clinical conditions associated with PCDH19. RNAC (Accession NM_005772) is another VGAM1774 host target gene. RNAC BINDING SITE is HOST TARGET binding site found in the 3' untranslated region of mRNA encoded by RNAC, corresponding to a HOST TARGET binding site such as BINDING SITE I, BINDING SITE II or BINDING SITE III. Table 2 illustrates the complementarity of the nucleotide sequences of RNAC BINDING SITE, designated SEQ ID:12343, to the nucleotide sequence of VGAM1774 RNA, herein designated VGAM RNA, also designated SEQ ID:4485.

Another function of VGAM1774 is therefore inhibition of RNAC (Accession NM_005772). Accordingly, utilities of VGAM1774 include diagnosis, prevention and treatment of diseases and clinical conditions associated with RNAC. STRIN (Accession NM_016271) is another VGAM1774 host target gene. STRIN BINDING SITE is HOST TARGET binding site found in the 3' untranslated region of mRNA encoded by STRIN, corresponding to a HOST TARGET binding site such as BINDING SITE I, BINDING SITE II or BINDING SITE III. Table 2 illustrates the complementarity of the nucleotide sequences of STRIN BINDING SITE, designated SEQ ID:18394, to the nucleotide sequence of VGAM1774 RNA, herein designated VGAM RNA, also designated SEQ ID:4485.

Another function of VGAM1774 is therefore inhibition of STRIN (Accession NM_016271). Accordingly, utilities of VGAM1774 include diagnosis, prevention and treatment of diseases and clinical conditions associated with STRIN. Three Prime Repair Exonuclease 1 (TREX1, Accession NM_033628) is another VGAM1774 host target gene. TREX1 BINDING SITE1 and TREX1 BINDING SITE2 are HOST TARGET binding sites found in untranslated regions of mRNA encoded by TREX1, corresponding to HOST TARGET binding sites such as BINDING SITE I, BINDING SITE II or BINDING SITE III. Table 2 illustrates the complementarity of the nucleotide sequences of TREX1 BINDING SITE1 and TREX1 BINDING SITE2, designated SEQ ID:27343 and SEQ ID:27334 respectively, to the nucleotide sequence of VGAM1774 RNA, herein designated VGAM RNA, also designated SEQ ID:4485.

Another function of VGAM1774 is therefore inhibition of Three Prime Repair Exonuclease 1 (TREX1, Accession NM_033628). Accordingly, utilities of VGAM1774 include diagnosis, prevention and treatment of diseases and clinical conditions associated with TREX1. LOC124602 (Accession XM_058829) is another VGAM1774 host target gene. LOC124602 BINDING SITE is HOST TARGET binding site found in the 5' untranslated region of mRNA encoded by LOC124602, corresponding to a HOST TARGET binding site such as BINDING SITE I, BINDING SITE II or BINDING SITE III. Table 2 illustrates the complementarity of the nucleotide sequences of LOC124602 BINDING SITE, designated SEQ ID:36755, to the nucleotide sequence of VGAM1774 RNA, herein designated VGAM RNA, also designated SEQ ID:4485.

Another function of VGAM1774 is therefore inhibition of LOC124602 (Accession XM_058829). Accordingly, utilities of VGAM1774 include diagnosis, prevention and treatment of diseases and clinical conditions associated with LOC124602. LOC163397 (Accession XM_099133) is another VGAM1774 host target gene. LOC163397 BINDING SITE is HOST TARGET binding site found in the 5' untranslated region of mRNA encoded by LOC163397, corresponding to a HOST TARGET binding site such as BINDING SITE I, BINDING SITE II or BINDING SITE III. Table 2 illustrates the complementarity of the nucleotide sequences of LOC163397 BINDING SITE, designated SEQ ID:42081, to the nucleotide sequence of VGAM1774 RNA, herein designated VGAM RNA, also designated SEQ ID:4485.

Another function of VGAM1774 is therefore inhibition of LOC163397 (Accession XM_099133). Accordingly, utilities of VGAM1774 include diagnosis, prevention and treatment of diseases and clinical conditions associated with LOC163397. LOC203397 (Accession XM_114695) is another VGAM1774 host target gene. LOC203397 BINDING SITE is HOST TARGET binding site found in the 5' untranslated region of mRNA encoded by LOC203397, corresponding to a HOST TARGET binding site such as BINDING SITE I, BINDING SITE II or BINDING SITE III. Table 2 illustrates the complementarity of the nucleotide sequences of LOC203397 BINDING SITE, designated SEQ ID:43035, to the nucleotide sequence of VGAM1774 RNA, herein designated VGAM RNA, also designated SEQ ID:4485.

Another function of VGAM1774 is therefore inhibition of LOC203397 (Accession XM_114695). Accordingly, utilities of VGAM1774 include diagnosis, prevention and treatment of diseases and clinical conditions associated with LOC203397. LOC90499 (Accession XM_032170) is another VGAM1774 host target gene. LOC90499 BINDING SITE is HOST TARGET binding site found in the 3' untranslated region of mRNA encoded by LOC90499, corresponding to a HOST TARGET binding site such as BINDING SITE I, BINDING SITE II or BINDING SITE III. Table 2 illustrates the complementarity of the nucleotide sequences of LOC90499 BINDING SITE, designated SEQ ID:31580, to the nucleotide sequence of VGAM1774 RNA, herein designated VGAM RNA, also designated SEQ ID:4485.

Another function of VGAM1774 is therefore inhibition of LOC90499 (Accession XM_032170). Accordingly, utilities of VGAM1774 include diagnosis, prevention and treatment of diseases and clinical conditions associated with LOC90499. LOC91445 (Accession XM_018516) is another VGAM1774 host target gene. LOC91445 BINDING SITE is HOST TARGET binding site found in the 3' untranslated region of mRNA encoded by LOC91445, corresponding to a HOST TARGET binding site such as BINDING SITE I, BINDING SITE II or BINDING SITE III. Table 2 illustrates the complementarity of the nucleotide sequences of LOC91445 BINDING SITE, designated SEQ ID:30368, to the nucleotide sequence of VGAM1774 RNA, herein designated VGAM RNA, also designated SEQ ID:4485.

Another function of VGAM1774 is therefore inhibition of LOC91445 (Accession XM_018516). Accordingly, utilities of VGAM1774 include diagnosis, prevention and treatment of diseases and clinical conditions associated with LOC91445. FIG. 1 further provides a conceptual description of a novel bioinformatically detected viral gene of the present invention, referred to here as Viral Genomic Address Messenger 1775 (VGAM1775) viral gene, which modulates expression of respective host target genes thereof, the function and utility of which host target genes is known in the art.

VGAM1775 is a novel bioinformatically detected regulatory, non protein coding, viral micro RNA (miRNA) gene. The method by which VGAM1775 was detected is described hereinabove with reference to FIGS. 1-8.

VGAM1775 gene, herein designated VGAM GENE, is a viral gene contained in the genome of Cryphonectria Hypovirus 1. VGAM1775 host target gene, herein designated VGAM HOST TARGET GENE, is a human gene contained in the human genome.

VGAM1775 gene encodes a VGAM1775 precursor RNA, herein designated VGAM PRECURSOR RNA. Similar to other miRNA genes, and unlike most ordinary genes, VGAM1775 precursor RNA does not encode a protein. A nucleotide sequence identical or highly similar to the nucleotide sequence of VGAM1775 precursor RNA is designated SEQ ID:1761, and is provided hereinbelow with reference to the sequence listing part. Nucleotide sequence SEQ ID:1761 is located at position 994 relative to the genome of Cryphonectria Hypovirus 1.

VGAM1775 precursor RNA folds onto itself, forming VGAM1775 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1775 folded precursor RNA into VGAM1775 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 89%) nucleotide sequence of VGAM1775 RNA is designated SEQ ID:4486, and is provided hereinbelow with reference to the sequence listing part.

VGAM1775 host target gene, herein designated VGAM HOST TARGET GENE, encodes a corresponding messenger RNA, VGAM1775 host target RNA, herein designated VGAM HOST TARGET RNA. VGAM1775 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1775 RNA, herein designated VGAM RNA, binds complementarily to one or more host target binding sites located in untranslated regions of VGAM1775 host target RNA, herein designated VGAM HOST TARGET RNA. This complementary binding is due to the fact that the nucleotide sequence of VGAM1775 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1775 RNA, herein designated VGAM RNA, may have a different number of host target binding sites in untranslated regions of a VGAM1775 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1775 RNA, herein designated VGAM RNA, to host target binding sites on VGAM1775 host target RNA, herein designated VGAM HOST TARGET RNA, such as BINDING SITE I, BINDING SITE II and BINDING SITE III, inhibits translation of VGAM1775 host target RNA into VGAM1775 host target protein, herein designated VGAM HOST TARGET PROTEIN. VGAM host target protein is therefore outlined by a broken line.

It is appreciated that VGAM1775 host target gene, herein designated VGAM HOST TARGET GENE, in fact represents a plurality of VGAM1775 host target genes. The mRNA of each one of this plurality of VGAM1775 host target genes comprises one or more host target binding sites, each having a nucleotide sequence which is at least partly complementary to VGAM1775 RNA, herein designated VGAM RNA, and which when bound by VGAM1775 RNA causes inhibition of translation of respective one or more VGAM1775 host target proteins.

It is further appreciated by one skilled in the art that the mode of translational inhibition illustrated by FIG. 1 with specific reference to translational inhibition exerted by VGAM1775 gene, herein designated VGAM GENE, on one or more VGAM1775 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1775 is inhibition of expression of host target genes, as part of a novel viral mechanism of attacking a host. Accordingly, utilities of VGAM1775 include diagnosis, prevention and treatment of viral infection by Cryphonectria Hypovirus 1. Specific functions, and accordingly utilities, of VGAM1775 correlate with, and may be deduced from, the identity of the host target genes which VGAM1775 binds and inhibits, and the function of these host target genes, as elaborated hereinbelow.

Nucleotide sequences of the VGAM1775 precursor RNA, herein designated VGAM PRECURSOR RNA, and of the 'diced' VGAM1775 RNA, herein designated VGAM RNA, and a schematic representation of the secondary folding of VGAM1775 folded precursor RNA, herein designated VGAM FOLDED PRECURSOR RNA, of VGAM1775 are further described hereinbelow with reference to Table 1.

Nucleotide sequences of host target binding sites, such as BINDING SITE-I, BINDING SITE-II and BINDING SITE-III of FIG. 1, found on VGAM1775 host target RNA, and schematic representation of the complementarity of each of these host target binding sites to VGAM1775 RNA, herein designated VGAM RNA, are described hereinbelow with reference to Table 2.

As mentioned hereinabove with reference to FIG. 1, a function of VGAM1775 gene, herein designated VGAM is inhibition of expression of VGAM1775 target genes. It is appreciated that specific functions, and accordingly utilities, of VGAM1775 correlate with, and may be deduced from, the identity of the target genes which VGAM1775 binds and inhibits, and the function of these target genes, as elaborated hereinbelow.

ATP-binding Cassette, Sub-family D (ALD), Member 3 (ABCD3, Accession NM_002858) is a VGAM1775 host target gene. ABCD3 BINDING SITE is HOST TARGET binding site found in the 3' untranslated region of mRNA encoded by ABCD3, corresponding to a HOST TARGET binding site such as BINDING SITE I, BINDING SITE II or BINDING SITE III. Table 2 illustrates the complementarity of the nucleotide sequences of ABCD3 BINDING SITE, designated SEQ ID:8753, to the nucleotide sequence of VGAM1775 RNA, herein designated VGAM RNA, also designated SEQ ID:4486.

A function of VGAM1775 is therefore inhibition of ATP-binding Cassette, Sub-family D (ALD), Member 3 (ABCD3, Accession NM_002858), a gene which a probable transporter. Accordingly, utilities of VGAM1775 include diagnosis, prevention and treatment of diseases and clinical conditions associated with ABCD3. The function of ABCD3 has been established by previous studies. Peroxisomes are single, membrane-bound, spheroid organelles present in virtually all eukaryotic cells. The polypeptide composition of the peroxisomal membrane is distinct from that of other organelles and comprises 2 quantitatively major (22K and 70K) and several minor peroxisomal membrane proteins. The peroxisome matrix contains more than 40 enzymes which are involved in a variety of metabolic processes including peroxide-based respiration, synthesis of plasmalogen and bile acids, beta-oxidation of very long chain fatty acids, and glyoxylate transamination. Biogenesis of peroxisomes appears to proceed by import of newly synthesized proteins into existing peroxisomes which enlarge and divide. Most matrix enzymes use an SKL (ser-lys-leu) tripeptide at the C-terminus as a targeting sequence, and the import of at least one, acyl-CoA oxidase, is ATP-dependent. Peroxisomal membrane proteins (PMP), as well as the peroxisomal matrix enzymes, are synthesized on free cytoplasmic polysomes at their mature size. Disorders with defective peroxisome biogenesis include Zellweger syndrome (ZWS1; 214100) and neonatal adrenoleukodystrophy (OMIM Ref. No. 202370). In these disorders, many peroxisomal matrix proteins are mislocated in the cytosol, whereas others, such as PMP70, PMP22 (OMIM Ref. No. 601097), and thiolase precursor, are associated with irregularly shaped vesicles which may be defective peroxisomes or peroxisome precursors. These observations led to the hypothesis that the peroxisome biogenesis defects are due to defective import mechanisms for peroxisomal matrix enzymes. Somatic cell fusion studies indicated the existence of at least 11 complementation groups for ZS and related phenotypes (Moser et al., 1995). PMP70 was mapped to chromosome 1 by analysis of somatic cell hybrid DNAs (Gartner et al., 1992) and regionalized to 1p22-p21 by fluorescence in situ hybridization (1,2: Gartner et al., 1992, 1993). The gene encoding the mouse homolog of PMP70 (Pmp1) was located on chromosome 3 by interspecific backcross analysis.

Full details of the abovementioned studies are described in the following publications, the disclosure of which are hereby incorporated by reference:

Moser, A. B.; Rasmussen, M.; Naidu, S.; Watkins, P. A.; McGuinness, M.; Hajra, A. K.; Chen, G.; Raymond, G.; Liu, A.; Gordon, D.; Garnaas, K.; Walton, D. S.; Skjedal, O. H.; Guggenheim, M. A.; Jackson, L. G.; Elias, E. R.; Moser, H. W.: Phenotype of patients with peroxisomal disorders subdivided into sixteen complementation groups. J. Pediat. 127: 13-22, 1995; and Gartner, J.; Kearns, W.; Pearson, P.; Valle, D.: Characterization and localization of the human 70-kD peroxisomal membrane protein (PMP70) gene. (Abstract) Am. J. Hum. Genet. 51 (suppl.

Further studies establishing the function and utilities of ABCD3 are found in John Hopkins OMIM database record ID 170995, and in sited publications numbered 10944-10946, 1111 and 11167-11168 listed in the bibliography section hereinbelow, which are also hereby incorporated by reference. ADP-ribosylation Factor 3 (ARF3, Accession NM_001659) is another VGAM1775 host target gene. ARF3 BINDING SITE is HOST TARGET binding site found in the 3' untranslated region of mRNA encoded by ARF3, corresponding to a HOST TARGET binding site such as BINDING SITE I, BINDING SITE II or BINDING SITE III. Table 2 illustrates the complementarity of the nucleotide sequences of ARF3 BINDING SITE, designated SEQ ID:7381, to the nucleotide sequence of VGAM1775 RNA, herein designated VGAM RNA, also designated SEQ ID:4486.

Another function of VGAM1775 is therefore inhibition of ADP-ribosylation Factor 3 (ARF3, Accession NM_001659). Accordingly, utilities of VGAM1775 include diagnosis, prevention and treatment of diseases and clinical conditions associated with ARF3. Beta-1,3-glucuronyltransferase 1 (glucuronosyltransferase P) (B3GAT1, Accession NM_018644) is another VGAM1775 host target gene. B3GAT1 BINDING SITE1 and B3GAT1 BINDING SITE2 are HOST TARGET binding sites found in untranslated regions of mRNA encoded by B3GAT1, corresponding to HOST TARGET binding sites such as BINDING SITE I, BINDING SITE II or BINDING SITE III. Table 2 illustrates the complementarity of the nucleotide sequences of B3GAT1 BINDING SITE1 and B3GAT1 BINDING SITE2, designated SEQ ID:20720 and SEQ ID:27633 respectively, to the nucleotide sequence of VGAM1775 RNA, herein designated VGAM RNA, also designated SEQ ID:4486.

Another function of VGAM1775 is therefore inhibition of Beta-1,3-glucuronyltransferase 1 (glucuronosyltransferase P) (B3GAT1, Accession NM_018644). Accordingly, utilities of VGAM1775 include diagnosis, prevention and treatment of diseases and clinical conditions associated with B3GAT1. Leucine Zipper, Putative Tumor Suppressor 1 (LZTS1, Accession NM_021020) is another VGAM1775 host target gene. LZTS1 BINDING SITE is HOST TARGET binding site found in the 3' untranslated region of mRNA encoded by LZTS1, corresponding to a HOST TARGET binding site such as BINDING SITE I, BINDING SITE II or BINDING SITE III. Table 2 illustrates the complementarity of the nucleotide sequences of LZTS1 BINDING SITE, designated SEQ ID:22009, to the nucleotide sequence of VGAM1775 RNA, herein designated VGAM RNA, also designated SEQ ID:4486.

Another function of VGAM1775 is therefore inhibition of Leucine Zipper, Putative Tumor Suppressor 1 (LZTS1, Accession NM_021020), a gene which Zygin 1; may have a role in axonal outgrowth; has similarity to C. elegans UNC-76. Accordingly, utilities of VGAM1775 include diagnosis, prevention and treatment of diseases and clinical conditions associated with LZTS1. The function of LZTS1 and its association with various diseases and clinical conditions, has been established by previous studies, as described hereinabove with reference to VGAM890. Phosphoprotein Enriched In Astrocytes 15 (PEA15, Accession NM_003768) is another VGAM1775 host target gene. PEA15 BINDING SITE is HOST TARGET binding site found in the 3' untranslated region of mRNA encoded by PEA15, corresponding to a HOST TARGET binding site such as BINDING SITE I, BINDING SITE II or BINDING SITE III. Table 2 illustrates the complementarity of the nucleotide sequences of PEA15 BINDING SITE, designated SEQ ID:9852, to the nucleotide sequence of VGAM1775 RNA, herein designated VGAM RNA, also designated SEQ ID:4486.

Another function of VGAM1775 is therefore inhibition of Phosphoprotein Enriched In Astrocytes 15 (PEA15, Accession NM_003768), a gene which is a phosphoprotein and involved in glucose uptake. Accordingly, utilities of VGAM1775 include diagnosis, prevention and treatment of diseases and clinical conditions associated with PEA15. The function of PEA15 and its association with various diseases and clinical conditions, has been established by previous studies, as described hereinabove with reference to VGAM949. Paxillin (PXN, Accession NM_002859) is another VGAM1775 host target gene. PXN BINDING SITE is HOST TARGET binding site found in the 3' untranslated region of mRNA encoded by PXN, corresponding to a HOST TARGET binding site such as BINDING SITE I, BINDING SITE II or BINDING SITE III. Table 2 illustrates the complementarity of the nucleotide sequences of PXN BINDING SITE, designated SEQ ID:8756, to the nucleotide sequence of VGAM1775 RNA, herein designated VGAM RNA, also designated SEQ ID:4486.

Another function of VGAM1775 is therefore inhibition of Paxillin (PXN, Accession NM_002859), a gene which may be involved in p53-dependent apoptosis. Accordingly, utilities of VGAM1775 include diagnosis, prevention and treatment of diseases and clinical conditions associated with PXN. The function of PXN and its association with various diseases and clinical conditions, has been established by previous studies, as described hereinabove with reference to VGAM132. Transcription Factor 7 (T-cell specific, HMG-box) (TCF7, Accession NM_003202) is another VGAM1775 host target gene. TCF7 BINDING SITE is HOST TARGET binding site found in the 3' untranslated region of mRNA encoded by TCF7, corresponding to a HOST TARGET binding site such as BINDING SITE I, BINDING SITE II or BINDING SITE III. Table 2 illustrates the complementarity of the nucleotide sequences of TCF7 BINDING SITE, designated SEQ ID:9195, to the nucleotide sequence of VGAM1775 RNA, herein designated VGAM RNA, also designated SEQ ID:4486.

Another function of VGAM1775 is therefore inhibition of Transcription Factor 7 (T-cell specific, HMG-box) (TCF7, Accession NM_003202). Accordingly, utilities of VGAM1775 include diagnosis, prevention and treatment of diseases and clinical conditions associated with TCF7. C1q and Tumor Necrosis Factor Related Protein 6 (C1QTNF6, Accession NM_031910) is another VGAM1775 host target gene. C1QTNF6 BINDING SITE is HOST TARGET binding site found in the 3' untranslated region of mRNA encoded by C1QTNF6, corresponding to a HOST TARGET binding site such as BINDING SITE I, BINDING SITE II or BINDING SITE III. Table 2 illustrates the complementarity of the nucleotide sequences of C1QTNF6 BINDING SITE, designated SEQ ID:25658, to the nucleotide sequence of VGAM1775 RNA, herein designated VGAM RNA, also designated SEQ ID:4486.

Another function of VGAM1775 is therefore inhibition of C1q and Tumor Necrosis Factor Related Protein 6 (C1QTNF6, Accession NM_031910). Accordingly, utilities of VGAM1775 include diagnosis, prevention and treatment of diseases and clinical conditions associated with C1QTNF6. DKFZp761D0614 (Accession XM_113634) is another VGAM1775 host target gene. DKFZp761D0614 BINDING SITE is HOST TARGET binding site found in the 3' untranslated region of mRNA encoded by DKFZp761D0614, corresponding to a HOST TARGET binding site such as BINDING SITE I, BINDING SITE II or BINDING SITE III. Table 2 illustrates the complementarity of the nucleotide sequences of DKFZp761D0614 BINDING SITE, designated SEQ ID:42311, to the nucleotide sequence of VGAM1775 RNA, herein designated VGAM RNA, also designated SEQ ID:4486.

Another function of VGAM1775 is therefore inhibition of DKFZp761D0614 (Accession XM_113634). Accordingly, utilities of VGAM1775 include diagnosis, prevention and treatment of diseases and clinical conditions associated with DKFZp761D0614. FLJ10508 (Accession NM_018118) is another VGAM1775 host target gene. FLJ10508 BINDING SITE is HOST TARGET binding site found in the 3' untranslated region of mRNA encoded by FLJ10508, corresponding to a HOST TARGET binding site such as BINDING SITE I, BINDING SITE II or BINDING SITE III. Table 2 illustrates the complementarity of the nucleotide sequences of FLJ10508 BINDING SITE, designated SEQ ID:19891, to the nucleotide sequence of VGAM1775 RNA, herein designated VGAM RNA, also designated SEQ ID:4486.

Another function of VGAM1775 is therefore inhibition of FLJ10508 (Accession NM_018118). Accordingly, utilities of VGAM1775 include diagnosis, prevention and treatment of diseases and clinical conditions associated with FLJ10508. FLJ14297 (Accession NM_024903) is another VGAM1775 host target gene. FLJ14297 BINDING SITE is HOST TARGET binding site found in the 3' untranslated region of mRNA encoded by FLJ14297, corresponding to a HOST TARGET binding site such as BINDING SITE I, BINDING SITE II or BINDING SITE III. Table 2 illustrates the complementarity of the nucleotide sequences of FLJ14297 BINDING SITE, designated SEQ ID:24393, to the nucleotide sequence of VGAM1775 RNA, herein designated VGAM RNA, also designated SEQ ID:4486.

Another function of VGAM1775 is therefore inhibition of FLJ14297 (Accession NM_024903). Accordingly, utilities of VGAM1775 include diagnosis, prevention and treatment of diseases and clinical conditions associated with FLJ14297. MGC11115 (Accession NM_032310) is another VGAM1775 host target gene. MGC11115 BINDING SITE is HOST TARGET binding site found in the 3' untranslated region of mRNA encoded by MGC11115, corresponding to a HOST TARGET binding site such as BINDING SITE I, BINDING SITE II or BINDING SITE III. Table 2 illustrates the complementarity of the nucleotide sequences of MGC11115 BINDING SITE, designated SEQ ID:26096, to the nucleotide sequence of VGAM1775 RNA, herein designated VGAM RNA, also designated SEQ ID:4486.

Another function of VGAM1775 is therefore inhibition of MGC11115 (Accession NM_032310). Accordingly, utilities of VGAM1775 include diagnosis, prevention and treatment of diseases and clinical conditions associated with MGC11115. RAB22A, Member RAS Oncogene Family (RAB22A, Accession XM_009454) is another VGAM1775 host target gene. RAB22A BINDING SITE is HOST TARGET binding site found in the 5' untranslated region of mRNA encoded by RAB22A, corresponding to a HOST TARGET binding site such as BINDING SITE I, BINDING SITE II or BINDING SITE III. Table 2 illustrates the complementarity of the nucleotide sequences of RAB22A BINDING SITE, designated SEQ ID:30111, to the nucleotide sequence of VGAM1775 RNA, herein designated VGAM RNA, also designated SEQ ID:4486.

Another function of VGAM1775 is therefore inhibition of RAB22A, Member RAS Oncogene Family (RAB22A, Accession XM_009454). Accordingly, utilities of VGAM1775 include diagnosis, prevention and treatment of diseases and clinical conditions associated with RAB22A. LOC115110 (Accession XM_049825) is another VGAM1775 host target gene. LOC115110 BINDING SITE is HOST TARGET binding site found in the 3' untranslated region of mRNA encoded by LOC115110, corresponding to a HOST TARGET binding site such as BINDING SITE I, BINDING SITE II or BINDING SITE III. Table 2 illustrates the complementarity of the nucleotide sequences of LOC115110 BINDING SITE, designated SEQ ID:35506, to the nucleotide sequence of VGAM1775 RNA, herein designated VGAM RNA, also designated SEQ ID:4486.

Another function of VGAM1775 is therefore inhibition of LOC115110 (Accession XM_049825). Accordingly, utilities of VGAM1775 include diagnosis, prevention and treatment of diseases and clinical conditions associated with LOC115110. LOC130162 (Accession XM_059406) is another VGAM1775 host target gene. LOC130162 BINDING SITE is HOST TARGET binding site found in the 3' untranslated region of mRNA encoded by LOC130162, corresponding to a HOST TARGET binding site such as BINDING SITE I, BINDING SITE II or BINDING SITE III. Table 2 illustrates the complementarity of the nucleotide sequences of LOC130162 BINDING SITE, designated SEQ ID:36985, to the nucleotide sequence of VGAM1775 RNA, herein designated VGAM RNA, also designated SEQ ID:4486.

Another function of VGAM1775 is therefore inhibition of LOC130162 (Accession XM_059406). Accordingly, utilities of VGAM1775 include diagnosis, prevention and treatment of diseases and clinical conditions associated with LOC130162. LOC146375 (Accession XM_085434) is another VGAM1775 host target gene. LOC146375 BINDING SITE is HOST TARGET binding site found in the 5' untranslated region of mRNA encoded by LOC146375, corresponding to a HOST TARGET binding site such as BINDING SITE I, BINDING SITE II or BINDING SITE III. Table 2 illustrates the complementarity of the nucleotide sequences of LOC146375 BINDING SITE, designated SEQ ID:38140, to the nucleotide sequence of VGAM1775 RNA, herein designated VGAM RNA, also designated SEQ ID:4486.

Another function of VGAM1775 is therefore inhibition of LOC146375 (Accession XM_085434). Accordingly, utilities of VGAM1775 include diagnosis, prevention and treatment of diseases and clinical conditions associated with LOC146375. LOC151249 (Accession XM_010852) is another VGAM1775 host target gene. LOC151249 BINDING SITE is HOST TARGET binding site found in the 3' untranslated region of mRNA encoded by LOC151249, corresponding to a HOST TARGET binding site such as BINDING SITE I, BINDING SITE II or BINDING SITE III. Table 2 illustrates the complementarity of the nucleotide sequences of LOC151249 BINDING SITE, designated SEQ ID:30163, to the nucleotide sequence of VGAM1775 RNA, herein designated VGAM RNA, also designated SEQ ID:4486.

Another function of VGAM1775 is therefore inhibition of LOC151249 (Accession XM_010852). Accordingly, utilities of VGAM1775 include diagnosis, prevention and treatment of diseases and clinical conditions associated with LOC151249. LOC153817 (Accession XM_027964) is another VGAM1775 host target gene. LOC153817 BINDING SITE is HOST TARGET binding site found in the 3' untranslated region of mRNA encoded by LOC153817, corresponding to a HOST TARGET binding site such as BINDING SITE I, BINDING SITE II or BINDING SITE III. Table 2 illustrates the complementarity of the nucleotide sequences of LOC153817 BINDING SITE, designated SEQ ID:30599, to the nucleotide sequence of VGAM1775 RNA, herein designated VGAM RNA, also designated SEQ ID:4486.

Another function of VGAM1775 is therefore inhibition of LOC153817 (Accession XM_027964). Accordingly, utilities of VGAM1775 include diagnosis, prevention and treatment of diseases and clinical conditions associated with LOC153817. LOC199858 (Accession XM_114040) is another VGAM1775 host target gene. LOC199858 BINDING SITE is HOST TARGET binding site found in the 5' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42638, to the nucleotide sequence of VGAM1775 RNA, herein designated VGAM RNA, also designated SEQ ID:4486.

Another function of VGAM1775 is therefore inhibition of LOC199858 (Accession XM_114040). Accordingly, utilities of VGAM1775 include diagnosis, prevention and treatment of diseases and clinical conditions associated with LOC199858. LOC203378 (Accession XM_117541) is another VGAM1775 host target gene. LOC203378 BINDING SITE is HOST TARGET binding site found in the 5' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43560, to the nucleotide sequence of VGAM1775 RNA, herein designated VGAM RNA, also designated SEQ ID:4486.

Another function of VGAM1775 is therefore inhibition of LOC203378 (Accession XM_117541). Accordingly, utilities of VGAM1775 include diagnosis, prevention and treatment of diseases and clinical conditions associated with LOC203378. LOC220840 (Accession XM_165514) is another VGAM1775 host target gene. LOC220840 BINDING SITE is HOST TARGET binding site found in the 3' untranslated region of mRNA encoded by LOC220840, corresponding to a HOST TARGET binding site such as BINDING SITE I, BINDING SITE II or BINDING SITE III. Table 2 illustrates the complementarity of the nucleotide sequences of LOC220840 BINDING SITE, designated SEQ ID:43659, to the nucleotide sequence of VGAM1775 RNA, herein designated VGAM RNA, also designated SEQ ID:4486.

Another function of VGAM1775 is therefore inhibition of LOC220840 (Accession XM_165514). Accordingly, utilities of VGAM1775 include diagnosis, prevention and treatment of diseases and clinical conditions associated with LOC220840. LOC253943 (Accession XM_171195) is another VGAM1775 host target gene. LOC253943 BINDING SITE is HOST TARGET binding site found in the 3' untranslated region of mRNA encoded by LOC253943, corresponding to a HOST TARGET binding site such as BINDING SITE I, BINDING SITE II or BINDING SITE III. Table 2 illustrates the complementarity of the nucleotide sequences of LOC253943 BINDING SITE, designated SEQ ID:45985, to the nucleotide sequence of VGAM1775 RNA, herein designated VGAM RNA, also designated SEQ ID:4486.

Another function of VGAM1775 is therefore inhibition of LOC253943 (Accession XM_171195). Accordingly, utilities of VGAM1775 include diagnosis, prevention and treatment of diseases and clinical conditions associated with LOC253943. FIG. 1 further provides a conceptual description of a novel bioinformatically detected viral gene of the present invention, referred to here as Viral Genomic Address Messenger 1776 (VGAM1776) viral gene, which modulates expression of respective host target genes thereof, the function and utility of which host target genes is known in the art.

VGAM1776 is a novel bioinformatically detected regulatory, non protein coding, viral micro RNA (miRNA) gene. The method by which VGAM1776 was detected is described hereinabove with reference to FIGS. 1-8.

VGAM1776 gene, herein designated VGAM GENE, is a viral gene contained in the genome of Cryphonectria Hypovirus 1. VGAM1776 host target gene, herein designated VGAM HOST TARGET GENE, is a human gene contained in the human genome.

VGAM1776 gene encodes a VGAM1776 precursor RNA, herein designated VGAM PRECURSOR RNA. Similar to other miRNA genes, and unlike most ordinary genes, VGAM1776 precursor RNA does not encode a protein. A nucleotide sequence identical or highly similar to the nucleotide sequence of VGAM1776 precursor RNA is designated SEQ ID:1762, and is provided hereinbelow with reference to the sequence listing part. Nucleotide sequence SEQ ID:1762 is located at position 9833 relative to the genome of Cryphonectria Hypovirus 1.

VGAM1776 precursor RNA folds onto itself, forming VGAM1776 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1776 folded precursor RNA into VGAM1776 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM1776 RNA is designated SEQ ID:4487, and is provided hereinbelow with reference to the sequence listing part.

VGAM1776 host target gene, herein designated VGAM HOST TARGET GENE, encodes a corresponding messenger RNA, VGAM1776 host target RNA, herein designated VGAM HOST TARGET RNA. VGAM1776 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1776 RNA, herein designated VGAM RNA, binds complementarily to one or more host target binding sites located in untranslated regions of VGAM1776 host target RNA, herein designated VGAM HOST TARGET RNA. This complementary binding is due to the fact that the nucleotide sequence of VGAM1776 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1776 RNA, herein designated VGAM RNA, may have a different number of host target binding sites in untranslated regions of a VGAM1776 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1776 RNA, herein designated VGAM RNA, to host target binding sites on VGAM1776 host target RNA, herein designated VGAM HOST TARGET RNA, such as BINDING SITE I, BINDING SITE II and BINDING SITE III, inhibits translation of VGAM1776 host target RNA into VGAM1776 host target protein, herein designated VGAM HOST TARGET PROTEIN. VGAM host target protein is therefore outlined by a broken line.

It is appreciated that VGAM1776 host target gene, herein designated VGAM HOST TARGET GENE, in fact represents a plurality of VGAM1776 host target genes. The mRNA of each one of this plurality of VGAM1776 host target genes comprises one or more host target binding sites, each having a nucleotide sequence which is at least partly complementary to VGAM1776 RNA, herein designated VGAM RNA, and which when bound by VGAM1776 RNA causes inhibition of translation of respective one or more VGAM1776 host target proteins.

It is further appreciated by one skilled in the art that the mode of translational inhibition illustrated by FIG. 1 with specific reference to translational inhibition exerted by VGAM1776 gene, herein designated VGAM GENE, on one or more VGAM1776 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1776 is inhibition of expression of host target genes, as part of a novel viral mechanism of attacking a host. Accordingly, utilities of VGAM1776 include diagnosis, prevention and treatment of viral infection by Cryphonectria Hypovirus 1. Specific functions, and accordingly utilities, of VGAM1776 correlate with, and may be deduced from, the identity of the host target genes which VGAM1776 binds and inhibits, and the function of these host target genes, as elaborated hereinbelow.

Nucleotide sequences of the VGAM1776 precursor RNA, herein designated VGAM PRECURSOR RNA, and of the 'diced' VGAM1776 RNA, herein designated VGAM RNA, and a schematic representation of the secondary folding of VGAM1776 folded precursor RNA, herein designated VGAM FOLDED PRECURSOR RNA, of VGAM1776 are further described hereinbelow with reference to Table 1.

Nucleotide sequences of host target binding sites, such as BINDING SITE-I, BINDING SITE-II and BINDING SITE-III of FIG. 1, found on VGAM1776 host target RNA, and schematic representation of the complementarity of each of these host target binding sites to VGAM1776 RNA, herein designated VGAM RNA, are described hereinbelow with reference to Table 2.

As mentioned hereinabove with reference to FIG. 1, a function of VGAM1776 gene, herein designated VGAM is inhibition of expression of VGAM1776 target genes. It is appreciated that specific functions, and accordingly utilities, of VGAM1776 correlate with, and may be deduced from, the identity of the target genes which VGAM1776 binds and inhibits, and the function of these target genes, as elaborated hereinbelow.

Exostoses (multiple)-like 1 (EXTL1, Accession NM_004455) is a VGAM1776 host target gene. EXTL1 BINDING SITE is HOST TARGET binding site found in the 3' untranslated region of mRNA encoded by EXTL1, corresponding to a HOST TARGET binding site such as BINDING SITE I, BINDING SITE II or BINDING SITE III. Table 2 illustrates the complementarity of the nucleotide sequences of EXTL1 BINDING SITE, designated SEQ ID:10753, to the nucleotide sequence of VGAM1776 RNA, herein designated VGAM RNA, also designated SEQ ID:4487.

A function of VGAM1776 is therefore inhibition of Exostoses (multiple)-like 1 (EXTL1, Accession NM_004455), a gene which probably contribute to the synthesis of heparan sulfate and heparin. Accordingly, utilities of VGAM1776 include diagnosis, prevention and treatment of diseases and clinical conditions associated with EXTL1. The function of EXTL1 and its association with various diseases and clinical conditions, has been established by previous studies, as described hereinabove with reference to VGAM806. Myeloid/lymphoid Or Mixed-lineage Leukemia (trithorax homolog, Drosophila); Translocated To, 4 (MLLT4, Accession XM_051832) is another VGAM1776 host target gene. MLLT4 BINDING SITE is HOST TARGET binding site found in the 3' untranslated region of mRNA encoded by MLLT4, corresponding to a HOST TARGET binding site such as BINDING SITE I, BINDING SITE II or BINDING SITE III. Table 2 illustrates the complementarity of the nucleotide sequences of MLLT4 BINDING SITE, designated SEQ ID:35886, to the nucleotide sequence of VGAM1776 RNA, herein designated VGAM RNA, also designated SEQ ID:4487.

Another function of VGAM1776 is therefore inhibition of Myeloid/lymphoid Or Mixed-lineage Leukemia (trithorax homolog, Drosophila); Translocated To, 4 (MLLT4, Accession XM_051832), a gene which may act as an intracellular signaling component. Accordingly, utilities of VGAM1776 include diagnosis, prevention and treatment of diseases and clinical conditions associated with MLLT4. The function of MLLT4 and its association with various diseases and clinical conditions, has been established by previous studies, as described hereinabove with reference to VGAM1608. Epiregulin (EREG, Accession NM_001432) is another VGAM1776 host target gene. EREG BINDING SITE is HOST TARGET binding site found in the 3' untranslated region of mRNA encoded by EREG, corresponding to a HOST TARGET binding site such as BINDING SITE I, BINDING SITE II or BINDING SITE III. Table 2 illustrates the complementarity of the nucleotide sequences of EREG BINDING SITE, designated SEQ ID:7156, to the nucleotide sequence of VGAM1776 RNA, herein designated VGAM RNA, also designated SEQ ID:4487.

Another function of VGAM1776 is therefore inhibition of Epiregulin (EREG, Accession NM_001432). Accordingly, utilities of VGAM1776 include diagnosis, prevention and treatment of diseases and clinical conditions associated with EREG. KIAA0057 (Accession NM_012288) is another VGAM1776 host target gene. KIAA0057 BINDING SITE is HOST TARGET binding site found in the 3' untranslated region of mRNA encoded by KIAA0057, corresponding to a HOST TARGET binding site such as BINDING SITE I, BINDING SITE II or BINDING SITE III. Table 2 illustrates the complementarity of the nucleotide sequences of KIAA0057 BINDING SITE, designated SEQ ID:14627, to the nucleotide sequence of VGAM1776 RNA, herein designated VGAM RNA, also designated SEQ ID:4487.

Another function of VGAM1776 is therefore inhibition of KIAA0057 (Accession NM_012288). Accordingly, utilities of VGAM1776 include diagnosis, prevention and treatment of diseases and clinical conditions associated with KIAA0057. KIAA1500 (Accession XM_034353) is another VGAM1776 host target gene. KIAA1500 BINDING SITE is HOST TARGET binding site found in the 3' untranslated region of mRNA encoded by KIAA1500, corresponding to a HOST TARGET binding site such as BINDING SITE I, BINDING SITE II or BINDING SITE III. Table 2 illustrates the complementarity of the nucleotide sequences of KIAA1500 BINDING SITE, designated SEQ ID:32064, to the nucleotide sequence of VGAM1776 RNA, herein designated VGAM RNA, also designated SEQ ID:4487.

Another function of VGAM1776 is therefore inhibition of KIAA1500 (Accession XM_034353). Accordingly, utilities of VGAM1776 include diagnosis, prevention and treatment of diseases and clinical conditions associated with KIAA1500. PRP8 Pre-mRNA Processing Factor 8 Homolog (yeast) (PRPF8, Accession XM_028335) is another VGAM1776 host target gene. PRPF8 BINDING SITE is HOST TARGET binding site found in the 3' untranslated region of mRNA encoded by PRPF8, corresponding to a HOST TARGET binding site such as BINDING SITE I, BINDING SITE II or BINDING SITE III. Table 2 illustrates the complementarity of the nucleotide sequences of PRPF8 BINDING SITE, designated SEQ ID:30686, to the nucleotide sequence of VGAM1776 RNA, herein designated VGAM RNA, also designated SEQ ID:4487.

Another function of VGAM1776 is therefore inhibition of PRP8 Pre-mRNA Processing Factor 8 Homolog (yeast) (PRPF8, Accession XM_028335). Accordingly, utilities of VGAM1776 include diagnosis, prevention and treatment of diseases and clinical conditions associated with PRPF8. Solute Carrier Family 2 (facilitated glucose transporter), Member 12 (SLC2A12, Accession NM_145176) is another VGAM1776 host target gene. SLC2A12 BINDING SITE is HOST TARGET binding site found in the 3' untranslated region of mRNA encoded by SLC2A12, corresponding to a HOST TARGET binding site such as BINDING SITE I, BINDING SITE II or BINDING SITE III. Table 2 illustrates the complementarity of the nucleotide sequences of SLC2A12 BINDING SITE, designated SEQ ID:29737, to the nucleotide sequence of VGAM1776 RNA, herein designated VGAM RNA, also designated SEQ ID:4487.

Another function of VGAM1776 is therefore inhibition of Solute Carrier Family 2 (facilitated glucose transporter), Member 12 (SLC2A12, Accession NM_145176). Accordingly, utilities of VGAM1776 include diagnosis, prevention and treatment of diseases and clinical conditions associated with SLC2A12. LOC153572 (Accession XM_098392) is another VGAM1776 host target gene. LOC153572 BINDING SITE is HOST TARGET binding site found in the 5' untranslated region of mRNA encoded by LOC153572, corresponding to a HOST TARGET binding site such as BINDING SITE I, BINDING SITE II or BINDING SITE III. Table 2 illustrates the complementarity of the nucleotide sequences of LOC153572 BINDING SITE, designated SEQ ID:41640, to the nucleotide sequence of VGAM1776 RNA, herein designated VGAM RNA, also designated SEQ ID:4487.

Another function of VGAM1776 is therefore inhibition of LOC153572 (Accession XM_098392). Accordingly, utilities of VGAM1776 include diagnosis, prevention and treatment of diseases and clinical conditions associated with LOC153572. FIG. 1 further provides a conceptual description of a novel bioinformatically detected viral gene of the present invention, referred to here as Viral Genomic Address Messenger 1777 (VGAM1777) viral gene, which modulates expression of respective host target genes thereof, the function and utility of which host target genes is known in the art.

VGAM1777 is a novel bioinformatically detected regulatory, non protein coding, viral micro RNA (miRNA) gene. The method by which VGAM1777 was detected is described hereinabove with reference to FIGS. 1-8.

VGAM1777 gene, herein designated VGAM GENE, is a viral gene contained in the genome of Cryphonectria Hypovirus 1. VGAM1777 host target gene, herein designated VGAM HOST TARGET GENE, is a human gene contained in the human genome.

VGAM1777 gene encodes a VGAM1777 precursor RNA, herein designated VGAM PRECURSOR RNA. Similar to other miRNA genes, and unlike most ordinary genes, VGAM1777 precursor RNA does not encode a protein. A nucleotide sequence identical or highly similar to the nucleotide sequence of VGAM1777 precursor RNA is designated SEQ ID:1763, and is provided hereinbelow with reference to the sequence listing part. Nucleotide sequence SEQ ID:1763 is located at position 7246 relative to the genome of Cryphonectria Hypovirus 1.

VGAM1777 precursor RNA folds onto itself, forming VGAM1777 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1777 folded precursor RNA into VGAM1777 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1777 RNA is designated SEQ ID:4488, and is provided hereinbelow with reference to the sequence listing part.

VGAM1777 host target gene, herein designated VGAM HOST TARGET GENE, encodes a corresponding messenger RNA, VGAM1777 host target RNA, herein designated VGAM HOST TARGET RNA. VGAM1777 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1777 RNA, herein designated VGAM RNA, binds complementarily to one or more host target binding sites located in untranslated regions of VGAM1777 host target RNA, herein designated VGAM HOST TARGET RNA. This complementary binding is due to the fact that the nucleotide sequence of VGAM1777 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1777 RNA, herein designated VGAM RNA, may have a different number of host target binding sites in untranslated regions of a VGAM1777 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1777 RNA, herein designated VGAM RNA, to host target binding sites on VGAM1777 host target RNA, herein designated VGAM HOST TARGET RNA, such as BINDING SITE I, BINDING SITE II and BINDING SITE III, inhibits translation of VGAM1777 host target RNA into VGAM1777 host target protein, herein designated VGAM HOST TARGET PROTEIN. VGAM host target protein is therefore outlined by a broken line.

It is appreciated that VGAM1777 host target gene, herein designated VGAM HOST TARGET GENE, in fact represents a plurality of VGAM1777 host target genes. The mRNA of each one of this plurality of VGAM1777 host target genes comprises one or more host target binding sites, each having a nucleotide sequence which is at least partly complementary to VGAM1777 RNA, herein designated VGAM RNA, and which when bound by VGAM1777 RNA causes inhibition of translation of respective one or more VGAM1777 host target proteins.

It is further appreciated by one skilled in the art that the mode of translational inhibition illustrated by FIG. 1 with specific reference to translational inhibition exerted by VGAM1777 gene, herein designated VGAM GENE, on one or more VGAM1777 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1777 is inhibition of expression of host target genes, as part of a novel viral mechanism of attacking a host. Accordingly, utilities of VGAM1777 include diagnosis, prevention and treatment of viral infection by Cryphonectria Hypovirus 1. Specific functions, and accordingly utilities, of VGAM1777 correlate with, and may be deduced from, the identity of the host target genes which VGAM1777 binds and inhibits, and the function of these host target genes, as elaborated hereinbelow.

Nucleotide sequences of the VGAM1777 precursor RNA, herein designated VGAM PRECURSOR RNA, and of the 'diced' VGAM1777 RNA, herein designated VGAM RNA, and a schematic representation of the secondary folding of VGAM1777 folded precursor RNA, herein designated VGAM FOLDED PRECURSOR RNA, of VGAM1777 are further described hereinbelow with reference to Table 1.

Nucleotide sequences of host target binding sites, such as BINDING SITE-I, BINDING SITE-II and BINDING SITE-III of FIG. 1, found on VGAM1777 host target RNA, and schematic representation of the complementarity of each of these host target binding sites to VGAM1777 RNA, herein designated VGAM RNA, are described hereinbelow with reference to Table 2.

As mentioned hereinabove with reference to FIG. 1, a function of VGAM1777 gene, herein designated VGAM is inhibition of expression of VGAM1777 target genes. It is appreciated that specific functions, and accordingly utilities, of VGAM1777 correlate with, and may be deduced from, the identity of the target genes which VGAM1777 binds and inhibits, and the function of these target genes, as elaborated hereinbelow.

Glutamate Dehydrogenase 1 (GLUD1, Accession NM_005271) is a VGAM1777 host target gene. GLUD1 BINDING SITE is HOST TARGET binding site found in the 3' untranslated region of mRNA encoded by GLUD1, corresponding to a HOST TARGET binding site such as BINDING SITE I, BINDING SITE II or BINDING SITE III. Table 2 illustrates the complementarity of the nucleotide sequences of GLUD1 BINDING SITE, designated SEQ ID:11773, to the nucleotide sequence of VGAM1777 RNA, herein designated VGAM RNA, also designated SEQ ID:4488.

A function of VGAM1777 is therefore inhibition of Glutamate Dehydrogenase 1 (GLUD1, Accession NM_005271). Accordingly, utilities of VGAM1777 include diagnosis, prevention and treatment of diseases and clinical conditions associated with GLUD1. RAD52 Homolog (S.

cerevisiae) (RAD52, Accession NM_134422) is another VGAM1777 host target gene. RAD52 BINDING SITE1 and RAD52 BINDING SITE2 are HOST TARGET binding sites found in untranslated regions of mRNA encoded by RAD52, corresponding to HOST TARGET binding sites such as BINDING SITE I, BINDING SITE II or BINDING SITE III. Table 2 illustrates the complementarity of the nucleotide sequences of RAD52 BINDING SITE1 and RAD52 BINDING SITE2, designated SEQ ID:28648 and SEQ ID:28656 respectively, to the nucleotide sequence of VGAM1777 RNA, herein designated VGAM RNA, also designated SEQ ID:4488.

Another function of VGAM1777 is therefore inhibition of RAD52 Homolog (S. cerevisiae) (RAD52, Accession NM_134422). Accordingly, utilities of VGAM1777 include diagnosis, prevention and treatment of diseases and clinical conditions associated with RAD52. DKFZP434O047 (Accession NM_015594) is another VGAM1777 host target gene. DKFZP434O047 BINDING SITE is HOST TARGET binding site found in the 5' untranslated region of mRNA encoded by DKFZP434O047, corresponding to a HOST TARGET binding site such as BINDING SITE I, BINDING SITE II or BINDING SITE III. Table 2 illustrates the complementarity of the nucleotide sequences of DKFZP434O047 BINDING SITE, designated SEQ ID:17867, to the nucleotide sequence of VGAM1777 RNA, herein designated VGAM RNA, also designated SEQ ID:4488.

Another function of VGAM1777 is therefore inhibition of DKFZP434O047 (Accession NM_015594). Accordingly, utilities of VGAM1777 include diagnosis, prevention and treatment of diseases and clinical conditions associated with DKFZP434O047. Erythrocyte Membrane Protein Band 4.1-like 1 (EPB41L1, Accession XM_047295) is another VGAM1777 host target gene. EPB41L1 BINDING SITE is HOST TARGET binding site found in the 3' untranslated region of mRNA encoded by EPB41L1, corresponding to a HOST TARGET binding site such as BINDING SITE I, BINDING SITE II or BINDING SITE III. Table 2 illustrates the complementarity of the nucleotide sequences of EPB41L1 BINDING SITE, designated SEQ ID:34942, to the nucleotide sequence of VGAM1777 RNA, herein designated VGAM RNA, also designated SEQ ID:4488.

Another function of VGAM1777 is therefore inhibition of Erythrocyte Membrane Protein Band 4.1-like 1 (EPB41L1, Accession XM_047295). Accordingly, utilities of VGAM1777 include diagnosis, prevention and treatment of diseases and clinical conditions associated with EPB41L1. FLJ14126 (Accession NM_024849) is another VGAM1777 host target gene. FLJ14126 BINDING SITE is HOST TARGET binding site found in the 3' untranslated region of mRNA encoded by FLJ14126, corresponding to a HOST TARGET binding site such as BINDING SITE I, BINDING SITE II or BINDING SITE III. Table 2 illustrates the complementarity of the nucleotide sequences of FLJ14126 BINDING SITE, designated SEQ ID:24282, to the nucleotide sequence of VGAM1777 RNA, herein designated VGAM RNA, also designated SEQ ID:4488.

Another function of VGAM1777 is therefore inhibition of FLJ14126 (Accession NM_024849). Accordingly, utilities of VGAM1777 include diagnosis, prevention and treatment of diseases and clinical conditions associated with FLJ14126. G Protein-coupled Receptor 107 (GPR107, Accession NM_020960) is another VGAM1777 host target gene. GPR107 BINDING SITE is HOST TARGET binding site found in the 3' untranslated region of mRNA encoded by GPR107, corresponding to a HOST TARGET binding site such as BINDING SITE I, BINDING SITE II or BINDING SITE III. Table 2 illustrates the complementarity of the nucleotide sequences of GPR107 BINDING SITE, designated SEQ ID:21950, to the nucleotide sequence of VGAM1777 RNA, herein designated VGAM RNA, also designated SEQ ID:4488.

Another function of VGAM1777 is therefore inhibition of G Protein-coupled Receptor 107 (GPR107, Accession NM_020960). Accordingly, utilities of VGAM1777 include diagnosis, prevention and treatment of diseases and clinical conditions associated with GPR107. HSGP25L2G (Accession XM_030771) is another VGAM1777 host target gene. HSGP25L2G BINDING SITE is HOST TARGET binding site found in the 3' untranslated region of mRNA encoded by HSGP25L2G, corresponding to a HOST TARGET binding site such as BINDING SITE I, BINDING SITE II or BINDING SITE III. Table 2 illustrates the complementarity of the nucleotide sequences of HSGP25L2G BINDING SITE, designated SEQ ID:31134, to the nucleotide sequence of VGAM1777 RNA, herein designated VGAM RNA, also designated SEQ ID:4488.

Another function of VGAM1777 is therefore inhibition of HSGP25L2G (Accession XM_030771). Accordingly, utilities of VGAM1777 include diagnosis, prevention and treatment of diseases and clinical conditions associated with HSGP25L2G. Neuromedin U Receptor 2 (NMU2R, Accession NM_020167) is another VGAM1777 host target gene. NMU2R BINDING SITE is HOST TARGET binding site found in the 3' untranslated region of mRNA encoded by NMU2R, corresponding to a HOST TARGET binding site such as BINDING SITE I, BINDING SITE II or BINDING SITE III. Table 2 illustrates the complementarity of the nucleotide sequences of NMU2R BINDING SITE, designated SEQ ID:21384, to the nucleotide sequence of VGAM1777 RNA, herein designated VGAM RNA, also designated SEQ ID:4488.

Another function of VGAM1777 is therefore inhibition of Neuromedin U Receptor 2 (NMU2R, Accession NM_020167). Accordingly, utilities of VGAM1777 include diagnosis, prevention and treatment of diseases and clinical conditions associated with NMU2R. NYD-SP11 (Accession NM_031951) is another VGAM1777 host target gene. NYD-SP11 BINDING SITE is HOST TARGET binding site found in the 5' untranslated region of mRNA encoded by NYD-SP11, corresponding to a HOST TARGET binding site such as BINDING SITE I, BINDING SITE II or BINDING SITE III. Table 2 illustrates the complementarity of the nucleotide sequences of NYD-SP11 BINDING SITE, designated SEQ ID:25691, to the nucleotide sequence of VGAM1777 RNA, herein designated VGAM RNA, also designated SEQ ID:4488.

Another function of VGAM1777 is therefore inhibition of NYD-SP11 (Accession NM_031951). Accordingly, utilities of VGAM1777 include diagnosis, prevention and treatment of diseases and clinical conditions associated with NYD-SP11. SQV7L (Accession XM_047287) is another VGAM1777 host target gene. SQV7L BINDING SITE is HOST TARGET binding site found in the 5' untranslated region of mRNA encoded by SQV7L, corresponding to a HOST TARGET binding site such as BINDING SITE I, BINDING SITE II or BINDING SITE III. Table 2 illustrates the complementarity of the nucleotide sequences of SQV7L BINDING SITE, designated SEQ ID:34932, to the nucleotide sequence of VGAM1777 RNA, herein designated VGAM RNA, also designated SEQ ID:4488.

Another function of VGAM1777 is therefore inhibition of SQV7L (Accession XM_047287). Accordingly, utilities of VGAM1777 include diagnosis, prevention and treatment of diseases and clinical conditions associated with SQV7L. ZER6 (Accession XM_032742) is another VGAM1777 host target gene. ZER6 BINDING SITE is HOST TARGET binding site found in the 3' untranslated region of mRNA encoded by ZER6, corresponding to a HOST TARGET binding site such as BINDING SITE I, BINDING SITE II or BINDING SITE III. Table 2 illustrates the complementarity of the nucleotide sequences of ZER6 BINDING SITE, designated SEQ ID:31739, to the nucleotide sequence of VGAM1777 RNA, herein designated VGAM RNA, also designated SEQ ID:4488.

Another function of VGAM1777 is therefore inhibition of ZER6 (Accession XM_032742). Accordingly, utilities of VGAM1777 include diagnosis, prevention and treatment of diseases and clinical conditions associated with ZER6. LOC158434 (Accession XM_098939) is another VGAM1777 host target gene. LOC158434 BINDING SITE is HOST TARGET binding site found in the 3' untranslated region of mRNA encoded by LOC158434, corresponding to a HOST TARGET binding site such as BINDING SITE I, BINDING SITE II or BINDING SITE III. Table 2 illustrates the complementarity of the nucleotide sequences of LOC158434 BINDING SITE, designated SEQ ID:41985, to the nucleotide sequence of VGAM1777 RNA, herein designated VGAM RNA, also designated SEQ ID:4488.

Another function of VGAM1777 is therefore inhibition of LOC158434 (Accession XM_098939). Accordingly, utilities of VGAM1777 include diagnosis, prevention and treatment of diseases and clinical conditions associated with LOC158434. LOC165741 (Accession XM_105272) is another VGAM1777 host target gene. LOC165741 BINDING SITE is HOST TARGET binding site found in the 3' untranslated region of mRNA encoded by LOC165741, corresponding to a HOST TARGET binding site such as BINDING SITE I, BINDING SITE II or BINDING SITE III. Table 2 illustrates the complementarity of the nucleotide sequences of LOC165741 BINDING SITE, designated SEQ ID:42189, to the nucleotide sequence of VGAM1777 RNA, herein designated VGAM RNA, also designated SEQ ID:4488.

Another function of VGAM1777 is therefore inhibition of LOC165741 (Accession XM_105272). Accordingly, utilities of VGAM1777 include diagnosis, prevention and treatment of diseases and clinical conditions associated with LOC165741. LOC90342 (Accession XM_031009) is another VGAM1777 host target gene. LOC90342 BINDING SITE is HOST TARGET binding site found in the 5' untranslated region of mRNA encoded by LOC90342, corresponding to a HOST TARGET binding site such as BINDING SITE I, BINDING SITE II or BINDING SITE III. Table 2 illustrates the complementarity of the nucleotide sequences of LOC90342 BINDING SITE, designated SEQ ID:31249, to the nucleotide sequence of VGAM1777 RNA, herein designated VGAM RNA, also designated SEQ ID:4488.

Another function of VGAM1777 is therefore inhibition of LOC90342 (Accession XM_031009). Accordingly, utilities of VGAM1777 include diagnosis, prevention and treatment of diseases and clinical conditions associated with LOC90342. LOC92689 (Accession XM_046663) is another VGAM1777 host target gene. LOC92689 BINDING SITE is HOST TARGET binding site found in the 3' untranslated region of mRNA encoded by LOC92689, corresponding to a HOST TARGET binding site such as BINDING SITE I, BINDING SITE II or BINDING SITE III. Table 2 illustrates the complementarity of the nucleotide sequences of LOC92689 BINDING SITE, designated SEQ ID:34780, to the nucleotide sequence of VGAM1777 RNA, herein designated VGAM RNA, also designated SEQ ID:4488.

Another function of VGAM1777 is therefore inhibition of LOC92689 (Accession XM_046663). Accordingly, utilities of VGAM1777 include diagnosis, prevention and treatment of diseases and clinical conditions associated with LOC92689. FIG. 1 further provides a conceptual description of a novel bioinformatically detected viral gene of the present invention, referred to here as Viral Genomic Address Messenger 1778 (VGAM1778) viral gene, which modulates expression of respective host target genes thereof, the function and utility of which host target genes is known in the art.

VGAM1778 is a novel bioinformatically detected regulatory, non protein coding, viral micro RNA (miRNA) gene. The method by which VGAM1778 was detected is described hereinabove with reference to FIGS. 1-8.

VGAM1778 gene, herein designated VGAM GENE, is a viral gene contained in the genome of Cryphonectria Hypovirus 1. VGAM1778 host target gene, herein designated VGAM HOST TARGET GENE, is a human gene contained in the human genome.

VGAM1778 gene encodes a VGAM1778 precursor RNA, herein designated VGAM PRECURSOR RNA. Similar to other miRNA genes, and unlike most ordinary genes, VGAM1778 precursor RNA does not encode a protein. A nucleotide sequence identical or highly similar to the nucleotide sequence of VGAM1778 precursor RNA is designated SEQ ID:1764, and is provided hereinbelow with reference to the sequence listing part. Nucleotide sequence SEQ ID:1764 is located at position 3023 relative to the genome of Cryphonectria Hypovirus 1.

VGAM1778 precursor RNA folds onto itself, forming VGAM1778 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1778 folded precursor RNA into VGAM1778 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1778 RNA is designated SEQ ID:4489, and is provided hereinbelow with reference to the sequence listing part.

VGAM1778 host target gene, herein designated VGAM HOST TARGET GENE, encodes a corresponding messenger RNA, VGAM1778 host target RNA, herein designated VGAM HOST TARGET RNA. VGAM1778 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1778 RNA, herein designated VGAM RNA, binds complementarily to one or more host target binding sites located in untranslated regions of VGAM1778 host target RNA, herein designated VGAM HOST TARGET RNA. This complementary binding is due to the fact that the nucleotide sequence of VGAM1778 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1778 RNA, herein designated VGAM RNA, may have a different number of host target binding sites in untranslated regions of a VGAM1778 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1778 RNA, herein designated VGAM RNA, to host target binding sites on VGAM1778 host target RNA, herein designated VGAM HOST TARGET RNA, such as BINDING SITE I, BINDING SITE II and BINDING SITE III, inhibits translation of VGAM1778 host target RNA into VGAM1778 host target protein, herein designated VGAM HOST TARGET PROTEIN. VGAM host target protein is therefore outlined by a broken line.

It is appreciated that VGAM1778 host target gene, herein designated VGAM HOST TARGET GENE, in fact represents a plurality of VGAM1778 host target genes. The mRNA of each one of this plurality of VGAM1778 host target genes comprises one or more host target binding sites, each having a nucleotide sequence which is at least partly complementary to VGAM1778 RNA, herein designated VGAM RNA, and which when bound by VGAM1778 RNA causes inhibition of translation of respective one or more VGAM1778 host target proteins.

It is further appreciated by one skilled in the art that the mode of translational inhibition illustrated by FIG. 1 with specific reference to translational inhibition exerted by VGAM1778 gene, herein designated VGAM GENE, on one or more VGAM1778 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1778 is inhibition of expression of host target genes, as part of a novel viral mechanism of attacking a host. Accordingly, utilities of VGAM1778 include diagnosis, prevention and treatment of viral infection by Cryphonectria Hypovirus 1. Specific functions, and accordingly utilities, of VGAM1778 correlate with, and may be deduced from, the identity of the host target genes which VGAM1778 binds and inhibits, and the function of these host target genes, as elaborated hereinbelow.

Nucleotide sequences of the VGAM1778 precursor RNA, herein designated VGAM PRECURSOR RNA, and of the 'diced' VGAM1778 RNA, herein designated VGAM RNA, and a schematic representation of the secondary folding of VGAM1778 folded precursor RNA, herein designated VGAM FOLDED PRECURSOR RNA, of VGAM1778 are further described hereinbelow with reference to Table 1.

Nucleotide sequences of host target binding sites, such as BINDING SITE-I, BINDING SITE-II and BINDING SITE-III of FIG. 1, found on VGAM1778 host target RNA, and schematic representation of the complementarity of each of these host target binding sites to VGAM1778 RNA, herein designated VGAM RNA, are described hereinbelow with reference to Table 2.

As mentioned hereinabove with reference to FIG. 1, a function of VGAM1778 gene, herein designated VGAM is inhibition of expression of VGAM1778 target genes. It is appreciated that specific functions, and accordingly utilities, of VGAM1778 correlate with, and may be deduced from, the identity of the target genes which VGAM1778 binds and inhibits, and the function of these target genes, as elaborated hereinbelow.

DnaJ (Hsp40) Homolog, Subfmaily B, Member 1 (DNAJB1, Accession NM_006145) is a VGAM1778 host target gene. DNAJB1 BINDING SITE is HOST TARGET binding site found in the 3' untranslated region of mRNA encoded by DNAJB1, corresponding to a HOST TARGET binding site such as BINDING SITE I, BINDING SITE II or BINDING SITE III. Table 2 illustrates the complementarity of the nucleotide sequences of DNAJB1 BINDING SITE, designated SEQ ID:12788, to the nucleotide sequence of VGAM1778 RNA, herein designated VGAM RNA, also designated SEQ ID:4489.

A function of VGAM1778 is therefore inhibition of DnaJ (Hsp40) Homolog, Subfmaily B, Member 1 (DNAJB1, Accession NM_006145), a gene which may prevent aggregation of newly translated proteins. Accordingly, utilities of VGAM1778 include diagnosis, prevention and treatment of diseases and clinical conditions associated with DNAJB1. The function of DNAJB1 has been established by previous studies. The E. coli heat-shock protein DnaJ (see OMIM Ref. No. 140550) functions together with DnaK (HSPA1A; 140550) and GrpE (OMIM Ref. No. 606173) as a molecular chaperone, involving them in assembly and disassembly of protein complexes, protein folding, renaturation of denatured proteins, prevention of protein aggregation, and protein export. By screening a human placenta cDNA library with anti-hsp40 antibody, Ohtsuka (1993) isolated a cDNA encoding a 40-kD heat-shock protein designated HSPF1. The deduced 340-amino acid HSPF1 protein is 34% identical to E. coli DnaJ and 34% and 36% identical to HSJ1 (OMIM Ref. No. 604139) and HSJ2 (OMIM Ref. No. 602837), respectively. By Northern blot analysis, Hata and Ohtsuka (1998) showed that expression of a major 2.4-kb and a minor 1.4-kb HSPF1 transcript is drastically induced by heat shock. Several dominant human neurodegenerative diseases involve the expansion of a polyglutamine within the disease proteins. This expansion confers toxicity on the proteins and is associated with nuclear inclusion formation. Data indicate that molecular chaperones can modulate polyglutamine pathogenesis. To elucidate the basis of polyglutamine toxicity and the mechanism by which chaperones suppress neurodegeneration, Chan et al. (2000) studied transgenic Drosophila disease models of Machado-Joseph disease (OMIM Ref. No. 109150) and Huntington disease (OMIM Ref. No. 143100). They demonstrated that Hsp70 (see OMIM Ref. No. 140559) and Hdj1, the Drosophila homolog to human HSP40 (see OMIM Ref. No. 604139), showed substrate specificity for polyglutamine proteins as well as synergy in suppression of neurotoxicity, and altered the solubility properties of the mutant polyglutamine protein.

Full details of the abovementioned studies are described in the following publications, the disclosure of which are hereby incorporated by reference:

Chan, H. Y. E.; Warrick, J. M.; Gray-Board, G. L.; Paulson, H. L.; Bonini, N. M.: Mechanisms of chaperone suppression of polyglutamine disease: selectivity, synergy and modulation of protein solubility in Drosophila. Hum. Molec. Genet. 9:2811-2820, 2000; and Hata, M.; Ohtsuka, K.: Characterization of HSE sequences in human Hsp40 gene: structural and promoter analysis. Biochim. Biophys. Acta 1397:43-55, 1998.

Further studies establishing the function and utilities of DNAJB1 are found in John Hopkins OMIM database record ID 604572, and in sited publications numbered 522 and 7947-7949 listed in the bibliography section hereinbelow, which are also hereby incorporated by reference. G Protein-coupled Receptor 75 (GPR75, Accession NM_006794) is another VGAM1778 host target gene. GPR75 BINDING SITE is HOST TARGET binding site found in the 5' untranslated region of mRNA encoded by GPR75, corresponding to a HOST TARGET binding site such as BINDING SITE I, BINDING SITE II or BINDING SITE III. Table 2 illustrates the complementarity of the nucleotide sequences of GPR75 BINDING SITE, designated SEQ ID:13669, to the nucleotide sequence of VGAM1778 RNA, herein designated VGAM RNA, also designated SEQ ID:4489.

Another function of VGAM1778 is therefore inhibition of G Protein-coupled Receptor 75 (GPR75, Accession NM_006794). Accordingly, utilities of VGAM1778 include diagnosis, prevention and treatment of diseases and clinical conditions associated with GPR75. Hermansky-Pudlak Syndrome 1 (HPS1, Accession NM_000195) is another VGAM1778 host target gene. HPS1 BINDING SITE is HOST TARGET binding site found in the 3' untranslated region of mRNA encoded by HPS1, corresponding to a HOST TARGET binding site such as BINDING SITE I, BINDING SITE II or BINDING SITE III. Table 2 illustrates the complementarity of the nucleotide sequences of HPS1 BINDING SITE, designated SEQ ID:5693, to the nucleotide sequence of VGAM1778 RNA, herein designated VGAM RNA, also designated SEQ ID:4489.

Another function of VGAM1778 is therefore inhibition of Hermansky-Pudlak Syndrome 1 (HPS1, Accession NM_000195). Accordingly, utilities of VGAM1778 include diagnosis, prevention and treatment of diseases and clinical conditions associated with HPS1. Heparan Sulfate (glucosamine) 3-O-sulfotransferase 3A1 (HS3ST3A1, Accession NM_006042) is another VGAM1778 host target gene. HS3ST3A1 BINDING SITE is HOST TARGET binding site found in the 5' untranslated region of mRNA encoded by HS3ST3A1, corresponding to a HOST TARGET binding site such as BINDING SITE I, BINDING SITE II or BINDING SITE III. Table 2 illustrates the complementarity of the nucleotide sequences of HS3ST3A1 BINDING SITE, designated SEQ ID:12676, to the nucleotide sequence of VGAM1778 RNA, herein designated VGAM RNA, also designated SEQ ID:4489.

Another function of VGAM1778 is therefore inhibition of Heparan Sulfate (glucosamine) 3-O-sulfotransferase 3A1 (HS3ST3A1, Accession NM_006042), a gene which plays a role in the generation of heparan sulfate proteoglycan. Accordingly, utilities of VGAM1778 include diagnosis, prevention and treatment of diseases and clinical conditions associated with HS3ST3A1. The function of HS3ST3A1 and its association with various diseases and clinical conditions, has been established by previous studies, as described hereinabove with reference to VGAM1454. RalA Binding Protein 1 (RALBP1, Accession NM_006788) is another VGAM1778 host target gene. RALBP1 BINDING SITE is HOST TARGET binding site found in the 3' untranslated region of mRNA encoded by RALBP1, corresponding to a HOST TARGET binding site such as BINDING SITE I, BINDING SITE II or BINDING SITE III. Table 2 illustrates the complementarity of the nucleotide sequences of RALBP1 BINDING SITE, designated SEQ ID:13664, to the nucleotide sequence of VGAM1778 RNA, herein designated VGAM RNA, also designated SEQ ID:4489.

Another function of VGAM1778 is therefore inhibition of RalA Binding Protein 1 (RALBP1, Accession NM_006788), a gene which plays a role in signal transduction and catalyzes the transport of glutathione conjugates and xenobiotics. Accordingly, utilities of VGAM1778 include diagnosis, prevention and treatment of diseases and clinical conditions associated with RALBP1. The function of RALBP1 and its association with various diseases and clinical conditions, has been established by previous studies, as described hereinabove with reference to VGAM345. Transient Receptor Potential Cation Channel, Subfamily V, Member 1 (TRPV1, Accession NM_080705) is another VGAM1778 host target gene. TRPV1 BINDING SITE1 through TRPV1 BINDING SITE4 are HOST TARGET binding sites found in untranslated regions of mRNA encoded by TRPV1, corresponding to HOST TARGET binding sites such as BINDING SITE I, BINDING SITE II or BINDING SITE III. Table 2 illustrates the complementarity of the nucleotide sequences of TRPV1 BINDING SITE1 through TRPV1 BINDING SITE4, designated SEQ ID:27999, SEQ ID:28007, SEQ ID:20811 and SEQ ID:27991 respectively, to the nucleotide sequence of VGAM1778 RNA, herein designated VGAM RNA, also designated SEQ ID:4489.

Another function of VGAM1778 is therefore inhibition of Transient Receptor Potential Cation Channel, Subfamily V, Member 1 (TRPV1, Accession NM_080705), a gene which functions as a receptor for capsaicin. Accordingly, utilities of VGAM1778 include diagnosis, prevention and treatment of diseases and clinical conditions associated with TRPV1. The function of TRPV1 and its association with various diseases and clinical conditions, has been established by previous studies, as described hereinabove with reference to VGAM146. LOC219649 (Accession XM_167562) is another VGAM1778 host target gene. LOC219649 BINDING SITE is HOST TARGET binding site found in the 3' untranslated region of mRNA encoded by LOC219649, corresponding to a HOST TARGET binding site such as BINDING SITE I, BINDING SITE II or BINDING SITE III. Table 2 illustrates the complementarity of the nucleotide sequences of LOC219649 BINDING SITE, designated SEQ ID:44669, to the nucleotide sequence of VGAM1778 RNA, herein designated VGAM RNA, also designated SEQ ID:4489.

Another function of VGAM1778 is therefore inhibition of LOC219649 (Accession XM_167562). Accordingly, utilities of VGAM1778 include diagnosis, prevention and treatment of diseases and clinical conditions associated with LOC219649. LOC91828 (Accession XM_040910) is another VGAM1778 host target gene. LOC91828 BINDING SITE is HOST TARGET binding site found in the 5' untranslated region of mRNA encoded by LOC91828, corresponding to a HOST TARGET binding site such as BINDING SITE I, BINDING SITE II or BINDING SITE III. Table 2 illustrates the complementarity of the nucleotide sequences of LOC91828 BINDING SITE, designated SEQ ID:33408, to the nucleotide sequence of VGAM1778 RNA, herein designated VGAM RNA, also designated SEQ ID:4489.

Another function of VGAM1778 is therefore inhibition of LOC91828 (Accession XM_040910). Accordingly, utilities of VGAM1778 include diagnosis, prevention and treatment of diseases and clinical conditions associated with LOC91828. FIG. 1 further provides a conceptual description of a novel bioinformatically detected viral gene of the present invention, referred to here as Viral Genomic Address Messenger 1779 (VGAM1779) viral gene, which modulates expression of respective host target genes thereof, the function and utility of which host target genes is known in the art.

VGAM1779 is a novel bioinformatically detected regulatory, non protein coding, viral micro RNA (miRNA) gene. The method by which VGAM1779 was detected is described hereinabove with reference to FIGS. 1-8.

VGAM1779 gene, herein designated VGAM GENE, is a viral gene contained in the genome of Cryphonectria Hypovirus 1. VGAM1779 host target gene, herein designated VGAM HOST TARGET GENE, is a human gene contained in the human genome.

VGAM1779 gene encodes a VGAM1779 precursor RNA, herein designated VGAM PRECURSOR RNA. Similar to other miRNA genes, and unlike most ordinary genes, VGAM1779 precursor RNA does not encode a protein. A nucleotide sequence identical or highly similar to the nucleotide sequence of VGAM1779 precursor RNA is designated SEQ ID:1765, and is provided hereinbelow with reference to the sequence listing part. Nucleotide sequence SEQ ID:1765 is located at position 4059 relative to the genome of Cryphonectria Hypovirus 1.

VGAM1779 precursor RNA folds onto itself, forming VGAM1779 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1779 folded precursor RNA into VGAM1779 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1779 RNA is designated SEQ ID:4490, and is provided hereinbelow with reference to the sequence listing part.

VGAM1779 host target gene, herein designated VGAM HOST TARGET GENE, encodes a corresponding messenger RNA, VGAM1779 host target RNA, herein designated VGAM HOST TARGET RNA. VGAM1779 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1779 RNA, herein designated VGAM RNA, binds complementarily to one or more host target binding sites located in untranslated regions of VGAM1779 host target RNA, herein designated VGAM HOST TARGET RNA. This complementary binding is due to the fact that the nucleotide sequence of VGAM1779 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1779 RNA, herein designated VGAM RNA, may have a different number of host target binding sites in untranslated regions of a VGAM1779 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1779 RNA, herein designated VGAM RNA, to host target binding sites on VGAM1779 host target RNA, herein designated VGAM HOST TARGET RNA, such as BINDING SITE I, BINDING SITE II and BINDING SITE III, inhibits translation of VGAM1779 host target RNA into VGAM1779 host target protein, herein designated VGAM HOST TARGET PROTEIN. VGAM host target protein is therefore outlined by a broken line.

It is appreciated that VGAM1779 host target gene, herein designated VGAM HOST TARGET GENE, in fact represents a plurality of VGAM1779 host target genes. The mRNA of each one of this plurality of VGAM1779 host target genes comprises one or more host target binding sites, each having a nucleotide sequence which is at least partly complementary to VGAM1779 RNA, herein designated VGAM RNA, and which when bound by VGAM1779 RNA causes inhibition of translation of respective one or more VGAM1779 host target proteins.

It is further appreciated by one skilled in the art that the mode of translational inhibition illustrated by FIG. 1 with specific reference to translational inhibition exerted by VGAM1779 gene, herein designated VGAM GENE, on one or more VGAM1779 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1779 is inhibition of expression of host target genes, as part of a novel viral mechanism of attacking a host. Accordingly, utilities of VGAM1779 include diagnosis, prevention and treatment of viral infection by Cryphonectria Hypovirus 1. Specific functions, and accordingly utilities, of VGAM1779 correlate with, and may be deduced from, the identity of the host target genes which VGAM1779 binds and inhibits, and the function of these host target genes, as elaborated hereinbelow.

Nucleotide sequences of the VGAM1779 precursor RNA, herein designated VGAM PRECURSOR RNA, and of the 'diced' VGAM1779 RNA, herein designated VGAM RNA, and a schematic representation of the secondary folding of VGAM1779 folded precursor RNA, herein designated VGAM FOLDED PRECURSOR RNA, of VGAM1779 are further described hereinbelow with reference to Table 1.

Nucleotide sequences of host target binding sites, such as BINDING SITE-I, BINDING SITE-II and BINDING SITE-III of FIG. 1, found on VGAM1779 host target RNA, and schematic representation of the complementarity of each of these host target binding sites to VGAM1779 RNA, herein designated VGAM RNA, are described hereinbelow with reference to Table 2.

As mentioned hereinabove with reference to FIG. 1, a function of VGAM1779 gene, herein designated VGAM is inhibition of expression of VGAM1779 target genes. It is appreciated that specific functions, and accordingly utilities, of VGAM1779 correlate with, and may be deduced from, the identity of the target genes which VGAM1779 binds and inhibits, and the function of these target genes, as elaborated hereinbelow.

Carcinoembryonic Antigen-related Cell Adhesion Molecule 6 (non-specific cross reacting antigen) (CEACAM6, Accession NM_002483) is a VGAM1779 host target gene. CEACAM6 BINDING SITE is HOST TARGET binding site found in the 3' untranslated region of mRNA encoded by CEACAM6, corresponding to a HOST TARGET binding site such as BINDING SITE I, BINDING SITE II or BINDING SITE III. Table 2 illustrates the complementarity of the nucleotide sequences of CEACAM6 BINDING SITE, designated SEQ ID:8309, to the nucleotide sequence of VGAM1779 RNA, herein designated VGAM RNA, also designated SEQ ID:4490.

A function of VGAM1779 is therefore inhibition of Carcinoembryonic Antigen-related Cell Adhesion Molecule 6 (non-specific cross reacting antigen) (CEACAM6, Accession NM_002483), a gene which Non-specific cross reacting antigen (. Accordingly, utilities of VGAM1779 include diagnosis, prevention and treatment of diseases and clinical conditions associated with CEACAM6. The function of CEACAM6 and its association with various diseases and clinical conditions, has been established by previous studies, as described hereinabove with reference to VGAM286. Trichorhinophalangeal Syndrome I (TRPS1, Accession NM_014112) is another VGAM1779 host target gene. TRPS1 BINDING SITE is HOST TARGET binding site found in the 3' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15351, to the nucleotide sequence of VGAM1779 RNA, herein designated VGAM RNA, also designated SEQ ID:4490.

Another function of VGAM1779 is therefore inhibition of Trichorhinophalangeal Syndrome I (TRPS1, Accession NM_014112), a gene which may function as a transcriptional activator protein. Accordingly, utilities of VGAM1779 include diagnosis, prevention and treatment of diseases and clinical conditions associated with TRPS1. The function of TRPS1 and its association with various diseases and clinical conditions, has been established by previous studies, as described hereinabove with reference to VGAM172. Actin Related Protein 2/3 Complex, Subunit 5, 16 kDa (ARPC5, Accession NM_005717) is another VGAM1779 host target gene. ARPC5 BINDING SITE is HOST TARGET binding site found in the 3' untranslated region of mRNA encoded by ARPC5, corresponding to a HOST TARGET binding site such as BINDING SITE I, BINDING SITE II or BINDING SITE III. Table 2 illustrates the complementarity of the nucleotide sequences of ARPC5 BINDING SITE, designated SEQ ID:12272, to the nucleotide sequence of VGAM1779 RNA, herein designated VGAM RNA, also designated SEQ ID:4490.

Another function of VGAM1779 is therefore inhibition of Actin Related Protein 2/3 Complex, Subunit 5, 16 kDa (ARPC5, Accession NM_005717). Accordingly, utilities of VGAM1779 include diagnosis, prevention and treatment of diseases and clinical conditions associated with ARPC5. FLJ23056 (Accession NM_024582) is another VGAM1779 host target gene. FLJ23056 BINDING SITE is HOST TARGET binding site found in the 3' untranslated region of mRNA encoded by FLJ23056, corresponding to a HOST TARGET binding site such as BINDING SITE I, BINDING SITE II or BINDING SITE III. Table 2 illustrates the complementarity of the nucleotide sequences of FLJ23056 BINDING SITE, designated SEQ ID:23808, to the nucleotide sequence of VGAM1779 RNA, herein designated VGAM RNA, also designated SEQ ID:4490.

Another function of VGAM1779 is therefore inhibition of FLJ23056 (Accession NM_024582). Accordingly, utilities of VGAM1779 include diagnosis, prevention and treatment of diseases and clinical conditions associated with FLJ23056. LOC51141 (Accession XM_043953) is another VGAM1779 host target gene. LOC51141 BINDING SITE is HOST TARGET binding site found in the 3' untranslated region of mRNA encoded by LOC51141, corresponding to a HOST TARGET binding site such as BINDING SITE I, BINDING SITE II or BINDING SITE III. Table 2 illustrates the complementarity of the nucleotide sequences of LOC51141 BINDING SITE, designated SEQ ID:34048, to the nucleotide sequence of VGAM1779 RNA, herein designated VGAM RNA, also designated SEQ ID:4490.

Another function of VGAM1779 is therefore inhibition of LOC51141 (Accession XM_043953). Accordingly, utilities of VGAM1779 include diagnosis, prevention and treatment of diseases and clinical conditions associated with LOC51141. FIG. 1 further provides a conceptual description of a novel bioinformatically detected viral gene of the present invention, referred to here as Viral Genomic Address Messenger 1780 (VGAM1780) viral gene, which modulates expression of respective host target genes thereof, the function and utility of which host target genes is known in the art.

VGAM1780 is a novel bioinformatically detected regulatory, non protein coding, viral micro RNA (miRNA) gene. The method by which VGAM1780 was detected is described hereinabove with reference to FIGS. 1-8.

VGAM1780 gene, herein designated VGAM GENE, is a viral gene contained in the genome of Cryphonectria Hypovirus 1. VGAM1780 host target gene, herein designated VGAM HOST TARGET GENE, is a human gene contained in the human genome.

VGAM1780 gene encodes a VGAM1780 precursor RNA, herein designated VGAM PRECURSOR RNA. Similar to other miRNA genes, and unlike most ordinary genes, VGAM1780 precursor RNA does not encode a protein. A nucleotide sequence identical or highly similar to the nucleotide sequence of VGAM1780 precursor RNA is designated SEQ ID:1766, and is provided hereinbelow with reference to the sequence listing part. Nucleotide sequence SEQ ID:1766 is located at position 6807 relative to the genome of Cryphonectria Hypovirus 1.

VGAM1780 precursor RNA folds onto itself, forming VGAM1780 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1780 folded precursor RNA into VGAM1780 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1780 RNA is designated SEQ ID:4491, and is provided hereinbelow with reference to the sequence listing part.

VGAM1780 host target gene, herein designated VGAM HOST TARGET GENE, encodes a corresponding messenger RNA, VGAM1780 host target RNA, herein designated VGAM HOST TARGET RNA. VGAM1780 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1780 RNA, herein designated VGAM RNA, binds complementarily to one or more host target binding sites located in untranslated regions of VGAM1780 host target RNA, herein designated VGAM HOST TARGET RNA. This complementary binding is due to the fact that the nucleotide sequence of VGAM1780 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1780 RNA, herein designated VGAM RNA, may have a different number of host target binding sites in untranslated regions of a VGAM1780 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1780 RNA, herein designated VGAM RNA, to host target binding sites on VGAM1780 host target RNA, herein designated VGAM HOST TARGET RNA, such as BINDING SITE I, BINDING SITE II and BINDING SITE III, inhibits translation of VGAM1780 host target RNA into VGAM1780 host target protein, herein designated VGAM HOST TARGET PROTEIN. VGAM host target protein is therefore outlined by a broken line.

It is appreciated that VGAM1780 host target gene, herein designated VGAM HOST TARGET GENE, in fact represents a plurality of VGAM1780 host target genes. The mRNA of each one of this plurality of VGAM1780 host target genes comprises one or more host target binding sites, each having a nucleotide sequence which is at least partly complementary to VGAM1780 RNA, herein designated VGAM RNA, and which when bound by VGAM1780 RNA causes inhibition of translation of respective one or more VGAM1780 host target proteins.

It is further appreciated by one skilled in the art that the mode of translational inhibition illustrated by FIG. 1 with specific reference to translational inhibition exerted by VGAM1780 gene, herein designated VGAM GENE, on one or more VGAM1780 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1780 is inhibition of expression of host target genes, as part of a novel viral mechanism of attacking a host. Accordingly, utilities of VGAM1780 include diagnosis, prevention and treatment of viral infection by Cryphonectria Hypovirus 1. Specific functions, and accordingly utilities, of VGAM1780 correlate with, and may be deduced from, the identity of the host target genes which VGAM1780 binds and inhibits, and the function of these host target genes, as elaborated hereinbelow.

Nucleotide sequences of the VGAM1780 precursor RNA, herein designated VGAM PRECURSOR RNA, and of the 'diced' VGAM1780 RNA, herein designated VGAM RNA, and a schematic representation of the secondary folding of VGAM1780 folded precursor RNA, herein designated VGAM FOLDED PRECURSOR RNA, of VGAM1780 are further described hereinbelow with reference to Table 1.

Nucleotide sequences of host target binding sites, such as BINDING SITE-I, BINDING SITE-II and BINDING SITE-III of FIG. 1, found on VGAM1780 host target RNA, and schematic representation of the complementarity of each of these host target binding sites to VGAM1780 RNA, herein designated VGAM RNA, are described hereinbelow with reference to Table 2.

As mentioned hereinabove with reference to FIG. 1, a function of VGAM1780 gene, herein designated VGAM is inhibition of expression of VGAM1780 target genes. It is appreciated that specific functions, and accordingly utilities, of VGAM1780 correlate with, and may be deduced from, the identity of the target genes which VGAM1780 binds and inhibits, and the function of these target genes, as elaborated hereinbelow.

Leucine Zipper, Putative Tumor Suppressor 1 (LZTS1, Accession NM_021020) is a VGAM1780 host target gene. LZTS1 BINDING SITE is HOST TARGET binding site found in the 3' untranslated region of mRNA encoded by LZTS1, corresponding to a HOST TARGET binding site such as BINDING SITE I, BINDING SITE II or BINDING SITE III. Table 2 illustrates the complementarity of the nucleotide sequences of LZTS1 BINDING SITE, designated SEQ ID:22005, to the nucleotide sequence of VGAM1780 RNA, herein designated VGAM RNA, also designated SEQ ID:4491.

A function of VGAM1780 is therefore inhibition of Leucine Zipper, Putative Tumor Suppressor 1 (LZTS1, Accession NM_021020), a gene which Zygin 1; may have a role in axonal outgrowth; has similarity to C. elegans UNC-76. Accordingly, utilities of VGAM1780 include diagnosis, prevention and treatment of diseases and clinical conditions associated with LZTS1. The function of LZTS1 and its association with various diseases and clinical conditions, has been established by previous studies, as described hereinabove with reference to VGAM890. FIG. 1 further provides a conceptual description of a novel bioinformatically detected viral gene of the present invention, referred to here as Viral Genomic Address Messenger 1781 (VGAM1781) viral gene, which modulates expression of respective host target genes thereof, the function and utility of which host target genes is known in the art.

VGAM1781 is a novel bioinformatically detected regulatory, non protein coding, viral micro RNA (miRNA) gene. The method by which VGAM1781 was detected is described hereinabove with reference to FIGS. 1-8.

VGAM1781 gene, herein designated VGAM GENE, is a viral gene contained in the genome of Cryphonectria Hypovirus 1. VGAM1781 host target gene, herein designated VGAM HOST TARGET GENE, is a human gene contained in the human genome.

VGAM1781 gene encodes a VGAM1781 precursor RNA, herein designated VGAM PRECURSOR RNA. Similar to other miRNA genes, and unlike most ordinary genes, VGAM1781 precursor RNA does not encode a protein. A nucleotide sequence identical or highly similar to the nucleotide sequence of VGAM1781 precursor RNA is designated SEQ ID:1767, and is provided hereinbelow with reference to the sequence listing part. Nucleotide sequence SEQ ID:1767 is located at position 9633 relative to the genome of Cryphonectria Hypovirus 1.

VGAM1781 precursor RNA folds onto itself, forming VGAM1781 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1781 folded precursor RNA into VGAM1781 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1781 RNA is designated SEQ ID:4492, and is provided hereinbelow with reference to the sequence listing part.

VGAM1781 host target gene, herein designated VGAM HOST TARGET GENE, encodes a corresponding messenger RNA, VGAM1781 host target RNA, herein designated VGAM HOST TARGET RNA. VGAM1781 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1781 RNA, herein designated VGAM RNA, binds complementarily to one or more host target binding sites located in untranslated regions of VGAM1781 host target RNA, herein designated VGAM HOST TARGET RNA. This complementary binding is due to the fact that the nucleotide sequence of VGAM1781 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1781 RNA, herein designated VGAM RNA, may have a different number of host target binding sites in untranslated regions of a VGAM1781 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1781 RNA, herein designated VGAM RNA, to host target binding sites on VGAM1781 host target RNA, herein designated VGAM HOST TARGET RNA, such as BINDING SITE I, BINDING SITE II and BINDING SITE III, inhibits translation of VGAM1781 host target RNA into VGAM1781 host target protein, herein designated VGAM HOST TARGET PROTEIN. VGAM host target protein is therefore outlined by a broken line.

It is appreciated that VGAM1781 host target gene, herein designated VGAM HOST TARGET GENE, in fact represents a plurality of VGAM1781 host target genes. The mRNA of each one of this plurality of VGAM1781 host target genes comprises one or more host target binding sites, each having a nucleotide sequence which is at least partly complementary to VGAM1781 RNA, herein designated VGAM RNA, and which when bound by VGAM1781 RNA causes inhibition of translation of respective one or more VGAM1781 host target proteins.

It is further appreciated by one skilled in the art that the mode of translational inhibition illustrated by FIG. 1 with specific reference to translational inhibition exerted by VGAM1781 gene, herein designated VGAM GENE, on one or more VGAM1781 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1781 is inhibition of expression of host target genes, as part of a novel viral mechanism of attacking a host. Accordingly, utilities of VGAM1781 include diagnosis, prevention and treatment of viral infection by Cryphonectria Hypovirus 1. Specific functions, and accordingly utilities, of VGAM1781 correlate with, and may be deduced from, the identity of the host target genes which VGAM1781 binds and inhibits, and the function of these host target genes, as elaborated hereinbelow.

Nucleotide sequences of the VGAM1781 precursor RNA, herein designated VGAM PRECURSOR RNA, and of the 'diced' VGAM1781 RNA, herein designated VGAM RNA, and a schematic representation of the secondary folding of VGAM1781 folded precursor RNA, herein designated VGAM FOLDED PRECURSOR RNA, of VGAM1781 are further described hereinbelow with reference to Table 1.

Nucleotide sequences of host target binding sites, such as BINDING SITE-I, BINDING SITE-II and BINDING SITE-III of FIG. 1, found on VGAM1781 host target RNA, and schematic representation of the complementarity of each of these host target binding sites to VGAM1781 RNA, herein designated VGAM RNA, are described hereinbelow with reference to Table 2.

As mentioned hereinabove with reference to FIG. 1, a function of VGAM1781 gene, herein designated VGAM is inhibition of expression of VGAM1781 target genes. It is appreciated that specific functions, and accordingly utilities, of VGAM1781 correlate with, and may be deduced from, the identity of the target genes which VGAM1781 binds and inhibits, and the function of these target genes, as elaborated hereinbelow.

Centrosomal Protein 2 (CEP2, Accession NM_006779) is a VGAM1781 host target gene. CEP2 BINDING SITE is HOST TARGET binding site found in the 5' untranslated region of mRNA encoded by CEP2, corresponding to a HOST TARGET binding site such as BINDING SITE I, BINDING SITE II or BINDING SITE III. Table 2 illustrates the complementarity of the nucleotide sequences of CEP2 BINDING SITE, designated SEQ ID:13650, to the nucleotide sequence of VGAM1781 RNA, herein designated VGAM RNA, also designated SEQ ID:4492.

A function of VGAM1781 is therefore inhibition of Centrosomal Protein 2 (CEP2, Accession NM_006779), a gene which interacts with TC10 and CDC42. Accordingly, utilities of VGAM1781 include diagnosis, prevention and treatment of diseases and clinical conditions associated with CEP2. The function of CEP2 and its association with various diseases and clinical conditions, has been established by previous studies, as described hereinabove with reference to VGAM329. CERD4 (Accession NM_012074) is another VGAM1781 host target gene. CERD4 BINDING SITE is HOST TARGET binding site found in the 3' untranslated region of mRNA encoded by CERD4, corresponding to a HOST TARGET binding site such as BINDING SITE I, BINDING SITE II or BINDING SITE III. Table 2 illustrates the complementarity of the nucleotide sequences of CERD4 BINDING SITE, designated SEQ ID:14344, to the nucleotide sequence of VGAM1781 RNA, herein designated VGAM RNA, also designated SEQ ID:4492.

Another function of VGAM1781 is therefore inhibition of CERD4 (Accession NM_012074). Accordingly, utilities of VGAM1781 include diagnosis, prevention and treatment of diseases and clinical conditions associated with CERD4. Glucokinase (hexokinase 4, maturity onset diabetes of the young 2) (GCK, Accession NM_000162) is another VGAM1781 host target gene. GCK BINDING SITE is HOST TARGET binding site found in the 5" untranslated region of mRNA encoded by GCK, corresponding to a HOST TARGET binding site such as BINDING SITE I, BINDING SITE II or BINDING SITE III. Table 2 illustrates the complementarity of the nucleotide sequences of GCK BINDING SITE, designated SEQ ID:5670, to the nucleotide sequence of VGAM1781 RNA, herein designated VGAM RNA, also designated SEQ ID:4492.

Another function of VGAM1781 is therefore inhibition of Glucokinase (hexokinase 4, maturity onset diabetes of the young 2) (GCK, Accession NM_000162), a gene which catalyzes the initial step in utilization of glucose by the beta-cell and liver at physiological glucose concentration. Accordingly, utilities of VGAM1781 include diagnosis, prevention and treatment of diseases and clinical conditions associated with GCK. The function of GCK has been established by previous studies. B lymphocytes that reside in the germinal center of lymphoid follicles are functionally and phenotypically distinct from those residing in the surrounding mantle zone. Various regulatory and structural genes control a complex series of differentiation and selection steps through which B cells that exit the germinal center of lymphoid follicles must pass. In differential hybridization studies to identify some of these genes, Katz et al. (1994) isolated a novel gene based on its preferential expression in tonsillar germinal center B lymphocytes. The complete nucleotide sequence predicted a 819-amino acid protein, named GC (for 'germinal center') kinase, with homology to serine-threonine protein kinases. Its catalytic domain was 39% and 37% identical to those of S. cerevisiae STE20 and Drosophila NinaC proteins, respectively. Northern blot analysis revealed expression of a 2.9-kb mRNA in several human tissues, including brain, lung, and placenta. In situ hybridization of tonsil tissue demonstrated preferential hybridization to the germinal center region. The expressed protein phosphorylated casein and myelin basic protein in in vitro kinase assays. Pombo et al. (1995) showed that GC kinase, or GCK, specifically activates the SAPK (OMIM Ref. No. 601335) pathway. They also showed that GCK is activated in situ by TNF-alpha (OMIM Ref. No. 191160), a potent SAPK agonist. The authors suggested that the SAPK pathway may be active in the differentiation and selection of B cells in the germinal center Full details of the abovementioned studies are described in the following publications, the disclosure of which are hereby incorporated by reference:

Katz, P.; Whalen, G.; Kehrl, J. H.: Differential expression of a novel protein kinase in human B lymphocytes: preferential localization in the germinal center. J. Biol. Chem. 269: 16802-16809, 1994; and Ren, M.; Zeng, J.; De Lemos-Chiarandini, C.; Rosenfeld, M.; Adesnik, M.; Sabatini, D. D.: In its active form, the GTP-binding protein rab8 interacts with a stress-activated protein kina.

Further studies establishing the function and utilities of GCK are found in John Hopkins OMIM database record ID 603166, and in sited publications numbered 11498-5866 listed in the bibliography section hereinbelow, which are also hereby incorporated by reference. Glucocorticoid Receptor DNA Binding Factor 1 (GRLF1, Accession XM_085943) is another VGAM1781 host target gene. GRLF1 BINDING SITE is HOST TARGET binding site found in the 3' untranslated region of mRNA encoded by GRLF1, corresponding to a HOST TARGET binding site such as BINDING SITE I, BINDING SITE II or BINDING SITE III. Table 2 illustrates the complementarity of the nucleotide sequences of GRLF1 BINDING SITE, designated SEQ ID:38413, to the nucleotide sequence of VGAM1781 RNA, herein designated VGAM RNA, also designated SEQ ID:4492.

Another function of VGAM1781 is therefore inhibition of Glucocorticoid Receptor DNA Binding Factor 1 (GRLF1, Accession XM_085943), a gene which inhibits transcription of the glucocorticoid receptor gene. Accordingly, utilities of VGAM1781 include diagnosis, prevention and treatment of diseases and clinical conditions associated with GRLF1. The function of GRLF1 and its association with various diseases and clinical conditions, has been established by previous studies, as described hereinabove with reference to VGAM55. Human Immunodeficiency Virus Type I Enhancer Binding Protein 3 (HIVEP3, Accession NM_024503) is another VGAM1781 host target gene. HIVEP3 BINDING SITE is HOST TARGET binding site found in the 5' untranslated region of mRNA encoded by HIVEP3, corresponding to a HOST TARGET binding site such as BINDING SITE I, BINDING SITE II or BINDING SITE III. Table 2 illustrates the complementarity of the nucleotide sequences of HIVEP3 BINDING SITE, designated SEQ ID:23698, to the nucleotide sequence of VGAM1781 RNA, herein designated VGAM RNA, also designated SEQ ID:4492.

Another function of VGAM1781 is therefore inhibition of Human Immunodeficiency Virus Type I Enhancer Binding Protein 3 (HIVEP3, Accession NM_024503), a gene which is required for transcriptional activation of glucose- repressible alcohol dehydrogenase (adh2). Accordingly, utilities of VGAM1781 include diagnosis, prevention and treatment of diseases and clinical conditions associated with HIVEP3. The function of HIVEP3 has been established by previous studies. Hicar et al. (2001) cloned HIVEP3, a member of the HIVEP family (see OMIM Ref. No. HIVEP1; 194540). HIVEPs encode large zinc finger proteins and regulate transcription via the kappa-B enhancer motif. HIVEP3 is homologous to the mouse Krc (kappa-B-binding and recognition component of the V(D)J recombination signal sequence) protein. The largest open reading frame of HIVEP3 contains 2,406 amino acids and is 80% identical to Krc. RNA studies showed that multiple HIVEP3 transcripts are differentially expressed and regulated. Transcription termination occurs in the ultimate exon, exon 10, or in exon 6. Therefore, HIVEP3 may produce protein isoforms that contain or exclude the C-terminal DNA-binding domain and the leucine zipper by alternative RNA splicing and differential polyadenylation. GENE FUNCTION Oukka et al. (2002) described a function for the zinc finger transcription factor Krc in regulating patterns of gene activation in response to proinflammatory stimuli. Krc overexpression inhibited, while antisense or dominant-negative Krc enhanced, NF-kappa-B (OMIM Ref. No. 164011)-dependent transactivation and JNK (OMIM Ref. No. 601158) phosphorylation and consequently inhibited apoptosis and cytokine gene expression. The effect of Krc was mediated through its interaction with the adaptor protein TRAF2 (OMIM Ref. No. 601895). Oukka et al. (2002) concluded that Krc is a participant in the signal transduction pathway leading from the TNF receptor (see OMIM Ref. No. 602746) to gene activation and may play a critical role in inflammatory and apoptotic responses.

Full details of the abovementioned studies are described in the following publications, the disclosure of which are hereby incorporated by reference:

Hicar, M. D.; Liu, Y.; Allen, C. E.; Wu, L.-C.: Structure of the human zinc finger protein HIVEP3: molecular cloning, expression, exon-intron structure, and comparison with paralogous genes HIVEP1 and HIVEP2. Genomics 71:89-100, 2001; and Oukka, M.; Kim, S. T.; Lugo, G.; Sun, J.; Wu, L.-C.; Glimcher, L. H.: A mammalian homolog of Drosophila schnurri, KRC, regulates TNF receptor-driven responses and interacts with TRAF2.

Further studies establishing the function and utilities of HIVEP3 are found in John Hopkins OMIM database record ID 606649, and in sited publications numbered 613 and 6144 listed in the bibliography section hereinbelow, which are also hereby incorporated by reference. Prostaglandin F Receptor (FP) (PTGFR, Accession NM_000959) is another VGAM1781 host target gene. PTGFR BINDING SITE is HOST TARGET binding site found in the 5' untranslated region of mRNA encoded by PTGFR, corresponding to a HOST TARGET binding site such as BINDING SITE I, BINDING SITE II or BINDING SITE III. Table 2 illustrates the complementarity of the nucleotide sequences of PTGFR BINDING SITE, designated SEQ ID:6661, to the nucleotide sequence of VGAM1781 RNA, herein designated VGAM RNA, also designated SEQ ID:4492.

Another function of VGAM1781 is therefore inhibition of Prostaglandin F Receptor (FP) (PTGFR, Accession NM_000959), a gene which mediates intracellular calcium flux, strongly similar to murine Ptgfr. Accordingly, utilities of VGAM1781 include diagnosis, prevention and treatment of diseases and clinical conditions associated with PTGFR. The function of PTGFR has been established by previous studies. Prostaglandin F(2-alpha) is involved in a number of physiologic processes. It serves as a potent luteolytic agent in many species, has been implicated as a modulator of intraocular pressure, and may be important in smooth muscle contraction in the uterus and elsewhere. Its effects on cells are mediated through specific interaction with prostaglandin receptors. Abramovitz et al. (1994) cloned a cDNA encoding the human prostanoid FP receptor from a uterus cDNA library. The 359-amino acid protein has 7 putative transmembrane domains characteristic of the G protein-coupled receptors. As expected, expression studies of the cDNA in Xenopus oocytes and COS cells showed strongest binding to PGF(2-alpha). Subsequently, Duncan et al. (1995) mapped the gene to 1p31.1 by in situ hybridization. Using a panel of interspecific backcross mice, Ishikawa et al. (1996) mapped the Ptgfr gene to distal mouse chromosome 3. Sugimoto et al. (1997) showed that knockout mice lacking the receptor for prostaglandin F(2-alpha) are unable to deliver normal fetuses at term due to a lack of response to oxytocin. The mice also failed to show the decline in serum progesterone expected to precede parturition. However, if the mice had their ovaries removed at day 19 of pregnancy, normal delivery occurred. The authors concluded that parturition is initiated when prostaglandin F(2-alpha) interacts with its receptor in ovarian luteal cells to induce luteolysis. Sugimoto et al. (1997) also suggested that this mechanism may explain why aspirin-like drugs delay parturition.

Full details of the abovementioned studies are described in the following publications, the disclosure of which are hereby incorporated by reference:

Sugimoto, Y.; Yamasaki, A.; Segi, E.; Tsuboi, K.; Aze, Y.; Nishimura, T.; Oida, H.; Yoshida, N.; Tanaka, T.; Katsuyama, M.; Hasumoto, K.; Murata, T.; Hirata, M.; Ushikubi, F.; Negishi, M.; Ichikawa, A.; Narumiya, S.: Failure of parturition in mice lacking the prostaglandin F receptor. Science 277:681-683, 1997; and Ishikawa, T.; Tamai, Y.; Rochelle, J. M.; Hirata, M.; Namba, T.; Sugimoto, Y.; Ichikawa, A.; Narumiya, S.; Taketo, M. M.; Seldin, M. F.: Mapping of the genes encoding mouse prostaglandi.

Further studies establishing the function and utilities of PTGFR are found in John Hopkins OMIM database record ID 600563, and in sited publications numbered 8166-816 and 10839 listed in the bibliography section hereinbelow, which are also hereby incorporated by reference. Stearoyl-CoA Desaturase (delta-9-desaturase) (SCD, Accession NM_005063) is another VGAM1781 host target gene. SCD BINDING SITE is HOST TARGET binding site found in the 5' untranslated region of mRNA encoded by SCD, corresponding to a HOST TARGET binding site such as BINDING SITE I, BINDING SITE II or BINDING SITE III. Table 2 illustrates the complementarity of the nucleotide sequences of SCD BINDING SITE, designated SEQ ID:11489, to the nucleotide sequence of VGAM1781 RNA, herein designated VGAM RNA, also designated SEQ ID:4492.

Another function of VGAM1781 is therefore inhibition of Stearoyl-CoA Desaturase (delta-9-desaturase) (SCD, Accession NM_005063), a gene which functions in the synthesis of unsaturated fatty acids. Accordingly, utilities of VGAM1781 include diagnosis, prevention and treatment of diseases and clinical conditions associated with SCD. The function of SCD and its association with various diseases and clinical conditions, has been established by previous studies, as described hereinabove with reference to VGAM314. Transmembrane 4 Superfamily Member 6 (TM4SF6, Accession NM_003270) is another VGAM1781 host target gene. TM4SF6 BINDING SITE is HOST TARGET binding site found in the 3' untranslated region of mRNA encoded by TM4SF6, corresponding to a HOST TARGET binding site such as BINDING SITE I, BINDING SITE II or BINDING SITE III. Table 2 illustrates the complementarity of the nucleotide sequences of TM4SF6 BINDING SITE, designated SEQ ID:9284, to the nucleotide sequence of VGAM1781 RNA, herein designated VGAM RNA, also designated SEQ ID:4492.

Another function of VGAM1781 is therefore inhibition of Transmembrane 4 Superfamily Member 6 (TM4SF6, Accession NM_003270), a gene which plays a role in the regulation of cell development, activation, growth and motility. Accordingly, utilities of VGAM1781 include diagnosis, prevention and treatment of diseases and clinical conditions associated with TM4SF6. The function of TM4SF6 and its association with various diseases and clinical conditions, has been established by previous studies, as described hereinabove with reference to VGAM84.13CDNA73 (Accession NM_023037) is another VGAM1781 host target gene. 13CDNA73 BINDING SITE is HOST TARGET binding site found in the 5' untranslated region of mRNA encoded by 13CDNA73, corresponding to a HOST TARGET binding site such as BINDING SITE I, BINDING SITE II or BINDING SITE III. Table 2 illustrates the complementarity of the nucleotide sequences of 13CDNA73 BINDING SITE, designated SEQ ID:23321, to the nucleotide sequence of VGAM1781 RNA, herein designated VGAM RNA, also designated SEQ ID:4492.

Another function of VGAM1781 is therefore inhibition of 13CDNA73 (Accession NM_023037). Accordingly, utilities of VGAM1781 include diagnosis, prevention and treatment of diseases and clinical conditions associated with 13CDNA73. Chromosome 17 Open Reading Frame 31 (C17orf31, Accession NM_017575) is another VGAM1781 host target gene. C17orf31 BINDING SITE is HOST TARGET binding site found in the 5' untranslated region of mRNA encoded by C17orf31, corresponding to a HOST TARGET binding site such as BINDING SITE I, BINDING SITE II or BINDING SITE III. Table 2 illustrates the complementarity of the nucleotide sequences of C17orf31 BINDING SITE, designated SEQ ID:19002, to the nucleotide sequence of VGAM1781 RNA, herein designated VGAM RNA, also designated SEQ ID:4492.

Another function of VGAM1781 is therefore inhibition of Chromosome 17 Open Reading Frame 31 (C17orf31, Accession NM_017575). Accordingly, utilities of VGAM1781 include diagnosis, prevention and treatment of diseases and clinical conditions associated with C17orf31. FLJ13241 (Accession NM_025088) is another VGAM1781 host target gene. FLJ13241 BINDING SITE is HOST TARGET binding site found in the 3' untranslated region of mRNA encoded by FLJ13241, corresponding to a HOST TARGET binding site such as BINDING SITE I, BINDING SITE II or BINDING SITE III. Table 2 illustrates the complementarity of the nucleotide sequences of FLJ13241 BINDING SITE, designated SEQ ID:24706, to the nucleotide sequence of VGAM1781 RNA, herein designated VGAM RNA, also designated SEQ ID:4492.

Another function of VGAM1781 is therefore inhibition of FLJ13241 (Accession NM_025088). Accordingly, utilities of VGAM1781 include diagnosis, prevention and treatment of diseases and clinical conditions associated with FLJ13241. FLJ14743 (Accession XM_042708) is another VGAM1781 host target gene. FLJ14743 BINDING SITE is HOST TARGET binding site found in the 5' untranslated region of mRNA encoded by FLJ14743, corresponding to a HOST TARGET binding site such as BINDING SITE I, BINDING SITE II or BINDING SITE III. Table 2 illustrates the complementarity of the nucleotide sequences of FLJ14743 BINDING SITE, designated SEQ ID:33762, to the nucleotide sequence of VGAM1781 RNA, herein designated VGAM RNA, also designated SEQ ID:4492.

Another function of VGAM1781 is therefore inhibition of FLJ14743 (Accession XM_042708). Accordingly, utilities of VGAM1781 include diagnosis, prevention and treatment of diseases and clinical conditions associated with FLJ14743. GMPPB (Accession XM_171044) is another VGAM1781 host target gene. GMPPB BINDING SITE is HOST TARGET binding site found in the 5' untranslated region of mRNA encoded by GMPPB, corresponding to a HOST TARGET binding site such as BINDING SITE I, BINDING SITE II or BINDING SITE III. Table 2 illustrates the complementarity of the nucleotide sequences of GMPPB BINDING SITE, designated SEQ ID:45811, to the nucleotide sequence of VGAM1781 RNA, herein designated VGAM RNA, also designated SEQ ID:4492.

Another function of VGAM1781 is therefore inhibition of GMPPB (Accession XM_171044). Accordingly, utilities of VGAM1781 include diagnosis, prevention and treatment of diseases and clinical conditions associated with GMPPB. KIAA0445 (Accession NM_014675) is another VGAM1781 host target gene. KIAA0445 BINDING SITE is HOST TARGET binding site found in the 5' untranslated region of mRNA encoded by KIAA0445, corresponding to a HOST TARGET binding site such as BINDING SITE I, BINDING SITE II or BINDING SITE III. Table 2 illustrates the complementarity of the nucleotide sequences of KIAA0445 BINDING SITE, designated SEQ ID:16146, to the nucleotide sequence of VGAM1781 RNA, herein designated VGAM RNA, also designated SEQ ID:4492.

Another function of VGAM1781 is therefore inhibition of KIAA0445 (Accession NM_014675). Accordingly, utilities of VGAM1781 include diagnosis, prevention and treatment of diseases and clinical conditions associated with KIAA0445. KIAA0478 (Accession NM_014870) is another VGAM1781 host target gene. KIAA0478 BINDING SITE is HOST TARGET binding site found in the 3' untranslated region of mRNA encoded by KIAA0478, corresponding to a HOST TARGET binding site such as BINDING SITE I, BINDING SITE II or BINDING SITE III. Table 2 illustrates the complementarity of the nucleotide sequences of KIAA0478 BINDING SITE, designated SEQ ID:16976, to the nucleotide sequence of VGAM1781 RNA, herein designated VGAM RNA, also designated SEQ ID:4492.

Another function of VGAM1781 is therefore inhibition of KIAA0478 (Accession NM_014870). Accordingly, utilities of VGAM1781 include diagnosis, prevention and treatment of diseases and clinical conditions associated with KIAA0478. KIAA1018 (Accession NM_014967) is another VGAM1781 host target gene. KIAA1018 BINDING SITE is HOST TARGET binding site found in the 3' untranslated region of mRNA encoded by KIAA1018, corresponding to a HOST TARGET binding site such as BINDING SITE I, BINDING SITE II or BINDING SITE III. Table 2 illustrates the complementarity of the nucleotide sequences of KIAA1018 BINDING SITE, designated SEQ ID:17356, to the nucleotide sequence of VGAM1781 RNA, herein designated VGAM RNA, also designated SEQ ID:4492.

Another function of VGAM1781 is therefore inhibition of KIAA1018 (Accession NM_014967). Accordingly, utilities of VGAM1781 include diagnosis, prevention and treatment of diseases and clinical conditions associated with KIAA1018. MGC2477 (Accession NM_024099) is another VGAM1781 host target gene. MGC2477 BINDING SITE is HOST TARGET binding site found in the 5' untranslated region of mRNA encoded by MGC2477, corresponding to a HOST TARGET binding site such as BINDING SITE I, BINDING SITE II or BINDING SITE III. Table 2 illustrates the complementarity of the nucleotide sequences of MGC2477 BINDING SITE, designated SEQ ID:23541, to the nucleotide sequence of VGAM1781 RNA, herein designated VGAM RNA, also designated SEQ ID:4492.

Another function of VGAM1781 is therefore inhibition of MGC2477 (Accession NM_024099). Accordingly, utilities of VGAM1781 include diagnosis, prevention and treatment of diseases and clinical conditions associated with MGC2477. Protein Tyrosine Phosphatase, Non-receptor Type Substrate 1 (PTPNS1, Accession NM_080792) is another VGAM1781 host target gene. PTPNS1 BINDING SITE is HOST TARGET binding site found in the 3' untranslated region of mRNA encoded by PTPNS1, corresponding to a HOST TARGET binding site such as BINDING SITE I, BINDING SITE II or BINDING SITE III. Table 2 illustrates the complementarity of the nucleotide sequences of PTPNS1 BINDING SITE, designated SEQ ID:28052, to the nucleotide sequence of VGAM1781 RNA, herein designated VGAM RNA, also designated SEQ ID:4492.

Another function of VGAM1781 is therefore inhibition of Protein Tyrosine Phosphatase, Non-receptor Type Substrate 1 (PTPNS1, Accession NM_080792). Accordingly, utilities of VGAM1781 include diagnosis, prevention and treatment of diseases and clinical conditions associated with PTPNS1. Tigger Transposable Element Derived 5 (TIGD5, Accession NM_032862) is another VGAM1781 host target gene. TIGD5 BINDING SITE is HOST TARGET binding site found in the 5' untranslated region of mRNA encoded by TIGD5, corresponding to a HOST TARGET binding site such as BINDING SITE I, BINDING SITE II or BINDING SITE III. Table 2 illustrates the complementarity of the nucleotide sequences of TIGD5 BINDING SITE, designated SEQ ID:26667, to the nucleotide sequence of VGAM1781 RNA, herein designated VGAM RNA, also designated SEQ ID:4492.

Another function of VGAM1781 is therefore inhibition of Tigger Transposable Element Derived 5 (TIGD5, Accession NM_032862). Accordingly, utilities of VGAM1781 include diagnosis, prevention and treatment of diseases and clinical conditions associated with TIGD5. Thyroid Hormone Receptor Interactor 13 (TRIP13, Accession NM_004237) is another VGAM1781 host target gene. TRIP13 BINDING SITE is HOST TARGET binding site found in the 3' untranslated region of mRNA encoded by TRIP13, corresponding to a HOST TARGET binding site such as BINDING SITE I, BINDING SITE II or BINDING SITE III. Table 2 illustrates the complementarity of the nucleotide sequences of TRIP13 BINDING SITE, designated SEQ ID:10435, to the nucleotide sequence of VGAM1781 RNA, herein designated VGAM RNA, also designated SEQ ID:4492.

Another function of VGAM1781 is therefore inhibition of Thyroid Hormone Receptor Interactor 13 (TRIP13, Accession NM_004237). Accordingly, utilities of VGAM1781 include diagnosis, prevention and treatment of diseases and clinical conditions associated with TRIP13. LOC115110 (Accession XM_049825) is another VGAM1781 host target gene. LOC115110 BINDING SITE is HOST TARGET binding site found in the 3' untranslated region of mRNA encoded by LOC115110, corresponding to a HOST TARGET binding site such as BINDING SITE I, BINDING SITE II or BINDING SITE III. Table 2 illustrates the complementarity of the nucleotide sequences of LOC115110 BINDING SITE, designated SEQ ID:35508, to the nucleotide sequence of VGAM1781 RNA, herein designated VGAM RNA, also designated SEQ ID:4492.

Another function of VGAM1781 is therefore inhibition of LOC115110 (Accession XM_049825). Accordingly, utilities of VGAM1781 include diagnosis, prevention and treatment of diseases and clinical conditions associated with LOC115110. LOC149579 (Accession XM_048743) is another VGAM1781 host target gene. LOC149579 BINDING SITE is HOST TARGET binding site found in the 5' untranslated region of mRNA encoded by LOC149579, corresponding to a HOST TARGET binding site such as BINDING SITE I, BINDING SITE II or BINDING SITE III. Table 2 illustrates the complementarity of the nucleotide sequences of LOC149579 BINDING SITE, designated SEQ ID:35242, to the nucleotide sequence of VGAM1781 RNA, herein designated VGAM RNA, also designated SEQ ID:4492.

Another function of VGAM1781 is therefore inhibition of LOC149579 (Accession XM_048743). Accordingly, utilities of VGAM1781 include diagnosis, prevention and treatment of diseases and clinical conditions associated with LOC149579. LOC154386 (Accession XM_087920) is another VGAM1781 host target gene. LOC154386 BINDING SITE is HOST TARGET binding site found in the 5' untranslated region of mRNA encoded by LOC154386, corresponding to a HOST TARGET binding site such as BINDING SITE I, BINDING SITE II or BINDING SITE III. Table 2 illustrates the complementarity of the nucleotide sequences of LOC154386 BINDING SITE, designated SEQ ID:39471, to the nucleotide sequence of VGAM1781 RNA, herein designated VGAM RNA, also designated SEQ ID:4492.

Another function of VGAM1781 is therefore inhibition of LOC154386 (Accession XM_087920). Accordingly, utilities of VGAM1781 include diagnosis, prevention and treatment of diseases and clinical conditions associated with LOC154386. LOC256158 (Accession XM_175125) is another VGAM1781 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46624, to the nucleotide sequence of VGAM1781 RNA, herein designated VGAM RNA, also designated SEQ ID:4492.

Another function of VGAM1781 is therefore inhibition of LOC256158 (Accession XM_175125). Accordingly, utilities of VGAM1781 include diagnosis, prevention and treatment of diseases and clinical conditions associated with LOC256158. FIG. 1 further provides a conceptual description of a novel bioinformatically detected viral gene of the present invention, referred to here as Viral Genomic Address Messenger 1782 (VGAM1782) viral gene, which modulates expression of respective host target genes thereof, the function and utility of which host target genes is known in the art.

VGAM1782 is a novel bioinformatically detected regulatory, non protein coding, viral micro RNA (miRNA) gene. The method by which VGAM1782 was detected is described hereinabove with reference to FIGS. 1-8.

VGAM1782 gene, herein designated VGAM GENE, is a viral gene contained in the genome of Cryphonectria Hypovirus 1. VGAM1782 host target gene, herein designated VGAM HOST TARGET GENE, is a human gene contained in the human genome.

VGAM1782 gene encodes a VGAM1782 precursor RNA, herein designated VGAM PRECURSOR RNA. Similar to other miRNA genes, and unlike most ordinary genes, VGAM1782 precursor RNA does not encode a protein. A nucleotide sequence identical or highly similar to the nucleotide sequence of VGAM1782 precursor RNA is designated SEQ ID:1768, and is provided hereinbelow with reference to the sequence listing part. Nucleotide sequence SEQ ID:1768 is located at position 9154 relative to the genome of Cryphonectria Hypovirus 1.

VGAM1782 precursor RNA folds onto itself, forming VGAM1782 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1782 folded precursor RNA into VGAM1782 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1782 RNA is designated SEQ ID:4493, and is provided hereinbelow with reference to the sequence listing part.

VGAM1782 host target gene, herein designated VGAM HOST TARGET GENE, encodes a corresponding messenger RNA, VGAM1782 host target RNA, herein designated VGAM HOST TARGET RNA. VGAM1782 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1782 RNA, herein designated VGAM RNA, binds complementarily to one or more host target binding sites located in untranslated regions of VGAM1782 host target RNA, herein designated VGAM HOST TARGET RNA. This complementary binding is due to the fact that the nucleotide sequence of VGAM1782 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1782 RNA, herein designated VGAM RNA, may have a different number of host target binding sites in untranslated regions of a VGAM1782 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1782 RNA, herein designated VGAM RNA, to host target binding sites on VGAM1782 host target RNA, herein designated VGAM HOST TARGET RNA, such as BINDING SITE I, BINDING SITE II and BINDING SITE III, inhibits translation of VGAM1782 host target RNA into VGAM1782 host target protein, herein designated VGAM HOST TARGET PROTEIN. VGAM host target protein is therefore outlined by a broken line.

It is appreciated that VGAM1782 host target gene, herein designated VGAM HOST TARGET GENE, in fact represents a plurality of VGAM1782 host target genes. The mRNA of each one of this plurality of VGAM1782 host target genes comprises one or more host target binding sites, each having a nucleotide sequence which is at least partly complementary to VGAM1782 RNA, herein designated VGAM RNA, and which when bound by VGAM1782 RNA causes inhibition of translation of respective one or more VGAM1782 host target proteins.

It is further appreciated by one skilled in the art that the mode of translational inhibition illustrated by FIG. 1 with specific reference to translational inhibition exerted by VGAM1782 gene, herein designated VGAM GENE, on one or more VGAM1782 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1782 is inhibition of expression of host target genes, as part of a novel viral mechanism of attacking a host. Accordingly, utilities of VGAM1782 include diagnosis, prevention and treatment of viral infection by Cryphonectria Hypovirus 1. Specific functions, and accordingly utilities, of VGAM1782 correlate with, and may be deduced from, the identity of the host target genes which VGAM1782 binds and inhibits, and the function of these host target genes, as elaborated hereinbelow.

Nucleotide sequences of the VGAM1782 precursor RNA, herein designated VGAM PRECURSOR RNA, and of the 'diced' VGAM1782 RNA, herein designated VGAM RNA, and a schematic representation of the secondary folding of VGAM1782 folded precursor RNA, herein designated VGAM FOLDED PRECURSOR RNA, of VGAM1782 are further described hereinbelow with reference to Table 1.

Nucleotide sequences of host target binding sites, such as BINDING SITE-I, BINDING SITE-II and BINDING SITE-III of FIG. 1, found on VGAM1782 host target RNA, and schematic representation of the complementarity of each of these host target binding sites to VGAM1782 RNA, herein designated VGAM RNA, are described hereinbelow with reference to Table 2.

As mentioned hereinabove with reference to FIG. 1, a function of VGAM1782 gene, herein designated VGAM is inhibition of expression of VGAM1782 target genes. It is appreciated that specific functions, and accordingly utilities, of VGAM1782 correlate with, and may be deduced from, the identity of the target genes which VGAM1782 binds and inhibits, and the function of these target genes, as elaborated hereinbelow.

Breast Cancer 1, Early Onset (BRCA1, Accession NM_007294) is a VGAM1782 host target gene. BRCA1 BINDING SITE1 through BRCA1 BINDING SITE10 are HOST TARGET binding sites found in untranslated regions of mRNA encoded by BRCA1, corresponding to HOST TARGET binding sites such as BINDING SITE I, BINDING SITE II or BINDING SITE III. Table 2 illustrates the complementarity of the nucleotide sequences of BRCA1 BINDING SITE1 through BRCA1 BINDING SITE10, designated SEQ ID:14164, SEQ ID:14201, SEQ ID:14189, SEQ ID:14209, SEQ ID:14221, SEQ ID:14195, SEQ ID:14170, SEQ ID:14182, SEQ ID:14215 and SEQ ID:14176 respectively, to the nucleotide sequence of VGAM1782 RNA, herein designated VGAM RNA, also designated SEQ ID:4493.

A function of VGAM1782 is therefore inhibition of Breast Cancer 1, Early Onset (BRCA1, Accession NM_007294). Accordingly, utilities of VGAM1782 include diagnosis, prevention and treatment of diseases and clinical conditions associated with BRCA1. Heat Shock 70 kDa Protein 5 (glucose-regulated protein, 78 kDa) (HSPA5, Accession NM_005347) is another VGAM1782 host target gene. HSPA5 BINDING SITE is HOST TARGET binding site found in the 3' untranslated region of mRNA encoded by HSPA5, corresponding to a HOST TARGET binding site such as BINDING SITE I, BINDING SITE II or BINDING SITE III. Table 2 illustrates the complementarity of the nucleotide sequences of HSPA5 BINDING SITE, designated SEQ ID:11820, to the nucleotide sequence of VGAM1782 RNA, herein designated VGAM RNA, also designated SEQ ID:4493.

Another function of VGAM1782 is therefore inhibition of Heat Shock 70 kDa Protein 5 (glucose-regulated protein, 78 kDa) (HSPA5, Accession NM_005347), a gene which is involved in the folding and assembly of proteins in the endoplasmic reticulum (ER). Accordingly, utilities of VGAM1782 include diagnosis, prevention and treatment of diseases and clinical conditions associated with HSPA5. The function of HSPA5 has been established by previous studies. Hendershot et al. (1994) pointed out that GRP78, also referred to as 'immunoglobulin heavy chain-binding protein' (BiP), is a member of the heat-shock protein-70 (HSP70) family and is involved in the folding and assembly of proteins in the endoplasmic reticulum (ER). Because so many ER proteins interact with GRP78 transiently, it may play a key role in monitoring protein transport through the cell. To examine how the binding of BiP influences the conformational maturation of thyroglobulin (TG; 188450), Muresan and Arvan (1998) expressed TG in Chinese hamster ovary (CHO) cells genetically manipulated for selectively increased BiP expression (CHO-B cells). The TG expressed in CHO-B cells did not contain any mutations that induce misfolding (i.e., no unfolded protein response), so that levels of all other ER chaperones were normal. Increased availability of BiP did not accelerate TG secretion; rather, the export of newly synthesized TG was delayed. TG that was detained intracullularly was concentrated in the ER. Muresan and Arvan (1998) concluded that increased binding of BiP to TG leads to its delayed conformational maturation in the ER.

Full details of the abovementioned studies are described in the following publications, the disclosure of which are hereby incorporated by reference:

Hendershot, L. M.; Valentine, V. A.; Lee, A. S.; Morris, S. W.; Shapiro, D. N.: Localization of the gene encoding human BiP/GRP78, the endoplasmic reticulum cognate of the HSP70 family, to chromosome 9q34. Genomics 20:281-284, 1994; and Muresan, Z.; Arvan, P.: Enhanced binding to the molecular chaperone BiP slows thyroglobulin export from the endoplasmic reticulum. Molec. Endocr. 12:458-467, 1998.

Further studies establishing the function and utilities of HSPA5 are found in John Hopkins OMIM database record ID 138120, and in sited publications numbered 1696-170 and 12097 listed in the bibliography section hereinbelow, which are also hereby incorporated by reference. Prostaglandin I2 (prostacyclin) Synthase (PTGIS, Accession NM_000961) is another VGAM1782 host target gene. PTGIS BINDING SITE is HOST TARGET binding site found in the 3' untranslated region of mRNA encoded by PTGIS, corresponding to a HOST TARGET binding site such as BINDING SITE I, BINDING SITE II or BINDING SITE III. Table 2 illustrates the complementarity of the nucleotide sequences of PTGIS BINDING SITE, designated SEQ ID:6669, to the nucleotide sequence of VGAM1782 RNA, herein designated VGAM RNA, also designated SEQ ID:4493.

Another function of VGAM1782 is therefore inhibition of Prostaglandin I2 (prostacyclin) Synthase (PTGIS, Accession NM_000961), a gene which catalyzes the isomerization of prostaglandin h2 to prostacyclin (=prostaglandin i2). Accordingly, utilities of VGAM1782 include diagnosis, prevention and treatment of diseases and clinical conditions associated with PTGIS. The function of PTGIS and its association with various diseases and clinical conditions, has been established by previous studies, as described hereinabove with reference to VGAM206. FLJ10781 (Accession NM_018215) is another VGAM1782 host target gene. FLJ10781 BINDING SITE is HOST TARGET binding site found in the 3' untranslated region of mRNA encoded by FLJ10781, corresponding to a HOST TARGET binding site such as BINDING SITE I, BINDING SITE II or BINDING SITE III. Table 2 illustrates the complementarity of the nucleotide sequences of FLJ10781 BINDING SITE, designated SEQ ID:20134, to the nucleotide sequence of VGAM1782 RNA, herein designated VGAM RNA, also designated SEQ ID:4493.

Another function of VGAM1782 is therefore inhibition of FLJ10781 (Accession NM_018215). Accordingly, utilities of VGAM1782 include diagnosis, prevention and treatment of diseases and clinical conditions associated with FLJ10781. FLJ14397 (Accession NM_032779) is another VGAM1782 host target gene. FLJ14397 BINDING SITE is HOST TARGET binding site found in the 3' untranslated region of mRNA encoded by FLJ14397, corresponding to a HOST TARGET binding site such as BINDING SITE I, BINDING SITE II or BINDING SITE III. Table 2 illustrates the complementarity of the nucleotide sequences of FLJ14397 BINDING SITE, designated SEQ ID:26522, to the nucleotide sequence of VGAM1782 RNA, herein designated VGAM RNA, also designated SEQ ID:4493.

Another function of VGAM1782 is therefore inhibition of FLJ14397 (Accession NM_032779). Accordingly, utilities of VGAM1782 include diagnosis, prevention and treatment of diseases and clinical conditions associated with FLJ14397. KIAA1582 (Accession XM_037262) is another VGAM1782 host target gene. KIAA1582 BINDING SITE is HOST TARGET binding site found in the 5' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32589, to the nucleotide sequence of VGAM1782 RNA, herein designated VGAM RNA, also designated SEQ ID:4493.

Another function of VGAM1782 is therefore inhibition of KIAA1582 (Accession XM_037262). Accordingly, utilities of VGAM1782 include diagnosis, prevention and treatment of diseases and clinical conditions associated with KIAA1582. MGC9564 (Accession NM_080669) is another VGAM1782 host target gene. MGC9564 BINDING SITE is HOST TARGET binding site found in the 3' untranslated region of mRNA encoded by MGC9564, corresponding to a HOST TARGET binding site such as BINDING SITE I, BINDING SITE II or BINDING SITE III. Table 2 illustrates the complementarity of the nucleotide sequences of MGC9564 BINDING SITE, designated SEQ ID:27961, to the nucleotide sequence of VGAM1782 RNA, herein designated VGAM RNA, also designated SEQ ID:4493.

Another function of VGAM1782 is therefore inhibition of MGC9564 (Accession NM_080669). Accordingly, utilities of VGAM1782 include diagnosis, prevention and treatment of diseases and clinical conditions associated with MGC9564. Solute Carrier Family 26, Member 6 (SLC26A6, Accession NM_022911) is another VGAM1782 host target gene. SLC26A6 BINDING SITE1 through SLC26A6 BINDING SITE3 are HOST TARGET binding sites found in untranslated regions of mRNA encoded by SLC26A6, corresponding to HOST TARGET binding sites such as BINDING SITE I, BINDING SITE II or BINDING SITE III. Table 2 illustrates the complementarity of the nucleotide sequences of SLC26A6 BINDING SITE1 through SLC26A6 BINDING SITE3, designated SEQ ID:23217, SEQ ID:28666 and SEQ ID:28612 respectively, to the nucleotide sequence of VGAM1782 RNA, herein designated VGAM RNA, also designated SEQ ID:4493.

Another function of VGAM1782 is therefore inhibition of Solute Carrier Family 26, Member 6 (SLC26A6, Accession NM_022911). Accordingly, utilities of VGAM1782 include diagnosis, prevention and treatment of diseases and clinical conditions associated with SLC26A6. LOC150299 (Accession XM_097869) is another VGAM1782 host target gene. LOC150299 BINDING SITE is HOST TARGET binding site found in the 3' untranslated region of mRNA encoded by LOC150299, corresponding to a HOST TARGET binding site such as BINDING SITE I, BINDING SITE II or BINDING SITE III. Table 2 illustrates the complementarity of the nucleotide sequences of LOC150299 BINDING SITE, designated SEQ ID:41182, to the nucleotide sequence of VGAM1782 RNA, herein designated VGAM RNA, also designated SEQ ID:4493.

Another function of VGAM1782 is therefore inhibition of LOC150299 (Accession XM_097869). Accordingly, utilities of VGAM1782 include diagnosis, prevention and treatment of diseases and clinical conditions associated with LOC150299. LOC220538 (Accession XM_165407) is another VGAM1782 host target gene. LOC220538 BINDING SITE is HOST TARGET binding site found in the 3' untranslated region of mRNA encoded by LOC220538, corresponding to a HOST TARGET binding site such as BINDING SITE I, BINDING SITE II or BINDING SITE III. Table 2 illustrates the complementarity of the nucleotide sequences of LOC220538 BINDING SITE, designated SEQ ID:43626, to the nucleotide sequence of VGAM1782 RNA, herein designated VGAM RNA, also designated SEQ ID:4493.

Another function of VGAM1782 is therefore inhibition of LOC220538 (Accession XM_165407). Accordingly, utilities of VGAM1782 include diagnosis, prevention and treatment of diseases and clinical conditions associated with LOC220538. FIG. 1 further provides a conceptual description of a novel bioinformatically detected viral gene of the present invention, referred to here as Viral Genomic Address Messenger 1783 (VGAM1783) viral gene, which modulates expression of respective host target genes thereof, the function and utility of which host target genes is known in the art.

VGAM1783 is a novel bioinformatically detected regulatory, non protein coding, viral micro RNA (miRNA) gene. The method by which VGAM1783 was detected is described hereinabove with reference to FIGS. 1-8.

VGAM1783 gene, herein designated VGAM GENE, is a viral gene contained in the genome of Fowlpox Virus. VGAM1783 host target gene, herein designated VGAM HOST TARGET GENE, is a human gene contained in the human genome.

VGAM1783 gene encodes a VGAM1783 precursor RNA, herein designated VGAM PRECURSOR RNA. Similar to other miRNA genes, and unlike most ordinary genes, VGAM1783 precursor RNA does not encode a protein. A nucleotide sequence identical or highly similar to the nucleotide sequence of VGAM1783 precursor RNA is designated SEQ ID:1769, and is provided hereinbelow with reference to the sequence listing part. Nucleotide sequence SEQ ID:1769 is located at position 33506 relative to the genome of Fowlpox Virus.

VGAM1783 precursor RNA folds onto itself, forming VGAM1783 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1783 folded precursor RNA into VGAM1783 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM1783 RNA is designated SEQ ID:4494, and is provided hereinbelow with reference to the sequence listing part.

VGAM1783 host target gene, herein designated VGAM HOST TARGET GENE, encodes a corresponding messenger RNA, VGAM1783 host target RNA, herein designated VGAM HOST TARGET RNA. VGAM1783 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1783 RNA, herein designated VGAM RNA, binds complementarily to one or more host target binding sites located in untranslated regions of VGAM1783 host target RNA, herein designated VGAM HOST TARGET RNA. This complementary binding is due to the fact that the nucleotide sequence of VGAM1783 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1783 RNA, herein designated VGAM RNA, may have a different number of host target binding sites in untranslated regions of a VGAM1783 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1783 RNA, herein designated VGAM RNA, to host target binding sites on VGAM1783 host target RNA, herein designated VGAM HOST TARGET RNA, such as BINDING SITE I, BINDING SITE II and BINDING SITE III, inhibits translation of VGAM1783 host target RNA into VGAM1783 host target protein, herein designated VGAM HOST TARGET PROTEIN. VGAM host target protein is therefore outlined by a broken line.

It is appreciated that VGAM1783 host target gene, herein designated VGAM HOST TARGET GENE, in fact represents a plurality of VGAM1783 host target genes. The mRNA of each one of this plurality of VGAM1783 host target genes comprises one or more host target binding sites, each having a nucleotide sequence which is at least partly complementary to VGAM1783 RNA, herein designated VGAM RNA, and which when bound by VGAM1783 RNA causes inhibition of translation of respective one or more VGAM1783 host target proteins.

It is further appreciated by one skilled in the art that the mode of translational inhibition illustrated by FIG. 1 with specific reference to translational inhibition exerted by VGAM1783 gene, herein designated VGAM GENE, on one or more VGAM1783 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1783 is inhibition of expression of host target genes, as part of a novel viral mechanism of attacking a host. Accordingly, utilities of VGAM1783 include diagnosis, prevention and treatment of viral infection by Fowlpox Virus. Specific functions, and accordingly utilities, of VGAM1783 correlate with, and may be deduced from, the identity of the host target genes which VGAM1783 binds and inhibits, and the function of these host target genes, as elaborated hereinbelow.

Nucleotide sequences of the VGAM1783 precursor RNA, herein designated VGAM PRECURSOR RNA, and of the 'diced' VGAM1783 RNA, herein designated VGAM RNA, and a schematic representation of the secondary folding of VGAM1783 folded precursor RNA, herein designated VGAM FOLDED PRECURSOR RNA, of VGAM1783 are further described hereinbelow with reference to Table 1.

Nucleotide sequences of host target binding sites, such as BINDING SITE-I, BINDING SITE-II and BINDING SITE-III of FIG. 1, found on VGAM1783 host target RNA, and schematic representation of the complementarity of each of these host target binding sites to VGAM1783 RNA, herein designated VGAM RNA, are described hereinbelow with reference to Table 2.

As mentioned hereinabove with reference to FIG. 1, a function of VGAM1783 gene, herein designated VGAM is inhibition of expression of VGAM1783 target genes. It is appreciated that specific functions, and accordingly utilities, of VGAM1783 correlate with, and may be deduced from, the identity of the target genes which VGAM1783 binds and inhibits, and the function of these target genes, as elaborated hereinbelow.

Transmembrane 7 Superfamily Member 1 (upregulated in kidney) (TM7SF1, Accession NM_003272) is a VGAM1783 host target gene. TM7SF1 BINDING SITE is HOST TARGET binding site found in the 3' untranslated region of mRNA encoded by TM7SF1, corresponding to a HOST TARGET binding site such as BINDING SITE I, BINDING SITE II or BINDING SITE III. Table 2 illustrates the complementarity of the nucleotide sequences of TM7SF1 BINDING SITE, designated SEQ ID:9286, to the nucleotide sequence of VGAM1783 RNA, herein designated VGAM RNA, also designated SEQ ID:4494.

A function of VGAM1783 is therefore inhibition of Transmembrane 7 Superfamily Member 1 (upregulated in kidney) (TM7SF1, Accession NM_003272). Accordingly, utilities of VGAM1783 include diagnosis, prevention and treatment of diseases and clinical conditions associated with TM7SF1. ANKT (Accession NM_016359) is another VGAM1783 host target gene. ANKT BINDING SITE is HOST TARGET binding site found in the 3' untranslated region of mRNA encoded by ANKT, corresponding to a HOST TARGET binding site such as BINDING SITE I, BINDING SITE II or BINDING SITE III. Table 2 illustrates the complementarity of the nucleotide sequences of ANKT BINDING SITE, designated SEQ ID:18499, to the nucleotide sequence of VGAM1783 RNA, herein designated VGAM RNA, also designated SEQ ID:4494.

Another function of VGAM1783 is therefore inhibition of ANKT (Accession NM_016359). Accordingly, utilities of VGAM1783 include diagnosis, prevention and treatment of diseases and clinical conditions associated with ANKT. LOC153077 (Accession XM_098307) is another VGAM1783 host target gene. LOC153077 BINDING SITE is HOST TARGET binding site found in the 3' untranslated region of mRNA encoded by LOC153077, corresponding to a HOST TARGET binding site such as BINDING SITE I, BINDING SITE II or BINDING SITE III. Table 2 illustrates the complementarity of the nucleotide sequences of LOC153077 BINDING SITE, designated SEQ ID:41567, to the nucleotide sequence of VGAM1783 RNA, herein designated VGAM RNA, also designated SEQ ID:4494.

Another function of VGAM1783 is therefore inhibition of LOC153077 (Accession XM_098307). Accordingly, utilities of VGAM1783 include diagnosis, prevention and treatment of diseases and clinical conditions associated with LOC153077. LOC91286 (Accession XM_037444) is another VGAM1783 host target gene. LOC91286 BINDING SITE is HOST TARGET binding site found in the 5' untranslated region of mRNA encoded by LOC91286, corresponding to a HOST TARGET binding site such as BINDING SITE I, BINDING SITE II or BINDING SITE III. Table 2 illustrates the complementarity of the nucleotide sequences of LOC91286 BINDING SITE, designated SEQ ID:32620, to the nucleotide sequence of VGAM1783 RNA, herein designated VGAM RNA, also designated SEQ ID:4494.

Another function of VGAM1783 is therefore inhibition of LOC91286 (Accession XM_037444). Accordingly, utilities of VGAM1783 include diagnosis, prevention and treatment of diseases and clinical conditions associated with LOC91286. FIG. 1 further provides a conceptual description of a novel bioinformatically detected viral gene of the present invention, referred to here as Viral Genomic Address Messenger 1784 (VGAM1784) viral gene, which modulates expression of respective host target genes thereof, the function and utility of which host target genes is known in the art.

VGAM1784 is a novel bioinformatically detected regulatory, non protein coding, viral micro RNA (miRNA) gene. The method by which VGAM1784 was detected is described hereinabove with reference to FIGS. 1-8.

VGAM1784 gene, herein designated VGAM GENE, is a viral gene contained in the genome of Fowlpox Virus. VGAM1784 host target gene, herein designated VGAM HOST TARGET GENE, is a human gene contained in the human genome.

VGAM1784 gene encodes a VGAM1784 precursor RNA, herein designated VGAM PRECURSOR RNA. Similar to other miRNA genes, and unlike most ordinary genes, VGAM1784 precursor RNA does not encode a protein. A nucleotide sequence identical or highly similar to the nucleotide sequence of VGAM1784 precursor RNA is designated SEQ ID:1770, and is provided hereinbelow with reference to the sequence listing part. Nucleotide sequence SEQ ID:1770 is located at position 43278 relative to the genome of Fowlpox Virus.

VGAM1784 precursor RNA folds onto itself, forming VGAM1784 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1784 folded precursor RNA into VGAM1784 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM1784 RNA is designated SEQ ID:4495, and is provided hereinbelow with reference to the sequence listing part.

VGAM1784 host target gene, herein designated VGAM HOST TARGET GENE, encodes a corresponding messenger RNA, VGAM1784 host target RNA, herein designated VGAM HOST TARGET RNA. VGAM1784 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1784 RNA, herein designated VGAM RNA, binds complementarily to one or more host target binding sites located in untranslated regions of VGAM1784 host target RNA, herein designated VGAM HOST TARGET RNA. This complementary binding is due to the fact that the nucleotide sequence of VGAM1784 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1784 RNA, herein designated VGAM RNA, may have a different number of host target binding sites in untranslated regions of a VGAM1784 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1784 RNA, herein designated VGAM RNA, to host target binding sites on VGAM1784 host target RNA, herein designated VGAM HOST TARGET RNA, such as BINDING SITE I, BINDING SITE II and BINDING SITE III, inhibits translation of VGAM1784 host target RNA into VGAM1784 host target protein, herein designated VGAM HOST TARGET PROTEIN. VGAM host target protein is therefore outlined by a broken line.

It is appreciated that VGAM1784 host target gene, herein designated VGAM HOST TARGET GENE, in fact represents a plurality of VGAM1784 host target genes. The mRNA of each one of this plurality of VGAM1784 host target genes comprises one or more host target binding sites, each having a nucleotide sequence which is at least partly complementary to VGAM1784 RNA, herein designated VGAM RNA, and which when bound by VGAM1784 RNA causes inhibition of translation of respective one or more VGAM1784 host target proteins.

It is further appreciated by one skilled in the art that the mode of translational inhibition illustrated by FIG. 1 with specific reference to translational inhibition exerted by VGAM1784 gene, herein designated VGAM GENE, on one or more VGAM1784 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1784 is inhibition of expression of host target genes, as part of a novel viral mechanism of attacking a host. Accordingly, utilities of VGAM1784 include diagnosis, prevention and treatment of viral infection by Fowlpox Virus. Specific functions, and accordingly utilities, of VGAM1784 correlate with, and may be deduced from, the identity of the host target genes which VGAM1784 binds and inhibits, and the function of these host target genes, as elaborated hereinbelow.

Nucleotide sequences of the VGAM1784 precursor RNA, herein designated VGAM PRECURSOR RNA, and of the 'diced' VGAM1784 RNA, herein designated VGAM RNA, and a schematic representation of the secondary folding of VGAM1784 folded precursor RNA, herein designated VGAM FOLDED PRECURSOR RNA, of VGAM1784 are further described hereinbelow with reference to Table 1.

Nucleotide sequences of host target binding sites, such as BINDING SITE-I, BINDING SITE-II and BINDING SITE-III of FIG. 1, found on VGAM1784 host target RNA, and schematic representation of the complementarity of each of these host target binding sites to VGAM1784 RNA, herein designated VGAM RNA, are described hereinbelow with reference to Table 2.

As mentioned hereinabove with reference to FIG. 1, a function of VGAM1784 gene, herein designated VGAM is inhibition of expression of VGAM1784 target genes. It is appreciated that specific functions, and accordingly utilities, of VGAM1784 correlate with, and may be deduced from, the identity of the target genes which VGAM1784 binds and inhibits, and the function of these target genes, as elaborated hereinbelow.

Chemokine (C-C motif) Receptor-like 1 (CCRL1, Accession NM_016557) is a VGAM1784 host target gene. CCRL1 BINDING SITE is HOST TARGET binding site found in the 3' untranslated region of mRNA encoded by CCRL1, corresponding to a HOST TARGET binding site such as BINDING SITE I, BINDING SITE II or BINDING SITE III. Table 2 illustrates the complementarity of the nucleotide sequences of CCRL1 BINDING SITE, designated SEQ ID:18631, to the nucleotide sequence of VGAM1784 RNA, herein designated VGAM RNA, also designated SEQ ID:4495.

A function of VGAM1784 is therefore inhibition of Chemokine (C-C motif) Receptor-like 1 (CCRL1, Accession NM_016557), a gene which is a G protein-coupled receptor that binds chemokines of the CC subfamily, especially MCP-4, ELC (SCYA19) and TECK (SCYA25). Accordingly, utilities of VGAM1784 include diagnosis, prevention and treatment of diseases and clinical conditions associated with CCRL1. The function of CCRL1 and its association with various diseases and clinical conditions, has been established by previous studies, as described hereinabove with reference to VGAM546. Oxytocin Receptor (OXTR, Accession NM_000916) is another VGAM1784 host target gene. OXTR BINDING SITE is HOST TARGET binding site found in the 3' untranslated region of mRNA encoded by OXTR, corresponding to a HOST TARGET binding site such as BINDING SITE I, BINDING SITE II or BINDING SITE III. Table 2 illustrates the complementarity of the nucleotide sequences of OXTR BINDING SITE, designated SEQ ID:6618, to the nucleotide sequence of VGAM1784 RNA, herein designated VGAM RNA, also designated SEQ ID:4495.

Another function of VGAM1784 is therefore inhibition of Oxytocin Receptor (OXTR, Accession NM_000916), a gene which induces inward ion currents. Accordingly, utilities of VGAM1784 include diagnosis, prevention and treatment of diseases and clinical conditions associated with OXTR. The function of OXTR and its association with various diseases and clinical conditions, has been established by previous studies, as described hereinabove with reference to VGAM636. FLJ10702 (Accession NM_018184) is another VGAM1784 host target gene. FLJ10702 BINDING SITE is HOST TARGET binding site found in the 3' untranslated region of mRNA encoded by FLJ10702, corresponding to a HOST TARGET binding site such as BINDING SITE I, BINDING SITE II or BINDING SITE III. Table 2 illustrates the complementarity of the nucleotide sequences of FLJ10702 BINDING SITE, designated SEQ ID:20025, to the nucleotide sequence of VGAM1784 RNA, herein designated VGAM RNA, also designated SEQ ID:4495.

Another function of VGAM1784 is therefore inhibition of FLJ10702 (Accession NM_018184). Accordingly, utilities of VGAM1784 include diagnosis, prevention and treatment of diseases and clinical conditions associated with FLJ10702. KIAA1013 (Accession XM_114303) is another VGAM1784 host target gene. KIAA1013 BINDING SITE is HOST TARGET binding site found in the 3' untranslated region of mRNA encoded by KIAA1013, corresponding to a HOST TARGET binding site such as BINDING SITE I, BINDING SITE II or BINDING SITE III. Table 2 illustrates the complementarity of the nucleotide sequences of KIAA1013 BINDING SITE, designated SEQ ID:42856, to the nucleotide sequence of VGAM1784 RNA, herein designated VGAM RNA, also designated SEQ ID:4495.

Another function of VGAM1784 is therefore inhibition of KIAA1013 (Accession XM_114303). Accordingly, utilities of VGAM1784 include diagnosis, prevention and treatment of diseases and clinical conditions associated with KIAA1013. SRY (sex determining region Y)-box 7 (SOX7, Accession NM_031439) is another VGAM1784 host target gene. SOX7 BINDING SITE is HOST TARGET binding site found in the 3' untranslated region of mRNA encoded by SOX7, corresponding to a HOST TARGET binding site such as BINDING SITE I, BINDING SITE II or BINDING SITE III. Table 2 illustrates the complementarity of the nucleotide sequences of SOX7 BINDING SITE, designated SEQ ID:25451, to the nucleotide sequence of VGAM1784 RNA, herein designated VGAM RNA, also designated SEQ ID:4495.

Another function of VGAM1784 is therefore inhibition of SRY (sex determining region Y)-box 7 (SOX7, Accession NM_031439). Accordingly, utilities of VGAM1784 include diagnosis, prevention and treatment of diseases and clinical conditions associated with SOX7. LOC115297 (Accession XM_053313) is another VGAM1784 host target gene. LOC115297 BINDING SITE is HOST TARGET binding site found in the 3' untranslated region of mRNA encoded by LOC115297, corresponding to a HOST TARGET binding site such as BINDING SITE I, BINDING SITE II or BINDING SITE III. Table 2 illustrates the complementarity of the nucleotide sequences of LOC115297 BINDING SITE, designated SEQ ID:36069, to the nucleotide sequence of VGAM1784 RNA, herein designated VGAM RNA, also designated SEQ ID:4495.

Another function of VGAM1784 is therefore inhibition of LOC115297 (Accession XM_053313). Accordingly, utilities of VGAM1784 include diagnosis, prevention and treatment of diseases and clinical conditions associated with LOC115297. LOC221288 (Accession XM_168058) is another VGAM1784 host target gene. LOC221288 BINDING SITE is HOST TARGET binding site found in the 5' untranslated region of mRNA encoded by LOC221288, corresponding to a HOST TARGET binding site such as BINDING SITE I, BINDING SITE II or BINDING SITE III. Table 2 illustrates the complementarity of the nucleotide sequences of LOC221288 BINDING SITE, designated SEQ ID:44966, to the nucleotide sequence of VGAM1784 RNA, herein designated VGAM RNA, also designated SEQ ID:4495.

Another function of VGAM1784 is therefore inhibition of LOC221288 (Accession XM_168058). Accordingly, utilities of VGAM1784 include diagnosis, prevention and treatment of diseases and clinical conditions associated with LOC221288. LOC90643 (Accession XM_033145) is another VGAM1784 host target gene. LOC90643 BINDING SITE is HOST TARGET binding site found in the 3' untranslated region of mRNA encoded by LOC90643, corresponding to a HOST TARGET binding site such as BINDING SITE I, BINDING SITE II or BINDING SITE III. Table 2 illustrates the complementarity of the nucleotide sequences of LOC90643 BINDING SITE, designated SEQ ID:31849, to the nucleotide sequence of VGAM1784 RNA, herein designated VGAM RNA, also designated SEQ ID:4495.

Another function of VGAM1784 is therefore inhibition of LOC90643 (Accession XM_033145). Accordingly, utilities of VGAM1784 include diagnosis, prevention and treatment of diseases and clinical conditions associated with LOC90643. FIG. 1 further provides a conceptual description of a novel bioinformatically detected viral gene of the present invention, referred to here as Viral Genomic Address Messenger 1785 (VGAM1785) viral gene, which modulates expression of respective host target genes thereof, the function and utility of which host target genes is known in the art.

VGAM1785 is a novel bioinformatically detected regulatory, non protein coding, viral micro RNA (miRNA) gene. The method by which VGAM1785 was detected is described hereinabove with reference to FIGS. 1-8.

VGAM1785 gene, herein designated VGAM GENE, is a viral gene contained in the genome of Fowlpox Virus. VGAM1785 host target gene, herein designated VGAM HOST TARGET GENE, is a human gene contained in the human genome.

VGAM1785 gene encodes a VGAM1785 precursor RNA, herein designated VGAM PRECURSOR RNA. Similar to other miRNA genes, and unlike most ordinary genes, VGAM1785 precursor RNA does not encode a protein. A nucleotide sequence identical or highly similar to the nucleotide sequence of VGAM1785 precursor RNA is designated SEQ ID:1771, and is provided hereinbelow with reference to the sequence listing part. Nucleotide sequence SEQ ID:1771 is located at position 36138 relative to the genome of Fowlpox Virus.

VGAM1785 precursor RNA folds onto itself, forming VGAM1785 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1785 folded precursor RNA into VGAM1785 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1785 RNA is designated SEQ ID:4496, and is provided hereinbelow with reference to the sequence listing part.

VGAM1785 host target gene, herein designated VGAM HOST TARGET GENE, encodes a corresponding messenger RNA, VGAM1785 host target RNA, herein designated VGAM HOST TARGET RNA. VGAM1785 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1785 RNA, herein designated VGAM RNA, binds complementarily to one or more host target binding sites located in untranslated regions of VGAM1785 host target RNA, herein designated VGAM HOST TARGET RNA. This complementary binding is due to the fact that the nucleotide sequence of VGAM1785 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1785 RNA, herein designated VGAM RNA, may have a different number of host target binding sites in untranslated regions of a VGAM1785 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1785 RNA, herein designated VGAM RNA, to host target binding sites on VGAM1785 host target RNA, herein designated VGAM HOST TARGET RNA, such as BINDING SITE I, BINDING SITE II and BINDING SITE III, inhibits translation of VGAM1785 host target RNA into VGAM1785 host target protein, herein designated VGAM HOST TARGET PROTEIN. VGAM host target protein is therefore outlined by a broken line.

It is appreciated that VGAM1785 host target gene, herein designated VGAM HOST TARGET GENE, in fact represents a plurality of VGAM1785 host target genes. The mRNA of each one of this plurality of VGAM1785 host target genes comprises one or more host target binding sites, each having a nucleotide sequence which is at least partly complementary to VGAM1785 RNA, herein designated VGAM RNA, and which when bound by VGAM1785 RNA causes inhibition of translation of respective one or more VGAM1785 host target proteins.

It is further appreciated by one skilled in the art that the mode of translational inhibition illustrated by FIG. 1 with specific reference to translational inhibition exerted by VGAM1785 gene, herein designated VGAM GENE, on one or more VGAM1785 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1785 is inhibition of expression of host target genes, as part of a novel viral mechanism of attacking a host. Accordingly, utilities of VGAM1785 include diagnosis, prevention and treatment of viral infection by Fowlpox Virus. Specific functions, and accordingly utilities, of VGAM1785 correlate with, and may be deduced from, the identity of the host target genes which VGAM1785 binds and inhibits, and the function of these host target genes, as elaborated hereinbelow.

Nucleotide sequences of the VGAM1785 precursor RNA, herein designated VGAM PRECURSOR RNA, and of the 'diced' VGAM1785 RNA, herein designated VGAM RNA, and a schematic representation of the secondary folding of VGAM1785 folded precursor RNA, herein designated VGAM FOLDED PRECURSOR RNA, of VGAM1785 are further described hereinbelow with reference to Table 1.

Nucleotide sequences of host target binding sites, such as BINDING SITE-I, BINDING SITE-II and BINDING SITE-III of FIG. 1, found on VGAM1785 host target RNA, and schematic representation of the complementarity of each of these host target binding sites to VGAM1785 RNA, herein designated VGAM RNA, are described hereinbelow with reference to Table 2.

As mentioned hereinabove with reference to FIG. 1, a function of VGAM1785 gene, herein designated VGAM is inhibition of expression of VGAM1785 target genes. It is appreciated that specific functions, and accordingly utilities, of VGAM1785 correlate with, and may be deduced from, the identity of the target genes which VGAM1785 binds and inhibits, and the function of these target genes, as elaborated hereinbelow.

ARP2 Actin-related Protein 2 Homolog (yeast) (ACTR2, Accession NM_005722) is a VGAM1785 host target gene. ACTR2 BINDING SITE is HOST TARGET binding site found in the 3' untranslated region of mRNA encoded by ACTR2, corresponding to a HOST TARGET binding site such as BINDING SITE I, BINDING SITE II or BINDING SITE III. Table 2 illustrates the complementarity of the nucleotide sequences of ACTR2 BINDING SITE, designated SEQ ID:12274, to the nucleotide sequence of VGAM1785 RNA, herein designated VGAM RNA, also designated SEQ ID:4496.

A function of VGAM1785 is therefore inhibition of ARP2 Actin-related Protein 2 Homolog (yeast) (ACTR2, Accession NM_005722). Accordingly, utilities of VGAM1785 include diagnosis, prevention and treatment of diseases and clinical conditions associated with ACTR2. FLJ20189 (Accession NM_017704) is another VGAM1785 host target gene. FLJ20189 BINDING SITE is HOST TARGET binding site found in the 3' untranslated region of mRNA encoded by FLJ20189, corresponding to a HOST TARGET binding site such as BINDING SITE I, BINDING SITE II or BINDING SITE III. Table 2 illustrates the complementarity of the nucleotide sequences of FLJ20189 BINDING SITE, designated SEQ ID:19279, to the nucleotide sequence of VGAM1785 RNA, herein designated VGAM RNA, also designated SEQ ID:4496.

Another function of VGAM1785 is therefore inhibition of FLJ20189 (Accession NM_017704). Accordingly, utilities of VGAM1785 include diagnosis, prevention and treatment of diseases and clinical conditions associated with FLJ20189. My015 (Accession XM_039512) is another VGAM1785 host target gene. My015 BINDING SITE is HOST TARGET binding site found in the 3' untranslated region of mRNA encoded by My015, corresponding to a HOST TARGET binding site such as BINDING SITE I, BINDING SITE II or BINDING SITE III. Table 2 illustrates the complementarity of the nucleotide sequences of My015 BINDING SITE, designated SEQ ID:33107, to the nucleotide sequence of VGAM1785 RNA, herein designated VGAM RNA, also designated SEQ ID:4496.

Another function of VGAM1785 is therefore inhibition of My015 (Accession XM_039512). Accordingly, utilities of VGAM1785 include diagnosis, prevention and treatment of diseases and clinical conditions associated with My015. FIG. 1 further provides a conceptual description of a novel bioinformatically detected viral gene of the present invention, referred to here as Viral Genomic Address Messenger 1786 (VGAM1786) viral gene, which modulates expression of respective host target genes thereof, the function and utility of which host target genes is known in the art.

VGAM1786 is a novel bioinformatically detected regulatory, non protein coding, viral micro RNA (miRNA) gene. The method by which VGAM1786 was detected is described hereinabove with reference to FIGS. 1-8.

VGAM1786 gene, herein designated VGAM GENE, is a viral gene contained in the genome of Fowlpox Virus. VGAM1786 host target gene, herein designated VGAM HOST TARGET GENE, is a human gene contained in the human genome.

VGAM1786 gene encodes a VGAM1786 precursor RNA, herein designated VGAM PRECURSOR RNA. Similar to other miRNA genes, and unlike most ordinary genes, VGAM1786 precursor RNA does not encode a protein. A nucleotide sequence identical or highly similar to the nucleotide sequence of VGAM1786 precursor RNA is designated SEQ ID:1772, and is provided hereinbelow with reference to the sequence listing part. Nucleotide sequence SEQ ID:1772 is located at position 36018 relative to the genome of Fowlpox Virus.

VGAM1786 precursor RNA folds onto itself, forming VGAM1786 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1786 folded precursor RNA into VGAM1786 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM1786 RNA is designated SEQ ID:4497, and is provided hereinbelow with reference to the sequence listing part.

VGAM1786 host target gene, herein designated VGAM HOST TARGET GENE, encodes a corresponding messenger RNA, VGAM1786 host target RNA, herein designated VGAM HOST TARGET RNA. VGAM1786 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1786 RNA, herein designated VGAM RNA, binds complementarily to one or more host target binding sites located in untranslated regions of VGAM1786 host target RNA, herein designated VGAM HOST TARGET RNA. This complementary binding is due to the fact that the nucleotide sequence of VGAM1786 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1786 RNA, herein designated VGAM RNA, may have a different number of host target binding sites in untranslated regions of a VGAM1786 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1786 RNA, herein designated VGAM RNA, to host target binding sites on VGAM1786 host target RNA, herein designated VGAM HOST TARGET RNA, such as BINDING SITE I, BINDING SITE II and BINDING SITE III, inhibits translation of VGAM1786 host target RNA into VGAM1786 host target protein, herein designated VGAM HOST TARGET PROTEIN. VGAM host target protein is therefore outlined by a broken line.

It is appreciated that VGAM1786 host target gene, herein designated VGAM HOST TARGET GENE, in fact represents a plurality of VGAM1786 host target genes. The mRNA of each one of this plurality of VGAM1786 host target genes comprises one or more host target binding sites, each having a nucleotide sequence which is at least partly complementary to VGAM1786 RNA, herein designated VGAM RNA, and which when bound by VGAM1786 RNA causes inhibition of translation of respective one or more VGAM1786 host target proteins.

It is further appreciated by one skilled in the art that the mode of translational inhibition illustrated by FIG. 1 with specific reference to translational inhibition exerted by VGAM1786 gene, herein designated VGAM GENE, on one or more VGAM1786 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1786 is inhibition of expression of host target genes, as part of a novel viral mechanism of attacking a host. Accordingly, utilities of VGAM1786 include diagnosis, prevention and treatment of viral infection by Fowlpox Virus. Specific functions, and accordingly utilities, of VGAM1786 correlate with, and may be deduced from, the identity of the host target genes which VGAM1786 binds and inhibits, and the function of these host target genes, as elaborated hereinbelow.

Nucleotide sequences of the VGAM1786 precursor RNA, herein designated VGAM PRECURSOR RNA, and of the 'diced' VGAM1786 RNA, herein designated VGAM RNA, and a schematic representation of the secondary folding of VGAM1786 folded precursor RNA, herein designated VGAM FOLDED PRECURSOR RNA, of VGAM1786 are further described hereinbelow with reference to Table 1.

Nucleotide sequences of host target binding sites, such as BINDING SITE-I, BINDING SITE-II and BINDING SITE-III of FIG. 1, found on VGAM1786 host target RNA, and schematic representation of the complementarity of each of these host target binding sites to VGAM1786 RNA, herein designated VGAM RNA, are described hereinbelow with reference to Table 2.

As mentioned hereinabove with reference to FIG. 1, a function of VGAM1786 gene, herein designated VGAM is inhibition of expression of VGAM1786 target genes. It is appreciated that specific functions, and accordingly utilities, of VGAM1786 correlate with, and may be deduced from, the identity of the target genes which VGAM1786 binds and inhibits, and the function of these target genes, as elaborated hereinbelow.

MGC16175 (Accession NM_032765) is a VGAM1786 host target gene. MGC16175 BINDING SITE is HOST TARGET binding site found in the 3' untranslated region of mRNA encoded by MGC16175, corresponding to a HOST TARGET binding site such as BINDING SITE I, BINDING SITE II or BINDING SITE III. Table 2 illustrates the complementarity of the nucleotide sequences of MGC16175 BINDING SITE, designated SEQ ID:26513, to the nucleotide sequence of VGAM1786 RNA, herein designated VGAM RNA, also designated SEQ ID:4497.

A function of VGAM1786 is therefore inhibition of MGC16175 (Accession NM_032765). Accordingly, utilities of VGAM1786 include diagnosis, prevention and treatment of diseases and clinical conditions associated with MGC16175. LOC119548 (Accession XM_058404) is another VGAM1786 host target gene. LOC119548 BINDING SITE is HOST TARGET binding site found in the 3' untranslated region of mRNA encoded by LOC119548, corresponding to a HOST TARGET binding site such as BINDING SITE I, BINDING SITE II or BINDING SITE III. Table 2 illustrates the complementarity of the nucleotide sequences of LOC119548 BINDING SITE, designated SEQ ID:36617, to the nucleotide sequence of VGAM1786 RNA, herein designated VGAM RNA, also designated SEQ ID:4497.

Another function of VGAM1786 is therefore inhibition of LOC119548 (Accession XM_058404). Accordingly, utilities of VGAM1786 include diagnosis, prevention and treatment of diseases and clinical conditions associated with LOC119548. FIG. 1 further provides a conceptual description of a novel bioinformatically detected viral gene of the present invention, referred to here as Viral Genomic Address Messenger 1787 (VGAM1787) viral gene, which modulates expression of respective host target genes thereof, the function and utility of which host target genes is known in the art.

VGAM1787 is a novel bioinformatically detected regulatory, non protein coding, viral micro RNA (miRNA) gene. The method by which VGAM1787 was detected is described hereinabove with reference to FIGS. 1-8.

VGAM1787 gene, herein designated VGAM GENE, is a viral gene contained in the genome of Fowlpox Virus. VGAM1787 host target gene, herein designated VGAM HOST TARGET GENE, is a human gene contained in the human genome.

VGAM1787 gene encodes a VGAM1787 precursor RNA, herein designated VGAM PRECURSOR RNA. Similar to other miRNA genes, and unlike most ordinary genes, VGAM1787 precursor RNA does not encode a protein. A nucleotide sequence identical or highly similar to the nucleotide sequence of VGAM1787 precursor RNA is designated SEQ ID:1773, and is provided hereinbelow with reference to the sequence listing part. Nucleotide sequence SEQ ID:1773 is located at position 44889 relative to the genome of Fowlpox Virus.

VGAM1787 precursor RNA folds onto itself, forming VGAM1787 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1787 folded precursor RNA into VGAM1787 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1787 RNA is designated SEQ ID:4498, and is provided hereinbelow with reference to the sequence listing part.

VGAM1787 host target gene, herein designated VGAM HOST TARGET GENE, encodes a corresponding messenger RNA, VGAM1787 host target RNA, herein designated VGAM HOST TARGET RNA. VGAM1787 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1787 RNA, herein designated VGAM RNA, binds complementarily to one or more host target binding sites located in untranslated regions of VGAM1787 host target RNA, herein designated VGAM HOST TARGET RNA. This complementary binding is due to the fact that the nucleotide sequence of VGAM1787 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1787 RNA, herein designated VGAM RNA, may have a different number of host target binding sites in untranslated regions of a VGAM1787 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1787 RNA, herein designated VGAM RNA, to host target binding sites on VGAM1787 host target RNA, herein designated VGAM HOST TARGET RNA, such as BINDING SITE I, BINDING SITE II and BINDING SITE III, inhibits translation of VGAM1787 host target RNA into VGAM1787 host target protein, herein designated VGAM HOST TARGET PROTEIN. VGAM host target protein is therefore outlined by a broken line.

It is appreciated that VGAM1787 host target gene, herein designated VGAM HOST TARGET GENE, in fact represents a plurality of VGAM1787 host target genes. The mRNA of each one of this plurality of VGAM1787 host target genes comprises one or more host target binding sites, each having a nucleotide sequence which is at least partly complementary to VGAM1787 RNA, herein designated VGAM RNA, and which when bound by VGAM1787 RNA causes inhibition of translation of respective one or more VGAM1787 host target proteins.

It is further appreciated by one skilled in the art that the mode of translational inhibition illustrated by FIG. 1 with specific reference to translational inhibition exerted by VGAM1787 gene, herein designated VGAM GENE, on one or more VGAM1787 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1787 is inhibition of expression of host target genes, as part of a novel viral mechanism of attacking a host. Accordingly, utilities of VGAM1787 include diagnosis, prevention and treatment of viral infection by Fowlpox Virus. Specific functions, and accordingly utilities, of VGAM1787 correlate with, and may be deduced from, the identity of the host target genes which VGAM1787 binds and inhibits, and the function of these host target genes, as elaborated hereinbelow.

Nucleotide sequences of the VGAM1787 precursor RNA, herein designated VGAM PRECURSOR RNA, and of the 'diced' VGAM1787 RNA, herein designated VGAM RNA, and a schematic representation of the secondary folding of VGAM1787 folded precursor RNA, herein designated VGAM FOLDED PRECURSOR RNA, of VGAM1787 are further described hereinbelow with reference to Table 1.

Nucleotide sequences of host target binding sites, such as BINDING SITE-I, BINDING SITE-II and BINDING SITE-III of FIG. 1, found on VGAM1787 host target RNA, and schematic representation of the complementarity of each of these host target binding sites to VGAM1787 RNA, herein designated VGAM RNA, are described hereinbelow with reference to Table 2.

As mentioned hereinabove with reference to FIG. 1, a function of VGAM1787 gene, herein designated VGAM is inhibition of expression of VGAM1787 target genes. It is appreciated that specific functions, and accordingly utilities, of VGAM1787 correlate with, and may be deduced from, the identity of the target genes which VGAM1787 binds and inhibits, and the function of these target genes, as elaborated hereinbelow.

BLAME (Accession NM_020125) is a VGAM1787 host target gene. BLAME BINDING SITE is HOST TARGET binding site found in the 3' untranslated region of mRNA encoded by BLAME, corresponding to a HOST TARGET binding site such as BINDING SITE I, BINDING SITE II or BINDING SITE III. Table 2 illustrates the complementarity of the nucleotide sequences of BLAME BINDING SITE, designated SEQ ID:21304, to the nucleotide sequence of VGAM1787 RNA, herein designated VGAM RNA, also designated SEQ ID:4498.

A function of VGAM1787 is therefore inhibition of BLAME (Accession NM_020125). Accordingly, utilities of VGAM1787 include diagnosis, prevention and treatment of diseases and clinical conditions associated with BLAME. RNA Binding Motif Protein 3 (RBM3, Accession XM_047024) is another VGAM1787 host target gene. RBM3 BINDING SITE is HOST TARGET binding site found in the 3' untranslated region of mRNA encoded by RBM3, corresponding to a HOST TARGET binding site such as BINDING SITE I, BINDING SITE II or BINDING SITE III. Table 2 illustrates the complementarity of the nucleotide sequences of RBM3 BINDING SITE, designated SEQ ID:34895, to the nucleotide sequence of VGAM1787 RNA, herein designated VGAM RNA, also designated SEQ ID:4498.

Another function of VGAM1787 is therefore inhibition of RNA Binding Motif Protein 3 (RBM3, Accession XM_047024). Accordingly, utilities of VGAM1787 include diagnosis, prevention and treatment of diseases and clinical conditions associated with RBM3. LOC152002 (Accession XM_087360) is another VGAM1787 host target gene. LOC152002 BINDING SITE is HOST TARGET binding site found in the 3' untranslated region of mRNA encoded by LOC152002, corresponding to a HOST TARGET binding site such as BINDING SITE I, BINDING SITE II or BINDING SITE III. Table 2 illustrates the complementarity of the nucleotide sequences of LOC152002 BINDING SITE, designated SEQ ID:39193, to the nucleotide sequence of VGAM1787 RNA, herein designated VGAM RNA, also designated SEQ ID:4498.

Another function of VGAM1787 is therefore inhibition of LOC152002 (Accession XM_087360). Accordingly, utilities of VGAM1787 include diagnosis, prevention and treatment of diseases and clinical conditions associated with LOC152002. LOC92979 (Accession NM_138396) is another VGAM1787 host target gene. LOC92979 BINDING SITE is HOST TARGET binding site found in the 5' untranslated region of mRNA encoded by LOC92979, corresponding to a HOST TARGET binding site such as BINDING SITE I, BINDING SITE II or BINDING SITE III. Table 2 illustrates the complementarity of the nucleotide sequences of LOC92979 BINDING SITE, designated SEQ ID:28763, to the nucleotide sequence of VGAM1787 RNA, herein designated VGAM RNA, also designated SEQ ID:4498.

Another function of VGAM1787 is therefore inhibition of LOC92979 (Accession NM_138396). Accordingly, utilities of VGAM1787 include diagnosis, prevention and treatment of diseases and clinical conditions associated with LOC92979. FIG. 1 further provides a conceptual description of a novel bioinformatically detected viral gene of the present invention, referred to here as Viral Genomic Address Messenger 1788 (VGAM1788) viral gene, which modulates expression of respective host target genes thereof, the function and utility of which host target genes is known in the art.

VGAM1788 is a novel bioinformatically detected regulatory, non protein coding, viral micro RNA (miRNA) gene. The method by which VGAM1788 was detected is described hereinabove with reference to FIGS. 1-8.

VGAM1788 gene, herein designated VGAM GENE, is a viral gene contained in the genome of Fowlpox Virus. VGAM1788 host target gene, herein designated VGAM HOST TARGET GENE, is a human gene contained in the human genome.

VGAM1788 gene encodes a VGAM1788 precursor RNA, herein designated VGAM PRECURSOR RNA. Similar to other miRNA genes, and unlike most ordinary genes, VGAM1788 precursor RNA does not encode a protein. A nucleotide sequence identical or highly similar to the nucleotide sequence of VGAM1788 precursor RNA is designated SEQ ID:1774, and is provided hereinbelow with reference to the sequence listing part. Nucleotide sequence SEQ ID:1774 is located at position 45071 relative to the genome of Fowlpox Virus.

VGAM1788 precursor RNA folds onto itself, forming VGAM1788 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1788 folded precursor RNA into VGAM1788 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1788 RNA is designated SEQ ID:4499, and is provided hereinbelow with reference to the sequence listing part.

VGAM1788 host target gene, herein designated VGAM HOST TARGET GENE, encodes a corresponding messenger RNA, VGAM1788 host target RNA, herein designated VGAM HOST TARGET RNA. VGAM1788 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1788 RNA, herein designated VGAM RNA, binds complementarily to one or more host target binding sites located in untranslated regions of VGAM1788 host target RNA, herein designated VGAM HOST TARGET RNA. This complementary binding is due to the fact that the nucleotide sequence of VGAM1788 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1788 RNA, herein designated VGAM RNA, may have a different number of host target binding sites in untranslated regions of a VGAM1788 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1788 RNA, herein designated VGAM RNA, to host target binding sites on VGAM1788 host target RNA, herein designated VGAM HOST TARGET RNA, such as BINDING SITE I, BINDING SITE II and BINDING SITE III, inhibits translation of VGAM1788 host target RNA into VGAM1788 host target protein, herein designated VGAM HOST TARGET PROTEIN. VGAM host target protein is therefore outlined by a broken line.

It is appreciated that VGAM1788 host target gene, herein designated VGAM HOST TARGET GENE, in fact represents a plurality of VGAM1788 host target genes. The mRNA of each one of this plurality of VGAM1788 host target genes comprises one or more host target binding sites, each having a nucleotide sequence which is at least partly complementary to VGAM1788 RNA, herein designated VGAM RNA, and which when bound by VGAM1788 RNA causes inhibition of translation of respective one or more VGAM1788 host target proteins.

It is further appreciated by one skilled in the art that the mode of translational inhibition illustrated by FIG. 1 with specific reference to translational inhibition exerted by VGAM1788 gene, herein designated VGAM GENE, on one or more VGAM1788 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1788 is inhibition of expression of host target genes, as part of a novel viral mechanism of attacking a host. Accordingly, utilities of VGAM1788 include diagnosis, prevention and treatment of viral infection by Fowlpox Virus. Specific functions, and accordingly utilities, of VGAM1788 correlate with, and may be deduced from, the identity of the host target genes which VGAM1788 binds and inhibits, and the function of these host target genes, as elaborated hereinbelow.

Nucleotide sequences of the VGAM1788 precursor RNA, herein designated VGAM PRECURSOR RNA, and of the 'diced' VGAM1788 RNA, herein designated VGAM RNA, and a schematic representation of the secondary folding of VGAM1788 folded precursor RNA, herein designated VGAM FOLDED PRECURSOR RNA, of VGAM1788 are further described hereinbelow with reference to Table 1.

Nucleotide sequences of host target binding sites, such as BINDING SITE-I, BINDING SITE-II and BINDING SITE-III of FIG. 1, found on VGAM1788 host target RNA, and schematic representation of the complementarity of each of these host target binding sites to VGAM1788 RNA, herein designated VGAM RNA, are described hereinbelow with reference to Table 2.

As mentioned hereinabove with reference to FIG. 1, a function of VGAM1788 gene, herein designated VGAM is inhibition of expression of VGAM1788 target genes. It is appreciated that specific functions, and accordingly utilities, of VGAM1788 correlate with, and may be deduced from, the identity of the target genes which VGAM1788 binds and inhibits, and the function of these target genes, as elaborated hereinbelow.

CUB and Sushi Multiple Domains 1 (CSMD1, Accession XM_054838) is a VGAM1788 host target gene. CSMD1 BINDING SITE is HOST TARGET binding site found in the 3' untranslated region of mRNA encoded by CSMD1, corresponding to a HOST TARGET binding site such as BINDING SITE I, BINDING SITE II or BINDING SITE III. Table 2 illustrates the complementarity of the nucleotide sequences of CSMD1 BINDING SITE, designated SEQ ID:36196, to the nucleotide sequence of VGAM1788 RNA, herein designated VGAM RNA, also designated SEQ ID:4499.

A function of VGAM1788 is therefore inhibition of CUB and Sushi Multiple Domains 1 (CSMD1, Accession XM_054838). Accordingly, utilities of VGAM1788 include diagnosis, prevention and treatment of diseases and clinical conditions associated with CSMD1. PRO2389 (Accession XM_033334) is another VGAM1788 host target gene. PRO2389 BINDING SITE is HOST TARGET binding site found in the 5' untranslated region of mRNA encoded by PRO2389, corresponding to a HOST TARGET binding site such as BINDING SITE I, BINDING SITE II or BINDING SITE III. Table 2 illustrates the complementarity of the nucleotide sequences of PRO2389 BINDING SITE, designated SEQ ID:31881, to the nucleotide sequence of VGAM1788 RNA, herein designated VGAM RNA, also designated SEQ ID:4499.

Another function of VGAM1788 is therefore inhibition of PRO2389 (Accession XM_033334). Accordingly, utilities of VGAM1788 include diagnosis, prevention and treatment of diseases and clinical conditions associated with PRO2389. FIG. 1 further provides a conceptual description of a novel bioinformatically detected viral gene of the present invention, referred to here as Viral Genomic Address Messenger 1789 (VGAM1789) viral gene, which modulates expression of respective host target genes thereof, the function and utility of which host target genes is known in the art.

VGAM1789 is a novel bioinformatically detected regulatory, non protein coding, viral micro RNA (miRNA) gene. The method by which VGAM1789 was detected is described hereinabove with reference to FIGS. 1-8.

VGAM1789 gene, herein designated VGAM GENE, is a viral gene contained in the genome of Fowlpox Virus. VGAM1789 host target gene, herein designated VGAM HOST TARGET GENE, is a human gene contained in the human genome.

VGAM1789 gene encodes a VGAM1789 precursor RNA, herein designated VGAM PRECURSOR RNA. Similar to other miRNA genes, and unlike most ordinary genes, VGAM1789 precursor RNA does not encode a protein. A nucleotide sequence identical or highly similar to the nucleotide sequence of VGAM1789 precursor RNA is designated SEQ ID:1775, and is provided hereinbelow with reference to the sequence listing part. Nucleotide sequence SEQ ID:1775 is located at position 42299 relative to the genome of Fowlpox Virus.

VGAM1789 precursor RNA folds onto itself, forming VGAM1789 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1789 folded precursor RNA into VGAM1789 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1789 RNA is designated SEQ ID:4500, and is provided hereinbelow with reference to the sequence listing part.

VGAM1789 host target gene, herein designated VGAM HOST TARGET GENE, encodes a corresponding messenger RNA, VGAM1789 host target RNA, herein designated VGAM HOST TARGET RNA. VGAM1789 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1789 RNA, herein designated VGAM RNA, binds complementarily to one or more host target binding sites located in untranslated regions of VGAM1789 host target RNA, herein designated VGAM HOST TARGET RNA. This complementary binding is due to the fact that the nucleotide sequence of VGAM1789 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1789 RNA, herein designated VGAM RNA, may have a different number of host target binding sites in untranslated regions of a VGAM1789 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1789 RNA, herein designated VGAM RNA, to host target binding sites on VGAM1789 host target RNA, herein designated VGAM HOST TARGET RNA, such as BINDING SITE I, BINDING SITE II and BINDING SITE III, inhibits translation of VGAM1789 host target RNA into VGAM1789 host target protein, herein designated VGAM HOST TARGET PROTEIN. VGAM host target protein is therefore outlined by a broken line.

It is appreciated that VGAM1789 host target gene, herein designated VGAM HOST TARGET GENE, in fact represents a plurality of VGAM1789 host target genes. The mRNA of each one of this plurality of VGAM1789 host target genes comprises one or more host target binding sites, each having a nucleotide sequence which is at least partly complementary to VGAM1789 RNA, herein designated VGAM RNA, and which when bound by VGAM1789 RNA causes inhibition of translation of respective one or more VGAM1789 host target proteins.

It is further appreciated by one skilled in the art that the mode of translational inhibition illustrated by FIG. 1 with specific reference to translational inhibition exerted by VGAM1789 gene, herein designated VGAM GENE, on one or more VGAM1789 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1789 is inhibition of expression of host target genes, as part of a novel viral mechanism of attacking a host. Accordingly, utilities of VGAM1789 include diagnosis, prevention and treatment of viral infection by Fowlpox Virus. Specific functions, and accordingly utilities, of VGAM1789 correlate with, and may be deduced from, the identity of the host target genes which VGAM1789 binds and inhibits, and the function of these host target genes, as elaborated hereinbelow.

Nucleotide sequences of the VGAM1789 precursor RNA, herein designated VGAM PRECURSOR RNA, and of the 'diced' VGAM1789 RNA, herein designated VGAM RNA, and a schematic representation of the secondary folding of VGAM1789 folded precursor RNA, herein designated VGAM FOLDED PRECURSOR RNA, of VGAM1789 are further described hereinbelow with reference to Table 1.

Nucleotide sequences of host target binding sites, such as BINDING SITE-I, BINDING SITE-II and BINDING SITE-III of FIG. 1, found on VGAM1789 host target RNA, and schematic representation of the complementarity of each of these host target binding sites to VGAM1789 RNA, herein designated VGAM RNA, are described hereinbelow with reference to Table 2.

As mentioned hereinabove with reference to FIG. 1, a function of VGAM1789 gene, herein designated VGAM is inhibition of expression of VGAM1789 target genes. It is appreciated that specific functions, and accordingly utilities, of VGAM1789 correlate with, and may be deduced from, the identity of the target genes which VGAM1789 binds and inhibits, and the function of these target genes, as elaborated hereinbelow.

Norrie Disease (pseudoglioma) (NDP, Accession NM_000266) is a VGAM1789 host target gene. NDP BINDING SITE is HOST TARGET binding site found in the 3' untranslated region of mRNA encoded by NDP, corresponding to a HOST TARGET binding site such as BINDING SITE I, BINDING SITE II or BINDING SITE III. Table 2 illustrates the complementarity of the nucleotide sequences of NDP BINDING SITE, designated SEQ ID:5807, to the nucleotide sequence of VGAM1789 RNA, herein designated VGAM RNA, also designated SEQ ID:4500.

A function of VGAM1789 is therefore inhibition of Norrie Disease (pseudoglioma) (NDP, Accession NM_000266), a gene which may be involved in a pathway that regulates neural cell differentiation and proliferation. Accordingly, utilities of VGAM1789 include diagnosis, prevention and treatment of diseases and clinical conditions associated with NDP. The function of NDP and its association with various diseases and clinical conditions, has been established by previous studies, as described hereinabove with reference to VGAM113. DKFZp761F2014 (Accession NM_020215) is another VGAM1789 host target gene. DKFZp761F2014 BINDING SITE is HOST TARGET binding site found in the 3' untranslated region of mRNA encoded by DKFZp761F2014, corresponding to a HOST TARGET binding site such as BINDING SITE I, BINDING SITE II or BINDING SITE III. Table 2 illustrates the complementarity of the nucleotide sequences of DKFZp761F2014 BINDING SITE, designated SEQ ID:21463, to the nucleotide sequence of VGAM1789 RNA, herein designated VGAM RNA, also designated SEQ ID:4500.

Another function of VGAM1789 is therefore inhibition of DKFZp761F2014 (Accession NM_020215). Accordingly, utilities of VGAM1789 include diagnosis, prevention and treatment of diseases and clinical conditions associated with DKFZp761F2014. FLJ23590 (Accession NM_024649) is another VGAM1789 host target gene. FLJ23590 BINDING SITE is HOST TARGET binding site found in the 3' untranslated region of mRNA encoded by FLJ23590, corresponding to a HOST TARGET binding site such as BINDING SITE I, BINDING SITE II or BINDING SITE III. Table 2 illustrates the complementarity of the nucleotide sequences of FLJ23590 BINDING SITE, designated SEQ ID:23941, to the nucleotide sequence of VGAM1789 RNA, herein designated VGAM RNA, also designated SEQ ID:4500.

Another function of VGAM1789 is therefore inhibition of FLJ23590 (Accession NM_024649). Accordingly, utilities of VGAM1789 include diagnosis, prevention and treatment of diseases and clinical conditions associated with FLJ23590. KIAA0016 (Accession NM_014765) is another VGAM1789 host target gene. KIAA0016 BINDING SITE is HOST TARGET binding site found in the 3' untranslated region of mRNA encoded by KIAA0016, corresponding to a HOST TARGET binding site such as BINDING SITE I, BINDING SITE II or BINDING SITE III. Table 2 illustrates the complementarity of the nucleotide sequences of KIAA0016 BINDING SITE, designated SEQ ID:16535, to the nucleotide sequence of VGAM1789 RNA, herein designated VGAM RNA, also designated SEQ ID:4500.

Another function of VGAM1789 is therefore inhibition of KIAA0016 (Accession NM_014765). Accordingly, utilities of VGAM1789 include diagnosis, prevention and treatment of diseases and clinical conditions associated with KIAA0016. LOC145566 (Accession XM_085174) is another VGAM1789 host target gene. LOC145566 BINDING SITE is HOST TARGET binding site found in the 5' untranslated region of mRNA encoded by LOC145566, corresponding to a HOST TARGET binding site such as BINDING SITE I, BINDING SITE II or BINDING SITE III. Table 2 illustrates the complementarity of the nucleotide sequences of LOC145566 BINDING SITE, designated SEQ ID:37901, to the nucleotide sequence of VGAM1789 RNA, herein designated VGAM RNA, also designated SEQ ID:4500.

Another function of VGAM1789 is therefore inhibition of LOC145566 (Accession XM_085174). Accordingly, utilities of VGAM1789 include diagnosis, prevention and treatment of diseases and clinical conditions associated with LOC145566. FIG. 1 further provides a conceptual description of a novel bioinformatically detected viral gene of the present invention, referred to here as Viral Genomic Address Messenger 1790 (VGAM1790) viral gene, which modulates expression of respective host target genes thereof, the function and utility of which host target genes is known in the art.

VGAM1790 is a novel bioinformatically detected regulatory, non protein coding, viral micro RNA (miRNA) gene. The method by which VGAM1790 was detected is described hereinabove with reference to FIGS. 1-8.

VGAM1790 gene, herein designated VGAM GENE, is a viral gene contained in the genome of Rana Tigrina Ranavirus. VGAM1790 host target gene, herein designated VGAM HOST TARGET GENE, is a human gene contained in the human genome.

VGAM1790 gene encodes a VGAM1790 precursor RNA, herein designated VGAM PRECURSOR RNA. Similar to other miRNA genes, and unlike most ordinary genes, VGAM1790 precursor RNA does not encode a protein. A nucleotide sequence identical or highly similar to the nucleotide sequence of VGAM1790 precursor RNA is designated SEQ ID:1776, and is provided hereinbelow with reference to the sequence listing part. Nucleotide sequence SEQ ID:1776 is located at position 79077 relative to the genome of Rana Tigrina Ranavirus.

VGAM1790 precursor RNA folds onto itself, forming VGAM1790 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1790 folded precursor RNA into VGAM1790 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 80%) nucleotide sequence of VGAM1790 RNA is designated SEQ ID:4501, and is provided hereinbelow with reference to the sequence listing part.

VGAM1790 host target gene, herein designated VGAM HOST TARGET GENE, encodes a corresponding messenger RNA, VGAM1790 host target RNA, herein designated VGAM HOST TARGET RNA. VGAM1790 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1790 RNA, herein designated VGAM RNA, binds complementarily to one or more host target binding sites located in untranslated regions of VGAM1790 host target RNA, herein designated VGAM HOST TARGET RNA. This complementary binding is due to the fact that the nucleotide sequence of VGAM1790 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1790 RNA, herein designated VGAM RNA, may have a different number of host target binding sites in untranslated regions of a VGAM1790 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1790 RNA, herein designated VGAM RNA, to host target binding sites on VGAM1790 host target RNA, herein designated VGAM HOST TARGET RNA, such as BINDING SITE I, BINDING SITE II and BINDING SITE III, inhibits translation of VGAM1790 host target RNA into VGAM1790 host target protein, herein designated VGAM HOST TARGET PROTEIN. VGAM host target protein is therefore outlined by a broken line.

It is appreciated that VGAM1790 host target gene, herein designated VGAM HOST TARGET GENE, in fact represents a plurality of VGAM1790 host target genes. The mRNA of each one of this plurality of VGAM1790 host target genes comprises one or more host target binding sites, each having a nucleotide sequence which is at least partly complementary to VGAM1790 RNA, herein designated VGAM RNA, and which when bound by VGAM1790 RNA causes inhibition of translation of respective one or more VGAM1790 host target proteins.

It is further appreciated by one skilled in the art that the mode of translational inhibition illustrated by FIG. 1 with specific reference to translational inhibition exerted by VGAM1790 gene, herein designated VGAM GENE, on one or more VGAM1790 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1790 is inhibition of expression of host target genes, as part of a novel viral mechanism of attacking a host. Accordingly, utilities of VGAM1790 include diagnosis, prevention and treatment of viral infection by Rana Tigrina Ranavirus. Specific functions, and accordingly utilities, of VGAM1790 correlate with, and may be deduced from, the identity of the host target genes which VGAM1790 binds and inhibits, and the function of these host target genes, as elaborated hereinbelow.

Nucleotide sequences of the VGAM1790 precursor RNA, herein designated VGAM PRECURSOR RNA, and of the 'diced' VGAM1790 RNA, herein designated VGAM RNA, and a schematic representation of the secondary folding of VGAM1790 folded precursor RNA, herein designated VGAM FOLDED PRECURSOR RNA, of VGAM1790 are further described hereinbelow with reference to Table 1.

Nucleotide sequences of host target binding sites, such as BINDING SITE-I, BINDING SITE-II and BINDING SITE-III of FIG. 1, found on VGAM1790 host target RNA, and schematic representation of the complementarity of each of these host target binding sites to VGAM1790 RNA, herein designated VGAM RNA, are described hereinbelow with reference to Table 2.

As mentioned hereinabove with reference to FIG. 1, a function of VGAM1790 gene, herein designated VGAM is inhibition of expression of VGAM1790 target genes. It is appreciated that specific functions, and accordingly utilities, of VGAM1790 correlate with, and may be deduced from, the identity of the target genes which VGAM1790 binds and inhibits, and the function of these target genes, as elaborated hereinbelow.

Peroxisome Proliferative Activated Receptor, Gamma, Coactivator 1 (PPARGC1, Accession NM_013261) is a VGAM1790 host target gene. PPARGC1 BINDING SITE is HOST TARGET binding site found in the 3' untranslated region of mRNA encoded by PPARGC1, corresponding to a HOST TARGET binding site such as BINDING SITE I, BINDING SITE II or BINDING SITE III. Table 2 illustrates the complementarity of the nucleotide sequences of PPARGC1 BINDING SITE, designated SEQ ID:14931, to the nucleotide sequence of VGAM1790 RNA, herein designated VGAM RNA, also designated SEQ ID:4501.

A function of VGAM1790 is therefore inhibition of Peroxisome Proliferative Activated Receptor, Gamma, Coactivator 1 (PPARGC1, Accession NM_013261), a gene which may play a role in insulin sensitivity and thermogenesis. Accordingly, utilities of VGAM1790 include diagnosis, prevention and treatment of diseases and clinical conditions associated with PPARGC1. The function of PPARGC1 and its association with various diseases and clinical conditions, has been established by previous studies, as described hereinabove with reference to VGAM952. PRO1575 (Accession NM_014092) is another VGAM1790 host target gene. PRO1575 BINDING SITE is HOST TARGET binding site found in the 5' untranslated region of mRNA encoded by PRO1575, corresponding to a HOST TARGET binding site such as BINDING SITE I, BINDING SITE II or BINDING SITE III. Table 2 illustrates the complementarity of the nucleotide sequences of PRO1575 BINDING SITE, designated SEQ ID:15312, to the nucleotide sequence of VGAM1790 RNA, herein designated VGAM RNA, also designated SEQ ID:4501.

Another function of VGAM1790 is therefore inhibition of PRO1575 (Accession NM_014092). Accordingly, utilities of VGAM1790 include diagnosis, prevention and treatment of diseases and clinical conditions associated with PRO1575. LOC90141 (Accession XM_029373) is another VGAM1790 host target gene. LOC90141 BINDING SITE is HOST TARGET binding site found in the 3' untranslated region of mRNA encoded by LOC90141, corresponding to a HOST TARGET binding site such as BINDING SITE I, BINDING SITE II or BINDING SITE III. Table 2 illustrates the complementarity of the nucleotide sequences of LOC90141 BINDING SITE, designated SEQ ID:30881, to the nucleotide sequence of VGAM1790 RNA, herein designated VGAM RNA, also designated SEQ ID:4501.

Another function of VGAM1790 is therefore inhibition of LOC90141 (Accession XM_029373). Accordingly, utilities of VGAM1790 include diagnosis, prevention and treatment of diseases and clinical conditions associated with LOC90141. FIG. 1 further provides a conceptual description of a novel bioinformatically detected viral gene of the present invention, referred to here as Viral Genomic Address Messenger 1791 (VGAM1791) viral gene, which modulates expression of respective host target genes thereof, the function and utility of which host target genes is known in the art.

VGAM1791 is a novel bioinformatically detected regulatory, non protein coding, viral micro RNA (miRNA) gene. The method by which VGAM1791 was detected is described hereinabove with reference to FIGS. 1-8.

VGAM1791 gene, herein designated VGAM GENE, is a viral gene contained in the genome of Rana Tigrina Ranavirus. VGAM1791 host target gene, herein designated VGAM HOST TARGET GENE, is a human gene contained in the human genome.

VGAM1791 gene encodes a VGAM1791 precursor RNA, herein designated VGAM PRECURSOR RNA. Similar to other miRNA genes, and unlike most ordinary genes, VGAM1791 precursor RNA does not encode a protein. A nucleotide sequence identical or highly similar to the nucleotide sequence of VGAM1791 precursor RNA is designated SEQ ID:1777, and is provided hereinbelow with reference to the sequence listing part. Nucleotide sequence SEQ ID:1777 is located at position 85010 relative to the genome of Rana Tigrina Ranavirus.

VGAM1791 precursor RNA folds onto itself, forming VGAM1791 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1791 folded precursor RNA into VGAM1791 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1791 RNA is designated SEQ ID:4502, and is provided hereinbelow with reference to the sequence listing part.

VGAM1791 host target gene, herein designated VGAM HOST TARGET GENE, encodes a corresponding messenger RNA, VGAM1791 host target RNA, herein designated VGAM HOST TARGET RNA. VGAM1791 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1791 RNA, herein designated VGAM RNA, binds complementarily to one or more host target binding sites located in untranslated regions of VGAM1791 host target RNA, herein designated VGAM HOST TARGET RNA. This complementary binding is due to the fact that the nucleotide sequence of VGAM1791 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1791 RNA, herein designated VGAM RNA, may have a different number of host target binding sites in untranslated regions of a VGAM1791 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1791 RNA, herein designated VGAM RNA, to host target binding sites on VGAM1791 host target RNA, herein designated VGAM HOST TARGET RNA, such as BINDING SITE I, BINDING SITE II and BINDING SITE III, inhibits translation of VGAM1791 host target RNA into VGAM1791 host target protein, herein designated VGAM HOST TARGET PROTEIN. VGAM host target protein is therefore outlined by a broken line.

It is appreciated that VGAM1791 host target gene, herein designated VGAM HOST TARGET GENE, in fact represents a plurality of VGAM1791 host target genes. The mRNA of each one of this plurality of VGAM1791 host target genes comprises one or more host target binding sites, each having a nucleotide sequence which is at least partly complementary to VGAM1791 RNA, herein designated VGAM RNA, and which when bound by VGAM1791 RNA causes inhibition of translation of respective one or more VGAM1791 host target proteins.

It is further appreciated by one skilled in the art that the mode of translational inhibition illustrated by FIG. 1 with specific reference to translational inhibition exerted by VGAM1791 gene, herein designated VGAM GENE, on one or more VGAM1791 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1791 is inhibition of expression of host target genes, as part of a novel viral mechanism of attacking a host. Accordingly, utilities of VGAM1791 include diagnosis, prevention and treatment of viral infection by Rana Tigrina Ranavirus. Specific functions, and accordingly utilities, of VGAM1791 correlate with, and may be deduced from, the identity of the host target genes which VGAM1791 binds and inhibits, and the function of these host target genes, as elaborated hereinbelow.

Nucleotide sequences of the VGAM1791 precursor RNA, herein designated VGAM PRECURSOR RNA, and of the 'diced' VGAM1791 RNA, herein designated VGAM RNA, and a schematic representation of the secondary folding of VGAM1791 folded precursor RNA, herein designated VGAM FOLDED PRECURSOR RNA, of VGAM1791 are further described hereinbelow with reference to Table 1.

Nucleotide sequences of host target binding sites, such as BINDING SITE-I, BINDING SITE-II and BINDING SITE-III of FIG. 1, found on VGAM1791 host target RNA, and schematic representation of the complementarity of each of these host target binding sites to VGAM1791 RNA, herein designated VGAM RNA, are described hereinbelow with reference to Table 2.

As mentioned hereinabove with reference to FIG. 1, a function of VGAM1791 gene, herein designated VGAM is inhibition of expression of VGAM1791 target genes. It is appreciated that specific functions, and accordingly utilities, of VGAM1791 correlate with, and may be deduced from, the identity of the target genes which VGAM1791 binds and inhibits, and the function of these target genes, as elaborated hereinbelow.

UDP-Gal:betaGlcNAc Beta 1,3-galactosyltransferase, Polypeptide 5 (B3GALT5, Accession NM_033171) is a VGAM1791 host target gene. B3GALT5 BINDING SITE1 through B3GALT5 BINDING SITE4 are HOST TARGET binding sites found in untranslated regions of mRNA encoded by B3GALT5, corresponding to HOST TARGET binding sites such as BINDING SITE I, BINDING SITE II or BINDING SITE III. Table 2 illustrates the complementarity of the nucleotide sequences of B3GALT5 BINDING SITE1 through B3GALT5 BINDING SITE4, designated SEQ ID:27026, SEQ ID:27036, SEQ ID:27031 and SEQ ID:12698 respectively, to the nucleotide sequence of VGAM1791 RNA, herein designated VGAM RNA, also designated SEQ ID:4502.

A function of VGAM1791 is therefore inhibition of UDP-Gal:betaGlcNAc Beta 1,3-galactosyltransferase, Polypeptide 5 (B3GALT5, Accession NM_033171). Accordingly, utilities of VGAM1791 include diagnosis, prevention and treatment of diseases and clinical conditions associated with B3GALT5. Gap Junction Protein, Beta 3, 31 kDa (connexin 31) (GJB3, Accession NM_024009) is another VGAM1791 host target gene. GJB3 BINDING SITE is HOST TARGET binding site found in the 3' untranslated region of mRNA encoded by GJB3, corresponding to a HOST TARGET binding site such as BINDING SITE I, BINDING SITE II or BINDING SITE III. Table 2 illustrates the complementarity of the nucleotide sequences of GJB3 BINDING SITE, designated SEQ ID:23437, to the nucleotide sequence of VGAM1791 RNA, herein designated VGAM RNA, also designated SEQ ID:4502.

Another function of VGAM1791 is therefore inhibition of Gap Junction Protein, Beta 3, 31 kDa (connexin 31) (GJB3, Accession NM_024009). Accordingly, utilities of VGAM1791 include diagnosis, prevention and treatment of diseases and clinical conditions associated with GJB3. Glucocorticoid Receptor DNA Binding Factor 1 (GRLF1, Accession XM_085943) is another VGAM1791 host target gene. GRLF1 BINDING SITE is HOST TARGET binding site found in the 3' untranslated region of mRNA encoded by GRLF1, corresponding to a HOST TARGET binding site such as BINDING SITE I, BINDING SITE II or BINDING SITE III. Table 2 illustrates the complementarity of the nucleotide sequences of GRLF1 BINDING SITE, designated SEQ ID:38408, to the nucleotide sequence of VGAM1791 RNA, herein designated VGAM RNA, also designated SEQ ID:4502.

Another function of VGAM1791 is therefore inhibition of Glucocorticoid Receptor DNA Binding Factor 1 (GRLF1, Accession XM_085943), a gene which inhibits transcription of the glucocorticoid receptor gene. Accordingly, utilities of VGAM1791 include diagnosis, prevention and treatment of diseases and clinical conditions associated with GRLF1. The function of GRLF1 and its association with various diseases and clinical conditions, has been established by previous studies, as described hereinabove with reference to VGAM55. MAX Binding Protein (MNT, Accession NM_020310) is another VGAM1791 host target gene. MNT BINDING SITE is HOST TARGET binding site found in the 3' untranslated region of mRNA encoded by MNT, corresponding to a HOST TARGET binding site such as BINDING SITE I, BINDING SITE II or BINDING SITE III. Table 2 illustrates the complementarity of the nucleotide sequences of MNT BINDING SITE, designated SEQ ID:21565, to the nucleotide sequence of VGAM1791 RNA, herein designated VGAM RNA, also designated SEQ ID:4502.

Another function of VGAM1791 is therefore inhibition of MAX Binding Protein (MNT, Accession NM_020310). Accordingly, utilities of VGAM1791 include diagnosis, prevention and treatment of diseases and clinical conditions associated with MNT. Metastasis-associated 1-like 1 (MTA1L1, Accession NM_004739) is another VGAM1791 host target gene. MTA1L1 BINDING SITE is HOST TARGET binding site found in the 5' untranslated region of mRNA encoded by MTA1L1, corresponding to a HOST TARGET binding site such as BINDING SITE I, BINDING SITE II or BINDING SITE III. Table 2 illustrates the complementarity of the nucleotide sequences of MTA1L1 BINDING SITE, designated SEQ ID:11136, to the nucleotide sequence of VGAM1791 RNA, herein designated VGAM RNA, also designated SEQ ID:4502.

Another function of VGAM1791 is therefore inhibition of Metastasis-associated 1-like 1 (MTA1L1, Accession NM_004739), a gene which regulates histone deacetylase core complex enzymatic activity. Accordingly, utilities of VGAM1791 include diagnosis, prevention and treatment of diseases and clinical conditions associated with MTA1L1. The function of MTA1L1 and its association with various diseases and clinical conditions, has been established by previous studies, as described hereinabove with reference to VGAM659. Promyelocytic Leukemia (PML, Accession NM_033240) is another VGAM1791 host target gene. PML BINDING SITE1 and PML BINDING SITE2 are HOST TARGET binding sites found in untranslated regions of mRNA encoded by PML, corresponding to HOST TARGET binding sites such as BINDING SITE I, BINDING SITE II or BINDING SITE III. Table 2 illustrates the complementarity of the nucleotide sequences of PML BINDING SITE1 and PML BINDING SITE2, designated SEQ ID:27079 and SEQ ID:27083 respectively, to the nucleotide sequence of VGAM1791 RNA, herein designated VGAM RNA, also designated SEQ ID:4502.

Another function of VGAM1791 is therefore inhibition of Promyelocytic Leukemia (PML, Accession NM_033240). Accordingly, utilities of VGAM1791 include diagnosis, prevention and treatment of diseases and clinical conditions associated with PML. Chromosome 20 Open Reading Frame 112 (C20orf112, Accession NM_080616) is another VGAM1791 host target gene. C20orf112 BINDING SITE is HOST TARGET binding site found in the 3' untranslated region of mRNA encoded by C20orf112, corresponding to a HOST TARGET binding site such as BINDING SITE I, BINDING SITE II or BINDING SITE III. Table 2 illustrates the complementarity of the nucleotide sequences of C20orf112 BINDING SITE, designated SEQ ID:27931, to the nucleotide sequence of VGAM1791 RNA, herein designated VGAM RNA, also designated SEQ ID:4502.

Another function of VGAM1791 is therefore inhibition of Chromosome 20 Open Reading Frame 112 (C20orf112, Accession NM_080616). Accordingly, utilities of VGAM1791 include diagnosis, prevention and treatment of diseases and clinical conditions associated with C20orf112. FLJ12488 (Accession NM_031218) is another VGAM1791 host target gene. FLJ12488 BINDING SITE is HOST TARGET binding site found in the 3' untranslated region of mRNA encoded by FLJ12488, corresponding to a HOST TARGET binding site such as BINDING SITE I, BINDING SITE II or BINDING SITE III. Table 2 illustrates the complementarity of the nucleotide sequences of FLJ12488 BINDING SITE, designated SEQ ID:25264, to the nucleotide sequence of VGAM1791 RNA, herein designated VGAM RNA, also designated SEQ ID:4502.

Another function of VGAM1791 is therefore inhibition of FLJ12488 (Accession NM_031218). Accordingly, utilities of VGAM1791 include diagnosis, prevention and treatment of diseases and clinical conditions associated with FLJ12488. FLJ23392 (Accession NM_024784) is another VGAM1791 host target gene. FLJ23392 BINDING SITE is HOST TARGET binding site found in the 3' untranslated region of mRNA encoded by FLJ23392, corresponding to a HOST TARGET binding site such as BINDING SITE I, BINDING SITE II or BINDING SITE III. Table 2 illustrates the complementarity of the nucleotide sequences of FLJ23392 BINDING SITE, designated SEQ ID:24159, to the nucleotide sequence of VGAM1791 RNA, herein designated VGAM RNA, also designated SEQ ID:4502.

Another function of VGAM1791 is therefore inhibition of FLJ23392 (Accession NM_024784). Accordingly, utilities of VGAM1791 include diagnosis, prevention and treatment of diseases and clinical conditions associated with FLJ23392. KIAA0153 (Accession NM_015140) is another VGAM1791 host target gene. KIAA0153 BINDING SITE is HOST TARGET binding site found in the 3' untranslated region of mRNA encoded by KIAA0153, corresponding to a HOST TARGET binding site such as BINDING SITE I, BINDING SITE II or BINDING SITE III. Table 2 illustrates the complementarity of the nucleotide sequences of KIAA0153 BINDING SITE, designated SEQ ID:17495, to the nucleotide sequence of VGAM1791 RNA, herein designated VGAM RNA, also designated SEQ ID:4502.

Another function of VGAM1791 is therefore inhibition of KIAA0153 (Accession NM_015140). Accordingly, utilities of VGAM1791 include diagnosis, prevention and treatment of diseases and clinical conditions associated with KIAA0153. KIAA0555 (Accession NM_014790) is another VGAM1791 host target gene. KIAA0555 BINDING SITE is HOST TARGET binding site found in the 3' untranslated region of mRNA encoded by KIAA0555, corresponding to a HOST TARGET binding site such as BINDING SITE I, BINDING SITE II or BINDING SITE III. Table 2 illustrates the complementarity of the nucleotide sequences of KIAA0555 BINDING SITE, designated SEQ ID:16678, to the nucleotide sequence of VGAM1791 RNA, herein designated VGAM RNA, also designated SEQ ID:4502.

Another function of VGAM1791 is therefore inhibition of KIAA0555 (Accession NM_014790). Accordingly, utilities of VGAM1791 include diagnosis, prevention and treatment of diseases and clinical conditions associated with KIAA0555. KIAA1204 (Accession XM_045011) is another VGAM1791 host target gene. KIAA1204 BINDING SITE is HOST TARGET binding site found in the 5' untranslated region of mRNA encoded by KIAA1204, corresponding to a HOST TARGET binding site such as BINDING SITE I, BINDING SITE II or BINDING SITE III. Table 2 illustrates the complementarity of the nucleotide sequences of KIAA1204 BINDING SITE, designated SEQ ID:34313, to the nucleotide sequence of VGAM1791 RNA, herein designated VGAM RNA, also designated SEQ ID:4502.

Another function of VGAM1791 is therefore inhibition of KIAA1204 (Accession XM_045011). Accordingly, utilities of VGAM1791 include diagnosis, prevention and treatment of diseases and clinical conditions associated with KIAA1204. KIAA1755 (Accession XM_028810) is another VGAM1791 host target gene. KIAA1755 BINDING SITE is HOST TARGET binding site found in the 3' untranslated region of mRNA encoded by KIAA1755, corresponding to a HOST TARGET binding site such as BINDING SITE I, BINDING SITE II or BINDING SITE III. Table 2 illustrates the complementarity of the nucleotide sequences of KIAA1755 BINDING SITE, designated SEQ ID:30746, to the nucleotide sequence of VGAM1791 RNA, herein designated VGAM RNA, also designated SEQ ID:4502.

Another function of VGAM1791 is therefore inhibition of KIAA1755 (Accession XM_028810). Accordingly, utilities of VGAM1791 include diagnosis, prevention and treatment of diseases and clinical conditions associated with KIAA1755. KIAA1908 (Accession XM_055834) is another VGAM1791 host target gene. KIAA1908 BINDING SITE is HOST TARGET binding site found in the 5' untranslated region of mRNA encoded by KIAA1908, corresponding to a HOST TARGET binding site such as BINDING SITE I, BINDING SITE II or BINDING SITE III. Table 2 illustrates the complementarity of the nucleotide sequences of KIAA1908 BINDING SITE, designated SEQ ID:36330, to the nucleotide sequence of VGAM1791 RNA, herein designated VGAM RNA, also designated SEQ ID:4502.

Another function of VGAM1791 is therefore inhibition of KIAA1908 (Accession XM_055834). Accordingly, utilities of VGAM1791 include diagnosis, prevention and treatment of diseases and clinical conditions associated with KIAA1908. Myosin, Heavy Polypeptide 10, Non-muscle (MYH10, Accession XM_044702) is another VGAM1791 host target gene. MYH10 BINDING SITE is HOST TARGET binding site found in the 3' untranslated region of mRNA encoded by MYH10, corresponding to a HOST TARGET binding site such as BINDING SITE I, BINDING SITE II or BINDING SITE III. Table 2 illustrates the complementarity of the nucleotide sequences of MYH10 BINDING SITE, designated SEQ ID:34264, to the nucleotide sequence of VGAM1791 RNA, herein designated VGAM RNA, also designated SEQ ID:4502.

Another function of VGAM1791 is therefore inhibition of Myosin, Heavy Polypeptide 10, Non-muscle (MYH10, Accession XM_044702). Accordingly, utilities of VGAM1791 include diagnosis, prevention and treatment of diseases and clinical conditions associated with MYH10. TOLLIP (Accession NM_019009) is another VGAM1791 host target gene. TOLLIP BINDING SITE is HOST TARGET binding site found in the 3' untranslated region of mRNA encoded by TOLLIP, corresponding to a HOST TARGET binding site such as BINDING SITE I, BINDING SITE II or BINDING SITE III. Table 2 illustrates the complementarity of the nucleotide sequences of TOLLIP BINDING SITE, designated SEQ ID:21090, to the nucleotide sequence of VGAM1791 RNA, herein designated VGAM RNA, also designated SEQ ID:4502.

Another function of VGAM1791 is therefore inhibition of TOLLIP (Accession NM_019009). Accordingly, utilities of VGAM1791 include diagnosis, prevention and treatment of diseases and clinical conditions associated with TOLLIP. LOC143451 (Accession XM_084521) is another VGAM1791 host target gene. LOC143451 BINDING SITE is HOST TARGET binding site found in the 3' untranslated region of mRNA encoded by LOC143451, corresponding to a HOST TARGET binding site such as BINDING SITE I, BINDING SITE II or BINDING SITE III. Table 2 illustrates the complementarity of the nucleotide sequences of LOC143451 BINDING SITE, designated SEQ ID:37620, to the nucleotide sequence of VGAM1791 RNA, herein designated VGAM RNA, also designated SEQ ID:4502.

Another function of VGAM1791 is therefore inhibition of LOC143451 (Accession XM_084521). Accordingly, utilities of VGAM1791 include diagnosis, prevention and treatment of diseases and clinical conditions associated with LOC143451. LOC145125 (Accession XM_085025) is another VGAM1791 host target gene. LOC145125 BINDING SITE is HOST TARGET binding site found in the 3' untranslated region of mRNA encoded by LOC145125, corresponding to a HOST TARGET binding site such as BINDING SITE I, BINDING SITE II or BINDING SITE III. Table 2 illustrates the complementarity of the nucleotide sequences of LOC145125 BINDING SITE, designated SEQ ID:37797, to the nucleotide sequence of VGAM1791 RNA, herein designated VGAM RNA, also designated SEQ ID:4502.

Another function of VGAM1791 is therefore inhibition of LOC145125 (Accession XM_085025). Accordingly, utilities of VGAM1791 include diagnosis, prevention and treatment of diseases and clinical conditions associated with LOC145125. LOC147495 (Accession XM_097240) is another VGAM1791 host target gene. LOC147495 BINDING SITE is HOST TARGET binding site found in the 5' untranslated region of mRNA encoded by LOC147495, corresponding to a HOST TARGET binding site such as BINDING SITE I, BINDING SITE II or BINDING SITE III. Table 2 illustrates the complementarity of the nucleotide sequences of LOC147495 BINDING SITE, designated SEQ ID:40839, to the nucleotide sequence of VGAM1791 RNA, herein designated VGAM RNA, also designated SEQ ID:4502.

Another function of VGAM1791 is therefore inhibition of LOC147495 (Accession XM_097240). Accordingly, utilities of VGAM1791 include diagnosis, prevention and treatment of diseases and clinical conditions associated with LOC147495. LOC158158 (Accession XM_088494) is another VGAM1791 host target gene. LOC158158 BINDING SITE is HOST TARGET binding site found in the 5' untranslated region of mRNA encoded by LOC158158, corresponding to a HOST TARGET binding site such as BINDING SITE I, BINDING SITE II or BINDING SITE III. Table 2 illustrates the complementarity of the nucleotide sequences of LOC158158 BINDING SITE, designated SEQ ID:39733, to the nucleotide sequence of VGAM1791 RNA, herein designated VGAM RNA, also designated SEQ ID:4502.

Another function of VGAM1791 is therefore inhibition of LOC158158 (Accession XM_088494). Accordingly, utilities of VGAM1791 include diagnosis, prevention and treatment of diseases and clinical conditions associated with LOC158158. LOC254440 (Accession XM_173126) is another VGAM1791 host target gene. LOC254440 BINDING SITE is HOST TARGET binding site found in the 3' untranslated region of mRNA encoded by LOC254440, corresponding to a HOST TARGET binding site such as BINDING SITE I, BINDING SITE II or BINDING SITE III. Table 2 illustrates the complementarity of the nucleotide sequences of LOC254440 BINDING SITE, designated SEQ ID:46374, to the nucleotide sequence of VGAM1791 RNA, herein designated VGAM RNA, also designated SEQ ID:4502.

Another function of VGAM1791 is therefore inhibition of LOC254440 (Accession XM_173126). Accordingly, utilities of VGAM1791 include diagnosis, prevention and treatment of diseases and clinical conditions associated with LOC254440. LOC256310 (Accession XM_172813) is another VGAM1791 host target gene. LOC256310 BINDING SITE is HOST TARGET binding site found in the 5' untranslated region of mRNA encoded by LOC256310, corresponding to a HOST TARGET binding site such as BINDING SITE I, BINDING SITE II or BINDING SITE III. Table 2 illustrates the complementarity of the nucleotide sequences of LOC256310 BINDING SITE, designated SEQ ID:46092, to the nucleotide sequence of VGAM1791 RNA, herein designated VGAM RNA, also designated SEQ ID:4502.

Another function of VGAM1791 is therefore inhibition of LOC256310 (Accession XM_172813). Accordingly, utilities of VGAM1791 include diagnosis, prevention and treatment of diseases and clinical conditions associated with LOC256310. LOC93356 (Accession XM_050744) is another VGAM1791 host target gene. LOC93356 BINDING SITE is HOST TARGET binding site found in the 5' untranslated region of mRNA encoded by LOC93356, corresponding to a HOST TARGET binding site such as BINDING SITE I, BINDING SITE II or BINDING SITE III. Table 2 illustrates the complementarity of the nucleotide sequences of LOC93356 BINDING SITE, designated SEQ ID:35671, to the nucleotide sequence of VGAM1791 RNA, herein designated VGAM RNA, also designated SEQ ID:4502.

Another function of VGAM1791 is therefore inhibition of LOC93356 (Accession XM_050744). Accordingly, utilities of VGAM1791 include diagnosis, prevention and treatment of diseases and clinical conditions associated with LOC93356. LOC93496 (Accession XM_051698) is another VGAM1791 host target gene. LOC93496 BINDING SITE is HOST TARGET binding site found in the 3' untranslated region of mRNA encoded by LOC93496, corresponding to a HOST TARGET binding site such as BINDING SITE I, BINDING SITE II or BINDING SITE III. Table 2 illustrates the complementarity of the nucleotide sequences of LOC93496 BINDING SITE, designated SEQ ID:35865, to the nucleotide sequence of VGAM1791 RNA, herein designated VGAM RNA, also designated SEQ ID:4502.

Another function of VGAM1791 is therefore inhibition of LOC93496 (Accession XM_051698). Accordingly, utilities of VGAM1791 include diagnosis, prevention and treatment of diseases and clinical conditions associated with LOC93496. FIG. 1 further provides a conceptual description of a novel bioinformatically detected viral gene of the present invention, referred to here as Viral Genomic Address Messenger 1792 (VGAM1792) viral gene, which modulates expression of respective host target genes thereof, the function and utility of which host target genes is known in the art.

VGAM1792 is a novel bioinformatically detected regulatory, non protein coding, viral micro RNA (miRNA) gene. The method by which VGAM1792 was detected is described hereinabove with reference to FIGS. 1-8.

VGAM1792 gene, herein designated VGAM GENE, is a viral gene contained in the genome of Rana Tigrina Ranavirus. VGAM1792 host target gene, herein designated VGAM HOST TARGET GENE, is a human gene contained in the human genome.

VGAM1792 gene encodes a VGAM1792 precursor RNA, herein designated VGAM PRECURSOR RNA. Similar to other miRNA genes, and unlike most ordinary genes, VGAM1792 precursor RNA does not encode a protein. A nucleotide sequence identical or highly similar to the nucleotide sequence of VGAM1792 precursor RNA is designated SEQ ID:1778, and is provided hereinbelow with reference to the sequence listing part. Nucleotide sequence SEQ ID:1778 is located at position 75405 relative to the genome of Rana Tigrina Ranavirus.

VGAM1792 precursor RNA folds onto itself, forming VGAM1792 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1792 folded precursor RNA into VGAM1792 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM1792 RNA is designated SEQ ID:4503, and is provided hereinbelow with reference to the sequence listing part.

VGAM1792 host target gene, herein designated VGAM HOST TARGET GENE, encodes a corresponding messenger RNA, VGAM1792 host target RNA, herein designated VGAM HOST TARGET RNA. VGAM1792 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1792 RNA, herein designated VGAM RNA, binds complementarily to one or more host target binding sites located in untranslated regions of VGAM1792 host target RNA, herein designated VGAM HOST TARGET RNA. This complementary binding is due to the fact that the nucleotide sequence of VGAM1792 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1792 RNA, herein designated VGAM RNA, may have a different number of host target binding sites in untranslated regions of a VGAM1792 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1792 RNA, herein designated VGAM RNA, to host target binding sites on VGAM1792 host target RNA, herein designated VGAM HOST TARGET RNA, such as BINDING SITE I, BINDING SITE II and BINDING SITE III, inhibits translation of VGAM1792 host target RNA into VGAM1792 host target protein, herein designated VGAM HOST TARGET PROTEIN. VGAM host target protein is therefore outlined by a broken line.

It is appreciated that VGAM1792 host target gene, herein designated VGAM HOST TARGET GENE, in fact represents a plurality of VGAM1792 host target genes. The mRNA of each one of this plurality of VGAM1792 host target genes comprises one or more host target binding sites, each having a nucleotide sequence which is at least partly complementary to VGAM1792 RNA, herein designated VGAM RNA, and which when bound by VGAM1792 RNA causes inhibition of translation of respective one or more VGAM1792 host target proteins.

It is further appreciated by one skilled in the art that the mode of translational inhibition illustrated by FIG. 1 with specific reference to translational inhibition exerted by VGAM1792 gene, herein designated VGAM GENE, on one or more VGAM1792 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1792 is inhibition of expression of host target genes, as part of a novel viral mechanism of attacking a host. Accordingly, utilities of VGAM1792 include diagnosis, prevention and treatment of viral infection by Rana Tigrina Ranavirus. Specific functions, and accordingly utilities, of VGAM1792 correlate with, and may be deduced from, the identity of the host target genes which VGAM1792 binds and inhibits, and the function of these host target genes, as elaborated hereinbelow.

Nucleotide sequences of the VGAM1792 precursor RNA, herein designated VGAM PRECURSOR RNA, and of the 'diced' VGAM1792 RNA, herein designated VGAM RNA, and a schematic representation of the secondary folding of VGAM1792 folded precursor RNA, herein designated VGAM FOLDED PRECURSOR RNA, of VGAM1792 are further described hereinbelow with reference to Table 1.

Nucleotide sequences of host target binding sites, such as BINDING SITE-I, BINDING SITE-II and BINDING SITE-III of FIG. 1, found on VGAM1792 host target RNA, and schematic representation of the complementarity of each of these host target binding sites to VGAM1792 RNA, herein designated VGAM RNA, are described hereinbelow with reference to Table 2.

As mentioned hereinabove with reference to FIG. 1, a function of VGAM1792 gene, herein designated VGAM is inhibition of expression of VGAM1792 target genes. It is appreciated that specific functions, and accordingly utilities, of VGAM1792 correlate with, and may be deduced from, the identity of the target genes which VGAM1792 binds and inhibits, and the function of these target genes, as elaborated hereinbelow.

Myosin, Heavy Polypeptide 11, Smooth Muscle (MYH11, Accession NM_002474) is a VGAM1792 host target gene. MYH11 BINDING SITE1 and MYH11 BINDING SITE2 are HOST TARGET binding sites found in untranslated regions of mRNA encoded by MYH11, corresponding to HOST TARGET binding sites such as BINDING SITE I, BINDING SITE II or BINDING SITE III. Table 2 illustrates the complementarity of the nucleotide sequences of MYH11 BINDING SITE1 and MYH11 BINDING SITE2, designated SEQ ID:8300 and SEQ ID:23142 respectively, to the nucleotide sequence of VGAM1792 RNA, herein designated VGAM RNA, also designated SEQ ID:4503.

A function of VGAM1792 is therefore inhibition of Myosin, Heavy Polypeptide 11, Smooth Muscle (MYH11, Accession NM_002474), a gene which is involved in muscle contraction. Accordingly, utilities of VGAM1792 include diagnosis, prevention and treatment of diseases and clinical conditions associated with MYH11. The function of MYH11 and its association with various diseases and clinical conditions, has been established by previous studies, as described hereinabove with reference to VGAM178. Calcium/calmodulin-dependent Protein Kinase Kinase 2, Beta (CAMKK2, Accession NM_006549) is another VGAM1792 host target gene. CAMKK2 BINDING SITE is HOST TARGET binding site found in the 3' untranslated region of mRNA encoded by CAMKK2, corresponding to a HOST TARGET binding site such as BINDING SITE I, BINDING SITE II or BINDING SITE III. Table 2 illustrates the complementarity of the nucleotide sequences of CAMKK2 BINDING SITE, designated SEQ ID:13316, to the nucleotide sequence of VGAM1792 RNA, herein designated VGAM RNA, also designated SEQ ID:4503.

Another function of VGAM1792 is therefore inhibition of Calcium/calmodulin-dependent Protein Kinase Kinase 2, Beta (CAMKK2, Accession NM_006549). Accordingly, utilities of VGAM1792 include diagnosis, prevention and treatment of diseases and clinical conditions associated with CAMKK2. FLJ32894 (Accession NM_144667) is another VGAM1792 host target gene. FLJ32894 BINDING SITE is HOST TARGET binding site found in the 3' untranslated region of mRNA encoded by FLJ32894, corresponding to a HOST TARGET binding site such as BINDING SITE I, BINDING SITE II or BINDING SITE III. Table 2 illustrates the complementarity of the nucleotide sequences of FLJ32894 BINDING SITE, designated SEQ ID:29485, to the nucleotide sequence of VGAM1792 RNA, herein designated VGAM RNA, also designated SEQ ID:4503.

Another function of VGAM1792 is therefore inhibition of FLJ32894 (Accession NM_144667). Accordingly, utilities of VGAM1792 include diagnosis, prevention and treatment of diseases and clinical conditions associated with FLJ32894. FIG. 1 further provides a conceptual description of a novel bioinformatically detected viral gene of the present invention, referred to here as Viral Genomic Address Messenger 1793 (VGAM1793) viral gene, which modulates expression of respective host target genes thereof, the function and utility of which host target genes is known in the art.

VGAM1793 is a novel bioinformatically detected regulatory, non protein coding, viral micro RNA (miRNA) gene. The method by which VGAM1793 was detected is described hereinabove with reference to FIGS. 1-8.

VGAM1793 gene, herein designated VGAM GENE, is a viral gene contained in the genome of Rana Tigrina Ranavirus. VGAM1793 host target gene, herein designated VGAM HOST TARGET GENE, is a human gene contained in the human genome.

VGAM1793 gene encodes a VGAM1793 precursor RNA, herein designated VGAM PRECURSOR RNA. Similar to other miRNA genes, and unlike most ordinary genes, VGAM1793 precursor RNA does not encode a protein. A nucleotide sequence identical or highly similar to the nucleotide sequence of VGAM1793 precursor RNA is designated SEQ ID:1779, and is provided hereinbelow with reference to the sequence listing part. Nucleotide sequence SEQ ID:1779 is located at position 85120 relative to the genome of Rana Tigrina Ranavirus.

VGAM1793 precursor RNA folds onto itself, forming VGAM1793 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1793 folded precursor RNA into VGAM1793 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1793 RNA is designated SEQ ID:4504, and is provided hereinbelow with reference to the sequence listing part.

VGAM1793 host target gene, herein designated VGAM HOST TARGET GENE, encodes a corresponding messenger RNA, VGAM1793 host target RNA, herein designated VGAM HOST TARGET RNA. VGAM1793 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1793 RNA, herein designated VGAM RNA, binds complementarily to one or more host target binding sites located in untranslated regions of VGAM1793 host target RNA, herein designated VGAM HOST TARGET RNA. This complementary binding is due to the fact that the nucleotide sequence of VGAM1793 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1793 RNA, herein designated VGAM RNA, may have a different number of host target binding sites in untranslated regions of a VGAM1793 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1793 RNA, herein designated VGAM RNA, to host target binding sites on VGAM1793 host target RNA, herein designated VGAM HOST TARGET RNA, such as BINDING SITE I, BINDING SITE II and BINDING SITE III, inhibits translation of VGAM1793 host target RNA into VGAM1793 host target protein, herein designated VGAM HOST TARGET PROTEIN. VGAM host target protein is therefore outlined by a broken line.

It is appreciated that VGAM1793 host target gene, herein designated VGAM HOST TARGET GENE, in fact represents a plurality of VGAM1793 host target genes. The mRNA of each one of this plurality of VGAM1793 host target genes comprises one or more host target binding sites, each having a nucleotide sequence which is at least partly complementary to VGAM1793 RNA, herein designated VGAM RNA, and which when bound by VGAM1793 RNA causes inhibition of translation of respective one or more VGAM1793 host target proteins.

It is further appreciated by one skilled in the art that the mode of translational inhibition illustrated by FIG. 1 with specific reference to translational inhibition exerted by VGAM1793 gene, herein designated VGAM GENE, on one or more VGAM1793 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1793 is inhibition of expression of host target genes, as part of a novel viral mechanism of attacking a host. Accordingly, utilities of VGAM1793 include diagnosis, prevention and treatment of viral infection by Rana Tigrina Ranavirus. Specific functions, and accordingly utilities, of VGAM1793 correlate with, and may be deduced from, the identity of the host target genes which VGAM1793 binds and inhibits, and the function of these host target genes, as elaborated hereinbelow.

Nucleotide sequences of the VGAM1793 precursor RNA, herein designated VGAM PRECURSOR RNA, and of the 'diced' VGAM1793 RNA, herein designated VGAM RNA, and a schematic representation of the secondary folding of VGAM1793 folded precursor RNA, herein designated VGAM FOLDED PRECURSOR RNA, of VGAM1793 are further described hereinbelow with reference to Table 1.

Nucleotide sequences of host target binding sites, such as BINDING SITE-I, BINDING SITE-II and BINDING SITE-III of FIG. 1, found on VGAM1793 host target RNA, and schematic representation of the complementarity of each of these host target binding sites to VGAM1793 RNA, herein designated VGAM RNA, are described hereinbelow with reference to Table 2.

As mentioned hereinabove with reference to FIG. 1, a function of VGAM1793 gene, herein designated VGAM is inhibition of expression of VGAM1793 target genes. It is appreciated that specific functions, and accordingly utilities, of VGAM1793 correlate with, and may be deduced from, the identity of the target genes which VGAM1793 binds and inhibits, and the function of these target genes, as elaborated hereinbelow.

Amphiregulin (schwannoma-derived growth factor) (AREG, Accession NM_001657) is a VGAM1793 host target gene. AREG BINDING SITE is HOST TARGET binding site found in the 5' untranslated region of mRNA encoded by AREG, corresponding to a HOST TARGET binding site such as BINDING SITE I, BINDING SITE II or BINDING SITE III. Table 2 illustrates the complementarity of the nucleotide sequences of AREG BINDING SITE, designated SEQ ID:7376, to the nucleotide sequence of VGAM1793 RNA, herein designated VGAM RNA, also designated SEQ ID:4504.

A function of VGAM1793 is therefore inhibition of Amphiregulin (schwannoma-derived growth factor) (AREG, Accession NM_001657), a gene which inhibits the growth of certain carcinoma cell lines but stimulates the growth of fibroblasts and epithelial cells. Accordingly, utilities of VGAM1793 include diagnosis, prevention and treatment of diseases and clinical conditions associated with AREG. The function of AREG has been established by previous studies. To identify new growth factors important to the development of the nervous system, Kimura et al. (1990) screened serum-free growth-conditioned media from many clonal cell lines for the presence of mitogens for CNS glial cells. A cell line secreting a potent glial mitogen was established from a schwannoma of the sciatic nerve. The cells of the tumor, named JS1 cells, were adapted to clonal culture and identified as Schwann cells. Schwann cells secrete an autocrine mitogen and human schwannoma extracts have mitogenic activity on glial cells. Kimura et al. (1990) reported the purification and characterization of the mitogenic molecule, designated schwannoma-derived growth factor (SDGF), from the growth-conditioned medium of the JS1 Schwann cell line. SDGF belongs to the epidermal growth factor family and is an autocrine growth factor as well as a mitogen for astrocytes, Schwann cells, and fibroblasts. Amphiregulin is a heparin-binding, heparin-inhibited member of the epidermal growth factor family and an autocrine growth factor for human keratinocytes. AREG expression is increased in psoriatic epidermis. To test the hypothesis that aberrant AREG expression is central to the development of psoriatic lesions, Cook et al. (1997) constructed a transgene encoding the human AREG gene driven by the promoter of human keratin 14 (OMIM Ref. No. 148066). They found that transgene integration and subsequent expression of AREG in basal keratinocytes correlated with a psoriasis-like skin phenotype. Afflicted mice demonstrated shortened life spans, prominent scaling and erythematous skin with alopecia, and occasional papillomatous epidermal growths. Histologic examination revealed extensive areas of marked hyperkeratosis with focal parakeratosis, acanthosis, dermal and epidermal lymphocytic and neutrophilic infiltration, and dilated blood vessels within the papillary dermis. The skin pathology was considered to be strikingly similar to psoriasis. The observations of Cook et al. (1997) linked the keratinocyte EGF receptor-ligand system to psoriatic inflammation and suggested that aberrant expression of AREG in the epidermis may represent a critical step in the development or propagation of psoriatic lesions.

Full details of the abovementioned studies are described in the following publications, the disclosure of which are hereby incorporated by reference:

Cook, P. W.; Piepkorn, M.; Clegg, C. H.; Plowman, G. D.; DeMay, J. M.; Brown, J. R.; Pittelkow, M. R.: Transgenic expression of the human amphiregulin gene induces a psoriasis-like phenotype. J. Clin. Invest. 100:2286-2294, 1997; and Kimura, H.; Fischer, W. H.; Schubert, D.: Structure, expression and function of a schwannoma-derived growth factor. Nature 348:257-260, 1990.

Further studies establishing the function and utilities of AREG are found in John Hopkins OMIM database record ID 104640, and in sited publications numbered 12266-12268, 26 and 12414-12415 listed in the bibliography section hereinbelow, which are also hereby incorporated by reference. Rho GTPase Activating Protein 6 (ARHGAP6, Accession NM_001174) is another VGAM1793 host target gene. ARHGAP6 BINDING SITE is HOST TARGET binding site found in the 5' untranslated region of mRNA encoded by ARHGAP6, corresponding to a HOST TARGET binding site such as BINDING SITE I, BINDING SITE II or BINDING SITE III. Table 2 illustrates the complementarity of the nucleotide sequences of ARHGAP6 BINDING SITE, designated SEQ ID:6843, to the nucleotide sequence of VGAM1793 RNA, herein designated VGAM RNA, also designated SEQ ID:4504.

Another function of VGAM1793 is therefore inhibition of Rho GTPase Activating Protein 6 (ARHGAP6, Accession NM_001174), a gene which activates the rho-type GTPases by converting them to an inactive GTP-bound state. Accordingly, utilities of VGAM1793 include diagnosis, prevention and treatment of diseases and clinical conditions associated with ARHGAP6. The function of ARHGAP6 and its association with various diseases and clinical conditions, has been established by previous studies, as described hereinabove with reference to VGAM55. Calmodulin 3 (phosphorylase kinase, delta) (CALM3, Accession NM_005184) is another VGAM1793 host target gene. CALM3 BINDING SITE is HOST TARGET binding site found in the 3' untranslated region of mRNA encoded by CALM3, corresponding to a HOST TARGET binding site such as BINDING SITE I, BINDING SITE II or BINDING SITE III. Table 2 illustrates the complementarity of the nucleotide sequences of CALM3 BINDING SITE, designated SEQ ID:11684, to the nucleotide sequence of VGAM1793 RNA, herein designated VGAM RNA, also designated SEQ ID:4504.

Another function of VGAM1793 is therefore inhibition of Calmodulin 3 (phosphorylase kinase, delta) (CALM3, Accession NM_005184), a gene which mediates the control of a large number of enzymes by ca (++). Accordingly, utilities of VGAM1793 include diagnosis, prevention and treatment of diseases and clinical conditions associated with CALM3. The function of CALM3 and its association with various diseases and clinical conditions, has been established by previous studies, as described hereinabove with reference to VGAM785. DnaJ (Hsp40) Homolog, Subfamily B, Member 9 (DNAJB9, Accession NM_012328) is another VGAM1793 host target gene. DNAJB9 BINDING SITE is HOST TARGET binding site found in the 5' untranslated region of mRNA encoded by DNAJB9, corresponding to a HOST TARGET binding site such as BINDING SITE I, BINDING SITE II or BINDING SITE III. Table 2 illustrates the complementarity of the nucleotide sequences of DNAJB9 BINDING SITE, designated SEQ ID:14718, to the nucleotide sequence of VGAM1793 RNA, herein designated VGAM RNA, also designated SEQ ID:4504.

Another function of VGAM1793 is therefore inhibition of DnaJ (Hsp40) Homolog, Subfamily B, Member 9 (DNAJB9, Accession NM_012328). Accordingly, utilities of VGAM1793 include diagnosis, prevention and treatment of diseases and clinical conditions associated with DNAJB9. EphA8 (EPHA8, Accession NM_020526) is another VGAM1793 host target gene. EPHA8 BINDING SITE is HOST TARGET binding site found in the 3' untranslated region of mRNA encoded by EPHA8, corresponding to a HOST TARGET binding site such as BINDING SITE I, BINDING SITE II or BINDING SITE III. Table 2 illustrates the complementarity of the nucleotide sequences of EPHA8 BINDING SITE, designated SEQ ID:21746, to the nucleotide sequence of VGAM1793 RNA, herein designated VGAM RNA, also designated SEQ ID:4504.

Another function of VGAM1793 is therefore inhibition of EphA8 (EPHA8, Accession NM_020526), a gene which Eph-related receptor tyrosine kinase A8. Accordingly, utilities of VGAM1793 include diagnosis, prevention and treatment of diseases and clinical conditions associated with EPHA8. The function of EPHA8 and its association with various diseases and clinical conditions, has been established by previous studies, as described hereinabove with reference to VGAM494. Ellis Van Creveld Syndrome (EVC, Accession NM_014556) is another VGAM1793 host target gene. EVC BINDING SITE is HOST TARGET binding site found in the 3' untranslated region of mRNA encoded by EVC, corresponding to a HOST TARGET binding site such as BINDING SITE I, BINDING SITE II or BINDING SITE III. Table 2 illustrates the complementarity of the nucleotide sequences of EVC BINDING SITE, designated SEQ ID:15882, to the nucleotide sequence of VGAM1793 RNA, herein designated VGAM RNA, also designated SEQ ID:4504.

Another function of VGAM1793 is therefore inhibition of Ellis Van Creveld Syndrome (EVC, Accession NM_014556). Accordingly, utilities of VGAM1793 include diagnosis, prevention and treatment of diseases and clinical conditions associated with EVC. Guanine Nucleotide Binding Protein (G protein), Alpha 15 (Gq class) (GNA15, Accession XM_009220) is another VGAM1793 host target gene. GNA15 BINDING SITE is HOST TARGET binding site found in the 5' untranslated region of mRNA encoded by GNA15, corresponding to a HOST TARGET binding site such as BINDING SITE I, BINDING SITE II or BINDING SITE III. Table 2 illustrates the complementarity of the nucleotide sequences of GNA15 BINDING SITE, designated SEQ ID:30103, to the nucleotide sequence of VGAM1793 RNA, herein designated VGAM RNA, also designated SEQ ID:4504.

Another function of VGAM1793 is therefore inhibition of Guanine Nucleotide Binding Protein (G protein), Alpha 15 (Gq class) (GNA15, Accession XM_009220). Accordingly, utilities of VGAM1793 include diagnosis, prevention and treatment of diseases and clinical conditions associated with GNA15. 5-hydroxytryptamine (serotonin) Receptor 1D (HTR1D, Accession NM_000864) is another VGAM1793 host target gene. HTR1D BINDING SITE is HOST TARGET binding site found in the 3' untranslated region of mRNA encoded by HTR1D, corresponding to a HOST TARGET binding site such as BINDING SITE I, BINDING SITE II or BINDING SITE III. Table 2 illustrates the complementarity of the nucleotide sequences of HTR1D BINDING SITE, designated SEQ ID:6530, to the nucleotide sequence of VGAM1793 RNA, herein designated VGAM RNA, also designated SEQ ID:4504.

Another function of VGAM1793 is therefore inhibition of 5-hydroxytryptamine (serotonin) Receptor 1D (HTR1D, Accession NM_000864), a gene which belongs to g-protein coupled receptor. Accordingly, utilities of VGAM1793 include diagnosis, prevention and treatment of diseases and clinical conditions associated with HTR1D. The function of HTR1D and its association with various diseases and clinical conditions, has been established by previous studies, as described hereinabove with reference to VGAM152. Immediate Early Response 3 (IER3, Accession NM_003897) is another VGAM1793 host target gene. IER3 BINDING SITE1 and IER3 BINDING SITE2 are HOST TARGET binding sites found in untranslated regions of mRNA encoded by IER3, corresponding to HOST TARGET binding sites such as BINDING SITE I, BINDING SITE II or BINDING SITE III. Table 2 illustrates the complementarity of the nucleotide sequences of IER3 BINDING SITE1 and IER3 BINDING SITE2, designated SEQ ID:9980 and SEQ ID:27400 respectively, to the nucleotide sequence of VGAM1793 RNA, herein designated VGAM RNA, also designated SEQ ID:4504.

Another function of VGAM1793 is therefore inhibition of Immediate Early Response 3 (IER3, Accession NM_003897), a gene which protects cells from apoptosis induced by FAS or TNFA. Accordingly, utilities of VGAM1793 include diagnosis, prevention and treatment of diseases and clinical conditions associated with IER3. The function of IER3 has been established by previous studies. Transcription factors of the nuclear factor-kappa-B/rel (NF-kappa-B) family (OMIM Ref. No. 164011) may be important in cell survival by regulating unidentified, anti-apoptotic genes. Charles et al. (1993) cloned gly96, a mouse immediate-early gene inducible by serum growth factors. Schafer et al. (1996) cloned the rat homolog, PRG1, which was induced in response to the pituitary adenylate cyclase-activating polypeptide (PACAP; 102980). Kondratyev et al. (1996) cloned the human immediate-early gene IEX1. The cDNA encodes 156-amino acid polypeptide containing a single predicted transmembrane domain. On Northern blots, they observed a 1.2-kb mRNA whose expression could be induced by ionizing radiation, 12-O-tetradecanoylphorbol-13-acetate (TPA), okadaic acid, and TNF-alpha (OMIM Ref. No. 191160); these agents are all activators of the protein kinase C (PKC; OMIM Ref. No. 176960) pathway. Pietzsch et al. (1997) cloned the same human gene, which they termed DIF2. The expression of the DIF2 mRNA is downregulated during differentiation of macrophages and upregulated by lipopolysaccharide (LPS) stimulation of monocytes. Northern blot analysis revealed that DIF2 is expressed most abundantly in monocytes, lymphocytes, and keratinocytes, and at a lesser level in several other human tissues and cell lines. Wu et al. (1998) described a gene that protects cells from apoptosis induced by FAS (OMIM Ref. No. 134637) or TNFA. The gene appeared to be the same as the immediate-early response gene IEX1 reported by Kondratyev et al. (1996), Charles et al. (1993), and Schafer et al. (1996), except that it had an in-frame insertion of 111 nucleotides at position 211 of the coding region of IEX1, and could encode a longer polypeptide with a 37-amino acid insertion relative to IEX1. The longer IEX1 (referred to as IEX1L; the original IEX1 was referred to as IEX1S) was found to be generated from IEX1 in the absence of RNA splicing as it contained the entire intron sequence of IEX1. The transcription of IEX1L induced by TNF was decreased in cells with defective NF-kappa-B activation, rendering them sensitive to TNF-induced apoptosis, which was abolished by transfection with IEX1L. In support, overexpression of antisense IEX1L partially blocked TNF-induced expression of IEX1L and sensitized normal cells to killing. This study demonstrated a key role of IEX1L in cellular resistance to TNF-induced apoptosis. Pietzsch et al. (1998) cloned the genomic DNA of the DIF2 gene. They found that the gene consists of 2 exons and a single small intron. The 5-prime flanking region of the gene contains binding sites for transcription factors including NF-kappa-B, CEBP (OMIM Ref. No. 116897), and SP1 (OMIM Ref. No. 189906). Pietzsch et al. (1998) used fluorescence in situ hybridization to map the IER3 gene to human chromosome 6p21.3.

Full details of the abovementioned studies are described in the following publications, the disclosure of which are hereby incorporated by reference:

Pietzsch, A.; Buchler, C.; Schmitz, G.: Genomic organization, promoter cloning, and chromosomal localization of the Dif-2 gene. Biochem. Biophys. Res. Commun. 245:651-657, 1998; and Wu, M. X.; Ao, Z.; Prasad, K. V. S.; Wu, R.; Schlossman, S. F.: IEX-1L, an apoptosis inhibitor involved in NF-kappa-B-mediated cell survival. Science 281:998-1001, 1998.

Further studies establishing the function and utilities of IER3 are found in John Hopkins OMIM database record ID 602996, and in sited publications numbered 5412-5417 listed in the bibliography section hereinbelow, which are also hereby incorporated by reference. Mucin 3B (MUC3B, Accession XM_168578) is another VGAM1793 host target gene. MUC3B BINDING SITE is HOST TARGET binding site found in the 5' untranslated region of mRNA encoded by MUC3B, corresponding to a HOST TARGET binding site such as BINDING SITE I, BINDING SITE II or BINDING SITE III. Table 2 illustrates the complementarity of the nucleotide sequences of MUC3B BINDING SITE, designated SEQ ID:45253, to the nucleotide sequence of VGAM1793 RNA, herein designated VGAM RNA, also designated SEQ ID:4504.

Another function of VGAM1793 is therefore inhibition of Mucin 3B (MUC3B, Accession XM_168578), a gene which provides a protective, lubricating barrier against particles and infectious agents at mucosal surfaces. Accordingly, utilities of VGAM1793 include diagnosis, prevention and treatment of diseases and clinical conditions associated with MUC3B. The function of MUC3B and its association with various diseases and clinical conditions, has been established by previous studies, as described hereinabove with reference to VGAM55. Myosin Light Chain Kinase 2, Skeletal Muscle (MYLK2, Accession NM_033118) is another VGAM1793 host target gene. MYLK2 BINDING SITE is HOST TARGET binding site found in the 3' untranslated region of mRNA encoded by MYLK2, corresponding to a HOST TARGET binding site such as BINDING SITE I, BINDING SITE II or BINDING SITE III. Table 2 illustrates the complementarity of the nucleotide sequences of MYLK2 BINDING SITE, designated SEQ ID:26966, to the nucleotide sequence of VGAM1793 RNA, herein designated VGAM RNA, also designated SEQ ID:4504.

Another function of VGAM1793 is therefore inhibition of Myosin Light Chain Kinase 2, Skeletal Muscle (MYLK2, Accession NM_033118). Accordingly, utilities of VGAM1793 include diagnosis, prevention and treatment of diseases and clinical conditions associated with MYLK2. Myogenin (myogenic factor 4) (MYOG, Accession XM_001688) is another VGAM1793 host target gene. MYOG BINDING SITE is HOST TARGET binding site found in the 3' untranslated region of mRNA encoded by MYOG, corresponding to a HOST TARGET binding site such as BINDING SITE I, BINDING SITE II or BINDING SITE III. Table 2 illustrates the complementarity of the nucleotide sequences of MYOG BINDING SITE, designated SEQ ID:29848, to the nucleotide sequence of VGAM1793 RNA, herein designated VGAM RNA, also designated SEQ ID:4504.

Another function of VGAM1793 is therefore inhibition of Myogenin (myogenic factor 4) (MYOG, Accession XM_001688), a gene which can induce myogenesis in a variety of cell types. Accordingly, utilities of VGAM1793 include diagnosis, prevention and treatment of diseases and clinical conditions associated with MYOG. The function of MYOG has been established by previous studies. Studies of the cloned MYF4 indicate limited sequence homology to MYOD1 and MYF5. Hybridization to DNA from a panel of somatic cell hybrids indicated that the MYF4 gene is located on human chromosome 1 (Braun et al., 1989). By in situ hybridization to human metaphase chromosomes and by segregation analysis in interspecific somatic cell hybrid panels, Olson et al. (1990) assigned the MYOG gene to 1q31-q41 and showed that the corresponding genes in the mouse (Myog) and Chinese hamster (MYOG) mapped to regions of syntenic homology on mouse chromosome 1 and Chinese hamster chromosome 5. Nonlinkage to MYOD1, MYF5, and MYF6 (OMIM Ref. No. 159991) was demonstrated. Animal model experiments lend further support to the function of MYOG. Myogenin is a muscle-specific transcription factor that can induce myogenesis in a variety of cell types in tissue culture. It is a member of the basic helix-loop-helix (bHLH) gene family. To test its role in vivo, Hasty et al. (1993) generated mice homozygous for a targeted mutation in the myogenin gene. These mice survived fetal development but died immediately after birth and showed a severe reduction of all skeletal muscle. Thus, myogenin-mutant mice differed from mice carrying mutations in genes for the related MYF5 (OMIM Ref. No. 159990) and MYF3 (MYOD1; 159970), which have no muscle defects. From these observations, Hasty et al. (1993) concluded that myogenin is essential for the development of functional skeletal muscle. Nabeshima et al. (1993) independently found similar results and arrived at similar conclusions from 'knockout' experiments in mice.

It is appreciated that the abovementioned animal model for MYOG is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hasty, P.; Bradley, A.; Morris, J. H.; Edmondson, D. G.; Venuti, J. M.; Olson, E. N.; Klein, W. H.: Muscle deficiency and neonatal death in mice with a targeted mutation in the myogenin gene. Nature 364:501-506, 1993; and Braun, T.; Grzeschik, K.-H.; Bober, E.; Arnold, H.-H.: The MYF genes, a group of human muscle determining factors, are localized on different human chromosomes. (Abstract) Cytogenet.

Further studies establishing the function and utilities of MYOG are found in John Hopkins OMIM database record ID 159980, and in sited publications numbered 168 and 11143-1688 listed in the bibliography section hereinbelow, which are also hereby incorporated by reference. Neuregulin 1 (NRG1, Accession NM_004495) is another VGAM1793 host target gene. NRG1 BINDING SITE1 through NRG1 BINDING SITE4 are HOST TARGET binding sites found in untranslated regions of mRNA encoded by NRG1, corresponding to HOST TARGET binding sites such as BINDING SITE I, BINDING SITE II or BINDING SITE III. Table 2 illustrates the complementarity of the nucleotide sequences of NRG1 BINDING SITE1 through NRG1 BINDING SITE4, designated SEQ ID:10834, SEQ ID:15137, SEQ ID:15138 and SEQ ID:15141 respectively, to the nucleotide sequence of VGAM1793 RNA, herein designated VGAM RNA, also designated SEQ ID:4504.

Another function of VGAM1793 is therefore inhibition of Neuregulin 1 (NRG1, Accession NM_004495), a gene which is essential for neuronal development. Accordingly, utilities of VGAM1793 include diagnosis, prevention and treatment of diseases and clinical conditions associated with NRG1. The function of NRG1 and its association with various diseases and clinical conditions, has been established by previous studies, as described hereinabove with reference to VGAM1259. Olfactomedin 1 (OLFM1, Accession NM_006334) is another VGAM1793 host target gene. OLFM1 BINDING SITE1 through OLFM1 BINDING SITE3 are HOST TARGET binding sites found in untranslated regions of mRNA encoded by OLFM1, corresponding to HOST TARGET binding sites such as BINDING SITE I, BINDING SITE II or BINDING SITE III. Table 2 illustrates the complementarity of the nucleotide sequences of OLFM1 BINDING SITE1 through OLFM1 BINDING SITE3, designated SEQ ID:13034, SEQ ID:27761 and SEQ ID:7497 respectively, to the nucleotide sequence of VGAM1793 RNA, herein designated VGAM RNA, also designated SEQ ID:4504.

Another function of VGAM1793 is therefore inhibition of Olfactomedin 1 (OLFM1, Accession NM_006334). Accordingly, utilities of VGAM1793 include diagnosis, prevention and treatment of diseases and clinical conditions associated with OLFM1. SNL (Accession NM_003088) is another VGAM1793 host target gene. SNL BINDING SITE is HOST TARGET binding site found in the 3' untranslated region of mRNA encoded by SNL, corresponding to a HOST TARGET binding site such as BINDING SITE I, BINDING SITE II or BINDING SITE III. Table 2 illustrates the complementarity of the nucleotide sequences of SNL BINDING SITE, designated SEQ ID:9060, to the nucleotide sequence of VGAM1793 RNA, herein designated VGAM RNA, also designated SEQ ID:4504.

Another function of VGAM1793 is therefore inhibition of SNL (Accession NM_003088), a gene which organizes filamentous actin into bundles with a minimum of 4.1:1 actin/fascin ratio. Accordingly, utilities of VGAM1793 include diagnosis, prevention and treatment of diseases and clinical conditions associated with SNL. The function of SNL and its association with various diseases and clinical conditions, has been established by previous studies, as described hereinabove with reference to VGAM675. APEG1 (Accession XM_050966) is another VGAM1793 host target gene. APEG1 BINDING SITE is HOST TARGET binding site found in the 3' untranslated region of mRNA encoded by APEG1, corresponding to a HOST TARGET binding site such as BINDING SITE I, BINDING SITE II or BINDING SITE III. Table 2 illustrates the complementarity of the nucleotide sequences of APEG1 BINDING SITE, designated SEQ ID:35693, to the nucleotide sequence of VGAM1793 RNA, herein designated VGAM RNA, also designated SEQ ID:4504.

Another function of VGAM1793 is therefore inhibition of APEG1 (Accession XM_050966). Accordingly, utilities of VGAM1793 include diagnosis, prevention and treatment of diseases and clinical conditions associated with APEG1. Cat Eye Syndrome Chromosome Region, Candidate 7 (CECR7, Accession XM_086803) is another VGAM1793 host target gene. CECR7 BINDING SITE is HOST TARGET binding site found in the 5' untranslated region of mRNA encoded by CECR7, corresponding to a HOST TARGET binding site such as BINDING SITE I, BINDING SITE II or BINDING SITE III. Table 2 illustrates the complementarity of the nucleotide sequences of CECR7 BINDING SITE, designated SEQ ID:38879, to the nucleotide sequence of VGAM1793 RNA, herein designated VGAM RNA, also designated SEQ ID:4504.

Another function of VGAM1793 is therefore inhibition of Cat Eye Syndrome Chromosome Region, Candidate 7 (CECR7, Accession XM_086803). Accordingly, utilities of VGAM1793 include diagnosis, prevention and treatment of diseases and clinical conditions associated with CECR7. Complexin 1 (CPLX1, Accession NM_006651) is another VGAM1793 host target gene. CPLX1 BINDING SITE is HOST TARGET binding site found in the 3' untranslated region of mRNA encoded by CPLX1, corresponding to a HOST TARGET binding site such as BINDING SITE I, BINDING SITE II or BINDING SITE III. Table 2 illustrates the complementarity of the nucleotide sequences of CPLX1 BINDING SITE, designated SEQ ID:13449, to the nucleotide sequence of VGAM1793 RNA, herein designated VGAM RNA, also designated SEQ ID:4504.

Another function of VGAM1793 is therefore inhibition of Complexin 1 (CPLX1, Accession NM_006651). Accordingly, utilities of VGAM1793 include diagnosis, prevention and treatment of diseases and clinical conditions associated with CPLX1. DKFZP434B205 (Accession XM_059966) is another VGAM1793 host target gene. DKFZP434B205 BINDING SITE is HOST TARGET binding site found in the 3' untranslated region of mRNA encoded by DKFZP434B205, corresponding to a HOST TARGET binding site such as BINDING SITE I, BINDING SITE II or BINDING SITE III. Table 2 illustrates the complementarity of the nucleotide sequences of DKFZP434B205 BINDING SITE, designated SEQ ID:37125, to the nucleotide sequence of VGAM1793 RNA, herein designated VGAM RNA, also designated SEQ ID:4504.

Another function of VGAM1793 is therefore inhibition of DKFZP434B205 (Accession XM_059966). Accordingly, utilities of VGAM1793 include diagnosis, prevention and treatment of diseases and clinical conditions associated with DKFZP434B205. DKFZP586J1624 (Accession NM_015537) is another VGAM1793 host target gene. DKFZP586J1624 BINDING SITE is HOST TARGET binding site found in the 3' untranslated region of mRNA encoded by DKFZP586J1624, corresponding to a HOST TARGET binding site such as BINDING SITE I, BINDING SITE II or BINDING SITE III. Table 2 illustrates the complementarity of the nucleotide sequences of DKFZP586J1624 BINDING SITE, designated SEQ ID:17799, to the nucleotide sequence of VGAM1793 RNA, herein designated VGAM RNA, also designated SEQ ID:4504.

Another function of VGAM1793 is therefore inhibition of DKFZP586J1624 (Accession NM_015537). Accordingly, utilities of VGAM1793 include diagnosis, prevention and treatment of diseases and clinical conditions associated with DKFZP586J1624. FLJ10342 (Accession NM_018064) is another VGAM1793 host target gene. FLJ10342 BINDING SITE is HOST TARGET binding site found in the 5' untranslated region of mRNA encoded by FLJ10342, corresponding to a HOST TARGET binding site such as BINDING SITE I, BINDING SITE II or BINDING SITE III. Table 2 illustrates the complementarity of the nucleotide sequences of FLJ10342 BINDING SITE, designated SEQ ID:19835, to the nucleotide sequence of VGAM1793 RNA, herein designated VGAM RNA, also designated SEQ ID:4504.

Another function of VGAM1793 is therefore inhibition of FLJ10342 (Accession NM_018064). Accordingly, utilities of VGAM1793 include diagnosis, prevention and treatment of diseases and clinical conditions associated with FLJ10342. FLJ10759 (Accession NM_018207) is another VGAM1793 host target gene. FLJ10759 BINDING SITE is HOST TARGET binding site found in the 5' untranslated region of mRNA encoded by FLJ10759, corresponding to a HOST TARGET binding site such as BINDING SITE I, BINDING SITE II or BINDING SITE III. Table 2 illustrates the complementarity of the nucleotide sequences of FLJ10759 BINDING SITE, designated SEQ ID:20101, to the nucleotide sequence of VGAM1793 RNA, herein designated VGAM RNA, also designated SEQ ID:4504.

Another function of VGAM1793 is therefore inhibition of FLJ10759 (Accession NM_018207). Accordingly, utilities of VGAM1793 include diagnosis, prevention and treatment of diseases and clinical conditions associated with FLJ10759. FLJ13052 (Accession NM_023018) is another VGAM1793 host target gene. FLJ13052 BINDING SITE is HOST TARGET binding site found in the 3' untranslated region of mRNA encoded by FLJ13052, corresponding to a HOST TARGET binding site such as BINDING SITE I, BINDING SITE II or BINDING SITE III. Table 2 illustrates the complementarity of the nucleotide sequences of FLJ13052 BINDING SITE, designated SEQ ID:23283, to the nucleotide sequence of VGAM1793 RNA, herein designated VGAM RNA, also designated SEQ ID:4504.

Another function of VGAM1793 is therefore inhibition of FLJ13052 (Accession NM_023018). Accordingly, utilities of VGAM1793 include diagnosis, prevention and treatment of diseases and clinical conditions associated with FLJ13052. FLJ23511 (Accession NM_032239) is another VGAM1793 host target gene. FLJ23511 BINDING SITE is HOST TARGET binding site found in the 5' untranslated region of mRNA encoded by FLJ23511, corresponding to a HOST TARGET binding site such as BINDING SITE I, BINDING SITE II or BINDING SITE III. Table 2 illustrates the complementarity of the nucleotide sequences of FLJ23511 BINDING SITE, designated SEQ ID:25967, to the nucleotide sequence of VGAM1793 RNA, herein designated VGAM RNA, also designated SEQ ID:4504.

Another function of VGAM1793 is therefore inhibition of FLJ23511 (Accession NM_032239). Accordingly, utilities of VGAM1793 include diagnosis, prevention and treatment of diseases and clinical conditions associated with FLJ23511. HSPC154 (Accession NM_014177) is another VGAM1793 host target gene. HSPC154 BINDING SITE is HOST TARGET binding site found in the 5' untranslated region of mRNA encoded by HSPC154, corresponding to a HOST TARGET binding site such as BINDING SITE I, BINDING SITE II or BINDING SITE III. Table 2 illustrates the complementarity of the nucleotide sequences of HSPC154 BINDING SITE, designated SEQ ID:15463, to the nucleotide sequence of VGAM1793 RNA, herein designated VGAM RNA, also designated SEQ ID:4504.

Another function of VGAM1793 is therefore inhibition of HSPC154 (Accession NM_014177). Accordingly, utilities of VGAM1793 include diagnosis, prevention and treatment of diseases and clinical conditions associated with HSPC154. HSU79274 (Accession NM_013300) is another VGAM1793 host target gene. HSU79274 BINDING SITE is HOST TARGET binding site found in the 5' untranslated region of mRNA encoded by HSU79274, corresponding to a HOST TARGET binding site such as BINDING SITE I, BINDING SITE II or BINDING SITE III. Table 2 illustrates the complementarity of the nucleotide sequences of HSU79274 BINDING SITE, designated SEQ ID:14959, to the nucleotide sequence of VGAM1793 RNA, herein designated VGAM RNA, also designated SEQ ID:4504.

Another function of VGAM1793 is therefore inhibition of HSU79274 (Accession NM_013300). Accordingly, utilities of VGAM1793 include diagnosis, prevention and treatment of diseases and clinical conditions associated with HSU79274. KIAA0217 (Accession XM_040265) is another VGAM1793 host target gene. KIAA0217 BINDING SITE is HOST TARGET binding site found in the 3' untranslated region of mRNA encoded by KIAA0217, corresponding to a HOST TARGET binding site such as BINDING SITE I, BINDING SITE II or BINDING SITE III. Table 2 illustrates the complementarity of the nucleotide sequences of KIAA0217 BINDING SITE, designated SEQ ID:33280, to the nucleotide sequence of VGAM1793 RNA, herein designated VGAM RNA, also designated SEQ ID:4504.

Another function of VGAM1793 is therefore inhibition of KIAA0217 (Accession XM_040265). Accordingly, utilities of VGAM1793 include diagnosis, prevention and treatment of diseases and clinical conditions associated with KIAA0217. KIAA0848 (Accession NM_014926) is another VGAM1793 host target gene. KIAA0848 BINDING SITE is HOST TARGET binding site found in the 3' untranslated region of mRNA encoded by KIAA0848, corresponding to a HOST TARGET binding site such as BINDING SITE I, BINDING SITE II or BINDING SITE III. Table 2 illustrates the complementarity of the nucleotide sequences of KIAA0848 BINDING SITE, designated SEQ ID:17214, to the nucleotide sequence of VGAM1793 RNA, herein designated VGAM RNA, also designated SEQ ID:4504.

Another function of VGAM1793 is therefore inhibition of KIAA0848 (Accession NM_014926). Accordingly, utilities of VGAM1793 include diagnosis, prevention and treatment of diseases and clinical conditions associated with KIAA0848. KIAA1467 (Accession XM_049605) is another VGAM1793 host target gene. KIAA1467 BINDING SITE is HOST TARGET binding site found in the 3' untranslated region of mRNA encoded by KIAA1467, corresponding to a HOST TARGET binding site such as BINDING SITE I, BINDING SITE II or BINDING SITE III. Table 2 illustrates the complementarity of the nucleotide sequences of KIAA1467 BINDING SITE, designated SEQ ID:35457, to the nucleotide sequence of VGAM1793 RNA, herein designated VGAM RNA, also designated SEQ ID:4504.

Another function of VGAM1793 is therefore inhibition of KIAA1467 (Accession XM_049605). Accordingly, utilities of VGAM1793 include diagnosis, prevention and treatment of diseases and clinical conditions associated with KIAA1467. KIAA1582 (Accession XM_037262) is another VGAM1793 host target gene. KIAA1582 BINDING SITE is HOST TARGET binding site found in the 5' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32587, to the nucleotide sequence of VGAM1793 RNA, herein designated VGAM RNA, also designated SEQ ID:4504.

Another function of VGAM1793 is therefore inhibition of KIAA1582 (Accession XM_037262). Accordingly, utilities of VGAM1793 include diagnosis, prevention and treatment of diseases and clinical conditions associated with KIAA1582. KIAA1784 (Accession XM_036660) is another VGAM1793 host target gene. KIAA1784 BINDING SITE is HOST TARGET binding site found in the 3' untranslated region of mRNA encoded by KIAA1784, corresponding to a HOST TARGET binding site such as BINDING SITE I, BINDING SITE II or BINDING SITE III. Table 2 illustrates the complementarity of the nucleotide sequences of KIAA1784 BINDING SITE, designated SEQ ID:32484, to the nucleotide sequence of VGAM1793 RNA, herein designated VGAM RNA, also designated SEQ ID:4504.

Another function of VGAM1793 is therefore inhibition of KIAA1784 (Accession XM_036660). Accordingly, utilities of VGAM1793 include diagnosis, prevention and treatment of diseases and clinical conditions associated with KIAA1784. KIAA1908 (Accession XM_055834) is another VGAM1793 host target gene. KIAA1908 BINDING SITE is HOST TARGET binding site found in the 3' untranslated region of mRNA encoded by KIAA1908, corresponding to a HOST TARGET binding site such as BINDING SITE I, BINDING SITE II or BINDING SITE III. Table 2 illustrates the complementarity of the nucleotide sequences of KIAA1908 BINDING SITE, designated SEQ ID:36333, to the nucleotide sequence of VGAM1793 RNA, herein designated VGAM RNA, also designated SEQ ID:4504.

Another function of VGAM1793 is therefore inhibition of KIAA1908 (Accession XM_055834). Accordingly, utilities of VGAM1793 include diagnosis, prevention and treatment of diseases and clinical conditions associated with KIAA1908. KLK15 (Accession NM_138563) is another VGAM1793 host target gene. KLK15 BINDING SITE1 and KLK15 BINDING SITE2 are HOST TARGET binding sites found in untranslated regions of mRNA encoded by KLK15, corresponding to HOST TARGET binding sites such as BINDING SITE I, BINDING SITE II or BINDING SITE III. Table 2 illustrates the complementarity of the nucleotide sequences of KLK15 BINDING SITE1 and KLK15 BINDING SITE2, designated SEQ ID:28863 and SEQ ID:23265 respectively, to the nucleotide sequence of VGAM1793 RNA, herein designated VGAM RNA, also designated SEQ ID:4504.

Another function of VGAM1793 is therefore inhibition of KLK15 (Accession NM_138563). Accordingly, utilities of VGAM1793 include diagnosis, prevention and treatment of diseases and clinical conditions associated with KLK15. MIG (Accession NM_002416) is another VGAM1793 host target gene. MIG BINDING SITE is HOST TARGET binding site found in the 3' untranslated region of mRNA encoded by MIG, corresponding to a HOST TARGET binding site such as BINDING SITE I, BINDING SITE II or BINDING SITE III. Table 2 illustrates the complementarity of the nucleotide sequences of MIG BINDING SITE, designated SEQ ID:8248, to the nucleotide sequence of VGAM1793 RNA, herein designated VGAM RNA, also designated SEQ ID:4504.

Another function of VGAM1793 is therefore inhibition of MIG (Accession NM_002416). Accordingly, utilities of VGAM1793 include diagnosis, prevention and treatment of diseases and clinical conditions associated with MIG. NEU4 (Accession NM_080741) is another VGAM1793 host target gene. NEU4 BINDING SITE is HOST TARGET binding site found in the 5' untranslated region of mRNA encoded by NEU4, corresponding to a HOST TARGET binding site such as BINDING SITE I, BINDING SITE II or BINDING SITE III. Table 2 illustrates the complementarity of the nucleotide sequences of NEU4 BINDING SITE, designated SEQ ID:28027, to the nucleotide sequence of VGAM1793 RNA, herein designated VGAM RNA, also designated SEQ ID:4504.

Another function of VGAM1793 is therefore inhibition of NEU4 (Accession NM_080741). Accordingly, utilities of VGAM1793 include diagnosis, prevention and treatment of diseases and clinical conditions associated with NEU4. Prostate Cancer Associated Protein 7 (PCANAP7, Accession XM_167803) is another VGAM1793 host target gene. PCANAP7 BINDING SITE is HOST TARGET binding site found in the 5' untranslated region of mRNA encoded by PCANAP7, corresponding to a HOST TARGET binding site such as BINDING SITE I, BINDING SITE II or BINDING SITE III. Table 2 illustrates the complementarity of the nucleotide sequences of PCANAP7 BINDING SITE, designated SEQ ID:44837, to the nucleotide sequence of VGAM1793 RNA, herein designated VGAM RNA, also designated SEQ ID:4504.

Another function of VGAM1793 is therefore inhibition of Prostate Cancer Associated Protein 7 (PCANAP7, Accession XM_167803). Accordingly, utilities of VGAM1793 include diagnosis, prevention and treatment of diseases and clinical conditions associated with PCANAP7. SAST (Accession XM_032034) is another VGAM1793 host target gene. SAST BINDING SITE is HOST TARGET binding site found in the 5' untranslated region of mRNA encoded by SAST, corresponding to a HOST TARGET binding site such as BINDING SITE I, BINDING SITE II or BINDING SITE III. Table 2 illustrates the complementarity of the nucleotide sequences of SAST BINDING SITE, designated SEQ ID:31543, to the nucleotide sequence of VGAM1793 RNA, herein designated VGAM RNA, also designated SEQ ID:4504.

Another function of VGAM1793 is therefore inhibition of SAST (Accession XM_032034). Accordingly, utilities of VGAM1793 include diagnosis, prevention and treatment of diseases and clinical conditions associated with SAST. Solute Carrier Family 26, Member 9 (SLC26A9, Accession NM_134325) is another VGAM1793 host target gene. SLC26A9 BINDING SITE1 and SLC26A9 BINDING SITE2 are HOST TARGET binding sites found in untranslated regions of mRNA encoded by SLC26A9, corresponding to HOST TARGET binding sites such as BINDING SITE I, BINDING SITE II or BINDING SITE III. Table 2 illustrates the complementarity of the nucleotide sequences of SLC26A9 BINDING SITE1 and SLC26A9 BINDING SITE2, designated SEQ ID:28631 and SEQ ID:27493 respectively, to the nucleotide sequence of VGAM1793 RNA, herein designated VGAM RNA, also designated SEQ ID:4504.

Another function of VGAM1793 is therefore inhibition of Solute Carrier Family 26, Member 9 (SLC26A9, Accession NM_134325). Accordingly, utilities of VGAM1793 include diagnosis, prevention and treatment of diseases and clinical conditions associated with SLC26A9. LOC118611 (Accession XM_061055) is another VGAM1793 host target gene. LOC118611 BINDING SITE is HOST TARGET binding site found in the 5' untranslated region of mRNA encoded by LOC118611, corresponding to a HOST TARGET binding site such as BINDING SITE I, BINDING SITE II or BINDING SITE III. Table 2 illustrates the complementarity of the nucleotide sequences of LOC118611 BINDING SITE, designated SEQ ID:37187, to the nucleotide sequence of VGAM1793 RNA, herein designated VGAM RNA, also designated SEQ ID:4504.

Another function of VGAM1793 is therefore inhibition of LOC118611 (Accession XM_061055). Accordingly, utilities of VGAM1793 include diagnosis, prevention and treatment of diseases and clinical conditions associated with LOC118611. LOC145989 (Accession XM_004815) is another VGAM1793 host target gene. LOC145989 BINDING SITE is HOST TARGET binding site found in the 3' untranslated region of mRNA encoded by LOC145989, corresponding to a HOST TARGET binding site such as BINDING SITE I, BINDING SITE II or BINDING SITE III. Table 2 illustrates the complementarity of the nucleotide sequences of LOC145989 BINDING SITE, designated SEQ ID:29950, to the nucleotide sequence of VGAM1793 RNA, herein designated VGAM RNA, also designated SEQ ID:4504.

Another function of VGAM1793 is therefore inhibition of LOC145989 (Accession XM_004815). Accordingly, utilities of VGAM1793 include diagnosis, prevention and treatment of diseases and clinical conditions associated with LOC145989. LOC148014 (Accession XM_085999) is another VGAM1793 host target gene. LOC148014 BINDING SITE is HOST TARGET binding site found in the 3' untranslated region of mRNA encoded by LOC148014, corresponding to a HOST TARGET binding site such as BINDING SITE I, BINDING SITE II or BINDING SITE III. Table 2 illustrates the complementarity of the nucleotide sequences of LOC148014 BINDING SITE, designated SEQ ID:38439, to the nucleotide sequence of VGAM1793 RNA, herein designated VGAM RNA, also designated SEQ ID:4504.

Another function of VGAM1793 is therefore inhibition of LOC148014 (Accession XM_085999). Accordingly, utilities of VGAM1793 include diagnosis, prevention and treatment of diseases and clinical conditions associated with LOC148014. LOC158435 (Accession NM_138497) is another VGAM1793 host target gene. LOC158435 BINDING SITE is HOST TARGET binding site found in the 3' untranslated region of mRNA encoded by LOC158435, corresponding to a HOST TARGET binding site such as BINDING SITE I, BINDING SITE II or BINDING SITE III. Table 2 illustrates the complementarity of the nucleotide sequences of LOC158435 BINDING SITE, designated SEQ ID:28846, to the nucleotide sequence of VGAM1793 RNA, herein designated VGAM RNA, also designated SEQ ID:4504.

Another function of VGAM1793 is therefore inhibition of LOC158435 (Accession NM_138497). Accordingly, utilities of VGAM1793 include diagnosis, prevention and treatment of diseases and clinical conditions associated with LOC158435. LOC158856 (Accession XM_098998) is another VGAM1793 host target gene. LOC158856 BINDING SITE is HOST TARGET binding site found in the 5' untranslated region of mRNA encoded by LOC158856, corresponding to a HOST TARGET binding site such as BINDING SITE I, BINDING SITE II or BINDING SITE III. Table 2 illustrates the complementarity of the nucleotide sequences of LOC158856 BINDING SITE, designated SEQ ID:42035, to the nucleotide sequence of VGAM1793 RNA, herein designated VGAM RNA, also designated SEQ ID:4504.

Another function of VGAM1793 is therefore inhibition of LOC158856 (Accession XM_098998). Accordingly, utilities of VGAM1793 include diagnosis, prevention and treatment of diseases and clinical conditions associated with LOC158856. LOC163833 (Accession XM_089174) is another VGAM1793 host target gene. LOC163833 BINDING SITE is HOST TARGET binding site found in the 5' untranslated region of mRNA encoded by LOC163833, corresponding to a HOST TARGET binding site such as BINDING SITE I, BINDING SITE II or BINDING SITE III. Table 2 illustrates the complementarity of the nucleotide sequences of LOC163833 BINDING SITE, designated SEQ ID:39968, to the nucleotide sequence of VGAM1793 RNA, herein designated VGAM RNA, also designated SEQ ID:4504.

Another function of VGAM1793 is therefore inhibition of LOC163833 (Accession XM_089174). Accordingly, utilities of VGAM1793 include diagnosis, prevention and treatment of diseases and clinical conditions associated with LOC163833. LOC168667 (Accession XM_166592) is another VGAM1793 host target gene. LOC168667 BINDING SITE is HOST TARGET binding site found in the 3' untranslated region of mRNA encoded by LOC168667, corresponding to a HOST TARGET binding site such as BINDING SITE I, BINDING SITE II or BINDING SITE III. Table 2 illustrates the complementarity of the nucleotide sequences of LOC168667 BINDING SITE, designated SEQ ID:44569, to the nucleotide sequence of VGAM1793 RNA, herein designated VGAM RNA, also designated SEQ ID:4504.

Another function of VGAM1793 is therefore inhibition of LOC168667 (Accession XM_166592). Accordingly, utilities of VGAM1793 include diagnosis, prevention and treatment of diseases and clinical conditions associated with LOC168667. LOC197319 (Accession XM_113862) is another VGAM1793 host target gene. LOC197319 BINDING SITE is HOST TARGET binding site found in the 3' untranslated region of mRNA encoded by LOC197319, corresponding to a HOST TARGET binding site such as BINDING SITE I, BINDING SITE II or BINDING SITE III. Table 2 illustrates the complementarity of the nucleotide sequences of LOC197319 BINDING SITE, designated SEQ ID:42477, to the nucleotide sequence of VGAM1793 RNA, herein designated VGAM RNA, also designated SEQ ID:4504.

Another function of VGAM1793 is therefore inhibition of LOC197319 (Accession XM_113862). Accordingly, utilities of VGAM1793 include diagnosis, prevention and treatment of diseases and clinical conditions associated with LOC197319. LOC202284 (Accession XM_117372) is another VGAM1793 host target gene. LOC202284 BINDING SITE is HOST TARGET binding site found in the 5' untranslated region of mRNA encoded by LOC202284, corresponding to a HOST TARGET binding site such as BINDING SITE I, BINDING SITE II or BINDING SITE III. Table 2 illustrates the complementarity of the nucleotide sequences of LOC202284 BINDING SITE, designated SEQ ID:43418, to the nucleotide sequence of VGAM1793 RNA, herein designated VGAM RNA, also designated SEQ ID:4504.

Another function of VGAM1793 is therefore inhibition of LOC202284 (Accession XM_117372). Accordingly, utilities of VGAM1793 include diagnosis, prevention and treatment of diseases and clinical conditions associated with LOC202284. LOC222183 (Accession XM_168436) is another VGAM1793 host target gene. LOC222183 BINDING SITE is HOST TARGET binding site found in the 5' untranslated region of mRNA encoded by LOC222183, corresponding to a HOST TARGET binding site such as BINDING SITE I, BINDING SITE II or BINDING SITE III. Table 2 illustrates the complementarity of the nucleotide sequences of LOC222183 BINDING SITE, designated SEQ ID:45184, to the nucleotide sequence of VGAM1793 RNA, herein designated VGAM RNA, also designated SEQ ID:4504.

Another function of VGAM1793 is therefore inhibition of LOC222183 (Accession XM_168436). Accordingly, utilities of VGAM1793 include diagnosis, prevention and treatment of diseases and clinical conditions associated with LOC222183. LOC90120 (Accession XM_029168) is another VGAM1793 host target gene. LOC90120 BINDING SITE is HOST TARGET binding site found in the 5' untranslated region of mRNA encoded by LOC90120, corresponding to a HOST TARGET binding site such as BINDING SITE I, BINDING SITE II or BINDING SITE III. Table 2 illustrates the complementarity of the nucleotide sequences of LOC90120 BINDING SITE, designated SEQ ID:30852, to the nucleotide sequence of VGAM1793 RNA, herein designated VGAM RNA, also designated SEQ ID:4504.

Another function of VGAM1793 is therefore inhibition of LOC90120 (Accession XM_029168). Accordingly, utilities of VGAM1793 include diagnosis, prevention and treatment of diseases and clinical conditions associated with LOC90120. LOC90499 (Accession XM_032170) is another VGAM1793 host target gene. LOC90499 BINDING SITE is HOST TARGET binding site found in the 3' untranslated region of mRNA encoded by LOC90499, corresponding to a HOST TARGET binding site such as BINDING SITE I, BINDING SITE II or BINDING SITE III. Table 2 illustrates the complementarity of the nucleotide sequences of LOC90499 BINDING SITE, designated SEQ ID:31584, to the nucleotide sequence of VGAM1793 RNA, herein designated VGAM RNA, also designated SEQ ID:4504.

Another function of VGAM1793 is therefore inhibition of LOC90499 (Accession XM_032170). Accordingly, utilities of VGAM1793 include diagnosis, prevention and treatment of diseases and clinical conditions associated with LOC90499. LOC96652 (Accession XM_037474) is another VGAM1793 host target gene. LOC96652 BINDING SITE is HOST TARGET binding site found in the 3' untranslated region of mRNA encoded by LOC96652, corresponding to a HOST TARGET binding site such as BINDING SITE I, BINDING SITE II or BINDING SITE III. Table 2 illustrates the complementarity of the nucleotide sequences of LOC96652 BINDING SITE, designated SEQ ID:32627, to the nucleotide sequence of VGAM1793 RNA, herein designated VGAM RNA, also designated SEQ ID:4504.

Another function of VGAM1793 is therefore inhibition of LOC96652 (Accession XM_037474). Accordingly, utilities of VGAM1793 include diagnosis, prevention and treatment of diseases and clinical conditions associated with LOC96652. FIG. 1 further provides a conceptual description of a novel bioinformatically detected viral gene of the present invention, referred to here as Viral Genomic Address Messenger 1794 (VGAM1794) viral gene, which modulates expression of respective host target genes thereof, the function and utility of which host target genes is known in the art.

VGAM1794 is a novel bioinformatically detected regulatory, non protein coding, viral micro RNA (miRNA) gene. The method by which VGAM1794 was detected is described hereinabove with reference to FIGS. 1-8.

VGAM1794 gene, herein designated VGAM GENE, is a viral gene contained in the genome of Rana Tigrina Ranavirus. VGAM1794 host target gene, herein designated VGAM HOST TARGET GENE, is a human gene contained in the human genome.

VGAM1794 gene encodes a VGAM1794 precursor RNA, herein designated VGAM PRECURSOR RNA. Similar to other miRNA genes, and unlike most ordinary genes, VGAM1794 precursor RNA does not encode a protein. A nucleotide sequence identical or highly similar to the nucleotide sequence of VGAM1794 precursor RNA is designated SEQ ID:1780, and is provided hereinbelow with reference to the sequence listing part. Nucleotide sequence SEQ ID:1780 is located at position 84588 relative to the genome of Rana Tigrina Ranavirus.

VGAM1794 precursor RNA folds onto itself, forming VGAM1794 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1794 folded precursor RNA into VGAM1794 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1794 RNA is designated SEQ ID:4505, and is provided hereinbelow with reference to the sequence listing part.

VGAM1794 host target gene, herein designated VGAM HOST TARGET GENE, encodes a corresponding messenger RNA, VGAM1794 host target RNA, herein designated VGAM HOST TARGET RNA. VGAM1794 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1794 RNA, herein designated VGAM RNA, binds complementarily to one or more host target binding sites located in untranslated regions of VGAM1794 host target RNA, herein designated VGAM HOST TARGET RNA. This complementary binding is due to the fact that the nucleotide sequence of VGAM1794 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1794 RNA, herein designated VGAM RNA, may have a different number of host target binding sites in untranslated regions of a VGAM1794 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1794 RNA, herein designated VGAM RNA, to host target binding sites on VGAM1794 host target RNA, herein designated VGAM HOST TARGET RNA, such as BINDING SITE I, BINDING SITE II and BINDING SITE III, inhibits translation of VGAM1794 host target RNA into VGAM1794 host target protein, herein designated VGAM HOST TARGET PROTEIN. VGAM host target protein is therefore outlined by a broken line.

It is appreciated that VGAM1794 host target gene, herein designated VGAM HOST TARGET GENE, in fact represents a plurality of VGAM1794 host target genes. The mRNA of each one of this plurality of VGAM1794 host target genes comprises one or more host target binding sites, each having a nucleotide sequence which is at least partly complementary to VGAM1794 RNA, herein designated VGAM RNA, and which when bound by VGAM1794 RNA causes inhibition of translation of respective one or more VGAM1794 host target proteins.

It is further appreciated by one skilled in the art that the mode of translational inhibition illustrated by FIG. 1 with specific reference to translational inhibition exerted by VGAM1794 gene, herein designated VGAM GENE, on one or more VGAM1794 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1794 is inhibition of expression of host target genes, as part of a novel viral mechanism of attacking a host. Accordingly, utilities of VGAM1794 include diagnosis, prevention and treatment of viral infection by Rana Tigrina Ranavirus. Specific functions, and accordingly utilities, of VGAM1794 correlate with, and may be deduced from, the identity of the host target genes which VGAM1794 binds and inhibits, and the function of these host target genes, as elaborated hereinbelow.

Nucleotide sequences of the VGAM1794 precursor RNA, herein designated VGAM PRECURSOR RNA, and of the 'diced' VGAM1794 RNA, herein designated VGAM RNA, and a schematic representation of the secondary folding of VGAM1794 folded precursor RNA, herein designated VGAM FOLDED PRECURSOR RNA, of VGAM1794 are further described hereinbelow with reference to Table 1.

Nucleotide sequences of host target binding sites, such as BINDING SITE-I, BINDING SITE-II and BINDING SITE-III of FIG. 1, found on VGAM1794 host target RNA, and schematic representation of the complementarity of each of these host target binding sites to VGAM1794 RNA, herein designated VGAM RNA, are described hereinbelow with reference to Table 2.

As mentioned hereinabove with reference to FIG. 1, a function of VGAM1794 gene, herein designated VGAM is inhibition of expression of VGAM1794 target genes. It is appreciated that specific functions, and accordingly utilities, of VGAM1794 correlate with, and may be deduced from, the identity of the target genes which VGAM1794 binds and inhibits, and the function of these target genes, as elaborated hereinbelow.

Alkaline Phosphatase, Intestinal (ALPI, Accession NM_001631) is a VGAM1794 host target gene. ALPI BINDING SITE is HOST TARGET binding site found in the 3' untranslated region of mRNA encoded by ALPI, corresponding to a HOST TARGET binding site such as BINDING SITE I, BINDING SITE II or BINDING SITE III. Table 2 illustrates the complementarity of the nucleotide sequences of ALPI BINDING SITE, designated SEQ ID:7343, to the nucleotide sequence of VGAM1794 RNA, herein designated VGAM RNA, also designated SEQ ID:4505.

A function of VGAM1794 is therefore inhibition of Alkaline Phosphatase, Intestinal (ALPI, Accession NM_001631), a gene which is a glycoprotein phosphatase. Accordingly, utilities of VGAM1794 include diagnosis, prevention and treatment of diseases and clinical conditions associated with ALPI. The function of ALPI and its association with various diseases and clinical conditions, has been established by previous studies, as described hereinabove with reference to VGAM885. Alkaline Phosphatase, Placental (Regan isozyme) (ALPP, Accession XM_044131) is another VGAM1794 host target gene. ALPP BINDING SITE is HOST TARGET binding site found in the 3' untranslated region of mRNA encoded by ALPP, corresponding to a HOST TARGET binding site such as BINDING SITE I, BINDING SITE II or BINDING SITE III. Table 2 illustrates the complementarity of the nucleotide sequences of ALPP BINDING SITE, designated SEQ ID:34138, to the nucleotide sequence of VGAM1794 RNA, herein designated VGAM RNA, also designated SEQ ID:4505.

Another function of VGAM1794 is therefore inhibition of Alkaline Phosphatase, Placental (Regan isozyme) (ALPP, Accession XM_044131), a gene which is a placental alkaline phosphatase. Accordingly, utilities of VGAM1794 include diagnosis, prevention and treatment of diseases and clinical conditions associated with ALPP. The function of ALPP has been established by previous studies. Boyer (1961, 1963) described an electrophoretic variant of alkaline phosphatase (orthophosphoric monoester phosphohydrolase, alkaline optimum; EC 3.1.3.1), which appears in the serum during pregnancy in some women, and demonstrated its origin in the placenta. Since the human placenta is largely fetal in origin, the polymorphism may be a characteristic determined by the fetal genotype. Historically, this was the first described example of a polymorphic placental protein. Robson and Harris (1965) studied the genetics. Beckman et al. (1967) found a rare phenotype, absence of placental alkaline phosphatase, in twins and suggested that these twins might be homozygous for a 'silent allele' ('null allele'). The twins were also concordant for Crouzon craniofacial dysostosis (OMIM Ref. No. 123500), raising the question of a causal relationship. Palmarino et al. (1979) found evidence for at least 11 different mutant alleles at the placental alkaline phosphatase locus. Garattini et al. (1985) demonstrated 'appreciable amounts' of placental alkaline phosphatase in extracts of liver and intestine. Kam et al. (1985) cloned placental alkaline phosphatase cDNA, sequenced it, and mapped the gene by direct spot-blot hybridization to the DNA of chromosomes resolved by dual laser chromosome sorting. A strong signal was obtained with chromosome 2. With longer exposure, a weaker signal appeared also on chromosome 17. They speculated that PLAP-related gene (s) may be located there. Human testis and thymus contain small amounts of an ALP closely resembling, but not identical to, placental ALP. This ALP has been referred to as placentallike ALP or the Nagao isoenzyme (Henthorn et al., 1987); see 171810. Millan and Stigbrand (1983) maintained that placentallike ALP was probably the product of a separate locus. Martin et al. (1987) used a cDNA probe in Southern blot analysis of somatic cell hybrid DNA and in situ hybridization to locate PLAP to 2q37. Martin et al. (1987) described a RFLP of the PLAP gene. Griffin et al. (1987) mapped both the placental and the intestinal alkaline phosphatase genes to 2q34-q37 by chromosomal in situ hybridization and hybridization to the DNA of somatic cell hybrids. By in situ hybridization, Raimondi et al. (1988) assigned the ALPP gene to 2q37. Knoll et al. (1988) concluded that 3 closely related alkaline phosphatase genes reside on the long arm of chromosome 2 in man. One of these genes (PLAP; the placental ALP-1, in their symbology) encodes the classic heat-stabile placental alkaline phosphatase; a second (which they referred to as placental ALP-2) is closely related to the first, and may encode the so-called placental ALP-like enzyme of the testis and thymus; the third member of this gene family, the intestinal ALP gene, encodes intestinal alkaline phosphatase (OMIM Ref. No. 171740). The expression of the intestinal and placental genes is highly tissue-specific in spite of nearly 90% sequence similarity within their exons. Knoll et al. (1988) compared the placental alkaline phosphatase gene with the placentallike gene.

Full details of the abovementioned studies are described in the following publications, the disclosure of which are hereby incorporated by reference:

Beckman, L.; Beckman, G.; Christodoulou, C.; Ifekwunigwe, A.: Variations in human placental alkaline phosphatase. Acta Genet. Statist. Med. 17:406-412, 1967; and Knoll, B. J.; Rothblum, K. N.; Longley, M.: Nucleotide sequence of the human placental alkaline phosphatase gene: evolution of the 5-prime flanking region by deletion/substitution. J.

Further studies establishing the function and utilities of ALPP are found in John Hopkins OMIM database record ID 171800, and in sited publications numbered 3253-3256, 3499, 3503-3507, 2498, 3508, 3509-351 and 3780 listed in the bibliography section hereinbelow, which are also hereby incorporated by reference. Mannosidase, Alpha, Class 2A, Member 2 (MAN2A2, Accession NM_006122) is another VGAM1794 host target gene. MAN2A2 BINDING SITE is HOST TARGET binding site found in the 3' untranslated region of mRNA encoded by MAN2A2, corresponding to a HOST TARGET binding site such as BINDING SITE I, BINDING SITE II or BINDING SITE III. Table 2 illustrates the complementarity of the nucleotide sequences of MAN2A2 BINDING SITE, designated SEQ ID:12765, to the nucleotide sequence of VGAM1794 RNA, herein designated VGAM RNA, also designated SEQ ID:4505.

Another function of VGAM1794 is therefore inhibition of Mannosidase, Alpha, Class 2A, Member 2 (MAN2A2, Accession NM_006122), a gene which is an enzyme involved in the processing of N-linked glycans. Accordingly, utilities of VGAM1794 include diagnosis, prevention and treatment of diseases and clinical conditions associated with MAN2A2. The function of MAN2A2 has been established by previous studies. Golgi alpha-mannosidase II (OMIM Ref. No. 154582) is an enzyme involved in the processing of N-linked glycans. Using a previously isolated murine cDNA clone as a probe, Misago et al. (1995) isolated cDNA clones encompassing the human MANA2 cDNA open reading frame. During the isolation of genomic clones, genes related to that encoding alpha-mannosidase II were isolated. One such gene was found to encode an isozyme, which they designated alpha-mannosidase II(x). A 5-kb cDNA clone of the MANA2X gene was then isolated from a human melanoma cDNA library. Comparison between the MANA2X and MANA2 cDNAs suggested that the cloned cDNA encodes a truncated polypeptide with 796 amino acid residues, while the product of the MANA2 gene consists of 1144 amino acid residues. However, further studies indicated that alternative splicing of the MANA2X transcript can result in an additional transcript encoding an 1139-amino acid polypeptide. Northern analysis showed transcription of MANA2X in various tissues, suggesting that it is a housekeeping gene. COS cells transfected with MANA2X cDNA containing the full-length open reading frame showed an increase in alpha-mannosidase activity. Animal model experiments lend further support to the function of MAN2A2. Akama et al. (2002) generated mice deficient for the Man2a2 gene, which encodes alpha-mannosidase-IIX, an enzyme that forms intermediate asparagine-linked carbohydrates (N-glycans). Male mice lacking Man2a2 are largely infertile. The Man2a2-null spermatogenic cells fail to adhere to Sertoli cells and are prematurely released from the testis to the epididymis. Akama et al. (2002) identified an N-glycan structure that plays a key role in germ cell-Sertoli cell adhesion and identified a specific carbohydrate that is required for spermatogenesis. This carbohydrate is designated 310.11 and is an N-acetylglucosamine-terminated tri-antennary and fucosylated N-glycan structure.

It is appreciated that the abovementioned animal model for MAN2A2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Misago, M.; Liao, Y.-F.; Kudo, S.; Eto, S.; Mattei, M.-G.; Moremen, K. W.; Fukuda, M. N.: Molecular cloning and expression of cDNAs encoding human alpha-mannosidase II and a previously unrecognized alpha-mannosidase II(X) isozyme. Proc. Nat. Acad. Sci. 92:11766-11770, 1995; and Akama, T. O.; Nakagawa, H.; Sugihara, K.; Narisawa, S.; Ohyama, C.; Nishimura, S.-I.; O'Brien, D. A.; Moremen, K. W.; Millan, J. L.; Fukuda, M. N.: Germ cell survival through carbohydra.

Further studies establishing the function and utilities of MAN2A2 are found in John Hopkins OMIM database record ID 600988, and in sited publications numbered 716 and 11529 listed in the bibliography section hereinbelow, which are also hereby incorporated by reference. Parkinson Disease (autosomal recessive, juvenile) 2, Parkin (PARK2, Accession NM_013987) is another VGAM1794 host target gene. PARK2 BINDING SITE1 through PARK2 BINDING SITE3 are HOST TARGET binding sites found in untranslated regions of mRNA encoded by PARK2, corresponding to HOST TARGET binding sites such as BINDING SITE I, BINDING SITE II or BINDING SITE III. Table 2 illustrates the complementarity of the nucleotide sequences of PARK2 BINDING SITE1 through PARK2 BINDING SITE3, designated SEQ ID:15151, SEQ ID:15158 and SEQ ID:10904 respectively, to the nucleotide sequence of VGAM1794 RNA, herein designated VGAM RNA, also designated SEQ ID:4505.

Another function of VGAM1794 is therefore inhibition of Parkinson Disease (autosomal recessive, juvenile) 2, Parkin (PARK2, Accession NM_013987). Accordingly, utilities of VGAM1794 include diagnosis, prevention and treatment of diseases and clinical conditions associated with PARK2. FLJ10352 (Accession NM_032142) is another VGAM1794 host target gene. FLJ10352 BINDING SITE is HOST TARGET binding site found in the 3' untranslated region of mRNA encoded by FLJ10352, corresponding to a HOST TARGET binding site such as BINDING SITE I, BINDING SITE II or BINDING SITE III. Table 2 illustrates the complementarity of the nucleotide sequences of FLJ10352 BINDING SITE, designated SEQ ID:25824, to the nucleotide sequence of VGAM1794 RNA, herein designated VGAM RNA, also designated SEQ ID:4505.

Another function of VGAM1794 is therefore inhibition of FLJ10352 (Accession NM_032142). Accordingly, utilities of VGAM1794 include diagnosis, prevention and treatment of diseases and clinical conditions associated with FLJ10352. KIAA0935 (Accession XM_052620) is another VGAM1794 host target gene. KIAA0935 BINDING SITE is HOST TARGET binding site found in the 3' untranslated region of mRNA encoded by KIAA0935, corresponding to a HOST TARGET binding site such as BINDING SITE I, BINDING SITE II or BINDING SITE III. Table 2 illustrates the complementarity of the nucleotide sequences of KIAA0935 BINDING SITE, designated SEQ ID:36010, to the nucleotide sequence of VGAM1794 RNA, herein designated VGAM RNA, also designated SEQ ID:4505.

Another function of VGAM1794 is therefore inhibition of KIAA0935 (Accession XM_052620). Accordingly, utilities of VGAM1794 include diagnosis, prevention and treatment of diseases and clinical conditions associated with KIAA0935. KIAA1061 (Accession XM_048786) is another VGAM1794 host target gene. KIAA1061 BINDING SITE is HOST TARGET binding site found in the 3' untranslated region of mRNA encoded by KIAA1061, corresponding to a HOST TARGET binding site such as BINDING SITE I, BINDING SITE II or BINDING SITE III. Table 2 illustrates the complementarity of the nucleotide sequences of KIAA1061 BINDING SITE, designated SEQ ID:35265, to the nucleotide sequence of VGAM1794 RNA, herein designated VGAM RNA, also designated SEQ ID:4505.

Another function of VGAM1794 is therefore inhibition of KIAA1061 (Accession XM_048786). Accordingly, utilities of VGAM1794 include diagnosis, prevention and treatment of diseases and clinical conditions associated with KIAA1061. KIAA1750 (Accession XM_043067) is another VGAM1794 host target gene. KIAA1750 BINDING SITE is HOST TARGET binding site found in the 3' untranslated region of mRNA encoded by KIAA1750, corresponding to a HOST TARGET binding site such as BINDING SITE I, BINDING SITE II or BINDING SITE III. Table 2 illustrates the complementarity of the nucleotide sequences of KIAA1750 BINDING SITE, designated SEQ ID:33873, to the nucleotide sequence of VGAM1794 RNA, herein designated VGAM RNA, also designated SEQ ID:4505.

Another function of VGAM1794 is therefore inhibition of KIAA1750 (Accession XM_043067). Accordingly, utilities of VGAM1794 include diagnosis, prevention and treatment of diseases and clinical conditions associated with KIAA1750. KIAA1881 (Accession XM_170901) is another VGAM1794 host target gene. KIAA1881 BINDING SITE is HOST TARGET binding site found in the 3' untranslated region of mRNA encoded by KIAA1881, corresponding to a HOST TARGET binding site such as BINDING SITE I, BINDING SITE II or BINDING SITE III. Table 2 illustrates the complementarity of the nucleotide sequences of KIAA1881 BINDING SITE, designated SEQ ID:45654, to the nucleotide sequence of VGAM1794 RNA, herein designated VGAM RNA, also designated SEQ ID:4505.

Another function of VGAM1794 is therefore inhibition of KIAA1881 (Accession XM_170901). Accordingly, utilities of VGAM1794 include diagnosis, prevention and treatment of diseases and clinical conditions associated with KIAA1881. Mitogen-activated Protein Kinase-activated Protein Kinase 2 (MAPKAPK2, Accession NM_004759) is another VGAM1794 host target gene. MAPKAPK2 BINDING SITE is HOST TARGET binding site found in the 3' untranslated region of mRNA encoded by MAPKAPK2, corresponding to a HOST TARGET binding site such as BINDING SITE I, BINDING SITE II or BINDING SITE III. Table 2 illustrates the complementarity of the nucleotide sequences of MAPKAPK2 BINDING SITE, designated SEQ ID:11148, to the nucleotide sequence of VGAM1794 RNA, herein designated VGAM RNA, also designated SEQ ID:4505.

Another function of VGAM1794 is therefore inhibition of Mitogen-activated Protein Kinase-activated Protein Kinase 2 (MAPKAPK2, Accession NM_004759). Accordingly, utilities of VGAM1794 include diagnosis, prevention and treatment of diseases and clinical conditions associated with MAPKAPK2. Solute Carrier Family 39 (zinc transporter), Member 3 (SLC39A3, Accession NM_144564) is another VGAM1794 host target gene. SLC39A3 BINDING SITE1 and SLC39A3 BINDING SITE2 are HOST TARGET binding sites found in untranslated regions of mRNA encoded by SLC39A3, corresponding to HOST TARGET binding sites such as BINDING SITE I, BINDING SITE II or BINDING SITE III. Table 2 illustrates the complementarity of the nucleotide sequences of SLC39A3 BINDING SITE1 and SLC39A3 BINDING SITE2, designated SEQ ID:29354 and SEQ ID:29355 respectively, to the nucleotide sequence of VGAM1794 RNA, herein designated VGAM RNA, also designated SEQ ID:4505.

Another function of VGAM1794 is therefore inhibition of Solute Carrier Family 39 (zinc transporter), Member 3 (SLC39A3, Accession NM_144564). Accordingly, utilities of VGAM1794 include diagnosis, prevention and treatment of diseases and clinical conditions associated with SLC39A3. LOC51134 (Accession NM_016122) is another VGAM1794 host target gene. LOC51134 BINDING SITE is HOST TARGET binding site found in the 3' untranslated region of mRNA encoded by LOC51134, corresponding to a HOST TARGET binding site such as BINDING SITE I, BINDING SITE II or BINDING SITE III. Table 2 illustrates the complementarity of the nucleotide sequences of LOC51134 BINDING SITE, designated SEQ ID:18209, to the nucleotide sequence of VGAM1794 RNA, herein designated VGAM RNA, also designated SEQ ID:4505.

Another function of VGAM1794 is therefore inhibition of LOC51134 (Accession NM_016122). Accordingly, utilities of VGAM1794 include diagnosis, prevention and treatment of diseases and clinical conditions associated with LOC51134. FIG. 1 further provides a conceptual description of a novel bioinformatically detected viral gene of the present invention, referred to here as Viral Genomic Address Messenger 1795 (VGAM1795) viral gene, which modulates expression of respective host target genes thereof, the function and utility of which host target genes is known in the art.

VGAM1795 is a novel bioinformatically detected regulatory, non protein coding, viral micro RNA (miRNA) gene. The method by which VGAM1795 was detected is described hereinabove with reference to FIGS. 1-8.

VGAM1795 gene, herein designated VGAM GENE, is a viral gene contained in the genome of Rana Tigrina Ranavirus. VGAM1795 host target gene, herein designated VGAM HOST TARGET GENE, is a human gene contained in the human genome.

VGAM1795 gene encodes a VGAM1795 precursor RNA, herein designated VGAM PRECURSOR RNA. Similar to other miRNA genes, and unlike most ordinary genes, VGAM1795 precursor RNA does not encode a protein. A nucleotide sequence identical or highly similar to the nucleotide sequence of VGAM1795 precursor RNA is designated SEQ ID:1781, and is provided hereinbelow with reference to the sequence listing part. Nucleotide sequence SEQ ID:1781 is located at position 85710 relative to the genome of Rana Tigrina Ranavirus.

VGAM1795 precursor RNA folds onto itself, forming VGAM1795 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1795 folded precursor RNA into VGAM1795 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1795 RNA is designated SEQ ID:4506, and is provided hereinbelow with reference to the sequence listing part.

VGAM1795 host target gene, herein designated VGAM HOST TARGET GENE, encodes a corresponding messenger RNA, VGAM1795 host target RNA, herein designated VGAM HOST TARGET RNA. VGAM1795 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1795 RNA, herein designated VGAM RNA, binds complementarily to one or more host target binding sites located in untranslated regions of VGAM1795 host target RNA, herein designated VGAM HOST TARGET RNA. This complementary binding is due to the fact that the nucleotide sequence of VGAM1795 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1795 RNA, herein designated VGAM RNA, may have a different number of host target binding sites in untranslated regions of a VGAM1795 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1795 RNA, herein designated VGAM RNA, to host target binding sites on VGAM1795 host target RNA, herein designated VGAM HOST TARGET RNA, such as BINDING SITE I, BINDING SITE II and BINDING SITE III, inhibits translation of VGAM1795 host target RNA into VGAM1795 host target protein, herein designated VGAM HOST TARGET PROTEIN. VGAM host target protein is therefore outlined by a broken line.

It is appreciated that VGAM1795 host target gene, herein designated VGAM HOST TARGET GENE, in fact represents a plurality of VGAM1795 host target genes. The mRNA of each one of this plurality of VGAM1795 host target genes comprises one or more host target binding sites, each having a nucleotide sequence which is at least partly complementary to VGAM1795 RNA, herein designated VGAM RNA, and which when bound by VGAM1795 RNA causes inhibition of translation of respective one or more VGAM1795 host target proteins.

It is further appreciated by one skilled in the art that the mode of translational inhibition illustrated by FIG. 1 with specific reference to translational inhibition exerted by VGAM1795 gene, herein designated VGAM GENE, on one or more VGAM1795 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1795 is inhibition of expression of host target genes, as part of a novel viral mechanism of attacking a host. Accordingly, utilities of VGAM1795 include diagnosis, prevention and treatment of viral infection by Rana Tigrina Ranavirus. Specific functions, and accordingly utilities, of VGAM1795 correlate with, and may be deduced from, the identity of the host target genes which VGAM1795 binds and inhibits, and the function of these host target genes, as elaborated hereinbelow.

Nucleotide sequences of the VGAM1795 precursor RNA, herein designated VGAM PRECURSOR RNA, and of the 'diced' VGAM1795 RNA, herein designated VGAM RNA, and a schematic representation of the secondary folding of VGAM1795 folded precursor RNA, herein designated VGAM FOLDED PRECURSOR RNA, of VGAM1795 are further described hereinbelow with reference to Table 1.

Nucleotide sequences of host target binding sites, such as BINDING SITE-I, BINDING SITE-II and BINDING SITE-III of FIG. 1, found on VGAM1795 host target RNA, and schematic representation of the complementarity of each of these host target binding sites to VGAM1795 RNA, herein designated VGAM RNA, are described hereinbelow with reference to Table 2.

As mentioned hereinabove with reference to FIG. 1, a function of VGAM1795 gene, herein designated VGAM is inhibition of expression of VGAM1795 target genes. It is appreciated that specific functions, and accordingly utilities, of VGAM1795 correlate with, and may be deduced from, the identity of the target genes which VGAM1795 binds and inhibits, and the function of these target genes, as elaborated hereinbelow.

LOC157663 (Accession XM_088354) is a VGAM1795 host target gene. LOC157663 BINDING SITE is HOST TARGET binding site found in the 3' untranslated region of mRNA encoded by LOC157663, corresponding to a HOST TARGET binding site such as BINDING SITE I, BINDING SITE II or BINDING SITE III. Table 2 illustrates the complementarity of the nucleotide sequences of LOC157663 BINDING SITE, designated SEQ ID:39638, to the nucleotide sequence of VGAM1795 RNA, herein designated VGAM RNA, also designated SEQ ID:4506.

A function of VGAM1795 is therefore inhibition of LOC157663 (Accession XM_088354). Accordingly, utilities of VGAM1795 include diagnosis, prevention and treatment of diseases and clinical conditions associated with LOC157663. LOC254228 (Accession XM_171123) is another VGAM1795 host target gene. LOC254228 BINDING SITE is HOST TARGET binding site found in the 3' untranslated region of mRNA encoded by LOC254228, corresponding to a HOST TARGET binding site such as BINDING SITE I, BINDING SITE II or BINDING SITE III. Table 2 illustrates the complementarity of the nucleotide sequences of LOC254228 BINDING SITE, designated SEQ ID:45919, to the nucleotide sequence of VGAM1795 RNA, herein designated VGAM RNA, also designated SEQ ID:4506.

Another function of VGAM1795 is therefore inhibition of LOC254228 (Accession XM_171123). Accordingly, utilities of VGAM1795 include diagnosis, prevention and treatment of diseases and clinical conditions associated with LOC254228. FIG. 1 further provides a conceptual description of a novel bioinformatically detected viral gene of the present invention, referred to here as Viral Genomic Address Messenger 1796 (VGAM1796) viral gene, which modulates expression of respective host target genes thereof, the function and utility of which host target genes is known in the art.

VGAM1796 is a novel bioinformatically detected regulatory, non protein coding, viral micro RNA (miRNA) gene. The method by which VGAM1796 was detected is described hereinabove with reference to FIGS. 1-8.

VGAM1796 gene, herein designated VGAM GENE, is a viral gene contained in the genome of Rana Tigrina Ranavirus. VGAM1796 host target gene, herein designated VGAM HOST TARGET GENE, is a human gene contained in the human genome.

VGAM1796 gene encodes a VGAM1796 precursor RNA, herein designated VGAM PRECURSOR RNA. Similar to other miRNA genes, and unlike most ordinary genes, VGAM1796 precursor RNA does not encode a protein. A nucleotide sequence identical or highly similar to the nucleotide sequence of VGAM1796 precursor RNA is designated SEQ ID:1782, and is provided hereinbelow with reference to the sequence listing part. Nucleotide sequence SEQ ID:1782 is located at position 79650 relative to the genome of Rana Tigrina Ranavirus.

VGAM1796 precursor RNA folds onto itself, forming VGAM1796 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1796 folded precursor RNA into VGAM1796 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1796 RNA is designated SEQ ID:4507, and is provided hereinbelow with reference to the sequence listing part.

VGAM1796 host target gene, herein designated VGAM HOST TARGET GENE, encodes a corresponding messenger RNA, VGAM1796 host target RNA, herein designated VGAM HOST TARGET RNA. VGAM1796 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1796 RNA, herein designated VGAM RNA, binds complementarily to one or more host target binding sites located in untranslated regions of VGAM1796 host target RNA, herein designated VGAM HOST TARGET RNA. This complementary binding is due to the fact that the nucleotide sequence of VGAM1796 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1796 RNA, herein designated VGAM RNA, may have a different number of host target binding sites in untranslated regions of a VGAM1796 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1796 RNA, herein designated VGAM RNA, to host target binding sites on VGAM1796 host target RNA, herein designated VGAM HOST TARGET RNA, such as BINDING SITE I, BINDING SITE II and BINDING SITE III, inhibits translation of VGAM1796 host target RNA into VGAM1796 host target protein, herein designated VGAM HOST TARGET PROTEIN. VGAM host target protein is therefore outlined by a broken line.

It is appreciated that VGAM1796 host target gene, herein designated VGAM HOST TARGET GENE, in fact represents a plurality of VGAM1796 host target genes. The mRNA of each one of this plurality of VGAM1796 host target genes comprises one or more host target binding sites, each having a nucleotide sequence which is at least partly complementary to VGAM1796 RNA, herein designated VGAM RNA, and which when bound by VGAM1796 RNA causes inhibition of translation of respective one or more VGAM1796 host target proteins.

It is further appreciated by one skilled in the art that the mode of translational inhibition illustrated by FIG. 1 with specific reference to translational inhibition exerted by VGAM1796 gene, herein designated VGAM GENE, on one or more VGAM1796 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1796 is inhibition of expression of host target genes, as part of a novel viral mechanism of attacking a host. Accordingly, utilities of VGAM1796 include diagnosis, prevention and treatment of viral infection by Rana Tigrina Ranavirus. Specific functions, and accordingly utilities, of VGAM1796 correlate with, and may be deduced from, the identity of the host target genes which VGAM1796 binds and inhibits, and the function of these host target genes, as elaborated hereinbelow.

Nucleotide sequences of the VGAM1796 precursor RNA, herein designated VGAM PRECURSOR RNA, and of the 'diced' VGAM1796 RNA, herein designated VGAM RNA, and a schematic representation of the secondary folding of VGAM1796 folded precursor RNA, herein designated VGAM FOLDED PRECURSOR RNA, of VGAM1796 are further described hereinbelow with reference to Table 1.

Nucleotide sequences of host target binding sites, such as BINDING SITE-I, BINDING SITE-II and BINDING SITE-III of FIG. 1, found on VGAM1796 host target RNA, and schematic representation of the complementarity of each of these host target binding sites to VGAM1796 RNA, herein designated VGAM RNA, are described hereinbelow with reference to Table 2.

As mentioned hereinabove with reference to FIG. 1, a function of VGAM1796 gene, herein designated VGAM is inhibition of expression of VGAM1796 target genes. It is appreciated that specific functions, and accordingly utilities, of VGAM1796 correlate with, and may be deduced from, the identity of the target genes which VGAM1796 binds and inhibits, and the function of these target genes, as elaborated hereinbelow.

Chromosome 9 Open Reading Frame 9 (C9orf9, Accession NM_018956) is a VGAM1796 host target gene. C9orf9 BINDING SITE is HOST TARGET binding site found in the 3' untranslated region of mRNA encoded by C9orf9, corresponding to a HOST TARGET binding site such as BINDING SITE I, BINDING SITE II or BINDING SITE III. Table 2 illustrates the complementarity of the nucleotide sequences of C9orf9 BINDING SITE, designated SEQ ID:21027, to the nucleotide sequence of VGAM1796 RNA, herein designated VGAM RNA, also designated SEQ ID:4507.

A function of VGAM1796 is therefore inhibition of Chromosome 9 Open Reading Frame 9 (C9orf9, Accession NM_018956). Accordingly, utilities of VGAM1796 include diagnosis, prevention and treatment of diseases and clinical conditions associated with C9orf9. KIAA0472 (Accession XM_050147) is another VGAM1796 host target gene. KIAA0472 BINDING SITE is HOST TARGET binding site found in the 3' untranslated region of mRNA encoded by KIAA0472, corresponding to a HOST TARGET binding site such as BINDING SITE I, BINDING SITE II or BINDING SITE III. Table 2 illustrates the complementarity of the nucleotide sequences of KIAA0472 BINDING SITE, designated SEQ ID:35577, to the nucleotide sequence of VGAM1796 RNA, herein designated VGAM RNA, also designated SEQ ID:4507.

Another function of VGAM1796 is therefore inhibition of KIAA0472 (Accession XM_050147). Accordingly, utilities of VGAM1796 include diagnosis, prevention and treatment of diseases and clinical conditions associated with KIAA0472. LOC158402 (Accession XM_098936) is another VGAM1796 host target gene. LOC158402 BINDING SITE is HOST TARGET binding site found in the 5' untranslated region of mRNA encoded by LOC158402, corresponding to a HOST TARGET binding site such as BINDING SITE I, BINDING SITE II or BINDING SITE III. Table 2 illustrates the complementarity of the nucleotide sequences of LOC158402 BINDING SITE, designated SEQ ID:41975, to the nucleotide sequence of VGAM1796 RNA, herein designated VGAM RNA, also designated SEQ ID:4507.

Another function of VGAM1796 is therefore inhibition of LOC158402 (Accession XM_098936). Accordingly, utilities of VGAM1796 include diagnosis, prevention and treatment of diseases and clinical conditions associated with LOC158402. FIG. 1 further provides a conceptual description of a novel bioinformatically detected viral gene of the present invention, referred to here as Viral Genomic Address Messenger 1797 (VGAM1797) viral gene, which modulates expression of respective host target genes thereof, the function and utility of which host target genes is known in the art.

VGAM1797 is a novel bioinformatically detected regulatory, non protein coding, viral micro RNA (miRNA) gene. The method by which VGAM1797 was detected is described hereinabove with reference to FIGS. 1-8.

VGAM1797 gene, herein designated VGAM GENE, is a viral gene contained in the genome of Rana Tigrina Ranavirus. VGAM1797 host target gene, herein designated VGAM HOST TARGET GENE, is a human gene contained in the human genome.

VGAM1797 gene encodes a VGAM1797 precursor RNA, herein designated VGAM PRECURSOR RNA. Similar to other miRNA genes, and unlike most ordinary genes, VGAM1797 precursor RNA does not encode a protein. A nucleotide sequence identical or highly similar to the nucleotide sequence of VGAM1797 precursor RNA is designated SEQ ID:1783, and is provided hereinbelow with reference to the sequence listing part. Nucleotide sequence SEQ ID:1783 is located at position 82741 relative to the genome of Rana Tigrina Ranavirus.

VGAM1797 precursor RNA folds onto itself, forming VGAM1797 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1797 folded precursor RNA into VGAM1797 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM1797 RNA is designated SEQ ID:4508, and is provided hereinbelow with reference to the sequence listing part.

VGAM1797 host target gene, herein designated VGAM HOST TARGET GENE, encodes a corresponding messenger RNA, VGAM1797 host target RNA, herein designated VGAM HOST TARGET RNA. VGAM1797 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1797 RNA, herein designated VGAM RNA, binds complementarily to one or more host target binding sites located in untranslated regions of VGAM1797 host target RNA, herein designated VGAM HOST TARGET RNA. This complementary binding is due to the fact that the nucleotide sequence of VGAM1797 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1797 RNA, herein designated VGAM RNA, may have a different number of host target binding sites in untranslated regions of a VGAM1797 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1797 RNA, herein designated VGAM RNA, to host target binding sites on VGAM1797 host target RNA, herein designated VGAM HOST TARGET RNA, such as BINDING SITE I, BINDING SITE II and BINDING SITE III, inhibits translation of VGAM1797 host target RNA into VGAM1797 host target protein, herein designated VGAM HOST TARGET PROTEIN. VGAM host target protein is therefore outlined by a broken line.

It is appreciated that VGAM1797 host target gene, herein designated VGAM HOST TARGET GENE, in fact represents a plurality of VGAM1797 host target genes. The mRNA of each one of this plurality of VGAM1797 host target genes comprises one or more host target binding sites, each having a nucleotide sequence which is at least partly complementary to VGAM1797 RNA, herein designated VGAM RNA, and which when bound by VGAM1797 RNA causes inhibition of translation of respective one or more VGAM1797 host target proteins.

It is further appreciated by one skilled in the art that the mode of translational inhibition illustrated by FIG. 1 with specific reference to translational inhibition exerted by VGAM1797 gene, herein designated VGAM GENE, on one or more VGAM1797 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1797 is inhibition of expression of host target genes, as part of a novel viral mechanism of attacking a host. Accordingly, utilities of VGAM1797 include diagnosis, prevention and treatment of viral infection by Rana Tigrina Ranavirus. Specific functions, and accordingly utilities, of VGAM1797 correlate with, and may be deduced from, the identity of the host target genes which VGAM1797 binds and inhibits, and the function of these host target genes, as elaborated hereinbelow.

Nucleotide sequences of the VGAM1797 precursor RNA, herein designated VGAM PRECURSOR RNA, and of the 'diced' VGAM1797 RNA, herein designated VGAM RNA, and a schematic representation of the secondary folding of VGAM1797 folded precursor RNA, herein designated VGAM FOLDED PRECURSOR RNA, of VGAM1797 are further described hereinbelow with reference to Table 1.

Nucleotide sequences of host target binding sites, such as BINDING SITE-I, BINDING SITE-II and BINDING SITE-III of FIG. 1, found on VGAM1797 host target RNA, and schematic representation of the complementarity of each of these host target binding sites to VGAM1797 RNA, herein designated VGAM RNA, are described hereinbelow with reference to Table 2.

As mentioned hereinabove with reference to FIG. 1, a function of VGAM1797 gene, herein designated VGAM is inhibition of expression of VGAM1797 target genes. It is appreciated that specific functions, and accordingly utilities, of VGAM1797 correlate with, and may be deduced from, the identity of the target genes which VGAM1797 binds and inhibits, and the function of these target genes, as elaborated hereinbelow.

Ankyrin-like with Transmembrane Domains 1 (ANKTM1, Accession NM_007332) is a VGAM1797 host target gene. ANKTM1 BINDING SITE is HOST TARGET binding site found in the 3' untranslated region of mRNA encoded by ANKTM1, corresponding to a HOST TARGET binding site such as BINDING SITE I, BINDING SITE II or BINDING SITE III. Table 2 illustrates the complementarity of the nucleotide sequences of ANKTM1 BINDING SITE, designated SEQ ID:14258, to the nucleotide sequence of VGAM1797 RNA, herein designated VGAM RNA, also designated SEQ ID:4508.

A function of VGAM1797 is therefore inhibition of Ankyrin-like with Transmembrane Domains 1 (ANKTM1, Accession NM_007332), a gene which attaches integral membrane proteins to cytoskeletal elements. Accordingly, utilities of VGAM1797 include diagnosis, prevention and treatment of diseases and clinical conditions associated with ANKTM1. The function of ANKTM1 and its association with various diseases and clinical conditions, has been established by previous studies, as described hereinabove with reference to VGAM644. Copine III (CPNE3, Accession NM_003909) is another VGAM1797 host target gene. CPNE3 BINDING SITE is HOST TARGET binding site found in the 3' untranslated region of mRNA encoded by CPNE3, corresponding to a HOST TARGET binding site such as BINDING SITE I, BINDING SITE II or BINDING SITE III. Table 2 illustrates the complementarity of the nucleotide sequences of CPNE3 BINDING SITE, designated SEQ ID:9996, to the nucleotide sequence of VGAM1797 RNA, herein designated VGAM RNA, also designated SEQ ID:4508.

Another function of VGAM1797 is therefore inhibition of Copine III (CPNE3, Accession NM_003909), a gene which may function in membrane traffiking. Accordingly, utilities of VGAM1797 include diagnosis, prevention and treatment of diseases and clinical conditions associated with CPNE3. The function of CPNE3 and its association with various diseases and clinical conditions, has been established by previous studies, as described hereinabove with reference to VGAM28. Dual Specificity Phosphatase 5 (DUSP5, Accession NM_004419) is another VGAM1797 host target gene. DUSP5 BINDING SITE is HOST TARGET binding site found in the 3' untranslated region of mRNA encoded by DUSP5, corresponding to a HOST TARGET binding site such as BINDING SITE I, BINDING SITE II or BINDING SITE III. Table 2 illustrates the complementarity of the nucleotide sequences of DUSP5 BINDING SITE, designated SEQ ID:10684, to the nucleotide sequence of VGAM1797 RNA, herein designated VGAM RNA, also designated SEQ ID:4508.

Another function of VGAM1797 is therefore inhibition of Dual Specificity Phosphatase 5 (DUSP5, Accession NM_004419), a gene which displays phosphatase activity toward several substrates. Accordingly, utilities of VGAM1797 include diagnosis, prevention and treatment of diseases and clinical conditions associated with DUSP5. The function of DUSP5 and its association with various diseases and clinical conditions, has been established by previous studies, as described hereinabove with reference to VGAM538. Guanylate Cyclase 1, Soluble, Beta 2 (GUCY1B2, Accession NM_004129) is another VGAM1797 host target gene. GUCY1B2 BINDING SITE is HOST TARGET binding site found in the 5' untranslated region of mRNA encoded by GUCY1B2, corresponding to a HOST TARGET binding site such as BINDING SITE I, BINDING SITE II or BINDING SITE III. Table 2 illustrates the complementarity of the nucleotide sequences of GUCY1B2 BINDING SITE, designated SEQ ID:10336, to the nucleotide sequence of VGAM1797 RNA, herein designated VGAM RNA, also designated SEQ ID:4508.

Another function of VGAM1797 is therefore inhibition of Guanylate Cyclase 1, Soluble, Beta 2 (GUCY1B2, Accession NM_004129), a gene which is beta 2 subunit of soluble guanylate cyclase which converts GTP into the second messenger cGMP and plays a major role in the cardiovascular system as a receptor for nitric oxide. Accordingly, utilities of VGAM1797 include diagnosis, prevention and treatment of diseases and clinical conditions associated with GUCY1B2. The function of GUCY1B2 and its association with various diseases and clinical conditions, has been established by previous studies, as described hereinabove with reference to VGAM379. Neuralized-like (Drosophila) (NEURL, Accession NM_004210) is another VGAM1797 host target gene. NEURL BINDING SITE is HOST TARGET binding site found in the 3' untranslated region of mRNA encoded by NEURL, corresponding to a HOST TARGET binding site such as BINDING SITE I, BINDING SITE II or BINDING SITE III. Table 2 illustrates the complementarity of the nucleotide sequences of NEURL BINDING SITE, designated SEQ ID:10414, to the nucleotide sequence of VGAM1797 RNA, herein designated VGAM RNA, also designated SEQ ID:4508.

Another function of VGAM1797 is therefore inhibition of Neuralized-like (Drosophila) (NEURL, Accession NM_004210). Accordingly, utilities of VGAM1797 include diagnosis, prevention and treatment of diseases and clinical conditions associated with NEURL. RAB6A, Member RAS Oncogene Family (RAB6A, Accession NM_002869) is another VGAM1797 host target gene. RAB6A BINDING SITE is HOST TARGET binding site found in the 3' untranslated region of mRNA encoded by RAB6A, corresponding to a HOST TARGET binding site such as BINDING SITE I, BINDING SITE II or BINDING SITE III. Table 2 illustrates the complementarity of the nucleotide sequences of RAB6A BINDING SITE, designated SEQ ID:8778, to the nucleotide sequence of VGAM1797 RNA, herein designated VGAM RNA, also designated SEQ ID:4508.

Another function of VGAM1797 is therefore inhibition of RAB6A, Member RAS Oncogene Family (RAB6A, Accession NM_002869), a gene which is involved in protein trafficking. Accordingly, utilities of VGAM1797 include diagnosis, prevention and treatment of diseases and clinical conditions associated with RAB6A. The function of RAB6A and its association with various diseases and clinical conditions, has been established by previous studies, as described hereinabove with reference to VGAM217. Regulator of G-protein Signalling 5 (RGS5, Accession NM_003617) is another VGAM1797 host target gene. RGS5 BINDING SITE is HOST TARGET binding site found in the 3' untranslated region of mRNA encoded by RGS5, corresponding to a HOST TARGET binding site such as BINDING SITE I, BINDING SITE II or BINDING SITE III. Table 2 illustrates the complementarity of the nucleotide sequences of RGS5 BINDING SITE, designated SEQ ID:9679, to the nucleotide sequence of VGAM1797 RNA, herein designated VGAM RNA, also designated SEQ ID:4508.

Another function of VGAM1797 is therefore inhibition of Regulator of G-protein Signalling 5 (RGS5, Accession NM_003617). Accordingly, utilities of VGAM1797 include diagnosis, prevention and treatment of diseases and clinical conditions associated with RGS5. Synaptosomal-associated Protein, 23 kDa (SNAP23, Accession NM_003825) is another VGAM1797 host target gene. SNAP23 BINDING SITE1 and SNAP23 BINDING SITE2 are HOST TARGET binding sites found in untranslated regions of mRNA encoded by SNAP23, corresponding to HOST TARGET binding sites such as BINDING SITE I, BINDING SITE II or BINDING SITE III. Table 2 illustrates the complementarity of the nucleotide sequences of SNAP23 BINDING SITE1 and SNAP23 BINDING SITE2, designated SEQ ID:9921 and SEQ ID:28286 respectively, to the nucleotide sequence of VGAM1797 RNA, herein designated VGAM RNA, also designated SEQ ID:4508.

Another function of VGAM1797 is therefore inhibition of Synaptosomal-associated Protein, 23 kDa (SNAP23, Accession NM_003825), a gene which is essential component of the high affinity receptor for the general membrane fusion machinery. Accordingly, utilities of VGAM1797 include diagnosis, prevention and treatment of diseases and clinical conditions associated with SNAP23. The function of SNAP23 and its association with various diseases and clinical conditions, has been established by previous studies, as described hereinabove with reference to VGAM1533. Zinc Finger Protein 264 (ZNF264, Accession NM_003417) is another VGAM1797 host target gene. ZNF264 BINDING SITE is HOST TARGET binding site found in the 3' untranslated region of mRNA encoded by ZNF264, corresponding to a HOST TARGET binding site such as BINDING SITE I, BINDING SITE II or BINDING SITE III. Table 2 illustrates the complementarity of the nucleotide sequences of ZNF264 BINDING SITE, designated SEQ ID:9457, to the nucleotide sequence of VGAM1797 RNA, herein designated VGAM RNA, also designated SEQ ID:4508.

Another function of VGAM1797 is therefore inhibition of Zinc Finger Protein 264 (ZNF264, Accession NM_003417). Accordingly, utilities of VGAM1797 include diagnosis, prevention and treatment of diseases and clinical conditions associated with ZNF264. ARP1 Actin-related Protein 1 Homolog A, Centractin Alpha (yeast) (ACTR1A, Accession XM_031949) is another VGAM1797 host target gene. ACTR1A BINDING SITE is HOST TARGET binding site found in the 3' untranslated region of mRNA encoded by ACTR1A, corresponding to a HOST TARGET binding site such as BINDING SITE I, BINDING SITE II or BINDING SITE III. Table 2 illustrates the complementarity of the nucleotide sequences of ACTR1A BINDING SITE, designated SEQ ID:31531, to the nucleotide sequence of VGAM1797 RNA, herein designated VGAM RNA, also designated SEQ ID:4508.

Another function of VGAM1797 is therefore inhibition of ARP1 Actin-related Protein 1 Homolog A, Centractin Alpha (yeast) (ACTR1A, Accession XM_031949). Accordingly, utilities of VGAM1797 include diagnosis, prevention and treatment of diseases and clinical conditions associated with ACTR1A. Activating Transcription Factor 3 (ATF3, Accession NM_004024) is another VGAM1797 host target gene. ATF3 BINDING SITE is HOST TARGET binding site found in the 3' untranslated region of mRNA encoded by ATF3, corresponding to a HOST TARGET binding site such as BINDING SITE I, BINDING SITE II or BINDING SITE III. Table 2 illustrates the complementarity of the nucleotide sequences of ATF3 BINDING SITE, designated SEQ ID:10243, to the nucleotide sequence of VGAM1797 RNA, herein designated VGAM RNA, also designated SEQ ID:4508.

Another function of VGAM1797 is therefore inhibition of Activating Transcription Factor 3 (ATF3, Accession NM_004024). Accordingly, utilities of VGAM1797 include diagnosis, prevention and treatment of diseases and clinical conditions associated with ATF3. BANK (Accession NM_017935) is another VGAM1797 host target gene. BANK BINDING SITE is HOST TARGET binding site found in the 3' untranslated region of mRNA encoded by BANK, corresponding to a HOST TARGET binding site such as BINDING SITE I, BINDING SITE II or BINDING SITE III. Table 2 illustrates the complementarity of the nucleotide sequences of BANK BINDING SITE, designated SEQ ID:19626, to the nucleotide sequence of VGAM1797 RNA, herein designated VGAM RNA, also designated SEQ ID:4508.

Another function of VGAM1797 is therefore inhibition of BANK (Accession NM_017935). Accordingly, utilities of VGAM1797 include diagnosis, prevention and treatment of diseases and clinical conditions associated with BANK. Chromosome 8 Open Reading Frame 2 (C8orf2, Accession NM_007175) is another VGAM1797 host target gene. C8orf2 BINDING SITE is HOST TARGET binding site found in the 3' untranslated region of mRNA encoded by C8orf2, corresponding to a HOST TARGET binding site such as BINDING SITE I, BINDING SITE II or BINDING SITE III. Table 2 illustrates the complementarity of the nucleotide sequences of C8orf2 BINDING SITE, designated SEQ ID:14023, to the nucleotide sequence of VGAM1797 RNA, herein designated VGAM RNA, also designated SEQ ID:4508.

Another function of VGAM1797 is therefore inhibition of Chromosome 8 Open Reading Frame 2 (C8orf2, Accession NM_007175). Accordingly, utilities of VGAM1797 include diagnosis, prevention and treatment of diseases and clinical conditions associated with C8orf2. Cell Adhesion Molecule with Homology to L1CAM (close homolog of L1) (CHL1, Accession NM_006614) is another VGAM1797 host target gene. CHL1 BINDING SITE is HOST TARGET binding site found in the 3' untranslated region of mRNA encoded by CHL1, corresponding to a HOST TARGET binding site such as BINDING SITE I, BINDING SITE II or BINDING SITE III. Table 2 illustrates the complementarity of the nucleotide sequences of CHL1 BINDING SITE, designated SEQ ID:13393, to the nucleotide sequence of VGAM1797 RNA, herein designated VGAM RNA, also designated SEQ ID:4508.

Another function of VGAM1797 is therefore inhibition of Cell Adhesion Molecule with Homology to L1CAM (close homolog of L1) (CHL1, Accession NM_006614). Accordingly, utilities of VGAM1797 include diagnosis, prevention and treatment of diseases and clinical conditions associated with CHL1. COE2 (Accession XM_034639) is another VGAM1797 host target gene. COE2 BINDING SITE is HOST TARGET binding site found in the 3' untranslated region of mRNA encoded by COE2, corresponding to a HOST TARGET binding site such as BINDING SITE I, BINDING SITE II or BINDING SITE III. Table 2 illustrates the complementarity of the nucleotide sequences of COE2 BINDING SITE, designated SEQ ID:32130, to the nucleotide sequence of VGAM1797 RNA, herein designated VGAM RNA, also designated SEQ ID:4508.

Another function of VGAM1797 is therefore inhibition of COE2 (Accession XM_034639). Accordingly, utilities of VGAM1797 include diagnosis, prevention and treatment of diseases and clinical conditions associated with COE2. Death-associated Protein Kinase 2 (DAPK2, Accession NM_014326) is another VGAM1797 host target gene. DAPK2 BINDING SITE is HOST TARGET binding site found in the 3' untranslated region of mRNA encoded by DAPK2, corresponding to a HOST TARGET binding site such as BINDING SITE I, BINDING SITE II or BINDING SITE III. Table 2 illustrates the complementarity of the nucleotide sequences of DAPK2 BINDING SITE, designated SEQ ID:15636, to the nucleotide sequence of VGAM1797 RNA, herein designated VGAM RNA, also designated SEQ ID:4508.

Another function of VGAM1797 is therefore inhibition of Death-associated Protein Kinase 2 (DAPK2, Accession NM_014326). Accordingly, utilities of VGAM1797 include diagnosis, prevention and treatment of diseases and clinical conditions associated with DAPK2. ERAP140 (Accession XM_059748) is another VGAM1797 host target gene. ERAP140 BINDING SITE is HOST TARGET binding site found in the 3' untranslated region of mRNA encoded by ERAP140, corresponding to a HOST TARGET binding site such as BINDING SITE I, BINDING SITE II or BINDING SITE III. Table 2 illustrates the complementarity of the nucleotide sequences of ERAP140 BINDING SITE, designated SEQ ID:37087, to the nucleotide sequence of VGAM1797 RNA, herein designated VGAM RNA, also designated SEQ ID:4508.

Another function of VGAM1797 is therefore inhibition of ERAP140 (Accession XM_059748). Accordingly, utilities of VGAM1797 include diagnosis, prevention and treatment of diseases and clinical conditions associated with ERAP140. FLJ10201 (Accession NM_018023) is another VGAM1797 host target gene. FLJ10201 BINDING SITE is HOST TARGET binding site found in the 5' untranslated region of mRNA encoded by FLJ10201, corresponding to a HOST TARGET binding site such as BINDING SITE I, BINDING SITE II or BINDING SITE III. Table 2 illustrates the complementarity of the nucleotide sequences of FLJ10201 BINDING SITE, designated SEQ ID:19764, to the nucleotide sequence of VGAM1797 RNA, herein designated VGAM RNA, also designated SEQ ID:4508.

Another function of VGAM1797 is therefore inhibition of FLJ10201 (Accession NM_018023). Accordingly, utilities of VGAM1797 include diagnosis, prevention and treatment of diseases and clinical conditions associated with FLJ10201. FLJ30567 (Accession NM_145022) is another VGAM1797 host target gene. FLJ30567 BINDING SITE is HOST TARGET binding site found in the 3' untranslated region of mRNA encoded by FLJ30567, corresponding to a HOST TARGET binding site such as BINDING SITE I, BINDING SITE II or BINDING SITE III. Table 2 illustrates the complementarity of the nucleotide sequences of FLJ30567 BINDING SITE, designated SEQ ID:29633, to the nucleotide sequence of VGAM1797 RNA, herein designated VGAM RNA, also designated SEQ ID:4508.

Another function of VGAM1797 is therefore inhibition of FLJ30567 (Accession NM_145022). Accordingly, utilities of VGAM1797 include diagnosis, prevention and treatment of diseases and clinical conditions associated with FLJ30567. Glutamic Pyruvate Transaminase (alanine aminotransferase) 2 (GPT2, Accession NM_133443) is another VGAM1797 host target gene. GPT2 BINDING SITE is HOST TARGET binding site found in the 3' untranslated region of mRNA encoded by GPT2, corresponding to a HOST TARGET binding site such as BINDING SITE I, BINDING SITE II or BINDING SITE III. Table 2 illustrates the complementarity of the nucleotide sequences of GPT2 BINDING SITE, designated SEQ ID:28526, to the nucleotide sequence of VGAM1797 RNA, herein designated VGAM RNA, also designated SEQ ID:4508.

Another function of VGAM1797 is therefore inhibition of Glutamic Pyruvate Transaminase (alanine aminotransferase) 2 (GPT2, Accession NM_133443). Accordingly, utilities of VGAM1797 include diagnosis, prevention and treatment of diseases and clinical conditions associated with GPT2. HIC (Accession XM_041273) is another VGAM1797 host target gene. HIC BINDING SITE is HOST TARGET binding site found in the 3' untranslated region of mRNA encoded by HIC, corresponding to a HOST TARGET binding site such as BINDING SITE I, BINDING SITE II or BINDING SITE III. Table 2 illustrates the complementarity of the nucleotide sequences of HIC BINDING SITE, designated SEQ ID:33495, to the nucleotide sequence of VGAM1797 RNA, herein designated VGAM RNA, also designated SEQ ID:4508.

Another function of VGAM1797 is therefore inhibition of HIC (Accession XM_041273). Accordingly, utilities of VGAM1797 include diagnosis, prevention and treatment of diseases and clinical conditions associated with HIC. High Mobility Group Nucleosomal Binding Domain 4 (HMGN4, Accession NM_006353) is another VGAM1797 host target gene. HMGN4 BINDING SITE is HOST TARGET binding site found in the 3' untranslated region of mRNA encoded by HMGN4, corresponding to a HOST TARGET binding site such as BINDING SITE I, BINDING SITE II or BINDING SITE III. Table 2 illustrates the complementarity of the nucleotide sequences of HMGN4 BINDING SITE, designated SEQ ID:13048, to the nucleotide sequence of VGAM1797 RNA, herein designated VGAM RNA, also designated SEQ ID:4508.

Another function of VGAM1797 is therefore inhibition of High Mobility Group Nucleosomal Binding Domain 4 (HMGN4, Accession NM_006353). Accordingly, utilities of VGAM1797 include diagnosis, prevention and treatment of diseases and clinical conditions associated with HMGN4. HSPC039 (Accession NM_016097) is another VGAM1797 host target gene. HSPC039 BINDING SITE is HOST TARGET binding site found in the 3' untranslated region of mRNA encoded by HSPC039, corresponding to a HOST TARGET binding site such as BINDING SITE I, BINDING SITE II or BINDING SITE III. Table 2 illustrates the complementarity of the nucleotide sequences of HSPC039 BINDING SITE, designated SEQ ID:18181, to the nucleotide sequence of VGAM1797 RNA, herein designated VGAM RNA, also designated SEQ ID:4508.

Another function of VGAM1797 is therefore inhibition of HSPC039 (Accession NM_016097). Accordingly, utilities of VGAM1797 include diagnosis, prevention and treatment of diseases and clinical conditions associated with HSPC039. KIAA0637 (Accession NM_014838) is another VGAM1797 host target gene. KIAA0637 BINDING SITE is HOST TARGET binding site found in the 5' untranslated region of mRNA encoded by KIAA0637, corresponding to a HOST TARGET binding site such as BINDING SITE I, BINDING SITE II or BINDING SITE III. Table 2 illustrates the complementarity of the nucleotide sequences of KIAA0637 BINDING SITE, designated SEQ ID:16861, to the nucleotide sequence of VGAM1797 RNA, herein designated VGAM RNA, also designated SEQ ID:4508.

Another function of VGAM1797 is therefore inhibition of KIAA0637 (Accession NM_014838). Accordingly, utilities of VGAM1797 include diagnosis, prevention and treatment of diseases and clinical conditions associated with KIAA0637. KIAA1136 (Accession XM_166110) is another VGAM1797 host target gene. KIAA1136 BINDING SITE is HOST TARGET binding site found in the 3' untranslated region of mRNA encoded by KIAA1136, corresponding to a HOST TARGET binding site such as BINDING SITE I, BINDING SITE II or BINDING SITE III. Table 2 illustrates the complementarity of the nucleotide sequences of KIAA1136 BINDING SITE, designated SEQ ID:43885, to the nucleotide sequence of VGAM1797 RNA, herein designated VGAM RNA, also designated SEQ ID:4508.

Another function of VGAM1797 is therefore inhibition of KIAA1136 (Accession XM_166110). Accordingly, utilities of VGAM1797 include diagnosis, prevention and treatment of diseases and clinical conditions associated with KIAA1136. KIAA1464 (Accession XM_043069) is another VGAM1797 host target gene. KIAA1464 BINDING SITE is HOST TARGET binding site found in the 3' untranslated region of mRNA encoded by KIAA1464, corresponding to a HOST TARGET binding site such as BINDING SITE I, BINDING SITE II or BINDING SITE III. Table 2 illustrates the complementarity of the nucleotide sequences of KIAA1464 BINDING SITE, designated SEQ ID:33885, to the nucleotide sequence of VGAM1797 RNA, herein designated VGAM RNA, also designated SEQ ID:4508.

Another function of VGAM1797 is therefore inhibition of KIAA1464 (Accession XM_043069). Accordingly, utilities of VGAM1797 include diagnosis, prevention and treatment of diseases and clinical conditions associated with KIAA1464. KIAA1948 (Accession XM_091984) is another VGAM1797 host target gene. KIAA1948 BINDING SITE is HOST TARGET binding site found in the 3' untranslated region of mRNA encoded by KIAA1948, corresponding to a HOST TARGET binding site such as BINDING SITE I, BINDING SITE II or BINDING SITE III. Table 2 illustrates the complementarity of the nucleotide sequences of KIAA1948 BINDING SITE, designated SEQ ID:40082, to the nucleotide sequence of VGAM1797 RNA, herein designated VGAM RNA, also designated SEQ ID:4508.

Another function of VGAM1797 is therefore inhibition of KIAA1948 (Accession XM_091984). Accordingly, utilities of VGAM1797 include diagnosis, prevention and treatment of diseases and clinical conditions associated with KIAA1948. LBP-9 (Accession NM_014553) is another VGAM1797 host target gene. LBP-9 BINDING SITE is HOST TARGET binding site found in the 3' untranslated region of mRNA encoded by LBP-9, corresponding to a HOST TARGET binding site such as BINDING SITE I, BINDING SITE II or BINDING SITE III. Table 2 illustrates the complementarity of the nucleotide sequences of LBP-9 BINDING SITE, designated SEQ ID:15879, to the nucleotide sequence of VGAM1797 RNA, herein designated VGAM RNA, also designated SEQ ID:4508.

Another function of VGAM1797 is therefore inhibition of LBP-9 (Accession NM_014553). Accordingly, utilities of VGAM1797 include diagnosis, prevention and treatment of diseases and clinical conditions associated with LBP-9. MacGAP (Accession NM_033515) is another VGAM1797 host target gene. MacGAP BINDING SITE is HOST TARGET binding site found in the 3' untranslated region of mRNA encoded by MacGAP, corresponding to a HOST TARGET binding site such as BINDING SITE I, BINDING SITE II or BINDING SITE III. Table 2 illustrates the complementarity of the nucleotide sequences of MacGAP BINDING SITE, designated SEQ ID:27288, to the nucleotide sequence of VGAM1797 RNA, herein designated VGAM RNA, also designated SEQ ID:4508.

Another function of VGAM1797 is therefore inhibition of MacGAP (Accession NM_033515). Accordingly, utilities of VGAM1797 include diagnosis, prevention and treatment of diseases and clinical conditions associated with MacGAP. MGC5242 (Accession NM_024033) is another VGAM1797 host target gene. MGC5242 BINDING SITE is HOST TARGET binding site found in the 5' untranslated region of mRNA encoded by MGC5242, corresponding to a HOST TARGET binding site such as BINDING SITE I, BINDING SITE II or BINDING SITE III. Table 2 illustrates the complementarity of the nucleotide sequences of MGC5242 BINDING SITE, designated SEQ ID:23463, to the nucleotide sequence of VGAM1797 RNA, herein designated VGAM RNA, also designated SEQ ID:4508.

Another function of VGAM1797 is therefore inhibition of MGC5242 (Accession NM_024033). Accordingly, utilities of VGAM1797 include diagnosis, prevention and treatment of diseases and clinical conditions associated with MGC5242. N4BP2 (Accession NM_018177) is another VGAM1797 host target gene. N4BP2 BINDING SITE is HOST TARGET binding site found in the 3' untranslated region of mRNA encoded by N4BP2, corresponding to a HOST TARGET binding site such as BINDING SITE I, BINDING SITE II or BINDING SITE III. Table 2 illustrates the complementarity of the nucleotide sequences of N4BP2 BINDING SITE, designated SEQ ID:20004, to the nucleotide sequence of VGAM1797 RNA, herein designated VGAM RNA, also designated SEQ ID:4508.

Another function of VGAM1797 is therefore inhibition of N4BP2 (Accession NM_018177). Accordingly, utilities of VGAM1797 include diagnosis, prevention and treatment of diseases and clinical conditions associated with N4BP2. Olfactomedin 3 (OLFM3, Accession XM_088951) is another VGAM1797 host target gene. OLFM3 BINDING SITE is HOST TARGET binding site found in the 3' untranslated region of mRNA encoded by OLFM3, corresponding to a HOST TARGET binding site such as BINDING SITE I, BINDING SITE II or BINDING SITE III. Table 2 illustrates the complementarity of the nucleotide sequences of OLFM3 BINDING SITE, designated SEQ ID:39960, to the nucleotide sequence of VGAM1797 RNA, herein designated VGAM RNA, also designated SEQ ID:4508.

Another function of VGAM1797 is therefore inhibition of Olfactomedin 3 (OLFM3, Accession XM_088951). Accordingly, utilities of VGAM1797 include diagnosis, prevention and treatment of diseases and clinical conditions associated with OLFM3. PRO2133 (Accession NM_018619) is another VGAM1797 host target gene. PRO2133 BINDING SITE is HOST TARGET binding site found in the 3' untranslated region of mRNA encoded by PRO2133, corresponding to a HOST TARGET binding site such as BINDING SITE I, BINDING SITE II or BINDING SITE III. Table 2 illustrates the complementarity of the nucleotide sequences of PRO2133 BINDING SITE, designated SEQ ID:20692, to the nucleotide sequence of VGAM1797 RNA, herein designated VGAM RNA, also designated SEQ ID:4508.

Another function of VGAM1797 is therefore inhibition of PRO2133 (Accession NM_018619). Accordingly, utilities of VGAM1797 include diagnosis, prevention and treatment of diseases and clinical conditions associated with PRO2133. RAB6C, Member RAS Oncogene Family (RAB6C, Accession NM_032144) is another VGAM1797 host target gene. RAB6C BINDING SITE is HOST TARGET binding site found in the 3' untranslated region of mRNA encoded by RAB6C, corresponding to a HOST TARGET binding site such as BINDING SITE I, BINDING SITE II or BINDING SITE III. Table 2 illustrates the complementarity of the nucleotide sequences of RAB6C BINDING SITE, designated SEQ ID:25835, to the nucleotide sequence of VGAM1797 RNA, herein designated VGAM RNA, also designated SEQ ID:4508.

Another function of VGAM1797 is therefore inhibition of RAB6C, Member RAS Oncogene Family (RAB6C, Accession NM_032144). Accordingly, utilities of VGAM1797 include diagnosis, prevention and treatment of diseases and clinical conditions associated with RAB6C. Ribosomal Protein S6 Kinase, 52 kDa, Polypeptide 1 (RPS6KC1, Accession NM_012424) is another VGAM1797 host target gene. RPS6KC1 BINDING SITE is HOST TARGET binding site found in the 3' untranslated region of mRNA encoded by RPS6KC1, corresponding to a HOST TARGET binding site such as BINDING SITE I, BINDING SITE II or BINDING SITE III. Table 2 illustrates the complementarity of the nucleotide sequences of RPS6KC1 BINDING SITE, designated SEQ ID:14801, to the nucleotide sequence of VGAM1797 RNA, herein designated VGAM RNA, also designated SEQ ID:4508.

Another function of VGAM1797 is therefore inhibition of Ribosomal Protein S6 Kinase, 52 kDa, Polypeptide 1 (RPS6KC1, Accession NM_012424). Accordingly, utilities of VGAM1797 include diagnosis, prevention and treatment of diseases and clinical conditions associated with RPS6KC1. SE57-1 (Accession NM_025214) is another VGAM1797 host target gene. SE57-1 BINDING SITE is HOST TARGET binding site found in the 3' untranslated region of mRNA encoded by SE57-1, corresponding to a HOST TARGET binding site such as BINDING SITE I, BINDING SITE II or BINDING SITE III. Table 2 illustrates the complementarity of the nucleotide sequences of SE57-1 BINDING SITE, designated SEQ ID:24889, to the nucleotide sequence of VGAM1797 RNA, herein designated VGAM RNA, also designated SEQ ID:4508.

Another function of VGAM1797 is therefore inhibition of SE57-1 (Accession NM_025214). Accordingly, utilities of VGAM1797 include diagnosis, prevention and treatment of diseases and clinical conditions associated with SE57-1. TED (Accession NM_015686) is another VGAM1797 host target gene. TED BINDING SITE is HOST TARGET binding site found in the 3' untranslated region of mRNA encoded by TED, corresponding to a HOST TARGET binding site such as BINDING SITE I, BINDING SITE II or BINDING SITE III. Table 2 illustrates the complementarity of the nucleotide sequences of TED BINDING SITE, designated SEQ ID:17921, to the nucleotide sequence of VGAM1797 RNA, herein designated VGAM RNA, also designated SEQ ID:4508.

Another function of VGAM1797 is therefore inhibition of TED (Accession NM_015686). Accordingly, utilities of VGAM1797 include diagnosis, prevention and treatment of diseases and clinical conditions associated with TED. TTY7 (Accession NM_031926) is another VGAM1797 host target gene. TTY7 BINDING SITE is HOST TARGET binding site found in the 3' untranslated region of mRNA encoded by TTY7, corresponding to a HOST TARGET binding site such as BINDING SITE I, BINDING SITE II or BINDING SITE III. Table 2 illustrates the complementarity of the nucleotide sequences of TTY7 BINDING SITE, designated SEQ ID:25673, to the nucleotide sequence of VGAM1797 RNA, herein designated VGAM RNA, also designated SEQ ID:4508.

Another function of VGAM1797 is therefore inhibition of TTY7 (Accession NM_031926). Accordingly, utilities of VGAM1797 include diagnosis, prevention and treatment of diseases and clinical conditions associated with TTY7. Wingless-type MMTV Integration Site Family, Member 16 (WNT16, Accession NM_016087) is another VGAM1797 host target gene. WNT16 BINDING SITE1 and WNT16 BINDING SITE2 are HOST TARGET binding sites found in untranslated regions of mRNA encoded by WNT16, corresponding to HOST TARGET binding sites such as BINDING SITE I, BINDING SITE II or BINDING SITE III. Table 2 illustrates the complementarity of the nucleotide sequences of WNT16 BINDING SITE1 and WNT16 BINDING SITE2, designated SEQ ID:18172 and SEQ ID:27676 respectively, to the nucleotide sequence of VGAM1797 RNA, herein designated VGAM RNA, also designated SEQ ID:4508.

Another function of VGAM1797 is therefore inhibition of Wingless-type MMTV Integration Site Family, Member 16 (WNT16, Accession NM_016087). Accordingly, utilities of VGAM1797 include diagnosis, prevention and treatment of diseases and clinical conditions associated with WNT16. Zinc Finger Protein 347 (ZNF347, Accession NM_032584) is another VGAM1797 host target gene. ZNF347 BINDING SITE is HOST TARGET binding site found in the 3' untranslated region of mRNA encoded by ZNF347, corresponding to a HOST TARGET binding site such as BINDING SITE I, BINDING SITE II or BINDING SITE III. Table 2 illustrates the complementarity of the nucleotide sequences of ZNF347 BINDING SITE, designated SEQ ID:26319, to the nucleotide sequence of VGAM1797 RNA, herein designated VGAM RNA, also designated SEQ ID:4508.

Another function of VGAM1797 is therefore inhibition of Zinc Finger Protein 347 (ZNF347, Accession NM_032584). Accordingly, utilities of VGAM1797 include diagnosis, prevention and treatment of diseases and clinical conditions associated with ZNF347. LOC153516 (Accession NM_138491) is another VGAM1797 host target gene. LOC153516 BINDING SITE is HOST TARGET binding site found in the 3' untranslated region of mRNA encoded by LOC153516, corresponding to a HOST TARGET binding site such as BINDING SITE I, BINDING SITE II or BINDING SITE III. Table 2 illustrates the complementarity of the nucleotide sequences of LOC153516 BINDING SITE, designated SEQ ID:28842, to the nucleotide sequence of VGAM1797 RNA, herein designated VGAM RNA, also designated SEQ ID:4508.

Another function of VGAM1797 is therefore inhibition of LOC153516 (Accession NM_138491). Accordingly, utilities of VGAM1797 include diagnosis, prevention and treatment of diseases and clinical conditions associated with LOC153516. LOC160646 (Accession XM_090413) is another VGAM1797 host target gene. LOC160646 BINDING SITE is HOST TARGET binding site found in the 3' untranslated region of mRNA encoded by LOC160646, corresponding to a HOST TARGET binding site such as BINDING SITE I, BINDING SITE II or BINDING SITE III. Table 2 illustrates the complementarity of the nucleotide sequences of LOC160646 BINDING SITE, designated SEQ ID:40001, to the nucleotide sequence of VGAM1797 RNA, herein designated VGAM RNA, also designated SEQ ID:4508.

Another function of VGAM1797 is therefore inhibition of LOC160646 (Accession XM_090413). Accordingly, utilities of VGAM1797 include diagnosis, prevention and treatment of diseases and clinical conditions associated with LOC160646. LOC200609 (Accession XM_117256) is another VGAM1797 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43334, to the nucleotide sequence of VGAM1797 RNA, herein designated VGAM RNA, also designated SEQ ID:4508.

Another function of VGAM1797 is therefore inhibition of LOC200609 (Accession XM_117256). Accordingly, utilities of VGAM1797 include diagnosis, prevention and treatment of diseases and clinical conditions associated with LOC200609. LOC221069 (Accession XM_167676) is another VGAM1797 host target gene. LOC221069 BINDING SITE is HOST TARGET binding site found in the 3' untranslated region of mRNA encoded by LOC221069, corresponding to a HOST TARGET binding site such as BINDING SITE I, BINDING SITE II or BINDING SITE III. Table 2 illustrates the complementarity of the nucleotide sequences of LOC221069 BINDING SITE, designated SEQ ID:44768, to the nucleotide sequence of VGAM1797 RNA, herein designated VGAM RNA, also designated SEQ ID:4508.

Another function of VGAM1797 is therefore inhibition of LOC221069 (Accession XM_167676). Accordingly, utilities of VGAM1797 include diagnosis, prevention and treatment of diseases and clinical conditions associated with LOC221069. LOC255461 (Accession XM_173207) is another VGAM1797 host target gene. LOC255461 BINDING SITE is HOST TARGET binding site found in the 5' untranslated region of mRNA encoded by LOC255461, corresponding to a HOST TARGET binding site such as BINDING SITE I, BINDING SITE II or BINDING SITE III. Table 2 illustrates the complementarity of the nucleotide sequences of LOC255461 BINDING SITE, designated SEQ ID:46466, to the nucleotide sequence of VGAM1797 RNA, herein designated VGAM RNA, also designated SEQ ID:4508.

Another function of VGAM1797 is therefore inhibition of LOC255461 (Accession XM_173207). Accordingly, utilities of VGAM1797 include diagnosis, prevention and treatment of diseases and clinical conditions associated with LOC255461. LOC255516 (Accession XM_173212) is another VGAM1797 host target gene. LOC255516 BINDING SITE is HOST TARGET binding site found in the 5' untranslated region of mRNA encoded by LOC255516, corresponding to a HOST TARGET binding site such as BINDING SITE I, BINDING SITE II or BINDING SITE III. Table 2 illustrates the complementarity of the nucleotide sequences of LOC255516 BINDING SITE, designated SEQ ID:46472, to the nucleotide sequence of VGAM1797 RNA, herein designated VGAM RNA, also designated SEQ ID:4508.

Another function of VGAM1797 is therefore inhibition of LOC255516 (Accession XM_173212). Accordingly, utilities of VGAM1797 include diagnosis, prevention and treatment of diseases and clinical conditions associated with LOC255516. LOC51020 (Accession NM_016063) is another VGAM1797 host target gene. LOC51020 BINDING SITE is HOST TARGET binding site found in the 3' untranslated region of mRNA encoded by LOC51020, corresponding to a HOST TARGET binding site such as BINDING SITE I, BINDING SITE II or BINDING SITE III. Table 2 illustrates the complementarity of the nucleotide sequences of LOC51020 BINDING SITE, designated SEQ ID:18138, to the nucleotide sequence of VGAM1797 RNA, herein designated VGAM RNA, also designated SEQ ID:4508.

Another function of VGAM1797 is therefore inhibition of LOC51020 (Accession NM_016063). Accordingly, utilities of VGAM1797 include diagnosis, prevention and treatment of diseases and clinical conditions associated with LOC51020. FIG. 1 further provides a conceptual description of a novel bioinformatically detected viral gene of the present invention, referred to here as Viral Genomic Address Messenger 1798 (VGAM1798) viral gene, which modulates expression of respective host target genes thereof, the function and utility of which host target genes is known in the art.

VGAM1798 is a novel bioinformatically detected regulatory, non protein coding, viral micro RNA (miRNA) gene. The method by which VGAM1798 was detected is described hereinabove with reference to FIGS. 1-8.

VGAM1798 gene, herein designated VGAM GENE, is a viral gene contained in the genome of Rana Tigrina Ranavirus. VGAM1798 host target gene, herein designated VGAM HOST TARGET GENE, is a human gene contained in the human genome.

VGAM1798 gene encodes a VGAM1798 precursor RNA, herein designated VGAM PRECURSOR RNA. Similar to other miRNA genes, and unlike most ordinary genes, VGAM1798 precursor RNA does not encode a protein. A nucleotide sequence identical or highly similar to the nucleotide sequence of VGAM1798 precursor RNA is designated SEQ ID:1784, and is provided hereinbelow with reference to the sequence listing part. Nucleotide sequence SEQ ID:1784 is located at position 85493 relative to the genome of Rana Tigrina Ranavirus.

VGAM1798 precursor RNA folds onto itself, forming VGAM1798 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1798 folded precursor RNA into VGAM1798 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1798 RNA is designated SEQ ID:4509, and is provided hereinbelow with reference to the sequence listing part.

VGAM1798 host target gene, herein designated VGAM HOST TARGET GENE, encodes a corresponding messenger RNA, VGAM1798 host target RNA, herein designated VGAM HOST TARGET RNA. VGAM1798 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1798 RNA, herein designated VGAM RNA, binds complementarily to one or more host target binding sites located in untranslated regions of VGAM1798 host target RNA, herein designated VGAM HOST TARGET RNA. This complementary binding is due to the fact that the nucleotide sequence of VGAM1798 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1798 RNA, herein designated VGAM RNA, may have a different number of host target binding sites in untranslated regions of a VGAM1798 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1798 RNA, herein designated VGAM RNA, to host target binding sites on VGAM1798 host target RNA, herein designated VGAM HOST TARGET RNA, such as BINDING SITE I, BINDING SITE II and BINDING SITE III, inhibits translation of VGAM1798 host target RNA into VGAM1798 host target protein, herein designated VGAM HOST TARGET PROTEIN. VGAM host target protein is therefore outlined by a broken line.

It is appreciated that VGAM1798 host target gene, herein designated VGAM HOST TARGET GENE, in fact represents a plurality of VGAM1798 host target genes. The mRNA of each one of this plurality of VGAM1798 host target genes comprises one or more host target binding sites, each having a nucleotide sequence which is at least partly complementary to VGAM1798 RNA, herein designated VGAM RNA, and which when bound by VGAM1798 RNA causes inhibition of translation of respective one or more VGAM1798 host target proteins.

It is further appreciated by one skilled in the art that the mode of translational inhibition illustrated by FIG. 1 with specific reference to translational inhibition exerted by VGAM1798 gene, herein designated VGAM GENE, on one or more VGAM1798 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1798 is inhibition of expression of host target genes, as part of a novel viral mechanism of attacking a host. Accordingly, utilities of VGAM1798 include diagnosis, prevention and treatment of viral infection by Rana Tigrina Ranavirus. Specific functions, and accordingly utilities, of VGAM1798 correlate with, and may be deduced from, the identity of the host target genes which VGAM1798 binds and inhibits, and the function of these host target genes, as elaborated hereinbelow.

Nucleotide sequences of the VGAM1798 precursor RNA, herein designated VGAM PRECURSOR RNA, and of the 'diced' VGAM1798 RNA, herein designated VGAM RNA, and a schematic representation of the secondary folding of VGAM1798 folded precursor RNA, herein designated VGAM FOLDED PRECURSOR RNA, of VGAM1798 are further described hereinbelow with reference to Table 1.

Nucleotide sequences of host target binding sites, such as BINDING SITE-I, BINDING SITE-II and BINDING SITE-III of FIG. 1, found on VGAM1798 host target RNA, and schematic representation of the complementarity of each of these host target binding sites to VGAM1798 RNA, herein designated VGAM RNA, are described hereinbelow with reference to Table 2.

As mentioned hereinabove with reference to FIG. 1, a function of VGAM1798 gene, herein designated VGAM is inhibition of expression of VGAM1798 target genes. It is appreciated that specific functions, and accordingly utilities, of VGAM1798 correlate with, and may be deduced from, the identity of the target genes which VGAM1798 binds and inhibits, and the function of these target genes, as elaborated hereinbelow.

Synaptosomal-associated Protein, 25 kDa (SNAP25, Accession NM_003081) is a VGAM1798 host target gene. SNAP25 BINDING SITE1 and SNAP25 BINDING SITE2 are HOST TARGET binding sites found in untranslated regions of mRNA encoded by SNAP25, corresponding to HOST TARGET binding sites such as BINDING SITE I, BINDING SITE II or BINDING SITE III. Table 2 illustrates the complementarity of the nucleotide sequences of SNAP25 BINDING SITE1 and SNAP25 BINDING SITE2, designated SEQ ID:9054 and SEQ ID:28317 respectively, to the nucleotide sequence of VGAM1798 RNA, herein designated VGAM RNA, also designated SEQ ID:4509.

A function of VGAM1798 is therefore inhibition of Synaptosomal-associated Protein, 25 kDa (SNAP25, Accession NM_003081). Accordingly, utilities of VGAM1798 include diagnosis, prevention and treatment of diseases and clinical conditions associated with SNAP25. LOC158332 (Accession XM_088554) is another VGAM1798 host target gene. LOC158332 BINDING SITE is HOST TARGET binding site found in the 3' untranslated region of mRNA encoded by LOC158332, corresponding to a HOST TARGET binding site such as BINDING SITE I, BINDING SITE II or BINDING SITE III. Table 2 illustrates the complementarity of the nucleotide sequences of LOC158332 BINDING SITE, designated SEQ ID:39823, to the nucleotide sequence of VGAM1798 RNA, herein designated VGAM RNA, also designated SEQ ID:4509.

Another function of VGAM1798 is therefore inhibition of LOC158332 (Accession XM_088554). Accordingly, utilities of VGAM1798 include diagnosis, prevention and treatment of diseases and clinical conditions associated with LOC158332. LOC84549 (Accession NM_032509) is another VGAM1798 host target gene. LOC84549 BINDING SITE is HOST TARGET binding site found in the 3' untranslated region of mRNA encoded by LOC84549, corresponding to a HOST TARGET binding site such as BINDING SITE I, BINDING SITE II or BINDING SITE III. Table 2 illustrates the complementarity of the nucleotide sequences of LOC84549 BINDING SITE, designated SEQ ID:26259, to the nucleotide sequence of VGAM1798 RNA, herein designated VGAM RNA, also designated SEQ ID:4509.

Another function of VGAM1798 is therefore inhibition of LOC84549 (Accession NM_032509). Accordingly, utilities of VGAM1798 include diagnosis, prevention and treatment of diseases and clinical conditions associated with LOC84549. FIG. 1 further provides a conceptual description of a novel bioinformatically detected viral gene of the present invention, referred to here as Viral Genomic Address Messenger 1799 (VGAM1799) viral gene, which modulates expression of respective host target genes thereof, the function and utility of which host target genes is known in the art.

VGAM1799 is a novel bioinformatically detected regulatory, non protein coding, viral micro RNA (miRNA) gene. The method by which VGAM1799 was detected is described hereinabove with reference to FIGS. 1-8.

VGAM1799 gene, herein designated VGAM GENE, is a viral gene contained in the genome of Tupaia Herpesvirus. VGAM1799 host target gene, herein designated VGAM HOST TARGET GENE, is a human gene contained in the human genome.

VGAM1799 gene encodes a VGAM1799 precursor RNA, herein designated VGAM PRECURSOR RNA. Similar to other miRNA genes, and unlike most ordinary genes, VGAM1799 precursor RNA does not encode a protein. A nucleotide sequence identical or highly similar to the nucleotide sequence of VGAM1799 precursor RNA is designated SEQ ID:1785, and is provided hereinbelow with reference to the sequence listing part. Nucleotide sequence SEQ ID:1785 is located at position 30160 relative to the genome of Tupaia Herpesvirus.

VGAM1799 precursor RNA folds onto itself, forming VGAM1799 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1799 folded precursor RNA into VGAM1799 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1799 RNA is designated SEQ ID:4510, and is provided hereinbelow with reference to the sequence listing part.

VGAM1799 host target gene, herein designated VGAM HOST TARGET GENE, encodes a corresponding messenger RNA, VGAM1799 host target RNA, herein designated VGAM HOST TARGET RNA. VGAM1799 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1799 RNA, herein designated VGAM RNA, binds complementarily to one or more host target binding sites located in untranslated regions of VGAM1799 host target RNA, herein designated VGAM HOST TARGET RNA. This complementary binding is due to the fact that the nucleotide sequence of VGAM1799 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1799 RNA, herein designated VGAM RNA, may have a different number of host target binding sites in untranslated regions of a VGAM1799 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1799 RNA, herein designated VGAM RNA, to host target binding sites on VGAM1799 host target RNA, herein designated VGAM HOST TARGET RNA, such as BINDING SITE I, BINDING SITE II and BINDING SITE III, inhibits translation of VGAM1799 host target RNA into VGAM1799 host target protein, herein designated VGAM HOST TARGET PROTEIN. VGAM host target protein is therefore outlined by a broken line.

It is appreciated that VGAM1799 host target gene, herein designated VGAM HOST TARGET GENE, in fact represents a plurality of VGAM1799 host target genes. The mRNA of each one of this plurality of VGAM1799 host target genes comprises one or more host target binding sites, each having a nucleotide sequence which is at least partly complementary to VGAM1799 RNA, herein designated VGAM RNA, and which when bound by VGAM1799 RNA causes inhibition of translation of respective one or more VGAM1799 host target proteins.

It is further appreciated by one skilled in the art that the mode of translational inhibition illustrated by FIG. 1 with specific reference to translational inhibition exerted by VGAM1799 gene, herein designated VGAM GENE, on one or more VGAM1799 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1799 is inhibition of expression of host target genes, as part of a novel viral mechanism of attacking a host. Accordingly, utilities of VGAM1799 include diagnosis, prevention and treatment of viral infection by Tupaia Herpesvirus. Specific functions, and accordingly utilities, of VGAM1799 correlate with, and may be deduced from, the identity of the host target genes which VGAM1799 binds and inhibits, and the function of these host target genes, as elaborated hereinbelow.

Nucleotide sequences of the VGAM1799 precursor RNA, herein designated VGAM PRECURSOR RNA, and of the 'diced' VGAM1799 RNA, herein designated VGAM RNA, and a schematic representation of the secondary folding of VGAM1799 folded precursor RNA, herein designated VGAM FOLDED PRECURSOR RNA, of VGAM1799 are further described hereinbelow with reference to Table 1.

Nucleotide sequences of host target binding sites, such as BINDING SITE-I, BINDING SITE-II and BINDING SITE-III of FIG. 1, found on VGAM1799 host target RNA, and schematic representation of the complementarity of each of these host target binding sites to VGAM1799 RNA, herein designated VGAM RNA, are described hereinbelow with reference to Table 2.

As mentioned hereinabove with reference to FIG. 1, a function of VGAM1799 gene, herein designated VGAM is inhibition of expression of VGAM1799 target genes. It is appreciated that specific functions, and accordingly utilities, of VGAM1799 correlate with, and may be deduced from, the identity of the target genes which VGAM1799 binds and inhibits, and the function of these target genes, as elaborated hereinbelow.

Cyclin F (CCNF, Accession NM_001761) is a VGAM1799 host target gene. CCNF BINDING SITE is HOST TARGET binding site found in the 3' untranslated region of mRNA encoded by CCNF, corresponding to a HOST TARGET binding site such as BINDING SITE I, BINDING SITE II or BINDING SITE III. Table 2 illustrates the complementarity of the nucleotide sequences of CCNF BINDING SITE, designated SEQ ID:7523, to the nucleotide sequence of VGAM1799 RNA, herein designated VGAM RNA, also designated SEQ ID:4510.

A function of VGAM1799 is therefore inhibition of Cyclin F (CCNF, Accession NM_001761), a gene which likely to be involved in the control of the cell cycle during s phase and g2. Accordingly, utilities of VGAM1799 include diagnosis, prevention and treatment of diseases and clinical conditions associated with CCNF. The function of CCNF and its association with various diseases and clinical conditions, has been established by previous studies, as described hereinabove with reference to VGAM367. LOC200574 (Accession XM_114264) is another VGAM1799 host target gene. LOC200574 BINDING SITE is HOST TARGET binding site found in the 3' untranslated region of mRNA encoded by LOC200574, corresponding to a HOST TARGET binding site such as BINDING SITE I, BINDING SITE II or BINDING SITE III. Table 2 illustrates the complementarity of the nucleotide sequences of LOC200574 BINDING SITE, designated SEQ ID:42821, to the nucleotide sequence of VGAM1799 RNA, herein designated VGAM RNA, also designated SEQ ID:4510.

Another function of VGAM1799 is therefore inhibition of LOC200574 (Accession XM_114264). Accordingly, utilities of VGAM1799 include diagnosis, prevention and treatment of diseases and clinical conditions associated with LOC200574. FIG. 1 further provides a conceptual description of a novel bioinformatically detected viral gene of the present invention, referred to here as Viral Genomic Address Messenger 1800 (VGAM1800) viral gene, which modulates expression of respective host target genes thereof, the function and utility of which host target genes is known in the art.

VGAM1800 is a novel bioinformatically detected regulatory, non protein coding, viral micro RNA (miRNA) gene. The method by which VGAM1800 was detected is described hereinabove with reference to FIGS. 1-8.

VGAM1800 gene, herein designated VGAM GENE, is a viral gene contained in the genome of Tupaia Herpesvirus. VGAM1800 host target gene, herein designated VGAM HOST TARGET GENE, is a human gene contained in the human genome.

VGAM1800 gene encodes a VGAM1800 precursor RNA, herein designated VGAM PRECURSOR RNA. Similar to other miRNA genes, and unlike most ordinary genes, VGAM1800 precursor RNA does not encode a protein. A nucleotide sequence identical or highly similar to the nucleotide sequence of VGAM1800 precursor RNA is designated SEQ ID:1786, and is provided hereinbelow with reference to the sequence listing part. Nucleotide sequence SEQ ID:1786 is located at position 23754 relative to the genome of Tupaia Herpesvirus.

VGAM1800 precursor RNA folds onto itself, forming VGAM1800 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1800 folded precursor RNA into VGAM1800 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1800 RNA is designated SEQ ID:4511, and is provided hereinbelow with reference to the sequence listing part.

VGAM1800 host target gene, herein designated VGAM HOST TARGET GENE, encodes a corresponding messenger RNA, VGAM1800 host target RNA, herein designated VGAM HOST TARGET RNA. VGAM1800 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1800 RNA, herein designated VGAM RNA, binds complementarily to one or more host target binding sites located in untranslated regions of VGAM1800 host target RNA, herein designated VGAM HOST TARGET RNA. This complementary binding is due to the fact that the nucleotide sequence of VGAM1800 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1800 RNA, herein designated VGAM RNA, may have a different number of host target binding sites in untranslated regions of a VGAM1800 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1800 RNA, herein designated VGAM RNA, to host target binding sites on VGAM1800 host target RNA, herein designated VGAM HOST TARGET RNA, such as BINDING SITE I, BINDING SITE II and BINDING SITE III, inhibits translation of VGAM1800 host target RNA into VGAM1800 host target protein, herein designated VGAM HOST TARGET PROTEIN. VGAM host target protein is therefore outlined by a broken line.

It is appreciated that VGAM1800 host target gene, herein designated VGAM HOST TARGET GENE, in fact represents a plurality of VGAM1800 host target genes. The mRNA of each one of this plurality of VGAM1800 host target genes comprises one or more host target binding sites, each having a nucleotide sequence which is at least partly complementary to VGAM1800 RNA, herein designated VGAM RNA, and which when bound by VGAM1800 RNA causes inhibition of translation of respective one or more VGAM1800 host target proteins.

It is further appreciated by one skilled in the art that the mode of translational inhibition illustrated by FIG. 1 with specific reference to translational inhibition exerted by VGAM1800 gene, herein designated VGAM GENE, on one or more VGAM1800 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1800 is inhibition of expression of host target genes, as part of a novel viral mechanism of attacking a host. Accordingly, utilities of VGAM1800 include diagnosis, prevention and treatment of viral infection by Tupaia Herpesvirus. Specific functions, and accordingly utilities, of VGAM1800 correlate with, and may be deduced from, the identity of the host target genes which VGAM1800 binds and inhibits, and the function of these host target genes, as elaborated hereinbelow.

Nucleotide sequences of the VGAM1800 precursor RNA, herein designated VGAM PRECURSOR RNA, and of the 'diced' VGAM1800 RNA, herein designated VGAM RNA, and a schematic representation of the secondary folding of VGAM1800 folded precursor RNA, herein designated VGAM FOLDED PRECURSOR RNA, of VGAM1800 are further described hereinbelow with reference to Table 1.

Nucleotide sequences of host target binding sites, such as BINDING SITE-I, BINDING SITE-II and BINDING SITE-III of FIG. 1, found on VGAM1800 host target RNA, and schematic representation of the complementarity of each of these host target binding sites to VGAM1800 RNA, herein designated VGAM RNA, are described hereinbelow with reference to Table 2.

As mentioned hereinabove with reference to FIG. 1, a function of VGAM1800 gene, herein designated VGAM is inhibition of expression of VGAM1800 target genes. It is appreciated that specific functions, and accordingly utilities, of VGAM1800 correlate with, and may be deduced from, the identity of the target genes which VGAM1800 binds and inhibits, and the function of these target genes, as elaborated hereinbelow.

Cyclin D2 (CCND2, Accession NM_001759) is a VGAM1800 host target gene. CCND2 BINDING SITE is HOST TARGET binding site found in the 3' untranslated region of mRNA encoded by CCND2, corresponding to a HOST TARGET binding site such as BINDING SITE I, BINDING SITE II or BINDING SITE III. Table 2 illustrates the complementarity of the nucleotide sequences of CCND2 BINDING SITE, designated SEQ ID:7516, to the nucleotide sequence of VGAM1800 RNA, herein designated VGAM RNA, also designated SEQ ID:4511.

A function of VGAM1800 is therefore inhibition of Cyclin D2 (CCND2, Accession NM_001759), a gene which is essential for the control of the cell cycle at the g1/s (start) transition. Accordingly, utilities of VGAM1800 include diagnosis, prevention and treatment of diseases and clinical conditions associated with CCND2. The function of CCND2 and its association with various diseases and clinical conditions, has been established by previous studies, as described hereinabove with reference to VGAM128. Cytochrome P450, Subfamily IVA, Polypeptide 11 (CYP4A11, Accession NM_000778) is another VGAM1800 host target gene. CYP4A11 BINDING SITE is HOST TARGET binding site found in the 3' untranslated region of mRNA encoded by CYP4A11, corresponding to a HOST TARGET binding site such as BINDING SITE I, BINDING SITE II or BINDING SITE III. Table 2 illustrates the complementarity of the nucleotide sequences of CYP4A11 BINDING SITE, designated SEQ ID:6418, to the nucleotide sequence of VGAM1800 RNA, herein designated VGAM RNA, also designated SEQ ID:4511.

Another function of VGAM1800 is therefore inhibition of Cytochrome P450, Subfamily IVA, Polypeptide 11 (CYP4A11, Accession NM_000778), a gene which catalyzes the omega- and (omega-1)-hydroxylation of various fatty acids. Accordingly, utilities of VGAM1800 include diagnosis, prevention and treatment of diseases and clinical conditions associated with CYP4A11. The function of CYP4A11 and its association with various diseases and clinical conditions, has been established by previous studies, as described hereinabove with reference to VGAM798. Leukocyte Immunoglobulin-like Receptor, Subfamily B (with TM and ITIM domains), Member 1 (LILRB1, Accession NM_006669) is another VGAM1800 host target gene. LILRB1 BINDING SITE is HOST TARGET binding site found in the 3' untranslated region of mRNA encoded by LILRB1, corresponding to a HOST TARGET binding site such as BINDING SITE I, BINDING SITE II or BINDING SITE III. Table 2 illustrates the complementarity of the nucleotide sequences of LILRB1 BINDING SITE, designated SEQ ID:13485, to the nucleotide sequence of VGAM1800 RNA, herein designated VGAM RNA, also designated SEQ ID:4511.

Another function of VGAM1800 is therefore inhibition of Leukocyte Immunoglobulin-like Receptor, Subfamily B (with TM and ITIM domains), Member 1 (LILRB1, Accession NM_006669). Accordingly, utilities of VGAM1800 include diagnosis, prevention and treatment of diseases and clinical conditions associated with LILRB1. Vitamin D (1,25-dihydroxyvitamin D3) Receptor (VDR, Accession NM_000376) is another VGAM1800 host target gene. VDR BINDING SITE is HOST TARGET binding site found in the 3" untranslated region of mRNA encoded by VDR, corresponding to a HOST TARGET binding site such as BINDING SITE I, BINDING SITE II or BINDING SITE III. Table 2 illustrates the complementarity of the nucleotide sequences of VDR BINDING SITE, designated SEQ ID:5943, to the nucleotide sequence of VGAM1800 RNA, herein designated VGAM RNA, also designated SEQ ID:4511.

Another function of VGAM1800 is therefore inhibition of Vitamin D (1,25-dihydroxyvitamin D3) Receptor (VDR, Accession NM_000376). Accordingly, utilities of VGAM1800 include diagnosis, prevention and treatment of diseases and clinical conditions associated with VDR. Zinc Finger Protein 217 (ZNF217, Accession NM_006526) is another VGAM1800 host target gene. ZNF217 BINDING SITE is HOST TARGET binding site found in the 3' untranslated region of mRNA encoded by ZNF217, corresponding to a HOST TARGET binding site such as BINDING SITE I, BINDING SITE II or BINDING SITE III. Table 2 illustrates the complementarity of the nucleotide sequences of ZNF217 BINDING SITE, designated SEQ ID:13278, to the nucleotide sequence of VGAM1800 RNA, herein designated VGAM RNA, also designated SEQ ID:4511.

Another function of VGAM1800 is therefore inhibition of Zinc Finger Protein 217 (ZNF217, Accession NM_006526). Accordingly, utilities of VGAM1800 include diagnosis, prevention and treatment of diseases and clinical conditions associated with ZNF217. ATPase, Class V, Type 10B (ATP10B, Accession XM_032721) is another VGAM1800 host target gene. ATP10B BINDING SITE is HOST TARGET binding site found in the 3' untranslated region of mRNA encoded by ATP10B, corresponding to a HOST TARGET binding site such as BINDING SITE I, BINDING SITE II or BINDING SITE III. Table 2 illustrates the complementarity of the nucleotide sequences of ATP10B BINDING SITE, designated SEQ ID:31733, to the nucleotide sequence of VGAM1800 RNA, herein designated VGAM RNA, also designated SEQ ID:4511.

Another function of VGAM1800 is therefore inhibition of ATPase, Class V, Type 10B (ATP10B, Accession XM_032721). Accordingly, utilities of VGAM1800 include diagnosis, prevention and treatment of diseases and clinical conditions associated with ATP10B. FLJ10246 (Accession NM_018038) is another VGAM1800 host target gene. FLJ10246 BINDING SITE is HOST TARGET binding site found in the 3' untranslated region of mRNA encoded by FLJ10246, corresponding to a HOST TARGET binding site such as BINDING SITE I, BINDING SITE II or BINDING SITE III. Table 2 illustrates the complementarity of the nucleotide sequences of FLJ10246 BINDING SITE, designated SEQ ID:19784, to the nucleotide sequence of VGAM1800 RNA, herein designated VGAM RNA, also designated SEQ ID:4511.

Another function of VGAM1800 is therefore inhibition of FLJ10246 (Accession NM_018038). Accordingly, utilities of VGAM1800 include diagnosis, prevention and treatment of diseases and clinical conditions associated with FLJ10246. KIAA0532 (Accession XM_047659) is another VGAM1800 host target gene. KIAA0532 BINDING SITE is HOST TARGET binding site found in the 3' untranslated region of mRNA encoded by KIAA0532, corresponding to a HOST TARGET binding site such as BINDING SITE I, BINDING SITE II or BINDING SITE III. Table 2 illustrates the complementarity of the nucleotide sequences of KIAA0532 BINDING SITE, designated SEQ ID:35021, to the nucleotide sequence of VGAM1800 RNA, herein designated VGAM RNA, also designated SEQ ID:4511.

Another function of VGAM1800 is therefore inhibition of KIAA0532 (Accession XM_047659). Accordingly, utilities of VGAM1800 include diagnosis, prevention and treatment of diseases and clinical conditions associated with KIAA0532. LAK-4P (Accession NM_007267) is another VGAM1800 host target gene. LAK-4P BINDING SITE is HOST TARGET binding site found in the 5' untranslated region of mRNA encoded by LAK-4P, corresponding to a HOST TARGET binding site such as BINDING SITE I, BINDING SITE II or BINDING SITE III. Table 2 illustrates the complementarity of the nucleotide sequences of LAK-4P BINDING SITE, designated SEQ ID:14132, to the nucleotide sequence of VGAM1800 RNA, herein designated VGAM RNA, also designated SEQ ID:4511.

Another function of VGAM1800 is therefore inhibition of LAK-4P (Accession NM_007267). Accordingly, utilities of VGAM1800 include diagnosis, prevention and treatment of diseases and clinical conditions associated with LAK-4P. LOC146517 (Accession XM_085491) is another VGAM1800 host target gene. LOC146517 BINDING SITE is HOST TARGET binding site found in the 3' untranslated region of mRNA encoded by LOC146517, corresponding to a HOST TARGET binding site such as BINDING SITE I, BINDING SITE II or BINDING SITE III. Table 2 illustrates the complementarity of the nucleotide sequences of LOC146517 BINDING SITE, designated SEQ ID:38182, to the nucleotide sequence of VGAM1800 RNA, herein designated VGAM RNA, also designated SEQ ID:4511.

Another function of VGAM1800 is therefore inhibition of LOC146517 (Accession XM_085491). Accordingly, utilities of VGAM1800 include diagnosis, prevention and treatment of diseases and clinical conditions associated with LOC146517. LOC149842 (Accession XM_097745) is another VGAM1800 host target gene. LOC149842 BINDING SITE is HOST TARGET binding site found in the 3' untranslated region of mRNA encoded by LOC149842, corresponding to a HOST TARGET binding site such as BINDING SITE I, BINDING SITE II or BINDING SITE III. Table 2 illustrates the complementarity of the nucleotide sequences of LOC149842 BINDING SITE, designated SEQ ID:41089, to the nucleotide sequence of VGAM1800 RNA, herein designated VGAM RNA, also designated SEQ ID:4511.

Another function of VGAM1800 is therefore inhibition of LOC149842 (Accession XM_097745). Accordingly, utilities of VGAM1800 include diagnosis, prevention and treatment of diseases and clinical conditions associated with LOC149842. LOC254243 (Accession XM_173233) is another VGAM1800 host target gene. LOC254243 BINDING SITE is HOST TARGET binding site found in the 3' untranslated region of mRNA encoded by LOC254243, corresponding to a HOST TARGET binding site such as BINDING SITE I, BINDING SITE II or BINDING SITE III. Table 2 illustrates the complementarity of the nucleotide sequences of LOC254243 BINDING SITE, designated SEQ ID:46513, to the nucleotide sequence of VGAM1800 RNA, herein designated VGAM RNA, also designated SEQ ID:4511.

Another function of VGAM1800 is therefore inhibition of LOC254243 (Accession XM_173233). Accordingly, utilities of VGAM1800 include diagnosis, prevention and treatment of diseases and clinical conditions associated with LOC254243. LOC254413 (Accession XM_173141) is another VGAM1800 host target gene. LOC254413 BINDING SITE is HOST TARGET binding site found in the 5' untranslated region of mRNA encoded by LOC254413, corresponding to a HOST TARGET binding site such as BINDING SITE I, BINDING SITE II or BINDING SITE III. Table 2 illustrates the complementarity of the nucleotide sequences of LOC254413 BINDING SITE, designated SEQ ID:46402, to the nucleotide sequence of VGAM1800 RNA, herein designated VGAM RNA, also designated SEQ ID:4511.

Another function of VGAM1800 is therefore inhibition of LOC254413 (Accession XM_173141). Accordingly, utilities of VGAM1800 include diagnosis, prevention and treatment of diseases and clinical conditions associated with LOC254413. LOC90038 (Accession XM_028305) is another VGAM1800 host target gene. LOC90038 BINDING SITE is HOST TARGET binding site found in the 3' untranslated region of mRNA encoded by LOC90038, corresponding to a HOST TARGET binding site such as BINDING SITE I, BINDING SITE II or BINDING SITE III. Table 2 illustrates the complementarity of the nucleotide sequences of LOC90038 BINDING SITE, designated SEQ ID:30650, to the nucleotide sequence of VGAM1800 RNA, herein designated VGAM RNA, also designated SEQ ID:4511.

Another function of VGAM1800 is therefore inhibition of LOC90038 (Accession XM_028305). Accordingly, utilities of VGAM1800 include diagnosis, prevention and treatment of diseases and clinical conditions associated with LOC90038. FIG. 1 further provides a conceptual description of a novel bioinformatically detected viral gene of the present invention, referred to here as Viral Genomic Address Messenger 1801 (VGAM1801) viral gene, which modulates expression of respective host target genes thereof, the function and utility of which host target genes is known in the art.

VGAM1801 is a novel bioinformatically detected regulatory, non protein coding, viral micro RNA (miRNA) gene. The method by which VGAM1801 was detected is described hereinabove with reference to FIGS. 1-8.

VGAM1801 gene, herein designated VGAM GENE, is a viral gene contained in the genome of Tupaia Herpesvirus. VGAM1801 host target gene, herein designated VGAM HOST TARGET GENE, is a human gene contained in the human genome.

VGAM1801 gene encodes a VGAM1801 precursor RNA, herein designated VGAM PRECURSOR RNA. Similar to other miRNA genes, and unlike most ordinary genes, VGAM1801 precursor RNA does not encode a protein. A nucleotide sequence identical or highly similar to the nucleotide sequence of VGAM1801 precursor RNA is designated SEQ ID:1787, and is provided hereinbelow with reference to the sequence listing part. Nucleotide sequence SEQ ID:1787 is located at position 28609 relative to the genome of Tupaia Herpesvirus.

VGAM1801 precursor RNA folds onto itself, forming VGAM1801 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1801 folded precursor RNA into VGAM1801 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1801 RNA is designated SEQ ID:4512, and is provided hereinbelow with reference to the sequence listing part.

VGAM1801 host target gene, herein designated VGAM HOST TARGET GENE, encodes a corresponding messenger RNA, VGAM1801 host target RNA, herein designated VGAM HOST TARGET RNA. VGAM1801 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1801 RNA, herein designated VGAM RNA, binds complementarily to one or more host target binding sites located in untranslated regions of VGAM1801 host target RNA, herein designated VGAM HOST TARGET RNA. This complementary binding is due to the fact that the nucleotide sequence of VGAM1801 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1801 RNA, herein designated VGAM RNA, may have a different number of host target binding sites in untranslated regions of a VGAM1801 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1801 RNA, herein designated VGAM RNA, to host target binding sites on VGAM1801 host target RNA, herein designated VGAM HOST TARGET RNA, such as BINDING SITE I, BINDING SITE II and BINDING SITE III, inhibits translation of VGAM1801 host target RNA into VGAM1801 host target protein, herein designated VGAM HOST TARGET PROTEIN. VGAM host target protein is therefore outlined by a broken line.

It is appreciated that VGAM1801 host target gene, herein designated VGAM HOST TARGET GENE, in fact represents a plurality of VGAM1801 host target genes. The mRNA of each one of this plurality of VGAM1801 host target genes comprises one or more host target binding sites, each having a nucleotide sequence which is at least partly complementary to VGAM1801 RNA, herein designated VGAM RNA, and which when bound by VGAM1801 RNA causes inhibition of translation of respective one or more VGAM1801 host target proteins.

It is further appreciated by one skilled in the art that the mode of translational inhibition illustrated by FIG. 1 with specific reference to translational inhibition exerted by VGAM1801 gene, herein designated VGAM GENE, on one or more VGAM1801 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1801 is inhibition of expression of host target genes, as part of a novel viral mechanism of attacking a host. Accordingly, utilities of VGAM1801 include diagnosis, prevention and treatment of viral infection by Tupaia Herpesvirus. Specific functions, and accordingly utilities, of VGAM1801 correlate with, and may be deduced from, the identity of the host target genes which VGAM1801 binds and inhibits, and the function of these host target genes, as elaborated hereinbelow.

Nucleotide sequences of the VGAM1801 precursor RNA, herein designated VGAM PRECURSOR RNA, and of the 'diced' VGAM1801 RNA, herein designated VGAM RNA, and a schematic representation of the secondary folding of VGAM1801 folded precursor RNA, herein designated VGAM FOLDED PRECURSOR RNA, of VGAM1801 are further described hereinbelow with reference to Table 1.

Nucleotide sequences of host target binding sites, such as BINDING SITE-I, BINDING SITE-II and BINDING SITE-III of FIG. 1, found on VGAM1801 host target RNA, and schematic representation of the complementarity of each of these host target binding sites to VGAM1801 RNA, herein designated VGAM RNA, are described hereinbelow with reference to Table 2.

As mentioned hereinabove with reference to FIG. 1, a function of VGAM1801 gene, herein designated VGAM is inhibition of expression of VGAM1801 target genes. It is appreciated that specific functions, and accordingly utilities, of VGAM1801 correlate with, and may be deduced from, the identity of the target genes which VGAM1801 binds and inhibits, and the function of these target genes, as elaborated hereinbelow.

COAS3 (Accession NM_139020) is a VGAM1801 host target gene. COAS3 BINDING SITE is HOST TARGET binding site found in the 3' untranslated region of mRNA encoded by COAS3, corresponding to a HOST TARGET binding site such as BINDING SITE I, BINDING SITE II or BINDING SITE III. Table 2 illustrates the complementarity of the nucleotide sequences of COAS3 BINDING SITE, designated SEQ ID:29121, to the nucleotide sequence of VGAM1801 RNA, herein designated VGAM RNA, also designated SEQ ID:4512.

A function of VGAM1801 is therefore inhibition of COAS3 (Accession NM_139020). Accordingly, utilities of VGAM1801 include diagnosis, prevention and treatment of diseases and clinical conditions associated with COAS3. FIG. 1 further provides a conceptual description of a novel bioinformatically detected viral gene of the present invention, referred to here as Viral Genomic Address Messenger 1802 (VGAM1802) viral gene, which modulates expression of respective host target genes thereof, the function and utility of which host target genes is known in the art.

VGAM1802 is a novel bioinformatically detected regulatory, non protein coding, viral micro RNA (miRNA) gene. The method by which VGAM1802 was detected is described hereinabove with reference to FIGS. 1-8.

VGAM1802 gene, herein designated VGAM GENE, is a viral gene contained in the genome of Tupaia Herpesvirus. VGAM1802 host target gene, herein designated VGAM HOST TARGET GENE, is a human gene contained in the human genome.

VGAM1802 gene encodes a VGAM1802 precursor RNA, herein designated VGAM PRECURSOR RNA. Similar to other miRNA genes, and unlike most ordinary genes, VGAM1802 precursor RNA does not encode a protein. A nucleotide sequence identical or highly similar to the nucleotide sequence of VGAM1802 precursor RNA is designated SEQ ID:1788, and is provided hereinbelow with reference to the sequence listing part. Nucleotide sequence SEQ ID:1788 is located at position 27372 relative to the genome of Tupaia Herpesvirus.

VGAM1802 precursor RNA folds onto itself, forming VGAM1802 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1802 folded precursor RNA into VGAM1802 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1802 RNA is designated SEQ ID:4513, and is provided hereinbelow with reference to the sequence listing part.

VGAM1802 host target gene, herein designated VGAM HOST TARGET GENE, encodes a corresponding messenger RNA, VGAM1802 host target RNA, herein designated VGAM HOST TARGET RNA. VGAM1802 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1802 RNA, herein designated VGAM RNA, binds complementarily to one or more host target binding sites located in untranslated regions of VGAM1802 host target RNA, herein designated VGAM HOST TARGET RNA. This complementary binding is due to the fact that the nucleotide sequence of VGAM1802 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1802 RNA, herein designated VGAM RNA, may have a different number of host target binding sites in untranslated regions of a VGAM1802 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1802 RNA, herein designated VGAM RNA, to host target binding sites on VGAM1802 host target RNA, herein designated VGAM HOST TARGET RNA, such as BINDING SITE I, BINDING SITE II and BINDING SITE III, inhibits translation of VGAM1802 host target RNA into VGAM1802 host target protein, herein designated VGAM HOST TARGET PROTEIN. VGAM host target protein is therefore outlined by a broken line.

It is appreciated that VGAM1802 host target gene, herein designated VGAM HOST TARGET GENE, in fact represents a plurality of VGAM1802 host target genes. The mRNA of each one of this plurality of VGAM1802 host target genes comprises one or more host target binding sites, each having a nucleotide sequence which is at least partly complementary to VGAM1802 RNA, herein designated VGAM RNA, and which when bound by VGAM1802 RNA causes inhibition of translation of respective one or more VGAM1802 host target proteins.

It is further appreciated by one skilled in the art that the mode of translational inhibition illustrated by FIG. 1 with specific reference to translational inhibition exerted by VGAM1802 gene, herein designated VGAM GENE, on one or more VGAM1802 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1802 is inhibition of expression of host target genes, as part of a novel viral mechanism of attacking a host. Accordingly, utilities of VGAM1802 include diagnosis, prevention and treatment of viral infection by Tupaia Herpesvirus. Specific functions, and accordingly utilities, of VGAM1802 correlate with, and may be deduced from, the identity of the host target genes which VGAM1802 binds and inhibits, and the function of these host target genes, as elaborated hereinbelow.

Nucleotide sequences of the VGAM1802 precursor RNA, herein designated VGAM PRECURSOR RNA, and of the 'diced' VGAM1802 RNA, herein designated VGAM RNA, and a schematic representation of the secondary folding of VGAM1802 folded precursor RNA, herein designated VGAM FOLDED PRECURSOR RNA, of VGAM1802 are further described hereinbelow with reference to Table 1.

Nucleotide sequences of host target binding sites, such as BINDING SITE-I, BINDING SITE-II and BINDING SITE-III of FIG. 1, found on VGAM1802 host target RNA, and schematic representation of the complementarity of each of these host target binding sites to VGAM1802 RNA, herein designated VGAM RNA, are described hereinbelow with reference to Table 2.

As mentioned hereinabove with reference to FIG. 1, a function of VGAM1802 gene, herein designated VGAM is inhibition of expression of VGAM1802 target genes. It is appreciated that specific functions, and accordingly utilities, of VGAM1802 correlate with, and may be deduced from, the identity of the target genes which VGAM1802 binds and inhibits, and the function of these target genes, as elaborated hereinbelow.

MGC11061 (Accession NM_032312) is a VGAM1802 host target gene. MGC11061 BINDING SITE is HOST TARGET binding site found in the 3' untranslated region of mRNA encoded by MGC11061, corresponding to a HOST TARGET binding site such as BINDING SITE I, BINDING SITE II or BINDING SITE III. Table 2 illustrates the complementarity of the nucleotide sequences of MGC11061 BINDING SITE, designated SEQ ID:26115, to the nucleotide sequence of VGAM1802 RNA, herein designated VGAM RNA, also designated SEQ ID:4513.

A function of VGAM1802 is therefore inhibition of MGC11061 (Accession NM_032312). Accordingly, utilities of VGAM1802 include diagnosis, prevention and treatment of diseases and clinical conditions associated with MGC11061. FIG. 1 further provides a conceptual description of a novel bioinformatically detected viral gene of the present invention, referred to here as Viral Genomic Address Messenger 1803 (VGAM1803) viral gene, which modulates expression of respective host target genes thereof, the function and utility of which host target genes is known in the art.

VGAM1803 is a novel bioinformatically detected regulatory, non protein coding, viral micro RNA (miRNA) gene. The method by which VGAM1803 was detected is described hereinabove with reference to FIGS. 1-8.

VGAM1803 gene, herein designated VGAM GENE, is a viral gene contained in the genome of Tupaia Herpesvirus. VGAM1803 host target gene, herein designated VGAM HOST TARGET GENE, is a human gene contained in the human genome.

VGAM1803 gene encodes a VGAM1803 precursor RNA, herein designated VGAM PRECURSOR RNA. Similar to other miRNA genes, and unlike most ordinary genes, VGAM1803 precursor RNA does not encode a protein. A nucleotide sequence identical or highly similar to the nucleotide sequence of VGAM1803 precursor RNA is designated SEQ ID:1789, and is provided hereinbelow with reference to the sequence listing part. Nucleotide sequence SEQ ID:1789 is located at position 29560 relative to the genome of Tupaia Herpesvirus.

VGAM1803 precursor RNA folds onto itself, forming VGAM1803 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1803 folded precursor RNA into VGAM1803 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1803 RNA is designated SEQ ID:4514, and is provided hereinbelow with reference to the sequence listing part.

VGAM1803 host target gene, herein designated VGAM HOST TARGET GENE, encodes a corresponding messenger RNA, VGAM1803 host target RNA, herein designated VGAM HOST TARGET RNA. VGAM1803 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1803 RNA, herein designated VGAM RNA, binds complementarily to one or more host target binding sites located in untranslated regions of VGAM1803 host target RNA, herein designated VGAM HOST TARGET RNA. This complementary binding is due to the fact that the nucleotide sequence of VGAM1803 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1803 RNA, herein designated VGAM RNA, may have a different number of host target binding sites in untranslated regions of a VGAM1803 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1803 RNA, herein designated VGAM RNA, to host target binding sites on VGAM1803 host target RNA, herein designated VGAM HOST TARGET RNA, such as BINDING SITE I, BINDING SITE II and BINDING SITE III, inhibits translation of VGAM1803 host target RNA into VGAM1803 host target protein, herein designated VGAM HOST TARGET PROTEIN. VGAM host target protein is therefore outlined by a broken line.

It is appreciated that VGAM1803 host target gene, herein designated VGAM HOST TARGET GENE, in fact represents a plurality of VGAM1803 host target genes. The mRNA of each one of this plurality of VGAM1803 host target genes comprises one or more host target binding sites, each having a nucleotide sequence which is at least partly complementary to VGAM1803 RNA, herein designated VGAM RNA, and which when bound by VGAM1803 RNA causes inhibition of translation of respective one or more VGAM1803 host target proteins.

It is further appreciated by one skilled in the art that the mode of translational inhibition illustrated by FIG. 1 with specific reference to translational inhibition exerted by VGAM1803 gene, herein designated VGAM GENE, on one or more VGAM1803 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1803 is inhibition of expression of host target genes, as part of a novel viral mechanism of attacking a host. Accordingly, utilities of VGAM1803 include diagnosis, prevention and treatment of viral infection by Tupaia Herpesvirus. Specific functions, and accordingly utilities, of VGAM1803 correlate with, and may be deduced from, the identity of the host target genes which VGAM1803 binds and inhibits, and the function of these host target genes, as elaborated hereinbelow.

Nucleotide sequences of the VGAM1803 precursor RNA, herein designated VGAM PRECURSOR RNA, and of the 'diced' VGAM1803 RNA, herein designated VGAM RNA, and a schematic representation of the secondary folding of VGAM1803 folded precursor RNA, herein designated VGAM FOLDED PRECURSOR RNA, of VGAM1803 are further described hereinbelow with reference to Table 1.

Nucleotide sequences of host target binding sites, such as BINDING SITE-I, BINDING SITE-II and BINDING SITE-III of FIG. 1, found on VGAM1803 host target RNA, and schematic representation of the complementarity of each of these host target binding sites to VGAM1803 RNA, herein designated VGAM RNA, are described hereinbelow with reference to Table 2.

As mentioned hereinabove with reference to FIG. 1, a function of VGAM1803 gene, herein designated VGAM is inhibition of expression of VGAM1803 target genes. It is appreciated that specific functions, and accordingly utilities, of VGAM1803 correlate with, and may be deduced from, the identity of the target genes which VGAM1803 binds and inhibits, and the function of these target genes, as elaborated hereinbelow.

Chromosome 20 Open Reading Frame 177 (C20orf177, Accession XM_030726) is a VGAM1803 host target gene. C20orf177 BINDING SITE is HOST TARGET binding site found in the 3' untranslated region of mRNA encoded by C20orf177, corresponding to a HOST TARGET binding site such as BINDING SITE I, BINDING SITE II or BINDING SITE III. Table 2 illustrates the complementarity of the nucleotide sequences of C20orf177 BINDING SITE, designated SEQ ID:31128, to the nucleotide sequence of VGAM1803 RNA, herein designated VGAM RNA, also designated SEQ ID:4514.

A function of VGAM1803 is therefore inhibition of Chromosome 20 Open Reading Frame 177 (C20orf177, Accession XM_030726). Accordingly, utilities of VGAM1803 include diagnosis, prevention and treatment of diseases and clinical conditions associated with C20orf177. FIG. 1 further provides a conceptual description of a novel bioinformatically detected viral gene of the present invention, referred to here as Viral Genomic Address Messenger 1804 (VGAM1804) viral gene, which modulates expression of respective host target genes thereof, the function and utility of which host target genes is known in the art.

VGAM1804 is a novel bioinformatically detected regulatory, non protein coding, viral micro RNA (miRNA) gene. The method by which VGAM1804 was detected is described hereinabove with reference to FIGS. 1-8.

VGAM1804 gene, herein designated VGAM GENE, is a viral gene contained in the genome of Tupaia Herpesvirus. VGAM1804 host target gene, herein designated VGAM HOST TARGET GENE, is a human gene contained in the human genome.

VGAM1804 gene encodes a VGAM1804 precursor RNA, herein designated VGAM PRECURSOR RNA. Similar to other miRNA genes, and unlike most ordinary genes, VGAM1804 precursor RNA does not encode a protein. A nucleotide sequence identical or highly similar to the nucleotide sequence of VGAM1804 precursor RNA is designated SEQ ID:1790, and is provided hereinbelow with reference to the sequence listing part. Nucleotide sequence SEQ ID:1790 is located at position 30515 relative to the genome of Tupaia Herpesvirus.

VGAM1804 precursor RNA folds onto itself, forming VGAM1804 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1804 folded precursor RNA into VGAM1804 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM1804 RNA is designated SEQ ID:4515, and is provided hereinbelow with reference to the sequence listing part.

VGAM1804 host target gene, herein designated VGAM HOST TARGET GENE, encodes a corresponding messenger RNA, VGAM1804 host target RNA, herein designated VGAM HOST TARGET RNA. VGAM1804 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1804 RNA, herein designated VGAM RNA, binds complementarily to one or more host target binding sites located in untranslated regions of VGAM1804 host target RNA, herein designated VGAM HOST TARGET RNA. This complementary binding is due to the fact that the nucleotide sequence of VGAM1804 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1804 RNA, herein designated VGAM RNA, may have a different number of host target binding sites in untranslated regions of a VGAM1804 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1804 RNA, herein designated VGAM RNA, to host target binding sites on VGAM1804 host target RNA, herein designated VGAM HOST TARGET RNA, such as BINDING SITE I, BINDING SITE II and BINDING SITE III, inhibits translation of VGAM1804 host target RNA into VGAM1804 host target protein, herein designated VGAM HOST TARGET PROTEIN. VGAM host target protein is therefore outlined by a broken line.

It is appreciated that VGAM1804 host target gene, herein designated VGAM HOST TARGET GENE, in fact represents a plurality of VGAM1804 host target genes. The mRNA of each one of this plurality of VGAM1804 host target genes comprises one or more host target binding sites, each having a nucleotide sequence which is at least partly complementary to VGAM1804 RNA, herein designated VGAM RNA, and which when bound by VGAM1804 RNA causes inhibition of translation of respective one or more VGAM1804 host target proteins.

It is further appreciated by one skilled in the art that the mode of translational inhibition illustrated by FIG. 1 with specific reference to translational inhibition exerted by VGAM1804 gene, herein designated VGAM GENE, on one or more VGAM1804 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1804 is inhibition of expression of host target genes, as part of a novel viral mechanism of attacking a host. Accordingly, utilities of VGAM1804 include diagnosis, prevention and treatment of viral infection by Tupaia Herpesvirus. Specific functions, and accordingly utilities, of VGAM1804 correlate with, and may be deduced from, the identity of the host target genes which VGAM1804 binds and inhibits, and the function of these host target genes, as elaborated hereinbelow.

Nucleotide sequences of the VGAM1804 precursor RNA, herein designated VGAM PRECURSOR RNA, and of the 'diced' VGAM1804 RNA, herein designated VGAM RNA, and a schematic representation of the secondary folding of VGAM1804 folded precursor RNA, herein designated VGAM FOLDED PRECURSOR RNA, of VGAM1804 are further described hereinbelow with reference to Table 1.

Nucleotide sequences of host target binding sites, such as BINDING SITE-I, BINDING SITE-II and BINDING SITE-III of FIG. 1, found on VGAM1804 host target RNA, and schematic representation of the complementarity of each of these host target binding sites to VGAM1804 RNA, herein designated VGAM RNA, are described hereinbelow with reference to Table 2.

As mentioned hereinabove with reference to FIG. 1, a function of VGAM1804 gene, herein designated VGAM is inhibition of expression of VGAM1804 target genes. It is appreciated that specific functions, and accordingly utilities, of VGAM1804 correlate with, and may be deduced from, the identity of the target genes which VGAM1804 binds and inhibits, and the function of these target genes, as elaborated hereinbelow.

Chemokine (C-C motif) Receptor 2 (CCR2, Accession NM_000647) is a VGAM1804 host target gene. CCR2 BINDING SITE is HOST TARGET binding site found in the 3' untranslated region of mRNA encoded by CCR2, corresponding to a HOST TARGET binding site such as BINDING SITE I, BINDING SITE II or BINDING SITE III. Table 2 illustrates the complementarity of the nucleotide sequences of CCR2 BINDING SITE, designated SEQ ID:6310, to the nucleotide sequence of VGAM1804 RNA, herein designated VGAM RNA, also designated SEQ ID:4515.

A function of VGAM1804 is therefore inhibition of Chemokine (C-C motif) Receptor 2 (CCR2, Accession NM_000647), a gene which binds chemokines and transduces a signal by increasing the intracellular calcium ions level. Accordingly, utilities of VGAM1804 include diagnosis, prevention and treatment of diseases and clinical conditions associated with CCR2. The function of CCR2 and its association with various diseases and clinical conditions, has been established by previous studies, as described hereinabove with reference to VGAM206. Mannose-binding Lectin (protein C) 2, Soluble (opsonic defect) (MBL2, Accession NM_000242) is another VGAM1804 host target gene. MBL2 BINDING SITE is HOST TARGET binding site found in the 3' untranslated region of mRNA encoded by MBL2, corresponding to a HOST TARGET binding site such as BINDING SITE I, BINDING SITE II or BINDING SITE III. Table 2 illustrates the complementarity of the nucleotide sequences of MBL2 BINDING SITE, designated SEQ ID:5764, to the nucleotide sequence of VGAM1804 RNA, herein designated VGAM RNA, also designated SEQ ID:4515.

Another function of VGAM1804 is therefore inhibition of Mannose-binding Lectin (protein C) 2, Soluble (opsonic defect) (MBL2, Accession NM_000242). Accordingly, utilities of VGAM1804 include diagnosis, prevention and treatment of diseases and clinical conditions associated with MBL2. PDGFA Associated Protein 1 (PDAP1, Accession XM_166484) is another VGAM1804 host target gene. PDAP1 BINDING SITE is HOST TARGET binding site found in the 3' untranslated region of mRNA encoded by PDAP1, corresponding to a HOST TARGET binding site such as BINDING SITE I, BINDING SITE II or BINDING SITE III. Table 2 illustrates the complementarity of the nucleotide sequences of PDAP1 BINDING SITE, designated SEQ ID:44419, to the nucleotide sequence of VGAM1804 RNA, herein designated VGAM RNA, also designated SEQ ID:4515.

Another function of VGAM1804 is therefore inhibition of PDGFA Associated Protein 1 (PDAP1, Accession XM_166484). Accordingly, utilities of VGAM1804 include diagnosis, prevention and treatment of diseases and clinical conditions associated with PDAP1. KIAA1668 (Accession XM_039236) is another VGAM1804 host target gene. KIAA1668 BINDING SITE is HOST TARGET binding site found in the 3' untranslated region of mRNA encoded by KIAA1668, corresponding to a HOST TARGET binding site such as BINDING SITE I, BINDING SITE II or BINDING SITE III. Table 2 illustrates the complementarity of the nucleotide sequences of KIAA1668 BINDING SITE, designated SEQ ID:33026, to the nucleotide sequence of VGAM1804 RNA, herein designated VGAM RNA, also designated SEQ ID:4515.

Another function of VGAM1804 is therefore inhibition of KIAA1668 (Accession XM_039236). Accordingly, utilities of VGAM1804 include diagnosis, prevention and treatment of diseases and clinical conditions associated with KIAA1668. FIG. 1 further provides a conceptual description of a novel bioinformatically detected viral gene of the present invention, referred to here as Viral Genomic Address Messenger 1805 (VGAM1805) viral gene, which modulates expression of respective host target genes thereof, the function and utility of which host target genes is known in the art.

VGAM1805 is a novel bioinformatically detected regulatory, non protein coding, viral micro RNA (miRNA) gene. The method by which VGAM1805 was detected is described hereinabove with reference to FIGS. 1-8.

VGAM1805 gene, herein designated VGAM GENE, is a viral gene contained in the genome of Tupaia Herpesvirus. VGAM1805 host target gene, herein designated VGAM HOST TARGET GENE, is a human gene contained in the human genome.

VGAM1805 gene encodes a VGAM1805 precursor RNA, herein designated VGAM PRECURSOR RNA. Similar to other miRNA genes, and unlike most ordinary genes, VGAM1805 precursor RNA does not encode a protein. A nucleotide sequence identical or highly similar to the nucleotide sequence of VGAM1805 precursor RNA is designated SEQ ID:1791, and is provided hereinbelow with reference to the sequence listing part. Nucleotide sequence SEQ ID:1791 is located at position 33339 relative to the genome of Tupaia Herpesvirus.

VGAM1805 precursor RNA folds onto itself, forming VGAM1805 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1805 folded precursor RNA into VGAM1805 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1805 RNA is designated SEQ ID:4516, and is provided hereinbelow with reference to the sequence listing part.

VGAM1805 host target gene, herein designated VGAM HOST TARGET GENE, encodes a corresponding messenger RNA, VGAM1805 host target RNA, herein designated VGAM HOST TARGET RNA. VGAM1805 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1805 RNA, herein designated VGAM RNA, binds complementarily to one or more host target binding sites located in untranslated regions of VGAM1805 host target RNA, herein designated VGAM HOST TARGET RNA. This complementary binding is due to the fact that the nucleotide sequence of VGAM1805 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1805 RNA, herein designated VGAM RNA, may have a different number of host target binding sites in untranslated regions of a VGAM1805 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1805 RNA, herein designated VGAM RNA, to host target binding sites on VGAM1805 host target RNA, herein designated VGAM HOST TARGET RNA, such as BINDING SITE I, BINDING SITE II and BINDING SITE III, inhibits translation of VGAM1805 host target RNA into VGAM1805 host target protein, herein designated VGAM HOST TARGET PROTEIN. VGAM host target protein is therefore outlined by a broken line.

It is appreciated that VGAM1805 host target gene, herein designated VGAM HOST TARGET GENE, in fact represents a plurality of VGAM1805 host target genes. The mRNA of each one of this plurality of VGAM1805 host target genes comprises one or more host target binding sites, each having a nucleotide sequence which is at least partly complementary to VGAM1805 RNA, herein designated VGAM RNA, and which when bound by VGAM1805 RNA causes inhibition of translation of respective one or more VGAM1805 host target proteins.

It is further appreciated by one skilled in the art that the mode of translational inhibition illustrated by FIG. 1 with specific reference to translational inhibition exerted by VGAM1805 gene, herein designated VGAM GENE, on one or more VGAM1805 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1805 is inhibition of expression of host target genes, as part of a novel viral mechanism of attacking a host. Accordingly, utilities of VGAM1805 include diagnosis, prevention and treatment of viral infection by Tupaia Herpesvirus. Specific functions, and accordingly utilities, of VGAM1805 correlate with, and may be deduced from, the identity of the host target genes which VGAM1805 binds and inhibits, and the function of these host target genes, as elaborated hereinbelow.

Nucleotide sequences of the VGAM1805 precursor RNA, herein designated VGAM PRECURSOR RNA, and of the 'diced' VGAM1805 RNA, herein designated VGAM RNA, and a schematic representation of the secondary folding of VGAM1805 folded precursor RNA, herein designated VGAM FOLDED PRECURSOR RNA, of VGAM1805 are further described hereinbelow with reference to Table 1.

Nucleotide sequences of host target binding sites, such as BINDING SITE-I, BINDING SITE-II and BINDING SITE-III of FIG. 1, found on VGAM1805 host target RNA, and schematic representation of the complementarity of each of these host target binding sites to VGAM1805 RNA, herein designated VGAM RNA, are described hereinbelow with reference to Table 2.

As mentioned hereinabove with reference to FIG. 1, a function of VGAM1805 gene, herein designated VGAM is inhibition of expression of VGAM1805 target genes. It is appreciated that specific functions, and accordingly utilities, of VGAM1805 correlate with, and may be deduced from, the identity of the target genes which VGAM1805 binds and inhibits, and the function of these target genes, as elaborated hereinbelow.

Alcohol Dehydrogenase IB (class I), Beta Polypeptide (ADH1B, Accession XM_052365) is a VGAM1805 host target gene. ADH1B BINDING SITE is HOST TARGET binding site found in the 3' untranslated region of mRNA encoded by ADH1B, corresponding to a HOST TARGET binding site such as BINDING SITE I, BINDING SITE II or BINDING SITE III. Table 2 illustrates the complementarity of the nucleotide sequences of ADH1B BINDING SITE, designated SEQ ID:35960, to the nucleotide sequence of VGAM1805 RNA, herein designated VGAM RNA, also designated SEQ ID:4516.

A function of VGAM1805 is therefore inhibition of Alcohol Dehydrogenase IB (class I), Beta Polypeptide (ADH1B, Accession XM_052365), a gene which Alcohol dehydrogenase 2 (alcohol:NAD+ oxidoreductase) class I beta subunit. Accordingly, utilities of VGAM1805 include diagnosis, prevention and treatment of diseases and clinical conditions associated with ADH1B. The function of ADH1B has been established by previous studies. See 103700 for evidence on the mapping of the ADH2 gene in the cluster of related genes on 4q22. According to the conclusion of Smith et al. (1973), locus ADH2 is expressed in the lung in early fetal life and remains active in this tissue throughout life. It is active also in liver after about the first trimester and gradually increases in activity so that in adults this locus is responsible for most of the liver ADH activity. It is active in the adult kidney. The 'atypical pH ratiO' phenotype is probably determined by a variant allele at the ADH2 locus. Stamatoyannopoulos et al. (1975) found that 85% of Japanese carry an atypical liver ADH (ADH2 type). About the same proportion have alcohol sensitivity, which they suggest may be due to increased formation of acetaldehyde by persons with the atypical ADH. Bosron et al. (1980) found new molecular forms of human ADH, collectively designated ADH(Indianapolis), in 29% of liver specimens from black Americans. Three different Indianapolis ADH phenotypes were identified by starch gel electrophoresis and 4 isolated by affinity and ion-exchange chromatography. One is a homodimer of a newly discovered subunit. The other 3 are heterodimers of this new subunit and the known subunits, alpha, beta-1, and gamma-1. Agarwal et al. (1981) could find no instance of the Indianapolis variant in Germany or Japan; it may be confined to American blacks. Bosron et al. (1983) concluded that the Indianapolis phenotypes reflect polymorphism at the ADH2 locus with the variant ADH(Indianapolis) allele coding for the beta-Indianapolis subunit. The frequency of this allele was 0.16 in black Americans and was not found in any of 63 livers from white Americans. The frequency of alleles at the ADH3 locus also differs in these 2 populations. Two of the 3 class I genes (ADHB and ADHC) are known to have alleles that produce enzymes that catalyze the oxidation of ethanol at different rates. At the protein level, the allelic series for ADH1B is generated by variation at 2 different sites at the genomic level: the ADH1B*1 allele is composed of 47 arg and 369 arg, the ADH1B*2 allele is composed of 47 his and 369 arg (see OMIM Ref. No. 103720.0001), and the ADH1B*3 allele (103720.0002) is composed of 47 arg and 369 cys. Osier et al. (2002) stated that the 'double variant' (composed of 47 his and 369 cys) could exist but had not been observed.

Full details of the abovementioned studies are described in the following publications, the disclosure of which are hereby incorporated by reference:

Bosron, W. F.; Magnes, L. J.; Li, T.-K.: Human liver alcohol dehydrogenase: ADH(Indianapolis) results from genetic polymorphism at the ADH-2 gene locus. Biochem. Genet. 21:735-744, 1983; and Osier, M. V.; Pakstis, A. J.; Soodyall, H.; Comas, D.; Goldman, D.; Odunsi, A.; Okonofua, F.; Parnas, J.; Schulz, L. O.; Bertranpetit, J.; Bonne-Tamir, B.; Lu, R.-B.; Kidd, J. R.; Kidd.

Further studies establishing the function and utilities of ADH1B are found in John Hopkins OMIM database record ID 103720, and in sited publications numbered 819-822, 4161, 12101-829, 12096, 12102, 378 and 12103-503 listed in the bibliography section hereinbelow, which are also hereby incorporated by reference. Core-binding Factor, Runt Domain, Alpha Subunit 2; Translocated To, 1; Cyclin D-related (CBFA2T1, Accession NM_004349) is another VGAM1805 host target gene. CBFA2T1 BINDING SITE is HOST TARGET binding site found in the 3' untranslated region of mRNA encoded by CBFA2T1, corresponding to a HOST TARGET binding site such as BINDING SITE I, BINDING SITE II or BINDING SITE III. Table 2 illustrates the complementarity of the nucleotide sequences of CBFA2T1 BINDING SITE, designated SEQ ID:10542, to the nucleotide sequence of VGAM1805 RNA, herein designated VGAM RNA, also designated SEQ ID:4516.

Another function of VGAM1805 is therefore inhibition of Core-binding Factor, Runt Domain, Alpha Subunit 2; Translocated To, 1; Cyclin D-related (CBFA2T1, Accession NM_004349), a gene which produces a chimeric gene made up of the 5-prime region of the AML1 gene fused to the 3-prime region of the ETO gene through translocation. Accordingly, utilities of VGAM1805 include diagnosis, prevention and treatment of diseases and clinical conditions associated with CBFA2T1. The function of CBFA2T1 and its association with various diseases and clinical conditions, has been established by previous studies, as described hereinabove with reference to VGAM113. Doublesex and Mab-3 Related Transcription Factor 1 (DMRT1, Accession NM_021951) is another VGAM1805 host target gene. DMRT1 BINDING SITE is HOST TARGET binding site found in the 3' untranslated region of mRNA encoded by DMRT1, corresponding to a HOST TARGET binding site such as BINDING SITE I, BINDING SITE II or BINDING SITE III. Table 2 illustrates the complementarity of the nucleotide sequences of DMRT1 BINDING SITE, designated SEQ ID:22480, to the nucleotide sequence of VGAM1805 RNA, herein designated VGAM RNA, also designated SEQ ID:4516.

Another function of VGAM1805 is therefore inhibition of Doublesex and Mab-3 Related Transcription Factor 1 (DMRT1, Accession NM_021951), a gene which May be involved in male sexual development. Accordingly, utilities of VGAM1805 include diagnosis, prevention and treatment of diseases and clinical conditions associated with DMRT1. The function of DMRT1 and its association with various diseases and clinical conditions, has been established by previous studies, as described hereinabove with reference to VGAM59. Early Growth Response 3 (EGR3, Accession XM_005040) is another VGAM1805 host target gene. EGR3 BINDING SITE is HOST TARGET binding site found in the 3' untranslated region of mRNA encoded by EGR3, corresponding to a HOST TARGET binding site such as BINDING SITE I, BINDING SITE II or BINDING SITE III. Table 2 illustrates the complementarity of the nucleotide sequences of EGR3 BINDING SITE, designated SEQ ID:29961, to the nucleotide sequence of VGAM1805 RNA, herein designated VGAM RNA, also designated SEQ ID:4516.

Another function of VGAM1805 is therefore inhibition of Early Growth Response 3 (EGR3, Accession XM_005040), a gene which is a putative transcription factor. Accordingly, utilities of VGAM1805 include diagnosis, prevention and treatment of diseases and clinical conditions associated with EGR3. The function of EGR3 and its association with various diseases and clinical conditions, has been established by previous studies, as described hereinabove with reference to VGAM189. Mesenchyme Homeo Box 2 (growth arrest-specific homeo box) (MEOX2, Accession NM_005924) is another VGAM1805 host target gene. MEOX2 BINDING SITE is HOST TARGET binding site found in the 3' untranslated region of mRNA encoded by MEOX2, corresponding to a HOST TARGET binding site such as BINDING SITE I, BINDING SITE II or BINDING SITE III. Table 2 illustrates the complementarity of the nucleotide sequences of MEOX2 BINDING SITE, designated SEQ ID:12552, to the nucleotide sequence of VGAM1805 RNA, herein designated VGAM RNA, also designated SEQ ID:4516.

Another function of VGAM1805 is therefore inhibition of Mesenchyme Homeo Box 2 (growth arrest-specific homeo box) (MEOX2, Accession NM_005924), a gene which roles in mesoderm induction and, somitogenesis, and myogenic and sclerotomal differentiation. Accordingly, utilities of VGAM1805 include diagnosis, prevention and treatment of diseases and clinical conditions associated with MEOX2. The function of MEOX2 and its association with various diseases and clinical conditions, has been established by previous studies, as described hereinabove with reference to VGAM827. Phosphodiesterase 4D, CAMP-specific (phosphodiesterase E3 dunce homolog, Drosophila) (PDE4D, Accession XM_056815) is another VGAM1805 host target gene. PDE4D BINDING SITE is HOST TARGET binding site found in the 3' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36436, to the nucleotide sequence of VGAM1805 RNA, herein designated VGAM RNA, also designated SEQ ID:4516.

Another function of VGAM1805 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM1805 include diagnosis, prevention and treatment of diseases and clinical conditions associated with PDE4D. The function of PDE4D and its association with various diseases and clinical conditions, has been established by previous studies, as described hereinabove with reference to VGAM180. Pleiomorphic Adenoma Gene 1 (PLAG1, Accession NM_002655) is another VGAM1805 host target gene. PLAG1 BINDING SITE is HOST TARGET binding site found in the 3' untranslated region of mRNA encoded by PLAG1, corresponding to a HOST TARGET binding site such as BINDING SITE I, BINDING SITE II or BINDING SITE III. Table 2 illustrates the complementarity of the nucleotide sequences of PLAG1 BINDING SITE, designated SEQ ID:8518, to the nucleotide sequence of VGAM1805 RNA, herein designated VGAM RNA, also designated SEQ ID:4516.

Another function of VGAM1805 is therefore inhibition of Pleiomorphic Adenoma Gene 1 (PLAG1, Accession NM_002655), a gene which contains a zinc finger domain. Accordingly, utilities of VGAM1805 include diagnosis, prevention and treatment of diseases and clinical conditions associated with PLAG1. The function of PLAG1 and its association with various diseases and clinical conditions, has been established by previous studies, as described hereinabove with reference to VGAM29. Protein Tyrosine Phosphatase Type IVA, Member 2 (PTP4A2, Accession NM_003479) is another VGAM1805 host target gene. PTP4A2 BINDING SITE1 and PTP4A2 BINDING SITE2 are HOST TARGET binding sites found in untranslated regions of mRNA encoded by PTP4A2, corresponding to HOST TARGET binding sites such as BINDING SITE I, BINDING SITE II or BINDING SITE III. Table 2 illustrates the complementarity of the nucleotide sequences of PTP4A2 BINDING SITE1 and PTP4A2 BINDING SITE2, designated SEQ ID:9549 and SEQ ID:27829 respectively, to the nucleotide sequence of VGAM1805 RNA, herein designated VGAM RNA, also designated SEQ ID:4516.

Another function of VGAM1805 is therefore inhibition of Protein Tyrosine Phosphatase Type IVA, Member 2 (PTP4A2, Accession NM_003479), a gene which is a protein tyrosine phosphatase which has a C-terminal prenylation site. Accordingly, utilities of VGAM1805 include diagnosis, prevention and treatment of diseases and clinical conditions associated with PTP4A2. The function of PTP4A2 and its association with various diseases and clinical conditions, has been established by previous studies, as described hereinabove with reference to VGAM217. TRAM (Accession NM_014294) is another VGAM1805 host target gene. TRAM BINDING SITE is HOST TARGET binding site found in the 3' untranslated region of mRNA encoded by TRAM, corresponding to a HOST TARGET binding site such as BINDING SITE I, BINDING SITE II or BINDING SITE III. Table 2 illustrates the complementarity of the nucleotide sequences of TRAM BINDING SITE, designated SEQ ID:15590, to the nucleotide sequence of VGAM1805 RNA, herein designated VGAM RNA, also designated SEQ ID:4516.

Another function of VGAM1805 is therefore inhibition of TRAM (Accession NM_014294). Accordingly, utilities of VGAM1805 include diagnosis, prevention and treatment of diseases and clinical conditions associated with TRAM. CCR4-NOT Transcription Complex, Subunit 8 (CNOT8, Accession NM_004779) is another VGAM1805 host target gene. CNOT8 BINDING SITE is HOST TARGET binding site found in the 3' untranslated region of mRNA encoded by CNOT8, corresponding to a HOST TARGET binding site such as BINDING SITE I, BINDING SITE II or BINDING SITE III. Table 2 illustrates the complementarity of the nucleotide sequences of CNOT8 BINDING SITE, designated SEQ ID:11181, to the nucleotide sequence of VGAM1805 RNA, herein designated VGAM RNA, also designated SEQ ID:4516.

Another function of VGAM1805 is therefore inhibition of CCR4-NOT Transcription Complex, Subunit 8 (CNOT8, Accession NM_004779). Accordingly, utilities of VGAM1805 include diagnosis, prevention and treatment of diseases and clinical conditions associated with CNOT8. FYVE and Coiled-coil Domain Containing 1 (FYCO1, Accession NM_024513) is another VGAM1805 host target gene. FYCO1 BINDING SITE is HOST TARGET binding site found in the 3' untranslated region of mRNA encoded by FYCO1, corresponding to a HOST TARGET binding site such as BINDING SITE I, BINDING SITE II or BINDING SITE III. Table 2 illustrates the complementarity of the nucleotide sequences of FYCO1 BINDING SITE, designated SEQ ID:23713, to the nucleotide sequence of VGAM1805 RNA, herein designated VGAM RNA, also designated SEQ ID:4516.

Another function of VGAM1805 is therefore inhibition of FYVE and Coiled-coil Domain Containing 1 (FYCO1, Accession NM_024513). Accordingly, utilities of VGAM1805 include diagnosis, prevention and treatment of diseases and clinical conditions associated with FYCO1. Potassium Voltage-gated Channel, Delayed-rectifier, Subfamily S, Member 1 (KCNS1, Accession NM_002251) is another VGAM1805 host target gene. KCNS1 BINDING SITE is HOST TARGET binding site found in the 5' untranslated region of mRNA encoded by KCNS1, corresponding to a HOST TARGET binding site such as BINDING SITE I, BINDING SITE II or BINDING SITE III. Table 2 illustrates the complementarity of the nucleotide sequences of KCNS1 BINDING SITE, designated SEQ ID:8041, to the nucleotide sequence of VGAM1805 RNA, herein designated VGAM RNA, also designated SEQ ID:4516.

Another function of VGAM1805 is therefore inhibition of Potassium Voltage-gated Channel, Delayed-rectifier, Subfamily S, Member 1 (KCNS1, Accession NM_002251). Accordingly, utilities of VGAM1805 include diagnosis, prevention and treatment of diseases and clinical conditions associated with KCNS1. KIAA1237 (Accession XM_087386) is another VGAM1805 host target gene. KIAA1237 BINDING SITE is HOST TARGET binding site found in the 3' untranslated region of mRNA encoded by KIAA1237, corresponding to a HOST TARGET binding site such as BINDING SITE I, BINDING SITE II or BINDING SITE III. Table 2 illustrates the complementarity of the nucleotide sequences of KIAA1237 BINDING SITE, designated SEQ ID:39221, to the nucleotide sequence of VGAM1805 RNA, herein designated VGAM RNA, also designated SEQ ID:4516.

Another function of VGAM1805 is therefore inhibition of KIAA1237 (Accession XM_087386). Accordingly, utilities of VGAM1805 include diagnosis, prevention and treatment of diseases and clinical conditions associated with KIAA1237. KIAA1254 (Accession XM_046132) is another VGAM1805 host target gene. KIAA1254 BINDING SITE is HOST TARGET binding site found in the 3' untranslated region of mRNA encoded by KIAA1254, corresponding to a HOST TARGET binding site such as BINDING SITE I, BINDING SITE II or BINDING SITE III. Table 2 illustrates the complementarity of the nucleotide sequences of KIAA1254 BINDING SITE, designated SEQ ID:34696, to the nucleotide sequence of VGAM1805 RNA, herein designated VGAM RNA, also designated SEQ ID:4516.

Another function of VGAM1805 is therefore inhibition of KIAA1254 (Accession XM_046132). Accordingly, utilities of VGAM1805 include diagnosis, prevention and treatment of diseases and clinical conditions associated with KIAA1254. KIAA1287 (Accession XM_085753) is another VGAM1805 host target gene. KIAA1287 BINDING SITE is HOST TARGET binding site found in the 3' untranslated region of mRNA encoded by KIAA1287, corresponding to a HOST TARGET binding site such as BINDING SITE I, BINDING SITE II or BINDING SITE III. Table 2 illustrates the complementarity of the nucleotide sequences of KIAA1287 BINDING SITE, designated SEQ ID:38325, to the nucleotide sequence of VGAM1805 RNA, herein designated VGAM RNA, also designated SEQ ID:4516.

Another function of VGAM1805 is therefore inhibition of KIAA1287 (Accession XM_085753). Accordingly, utilities of VGAM1805 include diagnosis, prevention and treatment of diseases and clinical conditions associated with KIAA1287. MGC14161 (Accession NM_032892) is another VGAM1805 host target gene. MGC14161 BINDING SITE is HOST TARGET binding site found in the 5' untranslated region of mRNA encoded by MGC14161, corresponding to a HOST TARGET binding site such as BINDING SITE I, BINDING SITE II or BINDING SITE III. Table 2 illustrates the complementarity of the nucleotide sequences of MGC14161 BINDING SITE, designated SEQ ID:26717, to the nucleotide sequence of VGAM1805 RNA, herein designated VGAM RNA, also designated SEQ ID:4516.

Another function of VGAM1805 is therefore inhibition of MGC14161 (Accession NM_032892). Accordingly, utilities of VGAM1805 include diagnosis, prevention and treatment of diseases and clinical conditions associated with MGC14161. MGC33182 (Accession XM_062903) is another VGAM1805 host target gene. MGC33182 BINDING SITE is HOST TARGET binding site found in the 3' untranslated region of mRNA encoded by MGC33182, corresponding to a HOST TARGET binding site such as BINDING SITE I, BINDING SITE II or BINDING SITE III. Table 2 illustrates the complementarity of the nucleotide sequences of MGC33182 BINDING SITE, designated SEQ ID:37234, to the nucleotide sequence of VGAM1805 RNA, herein designated VGAM RNA, also designated SEQ ID:4516.

Another function of VGAM1805 is therefore inhibition of MGC33182 (Accession XM_062903). Accordingly, utilities of VGAM1805 include diagnosis, prevention and treatment of diseases and clinical conditions associated with MGC33182. PRO1992 (Accession NM_014107) is another VGAM1805 host target gene. PRO1992 BINDING SITE is HOST TARGET binding site found in the 5' untranslated region of mRNA encoded by PRO1992, corresponding to a HOST TARGET binding site such as BINDING SITE I, BINDING SITE II or BINDING SITE III. Table 2 illustrates the complementarity of the nucleotide sequences of PRO1992 BINDING SITE, designated SEQ ID:15331, to the nucleotide sequence of VGAM1805 RNA, herein designated VGAM RNA, also designated SEQ ID:4516.

Another function of VGAM1805 is therefore inhibition of PRO1992 (Accession NM_014107). Accordingly, utilities of VGAM1805 include diagnosis, prevention and treatment of diseases and clinical conditions associated with PRO1992. RABEX5 (Accession NM_014504) is another VGAM1805 host target gene. RABEX5 BINDING SITE is HOST TARGET binding site found in the 3' untranslated region of mRNA encoded by RABEX5, corresponding to a HOST TARGET binding site such as BINDING SITE I, BINDING SITE II or BINDING SITE III. Table 2 illustrates the complementarity of the nucleotide sequences of RABEX5 BINDING SITE, designated SEQ ID:15839, to the nucleotide sequence of VGAM1805 RNA, herein designated VGAM RNA, also designated SEQ ID:4516.

Another function of VGAM1805 is therefore inhibition of RABEX5 (Accession NM_014504). Accordingly, utilities of VGAM1805 include diagnosis, prevention and treatment of diseases and clinical conditions associated with RABEX5. LOC118611 (Accession XM_061055) is another VGAM1805 host target gene. LOC118611 BINDING SITE is HOST TARGET binding site found in the 5' untranslated region of mRNA encoded by LOC118611, corresponding to a HOST TARGET binding site such as BINDING SITE I, BINDING SITE II or BINDING SITE III. Table 2 illustrates the complementarity of the nucleotide sequences of LOC118611 BINDING SITE, designated SEQ ID:37189, to the nucleotide sequence of VGAM1805 RNA, herein designated VGAM RNA, also designated SEQ ID:4516.

Another function of VGAM1805 is therefore inhibition of LOC118611 (Accession XM_061055). Accordingly, utilities of VGAM1805 include diagnosis, prevention and treatment of diseases and clinical conditions associated with LOC118611. LOC152715 (Accession XM_087511) is another VGAM1805 host target gene. LOC152715 BINDING SITE is HOST TARGET binding site found in the 5' untranslated region of mRNA encoded by LOC152715, corresponding to a HOST TARGET binding site such as BINDING SITE I, BINDING SITE II or BINDING SITE III. Table 2 illustrates the complementarity of the nucleotide sequences of LOC152715 BINDING SITE, designated SEQ ID:39303, to the nucleotide sequence of VGAM1805 RNA, herein designated VGAM RNA, also designated SEQ ID:4516.

Another function of VGAM1805 is therefore inhibition of LOC152715 (Accession XM_087511). Accordingly, utilities of VGAM1805 include diagnosis, prevention and treatment of diseases and clinical conditions associated with LOC152715. LOC220143 (Accession XM_168046) is another VGAM1805 host target gene. LOC220143 BINDING SITE is HOST TARGET binding site found in the 5' untranslated region of mRNA encoded by LOC220143, corresponding to a HOST TARGET binding site such as BINDING SITE I, BINDING SITE II or BINDING SITE III. Table 2 illustrates the complementarity of the nucleotide sequences of LOC220143 BINDING SITE, designated SEQ ID:44956, to the nucleotide sequence of VGAM1805 RNA, herein designated VGAM RNA, also designated SEQ ID:4516.

Another function of VGAM1805 is therefore inhibition of LOC220143 (Accession XM_168046). Accordingly, utilities of VGAM1805 include diagnosis, prevention and treatment of diseases and clinical conditions associated with LOC220143. FIG. 1 further provides a conceptual description of a novel bioinformatically detected viral gene of the present invention, referred to here as Viral Genomic Address Messenger 1806 (VGAM1806) viral gene, which modulates expression of respective host target genes thereof, the function and utility of which host target genes is known in the art.

VGAM1806 is a novel bioinformatically detected regulatory, non protein coding, viral micro RNA (miRNA) gene. The method by which VGAM1806 was detected is described hereinabove with reference to FIGS. 1-8.

VGAM1806 gene, herein designated VGAM GENE, is a viral gene contained in the genome of Tupaia Herpesvirus. VGAM1806 host target gene, herein designated VGAM HOST TARGET GENE, is a human gene contained in the human genome.

VGAM1806 gene encodes a VGAM1806 precursor RNA, herein designated VGAM PRECURSOR RNA. Similar to other miRNA genes, and unlike most ordinary genes, VGAM1806 precursor RNA does not encode a protein. A nucleotide sequence identical or highly similar to the nucleotide sequence of VGAM1806 precursor RNA is designated SEQ ID:1792, and is provided hereinbelow with reference to the sequence listing part. Nucleotide sequence SEQ ID:1792 is located at position 25245 relative to the genome of Tupaia Herpesvirus.

VGAM1806 precursor RNA folds onto itself, forming VGAM1806 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1806 folded precursor RNA into VGAM1806 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1806 RNA is designated SEQ ID:4517, and is provided hereinbelow with reference to the sequence listing part.

VGAM1806 host target gene, herein designated VGAM HOST TARGET GENE, encodes a corresponding messenger RNA, VGAM1806 host target RNA, herein designated VGAM HOST TARGET RNA. VGAM1806 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1806 RNA, herein designated VGAM RNA, binds complementarily to one or more host target binding sites located in untranslated regions of VGAM1806 host target RNA, herein designated VGAM HOST TARGET RNA. This complementary binding is due to the fact that the nucleotide sequence of VGAM1806 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1806 RNA, herein designated VGAM RNA, may have a different number of host target binding sites in untranslated regions of a VGAM1806 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1806 RNA, herein designated VGAM RNA, to host target binding sites on VGAM1806 host target RNA, herein designated VGAM HOST TARGET RNA, such as BINDING SITE I, BINDING SITE II and BINDING SITE III, inhibits translation of VGAM1806 host target RNA into VGAM1806 host target protein, herein designated VGAM HOST TARGET PROTEIN. VGAM host target protein is therefore outlined by a broken line.

It is appreciated that VGAM1806 host target gene, herein designated VGAM HOST TARGET GENE, in fact represents a plurality of VGAM1806 host target genes. The mRNA of each one of this plurality of VGAM1806 host target genes comprises one or more host target binding sites, each having a nucleotide sequence which is at least partly complementary to VGAM1806 RNA, herein designated VGAM RNA, and which when bound by VGAM1806 RNA causes inhibition of translation of respective one or more VGAM1806 host target proteins.

It is further appreciated by one skilled in the art that the mode of translational inhibition illustrated by FIG. 1 with specific reference to translational inhibition exerted by VGAM1806 gene, herein designated VGAM GENE, on one or more VGAM1806 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1806 is inhibition of expression of host target genes, as part of a novel viral mechanism of attacking a host. Accordingly, utilities of VGAM1806 include diagnosis, prevention and treatment of viral infection by Tupaia Herpesvirus. Specific functions, and accordingly utilities, of VGAM1806 correlate with, and may be deduced from, the identity of the host target genes which VGAM1806 binds and inhibits, and the function of these host target genes, as elaborated hereinbelow.

Nucleotide sequences of the VGAM1806 precursor RNA, herein designated VGAM PRECURSOR RNA, and of the 'diced' VGAM1806 RNA, herein designated VGAM RNA, and a schematic representation of the secondary folding of VGAM1806 folded precursor RNA, herein designated VGAM FOLDED PRECURSOR RNA, of VGAM1806 are further described hereinbelow with reference to Table 1.

Nucleotide sequences of host target binding sites, such as BINDING SITE-I, BINDING SITE-II and BINDING SITE-III of FIG. 1, found on VGAM1806 host target RNA, and schematic representation of the complementarity of each of these host target binding sites to VGAM1806 RNA, herein designated VGAM RNA, are described hereinbelow with reference to Table 2.

As mentioned hereinabove with reference to FIG. 1, a function of VGAM1806 gene, herein designated VGAM is inhibition of expression of VGAM1806 target genes. It is appreciated that specific functions, and accordingly utilities, of VGAM1806 correlate with, and may be deduced from, the identity of the target genes which VGAM1806 binds and inhibits, and the function of these target genes, as elaborated hereinbelow.

Carbohydrate Kinase-like (CARKL, Accession NM_013276) is a VGAM1806 host target gene. CARKL BINDING SITE is HOST TARGET binding site found in the 3' untranslated region of mRNA encoded by CARKL, corresponding to a HOST TARGET binding site such as BINDING SITE I, BINDING SITE II or BINDING SITE III. Table 2 illustrates the complementarity of the nucleotide sequences of CARKL BINDING SITE, designated SEQ ID:14941, to the nucleotide sequence of VGAM1806 RNA, herein designated VGAM RNA, also designated SEQ ID:4517.

A function of VGAM1806 is therefore inhibition of Carbohydrate Kinase-like (CARKL, Accession NM_013276), a gene which is a putative carbohydrate kinase and may be a modifier for the cystinosis phenotype. Accordingly, utilities of VGAM1806 include diagnosis, prevention and treatment of diseases and clinical conditions associated with CARKL. The function of CARKL and its association with various diseases and clinical conditions, has been established by previous studies, as described hereinabove with reference to VGAM419. PR Domain Containing 2, with ZNF Domain (PRDM2, Accession NM_015866) is another VGAM1806 host target gene. PRDM2 BINDING SITE is HOST TARGET binding site found in the 3' untranslated region of mRNA encoded by PRDM2, corresponding to a HOST TARGET binding site such as BINDING SITE I, BINDING SITE II or BINDING SITE III. Table 2 illustrates the complementarity of the nucleotide sequences of PRDM2 BINDING SITE, designated SEQ ID:18008, to the nucleotide sequence of VGAM1806 RNA, herein designated VGAM RNA, also designated SEQ ID:4517.

Another function of VGAM1806 is therefore inhibition of PR Domain Containing 2, with ZNF Domain (PRDM2, Accession NM_015866), a gene which plays a role in transcriptional regulation during neuronal differentiation and pathogenesis of retinoblastoma. Accordingly, utilities of VGAM1806 include diagnosis, prevention and treatment of diseases and clinical conditions associated with PRDM2. The function of PRDM2 and its association with various diseases and clinical conditions, has been established by previous studies, as described hereinabove with reference to VGAM120. RAB18, Member RAS Oncogene Family (RAB18, Accession NM_021252) is another VGAM1806 host target gene. RAB18 BINDING SITE is HOST TARGET binding site found in the 3' untranslated region of mRNA encoded by RAB18, corresponding to a HOST TARGET binding site such as BINDING SITE I, BINDING SITE II or BINDING SITE III. Table 2 illustrates the complementarity of the nucleotide sequences of RAB18 BINDING SITE, designated SEQ ID:22223, to the nucleotide sequence of VGAM1806 RNA, herein designated VGAM RNA, also designated SEQ ID:4517.

Another function of VGAM1806 is therefore inhibition of RAB18, Member RAS Oncogene Family (RAB18, Accession NM_021252), a gene which plays a role in apical endocytosis/recycling. Accordingly, utilities of VGAM1806 include diagnosis, prevention and treatment of diseases and clinical conditions associated with RAB18. The function of RAB18 and its association with various diseases and clinical conditions, has been established by previous studies, as described hereinabove with reference to VGAM120. Tumor Necrosis Factor Receptor Superfamily, Member 11a, Activator of NFKB (TNFRSF11A, Accession NM_003839) is another VGAM1806 host target gene. TNFRSF11A BINDING SITE is HOST TARGET binding site found in the 3' untranslated region of mRNA encoded by TNFRSF11A, corresponding to a HOST TARGET binding site such as BINDING SITE I, BINDING SITE II or BINDING SITE III. Table 2 illustrates the complementarity of the nucleotide sequences of TNFRSF11A BINDING SITE, designated SEQ ID:9931, to the nucleotide sequence of VGAM1806 RNA, herein designated VGAM RNA, also designated SEQ ID:4517.

Another function of VGAM1806 is therefore inhibition of Tumor Necrosis Factor Receptor Superfamily, Member 11a, Activator of NFKB (TNFRSF11A, Accession NM_003839). Accordingly, utilities of VGAM1806 include diagnosis, prevention and treatment of diseases and clinical conditions associated with TNFRSF11A. Zinc Finger Protein 192 (ZNF192, Accession NM_006298) is another VGAM1806 host target gene. ZNF192 BINDING SITE is HOST TARGET binding site found in the 5' untranslated region of mRNA encoded by ZNF192, corresponding to a HOST TARGET binding site such as BINDING SITE I, BINDING SITE II or BINDING SITE III. Table 2 illustrates the complementarity of the nucleotide sequences of ZNF192 BINDING SITE, designated SEQ ID:12992, to the nucleotide sequence of VGAM1806 RNA, herein designated VGAM RNA, also designated SEQ ID:4517.

Another function of VGAM1806 is therefore inhibition of Zinc Finger Protein 192 (ZNF192, Accession NM_006298). Accordingly, utilities of VGAM1806 include diagnosis, prevention and treatment of diseases and clinical conditions associated with ZNF192. Adaptor-related Protein Complex 3, Delta 1 Subunit (AP3D1, Accession NM_003938) is another VGAM1806 host target gene. AP3D1 BINDING SITE is HOST TARGET binding site found in the 3' untranslated region of mRNA encoded by AP3D1, corresponding to a HOST TARGET binding site such as BINDING SITE I, BINDING SITE II or BINDING SITE III. Table 2 illustrates the complementarity of the nucleotide sequences of AP3D1 BINDING SITE, designated SEQ ID:10048, to the nucleotide sequence of VGAM1806 RNA, herein designated VGAM RNA, also designated SEQ ID:4517.

Another function of VGAM1806 is therefore inhibition of Adaptor-related Protein Complex 3, Delta 1 Subunit (AP3D1, Accession NM_003938). Accordingly, utilities of VGAM1806 include diagnosis, prevention and treatment of diseases and clinical conditions associated with AP3D1. CCR4-NOT Transcription Complex, Subunit 8 (CNOT8, Accession NM_004779) is another VGAM1806 host target gene. CNOT8 BINDING SITE is HOST TARGET binding site found in the 3' untranslated region of mRNA encoded by CNOT8, corresponding to a HOST TARGET binding site such as BINDING SITE I, BINDING SITE II or BINDING SITE III. Table 2 illustrates the complementarity of the nucleotide sequences of CNOT8 BINDING SITE, designated SEQ ID:11183, to the nucleotide sequence of VGAM1806 RNA, herein designated VGAM RNA, also designated SEQ ID:4517.

Another function of VGAM1806 is therefore inhibition of CCR4-NOT Transcription Complex, Subunit 8 (CNOT8, Accession NM_004779). Accordingly, utilities of VGAM1806 include diagnosis, prevention and treatment of diseases and clinical conditions associated with CNOT8. FLJ10260 (Accession NM_018042) is another VGAM1806 host target gene. FLJ10260 BINDING SITE is HOST TARGET binding site found in the 5' untranslated region of mRNA encoded by FLJ10260, corresponding to a HOST TARGET binding site such as BINDING SITE I, BINDING SITE II or BINDING SITE III. Table 2 illustrates the complementarity of the nucleotide sequences of FLJ10260 BINDING SITE, designated SEQ ID:19787, to the nucleotide sequence of VGAM1806 RNA, herein designated VGAM RNA, also designated SEQ ID:4517.

Another function of VGAM1806 is therefore inhibition of FLJ10260 (Accession NM_018042). Accordingly, utilities of VGAM1806 include diagnosis, prevention and treatment of diseases and clinical conditions associated with FLJ10260. FLJ12568 (Accession NM_024993) is another VGAM1806 host target gene. FLJ12568 BINDING SITE is HOST TARGET binding site found in the 3' untranslated region of mRNA encoded by FLJ12568, corresponding to a HOST TARGET binding site such as BINDING SITE I, BINDING SITE II or BINDING SITE III. Table 2 illustrates the complementarity of the nucleotide sequences of FLJ12568 BINDING SITE, designated SEQ ID:24553, to the nucleotide sequence of VGAM1806 RNA, herein designated VGAM RNA, also designated SEQ ID:4517.

Another function of VGAM1806 is therefore inhibition of FLJ12568 (Accession NM_024993). Accordingly, utilities of VGAM1806 include diagnosis, prevention and treatment of diseases and clinical conditions associated with FLJ12568. Integrin, Beta 5 (ITGB5, Accession XM_003029) is another VGAM1806 host target gene. ITGB5 BINDING SITE is HOST TARGET binding site found in the 3' untranslated region of mRNA encoded by ITGB5, corresponding to a HOST TARGET binding site such as BINDING SITE I, BINDING SITE II or BINDING SITE III. Table 2 illustrates the complementarity of the nucleotide sequences of ITGB5 BINDING SITE, designated SEQ ID:29923, to the nucleotide sequence of VGAM1806 RNA, herein designated VGAM RNA, also designated SEQ ID:4517.

Another function of VGAM1806 is therefore inhibition of Integrin, Beta 5 (ITGB5, Accession XM_003029). Accordingly, utilities of VGAM1806 include diagnosis, prevention and treatment of diseases and clinical conditions associated with ITGB5. KIAA1434 (Accession XM_045585) is another VGAM1806 host target gene. KIAA1434 BINDING SITE is HOST TARGET binding site found in the 3' untranslated region of mRNA encoded by KIAA1434, corresponding to a HOST TARGET binding site such as BINDING SITE I, BINDING SITE II or BINDING SITE III. Table 2 illustrates the complementarity of the nucleotide sequences of KIAA1434 BINDING SITE, designated SEQ ID:34493, to the nucleotide sequence of VGAM1806 RNA, herein designated VGAM RNA, also designated SEQ ID:4517.

Another function of VGAM1806 is therefore inhibition of KIAA1434 (Accession XM_045585). Accordingly, utilities of VGAM1806 include diagnosis, prevention and treatment of diseases and clinical conditions associated with KIAA1434. KIAA1751 (Accession XM_049768) is another VGAM1806 host target gene. KIAA1751 BINDING SITE is HOST TARGET binding site found in the 3' untranslated region of mRNA encoded by KIAA1751, corresponding to a HOST TARGET binding site such as BINDING SITE I, BINDING SITE II or BINDING SITE III. Table 2 illustrates the complementarity of the nucleotide sequences of KIAA1751 BINDING SITE, designated SEQ ID:35498, to the nucleotide sequence of VGAM1806 RNA, herein designated VGAM RNA, also designated SEQ ID:4517.

Another function of VGAM1806 is therefore inhibition of KIAA1751 (Accession XM_049768). Accordingly, utilities of VGAM1806 include diagnosis, prevention and treatment of diseases and clinical conditions associated with KIAA1751. KIAA1854 (Accession XM_049884) is another VGAM1806 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35539, to the nucleotide sequence of VGAM1806 RNA, herein designated VGAM RNA, also designated SEQ ID:4517.

Another function of VGAM1806 is therefore inhibition of KIAA1854 (Accession XM_049884). Accordingly, utilities of VGAM1806 include diagnosis, prevention and treatment of diseases and clinical conditions associated with KIAA1854. MAWBP (Accession NM_022129) is another VGAM1806 host target gene. MAWBP BINDING SITE is HOST TARGET binding site found in the 3' untranslated region of mRNA encoded by MAWBP, corresponding to a HOST TARGET binding site such as BINDING SITE I, BINDING SITE II or BINDING SITE III. Table 2 illustrates the complementarity of the nucleotide sequences of MAWBP BINDING SITE, designated SEQ ID:22683, to the nucleotide sequence of VGAM1806 RNA, herein designated VGAM RNA, also designated SEQ ID:4517.

Another function of VGAM1806 is therefore inhibition of MAWBP (Accession NM_022129). Accordingly, utilities of VGAM1806 include diagnosis, prevention and treatment of diseases and clinical conditions associated with MAWBP. Protein Phosphatase 1A (formerly 2C), Magnesium-dependent, Alpha Isoform (PPM1A, Accession NM_021003) is another VGAM1806 host target gene. PPM1A BINDING SITE is HOST TARGET binding site found in the 3' untranslated region of mRNA encoded by PPM1A, corresponding to a HOST TARGET binding site such as BINDING SITE I, BINDING SITE II or BINDING SITE III. Table 2 illustrates the complementarity of the nucleotide sequences of PPM1A BINDING SITE, designated SEQ ID:22000, to the nucleotide sequence of VGAM1806 RNA, herein designated VGAM RNA, also designated SEQ ID:4517.

Another function of VGAM1806 is therefore inhibition of Protein Phosphatase 1A (formerly 2C), Magnesium-dependent, Alpha Isoform (PPM1A, Accession NM_021003). Accordingly, utilities of VGAM1806 include diagnosis, prevention and treatment of diseases and clinical conditions associated with PPM1A. STIP-1 (Accession XM_045694) is another VGAM1806 host target gene. STIP-1 BINDING SITE is HOST TARGET binding site found in the 3' untranslated region of mRNA encoded by STIP-1, corresponding to a HOST TARGET binding site such as BINDING SITE I, BINDING SITE II or BINDING SITE III. Table 2 illustrates the complementarity of the nucleotide sequences of STIP-1 BINDING SITE, designated SEQ ID:34528, to the nucleotide sequence of VGAM1806 RNA, herein designated VGAM RNA, also designated SEQ ID:4517.

Another function of VGAM1806 is therefore inhibition of STIP-1 (Accession XM_045694). Accordingly, utilities of VGAM1806 include diagnosis, prevention and treatment of diseases and clinical conditions associated with STIP-1. TEB4 (Accession XM_027156) is another VGAM1806 host target gene. TEB4 BINDING SITE is HOST TARGET binding site found in the 3' untranslated region of mRNA encoded by TEB4, corresponding to a HOST TARGET binding site such as BINDING SITE I, BINDING SITE II or BINDING SITE III. Table 2 illustrates the complementarity of the nucleotide sequences of TEB4 BINDING SITE, designated SEQ ID:30430, to the nucleotide sequence of VGAM1806 RNA, herein designated VGAM RNA, also designated SEQ ID:4517.

Another function of VGAM1806 is therefore inhibition of TEB4 (Accession XM_027156). Accordingly, utilities of VGAM1806 include diagnosis, prevention and treatment of diseases and clinical conditions associated with TEB4. ZW10 Interactor (ZWINT, Accession NM_032997) is another VGAM1806 host target gene. ZWINT BINDING SITE1 and ZWINT BINDING SITE2 are HOST TARGET binding sites found in untranslated regions of mRNA encoded by ZWINT, corresponding to HOST TARGET binding sites such as BINDING SITE I, BINDING SITE II or BINDING SITE III. Table 2 illustrates the complementarity of the nucleotide sequences of ZWINT BINDING SITE1 and ZWINT BINDING SITE2, designated SEQ ID:26876 and SEQ ID:13923 respectively, to the nucleotide sequence of VGAM1806 RNA, herein designated VGAM RNA, also designated SEQ ID:4517.

Another function of VGAM1806 is therefore inhibition of ZW10 Interactor (ZWINT, Accession NM_032997). Accordingly, utilities of VGAM1806 include diagnosis, prevention and treatment of diseases and clinical conditions associated with ZWINT. LOC220573 (Accession XM_045569) is another VGAM1806 host target gene. LOC220573 BINDING SITE is HOST TARGET binding site found in the 3' untranslated region of mRNA encoded by LOC220573, corresponding to a HOST TARGET binding site such as BINDING SITE I, BINDING SITE II or BINDING SITE III. Table 2 illustrates the complementarity of the nucleotide sequences of LOC220573 BINDING SITE, designated SEQ ID:34485, to the nucleotide sequence of VGAM1806 RNA, herein designated VGAM RNA, also designated SEQ ID:4517.

Another function of VGAM1806 is therefore inhibition of LOC220573 (Accession XM_045569). Accordingly, utilities of VGAM1806 include diagnosis, prevention and treatment of diseases and clinical conditions associated with LOC220573. LOC256073 (Accession XM_172972) is another VGAM1806 host target gene. LOC256073 BINDING SITE is HOST TARGET binding site found in the 3' untranslated region of mRNA encoded by LOC256073, corresponding to a HOST TARGET binding site such as BINDING SITE I, BINDING SITE II or BINDING SITE III. Table 2 illustrates the complementarity of the nucleotide sequences of LOC256073 BINDING SITE, designated SEQ ID:46230, to the nucleotide sequence of VGAM1806 RNA, herein designated VGAM RNA, also designated SEQ ID:4517.

Another function of VGAM1806 is therefore inhibition of LOC256073 (Accession XM_172972). Accordingly, utilities of VGAM1806 include diagnosis, prevention and treatment of diseases and clinical conditions associated with LOC256073. LOC92606 (Accession XM_046097) is another VGAM1806 host target gene. LOC92606 BINDING SITE is HOST TARGET binding site found in the 3' untranslated region of mRNA encoded by LOC92606, corresponding to a HOST TARGET binding site such as BINDING SITE I, BINDING SITE II or BINDING SITE III. Table 2 illustrates the complementarity of the nucleotide sequences of LOC92606 BINDING SITE, designated SEQ ID:34680, to the nucleotide sequence of VGAM1806 RNA, herein designated VGAM RNA, also designated SEQ ID:4517.

Another function of VGAM1806 is therefore inhibition of LOC92606 (Accession XM_046097). Accordingly, utilities of VGAM1806 include diagnosis, prevention and treatment of diseases and clinical conditions associated with LOC92606. FIG. 1 further provides a conceptual description of a novel bioinformatically detected viral gene of the present invention, referred to here as Viral Genomic Address Messenger 1807 (VGAM1807) viral gene, which modulates expression of respective host target genes thereof, the function and utility of which host target genes is known in the art.

VGAM1807 is a novel bioinformatically detected regulatory, non protein coding, viral micro RNA (miRNA) gene.

The method by which VGAM1807 was detected is described hereinabove with reference to FIGS. 1-8.

VGAM1807 gene, herein designated VGAM GENE, is a viral gene contained in the genome of Rana Tigrina Ranavirus. VGAM1807 host target gene, herein designated VGAM HOST TARGET GENE, is a human gene contained in the human genome.

VGAM1807 gene encodes a VGAM1807 precursor RNA, herein designated VGAM PRECURSOR RNA. Similar to other miRNA genes, and unlike most ordinary genes, VGAM1807 precursor RNA does not encode a protein. A nucleotide sequence identical or highly similar to the nucleotide sequence of VGAM1807 precursor RNA is designated SEQ ID:1793, and is provided hereinbelow with reference to the sequence listing part. Nucleotide sequence SEQ ID:1793 is located at position 16749 relative to the genome of Rana Tigrina Ranavirus.

VGAM1807 precursor RNA folds onto itself, forming VGAM1807 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1807 folded precursor RNA into VGAM1807 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM1807 RNA is designated SEQ ID:4518, and is provided hereinbelow with reference to the sequence listing part.

VGAM1807 host target gene, herein designated VGAM HOST TARGET GENE, encodes a corresponding messenger RNA, VGAM1807 host target RNA, herein designated VGAM HOST TARGET RNA. VGAM1807 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1807 RNA, herein designated VGAM RNA, binds complementarily to one or more host target binding sites located in untranslated regions of VGAM1807 host target RNA, herein designated VGAM HOST TARGET RNA. This complementary binding is due to the fact that the nucleotide sequence of VGAM1807 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1807 RNA, herein designated VGAM RNA, may have a different number of host target binding sites in untranslated regions of a VGAM1807 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1807 RNA, herein designated VGAM RNA, to host target binding sites on VGAM1807 host target RNA, herein designated VGAM HOST TARGET RNA, such as BINDING SITE I, BINDING SITE II and BINDING SITE III, inhibits translation of VGAM1807 host target RNA into VGAM1807 host target protein, herein designated VGAM HOST TARGET PROTEIN. VGAM host target protein is therefore outlined by a broken line.

It is appreciated that VGAM1807 host target gene, herein designated VGAM HOST TARGET GENE, in fact represents a plurality of VGAM1807 host target genes. The mRNA of each one of this plurality of VGAM1807 host target genes comprises one or more host target binding sites, each having a nucleotide sequence which is at least partly complementary to VGAM1807 RNA, herein designated VGAM RNA, and which when bound by VGAM1807 RNA causes inhibition of translation of respective one or more VGAM1807 host target proteins.

It is further appreciated by one skilled in the art that the mode of translational inhibition illustrated by FIG. 1 with specific reference to translational inhibition exerted by VGAM1807 gene, herein designated VGAM GENE, on one or more VGAM1807 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1807 is inhibition of expression of host target genes, as part of a novel viral mechanism of attacking a host. Accordingly, utilities of VGAM1807 include diagnosis, prevention and treatment of viral infection by Rana Tigrina Ranavirus. Specific functions, and accordingly utilities, of VGAM1807 correlate with, and may be deduced from, the identity of the host target genes which VGAM1807 binds and inhibits, and the function of these host target genes, as elaborated hereinbelow.

Nucleotide sequences of the VGAM1807 precursor RNA, herein designated VGAM PRECURSOR RNA, and of the 'diced' VGAM1807 RNA, herein designated VGAM RNA, and a schematic representation of the secondary folding of VGAM1807 folded precursor RNA, herein designated VGAM FOLDED PRECURSOR RNA, of VGAM1807 are further described hereinbelow with reference to Table 1.

Nucleotide sequences of host target binding sites, such as BINDING SITE-I, BINDING SITE-II and BINDING SITE-III of FIG. 1, found on VGAM1807 host target RNA, and schematic representation of the complementarity of each of these host target binding sites to VGAM1807 RNA, herein designated VGAM RNA, are described hereinbelow with reference to Table 2.

As mentioned hereinabove with reference to FIG. 1, a function of VGAM1807 gene, herein designated VGAM is inhibition of expression of VGAM1807 target genes. It is appreciated that specific functions, and accordingly utilities, of VGAM1807 correlate with, and may be deduced from, the identity of the target genes which VGAM1807 binds and inhibits, and the function of these target genes, as elaborated hereinbelow.

KIAA1013 (Accession XM_114303) is a VGAM1807 host target gene. KIAA1013 BINDING SITE is HOST TARGET binding site found in the 3' untranslated region of mRNA encoded by KIAA1013, corresponding to a HOST TARGET binding site such as BINDING SITE I, BINDING SITE II or BINDING SITE III. Table 2 illustrates the complementarity of the nucleotide sequences of KIAA1013 BINDING SITE, designated SEQ ID:42860, to the nucleotide sequence of VGAM1807 RNA, herein designated VGAM RNA, also designated SEQ ID:4518.

A function of VGAM1807 is therefore inhibition of KIAA1013 (Accession XM_114303). Accordingly, utilities of VGAM1807 include diagnosis, prevention and treatment of diseases and clinical conditions associated with KIAA1013. MGC13007 (Accession NM_032320) is another VGAM1807 host target gene. MGC13007 BINDING SITE is HOST TARGET binding site found in the 3' untranslated region of mRNA encoded by MGC13007, corresponding to a HOST TARGET binding site such as BINDING SITE I, BINDING SITE II or BINDING SITE III. Table 2 illustrates the complementarity of the nucleotide sequences of MGC13007 BINDING SITE, designated SEQ ID:26122, to the nucleotide sequence of VGAM1807 RNA, herein designated VGAM RNA, also designated SEQ ID:4518.

Another function of VGAM1807 is therefore inhibition of MGC13007 (Accession NM_032320). Accordingly, utilities of VGAM1807 include diagnosis, prevention and treatment of diseases and clinical conditions associated with MGC13007. PTD012 (Accession NM_014039) is another VGAM1807 host target gene. PTD012 BINDING SITE is HOST TARGET binding site found in the 3' untranslated region of mRNA encoded by PTD012, corresponding to a HOST TARGET binding site such as BINDING SITE I, BINDING SITE II or BINDING SITE III. Table 2 illustrates the complementarity of the nucleotide sequences of PTD012 BINDING SITE, designated SEQ ID:15269, to the nucleotide sequence of VGAM1807 RNA, herein designated VGAM RNA, also designated SEQ ID:4518.

Another function of VGAM1807 is therefore inhibition of PTD012 (Accession NM_014039). Accordingly, utilities of VGAM1807 include diagnosis, prevention and treatment of diseases and clinical conditions associated with PTD012. Serum/glucocorticoid Regulated Kinase 2 (SGK2, Accession NM_016276) is another VGAM1807 host target gene. SGK2 BINDING SITE is HOST TARGET binding site found in the 3' untranslated region of mRNA encoded by SGK2, corresponding to a HOST TARGET binding site such as BINDING SITE I, BINDING SITE II or BINDING SITE III. Table 2 illustrates the complementarity of the nucleotide sequences of SGK2 BINDING SITE, designated SEQ ID:18399, to the nucleotide sequence of VGAM1807 RNA, herein designated VGAM RNA, also designated SEQ ID:4518.

Another function of VGAM1807 is therefore inhibition of Serum/glucocorticoid Regulated Kinase 2 (SGK2, Accession NM_016276). Accordingly, utilities of VGAM1807 include diagnosis, prevention and treatment of diseases and clinical conditions associated with SGK2. LOC152559 (Accession XM_087487) is another VGAM1807 host target gene. LOC152559 BINDING SITE is HOST TARGET binding site found in the 3' untranslated region of mRNA encoded by LOC152559, corresponding to a HOST TARGET binding site such as BINDING SITE I, BINDING SITE II or BINDING SITE III. Table 2 illustrates the complementarity of the nucleotide sequences of LOC152559 BINDING SITE, designated SEQ ID:39286, to the nucleotide sequence of VGAM1807 RNA, herein designated VGAM RNA, also designated SEQ ID:4518.

Another function of VGAM1807 is therefore inhibition of LOC152559 (Accession XM_087487). Accordingly, utilities of VGAM1807 include diagnosis, prevention and treatment of diseases and clinical conditions associated with LOC152559. LOC90509 (Accession XM_032209) is another VGAM1807 host target gene. LOC90509 BINDING SITE is HOST TARGET binding site found in the 3' untranslated region of mRNA encoded by LOC90509, corresponding to a HOST TARGET binding site such as BINDING SITE I, BINDING SITE II or BINDING SITE III. Table 2 illustrates the complementarity of the nucleotide sequences of LOC90509 BINDING SITE, designated SEQ ID:31609, to the nucleotide sequence of VGAM1807 RNA, herein designated VGAM RNA, also designated SEQ ID:4518.

Another function of VGAM1807 is therefore inhibition of LOC90509 (Accession XM_032209). Accordingly, utilities of VGAM1807 include diagnosis, prevention and treatment of diseases and clinical conditions associated with LOC90509. FIG. 1 further provides a conceptual description of a novel bioinformatically detected viral gene of the present invention, referred to here as Viral Genomic Address Messenger 1808 (VGAM1808) viral gene, which modulates expression of respective host target genes thereof, the function and utility of which host target genes is known in the art.

VGAM1808 is a novel bioinformatically detected regulatory, non protein coding, viral micro RNA (miRNA) gene. The method by which VGAM1808 was detected is described hereinabove with reference to FIGS. 1-8.

VGAM1808 gene, herein designated VGAM GENE, is a viral gene contained in the genome of Rana Tigrina Ranavirus. VGAM1808 host target gene, herein designated VGAM HOST TARGET GENE, is a human gene contained in the human genome.

VGAM1808 gene encodes a VGAM1808 precursor RNA, herein designated VGAM PRECURSOR RNA. Similar to other miRNA genes, and unlike most ordinary genes, VGAM1808 precursor RNA does not encode a protein. A nucleotide sequence identical or highly similar to the nucleotide sequence of VGAM1808 precursor RNA is designated SEQ ID:1794, and is provided hereinbelow with reference to the sequence listing part. Nucleotide sequence SEQ ID:1794 is located at position 27725 relative to the genome of Rana Tigrina Ranavirus.

VGAM1808 precursor RNA folds onto itself, forming VGAM1808 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1808 folded precursor RNA into VGAM1808 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM1808 RNA is designated SEQ ID:4519, and is provided hereinbelow with reference to the sequence listing part.

VGAM1808 host target gene, herein designated VGAM HOST TARGET GENE, encodes a corresponding messenger RNA, VGAM1808 host target RNA, herein designated VGAM HOST TARGET RNA. VGAM1808 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1808 RNA, herein designated VGAM RNA, binds complementarily to one or more host target binding sites located in untranslated regions of VGAM1808 host target RNA, herein designated VGAM HOST TARGET RNA. This complementary binding is due to the fact that the nucleotide sequence of VGAM1808 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1808 RNA, herein designated VGAM RNA, may have a different number of host target binding sites in untranslated regions of a VGAM1808 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1808 RNA, herein designated VGAM RNA, to host target binding sites on VGAM1808 host target RNA, herein designated VGAM HOST TARGET RNA, such as BINDING SITE I, BINDING SITE II and BINDING SITE III, inhibits translation of VGAM1808 host target RNA into VGAM1808 host target protein, herein designated VGAM HOST TARGET PROTEIN. VGAM host target protein is therefore outlined by a broken line.

It is appreciated that VGAM1808 host target gene, herein designated VGAM HOST TARGET GENE, in fact represents a plurality of VGAM1808 host target genes. The mRNA of each one of this plurality of VGAM1808 host target genes comprises one or more host target binding sites, each having a nucleotide sequence which is at least partly complementary to VGAM1808 RNA, herein designated VGAM RNA, and which when bound by VGAM1808 RNA causes inhibition of translation of respective one or more VGAM1808 host target proteins.

It is further appreciated by one skilled in the art that the mode of translational inhibition illustrated by FIG. 1 with specific reference to translational inhibition exerted by VGAM1808 gene, herein designated VGAM GENE, on one or more VGAM1808 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1808 is inhibition of expression of host target genes, as part of a novel viral mechanism of attacking a host. Accordingly, utilities of VGAM1808 include diagnosis, prevention and treatment of viral infection by Rana Tigrina Ranavirus. Specific functions, and accordingly utilities, of VGAM1808 correlate with, and may be deduced from, the identity of the host target genes which VGAM1808 binds and inhibits, and the function of these host target genes, as elaborated hereinbelow.

Nucleotide sequences of the VGAM1808 precursor RNA, herein designated VGAM PRECURSOR RNA, and of the 'diced' VGAM1808 RNA, herein designated VGAM RNA, and a schematic representation of the secondary folding of VGAM1808 folded precursor RNA, herein designated VGAM FOLDED PRECURSOR RNA, of VGAM1808 are further described hereinbelow with reference to Table 1.

Nucleotide sequences of host target binding sites, such as BINDING SITE-I, BINDING SITE-II and BINDING SITE-III of FIG. 1, found on VGAM1808 host target RNA, and schematic representation of the complementarity of each of these host target binding sites to VGAM1808 RNA, herein designated VGAM RNA, are described hereinbelow with reference to Table 2.

As mentioned hereinabove with reference to FIG. 1, a function of VGAM1808 gene, herein designated VGAM is inhibition of expression of VGAM1808 target genes. It is appreciated that specific functions, and accordingly utilities, of VGAM1808 correlate with, and may be deduced from, the identity of the target genes which VGAM1808 binds and inhibits, and the function of these target genes, as elaborated hereinbelow.

Alpha Thalassemia/mental Retardation Syndrome X-linked (RAD54 homolog, S. cerevisiae) (ATRX, Accession NM_138271) is a VGAM1808 host target gene. ATRX BINDING SITE1 and ATRX BINDING SITE2 are HOST TARGET binding sites found in untranslated regions of mRNA encoded by ATRX, corresponding to HOST TARGET binding sites such as BINDING SITE I, BINDING SITE II or BINDING SITE III. Table 2 illustrates the complementarity of the nucleotide sequences of ATRX BINDING SITE1 and ATRX BINDING SITE2, designated SEQ ID:28684 and SEQ ID:6095 respectively, to the nucleotide sequence of VGAM1808 RNA, herein designated VGAM RNA, also designated SEQ ID:4519.

A function of VGAM1808 is therefore inhibition of Alpha Thalassemia/mental Retardation Syndrome X-linked (RAD54 homolog, S. cerevisiae) (ATRX, Accession NM_138271). Accordingly, utilities of VGAM1808 include diagnosis, prevention and treatment of diseases and clinical conditions associated with ATRX. Dystrophin (muscular dystrophy, Duchenne and Becker types) (DMD, Accession NM_004021) is another VGAM1808 host target gene. DMD BINDING SITE1 through DMD BINDING SITE3 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 through DMD BINDING SITE3, designated SEQ ID:10224, SEQ ID:10236 and SEQ ID:8261 respectively, to the nucleotide sequence of VGAM1808 RNA, herein designated VGAM RNA, also designated SEQ ID:4519.

Another function of VGAM1808 is therefore inhibition of Dystrophin (muscular dystrophy, Duchenne and Becker types) (DMD, Accession NM_004021), a gene which muscular dystrophy. Accordingly, utilities of VGAM1808 include diagnosis, prevention and treatment of diseases and clinical conditions associated with DMD. The function of DMD and its association with various diseases and clinical conditions, has been established by previous studies, as described hereinabove with reference to VGAM218. Prostaglandin F2 Receptor Negative Regulator (PTGFRN, Accession XM_040709) is another VGAM1808 host target gene. PTGFRN BINDING SITE is HOST TARGET binding site found in the 5' untranslated region of mRNA encoded by PTGFRN, corresponding to a HOST TARGET binding site such as BINDING SITE I, BINDING SITE II or BINDING SITE III. Table 2 illustrates the complementarity of the nucleotide sequences of PTGFRN BINDING SITE, designated SEQ ID:33362, to the nucleotide sequence of VGAM1808 RNA, herein designated VGAM RNA, also designated SEQ ID:4519.

Another function of VGAM1808 is therefore inhibition of Prostaglandin F2 Receptor Negative Regulator (PTGFRN, Accession XM_040709), a gene which inhibits the binding of prostaglandin f2-alpha (pgf2-alpha) to its specific fp receptor. Accordingly, utilities of VGAM1808 include diagnosis, prevention and treatment of diseases and clinical conditions associated with PTGFRN. The function of PTGFRN and its association with various diseases and clinical conditions, has been established by previous studies, as described hereinabove with reference to VGAM125. Solute Carrier Family 20 (phosphate transporter), Member 1 (SLC20A1, Accession XM_002217) is another VGAM1808 host target gene. SLC20A1 BINDING SITE is HOST TARGET binding site found in the 5' untranslated region of mRNA encoded by SLC20A1, corresponding to a HOST TARGET binding site such as BINDING SITE I, BINDING SITE II or BINDING SITE III. Table 2 illustrates the complementarity of the nucleotide sequences of SLC20A1 BINDING SITE, designated SEQ ID:29873, to the nucleotide sequence of VGAM1808 RNA, herein designated VGAM RNA, also designated SEQ ID:4519.

Another function of VGAM1808 is therefore inhibition of Solute Carrier Family 20 (phosphate transporter), Member 1 (SLC20A1, Accession XM_002217), a gene which could be a sodium-phosphate symporter. Accordingly, utilities of VGAM1808 include diagnosis, prevention and treatment of diseases and clinical conditions associated with SLC20A1. The function of SLC20A1 and its association with various diseases and clinical conditions, has been established by previous studies, as described hereinabove with reference to VGAM608. Solute Carrier Family 6 (neurotransmitter transporter, taurine), Member 6 (SLC6A6, Accession NM_003043) is another VGAM1808 host target gene. SLC6A6 BINDING SITE is HOST TARGET binding site found in the 3' untranslated region of mRNA encoded by SLC6A6, corresponding to a HOST TARGET binding site such as BINDING SITE I, BINDING SITE II or BINDING SITE III. Table 2 illustrates the complementarity of the nucleotide sequences of SLC6A6 BINDING SITE, designated SEQ ID:9003, to the nucleotide sequence of VGAM1808 RNA, herein designated VGAM RNA, also designated SEQ ID:4519.

Another function of VGAM1808 is therefore inhibition of Solute Carrier Family 6 (neurotransmitter transporter, taurine), Member 6 (SLC6A6, Accession NM_003043), a gene which transports taurine and other beta-amino acids like beta-alanine. Accordingly, utilities of VGAM1808 include diagnosis, prevention and treatment of diseases and clinical conditions associated with SLC6A6. The function of SLC6A6 and its association with various diseases and clinical conditions, has been established by previous studies, as described hereinabove with reference to VGAM36. Transient Receptor Potential Cation Channel, Subfamily M, Member 8 (TRPM8, Accession NM_024080) is another VGAM1808 host target gene. TRPM8 BINDING SITE is HOST TARGET binding site found in the 3' untranslated region of mRNA encoded by TRPM8, corresponding to a HOST TARGET binding site such as BINDING SITE I, BINDING SITE II or BINDING SITE III. Table 2 illustrates the complementarity of the nucleotide sequences of TRPM8 BINDING SITE, designated SEQ ID:23513, to the nucleotide sequence of VGAM1808 RNA, herein designated VGAM RNA, also designated SEQ ID:4519.

Another function of VGAM1808 is therefore inhibition of Transient Receptor Potential Cation Channel, Subfamily M, Member 8 (TRPM8, Accession NM_024080), a gene which is thought to form a receptor-activated calcium permeant cation channel. Accordingly, utilities of VGAM1808 include diagnosis, prevention and treatment of diseases and clinical conditions associated with TRPM8. The function of TRPM8 and its association with various diseases and clinical conditions, has been established by previous studies, as described hereinabove with reference to VGAM201. Chromosome 20 Open Reading Frame 80 (C20orf80, Accession XM_037014) is another VGAM1808 host target gene. C20orf80 BINDING SITE is HOST TARGET binding site found in the 5' untranslated region of mRNA encoded by C20orf80, corresponding to a HOST TARGET binding site such as BINDING SITE I, BINDING SITE II or BINDING SITE III. Table 2 illustrates the complementarity of the nucleotide sequences of C20orf80 BINDING SITE, designated SEQ ID:32537, to the nucleotide sequence of VGAM1808 RNA, herein designated VGAM RNA, also designated SEQ ID:4519.

Another function of VGAM1808 is therefore inhibition of Chromosome 20 Open Reading Frame 80 (C20orf80, Accession XM_037014). Accordingly, utilities of VGAM1808 include diagnosis, prevention and treatment of diseases and clinical conditions associated with C20orf80. Chromosome 5 Open Reading Frame 4 (C5orf4, Accession NM_032385) is another VGAM1808 host target gene. C5orf4 BINDING SITE1 and C5orf4 BINDING SITE2 are HOST TARGET binding sites found in untranslated regions of mRNA encoded by C5orf4, corresponding to HOST TARGET binding sites such as BINDING SITE I, BINDING SITE II or BINDING SITE III. Table 2 illustrates the complementarity of the nucleotide sequences of C5orf4 BINDING SITE1 and C5orf4 BINDING SITE2, designated SEQ ID:26184 and SEQ ID:18476 respectively, to the nucleotide sequence of VGAM1808 RNA, herein designated VGAM RNA, also designated SEQ ID:4519.

Another function of VGAM1808 is therefore inhibition of Chromosome 5 Open Reading Frame 4 (C5orf4, Accession NM_032385). Accordingly, utilities of VGAM1808 include diagnosis, prevention and treatment of diseases and clinical conditions associated with C5orf4. FLJ13352 (Accession NM_024592) is another VGAM1808 host target gene. FLJ13352 BINDING SITE is HOST TARGET binding site found in the 3' untranslated region of mRNA encoded by FLJ13352, corresponding to a HOST TARGET binding site such as BINDING SITE I, BINDING SITE II or BINDING SITE III. Table 2 illustrates the complementarity of the nucleotide sequences of FLJ13352 BINDING SITE, designated SEQ ID:23828, to the nucleotide sequence of VGAM1808 RNA, herein designated VGAM RNA, also designated SEQ ID:4519.

Another function of VGAM1808 is therefore inhibition of FLJ13352 (Accession NM_024592). Accordingly, utilities of VGAM1808 include diagnosis, prevention and treatment of diseases and clinical conditions associated with FLJ13352. FLJ14346 (Accession NM_025029) is another VGAM1808 host target gene. FLJ14346 BINDING SITE is HOST TARGET binding site found in the 3' untranslated region of mRNA encoded by FLJ14346, corresponding to a HOST TARGET binding site such as BINDING SITE I, BINDING SITE II or BINDING SITE III. Table 2 illustrates the complementarity of the nucleotide sequences of FLJ14346 BIND- ING SITE, designated SEQ ID:24622, to the nucleotide sequence of VGAM1808 RNA, herein designated VGAM RNA, also designated SEQ ID:4519.

Another function of VGAM1808 is therefore inhibition of FLJ14346 (Accession NM_025029). Accordingly, utilities of VGAM1808 include diagnosis, prevention and treatment of diseases and clinical conditions associated with FLJ14346. FLJ20073 (Accession NM_017654) is another VGAM1808 host target gene. FLJ20073 BINDING SITE is HOST TARGET binding site found in the 3' untranslated region of mRNA encoded by FLJ20073, corresponding to a HOST TARGET binding site such as BINDING SITE I, BINDING SITE II or BINDING SITE III. Table 2 illustrates the complementarity of the nucleotide sequences of FLJ20073 BINDING SITE, designated SEQ ID:19162, to the nucleotide sequence of VGAM1808 RNA, herein designated VGAM RNA, also designated SEQ ID:4519.

Another function of VGAM1808 is therefore inhibition of FLJ20073 (Accession NM_017654). Accordingly, utilities of VGAM1808 include diagnosis, prevention and treatment of diseases and clinical conditions associated with FLJ20073. FLJ22378 (Accession NM_025078) is another VGAM1808 host target gene. FLJ22378 BINDING SITE is HOST TARGET binding site found in the 3' untranslated region of mRNA encoded by FLJ22378, corresponding to a HOST TARGET binding site such as BINDING SITE I, BINDING SITE II or BINDING SITE III. Table 2 illustrates the complementarity of the nucleotide sequences of FLJ22378 BINDING SITE, designated SEQ ID:24678, to the nucleotide sequence of VGAM1808 RNA, herein designated VGAM RNA, also designated SEQ ID:4519.

Another function of VGAM1808 is therefore inhibition of FLJ22378 (Accession NM_025078). Accordingly, utilities of VGAM1808 include diagnosis, prevention and treatment of diseases and clinical conditions associated with FLJ22378. JDD1 (Accession XM_032515) is another VGAM1808 host target gene. JDD1 BINDING SITE is HOST TARGET binding site found in the 3' untranslated region of mRNA encoded by JDD1, corresponding to a HOST TARGET binding site such as BINDING SITE I, BINDING SITE II or BINDING SITE III. Table 2 illustrates the complementarity of the nucleotide sequences of JDD1 BINDING SITE, designated SEQ ID:31670, to the nucleotide sequence of VGAM1808 RNA, herein designated VGAM RNA, also designated SEQ ID:4519.

Another function of VGAM1808 is therefore inhibition of JDD1 (Accession XM_032515). Accordingly, utilities of VGAM1808 include diagnosis, prevention and treatment of diseases and clinical conditions associated with JDD1. Potassium Channel, Subfamily T, Member 1 (KCNT1, Accession XM_029962) is another VGAM1808 host target gene. KCNT1 BINDING SITE is HOST TARGET binding site found in the 3' untranslated region of mRNA encoded by KCNT1, corresponding to a HOST TARGET binding site such as BINDING SITE I, BINDING SITE II or BINDING SITE III. Table 2 illustrates the complementarity of the nucleotide sequences of KCNT1 BINDING SITE, designated SEQ ID:30972, to the nucleotide sequence of VGAM1808 RNA, herein designated VGAM RNA, also designated SEQ ID:4519.

Another function of VGAM1808 is therefore inhibition of Potassium Channel, Subfamily T, Member 1 (KCNT1, Accession XM_029962). Accordingly, utilities of VGAM1808 include diagnosis, prevention and treatment of diseases and clinical conditions associated with KCNT1. KIAA0285 (Accession NM_014807) is another VGAM1808 host target gene. KIAA0285 BINDING SITE is HOST TARGET binding site found in the 5' untranslated region of mRNA encoded by KIAA0285, corresponding to a HOST TARGET binding site such as BINDING SITE I, BINDING SITE II or BINDING SITE III. Table 2 illustrates the complementarity of the nucleotide sequences of KIAA0285 BINDING SITE, designated SEQ ID:16746, to the nucleotide sequence of VGAM1808 RNA, herein designated VGAM RNA, also designated SEQ ID:4519.

Another function of VGAM1808 is therefore inhibition of KIAA0285 (Accession NM_014807). Accordingly, utilities of VGAM1808 include diagnosis, prevention and treatment of diseases and clinical conditions associated with KIAA0285. KIAA1764 (Accession XM_045086) is another VGAM1808 host target gene. KIAA1764 BINDING SITE is HOST TARGET binding site found in the 5' untranslated region of mRNA encoded by KIAA1764, corresponding to a HOST TARGET binding site such as BINDING SITE I, BINDING SITE II or BINDING SITE III. Table 2 illustrates the complementarity of the nucleotide sequences of KIAA1764 BINDING SITE, designated SEQ ID:34353, to the nucleotide sequence of VGAM1808 RNA, herein designated VGAM RNA, also designated SEQ ID:4519.

Another function of VGAM1808 is therefore inhibition of KIAA1764 (Accession XM_045086). Accordingly, utilities of VGAM1808 include diagnosis, prevention and treatment of diseases and clinical conditions associated with KIAA1764. MGC2941 (Accession NM_024297) is another VGAM1808 host target gene. MGC2941 BINDING SITE is HOST TARGET binding site found in the 3' untranslated region of mRNA encoded by MGC2941, corresponding to a HOST TARGET binding site such as BINDING SITE I, BINDING SITE II or BINDING SITE III. Table 2 illustrates the complementarity of the nucleotide sequences of MGC2941 BINDING SITE, designated SEQ ID:23577, to the nucleotide sequence of VGAM1808 RNA, herein designated VGAM RNA, also designated SEQ ID:4519.

Another function of VGAM1808 is therefore inhibition of MGC2941 (Accession NM_024297). Accordingly, utilities of VGAM1808 include diagnosis, prevention and treatment of diseases and clinical conditions associated with MGC2941. moblak (Accession NM_130807) is another VGAM1808 host target gene. moblak BINDING SITE is HOST TARGET binding site found in the 3' untranslated region of mRNA encoded by moblak, corresponding to a HOST TARGET binding site such as BINDING SITE I, BINDING SITE II or BINDING SITE III. Table 2 illustrates the complementarity of the nucleotide sequences of moblak BINDING SITE, designated SEQ ID:28305, to the nucleotide sequence of VGAM1808 RNA, herein designated VGAM RNA, also designated SEQ ID:4519.

Another function of VGAM1808 is therefore inhibition of moblak (Accession NM_130807). Accordingly, utilities of VGAM1808 include diagnosis, prevention and treatment of diseases and clinical conditions associated with moblak. MSP (Accession NM_032046) is another VGAM1808 host target gene. MSP BINDING SITE is HOST TARGET binding site found in the 3' untranslated region of mRNA encoded by MSP, corresponding to a HOST TARGET binding site such as BINDING SITE I, BINDING SITE II or BINDING SITE III. Table 2 illustrates the complementarity of the nucleotide sequences of MSP BINDING SITE, designated SEQ ID:25760, to the nucleotide sequence of VGAM1808 RNA, herein designated VGAM RNA, also designated SEQ ID:4519.

Another function of VGAM1808 is therefore inhibition of MSP (Accession NM_032046). Accordingly, utilities of VGAM1808 include diagnosis, prevention and treatment of diseases and clinical conditions associated with MSP. Myosin, Heavy Polypeptide 10, Non-muscle (MYH10, Accession XM_044702) is another VGAM1808 host target gene. MYH10 BINDING SITE is HOST TARGET binding site found in the 3' untranslated region of mRNA encoded by MYH10, corresponding to a HOST TARGET binding site such as BINDING SITE I, BINDING SITE II or BINDING SITE III. Table 2 illustrates the complementarity of the nucleotide sequences of MYH10 BINDING SITE, designated SEQ ID:34260, to the nucleotide sequence of VGAM1808 RNA, herein designated VGAM RNA, also designated SEQ ID:4519.

Another function of VGAM1808 is therefore inhibition of Myosin, Heavy Polypeptide 10, Non-muscle (MYH10, Accession XM_044702). Accordingly, utilities of VGAM1808 include diagnosis, prevention and treatment of diseases and clinical conditions associated with MYH10. Solute Carrier Family 5 (choline transporter), Member 7 (SLC5A7, Accession NM_021815) is another VGAM1808 host target gene. SLC5A7 BINDING SITE is HOST TARGET binding site found in the 3' untranslated region of mRNA encoded by SLC5A7, corresponding to a HOST TARGET binding site such as BINDING SITE I, BINDING SITE II or BINDING SITE III. Table 2 illustrates the complementarity of the nucleotide sequences of SLC5A7 BINDING SITE, designated SEQ ID:22387, to the nucleotide sequence of VGAM1808 RNA, herein designated VGAM RNA, also designated SEQ ID:4519.

Another function of VGAM1808 is therefore inhibition of Solute Carrier Family 5 (choline transporter), Member 7 (SLC5A7, Accession NM_021815). Accordingly, utilities of VGAM1808 include diagnosis, prevention and treatment of diseases and clinical conditions associated with SLC5A7. LOC147514 (Accession XM_041564) is another VGAM1808 host target gene. LOC147514 BINDING SITE is HOST TARGET binding site found in the 3' untranslated region of mRNA encoded by LOC147514, corresponding to a HOST TARGET binding site such as BINDING SITE I, BINDING SITE II or BINDING SITE III. Table 2 illustrates the complementarity of the nucleotide sequences of LOC147514 BINDING SITE, designated SEQ ID:33548, to the nucleotide sequence of VGAM1808 RNA, herein designated VGAM RNA, also designated SEQ ID:4519.

Another function of VGAM1808 is therefore inhibition of LOC147514 (Accession XM_041564). Accordingly, utilities of VGAM1808 include diagnosis, prevention and treatment of diseases and clinical conditions associated with LOC147514. LOC157657 (Accession XM_088352) is another VGAM1808 host target gene. LOC157657 BINDING SITE is HOST TARGET binding site found in the 3' untranslated region of mRNA encoded by LOC157657, corresponding to a HOST TARGET binding site such as BINDING SITE I, BINDING SITE II or BINDING SITE III. Table 2 illustrates the complementarity of the nucleotide sequences of LOC157657 BINDING SITE, designated SEQ ID:39629, to the nucleotide sequence of VGAM1808 RNA, herein designated VGAM RNA, also designated SEQ ID:4519.

Another function of VGAM1808 is therefore inhibition of LOC157657 (Accession XM_088352). Accordingly, utilities of VGAM1808 include diagnosis, prevention and treatment of diseases and clinical conditions associated with LOC157657. LOC219347 (Accession XM_167564) is another VGAM1808 host target gene. LOC219347 BINDING SITE is HOST TARGET binding site found in the 5' untranslated region of mRNA encoded by LOC219347, corresponding to a HOST TARGET binding site such as BINDING SITE I, BINDING SITE II or BINDING SITE III. Table 2 illustrates the complementarity of the nucleotide sequences of LOC219347 BINDING SITE, designated SEQ ID:44677, to the nucleotide sequence of VGAM1808 RNA, herein designated VGAM RNA, also designated SEQ ID:4519.

Another function of VGAM1808 is therefore inhibition of LOC219347 (Accession XM_167564). Accordingly, utilities of VGAM1808 include diagnosis, prevention and treatment of diseases and clinical conditions associated with LOC219347. LOC221692 (Accession XM_166420) is another VGAM1808 host target gene. LOC221692 BINDING SITE is HOST TARGET binding site found in the 3' untranslated region of mRNA encoded by LOC221692, corresponding to a HOST TARGET binding site such as BINDING SITE I, BINDING SITE II or BINDING SITE III. Table 2 illustrates the complementarity of the nucleotide sequences of LOC221692 BINDING SITE, designated SEQ ID:44295, to the nucleotide sequence of VGAM1808 RNA, herein designated VGAM RNA, also designated SEQ ID:4519.

Another function of VGAM1808 is therefore inhibition of LOC221692 (Accession XM_166420). Accordingly, utilities of VGAM1808 include diagnosis, prevention and treatment of diseases and clinical conditions associated with LOC221692. LOC63923 (Accession XM_040527) is another VGAM1808 host target gene. LOC63923 BINDING SITE is HOST TARGET binding site found in the 3' untranslated region of mRNA encoded by LOC63923, corresponding to a HOST TARGET binding site such as BINDING SITE I, BINDING SITE II or BINDING SITE III. Table 2 illustrates the complementarity of the nucleotide sequences of LOC63923 BINDING SITE, designated SEQ ID:33322, to the nucleotide sequence of VGAM1808 RNA, herein designated VGAM RNA, also designated SEQ ID:4519.

Another function of VGAM1808 is therefore inhibition of LOC63923 (Accession XM_040527). Accordingly, utilities of VGAM1808 include diagnosis, prevention and treatment of diseases and clinical conditions associated with LOC63923. LOC90342 (Accession XM_031009) is another VGAM1808 host target gene. LOC90342 BINDING SITE is HOST TARGET binding site found in the 5' untranslated region of mRNA encoded by LOC90342, corresponding to a HOST TARGET binding site such as BINDING SITE I, BINDING SITE II or BINDING SITE III. Table 2 illustrates the complementarity of the nucleotide sequences of LOC90342 BINDING SITE, designated SEQ ID:31255, to the nucleotide sequence of VGAM1808 RNA, herein designated VGAM RNA, also designated SEQ ID:4519.

Another function of VGAM1808 is therefore inhibition of LOC90342 (Accession XM_031009). Accordingly, utilities of VGAM1808 include diagnosis, prevention and treatment of diseases and clinical conditions associated with LOC90342. LOC92465 (Accession XM_045250) is another VGAM1808 host target gene. LOC92465 BINDING SITE is HOST TARGET binding site found in the 5' untranslated region of mRNA encoded by LOC92465, corresponding to a HOST TARGET binding site such as BINDING SITE I, BINDING SITE II or BINDING SITE III. Table 2 illustrates the complementarity of the nucleotide sequences of LOC92465 BINDING SITE, designated SEQ ID:34392, to the nucleotide sequence of VGAM1808 RNA, herein designated VGAM RNA, also designated SEQ ID:4519.

Another function of VGAM1808 is therefore inhibition of LOC92465 (Accession XM_045250). Accordingly, utilities of VGAM1808 include diagnosis, prevention and treatment of diseases and clinical conditions associated with LOC92465. FIG. 1 further provides a conceptual description of a novel bioinformatically detected viral gene of the present invention, referred to here as Viral Genomic Address Messenger 1809 (VGAM1809) viral gene, which modulates expression of respective host target genes thereof, the function and utility of which host target genes is known in the art.

VGAM1809 is a novel bioinformatically detected regulatory, non protein coding, viral micro RNA (miRNA) gene. The method by which VGAM1809 was detected is described hereinabove with reference to FIGS. 1-8.

VGAM1809 gene, herein designated VGAM GENE, is a viral gene contained in the genome of Rana Tigrina Ranavirus. VGAM1809 host target gene, herein designated VGAM HOST TARGET GENE, is a human gene contained in the human genome.

VGAM1809 gene encodes a VGAM1809 precursor RNA, herein designated VGAM PRECURSOR RNA. Similar to other miRNA genes, and unlike most ordinary genes, VGAM1809 precursor RNA does not encode a protein. A nucleotide sequence identical or highly similar to the nucleotide sequence of VGAM1809 precursor RNA is designated SEQ ID:1795, and is provided hereinbelow with reference to the sequence listing part. Nucleotide sequence SEQ ID:1795 is located at position 28383 relative to the genome of Rana Tigrina Ranavirus.

VGAM1809 precursor RNA folds onto itself, forming VGAM1809 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1809 folded precursor RNA into VGAM1809 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1809 RNA is designated SEQ ID:4520, and is provided hereinbelow with reference to the sequence listing part.

VGAM1809 host target gene, herein designated VGAM HOST TARGET GENE, encodes a corresponding messenger RNA, VGAM1809 host target RNA, herein designated VGAM HOST TARGET RNA. VGAM1809 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1809 RNA, herein designated VGAM RNA, binds complementarily to one or more host target binding sites located in untranslated regions of VGAM1809 host target RNA, herein designated VGAM HOST TARGET RNA. This complementary binding is due to the fact that the nucleotide sequence of VGAM1809 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1809 RNA, herein designated VGAM RNA, may have a different number of host target binding sites in untranslated regions of a VGAM1809 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1809 RNA, herein designated VGAM RNA, to host target binding sites on VGAM1809 host target RNA, herein designated VGAM HOST TARGET RNA, such as BINDING SITE I, BINDING SITE II and BINDING SITE III, inhibits translation of VGAM1809 host target RNA into VGAM1809 host target protein, herein designated VGAM HOST TARGET PROTEIN. VGAM host target protein is therefore outlined by a broken line.

It is appreciated that VGAM1809 host target gene, herein designated VGAM HOST TARGET GENE, in fact represents a plurality of VGAM1809 host target genes. The mRNA of each one of this plurality of VGAM1809 host target genes comprises one or more host target binding sites, each having a nucleotide sequence which is at least partly complementary to VGAM1809 RNA, herein designated VGAM RNA, and which when bound by VGAM1809 RNA causes inhibition of translation of respective one or more VGAM1809 host target proteins.

It is further appreciated by one skilled in the art that the mode of translational inhibition illustrated by FIG. 1 with specific reference to translational inhibition exerted by VGAM1809 gene, herein designated VGAM GENE, on one or more VGAM1809 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1809 is inhibition of expression of host target genes, as part of a novel viral mechanism of attacking a host. Accordingly, utilities of VGAM1809 include diagnosis, prevention and treatment of viral infection by Rana Tigrina Ranavirus. Specific functions, and accordingly utilities, of VGAM1809 correlate with, and may be deduced from, the identity of the host target genes which VGAM1809 binds and inhibits, and the function of these host target genes, as elaborated hereinbelow.

Nucleotide sequences of the VGAM1809 precursor RNA, herein designated VGAM PRECURSOR RNA, and of the 'diced' VGAM1809 RNA, herein designated VGAM RNA, and a schematic representation of the secondary folding of VGAM1809 folded precursor RNA, herein designated VGAM FOLDED PRECURSOR RNA, of VGAM1809 are further described hereinbelow with reference to Table 1.

Nucleotide sequences of host target binding sites, such as BINDING SITE-I, BINDING SITE-II and BINDING SITE-III of FIG. 1, found on VGAM1809 host target RNA, and schematic representation of the complementarity of each of these host target binding sites to VGAM1809 RNA, herein designated VGAM RNA, are described hereinbelow with reference to Table 2.

As mentioned hereinabove with reference to FIG. 1, a function of VGAM1809 gene, herein designated VGAM is inhibition of expression of VGAM1809 target genes. It is appreciated that specific functions, and accordingly utilities, of VGAM1809 correlate with, and may be deduced from, the identity of the target genes which VGAM1809 binds and inhibits, and the function of these target genes, as elaborated hereinbelow.

Telomerase-associated Protein 1 (TEP1, Accession NM_007110) is a VGAM1809 host target gene. TEP1 BINDING SITE is HOST TARGET binding site found in the 3' untranslated region of mRNA encoded by TEP1, corresponding to a HOST TARGET binding site such as BINDING SITE I, BINDING SITE II or BINDING SITE III. Table 2 illustrates the complementarity of the nucleotide sequences of TEP1 BINDING SITE, designated SEQ ID:13975, to the nucleotide sequence of VGAM1809 RNA, herein designated VGAM RNA, also designated SEQ ID:4520.

A function of VGAM1809 is therefore inhibition of Telomerase-associated Protein 1 (TEP1, Accession NM_007110), a gene which interacts with active telomerase RNA. Accordingly, utilities of VGAM1809 include diagnosis, prevention and treatment of diseases and clinical conditions associated with TEP1. The function of TEP1 has been established by previous studies. The telomerase ribonucleoprotein (OMIM Ref. No. 187270) catalyzes the addition of new telomeres on the chromosome ends. Harrington et al. (1997) noted that in human S, the telomeric repeat is 5-prime-TTAGGG-3-prime and the telomerase RNA contains a sequence complementary to this telomeric repeat. The telomerase RNA template is required for telomere repeat synthesis in vitro and in vivo. The ribonucleoprotein complex responsible for telomerase activity had been purified only in ciliates. Purified tetrahymena telomerase contains an RNA and 2 protein components, p80 and p95. The p80 component can be specifically cross linked to telomerase RNA, whereas the p95 component binds and cross links to single-stranded, telomeric DNA. Harrington et al. (1997) identified a cDNA encoding a tetrahymena p80 homolog from a murine colonic crypt expressed sequence tag (EST) database. The mouse sequence was used as a probe to identify contiguous human cDNA clones from a library prepared from a human colon carcinoma cell line. The mouse and human open reading frames were found to be 75% identical at the amino acid level. The predicted human polypeptide contains 2,627 amino acids, 2 fewer than the predicted mouse polypeptide. Northern blot analysis of both mouse and human tissues showed widespread expression of the gene, which they symbolized TP1. The studies indicated that telomerase-associated proteins are conserved from ciliates to human S. Saito et al. (1997) mapped the human TEP1 gene and mouse Tep1 gene by fluorescence in situ hybridization to human chromosome 14q11.2 and to the C2-D1 band of mouse chromosome 14, respectively. By means of genetic linkage mapping, the mouse gene was further localized to a position 2.7 cM distal to D14Mit18 and D14Mit134, and 2.0 cM proximal to D14Mit5 on mouse chromosome 14, where conserved linkage homology with human chromosome 14q11-q12 had been identified.

Full details of the abovementioned studies are described in the following publications, the disclosure of which are hereby incorporated by reference:

Harrington, L.; McPhail, T.; Mar, V.; Zhou, W.; Oulton, R.; Bass, M. B.; Arruda, I.; Robinson, M. O.: A mammalian telomerase-associated protein. Science 275:973-976, 1997; and Saito, T.; Matsuda, Y.; Suzuki, T.; Hayashi, A.; Yuan, X.; Saito, M.; Nakayama, J.; Hori, T.; Ishikawa, F.: Comparative gene mapping of the human and mouse TEP1 genes, which encode one.

Further studies establishing the function and utilities of TEP1 are found in John Hopkins OMIM database record ID 601686, and in sited publications numbered 6227-6228 listed in the bibliography section hereinbelow, which are also hereby incorporated by reference. Zinc Finger Protein 265 (ZNF265, Accession NM_005455) is another VGAM1809 host target gene. ZNF265 BINDING SITE is HOST TARGET binding site found in the 3' untranslated region of mRNA encoded by ZNF265, corresponding to a HOST TARGET binding site such as BINDING SITE I, BINDING SITE II or BINDING SITE III. Table 2 illustrates the complementarity of the nucleotide sequences of ZNF265 BINDING SITE, designated SEQ ID:11937, to the nucleotide sequence of VGAM1809 RNA, herein designated VGAM RNA, also designated SEQ ID:4520.

Another function of VGAM1809 is therefore inhibition of Zinc Finger Protein 265 (ZNF265, Accession NM_005455). Accordingly, utilities of VGAM1809 include diagnosis, prevention and treatment of diseases and clinical conditions associated with ZNF265. LOC147837 (Accession XM_085915) is another VGAM1809 host target gene. LOC147837 BINDING SITE is HOST TARGET binding site found in the 3' untranslated region of mRNA encoded by LOC147837, corresponding to a HOST TARGET binding site such as BINDING SITE I, BINDING SITE II or BINDING SITE III. Table 2 illustrates the complementarity of the nucleotide sequences of LOC147837 BINDING SITE, designated SEQ ID:38395, to the nucleotide sequence of VGAM1809 RNA, herein designated VGAM RNA, also designated SEQ ID:4520.

Another function of VGAM1809 is therefore inhibition of LOC147837 (Accession XM_085915). Accordingly, utilities of VGAM1809 include diagnosis, prevention and treatment of diseases and clinical conditions associated with LOC147837. LOC221656 (Accession XM_166418) is another VGAM1809 host target gene. LOC221656 BINDING SITE is HOST TARGET binding site found in the 3' untranslated region of mRNA encoded by LOC221656, corresponding to a HOST TARGET binding site such as BINDING SITE I, BINDING SITE II or BINDING SITE III. Table 2 illustrates the complementarity of the nucleotide sequences of LOC221656 BINDING SITE, designated SEQ ID:44293, to the nucleotide sequence of VGAM1809 RNA, herein designated VGAM RNA, also designated SEQ ID:4520.

Another function of VGAM1809 is therefore inhibition of LOC221656 (Accession XM_166418). Accordingly, utilities of VGAM1809 include diagnosis, prevention and treatment of diseases and clinical conditions associated with LOC221656. FIG. 1 further provides a conceptual description of a novel bioinformatically detected viral gene of the present invention, referred to here as Viral Genomic Address Messenger 1810 (VGAM1810) viral gene, which modulates expression of respective host target genes thereof, the function and utility of which host target genes is known in the art.

VGAM1810 is a novel bioinformatically detected regulatory, non protein coding, viral micro RNA (miRNA) gene. The method by which VGAM1810 was detected is described hereinabove with reference to FIGS. 1-8.

VGAM1810 gene, herein designated VGAM GENE, is a viral gene contained in the genome of Equine Herpesvirus 1. VGAM1810 host target gene, herein designated VGAM HOST TARGET GENE, is a human gene contained in the human genome.

VGAM1810 gene encodes a VGAM1810 precursor RNA, herein designated VGAM PRECURSOR RNA. Similar to other miRNA genes, and unlike most ordinary genes, VGAM1810 precursor RNA does not encode a protein. A nucleotide sequence identical or highly similar to the nucleotide sequence of VGAM1810 precursor RNA is designated SEQ ID:1796, and is provided hereinbelow with reference to the sequence listing part. Nucleotide sequence SEQ ID:1796 is located at position 128214 relative to the genome of Equine Herpesvirus 1.

VGAM1810 precursor RNA folds onto itself, forming VGAM1810 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1810 folded precursor RNA into VGAM1810 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM1810 RNA is designated SEQ ID:4521, and is provided hereinbelow with reference to the sequence listing part.

VGAM1810 host target gene, herein designated VGAM HOST TARGET GENE, encodes a corresponding messenger RNA, VGAM1810 host target RNA, herein designated VGAM HOST TARGET RNA. VGAM1810 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1810 RNA, herein designated VGAM RNA, binds complementarily to one or more host target binding sites located in untranslated regions of VGAM1810 host target RNA, herein designated VGAM HOST TARGET RNA. This complementary binding is due to the fact that the nucleotide sequence of VGAM1810 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1810 RNA, herein designated VGAM RNA, may have a different number of host target binding sites in untranslated regions of a VGAM1810 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1810 RNA, herein designated VGAM RNA, to host target binding sites on VGAM1810 host target RNA, herein designated VGAM HOST TARGET RNA, such as BINDING SITE I, BINDING SITE II and BINDING SITE III, inhibits translation of VGAM1810 host target RNA into VGAM1810 host target protein, herein designated VGAM HOST TARGET PROTEIN. VGAM host target protein is therefore outlined by a broken line.

It is appreciated that VGAM1810 host target gene, herein designated VGAM HOST TARGET GENE, in fact represents a plurality of VGAM1810 host target genes. The mRNA of each one of this plurality of VGAM1810 host target genes comprises one or more host target binding sites, each having a nucleotide sequence which is at least partly complementary to VGAM1810 RNA, herein designated VGAM RNA, and which when bound by VGAM1810 RNA causes inhibition of translation of respective one or more VGAM1810 host target proteins.

It is further appreciated by one skilled in the art that the mode of translational inhibition illustrated by FIG. 1 with specific reference to translational inhibition exerted by VGAM1810 gene, herein designated VGAM GENE, on one or more VGAM1810 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1810 is inhibition of expression of host target genes, as part of a novel viral mechanism of attacking a host. Accordingly, utilities of VGAM1810 include diagnosis, prevention and treatment of viral infection by Equine Herpesvirus 1. Specific functions, and accordingly utilities, of VGAM1810 correlate with, and may be deduced from, the identity of the host target genes which VGAM1810 binds and inhibits, and the function of these host target genes, as elaborated hereinbelow.

Nucleotide sequences of the VGAM1810 precursor RNA, herein designated VGAM PRECURSOR RNA, and of the 'diced' VGAM1810 RNA, herein designated VGAM RNA, and a schematic representation of the secondary folding of VGAM1810 folded precursor RNA, herein designated VGAM FOLDED PRECURSOR RNA, of VGAM1810 are further described hereinbelow with reference to Table 1.

Nucleotide sequences of host target binding sites, such as BINDING SITE-I, BINDING SITE-II and BINDING SITE-III of FIG. 1, found on VGAM1810 host target RNA, and schematic representation of the complementarity of each of these host target binding sites to VGAM1810 RNA, herein designated VGAM RNA, are described hereinbelow with reference to Table 2.

As mentioned hereinabove with reference to FIG. 1, a function of VGAM1810 gene, herein designated VGAM is inhibition of expression of VGAM1810 target genes. It is appreciated that specific functions, and accordingly utilities, of VGAM1810 correlate with, and may be deduced from, the identity of the target genes which VGAM1810 binds and inhibits, and the function of these target genes, as elaborated hereinbelow.

Inositol Hexaphosphate Kinase 1 (IHPK1, Accession XM_171045) is a VGAM1810 host target gene. IHPK1 BINDING SITE is HOST TARGET binding site found in the 3' untranslated region of mRNA encoded by IHPK1, corresponding to a HOST TARGET binding site such as BINDING SITE I, BINDING SITE II or BINDING SITE III. Table 2 illustrates the complementarity of the nucleotide sequences of IHPK1 BINDING SITE, designated SEQ ID:45823, to the nucleotide sequence of VGAM1810 RNA, herein designated VGAM RNA, also designated SEQ ID:4521.

A function of VGAM1810 is therefore inhibition of Inositol Hexaphosphate Kinase 1 (IHPK1, Accession XM_171045), a gene which is a messenger molecule that releases calcium from intracellular stores. Accordingly, utilities of VGAM1810 include diagnosis, prevention and treatment of diseases and clinical conditions associated with IHPK1. The function of IHPK1 and its association with various diseases and clinical conditions, has been established by previous studies, as described hereinabove with reference to VGAM1061. Ring Finger Protein 26 (RNF26, Accession NM_032015) is another VGAM1810 host target gene. RNF26 BINDING SITE is HOST TARGET binding site found in the 3' untranslated region of mRNA encoded by RNF26, corresponding to a HOST TARGET binding site such as BINDING SITE I, BINDING SITE II or BINDING SITE III. Table 2 illustrates the complementarity of the nucleotide sequences of RNF26 BINDING SITE, designated SEQ ID:25728, to the nucleotide sequence of VGAM1810 RNA, herein designated VGAM RNA, also designated SEQ ID:4521.

Another function of VGAM1810 is therefore inhibition of Ring Finger Protein 26 (RNF26, Accession NM_032015). Accordingly, utilities of VGAM1810 include diagnosis, prevention and treatment of diseases and clinical conditions associated with RNF26. FLJ10898 (Accession XM_002486) is another VGAM1810 host target gene. FLJ10898 BINDING SITE is HOST TARGET binding site found in the 5' untranslated region of mRNA encoded by FLJ10898, corresponding to a HOST TARGET binding site such as BINDING SITE I, BINDING SITE II or BINDING SITE III. Table 2 illustrates the complementarity of the nucleotide sequences of FLJ10898 BINDING SITE, designated SEQ ID:29892, to the nucleotide sequence of VGAM1810 RNA, herein designated VGAM RNA, also designated SEQ ID:4521.

Another function of VGAM1810 is therefore inhibition of FLJ10898 (Accession XM_002486). Accordingly, utilities of VGAM1810 include diagnosis, prevention and treatment of diseases and clinical conditions associated with FLJ10898. KIAA1550 (Accession XM_039393) is another VGAM1810 host target gene. KIAA1550 BINDING SITE is HOST TARGET binding site found in the 3' untranslated region of mRNA encoded by KIAA1550, corresponding to a HOST TARGET binding site such as BINDING SITE I, BINDING SITE II or BINDING SITE III. Table 2 illustrates the complementarity of the nucleotide sequences of KIAA1550 BINDING SITE, designated SEQ ID:33070, to the nucleotide sequence of VGAM1810 RNA, herein designated VGAM RNA, also designated SEQ ID:4521.

Another function of VGAM1810 is therefore inhibition of KIAA1550 (Accession XM_039393). Accordingly, utilities of VGAM1810 include diagnosis, prevention and treatment of diseases and clinical conditions associated with KIAA1550. Ubiquitin-like, Containing PHD and RING Finger Domains, 1 (UHRF1, Accession NM_013282) is another VGAM1810 host target gene. UHRF1 BINDING SITE is HOST TARGET binding site found in the 3' untranslated region of mRNA encoded by UHRF1, corresponding to a HOST TARGET binding site such as BINDING SITE I, BINDING SITE II or BINDING SITE III. Table 2 illustrates the complementarity of the nucleotide sequences of UHRF1 BINDING SITE, designated SEQ ID:14951, to the nucleotide sequence of VGAM1810 RNA, herein designated VGAM RNA, also designated SEQ ID:4521.

Another function of VGAM1810 is therefore inhibition of Ubiquitin-like, Containing PHD and RING Finger Domains, 1 (UHRF1, Accession NM_013282). Accordingly, utilities of VGAM1810 include diagnosis, prevention and treatment of diseases and clinical conditions associated with UHRF1. Ubiquitin Specific Protease 20 (USP20, Accession NM_006676) is another VGAM1810 host target gene. USP20 BINDING SITE is HOST TARGET binding site found in the 3' untranslated region of mRNA encoded by USP20, corresponding to a HOST TARGET binding site such as BINDING SITE I, BINDING SITE II or BINDING SITE III. Table 2 illustrates the complementarity of the nucleotide sequences of USP20 BINDING SITE, designated SEQ ID:13502, to the nucleotide sequence of VGAM1810 RNA, herein designated VGAM RNA, also designated SEQ ID:4521.

Another function of VGAM1810 is therefore inhibition of Ubiquitin Specific Protease 20 (USP20, Accession NM_006676). Accordingly, utilities of VGAM1810 include diagnosis, prevention and treatment of diseases and clinical conditions associated with USP20. LOC147299 (Accession XM_085763) is another VGAM1810 host target gene. LOC147299 BINDING SITE is HOST TARGET binding site found in the 3' untranslated region of mRNA encoded by LOC147299, corresponding to a HOST TARGET binding site such as BINDING SITE I, BINDING SITE II or BINDING SITE III. Table 2 illustrates the complementarity of the nucleotide sequences of LOC147299 BINDING SITE, designated SEQ ID:38331, to the nucleotide sequence of VGAM1810 RNA, herein designated VGAM RNA, also designated SEQ ID:4521.

Another function of VGAM1810 is therefore inhibition of LOC147299 (Accession XM_085763). Accordingly, utilities of VGAM1810 include diagnosis, prevention and treatment of diseases and clinical conditions associated with LOC147299. LOC255189 (Accession XM_172929) is another VGAM1810 host target gene. LOC255189 BINDING SITE is HOST TARGET binding site found in the 5' untranslated region of mRNA encoded by LOC255189, corresponding to a HOST TARGET binding site such as BINDING SITE I, BINDING SITE II or BINDING SITE III. Table 2 illustrates the complementarity of the nucleotide sequences of LOC255189 BINDING SITE, designated SEQ ID:46193, to the nucleotide sequence of VGAM1810 RNA, herein designated VGAM RNA, also designated SEQ ID:4521.

Another function of VGAM1810 is therefore inhibition of LOC255189 (Accession XM_172929). Accordingly, utilities of VGAM1810 include diagnosis, prevention and treatment of diseases and clinical conditions associated with LOC255189. LOC257476 (Accession XM_028610) is another VGAM1810 host target gene. LOC257476 BINDING SITE is HOST TARGET binding site found in the 3' untranslated region of mRNA encoded by LOC257476, corresponding to a HOST TARGET binding site such as BINDING SITE I, BINDING SITE II or BINDING SITE III. Table 2 illustrates the complementarity of the nucleotide sequences of LOC257476 BINDING SITE, designated SEQ ID:30715, to the nucleotide sequence of VGAM1810 RNA, herein designated VGAM RNA, also designated SEQ ID:4521.

Another function of VGAM1810 is therefore inhibition of LOC257476 (Accession XM_028610). Accordingly, utilities of VGAM1810 include diagnosis, prevention and treatment of diseases and clinical conditions associated with LOC257476. LOC90917 (Accession XM_034861) is another VGAM1810 host target gene. LOC90917 BINDING SITE is HOST TARGET binding site found in the 3' untranslated region of mRNA encoded by LOC90917, corresponding to a HOST TARGET binding site such as BINDING SITE I, BINDING SITE II or BINDING SITE III. Table 2 illustrates the complementarity of the nucleotide sequences of LOC90917 BINDING SITE, designated SEQ ID:32167, to the nucleotide sequence of VGAM1810 RNA, herein designated VGAM RNA, also designated SEQ ID:4521.

Another function of VGAM1810 is therefore inhibition of LOC90917 (Accession XM_034861). Accordingly, utilities of VGAM1810 include diagnosis, prevention and treatment of diseases and clinical conditions associated with LOC90917. FIG. 1 further provides a conceptual description of a novel bioinformatically detected viral gene of the present invention, referred to here as Viral Genomic Address Messenger 1811 (VGAM1811) viral gene, which modulates expression of respective host target genes thereof, the function and utility of which host target genes is known in the art.

VGAM1811 is a novel bioinformatically detected regulatory, non protein coding, viral micro RNA (miRNA) gene. The method by which VGAM1811 was detected is described hereinabove with reference to FIGS. 1-8.

VGAM1811 gene, herein designated VGAM GENE, is a viral gene contained in the genome of Equine Herpesvirus 1. VGAM1811 host target gene, herein designated VGAM HOST TARGET GENE, is a human gene contained in the human genome.

VGAM1811 gene encodes a VGAM1811 precursor RNA, herein designated VGAM PRECURSOR RNA. Similar to other miRNA genes, and unlike most ordinary genes, VGAM1811 precursor RNA does not encode a protein. A nucleotide sequence identical or highly similar to the nucleotide sequence of VGAM1811 precursor RNA is designated SEQ ID:1797, and is provided hereinbelow with reference to the sequence listing part. Nucleotide sequence SEQ ID:1797 is located at position 132691 relative to the genome of Equine Herpesvirus 1.

VGAM1811 precursor RNA folds onto itself, forming VGAM1811 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1811 folded precursor RNA into VGAM1811 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1811 RNA is designated SEQ ID:4522, and is provided hereinbelow with reference to the sequence listing part.

VGAM1811 host target gene, herein designated VGAM HOST TARGET GENE, encodes a corresponding messenger RNA, VGAM1811 host target RNA, herein designated VGAM HOST TARGET RNA. VGAM1811 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1811 RNA, herein designated VGAM RNA, binds complementarily to one or more host target binding sites located in untranslated regions of VGAM1811 host target RNA, herein designated VGAM HOST TARGET RNA. This complementary binding is due to the fact that the nucleotide sequence of VGAM1811 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1811 RNA, herein designated VGAM RNA, may have a different number of host target binding sites in untranslated regions of a VGAM1811 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1811 RNA, herein designated VGAM RNA, to host target binding sites on VGAM1811 host target RNA, herein designated VGAM HOST TARGET RNA, such as BINDING SITE I, BINDING SITE II and BINDING SITE III, inhibits translation of VGAM1811 host target RNA into VGAM1811 host target protein, herein designated VGAM HOST TARGET PROTEIN. VGAM host target protein is therefore outlined by a broken line.

It is appreciated that VGAM1811 host target gene, herein designated VGAM HOST TARGET GENE, in fact represents a plurality of VGAM1811 host target genes. The mRNA of each one of this plurality of VGAM1811 host target genes comprises one or more host target binding sites, each having a nucleotide sequence which is at least partly complementary to VGAM1811 RNA, herein designated VGAM RNA, and which when bound by VGAM1811 RNA causes inhibition of translation of respective one or more VGAM1811 host target proteins.

It is further appreciated by one skilled in the art that the mode of translational inhibition illustrated by FIG. 1 with specific reference to translational inhibition exerted by VGAM1811 gene, herein designated VGAM GENE, on one or more VGAM1811 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1811 is inhibition of expression of host target genes, as part of a novel viral mechanism of attacking a host. Accordingly, utilities of VGAM1811 include diagnosis, prevention and treatment of viral infection by Equine Herpesvirus 1. Specific functions, and accordingly utilities, of VGAM1811 correlate with, and may be deduced from, the identity of the host target genes which VGAM1811 binds and inhibits, and the function of these host target genes, as elaborated hereinbelow.

Nucleotide sequences of the VGAM1811 precursor RNA, herein designated VGAM PRECURSOR RNA, and of the 'diced' VGAM1811 RNA, herein designated VGAM RNA, and a schematic representation of the secondary folding of VGAM1811 folded precursor RNA, herein designated VGAM FOLDED PRECURSOR RNA, of VGAM1811 are further described hereinbelow with reference to Table 1.

Nucleotide sequences of host target binding sites, such as BINDING SITE-I, BINDING SITE-II and BINDING SITE-III of FIG. 1, found on VGAM1811 host target RNA, and schematic representation of the complementarity of each of these host target binding sites to VGAM1811 RNA, herein designated VGAM RNA, are described hereinbelow with reference to Table 2.

As mentioned hereinabove with reference to FIG. 1, a function of VGAM1811 gene, herein designated VGAM is inhibition of expression of VGAM1811 target genes. It is appreciated that specific functions, and accordingly utilities, of VGAM1811 correlate with, and may be deduced from, the identity of the target genes which VGAM1811 binds and inhibits, and the function of these target genes, as elaborated hereinbelow.

Complement Component 7 (C7, Accession NM_000587) is a VGAM1811 host target gene. C7 BINDING SITE is HOST TARGET binding site found in the 3' untranslated region of mRNA encoded by C7, corresponding to a HOST TARGET binding site such as BINDING SITE I, BINDING SITE II or BINDING SITE III. Table 2 illustrates the complementarity of the nucleotide sequences of C7 BINDING SITE, designated SEQ ID:6190, to the nucleotide sequence of VGAM1811 RNA, herein designated VGAM RNA, also designated SEQ ID:4522.

A function of VGAM1811 is therefore inhibition of Complement Component 7 (C7, Accession NM_000587). Accordingly, utilities of VGAM1811 include diagnosis, prevention and treatment of diseases and clinical conditions associated with C7. Cholecystokinin A Receptor (CCKAR, Accession NM_000730) is another VGAM1811 host target gene. CCKAR BINDING SITE is HOST TARGET binding site found in the 5' untranslated region of mRNA encoded by CCKAR, corresponding to a HOST TARGET binding site such as BINDING SITE I, BINDING SITE II or BINDING SITE III. Table 2 illustrates the complementarity of the nucleotide sequences of CCKAR BINDING SITE, designated SEQ ID:6389, to the nucleotide sequence of VGAM1811 RNA, herein designated VGAM RNA, also designated SEQ ID:4522.

Another function of VGAM1811 is therefore inhibition of Cholecystokinin A Receptor (CCKAR, Accession NM_000730), a gene which Cholecystokinin A receptor, a G protein-coupled receptor; regulates gallbladder contraction and secretion of pancreatic enzymes. Accordingly, utilities of VGAM1811 include diagnosis, prevention and treatment of diseases and clinical conditions associated with CCKAR. The function of CCKAR has been established by previous studies. The cholecystokinin (CCK) family of peptide hormones (see OMIM Ref. No. 118440) have been implicated in numerous important physiologic events. These appear to be mediated through 2 general classes of receptors, A and B, based on their binding affinities for CCK/gastrin family peptides. Boden et al. (1995) compared the biologic and molecular properties of CCKA and CCKB (OMIM Ref. No. 118445) receptors. Ulrich et al. (1993) noted that, through binding to class A receptors, CCK is a major physiologic mediator of gallbladder contraction and pancreatic enzyme secretion. It appears to play a role in slowing gastric emptying, relaxation of the sphincter of Oddi, and potentiation of insulin secretion. Further, it has been implicated as a mediator of pancreatic growth and tumorigenesis. Class A receptors have also been described in the anterior pituitary, myenteric plexus, and regions of the central nervous system, where they have been implicated in the pathogenesis of feeding disorders, Parkinson disease, schizophrenia, and drug addiction. Animal model experiments lend further support to the function of CCKAR. ANIMAL MODEL Funakoshi et al. (1995) found a defect in expression of the CCKAR gene in both the fetal and the adult pancreas of a strain of rats (OLETF). They proposed these rats as a useful model for determining CCK receptor function.

It is appreciated that the abovementioned animal model for CCKAR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ulrich, C. D.; Ferber, I.; Holicky, E.; Hadac, E.; Buell, G.; Miller, L. J.: Molecular cloning and functional expression of the human gallbladder cholecystokinin A receptor. Biochem. Biophys. Res. Commun. 193:204-211, 1993; and Funakoshi, A.; Miyasaka, K.; Shinozaki, H.; Masuda, M.; Kawanami, T.; Takata, Y.; Kono, A.: An animal model of congenital defect of gene expression of cholecystokinin (CCK)-A receptor.

Further studies establishing the function and utilities of CCKAR are found in John Hopkins OMIM database record ID 118444, and in sited publications numbered 336-345 listed in the bibliography section hereinbelow, which are also hereby incorporated by reference. Interferon, Omega 1 (IFNW1, Accession NM_002177) is another VGAM1811 host target gene. IFNW1 BINDING SITE is HOST TARGET binding site found in the 5' untranslated region of mRNA encoded by IFNW1, corresponding to a HOST TARGET binding site such as BINDING SITE I, BINDING SITE II or BINDING SITE III. Table 2 illustrates the complementarity of the nucleotide sequences of IFNW1 BINDING SITE, designated SEQ ID:7936, to the nucleotide sequence of VGAM1811 RNA, herein designated VGAM RNA, also designated SEQ ID:4522.

Another function of VGAM1811 is therefore inhibition of Interferon, Omega 1 (IFNW1, Accession NM_002177), a gene which may regulate antiviral defence, cell growth, and immune activation. Accordingly, utilities of VGAM1811 include diagnosis, prevention and treatment of diseases and clinical conditions associated with IFNW1. The function of IFNW1 has been established by previous studies. Henco et al. (1985) compiled partial maps of the interferon gene cluster located on 9p21. These maps showed that members of the 2 main families of genes in the IFN superfamily, interferon-alpha (OMIM Ref. No. 147660) and interferon-omega (IFNW), are interspersed. Olopade et al. (1992) studied the deletions of the short arm of chromosome 9 frequently observed in acute lymphoblastic leukemia and in gliomas. These deletions often include the entire interferon gene cluster, which comprises about 26 IFNA, IFNW, and IFNB1 (OMIM Ref. No. 147640) genes, as well as the gene for methylthioadenosine phosphorylase (MTAP; 156540). By comparing microscopic deletions with the genes lost at the molecular level, Olopade et al. (1992) determined the order of these genes on 9p to be tel--IFNB1--IFNA/IFNW cluster--MTAP--cen. In a few cell lines and in primary leukemia cells, they observed deletions that had breakpoints within the IFN gene cluster and resulted in partial loss of the IFN genes. These partial deletions allowed them to determine the order of some genes or groups of genes in the IFNA/IFNW gene cluster. From their deletion analysis, Olopade et al. (1992) deduced the following order of the IFN gene on 9p: pter--IFNB1--(IFNW1, IFNA21)--IFNWP15--IFNA4--IFNW9--IFNA7--IFNA10--IFNWP18--IFNAP16--IFNA17--IFNA14--(IFNA22, IFNA5, IFNAP20, IFNA6, IFNA13, IFNA2)--(IFNA8, IFNW2, IFNWP19, IFNA1)--MTAP--cen. The genes within the large linkage group are arranged in tandem with their 3-prime end pointing toward the telomere of the short arm. Thus, at least 2 functional interferon-omega genes, IFNW1 and IFNW2, were mapped and several IFNW pseudogenes, e.g., IFNWP15, were localized Full details of the abovementioned studies are described in the following publications, the disclosure of which are hereby incorporated by reference:

Olopade, O. I.; Bohlander, S. K.; Pomykala, H.; Maltepe, E.; Van Melle, E.; Le Beau, M. M.; Diaz, M. O.: Mapping of the shortest region of overlap of deletions of the short arm of chromosome 9 associated with human neoplasia. Genomics 14:437-443, 1992; and Diaz, M. O.; Bohlander, S.: Nomenclature of the human interferon genes. J. Interferon Res. 13:443-444, 1993.

Further studies establishing the function and utilities of IFNW1 are found in John Hopkins OMIM database record ID 147553, and in sited publications numbered 4473-4475 listed in the bibliography section hereinbelow, which are also hereby incorporated by reference. Like-glycosyltransferase (LARGE, Accession NM_004737) is another VGAM1811 host target gene. LARGE BINDING SITE1 and LARGE BINDING SITE2 are HOST TARGET binding sites found in untranslated regions of mRNA encoded by LARGE, corresponding to HOST TARGET binding sites such as BINDING SITE I, BINDING SITE II or BINDING SITE III. Table 2 illustrates the complementarity of the nucleotide sequences of LARGE BINDING SITE1 and LARGE BINDING SITE2, designated SEQ ID:11129 and SEQ ID:28601 respectively, to the nucleotide sequence of VGAM1811 RNA, herein designated VGAM RNA, also designated SEQ ID:4522.

Another function of VGAM1811 is therefore inhibition of Like-glycosyltransferase (LARGE, Accession NM_004737), a gene which is a member of the N-acetylglucosaminyltransferase family. Accordingly, utilities of VGAM1811 include diagnosis, prevention and treatment of diseases and clinical conditions associated with LARGE. The function of LARGE and its association with various diseases and clinical conditions, has been established by previous studies, as described hereinabove with reference to VGAM205. Ubiquitin-conjugating Enzyme E2 Variant 1 (UBE2V1, Accession NM_022442) is another VGAM1811 host target gene. UBE2V1 BINDING SITE1 through UBE2V1 BINDING SITE3 are HOST TARGET binding sites found in untranslated regions of mRNA encoded by UBE2V1, corresponding to HOST TARGET binding sites such as BINDING SITE I, BINDING SITE II or BINDING SITE III. Table 2 illustrates the complementarity of the nucleotide sequences of UBE2V1 BINDING SITE1 through UBE2V1 BINDING SITE3, designated SEQ ID:22763, SEQ ID:9364 and SEQ ID:25510 respectively, to the nucleotide sequence of VGAM1811 RNA, herein designated VGAM RNA, also designated SEQ ID:4522.

Another function of VGAM1811 is therefore inhibition of Ubiquitin-conjugating Enzyme E2 Variant 1 (UBE2V1, Accession NM_022442), a gene which may play a role in signaling for DNA repair. Accordingly, utilities of VGAM1811 include diagnosis, prevention and treatment of diseases and clinical conditions associated with UBE2V1. The function of UBE2V1 and its association with various diseases and clinical conditions, has been established by previous studies, as described hereinabove with reference to VGAM155. DnaJ (Hsp40) Homolog, Subfamily C, Member 5 (DNAJC5, Accession XM_028966) is another VGAM1811 host target gene. DNAJC5 BINDING SITE is HOST TARGET binding site found in the 3' untranslated region of mRNA encoded by DNAJC5, corresponding to a HOST TARGET binding site such as BINDING SITE I, BINDING SITE II or BINDING SITE III. Table 2 illustrates the complementarity of the nucleotide sequences of DNAJC5 BINDING SITE, designated SEQ ID:30810, to the nucleotide sequence of VGAM1811 RNA, herein designated VGAM RNA, also designated SEQ ID:4522.

Another function of VGAM1811 is therefore inhibition of DnaJ (Hsp40) Homolog, Subfamily C, Member 5 (DNAJC5, Accession XM_028966). Accordingly, utilities of VGAM1811 include diagnosis, prevention and treatment of diseases and clinical conditions associated with DNAJC5. KIAA0367 (Accession XM_041018) is another VGAM1811 host target gene. KIAA0367 BINDING SITE is HOST TARGET binding site found in the 3" untranslated region of mRNA encoded by KIAA0367, corresponding to a HOST TARGET binding site such as BINDING SITE I, BINDING SITE II or BINDING SITE III. Table 2 illustrates the complementarity of the nucleotide sequences of KIAA0367 BINDING SITE, designated SEQ ID:33420, to the nucleotide sequence of VGAM1811 RNA, herein designated VGAM RNA, also designated SEQ ID:4522.

Another function of VGAM1811 is therefore inhibition of KIAA0367 (Accession XM_041018). Accordingly, utilities of VGAM1811 include diagnosis, prevention and treatment of diseases and clinical conditions associated with KIAA0367. MGC12538 (Accession NM_032746) is another VGAM1811 host target gene. MGC12538 BINDING SITE is HOST TARGET binding site found in the 3' untranslated region of mRNA encoded by MGC12538, corresponding to a HOST TARGET binding site such as BINDING SITE I, BINDING SITE II or BINDING SITE III. Table 2 illustrates the complementarity of the nucleotide sequences of MGC12538 BINDING SITE, designated SEQ ID:26481, to the nucleotide sequence of VGAM1811 RNA, herein designated VGAM RNA, also designated SEQ ID:4522.

Another function of VGAM1811 is therefore inhibition of MGC12538 (Accession NM_032746). Accordingly, utilities of VGAM1811 include diagnosis, prevention and treatment of diseases and clinical conditions associated with MGC12538. Protocadherin 10 (PCDH10, Accession NM_032961) is another VGAM1811 host target gene. PCDH10 BINDING SITE is HOST TARGET binding site found in the 3' untranslated region of mRNA encoded by PCDH10, corresponding to a HOST TARGET binding site such as BINDING SITE I, BINDING SITE II or BINDING SITE III. Table 2 illustrates the complementarity of the nucleotide sequences of PCDH10 BINDING SITE, designated SEQ ID:26766, to the nucleotide sequence of VGAM1811 RNA, herein designated VGAM RNA, also designated SEQ ID:4522.

Another function of VGAM1811 is therefore inhibition of Protocadherin 10 (PCDH10, Accession NM_032961). Accordingly, utilities of VGAM1811 include diagnosis, prevention and treatment of diseases and clinical conditions associated with PCDH10. Phosphodiesterase 1C, Calmodulin-dependent 70 kDa (PDE1C, Accession NM_005020) is another VGAM1811 host target gene. PDE1C BINDING SITE is HOST TARGET binding site found in the 3' untranslated region of mRNA encoded by PDE1C, corresponding to a HOST TARGET binding site such as BINDING SITE I, BINDING SITE II or BINDING SITE III. Table 2 illustrates the complementarity of the nucleotide sequences of PDE1C BINDING SITE, designated SEQ ID:11460, to the nucleotide sequence of VGAM1811 RNA, herein designated VGAM RNA, also designated SEQ ID:4522.

Another function of VGAM1811 is therefore inhibition of Phosphodiesterase 1C, Calmodulin-dependent 70 kDa (PDE1C, Accession NM_005020). Accordingly, utilities of VGAM1811 include diagnosis, prevention and treatment of diseases and clinical conditions associated with PDE1C. STATI2 (Accession XM_170547) is another VGAM1811 host target gene. STATI2 BINDING SITE1 and STATI2 BINDING SITE2 are HOST TARGET binding sites found in untranslated regions of mRNA encoded by STATI2, corresponding to HOST TARGET binding sites such as BINDING SITE I, BINDING SITE II or BINDING SITE III. Table 2 illustrates the complementarity of the nucleotide sequences of STATI2 BINDING SITE1 and STATI2 BINDING SITE2, designated SEQ ID:45368 and SEQ ID:9957 respectively, to the nucleotide sequence of VGAM1811 RNA, herein designated VGAM RNA, also designated SEQ ID:4522.

Another function of VGAM1811 is therefore inhibition of STATI2 (Accession XM_170547). Accordingly, utilities of VGAM1811 include diagnosis, prevention and treatment of diseases and clinical conditions associated with STATI2. LOC152059 (Accession XM_087372) is another VGAM1811 host target gene. LOC152059 BINDING SITE is HOST TARGET binding site found in the 5' untranslated region of mRNA encoded by LOC152059, corresponding to a HOST TARGET binding site such as BINDING SITE I, BINDING SITE II or BINDING SITE III. Table 2 illustrates the complementarity of the nucleotide sequences of LOC152059 BINDING SITE, designated SEQ ID:39207, to the nucleotide sequence of VGAM1811 RNA, herein designated VGAM RNA, also designated SEQ ID:4522.

Another function of VGAM1811 is therefore inhibition of LOC152059 (Accession XM_087372). Accordingly, utilities of VGAM1811 include diagnosis, prevention and treatment of diseases and clinical conditions associated with LOC152059. LOC157507 (Accession XM_088312) is another VGAM1811 host target gene. LOC157507 BINDING SITE is HOST TARGET binding site found in the 5' untranslated region of mRNA encoded by LOC157507, corresponding to a HOST TARGET binding site such as BINDING SITE I, BINDING SITE II or BINDING SITE III. Table 2 illustrates the complementarity of the nucleotide sequences of LOC157507 BINDING SITE, designated SEQ ID:39605, to the nucleotide sequence of VGAM1811 RNA, herein designated VGAM RNA, also designated SEQ ID:4522.

Another function of VGAM1811 is therefore inhibition of LOC157507 (Accession XM_088312). Accordingly, utilities of VGAM1811 include diagnosis, prevention and treatment of diseases and clinical conditions associated with LOC157507. LOC157697 (Accession XM_088365) is another VGAM1811 host target gene. LOC157697 BINDING SITE is HOST TARGET binding site found in the 5' untranslated region of mRNA encoded by LOC157697, corresponding to a HOST TARGET binding site such as BINDING SITE I, BINDING SITE II or BINDING SITE III. Table 2 illustrates the complementarity of the nucleotide sequences of LOC157697 BINDING SITE, designated SEQ ID:39645, to the nucleotide sequence of VGAM1811 RNA, herein designated VGAM RNA, also designated SEQ ID:4522.

Another function of VGAM1811 is therefore inhibition of LOC157697 (Accession XM_088365). Accordingly, utilities of VGAM1811 include diagnosis, prevention and treatment of diseases and clinical conditions associated with LOC157697. LOC201252 (Accession XM_113941) is another VGAM1811 host target gene. LOC201252 BINDING SITE is HOST TARGET binding site found in the 3' untranslated region of mRNA encoded by LOC201252, corresponding to a HOST TARGET binding site such as BINDING SITE I, BINDING SITE II or BINDING SITE III. Table 2 illustrates the complementarity of the nucleotide sequences of LOC201252 BINDING SITE, designated SEQ ID:42556, to the nucleotide sequence of VGAM1811 RNA, herein designated VGAM RNA, also designated SEQ ID:4522.

Another function of VGAM1811 is therefore inhibition of LOC201252 (Accession XM_113941). Accordingly, utilities of VGAM1811 include diagnosis, prevention and treatment of diseases and clinical conditions associated with LOC201252. FIG. 1 further provides a conceptual description of a novel bioinformatically detected viral gene of the present invention, referred to here as Viral Genomic Address Messenger 1812 (VGAM1812) viral gene, which modulates expression of respective host target genes thereof, the function and utility of which host target genes is known in the art.

VGAM1812 is a novel bioinformatically detected regulatory, non protein coding, viral micro RNA (miRNA) gene. The method by which VGAM1812 was detected is described hereinabove with reference to FIGS. 1-8.

VGAM1812 gene, herein designated VGAM GENE, is a viral gene contained in the genome of Equine Herpesvirus 1. VGAM1812 host target gene, herein designated VGAM HOST TARGET GENE, is a human gene contained in the human genome.

VGAM1812 gene encodes a VGAM1812 precursor RNA, herein designated VGAM PRECURSOR RNA. Similar to other miRNA genes, and unlike most ordinary genes, VGAM1812 precursor RNA does not encode a protein. A nucleotide sequence identical or highly similar to the nucleotide sequence of VGAM1812 precursor RNA is designated SEQ ID:1798, and is provided hereinbelow with reference to the sequence listing part. Nucleotide sequence SEQ ID:1798 is located at position 129486 relative to the genome of Equine Herpesvirus 1.

VGAM1812 precursor RNA folds onto itself, forming VGAM1812 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1812 folded precursor RNA into VGAM1812 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1812 RNA is designated SEQ ID:4523, and is provided hereinbelow with reference to the sequence listing part.

VGAM1812 host target gene, herein designated VGAM HOST TARGET GENE, encodes a corresponding messenger RNA, VGAM1812 host target RNA, herein designated VGAM HOST TARGET RNA. VGAM1812 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1812 RNA, herein designated VGAM RNA, binds complementarily to one or more host target binding sites located in untranslated regions of VGAM1812 host target RNA, herein designated VGAM HOST TARGET RNA. This complementary binding is due to the fact that the nucleotide sequence of VGAM1812 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1812 RNA, herein designated VGAM RNA, may have a different number of host target binding sites in untranslated regions of a VGAM1812 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1812 RNA, herein designated VGAM RNA, to host target binding sites on VGAM1812 host target RNA, herein designated VGAM HOST TARGET RNA, such as BINDING SITE I, BINDING SITE II and BINDING SITE III, inhibits translation of VGAM1812 host target RNA into VGAM1812 host target protein, herein designated VGAM HOST TARGET PROTEIN. VGAM host target protein is therefore outlined by a broken line.

It is appreciated that VGAM1812 host target gene, herein designated VGAM HOST TARGET GENE, in fact represents a plurality of VGAM1812 host target genes. The mRNA of each one of this plurality of VGAM1812 host target genes comprises one or more host target binding sites, each having a nucleotide sequence which is at least partly complementary to VGAM1812 RNA, herein designated VGAM RNA, and which when bound by VGAM1812 RNA causes inhibition of translation of respective one or more VGAM1812 host target proteins.

It is further appreciated by one skilled in the art that the mode of translational inhibition illustrated by FIG. 1 with specific reference to translational inhibition exerted by VGAM1812 gene, herein designated VGAM GENE, on one or more VGAM1812 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1812 is inhibition of expression of host target genes, as part of a novel viral mechanism of attacking a host. Accordingly, utilities of VGAM1812 include diagnosis, prevention and treatment of viral infection by Equine Herpesvirus 1. Specific functions, and accordingly utilities, of VGAM1812 correlate with, and may be deduced from, the identity of the host target genes which VGAM1812 binds and inhibits, and the function of these host target genes, as elaborated hereinbelow.

Nucleotide sequences of the VGAM1812 precursor RNA, herein designated VGAM PRECURSOR RNA, and of the 'diced' VGAM1812 RNA, herein designated VGAM RNA, and a schematic representation of the secondary folding of VGAM1812 folded precursor RNA, herein designated VGAM FOLDED PRECURSOR RNA, of VGAM1812 are further described hereinbelow with reference to Table 1.

Nucleotide sequences of host target binding sites, such as BINDING SITE-I, BINDING SITE-II and BINDING SITE-III of FIG. 1, found on VGAM1812 host target RNA, and schematic representation of the complementarity of each of these host target binding sites to VGAM1812 RNA, herein designated VGAM RNA, are described hereinbelow with reference to Table 2.

As mentioned hereinabove with reference to FIG. 1, a function of VGAM1812 gene, herein designated VGAM is inhibition of expression of VGAM1812 target genes. It is appreciated that specific functions, and accordingly utilities, of VGAM1812 correlate with, and may be deduced from, the identity of the target genes which VGAM1812 binds and inhibits, and the function of these target genes, as elaborated hereinbelow.

Breast Cancer 1, Early Onset (BRCA1, Accession NM_007301) is a VGAM1812 host target gene. BRCA1 BINDING SITE is HOST TARGET binding site found in the 3' untranslated region of mRNA encoded by BRCA1, corresponding to a HOST TARGET binding site such as BINDING SITE I, BINDING SITE II or BINDING SITE III. Table 2 illustrates the complementarity of the nucleotide sequences of BRCA1 BINDING SITE, designated SEQ ID:14202, to the nucleotide sequence of VGAM1812 RNA, herein designated VGAM RNA, also designated SEQ ID:4523.

A function of VGAM1812 is therefore inhibition of Breast Cancer 1, Early Onset (BRCA1, Accession NM_007301). Accordingly, utilities of VGAM1812 include diagnosis, prevention and treatment of diseases and clinical conditions associated with BRCA1. Guanine Nucleotide Binding Protein (G protein), Alpha Activating Activity Polypeptide O (GNAO1, Accession XM_165653) is another VGAM1812 host target gene. GNAO1 BINDING SITE is HOST TARGET binding site found in the 3' untranslated region of mRNA encoded by GNAO1, corresponding to a HOST TARGET binding site such as BINDING SITE I, BINDING SITE II or BINDING SITE III. Table 2 illustrates the complementarity of the nucleotide sequences of GNAO1 BINDING SITE, designated SEQ ID:43718, to the nucleotide sequence of VGAM1812 RNA, herein designated VGAM RNA, also designated SEQ ID:4523.

Another function of VGAM1812 is therefore inhibition of Guanine Nucleotide Binding Protein (G protein), Alpha Activating Activity Polypeptide O (GNAO1, Accession XM_165653), a gene which functions as modulators or transducers in various transmembrane signaling systems. Accordingly, utilities of VGAM1812 include diagnosis, prevention and treatment of diseases and clinical conditions associated with GNAO1. The function of GNAO1 and its association with various diseases and clinical conditions, has been established by previous studies, as described hereinabove with reference to VGAM665. Protein Phosphatase 1, Regulatory (inhibitor) Subunit 12B (PPP1R12B, Accession NM_032104) is another VGAM1812 host target gene. PPP1R12B BINDING SITE1 and PPP1R12B BINDING SITE2 are HOST TARGET binding sites found in untranslated regions of mRNA encoded by PPP1R12B, corresponding to HOST TARGET binding sites such as BINDING SITE I, BINDING SITE II or BINDING SITE III. Table 2 illustrates the complementarity of the nucleotide sequences of PPP1R12B BINDING SITE1 and PPP1R12B BINDING SITE2, designated SEQ ID:25796 and SEQ ID:25794 respectively, to the nucleotide sequence of VGAM1812 RNA, herein designated VGAM RNA, also designated SEQ ID:4523.

Another function of VGAM1812 is therefore inhibition of Protein Phosphatase 1, Regulatory (inhibitor) Subunit 12B (PPP1R12B, Accession NM_032104). Accordingly, utilities of VGAM1812 include diagnosis, prevention and treatment of diseases and clinical conditions associated with PPP1R12B. FLJ10922 (Accession NM_018273) is another VGAM1812 host target gene. FLJ10922 BINDING SITE is HOST TARGET binding site found in the 3' untranslated region of mRNA encoded by FLJ10922, corresponding to a HOST TARGET binding site such as BINDING SITE I, BINDING SITE II or BINDING SITE III. Table 2 illustrates the complementarity of the nucleotide sequences of FLJ10922 BINDING SITE, designated SEQ ID:20255, to the nucleotide sequence of VGAM1812 RNA, herein designated VGAM RNA, also designated SEQ ID:4523.

Another function of VGAM1812 is therefore inhibition of FLJ10922 (Accession NM_018273). Accordingly, utilities of VGAM1812 include diagnosis, prevention and treatment of diseases and clinical conditions associated with FLJ10922. FLJ12876 (Accession NM_022754) is another VGAM1812 host target gene. FLJ12876 BINDING SITE is HOST TARGET binding site found in the 3' untranslated region of mRNA encoded by FLJ12876, corresponding to a HOST TARGET binding site such as BINDING SITE I, BINDING SITE II or BINDING SITE III. Table 2 illustrates the complementarity of the nucleotide sequences of FLJ12876 BINDING SITE, designated SEQ ID:22986, to the nucleotide sequence of VGAM1812 RNA, herein designated VGAM RNA, also designated SEQ ID:4523.

Another function of VGAM1812 is therefore inhibition of FLJ12876 (Accession NM_022754). Accordingly, utilities of VGAM1812 include diagnosis, prevention and treatment of diseases and clinical conditions associated with FLJ12876. KIAA1582 (Accession XM_037262) is another VGAM1812 host target gene. KIAA1582 BINDING SITE is HOST TARGET binding site found in the 5' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32579, to the nucleotide sequence of VGAM1812 RNA, herein designated VGAM RNA, also designated SEQ ID:4523.

Another function of VGAM1812 is therefore inhibition of KIAA1582 (Accession XM_037262). Accordingly, utilities of VGAM1812 include diagnosis, prevention and treatment of diseases and clinical conditions associated with KIAA1582. Nuclear Factor of Activated T-cells 5, Tonicity-responsive (NFAT5, Accession NM_138714) is another VGAM1812 host target gene. NFAT5 BINDING SITE is HOST TARGET binding site found in the 5' untranslated region of mRNA encoded by NFAT5, corresponding to a HOST TARGET binding site such as BINDING SITE I, BINDING SITE II or BINDING SITE III. Table 2 illustrates the complementarity of the nucleotide sequences of NFAT5 BINDING SITE, designated SEQ ID:28953, to the nucleotide sequence of VGAM1812 RNA, herein designated VGAM RNA, also designated SEQ ID:4523.

Another function of VGAM1812 is therefore inhibition of Nuclear Factor of Activated T-cells 5, Tonicity-responsive (NFAT5, Accession NM_138714). Accordingly, utilities of VGAM1812 include diagnosis, prevention and treatment of diseases and clinical conditions associated with NFAT5. LOC151568 (Accession NM_138483) is another VGAM1812 host target gene. LOC151568 BINDING SITE is HOST TARGET binding site found in the 5' untranslated region of mRNA encoded by LOC151568, corresponding to a HOST TARGET binding site such as BINDING SITE I, BINDING SITE II or BINDING SITE III. Table 2 illustrates the complementarity of the nucleotide sequences of LOC151568 BINDING SITE, designated SEQ ID:28837, to the nucleotide sequence of VGAM1812 RNA, herein designated VGAM RNA, also designated SEQ ID:4523.

Another function of VGAM1812 is therefore inhibition of LOC151568 (Accession NM_138483). Accordingly, utilities of VGAM1812 include diagnosis, prevention and treatment of diseases and clinical conditions associated with LOC151568. LOC199986 (Accession XM_117168) is another VGAM1812 host target gene. LOC199986 BINDING SITE is HOST TARGET binding site found in the 3' untranslated region of mRNA encoded by LOC199986, corresponding to a HOST TARGET binding site such as BINDING SITE I, BINDING SITE II or BINDING SITE III. Table 2 illustrates the complementarity of the nucleotide sequences of LOC199986 BINDING SITE, designated SEQ ID:43271, to the nucleotide sequence of VGAM1812 RNA, herein designated VGAM RNA, also designated SEQ ID:4523.

Another function of VGAM1812 is therefore inhibition of LOC199986 (Accession XM_117168). Accordingly, utilities of VGAM1812 include diagnosis, prevention and treatment of diseases and clinical conditions associated with LOC199986. LOC255057 (Accession XM_170903) is another VGAM1812 host target gene. LOC255057 BINDING SITE is HOST TARGET binding site found in the 3' untranslated region of mRNA encoded by LOC255057, corresponding to a HOST TARGET binding site such as BINDING SITE I, BINDING SITE II or BINDING SITE III. Table 2 illustrates the complementarity of the nucleotide sequences of LOC255057 BINDING SITE, designated SEQ ID:45660, to the nucleotide sequence of VGAM1812 RNA, herein designated VGAM RNA, also designated SEQ ID:4523.

Another function of VGAM1812 is therefore inhibition of LOC255057 (Accession XM_170903). Accordingly, utilities of VGAM1812 include diagnosis, prevention and treatment of diseases and clinical conditions associated with LOC255057. LOC91801 (Accession NM_138775) is another VGAM1812 host target gene. LOC91801 BINDING SITE is HOST TARGET binding site found in the 3' untranslated region of mRNA encoded by LOC91801, corresponding to a HOST TARGET binding site such as BINDING SITE I, BINDING SITE II or BINDING SITE III. Table 2 illustrates the complementarity of the nucleotide sequences of LOC91801 BINDING SITE, designated SEQ ID:29009, to the nucleotide sequence of VGAM1812 RNA, herein designated VGAM RNA, also designated SEQ ID:4523.

Another function of VGAM1812 is therefore inhibition of LOC91801 (Accession NM_138775). Accordingly, utilities of VGAM1812 include diagnosis, prevention and treatment of diseases and clinical conditions associated with LOC91801. FIG. 1 further provides a conceptual description of a novel bioinformatically detected viral gene of the present invention, referred to here as Viral Genomic Address Messenger 1813 (VGAM1813) viral gene, which modulates expression of respective host target genes thereof, the function and utility of which host target genes is known in the art.

VGAM1813 is a novel bioinformatically detected regulatory, non protein coding, viral micro RNA (miRNA) gene. The method by which VGAM1813 was detected is described hereinabove with reference to FIGS. 1-8.

VGAM1813 gene, herein designated VGAM GENE, is a viral gene contained in the genome of Equine Herpesvirus 1. VGAM1813 host target gene, herein designated VGAM HOST TARGET GENE, is a human gene contained in the human genome.

VGAM1813 gene encodes a VGAM1813 precursor RNA, herein designated VGAM PRECURSOR RNA. Similar to other miRNA genes, and unlike most ordinary genes, VGAM1813 precursor RNA does not encode a protein. A nucleotide sequence identical or highly similar to the nucleotide sequence of VGAM1813 precursor RNA is designated SEQ ID:1799, and is provided hereinbelow with reference to the sequence listing part. Nucleotide sequence SEQ ID:1799 is located at position 137114 relative to the genome of Equine Herpesvirus 1.

VGAM1813 precursor RNA folds onto itself, forming VGAM1813 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1813 folded precursor RNA into VGAM1813 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM1813 RNA is designated SEQ ID:4524, and is provided hereinbelow with reference to the sequence listing part.

VGAM1813 host target gene, herein designated VGAM HOST TARGET GENE, encodes a corresponding messenger RNA, VGAM1813 host target RNA, herein designated VGAM HOST TARGET RNA. VGAM1813 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1813 RNA, herein designated VGAM RNA, binds complementarily to one or more host target binding sites located in untranslated regions of VGAM1813 host target RNA, herein designated VGAM HOST TARGET RNA. This complementary binding is due to the fact that the nucleotide sequence of VGAM1813 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1813 RNA, herein designated VGAM RNA, may have a different number of host target binding sites in untranslated regions of a VGAM1813 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1813 RNA, herein designated VGAM RNA, to host target binding sites on VGAM1813 host target RNA, herein designated VGAM HOST TARGET RNA, such as BINDING SITE I, BINDING SITE II and BINDING SITE III, inhibits translation of VGAM1813 host target RNA into VGAM1813 host target protein, herein designated VGAM HOST TARGET PROTEIN. VGAM host target protein is therefore outlined by a broken line.

It is appreciated that VGAM1813 host target gene, herein designated VGAM HOST TARGET GENE, in fact represents a plurality of VGAM1813 host target genes. The mRNA of each one of this plurality of VGAM1813 host target genes comprises one or more host target binding sites, each having a nucleotide sequence which is at least partly complementary to VGAM1813 RNA, herein designated VGAM RNA, and which when bound by VGAM1813 RNA causes inhibition of translation of respective one or more VGAM1813 host target proteins.

It is further appreciated by one skilled in the art that the mode of translational inhibition illustrated by FIG. 1 with specific reference to translational inhibition exerted by VGAM1813 gene, herein designated VGAM GENE, on one or more VGAM1813 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1813 is inhibition of expression of host target genes, as part of a novel viral mechanism of attacking a host. Accordingly, utilities of VGAM1813 include diagnosis, prevention and treatment of viral infection by Equine Herpesvirus 1. Specific functions, and accordingly utilities, of VGAM1813 correlate with, and may be deduced from, the identity of the host target genes which VGAM1813 binds and inhibits, and the function of these host target genes, as elaborated hereinbelow.

Nucleotide sequences of the VGAM1813 precursor RNA, herein designated VGAM PRECURSOR RNA, and of the 'diced' VGAM1813 RNA, herein designated VGAM RNA, and a schematic representation of the secondary folding of VGAM1813 folded precursor RNA, herein designated VGAM FOLDED PRECURSOR RNA, of VGAM1813 are further described hereinbelow with reference to Table 1.

Nucleotide sequences of host target binding sites, such as BINDING SITE-I, BINDING SITE-II and BINDING SITE-III of FIG. 1, found on VGAM1813 host target RNA, and schematic representation of the complementarity of each of these host target binding sites to VGAM1813 RNA, herein designated VGAM RNA, are described hereinbelow with reference to Table 2.

As mentioned hereinabove with reference to FIG. 1, a function of VGAM1813 gene, herein designated VGAM is inhibition of expression of VGAM1813 target genes. It is appreciated that specific functions, and accordingly utilities, of VGAM1813 correlate with, and may be deduced from, the identity of the target genes which VGAM1813 binds and inhibits, and the function of these target genes, as elaborated hereinbelow.

Mitogen-activated Protein Kinase 14 (MAPK14, Accession NM_001315) is a VGAM1813 host target gene. MAPK14 BINDING SITE1 through MAPK14 BINDING SITE4 are HOST TARGET binding sites found in untranslated regions of mRNA encoded by MAPK14, corresponding to HOST TARGET binding sites such as BINDING SITE I, BINDING SITE II or BINDING SITE III. Table 2 illustrates the complementarity of the nucleotide sequences of MAPK14 BINDING SITE1 through MAPK14 BINDING SITE4, designated SEQ ID:7003, SEQ ID:29107, SEQ ID:29110 and SEQ ID:29114 respectively, to the nucleotide sequence of VGAM1813 RNA, herein designated VGAM RNA, also designated SEQ ID:4524.

A function of VGAM1813 is therefore inhibition of Mitogen-activated Protein Kinase 14 (MAPK14, Accession NM_001315), a gene which is important for cytokine production; responds to changes in extracellular osmolarity. Accordingly, utilities of VGAM1813 include diagnosis, prevention and treatment of diseases and clinical conditions associated with MAPK14. The function of MAPK14 and its association with various diseases and clinical conditions, has been established by previous studies, as described hereinabove with reference to VGAM107. KIAA1110 (Accession XM_029973) is another VGAM1813 host target gene. KIAA1110 BINDING SITE is HOST TARGET binding site found in the 3' untranslated region of mRNA encoded by KIAA1110, corresponding to a HOST TARGET binding site such as BINDING SITE I, BINDING SITE II or BINDING SITE III. Table 2 illustrates the complementarity of the nucleotide sequences of KIAA1110 BINDING SITE, designated SEQ ID:30982, to the nucleotide sequence of VGAM1813 RNA, herein designated VGAM RNA, also designated SEQ ID:4524.

Another function of VGAM1813 is therefore inhibition of KIAA1110 (Accession XM_029973). Accordingly, utilities of VGAM1813 include diagnosis, prevention and treatment of diseases and clinical conditions associated with KIAA1110. LOC146315 (Accession XM_027576) is another VGAM1813 host target gene. LOC146315 BINDING SITE is HOST TARGET binding site found in the 5' untranslated region of mRNA encoded by LOC146315, corresponding to a HOST TARGET binding site such as BINDING SITE I, BINDING SITE II or BINDING SITE III. Table 2 illustrates the complementarity of the nucleotide sequences of LOC146315 BINDING SITE, designated SEQ ID:30533, to the nucleotide sequence of VGAM1813 RNA, herein designated VGAM RNA, also designated SEQ ID:4524.

Another function of VGAM1813 is therefore inhibition of LOC146315 (Accession XM_027576). Accordingly, utilities of VGAM1813 include diagnosis, prevention and treatment of diseases and clinical conditions associated with LOC146315. LOC256158 (Accession XM_175125) is another VGAM1813 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46621, to the nucleotide sequence of VGAM1813 RNA, herein designated VGAM RNA, also designated SEQ ID:4524.

Another function of VGAM1813 is therefore inhibition of LOC256158 (Accession XM_175125). Accordingly, utilities of VGAM1813 include diagnosis, prevention and treatment of diseases and clinical conditions associated with LOC256158. FIG. 1 further provides a conceptual description of a novel bioinformatically detected viral gene of the present invention, referred to here as Viral Genomic Address Messenger 1814 (VGAM1814) viral gene, which modulates expression of respective host target genes thereof, the function and utility of which host target genes is known in the art.

VGAM1814 is a novel bioinformatically detected regulatory, non protein coding, viral micro RNA (miRNA) gene. The method by which VGAM1814 was detected is described hereinabove with reference to FIGS. 1-8.

VGAM1814 gene, herein designated VGAM GENE, is a viral gene contained in the genome of Equine Herpesvirus 1. VGAM1814 host target gene, herein designated VGAM HOST TARGET GENE, is a human gene contained in the human genome.

VGAM1814 gene encodes a VGAM1814 precursor RNA, herein designated VGAM PRECURSOR RNA. Similar to other miRNA genes, and unlike most ordinary genes, VGAM1814 precursor RNA does not encode a protein. A nucleotide sequence identical or highly similar to the nucleotide sequence of VGAM1814 precursor RNA is designated SEQ ID:1800, and is provided hereinbelow with reference to the sequence listing part. Nucleotide sequence SEQ ID:1800 is located at position 127841 relative to the genome of Equine Herpesvirus 1.

VGAM1814 precursor RNA folds onto itself, forming VGAM1814 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1814 folded precursor RNA into VGAM1814 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 90%) nucleotide sequence of VGAM1814 RNA is designated SEQ ID:4525, and is provided hereinbelow with reference to the sequence listing part.

VGAM1814 host target gene, herein designated VGAM HOST TARGET GENE, encodes a corresponding messenger RNA, VGAM1814 host target RNA, herein designated VGAM HOST TARGET RNA. VGAM1814 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1814 RNA, herein designated VGAM RNA, binds complementarily to one or more host target binding sites located in untranslated regions of VGAM1814 host target RNA, herein designated VGAM HOST TARGET RNA. This complementary binding is due to the fact that the nucleotide sequence of VGAM1814 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1814 RNA, herein designated VGAM RNA, may have a different number of host target binding sites in untranslated regions of a VGAM1814 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1814 RNA, herein designated VGAM RNA, to host target binding sites on VGAM1814 host target RNA, herein designated VGAM HOST TARGET RNA, such as BINDING SITE I, BINDING SITE II and BINDING SITE III, inhibits translation of VGAM1814 host target RNA into VGAM1814 host target protein, herein designated VGAM HOST TARGET PROTEIN. VGAM host target protein is therefore outlined by a broken line.

It is appreciated that VGAM1814 host target gene, herein designated VGAM HOST TARGET GENE, in fact represents a plurality of VGAM1814 host target genes. The mRNA of each one of this plurality of VGAM1814 host target genes comprises one or more host target binding sites, each having a nucleotide sequence which is at least partly complementary to VGAM1814 RNA, herein designated VGAM RNA, and which when bound by VGAM1814 RNA causes inhibition of translation of respective one or more VGAM1814 host target proteins.

It is further appreciated by one skilled in the art that the mode of translational inhibition illustrated by FIG. 1 with specific reference to translational inhibition exerted by VGAM1814 gene, herein designated VGAM GENE, on one or more VGAM1814 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1814 is inhibition of expression of host target genes, as part of a novel viral mechanism of attacking a host. Accordingly, utilities of VGAM1814 include diagnosis, prevention and treatment of viral infection by Equine Herpesvirus 1. Specific functions, and accordingly utilities, of VGAM1814 correlate with, and may be deduced from, the identity of the host target genes which VGAM1814 binds and inhibits, and the function of these host target genes, as elaborated hereinbelow.

Nucleotide sequences of the VGAM1814 precursor RNA, herein designated VGAM PRECURSOR RNA, and of the 'diced' VGAM1814 RNA, herein designated VGAM RNA, and a schematic representation of the secondary folding of VGAM1814 folded precursor RNA, herein designated VGAM FOLDED PRECURSOR RNA, of VGAM1814 are further described hereinbelow with reference to Table 1.

Nucleotide sequences of host target binding sites, such as BINDING SITE-I, BINDING SITE-II and BINDING SITE-III of FIG. 1, found on VGAM1814 host target RNA, and schematic representation of the complementarity of each of these host target binding sites to VGAM1814 RNA, herein designated VGAM RNA, are described hereinbelow with reference to Table 2.

As mentioned hereinabove with reference to FIG. 1, a function of VGAM1814 gene, herein designated VGAM is inhibition of expression of VGAM1814 target genes. It is appreciated that specific functions, and accordingly utilities, of VGAM1814 correlate with, and may be deduced from, the identity of the target genes which VGAM1814 binds and inhibits, and the function of these target genes, as elaborated hereinbelow.

KH Domain Containing, RNA Binding, Signal Transduction Associated 1 (KHDRBS1, Accession NM_006559) is a VGAM1814 host target gene. KHDRBS1 BINDING SITE is HOST TARGET binding site found in the 3' untranslated region of mRNA encoded by KHDRBS1, corresponding to a HOST TARGET binding site such as BINDING SITE I, BINDING SITE II or BINDING SITE III. Table 2 illustrates the complementarity of the nucleotide sequences of KHDRBS1 BINDING SITE, designated SEQ ID:13327, to the nucleotide sequence of VGAM1814 RNA, herein designated VGAM RNA, also designated SEQ ID:4525.

A function of VGAM1814 is therefore inhibition of KH Domain Containing, RNA Binding, Signal Transduction Associated 1 (KHDRBS1, Accession NM_006559). Accordingly, utilities of VGAM1814 include diagnosis, prevention and treatment of diseases and clinical conditions associated with KHDRBS1. MGC3222 (Accession NM_024334) is another VGAM1814 host target gene. MGC3222 BINDING SITE is HOST TARGET binding site found in the 3' untranslated region of mRNA encoded by MGC3222, corresponding to a HOST TARGET binding site such as BINDING SITE I, BINDING SITE II or BINDING SITE III. Table 2 illustrates the complementarity of the nucleotide sequences of MGC3222 BINDING SITE, designated SEQ ID:23641, to the nucleotide sequence of VGAM1814 RNA, herein designated VGAM RNA, also designated SEQ ID:4525.

Another function of VGAM1814 is therefore inhibition of MGC3222 (Accession NM_024334). Accordingly, utilities of VGAM1814 include diagnosis, prevention and treatment of diseases and clinical conditions associated with MGC3222. PRO2198 (Accession NM_018621) is another VGAM1814 host target gene. PRO2198 BINDING SITE is HOST TARGET binding site found in the 3' untranslated region of mRNA encoded by PRO2198, corresponding to a HOST TARGET binding site such as BINDING SITE I, BINDING SITE II or BINDING SITE III. Table 2 illustrates the complementarity of the nucleotide sequences of PRO2198 BINDING SITE, designated SEQ ID:20694, to the nucleotide sequence of VGAM1814 RNA, herein designated VGAM RNA, also designated SEQ ID:4525.

Another function of VGAM1814 is therefore inhibition of PRO2198 (Accession NM_018621). Accordingly, utilities of VGAM1814 include diagnosis, prevention and treatment of diseases and clinical conditions associated with PRO2198. LOC200339 (Accession XM_117226) is another VGAM1814 host target gene. LOC200339 BINDING SITE is HOST TARGET binding site found in the 3' untranslated region of mRNA encoded by LOC200339, corresponding to a HOST TARGET binding site such as BINDING SITE I, BINDING SITE II or BINDING SITE III. Table 2 illustrates the complementarity of the nucleotide sequences of LOC200339 BINDING SITE, designated SEQ ID:43299, to the nucleotide sequence of VGAM1814 RNA, herein designated VGAM RNA, also designated SEQ ID:4525.

Another function of VGAM1814 is therefore inhibition of LOC200339 (Accession XM_117226). Accordingly, utilities of VGAM1814 include diagnosis, prevention and treatment of diseases and clinical conditions associated with LOC200339. FIG. 1 further provides a conceptual description of a novel bioinformatically detected viral gene of the present invention, referred to here as Viral Genomic Address Messenger 1815 (VGAM1815) viral gene, which modulates expression of respective host target genes thereof, the function and utility of which host target genes is known in the art.

VGAM1815 is a novel bioinformatically detected regulatory, non protein coding, viral micro RNA (miRNA) gene. The method by which VGAM1815 was detected is described hereinabove with reference to FIGS. 1-8.

VGAM1815 gene, herein designated VGAM GENE, is a viral gene contained in the genome of Equine Herpesvirus 1. VGAM1815 host target gene, herein designated VGAM HOST TARGET GENE, is a human gene contained in the human genome.

VGAM1815 gene encodes a VGAM1815 precursor RNA, herein designated VGAM PRECURSOR RNA. Similar to other miRNA genes, and unlike most ordinary genes, VGAM1815 precursor RNA does not encode a protein. A nucleotide sequence identical or highly similar to the nucleotide sequence of VGAM1815 precursor RNA is designated SEQ ID:1801, and is provided hereinbelow with reference to the sequence listing part. Nucleotide sequence SEQ ID:1801 is located at position 130995 relative to the genome of Equine Herp VGAM1815 precursor RNA folds onto itself, forming VGAM1815 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1815 folded precursor RNA into VGAM1815 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1815 RNA is designated SEQ ID:4526, and is provided hereinbelow with reference to the sequence listing part.

VGAM1815 host target gene, herein designated VGAM HOST TARGET GENE, encodes a corresponding messenger RNA, VGAM1815 host target RNA, herein designated VGAM HOST TARGET RNA. VGAM1815 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1815 RNA, herein designated VGAM RNA, binds complementarily to one or more host target binding sites located in untranslated regions of VGAM1815 host target RNA, herein designated VGAM HOST TARGET RNA. This complementary binding is due to the fact that the nucleotide sequence of VGAM1815 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1815 RNA, herein designated VGAM RNA, may have a different number of host target binding sites in untranslated regions of a VGAM1815 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1815 RNA, herein designated VGAM RNA, to host target binding sites on VGAM1815 host target RNA, herein designated VGAM HOST TARGET RNA, such as BINDING SITE I, BINDING SITE II and BINDING SITE III, inhibits translation of VGAM1815 host target RNA into VGAM1815 host target protein, herein designated VGAM HOST TARGET PROTEIN. VGAM host target protein is therefore outlined by a broken line.

It is appreciated that VGAM1815 host target gene, herein designated VGAM HOST TARGET GENE, in fact represents a plurality of VGAM1815 host target genes. The mRNA of each one of this plurality of VGAM1815 host target genes comprises one or more host target binding sites, each having a nucleotide sequence which is at least partly complementary to VGAM1815 RNA, herein designated VGAM RNA, and which when bound by VGAM1815 RNA causes inhibition of translation of respective one or more VGAM1815 host target proteins.

It is further appreciated by one skilled in the art that the mode of translational inhibition illustrated by FIG. 1 with specific reference to translational inhibition exerted by VGAM1815 gene, herein designated VGAM GENE, on one or more VGAM1815 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1815 is inhibition of expression of host target genes, as part of a novel viral mechanism of attacking a host. Accordingly, utilities of VGAM1815 include diagnosis, prevention and treatment of viral infection by Equine Herpesvirus 1. Specific functions, and accordingly utilities, of VGAM1815 correlate with, and may be deduced from, the identity of the host target genes which VGAM1815 binds and inhibits, and the function of these host target genes, as elaborated hereinbelow.

Nucleotide sequences of the VGAM1815 precursor RNA, herein designated VGAM PRECURSOR RNA, and of the 'diced' VGAM1815 RNA, herein designated VGAM RNA, and a schematic representation of the secondary folding of VGAM1815 folded precursor RNA, herein designated VGAM FOLDED PRECURSOR RNA, of VGAM1815 are further described hereinbelow with reference to Table 1.

Nucleotide sequences of host target binding sites, such as BINDING SITE-I, BINDING SITE-II and BINDING SITE-III of FIG. 1, found on VGAM1815 host target RNA, and schematic representation of the complementarity of each of these host target binding sites to VGAM1815 RNA, herein designated VGAM RNA, are described hereinbelow with reference to Table 2.

As mentioned hereinabove with reference to FIG. 1, a function of VGAM1815 gene, herein designated VGAM is inhibition of expression of VGAM1815 target genes. It is appreciated that specific functions, and accordingly utilities, of VGAM1815 correlate with, and may be deduced from, the identity of the target genes which VGAM1815 binds and inhibits, and the function of these target genes, as elaborated hereinbelow.

Engrailed Homolog 1 (EN1, Accession NM_001426) is a VGAM1815 host target gene. EN1 BINDING SITE is HOST TARGET binding site found in the 5' untranslated region of mRNA encoded by EN1, corresponding to a HOST TARGET binding site such as BINDING SITE I, BINDING SITE II or BINDING SITE III. Table 2 illustrates the complementarity of the nucleotide sequences of EN1 BINDING SITE, designated SEQ ID:7139, to the nucleotide sequence of VGAM1815 RNA, herein designated VGAM RNA, also designated SEQ ID:4526.

A function of VGAM1815 is therefore inhibition of Engrailed Homolog 1 (EN1, Accession NM_001426), a gene which is a member of the homeodomain family of DNA binding proteins; may regulate gene expression, morphogenesis, and differentiation;. Accordingly, utilities of VGAM1815 include diagnosis, prevention and treatment of diseases and clinical conditions associated with EN1. The function of EN1 and its association with various diseases and clinical conditions, has been established by previous studies, as described hereinabove with reference to VGAM1615. Mannosidase, Alpha, Class 2A, Member 1 (MAN2A1, Accession NM_002372) is another VGAM1815 host target gene. MAN2A1 BINDING SITE is HOST TARGET binding site found in the 5' untranslated region of mRNA encoded by MAN2A1, corresponding to a HOST TARGET binding site such as BINDING SITE I, BINDING SITE II or BINDING SITE III. Table 2 illustrates the complementarity of the nucleotide sequences of MAN2A1 BINDING SITE, designated SEQ ID:8178, to the nucleotide sequence of VGAM1815 RNA, herein designated VGAM RNA, also designated SEQ ID:4526.

Another function of VGAM1815 is therefore inhibition of Mannosidase, Alpha, Class 2A, Member 1 (MAN2A1, Accession NM_002372), a gene which catalyzes the final hydrolytic step in the asparagine-linked oligosaccharide (N-glycan) maturation pathway. Accordingly, utilities of VGAM1815 include diagnosis, prevention and treatment of diseases and clinical conditions associated with MAN2A1. The function of MAN2A1 and its association with various diseases and clinical conditions, has been established by previous studies, as described hereinabove with reference to VGAM1410. Netrin 4 (NTN4, Accession XM_031896) is another VGAM1815 host target gene. NTN4 BINDING SITE is HOST TARGET binding site found in the 5' untranslated region of mRNA encoded by NTN4, corresponding to a HOST TARGET binding site such as BINDING SITE I, BINDING SITE II or BINDING SITE III. Table 2 illustrates the complementarity of the nucleotide sequences of NTN4 BINDING SITE, designated SEQ ID:31511, to the nucleotide sequence of VGAM1815 RNA, herein designated VGAM RNA, also designated SEQ ID:4526.

Another function of VGAM1815 is therefore inhibition of Netrin 4 (NTN4, Accession XM_031896). Accordingly, utilities of VGAM1815 include diagnosis, prevention and treatment of diseases and clinical conditions associated with NTN4. Rabip4R (Accession NM_017987) is another VGAM1815 host target gene. Rabip4R BINDING SITE is HOST TARGET binding site found in the 3' untranslated region of mRNA encoded by Rabip4R, corresponding to a HOST TARGET binding site such as BINDING SITE I, BINDING SITE II or BINDING SITE III. Table 2 illustrates the complementarity of the nucleotide sequences of Rabip4R BINDING SITE, designated SEQ ID:19716, to the nucleotide sequence of VGAM1815 RNA, herein designated VGAM RNA, also designated SEQ ID:4526.

Another function of VGAM1815 is therefore inhibition of Rabip4R (Accession NM_017987). Accordingly, utilities of VGAM1815 include diagnosis, prevention and treatment of diseases and clinical conditions associated with Rabip4R. LOC143384 (Accession XM_084504) is another VGAM1815 host target gene. LOC143384 BINDING SITE is HOST TARGET binding site found in the 5' untranslated region of mRNA encoded by LOC143384, corresponding to a HOST TARGET binding site such as BINDING SITE I, BINDING SITE II or BINDING SITE III. Table 2 illustrates the complementarity of the nucleotide sequences of LOC143384 BINDING SITE, designated SEQ ID:37614, to the nucleotide sequence of VGAM1815 RNA, herein designated VGAM RNA, also designated SEQ ID:4526.

Another function of VGAM1815 is therefore inhibition of LOC143384 (Accession XM_084504). Accordingly, utilities of VGAM1815 include diagnosis, prevention and treatment of diseases and clinical conditions associated with LOC143384. FIG. 1 further provides a conceptual description of a novel bioinformatically detected viral gene of the present invention, referred to here as Viral Genomic Address Messenger 1816 (VGAM1816) viral gene, which modulates expression of respective host target genes thereof, the function and utility of which host target genes is known in the art.

VGAM1816 is a novel bioinformatically detected regulatory, non protein coding, viral micro RNA (miRNA) gene. The method by which VGAM1816 was detected is described hereinabove with reference to FIGS. 1-8.

VGAM1816 gene, herein designated VGAM GENE, is a viral gene contained in the genome of Camelpox Virus. VGAM1816 host target gene, herein designated VGAM HOST TARGET GENE, is a human gene contained in the human genome.

VGAM1816 gene encodes a VGAM1816 precursor RNA, herein designated VGAM PRECURSOR RNA. Similar to other miRNA genes, and unlike most ordinary genes, VGAM1816 precursor RNA does not encode a protein. A nucleotide sequence identical or highly similar to the nucleotide sequence of VGAM1816 precursor RNA is designated SEQ ID:1802, and is provided hereinbelow with reference to the sequence listing part. Nucleotide sequence SEQ ID:1802 is located at position 41903 relative to the genome of Camelpox Virus.

VGAM1816 precursor RNA folds onto itself, forming VGAM1816 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1816 folded precursor RNA into VGAM1816 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1816 RNA is designated SEQ ID:4527, and is provided hereinbelow with reference to the sequence listing part.

VGAM1816 host target gene, herein designated VGAM HOST TARGET GENE, encodes a corresponding messenger RNA, VGAM1816 host target RNA, herein designated VGAM HOST TARGET RNA. VGAM1816 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1816 RNA, herein designated VGAM RNA, binds complementarily to one or more host target binding sites located in untranslated regions of VGAM1816 host target RNA, herein designated VGAM HOST TARGET RNA. This complementary binding is due to the fact that the nucleotide sequence of VGAM1816 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1816 RNA, herein designated VGAM RNA, may have a different number of host target binding sites in untranslated regions of a VGAM1816 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1816 RNA, herein designated VGAM RNA, to host target binding sites on VGAM1816 host target RNA, herein designated VGAM HOST TARGET RNA, such as BINDING SITE I, BINDING SITE II and BINDING SITE III, inhibits translation of VGAM1816 host target RNA into VGAM1816 host target protein, herein designated VGAM HOST TARGET PROTEIN. VGAM host target protein is therefore outlined by a broken line.

It is appreciated that VGAM1816 host target gene, herein designated VGAM HOST TARGET GENE, in fact represents a plurality of VGAM1816 host target genes. The mRNA of each one of this plurality of VGAM1816 host target genes comprises one or more host target binding sites, each having a nucleotide sequence which is at least partly complementary to VGAM1816 RNA, herein designated VGAM RNA, and which when bound by VGAM1816 RNA causes inhibition of translation of respective one or more VGAM1816 host target proteins.

It is further appreciated by one skilled in the art that the mode of translational inhibition illustrated by FIG. 1 with specific reference to translational inhibition exerted by VGAM1816 gene, herein designated VGAM GENE, on one or more VGAM1816 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1816 is inhibition of expression of host target genes, as part of a novel viral mechanism of attacking a host. Accordingly, utilities of VGAM1816 include diagnosis, prevention and treatment of viral infection by Camelpox Virus. Specific functions, and accordingly utilities, of VGAM1816 correlate with, and may be deduced from, the identity of the host target genes which VGAM1816 binds and inhibits, and the function of these host target genes, as elaborated hereinbelow.

Nucleotide sequences of the VGAM1816 precursor RNA, herein designated VGAM PRECURSOR RNA, and of the 'diced' VGAM1816 RNA, herein designated VGAM RNA, and a schematic representation of the secondary folding of VGAM1816 folded precursor RNA, herein designated VGAM FOLDED PRECURSOR RNA, of VGAM1816 are further described hereinbelow with reference to Table 1.

Nucleotide sequences of host target binding sites, such as BINDING SITE-I, BINDING SITE-II and BINDING SITE-III of FIG. 1, found on VGAM1816 host target RNA, and schematic representation of the complementarity of each of these host target binding sites to VGAM1816 RNA, herein designated VGAM RNA, are described hereinbelow with reference to Table 2.

As mentioned hereinabove with reference to FIG. 1, a function of VGAM1816 gene, herein designated VGAM is inhibition of expression of VGAM1816 target genes. It is appreciated that specific functions, and accordingly utilities, of VGAM1816 correlate with, and may be deduced from, the identity of the target genes which VGAM1816 binds and inhibits, and the function of these target genes, as elaborated hereinbelow.

Four and A Half LIM Domains 1 (FHL1, Accession NM_001449) is a VGAM1816 host target gene. FHL1 BINDING SITE is HOST TARGET binding site found in the 3' untranslated region of mRNA encoded by FHL1, corresponding to a HOST TARGET binding site such as BINDING SITE I, BINDING SITE II or BINDING SITE III. Table 2 illustrates the complementarity of the nucleotide sequences of FHL1 BINDING SITE, designated SEQ ID:7181, to the nucleotide sequence of VGAM1816 RNA, herein designated VGAM RNA, also designated SEQ ID:4527.

A function of VGAM1816 is therefore inhibition of Four and A Half LIM Domains 1 (FHL1, Accession NM_001449), a gene which may have an involvement in muscle development or hypertrophy. Accordingly, utilities of VGAM1816 include diagnosis, prevention and treatment of diseases and clinical conditions associated with FHL1. The function of FHL1 has been established by previous studies. LIM proteins, named for 'LIN11, ISL1, and MEC3,' are defined by the possession of a highly conserved double zinc finger motif, called the LIM domain. Morgan et al. (1995) identified a partial human SLIM1 cDNA. They found that SLIM1 is a developmentally regulated protein that is expressed in human skeletal muscle but not in a variety of other tissues. By searching sequence databases with the partial SLIM1 cDNA isolated by Morgan et al. (1995), Morgan and Madgwick (1996) identified human cDNAs encoding the complete SLIM1 amino acid sequence. The predicted 280-amino acid protein contains 4 LIM domains and a novel single zinc finger domain in the N-terminal region. By Northern blot analysis, SLIM1 is expressed as a 2.3-kb mRNA in human masseter muscle. By somatic cell hybrid mapping, fluorescence in situ hybridization, and radiation hybrid mapping, Lee et al. (1998) assigned the FHL1 gene to Xq27.2.

Full details of the abovementioned studies are described in the following publications, the disclosure of which are hereby incorporated by reference:

Lee, S. M. Y.; Tsui, S. K. W.; Chan, K. K.; Garcia-Barcelo, M.; Waye, M. M. Y.; Fung, K. P.; Liew, C. C.; Lee, C. Y.: Chromosomal mapping, tissue distribution and cDNA sequence of four-and-a-half LIM domain protein 1 (FHL1). Gene 216:163-170, 1998; and Morgan, M. J.; Madgwick, A. J.; Charleston, B.; Pell, J. M.; Loughna, P. T.: The developmental regulation of a novel muscle LIM-protein. Biochem. Biophys. Res. Commun. 212: 840-846, 19.

Further studies establishing the function and utilities of FHL1 are found in John Hopkins OMIM database record ID 300163, and in sited publications numbered 11003-11005 listed in the bibliography section hereinbelow, which are also hereby incorporated by reference. Glutamate Receptor, Metabotropic 1 (GRM1, Accession NM_000838) is another VGAM1816 host target gene. GRM1 BINDING SITE is HOST TARGET binding site found in the 3' untranslated region of mRNA encoded by GRM1, corresponding to a HOST TARGET binding site such as BINDING SITE I, BINDING SITE II or BINDING SITE III. Table 2 illustrates the complementarity of the nucleotide sequences of GRM1 BINDING SITE, designated SEQ ID:6498, to the nucleotide sequence of VGAM1816 RNA, herein designated VGAM RNA, also designated SEQ ID:4527.

Another function of VGAM1816 is therefore inhibition of Glutamate Receptor, Metabotropic 1 (GRM1, Accession NM_000838), a gene which promotes phosphoinositide hydrolysis. Accordingly, utilities of VGAM1816 include diagnosis, prevention and treatment of diseases and clinical conditions associated with GRM1. The function of GRM1 and its association with various diseases and clinical conditions, has been established by previous studies, as described hereinabove with reference to VGAM786. Plakophilin 2 (PKP2, Accession NM_004572) is another VGAM1816 host target gene. PKP2 BINDING SITE is HOST TARGET binding site found in the 3' untranslated region of mRNA encoded by PKP2, corresponding to a HOST TARGET binding site such as BINDING SITE I, BINDING SITE II or BINDING SITE III. Table 2 illustrates the complementarity of the nucleotide sequences of PKP2 BINDING SITE, designated SEQ ID:10915, to the nucleotide sequence of VGAM1816 RNA, herein designated VGAM RNA, also designated SEQ ID:4527.

Another function of VGAM1816 is therefore inhibition of Plakophilin 2 (PKP2, Accession NM_004572), a gene which may play a role in junctional plaques. Accordingly, utilities of VGAM1816 include diagnosis, prevention and treatment of diseases and clinical conditions associated with PKP2. The function of PKP2 has been established by previous studies. Plakophilins are armadillo repeat-containing proteins that are localized in the desmosomal plaque and cell nucleus. Desmosomal plakophilins, like plakophilin 2, form part of the link between the cytoplasmic tail of cadherins and the intermediate filament cytoskeleton (Bonne et al., 2000). Mertens et al. (1996) isolated cDNAs encoding 2 forms of plakophilin-2 (PKP2), which they named PKP2a and PKP2b, from human colon carcinoma and heart cDNA libraries. The predicted 837-amino acid PKP2a protein contains 9 complete copies of the armadillo motif, which is an approximately 42-amino acid domain first defined in the Drosophila 'armadillO' gene product. Compared with PKP2a, the predicted 881-amino acid PKP2b protein contains an insertion of 44 amino acids between the second and third armadillo motifs. The authors suggested that PKP2a and PKP2b are derived from alternatively spliced PKP2 transcripts. The PKP2 and PKP1 (OMIM Ref. No. 601975) proteins are 42% identical in the armadillo repeats. Immunoblot analysis of a wide range of human cell lines and tissues using antibodies against PKP2 detected an approximately 100-kD protein, which sometimes appeared as a twin band. Immunolocalization studies showed that PKP2 is a constituent of the desmosomal plaque in simple epithelia, some stratified epithelia, and some nonepithelial cells. PKP2 is also enriched in the karyoplasm of cells of various types, including those lacking desmosomes. Northern blot analysis detected approximately 5.3-kb PKP2 transcripts in diverse human cell lines and tissues representing both epithelial and nonepithelial cells. By fluorescence in situ hybridization and analysis of a somatic cell hybrid mapping panel, Bonne et al. (1998) mapped the PKP2 gene to 12p13. Schmidt et al. (1999) used FISH to map the PKP2 gene to 12p11. Further analysis by Bonne et al. (2000) of a human 12p13-specific PAC clone showed that 12p13 was the location of a processed plakophilin-2 pseudogene, PKP2P1. By fluorescence in situ hybridization, Bonne et al. (2000) confirmed the localization of PKP2 to 12p11.

Full details of the abovementioned studies are described in the following publications, the disclosure of which are hereby incorporated by reference:

Bonne, S.; van Hengel, J; van Roy, F.: Assignment of the plakophilin-2 gene (PKP2) and a plakophilin-2 pseudogene (PKP2P1) to human chromosome bands 12p11 and 12p13, respectively, by in situ hybridization. Cytogenet. Cell Genet. 88:286-287, 2000; and Bonne, S.; van Hengel, J.; van Roy, F.: Chromosomal mapping of human armadillo genes belonging to the p120 (ctn)/plakophilin subfamily. Genomics 51:452-454, 1998.

Further studies establishing the function and utilities of PKP2 are found in John Hopkins OMIM database record ID 602861, and in sited publications numbered 532 and 7029-5322 listed in the bibliography section hereinbelow, which are also hereby incorporated by reference. Reticulocalbin 1, EF-hand Calcium Binding Domain (RCN1, Accession XM_006320) is another VGAM1816 host target gene. RCN1 BINDING SITE1 and RCN1 BINDING SITE2 are HOST TARGET binding sites found in untranslated regions of mRNA encoded by RCN1, corresponding to HOST TARGET binding sites such as BINDING SITE I, BINDING SITE II or BINDING SITE III. Table 2 illustrates the complementarity of the nucleotide sequences of RCN1 BINDING SITE1 and RCN1 BINDING SITE2, designated SEQ ID:29996 and SEQ ID:8804 respectively, to the nucleotide sequence of VGAM1816 RNA, herein designated VGAM RNA, also designated SEQ ID:4527.

Another function of VGAM1816 is therefore inhibition of Reticulocalbin 1, EF-hand Calcium Binding Domain (RCN1, Accession XM_006320), a gene which may regulate calcium-dependent activities in the ER lumen or post-ER compartment. Accordingly, utilities of VGAM1816 include diagnosis, prevention and treatment of diseases and clinical conditions associated with RCN1. The function of RCN1 and its association with various diseases and clinical conditions, has been established by previous studies, as described hereinabove with reference to VGAM865. TEM6 (Accession NM_022748) is another VGAM1816 host target gene. TEM6 BINDING SITE is HOST TARGET binding site found in the 3' untranslated region of mRNA encoded by TEM6, corresponding to a HOST TARGET binding site such as BINDING SITE I, BINDING SITE II or BINDING SITE III. Table 2 illustrates the complementarity of the nucleotide sequences of TEM6 BINDING SITE, designated SEQ ID:22967, to the nucleotide sequence of VGAM1816 RNA, herein designated VGAM RNA, also designated SEQ ID:4527.

Another function of VGAM1816 is therefore inhibition of TEM6 (Accession NM_022748), a gene which displays elevated expression during tumor angiogenesis. Accordingly, utilities of VGAM1816 include diagnosis, prevention and treatment of diseases and clinical conditions associated with TEM6. The function of TEM6 and its association with various diseases and clinical conditions, has been established by previous studies, as described hereinabove with reference to VGAM175. BTB (POZ) Domain Containing 3 (BTBD3, Accession NM_014962) is another VGAM1816 host target gene. BTBD3 BINDING SITE is HOST TARGET binding site found in the 3' untranslated region of mRNA encoded by BTBD3, corresponding to a HOST TARGET binding site such as BINDING SITE I, BINDING SITE II or BINDING SITE III. Table 2 illustrates the complementarity of the nucleotide sequences of BTBD3 BINDING SITE, designated SEQ ID:17340, to the nucleotide sequence of VGAM1816 RNA, herein designated VGAM RNA, also designated SEQ ID:4527.

Another function of VGAM1816 is therefore inhibition of BTB (POZ) Domain Containing 3 (BTBD3, Accession NM_014962). Accordingly, utilities of VGAM1816 include diagnosis, prevention and treatment of diseases and clinical conditions associated with BTBD3. Signal Sequence Receptor, Gamma (translocon-associated protein gamma) (SSR3, Accession NM_007107) is another VGAM1816 host target gene. SSR3 BINDING SITE is HOST TARGET binding site found in the 3' untranslated region of mRNA encoded by SSR3, corresponding to a HOST TARGET binding site such as BINDING SITE I, BINDING SITE II or BINDING SITE III. Table 2 illustrates the complementarity of the nucleotide sequences of SSR3 BINDING SITE, designated SEQ ID:13969, to the nucleotide sequence of VGAM1816 RNA, herein designated VGAM RNA, also designated SEQ ID:4527.

Another function of VGAM1816 is therefore inhibition of Signal Sequence Receptor, Gamma (translocon-associated protein gamma) (SSR3, Accession NM_007107). Accordingly, utilities of VGAM1816 include diagnosis, prevention and treatment of diseases and clinical conditions associated with SSR3. SUN1 (Accession NM_025154) is another VGAM1816 host target gene. SUN1 BINDING SITE is HOST TARGET binding site found in the 3' untranslated region of mRNA encoded by SUN1, corresponding to a HOST TARGET binding site such as BINDING SITE I, BINDING SITE II or BINDING SITE III. Table 2 illustrates the complementarity of the nucleotide sequences of SUN1 BINDING SITE, designated SEQ ID:24794, to the nucleotide sequence of VGAM1816 RNA, herein designated VGAM RNA, also designated SEQ ID:4527.

Another function of VGAM1816 is therefore inhibition of SUN1 (Accession NM_025154). Accordingly, utilities of VGAM1816 include diagnosis, prevention and treatment of diseases and clinical conditions associated with SUN1. LOC125228 (Accession XM_058913) is another VGAM1816 host target gene. LOC125228 BINDING SITE is HOST TARGET binding site found in the 3' untranslated region of mRNA encoded by LOC125228, corresponding to a HOST TARGET binding site such as BINDING SITE I, BINDING SITE II or BINDING SITE III. Table 2 illustrates the complementarity of the nucleotide sequences of LOC125228 BINDING SITE, designated SEQ ID:36794, to the nucleotide sequence of VGAM1816 RNA, herein designated VGAM RNA, also designated SEQ ID:4527.

Another function of VGAM1816 is therefore inhibition of LOC125228 (Accession XM_058913). Accordingly, utilities of VGAM1816 include diagnosis, prevention and treatment of diseases and clinical conditions associated with LOC125228. LOC158563 (Accession XM_088606) is another VGAM1816 host target gene. LOC158563 BINDING SITE is HOST TARGET binding site found in the 3' untranslated region of mRNA encoded by LOC158563, corresponding to a HOST TARGET binding site such as BINDING SITE I, BINDING SITE II or BINDING SITE III. Table 2 illustrates the complementarity of the nucleotide sequences of LOC158563 BINDING SITE, designated SEQ ID:39871, to the nucleotide sequence of VGAM1816 RNA, herein designated VGAM RNA, also designated SEQ ID:4527.

Another function of VGAM1816 is therefore inhibition of LOC158563 (Accession XM_088606). Accordingly, utilities of VGAM1816 include diagnosis, prevention and treatment of diseases and clinical conditions associated with LOC158563. LOC161635 (Accession XM_172921) is another VGAM1816 host target gene. LOC161635 BINDING SITE is HOST TARGET binding site found in the 5' untranslated region of mRNA encoded by LOC161635, corresponding to a HOST TARGET binding site such as BINDING SITE I, BINDING SITE II or BINDING SITE III. Table 2 illustrates the complementarity of the nucleotide sequences of LOC161635 BINDING SITE, designated SEQ ID:46188, to the nucleotide sequence of VGAM1816 RNA, herein designated VGAM RNA, also designated SEQ ID:4527.

Another function of VGAM1816 is therefore inhibition of LOC161635 (Accession XM_172921). Accordingly, utilities of VGAM1816 include diagnosis, prevention and treatment of diseases and clinical conditions associated with LOC161635. LOC257206 (Accession XM_173136) is another VGAM1816 host target gene. LOC257206 BINDING SITE is HOST TARGET binding site found in the 3' untranslated region of mRNA encoded by LOC257206, corresponding to a HOST TARGET binding site such as BINDING SITE I, BINDING SITE II or BINDING SITE III. Table 2 illustrates the complementarity of the nucleotide sequences of LOC257206 BINDING SITE, designated SEQ ID:46386, to the nucleotide sequence of VGAM1816 RNA, herein designated VGAM RNA, also designated SEQ ID:4527.

Another function of VGAM1816 is therefore inhibition of LOC257206 (Accession XM_173136). Accordingly, utilities of VGAM1816 include diagnosis, prevention and treatment of diseases and clinical conditions associated with LOC257206. FIG. 1 further provides a conceptual description of a novel bioinformatically detected viral gene of the present invention, referred to here as Viral Genomic Address Messenger 1817 (VGAM1817) viral gene, which modulates expression of respective host target genes thereof, the function and utility of which host target genes is known in the art.

VGAM1817 is a novel bioinformatically detected regulatory, non protein coding, viral micro RNA (miRNA) gene. The method by which VGAM1817 was detected is described hereinabove with reference to FIGS. 1-8.

VGAM1817 gene, herein designated VGAM GENE, is a viral gene contained in the genome of Variola Virus. VGAM1817 host target gene, herein designated VGAM HOST TARGET GENE, is a human gene contained in the human genome.

VGAM1817 gene encodes a VGAM1817 precursor RNA, herein designated VGAM PRECURSOR RNA. Similar to other miRNA genes, and unlike most ordinary genes, VGAM1817 precursor RNA does not encode a protein. A nucleotide sequence identical or highly similar to the nucleotide sequence of VGAM1817 precursor RNA is designated SEQ ID:1803, and is provided hereinbelow with reference to the sequence listing part. Nucleotide sequence SEQ ID:1803 is located at position 27215 relative to the genome of Variola Virus.

VGAM1817 precursor RNA folds onto itself, forming VGAM1817 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1817 folded precursor RNA into VGAM1817 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 78%) nucleotide sequence of VGAM1817 RNA is designated SEQ ID:4528, and is provided hereinbelow with reference to the sequence listing part.

VGAM1817 host target gene, herein designated VGAM HOST TARGET GENE, encodes a corresponding messenger RNA, VGAM1817 host target RNA, herein designated VGAM HOST TARGET RNA. VGAM1817 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1817 RNA, herein designated VGAM RNA, binds complementarily to one or more host target binding sites located in untranslated regions of VGAM1817 host target RNA, herein designated VGAM HOST TARGET RNA. This complementary binding is due to the fact that the nucleotide sequence of VGAM1817 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1817 RNA, herein designated VGAM RNA, may have a different number of host target binding sites in untranslated regions of a VGAM1817 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1817 RNA, herein designated VGAM RNA, to host target binding sites on VGAM1817 host target RNA, herein designated VGAM HOST TARGET RNA, such as BINDING SITE I, BINDING SITE II and BINDING SITE III, inhibits translation of VGAM1817 host target RNA into VGAM1817 host target protein, herein designated VGAM HOST TARGET PROTEIN. VGAM host target protein is therefore outlined by a broken line.

It is appreciated that VGAM1817 host target gene, herein designated VGAM HOST TARGET GENE, in fact represents a plurality of VGAM1817 host target genes. The mRNA of each one of this plurality of VGAM1817 host target genes comprises one or more host target binding sites, each having a nucleotide sequence which is at least partly complementary to VGAM1817 RNA, herein designated VGAM RNA, and which when bound by VGAM1817 RNA causes inhibition of translation of respective one or more VGAM1817 host target proteins.

It is further appreciated by one skilled in the art that the mode of translational inhibition illustrated by FIG. 1 with specific reference to translational inhibition exerted by VGAM1817 gene, herein designated VGAM GENE, on one or more VGAM1817 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1817 is inhibition of expression of host target genes, as part of a novel viral mechanism of attacking a host. Accordingly, utilities of VGAM1817 include diagnosis, prevention and treatment of viral infection by Variola Virus. Specific functions, and accordingly utilities, of VGAM1817 correlate with, and may be deduced from, the identity of the host target genes which VGAM1817 binds and inhibits, and the function of these host target genes, as elaborated hereinbelow.

Nucleotide sequences of the VGAM1817 precursor RNA, herein designated VGAM PRECURSOR RNA, and of the 'diced' VGAM1817 RNA, herein designated VGAM RNA, and a schematic representation of the secondary folding of VGAM1817 folded precursor RNA, herein designated VGAM FOLDED PRECURSOR RNA, of VGAM1817 are further described hereinbelow with reference to Table 1.

Nucleotide sequences of host target binding sites, such as BINDING SITE-I, BINDING SITE-II and BINDING SITE-III of FIG. 1, found on VGAM1817 host target RNA, and schematic representation of the complementarity of each of these host target binding sites to VGAM1817 RNA, herein designated VGAM RNA, are described hereinbelow with reference to Table 2.

As mentioned hereinabove with reference to FIG. 1, a function of VGAM1817 gene, herein designated VGAM is inhibition of expression of VGAM1817 target genes. It is appreciated that specific functions, and accordingly utilities, of VGAM1817 correlate with, and may be deduced from, the identity of the target genes which VGAM1817 binds and inhibits, and the function of these target genes, as elaborated hereinbelow.

Collagen, Type IV, Alpha 4 (COL4A4, Accession NM_000092) is a VGAM1817 host target gene. COL4A4 BINDING SITE is HOST TARGET binding site found in the 3' untranslated region of mRNA encoded by COL4A4, corresponding to a HOST TARGET binding site such as BINDING SITE I, BINDING SITE II or BINDING SITE III. Table 2 illustrates the complementarity of the nucleotide sequences of COL4A4 BINDING SITE, designated SEQ ID:5554, to the nucleotide sequence of VGAM1817 RNA, herein designated VGAM RNA, also designated SEQ ID:4528.

A function of VGAM1817 is therefore inhibition of Collagen, Type IV, Alpha 4 (COL4A4, Accession NM_000092). Accordingly, utilities of VGAM1817 include diagnosis, prevention and treatment of diseases and clinical conditions associated with COL4A4. CDC14 Cell Division Cycle 14 Homolog B (S. cerevisiae) (CDC14B, Accession NM_033332) is another VGAM1817 host target gene. CDC14B BINDING SITE is HOST TARGET binding site found in the 3' untranslated region of mRNA encoded by CDC14B, corresponding to a HOST TARGET binding site such as BINDING SITE I, BINDING SITE II or BINDING SITE III. Table 2 illustrates the complementarity of the nucleotide sequences of CDC14B BINDING SITE, designated SEQ ID:27172, to the nucleotide sequence of VGAM1817 RNA, herein designated VGAM RNA, also designated SEQ ID:4528.

Another function of VGAM1817 is therefore inhibition of CDC14 Cell Division Cycle 14 Homolog B (S. cerevisiae) (CDC14B, Accession NM_033332). Accordingly, utilities of VGAM1817 include diagnosis, prevention and treatment of diseases and clinical conditions associated with CDC14B. FLJ23120 (Accession XM_097961) is another VGAM1817 host target gene. FLJ23120 BINDING SITE is HOST TARGET binding site found in the 3' untranslated region of mRNA encoded by FLJ23120, corresponding to a HOST TARGET binding site such as BINDING SITE I, BINDING SITE II or BINDING SITE III. Table 2 illustrates the complementarity of the nucleotide sequences of FLJ23120 BINDING SITE, designated SEQ ID:41267, to the nucleotide sequence of VGAM1817 RNA, herein designated VGAM RNA, also designated SEQ ID:4528.

Another function of VGAM1817 is therefore inhibition of FLJ23120 (Accession XM_097961). Accordingly, utilities of VGAM1817 include diagnosis, prevention and treatment of diseases and clinical conditions associated with FLJ23120.

KIAA0738 (Accession NM_014719) is another VGAM1817 host target gene. KIAA0738 BINDING SITE is HOST TARGET binding site found in the 3' untranslated region of mRNA encoded by KIAA0738, corresponding to a HOST TARGET binding site such as BINDING SITE I, BINDING SITE II or BINDING SITE III. Table 2 illustrates the complementarity of the nucleotide sequences of KIAA0738 BINDING SITE, designated SEQ ID:16277, to the nucleotide sequence of VGAM1817 RNA, herein designated VGAM RNA, also designated SEQ ID:4528.

Another function of VGAM1817 is therefore inhibition of KIAA0738 (Accession NM_014719). Accordingly, utilities of VGAM1817 include diagnosis, prevention and treatment of diseases and clinical conditions associated with KIAA0738. KIAA1239 (Accession XM_049078) is another VGAM1817 host target gene. KIAA1239 BINDING SITE is HOST TARGET binding site found in the 3' untranslated region of mRNA encoded by KIAA1239, corresponding to a HOST TARGET binding site such as BINDING SITE I, BINDING SITE II or BINDING SITE III. Table 2 illustrates the complementarity of the nucleotide sequences of KIAA1239 BINDING SITE, designated SEQ ID:35341, to the nucleotide sequence of VGAM1817 RNA, herein designated VGAM RNA, also designated SEQ ID:4528.

Another function of VGAM1817 is therefore inhibition of KIAA1239 (Accession XM_049078). Accordingly, utilities of VGAM1817 include diagnosis, prevention and treatment of diseases and clinical conditions associated with KIAA1239. FIG. 1 further provides a conceptual description of a novel bioinformatically detected viral gene of the present invention, referred to here as Viral Genomic Address Messenger 1818 (VGAM1818) viral gene, which modulates expression of respective host target genes thereof, the function and utility of which host target genes is known in the art.

VGAM1818 is a novel bioinformatically detected regulatory, non protein coding, viral micro RNA (miRNA) gene. The method by which VGAM1818 was detected is described hereinabove with reference to FIGS. 1-8.

VGAM1818 gene, herein designated VGAM GENE, is a viral gene contained in the genome of Variola Virus. VGAM1818 host target gene, herein designated VGAM HOST TARGET GENE, is a human gene contained in the human genome.

VGAM1818 gene encodes a VGAM1818 precursor RNA, herein designated VGAM PRECURSOR RNA. Similar to other miRNA genes, and unlike most ordinary genes, VGAM1818 precursor RNA does not encode a protein. A nucleotide sequence identical or highly similar to the nucleotide sequence of VGAM1818 precursor RNA is designated SEQ ID:1804, and is provided hereinbelow with reference to the sequence listing part. Nucleotide sequence SEQ ID:1804 is located at position 28707 relative to the genome of Variola Virus.

VGAM1818 precursor RNA folds onto itself, forming VGAM1818 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1818 folded precursor RNA into VGAM1818 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1818 RNA is designated SEQ ID:4529, and is provided hereinbelow with reference to the sequence listing part.

VGAM1818 host target gene, herein designated VGAM HOST TARGET GENE, encodes a corresponding messenger RNA, VGAM1818 host target RNA, herein designated VGAM HOST TARGET RNA. VGAM1818 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1818 RNA, herein designated VGAM RNA, binds complementarily to one or more host target binding sites located in untranslated regions of VGAM1818 host target RNA, herein designated VGAM HOST TARGET RNA. This complementary binding is due to the fact that the nucleotide sequence of VGAM1818 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1818 RNA, herein designated VGAM RNA, may have a different number of host target binding sites in untranslated regions of a VGAM1818 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1818 RNA, herein designated VGAM RNA, to host target binding sites on VGAM1818 host target RNA, herein designated VGAM HOST TARGET RNA, such as BINDING SITE I, BINDING SITE II and BINDING SITE III, inhibits translation of VGAM1818 host target RNA into VGAM1818 host target protein, herein designated VGAM HOST TARGET PROTEIN. VGAM host target protein is therefore outlined by a broken line.

It is appreciated that VGAM1818 host target gene, herein designated VGAM HOST TARGET GENE, in fact represents a plurality of VGAM1818 host target genes. The mRNA of each one of this plurality of VGAM1818 host target genes comprises one or more host target binding sites, each having a nucleotide sequence which is at least partly complementary to VGAM1818 RNA, herein designated VGAM RNA, and which when bound by VGAM1818 RNA causes inhibition of translation of respective one or more VGAM1818 host target proteins.

It is further appreciated by one skilled in the art that the mode of translational inhibition illustrated by FIG. 1 with specific reference to translational inhibition exerted by VGAM1818 gene, herein designated VGAM GENE, on one or more VGAM1818 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1818 is inhibition of expression of host target genes, as part of a novel viral mechanism of attacking a host. Accordingly, utilities of VGAM1818 include diagnosis, prevention and treatment of viral infection by Variola Virus. Specific functions, and accordingly utilities, of VGAM1818 correlate with, and may be deduced from, the identity of the host target genes which VGAM1818 binds and inhibits, and the function of these host target genes, as elaborated hereinbelow.

Nucleotide sequences of the VGAM1818 precursor RNA, herein designated VGAM PRECURSOR RNA, and of the 'diced' VGAM1818 RNA, herein designated VGAM RNA, and a schematic representation of the secondary folding of VGAM1818 folded precursor RNA, herein designated VGAM FOLDED PRECURSOR RNA, of VGAM1818 are further described hereinbelow with reference to Table 1.

Nucleotide sequences of host target binding sites, such as BINDING SITE-I, BINDING SITE-II and BINDING SITE-III of FIG. 1, found on VGAM1818 host target RNA, and schematic representation of the complementarity of each of these host target binding sites to VGAM1818 RNA, herein designated VGAM RNA, are described hereinbelow with reference to Table 2.

As mentioned hereinabove with reference to FIG. 1, a function of VGAM1818 gene, herein designated VGAM is inhibition of expression of VGAM1818 target genes. It is appreciated that specific functions, and accordingly utilities, of VGAM1818 correlate with, and may be deduced from, the identity of the target genes which VGAM1818 binds and inhibits, and the function of these target genes, as elaborated hereinbelow.

OSRF (Accession XM_003724) is a VGAM1818 host target gene. OSRF BINDING SITE is HOST TARGET binding site found in the 3' untranslated region of mRNA encoded by OSRF, corresponding to a HOST TARGET binding site such as BINDING SITE I, BINDING SITE II or BINDING SITE III. Table 2 illustrates the complementarity of the nucleotide sequences of OSRF BINDING SITE, designated SEQ ID:29941, to the nucleotide sequence of VGAM1818 RNA, herein designated VGAM RNA, also designated SEQ ID:4529.

A function of VGAM1818 is therefore inhibition of OSRF (Accession XM_003724). Accordingly, utilities of VGAM1818 include diagnosis, prevention and treatment of diseases and clinical conditions associated with OSRF. POPX1 (Accession NM_014906) is another VGAM1818 host target gene. POPX1 BINDING SITE is HOST TARGET binding site found in the 3' untranslated region of mRNA encoded by POPX1, corresponding to a HOST TARGET binding site such as BINDING SITE I, BINDING SITE II or BINDING SITE III. Table 2 illustrates the complementarity of the nucleotide sequences of POPX1 BINDING SITE, designated SEQ ID:17116, to the nucleotide sequence of VGAM1818 RNA, herein designated VGAM RNA, also designated SEQ ID:4529.

Another function of VGAM1818 is therefore inhibition of POPX1 (Accession NM_014906). Accordingly, utilities of VGAM1818 include diagnosis, prevention and treatment of diseases and clinical conditions associated with POPX1. LOC124045 (Accession XM_071873) is another VGAM1818 host target gene. LOC124045 BINDING SITE is HOST TARGET binding site found in the 3' untranslated region of mRNA encoded by LOC124045, corresponding to a HOST TARGET binding site such as BINDING SITE I, BINDING SITE II or BINDING SITE III. Table 2 illustrates the complementarity of the nucleotide sequences of LOC124045 BINDING SITE, designated SEQ ID:37439, to the nucleotide sequence of VGAM1818 RNA, herein designated VGAM RNA, also designated SEQ ID:4529.

Another function of VGAM1818 is therefore inhibition of LOC124045 (Accession XM_071873). Accordingly, utilities of VGAM1818 include diagnosis, prevention and treatment of diseases and clinical conditions associated with LOC124045. LOC150848 (Accession XM_097959) is another VGAM1818 host target gene. LOC150848 BINDING SITE is HOST TARGET binding site found in the 5' untranslated region of mRNA encoded by LOC150848, corresponding to a HOST TARGET binding site such as BINDING SITE I, BINDING SITE II or BINDING SITE III. Table 2 illustrates the complementarity of the nucleotide sequences of LOC150848 BINDING SITE, designated SEQ ID:41253, to the nucleotide sequence of VGAM1818 RNA, herein designated VGAM RNA, also designated SEQ ID:4529.

Another function of VGAM1818 is therefore inhibition of LOC150848 (Accession XM_097959). Accordingly, utilities of VGAM1818 include diagnosis, prevention and treatment of diseases and clinical conditions associated with LOC150848. FIG. 1 further provides a conceptual description of a novel bioinformatically detected viral gene of the present invention, referred to here as Viral Genomic Address Messenger 1819 (VGAM1819) viral gene, which modulates expression of respective host target genes thereof, the function and utility of which host target genes is known in the art.

VGAM1819 is a novel bioinformatically detected regulatory, non protein coding, viral micro RNA (miRNA) gene. The method by which VGAM1819 was detected is described hereinabove with reference to FIGS. 1-8.

VGAM1819 gene, herein designated VGAM GENE, is a viral gene contained in the genome of Cryphonectria Hypovirus. VGAM1819 host target gene, herein designated VGAM HOST TARGET GENE, is a human gene contained in the human genome.

VGAM1819 gene encodes a VGAM1819 precursor RNA, herein designated VGAM PRECURSOR RNA. Similar to other miRNA genes, and unlike most ordinary genes, VGAM1819 precursor RNA does not encode a protein. A nucleotide sequence identical or highly similar to the nucleotide sequence of VGAM1819 precursor RNA is designated SEQ ID:1805, and is provided hereinbelow with reference to the sequence listing part. Nucleotide sequence SEQ ID:1805 is located at position 7183 relative to the genome of Cryphonectria Hypovirus.

VGAM1819 precursor RNA folds onto itself, forming VGAM1819 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1819 folded precursor RNA into VGAM1819 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1819 RNA is designated SEQ ID:4530, and is provided hereinbelow with reference to the sequence listing part.

VGAM1819 host target gene, herein designated VGAM HOST TARGET GENE, encodes a corresponding messenger RNA, VGAM1819 host target RNA, herein designated VGAM HOST TARGET RNA. VGAM1819 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1819 RNA, herein designated VGAM RNA, binds complementarily to one or more host target binding sites located in untranslated regions of VGAM1819 host target RNA, herein designated VGAM HOST TARGET RNA. This complementary binding is due to the fact that the nucleotide sequence of VGAM1819 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1819 RNA, herein designated VGAM RNA, may have a different number of host target binding sites in untranslated regions of a VGAM1819 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1819 RNA, herein designated VGAM RNA, to host target binding sites on VGAM1819 host target RNA, herein designated VGAM HOST TARGET RNA, such as BINDING SITE I, BINDING SITE II and BINDING SITE III, inhibits translation of VGAM1819 host target RNA into VGAM1819 host target protein, herein designated VGAM HOST TARGET PROTEIN. VGAM host target protein is therefore outlined by a broken line.

It is appreciated that VGAM1819 host target gene, herein designated VGAM HOST TARGET GENE, in fact represents a plurality of VGAM1819 host target genes. The mRNA of each one of this plurality of VGAM1819 host target genes comprises one or more host target binding sites, each having a nucleotide sequence which is at least partly complementary to VGAM1819 RNA, herein designated VGAM RNA, and which when bound by VGAM1819 RNA causes inhibition of translation of respective one or more VGAM1819 host target proteins.

It is further appreciated by one skilled in the art that the mode of translational inhibition illustrated by FIG. 1 with specific reference to translational inhibition exerted by VGAM1819 gene, herein designated VGAM GENE, on one or more VGAM1819 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1819 is inhibition of expression of host target genes, as part of a novel viral mechanism of attacking a host. Accordingly, utilities of VGAM1819 include diagnosis, prevention and treatment of viral infection by Cryphonectria Hypovirus. Specific functions, and accordingly utilities, of VGAM1819 correlate with, and may be deduced from, the identity of the host target genes which VGAM1819 binds and inhibits, and the function of these host target genes, as elaborated hereinbelow.

Nucleotide sequences of the VGAM1819 precursor RNA, herein designated VGAM PRECURSOR RNA, and of the 'diced' VGAM1819 RNA, herein designated VGAM RNA, and a schematic representation of the secondary folding of VGAM1819 folded precursor RNA, herein designated VGAM FOLDED PRECURSOR RNA, of VGAM1819 are further described hereinbelow with reference to Table 1.

Nucleotide sequences of host target binding sites, such as BINDING SITE-I, BINDING SITE-II and BINDING SITE-III of FIG. 1, found on VGAM1819 host target RNA, and schematic representation of the complementarity of each of these host target binding sites to VGAM1819 RNA, herein designated VGAM RNA, are described hereinbelow with reference to Table 2.

As mentioned hereinabove with reference to FIG. 1, a function of VGAM1819 gene, herein designated VGAM is inhibition of expression of VGAM1819 target genes. It is appreciated that specific functions, and accordingly utilities, of VGAM1819 correlate with, and may be deduced from, the identity of the target genes which VGAM1819 binds and inhibits, and the function of these target genes, as elaborated hereinbelow.

Transmembrane Protease, Serine 3 (TMPRSS3, Accession NM_024022) is a VGAM1819 host target gene. TMPRSS3 BINDING SITE1 through TMPRSS3 BINDING SITE3 are HOST TARGET binding sites found in untranslated regions of mRNA encoded by TMPRSS3, corresponding to HOST TARGET binding sites such as BINDING SITE I, BINDING SITE II or BINDING SITE III. Table 2 illustrates the complementarity of the nucleotide sequences of TMPRSS3 BINDING SITE1 through TMPRSS3 BINDING SITE3, designated SEQ ID:23451, SEQ ID:26187 and SEQ ID:26189 respectively, to the nucleotide sequence of VGAM1819 RNA, herein designated VGAM RNA, also designated SEQ ID:4530.

A function of VGAM1819 is therefore inhibition of Transmembrane Protease, Serine 3 (TMPRSS3, Accession NM_024022). Accordingly, utilities of VGAM1819 include diagnosis, prevention and treatment of diseases and clinical conditions associated with TMPRSS3. KIAA0757 (Accession NM_006038) is another VGAM1819 host target gene. KIAA0757 BINDING SITE is HOST TARGET binding site found in the 3' untranslated region of mRNA encoded by KIAA0757, corresponding to a HOST TARGET binding site such as BINDING SITE I, BINDING SITE II or BINDING SITE III. Table 2 illustrates the complementarity of the nucleotide sequences of KIAA0757 BINDING SITE, designated SEQ ID:12673, to the nucleotide sequence of VGAM1819 RNA, herein designated VGAM RNA, also designated SEQ ID:4530.

Another function of VGAM1819 is therefore inhibition of KIAA0757 (Accession NM_006038). Accordingly, utilities of VGAM1819 include diagnosis, prevention and treatment of diseases and clinical conditions associated with KIAA0757. KIAA0828 (Accession XM_088105) is another VGAM1819 host target gene. KIAA0828 BINDING SITE is HOST TARGET binding site found in the 3' untranslated region of mRNA encoded by KIAA0828, corresponding to a HOST TARGET binding site such as BINDING SITE I, BINDING SITE II or BINDING SITE III. Table 2 illustrates the complementarity of the nucleotide sequences of KIAA0828 BINDING SITE, designated SEQ ID:39512, to the nucleotide sequence of VGAM1819 RNA, herein designated VGAM RNA, also designated SEQ ID:4530.

Another function of VGAM1819 is therefore inhibition of KIAA0828 (Accession XM_088105). Accordingly, utilities of VGAM1819 include diagnosis, prevention and treatment of diseases and clinical conditions associated with KIAA0828. LOC51133 (Accession NM_016121) is another VGAM1819 host target gene. LOC51133 BINDING SITE is HOST TARGET binding site found in the 3' untranslated region of mRNA encoded by LOC51133, corresponding to a HOST TARGET binding site such as BINDING SITE I, BINDING SITE II or BINDING SITE III. Table 2 illustrates the complementarity of the nucleotide sequences of LOC51133 BINDING SITE, designated SEQ ID:18206, to the nucleotide sequence of VGAM1819 RNA, herein designated VGAM RNA, also designated SEQ ID:4530.

Another function of VGAM1819 is therefore inhibition of LOC51133 (Accession NM_016121). Accordingly, utilities of VGAM1819 include diagnosis, prevention and treatment of diseases and clinical conditions associated with LOC51133. FIG. 1 further provides a conceptual description of a novel bioinformatically detected viral gene of the present invention, referred to here as Viral Genomic Address Messenger 1820 (VGAM1820) viral gene, which modulates expression of respective host target genes thereof, the function and utility of which host target genes is known in the art.

VGAM1820 is a novel bioinformatically detected regulatory, non protein coding, viral micro RNA (miRNA) gene. The method by which VGAM1820 was detected is described hereinabove with reference to FIGS. 1-8.

VGAM1820 gene, herein designated VGAM GENE, is a viral gene contained in the genome of Cryphonectria Hypovirus. VGAM1820 host target gene, herein designated VGAM HOST TARGET GENE, is a human gene contained in the human genome.

VGAM1820 gene encodes a VGAM1820 precursor RNA, herein designated VGAM PRECURSOR RNA. Similar to other miRNA genes, and unlike most ordinary genes, VGAM1820 precursor RNA does not encode a protein. A nucleotide sequence identical or highly similar to the nucleotide sequence of VGAM1820 precursor RNA is designated SEQ ID:1806, and is provided hereinbelow with reference to the sequence listing part. Nucleotide sequence SEQ ID:1806 is located at position 7825 relative to the genome of Cryphonectria Hypovirus.

VGAM1820 precursor RNA folds onto itself, forming VGAM1820 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1820 folded precursor RNA into VGAM1820 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 79%) nucleotide sequence of VGAM1820 RNA is designated SEQ ID:4531, and is provided hereinbelow with reference to the sequence listing part.

VGAM1820 host target gene, herein designated VGAM HOST TARGET GENE, encodes a corresponding messenger RNA, VGAM1820 host target RNA, herein designated VGAM HOST TARGET RNA. VGAM1820 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1820 RNA, herein designated VGAM RNA, binds complementarily to one or more host target binding sites located in untranslated regions of VGAM1820 host target RNA, herein designated VGAM HOST TARGET RNA. This complementary binding is due to the fact that the nucleotide sequence of VGAM1820 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1820 RNA, herein designated VGAM RNA, may have a different number of host target binding sites in untranslated regions of a VGAM1820 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1820 RNA, herein designated VGAM RNA, to host target binding sites on VGAM1820 host target RNA, herein designated VGAM HOST TARGET RNA, such as BINDING SITE I, BINDING SITE II and BINDING SITE III, inhibits translation of VGAM1820 host target RNA into VGAM1820 host target protein, herein designated VGAM HOST TARGET PROTEIN. VGAM host target protein is therefore outlined by a broken line.

It is appreciated that VGAM1820 host target gene, herein designated VGAM HOST TARGET GENE, in fact represents a plurality of VGAM1820 host target genes. The mRNA of each one of this plurality of VGAM1820 host target genes comprises one or more host target binding sites, each having a nucleotide sequence which is at least partly complementary to VGAM1820 RNA, herein designated VGAM RNA, and which when bound by VGAM1820 RNA causes inhibition of translation of respective one or more VGAM1820 host target proteins.

It is further appreciated by one skilled in the art that the mode of translational inhibition illustrated by FIG. 1 with specific reference to translational inhibition exerted by VGAM1820 gene, herein designated VGAM GENE, on one or more VGAM1820 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM1820 is inhibition of expression of host target genes, as part of a novel viral mechanism of attacking a host. Accordingly, utilities of VGAM1820 include diagnosis, prevention and treatment of viral infection by Cryphonectria Hypovirus. Specific functions, and accordingly utilities, of VGAM1820 correlate with, and may be deduced from, the identity of the host target genes which VGAM1820 binds and inhibits, and the function of these host target genes, as elaborated hereinbelow.

Nucleotide sequences of the VGAM1820 precursor RNA, herein designated VGAM PRECURSOR RNA, and of the 'diced' VGAM1820 RNA, herein designated VGAM RNA, and a schematic representation of the secondary folding of VGAM1820 folded precursor RNA, herein designated VGAM FOLDED PRECURSOR RNA, of VGAM1820 are further described hereinbelow with reference to Table 1.

Nucleotide sequences of host target binding sites, such as BINDING SITE-I, BINDING SITE-II and BINDING SITE-III of FIG. 1, found on VGAM1820 host target RNA, and schematic representation of the complementarity of each of these host target binding sites to VGAM1820 RNA, herein designated VGAM RNA, are described hereinbelow with reference to Table 2.

As mentioned hereinabove with reference to FIG. 1, a function of VGAM1820 gene, herein designated VGAM is inhibition of expression of VGAM1820 target genes. It is appreciated that specific functions, and accordingly utilities, of VGAM1820 correlate with, and may be deduced from, the identity of the target genes which VGAM1820 binds and inhibits, and the function of these target genes, as elaborated hereinbelow.

Estrogen-related Receptor Beta Like 1 (ESRRBL1, Accession NM_018010) is a VGAM1820 host target gene. ESRRBL1 BINDING SITE is HOST TARGET binding site found in the 3' untranslated region of mRNA encoded by ESRRBL1, corresponding to a HOST TARGET binding site such as BINDING SITE I, BINDING SITE II or BINDING SITE III. Table 2 illustrates the complementarity of the nucleotide sequences of ESRRBL1 BINDING SITE, designated SEQ ID:19743, to the nucleotide sequence of VGAM1820 RNA, herein designated VGAM RNA, also designated SEQ ID:4531.

A function of VGAM1820 is therefore inhibition of Estrogen-related Receptor Beta Like 1 (ESRRBL1, Accession NM_018010). Accordingly, utilities of VGAM1820 include diagnosis, prevention and treatment of diseases and clinical conditions associated with ESRRBL1. Fasciculation and Elongation Protein Zeta 1 (zygin I) (FEZ1, Accession NM_022549) is another VGAM1820 host target gene. FEZ1 BINDING SITE is HOST TARGET binding site found in the 3' untranslated region of mRNA encoded by FEZ1, corresponding to a HOST TARGET binding site such as BINDING SITE I, BINDING SITE II or BINDING SITE III. Table 2 illustrates the complementarity of the nucleotide sequences of FEZ1 BINDING SITE, designated SEQ ID:22878, to the nucleotide sequence of VGAM1820 RNA, herein designated VGAM RNA, also designated SEQ ID:4531.

Another function of VGAM1820 is therefore inhibition of Fasciculation and Elongation Protein Zeta 1 (zygin I) (FEZ1, Accession NM_022549), a gene which Zygin 1; may have a role in axonal outgrowth; has similarity to C. elegans UNC-76. Accordingly, utilities of VGAM1820 include diagnosis, prevention and treatment of diseases and clinical conditions associated with FEZ1. The function of FEZ1 and its association with various diseases and clinical conditions, has been established by previous studies, as described hereinabove with reference to VGAM37. Hepatocyte Growth Factor (hepapoietin A; scatter factor) (HGF, Accession XM_168542) is another VGAM1820 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45220, to the nucleotide sequence of VGAM1820 RNA, herein designated VGAM RNA, also designated SEQ ID:4531.

Another function of VGAM1820 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM1820 include diagnosis, prevention and treatment of diseases and clinical conditions associated with HGF. The function of HGF and its association with various diseases and clinical conditions, has been established by previous studies, as described hereinabove with reference to VGAM174. Homeo Box D4 (HOXD4, Accession NM_014621) is another VGAM1820 host target gene. HOXD4 BINDING SITE is HOST TARGET binding site found in the 3' untranslated region of mRNA encoded by HOXD4, corresponding to a HOST TARGET binding site such as BINDING SITE I, BINDING SITE II or BINDING SITE III. Table 2 illustrates the complementarity of the nucleotide sequences of HOXD4 BINDING SITE, designated SEQ ID:15982, to the nucleotide sequence of VGAM1820 RNA, herein designated VGAM RNA, also designated SEQ ID:4531.

Another function of VGAM1820 is therefore inhibition of Homeo Box D4 (HOXD4, Accession NM_014621), a gene which is part of a developmental regulatory system. Accordingly, utilities of VGAM1820 include diagnosis, prevention and treatment of diseases and clinical conditions associated with HOXD4. The function of HOXD4 and its association with various diseases and clinical conditions, has been established by previous studies, as described hereinabove with reference to VGAM330. NKX3A (Accession NM_006167) is another VGAM1820 host target gene. NKX3A BINDING SITE is HOST TARGET binding site found in the 3' untranslated region of mRNA encoded by NKX3A, corresponding to a HOST TARGET binding site such as BINDING SITE I, BINDING SITE II or BINDING SITE III. Table 2 illustrates the complementarity of the nucleotide sequences of NKX3A BINDING SITE, designated SEQ ID:12827, to the nucleotide sequence of VGAM1820 RNA, herein designated VGAM RNA, also designated SEQ ID:4531.

Another function of VGAM1820 is therefore inhibition of NKX3A (Accession NM_006167), a gene which may regulate gene expression and control cell differentiation. Accordingly, utilities of VGAM1820 include diagnosis, prevention and treatment of diseases and clinical conditions associated with NKX3A. The function of NKX3A and its association with various diseases and clinical conditions, has been established by previous studies, as described hereinabove with reference to VGAM481. Stearoyl-CoA Desaturase (delta-9-desaturase) (SCD, Accession NM_005063) is another VGAM1820 host target gene. SCD BINDING SITE is HOST TARGET binding site found in the 3' untranslated region of mRNA encoded by SCD, corresponding to a HOST TARGET binding site such as BINDING SITE I, BINDING SITE II or BINDING SITE III. Table 2 illustrates the complementarity of the nucleotide sequences of SCD BINDING SITE, designated SEQ ID:11491, to the nucleotide sequence of VGAM1820 RNA, herein designated VGAM RNA, also designated SEQ ID:4531.

Another function of VGAM1820 is therefore inhibition of Stearoyl-CoA Desaturase (delta-9-desaturase) (SCD, Accession NM_005063), a gene which functions in the synthesis of unsaturated fatty acids. Accordingly, utilities of VGAM1820 include diagnosis, prevention and treatment of diseases and clinical conditions associated with SCD. The function of SCD and its association with various diseases and clinical conditions, has been established by previous studies, as described hereinabove with reference to VGAM314. SMT3 Suppressor of Mif Two 3 Homolog 1 (yeast) (SMT3H1, Accession XM_009805) is another VGAM1820 host target gene. SMT3H1 BINDING SITE is HOST TARGET binding site found in the 3' untranslated region of mRNA encoded by SMT3H1, corresponding to a HOST TARGET binding site such as BINDING SITE I, BINDING SITE II or BINDING SITE III. Table 2 illustrates the complementarity of the nucleotide sequences of SMT3H1 BINDING SITE, designated SEQ ID:30124, to the nucleotide sequence of VGAM1820 RNA, herein designated VGAM RNA, also designated SEQ ID:4531.

Another function of VGAM1820 is therefore inhibition of SMT3 Suppressor of Mif Two 3 Homolog 1 (yeast) (SMT3H1, Accession XM_009805), a gene which is involved in the function and/or structure of the eukaryotic kinetochore. Accordingly, utilities of VGAM1820 include diagnosis, prevention and treatment of diseases and clinical conditions associated with SMT3H1. The function of SMT3H1 and its association with various diseases and clinical conditions, has been established by previous studies, as described hereinabove with reference to VGAM119. Chromobox Homolog 3 (HP1 gamma homolog, Drosophila) (CBX3, Accession NM_007276) is another VGAM1820 host target gene. CBX3 BINDING SITE1 and CBX3 BINDING SITE2 are HOST TARGET binding sites found in untranslated regions of mRNA encoded by CBX3, corresponding to HOST TARGET binding sites such as BINDING SITE I, BINDING SITE II or BINDING SITE III. Table 2 illustrates the complementarity of the nucleotide sequences of CBX3 BINDING SITE1 and CBX3 BINDING SITE2, designated SEQ ID:14141 and SEQ ID:18661 respectively, to the nucleotide sequence of VGAM1820 RNA, herein designated VGAM RNA, also designated SEQ ID:4531.

Another function of VGAM1820 is therefore inhibition of Chromobox Homolog 3 (HP1 gamma homolog, Drosophila) (CBX3, Accession NM_007276). Accordingly, utilities of VGAM1820 include diagnosis, prevention and treatment of diseases and clinical conditions associated with CBX3. Chromosome Y Open Reading Frame 14 (CYorf14, Accession NM_018542) is another VGAM1820 host target gene. CYorf14 BINDING SITE is HOST TARGET binding site found in the 3' untranslated region of mRNA encoded by CYorf14, corresponding to a HOST TARGET binding site such as BINDING SITE I, BINDING SITE II or BINDING SITE III. Table 2 illustrates the complementarity of the nucleotide sequences of CYorf14 BINDING SITE, designated SEQ ID:20613, to the nucleotide sequence of VGAM1820 RNA, herein designated VGAM RNA, also designated SEQ ID:4531.

Another function of VGAM1820 is therefore inhibition of Chromosome Y Open Reading Frame 14 (CYorf14, Accession NM_018542). Accordingly, utilities of VGAM1820 include diagnosis, prevention and treatment of diseases and clinical conditions associated with CYorf14. DKFZP434I092 (Accession XM_042042) is another VGAM1820 host target gene. DKFZP434I092 BINDING SITE is HOST TARGET binding site found in the 3' untranslated region of mRNA encoded by DKFZP434I092, corresponding to a HOST TARGET binding site such as BINDING SITE I, BINDING SITE II or BINDING SITE III. Table 2 illustrates the complementarity of the nucleotide sequences of DKFZP434I092 BINDING SITE, designated SEQ ID:33675, to the nucleotide sequence of VGAM1820 RNA, herein designated VGAM RNA, also designated SEQ ID:4531.

Another function of VGAM1820 is therefore inhibition of DKFZP434I092 (Accession XM_042042). Accordingly, utilities of VGAM1820 include diagnosis, prevention and treatment of diseases and clinical conditions associated with DKFZP434I092. FLJ14827 (Accession NM_032848) is another VGAM1820 host target gene. FLJ14827 BINDING SITE is HOST TARGET binding site found in the 5' untranslated region of mRNA encoded by FLJ14827, corresponding to a HOST TARGET binding site such as BINDING SITE I, BINDING SITE II or BINDING SITE III. Table 2 illustrates the complementarity of the nucleotide sequences of FLJ14827 BINDING SITE, designated SEQ ID:26642, to the nucleotide sequence of VGAM1820 RNA, herein designated VGAM RNA, also designated SEQ ID:4531.

Another function of VGAM1820 is therefore inhibition of FLJ14827 (Accession NM_032848). Accordingly, utilities of VGAM1820 include diagnosis, prevention and treatment of diseases and clinical conditions associated with FLJ14827. KIAA0247 (Accession NM_014734) is another VGAM1820 host target gene. KIAA0247 BINDING SITE is HOST TARGET binding site found in the 3' untranslated region of mRNA encoded by KIAA0247, corresponding to a HOST TARGET binding site such as BINDING SITE I, BINDING SITE II or BINDING SITE III. Table 2 illustrates the complementarity of the nucleotide sequences of KIAA0247 BINDING SITE, designated SEQ ID:16371, to the nucleotide sequence of VGAM1820 RNA, herein designated VGAM RNA, also designated SEQ ID:4531.

Another function of VGAM1820 is therefore inhibition of KIAA0247 (Accession NM_014734). Accordingly, utilities of VGAM1820 include diagnosis, prevention and treatment of diseases and clinical conditions associated with KIAA0247. KIAA0367 (Accession XM_041018) is another VGAM1820 host target gene. KIAA0367 BINDING SITE is HOST TARGET binding site found in the 3' untranslated region of mRNA encoded by KIAA0367, corresponding to a HOST TARGET binding site such as BINDING SITE I, BINDING SITE II or BINDING SITE III. Table 2 illustrates the complementarity of the nucleotide sequences of KIAA0367 BINDING SITE, designated SEQ ID:33417, to the nucleotide sequence of VGAM1820 RNA, herein designated VGAM RNA, also designated SEQ ID:4531.

Another function of VGAM1820 is therefore inhibition of KIAA0367 (Accession XM_041018). Accordingly, utilities of VGAM1820 include diagnosis, prevention and treatment of diseases and clinical conditions associated with KIAA0367. KIAA1040 (Accession XM_051091) is another VGAM1820 host target gene. KIAA1040 BINDING SITE is HOST TARGET binding site found in the 3' untranslated region of mRNA encoded by KIAA1040, corresponding to a HOST TARGET binding site such as BINDING SITE I, BINDING SITE II or BINDING SITE III. Table 2 illustrates the complementarity of the nucleotide sequences of KIAA1040 BINDING SITE, designated SEQ ID:35741, to the nucleotide sequence of VGAM1820 RNA, herein designated VGAM RNA, also designated SEQ ID:4531.

Another function of VGAM1820 is therefore inhibition of KIAA1040 (Accession XM_051091). Accordingly, utilities of VGAM1820 include diagnosis, prevention and treatment of diseases and clinical conditions associated with KIAA1040. Phosphodiesterase 7B (PDE7B, Accession NM_018945) is another VGAM1820 host target gene. PDE7B BINDING SITE is HOST TARGET binding site found in the 5' untranslated region of mRNA encoded by PDE7B, corresponding to a HOST TARGET binding site such as BINDING SITE I, BINDING SITE II or BINDING SITE III. Table 2 illustrates the complementarity of the nucleotide sequences of PDE7B BINDING SITE, designated SEQ ID:21011, to the nucleotide sequence of VGAM1820 RNA, herein designated VGAM RNA, also designated SEQ ID:4531.

Another function of VGAM1820 is therefore inhibition of Phosphodiesterase 7B (PDE7B, Accession NM_018945). Accordingly, utilities of VGAM1820 include diagnosis, prevention and treatment of diseases and clinical conditions associated with PDE7B. LOC145134 (Accession XM_096722) is another VGAM1820 host target gene. LOC145134 BINDING SITE is HOST TARGET binding site found in the 5' untranslated region of mRNA encoded by LOC145134, corresponding to a HOST TARGET binding site such as BINDING SITE I, BINDING SITE II or BINDING SITE III. Table 2 illustrates the complementarity of the nucleotide sequences of LOC145134 BINDING SITE, designated SEQ ID:40502, to the nucleotide sequence of VGAM1820 RNA, herein designated VGAM RNA, also designated SEQ ID:4531.

Another function of VGAM1820 is therefore inhibition of LOC145134 (Accession XM_096722). Accordingly, utilities of VGAM1820 include diagnosis, prevention and treatment of diseases and clinical conditions associated with LOC145134. LOC90246 (Accession XM_030283) is another VGAM1820 host target gene. LOC90246 BINDING SITE is HOST TARGET binding site found in the 5' untranslated region of mRNA encoded by LOC90246, corresponding to a HOST TARGET binding site such as BINDING SITE I, BINDING SITE II or BINDING SITE III. Table 2 illustrates the complementarity of the nucleotide sequences of LOC90246 BINDING SITE, designated SEQ ID:31000, to the nucleotide sequence of VGAM1820 RNA, herein designated VGAM RNA, also designated SEQ ID:4531.

Another function of VGAM1820 is therefore inhibition of LOC90246 (Accession XM_030283). Accordingly, utilities of VGAM1820 include diagnosis, prevention and treatment of diseases and clinical conditions associated with LOC90246. LOC93097 (Accession XM_049221) is another VGAM1820 host target gene. LOC93097 BINDING SITE is HOST TARGET binding site found in the 5' untranslated region of mRNA encoded by LOC93097, corresponding to a HOST TARGET binding site such as BINDING SITE I, BINDING SITE II or BINDING SITE III. Table 2 illustrates the complementarity of the nucleotide sequences of LOC93097 BINDING SITE, designated SEQ ID:35355, to the nucleotide sequence of VGAM1820 RNA, herein designated VGAM RNA, also designated SEQ ID:4531.

Another function of VGAM1820 is therefore inhibition of LOC93097 (Accession XM_049221). Accordingly, utilities of VGAM1820 include diagnosis, prevention and treatment of diseases and clinical conditions associated with LOC93097. FIG. 1 further provides a conceptual description of a novel bioinformatically detected viral gene of the present invention, referred to here as Viral Genomic Address Messenger 1821 (VGAM1821) viral gene, which modulates expression of respective host target genes thereof, the function and utility of which host target genes is known in the art.

VGAM1821 is a novel bioinformatically detected regulatory, non protein coding, viral micro RNA (miRNA) gene. The method by which VGAM1821 was detected is described hereinabove with reference to FIGS. 1-8.

VGAM1821 gene, herein designated VGAM GENE, is a viral gene contained in the genome of Variola Virus. VGAM1821 host target gene, herein designated VGAM HOST TARGET GENE, is a human gene contained in the human genome.

VGAM1821 gene encodes a VGAM1821 precursor RNA, herein designated VGAM PRECURSOR RNA. Similar to other miRNA genes, and unlike most ordinary genes, VGAM1821 precursor RNA does not encode a protein. A nucleotide sequence identical or highly similar to the nucleotide sequence of VGAM1821 precursor RNA is designated SEQ ID:1807, and is provided hereinbelow with reference to the sequence listing part. Nucleotide sequence SEQ ID:1807 is located at position 28943 relative to the genome of Variola Virus.

VGAM1821 precursor RNA folds onto itself, forming VGAM1821 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1821 folded precursor RNA into VGAM1821 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM1821 RNA is designated SEQ ID:4532, and is provided hereinbelow with reference to the sequence listing part.

VGAM1821 host target gene, herein designated VGAM HOST TARGET GENE, encodes a corresponding messenger RNA, VGAM1821 host target RNA, herein designated VGAM HOST TARGET RNA. VGAM1821 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1821 RNA, herein designated VGAM RNA, binds complementarily to one or more host target binding sites located in untranslated regions of VGAM1821 host target RNA, herein designated VGAM HOST TARGET RNA. This complementary binding is due to the fact that the nucleotide sequence of VGAM1821 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1821 RNA, herein designated VGAM RNA, may have a different number of host target binding sites in untranslated regions of a VGAM1821 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1821 RNA, herein designated VGAM RNA, to host target binding sites on VGAM1821 host target RNA, herein designated VGAM HOST TARGET RNA, such as BINDING SITE I, BINDING SITE II and BINDING SITE III, inhibits translation of VGAM1821 host target RNA into VGAM1821 host target protein, herein designated VGAM HOST TARGET PROTEIN. VGAM host target protein is therefore outlined by a broken line.

It is appreciated that VGAM1821 host target gene, herein designated VGAM HOST TARGET GENE, in fact represents a plurality of VGAM1821 host target genes. The mRNA of each one of this plurality of VGAM1821 host target genes comprises one or more host target binding sites, each having a nucleotide sequence which is at least partly complementary to VGAM1821 RNA, herein designated VGAM RNA, and which when bound by VGAM1821 RNA causes inhibition of translation of respective one or more VGAM1821 host target proteins.

It is further appreciated by one skilled in the art that the mode of translational inhibition illustrated by FIG. 1 with specific reference to translational inhibition exerted by VGAM1821 gene, herein designated VGAM GENE, on one or more VGAM1821 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1821 is inhibition of expression of host target genes, as part of a novel viral mechanism of attacking a host. Accordingly, utilities of VGAM1821 include diagnosis, prevention and treatment of viral infection by Variola Virus. Specific functions, and accordingly utilities, of VGAM1821 correlate with, and may be deduced from, the identity of the host target genes which VGAM1821 binds and inhibits, and the function of these host target genes, as elaborated hereinbelow.

Nucleotide sequences of the VGAM1821 precursor RNA, herein designated VGAM PRECURSOR RNA, and of the 'diced' VGAM1821 RNA, herein designated VGAM RNA, and a schematic representation of the secondary folding of VGAM1821 folded precursor RNA, herein designated VGAM FOLDED PRECURSOR RNA, of VGAM1821 are further described hereinbelow with reference to Table 1.

Nucleotide sequences of host target binding sites, such as BINDING SITE-I, BINDING SITE-II and BINDING SITE-III of FIG. 1, found on VGAM1821 host target RNA, and schematic representation of the complementarity of each of these host target binding sites to VGAM1821 RNA, herein designated VGAM RNA, are described hereinbelow with reference to Table 2.

As mentioned hereinabove with reference to FIG. 1, a function of VGAM1821 gene, herein designated VGAM is inhibition of expression of VGAM1821 target genes. It is appreciated that specific functions, and accordingly utilities, of VGAM1821 correlate with, and may be deduced from, the identity of the target genes which VGAM1821 binds and inhibits, and the function of these target genes, as elaborated hereinbelow.

UDP-Gal:betaGlcNAc Beta 1,4-Galactosyltransferase, Polypeptide 5 (B4GALT5, Accession NM_004776) is a VGAM1821 host target gene. B4GALT5 BINDING SITE is HOST TARGET binding site found in the 3' untranslated region of mRNA encoded by B4GALT5, corresponding to a HOST TARGET binding site such as BINDING SITE I, BINDING SITE II or BINDING SITE III. Table 2 illustrates the complementarity of the nucleotide sequences of B4GALT5 BINDING SITE, designated SEQ ID:11170, to the nucleotide sequence of VGAM1821 RNA, herein designated VGAM RNA, also designated SEQ ID:4532.

A function of VGAM1821 is therefore inhibition of UDP-Gal:betaGlcNAc Beta 1,4-Galactosyltransferase, Polypeptide 5 (B4GALT5, Accession NM_004776). Accordingly, utilities of VGAM1821 include diagnosis, prevention and treatment of diseases and clinical conditions associated with B4GALT5. BCL2-antagonist/killer 1 (BAK1, Accession XM_166333) is another VGAM1821 host target gene. BAK1 BINDING SITE is HOST TARGET binding site found in the 3' untranslated region of mRNA encoded by BAK1, corresponding to a HOST TARGET binding site such as BINDING SITE I, BINDING SITE II or BINDING SITE III. Table 2 illustrates the complementarity of the nucleotide sequences of BAK1 BINDING SITE, designated SEQ ID:44175, to the nucleotide sequence of VGAM1821 RNA, herein designated VGAM RNA, also designated SEQ ID:4532.

Another function of VGAM1821 is therefore inhibition of BCL2-antagonist/killer 1 (BAK1, Accession XM_166333), a gene which accelerates programmed cell death by binding to, and antagonizing the a repressor bcl-2. Accordingly, utilities of VGAM1821 include diagnosis, prevention and treatment of diseases and clinical conditions associated with BAK1. The function of BAK1 and its association with various diseases and clinical conditions, has been established by previous studies, as described hereinabove with reference to VGAM430. Forkhead Box O1A (rhabdomyosarcoma) (FOXO1A, Accession NM_002015) is another VGAM1821 host target gene. FOXO1A BINDING SITE is HOST TARGET binding site found in the 3' untranslated region of mRNA encoded by FOXO1A, corresponding to a HOST TARGET binding site such as BINDING SITE I, BINDING SITE II or BINDING SITE III. Table 2 illustrates the complementarity of the nucleotide sequences of FOXO1A BINDING SITE, designated SEQ ID:7758, to the nucleotide sequence of VGAM1821 RNA, herein designated VGAM RNA, also designated SEQ ID:4532.

Another function of VGAM1821 is therefore inhibition of Forkhead Box O1A (rhabdomyosarcoma) (FOXO1A, Accession NM_002015), a gene which is a probable transcription factor. Accordingly, utilities of VGAM1821 include diagnosis, prevention and treatment of diseases and clinical conditions associated with FOXO1A. The function of FOXO1A and its association with various diseases and clinical conditions, has been established by previous studies, as described hereinabove with reference to VGAM228. Angiomotin Like 2 (AMOTL2, Accession NM_016201) is another VGAM1821 host target gene. AMOTL2 BINDING SITE is HOST TARGET binding site found in the 3' untranslated region of mRNA encoded by AMOTL2, corresponding to a HOST TARGET binding site such as BINDING SITE I, BINDING SITE II or BINDING SITE III. Table 2 illustrates the complementarity of the nucleotide sequences of AMOTL2 BINDING SITE, designated SEQ ID:18293, to the nucleotide sequence of VGAM1821 RNA, herein designated VGAM RNA, also designated SEQ ID:4532.

Another function of VGAM1821 is therefore inhibition of Angiomotin Like 2 (AMOTL2, Accession NM_016201). Accordingly, utilities of VGAM1821 include diagnosis, prevention and treatment of diseases and clinical conditions associated with AMOTL2. FUS Interacting Protein (serine-arginine rich) 1 (FUSIP1, Accession NM_054016) is another VGAM1821 host target gene. FUSIP1 BINDING SITE is HOST TARGET binding site found in the 3' untranslated region of mRNA encoded by FUSIP1, corresponding to a HOST TARGET binding site such as BINDING SITE I, BINDING SITE II or BINDING SITE III. Table 2 illustrates the complementarity of the nucleotide sequences of FUSIP1 BINDING SITE, designated SEQ ID:27624, to the nucleotide sequence of VGAM1821 RNA, herein designated VGAM RNA, also designated SEQ ID:4532.

Another function of VGAM1821 is therefore inhibition of FUS Interacting Protein (serine-arginine rich) 1 (FUSIP1, Accession NM_054016). Accordingly, utilities of VGAM1821 include diagnosis, prevention and treatment of diseases and clinical conditions associated with FUSIP1. MGC10999 (Accession NM_032307) is another VGAM1821 host target gene. MGC10999 BINDING SITE is HOST TARGET binding site found in the 3' untranslated region of mRNA encoded by MGC10999, corresponding to a HOST TARGET binding site such as BINDING SITE I, BINDING SITE II or BINDING SITE III. Table 2 illustrates the complementarity of the nucleotide sequences of MGC10999 BINDING SITE, designated SEQ ID:26090, to the nucleotide sequence of VGAM1821 RNA, herein designated VGAM RNA, also designated SEQ ID:4532.

Another function of VGAM1821 is therefore inhibition of MGC10999 (Accession NM_032307). Accordingly, utilities of VGAM1821 include diagnosis, prevention and treatment of diseases and clinical conditions associated with MGC10999. LOC153259 (Accession XM_098342) is another VGAM1821 host target gene. LOC153259 BINDING SITE is HOST TARGET binding site found in the 5' untranslated region of mRNA encoded by LOC153259, corresponding to a HOST TARGET binding site such as BINDING SITE I, BINDING SITE II or BINDING SITE III. Table 2 illustrates the complementarity of the nucleotide sequences of LOC153259 BINDING SITE, designated SEQ ID:41600, to the nucleotide sequence of VGAM1821 RNA, herein designated VGAM RNA, also designated SEQ ID:4532.

Another function of VGAM1821 is therefore inhibition of LOC153259 (Accession XM_098342). Accordingly, utilities of VGAM1821 include diagnosis, prevention and treatment of diseases and clinical conditions associated with LOC153259. FIG. 1 further provides a conceptual description of a novel bioinformatically detected viral gene of the present invention, referred to here as Viral Genomic Address Messenger 1822 (VGAM1822) viral gene, which modulates expression of respective host target genes thereof, the function and utility of which host target genes is known in the art.

VGAM1822 is a novel bioinformatically detected regulatory, non protein coding, viral micro RNA (miRNA) gene. The method by which VGAM1822 was detected is described hereinabove with reference to FIGS. 1-8.

VGAM1822 gene, herein designated VGAM GENE, is a viral gene contained in the genome of Cryphonectria Hypovirus. VGAM1822 host target gene, herein designated VGAM HOST TARGET GENE, is a human gene contained in the human genome.

VGAM1822 gene encodes a VGAM1822 precursor RNA, herein designated VGAM PRECURSOR RNA. Similar to other miRNA genes, and unlike most ordinary genes, VGAM1822 precursor RNA does not encode a protein. A nucleotide sequence identical or highly similar to the nucleotide sequence of VGAM1822 precursor RNA is designated SEQ ID:1808, and is provided hereinbelow with reference to the sequence listing part. Nucleotide sequence SEQ ID:1808 is located at position 9148 relative to the genome of Cryphonectria Hypovirus.

VGAM1822 precursor RNA folds onto itself, forming VGAM1822 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1822 folded precursor RNA into VGAM1822 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 40%) nucleotide sequence of VGAM1822 RNA is designated SEQ ID:4533, and is provided hereinbelow with reference to the sequence listing part.

VGAM1822 host target gene, herein designated VGAM HOST TARGET GENE, encodes a corresponding messenger RNA, VGAM1822 host target RNA, herein designated VGAM HOST TARGET RNA. VGAM1822 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1822 RNA, herein designated VGAM RNA, binds complementarily to one or more host target binding sites located in untranslated regions of VGAM1822 host target RNA, herein designated VGAM HOST TARGET RNA. This complementary binding is due to the fact that the nucleotide sequence of VGAM1822 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1822 RNA, herein designated VGAM RNA, may have a different number of host target binding sites in untranslated regions of a VGAM1822 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1822 RNA, herein designated VGAM RNA, to host target binding sites on VGAM1822 host target RNA, herein designated VGAM HOST TARGET RNA, such as BINDING SITE I, BINDING SITE II and BINDING SITE III, inhibits translation of VGAM1822 host target RNA into VGAM1822 host target protein, herein designated VGAM HOST TARGET PROTEIN. VGAM host target protein is therefore outlined by a broken line.

It is appreciated that VGAM1822 host target gene, herein designated VGAM HOST TARGET GENE, in fact represents a plurality of VGAM1822 host target genes. The mRNA of each one of this plurality of VGAM1822 host target genes comprises one or more host target binding sites, each having a nucleotide sequence which is at least partly complementary to VGAM1822 RNA, herein designated VGAM RNA, and which when bound by VGAM1822 RNA causes inhibition of translation of respective one or more VGAM1822 host target proteins.

It is further appreciated by one skilled in the art that the mode of translational inhibition illustrated by FIG. 1 with specific reference to translational inhibition exerted by VGAM1822 gene, herein designated VGAM GENE, on one or more VGAM1822 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1822 is inhibition of expression of host target genes, as part of a novel viral mechanism of attacking a host. Accordingly, utilities of VGAM1822 include diagnosis, prevention and treatment of viral infection by Cryphonectria Hypovirus. Specific functions, and accordingly utilities, of VGAM1822 correlate with, and may be deduced from, the identity of the host target genes which VGAM1822 binds and inhibits, and the function of these host target genes, as elaborated hereinbelow.

Nucleotide sequences of the VGAM1822 precursor RNA, herein designated VGAM PRECURSOR RNA, and of the 'diced' VGAM1822 RNA, herein designated VGAM RNA, and a schematic representation of the secondary folding of VGAM1822 folded precursor RNA, herein designated VGAM FOLDED PRECURSOR RNA, of VGAM1822 are further described hereinbelow with reference to Table 1.

Nucleotide sequences of host target binding sites, such as BINDING SITE-I, BINDING SITE-II and BINDING SITE-III of FIG. 1, found on VGAM1822 host target RNA, and schematic representation of the complementarity of each of these host target binding sites to VGAM1822 RNA, herein designated VGAM RNA, are described hereinbelow with reference to Table 2.

As mentioned hereinabove with reference to FIG. 1, a function of VGAM1822 gene, herein designated VGAM is inhibition of expression of VGAM1822 target genes. It is appreciated that specific functions, and accordingly utilities, of VGAM1822 correlate with, and may be deduced from, the identity of the target genes which VGAM1822 binds and inhibits, and the function of these target genes, as elaborated hereinbelow.

MEP50 (Accession NM_024102) is a VGAM1822 host target gene. MEP50 BINDING SITE is HOST TARGET binding site found in the 3' untranslated region of mRNA encoded by MEP50, corresponding to a HOST TARGET binding site such as BINDING SITE I, BINDING SITE II or BINDING SITE III. Table 2 illustrates the complementarity of the nucleotide sequences of MEP50 BINDING SITE, designated SEQ ID:23548, to the nucleotide sequence of VGAM1822 RNA, herein designated VGAM RNA, also designated SEQ ID:4533.

A function of VGAM1822 is therefore inhibition of MEP50 (Accession NM_024102). Accordingly, utilities of VGAM1822 include diagnosis, prevention and treatment of diseases and clinical conditions associated with MEP50. LOC139197 (Accession XM_066541) is another VGAM1822 host target gene. LOC139197 BINDING SITE is HOST TARGET binding site found in the 5' untranslated region of mRNA encoded by LOC139197, corresponding to a HOST TARGET binding site such as BINDING SITE I, BINDING SITE II or BINDING SITE III. Table 2 illustrates the complementarity of the nucleotide sequences of LOC139197 BINDING SITE, designated SEQ ID:37329, to the nucleotide sequence of VGAM1822 RNA, herein designated VGAM RNA, also designated SEQ ID:4533.

Another function of VGAM1822 is therefore inhibition of LOC139197 (Accession XM_066541). Accordingly, utilities of VGAM1822 include diagnosis, prevention and treatment of diseases and clinical conditions associated with LOC139197. FIG. 1 further provides a conceptual description of a novel bioinformatically detected viral gene of the present invention, referred to here as Viral Genomic Address Messenger 1823 (VGAM1823) viral gene, which modulates expression of respective host target genes thereof, the function and utility of which host target genes is known in the art.

VGAM1823 is a novel bioinformatically detected regulatory, non protein coding, viral micro RNA (miRNA) gene. The method by which VGAM1823 was detected is described hereinabove with reference to FIGS. 1-8.

VGAM1823 gene, herein designated VGAM GENE, is a viral gene contained in the genome of Cryphonectria Hypovirus. VGAM1823 host target gene, herein designated VGAM HOST TARGET GENE, is a human gene contained in the human genome.

VGAM1823 gene encodes a VGAM1823 precursor RNA, herein designated VGAM PRECURSOR RNA. Similar to other miRNA genes, and unlike most ordinary genes, VGAM1823 precursor RNA does not encode a protein. A nucleotide sequence identical or highly similar to the nucleotide sequence of VGAM1823 precursor RNA is designated SEQ ID:1809, and is provided hereinbelow with reference to the sequence listing part. Nucleotide sequence SEQ ID:1809 is located at position 3317 relative to the genome of Cryphonectria Hypovirus.

VGAM1823 precursor RNA folds onto itself, forming VGAM1823 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1823 folded precursor RNA into VGAM1823 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM1823 RNA is designated SEQ ID:4534, and is provided hereinbelow with reference to the sequence listing part.

VGAM1823 host target gene, herein designated VGAM HOST TARGET GENE, encodes a corresponding messenger RNA, VGAM1823 host target RNA, herein designated VGAM HOST TARGET RNA. VGAM1823 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1823 RNA, herein designated VGAM RNA, binds complementarily to one or more host target binding sites located in untranslated regions of VGAM1823 host target RNA, herein designated VGAM HOST TARGET RNA. This complementary binding is due to the fact that the nucleotide sequence of VGAM1823 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1823 RNA, herein designated VGAM RNA, may have a different number of host target binding sites in untranslated regions of a VGAM1823 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1823 RNA, herein designated VGAM RNA, to host target binding sites on VGAM1823 host target RNA, herein designated VGAM HOST TARGET RNA, such as BINDING SITE I, BINDING SITE II and BINDING SITE III, inhibits translation of VGAM1823 host target RNA into VGAM1823 host target protein, herein designated VGAM HOST TARGET PROTEIN. VGAM host target protein is therefore outlined by a broken line.

It is appreciated that VGAM1823 host target gene, herein designated VGAM HOST TARGET GENE, in fact represents a plurality of VGAM1823 host target genes. The mRNA of each one of this plurality of VGAM1823 host target genes comprises one or more host target binding sites, each having a nucleotide sequence which is at least partly complementary to VGAM1823 RNA, herein designated VGAM RNA, and which when bound by VGAM1823 RNA causes inhibition of translation of respective one or more VGAM1823 host target proteins.

It is further appreciated by one skilled in the art that the mode of translational inhibition illustrated by FIG. 1 with specific reference to translational inhibition exerted by VGAM1823 gene, herein designated VGAM GENE, on one or more VGAM1823 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1823 is inhibition of expression of host target genes, as part of a novel viral mechanism of attacking a host. Accordingly, utilities of VGAM1823 include diagnosis, prevention and treatment of viral infection by Cryphonectria Hypovirus. Specific functions, and accordingly utilities, of VGAM1823 correlate with, and may be deduced from, the identity of the host target genes which VGAM1823 binds and inhibits, and the function of these host target genes, as elaborated hereinbelow.

Nucleotide sequences of the VGAM1823 precursor RNA, herein designated VGAM PRECURSOR RNA, and of the 'diced' VGAM1823 RNA, herein designated VGAM RNA, and a schematic representation of the secondary folding of VGAM1823 folded precursor RNA, herein designated VGAM FOLDED PRECURSOR RNA, of VGAM1823 are further described hereinbelow with reference to Table 1.

Nucleotide sequences of host target binding sites, such as BINDING SITE-I, BINDING SITE-II and BINDING SITE-III of FIG. 1, found on VGAM1823 host target RNA, and schematic representation of the complementarity of each of these host target binding sites to VGAM1823 RNA, herein designated VGAM RNA, are described hereinbelow with reference to Table 2.

As mentioned hereinabove with reference to FIG. 1, a function of VGAM1823 gene, herein designated VGAM is inhibition of expression of VGAM1823 target genes. It is appreciated that specific functions, and accordingly utilities, of VGAM1823 correlate with, and may be deduced from, the identity of the target genes which VGAM1823 binds and inhibits, and the function of these target genes, as elaborated hereinbelow.

KIAA0547 (Accession NM_014793) is a VGAM1823 host target gene. KIAA0547 BINDING SITE is HOST TARGET binding site found in the 3' untranslated region of mRNA encoded by KIAA0547, corresponding to a HOST TARGET binding site such as BINDING SITE I, BINDING SITE II or BINDING SITE III. Table 2 illustrates the complementarity of the nucleotide sequences of KIAA0547 BINDING SITE, designated SEQ ID:16693, to the nucleotide sequence of VGAM1823 RNA, herein designated VGAM RNA, also designated SEQ ID:4534.

A function of VGAM1823 is therefore inhibition of KIAA0547 (Accession NM_014793). Accordingly, utilities of VGAM1823 include diagnosis, prevention and treatment of diseases and clinical conditions associated with KIAA0547. NDP52 (Accession NM_005831) is another VGAM1823 host target gene. NDP52 BINDING SITE is HOST TARGET binding site found in the 3' untranslated region of mRNA encoded by NDP52, corresponding to a HOST TARGET binding site such as BINDING SITE I, BINDING SITE II or BINDING SITE III. Table 2 illustrates the complementarity of the nucleotide sequences of NDP52 BINDING SITE, designated SEQ ID:12446, to the nucleotide sequence of VGAM1823 RNA, herein designated VGAM RNA, also designated SEQ ID:4534.

Another function of VGAM1823 is therefore inhibition of NDP52 (Accession NM_005831). Accordingly, utilities of VGAM1823 include diagnosis, prevention and treatment of diseases and clinical conditions associated with NDP52. Oxysterol Binding Protein-like 2 (OSBPL2, Accession NM_014835) is another VGAM1823 host target gene. OSBPL2 BINDING SITE1 and OSBPL2 BINDING SITE2 are HOST TARGET binding sites found in untranslated regions of mRNA encoded by OSBPL2, corresponding to HOST TARGET binding sites such as BINDING SITE I, BINDING SITE II or BINDING SITE III. Table 2 illustrates the complementarity of the nucleotide sequences of OSBPL2 BINDING SITE1 and OSBPL2 BINDING SITE2, designated SEQ ID:16847 and SEQ ID:29315 respectively, to the nucleotide sequence of VGAM1823 RNA, herein designated VGAM RNA, also designated SEQ ID:4534.

Another function of VGAM1823 is therefore inhibition of Oxysterol Binding Protein-like 2 (OSBPL2, Accession NM_014835). Accordingly, utilities of VGAM1823 include diagnosis, prevention and treatment of diseases and clinical conditions associated with OSBPL2. LOC197358 (Accession XM_113872) is another VGAM1823 host target gene. LOC197358 BINDING SITE is HOST TARGET binding site found in the 3' untranslated region of mRNA encoded by LOC197358, corresponding to a HOST TARGET binding site such as BINDING SITE I, BINDING SITE II or BIND- ING SITE III. Table 2 illustrates the complementarity of the nucleotide sequences of LOC197358 BINDING SITE, designated SEQ ID:42509, to the nucleotide sequence of VGAM1823 RNA, herein designated VGAM RNA, also designated SEQ ID:4534.

Another function of VGAM1823 is therefore inhibition of LOC197358 (Accession XM_113872). Accordingly, utilities of VGAM1823 include diagnosis, prevention and treatment of diseases and clinical conditions associated with LOC197358. LOC200317 (Accession XM_114208) is another VGAM1823 host target gene. LOC200317 BINDING SITE is HOST TARGET binding site found in the 3' untranslated region of mRNA encoded by LOC200317, corresponding to a HOST TARGET binding site such as BINDING SITE I, BINDING SITE II or BINDING SITE III. Table 2 illustrates the complementarity of the nucleotide sequences of LOC200317 BINDING SITE, designated SEQ ID:42803, to the nucleotide sequence of VGAM1823 RNA, herein designated VGAM RNA, also designated SEQ ID:4534.

Another function of VGAM1823 is therefore inhibition of LOC200317 (Accession XM_114208). Accordingly, utilities of VGAM1823 include diagnosis, prevention and treatment of diseases and clinical conditions associated with LOC200317. FIG. 1 further provides a conceptual description of a novel bioinformatically detected viral gene of the present invention, referred to here as Viral Genomic Address Messenger 1824 (VGAM1824) viral gene, which modulates expression of respective host target genes thereof, the function and utility of which host target genes is known in the art.

VGAM1824 is a novel bioinformatically detected regulatory, non protein coding, viral micro RNA (miRNA) gene. The method by which VGAM1824 was detected is described hereinabove with reference to FIGS. 1-8.

VGAM1824 gene, herein designated VGAM GENE, is a viral gene contained in the genome of Cryphonectria Hypovirus. VGAM1824 host target gene, herein designated VGAM HOST TARGET GENE, is a human gene contained in the human genome.

VGAM1824 gene encodes a VGAM1824 precursor RNA, herein designated VGAM PRECURSOR RNA. Similar to other miRNA genes, and unlike most ordinary genes, VGAM1824 precursor RNA does not encode a protein. A nucleotide sequence identical or highly similar to the nucleotide sequence of VGAM1824 precursor RNA is designated SEQ ID:1810, and is provided hereinbelow with reference to the sequence listing part. Nucleotide sequence SEQ ID:1810 is located at position 3901 relative to the genome of Cryphonectria Hypovirus.

VGAM1824 precursor RNA folds onto itself, forming VGAM1824 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1824 folded precursor RNA into VGAM1824 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM1824 RNA is designated SEQ ID:4535, and is provided hereinbelow with reference to the sequence listing part.

VGAM1824 host target gene, herein designated VGAM HOST TARGET GENE, encodes a corresponding messenger RNA, VGAM1824 host target RNA, herein designated VGAM HOST TARGET RNA. VGAM1824 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1824 RNA, herein designated VGAM RNA, binds complementarily to one or more host target binding sites located in untranslated regions of VGAM1824 host target RNA, herein designated VGAM HOST TARGET RNA. This complementary binding is due to the fact that the nucleotide sequence of VGAM1824 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1824 RNA, herein designated VGAM RNA, may have a different number of host target binding sites in untranslated regions of a VGAM1824 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1824 RNA, herein designated VGAM RNA, to host target binding sites on VGAM1824 host target RNA, herein designated VGAM HOST TARGET RNA, such as BINDING SITE I, BINDING SITE II and BINDING SITE III, inhibits translation of VGAM1824 host target RNA into VGAM1824 host target protein, herein designated VGAM HOST TARGET PROTEIN. VGAM host target protein is therefore outlined by a broken line.

It is appreciated that VGAM1824 host target gene, herein designated VGAM HOST TARGET GENE, in fact represents a plurality of VGAM1824 host target genes. The mRNA of each one of this plurality of VGAM1824 host target genes comprises one or more host target binding sites, each having a nucleotide sequence which is at least partly complementary to VGAM1824 RNA, herein designated VGAM RNA, and which when bound by VGAM1824 RNA causes inhibition of translation of respective one or more VGAM1824 host target proteins.

It is further appreciated by one skilled in the art that the mode of translational inhibition illustrated by FIG. 1 with specific reference to translational inhibition exerted by VGAM1824 gene, herein designated VGAM GENE, on one or more VGAM1824 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1824 is inhibition of expression of host target genes, as part of a novel viral mechanism of attacking a host. Accordingly, utilities of VGAM1824 include diagnosis, prevention and treatment of viral infection by Cryphonectria Hypovirus. Specific functions, and accordingly utilities, of VGAM1824 correlate with, and may be deduced from, the identity of the host target genes which VGAM1824 binds and inhibits, and the function of these host target genes, as elaborated hereinbelow.

Nucleotide sequences of the VGAM1824 precursor RNA, herein designated VGAM PRECURSOR RNA, and of the 'diced' VGAM1824 RNA, herein designated VGAM RNA, and a schematic representation of the secondary folding of VGAM1824 folded precursor RNA, herein designated VGAM FOLDED PRECURSOR RNA, of VGAM1824 are further described hereinbelow with reference to Table 1.

Nucleotide sequences of host target binding sites, such as BINDING SITE-I, BINDING SITE-II and BINDING SITE-III of FIG. 1, found on VGAM1824 host target RNA, and schematic representation of the complementarity of each of these host target binding sites to VGAM1824 RNA, herein designated VGAM RNA, are described hereinbelow with reference to Table 2.

As mentioned hereinabove with reference to FIG. 1, a function of VGAM1824 gene, herein designated VGAM is inhibition of expression of VGAM1824 target genes. It is appreciated that specific functions, and accordingly utilities, of VGAM1824 correlate with, and may be deduced from, the identity of the target genes which VGAM1824 binds and inhibits, and the function of these target genes, as elaborated hereinbelow.

FLJ21032 (Accession NM_024906) is a VGAM1824 host target gene. FLJ21032 BINDING SITE is HOST TARGET binding site found in the 5' untranslated region of mRNA encoded by FLJ21032, corresponding to a HOST TARGET binding site such as BINDING SITE I, BINDING SITE II or BINDING SITE III. Table 2 illustrates the complementarity of the nucleotide sequences of FLJ21032 BINDING SITE, designated SEQ ID:24395, to the nucleotide sequence of VGAM1824 RNA, herein designated VGAM RNA, also designated SEQ ID:4535.

A function of VGAM1824 is therefore inhibition of FLJ21032 (Accession NM_024906). Accordingly, utilities of VGAM1824 include diagnosis, prevention and treatment of diseases and clinical conditions associated with FLJ21032. KIAA0258 (Accession NM_014785) is another VGAM1824 host target gene. KIAA0258 BINDING SITE is HOST TARGET binding site found in the 3' untranslated region of mRNA encoded by KIAA0258, corresponding to a HOST TARGET binding site such as BINDING SITE I, BINDING SITE II or BINDING SITE III. Table 2 illustrates the complementarity of the nucleotide sequences of KIAA0258 BINDING SITE, designated SEQ ID:16642, to the nucleotide sequence of VGAM1824 RNA, herein designated VGAM RNA, also designated SEQ ID:4535.

Another function of VGAM1824 is therefore inhibition of KIAA0258 (Accession NM_014785). Accordingly, utilities of VGAM1824 include diagnosis, prevention and treatment of diseases and clinical conditions associated with KIAA0258. FIG. 1 further provides a conceptual description of a novel bioinformatically detected viral gene of the present invention, referred to here as Viral Genomic Address Messenger 1825 (VGAM1825) viral gene, which modulates expression of respective host target genes thereof, the function and utility of which host target genes is known in the art.

VGAM1825 is a novel bioinformatically detected regulatory, non protein coding, viral micro RNA (miRNA) gene. The method by which VGAM1825 was detected is described hereinabove with reference to FIGS. 1-8.

VGAM1825 gene, herein designated VGAM GENE, is a viral gene contained in the genome of Vaccinia Virus. VGAM1825 host target gene, herein designated VGAM HOST TARGET GENE, is a human gene contained in the human genome.

VGAM1825 gene encodes a VGAM1825 precursor RNA, herein designated VGAM PRECURSOR RNA. Similar to other miRNA genes, and unlike most ordinary genes, VGAM1825 precursor RNA does not encode a protein. A nucleotide sequence identical or highly similar to the nucleotide sequence of VGAM1825 precursor RNA is designated SEQ ID:1811, and is provided hereinbelow with reference to the sequence listing part. Nucleotide sequence SEQ ID:1811 is located at position 34526 relative to the genome of Vaccinia Virus.

VGAM1825 precursor RNA folds onto itself, forming VGAM1825 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1825 folded precursor RNA into VGAM1825 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM1825 RNA is designated SEQ ID:4536, and is provided hereinbelow with reference to the sequence listing part.

VGAM1825 host target gene, herein designated VGAM HOST TARGET GENE, encodes a corresponding messenger RNA, VGAM1825 host target RNA, herein designated VGAM HOST TARGET RNA. VGAM1825 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1825 RNA, herein designated VGAM RNA, binds complementarily to one or more host target binding sites located in untranslated regions of VGAM1825 host target RNA, herein designated VGAM HOST TARGET RNA. This complementary binding is due to the fact that the nucleotide sequence of VGAM1825 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1825 RNA, herein designated VGAM RNA, may have a different number of host target binding sites in untranslated regions of a VGAM1825 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1825 RNA, herein designated VGAM RNA, to host target binding sites on VGAM1825 host target RNA, herein designated VGAM HOST TARGET RNA, such as BINDING SITE I, BINDING SITE II and BINDING SITE III, inhibits translation of VGAM1825 host target RNA into VGAM1825 host target protein, herein designated VGAM HOST TARGET PROTEIN. VGAM host target protein is therefore outlined by a broken line.

It is appreciated that VGAM1825 host target gene, herein designated VGAM HOST TARGET GENE, in fact represents a plurality of VGAM1825 host target genes. The mRNA of each one of this plurality of VGAM1825 host target genes comprises one or more host target binding sites, each having a nucleotide sequence which is at least partly complementary to VGAM1825 RNA, herein designated VGAM RNA, and which when bound by VGAM1825 RNA causes inhibition of translation of respective one or more VGAM1825 host target proteins.

It is further appreciated by one skilled in the art that the mode of translational inhibition illustrated by FIG. 1 with specific reference to translational inhibition exerted by VGAM1825 gene, herein designated VGAM GENE, on one or more VGAM1825 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1825 is inhibition of expression of host target genes, as part of a novel viral mechanism of attacking a host. Accordingly, utilities of VGAM1825 include diagnosis, prevention and treatment of viral infection by Vaccinia Virus. Specific functions, and accordingly utilities, of VGAM1825 correlate with, and may be deduced from, the identity of the host target genes which VGAM1825 binds and inhibits, and the function of these host target genes, as elaborated hereinbelow.

Nucleotide sequences of the VGAM1825 precursor RNA, herein designated VGAM PRECURSOR RNA, and of the 'diced' VGAM1825 RNA, herein designated VGAM RNA, and a schematic representation of the secondary folding of VGAM1825 folded precursor RNA, herein designated VGAM FOLDED PRECURSOR RNA, of VGAM1825 are further described hereinbelow with reference to Table 1.

Nucleotide sequences of host target binding sites, such as BINDING SITE-I, BINDING SITE-II and BINDING SITE-III of FIG. 1, found on VGAM1825 host target RNA, and schematic representation of the complementarity of each of these host target binding sites to VGAM1825 RNA, herein designated VGAM RNA, are described hereinbelow with reference to Table 2.

As mentioned hereinabove with reference to FIG. 1, a function of VGAM1825 gene, herein designated VGAM is inhibition of expression of VGAM1825 target genes. It is appreciated that specific functions, and accordingly utilities, of VGAM1825 correlate with, and may be deduced from, the identity of the target genes which VGAM1825 binds and inhibits, and the function of these target genes, as elaborated hereinbelow.

RAS P21 Protein Activator (GTPase activating protein) 1 (RASA1, Accession NM_022650) is a VGAM1825 host target gene. RASA1 BINDING SITE is HOST TARGET binding site found in the 3' untranslated region of mRNA encoded by RASA1, corresponding to a HOST TARGET binding site such as BINDING SITE I, BINDING SITE II or BINDING SITE III. Table 2 illustrates the complementarity of the nucleotide sequences of RASA1 BINDING SITE, designated SEQ ID:22907, to the nucleotide sequence of VGAM1825 RNA, herein designated VGAM RNA, also designated SEQ ID:4536.

A function of VGAM1825 is therefore inhibition of RAS P21 Protein Activator (GTPase activating protein) 1 (RASA1, Accession NM_022650), a gene which is involved in the control of cellular proliferation and differentiation. Accordingly, utilities of VGAM1825 include diagnosis, prevention and treatment of diseases and clinical conditions associated with RASA1. The function of RASA1 and its association with various diseases and clinical conditions, has been established by previous studies, as described hereinabove with reference to VGAM464. Selenoprotein P, Plasma, 1 (SEPP1, Accession NM_005410) is another VGAM1825 host target gene. SEPP1 BINDING SITE1 and SEPP1 BINDING SITE2 are HOST TARGET binding sites found in untranslated regions of mRNA encoded by SEPP1, corresponding to HOST TARGET binding sites such as BINDING SITE I, BINDING SITE II or BINDING SITE III. Table 2 illustrates the complementarity of the nucleotide sequences of SEPP1 BINDING SITE1 and SEPP1 BINDING SITE2, designated SEQ ID:11878 and SEQ ID:30185 respectively, to the nucleotide sequence of VGAM1825 RNA, herein designated VGAM RNA, also designated SEQ ID:4536.

Another function of VGAM1825 is therefore inhibition of Selenoprotein P, Plasma, 1 (SEPP1, Accession NM_005410), a gene which might be responsible for some of the extracellular antioxidant defense properties of selenium or might be involved in the transport of selenium. Accordingly, utilities of VGAM1825 include diagnosis, prevention and treatment of diseases and clinical conditions associated with SEPP1. The function of SEPP1 has been established by previous studies. Selenium is an essential trace element that is incorporated as selenocysteine into the primary structure of selenoproteins. There are at least 10 animal selenoproteins. Nutritional deficiency of selenium decreases selenoprotein concentrations and leads to pathologic conditions. Human populations that are selenium deficient are susceptible to the development of Keshan disease, a cardiomyopathy of children reported in selenium-deficient areas of China (Keshan Disease Research Group of the Chinese Academy of Medical Sciences, 1979). Hill et al. (1996) cited animal studies that have demonstrated roles for selenium in oxidant defense, thyroid hormone metabolism, and defense against viral infections. Selenoproteins presumably mediate these biologic effects. Human selenoproteins include glutathione peroxidase-1 (OMIM Ref. No. 138320), thioredoxin reductase (OMIM Ref. No. 601112), glutathione peroxidase-2 (OMIM Ref. No. 138319), glutathione peroxidase-3 (OMIM Ref. No. 138321), thyroxine deiodinase type 1 (OMIM Ref. No. 147892), and mitochondrial capsule selenoprotein (OMIM Ref. No. 601148). Most of the known selenoproteins are members of the glutathione peroxidase or iodothyronine deiodinase families. Hill et al. (1996) stated that selenoprotein P (SEPP1) is a major selenoprotein that is not a member of those families. It is an extracellular glycoprotein that is present in several isoforms and is the only selenoprotein known to contain multiple selenocysteine residues (Hill et al., 1993). It is a heparin-binding protein that appears to be associated with endothelial cells and has been implicated as an oxidant defense in the extracellular space. Hill et al. (1993) cloned human selenoprotein P from a liver cDNA library. The human open reading frame is 69% identical to that of rat selenoprotein P and the predicted proteins share 72% amino acid identity. Hill et al. (1996) mapped the SEPP1 gene to chromosome 5 by Southern analysis of 2 somatic cell hybrid DNA panels using as a probe their liver cDNA library clone. They narrowed the assignment to 5q31 by fluorescence in situ hybridization. Only 1 SEPP1 locus was detected. Although there is evidence of several isoforms of the protein, all of them share the same N-terminal sequence and therefore are likely products of the same gene (Chittum et al., 1996). Hill et al. (1996) commented that limb-girdle muscular dystrophy type 1A(LGMD1A; 159000) maps to the distal portion of 5q. They noted that since selenium deficiency is associated with nutritional muscular dystrophies in several species, it might be of interest to evaluate SEPP1 in that form of muscular dystrophy. Acute nonlymphocytic leukemia and the myelodysplastic syndrome are associated with deletions of a critical region of 5q.

Full details of the abovementioned studies are described in the following publications, the disclosure of which are hereby incorporated by reference:

Hill, K. E.; Dasouki, M.; Phillips, J. A., III; Burk, R. F.: Human selenoprotein P gene maps to 5q31. Genomics 36:550-551, 1996; and Hill, K. E.; Lloyd, R. S.; Burk, R. F.: Conserved nucleotide sequences in the open reading frame and 3-prime untranslated region of selenoprotein P mRNA. Proc. Nat. Acad. Sci. 90:537-5.

Further studies establishing the function and utilities of SEPP1 are found in John Hopkins OMIM database record ID 601484, and in sited publications numbered 7028-6830 listed in the bibliography section hereinbelow, which are also hereby incorporated by reference. Fatty Acid Desaturase 1 (FADS1, Accession NM_013402) is another VGAM1825 host target gene. FADS1 BINDING SITE is HOST TARGET binding site found in the 3' untranslated region of mRNA encoded by FADS1, corresponding to a HOST TARGET binding site such as BINDING SITE I, BINDING SITE II or BINDING SITE III. Table 2 illustrates the complementarity of the nucleotide sequences of FADS1 BINDING SITE, designated SEQ ID:15067, to the nucleotide sequence of VGAM1825 RNA, herein designated VGAM RNA, also designated SEQ ID:4536.

Another function of VGAM1825 is therefore inhibition of Fatty Acid Desaturase 1 (FADS1, Accession NM_013402). Accordingly, utilities of VGAM1825 include diagnosis, prevention and treatment of diseases and clinical conditions associated with FADS1. GENX-3414 (Accession NM_003943) is another VGAM1825 host target gene. GENX-3414 BINDING SITE is HOST TARGET binding site found in the 3' untranslated region of mRNA encoded by GENX-3414, corresponding to a HOST TARGET binding site such as BINDING SITE I, BINDING SITE II or BINDING SITE III. Table 2 illustrates the complementarity of the nucleotide sequences of GENX-3414 BINDING SITE, designated SEQ ID:10059, to the nucleotide sequence of VGAM1825 RNA, herein designated VGAM RNA, also designated SEQ ID:4536.

Another function of VGAM1825 is therefore inhibition of GENX-3414 (Accession NM_003943). Accordingly, utilities of VGAM1825 include diagnosis, prevention and treatment of diseases and clinical conditions associated with GENX-3414. MGC3048 (Accession NM_024052) is another VGAM1825 host target gene. MGC3048 BINDING SITE is HOST TARGET binding site found in the 3' untranslated region of mRNA encoded by MGC3048, corresponding to a HOST TARGET binding site such as BINDING SITE I, BINDING SITE II or BINDING SITE III. Table 2 illustrates the complementarity of the nucleotide sequences of MGC3048 BINDING SITE, designated SEQ ID:23488, to the nucleotide sequence of VGAM1825 RNA, herein designated VGAM RNA, also designated SEQ ID:4536.

Another function of VGAM1825 is therefore inhibition of MGC3048 (Accession NM_024052). Accordingly, utilities of VGAM1825 include diagnosis, prevention and treatment of diseases and clinical conditions associated with MGC3048. YME1-like 1 (S. cerevisiae) (YME1L1, Accession NM_139312) is another VGAM1825 host target gene. YME1L1 BINDING SITE1 and YME1L1 BINDING SITE2 are HOST TARGET binding sites found in untranslated regions of mRNA encoded by YME1L1, corresponding to HOST TARGET binding sites such as BINDING SITE I, BINDING SITE II or BINDING SITE III. Table 2 illustrates the complementarity of the nucleotide sequences of YME1L1 BINDING SITE1 and YME1L1 BINDING SITE2, designated SEQ ID:29293 and SEQ ID:15537 respectively, to the nucleotide sequence of VGAM1825 RNA, herein designated VGAM RNA, also designated SEQ ID:4536.

Another function of VGAM1825 is therefore inhibition of YME1-like 1 (S. cerevisiae) (YME1L1, Accession NM_139312). Accordingly, utilities of VGAM1825 include diagnosis, prevention and treatment of diseases and clinical conditions associated with YME1L1. FIG. 1 further provides a conceptual description of a novel bioinformatically detected viral gene of the present invention, referred to here as Viral Genomic Address Messenger 1826 (VGAM1826) viral gene, which modulates expression of respective host target genes thereof, the function and utility of which host target genes is known in the art.

VGAM1826 is a novel bioinformatically detected regulatory, non protein coding, viral micro RNA (miRNA) gene. The method by which VGAM1826 was detected is described hereinabove with reference to FIGS. 1-8.

VGAM1826 gene, herein designated VGAM GENE, is a viral gene contained in the genome of Variola Virus. VGAM1826 host target gene, herein designated VGAM HOST TARGET GENE, is a human gene contained in the human genome.

VGAM1826 gene encodes a VGAM1826 precursor RNA, herein designated VGAM PRECURSOR RNA. Similar to other miRNA genes, and unlike most ordinary genes, VGAM1826 precursor RNA does not encode a protein. A nucleotide sequence identical or highly similar to the nucleotide sequence of VGAM1826 precursor RNA is designated SEQ ID:1812, and is provided hereinbelow with reference to the sequence listing part. Nucleotide sequence SEQ ID:1812 is located at position 29285 relative to the genome of Variola Virus.

VGAM1826 precursor RNA folds onto itself, forming VGAM1826 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1826 folded precursor RNA into VGAM1826 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1826 RNA is designated SEQ ID:4537, and is provided hereinbelow with reference to the sequence listing part.

VGAM1826 host target gene, herein designated VGAM HOST TARGET GENE, encodes a corresponding messenger RNA, VGAM1826 host target RNA, herein designated VGAM HOST TARGET RNA. VGAM1826 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1826 RNA, herein designated VGAM RNA, binds complementarily to one or more host target binding sites located in untranslated regions of VGAM1826 host target RNA, herein designated VGAM HOST TARGET RNA. This complementary binding is due to the fact that the nucleotide sequence of VGAM1826 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1826 RNA, herein designated VGAM RNA, may have a different number of host target binding sites in untranslated regions of a VGAM1826 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1826 RNA, herein designated VGAM RNA, to host target binding sites on VGAM1826 host target RNA, herein designated VGAM HOST TARGET RNA, such as BINDING SITE I, BINDING SITE II and BINDING SITE III, inhibits translation of VGAM1826 host target RNA into VGAM1826 host target protein, herein designated VGAM HOST TARGET PROTEIN. VGAM host target protein is therefore outlined by a broken line.

It is appreciated that VGAM1826 host target gene, herein designated VGAM HOST TARGET GENE, in fact represents a plurality of VGAM1826 host target genes. The mRNA of each one of this plurality of VGAM1826 host target genes comprises one or more host target binding sites, each having a nucleotide sequence which is at least partly complementary to VGAM1826 RNA, herein designated VGAM RNA, and which when bound by VGAM1826 RNA causes inhibition of translation of respective one or more VGAM1826 host target proteins.

It is further appreciated by one skilled in the art that the mode of translational inhibition illustrated by FIG. 1 with specific reference to translational inhibition exerted by VGAM1826 gene, herein designated VGAM GENE, on one or more VGAM1826 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1826 is inhibition of expression of host target genes, as part of a novel viral mechanism of attacking a host. Accordingly, utilities of VGAM1826 include diagnosis, prevention and treatment of viral infection by Variola Virus. Specific functions, and accordingly utilities, of VGAM1826 correlate with, and may be deduced from, the identity of the host target genes which VGAM1826 binds and inhibits, and the function of these host target genes, as elaborated hereinbelow.

Nucleotide sequences of the VGAM1826 precursor RNA, herein designated VGAM PRECURSOR RNA, and of the 'diced' VGAM1826 RNA, herein designated VGAM RNA, and a schematic representation of the secondary folding of VGAM1826 folded precursor RNA, herein designated VGAM FOLDED PRECURSOR RNA, of VGAM1826 are further described hereinbelow with reference to Table 1.

Nucleotide sequences of host target binding sites, such as BINDING SITE-I, BINDING SITE-II and BINDING SITE-III of FIG. 1, found on VGAM1826 host target RNA, and schematic representation of the complementarity of each of these host target binding sites to VGAM1826 RNA, herein designated VGAM RNA, are described hereinbelow with reference to Table 2.

As mentioned hereinabove with reference to FIG. 1, a function of VGAM1826 gene, herein designated VGAM is inhibition of expression of VGAM1826 target genes. It is appreciated that specific functions, and accordingly utilities, of VGAM1826 correlate with, and may be deduced from, the identity of the target genes which VGAM1826 binds and inhibits, and the function of these target genes, as elaborated hereinbelow.

Cyclin D2 (CCND2, Accession NM_001759) is a VGAM1826 host target gene. CCND2 BINDING SITE is HOST TARGET binding site found in the 3' untranslated region of mRNA encoded by CCND2, corresponding to a HOST TARGET binding site such as BINDING SITE I, BINDING SITE II or BINDING SITE III. Table 2 illustrates the complementarity of the nucleotide sequences of CCND2 BINDING SITE, designated SEQ ID:7512, to the nucleotide sequence of VGAM1826 RNA, herein designated VGAM RNA, also designated SEQ ID:4537.

A function of VGAM1826 is therefore inhibition of Cyclin D2 (CCND2, Accession NM_001759), a gene which is essential for the control of the cell cycle at the g1/s (start) transition. Accordingly, utilities of VGAM1826 include diagnosis, prevention and treatment of diseases and clinical conditions associated with CCND2. The function of CCND2 and its association with various diseases and clinical conditions, has been established by previous studies, as described hereinabove with reference to VGAM128. Hyaluronan Synthase 2 (HAS2, Accession NM_005328) is another VGAM1826 host target gene. HAS2 BINDING SITE is HOST TARGET binding site found in the 3' untranslated region of mRNA encoded by HAS2, corresponding to a HOST TARGET binding site such as BINDING SITE I, BINDING SITE II or BINDING SITE III. Table 2 illustrates the complementarity of the nucleotide sequences of HAS2 BINDING SITE, designated SEQ ID:11801, to the nucleotide sequence of VGAM1826 RNA, herein designated VGAM RNA, also designated SEQ ID:4537.

Another function of VGAM1826 is therefore inhibition of Hyaluronan Synthase 2 (HAS2, Accession NM_005328), a gene which plays a role in hyaluronan/hyaluronic acid (ha)

synthesis and transport. Accordingly, utilities of VGAM1826 include diagnosis, prevention and treatment of diseases and clinical conditions associated with HAS2. The function of HAS2 and its association with various diseases and clinical conditions, has been established by previous studies, as described hereinabove with reference to VGAM874. Integrin, Beta-like 1 (with EGF-like repeat domains) (ITGBL1, Accession NM_004791) is another VGAM1826 host target gene. ITGBL1 BINDING SITE is HOST TARGET binding site found in the 3' untranslated region of mRNA encoded by ITGBL1, corresponding to a HOST TARGET binding site such as BINDING SITE I, BINDING SITE II or BINDING SITE III. Table 2 illustrates the complementarity of the nucleotide sequences of ITGBL1 BINDING SITE, designated SEQ ID:11201, to the nucleotide sequence of VGAM1826 RNA, herein designated VGAM RNA, also designated SEQ ID:4537.

Another function of VGAM1826 is therefore inhibition of Integrin, Beta-like 1 (with EGF-like repeat domains) (ITGBL1, Accession NM_004791). Accordingly, utilities of VGAM1826 include diagnosis, prevention and treatment of diseases and clinical conditions associated with ITGBL1. Neurofilament, Heavy Polypeptide 200 kDa (NEFH, Accession NM_021076) is another VGAM1826 host target gene. NEFH BINDING SITE is HOST TARGET binding site found in the 3' untranslated region of mRNA encoded by NEFH, corresponding to a HOST TARGET binding site such as BINDING SITE I, BINDING SITE II or BINDING SITE III. Table 2 illustrates the complementarity of the nucleotide sequences of NEFH BINDING SITE, designated SEQ ID:22046, to the nucleotide sequence of VGAM1826 RNA, herein designated VGAM RNA, also designated SEQ ID:4537.

Another function of VGAM1826 is therefore inhibition of Neurofilament, Heavy Polypeptide 200 kDa (NEFH, Accession NM_021076), a gene which is involved in the maintenance of neuronal caliber and in mature axons. Accordingly, utilities of VGAM1826 include diagnosis, prevention and treatment of diseases and clinical conditions associated with NEFH. The function of NEFH has been established by previous studies. See 162280. Mattei et al. (1988) used a rat cDNA probe coding for the C-terminal extension of the NFH gene to assign, by in situ hybridization, the human NFH gene to 22q12.1-q13.1. The possible implications of the fact that neurologic disorders such as meningioma map to this region were discussed. In the course of cloning the region between 2 markers, D22S212 and D22S32, that flank the NF2 (OMIM Ref. No. 101000) gene, Rouleau et al. (1993) identified a gene with a neuronal pattern of expression and a transcript size identical to that of NEFH. Use of NEFH cDNA confirmed the identity. There is compelling evidence that the NEFH locus is close to the NF2 locus. For example, Watson et al. (1993) found that the NEFH locus was hemizygous in a deletion that was observed in affected members of a family with NF2 and was estimated to be about 700 kb long. The NF2 locus has been positioned at 22q12.2. Bucan et al. (1993) mapped the homologous murine gene, which they symbolized Nfh, to chromosome 11. The tail of the heavy neurofilament subunit is composed of the repeating amino acid motif, usually X-lysine-serine-proline-Y-lysine (OMIM Ref. No. XKSPYK), where X is a single amino acid and Y is 1 to 3 amino acids. There are 2 common polymorphic variants of 44 and 45 repeats. The tail probably regulates axonal caliber, with interfilament spacing determined by phosphorylation of the KSP motifs. According to Al-Chalabi et al. (1999), the polymorphic variants had been mislabeled in the published literature as 44 and 43 repeat variants, respectively, and therefore were referred to by them simply as long (L) and short (S) alleles.

Full details of the abovementioned studies are described in the following publications, the disclosure of which are hereby incorporated by reference:

Al-Chalabi, A.; Andersen, P. M.; Nilsson, P.; Chioza, B.; Andersson, J. L.; Russ, C.; Shaw, C. E.; Powell, J. F.; Leigh, P. N.: Deletions of the heavy neurofilament subunit tail in amyotrophic lateral sclerosis. Hum. Molec. Genet. 8:157-164, 1999; and Watson, C. J.; Gaunt, L.; Evans, G.; Patel, K.; Harris, R.; Strachan, T.: A disease-associated germline deletion maps the type 2 neurofibromatosis (NF2) gene between the Ewing sarcoma.

Further studies establishing the function and utilities of NEFH are found in John Hopkins OMIM database record ID 162230, and in sited publications numbered 1029 and 10293-10301 listed in the bibliography section hereinbelow, which are also hereby incorporated by reference. Chromosome 22 Open Reading Frame 5 (C22orf5, Accession NM_012264) is another VGAM1826 host target gene. C22orf5 BINDING SITE is HOST TARGET binding site found in the 3' untranslated region of mRNA encoded by C22orf5, corresponding to a HOST TARGET binding site such as BINDING SITE I, BINDING SITE II or BINDING SITE III. Table 2 illustrates the complementarity of the nucleotide sequences of C22orf5 BINDING SITE, designated SEQ ID:14585, to the nucleotide sequence of VGAM1826 RNA, herein designated VGAM RNA, also designated SEQ ID:4537.

Another function of VGAM1826 is therefore inhibition of Chromosome 22 Open Reading Frame 5 (C22orf5, Accession NM_012264). Accordingly, utilities of VGAM1826 include diagnosis, prevention and treatment of diseases and clinical conditions associated with C22orf5. Centaurin, Beta 5 (CENTB5, Accession XM_170937) is another VGAM1826 host target gene. CENTB5 BINDING SITE is HOST TARGET binding site found in the 3' untranslated region of mRNA encoded by CENTB5, corresponding to a HOST TARGET binding site such as BINDING SITE I, BINDING SITE II or BINDING SITE III. Table 2 illustrates the complementarity of the nucleotide sequences of CENTB5 BINDING SITE, designated SEQ ID:45723, to the nucleotide sequence of VGAM1826 RNA, herein designated VGAM RNA, also designated SEQ ID:4537.

Another function of VGAM1826 is therefore inhibition of Centaurin, Beta 5 (CENTB5, Accession XM_170937). Accordingly, utilities of VGAM1826 include diagnosis, prevention and treatment of diseases and clinical conditions associated with CENTB5. FLJ00026 (Accession XM_036307) is another VGAM1826 host target gene. FLJ00026 BINDING SITE is HOST TARGET binding site found in the 5' untranslated region of mRNA encoded by FLJ00026, corresponding to a HOST TARGET binding site such as BINDING SITE I, BINDING SITE II or BINDING SITE III. Table 2 illustrates the complementarity of the nucleotide sequences of FLJ00026 BINDING SITE, designated SEQ ID:32427, to the nucleotide sequence of VGAM1826 RNA, herein designated VGAM RNA, also designated SEQ ID:4537.

Another function of VGAM1826 is therefore inhibition of FLJ00026 (Accession XM_036307). Accordingly, utilities of VGAM1826 include diagnosis, prevention and treatment of diseases and clinical conditions associated with FLJ00026. FLJ10718 (Accession NM_018192) is another VGAM1826 host target gene. FLJ10718 BINDING SITE is HOST TARGET binding site found in the 3' untranslated region of mRNA encoded by FLJ10718, corresponding to a HOST TARGET binding site such as BINDING SITE I, BINDING SITE II or BINDING SITE III. Table 2 illustrates the complementarity of the nucleotide sequences of FLJ10718 BINDING SITE, designated SEQ ID:20048, to the nucleotide sequence of VGAM1826 RNA, herein designated VGAM RNA, also designated SEQ ID:4537.

Another function of VGAM1826 is therefore inhibition of FLJ10718 (Accession NM_018192). Accordingly, utilities of VGAM1826 include diagnosis, prevention and treatment of diseases and clinical conditions associated with FLJ10718. FLJ10743 (Accession NM_018201) is another VGAM1826 host target gene. FLJ10743 BINDING SITE is HOST TARGET binding site found in the 3' untranslated region of mRNA encoded by FLJ10743, corresponding to a HOST TARGET binding site such as BINDING SITE I, BINDING SITE II or BINDING SITE III. Table 2 illustrates the complementarity of the nucleotide sequences of FLJ10743 BINDING SITE, designated SEQ ID:20081, to the nucleotide sequence of VGAM1826 RNA, herein designated VGAM RNA, also designated SEQ ID:4537.

Another function of VGAM1826 is therefore inhibition of FLJ10743 (Accession NM_018201). Accordingly, utilities of VGAM1826 include diagnosis, prevention and treatment of diseases and clinical conditions associated with FLJ10743. FLJ14260 (Accession NM_025027) is another VGAM1826 host target gene. FLJ14260 BINDING SITE is HOST TARGET binding site found in the 5' untranslated region of mRNA encoded by FLJ14260, corresponding to a HOST TARGET binding site such as BINDING SITE I, BINDING SITE II or BINDING SITE III. Table 2 illustrates the complementarity of the nucleotide sequences of FLJ14260 BINDING SITE, designated SEQ ID:24618, to the nucleotide sequence of VGAM1826 RNA, herein designated VGAM RNA, also designated SEQ ID:4537.

Another function of VGAM1826 is therefore inhibition of FLJ14260 (Accession NM_025027). Accordingly, utilities of VGAM1826 include diagnosis, prevention and treatment of diseases and clinical conditions associated with FLJ14260. FLJ14800 (Accession NM_032840) is another VGAM1826 host target gene. FLJ14800 BINDING SITE is HOST TARGET binding site found in the 3' untranslated region of mRNA encoded by FLJ14800, corresponding to a HOST TARGET binding site such as BINDING SITE I, BINDING SITE II or BINDING SITE III. Table 2 illustrates the complementarity of the nucleotide sequences of FLJ14800 BINDING SITE, designated SEQ ID:26620, to the nucleotide sequence of VGAM1826 RNA, herein designated VGAM RNA, also designated SEQ ID:4537.

Another function of VGAM1826 is therefore inhibition of FLJ14800 (Accession NM_032840). Accordingly, utilities of VGAM1826 include diagnosis, prevention and treatment of diseases and clinical conditions associated with FLJ14800. FLJ14810 (Accession NM_032843) is another VGAM1826 host target gene. FLJ14810 BINDING SITE is HOST TARGET binding site found in the 3' untranslated region of mRNA encoded by FLJ14810, corresponding to a HOST TARGET binding site such as BINDING SITE I, BINDING SITE II or BINDING SITE III. Table 2 illustrates the complementarity of the nucleotide sequences of FLJ14810 BINDING SITE, designated SEQ ID:26631, to the nucleotide sequence of VGAM1826 RNA, herein designated VGAM RNA, also designated SEQ ID:4537.

Another function of VGAM1826 is therefore inhibition of FLJ14810 (Accession NM_032843). Accordingly, utilities of VGAM1826 include diagnosis, prevention and treatment of diseases and clinical conditions associated with FLJ14810. FLJ20079 (Accession NM_017656) is another VGAM1826 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19172, to the nucleotide sequence of VGAM1826 RNA, herein designated VGAM RNA, also designated SEQ ID:4537.

Another function of VGAM1826 is therefore inhibition of FLJ20079 (Accession NM_017656). Accordingly, utilities of VGAM1826 include diagnosis, prevention and treatment of diseases and clinical conditions associated with FLJ20079. FLJ30294 (Accession NM_144632) is another VGAM1826 host target gene. FLJ30294 BINDING SITE is HOST TARGET binding site found in the 3' untranslated region of mRNA encoded by FLJ30294, corresponding to a HOST TARGET binding site such as BINDING SITE I, BINDING SITE II or BINDING SITE III. Table 2 illustrates the complementarity of the nucleotide sequences of FLJ30294 BINDING SITE, designated SEQ ID:29449, to the nucleotide sequence of VGAM1826 RNA, herein designated VGAM RNA, also designated SEQ ID:4537.

Another function of VGAM1826 is therefore inhibition of FLJ30294 (Accession NM_144632). Accordingly, utilities of VGAM1826 include diagnosis, prevention and treatment of diseases and clinical conditions associated with FLJ30294. KIAA0430 (Accession NM_019081) is another VGAM1826 host target gene. KIAA0430 BINDING SITE is HOST TARGET binding site found in the 3' untranslated region of mRNA encoded by KIAA0430, corresponding to a HOST TARGET binding site such as BINDING SITE I, BINDING SITE II or BINDING SITE III. Table 2 illustrates the complementarity of the nucleotide sequences of KIAA0430 BINDING SITE, designated SEQ ID:21152, to the nucleotide sequence of VGAM1826 RNA, herein designated VGAM RNA, also designated SEQ ID:4537.

Another function of VGAM1826 is therefore inhibition of KIAA0430 (Accession NM_019081). Accordingly, utilities of VGAM1826 include diagnosis, prevention and treatment of diseases and clinical conditions associated with KIAA0430. KIAA0564 (Accession XM_038664) is another VGAM1826 host target gene. KIAA0564 BINDING SITE is HOST TARGET binding site found in the 3' untranslated region of mRNA encoded by KIAA0564, corresponding to a HOST TARGET binding site such as BINDING SITE I, BINDING SITE II or BINDING SITE III. Table 2 illustrates the complementarity of the nucleotide sequences of KIAA0564 BINDING SITE, designated SEQ ID:32900, to the nucleotide sequence of VGAM1826 RNA, herein designated VGAM RNA, also designated SEQ ID:4537.

Another function of VGAM1826 is therefore inhibition of KIAA0564 (Accession XM_038664). Accordingly, utilities of VGAM1826 include diagnosis, prevention and treatment of diseases and clinical conditions associated with KIAA0564. MGC15882 (Accession NM_032884) is another VGAM1826 host target gene. MGC15882 BINDING SITE is HOST TARGET binding site found in the 5' untranslated region of mRNA encoded by MGC15882, corresponding to a HOST TARGET binding site such as BINDING SITE I, BINDING SITE II or BINDING SITE III. Table 2 illustrates the complementarity of the nucleotide sequences of MGC15882 BINDING SITE, designated SEQ ID:26706, to the nucleotide sequence of VGAM1826 RNA, herein designated VGAM RNA, also designated SEQ ID:4537.

Another function of VGAM1826 is therefore inhibition of MGC15882 (Accession NM_032884). Accordingly, utilities of VGAM1826 include diagnosis, prevention and treatment of diseases and clinical conditions associated with MGC15882. Sema Domain, Immunoglobulin Domain (Ig), Transmembrane Domain (TM) and Short Cytoplasmic Domain, (semaphorin) 4F (SEMA4F, Accession NM_004263) is another VGAM1826 host target gene. SEMA4F BINDING SITE is HOST TARGET binding site found in the 3' untranslated region of mRNA encoded by SEMA4F, corresponding to a HOST TARGET binding site such as BINDING SITE I, BINDING SITE II or BINDING SITE III. Table 2 illustrates the complementarity of the nucleotide sequences of SEMA4F BINDING SITE, designated SEQ ID:10460, to the nucleotide sequence of VGAM1826 RNA, herein designated VGAM RNA, also designated SEQ ID:4537.

Another function of VGAM1826 is therefore inhibition of Sema Domain, Immunoglobulin Domain (Ig), Transmembrane Domain (TM) and Short Cytoplasmic Domain, (semaphorin) 4F (SEMA4F, Accession NM_004263). Accordingly, utilities of VGAM1826 include diagnosis, prevention and treatment of diseases and clinical conditions associated with SEMA4F. Sialyltransferase 4A (beta-galactoside alpha-2,3-sialytransferase) (SIAT4A, Accession NM_003033) is another VGAM1826 host target gene. SIAT4A BINDING SITE is HOST TARGET binding site found in the 3' untranslated region of mRNA encoded by SIAT4A, corresponding to a HOST TARGET binding site such as BINDING SITE I, BINDING SITE II or BINDING SITE III. Table 2 illustrates the complementarity of the nucleotide sequences of SIAT4A BINDING SITE, designated SEQ ID:8978, to the nucleotide sequence of VGAM1826 RNA, herein designated VGAM RNA, also designated SEQ ID:4537.

Another function of VGAM1826 is therefore inhibition of Sialyltransferase 4A (beta-galactoside alpha-2,3-sialytransferase) (SIAT4A, Accession NM_003033). Accordingly, utilities of VGAM1826 include diagnosis, prevention and treatment of diseases and clinical conditions associated with SIAT4A. VEZATIN (Accession NM_017599) is another VGAM1826 host target gene. VEZATIN BINDING SITE is HOST TARGET binding site found in the 3' untranslated region of mRNA encoded by VEZATIN, corresponding to a HOST TARGET binding site such as BINDING SITE I, BINDING SITE II or BINDING SITE III. Table 2 illustrates the complementarity of the nucleotide sequences of VEZATIN BINDING SITE, designated SEQ ID:19068, to the nucleotide sequence of VGAM1826 RNA, herein designated VGAM RNA, also designated SEQ ID:4537.

Another function of VGAM1826 is therefore inhibition of VEZATIN (Accession NM_017599). Accordingly, utilities of VGAM1826 include diagnosis, prevention and treatment of diseases and clinical conditions associated with VEZATIN. LOC120087 (Accession XM_061853) is another VGAM1826 host target gene. LOC120087 BINDING SITE is HOST TARGET binding site found in the 5' untranslated region of mRNA encoded by LOC120087, corresponding to a HOST TARGET binding site such as BINDING SITE I, BINDING SITE II or BINDING SITE III. Table 2 illustrates the complementarity of the nucleotide sequences of LOC120087 BINDING SITE, designated SEQ ID:37208, to the nucleotide sequence of VGAM1826 RNA, herein designated VGAM RNA, also designated SEQ ID:4537.

Another function of VGAM1826 is therefore inhibition of LOC120087 (Accession XM_061853). Accordingly, utilities of VGAM1826 include diagnosis, prevention and treatment of diseases and clinical conditions associated with LOC120087. LOC138128 (Accession XM_070769) is another VGAM1826 host target gene. LOC138128 BINDING SITE is HOST TARGET binding site found in the 5' untranslated region of mRNA encoded by LOC138128, corresponding to a HOST TARGET binding site such as BINDING SITE I, BINDING SITE II or BINDING SITE III. Table 2 illustrates the complementarity of the nucleotide sequences of LOC138128 BINDING SITE, designated SEQ ID:37393, to the nucleotide sequence of VGAM1826 RNA, herein designated VGAM RNA, also designated SEQ ID:4537.

Another function of VGAM1826 is therefore inhibition of LOC138128 (Accession XM_070769). Accordingly, utilities of VGAM1826 include diagnosis, prevention and treatment of diseases and clinical conditions associated with LOC138128. LOC148930 (Accession XM_086369) is another VGAM1826 host target gene. LOC148930 BINDING SITE is HOST TARGET binding site found in the 3' untranslated region of mRNA encoded by LOC148930, corresponding to a HOST TARGET binding site such as BINDING SITE I, BINDING SITE II or BINDING SITE III. Table 2 illustrates the complementarity of the nucleotide sequences of LOC148930 BINDING SITE, designated SEQ ID:38616, to the nucleotide sequence of VGAM1826 RNA, herein designated VGAM RNA, also designated SEQ ID:4537.

Another function of VGAM1826 is therefore inhibition of LOC148930 (Accession XM_086369). Accordingly, utilities of VGAM1826 include diagnosis, prevention and treatment of diseases and clinical conditions associated with LOC148930. LOC150372 (Accession XM_086893) is another VGAM1826 host target gene. LOC150372 BINDING SITE is HOST TARGET binding site found in the 5' untranslated region of mRNA encoded by LOC150372, corresponding to a HOST TARGET binding site such as BINDING SITE I, BINDING SITE II or BINDING SITE III. Table 2 illustrates the complementarity of the nucleotide sequences of LOC150372 BINDING SITE, designated SEQ ID:38936, to the nucleotide sequence of VGAM1826 RNA, herein designated VGAM RNA, also designated SEQ ID:4537.

Another function of VGAM1826 is therefore inhibition of LOC150372 (Accession XM_086893). Accordingly, utilities of VGAM1826 include diagnosis, prevention and treatment of diseases and clinical conditions associated with LOC150372. LOC151877 (Accession XM_098132) is another VGAM1826 host target gene. LOC151877 BINDING SITE is HOST TARGET binding site found in the 3' untranslated region of mRNA encoded by LOC151877, corresponding to a HOST TARGET binding site such as BINDING SITE I, BINDING SITE II or BINDING SITE III. Table 2 illustrates the complementarity of the nucleotide sequences of LOC151877 BINDING SITE, designated SEQ ID:41393, to the nucleotide sequence of VGAM1826 RNA, herein designated VGAM RNA, also designated SEQ ID:4537.

Another function of VGAM1826 is therefore inhibition of LOC151877 (Accession XM_098132). Accordingly, utilities of VGAM1826 include diagnosis, prevention and treatment of diseases and clinical conditions associated with LOC151877. LOC154761 (Accession XM_088038) is another VGAM1826 host target gene. LOC154761 BINDING SITE is HOST TARGET binding site found in the 3' untranslated region of mRNA encoded by LOC154761, corresponding to a HOST TARGET binding site such as BINDING SITE I, BINDING SITE II or BINDING SITE III. Table 2 illustrates the complementarity of the nucleotide sequences of LOC154761 BINDING SITE, designated SEQ ID:39483, to the nucleotide sequence of VGAM1826 RNA, herein designated VGAM RNA, also designated SEQ ID:4537.

Another function of VGAM1826 is therefore inhibition of LOC154761 (Accession XM_088038). Accordingly, utilities of VGAM1826 include diagnosis, prevention and treatment of diseases and clinical conditions associated with LOC154761. LOC163882 (Accession XM_089211) is another VGAM1826 host target gene. LOC163882 BINDING SITE is HOST TARGET binding site found in the 3' untranslated region of mRNA encoded by LOC163882, corresponding to a HOST TARGET binding site such as BINDING SITE I, BINDING SITE II or BINDING SITE III. Table 2 illustrates the complementarity of the nucleotide sequences of LOC163882 BINDING SITE, designated SEQ ID:39973, to the nucleotide sequence of VGAM1826 RNA, herein designated VGAM RNA, also designated SEQ ID:4537.

Another function of VGAM1826 is therefore inhibition of LOC163882 (Accession XM_089211). Accordingly, utilities of VGAM1826 include diagnosis, prevention and treatment of diseases and clinical conditions associated with LOC163882. FIG. 1 further provides a conceptual description of a novel bioinformatically detected viral gene of the present invention, referred to here as Viral Genomic Address Messenger 1827 (VGAM1827) viral gene, which modulates expression of respective host target genes thereof, the function and utility of which host target genes is known in the art.

VGAM1827 is a novel bioinformatically detected regulatory, non protein coding, viral micro RNA (miRNA) gene. The method by which VGAM1827 was detected is described hereinabove with reference to FIGS. 1-8.

VGAM1827 gene, herein designated VGAM GENE, is a viral gene contained in the genome of Rabbit Fibroma Virus. VGAM1827 host target gene, herein designated VGAM HOST TARGET GENE, is a human gene contained in the human genome.

VGAM1827 gene encodes a VGAM1827 precursor RNA, herein designated VGAM PRECURSOR RNA. Similar to other miRNA genes, and unlike most ordinary genes, VGAM1827 precursor RNA does not encode a protein. A nucleotide sequence identical or highly similar to the nucleotide sequence of VGAM1827 precursor RNA is designated SEQ ID:1813, and is provided hereinbelow with reference to the sequence listing part. Nucleotide sequence SEQ ID:1813 is located at position 144104 relative to the genome of Rabbit Fibroma Virus.

VGAM1827 precursor RNA folds onto itself, forming VGAM1827 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1827 folded precursor RNA into VGAM1827 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1827 RNA is designated SEQ ID:4538, and is provided hereinbelow with reference to the sequence listing part.

VGAM1827 host target gene, herein designated VGAM HOST TARGET GENE, encodes a corresponding messenger RNA, VGAM1827 host target RNA, herein designated VGAM HOST TARGET RNA. VGAM1827 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1827 RNA, herein designated VGAM RNA, binds complementarily to one or more host target binding sites located in untranslated regions of VGAM1827 host target RNA, herein designated VGAM HOST TARGET RNA. This complementary binding is due to the fact that the nucleotide sequence of VGAM1827 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1827 RNA, herein designated VGAM RNA, may have a different number of host target binding sites in untranslated regions of a VGAM1827 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1827 RNA, herein designated VGAM RNA, to host target binding sites on VGAM1827 host target RNA, herein designated VGAM HOST TARGET RNA, such as BINDING SITE I, BINDING SITE II and BINDING SITE III, inhibits translation of VGAM1827 host target RNA into VGAM1827 host target protein, herein designated VGAM HOST TARGET PROTEIN. VGAM host target protein is therefore outlined by a broken line.

It is appreciated that VGAM1827 host target gene, herein designated VGAM HOST TARGET GENE, in fact represents a plurality of VGAM1827 host target genes. The mRNA of each one of this plurality of VGAM1827 host target genes comprises one or more host target binding sites, each having a nucleotide sequence which is at least partly complementary to VGAM1827 RNA, herein designated VGAM RNA, and which when bound by VGAM1827 RNA causes inhibition of translation of respective one or more VGAM1827 host target proteins.

It is further appreciated by one skilled in the art that the mode of translational inhibition illustrated by FIG. 1 with specific reference to translational inhibition exerted by VGAM1827 gene, herein designated VGAM GENE, on one or more VGAM1827 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1827 is inhibition of expression of host target genes, as part of a novel viral mechanism of attacking a host. Accordingly, utilities of VGAM1827 include diagnosis, prevention and treatment of viral infection by Rabbit Fibroma Virus. Specific functions, and accordingly utilities, of VGAM1827 correlate with, and may be deduced from, the identity of the host target genes which VGAM1827 binds and inhibits, and the function of these host target genes, as elaborated hereinbelow.

Nucleotide sequences of the VGAM1827 precursor RNA, herein designated VGAM PRECURSOR RNA, and of the 'diced' VGAM1827 RNA, herein designated VGAM RNA, and a schematic representation of the secondary folding of VGAM1827 folded precursor RNA, herein designated VGAM FOLDED PRECURSOR RNA, of VGAM1827 are further described hereinbelow with reference to Table 1.

Nucleotide sequences of host target binding sites, such as BINDING SITE-I, BINDING SITE-II and BINDING SITE-III of FIG. 1, found on VGAM1827 host target RNA, and schematic representation of the complementarity of each of these host target binding sites to VGAM1827 RNA, herein designated VGAM RNA, are described hereinbelow with reference to Table 2.

As mentioned hereinabove with reference to FIG. 1, a function of VGAM1827 gene, herein designated VGAM is inhibition of expression of VGAM1827 target genes. It is appreciated that specific functions, and accordingly utilities, of VGAM1827 correlate with, and may be deduced from, the identity of the target genes which VGAM1827 binds and inhibits, and the function of these target genes, as elaborated hereinbelow.

SE57-1 (Accession NM_025214) is a VGAM1827 host target gene. SE57-1 BINDING SITE is HOST TARGET binding site found in the 3' untranslated region of mRNA encoded by SE57-1, corresponding to a HOST TARGET binding site such as BINDING SITE I, BINDING SITE II or BINDING SITE III. Table 2 illustrates the complementarity of the nucleotide sequences of SE57-1 BINDING SITE, designated SEQ ID:24886, to the nucleotide sequence of VGAM1827 RNA, herein designated VGAM RNA, also designated SEQ ID:4538.

A function of VGAM1827 is therefore inhibition of SE57-1 (Accession NM_025214). Accordingly, utilities of VGAM1827 include diagnosis, prevention and treatment of diseases and clinical conditions associated with SE57-1. FIG. 1 further provides a conceptual description of a novel bioinformatically detected viral gene of the present invention, referred to here as Viral Genomic Address Messenger 1828 (VGAM1828) viral gene, which modulates expression of respective host target genes thereof, the function and utility of which host target genes is known in the art.

VGAM1828 is a novel bioinformatically detected regulatory, non protein coding, viral micro RNA (miRNA) gene. The method by which VGAM1828 was detected is described hereinabove with reference to FIGS. 1-8.

VGAM1828 gene, herein designated VGAM GENE, is a viral gene contained in the genome of Rabbit Fibroma Virus. VGAM1828 host target gene, herein designated VGAM HOST TARGET GENE, is a human gene contained in the human genome.

VGAM1828 gene encodes a VGAM1828 precursor RNA, herein designated VGAM PRECURSOR RNA. Similar to other miRNA genes, and unlike most ordinary genes, VGAM1828 precursor RNA does not encode a protein. A nucleotide sequence identical or highly similar to the nucleotide sequence of VGAM1828 precursor RNA is designated SEQ ID:1814, and is provided hereinbelow with reference to the sequence listing part. Nucleotide sequence SEQ ID:1814 is located at position 140535 relative to the genome of Rabbit Fibroma Virus.

VGAM1828 precursor RNA folds onto itself, forming VGAM1828 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1828 folded precursor RNA into VGAM1828 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1828 RNA is designated SEQ ID:4539, and is provided hereinbelow with reference to the sequence listing part.

VGAM1828 host target gene, herein designated VGAM HOST TARGET GENE, encodes a corresponding messenger RNA, VGAM1828 host target RNA, herein designated VGAM HOST TARGET RNA. VGAM1828 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1828 RNA, herein designated VGAM RNA, binds complementarily to one or more host target binding sites located in untranslated regions of VGAM1828 host target RNA, herein designated VGAM HOST TARGET RNA. This complementary binding is due to the fact that the nucleotide sequence of VGAM1828 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1828 RNA, herein designated VGAM RNA, may have a different number of host target binding sites in untranslated regions of a VGAM1828 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1828 RNA, herein designated VGAM RNA, to host target binding sites on VGAM1828 host target RNA, herein designated VGAM HOST TARGET RNA, such as BINDING SITE I, BINDING SITE II and BINDING SITE III, inhibits translation of VGAM1828 host target RNA into VGAM1828 host target protein, herein designated VGAM HOST TARGET PROTEIN. VGAM host target protein is therefore outlined by a broken line.

It is appreciated that VGAM1828 host target gene, herein designated VGAM HOST TARGET GENE, in fact represents a plurality of VGAM1828 host target genes. The mRNA of each one of this plurality of VGAM1828 host target genes comprises one or more host target binding sites, each having a nucleotide sequence which is at least partly complementary to VGAM1828 RNA, herein designated VGAM RNA, and which when bound by VGAM1828 RNA causes inhibition of translation of respective one or more VGAM1828 host target proteins.

It is further appreciated by one skilled in the art that the mode of translational inhibition illustrated by FIG. 1 with specific reference to translational inhibition exerted by VGAM1828 gene, herein designated VGAM GENE, on one or more VGAM1828 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1828 is inhibition of expression of host target genes, as part of a novel viral mechanism of attacking a host. Accordingly, utilities of VGAM1828 include diagnosis, prevention and treatment of viral infection by Rabbit Fibroma Virus. Specific functions, and accordingly utilities, of VGAM1828 correlate with, and may be deduced from, the identity of the host target genes which VGAM1828 binds and inhibits, and the function of these host target genes, as elaborated hereinbelow.

Nucleotide sequences of the VGAM1828 precursor RNA, herein designated VGAM PRECURSOR RNA, and of the 'diced' VGAM1828 RNA, herein designated VGAM RNA, and a schematic representation of the secondary folding of VGAM1828 folded precursor RNA, herein designated VGAM FOLDED PRECURSOR RNA, of VGAM1828 are further described hereinbelow with reference to Table 1.

Nucleotide sequences of host target binding sites, such as BINDING SITE-I, BINDING SITE-II and BINDING SITE-III of FIG. 1, found on VGAM1828 host target RNA, and schematic representation of the complementarity of each of these host target binding sites to VGAM1828 RNA, herein designated VGAM RNA, are described hereinbelow with reference to Table 2.

As mentioned hereinabove with reference to FIG. 1, a function of VGAM1828 gene, herein designated VGAM is inhibition of expression of VGAM1828 target genes. It is appreciated that specific functions, and accordingly utilities, of VGAM1828 correlate with, and may be deduced from, the identity of the target genes which VGAM1828 binds and inhibits, and the function of these target genes, as elaborated hereinbelow.

Transducin (beta)-like 1X-linked (TBL1X, Accession NM_005647) is a VGAM1828 host target gene. TBL1X BINDING SITE is HOST TARGET binding site found in the 3' untranslated region of mRNA encoded by TBL1X, corresponding to a HOST TARGET binding site such as BINDING SITE I, BINDING SITE II or BINDING SITE III. Table 2 illustrates the complementarity of the nucleotide sequences of TBL1X BINDING SITE, designated SEQ ID:12184, to the nucleotide sequence of VGAM1828 RNA, herein designated VGAM RNA, also designated SEQ ID:4539.

A function of VGAM1828 is therefore inhibition of Transducin (beta)-like 1X-linked (TBL1X, Accession NM_005647), a gene which activates latent HDAC3 activity. Accordingly, utilities of VGAM1828 include diagnosis, prevention and treatment of diseases and clinical conditions associated with TBL1X. The function of TBL1X and its association with various diseases and clinical conditions, has been established by previous studies, as described hereinabove with reference to VGAM1151. Chromosome X Open Reading Frame 1 (CXorf1, Accession NM_004709) is another VGAM1828 host target gene. CXorf1 BINDING SITE is HOST TARGET binding site found in the 3' untranslated region of mRNA encoded by CXorf1, corresponding to a HOST TARGET binding site such as BINDING SITE I, BINDING SITE II or BINDING SITE III. Table 2 illustrates the complementarity of the nucleotide sequences of CXorf1 BINDING SITE, designated SEQ ID:11056, to the nucleotide sequence of VGAM1828 RNA, herein designated VGAM RNA, also designated SEQ ID:4539.

Another function of VGAM1828 is therefore inhibition of Chromosome X Open Reading Frame 1 (CXorf1, Accession NM_004709). Accordingly, utilities of VGAM1828 include diagnosis, prevention and treatment of diseases and clinical conditions associated with CXorf1. FIG. 1 further provides a conceptual description of a novel bioinformatically detected viral gene of the present invention, referred to here as Viral Genomic Address Messenger 1829 (VGAM1829) viral gene, which modulates expression of respective host target genes thereof, the function and utility of which host target genes is known in the art.

VGAM1829 is a novel bioinformatically detected regulatory, non protein coding, viral micro RNA (miRNA) gene. The method by which VGAM1829 was detected is described hereinabove with reference to FIGS. 1-8.

VGAM1829 gene, herein designated VGAM GENE, is a viral gene contained in the genome of Rabbit Fibroma Virus. VGAM1829 host target gene, herein designated VGAM HOST TARGET GENE, is a human gene contained in the human genome.

VGAM1829 gene encodes a VGAM1829 precursor RNA, herein designated VGAM PRECURSOR RNA. Similar to other miRNA genes, and unlike most ordinary genes, VGAM1829 precursor RNA does not encode a protein. A nucleotide sequence identical or highly similar to the nucleotide sequence of VGAM1829 precursor RNA is designated SEQ ID:1815, and is provided hereinbelow with reference to the sequence listing part. Nucleotide sequence SEQ ID:1815 is located at position 140030 relative to the genome of Rabbit Fibroma Virus.

VGAM1829 precursor RNA folds onto itself, forming VGAM1829 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1829 folded precursor RNA into VGAM1829 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1829 RNA is designated SEQ ID:4540, and is provided hereinbelow with reference to the sequence listing part.

VGAM1829 host target gene, herein designated VGAM HOST TARGET GENE, encodes a corresponding messenger RNA, VGAM1829 host target RNA, herein designated VGAM HOST TARGET RNA. VGAM1829 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1829 RNA, herein designated VGAM RNA, binds complementarily to one or more host target binding sites located in untranslated regions of VGAM1829 host target RNA, herein designated VGAM HOST TARGET RNA. This complementary binding is due to the fact that the nucleotide sequence of VGAM1829 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1829 RNA, herein designated VGAM RNA, may have a different number of host target binding sites in untranslated regions of a VGAM1829 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1829 RNA, herein designated VGAM RNA, to host target binding sites on VGAM1829 host target RNA, herein designated VGAM HOST TARGET RNA, such as BINDING SITE I, BINDING SITE II and BINDING SITE III, inhibits translation of VGAM1829 host target RNA into VGAM1829 host target protein, herein designated VGAM HOST TARGET PROTEIN. VGAM host target protein is therefore outlined by a broken line.

It is appreciated that VGAM1829 host target gene, herein designated VGAM HOST TARGET GENE, in fact represents a plurality of VGAM1829 host target genes. The mRNA of each one of this plurality of VGAM1829 host target genes comprises one or more host target binding sites, each having a nucleotide sequence which is at least partly complementary to VGAM1829 RNA, herein designated VGAM RNA, and which when bound by VGAM1829 RNA causes inhibition of translation of respective one or more VGAM1829 host target proteins.

It is further appreciated by one skilled in the art that the mode of translational inhibition illustrated by FIG. 1 with specific reference to translational inhibition exerted by VGAM1829 gene, herein designated VGAM GENE, on one or more VGAM1829 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1829 is inhibition of expression of host target genes, as part of a novel viral mechanism of attacking a host. Accordingly, utilities of VGAM1829 include diagnosis, prevention and treatment of viral infection by Rabbit Fibroma Virus. Specific functions, and accordingly utilities, of VGAM1829 correlate with, and may be deduced from, the identity of the host target genes which VGAM1829 binds and inhibits, and the function of these host target genes, as elaborated hereinbelow.

Nucleotide sequences of the VGAM1829 precursor RNA, herein designated VGAM PRECURSOR RNA, and of the 'diced' VGAM1829 RNA, herein designated VGAM RNA, and a schematic representation of the secondary folding of VGAM1829 folded precursor RNA, herein designated VGAM FOLDED PRECURSOR RNA, of VGAM1829 are further described hereinbelow with reference to Table 1.

Nucleotide sequences of host target binding sites, such as BINDING SITE-I, BINDING SITE-II and BINDING SITE-III of FIG. 1, found on VGAM1829 host target RNA, and schematic representation of the complementarity of each of these host target binding sites to VGAM1829 RNA, herein designated VGAM RNA, are described hereinbelow with reference to Table 2.

As mentioned hereinabove with reference to FIG. 1, a function of VGAM1829 gene, herein designated VGAM is inhibition of expression of VGAM1829 target genes. It is appreciated that specific functions, and accordingly utilities, of VGAM1829 correlate with, and may be deduced from, the identity of the target genes which VGAM1829 binds and inhibits, and the function of these target genes, as elaborated hereinbelow.

DKFZP564L0864 (Accession XM_051905) is a VGAM1829 host target gene. DKFZP564L0864 BINDING SITE is HOST TARGET binding site found in the 3' untranslated region of mRNA encoded by DKFZP564L0864, corresponding to a HOST TARGET binding site such as BINDING SITE I, BINDING SITE II or BINDING SITE III. Table 2 illustrates the complementarity of the nucleotide sequences of DKFZP564L0864 BINDING SITE, designated SEQ ID:35918, to the nucleotide sequence of VGAM1829 RNA, herein designated VGAM RNA, also designated SEQ ID:4540.

A function of VGAM1829 is therefore inhibition of DKFZP564L0864 (Accession XM_051905). Accordingly, utilities of VGAM1829 include diagnosis, prevention and treatment of diseases and clinical conditions associated with DKFZP564L0864. KIAA1596 (Accession XM_048128) is another VGAM1829 host target gene. KIAA1596 BINDING SITE is HOST TARGET binding site found in the 3' untranslated region of mRNA encoded by KIAA1596, corresponding to a HOST TARGET binding site such as BINDING SITE I, BINDING SITE II or BINDING SITE III. Table 2 illustrates the complementarity of the nucleotide sequences of KIAA1596 BINDING SITE, designated SEQ ID:35119, to the nucleotide sequence of VGAM1829 RNA, herein designated VGAM RNA, also designated SEQ ID:4540.

Another function of VGAM1829 is therefore inhibition of KIAA1596 (Accession XM_048128). Accordingly, utilities of VGAM1829 include diagnosis, prevention and treatment of diseases and clinical conditions associated with KIAA1596. LOC90246 (Accession XM_030283) is another VGAM1829 host target gene. LOC90246 BINDING SITE is HOST TARGET binding site found in the 3' untranslated region of mRNA encoded by LOC90246, corresponding to a HOST TARGET binding site such as BINDING SITE I, BINDING SITE II or BINDING SITE III. Table 2 illustrates the complementarity of the nucleotide sequences of LOC90246 BINDING SITE, designated SEQ ID:31002, to the nucleotide sequence of VGAM1829 RNA, herein designated VGAM RNA, also designated SEQ ID:4540.

Another function of VGAM1829 is therefore inhibition of LOC90246 (Accession XM_030283). Accordingly, utilities of VGAM1829 include diagnosis, prevention and treatment of diseases and clinical conditions associated with LOC90246. FIG. 1 further provides a conceptual description of a novel bioinformatically detected viral gene of the present invention, referred to here as Viral Genomic Address Messenger 1830 (VGAM1830) viral gene, which modulates expression of respective host target genes thereof, the function and utility of which host target genes is known in the art.

VGAM1830 is a novel bioinformatically detected regulatory, non protein coding, viral micro RNA (miRNA) gene.

The method by which VGAM1830 was detected is described hereinabove with reference to FIGS. 1-8.

VGAM1830 gene, herein designated VGAM GENE, is a viral gene contained in the genome of Camelpox Virus. VGAM1830 host target gene, herein designated VGAM HOST TARGET GENE, is a human gene contained in the human genome.

VGAM1830 gene encodes a VGAM1830 precursor RNA, herein designated VGAM PRECURSOR RNA. Similar to other miRNA genes, and unlike most ordinary genes, VGAM1830 precursor RNA does not encode a protein. A nucleotide sequence identical or highly similar to the nucleotide sequence of VGAM1830 precursor RNA is designated SEQ ID:1816, and is provided hereinbelow with reference to the sequence listing part. Nucleotide sequence SEQ ID:1816 is located at position 40729 relative to the genome of Camelpox Virus.

VGAM1830 precursor RNA folds onto itself, forming VGAM1830 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1830 folded precursor RNA into VGAM1830 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1830 RNA is designated SEQ ID:4541, and is provided hereinbelow with reference to the sequence listing part.

VGAM1830 host target gene, herein designated VGAM HOST TARGET GENE, encodes a corresponding messenger RNA, VGAM1830 host target RNA, herein designated VGAM HOST TARGET RNA. VGAM1830 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1830 RNA, herein designated VGAM RNA, binds complementarily to one or more host target binding sites located in untranslated regions of VGAM1830 host target RNA, herein designated VGAM HOST TARGET RNA. This complementary binding is due to the fact that the nucleotide sequence of VGAM1830 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1830 RNA, herein designated VGAM RNA, may have a different number of host target binding sites in untranslated regions of a VGAM1830 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1830 RNA, herein designated VGAM RNA, to host target binding sites on VGAM1830 host target RNA, herein designated VGAM HOST TARGET RNA, such as BINDING SITE I, BINDING SITE II and BINDING SITE III, inhibits translation of VGAM1830 host target RNA into VGAM1830 host target protein, herein designated VGAM HOST TARGET PROTEIN. VGAM host target protein is therefore outlined by a broken line.

It is appreciated that VGAM1830 host target gene, herein designated VGAM HOST TARGET GENE, in fact represents a plurality of VGAM1830 host target genes. The mRNA of each one of this plurality of VGAM1830 host target genes comprises one or more host target binding sites, each having a nucleotide sequence which is at least partly complementary to VGAM1830 RNA, herein designated VGAM RNA, and which when bound by VGAM1830 RNA causes inhibition of translation of respective one or more VGAM1830 host target proteins.

It is further appreciated by one skilled in the art that the mode of translational inhibition illustrated by FIG. 1 with specific reference to translational inhibition exerted by VGAM1830 gene, herein designated VGAM GENE, on one or more VGAM1830 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1830 is inhibition of expression of host target genes, as part of a novel viral mechanism of attacking a host. Accordingly, utilities of VGAM1830 include diagnosis, prevention and treatment of viral infection by Camelpox Virus. Specific functions, and accordingly utilities, of VGAM1830 correlate with, and may be deduced from, the identity of the host target genes which VGAM1830 binds and inhibits, and the function of these host target genes, as elaborated hereinbelow.

Nucleotide sequences of the VGAM1830 precursor RNA, herein designated VGAM PRECURSOR RNA, and of the 'diced' VGAM1830 RNA, herein designated VGAM RNA, and a schematic representation of the secondary folding of VGAM1830 folded precursor RNA, herein designated VGAM FOLDED PRECURSOR RNA, of VGAM1830 are further described hereinbelow with reference to Table 1.

Nucleotide sequences of host target binding sites, such as BINDING SITE-I, BINDING SITE-II and BINDING SITE-III of FIG. 1, found on VGAM1830 host target RNA, and schematic representation of the complementarity of each of these host target binding sites to VGAM1830 RNA, herein designated VGAM RNA, are described hereinbelow with reference to Table 2.

As mentioned hereinabove with reference to FIG. 1, a function of VGAM1830 gene, herein designated VGAM is inhibition of expression of VGAM1830 target genes. It is appreciated that specific functions, and accordingly utilities, of VGAM1830 correlate with, and may be deduced from, the identity of the target genes which VGAM1830 binds and inhibits, and the function of these target genes, as elaborated hereinbelow.

FLJ12270 (Accession NM_030581) is a VGAM1830 host target gene. FLJ12270 BINDING SITE is HOST TARGET binding site found in the 3' untranslated region of mRNA encoded by FLJ12270, corresponding to a HOST TARGET binding site such as BINDING SITE I, BINDING SITE II or BINDING SITE III. Table 2 illustrates the complementarity of the nucleotide sequences of FLJ12270 BINDING SITE, designated SEQ ID:24953, to the nucleotide sequence of VGAM1830 RNA, herein designated VGAM RNA, also designated SEQ ID:4541.

A function of VGAM1830 is therefore inhibition of FLJ12270 (Accession NM_030581). Accordingly, utilities of VGAM1830 include diagnosis, prevention and treatment of diseases and clinical conditions associated with FLJ12270. OSRF (Accession XM_003724) is another VGAM1830 host target gene. OSRF BINDING SITE is HOST TARGET binding site found in the 3' untranslated region of mRNA encoded by OSRF, corresponding to a HOST TARGET binding site such as BINDING SITE I, BINDING SITE II or BINDING SITE III. Table 2 illustrates the complementarity of the nucleotide sequences of OSRF BINDING SITE, designated SEQ ID:29941, to the nucleotide sequence of VGAM1830 RNA, herein designated VGAM RNA, also designated SEQ ID:4541.

Another function of VGAM1830 is therefore inhibition of OSRF (Accession XM_003724). Accordingly, utilities of VGAM1830 include diagnosis, prevention and treatment of diseases and clinical conditions associated with OSRF. POPX1 (Accession NM_014906) is another VGAM1830 host target gene. POPX1 BINDING SITE is HOST TARGET binding site found in the 3' untranslated region of mRNA encoded by POPX1, corresponding to a HOST TARGET binding site such as BINDING SITE I, BINDING SITE II or BINDING SITE III. Table 2 illustrates the complementarity of the nucleotide sequences of POPX1 BINDING SITE, designated SEQ ID:17116, to the nucleotide sequence of VGAM1830 RNA, herein designated VGAM RNA, also designated SEQ ID:4541.

Another function of VGAM1830 is therefore inhibition of POPX1 (Accession NM_014906). Accordingly, utilities of VGAM1830 include diagnosis, prevention and treatment of diseases and clinical conditions associated with POPX1. LOC124045 (Accession XM_071873) is another VGAM1830 host target gene. LOC124045 BINDING SITE is HOST TARGET binding site found in the 3' untranslated region of mRNA encoded by LOC124045, corresponding to a HOST TARGET binding site such as BINDING SITE I, BINDING SITE II or BINDING SITE III. Table 2 illustrates the complementarity of the nucleotide sequences of LOC124045 BINDING SITE, designated SEQ ID:37439, to the nucleotide sequence of VGAM1830 RNA, herein designated VGAM RNA, also designated SEQ ID:4541.

Another function of VGAM1830 is therefore inhibition of LOC124045 (Accession XM_071873). Accordingly, utilities of VGAM1830 include diagnosis, prevention and treatment of diseases and clinical conditions associated with LOC124045. LOC51279 (Accession NM_016546) is another VGAM1830 host target gene. LOC51279 BINDING SITE is HOST TARGET binding site found in the 3' untranslated region of mRNA encoded by LOC51279, corresponding to a HOST TARGET binding site such as BINDING SITE I, BINDING SITE II or BINDING SITE III. Table 2 illustrates the complementarity of the nucleotide sequences of LOC51279 BINDING SITE, designated SEQ ID:18614, to the nucleotide sequence of VGAM1830 RNA, herein designated VGAM RNA, also designated SEQ ID:4541.

Another function of VGAM1830 is therefore inhibition of LOC51279 (Accession NM_016546). Accordingly, utilities of VGAM1830 include diagnosis, prevention and treatment of diseases and clinical conditions associated with LOC51279. FIG. 1 further provides a conceptual description of a novel bioinformatically detected viral gene of the present invention, referred to here as Viral Genomic Address Messenger 1831 (VGAM1831) viral gene, which modulates expression of respective host target genes thereof, the function and utility of which host target genes is known in the art.

VGAM1831 is a novel bioinformatically detected regulatory, non protein coding, viral micro RNA (miRNA) gene. The method by which VGAM1831 was detected is described hereinabove with reference to FIGS. 1-8.

VGAM1831 gene, herein designated VGAM GENE, is a viral gene contained in the genome of Camelpox Virus. VGAM1831 host target gene, herein designated VGAM HOST TARGET GENE, is a human gene contained in the human genome.

VGAM1831 gene encodes a VGAM1831 precursor RNA, herein designated VGAM PRECURSOR RNA. Similar to other miRNA genes, and unlike most ordinary genes, VGAM1831 precursor RNA does not encode a protein. A nucleotide sequence identical or highly similar to the nucleotide sequence of VGAM1831 precursor RNA is designated SEQ ID:1817, and is provided hereinbelow with reference to the sequence listing part. Nucleotide sequence SEQ ID:1817 is located at position 40965 relative to the genome of Camelpox Virus.

VGAM1831 precursor RNA folds onto itself, forming VGAM1831 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1831 folded precursor RNA into VGAM1831 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM1831 RNA is designated SEQ ID:4542, and is provided hereinbelow with reference to the sequence listing part.

VGAM1831 host target gene, herein designated VGAM HOST TARGET GENE, encodes a corresponding messenger RNA, VGAM1831 host target RNA, herein designated VGAM HOST TARGET RNA. VGAM1831 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1831 RNA, herein designated VGAM RNA, binds complementarily to one or more host target binding sites located in untranslated regions of VGAM1831 host target RNA, herein designated VGAM HOST TARGET RNA. This complementary binding is due to the fact that the nucleotide sequence of VGAM1831 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1831 RNA, herein designated VGAM RNA, may have a different number of host target binding sites in untranslated regions of a VGAM1831 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1831 RNA, herein designated VGAM RNA, to host target binding sites on VGAM1831 host target RNA, herein designated VGAM HOST TARGET RNA, such as BINDING SITE I, BINDING SITE II and BINDING SITE III, inhibits translation of VGAM1831 host target RNA into VGAM1831 host target protein, herein designated VGAM HOST TARGET PROTEIN. VGAM host target protein is therefore outlined by a broken line.

It is appreciated that VGAM1831 host target gene, herein designated VGAM HOST TARGET GENE, in fact represents a plurality of VGAM1831 host target genes. The mRNA of each one of this plurality of VGAM1831 host target genes comprises one or more host target binding sites, each having a nucleotide sequence which is at least partly complementary to VGAM1831 RNA, herein designated VGAM RNA, and which when bound by VGAM1831 RNA causes inhibition of translation of respective one or more VGAM1831 host target proteins.

It is further appreciated by one skilled in the art that the mode of translational inhibition illustrated by FIG. 1 with specific reference to translational inhibition exerted by VGAM1831 gene, herein designated VGAM GENE, on one or more VGAM1831 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1831 is inhibition of expression of host target genes, as part of a novel viral mechanism of attacking a host. Accordingly, utilities of VGAM1831 include diagnosis, prevention and treatment of viral infection by Camelpox Virus. Specific functions, and accordingly utilities, of VGAM1831 correlate with, and may be deduced from, the identity of the host target genes which VGAM1831 binds and inhibits, and the function of these host target genes, as elaborated hereinbelow.

Nucleotide sequences of the VGAM1831 precursor RNA, herein designated VGAM PRECURSOR RNA, and of the 'diced' VGAM1831 RNA, herein designated VGAM RNA, and a schematic representation of the secondary folding of VGAM1831 folded precursor RNA, herein designated VGAM FOLDED PRECURSOR RNA, of VGAM1831 are further described hereinbelow with reference to Table 1.

Nucleotide sequences of host target binding sites, such as BINDING SITE-I, BINDING SITE-II and BINDING SITE-III of FIG. 1, found on VGAM1831 host target RNA, and schematic representation of the complementarity of each of these host target binding sites to VGAM1831 RNA, herein designated VGAM RNA, are described hereinbelow with reference to Table 2.

As mentioned hereinabove with reference to FIG. 1, a function of VGAM1831 gene, herein designated VGAM is inhibition of expression of VGAM1831 target genes. It is appreciated that specific functions, and accordingly utilities, of VGAM1831 correlate with, and may be deduced from, the identity of the target genes which VGAM1831 binds and inhibits, and the function of these target genes, as elaborated hereinbelow.

UDP-Gal:betaGlcNAc Beta 1,4-Galactosyltransferase, Polypeptide 5 (B4GALT5, Accession NM_004776) is a VGAM1831 host target gene. B4GALT5 BINDING SITE is HOST TARGET binding site found in the 3' untranslated region of mRNA encoded by B4GALT5, corresponding to a HOST TARGET binding site such as BINDING SITE I, BINDING SITE II or BINDING SITE III. Table 2 illustrates the complementarity of the nucleotide sequences of B4GALT5 BINDING SITE, designated SEQ ID:11170, to the nucleotide sequence of VGAM1831 RNA, herein designated VGAM RNA, also designated SEQ ID:4542.

A function of VGAM1831 is therefore inhibition of UDP-Gal:betaGlcNAc Beta 1,4-Galactosyltransferase, Polypeptide 5 (B4GALT5, Accession NM_004776). Accordingly, utilities of VGAM1831 include diagnosis, prevention and treatment of diseases and clinical conditions associated with B4GALT5. BCL2-antagonist/killer 1 (BAK1, Accession XM_166333) is another VGAM1831 host target gene. BAK1 BINDING SITE is HOST TARGET binding site found in the 3' untranslated region of mRNA encoded by BAK1, corresponding to a HOST TARGET binding site such as BINDING SITE I, BINDING SITE II or BINDING SITE III. Table 2 illustrates the complementarity of the nucleotide sequences of BAK1 BINDING SITE, designated SEQ ID:44175, to the nucleotide sequence of VGAM1831 RNA, herein designated VGAM RNA, also designated SEQ ID:4542.

Another function of VGAM1831 is therefore inhibition of BCL2-antagonist/killer 1 (BAK1, Accession XM_166333), a gene which accelerates programmed cell death by binding to, and antagonizing the a repressor bcl-2. Accordingly, utilities of VGAM1831 include diagnosis, prevention and treatment of diseases and clinical conditions associated with BAK1. The function of BAK1 and its association with various diseases and clinical conditions, has been established by previous studies, as described hereinabove with reference to VGAM430. Forkhead Box O1A (rhabdomyosarcoma) (FOXO1A, Accession NM_002015) is another VGAM1831 host target gene. FOXO1A BINDING SITE is HOST TARGET binding site found in the 3' untranslated region of mRNA encoded by FOXO1A, corresponding to a HOST TARGET binding site such as BINDING SITE I, BINDING SITE II or BINDING SITE III. Table 2 illustrates the complementarity of the nucleotide sequences of FOXO1A BINDING SITE, designated SEQ ID:7758, to the nucleotide sequence of VGAM1831 RNA, herein designated VGAM RNA, also designated SEQ ID:4542.

Another function of VGAM1831 is therefore inhibition of Forkhead Box O1A (rhabdomyosarcoma) (FOXO1A, Accession NM_002015), a gene which is a probable transcription factor. Accordingly, utilities of VGAM1831 include diagnosis, prevention and treatment of diseases and clinical conditions associated with FOXO1A. The function of FOXO1A and its association with various diseases and clinical conditions, has been established by previous studies, as described hereinabove with reference to VGAM228. Angiomotin Like 2 (AMOTL2, Accession NM_016201) is another VGAM1831 host target gene. AMOTL2 BINDING SITE is HOST TARGET binding site found in the 3' untranslated region of mRNA encoded by AMOTL2, corresponding to a HOST TARGET binding site such as BINDING SITE I, BINDING SITE II or BINDING SITE III. Table 2 illustrates the complementarity of the nucleotide sequences of AMOTL2 BINDING SITE, designated SEQ ID:18293, to the nucleotide sequence of VGAM1831 RNA, herein designated VGAM RNA, also designated SEQ ID:4542.

Another function of VGAM1831 is therefore inhibition of Angiomotin Like 2 (AMOTL2, Accession NM_016201). Accordingly, utilities of VGAM1831 include diagnosis, prevention and treatment of diseases and clinical conditions associated with AMOTL2. FUS Interacting Protein (serine-arginine rich) 1 (FUSIP1, Accession NM_054016) is another VGAM1831 host target gene. FUSIP1 BINDING SITE is HOST TARGET binding site found in the 3' untranslated region of mRNA encoded by FUSIP1, corresponding to a HOST TARGET binding site such as BINDING SITE I, BINDING SITE II or BINDING SITE III. Table 2 illustrates the complementarity of the nucleotide sequences of FUSIP1 BINDING SITE, designated SEQ ID:27624, to the nucleotide sequence of VGAM1831 RNA, herein designated VGAM RNA, also designated SEQ ID:4542.

Another function of VGAM1831 is therefore inhibition of FUS Interacting Protein (serine-arginine rich) 1 (FUSIP1, Accession NM_054016). Accordingly, utilities of VGAM1831 include diagnosis, prevention and treatment of diseases and clinical conditions associated with FUSIP1. MGC10999 (Accession NM_032307) is another VGAM1831 host target gene. MGC10999 BINDING SITE is HOST TARGET binding site found in the 3' untranslated region of mRNA encoded by MGC10999, corresponding to a HOST TARGET binding site such as BINDING SITE I, BINDING SITE II or BINDING SITE III. Table 2 illustrates the complementarity of the nucleotide sequences of MGC10999 BINDING SITE, designated SEQ ID:26090, to the nucleotide sequence of VGAM1831 RNA, herein designated VGAM RNA, also designated SEQ ID:4542.

Another function of VGAM1831 is therefore inhibition of MGC10999 (Accession NM_032307). Accordingly, utilities of VGAM1831 include diagnosis, prevention and treatment of diseases and clinical conditions associated with MGC10999. LOC153259 (Accession XM_098342) is another VGAM1831 host target gene. LOC153259 BINDING SITE is HOST TARGET binding site found in the 5' untranslated region of mRNA encoded by LOC153259, corresponding to a HOST TARGET binding site such as BINDING SITE I, BINDING SITE II or BINDING SITE III. Table 2 illustrates the complementarity of the nucleotide sequences of LOC153259 BINDING SITE, designated SEQ ID:41600, to the nucleotide sequence of VGAM1831 RNA, herein designated VGAM RNA, also designated SEQ ID:4542.

Another function of VGAM1831 is therefore inhibition of LOC153259 (Accession XM_098342). Accordingly, utilities of VGAM1831 include diagnosis, prevention and treatment of diseases and clinical conditions associated with LOC153259. FIG. 1 further provides a conceptual description of a novel bioinformatically detected viral gene of the present invention, referred to here as Viral Genomic Address Messenger 1832 (VGAM1832) viral gene, which modulates expression of respective host target genes thereof, the function and utility of which host target genes is known in the art.

VGAM1832 is a novel bioinformatically detected regulatory, non protein coding, viral micro RNA (miRNA) gene. The method by which VGAM1832 was detected is described hereinabove with reference to FIGS. 1-8.

VGAM1832 gene, herein designated VGAM GENE, is a viral gene contained in the genome of Camelpox Virus. VGAM1832 host target gene, herein designated VGAM HOST TARGET GENE, is a human gene contained in the human genome.

VGAM1832 gene encodes a VGAM1832 precursor RNA, herein designated VGAM PRECURSOR RNA. Similar to other miRNA genes, and unlike most ordinary genes, VGAM1832 precursor RNA does not encode a protein. A nucleotide sequence identical or highly similar to the nucleotide sequence of VGAM1832 precursor RNA is designated SEQ ID:1818, and is provided hereinbelow with reference to the sequence listing part. Nucleotide sequence SEQ ID:1818 is located at position 38937 relative to the genome of Camelpox Virus.

VGAM1832 precursor RNA folds onto itself, forming VGAM1832 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1832 folded precursor RNA into VGAM1832 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1832 RNA is designated SEQ ID:4543, and is provided hereinbelow with reference to the sequence listing part.

VGAM1832 host target gene, herein designated VGAM HOST TARGET GENE, encodes a corresponding messenger RNA, VGAM1832 host target RNA, herein designated VGAM HOST TARGET RNA. VGAM1832 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1832 RNA, herein designated VGAM RNA, binds complementarily to one or more host target binding sites located in untranslated regions of VGAM1832 host target RNA, herein designated VGAM HOST TARGET RNA. This complementary binding is due to the fact that the nucleotide sequence of VGAM1832 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1832 RNA, herein designated VGAM RNA, may have a different number of host target binding sites in untranslated regions of a VGAM1832 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1832 RNA, herein designated VGAM RNA, to host target binding sites on VGAM1832 host target RNA, herein designated VGAM HOST TARGET RNA, such as BINDING SITE I, BINDING SITE II and BINDING SITE III, inhibits translation of VGAM1832 host target RNA into VGAM1832 host target protein, herein designated VGAM HOST TARGET PROTEIN. VGAM host target protein is therefore outlined by a broken line.

It is appreciated that VGAM1832 host target gene, herein designated VGAM HOST TARGET GENE, in fact represents a plurality of VGAM1832 host target genes. The mRNA of each one of this plurality of VGAM1832 host target genes comprises one or more host target binding sites, each having a nucleotide sequence which is at least partly complementary to VGAM1832 RNA, herein designated VGAM RNA, and which when bound by VGAM1832 RNA causes inhibition of translation of respective one or more VGAM1832 host target proteins.

It is further appreciated by one skilled in the art that the mode of translational inhibition illustrated by FIG. 1 with specific reference to translational inhibition exerted by VGAM1832 gene, herein designated VGAM GENE, on one or more VGAM1832 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1832 is inhibition of expression of host target genes, as part of a novel viral mechanism of attacking a host. Accordingly, utilities of VGAM1832 include diagnosis, prevention and treatment of viral infection by Camelpox Virus. Specific functions, and accordingly utilities, of VGAM1832 correlate with, and may be deduced from, the identity of the host target genes which VGAM1832 binds and inhibits, and the function of these host target genes, as elaborated hereinbelow.

Nucleotide sequences of the VGAM1832 precursor RNA, herein designated VGAM PRECURSOR RNA, and of the 'diced' VGAM1832 RNA, herein designated VGAM RNA, and a schematic representation of the secondary folding of VGAM1832 folded precursor RNA, herein designated VGAM FOLDED PRECURSOR RNA, of VGAM1832 are further described hereinbelow with reference to Table 1.

Nucleotide sequences of host target binding sites, such as BINDING SITE-I, BINDING SITE-II and BINDING SITE-III of FIG. 1, found on VGAM1832 host target RNA, and schematic representation of the complementarity of each of these host target binding sites to VGAM1832 RNA, herein designated VGAM RNA, are described hereinbelow with reference to Table 2.

As mentioned hereinabove with reference to FIG. 1, a function of VGAM1832 gene, herein designated VGAM is inhibition of expression of VGAM1832 target genes. It is appreciated that specific functions, and accordingly utilities, of VGAM1832 correlate with, and may be deduced from, the identity of the target genes which VGAM1832 binds and inhibits, and the function of these target genes, as elaborated hereinbelow.

GA (Accession NM_013267) is a VGAM1832 host target gene. GA BINDING SITE is HOST TARGET binding site found in the 5' untranslated region of mRNA encoded by GA, corresponding to a HOST TARGET binding site such as BINDING SITE I, BINDING SITE II or BINDING SITE III. Table 2 illustrates the complementarity of the nucleotide sequences of GA BINDING SITE, designated SEQ ID:14936, to the nucleotide sequence of VGAM1832 RNA, herein designated VGAM RNA, also designated SEQ ID:4543.

A function of VGAM1832 is therefore inhibition of GA (Accession NM_013267). Accordingly, utilities of VGAM1832 include diagnosis, prevention and treatment of diseases and clinical conditions associated with GA. KIAA0753 (Accession NM_014804) is another VGAM1832 host target gene. KIAA0753 BINDING SITE is HOST TARGET binding site found in the 3" untranslated region of mRNA encoded by KIAA0753, corresponding to a HOST TARGET binding site such as BINDING SITE I, BINDING SITE II or BINDING SITE III. Table 2 illustrates the complementarity of the nucleotide sequences of KIAA0753 BINDING SITE, designated SEQ ID:16737, to the nucleotide sequence of VGAM1832 RNA, herein designated VGAM RNA, also designated SEQ ID:4543.

Another function of VGAM1832 is therefore inhibition of KIAA0753 (Accession NM_014804). Accordingly, utilities of VGAM1832 include diagnosis, prevention and treatment of diseases and clinical conditions associated with KIAA0753. KIAA1130 (Accession XM_031104) is another VGAM1832 host target gene. KIAA1130 BINDING SITE is HOST TARGET binding site found in the 3' untranslated region of mRNA encoded by KIAA1130, corresponding to a HOST TARGET binding site such as BINDING SITE I, BINDING SITE II or BINDING SITE III. Table 2 illustrates the complementarity of the nucleotide sequences of KIAA1130 BINDING SITE, designated SEQ ID:31289, to the nucleotide sequence of VGAM1832 RNA, herein designated VGAM RNA, also designated SEQ ID:4543.

Another function of VGAM1832 is therefore inhibition of KIAA1130 (Accession XM_031104). Accordingly, utilities of VGAM1832 include diagnosis, prevention and treatment of diseases and clinical conditions associated with KIAA1130. Ribosomal Protein L36 (RPL36, Accession NM_015414) is another VGAM1832 host target gene. RPL36 BINDING SITE is HOST TARGET binding site found in the 5' untranslated region of mRNA encoded by RPL36, corresponding to a HOST TARGET binding site such as BINDING SITE I, BINDING SITE II or BINDING SITE III. Table 2 illustrates the complementarity of the nucleotide sequences of RPL36 BINDING SITE, designated SEQ ID:17715, to the nucleotide sequence of VGAM1832 RNA, herein designated VGAM RNA, also designated SEQ ID:4543.

Another function of VGAM1832 is therefore inhibition of Ribosomal Protein L36 (RPL36, Accession NM_015414). Accordingly, utilities of VGAM1832 include diagnosis, prevention and treatment of diseases and clinical conditions associated with RPL36. LOC56920 (Accession NM_020163) is another VGAM1832 host target gene. LOC56920 BINDING SITE is HOST TARGET binding site found in the 3' untranslated region of mRNA encoded by LOC56920, corresponding to a HOST TARGET binding site such as BINDING SITE I, BINDING SITE II or BINDING SITE III. Table 2 illustrates the complementarity of the nucleotide sequences of LOC56920 BINDING SITE, designated SEQ ID:21381, to the nucleotide sequence of VGAM1832 RNA, herein designated VGAM RNA, also designated SEQ ID:4543.

Another function of VGAM1832 is therefore inhibition of LOC56920 (Accession NM_020163). Accordingly, utilities of VGAM1832 include diagnosis, prevention and treatment of diseases and clinical conditions associated with LOC56920. FIG. 1 further provides a conceptual description of a novel bioinformatically detected viral gene of the present invention, referred to here as Viral Genomic Address Messenger 1833 (VGAM1833) viral gene, which modulates expression of respective host target genes thereof, the function and utility of which host target genes is known in the art.

VGAM1833 is a novel bioinformatically detected regulatory, non protein coding, viral micro RNA (miRNA) gene. The method by which VGAM1833 was detected is described hereinabove with reference to FIGS. 1-8.

VGAM1833 gene, herein designated VGAM GENE, is a viral gene contained in the genome of Camelpox Virus. VGAM1833 host target gene, herein designated VGAM HOST TARGET GENE, is a human gene contained in the human genome.

VGAM1833 gene encodes a VGAM1833 precursor RNA, herein designated VGAM PRECURSOR RNA. Similar to other miRNA genes, and unlike most ordinary genes, VGAM1833 precursor RNA does not encode a protein. A nucleotide sequence identical or highly similar to the nucleotide sequence of VGAM1833 precursor RNA is designated SEQ ID:1819, and is provided hereinbelow with reference to the sequence listing part. Nucleotide sequence SEQ ID:1819 is located at position 38839 relative to the genome of Camelpox Virus.

VGAM1833 precursor RNA folds onto itself, forming VGAM1833 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1833 folded precursor RNA into VGAM1833 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1833 RNA is designated SEQ ID:4544, and is provided hereinbelow with reference to the sequence listing part.

VGAM1833 host target gene, herein designated VGAM HOST TARGET GENE, encodes a corresponding messenger RNA, VGAM1833 host target RNA, herein designated VGAM HOST TARGET RNA. VGAM1833 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1833 RNA, herein designated VGAM RNA, binds complementarily to one or more host target binding sites located in untranslated regions of VGAM1833 host target RNA, herein designated VGAM HOST TARGET RNA. This complementary binding is due to the fact that the nucleotide sequence of VGAM1833 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1833 RNA, herein designated VGAM RNA, may have a different number of host target binding sites in untranslated regions of a VGAM1833 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1833 RNA, herein designated VGAM RNA, to host target binding sites on VGAM1833 host target RNA, herein designated VGAM HOST TARGET RNA, such as BINDING SITE I, BINDING SITE II and BINDING SITE III, inhibits translation of VGAM1833 host target RNA into VGAM1833 host target protein, herein designated VGAM HOST TARGET PROTEIN. VGAM host target protein is therefore outlined by a broken line.

It is appreciated that VGAM1833 host target gene, herein designated VGAM HOST TARGET GENE, in fact represents a plurality of VGAM1833 host target genes. The mRNA of each one of this plurality of VGAM1833 host target genes comprises one or more host target binding sites, each having a nucleotide sequence which is at least partly complementary to VGAM1833 RNA, herein designated VGAM RNA, and which when bound by VGAM1833 RNA causes inhibition of translation of respective one or more VGAM1833 host target proteins.

It is further appreciated by one skilled in the art that the mode of translational inhibition illustrated by FIG. 1 with specific reference to translational inhibition exerted by VGAM1833 gene, herein designated VGAM GENE, on one or more VGAM1833 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1833 is inhibition of expression of host target genes, as part of a novel viral mechanism of attacking a host. Accordingly, utilities of VGAM1833 include diagnosis, prevention and treatment of viral infection by Camelpox Virus. Specific functions, and accordingly utilities, of VGAM1833 correlate with, and may be deduced from, the identity of the host target genes which VGAM1833 binds and inhibits, and the function of these host target genes, as elaborated hereinbelow.

Nucleotide sequences of the VGAM1833 precursor RNA, herein designated VGAM PRECURSOR RNA, and of the 'diced' VGAM1833 RNA, herein designated VGAM RNA, and a schematic representation of the secondary folding of VGAM1833 folded precursor RNA, herein designated VGAM FOLDED PRECURSOR RNA, of VGAM1833 are further described hereinbelow with reference to Table 1.

Nucleotide sequences of host target binding sites, such as BINDING SITE-I, BINDING SITE-II and BINDING SITE-III of FIG. 1, found on VGAM1833 host target RNA, and schematic representation of the complementarity of each of these host target binding sites to VGAM1833 RNA, herein designated VGAM RNA, are described hereinbelow with reference to Table 2.

As mentioned hereinabove with reference to FIG. 1, a function of VGAM1833 gene, herein designated VGAM is inhibition of expression of VGAM1833 target genes. It is appreciated that specific functions, and accordingly utilities, of VGAM1833 correlate with, and may be deduced from, the identity of the target genes which VGAM1833 binds and inhibits, and the function of these target genes, as elaborated hereinbelow.

Carbonic Anhydrase XII (CA12, Accession NM_001218) is a VGAM1833 host target gene. CA12 BINDING SITE is HOST TARGET binding site found in the 3' untranslated region of mRNA encoded by CA12, corresponding to a HOST TARGET binding site such as BINDING SITE I, BINDING SITE II or BINDING SITE III. Table 2 illustrates the complementarity of the nucleotide sequences of CA12 BINDING SITE, designated SEQ ID:6881, to the nucleotide sequence of VGAM1833 RNA, herein designated VGAM RNA, also designated SEQ ID:4544.

A function of VGAM1833 is therefore inhibition of Carbonic Anhydrase XII (CA12, Accession NM_001218), a gene which functions in cellular transport and metabolic processes. Accordingly, utilities of VGAM1833 include diagnosis, prevention and treatment of diseases and clinical conditions associated with CA12. The function of CA12 and its association with various diseases and clinical conditions, has been established by previous studies, as described hereinabove with reference to VGAM508. Cytoplasmic Linker Associated Protein 2 (CLASP2, Accession XM_035453) is another VGAM1833 host target gene. CLASP2 BINDING SITE is HOST TARGET binding site found in the 3' untranslated region of mRNA encoded by CLASP2, corresponding to a HOST TARGET binding site such as BINDING SITE I, BINDING SITE II or BINDING SITE III. Table 2 illustrates the complementarity of the nucleotide sequences of CLASP2 BINDING SITE, designated SEQ ID:32270, to the nucleotide sequence of VGAM1833 RNA, herein designated VGAM RNA, also designated SEQ ID:4544.

Another function of VGAM1833 is therefore inhibition of Cytoplasmic Linker Associated Protein 2 (CLASP2, Accession XM_035453), a gene which is involved in the regional regulation of microtubule dynamics in motile fibroblasts. Accordingly, utilities of VGAM1833 include diagnosis, prevention and treatment of diseases and clinical conditions associated with CLASP2. The function of CLASP2 and its association with various diseases and clinical conditions, has been established by previous studies, as described hereinabove with reference to VGAM897. G Protein-coupled Receptor 48 (GPR48, Accession NM_018490) is another VGAM1833 host target gene. GPR48 BINDING SITE is HOST TARGET binding site found in the 3' untranslated region of mRNA encoded by GPR48, corresponding to a HOST TARGET binding site such as BINDING SITE I, BINDING SITE II or BINDING SITE III. Table 2 illustrates the complementarity of the nucleotide sequences of GPR48 BINDING SITE, designated SEQ ID:20549, to the nucleotide sequence of VGAM1833 RNA, herein designated VGAM RNA, also designated SEQ ID:4544.

Another function of VGAM1833 is therefore inhibition of G Protein-coupled Receptor 48 (GPR48, Accession NM_018490), a gene which binds to follicle-stimulating hormone and thyroid-stimulating hormone. Accordingly, utilities of VGAM1833 include diagnosis, prevention and treatment of diseases and clinical conditions associated with GPR48. The function of GPR48 and its association with various diseases and clinical conditions, has been established by previous studies, as described hereinabove with reference to VGAM376. Ladinin 1 (LAD1, Accession NM_005558) is another VGAM1833 host target gene. LAD1 BINDING SITE is HOST TARGET binding site found in the 3' untranslated region of mRNA encoded by LAD1, corresponding to a HOST TARGET binding site such as BINDING SITE I, BINDING SITE II or BINDING SITE III. Table 2 illustrates the complementarity of the nucleotide sequences of LAD1 BINDING SITE, designated SEQ ID:12083, to the nucleotide sequence of VGAM1833 RNA, herein designated VGAM RNA, also designated SEQ ID:4544.

Another function of VGAM1833 is therefore inhibition of Ladinin 1 (LAD1, Accession NM_005558). Accordingly, utilities of VGAM1833 include diagnosis, prevention and treatment of diseases and clinical conditions associated with LAD1. Phosphatidylinositol Glycan, Class A (paroxysmal nocturnal hemoglobinuria) (PIGA, Accession NM_020472) is another VGAM1833 host target gene. PIGA BINDING SITE1 and PIGA BINDING SITE2 are HOST TARGET binding sites found in untranslated regions of mRNA encoded by PIGA, corresponding to HOST TARGET binding sites such as BINDING SITE I, BINDING SITE II or BINDING SITE III. Table 2 illustrates the complementarity of the nucleotide sequences of PIGA BINDING SITE1 and PIGA BINDING SITE2, designated SEQ ID:21710 and SEQ ID:21717 respectively, to the nucleotide sequence of VGAM1833 RNA, herein designated VGAM RNA, also designated SEQ ID:4544.

Another function of VGAM1833 is therefore inhibition of Phosphatidylinositol Glycan, Class A (paroxysmal nocturnal hemoglobinuria) (PIGA, Accession NM_020472). Accordingly, utilities of VGAM1833 include diagnosis, prevention and treatment of diseases and clinical conditions associated with PIGA. Exportin 1 (CRM1 homolog, yeast) (XPO1, Accession NM_003400) is another VGAM1833 host target gene. XPO1 BINDING SITE is HOST TARGET binding site found in the 3' untranslated region of mRNA encoded by XPO1, corresponding to a HOST TARGET binding site such as BINDING SITE I, BINDING SITE II or BINDING SITE III. Table 2 illustrates the complementarity of the nucleotide sequences of XPO1 BINDING SITE, designated SEQ ID:9436, to the nucleotide sequence of VGAM1833 RNA, herein designated VGAM RNA, also designated SEQ ID:4544.

Another function of VGAM1833 is therefore inhibition of Exportin 1 (CRM1 homolog, yeast) (XPO1, Accession NM_003400), a gene which is the cell cycle-regulated nuclear export protein 1. Accordingly, utilities of VGAM1833 include diagnosis, prevention and treatment of diseases and clinical conditions associated with XPO1. The function of XPO1 has been established by previous studies. Human CRM1, or XPO1, is the homolog of yeast crm1 (named for 'required for chromosome region maintenance'), a nuclear protein essential for proliferation and chromosome region maintenance. Fornerod et al. (1997) used the oncogenic nucleoporin CAN (OMIM Ref. No. 114350) to coprecipitate human CRM1. The complete cDNA encodes a predicted protein of 1,071 amino acids with a predicted molecular mass of 123 kD. The CRM1 protein migrates at 112 kD. Human CRM1 has 47% identity with S. cerevisiae crm1 and 52% identity with S. pombe crm1+. The N terminus of human CRM1 shares significant homology with the N terminus of importin-beta. Fornerod et al. (1997) identified a group of largely uncharacterized yeast and vertebrate proteins of similar size (110 to 120 kD) that share this homology domain, which they proposed to call the CRIME domain (for 'CRM1, importin-beta, etc.'). Kudo et al. (1997) cloned human CRM1 cDNA using sequence information from EST databases and a PCR-based strategy based on the sequence of S. pombe crm1+. Northern blot analysis using the C-terminal region of human CRM1 cDNA as a probe revealed a major transcript of 5.6 kb expressed in all tissues tested except kidney. Human CRM1 weakly complemented the cold-sensitive mutation of S. pombe crm1-809. Overproduction of human CRM1 suppressed cell proliferation in wildtype S. pombe in an expression level-dependent manner. Overexpression of native S. pombe crm1+ had the same effect. Northern blot analysis with RNAs isolated from synchronized mammalian cells showed that the expression of mammalian CRM1 was initiated in the late G1 phase and reached a peak at G2/M, although the protein level did not change during the cell cycle. Human CRM1 fused to green fluorescent protein (GFP) and transiently expressed in NIH 3T3 cells showed that human CRM1 was localized preferentially in the nuclear envelope, but was also detectable in the nucleoplasm and the cytoplasm. A crm1 mutation of S. pombe caused nuclear import of a GFP fusion protein containing a nuclear export signal (NES) but no change in the distribution of a GFP fusion protein containing a nuclear localization signal (NLS). These data suggested to Kudo et al. (1997) that CRM1 is a novel cell cycle-regulated gene that is essential for the NES-dependent nuclear export of proteins.

Full details of the abovementioned studies are described in the following publications, the disclosure of which are hereby incorporated by reference:

Fornerod, M.; van Duersen, J.; van Baal, S.; Reynolds, A.; Davis, D.; Murti, K. G.; Fransen, J.; Grosveld, G.: The human homologue of yeast CRM1 is in a dynamic subcomplex with CAN/Nup214 and a novel nuclear pore component Nup88. EMBO J. 16:807-816, 1997; and Kudo, N.; Khochbin, S.; Nishi, K.; Kitano, K.; Yanagida, M.; Yoshida, M.; Horinouchi, S.: Molecular cloning and cell cycle-dependent expression of mammalian CRM1, a protein involved in.

Further studies establishing the function and utilities of XPO1 are found in John Hopkins OMIM database record ID 602559, and in sited publications numbered 5912, 12100-633 and 9267 listed in the bibliography section hereinbelow, which are also hereby incorporated by reference. KIAA0368 (Accession XM_036708) is another VGAM1833 host target gene. KIAA0368 BINDING SITE is HOST TARGET binding site found in the 3' untranslated region of mRNA encoded by KIAA0368, corresponding to a HOST TARGET binding site such as BINDING SITE I, BINDING SITE II or BINDING SITE III. Table 2 illustrates the complementarity of the nucleotide sequences of KIAA0368 BINDING SITE, designated SEQ ID:32487, to the nucleotide sequence of VGAM1833 RNA, herein designated VGAM RNA, also designated SEQ ID:4544.

Another function of VGAM1833 is therefore inhibition of KIAA0368 (Accession XM_036708). Accordingly, utilities of VGAM1833 include diagnosis, prevention and treatment of diseases and clinical conditions associated with KIAA0368. KIAA1018 (Accession NM_014967) is another VGAM1833 host target gene. KIAA1018 BINDING SITE is HOST TARGET binding site found in the 3' untranslated region of mRNA encoded by KIAA1018, corresponding to a HOST TARGET binding site such as BINDING SITE I, BINDING SITE II or BINDING SITE III. Table 2 illustrates the complementarity of the nucleotide sequences of KIAA1018 BINDING SITE, designated SEQ ID:17358, to the nucleotide sequence of VGAM1833 RNA, herein designated VGAM RNA, also designated SEQ ID:4544.

Another function of VGAM1833 is therefore inhibition of KIAA1018 (Accession NM_014967). Accordingly, utilities of VGAM1833 include diagnosis, prevention and treatment of diseases and clinical conditions associated with KIAA1018. KIAA1576 (Accession XM_038186) is another VGAM1833 host target gene. KIAA1576 BINDING SITE is HOST TARGET binding site found in the 3' untranslated region of mRNA encoded by KIAA1576, corresponding to a HOST TARGET binding site such as BINDING SITE I, BINDING SITE II or BINDING SITE III. Table 2 illustrates the complementarity of the nucleotide sequences of KIAA1576 BINDING SITE, designated SEQ ID:32769, to the nucleotide sequence of VGAM1833 RNA, herein designated VGAM RNA, also designated SEQ ID:4544.

Another function of VGAM1833 is therefore inhibition of KIAA1576 (Accession XM_038186). Accordingly, utilities of VGAM1833 include diagnosis, prevention and treatment of diseases and clinical conditions associated with KIAA1576. Translocase of Outer Mitochondrial Membrane 70 Homolog A (yeast) (TOMM70A, Accession NM_014820) is another VGAM1833 host target gene. TOMM70A BINDING SITE is HOST TARGET binding site found in the 3' untranslated region of mRNA encoded by TOMM70A, corresponding to a HOST TARGET binding site such as BINDING SITE I, BINDING SITE II or BINDING SITE III. Table 2 illustrates the complementarity of the nucleotide sequences of TOMM70A BINDING SITE, designated SEQ ID:16791, to the nucleotide sequence of VGAM1833 RNA, herein designated VGAM RNA, also designated SEQ ID:4544.

Another function of VGAM1833 is therefore inhibition of Translocase of Outer Mitochondrial Membrane 70 Homolog A (yeast) (TOMM70A, Accession NM_014820). Accordingly, utilities of VGAM1833 include diagnosis, prevention and treatment of diseases and clinical conditions associated with TOMM70A. LOC158527 (Accession XM_088594) is another VGAM1833 host target gene. LOC158527 BINDING SITE is HOST TARGET binding site found in the 5' untranslated region of mRNA encoded by LOC158527, corresponding to a HOST TARGET binding site such as BINDING SITE I, BINDING SITE II or BINDING SITE III. Table 2 illustrates the complementarity of the nucleotide sequences of LOC158527 BINDING SITE, designated SEQ ID:39862, to the nucleotide sequence of VGAM1833 RNA, herein designated VGAM RNA, also designated SEQ ID:4544.

Another function of VGAM1833 is therefore inhibition of LOC158527 (Accession XM_088594). Accordingly, utilities of VGAM1833 include diagnosis, prevention and treatment of diseases and clinical conditions associated with LOC158527. FIG. 1 further provides a conceptual description of a novel bioinformatically detected viral gene of the present invention, referred to here as Viral Genomic Address Messenger 1834 (VGAM1834) viral gene, which modulates expression of respective host target genes thereof, the function and utility of which host target genes is known in the art.

VGAM1834 is a novel bioinformatically detected regulatory, non protein coding, viral micro RNA (miRNA) gene. The method by which VGAM1834 was detected is described hereinabove with reference to FIGS. 1-8.

VGAM1834 gene, herein designated VGAM GENE, is a viral gene contained in the genome of Camelpox Virus. VGAM1834 host target gene, herein designated VGAM HOST TARGET GENE, is a human gene contained in the human genome.

VGAM1834 gene encodes a VGAM1834 precursor RNA, herein designated VGAM PRECURSOR RNA. Similar to other miRNA genes, and unlike most ordinary genes, VGAM1834 precursor RNA does not encode a protein. A nucleotide sequence identical or highly similar to the nucleotide sequence of VGAM1834 precursor RNA is designated SEQ ID:1820, and is provided hereinbelow with reference to the sequence listing part. Nucleotide sequence SEQ ID:1820 is located at position 36702 relative to the genome of Camelpox Virus.

VGAM1834 precursor RNA folds onto itself, forming VGAM1834 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1834 folded precursor RNA into VGAM1834 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1834 RNA is designated SEQ ID:4545, and is provided hereinbelow with reference to the sequence listing part.

VGAM1834 host target gene, herein designated VGAM HOST TARGET GENE, encodes a corresponding messenger RNA, VGAM1834 host target RNA, herein designated VGAM HOST TARGET RNA. VGAM1834 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1834 RNA, herein designated VGAM RNA, binds complementarily to one or more host target binding sites located in untranslated regions of VGAM1834 host target RNA, herein designated VGAM HOST TARGET RNA. This complementary binding is due to the fact that the nucleotide sequence of VGAM1834 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1834 RNA, herein designated VGAM RNA, may have a different number of host target binding sites in untranslated regions of a VGAM1834 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1834 RNA, herein designated VGAM RNA, to host target binding sites on VGAM1834 host target RNA, herein designated VGAM HOST TARGET RNA, such as BINDING SITE I, BINDING SITE II and BINDING SITE III, inhibits translation of VGAM1834 host target RNA into VGAM1834 host target protein, herein designated VGAM HOST TARGET PROTEIN. VGAM host target protein is therefore outlined by a broken line.

It is appreciated that VGAM1834 host target gene, herein designated VGAM HOST TARGET GENE, in fact represents a plurality of VGAM1834 host target genes. The mRNA of each one of this plurality of VGAM1834 host target genes comprises one or more host target binding sites, each having a nucleotide sequence which is at least partly complementary to VGAM1834 RNA, herein designated VGAM RNA, and which when bound by VGAM1834 RNA causes inhibition of translation of respective one or more VGAM1834 host target proteins.

It is further appreciated by one skilled in the art that the mode of translational inhibition illustrated by FIG. 1 with specific reference to translational inhibition exerted by VGAM1834 gene, herein designated VGAM GENE, on one or more VGAM1834 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1834 is inhibition of expression of host target genes, as part of a novel viral mechanism of attacking a host. Accordingly, utilities of VGAM1834 include diagnosis, prevention and treatment of viral infection by Camelpox Virus. Specific functions, and accordingly utilities, of VGAM1834 correlate with, and may be deduced from, the identity of the host target genes which VGAM1834 binds and inhibits, and the function of these host target genes, as elaborated hereinbelow.

Nucleotide sequences of the VGAM1834 precursor RNA, herein designated VGAM PRECURSOR RNA, and of the 'diced' VGAM1834 RNA, herein designated VGAM RNA, and a schematic representation of the secondary folding of VGAM1834 folded precursor RNA, herein designated VGAM FOLDED PRECURSOR RNA, of VGAM1834 are further described hereinbelow with reference to Table 1.

Nucleotide sequences of host target binding sites, such as BINDING SITE-I, BINDING SITE-II and BINDING SITE-III of FIG. 1, found on VGAM1834 host target RNA, and schematic representation of the complementarity of each of these host target binding sites to VGAM1834 RNA, herein designated VGAM RNA, are described hereinbelow with reference to Table 2.

As mentioned hereinabove with reference to FIG. 1, a function of VGAM1834 gene, herein designated VGAM is inhibition of expression of VGAM1834 target genes. It is appreciated that specific functions, and accordingly utilities, of VGAM1834 correlate with, and may be deduced from, the identity of the target genes which VGAM1834 binds and inhibits, and the function of these target genes, as elaborated hereinbelow.

E2F Transcription Factor 3 (E2F3, Accession NM_001949) is a VGAM1834 host target gene. E2F3 BINDING SITE is HOST TARGET binding site found in the 3' untranslated region of mRNA encoded by E2F3, corresponding to a HOST TARGET binding site such as BINDING SITE I, BINDING SITE II or BINDING SITE III. Table 2 illustrates the complementarity of the nucleotide sequences of E2F3 BINDING SITE, designated SEQ ID:7670, to the nucleotide sequence of VGAM1834 RNA, herein designated VGAM RNA, also designated SEQ ID:4545.

A function of VGAM1834 is therefore inhibition of E2F Transcription Factor 3 (E2F3, Accession NM_001949), a gene which binds dna and controls cell-cycle progression from g1 to s phase. Accordingly, utilities of VGAM1834 include diagnosis, prevention and treatment of diseases and clinical conditions associated with E2F3. The function of E2F3 and its association with various diseases and clinical conditions, has been established by previous studies, as described hereinabove with reference to VGAM475. Homeo Box B3 (HOXB3, Accession NM_002146) is another VGAM1834 host target gene. HOXB3 BINDING SITE is HOST TARGET binding site found in the 5' untranslated region of mRNA encoded by HOXB3, corresponding to a HOST TARGET binding site such as BINDING SITE I, BINDING SITE II or BINDING SITE III. Table 2 illustrates the complementarity of the nucleotide sequences of HOXB3 BINDING SITE, designated SEQ ID:7924, to the nucleotide sequence of VGAM1834 RNA, herein designated VGAM RNA, also designated SEQ ID:4545.

Another function of VGAM1834 is therefore inhibition of Homeo Box B3 (HOXB3, Accession NM_002146). Accordingly, utilities of VGAM1834 include diagnosis, prevention and treatment of diseases and clinical conditions associated with HOXB3. Nuclear Receptor Subfamily 1, Group I, Member 2 (NR1I2, Accession NM_003889) is another VGAM1834 host target gene. NR1I2 BINDING SITE is HOST TARGET binding site found in the 5' untranslated region of mRNA encoded by NR1I2, corresponding to a HOST TARGET binding site such as BINDING SITE I, BINDING SITE II or BINDING SITE III. Table 2 illustrates the complementarity of the nucleotide sequences of NR1I2 BINDING SITE, designated SEQ ID:9975, to the nucleotide sequence of VGAM1834 RNA, herein designated VGAM RNA, also designated SEQ ID:4545.

Another function of VGAM1834 is therefore inhibition of Nuclear Receptor Subfamily 1, Group I, Member 2 (NR1I2, Accession NM_003889), a gene which binds to a response element in the cyp3a4 gene promoter and activates its expression in response to a wide variety of endobiotics and xenobiotics. Accordingly, utilities of VGAM1834 include diagnosis, prevention and treatment of diseases and clinical conditions associated with NR1I2. The function of NR1I2 and its association with various diseases and clinical conditions, has been established by previous studies, as described hereinabove with reference to VGAM336. Neural Retina Leucine Zipper (NRL, Accession NM_006177) is another VGAM1834 host target gene. NRL BINDING SITE is HOST TARGET binding site found in the 3' untranslated region of mRNA encoded by NRL, corresponding to a HOST TARGET binding site such as BINDING SITE I, BINDING SITE II or BINDING SITE III. Table 2 illustrates the complementarity of the nucleotide sequences of NRL BINDING SITE, designated SEQ ID:12840, to the nucleotide sequence of VGAM1834 RNA, herein designated VGAM RNA, also designated SEQ ID:4545.

Another function of VGAM1834 is therefore inhibition of Neural Retina Leucine Zipper (NRL, Accession NM_006177), a gene which has a basic motif and a leucine zipper domain similar to jun and fos. Accordingly, utilities of VGAM1834 include diagnosis, prevention and treatment of diseases and clinical conditions associated with NRL. The function of NRL and its association with various diseases and clinical conditions, has been established by previous studies, as described hereinabove with reference to VGAM419. Polycystic Kidney and Hepatic Disease 1 (autosomal recessive) (PKHD1, Accession NM_138694) is another VGAM1834 host target gene. PKHD1 BINDING SITE is HOST TARGET binding site found in the 3' untranslated region of mRNA encoded by PKHD1, corresponding to a HOST TARGET binding site such as BINDING SITE I, BINDING SITE II or BINDING SITE III. Table 2 illustrates the complementarity of the nucleotide sequences of PKHD1 BINDING SITE, designated SEQ ID:28947, to the nucleotide sequence of VGAM1834 RNA, herein designated VGAM RNA, also designated SEQ ID:4545.

Another function of VGAM1834 is therefore inhibition of Polycystic Kidney and Hepatic Disease 1 (autosomal recessive) (PKHD1, Accession NM_138694). Accordingly, utilities of VGAM1834 include diagnosis, prevention and treatment of diseases and clinical conditions associated with PKHD1. Solute Carrier Family 1 (glutamate/neutral amino acid transporter), Member 4 (SLC1A4, Accession NM_003038) is another VGAM1834 host target gene. SLC1A4 BINDING SITE is HOST TARGET binding site found in the 3' untranslated region of mRNA encoded by SLC1A4, corresponding to a HOST TARGET binding site such as BINDING SITE I, BINDING SITE II or BINDING SITE III. Table 2 illustrates the complementarity of the nucleotide sequences of SLC1A4 BINDING SITE, designated SEQ ID:9000, to the nucleotide sequence of VGAM1834 RNA, herein designated VGAM RNA, also designated SEQ ID:4545.

Another function of VGAM1834 is therefore inhibition of Solute Carrier Family 1 (glutamate/neutral amino acid transporter), Member 4 (SLC1A4, Accession NM_003038), a gene which transports alanine, serine, cysteine, and threonine. exhibits sodium dependence. Accordingly, utilities of VGAM1834 include diagnosis, prevention and treatment of diseases and clinical conditions associated with SLC1A4. The function of SLC1A4 and its association with various diseases and clinical conditions, has been established by previous studies, as described hereinabove with reference to VGAM859. BCMP1 (Accession NM_031442) is another VGAM1834 host target gene. BCMP1 BINDING SITE is HOST TARGET binding site found in the 3' untranslated region of mRNA encoded by BCMP1, corresponding to a HOST TARGET binding site such as BINDING SITE I, BINDING SITE II or BINDING SITE III. Table 2 illustrates the complementarity of the nucleotide sequences of BCMP1 BINDING SITE, designated SEQ ID:25460, to the nucleotide sequence of VGAM1834 RNA, herein designated VGAM RNA, also designated SEQ ID:4545.

Another function of VGAM1834 is therefore inhibition of BCMP1 (Accession NM_031442). Accordingly, utilities of VGAM1834 include diagnosis, prevention and treatment of diseases and clinical conditions associated with BCMP1. DIM1 (Accession NM_006701) is another VGAM1834 host target gene. DIM1 BINDING SITE is HOST TARGET binding site found in the 3' untranslated region of mRNA encoded by DIM1, corresponding to a HOST TARGET binding site such as BINDING SITE I, BINDING SITE II or BINDING SITE III. Table 2 illustrates the complementarity of the nucleotide sequences of DIM1 BINDING SITE, designated SEQ ID:13525, to the nucleotide sequence of VGAM1834 RNA, herein designated VGAM RNA, also designated SEQ ID:4545.

Another function of VGAM1834 is therefore inhibition of DIM1 (Accession NM_006701). Accordingly, utilities of VGAM1834 include diagnosis, prevention and treatment of diseases and clinical conditions associated with DIM1. FLJ10738 (Accession NM_018199) is another VGAM1834 host target gene. FLJ10738 BINDING SITE is HOST TARGET binding site found in the 3' untranslated region of mRNA encoded by FLJ10738, corresponding to a HOST TARGET binding site such as BINDING SITE I, BINDING SITE II or BINDING SITE III. Table 2 illustrates the complementarity of the nucleotide sequences of FLJ10738 BINDING SITE, designated SEQ ID:20071, to the nucleotide sequence of VGAM1834 RNA, herein designated VGAM RNA, also designated SEQ ID:4545.

Another function of VGAM1834 is therefore inhibition of FLJ10738 (Accession NM_018199). Accordingly, utilities of VGAM1834 include diagnosis, prevention and treatment of diseases and clinical conditions associated with FLJ10738. KIAA0040 (Accession NM_014656) is another VGAM1834 host target gene. KIAA0040 BINDING SITE is HOST TARGET binding site found in the 3' untranslated region of mRNA encoded by KIAA0040, corresponding to a HOST TARGET binding site such as BINDING SITE I, BINDING SITE II or BINDING SITE III. Table 2 illustrates the complementarity of the nucleotide sequences of KIAA0040 BINDING SITE, designated SEQ ID:16101, to the nucleotide sequence of VGAM1834 RNA, herein designated VGAM RNA, also designated SEQ ID:4545.

Another function of VGAM1834 is therefore inhibition of KIAA0040 (Accession NM_014656). Accordingly, utilities of VGAM1834 include diagnosis, prevention and treatment of diseases and clinical conditions associated with KIAA0040. KIAA0261 (Accession XM_042946) is another VGAM1834 host target gene. KIAA0261 BINDING SITE1 and KIAA0261 BINDING SITE2 are HOST TARGET binding sites found in untranslated regions of mRNA encoded by KIAA0261, corresponding to HOST TARGET binding sites such as BINDING SITE I, BINDING SITE II or BINDING SITE III. Table 2 illustrates the complementarity of the nucleotide sequences of KIAA0261 BINDING SITE1 and KIAA0261 BINDING SITE2, designated SEQ ID:33831 and SEQ ID:33837 respectively, to the nucleotide sequence of VGAM1834 RNA, herein designated VGAM RNA, also designated SEQ ID:4545.

Another function of VGAM1834 is therefore inhibition of KIAA0261 (Accession XM_042946). Accordingly, utilities of VGAM1834 include diagnosis, prevention and treatment of diseases and clinical conditions associated with KIAA0261. LOC149842 (Accession XM_097745) is another VGAM1834 host target gene. LOC149842 BINDING SITE is HOST TARGET binding site found in the 3' untranslated region of mRNA encoded by LOC149842, corresponding to a HOST TARGET binding site such as BINDING SITE I, BINDING SITE II or BINDING SITE III. Table 2 illustrates the complementarity of the nucleotide sequences of LOC149842 BINDING SITE, designated SEQ ID:41093, to the nucleotide sequence of VGAM1834 RNA, herein designated VGAM RNA, also designated SEQ ID:4545.

Another function of VGAM1834 is therefore inhibition of LOC149842 (Accession XM_097745). Accordingly, utilities of VGAM1834 include diagnosis, prevention and treatment of diseases and clinical conditions associated with LOC149842. LOC150967 (Accession XM_087060) is another VGAM1834 host target gene. LOC150967 BINDING SITE is HOST TARGET binding site found in the 3' untranslated region of mRNA encoded by LOC150967, corresponding to a HOST TARGET binding site such as BINDING SITE I, BINDING SITE II or BINDING SITE III. Table 2 illustrates the complementarity of the nucleotide sequences of LOC150967 BINDING SITE, designated SEQ ID:39038, to the nucleotide sequence of VGAM1834 RNA, herein designated VGAM RNA, also designated SEQ ID:4545.

Another function of VGAM1834 is therefore inhibition of LOC150967 (Accession XM_087060). Accordingly, utilities of VGAM1834 include diagnosis, prevention and treatment of diseases and clinical conditions associated with LOC150967. LOC152503 (Accession XM_098238) is another VGAM1834 host target gene. LOC152503 BINDING SITE is HOST TARGET binding site found in the 3' untranslated region of mRNA encoded by LOC152503, corresponding to a HOST TARGET binding site such as BINDING SITE I, BINDING SITE II or BINDING SITE III. Table 2 illustrates the complementarity of the nucleotide sequences of LOC152503 BINDING SITE, designated SEQ ID:41520, to the nucleotide sequence of VGAM1834 RNA, herein designated VGAM RNA, also designated SEQ ID:4545.

Another function of VGAM1834 is therefore inhibition of LOC152503 (Accession XM_098238). Accordingly, utilities of VGAM1834 include diagnosis, prevention and treatment of diseases and clinical conditions associated with LOC152503. LOC221495 (Accession XM_168136) is another VGAM1834 host target gene. LOC221495 BINDING SITE is HOST TARGET binding site found in the 3' untranslated region of mRNA encoded by LOC221495, corresponding to a HOST TARGET binding site such as BINDING SITE I, BINDING SITE II or BINDING SITE III. Table 2 illustrates the complementarity of the nucleotide sequences of LOC221495 BINDING SITE, designated SEQ ID:45063, to the nucleotide sequence of VGAM1834 RNA, herein designated VGAM RNA, also designated SEQ ID:4545.

Another function of VGAM1834 is therefore inhibition of LOC221495 (Accession XM_168136). Accordingly, utilities of VGAM1834 include diagnosis, prevention and treatment of diseases and clinical conditions associated with LOC221495. LOC221935 (Accession XM_166537) is another VGAM1834 host target gene. LOC221935 BINDING SITE is HOST TARGET binding site found in the 3' untranslated region of mRNA encoded by LOC221935, corresponding to a HOST TARGET binding site such as BINDING SITE I, BINDING SITE II or BINDING SITE III. Table 2 illustrates the complementarity of the nucleotide sequences of LOC221935 BINDING SITE, designated SEQ ID:44504, to the nucleotide sequence of VGAM1834 RNA, herein designated VGAM RNA, also designated SEQ ID:4545.

Another function of VGAM1834 is therefore inhibition of LOC221935 (Accession XM_166537). Accordingly, utilities of VGAM1834 include diagnosis, prevention and treatment of diseases and clinical conditions associated with LOC221935. LOC254100 (Accession XM_172851) is another VGAM1834 host target gene. LOC254100 BINDING SITE is HOST TARGET binding site found in the 3' untranslated region of mRNA encoded by LOC254100, corresponding to a HOST TARGET binding site such as BINDING SITE I, BINDING SITE II or BINDING SITE III. Table 2 illustrates the complementarity of the nucleotide sequences of LOC254100 BINDING SITE, designated SEQ ID:46129, to the nucleotide sequence of VGAM1834 RNA, herein designated VGAM RNA, also designated SEQ ID:4545.

Another function of VGAM1834 is therefore inhibition of LOC254100 (Accession XM_172851). Accordingly, utilities of VGAM1834 include diagnosis, prevention and treatment of diseases and clinical conditions associated with LOC254100. FIG. 1 further provides a conceptual description of a novel bioinformatically detected viral gene of the present invention, referred to here as Viral Genomic Address Messenger 1835 (VGAM1835) viral gene, which modulates expression of respective host target genes thereof, the function and utility of which host target genes is known in the art.

VGAM1835 is a novel bioinformatically detected regulatory, non protein coding, viral micro RNA (miRNA) gene. The method by which VGAM1835 was detected is described hereinabove with reference to FIGS. 1-8.

VGAM1835 gene, herein designated VGAM GENE, is a viral gene contained in the genome of Fowlpox Virus. VGAM1835 host target gene, herein designated VGAM HOST TARGET GENE, is a human gene contained in the human genome.

VGAM1835 gene encodes a VGAM1835 precursor RNA, herein designated VGAM PRECURSOR RNA. Similar to other miRNA genes, and unlike most ordinary genes, VGAM1835 precursor RNA does not encode a protein. A nucleotide sequence identical or highly similar to the nucleotide sequence of VGAM1835 precursor RNA is designated SEQ ID:1821, and is provided hereinbelow with reference to the sequence listing part. Nucleotide sequence SEQ ID:1821 is located at position 136546 relative to the genome of Fowlpox Virus.

VGAM1835 precursor RNA folds onto itself, forming VGAM1835 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1835 folded precursor RNA into VGAM1835 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1835 RNA is designated SEQ ID:4546, and is provided hereinbelow with reference to the sequence listing part.

VGAM1835 host target gene, herein designated VGAM HOST TARGET GENE, encodes a corresponding messenger RNA, VGAM1835 host target RNA, herein designated VGAM HOST TARGET RNA. VGAM1835 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1835 RNA, herein designated VGAM RNA, binds complementarily to one or more host target binding sites located in untranslated regions of VGAM1835 host target RNA, herein designated VGAM HOST TARGET RNA. This complementary binding is due to the fact that the nucleotide sequence of VGAM1835 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1835 RNA, herein designated VGAM RNA, may have a different number of host target binding sites in untranslated regions of a VGAM1835 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1835 RNA, herein designated VGAM RNA, to host target binding sites on VGAM1835 host target RNA, herein designated VGAM HOST TARGET RNA, such as BINDING SITE I, BINDING SITE II and BINDING SITE III, inhibits translation of VGAM1835 host target RNA into VGAM1835 host target protein, herein designated VGAM HOST TARGET PROTEIN. VGAM host target protein is therefore outlined by a broken line.

It is appreciated that VGAM1835 host target gene, herein designated VGAM HOST TARGET GENE, in fact represents a plurality of VGAM1835 host target genes. The mRNA of each one of this plurality of VGAM1835 host target genes comprises one or more host target binding sites, each having a nucleotide sequence which is at least partly complementary to VGAM1835 RNA, herein designated VGAM RNA, and which when bound by VGAM1835 RNA causes inhibition of translation of respective one or more VGAM1835 host target proteins.

It is further appreciated by one skilled in the art that the mode of translational inhibition illustrated by FIG. 1 with specific reference to translational inhibition exerted by VGAM1835 gene, herein designated VGAM GENE, on one or more VGAM1835 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1835 is inhibition of expression of host target genes, as part of a novel viral mechanism of attacking a host. Accordingly, utilities of VGAM1835 include diagnosis, prevention and treatment of viral infection by Fowlpox Virus. Specific functions, and accordingly utilities, of VGAM1835 correlate with, and may be deduced from, the identity of the host target genes which VGAM1835 binds and inhibits, and the function of these host target genes, as elaborated hereinbelow.

Nucleotide sequences of the VGAM1835 precursor RNA, herein designated VGAM PRECURSOR RNA, and of the 'diced' VGAM1835 RNA, herein designated VGAM RNA, and a schematic representation of the secondary folding of VGAM1835 folded precursor RNA, herein designated VGAM FOLDED PRECURSOR RNA, of VGAM1835 are further described hereinbelow with reference to Table 1.

Nucleotide sequences of host target binding sites, such as BINDING SITE-I, BINDING SITE-II and BINDING SITE-III of FIG. 1, found on VGAM1835 host target RNA, and schematic representation of the complementarity of each of these host target binding sites to VGAM1835 RNA, herein designated VGAM RNA, are described hereinbelow with reference to Table 2.

As mentioned hereinabove with reference to FIG. 1, a function of VGAM1835 gene, herein designated VGAM is inhibition of expression of VGAM1835 target genes. It is appreciated that specific functions, and accordingly utilities, of VGAM1835 correlate with, and may be deduced from, the identity of the target genes which VGAM1835 binds and inhibits, and the function of these target genes, as elaborated hereinbelow.

Dihydropyrimidinase-like 3 (DPYSL3, Accession NM_001387) is a VGAM1835 host target gene. DPYSL3 BINDING SITE is HOST TARGET binding site found in the 3' untranslated region of mRNA encoded by DPYSL3, corresponding to a HOST TARGET binding site such as BINDING SITE I, BINDING SITE II or BINDING SITE III. Table 2 illustrates the complementarity of the nucleotide sequences of DPYSL3 BINDING SITE, designated SEQ ID:7068, to the nucleotide sequence of VGAM1835 RNA, herein designated VGAM RNA, also designated SEQ ID:4546.

A function of VGAM1835 is therefore inhibition of Dihydropyrimidinase-like 3 (DPYSL3, Accession NM_001387), a gene which is a member of the dihydropyrimidinase family. Accordingly, utilities of VGAM1835 include diagnosis, prevention and treatment of diseases and clinical conditions associated with DPYSL3. The function of DPYSL3 and its association with various diseases and clinical conditions, has been established by previous studies, as described hereinabove with reference to VGAM24. FIG. 1 further provides a conceptual description of a novel bioinformatically detected viral gene of the present invention, referred to here as Viral Genomic Address Messenger 1836 (VGAM1836) viral gene, which modulates expression of respective host target genes thereof, the function and utility of which host target genes is known in the art.

VGAM1836 is a novel bioinformatically detected regulatory, non protein coding, viral micro RNA (miRNA) gene. The method by which VGAM1836 was detected is described hereinabove with reference to FIGS. 1-8.

VGAM1836 gene, herein designated VGAM GENE, is a viral gene contained in the genome of Fowlpox Virus. VGAM1836 host target gene, herein designated VGAM HOST TARGET GENE, is a human gene contained in the human genome.

VGAM1836 gene encodes a VGAM1836 precursor RNA, herein designated VGAM PRECURSOR RNA. Similar to other miRNA genes, and unlike most ordinary genes, VGAM1836 precursor RNA does not encode a protein. A nucleotide sequence identical or highly similar to the nucleotide sequence of VGAM1836 precursor RNA is designated SEQ ID:1822, and is provided hereinbelow with reference to the sequence listing part. Nucleotide sequence SEQ ID:1822 is located at position 140071 relative to the genome of Fowlpox Virus.

VGAM1836 precursor RNA folds onto itself, forming VGAM1836 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1836 folded precursor RNA into VGAM1836 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1836 RNA is designated SEQ ID:4547, and is provided hereinbelow with reference to the sequence listing part.

VGAM1836 host target gene, herein designated VGAM HOST TARGET GENE, encodes a corresponding messenger RNA, VGAM1836 host target RNA, herein designated VGAM HOST TARGET RNA. VGAM1836 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1836 RNA, herein designated VGAM RNA, binds complementarily to one or more host target binding sites located in untranslated regions of VGAM1836 host target RNA, herein designated VGAM HOST TARGET RNA. This complementary binding is due to the fact that the nucleotide sequence of VGAM1836 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1836 RNA, herein designated VGAM RNA, may have a different number of host target binding sites in untranslated regions of a VGAM1836 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1836 RNA, herein designated VGAM RNA, to host target binding sites on VGAM1836 host target RNA, herein designated VGAM HOST TARGET RNA, such as BINDING SITE I, BINDING SITE II and BINDING SITE III, inhibits translation of VGAM1836 host target RNA into VGAM1836 host target protein, herein designated VGAM HOST TARGET PROTEIN. VGAM host target protein is therefore outlined by a broken line.

It is appreciated that VGAM1836 host target gene, herein designated VGAM HOST TARGET GENE, in fact represents a plurality of VGAM1836 host target genes. The mRNA of each one of this plurality of VGAM1836 host target genes comprises one or more host target binding sites, each having a nucleotide sequence which is at least partly complementary to VGAM1836 RNA, herein designated VGAM RNA, and which when bound by VGAM1836 RNA causes inhibition of translation of respective one or more VGAM1836 host target proteins.

It is further appreciated by one skilled in the art that the mode of translational inhibition illustrated by FIG. 1 with specific reference to translational inhibition exerted by VGAM1836 gene, herein designated VGAM GENE, on one or more VGAM1836 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1836 is inhibition of expression of host target genes, as part of a novel viral mechanism of attacking a host. Accordingly, utilities of VGAM1836 include diagnosis, prevention and treatment of viral infection by Fowlpox Virus. Specific functions, and accordingly utilities, of VGAM1836 correlate with, and may be deduced from, the identity of the host target genes which VGAM1836 binds and inhibits, and the function of these host target genes, as elaborated hereinbelow.

Nucleotide sequences of the VGAM1836 precursor RNA, herein designated VGAM PRECURSOR RNA, and of the 'diced' VGAM1836 RNA, herein designated VGAM RNA, and a schematic representation of the secondary folding of VGAM1836 folded precursor RNA, herein designated VGAM FOLDED PRECURSOR RNA, of VGAM1836 are further described hereinbelow with reference to Table 1.

Nucleotide sequences of host target binding sites, such as BINDING SITE-I, BINDING SITE-II and BINDING SITE-III of FIG. 1, found on VGAM1836 host target RNA, and schematic representation of the complementarity of each of these host target binding sites to VGAM1836 RNA, herein designated VGAM RNA, are described hereinbelow with reference to Table 2.

As mentioned hereinabove with reference to FIG. 1, a function of VGAM1836 gene, herein designated VGAM is inhibition of expression of VGAM1836 target genes. It is appreciated that specific functions, and accordingly utilities, of VGAM1836 correlate with, and may be deduced from, the identity of the target genes which VGAM1836 binds and inhibits, and the function of these target genes, as elaborated hereinbelow.

KIAA1856 (Accession XM_166549) is a VGAM1836 host target gene. KIAA1856 BINDING SITE is HOST TARGET binding site found in the 3' untranslated region of mRNA encoded by KIAA1856, corresponding to a HOST TARGET binding site such as BINDING SITE I, BINDING SITE II or BINDING SITE III. Table 2 illustrates the complementarity of the nucleotide sequences of KIAA1856 BINDING SITE, designated SEQ ID:44526, to the nucleotide sequence of VGAM1836 RNA, herein designated VGAM RNA, also designated SEQ ID:4547.

A function of VGAM1836 is therefore inhibition of KIAA1856 (Accession XM_166549). Accordingly, utilities of VGAM1836 include diagnosis, prevention and treatment of diseases and clinical conditions associated with KIAA1856. FIG. 1 further provides a conceptual description of a novel bioinformatically detected viral gene of the present invention, referred to here as Viral Genomic Address Messenger 1837 (VGAM1837) viral gene, which modulates expression of respective host target genes thereof, the function and utility of which host target genes is known in the art.

VGAM1837 is a novel bioinformatically detected regulatory, non protein coding, viral micro RNA (miRNA) gene. The method by which VGAM1837 was detected is described hereinabove with reference to FIGS. 1-8.

VGAM1837 gene, herein designated VGAM GENE, is a viral gene contained in the genome of Fowlpox Virus. VGAM1837 host target gene, herein designated VGAM HOST TARGET GENE, is a human gene contained in the human genome.

VGAM1837 gene encodes a VGAM1837 precursor RNA, herein designated VGAM PRECURSOR RNA. Similar to other miRNA genes, and unlike most ordinary genes, VGAM1837 precursor RNA does not encode a protein. A nucleotide sequence identical or highly similar to the nucleotide sequence of VGAM1837 precursor RNA is designated SEQ ID:1823, and is provided hereinbelow with reference to the sequence listing part. Nucleotide sequence SEQ ID:1823 is located at position 133890 relative to the genome of Fowlpox Virus.

VGAM1837 precursor RNA folds onto itself, forming VGAM1837 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1837 folded precursor RNA into VGAM1837 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1837 RNA is designated SEQ ID:4548, and is provided hereinbelow with reference to the sequence listing part.

VGAM1837 host target gene, herein designated VGAM HOST TARGET GENE, encodes a corresponding messenger RNA, VGAM1837 host target RNA, herein designated VGAM HOST TARGET RNA. VGAM1837 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1837 RNA, herein designated VGAM RNA, binds complementarily to one or more host target binding sites located in untranslated regions of VGAM1837 host target RNA, herein designated VGAM HOST TARGET RNA. This complementary binding is due to the fact that the nucleotide sequence of VGAM1837 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1837 RNA, herein designated VGAM RNA, may have a different number of host target binding sites in untranslated regions of a VGAM1837 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1837 RNA, herein designated VGAM RNA, to host target binding sites on VGAM1837 host target RNA, herein designated VGAM HOST TARGET RNA, such as BINDING SITE I, BINDING SITE II and BINDING SITE III, inhibits translation of VGAM1837 host target RNA into VGAM1837 host target protein, herein designated VGAM HOST TARGET PROTEIN. VGAM host target protein is therefore outlined by a broken line.

It is appreciated that VGAM1837 host target gene, herein designated VGAM HOST TARGET GENE, in fact represents a plurality of VGAM1837 host target genes. The mRNA of each one of this plurality of VGAM1837 host target genes comprises one or more host target binding sites, each having a nucleotide sequence which is at least partly complementary to VGAM1837 RNA, herein designated VGAM RNA, and which when bound by VGAM1837 RNA causes inhibition of translation of respective one or more VGAM1837 host target proteins.

It is further appreciated by one skilled in the art that the mode of translational inhibition illustrated by FIG. 1 with specific reference to translational inhibition exerted by VGAM1837 gene, herein designated VGAM GENE, on one or more VGAM1837 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let- 7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1837 is inhibition of expression of host target genes, as part of a novel viral mechanism of attacking a host. Accordingly, utilities of VGAM1837 include diagnosis, prevention and treatment of viral infection by Fowlpox Virus. Specific functions, and accordingly utilities, of VGAM1837 correlate with, and may be deduced from, the identity of the host target genes which VGAM1837 binds and inhibits, and the function of these host target genes, as elaborated hereinbelow.

Nucleotide sequences of the VGAM1837 precursor RNA, herein designated VGAM PRECURSOR RNA, and of the 'diced' VGAM1837 RNA, herein designated VGAM RNA, and a schematic representation of the secondary folding of VGAM1837 folded precursor RNA, herein designated VGAM FOLDED PRECURSOR RNA, of VGAM1837 are further described hereinbelow with reference to Table 1.

Nucleotide sequences of host target binding sites, such as BINDING SITE-I, BINDING SITE-II and BINDING SITE-III of FIG. 1, found on VGAM1837 host target RNA, and schematic representation of the complementarity of each of these host target binding sites to VGAM1837 RNA, herein designated VGAM RNA, are described hereinbelow with reference to Table 2.

As mentioned hereinabove with reference to FIG. 1, a function of VGAM1837 gene, herein designated VGAM is inhibition of expression of VGAM1837 target genes. It is appreciated that specific functions, and accordingly utilities, of VGAM1837 correlate with, and may be deduced from, the identity of the target genes which VGAM1837 binds and inhibits, and the function of these target genes, as elaborated hereinbelow.

Contactin Associated Protein-like 2 (CNTNAP2, Accession NM_014141) is a VGAM1837 host target gene. CNTNAP2 BINDING SITE is HOST TARGET binding site found in the 3' untranslated region of mRNA encoded by CNTNAP2, corresponding to a HOST TARGET binding site such as BINDING SITE I, BINDING SITE II or BINDING SITE III. Table 2 illustrates the complementarity of the nucleotide sequences of CNTNAP2 BINDING SITE, designated SEQ ID:15413, to the nucleotide sequence of VGAM1837 RNA, herein designated VGAM RNA, also designated SEQ ID:4548.

A function of VGAM1837 is therefore inhibition of Contactin Associated Protein-like 2 (CNTNAP2, Accession NM_014141). Accordingly, utilities of VGAM1837 include diagnosis, prevention and treatment of diseases and clinical conditions associated with CNTNAP2. G Protein-coupled Receptor 65 (GPR65, Accession XM_007392) is another VGAM1837 host target gene. GPR65 BINDING SITE is HOST TARGET binding site found in the 5' untranslated region of mRNA encoded by GPR65, corresponding to a HOST TARGET binding site such as BINDING SITE I, BINDING SITE II or BINDING SITE III. Table 2 illustrates the complementarity of the nucleotide sequences of GPR65 BINDING SITE, designated SEQ ID:30051, to the nucleotide sequence of VGAM1837 RNA, herein designated VGAM RNA, also designated SEQ ID:4548.

Another function of VGAM1837 is therefore inhibition of G Protein-coupled Receptor 65 (GPR65, Accession XM_007392). Accordingly, utilities of VGAM1837 include diagnosis, prevention and treatment of diseases and clinical conditions associated with GPR65. Neurexin 1 (NRXN1, Accession NM_138735) is another VGAM1837 host target gene. NRXN1 BINDING SITE1 and NRXN1 BINDING SITE2 are HOST TARGET binding sites found in untranslated regions of mRNA encoded by NRXN1, corresponding to HOST TARGET binding sites such as BINDING SITE I, BINDING SITE II or BINDING SITE III. Table 2 illustrates the complementarity of the nucleotide sequences of NRXN1 BINDING SITE1 and NRXN1 BINDING SITE2, designated SEQ ID:28992 and SEQ ID:11221 respectively, to the nucleotide sequence of VGAM1837 RNA, herein designated VGAM RNA, also designated SEQ ID:4548.

Another function of VGAM1837 is therefore inhibition of Neurexin 1 (NRXN1, Accession NM_138735), a gene which may be involved in cell recognition, cell adhesion, and mediate intracellular signaling. Accordingly, utilities of VGAM1837 include diagnosis, prevention and treatment of diseases and clinical conditions associated with NRXN1. The function of NRXN1 and its association with various diseases and clinical conditions, has been established by previous studies, as described hereinabove with reference to VGAM191. Ectonucleotide Pyrophosphatase/phosphodiesterase 4 (putative function) (ENPP4, Accession NM_014936) is another VGAM1837 host target gene. ENPP4 BINDING SITE is HOST TARGET binding site found in the 3' untranslated region of mRNA encoded by ENPP4, corresponding to a HOST TARGET binding site such as BINDING SITE I, BINDING SITE II or BINDING SITE III. Table 2 illustrates the complementarity of the nucleotide sequences of ENPP4 BINDING SITE, designated SEQ ID:17239, to the nucleotide sequence of VGAM1837 RNA, herein designated VGAM RNA, also designated SEQ ID:4548.

Another function of VGAM1837 is therefore inhibition of Ectonucleotide Pyrophosphatase/phosphodiesterase 4 (putative function) (ENPP4, Accession NM_014936). Accordingly, utilities of VGAM1837 include diagnosis, prevention and treatment of diseases and clinical conditions associated with ENPP4. LOC148824 (Accession XM_097527) is another VGAM1837 host target gene. LOC148824 BINDING SITE is HOST TARGET binding site found in the 3' untranslated region of mRNA encoded by LOC148824, corresponding to a HOST TARGET binding site such as BINDING SITE I, BINDING SITE II or BINDING SITE III. Table 2 illustrates the complementarity of the nucleotide sequences of LOC148824 BINDING SITE, designated SEQ ID:40909, to the nucleotide sequence of VGAM1837 RNA, herein designated VGAM RNA, also designated SEQ ID:4548.

Another function of VGAM1837 is therefore inhibition of LOC148824 (Accession XM_097527). Accordingly, utilities of VGAM1837 include diagnosis, prevention and treatment of diseases and clinical conditions associated with LOC148824. LOC153711 (Accession XM_098419) is another VGAM1837 host target gene. LOC153711 BINDING SITE is HOST TARGET binding site found in the 3' untranslated region of mRNA encoded by LOC153711, corresponding to a HOST TARGET binding site such as BINDING SITE I, BINDING SITE II or BINDING SITE III. Table 2 illustrates the complementarity of the nucleotide sequences of LOC153711 BINDING SITE, designated SEQ ID:41665, to the nucleotide sequence of VGAM1837 RNA, herein designated VGAM RNA, also designated SEQ ID:4548.

Another function of VGAM1837 is therefore inhibition of LOC153711 (Accession XM_098419). Accordingly, utilities of VGAM1837 include diagnosis, prevention and treatment of diseases and clinical conditions associated with LOC153711. LOC253664 (Accession XM_170673) is another VGAM1837 host target gene. LOC253664 BINDING SITE is HOST TARGET binding site found in the 5' untranslated region of mRNA encoded by LOC253664, corresponding to a HOST TARGET binding site such as BINDING SITE I, BINDING SITE II or BINDING SITE III. Table 2 illustrates the complementarity of the nucleotide sequences of LOC253664 BINDING SITE, designated SEQ ID:45446, to the nucleotide sequence of VGAM1837 RNA, herein designated VGAM RNA, also designated SEQ ID:4548.

Another function of VGAM1837 is therefore inhibition of LOC253664 (Accession XM_170673). Accordingly, utilities of VGAM1837 include diagnosis, prevention and treatment of diseases and clinical conditions associated with LOC253664. FIG. 1 further provides a conceptual description of a novel bioinformatically detected viral gene of the present invention, referred to here as Viral Genomic Address Messenger 1838 (VGAM1838) viral gene, which modulates expression of respective host target genes thereof, the function and utility of which host target genes is known in the art.

VGAM1838 is a novel bioinformatically detected regulatory, non protein coding, viral micro RNA (miRNA) gene. The method by which VGAM1838 was detected is described hereinabove with reference to FIGS. 1-8.

VGAM1838 gene, herein designated VGAM GENE, is a viral gene contained in the genome of Fowlpox Virus. VGAM1838 host target gene, herein designated VGAM HOST TARGET GENE, is a human gene contained in the human genome.

VGAM1838 gene encodes a VGAM1838 precursor RNA, herein designated VGAM PRECURSOR RNA. Similar to other miRNA genes, and unlike most ordinary genes, VGAM1838 precursor RNA does not encode a protein. A nucleotide sequence identical or highly similar to the nucleotide sequence of VGAM1838 precursor RNA is designated SEQ ID:1824, and is provided hereinbelow with reference to the sequence listing part. Nucleotide sequence SEQ ID:1824 is located at position 131052 relative to the genome of Fowlpox Virus.

VGAM1838 precursor RNA folds onto itself, forming VGAM1838 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1838 folded precursor RNA into VGAM1838 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM1838 RNA is designated SEQ ID:4549, and is provided hereinbelow with reference to the sequence listing part.

VGAM1838 host target gene, herein designated VGAM HOST TARGET GENE, encodes a corresponding messenger RNA, VGAM1838 host target RNA, herein designated VGAM HOST TARGET RNA. VGAM1838 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1838 RNA, herein designated VGAM RNA, binds complementarily to one or more host target binding sites located in untranslated regions of VGAM1838 host target RNA, herein designated VGAM HOST TARGET RNA. This complementary binding is due to the fact that the nucleotide sequence of VGAM1838 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1838 RNA, herein designated VGAM RNA, may have a different number of host target binding sites in untranslated regions of a VGAM1838 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1838 RNA, herein designated VGAM RNA, to host target binding sites on VGAM1838 host target RNA, herein designated VGAM HOST TARGET RNA, such as BINDING SITE I, BINDING SITE II and BINDING SITE III, inhibits translation of VGAM1838 host target RNA into VGAM1838 host target protein, herein designated VGAM HOST TARGET PROTEIN. VGAM host target protein is therefore outlined by a broken line.

It is appreciated that VGAM1838 host target gene, herein designated VGAM HOST TARGET GENE, in fact represents a plurality of VGAM1838 host target genes. The mRNA of each one of this plurality of VGAM1838 host target genes comprises one or more host target binding sites, each having a nucleotide sequence which is at least partly complementary to VGAM1838 RNA, herein designated VGAM RNA, and which when bound by VGAM1838 RNA causes inhibition of translation of respective one or more VGAM1838 host target proteins.

It is further appreciated by one skilled in the art that the mode of translational inhibition illustrated by FIG. 1 with specific reference to translational inhibition exerted by VGAM1838 gene, herein designated VGAM GENE, on one or more VGAM1838 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1838 is inhibition of expression of host target genes, as part of a novel viral mechanism of attacking a host. Accordingly, utilities of VGAM1838 include diagnosis, prevention and treatment of viral infection by Fowlpox Virus. Specific functions, and accordingly utilities, of VGAM1838 correlate with, and may be deduced from, the identity of the host target genes which VGAM1838 binds and inhibits, and the function of these host target genes, as elaborated hereinbelow.

Nucleotide sequences of the VGAM1838 precursor RNA, herein designated VGAM PRECURSOR RNA, and of the 'diced' VGAM1838 RNA, herein designated VGAM RNA, and a schematic representation of the secondary folding of VGAM1838 folded precursor RNA, herein designated VGAM FOLDED PRECURSOR RNA, of VGAM1838 are further described hereinbelow with reference to Table 1.

Nucleotide sequences of host target binding sites, such as BINDING SITE-I, BINDING SITE-II and BINDING SITE-III of FIG. 1, found on VGAM1838 host target RNA, and schematic representation of the complementarity of each of these host target binding sites to VGAM1838 RNA, herein designated VGAM RNA, are described hereinbelow with reference to Table 2.

As mentioned hereinabove with reference to FIG. 1, a function of VGAM1838 gene, herein designated VGAM is inhibition of expression of VGAM1838 target genes. It is appreciated that specific functions, and accordingly utilities, of VGAM1838 correlate with, and may be deduced from, the identity of the target genes which VGAM1838 binds and inhibits, and the function of these target genes, as elaborated hereinbelow.

Amylo-1, 6-glucosidase, 4-alpha-glucanotransferase (glycogen debranching enzyme, glycogen storage disease type III) (AGL, Accession NM_000028) is a VGAM1838 host target gene. AGL BINDING SITE1 through AGL BINDING SITE6 are HOST TARGET binding sites found in untranslated regions of mRNA encoded by AGL, corresponding to HOST TARGET binding sites such as BINDING SITE I, BINDING SITE II or BINDING SITE III. Table 2 illustrates the complementarity of the nucleotide sequences of AGL BINDING SITE1 through AGL BINDING SITE6, designated SEQ ID:5466, SEQ ID:6305, SEQ ID:6298, SEQ ID:6293, SEQ ID:6288 and SEQ ID:6283 respectively, to the nucleotide sequence of VGAM1838 RNA, herein designated VGAM RNA, also designated SEQ ID:4549.

A function of VGAM1838 is therefore inhibition of Amylo-1, 6-glucosidase, 4-alpha-glucanotransferase (glycogen debranching enzyme, glycogen storage disease type III) (AGL, Accession NM_000028). Accordingly, utilities of VGAM1838 include diagnosis, prevention and treatment of diseases and clinical conditions associated with AGL. Syntrophin, Gamma 1 (SNTG1, Accession NM_018967) is another VGAM1838 host target gene. SNTG1 BINDING SITE is HOST TARGET binding site found in the 3' untranslated region of mRNA encoded by SNTG1, corresponding to a HOST TARGET binding site such as BINDING SITE I, BINDING SITE II or BINDING SITE III. Table 2 illustrates the complementarity of the nucleotide sequences of SNTG1 BINDING SITE, designated SEQ ID:21039, to the nucleotide sequence of VGAM1838 RNA, herein designated VGAM RNA, also designated SEQ ID:4549.

Another function of VGAM1838 is therefore inhibition of Syntrophin, Gamma 1 (SNTG1, Accession NM_018967). Accordingly, utilities of VGAM1838 include diagnosis, prevention and treatment of diseases and clinical conditions associated with SNTG1. LOC133686 (Accession XM_059667) is another VGAM1838 host target gene. LOC133686 BINDING SITE is HOST TARGET binding site found in the 3' untranslated region of mRNA encoded by LOC133686, corresponding to a HOST TARGET binding site such as BINDING SITE I, BINDING SITE II or BINDING SITE III. Table 2 illustrates the complementarity of the nucleotide sequences of LOC133686 BINDING SITE, designated SEQ ID:37052, to the nucleotide sequence of VGAM1838 RNA, herein designated VGAM RNA, also designated SEQ ID:4549.

Another function of VGAM1838 is therefore inhibition of LOC133686 (Accession XM_059667). Accordingly, utilities of VGAM1838 include diagnosis, prevention and treatment of diseases and clinical conditions associated with LOC133686. LOC91301 (Accession XM_037564) is another VGAM1838 host target gene. LOC91301 BINDING SITE is HOST TARGET binding site found in the 5' untranslated region of mRNA encoded by LOC91301, corresponding to a HOST TARGET binding site such as BINDING SITE I, BINDING SITE II or BINDING SITE III. Table 2 illustrates the complementarity of the nucleotide sequences of LOC91301 BINDING SITE, designated SEQ ID:32649, to the nucleotide sequence of VGAM1838 RNA, herein designated VGAM RNA, also designated SEQ ID:4549.

Another function of VGAM1838 is therefore inhibition of LOC91301 (Accession XM_037564). Accordingly, utilities of VGAM1838 include diagnosis, prevention and treatment of diseases and clinical conditions associated with LOC91301. FIG. 1 further provides a conceptual description of a novel bioinformatically detected viral gene of the present invention, referred to here as Viral Genomic Address Messenger 1839 (VGAM1839) viral gene, which modulates expression of respective host target genes thereof, the function and utility of which host target genes is known in the art.

VGAM1839 is a novel bioinformatically detected regulatory, non protein coding, viral micro RNA (miRNA) gene. The method by which VGAM1839 was detected is described hereinabove with reference to FIGS. 1-8.

VGAM1839 gene, herein designated VGAM GENE, is a viral gene contained in the genome of Fowlpox Virus. VGAM1839 host target gene, herein designated VGAM HOST TARGET GENE, is a human gene contained in the human genome.

VGAM1839 gene encodes a VGAM1839 precursor RNA, herein designated VGAM PRECURSOR RNA. Similar to other miRNA genes, and unlike most ordinary genes, VGAM1839 precursor RNA does not encode a protein. A nucleotide sequence identical or highly similar to the nucleotide sequence of VGAM1839 precursor RNA is designated SEQ ID:1825, and is provided hereinbelow with reference to the sequence listing part. Nucleotide sequence SEQ ID:1825 is located at position 139769 relative to the genome of Fowlpox Virus.

VGAM1839 precursor RNA folds onto itself, forming VGAM1839 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1839 folded precursor RNA into VGAM1839 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1839 RNA is designated SEQ ID:4550, and is provided hereinbelow with reference to the sequence listing part.

VGAM1839 host target gene, herein designated VGAM HOST TARGET GENE, encodes a corresponding messenger RNA, VGAM1839 host target RNA, herein designated VGAM HOST TARGET RNA. VGAM1839 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1839 RNA, herein designated VGAM RNA, binds complementarily to one or more host target binding sites located in untranslated regions of VGAM1839 host target RNA, herein designated VGAM HOST TARGET RNA. This complementary binding is due to the fact that the nucleotide sequence of VGAM1839 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1839 RNA, herein designated VGAM RNA, may have a different number of host target binding sites in untranslated regions of a VGAM1839 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1839 RNA, herein designated VGAM RNA, to host target binding sites on VGAM1839 host target RNA, herein designated VGAM HOST TARGET RNA, such as BINDING SITE I, BINDING SITE II and BINDING SITE III, inhibits translation of VGAM1839 host target RNA into VGAM1839 host target protein, herein designated VGAM HOST TARGET PROTEIN. VGAM host target protein is therefore outlined by a broken line.

It is appreciated that VGAM1839 host target gene, herein designated VGAM HOST TARGET GENE, in fact represents a plurality of VGAM1839 host target genes. The mRNA of each one of this plurality of VGAM1839 host target genes comprises one or more host target binding sites, each having a nucleotide sequence which is at least partly complementary to VGAM1839 RNA, herein designated VGAM RNA, and which when bound by VGAM1839 RNA causes inhibition of translation of respective one or more VGAM1839 host target proteins.

It is further appreciated by one skilled in the art that the mode of translational inhibition illustrated by FIG. 1 with specific reference to translational inhibition exerted by VGAM1839 gene, herein designated VGAM GENE, on one or more VGAM1839 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1839 is inhibition of expression of host target genes, as part of a novel viral mechanism of attacking a host. Accordingly, utilities of VGAM1839 include diagnosis, prevention and treatment of viral infection by Fowlpox Virus. Specific functions, and accordingly utilities, of VGAM1839 correlate with, and may be deduced from, the identity of the host target genes which VGAM1839 binds and inhibits, and the function of these target genes, as elaborated hereinbelow.

Nucleotide sequences of the VGAM1839 precursor RNA, herein designated VGAM PRECURSOR RNA, and of the 'diced' VGAM1839 RNA, herein designated VGAM RNA, and a schematic representation of the secondary folding of VGAM1839 folded precursor RNA, herein designated VGAM FOLDED PRECURSOR RNA, of VGAM1839 are further described hereinbelow with reference to Table 1.

Nucleotide sequences of host target binding sites, such as BINDING SITE-I, BINDING SITE-II and BINDING SITE-III of FIG. 1, found on VGAM1839 host target RNA, and schematic representation of the complementarity of each of these host target binding sites to VGAM1839 RNA, herein designated VGAM RNA, are described hereinbelow with reference to Table 2.

As mentioned hereinabove with reference to FIG. 1, a function of VGAM1839 gene, herein designated VGAM is inhibition of expression of VGAM1839 target genes. It is appreciated that specific functions, and accordingly utilities, of VGAM1839 correlate with, and may be deduced from, the identity of the target genes which VGAM1839 binds and inhibits, and the function of these target genes, as elaborated hereinbelow.

FLJ20051 (Accession NM_019087) is a VGAM1839 host target gene. FLJ20051 BINDING SITE is HOST TARGET binding site found in the 3' untranslated region of mRNA encoded by FLJ20051, corresponding to a HOST TARGET binding site such as BINDING SITE I, BINDING SITE II or BINDING SITE III. Table 2 illustrates the complementarity of the nucleotide sequences of FLJ20051 BINDING SITE, designated SEQ ID:21163, to the nucleotide sequence of VGAM1839 RNA, herein designated VGAM RNA, also designated SEQ ID:4550.

A function of VGAM1839 is therefore inhibition of FLJ20051 (Accession NM_019087). Accordingly, utilities of VGAM1839 include diagnosis, prevention and treatment of diseases and clinical conditions associated with FLJ20051.

FIG. 1 further provides a conceptual description of a novel bioinformatically detected viral gene of the present invention, referred to here as Viral Genomic Address Messenger 1840 (VGAM1840) viral gene, which modulates expression of respective host target genes thereof, the function and utility of which host target genes is known in the art.

VGAM1840 is a novel bioinformatically detected regulatory, non protein coding, viral micro RNA (miRNA) gene. The method by which VGAM1840 was detected is described hereinabove with reference to FIGS. 1-8.

VGAM1840 gene, herein designated VGAM GENE, is a viral gene contained in the genome of Cowpea Mottle Virus. VGAM1840 host target gene, herein designated VGAM HOST TARGET GENE, is a human gene contained in the human genome.

VGAM1840 gene encodes a VGAM1840 precursor RNA, herein designated VGAM PRECURSOR RNA. Similar to other miRNA genes, and unlike most ordinary genes, VGAM1840 precursor RNA does not encode a protein. A nucleotide sequence identical or highly similar to the nucleotide sequence of VGAM1840 precursor RNA is designated SEQ ID:1826, and is provided hereinbelow with reference to the sequence listing part. Nucleotide sequence SEQ ID:1826 is located at position 998 relative to the genome of Cowpea Mottle Virus.

VGAM1840 precursor RNA folds onto itself, forming VGAM1840 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1840 folded precursor RNA into VGAM1840 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1840 RNA is designated SEQ ID:4551, and is provided hereinbelow with reference to the sequence listing part.

VGAM1840 host target gene, herein designated VGAM HOST TARGET GENE, encodes a corresponding messenger RNA, VGAM1840 host target RNA, herein designated VGAM HOST TARGET RNA. VGAM1840 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1840 RNA, herein designated VGAM RNA, binds complementarily to one or more host target binding sites located in untranslated regions of VGAM1840 host target RNA, herein designated VGAM HOST TARGET RNA. This complementary binding is due to the fact that the nucleotide sequence of VGAM1840 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1840 RNA, herein designated VGAM RNA, may have a different number of host target binding sites in untranslated regions of a VGAM1840 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1840 RNA, herein designated VGAM RNA, to host target binding sites on VGAM1840 host target RNA, herein designated VGAM HOST TARGET RNA, such as BINDING SITE I, BINDING SITE II and BINDING SITE III, inhibits translation of VGAM1840 host target RNA into VGAM1840 host target protein, herein designated VGAM HOST TARGET PROTEIN. VGAM host target protein is therefore outlined by a broken line.

It is appreciated that VGAM1840 host target gene, herein designated VGAM HOST TARGET GENE, in fact represents a plurality of VGAM1840 host target genes. The mRNA of each one of this plurality of VGAM1840 host target genes comprises one or more host target binding sites, each having a nucleotide sequence which is at least partly complementary to VGAM1840 RNA, herein designated VGAM RNA, and which when bound by VGAM1840 RNA causes inhibition of translation of respective one or more VGAM1840 host target proteins.

It is further appreciated by one skilled in the art that the mode of translational inhibition illustrated by FIG. 1 with specific reference to translational inhibition exerted by VGAM1840 gene, herein designated VGAM GENE, on one or more VGAM1840 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1840 is inhibition of expression of host target genes, as part of a novel viral mechanism of attacking a host. Accordingly, utilities of VGAM1840 include diagnosis, prevention and treatment of viral infection by Cowpea Mottle Virus. Specific functions, and accordingly utilities, of VGAM1840 correlate with, and may be deduced from, the identity of the host target genes which VGAM1840 binds and inhibits, and the function of these host target genes, as elaborated hereinbelow.

Nucleotide sequences of the VGAM1840 precursor RNA, herein designated VGAM PRECURSOR RNA, and of the 'diced' VGAM1840 RNA, herein designated VGAM RNA, and a schematic representation of the secondary folding of VGAM1840 folded precursor RNA, herein designated VGAM FOLDED PRECURSOR RNA, of VGAM1840 are further described hereinbelow with reference to Table 1.

Nucleotide sequences of host target binding sites, such as BINDING SITE-I, BINDING SITE-II and BINDING SITE-III of FIG. 1, found on VGAM1840 host target RNA, and schematic representation of the complementarity of each of these host target binding sites to VGAM1840 RNA, herein designated VGAM RNA, are described hereinbelow with reference to Table 2.

As mentioned hereinabove with reference to FIG. 1, a function of VGAM1840 gene, herein designated VGAM is inhibition of expression of VGAM1840 target genes. It is appreciated that specific functions, and accordingly utilities, of VGAM1840 correlate with, and may be deduced from, the identity of the target genes which VGAM1840 binds and inhibits, and the function of these target genes, as elaborated hereinbelow.

Testis Derived Transcript (3 LIM domains) (TES, Accession XM_050430) is a VGAM1840 host target gene. TES BINDING SITE is HOST TARGET binding site found in the 3' untranslated region of mRNA encoded by TES, corresponding to a HOST TARGET binding site such as BINDING SITE I, BINDING SITE II or BINDING SITE III. Table 2 illustrates the complementarity of the nucleotide sequences of TES BINDING SITE, designated SEQ ID:35632, to the nucleotide sequence of VGAM1840 RNA, herein designated VGAM RNA, also designated SEQ ID:4551.

A function of VGAM1840 is therefore inhibition of Testis Derived Transcript (3 LIM domains) (TES, Accession XM_050430), a gene which acts as a tumor suppressor. Accordingly, utilities of VGAM1840 include diagnosis, prevention and treatment of diseases and clinical conditions associated with TES. The function of TES and its association with various diseases and clinical conditions, has been established by previous studies, as described hereinabove with reference to VGAM363. Chromosome 6 Open Reading Frame 37 (C6orf37, Accession XM_041375) is another VGAM1840 host target gene. C6orf37 BINDING SITE is HOST TARGET binding site found in the 3' untranslated region of mRNA encoded by C6orf37, corresponding to a HOST TARGET binding site such as BINDING SITE I, BINDING SITE II or BINDING SITE III. Table 2 illustrates the complementarity of the nucleotide sequences of C6orf37 BINDING SITE, designated SEQ ID:33509, to the nucleotide sequence of VGAM1840 RNA, herein designated VGAM RNA, also designated SEQ ID:4551.

Another function of VGAM1840 is therefore inhibition of Chromosome 6 Open Reading Frame 37 (C6orf37, Accession XM_041375). Accordingly, utilities of VGAM1840 include diagnosis, prevention and treatment of diseases and clinical conditions associated with C6orf37. SYNE-2 (Accession NM_015180) is another VGAM1840 host target gene. SYNE-2 BINDING SITE is HOST TARGET binding site found in the 3' untranslated region of mRNA encoded by SYNE-2, corresponding to a HOST TARGET binding site such as BINDING SITE I, BINDING SITE II or BINDING SITE III. Table 2 illustrates the complementarity of the nucleotide sequences of SYNE-2 BINDING SITE, designated SEQ ID:17534, to the nucleotide sequence of VGAM1840 RNA, herein designated VGAM RNA, also designated SEQ ID:4551.

Another function of VGAM1840 is therefore inhibition of SYNE-2 (Accession NM_015180). Accordingly, utilities of VGAM1840 include diagnosis, prevention and treatment of diseases and clinical conditions associated with SYNE-2. LOC121838 (Accession XM_071772) is another VGAM1840 host target gene. LOC121838 BINDING SITE is HOST TARGET binding site found in the 5' untranslated region of mRNA encoded by LOC121838, corresponding to a HOST TARGET binding site such as BINDING SITE I, BINDING SITE II or BINDING SITE III. Table 2 illustrates the complementarity of the nucleotide sequences of LOC121838 BINDING SITE, designated SEQ ID:37417, to the nucleotide sequence of VGAM1840 RNA, herein designated VGAM RNA, also designated SEQ ID:4551.

Another function of VGAM1840 is therefore inhibition of LOC121838 (Accession XM_071772). Accordingly, utilities of VGAM1840 include diagnosis, prevention and treatment of diseases and clinical conditions associated with LOC121838. LOC158337 (Accession XM_098926) is another VGAM1840 host target gene. LOC158337 BINDING SITE is HOST TARGET binding site found in the 3' untranslated region of mRNA encoded by LOC158337, corresponding to a HOST TARGET binding site such as BINDING SITE I, BINDING SITE II or BINDING SITE III. Table 2 illustrates the complementarity of the nucleotide sequences of LOC158337 BINDING SITE, designated SEQ ID:41960, to the nucleotide sequence of VGAM1840 RNA, herein designated VGAM RNA, also designated SEQ ID:4551.

Another function of VGAM1840 is therefore inhibition of LOC158337 (Accession XM_098926). Accordingly, utilities of VGAM1840 include diagnosis, prevention and treatment of diseases and clinical conditions associated with LOC158337. FIG. 1 further provides a conceptual description of a novel bioinformatically detected viral gene of the present invention, referred to here as Viral Genomic Address Messenger 1841 (VGAM1841) viral gene, which modulates expression of respective host target genes thereof, the function and utility of which host target genes is known in the art.

VGAM1841 is a novel bioinformatically detected regulatory, non protein coding, viral micro RNA (miRNA) gene. The method by which VGAM1841 was detected is described hereinabove with reference to FIGS. 1-8.

VGAM1841 gene, herein designated VGAM GENE, is a viral gene contained in the genome of Cowpea Mottle Virus. VGAM1841 host target gene, herein designated VGAM HOST TARGET GENE, is a human gene contained in the human genome.

VGAM1841 gene encodes a VGAM1841 precursor RNA, herein designated VGAM PRECURSOR RNA. Similar to other miRNA genes, and unlike most ordinary genes, VGAM1841 precursor RNA does not encode a protein. A nucleotide sequence identical or highly similar to the nucleotide sequence of VGAM1841 precursor RNA is designated SEQ ID:1827, and is provided hereinbelow with reference to the sequence listing part. Nucleotide sequence SEQ ID:1827 is located at position 695 relative to the genome of Cowpea Mottle Virus.

VGAM1841 precursor RNA folds onto itself, forming VGAM1841 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1841 folded precursor RNA into VGAM1841 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1841 RNA is designated SEQ ID:4552, and is provided hereinbelow with reference to the sequence listing part.

VGAM1841 host target gene, herein designated VGAM HOST TARGET GENE, encodes a corresponding messenger RNA, VGAM1841 host target RNA, herein designated VGAM HOST TARGET RNA. VGAM1841 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1841 RNA, herein designated VGAM RNA, binds complementarily to one or more host target binding sites located in untranslated regions of VGAM1841 host target RNA, herein designated VGAM HOST TARGET RNA. This complementary binding is due to the fact that the nucleotide sequence of VGAM1841 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1841 RNA, herein designated VGAM RNA, may have a different number of host target binding sites in untranslated regions of a VGAM1841 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1841 RNA, herein designated VGAM RNA, to host target binding sites on VGAM1841 host target RNA, herein designated VGAM HOST TARGET RNA, such as BINDING SITE I, BINDING SITE II and BINDING SITE III, inhibits translation of VGAM1841 host target RNA into VGAM1841 host target protein, herein designated VGAM HOST TARGET PRO- TEIN. VGAM host target protein is therefore outlined by a broken line.

It is appreciated that VGAM1841 host target gene, herein designated VGAM HOST TARGET GENE, in fact represents a plurality of VGAM1841 host target genes. The mRNA of each one of this plurality of VGAM1841 host target genes comprises one or more host target binding sites, each having a nucleotide sequence which is at least partly complementary to VGAM1841 RNA, herein designated VGAM RNA, and which when bound by VGAM1841 RNA causes inhibition of translation of respective one or more VGAM1841 host target proteins.

It is further appreciated by one skilled in the art that the mode of translational inhibition illustrated by FIG. 1 with specific reference to translational inhibition exerted by VGAM1841 gene, herein designated VGAM GENE, on one or more VGAM1841 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1841 is inhibition of expression of host target genes, as part of a novel viral mechanism of attacking a host. Accordingly, utilities of VGAM1841 include diagnosis, prevention and treatment of viral infection by Cowpea Mottle Virus. Specific functions, and accordingly utilities, of VGAM1841 correlate with, and may be deduced from, the identity of the host target genes which VGAM1841 binds and inhibits, and the function of these host target genes, as elaborated hereinbelow.

Nucleotide sequences of the VGAM1841 precursor RNA, herein designated VGAM PRECURSOR RNA, and of the 'diced' VGAM1841 RNA, herein designated VGAM RNA, and a schematic representation of the secondary folding of VGAM1841 folded precursor RNA, herein designated VGAM FOLDED PRECURSOR RNA, of VGAM1841 are further described hereinbelow with reference to Table 1.

Nucleotide sequences of host target binding sites, such as BINDING SITE-I, BINDING SITE-II and BINDING SITE-III of FIG. 1, found on VGAM1841 host target RNA, and schematic representation of the complementarity of each of these host target binding sites to VGAM1841 RNA, herein designated VGAM RNA, are described hereinbelow with reference to Table 2.

As mentioned hereinabove with reference to FIG. 1, a function of VGAM1841 gene, herein designated VGAM is inhibition of expression of VGAM1841 target genes. It is appreciated that specific functions, and accordingly utilities, of VGAM1841 correlate with, and may be deduced from, the identity of the target genes which VGAM1841 binds and inhibits, and the function of these target genes, as elaborated hereinbelow.

Ankyrin Repeat Domain 3 (ANKRD3, Accession NM_020639) is a VGAM1841 host target gene. ANKRD3 BINDING SITE is HOST TARGET binding site found in the 3' untranslated region of mRNA encoded by ANKRD3, corresponding to a HOST TARGET binding site such as BINDING SITE I, BINDING SITE II or BINDING SITE III. Table 2 illustrates the complementarity of the nucleotide sequences of ANKRD3 BINDING SITE, designated SEQ ID:21797, to the nucleotide sequence of VGAM1841 RNA, herein designated VGAM RNA, also designated SEQ ID:4552.

A function of VGAM1841 is therefore inhibition of Ankyrin Repeat Domain 3 (ANKRD3, Accession NM_020639). Accordingly, utilities of VGAM1841 include diagnosis, prevention and treatment of diseases and clinical conditions associated with ANKRD3. Drebrin 1 (DBN1, Accession NM_004395) is another VGAM1841 host target gene. DBN1 BINDING SITE1 and DBN1 BINDING SITE2 are HOST TARGET binding sites found in untranslated regions of mRNA encoded by DBN1, corresponding to HOST TARGET binding sites such as BINDING SITE I, BINDING SITE II or BINDING SITE III. Table 2 illustrates the complementarity of the nucleotide sequences of DBN1 BINDING SITE1 and DBN1 BINDING SITE2, designated SEQ ID:10638 and SEQ ID:28121 respectively, to the nucleotide sequence of VGAM1841 RNA, herein designated VGAM RNA, also designated SEQ ID:4552.

Another function of VGAM1841 is therefore inhibition of Drebrin 1 (DBN1, Accession NM_004395). Accordingly, utilities of VGAM1841 include diagnosis, prevention and treatment of diseases and clinical conditions associated with DBN1. Thrombomodulin (THBD, Accession NM_000361) is another VGAM1841 host target gene. THBD BINDING SITE is HOST TARGET binding site found in the 5' untranslated region of mRNA encoded by THBD, corresponding to a HOST TARGET binding site such as BINDING SITE I, BINDING SITE II or BINDING SITE III. Table 2 illustrates the complementarity of the nucleotide sequences of THBD BINDING SITE, designated SEQ ID:5918, to the nucleotide sequence of VGAM1841 RNA, herein designated VGAM RNA, also designated SEQ ID:4552.

Another function of VGAM1841 is therefore inhibition of Thrombomodulin (THBD, Accession NM_000361). Accordingly, utilities of VGAM1841 include diagnosis, prevention and treatment of diseases and clinical conditions associated with THBD. DKFZP727M111 (Accession NM_015540) is another VGAM1841 host target gene. DKFZP727M111 BINDING SITE is HOST TARGET binding site found in the 5' untranslated region of mRNA encoded by DKFZP727M111, corresponding to a HOST TARGET binding site such as BINDING SITE I, BINDING SITE II or BINDING SITE III. Table 2 illustrates the complementarity of the nucleotide sequences of DKFZP727M111 BINDING SITE, designated SEQ ID:17800, to the nucleotide sequence of VGAM1841 RNA, herein designated VGAM RNA, also designated SEQ ID:4552.

Another function of VGAM1841 is therefore inhibition of DKFZP727M111 (Accession NM_015540). Accordingly, utilities of VGAM1841 include diagnosis, prevention and treatment of diseases and clinical conditions associated with DKFZP727M111. KIAA0700 (Accession XM_050561) is another VGAM1841 host target gene. KIAA0700 BINDING SITE is HOST TARGET binding site found in the 3' untranslated region of mRNA encoded by KIAA0700, corresponding to a HOST TARGET binding site such as BINDING SITE I, BINDING SITE II or BINDING SITE III. Table 2 illustrates the complementarity of the nucleotide sequences of KIAA0700 BINDING SITE, designated SEQ ID:35659, to the nucleotide sequence of VGAM1841 RNA, herein designated VGAM RNA, also designated SEQ ID:4552.

Another function of VGAM1841 is therefore inhibition of KIAA0700 (Accession XM_050561). Accordingly, utilities of VGAM1841 include diagnosis, prevention and treatment of diseases and clinical conditions associated with KIAA0700. LOC116166 (Accession XM_007651) is another VGAM1841 host target gene. LOC116166 BIND- ING SITE is HOST TARGET binding site found in the 3' untranslated region of mRNA encoded by LOC116166, corresponding to a HOST TARGET binding site such as BINDING SITE I, BINDING SITE II or BINDING SITE III. Table 2 illustrates the complementarity of the nucleotide sequences of LOC116166 BINDING SITE, designated SEQ ID:30060, to the nucleotide sequence of VGAM1841 RNA, herein designated VGAM RNA, also designated SEQ ID:4552.

Another function of VGAM1841 is therefore inhibition of LOC116166 (Accession XM_007651). Accordingly, utilities of VGAM1841 include diagnosis, prevention and treatment of diseases and clinical conditions associated with LOC116166. LOC158987 (Accession XM_099015) is another VGAM1841 host target gene. LOC158987 BINDING SITE is HOST TARGET binding site found in the 3' untranslated region of mRNA encoded by LOC158987, corresponding to a HOST TARGET binding site such as BINDING SITE I, BINDING SITE II or BINDING SITE III. Table 2 illustrates the complementarity of the nucleotide sequences of LOC158987 BINDING SITE, designated SEQ ID:42048, to the nucleotide sequence of VGAM1841 RNA, herein designated VGAM RNA, also designated SEQ ID:4552.

Another function of VGAM1841 is therefore inhibition of LOC158987 (Accession XM_099015). Accordingly, utilities of VGAM1841 include diagnosis, prevention and treatment of diseases and clinical conditions associated with LOC158987. LOC165904 (Accession XM_093522) is another VGAM1841 host target gene. LOC165904 BINDING SITE is HOST TARGET binding site found in the 3' untranslated region of mRNA encoded by LOC165904, corresponding to a HOST TARGET binding site such as BINDING SITE I, BINDING SITE II or BINDING SITE III. Table 2 illustrates the complementarity of the nucleotide sequences of LOC165904 BINDING SITE, designated SEQ ID:40195, to the nucleotide sequence of VGAM1841 RNA, herein designated VGAM RNA, also designated SEQ ID:4552.

Another function of VGAM1841 is therefore inhibition of LOC165904 (Accession XM_093522). Accordingly, utilities of VGAM1841 include diagnosis, prevention and treatment of diseases and clinical conditions associated with LOC165904. LOC90678 (Accession NM_138361) is another VGAM1841 host target gene. LOC90678 BINDING SITE is HOST TARGET binding site found in the 3' untranslated region of mRNA encoded by LOC90678, corresponding to a HOST TARGET binding site such as BINDING SITE I, BINDING SITE II or BINDING SITE III. Table 2 illustrates the complementarity of the nucleotide sequences of LOC90678 BINDING SITE, designated SEQ ID:28747, to the nucleotide sequence of VGAM1841 RNA, herein designated VGAM RNA, also designated SEQ ID:4552.

Another function of VGAM1841 is therefore inhibition of LOC90678 (Accession NM_138361). Accordingly, utilities of VGAM1841 include diagnosis, prevention and treatment of diseases and clinical conditions associated with LOC90678. LOC91807 (Accession XM_040819) is another VGAM1841 host target gene. LOC91807 BINDING SITE is HOST TARGET binding site found in the 5' untranslated region of mRNA encoded by LOC91807, corresponding to a HOST TARGET binding site such as BINDING SITE I, BINDING SITE II or BINDING SITE III. Table 2 illustrates the complementarity of the nucleotide sequences of LOC91807 BINDING SITE, designated SEQ ID:33384, to the nucleotide sequence of VGAM1841 RNA, herein designated VGAM RNA, also designated SEQ ID:4552.

Another function of VGAM1841 is therefore inhibition of LOC91807 (Accession XM_040819). Accordingly, utilities of VGAM1841 include diagnosis, prevention and treatment of diseases and clinical conditions associated with LOC91807. FIG. 1 further provides a conceptual description of a novel bioinformatically detected viral gene of the present invention, referred to here as Viral Genomic Address Messenger 1842 (VGAM1842) viral gene, which modulates expression of respective host target genes thereof, the function and utility of which host target genes is known in the art.

VGAM1842 is a novel bioinformatically detected regulatory, non protein coding, viral micro RNA (miRNA) gene. The method by which VGAM1842 was detected is described hereinabove with reference to FIGS. 1-8.

VGAM1842 gene, herein designated VGAM GENE, is a viral gene contained in the genome of Chimpanzee Cytomegalovirus. VGAM1842 host target gene, herein designated VGAM HOST TARGET GENE, is a human gene contained in the human genome.

VGAM1842 gene encodes a VGAM1842 precursor RNA, herein designated VGAM PRECURSOR RNA. Similar to other miRNA genes, and unlike most ordinary genes, VGAM1842 precursor RNA does not encode a protein. A nucleotide sequence identical or highly similar to the nucleotide sequence of VGAM1842 precursor RNA is designated SEQ ID:1828, and is provided hereinbelow with reference to the sequence listing part. Nucleotide sequence SEQ ID:1828 is located at position 19726 relative to the genome of Chimpanzee Cytomegalovirus.

VGAM1842 precursor RNA folds onto itself, forming VGAM1842 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1842 folded precursor RNA into VGAM1842 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 82%) nucleotide sequence of VGAM1842 RNA is designated SEQ ID:4553, and is provided hereinbelow with reference to the sequence listing part.

VGAM1842 host target gene, herein designated VGAM HOST TARGET GENE, encodes a corresponding messenger RNA, VGAM1842 host target RNA, herein designated VGAM HOST TARGET RNA. VGAM1842 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1842 RNA, herein designated VGAM RNA, binds complementarily to one or more host target binding sites located in untranslated regions of VGAM1842 host target RNA, herein designated VGAM HOST TARGET RNA. This complementary binding is due to the fact that the nucleotide sequence of VGAM1842 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1842 RNA, herein designated VGAM RNA, may have a different number of host target binding sites in untranslated regions of a VGAM1842 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1842 RNA, herein designated VGAM RNA, to host target binding sites on VGAM1842 host target RNA, herein designated VGAM HOST TARGET RNA, such as BINDING SITE I, BINDING SITE II and BINDING SITE III, inhibits translation of VGAM1842 host target RNA into VGAM1842 host target protein, herein designated VGAM HOST TARGET PROTEIN. VGAM host target protein is therefore outlined by a broken line.

It is appreciated that VGAM1842 host target gene, herein designated VGAM HOST TARGET GENE, in fact represents a plurality of VGAM1842 host target genes. The mRNA of each one of this plurality of VGAM1842 host target genes comprises one or more host target binding sites, each having a nucleotide sequence which is at least partly complementary to VGAM1842 RNA, herein designated VGAM RNA, and which when bound by VGAM1842 RNA causes inhibition of translation of respective one or more VGAM1842 host target proteins.

It is further appreciated by one skilled in the art that the mode of translational inhibition illustrated by FIG. 1 with specific reference to translational inhibition exerted by VGAM1842 gene, herein designated VGAM GENE, on one or more VGAM1842 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1842 is inhibition of expression of host target genes, as part of a novel viral mechanism of attacking a host. Accordingly, utilities of VGAM1842 include diagnosis, prevention and treatment of viral infection by Chimpanzee Cytomegalovirus. Specific functions, and accordingly utilities, of VGAM1842 correlate with, and may be deduced from, the identity of the host target genes which VGAM1842 binds and inhibits, and the function of these host target genes, as elaborated hereinbelow.

Nucleotide sequences of the VGAM1842 precursor RNA, herein designated VGAM PRECURSOR RNA, and of the 'diced' VGAM1842 RNA, herein designated VGAM RNA, and a schematic representation of the secondary folding of VGAM1842 folded precursor RNA, herein designated VGAM FOLDED PRECURSOR RNA, of VGAM1842 are further described hereinbelow with reference to Table 1.

Nucleotide sequences of host target binding sites, such as BINDING SITE-I, BINDING SITE-II and BINDING SITE-III of FIG. 1, found on VGAM1842 host target RNA, and schematic representation of the complementarity of each of these host target binding sites to VGAM1842 RNA, herein designated VGAM RNA, are described hereinbelow with reference to Table 2.

As mentioned hereinabove with reference to FIG. 1, a function of VGAM1842 gene, herein designated VGAM is inhibition of expression of VGAM1842 target genes. It is appreciated that specific functions, and accordingly utilities, of VGAM1842 correlate with, and may be deduced from, the identity of the target genes which VGAM1842 binds and inhibits, and the function of these target genes, as elaborated hereinbelow.

Myelin Protein Zero (Charcot-Marie-Tooth neuropathy 1B) (MPZ, Accession NM_000530) is a VGAM1842 host target gene. MPZ BINDING SITE is HOST TARGET binding site found in the 3' untranslated region of mRNA encoded by MPZ, corresponding to a HOST TARGET binding site such as BINDING SITE I, BINDING SITE II or BINDING SITE III. Table 2 illustrates the complementarity of the nucleotide sequences of MPZ BINDING SITE, designated SEQ ID:6130, to the nucleotide sequence of VGAM1842 RNA, herein designated VGAM RNA, also designated SEQ ID:4553.

A function of VGAM1842 is therefore inhibition of Myelin Protein Zero (Charcot-Marie-Tooth neuropathy 1B) (MPZ, Accession NM_000530). Accordingly, utilities of VGAM1842 include diagnosis, prevention and treatment of diseases and clinical conditions associated with MPZ. LOC147080 (Accession XM_097182) is another VGAM1842 host target gene. LOC147080 BINDING SITE is HOST TARGET binding site found in the 5' untranslated region of mRNA encoded by LOC147080, corresponding to a HOST TARGET binding site such as BINDING SITE I, BINDING SITE II or BINDING SITE III. Table 2 illustrates the complementarity of the nucleotide sequences of LOC147080 BINDING SITE, designated SEQ ID:40796, to the nucleotide sequence of VGAM1842 RNA, herein designated VGAM RNA, also designated SEQ ID:4553.

Another function of VGAM1842 is therefore inhibition of LOC147080 (Accession XM_097182). Accordingly, utilities of VGAM1842 include diagnosis, prevention and treatment of diseases and clinical conditions associated with LOC147080. FIG. 1 further provides a conceptual description of a novel bioinformatically detected viral gene of the present invention, referred to here as Viral Genomic Address Messenger 1843 (VGAM1843) viral gene, which modulates expression of respective host target genes thereof, the function and utility of which host target genes is known in the art.

VGAM1843 is a novel bioinformatically detected regulatory, non protein coding, viral micro RNA (miRNA) gene. The method by which VGAM1843 was detected is described hereinabove with reference to FIGS. 1-8.

VGAM1843 gene, herein designated VGAM GENE, is a viral gene contained in the genome of Chimpanzee Cytomegalovirus. VGAM1843 host target gene, herein designated VGAM HOST TARGET GENE, is a human gene contained in the human genome.

VGAM1843 gene encodes a VGAM1843 precursor RNA, herein designated VGAM PRECURSOR RNA. Similar to other miRNA genes, and unlike most ordinary genes, VGAM1843 precursor RNA does not encode a protein. A nucleotide sequence identical or highly similar to the nucleotide sequence of VGAM1843 precursor RNA is designated SEQ ID:1829, and is provided hereinbelow with reference to the sequence listing part. Nucleotide sequence SEQ ID:1829 is located at position 14213 relative to the genome of Chimpanzee Cytomegalovirus.

VGAM1843 precursor RNA folds onto itself, forming VGAM1843 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1843 folded precursor RNA into VGAM1843 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1843 RNA is designated SEQ ID:4554, and is provided hereinbelow with reference to the sequence listing part.

VGAM1843 host target gene, herein designated VGAM HOST TARGET GENE, encodes a corresponding messenger RNA, VGAM1843 host target RNA, herein designated VGAM HOST TARGET RNA. VGAM1843 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1843 RNA, herein designated VGAM RNA, binds complementarily to one or more host target binding sites located in untranslated regions of VGAM1843 host target RNA, herein designated VGAM HOST TARGET RNA. This complementary binding is due to the fact that the nucleotide sequence of VGAM1843 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1843 RNA, herein designated VGAM RNA, may have a different number of host target binding sites in untranslated regions of a VGAM1843 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1843 RNA, herein designated VGAM RNA, to host target binding sites on VGAM1843 host target RNA, herein designated VGAM HOST TARGET RNA, such as BINDING SITE I, BINDING SITE II and BINDING SITE III, inhibits translation of VGAM1843 host target RNA into VGAM1843 host target protein, herein designated VGAM HOST TARGET PROTEIN. VGAM host target protein is therefore outlined by a broken line.

It is appreciated that VGAM1843 host target gene, herein designated VGAM HOST TARGET GENE, in fact represents a plurality of VGAM1843 host target genes. The mRNA of each one of this plurality of VGAM1843 host target genes comprises one or more host target binding sites, each having a nucleotide sequence which is at least partly complementary to VGAM1843 RNA, herein designated VGAM RNA, and which when bound by VGAM1843 RNA causes inhibition of translation of respective one or more VGAM1843 host target proteins.

It is further appreciated by one skilled in the art that the mode of translational inhibition illustrated by FIG. 1 with specific reference to translational inhibition exerted by VGAM1843 gene, herein designated VGAM GENE, on one or more VGAM1843 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1843 is inhibition of expression of host target genes, as part of a novel viral mechanism of attacking a host. Accordingly, utilities of VGAM1843 include diagnosis, prevention and treatment of viral infection by Chimpanzee Cytomegalovirus. Specific functions, and accordingly utilities, of VGAM1843 correlate with, and may be deduced from, the identity of the host target genes which VGAM1843 binds and inhibits, and the function of these host target genes, as elaborated hereinbelow.

Nucleotide sequences of the VGAM1843 precursor RNA, herein designated VGAM PRECURSOR RNA, and of the 'diced' VGAM1843 RNA, herein designated VGAM RNA, and a schematic representation of the secondary folding of VGAM1843 folded precursor RNA, herein designated VGAM FOLDED PRECURSOR RNA, of VGAM1843 are further described hereinbelow with reference to Table 1.

Nucleotide sequences of host target binding sites, such as BINDING SITE-I, BINDING SITE-II and BINDING SITE-III of FIG. 1, found on VGAM1843 host target RNA, and schematic representation of the complementarity of each of these host target binding sites to VGAM1843 RNA, herein designated VGAM RNA, are described hereinbelow with reference to Table 2.

As mentioned hereinabove with reference to FIG. 1, a function of VGAM1843 gene, herein designated VGAM is inhibition of expression of VGAM1843 target genes. It is appreciated that specific functions, and accordingly utilities, of VGAM1843 correlate with, and may be deduced from, the identity of the target genes which VGAM1843 binds and inhibits, and the function of these target genes, as elaborated hereinbelow.

Cytochrome P450, Subfamily IVF, Polypeptide 3 (leukotriene B4 omega hydroxylase) (CYP4F3, Accession NM_000896) is a VGAM1843 host target gene. CYP4F3 BINDING SITE is HOST TARGET binding site found in the 3' untranslated region of mRNA encoded by CYP4F3, corresponding to a HOST TARGET binding site such as BINDING SITE I, BINDING SITE II or BINDING SITE III. Table 2 illustrates the complementarity of the nucleotide sequences of CYP4F3 BINDING SITE, designated SEQ ID:6591, to the nucleotide sequence of VGAM1843 RNA, herein designated VGAM RNA, also designated SEQ ID:4554.

A function of VGAM1843 is therefore inhibition of Cytochrome P450, Subfamily IVF, Polypeptide 3 (leukotriene B4 omega hydroxylase) (CYP4F3, Accession NM_000896), a gene which converts leukotriene B4 into the less active 20-hydroxy-leukotriene B4. Accordingly, utilities of VGAM1843 include diagnosis, prevention and treatment of diseases and clinical conditions associated with CYP4F3. The function of CYP4F3 and its association with various diseases and clinical conditions, has been established by previous studies, as described hereinabove with reference to VGAM186. Dystrophin (muscular dystrophy, Duchenne and Becker types)

(DMD, Accession NM_000109) is another VGAM1843 host target gene. DMD BINDING SITE1 through DMD BINDING SITE13 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 through DMD BINDING SITE13, designated SEQ ID:5570, SEQ ID:10155, SEQ ID:10161, SEQ ID:10168, SEQ ID:10175, SEQ ID:10181, SEQ ID:10186, SEQ ID:10193, SEQ ID:10203, SEQ ID:10208, SEQ ID:10213, SEQ ID:10220 and SEQ ID:10232 respectively, to the nucleotide sequence of VGAM1843 RNA, herein designated VGAM RNA, also designated SEQ ID:4554.

Another function of VGAM1843 is therefore inhibition of Dystrophin (muscular dystrophy, Duchenne and Becker types) (DMD, Accession NM_000109), a gene which muscular dystrophy. Accordingly, utilities of VGAM1843 include diagnosis, prevention and treatment of diseases and clinical conditions associated with DMD. The function of DMD and its association with various diseases and clinical conditions, has been established by previous studies, as described hereinabove with reference to VGAM218. Fibroblast Growth Factor Receptor 1 (fms-related tyrosine kinase 2, Pfeiffer syndrome) (FGFR1, Accession NM_023109) is another VGAM1843 host target gene. FGFR1 BINDING SITE1 through FGFR1 BINDING SITE3 are HOST TARGET binding sites found in untranslated regions of mRNA encoded by FGFR1, corresponding to HOST TARGET binding sites such as BINDING SITE I, BINDING SITE II or BINDING SITE III. Table 2 illustrates the complementarity of the nucleotide sequences of FGFR1 BINDING SITE1 through FGFR1 BINDING SITE3, designated SEQ ID:23372, SEQ ID:6207 and SEQ ID:6611 respectively, to the nucleotide sequence of VGAM1843 RNA, herein designated VGAM RNA, also designated SEQ ID:4554.

Another function of VGAM1843 is therefore inhibition of Fibroblast Growth Factor Receptor 1 (fms-related tyrosine kinase 2, Pfeiffer syndrome) (FGFR1, Accession NM_023109). Accordingly, utilities of VGAM1843 include diagnosis, prevention and treatment of diseases and clinical conditions associated with FGFR1. Phosphoinositide-3-kinase, Class 2, Beta Polypeptide (PIK3C2B, Accession NM_002646) is another VGAM1843 host target gene. PIK3C2B BINDING SITE is HOST TARGET binding site found in the 3' untranslated region of mRNA encoded by PIK3C2B, corresponding to a HOST TARGET binding site such as BINDING SITE I, BINDING SITE II or BINDING SITE III. Table 2 illustrates the complementarity of the nucleotide sequences of PIK3C2B BINDING SITE, designated SEQ ID:8508, to the nucleotide sequence of VGAM1843 RNA, herein designated VGAM RNA, also designated SEQ ID:4554.

Another function of VGAM1843 is therefore inhibition of Phosphoinositide-3-kinase, Class 2, Beta Polypeptide (PIK3C2B, Accession NM_002646). Accordingly, utilities of VGAM1843 include diagnosis, prevention and treatment of diseases and clinical conditions associated with PIK3C2B. Regulator of G-protein Signalling 16 (RGS16, Accession NM_002928) is another VGAM1843 host target gene. RGS16 BINDING SITE is HOST TARGET binding site found in the 3' untranslated region of mRNA encoded by RGS16, corresponding to a HOST TARGET binding site such as BINDING SITE I, BINDING SITE II or BINDING SITE III. Table 2 illustrates the complementarity of the nucleotide sequences of RGS16 BINDING SITE, designated SEQ ID:8833, to the nucleotide sequence of VGAM1843 RNA, herein designated VGAM RNA, also designated SEQ ID:4554.

Another function of VGAM1843 is therefore inhibition of Regulator of G-protein Signalling 16 (RGS16, Accession NM_002928), a gene which inhibits signal transduction. Accordingly, utilities of VGAM1843 include diagnosis, prevention and treatment of diseases and clinical conditions associated with RGS16. The function of RGS16 has been established by previous studies. Snow et al. (1998) found that the RGS16 gene contains 5 exons. Northern blot analysis revealed that RGS16 is expressed at high levels in retina and at lower levels in all other tissues examined. By searching for retinal-specific RGS family members that might be involved in the phototransduction cascade, Chen et al. (1996) identified cDNAs encoding the mouse and rat homologs of RGS16, called Rgs-r by them. Northern blot analysis showed that rat Rgs16 is expressed predominantly in the retina. Chen et al. (1996) found that mouse Rgs16 enhances the rate of GTP-hydrolysis by transducin (see OMIM Ref. No. GNAT2; 139340), suggesting that Rgs16 may play a role in regulating the kinetics of signaling in the phototransduction cascade. The mouse and rat Rgs16 proteins have 94% amino acid sequence identity. Snow et al. (1998) reported that the mouse and human RGS16 proteins have 86% amino acid sequence identity Full details of the abovementioned studies are described in the following publications, the disclosure of which are hereby incorporated by reference:

Snow, B. E.; Antonio, L.; Suggs, S.; Siderovski, D. P.: Cloning of a retinally abundant regulator of G-protein signaling (RGS-r/RGS16): genomic structure and chromosomal localization of the human gene. Gene 206:247-253, 1998; and Chen, C.-K.; Wieland, T.; Simon, M. I.: RGS-r, a retinal specific RGS protein, binds an intermediate conformation of transducin and enhances recycling. Proc. Nat. Acad. Sci. 93:12885-1288.

Further studies establishing the function and utilities of RGS16 are found in John Hopkins OMIM database record ID 602514, and in sited publications numbered 8545-8548 listed in the bibliography section hereinbelow, which are also hereby incorporated by reference. Selectin P Ligand (SELPLG, Accession XM_006867) is another VGAM1843 host target gene. SELPLG BINDING SITE is HOST TARGET binding site found in the 3' untranslated region of mRNA encoded by SELPLG, corresponding to a HOST TARGET binding site such as BINDING SITE I, BINDING SITE II or BINDING SITE III. Table 2 illustrates the complementarity of the nucleotide sequences of SELPLG BINDING SITE, designated SEQ ID:30019, to the nucleotide sequence of VGAM1843 RNA, herein designated VGAM RNA, also designated SEQ ID:4554.

Another function of VGAM1843 is therefore inhibition of Selectin P Ligand (SELPLG, Accession XM_006867), a gene which binds to p-, e- and l-selectins, which mediates the tethering and rolling of neutrophils and t-lymphocytes on endothelial cells. Accordingly, utilities of VGAM1843 include diagnosis, prevention and treatment of diseases and clinical conditions associated with SELPLG. The function of SELPLG and its association with various diseases and clinical conditions, has been established by previous studies, as described hereinabove with reference to VGAM200. Small Glutamine-rich Tetratricopeptide Repeat (TPR)-containing (SGT, Accession NM_003021) is another VGAM1843 host target gene. SGT BINDING SITE is HOST TARGET binding site found in the 3' untranslated region of mRNA encoded by SGT, corresponding to a HOST TARGET binding site such as BINDING SITE I, BINDING SITE II or BINDING SITE III.

Table 2 illustrates the complementarity of the nucleotide sequences of SGT BINDING SITE, designated SEQ ID:8942, to the nucleotide sequence of VGAM1843 RNA, herein designated VGAM RNA, also designated SEQ ID:4554.

Another function of VGAM1843 is therefore inhibition of Small Glutamine-rich Tetratricopeptide Repeat (TPR)-containing (SGT, Accession NM_003021). Accordingly, utilities of VGAM1843 include diagnosis, prevention and treatment of diseases and clinical conditions associated with SGT. Solute Carrier Family 7 (cationic amino acid transporter, y+ system), Member 6 (SLC7A6, Accession NM_003983) is another VGAM1843 host target gene. SLC7A6 BINDING SITE is HOST TARGET binding site found in the 3' untranslated region of mRNA encoded by SLC7A6, corresponding to a HOST TARGET binding site such as BINDING SITE I, BINDING SITE II or BINDING SITE III. Table 2 illustrates the complementarity of the nucleotide sequences of SLC7A6 BINDING SITE, designated SEQ ID:10130, to the nucleotide sequence of VGAM1843 RNA, herein designated VGAM RNA, also designated SEQ ID:4554.

Another function of VGAM1843 is therefore inhibition of Solute Carrier Family 7 (cationic amino acid transporter, y+ system), Member 6 (SLC7A6, Accession NM_003983), a gene which is involved in mediating amino acid transport. Accordingly, utilities of VGAM1843 include diagnosis, prevention and treatment of diseases and clinical conditions associated with SLC7A6. The function of SLC7A6 and its association with various diseases and clinical conditions, has been established by previous studies, as described hereinabove with reference to VGAM87. Tyrosinase-related Protein 1 (TYRP1, Accession XM_051267) is another VGAM1843 host target gene. TYRP1 BINDING SITE is HOST TARGET binding site found in the 3' untranslated region of mRNA encoded by TYRP1, corresponding to a HOST TARGET binding site such as BINDING SITE I, BINDING SITE II or BINDING SITE III. Table 2 illustrates the complementarity of the nucleotide sequences of TYRP1 BINDING SITE, designated SEQ ID:35797, to the nucleotide sequence of VGAM1843 RNA, herein designated VGAM RNA, also designated SEQ ID:4554.

Another function of VGAM1843 is therefore inhibition of Tyrosinase-related Protein 1 (TYRP1, Accession XM_051267). Accordingly, utilities of VGAM1843 include diagnosis, prevention and treatment of diseases and clinical conditions associated with TYRP1. Cytochrome P450, Subfamily IVF, Polypeptide 2 (CYP4F2, Accession NM_001082) is another VGAM1843 host target gene. CYP4F2 BINDING SITE is HOST TARGET binding site found in the 3' untranslated region of mRNA encoded by CYP4F2, corresponding to a HOST TARGET binding site such as BINDING SITE I, BINDING SITE II or BINDING SITE III. Table 2 illustrates the complementarity of the nucleotide sequences of CYP4F2 BINDING SITE, designated SEQ ID:6742, to the nucleotide sequence of VGAM1843 RNA, herein designated VGAM RNA, also designated SEQ ID:4554.

Another function of VGAM1843 is therefore inhibition of Cytochrome P450, Subfamily IVF, Polypeptide 2 (CYP4F2, Accession NM_001082). Accordingly, utilities of VGAM1843 include diagnosis, prevention and treatment of diseases and clinical conditions associated with CYP4F2. DEAD/H (Asp-Glu-Ala-Asp/His) Box Polypeptide 34 (DDX34, Accession NM_014681) is another VGAM1843 host target gene. DDX34 BINDING SITE is HOST TARGET binding site found in the 3' untranslated region of mRNA encoded by DDX34, corresponding to a HOST TARGET binding site such as BINDING SITE I, BINDING SITE II or BINDING SITE III. Table 2 illustrates the complementarity of the nucleotide sequences of DDX34 BINDING SITE, designated SEQ ID:16161, to the nucleotide sequence of VGAM1843 RNA, herein designated VGAM RNA, also designated SEQ ID:4554.

Another function of VGAM1843 is therefore inhibition of DEAD/H (Asp-Glu-Ala-Asp/His) Box Polypeptide 34 (DDX34, Accession NM_014681). Accordingly, utilities of VGAM1843 include diagnosis, prevention and treatment of diseases and clinical conditions associated with DDX34. DJ971N18.2 (Accession NM_021156) is another VGAM1843 host target gene. DJ971N18.2 BINDING SITE is HOST TARGET binding site found in the 3' untranslated region of mRNA encoded by DJ971N18.2, corresponding to a HOST TARGET binding site such as BINDING SITE I, BINDING SITE II or BINDING SITE III. Table 2 illustrates the complementarity of the nucleotide sequences of DJ971N18.2 BINDING SITE, designated SEQ ID:22135, to the nucleotide sequence of VGAM1843 RNA, herein designated VGAM RNA, also designated SEQ ID:4554.

Another function of VGAM1843 is therefore inhibition of DJ971N18.2 (Accession NM_021156). Accordingly, utilities of VGAM1843 include diagnosis, prevention and treatment of diseases and clinical conditions associated with DJ971N18.2. DKFZp547M072 (Accession XM_028067) is another VGAM1843 host target gene. DKFZp547M072 BINDING SITE is HOST TARGET binding site found in the 3' untranslated region of mRNA encoded by DKFZp547M072, corresponding to a HOST TARGET binding site such as BINDING SITE I, BINDING SITE II or BINDING SITE III. Table 2 illustrates the complementarity of the nucleotide sequences of DKFZp547M072 BINDING SITE, designated SEQ ID:30615, to the nucleotide sequence of VGAM1843 RNA, herein designated VGAM RNA, also designated SEQ ID:4554.

Another function of VGAM1843 is therefore inhibition of DKFZp547M072 (Accession XM_028067). Accordingly, utilities of VGAM1843 include diagnosis, prevention and treatment of diseases and clinical conditions associated with DKFZp547M072. DKFZP586M1120 (Accession NM_031294) is another VGAM1843 host target gene. DKFZP586M1120 BINDING SITE is HOST TARGET binding site found in the 3' untranslated region of mRNA encoded by DKFZP586M1120, corresponding to a HOST TARGET binding site such as BINDING SITE I, BINDING SITE II or BINDING SITE III. Table 2 illustrates the complementarity of the nucleotide sequences of DKFZP586M1120 BINDING SITE, designated SEQ ID:25322, to the nucleotide sequence of VGAM1843 RNA, herein designated VGAM RNA, also designated SEQ ID:4554.

Another function of VGAM1843 is therefore inhibition of DKFZP586M1120 (Accession NM_031294). Accordingly, utilities of VGAM1843 include diagnosis, prevention and treatment of diseases and clinical conditions associated with DKFZP586M1120. FLJ10751 (Accession NM_018205) is another VGAM1843 host target gene. FLJ10751 BINDING SITE1 and FLJ10751 BINDING SITE2 are HOST TARGET binding sites found in untranslated regions of mRNA encoded by FLJ10751, corresponding to HOST TARGET binding sites such as BINDING SITE I, BINDING SITE II or BINDING SITE III. Table 2 illustrates the complementarity of the nucleotide sequences of FLJ10751 BINDING SITE1 and FLJ10751 BINDING SITE2, designated SEQ ID:20092 and SEQ ID:20191 respectively, to the nucleotide sequence of VGAM1843 RNA, herein designated VGAM RNA, also designated SEQ ID:4554.

Another function of VGAM1843 is therefore inhibition of FLJ10751 (Accession NM_018205). Accordingly, utilities of VGAM1843 include diagnosis, prevention and treatment of diseases and clinical conditions associated with FLJ10751. KIAA0342 (Accession XM_047357) is another VGAM1843 host target gene. KIAA0342 BINDING SITE is HOST TARGET binding site found in the 5' untranslated region of mRNA encoded by KIAA0342, corresponding to a HOST TARGET binding site such as BINDING SITE I, BINDING SITE II or BINDING SITE III. Table 2 illustrates the complementarity of the nucleotide sequences of KIAA0342 BINDING SITE, designated SEQ ID:34959, to the nucleotide sequence of VGAM1843 RNA, herein designated VGAM RNA, also designated SEQ ID:4554.

Another function of VGAM1843 is therefore inhibition of KIAA0342 (Accession XM_047357). Accordingly, utilities of VGAM1843 include diagnosis, prevention and treatment of diseases and clinical conditions associated with KIAA0342. KIAA0478 (Accession NM_014870) is another VGAM1843 host target gene. KIAA0478 BINDING SITE is HOST TARGET binding site found in the 3' untranslated region of mRNA encoded by KIAA0478, corresponding to a HOST TARGET binding site such as BINDING SITE I, BINDING SITE II or BINDING SITE III. Table 2 illustrates the complementarity of the nucleotide sequences of KIAA0478 BINDING SITE, designated SEQ ID:16978, to the nucleotide sequence of VGAM1843 RNA, herein designated VGAM RNA, also designated SEQ ID:4554.

Another function of VGAM1843 is therefore inhibition of KIAA0478 (Accession NM_014870). Accordingly, utilities of VGAM1843 include diagnosis, prevention and treatment of diseases and clinical conditions associated with KIAA0478. KIAA1332 (Accession XM_048774) is another VGAM1843 host target gene. KIAA1332 BINDING SITE is HOST TARGET binding site found in the 3' untranslated region of mRNA encoded by KIAA1332, corresponding to a HOST TARGET binding site such as BINDING SITE I, BINDING SITE II or BINDING SITE III. Table 2 illustrates the complementarity of the nucleotide sequences of KIAA1332 BINDING SITE, designated SEQ ID:35256, to the nucleotide sequence of VGAM1843 RNA, herein designated VGAM RNA, also designated SEQ ID:4554.

Another function of VGAM1843 is therefore inhibition of KIAA1332 (Accession XM_048774). Accordingly, utilities of VGAM1843 include diagnosis, prevention and treatment of diseases and clinical conditions associated with KIAA1332. KIAA1529 (Accession XM_047336) is another VGAM1843 host target gene. KIAA1529 BINDING SITE is HOST TARGET binding site found in the 5' untranslated region of mRNA encoded by KIAA1529, corresponding to a HOST TARGET binding site such as BINDING SITE I, BINDING SITE II or BINDING SITE III. Table 2 illustrates the complementarity of the nucleotide sequences of KIAA1529 BINDING SITE, designated SEQ ID:34951, to the nucleotide sequence of VGAM1843 RNA, herein designated VGAM RNA, also designated SEQ ID:4554.

Another function of VGAM1843 is therefore inhibition of KIAA1529 (Accession XM_047336). Accordingly, utilities of VGAM1843 include diagnosis, prevention and treatment of diseases and clinical conditions associated with KIAA1529. KIAA1674 (Accession XM_044065) is another VGAM1843 host target gene. KIAA1674 BINDING SITE is HOST TARGET binding site found in the 3' untranslated region of mRNA encoded by KIAA1674, corresponding to a HOST TARGET binding site such as BINDING SITE I, BINDING SITE II or BINDING SITE III. Table 2 illustrates the complementarity of the nucleotide sequences of KIAA1674 BINDING SITE, designated SEQ ID:34112, to the nucleotide sequence of VGAM1843 RNA, herein designated VGAM RNA, also designated SEQ ID:4554.

Another function of VGAM1843 is therefore inhibition of KIAA1674 (Accession XM_044065). Accordingly, utilities of VGAM1843 include diagnosis, prevention and treatment of diseases and clinical conditions associated with KIAA1674. KIAA1679 (Accession XM_046570) is another VGAM1843 host target gene. KIAA1679 BINDING SITE is HOST TARGET binding site found in the 3' untranslated region of mRNA encoded by KIAA1679, corresponding to a HOST TARGET binding site such as BINDING SITE I, BINDING SITE II or BINDING SITE III. Table 2 illustrates the complementarity of the nucleotide sequences of KIAA1679 BINDING SITE, designated SEQ ID:34751, to the nucleotide sequence of VGAM1843 RNA, herein designated VGAM RNA, also designated SEQ ID:4554.

Another function of VGAM1843 is therefore inhibition of KIAA1679 (Accession XM_046570). Accordingly, utilities of VGAM1843 include diagnosis, prevention and treatment of diseases and clinical conditions associated with KIAA1679. KIAA1878 (Accession XM_166256) is another VGAM1843 host target gene. KIAA1878 BINDING SITE is HOST TARGET binding site found in the 3' untranslated region of mRNA encoded by KIAA1878, corresponding to a HOST TARGET binding site such as BINDING SITE I, BINDING SITE II or BINDING SITE III. Table 2 illustrates the complementarity of the nucleotide sequences of KIAA1878 BINDING SITE, designated SEQ ID:44075, to the nucleotide sequence of VGAM1843 RNA, herein designated VGAM RNA, also designated SEQ ID:4554.

Another function of VGAM1843 is therefore inhibition of KIAA1878 (Accession XM_166256). Accordingly, utilities of VGAM1843 include diagnosis, prevention and treatment of diseases and clinical conditions associated with KIAA1878. Serine/threonine Kinase 38 Like (STK38L, Accession XM_044823) is another VGAM1843 host target gene. STK38L BINDING SITE is HOST TARGET binding site found in the 3' untranslated region of mRNA encoded by STK38L, corresponding to a HOST TARGET binding site such as BINDING SITE I, BINDING SITE II or BINDING SITE III. Table 2 illustrates the complementarity of the nucleotide sequences of STK38L BINDING SITE, designated SEQ ID:34290, to the nucleotide sequence of VGAM1843 RNA, herein designated VGAM RNA, also designated SEQ ID:4554.

Another function of VGAM1843 is therefore inhibition of Serine/threonine Kinase 38 Like (STK38L, Accession XM_044823). Accordingly, utilities of VGAM1843 include diagnosis, prevention and treatment of diseases and clinical conditions associated with STK38L. LOC139248 (Accession XM_066582) is another VGAM1843 host target gene. LOC139248 BINDING SITE is HOST TARGET binding site found in the 5' untranslated region of mRNA encoded by LOC139248, corresponding to a HOST TARGET binding site such as BINDING SITE I, BINDING SITE II or BINDING SITE III. Table 2 illustrates the complementarity of the nucleotide sequences of LOC139248 BINDING SITE, designated SEQ ID:37335, to the nucleotide sequence of VGAM1843 RNA, herein designated VGAM RNA, also designated SEQ ID:4554.

Another function of VGAM1843 is therefore inhibition of LOC139248 (Accession XM_066582). Accordingly, utilities of VGAM1843 include diagnosis, prevention and treatment of diseases and clinical conditions associated with LOC139248. LOC145225 (Accession XM_096741) is another VGAM1843 host target gene. LOC145225 BIND- ING SITE is HOST TARGET binding site found in the 3' untranslated region of mRNA encoded by LOC145225, corresponding to a HOST TARGET binding site such as BINDING SITE I, BINDING SITE II or BINDING SITE III. Table 2 illustrates the complementarity of the nucleotide sequences of LOC145225 BINDING SITE, designated SEQ ID:40526, to the nucleotide sequence of VGAM1843 RNA, herein designated VGAM RNA, also designated SEQ ID:4554.

Another function of VGAM1843 is therefore inhibition of LOC145225 (Accession XM_096741). Accordingly, utilities of VGAM1843 include diagnosis, prevention and treatment of diseases and clinical conditions associated with LOC145225. LOC146756 (Accession XM_097085) is another VGAM1843 host target gene. LOC146756 BINDING SITE is HOST TARGET binding site found in the 3' untranslated region of mRNA encoded by LOC146756, corresponding to a HOST TARGET binding site such as BINDING SITE I, BINDING SITE II or BINDING SITE III. Table 2 illustrates the complementarity of the nucleotide sequences of LOC146756 BINDING SITE, designated SEQ ID:40736, to the nucleotide sequence of VGAM1843 RNA, herein designated VGAM RNA, also designated SEQ ID:4554.

Another function of VGAM1843 is therefore inhibition of LOC146756 (Accession XM_097085). Accordingly, utilities of VGAM1843 include diagnosis, prevention and treatment of diseases and clinical conditions associated with LOC146756. LOC148229 (Accession XM_086103) is another VGAM1843 host target gene. LOC148229 BINDING SITE is HOST TARGET binding site found in the 5' untranslated region of mRNA encoded by LOC148229, corresponding to a HOST TARGET binding site such as BINDING SITE I, BINDING SITE II or BINDING SITE III. Table 2 illustrates the complementarity of the nucleotide sequences of LOC148229 BINDING SITE, designated SEQ ID:38497, to the nucleotide sequence of VGAM1843 RNA, herein designated VGAM RNA, also designated SEQ ID:4554.

Another function of VGAM1843 is therefore inhibition of LOC148229 (Accession XM_086103). Accordingly, utilities of VGAM1843 include diagnosis, prevention and treatment of diseases and clinical conditions associated with LOC148229. LOC166867 (Accession XM_094142) is another VGAM1843 host target gene. LOC166867 BINDING SITE is HOST TARGET binding site found in the 5' untranslated region of mRNA encoded by LOC166867, corresponding to a HOST TARGET binding site such as BINDING SITE I, BINDING SITE II or BINDING SITE III. Table 2 illustrates the complementarity of the nucleotide sequences of LOC166867 BINDING SITE, designated SEQ ID:40222, to the nucleotide sequence of VGAM1843 RNA, herein designated VGAM RNA, also designated SEQ ID:4554.

Another function of VGAM1843 is therefore inhibition of LOC166867 (Accession XM_094142). Accordingly, utilities of VGAM1843 include diagnosis, prevention and treatment of diseases and clinical conditions associated with LOC166867. LOC196510 (Accession XM_113738) is another VGAM1843 host target gene. LOC196510 BINDING SITE is HOST TARGET binding site found in the 3' untranslated region of mRNA encoded by LOC196510, corresponding to a HOST TARGET binding site such as BINDING SITE I, BINDING SITE II or BINDING SITE III. Table 2 illustrates the complementarity of the nucleotide sequences of LOC196510 BINDING SITE, designated SEQ ID:42395, to the nucleotide sequence of VGAM1843 RNA, herein designated VGAM RNA, also designated SEQ ID:4554.

Another function of VGAM1843 is therefore inhibition of LOC196510 (Accession XM_113738). Accordingly, utilities of VGAM1843 include diagnosis, prevention and treatment of diseases and clinical conditions associated with LOC196510. LOC200220 (Accession XM_114157) is another VGAM1843 host target gene. LOC200220 BINDING SITE is HOST TARGET binding site found in the 3' untranslated region of mRNA encoded by LOC200220, corresponding to a HOST TARGET binding site such as BINDING SITE I, BINDING SITE II or BINDING SITE III. Table 2 illustrates the complementarity of the nucleotide sequences of LOC200220 BINDING SITE, designated SEQ ID:42744, to the nucleotide sequence of VGAM1843 RNA, herein designated VGAM RNA, also designated SEQ ID:4554.

Another function of VGAM1843 is therefore inhibition of LOC200220 (Accession XM_114157). Accordingly, utilities of VGAM1843 include diagnosis, prevention and treatment of diseases and clinical conditions associated with LOC200220. LOC200310 (Accession XM_037840) is another VGAM1843 host target gene. LOC200310 BINDING SITE is HOST TARGET binding site found in the 3' untranslated region of mRNA encoded by LOC200310, corresponding to a HOST TARGET binding site such as BINDING SITE I, BINDING SITE II or BINDING SITE III. Table 2 illustrates the complementarity of the nucleotide sequences of LOC200310 BINDING SITE, designated SEQ ID:32708, to the nucleotide sequence of VGAM1843 RNA, herein designated VGAM RNA, also designated SEQ ID:4554.

Another function of VGAM1843 is therefore inhibition of LOC200310 (Accession XM_037840). Accordingly, utilities of VGAM1843 include diagnosis, prevention and treatment of diseases and clinical conditions associated with LOC200310. LOC201952 (Accession XM_117345) is another VGAM1843 host target gene. LOC201952 BINDING SITE is HOST TARGET binding site found in the 3' untranslated region of mRNA encoded by LOC201952, corresponding to a HOST TARGET binding site such as BINDING SITE I, BINDING SITE II or BINDING SITE III. Table 2 illustrates the complementarity of the nucleotide sequences of LOC201952 BINDING SITE, designated SEQ ID:43394, to the nucleotide sequence of VGAM1843 RNA, herein designated VGAM RNA, also designated SEQ ID:4554.

Another function of VGAM1843 is therefore inhibition of LOC201952 (Accession XM_117345). Accordingly, utilities of VGAM1843 include diagnosis, prevention and treatment of diseases and clinical conditions associated with LOC201952. LOC202934 (Accession XM_117486) is another VGAM1843 host target gene. LOC202934 BINDING SITE is HOST TARGET binding site found in the 5' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43459, to the nucleotide sequence of VGAM1843 RNA, herein designated VGAM RNA, also designated SEQ ID:4554.

Another function of VGAM1843 is therefore inhibition of LOC202934 (Accession XM_117486). Accordingly, utilities of VGAM1843 include diagnosis, prevention and treatment of diseases and clinical conditions associated with LOC202934. LOC219627 (Accession XM_166402) is another VGAM1843 host target gene. LOC219627 BINDING SITE is HOST TARGET binding site found in the 3' untranslated region of mRNA encoded by LOC219627, corresponding to a HOST TARGET binding site such as BINDING SITE I, BINDING SITE II or BINDING SITE III. Table 2 illustrates the complementarity of the nucleotide sequences of LOC219627 BINDING SITE, designated SEQ ID:44274, to the nucleotide sequence of VGAM1843 RNA, herein designated VGAM RNA, also designated SEQ ID:4554.

Another function of VGAM1843 is therefore inhibition of LOC219627 (Accession XM_166402). Accordingly, utilities of VGAM1843 include diagnosis, prevention and treatment of diseases and clinical conditions associated with LOC219627. LOC219848 (Accession XM_166170) is another VGAM1843 host target gene. LOC219848 BINDING SITE is HOST TARGET binding site found in the 3' untranslated region of mRNA encoded by LOC219848, corresponding to a HOST TARGET binding site such as BINDING SITE I, BINDING SITE II or BINDING SITE III. Table 2 illustrates the complementarity of the nucleotide sequences of LOC219848 BINDING SITE, designated SEQ ID:43986, to the nucleotide sequence of VGAM1843 RNA, herein designated VGAM RNA, also designated SEQ ID:4554.

Another function of VGAM1843 is therefore inhibition of LOC219848 (Accession XM_166170). Accordingly, utilities of VGAM1843 include diagnosis, prevention and treatment of diseases and clinical conditions associated with LOC219848. LOC222066 (Accession XM_166582) is another VGAM1843 host target gene. LOC222066 BINDING SITE is HOST TARGET binding site found in the 5' untranslated region of mRNA encoded by LOC222066, corresponding to a HOST TARGET binding site such as BINDING SITE I, BINDING SITE II or BINDING SITE III. Table 2 illustrates the complementarity of the nucleotide sequences of LOC222066 BINDING SITE, designated SEQ ID:44556, to the nucleotide sequence of VGAM1843 RNA, herein designated VGAM RNA, also designated SEQ ID:4554.

Another function of VGAM1843 is therefore inhibition of LOC222066 (Accession XM_166582). Accordingly, utilities of VGAM1843 include diagnosis, prevention and treatment of diseases and clinical conditions associated with LOC222066. LOC222962 (Accession XM_167291) is another VGAM1843 host target gene. LOC222962 BINDING SITE is HOST TARGET binding site found in the 3' untranslated region of mRNA encoded by LOC222962, corresponding to a HOST TARGET binding site such as BINDING SITE I, BINDING SITE II or BINDING SITE III. Table 2 illustrates the complementarity of the nucleotide sequences of LOC222962 BINDING SITE, designated SEQ ID:44629, to the nucleotide sequence of VGAM1843 RNA, herein designated VGAM RNA, also designated SEQ ID:4554.

Another function of VGAM1843 is therefore inhibition of LOC222962 (Accession XM_167291). Accordingly, utilities of VGAM1843 include diagnosis, prevention and treatment of diseases and clinical conditions associated with LOC222962. LOC254015 (Accession XM_172977) is another VGAM1843 host target gene. LOC254015 BINDING SITE is HOST TARGET binding site found in the 3' untranslated region of mRNA encoded by LOC254015, corresponding to a HOST TARGET binding site such as BINDING SITE I, BINDING SITE II or BINDING SITE III. Table 2 illustrates the complementarity of the nucleotide sequences of LOC254015 BINDING SITE, designated SEQ ID:46244, to the nucleotide sequence of VGAM1843 RNA, herein designated VGAM RNA, also designated SEQ ID:4554.

Another function of VGAM1843 is therefore inhibition of LOC254015 (Accession XM_172977). Accordingly, utilities of VGAM1843 include diagnosis, prevention and treatment of diseases and clinical conditions associated with LOC254015. LOC254778 (Accession XM_171193) is another VGAM1843 host target gene. LOC254778 BINDING SITE is HOST TARGET binding site found in the 3' untranslated region of mRNA encoded by LOC254778, corresponding to a HOST TARGET binding site such as BINDING SITE I, BINDING SITE II or BINDING SITE III. Table 2 illustrates the complementarity of the nucleotide sequences of LOC254778 BINDING SITE, designated SEQ ID:45977, to the nucleotide sequence of VGAM1843 RNA, herein designated VGAM RNA, also designated SEQ ID:4554.

Another function of VGAM1843 is therefore inhibition of LOC254778 (Accession XM_171193). Accordingly, utilities of VGAM1843 include diagnosis, prevention and treatment of diseases and clinical conditions associated with LOC254778. LOC255465 (Accession XM_173206) is another VGAM1843 host target gene. LOC255465 BINDING SITE is HOST TARGET binding site found in the 5' untranslated region of mRNA encoded by LOC255465, corresponding to a HOST TARGET binding site such as BINDING SITE I, BINDING SITE II or BINDING SITE III. Table 2 illustrates the complementarity of the nucleotide sequences of LOC255465 BINDING SITE, designated SEQ ID:46452, to the nucleotide sequence of VGAM1843 RNA, herein designated VGAM RNA, also designated SEQ ID:4554.

Another function of VGAM1843 is therefore inhibition of LOC255465 (Accession XM_173206). Accordingly, utilities of VGAM1843 include diagnosis, prevention and treatment of diseases and clinical conditions associated with LOC255465. FIG. 1 further provides a conceptual description of a novel bioinformatically detected viral gene of the present invention, referred to here as Viral Genomic Address Messenger 1844 (VGAM1844) viral gene, which modulates expression of respective host target genes thereof, the function and utility of which host target genes is known in the art.

VGAM1844 is a novel bioinformatically detected regulatory, non protein coding, viral micro RNA (miRNA) gene. The method by which VGAM1844 was detected is described hereinabove with reference to FIGS. 1-8.

VGAM1844 gene, herein designated VGAM GENE, is a viral gene contained in the genome of Chimpanzee Cytomegalovirus. VGAM1844 host target gene, herein designated VGAM HOST TARGET GENE, is a human gene contained in the human genome.

VGAM1844 gene encodes a VGAM1844 precursor RNA, herein designated VGAM PRECURSOR RNA. Similar to other miRNA genes, and unlike most ordinary genes, VGAM1844 precursor RNA does not encode a protein. A nucleotide sequence identical or highly similar to the nucleotide sequence of VGAM1844 precursor RNA is designated SEQ ID:1830, and is provided hereinbelow with reference to the sequence listing part. Nucleotide sequence SEQ ID:1830 is located at position 20461 relative to the genome of Chimpanzee Cytomegalovirus.

VGAM1844 precursor RNA folds onto itself, forming VGAM1844 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1844 folded precursor RNA into VGAM1844 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1844 RNA is designated SEQ ID:4555, and is provided hereinbelow with reference to the sequence listing part.

VGAM1844 host target gene, herein designated VGAM HOST TARGET GENE, encodes a corresponding messenger RNA, VGAM1844 host target RNA, herein designated VGAM HOST TARGET RNA. VGAM1844 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1844 RNA, herein designated VGAM RNA, binds complementarily to one or more host target binding sites located in untranslated regions of VGAM1844 host target RNA, herein designated VGAM HOST TARGET RNA. This complementary binding is due to the fact that the nucleotide sequence of VGAM1844 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1844 RNA, herein designated VGAM RNA, may have a different number of host target binding sites in untranslated regions of a VGAM1844 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1844 RNA, herein designated VGAM RNA, to host target binding sites on VGAM1844 host target RNA, herein designated VGAM HOST TARGET RNA, such as BINDING SITE I, BINDING SITE II and BINDING SITE III, inhibits translation of VGAM1844 host target RNA into VGAM1844 host target protein, herein designated VGAM HOST TARGET PROTEIN. VGAM host target protein is therefore outlined by a broken line.

It is appreciated that VGAM1844 host target gene, herein designated VGAM HOST TARGET GENE, in fact represents a plurality of VGAM1844 host target genes. The mRNA of each one of this plurality of VGAM1844 host target genes comprises one or more host target binding sites, each having a nucleotide sequence which is at least partly complementary to VGAM1844 RNA, herein designated VGAM RNA, and which when bound by VGAM1844 RNA causes inhibition of translation of respective one or more VGAM1844 host target proteins.

It is further appreciated by one skilled in the art that the mode of translational inhibition illustrated by FIG. 1 with specific reference to translational inhibition exerted by VGAM1844 gene, herein designated VGAM GENE, on one or more VGAM1844 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1844 is inhibition of expression of host target genes, as part of a novel viral mechanism of attacking a host. Accordingly, utilities of VGAM1844 include diagnosis, prevention and treatment of viral infection by Chimpanzee Cytomegalovirus. Specific functions, and accordingly utilities, of VGAM1844 correlate with, and may be deduced from, the identity of the host target genes which VGAM1844 binds and inhibits, and the function of these host target genes, as elaborated hereinbelow.

Nucleotide sequences of the VGAM1844 precursor RNA, herein designated VGAM PRECURSOR RNA, and of the 'diced' VGAM1844 RNA, herein designated VGAM RNA, and a schematic representation of the secondary folding of VGAM1844 folded precursor RNA, herein designated VGAM FOLDED PRECURSOR RNA, of VGAM1844 are further described hereinbelow with reference to Table 1.

Nucleotide sequences of host target binding sites, such as BINDING SITE-I, BINDING SITE-II and BINDING SITE-III of FIG. 1, found on VGAM1844 host target RNA, and schematic representation of the complementarity of each of these host target binding sites to VGAM1844 RNA, herein designated VGAM RNA, are described hereinbelow with reference to Table 2.

As mentioned hereinabove with reference to FIG. 1, a function of VGAM1844 gene, herein designated VGAM is inhibition of expression of VGAM1844 target genes. It is appreciated that specific functions, and accordingly utilities, of VGAM1844 correlate with, and may be deduced from, the identity of the target genes which VGAM1844 binds and inhibits, and the function of these target genes, as elaborated hereinbelow.

Alpha-methylacyl-CoA Racemase (AMACR, Accession XM_043771) is a VGAM1844 host target gene. AMACR BINDING SITE is HOST TARGET binding site found in the 3' untranslated region of mRNA encoded by AMACR, corresponding to a HOST TARGET binding site such as BINDING SITE I, BINDING SITE II or BINDING SITE III. Table 2 illustrates the complementarity of the nucleotide sequences of AMACR BINDING SITE, designated SEQ ID:34014, to the nucleotide sequence of VGAM1844 RNA, herein designated VGAM RNA, also designated SEQ ID:4555.

A function of VGAM1844 is therefore inhibition of Alpha-methylacyl-CoA Racemase (AMACR, Accession XM_043771). Accordingly, utilities of VGAM1844 include diagnosis, prevention and treatment of diseases and clinical conditions associated with AMACR. KIAA1305 (Accession NM_025081) is another VGAM1844 host target gene. KIAA1305 BINDING SITE is HOST TARGET binding site found in the 3' untranslated region of mRNA encoded by KIAA1305, corresponding to a HOST TARGET binding site such as BINDING SITE I, BINDING SITE II or BINDING SITE III. Table 2 illustrates the complementarity of the nucleotide sequences of KIAA1305 BINDING SITE, designated SEQ ID:24683, to the nucleotide sequence of VGAM1844 RNA, herein designated VGAM RNA, also designated SEQ ID:4555.

Another function of VGAM1844 is therefore inhibition of KIAA1305 (Accession NM_025081). Accordingly, utilities of VGAM1844 include diagnosis, prevention and treatment of diseases and clinical conditions associated with KIAA1305. LOC145547 (Accession XM_085167) is another VGAM1844 host target gene. LOC145547 BINDING SITE is HOST TARGET binding site found in the 3' untranslated region of mRNA encoded by LOC145547, corresponding to a HOST TARGET binding site such as BINDING SITE I, BINDING SITE II or BINDING SITE III. Table 2 illustrates the complementarity of the nucleotide sequences of LOC145547 BINDING SITE, designated SEQ ID:37894, to the nucleotide sequence of VGAM1844 RNA, herein designated VGAM RNA, also designated SEQ ID:4555.

Another function of VGAM1844 is therefore inhibition of LOC145547 (Accession XM_085167). Accordingly, utilities of VGAM1844 include diagnosis, prevention and treatment of diseases and clinical conditions associated with LOC145547. FIG. 1 further provides a conceptual description of a novel bioinformatically detected viral gene of the present invention, referred to here as Viral Genomic Address Messenger 1845 (VGAM1845) viral gene, which modulates expression of respective host target genes thereof, the function and utility of which host target genes is known in the art.

VGAM1845 is a novel bioinformatically detected regulatory, non protein coding, viral micro RNA (miRNA) gene. The method by which VGAM1845 was detected is described hereinabove with reference to FIGS. 1-8.

VGAM1845 gene, herein designated VGAM GENE, is a viral gene contained in the genome of Chimpanzee Cytomegalovirus. VGAM1845 host target gene, herein designated VGAM HOST TARGET GENE, is a human gene contained in the human genome.

VGAM1845 gene encodes a VGAM1845 precursor RNA, herein designated VGAM PRECURSOR RNA. Similar to other miRNA genes, and unlike most ordinary genes, VGAM1845 precursor RNA does not encode a protein. A nucleotide sequence identical or highly similar to the nucleotide sequence of VGAM1845 precursor RNA is designated SEQ ID:1831, and is provided hereinbelow with reference to the sequence listing part. Nucleotide sequence SEQ ID:1831 is located at position 23567 relative to the genome of Chimpanzee Cytomegalovirus.

VGAM1845 precursor RNA folds onto itself, forming VGAM1845 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1845 folded precursor RNA into VGAM1845 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1845 RNA is designated SEQ ID:4556, and is provided hereinbelow with reference to the sequence listing part.

VGAM1845 host target gene, herein designated VGAM HOST TARGET GENE, encodes a corresponding messenger RNA, VGAM1845 host target RNA, herein designated VGAM HOST TARGET RNA. VGAM1845 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1845 RNA, herein designated VGAM RNA, binds complementarily to one or more host target binding sites located in untranslated regions of VGAM1845 host target RNA, herein designated VGAM HOST TARGET RNA. This complementary binding is due to the fact that the nucleotide sequence of VGAM1845 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1845 RNA, herein designated VGAM RNA, may have a different number of host target binding sites in untranslated regions of a VGAM1845 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1845 RNA, herein designated VGAM RNA, to host target binding sites on VGAM1845 host target RNA, herein designated VGAM HOST TARGET RNA, such as BINDING SITE I, BINDING SITE II and BINDING SITE III, inhibits translation of VGAM1845 host target RNA into VGAM1845 host target protein, herein designated VGAM HOST TARGET PROTEIN. VGAM host target protein is therefore outlined by a broken line.

It is appreciated that VGAM1845 host target gene, herein designated VGAM HOST TARGET GENE, in fact represents a plurality of VGAM1845 host target genes. The mRNA of each one of this plurality of VGAM1845 host target genes comprises one or more host target binding sites, each having a nucleotide sequence which is at least partly complementary to VGAM1845 RNA, herein designated VGAM RNA, and which when bound by VGAM1845 RNA causes inhibition of translation of respective one or more VGAM1845 host target proteins.

It is further appreciated by one skilled in the art that the mode of translational inhibition illustrated by FIG. 1 with specific reference to translational inhibition exerted by VGAM1845 gene, herein designated VGAM GENE, on one or more VGAM1845 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1845 is inhibition of expression of host target genes, as part of a novel viral mechanism of attacking a host. Accordingly, utilities of VGAM1845 include diagnosis, prevention and treatment of viral infection by Chimpanzee Cytomegalovirus. Specific functions, and accordingly utilities, of VGAM1845 correlate with, and may be deduced from, the identity of the host target genes which VGAM1845 binds and inhibits, and the function of these host target genes, as elaborated hereinbelow.

Nucleotide sequences of the VGAM1845 precursor RNA, herein designated VGAM PRECURSOR RNA, and of the 'diced' VGAM1845 RNA, herein designated VGAM RNA, and a schematic representation of the secondary folding of VGAM1845 folded precursor RNA, herein designated VGAM FOLDED PRECURSOR RNA, of VGAM1845 are further described hereinbelow with reference to Table 1.

Nucleotide sequences of host target binding sites, such as BINDING SITE-I, BINDING SITE-II and BINDING SITE- III of FIG. 1, found on VGAM1845 host target RNA, and schematic representation of the complementarity of each of these host target binding sites to VGAM1845 RNA, herein designated VGAM RNA, are described hereinbelow with reference to Table 2.

As mentioned hereinabove with reference to FIG. 1, a function of VGAM1845 gene, herein designated VGAM is inhibition of expression of VGAM1845 target genes. It is appreciated that specific functions, and accordingly utilities, of VGAM1845 correlate with, and may be deduced from, the identity of the target genes which VGAM1845 binds and inhibits, and the function of these target genes, as elaborated hereinbelow.

CD3Z Antigen, Zeta Polypeptide (TiT3 complex) (CD3Z, Accession NM_000734) is a VGAM1845 host target gene. CD3Z BINDING SITE is HOST TARGET binding site found in the 3' untranslated region of mRNA encoded by CD3Z, corresponding to a HOST TARGET binding site such as BINDING SITE I, BINDING SITE II or BINDING SITE III. Table 2 illustrates the complementarity of the nucleotide sequences of CD3Z BINDING SITE, designated SEQ ID:6391, to the nucleotide sequence of VGAM1845 RNA, herein designated VGAM RNA, also designated SEQ ID:4556.

A function of VGAM1845 is therefore inhibition of CD3Z Antigen, Zeta Polypeptide (TiT3 complex) (CD3Z, Accession NM_000734), a gene which may involve in assembly and expression of the tcr complex as well as signal transduction upon antigen triggering. Accordingly, utilities of VGAM1845 include diagnosis, prevention and treatment of diseases and clinical conditions associated with CD3Z. The function of CD3Z and its association with various diseases and clinical conditions, has been established by previous studies, as described hereinabove with reference to VGAM167. Chemokine (C-X-C motif) Ligand 16 (CXCL16, Accession NM_022059) is another VGAM1845 host target gene. CXCL16 BINDING SITE is HOST TARGET binding site found in the 3' untranslated region of mRNA encoded by CXCL16, corresponding to a HOST TARGET binding site such as BINDING SITE I, BINDING SITE II or BINDING SITE III. Table 2 illustrates the complementarity of the nucleotide sequences of CXCL16 BINDING SITE, designated SEQ ID:22596, to the nucleotide sequence of VGAM1845 RNA, herein designated VGAM RNA, also designated SEQ ID:4556.

Another function of VGAM1845 is therefore inhibition of Chemokine (C-X-C motif) Ligand 16 (CXCL16, Accession NM_022059), a gene which induces calcium mobilization. Accordingly, utilities of VGAM1845 include diagnosis, prevention and treatment of diseases and clinical conditions associated with CXCL16. The function of CXCL16 has been established by previous studies. Using a 2-step EST database search in which putative transcripts were scanned for the occurrence of functional patterns, Matloubian et al. (2000) identified a cDNA encoding a CXC chemokine that they termed CXCL16. The predicted 273-amino acid CXCL16 protein, which is 49% identical to the 246-amino acid mouse sequence, contains a non-glu/leu/arg (ELR) motif-containing CXC chemokine domain, a mucin-like spacer region, a transmembrane domain, and a cytoplasmic tail with a potential tyrosine phosphorylation and SH2 protein-binding site. CXCL16 was the first transmembrane CXC chemokine identified; CX3CL1 (SCYD1; 601880), which also has a mucin-like spacer region, was the only other known transmembrane chemokine. Northern blot analysis of mouse and human tissues detected a 2.2-kb CXCL16 transcript in spleen, lymph nodes, Peyer patches, lung, kidney, small intestine, and thymus, with weak expression in heart and liver and no expression in brain and bone marrow. Flow cytometry and Western blot analysis demonstrated expression of an approximately 60-kD glycosylated cell-surface protein as well as a cell supernatant 35-kD soluble protein. Flow cytometry of cells from mouse tissues indicated that CXCL16 is found on CD11C (ITGAX; 151510)-positive splenic and lymph node dendritic cells; this expression was increased after injection with lipopolysaccharide. Immunohistochemical analysis showed that CXCL16 is expressed in T-cell areas of the splenic white pulp, lymph nodes, the thymus medulla, and, interestingly, in the splenic red pulp. No staining was observed in B-cell areas. After injection of inflammatory mediators, expression was enhanced in T-cell zones and, more prominently, in splenic red pulp. Chemotaxis assays found that CXCL16 induced a strong chemotactic response in activated CD8 T cells. In addition, CXCL16 induced calcium mobilization. Expression cloning of mouse Cxcl16 identified a protein with 71% amino acid identity to human BONZO (OMIM Ref. No. 605163), which Matloubian et al. (2000) renamed CXCR6. Human and mouse cells expressing CXCR6 showed a strong chemotactic response to CXCL16 but not to other chemokines. The authors concluded that CXCL16 and CXCR6 probably function in interactions between dendritic cells and T cells and in regulating T-cell migration in the splenic red pulp. Macrophages endocytose oxidized low density lipoprotein (OxLDL) by a receptor-mediated mechanism. By expression cloning from a phorbol ester-stimulated THP-1 cell library, Shimaoka et al. (2000) isolated a cDNA encoding SRPSOX (scavenger receptor that binds phophatidylserine and oxidized lipoprotein). The deduced 254-amino acid type I transmembrane protein is identical to the CXCL16 protein reported by Matloubian et al. (2000) except that SRPSOX differs by 2 residues and lacks the N-terminal 19 amino acids. Cells expressing SRPSOX bound to phophatidylserine-coated plates; this binding could be inhibited by OxLDL. Scatchard analysis confirmed that SRPSOX is a specific receptor for OxLDL but not LDL or acetyl-LDL. Fluorescence microscopy demonstrated OxLDL uptake in SRPSOX-expressing cells. Immunoblot analysis showed that SRPSOX is expressed as a 30-kD protein in human and mouse macrophages. Northern blot analysis revealed differentiation-inducible expression of 1.8- and 2.5-kb transcripts in macrophages.

Full details of the abovementioned studies are described in the following publications, the disclosure of which are hereby incorporated by reference:

Matloubian, M.; David, A.; Engel, S.; Ryan, J. E.; Cyster, J. G.: A transmembrane CXC chemokine is a ligand for HIV-coreceptor Bonzo. Nature Immun. 1:298-304, 2000; and Shimaoka, T.; Kume, N.; Minami, M.; Hayashida, K.; Kataoka, H.; Kita, T.; Yonehara, S.: Molecular cloning of a novel scavenger receptor for oxidized low density lipoprotein, SR-PSOX.

Further studies establishing the function and utilities of CXCL16 are found in John Hopkins OMIM database record ID 605398, and in sited publications numbered 439 and 7313-7314 listed in the bibliography section hereinbelow, which are also hereby incorporated by reference. Huntingtin-associated Protein 1 (neuroan 1) (HAP1, Accession NM_003949) is another VGAM1845 host target gene. HAP1 BINDING SITE is HOST TARGET binding site found in the 3' untranslated region of mRNA encoded by HAP1, corresponding to a HOST TARGET binding site such as BINDING SITE I, BINDING SITE II or BINDING SITE III. Table 2 illustrates the complementarity of the nucleotide sequences of HAP1 BINDING SITE, designated SEQ ID:10074, to the nucleotide sequence of VGAM1845 RNA, herein designated VGAM RNA, also designated SEQ ID:4556.

Another function of VGAM1845 is therefore inhibition of Huntingtin-associated Protein 1 (neuroan 1) (HAP1, Accession NM_003949), a gene which functions as an adaptor protein using coiled coils to mediate interactions among cytoskeletal, vascular, and motor proteins. Accordingly, utilities of VGAM1845 include diagnosis, prevention and treatment of diseases and clinical conditions associated with HAP1. The function of HAP1 and its association with various diseases and clinical conditions, has been established by previous studies, as described hereinabove with reference to VGAM126. Polymeric Immunoglobulin Receptor (PIGR, Accession XM_052013) is another VGAM1845 host target gene. PIGR BINDING SITE is HOST TARGET binding site found in the 3' untranslated region of mRNA encoded by PIGR, corresponding to a HOST TARGET binding site such as BINDING SITE I, BINDING SITE II or BINDING SITE III. Table 2 illustrates the complementarity of the nucleotide sequences of PIGR BINDING SITE, designated SEQ ID:35936, to the nucleotide sequence of VGAM1845 RNA, herein designated VGAM RNA, also designated SEQ ID:4556.

Another function of VGAM1845 is therefore inhibition of Polymeric Immunoglobulin Receptor (PIGR, Accession XM_052013). Accordingly, utilities of VGAM1845 include diagnosis, prevention and treatment of diseases and clinical conditions associated with PIGR. Proteoglycan 2, Bone Marrow (natural killer cell activator, eosinophil granule major basic protein) (PRG2, Accession NM_002728) is another VGAM1845 host target gene. PRG2 BINDING SITE is HOST TARGET binding site found in the 5' untranslated region of mRNA encoded by PRG2, corresponding to a HOST TARGET binding site such as BINDING SITE I, BINDING SITE II or BINDING SITE III. Table 2 illustrates the complementarity of the nucleotide sequences of PRG2 BINDING SITE, designated SEQ ID:8592, to the nucleotide sequence of VGAM1845 RNA, herein designated VGAM RNA, also designated SEQ ID:4556.

Another function of VGAM1845 is therefore inhibition of Proteoglycan 2, Bone Marrow (natural killer cell activator, eosinophil granule major basic protein) (PRG2, Accession NM_002728), a gene which Myelin basic protein; a constituent of myelin, plays a role in nerve function. Accordingly, utilities of VGAM1845 include diagnosis, prevention and treatment of diseases and clinical conditions associated with PRG2. The function of PRG2 has been established by previous studies. Eosinophil granule major basic protein (MBP) comprises the crystalloid core of the eosinophil granule. Wasmoen et al. (1988) and Weller et al. (1988) published a partial amino acid sequence for MBP, also designated proteoglycan-2 (PRG2). Using this partial sequence, Barker et al. (1988) isolated a full-length PRG2 cDNA from a human promyelocytic leukemia cell line (HL60) cDNA library. McGrogan et al. (1988) independently isolated a PRG2 cDNA from an HL60 cell line cDNA. Yoshimatsu et al. (1992) also identified PRG2 in a search for a natural killer (NK) cell-activating factor purified from the supernatant of a T-cell hybridoma. McGrogan et al. (1988) and Barker et al. (1988) determined that the PRG2 cDNA encodes a deduced 222-amino acid protein with a 15-amino acid hydrophobic signal sequence. PRG2 is initially translated as a 25-kD preproprotein that is posttranslationally modified to a proprotein. Posttranslational modification results in the mature form of PRG2, which is encoded by the carboxy 117 amino acids of the preprotein and has a molecular mass of 14 kD. The 90-amino acid N-terminal domain has 1 potential N-linked glycosylation site. Yoshimatsu et al. (1992) reported that the C-terminal end of PRG2 shares homology with animal lectins. McGrogan et al. (1988) determined that the putative PRG2 proprotein is a bipolar molecule. The amino-terminal half is hydrophilic, whereas the mature PRG2 is hydrophobic. Barker et al. (1988) hypothesized that the translation of PRG2 as a bipolar proprotein may mask the toxic effects of the mature PRG2 and protect the eosinophil from damage while the protein is processed through the endoplasmic reticulum to its sequestered site in the eosinophil granule. Using Northern blot analysis, McGrogan et al. (1988) detected a major 1-kb transcript and a minor 0.5-kb PRG2 transcript in HL60 cells. By the same method, Li et al. (1995) detected a 1-kb transcript in immature cells including bone-marrow and HL60 cells, but not in purified blood eosinophils. Using RT-PCR, Li et al. (1995) detected an additional 1.6-kb transcript in bone marrow cells and HL60 cells at lower levels than the 1-kb transcript. In differentiated blood eosinophils from idiopathic hypereosinophilic syndrome patients, the 1.6-kb transcript predominated. The International Radiation Hybrid Mapping Consortium mapped the PRG2 gene to chromosome 11 (A005W41). By FISH, Plager et al. (2001) mapped the PRG2 and PRG3 (OMIM Ref. No. 606814) genes to chromosome 11cen-q12.

Full details of the abovementioned studies are described in the following publications, the disclosure of which are hereby incorporated by reference:

Li, M.-S.; Sun, L.; Satoh, T.; Fisher, L. M.; Spry, C. J. F.: Human eosinophil major basic protein, a mediator of allergic inflammation, is expressed by alternative splicing from two promoters. Biochem. J. 305:921-927, 1995; and Plager, D. A.; Weiler, D. A.; Loegering, D. A.; Johnson, W. B.; Haley, L.; Eddy, R. L.; Shows, T. B.; Gleich, G. J.: Comparative structure, proximal promoter elements, and chromosome lo.

Further studies establishing the function and utilities of PRG2 are found in John Hopkins OMIM database record ID 605601, and in sited publications numbered 6995-7001 listed in the bibliography section hereinbelow, which are also hereby incorporated by reference. Pleckstrin and Sec7 Domain Protein (PSD, Accession NM_002779) is another VGAM1845 host target gene. PSD BINDING SITE is HOST TARGET binding site found in the 5' untranslated region of mRNA encoded by PSD, corresponding to a HOST TARGET binding site such as BINDING SITE I, BINDING SITE II or BINDING SITE III. Table 2 illustrates the complementarity of the nucleotide sequences of PSD BINDING SITE, designated SEQ ID:8670, to the nucleotide sequence of VGAM1845 RNA, herein designated VGAM RNA, also designated SEQ ID:4556.

Another function of VGAM1845 is therefore inhibition of Pleckstrin and Sec7 Domain Protein (PSD, Accession NM_002779), a gene which promotes guanine-nucleotide exchange on arf6. Accordingly, utilities of VGAM1845 include diagnosis, prevention and treatment of diseases and clinical conditions associated with PSD. The function of PSD and its association with various diseases and clinical conditions, has been established by previous studies, as described hereinabove with reference to VGAM261. Prostaglandin I2 (prostacyclin) Synthase (PTGIS, Accession NM_000961) is another VGAM1845 host target gene. PTGIS BINDING SITE is HOST TARGET binding site found in the 3' untranslated region of mRNA encoded by PTGIS, corresponding to a HOST TARGET binding site such as BINDING SITE I, BINDING SITE II or BINDING SITE III. Table 2 illustrates the complementarity of the nucleotide sequences of PTGIS BINDING SITE, designated SEQ ID:6666, to the nucleotide sequence of VGAM1845 RNA, herein designated VGAM RNA, also designated SEQ ID:4556.

Another function of VGAM1845 is therefore inhibition of Prostaglandin I2 (prostacyclin) Synthase (PTGIS, Accession NM_000961), a gene which catalyzes the isomerization of prostaglandin h2 to prostacyclin (=prostaglandin i2). Accordingly, utilities of VGAM1845 include diagnosis, prevention and treatment of diseases and clinical conditions associated with PTGIS. The function of PTGIS and its association with various diseases and clinical conditions, has been established by previous studies, as described hereinabove with reference to VGAM206. Solute Carrier Family 22 (organic anion/cation transporter), Member 12 (SLC22A12, Accession NM_144585) is another VGAM1845 host target gene. SLC22A12 BINDING SITE is HOST TARGET binding site found in the 3' untranslated region of mRNA encoded by SLC22A12, corresponding to a HOST TARGET binding site such as BINDING SITE I, BINDING SITE II or BINDING SITE III. Table 2 illustrates the complementarity of the nucleotide sequences of SLC22A12 BINDING SITE, designated SEQ ID:29403, to the nucleotide sequence of VGAM1845 RNA, herein designated VGAM RNA, also designated SEQ ID:4556.

Another function of VGAM1845 is therefore inhibition of Solute Carrier Family 22 (organic anion/cation transporter), Member 12 (SLC22A12, Accession NM_144585), a gene which is a urate -anion exchanger regulating blood yrate levels. Accordingly, utilities of VGAM1845 include diagnosis, prevention and treatment of diseases and clinical conditions associated with SLC22A12. The function of SLC22A12 and its association with various diseases and clinical conditions, has been established by previous studies, as described hereinabove with reference to VGAM1034. Unc-13-like (C. elegans) (UNC13, Accession NM_006377) is another VGAM1845 host target gene. UNC13 BINDING SITE is HOST TARGET binding site found in the 3' untranslated region of mRNA encoded by UNC13, corresponding to a HOST TARGET binding site such as BINDING SITE I, BINDING SITE II or BINDING SITE III. Table 2 illustrates the complementarity of the nucleotide sequences of UNC13 BINDING SITE, designated SEQ ID:13069, to the nucleotide sequence of VGAM1845 RNA, herein designated VGAM RNA, also designated SEQ ID:4556.

Another function of VGAM1845 is therefore inhibition of Unc-13-like (C. elegans) (UNC13, Accession NM_006377), a gene which is a putative diacylglycerol receptor and may act in PKC-independent, diacylglycerol-activated apoptosis pathway. Accordingly, utilities of VGAM1845 include diagnosis, prevention and treatment of diseases and clinical conditions associated with UNC13. The function of UNC13 has been established by previous studies. The priming step of synaptic vesicle exocytosis is thought to require the formation of the SNARE complex, which comprises the proteins synaptobrevin (OMIM Ref. No. 185881), SNAP25 (OMIM Ref. No. 600322), and syntaxin (see OMIM Ref. No. 186590). In solution, syntaxin adopts a default, closed configuration that is incompatible with formation of the SNARE complex. Specifically, the amino terminus of syntaxin binds the SNARE motif and occludes interactions with the other SNARE proteins. The N terminus of syntaxin also binds the presynaptic protein UNC13. Studies in mouse, Drosophila, and Caenorhabditis elegans suggest that UNC13 functions at a postdocking step of exocytosis, most likely during synaptic vesicle priming. Therefore, UNC13 binding to the N terminus of syntaxin may promote the open configuration of syntaxin. To test this model, Richmond et al. (2001) engineered mutations into C. elegans syntaxin that caused the protein to adopt the open configuration constitutively. Richmond et al. (2001) demonstrated that the open form of syntaxin can bypass the requirement for UNC13 in synaptic vesicle priming. Thus, Richmond et al. (2001) concluded that it is likely that UNC13 primes synaptic vesicles for fusion by promoting the open configuration of syntaxin. Animal model experiments lend further support to the function of UNC13. Munc13-1 is a presynaptic protein with an essential role in synaptic vesicle priming. It contains a diacylglycerol (DAG)/beta phorbol ester-binding C1 domain and is a potential target of the DAG second messenger pathway that may act in parallel with protein kinases C (PKCs; OMIM Ref. No. 600448). Using genetically modified mice that expressed a DAG/beta phorbol ester-binding-deficient Munc13-1 variant (missense mutation his567 to lys) instead of the wildtype protein, Rhee et al. (2002) determined the relative contribution of PKCs and Munc13-1 to DAG/beta phorbol ester-dependent regulation of neurotransmitter release. They showed that Munc13s are the main presynaptic DAG/beta phorbol ester receptors in hippocampal neurons. Modulation of Munc13-1 activity by second messengers via the DAG/beta phorbol ester-binding C1 domain is essential for use-dependent alterations of synaptic efficacy and survival.

It is appreciated that the abovementioned animal model for UNC13 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Richmond, J. E.; Weimer, R. M.; Jorgensen, E. M.: An open form of syntaxin bypasses the requirement for UNC-13 in vesicle priming. Nature 412:338-341, 2001; and Rhee, J.-S.; Betz, A.; Pyott, S.; Reim, K.; Varoqueaux, F.; Augustin, I.; Hesse, D.; Sudhof, T. C.; Takahashi, M.; Rosenmund, C.; Brose, N.: Beta phorbol ester- and diacylglycerol-indu.

Further studies establishing the function and utilities of UNC13 are found in John Hopkins OMIM database record ID 605836, and in sited publications numbered 6430-6432, 176 and 6433-6434 listed in the bibliography section hereinbelow, which are also hereby incorporated by reference. V-yes-1 Yamaguchi Sarcoma Viral Oncogene Homolog 1 (YES1, Accession NM_005433) is another VGAM1845 host target gene. YES1 BINDING SITE is HOST TARGET binding site found in the 3' untranslated region of mRNA encoded by YES1, corresponding to a HOST TARGET binding site such as BINDING SITE I, BINDING SITE II or BINDING SITE III. Table 2 illustrates the complementarity of the nucleotide sequences of YES1 BINDING SITE, designated SEQ ID:11911, to the nucleotide sequence of VGAM1845 RNA, herein designated VGAM RNA, also designated SEQ ID:4556.

Another function of VGAM1845 is therefore inhibition of V-yes-1 Yamaguchi Sarcoma Viral Oncogene Homolog 1 (YES1, Accession NM_005433), a gene which is a putative protein-tyrosine kinase. Accordingly, utilities of VGAM1845 include diagnosis, prevention and treatment of diseases and clinical conditions associated with YES1. The function of YES1 and its association with various diseases and clinical conditions, has been established by previous studies, as described hereinabove with reference to VGAM74. Zinc Finger Protein 137 (clone pHZ-30) (ZNF137, Accession NM_003438) is another VGAM1845 host target gene. ZNF137 BINDING SITE is HOST TARGET binding site found in the 3' untranslated region of mRNA encoded by ZNF137, corresponding to a HOST TARGET binding site such as BINDING SITE I, BINDING SITE II or BINDING SITE III. Table 2 illustrates the complementarity of the nucleotide sequences of ZNF137 BINDING SITE, designated SEQ ID:9492, to the nucleotide sequence of VGAM1845 RNA, herein designated VGAM RNA, also designated SEQ ID:4556.

Another function of VGAM1845 is therefore inhibition of Zinc Finger Protein 137 (clone pHZ-30) (ZNF137, Accession NM_003438). Accordingly, utilities of VGAM1845 include diagnosis, prevention and treatment of diseases and clinical conditions associated with ZNF137. APCL (Accession NM_005883) is another VGAM1845 host target gene. APCL BINDING SITE is HOST TARGET binding site found in the 3' untranslated region of mRNA encoded by APCL, corresponding to a HOST TARGET binding site such as BINDING SITE I, BINDING SITE II or BINDING SITE III. Table 2 illustrates the complementarity of the nucleotide sequences of APCL BINDING SITE, designated SEQ ID:12501, to the nucleotide sequence of VGAM1845 RNA, herein designated VGAM RNA, also designated SEQ ID:4556.

Another function of VGAM1845 is therefore inhibition of APCL (Accession NM_005883). Accordingly, utilities of VGAM1845 include diagnosis, prevention and treatment of diseases and clinical conditions associated with APCL. Chromosome 11 Open Reading Frame 17 (C11orf17, Accession NM_020642) is another VGAM1845 host target gene. C11orf17 BINDING SITE is HOST TARGET binding site found in the 3' untranslated region of mRNA encoded by C11orf17, corresponding to a HOST TARGET binding site such as BINDING SITE I, BINDING SITE II or BINDING SITE III. Table 2 illustrates the complementarity of the nucleotide sequences of C11orf17 BINDING SITE, designated SEQ ID:21806, to the nucleotide sequence of VGAM1845 RNA, herein designated VGAM RNA, also designated SEQ ID:4556.

Another function of VGAM1845 is therefore inhibition of Chromosome 11 Open Reading Frame 17 (C11orf17, Accession NM_020642). Accordingly, utilities of VGAM1845 include diagnosis, prevention and treatment of diseases and clinical conditions associated with C11orf17. Carcinoembryonic Antigen-related Cell Adhesion Molecule 8 (CEACAM8, Accession NM_001816) is another VGAM1845 host target gene. CEACAM8 BINDING SITE is HOST TARGET binding site found in the 3' untranslated region of mRNA encoded by CEACAM8, corresponding to a HOST TARGET binding site such as BINDING SITE I, BINDING SITE II or BINDING SITE III. Table 2 illustrates the complementarity of the nucleotide sequences of CEACAM8 BINDING SITE, designated SEQ ID:7560, to the nucleotide sequence of VGAM1845 RNA, herein designated VGAM RNA, also designated SEQ ID:4556.

Another function of VGAM1845 is therefore inhibition of Carcinoembryonic Antigen-related Cell Adhesion Molecule 8 (CEACAM8, Accession NM_001816). Accordingly, utilities of VGAM1845 include diagnosis, prevention and treatment of diseases and clinical conditions associated with CEACAM8. DKFZP434P0111 (Accession XM_041116) is another VGAM1845 host target gene. DKFZP434P0111 BINDING SITE is HOST TARGET binding site found in the 3' untranslated region of mRNA encoded by DKFZP434P0111, corresponding to a HOST TARGET binding site such as BINDING SITE I, BINDING SITE II or BINDING SITE III. Table 2 illustrates the complementarity of the nucleotide sequences of DKFZP434P0111 BINDING SITE, designated SEQ ID:33456, to the nucleotide sequence of VGAM1845 RNA, herein designated VGAM RNA, also designated SEQ ID:4556.

Another function of VGAM1845 is therefore inhibition of DKFZP434P0111 (Accession XM_041116). Accordingly, utilities of VGAM1845 include diagnosis, prevention and treatment of diseases and clinical conditions associated with DKFZP434P0111. DKFZP566G1424 (Accession XM_097771) is another VGAM1845 host target gene. DKFZP566G1424 BINDING SITE is HOST TARGET binding site found in the 5' untranslated region of mRNA encoded by DKFZP566G1424, corresponding to a HOST TARGET binding site such as BINDING SITE I, BINDING SITE II or BINDING SITE III. Table 2 illustrates the complementarity of the nucleotide sequences of DKFZP566G1424 BINDING SITE, designated SEQ ID:41113, to the nucleotide sequence of VGAM1845 RNA, herein designated VGAM RNA, also designated SEQ ID:4556.

Another function of VGAM1845 is therefore inhibition of DKFZP566G1424 (Accession XM_097771). Accordingly, utilities of VGAM1845 include diagnosis, prevention and treatment of diseases and clinical conditions associated with DKFZP566G1424. FLJ14442 (Accession NM_032785) is another VGAM1845 host target gene. FLJ14442 BINDING SITE is HOST TARGET binding site found in the 3' untranslated region of mRNA encoded by FLJ14442, corresponding to a HOST TARGET binding site such as BINDING SITE I, BINDING SITE II or BINDING SITE III. Table 2 illustrates the complementarity of the nucleotide sequences of FLJ14442 BINDING SITE, designated SEQ ID:26538, to the nucleotide sequence of VGAM1845 RNA, herein designated VGAM RNA, also designated SEQ ID:4556.

Another function of VGAM1845 is therefore inhibition of FLJ14442 (Accession NM_032785). Accordingly, utilities of VGAM1845 include diagnosis, prevention and treatment of diseases and clinical conditions associated with FLJ14442. FLJ20291 (Accession NM_017748) is another VGAM1845 host target gene. FLJ20291 BINDING SITE is HOST TARGET binding site found in the 3' untranslated region of mRNA encoded by FLJ20291, corresponding to a HOST TARGET binding site such as BINDING SITE I, BINDING SITE II or BINDING SITE III. Table 2 illustrates the complementarity of the nucleotide sequences of FLJ20291 BINDING SITE, designated SEQ ID:19340, to the nucleotide sequence of VGAM1845 RNA, herein designated VGAM RNA, also designated SEQ ID:4556.

Another function of VGAM1845 is therefore inhibition of FLJ20291 (Accession NM_017748). Accordingly, utilities of VGAM1845 include diagnosis, prevention and treatment of diseases and clinical conditions associated with FLJ20291. FLJ23556 (Accession NM_024880) is another VGAM1845 host target gene. FLJ23556 BINDING SITE is HOST TARGET binding site found in the 3' untranslated region of mRNA encoded by FLJ23556, corresponding to a HOST TARGET binding site such as BINDING SITE I, BINDING SITE II or BINDING SITE III. Table 2 illustrates the complementarity of the nucleotide sequences of FLJ23556 BINDING SITE, designated SEQ ID:24319, to the nucleotide sequence of VGAM1845 RNA, herein designated VGAM RNA, also designated SEQ ID:4556.

Another function of VGAM1845 is therefore inhibition of FLJ23556 (Accession NM_024880). Accordingly, utilities of VGAM1845 include diagnosis, prevention and treatment of diseases and clinical conditions associated with FLJ23556. KIAA0720 (Accession XM_030970) is another VGAM1845 host target gene. KIAA0720 BINDING SITE is HOST TARGET binding site found in the 3' untranslated region of mRNA encoded by KIAA0720, corresponding to a HOST TARGET binding site such as BINDING SITE I, BINDING SITE II or BINDING SITE III. Table 2 illustrates the complementarity of the nucleotide sequences of KIAA0720 BINDING SITE, designated SEQ ID:31236, to the nucleotide sequence of VGAM1845 RNA, herein designated VGAM RNA, also designated SEQ ID:4556.

Another function of VGAM1845 is therefore inhibition of KIAA0720 (Accession XM_030970). Accordingly, utilities of VGAM1845 include diagnosis, prevention and treatment of diseases and clinical conditions associated with KIAA0720. KIAA1615 (Accession XM_044021) is another VGAM1845 host target gene. KIAA1615 BINDING SITE is HOST TARGET binding site found in the 3' untranslated region of mRNA encoded by KIAA1615, corresponding to a HOST TARGET binding site such as BINDING SITE I, BINDING SITE II or BINDING SITE III. Table 2 illustrates the complementarity of the nucleotide sequences of KIAA1615 BINDING SITE, designated SEQ ID:34087, to the nucleotide sequence of VGAM1845 RNA, herein designated VGAM RNA, also designated SEQ ID:4556.

Another function of VGAM1845 is therefore inhibition of KIAA1615 (Accession XM_044021). Accordingly, utilities of VGAM1845 include diagnosis, prevention and treatment of diseases and clinical conditions associated with KIAA1615. KIAA1727 (Accession XM_034262) is another VGAM1845 host target gene. KIAA1727 BINDING SITE is HOST TARGET binding site found in the 3' untranslated region of mRNA encoded by KIAA1727, corresponding to a HOST TARGET binding site such as BINDING SITE I, BINDING SITE II or BINDING SITE III. Table 2 illustrates the complementarity of the nucleotide sequences of KIAA1727 BINDING SITE, designated SEQ ID:32035, to the nucleotide sequence of VGAM1845 RNA, herein designated VGAM RNA, also designated SEQ ID:4556.

Another function of VGAM1845 is therefore inhibition of KIAA1727 (Accession XM_034262). Accordingly, utilities of VGAM1845 include diagnosis, prevention and treatment of diseases and clinical conditions associated with KIAA1727. KIAA1877 (Accession XM_038616) is another VGAM1845 host target gene. KIAA1877 BINDING SITE is HOST TARGET binding site found in the 3' untranslated region of mRNA encoded by KIAA1877, corresponding to a HOST TARGET binding site such as BINDING SITE I, BINDING SITE II or BINDING SITE III. Table 2 illustrates the complementarity of the nucleotide sequences of KIAA1877 BINDING SITE, designated SEQ ID:32880, to the nucleotide sequence of VGAM1845 RNA, herein designated VGAM RNA, also designated SEQ ID:4556.

Another function of VGAM1845 is therefore inhibition of KIAA1877 (Accession XM_038616). Accordingly, utilities of VGAM1845 include diagnosis, prevention and treatment of diseases and clinical conditions associated with KIAA1877. KIAA1924 (Accession XM_057091) is another VGAM1845 host target gene. KIAA1924 BINDING SITE is HOST TARGET binding site found in the 3' untranslated region of mRNA encoded by KIAA1924, corresponding to a HOST TARGET binding site such as BINDING SITE I, BINDING SITE II or BINDING SITE III. Table 2 illustrates the complementarity of the nucleotide sequences of KIAA1924 BINDING SITE, designated SEQ ID:36472, to the nucleotide sequence of VGAM1845 RNA, herein designated VGAM RNA, also designated SEQ ID:4556.

Another function of VGAM1845 is therefore inhibition of KIAA1924 (Accession XM_057091). Accordingly, utilities of VGAM1845 include diagnosis, prevention and treatment of diseases and clinical conditions associated with KIAA1924. Nup43 (Accession NM_024647) is another VGAM1845 host target gene. Nup43 BINDING SITE is HOST TARGET binding site found in the 3' untranslated region of mRNA encoded by Nup43, corresponding to a HOST TARGET binding site such as BINDING SITE I, BINDING SITE II or BINDING SITE III. Table 2 illustrates the complementarity of the nucleotide sequences of Nup43 BINDING SITE, designated SEQ ID:23935, to the nucleotide sequence of VGAM1845 RNA, herein designated VGAM RNA, also designated SEQ ID:4556.

Another function of VGAM1845 is therefore inhibition of Nup43 (Accession NM_024647). Accordingly, utilities of VGAM1845 include diagnosis, prevention and treatment of diseases and clinical conditions associated with Nup43. Phytanoyl-CoA Hydroxylase Interacting Protein (PHYHIP, Accession NM_014759) is another VGAM1845 host target gene. PHYHIP BINDING SITE is HOST TARGET binding site found in the 5' untranslated region of mRNA encoded by PHYHIP, corresponding to a HOST TARGET binding site such as BINDING SITE I, BINDING SITE II or BINDING SITE III. Table 2 illustrates the complementarity of the nucleotide sequences of PHYHIP BINDING SITE, designated SEQ ID:16510, to the nucleotide sequence of VGAM1845 RNA, herein designated VGAM RNA, also designated SEQ ID:4556.

Another function of VGAM1845 is therefore inhibition of Phytanoyl-CoA Hydroxylase Interacting Protein (PHYHIP, Accession NM_014759). Accordingly, utilities of VGAM1845 include diagnosis, prevention and treatment of diseases and clinical conditions associated with PHYHIP. PRO1992 (Accession NM_014107) is another VGAM1845 host target gene. PRO1992 BINDING SITE is HOST TARGET binding site found in the 3' untranslated region of mRNA encoded by PRO1992, corresponding to a HOST TARGET binding site such as BINDING SITE I, BINDING SITE II or BINDING SITE III. Table 2 illustrates the complementarity of the nucleotide sequences of PRO1992 BINDING SITE, designated SEQ ID:15334, to the nucleotide sequence of VGAM1845 RNA, herein designated VGAM RNA, also designated SEQ ID:4556.

Another function of VGAM1845 is therefore inhibition of PRO1992 (Accession NM_014107). Accordingly, utilities of VGAM1845 include diagnosis, prevention and treatment of diseases and clinical conditions associated with PRO1992. RAP140 (Accession NM_015224) is another VGAM1845 host target gene. RAP140 BINDING SITE is HOST TARGET binding site found in the 3' untranslated region of mRNA encoded by RAP140, corresponding to a HOST TARGET binding site such as BINDING SITE I, BINDING SITE II or BINDING SITE III. Table 2 illustrates the complementarity of the nucleotide sequences of RAP140 BINDING SITE, designated SEQ ID:17552, to the nucleotide sequence of VGAM1845 RNA, herein designated VGAM RNA, also designated SEQ ID:4556.

Another function of VGAM1845 is therefore inhibition of RAP140 (Accession NM_015224). Accordingly, utilities of VGAM1845 include diagnosis, prevention and treatment of diseases and clinical conditions associated with RAP140. LOC121504 (Accession XM_058571) is another VGAM1845 host target gene. LOC121504 BINDING SITE is HOST TARGET binding site found in the 3' untranslated region of mRNA encoded by LOC121504, corresponding to a HOST TARGET binding site such as BINDING SITE I, BINDING SITE II or BINDING SITE III. Table 2 illustrates the complementarity of the nucleotide sequences of LOC121504 BINDING SITE, designated SEQ ID:36670, to the nucleotide sequence of VGAM1845 RNA, herein designated VGAM RNA, also designated SEQ ID:4556.

Another function of VGAM1845 is therefore inhibition of LOC121504 (Accession XM_058571). Accordingly, utilities of VGAM1845 include diagnosis, prevention and treatment of diseases and clinical conditions associated with LOC121504. LOC128077 (Accession XM_059208) is another VGAM1845 host target gene. LOC128077 BINDING SITE is HOST TARGET binding site found in the 3' untranslated region of mRNA encoded by LOC128077, corresponding to a HOST TARGET binding site such as BINDING SITE I, BINDING SITE II or BINDING SITE III. Table 2 illustrates the complementarity of the nucleotide sequences of LOC128077 BINDING SITE, designated SEQ ID:36915, to the nucleotide sequence of VGAM1845 RNA, herein designated VGAM RNA, also designated SEQ ID:4556.

Another function of VGAM1845 is therefore inhibition of LOC128077 (Accession XM_059208). Accordingly, utilities of VGAM1845 include diagnosis, prevention and treatment of diseases and clinical conditions associated with LOC128077. LOC146909 (Accession XM_085634) is another VGAM1845 host target gene. LOC146909 BINDING SITE is HOST TARGET binding site found in the 3' untranslated region of mRNA encoded by LOC146909, corresponding to a HOST TARGET binding site such as BINDING SITE I, BINDING SITE II or BINDING SITE III. Table 2 illustrates the complementarity of the nucleotide sequences of LOC146909 BINDING SITE, designated SEQ ID:38265, to the nucleotide sequence of VGAM1845 RNA, herein designated VGAM RNA, also designated SEQ ID:4556.

Another function of VGAM1845 is therefore inhibition of LOC146909 (Accession XM_085634). Accordingly, utilities of VGAM1845 include diagnosis, prevention and treatment of diseases and clinical conditions associated with LOC146909. LOC147080 (Accession XM_097182) is another VGAM1845 host target gene. LOC147080 BINDING SITE is HOST TARGET binding site found in the 5' untranslated region of mRNA encoded by LOC147080, corresponding to a HOST TARGET binding site such as BINDING SITE I, BINDING SITE II or BINDING SITE III. Table 2 illustrates the complementarity of the nucleotide sequences of LOC147080 BINDING SITE, designated SEQ ID:40797, to the nucleotide sequence of VGAM1845 RNA, herein designated VGAM RNA, also designated SEQ ID:4556.

Another function of VGAM1845 is therefore inhibition of LOC147080 (Accession XM_097182). Accordingly, utilities of VGAM1845 include diagnosis, prevention and treatment of diseases and clinical conditions associated with LOC147080. LOC147299 (Accession XM_085763) is another VGAM1845 host target gene. LOC147299 BINDING SITE is HOST TARGET binding site found in the 3' untranslated region of mRNA encoded by LOC147299, corresponding to a HOST TARGET binding site such as BINDING SITE I, BINDING SITE II or BINDING SITE III. Table 2 illustrates the complementarity of the nucleotide sequences of LOC147299 BINDING SITE, designated SEQ ID:38329, to the nucleotide sequence of VGAM1845 RNA, herein designated VGAM RNA, also designated SEQ ID:4556.

Another function of VGAM1845 is therefore inhibition of LOC147299 (Accession XM_085763). Accordingly, utilities of VGAM1845 include diagnosis, prevention and treatment of diseases and clinical conditions associated with LOC147299. LOC151701 (Accession XM_098109) is another VGAM1845 host target gene. LOC151701 BINDING SITE is HOST TARGET binding site found in the 3' untranslated region of mRNA encoded by LOC151701, corresponding to a HOST TARGET binding site such as BINDING SITE I, BINDING SITE II or BINDING SITE III. Table 2 illustrates the complementarity of the nucleotide sequences of LOC151701 BINDING SITE, designated SEQ ID:41384, to the nucleotide sequence of VGAM1845 RNA, herein designated VGAM RNA, also designated SEQ ID:4556.

Another function of VGAM1845 is therefore inhibition of LOC151701 (Accession XM_098109). Accordingly, utilities of VGAM1845 include diagnosis, prevention and treatment of diseases and clinical conditions associated with LOC151701. LOC154877 (Accession XM_098626) is another VGAM1845 host target gene. LOC154877 BINDING SITE is HOST TARGET binding site found in the 3' untranslated region of mRNA encoded by LOC154877, corresponding to a HOST TARGET binding site such as BINDING SITE I, BINDING SITE II or BINDING SITE III. Table 2 illustrates the complementarity of the nucleotide sequences of LOC154877 BINDING SITE, designated SEQ ID:41739, to the nucleotide sequence of VGAM1845 RNA, herein designated VGAM RNA, also designated SEQ ID:4556.

Another function of VGAM1845 is therefore inhibition of LOC154877 (Accession XM_098626). Accordingly, utilities of VGAM1845 include diagnosis, prevention and treatment of diseases and clinical conditions associated with LOC154877. LOC220002 (Accession XM_166224) is another VGAM1845 host target gene. LOC220002 BINDING SITE is HOST TARGET binding site found in the 3' untranslated region of mRNA encoded by LOC220002, corresponding to a HOST TARGET binding site such as BINDING SITE I, BINDING SITE II or BINDING SITE III. Table 2 illustrates the complementarity of the nucleotide sequences of LOC220002 BINDING SITE, designated SEQ ID:44047, to the nucleotide sequence of VGAM1845 RNA, herein designated VGAM RNA, also designated SEQ ID:4556.

Another function of VGAM1845 is therefore inhibition of LOC220002 (Accession XM_166224). Accordingly, utilities of VGAM1845 include diagnosis, prevention and treatment of diseases and clinical conditions associated with LOC220002. LOC91115 (Accession XM_036218) is another VGAM1845 host target gene. LOC91115 BINDING SITE is HOST TARGET binding site found in the 3' untranslated region of mRNA encoded by LOC91115, corresponding to a HOST TARGET binding site such as BINDING SITE I, BINDING SITE II or BINDING SITE III. Table 2 illustrates the complementarity of the nucleotide sequences of LOC91115 BINDING SITE, designated SEQ ID:32393, to the nucleotide sequence of VGAM1845 RNA, herein designated VGAM RNA, also designated SEQ ID:4556.

Another function of VGAM1845 is therefore inhibition of LOC91115 (Accession XM_036218). Accordingly, utilities of VGAM1845 include diagnosis, prevention and treatment of diseases and clinical conditions associated with LOC91115. FIG. 1 further provides a conceptual description of a novel bioinformatically detected viral gene of the present invention, referred to here as Viral Genomic Address Messenger 1846 (VGAM1846) viral gene, which modulates expression of respective host target genes thereof, the function and utility of which host target genes is known in the art.

VGAM1846 is a novel bioinformatically detected regulatory, non protein coding, viral micro RNA (miRNA) gene. The method by which VGAM1846 was detected is described hereinabove with reference to FIGS. 1-8.

VGAM1846 gene, herein designated VGAM GENE, is a viral gene contained in the genome of Chimpanzee Cytomegalovirus. VGAM1846 host target gene, herein designated VGAM HOST TARGET GENE, is a human gene contained in the human genome.

VGAM1846 gene encodes a VGAM1846 precursor RNA, herein designated VGAM PRECURSOR RNA. Similar to other miRNA genes, and unlike most ordinary genes, VGAM1846 precursor RNA does not encode a protein. A nucleotide sequence identical or highly similar to the nucleotide sequence of VGAM1846 precursor RNA is designated SEQ ID:1832, and is provided hereinbelow with reference to the sequence listing part. Nucleotide sequence SEQ ID:1832 is located at position 16140 relative to the genome of Chimpanzee Cytomegalovirus.

VGAM1846 precursor RNA folds onto itself, forming VGAM1846 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1846 folded precursor RNA into VGAM1846 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM1846 RNA is designated SEQ ID:4557, and is provided hereinbelow with reference to the sequence listing part.

VGAM1846 host target gene, herein designated VGAM HOST TARGET GENE, encodes a corresponding messenger RNA, VGAM1846 host target RNA, herein designated VGAM HOST TARGET RNA. VGAM1846 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1846 RNA, herein designated VGAM RNA, binds complementarily to one or more host target binding sites located in untranslated regions of VGAM1846 host target RNA, herein designated VGAM HOST TARGET RNA. This complementary binding is due to the fact that the nucleotide sequence of VGAM1846 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1846 RNA, herein designated VGAM RNA, may have a different number of host target binding sites in untranslated regions of a VGAM1846 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1846 RNA, herein designated VGAM RNA, to host target binding sites on VGAM1846 host target RNA, herein designated VGAM HOST TARGET RNA, such as BINDING SITE I, BINDING SITE II and BINDING SITE III, inhibits translation of VGAM1846 host target RNA into VGAM1846 host target protein, herein designated VGAM HOST TARGET PROTEIN. VGAM host target protein is therefore outlined by a broken line.

It is appreciated that VGAM1846 host target gene, herein designated VGAM HOST TARGET GENE, in fact represents a plurality of VGAM1846 host target genes. The mRNA of each one of this plurality of VGAM1846 host target genes comprises one or more host target binding sites, each having a nucleotide sequence which is at least partly complementary to VGAM1846 RNA, herein designated VGAM RNA, and which when bound by VGAM1846 RNA causes inhibition of translation of respective one or more VGAM1846 host target proteins.

It is further appreciated by one skilled in the art that the mode of translational inhibition illustrated by FIG. 1 with specific reference to translational inhibition exerted by VGAM1846 gene, herein designated VGAM GENE, on one or more VGAM1846 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1846 is inhibition of expression of host target genes, as part of a novel viral mechanism of attacking a host. Accordingly, utilities of VGAM1846 include diagnosis, prevention and treatment of viral infection by Chimpanzee Cytomegalovirus. Specific functions, and accordingly utilities, of VGAM1846 correlate with, and may be deduced from, the identity of the host target genes which VGAM1846 binds and inhibits, and the function of these host target genes, as elaborated hereinbelow.

Nucleotide sequences of the VGAM1846 precursor RNA, herein designated VGAM PRECURSOR RNA, and of the 'diced' VGAM1846 RNA, herein designated VGAM RNA, and a schematic representation of the secondary folding of VGAM1846 folded precursor RNA, herein designated VGAM FOLDED PRECURSOR RNA, of VGAM1846 are further described hereinbelow with reference to Table 1.

Nucleotide sequences of host target binding sites, such as BINDING SITE-I, BINDING SITE-II and BINDING SITE-III of FIG. 1, found on VGAM1846 host target RNA, and schematic representation of the complementarity of each of these host target binding sites to VGAM1846 RNA, herein designated VGAM RNA, are described hereinbelow with reference to Table 2.

As mentioned hereinabove with reference to FIG. 1, a function of VGAM1846 gene, herein designated VGAM is inhibition of expression of VGAM1846 target genes. It is appreciated that specific functions, and accordingly utilities, of VGAM1846 correlate with, and may be deduced from, the identity of the target genes which VGAM1846 binds and inhibits, and the function of these target genes, as elaborated hereinbelow.

FLJ10713 (Accession NM_018189) is a VGAM1846 host target gene. FLJ10713 BINDING SITE is HOST TARGET binding site found in the 3' untranslated region of mRNA encoded by FLJ10713, corresponding to a HOST TARGET binding site such as BINDING SITE I, BINDING SITE II or BINDING SITE III. Table 2 illustrates the complementarity of the nucleotide sequences of FLJ10713 BINDING SITE, designated SEQ ID:20039, to the nucleotide sequence of VGAM1846 RNA, herein designated VGAM RNA, also designated SEQ ID:4557.

A function of VGAM1846 is therefore inhibition of FLJ10713 (Accession NM_018189). Accordingly, utilities of VGAM1846 include diagnosis, prevention and treatment of diseases and clinical conditions associated with FLJ10713. FLJ22794 (Accession XM_166220) is another VGAM1846 host target gene. FLJ22794 BINDING SITE is HOST TARGET binding site found in the 5' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44031, to the nucleotide sequence of VGAM1846 RNA, herein designated VGAM RNA, also designated SEQ ID:4557.

Another function of VGAM1846 is therefore inhibition of FLJ22794 (Accession XM_166220). Accordingly, utilities of VGAM1846 include diagnosis, prevention and treatment of diseases and clinical conditions associated with FLJ22794. LOC152271 (Accession XM_087419) is another VGAM1846 host target gene. LOC152271 BINDING SITE is HOST TARGET binding site found in the 3' untranslated region of mRNA encoded by LOC152271, corresponding to a HOST TARGET binding site such as BINDING SITE I, BINDING SITE II or BINDING SITE III. Table 2 illustrates the complementarity of the nucleotide sequences of LOC152271 BINDING SITE, designated SEQ ID:39239, to the nucleotide sequence of VGAM1846 RNA, herein designated VGAM RNA, also designated SEQ ID:4557.

Another function of VGAM1846 is therefore inhibition of LOC152271 (Accession XM_087419). Accordingly, utilities of VGAM1846 include diagnosis, prevention and treatment of diseases and clinical conditions associated with LOC152271. FIG. 1 further provides a conceptual description of a novel bioinformatically detected viral gene of the present invention, referred to here as Viral Genomic Address Messenger 1847 (VGAM1847) viral gene, which modulates expression of respective host target genes thereof, the function and utility of which host target genes is known in the art.

VGAM1847 is a novel bioinformatically detected regulatory, non protein coding, viral micro RNA (miRNA) gene. The method by which VGAM1847 was detected is described hereinabove with reference to FIGS. 1-8.

VGAM1847 gene, herein designated VGAM GENE, is a viral gene contained in the genome of Sonchus Yellow Net Virus. VGAM1847 host target gene, herein designated VGAM HOST TARGET GENE, is a human gene contained in the human genome.

VGAM1847 gene encodes a VGAM1847 precursor RNA, herein designated VGAM PRECURSOR RNA. Similar to other miRNA genes, and unlike most ordinary genes, VGAM1847 precursor RNA does not encode a protein. A nucleotide sequence identical or highly similar to the nucleotide sequence of VGAM1847 precursor RNA is designated SEQ ID:1833, and is provided hereinbelow with reference to the sequence listing part. Nucleotide sequence SEQ ID:1833 is located at position 6650 relative to the genome of Sonchus Yellow Net Virus.

VGAM1847 precursor RNA folds onto itself, forming VGAM1847 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1847 folded precursor RNA into VGAM1847 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 43%) nucleotide sequence of VGAM1847 RNA is designated SEQ ID:4558, and is provided hereinbelow with reference to the sequence listing part.

VGAM1847 host target gene, herein designated VGAM HOST TARGET GENE, encodes a corresponding messenger RNA, VGAM1847 host target RNA, herein designated VGAM HOST TARGET RNA. VGAM1847 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1847 RNA, herein designated VGAM RNA, binds complementarily to one or more host target binding sites located in untranslated regions of VGAM1847 host target RNA, herein designated VGAM HOST TARGET RNA. This complementary binding is due to the fact that the nucleotide sequence of VGAM1847 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1847 RNA, herein designated VGAM RNA, may have a different number of host target binding sites in untranslated regions of a VGAM1847 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1847 RNA, herein designated VGAM RNA, to host target binding sites on VGAM1847 host target RNA, herein designated VGAM HOST TARGET RNA, such as BINDING SITE I, BINDING SITE II and BINDING SITE III, inhibits translation of VGAM1847 host target RNA into VGAM1847 host target protein, herein designated VGAM HOST TARGET PROTEIN. VGAM host target protein is therefore outlined by a broken line.

It is appreciated that VGAM1847 host target gene, herein designated VGAM HOST TARGET GENE, in fact represents a plurality of VGAM1847 host target genes. The mRNA of each one of this plurality of VGAM1847 host target genes comprises one or more host target binding sites, each having a nucleotide sequence which is at least partly complementary to VGAM1847 RNA, herein designated VGAM RNA, and which when bound by VGAM1847 RNA causes inhibition of translation of respective one or more VGAM1847 host target proteins.

It is further appreciated by one skilled in the art that the mode of translational inhibition illustrated by FIG. 1 with specific reference to translational inhibition exerted by VGAM1847 gene, herein designated VGAM GENE, on one or more VGAM1847 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1847 is inhibition of expression of host target genes, as part of a novel viral mechanism of attacking a host. Accordingly, utilities of VGAM1847 include diagnosis, prevention and treatment of viral infection by Sonchus Yellow Net Virus. Specific functions, and accordingly utilities, of VGAM1847 correlate with, and may be deduced from, the identity of the host target genes which VGAM1847 binds and inhibits, and the function of these host target genes, as elaborated hereinbelow.

Nucleotide sequences of the VGAM1847 precursor RNA, herein designated VGAM PRECURSOR RNA, and of the 'diced' VGAM1847 RNA, herein designated VGAM RNA, and a schematic representation of the secondary folding of VGAM1847 folded precursor RNA, herein designated VGAM FOLDED PRECURSOR RNA, of VGAM1847 are further described hereinbelow with reference to Table 1.

Nucleotide sequences of host target binding sites, such as BINDING SITE-I, BINDING SITE-II and BINDING SITE-III of FIG. 1, found on VGAM1847 host target RNA, and schematic representation of the complementarity of each of these host target binding sites to VGAM1847 RNA, herein designated VGAM RNA, are described hereinbelow with reference to Table 2.

As mentioned hereinabove with reference to FIG. 1, a function of VGAM1847 gene, herein designated VGAM is inhibition of expression of VGAM1847 target genes. It is appreciated that specific functions, and accordingly utilities, of VGAM1847 correlate with, and may be deduced from, the identity of the target genes which VGAM1847 binds and inhibits, and the function of these target genes, as elaborated hereinbelow.

Absent In Melanoma 1 (AIM1, Accession XM_166300) is a VGAM1847 host target gene. AIM1 BINDING SITE is HOST TARGET binding site found in the 3' untranslated region of mRNA encoded by AIM1, corresponding to a HOST TARGET binding site such as BINDING SITE I, BINDING SITE II or BINDING SITE III. Table 2 illustrates the complementarity of the nucleotide sequences of AIM1 BINDING SITE, designated SEQ ID:44113, to the nucleotide sequence of VGAM1847 RNA, herein designated VGAM RNA, also designated SEQ ID:4558.

A function of VGAM1847 is therefore inhibition of Absent In Melanoma 1 (AIM1, Accession XM_166300), a gene which interactions with the cytoskeleton. Accordingly, utilities of VGAM1847 include diagnosis, prevention and treatment of diseases and clinical conditions associated with AIM1. The function of AIM1 and its association with various diseases and clinical conditions, has been established by previous studies, as described hereinabove with reference to VGAM808. KIAA1301 (Accession XM_038999) is another VGAM1847 host target gene. KIAA1301 BINDING SITE is HOST TARGET binding site found in the 3' untranslated region of mRNA encoded by KIAA1301, corresponding to a HOST TARGET binding site such as BINDING SITE I, BINDING SITE II or BINDING SITE III. Table 2 illustrates the complementarity of the nucleotide sequences of KIAA1301 BINDING SITE, designated SEQ ID:32976, to the nucleotide sequence of VGAM1847 RNA, herein designated VGAM RNA, also designated SEQ ID:4558.

Another function of VGAM1847 is therefore inhibition of KIAA1301 (Accession XM_038999). Accordingly, utilities of VGAM1847 include diagnosis, prevention and treatment of diseases and clinical conditions associated with KIAA1301. LOC157681 (Accession XM_088363) is another VGAM1847 host target gene. LOC157681 BINDING SITE is HOST TARGET binding site found in the 5' untranslated region of mRNA encoded by LOC157681, corresponding to a HOST TARGET binding site such as BINDING SITE I, BINDING SITE II or BINDING SITE III. Table 2 illustrates the complementarity of the nucleotide sequences of LOC157681 BINDING SITE, designated SEQ ID:39644, to the nucleotide sequence of VGAM1847 RNA, herein designated VGAM RNA, also designated SEQ ID:4558.

Another function of VGAM1847 is therefore inhibition of LOC157681 (Accession XM_088363). Accordingly, utilities of VGAM1847 include diagnosis, prevention and treatment of diseases and clinical conditions associated with LOC157681. LOC92391 (Accession XM_044793) is another VGAM1847 host target gene. LOC92391 BINDING SITE is HOST TARGET binding site found in the 3' untranslated region of mRNA encoded by LOC92391, corresponding to a HOST TARGET binding site such as BINDING SITE I, BINDING SITE II or BINDING SITE III. Table 2 illustrates the complementarity of the nucleotide sequences of LOC92391 BINDING SITE, designated SEQ ID:34271, to the nucleotide sequence of VGAM1847 RNA, herein designated VGAM RNA, also designated SEQ ID:4558.

Another function of VGAM1847 is therefore inhibition of LOC92391 (Accession XM_044793). Accordingly, utilities of VGAM1847 include diagnosis, prevention and treatment of diseases and clinical conditions associated with LOC92391. FIG. 1 further provides a conceptual description of a novel bioinformatically detected viral gene of the present invention, referred to here as Viral Genomic Address Messenger 1848 (VGAM1848) viral gene, which modulates expression of respective host target genes thereof, the function and utility of which host target genes is known in the art.

VGAM1848 is a novel bioinformatically detected regulatory, non protein coding, viral micro RNA (miRNA) gene. The method by which VGAM1848 was detected is described hereinabove with reference to FIGS. 1-8.

VGAM1848 gene, herein designated VGAM GENE, is a viral gene contained in the genome of Sonchus Yellow Net Virus. VGAM1848 host target gene, herein designated VGAM HOST TARGET GENE, is a human gene contained in the human genome.

VGAM1848 gene encodes a VGAM1848 precursor RNA, herein designated VGAM PRECURSOR RNA. Similar to other miRNA genes, and unlike most ordinary genes, VGAM1848 precursor RNA does not encode a protein. A nucleotide sequence identical or highly similar to the nucleotide sequence of VGAM1848 precursor RNA is designated SEQ ID:1834, and is provided hereinbelow with reference to the sequence listing part. Nucleotide sequence SEQ ID:1834 is located at position 9698 relative to the genome of Sonchus Yellow Net Virus.

VGAM1848 precursor RNA folds onto itself, forming VGAM1848 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1848 folded precursor RNA into VGAM1848 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1848 RNA is designated SEQ ID:4559, and is provided hereinbelow with reference to the sequence listing part.

VGAM1848 host target gene, herein designated VGAM HOST TARGET GENE, encodes a corresponding messenger RNA, VGAM1848 host target RNA, herein designated VGAM HOST TARGET RNA. VGAM1848 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1848 RNA, herein designated VGAM RNA, binds complementarily to one or more host target binding sites located in untranslated regions of VGAM1848 host target RNA, herein designated VGAM HOST TARGET RNA. This complementary binding is due to the fact that the nucleotide sequence of VGAM1848 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1848 RNA, herein designated VGAM RNA, may have a different number of host target binding sites in untranslated regions of a VGAM1848 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1848 RNA, herein designated VGAM RNA, to host target binding sites on VGAM1848 host target RNA, herein designated VGAM HOST TARGET RNA, such as BINDING SITE I, BINDING SITE II and BINDING SITE III, inhibits translation of VGAM1848 host target RNA into VGAM1848 host target protein, herein designated VGAM HOST TARGET PROTEIN. VGAM host target protein is therefore outlined by a broken line.

It is appreciated that VGAM1848 host target gene, herein designated VGAM HOST TARGET GENE, in fact represents a plurality of VGAM1848 host target genes. The mRNA of each one of this plurality of VGAM1848 host target genes comprises one or more host target binding sites, each having a nucleotide sequence which is at least partly complementary to VGAM1848 RNA, herein designated VGAM RNA, and which when bound by VGAM1848 RNA causes inhibition of translation of respective one or more VGAM1848 host target proteins.

It is further appreciated by one skilled in the art that the mode of translational inhibition illustrated by FIG. 1 with specific reference to translational inhibition exerted by VGAM1848 gene, herein designated VGAM GENE, on one or more VGAM1848 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1848 is inhibition of expression of host target genes, as part of a novel viral mechanism of attacking a host. Accordingly, utilities of VGAM1848 include diagnosis, prevention and treatment of viral infection by Sonchus Yellow Net Virus. Specific functions, and accordingly utilities, of VGAM1848 correlate with, and may be deduced from, the identity of the host target genes which VGAM1848 binds and inhibits, and the function of these host target genes, as elaborated hereinbelow.

Nucleotide sequences of the VGAM1848 precursor RNA, herein designated VGAM PRECURSOR RNA, and of the 'diced' VGAM1848 RNA, herein designated VGAM RNA, and a schematic representation of the secondary folding of VGAM1848 folded precursor RNA, herein designated VGAM FOLDED PRECURSOR RNA, of VGAM1848 are further described hereinbelow with reference to Table 1.

Nucleotide sequences of host target binding sites, such as BINDING SITE-I, BINDING SITE-II and BINDING SITE-III of FIG. 1, found on VGAM1848 host target RNA, and schematic representation of the complementarity of each of these host target binding sites to VGAM1848 RNA, herein designated VGAM RNA, are described hereinbelow with reference to Table 2.

As mentioned hereinabove with reference to FIG. 1, a function of VGAM1848 gene, herein designated VGAM is inhibition of expression of VGAM1848 target genes. It is appreciated that specific functions, and accordingly utilities, of VGAM1848 correlate with, and may be deduced from, the identity of the target genes which VGAM1848 binds and inhibits, and the function of these target genes, as elaborated hereinbelow.

Solute Carrier Family 9 (sodium/hydrogen exchanger), Isoform 6 (SLC9A6, Accession NM_006359) is a VGAM1848 host target gene. SLC9A6 BINDING SITE is HOST TARGET binding site found in the 3' untranslated region of mRNA encoded by SLC9A6, corresponding to a HOST TARGET binding site such as BINDING SITE I, BINDING SITE II or BINDING SITE III. Table 2 illustrates the complementarity of the nucleotide sequences of SLC9A6 BINDING SITE, designated SEQ ID:13052, to the nucleotide sequence of VGAM1848 RNA, herein designated VGAM RNA, also designated SEQ ID:4559.

A function of VGAM1848 is therefore inhibition of Solute Carrier Family 9 (sodium/hydrogen exchanger), Isoform 6 (SLC9A6, Accession NM_006359), a gene which is involved electroneutral exchange of protons for na+ and k+ across the mitochondrial inner membrane. Accordingly, utilities of VGAM1848 include diagnosis, prevention and treatment of diseases and clinical conditions associated with SLC9A6. The function of SLC9A6 and its association with various diseases and clinical conditions, has been established by previous studies, as described hereinabove with reference to VGAM493. SPF30 (Accession NM_005871) is another VGAM1848 host target gene. SPF30 BINDING SITE is HOST TARGET binding site found in the 3' untranslated region of mRNA encoded by SPF30, corresponding to a HOST TARGET binding site such as BINDING SITE I, BINDING SITE II or BINDING SITE III. Table 2 illustrates the complementarity of the nucleotide sequences of SPF30 BINDING SITE, designated SEQ ID:12489, to the nucleotide sequence of VGAM1848 RNA, herein designated VGAM RNA, also designated SEQ ID:4559.

Another function of VGAM1848 is therefore inhibition of SPF30 (Accession NM_005871). Accordingly, utilities of VGAM1848 include diagnosis, prevention and treatment of diseases and clinical conditions associated with SPF30. FLJ10035 (Accession NM_017974) is another VGAM1848 host target gene. FLJ10035 BINDING SITE is HOST TARGET binding site found in the 3' untranslated region of mRNA encoded by FLJ10035, corresponding to a HOST TARGET binding site such as BINDING SITE I, BINDING SITE II or BINDING SITE III. Table 2 illustrates the complementarity of the nucleotide sequences of FLJ10035 BINDING SITE, designated SEQ ID:19706, to the nucleotide sequence of VGAM1848 RNA, herein designated VGAM RNA, also designated SEQ ID:4559.

Another function of VGAM1848 is therefore inhibition of FLJ10035 (Accession NM_017974). Accordingly, utilities of VGAM1848 include diagnosis, prevention and treatment of diseases and clinical conditions associated with FLJ10035. Pellino Homolog 1 (Drosophila) (PELI1, Accession NM_020651) is another VGAM1848 host target gene. PELI1 BINDING SITE is HOST TARGET binding site found in the 3' untranslated region of mRNA encoded by PELI1, corresponding to a HOST TARGET binding site such as BINDING SITE I, BINDING SITE II or BINDING SITE III. Table 2 illustrates the complementarity of the nucleotide sequences of PELI1 BINDING SITE, designated SEQ ID:21813, to the nucleotide sequence of VGAM1848 RNA, herein designated VGAM RNA, also designated SEQ ID:4559.

Another function of VGAM1848 is therefore inhibition of Pellino Homolog 1 (Drosophila) (PELI1, Accession NM_020651). Accordingly, utilities of VGAM1848 include diagnosis, prevention and treatment of diseases and clinical conditions associated with PELI1. LOC145786 (Accession XM_096860) is another VGAM1848 host target gene. LOC145786 BINDING SITE is HOST TARGET binding site found in the 5' untranslated region of mRNA encoded by LOC145786, corresponding to a HOST TARGET binding site such as BINDING SITE I, BINDING SITE II or BINDING SITE III. Table 2 illustrates the complementarity of the nucleotide sequences of LOC145786 BINDING SITE, designated SEQ ID:40590, to the nucleotide sequence of VGAM1848 RNA, herein designated VGAM RNA, also designated SEQ ID:4559.

Another function of VGAM1848 is therefore inhibition of LOC145786 (Accession XM_096860). Accordingly, utilities of VGAM1848 include diagnosis, prevention and treatment of diseases and clinical conditions associated with LOC145786. FIG. 1 further provides a conceptual description of a novel bioinformatically detected viral gene of the present invention, referred to here as Viral Genomic Address Messenger 1849 (VGAM1849) viral gene, which modulates expression of respective host target genes thereof, the function and utility of which host target genes is known in the art.

VGAM1849 is a novel bioinformatically detected regulatory, non protein coding, viral micro RNA (miRNA) gene. The method by which VGAM1849 was detected is described hereinabove with reference to FIGS. 1-8.

VGAM1849 gene, herein designated VGAM GENE, is a viral gene contained in the genome of Cowpea Chlorotic Mottle Virus. VGAM1849 host target gene, herein designated VGAM HOST TARGET GENE, is a human gene contained in the human genome.

VGAM1849 gene encodes a VGAM1849 precursor RNA, herein designated VGAM PRECURSOR RNA. Similar to other miRNA genes, and unlike most ordinary genes, VGAM1849 precursor RNA does not encode a protein. A nucleotide sequence identical or highly similar to the nucleotide sequence of VGAM1849 precursor RNA is designated SEQ ID:1835, and is provided hereinbelow with reference to the sequence listing part. Nucleotide sequence SEQ ID:1835 is located at position 1870 relative to the genome of Cowpea Chlorotic Mottle Virus.

VGAM1849 precursor RNA folds onto itself, forming VGAM1849 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1849 folded precursor RNA into VGAM1849 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM1849 RNA is designated SEQ ID:4560, and is provided hereinbelow with reference to the sequence listing part.

VGAM1849 host target gene, herein designated VGAM HOST TARGET GENE, encodes a corresponding messenger RNA, VGAM1849 host target RNA, herein designated VGAM HOST TARGET RNA. VGAM1849 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1849 RNA, herein designated VGAM RNA, binds complementarily to one or more host target binding sites located in untranslated regions of VGAM1849 host target RNA, herein designated VGAM HOST TARGET RNA. This complementary binding is due to the fact that the nucleotide sequence of VGAM1849 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1849 RNA, herein designated VGAM RNA, may have a different number of host target binding sites in untranslated regions of a VGAM1849 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1849 RNA, herein designated VGAM RNA, to host target binding sites on VGAM1849 host target RNA, herein designated VGAM HOST TARGET RNA, such as BINDING SITE I, BINDING SITE II and BINDING SITE III, inhibits translation of VGAM1849 host target RNA into VGAM1849 host target protein, herein designated VGAM HOST TARGET PROTEIN. VGAM host target protein is therefore outlined by a broken line.

It is appreciated that VGAM1849 host target gene, herein designated VGAM HOST TARGET GENE, in fact represents a plurality of VGAM1849 host target genes. The mRNA of each one of this plurality of VGAM1849 host target genes comprises one or more host target binding sites, each having a nucleotide sequence which is at least partly complementary to VGAM1849 RNA, herein designated VGAM RNA, and which when bound by VGAM1849 RNA causes inhibition of translation of respective one or more VGAM1849 host target proteins.

It is further appreciated by one skilled in the art that the mode of translational inhibition illustrated by FIG. 1 with specific reference to translational inhibition exerted by VGAM1849 gene, herein designated VGAM GENE, on one or more VGAM1849 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1849 is inhibition of expression of host target genes, as part of a novel viral mechanism of attacking a host. Accordingly, utilities of VGAM1849 include diagnosis, prevention and treatment of viral infection by Cowpea Chlorotic Mottle Virus. Specific functions, and accordingly utilities, of VGAM1849 correlate with, and may be deduced from, the identity of the host target genes which VGAM1849 binds and inhibits, and the function of these host target genes, as elaborated hereinbelow.

Nucleotide sequences of the VGAM1849 precursor RNA, herein designated VGAM PRECURSOR RNA, and of the 'diced' VGAM1849 RNA, herein designated VGAM RNA, and a schematic representation of the secondary folding of VGAM1849 folded precursor RNA, herein designated VGAM FOLDED PRECURSOR RNA, of VGAM1849 are further described hereinbelow with reference to Table 1.

Nucleotide sequences of host target binding sites, such as BINDING SITE-I, BINDING SITE-II and BINDING SITE-III of FIG. 1, found on VGAM1849 host target RNA, and schematic representation of the complementarity of each of these host target binding sites to VGAM1849 RNA, herein designated VGAM RNA, are described hereinbelow with reference to Table 2.

As mentioned hereinabove with reference to FIG. 1, a function of VGAM1849 gene, herein designated VGAM is inhibition of expression of VGAM1849 target genes. It is appreciated that specific functions, and accordingly utilities, of VGAM1849 correlate with, and may be deduced from, the identity of the target genes which VGAM1849 binds and inhibits, and the function of these target genes, as elaborated hereinbelow.

ATPase, Class VI, Type 11B (ATP11B, Accession XM_087254) is a VGAM1849 host target gene. ATP11B BINDING SITE is HOST TARGET binding site found in the 3' untranslated region of mRNA encoded by ATP11B, corresponding to a HOST TARGET binding site such as BINDING SITE I, BINDING SITE II or BINDING SITE III. Table 2 illustrates the complementarity of the nucleotide sequences of ATP11B BINDING SITE, designated SEQ ID:39147, to the nucleotide sequence of VGAM1849 RNA, herein designated VGAM RNA, also designated SEQ ID:4560.

A function of VGAM1849 is therefore inhibition of ATPase, Class VI, Type 11B (ATP11B, Accession XM_087254), a gene which is phosphorylated in their intermediate state, drives uphill transport of ions across membranes. Accordingly, utilities of VGAM1849 include diagnosis, prevention and treatment of diseases and clinical conditions associated with ATP11B. The function of ATP11B and its association with various diseases and clinical conditions, has been established by previous studies, as described hereinabove with reference to VGAM665. Phosphoinositide-3-kinase, Class 2, Beta Polypeptide (PIK3C2B, Accession NM_002646) is another VGAM1849 host target gene. PIK3C2B BINDING SITE is HOST TARGET binding site found in the 5' untranslated region of mRNA encoded by PIK3C2B, corresponding to a HOST TARGET binding site such as BINDING SITE I, BINDING SITE II or BINDING SITE III. Table 2 illustrates the complementarity of the nucleotide sequences of PIK3C2B BINDING SITE, designated SEQ ID:8505, to the nucleotide sequence of VGAM1849 RNA, herein designated VGAM RNA, also designated SEQ ID:4560.

Another function of VGAM1849 is therefore inhibition of Phosphoinositide-3-kinase, Class 2, Beta Polypeptide (PIK3C2B, Accession NM_002646). Accordingly, utilities of VGAM1849 include diagnosis, prevention and treatment of diseases and clinical conditions associated with PIK3C2B. Cell Division Cycle Associated 7 (CDCA7, Accession NM_031942) is another VGAM1849 host target gene. CDCA7 BINDING SITE is HOST TARGET binding site found in the 3' untranslated region of mRNA encoded by CDCA7, corresponding to a HOST TARGET binding site such as BINDING SITE I, BINDING SITE II or BINDING SITE III. Table 2 illustrates the complementarity of the nucleotide sequences of CDCA7 BINDING SITE, designated SEQ ID:25687, to the nucleotide sequence of VGAM1849 RNA, herein designated VGAM RNA, also designated SEQ ID:4560.

Another function of VGAM1849 is therefore inhibition of Cell Division Cycle Associated 7 (CDCA7, Accession NM_031942). Accordingly, utilities of VGAM1849 include diagnosis, prevention and treatment of diseases and clinical conditions associated with CDCA7. Hyaluronan Binding Protein 2 (HABP2, Accession NM_004132) is another VGAM1849 host target gene. HABP2 BINDING SITE is HOST TARGET binding site found in the 3' untranslated region of mRNA encoded by HABP2, corresponding to a HOST TARGET binding site such as BINDING SITE I, BINDING SITE II or BINDING SITE III. Table 2 illustrates the complementarity of the nucleotide sequences of HABP2 BINDING SITE, designated SEQ ID:10342, to the nucleotide sequence of VGAM1849 RNA, herein designated VGAM RNA, also designated SEQ ID:4560.

Another function of VGAM1849 is therefore inhibition of Hyaluronan Binding Protein 2 (HABP2, Accession NM_004132). Accordingly, utilities of VGAM1849 include diagnosis, prevention and treatment of diseases and clinical conditions associated with HABP2. KIAA0523 (Accession XM_041964) is another VGAM1849 host target gene. KIAA0523 BINDING SITE is HOST TARGET binding site found in the 3' untranslated region of mRNA encoded by KIAA0523, corresponding to a HOST TARGET binding site such as BINDING SITE I, BINDING SITE II or BINDING SITE III. Table 2 illustrates the complementarity of the nucleotide sequences of KIAA0523 BINDING SITE, designated SEQ ID:33642, to the nucleotide sequence of VGAM1849 RNA, herein designated VGAM RNA, also designated SEQ ID:4560.

Another function of VGAM1849 is therefore inhibition of KIAA0523 (Accession XM_041964). Accordingly, utilities of VGAM1849 include diagnosis, prevention and treatment of diseases and clinical conditions associated with KIAA0523. LOC122618 (Accession NM_138790) is another VGAM1849 host target gene. LOC122618 BINDING SITE is HOST TARGET binding site found in the 5' untranslated region of mRNA encoded by LOC122618, corresponding to a HOST TARGET binding site such as BINDING SITE I, BINDING SITE II or BINDING SITE III. Table 2 illustrates the complementarity of the nucleotide sequences of LOC122618 BINDING SITE, designated SEQ ID:29014, to the nucleotide sequence of VGAM1849 RNA, herein designated VGAM RNA, also designated SEQ ID:4560.

Another function of VGAM1849 is therefore inhibition of LOC122618 (Accession NM_138790). Accordingly, utilities of VGAM1849 include diagnosis, prevention and treatment of diseases and clinical conditions associated with LOC122618. LOC154739 (Accession XM_098602) is another VGAM1849 host target gene. LOC154739 BINDING SITE is HOST TARGET binding site found in the 5' untranslated region of mRNA encoded by LOC154739, corresponding to a HOST TARGET binding site such as BINDING SITE I, BINDING SITE II or BINDING SITE III. Table 2 illustrates the complementarity of the nucleotide sequences of LOC154739 BINDING SITE, designated SEQ ID:41720, to the nucleotide sequence of VGAM1849 RNA, herein designated VGAM RNA, also designated SEQ ID:4560.

Another function of VGAM1849 is therefore inhibition of LOC154739 (Accession XM_098602). Accordingly, utilities of VGAM1849 include diagnosis, prevention and treatment of diseases and clinical conditions associated with LOC154739. LOC203276 (Accession XM_117523) is another VGAM1849 host target gene. LOC203276 BINDING SITE is HOST TARGET binding site found in the 3' untranslated region of mRNA encoded by LOC203276, corresponding to a HOST TARGET binding site such as BINDING SITE I, BINDING SITE II or BINDING SITE III. Table 2 illustrates the complementarity of the nucleotide sequences of LOC203276 BINDING SITE, designated SEQ ID:43489, to the nucleotide sequence of VGAM1849 RNA, herein designated VGAM RNA, also designated SEQ ID:4560.

Another function of VGAM1849 is therefore inhibition of LOC203276 (Accession XM_117523). Accordingly, utilities of VGAM1849 include diagnosis, prevention and treatment of diseases and clinical conditions associated with LOC203276. LOC203305 (Accession XM_117529) is another VGAM1849 host target gene. LOC203305 BINDING SITE is HOST TARGET binding site found in the 3' untranslated region of mRNA encoded by LOC203305, corresponding to a HOST TARGET binding site such as BINDING SITE I, BINDING SITE II or BINDING SITE III. Table 2 illustrates the complementarity of the nucleotide sequences of LOC203305 BINDING SITE, designated SEQ ID:43513, to the nucleotide sequence of VGAM1849 RNA, herein designated VGAM RNA, also designated SEQ ID:4560.

Another function of VGAM1849 is therefore inhibition of LOC203305 (Accession XM_117529). Accordingly, utilities of VGAM1849 include diagnosis, prevention and treatment of diseases and clinical conditions associated with LOC203305. LOC204970 (Accession XM_114795) is another VGAM1849 host target gene. LOC204970 BINDING SITE is HOST TARGET binding site found in the 3' untranslated region of mRNA encoded by LOC204970, corresponding to a HOST TARGET binding site such as BINDING SITE I, BINDING SITE II or BINDING SITE III. Table 2 illustrates the complementarity of the nucleotide sequences of LOC204970 BINDING SITE, designated SEQ ID:43071, to the nucleotide sequence of VGAM1849 RNA, herein designated VGAM RNA, also designated SEQ ID:4560.

Another function of VGAM1849 is therefore inhibition of LOC204970 (Accession XM_114795). Accordingly, utilities of VGAM1849 include diagnosis, prevention and treatment of diseases and clinical conditions associated with LOC204970. LOC206324 (Accession XM_121162) is another VGAM1849 host target gene. LOC206324 BINDING SITE is HOST TARGET binding site found in the 5' untranslated region of mRNA encoded by LOC206324, corresponding to a HOST TARGET binding site such as BINDING SITE I, BINDING SITE II or BINDING SITE III. Table 2 illustrates the complementarity of the nucleotide sequences of LOC206324 BINDING SITE, designated SEQ ID:43612, to the nucleotide sequence of VGAM1849 RNA, herein designated VGAM RNA, also designated SEQ ID:4560.

Another function of VGAM1849 is therefore inhibition of LOC206324 (Accession XM_121162). Accordingly, utilities of VGAM1849 include diagnosis, prevention and treatment of diseases and clinical conditions associated with LOC206324. LOC219894 (Accession XM_167782) is another VGAM1849 host target gene. LOC219894 BINDING SITE is HOST TARGET binding site found in the 3' untranslated region of mRNA encoded by LOC219894, corresponding to a HOST TARGET binding site such as BINDING SITE I, BINDING SITE II or BINDING SITE III. Table 2 illustrates the complementarity of the nucleotide sequences of LOC219894 BINDING SITE, designated SEQ ID:44797, to the nucleotide sequence of VGAM1849 RNA, herein designated VGAM RNA, also designated SEQ ID:4560.

Another function of VGAM1849 is therefore inhibition of LOC219894 (Accession XM_167782). Accordingly, utilities of VGAM1849 include diagnosis, prevention and treatment of diseases and clinical conditions associated with LOC219894. LOC254243 (Accession XM_173233) is another VGAM1849 host target gene. LOC254243 BINDING SITE is HOST TARGET binding site found in the 3' untranslated region of mRNA encoded by LOC254243, corresponding to a HOST TARGET binding site such as BINDING SITE I, BINDING SITE II or BINDING SITE III. Table 2 illustrates the complementarity of the nucleotide sequences of LOC254243 BINDING SITE, designated SEQ ID:46515, to the nucleotide sequence of VGAM1849 RNA, herein designated VGAM RNA, also designated SEQ ID:4560.

Another function of VGAM1849 is therefore inhibition of LOC254243 (Accession XM_173233). Accordingly, utilities of VGAM1849 include diagnosis, prevention and treatment of diseases and clinical conditions associated with LOC254243. LOC90038 (Accession XM_028305) is another VGAM1849 host target gene. LOC90038 BINDING SITE is HOST TARGET binding site found in the 3' untranslated region of mRNA encoded by LOC90038, corresponding to a HOST TARGET binding site such as BINDING SITE I, BINDING SITE II or BINDING SITE III. Table 2 illustrates the complementarity of the nucleotide sequences of LOC90038 BINDING SITE, designated SEQ ID:30652, to the nucleotide sequence of VGAM1849 RNA, herein designated VGAM RNA, also designated SEQ ID:4560.

Another function of VGAM1849 is therefore inhibition of LOC90038 (Accession XM_028305). Accordingly, utilities of VGAM1849 include diagnosis, prevention and treatment of diseases and clinical conditions associated with LOC90038. LOC91796 (Accession XM_040743) is another VGAM1849 host target gene. LOC91796 BINDING SITE is HOST TARGET binding site found in the 3' untranslated region of mRNA encoded by LOC91796, corresponding to a HOST TARGET binding site such as BINDING SITE I, BINDING SITE II or BINDING SITE III. Table 2 illustrates the complementarity of the nucleotide sequences of LOC91796 BINDING SITE, designated SEQ ID:33373, to the nucleotide sequence of VGAM1849 RNA, herein designated VGAM RNA, also designated SEQ ID:4560.

Another function of VGAM1849 is therefore inhibition of LOC91796 (Accession XM_040743). Accordingly, utilities of VGAM1849 include diagnosis, prevention and treatment of diseases and clinical conditions associated with LOC91796. FIG. 1 further provides a conceptual description of a novel bioinformatically detected viral gene of the present invention, referred to here as Viral Genomic Address Messenger 1850 (VGAM1850) viral gene, which modulates expression of respective host target genes thereof, the function and utility of which host target genes is known in the art.

VGAM1850 is a novel bioinformatically detected regulatory, non protein coding, viral micro RNA (miRNA) gene. The method by which VGAM1850 was detected is described hereinabove with reference to FIGS. 1-8.

VGAM1850 gene, herein designated VGAM GENE, is a viral gene contained in the genome of Sonchus Yellow Net Virus. VGAM1850 host target gene, herein designated VGAM HOST TARGET GENE, is a human gene contained in the human genome.

VGAM1850 gene encodes a VGAM1850 precursor RNA, herein designated VGAM PRECURSOR RNA. Similar to other miRNA genes, and unlike most ordinary genes, VGAM1850 precursor RNA does not encode a protein. A nucleotide sequence identical or highly similar to the nucleotide sequence of VGAM1850 precursor RNA is designated SEQ ID:1836, and is provided hereinbelow with reference to the sequence listing part. Nucleotide sequence SEQ ID:1836 is located at position 1237 relative to the genome of Sonchus Yellow Net Virus.

VGAM1850 precursor RNA folds onto itself, forming VGAM1850 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1850 folded precursor RNA into VGAM1850 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM1850 RNA is designated SEQ ID:4561, and is provided hereinbelow with reference to the sequence listing part.

VGAM1850 host target gene, herein designated VGAM HOST TARGET GENE, encodes a corresponding messenger RNA, VGAM1850 host target RNA, herein designated VGAM HOST TARGET RNA. VGAM1850 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1850 RNA, herein designated VGAM RNA, binds complementarily to one or more host target binding sites located in untranslated regions of VGAM1850 host target RNA, herein designated VGAM HOST TARGET RNA. This complementary binding is due to the fact that the nucleotide sequence of VGAM1850 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1850 RNA, herein designated VGAM RNA, may have a different number of host target binding sites in untranslated regions of a VGAM1850 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1850 RNA, herein designated VGAM RNA, to host target binding sites on VGAM1850 host target RNA, herein designated VGAM HOST TARGET RNA, such as BINDING SITE I, BINDING SITE II and BINDING SITE III, inhibits translation of VGAM1850 host target RNA into VGAM1850 host target protein, herein designated VGAM HOST TARGET PROTEIN. VGAM host target protein is therefore outlined by a broken line.

It is appreciated that VGAM1850 host target gene, herein designated VGAM HOST TARGET GENE, in fact represents a plurality of VGAM1850 host target genes. The mRNA of each one of this plurality of VGAM1850 host target genes comprises one or more host target binding sites, each having a nucleotide sequence which is at least partly complementary to VGAM1850 RNA, herein designated VGAM RNA, and which when bound by VGAM1850 RNA causes inhibition of translation of respective one or more VGAM1850 host target proteins.

It is further appreciated by one skilled in the art that the mode of translational inhibition illustrated by FIG. 1 with specific reference to translational inhibition exerted by VGAM1850 gene, herein designated VGAM GENE, on one or more VGAM1850 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1850 is inhibition of expression of host target genes, as part of a novel viral mechanism of attacking a host. Accordingly, utilities of VGAM1850 include diagnosis, prevention and treatment of viral infection by Sonchus Yellow Net Virus. Specific functions, and accordingly utilities, of VGAM1850 correlate with, and may be deduced from, the identity of the host target genes which VGAM1850 binds and inhibits, and the function of these host target genes, as elaborated hereinbelow.

Nucleotide sequences of the VGAM1850 precursor RNA, herein designated VGAM PRECURSOR RNA, and of the 'diced' VGAM1850 RNA, herein designated VGAM RNA, and a schematic representation of the secondary folding of VGAM1850 folded precursor RNA, herein designated VGAM FOLDED PRECURSOR RNA, of VGAM1850 are further described hereinbelow with reference to Table 1.

Nucleotide sequences of host target binding sites, such as BINDING SITE-I, BINDING SITE-II and BINDING SITE- III of FIG. 1, found on VGAM1850 host target RNA, and schematic representation of the complementarity of each of these host target binding sites to VGAM1850 RNA, herein designated VGAM RNA, are described hereinbelow with reference to Table 2.

As mentioned hereinabove with reference to FIG. 1, a function of VGAM1850 gene, herein designated VGAM is inhibition of expression of VGAM1850 target genes. It is appreciated that specific functions, and accordingly utilities, of VGAM1850 correlate with, and may be deduced from, the identity of the target genes which VGAM1850 binds and inhibits, and the function of these target genes, as elaborated hereinbelow.

BCRP2 (Accession XM_031102) is a VGAM1850 host target gene. BCRP2 BINDING SITE is HOST TARGET binding site found in the 3' untranslated region of mRNA encoded by BCRP2, corresponding to a HOST TARGET binding site such as BINDING SITE I, BINDING SITE II or BINDING SITE III. Table 2 illustrates the complementarity of the nucleotide sequences of BCRP2 BINDING SITE, designated SEQ ID:31276, to the nucleotide sequence of VGAM1850 RNA, herein designated VGAM RNA, also designated SEQ ID:4561.

A function of VGAM1850 is therefore inhibition of BCRP2 (Accession XM_031102). Accordingly, utilities of VGAM1850 include diagnosis, prevention and treatment of diseases and clinical conditions associated with BCRP2. Neural Cell Adhesion Molecule 2 (NCAM2, Accession NM_004540) is another VGAM1850 host target gene. NCAM2 BINDING SITE is HOST TARGET binding site found in the 3' untranslated region of mRNA encoded by NCAM2, corresponding to a HOST TARGET binding site such as BINDING SITE I, BINDING SITE II or BINDING SITE III. Table 2 illustrates the complementarity of the nucleotide sequences of NCAM2 BINDING SITE, designated SEQ ID:10891, to the nucleotide sequence of VGAM1850 RNA, herein designated VGAM RNA, also designated SEQ ID:4561.

Another function of VGAM1850 is therefore inhibition of Neural Cell Adhesion Molecule 2 (NCAM2, Accession NM_004540). Accordingly, utilities of VGAM1850 include diagnosis, prevention and treatment of diseases and clinical conditions associated with NCAM2. Di-Ras2 (Accession NM_017594) is another VGAM1850 host target gene. Di-Ras2 BINDING SITE is HOST TARGET binding site found in the 3' untranslated region of mRNA encoded by Di-Ras2, corresponding to a HOST TARGET binding site such as BINDING SITE I, BINDING SITE II or BINDING SITE III. Table 2 illustrates the complementarity of the nucleotide sequences of Di-Ras2 BINDING SITE, designated SEQ ID:19045, to the nucleotide sequence of VGAM1850 RNA, herein designated VGAM RNA, also designated SEQ ID:4561.

Another function of VGAM1850 is therefore inhibition of Di-Ras2 (Accession NM_017594). Accordingly, utilities of VGAM1850 include diagnosis, prevention and treatment of diseases and clinical conditions associated with Di-Ras2. FIG. 1 further provides a conceptual description of a novel bioinformatically detected viral gene of the present invention, referred to here as Viral Genomic Address Messenger 1851 (VGAM1851) viral gene, which modulates expression of respective host target genes thereof, the function and utility of which host target genes is known in the art.

VGAM1851 is a novel bioinformatically detected regulatory, non protein coding, viral micro RNA (miRNA) gene. The method by which VGAM1851 was detected is described hereinabove with reference to FIGS. 1-8.

VGAM1851 gene, herein designated VGAM GENE, is a viral gene contained in the genome of Sonchus Yellow Net Virus. VGAM1851 host target gene, herein designated VGAM HOST TARGET GENE, is a human gene contained in the human genome.

VGAM1851 gene encodes a VGAM1851 precursor RNA, herein designated VGAM PRECURSOR RNA. Similar to other miRNA genes, and unlike most ordinary genes, VGAM1851 precursor RNA does not encode a protein. A nucleotide sequence identical or highly similar to the nucleotide sequence of VGAM1851 precursor RNA is designated SEQ ID:1837, and is provided hereinbelow with reference to the sequence listing part. Nucleotide sequence SEQ ID:1837 is located at position 6021 relative to the genome of Sonchus Yellow Net Virus.

VGAM1851 precursor RNA folds onto itself, forming VGAM1851 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1851 folded precursor RNA into VGAM1851 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1851 RNA is designated SEQ ID:4562, and is provided hereinbelow with reference to the sequence listing part.

VGAM1851 host target gene, herein designated VGAM HOST TARGET GENE, encodes a corresponding messenger RNA, VGAM1851 host target RNA, herein designated VGAM HOST TARGET RNA. VGAM1851 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1851 RNA, herein designated VGAM RNA, binds complementarily to one or more host target binding sites located in untranslated regions of VGAM1851 host target RNA, herein designated VGAM HOST TARGET RNA. This complementary binding is due to the fact that the nucleotide sequence of VGAM1851 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1851 RNA, herein designated VGAM RNA, may have a different number of host target binding sites in untranslated regions of a VGAM1851 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1851 RNA, herein designated VGAM RNA, to host target binding sites on VGAM1851 host target RNA, herein designated VGAM HOST TARGET RNA, such as BINDING SITE I, BINDING SITE II and BINDING SITE III, inhibits translation of VGAM1851 host target RNA into VGAM1851 host target protein, herein designated VGAM HOST TARGET PROTEIN. VGAM host target protein is therefore outlined by a broken line.

It is appreciated that VGAM1851 host target gene, herein designated VGAM HOST TARGET GENE, in fact represents a plurality of VGAM1851 host target genes. The mRNA of each one of this plurality of VGAM1851 host target genes comprises one or more host target binding sites, each having a nucleotide sequence which is at least partly complementary to VGAM1851 RNA, herein designated VGAM RNA, and which when bound by VGAM1851 RNA causes inhibition of translation of respective one or more VGAM1851 host target proteins.

It is further appreciated by one skilled in the art that the mode of translational inhibition illustrated by FIG. 1 with specific reference to translational inhibition exerted by VGAM1851 gene, herein designated VGAM GENE, on one or more VGAM1851 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1851 is inhibition of expression of host target genes, as part of a novel viral mechanism of attacking a host. Accordingly, utilities of VGAM1851 include diagnosis, prevention and treatment of viral infection by Sonchus Yellow Net Virus. Specific functions, and accordingly utilities, of VGAM1851 correlate with, and may be deduced from, the identity of the host target genes which VGAM1851 binds and inhibits, and the function of these host target genes, as elaborated hereinbelow.

Nucleotide sequences of the VGAM1851 precursor RNA, herein designated VGAM PRECURSOR RNA, and of the 'diced' VGAM1851 RNA, herein designated VGAM RNA, and a schematic representation of the secondary folding of VGAM1851 folded precursor RNA, herein designated VGAM FOLDED PRECURSOR RNA, of VGAM1851 are further described hereinbelow with reference to Table 1.

Nucleotide sequences of host target binding sites, such as BINDING SITE-I, BINDING SITE-II and BINDING SITE-III of FIG. 1, found on VGAM1851 host target RNA, and schematic representation of the complementarity of each of these host target binding sites to VGAM1851 RNA, herein designated VGAM RNA, are described hereinbelow with reference to Table 2.

As mentioned hereinabove with reference to FIG. 1, a function of VGAM1851 gene, herein designated VGAM is inhibition of expression of VGAM1851 target genes. It is appreciated that specific functions, and accordingly utilities, of VGAM1851 correlate with, and may be deduced from, the identity of the target genes which VGAM1851 binds and inhibits, and the function of these target genes, as elaborated hereinbelow.

Amyloid Beta Precursor Protein (cytoplasmic tail) Binding Protein 2 (APPBP2, Accession NM_006380) is a VGAM1851 host target gene. APPBP2 BINDING SITE is HOST TARGET binding site found in the 3' untranslated region of mRNA encoded by APPBP2, corresponding to a HOST TARGET binding site such as BINDING SITE I, BINDING SITE II or BINDING SITE III. Table 2 illustrates the complementarity of the nucleotide sequences of APPBP2 BINDING SITE, designated SEQ ID:13079, to the nucleotide sequence of VGAM1851 RNA, herein designated VGAM RNA, also designated SEQ ID:4562.

A function of VGAM1851 is therefore inhibition of Amyloid Beta Precursor Protein (cytoplasmic tail) Binding Protein 2 (APPBP2, Accession NM_006380), a gene which interacts with the basolateral sorting signal of amyloid precursor protein. Accordingly, utilities of VGAM1851 include diagnosis, prevention and treatment of diseases and clinical conditions associated with APPBP2. The function of APPBP2 and its association with various diseases and clinical conditions, has been established by previous studies, as described hereinabove with reference to VGAM525. Lectin, Mannose-binding, 1 (LMAN1, Accession NM_005570) is another VGAM1851 host target gene. LMAN1 BINDING SITE is HOST TARGET binding site found in the 3' untranslated region of mRNA encoded by LMAN1, corresponding to a HOST TARGET binding site such as BINDING SITE I, BINDING SITE II or BINDING SITE III. Table 2 illustrates the complementarity of the nucleotide sequences of LMAN1 BINDING SITE, designated SEQ ID:12097, to the nucleotide sequence of VGAM1851 RNA, herein designated VGAM RNA, also designated SEQ ID:4562.

Another function of VGAM1851 is therefore inhibition of Lectin, Mannose-binding, 1 (LMAN1, Accession NM_005570). Accordingly, utilities of VGAM1851 include diagnosis, prevention and treatment of diseases and clinical conditions associated with LMAN1. Ring Finger Protein 14 (RNF14, Accession NM_004290) is another VGAM1851 host target gene. RNF14 BINDING SITE is HOST TARGET binding site found in the 3' untranslated region of mRNA encoded by RNF14, corresponding to a HOST TARGET binding site such as BINDING SITE I, BINDING SITE II or BINDING SITE III. Table 2 illustrates the complementarity of the nucleotide sequences of RNF14 BINDING SITE, designated SEQ ID:10502, to the nucleotide sequence of VGAM1851 RNA, herein designated VGAM RNA, also designated SEQ ID:4562.

Another function of VGAM1851 is therefore inhibition of Ring Finger Protein 14 (RNF14, Accession NM_004290), a gene which associates with the androgen receptor (AR); functions as a transcriptional coactivator. Accordingly, utilities of VGAM1851 include diagnosis, prevention and treatment of diseases and clinical conditions associated with RNF14. The function of RNF14 and its association with various diseases and clinical conditions, has been established by previous studies, as described hereinabove with reference to VGAM827. Sodium Channel, Voltage-gated, Type I, Alpha Polypeptide (SCN1A, Accession XM_114281) is another VGAM1851 host target gene. SCN1A BINDING SITE is HOST TARGET binding site found in the 5' untranslated region of mRNA encoded by SCN1A, corresponding to a HOST TARGET binding site such as BINDING SITE I, BINDING SITE II or BINDING SITE III. Table 2 illustrates the complementarity of the nucleotide sequences of SCN1A BINDING SITE, designated SEQ ID:42830, to the nucleotide sequence of VGAM1851 RNA, herein designated VGAM RNA, also designated SEQ ID:4562.

Another function of VGAM1851 is therefore inhibition of Sodium Channel, Voltage-gated, Type I, Alpha Polypeptide (SCN1A, Accession XM_114281). Accordingly, utilities of VGAM1851 include diagnosis, prevention and treatment of diseases and clinical conditions associated with SCN1A.

FLJ20274 (Accession XM_031455) is another VGAM1851 host target gene. FLJ20274 BINDING SITE is HOST TARGET binding site found in the 3' untranslated region of mRNA encoded by FLJ20274, corresponding to a HOST TARGET binding site such as BINDING SITE I, BINDING SITE II or BINDING SITE III. Table 2 illustrates the complementarity of the nucleotide sequences of FLJ20274 BINDING SITE, designated SEQ ID:31386, to the nucleotide sequence of VGAM1851 RNA, herein designated VGAM RNA, also designated SEQ ID:4562.

Another function of VGAM1851 is therefore inhibition of FLJ20274 (Accession XM_031455). Accordingly, utilities of VGAM1851 include diagnosis, prevention and treatment of diseases and clinical conditions associated with FLJ20274. FLJ21617 (Accession NM_030897) is another VGAM1851 host target gene. FLJ21617 BINDING SITE is HOST TARGET binding site found in the 5' untranslated region of mRNA encoded by FLJ21617, corresponding to a HOST TARGET binding site such as BINDING SITE I, BINDING SITE II or BINDING SITE III. Table 2 illustrates the complementarity of the nucleotide sequences of FLJ21617 BINDING SITE, designated SEQ ID:25165, to the nucleotide sequence of VGAM1851 RNA, herein designated VGAM RNA, also designated SEQ ID:4562.

Another function of VGAM1851 is therefore inhibition of FLJ21617 (Accession NM_030897). Accordingly, utilities of VGAM1851 include diagnosis, prevention and treatment of diseases and clinical conditions associated with FLJ21617. KATII (Accession NM_016228) is another VGAM1851 host target gene. KATII BINDING SITE is HOST TARGET binding site found in the 5' untranslated region of mRNA encoded by KATII, corresponding to a HOST TARGET binding site such as BINDING SITE I, BINDING SITE II or BINDING SITE III. Table 2 illustrates the complementarity of the nucleotide sequences of KATII BINDING SITE, designated SEQ ID:18343, to the nucleotide sequence of VGAM1851 RNA, herein designated VGAM RNA, also designated SEQ ID:4562.

Another function of VGAM1851 is therefore inhibition of KATII (Accession NM_016228). Accordingly, utilities of VGAM1851 include diagnosis, prevention and treatment of diseases and clinical conditions associated with KATII. KIAA0090 (Accession XM_114045) is another VGAM1851 host target gene. KIAA0090 BINDING SITE is HOST TARGET binding site found in the 3' untranslated region of mRNA encoded by KIAA0090, corresponding to a HOST TARGET binding site such as BINDING SITE I, BINDING SITE II or BINDING SITE III. Table 2 illustrates the complementarity of the nucleotide sequences of KIAA0090 BINDING SITE, designated SEQ ID:42650, to the nucleotide sequence of VGAM1851 RNA, herein designated VGAM RNA, also designated SEQ ID:4562.

Another function of VGAM1851 is therefore inhibition of KIAA0090 (Accession XM_114045). Accordingly, utilities of VGAM1851 include diagnosis, prevention and treatment of diseases and clinical conditions associated with KIAA0090. NYD-SP16 (Accession NM_031952) is another VGAM1851 host target gene. NYD-SP16 BINDING SITE is HOST TARGET binding site found in the 3' untranslated region of mRNA encoded by NYD-SP16, corresponding to a HOST TARGET binding site such as BINDING SITE I, BINDING SITE II or BINDING SITE III. Table 2 illustrates the complementarity of the nucleotide sequences of NYD-SP16 BINDING SITE, designated SEQ ID:25693, to the nucleotide sequence of VGAM1851 RNA, herein designated VGAM RNA, also designated SEQ ID:4562.

Another function of VGAM1851 is therefore inhibition of NYD-SP16 (Accession NM_031952). Accordingly, utilities of VGAM1851 include diagnosis, prevention and treatment of diseases and clinical conditions associated with NYD-SP16. LOC203378 (Accession XM_117541) is another VGAM1851 host target gene. LOC203378 BINDING SITE is HOST TARGET binding site found in the 5' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43557, to the nucleotide sequence of VGAM1851 RNA, herein designated VGAM RNA, also designated SEQ ID:4562.

Another function of VGAM1851 is therefore inhibition of LOC203378 (Accession XM_117541). Accordingly, utilities of VGAM1851 include diagnosis, prevention and treatment of diseases and clinical conditions associated with LOC203378. FIG. 1 further provides a conceptual description of a novel bioinformatically detected viral gene of the present invention, referred to here as Viral Genomic Address Messenger 1852 (VGAM1852) viral gene, which modulates expression of respective host target genes thereof, the function and utility of which host target genes is known in the art.

VGAM1852 is a novel bioinformatically detected regulatory, non protein coding, viral micro RNA (miRNA) gene. The method by which VGAM1852 was detected is described hereinabove with reference to FIGS. 1-8.

VGAM1852 gene, herein designated VGAM GENE, is a viral gene contained in the genome of Sonchus Yellow Net Virus. VGAM1852 host target gene, herein designated VGAM HOST TARGET GENE, is a human gene contained in the human genome.

VGAM1852 gene encodes a VGAM1852 precursor RNA, herein designated VGAM PRECURSOR RNA. Similar to other miRNA genes, and unlike most ordinary genes, VGAM1852 precursor RNA does not encode a protein. A nucleotide sequence identical or highly similar to the nucleotide sequence of VGAM1852 precursor RNA is designated SEQ ID:1838, and is provided hereinbelow with reference to the sequence listing part. Nucleotide sequence SEQ ID:1838 is located at position 1792 relative to the genome of Sonchus Yellow Net Virus.

VGAM1852 precursor RNA folds onto itself, forming VGAM1852 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1852 folded precursor RNA into VGAM1852 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM1852 RNA is designated SEQ ID:4563, and is provided hereinbelow with reference to the sequence listing part.

VGAM1852 host target gene, herein designated VGAM HOST TARGET GENE, encodes a corresponding messenger RNA, VGAM1852 host target RNA, herein designated VGAM HOST TARGET RNA. VGAM1852 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1852 RNA, herein designated VGAM RNA, binds complementarily to one or more host target binding sites located in untranslated regions of VGAM1852 host target RNA, herein designated VGAM HOST TARGET RNA. This complementary binding is due to the fact that the nucleotide sequence of VGAM1852 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1852 RNA, herein designated VGAM RNA, may have a different number of host target binding sites in untranslated regions of a VGAM1852 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1852 RNA, herein designated VGAM RNA, to host target binding sites on VGAM1852 host target RNA, herein designated VGAM HOST TARGET RNA, such as BINDING SITE I, BINDING SITE II and BINDING SITE III, inhibits translation of VGAM1852 host target RNA into VGAM1852 host target protein, herein designated VGAM HOST TARGET PROTEIN. VGAM host target protein is therefore outlined by a broken line.

It is appreciated that VGAM1852 host target gene, herein designated VGAM HOST TARGET GENE, in fact represents a plurality of VGAM1852 host target genes. The mRNA of each one of this plurality of VGAM1852 host target genes comprises one or more host target binding sites, each having a nucleotide sequence which is at least partly complementary to VGAM1852 RNA, herein designated VGAM RNA, and which when bound by VGAM1852 RNA causes inhibition of translation of respective one or more VGAM1852 host target proteins.

It is further appreciated by one skilled in the art that the mode of translational inhibition illustrated by FIG. 1 with specific reference to translational inhibition exerted by VGAM1852 gene, herein designated VGAM GENE, on one or more VGAM1852 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1852 is inhibition of expression of host target genes, as part of a novel viral mechanism of attacking a host. Accordingly, utilities of VGAM1852 include diagnosis, prevention and treatment of viral infection by Sonchus Yellow Net Virus. Specific functions, and accordingly utilities, of VGAM1852 correlate with, and may be deduced from, the identity of the host target genes which VGAM1852 binds and inhibits, and the function of these host target genes, as elaborated hereinbelow.

Nucleotide sequences of the VGAM1852 precursor RNA, herein designated VGAM PRECURSOR RNA, and of the 'diced' VGAM1852 RNA, herein designated VGAM RNA, and a schematic representation of the secondary folding of VGAM1852 folded precursor RNA, herein designated VGAM FOLDED PRECURSOR RNA, of VGAM1852 are further described hereinbelow with reference to Table 1.

Nucleotide sequences of host target binding sites, such as BINDING SITE-I, BINDING SITE-II and BINDING SITE-III of FIG. 1, found on VGAM1852 host target RNA, and schematic representation of the complementarity of each of these host target binding sites to VGAM1852 RNA, herein designated VGAM RNA, are described hereinbelow with reference to Table 2.

As mentioned hereinabove with reference to FIG. 1, a function of VGAM1852 gene, herein designated VGAM is inhibition of expression of VGAM1852 target genes. It is appreciated that specific functions, and accordingly utilities, of VGAM1852 correlate with, and may be deduced from, the identity of the target genes which VGAM1852 binds and inhibits, and the function of these target genes, as elaborated hereinbelow.

ATP-binding Cassette, Sub-family B (MDR/TAP), Member 4 (ABCB4, Accession NM_000443) is a VGAM1852 host target gene. ABCB4 BINDING SITE1 and ABCB4 BINDING SITE2 are HOST TARGET binding sites found in untranslated regions of mRNA encoded by ABCB4, corresponding to HOST TARGET binding sites such as BINDING SITE I, BINDING SITE II or BINDING SITE III. Table 2 illustrates the complementarity of the nucleotide sequences of ABCB4 BINDING SITE1 and ABCB4 BINDING SITE2, designated SEQ ID:6029 and SEQ ID:20834 respectively, to the nucleotide sequence of VGAM1852 RNA, herein designated VGAM RNA, also designated SEQ ID:4563.

A function of VGAM1852 is therefore inhibition of ATP-binding Cassette, Sub-family B (MDR/TAP), Member 4 (ABCB4, Accession NM_000443). Accordingly, utilities of VGAM1852 include diagnosis, prevention and treatment of diseases and clinical conditions associated with ABCB4. 5-hydroxytryptamine (serotonin) Receptor 2C (HTR2C, Accession NM_000868) is another VGAM1852 host target gene. HTR2C BINDING SITE is HOST TARGET binding site found in the 3' untranslated region of mRNA encoded by HTR2C, corresponding to a HOST TARGET binding site such as BINDING SITE I, BINDING SITE II or BINDING SITE III. Table 2 illustrates the complementarity of the nucleotide sequences of HTR2C BINDING SITE, designated SEQ ID:6532, to the nucleotide sequence of VGAM1852 RNA, herein designated VGAM RNA, also designated SEQ ID:4563.

Another function of VGAM1852 is therefore inhibition of 5-hydroxytryptamine (serotonin) Receptor 2C (HTR2C, Accession NM_000868), a gene which activates phospholipase C and regulates intracellular calcium flux. Accordingly, utilities of VGAM1852 include diagnosis, prevention and treatment of diseases and clinical conditions associated with HTR2C. The function of HTR2C and its association with various diseases and clinical conditions, has been established by previous studies, as described hereinabove with reference to VGAM1052. CGG Triplet Repeat Binding Protein 1 (CGGBP1, Accession NM_003663) is another VGAM1852 host target gene. CGGBP1 BINDING SITE is HOST TARGET binding site found in the 3' untranslated region of mRNA encoded by CGGBP1, corresponding to a HOST TARGET binding site such as BINDING SITE I, BINDING SITE II or BINDING SITE III. Table 2 illustrates the complementarity of the nucleotide sequences of CGGBP1 BINDING SITE, designated SEQ ID:9743, to the nucleotide sequence of VGAM1852 RNA, herein designated VGAM RNA, also designated SEQ ID:4563.

Another function of VGAM1852 is therefore inhibition of CGG Triplet Repeat Binding Protein 1 (CGGBP1, Accession NM_003663). Accordingly, utilities of VGAM1852 include diagnosis, prevention and treatment of diseases and clinical conditions associated with CGGBP1. DKFZP434G1411 (Accession XM_166383) is another VGAM1852 host target gene. DKFZP434G1411 BINDING SITE is HOST TARGET binding site found in the 3' untranslated region of mRNA encoded by DKFZP434G1411, corresponding to a HOST TARGET binding site such as BINDING SITE I, BINDING SITE II or BINDING SITE III. Table 2 illustrates the complementarity of the nucleotide sequences of DKFZP434G1411 BINDING SITE, designated SEQ ID:44231, to the nucleotide sequence of VGAM1852 RNA, herein designated VGAM RNA, also designated SEQ ID:4563.

Another function of VGAM1852 is therefore inhibition of DKFZP434G1411 (Accession XM_166383). Accordingly, utilities of VGAM1852 include diagnosis, prevention and treatment of diseases and clinical conditions associated with DKFZP434G1411. FLJ10154 (Accession NM_018011) is another VGAM1852 host target gene. FLJ10154 BINDING SITE is HOST TARGET binding site found in the 3' untranslated region of mRNA encoded by FLJ10154, corresponding to a HOST TARGET binding site such as BINDING SITE I, BINDING SITE II or BINDING SITE III. Table 2 illustrates the complementarity of the nucleotide sequences of FLJ10154 BINDING SITE, designated SEQ ID:19744, to the nucleotide sequence of VGAM1852 RNA, herein designated VGAM RNA, also designated SEQ ID:4563.

Another function of VGAM1852 is therefore inhibition of FLJ10154 (Accession NM_018011). Accordingly, utilities of VGAM1852 include diagnosis, prevention and treatment of diseases and clinical conditions associated with FLJ10154. FLJ14281 (Accession NM_024920) is another VGAM1852 host target gene. FLJ14281 BINDING SITE is HOST TARGET binding site found in the 5' untranslated region of mRNA encoded by FLJ14281, corresponding to a HOST TARGET binding site such as BINDING SITE I, BINDING SITE II or BINDING SITE III. Table 2 illustrates the complementarity of the nucleotide sequences of FLJ14281 BINDING SITE, designated SEQ ID:24451, to the nucleotide sequence of VGAM1852 RNA, herein designated VGAM RNA, also designated SEQ ID:4563.

Another function of VGAM1852 is therefore inhibition of FLJ14281 (Accession NM_024920). Accordingly, utilities of VGAM1852 include diagnosis, prevention and treatment of diseases and clinical conditions associated with FLJ14281. FLJ20457 (Accession NM_017832) is another VGAM1852 host target gene. FLJ20457 BINDING SITE is HOST TARGET binding site found in the 3' untranslated region of mRNA encoded by FLJ20457, corresponding to a HOST TARGET binding site such as BINDING SITE I, BINDING SITE II or BINDING SITE III. Table 2 illustrates the complementarity of the nucleotide sequences of FLJ20457 BINDING SITE, designated SEQ ID:19497, to the nucleotide sequence of VGAM1852 RNA, herein designated VGAM RNA, also designated SEQ ID:4563.

Another function of VGAM1852 is therefore inhibition of FLJ20457 (Accession NM_017832). Accordingly, utilities of VGAM1852 include diagnosis, prevention and treatment of diseases and clinical conditions associated with FLJ20457. Glia Maturation Factor, Beta (GMFB, Accession NM_004124) is another VGAM1852 host target gene. GMFB BINDING SITE is HOST TARGET binding site found in the 3' untranslated region of mRNA encoded by GMFB, corresponding to a HOST TARGET binding site such as BINDING SITE I, BINDING SITE II or BINDING SITE III. Table 2 illustrates the complementarity of the nucleotide sequences of GMFB BINDING SITE, designated SEQ ID:10327, to the nucleotide sequence of VGAM1852 RNA, herein designated VGAM RNA, also designated SEQ ID:4563.

Another function of VGAM1852 is therefore inhibition of Glia Maturation Factor, Beta (GMFB, Accession NM_004124). Accordingly, utilities of VGAM1852 include diagnosis, prevention and treatment of diseases and clinical conditions associated with GMFB. FIG. 1 further provides a conceptual description of a novel bioinformatically detected viral gene of the present invention, referred to here as Viral Genomic Address Messenger 1853 (VGAM1853) viral gene, which modulates expression of respective host target genes thereof, the function and utility of which host target genes is known in the art.

VGAM1853 is a novel bioinformatically detected regulatory, non protein coding, viral micro RNA (miRNA) gene. The method by which VGAM1853 was detected is described hereinabove with reference to FIGS. 1-8.

VGAM1853 gene, herein designated VGAM GENE, is a viral gene contained in the genome of Sonchus Yellow Net Virus. VGAM1853 host target gene, herein designated VGAM HOST TARGET GENE, is a human gene contained in the human genome.

VGAM1853 gene encodes a VGAM1853 precursor RNA, herein designated VGAM PRECURSOR RNA. Similar to other miRNA genes, and unlike most ordinary genes, VGAM1853 precursor RNA does not encode a protein. A nucleotide sequence identical or highly similar to the nucleotide sequence of VGAM1853 precursor RNA is designated SEQ ID:1839, and is provided hereinbelow with reference to the sequence listing part. Nucleotide sequence SEQ ID:1839 is located at position 3373 relative to the genome of Sonchus Yellow Net Virus.

VGAM1853 precursor RNA folds onto itself, forming VGAM1853 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1853 folded precursor RNA into VGAM1853 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1853 RNA is designated SEQ ID:4564, and is provided hereinbelow with reference to the sequence listing part.

VGAM1853 host target gene, herein designated VGAM HOST TARGET GENE, encodes a corresponding messenger RNA, VGAM1853 host target RNA, herein designated VGAM HOST TARGET RNA. VGAM1853 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1853 RNA, herein designated VGAM RNA, binds complementarily to one or more host target binding sites located in untranslated regions of VGAM1853 host target RNA, herein designated VGAM HOST TARGET RNA. This complementary binding is due to the fact that the nucleotide sequence of VGAM1853 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1853 RNA, herein designated VGAM RNA, may have a different number of host target binding sites in untranslated regions of a VGAM1853 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1853 RNA, herein designated VGAM RNA, to host target binding sites on VGAM1853 host target RNA, herein designated VGAM HOST TARGET RNA, such as BINDING SITE I, BINDING SITE II and BINDING SITE III, inhibits translation of VGAM1853 host target RNA into VGAM1853 host target protein, herein designated VGAM HOST TARGET PROTEIN. VGAM host target protein is therefore outlined by a broken line.

It is appreciated that VGAM1853 host target gene, herein designated VGAM HOST TARGET GENE, in fact represents a plurality of VGAM1853 host target genes. The mRNA of each one of this plurality of VGAM1853 host target genes comprises one or more host target binding sites, each having a nucleotide sequence which is at least partly complementary to VGAM1853 RNA, herein designated VGAM RNA, and which when bound by VGAM1853 RNA causes inhibition of translation of respective one or more VGAM1853 host target proteins.

It is further appreciated by one skilled in the art that the mode of translational inhibition illustrated by FIG. 1 with specific reference to translational inhibition exerted by VGAM1853 gene, herein designated VGAM GENE, on one or more VGAM1853 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1853 is inhibition of expression of host target genes, as part of a novel viral mechanism of attacking a host. Accordingly, utilities of VGAM1853 include diagnosis, prevention and treatment of viral infection by Sonchus Yellow Net Virus. Specific functions, and accordingly utilities, of VGAM1853 correlate with, and may be deduced from, the identity of the host target genes which VGAM1853 binds and inhibits, and the function of these host target genes, as elaborated hereinbelow.

Nucleotide sequences of the VGAM1853 precursor RNA, herein designated VGAM PRECURSOR RNA, and of the 'diced' VGAM1853 RNA, herein designated VGAM RNA, and a schematic representation of the secondary folding of VGAM1853 folded precursor RNA, herein designated VGAM FOLDED PRECURSOR RNA, of VGAM1853 are further described hereinbelow with reference to Table 1.

Nucleotide sequences of host target binding sites, such as BINDING SITE-I, BINDING SITE-II and BINDING SITE-III of FIG. 1, found on VGAM1853 host target RNA, and schematic representation of the complementarity of each of these host target binding sites to VGAM1853 RNA, herein designated VGAM RNA, are described hereinbelow with reference to Table 2.

As mentioned hereinabove with reference to FIG. 1, a function of VGAM1853 gene, herein designated VGAM is inhibition of expression of VGAM1853 target genes. It is appreciated that specific functions, and accordingly utilities, of VGAM1853 correlate with, and may be deduced from, the identity of the target genes which VGAM1853 binds and inhibits, and the function of these target genes, as elaborated hereinbelow.

Cadherin 17, LI Cadherin (liver-intestine) (CDH17, Accession NM_004063) is a VGAM1853 host target gene. CDH17 BINDING SITE is HOST TARGET binding site found in the 3' untranslated region of mRNA encoded by CDH17, corresponding to a HOST TARGET binding site such as BINDING SITE I, BINDING SITE II or BINDING SITE III. Table 2 illustrates the complementarity of the nucleotide sequences of CDH17 BINDING SITE, designated SEQ ID:10270, to the nucleotide sequence of VGAM1853 RNA, herein designated VGAM RNA, also designated SEQ ID:4564.

A function of VGAM1853 is therefore inhibition of Cadherin 17, LI Cadherin (liver-intestine) (CDH17, Accession NM_004063), a gene which may have a role in the morphological organization of liver and intestine and involved in intestinal peptide transport. Accordingly, utilities of VGAM1853 include diagnosis, prevention and treatment of diseases and clinical conditions associated with CDH17. The function of CDH17 and its association with various diseases and clinical conditions, has been established by previous studies, as described hereinabove with reference to VGAM795. Copine III (CPNE3, Accession NM_003909) is another VGAM1853 host target gene. CPNE3 BINDING SITE is HOST TARGET binding site found in the 3' untranslated region of mRNA encoded by CPNE3, corresponding to a HOST TARGET binding site such as BINDING SITE I, BINDING SITE II or BINDING SITE III. Table 2 illustrates the complementarity of the nucleotide sequences of CPNE3 BINDING SITE, designated SEQ ID:9995, to the nucleotide sequence of VGAM1853 RNA, herein designated VGAM RNA, also designated SEQ ID:4564.

Another function of VGAM1853 is therefore inhibition of Copine III (CPNE3, Accession NM_003909), a gene which may function in membrane trafficking. Accordingly, utilities of VGAM1853 include diagnosis, prevention and treatment of diseases and clinical conditions associated with CPNE3. The function of CPNE3 and its association with various diseases and clinical conditions, has been established by previous studies, as described hereinabove with reference to VGAM28. Cullin 3 (CUL3, Accession NM_003590) is another VGAM1853 host target gene. CUL3 BINDING SITE is HOST TARGET binding site found in the 3' untranslated region of mRNA encoded by CUL3, corresponding to a HOST TARGET binding site such as BINDING SITE I, BINDING SITE II or BINDING SITE III. Table 2 illustrates the complementarity of the nucleotide sequences of CUL3

BINDING SITE, designated SEQ ID:9646, to the nucleotide sequence of VGAM1853 RNA, herein designated VGAM RNA, also designated SEQ ID:4564.

Another function of VGAM1853 is therefore inhibition of Cullin 3 (CUL3, Accession NM_003590), a gene which may target other proteins for ubiquitin-dependent proteolysis. Accordingly, utilities of VGAM1853 include diagnosis, prevention and treatment of diseases and clinical conditions associated with CUL3. The function of CUL3 and its association with various diseases and clinical conditions, has been established by previous studies, as described hereinabove with reference to VGAM143. Follistatin-like 1 (FSTL1, Accession NM_007085) is another VGAM1853 host target gene. FSTL1 BINDING SITE is HOST TARGET binding site found in the 3' untranslated region of mRNA encoded by FSTL1, corresponding to a HOST TARGET binding site such as BINDING SITE I, BINDING SITE II or BINDING SITE III. Table 2 illustrates the complementarity of the nucleotide sequences of FSTL1 BINDING SITE, designated SEQ ID:13953, to the nucleotide sequence of VGAM1853 RNA, herein designated VGAM RNA, also designated SEQ ID:4564.

Another function of VGAM1853 is therefore inhibition of Follistatin-like 1 (FSTL1, Accession NM_007085), a gene which may modulate the action of some growth factors on cell proliferation and differentiation. Accordingly, utilities of VGAM1853 include diagnosis, prevention and treatment of diseases and clinical conditions associated with FSTL1. The function of FSTL1 and its association with various diseases and clinical conditions, has been established by previous studies, as described hereinabove with reference to VGAM791. Glycoprotein M6A (GPM6A, Accession NM_005277) is another VGAM1853 host target gene. GPM6A BINDING SITE is HOST TARGET binding site found in the 3' untranslated region of mRNA encoded by GPM6A, corresponding to a HOST TARGET binding site such as BINDING SITE I, BINDING SITE II or BINDING SITE III. Table 2 illustrates the complementarity of the nucleotide sequences of GPM6A BINDING SITE, designated SEQ ID:11779, to the nucleotide sequence of VGAM1853 RNA, herein designated VGAM RNA, also designated SEQ ID:4564.

Another function of VGAM1853 is therefore inhibition of Glycoprotein M6A (GPM6A, Accession NM_005277), a gene which may play a role in neuronal development. Accordingly, utilities of VGAM1853 include diagnosis, prevention and treatment of diseases and clinical conditions associated with GPM6A. The function of GPM6A and its association with various diseases and clinical conditions, has been established by previous studies, as described hereinabove with reference to VGAM326. Interleukin 8 (IL8, Accession XM_170504) is another VGAM1853 host target gene. IL8 BINDING SITE is HOST TARGET binding site found in the 3' untranslated region of mRNA encoded by IL8, corresponding to a HOST TARGET binding site such as BINDING SITE I, BINDING SITE II or BINDING SITE III. Table 2 illustrates the complementarity of the nucleotide sequences of IL8 BINDING SITE, designated SEQ ID:45339, to the nucleotide sequence of VGAM1853 RNA, herein designated VGAM RNA, also designated SEQ ID:4564.

Another function of VGAM1853 is therefore inhibition of Interleukin 8 (IL8, Accession XM_170504). Accordingly, utilities of VGAM1853 include diagnosis, prevention and treatment of diseases and clinical conditions associated with IL8. Uridine Monophosphate Synthetase (orotate phosphoribosyl transferase and orotidine-5'-decarboxylase) (UMPS, Accession NM_000373) is another VGAM1853 host target gene. UMPS BINDING SITE is HOST TARGET binding site found in the 3' untranslated region of mRNA encoded by UMPS, corresponding to a HOST TARGET binding site such as BINDING SITE I, BINDING SITE II or BINDING SITE III. Table 2 illustrates the complementarity of the nucleotide sequences of UMPS BINDING SITE, designated SEQ ID:5941, to the nucleotide sequence of VGAM1853 RNA, herein designated VGAM RNA, also designated SEQ ID:4564.

Another function of VGAM1853 is therefore inhibition of Uridine Monophosphate Synthetase (orotate phosphoribosyl transferase and orotidine-5'-decarboxylase) (UMPS, Accession NM_000373). Accordingly, utilities of VGAM1853 include diagnosis, prevention and treatment of diseases and clinical conditions associated with UMPS. Claudin 1 (CLDN1, Accession NM_021101) is another VGAM1853 host target gene. CLDN1 BINDING SITE is HOST TARGET binding site found in the 3' untranslated region of mRNA encoded by CLDN1, corresponding to a HOST TARGET binding site such as BINDING SITE I, BINDING SITE II or BINDING SITE III. Table 2 illustrates the complementarity of the nucleotide sequences of CLDN1 BINDING SITE, designated SEQ ID:22084, to the nucleotide sequence of VGAM1853 RNA, herein designated VGAM RNA, also designated SEQ ID:4564.

Another function of VGAM1853 is therefore inhibition of Claudin 1 (CLDN1, Accession NM_021101). Accordingly, utilities of VGAM1853 include diagnosis, prevention and treatment of diseases and clinical conditions associated with CLDN1. DKFZp434E2220 (Accession NM_017612) is another VGAM1853 host target gene. DKFZp434E2220 BINDING SITE is HOST TARGET binding site found in the 5' untranslated region of mRNA encoded by DKFZp434E2220, corresponding to a HOST TARGET binding site such as BINDING SITE I, BINDING SITE II or BINDING SITE III. Table 2 illustrates the complementarity of the nucleotide sequences of DKFZp434E2220 BINDING SITE, designated SEQ ID:19112, to the nucleotide sequence of VGAM1853 RNA, herein designated VGAM RNA, also designated SEQ ID:4564.

Another function of VGAM1853 is therefore inhibition of DKFZp434E2220 (Accession NM_017612). Accordingly, utilities of VGAM1853 include diagnosis, prevention and treatment of diseases and clinical conditions associated with DKFZp434E2220. FLJ12409 (Accession NM_025105) is another VGAM1853 host target gene. FLJ12409 BINDING SITE is HOST TARGET binding site found in the 3' untranslated region of mRNA encoded by FLJ12409, corresponding to a HOST TARGET binding site such as BINDING SITE I, BINDING SITE II or BINDING SITE III. Table 2 illustrates the complementarity of the nucleotide sequences of FLJ12409 BINDING SITE, designated SEQ ID:24755, to the nucleotide sequence of VGAM1853 RNA, herein designated VGAM RNA, also designated SEQ ID:4564.

Another function of VGAM1853 is therefore inhibition of FLJ12409 (Accession NM_025105). Accordingly, utilities of VGAM1853 include diagnosis, prevention and treatment of diseases and clinical conditions associated with FLJ12409. FLJ20274 (Accession XM_031455) is another VGAM1853 host target gene. FLJ20274 BINDING SITE is HOST TARGET binding site found in the 3' untranslated region of mRNA encoded by FLJ20274, corresponding to a HOST TARGET binding site such as BINDING SITE I, BINDING SITE II or BINDING SITE III. Table 2 illustrates the complementarity of the nucleotide sequences of FLJ20274 BINDING SITE, designated SEQ ID:31387, to the nucleotide sequence of VGAM1853 RNA, herein designated VGAM RNA, also designated SEQ ID:4564.

Another function of VGAM1853 is therefore inhibition of FLJ20274 (Accession XM_031455). Accordingly, utilities of VGAM1853 include diagnosis, prevention and treatment of diseases and clinical conditions associated with FLJ20274. FLJ22056 (Accession NM_022489) is another VGAM1853 host target gene. FLJ22056 BINDING SITE is HOST TARGET binding site found in the 3' untranslated region of mRNA encoded by FLJ22056, corresponding to a HOST TARGET binding site such as BINDING SITE I, BINDING SITE II or BINDING SITE III. Table 2 illustrates the complementarity of the nucleotide sequences of FLJ22056 BINDING SITE, designated SEQ ID:22870, to the nucleotide sequence of VGAM1853 RNA, herein designated VGAM RNA, also designated SEQ ID:4564.

Another function of VGAM1853 is therefore inhibition of FLJ22056 (Accession NM_022489). Accordingly, utilities of VGAM1853 include diagnosis, prevention and treatment of diseases and clinical conditions associated with FLJ22056. FLJ23598 (Accession NM_024783) is another VGAM1853 host target gene. FLJ23598 BINDING SITE is HOST TARGET binding site found in the 3' untranslated region of mRNA encoded by FLJ23598, corresponding to a HOST TARGET binding site such as BINDING SITE I, BINDING SITE II or BINDING SITE III. Table 2 illustrates the complementarity of the nucleotide sequences of FLJ23598 BINDING SITE, designated SEQ ID:24156, to the nucleotide sequence of VGAM1853 RNA, herein designated VGAM RNA, also designated SEQ ID:4564.

Another function of VGAM1853 is therefore inhibition of FLJ23598 (Accession NM_024783). Accordingly, utilities of VGAM1853 include diagnosis, prevention and treatment of diseases and clinical conditions associated with FLJ23598. HIC (Accession XM_041273) is another VGAM1853 host target gene. HIC BINDING SITE is HOST TARGET binding site found in the 3' untranslated region of mRNA encoded by HIC, corresponding to a HOST TARGET binding site such as BINDING SITE I, BINDING SITE II or BINDING SITE III. Table 2 illustrates the complementarity of the nucleotide sequences of HIC BINDING SITE, designated SEQ ID:33493, to the nucleotide sequence of VGAM1853 RNA, herein designated VGAM RNA, also designated SEQ ID:4564.

Another function of VGAM1853 is therefore inhibition of HIC (Accession XM_041273). Accordingly, utilities of VGAM1853 include diagnosis, prevention and treatment of diseases and clinical conditions associated with HIC. KIAA1500 (Accession XM_034353) is another VGAM1853 host target gene. KIAA1500 BINDING SITE is HOST TARGET binding site found in the 3" untranslated region of mRNA encoded by KIAA1500, corresponding to a HOST TARGET binding site such as BINDING SITE I, BINDING SITE II or BINDING SITE III. Table 2 illustrates the complementarity of the nucleotide sequences of KIAA1500 BINDING SITE, designated SEQ ID:32068, to the nucleotide sequence of VGAM1853 RNA, herein designated VGAM RNA, also designated SEQ ID:4564.

Another function of VGAM1853 is therefore inhibition of KIAA1500 (Accession XM_034353). Accordingly, utilities of VGAM1853 include diagnosis, prevention and treatment of diseases and clinical conditions associated with KIAA1500. Myosin, Heavy Polypeptide 10, Non-muscle (MYH10, Accession XM_044702) is another VGAM1853 host target gene. MYH10 BINDING SITE is HOST TARGET binding site found in the 3' untranslated region of mRNA encoded by MYH10, corresponding to a HOST TARGET binding site such as BINDING SITE I, BINDING SITE II or BINDING SITE III. Table 2 illustrates the complementarity of the nucleotide sequences of MYH10 BINDING SITE, designated SEQ ID:34266, to the nucleotide sequence of VGAM1853 RNA, herein designated VGAM RNA, also designated SEQ ID:4564.

Another function of VGAM1853 is therefore inhibition of Myosin, Heavy Polypeptide 10, Non-muscle (MYH10, Accession XM_044702). Accordingly, utilities of VGAM1853 include diagnosis, prevention and treatment of diseases and clinical conditions associated with MYH10. PRO0082 (Accession NM_018590) is another VGAM1853 host target gene. PRO0082 BINDING SITE is HOST TARGET binding site found in the 3' untranslated region of mRNA encoded by PRO0082, corresponding to a HOST TARGET binding site such as BINDING SITE I, BINDING SITE II or BINDING SITE III. Table 2 illustrates the complementarity of the nucleotide sequences of PRO0082 BINDING SITE, designated SEQ ID:20670, to the nucleotide sequence of VGAM1853 RNA, herein designated VGAM RNA, also designated SEQ ID:4564.

Another function of VGAM1853 is therefore inhibition of PRO0082 (Accession NM_018590). Accordingly, utilities of VGAM1853 include diagnosis, prevention and treatment of diseases and clinical conditions associated with PRO0082. Solute Carrier Family 6 (neurotransmitter transporter), Member 14 (SLC6A14, Accession NM_007231) is another VGAM1853 host target gene. SLC6A14 BINDING SITE is HOST TARGET binding site found in the 3' untranslated region of mRNA encoded by SLC6A14, corresponding to a HOST TARGET binding site such as BINDING SITE I, BINDING SITE II or BINDING SITE III. Table 2 illustrates the complementarity of the nucleotide sequences of SLC6A14 BINDING SITE, designated SEQ ID:14102, to the nucleotide sequence of VGAM1853 RNA, herein designated VGAM RNA, also designated SEQ ID:4564.

Another function of VGAM1853 is therefore inhibition of Solute Carrier Family 6 (neurotransmitter transporter), Member 14 (SLC6A14, Accession NM_007231). Accordingly, utilities of VGAM1853 include diagnosis, prevention and treatment of diseases and clinical conditions associated with SLC6A14. LOC256733 (Accession XM_173116) is another VGAM1853 host target gene. LOC256733 BINDING SITE is HOST TARGET binding site found in the 5' untranslated region of mRNA encoded by LOC256733, corresponding to a HOST TARGET binding site such as BINDING SITE I, BINDING SITE II or BINDING SITE III. Table 2 illustrates the complementarity of the nucleotide sequences of LOC256733 BINDING SITE, designated SEQ ID:46369, to the nucleotide sequence of VGAM1853 RNA, herein designated VGAM RNA, also designated SEQ ID:4564.

Another function of VGAM1853 is therefore inhibition of LOC256733 (Accession XM_173116). Accordingly, utilities of VGAM1853 include diagnosis, prevention and treatment of diseases and clinical conditions associated with LOC256733. LOC83690 (Accession NM_031461) is another VGAM1853 host target gene. LOC83690 BINDING SITE is HOST TARGET binding site found in the 3' untranslated region of mRNA encoded by LOC83690, corresponding to a HOST TARGET binding site such as BINDING SITE I, BINDING SITE II or BINDING SITE III. Table 2 illustrates the complementarity of the nucleotide sequences of LOC83690 BINDING SITE, designated SEQ ID:25484, to the nucleotide sequence of VGAM1853 RNA, herein designated VGAM RNA, also designated SEQ ID:4564.

Another function of VGAM1853 is therefore inhibition of LOC83690 (Accession NM_031461). Accordingly, utilities of VGAM1853 include diagnosis, prevention and treatment of diseases and clinical conditions associated with LOC83690. FIG. 1 further provides a conceptual description of a novel bioinformatically detected viral gene of the present invention, referred to here as Viral Genomic Address Messenger 1854 (VGAM1854) viral gene, which modulates expression of respective host target genes thereof, the function and utility of which host target genes is known in the art.

VGAM1854 is a novel bioinformatically detected regulatory, non protein coding, viral micro RNA (miRNA) gene. The method by which VGAM1854 was detected is described hereinabove with reference to FIGS. 1-8.

VGAM1854 gene, herein designated VGAM GENE, is a viral gene contained in the genome of Cowpea Chlorotic Mottle Virus. VGAM1854 host target gene, herein designated VGAM HOST TARGET GENE, is a human gene contained in the human genome.

VGAM1854 gene encodes a VGAM1854 precursor RNA, herein designated VGAM PRECURSOR RNA. Similar to other miRNA genes, and unlike most ordinary genes, VGAM1854 precursor RNA does not encode a protein. A nucleotide sequence identical or highly similar to the nucleotide sequence of VGAM1854 precursor RNA is designated SEQ ID:1840, and is provided hereinbelow with reference to the sequence listing part. Nucleotide sequence SEQ ID:1840 is located at position 1253 relative to the genome of Cowpea Chlorotic Mottle Virus.

VGAM1854 precursor RNA folds onto itself, forming VGAM1854 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1854 folded precursor RNA into VGAM1854 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1854 RNA is designated SEQ ID:4565, and is provided hereinbelow with reference to the sequence listing part.

VGAM1854 host target gene, herein designated VGAM HOST TARGET GENE, encodes a corresponding messenger RNA, VGAM1854 host target RNA, herein designated VGAM HOST TARGET RNA. VGAM1854 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1854 RNA, herein designated VGAM RNA, binds complementarily to one or more host target binding sites located in untranslated regions of VGAM1854 host target RNA, herein designated VGAM HOST TARGET RNA. This complementary binding is due to the fact that the nucleotide sequence of VGAM1854 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1854 RNA, herein designated VGAM RNA, may have a different number of host target binding sites in untranslated regions of a VGAM1854 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1854 RNA, herein designated VGAM RNA, to host target binding sites on VGAM1854 host target RNA, herein designated VGAM HOST TARGET RNA, such as BINDING SITE I, BINDING SITE II and BINDING SITE III, inhibits translation of VGAM1854 host target RNA into VGAM1854 host target protein, herein designated VGAM HOST TARGET PROTEIN. VGAM host target protein is therefore outlined by a broken line.

It is appreciated that VGAM1854 host target gene, herein designated VGAM HOST TARGET GENE, in fact represents a plurality of VGAM1854 host target genes. The mRNA of each one of this plurality of VGAM1854 host target genes comprises one or more host target binding sites, each having a nucleotide sequence which is at least partly complementary to VGAM1854 RNA, herein designated VGAM RNA, and which when bound by VGAM1854 RNA causes inhibition of translation of respective one or more VGAM1854 host target proteins.

It is further appreciated by one skilled in the art that the mode of translational inhibition illustrated by FIG. 1 with specific reference to translational inhibition exerted by VGAM1854 gene, herein designated VGAM GENE, on one or more VGAM1854 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1854 is inhibition of expression of host target genes, as part of a novel viral mechanism of attacking a host. Accordingly, utilities of VGAM1854 include diagnosis, prevention and treatment of viral infection by Cowpea Chlorotic Mottle Virus. Specific functions, and accordingly utilities, of VGAM1854 correlate with, and may be deduced from, the identity of the host target genes which VGAM1854 binds and inhibits, and the function of these host target genes, as elaborated hereinbelow.

Nucleotide sequences of the VGAM1854 precursor RNA, herein designated VGAM PRECURSOR RNA, and of the 'diced' VGAM1854 RNA, herein designated VGAM RNA, and a schematic representation of the secondary folding of VGAM1854 folded precursor RNA, herein designated VGAM FOLDED PRECURSOR RNA, of VGAM1854 are further described hereinbelow with reference to Table 1.

Nucleotide sequences of host target binding sites, such as BINDING SITE-I, BINDING SITE-II and BINDING SITE-III of FIG. 1, found on VGAM1854 host target RNA, and schematic representation of the complementarity of each of these host target binding sites to VGAM1854 RNA, herein designated VGAM RNA, are described hereinbelow with reference to Table 2.

As mentioned hereinabove with reference to FIG. 1, a function of VGAM1854 gene, herein designated VGAM is inhibition of expression of VGAM1854 target genes. It is appreciated that specific functions, and accordingly utilities, of VGAM1854 correlate with, and may be deduced from, the identity of the target genes which VGAM1854 binds and inhibits, and the function of these target genes, as elaborated hereinbelow.

TEA Domain Family Member 3 (TEAD3, Accession NM_003214) is a VGAM1854 host target gene. TEAD3 BINDING SITE is HOST TARGET binding site found in the 3' untranslated region of mRNA encoded by TEAD3, corresponding to a HOST TARGET binding site such as BINDING SITE I, BINDING SITE II or BINDING SITE III. Table 2 illustrates the complementarity of the nucleotide sequences of TEAD3 BINDING SITE, designated SEQ ID:9214, to the nucleotide sequence of VGAM1854 RNA, herein designated VGAM RNA, also designated SEQ ID:4565.

A function of VGAM1854 is therefore inhibition of TEA Domain Family Member 3 (TEAD3, Accession NM_003214), a gene which binds to multiple functional elements of the human chorionic somatomammotropin-b gene enhancer. Accordingly, utilities of VGAM1854 include diagnosis, prevention and treatment of diseases and clinical conditions associated with TEAD3. The function of TEAD3 and its association with various diseases and clinical conditions, has been established by previous studies, as described hereinabove with reference to VGAM299. FLJ14442 (Accession NM_032785) is another VGAM1854 host target gene. FLJ14442 BINDING SITE is HOST TARGET binding site found in the 3' untranslated region of mRNA encoded by FLJ14442, corresponding to a HOST TARGET binding site such as BINDING SITE I, BINDING SITE II or BINDING SITE III. Table 2 illustrates the complementarity of the nucleotide sequences of FLJ14442 BINDING SITE, designated SEQ ID:26535, to the nucleotide sequence of VGAM1854 RNA, herein designated VGAM RNA, also designated SEQ ID:4565.

Another function of VGAM1854 is therefore inhibition of FLJ14442 (Accession NM_032785). Accordingly, utilities of VGAM1854 include diagnosis, prevention and treatment of diseases and clinical conditions associated with FLJ14442. LOC150998 (Accession XM_097990) is another VGAM1854 host target gene. LOC150998 BINDING SITE is HOST TARGET binding site found in the 3' untranslated region of mRNA encoded by LOC150998, corresponding to a HOST TARGET binding site such as BINDING SITE I, BINDING SITE II or BINDING SITE III. Table 2 illustrates the complementarity of the nucleotide sequences of LOC150998 BINDING SITE, designated SEQ ID:41286, to the nucleotide sequence of VGAM1854 RNA, herein designated VGAM RNA, also designated SEQ ID:4565.

Another function of VGAM1854 is therefore inhibition of LOC150998 (Accession XM_097990). Accordingly, utilities of VGAM1854 include diagnosis, prevention and treatment of diseases and clinical conditions associated with LOC150998. LOC256096 (Accession XM_173164) is another VGAM1854 host target gene. LOC256096 BINDING SITE is HOST TARGET binding site found in the 5' untranslated region of mRNA encoded by LOC256096, corresponding to a HOST TARGET binding site such as BINDING SITE I, BINDING SITE II or BINDING SITE III. Table 2 illustrates the complementarity of the nucleotide sequences of LOC256096 BINDING SITE, designated SEQ ID:46419, to the nucleotide sequence of VGAM1854 RNA, herein designated VGAM RNA, also designated SEQ ID:4565.

Another function of VGAM1854 is therefore inhibition of LOC256096 (Accession XM_173164). Accordingly, utilities of VGAM1854 include diagnosis, prevention and treatment of diseases and clinical conditions associated with LOC256096. FIG. 1 further provides a conceptual description of a novel bioinformatically detected viral gene of the present invention, referred to here as Viral Genomic Address Messenger 1855 (VGAM1855) viral gene, which modulates expression of respective host target genes thereof, the function and utility of which host target genes is known in the art.

VGAM1855 is a novel bioinformatically detected regulatory, non protein coding, viral micro RNA (miRNA) gene. The method by which VGAM1855 was detected is described hereinabove with reference to FIGS. 1-8.

VGAM1855 gene, herein designated VGAM GENE, is a viral gene contained in the genome of Sonchus Yellow Net Virus. VGAM1855 host target gene, herein designated VGAM HOST TARGET GENE, is a human gene contained in the human genome.

VGAM1855 gene encodes a VGAM1855 precursor RNA, herein designated VGAM PRECURSOR RNA. Similar to other miRNA genes, and unlike most ordinary genes, VGAM1855 precursor RNA does not encode a protein. A nucleotide sequence identical or highly similar to the nucleotide sequence of VGAM1855 precursor RNA is designated SEQ ID:1841, and is provided hereinbelow with reference to the sequence listing part. Nucleotide sequence SEQ ID:1841 is located at position 8120 relative to the genome of Sonchus Yellow Net Virus.

VGAM1855 precursor RNA folds onto itself, forming VGAM1855 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1855 folded precursor RNA into VGAM1855 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1855 RNA is designated SEQ ID:4566, and is provided hereinbelow with reference to the sequence listing part.

VGAM1855 host target gene, herein designated VGAM HOST TARGET GENE, encodes a corresponding messenger RNA, VGAM1855 host target RNA, herein designated VGAM HOST TARGET RNA. VGAM1855 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1855 RNA, herein designated VGAM RNA, binds complementarily to one or more host target binding sites located in untranslated regions of VGAM1855 host target RNA, herein designated VGAM HOST TARGET RNA. This complementary binding is due to the fact that the nucleotide sequence of VGAM1855 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1855 RNA, herein designated VGAM RNA, may have a different number of host target binding sites in untranslated regions of a VGAM1855 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1855 RNA, herein designated VGAM RNA, to host target binding sites on VGAM1855 host target RNA, herein designated VGAM HOST TARGET RNA, such as BINDING SITE I, BINDING SITE II and BINDING SITE III, inhibits translation of VGAM1855 host target RNA into VGAM1855 host target protein, herein designated VGAM HOST TARGET PROTEIN. VGAM host target protein is therefore outlined by a broken line.

It is appreciated that VGAM1855 host target gene, herein designated VGAM HOST TARGET GENE, in fact represents a plurality of VGAM1855 host target genes. The mRNA of each one of this plurality of VGAM1855 host target genes comprises one or more host target binding sites, each having a nucleotide sequence which is at least partly complementary to VGAM1855 RNA, herein designated VGAM RNA, and which when bound by VGAM1855 RNA causes inhibition of translation of respective one or more VGAM1855 host target proteins.

It is further appreciated by one skilled in the art that the mode of translational inhibition illustrated by FIG. 1 with specific reference to translational inhibition exerted by VGAM1855 gene, herein designated VGAM GENE, on one or more VGAM1855 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1855 is inhibition of expression of host target genes, as part of a novel viral mechanism of attacking a host. Accordingly, utilities of VGAM1855 include diagnosis, prevention and treatment of viral infection by Sonchus Yellow Net Virus. Specific functions, and accordingly utilities, of VGAM1855 correlate with, and may be deduced from, the identity of the host target genes which VGAM1855 binds and inhibits, and the function of these host target genes, as elaborated hereinbelow.

Nucleotide sequences of the VGAM1855 precursor RNA, herein designated VGAM PRECURSOR RNA, and of the 'diced' VGAM1855 RNA, herein designated VGAM RNA, and a schematic representation of the secondary folding of VGAM1855 folded precursor RNA, herein designated VGAM FOLDED PRECURSOR RNA, of VGAM1855 are further described hereinbelow with reference to Table 1.

Nucleotide sequences of host target binding sites, such as BINDING SITE-I, BINDING SITE-II and BINDING SITE-III of FIG. 1, found on VGAM1855 host target RNA, and schematic representation of the complementarity of each of these host target binding sites to VGAM1855 RNA, herein designated VGAM RNA, are described hereinbelow with reference to Table 2.

As mentioned hereinabove with reference to FIG. 1, a function of VGAM1855 gene, herein designated VGAM is inhibition of expression of VGAM1855 target genes. It is appreciated that specific functions, and accordingly utilities, of VGAM1855 correlate with, and may be deduced from, the identity of the target genes which VGAM1855 binds and inhibits, and the function of these target genes, as elaborated hereinbelow.

Collagen, Type XV, Alpha 1 (COL15A1, Accession NM_001855) is a VGAM1855 host target gene. COL15A1 BINDING SITE is HOST TARGET binding site found in the 3' untranslated region of mRNA encoded by COL15A1, corresponding to a HOST TARGET binding site such as BINDING SITE I, BINDING SITE II or BINDING SITE III. Table 2 illustrates the complementarity of the nucleotide sequences of COL15A1 BINDING SITE, designated SEQ ID:7587, to the nucleotide sequence of VGAM1855 RNA, herein designated VGAM RNA, also designated SEQ ID:4566.

A function of VGAM1855 is therefore inhibition of Collagen, Type XV, Alpha 1 (COL15A1, Accession NM_001855), a gene which may be involved in maintaining the structure of connective tissue. Accordingly, utilities of VGAM1855 include diagnosis, prevention and treatment of diseases and clinical conditions associated with COL15A1. The function of COL15A1 and its association with various diseases and clinical conditions, has been established by previous studies, as described hereinabove with reference to VGAM304. Myosin IC (MYO1C, Accession XM_028385) is another VGAM1855 host target gene. MYO1C BINDING SITE is HOST TARGET binding site found in the 3" untranslated region of mRNA encoded by MYO1C, corresponding to a HOST TARGET binding site such as BINDING SITE I, BINDING SITE II or BINDING SITE III. Table 2 illustrates the complementarity of the nucleotide sequences of MYO1C BINDING SITE, designated SEQ ID:30697, to the nucleotide sequence of VGAM1855 RNA, herein designated VGAM RNA, also designated SEQ ID:4566.

Another function of VGAM1855 is therefore inhibition of Myosin IC (MYO1C, Accession XM_028385), a gene which participates in adaptation in hair cells. Accordingly, utilities of VGAM1855 include diagnosis, prevention and treatment of diseases and clinical conditions associated with MYO1C. The function of MYO1C and its association with various diseases and clinical conditions, has been established by previous studies, as described hereinabove with reference to VGAM381. DKFZp564I1922 (Accession NM_015419) is another VGAM1855 host target gene. DKFZp564I1922 BINDING SITE is HOST TARGET binding site found in the 3' untranslated region of mRNA encoded by DKFZp564I1922, corresponding to a HOST TARGET binding site such as BINDING SITE I, BINDING SITE II or BINDING SITE III. Table 2 illustrates the complementarity of the nucleotide sequences of DKFZp564I1922 BINDING SITE, designated SEQ ID:17721, to the nucleotide sequence of VGAM1855 RNA, herein designated VGAM RNA, also designated SEQ ID:4566.

Another function of VGAM1855 is therefore inhibition of DKFZp564I1922 (Accession NM_015419). Accordingly, utilities of VGAM1855 include diagnosis, prevention and treatment of diseases and clinical conditions associated with DKFZp564I1922. KIAA1579 (Accession NM_018211) is another VGAM1855 host target gene. KIAA1579 BINDING SITE is HOST TARGET binding site found in the 3' untranslated region of mRNA encoded by KIAA1579, corresponding to a HOST TARGET binding site such as BINDING SITE I, BINDING SITE II or BINDING SITE III. Table 2 illustrates the complementarity of the nucleotide sequences of KIAA1579 BINDING SITE, designated SEQ ID:20116, to the nucleotide sequence of VGAM1855 RNA, herein designated VGAM RNA, also designated SEQ ID:4566.

Another function of VGAM1855 is therefore inhibition of KIAA1579 (Accession NM_018211). Accordingly, utilities of VGAM1855 include diagnosis, prevention and treatment of diseases and clinical conditions associated with KIAA1579. LOC219686 (Accession XM_165544) is another VGAM1855 host target gene. LOC219686 BINDING SITE is HOST TARGET binding site found in the 3' untranslated region of mRNA encoded by LOC219686, corresponding to a HOST TARGET binding site such as BINDING SITE I, BINDING SITE II or BINDING SITE III. Table 2 illustrates the complementarity of the nucleotide sequences of LOC219686 BINDING SITE, designated SEQ ID:43671, to the nucleotide sequence of VGAM1855 RNA, herein designated VGAM RNA, also designated SEQ ID:4566.

Another function of VGAM1855 is therefore inhibition of LOC219686 (Accession XM_165544). Accordingly, utilities of VGAM1855 include diagnosis, prevention and treatment of diseases and clinical conditions associated with LOC219686. FIG. 1 further provides a conceptual description of a novel bioinformatically detected viral gene of the present invention, referred to here as Viral Genomic Address Messenger 1856 (VGAM1856) viral gene, which modulates expression of respective host target genes thereof, the function and utility of which host target genes is known in the art.

VGAM1856 is a novel bioinformatically detected regulatory, non protein coding, viral micro RNA (miRNA) gene. The method by which VGAM1856 was detected is described hereinabove with reference to FIGS. 1-8.

VGAM1856 gene, herein designated VGAM GENE, is a viral gene contained in the genome of Rice Yellow Stunt Virus. VGAM1856 host target gene, herein designated VGAM HOST TARGET GENE, is a human gene contained in the human genome.

VGAM1856 gene encodes a VGAM1856 precursor RNA, herein designated VGAM PRECURSOR RNA. Similar to other miRNA genes, and unlike most ordinary genes, VGAM1856 precursor RNA does not encode a protein. A nucleotide sequence identical or highly similar to the nucleotide sequence of VGAM1856 precursor RNA is designated SEQ ID:1842, and is provided hereinbelow with reference to the sequence listing part. Nucleotide sequence SEQ ID:1842 is located at position 13503 relative to the genome of Rice Yellow Stunt Virus.

VGAM1856 precursor RNA folds onto itself, forming VGAM1856 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1856 folded precursor RNA into VGAM1856 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1856 RNA is designated SEQ ID:4567, and is provided hereinbelow with reference to the sequence listing part.

VGAM1856 host target gene, herein designated VGAM HOST TARGET GENE, encodes a corresponding messenger RNA, VGAM1856 host target RNA, herein designated VGAM HOST TARGET RNA. VGAM1856 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1856 RNA, herein designated VGAM RNA, binds complementarily to one or more host target binding sites located in untranslated regions of VGAM1856 host target RNA, herein designated VGAM HOST TARGET RNA. This complementary binding is due to the fact that the nucleotide sequence of VGAM1856 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1856 RNA, herein designated VGAM RNA, may have a different number of host target binding sites in untranslated regions of a VGAM1856 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1856 RNA, herein designated VGAM RNA, to host target binding sites on VGAM1856 host target RNA, herein designated VGAM HOST TARGET RNA, such as BINDING SITE I, BINDING SITE II and BINDING SITE III, inhibits translation of VGAM1856 host target RNA into VGAM1856 host target protein, herein designated VGAM HOST TARGET PROTEIN. VGAM host target protein is therefore outlined by a broken line.

It is appreciated that VGAM1856 host target gene, herein designated VGAM HOST TARGET GENE, in fact represents a plurality of VGAM1856 host target genes. The mRNA of each one of this plurality of VGAM1856 host target genes comprises one or more host target binding sites, each having a nucleotide sequence which is at least partly complementary to VGAM1856 RNA, herein designated VGAM RNA, and which when bound by VGAM1856 RNA causes inhibition of translation of respective one or more VGAM1856 host target proteins.

It is further appreciated by one skilled in the art that the mode of translational inhibition illustrated by FIG. 1 with specific reference to translational inhibition exerted by VGAM1856 gene, herein designated VGAM GENE, on one or more VGAM1856 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1856 is inhibition of expression of host target genes, as part of a novel viral mechanism of attacking a host. Accordingly, utilities of VGAM1856 include diagnosis, prevention and treatment of viral infection by Rice Yellow Stunt Virus. Specific functions, and accordingly utilities, of VGAM1856 correlate with, and may be deduced from, the identity of the host target genes which VGAM1856 binds and inhibits, and the function of these host target genes, as elaborated hereinbelow.

Nucleotide sequences of the VGAM1856 precursor RNA, herein designated VGAM PRECURSOR RNA, and of the 'diced' VGAM1856 RNA, herein designated VGAM RNA, and a schematic representation of the secondary folding of VGAM1856 folded precursor RNA, herein designated VGAM FOLDED PRECURSOR RNA, of VGAM1856 are further described hereinbelow with reference to Table 1.

Nucleotide sequences of host target binding sites, such as BINDING SITE-I, BINDING SITE-II and BINDING SITE-III of FIG. 1, found on VGAM1856 host target RNA, and schematic representation of the complementarity of each of these host target binding sites to VGAM1856 RNA, herein designated VGAM RNA, are described hereinbelow with reference to Table 2.

As mentioned hereinabove with reference to FIG. 1, a function of VGAM1856 gene, herein designated VGAM is inhibition of expression of VGAM1856 target genes. It is appreciated that specific functions, and accordingly utilities, of VGAM1856 correlate with, and may be deduced from, the identity of the target genes which VGAM1856 binds and inhibits, and the function of these target genes, as elaborated hereinbelow.

UC28 (Accession NM_021635) is a VGAM1856 host target gene. UC28 BINDING SITE is HOST TARGET binding site found in the 3' untranslated region of mRNA encoded by UC28, corresponding to a HOST TARGET binding site such as BINDING SITE I, BINDING SITE II or BINDING SITE III. Table 2 illustrates the complementarity of the nucleotide sequences of UC28 BINDING SITE, designated SEQ ID:22279, to the nucleotide sequence of VGAM1856 RNA, herein designated VGAM RNA, also designated SEQ ID:4567.

A function of VGAM1856 is therefore inhibition of UC28 (Accession NM_021635). Accordingly, utilities of VGAM1856 include diagnosis, prevention and treatment of diseases and clinical conditions associated with UC28. KIAA1463 (Accession XM_051160) is another VGAM1856 host target gene. KIAA1463 BINDING SITE is HOST TARGET binding site found in the 3' untranslated region of mRNA encoded by KIAA1463, corresponding to a HOST TARGET binding site such as BINDING SITE I, BINDING SITE II or BINDING SITE III. Table 2 illustrates the complementarity of the nucleotide sequences of KIAA1463 BINDING SITE, designated SEQ ID:35770, to the nucleotide sequence of VGAM1856 RNA, herein designated VGAM RNA, also designated SEQ ID:4567.

Another function of VGAM1856 is therefore inhibition of KIAA1463 (Accession XM_051160). Accordingly, utilities of VGAM1856 include diagnosis, prevention and treatment of diseases and clinical conditions associated with KIAA1463. OBTP (Accession NM_017601) is another VGAM1856 host target gene. OBTP BINDING SITE is HOST TARGET binding site found in the 5' untranslated region of mRNA encoded by OBTP, corresponding to a HOST TARGET binding site such as BINDING SITE I, BINDING SITE II or BINDING SITE III. Table 2 illustrates the complementarity of the nucleotide sequences of OBTP BINDING SITE, designated SEQ ID:19077, to the nucleotide sequence of VGAM1856 RNA, herein designated VGAM RNA, also designated SEQ ID:4567.

Another function of VGAM1856 is therefore inhibition of OBTP (Accession NM_017601). Accordingly, utilities of VGAM1856 include diagnosis, prevention and treatment of diseases and clinical conditions associated with OBTP. Protocadherin 20 (PCDH20, Accession NM_022843) is another VGAM1856 host target gene. PCDH20 BINDING SITE is HOST TARGET binding site found in the 3' untranslated region of mRNA encoded by PCDH20, corresponding to a HOST TARGET binding site such as BINDING SITE I, BINDING SITE II or BINDING SITE III. Table 2 illustrates the complementarity of the nucleotide sequences of PCDH20 BINDING SITE, designated SEQ ID:23135, to the nucleotide sequence of VGAM1856 RNA, herein designated VGAM RNA, also designated SEQ ID:4567.

Another function of VGAM1856 is therefore inhibition of Protocadherin 20 (PCDH20, Accession NM_022843). Accordingly, utilities of VGAM1856 include diagnosis, prevention and treatment of diseases and clinical conditions associated with PCDH20. LOC153020 (Accession XM_087578) is another VGAM1856 host target gene. LOC153020 BINDING SITE is HOST TARGET binding site found in the 3' untranslated region of mRNA encoded by LOC153020, corresponding to a HOST TARGET binding site such as BINDING SITE I, BINDING SITE II or BINDING SITE III. Table 2 illustrates the complementarity of the nucleotide sequences of LOC153020 BINDING SITE, designated SEQ ID:39353, to the nucleotide sequence of VGAM1856 RNA, herein designated VGAM RNA, also designated SEQ ID:4567.

Another function of VGAM1856 is therefore inhibition of LOC153020 (Accession XM_087578). Accordingly, utilities of VGAM1856 include diagnosis, prevention and treatment of diseases and clinical conditions associated with LOC153020. FIG. 1 further provides a conceptual description of a novel bioinformatically detected viral gene of the present invention, referred to here as Viral Genomic Address Messenger 1857 (VGAM1857) viral gene, which modulates expression of respective host target genes thereof, the function and utility of which host target genes is known in the art.

VGAM1857 is a novel bioinformatically detected regulatory, non protein coding, viral micro RNA (miRNA) gene. The method by which VGAM1857 was detected is described hereinabove with reference to FIGS. 1-8.

VGAM1857 gene, herein designated VGAM GENE, is a viral gene contained in the genome of Rice Yellow Stunt Virus. VGAM1857 host target gene, herein designated VGAM HOST TARGET GENE, is a human gene contained in the human genome.

VGAM1857 gene encodes a VGAM1857 precursor RNA, herein designated VGAM PRECURSOR RNA. Similar to other miRNA genes, and unlike most ordinary genes, VGAM1857 precursor RNA does not encode a protein. A nucleotide sequence identical or highly similar to the nucleotide sequence of VGAM1857 precursor RNA is designated SEQ ID:1843, and is provided hereinbelow with reference to the sequence listing part. Nucleotide sequence SEQ ID:1843 is located at position 9634 relative to the genome of Rice Yellow Stunt Virus.

VGAM1857 precursor RNA folds onto itself, forming VGAM1857 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1857 folded precursor RNA into VGAM1857 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1857 RNA is designated SEQ ID:4568, and is provided hereinbelow with reference to the sequence listing part.

VGAM1857 host target gene, herein designated VGAM HOST TARGET GENE, encodes a corresponding messenger RNA, VGAM1857 host target RNA, herein designated VGAM HOST TARGET RNA. VGAM1857 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1857 RNA, herein designated VGAM RNA, binds complementarily to one or more host target binding sites located in untranslated regions of VGAM1857 host target RNA, herein designated VGAM HOST TARGET RNA. This complementary binding is due to the fact that the nucleotide sequence of VGAM1857 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1857 RNA, herein designated VGAM RNA, may have a different number of host target binding sites in untranslated regions of a VGAM1857 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1857 RNA, herein designated VGAM RNA, to host target binding sites on VGAM1857 host target RNA, herein designated VGAM HOST TARGET RNA, such as BINDING SITE I, BINDING SITE II and BINDING SITE III, inhibits translation of VGAM1857 host target RNA into VGAM1857 host target protein, herein designated VGAM HOST TARGET PROTEIN. VGAM host target protein is therefore outlined by a broken line.

It is appreciated that VGAM1857 host target gene, herein designated VGAM HOST TARGET GENE, in fact represents a plurality of VGAM1857 host target genes. The mRNA of each one of this plurality of VGAM1857 host target genes comprises one or more host target binding sites, each having a nucleotide sequence which is at least partly complementary to VGAM1857 RNA, herein designated VGAM RNA, and which when bound by VGAM1857 RNA causes inhibition of translation of respective one or more VGAM1857 host target proteins.

It is further appreciated by one skilled in the art that the mode of translational inhibition illustrated by FIG. 1 with specific reference to translational inhibition exerted by VGAM1857 gene, herein designated VGAM GENE, on one or more VGAM1857 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1857 is inhibition of expression of host target genes, as part of a novel viral mechanism of attacking a host. Accordingly, utilities of VGAM1857 include diagnosis, prevention and treatment of viral infection by Rice Yellow Stunt Virus. Specific functions, and accordingly utilities, of VGAM1857 correlate with, and may be deduced from, the identity of the host target genes which VGAM1857 binds and inhibits, and the function of these host target genes, as elaborated hereinbelow.

Nucleotide sequences of the VGAM1857 precursor RNA, herein designated VGAM PRECURSOR RNA, and of the 'diced' VGAM1857 RNA, herein designated VGAM RNA, and a schematic representation of the secondary folding of VGAM1857 folded precursor RNA, herein designated VGAM FOLDED PRECURSOR RNA, of VGAM1857 are further described hereinbelow with reference to Table 1.

Nucleotide sequences of host target binding sites, such as BINDING SITE-I, BINDING SITE-II and BINDING SITE-III of FIG. 1, found on VGAM1857 host target RNA, and schematic representation of the complementarity of each of these host target binding sites to VGAM1857 RNA, herein designated VGAM RNA, are described hereinbelow with reference to Table 2.

As mentioned hereinabove with reference to FIG. 1, a function of VGAM1857 gene, herein designated VGAM is inhibition of expression of VGAM1857 target genes. It is appreciated that specific functions, and accordingly utilities, of VGAM1857 correlate with, and may be deduced from, the identity of the target genes which VGAM1857 binds and inhibits, and the function of these target genes, as elaborated hereinbelow.

Alcohol Dehydrogenase IB (class I), Beta Polypeptide (ADH1B, Accession XM_052365) is a VGAM1857 host target gene. ADH1B BINDING SITE is HOST TARGET binding site found in the 3' untranslated region of mRNA encoded by ADH1B, corresponding to a HOST TARGET binding site such as BINDING SITE I, BINDING SITE II or BINDING SITE III. Table 2 illustrates the complementarity of the nucleotide sequences of ADH1B BINDING SITE, designated SEQ ID:35961, to the nucleotide sequence of VGAM1857 RNA, herein designated VGAM RNA, also designated SEQ ID:4568.

A function of VGAM1857 is therefore inhibition of Alcohol Dehydrogenase IB (class I), Beta Polypeptide (ADH1B, Accession XM_052365), a gene which Alcohol dehydrogenase 2 (alcohol:NAD+ oxidoreductase) class I beta subunit. Accordingly, utilities of VGAM1857 include diagnosis, prevention and treatment of diseases and clinical conditions associated with ADH1B. The function of ADH1B and its association with various diseases and clinical conditions, has been established by previous studies, as described hereinabove with reference to VGAM1805. Secretory Carrier Membrane Protein 1 (SCAMP1, Accession NM_004866) is another VGAM1857 host target gene. SCAMP1 BINDING SITE is HOST TARGET binding site found in the 3' untranslated region of mRNA encoded by SCAMP1, corresponding to a HOST TARGET binding site such as BINDING SITE I, BINDING SITE II or BINDING SITE III. Table 2 illustrates the complementarity of the nucleotide sequences of SCAMP1 BINDING SITE, designated SEQ ID:11290, to the nucleotide sequence of VGAM1857 RNA, herein designated VGAM RNA, also designated SEQ ID:4568.

Another function of VGAM1857 is therefore inhibition of Secretory Carrier Membrane Protein 1 (SCAMP1, Accession NM_004866), a gene which functions in post-golgi recycling pathways and acts as a recycling carrier to the cell surface. Accordingly, utilities of VGAM1857 include diagnosis, prevention and treatment of diseases and clinical conditions associated with SCAMP1. The function of SCAMP1 and its association with various diseases and clinical conditions, has been established by previous studies, as described hereinabove with reference to VGAM366. Solute Carrier Family 10 (sodium/bile acid cotransporter family), Member 2 (SLC10A2, Accession NM_000452) is another VGAM1857 host target gene. SLC10A2 BINDING SITE is HOST TARGET binding site found in the 3' untranslated region of mRNA encoded by SLC10A2, corresponding to a HOST TARGET binding site such as BINDING SITE I, BINDING SITE II or BINDING SITE III. Table 2 illustrates the complementarity of the nucleotide sequences of SLC10A2 BINDING SITE, designated SEQ ID:6063, to the nucleotide sequence of VGAM1857 RNA, herein designated VGAM RNA, also designated SEQ ID:4568.

Another function of VGAM1857 is therefore inhibition of Solute Carrier Family 10 (sodium/bile acid cotransporter family), Member 2 (SLC10A2, Accession NM_000452). Accordingly, utilities of VGAM1857 include diagnosis, prevention and treatment of diseases and clinical conditions associated with SLC10A2. FLJ20457 (Accession NM_017832) is another VGAM1857 host target gene. FLJ20457 BINDING SITE is HOST TARGET binding site found in the 3' untranslated region of mRNA encoded by FLJ20457, corresponding to a HOST TARGET binding site such as BINDING SITE I, BINDING SITE II or BINDING SITE III. Table 2 illustrates the complementarity of the nucleotide sequences of FLJ20457 BINDING SITE, designated SEQ ID:19496, to the nucleotide sequence of VGAM1857 RNA, herein designated VGAM RNA, also designated SEQ ID:4568.

Another function of VGAM1857 is therefore inhibition of FLJ20457 (Accession NM_017832). Accordingly, utilities of VGAM1857 include diagnosis, prevention and treatment of diseases and clinical conditions associated with FLJ20457. KIAA1223 (Accession XM_048747) is another VGAM1857 host target gene. KIAA1223 BINDING SITE is HOST TARGET binding site found in the 3' untranslated region of mRNA encoded by KIAA1223, corresponding to a HOST TARGET binding site such as BINDING SITE I, BINDING SITE II or BINDING SITE III. Table 2 illustrates the complementarity of the nucleotide sequences of KIAA1223 BINDING SITE, designated SEQ ID:35247, to the nucleotide sequence of VGAM1857 RNA, herein designated VGAM RNA, also designated SEQ ID:4568.

Another function of VGAM1857 is therefore inhibition of KIAA1223 (Accession XM_048747). Accordingly, utilities of VGAM1857 include diagnosis, prevention and treatment of diseases and clinical conditions associated with KIAA1223. YME1-like 1 (S. cerevisiae) (YME1L1, Accession NM_139312) is another VGAM1857 host target gene. YME1L1 BINDING SITE1 and YME1L1 BINDING SITE2 are HOST TARGET binding sites found in untranslated regions of mRNA encoded by YME1L1, corresponding to HOST TARGET binding sites such as BINDING SITE I, BINDING SITE II or BINDING SITE III. Table 2 illustrates the complementarity of the nucleotide sequences of YME1L1 BINDING SITE1 and YME1L1 BINDING SITE2, designated SEQ ID:29294 and SEQ ID:15538 respectively, to the nucleotide sequence of VGAM1857 RNA, herein designated VGAM RNA, also designated SEQ ID:4568.

Another function of VGAM1857 is therefore inhibition of YME1-like 1 (S. cerevisiae) (YME1L1, Accession NM_139312). Accordingly, utilities of VGAM1857 include diagnosis, prevention and treatment of diseases and clinical conditions associated with YME1L1. LOC256925 (Accession XM_175065) is another VGAM1857 host target gene. LOC256925 BINDING SITE is HOST TARGET binding site found in the 5' untranslated region of mRNA encoded by LOC256925, corresponding to a HOST TARGET binding site such as BINDING SITE I, BINDING SITE II or BINDING SITE III. Table 2 illustrates the complementarity of the nucleotide sequences of LOC256925 BINDING SITE, designated SEQ ID:46611, to the nucleotide sequence of VGAM1857 RNA, herein designated VGAM RNA, also designated SEQ ID:4568.

Another function of VGAM1857 is therefore inhibition of LOC256925 (Accession XM_175065). Accordingly, utilities of VGAM1857 include diagnosis, prevention and treatment of diseases and clinical conditions associated with LOC256925. FIG. 1 further provides a conceptual description of a novel bioinformatically detected viral gene of the present invention, referred to here as Viral Genomic Address Messenger 1858 (VGAM1858) viral gene, which modulates expression of respective host target genes thereof, the function and utility of which host target genes is known in the art.

VGAM1858 is a novel bioinformatically detected regulatory, non protein coding, viral micro RNA (miRNA) gene. The method by which VGAM1858 was detected is described hereinabove with reference to FIGS. 1-8.

VGAM1858 gene, herein designated VGAM GENE, is a viral gene contained in the genome of Rice Yellow Stunt Virus. VGAM1858 host target gene, herein designated VGAM HOST TARGET GENE, is a human gene contained in the human genome.

VGAM1858 gene encodes a VGAM1858 precursor RNA, herein designated VGAM PRECURSOR RNA. Similar to other miRNA genes, and unlike most ordinary genes, VGAM1858 precursor RNA does not encode a protein. A nucleotide sequence identical or highly similar to the nucleotide sequence of VGAM1858 precursor RNA is designated SEQ ID:1844, and is provided hereinbelow with reference to the sequence listing part. Nucleotide sequence SEQ ID:1844 is located at position 4741 relative to the genome of Rice Yellow Stunt Virus.

VGAM1858 precursor RNA folds onto itself, forming VGAM1858 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1858 folded precursor RNA into VGAM1858 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1858 RNA is designated SEQ ID:4569, and is provided hereinbelow with reference to the sequence listing part.

VGAM1858 host target gene, herein designated VGAM HOST TARGET GENE, encodes a corresponding messenger RNA, VGAM1858 host target RNA, herein designated VGAM HOST TARGET RNA. VGAM1858 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1858 RNA, herein designated VGAM RNA, binds complementarily to one or more host target binding sites located in untranslated regions of VGAM1858 host target RNA, herein designated VGAM HOST TARGET RNA. This complementary binding is due to the fact that the nucleotide sequence of VGAM1858 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1858 RNA, herein designated VGAM RNA, may have a different number of host target binding sites in untranslated regions of a VGAM1858 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1858 RNA, herein designated VGAM RNA, to host target binding sites on VGAM1858 host target RNA, herein designated VGAM HOST TARGET RNA, such as BINDING SITE I, BINDING SITE II and BINDING SITE III, inhibits translation of VGAM1858 host target RNA into VGAM1858 host target protein, herein designated VGAM HOST TARGET PROTEIN. VGAM host target protein is therefore outlined by a broken line.

It is appreciated that VGAM1858 host target gene, herein designated VGAM HOST TARGET GENE, in fact represents a plurality of VGAM1858 host target genes. The mRNA of each one of this plurality of VGAM1858 host target genes comprises one or more host target binding sites, each having a nucleotide sequence which is at least partly complementary to VGAM1858 RNA, herein designated VGAM RNA, and which when bound by VGAM1858 RNA causes inhibition of translation of respective one or more VGAM1858 host target proteins.

It is further appreciated by one skilled in the art that the mode of translational inhibition illustrated by FIG. 1 with specific reference to translational inhibition exerted by VGAM1858 gene, herein designated VGAM GENE, on one or more VGAM1858 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1858 is inhibition of expression of host target genes, as part of a novel viral mechanism of attacking a host. Accordingly, utilities of VGAM1858 include diagnosis, prevention and treatment of viral infection by Rice Yellow Stunt Virus. Specific functions, and accordingly utilities, of VGAM1858 correlate with, and may be deduced from, the identity of the host target genes which VGAM1858 binds and inhibits, and the function of these host target genes, as elaborated hereinbelow.

Nucleotide sequences of the VGAM1858 precursor RNA, herein designated VGAM PRECURSOR RNA, and of the 'diced' VGAM1858 RNA, herein designated VGAM RNA, and a schematic representation of the secondary folding of VGAM1858 folded precursor RNA, herein designated VGAM FOLDED PRECURSOR RNA, of VGAM1858 are further described hereinbelow with reference to Table 1.

Nucleotide sequences of host target binding sites, such as BINDING SITE-I, BINDING SITE-II and BINDING SITE-III of FIG. 1, found on VGAM1858 host target RNA, and schematic representation of the complementarity of each of these host target binding sites to VGAM1858 RNA, herein designated VGAM RNA, are described hereinbelow with reference to Table 2.

As mentioned hereinabove with reference to FIG. 1, a function of VGAM1858 gene, herein designated VGAM is inhibition of expression of VGAM1858 target genes. It is appreciated that specific functions, and accordingly utilities, of VGAM1858 correlate with, and may be deduced from, the identity of the target genes which VGAM1858 binds and inhibits, and the function of these target genes, as elaborated hereinbelow.

Glucosaminyl (N-acetyl) Transferase 2, I-branching Enzyme (GCNT2, Accession NM_001491) is a VGAM1858 host target gene. GCNT2 BINDING SITE is HOST TARGET binding site found in the 5' untranslated region of mRNA encoded by GCNT2, corresponding to a HOST TARGET binding site such as BINDING SITE I, BINDING SITE II or BINDING SITE III. Table 2 illustrates the complementarity of the nucleotide sequences of GCNT2 BINDING SITE, designated SEQ ID:7239, to the nucleotide sequence of VGAM1858 RNA, herein designated VGAM RNA, also designated SEQ ID:4569.

A function of VGAM1858 is therefore inhibition of Glucosaminyl (N-acetyl) Transferase 2, I-branching Enzyme (GCNT2, Accession NM_001491), a gene which converts linear into branched poly-n-acetyllactosaminoglycans. Accordingly, utilities of VGAM1858 include diagnosis, prevention and treatment of diseases and clinical conditions associated with GCNT2. The function of GCNT2 and its association with various diseases and clinical conditions, has been established by previous studies, as described hereinabove with reference to VGAM943. Lactate Dehydrogenase B (LDHB, Accession NM_002300) is another VGAM1858 host target gene. LDHB BINDING SITE is HOST TARGET binding site found in the 5' untranslated region of mRNA encoded by LDHB, corresponding to a HOST TARGET binding site such as BINDING SITE I, BINDING SITE II or BINDING SITE III. Table 2 illustrates the complementarity of the nucleotide sequences of LDHB BINDING SITE, designated SEQ ID:8091, to the nucleotide sequence of VGAM1858 RNA, herein designated VGAM RNA, also designated SEQ ID:4569.

Another function of VGAM1858 is therefore inhibition of Lactate Dehydrogenase B (LDHB, Accession NM_002300), a gene which causes dehydrogenation of lactate. Accordingly, utilities of VGAM1858 include diagnosis, prevention and treatment of diseases and clinical conditions associated with LDHB. The function of LDHB and its association with various diseases and clinical conditions, has been established by previous studies, as described hereinabove with reference to VGAM273. Aminopeptidase Puromycin Sensitive (NPEPPS, Accession NM_006310) is another VGAM1858 host target gene. NPEPPS BINDING SITE is HOST TARGET binding site found in the 3' untranslated region of mRNA encoded by NPEPPS, corresponding to a HOST TARGET binding site such as BINDING SITE I, BINDING SITE II or BINDING SITE III. Table 2 illustrates the complementarity of the nucleotide sequences of NPEPPS BINDING SITE, designated SEQ ID:12998, to the nucleotide sequence of VGAM1858 RNA, herein designated VGAM RNA, also designated SEQ ID:4569.

Another function of VGAM1858 is therefore inhibition of Aminopeptidase Puromycin Sensitive (NPEPPS, Accession NM_006310), a gene which is puromycin-sensitive aminopeptidase and has metallopeptidase activity. Accordingly, utilities of VGAM1858 include diagnosis, prevention and treatment of diseases and clinical conditions associated with NPEPPS. The function of NPEPPS and its association with various diseases and clinical conditions, has been established by previous studies, as described hereinabove with reference to VGAM83. Protein Tyrosine Phosphatase, Receptor Type, K (PTPRK, Accession NM_002844) is another VGAM1858 host target gene. PTPRK BINDING SITE is HOST TARGET binding site found in the 3' untranslated region of mRNA encoded by PTPRK, corresponding to a HOST TARGET binding site such as BINDING SITE I, BINDING SITE II or BINDING SITE III. Table 2 illustrates the complementarity of the nucleotide sequences of PTPRK BINDING SITE, designated SEQ ID:8733, to the nucleotide sequence of VGAM1858 RNA, herein designated VGAM RNA, also designated SEQ ID:4569.

Another function of VGAM1858 is therefore inhibition of Protein Tyrosine Phosphatase, Receptor Type, K (PTPRK, Accession NM_002844), a gene which regulates of processes involving cell contact and adhesion. Accordingly, utilities of VGAM1858 include diagnosis, prevention and treatment of diseases and clinical conditions associated with PTPRK. The function of PTPRK has been established by previous studies. For general information about receptor-type protein-tyrosine phosphatases (PTPs), see PTPRA (OMIM Ref. No. 176884). Yang et al. (1997) used degenerate PCR to identify novel receptor PTPs in a human keratinocyte cDNA library. One of the genes identified was the human homolog of mouse PTPR-kappa. Human PTPR-kappa encodes a 1,440-amino acid polypeptide that is 98% identical to mouse PTPR-kappa. Northern blotting revealed that PTPR-kappa is expressed as a 7.0-kb transcript in a variety of tissues. Fuchs et al. (1996) also used degenerate PCR to clone human PTPR-kappa. Northern blotting revealed expression of PTPR-kappa in mammary carcinoma cell lines as well as in various tissues. Fuchs et al. (1996) noted that PTPR-kappa has several structural features, such as a MAM domain, an Ig-like domain, and fibronectin repeats, suggesting that it could be involved in cell adhesion. They showed that PTPR-kappa forms a complex with beta-catenin (OMIM Ref. No. 116806) and gamma-catenin/plakoglobin (OMIM Ref. No. 173325). They also showed that PTPR-kappa expression is dependent on cell density and that it colocalizes with catenins at adherens junctions. These findings suggest that PTPR-kappa may have a role in the regulation of processes involving cell contact and adhesion.

Full details of the abovementioned studies are described in the following publications, the disclosure of which are hereby incorporated by reference:

Fuchs, M.; Muller, T.; Lerch, M. M.; Ullrich, A.: Association of human protein-tyrosine phosphatase kappa with members of the armadillo family. J. Biol. Chem. 271:16712-16719, 1996; and Yang, Y.; Gil, M. C.; Choi, E. Y.; Park, S. H.; Pyun, K. H.; Ha, H.: Molecular cloning and chromosomal localization of a human gene homologous to the murine R-PTP-kappa, a receptor-type.

Further studies establishing the function and utilities of PTPRK are found in John Hopkins OMIM database record ID 602545, and in sited publications numbered 5873-5875 listed in the bibliography section hereinbelow, which are also hereby incorporated by reference. Protein Tyrosine Phosphatase, Receptor Type, O (PTPRO, Accession NM_002848) is another VGAM1858 host target gene. PTPRO BINDING SITE1 through PTPRO BINDING SITE5 are HOST TARGET binding sites found in untranslated regions of mRNA encoded by PTPRO, corresponding to HOST TARGET binding sites such as BINDING SITE I, BINDING SITE II or BINDING SITE III. Table 2 illustrates the complementarity of the nucleotide sequences of PTPRO BINDING SITE1 through PTPRO BINDING SITE5, designated SEQ ID:8739, SEQ ID:25004, SEQ ID:25012, SEQ ID:25021 and SEQ ID:25031 respectively, to the nucleotide sequence of VGAM1858 RNA, herein designated VGAM RNA, also designated SEQ ID:4569.

Another function of VGAM1858 is therefore inhibition of Protein Tyrosine Phosphatase, Receptor Type, O (PTPRO, Accession NM_002848), a gene which may function as a cell contact receptor that mediates and controls cell-cell signals. Accordingly, utilities of VGAM1858 include diagnosis, prevention and treatment of diseases and clinical conditions associated with PTPRO. The function of PTPRO and its association with various diseases and clinical conditions, has been established by previous studies, as described hereinabove with reference to VGAM140. Vasoactive Intestinal Peptide Receptor 1 (VIPR1, Accession NM_004624) is another VGAM1858 host target gene. VIPR1 BINDING SITE is HOST TARGET binding site found in the 3' untranslated region of mRNA encoded by VIPR1, corresponding to a HOST TARGET binding site such as BINDING SITE I, BINDING SITE II or BINDING SITE III. Table 2 illustrates the complementarity of the nucleotide sequences of VIPR1 BINDING SITE, designated SEQ ID:10991, to the nucleotide sequence of VGAM1858 RNA, herein designated VGAM RNA, also designated SEQ ID:4569.

Another function of VGAM1858 is therefore inhibition of Vasoactive Intestinal Peptide Receptor 1 (VIPR1, Accession NM_004624), a gene which binds vip and is mediated by g proteins which activate adenylyl cyclase. Accordingly, utilities of VGAM1858 include diagnosis, prevention and treatment of diseases and clinical conditions associated with VIPR1. The function of VIPR1 and its association with various diseases and clinical conditions, has been established by previous studies, as described hereinabove with reference to VGAM548. Chromosome 22 Open Reading Frame 19 (C22orf19, Accession NM_003678) is another VGAM1858 host target gene. C22orf19 BINDING SITE is HOST TARGET binding site found in the 3' untranslated region of mRNA encoded by C22orf19, corresponding to a HOST TARGET binding site such as BINDING SITE I, BINDING SITE II or BINDING SITE III. Table 2 illustrates the complementarity of the nucleotide sequences of C22orf19 BINDING SITE, designated SEQ ID:9774, to the nucleotide sequence of VGAM1858 RNA, herein designated VGAM RNA, also designated SEQ ID:4569.

Another function of VGAM1858 is therefore inhibition of Chromosome 22 Open Reading Frame 19 (C22orf19, Accession NM_003678). Accordingly, utilities of VGAM1858 include diagnosis, prevention and treatment of diseases and clinical conditions associated with C22orf19. DKFZp547D155 (Accession XM_046977) is another VGAM1858 host target gene. DKFZp547D155 BINDING SITE is HOST TARGET binding site found in the 3' untranslated region of mRNA encoded by DKFZp547D155, corresponding to a HOST TARGET binding site such as BINDING SITE I, BINDING SITE II or BINDING SITE III. Table 2 illustrates the complementarity of the nucleotide sequences of DKFZp547D155 BINDING SITE, designated SEQ ID:34869, to the nucleotide sequence of VGAM1858 RNA, herein designated VGAM RNA, also designated SEQ ID:4569.

Another function of VGAM1858 is therefore inhibition of DKFZp547D155 (Accession XM_046977). Accordingly, utilities of VGAM1858 include diagnosis, prevention and treatment of diseases and clinical conditions associated with DKFZp547D155. E74-like Factor 2 (ets domain transcription factor) (ELF2, Accession NM_006874) is another VGAM1858 host target gene. ELF2 BINDING SITE is HOST TARGET binding site found in the 3' untranslated region of mRNA encoded by ELF2, corresponding to a HOST TARGET binding site such as BINDING SITE I, BINDING SITE II or BINDING SITE III. Table 2 illustrates the complementarity of the nucleotide sequences of ELF2 BINDING SITE, designated SEQ ID:13744, to the nucleotide sequence of VGAM1858 RNA, herein designated VGAM RNA, also designated SEQ ID:4569.

Another function of VGAM1858 is therefore inhibition of E74-like Factor 2 (ets domain transcription factor) (ELF2, Accession NM_006874). Accordingly, utilities of VGAM1858 include diagnosis, prevention and treatment of diseases and clinical conditions associated with ELF2. FLJ10648 (Accession NM_018167) is another VGAM1858 host target gene. FLJ10648 BINDING SITE is HOST TARGET binding site found in the 3' untranslated region of mRNA encoded by FLJ10648, corresponding to a HOST TARGET binding site such as BINDING SITE I, BINDING SITE II or BINDING SITE III. Table 2 illustrates the complementarity of the nucleotide sequences of FLJ10648 BINDING SITE, designated SEQ ID:19985, to the nucleotide sequence of VGAM1858 RNA, herein designated VGAM RNA, also designated SEQ ID:4569.

Another function of VGAM1858 is therefore inhibition of FLJ10648 (Accession NM_018167). Accordingly, utilities of VGAM1858 include diagnosis, prevention and treatment of diseases and clinical conditions associated with FLJ10648. FLJ20432 (Accession NM_017819) is another VGAM1858 host target gene. FLJ20432 BINDING SITE is HOST TARGET binding site found in the 5' untranslated region of mRNA encoded by FLJ20432, corresponding to a HOST TARGET binding site such as BINDING SITE I, BINDING SITE II or BINDING SITE III. Table 2 illustrates the complementarity of the nucleotide sequences of FLJ20432 BINDING SITE, designated SEQ ID:19466, to the nucleotide sequence of VGAM1858 RNA, herein designated VGAM RNA, also designated SEQ ID:4569.

Another function of VGAM1858 is therefore inhibition of FLJ20432 (Accession NM_017819). Accordingly, utilities of VGAM1858 include diagnosis, prevention and treatment of diseases and clinical conditions associated with FLJ20432. Golgi Autoantigen, Golgin Subfamily A, 1 (GOLGA1, Accession NM_002077) is another VGAM1858 host target gene. GOLGA1 BINDING SITE is HOST TARGET binding site found in the 5' untranslated region of mRNA encoded by GOLGA1, corresponding to a HOST TARGET binding site such as BINDING SITE I, BINDING SITE II or BINDING SITE III. Table 2 illustrates the complementarity of the nucleotide sequences of GOLGA1 BINDING SITE, designated SEQ ID:7862, to the nucleotide sequence of VGAM1858 RNA, herein designated VGAM RNA, also designated SEQ ID:4569.

Another function of VGAM1858 is therefore inhibition of Golgi Autoantigen, Golgin Subfamily A, 1 (GOLGA1, Accession NM_002077). Accordingly, utilities of VGAM1858 include diagnosis, prevention and treatment of diseases and clinical conditions associated with GOLGA1. KIAA0193 (Accession NM_014766) is another VGAM1858 host target gene. KIAA0193 BINDING SITE is HOST TARGET binding site found in the 3' untranslated region of mRNA encoded by KIAA0193, corresponding to a HOST TARGET binding site such as BINDING SITE I, BINDING SITE II or BINDING SITE III. Table 2 illustrates the complementarity of the nucleotide sequences of KIAA0193 BINDING SITE, designated SEQ ID:16543, to the nucleotide sequence of VGAM1858 RNA, herein designated VGAM RNA, also designated SEQ ID:4569.

Another function of VGAM1858 is therefore inhibition of KIAA0193 (Accession NM_014766). Accordingly, utilities of VGAM1858 include diagnosis, prevention and treatment of diseases and clinical conditions associated with KIAA0193. KIAA0746 (Accession XM_045277) is another VGAM1858 host target gene. KIAA0746 BINDING SITE is HOST TARGET binding site found in the 3' untranslated region of mRNA encoded by KIAA0746, corresponding to a HOST TARGET binding site such as BINDING SITE I, BINDING SITE II or BINDING SITE III. Table 2 illustrates the complementarity of the nucleotide sequences of KIAA0746 BINDING SITE, designated SEQ ID:34414, to the nucleotide sequence of VGAM1858 RNA, herein designated VGAM RNA, also designated SEQ ID:4569.

Another function of VGAM1858 is therefore inhibition of KIAA0746 (Accession XM_045277). Accordingly, utilities of VGAM1858 include diagnosis, prevention and treatment of diseases and clinical conditions associated with KIAA0746. KIAA1041 (Accession NM_014947) is another VGAM1858 host target gene. KIAA1041 BINDING SITE is HOST TARGET binding site found in the 3' untranslated region of mRNA encoded by KIAA1041, corresponding to a HOST TARGET binding site such as BINDING SITE I, BINDING SITE II or BINDING SITE III. Table 2 illustrates the complementarity of the nucleotide sequences of KIAA1041 BINDING SITE, designated SEQ ID:17264, to the nucleotide sequence of VGAM1858 RNA, herein designated VGAM RNA, also designated SEQ ID:4569.

Another function of VGAM1858 is therefore inhibition of KIAA1041 (Accession NM_014947). Accordingly, utilities of VGAM1858 include diagnosis, prevention and treatment of diseases and clinical conditions associated with KIAA1041. KIAA1219 (Accession XM_028835) is another VGAM1858 host target gene. KIAA1219 BINDING SITE is HOST TARGET binding site found in the 3' untranslated region of mRNA encoded by KIAA1219, corresponding to a HOST TARGET binding site such as BINDING SITE I, BINDING SITE II or BINDING SITE III. Table 2 illustrates the complementarity of the nucleotide sequences of KIAA1219 BINDING SITE, designated SEQ ID:30758, to the nucleotide sequence of VGAM1858 RNA, herein designated VGAM RNA, also designated SEQ ID:4569.

Another function of VGAM1858 is therefore inhibition of KIAA1219 (Accession XM_028835). Accordingly, utilities of VGAM1858 include diagnosis, prevention and treatment of diseases and clinical conditions associated with KIAA1219. Leucine Rich Repeat (in FLII) Interacting Protein 1 (LRRFIP1, Accession NM_004735) is another VGAM1858 host target gene. LRRFIP1 BINDING SITE is HOST TARGET binding site found in the 3' untranslated region of mRNA encoded by LRRFIP1, corresponding to a HOST TARGET binding site such as BINDING SITE I, BINDING SITE II or BINDING SITE III. Table 2 illustrates the complementarity of the nucleotide sequences of LRRFIP1 BINDING SITE, designated SEQ ID:11120, to the nucleotide sequence of VGAM1858 RNA, herein designated VGAM RNA, also designated SEQ ID:4569.

Another function of VGAM1858 is therefore inhibition of Leucine Rich Repeat (in FLII) Interacting Protein 1 (LRRFIP1, Accession NM_004735). Accordingly, utilities of VGAM1858 include diagnosis, prevention and treatment of diseases and clinical conditions associated with LRRFIP1. NIR3 (Accession XM_038799) is another VGAM1858 host target gene. NIR3 BINDING SITE is HOST TARGET binding site found in the 3' untranslated region of mRNA encoded by NIR3, corresponding to a HOST TARGET binding site such as BINDING SITE I, BINDING SITE II or BINDING SITE III. Table 2 illustrates the complementarity of the nucleotide sequences of NIR3 BINDING SITE, designated SEQ ID:32929, to the nucleotide sequence of VGAM1858 RNA, herein designated VGAM RNA, also designated SEQ ID:4569.

Another function of VGAM1858 is therefore inhibition of NIR3 (Accession XM_038799). Accordingly, utilities of VGAM1858 include diagnosis, prevention and treatment of diseases and clinical conditions associated with NIR3. p21 (CDKN1A)-activated Kinase 6 (PAK6, Accession NM_020168) is another VGAM1858 host target gene. PAK6 BINDING SITE is HOST TARGET binding site found in the 3' untranslated region of mRNA encoded by PAK6, corresponding to a HOST TARGET binding site such as BINDING SITE I, BINDING SITE II or BINDING SITE III. Table 2 illustrates the complementarity of the nucleotide sequences of PAK6 BINDING SITE, designated SEQ ID:21392, to the nucleotide sequence of VGAM1858 RNA, herein designated VGAM RNA, also designated SEQ ID:4569.

Another function of VGAM1858 is therefore inhibition of p21(CDKN1A)-activated Kinase 6 (PAK6, Accession NM_020168). Accordingly, utilities of VGAM1858 include diagnosis, prevention and treatment of diseases and clinical conditions associated with PAK6. Syntaphilin (SNPH, Accession NM_014723) is another VGAM1858 host target gene. SNPH BINDING SITE is HOST TARGET binding site found in the 3' untranslated region of mRNA encoded by SNPH, corresponding to a HOST TARGET binding site such as BINDING SITE I, BINDING SITE II or BINDING SITE III. Table 2 illustrates the complementarity of the nucleotide sequences of SNPH BINDING SITE, designated SEQ ID:16296, to the nucleotide sequence of VGAM1858 RNA, herein designated VGAM RNA, also designated SEQ ID:4569.

Another function of VGAM1858 is therefore inhibition of Syntaphilin (SNPH, Accession NM_014723). Accordingly, utilities of VGAM1858 include diagnosis, prevention and treatment of diseases and clinical conditions associated with SNPH. TP53TG3 (Accession NM_015369) is another VGAM1858 host target gene. TP53TG3 BINDING SITE is HOST TARGET binding site found in the 3' untranslated region of mRNA encoded by TP53TG3, corresponding to a HOST TARGET binding site such as BINDING SITE I, BINDING SITE II or BINDING SITE III. Table 2 illustrates the complementarity of the nucleotide sequences of TP53TG3 BINDING SITE, designated SEQ ID:17671, to the nucleotide sequence of VGAM1858 RNA, herein designated VGAM RNA, also designated SEQ ID:4569.

Another function of VGAM1858 is therefore inhibition of TP53TG3 (Accession NM_015369). Accordingly, utilities of VGAM1858 include diagnosis, prevention and treatment of diseases and clinical conditions associated with TP53TG3. Ubiquitin Specific Protease 24 (USP24, Accession XM_165973) is another VGAM1858 host target gene. USP24 BINDING SITE is HOST TARGET binding site found in the 3' untranslated region of mRNA encoded by USP24, corresponding to a HOST TARGET binding site such as BINDING SITE I, BINDING SITE II or BINDING SITE III. Table 2 illustrates the complementarity of the nucleotide sequences of USP24 BINDING SITE, designated SEQ ID:43818, to the nucleotide sequence of VGAM1858 RNA, herein designated VGAM RNA, also designated SEQ ID:4569.

Another function of VGAM1858 is therefore inhibition of Ubiquitin Specific Protease 24 (USP24, Accession XM_165973). Accordingly, utilities of VGAM1858 include diagnosis, prevention and treatment of diseases and clinical conditions associated with USP24. LOC151571 (Accession XM_098088) is another VGAM1858 host target gene. LOC151571 BINDING SITE is HOST TARGET binding site found in the 5' untranslated region of mRNA encoded by LOC151571, corresponding to a HOST TARGET binding site such as BINDING SITE I, BINDING SITE II or BINDING SITE III. Table 2 illustrates the complementarity of the nucleotide sequences of LOC151571 BINDING SITE, designated SEQ ID:41372, to the nucleotide sequence of VGAM1858 RNA, herein designated VGAM RNA, also designated SEQ ID:4569.

Another function of VGAM1858 is therefore inhibition of LOC151571 (Accession XM_098088). Accordingly, utilities of VGAM1858 include diagnosis, prevention and treatment of diseases and clinical conditions associated with LOC151571. LOC196337 (Accession XM_113696) is another VGAM1858 host target gene. LOC196337 BINDING SITE is HOST TARGET binding site found in the 5' untranslated region of mRNA encoded by LOC196337, corresponding to a HOST TARGET binding site such as BINDING SITE I, BINDING SITE II or BINDING SITE III. Table 2 illustrates the complementarity of the nucleotide sequences of LOC196337 BINDING SITE, designated SEQ ID:42359, to the nucleotide sequence of VGAM1858 RNA, herein designated VGAM RNA, also designated SEQ ID:4569.

Another function of VGAM1858 is therefore inhibition of LOC196337 (Accession XM_113696). Accordingly, utilities of VGAM1858 include diagnosis, prevention and treatment of diseases and clinical conditions associated with LOC196337. LOC221341 (Accession XM_167239) is another VGAM1858 host target gene. LOC221341 BINDING SITE is HOST TARGET binding site found in the 5' untranslated region of mRNA encoded by LOC221341, corresponding to a HOST TARGET binding site such as BINDING SITE I, BINDING SITE II or BINDING SITE III. Table 2 illustrates the complementarity of the nucleotide sequences of LOC221341 BINDING SITE, designated SEQ ID:44619, to the nucleotide sequence of VGAM1858 RNA, herein designated VGAM RNA, also designated SEQ ID:4569.

Another function of VGAM1858 is therefore inhibition of LOC221341 (Accession XM_167239). Accordingly, utilities of VGAM1858 include diagnosis, prevention and treatment of diseases and clinical conditions associated with LOC221341. LOC54505 (Accession XM_042110) is another VGAM1858 host target gene. LOC54505 BINDING SITE is HOST TARGET binding site found in the 5' untranslated region of mRNA encoded by LOC54505, corresponding to a HOST TARGET binding site such as BINDING SITE I, BINDING SITE II or BINDING SITE III. Table 2 illustrates the complementarity of the nucleotide sequences of LOC54505 BINDING SITE, designated SEQ ID:33695, to the nucleotide sequence of VGAM1858 RNA, herein designated VGAM RNA, also designated SEQ ID:4569.

Another function of VGAM1858 is therefore inhibition of LOC54505 (Accession XM_042110). Accordingly, utilities of VGAM1858 include diagnosis, prevention and treatment of diseases and clinical conditions associated with LOC54505. LOC54516 (Accession NM_019041) is another VGAM1858 host target gene. LOC54516 BINDING SITE is HOST TARGET binding site found in the 3' untranslated region of mRNA encoded by LOC54516, corresponding to a HOST TARGET binding site such as BINDING SITE I, BINDING SITE II or BINDING SITE III. Table 2 illustrates the complementarity of the nucleotide sequences of LOC54516 BINDING SITE, designated SEQ ID:21123, to the nucleotide sequence of VGAM1858 RNA, herein designated VGAM RNA, also designated SEQ ID:4569.

Another function of VGAM1858 is therefore inhibition of LOC54516 (Accession NM_019041). Accordingly, utilities of VGAM1858 include diagnosis, prevention and treatment of diseases and clinical conditions associated with LOC54516. LOC90917 (Accession XM_034861) is another VGAM1858 host target gene. LOC90917 BINDING SITE is HOST TARGET binding site found in the 3' untranslated region of mRNA encoded by LOC90917, corresponding to a HOST TARGET binding site such as BINDING SITE I, BINDING SITE II or BINDING SITE III. Table 2 illustrates the complementarity of the nucleotide sequences of LOC90917 BINDING SITE, designated SEQ ID:32170, to the nucleotide sequence of VGAM1858 RNA, herein designated VGAM RNA, also designated SEQ ID:4569.

Another function of VGAM1858 is therefore inhibition of LOC90917 (Accession XM_034861). Accordingly, utilities of VGAM1858 include diagnosis, prevention and treatment of diseases and clinical conditions associated with LOC90917. FIG. 1 further provides a conceptual description of a novel bioinformatically detected viral gene of the present invention, referred to here as Viral Genomic Address Messenger 1859 (VGAM1859) viral gene, which modulates expression of respective host target genes thereof, the function and utility of which host target genes is known in the art.

VGAM1859 is a novel bioinformatically detected regulatory, non protein coding, viral micro RNA (miRNA) gene. The method by which VGAM1859 was detected is described hereinabove with reference to FIGS. 1-8.

VGAM1859 gene, herein designated VGAM GENE, is a viral gene contained in the genome of Rice Yellow Stunt Virus. VGAM1859 host target gene, herein designated VGAM HOST TARGET GENE, is a human gene contained in the human genome.

VGAM1859 gene encodes a VGAM1859 precursor RNA, herein designated VGAM PRECURSOR RNA. Similar to other miRNA genes, and unlike most ordinary genes, VGAM1859 precursor RNA does not encode a protein. A nucleotide sequence identical or highly similar to the nucleotide sequence of VGAM1859 precursor RNA is designated SEQ ID:1845, and is provided hereinbelow with reference to the sequence listing part. Nucleotide sequence SEQ ID:1845 is located at position 3094 relative to the genome of Rice Yellow Stunt Virus.

VGAM1859 precursor RNA folds onto itself, forming VGAM1859 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1859 folded precursor RNA into VGAM1859 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM1859 RNA is designated SEQ ID:4570, and is provided hereinbelow with reference to the sequence listing part.

VGAM1859 host target gene, herein designated VGAM HOST TARGET GENE, encodes a corresponding messenger RNA, VGAM1859 host target RNA, herein designated VGAM HOST TARGET RNA. VGAM1859 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1859 RNA, herein designated VGAM RNA, binds complementarily to one or more host target binding sites located in untranslated regions of VGAM1859 host target RNA, herein designated VGAM HOST TARGET RNA. This complementary binding is due to the fact that the nucleotide sequence of VGAM1859 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1859 RNA, herein designated VGAM RNA, may have a different number of host target binding sites in untranslated regions of a VGAM1859 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1859 RNA, herein designated VGAM RNA, to host target binding sites on VGAM1859 host target RNA, herein designated VGAM HOST TARGET RNA, such as BINDING SITE I, BINDING SITE II and BINDING SITE III, inhibits translation of VGAM1859 host target RNA into VGAM1859 host target protein, herein designated VGAM HOST TARGET PROTEIN. VGAM host target protein is therefore outlined by a broken line.

It is appreciated that VGAM1859 host target gene, herein designated VGAM HOST TARGET GENE, in fact represents a plurality of VGAM1859 host target genes. The mRNA of each one of this plurality of VGAM1859 host target genes comprises one or more host target binding sites, each having a nucleotide sequence which is at least partly complementary to VGAM1859 RNA, herein designated VGAM RNA, and which when bound by VGAM1859 RNA causes inhibition of translation of respective one or more VGAM1859 host target proteins.

It is further appreciated by one skilled in the art that the mode of translational inhibition illustrated by FIG. 1 with specific reference to translational inhibition exerted by VGAM1859 gene, herein designated VGAM GENE, on one or more VGAM1859 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1859 is inhibition of expression of host target genes, as part of a novel viral mechanism of attacking a host. Accordingly, utilities of VGAM1859 include diagnosis, prevention and treatment of viral infection by Rice Yellow Stunt Virus. Specific functions, and accordingly utilities, of VGAM1859 correlate with, and may be deduced from, the identity of the host target genes which VGAM1859 binds and inhibits, and the function of these host target genes, as elaborated hereinbelow.

Nucleotide sequences of the VGAM1859 precursor RNA, herein designated VGAM PRECURSOR RNA, and of the 'diced' VGAM1859 RNA, herein designated VGAM RNA, and a schematic representation of the secondary folding of VGAM1859 folded precursor RNA, herein designated VGAM FOLDED PRECURSOR RNA, of VGAM1859 are further described hereinbelow with reference to Table 1.

Nucleotide sequences of host target binding sites, such as BINDING SITE-I, BINDING SITE-II and BINDING SITE-III of FIG. 1, found on VGAM1859 host target RNA, and schematic representation of the complementarity of each of these host target binding sites to VGAM1859 RNA, herein designated VGAM RNA, are described hereinbelow with reference to Table 2.

As mentioned hereinabove with reference to FIG. 1, a function of VGAM1859 gene, herein designated VGAM is inhibition of expression of VGAM1859 target genes. It is appreciated that specific functions, and accordingly utilities, of VGAM1859 correlate with, and may be deduced from, the identity of the target genes which VGAM1859 binds and inhibits, and the function of these target genes, as elaborated hereinbelow.

Histone Deacetylase 4 (HDAC4, Accession NM_006037) is a VGAM1859 host target gene. HDAC4 BINDING SITE is HOST TARGET binding site found in the 3' untranslated region of mRNA encoded by HDAC4, corresponding to a HOST TARGET binding site such as BINDING SITE I, BINDING SITE II or BINDING SITE III. Table 2 illustrates the complementarity of the nucleotide sequences of HDAC4 BINDING SITE, designated SEQ ID:12669, to the nucleotide sequence of VGAM1859 RNA, herein designated VGAM RNA, also designated SEQ ID:4570.

A function of VGAM1859 is therefore inhibition of Histone Deacetylase 4 (HDAC4, Accession NM_006037), a gene which is responsible for the deacetylation of lysine residues on the n-terminal part of the core histones and may mediate transcriptional regulation. Accordingly, utilities of VGAM1859 include diagnosis, prevention and treatment of diseases and clinical conditions associated with HDAC4. The function of HDAC4 and its association with various diseases and clinical conditions, has been established by previous studies, as described hereinabove with reference to VGAM264. High Mobility Group AT-hook 2 (HMGA2, Accession NM_003483) is another VGAM1859 host target gene. HMGA2 BINDING SITE is HOST TARGET binding site found in the 3' untranslated region of mRNA encoded by HMGA2, corresponding to a HOST TARGET binding site such as BINDING SITE I, BINDING SITE II or BINDING SITE III. Table 2 illustrates the complementarity of the nucleotide sequences of HMGA2 BINDING SITE, designated SEQ ID:9570, to the nucleotide sequence of VGAM1859 RNA, herein designated VGAM RNA, also designated SEQ ID:4570.

Another function of VGAM1859 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM1859 include diagnosis, prevention and treatment of diseases and clinical conditions associated with HMGA2. The function of HMGA2 and its association with various diseases and clinical conditions, has been established by previous studies, as described hereinabove with reference to VGAM552. Phosphodiesterase 4D, CAMP-specific (phosphodiesterase E3 dunce homolog, Drosophila) (PDE4D, Accession XM_056815) is another VGAM1859 host target gene. PDE4D BINDING SITE is HOST TARGET binding site found in the 3' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36428, to the nucleotide sequence of VGAM1859 RNA, herein designated VGAM RNA, also designated SEQ ID:4570.

Another function of VGAM1859 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM1859 include diagnosis, prevention and treatment of diseases and clinical conditions associated with PDE4D. The function of PDE4D and its association with various diseases and clinical conditions, has been established by previous studies, as described hereinabove with reference to VGAM180. ADMP (Accession NM_145035) is another VGAM1859 host target gene. ADMP BINDING SITE is HOST TARGET binding site found in the 3' untranslated region of mRNA encoded by ADMP, corresponding to a HOST TARGET binding site such as BINDING SITE I, BINDING SITE II or BINDING SITE III. Table 2 illustrates the complementarity of the nucleotide sequences of ADMP BINDING SITE, designated SEQ ID:29655, to the nucleotide sequence of VGAM1859 RNA, herein designated VGAM RNA, also designated SEQ ID:4570.

Another function of VGAM1859 is therefore inhibition of ADMP (Accession NM_145035). Accordingly, utilities of VGAM1859 include diagnosis, prevention and treatment of diseases and clinical conditions associated with ADMP. DKFZP586N0721 (Accession NM_015400) is another VGAM1859 host target gene. DKFZP586N0721 BINDING SITE is HOST TARGET binding site found in the 3' untranslated region of mRNA encoded by DKFZP586N0721, corresponding to a HOST TARGET binding site such as BINDING SITE I, BINDING SITE II or BINDING SITE III. Table 2 illustrates the complementarity of the nucleotide sequences of DKFZP586N0721 BINDING SITE, designated SEQ ID:17710, to the nucleotide sequence of VGAM1859 RNA, herein designated VGAM RNA, also designated SEQ ID:4570.

Another function of VGAM1859 is therefore inhibition of DKFZP586N0721 (Accession NM_015400). Accordingly, utilities of VGAM1859 include diagnosis, prevention and treatment of diseases and clinical conditions associated with DKFZP586N0721. FLJ13096 (Accession NM_025000) is another VGAM1859 host target gene. FLJ13096 BINDING SITE is HOST TARGET binding site found in the 3' untranslated region of mRNA encoded by FLJ13096, corresponding to a HOST TARGET binding site such as BINDING SITE I, BINDING SITE II or BINDING SITE III. Table 2 illustrates the complementarity of the nucleotide sequences of FLJ13096 BINDING SITE, designated SEQ ID:24568, to the nucleotide sequence of VGAM1859 RNA, herein designated VGAM RNA, also designated SEQ ID:4570.

Another function of VGAM1859 is therefore inhibition of FLJ13096 (Accession NM_025000). Accordingly, utilities of VGAM1859 include diagnosis, prevention and treatment of diseases and clinical conditions associated with FLJ13096. FLJ22794 (Accession XM_166220) is another VGAM1859 host target gene. FLJ22794 BINDING SITE is HOST TARGET binding site found in the 3' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44035, to the nucleotide sequence of VGAM1859 RNA, herein designated VGAM RNA, also designated SEQ ID:4570.

Another function of VGAM1859 is therefore inhibition of FLJ22794 (Accession XM_166220). Accordingly, utilities of VGAM1859 include diagnosis, prevention and treatment of diseases and clinical conditions associated with FLJ22794. KIAA0232 (Accession XM_052627) is another VGAM1859 host target gene. KIAA0232 BINDING SITE is HOST TARGET binding site found in the 3' untranslated region of mRNA encoded by KIAA0232, corresponding to a HOST TARGET binding site such as BINDING SITE I, BINDING SITE II or BINDING SITE III. Table 2 illustrates the complementarity of the nucleotide sequences of KIAA0232 BINDING SITE, designated SEQ ID:36038, to the nucleotide sequence of VGAM1859 RNA, herein designated VGAM RNA, also designated SEQ ID:4570.

Another function of VGAM1859 is therefore inhibition of KIAA0232 (Accession XM_052627). Accordingly, utilities of VGAM1859 include diagnosis, prevention and treatment of diseases and clinical conditions associated with KIAA0232. Mitogen-activated Protein Kinase 8 Interacting Protein 3 (MAPK8IP3, Accession NM_033392) is another VGAM1859 host target gene. MAPK8IP3 BINDING SITE is HOST TARGET binding site found in the 3' untranslated region of mRNA encoded by MAPK8IP3, corresponding to a HOST TARGET binding site such as BINDING SITE I, BINDING SITE II or BINDING SITE III. Table 2 illustrates the complementarity of the nucleotide sequences of MAPK8IP3 BINDING SITE, designated SEQ ID:27223, to the nucleotide sequence of VGAM1859 RNA, herein designated VGAM RNA, also designated SEQ ID:4570.

Another function of VGAM1859 is therefore inhibition of Mitogen-activated Protein Kinase 8 Interacting Protein 3 (MAPK8IP3, Accession NM_033392). Accordingly, utilities of VGAM1859 include diagnosis, prevention and treatment of diseases and clinical conditions associated with MAPK8IP3. Testis-specific Kinase 2 (TESK2, Accession XM_032399) is another VGAM1859 host target gene. TESK2 BINDING SITE is HOST TARGET binding site found in the 3' untranslated region of mRNA encoded by TESK2, corresponding to a HOST TARGET binding site such as BINDING SITE I, BINDING SITE II or BINDING SITE III. Table 2 illustrates the complementarity of the nucleotide sequences of TESK2 BINDING SITE, designated SEQ ID:31653, to the nucleotide sequence of VGAM1859 RNA, herein designated VGAM RNA, also designated SEQ ID:4570.

Another function of VGAM1859 is therefore inhibition of Testis-specific Kinase 2 (TESK2, Accession XM_032399). Accordingly, utilities of VGAM1859 include diagnosis, prevention and treatment of diseases and clinical conditions associated with TESK2. LOC150225 (Accession XM_097870) is another VGAM1859 host target gene. LOC150225 BINDING SITE is HOST TARGET binding site found in the 5' untranslated region of mRNA encoded by LOC150225, corresponding to a HOST TARGET binding site such as BINDING SITE I, BINDING SITE II or BINDING SITE III. Table 2 illustrates the complementarity of the nucleotide sequences of LOC150225 BINDING SITE, designated SEQ ID:41194, to the nucleotide sequence of VGAM1859 RNA, herein designated VGAM RNA, also designated SEQ ID:4570.

Another function of VGAM1859 is therefore inhibition of LOC150225 (Accession XM_097870). Accordingly, utilities of VGAM1859 include diagnosis, prevention and treatment of diseases and clinical conditions associated with LOC150225. LOC221814 (Accession XM_168226) is another VGAM1859 host target gene. LOC221814 BINDING SITE is HOST TARGET binding site found in the 5' untranslated region of mRNA encoded by LOC221814, corresponding to a HOST TARGET binding site such as BINDING SITE I, BINDING SITE II or BINDING SITE III. Table 2 illustrates the complementarity of the nucleotide sequences of LOC221814 BINDING SITE, designated SEQ ID:45094, to the nucleotide sequence of VGAM1859 RNA, herein designated VGAM RNA, also designated SEQ ID:4570.

Another function of VGAM1859 is therefore inhibition of LOC221814 (Accession XM_168226). Accordingly, utilities of VGAM1859 include diagnosis, prevention and treatment of diseases and clinical conditions associated with LOC221814. FIG. 1 further provides a conceptual description of a novel bioinformatically detected viral gene of the present invention, referred to here as Viral Genomic Address Messenger 1860 (VGAM1860) viral gene, which modulates expression of respective host target genes thereof, the function and utility of which host target genes is known in the art.

VGAM1860 is a novel bioinformatically detected regulatory, non protein coding, viral micro RNA (miRNA) gene. The method by which VGAM1860 was detected is described hereinabove with reference to FIGS. 1-8.

VGAM1860 gene, herein designated VGAM GENE, is a viral gene contained in the genome of Rice Yellow Stunt Virus. VGAM1860 host target gene, herein designated VGAM HOST TARGET GENE, is a human gene contained in the human genome.

VGAM1860 gene encodes a VGAM1860 precursor RNA, herein designated VGAM PRECURSOR RNA. Similar to other miRNA genes, and unlike most ordinary genes, VGAM1860 precursor RNA does not encode a protein. A nucleotide sequence identical or highly similar to the nucleotide sequence of VGAM1860 precursor RNA is designated SEQ ID:1846, and is provided hereinbelow with reference to the sequence listing part. Nucleotide sequence SEQ ID:1846 is located at position 9805 relative to the genome of Rice Yellow Stunt Virus.

VGAM1860 precursor RNA folds onto itself, forming VGAM1860 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1860 folded precursor RNA into VGAM1860 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM1860 RNA is designated SEQ ID:4571, and is provided hereinbelow with reference to the sequence listing part.

VGAM1860 host target gene, herein designated VGAM HOST TARGET GENE, encodes a corresponding messenger RNA, VGAM1860 host target RNA, herein designated VGAM HOST TARGET RNA. VGAM1860 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1860 RNA, herein designated VGAM RNA, binds complementarily to one or more host target binding sites located in untranslated regions of VGAM1860 host target RNA, herein designated VGAM HOST TARGET RNA. This complementary binding is due to the fact that the nucleotide sequence of VGAM1860 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1860 RNA, herein designated VGAM RNA, may have a different number of host target binding sites in untranslated regions of a VGAM1860 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1860 RNA, herein designated VGAM RNA, to host target binding sites on VGAM1860 host target RNA, herein designated VGAM HOST TARGET RNA, such as BINDING SITE I, BINDING SITE II and BINDING SITE III, inhibits translation of VGAM1860 host target RNA into VGAM1860 host target protein, herein designated VGAM HOST TARGET PROTEIN. VGAM host target protein is therefore outlined by a broken line.

It is appreciated that VGAM1860 host target gene, herein designated VGAM HOST TARGET GENE, in fact represents a plurality of VGAM1860 host target genes. The mRNA of each one of this plurality of VGAM1860 host target genes comprises one or more host target binding sites, each having a nucleotide sequence which is at least partly complementary to VGAM1860 RNA, herein designated VGAM RNA, and which when bound by VGAM1860 RNA causes inhibition of translation of respective one or more VGAM1860 host target proteins.

It is further appreciated by one skilled in the art that the mode of translational inhibition illustrated by FIG. 1 with specific reference to translational inhibition exerted by VGAM1860 gene, herein designated VGAM GENE, on one or more VGAM1860 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1860 is inhibition of expression of host target genes, as part of a novel viral mechanism of attacking a host. Accordingly, utilities of VGAM1860 include diagnosis, prevention and treatment of viral infection by Rice Yellow Stunt Virus. Specific functions, and accordingly utilities, of VGAM1860 correlate with, and may be deduced from, the identity of the host target genes which VGAM1860 binds and inhibits, and the function of these host target genes, as elaborated hereinbelow.

Nucleotide sequences of the VGAM1860 precursor RNA, herein designated VGAM PRECURSOR RNA, and of the 'diced' VGAM1860 RNA, herein designated VGAM RNA, and a schematic representation of the secondary folding of VGAM1860 folded precursor RNA, herein designated VGAM FOLDED PRECURSOR RNA, of VGAM1860 are further described hereinbelow with reference to Table 1.

Nucleotide sequences of host target binding sites, such as BINDING SITE-I, BINDING SITE-II and BINDING SITE-III of FIG. 1, found on VGAM1860 host target RNA, and schematic representation of the complementarity of each of these host target binding sites to VGAM1860 RNA, herein designated VGAM RNA, are described hereinbelow with reference to Table 2.

As mentioned hereinabove with reference to FIG. 1, a function of VGAM1860 gene, herein designated VGAM is inhibition of expression of VGAM1860 target genes. It is appreciated that specific functions, and accordingly utilities, of VGAM1860 correlate with, and may be deduced from, the identity of the target genes which VGAM1860 binds and inhibits, and the function of these target genes, as elaborated hereinbelow.

Beta-site APP-cleaving Enzyme 2 (BACE2, Accession NM_138992) is a VGAM1860 host target gene. BACE2 BINDING SITE1 through BACE2 BINDING SITE3 are HOST TARGET binding sites found in untranslated regions of mRNA encoded by BACE2, corresponding to HOST TARGET binding sites such as BINDING SITE I, BINDING SITE II or BINDING SITE III. Table 2 illustrates the complementarity of the nucleotide sequences of BACE2 BINDING SITE1 through BACE2 BINDING SITE3, designated SEQ ID:29093, SEQ ID:29091 and SEQ ID:14423 respectively, to the nucleotide sequence of VGAM1860 RNA, herein designated VGAM RNA, also designated SEQ ID:4571.

A function of VGAM1860 is therefore inhibition of Beta-site APP-cleaving Enzyme 2 (BACE2, Accession NM_138992), a gene which cleaves intracellularly the b-secretase site of amyloid precursor protein. Accordingly, utilities of VGAM1860 include diagnosis, prevention and treatment of diseases and clinical conditions associated with BACE2. The function of BACE2 and its association with various diseases and clinical conditions, has been established by previous studies, as described hereinabove with reference to VGAM486. Sodium Channel, Nonvoltage-gated 1 Alpha (SCNN1A, Accession NM_001038) is another VGAM1860 host target gene. SCNN1A BINDING SITE is HOST TARGET binding site found in the 3' untranslated region of mRNA encoded by SCNN1A, corresponding to a HOST TARGET binding site such as BINDING SITE I, BINDING SITE II or BINDING SITE III. Table 2 illustrates the complementarity of the nucleotide sequences of SCNN1A BINDING SITE, designated SEQ ID:6703, to the nucleotide sequence of VGAM1860 RNA, herein designated VGAM RNA, also designated SEQ ID:4571.

Another function of VGAM1860 is therefore inhibition of Sodium Channel, Nonvoltage-gated 1 Alpha (SCNN1A, Accession NM_001038). Accordingly, utilities of VGAM1860 include diagnosis, prevention and treatment of diseases and clinical conditions associated with SCNN1A. Spondin 1, (f-spondin) Extracellular Matrix Protein (SPON1, Accession XM_031184) is another VGAM1860 host target gene. SPON1 BINDING SITE is HOST TARGET binding site found in the 3' untranslated region of mRNA encoded by SPON1, corresponding to a HOST TARGET binding site such as BINDING SITE I, BINDING SITE II or BINDING SITE III. Table 2 illustrates the complementarity of the nucleotide sequences of SPON1 BINDING SITE, designated SEQ ID:31300, to the nucleotide sequence of VGAM1860 RNA, herein designated VGAM RNA, also designated SEQ ID:4571.

Another function of VGAM1860 is therefore inhibition of Spondin 1, (f-spondin) Extracellular Matrix Protein (SPON1, Accession XM_031184). Accordingly, utilities of VGAM1860 include diagnosis, prevention and treatment of diseases and clinical conditions associated with SPON1. Suppressor of Fused Homolog (Drosophila) (SUFU, Accession NM_016169) is another VGAM1860 host target gene. SUFU BINDING SITE is HOST TARGET binding site found in the 3' untranslated region of mRNA encoded by SUFU, corresponding to a HOST TARGET binding site such as BINDING SITE I, BINDING SITE II or BINDING SITE III. Table 2 illustrates the complementarity of the nucleotide sequences of SUFU BINDING SITE, designated SEQ ID:18252, to the nucleotide sequence of VGAM1860 RNA, herein designated VGAM RNA, also designated SEQ ID:4571.

Another function of VGAM1860 is therefore inhibition of Suppressor of Fused Homolog (Drosophila) (SUFU, Accession NM_016169). Accordingly, utilities of VGAM1860 include diagnosis, prevention and treatment of diseases and clinical conditions associated with SUFU. A Kinase (PRKA) Anchor Protein 11 (AKAP11, Accession NM_016248) is another VGAM1860 host target gene. AKAP11 BINDING SITE is HOST TARGET binding site found in the 3' untranslated region of mRNA encoded by AKAP11, corresponding to a HOST TARGET binding site such as BINDING SITE I, BINDING SITE II or BINDING SITE III. Table 2 illustrates the complementarity of the nucleotide sequences of AKAP11 BINDING SITE, designated SEQ ID:18373, to the nucleotide sequence of VGAM1860 RNA, herein designated VGAM RNA, also designated SEQ ID:4571.

Another function of VGAM1860 is therefore inhibition of A Kinase (PRKA) Anchor Protein 11 (AKAP11, Accession NM_016248). Accordingly, utilities of VGAM1860 include diagnosis, prevention and treatment of diseases and clinical conditions associated with AKAP11. CHFR (Accession NM_018223) is another VGAM1860 host target gene. CHFR BINDING SITE is HOST TARGET binding site found in the 3' untranslated region of mRNA encoded by CHFR, corresponding to a HOST TARGET binding site such as BINDING SITE I, BINDING SITE II or BINDING SITE III. Table 2 illustrates the complementarity of the nucleotide sequences of CHFR BINDING SITE, designated SEQ ID:20147, to the nucleotide sequence of VGAM1860 RNA, herein designated VGAM RNA, also designated SEQ ID:4571.

Another function of VGAM1860 is therefore inhibition of CHFR (Accession NM_018223). Accordingly, utilities of VGAM1860 include diagnosis, prevention and treatment of diseases and clinical conditions associated with CHFR. FLJ10724 (Accession NM_018194) is another VGAM1860 host target gene. FLJ10724 BINDING SITE is HOST TARGET binding site found in the 3' untranslated region of mRNA encoded by FLJ10724, corresponding to a HOST TARGET binding site such as BINDING SITE I, BINDING SITE II or BINDING SITE III. Table 2 illustrates the complementarity of the nucleotide sequences of FLJ10724 BINDING SITE, designated SEQ ID:20055, to the nucleotide sequence of VGAM1860 RNA, herein designated VGAM RNA, also designated SEQ ID:4571.

Another function of VGAM1860 is therefore inhibition of FLJ10724 (Accession NM_018194). Accordingly, utilities of VGAM1860 include diagnosis, prevention and treatment of diseases and clinical conditions associated with FLJ10724. Histamine Receptor H4 (HRH4, Accession NM_021624) is another VGAM1860 host target gene. HRH4 BINDING SITE is HOST TARGET binding site found in the 3' untranslated region of mRNA encoded by HRH4, corresponding to a HOST TARGET binding site such as BINDING SITE I, BINDING SITE II or BINDING SITE III. Table 2 illustrates the complementarity of the nucleotide sequences of HRH4 BINDING SITE, designated SEQ ID:22264, to the nucleotide sequence of VGAM1860 RNA, herein designated VGAM RNA, also designated SEQ ID:4571.

Another function of VGAM1860 is therefore inhibition of Histamine Receptor H4 (HRH4, Accession NM_021624). Accordingly, utilities of VGAM1860 include diagnosis, prevention and treatment of diseases and clinical conditions associated with HRH4. KIAA0152 (Accession NM_014730) is another VGAM1860 host target gene. KIAA0152 BINDING SITE is HOST TARGET binding site found in the 3' untranslated region of mRNA encoded by KIAA0152, corresponding to a HOST TARGET binding site such as BINDING SITE I, BINDING SITE II or BINDING SITE III. Table 2 illustrates the complementarity of the nucleotide sequences of KIAA0152 BINDING SITE, designated SEQ ID:16333, to the nucleotide sequence of VGAM1860 RNA, herein designated VGAM RNA, also designated SEQ ID:4571.

Another function of VGAM1860 is therefore inhibition of KIAA0152 (Accession NM_014730). Accordingly, utilities of VGAM1860 include diagnosis, prevention and treatment of diseases and clinical conditions associated with KIAA0152. KIAA1871 (Accession XM_028409) is another VGAM1860 host target gene. KIAA1871 BINDING SITE is HOST TARGET binding site found in the 3' untranslated region of mRNA encoded by KIAA1871, corresponding to a HOST TARGET binding site such as BINDING SITE I, BINDING SITE II or BINDING SITE III. Table 2 illustrates the complementarity of the nucleotide sequences of KIAA1871 BINDING SITE, designated SEQ ID:30706, to the nucleotide sequence of VGAM1860 RNA, herein designated VGAM RNA, also designated SEQ ID:4571.

Another function of VGAM1860 is therefore inhibition of KIAA1871 (Accession XM_028409). Accordingly, utilities of VGAM1860 include diagnosis, prevention and treatment of diseases and clinical conditions associated with KIAA1871. MGC32043 (Accession NM_144582) is another VGAM1860 host target gene. MGC32043 BINDING SITE is HOST TARGET binding site found in the 3' untranslated region of mRNA encoded by MGC32043, corresponding to a HOST TARGET binding site such as BINDING SITE I, BINDING SITE II or BINDING SITE III. Table 2 illustrates the complementarity of the nucleotide sequences of MGC32043 BINDING SITE, designated SEQ ID:29391, to the nucleotide sequence of VGAM1860 RNA, herein designated VGAM RNA, also designated SEQ ID:4571.

Another function of VGAM1860 is therefore inhibition of MGC32043 (Accession NM_144582). Accordingly, utilities of VGAM1860 include diagnosis, prevention and treatment of diseases and clinical conditions associated with MGC32043. MGC32104 (Accession NM_144684) is another VGAM1860 host target gene. MGC32104 BINDING SITE is HOST TARGET binding site found in the 3' untranslated region of mRNA encoded by MGC32104, corresponding to a HOST TARGET binding site such as BINDING SITE I, BINDING SITE II or BINDING SITE III. Table 2 illustrates the complementarity of the nucleotide sequences of MGC32104 BINDING SITE, designated SEQ ID:29504, to the nucleotide sequence of VGAM1860 RNA, herein designated VGAM RNA, also designated SEQ ID:4571.

Another function of VGAM1860 is therefore inhibition of MGC32104 (Accession NM_144684). Accordingly, utilities of VGAM1860 include diagnosis, prevention and treatment of diseases and clinical conditions associated with MGC32104. Protein Phosphatase 1, Regulatory (inhibitor) Subunit 16B (PPP1R16B, Accession XM_028840) is another VGAM1860 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30771, to the nucleotide sequence of VGAM1860 RNA, herein designated VGAM RNA, also designated SEQ ID:4571.

Another function of VGAM1860 is therefore inhibition of Protein Phosphatase 1, Regulatory (inhibitor) Subunit 16B (PPP1R16B, Accession XM_028840). Accordingly, utilities of VGAM1860 include diagnosis, prevention and treatment of diseases and clinical conditions associated with PPP1R16B. RAB1B, Member RAS Oncogene Family (RAB1B, Accession NM_030981) is another VGAM1860 host target gene. RAB1B BINDING SITE is HOST TARGET binding site found in the 3' untranslated region of mRNA encoded by RAB1B, corresponding to a HOST TARGET binding site such as BINDING SITE I, BINDING SITE II or BINDING SITE III. Table 2 illustrates the complementarity of the nucleotide sequences of RAB1B BINDING SITE, designated SEQ ID:25245, to the nucleotide sequence of VGAM1860 RNA, herein designated VGAM RNA, also designated SEQ ID:4571.

Another function of VGAM1860 is therefore inhibition of RAB1B, Member RAS Oncogene Family (RAB1B, Accession NM_030981). Accordingly, utilities of VGAM1860 include diagnosis, prevention and treatment of diseases and clinical conditions associated with RAB1B. SMT3 Suppressor of Mif Two 3 Homolog 2 (yeast) (SMT3H2, Accession NM_006937) is another VGAM1860 host target gene. SMT3H2 BINDING SITE is HOST TARGET binding site found in the 3' untranslated region of mRNA encoded by SMT3H2, corresponding to a HOST TARGET binding site such as BINDING SITE I, BINDING SITE II or BINDING SITE III. Table 2 illustrates the complementarity of the nucleotide sequences of SMT3H2 BINDING SITE, designated SEQ ID:13820, to the nucleotide sequence of VGAM1860 RNA, herein designated VGAM RNA, also designated SEQ ID:4571.

Another function of VGAM1860 is therefore inhibition of SMT3 Suppressor of Mif Two 3 Homolog 2 (yeast) (SMT3H2, Accession NM_006937). Accordingly, utilities of VGAM1860 include diagnosis, prevention and treatment of diseases and clinical conditions associated with SMT3H2. TP53TG3 (Accession NM_015369) is another VGAM1860 host target gene. TP53TG3 BINDING SITE is HOST TARGET binding site found in the 3' untranslated region of mRNA encoded by TP53TG3, corresponding to a HOST TARGET binding site such as BINDING SITE I, BINDING SITE II or BINDING SITE III. Table 2 illustrates the complementarity of the nucleotide sequences of TP53TG3 BINDING SITE, designated SEQ ID:17670, to the nucleotide sequence of VGAM1860 RNA, herein designated VGAM RNA, also designated SEQ ID:4571.

Another function of VGAM1860 is therefore inhibition of TP53TG3 (Accession NM_015369). Accordingly, utilities of VGAM1860 include diagnosis, prevention and treatment of diseases and clinical conditions associated with TP53TG3. LOC158581 (Accession XM_098968) is another VGAM1860 host target gene. LOC158581 BINDING SITE is HOST TARGET binding site found in the 5' untranslated region of mRNA encoded by LOC158581, corresponding to a HOST TARGET binding site such as BINDING SITE I, BINDING SITE II or BINDING SITE III. Table 2 illustrates the complementarity of the nucleotide sequences of LOC158581 BINDING SITE, designated SEQ ID:42016, to the nucleotide sequence of VGAM1860 RNA, herein designated VGAM RNA, also designated SEQ ID:4571.

Another function of VGAM1860 is therefore inhibition of LOC158581 (Accession XM_098968). Accordingly, utilities of VGAM1860 include diagnosis, prevention and treatment of diseases and clinical conditions associated with LOC158581. LOC166713 (Accession XM_106174) is another VGAM1860 host target gene. LOC166713 BINDING SITE is HOST TARGET binding site found in the 5' untranslated region of mRNA encoded by LOC166713, corresponding to a HOST TARGET binding site such as BINDING SITE I, BINDING SITE II or BINDING SITE III. Table 2 illustrates the complementarity of the nucleotide sequences of LOC166713 BINDING SITE, designated SEQ ID:42196, to the nucleotide sequence of VGAM1860 RNA, herein designated VGAM RNA, also designated SEQ ID:4571.

Another function of VGAM1860 is therefore inhibition of LOC166713 (Accession XM_106174). Accordingly, utilities of VGAM1860 include diagnosis, prevention and treatment of diseases and clinical conditions associated with LOC166713. LOC196074 (Accession XM_113647) is another VGAM1860 host target gene. LOC196074 BINDING SITE is HOST TARGET binding site found in the 5' untranslated region of mRNA encoded by LOC196074, corresponding to a HOST TARGET binding site such as BINDING SITE I, BINDING SITE II or BINDING SITE III. Table 2 illustrates the complementarity of the nucleotide sequences of LOC196074 BINDING SITE, designated SEQ ID:42321, to the nucleotide sequence of VGAM1860 RNA, herein designated VGAM RNA, also designated SEQ ID:4571.

Another function of VGAM1860 is therefore inhibition of LOC196074 (Accession XM_113647). Accordingly, utilities of VGAM1860 include diagnosis, prevention and treatment of diseases and clinical conditions associated with LOC196074. FIG. 1 further provides a conceptual description of a novel bioinformatically detected viral gene of the present invention, referred to here as Viral Genomic Address Messenger 1861 (VGAM1861) viral gene, which modulates expression of respective host target genes thereof, the function and utility of which host target genes is known in the art.

VGAM1861 is a novel bioinformatically detected regulatory, non protein coding, viral micro RNA (miRNA) gene. The method by which VGAM1861 was detected is described hereinabove with reference to FIGS. 1-8.

VGAM1861 gene, herein designated VGAM GENE, is a viral gene contained in the genome of Rice Yellow Stunt Virus. VGAM1861 host target gene, herein designated VGAM HOST TARGET GENE, is a human gene contained in the human genome.

VGAM1861 gene encodes a VGAM1861 precursor RNA, herein designated VGAM PRECURSOR RNA. Similar to other miRNA genes, and unlike most ordinary genes, VGAM1861 precursor RNA does not encode a protein. A nucleotide sequence identical or highly similar to the nucleotide sequence of VGAM1861 precursor RNA is designated SEQ ID:1847, and is provided hereinbelow with reference to the sequence listing part. Nucleotide sequence SEQ ID:1847 is located at position 11283 relative to the genome of Rice Yellow Stunt Virus.

VGAM1861 precursor RNA folds onto itself, forming VGAM1861 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1861 folded precursor RNA into VGAM1861 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1861 RNA is designated SEQ ID:4572, and is provided hereinbelow with reference to the sequence listing part.

VGAM1861 host target gene, herein designated VGAM HOST TARGET GENE, encodes a corresponding messenger RNA, VGAM1861 host target RNA, herein designated VGAM HOST TARGET RNA. VGAM1861 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1861 RNA, herein designated VGAM RNA, binds complementarily to one or more host target binding sites located in untranslated regions of VGAM1861 host target RNA, herein designated VGAM HOST TARGET RNA. This complementary binding is due to the fact that the nucleotide sequence of VGAM1861 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1861 RNA, herein designated VGAM RNA, may have a different number of host target binding sites in untranslated regions of a VGAM1861 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1861 RNA, herein designated VGAM RNA, to host target binding sites on VGAM1861 host target RNA, herein designated VGAM HOST TARGET RNA, such as BINDING SITE I, BINDING SITE II and BINDING SITE III, inhibits translation of VGAM1861 host target RNA into VGAM1861 host target protein, herein designated VGAM HOST TARGET PROTEIN. VGAM host target protein is therefore outlined by a broken line.

It is appreciated that VGAM1861 host target gene, herein designated VGAM HOST TARGET GENE, in fact represents a plurality of VGAM1861 host target genes. The mRNA of each one of this plurality of VGAM1861 host target genes comprises one or more host target binding sites, each having a nucleotide sequence which is at least partly complementary to VGAM1861 RNA, herein designated VGAM RNA, and which when bound by VGAM1861 RNA causes inhibition of translation of respective one or more VGAM1861 host target proteins.

It is further appreciated by one skilled in the art that the mode of translational inhibition illustrated by FIG. 1 with specific reference to translational inhibition exerted by VGAM1861 gene, herein designated VGAM GENE, on one or more VGAM1861 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1861 is inhibition of expression of host target genes, as part of a novel viral mechanism of attacking a host. Accordingly, utilities of VGAM1861 include diagnosis, prevention and treatment of viral infection by Rice Yellow Stunt Virus. Specific functions, and accordingly utilities, of VGAM1861 correlate with, and may be deduced from, the identity of the host target genes which VGAM1861 binds and inhibits, and the function of these host target genes, as elaborated hereinbelow.

Nucleotide sequences of the VGAM1861 precursor RNA, herein designated VGAM PRECURSOR RNA, and of the 'diced' VGAM1861 RNA, herein designated VGAM RNA, and a schematic representation of the secondary folding of VGAM1861 folded precursor RNA, herein designated VGAM FOLDED PRECURSOR RNA, of VGAM1861 are further described hereinbelow with reference to Table 1.

Nucleotide sequences of host target binding sites, such as BINDING SITE-I, BINDING SITE-II and BINDING SITE-III of FIG. 1, found on VGAM1861 host target RNA, and schematic representation of the complementarity of each of these host target binding sites to VGAM1861 RNA, herein designated VGAM RNA, are described hereinbelow with reference to Table 2.

As mentioned hereinabove with reference to FIG. 1, a function of VGAM1861 gene, herein designated VGAM is inhibition of expression of VGAM1861 target genes. It is appreciated that specific functions, and accordingly utilities, of VGAM1861 correlate with, and may be deduced from, the identity of the target genes which VGAM1861 binds and inhibits, and the function of these target genes, as elaborated hereinbelow.

FLJ12838 (Accession NM_024641) is a VGAM1861 host target gene. FLJ12838 BINDING SITE is HOST TARGET binding site found in the 3' untranslated region of mRNA encoded by FLJ12838, corresponding to a HOST TARGET binding site such as BINDING SITE I, BINDING SITE II or BINDING SITE III. Table 2 illustrates the complementarity of the nucleotide sequences of FLJ12838 BINDING SITE, designated SEQ ID:23922, to the nucleotide sequence of VGAM1861 RNA, herein designated VGAM RNA, also designated SEQ ID:4572.

A function of VGAM1861 is therefore inhibition of FLJ12838 (Accession NM_024641). Accordingly, utilities of VGAM1861 include diagnosis, prevention and treatment of diseases and clinical conditions associated with FLJ12838. LOC253971 (Accession XM_171197) is another VGAM1861 host target gene. LOC253971 BINDING SITE is HOST TARGET binding site found in the 3' untranslated region of mRNA encoded by LOC253971, corresponding to a HOST TARGET binding site such as BINDING SITE I, BINDING SITE II or BINDING SITE III. Table 2 illustrates the complementarity of the nucleotide sequences of LOC253971 BINDING SITE, designated SEQ ID:45986, to the nucleotide sequence of VGAM1861 RNA, herein designated VGAM RNA, also designated SEQ ID:4572.

Another function of VGAM1861 is therefore inhibition of LOC253971 (Accession XM_171197). Accordingly, utilities of VGAM1861 include diagnosis, prevention and treatment of diseases and clinical conditions associated with LOC253971. FIG. 1 further provides a conceptual description of a novel bioinformatically detected viral gene of the present invention, referred to here as Viral Genomic Address Messenger 1862 (VGAM1862) viral gene, which modulates expression of respective host target genes thereof, the function and utility of which host target genes is known in the art.

VGAM1862 is a novel bioinformatically detected regulatory, non protein coding, viral micro RNA (miRNA) gene. The method by which VGAM1862 was detected is described hereinabove with reference to FIGS. 1-8.

VGAM1862 gene, herein designated VGAM GENE, is a viral gene contained in the genome of Lactate Dehydrogenase-elevating Virus. VGAM1862 host target gene, herein designated VGAM HOST TARGET GENE, is a human gene contained in the human genome.

VGAM1862 gene encodes a VGAM1862 precursor RNA, herein designated VGAM PRECURSOR RNA. Similar to other miRNA genes, and unlike most ordinary genes, VGAM1862 precursor RNA does not encode a protein. A nucleotide sequence identical or highly similar to the nucleotide sequence of VGAM1862 precursor RNA is designated SEQ ID:1848, and is provided hereinbelow with reference to the sequence listing part. Nucleotide sequence SEQ ID:1848 is located at position 5398 relative to the genome of Lactate Dehydrogenase-elevating Virus.

VGAM1862 precursor RNA folds onto itself, forming VGAM1862 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1862 folded precursor RNA into VGAM1862 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1862 RNA is designated SEQ ID:4573, and is provided hereinbelow with reference to the sequence listing part.

VGAM1862 host target gene, herein designated VGAM HOST TARGET GENE, encodes a corresponding messenger RNA, VGAM1862 host target RNA, herein designated VGAM HOST TARGET RNA. VGAM1862 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1862 RNA, herein designated VGAM RNA, binds complementarily to one or more host target binding sites located in untranslated regions of VGAM1862 host target RNA, herein designated VGAM HOST TARGET RNA. This complementary binding is due to the fact that the nucleotide sequence of VGAM1862 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1862 RNA, herein designated VGAM RNA, may have a different number of host target binding sites in untranslated regions of a VGAM1862 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1862 RNA, herein designated VGAM RNA, to host target binding sites on VGAM1862 host target RNA, herein designated VGAM HOST TARGET RNA, such as BINDING SITE I, BINDING SITE II and BINDING SITE III, inhibits translation of VGAM1862 host target RNA into VGAM1862 host target protein, herein designated VGAM HOST TARGET PROTEIN. VGAM host target protein is therefore outlined by a broken line.

It is appreciated that VGAM1862 host target gene, herein designated VGAM HOST TARGET GENE, in fact represents a plurality of VGAM1862 host target genes. The mRNA of each one of this plurality of VGAM1862 host target genes comprises one or more host target binding sites, each having a nucleotide sequence which is at least partly complementary to VGAM1862 RNA, herein designated VGAM RNA, and which when bound by VGAM1862 RNA causes inhibition of translation of respective one or more VGAM1862 host target proteins.

It is further appreciated by one skilled in the art that the mode of translational inhibition illustrated by FIG. 1 with specific reference to translational inhibition exerted by VGAM1862 gene, herein designated VGAM GENE, on one or more VGAM1862 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1862 is inhibition of expression of host target genes, as part of a novel viral mechanism of attacking a host. Accordingly, utilities of VGAM1862 include diagnosis, prevention and treatment of viral infection by Lactate Dehydrogenase-elevating Virus. Specific functions, and accordingly utilities, of VGAM1862 correlate with, and may be deduced from, the identity of the host target genes which VGAM1862 binds and inhibits, and the function of these host target genes, as elaborated hereinbelow.

Nucleotide sequences of the VGAM1862 precursor RNA, herein designated VGAM PRECURSOR RNA, and of the 'diced' VGAM1862 RNA, herein designated VGAM RNA, and a schematic representation of the secondary folding of VGAM1862 folded precursor RNA, herein designated VGAM FOLDED PRECURSOR RNA, of VGAM1862 are further described hereinbelow with reference to Table 1.

Nucleotide sequences of host target binding sites, such as BINDING SITE-I, BINDING SITE-II and BINDING SITE-III of FIG. 1, found on VGAM1862 host target RNA, and schematic representation of the complementarity of each of these host target binding sites to VGAM1862 RNA, herein designated VGAM RNA, are described hereinbelow with reference to Table 2.

As mentioned hereinabove with reference to FIG. 1, a function of VGAM1862 gene, herein designated VGAM is inhibition of expression of VGAM1862 target genes. It is appreciated that specific functions, and accordingly utilities, of VGAM1862 correlate with, and may be deduced from, the identity of the target genes which VGAM1862 binds and inhibits, and the function of these target genes, as elaborated hereinbelow.

BTB and CNC Homology 1, Basic Leucine Zipper Transcription Factor 2 (BACH2, Accession NM_021813) is a VGAM1862 host target gene. BACH2 BINDING SITE is HOST TARGET binding site found in the 3' untranslated region of mRNA encoded by BACH2, corresponding to a HOST TARGET binding site such as BINDING SITE I, BINDING SITE II or BINDING SITE III. Table 2 illustrates the complementarity of the nucleotide sequences of BACH2 BINDING SITE, designated SEQ ID:22382, to the nucleotide sequence of VGAM1862 RNA, herein designated VGAM RNA, also designated SEQ ID:4573.

A function of VGAM1862 is therefore inhibition of BTB and CNC Homology 1, Basic Leucine Zipper Transcription Factor 2 (BACH2, Accession NM_021813), a gene which acts as repressor or activator, binds to maf recognition elements. Accordingly, utilities of VGAM1862 include diagnosis, prevention and treatment of diseases and clinical conditions associated with BACH2. The function of BACH2 and its association with various diseases and clinical conditions, has been established by previous studies, as described hereinabove with reference to VGAM331. C-type (calcium dependent, carbohydrate-recognition domain) Lectin, Superfamily Member 12 (CLECSF12, Accession XM_084768) is another VGAM1862 host target gene. CLECSF12 BINDING SITE is HOST TARGET binding site found in the 3' untranslated region of mRNA encoded by CLECSF12, corresponding to a HOST TARGET binding site such as BINDING SITE I, BINDING SITE II or BINDING SITE III. Table 2 illustrates the complementarity of the nucleotide sequences of CLECSF12 BINDING SITE, designated SEQ ID:37686, to the nucleotide sequence of VGAM1862 RNA, herein designated VGAM RNA, also designated SEQ ID:4573.

Another function of VGAM1862 is therefore inhibition of C-type (calcium dependent, carbohydrate-recognition domain) Lectin, Superfamily Member 12 (CLECSF12, Accession XM_084768), a gene which is a pattern-recognition receptor. Accordingly, utilities of VGAM1862 include diagnosis, prevention and treatment of diseases and clinical conditions associated with CLECSF12. The function of CLECSF12 and its association with various diseases and clinical conditions, has been established by previous studies, as described hereinabove with reference to VGAM121. Clathrin, Heavy Polypeptide-like 1 (CLTCL1, Accession XM_033096) is another VGAM1862 host target gene. CLTCL1 BINDING SITE is HOST TARGET binding site found in the 3' untranslated region of mRNA encoded by CLTCL1, corresponding to a HOST TARGET binding site such as BINDING SITE I, BINDING SITE II or BINDING SITE III. Table 2 illustrates the complementarity of the nucleotide sequences of CLTCL1 BINDING SITE, designated SEQ ID:31839, to the nucleotide sequence of VGAM1862 RNA, herein designated VGAM RNA, also designated SEQ ID:4573.

Another function of VGAM1862 is therefore inhibition of Clathrin, Heavy Polypeptide-like 1 (CLTCL1, Accession XM_033096), a gene which is involved in vesicle budding. Accordingly, utilities of VGAM1862 include diagnosis, prevention and treatment of diseases and clinical conditions associated with CLTCL1. The function of CLTCL1 and its association with various diseases and clinical conditions, has been established by previous studies, as described hereinabove with reference to VGAM42. Heparan Sulfate 2-O-sulfotransferase 1 (HS2ST1, Accession NM_012262) is another VGAM1862 host target gene. HS2ST1 BINDING SITE is HOST TARGET binding site found in the 3' untranslated region of mRNA encoded by HS2ST1, corresponding to a HOST TARGET binding site such as BINDING SITE I, BINDING SITE II or BINDING SITE III. Table 2 illustrates the complementarity of the nucleotide sequences of HS2ST1 BINDING SITE, designated SEQ ID:14572, to the nucleotide sequence of VGAM1862 RNA, herein designated VGAM RNA, also designated SEQ ID:4573.

Another function of VGAM1862 is therefore inhibition of Heparan Sulfate 2-O-sulfotransferase 1 (HS2ST1, Accession NM_012262). Accordingly, utilities of VGAM1862 include diagnosis, prevention and treatment of diseases and clinical conditions associated with HS2ST1. Potassium Voltage-gated Channel, Shaker-related Subfamily, Beta Member 2 (KCNAB2, Accession NM_003636) is another VGAM1862 host target gene. KCNAB2 BINDING SITE is HOST TARGET binding site found in the 3' untranslated region of mRNA encoded by KCNAB2, corresponding to a HOST TARGET binding site such as BINDING SITE I, BINDING SITE II or BINDING SITE III. Table 2 illustrates the complementarity of the nucleotide sequences of KCNAB2 BINDING SITE, designated SEQ ID:9709, to the nucleotide sequence of VGAM1862 RNA, herein designated VGAM RNA, also designated SEQ ID:4573.

Another function of VGAM1862 is therefore inhibition of Potassium Voltage-gated Channel, Shaker-related Subfamily, Beta Member 2 (KCNAB2, Accession NM_003636), a gene which is the beta subunit of shaker voltage-gated potassium channels. Accordingly, utilities of VGAM1862 include diagnosis, prevention and treatment of diseases and clinical conditions associated with KCNAB2. The function of KCNAB2 and its association with various diseases and clinical conditions, has been established by previous studies, as described hereinabove with reference to VGAM659. Transcription Factor-like 4 (TCFL4, Accession XM_032817) is another VGAM1862 host target gene. TCFL4 BINDING SITE is HOST TARGET binding site found in the 3' untranslated region of mRNA encoded by TCFL4, corresponding to a HOST TARGET binding site such as BINDING SITE I, BINDING SITE II or BINDING SITE III. Table 2 illustrates the complementarity of the nucleotide sequences of TCFL4 BINDING SITE, designated SEQ ID:31771, to the nucleotide sequence of VGAM1862 RNA, herein designated VGAM RNA, also designated SEQ ID:4573.

Another function of VGAM1862 is therefore inhibition of Transcription Factor-like 4 (TCFL4, Accession XM_032817), a gene which interacts with Mad and represses transcription by recruiting the Sin3A-histone deacetylase corepressor complex. Accordingly, utilities of VGAM1862 include diagnosis, prevention and treatment of diseases and clinical conditions associated with TCFL4. The function of TCFL4 and its association with various diseases and clinical conditions, has been established by previous studies, as described hereinabove with reference to VGAM172. Thyroid Hormone Receptor, Beta (erythroblastic leukemia viral (v-erb-a) Oncogene Homolog 2, Avian) (THRB, Accession NM_000461) is another VGAM1862 host target gene. THRB BINDING SITE is HOST TARGET binding site found in the 5' untranslated region of mRNA encoded by THRB, corresponding to a HOST TARGET binding site such as BINDING SITE I, BINDING SITE II or BINDING SITE III. Table 2 illustrates the complementarity of the nucleotide sequences of THRB BINDING SITE, designated SEQ ID:6077, to the nucleotide sequence of VGAM1862 RNA, herein designated VGAM RNA, also designated SEQ ID:4573.

Another function of VGAM1862 is therefore inhibition of Thyroid Hormone Receptor, Beta (erythroblastic leukemia viral (v-erb-a) Oncogene Homolog 2, Avian) (THRB, Accession NM_000461). Accordingly, utilities of VGAM1862 include diagnosis, prevention and treatment of diseases and clinical conditions associated with THRB. Tetratricopeptide Repeat Domain 3 (TTC3, Accession NM_003316) is another VGAM1862 host target gene. TTC3 BINDING SITE is HOST TARGET binding site found in the 5' untranslated region of mRNA encoded by TTC3, corresponding to a HOST TARGET binding site such as BINDING SITE I, BINDING SITE II or BINDING SITE III. Table 2 illustrates the complementarity of the nucleotide sequences of TTC3 BINDING SITE, designated SEQ ID:9317, to the nucleotide sequence of VGAM1862 RNA, herein designated VGAM RNA, also designated SEQ ID:4573.

Another function of VGAM1862 is therefore inhibition of Tetratricopeptide Repeat Domain 3 (TTC3, Accession NM_003316), a gene which contains tetratricopeptide repeat (TPR) motifs. Accordingly, utilities of VGAM1862 include diagnosis, prevention and treatment of diseases and clinical conditions associated with TTC3. The function of TTC3 and its association with various diseases and clinical conditions, has been established by previous studies, as described hereinabove with reference to VGAM699. Zinc Finger Protein 124 (HZF-16) (ZNF124, Accession NM_003431) is another VGAM1862 host target gene. ZNF124 BINDING SITE is HOST TARGET binding site found in the 3' untranslated region of mRNA encoded by ZNF124, corresponding to a HOST TARGET binding site such as BINDING SITE I, BINDING SITE II or BINDING SITE III. Table 2 illustrates the complementarity of the nucleotide sequences of ZNF124 BINDING SITE, designated SEQ ID:9482, to the nucleotide sequence of VGAM1862 RNA, herein designated VGAM RNA, also designated SEQ ID:4573.

Another function of VGAM1862 is therefore inhibition of Zinc Finger Protein 124 (HZF-16) (ZNF124, Accession NM_003431). Accordingly, utilities of VGAM1862 include diagnosis, prevention and treatment of diseases and clinical conditions associated with ZNF124. A Kinase (PRKA) Anchor Protein 11 (AKAP11, Accession NM_016248) is another VGAM1862 host target gene. AKAP11 BINDING SITE is HOST TARGET binding site found in the 3' untranslated region of mRNA encoded by AKAP11, corresponding to a HOST TARGET binding site such as BINDING SITE I, BINDING SITE II or BINDING SITE III. Table 2 illustrates the complementarity of the nucleotide sequences of AKAP11 BINDING SITE, designated SEQ ID:18376, to the nucleotide sequence of VGAM1862 RNA, herein designated VGAM RNA, also designated SEQ ID:4573.

Another function of VGAM1862 is therefore inhibition of A Kinase (PRKA) Anchor Protein 11 (AKAP11, Accession NM_016248). Accordingly, utilities of VGAM1862 include diagnosis, prevention and treatment of diseases and clinical conditions associated with AKAP11. C1q and Tumor Necrosis Factor Related Protein 2 (C1QTNF2, Accession NM_031908) is another VGAM1862 host target gene. C1QTNF2 BINDING SITE is HOST TARGET binding site found in the 3' untranslated region of mRNA encoded by C1QTNF2, corresponding to a HOST TARGET binding site such as BINDING SITE I, BINDING SITE II or BINDING SITE III. Table 2 illustrates the complementarity of the nucleotide sequences of C1QTNF2 BINDING SITE, designated SEQ ID:25652, to the nucleotide sequence of VGAM1862 RNA, herein designated VGAM RNA, also designated SEQ ID:4573.

Another function of VGAM1862 is therefore inhibition of C1q and Tumor Necrosis Factor Related Protein 2 (C1QTNF2, Accession NM_031908). Accordingly, utilities of VGAM1862 include diagnosis, prevention and treatment of diseases and clinical conditions associated with C1QTNF2. Chromosome 21 Open Reading Frame 108 (C21orf108, Accession XM_114191) is another VGAM1862 host target gene. C21orf108 BINDING SITE is HOST TARGET binding site found in the 3" untranslated region of mRNA encoded by C21orf108, corresponding to a HOST TARGET binding site such as BINDING SITE I, BINDING SITE II or BINDING SITE III. Table 2 illustrates the complementarity of the nucleotide sequences of C21orf108 BINDING SITE, designated SEQ ID:42773, to the nucleotide sequence of VGAM1862 RNA, herein designated VGAM RNA, also designated SEQ ID:4573.

Another function of VGAM1862 is therefore inhibition of Chromosome 21 Open Reading Frame 108 (C21orf108, Accession XM_114191). Accordingly, utilities of VGAM1862 include diagnosis, prevention and treatment of diseases and clinical conditions associated with C21orf108. Collagen, Type XII, Alpha 1 (COL12A1, Accession NM_080645) is another VGAM1862 host target gene. COL12A1 BINDING SITE1 and COL12A1 BINDING SITE2 are HOST TARGET binding sites found in untranslated regions of mRNA encoded by COL12A1, corresponding to HOST TARGET binding sites such as BINDING SITE I, BINDING SITE II or BINDING SITE III. Table 2 illustrates the complementarity of the nucleotide sequences of COL12A1 BINDING SITE1 and COL12A1 BINDING SITE2, designated SEQ ID:27937 and SEQ ID:10590 respectively, to the nucleotide sequence of VGAM1862 RNA, herein designated VGAM RNA, also designated SEQ ID:4573.

Another function of VGAM1862 is therefore inhibition of Collagen, Type XII, Alpha 1 (COL12A1, Accession NM_080645). Accordingly, utilities of VGAM1862 include diagnosis, prevention and treatment of diseases and clinical conditions associated with COL12A1. DKFZP667O116 (Accession XM_168586) is another VGAM1862 host target gene. DKFZP667O116 BINDING SITE is HOST TARGET binding site found in the 3' untranslated region of mRNA encoded by DKFZP667O116, corresponding to a HOST TARGET binding site such as BINDING SITE I, BINDING SITE II or BINDING SITE III. Table 2 illustrates the complementarity of the nucleotide sequences of DKFZP667O116 BINDING SITE, designated SEQ ID:45266, to the nucleotide sequence of VGAM1862 RNA, herein designated VGAM RNA, also designated SEQ ID:4573.

Another function of VGAM1862 is therefore inhibition of DKFZP667O116 (Accession XM_168586). Accordingly, utilities of VGAM1862 include diagnosis, prevention and treatment of diseases and clinical conditions associated with DKFZP667O116. FLJ10687 (Accession NM_018178) is another VGAM1862 host target gene. FLJ10687 BINDING SITE is HOST TARGET binding site found in the 3' untranslated region of mRNA encoded by FLJ10687, corresponding to a HOST TARGET binding site such as BINDING SITE I, BINDING SITE II or BINDING SITE III. Table 2 illustrates the complementarity of the nucleotide sequences of FLJ10687 BINDING SITE, designated SEQ ID:20011, to the nucleotide sequence of VGAM1862 RNA, herein designated VGAM RNA, also designated SEQ ID:4573.

Another function of VGAM1862 is therefore inhibition of FLJ10687 (Accession NM_018178). Accordingly, utilities of VGAM1862 include diagnosis, prevention and treatment of diseases and clinical conditions associated with FLJ10687. FLJ14260 (Accession NM_025027) is another VGAM1862 host target gene. FLJ14260 BINDING SITE is HOST TARGET binding site found in the 3' untranslated region of mRNA encoded by FLJ14260, corresponding to a HOST TARGET binding site such as BINDING SITE I, BINDING SITE II or BINDING SITE III. Table 2 illustrates the complementarity of the nucleotide sequences of FLJ14260 BINDING SITE, designated SEQ ID:24619, to the nucleotide sequence of VGAM1862 RNA, herein designated VGAM RNA, also designated SEQ ID:4573.

Another function of VGAM1862 is therefore inhibition of FLJ14260 (Accession NM_025027). Accordingly, utilities of VGAM1862 include diagnosis, prevention and treatment of diseases and clinical conditions associated with FLJ14260. FLJ20445 (Accession NM_017824) is another VGAM1862 host target gene. FLJ20445 BINDING SITE is HOST TARGET binding site found in the 3' untranslated region of mRNA encoded by FLJ20445, corresponding to a HOST TARGET binding site such as BINDING SITE I, BINDING SITE II or BINDING SITE III. Table 2 illustrates the complementarity of the nucleotide sequences of FLJ20445 BINDING SITE, designated SEQ ID:19476, to the nucleotide sequence of VGAM1862 RNA, herein designated VGAM RNA, also designated SEQ ID:4573.

Another function of VGAM1862 is therefore inhibition of FLJ20445 (Accession NM_017824). Accordingly, utilities of VGAM1862 include diagnosis, prevention and treatment of diseases and clinical conditions associated with FLJ20445. FLJ20972 (Accession NM_025030) is another VGAM1862 host target gene. FLJ20972 BINDING SITE is HOST TARGET binding site found in the 3' untranslated region of mRNA encoded by FLJ20972, corresponding to a HOST TARGET binding site such as BINDING SITE I, BINDING SITE II or BINDING SITE III. Table 2 illustrates the complementarity of the nucleotide sequences of FLJ20972 BINDING SITE, designated SEQ ID:24628, to the nucleotide sequence of VGAM1862 RNA, herein designated VGAM RNA, also designated SEQ ID:4573.

Another function of VGAM1862 is therefore inhibition of FLJ20972 (Accession NM_025030). Accordingly, utilities of VGAM1862 include diagnosis, prevention and treatment of diseases and clinical conditions associated with FLJ20972. FLJ21432 (Accession NM_024551) is another VGAM1862 host target gene. FLJ21432 BINDING SITE is HOST TARGET binding site found in the 3' untranslated region of mRNA encoded by FLJ21432, corresponding to a HOST TARGET binding site such as BINDING SITE I, BINDING SITE II or BINDING SITE III. Table 2 illustrates the complementarity of the nucleotide sequences of FLJ21432 BINDING SITE, designated SEQ ID:23763, to the nucleotide sequence of VGAM1862 RNA, herein designated VGAM RNA, also designated SEQ ID:4573.

Another function of VGAM1862 is therefore inhibition of FLJ21432 (Accession NM_024551). Accordingly, utilities of VGAM1862 include diagnosis, prevention and treatment of diseases and clinical conditions associated with FLJ21432. HU-K4 (Accession NM_012268) is another VGAM1862 host target gene. HU-K4 BINDING SITE is HOST TARGET binding site found in the 5' untranslated region of mRNA encoded by HU-K4, corresponding to a HOST TARGET binding site such as BINDING SITE I, BINDING SITE II or BINDING SITE III. Table 2 illustrates the complementarity of the nucleotide sequences of HU-K4 BINDING SITE, designated SEQ ID:14591, to the nucleotide sequence of VGAM1862 RNA, herein designated VGAM RNA, also designated SEQ ID:4573.

Another function of VGAM1862 is therefore inhibition of HU-K4 (Accession NM_012268). Accordingly, utilities of VGAM1862 include diagnosis, prevention and treatment of diseases and clinical conditions associated with HU-K4. HZFW1 (Accession NM_025236) is another VGAM1862 host target gene. HZFW1 BINDING SITE is HOST TARGET binding site found in the 3' untranslated region of mRNA encoded by HZFW1, corresponding to a HOST TARGET binding site such as BINDING SITE I, BINDING SITE II or BINDING SITE III. Table 2 illustrates the complementarity of the nucleotide sequences of HZFW1 BINDING SITE, designated SEQ ID:24914, to the nucleotide sequence of VGAM1862 RNA, herein designated VGAM RNA, also designated SEQ ID:4573.

Another function of VGAM1862 is therefore inhibition of HZFW1 (Accession NM_025236). Accordingly, utilities of VGAM1862 include diagnosis, prevention and treatment of diseases and clinical conditions associated with HZFW1. KIAA0237 (Accession NM_014747) is another VGAM1862 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16448, to the nucleotide sequence of VGAM1862 RNA, herein designated VGAM RNA, also designated SEQ ID:4573.

Another function of VGAM1862 is therefore inhibition of KIAA0237 (Accession NM_014747). Accordingly, utilities of VGAM1862 include diagnosis, prevention and treatment of diseases and clinical conditions associated with KIAA0237. KIAA0322 (Accession XM_166591) is another VGAM1862 host target gene. KIAA0322 BINDING SITE is HOST TARGET binding site found in the 3' untranslated region of mRNA encoded by KIAA0322, corresponding to a HOST TARGET binding site such as BINDING SITE I, BINDING SITE II or BINDING SITE III. Table 2 illustrates the complementarity of the nucleotide sequences of KIAA0322 BINDING SITE, designated SEQ ID:44563, to the nucleotide sequence of VGAM1862 RNA, herein designated VGAM RNA, also designated SEQ ID:4573.

Another function of VGAM1862 is therefore inhibition of KIAA0322 (Accession XM_166591). Accordingly, utilities of VGAM1862 include diagnosis, prevention and treatment of diseases and clinical conditions associated with KIAA0322. KIAA1775 (Accession NM_033100) is another VGAM1862 host target gene. KIAA1775 BINDING SITE is HOST TARGET binding site found in the 3' untranslated region of mRNA encoded by KIAA1775, corresponding to a HOST TARGET binding site such as BINDING SITE I, BINDING SITE II or BINDING SITE III. Table 2 illustrates the complementarity of the nucleotide sequences of KIAA1775 BINDING SITE, designated SEQ ID:26946, to the nucleotide sequence of VGAM1862 RNA, herein designated VGAM RNA, also designated SEQ ID:4573.

Another function of VGAM1862 is therefore inhibition of KIAA1775 (Accession NM_033100). Accordingly, utilities of VGAM1862 include diagnosis, prevention and treatment of diseases and clinical conditions associated with KIAA1775. KIAA1948 (Accession XM_091984) is another VGAM1862 host target gene. KIAA1948 BINDING SITE is HOST TARGET binding site found in the 3' untranslated region of mRNA encoded by KIAA1948, corresponding to a HOST TARGET binding site such as BINDING SITE I, BINDING SITE II or BINDING SITE III. Table 2 illustrates the complementarity of the nucleotide sequences of KIAA1948 BINDING SITE, designated SEQ ID:40075, to the nucleotide sequence of VGAM1862 RNA, herein designated VGAM RNA, also designated SEQ ID:4573.

Another function of VGAM1862 is therefore inhibition of KIAA1948 (Accession XM_091984). Accordingly, utilities of VGAM1862 include diagnosis, prevention and treatment of diseases and clinical conditions associated with KIAA1948. Nuclear Cap Binding Protein Subunit 2, 20kDa (NCBP2, Accession NM_007362) is another VGAM1862 host target gene. NCBP2 BINDING SITE is HOST TARGET binding site found in the 3' untranslated region of mRNA encoded by NCBP2, corresponding to a HOST TARGET binding site such as BINDING SITE I, BINDING SITE II or BINDING SITE III. Table 2 illustrates the complementarity of the nucleotide sequences of NCBP2 BINDING SITE, designated SEQ ID:14294, to the nucleotide sequence of VGAM1862 RNA, herein designated VGAM RNA, also designated SEQ ID:4573.

Another function of VGAM1862 is therefore inhibition of Nuclear Cap Binding Protein Subunit 2, 20 kDa (NCBP2, Accession NM_007362). Accordingly, utilities of VGAM1862 include diagnosis, prevention and treatment of diseases and clinical conditions associated with NCBP2. PNPASE (Accession XM_048088) is another VGAM1862 host target gene. PNPASE BINDING SITE is HOST TARGET binding site found in the 3' untranslated region of mRNA encoded by PNPASE, corresponding to a HOST TARGET binding site such as BINDING SITE I, BINDING SITE II or BINDING SITE III. Table 2 illustrates the complementarity of the nucleotide sequences of PNPASE BINDING SITE, designated SEQ ID:35100, to the nucleotide sequence of VGAM1862 RNA, herein designated VGAM RNA, also designated SEQ ID:4573.

Another function of VGAM1862 is therefore inhibition of PNPASE (Accession XM_048088). Accordingly, utilities of VGAM1862 include diagnosis, prevention and treatment of diseases and clinical conditions associated with PNPASE. SBBI31 (Accession NM_014035) is another VGAM1862 host target gene. SBBI31 BINDING SITE is HOST TARGET binding site found in the 3' untranslated region of mRNA encoded by SBBI31, corresponding to a HOST TARGET binding site such as BINDING SITE I, BINDING SITE II or BINDING SITE III. Table 2 illustrates the complementarity of the nucleotide sequences of SBBI31 BINDING SITE, designated SEQ ID:15267, to the nucleotide sequence of VGAM1862 RNA, herein designated VGAM RNA, also designated SEQ ID:4573.

Another function of VGAM1862 is therefore inhibition of SBBI31 (Accession NM_014035). Accordingly, utilities of VGAM1862 include diagnosis, prevention and treatment of diseases and clinical conditions associated with SBBI31. TXI1 (Accession NM_018430) is another VGAM1862 host target gene. TXI1 BINDING SITE is HOST TARGET binding site found in the 5' untranslated region of mRNA encoded by TXI1, corresponding to a HOST TARGET binding site such as BINDING SITE I, BINDING SITE II or BINDING SITE III. Table 2 illustrates the complementarity of the nucleotide sequences of TXI1 BINDING SITE, designated SEQ ID:20493, to the nucleotide sequence of VGAM1862 RNA, herein designated VGAM RNA, also designated SEQ ID:4573.

Another function of VGAM1862 is therefore inhibition of TXI1 (Accession NM_018430). Accordingly, utilities of VGAM1862 include diagnosis, prevention and treatment of diseases and clinical conditions associated with TXI1. Zinc Finger Protein 17 (HPF3, KOX 10) (ZNF17, Accession XM_091895) is another VGAM1862 host target gene. ZNF17 BINDING SITE is HOST TARGET binding site found in the 3' untranslated region of mRNA encoded by ZNF17, corresponding to a HOST TARGET binding site such as BINDING SITE I, BINDING SITE II or BINDING SITE III. Table 2 illustrates the complementarity of the nucleotide sequences of ZNF17 BINDING SITE, designated SEQ ID:40069, to the nucleotide sequence of VGAM1862 RNA, herein designated VGAM RNA, also designated SEQ ID:4573.

Another function of VGAM1862 is therefore inhibition of Zinc Finger Protein 17 (HPF3, KOX 10) (ZNF17, Accession XM_091895). Accordingly, utilities of VGAM1862 include diagnosis, prevention and treatment of diseases and clinical conditions associated with ZNF17. LOC120114 (Accession XM_061871) is another VGAM1862 host target gene. LOC120114 BINDING SITE is HOST TARGET binding site found in the 3' untranslated region of mRNA encoded by LOC120114, corresponding to a HOST TARGET binding site such as BINDING SITE I, BINDING SITE II or BINDING SITE III. Table 2 illustrates the complementarity of the nucleotide sequences of LOC120114 BINDING SITE, designated SEQ ID:37215, to the nucleotide sequence of VGAM1862 RNA, herein designated VGAM RNA, also designated SEQ ID:4573.

Another function of VGAM1862 is therefore inhibition of LOC120114 (Accession XM_061871). Accordingly, utilities of VGAM1862 include diagnosis, prevention and treatment of diseases and clinical conditions associated with LOC120114. LOC122553 (Accession XM_058630) is another VGAM1862 host target gene. LOC122553 BINDING SITE is HOST TARGET binding site found in the 3' untranslated region of mRNA encoded by LOC122553, corresponding to a HOST TARGET binding site such as BIND- ING SITE I, BINDING SITE II or BINDING SITE III. Table 2 illustrates the complementarity of the nucleotide sequences of LOC122553 BINDING SITE, designated SEQ ID:36691, to the nucleotide sequence of VGAM1862 RNA, herein designated VGAM RNA, also designated SEQ ID:4573.

Another function of VGAM1862 is therefore inhibition of LOC122553 (Accession XM_058630). Accordingly, utilities of VGAM1862 include diagnosis, prevention and treatment of diseases and clinical conditions associated with LOC122553. LOC123242 (Accession XM_063548) is another VGAM1862 host target gene. LOC123242 BINDING SITE is HOST TARGET binding site found in the 5' untranslated region of mRNA encoded by LOC123242, corresponding to a HOST TARGET binding site such as BINDING SITE I, BINDING SITE II or BINDING SITE III. Table 2 illustrates the complementarity of the nucleotide sequences of LOC123242 BINDING SITE, designated SEQ ID:37246, to the nucleotide sequence of VGAM1862 RNA, herein designated VGAM RNA, also designated SEQ ID:4573.

Another function of VGAM1862 is therefore inhibition of LOC123242 (Accession XM_063548). Accordingly, utilities of VGAM1862 include diagnosis, prevention and treatment of diseases and clinical conditions associated with LOC123242. LOC145815 (Accession XM_096874) is another VGAM1862 host target gene. LOC145815 BINDING SITE is HOST TARGET binding site found in the 5' untranslated region of mRNA encoded by LOC145815, corresponding to a HOST TARGET binding site such as BINDING SITE I, BINDING SITE II or BINDING SITE III. Table 2 illustrates the complementarity of the nucleotide sequences of LOC145815 BINDING SITE, designated SEQ ID:40605, to the nucleotide sequence of VGAM1862 RNA, herein designated VGAM RNA, also designated SEQ ID:4573.

Another function of VGAM1862 is therefore inhibition of LOC145815 (Accession XM_096874). Accordingly, utilities of VGAM1862 include diagnosis, prevention and treatment of diseases and clinical conditions associated with LOC145815. LOC149448 (Accession XM_097642) is another VGAM1862 host target gene. LOC149448 BINDING SITE is HOST TARGET binding site found in the 3' untranslated region of mRNA encoded by LOC149448, corresponding to a HOST TARGET binding site such as BINDING SITE I, BINDING SITE II or BINDING SITE III. Table 2 illustrates the complementarity of the nucleotide sequences of LOC149448 BINDING SITE, designated SEQ ID:40991, to the nucleotide sequence of VGAM1862 RNA, herein designated VGAM RNA, also designated SEQ ID:4573.

Another function of VGAM1862 is therefore inhibition of LOC149448 (Accession XM_097642). Accordingly, utilities of VGAM1862 include diagnosis, prevention and treatment of diseases and clinical conditions associated with LOC149448. LOC153146 (Accession XM_098319) is another VGAM1862 host target gene. LOC153146 BINDING SITE is HOST TARGET binding site found in the 3' untranslated region of mRNA encoded by LOC153146, corresponding to a HOST TARGET binding site such as BINDING SITE I, BINDING SITE II or BINDING SITE III. Table 2 illustrates the complementarity of the nucleotide sequences of LOC153146 BINDING SITE, designated SEQ ID:41578, to the nucleotide sequence of VGAM1862 RNA, herein designated VGAM RNA, also designated SEQ ID:4573.

Another function of VGAM1862 is therefore inhibition of LOC153146 (Accession XM_098319). Accordingly, utilities of VGAM1862 include diagnosis, prevention and treatment of diseases and clinical conditions associated with LOC153146. LOC153768 (Accession NM_138492) is another VGAM1862 host target gene. LOC153768 BINDING SITE is HOST TARGET binding site found in the 5' untranslated region of mRNA encoded by LOC153768, corresponding to a HOST TARGET binding site such as BINDING SITE I, BINDING SITE II or BINDING SITE III. Table 2 illustrates the complementarity of the nucleotide sequences of LOC153768 BINDING SITE, designated SEQ ID:28844, to the nucleotide sequence of VGAM1862 RNA, herein designated VGAM RNA, also designated SEQ ID:4573.

Another function of VGAM1862 is therefore inhibition of LOC153768 (Accession NM_138492). Accordingly, utilities of VGAM1862 include diagnosis, prevention and treatment of diseases and clinical conditions associated with LOC153768. LOC157627 (Accession XM_088347) is another VGAM1862 host target gene. LOC157627 BINDING SITE is HOST TARGET binding site found in the 3' untranslated region of mRNA encoded by LOC157627, corresponding to a HOST TARGET binding site such as BINDING SITE I, BINDING SITE II or BINDING SITE III. Table 2 illustrates the complementarity of the nucleotide sequences of LOC157627 BINDING SITE, designated SEQ ID:39618, to the nucleotide sequence of VGAM1862 RNA, herein designated VGAM RNA, also designated SEQ ID:4573.

Another function of VGAM1862 is therefore inhibition of LOC157627 (Accession XM_088347). Accordingly, utilities of VGAM1862 include diagnosis, prevention and treatment of diseases and clinical conditions associated with LOC157627. LOC196955 (Accession XM_085210) is another VGAM1862 host target gene. LOC196955 BINDING SITE is HOST TARGET binding site found in the 5' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37938, to the nucleotide sequence of VGAM1862 RNA, herein designated VGAM RNA, also designated SEQ ID:4573.

Another function of VGAM1862 is therefore inhibition of LOC196955 (Accession XM_085210). Accordingly, utilities of VGAM1862 include diagnosis, prevention and treatment of diseases and clinical conditions associated with LOC196955. LOC201824 (Accession XM_114384) is another VGAM1862 host target gene. LOC201824 BINDING SITE is HOST TARGET binding site found in the 3' untranslated region of mRNA encoded by LOC201824, corresponding to a HOST TARGET binding site such as BINDING SITE I, BINDING SITE II or BINDING SITE III. Table 2 illustrates the complementarity of the nucleotide sequences of LOC201824 BINDING SITE, designated SEQ ID:42920, to the nucleotide sequence of VGAM1862 RNA, herein designated VGAM RNA, also designated SEQ ID:4573.

Another function of VGAM1862 is therefore inhibition of LOC201824 (Accession XM_114384). Accordingly, utilities of VGAM1862 include diagnosis, prevention and treatment of diseases and clinical conditions associated with LOC201824. LOC219654 (Accession XM_166095) is another VGAM1862 host target gene. LOC219654 BINDING SITE is HOST TARGET binding site found in the 3' untranslated region of mRNA encoded by LOC219654, corresponding to a HOST TARGET binding site such as BINDING SITE I, BINDING SITE II or BINDING SITE III. Table 2 illustrates the complementarity of the nucleotide sequences of LOC219654 BINDING SITE, designated SEQ ID:43871, to the nucleotide sequence of VGAM1862 RNA, herein designated VGAM RNA, also designated SEQ ID:4573.

Another function of VGAM1862 is therefore inhibition of LOC219654 (Accession XM_166095). Accordingly, utilities of VGAM1862 include diagnosis, prevention and treatment of diseases and clinical conditions associated with LOC219654. LOC222803 (Accession XM_169907) is another VGAM1862 host target gene. LOC222803 BINDING SITE is HOST TARGET binding site found in the 5' untranslated region of mRNA encoded by LOC222803, corresponding to a HOST TARGET binding site such as BINDING SITE I, BINDING SITE II or BINDING SITE III. Table 2 illustrates the complementarity of the nucleotide sequences of LOC222803 BINDING SITE, designated SEQ ID:45305, to the nucleotide sequence of VGAM1862 RNA, herein designated VGAM RNA, also designated SEQ ID:4573.

Another function of VGAM1862 is therefore inhibition of LOC222803 (Accession XM_169907). Accordingly, utilities of VGAM1862 include diagnosis, prevention and treatment of diseases and clinical conditions associated with LOC222803. LOC257438 (Accession XM_168338) is another VGAM1862 host target gene. LOC257438 BINDING SITE is HOST TARGET binding site found in the 3' untranslated region of mRNA encoded by LOC257438, corresponding to a HOST TARGET binding site such as BINDING SITE I, BINDING SITE II or BINDING SITE III. Table 2 illustrates the complementarity of the nucleotide sequences of LOC257438 BINDING SITE, designated SEQ ID:45109, to the nucleotide sequence of VGAM1862 RNA, herein designated VGAM RNA, also designated SEQ ID:4573.

Another function of VGAM1862 is therefore inhibition of LOC257438 (Accession XM_168338). Accordingly, utilities of VGAM1862 include diagnosis, prevention and treatment of diseases and clinical conditions associated with LOC257438. LOC90906 (Accession XM_034809) is another VGAM1862 host target gene. LOC90906 BINDING SITE is HOST TARGET binding site found in the 3' untranslated region of mRNA encoded by LOC90906, corresponding to a HOST TARGET binding site such as BINDING SITE I, BINDING SITE II or BINDING SITE III. Table 2 illustrates the complementarity of the nucleotide sequences of LOC90906 BINDING SITE, designated SEQ ID:32155, to the nucleotide sequence of VGAM1862 RNA, herein designated VGAM RNA, also designated SEQ ID:4573.

Another function of VGAM1862 is therefore inhibition of LOC90906 (Accession XM_034809). Accordingly, utilities of VGAM1862 include diagnosis, prevention and treatment of diseases and clinical conditions associated with LOC90906. FIG. 1 further provides a conceptual description of a novel bioinformatically detected viral gene of the present invention, referred to here as Viral Genomic Address Messenger 1863 (VGAM1863) viral gene, which modulates expression of respective host target genes thereof, the function and utility of which host target genes is known in the art.

VGAM1863 is a novel bioinformatically detected regulatory, non protein coding, viral micro RNA (miRNA) gene. The method by which VGAM1863 was detected is described hereinabove with reference to FIGS. 1-8.

VGAM1863 gene, herein designated VGAM GENE, is a viral gene contained in the genome of Callitrichine Herpesvirus 3. VGAM1863 host target gene, herein designated VGAM HOST TARGET GENE, is a human gene contained in the human genome.

VGAM1863 gene encodes a VGAM1863 precursor RNA, herein designated VGAM PRECURSOR RNA. Similar to other miRNA genes, and unlike most ordinary genes, VGAM1863 precursor RNA does not encode a protein. A nucleotide sequence identical or highly similar to the nucleotide sequence of VGAM1863 precursor RNA is designated SEQ ID:1849, and is provided hereinbelow with reference to the sequence listing part. Nucleotide sequence SEQ ID:1849 is located at position 121675 relative to the genome of Callitrichine Herpesvirus 3.

VGAM1863 precursor RNA folds onto itself, forming VGAM1863 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1863 folded precursor RNA into VGAM1863 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 43%) nucleotide sequence of VGAM1863 RNA is designated SEQ ID:4574, and is provided hereinbelow with reference to the sequence listing part.

VGAM1863 host target gene, herein designated VGAM HOST TARGET GENE, encodes a corresponding messenger RNA, VGAM1863 host target RNA, herein designated VGAM HOST TARGET RNA. VGAM1863 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1863 RNA, herein designated VGAM RNA, binds complementarily to one or more host target binding sites located in untranslated regions of VGAM1863 host target RNA, herein designated VGAM HOST TARGET RNA. This complementary binding is due to the fact that the nucleotide sequence of VGAM1863 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1863 RNA, herein designated VGAM RNA, may have a different number of host target binding sites in untranslated regions of a VGAM1863 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1863 RNA, herein designated VGAM RNA, to host target binding sites on VGAM1863 host target RNA, herein designated VGAM HOST TARGET RNA, such as BINDING SITE I, BINDING SITE II and BINDING SITE III, inhibits translation of VGAM1863 host target RNA into VGAM1863 host target protein, herein designated VGAM HOST TARGET PROTEIN. VGAM host target protein is therefore outlined by a broken line.

It is appreciated that VGAM1863 host target gene, herein designated VGAM HOST TARGET GENE, in fact represents a plurality of VGAM1863 host target genes. The mRNA of each one of this plurality of VGAM1863 host target genes comprises one or more host target binding sites, each having a nucleotide sequence which is at least partly complementary to VGAM1863 RNA, herein designated VGAM RNA, and which when bound by VGAM1863 RNA causes inhibition of translation of respective one or more VGAM1863 host target proteins.

It is further appreciated by one skilled in the art that the mode of translational inhibition illustrated by FIG. 1 with specific reference to translational inhibition exerted by VGAM1863 gene, herein designated VGAM GENE, on one or more VGAM1863 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1863 is inhibition of expression of host target genes, as part of a novel viral mechanism of attacking a host. Accordingly, utilities of VGAM1863 include diagnosis, prevention and treatment of viral infection by Callitrichine Herpesvirus 3. Specific functions, and accordingly utilities, of VGAM1863 correlate with, and may be deduced from, the identity of the host target genes which VGAM1863 binds and inhibits, and the function of these host target genes, as elaborated hereinbelow.

Nucleotide sequences of the VGAM1863 precursor RNA, herein designated VGAM PRECURSOR RNA, and of the 'diced' VGAM1863 RNA, herein designated VGAM RNA, and a schematic representation of the secondary folding of VGAM1863 folded precursor RNA, herein designated VGAM FOLDED PRECURSOR RNA, of VGAM1863 are further described hereinbelow with reference to Table 1.

Nucleotide sequences of host target binding sites, such as BINDING SITE-I, BINDING SITE-II and BINDING SITE-III of FIG. 1, found on VGAM1863 host target RNA, and schematic representation of the complementarity of each of these host target binding sites to VGAM1863 RNA, herein designated VGAM RNA, are described hereinbelow with reference to Table 2.

As mentioned hereinabove with reference to FIG. 1, a function of VGAM1863 gene, herein designated VGAM is inhibition of expression of VGAM1863 target genes. It is appreciated that specific functions, and accordingly utilities, of VGAM1863 correlate with, and may be deduced from, the identity of the target genes which VGAM1863 binds and inhibits, and the function of these target genes, as elaborated hereinbelow.

Asialoglycoprotein Receptor 1 (ASGR1, Accession NM_001671) is a VGAM1863 host target gene. ASGR1 BINDING SITE is HOST TARGET binding site found in the 5' untranslated region of mRNA encoded by ASGR1, corresponding to a HOST TARGET binding site such as BINDING SITE I, BINDING SITE II or BINDING SITE III. Table 2 illustrates the complementarity of the nucleotide sequences of ASGR1 BINDING SITE, designated SEQ ID:7384, to the nucleotide sequence of VGAM1863 RNA, herein designated VGAM RNA, also designated SEQ ID:4574.

A function of VGAM1863 is therefore inhibition of Asialoglycoprotein Receptor 1 (ASGR1, Accession NM_001671), a gene which mediates the endocytosis of plasma glycoproteins. Accordingly, utilities of VGAM1863 include diagnosis, prevention and treatment of diseases and clinical conditions associated with ASGR1. The function of ASGR1 and its association with various diseases and clinical conditions, has been established by previous studies, as described hereinabove with reference to VGAM1345. ATPase, Ca++ Transporting, Plasma Membrane 4 (ATP2B4, Accession XM_046775) is another VGAM1863 host target gene. ATP2B4 BINDING SITE is HOST TARGET binding site found in the 5' untranslated region of mRNA encoded by ATP2B4, corresponding to a HOST TARGET binding site such as BINDING SITE I, BINDING SITE II or BINDING SITE III. Table 2 illustrates the complementarity of the nucleotide sequences of ATP2B4 BINDING SITE, designated SEQ ID:34826, to the nucleotide sequence of VGAM1863 RNA, herein designated VGAM RNA, also designated SEQ ID:4574.

Another function of VGAM1863 is therefore inhibition of ATPase, Ca++ Transporting, Plasma Membrane 4 (ATP2B4, Accession XM_046775). Accordingly, utilities of VGAM1863 include diagnosis, prevention and treatment of diseases and clinical conditions associated with ATP2B4. Guanine Nucleotide Binding Protein (G protein), Alpha Z Polypeptide (GNAZ, Accession NM_002073) is another VGAM1863 host target gene. GNAZ BINDING SITE is HOST TARGET binding site found in the 3' untranslated region of mRNA encoded by GNAZ, corresponding to a HOST TARGET binding site such as BINDING SITE I, BINDING SITE II or BINDING SITE III. Table 2 illustrates the complementarity of the nucleotide sequences of GNAZ BINDING SITE, designated SEQ ID:7845, to the nucleotide sequence of VGAM1863 RNA, herein designated VGAM RNA, also designated SEQ ID:4574.

Another function of VGAM1863 is therefore inhibition of Guanine Nucleotide Binding Protein (G protein), Alpha Z Polypeptide (GNAZ, Accession NM_002073), a gene which functions as modulator or transducer in various transmembrane signaling systems. Accordingly, utilities of VGAM1863 include diagnosis, prevention and treatment of diseases and clinical conditions associated with GNAZ. The function of GNAZ and its association with various diseases and clinical conditions, has been established by previous studies, as described hereinabove with reference to VGAM1508. Potassium Inwardly-rectifying Channel, Subfamily J, Member 10 (KCNJ10, Accession NM_002241) is another VGAM1863 host target gene. KCNJ10 BINDING SITE is HOST TARGET binding site found in the 3' untranslated region of mRNA encoded by KCNJ10, corresponding to a HOST TARGET binding site such as BINDING SITE I, BINDING SITE II or BINDING SITE III. Table 2 illustrates the complementarity of the nucleotide sequences of KCNJ10 BINDING SITE, designated SEQ ID:8028, to the nucleotide sequence of VGAM1863 RNA, herein designated VGAM RNA, also designated SEQ ID:4574.

Another function of VGAM1863 is therefore inhibition of Potassium Inwardly-rectifying Channel, Subfamily J, Member 10 (KCNJ10, Accession NM_002241), a gene which may be responsible for potassium buffering action of glial cells in the brain. Accordingly, utilities of VGAM1863 include diagnosis, prevention and treatment of diseases and clinical conditions associated with KCNJ10. The function of KCNJ10 and its association with various diseases and clinical conditions, has been established by previous studies, as described hereinabove with reference to VGAM167.p21(CDKN1A)-activated Kinase 4 (PAK4, Accession NM_005884) is another VGAM1863 host target gene. PAK4 BINDING SITE is HOST TARGET binding site found in the 3' untranslated region of mRNA encoded by PAK4, corresponding to a HOST TARGET binding site such as BINDING SITE I, BINDING SITE II or BINDING SITE III. Table 2 illustrates the complementarity of the nucleotide sequences of PAK4 BINDING SITE, designated SEQ ID:12505, to the nucleotide sequence of VGAM1863 RNA, herein designated VGAM RNA, also designated SEQ ID:4574.

Another function of VGAM1863 is therefore inhibition of p21(CDKN1A)-activated Kinase 4 (PAK4, Accession NM_005884). Accordingly, utilities of VGAM1863 include diagnosis, prevention and treatment of diseases and clinical conditions associated with PAK4. Polycystic Kidney Disease 2-like 1 (PKD2L1, Accession NM_016112) is another VGAM1863 host target gene. PKD2L1 BINDING SITE is HOST TARGET binding site found in the 5' untranslated region of mRNA encoded by PKD2L1, corresponding to a HOST TARGET binding site such as BINDING SITE I, BINDING SITE II or BINDING SITE III. Table 2 illustrates the complementarity of the nucleotide sequences of PKD2L1 BINDING SITE, designated SEQ ID:18193, to the nucleotide sequence of VGAM1863 RNA, herein designated VGAM RNA, also designated SEQ ID:4574.

Another function of VGAM1863 is therefore inhibition of Polycystic Kidney Disease 2-like 1 (PKD2L1, Accession NM_016112). Accordingly, utilities of VGAM1863 include diagnosis, prevention and treatment of diseases and clinical conditions associated with PKD2L1. Arginine-glutamic Acid Dipeptide (RE) Repeats (RERE, Accession NM_012102) is another VGAM1863 host target gene. RERE BINDING SITE is HOST TARGET binding site found in the 3' untranslated region of mRNA encoded by RERE, corresponding to a HOST TARGET binding site such as BINDING SITE I, BINDING SITE II or BINDING SITE III. Table 2 illustrates the complementarity of the nucleotide sequences of RERE BINDING SITE, designated SEQ ID:14404, to the nucleotide sequence of VGAM1863 RNA, herein designated VGAM RNA, also designated SEQ ID:4574.

Another function of VGAM1863 is therefore inhibition of Arginine-glutamic Acid Dipeptide (RE) Repeats (RERE, Accession NM_012102), a gene which binds DRPLA and locates in the nucleus. Accordingly, utilities of VGAM1863 include diagnosis, prevention and treatment of diseases and clinical conditions associated with RERE. The function of RERE and its association with various diseases and clinical conditions, has been established by previous studies, as described hereinabove with reference to VGAM51. Selectin L (lymphocyte adhesion molecule 1) (SELL, Accession NM_000655) is another VGAM1863 host target gene. SELL BINDING SITE is HOST TARGET binding site found in the 3' untranslated region of mRNA encoded by SELL, corresponding to a HOST TARGET binding site such as BINDING SITE I, BINDING SITE II or BINDING SITE III. Table 2 illustrates the complementarity of the nucleotide sequences of SELL BINDING SITE, designated SEQ ID:6317, to the nucleotide sequence of VGAM1863 RNA, herein designated VGAM RNA, also designated SEQ ID:4574.

Another function of VGAM1863 is therefore inhibition of Selectin L (lymphocyte adhesion molecule 1) (SELL, Accession NM_000655), a gene which is a cell surface adhesion protein. Accordingly, utilities of VGAM1863 include diagnosis, prevention and treatment of diseases and clinical conditions associated with SELL. The function of SELL and its association with various diseases and clinical conditions, has been established by previous studies, as described hereinabove with reference to VGAM374. Snail Homolog 1 (Drosophila) (SNAI1, Accession NM_005985) is another VGAM1863 host target gene. SNAI1 BINDING SITE is HOST TARGET binding site found in the 3' untranslated region of mRNA encoded by SNAI1, corresponding to a HOST TARGET binding site such as BINDING SITE I, BINDING SITE II or BINDING SITE III. Table 2 illustrates the complementarity of the nucleotide sequences of SNAI1 BINDING SITE, designated SEQ ID:12608, to the nucleotide sequence of VGAM1863 RNA, herein designated VGAM RNA, also designated SEQ ID:4574.

Another function of VGAM1863 is therefore inhibition of Snail Homolog 1 (Drosophila) (SNAI1, Accession NM_005985). Accordingly, utilities of VGAM1863 include diagnosis, prevention and treatment of diseases and clinical conditions associated with SNAI1. SRGAP2 (Accession XM_059095) is another VGAM1863 host target gene. SRGAP2 BINDING SITE is HOST TARGET binding site found in the 3' untranslated region of mRNA encoded by SRGAP2, corresponding to a HOST TARGET binding site such as BINDING SITE I, BINDING SITE II or BINDING SITE III. Table 2 illustrates the complementarity of the nucleotide sequences of SRGAP2 BINDING SITE, designated SEQ ID:36878, to the nucleotide sequence of VGAM1863 RNA, herein designated VGAM RNA, also designated SEQ ID:4574.

Another function of VGAM1863 is therefore inhibition of SRGAP2 (Accession XM_059095). Accordingly, utilities of VGAM1863 include diagnosis, prevention and treatment of diseases and clinical conditions associated with SRGAP2. Chromosome 1 Open Reading Frame 8 (C1orf8, Accession NM_004872) is another VGAM1863 host target gene. C1orf8 BINDING SITE is HOST TARGET binding site found in the 5' untranslated region of mRNA encoded by C1orf8, corresponding to a HOST TARGET binding site such as BINDING SITE I, BINDING SITE II or BINDING SITE III. Table 2 illustrates the complementarity of the nucleotide sequences of C1orf8 BINDING SITE, designated SEQ ID:11300, to the nucleotide sequence of VGAM1863 RNA, herein designated VGAM RNA, also designated SEQ ID:4574.

Another function of VGAM1863 is therefore inhibition of Chromosome 1 Open Reading Frame 8 (C1orf8, Accession NM_004872). Accordingly, utilities of VGAM1863 include diagnosis, prevention and treatment of diseases and clinical conditions associated with C1orf8. CCR4-NOT Transcription Complex, Subunit 8 (CNOT8, Accession NM_004779) is another VGAM1863 host target gene. CNOT8 BINDING SITE is HOST TARGET binding site found in the 5' untranslated region of mRNA encoded by CNOT8, corresponding to a HOST TARGET binding site such as BINDING SITE I, BINDING SITE II or BINDING SITE III. Table 2 illustrates the complementarity of the nucleotide sequences of CNOT8 BINDING SITE, designated SEQ ID:11179, to the nucleotide sequence of VGAM1863 RNA, herein designated VGAM RNA, also designated SEQ ID:4574.

Another function of VGAM1863 is therefore inhibition of CCR4-NOT Transcription Complex, Subunit 8 (CNOT8, Accession NM_004779). Accordingly, utilities of VGAM1863 include diagnosis, prevention and treatment of diseases and clinical conditions associated with CNOT8. COP9 Constitutive Photomorphogenic Homolog Subunit 7B (Arabidopsis) (COPS7B, Accession NM_022730) is another VGAM1863 host target gene. COPS7B BINDING SITE is HOST TARGET binding site found in the 3' untranslated region of mRNA encoded by COPS7B, corresponding to a HOST TARGET binding site such as BINDING SITE I, BINDING SITE II or BINDING SITE III. Table 2 illustrates the complementarity of the nucleotide sequences of COPS7B BINDING SITE, designated SEQ ID:22931, to the nucleotide sequence of VGAM1863 RNA, herein designated VGAM RNA, also designated SEQ ID:4574.

Another function of VGAM1863 is therefore inhibition of COP9 Constitutive Photomorphogenic Homolog Subunit 7B (Arabidopsis) (COPS7B, Accession NM_022730). Accordingly, utilities of VGAM1863 include diagnosis, prevention and treatment of diseases and clinical conditions associated with COPS7B. Discoidin Domain Receptor Family, Member 1 (DDR1, Accession NM_013993) is another VGAM1863 host target gene. DDR1 BINDING SITE1 through DDR1 BINDING SITE3 are HOST TARGET binding sites found in untranslated regions of mRNA encoded by DDR1, corresponding to HOST TARGET binding sites such as BINDING SITE I, BINDING SITE II or BINDING SITE III. Table 2 illustrates the complementarity of the nucleotide sequences of DDR1 BINDING SITE1 through DDR1 BINDING SITE3, designated SEQ ID:15179, SEQ ID:15181 and SEQ ID:7678 respectively, to the nucleotide sequence of VGAM1863 RNA, herein designated VGAM RNA, also designated SEQ ID:4574.

Another function of VGAM1863 is therefore inhibition of Discoidin Domain Receptor Family, Member 1 (DDR1, Accession NM_013993). Accordingly, utilities of VGAM1863 include diagnosis, prevention and treatment of diseases and clinical conditions associated with DDR1. FHX (Accession NM_018416) is another VGAM1863 host target gene. FHX BINDING SITE is HOST TARGET binding site found in the 5' untranslated region of mRNA encoded by FHX, corresponding to a HOST TARGET binding site such as BINDING SITE I, BINDING SITE II or BINDING SITE III. Table 2 illustrates the complementarity of the nucleotide sequences of FHX BINDING SITE, designated SEQ ID:20463, to the nucleotide sequence of VGAM1863 RNA, herein designated VGAM RNA, also designated SEQ ID:4574.

Another function of VGAM1863 is therefore inhibition of FHX (Accession NM_018416). Accordingly, utilities of VGAM1863 include diagnosis, prevention and treatment of diseases and clinical conditions associated with FHX. FLJ13241 (Accession NM_025088) is another VGAM1863 host target gene. FLJ13241 BINDING SITE is HOST TARGET binding site found in the 3' untranslated region of mRNA encoded by FLJ13241, corresponding to a HOST TARGET binding site such as BINDING SITE I, BINDING SITE II or BINDING SITE III. Table 2 illustrates the complementarity of the nucleotide sequences of FLJ13241 BINDING SITE, designated SEQ ID:24710, to the nucleotide sequence of VGAM1863 RNA, herein designated VGAM RNA, also designated SEQ ID:4574.

Another function of VGAM1863 is therefore inhibition of FLJ13241 (Accession NM_025088). Accordingly, utilities of VGAM1863 include diagnosis, prevention and treatment of diseases and clinical conditions associated with FLJ13241. FLJ14107 (Accession NM_025026) is another VGAM1863 host target gene. FLJ14107 BINDING SITE is HOST TARGET binding site found in the 5' untranslated region of mRNA encoded by FLJ14107, corresponding to a HOST TARGET binding site such as BINDING SITE I, BINDING SITE II or BINDING SITE III. Table 2 illustrates the complementarity of the nucleotide sequences of FLJ14107 BINDING SITE, designated SEQ ID:24617, to the nucleotide sequence of VGAM1863 RNA, herein designated VGAM RNA, also designated SEQ ID:4574.

Another function of VGAM1863 is therefore inhibition of FLJ14107 (Accession NM_025026). Accordingly, utilities of VGAM1863 include diagnosis, prevention and treatment of diseases and clinical conditions associated with FLJ14107. FLJ22644 (Accession NM_025098) is another VGAM1863 host target gene. FLJ22644 BINDING SITE is HOST TARGET binding site found in the 3' untranslated region of mRNA encoded by FLJ22644, corresponding to a HOST TARGET binding site such as BINDING SITE I, BINDING SITE II or BINDING SITE III. Table 2 illustrates the complementarity of the nucleotide sequences of FLJ22644 BINDING SITE, designated SEQ ID:24741, to the nucleotide sequence of VGAM1863 RNA, herein designated VGAM RNA, also designated SEQ ID:4574.

Another function of VGAM1863 is therefore inhibition of FLJ22644 (Accession NM_025098). Accordingly, utilities of VGAM1863 include diagnosis, prevention and treatment of diseases and clinical conditions associated with FLJ22644. HXCP2 (Accession NM_032579) is another VGAM1863 host target gene. HXCP2 BINDING SITE is HOST TARGET binding site found in the 3' untranslated region of mRNA encoded by HXCP2, corresponding to a HOST TARGET binding site such as BINDING SITE I, BINDING SITE II or BINDING SITE III. Table 2 illustrates the complementarity of the nucleotide sequences of HXCP2 BINDING SITE, designated SEQ ID:26313, to the nucleotide sequence of VGAM1863 RNA, herein designated VGAM RNA, also designated SEQ ID:4574.

Another function of VGAM1863 is therefore inhibition of HXCP2 (Accession NM_032579). Accordingly, utilities of VGAM1863 include diagnosis, prevention and treatment of diseases and clinical conditions associated with HXCP2. KIAA0275 (Accession NM_014767) is another VGAM1863 host target gene. KIAA0275 BINDING SITE is HOST TARGET binding site found in the 3' untranslated region of mRNA encoded by KIAA0275, corresponding to a HOST TARGET binding site such as BINDING SITE I, BINDING SITE II or BINDING SITE III. Table 2 illustrates the complementarity of the nucleotide sequences of KIAA0275 BINDING SITE, designated SEQ ID:16551, to the nucleotide sequence of VGAM1863 RNA, herein designated VGAM RNA, also designated SEQ ID:4574.

Another function of VGAM1863 is therefore inhibition of KIAA0275 (Accession NM_014767). Accordingly, utilities of VGAM1863 include diagnosis, prevention and treatment of diseases and clinical conditions associated with KIAA0275. KIAA0537 (Accession NM_014840) is another VGAM1863 host target gene. KIAA0537 BINDING SITE is HOST TARGET binding site found in the 5' untranslated region of mRNA encoded by KIAA0537, corresponding to a HOST TARGET binding site such as BINDING SITE I, BINDING SITE II or BINDING SITE III. Table 2 illustrates the complementarity of the nucleotide sequences of KIAA0537 BINDING SITE, designated SEQ ID:16864, to the nucleotide sequence of VGAM1863 RNA, herein designated VGAM RNA, also designated SEQ ID:4574.

Another function of VGAM1863 is therefore inhibition of KIAA0537 (Accession NM_014840). Accordingly, utilities of VGAM1863 include diagnosis, prevention and treatment of diseases and clinical conditions associated with KIAA0537. KIAA1393 (Accession XM_050793) is another VGAM1863 host target gene. KIAA1393 BINDING SITE is HOST TARGET binding site found in the 3' untranslated region of mRNA encoded by KIAA1393, corresponding to a HOST TARGET binding site such as BINDING SITE I, BINDING SITE II or BINDING SITE III. Table 2 illustrates the complementarity of the nucleotide sequences of KIAA1393 BINDING SITE, designated SEQ ID:35689, to the nucleotide sequence of VGAM1863 RNA, herein designated VGAM RNA, also designated SEQ ID:4574.

Another function of VGAM1863 is therefore inhibition of KIAA1393 (Accession XM_050793). Accordingly, utilities of VGAM1863 include diagnosis, prevention and treatment of diseases and clinical conditions associated with KIAA1393. LIECG3 (Accession XM_113371) is another VGAM1863 host target gene. LIECG3 BINDING SITE is HOST TARGET binding site found in the 3' untranslated region of mRNA encoded by LIECG3, corresponding to a HOST TARGET binding site such as BINDING SITE I, BINDING SITE II or BINDING SITE III. Table 2 illustrates the complementarity of the nucleotide sequences of LIECG3 BINDING SITE, designated SEQ ID:42247, to the nucleotide sequence of VGAM1863 RNA, herein designated VGAM RNA, also designated SEQ ID:4574.

Another function of VGAM1863 is therefore inhibition of LIECG3 (Accession XM_113371). Accordingly, utilities of VGAM1863 include diagnosis, prevention and treatment of diseases and clinical conditions associated with LIECG3. MGC4504 (Accession NM_024111) is another VGAM1863 host target gene. MGC4504 BINDING SITE is HOST TARGET binding site found in the 3' untranslated region of mRNA encoded by MGC4504, corresponding to a HOST TARGET binding site such as BINDING SITE I, BINDING SITE II or BINDING SITE III. Table 2 illustrates the complementarity of the nucleotide sequences of MGC4504 BINDING SITE, designated SEQ ID:23559, to the nucleotide sequence of VGAM1863 RNA, herein designated VGAM RNA, also designated SEQ ID:4574.

Another function of VGAM1863 is therefore inhibition of MGC4504 (Accession NM_024111). Accordingly, utilities of VGAM1863 include diagnosis, prevention and treatment of diseases and clinical conditions associated with MGC4504. PL6 (Accession NM_007024) is another VGAM1863 host target gene. PL6 BINDING SITE is HOST TARGET binding site found in the 3' untranslated region of mRNA encoded by PL6, corresponding to a HOST TARGET binding site such as BINDING SITE I, BINDING SITE II or BINDING SITE III. Table 2 illustrates the complementarity of the nucleotide sequences of PL6 BINDING SITE, designated SEQ ID:13883, to the nucleotide sequence of VGAM1863 RNA, herein designated VGAM RNA, also designated SEQ ID:4574.

Another function of VGAM1863 is therefore inhibition of PL6 (Accession NM_007024). Accordingly, utilities of VGAM1863 include diagnosis, prevention and treatment of diseases and clinical conditions associated with PL6. Sema Domain, Transmembrane Domain (TM), and Cytoplasmic Domain, (semaphorin) 6C (SEMA6C, Accession NM_030913) is another VGAM1863 host target gene. SEMA6C BINDING SITE is HOST TARGET binding site found in the 5' untranslated region of mRNA encoded by SEMA6C, corresponding to a HOST TARGET binding site such as BINDING SITE I, BINDING SITE II or BINDING SITE III. Table 2 illustrates the complementarity of the nucleotide sequences of SEMA6C BINDING SITE, designated SEQ ID:25183, to the nucleotide sequence of VGAM1863 RNA, herein designated VGAM RNA, also designated SEQ ID:4574.

Another function of VGAM1863 is therefore inhibition of Sema Domain, Transmembrane Domain (TM), and Cytoplasmic Domain, (semaphorin) 6C (SEMA6C, Accession NM_030913). Accordingly, utilities of VGAM1863 include diagnosis, prevention and treatment of diseases and clinical conditions associated with SEMA6C. TP53TG3 (Accession NM_015369) is another VGAM1863 host target gene. TP53TG3 BINDING SITE is HOST TARGET binding site found in the 3' untranslated region of mRNA encoded by TP53TG3, corresponding to a HOST TARGET binding site such as BINDING SITE I, BINDING SITE II or BINDING SITE III. Table 2 illustrates the complementarity of the nucleotide sequences of TP53TG3 BINDING SITE, designated SEQ ID:17672, to the nucleotide sequence of VGAM1863 RNA, herein designated VGAM RNA, also designated SEQ ID:4574.

Another function of VGAM1863 is therefore inhibition of TP53TG3 (Accession NM_015369). Accordingly, utilities of VGAM1863 include diagnosis, prevention and treatment of diseases and clinical conditions associated with TP53TG3. LOC116113 (Accession XM_166413) is another VGAM1863 host target gene. LOC116113 BINDING SITE is HOST TARGET binding site found in the 3' untranslated region of mRNA encoded by LOC116113, corresponding to a HOST TARGET binding site such as BINDING SITE I, BINDING SITE II or BINDING SITE III. Table 2 illustrates the complementarity of the nucleotide sequences of LOC116113 BINDING SITE, designated SEQ ID:44283, to the nucleotide sequence of VGAM1863 RNA, herein designated VGAM RNA, also designated SEQ ID:4574.

Another function of VGAM1863 is therefore inhibition of LOC116113 (Accession XM_166413). Accordingly, utilities of VGAM1863 include diagnosis, prevention and treatment of diseases and clinical conditions associated with LOC116113. LOC145757 (Accession XM_085227) is another VGAM1863 host target gene. LOC145757 BINDING SITE is HOST TARGET binding site found in the 5' untranslated region of mRNA encoded by LOC145757, corresponding to a HOST TARGET binding site such as BINDING SITE I, BINDING SITE II or BINDING SITE III. Table 2 illustrates the complementarity of the nucleotide sequences of LOC145757 BINDING SITE, designated SEQ ID:37970, to the nucleotide sequence of VGAM1863 RNA, herein designated VGAM RNA, also designated SEQ ID:4574.

Another function of VGAM1863 is therefore inhibition of LOC145757 (Accession XM_085227). Accordingly, utilities of VGAM1863 include diagnosis, prevention and treatment of diseases and clinical conditions associated with LOC145757. LOC146988 (Accession XM_097150) is another VGAM1863 host target gene. LOC146988 BINDING SITE is HOST TARGET binding site found in the 5' untranslated region of mRNA encoded by LOC146988, corresponding to a HOST TARGET binding site such as BINDING SITE I, BINDING SITE II or BINDING SITE III. Table 2 illustrates the complementarity of the nucleotide sequences of LOC146988 BINDING SITE, designated SEQ ID:40777, to the nucleotide sequence of VGAM1863 RNA, herein designated VGAM RNA, also designated SEQ ID:4574.

Another function of VGAM1863 is therefore inhibition of LOC146988 (Accession XM_097150). Accordingly, utilities of VGAM1863 include diagnosis, prevention and treatment of diseases and clinical conditions associated with LOC146988. LOC148029 (Accession XM_086014) is another VGAM1863 host target gene. LOC148029 BINDING SITE is HOST TARGET binding site found in the 5' untranslated region of mRNA encoded by LOC148029, corresponding to a HOST TARGET binding site such as BINDING SITE I, BINDING SITE II or BINDING SITE III. Table 2 illustrates the complementarity of the nucleotide sequences of LOC148029 BINDING SITE, designated SEQ ID:38443, to the nucleotide sequence of VGAM1863 RNA, herein designated VGAM RNA, also designated SEQ ID:4574.

Another function of VGAM1863 is therefore inhibition of LOC148029 (Accession XM_086014). Accordingly, utilities of VGAM1863 include diagnosis, prevention and treatment of diseases and clinical conditions associated with LOC148029. LOC148114 (Accession XM_086050) is another VGAM1863 host target gene. LOC148114 BINDING SITE is HOST TARGET binding site found in the 5' untranslated region of mRNA encoded by LOC148114, corresponding to a HOST TARGET binding site such as BINDING SITE I, BINDING SITE II or BINDING SITE III. Table 2 illustrates the complementarity of the nucleotide sequences of LOC148114 BINDING SITE, designated SEQ ID:38466, to the nucleotide sequence of VGAM1863 RNA, herein designated VGAM RNA, also designated SEQ ID:4574.

Another function of VGAM1863 is therefore inhibition of LOC148114 (Accession XM_086050). Accordingly, utilities of VGAM1863 include diagnosis, prevention and treatment of diseases and clinical conditions associated with LOC148114. LOC157450 (Accession XM_048209) is another VGAM1863 host target gene. LOC157450 BINDING SITE is HOST TARGET binding site found in the 3' untranslated region of mRNA encoded by LOC157450, corresponding to a HOST TARGET binding site such as BINDING SITE I, BINDING SITE II or BINDING SITE III. Table 2 illustrates the complementarity of the nucleotide sequences of LOC157450 BINDING SITE, designated SEQ ID:35145, to the nucleotide sequence of VGAM1863 RNA, herein designated VGAM RNA, also designated SEQ ID:4574.

Another function of VGAM1863 is therefore inhibition of LOC157450 (Accession XM_048209). Accordingly, utilities of VGAM1863 include diagnosis, prevention and treatment of diseases and clinical conditions associated with LOC157450. LOC157923 (Accession XM_088422) is another VGAM1863 host target gene. LOC157923 BINDING SITE is HOST TARGET binding site found in the 5' untranslated region of mRNA encoded by LOC157923, corresponding to a HOST TARGET binding site such as BINDING SITE I, BINDING SITE II or BINDING SITE III. Table 2 illustrates the complementarity of the nucleotide sequences of LOC157923 BINDING SITE, designated SEQ ID:39684, to the nucleotide sequence of VGAM1863 RNA, herein designated VGAM RNA, also designated SEQ ID:4574.

Another function of VGAM1863 is therefore inhibition of LOC157923 (Accession XM_088422). Accordingly, utilities of VGAM1863 include diagnosis, prevention and treatment of diseases and clinical conditions associated with LOC157923. LOC199986 (Accession XM_117168) is another VGAM1863 host target gene. LOC199986 BINDING SITE is HOST TARGET binding site found in the 5' untranslated region of mRNA encoded by LOC199986, corresponding to a HOST TARGET binding site such as BINDING SITE I, BINDING SITE II or BINDING SITE III. Table 2 illustrates the complementarity of the nucleotide sequences of LOC199986 BINDING SITE, designated SEQ ID:43269, to the nucleotide sequence of VGAM1863 RNA, herein designated VGAM RNA, also designated SEQ ID:4574.

Another function of VGAM1863 is therefore inhibition of LOC199986 (Accession XM_117168). Accordingly, utilities of VGAM1863 include diagnosis, prevention and treatment of diseases and clinical conditions associated with LOC199986. LOC203043 (Accession XM_121734) is another VGAM1863 host target gene. LOC203043 BINDING SITE is HOST TARGET binding site found in the 5' untranslated region of mRNA encoded by LOC203043, corresponding to a HOST TARGET binding site such as BINDING SITE I, BINDING SITE II or BINDING SITE III. Table 2 illustrates the complementarity of the nucleotide sequences of LOC203043 BINDING SITE, designated SEQ ID:43615, to the nucleotide sequence of VGAM1863 RNA, herein designated VGAM RNA, also designated SEQ ID:4574.

Another function of VGAM1863 is therefore inhibition of LOC203043 (Accession XM_121734). Accordingly, utilities of VGAM1863 include diagnosis, prevention and treatment of diseases and clinical conditions associated with LOC203043. LOC221749 (Accession XM_166341) is another VGAM1863 host target gene. LOC221749 BINDING SITE is HOST TARGET binding site found in the 3' untranslated region of mRNA encoded by LOC221749, corresponding to a HOST TARGET binding site such as BINDING SITE I, BINDING SITE II or BINDING SITE III. Table 2 illustrates the complementarity of the nucleotide sequences of LOC221749 BINDING SITE, designated SEQ ID:44179, to the nucleotide sequence of VGAM1863 RNA, herein designated VGAM RNA, also designated SEQ ID:4574.

Another function of VGAM1863 is therefore inhibition of LOC221749 (Accession XM_166341). Accordingly, utilities of VGAM1863 include diagnosis, prevention and treatment of diseases and clinical conditions associated with LOC221749. FIG. 1 further provides a conceptual description of a novel bioinformatically detected viral gene of the present invention, referred to here as Viral Genomic Address Messenger 1864 (VGAM1864) viral gene, which modulates expression of respective host target genes thereof, the function and utility of which host target genes is known in the art.

VGAM1864 is a novel bioinformatically detected regulatory, non protein coding, viral micro RNA (miRNA) gene. The method by which VGAM1864 was detected is described hereinabove with reference to FIGS. 1-8.

VGAM1864 gene, herein designated VGAM GENE, is a viral gene contained in the genome of Callitrichine Herpesvirus 3. VGAM1864 host target gene, herein designated VGAM HOST TARGET GENE, is a human gene contained in the human genome.

VGAM1864 gene encodes a VGAM1864 precursor RNA, herein designated VGAM PRECURSOR RNA. Similar to other miRNA genes, and unlike most ordinary genes, VGAM1864 precursor RNA does not encode a protein. A nucleotide sequence identical or highly similar to the nucleotide sequence of VGAM1864 precursor RNA is designated SEQ ID:1850, and is provided hereinbelow with reference to the sequence listing part. Nucleotide sequence SEQ ID:1850 is located at position 121062 relative to the genome of Callitrichine Herpesvirus 3.

VGAM1864 precursor RNA folds onto itself, forming VGAM1864 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1864 folded precursor RNA into VGAM1864 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM1864 RNA is designated SEQ ID:4575, and is provided hereinbelow with reference to the sequence listing part.

VGAM1864 host target gene, herein designated VGAM HOST TARGET GENE, encodes a corresponding messenger RNA, VGAM1864 host target RNA, herein designated VGAM HOST TARGET RNA. VGAM1864 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1864 RNA, herein designated VGAM RNA, binds complementarily to one or more host target binding sites located in untranslated regions of VGAM1864 host target RNA, herein designated VGAM HOST TARGET RNA. This complementary binding is due to the fact that the nucleotide sequence of VGAM1864 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1864 RNA, herein designated VGAM RNA, may have a different number of host target binding sites in untranslated regions of a VGAM1864 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1864 RNA, herein designated VGAM RNA, to host target binding sites on VGAM1864 host target RNA, herein designated VGAM HOST TARGET RNA, such as BINDING SITE I, BINDING SITE II and BINDING SITE III, inhibits translation of VGAM1864 host target RNA into VGAM1864 host target protein, herein designated VGAM HOST TARGET PROTEIN. VGAM host target protein is therefore outlined by a broken line.

It is appreciated that VGAM1864 host target gene, herein designated VGAM HOST TARGET GENE, in fact represents a plurality of VGAM1864 host target genes. The mRNA of each one of this plurality of VGAM1864 host target genes comprises one or more host target binding sites, each having a nucleotide sequence which is at least partly complementary to VGAM1864 RNA, herein designated VGAM RNA, and which when bound by VGAM1864 RNA causes inhibition of translation of respective one or more VGAM1864 host target proteins.

It is further appreciated by one skilled in the art that the mode of translational inhibition illustrated by FIG. 1 with specific reference to translational inhibition exerted by VGAM1864 gene, herein designated VGAM GENE, on one or more VGAM1864 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1864 is inhibition of expression of host target genes, as part of a novel viral mechanism of attacking a host. Accordingly, utilities of VGAM1864 include diagnosis, prevention and treatment of viral infection by Callitrichine Herpesvirus 3. Specific functions, and accordingly utilities, of VGAM1864 correlate with, and may be deduced from, the identity of the host target genes which VGAM1864 binds and inhibits, and the function of these host target genes, as elaborated hereinbelow.

Nucleotide sequences of the VGAM1864 precursor RNA, herein designated VGAM PRECURSOR RNA, and of the 'diced' VGAM1864 RNA, herein designated VGAM RNA, and a schematic representation of the secondary folding of VGAM1864 folded precursor RNA, herein designated VGAM FOLDED PRECURSOR RNA, of VGAM1864 are further described hereinbelow with reference to Table 1.

Nucleotide sequences of host target binding sites, such as BINDING SITE-I, BINDING SITE-II and BINDING SITE-III of FIG. 1, found on VGAM1864 host target RNA, and schematic representation of the complementarity of each of these host target binding sites to VGAM1864 RNA, herein designated VGAM RNA, are described hereinbelow with reference to Table 2.

As mentioned hereinabove with reference to FIG. 1, a function of VGAM1864 gene, herein designated VGAM is inhibition of expression of VGAM1864 target genes. It is appreciated that specific functions, and accordingly utilities, of VGAM1864 correlate with, and may be deduced from, the identity of the target genes which VGAM1864 binds and inhibits, and the function of these target genes, as elaborated hereinbelow.

Adenylate Cyclase 8 (brain) (ADCY8, Accession NM_001115) is a VGAM1864 host target gene. ADCY8 BINDING SITE is HOST TARGET binding site found in the 5' untranslated region of mRNA encoded by ADCY8, corresponding to a HOST TARGET binding site such as BINDING SITE I, BINDING SITE II or BINDING SITE III. Table 2 illustrates the complementarity of the nucleotide sequences of ADCY8 BINDING SITE, designated SEQ ID:6788, to the nucleotide sequence of VGAM1864 RNA, herein designated VGAM RNA, also designated SEQ ID:4575.

A function of VGAM1864 is therefore inhibition of Adenylate Cyclase 8 (brain) (ADCY8, Accession NM_001115), a gene which this a membrane-bound, ca (2+)-inhibitable adenylyl cyclase. Accordingly, utilities of VGAM1864 include diagnosis, prevention and treatment of diseases and clinical conditions associated with ADCY8. The function of ADCY8 and its association with various diseases and clinical conditions, has been established by previous studies, as described hereinabove with reference to VGAM1169. AT-binding Transcription Factor 1 (ATBF1, Accession NM_006885) is another VGAM1864 host target gene. ATBF1 BINDING SITE is HOST TARGET binding site found in the 5' untranslated region of mRNA encoded by ATBF1, corresponding to a HOST TARGET binding site such as BINDING SITE I, BINDING SITE II or BINDING SITE III. Table 2 illustrates the complementarity of the nucleotide sequences of ATBF1 BINDING SITE, designated SEQ ID:13748, to the nucleotide sequence of VGAM1864 RNA, herein designated VGAM RNA, also designated SEQ ID:4575.

Another function of VGAM1864 is therefore inhibition of AT-binding Transcription Factor 1 (ATBF1, Accession NM_006885). Accordingly, utilities of VGAM1864 include diagnosis, prevention and treatment of diseases and clinical conditions associated with ATBF1. BCL2-like 2 (BCL2L2, Accession NM_004050) is another VGAM1864 host target gene. BCL2L2 BINDING SITE is HOST TARGET binding site found in the 3' untranslated region of mRNA encoded by BCL2L2, corresponding to a HOST TARGET binding site such as BINDING SITE I, BINDING SITE II or BINDING SITE III. Table 2 illustrates the complementarity of the nucleotide sequences of BCL2L2 BINDING SITE, designated SEQ ID:10262, to the nucleotide sequence of VGAM1864 RNA, herein designated VGAM RNA, also designated SEQ ID:4575.

Another function of VGAM1864 is therefore inhibition of BCL2-like 2 (BCL2L2, Accession NM_004050), a gene which promotes cell survival. Accordingly, utilities of VGAM1864 include diagnosis, prevention and treatment of diseases and clinical conditions associated with BCL2L2. The function of BCL2L2 and its association with various diseases and clinical conditions, has been established by previous studies, as described hereinabove with reference to VGAM431. Dishevelled, Dsh Homolog 1 (Drosophila) (DVL1, Accession XM_001589) is another VGAM1864 host target gene. DVL1 BINDING SITE is HOST TARGET binding site found in the 3' untranslated region of mRNA encoded by DVL1, corresponding to a HOST TARGET binding site such as BINDING SITE I, BINDING SITE II or BINDING SITE III. Table 2 illustrates the complementarity of the nucleotide sequences of DVL1 BINDING SITE, designated SEQ ID:29842, to the nucleotide sequence of VGAM1864 RNA, herein designated VGAM RNA, also designated SEQ ID:4575.

Another function of VGAM1864 is therefore inhibition of Dishevelled, Dsh Homolog 1 (Drosophila) (DVL1, Accession XM_001589), a gene which may play a role in the signal transduction pathway. Accordingly, utilities of VGAM1864 include diagnosis, prevention and treatment of diseases and clinical conditions associated with DVL1. The function of DVL1 and its association with various diseases and clinical conditions, has been established by previous studies, as described hereinabove with reference to VGAM232. Eukaryotic Translation Initiation Factor 4E Binding Protein 2 (EIF4EBP2, Accession NM_004096) is another VGAM1864 host target gene. EIF4EBP2 BINDING SITE is HOST TARGET binding site found in the 3' untranslated region of mRNA encoded by EIF4EBP2, corresponding to a HOST TARGET binding site such as BINDING SITE I, BINDING SITE II or BINDING SITE III. Table 2 illustrates the complementarity of the nucleotide sequences of EIF4EBP2 BINDING SITE, designated SEQ ID:10302, to the nucleotide sequence of VGAM1864 RNA, herein designated VGAM RNA, also designated SEQ ID:4575.

Another function of VGAM1864 is therefore inhibition of Eukaryotic Translation Initiation Factor 4E Binding Protein 2 (EIF4EBP2, Accession NM_004096), a gene which binds EIF4E and negatively regulates initiation of translation. Accordingly, utilities of VGAM1864 include diagnosis, prevention and treatment of diseases and clinical conditions associated with EIF4EBP2. The function of EIF4EBP2 and its association with various diseases and clinical conditions, has been established by previous studies, as described hereinabove with reference to VGAM501. Engrailed Homolog 2 (EN2, Accession NM_001427) is another VGAM1864 host target gene. EN2 BINDING SITE is HOST TARGET binding site found in the 3' untranslated region of mRNA encoded by EN2, corresponding to a HOST TARGET binding site such as BINDING SITE I, BINDING SITE II or BINDING SITE III. Table 2 illustrates the complementarity of the nucleotide sequences of EN2 BINDING SITE, designated SEQ ID:7145, to the nucleotide sequence of VGAM1864 RNA, herein designated VGAM RNA, also designated SEQ ID:4575.

Another function of VGAM1864 is therefore inhibition of Engrailed Homolog 2 (EN2, Accession NM_001427), a gene which may be required for normal cerebellar development; a homeobox protein, very strongly similar to murine En2. Accordingly, utilities of VGAM1864 include diagnosis, prevention and treatment of diseases and clinical conditions associated with EN2. The function of EN2 and its association with various diseases and clinical conditions, has been established by previous studies, as described hereinabove with reference to VGAM232. G Protein-coupled Receptor 85 (GPR85, Accession NM_018970) is another VGAM1864 host target gene. GPR85 BINDING SITE is HOST TARGET binding site found in the 3' untranslated region of mRNA encoded by GPR85, corresponding to a HOST TARGET binding site such as BINDING SITE I, BINDING SITE II or BINDING SITE III. Table 2 illustrates the complementarity of the nucleotide sequences of GPR85 BINDING SITE, designated SEQ ID:21043, to the nucleotide sequence of VGAM1864 RNA, herein designated VGAM RNA, also designated SEQ ID:4575.

Another function of VGAM1864 is therefore inhibition of G Protein-coupled Receptor 85 (GPR85, Accession NM_018970). Accordingly, utilities of VGAM1864 include diagnosis, prevention and treatment of diseases and clinical conditions associated with GPR85. Glutathione Peroxidase 3 (plasma) (GPX3, Accession NM_002084) is another VGAM1864 host target gene. GPX3 BINDING SITE is HOST TARGET binding site found in the 3' untranslated region of mRNA encoded by GPX3, corresponding to a HOST TARGET binding site such as BINDING SITE I, BINDING SITE II or BINDING SITE III. Table 2 illustrates the complementarity of the nucleotide sequences of GPX3 BINDING SITE, designated SEQ ID:7879, to the nucleotide sequence of VGAM1864 RNA, herein designated VGAM RNA, also designated SEQ ID:4575.

Another function of VGAM1864 is therefore inhibition of Glutathione Peroxidase 3 (plasma) (GPX3, Accession NM_002084), a gene which reduces lipid hydroperoxide and H2O2 in plasma. Accordingly, utilities of VGAM1864 include diagnosis, prevention and treatment of diseases and clinical conditions associated with GPX3. The function of GPX3 and its association with various diseases and clinical conditions, has been established by previous studies, as described hereinabove with reference to VGAM225. High-mobility Group Box 2 (HMGB2, Accession NM_002129) is another VGAM1864 host target gene. HMGB2 BINDING SITE is HOST TARGET binding site found in the 5' untranslated region of mRNA encoded by HMGB2, corresponding to a HOST TARGET binding site such as BINDING SITE I, BINDING SITE II or BINDING SITE III. Table 2 illustrates the complementarity of the nucleotide sequences of HMGB2 BINDING SITE, designated SEQ ID:7907, to the nucleotide sequence of VGAM1864 RNA, herein designated VGAM RNA, also designated SEQ ID:4575.

Another function of VGAM1864 is therefore inhibition of High-mobility Group Box 2 (HMGB2, Accession NM_002129), a gene which binds to single-stranded DNA, unwinds double-stranded DNA, and increases transcription. Accordingly, utilities of VGAM1864 include diagnosis, prevention and treatment of diseases and clinical conditions associated with HMGB2. The function of HMGB2 has been established by previous studies. The high mobility group (HMG) proteins are localized in the nuclei of higher eukaryotes and occur in 3 families, 1 of which includes HMG1 (OMIM Ref. No. 163905) and HMG2. These proteins include a so-called HMG box which is involved in DNA binding. Both HMG1 and HMG2 proteins bind to single-stranded DNA, unwind double-stranded DNA, and increase transcription (Wanschura et al., 1996). By screening a human genomic library with the pig thymus cDNA coding for chromosomal protein HGM2, Shirakawa and Yoshida (1992) isolated a 4,341-bp fragment containing the entire gene encoding this protein. The gene was 2,665 bp long from the start site to the end of transcription and comprised 5 exons. Length of the mRNA predicted from the exons was 1,125 bp. The canonical 5-prime regulatory motifs, CCAAT, were present, whereas the TATA element was absent from the gene. The primary structure of the human HMG2 protein consisted of 208 amino acid residues and was different from that of the pig HGM2 in only 2 amino acids; one was exchanged and the other was missing.

Full details of the abovementioned studies are described in the following publications, the disclosure of which are hereby incorporated by reference:

Shirakawa, H.; Yoshida, M.: Structure of a gene coding for human HMG2 protein. J. Biol. Chem. 267:6641-6645, 1992; and Wanschura, S.; Schoenmakers, E. F. P. M.; Huysmans, C.; Bartnitzke, S.; Van de Ven, W. J. M.; Bullerdiek, J.: Mapping of the human HMG2 gene to 4q31. Genomics 31:264-265, 1996.

Further studies establishing the function and utilities of HMGB2 are found in John Hopkins OMIM database record ID 163906, and in sited publications numbered 3009-3010 listed in the bibliography section hereinbelow, which are also hereby incorporated by reference. Inositol 1,4,5-trisphosphate 3-kinase B (ITPKB, Accession NM_002221) is another VGAM1864 host target gene. ITPKB BINDING SITE is HOST TARGET binding site found in the 3' untranslated region of mRNA encoded by ITPKB, corresponding to a HOST TARGET binding site such as BINDING SITE I, BINDING SITE II or BINDING SITE III. Table 2 illustrates the complementarity of the nucleotide sequences of ITPKB BINDING SITE, designated SEQ ID:7981, to the nucleotide sequence of VGAM1864 RNA, herein designated VGAM RNA, also designated SEQ ID:4575.

Another function of VGAM1864 is therefore inhibition of Inositol 1,4,5-trisphosphate 3-kinase B (ITPKB, Accession NM_002221), a gene which is a type B inositol 1,4,5-triphosphate 3 kinase. Accordingly, utilities of VGAM1864 include diagnosis, prevention and treatment of diseases and clinical conditions associated with ITPKB. The function of ITPKB and its association with various diseases and clinical conditions, has been established by previous studies, as described hereinabove with reference to VGAM1252. Potassium Voltage-gated Channel, Isk-related Family, Member 1-like (KCNE1L, Accession NM_012282) is another VGAM1864 host target gene. KCNE1L BINDING SITE is HOST TARGET binding site found in the 3' untranslated region of mRNA encoded by KCNE1L, corresponding to a HOST TARGET binding site such as BINDING SITE I, BINDING SITE II or BINDING SITE III. Table 2 illustrates the complementarity of the nucleotide sequences of KCNE1L BINDING SITE, designated SEQ ID:14615, to the nucleotide sequence of VGAM1864 RNA, herein designated VGAM RNA, also designated SEQ ID:4575.

Another function of VGAM1864 is therefore inhibition of Potassium Voltage-gated Channel, Isk-related Family, Member 1-like (KCNE1L, Accession NM_012282), a gene which is a potassium voltage-gated channel. Accordingly, utilities of VGAM1864 include diagnosis, prevention and treatment of diseases and clinical conditions associated with KCNE1L. The function of KCNE1L has been established by previous studies. Kv4 (KCND) proteins form voltage-activated A-type potassium ion channels and are prominent in the repolarization phase of the action potential. By screening a cardiac cDNA library and RT-PCR of human ventricular RNA, Kong et al. (1998) isolated a cDNA encoding KCND3. The deduced 637-amino acid protein shares 99% sequence homology with the rat homolog. KCND3 contains 6 transmembrane segments and intracellular N- and C-termini. RT-PCR and sequence analysis demonstrated the existence of a splice variant, KCND3L, with an insert encoding an additional 19 amino acids and containing a phosphorylation site. The shorter isoform was designated KCND3S. Zhu et al. (1999) found that the KCND3L, KCND1 (OMIM Ref. No. 300281), and KCND2 (OMIM Ref. No. 600410) proteins share 60% sequence identity and 71% homology, with the least conservation in the C terminus. By Northern blot analysis, Kong et al. (1998) detected expression of an 8.5-kb transcript that is most abundant in brain and heart and is not detectable in kidney, liver, lung, pancreas, spleen, or skeletal muscle. By the same method, Isbrandt et al. (2000) found that expression within the brain is greatest in the cerebral cortex. By RT-PCR analysis, they found that the long transcript predominates in thalamus, caudate nucleus, white matter, and epiphysis, whereas the short transcript is more abundant in frontal cortex, occipital lobe, and cerebellar cortex. Dilks et al. (1999), who cloned KCND3 from human heart and brain, found by RT-PCR that only the long form of KCND3 is expressed in heart. Isbrandt et al. (2000) determined that the long form of the KCND3 gene contains 7 exons and spans at least 25 kb. The shorter isoform is encoded by 6 exons. Kong et al. (1998) and Dilks et al. (1999) found no differences in the splice variants in terms of their voltage dependence or inactivation kinetics in the basal state. The transient outward potassium current, I(to), is especially important during the early phase of repolarization in many species, including human, as it sets the plateau voltage of both the atrial and the ventricular action potential. KCND2 and/or KCND3 code for the primary alpha subunits responsible for I(to) (Tseng, 1999). In the human ventricle, KCND3 is the gene that encodes the K+ channel that underlies I(to) (Dixon et al., 1996). By FISH, Kong et al. (1998) mapped the KCND3 gene to chromosome 1p13.3. By radiation hybrid mapping, Postma et al. (2000) assigned the gene to 1p13

Full details of the abovementioned studies are described in the following publications, the disclosure of which are hereby incorporated by reference:

Tseng, G.-N.: Molecular structure of cardiac I(to) channels: Kv4.2, Kv4.3, and other possibilities? Cardiovasc. Res. 41:16-18, 1999; and Zhu, X. R.; Wulf, A.; Schwarz, M.; Isbrandt, D.; Pongs, O.: Characterization of human Kv4.2 mediating a rapidly-inactivating transient voltage-sensitive K+ current. Receptors Channels.

Further studies establishing the function and utilities of KCNE1L are found in John Hopkins OMIM database record ID 300328, and in sited publications numbered 9151 listed in the bibliography section hereinbelow, which are also hereby incorporated by reference. LAPTM5 (Accession NM_006762) is another VGAM1864 host target gene. LAPTM5 BINDING SITE is HOST TARGET binding site found in the 3' untranslated region of mRNA encoded by LAPTM5, corresponding to a HOST TARGET binding site such as BINDING SITE I, BINDING SITE II or BINDING SITE III. Table 2 illustrates the complementarity of the nucleotide sequences of LAPTM5 BINDING SITE, designated SEQ ID:13616, to the nucleotide sequence of VGAM1864 RNA, herein designated VGAM RNA, also designated SEQ ID:4575.

Another function of VGAM1864 is therefore inhibition of LAPTM5 (Accession NM_006762). Accordingly, utilities of VGAM1864 include diagnosis, prevention and treatment of diseases and clinical conditions associated with LAPTM5. Low Density Lipoprotein Receptor-related Protein 4 (LRP4, Accession XM_035037) is another VGAM1864 host target gene. LRP4 BINDING SITE is HOST TARGET binding site found in the 3' untranslated region of mRNA encoded by LRP4, corresponding to a HOST TARGET binding site such as BINDING SITE I, BINDING SITE II or BINDING SITE III. Table 2 illustrates the complementarity of the nucleotide sequences of LRP4 BINDING SITE, designated SEQ ID:32203, to the nucleotide sequence of VGAM1864 RNA, herein designated VGAM RNA, also designated SEQ ID:4575.

Another function of VGAM1864 is therefore inhibition of Low Density Lipoprotein Receptor-related Protein 4 (LRP4, Accession XM_035037). Accordingly, utilities of VGAM1864 include diagnosis, prevention and treatment of diseases and clinical conditions associated with LRP4. Neuralized-like (Drosophila) (NEURL, Accession NM_004210) is another VGAM1864 host target gene. NEURL BINDING SITE is HOST TARGET binding site found in the 3' untranslated region of mRNA encoded by NEURL, corresponding to a HOST TARGET binding site such as BINDING SITE I, BINDING SITE II or BINDING SITE III. Table 2 illustrates the complementarity of the nucleotide sequences of NEURL BINDING SITE, designated SEQ ID:10411, to the nucleotide sequence of VGAM1864 RNA, herein designated VGAM RNA, also designated SEQ ID:4575.

Another function of VGAM1864 is therefore inhibition of Neuralized-like (Drosophila) (NEURL, Accession NM_004210). Accordingly, utilities of VGAM1864 include diagnosis, prevention and treatment of diseases and clinical conditions associated with NEURL. Neurotensin Receptor 1 (high affinity) (NTSR1, Accession NM_002531) is another VGAM1864 host target gene. NTSR1 BINDING SITE is HOST TARGET binding site found in the 5' untranslated region of mRNA encoded by NTSR1, corresponding to a HOST TARGET binding site such as BINDING SITE I, BINDING SITE II or BINDING SITE III. Table 2 illustrates the complementarity of the nucleotide sequences of NTSR1 BINDING SITE, designated SEQ ID:8371, to the nucleotide sequence of VGAM1864 RNA, herein designated VGAM RNA, also designated SEQ ID:4575.

Another function of VGAM1864 is therefore inhibition of Neurotensin Receptor 1 (high affinity) (NTSR1, Accession NM_002531), a gene which is associated with g proteins that activate a phosphatidylinositol- calcium second messenger system. Accordingly, utilities of VGAM1864 include diagnosis, prevention and treatment of diseases and clinical conditions associated with NTSR1. The function of NTSR1 and its association with various diseases and clinical conditions, has been established by previous studies, as described hereinabove with reference to VGAM200. Phosphoinositide-3-kinase, Regulatory Subunit, Polypeptide 1 (p85 alpha) (PIK3R1, Accession XM_043865) is another VGAM1864 host target gene. PIK3R1 BINDING SITE is HOST TARGET binding site found in the 3' untranslated region of mRNA encoded by PIK3R1, corresponding to a HOST TARGET binding site such as BINDING SITE I, BINDING SITE II or BINDING SITE III. Table 2 illustrates the complementarity of the nucleotide sequences of PIK3R1 BINDING SITE, designated SEQ ID:34037, to the nucleotide sequence of VGAM1864 RNA, herein designated VGAM RNA, also designated SEQ ID:4575.

Another function of VGAM1864 is therefore inhibition of Phosphoinositide-3-kinase, Regulatory Subunit, Polypeptide 1 (p85 alpha) (PIK3R1, Accession XM_043865), a gene which acts as an adapter, for the insulin-stimulated increase in glucose uptake and glycogen synthesis. Accordingly, utilities of VGAM1864 include diagnosis, prevention and treatment of diseases and clinical conditions associated with PIK3R1. The function of PIK3R1 and its association with various diseases and clinical conditions, has been established by previous studies, as described hereinabove with reference to VGAM826. Placenta-specific 1 (PLAC1, Accession NM_021796) is another VGAM1864 host target gene. PLAC1 BINDING SITE is HOST TARGET binding site found in the 5' untranslated region of mRNA encoded by PLAC1, corresponding to a HOST TARGET binding site such as BINDING SITE I, BINDING SITE II or BINDING SITE III. Table 2 illustrates the complementarity of the nucleotide sequences of PLAC1 BINDING SITE, designated SEQ ID:22353, to the nucleotide sequence of VGAM1864 RNA, herein designated VGAM RNA, also designated SEQ ID:4575.

Another function of VGAM1864 is therefore inhibition of Placenta-specific 1 (PLAC1, Accession NM_021796). Accordingly, utilities of VGAM1864 include diagnosis, prevention and treatment of diseases and clinical conditions associated with PLAC1. POU Domain, Class 4, Transcription Factor 1 (POU4F1, Accession NM_006237) is another VGAM1864 host target gene. POU4F1 BINDING SITE is HOST TARGET binding site found in the 3' untranslated region of mRNA encoded by POU4F1, corresponding to a HOST TARGET binding site such as BINDING SITE I, BINDING SITE II or BINDING SITE III. Table 2 illustrates the complementarity of the nucleotide sequences of POU4F1 BINDING SITE, designated SEQ ID:12896, to the nucleotide sequence of VGAM1864 RNA, herein designated VGAM RNA, also designated SEQ ID:4575.

Another function of VGAM1864 is therefore inhibition of POU Domain, Class 4, Transcription Factor 1 (POU4F1, Accession NM_006237), a gene which plays a role in the regulation of specific gene expression within a subset of neuronal lineages. Accordingly, utilities of VGAM1864 include diagnosis, prevention and treatment of diseases and clinical conditions associated with POU4F1. The function of POU4F1 and its association with various diseases and clinical conditions, has been established by previous studies, as described hereinabove with reference to VGAM1026. RNA Binding Motif Protein 8A (RBM8A, Accession NM_005105) is another VGAM1864 host target gene. RBM8A BINDING SITE is HOST TARGET binding site found in the 3" untranslated region of mRNA encoded by RBM8A, corresponding to a HOST TARGET binding site such as BINDING SITE I, BINDING SITE II or BINDING SITE III. Table 2 illustrates the complementarity of the nucleotide sequences of RBM8A BINDING SITE, designated SEQ ID:11580, to the nucleotide sequence of VGAM1864 RNA, herein designated VGAM RNA, also designated SEQ ID:4575.

Another function of VGAM1864 is therefore inhibition of RNA Binding Motif Protein 8A (RBM8A, Accession NM_005105), a gene which involves in the pathway of gene expression postsplicing nuclear preexport mRNPs, and newly exported cytoplasmic mRNPs. Accordingly, utilities of VGAM1864 include diagnosis, prevention and treatment of diseases and clinical conditions associated with RBM8A. The function of RBM8A has been established by previous studies. Mago nashi (MAGOH; 602603), meaning grandchildless, is the homolog of a Drosophila protein required for normal germ plasm development in fly embryos. By performing a yeast 2-hybrid screen on a fetal brain cDNA library with MAGOH as the bait, Zhao et al. (2000) recovered a cDNA encoding RBM8. The 173-amino acid RBM8 protein is more than 93% identical to the mouse and zebrafish sequences, and the mouse differences are all accounted for by an 11-amino acid N-terminal insertion and another single-residue insertion in the mouse sequence. Exchange partner and GST pull-down assays confirmed the MAGOH-RBM8 interaction and showed that RBM8 is expressed as a 26-kD protein, slightly larger than the predicted mass of 23 kD. Northern blot analysis detected a major RBM8 transcript of less than 1.0 kb in all tissues tested, with weakest expression in pancreas and brain. By searching an EST database for homologs of the gonadotropin-releasing hormone receptor (GNRHR; 138850), followed by 5-prime RACE on a skeletal muscle cDNA library, Conklin et al. (2000) identified a cDNA encoding RBM8. Northern blot analysis detected a major 0.9-kb transcript in all tissues tested. Sequence analysis of the 174-amino acid protein predicted an RNA-binding domain, which is composed of 2 amphipathic alpha helices packed against a 4-stranded beta sheet, and a C-terminal arg-rich segment.

Full details of the abovementioned studies are described in the following publications, the disclosure of which are hereby incorporated by reference:

Conklin, D. C.; Rixon, M. W.; Kuestner, R. E.; Maurer, M. F.; Whitmore, T. E.; Millar, R. P.: Cloning and gene expression of a novel human ribonucleoprotein. Biochim. Biophys. Acta 1492:465-469, 2000; and Zhao, X.-F.; Nowak, N. J.; Shows, T. B.; Aplan, P. D.: MAGOH interacts with a novel RNA-binding protein. Genomics 63:145-148, 2000.

Further studies establishing the function and utilities of RBM8A are found in John Hopkins OMIM database record ID 605313, and in sited publications numbered 745 and 7455-7457 listed in the bibliography section hereinbelow, which are also hereby incorporated by reference. Receptor Tyrosine Kinase-like Orphan Receptor 2 (ROR2, Accession NM_004560) is another VGAM1864 host target gene. ROR2 BINDING SITE is HOST TARGET binding site found in the 3' untranslated region of mRNA encoded by ROR2, corresponding to a HOST TARGET binding site such as BINDING SITE I, BINDING SITE II or BINDING SITE III. Table 2 illustrates the complementarity of the nucleotide sequences of ROR2 BINDING SITE, designated SEQ ID:10899, to the nucleotide sequence of VGAM1864 RNA, herein designated VGAM RNA, also designated SEQ ID:4575.

Another function of VGAM1864 is therefore inhibition of Receptor Tyrosine Kinase-like Orphan Receptor 2 (ROR2, Accession NM_004560), a gene which may be involved in the early formayion of the chonrocytes. Accordingly, utilities of VGAM1864 include diagnosis, prevention and treatment of diseases and clinical conditions associated with ROR2. The function of ROR2 and its association with various diseases and clinical conditions, has been established by previous studies, as described hereinabove with reference to VGAM232. Solute Carrier Family 1 (neutral amino acid transporter), Member 5 (SLC1A5, Accession NM_005628) is another VGAM1864 host target gene. SLC1A5 BINDING SITE1 and SLC1A5 BINDING SITE2 are HOST TARGET binding sites found in untranslated regions of mRNA encoded by SLC1A5, corresponding to HOST TARGET binding sites such as BINDING SITE I, BINDING SITE II or BINDING SITE III. Table 2 illustrates the complementarity of the nucleotide sequences of SLC1A5 BINDING SITE1 and SLC1A5 BINDING SITE2, designated SEQ ID:12140 and SEQ ID:38400 respectively, to the nucleotide sequence of VGAM1864 RNA, herein designated VGAM RNA, also designated SEQ ID:4575.

Another function of VGAM1864 is therefore inhibition of Solute Carrier Family 1 (neutral amino acid transporter), Member 5 (SLC1A5, Accession NM_005628). Accordingly, utilities of VGAM1864 include diagnosis, prevention and treatment of diseases and clinical conditions associated with SLC1A5. Solute Carrier Family 9 (sodium/hydrogen exchanger), Isoform 6 (SLC9A6, Accession NM_006359) is another VGAM1864 host target gene. SLC9A6 BINDING SITE is HOST TARGET binding site found in the 3' untranslated region of mRNA encoded by SLC9A6, corresponding to a HOST TARGET binding site such as BINDING SITE I, BINDING SITE II or BINDING SITE III. Table 2 illustrates the complementarity of the nucleotide sequences of SLC9A6 BINDING SITE, designated SEQ ID:13055, to the nucleotide sequence of VGAM1864 RNA, herein designated VGAM RNA, also designated SEQ ID:4575.

Another function of VGAM1864 is therefore inhibition of Solute Carrier Family 9 (sodium/hydrogen exchanger), Isoform 6 (SLC9A6, Accession NM_006359), a gene which is involved electroneutral exchange of protons for na+ and k+ across the mitochondrial inner membrane. Accordingly, utilities of VGAM1864 include diagnosis, prevention and treatment of diseases and clinical conditions associated with SLC9A6. The function of SLC9A6 and its association with various diseases and clinical conditions, has been established by previous studies, as described hereinabove with reference to VGAM493. Spondin 1, (f-spondin) Extracellular Matrix Protein (SPON1, Accession XM_031184) is another VGAM1864 host target gene. SPON1 BINDING SITE is HOST TARGET binding site found in the 3' untranslated region of mRNA encoded by SPON1, corresponding to a HOST TARGET binding site such as BINDING SITE I, BINDING SITE II or BINDING SITE III. Table 2 illustrates the complementarity of the nucleotide sequences of SPON1 BINDING SITE, designated SEQ ID:31301, to the nucleotide sequence of VGAM1864 RNA, herein designated VGAM RNA, also designated SEQ ID:4575.

Another function of VGAM1864 is therefore inhibition of Spondin 1, (f-spondin) Extracellular Matrix Protein (SPON1, Accession XM_031184). Accordingly, utilities of VGAM1864 include diagnosis, prevention and treatment of diseases and clinical conditions associated with SPON1. Transglutaminase 2 (C polypeptide, protein-glutamine-gamma-glutamyltransferase) (TGM2, Accession NM_004613) is another VGAM1864 host target gene. TGM2 BINDING SITE is HOST TARGET binding site found in the 3' untranslated region of mRNA encoded by TGM2, corresponding to a HOST TARGET binding site such as BINDING SITE I, BINDING SITE II or BINDING SITE III. Table 2 illustrates the complementarity of the nucleotide sequences of TGM2 BINDING SITE, designated SEQ ID:10956, to the nucleotide sequence of VGAM1864 RNA, herein designated VGAM RNA, also designated SEQ ID:4575.

Another function of VGAM1864 is therefore inhibition of Transglutaminase 2 (C polypeptide, protein-glutamine-gamma-glutamyltransferase) (TGM2, Accession NM_004613), a gene which catalyzes the cross-linking of proteins and the conjugation of polyamines to proteins. Accordingly, utilities of VGAM1864 include diagnosis, prevention and treatment of diseases and clinical conditions associated with TGM2. The function of TGM2 and its association with various diseases and clinical conditions, has been established by previous studies, as described hereinabove with reference to VGAM899. Vascular Endothelial Growth Factor (VEGF, Accession NM_003376) is another VGAM1864 host target gene. VEGF BINDING SITE is HOST TARGET binding site found in the 3' untranslated region of mRNA encoded by VEGF, corresponding to a HOST TARGET binding site such as BINDING SITE I, BINDING SITE II or BINDING SITE III. Table 2 illustrates the complementarity of the nucleotide sequences of VEGF BINDING SITE, designated SEQ ID:9409, to the nucleotide sequence of VGAM1864 RNA, herein designated VGAM RNA, also designated SEQ ID:4575.

Another function of VGAM1864 is therefore inhibition of Vascular Endothelial Growth Factor (VEGF, Accession NM_003376), a gene which induces endothelial cell proliferation and vascular permeability. Accordingly, utilities of VGAM1864 include diagnosis, prevention and treatment of diseases and clinical conditions associated with VEGF. The function of VEGF and its association with various diseases and clinical conditions, has been established by previous studies, as described hereinabove with reference to VGAM232. Zinc Finger Protein 144 (Mel-18) (ZNF144, Accession NM_007144) is another VGAM1864 host target gene. ZNF144 BINDING SITE is HOST TARGET binding site found in the 3' untranslated region of mRNA encoded by ZNF144, corresponding to a HOST TARGET binding site such as BINDING SITE I, BINDING SITE II or BINDING SITE III. Table 2 illustrates the complementarity of the nucleotide sequences of ZNF144 BINDING SITE, designated SEQ ID:13991, to the nucleotide sequence of VGAM1864 RNA, herein designated VGAM RNA, also designated SEQ ID:4575.

Another function of VGAM1864 is therefore inhibition of Zinc Finger Protein 144 (Mel-18) (ZNF144, Accession NM_007144), a gene which is a transcriptional repressor and may play a role in the control of cell proliferation. Accordingly, utilities of VGAM1864 include diagnosis, prevention and treatment of diseases and clinical conditions associated with ZNF144. The function of ZNF144 and its association with various diseases and clinical conditions, has been established by previous studies, as described hereinabove with reference to VGAM380. 13CDNA73 (Accession NM_023037) is another VGAM1864 host target gene. 13CDNA73 BINDING SITE is HOST TARGET binding site found in the 5' untranslated region of mRNA encoded by 13CDNA73, corresponding to a HOST TARGET binding site such as BINDING SITE I, BINDING SITE II or BINDING SITE III. Table 2 illustrates the complementarity of the nucleotide sequences of 13CDNA73 BINDING SITE, designated SEQ ID:23322, to the nucleotide sequence of VGAM1864 RNA, herein designated VGAM RNA, also designated SEQ ID:4575.

Another function of VGAM1864 is therefore inhibition of 13CDNA73 (Accession NM_023037). Accordingly, utilities of VGAM1864 include diagnosis, prevention and treatment of diseases and clinical conditions associated with 13CDNA73. UDP-GlcNAc:betaGal Beta-1,3-N-acetylglucosaminyltransferase 6 (B3GNT6, Accession NM_006876) is another VGAM1864 host target gene. B3GNT6 BINDING SITE is HOST TARGET binding site found in the 3' untranslated region of mRNA encoded by B3GNT6, corresponding to a HOST TARGET binding site such as BINDING SITE I, BINDING SITE II or BINDING SITE III. Table 2 illustrates the complementarity of the nucleotide sequences of B3GNT6 BINDING SITE, designated SEQ ID:13745, to the nucleotide sequence of VGAM1864 RNA, herein designated VGAM RNA, also designated SEQ ID:4575.

Another function of VGAM1864 is therefore inhibition of UDP-GlcNAc:betaGal Beta-1,3-N-acetylglucosaminyltransferase 6 (B3GNT6, Accession NM_006876). Accordingly, utilities of VGAM1864 include diagnosis, prevention and treatment of diseases and clinical conditions associated with B3GNT6. Calcium/calmodulin-dependent Protein Kinase Kinase 1, Alpha (CAMKK1, Accession NM_032294) is another VGAM1864 host target gene. CAMKK1 BINDING SITE is HOST TARGET binding site found in the 3' untranslated region of mRNA encoded by CAMKK1, corresponding to a HOST TARGET binding site such as BINDING SITE I, BINDING SITE II or BINDING SITE III. Table 2 illustrates the complementarity of the nucleotide sequences of CAMKK1 BINDING SITE, designated SEQ ID:26069, to the nucleotide sequence of VGAM1864 RNA, herein designated VGAM RNA, also designated SEQ ID:4575.

Another function of VGAM1864 is therefore inhibition of Calcium/calmodulin-dependent Protein Kinase Kinase 1, Alpha (CAMKK1, Accession NM_032294). Accordingly, utilities of VGAM1864 include diagnosis, prevention and treatment of diseases and clinical conditions associated with CAMKK1. Claudin 4 (CLDN4, Accession NM_001305) is another VGAM1864 host target gene. CLDN4 BINDING SITE is HOST TARGET binding site found in the 3' untranslated region of mRNA encoded by CLDN4, corresponding to a HOST TARGET binding site such as BINDING SITE I, BINDING SITE II or BINDING SITE III. Table 2 illustrates the complementarity of the nucleotide sequences of CLDN4 BINDING SITE, designated SEQ ID:6987, to the nucleotide sequence of VGAM1864 RNA, herein designated VGAM RNA, also designated SEQ ID:4575.

Another function of VGAM1864 is therefore inhibition of Claudin 4 (CLDN4, Accession NM_001305). Accordingly, utilities of VGAM1864 include diagnosis, prevention and treatment of diseases and clinical conditions associated with CLDN4. CLIPR-59 (Accession NM_015526) is another VGAM1864 host target gene. CLIPR-59 BINDING SITE is HOST TARGET binding site found in the 3' untranslated region of mRNA encoded by CLIPR-59, corresponding to a HOST TARGET binding site such as BINDING SITE I, BINDING SITE II or BINDING SITE III. Table 2 illustrates the complementarity of the nucleotide sequences of CLIPR-59 BINDING SITE, designated SEQ ID:17790, to the nucleotide sequence of VGAM1864 RNA, herein designated VGAM RNA, also designated SEQ ID:4575.

Another function of VGAM1864 is therefore inhibition of CLIPR-59 (Accession NM_015526). Accordingly, utilities of VGAM1864 include diagnosis, prevention and treatment of diseases and clinical conditions associated with CLIPR-59. DKFZP434C131 (Accession XM_044630) is another VGAM1864 host target gene. DKFZP434C131 BINDING SITE is HOST TARGET binding site found in the 3' untranslated region of mRNA encoded by DKFZP434C131, corresponding to a HOST TARGET binding site such as BINDING SITE I, BINDING SITE II or BINDING SITE III. Table 2 illustrates the complementarity of the nucleotide sequences of DKFZP434C131 BINDING SITE, designated SEQ ID:34244, to the nucleotide sequence of VGAM1864 RNA, herein designated VGAM RNA, also designated SEQ ID:4575.

Another function of VGAM1864 is therefore inhibition of DKFZP434C131 (Accession XM_044630). Accordingly, utilities of VGAM1864 include diagnosis, prevention and treatment of diseases and clinical conditions associated with DKFZP434C131. DKFZP434N1511 (Accession XM_166138) is another VGAM1864 host target gene. DKFZP434N1511 BINDING SITE is HOST TARGET binding site found in the 5' untranslated region of mRNA encoded by DKFZP434N1511, corresponding to a HOST TARGET binding site such as BINDING SITE I, BINDING SITE II or BINDING SITE III. Table 2 illustrates the complementarity of the nucleotide sequences of DKFZP434N1511 BINDING SITE, designated SEQ ID:43935, to the nucleotide sequence of VGAM1864 RNA, herein designated VGAM RNA, also designated SEQ ID:4575.

Another function of VGAM1864 is therefore inhibition of DKFZP434N1511 (Accession XM_166138). Accordingly, utilities of VGAM1864 include diagnosis, prevention and treatment of diseases and clinical conditions associated with DKFZP434N1511. DKFZp547D155 (Accession XM_046977) is another VGAM1864 host target gene. DKFZp547D155 BINDING SITE is HOST TARGET binding site found in the 3' untranslated region of mRNA encoded by DKFZp547D155, corresponding to a HOST TARGET binding site such as BINDING SITE I, BINDING SITE II or BINDING SITE III. Table 2 illustrates the complementarity of the nucleotide sequences of DKFZp547D155 BINDING SITE, designated SEQ ID:34866, to the nucleotide sequence of VGAM1864 RNA, herein designated VGAM RNA, also designated SEQ ID:4575.

Another function of VGAM1864 is therefore inhibition of DKFZp547D155 (Accession XM_046977). Accordingly, utilities of VGAM1864 include diagnosis, prevention and treatment of diseases and clinical conditions associated with DKFZp547D155. DKFZP727C091 (Accession XM_038689) is another VGAM1864 host target gene. DKFZP727C091 BINDING SITE is HOST TARGET binding site found in the 3' untranslated region of mRNA encoded by DKFZP727C091, corresponding to a HOST TARGET binding site such as BINDING SITE I, BINDING SITE II or BINDING SITE III. Table 2 illustrates the complementarity of the nucleotide sequences of DKFZP727C091 BINDING SITE, designated SEQ ID:32902, to the nucleotide sequence of VGAM1864 RNA, herein designated VGAM RNA, also designated SEQ ID:4575.

Another function of VGAM1864 is therefore inhibition of DKFZP727C091 (Accession XM_038689). Accordingly, utilities of VGAM1864 include diagnosis, prevention and treatment of diseases and clinical conditions associated with DKFZP727C091. DKFZp762P2111 (Accession XM_098654) is another VGAM1864 host target gene. DKFZp762P2111 BINDING SITE is HOST TARGET binding site found in the 3' untranslated region of mRNA encoded by DKFZp762P2111, corresponding to a HOST TARGET binding site such as BINDING SITE I, BINDING SITE II or BINDING SITE III. Table 2 illustrates the complementarity of the nucleotide sequences of DKFZp762P2111 BINDING SITE, designated SEQ ID:41757, to the nucleotide sequence of VGAM1864 RNA, herein designated VGAM RNA, also designated SEQ ID:4575.

Another function of VGAM1864 is therefore inhibition of DKFZp762P2111 (Accession XM_098654). Accordingly, utilities of VGAM1864 include diagnosis, prevention and treatment of diseases and clinical conditions associated with DKFZp762P2111. DZIP1 (Accession NM_014934) is another VGAM1864 host target gene. DZIP1 BINDING SITE is HOST TARGET binding site found in the 5' untranslated region of mRNA encoded by DZIP1, corresponding to a HOST TARGET binding site such as BINDING SITE I, BINDING SITE II or BINDING SITE III. Table 2 illustrates the complementarity of the nucleotide sequences of DZIP1 BINDING SITE, designated SEQ ID:17232, to the nucleotide sequence of VGAM1864 RNA, herein designated VGAM RNA, also designated SEQ ID:4575.

Another function of VGAM1864 is therefore inhibition of DZIP1 (Accession NM_014934). Accordingly, utilities of VGAM1864 include diagnosis, prevention and treatment of diseases and clinical conditions associated with DZIP1. Erythrocyte Membrane Protein Band 4.1-like 1 (EPB41L1, Accession XM_047295) is another VGAM1864 host target gene. EPB41L1 BINDING SITE is HOST TARGET binding site found in the 3' untranslated region of mRNA encoded by EPB41L1, corresponding to a HOST TARGET binding site such as BINDING SITE I, BINDING SITE II or BINDING SITE III. Table 2 illustrates the complementarity of the nucleotide sequences of EPB41L1 BINDING SITE, designated SEQ ID:34939, to the nucleotide sequence of VGAM1864 RNA, herein designated VGAM RNA, also designated SEQ ID:4575.

Another function of VGAM1864 is therefore inhibition of Erythrocyte Membrane Protein Band 4.1-like 1 (EPB41L1, Accession XM_047295). Accordingly, utilities of VGAM1864 include diagnosis, prevention and treatment of diseases and clinical conditions associated with EPB41L1. ETR101 (Accession XM_051364) is another VGAM1864 host target gene. ETR101 BINDING SITE is HOST TARGET binding site found in the 3' untranslated region of mRNA encoded by ETR101, corresponding to a HOST TARGET binding site such as BINDING SITE I, BINDING SITE II or BINDING SITE III. Table 2 illustrates the complementarity of the nucleotide sequences of ETR101 BINDING SITE, designated SEQ ID:35831, to the nucleotide sequence of VGAM1864 RNA, herein designated VGAM RNA, also designated SEQ ID:4575.

Another function of VGAM1864 is therefore inhibition of ETR101 (Accession XM_051364). Accordingly, utilities of VGAM1864 include diagnosis, prevention and treatment of diseases and clinical conditions associated with ETR101. F-box Only Protein 21 (FBXO21, Accession NM_033624) is another VGAM1864 host target gene. FBXO21 BINDING SITE is HOST TARGET binding site found in the 3' untranslated region of mRNA encoded by FBXO21, corresponding to a HOST TARGET binding site such as BINDING SITE I, BINDING SITE II or BINDING SITE III. Table 2 illustrates the complementarity of the nucleotide sequences of FBXO21 BINDING SITE, designated SEQ ID:27319, to the nucleotide sequence of VGAM1864 RNA, herein designated VGAM RNA, also designated SEQ ID:4575.

Another function of VGAM1864 is therefore inhibition of F-box Only Protein 21 (FBXO21, Accession NM_033624). Accordingly, utilities of VGAM1864 include diagnosis, prevention and treatment of diseases and clinical conditions associated with FBXO21. FLJ12541 (Accession NM_022369) is another VGAM1864 host target gene. FLJ12541 BINDING SITE is HOST TARGET binding site found in the 3' untranslated region of mRNA encoded by FLJ12541, corresponding to a HOST TARGET binding site such as BINDING SITE I, BINDING SITE II or BINDING SITE III. Table 2 illustrates the complementarity of the nucleotide sequences of FLJ12541 BINDING SITE, designated SEQ ID:22758, to the nucleotide sequence of VGAM1864 RNA, herein designated VGAM RNA, also designated SEQ ID:4575.

Another function of VGAM1864 is therefore inhibition of FLJ12541 (Accession NM_022369). Accordingly, utilities of VGAM1864 include diagnosis, prevention and treatment of diseases and clinical conditions associated with FLJ12541. FLJ12816 (Accession NM_022060) is another VGAM1864 host target gene. FLJ12816 BINDING SITE is HOST TARGET binding site found in the 3' untranslated region of mRNA encoded by FLJ12816, corresponding to a HOST TARGET binding site such as BINDING SITE I, BINDING SITE II or BINDING SITE III. Table 2 illustrates the complementarity of the nucleotide sequences of FLJ12816 BINDING SITE, designated SEQ ID:22604, to the nucleotide sequence of VGAM1864 RNA, herein designated VGAM RNA, also designated SEQ ID:4575.

Another function of VGAM1864 is therefore inhibition of FLJ12816 (Accession NM_022060). Accordingly, utilities of VGAM1864 include diagnosis, prevention and treatment of diseases and clinical conditions associated with FLJ12816. FLJ13189 (Accession NM_024882) is another VGAM1864 host target gene. FLJ13189 BINDING SITE is HOST TAR- GET binding site found in the 3' untranslated region of mRNA encoded by FLJ13189, corresponding to a HOST TARGET binding site such as BINDING SITE I, BINDING SITE II or BINDING SITE III. Table 2 illustrates the complementarity of the nucleotide sequences of FLJ13189 BINDING SITE, designated SEQ ID:24329, to the nucleotide sequence of VGAM1864 RNA, herein designated VGAM RNA, also designated SEQ ID:4575.

Another function of VGAM1864 is therefore inhibition of FLJ13189 (Accession NM_024882). Accordingly, utilities of VGAM1864 include diagnosis, prevention and treatment of diseases and clinical conditions associated with FLJ13189. FLJ14803 (Accession NM_032842) is another VGAM1864 host target gene. FLJ14803 BINDING SITE is HOST TARGET binding site found in the 3' untranslated region of mRNA encoded by FLJ14803, corresponding to a HOST TARGET binding site such as BINDING SITE I, BINDING SITE II or BINDING SITE III. Table 2 illustrates the complementarity of the nucleotide sequences of FLJ14803 BINDING SITE, designated SEQ ID:26626, to the nucleotide sequence of VGAM1864 RNA, herein designated VGAM RNA, also designated SEQ ID:4575.

Another function of VGAM1864 is therefore inhibition of FLJ14803 (Accession NM_032842). Accordingly, utilities of VGAM1864 include diagnosis, prevention and treatment of diseases and clinical conditions associated with FLJ14803. FLJ20249 (Accession XM_086573) is another VGAM1864 host target gene. FLJ20249 BINDING SITE is HOST TARGET binding site found in the 3' untranslated region of mRNA encoded by FLJ20249, corresponding to a HOST TARGET binding site such as BINDING SITE I, BINDING SITE II or BINDING SITE III. Table 2 illustrates the complementarity of the nucleotide sequences of FLJ20249 BINDING SITE, designated SEQ ID:38773, to the nucleotide sequence of VGAM1864 RNA, herein designated VGAM RNA, also designated SEQ ID:4575.

Another function of VGAM1864 is therefore inhibition of FLJ20249 (Accession XM_086573). Accordingly, utilities of VGAM1864 include diagnosis, prevention and treatment of diseases and clinical conditions associated with FLJ20249. FLJ20695 (Accession NM_017929) is another VGAM1864 host target gene. FLJ20695 BINDING SITE is HOST TARGET binding site found in the 5' untranslated region of mRNA encoded by FLJ20695, corresponding to a HOST TARGET binding site such as BINDING SITE I, BINDING SITE II or BINDING SITE III. Table 2 illustrates the complementarity of the nucleotide sequences of FLJ20695 BINDING SITE, designated SEQ ID:19610, to the nucleotide sequence of VGAM1864 RNA, herein designated VGAM RNA, also designated SEQ ID:4575.

Another function of VGAM1864 is therefore inhibition of FLJ20695 (Accession NM_017929). Accordingly, utilities of VGAM1864 include diagnosis, prevention and treatment of diseases and clinical conditions associated with FLJ20695. FLJ20886 (Accession XM_170820) is another VGAM1864 host target gene. FLJ20886 BINDING SITE is HOST TARGET binding site found in the 5' untranslated region of mRNA encoded by FLJ20886, corresponding to a HOST TARGET binding site such as BINDING SITE I, BINDING SITE II or BINDING SITE III. Table 2 illustrates the complementarity of the nucleotide sequences of FLJ20886 BINDING SITE, designated SEQ ID:45596, to the nucleotide sequence of VGAM1864 RNA, herein designated VGAM RNA, also designated SEQ ID:4575.

Another function of VGAM1864 is therefore inhibition of FLJ20886 (Accession XM_170820). Accordingly, utilities of VGAM1864 include diagnosis, prevention and treatment of diseases and clinical conditions associated with FLJ20886. FLJ21313 (Accession NM_023927) is another VGAM1864 host target gene. FLJ21313 BINDING SITE is HOST TARGET binding site found in the 3' untranslated region of mRNA encoded by FLJ21313, corresponding to a HOST TARGET binding site such as BINDING SITE I, BINDING SITE II or BINDING SITE III. Table 2 illustrates the complementarity of the nucleotide sequences of FLJ21313 BINDING SITE, designated SEQ ID:23407, to the nucleotide sequence of VGAM1864 RNA, herein designated VGAM RNA, also designated SEQ ID:4575.

Another function of VGAM1864 is therefore inhibition of FLJ21313 (Accession NM_023927). Accordingly, utilities of VGAM1864 include diagnosis, prevention and treatment of diseases and clinical conditions associated with FLJ21313. FLJ23024 (Accession NM_024936) is another VGAM1864 host target gene. FLJ23024 BINDING SITE is HOST TARGET binding site found in the 3' untranslated region of mRNA encoded by FLJ23024, corresponding to a HOST TARGET binding site such as BINDING SITE I, BINDING SITE II or BINDING SITE III. Table 2 illustrates the complementarity of the nucleotide sequences of FLJ23024 BINDING SITE, designated SEQ ID:24473, to the nucleotide sequence of VGAM1864 RNA, herein designated VGAM RNA, also designated SEQ ID:4575.

Another function of VGAM1864 is therefore inhibition of FLJ23024 (Accession NM_024936). Accordingly, utilities of VGAM1864 include diagnosis, prevention and treatment of diseases and clinical conditions associated with FLJ23024. FLJ23441 (Accession NM_024678) is another VGAM1864 host target gene. FLJ23441 BINDING SITE is HOST TARGET binding site found in the 5' untranslated region of mRNA encoded by FLJ23441, corresponding to a HOST TARGET binding site such as BINDING SITE I, BINDING SITE II or BINDING SITE III. Table 2 illustrates the complementarity of the nucleotide sequences of FLJ23441 BINDING SITE, designated SEQ ID:23988, to the nucleotide sequence of VGAM1864 RNA, herein designated VGAM RNA, also designated SEQ ID:4575.

Another function of VGAM1864 is therefore inhibition of FLJ23441 (Accession NM_024678). Accordingly, utilities of VGAM1864 include diagnosis, prevention and treatment of diseases and clinical conditions associated with FLJ23441. Forkhead Box J1 (FOXJ1, Accession NM_001454) is another VGAM1864 host target gene. FOXJ1 BINDING SITE is HOST TARGET binding site found in the 5' untranslated region of mRNA encoded by FOXJ1, corresponding to a HOST TARGET binding site such as BINDING SITE I, BINDING SITE II or BINDING SITE III. Table 2 illustrates the complementarity of the nucleotide sequences of FOXJ1 BINDING SITE, designated SEQ ID:7189, to the nucleotide sequence of VGAM1864 RNA, herein designated VGAM RNA, also designated SEQ ID:4575.

Another function of VGAM1864 is therefore inhibition of Forkhead Box J1 (FOXJ1, Accession NM_001454). Accordingly, utilities of VGAM1864 include diagnosis, prevention and treatment of diseases and clinical conditions associated with FOXJ1. HYA22 (Accession NM_005808) is another VGAM1864 host target gene. HYA22 BINDING SITE is HOST TARGET binding site found in the 3' untranslated region of mRNA encoded by HYA22, corresponding to a HOST TARGET binding site such as BINDING SITE I, BINDING SITE II or BINDING SITE III. Table 2 illustrates the complementarity of the nucleotide sequences of HYA22 BINDING SITE, designated SEQ ID:12388, to the nucleotide sequence of VGAM1864 RNA, herein designated VGAM RNA, also designated SEQ ID:4575.

Another function of VGAM1864 is therefore inhibition of HYA22 (Accession NM_005808). Accordingly, utilities of VGAM1864 include diagnosis, prevention and treatment of diseases and clinical conditions associated with HYA22. IDI2 (Accession NM_033261) is another VGAM1864 host target gene. IDI2 BINDING SITE is HOST TARGET binding site found in the 3' untranslated region of mRNA encoded by IDI2, corresponding to a HOST TARGET binding site such as BINDING SITE I, BINDING SITE II or BINDING SITE III. Table 2 illustrates the complementarity of the nucleotide sequences of IDI2 BINDING SITE, designated SEQ ID:27092, to the nucleotide sequence of VGAM1864 RNA, herein designated VGAM RNA, also designated SEQ ID:4575.

Another function of VGAM1864 is therefore inhibition of IDI2 (Accession NM_033261). Accordingly, utilities of VGAM1864 include diagnosis, prevention and treatment of diseases and clinical conditions associated with IDI2. Potassium Inwardly-rectifying Channel, Subfamily J, Member 9 (KCNJ9, Accession NM_004983) is another VGAM1864 host target gene. KCNJ9 BINDING SITE is HOST TARGET binding site found in the 5' untranslated region of mRNA encoded by KCNJ9, corresponding to a HOST TARGET binding site such as BINDING SITE I, BINDING SITE II or BINDING SITE III. Table 2 illustrates the complementarity of the nucleotide sequences of KCNJ9 BINDING SITE, designated SEQ ID:11431, to the nucleotide sequence of VGAM1864 RNA, herein designated VGAM RNA, also designated SEQ ID:4575.

Another function of VGAM1864 is therefore inhibition of Potassium Inwardly-rectifying Channel, Subfamily J, Member 9 (KCNJ9, Accession NM_004983). Accordingly, utilities of VGAM1864 include diagnosis, prevention and treatment of diseases and clinical conditions associated with KCNJ9. KIAA0513 (Accession NM_014732) is another VGAM1864 host target gene. KIAA0513 BINDING SITE is HOST TARGET binding site found in the 3' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16363, to the nucleotide sequence of VGAM1864 RNA, herein designated VGAM RNA, also designated SEQ ID:4575.

Another function of VGAM1864 is therefore inhibition of KIAA0513 (Accession NM_014732). Accordingly, utilities of VGAM1864 include diagnosis, prevention and treatment of diseases and clinical conditions associated with KIAA0513. KIAA0515 (Accession XM_033380) is another VGAM1864 host target gene. KIAA0515 BINDING SITE is HOST TARGET binding site found in the 3' untranslated region of mRNA encoded by KIAA0515, corresponding to a HOST TARGET binding site such as BINDING SITE I, BINDING SITE II or BINDING SITE III. Table 2 illustrates the complementarity of the nucleotide sequences of KIAA0515 BINDING SITE, designated SEQ ID:31925, to the nucleotide sequence of VGAM1864 RNA, herein designated VGAM RNA, also designated SEQ ID:4575.

Another function of VGAM1864 is therefore inhibition of KIAA0515 (Accession XM_033380). Accordingly, utilities of VGAM1864 include diagnosis, prevention and treatment of diseases and clinical conditions associated with KIAA0515. KIAA0545 (Accession XM_032278) is another VGAM1864 host target gene. KIAA0545 BINDING SITE is HOST TARGET binding site found in the 3' untranslated region of mRNA encoded by KIAA0545, corresponding to a HOST TARGET binding site such as BINDING SITE I, BINDING SITE II or BINDING SITE III. Table 2 illustrates the complementarity of the nucleotide sequences of KIAA0545 BINDING SITE, designated SEQ ID:31637, to the nucleotide sequence of VGAM1864 RNA, herein designated VGAM RNA, also designated SEQ ID:4575.

Another function of VGAM1864 is therefore inhibition of KIAA0545 (Accession XM_032278). Accordingly, utilities of VGAM1864 include diagnosis, prevention and treatment of diseases and clinical conditions associated with KIAA0545. KIAA0792 (Accession NM_014698) is another VGAM1864 host target gene. KIAA0792 BINDING SITE is HOST TARGET binding site found in the 3' untranslated region of mRNA encoded by KIAA0792, corresponding to a HOST TARGET binding site such as BINDING SITE I, BINDING SITE II or BINDING SITE III. Table 2 illustrates the complementarity of the nucleotide sequences of KIAA0792 BINDING SITE, designated SEQ ID:16214, to the nucleotide sequence of VGAM1864 RNA, herein designated VGAM RNA, also designated SEQ ID:4575.

Another function of VGAM1864 is therefore inhibition of KIAA0792 (Accession NM_014698). Accordingly, utilities of VGAM1864 include diagnosis, prevention and treatment of diseases and clinical conditions associated with KIAA0792. KIAA0937 (Accession XM_166213) is another VGAM1864 host target gene. KIAA0937 BINDING SITE is HOST TARGET binding site found in the 3' untranslated region of mRNA encoded by KIAA0937, corresponding to a HOST TARGET binding site such as BINDING SITE I, BINDING SITE II or BINDING SITE III. Table 2 illustrates the complementarity of the nucleotide sequences of KIAA0937 BINDING SITE, designated SEQ ID:44014, to the nucleotide sequence of VGAM1864 RNA, herein designated VGAM RNA, also designated SEQ ID:4575.

Another function of VGAM1864 is therefore inhibition of KIAA0937 (Accession XM_166213). Accordingly, utilities of VGAM1864 include diagnosis, prevention and treatment of diseases and clinical conditions associated with KIAA0937. KIAA1126 (Accession XM_050325) is another VGAM1864 host target gene. KIAA1126 BINDING SITE is HOST TARGET binding site found in the 3' untranslated region of mRNA encoded by KIAA1126, corresponding to a HOST TARGET binding site such as BINDING SITE I, BINDING SITE II or BINDING SITE III. Table 2 illustrates the complementarity of the nucleotide sequences of KIAA1126 BINDING SITE, designated SEQ ID:35606, to the nucleotide sequence of VGAM1864 RNA, herein designated VGAM RNA, also designated SEQ ID:4575.

Another function of VGAM1864 is therefore inhibition of KIAA1126 (Accession XM_050325). Accordingly, utilities of VGAM1864 include diagnosis, prevention and treatment of diseases and clinical conditions associated with KIAA1126. KIAA1257 (Accession XM_031577) is another VGAM1864 host target gene. KIAA1257 BINDING SITE is HOST TARGET binding site found in the 3' untranslated region of mRNA encoded by KIAA1257, corresponding to a HOST TARGET binding site such as BINDING SITE I, BINDING SITE II or BINDING SITE III. Table 2 illustrates the complementarity of the nucleotide sequences of KIAA1257 BINDING SITE, designated SEQ ID:31435, to the nucleotide sequence of VGAM1864 RNA, herein designated VGAM RNA, also designated SEQ ID:4575.

Another function of VGAM1864 is therefore inhibition of KIAA1257 (Accession XM_031577). Accordingly, utilities of VGAM1864 include diagnosis, prevention and treatment of diseases and clinical conditions associated with KIAA1257. KIAA1363 (Accession XM_045056) is another VGAM1864 host target gene. KIAA1363 BINDING SITE is HOST TARGET binding site found in the 3' untranslated region of mRNA encoded by KIAA1363, corresponding to a HOST TARGET binding site such as BINDING SITE I, BINDING SITE II or BINDING SITE III. Table 2 illustrates the complementarity of the nucleotide sequences of KIAA1363 BINDING SITE, designated SEQ ID:34333, to the nucleotide sequence of VGAM1864 RNA, herein designated VGAM RNA, also designated SEQ ID:4575.

Another function of VGAM1864 is therefore inhibition of KIAA1363 (Accession XM_045056). Accordingly, utilities of VGAM1864 include diagnosis, prevention and treatment of diseases and clinical conditions associated with KIAA1363. KIAA1377 (Accession XM_040708) is another VGAM1864 host target gene. KIAA1377 BINDING SITE is HOST TARGET binding site found in the 5' untranslated region of mRNA encoded by KIAA1377, corresponding to a HOST TARGET binding site such as BINDING SITE I, BINDING SITE II or BINDING SITE III. Table 2 illustrates the complementarity of the nucleotide sequences of KIAA1377 BINDING SITE, designated SEQ ID:33360, to the nucleotide sequence of VGAM1864 RNA, herein designated VGAM RNA, also designated SEQ ID:4575.

Another function of VGAM1864 is therefore inhibition of KIAA1377 (Accession XM_040708). Accordingly, utilities of VGAM1864 include diagnosis, prevention and treatment of diseases and clinical conditions associated with KIAA1377. KIAA1509 (Accession XM_029353) is another VGAM1864 host target gene. KIAA1509 BINDING SITE is HOST TARGET binding site found in the 3' untranslated region of mRNA encoded by KIAA1509, corresponding to a HOST TARGET binding site such as BINDING SITE I, BINDING SITE II or BINDING SITE III. Table 2 illustrates the complementarity of the nucleotide sequences of KIAA1509 BINDING SITE, designated SEQ ID:30874, to the nucleotide sequence of VGAM1864 RNA, herein designated VGAM RNA, also designated SEQ ID:4575.

Another function of VGAM1864 is therefore inhibition of KIAA1509 (Accession XM_029353). Accordingly, utilities of VGAM1864 include diagnosis, prevention and treatment of diseases and clinical conditions associated with KIAA1509. KIAA1750 (Accession XM_043067) is another VGAM1864 host target gene. KIAA1750 BINDING SITE is HOST TARGET binding site found in the 3' untranslated region of mRNA encoded by KIAA1750, corresponding to a HOST TARGET binding site such as BINDING SITE I, BINDING SITE II or BINDING SITE III. Table 2 illustrates the complementarity of the nucleotide sequences of KIAA1750 BINDING SITE, designated SEQ ID:33876, to the nucleotide sequence of VGAM1864 RNA, herein designated VGAM RNA, also designated SEQ ID:4575.

Another function of VGAM1864 is therefore inhibition of KIAA1750 (Accession XM_043067). Accordingly, utilities of VGAM1864 include diagnosis, prevention and treatment of diseases and clinical conditions associated with KIAA1750. LIM and SH3 Protein 1 (LASP1, Accession NM_006148) is another VGAM1864 host target gene. LASP1 BINDING SITE is HOST TARGET binding site found in the 3' untranslated region of mRNA encoded by LASP1, corresponding to a HOST TARGET binding site such as BINDING SITE I, BINDING SITE II or BINDING SITE III. Table 2 illustrates the complementarity of the nucleotide sequences of LASP1 BINDING SITE, designated SEQ ID:12800, to the nucleotide sequence of VGAM1864 RNA, herein designated VGAM RNA, also designated SEQ ID:4575.

Another function of VGAM1864 is therefore inhibition of LIM and SH3 Protein 1 (LASP1, Accession NM_006148). Accordingly, utilities of VGAM1864 include diagnosis, prevention and treatment of diseases and clinical conditions associated with LASP1. Leiomodin 1 (smooth muscle) (LMOD1, Accession NM_012134) is another VGAM1864 host target gene. LMOD1 BINDING SITE is HOST TARGET binding site found in the 3' untranslated region of mRNA encoded by LMOD1, corresponding to a HOST TARGET binding site such as BINDING SITE I, BINDING SITE II or BINDING SITE III. Table 2 illustrates the complementarity of the nucleotide sequences of LMOD1 BINDING SITE, designated SEQ ID:14446, to the nucleotide sequence of VGAM1864 RNA, herein designated VGAM RNA, also designated SEQ ID:4575.

Another function of VGAM1864 is therefore inhibition of Leiomodin 1 (smooth muscle) (LMOD1, Accession NM_012134). Accordingly, utilities of VGAM1864 include diagnosis, prevention and treatment of diseases and clinical conditions associated with LMOD1. Mitogen-activated Protein Kinase 13 (MAPK13, Accession NM_002754) is another VGAM1864 host target gene. MAPK13 BINDING SITE is HOST TARGET binding site found in the 3' untranslated region of mRNA encoded by MAPK13, corresponding to a HOST TARGET binding site such as BINDING SITE I, BINDING SITE II or BINDING SITE III. Table 2 illustrates the complementarity of the nucleotide sequences of MAPK13 BINDING SITE, designated SEQ ID:8632, to the nucleotide sequence of VGAM1864 RNA, herein designated VGAM RNA, also designated SEQ ID:4575.

Another function of VGAM1864 is therefore inhibition of Mitogen-activated Protein Kinase 13 (MAPK13, Accession NM_002754). Accordingly, utilities of VGAM1864 include diagnosis, prevention and treatment of diseases and clinical conditions associated with MAPK13. MEP50 (Accession NM_024102) is another VGAM1864 host target gene. MEP50 BINDING SITE is HOST TARGET binding site found in the 3' untranslated region of mRNA encoded by MEP50, corresponding to a HOST TARGET binding site such as BINDING SITE I, BINDING SITE II or BINDING SITE III. Table 2 illustrates the complementarity of the nucleotide sequences of MEP50 BINDING SITE, designated SEQ ID:23546, to the nucleotide sequence of VGAM1864 RNA, herein designated VGAM RNA, also designated SEQ ID:4575.

Another function of VGAM1864 is therefore inhibition of MEP50 (Accession NM_024102). Accordingly, utilities of VGAM1864 include diagnosis, prevention and treatment of diseases and clinical conditions associated with MEP50. PDEF (Accession NM_012391) is another VGAM1864 host target gene. PDEF BINDING SITE is HOST TARGET binding site found in the 5' untranslated region of mRNA encoded by PDEF, corresponding to a HOST TARGET binding site such as BINDING SITE I, BINDING SITE II or BINDING SITE III. Table 2 illustrates the complementarity of the nucleotide sequences of PDEF BINDING SITE, designated SEQ ID:14747, to the nucleotide sequence of VGAM1864 RNA, herein designated VGAM RNA, also designated SEQ ID:4575.

Another function of VGAM1864 is therefore inhibition of PDEF (Accession NM_012391). Accordingly, utilities of VGAM1864 include diagnosis, prevention and treatment of diseases and clinical conditions associated with PDEF. PHD Finger Protein 7 (PHF7, Accession NM_016483) is another VGAM1864 host target gene. PHF7 BINDING SITE is HOST TARGET binding site found in the 5' untranslated region of mRNA encoded by PHF7, corresponding to a HOST TARGET binding site such as BINDING SITE I, BINDING SITE II or BINDING SITE III. Table 2 illustrates the complementarity of the nucleotide sequences of PHF7 BINDING SITE, designated SEQ ID:18581, to the nucleotide sequence of VGAM1864 RNA, herein designated VGAM RNA, also designated SEQ ID:4575.

Another function of VGAM1864 is therefore inhibition of PHD Finger Protein 7 (PHF7, Accession NM_016483). Accordingly, utilities of VGAM1864 include diagnosis, prevention and treatment of diseases and clinical conditions associated with PHF7. PPI5PIV (Accession NM_019892) is another VGAM1864 host target gene. PPI5PIV BINDING SITE is HOST TARGET binding site found in the 3' untranslated region of mRNA encoded by PPI5PIV, corresponding to a HOST TARGET binding site such as BINDING SITE I, BINDING SITE II or BINDING SITE III. Table 2 illustrates the complementarity of the nucleotide sequences of PPI5PIV BINDING SITE, designated SEQ ID:21275, to the nucleotide sequence of VGAM1864 RNA, herein designated VGAM RNA, also designated SEQ ID:4575.

Another function of VGAM1864 is therefore inhibition of PPI5PIV (Accession NM_019892). Accordingly, utilities of VGAM1864 include diagnosis, prevention and treatment of diseases and clinical conditions associated with PPI5PIV. Protease, Serine, 25 (PRSS25, Accession NM_013247) is another VGAM1864 host target gene. PRSS25 BINDING SITE1 and PRSS25 BINDING SITE2 are HOST TARGET binding sites found in untranslated regions of mRNA encoded by PRSS25, corresponding to HOST TARGET binding sites such as BINDING SITE I, BINDING SITE II or BINDING SITE III. Table 2 illustrates the complementarity of the nucleotide sequences of PRSS25 BINDING SITE1 and PRSS25 BINDING SITE2, designated SEQ ID:14908 and SEQ ID:29707 respectively, to the nucleotide sequence of VGAM1864 RNA, herein designated VGAM RNA, also designated SEQ ID:4575.

Another function of VGAM1864 is therefore inhibition of Protease, Serine, 25 (PRSS25, Accession NM_013247). Accordingly, utilities of VGAM1864 include diagnosis, prevention and treatment of diseases and clinical conditions associated with PRSS25. SARM (Accession NM_015077) is another VGAM1864 host target gene. SARM BINDING SITE is HOST TARGET binding site found in the 3' untranslated region of mRNA encoded by SARM, corresponding to a HOST TARGET binding site such as BINDING SITE I, BINDING SITE II or BINDING SITE III. Table 2 illustrates the complementarity of the nucleotide sequences of SARM BINDING SITE, designated SEQ ID:17454, to the nucleotide sequence of VGAM1864 RNA, herein designated VGAM RNA, also designated SEQ ID:4575.

Another function of VGAM1864 is therefore inhibition of SARM (Accession NM_015077). Accordingly, utilities of VGAM1864 include diagnosis, prevention and treatment of diseases and clinical conditions associated with SARM. Syndecan 3 (N-syndecan) (SDC3, Accession NM_014654) is another VGAM1864 host target gene. SDC3 BINDING SITE is HOST TARGET binding site found in the 5' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16080, to the nucleotide sequence of VGAM1864 RNA, herein designated VGAM RNA, also designated SEQ ID:4575.

Another function of VGAM1864 is therefore inhibition of Syndecan 3 (N-syndecan) (SDC3, Accession NM_014654). Accordingly, utilities of VGAM1864 include diagnosis, prevention and treatment of diseases and clinical conditions associated with SDC3. SKIP (Accession NM_016532) is another VGAM1864 host target gene. SKIP BINDING SITE1 and SKIP BINDING SITE2 are HOST TARGET binding sites found in untranslated regions of mRNA encoded by SKIP, corresponding to HOST TARGET binding sites such as BINDING SITE I, BINDING SITE II or BINDING SITE III. Table 2 illustrates the complementarity of the nucleotide sequences of SKIP BINDING SITE1 and SKIP BINDING SITE2, designated SEQ ID:18596 and SEQ ID:28259 respectively, to the nucleotide sequence of VGAM1864 RNA, herein designated VGAM RNA, also designated SEQ ID:4575.

Another function of VGAM1864 is therefore inhibition of SKIP (Accession NM_016532). Accordingly, utilities of VGAM1864 include diagnosis, prevention and treatment of diseases and clinical conditions associated with SKIP. TED (Accession NM_015686) is another VGAM1864 host target gene. TED BINDING SITE is HOST TARGET binding site found in the 3' untranslated region of mRNA encoded by TED, corresponding to a HOST TARGET binding site such as BINDING SITE I, BINDING SITE II or BINDING SITE III. Table 2 illustrates the complementarity of the nucleotide sequences of TED BINDING SITE, designated SEQ ID:17912, to the nucleotide sequence of VGAM1864 RNA, herein designated VGAM RNA, also designated SEQ ID:4575.

Another function of VGAM1864 is therefore inhibition of TED (Accession NM_015686). Accordingly, utilities of VGAM1864 include diagnosis, prevention and treatment of diseases and clinical conditions associated with TED. Translocase of Outer Mitochondrial Membrane 70 Homolog A (yeast) (TOMM70A, Accession NM_014820) is another VGAM1864 host target gene. TOMM70A BINDING SITE is HOST TARGET binding site found in the 3' untranslated region of mRNA encoded by TOMM70A, corresponding to a HOST TARGET binding site such as BINDING SITE I, BINDING SITE II or BINDING SITE III. Table 2 illustrates the complementarity of the nucleotide sequences of TOMM70A BINDING SITE, designated SEQ ID:16792, to the nucleotide sequence of VGAM1864 RNA, herein designated VGAM RNA, also designated SEQ ID:4575.

Another function of VGAM1864 is therefore inhibition of Translocase of Outer Mitochondrial Membrane 70 Homolog A (yeast) (TOMM70A, Accession NM_014820). Accordingly, utilities of VGAM1864 include diagnosis, prevention and treatment of diseases and clinical conditions associated with TOMM70A. Zinc Finger Protein 313 (ZNF313, Accession NM_018683) is another VGAM1864 host target gene. ZNF313 BINDING SITE is HOST TARGET binding site found in the 3' untranslated region of mRNA encoded by ZNF313, corresponding to a HOST TARGET binding site such as BINDING SITE I, BINDING SITE II or BINDING SITE III. Table 2 illustrates the complementarity of the nucleotide sequences of ZNF313 BINDING SITE, designated SEQ ID:20753, to the nucleotide sequence of VGAM1864 RNA, herein designated VGAM RNA, also designated SEQ ID:4575.

Another function of VGAM1864 is therefore inhibition of Zinc Finger Protein 313 (ZNF313, Accession NM_018683). Accordingly, utilities of VGAM1864 include diagnosis, prevention and treatment of diseases and clinical conditions associated with ZNF313. LOC124044 (Accession XM_071871) is another VGAM1864 host target gene. LOC124044 BINDING SITE is HOST TARGET binding site found in the 3' untranslated region of mRNA encoded by LOC124044, corresponding to a HOST TARGET binding site such as BINDING SITE I, BINDING SITE II or BINDING SITE III. Table 2 illustrates the complementarity of the nucleotide sequences of LOC124044 BINDING SITE, designated SEQ ID:37432, to the nucleotide sequence of VGAM1864 RNA, herein designated VGAM RNA, also designated SEQ ID:4575.

Another function of VGAM1864 is therefore inhibition of LOC124044 (Accession XM_071871). Accordingly, utilities of VGAM1864 include diagnosis, prevention and treatment of diseases and clinical conditions associated with LOC124044. LOC124997 (Accession XM_058886) is another VGAM1864 host target gene. LOC124997 BINDING SITE is HOST TARGET binding site found in the 5' untranslated region of mRNA encoded by LOC124997, corresponding to a HOST TARGET binding site such as BINDING SITE I, BINDING SITE II or BINDING SITE III. Table 2 illustrates the complementarity of the nucleotide sequences of LOC124997 BINDING SITE, designated SEQ ID:36786, to the nucleotide sequence of VGAM1864 RNA, herein designated VGAM RNA, also designated SEQ ID:4575.

Another function of VGAM1864 is therefore inhibition of LOC124997 (Accession XM_058886). Accordingly, utilities of VGAM1864 include diagnosis, prevention and treatment of diseases and clinical conditions associated with LOC124997. LOC126006 (Accession XM_058956) is another VGAM1864 host target gene. LOC126006 BINDING SITE is HOST TARGET binding site found in the 5' untranslated region of mRNA encoded by LOC126006, corresponding to a HOST TARGET binding site such as BINDING SITE I, BINDING SITE II or BINDING SITE III. Table 2 illustrates the complementarity of the nucleotide sequences of LOC126006 BINDING SITE, designated SEQ ID:36801, to the nucleotide sequence of VGAM1864 RNA, herein designated VGAM RNA, also designated SEQ ID:4575.

Another function of VGAM1864 is therefore inhibition of LOC126006 (Accession XM_058956). Accordingly, utilities of VGAM1864 include diagnosis, prevention and treatment of diseases and clinical conditions associated with LOC126006. LOC130813 (Accession XM_065904) is another VGAM1864 host target gene. LOC130813 BINDING SITE is HOST TARGET binding site found in the 3' untranslated region of mRNA encoded by LOC130813, corresponding to a HOST TARGET binding site such as BINDING SITE I, BINDING SITE II or BINDING SITE III. Table 2 illustrates the complementarity of the nucleotide sequences of LOC130813 BINDING SITE, designated SEQ ID:37312, to the nucleotide sequence of VGAM1864 RNA, herein designated VGAM RNA, also designated SEQ ID:4575.

Another function of VGAM1864 is therefore inhibition of LOC130813 (Accession XM_065904). Accordingly, utilities of VGAM1864 include diagnosis, prevention and treatment of diseases and clinical conditions associated with LOC130813. LOC145371 (Accession XM_085123) is another VGAM1864 host target gene. LOC145371 BINDING SITE is HOST TARGET binding site found in the 3' untranslated region of mRNA encoded by LOC145371, corresponding to a HOST TARGET binding site such as BINDING SITE I, BINDING SITE II or BINDING SITE III. Table 2 illustrates the complementarity of the nucleotide sequences of LOC145371 BINDING SITE, designated SEQ ID:37841, to the nucleotide sequence of VGAM1864 RNA, herein designated VGAM RNA, also designated SEQ ID:4575.

Another function of VGAM1864 is therefore inhibition of LOC145371 (Accession XM_085123). Accordingly, utilities of VGAM1864 include diagnosis, prevention and treatment of diseases and clinical conditions associated with LOC145371. LOC145438 (Accession XM_096781) is another VGAM1864 host target gene. LOC145438 BINDING SITE is HOST TARGET binding site found in the 5' untranslated region of mRNA encoded by LOC145438, corresponding to a HOST TARGET binding site such as BINDING SITE I, BINDING SITE II or BINDING SITE III. Table 2 illustrates the complementarity of the nucleotide sequences of LOC145438 BINDING SITE, designated SEQ ID:40535, to the nucleotide sequence of VGAM1864 RNA, herein designated VGAM RNA, also designated SEQ ID:4575.

Another function of VGAM1864 is therefore inhibition of LOC145438 (Accession XM_096781). Accordingly, utilities of VGAM1864 include diagnosis, prevention and treatment of diseases and clinical conditions associated with LOC145438. LOC146728 (Accession XM_097074) is another VGAM1864 host target gene. LOC146728 BINDING SITE is HOST TARGET binding site found in the 5' untranslated region of mRNA encoded by LOC146728, corresponding to a HOST TARGET binding site such as BINDING SITE I, BINDING SITE II or BINDING SITE III. Table 2 illustrates the complementarity of the nucleotide sequences of LOC146728 BINDING SITE, designated SEQ ID:40724, to the nucleotide sequence of VGAM1864 RNA, herein designated VGAM RNA, also designated SEQ ID:4575.

Another function of VGAM1864 is therefore inhibition of LOC146728 (Accession XM_097074). Accordingly, utilities of VGAM1864 include diagnosis, prevention and treatment of diseases and clinical conditions associated with LOC146728. LOC148397 (Accession XM_086171) is another VGAM1864 host target gene. LOC148397 BINDING SITE is HOST TARGET binding site found in the 3' untranslated region of mRNA encoded by LOC148397, corresponding to a HOST TARGET binding site such as BINDING SITE I, BINDING SITE II or BINDING SITE III. Table 2 illustrates the complementarity of the nucleotide sequences of LOC148397 BINDING SITE, designated SEQ ID:38526, to the nucleotide sequence of VGAM1864 RNA, herein designated VGAM RNA, also designated SEQ ID:4575.

Another function of VGAM1864 is therefore inhibition of LOC148397 (Accession XM_086171). Accordingly, utilities of VGAM1864 include diagnosis, prevention and treatment of diseases and clinical conditions associated with LOC148397. LOC149171 (Accession XM_086450) is another VGAM1864 host target gene. LOC149171 BINDING SITE is HOST TARGET binding site found in the 5' untranslated region of mRNA encoded by LOC149171, corresponding to a HOST TARGET binding site such as BINDING SITE I, BINDING SITE II or BINDING SITE III. Table 2 illustrates the complementarity of the nucleotide sequences of LOC149171 BINDING SITE, designated SEQ ID:38667, to the nucleotide sequence of VGAM1864 RNA, herein designated VGAM RNA, also designated SEQ ID:4575.

Another function of VGAM1864 is therefore inhibition of LOC149171 (Accession XM_086450). Accordingly, utilities of VGAM1864 include diagnosis, prevention and treatment of diseases and clinical conditions associated with LOC149171. LOC149706 (Accession XM_097718) is another VGAM1864 host target gene. LOC149706 BINDING SITE is HOST TARGET binding site found in the 5' untranslated region of mRNA encoded by LOC149706, corresponding to a HOST TARGET binding site such as BINDING SITE I, BINDING SITE II or BINDING SITE III. Table 2 illustrates the complementarity of the nucleotide sequences of LOC149706 BINDING SITE, designated SEQ ID:41058, to the nucleotide sequence of VGAM1864 RNA, herein designated VGAM RNA, also designated SEQ ID:4575.

Another function of VGAM1864 is therefore inhibition of LOC149706 (Accession XM_097718). Accordingly, utilities of VGAM1864 include diagnosis, prevention and treatment of diseases and clinical conditions associated with LOC149706. LOC152805 (Accession XM_087526) is another VGAM1864 host target gene. LOC152805 BINDING SITE is HOST TARGET binding site found in the 5' untranslated region of mRNA encoded by LOC152805, corresponding to a HOST TARGET binding site such as BINDING SITE I, BINDING SITE II or BINDING SITE III. Table 2 illustrates the complementarity of the nucleotide sequences of LOC152805 BINDING SITE, designated SEQ ID:39323, to the nucleotide sequence of VGAM1864 RNA, herein designated VGAM RNA, also designated SEQ ID:4575.

Another function of VGAM1864 is therefore inhibition of LOC152805 (Accession XM_087526). Accordingly, utilities of VGAM1864 include diagnosis, prevention and treatment of diseases and clinical conditions associated with LOC152805. LOC153577 (Accession XM_098394) is another VGAM1864 host target gene. LOC153577 BINDING SITE is HOST TARGET binding site found in the 3' untranslated region of mRNA encoded by LOC153577, corresponding to a HOST TARGET binding site such as BINDING SITE I, BINDING SITE II or BINDING SITE III. Table 2 illustrates the complementarity of the nucleotide sequences of LOC153577 BINDING SITE, designated SEQ ID:41646, to the nucleotide sequence of VGAM1864 RNA, herein designated VGAM RNA, also designated SEQ ID:4575.

Another function of VGAM1864 is therefore inhibition of LOC153577 (Accession XM_098394). Accordingly, utilities of VGAM1864 include diagnosis, prevention and treatment of diseases and clinical conditions associated with LOC153577. LOC157349 (Accession XM_088298) is another VGAM1864 host target gene. LOC157349 BINDING SITE is HOST TARGET binding site found in the 5' untranslated region of mRNA encoded by LOC157349, corresponding to a HOST TARGET binding site such as BINDING SITE I, BINDING SITE II or BINDING SITE III. Table 2 illustrates the complementarity of the nucleotide sequences of LOC157349 BINDING SITE, designated SEQ ID:39598, to the nucleotide sequence of VGAM1864 RNA, herein designated VGAM RNA, also designated SEQ ID:4575.

Another function of VGAM1864 is therefore inhibition of LOC157349 (Accession XM_088298). Accordingly, utilities of VGAM1864 include diagnosis, prevention and treatment of diseases and clinical conditions associated with LOC157349. LOC157858 (Accession XM_098833) is another VGAM1864 host target gene. LOC157858 BINDING SITE is HOST TARGET binding site found in the 3' untranslated region of mRNA encoded by LOC157858, corresponding to a HOST TARGET binding site such as BINDING SITE I, BINDING SITE II or BINDING SITE III. Table 2 illustrates the complementarity of the nucleotide sequences of LOC157858 BINDING SITE, designated SEQ ID:41865, to the nucleotide sequence of VGAM1864 RNA, herein designated VGAM RNA, also designated SEQ ID:4575.

Another function of VGAM1864 is therefore inhibition of LOC157858 (Accession XM_098833). Accordingly, utilities of VGAM1864 include diagnosis, prevention and treatment of diseases and clinical conditions associated with LOC157858. LOC164382 (Accession XM_104390) is another VGAM1864 host target gene. LOC164382 BINDING SITE is HOST TARGET binding site found in the 3' untranslated region of mRNA encoded by LOC164382, corresponding to a HOST TARGET binding site such as BINDING SITE I, BINDING SITE II or BINDING SITE III. Table 2 illustrates the complementarity of the nucleotide sequences of LOC164382 BINDING SITE, designated SEQ ID:42160, to the nucleotide sequence of VGAM1864 RNA, herein designated VGAM RNA, also designated SEQ ID:4575.

Another function of VGAM1864 is therefore inhibition of LOC164382 (Accession XM_104390). Accordingly, utilities of VGAM1864 include diagnosis, prevention and treatment of diseases and clinical conditions associated with LOC164382. LOC166042 (Accession XM_093623) is another VGAM1864 host target gene. LOC166042 BINDING SITE is HOST TARGET binding site found in the 5' untranslated region of mRNA encoded by LOC166042, corresponding to a HOST TARGET binding site such as BINDING SITE I, BINDING SITE II or BINDING SITE III. Table 2 illustrates the complementarity of the nucleotide sequences of LOC166042 BINDING SITE, designated SEQ ID:40200, to the nucleotide sequence of VGAM1864 RNA, herein designated VGAM RNA, also designated SEQ ID:4575.

Another function of VGAM1864 is therefore inhibition of LOC166042 (Accession XM_093623). Accordingly, utilities of VGAM1864 include diagnosis, prevention and treatment of diseases and clinical conditions associated with LOC166042. LOC196707 (Accession XM_113616) is another VGAM1864 host target gene. LOC196707 BINDING SITE is HOST TARGET binding site found in the 3' untranslated region of mRNA encoded by LOC196707, corresponding to a HOST TARGET binding site such as BINDING SITE I, BINDING SITE II or BINDING SITE III. Table 2 illustrates the complementarity of the nucleotide sequences of LOC196707 BINDING SITE, designated SEQ ID:42297, to the nucleotide sequence of VGAM1864 RNA, herein designated VGAM RNA, also designated SEQ ID:4575.

Another function of VGAM1864 is therefore inhibition of LOC196707 (Accession XM_113616). Accordingly, utilities of VGAM1864 include diagnosis, prevention and treatment of diseases and clinical conditions associated with LOC196707. LOC199923 (Accession XM_114057) is another VGAM1864 host target gene. LOC199923 BINDING SITE is HOST TARGET binding site found in the 5' untranslated region of mRNA encoded by LOC199923, corresponding to a HOST TARGET binding site such as BINDING SITE I, BINDING SITE II or BINDING SITE III. Table 2 illustrates the complementarity of the nucleotide sequences of LOC199923 BINDING SITE, designated SEQ ID:42670, to the nucleotide sequence of VGAM1864 RNA, herein designated VGAM RNA, also designated SEQ ID:4575.

Another function of VGAM1864 is therefore inhibition of LOC199923 (Accession XM_114057). Accordingly, utilities of VGAM1864 include diagnosis, prevention and treatment of diseases and clinical conditions associated with LOC199923. LOC200470 (Accession XM_117235) is another VGAM1864 host target gene. LOC200470 BINDING SITE is HOST TARGET binding site found in the 5' untranslated region of mRNA encoded by LOC200470, corresponding to a HOST TARGET binding site such as BINDING SITE I, BINDING SITE II or BINDING SITE III. Table 2 illustrates the complementarity of the nucleotide sequences of LOC200470 BINDING SITE, designated SEQ ID:43306, to the nucleotide sequence of VGAM1864 RNA, herein designated VGAM RNA, also designated SEQ ID:4575.

Another function of VGAM1864 is therefore inhibition of LOC200470 (Accession XM_117235). Accordingly, utilities of VGAM1864 include diagnosis, prevention and treatment of diseases and clinical conditions associated with LOC200470. LOC201617 (Accession XM_117315) is another VGAM1864 host target gene. LOC201617 BINDING SITE is HOST TARGET binding site found in the 3' untranslated region of mRNA encoded by LOC201617, corresponding to a HOST TARGET binding site such as BINDING SITE I, BINDING SITE II or BINDING SITE III. Table 2 illustrates the complementarity of the nucleotide sequences of LOC201617 BINDING SITE, designated SEQ ID:43380, to the nucleotide sequence of VGAM1864 RNA, herein designated VGAM RNA, also designated SEQ ID:4575.

Another function of VGAM1864 is therefore inhibition of LOC201617 (Accession XM_117315). Accordingly, utilities of VGAM1864 include diagnosis, prevention and treatment of diseases and clinical conditions associated with LOC201617. LOC202126 (Accession XM_117362) is another VGAM1864 host target gene. LOC202126 BINDING SITE is HOST TARGET binding site found in the 3' untranslated region of mRNA encoded by LOC202126, corresponding to a HOST TARGET binding site such as BINDING SITE I, BINDING SITE II or BINDING SITE III. Table 2 illustrates the complementarity of the nucleotide sequences of LOC202126 BINDING SITE, designated SEQ ID:43410, to the nucleotide sequence of VGAM1864 RNA, herein designated VGAM RNA, also designated SEQ ID:4575.

Another function of VGAM1864 is therefore inhibition of LOC202126 (Accession XM_117362). Accordingly, utilities of VGAM1864 include diagnosis, prevention and treatment of diseases and clinical conditions associated with LOC202126. LOC203504 (Accession XM_117550) is another VGAM1864 host target gene. LOC203504 BINDING SITE is HOST TARGET binding site found in the 5' untranslated region of mRNA encoded by LOC203504, corresponding to a HOST TARGET binding site such as BINDING SITE I, BINDING SITE II or BINDING SITE III. Table 2 illustrates the complementarity of the nucleotide sequences of LOC203504 BINDING SITE, designated SEQ ID:43572, to the nucleotide sequence of VGAM1864 RNA, herein designated VGAM RNA, also designated SEQ ID:4575.

Another function of VGAM1864 is therefore inhibition of LOC203504 (Accession XM_117550). Accordingly, utilities of VGAM1864 include diagnosis, prevention and treatment of diseases and clinical conditions associated with LOC203504. LOC204161 (Accession XM_118480) is another VGAM1864 host target gene. LOC204161 BINDING SITE1 and LOC204161 BINDING SITE2 are HOST TARGET binding sites found in untranslated regions of mRNA encoded by LOC204161, corresponding to HOST TARGET binding sites such as BINDING SITE I, BINDING SITE II or BINDING SITE III. Table 2 illustrates the complementarity of the nucleotide sequences of LOC204161 BINDING SITE1 and LOC204161 BINDING SITE2, designated SEQ ID:43579 and SEQ ID:43580 respectively, to the nucleotide sequence of VGAM1864 RNA, herein designated VGAM RNA, also designated SEQ ID:4575.

Another function of VGAM1864 is therefore inhibition of LOC204161 (Accession XM_118480). Accordingly, utilities of VGAM1864 include diagnosis, prevention and treatment of diseases and clinical conditions associated with LOC204161. LOC221463 (Accession XM_166374) is another VGAM1864 host target gene. LOC221463 BINDING SITE is HOST TARGET binding site found in the 3' untranslated region of mRNA encoded by LOC221463, corresponding to a HOST TARGET binding site such as BINDING SITE I, BINDING SITE II or BINDING SITE III. Table 2 illustrates the complementarity of the nucleotide sequences of LOC221463 BINDING SITE, designated SEQ ID:44199, to the nucleotide sequence of VGAM1864 RNA, herein designated VGAM RNA, also designated SEQ ID:4575.

Another function of VGAM1864 is therefore inhibition of LOC221463 (Accession XM_166374). Accordingly, utilities of VGAM1864 include diagnosis, prevention and treatment of diseases and clinical conditions associated with LOC221463. LOC221490 (Accession XM_168084) is another VGAM1864 host target gene. LOC221490 BINDING SITE is HOST TARGET binding site found in the 5' untranslated region of mRNA encoded by LOC221490, corresponding to a HOST TARGET binding site such as BINDING SITE I, BINDING SITE II or BINDING SITE III. Table 2 illustrates the complementarity of the nucleotide sequences of LOC221490 BINDING SITE, designated SEQ ID:44987, to the nucleotide sequence of VGAM1864 RNA, herein designated VGAM RNA, also designated SEQ ID:4575.

Another function of VGAM1864 is therefore inhibition of LOC221490 (Accession XM_168084). Accordingly, utilities of VGAM1864 include diagnosis, prevention and treatment of diseases and clinical conditions associated with LOC221490. LOC253675 (Accession XM_172990) is another VGAM1864 host target gene. LOC253675 BINDING SITE is HOST TARGET binding site found in the 5' untranslated region of mRNA encoded by LOC253675, corresponding to a HOST TARGET binding site such as BINDING SITE I, BINDING SITE II or BINDING SITE III. Table 2 illustrates the complementarity of the nucleotide sequences of LOC253675 BINDING SITE, designated SEQ ID:46263, to the nucleotide sequence of VGAM1864 RNA, herein designated VGAM RNA, also designated SEQ ID:4575.

Another function of VGAM1864 is therefore inhibition of LOC253675 (Accession XM_172990). Accordingly, utilities of VGAM1864 include diagnosis, prevention and treatment of diseases and clinical conditions associated with LOC253675. LOC253891 (Accession XM_170485) is another VGAM1864 host target gene. LOC253891 BINDING SITE is HOST TARGET binding site found in the 3' untranslated region of mRNA encoded by LOC253891, corresponding to a HOST TARGET binding site such as BINDING SITE I, BINDING SITE II or BINDING SITE III. Table 2 illustrates the complementarity of the nucleotide sequences of LOC253891 BINDING SITE, designated SEQ ID:45323, to the nucleotide sequence of VGAM1864 RNA, herein designated VGAM RNA, also designated SEQ ID:4575.

Another function of VGAM1864 is therefore inhibition of LOC253891 (Accession XM_170485). Accordingly, utilities of VGAM1864 include diagnosis, prevention and treatment of diseases and clinical conditions associated with LOC253891. LOC254228 (Accession XM_171123) is another VGAM1864 host target gene. LOC254228 BINDING SITE is HOST TARGET binding site found in the 3' untranslated region of mRNA encoded by LOC254228, corresponding to a HOST TARGET binding site such as BINDING SITE I, BINDING SITE II or BINDING SITE III. Table 2 illustrates the complementarity of the nucleotide sequences of LOC254228 BINDING SITE, designated SEQ ID:45920, to the nucleotide sequence of VGAM1864 RNA, herein designated VGAM RNA, also designated SEQ ID:4575.

Another function of VGAM1864 is therefore inhibition of LOC254228 (Accession XM_171123). Accordingly, utilities of VGAM1864 include diagnosis, prevention and treatment of diseases and clinical conditions associated with LOC254228. LOC255189 (Accession XM_172929) is another VGAM1864 host target gene. LOC255189 BINDING SITE is HOST TARGET binding site found in the 5' untranslated region of mRNA encoded by LOC255189, corresponding to a HOST TARGET binding site such as BINDING SITE I, BINDING SITE II or BINDING SITE III. Table 2 illustrates the complementarity of the nucleotide sequences of LOC255189 BINDING SITE, designated SEQ ID:46194, to the nucleotide sequence of VGAM1864 RNA, herein designated VGAM RNA, also designated SEQ ID:4575.

Another function of VGAM1864 is therefore inhibition of LOC255189 (Accession XM_172929). Accordingly, utilities of VGAM1864 include diagnosis, prevention and treatment of diseases and clinical conditions associated with LOC255189. LOC256502 (Accession XM_170546) is another VGAM1864 host target gene. LOC256502 BINDING SITE is HOST TARGET binding site found in the 3' untranslated region of mRNA encoded by LOC256502, corresponding to a HOST TARGET binding site such as BINDING SITE I, BINDING SITE II or BINDING SITE III. Table 2 illustrates the complementarity of the nucleotide sequences of LOC256502 BINDING SITE, designated SEQ ID:45367, to the nucleotide sequence of VGAM1864 RNA, herein designated VGAM RNA, also designated SEQ ID:4575.

Another function of VGAM1864 is therefore inhibition of LOC256502 (Accession XM_170546). Accordingly, utilities of VGAM1864 include diagnosis, prevention and treatment of diseases and clinical conditions associated with LOC256502. LOC256581 (Accession XM_174399) is another VGAM1864 host target gene. LOC256581 BINDING SITE is HOST TARGET binding site found in the 5' untranslated region of mRNA encoded by LOC256581, corresponding to a HOST TARGET binding site such as BINDING SITE I, BINDING SITE II or BINDING SITE III. Table 2 illustrates the complementarity of the nucleotide sequences of LOC256581 BINDING SITE, designated SEQ ID:46591, to the nucleotide sequence of VGAM1864 RNA, herein designated VGAM RNA, also designated SEQ ID:4575.

Another function of VGAM1864 is therefore inhibition of LOC256581 (Accession XM_174399). Accordingly, utilities of VGAM1864 include diagnosis, prevention and treatment of diseases and clinical conditions associated with LOC256581. LOC257447 (Accession XM_096847) is another VGAM1864 host target gene. LOC257447 BINDING SITE is HOST TARGET binding site found in the 5' untranslated region of mRNA encoded by LOC257447, corresponding to a HOST TARGET binding site such as BINDING SITE I, BINDING SITE II or BINDING SITE III. Table 2 illustrates the complementarity of the nucleotide sequences of LOC257447 BINDING SITE, designated SEQ ID:40568, to the nucleotide sequence of VGAM1864 RNA, herein designated VGAM RNA, also designated SEQ ID:4575.

Another function of VGAM1864 is therefore inhibition of LOC257447 (Accession XM_096847). Accordingly, utilities of VGAM1864 include diagnosis, prevention and treatment of diseases and clinical conditions associated with LOC257447. LOC51152 (Accession NM_016181) is another VGAM1864 host target gene. LOC51152 BINDING SITE is HOST TARGET binding site found in the 3' untranslated region of mRNA encoded by LOC51152, corresponding to a HOST TARGET binding site such as BINDING SITE I, BINDING SITE II or BINDING SITE III. Table 2 illustrates the complementarity of the nucleotide sequences of LOC51152 BINDING SITE, designated SEQ ID:18284, to the nucleotide sequence of VGAM1864 RNA, herein designated VGAM RNA, also designated SEQ ID:4575.

Another function of VGAM1864 is therefore inhibition of LOC51152 (Accession NM_016181). Accordingly, utilities of VGAM1864 include diagnosis, prevention and treatment of diseases and clinical conditions associated with LOC51152. LOC90141 (Accession XM_029373) is another VGAM1864 host target gene. LOC90141 BINDING SITE is HOST TARGET binding site found in the 3' untranslated region of mRNA encoded by LOC90141, corresponding to a HOST TARGET binding site such as BINDING SITE I, BINDING SITE II or BINDING SITE III. Table 2 illustrates the complementarity of the nucleotide sequences of LOC90141 BINDING SITE, designated SEQ ID:30880, to the nucleotide sequence of VGAM1864 RNA, herein designated VGAM RNA, also designated SEQ ID:4575.

Another function of VGAM1864 is therefore inhibition of LOC90141 (Accession XM_029373). Accordingly, utilities of VGAM1864 include diagnosis, prevention and treatment of diseases and clinical conditions associated with LOC90141. LOC92568 (Accession XM_045852) is another VGAM1864 host target gene. LOC92568 BINDING SITE is HOST TARGET binding site found in the 3' untranslated region of mRNA encoded by LOC92568, corresponding to a HOST TARGET binding site such as BINDING SITE I, BINDING SITE II or BINDING SITE III. Table 2 illustrates the complementarity of the nucleotide sequences of LOC92568 BINDING SITE, designated SEQ ID:34579, to the nucleotide sequence of VGAM1864 RNA, herein designated VGAM RNA, also designated SEQ ID:4575.

Another function of VGAM1864 is therefore inhibition of LOC92568 (Accession XM_045852). Accordingly, utilities of VGAM1864 include diagnosis, prevention and treatment of diseases and clinical conditions associated with LOC92568. LOC93268 (Accession XM_050158) is another VGAM1864 host target gene. LOC93268 BINDING SITE is HOST TARGET binding site found in the 5' untranslated region of mRNA encoded by LOC93268, corresponding to a HOST TARGET binding site such as BINDING SITE I, BINDING SITE II or BINDING SITE III. Table 2 illustrates the complementarity of the nucleotide sequences of LOC93268 BINDING SITE, designated SEQ ID:35588, to the nucleotide sequence of VGAM1864 RNA, herein designated VGAM RNA, also designated SEQ ID:4575.

Another function of VGAM1864 is therefore inhibition of LOC93268 (Accession XM_050158). Accordingly, utilities of VGAM1864 include diagnosis, prevention and treatment of diseases and clinical conditions associated with LOC93268. FIG. 1 further provides a conceptual description of a novel bioinformatically detected viral gene of the present invention, referred to here as Viral Genomic Address Messenger 1865 (VGAM1865) viral gene, which modulates expression of respective host target genes thereof, the function and utility of which host target genes is known in the art.

VGAM1865 is a novel bioinformatically detected regulatory, non protein coding, viral micro RNA (miRNA) gene. The method by which VGAM1865 was detected is described hereinabove with reference to FIGS. 1-8.

VGAM1865 gene, herein designated VGAM GENE, is a viral gene contained in the genome of Callitrichine Herpesvirus 3. VGAM1865 host target gene, herein designated VGAM HOST TARGET GENE, is a human gene contained in the human genome.

VGAM1865 gene encodes a VGAM1865 precursor RNA, herein designated VGAM PRECURSOR RNA. Similar to other miRNA genes, and unlike most ordinary genes, VGAM1865 precursor RNA does not encode a protein. A nucleotide sequence identical or highly similar to the nucleotide sequence of VGAM1865 precursor RNA is designated SEQ ID:1851, and is provided hereinbelow with reference to the sequence listing part. Nucleotide sequence SEQ ID:1851 is located at position 122877 relative to the genome of Callitrichine Herpesvirus 3.

VGAM1865 precursor RNA folds onto itself, forming VGAM1865 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1865 folded precursor RNA into VGAM1865 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1865 RNA is designated SEQ ID:4576, and is provided hereinbelow with reference to the sequence listing part.

VGAM1865 host target gene, herein designated VGAM HOST TARGET GENE, encodes a corresponding messenger RNA, VGAM1865 host target RNA, herein designated VGAM HOST TARGET RNA. VGAM1865 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1865 RNA, herein designated VGAM RNA, binds complementarily to one or more host target binding sites located in untranslated regions of VGAM1865 host target RNA, herein designated VGAM HOST TARGET RNA. This complementary binding is due to the fact that the nucleotide sequence of VGAM1865 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1865 RNA, herein designated VGAM RNA, may have a different number of host target binding sites in untranslated regions of a VGAM1865 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1865 RNA, herein designated VGAM RNA, to host target binding sites on VGAM1865 host target RNA, herein designated VGAM HOST TARGET RNA, such as BINDING SITE I, BINDING SITE II and BINDING SITE III, inhibits translation of VGAM1865 host target RNA into VGAM1865 host target protein, herein designated VGAM HOST TARGET PROTEIN. VGAM host target protein is therefore outlined by a broken line.

It is appreciated that VGAM1865 host target gene, herein designated VGAM HOST TARGET GENE, in fact represents a plurality of VGAM1865 host target genes. The mRNA of each one of this plurality of VGAM1865 host target genes comprises one or more host target binding sites, each having a nucleotide sequence which is at least partly complementary to VGAM1865 RNA, herein designated VGAM RNA, and which when bound by VGAM1865 RNA causes inhibition of translation of respective one or more VGAM1865 host target proteins.

It is further appreciated by one skilled in the art that the mode of translational inhibition illustrated by FIG. 1 with specific reference to translational inhibition exerted by VGAM1865 gene, herein designated VGAM GENE, on one or more VGAM1865 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1865 is inhibition of expression of host target genes, as part of a novel viral mechanism of attacking a host. Accordingly, utilities of VGAM1865 include diagnosis, prevention and treatment of viral infection by Callitrichine Herpesvirus 3. Specific functions, and accordingly utilities, of VGAM1865 correlate with, and may be deduced from, the identity of the host target genes which VGAM1865 binds and inhibits, and the function of these host target genes, as elaborated hereinbelow.

Nucleotide sequences of the VGAM1865 precursor RNA, herein designated VGAM PRECURSOR RNA, and of the 'diced' VGAM1865 RNA, herein designated VGAM RNA, and a schematic representation of the secondary folding of VGAM1865 folded precursor RNA, herein designated VGAM FOLDED PRECURSOR RNA, of VGAM1865 are further described hereinbelow with reference to Table 1.

Nucleotide sequences of host target binding sites, such as BINDING SITE-I, BINDING SITE-II and BINDING SITE-III of FIG. 1, found on VGAM1865 host target RNA, and schematic representation of the complementarity of each of these host target binding sites to VGAM1865 RNA, herein designated VGAM RNA, are described hereinbelow with reference to Table 2.

As mentioned hereinabove with reference to FIG. 1, a function of VGAM1865 gene, herein designated VGAM is inhibition of expression of VGAM1865 target genes. It is appreciated that specific functions, and accordingly utilities, of VGAM1865 correlate with, and may be deduced from, the identity of the target genes which VGAM1865 binds and inhibits, and the function of these target genes, as elaborated hereinbelow.

E2F Transcription Factor 3 (E2F3, Accession NM_001949) is a VGAM1865 host target gene. E2F3 BINDING SITE is HOST TARGET binding site found in the 3' untranslated region of mRNA encoded by E2F3, corresponding to a HOST TARGET binding site such as BINDING SITE I, BINDING SITE II or BINDING SITE III. Table 2 illustrates the complementarity of the nucleotide sequences of E2F3 BINDING SITE, designated SEQ ID:7665, to the nucleotide sequence of VGAM1865 RNA, herein designated VGAM RNA, also designated SEQ ID:4576.

A function of VGAM1865 is therefore inhibition of E2F Transcription Factor 3 (E2F3, Accession NM_001949), a gene which binds dna and controls cell-cycle progression from g1 to s phase. Accordingly, utilities of VGAM1865 include diagnosis, prevention and treatment of diseases and clinical conditions associated with E2F3. The function of E2F3 and its association with various diseases and clinical conditions, has been established by previous studies, as described hereinabove with reference to VGAM475. Protein Tyrosine Phosphatase, Receptor Type, A (PTPRA, Accession NM_002836) is another VGAM1865 host target gene. PTPRA BINDING SITE is HOST TARGET binding site found in the 5' untranslated region of mRNA encoded by PTPRA, corresponding to a HOST TARGET binding site such as BINDING SITE I, BINDING SITE II or BINDING SITE III. Table 2 illustrates the complementarity of the nucleotide sequences of PTPRA BINDING SITE, designated SEQ ID:8714, to the nucleotide sequence of VGAM1865 RNA, herein designated VGAM RNA, also designated SEQ ID:4576.

Another function of VGAM1865 is therefore inhibition of Protein Tyrosine Phosphatase, Receptor Type, A (PTPRA, Accession NM_002836), a gene which is the human homolog of the murine PTPase. Accordingly, utilities of VGAM1865 include diagnosis, prevention and treatment of diseases and clinical conditions associated with PTPRA. The function of PTPRA and its association with various diseases and clinical conditions, has been established by previous studies, as described hereinabove with reference to VGAM1205. SH3-domain GRB2-like 1 (SH3GL1, Accession NM_003025) is another VGAM1865 host target gene. SH3GL1 BINDING SITE is HOST TARGET binding site found in the 3' untranslated region of mRNA encoded by SH3GL1, corresponding to a HOST TARGET binding site such as BINDING SITE I, BINDING SITE II or BINDING SITE III. Table 2 illustrates the complementarity of the nucleotide sequences of SH3GL1 BINDING SITE, designated SEQ ID:8964, to the nucleotide sequence of VGAM1865 RNA, herein designated VGAM RNA, also designated SEQ ID:4576.

Another function of VGAM1865 is therefore inhibition of SH3-domain GRB2-like 1 (SH3GL1, Accession NM_003025). Accordingly, utilities of VGAM1865 include diagnosis, prevention and treatment of diseases and clinical conditions associated with SH3GL1. Solute Carrier Family 1 (glutamate/neutral amino acid transporter), Member 4 (SLC1A4, Accession NM_003038) is another VGAM1865 host target gene. SLC1A4 BINDING SITE is HOST TARGET binding site found in the 3' untranslated region of mRNA encoded by SLC1A4, corresponding to a HOST TARGET binding site such as BINDING SITE I, BINDING SITE II or BINDING SITE III. Table 2 illustrates the complementarity of the nucleotide sequences of SLC1A4 BINDING SITE, designated SEQ ID:8993, to the nucleotide sequence of VGAM1865 RNA, herein designated VGAM RNA, also designated SEQ ID:4576.

Another function of VGAM1865 is therefore inhibition of Solute Carrier Family 1 (glutamate/neutral amino acid transporter), Member 4 (SLC1A4, Accession NM_003038), a gene which transports alanine, serine, cysteine, and threonine. exhibits sodium dependence. Accordingly, utilities of VGAM1865 include diagnosis, prevention and treatment of diseases and clinical conditions associated with SLC1A4. The function of SLC1A4 and its association with various diseases and clinical conditions, has been established by previous studies, as described hereinabove with reference to VGAM859. Solute Carrier Family 21 (organic anion transporter), Member 9 (SLC21A9, Accession NM_007256) is another VGAM1865 host target gene. SLC21A9 BINDING SITE is HOST TARGET binding site found in the 3' untranslated region of mRNA encoded by SLC21A9, corresponding to a HOST TARGET binding site such as BINDING SITE I, BINDING SITE II or BINDING SITE III. Table 2 illustrates the complementarity of the nucleotide sequences of SLC21A9 BINDING SITE, designated SEQ ID:14125, to the nucleotide sequence of VGAM1865 RNA, herein designated VGAM RNA, also designated SEQ ID:4576.

Another function of VGAM1865 is therefore inhibition of Solute Carrier Family 21 (organic anion transporter), Member 9 (SLC21A9, Accession NM_007256), a gene which is Moderately similar to SLC21A2 prostaglandin transporter. Accordingly, utilities of VGAM1865 include diagnosis, prevention and treatment of diseases and clinical conditions associated with SLC21A9. The function of SLC21A9 and its association with various diseases and clinical conditions, has been established by previous studies, as described hereinabove with reference to VGAM894. Tumor Necrosis Factor, Alpha-induced Protein 2 (TNFAIP2, Accession NM_006291) is another VGAM1865 host target gene. TNFAIP2 BINDING SITE is HOST TARGET binding site found in the 3' untranslated region of mRNA encoded by TNFAIP2, corresponding to a HOST TARGET binding site such as BINDING SITE I, BINDING SITE II or BINDING SITE III. Table 2 illustrates the complementarity of the nucleotide sequences of TNFAIP2 BINDING SITE, designated SEQ ID:12982, to the nucleotide sequence of VGAM1865 RNA, herein designated VGAM RNA, also designated SEQ ID:4576.

Another function of VGAM1865 is therefore inhibition of Tumor Necrosis Factor, Alpha-induced Protein 2 (TNFAIP2, Accession NM_006291). Accordingly, utilities of VGAM1865 include diagnosis, prevention and treatment of diseases and clinical conditions associated with TNFAIP2. C1q and Tumor Necrosis Factor Related Protein 7 (C1QTNF7, Accession NM_031911) is another VGAM1865 host target gene. C1QTNF7 BINDING SITE is HOST TARGET binding site found in the 3' untranslated region of mRNA encoded by C1QTNF7, corresponding to a HOST TARGET binding site such as BINDING SITE I, BINDING SITE II or BINDING SITE III. Table 2 illustrates the complementarity of the nucleotide sequences of C1QTNF7 BINDING SITE, designated SEQ ID:25661, to the nucleotide sequence of VGAM1865 RNA, herein designated VGAM RNA, also designated SEQ ID:4576.

Another function of VGAM1865 is therefore inhibition of C1q and Tumor Necrosis Factor Related Protein 7 (C1QTNF7, Accession NM_031911). Accordingly, utilities of VGAM1865 include diagnosis, prevention and treatment of diseases and clinical conditions associated with C1QTNF7. KIAA1979 (Accession XM_113984) is another VGAM1865 host target gene. KIAA1979 BINDING SITE is HOST TARGET binding site found in the 3' untranslated region of mRNA encoded by KIAA1979, corresponding to a HOST TARGET binding site such as BINDING SITE I, BINDING SITE II or BINDING SITE III. Table 2 illustrates the complementarity of the nucleotide sequences of KIAA1979 BINDING SITE, designated SEQ ID:42591, to the nucleotide sequence of VGAM1865 RNA, herein designated VGAM RNA, also designated SEQ ID:4576.

Another function of VGAM1865 is therefore inhibition of KIAA1979 (Accession XM_113984). Accordingly, utilities of VGAM1865 include diagnosis, prevention and treatment of diseases and clinical conditions associated with KIAA1979. STAF65(gamma) (Accession NM_014860) is another VGAM1865 host target gene. STAF65(gamma) BINDING SITE is HOST TARGET binding site found in the 3' untranslated region of mRNA encoded by STAF65 (gamma), corresponding to a HOST TARGET binding site such as BINDING SITE I, BINDING SITE II or BINDING SITE III. Table 2 illustrates the complementarity of the nucleotide sequences of STAF65(gamma) BINDING SITE, designated SEQ ID:16926, to the nucleotide sequence of VGAM1865 RNA, herein designated VGAM RNA, also designated SEQ ID:4576.

Another function of VGAM1865 is therefore inhibition of STAF65(gamma) (Accession NM_014860). Accordingly, utilities of VGAM1865 include diagnosis, prevention and treatment of diseases and clinical conditions associated with STAF65(gamma). LOC146856 (Accession XM_096086) is another VGAM1865 host target gene. LOC146856 BINDING SITE is HOST TARGET binding site found in the 3' untranslated region of mRNA encoded by LOC146856, corresponding to a HOST TARGET binding site such as BINDING SITE I, BINDING SITE II or BINDING SITE III. Table 2 illustrates the complementarity of the nucleotide sequences of LOC146856 BINDING SITE, designated SEQ ID:40298, to the nucleotide sequence of VGAM1865 RNA, herein designated VGAM RNA, also designated SEQ ID:4576.

Another function of VGAM1865 is therefore inhibition of LOC146856 (Accession XM_096086). Accordingly, utilities of VGAM1865 include diagnosis, prevention and treatment of diseases and clinical conditions associated with LOC146856. FIG. 1 further provides a conceptual description of a novel bioinformatically detected viral gene of the present invention, referred to here as Viral Genomic Address Messenger 1866 (VGAM1866) viral gene, which modulates expression of respective host target genes thereof, the function and utility of which host target genes is known in the art.

VGAM1866 is a novel bioinformatically detected regulatory, non protein coding, viral micro RNA (miRNA) gene. The method by which VGAM1866 was detected is described hereinabove with reference to FIGS. 1-8.

VGAM1866 gene, herein designated VGAM GENE, is a viral gene contained in the genome of Callitrichine Herpesvirus 3. VGAM1866 host target gene, herein designated VGAM HOST TARGET GENE, is a human gene contained in the human genome.

VGAM1866 gene encodes a VGAM1866 precursor RNA, herein designated VGAM PRECURSOR RNA. Similar to other miRNA genes, and unlike most ordinary genes, VGAM1866 precursor RNA does not encode a protein. A nucleotide sequence identical or highly similar to the nucleotide sequence of VGAM1866 precursor RNA is designated SEQ ID:1852, and is provided hereinbelow with reference to the sequence listing part. Nucleotide sequence SEQ ID:1852 is located at position 121344 relative to the genome of Callitrichine Herpesvirus 3.

VGAM1866 precursor RNA folds onto itself, forming VGAM1866 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1866 folded precursor RNA into VGAM1866 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1866 RNA is designated SEQ ID:4577, and is provided hereinbelow with reference to the sequence listing part.

VGAM1866 host target gene, herein designated VGAM HOST TARGET GENE, encodes a corresponding messenger RNA, VGAM1866 host target RNA, herein designated VGAM HOST TARGET RNA. VGAM1866 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1866 RNA, herein designated VGAM RNA, binds complementarily to one or more host target binding sites located in untranslated regions of VGAM1866 host target RNA, herein designated VGAM HOST TARGET RNA. This complementary binding is due to the fact that the nucleotide sequence of VGAM1866 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1866 RNA, herein designated VGAM RNA, may have a different number of host target binding sites in untranslated regions of a VGAM1866 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1866 RNA, herein designated VGAM RNA, to host target binding sites on VGAM1866 host target RNA, herein designated VGAM HOST TARGET RNA, such as BINDING SITE I, BINDING SITE II and BINDING SITE III, inhibits translation of VGAM1866 host target RNA into VGAM1866 host target protein, herein designated VGAM HOST TARGET PROTEIN. VGAM host target protein is therefore outlined by a broken line.

It is appreciated that VGAM1866 host target gene, herein designated VGAM HOST TARGET GENE, in fact represents a plurality of VGAM1866 host target genes. The mRNA of each one of this plurality of VGAM1866 host target genes comprises one or more host target binding sites, each having a nucleotide sequence which is at least partly complementary to VGAM1866 RNA, herein designated VGAM RNA, and which when bound by VGAM1866 RNA causes inhibition of translation of respective one or more VGAM1866 host target proteins.

It is further appreciated by one skilled in the art that the mode of translational inhibition illustrated by FIG. 1 with specific reference to translational inhibition exerted by VGAM1866 gene, herein designated VGAM GENE, on one or more VGAM1866 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1866 is inhibition of expression of host target genes, as part of a novel viral mechanism of attacking a host. Accordingly, utilities of VGAM1866 include diagnosis, prevention and treatment of viral infection by Callitrichine Herpesvirus 3. Specific functions, and accordingly utilities, of VGAM1866 correlate with, and may be deduced from, the identity of the host target genes which VGAM1866 binds and inhibits, and the function of these host target genes, as elaborated hereinbelow.

Nucleotide sequences of the VGAM1866 precursor RNA, herein designated VGAM PRECURSOR RNA, and of the 'diced' VGAM1866 RNA, herein designated VGAM RNA, and a schematic representation of the secondary folding of VGAM1866 folded precursor RNA, herein designated VGAM FOLDED PRECURSOR RNA, of VGAM1866 are further described hereinbelow with reference to Table 1.

Nucleotide sequences of host target binding sites, such as BINDING SITE-I, BINDING SITE-II and BINDING SITE-III of FIG. 1, found on VGAM1866 host target RNA, and schematic representation of the complementarity of each of these host target binding sites to VGAM1866 RNA, herein designated VGAM RNA, are described hereinbelow with reference to Table 2.

As mentioned hereinabove with reference to FIG. 1, a function of VGAM1866 gene, herein designated VGAM is inhibition of expression of VGAM1866 target genes. It is appreciated that specific functions, and accordingly utilities, of VGAM1866 correlate with, and may be deduced from, the identity of the target genes which VGAM1866 binds and inhibits, and the function of these target genes, as elaborated hereinbelow.

BRF1 Homolog, Subunit of RNA Polymerase III Transcription Initiation Factor IIIB (S. cerevisiae) (BRF1, Accession NM_001519) is a VGAM1866 host target gene. BRF1 BINDING SITE is HOST TARGET binding site found in the 3' untranslated region of mRNA encoded by BRF1, corresponding to a HOST TARGET binding site such as BINDING SITE I, BINDING SITE II or BINDING SITE III. Table 2 illustrates the complementarity of the nucleotide sequences of BRF1 BINDING SITE, designated SEQ ID:7254, to the nucleotide sequence of VGAM1866 RNA, herein designated VGAM RNA, also designated SEQ ID:4577.

A function of VGAM1866 is therefore inhibition of BRF1 Homolog, Subunit of RNA Polymerase III Transcription Initiation Factor IIIB (S. cerevisiae) (BRF1, Accession NM_001519), a gene which is a general activator of RNA polymerase III. Accordingly, utilities of VGAM1866 include diagnosis, prevention and treatment of diseases and clinical conditions associated with BRF1. The function of BRF1 and its association with various diseases and clinical conditions, has been established by previous studies, as described hereinabove with reference to VGAM232. HERV-H LTR-associating 1 (HHLA1, Accession NM_005712) is another VGAM1866 host target gene. HHLA1 BINDING SITE is HOST TARGET binding site found in the 5' untranslated region of mRNA encoded by HHLA1, corresponding to a HOST TARGET binding site such as BINDING SITE I, BINDING SITE II or BINDING SITE III. Table 2 illustrates the complementarity of the nucleotide sequences of HHLA1 BINDING SITE, designated SEQ ID:12264, to the nucleotide sequence of VGAM1866 RNA, herein designated VGAM RNA, also designated SEQ ID:4577.

Another function of VGAM1866 is therefore inhibition of HERV-H LTR-associating 1 (HHLA1, Accession NM_005712), a gene which has unknown function and with low similarity to a region of S. cerevisiae WSC4. Accordingly, utilities of VGAM1866 include diagnosis, prevention and treatment of diseases and clinical conditions associated with HHLA1. The function of HHLA1 and its association with various diseases and clinical conditions, has been established by previous studies, as described hereinabove with reference to VGAM158. Nerve Growth Factor Receptor (TNFR superfamily, member 16) (NGFR, Accession NM_002507) is another VGAM1866 host target gene. NGFR BINDING SITE is HOST TARGET binding site found in the 3' untranslated region of mRNA encoded by NGFR, corresponding to a HOST TARGET binding site such as BINDING SITE I, BINDING SITE II or BINDING SITE III. Table 2 illustrates the complementarity of the nucleotide sequences of NGFR BINDING SITE, designated SEQ ID:8333, to the nucleotide sequence of VGAM1866 RNA, herein designated VGAM RNA, also designated SEQ ID:4577.

Another function of VGAM1866 is therefore inhibition of Nerve Growth Factor Receptor (TNFR superfamily, member 16) (NGFR, Accession NM_002507), a gene which can mediate cell survival as well as cell death of neural cells. Accordingly, utilities of VGAM1866 include diagnosis, prevention and treatment of diseases and clinical conditions associated with NGFR. The function of NGFR and its association with various diseases and clinical conditions, has been established by previous studies, as described hereinabove with reference to VGAM212. Protein Tyrosine Phosphatase, Non-receptor Type 18 (brain-derived) (PTPN18, Accession NM_014369) is another VGAM1866 host target gene. PTPN18 BINDING SITE is HOST TARGET binding site found in the 3' untranslated region of mRNA encoded by PTPN18, corresponding to a HOST TARGET binding site such as BINDING SITE I, BINDING SITE II or BINDING SITE III. Table 2 illustrates the complementarity of the nucleotide sequences of PTPN18 BINDING SITE, designated SEQ ID:15702, to the nucleotide sequence of VGAM1866 RNA, herein designated VGAM RNA, also designated SEQ ID:4577.

Another function of VGAM1866 is therefore inhibition of Protein Tyrosine Phosphatase, Non-receptor Type 18 (brain-derived) (PTPN18, Accession NM_014369). Accordingly, utilities of VGAM1866 include diagnosis, prevention and treatment of diseases and clinical conditions associated with PTPN18. Vitamin D (1,25- dihydroxyvitamin D3) Receptor (VDR, Accession NM_000376) is another VGAM1866 host target gene. VDR BINDING SITE is HOST TARGET binding site found in the 3' untranslated region of mRNA encoded by VDR, corresponding to a HOST TARGET binding site such as BINDING SITE I, BINDING SITE II or BINDING SITE III. Table 2 illustrates the complementarity of the nucleotide sequences of VDR BINDING SITE, designated SEQ ID:5942, to the nucleotide sequence of VGAM1866 RNA, herein designated VGAM RNA, also designated SEQ ID:4577.

Another function of VGAM1866 is therefore inhibition of Vitamin D (1,25- dihydroxyvitamin D3) Receptor (VDR, Accession NM_000376). Accordingly, utilities of VGAM1866 include diagnosis, prevention and treatment of diseases and clinical conditions associated with VDR. A2BP1 (Accession NM_018723) is another VGAM1866 host target gene. A2BP1 BINDING SITE is HOST TARGET binding site found in the 5' untranslated region of mRNA encoded by A2BP1, corresponding to a HOST TARGET binding site such as BINDING SITE I, BINDING SITE II or BINDING SITE III. Table 2 illustrates the complementarity of the nucleotide sequences of A2BP1 BINDING SITE, designated SEQ ID:20802, to the nucleotide sequence of VGAM1866 RNA, herein designated VGAM RNA, also designated SEQ ID:4577.

Another function of VGAM1866 is therefore inhibition of A2BP1 (Accession NM_018723). Accordingly, utilities of VGAM1866 include diagnosis, prevention and treatment of diseases and clinical conditions associated with A2BP1. Bromodomain Containing 4 (BRD4, Accession NM_058243) is another VGAM1866 host target gene. BRD4 BINDING SITE is HOST TARGET binding site found in the 3' untranslated region of mRNA encoded by BRD4, corresponding to a HOST TARGET binding site such as BINDING SITE I, BINDING SITE II or BINDING SITE III. Table 2 illustrates the complementarity of the nucleotide sequences of BRD4 BINDING SITE, designated SEQ ID:27773, to the nucleotide sequence of VGAM1866 RNA, herein designated VGAM RNA, also designated SEQ ID:4577.

Another function of VGAM1866 is therefore inhibition of Bromodomain Containing 4 (BRD4, Accession NM_058243). Accordingly, utilities of VGAM1866 include diagnosis, prevention and treatment of diseases and clinical conditions associated with BRD4. DKFZP564B1162 (Accession NM_031305) is another VGAM1866 host target gene. DKFZP564B1162 BINDING SITE is HOST TARGET binding site found in the 3' untranslated region of mRNA encoded by DKFZP564B1162, corresponding to a HOST TARGET binding site such as BINDING SITE I, BINDING SITE II or BINDING SITE III. Table 2 illustrates the complementarity of the nucleotide sequences of DKFZP564B1162 BINDING SITE, designated SEQ ID:25336, to the nucleotide sequence of VGAM1866 RNA, herein designated VGAM RNA, also designated SEQ ID:4577.

Another function of VGAM1866 is therefore inhibition of DKFZP564B1162 (Accession NM_031305). Accordingly, utilities of VGAM1866 include diagnosis, prevention and treatment of diseases and clinical conditions associated with DKFZP564B1162. KIAA1607 (Accession XM_033379) is another VGAM1866 host target gene. KIAA1607 BINDING SITE is HOST TARGET binding site found in the 3' untranslated region of mRNA encoded by KIAA1607, corresponding to a HOST TARGET binding site such as BINDING SITE I, BINDING SITE II or BINDING SITE III. Table 2 illustrates the complementarity of the nucleotide sequences of KIAA1607 BINDING SITE, designated SEQ ID:31913, to the nucleotide sequence of VGAM1866 RNA, herein designated VGAM RNA, also designated SEQ ID:4577.

Another function of VGAM1866 is therefore inhibition of KIAA1607 (Accession XM_033379). Accordingly, utilities of VGAM1866 include diagnosis, prevention and treatment of diseases and clinical conditions associated with KIAA1607. KIAA1987 (Accession XM_113870) is another VGAM1866 host target gene. KIAA1987 BINDING SITE is HOST TARGET binding site found in the 3' untranslated region of mRNA encoded by KIAA1987, corresponding to a HOST TARGET binding site such as BINDING SITE I, BINDING SITE II or BINDING SITE III. Table 2 illustrates the complementarity of the nucleotide sequences of KIAA1987 BINDING SITE, designated SEQ ID:42491, to the nucleotide sequence of VGAM1866 RNA, herein designated VGAM RNA, also designated SEQ ID:4577.

Another function of VGAM1866 is therefore inhibition of KIAA1987 (Accession XM_113870). Accordingly, utilities of VGAM1866 include diagnosis, prevention and treatment of diseases and clinical conditions associated with KIAA1987. LOC116113 (Accession XM_166413) is another VGAM1866 host target gene. LOC116113 BINDING SITE is HOST TARGET binding site found in the 3' untranslated region of mRNA encoded by LOC116113, corresponding to a HOST TARGET binding site such as BINDING SITE I, BINDING SITE II or BINDING SITE III. Table 2 illustrates the complementarity of the nucleotide sequences of LOC116113 BINDING SITE, designated SEQ ID:44282, to the nucleotide sequence of VGAM1866 RNA, herein designated VGAM RNA, also designated SEQ ID:4577.

Another function of VGAM1866 is therefore inhibition of LOC116113 (Accession XM_166413). Accordingly, utilities of VGAM1866 include diagnosis, prevention and treatment of diseases and clinical conditions associated with LOC116113. LOC162333 (Accession XM_102591) is another VGAM1866 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42132, to the nucleotide sequence of VGAM1866 RNA, herein designated VGAM RNA, also designated SEQ ID:4577.

Another function of VGAM1866 is therefore inhibition of LOC162333 (Accession XM_102591). Accordingly, utilities of VGAM1866 include diagnosis, prevention and treatment of diseases and clinical conditions associated with LOC162333. LOC221495 (Accession XM_168136) is another VGAM1866 host target gene. LOC221495 BINDING SITE is HOST TARGET binding site found in the 3' untranslated region of mRNA encoded by LOC221495, corresponding to a HOST TARGET binding site such as BINDING SITE I, BINDING SITE II or BINDING SITE III. Table 2 illustrates the complementarity of the nucleotide sequences of LOC221495 BINDING SITE, designated SEQ ID:45055, to the nucleotide sequence of VGAM1866 RNA, herein designated VGAM RNA, also designated SEQ ID:4577.

Another function of VGAM1866 is therefore inhibition of LOC221495 (Accession XM_168136). Accordingly, utilities of VGAM1866 include diagnosis, prevention and treatment of diseases and clinical conditions associated with LOC221495. LOC257479 (Accession XM_171548) is another VGAM1866 host target gene. LOC257479 BINDING SITE is HOST TARGET binding site found in the 5' untranslated region of mRNA encoded by LOC257479, corresponding to a HOST TARGET binding site such as BINDING SITE I, BINDING SITE II or BINDING SITE III. Table 2 illustrates the complementarity of the nucleotide sequences of LOC257479 BINDING SITE, designated SEQ ID:46053, to the nucleotide sequence of VGAM1866 RNA, herein designated VGAM RNA, also designated SEQ ID:4577.

Another function of VGAM1866 is therefore inhibition of LOC257479 (Accession XM_171548). Accordingly, utilities of VGAM1866 include diagnosis, prevention and treatment of diseases and clinical conditions associated with LOC257479. FIG. 1 further provides a conceptual description of a novel bioinformatically detected viral gene of the present invention, referred to here as Viral Genomic Address Messenger 1867 (VGAM1867) viral gene, which modulates expression of respective host target genes thereof, the function and utility of which host target genes is known in the art.

VGAM1867 is a novel bioinformatically detected regulatory, non protein coding, viral micro RNA (miRNA) gene. The method by which VGAM1867 was detected is described hereinabove with reference to FIGS. 1-8.

VGAM1867 gene, herein designated VGAM GENE, is a viral gene contained in the genome of Callitrichine Herpesvirus 3. VGAM1867 host target gene, herein designated VGAM HOST TARGET GENE, is a human gene contained in the human genome.

VGAM1867 gene encodes a VGAM1867 precursor RNA, herein designated VGAM PRECURSOR RNA. Similar to other miRNA genes, and unlike most ordinary genes, VGAM1867 precursor RNA does not encode a protein. A nucleotide sequence identical or highly similar to the nucleotide sequence of VGAM1867 precursor RNA is designated SEQ ID:1853, and is provided hereinbelow with reference to the sequence listing part. Nucleotide sequence SEQ ID:1853 is located at position 121561 relative to the genome of Callitrichine Herpesvirus 3.

VGAM1867 precursor RNA folds onto itself, forming VGAM1867 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1867 folded precursor RNA into VGAM1867 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM1867 RNA is designated SEQ ID:4578, and is provided hereinbelow with reference to the sequence listing part.

VGAM1867 host target gene, herein designated VGAM HOST TARGET GENE, encodes a corresponding messenger RNA, VGAM1867 host target RNA, herein designated VGAM HOST TARGET RNA. VGAM1867 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1867 RNA, herein designated VGAM RNA, binds complementarily to one or more host target binding sites located in untranslated regions of VGAM1867 host target RNA, herein designated VGAM HOST TARGET RNA. This complementary binding is due to the fact that the nucleotide sequence of VGAM1867 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1867 RNA, herein designated VGAM RNA, may have a different number of host target binding sites in untranslated regions of a VGAM1867 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1867 RNA, herein designated VGAM RNA, to host target binding sites on VGAM1867 host target RNA, herein designated VGAM HOST TARGET RNA, such as BINDING SITE I, BINDING SITE II and BINDING SITE III, inhibits translation of VGAM1867 host target RNA into VGAM1867 host target protein, herein designated VGAM HOST TARGET PROTEIN. VGAM host target protein is therefore outlined by a broken line.

It is appreciated that VGAM1867 host target gene, herein designated VGAM HOST TARGET GENE, in fact represents a plurality of VGAM1867 host target genes. The mRNA of each one of this plurality of VGAM1867 host target genes comprises one or more host target binding sites, each having a nucleotide sequence which is at least partly complementary to VGAM1867 RNA, herein designated VGAM RNA, and which when bound by VGAM1867 RNA causes inhibition of translation of respective one or more VGAM1867 host target proteins.

It is further appreciated by one skilled in the art that the mode of translational inhibition illustrated by FIG. 1 with specific reference to translational inhibition exerted by VGAM1867 gene, herein designated VGAM GENE, on one or more VGAM1867 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1867 is inhibition of expression of host target genes, as part of a novel viral mechanism of attacking a host. Accordingly, utilities of VGAM1867 include diagnosis, prevention and treatment of viral infection by Callitrichine Herpesvirus 3. Specific functions, and accordingly utilities, of VGAM1867 correlate with, and may be deduced from, the identity of the host target genes which VGAM1867 binds and inhibits, and the function of these host target genes, as elaborated hereinbelow.

Nucleotide sequences of the VGAM1867 precursor RNA, herein designated VGAM PRECURSOR RNA, and of the 'diced' VGAM1867 RNA, herein designated VGAM RNA, and a schematic representation of the secondary folding of VGAM1867 folded precursor RNA, herein designated VGAM FOLDED PRECURSOR RNA, of VGAM1867 are further described hereinbelow with reference to Table 1.

Nucleotide sequences of host target binding sites, such as BINDING SITE-I, BINDING SITE-II and BINDING SITE-III of FIG. 1, found on VGAM1867 host target RNA, and schematic representation of the complementarity of each of these host target binding sites to VGAM1867 RNA, herein designated VGAM RNA, are described hereinbelow with reference to Table 2.

As mentioned hereinabove with reference to FIG. 1, a function of VGAM1867 gene, herein designated VGAM is inhibition of expression of VGAM1867 target genes. It is appreciated that specific functions, and accordingly utilities, of VGAM1867 correlate with, and may be deduced from, the identity of the target genes which VGAM1867 binds and inhibits, and the function of these target genes, as elaborated hereinbelow.

Amylo-1, 6-glucosidase, 4-alpha-glucanotransferase (glycogen debranching enzyme, glycogen storage disease type III) (AGL, Accession NM_000646) is a VGAM1867 host target gene. AGL BINDING SITE is HOST TARGET binding site found in the 5' untranslated region of mRNA encoded by AGL, corresponding to a HOST TARGET binding site such as BINDING SITE I, BINDING SITE II or BINDING SITE III. Table 2 illustrates the complementarity of the nucleotide sequences of AGL BINDING SITE, designated SEQ ID:6301, to the nucleotide sequence of VGAM1867 RNA, herein designated VGAM RNA, also designated SEQ ID:4578.

A function of VGAM1867 is therefore inhibition of Amylo-1, 6-glucosidase, 4-alpha-glucanotransferase (glycogen debranching enzyme, glycogen storage disease type III) (AGL, Accession NM_000646). Accordingly, utilities of VGAM1867 include diagnosis, prevention and treatment of diseases and clinical conditions associated with AGL. Ras Homolog Gene Family, Member C (ARHC, Accession NM_005167) is another VGAM1867 host target gene. ARHC BINDING SITE is HOST TARGET binding site found in the 5' untranslated region of mRNA encoded by ARHC, corresponding to a HOST TARGET binding site such as BINDING SITE I, BINDING SITE II or BINDING SITE III. Table 2 illustrates the complementarity of the nucleotide sequences of ARHC BINDING SITE, designated SEQ ID:11661, to the nucleotide sequence of VGAM1867 RNA, herein designated VGAM RNA, also designated SEQ ID:4578.

Another function of VGAM1867 is therefore inhibition of Ras Homolog Gene Family, Member C (ARHC, Accession NM_005167), a gene which remodels of the actin cytoskeleton during cell morphogenesis and motility. Accordingly, utilities of VGAM1867 include diagnosis, prevention and treatment of diseases and clinical conditions associated with ARHC. The function of ARHC and its association with various diseases and clinical conditions, has been established by previous studies, as described hereinabove with reference to VGAM885. Deleted In Azoospermia-like (DAZL, Accession XM_042839) is another VGAM1867 host target gene. DAZL BINDING SITE is HOST TARGET binding site found in the 3' untranslated region of mRNA encoded by DAZL, corresponding to a HOST TARGET binding site such as BINDING SITE I, BINDING SITE II or BINDING SITE III. Table 2 illustrates the complementarity of the nucleotide sequences of DAZL BINDING SITE, designated SEQ ID:33797, to the nucleotide sequence of VGAM1867 RNA, herein designated VGAM RNA, also designated SEQ ID:4578.

Another function of VGAM1867 is therefore inhibition of Deleted In Azoospermia-like (DAZL, Accession XM_042839), a gene which may be essential for gametogenesis. Accordingly, utilities of VGAM1867 include diagnosis, prevention and treatment of diseases and clinical conditions associated with DAZL. The function of DAZL and its association with various diseases and clinical conditions, has been established by previous studies, as described hereinabove with reference to VGAM206. FBJ Murine Osteosarcoma Viral Oncogene Homolog B (FOSB, Accession NM_006732) is another VGAM1867 host target gene. FOSB BINDING SITE is HOST TARGET binding site found in the 3' untranslated region of mRNA encoded by FOSB, corresponding to a HOST TARGET binding site such as BINDING SITE I, BINDING SITE II or BINDING SITE III. Table 2 illustrates the complementarity of the nucleotide sequences of FOSB BINDING SITE, designated SEQ ID:13579, to the nucleotide sequence of VGAM1867 RNA, herein designated VGAM RNA, also designated SEQ ID:4578.

Another function of VGAM1867 is therefore inhibition of FBJ Murine Osteosarcoma Viral Oncogene Homolog B (FOSB, Accession NM_006732), a gene which interacts with jun proteins enhancing their dna binding activity. Accordingly, utilities of VGAM1867 include diagnosis, prevention and treatment of diseases and clinical conditions associated with FOSB. The function of FOSB and its association with various diseases and clinical conditions, has been established by previous studies, as described hereinabove with reference to VGAM747. 3-hydroxy-3-methylglutaryl-Coenzyme A Reductase (HMGCR, Accession NM_000859) is another VGAM1867 host target gene. HMGCR BINDING SITE is HOST TARGET binding site found in the 3' untranslated region of mRNA encoded by HMGCR, corresponding to a HOST TARGET binding site such as BINDING SITE I, BINDING SITE II or BINDING SITE III. Table 2 illustrates the complementarity of the nucleotide sequences of HMGCR BINDING SITE, designated SEQ ID:6521, to the nucleotide sequence of VGAM1867 RNA, herein designated VGAM RNA, also designated SEQ ID:4578.

Another function of VGAM1867 is therefore inhibition of 3-hydroxy-3-methylglutaryl-Coenzyme A Reductase (HMGCR, Accession NM_000859), a gene which is involved in the control of cholesterol biosynthesis and is the rate-limiting enzyme of sterol biosynthesis. Accordingly, utilities of VGAM1867 include diagnosis, prevention and treatment of diseases and clinical conditions associated with HMGCR. The function of HMGCR has been established by previous studies. Although catalyzing a rate-limiting step in cholesterol biosynthesis (see OMIM Ref. No. 143890) is the best known role of HMG-CoA reductase, the enzyme also participates in the production of a wide variety of other compounds. Some clinical benefits attributed to inhibitors of HMG-CoA reductase appear to be independent of any serum cholesterol-lowering effect. Van Doren et al. (1998) described a new cholesterol-independent role for the enzyme, in regulating a developmental process, primordial germ cell migration. They showed that in Drosophila this enzyme is highly expressed in the somatic gonad and that it is necessary for primordial germ cells to migrate to this tissue. Misexpression of HMG-CoA reductase was sufficient to attract primordial germ cells to tissues other than the gonadal mesoderm. Van Doren et al. (1998) concluded that the regulated expression of HMG-CoA reductase has a critical developmental function in providing spatial information to guide migrating primordial germ cells. Istvan and Deisenhofer (2001) determined structures of the catalytic portion of human HMG-CoA reductase complexed with 6 different statins. The statins occupy a portion of the binding site of HMG-CoA, thus blocking access of this substrate to the active site. Near the carboxyl terminus of HMG-CoA reductase, several catalytically relevant residues are disordered in the enzyme-statin complexes. If these residues were not flexible, they would sterically hinder statin binding.

Full details of the abovementioned studies are described in the following publications, the disclosure of which are hereby incorporated by reference:

Van Doren, M.; Broihier, H. T.; Moore, L. A.; Lehmann, R.: HMG-CoA reductase guides migrating primordial germ cells. Nature 396:466-469, 1998; and Istvan, E. S.; Deisenhofer, J.: Structural mechanism for statin inhibition of HMG-CoA reductase. Science 292:1160-1164, 2001.

Further studies establishing the function and utilities of HMGCR are found in John Hopkins OMIM database record ID 142910, and in sited publications numbered 11712-11713, 359 and 3614-3618 listed in the bibliography section hereinbelow, which are also hereby incorporated by reference. Lecithin Retinol Acyltransferase (phosphatidylcholine--retinol O-acyltransferase) (LRAT, Accession XM_011181) is another VGAM1867 host target gene. LRAT BINDING SITE is HOST TARGET binding site found in the 3' untranslated region of mRNA encoded by LRAT, corresponding to a HOST TARGET binding site such as BINDING SITE I, BINDING SITE II or BINDING SITE III. Table 2 illustrates the complementarity of the nucleotide sequences of LRAT BINDING SITE, designated SEQ ID:30181, to the nucleotide sequence of VGAM1867 RNA, herein designated VGAM RNA, also designated SEQ ID:4578.

Another function of VGAM1867 is therefore inhibition of Lecithin Retinol Acyltransferase (phosphatidylcholine--retinol O-acyltransferase) (LRAT, Accession XM_011181). Accordingly, utilities of VGAM1867 include diagnosis, prevention and treatment of diseases and clinical conditions associated with LRAT. Myotubularin Related Protein 8 (MTMR8, Accession NM_015458) is another VGAM1867 host target gene. MTMR8 BINDING SITE is HOST TARGET binding site found in the 3' untranslated region of mRNA encoded by MTMR8, corresponding to a HOST TARGET binding site such as BINDING SITE I, BINDING SITE II or BINDING SITE III. Table 2 illustrates the complementarity of the nucleotide sequences of MTMR8 BINDING SITE, designated SEQ ID:17742, to the nucleotide sequence of VGAM1867 RNA, herein designated VGAM RNA, also designated SEQ ID:4578.

Another function of VGAM1867 is therefore inhibition of Myotubularin Related Protein 8 (MTMR8, Accession NM_015458), a gene which could be a tyrosine-phosphatase. Accordingly, utilities of VGAM1867 include diagnosis, prevention and treatment of diseases and clinical conditions associated with MTMR8. The function of MTMR8 and its association with various diseases and clinical conditions, has been established by previous studies, as described hereinabove with reference to VGAM379. Neurocalcin Delta (NCALD, Accession NM_032041) is another VGAM1867 host target gene. NCALD BINDING SITE is HOST TARGET binding site found in the 3' untranslated region of mRNA encoded by NCALD, corresponding to a HOST TARGET binding site such as BINDING SITE I, BINDING SITE II or BINDING SITE III. Table 2 illustrates the complementarity of the nucleotide sequences of NCALD BINDING SITE, designated SEQ ID:25742, to the nucleotide sequence of VGAM1867 RNA, herein designated VGAM RNA, also designated SEQ ID:4578.

Another function of VGAM1867 is therefore inhibition of Neurocalcin Delta (NCALD, Accession NM_032041). Accordingly, utilities of VGAM1867 include diagnosis, prevention and treatment of diseases and clinical conditions associated with NCALD. PACE (Accession NM_002569) is another VGAM1867 host target gene. PACE BINDING SITE is HOST TARGET binding site found in the 3' untranslated region of mRNA encoded by PACE, corresponding to a HOST TARGET binding site such as BINDING SITE I, BINDING SITE II or BINDING SITE III. Table 2 illustrates the complementarity of the nucleotide sequences of PACE BINDING SITE, designated SEQ ID:8421, to the nucleotide sequence of VGAM1867 RNA, herein designated VGAM RNA, also designated SEQ ID:4578.

Another function of VGAM1867 is therefore inhibition of PACE (Accession NM_002569), a gene which processes pro-parathyroid hormone, pro-transforming growth factor beta. Accordingly, utilities of VGAM1867 include diagnosis, prevention and treatment of diseases and clinical conditions associated with PACE. The function of PACE and its association with various diseases and clinical conditions, has been established by previous studies, as described hereinabove with reference to VGAM151. Protein Tyrosine Phosphatase, Non-receptor Type 7 (PTPN7, Accession NM_002832) is another VGAM1867 host target gene. PTPN7 BINDING SITE1 through PTPN7 BINDING SITE3 are HOST TARGET binding sites found in untranslated regions of mRNA encoded by PTPN7, corresponding to HOST TARGET binding sites such as BINDING SITE I, BINDING SITE II or BINDING SITE III. Table 2 illustrates the complementarity of the nucleotide sequences of PTPN7 BINDING SITE1 through PTPN7 BINDING SITE3, designated SEQ ID:8708, SEQ ID:27886 and SEQ ID:27889 respectively, to the nucleotide sequence of VGAM1867 RNA, herein designated VGAM RNA, also designated SEQ ID:4578.

Another function of VGAM1867 is therefore inhibition of Protein Tyrosine Phosphatase, Non-receptor Type 7 (PTPN7, Accession NM_002832). Accordingly, utilities of VGAM1867 include diagnosis, prevention and treatment of diseases and clinical conditions associated with PTPN7. DKFZp434F054 (Accession NM_032259) is another VGAM1867 host target gene. DKFZp434F054 BINDING SITE is HOST TARGET binding site found in the 5' untranslated region of mRNA encoded by DKFZp434F054, corresponding to a HOST TARGET binding site such as BINDING SITE I, BINDING SITE II or BINDING SITE III. Table 2 illustrates the complementarity of the nucleotide sequences of DKFZp434F054 BINDING SITE, designated SEQ ID:26002, to the nucleotide sequence of VGAM1867 RNA, herein designated VGAM RNA, also designated SEQ ID:4578.

Another function of VGAM1867 is therefore inhibition of DKFZp434F054 (Accession NM_032259). Accordingly, utilities of VGAM1867 include diagnosis, prevention and treatment of diseases and clinical conditions associated with DKFZp434F054. FACTP140 (Accession NM_007192) is another VGAM1867 host target gene. FACTP140 BINDING SITE is HOST TARGET binding site found in the 3' untranslated region of mRNA encoded by FACTP140, corresponding to a HOST TARGET binding site such as BINDING SITE I, BINDING SITE II or BINDING SITE III. Table 2 illustrates the complementarity of the nucleotide sequences of FACTP140 BINDING SITE, designated SEQ ID:14045, to the nucleotide sequence of VGAM1867 RNA, herein designated VGAM RNA, also designated SEQ ID:4578.

Another function of VGAM1867 is therefore inhibition of FACTP140 (Accession NM_007192). Accordingly, utilities of VGAM1867 include diagnosis, prevention and treatment of diseases and clinical conditions associated with FACTP140. FLJ11099 (Accession NM_018320) is another VGAM1867 host target gene. FLJ11099 BINDING SITE is HOST TARGET binding site found in the 3' untranslated region of mRNA encoded by FLJ11099, corresponding to a HOST TARGET binding site such as BINDING SITE I, BINDING SITE II or BINDING SITE III. Table 2 illustrates the complementarity of the nucleotide sequences of FLJ11099 BINDING SITE, designated SEQ ID:20312, to the nucleotide sequence of VGAM1867 RNA, herein designated VGAM RNA, also designated SEQ ID:4578.

Another function of VGAM1867 is therefore inhibition of FLJ11099 (Accession NM_018320). Accordingly, utilities of VGAM1867 include diagnosis, prevention and treatment of diseases and clinical conditions associated with FLJ11099. FLJ20436 (Accession NM_017822) is another VGAM1867 host target gene. FLJ20436 BINDING SITE is HOST TARGET binding site found in the 5' untranslated region of mRNA encoded by FLJ20436, corresponding to a HOST TARGET binding site such as BINDING SITE I, BINDING SITE II or BINDING SITE III. Table 2 illustrates the complementarity of the nucleotide sequences of FLJ20436 BINDING SITE, designated SEQ ID:19474, to the nucleotide sequence of VGAM1867 RNA, herein designated VGAM RNA, also designated SEQ ID:4578.

Another function of VGAM1867 is therefore inhibition of FLJ20436 (Accession NM_017822). Accordingly, utilities of VGAM1867 include diagnosis, prevention and treatment of diseases and clinical conditions associated with FLJ20436. FLJ21977 (Accession NM_032213) is another VGAM1867 host target gene. FLJ21977 BINDING SITE is HOST TARGET binding site found in the 3' untranslated region of mRNA encoded by FLJ21977, corresponding to a HOST TARGET binding site such as BINDING SITE I, BINDING SITE II or BINDING SITE III. Table 2 illustrates the complementarity of the nucleotide sequences of FLJ21977 BINDING SITE, designated SEQ ID:25938, to the nucleotide sequence of VGAM1867 RNA, herein designated VGAM RNA, also designated SEQ ID:4578.

Another function of VGAM1867 is therefore inhibition of FLJ21977 (Accession NM_032213). Accordingly, utilities of VGAM1867 include diagnosis, prevention and treatment of diseases and clinical conditions associated with FLJ21977.

HCA127 (Accession NM_018684) is another VGAM1867 host target gene. HCA127 BINDING SITE is HOST TARGET binding site found in the 3' untranslated region of mRNA encoded by HCA127, corresponding to a HOST TARGET binding site such as BINDING SITE I, BINDING SITE II or BINDING SITE III. Table 2 illustrates the complementarity of the nucleotide sequences of HCA127 BINDING SITE, designated SEQ ID:20758, to the nucleotide sequence of VGAM1867 RNA, herein designated VGAM RNA, also designated SEQ ID:4578.

Another function of VGAM1867 is therefore inhibition of HCA127 (Accession NM_018684). Accordingly, utilities of VGAM1867 include diagnosis, prevention and treatment of diseases and clinical conditions associated with HCA127. KIAA0493 (Accession XM_034717) is another VGAM1867 host target gene. KIAA0493 BINDING SITE is HOST TARGET binding site found in the 5' untranslated region of mRNA encoded by KIAA0493, corresponding to a HOST TARGET binding site such as BINDING SITE I, BINDING SITE II or BINDING SITE III. Table 2 illustrates the complementarity of the nucleotide sequences of KIAA0493 BINDING SITE, designated SEQ ID:32141, to the nucleotide sequence of VGAM1867 RNA, herein designated VGAM RNA, also designated SEQ ID:4578.

Another function of VGAM1867 is therefore inhibition of KIAA0493 (Accession XM_034717). Accordingly, utilities of VGAM1867 include diagnosis, prevention and treatment of diseases and clinical conditions associated with KIAA0493. KIAA0618 (Accession NM_014833) is another VGAM1867 host target gene. KIAA0618 BINDING SITE is HOST TARGET binding site found in the 3' untranslated region of mRNA encoded by KIAA0618, corresponding to a HOST TARGET binding site such as BINDING SITE I, BINDING SITE II or BINDING SITE III. Table 2 illustrates the complementarity of the nucleotide sequences of KIAA0618 BINDING SITE, designated SEQ ID:16838, to the nucleotide sequence of VGAM1867 RNA, herein designated VGAM RNA, also designated SEQ ID:4578.

Another function of VGAM1867 is therefore inhibition of KIAA0618 (Accession NM_014833). Accordingly, utilities of VGAM1867 include diagnosis, prevention and treatment of diseases and clinical conditions associated with KIAA0618. MGC20235 (Accession NM_145041) is another VGAM1867 host target gene. MGC20235 BINDING SITE is HOST TARGET binding site found in the 5' untranslated region of mRNA encoded by MGC20235, corresponding to a HOST TARGET binding site such as BINDING SITE I, BINDING SITE II or BINDING SITE III. Table 2 illustrates the complementarity of the nucleotide sequences of MGC20235 BINDING SITE, designated SEQ ID:29667, to the nucleotide sequence of VGAM1867 RNA, herein designated VGAM RNA, also designated SEQ ID:4578.

Another function of VGAM1867 is therefore inhibition of MGC20235 (Accession NM_145041). Accordingly, utilities of VGAM1867 include diagnosis, prevention and treatment of diseases and clinical conditions associated with MGC20235. MGC23280 (Accession NM_144683) is another VGAM1867 host target gene. MGC23280 BINDING SITE is HOST TARGET binding site found in the 3' untranslated region of mRNA encoded by MGC23280, corresponding to a HOST TARGET binding site such as BINDING SITE I, BINDING SITE II or BINDING SITE III. Table 2 illustrates the complementarity of the nucleotide sequences of MGC23280 BINDING SITE, designated SEQ ID:29500, to the nucleotide sequence of VGAM1867 RNA, herein designated VGAM RNA, also designated SEQ ID:4578.

Another function of VGAM1867 is therefore inhibition of MGC23280 (Accession NM_144683). Accordingly, utilities of VGAM1867 include diagnosis, prevention and treatment of diseases and clinical conditions associated with MGC23280. MGC4771 (Accession NM_032668) is another VGAM1867 host target gene. MGC4771 BINDING SITE is HOST TARGET binding site found in the 3' untranslated region of mRNA encoded by MGC4771, corresponding to a HOST TARGET binding site such as BINDING SITE I, BINDING SITE II or BINDING SITE III. Table 2 illustrates the complementarity of the nucleotide sequences of MGC4771 BINDING SITE, designated SEQ ID:26395, to the nucleotide sequence of VGAM1867 RNA, herein designated VGAM RNA, also designated SEQ ID:4578.

Another function of VGAM1867 is therefore inhibition of MGC4771 (Accession NM_032668). Accordingly, utilities of VGAM1867 include diagnosis, prevention and treatment of diseases and clinical conditions associated with MGC4771. MGC5149 (Accession XM_051200) is another VGAM1867 host target gene. MGC5149 BINDING SITE is HOST TARGET binding site found in the 3' untranslated region of mRNA encoded by MGC5149, corresponding to a HOST TARGET binding site such as BINDING SITE I, BINDING SITE II or BINDING SITE III. Table 2 illustrates the complementarity of the nucleotide sequences of MGC5149 BINDING SITE, designated SEQ ID:35781, to the nucleotide sequence of VGAM1867 RNA, herein designated VGAM RNA, also designated SEQ ID:4578.

Another function of VGAM1867 is therefore inhibition of MGC5149 (Accession XM_051200). Accordingly, utilities of VGAM1867 include diagnosis, prevention and treatment of diseases and clinical conditions associated with MGC5149. poly (rC) Binding Protein 4 (PCBP4, Accession NM_033008) is another VGAM1867 host target gene. PCBP4 BINDING SITE1 through PCBP4 BINDING SITE3 are HOST TARGET binding sites found in untranslated regions of mRNA encoded by PCBP4, corresponding to HOST TARGET binding sites such as BINDING SITE I, BINDING SITE II or BINDING SITE III. Table 2 illustrates the complementarity of the nucleotide sequences of PCBP4 BINDING SITE1 through PCBP4 BINDING SITE3, designated SEQ ID:26893, SEQ ID:26895 and SEQ ID:21677 respectively, to the nucleotide sequence of VGAM1867 RNA, herein designated VGAM RNA, also designated SEQ ID:4578.

Another function of VGAM1867 is therefore inhibition of poly (rC) Binding Protein 4 (PCBP4, Accession NM_033008). Accordingly, utilities of VGAM1867 include diagnosis, prevention and treatment of diseases and clinical conditions associated with PCBP4. LOC129566 (Accession XM_065294) is another VGAM1867 host target gene. LOC129566 BINDING SITE is HOST TARGET binding site found in the 5' untranslated region of mRNA encoded by LOC129566, corresponding to a HOST TARGET binding site such as BINDING SITE I, BINDING SITE II or BINDING SITE III. Table 2 illustrates the complementarity of the nucleotide sequences of LOC129566 BINDING SITE, designated SEQ ID:37278, to the nucleotide sequence of VGAM1867 RNA, herein designated VGAM RNA, also designated SEQ ID:4578.

Another function of VGAM1867 is therefore inhibition of LOC129566 (Accession XM_065294). Accordingly, utilities of VGAM1867 include diagnosis, prevention and treatment of diseases and clinical conditions associated with LOC129566. LOC130595 (Accession XM_065793) is another VGAM1867 host target gene. LOC130595 BINDING SITE is HOST TARGET binding site found in the 5' untranslated region of mRNA encoded by LOC130595, corresponding to a HOST TARGET binding site such as BINDING SITE I, BINDING SITE II or BINDING SITE III. Table 2 illustrates the complementarity of the nucleotide sequences of LOC130595 BINDING SITE, designated SEQ ID:37298, to the nucleotide sequence of VGAM1867 RNA, herein designated VGAM RNA, also designated SEQ ID:4578.

Another function of VGAM1867 is therefore inhibition of LOC130595 (Accession XM_065793). Accordingly, utilities of VGAM1867 include diagnosis, prevention and treatment of diseases and clinical conditions associated with LOC130595. LOC143286 (Accession XM_096412) is another VGAM1867 host target gene. LOC143286 BINDING SITE is HOST TARGET binding site found in the 5' untranslated region of mRNA encoded by LOC143286, corresponding to a HOST TARGET binding site such as BINDING SITE I, BINDING SITE II or BINDING SITE III. Table 2 illustrates the complementarity of the nucleotide sequences of LOC143286 BINDING SITE, designated SEQ ID:40352, to the nucleotide sequence of VGAM1867 RNA, herein designated VGAM RNA, also designated SEQ ID:4578.

Another function of VGAM1867 is therefore inhibition of LOC143286 (Accession XM_096412). Accordingly, utilities of VGAM1867 include diagnosis, prevention and treatment of diseases and clinical conditions associated with LOC143286. LOC144438 (Accession XM_084860) is another VGAM1867 host target gene. LOC144438 BINDING SITE is HOST TARGET binding site found in the 3' untranslated region of mRNA encoded by LOC144438, corresponding to a HOST TARGET binding site such as BINDING SITE I, BINDING SITE II or BINDING SITE III. Table 2 illustrates the complementarity of the nucleotide sequences of LOC144438 BINDING SITE, designated SEQ ID:37733, to the nucleotide sequence of VGAM1867 RNA, herein designated VGAM RNA, also designated SEQ ID:4578.

Another function of VGAM1867 is therefore inhibition of LOC144438 (Accession XM_084860). Accordingly, utilities of VGAM1867 include diagnosis, prevention and treatment of diseases and clinical conditions associated with LOC144438. LOC147077 (Accession XM_085699) is another VGAM1867 host target gene. LOC147077 BINDING SITE is HOST TARGET binding site found in the 5' untranslated region of mRNA encoded by LOC147077, corresponding to a HOST TARGET binding site such as BINDING SITE I, BINDING SITE II or BINDING SITE III. Table 2 illustrates the complementarity of the nucleotide sequences of LOC147077 BINDING SITE, designated SEQ ID:38289, to the nucleotide sequence of VGAM1867 RNA, herein designated VGAM RNA, also designated SEQ ID:4578.

Another function of VGAM1867 is therefore inhibition of LOC147077 (Accession XM_085699). Accordingly, utilities of VGAM1867 include diagnosis, prevention and treatment of diseases and clinical conditions associated with LOC147077. LOC152765 (Accession XM_087519) is another VGAM1867 host target gene. LOC152765 BINDING SITE1 and LOC152765 BINDING SITE2 are HOST TARGET binding sites found in untranslated regions of mRNA encoded by LOC152765, corresponding to HOST TARGET binding sites such as BINDING SITE I, BINDING SITE II or BINDING SITE III. Table 2 illustrates the complementarity of the nucleotide sequences of LOC152765 BINDING SITE1 and LOC152765 BINDING SITE2, designated SEQ ID:39309 and SEQ ID:39310 respectively, to the nucleotide sequence of VGAM1867 RNA, herein designated VGAM RNA, also designated SEQ ID:4578.

Another function of VGAM1867 is therefore inhibition of LOC152765 (Accession XM_087519). Accordingly, utilities of VGAM1867 include diagnosis, prevention and treatment of diseases and clinical conditions associated with LOC152765. LOC153577 (Accession XM_098394) is another VGAM1867 host target gene. LOC153577 BINDING SITE is HOST TARGET binding site found in the 5' untranslated region of mRNA encoded by LOC153577, corresponding to a HOST TARGET binding site such as BINDING SITE I, BINDING SITE II or BINDING SITE III. Table 2 illustrates the complementarity of the nucleotide sequences of LOC153577 BINDING SITE, designated SEQ ID:41642, to the nucleotide sequence of VGAM1867 RNA, herein designated VGAM RNA, also designated SEQ ID:4578.

Another function of VGAM1867 is therefore inhibition of LOC153577 (Accession XM_098394). Accordingly, utilities of VGAM1867 include diagnosis, prevention and treatment of diseases and clinical conditions associated with LOC153577. LOC90936 (Accession XM_034953) is another VGAM1867 host target gene. LOC90936 BINDING SITE is HOST TARGET binding site found in the 5' untranslated region of mRNA encoded by LOC90936, corresponding to a HOST TARGET binding site such as BINDING SITE I, BINDING SITE II or BINDING SITE III. Table 2 illustrates the complementarity of the nucleotide sequences of LOC90936 BINDING SITE, designated SEQ ID:32189, to the nucleotide sequence of VGAM1867 RNA, herein designated VGAM RNA, also designated SEQ ID:4578.

Another function of VGAM1867 is therefore inhibition of LOC90936 (Accession XM_034953). Accordingly, utilities of VGAM1867 include diagnosis, prevention and treatment of diseases and clinical conditions associated with LOC90936. LOC92218 (Accession XM_043647) is another VGAM1867 host target gene. LOC92218 BINDING SITE is HOST TARGET binding site found in the 5' untranslated region of mRNA encoded by LOC92218, corresponding to a HOST TARGET binding site such as BINDING SITE I, BINDING SITE II or BINDING SITE III. Table 2 illustrates the complementarity of the nucleotide sequences of LOC92218 BINDING SITE, designated SEQ ID:33986, to the nucleotide sequence of VGAM1867 RNA, herein designated VGAM RNA, also designated SEQ ID:4578.

Another function of VGAM1867 is therefore inhibition of LOC92218 (Accession XM_043647). Accordingly, utilities of VGAM1867 include diagnosis, prevention and treatment of diseases and clinical conditions associated with LOC92218. LOC92305 (Accession NM_138385) is another VGAM1867 host target gene. LOC92305 BINDING SITE is HOST TARGET binding site found in the 3' untranslated region of mRNA encoded by LOC92305, corresponding to a HOST TARGET binding site such as BINDING SITE I, BINDING SITE II or BINDING SITE III. Table 2 illustrates the complementarity of the nucleotide sequences of LOC92305 BINDING SITE, designated SEQ ID:28757, to the nucleotide sequence of VGAM1867 RNA, herein designated VGAM RNA, also designated SEQ ID:4578.

Another function of VGAM1867 is therefore inhibition of LOC92305 (Accession NM_138385). Accordingly, utilities of VGAM1867 include diagnosis, prevention and treatment of diseases and clinical conditions associated with LOC92305. FIG. 1 further provides a conceptual description of a novel bioinformatically detected viral gene of the present invention, referred to here as Viral Genomic Address Messenger 1868 (VGAM1868) viral gene, which modulates expression of respective host target genes thereof, the function and utility of which host target genes is known in the art.

VGAM1868 is a novel bioinformatically detected regulatory, non protein coding, viral micro RNA (miRNA) gene.

The method by which VGAM1868 was detected is described hereinabove with reference to FIGS. 1-8.

VGAM1868 gene, herein designated VGAM GENE, is a viral gene contained in the genome of Callitrichine Herpesvirus 3. VGAM1868 host target gene, herein designated VGAM HOST TARGET GENE, is a human gene contained in the human genome.

VGAM1868 gene encodes a VGAM1868 precursor RNA, herein designated VGAM PRECURSOR RNA. Similar to other miRNA genes, and unlike most ordinary genes, VGAM1868 precursor RNA does not encode a protein. A nucleotide sequence identical or highly similar to the nucleotide sequence of VGAM1868 precursor RNA is designated SEQ ID:1854, and is provided hereinbelow with reference to the sequence listing part. Nucleotide sequence SEQ ID:1854 is located at position 119545 relative to the genome of Callitrichine Herpesvirus 3.

VGAM1868 precursor RNA folds onto itself, forming VGAM1868 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1868 folded precursor RNA into VGAM1868 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM1868 RNA is designated SEQ ID:4579, and is provided hereinbelow with reference to the sequence listing part.

VGAM1868 host target gene, herein designated VGAM HOST TARGET GENE, encodes a corresponding messenger RNA, VGAM1868 host target RNA, herein designated VGAM HOST TARGET RNA. VGAM1868 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1868 RNA, herein designated VGAM RNA, binds complementarily to one or more host target binding sites located in untranslated regions of VGAM1868 host target RNA, herein designated VGAM HOST TARGET RNA. This complementary binding is due to the fact that the nucleotide sequence of VGAM1868 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1868 RNA, herein designated VGAM RNA, may have a different number of host target binding sites in untranslated regions of a VGAM1868 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1868 RNA, herein designated VGAM RNA, to host target binding sites on VGAM1868 host target RNA, herein designated VGAM HOST TARGET RNA, such as BINDING SITE I, BINDING SITE II and BINDING SITE III, inhibits translation of VGAM1868 host target RNA into VGAM1868 host target protein, herein designated VGAM HOST TARGET PROTEIN. VGAM host target protein is therefore outlined by a broken line.

It is appreciated that VGAM1868 host target gene, herein designated VGAM HOST TARGET GENE, in fact represents a plurality of VGAM1868 host target genes. The mRNA of each one of this plurality of VGAM1868 host target genes comprises one or more host target binding sites, each having a nucleotide sequence which is at least partly complementary to VGAM1868 RNA, herein designated VGAM RNA, and which when bound by VGAM1868 RNA causes inhibition of translation of respective one or more VGAM1868 host target proteins.

It is further appreciated by one skilled in the art that the mode of translational inhibition illustrated by FIG. 1 with specific reference to translational inhibition exerted by VGAM1868 gene, herein designated VGAM GENE, on one or more VGAM1868 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1868 is inhibition of expression of host target genes, as part of a novel viral mechanism of attacking a host. Accordingly, utilities of VGAM1868 include diagnosis, prevention and treatment of viral infection by Callitrichine Herpesvirus 3. Specific functions, and accordingly utilities, of VGAM1868 correlate with, and may be deduced from, the identity of the host target genes which VGAM1868 binds and inhibits, and the function of these host target genes, as elaborated hereinbelow.

Nucleotide sequences of the VGAM1868 precursor RNA, herein designated VGAM PRECURSOR RNA, and of the 'diced' VGAM1868 RNA, herein designated VGAM RNA, and a schematic representation of the secondary folding of VGAM1868 folded precursor RNA, herein designated VGAM FOLDED PRECURSOR RNA, of VGAM1868 are further described hereinbelow with reference to Table 1.

Nucleotide sequences of host target binding sites, such as BINDING SITE-I, BINDING SITE-II and BINDING SITE-III of FIG. 1, found on VGAM1868 host target RNA, and schematic representation of the complementarity of each of these host target binding sites to VGAM1868 RNA, herein designated VGAM RNA, are described hereinbelow with reference to Table 2.

As mentioned hereinabove with reference to FIG. 1, a function of VGAM1868 gene, herein designated VGAM is inhibition of expression of VGAM1868 target genes. It is appreciated that specific functions, and accordingly utilities, of VGAM1868 correlate with, and may be deduced from, the identity of the target genes which VGAM1868 binds and inhibits, and the function of these target genes, as elaborated hereinbelow.

V-akt Murine Thymoma Viral Oncogene Homolog 1 (AKT1, Accession NM_005163) is a VGAM1868 host target gene. AKT1 BINDING SITE is HOST TARGET binding site found in the 3' untranslated region of mRNA encoded by AKT1, corresponding to a HOST TARGET binding site such as BINDING SITE I, BINDING SITE II or BINDING SITE III. Table 2 illustrates the complementarity of the nucleotide sequences of AKT1 BINDING SITE, designated SEQ ID:11653, to the nucleotide sequence of VGAM1868 RNA, herein designated VGAM RNA, also designated SEQ ID:4579.

A function of VGAM1868 is therefore inhibition of V-akt Murine Thymoma Viral Oncogene Homolog 1 (AKT1, Accession NM_005163), a gene which Serine-threonine protein kinase. Accordingly, utilities of VGAM1868 include diagnosis, prevention and treatment of diseases and clinical conditions associated with AKT1. The function of AKT1 and its association with various diseases and clinical conditions, has been established by previous studies, as described hereinabove with reference to VGAM188. Estrogen-related Receptor Gamma (ESRRG, Accession XM_039053) is another VGAM1868 host target gene. ESRRG BINDING SITE is HOST TARGET binding site found in the 3' untranslated region of mRNA encoded by ESRRG, corresponding to a HOST TARGET binding site such as BINDING SITE I, BINDING SITE II or BINDING SITE III. Table 2 illustrates the complementarity of the nucleotide sequences of ESRRG BINDING SITE, designated SEQ ID:33000, to the nucleotide sequence of VGAM1868 RNA, herein designated VGAM RNA, also designated SEQ ID:4579.

Another function of VGAM1868 is therefore inhibition of Estrogen-related Receptor Gamma (ESRRG, Accession XM_039053), a gene which Estrogen-related receptor gamma. Accordingly, utilities of VGAM1868 include diagnosis, prevention and treatment of diseases and clinical conditions associated with ESRRG. The function of ESRRG and its association with various diseases and clinical conditions, has been established by previous studies, as described hereinabove with reference to VGAM359. Protocadherin Beta 9 (PCDHB9, Accession NM_019119) is another VGAM1868 host target gene. PCDHB9 BINDING SITE is HOST TARGET binding site found in the 3' untranslated region of mRNA encoded by PCDHB9, corresponding to a HOST TARGET binding site such as BINDING SITE I, BINDING SITE II or BINDING SITE III. Table 2 illustrates the complementarity of the nucleotide sequences of PCDHB9 BINDING SITE, designated SEQ ID:21204, to the nucleotide sequence of VGAM1868 RNA, herein designated VGAM RNA, also designated SEQ ID:4579.

Another function of VGAM1868 is therefore inhibition of Protocadherin Beta 9 (PCDHB9, Accession NM_019119), a gene which is a potential calcium-dependent cell-adhesion protein. Accordingly, utilities of VGAM1868 include diagnosis, prevention and treatment of diseases and clinical conditions associated with PCDHB9. The function of PCDHB9 and its association with various diseases and clinical conditions, has been established by previous studies, as described hereinabove with reference to VGAM74. Sialyltransferase 8E (alpha-2, 8-polysialytransferase) (SIAT8E, Accession XM_008705) is another VGAM1868 host target gene. SIAT8E BINDING SITE is HOST TARGET binding site found in the 5' untranslated region of mRNA encoded by SIAT8E, corresponding to a HOST TARGET binding site such as BINDING SITE I, BINDING SITE II or BINDING SITE III. Table 2 illustrates the complementarity of the nucleotide sequences of SIAT8E BINDING SITE, designated SEQ ID:30089, to the nucleotide sequence of VGAM1868 RNA, herein designated VGAM RNA, also designated SEQ ID:4579.

Another function of VGAM1868 is therefore inhibition of Sialyltransferase 8E (alpha-2, 8-polysialytransferase) (SIAT8E, Accession XM_008705). Accordingly, utilities of VGAM1868 include diagnosis, prevention and treatment of diseases and clinical conditions associated with SIAT8E. TNF Receptor-associated Factor 1 (TRAF1, Accession NM_005658) is another VGAM1868 host target gene. TRAF1 BINDING SITE is HOST TARGET binding site found in the 3' untranslated region of mRNA encoded by TRAF1, corresponding to a HOST TARGET binding site such as BINDING SITE I, BINDING SITE II or BINDING SITE III. Table 2 illustrates the complementarity of the nucleotide sequences of TRAF1 BINDING SITE, designated SEQ ID:12197, to the nucleotide sequence of VGAM1868 RNA, herein designated VGAM RNA, also designated SEQ ID:4579.

Another function of VGAM1868 is therefore inhibition of TNF Receptor-associated Factor 1 (TRAF1, Accession NM_005658), a gene which signal transducer associated with the cytoplasmic domain of the 75 kda tumor necrosis factor receptor (tnf-r2). Accordingly, utilities of VGAM1868 include diagnosis, prevention and treatment of diseases and clinical conditions associated with TRAF1. The function of TRAF1 and its association with various diseases and clinical conditions, has been established by previous studies, as described hereinabove with reference to VGAM250. DKFZP434G1411 (Accession XM_166383) is another VGAM1868 host target gene. DKFZP434G1411 BINDING SITE is HOST TARGET binding site found in the 3' untranslated region of mRNA encoded by DKFZP434G1411, corresponding to a HOST TARGET binding site such as BINDING SITE I, BINDING SITE II or BINDING SITE III. Table 2 illustrates the complementarity of the nucleotide sequences of DKFZP434G1411 BINDING SITE, designated SEQ ID:44230, to the nucleotide sequence of VGAM1868 RNA, herein designated VGAM RNA, also designated SEQ ID:4579.

Another function of VGAM1868 is therefore inhibition of DKFZP434G1411 (Accession XM_166383). Accordingly, utilities of VGAM1868 include diagnosis, prevention and treatment of diseases and clinical conditions associated with DKFZP434G1411. FLJ10956 (Accession NM_018283) is another VGAM1868 host target gene. FLJ10956 BINDING SITE is HOST TARGET binding site found in the 3' untranslated region of mRNA encoded by FLJ10956, corresponding to a HOST TARGET binding site such as BINDING SITE I, BINDING SITE II or BINDING SITE III. Table 2 illustrates the complementarity of the nucleotide sequences of FLJ10956 BINDING SITE, designated SEQ ID:20276, to the nucleotide sequence of VGAM1868 RNA, herein designated VGAM RNA, also designated SEQ ID:4579.

Another function of VGAM1868 is therefore inhibition of FLJ10956 (Accession NM_018283). Accordingly, utilities of VGAM1868 include diagnosis, prevention and treatment of diseases and clinical conditions associated with FLJ10956. FLJ12787 (Accession NM_032175) is another VGAM1868 host target gene. FLJ12787 BINDING SITE is HOST TARGET binding site found in the 3' untranslated region of mRNA encoded by FLJ12787, corresponding to a HOST TARGET binding site such as BINDING SITE I, BINDING SITE II or BINDING SITE III. Table 2 illustrates the complementarity of the nucleotide sequences of FLJ12787 BINDING SITE, designated SEQ ID:25889, to the nucleotide sequence of VGAM1868 RNA, herein designated VGAM RNA, also designated SEQ ID:4579.

Another function of VGAM1868 is therefore inhibition of FLJ12787 (Accession NM_032175). Accordingly, utilities of VGAM1868 include diagnosis, prevention and treatment of diseases and clinical conditions associated with FLJ12787. Oxysterol Binding Protein-like 11 (OSBPL11, Accession NM_022776) is another VGAM1868 host target gene. OSBPL11 BINDING SITE is HOST TARGET binding site found in the 3' untranslated region of mRNA encoded by OSBPL11, corresponding to a HOST TARGET binding site such as BINDING SITE I, BINDING SITE II or BINDING SITE III. Table 2 illustrates the complementarity of the nucleotide sequences of OSBPL11 BINDING SITE, designated SEQ ID:23045, to the nucleotide sequence of VGAM1868 RNA, herein designated VGAM RNA, also designated SEQ ID:4579.

Another function of VGAM1868 is therefore inhibition of Oxysterol Binding Protein-like 11 (OSBPL11, Accession NM_022776). Accordingly, utilities of VGAM1868 include diagnosis, prevention and treatment of diseases and clinical conditions associated with OSBPL11. PSR (Accession XM_036784) is another VGAM1868 host target gene. PSR BINDING SITE is HOST TARGET binding site found in the 3' untranslated region of mRNA encoded by PSR, corresponding to a HOST TARGET binding site such as BINDING SITE I, BINDING SITE II or BINDING SITE III. Table 2 illustrates the complementarity of the nucleotide sequences of PSR BINDING SITE, designated SEQ ID:32495, to the nucleotide sequence of VGAM1868 RNA, herein designated VGAM RNA, also designated SEQ ID:4579.

Another function of VGAM1868 is therefore inhibition of PSR (Accession XM_036784). Accordingly, utilities of VGAM1868 include diagnosis, prevention and treatment of diseases and clinical conditions associated with PSR. RA-GEF-2 (Accession NM_016340) is another VGAM1868 host target gene. RA-GEF-2 BINDING SITE is HOST TARGET binding site found in the 3' untranslated region of mRNA encoded by RA-GEF-2, corresponding to a HOST TARGET binding site such as BINDING SITE I, BINDING SITE II or BINDING SITE III. Table 2 illustrates the complementarity of the nucleotide sequences of RA-GEF-2 BINDING SITE, designated SEQ ID:18460, to the nucleotide sequence of VGAM1868 RNA, herein designated VGAM RNA, also designated SEQ ID:4579.

Another function of VGAM1868 is therefore inhibition of RA-GEF-2 (Accession NM_016340). Accordingly, utilities of VGAM1868 include diagnosis, prevention and treatment of diseases and clinical conditions associated with RA-GEF-2. LOC149401 (Accession XM_086511) is another VGAM1868 host target gene. LOC149401 BINDING SITE is HOST TARGET binding site found in the 5' untranslated region of mRNA encoded by LOC149401, corresponding to a HOST TARGET binding site such as BINDING SITE I, BINDING SITE II or BINDING SITE III. Table 2 illustrates the complementarity of the nucleotide sequences of LOC149401 BINDING SITE, designated SEQ ID:38735, to the nucleotide sequence of VGAM1868 RNA, herein designated VGAM RNA, also designated SEQ ID:4579.

Another function of VGAM1868 is therefore inhibition of LOC149401 (Accession XM_086511). Accordingly, utilities of VGAM1868 include diagnosis, prevention and treatment of diseases and clinical conditions associated with LOC149401. LOC157860 (Accession XM_098832) is another VGAM1868 host target gene. LOC157860 BINDING SITE is HOST TARGET binding site found in the 5' untranslated region of mRNA encoded by LOC157860, corresponding to a HOST TARGET binding site such as BINDING SITE I, BINDING SITE II or BINDING SITE III. Table 2 illustrates the complementarity of the nucleotide sequences of LOC157860 BINDING SITE, designated SEQ ID:41860, to the nucleotide sequence of VGAM1868 RNA, herein designated VGAM RNA, also designated SEQ ID:4579.

Another function of VGAM1868 is therefore inhibition of LOC157860 (Accession XM_098832). Accordingly, utilities of VGAM1868 include diagnosis, prevention and treatment of diseases and clinical conditions associated with LOC157860. LOC158927 (Accession XM_099004) is another VGAM1868 host target gene. LOC158927 BINDING SITE is HOST TARGET binding site found in the 3' untranslated region of mRNA encoded by LOC158927, corresponding to a HOST TARGET binding site such as BINDING SITE I, BINDING SITE II or BINDING SITE III. Table 2 illustrates the complementarity of the nucleotide sequences of LOC158927 BINDING SITE, designated SEQ ID:42040, to the nucleotide sequence of VGAM1868 RNA, herein designated VGAM RNA, also designated SEQ ID:4579.

Another function of VGAM1868 is therefore inhibition of LOC158927 (Accession XM_099004). Accordingly, utilities of VGAM1868 include diagnosis, prevention and treatment of diseases and clinical conditions associated with LOC158927. LOC165552 (Accession XM_092666) is another VGAM1868 host target gene. LOC165552 BINDING SITE is HOST TARGET binding site found in the 3' untranslated region of mRNA encoded by LOC165552, corresponding to a HOST TARGET binding site such as BINDING SITE I, BINDING SITE II or BINDING SITE III. Table 2 illustrates the complementarity of the nucleotide sequences of LOC165552 BINDING SITE, designated SEQ ID:40132, to the nucleotide sequence of VGAM1868 RNA, herein designated VGAM RNA, also designated SEQ ID:4579.

Another function of VGAM1868 is therefore inhibition of LOC165552 (Accession XM_092666). Accordingly, utilities of VGAM1868 include diagnosis, prevention and treatment of diseases and clinical conditions associated with LOC165552. LOC92370 (Accession XM_044665) is another VGAM1868 host target gene. LOC92370 BINDING SITE is HOST TARGET binding site found in the 3' untranslated region of mRNA encoded by LOC92370, corresponding to a HOST TARGET binding site such as BINDING SITE I, BINDING SITE II or BINDING SITE III. Table 2 illustrates the complementarity of the nucleotide sequences of LOC92370 BINDING SITE, designated SEQ ID:34258, to the nucleotide sequence of VGAM1868 RNA, herein designated VGAM RNA, also designated SEQ ID:4579.

Another function of VGAM1868 is therefore inhibition of LOC92370 (Accession XM_044665). Accordingly, utilities of VGAM1868 include diagnosis, prevention and treatment of diseases and clinical conditions associated with LOC92370. FIG. 1 further provides a conceptual description of a novel bioinformatically detected viral gene of the present invention, referred to here as Viral Genomic Address Messenger 1869 (VGAM1869) viral gene, which modulates expression of respective host target genes thereof, the function and utility of which host target genes is known in the art.

VGAM1869 is a novel bioinformatically detected regulatory, non protein coding, viral micro RNA (miRNA) gene. The method by which VGAM1869 was detected is described hereinabove with reference to FIGS. 1-8.

VGAM1869 gene, herein designated VGAM GENE, is a viral gene contained in the genome of Equine Herpesvirus 2. VGAM1869 host target gene, herein designated VGAM HOST TARGET GENE, is a human gene contained in the human genome.

VGAM1869 gene encodes a VGAM1869 precursor RNA, herein designated VGAM PRECURSOR RNA. Similar to other miRNA genes, and unlike most ordinary genes, VGAM1869 precursor RNA does not encode a protein. A nucleotide sequence identical or highly similar to the nucleotide sequence of VGAM1869 precursor RNA is designated SEQ ID:1855, and is provided hereinbelow with reference to the sequence listing part. Nucleotide sequence SEQ ID:1855 is located at position 125161 relative to the genome of Equine Herpesvirus 2.

VGAM1869 precursor RNA folds onto itself, forming VGAM1869 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1869 folded precursor RNA into VGAM1869 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1869 RNA is designated SEQ ID:4580, and is provided hereinbelow with reference to the sequence listing part.

VGAM1869 host target gene, herein designated VGAM HOST TARGET GENE, encodes a corresponding messenger RNA, VGAM1869 host target RNA, herein designated VGAM HOST TARGET RNA. VGAM1869 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1869 RNA, herein designated VGAM RNA, binds complementarily to one or more host target binding sites located in untranslated regions of VGAM1869 host target RNA, herein designated VGAM HOST TARGET RNA. This complementary binding is due to the fact that the nucleotide sequence of VGAM1869 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1869 RNA, herein designated VGAM RNA, may have a different number of host target binding sites in untranslated regions of a VGAM1869 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1869 RNA, herein designated VGAM RNA, to host target binding sites on VGAM1869 host target RNA, herein designated VGAM HOST TARGET RNA, such as BINDING SITE I, BINDING SITE II and BINDING SITE III, inhibits translation of VGAM1869 host target RNA into VGAM1869 host target protein, herein designated VGAM HOST TARGET PROTEIN. VGAM host target protein is therefore outlined by a broken line.

It is appreciated that VGAM1869 host target gene, herein designated VGAM HOST TARGET GENE, in fact represents a plurality of VGAM1869 host target genes. The mRNA of each one of this plurality of VGAM1869 host target genes comprises one or more host target binding sites, each having a nucleotide sequence which is at least partly complementary to VGAM1869 RNA, herein designated VGAM RNA, and which when bound by VGAM1869 RNA causes inhibition of translation of respective one or more VGAM1869 host target proteins.

It is further appreciated by one skilled in the art that the mode of translational inhibition illustrated by FIG. 1 with specific reference to translational inhibition exerted by VGAM1869 gene, herein designated VGAM GENE, on one or more VGAM1869 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1869 is inhibition of expression of host target genes, as part of a novel viral mechanism of attacking a host. Accordingly, utilities of VGAM1869 include diagnosis, prevention and treatment of viral infection by Equine Herpesvirus 2. Specific functions, and accordingly utilities, of VGAM1869 correlate with, and may be deduced from, the identity of the host target genes which VGAM1869 binds and inhibits, and the function of these host target genes, as elaborated hereinbelow.

Nucleotide sequences of the VGAM1869 precursor RNA, herein designated VGAM PRECURSOR RNA, and of the 'diced' VGAM1869 RNA, herein designated VGAM RNA, and a schematic representation of the secondary folding of VGAM1869 folded precursor RNA, herein designated VGAM FOLDED PRECURSOR RNA, of VGAM1869 are further described hereinbelow with reference to Table 1.

Nucleotide sequences of host target binding sites, such as BINDING SITE-I, BINDING SITE-II and BINDING SITE-III of FIG. 1, found on VGAM1869 host target RNA, and schematic representation of the complementarity of each of these host target binding sites to VGAM1869 RNA, herein designated VGAM RNA, are described hereinbelow with reference to Table 2.

As mentioned hereinabove with reference to FIG. 1, a function of VGAM1869 gene, herein designated VGAM is inhibition of expression of VGAM1869 target genes. It is appreciated that specific functions, and accordingly utilities, of VGAM1869 correlate with, and may be deduced from, the identity of the target genes which VGAM1869 binds and inhibits, and the function of these target genes, as elaborated hereinbelow.

CDP-diacylglycerol Synthase (phosphatidate cytidylyltransferase) 2 (CDS2, Accession NM_003818) is a VGAM1869 host target gene. CDS2 BINDING SITE is HOST TARGET binding site found in the 5' untranslated region of mRNA encoded by CDS2, corresponding to a HOST TARGET binding site such as BINDING SITE I, BINDING SITE II or BINDING SITE III. Table 2 illustrates the complementarity of the nucleotide sequences of CDS2 BINDING SITE, designated SEQ ID:9908, to the nucleotide sequence of VGAM1869 RNA, herein designated VGAM RNA, also designated SEQ ID:4580.

A function of VGAM1869 is therefore inhibition of CDP-diacylglycerol Synthase (phosphatidate cytidylyltransferase) 2 (CDS2, Accession NM_003818), a gene which is a key regulator of the amount of PIP2 available for signaling. Accordingly, utilities of VGAM1869 include diagnosis, prevention and treatment of diseases and clinical conditions associated with CDS2. The function of CDS2 and its association with various diseases and clinical conditions, has been established by previous studies, as described hereinabove with reference to VGAM900. Dysferlin, Limb Girdle Muscular Dystrophy 2B (autosomal recessive) (DYSF, Accession NM_003494) is another VGAM1869 host target gene. DYSF BINDING SITE is HOST TARGET binding site found in the 5' untranslated region of mRNA encoded by DYSF, corresponding to a HOST TARGET binding site such as BINDING SITE I, BINDING SITE II or BINDING SITE III. Table 2 illustrates the complementarity of the nucleotide sequences of DYSF BINDING SITE, designated SEQ ID:9585, to the nucleotide sequence of VGAM1869 RNA, herein designated VGAM RNA, also designated SEQ ID:4580.

Another function of VGAM1869 is therefore inhibition of Dysferlin, Limb Girdle Muscular Dystrophy 2B (autosomal recessive) (DYSF, Accession NM_003494), a gene which is highly expressed in skeletal muscle. Accordingly, utilities of VGAM1869 include diagnosis, prevention and treatment of diseases and clinical conditions associated with DYSF. The function of DYSF has been established by previous studies. The limb-girdle muscular dystrophies are a genetically heterogeneous group of inherited progressive muscular disorders that affect mainly the proximal musculature, with evidence for at least 3 autosomal dominant and 8 autosomal recessive loci. The recessive forms for the most part involve mutations in genes encoding components of the dystrophin-associated complex; another form, LGMD2A (OMIM Ref. No. 253600), is caused by mutations in the gene for the muscle-specific protease calpain 3 (CAPN3; 114340). Miyoshi myopathy (MM; 254130) is an adult-onset, recessively inherited distal muscular dystrophy that maps to 2p13. A form of recessive limb-girdle muscular dystrophy, designated LGMD2B (OMIM Ref. No. 253601), maps to the same chromosomal region. This raised the possibility that MM and LGMD2B are allelic disorders. In fact they were shown to be varying expressions of the same mutant gene; 2 large, inbred kindreds whose members included both MM and LGMD2B patients were described by Weiler et al. (1996) and Illarioshkin et al. (1996, 1997). Affected individuals in both pedigrees shared the same haplotype. Differences in the phenotype appeared to be due to additional modifying factors. Liu et al. (1998) constructed a 3-Mb PAC contig spanning the MM candidate region. This clarified the order of genetic markers across the area, provided 5 new polymorphic markers within it, and narrowed the locus to approximately 2 Mb. They found 5 skeletal muscle ESTs that mapped in this region. Liu et al. (1998) reported that 1 of these ESTs is located in a novel, full-length 6.9-kb muscle cDNA; they designated the corresponding protein dysferlin. Animal model experiments lend further support to the function of DYSF. The SJL mouse strain (Festing, 1979) is susceptible to many induced autoimmune diseases such as experimental autoimmune encephalitis (EAE) and inflammatory muscle disease. Additionally, the skeletal muscle of SJL mice was shown to have an increased regenerative capacity and demonstrates the spontaneous occurrence of what was designated an 'inflammatory myopathy,' accompanied by loss of strength. By histopathologic examinations of muscles in SJL mice of different ages, Bittner et al. (1999) found features compatible with a progressive muscular dystrophy, including degenerative and regenerative changes of muscle fibers and a progressive fibrosis. Histologically, the changes were observed in mice as young as 3 weeks of age. Changes affected primarily the proximal muscle groups, whereas the distal muscles remained less affected. The morphologic alterations were associated with signs of slowly progressive muscle weakness, which Bittner et al. (1999) detected as early as 3 weeks after birth when mice were suspended by their tails. The phenotype was found to be inherited as an autosomal recessive trait and was found to map to mouse chromosome 6, in a region syntenic with human 2p13, where the DYSF gene maps. Because of this synteny, Bittner et al. (1999) studied dysferlin in these mice. They found a reduction to approximately 15% of control levels in SJL mice. They found a 171-bp deletion in the Dysf gene of SJL mice, predicted to result in removal of 57 amino acids, including most of the fourth C2 domain. The last C2 domain is conserved in other members of the fer-like gene family.

It is appreciated that the abovementioned animal model for DYSF is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bittner, R. E.; Anderson, L. V. B.; Burkhardt, E.; Bashir, R.; Vafiadaki, E.; Ivanova, S.; Raffelsberger, T.; Maerk, I.; Hoger, H.; Jung, M.; Karbasiyan, M.; Storch, M.; Lassmann, H.; Moss, J. A.; Davison, K.; Harrison, R.; Bushby, K. M. D.; Reis, A. : Dysferlin deletion in SJL mice (SJL-Dysf) defines a natural model for limb girdle muscular dystrophy 2B. (Letter) Nature Genet. 23:141-142, 1999; and Liu, J.; Wu, C.; Bossie, K.; Bejaoui, K.; Hosler, B. A.; Gingrich, J. C.; Ben Hamida, M.; Hentati, F.; Schurr, E.; de Jong, P. J.; Brown, R. H., JR.: Generation of 3-Mb PAC contig sp.

Further studies establishing the function and utilities of DYSF are found in John Hopkins OMIM database record ID 603009, and in sited publications numbered 5879, 7234, 7754-7756, 6425, 6427, 7235, 7757-7758, 947 and 7759 listed in the bibliography section hereinbelow, which are also hereby incorporated by reference. Fibroblast Growth Factor 18 (FGF18, Accession NM_003862) is another VGAM1869 host target gene. FGF18 BINDING SITE1 and FGF18 BINDING SITE2 are HOST TARGET binding sites found in untranslated regions of mRNA encoded by FGF18, corresponding to HOST TARGET binding sites such as BINDING SITE I, BINDING SITE II or BINDING SITE III. Table 2 illustrates the complementarity of the nucleotide sequences of FGF18 BINDING SITE1 and FGF18 BINDING SITE2, designated SEQ ID:9955 and SEQ ID:27383 respectively, to the nucleotide sequence of VGAM1869 RNA, herein designated VGAM RNA, also designated SEQ ID:4580.

Another function of VGAM1869 is therefore inhibition of Fibroblast Growth Factor 18 (FGF18, Accession NM_003862), a gene which stimulates hepatic and intestinal proliferation. Accordingly, utilities of VGAM1869 include diagnosis, prevention and treatment of diseases and clinical conditions associated with FGF18. The function of FGF18 and its association with various diseases and clinical conditions, has been established by previous studies, as described hereinabove with reference to VGAM925. LENG4 (Accession NM_024298) is another VGAM1869 host target gene. LENG4 BINDING SITE is HOST TARGET binding site found in the 3' untranslated region of mRNA encoded by LENG4, corresponding to a HOST TARGET binding site such as BINDING SITE I, BINDING SITE II or BINDING SITE III. Table 2 illustrates the complementarity of the nucleotide sequences of LENG4 BINDING SITE, designated SEQ ID:23585, to the nucleotide sequence of VGAM1869 RNA, herein designated VGAM RNA, also designated SEQ ID:4580.

Another function of VGAM1869 is therefore inhibition of LENG4 (Accession NM_024298), a gene which may be a transmembrane protein. Accordingly, utilities of VGAM1869 include diagnosis, prevention and treatment of diseases and clinical conditions associated with LENG4. The function of LENG4 and its association with various diseases and clinical conditions, has been established by previous studies, as described hereinabove with reference to VGAM259. V-yes-1 Yamaguchi Sarcoma Viral Related Oncogene Homolog (LYN, Accession NM_002350) is another VGAM1869 host target gene. LYN BINDING SITE is HOST TARGET binding site found in the 5' untranslated region of mRNA encoded by LYN, corresponding to a HOST TARGET binding site such as BINDING SITE I, BINDING SITE II or BINDING SITE III. Table 2 illustrates the complementarity of the nucleotide sequences of LYN BINDING SITE, designated SEQ ID:8153, to the nucleotide sequence of VGAM1869 RNA, herein designated VGAM RNA, also designated SEQ ID:4580.

Another function of VGAM1869 is therefore inhibition of V-yes-1 Yamaguchi Sarcoma Viral Related Oncogene Homolog (LYN, Accession NM_002350), a gene which is a Tyrosine kinase with similarity to murine tyrosine kinase p56lck; similar to v-yes protein and the gene products of v-fgr and v-src. Accordingly, utilities of VGAM1869 include diagnosis, prevention and treatment of diseases and clinical conditions associated with LYN. The function of LYN and its association with various diseases and clinical conditions, has been established by previous studies, as described hereinabove with reference to VGAM247. Matrix Metalloproteinase 25 (MMP25, Accession NM_022468) is another VGAM1869 host target gene. MMP25 BINDING SITE is HOST TARGET binding site found in the 3' untranslated region of mRNA encoded by MMP25, corresponding to a HOST TARGET binding site such as BINDING SITE I, BINDING SITE II or BINDING SITE III. Table 2 illustrates the complementarity of the nucleotide sequences of MMP25 BINDING SITE, designated SEQ ID:22822, to the nucleotide sequence of VGAM1869 RNA, herein designated VGAM RNA, also designated SEQ ID:4580.

Another function of VGAM1869 is therefore inhibition of Matrix Metalloproteinase 25 (MMP25, Accession NM_022468). Accordingly, utilities of VGAM1869 include diagnosis, prevention and treatment of diseases and clinical conditions associated with MMP25. Phospholipase A2, Group X (PLA2G10, Accession NM_003561) is another VGAM1869 host target gene. PLA2G10 BINDING SITE is HOST TARGET binding site found in the 5' untranslated region of mRNA encoded by PLA2G10, corresponding to a HOST TARGET binding site such as BINDING SITE I, BINDING SITE II or BINDING SITE III. Table 2 illustrates the complementarity of the nucleotide sequences of PLA2G10 BINDING SITE, designated SEQ ID:9619, to the nucleotide sequence of VGAM1869 RNA, herein designated VGAM RNA, also designated SEQ ID:4580.

Another function of VGAM1869 is therefore inhibition of Phospholipase A2, Group X (PLA2G10, Accession NM_003561). Accordingly, utilities of VGAM1869 include diagnosis, prevention and treatment of diseases and clinical conditions associated with PLA2G10. Scratch Homolog 1, Zinc Finger Protein (Drosophila) (SCRT1, Accession NM_031309) is another VGAM1869 host target gene. SCRT1 BINDING SITE is HOST TARGET binding site found in the 3' untranslated region of mRNA encoded by SCRT1, corresponding to a HOST TARGET binding site such as BINDING SITE I, BINDING SITE II or BINDING SITE III. Table 2 illustrates the complementarity of the nucleotide sequences of SCRT1 BINDING SITE, designated SEQ ID:25346, to the nucleotide sequence of VGAM1869 RNA, herein designated VGAM RNA, also designated SEQ ID:4580.

Another function of VGAM1869 is therefore inhibition of Scratch Homolog 1, Zinc Finger Protein (Drosophila) (SCRT1, Accession NM_031309), a gene which is involved in the generation and migration of neural crest cells. Accordingly, utilities of VGAM1869 include diagnosis, prevention and treatment of diseases and clinical conditions associated with SCRT1. The function of SCRT1 and its association with various diseases and clinical conditions, has been established by previous studies, as described hereinabove with reference to VGAM1189. Solute Carrier Family 14 (urea transporter), Member 2 (SLC14A2, Accession NM_007163) is another VGAM1869 host target gene. SLC14A2 BINDING SITE is HOST TARGET binding site found in the 5' untranslated region of mRNA encoded by SLC14A2, corresponding to a HOST TARGET binding site such as BINDING SITE I, BINDING SITE II or BINDING SITE III. Table 2 illustrates the complementarity of the nucleotide sequences of SLC14A2 BINDING SITE, designated SEQ ID:14011, to the nucleotide sequence of VGAM1869 RNA, herein designated VGAM RNA, also designated SEQ ID:4580.

Another function of VGAM1869 is therefore inhibition of Solute Carrier Family 14 (urea transporter), Member 2 (SLC14A2, Accession NM_007163), a gene which is a renal urea transporter 2. Accordingly, utilities of VGAM1869 include diagnosis, prevention and treatment of diseases and clinical conditions associated with SLC14A2. The function of SLC14A2 and its association with various diseases and clinical conditions, has been established by previous studies, as described hereinabove with reference to VGAM74. Survival of Motor Neuron 1, Telomeric (SMN1, Accession NM_022874) is another VGAM1869 host target gene. SMN1 BINDING SITE1 and SMN1 BINDING SITE2 are HOST TARGET binding sites found in untranslated regions of mRNA encoded by SMN1, corresponding to HOST TARGET binding sites such as BINDING SITE I, BINDING SITE II or BINDING SITE III. Table 2 illustrates the complementarity of the nucleotide sequences of SMN1 BINDING SITE1 and SMN1 BINDING SITE2, designated SEQ ID:23151 and SEQ ID:5895 respectively, to the nucleotide sequence of VGAM1869 RNA, herein designated VGAM RNA, also designated SEQ ID:4580.

Another function of VGAM1869 is therefore inhibition of Survival of Motor Neuron 1, Telomeric (SMN1, Accession NM_022874), a gene which plays an essential role in spliceosomal snrnp assembly in the cytoplasm. Accordingly, utilities of VGAM1869 include diagnosis, prevention and treatment of diseases and clinical conditions associated with SMN1. The function of SMN1 has been established by previous studies. Lefebvre et al. (1995) described an inverted duplication of a 500-kb element in normal chromosome 5q13 which contains the gene for spinal muscular atrophy, e.g., type I (SMA1; 253300). They further narrowed the critical region to 140 kb within the telomeric portion of this region. This interval was found to contain a 20-kb gene encoding a novel protein of 294 amino acids. A highly homologous gene (SMN2; 601627), referred to as C-BCD541, was present in the duplicated centromeric element in 95% of controls. The authors suggested that the defect in SMA resides in the telomeric gene, which they found was either lacking or interrupted in 226 of 229 patients. The other 3 patients retaining the gene carried either a point mutation (Y272C; 600354.0004) or short deletions in the consensus splice sites of introns 6 and 7. The gene, designated SMN for survival motor neuron gene, was found to have no homology at either the nucleotide or the amino acid level to sequences in several databases. The SMN gene has 8 exons. SMN interacts with spliceosomal snRNP proteins and is critical for snRNP assembly in the cytoplasm. Pellizzoni et al. (1998) demonstrated that a dominant-negative mutant SMN lacking the first amino-terminal 27 amino acids (SMNdelN27) causes a dramatic reorganization of snRNPs in the nucleus. Furthermore, SMNdelN27 inhibits pre-mRNA splicing in vitro, while wildtype SMN stimulates splicing (using chicken delta-crystallin mRNA as the experimental system). SMN mutants found in SMA patients cannot stimulate splicing. These findings demonstrate that SMN plays a crucial role in the generation of the pre-mRNA splicing machinery and thus in mRNA biogenesis. Animal model experiments lend further support to the function of SMN1. To understand the functional role of SMN1 in spinal muscular atrophy, Hsieh-Li et al. (2000) produced mouse lines deficient for mouse Smn and transgenic mouse lines that expressed human SMN2. Smn -/- mice died during the peri-implantation stage. In contrast, transgenic mice harboring SMN2 in the Smn -/- background showed pathologic changes in the spinal cord and skeletal muscles similar to those of SMA patients. The severity of the pathologic changes in these mice correlated with the amount of SMN protein that contained the region encoded by exon 7. The results demonstrated that SMN2 can partially compensate for lack of SMN1. The variable phenotypes of Smn -/-SMN2 mice reflected those seen in SMA patients, thus providing a mouse model for that disease.

It is appreciated that the abovementioned animal model for SMN1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Lefebvre, S.; Burglen, L.; Reboullet, S.; Clermont, O.; Burlet, P.; Viollet, L.; Benichou, B.; Cruaud, C.; Millasseau, P.; Zeviani, M.; Le Paslier, D.; Frezal, J.; Cohen, D.; Weissenbach, J.; Munnich, A.; Melki, J.: Identification and characterization of a spinal muscular atrophy-determining gene. Cell 80:155-165, 1995; and Hsieh-Li, H. M.; Chang, J.-G.; Jong, Y.-J.; Wu, M.-H.; Wang, N. M.; Tsai, C. H.; Li, H.: A mouse model for spinal muscular atrophy. Nature Genet. 24:66-70, 2000.

Further studies establishing the function and utilities of SMN1 are found in John Hopkins OMIM database record ID 600354, and in sited publications numbered 8364, 9829-8371, 9237, 9879-9885, 9238, 9886-9888, 9239, 9889-9893, 9240, 9894-9902, 10138, 10160-10172, 673 and 10173 listed in the bibliography section hereinbelow, which are also hereby incorporated by reference. Centaurin, Beta 5 (CENTB5, Accession XM_170937) is another VGAM1869 host target gene. CENTB5 BINDING SITE is HOST TARGET binding site found in the 3' untranslated region of mRNA encoded by CENTB5, corresponding to a HOST TARGET binding site such as BINDING SITE I, BINDING SITE II or BINDING SITE III. Table 2 illustrates the complementarity of the nucleotide sequences of CENTB5 BINDING SITE, designated SEQ ID:45724, to the nucleotide sequence of VGAM1869 RNA, herein designated VGAM RNA, also designated SEQ ID:4580.

Another function of VGAM1869 is therefore inhibition of Centaurin, Beta 5 (CENTB5, Accession XM_170937). Accordingly, utilities of VGAM1869 include diagnosis, prevention and treatment of diseases and clinical conditions associated with CENTB5. DKFZP434F0318 (Accession NM_030817) is another VGAM1869 host target gene. DKFZP434F0318 BINDING SITE is HOST TARGET binding site found in the 3' untranslated region of mRNA encoded by DKFZP434F0318, corresponding to a HOST TARGET binding site such as BINDING SITE I, BINDING SITE II or BINDING SITE III. Table 2 illustrates the complementarity of the nucleotide sequences of DKFZP434F0318 BINDING SITE, designated SEQ ID:25142, to the nucleotide sequence of VGAM1869 RNA, herein designated VGAM RNA, also designated SEQ ID:4580.

Another function of VGAM1869 is therefore inhibition of DKFZP434F0318 (Accession NM_030817). Accordingly, utilities of VGAM1869 include diagnosis, prevention and treatment of diseases and clinical conditions associated with DKFZP434F0318. DKFZp761O0113 (Accession NM_018409) is another VGAM1869 host target gene. DKFZp761O0113 BINDING SITE is HOST TARGET binding site found in the 5' untranslated region of mRNA encoded by DKFZp761O0113, corresponding to a HOST TARGET binding site such as BINDING SITE I, BINDING SITE II or BINDING SITE III. Table 2 illustrates the complementarity of the nucleotide sequences of DKFZp761O0113 BINDING SITE, designated SEQ ID:20447, to the nucleotide sequence of VGAM1869 RNA, herein designated VGAM RNA, also designated SEQ ID:4580.

Another function of VGAM1869 is therefore inhibition of DKFZp761O0113 (Accession NM_018409). Accordingly, utilities of VGAM1869 include diagnosis, prevention and treatment of diseases and clinical conditions associated with DKFZp761O0113. FLJ10297 (Accession NM_018049) is another VGAM1869 host target gene. FLJ10297 BINDING SITE1 and FLJ10297 BINDING SITE2 are HOST TARGET binding sites found in untranslated regions of mRNA encoded by FLJ10297, corresponding to HOST TARGET binding sites such as BINDING SITE I, BINDING SITE II or BINDING SITE III. Table 2 illustrates the complementarity of the nucleotide sequences of FLJ10297 BINDING SITE1 and FLJ10297 BINDING SITE2, designated SEQ ID:19804 and SEQ ID:19806 respectively, to the nucleotide sequence of VGAM1869 RNA, herein designated VGAM RNA, also designated SEQ ID:4580.

Another function of VGAM1869 is therefore inhibition of FLJ10297 (Accession NM_018049). Accordingly, utilities of VGAM1869 include diagnosis, prevention and treatment of diseases and clinical conditions associated with FLJ10297. FLJ12387 (Accession NM_022822) is another VGAM1869 host target gene. FLJ12387 BINDING SITE is HOST TARGET binding site found in the 3' untranslated region of mRNA encoded by FLJ12387, corresponding to a HOST TARGET binding site such as BINDING SITE I, BINDING SITE II or BINDING SITE III. Table 2 illustrates the complementarity of the nucleotide sequences of FLJ12387 BINDING SITE, designated SEQ ID:23102, to the nucleotide sequence of VGAM1869 RNA, herein designated VGAM RNA, also designated SEQ ID:4580.

Another function of VGAM1869 is therefore inhibition of FLJ12387 (Accession NM_022822). Accordingly, utilities of VGAM1869 include diagnosis, prevention and treatment of diseases and clinical conditions associated with FLJ12387. FLJ12581 (Accession NM_024865) is another VGAM1869 host target gene. FLJ12581 BINDING SITE is HOST TARGET binding site found in the 3' untranslated region of mRNA encoded by FLJ12581, corresponding to a HOST TARGET binding site such as BINDING SITE I, BINDING SITE II or BINDING SITE III. Table 2 illustrates the complementarity of the nucleotide sequences of FLJ12581 BINDING SITE, designated SEQ ID:24301, to the nucleotide sequence of VGAM1869 RNA, herein designated VGAM RNA, also designated SEQ ID:4580.

Another function of VGAM1869 is therefore inhibition of FLJ12581 (Accession NM_024865). Accordingly, utilities of VGAM1869 include diagnosis, prevention and treatment of diseases and clinical conditions associated with FLJ12581. FLJ14810 (Accession NM_032843) is another VGAM1869 host target gene. FLJ14810 BINDING SITE is HOST TARGET binding site found in the 3' untranslated region of mRNA encoded by FLJ14810, corresponding to a HOST TARGET binding site such as BINDING SITE I, BINDING SITE II or BINDING SITE III. Table 2 illustrates the complementarity of the nucleotide sequences of FLJ14810 BINDING SITE, designated SEQ ID:26636, to the nucleotide sequence of VGAM1869 RNA, herein designated VGAM RNA, also designated SEQ ID:4580.

Another function of VGAM1869 is therefore inhibition of FLJ14810 (Accession NM_032843). Accordingly, utilities of VGAM1869 include diagnosis, prevention and treatment of diseases and clinical conditions associated with FLJ14810. FLJ14834 (Accession NM_032849) is another VGAM1869 host target gene. FLJ14834 BINDING SITE is HOST TARGET binding site found in the 5' untranslated region of mRNA encoded by FLJ14834, corresponding to a HOST TARGET binding site such as BINDING SITE I, BINDING SITE II or BINDING SITE III. Table 2 illustrates the complementarity of the nucleotide sequences of FLJ14834 BINDING SITE, designated SEQ ID:26643, to the nucleotide sequence of VGAM1869 RNA, herein designated VGAM RNA, also designated SEQ ID:4580.

Another function of VGAM1869 is therefore inhibition of FLJ14834 (Accession NM_032849). Accordingly, utilities of VGAM1869 include diagnosis, prevention and treatment of diseases and clinical conditions associated with FLJ14834. FLJ21032 (Accession NM_024906) is another VGAM1869 host target gene. FLJ21032 BINDING SITE is HOST TARGET binding site found in the 5' untranslated region of mRNA encoded by FLJ21032, corresponding to a HOST TARGET binding site such as BINDING SITE I, BINDING SITE II or BINDING SITE III. Table 2 illustrates the complementarity of the nucleotide sequences of FLJ21032 BINDING SITE, designated SEQ ID:24397, to the nucleotide sequence of VGAM1869 RNA, herein designated VGAM RNA, also designated SEQ ID:4580.

Another function of VGAM1869 is therefore inhibition of FLJ21032 (Accession NM_024906). Accordingly, utilities of VGAM1869 include diagnosis, prevention and treatment of diseases and clinical conditions associated with FLJ21032. FLJ22479 (Accession NM_024900) is another VGAM1869 host target gene. FLJ22479 BINDING SITE is HOST TARGET binding site found in the 5' untranslated region of mRNA encoded by FLJ22479, corresponding to a HOST TARGET binding site such as BINDING SITE I, BINDING SITE II or BINDING SITE III. Table 2 illustrates the complementarity of the nucleotide sequences of FLJ22479 BINDING SITE, designated SEQ ID:24385, to the nucleotide sequence of VGAM1869 RNA, herein designated VGAM RNA, also designated SEQ ID:4580.

Another function of VGAM1869 is therefore inhibition of FLJ22479 (Accession NM_024900). Accordingly, utilities of VGAM1869 include diagnosis, prevention and treatment of diseases and clinical conditions associated with FLJ22479. HCA4 (Accession XM_085287) is another VGAM1869 host target gene. HCA4 BINDING SITE is HOST TARGET binding site found in the 3' untranslated region of mRNA encoded by HCA4, corresponding to a HOST TARGET binding site such as BINDING SITE I, BINDING SITE II or BINDING SITE III. Table 2 illustrates the complementarity of the nucleotide sequences of HCA4 BINDING SITE, designated SEQ ID:38023, to the nucleotide sequence of VGAM1869 RNA, herein designated VGAM RNA, also designated SEQ ID:4580.

Another function of VGAM1869 is therefore inhibition of HCA4 (Accession XM_085287). Accordingly, utilities of VGAM1869 include diagnosis, prevention and treatment of diseases and clinical conditions associated with HCA4. KIAA0089 (Accession XM_046056) is another VGAM1869 host target gene. KIAA0089 BINDING SITE is HOST TARGET binding site found in the 5' untranslated region of mRNA encoded by KIAA0089, corresponding to a HOST TARGET binding site such as BINDING SITE I, BINDING SITE II or BINDING SITE III. Table 2 illustrates the complementarity of the nucleotide sequences of KIAA0089 BINDING SITE, designated SEQ ID:34665, to the nucleotide sequence of VGAM1869 RNA, herein designated VGAM RNA, also designated SEQ ID:4580.

Another function of VGAM1869 is therefore inhibition of KIAA0089 (Accession XM_046056). Accordingly, utilities of VGAM1869 include diagnosis, prevention and treatment of diseases and clinical conditions associated with KIAA0089. KIAA0557 (Accession XM_085507) is another VGAM1869 host target gene. KIAA0557 BINDING SITE is HOST TARGET binding site found in the 3' untranslated region of mRNA encoded by KIAA0557, corresponding to a HOST TARGET binding site such as BINDING SITE I, BINDING SITE II or BINDING SITE III. Table 2 illustrates the complementarity of the nucleotide sequences of KIAA0557 BINDING SITE, designated SEQ ID:38208, to the nucleotide sequence of VGAM1869 RNA, herein designated VGAM RNA, also designated SEQ ID:4580.

Another function of VGAM1869 is therefore inhibition of KIAA0557 (Accession XM_085507). Accordingly, utilities of VGAM1869 include diagnosis, prevention and treatment of diseases and clinical conditions associated with KIAA0557. KIAA1210 (Accession XM_172801) is another VGAM1869 host target gene. KIAA1210 BINDING SITE is HOST TARGET binding site found in the 3' untranslated region of mRNA encoded by KIAA1210, corresponding to a HOST TARGET binding site such as BINDING SITE I, BINDING SITE II or BINDING SITE III. Table 2 illustrates the complementarity of the nucleotide sequences of KIAA1210 BINDING SITE, designated SEQ ID:46087, to the nucleotide sequence of VGAM1869 RNA, herein designated VGAM RNA, also designated SEQ ID:4580.

Another function of VGAM1869 is therefore inhibition of KIAA1210 (Accession XM_172801). Accordingly, utilities of VGAM1869 include diagnosis, prevention and treatment of diseases and clinical conditions associated with KIAA1210. KIAA1668 (Accession XM_039236) is another VGAM1869 host target gene. KIAA1668 BINDING SITE is HOST TARGET binding site found in the 3' untranslated region of mRNA encoded by KIAA1668, corresponding to a HOST TARGET binding site such as BINDING SITE I, BINDING SITE II or BINDING SITE III. Table 2 illustrates the complementarity of the nucleotide sequences of KIAA1668 BINDING SITE, designated SEQ ID:33028, to the nucleotide sequence of VGAM1869 RNA, herein designated VGAM RNA, also designated SEQ ID:4580.

Another function of VGAM1869 is therefore inhibition of KIAA1668 (Accession XM_039236). Accordingly, utilities of VGAM1869 include diagnosis, prevention and treatment of diseases and clinical conditions associated with KIAA1668. SARM (Accession NM_015077) is another VGAM1869 host target gene. SARM BINDING SITE is HOST TARGET binding site found in the 3' untranslated region of mRNA encoded by SARM, corresponding to a HOST TARGET binding site such as BINDING SITE I, BINDING SITE II or BINDING SITE III. Table 2 illustrates the complementarity of the nucleotide sequences of SARM BINDING SITE, designated SEQ ID:17462, to the nucleotide sequence of VGAM1869 RNA, herein designated VGAM RNA, also designated SEQ ID:4580.

Another function of VGAM1869 is therefore inhibition of SARM (Accession NM_015077). Accordingly, utilities of VGAM1869 include diagnosis, prevention and treatment of diseases and clinical conditions associated with SARM. SNFT (Accession NM_018664) is another VGAM1869 host target gene. SNFT BINDING SITE is HOST TARGET binding site found in the 5' untranslated region of mRNA encoded by SNFT, corresponding to a HOST TARGET binding site such as BINDING SITE I, BINDING SITE II or BINDING SITE III. Table 2 illustrates the complementarity of the nucleotide sequences of SNFT BINDING SITE, designated SEQ ID:20743, to the nucleotide sequence of VGAM1869 RNA, herein designated VGAM RNA, also designated SEQ ID:4580.

Another function of VGAM1869 is therefore inhibition of SNFT (Accession NM_018664). Accordingly, utilities of VGAM1869 include diagnosis, prevention and treatment of diseases and clinical conditions associated with SNFT. Ubiquitin-like, Containing PHD and RING Finger Domains, 2 (UHRF2, Accession XM_055929) is another VGAM1869 host target gene. UHRF2 BINDING SITE is HOST TARGET binding site found in the 5' untranslated region of mRNA encoded by UHRF2, corresponding to a HOST TARGET binding site such as BINDING SITE I, BINDING SITE II or BINDING SITE III. Table 2 illustrates the complementarity of the nucleotide sequences of UHRF2 BINDING SITE, designated SEQ ID:36356, to the nucleotide sequence of VGAM1869 RNA, herein designated VGAM RNA, also designated SEQ ID:4580.

Another function of VGAM1869 is therefore inhibition of Ubiquitin-like, Containing PHD and RING Finger Domains, 2 (UHRF2, Accession XM_055929). Accordingly, utilities of VGAM1869 include diagnosis, prevention and treatment of diseases and clinical conditions associated with UHRF2. LOC134121 (Accession XM_059692) is another VGAM1869 host target gene. LOC134121 BINDING SITE is HOST TARGET binding site found in the 5' untranslated region of mRNA encoded by LOC134121, corresponding to a HOST TARGET binding site such as BINDING SITE I, BINDING SITE II or BINDING SITE III. Table 2 illustrates the complementarity of the nucleotide sequences of LOC134121 BINDING SITE, designated SEQ ID:37063, to the nucleotide sequence of VGAM1869 RNA, herein designated VGAM RNA, also designated SEQ ID:4580.

Another function of VGAM1869 is therefore inhibition of LOC134121 (Accession XM_059692). Accordingly, utilities of VGAM1869 include diagnosis, prevention and treatment of diseases and clinical conditions associated with LOC134121. LOC150630 (Accession XM_097931) is another VGAM1869 host target gene. LOC150630 BINDING SITE is HOST TARGET binding site found in the 5' untranslated region of mRNA encoded by LOC150630, corresponding to a HOST TARGET binding site such as BINDING SITE I, BINDING SITE II or BINDING SITE III. Table 2 illustrates the complementarity of the nucleotide sequences of LOC150630 BINDING SITE, designated SEQ ID:41241, to the nucleotide sequence of VGAM1869 RNA, herein designated VGAM RNA, also designated SEQ ID:4580.

Another function of VGAM1869 is therefore inhibition of LOC150630 (Accession XM_097931). Accordingly, utilities of VGAM1869 include diagnosis, prevention and treatment of diseases and clinical conditions associated with LOC150630. LOC155382 (Accession XM_098713) is another VGAM1869 host target gene. LOC155382 BINDING SITE is HOST TARGET binding site found in the 5' untranslated region of mRNA encoded by LOC155382, corresponding to a HOST TARGET binding site such as BINDING SITE I, BINDING SITE II or BINDING SITE III. Table 2 illustrates the complementarity of the nucleotide sequences of LOC155382 BINDING SITE, designated SEQ ID:41765, to the nucleotide sequence of VGAM1869 RNA, herein designated VGAM RNA, also designated SEQ ID:4580.

Another function of VGAM1869 is therefore inhibition of LOC155382 (Accession XM_098713). Accordingly, utilities of VGAM1869 include diagnosis, prevention and treatment of diseases and clinical conditions associated with LOC155382. LOC203369 (Accession XM_114689) is another VGAM1869 host target gene. LOC203369 BINDING SITE is HOST TARGET binding site found in the 3' untranslated region of mRNA encoded by LOC203369, corresponding to a HOST TARGET binding site such as BINDING SITE I, BINDING SITE II or BINDING SITE III. Table 2 illustrates the complementarity of the nucleotide sequences of LOC203369 BINDING SITE, designated SEQ ID:43032, to the nucleotide sequence of VGAM1869 RNA, herein designated VGAM RNA, also designated SEQ ID:4580.

Another function of VGAM1869 is therefore inhibition of LOC203369 (Accession XM_114689). Accordingly, utilities of VGAM1869 include diagnosis, prevention and treatment of diseases and clinical conditions associated with LOC203369. LOC203427 (Accession XM_114699) is another VGAM1869 host target gene. LOC203427 BINDING SITE is HOST TARGET binding site found in the 5' untranslated region of mRNA encoded by LOC203427, corresponding to a HOST TARGET binding site such as BINDING SITE I, BINDING SITE II or BINDING SITE III. Table 2 illustrates the complementarity of the nucleotide sequences of LOC203427 BINDING SITE, designated SEQ ID:43044, to the nucleotide sequence of VGAM1869 RNA, herein designated VGAM RNA, also designated SEQ ID:4580.

Another function of VGAM1869 is therefore inhibition of LOC203427 (Accession XM_114699). Accordingly, utilities of VGAM1869 include diagnosis, prevention and treatment of diseases and clinical conditions associated with LOC203427. LOC221431 (Accession XM_166380) is another VGAM1869 host target gene. LOC221431 BINDING SITE is HOST TARGET binding site found in the 5' untranslated region of mRNA encoded by LOC221431, corresponding to a HOST TARGET binding site such as BINDING SITE I, BINDING SITE II or BINDING SITE III. Table 2 illustrates the complementarity of the nucleotide sequences of LOC221431 BINDING SITE, designated SEQ ID:44224, to the nucleotide sequence of VGAM1869 RNA, herein designated VGAM RNA, also designated SEQ ID:4580.

Another function of VGAM1869 is therefore inhibition of LOC221431 (Accession XM_166380). Accordingly, utilities of VGAM1869 include diagnosis, prevention and treatment of diseases and clinical conditions associated with LOC221431. LOC254057 (Accession XM_173085) is another VGAM1869 host target gene. LOC254057 BINDING SITE is HOST TARGET binding site found in the 5' untranslated region of mRNA encoded by LOC254057, corresponding to a HOST TARGET binding site such as BINDING SITE I, BINDING SITE II or BINDING SITE III. Table 2 illustrates the complementarity of the nucleotide sequences of LOC254057 BINDING SITE, designated SEQ ID:46343, to the nucleotide sequence of VGAM1869 RNA, herein designated VGAM RNA, also designated SEQ ID:4580.

Another function of VGAM1869 is therefore inhibition of LOC254057 (Accession XM_173085). Accordingly, utilities of VGAM1869 include diagnosis, prevention and treatment of diseases and clinical conditions associated with LOC254057. LOC257486 (Accession XM_045029) is another VGAM1869 host target gene. LOC257486 BINDING SITE is HOST TARGET binding site found in the 3' untranslated region of mRNA encoded by LOC257486, corresponding to a HOST TARGET binding site such as BINDING SITE I, BINDING SITE II or BINDING SITE III. Table 2 illustrates the complementarity of the nucleotide sequences of LOC257486 BINDING SITE, designated SEQ ID:34325, to the nucleotide sequence of VGAM1869 RNA, herein designated VGAM RNA, also designated SEQ ID:4580.

Another function of VGAM1869 is therefore inhibition of LOC257486 (Accession XM_045029). Accordingly, utilities of VGAM1869 include diagnosis, prevention and treatment of diseases and clinical conditions associated with LOC257486. LOC91300 (Accession NM_138774) is another VGAM1869 host target gene. LOC91300 BINDING SITE1 and LOC91300 BINDING SITE2 are HOST TARGET binding sites found in untranslated regions of mRNA encoded by LOC91300, corresponding to HOST TARGET binding sites such as BINDING SITE I, BINDING SITE II or BINDING SITE III. Table 2 illustrates the complementarity of the nucleotide sequences of LOC91300 BINDING SITE1 and LOC91300 BINDING SITE2, designated SEQ ID:29006 and SEQ ID:45387 respectively, to the nucleotide sequence of VGAM1869 RNA, herein designated VGAM RNA, also designated SEQ ID:4580.

Another function of VGAM1869 is therefore inhibition of LOC91300 (Accession NM_138774). Accordingly, utilities of VGAM1869 include diagnosis, prevention and treatment of diseases and clinical conditions associated with LOC91300. LOC92697 (Accession XM_046715) is another VGAM1869 host target gene. LOC92697 BINDING SITE is HOST TARGET binding site found in the 5' untranslated region of mRNA encoded by LOC92697, corresponding to a HOST TARGET binding site such as BINDING SITE I, BINDING SITE II or BINDING SITE III. Table 2 illustrates the complementarity of the nucleotide sequences of LOC92697 BINDING SITE, designated SEQ ID:34804, to the nucleotide sequence of VGAM1869 RNA, herein designated VGAM RNA, also designated SEQ ID:4580.

Another function of VGAM1869 is therefore inhibition of LOC92697 (Accession XM_046715). Accordingly, utilities of VGAM1869 include diagnosis, prevention and treatment of diseases and clinical conditions associated with LOC92697. FIG. 1 further provides a conceptual description of a novel bioinformatically detected viral gene of the present invention, referred to here as Viral Genomic Address Messenger 1870 (VGAM1870) viral gene, which modulates expression of respective host target genes thereof, the function and utility of which host target genes is known in the art.

VGAM1870 is a novel bioinformatically detected regulatory, non protein coding, viral micro RNA (miRNA) gene. The method by which VGAM1870 was detected is described hereinabove with reference to FIGS. 1-8.

VGAM1870 gene, herein designated VGAM GENE, is a viral gene contained in the genome of Fowlpox Virus. VGAM1870 host target gene, herein designated VGAM HOST TARGET GENE, is a human gene contained in the human genome.

VGAM1870 gene encodes a VGAM1870 precursor RNA, herein designated VGAM PRECURSOR RNA. Similar to other miRNA genes, and unlike most ordinary genes, VGAM1870 precursor RNA does not encode a protein. A nucleotide sequence identical or highly similar to the nucleotide sequence of VGAM1870 precursor RNA is designated SEQ ID:1856, and is provided hereinbelow with reference to the sequence listing part. Nucleotide sequence SEQ ID:1856 is located at position 190565 relative to the genome of Fowlpox Virus.

VGAM1870 precursor RNA folds onto itself, forming VGAM1870 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1870 folded precursor RNA into VGAM1870 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1870 RNA is designated SEQ ID:4581, and is provided hereinbelow with reference to the sequence listing part.

VGAM1870 host target gene, herein designated VGAM HOST TARGET GENE, encodes a corresponding messenger RNA, VGAM1870 host target RNA, herein designated VGAM HOST TARGET RNA. VGAM1870 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1870 RNA, herein designated VGAM RNA, binds complementarily to one or more host target binding sites located in untranslated regions of VGAM1870 host target RNA, herein designated VGAM HOST TARGET RNA. This complementary binding is due to the fact that the nucleotide sequence of VGAM1870 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1870 RNA, herein designated VGAM RNA, may have a different number of host target binding sites in untranslated regions of a VGAM1870 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1870 RNA, herein designated VGAM RNA, to host target binding sites on VGAM1870 host target RNA, herein designated VGAM HOST TARGET RNA, such as BINDING SITE I, BINDING SITE II and BINDING SITE III, inhibits translation of VGAM1870 host target RNA into VGAM1870 host target protein, herein designated VGAM HOST TARGET PROTEIN. VGAM host target protein is therefore outlined by a broken line.

It is appreciated that VGAM1870 host target gene, herein designated VGAM HOST TARGET GENE, in fact represents a plurality of VGAM1870 host target genes. The mRNA of each one of this plurality of VGAM1870 host target genes comprises one or more host target binding sites, each having a nucleotide sequence which is at least partly complementary to VGAM1870 RNA, herein designated VGAM RNA, and which when bound by VGAM1870 RNA causes inhibition of translation of respective one or more VGAM1870 host target proteins.

It is further appreciated by one skilled in the art that the mode of translational inhibition illustrated by FIG. 1 with specific reference to translational inhibition exerted by VGAM1870 gene, herein designated VGAM GENE, on one or more VGAM1870 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1870 is inhibition of expression of host target genes, as part of a novel viral mechanism of attacking a host. Accordingly, utilities of VGAM1870 include diagnosis, prevention and treatment of viral infection by Fowlpox Virus. Specific functions, and accordingly utilities, of VGAM1870 correlate with, and may be deduced from, the identity of the host target genes which VGAM1870 binds and inhibits, and the function of these host target genes, as elaborated hereinbelow.

Nucleotide sequences of the VGAM1870 precursor RNA, herein designated VGAM PRECURSOR RNA, and of the 'diced' VGAM1870 RNA, herein designated VGAM RNA, and a schematic representation of the secondary folding of VGAM1870 folded precursor RNA, herein designated VGAM FOLDED PRECURSOR RNA, of VGAM1870 are further described hereinbelow with reference to Table 1.

Nucleotide sequences of host target binding sites, such as BINDING SITE-I, BINDING SITE-II and BINDING SITE-III of FIG. 1, found on VGAM1870 host target RNA, and schematic representation of the complementarity of each of these host target binding sites to VGAM1870 RNA, herein designated VGAM RNA, are described hereinbelow with reference to Table 2.

As mentioned hereinabove with reference to FIG. 1, a function of VGAM1870 gene, herein designated VGAM is inhibition of expression of VGAM1870 target genes. It is appreciated that specific functions, and accordingly utilities, of VGAM1870 correlate with, and may be deduced from, the identity of the target genes which VGAM1870 binds and inhibits, and the function of these target genes, as elaborated hereinbelow.

Zinc Finger Protein 261 (ZNF261, Accession NM_005096) is a VGAM1870 host target gene. ZNF261 BINDING SITE is HOST TARGET binding site found in the 3' untranslated region of mRNA encoded by ZNF261, corresponding to a HOST TARGET binding site such as BINDING SITE I, BINDING SITE II or BINDING SITE III. Table 2 illustrates the complementarity of the nucleotide sequences of ZNF261 BINDING SITE, designated SEQ ID:11561, to the nucleotide sequence of VGAM1870 RNA, herein designated VGAM RNA, also designated SEQ ID:4581.

A function of VGAM1870 is therefore inhibition of Zinc Finger Protein 261 (ZNF261, Accession NM_005096). Accordingly, utilities of VGAM1870 include diagnosis, prevention and treatment of diseases and clinical conditions associated with ZNF261. HTEX4 (Accession XM_166378) is another VGAM1870 host target gene. HTEX4 BINDING SITE1 through HTEX4 BINDING SITE3 are HOST TARGET binding sites found in untranslated regions of mRNA encoded by HTEX4, corresponding to HOST TARGET binding sites such as BINDING SITE I, BINDING SITE II or BINDING SITE III. Table 2 illustrates the complementarity of the nucleotide sequences of HTEX4 BINDING SITE1 through HTEX4 BINDING SITE3, designated SEQ ID:44213, SEQ ID:46718 and SEQ ID:46649 respectively, to the nucleotide sequence of VGAM1870 RNA, herein designated VGAM RNA, also designated SEQ ID:4581.

Another function of VGAM1870 is therefore inhibition of HTEX4 (Accession XM_166378). Accordingly, utilities of VGAM1870 include diagnosis, prevention and treatment of diseases and clinical conditions associated with HTEX4. FIG. 1 further provides a conceptual description of a novel bioinformatically detected viral gene of the present invention, referred to here as Viral Genomic Address Messenger 1871 (VGAM1871) viral gene, which modulates expression of respective host target genes thereof, the function and utility of which host target genes is known in the art.

VGAM1871 is a novel bioinformatically detected regulatory, non protein coding, viral micro RNA (miRNA) gene. The method by which VGAM1871 was detected is described hereinabove with reference to FIGS. 1-8.

VGAM1871 gene, herein designated VGAM GENE, is a viral gene contained in the genome of Fowlpox Virus. VGAM1871 host target gene, herein designated VGAM HOST TARGET GENE, is a human gene contained in the human genome.

VGAM1871 gene encodes a VGAM1871 precursor RNA, herein designated VGAM PRECURSOR RNA. Similar to other miRNA genes, and unlike most ordinary genes, VGAM1871 precursor RNA does not encode a protein. A nucleotide sequence identical or highly similar to the nucleotide sequence of VGAM1871 precursor RNA is designated SEQ ID:1857, and is provided hereinbelow with reference to the sequence listing part. Nucleotide sequence SEQ ID:1857 is located at position 195331 relative to the genome of Fowlpox Virus.

VGAM1871 precursor RNA folds onto itself, forming VGAM1871 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1871 folded precursor RNA into VGAM1871 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1871 RNA is designated SEQ ID:4582, and is provided hereinbelow with reference to the sequence listing part.

VGAM1871 host target gene, herein designated VGAM HOST TARGET GENE, encodes a corresponding messenger RNA, VGAM1871 host target RNA, herein designated VGAM HOST TARGET RNA. VGAM1871 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1871 RNA, herein designated VGAM RNA, binds complementarily to one or more host target binding sites located in untranslated regions of VGAM1871 host target RNA, herein designated VGAM HOST TARGET RNA. This complementary binding is due to the fact that the nucleotide sequence of VGAM1871 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1871 RNA, herein designated VGAM RNA, may have a different number of host target binding sites in untranslated regions of a VGAM1871 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1871 RNA, herein designated VGAM RNA, to host target binding sites on VGAM1871 host target RNA, herein designated VGAM HOST TARGET RNA, such as BINDING SITE I, BINDING SITE II and BINDING SITE III, inhibits translation of VGAM1871 host target RNA into VGAM1871 host target protein, herein designated VGAM HOST TARGET PROTEIN. VGAM host target protein is therefore outlined by a broken line.

It is appreciated that VGAM1871 host target gene, herein designated VGAM HOST TARGET GENE, in fact represents a plurality of VGAM1871 host target genes. The mRNA of each one of this plurality of VGAM1871 host target genes comprises one or more host target binding sites, each having a nucleotide sequence which is at least partly complementary to VGAM1871 RNA, herein designated VGAM RNA, and which when bound by VGAM1871 RNA causes inhibition of translation of respective one or more VGAM1871 host target proteins.

It is further appreciated by one skilled in the art that the mode of translational inhibition illustrated by FIG. 1 with specific reference to translational inhibition exerted by VGAM1871 gene, herein designated VGAM GENE, on one or more VGAM1871 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1871 is inhibition of expression of host target genes, as part of a novel viral mechanism of attacking a host. Accordingly, utilities of VGAM1871 include diagnosis, prevention and treatment of viral infection by Fowlpox Virus. Specific functions, and accordingly utilities, of VGAM1871 correlate with, and may be deduced from, the identity of the host target genes which VGAM1871 binds and inhibits, and the function of these host target genes, as elaborated hereinbelow.

Nucleotide sequences of the VGAM1871 precursor RNA, herein designated VGAM PRECURSOR RNA, and of the 'diced' VGAM1871 RNA, herein designated VGAM RNA, and a schematic representation of the secondary folding of VGAM1871 folded precursor RNA, herein designated VGAM FOLDED PRECURSOR RNA, of VGAM1871 are further described hereinbelow with reference to Table 1.

Nucleotide sequences of host target binding sites, such as BINDING SITE-I, BINDING SITE-II and BINDING SITE-III of FIG. 1, found on VGAM1871 host target RNA, and schematic representation of the complementarity of each of these host target binding sites to VGAM1871 RNA, herein designated VGAM RNA, are described hereinbelow with reference to Table 2.

As mentioned hereinabove with reference to FIG. 1, a function of VGAM1871 gene, herein designated VGAM is inhibition of expression of VGAM1871 target genes. It is appreciated that specific functions, and accordingly utilities, of VGAM1871 correlate with, and may be deduced from, the identity of the target genes which VGAM1871 binds and inhibits, and the function of these target genes, as elaborated hereinbelow.

AFAP (Accession NM_021638) is a VGAM1871 host target gene. AFAP BINDING SITE is HOST TARGET binding site found in the 3' untranslated region of mRNA encoded by AFAP, corresponding to a HOST TARGET binding site such as BINDING SITE I, BINDING SITE II or BINDING SITE III. Table 2 illustrates the complementarity of the nucleotide sequences of AFAP BINDING SITE, designated SEQ ID:22288, to the nucleotide sequence of VGAM1871 RNA, herein designated VGAM RNA, also designated SEQ ID:4582.

A function of VGAM1871 is therefore inhibition of AFAP (Accession NM_021638). Accordingly, utilities of VGAM1871 include diagnosis, prevention and treatment of diseases and clinical conditions associated with AFAP. ARP3BETA (Accession NM_020445) is another VGAM1871 host target gene. ARP3BETA BINDING SITE is HOST TARGET binding site found in the 3' untranslated region of mRNA encoded by ARP3BETA, corresponding to a HOST TARGET binding site such as BINDING SITE I, BINDING SITE II or BINDING SITE III. Table 2 illustrates the complementarity of the nucleotide sequences of ARP3BETA BINDING SITE, designated SEQ ID:21686, to the nucleotide sequence of VGAM1871 RNA, herein designated VGAM RNA, also designated SEQ ID:4582.

Another function of VGAM1871 is therefore inhibition of ARP3BETA (Accession NM_020445). Accordingly, utilities of VGAM1871 include diagnosis, prevention and treatment of diseases and clinical conditions associated with ARP3BETA. MSTP032 (Accession NM_025226) is another VGAM1871 host target gene. MSTP032 BINDING SITE is HOST TARGET binding site found in the 3' untranslated region of mRNA encoded by MSTP032, corresponding to a HOST TARGET binding site such as BINDING SITE I, BINDING SITE II or BINDING SITE III. Table 2 illustrates the complementarity of the nucleotide sequences of MSTP032 BINDING SITE, designated SEQ ID:24905, to the nucleotide sequence of VGAM1871 RNA, herein designated VGAM RNA, also designated SEQ ID:4582.

Another function of VGAM1871 is therefore inhibition of MSTP032 (Accession NM_025226). Accordingly, utilities of VGAM1871 include diagnosis, prevention and treatment of diseases and clinical conditions associated with MSTP032. Pleckstrin Homology Domain Containing, Family A (phosphoinositide binding specific) Member 3 (PLEKHA3, Accession NM_019091) is another VGAM1871 host target gene. PLEKHA3 BINDING SITE is HOST TARGET binding site found in the 3' untranslated region of mRNA encoded by PLEKHA3, corresponding to a HOST TARGET binding site such as BINDING SITE I, BINDING SITE II or BINDING SITE III. Table 2 illustrates the complementarity of the nucleotide sequences of PLEKHA3 BINDING SITE, designated SEQ ID:21168, to the nucleotide sequence of VGAM1871 RNA, herein designated VGAM RNA, also designated SEQ ID:4582.

Another function of VGAM1871 is therefore inhibition of Pleckstrin Homology Domain Containing, Family A (phosphoinositide binding specific) Member 3 (PLEKHA3, Accession NM_019091). Accordingly, utilities of VGAM1871 include diagnosis, prevention and treatment of diseases and clinical conditions associated with PLEKHA3. PRO2133 (Accession NM_018619) is another VGAM1871 host target gene. PRO2133 BINDING SITE is HOST TARGET binding site found in the 3' untranslated region of mRNA encoded by PRO2133, corresponding to a HOST TARGET binding site such as BINDING SITE I, BINDING SITE II or BINDING SITE III. Table 2 illustrates the complementarity of the nucleotide sequences of PRO2133 BINDING SITE, designated SEQ ID:20690, to the nucleotide sequence of VGAM1871 RNA, herein designated VGAM RNA, also designated SEQ ID:4582.

Another function of VGAM1871 is therefore inhibition of PRO2133 (Accession NM_018619). Accordingly, utilities of VGAM1871 include diagnosis, prevention and treatment of diseases and clinical conditions associated with PRO2133. FIG. 1 further provides a conceptual description of a novel bioinformatically detected viral gene of the present invention, referred to here as Viral Genomic Address Messenger 1872 (VGAM1872) viral gene, which modulates expression of respective host target genes thereof, the function and utility of which host target genes is known in the art.

VGAM1872 is a novel bioinformatically detected regulatory, non protein coding, viral micro RNA (miRNA) gene. The method by which VGAM1872 was detected is described hereinabove with reference to FIGS. 1-8.

VGAM1872 gene, herein designated VGAM GENE, is a viral gene contained in the genome of Fowlpox Virus. VGAM1872 host target gene, herein designated VGAM HOST TARGET GENE, is a human gene contained in the human genome.

VGAM1872 gene encodes a VGAM1872 precursor RNA, herein designated VGAM PRECURSOR RNA. Similar to other miRNA genes, and unlike most ordinary genes, VGAM1872 precursor RNA does not encode a protein. A nucleotide sequence identical or highly similar to the nucleotide sequence of VGAM1872 precursor RNA is designated SEQ ID:1858, and is provided hereinbelow with reference to the sequence listing part. Nucleotide sequence SEQ ID:1858 is located at position 190660 relative to the genome of Fowlpox Virus.

VGAM1872 precursor RNA folds onto itself, forming VGAM1872 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1872 folded precursor RNA into VGAM1872 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1872 RNA is designated SEQ ID:4583, and is provided hereinbelow with reference to the sequence listing part.

VGAM1872 host target gene, herein designated VGAM HOST TARGET GENE, encodes a corresponding messenger RNA, VGAM1872 host target RNA, herein designated VGAM HOST TARGET RNA. VGAM1872 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1872 RNA, herein designated VGAM RNA, binds complementarily to one or more host target binding sites located in untranslated regions of VGAM1872 host target RNA, herein designated VGAM HOST TARGET RNA. This complementary binding is due to the fact that the nucleotide sequence of VGAM1872 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1872 RNA, herein designated VGAM RNA, may have a different number of host target binding sites in untranslated regions of a VGAM1872 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1872 RNA, herein designated VGAM RNA, to host target binding sites on VGAM1872 host target RNA, herein designated VGAM HOST TARGET RNA, such as BINDING SITE I, BINDING SITE II and BINDING SITE III, inhibits translation of VGAM1872 host target RNA into VGAM1872 host target protein, herein designated VGAM HOST TARGET PROTEIN. VGAM host target protein is therefore outlined by a broken line.

It is appreciated that VGAM1872 host target gene, herein designated VGAM HOST TARGET GENE, in fact represents a plurality of VGAM1872 host target genes. The mRNA of each one of this plurality of VGAM1872 host target genes comprises one or more host target binding sites, each having a nucleotide sequence which is at least partly complementary to VGAM1872 RNA, herein designated VGAM RNA, and which when bound by VGAM1872 RNA causes inhibition of translation of respective one or more VGAM1872 host target proteins.

It is further appreciated by one skilled in the art that the mode of translational inhibition illustrated by FIG. 1 with specific reference to translational inhibition exerted by VGAM1872 gene, herein designated VGAM GENE, on one or more VGAM1872 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1872 is inhibition of expression of host target genes, as part of a novel viral mechanism of attacking a host. Accordingly, utilities of VGAM1872 include diagnosis, prevention and treatment of viral infection by Fowlpox Virus. Specific functions, and accordingly utilities, of VGAM1872 correlate with, and may be deduced from, the identity of the host target genes which VGAM1872 binds and inhibits, and the function of these host target genes, as elaborated hereinbelow.

Nucleotide sequences of the VGAM1872 precursor RNA, herein designated VGAM PRECURSOR RNA, and of the 'diced' VGAM1872 RNA, herein designated VGAM RNA, and a schematic representation of the secondary folding of VGAM1872 folded precursor RNA, herein designated VGAM FOLDED PRECURSOR RNA, of VGAM1872 are further described hereinbelow with reference to Table 1.

Nucleotide sequences of host target binding sites, such as BINDING SITE-I, BINDING SITE-II and BINDING SITE-III of FIG. 1, found on VGAM1872 host target RNA, and schematic representation of the complementarity of each of these host target binding sites to VGAM1872 RNA, herein designated VGAM RNA, are described hereinbelow with reference to Table 2.

As mentioned hereinabove with reference to FIG. 1, a function of VGAM1872 gene, herein designated VGAM is inhibition of expression of VGAM1872 target genes. It is appreciated that specific functions, and accordingly utilities, of VGAM1872 correlate with, and may be deduced from, the identity of the target genes which VGAM1872 binds and inhibits, and the function of these target genes, as elaborated hereinbelow.

Protein Phosphatase 1, Regulatory (inhibitor) Subunit 3A (glycogen and sarcoplasmic reticulum binding subunit, skeletal muscle) (PPP1R3A, Accession NM_002711) is a VGAM1872 host target gene. PPP1R3A BINDING SITE is HOST TARGET binding site found in the 3' untranslated region of mRNA encoded by PPP1R3A, corresponding to a HOST TARGET binding site such as BINDING SITE I, BINDING SITE II or BINDING SITE III. Table 2 illustrates the complementarity of the nucleotide sequences of PPP1R3A BINDING SITE, designated SEQ ID:8566, to the nucleotide sequence of VGAM1872 RNA, herein designated VGAM RNA, also designated SEQ ID:4583.

A function of VGAM1872 is therefore inhibition of Protein Phosphatase 1, Regulatory (inhibitor) Subunit 3A (glycogen and sarcoplasmic reticulum binding subunit, skeletal muscle) (PPP1R3A, Accession NM_002711), a gene which regulates phosphatase activity towards glycogen synthase, active in skeletal muscle. Accordingly, utilities of VGAM1872 include diagnosis, prevention and treatment of diseases and clinical conditions associated with PPP1R3A. The function of PPP1R3A has been established by previous studies. The glycogen-associated form of protein phosphatase-1 (PP1) derived from skeletal muscle is a heterodimer composed of a 37-kD catalytic subunit (OMIM Ref. No. 176875) and a 124-kD targeting and regulatory subunit, referred to as PP1G by Hansen et al. (1995). PP1G binds to muscle glycogen with high affinity, thereby enhancing dephosphorylation of glycogen-bound substrates for PP1 such as glycogen synthase (e.g., 138570) and glycogen phosphorylase kinase (e.g., 306000). Phosphorylation at ser46 of the PP1G subunit in response to insulin increases PP1 activity, while phosphorylation at ser65 in response to adrenaline causes dissociation of the catalytic subunit from the G subunit and inhibits glycogen synthesis. Because of these functions, PP1G was postulated to be involved in noninsulin-dependent diabetes mellitus (NIDDM; 125853) and obesity. Savage et al. (2002) described an example of digenic inheritance of severe insulin resistance. In a family they referred to as 'a Europid pedigree' they found 5 members with severe insulin resistance and heterozygosity for frameshift/premature stop mutations in each of 2 unlinked genes, PPARG (601487.0011) and PPP1R3A (600917.0003). PPARG is highly expressed in adipocytes, and PPP1R3A, the muscle-specific regulatory subunit of protein phosphatase 1, is centrally involved in the regulation of carbohydrate and lipid metabolism, respectively. That mutant molecules primarily involved in either carbohydrate or lipid metabolism can combine to produce a phenotype of extreme insulin resistance provides a model of interaction among genes that may underlie common human metabolic disorders such as type 2 diabetes (NIDDM). In the Europid family reported by Savage et al. (2002), the grandfather was heterozygous for the PPARG mutation, the grandmother was heterozygous for the PPP1R3A mutation. Three of their children and 2 of their grandchildren carried both mutations in heterozygous state, and all 5, but only these 5, had severe insulin resistance manifest by acanthosis nigricans, a dermatologic marker of extreme insulin resistance, and markedly elevated fasting plasma insulin levels.

Full details of the abovementioned studies are described in the following publications, the disclosure of which are hereby incorporated by reference:

Savage, D. B.; Agostini, M.; Barroso, I.; Gurnell, M.; Luan, J.; Meirhaeghe, A.; Harding, A.-H.; Ihrke, G.; Rajanayagam, O.; Soos, M. A.; George, S.; Berger, D.; and 9 others. Digenic inheritance of severe insulin resistance in a human pedigree. Nature Genet. 31:379-384, 2002; and Tang, P. M.; Bondor, J. A.; Swiderek, K. M.; DePaoli-Roach, A. A.: Molecular cloning and expression of the regulatory (RG1) subunit of the glycogen-associated protein phosphatase. J. B.

Further studies establishing the function and utilities of PPP1R3A are found in John Hopkins OMIM database record ID 600917, and in sited publications numbered 9926, 9953-995 and 9954 listed in the bibliography section hereinbelow, which are also hereby incorporated by reference. Protease, Serine, 16 (thymus) (PRSS16, Accession NM_005865) is another VGAM1872 host target gene. PRSS16 BINDING SITE is HOST TARGET binding site found in the 3' untranslated region of mRNA encoded by PRSS16, corresponding to a HOST TARGET binding site such as BINDING SITE I, BINDING SITE II or BINDING SITE III. Table 2 illustrates the complementarity of the nucleotide sequences of PRSS16 BINDING SITE, designated SEQ ID:12483, to the nucleotide sequence of VGAM1872 RNA, herein designated VGAM RNA, also designated SEQ ID:4583.

Another function of VGAM1872 is therefore inhibition of Protease, Serine, 16 (thymus) (PRSS16, Accession NM_005865). Accordingly, utilities of VGAM1872 include diagnosis, prevention and treatment of diseases and clinical conditions associated with PRSS16. FLJ13576 (Accession NM_022484) is another VGAM1872 host target gene. FLJ13576 BINDING SITE is HOST TARGET binding site found in the 3' untranslated region of mRNA encoded by FLJ13576, corresponding to a HOST TARGET binding site such as BINDING SITE I, BINDING SITE II or BINDING SITE III. Table 2 illustrates the complementarity of the nucleotide sequences of FLJ13576 BINDING SITE, designated SEQ ID:22861, to the nucleotide sequence of VGAM1872 RNA, herein designated VGAM RNA, also designated SEQ ID:4583.

Another function of VGAM1872 is therefore inhibition of FLJ13576 (Accession NM_022484). Accordingly, utilities of VGAM1872 include diagnosis, prevention and treatment of diseases and clinical conditions associated with FLJ13576. KIAA0372 (Accession NM_014639) is another VGAM1872 host target gene. KIAA0372 BINDING SITE is HOST TARGET binding site found in the 3' untranslated region of mRNA encoded by KIAA0372, corresponding to a HOST TARGET binding site such as BINDING SITE I, BINDING SITE II or BINDING SITE III. Table 2 illustrates the complementarity of the nucleotide sequences of KIAA0372 BINDING SITE, designated SEQ ID:16038, to the nucleotide sequence of VGAM1872 RNA, herein designated VGAM RNA, also designated SEQ ID:4583.

Another function of VGAM1872 is therefore inhibition of KIAA0372 (Accession NM_014639). Accordingly, utilities of VGAM1872 include diagnosis, prevention and treatment of diseases and clinical conditions associated with KIAA0372. KIAA1361 (Accession XM_030845) is another VGAM1872 host target gene. KIAA1361 BINDING SITE is HOST TARGET binding site found in the 3' untranslated region of mRNA encoded by KIAA1361, corresponding to a HOST TARGET binding site such as BINDING SITE I, BINDING SITE II or BINDING SITE III. Table 2 illustrates the complementarity of the nucleotide sequences of KIAA1361 BINDING SITE, designated SEQ ID:31173, to the nucleotide sequence of VGAM1872 RNA, herein designated VGAM RNA, also designated SEQ ID:4583.

Another function of VGAM1872 is therefore inhibition of KIAA1361 (Accession XM_030845). Accordingly, utilities of VGAM1872 include diagnosis, prevention and treatment of diseases and clinical conditions associated with KIAA1361. LOC222060 (Accession XM_168427) is another VGAM1872 host target gene. LOC222060 BINDING SITE is HOST TARGET binding site found in the 5' untranslated region of mRNA encoded by LOC222060, corresponding to a HOST TARGET binding site such as BINDING SITE I, BINDING SITE II or BINDING SITE III. Table 2 illustrates the complementarity of the nucleotide sequences of LOC222060 BINDING SITE, designated SEQ ID:45161, to the nucleotide sequence of VGAM1872 RNA, herein designated VGAM RNA, also designated SEQ ID:4583.

Another function of VGAM1872 is therefore inhibition of LOC222060 (Accession XM_168427). Accordingly, utilities of VGAM1872 include diagnosis, prevention and treatment of diseases and clinical conditions associated with LOC222060. FIG. 1 further provides a conceptual description of a novel bioinformatically detected viral gene of the present invention, referred to here as Viral Genomic Address Messenger 1873 (VGAM1873) viral gene, which modulates expression of respective host target genes thereof, the function and utility of which host target genes is known in the art.

VGAM1873 is a novel bioinformatically detected regulatory, non protein coding, viral micro RNA (miRNA) gene. The method by which VGAM1873 was detected is described hereinabove with reference to FIGS. 1-8.

VGAM1873 gene, herein designated VGAM GENE, is a viral gene contained in the genome of Fowlpox Virus. VGAM1873 host target gene, herein designated VGAM HOST TARGET GENE, is a human gene contained in the human genome.

VGAM1873 gene encodes a VGAM1873 precursor RNA, herein designated VGAM PRECURSOR RNA. Similar to other miRNA genes, and unlike most ordinary genes, VGAM1873 precursor RNA does not encode a protein. A nucleotide sequence identical or highly similar to the nucleotide sequence of VGAM1873 precursor RNA is designated SEQ ID:1859, and is provided hereinbelow with reference to the sequence listing part. Nucleotide sequence SEQ ID:1859 is located at position 188015 relative to the genome of Fowlpox Virus.

VGAM1873 precursor RNA folds onto itself, forming VGAM1873 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1873 folded precursor RNA into VGAM1873 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM1873 RNA is designated SEQ ID:4584, and is provided hereinbelow with reference to the sequence listing part.

VGAM1873 host target gene, herein designated VGAM HOST TARGET GENE, encodes a corresponding messenger RNA, VGAM1873 host target RNA, herein designated VGAM HOST TARGET RNA. VGAM1873 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1873 RNA, herein designated VGAM RNA, binds complementarily to one or more host target binding sites located in untranslated regions of VGAM1873 host target RNA, herein designated VGAM HOST TARGET RNA. This complementary binding is due to the fact that the nucleotide sequence of VGAM1873 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1873 RNA, herein designated VGAM RNA, may have a different number of host target binding sites in untranslated regions of a VGAM1873 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1873 RNA, herein designated VGAM RNA, to host target binding sites on VGAM1873 host target RNA, herein designated VGAM HOST TARGET RNA, such as BINDING SITE I, BINDING SITE II and BINDING SITE III, inhibits translation of VGAM1873 host target RNA into VGAM1873 host target protein, herein designated VGAM HOST TARGET PROTEIN. VGAM host target protein is therefore outlined by a broken line.

It is appreciated that VGAM1873 host target gene, herein designated VGAM HOST TARGET GENE, in fact represents a plurality of VGAM1873 host target genes. The mRNA of each one of this plurality of VGAM1873 host target genes comprises one or more host target binding sites, each having a nucleotide sequence which is at least partly complementary to VGAM1873 RNA, herein designated VGAM RNA, and which when bound by VGAM1873 RNA causes inhibition of translation of respective one or more VGAM1873 host target proteins.

It is further appreciated by one skilled in the art that the mode of translational inhibition illustrated by FIG. 1 with specific reference to translational inhibition exerted by VGAM1873 gene, herein designated VGAM GENE, on one or more VGAM1873 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1873 is inhibition of expression of host target genes, as part of a novel viral mechanism of attacking a host. Accordingly, utilities of VGAM1873 include diagnosis, prevention and treatment of viral infection by Fowlpox Virus. Specific functions, and accordingly utilities, of VGAM1873 correlate with, and may be deduced from, the identity of the host target genes which VGAM1873 binds and inhibits, and the function of these host target genes, as elaborated hereinbelow.

Nucleotide sequences of the VGAM1873 precursor RNA, herein designated VGAM PRECURSOR RNA, and of the 'diced' VGAM1873 RNA, herein designated VGAM RNA, and a schematic representation of the secondary folding of VGAM1873 folded precursor RNA, herein designated VGAM FOLDED PRECURSOR RNA, of VGAM1873 are further described hereinbelow with reference to Table 1.

Nucleotide sequences of host target binding sites, such as BINDING SITE-I, BINDING SITE-II and BINDING SITE-III of FIG. 1, found on VGAM1873 host target RNA, and schematic representation of the complementarity of each of these host target binding sites to VGAM1873 RNA, herein designated VGAM RNA, are described hereinbelow with reference to Table 2.

As mentioned hereinabove with reference to FIG. 1, a function of VGAM1873 gene, herein designated VGAM is inhibition of expression of VGAM1873 target genes. It is appreciated that specific functions, and accordingly utilities, of VGAM1873 correlate with, and may be deduced from, the identity of the target genes which VGAM1873 binds and inhibits, and the function of these target genes, as elaborated hereinbelow.

Engulfment and Cell Motility 1 (ced-12 homolog, C. elegans) (ELMO1, Accession NM_130442) is a VGAM1873 host target gene. ELMO1 BINDING SITE is HOST TARGET binding site found in the 3' untranslated region of mRNA encoded by ELMO1, corresponding to a HOST TARGET binding site such as BINDING SITE I, BINDING SITE II or BINDING SITE III. Table 2 illustrates the complementarity of the nucleotide sequences of ELMO1 BINDING SITE, designated SEQ ID:28204, to the nucleotide sequence of VGAM1873 RNA, herein designated VGAM RNA, also designated SEQ ID:4584.

A function of VGAM1873 is therefore inhibition of Engulfment and Cell Motility 1 (ced-12 homolog, C. elegans) (ELMO1, Accession NM_130442). Accordingly, utilities of VGAM1873 include diagnosis, prevention and treatment of diseases and clinical conditions associated with ELMO1. Ectodermal-neural Cortex (with BTB-like domain) (ENC1, Accession NM_003633) is another VGAM1873 host target gene. ENC1 BINDING SITE is HOST TARGET binding site found in the 3' untranslated region of mRNA encoded by ENC1, corresponding to a HOST TARGET binding site such as BINDING SITE I, BINDING SITE II or BINDING SITE III. Table 2 illustrates the complementarity of the nucleotide sequences of ENC1 BINDING SITE, designated SEQ ID:9697, to the nucleotide sequence of VGAM1873 RNA, herein designated VGAM RNA, also designated SEQ ID:4584.

Another function of VGAM1873 is therefore inhibition of Ectodermal-neural Cortex (with BTB-like domain) (ENC1, Accession NM_003633), a gene which is an actin-binding protein involved in the regulation of neuronal process formation and in differentiation of neural crest cells. Accordingly, utilities of VGAM1873 include diagnosis, prevention and treatment of diseases and clinical conditions associated with ENC1. The function of ENC1 and its association with various diseases and clinical conditions, has been established by previous studies, as described hereinabove with reference to VGAM233. Heparanase (HPSE, Accession NM_006665) is another VGAM1873 host target gene. HPSE BINDING SITE is HOST TARGET binding site found in the 3' untranslated region of mRNA encoded by HPSE, corresponding to a HOST TARGET binding site such as BINDING SITE I, BINDING SITE II or BINDING SITE III. Table 2 illustrates the complementarity of the nucleotide sequences of HPSE BINDING SITE, designated SEQ ID:13475, to the nucleotide sequence of VGAM1873 RNA, herein designated VGAM RNA, also designated SEQ ID:4584.

Another function of VGAM1873 is therefore inhibition of Heparanase (HPSE, Accession NM_006665), a gene which is an endoglycosidase that cleaves heparan sulfate. Accordingly, utilities of VGAM1873 include diagnosis, prevention and treatment of diseases and clinical conditions associated with HPSE. The function of HPSE and its association with various diseases and clinical conditions, has been established by previous studies, as described hereinabove with reference to VGAM374. RAB3B, Member RAS Oncogene Family (RAB3B, Accession NM_002867) is another VGAM1873 host target gene. RAB3B BINDING SITE is HOST TARGET binding site found in the 3' untranslated region of mRNA encoded by RAB3B, corresponding to a HOST TARGET binding site such as BINDING SITE I, BINDING SITE II or BINDING SITE III. Table 2 illustrates the complementarity of the nucleotide sequences of RAB3B BINDING SITE, designated SEQ ID:8771, to the nucleotide sequence of VGAM1873 RNA, herein designated VGAM RNA, also designated SEQ ID:4584.

Another function of VGAM1873 is therefore inhibition of RAB3B, Member RAS Oncogene Family (RAB3B, Accession NM_002867). Accordingly, utilities of VGAM1873 include diagnosis, prevention and treatment of diseases and clinical conditions associated with RAB3B. Solute Carrier Family 16 (monocarboxylic acid transporters), Member 1 (SLC16A1, Accession NM_003051) is another VGAM1873 host target gene. SLC16A1 BINDING SITE is HOST TARGET binding site found in the 3' untranslated region of mRNA encoded by SLC16A1, corresponding to a HOST TARGET binding site such as BINDING SITE I, BINDING SITE II or BINDING SITE III. Table 2 illustrates the complementarity of the nucleotide sequences of SLC16A1 BINDING SITE, designated SEQ ID:9012, to the nucleotide sequence of VGAM1873 RNA, herein designated VGAM RNA, also designated SEQ ID:4584.

Another function of VGAM1873 is therefore inhibition of Solute Carrier Family 16 (monocarboxylic acid transporters), Member 1 (SLC16A1, Accession NM_003051), a gene which is a Proton-monocarboxylate cotransporter that transports lactate and pyruvate. Accordingly, utilities of VGAM1873 include diagnosis, prevention and treatment of diseases and clinical conditions associated with SLC16A1. The function of SLC16A1 and its association with various diseases and clinical conditions, has been established by previous studies, as described hereinabove with reference to VGAM140. Zinc Finger Protein 268 (ZNF268, Accession XM_031851) is another VGAM1873 host target gene. ZNF268 BINDING SITE is HOST TARGET binding site found in the 5' untranslated region of mRNA encoded by ZNF268, corresponding to a HOST TARGET binding site such as BINDING SITE I, BINDING SITE II or BINDING SITE III. Table 2 illustrates the complementarity of the nucleotide sequences of ZNF268 BINDING SITE, designated SEQ ID:31500, to the nucleotide sequence of VGAM1873 RNA, herein designated VGAM RNA, also designated SEQ ID:4584.

Another function of VGAM1873 is therefore inhibition of Zinc Finger Protein 268 (ZNF268, Accession XM_031851). Accordingly, utilities of VGAM1873 include diagnosis, prevention and treatment of diseases and clinical conditions associated with ZNF268. Ras Homolog Gene Family, Member E (ARHE, Accession NM_005168) is another VGAM1873 host target gene. ARHE BINDING SITE is HOST TARGET binding site found in the 3' untranslated region of mRNA encoded by ARHE, corresponding to a HOST TARGET binding site such as BINDING SITE I, BINDING SITE II or BINDING SITE III. Table 2 illustrates the complementarity of the nucleotide sequences of ARHE BINDING SITE, designated SEQ ID:11668, to the nucleotide sequence of VGAM1873 RNA, herein designated VGAM RNA, also designated SEQ ID:4584.

Another function of VGAM1873 is therefore inhibition of Ras Homolog Gene Family, Member E (ARHE, Accession NM_005168). Accordingly, utilities of VGAM1873 include diagnosis, prevention and treatment of diseases and clinical conditions associated with ARHE. FLJ12934 (Accession NM_022899) is another VGAM1873 host target gene. FLJ12934 BINDING SITE is HOST TARGET binding site found in the 3' untranslated region of mRNA encoded by FLJ12934, corresponding to a HOST TARGET binding site such as BINDING SITE I, BINDING SITE II or BINDING SITE III. Table 2 illustrates the complementarity of the nucleotide sequences of FLJ12934 BINDING SITE, designated SEQ ID:23175, to the nucleotide sequence of VGAM1873 RNA, herein designated VGAM RNA, also designated SEQ ID:4584.

Another function of VGAM1873 is therefore inhibition of FLJ12934 (Accession NM_022899). Accordingly, utilities of VGAM1873 include diagnosis, prevention and treatment of diseases and clinical conditions associated with FLJ12934. HCA4 (Accession XM_085287) is another VGAM1873 host target gene. HCA4 BINDING SITE is HOST TARGET binding site found in the 3' untranslated region of mRNA encoded by HCA4, corresponding to a HOST TARGET binding site such as BINDING SITE I, BINDING SITE II or BINDING SITE III. Table 2 illustrates the complementarity of the nucleotide sequences of HCA4 BINDING SITE, designated SEQ ID:38030, to the nucleotide sequence of VGAM1873 RNA, herein designated VGAM RNA, also designated SEQ ID:4584.

Another function of VGAM1873 is therefore inhibition of HCA4 (Accession XM_085287). Accordingly, utilities of VGAM1873 include diagnosis, prevention and treatment of diseases and clinical conditions associated with HCA4. KIAA0427 (Accession NM_014772) is another VGAM1873 host target gene. KIAA0427 BINDING SITE is HOST TARGET binding site found in the 3' untranslated region of mRNA encoded by KIAA0427, corresponding to a HOST TARGET binding site such as BINDING SITE I, BINDING SITE II or BINDING SITE III. Table 2 illustrates the complementarity of the nucleotide sequences of KIAA0427 BINDING SITE, designated SEQ ID:16571, to the nucleotide sequence of VGAM1873 RNA, herein designated VGAM RNA, also designated SEQ ID:4584.

Another function of VGAM1873 is therefore inhibition of KIAA0427 (Accession NM_014772). Accordingly, utilities of VGAM1873 include diagnosis, prevention and treatment of diseases and clinical conditions associated with KIAA0427. LOC116228 (Accession XM_057659) is another VGAM1873 host target gene. LOC116228 BINDING SITE is HOST TARGET binding site found in the 3' untranslated region of mRNA encoded by LOC116228, corresponding to a HOST TARGET binding site such as BINDING SITE I, BINDING SITE II or BINDING SITE III. Table 2 illustrates the complementarity of the nucleotide sequences of LOC116228 BINDING SITE, designated SEQ ID:36533, to the nucleotide sequence of VGAM1873 RNA, herein designated VGAM RNA, also designated SEQ ID:4584.

Another function of VGAM1873 is therefore inhibition of LOC116228 (Accession XM_057659). Accordingly, utilities of VGAM1873 include diagnosis, prevention and treatment of diseases and clinical conditions associated with LOC116228. LOC221540 (Accession XM_168133) is another VGAM1873 host target gene. LOC221540 BINDING SITE is HOST TARGET binding site found in the 3' untranslated region of mRNA encoded by LOC221540, corresponding to a HOST TARGET binding site such as BINDING SITE I, BINDING SITE II or BINDING SITE III. Table 2 illustrates the complementarity of the nucleotide sequences of LOC221540 BINDING SITE, designated SEQ ID:45044, to the nucleotide sequence of VGAM1873 RNA, herein designated VGAM RNA, also designated SEQ ID:4584.

Another function of VGAM1873 is therefore inhibition of LOC221540 (Accession XM_168133). Accordingly, utilities of VGAM1873 include diagnosis, prevention and treatment of diseases and clinical conditions associated with LOC221540. LOC257545 (Accession XM_175217) is another VGAM1873 host target gene. LOC257545 BINDING SITE is HOST TARGET binding site found in the 3' untranslated region of mRNA encoded by LOC257545, corresponding to a HOST TARGET binding site such as BIND- ING SITE I, BINDING SITE II or BINDING SITE III. Table 2 illustrates the complementarity of the nucleotide sequences of LOC257545 BINDING SITE, designated SEQ ID:46692, to the nucleotide sequence of VGAM1873 RNA, herein designated VGAM RNA, also designated SEQ ID:4584.

Another function of VGAM1873 is therefore inhibition of LOC257545 (Accession XM_175217). Accordingly, utilities of VGAM1873 include diagnosis, prevention and treatment of diseases and clinical conditions associated with LOC257545. LOC257598 (Accession XM_175295) is another VGAM1873 host target gene. LOC257598 BINDING SITE is HOST TARGET binding site found in the 3' untranslated region of mRNA encoded by LOC257598, corresponding to a HOST TARGET binding site such as BINDING SITE I, BINDING SITE II or BINDING SITE III. Table 2 illustrates the complementarity of the nucleotide sequences of LOC257598 BINDING SITE, designated SEQ ID:46749, to the nucleotide sequence of VGAM1873 RNA, herein designated VGAM RNA, also designated SEQ ID:4584.

Another function of VGAM1873 is therefore inhibition of LOC257598 (Accession XM_175295). Accordingly, utilities of VGAM1873 include diagnosis, prevention and treatment of diseases and clinical conditions associated with LOC257598. FIG. 1 further provides a conceptual description of a novel bioinformatically detected viral gene of the present invention, referred to here as Viral Genomic Address Messenger 1874 (VGAM1874) viral gene, which modulates expression of respective host target genes thereof, the function and utility of which host target genes is known in the art.

VGAM1874 is a novel bioinformatically detected regulatory, non protein coding, viral micro RNA (miRNA) gene. The method by which VGAM1874 was detected is described hereinabove with reference to FIGS. 1-8.

VGAM1874 gene, herein designated VGAM GENE, is a viral gene contained in the genome of Fowlpox Virus. VGAM1874 host target gene, herein designated VGAM HOST TARGET GENE, is a human gene contained in the human genome.

VGAM1874 gene encodes a VGAM1874 precursor RNA, herein designated VGAM PRECURSOR RNA. Similar to other miRNA genes, and unlike most ordinary genes, VGAM1874 precursor RNA does not encode a protein. A nucleotide sequence identical or highly similar to the nucleotide sequence of VGAM1874 precursor RNA is designated SEQ ID:1860, and is provided hereinbelow with reference to the sequence listing part. Nucleotide sequence SEQ ID:1860 is located at position 196857 relative to the genome of Fowlpox Virus.

VGAM1874 precursor RNA folds onto itself, forming VGAM1874 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1874 folded precursor RNA into VGAM1874 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1874 RNA is designated SEQ ID:4585, and is provided hereinbelow with reference to the sequence listing part.

VGAM1874 host target gene, herein designated VGAM HOST TARGET GENE, encodes a corresponding messenger RNA, VGAM1874 host target RNA, herein designated VGAM HOST TARGET RNA. VGAM1874 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1874 RNA, herein designated VGAM RNA, binds complementarily to one or more host target binding sites located in untranslated regions of VGAM1874 host target RNA, herein designated VGAM HOST TARGET RNA. This complementary binding is due to the fact that the nucleotide sequence of VGAM1874 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1874 RNA, herein designated VGAM RNA, may have a different number of host target binding sites in untranslated regions of a VGAM1874 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1874 RNA, herein designated VGAM RNA, to host target binding sites on VGAM1874 host target RNA, herein designated VGAM HOST TARGET RNA, such as BINDING SITE I, BINDING SITE II and BINDING SITE III, inhibits translation of VGAM1874 host target RNA into VGAM1874 host target protein, herein designated VGAM HOST TARGET PROTEIN. VGAM host target protein is therefore outlined by a broken line.

It is appreciated that VGAM1874 host target gene, herein designated VGAM HOST TARGET GENE, in fact represents a plurality of VGAM1874 host target genes. The mRNA of each one of this plurality of VGAM1874 host target genes comprises one or more host target binding sites, each having a nucleotide sequence which is at least partly complementary to VGAM1874 RNA, herein designated VGAM RNA, and which when bound by VGAM1874 RNA causes inhibition of translation of respective one or more VGAM1874 host target proteins.

It is further appreciated by one skilled in the art that the mode of translational inhibition illustrated by FIG. 1 with specific reference to translational inhibition exerted by VGAM1874 gene, herein designated VGAM GENE, on one or more VGAM1874 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1874 is inhibition of expression of host target genes, as part of a novel viral mechanism of attacking a host. Accordingly, utilities of VGAM1874 include diagnosis, prevention and treatment of viral infection by Fowlpox Virus. Specific functions, and accordingly utilities, of VGAM1874 correlate with, and may be deduced from, the identity of the host target genes which VGAM1874 binds and inhibits, and the function of these host target genes, as elaborated hereinbelow.

Nucleotide sequences of the VGAM1874 precursor RNA, herein designated VGAM PRECURSOR RNA, and of the 'diced' VGAM1874 RNA, herein designated VGAM RNA, and a schematic representation of the secondary folding of VGAM1874 folded precursor RNA, herein designated VGAM FOLDED PRECURSOR RNA, of VGAM1874 are further described hereinbelow with reference to Table 1.

Nucleotide sequences of host target binding sites, such as BINDING SITE-I, BINDING SITE-II and BINDING SITE-III of FIG. 1, found on VGAM1874 host target RNA, and schematic representation of the complementarity of each of these host target binding sites to VGAM1874 RNA, herein designated VGAM RNA, are described hereinbelow with reference to Table 2.

As mentioned hereinabove with reference to FIG. 1, a function of VGAM1874 gene, herein designated VGAM is inhibition of expression of VGAM1874 target genes. It is appreciated that specific functions, and accordingly utilities, of VGAM1874 correlate with, and may be deduced from, the identity of the target genes which VGAM1874 binds and inhibits, and the function of these target genes, as elaborated hereinbelow.

Carcinoembryonic Antigen-related Cell Adhesion Molecule 6 (non-specific cross reacting antigen) (CEACAM6, Accession NM_002483) is a VGAM1874 host target gene. CEACAM6 BINDING SITE is HOST TARGET binding site found in the 3' untranslated region of mRNA encoded by CEACAM6, corresponding to a HOST TARGET binding site such as BINDING SITE I, BINDING SITE II or BINDING SITE III. Table 2 illustrates the complementarity of the nucleotide sequences of CEACAM6 BINDING SITE, designated SEQ ID:8307, to the nucleotide sequence of VGAM1874 RNA, herein designated VGAM RNA, also designated SEQ ID:4585.

A function of VGAM1874 is therefore inhibition of Carcinoembryonic Antigen-related Cell Adhesion Molecule 6 (non-specific cross reacting antigen) (CEACAM6, Accession NM_002483), a gene which Non-specific cross reacting antigen (. Accordingly, utilities of VGAM1874 include diagnosis, prevention and treatment of diseases and clinical conditions associated with CEACAM6. The function of CEACAM6 and its association with various diseases and clinical conditions, has been established by previous studies, as described hereinabove with reference to VGAM286. Matrix Metalloproteinase 19 (MMP19, Accession NM_022790) is another VGAM1874 host target gene. MMP19 BINDING SITE1 and MMP19 BINDING SITE2 are HOST TARGET binding sites found in untranslated regions of mRNA encoded by MMP19, corresponding to HOST TARGET binding sites such as BINDING SITE I, BINDING SITE II or BINDING SITE III. Table 2 illustrates the complementarity of the nucleotide sequences of MMP19 BINDING SITE1 and MMP19 BINDING SITE2, designated SEQ ID:23072 and SEQ ID:23081 respectively, to the nucleotide sequence of VGAM1874 RNA, herein designated VGAM RNA, also designated SEQ ID:4585.

Another function of VGAM1874 is therefore inhibition of Matrix Metalloproteinase 19 (MMP19, Accession NM_022790). Accordingly, utilities of VGAM1874 include diagnosis, prevention and treatment of diseases and clinical conditions associated with MMP19. DREV1 (Accession NM_016025) is another VGAM1874 host target gene. DREV1 BINDING SITE is HOST TARGET binding site found in the 3' untranslated region of mRNA encoded by DREV1, corresponding to a HOST TARGET binding site such as BINDING SITE I, BINDING SITE II or BINDING SITE III. Table 2 illustrates the complementarity of the nucleotide sequences of DREV1 BINDING SITE, designated SEQ ID:18106, to the nucleotide sequence of VGAM1874 RNA, herein designated VGAM RNA, also designated SEQ ID:4585.

Another function of VGAM1874 is therefore inhibition of DREV1 (Accession NM_016025). Accordingly, utilities of VGAM1874 include diagnosis, prevention and treatment of diseases and clinical conditions associated with DREV1. Potassium Voltage-gated Channel, Isk-related Family, Member 4 (KCNE4, Accession NM_080671) is another VGAM1874 host target gene. KCNE4 BINDING SITE is HOST TARGET binding site found in the 3' untranslated region of mRNA encoded by KCNE4, corresponding to a HOST TARGET binding site such as BINDING SITE I, BINDING SITE II or BINDING SITE III. Table 2 illustrates the complementarity of the nucleotide sequences of KCNE4 BINDING SITE, designated SEQ ID:27967, to the nucleotide sequence of VGAM1874 RNA, herein designated VGAM RNA, also designated SEQ ID:4585.

Another function of VGAM1874 is therefore inhibition of Potassium Voltage-gated Channel, Isk-related Family, Member 4 (KCNE4, Accession NM_080671). Accordingly, utilities of VGAM1874 include diagnosis, prevention and treatment of diseases and clinical conditions associated with KCNE4. Phospholipid Scramblase 4 (PLSCR4, Accession NM_020353) is another VGAM1874 host target gene. PLSCR4 BINDING SITE is HOST TARGET binding site found in the 3' untranslated region of mRNA encoded by PLSCR4, corresponding to a HOST TARGET binding site such as BINDING SITE I, BINDING SITE II or BINDING SITE III. Table 2 illustrates the complementarity of the nucleotide sequences of PLSCR4 BINDING SITE, designated SEQ ID:21619, to the nucleotide sequence of VGAM1874 RNA, herein designated VGAM RNA, also designated SEQ ID:4585.

Another function of VGAM1874 is therefore inhibition of Phospholipid Scramblase 4 (PLSCR4, Accession NM_020353). Accordingly, utilities of VGAM1874 include diagnosis, prevention and treatment of diseases and clinical conditions associated with PLSCR4. LOC163033 (Accession XM_091949) is another VGAM1874 host target gene. LOC163033 BINDING SITE is HOST TARGET binding site found in the 5' untranslated region of mRNA encoded by LOC163033, corresponding to a HOST TARGET binding site such as BINDING SITE I, BINDING SITE II or BINDING SITE III. Table 2 illustrates the complementarity of the nucleotide sequences of LOC163033 BINDING SITE, designated SEQ ID:40072, to the nucleotide sequence of VGAM1874 RNA, herein designated VGAM RNA, also designated SEQ ID:4585.

Another function of VGAM1874 is therefore inhibition of LOC163033 (Accession XM_091949). Accordingly, utilities of VGAM1874 include diagnosis, prevention and treatment of diseases and clinical conditions associated with LOC163033. LOC219920 (Accession XM_167787) is another VGAM1874 host target gene. LOC219920 BINDING SITE is HOST TARGET binding site found in the 5' untranslated region of mRNA encoded by LOC219920, corresponding to a HOST TARGET binding site such as BINDING SITE I, BINDING SITE II or BINDING SITE III. Table 2 illustrates the complementarity of the nucleotide sequences of LOC219920 BINDING SITE, designated SEQ ID:44801, to the nucleotide sequence of VGAM1874 RNA, herein designated VGAM RNA, also designated SEQ ID:4585.

Another function of VGAM1874 is therefore inhibition of LOC219920 (Accession XM_167787). Accordingly, utilities of VGAM1874 include diagnosis, prevention and treatment of diseases and clinical conditions associated with LOC219920. LOC253598 (Accession XM_175049) is another VGAM1874 host target gene. LOC253598 BINDING SITE is HOST TARGET binding site found in the 5' untranslated region of mRNA encoded by LOC253598, corresponding to a HOST TARGET binding site such as BINDING SITE I, BINDING SITE II or BINDING SITE III. Table 2 illustrates the complementarity of the nucleotide sequences of LOC253598 BINDING SITE, designated SEQ ID:46609, to the nucleotide sequence of VGAM1874 RNA, herein designated VGAM RNA, also designated SEQ ID:4585.

Another function of VGAM1874 is therefore inhibition of LOC253598 (Accession XM_175049). Accordingly, utilities of VGAM1874 include diagnosis, prevention and treatment of diseases and clinical conditions associated with LOC253598. LOC254173 (Accession XM_173022) is another VGAM1874 host target gene. LOC254173 BINDING SITE is HOST TARGET binding site found in the 3' untranslated region of mRNA encoded by LOC254173, corresponding to a HOST TARGET binding site such as BINDING SITE I, BINDING SITE II or BINDING SITE III. Table 2 illustrates the complementarity of the nucleotide sequences of LOC254173 BINDING SITE, designated SEQ ID:46285, to the nucleotide sequence of VGAM1874 RNA, herein designated VGAM RNA, also designated SEQ ID:4585.

Another function of VGAM1874 is therefore inhibition of LOC254173 (Accession XM_173022). Accordingly, utilities of VGAM1874 include diagnosis, prevention and treatment of diseases and clinical conditions associated with LOC254173. FIG. 1 further provides a conceptual description of a novel bioinformatically detected viral gene of the present invention, referred to here as Viral Genomic Address Messenger 1875 (VGAM1875) viral gene, which modulates expression of respective host target genes thereof, the function and utility of which host target genes is known in the art.

VGAM1875 is a novel bioinformatically detected regulatory, non protein coding, viral micro RNA (miRNA) gene. The method by which VGAM1875 was detected is described hereinabove with reference to FIGS. 1-8.

VGAM1875 gene, herein designated VGAM GENE, is a viral gene contained in the genome of Fowlpox Virus. VGAM1875 host target gene, herein designated VGAM HOST TARGET GENE, is a human gene contained in the human genome.

VGAM1875 gene encodes a VGAM1875 precursor RNA, herein designated VGAM PRECURSOR RNA. Similar to other miRNA genes, and unlike most ordinary genes, VGAM1875 precursor RNA does not encode a protein. A nucleotide sequence identical or highly similar to the nucleotide sequence of VGAM1875 precursor RNA is designated SEQ ID:1861, and is provided hereinbelow with reference to the sequence listing part. Nucleotide sequence SEQ ID:1861 is located at position 187831 relative to the genome of Fowlpox Virus.

VGAM1875 precursor RNA folds onto itself, forming VGAM1875 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1875 folded precursor RNA into VGAM1875 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 62%) nucleotide sequence of VGAM1875 RNA is designated SEQ ID:4586, and is provided hereinbelow with reference to the sequence listing part.

VGAM1875 host target gene, herein designated VGAM HOST TARGET GENE, encodes a corresponding messenger RNA, VGAM1875 host target RNA, herein designated VGAM HOST TARGET RNA. VGAM1875 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1875 RNA, herein designated VGAM RNA, binds complementarily to one or more host target binding sites located in untranslated regions of VGAM1875 host target RNA, herein designated VGAM HOST TARGET RNA. This complementary binding is due to the fact that the nucleotide sequence of VGAM1875 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1875 RNA, herein designated VGAM RNA, may have a different number of host target binding sites in untranslated regions of a VGAM1875 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1875 RNA, herein designated VGAM RNA, to host target binding sites on VGAM1875 host target RNA, herein designated VGAM HOST TARGET RNA, such as BINDING SITE I, BINDING SITE II and BINDING SITE III, inhibits translation of VGAM1875 host target RNA into VGAM1875 host target protein, herein designated VGAM HOST TARGET PROTEIN. VGAM host target protein is therefore outlined by a broken line.

It is appreciated that VGAM1875 host target gene, herein designated VGAM HOST TARGET GENE, in fact represents a plurality of VGAM1875 host target genes. The mRNA of each one of this plurality of VGAM1875 host target genes comprises one or more host target binding sites, each having a nucleotide sequence which is at least partly complementary to VGAM1875 RNA, herein designated VGAM RNA, and which when bound by VGAM1875 RNA causes inhibition of translation of respective one or more VGAM1875 host target proteins.

It is further appreciated by one skilled in the art that the mode of translational inhibition illustrated by FIG. 1 with specific reference to translational inhibition exerted by VGAM1875 gene, herein designated VGAM GENE, on one or more VGAM1875 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1875 is inhibition of expression of host target genes, as part of a novel viral mechanism of attacking a host. Accordingly, utilities of VGAM1875 include diagnosis, prevention and treatment of viral infection by Fowlpox Virus. Specific functions, and accordingly utilities, of VGAM1875 correlate with, and may be deduced from, the identity of the host target genes which VGAM1875 binds and inhibits, and the function of these host target genes, as elaborated hereinbelow.

Nucleotide sequences of the VGAM1875 precursor RNA, herein designated VGAM PRECURSOR RNA, and of the 'diced' VGAM1875 RNA, herein designated VGAM RNA, and a schematic representation of the secondary folding of VGAM1875 folded precursor RNA, herein designated VGAM FOLDED PRECURSOR RNA, of VGAM1875 are further described hereinbelow with reference to Table 1.

Nucleotide sequences of host target binding sites, such as BINDING SITE-I, BINDING SITE-II and BINDING SITE-III of FIG. 1, found on VGAM1875 host target RNA, and schematic representation of the complementarity of each of these host target binding sites to VGAM1875 RNA, herein designated VGAM RNA, are described hereinbelow with reference to Table 2.

As mentioned hereinabove with reference to FIG. 1, a function of VGAM1875 gene, herein designated VGAM is inhibition of expression of VGAM1875 target genes. It is appreciated that specific functions, and accordingly utilities, of VGAM1875 correlate with, and may be deduced from, the identity of the target genes which VGAM1875 binds and inhibits, and the function of these target genes, as elaborated hereinbelow.

Cadherin 13, H-cadherin (heart) (CDH13, Accession NM_001257) is a VGAM1875 host target gene. CDH13 BINDING SITE is HOST TARGET binding site found in the 3' untranslated region of mRNA encoded by CDH13, corresponding to a HOST TARGET binding site such as BINDING SITE I, BINDING SITE II or BINDING SITE III. Table 2 illustrates the complementarity of the nucleotide sequences of CDH13 BINDING SITE, designated SEQ ID:6925, to the nucleotide sequence of VGAM1875 RNA, herein designated VGAM RNA, also designated SEQ ID:4586.

A function of VGAM1875 is therefore inhibition of Cadherin 13, H-cadherin (heart) (CDH13, Accession NM_001257). Accordingly, utilities of VGAM1875 include diagnosis, prevention and treatment of diseases and clinical conditions associated with CDH13. Coagulation Factor XIII, A1 Polypeptide (F13A1, Accession XM_165833) is another VGAM1875 host target gene. F13A1 BINDING SITE is HOST TARGET binding site found in the 3' untranslated region of mRNA encoded by F13A1, corresponding to a HOST TARGET binding site such as BINDING SITE I, BINDING SITE II or BINDING SITE III. Table 2 illustrates the complementarity of the nucleotide sequences of F13A1 BINDING SITE, designated SEQ ID:43774, to the nucleotide sequence of VGAM1875 RNA, herein designated VGAM RNA, also designated SEQ ID:4586.

Another function of VGAM1875 is therefore inhibition of Coagulation Factor XIII, A1 Polypeptide (F13A1, Accession XM_165833). Accordingly, utilities of VGAM1875 include diagnosis, prevention and treatment of diseases and clinical conditions associated with F13A1. Heparanase (HPSE, Accession NM_006665) is another VGAM1875 host target gene. HPSE BINDING SITE is HOST TARGET binding site found in the 3' untranslated region of mRNA encoded by HPSE, corresponding to a HOST TARGET binding site such as BINDING SITE I, BINDING SITE II or BINDING SITE III. Table 2 illustrates the complementarity of the nucleotide sequences of HPSE BINDING SITE, designated SEQ ID:13482, to the nucleotide sequence of VGAM1875 RNA, herein designated VGAM RNA, also designated SEQ ID:4586.

Another function of VGAM1875 is therefore inhibition of Heparanase (HPSE, Accession NM_006665), a gene which is an endoglycosidase that cleaves heparan sulfate. Accordingly, utilities of VGAM1875 include diagnosis, prevention and treatment of diseases and clinical conditions associated with HPSE. The function of HPSE and its association with various diseases and clinical conditions, has been established by previous studies, as described hereinabove with reference to VGAM374. Palmitoyl-protein Thioesterase 2 (PPT2, Accession NM_138717) is another VGAM1875 host target gene. PPT2 BINDING SITE1 and PPT2 BINDING SITE2 are HOST TARGET binding sites found in untranslated regions of mRNA encoded by PPT2, corresponding to HOST TARGET binding sites such as BINDING SITE I, BINDING SITE II or BINDING SITE III. Table 2 illustrates the complementarity of the nucleotide sequences of PPT2 BINDING SITE1 and PPT2 BINDING SITE2, designated SEQ ID:28965 and SEQ ID:11634 respectively, to the nucleotide sequence of VGAM1875 RNA, herein designated VGAM RNA, also designated SEQ ID:4586.

Another function of VGAM1875 is therefore inhibition of Palmitoyl-protein Thioesterase 2 (PPT2, Accession NM_138717), a gene which is a palmitoyl-protein thioesterase 2 which possesses a different substrate specificity than PPT1. Accordingly, utilities of VGAM1875 include diagnosis, prevention and treatment of diseases and clinical conditions associated with PPT2. The function of PPT2 and its association with various diseases and clinical conditions, has been established by previous studies, as described hereinabove with reference to VGAM120. KIAA0836 (Accession XM_035390) is another VGAM1875 host target gene. KIAA0836 BINDING SITE is HOST TARGET binding site found in the 3' untranslated region of mRNA encoded by KIAA0836, corresponding to a HOST TARGET binding site such as BINDING SITE I, BINDING SITE II or BINDING SITE III. Table 2 illustrates the complementarity of the nucleotide sequences of KIAA0836 BINDING SITE, designated SEQ ID:32247, to the nucleotide sequence of VGAM1875 RNA, herein designated VGAM RNA, also designated SEQ ID:4586.

Another function of VGAM1875 is therefore inhibition of KIAA0836 (Accession XM_035390). Accordingly, utilities of VGAM1875 include diagnosis, prevention and treatment of diseases and clinical conditions associated with KIAA0836. KIAA0953 (Accession XM_039733) is another VGAM1875 host target gene. KIAA0953 BINDING SITE is HOST TARGET binding site found in the 3' untranslated region of mRNA encoded by KIAA0953, corresponding to a HOST TARGET binding site such as BINDING SITE I, BINDING SITE II or BINDING SITE III. Table 2 illustrates the complementarity of the nucleotide sequences of KIAA0953 BINDING SITE, designated SEQ ID:33168, to the nucleotide sequence of VGAM1875 RNA, herein designated VGAM RNA, also designated SEQ ID:4586.

Another function of VGAM1875 is therefore inhibition of KIAA0953 (Accession XM_039733). Accordingly, utilities of VGAM1875 include diagnosis, prevention and treatment of diseases and clinical conditions associated with KIAA0953. PRO2958 (Accession NM_018546) is another VGAM1875 host target gene. PRO2958 BINDING SITE is HOST TARGET binding site found in the 5' untranslated region of mRNA encoded by PRO2958, corresponding to a HOST TARGET binding site such as BINDING SITE I, BINDING SITE II or BINDING SITE III. Table 2 illustrates the complementarity of the nucleotide sequences of PRO2958 BINDING SITE, designated SEQ ID:20624, to the nucleotide sequence of VGAM1875 RNA, herein designated VGAM RNA, also designated SEQ ID:4586.

Another function of VGAM1875 is therefore inhibition of PRO2958 (Accession NM_018546). Accordingly, utilities of VGAM1875 include diagnosis, prevention and treatment of diseases and clinical conditions associated with PRO2958. Serologically Defined Colon Cancer Antigen 1 (SDCCAG1, Accession NM_004713) is another VGAM1875 host target gene. SDCCAG1 BINDING SITE is HOST TARGET binding site found in the 3' untranslated region of mRNA encoded by SDCCAG1, corresponding to a HOST TARGET binding site such as BINDING SITE I, BINDING SITE II or BINDING SITE III. Table 2 illustrates the complementarity of the nucleotide sequences of SDCCAG1 BINDING SITE, designated SEQ ID:11070, to the nucleotide sequence of VGAM1875 RNA, herein designated VGAM RNA, also designated SEQ ID:4586.

Another function of VGAM1875 is therefore inhibition of Serologically Defined Colon Cancer Antigen 1 (SDCCAG1, Accession NM_004713). Accordingly, utilities of VGAM1875 include diagnosis, prevention and treatment of diseases and clinical conditions associated with SDCCAG1. Syntrophin, Gamma 1 (SNTG1, Accession NM_018967) is another VGAM1875 host target gene. SNTG1 BINDING SITE is HOST TARGET binding site found in the 3' untranslated region of mRNA encoded by SNTG1, corresponding to a HOST TARGET binding site such as BINDING SITE I, BINDING SITE II or BINDING SITE III. Table 2 illustrates the complementarity of the nucleotide sequences of SNTG1 BINDING SITE, designated SEQ ID:21037, to the nucleotide sequence of VGAM1875 RNA, herein designated VGAM RNA, also designated SEQ ID:4586.

Another function of VGAM1875 is therefore inhibition of Syntrophin, Gamma 1 (SNTG1, Accession NM_018967). Accordingly, utilities of VGAM1875 include diagnosis, prevention and treatment of diseases and clinical conditions associated with SNTG1. LOC120856 (Accession XM_058509) is another VGAM1875 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36642, to the nucleotide sequence of VGAM1875 RNA, herein designated VGAM RNA, also designated SEQ ID:4586.

Another function of VGAM1875 is therefore inhibition of LOC120856 (Accession XM_058509). Accordingly, utilities of VGAM1875 include diagnosis, prevention and treatment of diseases and clinical conditions associated with LOC120856. LOC131744 (Accession XM_067529) is another VGAM1875 host target gene. LOC131744 BINDING SITE is HOST TARGET binding site found in the 3' untranslated region of mRNA encoded by LOC131744, corresponding to a HOST TARGET binding site such as BINDING SITE I, BINDING SITE II or BINDING SITE III. Table 2 illustrates the complementarity of the nucleotide sequences of LOC131744 BINDING SITE, designated SEQ ID:37358, to the nucleotide sequence of VGAM1875 RNA, herein designated VGAM RNA, also designated SEQ ID:4586.

Another function of VGAM1875 is therefore inhibition of LOC131744 (Accession XM_067529). Accordingly, utilities of VGAM1875 include diagnosis, prevention and treatment of diseases and clinical conditions associated with LOC131744. LOC147172 (Accession XM_085729) is another VGAM1875 host target gene. LOC147172 BINDING SITE is HOST TARGET binding site found in the 3' untranslated region of mRNA encoded by LOC147172, corresponding to a HOST TARGET binding site such as BINDING SITE I, BINDING SITE II or BINDING SITE III. Table 2 illustrates the complementarity of the nucleotide sequences of LOC147172 BINDING SITE, designated SEQ ID:38313, to the nucleotide sequence of VGAM1875 RNA, herein designated VGAM RNA, also designated SEQ ID:4586.

Another function of VGAM1875 is therefore inhibition of LOC147172 (Accession XM_085729). Accordingly, utilities of VGAM1875 include diagnosis, prevention and treatment of diseases and clinical conditions associated with LOC147172. LOC152195 (Accession XM_098172) is another VGAM1875 host target gene. LOC152195 BINDING SITE is HOST TARGET binding site found in the 3' untranslated region of mRNA encoded by LOC152195, corresponding to a HOST TARGET binding site such as BINDING SITE I, BINDING SITE II or BINDING SITE III. Table 2 illustrates the complementarity of the nucleotide sequences of LOC152195 BINDING SITE, designated SEQ ID:41435, to the nucleotide sequence of VGAM1875 RNA, herein designated VGAM RNA, also designated SEQ ID:4586.

Another function of VGAM1875 is therefore inhibition of LOC152195 (Accession XM_098172). Accordingly, utilities of VGAM1875 include diagnosis, prevention and treatment of diseases and clinical conditions associated with LOC152195. LOC153454 (Accession XM_087672) is another VGAM1875 host target gene. LOC153454 BINDING SITE is HOST TARGET binding site found in the 3' untranslated region of mRNA encoded by LOC153454, corresponding to a HOST TARGET binding site such as BINDING SITE I, BINDING SITE II or BINDING SITE III. Table 2 illustrates the complementarity of the nucleotide sequences of LOC153454 BINDING SITE, designated SEQ ID:39375, to the nucleotide sequence of VGAM1875 RNA, herein designated VGAM RNA, also designated SEQ ID:4586.

Another function of VGAM1875 is therefore inhibition of LOC153454 (Accession XM_087672). Accordingly, utilities of VGAM1875 include diagnosis, prevention and treatment of diseases and clinical conditions associated with LOC153454. FIG. 1 further provides a conceptual description of a novel bioinformatically detected viral gene of the present invention, referred to here as Viral Genomic Address Messenger 1876 (VGAM1876) viral gene, which modulates expression of respective host target genes thereof, the function and utility of which host target genes is known in the art.

VGAM1876 is a novel bioinformatically detected regulatory, non protein coding, viral micro RNA (miRNA) gene. The method by which VGAM1876 was detected is described hereinabove with reference to FIGS. 1-8.

VGAM1876 gene, herein designated VGAM GENE, is a viral gene contained in the genome of Fowlpox Virus. VGAM1876 host target gene, herein designated VGAM HOST TARGET GENE, is a human gene contained in the human genome.

VGAM1876 gene encodes a VGAM1876 precursor RNA, herein designated VGAM PRECURSOR RNA. Similar to other miRNA genes, and unlike most ordinary genes, VGAM1876 precursor RNA does not encode a protein. A nucleotide sequence identical or highly similar to the nucleotide sequence of VGAM1876 precursor RNA is designated SEQ ID:1862, and is provided hereinbelow with reference to the sequence listing part. Nucleotide sequence SEQ ID:1862 is located at position 194761 relative to the genome of Fowlpox Virus.

VGAM1876 precursor RNA folds onto itself, forming VGAM1876 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1876 folded precursor RNA into VGAM1876 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1876 RNA is designated SEQ ID:4587, and is provided hereinbelow with reference to the sequence listing part.

VGAM1876 host target gene, herein designated VGAM HOST TARGET GENE, encodes a corresponding messenger RNA, VGAM1876 host target RNA, herein designated VGAM HOST TARGET RNA. VGAM1876 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1876 RNA, herein designated VGAM RNA, binds complementarily to one or more host target binding sites located in untranslated regions of VGAM1876 host target RNA, herein designated VGAM HOST TARGET RNA. This complementary binding is due to the fact that the nucleotide sequence of VGAM1876 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1876 RNA, herein designated VGAM RNA, may have a different number of host target binding sites in untranslated regions of a VGAM1876 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1876 RNA, herein designated VGAM RNA, to host target binding sites on VGAM1876 host target RNA, herein designated VGAM HOST TARGET RNA, such as BINDING SITE I, BINDING SITE II and BINDING SITE III, inhibits translation of VGAM1876 host target RNA into VGAM1876 host target protein, herein designated VGAM HOST TARGET PROTEIN. VGAM host target protein is therefore outlined by a broken line.

It is appreciated that VGAM1876 host target gene, herein designated VGAM HOST TARGET GENE, in fact represents a plurality of VGAM1876 host target genes. The mRNA of each one of this plurality of VGAM1876 host target genes comprises one or more host target binding sites, each having a nucleotide sequence which is at least partly complementary to VGAM1876 RNA, herein designated VGAM RNA, and which when bound by VGAM1876 RNA causes inhibition of translation of respective one or more VGAM1876 host target proteins.

It is further appreciated by one skilled in the art that the mode of translational inhibition illustrated by FIG. 1 with specific reference to translational inhibition exerted by VGAM1876 gene, herein designated VGAM GENE, on one or more VGAM1876 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1876 is inhibition of expression of host target genes, as part of a novel viral mechanism of attacking a host. Accordingly, utilities of VGAM1876 include diagnosis, prevention and treatment of viral infection by Fowlpox Virus. Specific functions, and accordingly utilities, of VGAM1876 correlate with, and may be deduced from, the identity of the host target genes which VGAM1876 binds and inhibits, and the function of these host target genes, as elaborated hereinbelow.

Nucleotide sequences of the VGAM1876 precursor RNA, herein designated VGAM PRECURSOR RNA, and of the 'diced' VGAM1876 RNA, herein designated VGAM RNA, and a schematic representation of the secondary folding of VGAM1876 folded precursor RNA, herein designated VGAM FOLDED PRECURSOR RNA, of VGAM1876 are further described hereinbelow with reference to Table 1.

Nucleotide sequences of host target binding sites, such as BINDING SITE-I, BINDING SITE-II and BINDING SITE-III of FIG. 1, found on VGAM1876 host target RNA, and schematic representation of the complementarity of each of these host target binding sites to VGAM1876 RNA, herein designated VGAM RNA, are described hereinbelow with reference to Table 2.

As mentioned hereinabove with reference to FIG. 1, a function of VGAM1876 gene, herein designated VGAM is inhibition of expression of VGAM1876 target genes. It is appreciated that specific functions, and accordingly utilities, of VGAM1876 correlate with, and may be deduced from, the identity of the target genes which VGAM1876 binds and inhibits, and the function of these target genes, as elaborated hereinbelow.

Complement Component 7 (C7, Accession NM_000587) is a VGAM1876 host target gene. C7 BINDING SITE is HOST TARGET binding site found in the 3' untranslated region of mRNA encoded by C7, corresponding to a HOST TARGET binding site such as BINDING SITE I, BINDING SITE II or BINDING SITE III. Table 2 illustrates the complementarity of the nucleotide sequences of C7 BINDING SITE, designated SEQ ID:6188, to the nucleotide sequence of VGAM1876 RNA, herein designated VGAM RNA, also designated SEQ ID:4587.

A function of VGAM1876 is therefore inhibition of Complement Component 7 (C7, Accession NM_000587). Accordingly, utilities of VGAM1876 include diagnosis, prevention and treatment of diseases and clinical conditions associated with C7. Calumenin (CALU, Accession NM_001219) is another VGAM1876 host target gene. CALU BINDING SITE is HOST TARGET binding site found in the 3' untranslated region of mRNA encoded by CALU, corresponding to a HOST TARGET binding site such as BINDING SITE I, BINDING SITE II or BINDING SITE III. Table 2 illustrates the complementarity of the nucleotide sequences of CALU BINDING SITE, designated SEQ ID:6884, to the nucleotide sequence of VGAM1876 RNA, herein designated VGAM RNA, also designated SEQ ID:4587.

Another function of VGAM1876 is therefore inhibition of Calumenin (CALU, Accession NM_001219), a gene which binds 7 calcium ions with a low affinity with unidtified function. Accordingly, utilities of VGAM1876 include diagnosis, prevention and treatment of diseases and clinical conditions associated with CALU. The function of CALU and its association with various diseases and clinical conditions, has been established by previous studies, as described hereinabove with reference to VGAM253. Heparanase (HPSE, Accession NM_006665) is another VGAM1876 host target gene. HPSE BINDING SITE is HOST TARGET binding site found in the 3' untranslated region of mRNA encoded by HPSE, corresponding to a HOST TARGET binding site such as BINDING SITE I, BINDING SITE II or BINDING SITE III. Table 2 illustrates the complementarity of the nucleotide sequences of HPSE BINDING SITE, designated SEQ ID:13478, to the nucleotide sequence of VGAM1876 RNA, herein designated VGAM RNA, also designated SEQ ID:4587.

Another function of VGAM1876 is therefore inhibition of Heparanase (HPSE, Accession NM_006665), a gene which is an endoglycosidase that cleaves heparan sulfate. Accordingly, utilities of VGAM1876 include diagnosis, prevention and treatment of diseases and clinical conditions associated with HPSE. The function of HPSE and its association with various diseases and clinical conditions, has been established by previous studies, as described hereinabove with reference to VGAM374. Prostaglandin F Receptor (FP) (PTGFR, Accession NM_000959) is another VGAM1876 host target gene. PTGFR BINDING SITE is HOST TARGET binding site found in the 3' untranslated region of mRNA encoded by PTGFR, corresponding to a HOST TARGET binding site such as BINDING SITE I, BINDING SITE II or BINDING SITE III. Table 2 illustrates the complementarity of the nucleotide sequences of PTGFR BINDING SITE, designated SEQ ID:6662, to the nucleotide sequence of VGAM1876 RNA, herein designated VGAM RNA, also designated SEQ ID:4587.

Another function of VGAM1876 is therefore inhibition of Prostaglandin F Receptor (FP) (PTGFR, Accession NM_000959), a gene which mediates intracellular calcium flux, strongly similar to murine Ptgfr. Accordingly, utilities of VGAM1876 include diagnosis, prevention and treatment of diseases and clinical conditions associated with PTGFR. The function of PTGFR and its association with various diseases and clinical conditions, has been established by previous studies, as described hereinabove with reference to VGAM1781. RAB18, Member RAS Oncogene Family (RAB18, Accession NM_021252) is another VGAM1876 host target gene. RAB18 BINDING SITE is HOST TARGET binding site found in the 3' untranslated region of mRNA encoded by RAB18, corresponding to a HOST TARGET binding site such as BINDING SITE I, BINDING SITE II or BINDING SITE III. Table 2 illustrates the complementarity of the nucleotide sequences of RAB18 BINDING SITE, designated SEQ ID:22220, to the nucleotide sequence of VGAM1876 RNA, herein designated VGAM RNA, also designated SEQ ID:4587.

Another function of VGAM1876 is therefore inhibition of RAB18, Member RAS Oncogene Family (RAB18, Accession NM_021252), a gene which plays a role in apical endocytosis/recycling. Accordingly, utilities of VGAM1876 include diagnosis, prevention and treatment of diseases and clinical conditions associated with RAB18. The function of RAB18 and its association with various diseases and clinical conditions, has been established by previous studies, as described hereinabove with reference to VGAM120. C1q and Tumor Necrosis Factor Related Protein 7 (C1QTNF7, Accession NM_031911) is another VGAM1876 host target gene. C1QTNF7 BINDING SITE is HOST TARGET binding site found in the 3' untranslated region of mRNA encoded by C1QTNF7, corresponding to a HOST TARGET binding site such as BINDING SITE I, BINDING SITE II or BINDING SITE III. Table 2 illustrates the complementarity of the nucleotide sequences of C1QTNF7 BINDING SITE, designated SEQ ID:25664, to the nucleotide sequence of VGAM1876 RNA, herein designated VGAM RNA, also designated SEQ ID:4587.

Another function of VGAM1876 is therefore inhibition of C1q and Tumor Necrosis Factor Related Protein 7 (C1QTNF7, Accession NM_031911). Accordingly, utilities of VGAM1876 include diagnosis, prevention and treatment of diseases and clinical conditions associated with C1QTNF7. FLJ13340 (Accession NM_057175) is another VGAM1876 host target gene. FLJ13340 BINDING SITE is HOST TARGET binding site found in the 3' untranslated region of mRNA encoded by FLJ13340, corresponding to a HOST TARGET binding site such as BINDING SITE I, BINDING SITE II or BINDING SITE III. Table 2 illustrates the complementarity of the nucleotide sequences of FLJ13340 BINDING SITE, designated SEQ ID:27708, to the nucleotide sequence of VGAM1876 RNA, herein designated VGAM RNA, also designated SEQ ID:4587.

Another function of VGAM1876 is therefore inhibition of FLJ13340 (Accession NM_057175). Accordingly, utilities of VGAM1876 include diagnosis, prevention and treatment of diseases and clinical conditions associated with FLJ13340. FLJ14621 (Accession NM_032811) is another VGAM1876 host target gene. FLJ14621 BINDING SITE is HOST TARGET binding site found in the 3' untranslated region of mRNA encoded by FLJ14621, corresponding to a HOST TARGET binding site such as BINDING SITE I, BINDING SITE II or BINDING SITE III. Table 2 illustrates the complementarity of the nucleotide sequences of FLJ14621 BINDING SITE, designated SEQ ID:26579, to the nucleotide sequence of VGAM1876 RNA, herein designated VGAM RNA, also designated SEQ ID:4587.

Another function of VGAM1876 is therefore inhibition of FLJ14621 (Accession NM_032811). Accordingly, utilities of VGAM1876 include diagnosis, prevention and treatment of diseases and clinical conditions associated with FLJ14621. TBDN100 (Accession NM_025085) is another VGAM1876 host target gene. TBDN100 BINDING SITE is HOST TARGET binding site found in the 3' untranslated region of mRNA encoded by TBDN100, corresponding to a HOST TARGET binding site such as BINDING SITE I, BINDING SITE II or BINDING SITE III. Table 2 illustrates the complementarity of the nucleotide sequences of TBDN100 BINDING SITE, designated SEQ ID:24699, to the nucleotide sequence of VGAM1876 RNA, herein designated VGAM RNA, also designated SEQ ID:4587.

Another function of VGAM1876 is therefore inhibition of TBDN100 (Accession NM_025085). Accordingly, utilities of VGAM1876 include diagnosis, prevention and treatment of diseases and clinical conditions associated with TBDN100. FIG. 1 further provides a conceptual description of a novel bioinformatically detected viral gene of the present invention, referred to here as Viral Genomic Address Messenger 1877 (VGAM1877) viral gene, which modulates expression of respective host target genes thereof, the function and utility of which host target genes is known in the art.

VGAM1877 is a novel bioinformatically detected regulatory, non protein coding, viral micro RNA (miRNA) gene. The method by which VGAM1877 was detected is described hereinabove with reference to FIGS. 1-8.

VGAM1877 gene, herein designated VGAM GENE, is a viral gene contained in the genome of Fowlpox Virus. VGAM1877 host target gene, herein designated VGAM HOST TARGET GENE, is a human gene contained in the human genome.

VGAM1877 gene encodes a VGAM1877 precursor RNA, herein designated VGAM PRECURSOR RNA. Similar to other miRNA genes, and unlike most ordinary genes, VGAM1877 precursor RNA does not encode a protein. A nucleotide sequence identical or highly similar to the nucleotide sequence of VGAM1877 precursor RNA is designated SEQ ID:1863, and is provided hereinbelow with reference to the sequence listing part. Nucleotide sequence SEQ ID:1863 is located at position 184855 relative to the genome of Fowlpox Virus.

VGAM1877 precursor RNA folds onto itself, forming VGAM1877 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1877 folded precursor RNA into VGAM1877 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1877 RNA is designated SEQ ID:4588, and is provided hereinbelow with reference to the sequence listing part.

VGAM1877 host target gene, herein designated VGAM HOST TARGET GENE, encodes a corresponding messenger RNA, VGAM1877 host target RNA, herein designated VGAM HOST TARGET RNA. VGAM1877 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1877 RNA, herein designated VGAM RNA, binds complementarily to one or more host target binding sites located in untranslated regions of VGAM1877 host target RNA, herein designated VGAM HOST TARGET RNA. This complementary binding is due to the fact that the nucleotide sequence of VGAM1877 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1877 RNA, herein designated VGAM RNA, may have a different number of host target binding sites in untranslated regions of a VGAM1877 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1877 RNA, herein designated VGAM RNA, to host target binding sites on VGAM1877 host target RNA, herein designated VGAM HOST TARGET RNA, such as BINDING SITE I, BINDING SITE II and BINDING SITE III, inhibits translation of VGAM1877 host target RNA into VGAM1877 host target protein, herein designated VGAM HOST TARGET PROTEIN. VGAM host target protein is therefore outlined by a broken line.

It is appreciated that VGAM1877 host target gene, herein designated VGAM HOST TARGET GENE, in fact represents a plurality of VGAM1877 host target genes. The mRNA of each one of this plurality of VGAM1877 host target genes comprises one or more host target binding sites, each having a nucleotide sequence which is at least partly complementary to VGAM1877 RNA, herein designated VGAM RNA, and which when bound by VGAM1877 RNA causes inhibition of translation of respective one or more VGAM1877 host target proteins.

It is further appreciated by one skilled in the art that the mode of translational inhibition illustrated by FIG. 1 with specific reference to translational inhibition exerted by VGAM1877 gene, herein designated VGAM GENE, on one or more VGAM1877 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1877 is inhibition of expression of host target genes, as part of a novel viral mechanism of attacking a host. Accordingly, utilities of VGAM1877 include diagnosis, prevention and treatment of viral infection by Fowlpox Virus. Specific functions, and accordingly utilities, of VGAM1877 correlate with, and may be deduced from, the identity of the host target genes which VGAM1877 binds and inhibits, and the function of these host target genes, as elaborated hereinbelow.

Nucleotide sequences of the VGAM1877 precursor RNA, herein designated VGAM PRECURSOR RNA, and of the 'diced' VGAM1877 RNA, herein designated VGAM RNA, and a schematic representation of the secondary folding of VGAM1877 folded precursor RNA, herein designated VGAM FOLDED PRECURSOR RNA, of VGAM1877 are further described hereinbelow with reference to Table 1.

Nucleotide sequences of host target binding sites, such as BINDING SITE-I, BINDING SITE-II and BINDING SITE-III of FIG. 1, found on VGAM1877 host target RNA, and schematic representation of the complementarity of each of these host target binding sites to VGAM1877 RNA, herein designated VGAM RNA, are described hereinbelow with reference to Table 2.

As mentioned hereinabove with reference to FIG. 1, a function of VGAM1877 gene, herein designated VGAM is inhibition of expression of VGAM1877 target genes. It is appreciated that specific functions, and accordingly utilities, of VGAM1877 correlate with, and may be deduced from, the identity of the target genes which VGAM1877 binds and inhibits, and the function of these target genes, as elaborated hereinbelow.

A Kinase (PRKA) Anchor Protein 11 (AKAP11, Accession NM_016248) is a VGAM1877 host target gene. AKAP11 BINDING SITE is HOST TARGET binding site found in the 3' untranslated region of mRNA encoded by AKAP11, corresponding to a HOST TARGET binding site such as BINDING SITE I, BINDING SITE II or BINDING SITE III. Table 2 illustrates the complementarity of the nucleotide sequences of AKAP11 BINDING SITE, designated SEQ ID:18372, to the nucleotide sequence of VGAM1877 RNA, herein designated VGAM RNA, also designated SEQ ID:4588.

A function of VGAM1877 is therefore inhibition of A Kinase (PRKA) Anchor Protein 11 (AKAP11, Accession NM_016248). Accordingly, utilities of VGAM1877 include diagnosis, prevention and treatment of diseases and clinical conditions associated with AKAP11. CG012 (Accession XM_096710) is another VGAM1877 host target gene. CG012 BINDING SITE is HOST TARGET binding site found in the 3' untranslated region of mRNA encoded by CG012, corresponding to a HOST TARGET binding site such as BINDING SITE I, BINDING SITE II or BINDING SITE III. Table 2 illustrates the complementarity of the nucleotide sequences of CG012 BINDING SITE, designated SEQ ID:40490, to the nucleotide sequence of VGAM1877 RNA, herein designated VGAM RNA, also designated SEQ ID:4588.

Another function of VGAM1877 is therefore inhibition of CG012 (Accession XM_096710). Accordingly, utilities of VGAM1877 include diagnosis, prevention and treatment of diseases and clinical conditions associated with CG012. KIAA0565 (Accession XM_039912) is another VGAM1877 host target gene. KIAA0565 BINDING SITE is HOST TARGET binding site found in the 3' untranslated region of mRNA encoded by KIAA0565, corresponding to a HOST TARGET binding site such as BINDING SITE I, BINDING SITE II or BINDING SITE III. Table 2 illustrates the complementarity of the nucleotide sequences of KIAA0565 BINDING SITE, designated SEQ ID:33222, to the nucleotide sequence of VGAM1877 RNA, herein designated VGAM RNA, also designated SEQ ID:4588.

Another function of VGAM1877 is therefore inhibition of KIAA0565 (Accession XM_039912). Accordingly, utilities of VGAM1877 include diagnosis, prevention and treatment of diseases and clinical conditions associated with KIAA0565. Methionyl Aminopeptidase 1 (METAP1, Accession XM_052334) is another VGAM1877 host target gene. METAP1 BINDING SITE is HOST TARGET binding site found in the 3' untranslated region of mRNA encoded by METAP1, corresponding to a HOST TARGET binding site such as BINDING SITE I, BINDING SITE II or BINDING SITE III. Table 2 illustrates the complementarity of the nucleotide sequences of METAP1 BINDING SITE, designated SEQ ID:35959, to the nucleotide sequence of VGAM1877 RNA, herein designated VGAM RNA, also designated SEQ ID:4588.

Another function of VGAM1877 is therefore inhibition of Methionyl Aminopeptidase 1 (METAP1, Accession XM_052334). Accordingly, utilities of VGAM1877 include diagnosis, prevention and treatment of diseases and clinical conditions associated with METAP1. PTD002 (Accession NM_016144) is another VGAM1877 host target gene. PTD002 BINDING SITE is HOST TARGET binding site found in the 3' untranslated region of mRNA encoded by PTD002, corresponding to a HOST TARGET binding site such as BINDING SITE I, BINDING SITE II or BINDING SITE III. Table 2 illustrates the complementarity of the nucleotide sequences of PTD002 BINDING SITE, designated SEQ ID:18228, to the nucleotide sequence of VGAM1877 RNA, herein designated VGAM RNA, also designated SEQ ID:4588.

Another function of VGAM1877 is therefore inhibition of PTD002 (Accession NM_016144). Accordingly, utilities of VGAM1877 include diagnosis, prevention and treatment of diseases and clinical conditions associated with PTD002. RAB40A, Member RAS Oncogene Family (RAB40A, Accession XM_088733) is another VGAM1877 host target gene. RAB40A BINDING SITE is HOST TARGET binding site found in the 5' untranslated region of mRNA encoded by RAB40A, corresponding to a HOST TARGET binding site such as BINDING SITE I, BINDING SITE II or BINDING SITE III. Table 2 illustrates the complementarity of the nucleotide sequences of RAB40A BINDING SITE, designated SEQ ID:39928, to the nucleotide sequence of VGAM1877 RNA, herein designated VGAM RNA, also designated SEQ ID:4588.

Another function of VGAM1877 is therefore inhibition of RAB40A, Member RAS Oncogene Family (RAB40A, Accession XM_088733). Accordingly, utilities of VGAM1877 include diagnosis, prevention and treatment of diseases and clinical conditions associated with RAB40A. LOC146723 (Accession XM_085565) is another VGAM1877 host target gene. LOC146723 BINDING SITE is HOST TARGET binding site found in the 3' untranslated region of mRNA encoded by LOC146723, corresponding to a HOST TARGET binding site such as BINDING SITE I, BINDING SITE II or BINDING SITE III. Table 2 illustrates the complementarity of the nucleotide sequences of LOC146723 BINDING SITE, designated SEQ ID:38228, to the nucleotide sequence of VGAM1877 RNA, herein designated VGAM RNA, also designated SEQ ID:4588.

Another function of VGAM1877 is therefore inhibition of LOC146723 (Accession XM_085565). Accordingly, utilities of VGAM1877 include diagnosis, prevention and treatment of diseases and clinical conditions associated with LOC146723. LOC147341 (Accession XM_097223) is another VGAM1877 host target gene. LOC147341 BINDING SITE is HOST TARGET binding site found in the 3' untranslated region of mRNA encoded by LOC147341, corresponding to a HOST TARGET binding site such as BINDING SITE I, BINDING SITE II or BINDING SITE III. Table 2 illustrates the complementarity of the nucleotide sequences of LOC147341 BINDING SITE, designated SEQ ID:40826, to the nucleotide sequence of VGAM1877 RNA, herein designated VGAM RNA, also designated SEQ ID:4588.

Another function of VGAM1877 is therefore inhibition of LOC147341 (Accession XM_097223). Accordingly, utilities of VGAM1877 include diagnosis, prevention and treatment of diseases and clinical conditions associated with LOC147341. LOC196528 (Accession XM_113745) is another VGAM1877 host target gene. LOC196528 BINDING SITE is HOST TARGET binding site found in the 3' untranslated region of mRNA encoded by LOC196528, corresponding to a HOST TARGET binding site such as BINDING SITE I, BINDING SITE II or BINDING SITE III. Table 2 illustrates the complementarity of the nucleotide sequences of LOC196528 BINDING SITE, designated SEQ ID:42408, to the nucleotide sequence of VGAM1877 RNA, herein designated VGAM RNA, also designated SEQ ID:4588.

Another function of VGAM1877 is therefore inhibition of LOC196528 (Accession XM_113745). Accordingly, utilities of VGAM1877 include diagnosis, prevention and treatment of diseases and clinical conditions associated with LOC196528. LOC203276 (Accession XM_117523) is another VGAM1877 host target gene. LOC203276 BINDING SITE is HOST TARGET binding site found in the 3' untranslated region of mRNA encoded by LOC203276, corresponding to a HOST TARGET binding site such as BINDING SITE I, BINDING SITE II or BINDING SITE III. Table 2 illustrates the complementarity of the nucleotide sequences of LOC203276 BINDING SITE, designated SEQ ID:43491, to the nucleotide sequence of VGAM1877 RNA, herein designated VGAM RNA, also designated SEQ ID:4588.

Another function of VGAM1877 is therefore inhibition of LOC203276 (Accession XM_117523). Accordingly, utilities of VGAM1877 include diagnosis, prevention and treatment of diseases and clinical conditions associated with LOC203276. LOC203305 (Accession XM_117529) is another VGAM1877 host target gene. LOC203305 BINDING SITE is HOST TARGET binding site found in the 3' untranslated region of mRNA encoded by LOC203305, corresponding to a HOST TARGET binding site such as BINDING SITE I, BINDING SITE II or BINDING SITE III. Table 2 illustrates the complementarity of the nucleotide sequences of LOC203305 BINDING SITE, designated SEQ ID:43515, to the nucleotide sequence of VGAM1877 RNA, herein designated VGAM RNA, also designated SEQ ID:4588.

Another function of VGAM1877 is therefore inhibition of LOC203305 (Accession XM_117529). Accordingly, utilities of VGAM1877 include diagnosis, prevention and treatment of diseases and clinical conditions associated with LOC203305. LOC221662 (Accession XM_166466) is another VGAM1877 host target gene. LOC221662 BINDING SITE is HOST TARGET binding site found in the 3' untranslated region of mRNA encoded by LOC221662, corresponding to a HOST TARGET binding site such as BINDING SITE I, BINDING SITE II or BINDING SITE III. Table 2 illustrates the complementarity of the nucleotide sequences of LOC221662 BINDING SITE, designated SEQ ID:44391, to the nucleotide sequence of VGAM1877 RNA, herein designated VGAM RNA, also designated SEQ ID:4588.

Another function of VGAM1877 is therefore inhibition of LOC221662 (Accession XM_166466). Accordingly, utilities of VGAM1877 include diagnosis, prevention and treatment of diseases and clinical conditions associated with LOC221662. LOC254243 (Accession XM_173233) is another VGAM1877 host target gene. LOC254243 BINDING SITE is HOST TARGET binding site found in the 3' untranslated region of mRNA encoded by LOC254243, corresponding to a HOST TARGET binding site such as BINDING SITE I, BINDING SITE II or BINDING SITE III. Table 2 illustrates the complementarity of the nucleotide sequences of LOC254243 BINDING SITE, designated SEQ ID:46517, to the nucleotide sequence of VGAM1877 RNA, herein designated VGAM RNA, also designated SEQ ID:4588.

Another function of VGAM1877 is therefore inhibition of LOC254243 (Accession XM_173233). Accordingly, utilities of VGAM1877 include diagnosis, prevention and treatment of diseases and clinical conditions associated with LOC254243. LOC90038 (Accession XM_028305) is another VGAM1877 host target gene. LOC90038 BINDING SITE is HOST TARGET binding site found in the 3' untranslated region of mRNA encoded by LOC90038, corresponding to a HOST TARGET binding site such as BINDING SITE I, BINDING SITE II or BINDING SITE III. Table 2 illustrates the complementarity of the nucleotide sequences of LOC90038 BINDING SITE, designated SEQ ID:30654, to the nucleotide sequence of VGAM1877 RNA, herein designated VGAM RNA, also designated SEQ ID:4588.

Another function of VGAM1877 is therefore inhibition of LOC90038 (Accession XM_028305). Accordingly, utilities of VGAM1877 include diagnosis, prevention and treatment of diseases and clinical conditions associated with LOC90038. FIG. 1 further provides a conceptual description of a novel bioinformatically detected viral gene of the present invention, referred to here as Viral Genomic Address Messenger 1878 (VGAM1878) viral gene, which modulates expression of respective host target genes thereof, the function and utility of which host target genes is known in the art.

VGAM1878 is a novel bioinformatically detected regulatory, non protein coding, viral micro RNA (miRNA) gene. The method by which VGAM1878 was detected is described hereinabove with reference to FIGS. 1-8.

VGAM1878 gene, herein designated VGAM GENE, is a viral gene contained in the genome of Bovine Respiratory Syncytial Virus. VGAM1878 host target gene, herein designated VGAM HOST TARGET GENE, is a human gene contained in the human genome.

VGAM1878 gene encodes a VGAM1878 precursor RNA, herein designated VGAM PRECURSOR RNA. Similar to other miRNA genes, and unlike most ordinary genes, VGAM1878 precursor RNA does not encode a protein. A nucleotide sequence identical or highly similar to the nucleotide sequence of VGAM1878 precursor RNA is designated SEQ ID:1864, and is provided hereinbelow with reference to the sequence listing part. Nucleotide sequence SEQ ID:1864 is located at position 7295 relative to the genome of Bovine Respiratory Syncytial Virus.

VGAM1878 precursor RNA folds onto itself, forming VGAM1878 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1878 folded precursor RNA into VGAM1878 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM1878 RNA is designated SEQ ID:4589, and is provided hereinbelow with reference to the sequence listing part.

VGAM1878 host target gene, herein designated VGAM HOST TARGET GENE, encodes a corresponding messenger RNA, VGAM1878 host target RNA, herein designated VGAM HOST TARGET RNA. VGAM1878 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1878 RNA, herein designated VGAM RNA, binds complementarily to one or more host target binding sites located in untranslated regions of VGAM1878 host target RNA, herein designated VGAM HOST TARGET RNA. This complementary binding is due to the fact that the nucleotide sequence of VGAM1878 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1878 RNA, herein designated VGAM RNA, may have a different number of host target binding sites in untranslated regions of a VGAM1878 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1878 RNA, herein designated VGAM RNA, to host target binding sites on VGAM1878 host target RNA, herein designated VGAM HOST TARGET RNA, such as BINDING SITE I, BINDING SITE II and BINDING SITE III, inhibits translation of VGAM1878 host target RNA into VGAM1878 host target protein, herein designated VGAM HOST TARGET PROTEIN. VGAM host target protein is therefore outlined by a broken line.

It is appreciated that VGAM1878 host target gene, herein designated VGAM HOST TARGET GENE, in fact represents a plurality of VGAM1878 host target genes. The mRNA of each one of this plurality of VGAM1878 host target genes comprises one or more host target binding sites, each having a nucleotide sequence which is at least partly complementary to VGAM1878 RNA, herein designated VGAM RNA, and which when bound by VGAM1878 RNA causes inhibition of translation of respective one or more VGAM1878 host target proteins.

It is further appreciated by one skilled in the art that the mode of translational inhibition illustrated by FIG. 1 with specific reference to translational inhibition exerted by VGAM1878 gene, herein designated VGAM GENE, on one or more VGAM1878 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1878 is inhibition of expression of host target genes, as part of a novel viral mechanism of attacking a host. Accordingly, utilities of VGAM1878 include diagnosis, prevention and treatment of viral infection by Bovine Respiratory Syncytial Virus. Specific functions, and accordingly utilities, of VGAM1878 correlate with, and may be deduced from, the identity of the host target genes which VGAM1878 binds and inhibits, and the function of these host target genes, as elaborated hereinbelow.

Nucleotide sequences of the VGAM1878 precursor RNA, herein designated VGAM PRECURSOR RNA, and of the 'diced' VGAM1878 RNA, herein designated VGAM RNA, and a schematic representation of the secondary folding of VGAM1878 folded precursor RNA, herein designated VGAM FOLDED PRECURSOR RNA, of VGAM1878 are further described hereinbelow with reference to Table 1.

Nucleotide sequences of host target binding sites, such as BINDING SITE-I, BINDING SITE-II and BINDING SITE-III of FIG. 1, found on VGAM1878 host target RNA, and schematic representation of the complementarity of each of these host target binding sites to VGAM1878 RNA, herein designated VGAM RNA, are described hereinbelow with reference to Table 2.

As mentioned hereinabove with reference to FIG. 1, a function of VGAM1878 gene, herein designated VGAM is inhibition of expression of VGAM1878 target genes. It is appreciated that specific functions, and accordingly utilities, of VGAM1878 correlate with, and may be deduced from, the identity of the target genes which VGAM1878 binds and inhibits, and the function of these target genes, as elaborated hereinbelow.

DKFZp434J1015 (Accession XM_166538) is a VGAM1878 host target gene. DKFZp434J1015 BINDING SITE is HOST TARGET binding site found in the 3' untranslated region of mRNA encoded by DKFZp434J1015, corresponding to a HOST TARGET binding site such as BINDING SITE I, BINDING SITE II or BINDING SITE III. Table 2 illustrates the complementarity of the nucleotide sequences of DKFZp434J1015 BINDING SITE, designated SEQ ID:44505, to the nucleotide sequence of VGAM1878 RNA, herein designated VGAM RNA, also designated SEQ ID:4589.

A function of VGAM1878 is therefore inhibition of DKFZp434J1015 (Accession XM_166538). Accordingly, utilities of VGAM1878 include diagnosis, prevention and treatment of diseases and clinical conditions associated with DKFZp434J1015. Formin Homology 2 Domain Containing 2 (FHOD2, Accession XM_057927) is another VGAM1878 host target gene. FHOD2 BINDING SITE is HOST TARGET binding site found in the 5' untranslated region of mRNA encoded by FHOD2, corresponding to a HOST TARGET binding site such as BINDING SITE I, BINDING SITE II or BINDING SITE III. Table 2 illustrates the complementarity of the nucleotide sequences of FHOD2 BINDING SITE, designated SEQ ID:36554, to the nucleotide sequence of VGAM1878 RNA, herein designated VGAM RNA, also designated SEQ ID:4589.

Another function of VGAM1878 is therefore inhibition of Formin Homology 2 Domain Containing 2 (FHOD2, Accession XM_057927). Accordingly, utilities of VGAM1878 include diagnosis, prevention and treatment of diseases and clinical conditions associated with FHOD2. FLJ32784 (Accession NM_144623) is another VGAM1878 host target gene. FLJ32784 BINDING SITE is HOST TARGET binding site found in the 3' untranslated region of mRNA encoded by FLJ32784, corresponding to a HOST TARGET binding site such as BINDING SITE I, BINDING SITE II or BINDING SITE III. Table 2 illustrates the complementarity of the nucleotide sequences of FLJ32784 BINDING SITE, designated SEQ ID:29441, to the nucleotide sequence of VGAM1878 RNA, herein designated VGAM RNA, also designated SEQ ID:4589.

Another function of VGAM1878 is therefore inhibition of FLJ32784 (Accession NM_144623). Accordingly, utilities of VGAM1878 include diagnosis, prevention and treatment of diseases and clinical conditions associated with FLJ32784. LOC146520 (Accession XM_085492) is another VGAM1878 host target gene. LOC146520 BINDING SITE is HOST TARGET binding site found in the 5' untranslated region of mRNA encoded by LOC146520, corresponding to a HOST TARGET binding site such as BINDING SITE I, BINDING SITE II or BINDING SITE III. Table 2 illustrates the complementarity of the nucleotide sequences of LOC146520 BINDING SITE, designated SEQ ID:38184, to the nucleotide sequence of VGAM1878 RNA, herein designated VGAM RNA, also designated SEQ ID:4589.

Another function of VGAM1878 is therefore inhibition of LOC146520 (Accession XM_085492). Accordingly, utilities of VGAM1878 include diagnosis, prevention and treatment of diseases and clinical conditions associated with LOC146520. LOC149711 (Accession XM_097720) is another VGAM1878 host target gene. LOC149711 BINDING SITE is HOST TARGET binding site found in the 3' untranslated region of mRNA encoded by LOC149711, corresponding to a HOST TARGET binding site such as BINDING SITE I, BINDING SITE II or BINDING SITE III. Table 2 illustrates the complementarity of the nucleotide sequences of LOC149711 BINDING SITE, designated SEQ ID:41073, to the nucleotide sequence of VGAM1878 RNA, herein designated VGAM RNA, also designated SEQ ID:4589.

Another function of VGAM1878 is therefore inhibition of LOC149711 (Accession XM_097720). Accordingly, utilities of VGAM1878 include diagnosis, prevention and treatment of diseases and clinical conditions associated with LOC149711. LOC150113 (Accession XM_104532) is another VGAM1878 host target gene. LOC150113 BINDING SITE is HOST TARGET binding site found in the 5' untranslated region of mRNA encoded by LOC150113, corresponding to a HOST TARGET binding site such as BINDING SITE I, BINDING SITE II or BINDING SITE III. Table 2 illustrates the complementarity of the nucleotide sequences of LOC150113 BINDING SITE, designated SEQ ID:42170, to the nucleotide sequence of VGAM1878 RNA, herein designated VGAM RNA, also designated SEQ ID:4589.

Another function of VGAM1878 is therefore inhibition of LOC150113 (Accession XM_104532). Accordingly, utilities of VGAM1878 include diagnosis, prevention and treatment of diseases and clinical conditions associated with LOC150113. LOC90288 (Accession XM_030669) is another VGAM1878 host target gene. LOC90288 BINDING SITE is HOST TARGET binding site found in the 3' untranslated region of mRNA encoded by LOC90288, corresponding to a HOST TARGET binding site such as BINDING SITE I, BINDING SITE II or BINDING SITE III. Table 2 illustrates the complementarity of the nucleotide sequences of LOC90288 BINDING SITE, designated SEQ ID:31115, to the nucleotide sequence of VGAM1878 RNA, herein designated VGAM RNA, also designated SEQ ID:4589.

Another function of VGAM1878 is therefore inhibition of LOC90288 (Accession XM_030669). Accordingly, utilities of VGAM1878 include diagnosis, prevention and treatment of diseases and clinical conditions associated with LOC90288. FIG. 1 further provides a conceptual description of a novel bioinformatically detected viral gene of the present invention, referred to here as Viral Genomic Address Messenger 1879 (VGAM1879) viral gene, which modulates expression of respective host target genes thereof, the function and utility of which host target genes is known in the art.

VGAM1879 is a novel bioinformatically detected regulatory, non protein coding, viral micro RNA (miRNA) gene. The method by which VGAM1879 was detected is described hereinabove with reference to FIGS. 1-8.

VGAM1879 gene, herein designated VGAM GENE, is a viral gene contained in the genome of Bovine Respiratory Syncytial Virus. VGAM1879 host target gene, herein designated VGAM HOST TARGET GENE, is a human gene contained in the human genome.

VGAM1879 gene encodes a VGAM1879 precursor RNA, herein designated VGAM PRECURSOR RNA. Similar to other miRNA genes, and unlike most ordinary genes, VGAM1879 precursor RNA does not encode a protein. A nucleotide sequence identical or highly similar to the nucleotide sequence of VGAM1879 precursor RNA is designated SEQ ID:1865, and is provided hereinbelow with reference to the sequence listing part. Nucleotide sequence SEQ ID:1865 is located at position 5455 relative to the genome of Bovine Respiratory Syncytial Virus.

VGAM1879 precursor RNA folds onto itself, forming VGAM1879 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1879 folded precursor RNA into VGAM1879 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM1879 RNA is designated SEQ ID:4590, and is provided hereinbelow with reference to the sequence listing part.

VGAM1879 host target gene, herein designated VGAM HOST TARGET GENE, encodes a corresponding messenger RNA, VGAM1879 host target RNA, herein designated VGAM HOST TARGET RNA. VGAM1879 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1879 RNA, herein designated VGAM RNA, binds complementarily to one or more host target binding sites located in untranslated regions of VGAM1879 host target RNA, herein designated VGAM HOST TARGET RNA. This complementary binding is due to the fact that the nucleotide sequence of VGAM1879 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1879 RNA, herein designated VGAM RNA, may have a different number of host target binding sites in untranslated regions of a VGAM1879 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1879 RNA, herein designated VGAM RNA, to host target binding sites on VGAM1879 host target RNA, herein designated VGAM HOST TARGET RNA, such as BINDING SITE I, BINDING SITE II and BINDING SITE III, inhibits translation of VGAM1879 host target RNA into VGAM1879 host target protein, herein designated VGAM HOST TARGET PROTEIN. VGAM host target protein is therefore outlined by a broken line.

It is appreciated that VGAM1879 host target gene, herein designated VGAM HOST TARGET GENE, in fact represents a plurality of VGAM1879 host target genes. The mRNA of each one of this plurality of VGAM1879 host target genes comprises one or more host target binding sites, each having a nucleotide sequence which is at least partly complementary to VGAM1879 RNA, herein designated VGAM RNA, and which when bound by VGAM1879 RNA causes inhibition of translation of respective one or more VGAM1879 host target proteins.

It is further appreciated by one skilled in the art that the mode of translational inhibition illustrated by FIG. 1 with specific reference to translational inhibition exerted by VGAM1879 gene, herein designated VGAM GENE, on one or more VGAM1879 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1879 is inhibition of expression of host target genes, as part of a novel viral mechanism of attacking a host. Accordingly, utilities of VGAM1879 include diagnosis, prevention and treatment of viral infection by Bovine Respiratory Syncytial Virus. Specific functions, and accordingly utilities of VGAM1879 correlate with, and may be deduced from, the identity of the host target genes which VGAM1879 binds and inhibits, and the function of these host target genes, as elaborated hereinbelow.

Nucleotide sequences of the VGAM1879 precursor RNA, herein designated VGAM PRECURSOR RNA, and of the 'diced' VGAM1879 RNA, herein designated VGAM RNA, and a schematic representation of the secondary folding of VGAM1879 folded precursor RNA, herein designated VGAM FOLDED PRECURSOR RNA, of VGAM1879 are further described hereinbelow with reference to Table 1.

Nucleotide sequences of host target binding sites, such as BINDING SITE-I, BINDING SITE-II and BINDING SITE-III of FIG. 1, found on VGAM1879 host target RNA, and schematic representation of the complementarity of each of these host target binding sites to VGAM1879 RNA, herein designated VGAM RNA, are described hereinbelow with reference to Table 2.

As mentioned hereinabove with reference to FIG. 1, a function of VGAM1879 gene, herein designated VGAM is inhibition of expression of VGAM1879 target genes. It is appreciated that specific functions, and accordingly utilities, of VGAM1879 correlate with, and may be deduced from, the identity of the target genes which VGAM1879 binds and inhibits, and the function of these target genes, as elaborated hereinbelow.

Proteasome (prosome, macropain) 26S Subunit, Non-ATPase, 12 (PSMD12, Accession NM_002816) is a VGAM1879 host target gene. PSMD12 BINDING SITE is HOST TARGET binding site found in the 3' untranslated region of mRNA encoded by PSMD12, corresponding to a HOST TARGET binding site such as BINDING SITE I, BINDING SITE II or BINDING SITE III. Table 2 illustrates the complementarity of the nucleotide sequences of PSMD12 BINDING SITE, designated SEQ ID:8682, to the nucleotide sequence of VGAM1879 RNA, herein designated VGAM RNA, also designated SEQ ID:4590.

A function of VGAM1879 is therefore inhibition of Proteasome (prosome, macropain) 26S Subunit, Non-ATPase, 12 (PSMD12, Accession NM_002816). Accordingly, utilities of VGAM1879 include diagnosis, prevention and treatment of diseases and clinical conditions associated with PSMD12. FIG. 1 further provides a conceptual description of a novel bioinformatically detected viral gene of the present invention, referred to here as Viral Genomic Address Messenger 1880 (VGAM1880) viral gene, which modulates expression of respective host target genes thereof, the function and utility of which host target genes is known in the art.

VGAM1880 is a novel bioinformatically detected regulatory, non protein coding, viral micro RNA (miRNA) gene. The method by which VGAM1880 was detected is described hereinabove with reference to FIGS. 1-8.

VGAM1880 gene, herein designated VGAM GENE, is a viral gene contained in the genome of Bovine Respiratory Syncytial Virus. VGAM1880 host target gene, herein designated VGAM HOST TARGET GENE, is a human gene contained in the human genome.

VGAM1880 gene encodes a VGAM1880 precursor RNA, herein designated VGAM PRECURSOR RNA. Similar to other miRNA genes, and unlike most ordinary genes, VGAM1880 precursor RNA does not encode a protein. A nucleotide sequence identical or highly similar to the nucleotide sequence of VGAM1880 precursor RNA is designated SEQ ID:1866, and is provided hereinbelow with reference to the sequence listing part. Nucleotide sequence SEQ ID:1866 is located at position 14933 relative to the genome of Bovine Respiratory Syncytial Virus.

VGAM1880 precursor RNA folds onto itself, forming VGAM1880 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1880 folded precursor RNA into VGAM1880 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1880 RNA is designated SEQ ID:4591, and is provided hereinbelow with reference to the sequence listing part.

VGAM1880 host target gene, herein designated VGAM HOST TARGET GENE, encodes a corresponding messenger RNA, VGAM1880 host target RNA, herein designated VGAM HOST TARGET RNA. VGAM1880 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1880 RNA, herein designated VGAM RNA, binds complementarily to one or more host target binding sites located in untranslated regions of VGAM1880 host target RNA, herein designated VGAM HOST TARGET RNA. This complementary binding is due to the fact that the nucleotide sequence of VGAM1880 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1880 RNA, herein designated VGAM RNA, may have a different number of host target binding sites in untranslated regions of a VGAM1880 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1880 RNA, herein designated VGAM RNA, to host target binding sites on VGAM1880 host target RNA, herein designated VGAM HOST TARGET RNA, such as BINDING SITE I, BINDING SITE II and BINDING SITE III, inhibits translation of VGAM1880 host target RNA into VGAM1880 host target protein, herein designated VGAM HOST TARGET PROTEIN. VGAM host target protein is therefore outlined by a broken line.

It is appreciated that VGAM1880 host target gene, herein designated VGAM HOST TARGET GENE, in fact represents a plurality of VGAM1880 host target genes. The mRNA of each one of this plurality of VGAM1880 host target genes comprises one or more host target binding sites, each having a nucleotide sequence which is at least partly complementary to VGAM1880 RNA, herein designated VGAM RNA, and which when bound by VGAM1880 RNA causes inhibition of translation of respective one or more VGAM1880 host target proteins.

It is further appreciated by one skilled in the art that the mode of translational inhibition illustrated by FIG. 1 with specific reference to translational inhibition exerted by VGAM1880 gene, herein designated VGAM GENE, on one or more VGAM1880 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1880 is inhibition of expression of host target genes, as part of a novel viral mechanism of attacking a host. Accordingly, utilities of VGAM1880 include diagnosis, prevention and treatment of viral infection by Bovine Respiratory Syncytial Virus. Specific functions, and accordingly utilities, of VGAM1880 correlate with, and may be deduced from, the identity of the host target genes which VGAM1880 binds and inhibits, and the function of these host target genes, as elaborated hereinbelow.

Nucleotide sequences of the VGAM1880 precursor RNA, herein designated VGAM PRECURSOR RNA, and of the 'diced' VGAM1880 RNA, herein designated VGAM RNA, and a schematic representation of the secondary folding of VGAM1880 folded precursor RNA, herein designated VGAM FOLDED PRECURSOR RNA, of VGAM1880 are further described hereinbelow with reference to Table 1.

Nucleotide sequences of host target binding sites, such as BINDING SITE-I, BINDING SITE-II and BINDING SITE-III of FIG. 1, found on VGAM1880 host target RNA, and schematic representation of the complementarity of each of these host target binding sites to VGAM1880 RNA, herein designated VGAM RNA, are described hereinbelow with reference to Table 2.

As mentioned hereinabove with reference to FIG. 1, a function of VGAM1880 gene, herein designated VGAM is inhibition of expression of VGAM1880 target genes. It is appreciated that specific functions, and accordingly utilities, of VGAM1880 correlate with, and may be deduced from, the identity of the target genes which VGAM1880 binds and inhibits, and the function of these target genes, as elaborated hereinbelow.

Cytochrome P450, Subfamily I (aromatic compound-inducible), Polypeptide 1 (CYP1A1, Accession NM_000499) is a VGAM1880 host target gene. CYP1A1 BINDING SITE is HOST TARGET binding site found in the 3' untranslated region of mRNA encoded by CYP1A1, corresponding to a HOST TARGET binding site such as BINDING SITE I, BINDING SITE II or BINDING SITE III. Table 2 illustrates the complementarity of the nucleotide sequences of CYP1A1 BINDING SITE, designated SEQ ID:6113, to the nucleotide sequence of VGAM1880 RNA, herein designated VGAM RNA, also designated SEQ ID:4591.

A function of VGAM1880 is therefore inhibition of Cytochrome P450, Subfamily I (aromatic compound-inducible), Polypeptide 1 (CYP1A1, Accession NM_000499), a gene which intervenes in an NADPH-dependent electron transport pathway. Accordingly, utilities of VGAM1880 include diagnosis, prevention and treatment of diseases and clinical conditions associated with CYP1A1. The function of CYP1A1 and its association with various diseases and clinical conditions, has been established by previous studies, as described hereinabove with reference to VGAM335. FLJ10781 (Accession NM_018215) is another VGAM1880 host target gene. FLJ10781 BINDING SITE is HOST TARGET binding site found in the 3' untranslated region of mRNA encoded by FLJ10781, corresponding to a HOST TARGET binding site such as BINDING SITE I, BINDING SITE II or BINDING SITE III. Table 2 illustrates the complementarity of the nucleotide sequences of FLJ10781 BINDING SITE, designated SEQ ID:20132, to the nucleotide sequence of VGAM1880 RNA, herein designated VGAM RNA, also designated SEQ ID:4591.

Another function of VGAM1880 is therefore inhibition of FLJ10781 (Accession NM_018215). Accordingly, utilities of VGAM1880 include diagnosis, prevention and treatment of diseases and clinical conditions associated with FLJ10781. LOC51580 (Accession NM_015874) is another VGAM1880 host target gene. LOC51580 BINDING SITE is HOST TARGET binding site found in the 3' untranslated region of mRNA encoded by LOC51580, corresponding to a HOST TARGET binding site such as BINDING SITE I, BINDING SITE II or BINDING SITE III. Table 2 illustrates the complementarity of the nucleotide sequences of LOC51580 BIND- ING SITE, designated SEQ ID:18013, to the nucleotide sequence of VGAM1880 RNA, herein designated VGAM RNA, also designated SEQ ID:4591.

Another function of VGAM1880 is therefore inhibition of LOC51580 (Accession NM_015874). Accordingly, utilities of VGAM1880 include diagnosis, prevention and treatment of diseases and clinical conditions associated with LOC51580. FIG. 1 further provides a conceptual description of a novel bioinformatically detected viral gene of the present invention, referred to here as Viral Genomic Address Messenger 1881 (VGAM1881) viral gene, which modulates expression of respective host target genes thereof, the function and utility of which host target genes is known in the art.

VGAM1881 is a novel bioinformatically detected regulatory, non protein coding, viral micro RNA (miRNA) gene. The method by which VGAM1881 was detected is described hereinabove with reference to FIGS. 1-8.

VGAM1881 gene, herein designated VGAM GENE, is a viral gene contained in the genome of Bovine Respiratory Syncytial Virus. VGAM1881 host target gene, herein designated VGAM HOST TARGET GENE, is a human gene contained in the human genome.

VGAM1881 gene encodes a VGAM1881 precursor RNA, herein designated VGAM PRECURSOR RNA. Similar to other miRNA genes, and unlike most ordinary genes, VGAM1881 precursor RNA does not encode a protein. A nucleotide sequence identical or highly similar to the nucleotide sequence of VGAM1881 precursor RNA is designated SEQ ID:1867, and is provided hereinbelow with reference to the sequence listing part. Nucleotide sequence SEQ ID:1867 is located at position 7527 relative to the genome of Bovine Respiratory Syncytial Virus.

VGAM1881 precursor RNA folds onto itself, forming VGAM1881 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1881 folded precursor RNA into VGAM1881 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1881 RNA is designated SEQ ID:4592, and is provided hereinbelow with reference to the sequence listing part.

VGAM1881 host target gene, herein designated VGAM HOST TARGET GENE, encodes a corresponding messenger RNA, VGAM1881 host target RNA, herein designated VGAM HOST TARGET RNA. VGAM1881 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1881 RNA, herein designated VGAM RNA, binds complementarily to one or more host target binding sites located in untranslated regions of VGAM1881 host target RNA, herein designated VGAM HOST TARGET RNA. This complementary binding is due to the fact that the nucleotide sequence of VGAM1881 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1881 RNA, herein designated VGAM RNA, may have a different number of host target binding sites in untranslated regions of a VGAM1881 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1881 RNA, herein designated VGAM RNA, to host target binding sites on VGAM1881 host target RNA, herein designated VGAM HOST TARGET RNA, such as BINDING SITE I, BINDING SITE II and BINDING SITE III, inhibits translation of VGAM1881 host target RNA into VGAM1881 host target protein, herein designated VGAM HOST TARGET PROTEIN. VGAM host target protein is therefore outlined by a broken line.

It is appreciated that VGAM1881 host target gene, herein designated VGAM HOST TARGET GENE, in fact represents a plurality of VGAM1881 host target genes. The mRNA of each one of this plurality of VGAM1881 host target genes comprises one or more host target binding sites, each having a nucleotide sequence which is at least partly complementary to VGAM1881 RNA, herein designated VGAM RNA, and which when bound by VGAM1881 RNA causes inhibition of translation of respective one or more VGAM1881 host target proteins.

It is further appreciated by one skilled in the art that the mode of translational inhibition illustrated by FIG. 1 with specific reference to translational inhibition exerted by VGAM1881 gene, herein designated VGAM GENE, on one or more VGAM1881 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1881 is inhibition of expression of host target genes, as part of a novel viral mechanism of attacking a host. Accordingly, utilities of VGAM1881 include diagnosis, prevention and treatment of viral infection by Bovine Respiratory Syncytial Virus. Specific functions, and accordingly utilities, of VGAM1881 correlate with, and may be deduced from, the identity of the host target genes which VGAM1881 binds and inhibits, and the function of these host target genes, as elaborated hereinbelow.

Nucleotide sequences of the VGAM1881 precursor RNA, herein designated VGAM PRECURSOR RNA, and of the 'diced' VGAM1881 RNA, herein designated VGAM RNA, and a schematic representation of the secondary folding of VGAM1881 folded precursor RNA, herein designated VGAM FOLDED PRECURSOR RNA, of VGAM1881 are further described hereinbelow with reference to Table 1.

Nucleotide sequences of host target binding sites, such as BINDING SITE-I, BINDING SITE-II and BINDING SITE-III of FIG. 1, found on VGAM1881 host target RNA, and schematic representation of the complementarity of each of these host target binding sites to VGAM1881 RNA, herein designated VGAM RNA, are described hereinbelow with reference to Table 2.

As mentioned hereinabove with reference to FIG. 1, a function of VGAM1881 gene, herein designated VGAM is inhibition of expression of VGAM1881 target genes. It is appreciated that specific functions, and accordingly utilities, of VGAM1881 correlate with, and may be deduced from, the identity of the target genes which VGAM1881 binds and inhibits, and the function of these target genes, as elaborated hereinbelow.

Hepatic Leukemia Factor (HLF, Accession NM_002126) is a VGAM1881 host target gene. HLF BINDING SITE1 and HLF BINDING SITE2 are HOST TARGET binding sites found in untranslated regions of mRNA encoded by HLF, corresponding to HOST TARGET binding sites such as BINDING SITE I, BINDING SITE II or BINDING SITE III. Table 2 illustrates the complementarity of the nucleotide sequences of HLF BINDING SITE1 and HLF BINDING SITE2, designated SEQ ID:7900 and SEQ ID:7901 respectively, to the nucleotide sequence of VGAM1881 RNA, herein designated VGAM RNA, also designated SEQ ID:4592.

A function of VGAM1881 is therefore inhibition of Hepatic Leukemia Factor (HLF, Accession NM_002126). Accordingly, utilities of VGAM1881 include diagnosis, prevention and treatment of diseases and clinical conditions associated with HLF. KIAA0594 (Accession XM_036117) is another VGAM1881 host target gene. KIAA0594 BINDING SITE is HOST TARGET binding site found in the 3' untranslated region of mRNA encoded by KIAA0594, corresponding to a HOST TARGET binding site such as BINDING SITE I, BINDING SITE II or BINDING SITE III. Table 2 illustrates the complementarity of the nucleotide sequences of KIAA0594 BINDING SITE, designated SEQ ID:32389, to the nucleotide sequence of VGAM1881 RNA, herein designated VGAM RNA, also designated SEQ ID:4592.

Another function of VGAM1881 is therefore inhibition of KIAA0594 (Accession XM_036117). Accordingly, utilities of VGAM1881 include diagnosis, prevention and treatment of diseases and clinical conditions associated with KIAA0594. KIAA1040 (Accession XM_051091) is another VGAM1881 host target gene. KIAA1040 BINDING SITE is HOST TARGET binding site found in the 3' untranslated region of mRNA encoded by KIAA1040, corresponding to a HOST TARGET binding site such as BINDING SITE I, BINDING SITE II or BINDING SITE III. Table 2 illustrates the complementarity of the nucleotide sequences of KIAA1040 BINDING SITE, designated SEQ ID:35736, to the nucleotide sequence of VGAM1881 RNA, herein designated VGAM RNA, also designated SEQ ID:4592.

Another function of VGAM1881 is therefore inhibition of KIAA1040 (Accession XM_051091). Accordingly, utilities of VGAM1881 include diagnosis, prevention and treatment of diseases and clinical conditions associated with KIAA1040. FIG. 1 further provides a conceptual description of a novel bioinformatically detected viral gene of the present invention, referred to here as Viral Genomic Address Messenger 1882 (VGAM1882) viral gene, which modulates expression of respective host target genes thereof, the function and utility of which host target genes is known in the art.

VGAM1882 is a novel bioinformatically detected regulatory, non protein coding, viral micro RNA (miRNA) gene. The method by which VGAM1882 was detected is described hereinabove with reference to FIGS. 1-8.

VGAM1882 gene, herein designated VGAM GENE, is a viral gene contained in the genome of Bovine Respiratory Syncytial Virus. VGAM1882 host target gene, herein designated VGAM HOST TARGET GENE, is a human gene contained in the human genome.

VGAM1882 gene encodes a VGAM1882 precursor RNA, herein designated VGAM PRECURSOR RNA. Similar to other miRNA genes, and unlike most ordinary genes, VGAM1882 precursor RNA does not encode a protein. A nucleotide sequence identical or highly similar to the nucleotide sequence of VGAM1882 precursor RNA is designated SEQ ID:1868, and is provided hereinbelow with reference to the sequence listing part. Nucleotide sequence SEQ ID:1868 is located at position 417 relative to the genome of Bovine Respiratory Syncytial Virus.

VGAM1882 precursor RNA folds onto itself, forming VGAM1882 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1882 folded precursor RNA into VGAM1882 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1882 RNA is designated SEQ ID:4593, and is provided hereinbelow with reference to the sequence listing part.

VGAM1882 host target gene, herein designated VGAM HOST TARGET GENE, encodes a corresponding messenger RNA, VGAM1882 host target RNA, herein designated VGAM HOST TARGET RNA. VGAM1882 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1882 RNA, herein designated VGAM RNA, binds complementarily to one or more host target binding sites located in untranslated regions of VGAM1882 host target RNA, herein designated VGAM HOST TARGET RNA. This complementary binding is due to the fact that the nucleotide sequence of VGAM1882 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1882 RNA, herein designated VGAM RNA, may have a different number of host target binding sites in untranslated regions of a VGAM1882 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1882 RNA, herein designated VGAM RNA, to host target binding sites on VGAM1882 host target RNA, herein designated VGAM HOST TARGET RNA, such as BINDING SITE I, BINDING SITE II and BINDING SITE III, inhibits translation of VGAM1882 host target RNA into VGAM1882 host target protein, herein designated VGAM HOST TARGET PROTEIN. VGAM host target protein is therefore outlined by a broken line.

It is appreciated that VGAM1882 host target gene, herein designated VGAM HOST TARGET GENE, in fact represents a plurality of VGAM1882 host target genes. The mRNA of each one of this plurality of VGAM1882 host target genes comprises one or more host target binding sites, each having a nucleotide sequence which is at least partly complementary to VGAM1882 RNA, herein designated VGAM RNA, and which when bound by VGAM1882 RNA causes inhibition of translation of respective one or more VGAM1882 host target proteins.

It is further appreciated by one skilled in the art that the mode of translational inhibition illustrated by FIG. 1 with specific reference to translational inhibition exerted by VGAM1882 gene, herein designated VGAM GENE, on one or more VGAM1882 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1882 is inhibition of expression of host target genes, as part of a novel viral mechanism of attacking a host. Accordingly, utilities of VGAM1882 include diagnosis, prevention and treatment of viral infection by Bovine Respiratory Syncytial Virus. Specific functions, and accordingly utilities, of VGAM1882 correlate with, and may be deduced from, the identity of the host target genes which VGAM1882 binds and inhibits, and the function of these host target genes, as elaborated hereinbelow.

Nucleotide sequences of the VGAM1882 precursor RNA, herein designated VGAM PRECURSOR RNA, and of the 'diced' VGAM1882 RNA, herein designated VGAM RNA, and a schematic representation of the secondary folding of VGAM1882 folded precursor RNA, herein designated VGAM FOLDED PRECURSOR RNA, of VGAM1882 are further described hereinbelow with reference to Table 1.

Nucleotide sequences of host target binding sites, such as BINDING SITE-I, BINDING SITE-II and BINDING SITE-III of FIG. 1, found on VGAM1882 host target RNA, and schematic representation of the complementarity of each of these host target binding sites to VGAM1882 RNA, herein designated VGAM RNA, are described hereinbelow with reference to Table 2.

As mentioned hereinabove with reference to FIG. 1, a function of VGAM1882 gene, herein designated VGAM is inhibition of expression of VGAM1882 target genes. It is appreciated that specific functions, and accordingly utilities, of VGAM1882 correlate with, and may be deduced from, the identity of the target genes which VGAM1882 binds and inhibits, and the function of these target genes, as elaborated hereinbelow.

Caveolin 1, Caveolae Protein, 22 kDa (CAV1, Accession NM_001753) is a VGAM1882 host target gene. CAV1 BINDING SITE is HOST TARGET binding site found in the 3' untranslated region of mRNA encoded by CAV1, corresponding to a HOST TARGET binding site such as BINDING SITE I, BINDING SITE II or BINDING SITE III. Table 2 illustrates the complementarity of the nucleotide sequences of CAV1 BINDING SITE, designated SEQ ID:7490, to the nucleotide sequence of VGAM1882 RNA, herein designated VGAM RNA, also designated SEQ ID:4593.

A function of VGAM1882 is therefore inhibition of Caveolin 1, Caveolae Protein, 22 kDa (CAV1, Accession NM_001753), a gene which may act as a scaffolding protein within caveolar membranes, and interacts directly with g-protein alpha subunits and can functionally regulate their activity. Accordingly, utilities of VGAM1882 include diagnosis, prevention and treatment of diseases and clinical conditions associated with CAV1. The function of CAV1 and its association with various diseases and clinical conditions, has been established by previous studies, as described hereinabove with reference to VGAM331. FLJ30294 (Accession NM_144632) is another VGAM1882 host target gene. FLJ30294 BINDING SITE is HOST TARGET binding site found in the 3' untranslated region of mRNA encoded by FLJ30294, corresponding to a HOST TARGET binding site such as BINDING SITE I, BINDING SITE II or BINDING SITE III. Table 2 illustrates the complementarity of the nucleotide sequences of FLJ30294 BINDING SITE, designated SEQ ID:29452, to the nucleotide sequence of VGAM1882 RNA, herein designated VGAM RNA, also designated SEQ ID:4593.

Another function of VGAM1882 is therefore inhibition of FLJ30294 (Accession NM_144632). Accordingly, utilities of VGAM1882 include diagnosis, prevention and treatment of diseases and clinical conditions associated with FLJ30294. KIAA1571 (Accession XM_027744) is another VGAM1882 host target gene. KIAA1571 BINDING SITE is HOST TARGET binding site found in the 3' untranslated region of mRNA encoded by KIAA1571, corresponding to a HOST TARGET binding site such as BINDING SITE I, BINDING SITE II or BINDING SITE III. Table 2 illustrates the complementarity of the nucleotide sequences of KIAA1571 BINDING SITE, designated SEQ ID:30567, to the nucleotide sequence of VGAM1882 RNA, herein designated VGAM RNA, also designated SEQ ID:4593.

Another function of VGAM1882 is therefore inhibition of KIAA1571 (Accession XM_027744). Accordingly, utilities of VGAM1882 include diagnosis, prevention and treatment of diseases and clinical conditions associated with KIAA1571. LOC201965 (Accession XM_114412) is another VGAM1882 host target gene. LOC201965 BINDING SITE is HOST TARGET binding site found in the 3' untranslated region of mRNA encoded by LOC201965, corresponding to a HOST TARGET binding site such as BINDING SITE I, BINDING SITE II or BINDING SITE III. Table 2 illustrates the complementarity of the nucleotide sequences of LOC201965 BINDING SITE, designated SEQ ID:42931, to the nucleotide sequence of VGAM1882 RNA, herein designated VGAM RNA, also designated SEQ ID:4593.

Another function of VGAM1882 is therefore inhibition of LOC201965 (Accession XM_114412). Accordingly, utilities of VGAM1882 include diagnosis, prevention and treatment of diseases and clinical conditions associated with LOC201965. LOC257017 (Accession XM_173227) is another VGAM1882 host target gene. LOC257017 BINDING SITE is HOST TARGET binding site found in the 5' untranslated region of mRNA encoded by LOC257017, corresponding to a HOST TARGET binding site such as BINDING SITE I, BINDING SITE II or BINDING SITE III. Table 2 illustrates the complementarity of the nucleotide sequences of LOC257017 BINDING SITE, designated SEQ ID:46494, to the nucleotide sequence of VGAM1882 RNA, herein designated VGAM RNA, also designated SEQ ID:4593.

Another function of VGAM1882 is therefore inhibition of LOC257017 (Accession XM_173227). Accordingly, utilities of VGAM1882 include diagnosis, prevention and treatment of diseases and clinical conditions associated with LOC257017. FIG. 1 further provides a conceptual description of a novel bioinformatically detected viral gene of the present invention, referred to here as Viral Genomic Address Messenger 1883 (VGAM1883) viral gene, which modulates expression of respective host target genes thereof, the function and utility of which host target genes is known in the art.

VGAM1883 is a novel bioinformatically detected regulatory, non protein coding, viral micro RNA (miRNA) gene. The method by which VGAM1883 was detected is described hereinabove with reference to FIGS. 1-8.

VGAM1883 gene, herein designated VGAM GENE, is a viral gene contained in the genome of Bovine Respiratory Syncytial Virus. VGAM1883 host target gene, herein designated VGAM HOST TARGET GENE, is a human gene contained in the human genome.

VGAM1883 gene encodes a VGAM1883 precursor RNA, herein designated VGAM PRECURSOR RNA. Similar to other miRNA genes, and unlike most ordinary genes, VGAM1883 precursor RNA does not encode a protein. A nucleotide sequence identical or highly similar to the nucleotide sequence of VGAM1883 precursor RNA is designated SEQ ID:1869, and is provided hereinbelow with reference to the sequence listing part. Nucleotide sequence SEQ ID:1869 is located at position 10923 relative to the genome of Bovine Respiratory Syncytial Virus.

VGAM1883 precursor RNA folds onto itself, forming VGAM1883 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1883 folded precursor RNA into VGAM1883 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1883 RNA is designated SEQ ID:4594, and is provided hereinbelow with reference to the sequence listing part.

VGAM1883 host target gene, herein designated VGAM HOST TARGET GENE, encodes a corresponding messenger RNA, VGAM1883 host target RNA, herein designated VGAM HOST TARGET RNA. VGAM1883 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1883 RNA, herein designated VGAM RNA, binds complementarily to one or more host target binding sites located in untranslated regions of VGAM1883 host target RNA, herein designated VGAM HOST TARGET RNA. This complementary binding is due to the fact that the nucleotide sequence of VGAM1883 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1883 RNA, herein designated VGAM RNA, may have a different number of host target binding sites in untranslated regions of a VGAM1883 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1883 RNA, herein designated VGAM RNA, to host target binding sites on VGAM1883 host target RNA, herein designated VGAM HOST TARGET RNA, such as BINDING SITE I, BINDING SITE II and BINDING SITE III, inhibits translation of VGAM1883 host target RNA into VGAM1883 host target protein, herein designated VGAM HOST TARGET PROTEIN. VGAM host target protein is therefore outlined by a broken line.

It is appreciated that VGAM1883 host target gene, herein designated VGAM HOST TARGET GENE, in fact represents a plurality of VGAM1883 host target genes. The mRNA of each one of this plurality of VGAM1883 host target genes comprises one or more host target binding sites, each having a nucleotide sequence which is at least partly complementary to VGAM1883 RNA, herein designated VGAM RNA, and which when bound by VGAM1883 RNA causes inhibition of translation of respective one or more VGAM1883 host target proteins.

It is further appreciated by one skilled in the art that the mode of translational inhibition illustrated by FIG. 1 with specific reference to translational inhibition exerted by VGAM1883 gene, herein designated VGAM GENE, on one or more VGAM1883 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1883 is inhibition of expression of host target genes, as part of a novel viral mechanism of attacking a host. Accordingly, utilities of VGAM1883 include diagnosis, prevention and treatment of viral infection by Bovine Respiratory Syncytial Virus. Specific functions, and accordingly utilities, of VGAM1883 correlate with, and may be deduced from, the identity of the host target genes which VGAM1883 binds and inhibits, and the function of these host target genes, as elaborated hereinbelow.

Nucleotide sequences of the VGAM1883 precursor RNA, herein designated VGAM PRECURSOR RNA, and of the 'diced' VGAM1883 RNA, herein designated VGAM RNA, and a schematic representation of the secondary folding of VGAM1883 folded precursor RNA, herein designated VGAM FOLDED PRECURSOR RNA, of VGAM1883 are further described hereinbelow with reference to Table 1.

Nucleotide sequences of host target binding sites, such as BINDING SITE-I, BINDING SITE-II and BINDING SITE-III of FIG. 1, found on VGAM1883 host target RNA, and schematic representation of the complementarity of each of these host target binding sites to VGAM1883 RNA, herein designated VGAM RNA, are described hereinbelow with reference to Table 2.

As mentioned hereinabove with reference to FIG. 1, a function of VGAM1883 gene, herein designated VGAM is inhibition of expression of VGAM1883 target genes. It is appreciated that specific functions, and accordingly utilities, of VGAM1883 correlate with, and may be deduced from, the identity of the target genes which VGAM1883 binds and inhibits, and the function of these target genes, as elaborated hereinbelow.

Glutaminase (GLS, Accession NM_014905) is a VGAM1883 host target gene. GLS BINDING SITE is HOST TARGET binding site found in the 3' untranslated region of mRNA encoded by GLS, corresponding to a HOST TARGET binding site such as BINDING SITE I, BINDING SITE II or BINDING SITE III. Table 2 illustrates the complementarity of the nucleotide sequences of GLS BINDING SITE, designated SEQ ID:17109, to the nucleotide sequence of VGAM1883 RNA, herein designated VGAM RNA, also designated SEQ ID:4594.

A function of VGAM1883 is therefore inhibition of Glutaminase (GLS, Accession NM_014905). Accordingly, utilities of VGAM1883 include diagnosis, prevention and treatment of diseases and clinical conditions associated with GLS. Matrix Metalloproteinase 8 (neutrophil collagenase) (MMP8, Accession NM_002424) is another VGAM1883 host target gene. MMP8 BINDING SITE is HOST TARGET binding site found in the 3' untranslated region of mRNA encoded by MMP8, corresponding to a HOST TARGET binding site such as BINDING SITE I, BINDING SITE II or BINDING SITE III. Table 2 illustrates the complementarity of the nucleotide sequences of MMP8 BINDING SITE, designated SEQ ID:8257, to the nucleotide sequence of VGAM1883 RNA, herein designated VGAM RNA, also designated SEQ ID:4594.

Another function of VGAM1883 is therefore inhibition of Matrix Metalloproteinase 8 (neutrophil collagenase) (MMP8, Accession NM_002424). Accordingly, utilities of VGAM1883 include diagnosis, prevention and treatment of diseases and clinical conditions associated with MMP8. Selectin L (lymphocyte adhesion molecule 1) (SELL, Accession NM_000655) is another VGAM1883 host target gene. SELL BINDING SITE is HOST TARGET binding site found in the 3' untranslated region of mRNA encoded by SELL, corresponding to a HOST TARGET binding site such as BINDING SITE I, BINDING SITE II or BINDING SITE III. Table 2 illustrates the complementarity of the nucleotide sequences of SELL BINDING SITE, designated SEQ ID:6314, to the nucleotide sequence of VGAM1883 RNA, herein designated VGAM RNA, also designated SEQ ID:4594.

Another function of VGAM1883 is therefore inhibition of Selectin L (lymphocyte adhesion molecule 1) (SELL, Accession NM_000655), a gene which is a cell surface adhesion protein. Accordingly, utilities of VGAM1883 include diagnosis, prevention and treatment of diseases and clinical conditions associated with SELL. The function of SELL and its association with various diseases and clinical conditions, has been established by previous studies, as described hereinabove with reference to VGAM374. DKFZP564D206 (Accession XM_166501) is another VGAM1883 host target gene. DKFZP564D206 BINDING SITE is HOST TARGET binding site found in the 3' untranslated region of mRNA encoded by DKFZP564D206, corresponding to a HOST TARGET binding site such as BINDING SITE I, BINDING SITE II or BINDING SITE III. Table 2 illustrates the complementarity of the nucleotide sequences of DKFZP564D206 BINDING SITE, designated SEQ ID:44427, to the nucleotide sequence of VGAM1883 RNA, herein designated VGAM RNA, also designated SEQ ID:4594.

Another function of VGAM1883 is therefore inhibition of DKFZP564D206 (Accession XM_166501). Accordingly, utilities of VGAM1883 include diagnosis, prevention and treatment of diseases and clinical conditions associated with DKFZP564D206. DKFZP564I0422 (Accession NM_031435) is another VGAM1883 host target gene. DKFZP564I0422 BINDING SITE is HOST TARGET binding site found in the 3' untranslated region of mRNA encoded by DKFZP564I0422, corresponding to a HOST TARGET binding site such as BINDING SITE I, BINDING SITE II or BINDING SITE III. Table 2 illustrates the complementarity of the nucleotide sequences of DKFZP564I0422 BINDING SITE, designated SEQ ID:25433, to the nucleotide sequence of VGAM1883 RNA, herein designated VGAM RNA, also designated SEQ ID:4594.

Another function of VGAM1883 is therefore inhibition of DKFZP564I0422 (Accession NM_031435). Accordingly, utilities of VGAM1883 include diagnosis, prevention and treatment of diseases and clinical conditions associated with DKFZP564I0422. FLJ23189 (Accession NM_025057) is another VGAM1883 host target gene. FLJ23189 BINDING SITE is HOST TARGET binding site found in the 3' untranslated region of mRNA encoded by FLJ23189, corresponding to a HOST TARGET binding site such as BINDING SITE I, BINDING SITE II or BINDING SITE III. Table 2 illustrates the complementarity of the nucleotide sequences of FLJ23189 BINDING SITE, designated SEQ ID:24655, to the nucleotide sequence of VGAM1883 RNA, herein designated VGAM RNA, also designated SEQ ID:4594.

Another function of VGAM1883 is therefore inhibition of FLJ23189 (Accession NM_025057). Accordingly, utilities of VGAM1883 include diagnosis, prevention and treatment of diseases and clinical conditions associated with FLJ23189. P37NB (Accession NM_005824) is another VGAM1883 host target gene. P37NB BINDING SITE is HOST TARGET binding site found in the 3' untranslated region of mRNA encoded by P37NB, corresponding to a HOST TARGET binding site such as BINDING SITE I, BINDING SITE II or BINDING SITE III. Table 2 illustrates the complementarity of the nucleotide sequences of P37NB BINDING SITE, designated SEQ ID:12433, to the nucleotide sequence of VGAM1883 RNA, herein designated VGAM RNA, also designated SEQ ID:4594.

Another function of VGAM1883 is therefore inhibition of P37NB (Accession NM_005824). Accordingly, utilities of VGAM1883 include diagnosis, prevention and treatment of diseases and clinical conditions associated with P37NB. Vesicular Membrane Protein P24 (VMP, Accession NM_080723) is another VGAM1883 host target gene. VMP BINDING SITE is HOST TARGET binding site found in the 3' untranslated region of mRNA encoded by VMP, corresponding to a HOST TARGET binding site such as BINDING SITE I, BINDING SITE II or BINDING SITE III. Table 2 illustrates the complementarity of the nucleotide sequences of VMP BINDING SITE, designated SEQ ID:28016, to the nucleotide sequence of VGAM1883 RNA, herein designated VGAM RNA, also designated SEQ ID:4594.

Another function of VGAM1883 is therefore inhibition of Vesicular Membrane Protein P24 (VMP, Accession NM_080723). Accordingly, utilities of VGAM1883 include diagnosis, prevention and treatment of diseases and clinical conditions associated with VMP. LOC170063 (Accession XM_104820) is another VGAM1883 host target gene. LOC170063 BINDING SITE is HOST TARGET binding site found in the 3' untranslated region of mRNA encoded by LOC170063, corresponding to a HOST TARGET binding site such as BINDING SITE I, BINDING SITE II or BINDING SITE III. Table 2 illustrates the complementarity of the nucleotide sequences of LOC170063 BINDING SITE, designated SEQ ID:42187, to the nucleotide sequence of VGAM1883 RNA, herein designated VGAM RNA, also designated SEQ ID:4594.

Another function of VGAM1883 is therefore inhibition of LOC170063 (Accession XM_104820). Accordingly, utilities of VGAM1883 include diagnosis, prevention and treatment of diseases and clinical conditions associated with LOC170063. FIG. 1 further provides a conceptual description of a novel bioinformatically detected viral gene of the present invention, referred to here as Viral Genomic Address Messenger 1884 (VGAM1884) viral gene, which modulates expression of respective host target genes thereof, the function and utility of which host target genes is known in the art.

VGAM1884 is a novel bioinformatically detected regulatory, non protein coding, viral micro RNA (miRNA) gene. The method by which VGAM1884 was detected is described hereinabove with reference to FIGS. 1-8.

VGAM1884 gene, herein designated VGAM GENE, is a viral gene contained in the genome of Bovine Respiratory Syncytial Virus. VGAM1884 host target gene, herein designated VGAM HOST TARGET GENE, is a human gene contained in the human genome.

VGAM1884 gene encodes a VGAM1884 precursor RNA, herein designated VGAM PRECURSOR RNA. Similar to other miRNA genes, and unlike most ordinary genes, VGAM1884 precursor RNA does not encode a protein. A nucleotide sequence identical or highly similar to the nucleotide sequence of VGAM1884 precursor RNA is designated SEQ ID:1870, and is provided hereinbelow with reference to the sequence listing part. Nucleotide sequence SEQ ID:1870 is located at position 8134 relative to the genome of Bovine Respiratory Syncytial Virus.

VGAM1884 precursor RNA folds onto itself, forming VGAM1884 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1884 folded precursor RNA into VGAM1884 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM1884 RNA is designated SEQ ID:4595, and is provided hereinbelow with reference to the sequence listing part.

VGAM1884 host target gene, herein designated VGAM HOST TARGET GENE, encodes a corresponding messenger RNA, VGAM1884 host target RNA, herein designated VGAM HOST TARGET RNA. VGAM1884 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1884 RNA, herein designated VGAM RNA, binds complementarily to one or more host target binding sites located in untranslated regions of VGAM1884 host target RNA, herein designated VGAM HOST TARGET RNA. This complementary binding is due to the fact that the nucleotide sequence of VGAM1884 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1884 RNA, herein designated VGAM RNA, may have a different number of host target binding sites in untranslated regions of a VGAM1884 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1884 RNA, herein designated VGAM RNA, to host target binding sites on VGAM1884 host target RNA, herein designated VGAM HOST TARGET RNA, such as BINDING SITE I, BINDING SITE II and BINDING SITE III, inhibits translation of VGAM1884 host target RNA into VGAM1884 host target protein, herein designated VGAM HOST TARGET PROTEIN. VGAM host target protein is therefore outlined by a broken line.

It is appreciated that VGAM1884 host target gene, herein designated VGAM HOST TARGET GENE, in fact represents a plurality of VGAM1884 host target genes. The mRNA of each one of this plurality of VGAM1884 host target genes comprises one or more host target binding sites, each having a nucleotide sequence which is at least partly complementary to VGAM1884 RNA, herein designated VGAM RNA, and which when bound by VGAM1884 RNA causes inhibition of translation of respective one or more VGAM1884 host target proteins.

It is further appreciated by one skilled in the art that the mode of translational inhibition illustrated by FIG. 1 with specific reference to translational inhibition exerted by VGAM1884 gene, herein designated VGAM GENE, on one or more VGAM1884 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1884 is inhibition of expression of host target genes, as part of a novel viral mechanism of attacking a host. Accordingly, utilities of VGAM1884 include diagnosis, prevention and treatment of viral infection by Bovine Respiratory Syncytial Virus. Specific functions, and accordingly utilities, of VGAM1884 correlate with, and may be deduced from, the identity of the host target genes which VGAM1884 binds and inhibits, and the function of these host target genes, as elaborated hereinbelow.

Nucleotide sequences of the VGAM1884 precursor RNA, herein designated VGAM PRECURSOR RNA, and of the 'diced' VGAM1884 RNA, herein designated VGAM RNA, and a schematic representation of the secondary folding of VGAM1884 folded precursor RNA, herein designated VGAM FOLDED PRECURSOR RNA, of VGAM1884 are further described hereinbelow with reference to Table 1.

Nucleotide sequences of host target binding sites, such as BINDING SITE-I, BINDING SITE-II and BINDING SITE-III of FIG. 1, found on VGAM1884 host target RNA, and schematic representation of the complementarity of each of these host target binding sites to VGAM1884 RNA, herein designated VGAM RNA, are described hereinbelow with reference to Table 2.

As mentioned hereinabove with reference to FIG. 1, a function of VGAM1884 gene, herein designated VGAM is inhibition of expression of VGAM1884 target genes. It is appreciated that specific functions, and accordingly utilities, of VGAM1884 correlate with, and may be deduced from, the identity of the target genes which VGAM1884 binds and inhibits, and the function of these target genes, as elaborated hereinbelow.

5-methyltetrahydrofolate-homocysteine Methyltransferase Reductase (MTRR, Accession NM_024010) is a VGAM1884 host target gene. MTRR BINDING SITE1 and MTRR BINDING SITE2 are HOST TARGET binding sites found in untranslated regions of mRNA encoded by MTRR, corresponding to HOST TARGET binding sites such as BINDING SITE I, BINDING SITE II or BINDING SITE III. Table 2 illustrates the complementarity of the nucleotide sequences of MTRR BINDING SITE1 and MTRR BINDING SITE2, designated SEQ ID:23444 and SEQ ID:8290 respectively, to the nucleotide sequence of VGAM1884 RNA, herein designated VGAM RNA, also designated SEQ ID:4595.

A function of VGAM1884 is therefore inhibition of 5-methyltetrahydrofolate-homocysteine Methyltransferase Reductase (MTRR, Accession NM_024010). Accordingly, utilities of VGAM1884 include diagnosis, prevention and treatment of diseases and clinical conditions associated with MTRR. Protein Kinase, CAMP-dependent, Regulatory, Type I, Alpha (tissue specific extinguisher 1) (PRKAR1A, Accession NM_002734) is another VGAM1884 host target gene. PRKAR1A BINDING SITE is HOST TARGET binding site found in the 3' untranslated region of mRNA encoded by PRKAR1A, corresponding to a HOST TARGET binding site such as BINDING SITE I, BINDING SITE II or BINDING SITE III. Table 2 illustrates the complementarity of the nucleotide sequences of PRKAR1A BINDING SITE, designated SEQ ID:8605, to the nucleotide sequence of VGAM1884 RNA, herein designated VGAM RNA, also designated SEQ ID:4595.

Another function of VGAM1884 is therefore inhibition of Protein Kinase, CAMP-dependent, Regulatory, Type I, Alpha (tissue specific extinguisher 1) (PRKAR1A, Accession NM_002734). Accordingly, utilities of VGAM1884 include diagnosis, prevention and treatment of diseases and clinical conditions associated with PRKAR1A. Protein Kinase C, Nu (PRKCN, Accession NM_005813) is another VGAM1884 host target gene. PRKCN BINDING SITE is HOST TARGET binding site found in the 3' untranslated region of mRNA encoded by PRKCN, corresponding to a HOST TARGET binding site such as BINDING SITE I, BINDING SITE II or BINDING SITE III. Table 2 illustrates the complementarity of the nucleotide sequences of PRKCN BINDING SITE, designated SEQ ID:12395, to the nucleotide sequence of VGAM1884 RNA, herein designated VGAM RNA, also designated SEQ ID:4595.

Another function of VGAM1884 is therefore inhibition of Protein Kinase C, Nu (PRKCN, Accession NM_005813). Accordingly, utilities of VGAM1884 include diagnosis, prevention and treatment of diseases and clinical conditions associated with PRKCN. RINZF (Accession NM_023929) is another VGAM1884 host target gene. RINZF BINDING SITE is HOST TARGET binding site found in the 3' untranslated region of mRNA encoded by RINZF, corresponding to a HOST TARGET binding site such as BINDING SITE I, BINDING SITE II or BINDING SITE III. Table 2 illustrates the complementarity of the nucleotide sequences of RINZF BINDING SITE, designated SEQ ID:23411, to the nucleotide sequence of VGAM1884 RNA, herein designated VGAM RNA, also designated SEQ ID:4595.

Another function of VGAM1884 is therefore inhibition of RINZF (Accession NM_023929). Accordingly, utilities of VGAM1884 include diagnosis, prevention and treatment of diseases and clinical conditions associated with RINZF. LOC143692 (Accession XM_084601) is another VGAM1884 host target gene. LOC143692 BINDING SITE is HOST TARGET binding site found in the 5' untranslated region of mRNA encoded by LOC143692, corresponding to a HOST TARGET binding site such as BINDING SITE I, BINDING SITE II or BINDING SITE III. Table 2 illustrates the complementarity of the nucleotide sequences of LOC143692 BINDING SITE, designated SEQ ID:37630, to the nucleotide sequence of VGAM1884 RNA, herein designated VGAM RNA, also designated SEQ ID:4595.

Another function of VGAM1884 is therefore inhibition of LOC143692 (Accession XM_084601). Accordingly, utilities of VGAM1884 include diagnosis, prevention and treatment of diseases and clinical conditions associated with LOC143692. LOC158549 (Accession XM_098963) is another VGAM1884 host target gene. LOC158549 BINDING SITE is HOST TARGET binding site found in the 3' untranslated region of mRNA encoded by LOC158549, corresponding to a HOST TARGET binding site such as BINDING SITE I, BINDING SITE II or BINDING SITE III. Table 2 illustrates the complementarity of the nucleotide sequences of LOC158549 BINDING SITE, designated SEQ ID:42004, to the nucleotide sequence of VGAM1884 RNA, herein designated VGAM RNA, also designated SEQ ID:4595.

Another function of VGAM1884 is therefore inhibition of LOC158549 (Accession XM_098963). Accordingly, utilities of VGAM1884 include diagnosis, prevention and treatment of diseases and clinical conditions associated with LOC158549. FIG. 1 further provides a conceptual description of a novel bioinformatically detected viral gene of the present invention, referred to here as Viral Genomic Address Messenger 1885 (VGAM1885) viral gene, which modulates expression of respective host target genes thereof, the function and utility of which host target genes is known in the art.

VGAM1885 is a novel bioinformatically detected regulatory, non protein coding, viral micro RNA (miRNA) gene. The method by which VGAM1885 was detected is described hereinabove with reference to FIGS. 1-8.

VGAM1885 gene, herein designated VGAM GENE, is a viral gene contained in the genome of Newcastle Disease Virus. VGAM1885 host target gene, herein designated VGAM HOST TARGET GENE, is a human gene contained in the human genome.

VGAM1885 gene encodes a VGAM1885 precursor RNA, herein designated VGAM PRECURSOR RNA. Similar to other miRNA genes, and unlike most ordinary genes, VGAM1885 precursor RNA does not encode a protein. A nucleotide sequence identical or highly similar to the nucleotide sequence of VGAM1885 precursor RNA is designated SEQ ID:1871, and is provided hereinbelow with reference to the sequence listing part. Nucleotide sequence SEQ ID:1871 is located at position 363 relative to the genome of Newcastle Disease Virus.

VGAM1885 precursor RNA folds onto itself, forming VGAM1885 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1885 folded precursor RNA into VGAM1885 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1885 RNA is designated SEQ ID:4596, and is provided hereinbelow with reference to the sequence listing part.

VGAM1885 host target gene, herein designated VGAM HOST TARGET GENE, encodes a corresponding messenger RNA, VGAM1885 host target RNA, herein designated VGAM HOST TARGET RNA. VGAM1885 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1885 RNA, herein designated VGAM RNA, binds complementarily to one or more host target binding sites located in untranslated regions of VGAM1885 host target RNA, herein designated VGAM HOST TARGET RNA. This complementary binding is due to the fact that the nucleotide sequence of VGAM1885 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1885 RNA, herein designated VGAM RNA, may have a different number of host target binding sites in untranslated regions of a VGAM1885 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1885 RNA, herein designated VGAM RNA, to host target binding sites on VGAM1885 host target RNA, herein designated VGAM HOST TARGET RNA, such as BINDING SITE I, BINDING SITE II and BINDING SITE III, inhibits translation of VGAM1885 host target RNA into VGAM1885 host target protein, herein designated VGAM HOST TARGET PROTEIN. VGAM host target protein is therefore outlined by a broken line.

It is appreciated that VGAM1885 host target gene, herein designated VGAM HOST TARGET GENE, in fact represents a plurality of VGAM1885 host target genes. The mRNA of each one of this plurality of VGAM1885 host target genes comprises one or more host target binding sites, each having a nucleotide sequence which is at least partly complementary to VGAM1885 RNA, herein designated VGAM RNA, and which when bound by VGAM1885 RNA causes inhibition of translation of respective one or more VGAM1885 host target proteins.

It is further appreciated by one skilled in the art that the mode of translational inhibition illustrated by FIG. 1 with specific reference to translational inhibition exerted by VGAM1885 gene, herein designated VGAM GENE, on one or more VGAM1885 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1885 is inhibition of expression of host target genes, as part of a novel viral mechanism of attacking a host. Accordingly, utilities of VGAM1885 include diagnosis, prevention and treatment of viral infection by Newcastle Disease Virus. Specific functions, and accordingly utilities, of VGAM1885 correlate with, and may be deduced from, the identity of the host target genes which VGAM1885 binds and inhibits, and the function of these host target genes, as elaborated hereinbelow.

Nucleotide sequences of the VGAM1885 precursor RNA, herein designated VGAM PRECURSOR RNA, and of the 'diced' VGAM1885 RNA, herein designated VGAM RNA, and a schematic representation of the secondary folding of VGAM1885 folded precursor RNA, herein designated VGAM FOLDED PRECURSOR RNA, of VGAM1885 are further described hereinbelow with reference to Table 1.

Nucleotide sequences of host target binding sites, such as BINDING SITE-I, BINDING SITE-II and BINDING SITE-III of FIG. 1, found on VGAM1885 host target RNA, and schematic representation of the complementarity of each of these host target binding sites to VGAM1885 RNA, herein designated VGAM RNA, are described hereinbelow with reference to Table 2.

As mentioned hereinabove with reference to FIG. 1, a function of VGAM1885 gene, herein designated VGAM is inhibition of expression of VGAM1885 target genes. It is appreciated that specific functions, and accordingly utilities, of VGAM1885 correlate with, and may be deduced from, the identity of the target genes which VGAM1885 binds and inhibits, and the function of these target genes, as elaborated hereinbelow.

B-cell CLL/lymphoma 11A (zinc finger protein) (BCL11A, Accession NM_138553) is a VGAM1885 host target gene. BCL11A BINDING SITE1 and BCL11A BINDING SITE2 are HOST TARGET binding sites found in untranslated regions of mRNA encoded by BCL11A, corresponding to HOST TARGET binding sites such as BINDING SITE I, BINDING SITE II or BINDING SITE III. Table 2 illustrates the complementarity of the nucleotide sequences of BCL11A BINDING SITE1 and BCL11A BINDING SITE2, designated SEQ ID:28851 and SEQ ID:19751 respectively, to the nucleotide sequence of VGAM1885 RNA, herein designated VGAM RNA, also designated SEQ ID:4596.

A function of VGAM1885 is therefore inhibition of B-cell CLL/lymphoma 11A (zinc finger protein) (BCL11A, Accession NM_138553), a gene which acts as a transcriptional repressor. Accordingly, utilities of VGAM1885 include diagnosis, prevention and treatment of diseases and clinical conditions associated with BCL11A. The function of BCL11A and its association with various diseases and clinical conditions, has been established by previous studies, as described hereinabove with reference to VGAM190. BTG Family, Member 2 (BTG2, Accession NM_006763) is another VGAM1885 host target gene. BTG2 BINDING SITE is HOST TARGET binding site found in the 3' untranslated region of mRNA encoded by BTG2, corresponding to a HOST TARGET binding site such as BINDING SITE I, BINDING SITE II or BINDING SITE III. Table 2 illustrates the complementarity of the nucleotide sequences of BTG2 BINDING SITE, designated SEQ ID:13620, to the nucleotide sequence of VGAM1885 RNA, herein designated VGAM RNA, also designated SEQ ID:4596.

Another function of VGAM1885 is therefore inhibition of BTG Family, Member 2 (BTG2, Accession NM_006763). Accordingly, utilities of VGAM1885 include diagnosis, prevention and treatment of diseases and clinical conditions associated with BTG2. Cadherin, EGF LAG Seven-pass G-type Receptor 2 (flamingo homolog, Drosophila) (CELSR2, Accession NM_001408) is another VGAM1885 host target gene. CELSR2 BINDING SITE is HOST TARGET binding site found in the 3' untranslated region of mRNA encoded by CELSR2, corresponding to a HOST TARGET binding site such as BINDING SITE I, BINDING SITE II or BINDING SITE III. Table 2 illustrates the complementarity of the nucleotide sequences of CELSR2 BINDING SITE, designated SEQ ID:7108, to the nucleotide sequence of VGAM1885 RNA, herein designated VGAM RNA, also designated SEQ ID:4596.

Another function of VGAM1885 is therefore inhibition of Cadherin, EGF LAG Seven-pass G-type Receptor 2 (flamingo homolog, Drosophila) (CELSR2, Accession NM_001408), a gene which is a calcium dependent cell adhesion protein. Accordingly, utilities of VGAM1885 include diagnosis, prevention and treatment of diseases and clinical conditions associated with CELSR2. The function of CELSR2 and its association with various diseases and clinical conditions, has been established by previous studies, as described hereinabove with reference to VGAM432. Centrin, EF-hand Protein, 1 (CETN1, Accession XM_170866) is another VGAM1885 host target gene. CETN1 BINDING SITE is HOST TARGET binding site found in the 3' untranslated region of mRNA encoded by CETN1, corresponding to a HOST TARGET binding site such as BINDING SITE I, BINDING SITE II or BINDING SITE III. Table 2 illustrates the complementarity of the nucleotide sequences of CETN1 BINDING SITE, designated SEQ ID:45639, to the nucleotide sequence of VGAM1885 RNA, herein designated VGAM RNA, also designated SEQ ID:4596.

Another function of VGAM1885 is therefore inhibition of Centrin, EF-hand Protein, 1 (CETN1, Accession XM_170866). Accordingly, utilities of VGAM1885 include diagnosis, prevention and treatment of diseases and clinical conditions associated with CETN1. LIM Domain Only 4 (LMO4, Accession NM_006769) is another VGAM1885 host target gene. LMO4 BINDING SITE is HOST TARGET binding site found in the 5' untranslated region of mRNA encoded by LMO4, corresponding to a HOST TARGET binding site such as BINDING SITE I, BINDING SITE II or BINDING SITE III. Table 2 illustrates the complementarity of the nucleotide sequences of LMO4 BINDING SITE, designated SEQ ID:13643, to the nucleotide sequence of VGAM1885 RNA, herein designated VGAM RNA, also designated SEQ ID:4596.

Another function of VGAM1885 is therefore inhibition of LIM Domain Only 4 (LMO4, Accession NM_006769), a gene which promotes myogenic differentiation. Accordingly, utilities of VGAM1885 include diagnosis, prevention and treatment of diseases and clinical conditions associated with LMO4. The function of LMO4 has been established by previous studies. Muscle development is a complex, multistep process under the control of both ubiquitous and muscle-specific transcriptional regulators. Arber et al. (1994) described a positive regulator of myogenesis that was cloned from a subtracted cDNA library enriched for messages induced in denervated rat skeletal muscle. The rat cDNA was designated muscle LIM protein (Mlp) because it contained a cysteine-rich domain originally described in the 3 proteins Lin-11, Isl-1 (OMIM Ref. No. 600366), and Mec-3. Mlp is enriched in striated muscle and its expression coincides with myogenic differentiation. In the absence of Mlp, induced myoblasts express myogenin but fail to exit the cell cycle and differentiate. The rat Mlp cDNA encodes a predicted 194-amino acid protein containing 2 LIM motifs. The protein is highly conserved and Northern blots detected transcripts in chicken and Drosophila, from which the corresponding genes were isolated. The chicken and rat proteins are 93% identical. Fung et al. (1995) cloned a human cDNA, which they designated cardiac LIM protein (CLP), whose deduced amino acid sequence is 95% identical to that of rat Mlp. The authors proposed that the human gene is the homolog of the rat sequence. Northern blots showed expression in cardiac and slow-twitch skeletal muscles Full details of the abovementioned studies are described in the following publications, the disclosure of which are hereby incorporated by reference:

Arber, S.; Halder, G.; Caroni, P.: Muscle LIM protein, a novel essential regulator of myogenesis, promotes myogenic differentiation. Cell 79:221-231, 1994; and Weiskirchen, R.; Pino, J. D.; Macalma, T.; Bister, K.; Beckerle, M. C.: The cysteine-rich protein family of highly related LIM domain proteins. J. Biol. Chem. 270:28946-28954, 1995.

Further studies establishing the function and utilities of LMO4 are found in John Hopkins OMIM database record ID 600824, and in sited publications numbered 7775-777 and 3980 listed in the bibliography section hereinbelow, which are also hereby incorporated by reference. Mitogen-activated Protein Kinase Kinase Kinase 1 (MAP3K1, Accession XM_042066) is another VGAM1885 host target gene. MAP3K1 BINDING SITE is HOST TARGET binding site found in the 3' untranslated region of mRNA encoded by MAP3K1, corresponding to a HOST TARGET binding site such as BINDING SITE I, BINDING SITE II or BINDING SITE III. Table 2 illustrates the complementarity of the nucleotide sequences of MAP3K1 BINDING SITE, designated SEQ ID:33680, to the nucleotide sequence of VGAM1885 RNA, herein designated VGAM RNA, also designated SEQ ID:4596.

Another function of VGAM1885 is therefore inhibition of Mitogen-activated Protein Kinase Kinase Kinase 1 (MAP3K1, Accession XM_042066), a gene which can phosphorylate and activate mapkk 1 and mapkk 2 (mek1/mek2)

which leads to phosphorylation of map kinases. it is also a highly efficient activator of the jnk cascade. Accordingly, utilities of VGAM1885 include diagnosis, prevention and treatment of diseases and clinical conditions associated with MAP3K1. The function of MAP3K1 and its association with various diseases and clinical conditions, has been established by previous studies, as described hereinabove with reference to VGAM469. MAX Binding Protein (MNT, Accession NM_020310) is another VGAM1885 host target gene. MNT BINDING SITE is HOST TARGET binding site found in the 3' untranslated region of mRNA encoded by MNT, corresponding to a HOST TARGET binding site such as BINDING SITE I, BINDING SITE II or BINDING SITE III. Table 2 illustrates the complementarity of the nucleotide sequences of MNT BINDING SITE, designated SEQ ID:21566, to the nucleotide sequence of VGAM1885 RNA, herein designated VGAM RNA, also designated SEQ ID:4596.

Another function of VGAM1885 is therefore inhibition of MAX Binding Protein (MNT, Accession NM_020310). Accordingly, utilities of VGAM1885 include diagnosis, prevention and treatment of diseases and clinical conditions associated with MNT. Membrane Protein, Palmitoylated 5 (MAGUK p55 subfamily member 5) (MPP5, Accession NM_022474) is another VGAM1885 host target gene. MPP5 BINDING SITE is HOST TARGET binding site found in the 3' untranslated region of mRNA encoded by MPP5, corresponding to a HOST TARGET binding site such as BINDING SITE I, BINDING SITE II or BINDING SITE III. Table 2 illustrates the complementarity of the nucleotide sequences of MPP5 BINDING SITE, designated SEQ ID:22839, to the nucleotide sequence of VGAM1885 RNA, herein designated VGAM RNA, also designated SEQ ID:4596.

Another function of VGAM1885 is therefore inhibition of Membrane Protein, Palmitoylated 5 (MAGUK p55 subfamily member 5) (MPP5, Accession NM_022474), a gene which may regulate transmembrane proteins that bind calcium, calmodulin, or nucleotides. Accordingly, utilities of VGAM1885 include diagnosis, prevention and treatment of diseases and clinical conditions associated with MPP5. The function of MPP5 and its association with various diseases and clinical conditions, has been established by previous studies, as described hereinabove with reference to VGAM306. Aminopeptidase Puromycin Sensitive (NPEPPS, Accession NM_006310) is another VGAM1885 host target gene. NPEPPS BINDING SITE is HOST TARGET binding site found in the 3' untranslated region of mRNA encoded by NPEPPS, corresponding to a HOST TARGET binding site such as BINDING SITE I, BINDING SITE II or BINDING SITE III. Table 2 illustrates the complementarity of the nucleotide sequences of NPEPPS BINDING SITE, designated SEQ ID:12999, to the nucleotide sequence of VGAM1885 RNA, herein designated VGAM RNA, also designated SEQ ID:4596.

Another function of VGAM1885 is therefore inhibition of Aminopeptidase Puromycin Sensitive (NPEPPS, Accession NM_006310), a gene which is puromycin-sensitive aminopeptidase and has metallopeptidase activity. Accordingly, utilities of VGAM1885 include diagnosis, prevention and treatment of diseases and clinical conditions associated with NPEPPS. The function of NPEPPS and its association with various diseases and clinical conditions, has been established by previous studies, as described hereinabove with reference to VGAM83. RNTRE (Accession NM_014688) is another VGAM1885 host target gene. RNTRE BINDING SITE is HOST TARGET binding site found in the 3' untranslated region of mRNA encoded by RNTRE, corresponding to a HOST TARGET binding site such as BINDING SITE I, BINDING SITE II or BINDING SITE III. Table 2 illustrates the complementarity of the nucleotide sequences of RNTRE BINDING SITE, designated SEQ ID:16188, to the nucleotide sequence of VGAM1885 RNA, herein designated VGAM RNA, also designated SEQ ID:4596.

Another function of VGAM1885 is therefore inhibition of RNTRE (Accession NM_014688), a gene which may be involved in cell proliferation. Accordingly, utilities of VGAM1885 include diagnosis, prevention and treatment of diseases and clinical conditions associated with RNTRE. The function of RNTRE and its association with various diseases and clinical conditions, has been established by previous studies, as described hereinabove with reference to VGAM379. Sodium Channel, Voltage-gated, Type III, Alpha Polypeptide (SCN3A, Accession NM_006922) is another VGAM1885 host target gene. SCN3A BINDING SITE is HOST TARGET binding site found in the 5' untranslated region of mRNA encoded by SCN3A, corresponding to a HOST TARGET binding site such as BINDING SITE I, BINDING SITE II or BINDING SITE III. Table 2 illustrates the complementarity of the nucleotide sequences of SCN3A BINDING SITE, designated SEQ ID:13795, to the nucleotide sequence of VGAM1885 RNA, herein designated VGAM RNA, also designated SEQ ID:4596.

Another function of VGAM1885 is therefore inhibition of Sodium Channel, Voltage-gated, Type III, Alpha Polypeptide (SCN3A, Accession NM_006922), a gene which may be important for maintaining neural membrane excitability. Accordingly, utilities of VGAM1885 include diagnosis, prevention and treatment of diseases and clinical conditions associated with SCN3A. The function of SCN3A and its association with various diseases and clinical conditions, has been established by previous studies, as described hereinabove with reference to VGAM124. Solute Carrier Family 4, Sodium Bicarbonate Cotransporter, Member 4 (SLC4A4, Accession NM_003759) is another VGAM1885 host target gene. SLC4A4 BINDING SITE is HOST TARGET binding site found in the 3' untranslated region of mRNA encoded by SLC4A4, corresponding to a HOST TARGET binding site such as BINDING SITE I, BINDING SITE II or BINDING SITE III. Table 2 illustrates the complementarity of the nucleotide sequences of SLC4A4 BINDING SITE, designated SEQ ID:9837, to the nucleotide sequence of VGAM1885 RNA, herein designated VGAM RNA, also designated SEQ ID:4596.

Another function of VGAM1885 is therefore inhibition of Solute Carrier Family 4, Sodium Bicarbonate Cotransporter, Member 4 (SLC4A4, Accession NM_003759), a gene which is a sodium bicarbonate cotransporter. Accordingly, utilities of VGAM1885 include diagnosis, prevention and treatment of diseases and clinical conditions associated with SLC4A4. The function of SLC4A4 and its association with various diseases and clinical conditions, has been established by previous studies, as described hereinabove with reference to VGAM222. Sorbin and SH3 Domain Containing 1 (SORBS1, Accession NM_015385) is another VGAM1885 host target gene. SORBS1 BINDING SITE is HOST TARGET binding site found in the 3' untranslated region of mRNA encoded by SORBS1, corresponding to a HOST TARGET binding site such as BINDING SITE I, BINDING SITE II or BINDING SITE III. Table 2 illustrates the complementarity of the nucleotide sequences of SORBS1 BINDING SITE, designated SEQ ID:17687, to the nucleotide sequence of VGAM1885 RNA, herein designated VGAM RNA, also designated SEQ ID:4596.

Another function of VGAM1885 is therefore inhibition of Sorbin and SH3 Domain Containing 1 (SORBS1, Accession NM_015385), a gene which necessary for cell polarization during vegetative growth. Accordingly, utilities of VGAM1885 include diagnosis, prevention and treatment of diseases and clinical conditions associated with SORBS1. The function of SORBS1 and its association with various diseases and clinical conditions, has been established by previous studies, as described hereinabove with reference to VGAM475. Tissue Inhibitor of Metalloproteinase 3 (Sorsby fundus dystrophy, pseudoinflammatory) (TIMP3, Accession NM_000362) is another VGAM1885 host target gene. TIMP3 BINDING SITE is HOST TARGET binding site found in the 3' untranslated region of mRNA encoded by TIMP3, corresponding to a HOST TARGET binding site such as BINDING SITE I, BINDING SITE II or BINDING SITE III. Table 2 illustrates the complementarity of the nucleotide sequences of TIMP3 BINDING SITE, designated SEQ ID:5932, to the nucleotide sequence of VGAM1885 RNA, herein designated VGAM RNA, also designated SEQ ID:4596.

Another function of VGAM1885 is therefore inhibition of Tissue Inhibitor of Metalloproteinase 3 (Sorsby fundus dystrophy, pseudoinflammatory) (TIMP3, Accession NM_000362). Accordingly, utilities of VGAM1885 include diagnosis, prevention and treatment of diseases and clinical conditions associated with TIMP3. CMG2 (Accession NM_058172) is another VGAM1885 host target gene. CMG2 BINDING SITE is HOST TARGET binding site found in the 3' untranslated region of mRNA encoded by CMG2, corresponding to a HOST TARGET binding site such as BINDING SITE I, BINDING SITE II or BINDING SITE III. Table 2 illustrates the complementarity of the nucleotide sequences of CMG2 BINDING SITE, designated SEQ ID:27719, to the nucleotide sequence of VGAM1885 RNA, herein designated VGAM RNA, also designated SEQ ID:4596.

Another function of VGAM1885 is therefore inhibition of CMG2 (Accession NM_058172). Accordingly, utilities of VGAM1885 include diagnosis, prevention and treatment of diseases and clinical conditions associated with CMG2. DnaJ (Hsp40) Homolog, Subfamily C, Member 6 (DNAJC6, Accession NM_014787) is another VGAM1885 host target gene. DNAJC6 BINDING SITE is HOST TARGET binding site found in the 3' untranslated region of mRNA encoded by DNAJC6, corresponding to a HOST TARGET binding site such as BINDING SITE I, BINDING SITE II or BINDING SITE III. Table 2 illustrates the complementarity of the nucleotide sequences of DNAJC6 BINDING SITE, designated SEQ ID:16662, to the nucleotide sequence of VGAM1885 RNA, herein designated VGAM RNA, also designated SEQ ID:4596.

Another function of VGAM1885 is therefore inhibition of DnaJ (Hsp40) Homolog, Subfamily C, Member 6 (DNAJC6, Accession NM_014787). Accordingly, utilities of VGAM1885 include diagnosis, prevention and treatment of diseases and clinical conditions associated with DNAJC6. FLJ20291 (Accession NM_017748) is another VGAM1885 host target gene. FLJ20291 BINDING SITE is HOST TARGET binding site found in the 3' untranslated region of mRNA encoded by FLJ20291, corresponding to a HOST TARGET binding site such as BINDING SITE I, BINDING SITE II or BINDING SITE III. Table 2 illustrates the complementarity of the nucleotide sequences of FLJ20291 BINDING SITE, designated SEQ ID:19342, to the nucleotide sequence of VGAM1885 RNA, herein designated VGAM RNA, also designated SEQ ID:4596.

Another function of VGAM1885 is therefore inhibition of FLJ20291 (Accession NM_017748). Accordingly, utilities of VGAM1885 include diagnosis, prevention and treatment of diseases and clinical conditions associated with FLJ20291. FLJ21870 (Accession NM_023016) is another VGAM1885 host target gene. FLJ21870 BINDING SITE is HOST TARGET binding site found in the 3' untranslated region of mRNA encoded by FLJ21870, corresponding to a HOST TARGET binding site such as BINDING SITE I, BINDING SITE II or BINDING SITE III. Table 2 illustrates the complementarity of the nucleotide sequences of FLJ21870 BINDING SITE, designated SEQ ID:23278, to the nucleotide sequence of VGAM1885 RNA, herein designated VGAM RNA, also designated SEQ ID:4596.

Another function of VGAM1885 is therefore inhibition of FLJ21870 (Accession NM_023016). Accordingly, utilities of VGAM1885 include diagnosis, prevention and treatment of diseases and clinical conditions associated with FLJ21870. IMP-2 (Accession NM_006548) is another VGAM1885 host target gene. IMP-2 BINDING SITE is HOST TARGET binding site found in the 3' untranslated region of mRNA encoded by IMP-2, corresponding to a HOST TARGET binding site such as BINDING SITE I, BINDING SITE II or BINDING SITE III. Table 2 illustrates the complementarity of the nucleotide sequences of IMP-2 BINDING SITE, designated SEQ ID:13306, to the nucleotide sequence of VGAM1885 RNA, herein designated VGAM RNA, also designated SEQ ID:4596.

Another function of VGAM1885 is therefore inhibition of IMP-2 (Accession NM_006548). Accordingly, utilities of VGAM1885 include diagnosis, prevention and treatment of diseases and clinical conditions associated with IMP-2. KIAA0628 (Accession NM_014789) is another VGAM1885 host target gene. KIAA0628 BINDING SITE is HOST TARGET binding site found in the 3' untranslated region of mRNA encoded by KIAA0628, corresponding to a HOST TARGET binding site such as BINDING SITE I, BINDING SITE II or BINDING SITE III. Table 2 illustrates the complementarity of the nucleotide sequences of KIAA0628 BINDING SITE, designated SEQ ID:16675, to the nucleotide sequence of VGAM1885 RNA, herein designated VGAM RNA, also designated SEQ ID:4596.

Another function of VGAM1885 is therefore inhibition of KIAA0628 (Accession NM_014789). Accordingly, utilities of VGAM1885 include diagnosis, prevention and treatment of diseases and clinical conditions associated with KIAA0628. KIAA0737 (Accession NM_014828) is another VGAM1885 host target gene. KIAA0737 BINDING SITE is HOST TARGET binding site found in the 3' untranslated region of mRNA encoded by KIAA0737, corresponding to a HOST TARGET binding site such as BINDING SITE I, BINDING SITE II or BINDING SITE III. Table 2 illustrates the complementarity of the nucleotide sequences of KIAA0737 BINDING SITE, designated SEQ ID:16816, to the nucleotide sequence of VGAM1885 RNA, herein designated VGAM RNA, also designated SEQ ID:4596.

Another function of VGAM1885 is therefore inhibition of KIAA0737 (Accession NM_014828). Accordingly, utilities of VGAM1885 include diagnosis, prevention and treatment of diseases and clinical conditions associated with KIAA0737. KIAA0820 (Accession XM_044463) is another VGAM1885 host target gene. KIAA0820 BINDING SITE is HOST TARGET binding site found in the 3' untranslated region of mRNA encoded by KIAA0820, corresponding to a HOST TARGET binding site such as BINDING SITE I, BINDING SITE II or BINDING SITE III. Table 2 illustrates the complementarity of the nucleotide sequences of KIAA0820 BINDING SITE, designated SEQ ID:34219, to the nucleotide sequence of VGAM1885 RNA, herein designated VGAM RNA, also designated SEQ ID:4596.

Another function of VGAM1885 is therefore inhibition of KIAA0820 (Accession XM_044463). Accordingly, utilities of VGAM1885 include diagnosis, prevention and treatment of diseases and clinical conditions associated with KIAA0820. KIAA1128 (Accession XM_043596) is another VGAM1885 host target gene. KIAA1128 BINDING SITE is HOST TARGET binding site found in the 3' untranslated region of mRNA encoded by KIAA1128, corresponding to a HOST TARGET binding site such as BINDING SITE I, BINDING SITE II or BINDING SITE III. Table 2 illustrates the complementarity of the nucleotide sequences of KIAA1128 BINDING SITE, designated SEQ ID:33970, to the nucleotide sequence of VGAM1885 RNA, herein designated VGAM RNA, also designated SEQ ID:4596.

Another function of VGAM1885 is therefore inhibition of KIAA1128 (Accession XM_043596). Accordingly, utilities of VGAM1885 include diagnosis, prevention and treatment of diseases and clinical conditions associated with KIAA1128. KIAA1450 (Accession XM_038035) is another VGAM1885 host target gene. KIAA1450 BINDING SITE is HOST TARGET binding site found in the 3' untranslated region of mRNA encoded by KIAA1450, corresponding to a HOST TARGET binding site such as BINDING SITE I, BINDING SITE II or BINDING SITE III. Table 2 illustrates the complementarity of the nucleotide sequences of KIAA1450 BINDING SITE, designated SEQ ID:32747, to the nucleotide sequence of VGAM1885 RNA, herein designated VGAM RNA, also designated SEQ ID:4596.

Another function of VGAM1885 is therefore inhibition of KIAA1450 (Accession XM_038035). Accordingly, utilities of VGAM1885 include diagnosis, prevention and treatment of diseases and clinical conditions associated with KIAA1450. KIAA1641 (Accession XM_087167) is another VGAM1885 host target gene. KIAA1641 BINDING SITE is HOST TARGET binding site found in the 3' untranslated region of mRNA encoded by KIAA1641, corresponding to a HOST TARGET binding site such as BINDING SITE I, BINDING SITE II or BINDING SITE III. Table 2 illustrates the complementarity of the nucleotide sequences of KIAA1641 BINDING SITE, designated SEQ ID:39098, to the nucleotide sequence of VGAM1885 RNA, herein designated VGAM RNA, also designated SEQ ID:4596.

Another function of VGAM1885 is therefore inhibition of KIAA1641 (Accession XM_087167). Accordingly, utilities of VGAM1885 include diagnosis, prevention and treatment of diseases and clinical conditions associated with KIAA1641. KIAA1713 (Accession XM_051335) is another VGAM1885 host target gene. KIAA1713 BINDING SITE is HOST TARGET binding site found in the 5' untranslated region of mRNA encoded by KIAA1713, corresponding to a HOST TARGET binding site such as BINDING SITE I, BINDING SITE II or BINDING SITE III. Table 2 illustrates the complementarity of the nucleotide sequences of KIAA1713 BINDING SITE, designated SEQ ID:35810, to the nucleotide sequence of VGAM1885 RNA, herein designated VGAM RNA, also designated SEQ ID:4596.

Another function of VGAM1885 is therefore inhibition of KIAA1713 (Accession XM_051335). Accordingly, utilities of VGAM1885 include diagnosis, prevention and treatment of diseases and clinical conditions associated with KIAA1713. KIAA1944 (Accession XM_062545) is another VGAM1885 host target gene. KIAA1944 BINDING SITE is HOST TARGET binding site found in the 3' untranslated region of mRNA encoded by KIAA1944, corresponding to a HOST TARGET binding site such as BINDING SITE I, BINDING SITE II or BINDING SITE III. Table 2 illustrates the complementarity of the nucleotide sequences of KIAA1944 BINDING SITE, designated SEQ ID:37224, to the nucleotide sequence of VGAM1885 RNA, herein designated VGAM RNA, also designated SEQ ID:4596.

Another function of VGAM1885 is therefore inhibition of KIAA1944 (Accession XM_062545). Accordingly, utilities of VGAM1885 include diagnosis, prevention and treatment of diseases and clinical conditions associated with KIAA1944. MGC26954 (Accession NM_145025) is another VGAM1885 host target gene. MGC26954 BINDING SITE is HOST TARGET binding site found in the 3' untranslated region of mRNA encoded by MGC26954, corresponding to a HOST TARGET binding site such as BINDING SITE I, BINDING SITE II or BINDING SITE III. Table 2 illustrates the complementarity of the nucleotide sequences of MGC26954 BINDING SITE, designated SEQ ID:29638, to the nucleotide sequence of VGAM1885 RNA, herein designated VGAM RNA, also designated SEQ ID:4596.

Another function of VGAM1885 is therefore inhibition of MGC26954 (Accession NM_145025). Accordingly, utilities of VGAM1885 include diagnosis, prevention and treatment of diseases and clinical conditions associated with MGC26954. Mitochondrial Ribosomal Protein 63 (MRP63, Accession NM_024026) is another VGAM1885 host target gene. MRP63 BINDING SITE is HOST TARGET binding site found in the 3' untranslated region of mRNA encoded by MRP63, corresponding to a HOST TARGET binding site such as BINDING SITE I, BINDING SITE II or BINDING SITE III. Table 2 illustrates the complementarity of the nucleotide sequences of MRP63 BINDING SITE, designated SEQ ID:23455, to the nucleotide sequence of VGAM1885 RNA, herein designated VGAM RNA, also designated SEQ ID:4596.

Another function of VGAM1885 is therefore inhibition of Mitochondrial Ribosomal Protein 63 (MRP63, Accession NM_024026). Accordingly, utilities of VGAM1885 include diagnosis, prevention and treatment of diseases and clinical conditions associated with MRP63. Placenta-specific 3 (PLAC3, Accession XM_045115) is another VGAM1885 host target gene. PLAC3 BINDING SITE is HOST TARGET binding site found in the 5' untranslated region of mRNA encoded by PLAC3, corresponding to a HOST TARGET binding site such as BINDING SITE I, BINDING SITE II or BINDING SITE III. Table 2 illustrates the complementarity of the nucleotide sequences of PLAC3 BINDING SITE, designated SEQ ID:34367, to the nucleotide sequence of VGAM1885 RNA, herein designated VGAM RNA, also designated SEQ ID:4596.

Another function of VGAM1885 is therefore inhibition of Placenta-specific 3 (PLAC3, Accession XM_045115). Accordingly, utilities of VGAM1885 include diagnosis, prevention and treatment of diseases and clinical conditions associated with PLAC3. Phospholipid Scramblase 2 (PLSCR2, Accession NM_020359) is another VGAM1885 host target gene. PLSCR2 BINDING SITE is HOST TARGET binding site found in the 5' untranslated region of mRNA encoded by PLSCR2, corresponding to a HOST TARGET binding site such as BINDING SITE I, BINDING SITE II or BINDING SITE III. Table 2 illustrates the complementarity of the nucleotide sequences of PLSCR2 BINDING SITE, designated SEQ ID:21631, to the nucleotide sequence of VGAM1885 RNA, herein designated VGAM RNA, also designated SEQ ID:4596.

Another function of VGAM1885 is therefore inhibition of Phospholipid Scramblase 2 (PLSCR2, Accession NM_020359). Accordingly, utilities of VGAM1885 include diagnosis, prevention and treatment of diseases and clinical conditions associated with PLSCR2. PTD002 (Accession NM_016144) is another VGAM1885 host target gene. PTD002 BINDING SITE is HOST TARGET binding site found in the 3' untranslated region of mRNA encoded by PTD002, corresponding to a HOST TARGET binding site such as BINDING SITE I, BINDING SITE II or BINDING SITE III. Table 2 illustrates the complementarity of the nucleotide sequences of PTD002 BINDING SITE, designated SEQ ID:18229, to the nucleotide sequence of VGAM1885 RNA, herein designated VGAM RNA, also designated SEQ ID:4596.

Another function of VGAM1885 is therefore inhibition of PTD002 (Accession NM_016144). Accordingly, utilities of VGAM1885 include diagnosis, prevention and treatment of diseases and clinical conditions associated with PTD002. RAP140 (Accession NM_015224) is another VGAM1885 host target gene. RAP140 BINDING SITE is HOST TARGET binding site found in the 3' untranslated region of mRNA encoded by RAP140, corresponding to a HOST TARGET binding site such as BINDING SITE I, BINDING SITE II or BINDING SITE III. Table 2 illustrates the complementarity of the nucleotide sequences of RAP140 BINDING SITE, designated SEQ ID:17558, to the nucleotide sequence of VGAM1885 RNA, herein designated VGAM RNA, also designated SEQ ID:4596.

Another function of VGAM1885 is therefore inhibition of RAP140 (Accession NM_015224). Accordingly, utilities of VGAM1885 include diagnosis, prevention and treatment of diseases and clinical conditions associated with RAP140. RNO2 (Accession NM_033297) is another VGAM1885 host target gene. RNO2 BINDING SITE is HOST TARGET binding site found in the 5' untranslated region of mRNA encoded by RNO2, corresponding to a HOST TARGET binding site such as BINDING SITE I, BINDING SITE II or BINDING SITE III. Table 2 illustrates the complementarity of the nucleotide sequences of RNO2 BINDING SITE, designated SEQ ID:27126, to the nucleotide sequence of VGAM1885 RNA, herein designated VGAM RNA, also designated SEQ ID:4596.

Another function of VGAM1885 is therefore inhibition of RNO2 (Accession NM_033297). Accordingly, utilities of VGAM1885 include diagnosis, prevention and treatment of diseases and clinical conditions associated with RNO2. TACTILE (Accession NM_005816) is another VGAM1885 host target gene. TACTILE BINDING SITE is HOST TARGET binding site found in the 3' untranslated region of mRNA encoded by TACTILE, corresponding to a HOST TARGET binding site such as BINDING SITE I, BINDING SITE II or BINDING SITE III. Table 2 illustrates the complementarity of the nucleotide sequences of TACTILE BINDING SITE, designated SEQ ID:12413, to the nucleotide sequence of VGAM1885 RNA, herein designated VGAM RNA, also designated SEQ ID:4596.

Another function of VGAM1885 is therefore inhibition of TACTILE (Accession NM_005816). Accordingly, utilities of VGAM1885 include diagnosis, prevention and treatment of diseases and clinical conditions associated with TACTILE. LOC115073 (Accession XM_055193) is another VGAM1885 host target gene. LOC115073 BINDING SITE is HOST TARGET binding site found in the 3' untranslated region of mRNA encoded by LOC115073, corresponding to a HOST TARGET binding site such as BINDING SITE I, BINDING SITE II or BINDING SITE III. Table 2 illustrates the complementarity of the nucleotide sequences of LOC115073 BINDING SITE, designated SEQ ID:36241, to the nucleotide sequence of VGAM1885 RNA, herein designated VGAM RNA, also designated SEQ ID:4596.

Another function of VGAM1885 is therefore inhibition of LOC115073 (Accession XM_055193). Accordingly, utilities of VGAM1885 include diagnosis, prevention and treatment of diseases and clinical conditions associated with LOC115073. LOC116123 (Accession NM_138784) is another VGAM1885 host target gene. LOC116123 BINDING SITE is HOST TARGET binding site found in the 5' untranslated region of mRNA encoded by LOC116123, corresponding to a HOST TARGET binding site such as BINDING SITE I, BINDING SITE II or BINDING SITE III. Table 2 illustrates the complementarity of the nucleotide sequences of LOC116123 BINDING SITE, designated SEQ ID:29013, to the nucleotide sequence of VGAM1885 RNA, herein designated VGAM RNA, also designated SEQ ID:4596.

Another function of VGAM1885 is therefore inhibition of LOC116123 (Accession NM_138784). Accordingly, utilities of VGAM1885 include diagnosis, prevention and treatment of diseases and clinical conditions associated with LOC116123. LOC125929 (Accession XM_064872) is another VGAM1885 host target gene. LOC125929 BINDING SITE is HOST TARGET binding site found in the 3' untranslated region of mRNA encoded by LOC125929, corresponding to a HOST TARGET binding site such as BINDING SITE I, BINDING SITE II or BINDING SITE III. Table 2 illustrates the complementarity of the nucleotide sequences of LOC125929 BINDING SITE, designated SEQ ID:37267, to the nucleotide sequence of VGAM1885 RNA, herein designated VGAM RNA, also designated SEQ ID:4596.

Another function of VGAM1885 is therefore inhibition of LOC125929 (Accession XM_064872). Accordingly, utilities of VGAM1885 include diagnosis, prevention and treatment of diseases and clinical conditions associated with LOC125929. LOC142927 (Accession XM_084380) is another VGAM1885 host target gene. LOC142927 BINDING SITE is HOST TARGET binding site found in the 3' untranslated region of mRNA encoded by LOC142927, corresponding to a HOST TARGET binding site such as BINDING SITE I, BINDING SITE II or BINDING SITE III. Table 2 illustrates the complementarity of the nucleotide sequences of LOC142927 BINDING SITE, designated SEQ ID:37568, to the nucleotide sequence of VGAM1885 RNA, herein designated VGAM RNA, also designated SEQ ID:4596.

Another function of VGAM1885 is therefore inhibition of LOC142927 (Accession XM_084380). Accordingly, utilities of VGAM1885 include diagnosis, prevention and treatment of diseases and clinical conditions associated with LOC142927. LOC144893 (Accession XM_096687) is another VGAM1885 host target gene. LOC144893 BINDING SITE is HOST TARGET binding site found in the 5' untranslated region of mRNA encoded by LOC144893, corresponding to a HOST TARGET binding site such as BINDING SITE I, BINDING SITE II or BINDING SITE III. Table 2 illustrates the complementarity of the nucleotide sequences of LOC144893 BINDING SITE, designated SEQ ID:40460, to the nucleotide sequence of VGAM1885 RNA, herein designated VGAM RNA, also designated SEQ ID:4596.

Another function of VGAM1885 is therefore inhibition of LOC144893 (Accession XM_096687). Accordingly, utilities of VGAM1885 include diagnosis, prevention and treatment of diseases and clinical conditions associated with LOC144893. LOC145622 (Accession XM_085186) is another VGAM1885 host target gene. LOC145622 BINDING SITE is HOST TARGET binding site found in the 3' untranslated region of mRNA encoded by LOC145622, corresponding to a HOST TARGET binding site such as BINDING SITE I, BINDING SITE II or BINDING SITE III. Table 2 illustrates the complementarity of the nucleotide sequences of LOC145622 BINDING SITE, designated SEQ ID:37904, to the nucleotide sequence of VGAM1885 RNA, herein designated VGAM RNA, also designated SEQ ID:4596.

Another function of VGAM1885 is therefore inhibition of LOC145622 (Accession XM_085186). Accordingly, utilities of VGAM1885 include diagnosis, prevention and treatment of diseases and clinical conditions associated with LOC145622. LOC148811 (Accession XM_086326) is another VGAM1885 host target gene. LOC148811 BINDING SITE is HOST TARGET binding site found in the 3' untranslated region of mRNA encoded by LOC148811, corresponding to a HOST TARGET binding site such as BINDING SITE I, BINDING SITE II or BINDING SITE III. Table 2 illustrates the complementarity of the nucleotide sequences of LOC148811 BINDING SITE, designated SEQ ID:38599, to the nucleotide sequence of VGAM1885 RNA, herein designated VGAM RNA, also designated SEQ ID:4596.

Another function of VGAM1885 is therefore inhibition of LOC148811 (Accession XM_086326). Accordingly, utilities of VGAM1885 include diagnosis, prevention and treatment of diseases and clinical conditions associated with LOC148811. LOC158156 (Accession XM_088496) is another VGAM1885 host target gene. LOC158156 BINDING SITE is HOST TARGET binding site found in the 3' untranslated region of mRNA encoded by LOC158156, corresponding to a HOST TARGET binding site such as BINDING SITE I, BINDING SITE II or BINDING SITE III. Table 2 illustrates the complementarity of the nucleotide sequences of LOC158156 BINDING SITE, designated SEQ ID:39742, to the nucleotide sequence of VGAM1885 RNA, herein designated VGAM RNA, also designated SEQ ID:4596.

Another function of VGAM1885 is therefore inhibition of LOC158156 (Accession XM_088496). Accordingly, utilities of VGAM1885 include diagnosis, prevention and treatment of diseases and clinical conditions associated with LOC158156. LOC50999 (Accession NM_016040) is another VGAM1885 host target gene. LOC50999 BINDING SITE is HOST TARGET binding site found in the 3' untranslated region of mRNA encoded by LOC50999, corresponding to a HOST TARGET binding site such as BINDING SITE I, BINDING SITE II or BINDING SITE III. Table 2 illustrates the complementarity of the nucleotide sequences of LOC50999 BINDING SITE, designated SEQ ID:18114, to the nucleotide sequence of VGAM1885 RNA, herein designated VGAM RNA, also designated SEQ ID:4596.

Another function of VGAM1885 is therefore inhibition of LOC50999 (Accession NM_016040). Accordingly, utilities of VGAM1885 include diagnosis, prevention and treatment of diseases and clinical conditions associated with LOC50999. LOC91151 (Accession NM_033208) is another VGAM1885 host target gene. LOC91151 BINDING SITE is HOST TARGET binding site found in the 5' untranslated region of mRNA encoded by LOC91151, corresponding to a HOST TARGET binding site such as BINDING SITE I, BINDING SITE II or BINDING SITE III. Table 2 illustrates the complementarity of the nucleotide sequences of LOC91151 BINDING SITE, designated SEQ ID:27054, to the nucleotide sequence of VGAM1885 RNA, herein designated VGAM RNA, also designated SEQ ID:4596.

Another function of VGAM1885 is therefore inhibition of LOC91151 (Accession NM_033208). Accordingly, utilities of VGAM1885 include diagnosis, prevention and treatment of diseases and clinical conditions associated with LOC91151. FIG. 1 further provides a conceptual description of a novel bioinformatically detected viral gene of the present invention, referred to here as Viral Genomic Address Messenger 1886 (VGAM1886) viral gene, which modulates expression of respective host target genes thereof, the function and utility of which host target genes is known in the art.

VGAM1886 is a novel bioinformatically detected regulatory, non protein coding, viral micro RNA (miRNA) gene. The method by which VGAM1886 was detected is described hereinabove with reference to FIGS. 1-8.

VGAM1886 gene, herein designated VGAM GENE, is a viral gene contained in the genome of Newcastle Disease Virus. VGAM1886 host target gene, herein designated VGAM HOST TARGET GENE, is a human gene contained in the human genome.

VGAM1886 gene encodes a VGAM1886 precursor RNA, herein designated VGAM PRECURSOR RNA. Similar to other miRNA genes, and unlike most ordinary genes, VGAM1886 precursor RNA does not encode a protein. A nucleotide sequence identical or highly similar to the nucleotide sequence of VGAM1886 precursor RNA is designated SEQ ID:1872, and is provided hereinbelow with reference to the sequence listing part. Nucleotide sequence SEQ ID:1872 is located at position 7875 relative to the genome of Newcastle Disease Virus.

VGAM1886 precursor RNA folds onto itself, forming VGAM1886 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1886 folded precursor RNA into VGAM1886 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1886 RNA is designated SEQ ID:4597, and is provided hereinbelow with reference to the sequence listing part.

VGAM1886 host target gene, herein designated VGAM HOST TARGET GENE, encodes a corresponding messenger RNA, VGAM1886 host target RNA, herein designated VGAM HOST TARGET RNA. VGAM1886 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1886 RNA, herein designated VGAM RNA, binds complementarily to one or more host target binding sites located in untranslated regions of VGAM1886 host target RNA, herein designated VGAM HOST TARGET RNA. This complementary binding is due to the fact that the nucleotide sequence of VGAM1886 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1886 RNA, herein designated VGAM RNA, may have a different number of host target binding sites in untranslated regions of a VGAM1886 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1886 RNA, herein designated VGAM RNA, to host target binding sites on VGAM1886 host target RNA, herein designated VGAM HOST TARGET RNA, such as BINDING SITE I, BINDING SITE II and BINDING SITE III, inhibits translation of VGAM1886 host target RNA into VGAM1886 host target protein, herein designated VGAM HOST TARGET PROTEIN. VGAM host target protein is therefore outlined by a broken line.

It is appreciated that VGAM1886 host target gene, herein designated VGAM HOST TARGET GENE, in fact represents a plurality of VGAM1886 host target genes. The mRNA of each one of this plurality of VGAM1886 host target genes comprises one or more host target binding sites, each having a nucleotide sequence which is at least partly complementary to VGAM1886 RNA, herein designated VGAM RNA, and which when bound by VGAM1886 RNA causes inhibition of translation of respective one or more VGAM1886 host target proteins.

It is further appreciated by one skilled in the art that the mode of translational inhibition illustrated by FIG. 1 with specific reference to translational inhibition exerted by VGAM1886 gene, herein designated VGAM GENE, on one or more VGAM1886 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1886 is inhibition of expression of host target genes, as part of a novel viral mechanism of attacking a host. Accordingly, utilities of VGAM1886 include diagnosis, prevention and treatment of viral infection by Newcastle Disease Virus. Specific functions, and accordingly utilities, of VGAM1886 correlate with, and may be deduced from, the identity of the host target genes which VGAM1886 binds and inhibits, and the function of these host target genes, as elaborated hereinbelow.

Nucleotide sequences of the VGAM1886 precursor RNA, herein designated VGAM PRECURSOR RNA, and of the 'diced' VGAM1886 RNA, herein designated VGAM RNA, and a schematic representation of the secondary folding of VGAM1886 folded precursor RNA, herein designated VGAM FOLDED PRECURSOR RNA, of VGAM1886 are further described hereinbelow with reference to Table 1.

Nucleotide sequences of host target binding sites, such as BINDING SITE-I, BINDING SITE-II and BINDING SITE-III of FIG. 1, found on VGAM1886 host target RNA, and schematic representation of the complementarity of each of these host target binding sites to VGAM1886 RNA, herein designated VGAM RNA, are described hereinbelow with reference to Table 2.

As mentioned hereinabove with reference to FIG. 1, a function of VGAM1886 gene, herein designated VGAM is inhibition of expression of VGAM1886 target genes. It is appreciated that specific functions, and accordingly utilities, of VGAM1886 correlate with, and may be deduced from, the identity of the target genes which VGAM1886 binds and inhibits, and the function of these target genes, as elaborated hereinbelow.

Cadherin Related 23 (CDH23, Accession NM_022124) is a VGAM1886 host target gene. CDH23 BINDING SITE is HOST TARGET binding site found in the 3' untranslated region of mRNA encoded by CDH23, corresponding to a HOST TARGET binding site such as BINDING SITE I, BINDING SITE II or BINDING SITE III. Table 2 illustrates the complementarity of the nucleotide sequences of CDH23 BINDING SITE, designated SEQ ID:22668, to the nucleotide sequence of VGAM1886 RNA, herein designated VGAM RNA, also designated SEQ ID:4597.

A function of VGAM1886 is therefore inhibition of Cadherin Related 23 (CDH23, Accession NM_022124). Accordingly, utilities of VGAM1886 include diagnosis, prevention and treatment of diseases and clinical conditions associated with CDH23. TNF Receptor-associated Factor 1 (TRAF1, Accession NM_005658) is another VGAM1886 host target gene. TRAF1 BINDING SITE is HOST TARGET binding site found in the 3' untranslated region of mRNA encoded by TRAF1, corresponding to a HOST TARGET binding site such as BINDING SITE I, BINDING SITE II or BINDING SITE III. Table 2 illustrates the complementarity of the nucleotide sequences of TRAF1 BINDING SITE, designated SEQ ID:12200, to the nucleotide sequence of VGAM1886 RNA, herein designated VGAM RNA, also designated SEQ ID:4597.

Another function of VGAM1886 is therefore inhibition of TNF Receptor-associated Factor 1 (TRAF1, Accession NM_005658), a gene which signal transducer associated with the cytoplasmic domain of the 75 kda tumor necrosis factor receptor (tnf-r2). Accordingly, utilities of VGAM1886 include diagnosis, prevention and treatment of diseases and clinical conditions associated with TRAF1. The function of TRAF1 and its association with various diseases and clinical conditions, has been established by previous studies, as described hereinabove with reference to VGAM250. KIAA0893 (Accession NM_014969) is another VGAM1886 host target gene. KIAA0893 BINDING SITE is HOST TARGET binding site found in the 3' untranslated region of mRNA encoded by KIAA0893, corresponding to a HOST TARGET binding site such as BINDING SITE I, BINDING SITE II or BINDING SITE III. Table 2 illustrates the complementarity of the nucleotide sequences of KIAA0893 BINDING SITE, designated SEQ ID:17360, to the nucleotide sequence of VGAM1886 RNA, herein designated VGAM RNA, also designated SEQ ID:4597.

Another function of VGAM1886 is therefore inhibition of KIAA0893 (Accession NM_014969). Accordingly, utilities of VGAM1886 include diagnosis, prevention and treatment of diseases and clinical conditions associated with KIAA0893. LOC203350 (Accession XM_117536) is another VGAM1886 host target gene. LOC203350 BINDING SITE is HOST TARGET binding site found in the 3' untranslated region of mRNA encoded by LOC203350, corresponding to a HOST TARGET binding site such as BINDING SITE I, BINDING SITE II or BINDING SITE III. Table 2 illustrates the complementarity of the nucleotide sequences of LOC203350 BINDING SITE, designated SEQ ID:43531, to the nucleotide sequence of VGAM1886 RNA, herein designated VGAM RNA, also designated SEQ ID:4597.

Another function of VGAM1886 is therefore inhibition of LOC203350 (Accession XM_117536). Accordingly, utilities of VGAM1886 include diagnosis, prevention and treatment of diseases and clinical conditions associated with LOC203350. LOC254413 (Accession XM_173141) is another VGAM1886 host target gene. LOC254413 BIND- ING SITE is HOST TARGET binding site found in the 5' untranslated region of mRNA encoded by LOC254413, corresponding to a HOST TARGET binding site such as BINDING SITE I, BINDING SITE II or BINDING SITE III. Table 2 illustrates the complementarity of the nucleotide sequences of LOC254413 BINDING SITE, designated SEQ ID:46395, to the nucleotide sequence of VGAM1886 RNA, herein designated VGAM RNA, also designated SEQ ID:4597.

Another function of VGAM1886 is therefore inhibition of LOC254413 (Accession XM_173141). Accordingly, utilities of VGAM1886 include diagnosis, prevention and treatment of diseases and clinical conditions associated with LOC254413. LOC93017 (Accession XM_048772) is another VGAM1886 host target gene. LOC93017 BINDING SITE is HOST TARGET binding site found in the 3' untranslated region of mRNA encoded by LOC93017, corresponding to a HOST TARGET binding site such as BINDING SITE I, BINDING SITE II or BINDING SITE III. Table 2 illustrates the complementarity of the nucleotide sequences of LOC93017 BINDING SITE, designated SEQ ID:35253, to the nucleotide sequence of VGAM1886 RNA, herein designated VGAM RNA, also designated SEQ ID:4597.

Another function of VGAM1886 is therefore inhibition of LOC93017 (Accession XM_048772). Accordingly, utilities of VGAM1886 include diagnosis, prevention and treatment of diseases and clinical conditions associated with LOC93017. FIG. 1 further provides a conceptual description of a novel bioinformatically detected viral gene of the present invention, referred to here as Viral Genomic Address Messenger 1887 (VGAM1887) viral gene, which modulates expression of respective host target genes thereof, the function and utility of which host target genes is known in the art.

VGAM1887 is a novel bioinformatically detected regulatory, non protein coding, viral micro RNA (miRNA) gene. The method by which VGAM1887 was detected is described hereinabove with reference to FIGS. 1-8.

VGAM1887 gene, herein designated VGAM GENE, is a viral gene contained in the genome of Newcastle Disease Virus. VGAM1887 host target gene, herein designated VGAM HOST TARGET GENE, is a human gene contained in the human genome.

VGAM1887 gene encodes a VGAM1887 precursor RNA, herein designated VGAM PRECURSOR RNA. Similar to other miRNA genes, and unlike most ordinary genes, VGAM1887 precursor RNA does not encode a protein. A nucleotide sequence identical or highly similar to the nucleotide sequence of VGAM1887 precursor RNA is designated SEQ ID:1873, and is provided hereinbelow with reference to the sequence listing part. Nucleotide sequence SEQ ID:1873 is located at position 4276 relative to the genome of Newcastle Disease Virus.

VGAM1887 precursor RNA folds onto itself, forming VGAM1887 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1887 folded precursor RNA into VGAM1887 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 85%) nucleotide sequence of VGAM1887 RNA is designated SEQ ID:4598, and is provided hereinbelow with reference to the sequence listing part.

VGAM1887 host target gene, herein designated VGAM HOST TARGET GENE, encodes a corresponding messenger RNA, VGAM1887 host target RNA, herein designated VGAM HOST TARGET RNA. VGAM1887 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1887 RNA, herein designated VGAM RNA, binds complementarily to one or more host target binding sites located in untranslated regions of VGAM1887 host target RNA, herein designated VGAM HOST TARGET RNA. This complementary binding is due to the fact that the nucleotide sequence of VGAM1887 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1887 RNA, herein designated VGAM RNA, may have a different number of host target binding sites in untranslated regions of a VGAM1887 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1887 RNA, herein designated VGAM RNA, to host target binding sites on VGAM1887 host target RNA, herein designated VGAM HOST TARGET RNA, such as BINDING SITE I, BINDING SITE II and BINDING SITE III, inhibits translation of VGAM1887 host target RNA into VGAM1887 host target protein, herein designated VGAM HOST TARGET PROTEIN. VGAM host target protein is therefore outlined by a broken line.

It is appreciated that VGAM1887 host target gene, herein designated VGAM HOST TARGET GENE, in fact represents a plurality of VGAM1887 host target genes. The mRNA of each one of this plurality of VGAM1887 host target genes comprises one or more host target binding sites, each having a nucleotide sequence which is at least partly complementary to VGAM1887 RNA, herein designated VGAM RNA, and which when bound by VGAM1887 RNA causes inhibition of translation of respective one or more VGAM1887 host target proteins.

It is further appreciated by one skilled in the art that the mode of translational inhibition illustrated by FIG. 1 with specific reference to translational inhibition exerted by VGAM1887 gene, herein designated VGAM GENE, on one or more VGAM1887 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1887 is inhibition of expression of host target genes, as part of a novel viral mechanism of attacking a host. Accordingly, utilities of VGAM1887 include diagnosis, prevention and treatment of viral infection by Newcastle Disease Virus. Specific functions, and accordingly utilities, of VGAM1887 correlate with, and may be deduced from, the identity of the host target genes which VGAM1887 binds and inhibits, and the function of these host target genes, as elaborated hereinbelow.

Nucleotide sequences of the VGAM1887 precursor RNA, herein designated VGAM PRECURSOR RNA, and of the 'diced' VGAM1887 RNA, herein designated VGAM RNA, and a schematic representation of the secondary folding of VGAM1887 folded precursor RNA, herein designated VGAM FOLDED PRECURSOR RNA, of VGAM1887 are further described hereinbelow with reference to Table 1.

Nucleotide sequences of host target binding sites, such as BINDING SITE-I, BINDING SITE-II and BINDING SITE-III of FIG. 1, found on VGAM1887 host target RNA, and schematic representation of the complementarity of each of these host target binding sites to VGAM1887 RNA, herein designated VGAM RNA, are described hereinbelow with reference to Table 2.

As mentioned hereinabove with reference to FIG. 1, a function of VGAM1887 gene, herein designated VGAM is inhibition of expression of VGAM1887 target genes. It is appreciated that specific functions, and accordingly utilities, of VGAM1887 correlate with, and may be deduced from, the identity of the target genes which VGAM1887 binds and inhibits, and the function of these target genes, as elaborated hereinbelow.

GATA Binding Protein 2 (GATA2, Accession NM_002050) is a VGAM1887 host target gene. GATA2 BINDING SITE is HOST TARGET binding site found in the 3' untranslated region of mRNA encoded by GATA2, corresponding to a HOST TARGET binding site such as BINDING SITE I, BINDING SITE II or BINDING SITE III. Table 2 illustrates the complementarity of the nucleotide sequences of GATA2 BINDING SITE, designated SEQ ID:7802, to the nucleotide sequence of VGAM1887 RNA, herein designated VGAM RNA, also designated SEQ ID:4598.

A function of VGAM1887 is therefore inhibition of GATA Binding Protein 2 (GATA2, Accession NM_002050). Accordingly, utilities of VGAM1887 include diagnosis, prevention and treatment of diseases and clinical conditions associated with GATA2. MGC2306 (Accession NM_032638) is another VGAM1887 host target gene. MGC2306 BINDING SITE is HOST TARGET binding site found in the 3' untranslated region of mRNA encoded by MGC2306, corresponding to a HOST TARGET binding site such as BINDING SITE I, BINDING SITE II or BINDING SITE III. Table 2 illustrates the complementarity of the nucleotide sequences of MGC2306 BINDING SITE, designated SEQ ID:26351, to the nucleotide sequence of VGAM1887 RNA, herein designated VGAM RNA, also designated SEQ ID:4598.

Another function of VGAM1887 is therefore inhibition of MGC2306 (Accession NM_032638). Accordingly, utilities of VGAM1887 include diagnosis, prevention and treatment of diseases and clinical conditions associated with MGC2306. FIG. 1 further provides a conceptual description of a novel bioinformatically detected viral gene of the present invention, referred to here as Viral Genomic Address Messenger 1888 (VGAM1888) viral gene, which modulates expression of respective host target genes thereof, the function and utility of which host target genes is known in the art.

VGAM1888 is a novel bioinformatically detected regulatory, non protein coding, viral micro RNA (miRNA) gene. The method by which VGAM1888 was detected is described hereinabove with reference to FIGS. 1-8.

VGAM1888 gene, herein designated VGAM GENE, is a viral gene contained in the genome of Newcastle Disease Virus. VGAM1888 host target gene, herein designated VGAM HOST TARGET GENE, is a human gene contained in the human genome.

VGAM1888 gene encodes a VGAM1888 precursor RNA, herein designated VGAM PRECURSOR RNA. Similar to other miRNA genes, and unlike most ordinary genes, VGAM1888 precursor RNA does not encode a protein. A nucleotide sequence identical or highly similar to the nucleotide sequence of VGAM1888 precursor RNA is designated SEQ ID:1874, and is provided hereinbelow with reference to the sequence listing part. Nucleotide sequence SEQ ID:1874 is located at position 12826 relative to the genome of Newcastle Disease Virus.

VGAM1888 precursor RNA folds onto itself, forming VGAM1888 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1888 folded precursor RNA into VGAM1888 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM1888 RNA is designated SEQ ID:4599, and is provided hereinbelow with reference to the sequence listing part.

VGAM1888 host target gene, herein designated VGAM HOST TARGET GENE, encodes a corresponding messenger RNA, VGAM1888 host target RNA, herein designated VGAM HOST TARGET RNA. VGAM1888 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1888 RNA, herein designated VGAM RNA, binds complementarily to one or more host target binding sites located in untranslated regions of VGAM1888 host target RNA, herein designated VGAM HOST TARGET RNA. This complementary binding is due to the fact that the nucleotide sequence of VGAM1888 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1888 RNA, herein designated VGAM RNA, may have a different number of host target binding sites in untranslated regions of a VGAM1888 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1888 RNA, herein designated VGAM RNA, to host target binding sites on VGAM1888 host target RNA, herein designated VGAM HOST TARGET RNA, such as BINDING SITE I, BINDING SITE II and BINDING SITE III, inhibits translation of VGAM1888 host target RNA into VGAM1888 host target protein, herein designated VGAM HOST TARGET PROTEIN. VGAM host target protein is therefore outlined by a broken line.

It is appreciated that VGAM1888 host target gene, herein designated VGAM HOST TARGET GENE, in fact represents a plurality of VGAM1888 host target genes. The mRNA of each one of this plurality of VGAM1888 host target genes comprises one or more host target binding sites, each having a nucleotide sequence which is at least partly complementary to VGAM1888 RNA, herein designated VGAM RNA, and which when bound by VGAM1888 RNA causes inhibition of translation of respective one or more VGAM1888 host target proteins.

It is further appreciated by one skilled in the art that the mode of translational inhibition illustrated by FIG. 1 with specific reference to translational inhibition exerted by VGAM1888 gene, herein designated VGAM GENE, on one or more VGAM1888 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1888 is inhibition of expression of host target genes, as part of a novel viral mechanism of attacking a host. Accordingly, utilities of VGAM1888 include diagnosis, prevention and treatment of viral infection by Newcastle Disease Virus. Specific functions, and accordingly utilities, of VGAM1888 correlate with, and may be deduced from, the identity of the host target genes which VGAM1888 binds and inhibits, and the function of these host target genes, as elaborated hereinbelow.

Nucleotide sequences of the VGAM1888 precursor RNA, herein designated VGAM PRECURSOR RNA, and of the 'diced' VGAM1888 RNA, herein designated VGAM RNA, and a schematic representation of the secondary folding of VGAM1888 folded precursor RNA, herein designated VGAM FOLDED PRECURSOR RNA, of VGAM1888 are further described hereinbelow with reference to Table 1.

Nucleotide sequences of host target binding sites, such as BINDING SITE-I, BINDING SITE-II and BINDING SITE-III of FIG. 1, found on VGAM1888 host target RNA, and schematic representation of the complementarity of each of these host target binding sites to VGAM1888 RNA, herein designated VGAM RNA, are described hereinbelow with reference to Table 2.

As mentioned hereinabove with reference to FIG. 1, a function of VGAM1888 gene, herein designated VGAM is inhibition of expression of VGAM1888 target genes. It is appreciated that specific functions, and accordingly utilities, of VGAM1888 correlate with, and may be deduced from, the identity of the target genes which VGAM1888 binds and inhibits, and the function of these target genes, as elaborated hereinbelow.

CD69 Antigen (p60, early T-cell activation antigen) (CD69, Accession NM_001781) is a VGAM1888 host target gene. CD69 BINDING SITE is HOST TARGET binding site found in the 3' untranslated region of mRNA encoded by CD69, corresponding to a HOST TARGET binding site such as BINDING SITE I, BINDING SITE II or BINDING SITE III. Table 2 illustrates the complementarity of the nucleotide sequences of CD69 BINDING SITE, designated SEQ ID:7538, to the nucleotide sequence of VGAM1888 RNA, herein designated VGAM RNA, also designated SEQ ID:4599.

A function of VGAM1888 is therefore inhibition of CD69 Antigen (p60, early T-cell activation antigen) (CD69, Accession NM_001781), a gene which is involved in lymphocyte proliferation and functions as a signal transmitting receptor. Accordingly, utilities of VGAM1888 include diagnosis, prevention and treatment of diseases and clinical conditions associated with CD69. The function of CD69 has been established by previous studies. The activation of T lymphocytes, both in vivo and in vitro, induces the expression of CD69. This molecule, which appears to be the earliest inducible cell surface glycoprotein acquired during lymphoid activation, is involved in lymphocyte proliferation and functions as a signal transmitting receptor in lymphocytes, natural killer (NK) cells, and platelets. Cambiaggi et al. (1992) produced and characterized interspecies somatic cell hybrids between human activated mature T cells and mouse BW5147 thymoma cells. A preferential segregation of human chromosomes was observed in the hybrids. They found in clones a coexpression of CD4 and CD69 antigens. Molecular and karyotypic studies of the hybrids demonstrated that the locus encoding CD69 maps to human chromosome 12 as does that for CD4 (OMIM Ref. No. 186940). Although the expression of CD69 antigen is an early event after T-lymphocyte activation and rapidly declines in the absence of exogenous stimuli, in the hybrids they developed the expression was constitutive, similar to what is found in early thymocyte precursors and mature thymocytes. The finding suggested a dominant influence of the thymus-derived mouse tumor cell genome in controlling the constitutive expression of CD69. Lopez-Cabrera et al. (1993) demonstrated that a cDNA for CD69 showed a single open reading frame of 597 bp, predicting a 199-amino acid protein of type II membrane topology. The CD69 clone hybridized to a 1.7-kb mRNA species, which was rapidly induced and degraded after lymphocyte stimulation, consistent with the presence of rapid degradation signals at the 3-prime untranslated region. By somatic cell hybrid DNA analysis and fluorescence in situ hybridization, Lopez-Cabrera et al. (1993) assigned the CD69 gene to 12p13-p12. Protein sequence homology search demonstrated that CD69 is a member of the same superfamily of type II transmembrane receptors as natural killer cell lectin (NKG2; 161555), which also maps to chromosome 12.

Full details of the abovementioned studies are described in the following publications, the disclosure of which are hereby incorporated by reference:

Cambiaggi, C.; Scupoli, M. T.; Cestari, T.; Gerosa, F.; Carra, G.; Tridente, G.; Accolla, R. S.: Constitutive expression of CD69 in interspecies T-cell hybrids and locus assignment to human chromosome 12. Immunogenetics 36:117-120, 1992; and Lopez-Cabrera, M.; Santis, A. G.; Fernandez-Ruiz, E.; Blacher, R.; Esch, F.; Sanchez-Mateos, P.; Sanchez-Madrid, F.: Molecular cloning, expression, and chromosomal localization of the.

Further studies establishing the function and utilities of CD69 are found in John Hopkins OMIM database record ID 107273, and in sited publications numbered 12426-12427 listed in the bibliography section hereinbelow, which are also hereby incorporated by reference. CAT56 (Accession NM_025263) is another VGAM1888 host target gene. CAT56 BINDING SITE is HOST TARGET binding site found in the 3' untranslated region of mRNA encoded by CAT56, corresponding to a HOST TARGET binding site such as BINDING SITE I, BINDING SITE II or BINDING SITE III. Table 2 illustrates the complementarity of the nucleotide sequences of CAT56 BINDING SITE, designated SEQ ID:24931, to the nucleotide sequence of VGAM1888 RNA, herein designated VGAM RNA, also designated SEQ ID:4599.

Another function of VGAM1888 is therefore inhibition of CAT56 (Accession NM_025263). Accordingly, utilities of VGAM1888 include diagnosis, prevention and treatment of diseases and clinical conditions associated with CAT56. FLJ20527 (Accession NM_017863) is another VGAM1888 host target gene. FLJ20527 BINDING SITE is HOST TARGET binding site found in the 3' untranslated region of mRNA encoded by FLJ20527, corresponding to a HOST TARGET binding site such as BINDING SITE I, BINDING SITE II or BINDING SITE III. Table 2 illustrates the complementarity of the nucleotide sequences of FLJ20527 BINDING SITE, designated SEQ ID:19541, to the nucleotide sequence of VGAM1888 RNA, herein designated VGAM RNA, also designated SEQ ID:4599.

Another function of VGAM1888 is therefore inhibition of FLJ20527 (Accession NM_017863). Accordingly, utilities of VGAM1888 include diagnosis, prevention and treatment of diseases and clinical conditions associated with FLJ20527. G Protein-coupled Receptor 105 (GPR105, Accession NM_014879) is another VGAM1888 host target gene. GPR105 BINDING SITE is HOST TARGET binding site found in the 5' untranslated region of mRNA encoded by GPR105, corresponding to a HOST TARGET binding site such as BINDING SITE I, BINDING SITE II or BINDING SITE III. Table 2 illustrates the complementarity of the nucleotide sequences of GPR105 BINDING SITE, designated SEQ ID:17021, to the nucleotide sequence of VGAM1888 RNA, herein designated VGAM RNA, also designated SEQ ID:4599.

Another function of VGAM1888 is therefore inhibition of G Protein-coupled Receptor 105 (GPR105, Accession NM_014879). Accordingly, utilities of VGAM1888 include diagnosis, prevention and treatment of diseases and clinical conditions associated with GPR105. LOC144893 (Accession XM_096687) is another VGAM1888 host target gene. LOC144893 BINDING SITE is HOST TARGET binding site found in the 3' untranslated region of mRNA encoded by LOC144893, corresponding to a HOST TARGET binding site such as BINDING SITE I, BINDING SITE II or BINDING SITE III. Table 2 illustrates the complementarity of the nucleotide sequences of LOC144893 BINDING SITE, designated SEQ ID:40463, to the nucleotide sequence of VGAM1888 RNA, herein designated VGAM RNA, also designated SEQ ID:4599.

Another function of VGAM1888 is therefore inhibition of LOC144893 (Accession XM_096687). Accordingly, utilities of VGAM1888 include diagnosis, prevention and treatment of diseases and clinical conditions associated with LOC144893. LOC170261 (Accession XM_093214) is another VGAM1888 host target gene. LOC170261 BINDING SITE is HOST TARGET binding site found in the 5' untranslated region of mRNA encoded by LOC170261, corresponding to a HOST TARGET binding site such as BINDING SITE I, BINDING SITE II or BINDING SITE III. Table 2 illustrates the complementarity of the nucleotide sequences of LOC170261 BINDING SITE, designated SEQ ID:40184, to the nucleotide sequence of VGAM1888 RNA, herein designated VGAM RNA, also designated SEQ ID:4599.

Another function of VGAM1888 is therefore inhibition of LOC170261 (Accession XM_093214). Accordingly, utilities of VGAM1888 include diagnosis, prevention and treatment of diseases and clinical conditions associated with LOC170261. LOC257051 (Accession XM_172800) is another VGAM1888 host target gene. LOC257051 BINDING SITE is HOST TARGET binding site found in the 5' untranslated region of mRNA encoded by LOC257051, corresponding to a HOST TARGET binding site such as BINDING SITE I, BINDING SITE II or BINDING SITE III. Table 2 illustrates the complementarity of the nucleotide sequences of LOC257051 BINDING SITE, designated SEQ ID:46084, to the nucleotide sequence of VGAM1888 RNA, herein designated VGAM RNA, also designated SEQ ID:4599.

Another function of VGAM1888 is therefore inhibition of LOC257051 (Accession XM_172800). Accordingly, utilities of VGAM1888 include diagnosis, prevention and treatment of diseases and clinical conditions associated with LOC257051. FIG. 1 further provides a conceptual description of a novel bioinformatically detected viral gene of the present invention, referred to here as Viral Genomic Address Messenger 1889 (VGAM1889) viral gene, which modulates expression of respective host target genes thereof, the function and utility of which host target genes is known in the art.

VGAM1889 is a novel bioinformatically detected regulatory, non protein coding, viral micro RNA (miRNA) gene. The method by which VGAM1889 was detected is described hereinabove with reference to FIGS. 1-8.

VGAM1889 gene, herein designated VGAM GENE, is a viral gene contained in the genome of Newcastle Disease Virus. VGAM1889 host target gene, herein designated VGAM HOST TARGET GENE, is a human gene contained in the human genome.

VGAM1889 gene encodes a VGAM1889 precursor RNA, herein designated VGAM PRECURSOR RNA. Similar to other miRNA genes, and unlike most ordinary genes, VGAM1889 precursor RNA does not encode a protein. A nucleotide sequence identical or highly similar to the nucleotide sequence of VGAM1889 precursor RNA is designated SEQ ID:1875, and is provided hereinbelow with reference to the sequence listing part. Nucleotide sequence SEQ ID:1875 is located at position 48 relative to the genome of Newcastle Disease Virus.

VGAM1889 precursor RNA folds onto itself, forming VGAM1889 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1889 folded precursor RNA into VGAM1889 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1889 RNA is designated SEQ ID:4600, and is provided hereinbelow with reference to the sequence listing part.

VGAM1889 host target gene, herein designated VGAM HOST TARGET GENE, encodes a corresponding messenger RNA, VGAM1889 host target RNA, herein designated VGAM HOST TARGET RNA. VGAM1889 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1889 RNA, herein designated VGAM RNA, binds complementarily to one or more host target binding sites located in untranslated regions of VGAM1889 host target RNA, herein designated VGAM HOST TARGET RNA. This complementary binding is due to the fact that the nucleotide sequence of VGAM1889 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1889 RNA, herein designated VGAM RNA, may have a different number of host target binding sites in untranslated regions of a VGAM1889 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1889 RNA, herein designated VGAM RNA, to host target binding sites on VGAM1889 host target RNA, herein designated VGAM HOST TARGET RNA, such as BINDING SITE I, BINDING SITE II and BINDING SITE III, inhibits translation of VGAM1889 host target RNA into VGAM1889 host target protein, herein designated VGAM HOST TARGET PROTEIN. VGAM host target protein is therefore outlined by a broken line.

It is appreciated that VGAM1889 host target gene, herein designated VGAM HOST TARGET GENE, in fact represents a plurality of VGAM1889 host target genes. The mRNA of each one of this plurality of VGAM1889 host target genes comprises one or more host target binding sites, each having a nucleotide sequence which is at least partly complementary to VGAM1889 RNA, herein designated VGAM RNA, and which when bound by VGAM1889 RNA causes inhibition of translation of respective one or more VGAM1889 host target proteins.

It is further appreciated by one skilled in the art that the mode of translational inhibition illustrated by FIG. 1 with specific reference to translational inhibition exerted by VGAM1889 gene, herein designated VGAM GENE, on one or more VGAM1889 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1889 is inhibition of expression of host target genes, as part of a novel viral mechanism of attacking a host. Accordingly, utilities of VGAM1889 include diagnosis, prevention and treatment of viral infection by Newcastle Disease Virus. Specific functions, and accordingly utilities, of VGAM1889 correlate with, and may be deduced from, the identity of the host target genes which VGAM1889 binds and inhibits, and the function of these host target genes, as elaborated hereinbelow.

Nucleotide sequences of the VGAM1889 precursor RNA, herein designated VGAM PRECURSOR RNA, and of the 'diced' VGAM1889 RNA, herein designated VGAM RNA, and a schematic representation of the secondary folding of VGAM1889 folded precursor RNA, herein designated VGAM FOLDED PRECURSOR RNA, of VGAM1889 are further described hereinbelow with reference to Table 1.

Nucleotide sequences of host target binding sites, such as BINDING SITE-I, BINDING SITE-II and BINDING SITE-III of FIG. 1, found on VGAM1889 host target RNA, and schematic representation of the complementarity of each of these host target binding sites to VGAM1889 RNA, herein designated VGAM RNA, are described hereinbelow with reference to Table 2.

As mentioned hereinabove with reference to FIG. 1, a function of VGAM1889 gene, herein designated VGAM is inhibition of expression of VGAM1889 target genes. It is appreciated that specific functions, and accordingly utilities, of VGAM1889 correlate with, and may be deduced from, the identity of the target genes which VGAM1889 binds and inhibits, and the function of these target genes, as elaborated hereinbelow.

Plexin A2 (PLXNA2, Accession NM_025179) is a VGAM1889 host target gene. PLXNA2 BINDING SITE is HOST TARGET binding site found in the 3' untranslated region of mRNA encoded by PLXNA2, corresponding to a HOST TARGET binding site such as BINDING SITE I, BINDING SITE II or BINDING SITE III. Table 2 illustrates the complementarity of the nucleotide sequences of PLXNA2 BINDING SITE, designated SEQ ID:24813, to the nucleotide sequence of VGAM1889 RNA, herein designated VGAM RNA, also designated SEQ ID:4600.

A function of VGAM1889 is therefore inhibition of Plexin A2 (PLXNA2, Accession NM_025179), a gene which is a transmembrane protein. Accordingly, utilities of VGAM1889 include diagnosis, prevention and treatment of diseases and clinical conditions associated with PLXNA2. The function of PLXNA2 and its association with various diseases and clinical conditions, has been established by previous studies, as described hereinabove with reference to VGAM538. Solute Carrier Family 7 (cationic amino acid transporter, y+ system), Member 8 (SLC7A8, Accession NM_012244) is another VGAM1889 host target gene. SLC7A8 BINDING SITE is HOST TARGET binding site found in the 5' untranslated region of mRNA encoded by SLC7A8, corresponding to a HOST TARGET binding site such as BINDING SITE I, BINDING SITE II or BINDING SITE III. Table 2 illustrates the complementarity of the nucleotide sequences of SLC7A8 BINDING SITE, designated SEQ ID:14550, to the nucleotide sequence of VGAM1889 RNA, herein designated VGAM RNA, also designated SEQ ID:4600.

Another function of VGAM1889 is therefore inhibition of Solute Carrier Family 7 (cationic amino acid transporter, y+ system), Member 8 (SLC7A8, Accession NM_012244), a gene which helps mediate transport of large and small neutral amino acids. Accordingly, utilities of VGAM1889 include diagnosis, prevention and treatment of diseases and clinical conditions associated with SLC7A8. The function of SLC7A8 and its association with various diseases and clinical conditions, has been established by previous studies, as described hereinabove with reference to VGAM1263. DKFZP434F091 (Accession NM_015453) is another VGAM1889 host target gene. DKFZP434F091 BINDING SITE is HOST TARGET binding site found in the 3' untranslated region of mRNA encoded by DKFZP434F091, corresponding to a HOST TARGET binding site such as BINDING SITE I, BINDING SITE II or BINDING SITE III. Table 2 illustrates the complementarity of the nucleotide sequences of DKFZP434F091 BINDING SITE, designated SEQ ID:17736, to the nucleotide sequence of VGAM1889 RNA, herein designated VGAM RNA, also designated SEQ ID:4600.

Another function of VGAM1889 is therefore inhibition of DKFZP434F091 (Accession NM_015453). Accordingly, utilities of VGAM1889 include diagnosis, prevention and treatment of diseases and clinical conditions associated with DKFZP434F091. FLJ13111 (Accession NM_025082) is another VGAM1889 host target gene. FLJ13111 BINDING SITE is HOST TARGET binding site found in the 3' untranslated region of mRNA encoded by FLJ13111, corresponding to a HOST TARGET binding site such as BINDING SITE I, BINDING SITE II or BINDING SITE III. Table 2 illustrates the complementarity of the nucleotide sequences of FLJ13111 BINDING SITE, designated SEQ ID:24684, to the nucleotide sequence of VGAM1889 RNA, herein designated VGAM RNA, also designated SEQ ID:4600.

Another function of VGAM1889 is therefore inhibition of FLJ13111 (Accession NM_025082). Accordingly, utilities of VGAM1889 include diagnosis, prevention and treatment of diseases and clinical conditions associated with FLJ13111. FLJ20312 (Accession NM_017761) is another VGAM1889 host target gene. FLJ20312 BINDING SITE is HOST TARGET binding site found in the 3' untranslated region of mRNA encoded by FLJ20312, corresponding to a HOST TARGET binding site such as BINDING SITE I, BINDING SITE II or BINDING SITE III. Table 2 illustrates the complementarity of the nucleotide sequences of FLJ20312 BINDING SITE, designated SEQ ID:19373, to the nucleotide sequence of VGAM1889 RNA, herein designated VGAM RNA, also designated SEQ ID:4600.

Another function of VGAM1889 is therefore inhibition of FLJ20312 (Accession NM_017761). Accordingly, utilities of VGAM1889 include diagnosis, prevention and treatment of diseases and clinical conditions associated with FLJ20312. KIAA0776 (Accession XM_035970) is another VGAM1889 host target gene. KIAA0776 BINDING SITE is HOST TARGET binding site found in the 3' untranslated region of mRNA encoded by KIAA0776, corresponding to a HOST TARGET binding site such as BINDING SITE I, BINDING SITE II or BINDING SITE III. Table 2 illustrates the complementarity of the nucleotide sequences of KIAA0776 BINDING SITE, designated SEQ ID:32362, to the nucleotide sequence of VGAM1889 RNA, herein designated VGAM RNA, also designated SEQ ID:4600.

Another function of VGAM1889 is therefore inhibition of KIAA0776 (Accession XM_035970). Accordingly, utilities of VGAM1889 include diagnosis, prevention and treatment of diseases and clinical conditions associated with KIAA0776. KIAA1040 (Accession XM_051091) is another VGAM1889 host target gene. KIAA1040 BINDING SITE is HOST TARGET binding site found in the 3' untranslated region of mRNA encoded by KIAA1040, corresponding to a HOST TARGET binding site such as BINDING SITE I, BINDING SITE II or BINDING SITE III. Table 2 illustrates the complementarity of the nucleotide sequences of KIAA1040 BINDING SITE, designated SEQ ID:35738, to the nucleotide sequence of VGAM1889 RNA, herein designated VGAM RNA, also designated SEQ ID:4600.

Another function of VGAM1889 is therefore inhibition of KIAA1040 (Accession XM_051091). Accordingly, utilities of VGAM1889 include diagnosis, prevention and treatment of diseases and clinical conditions associated with KIAA1040. KIAA1956 (Accession XM_085836) is another VGAM1889 host target gene. KIAA1956 BINDING SITE is HOST TARGET binding site found in the 3' untranslated region of mRNA encoded by KIAA1956, corresponding to a HOST TARGET binding site such as BINDING SITE I, BINDING SITE II or BINDING SITE III. Table 2 illustrates the complementarity of the nucleotide sequences of KIAA1956 BINDING SITE, designated SEQ ID:38361, to the nucleotide sequence of VGAM1889 RNA, herein designated VGAM RNA, also designated SEQ ID:4600.

Another function of VGAM1889 is therefore inhibition of KIAA1956 (Accession XM_085836). Accordingly, utilities of VGAM1889 include diagnosis, prevention and treatment of diseases and clinical conditions associated with KIAA1956. Mitogen-activated Protein Kinase Kinase Kinase 2 (MAP3K2, Accession NM_006609) is another VGAM1889 host target gene. MAP3K2 BINDING SITE is HOST TARGET binding site found in the 3' untranslated region of mRNA encoded by MAP3K2, corresponding to a HOST TARGET binding site such as BINDING SITE I, BINDING SITE II or BINDING SITE III. Table 2 illustrates the complementarity of the nucleotide sequences of MAP3K2 BINDING SITE, designated SEQ ID:13384, to the nucleotide sequence of VGAM1889 RNA, herein designated VGAM RNA, also designated SEQ ID:4600.

Another function of VGAM1889 is therefore inhibition of Mitogen-activated Protein Kinase Kinase Kinase 2 (MAP3K2, Accession NM_006609). Accordingly, utilities of VGAM1889 include diagnosis, prevention and treatment of diseases and clinical conditions associated with MAP3K2. Phospholipase A2, Group XII (PLA2G12, Accession NM_030821) is another VGAM1889 host target gene. PLA2G12 BINDING SITE is HOST TARGET binding site found in the 3' untranslated region of mRNA encoded by PLA2G12, corresponding to a HOST TARGET binding site such as BINDING SITE I, BINDING SITE II or BINDING SITE III. Table 2 illustrates the complementarity of the nucleotide sequences of PLA2G12 BINDING SITE, designated SEQ ID:25151, to the nucleotide sequence of VGAM1889 RNA, herein designated VGAM RNA, also designated SEQ ID:4600.

Another function of VGAM1889 is therefore inhibition of Phospholipase A2, Group XII (PLA2G12, Accession NM_030821). Accordingly, utilities of VGAM1889 include diagnosis, prevention and treatment of diseases and clinical conditions associated with PLA2G12. FIG. 1 further provides a conceptual description of a novel bioinformatically detected viral gene of the present invention, referred to here as Viral Genomic Address Messenger 1890 (VGAM1890) viral gene, which modulates expression of respective host target genes thereof, the function and utility of which host target genes is known in the art.

VGAM1890 is a novel bioinformatically detected regulatory, non protein coding, viral micro RNA (miRNA) gene. The method by which VGAM1890 was detected is described hereinabove with reference to FIGS. 1-8.

VGAM1890 gene, herein designated VGAM GENE, is a viral gene contained in the genome of Newcastle Disease Virus. VGAM1890 host target gene, herein designated VGAM HOST TARGET GENE, is a human gene contained in the human genome.

VGAM1890 gene encodes a VGAM1890 precursor RNA, herein designated VGAM PRECURSOR RNA. Similar to other miRNA genes, and unlike most ordinary genes, VGAM1890 precursor RNA does not encode a protein. A nucleotide sequence identical or highly similar to the nucleotide sequence of VGAM1890 precursor RNA is designated SEQ ID:1876, and is provided hereinbelow with reference to the sequence listing part. Nucleotide sequence SEQ ID:1876 is located at position 14381 relative to the genome of Newcastle Disease Virus.

VGAM1890 precursor RNA folds onto itself, forming VGAM1890 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1890 folded precursor RNA into VGAM1890 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1890 RNA is designated SEQ ID:4601, and is provided hereinbelow with reference to the sequence listing part.

VGAM1890 host target gene, herein designated VGAM HOST TARGET GENE, encodes a corresponding messenger RNA, VGAM1890 host target RNA, herein designated VGAM HOST TARGET RNA. VGAM1890 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1890 RNA, herein designated VGAM RNA, binds complementarily to one or more host target binding sites located in untranslated regions of VGAM1890 host target RNA, herein designated VGAM HOST TARGET RNA. This complementary binding is due to the fact that the nucleotide sequence of VGAM1890 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1890 RNA, herein designated VGAM RNA, may have a different number of host target binding sites in untranslated regions of a VGAM1890 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1890 RNA, herein designated VGAM RNA, to host target binding sites on VGAM1890 host target RNA, herein designated VGAM HOST TARGET RNA, such as BINDING SITE I, BINDING SITE II and BINDING SITE III, inhibits translation of VGAM1890 host target RNA into VGAM1890 host target protein, herein designated VGAM HOST TARGET PROTEIN. VGAM host target protein is therefore outlined by a broken line.

It is appreciated that VGAM1890 host target gene, herein designated VGAM HOST TARGET GENE, in fact represents a plurality of VGAM1890 host target genes. The mRNA of each one of this plurality of VGAM1890 host target genes comprises one or more host target binding sites, each having a nucleotide sequence which is at least partly complementary to VGAM1890 RNA, herein designated VGAM RNA, and which when bound by VGAM1890 RNA causes inhibition of translation of respective one or more VGAM1890 host target proteins.

It is further appreciated by one skilled in the art that the mode of translational inhibition illustrated by FIG. 1 with specific reference to translational inhibition exerted by VGAM1890 gene, herein designated VGAM GENE, on one or more VGAM1890 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1890 is inhibition of expression of host target genes, as part of a novel viral mechanism of attacking a host. Accordingly, utilities of VGAM1890 include diagnosis, prevention and treatment of viral infection by Newcastle Disease Virus. Specific functions, and accordingly utilities, of VGAM1890 correlate with, and may be deduced from, the identity of the host target genes which VGAM1890 binds and inhibits, and the function of these host target genes, as elaborated hereinbelow.

Nucleotide sequences of the VGAM1890 precursor RNA, herein designated VGAM PRECURSOR RNA, and of the 'diced' VGAM1890 RNA, herein designated VGAM RNA, and a schematic representation of the secondary folding of VGAM1890 folded precursor RNA, herein designated VGAM FOLDED PRECURSOR RNA, of VGAM1890 are further described hereinbelow with reference to Table 1.

Nucleotide sequences of host target binding sites, such as BINDING SITE-I, BINDING SITE-II and BINDING SITE-III of FIG. 1, found on VGAM1890 host target RNA, and schematic representation of the complementarity of each of these host target binding sites to VGAM1890 RNA, herein designated VGAM RNA, are described hereinbelow with reference to Table 2.

As mentioned hereinabove with reference to FIG. 1, a function of VGAM1890 gene, herein designated VGAM is inhibition of expression of VGAM1890 target genes. It is appreciated that specific functions, and accordingly utilities, of VGAM1890 correlate with, and may be deduced from, the identity of the target genes which VGAM1890 binds and inhibits, and the function of these target genes, as elaborated hereinbelow.

Protein Kinase, Interferon-inducible Double Stranded RNA Dependent (PRKR, Accession NM_002759) is a VGAM1890 host target gene. PRKR BINDING SITE is HOST TARGET binding site found in the 5' untranslated region of mRNA encoded by PRKR, corresponding to a HOST TARGET binding site such as BINDING SITE I, BINDING SITE II or BINDING SITE III. Table 2 illustrates the complementarity of the nucleotide sequences of PRKR BINDING SITE, designated SEQ ID:8645, to the nucleotide sequence of VGAM1890 RNA, herein designated VGAM RNA, also designated SEQ ID:4601.

A function of VGAM1890 is therefore inhibition of Protein Kinase, Interferon-inducible Double Stranded RNA Dependent (PRKR, Accession NM_002759), a gene which catalyze the phosphorylation of the alpha subunit of eif2. Accordingly, utilities of VGAM1890 include diagnosis, prevention and treatment of diseases and clinical conditions associated with PRKR. The function of PRKR has been established by previous studies. Ben-Asouli et al. (2002) showed that human gamma-interferon (IFNG; 147570) mRNA uses local activation of PKR in the cell to control its own translation yield. IFNG mRNA was found to activate PKR through a pseudoknot in its 5-prime untranslated region. Mutations that impaired pseudoknot stability reduced the ability to activate PKR and strongly increased the translation efficiency of IFNG mRNA. Nonphosphorylatable mutant eIF2-alpha, knockout of PKR, and the PKR inhibitors 2-aminopurine, transdominant-negative PKR, or vaccinia E3L correspondingly enhanced translation of IFNG mRNA. The potential to form the pseudoknot was found to be phylogenetically conserved. Ben-Asouli et al. (2002) proposed that the RNA pseudoknot acts to adjust translation of IFNG mRNA to the PKR level expressed in the cell. Barber et al. (1993) mapped the PRKR gene to 2p21 by in situ hybridization. The corresponding mouse gene was mapped to chromosome 17 (band E2) by the same method. Squire et al. (1993) assigned the PRKR gene to the boundary between 2p22 and 2p21 by fluorescence in situ hybridization. Taylor et al. (1999) studied the mechanism underlying the resistance of hepatitis C virus (HCV) to interferon. They demonstrated that the HCV envelope protein E2 contains a sequence identical with phosphorylation sites of the interferon-inducible protein kinase PKR and the translation initiation factor EIF2-alpha, a target of PKR. E2 inhibited the kinase activity of PKR and blocked its inhibitory effect on protein synthesis and cell growth. This interaction of E2 in PKR may be one mechanism by which HCV circumvents the antiviral effect of interferon. Taylor et al. (1999) hypothesized that another potential outcome of PKR inhibition is the promotion of cell growth which may contribute to HCV-associated hepatocellular carcinoma. Huntington disease (OMIM Ref. No. 143100) is a neurodegenerative disorder caused by a trinucleotide repeat expansion within the huntingtin gene, resulting in generation of a polyglutamine tract in the protein product. Peel et al. (2001) showed that PKR preferentially bound mutant huntingtin RNA transcripts immobilized on streptavidin columns that had been incubated with human brain extracts. Immunohistochemical studies demonstrated that PKR was present in its activated form in both human Huntington autopsy material and brain tissue derived from Huntington yeast artificial chromosome transgenic mice. The increased immunolocalization of the activated kinase was more pronounced in areas most affected by the disease. The authors suggested a role for PKR activation in the Huntington disease process.

Full details of the abovementioned studies are described in the following publications, the disclosure of which are hereby incorporated by reference:

Ben-Asouli, Y.; Banai, Y.; Pel-Or, Y.; Shir, A.; Kaempfer, R.: Human interferon-gamma mRNA autoregulates its translation through a pseudoknot that activates the interferon-inducible protein kinase PKR. Cell 108:221-232, 2002; and Peel, A. L.; Rao, R. V.; Cottrell, B. A.; Hayden, M. R.; Ellerby, L. M.; Bredesen, D. E.: Double-stranded RNA-dependent protein kinase, PKR, binds preferentially to Huntington's diseas.

Further studies establishing the function and utilities of PRKR are found in John Hopkins OMIM database record ID 176871, and in sited publications numbered 5778, 5779-5780, 602 and 10341-10343 listed in the bibliography section hereinbelow, which are also hereby incorporated by reference. FLJ14117 (Accession NM_022777) is another VGAM1890 host target gene. FLJ14117 BINDING SITE is HOST TARGET binding site found in the 3' untranslated region of mRNA encoded by FLJ14117, corresponding to a HOST TARGET binding site such as BINDING SITE I, BINDING SITE II or BINDING SITE III. Table 2 illustrates the complementarity of the nucleotide sequences of FLJ14117 BINDING SITE, designated SEQ ID:23048, to the nucleotide sequence of VGAM1890 RNA, herein designated VGAM RNA, also designated SEQ ID:4601.

Another function of VGAM1890 is therefore inhibition of FLJ14117 (Accession NM_022777). Accordingly, utilities of VGAM1890 include diagnosis, prevention and treatment of diseases and clinical conditions associated with FLJ14117. KIAA1464 (Accession XM_043069) is another VGAM1890 host target gene. KIAA1464 BINDING SITE is HOST TARGET binding site found in the 3' untranslated region of mRNA encoded by KIAA1464, corresponding to a HOST TARGET binding site such as BINDING SITE I, BINDING SITE II or BINDING SITE III. Table 2 illustrates the complementarity of the nucleotide sequences of KIAA1464 BINDING SITE, designated SEQ ID:33880, to the nucleotide sequence of VGAM1890 RNA, herein designated VGAM RNA, also designated SEQ ID:4601.

Another function of VGAM1890 is therefore inhibition of KIAA1464 (Accession XM_043069). Accordingly, utilities of VGAM1890 include diagnosis, prevention and treatment of diseases and clinical conditions associated with KIAA1464. Nuclear Receptor Subfamily 1, Group I, Member 3 (NR1I3, Accession NM_005122) is another VGAM1890 host target gene. NR1I3 BINDING SITE is HOST TARGET binding site found in the 5' untranslated region of mRNA encoded by NR1I3, corresponding to a HOST TARGET binding site such as BINDING SITE I, BINDING SITE II or BINDING SITE III. Table 2 illustrates the complementarity of the nucleotide sequences of NR1I3 BINDING SITE, designated SEQ ID:11606, to the nucleotide sequence of VGAM1890 RNA, herein designated VGAM RNA, also designated SEQ ID:4601.

Another function of VGAM1890 is therefore inhibition of Nuclear Receptor Subfamily 1, Group I, Member 3 (NR1I3, Accession NM_005122). Accordingly, utilities of VGAM1890 include diagnosis, prevention and treatment of diseases and clinical conditions associated with NR1I3. NY-REN-25 (Accession XM_027116) is another VGAM1890 host target gene. NY-REN-25 BINDING SITE is HOST TARGET binding site found in the 5' untranslated region of mRNA encoded by NY-REN-25, corresponding to a HOST TARGET binding site such as BINDING SITE I, BINDING SITE II or BINDING SITE III. Table 2 illustrates the complementarity of the nucleotide sequences of NY-REN-25 BINDING SITE, designated SEQ ID:30418, to the nucleotide sequence of VGAM1890 RNA, herein designated VGAM RNA, also designated SEQ ID:4601.

Another function of VGAM1890 is therefore inhibition of NY-REN-25 (Accession XM_027116). Accordingly, utilities of VGAM1890 include diagnosis, prevention and treatment of diseases and clinical conditions associated with NY-REN-25. LOC199858 (Accession XM_114040) is another VGAM1890 host target gene. LOC199858 BINDING SITE is HOST TARGET binding site found in the 3' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42632, to the nucleotide sequence of VGAM1890 RNA, herein designated VGAM RNA, also designated SEQ ID:4601.

Another function of VGAM1890 is therefore inhibition of LOC199858 (Accession XM_114040). Accordingly, utilities of VGAM1890 include diagnosis, prevention and treatment of diseases and clinical conditions associated with LOC199858. FIG. 1 further provides a conceptual description of a novel bioinformatically detected viral gene of the present invention, referred to here as Viral Genomic Address Messenger 1891 (VGAM1891) viral gene, which modulates expression of respective host target genes thereof, the function and utility of which host target genes is known in the art.

VGAM1891 is a novel bioinformatically detected regulatory, non protein coding, viral micro RNA (miRNA) gene. The method by which VGAM1891 was detected is described hereinabove with reference to FIGS. 1-8.

VGAM1891 gene, herein designated VGAM GENE, is a viral gene contained in the genome of Newcastle Disease Virus. VGAM1891 host target gene, herein designated VGAM HOST TARGET GENE, is a human gene contained in the human genome.

VGAM1891 gene encodes a VGAM1891 precursor RNA, herein designated VGAM PRECURSOR RNA. Similar to other miRNA genes, and unlike most ordinary genes, VGAM1891 precursor RNA does not encode a protein. A nucleotide sequence identical or highly similar to the nucleotide sequence of VGAM1891 precursor RNA is designated SEQ ID:1877, and is provided hereinbelow with reference to the sequence listing part. Nucleotide sequence SEQ ID:1877 is located at position 8373 relative to the genome of Newcastle Disease Virus.

VGAM1891 precursor RNA folds onto itself, forming VGAM1891 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1891 folded precursor RNA into VGAM1891 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM1891 RNA is designated SEQ ID:4602, and is provided hereinbelow with reference to the sequence listing part.

VGAM1891 host target gene, herein designated VGAM HOST TARGET GENE, encodes a corresponding messenger RNA, VGAM1891 host target RNA, herein designated VGAM HOST TARGET RNA. VGAM1891 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1891 RNA, herein designated VGAM RNA, binds complementarily to one or more host target binding sites located in untranslated regions of VGAM1891 host target RNA, herein designated VGAM HOST TARGET RNA. This complementary binding is due to the fact that the nucleotide sequence of VGAM1891 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1891 RNA, herein designated VGAM RNA, may have a different number of host target binding sites in untranslated regions of a VGAM1891 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1891 RNA, herein designated VGAM RNA, to host target binding sites on VGAM1891 host target RNA, herein designated VGAM HOST TARGET RNA, such as BINDING SITE I, BINDING SITE II and BINDING SITE III, inhibits translation of VGAM1891 host target RNA into VGAM1891 host target protein, herein designated VGAM HOST TARGET PROTEIN. VGAM host target protein is therefore outlined by a broken line.

It is appreciated that VGAM1891 host target gene, herein designated VGAM HOST TARGET GENE, in fact represents a plurality of VGAM1891 host target genes. The mRNA of each one of this plurality of VGAM1891 host target genes comprises one or more host target binding sites, each having a nucleotide sequence which is at least partly complementary to VGAM1891 RNA, herein designated VGAM RNA, and which when bound by VGAM1891 RNA causes inhibition of translation of respective one or more VGAM1891 host target proteins.

It is further appreciated by one skilled in the art that the mode of translational inhibition illustrated by FIG. 1 with specific reference to translational inhibition exerted by VGAM1891 gene, herein designated VGAM GENE, on one or more VGAM1891 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1891 is inhibition of expression of host target genes, as part of a novel viral mechanism of attacking a host. Accordingly, utilities of VGAM1891 include diagnosis, prevention and treatment of viral infection by Newcastle Disease Virus. Specific functions, and accordingly utilities, of VGAM1891 correlate with, and may be deduced from, the identity of the host target genes which VGAM1891 binds and inhibits, and the function of these host target genes, as elaborated hereinbelow.

Nucleotide sequences of the VGAM1891 precursor RNA, herein designated VGAM PRECURSOR RNA, and of the 'diced' VGAM1891 RNA, herein designated VGAM RNA, and a schematic representation of the secondary folding of VGAM1891 folded precursor RNA, herein designated VGAM FOLDED PRECURSOR RNA, of VGAM1891 are further described hereinbelow with reference to Table 1.

Nucleotide sequences of host target binding sites, such as BINDING SITE-I, BINDING SITE-II and BINDING SITE-III of FIG. 1, found on VGAM1891 host target RNA, and schematic representation of the complementarity of each of these host target binding sites to VGAM1891 RNA, herein designated VGAM RNA, are described hereinbelow with reference to Table 2.

As mentioned hereinabove with reference to FIG. 1, a function of VGAM1891 gene, herein designated VGAM is inhibition of expression of VGAM1891 target genes. It is appreciated that specific functions, and accordingly utilities, of VGAM1891 correlate with, and may be deduced from, the identity of the target genes which VGAM1891 binds and inhibits, and the function of these target genes, as elaborated hereinbelow.

ATP10C (Accession NM_024490) is a VGAM1891 host target gene. ATP10C BINDING SITE is HOST TARGET binding site found in the 3' untranslated region of mRNA encoded by ATP10C, corresponding to a HOST TARGET binding site such as BINDING SITE I, BINDING SITE II or BINDING SITE III. Table 2 illustrates the complementarity of the nucleotide sequences of ATP10C BINDING SITE, designated SEQ ID:23686, to the nucleotide sequence of VGAM1891 RNA, herein designated VGAM RNA, also designated SEQ ID:4602.

A function of VGAM1891 is therefore inhibition of ATP10C (Accession NM_024490), a gene which is phosphorylated in their intermediate state, drives uphill transport of ions across membranes. Accordingly, utilities of VGAM1891 include diagnosis, prevention and treatment of diseases and clinical conditions associated with ATP10C. The function of ATP10C and its association with various diseases and clinical conditions, has been established by previous studies, as described hereinabove with reference to VGAM801. Collagen, Type XIII, Alpha 1 (COL13A1, Accession NM_080799) is another VGAM1891 host target gene. COL13A1 BINDING SITE1 through COL13A1 BINDING SITE7 are HOST TARGET binding sites found in untranslated regions of mRNA encoded by COL13A1, corresponding to HOST TARGET binding sites such as BINDING SITE I, BINDING SITE II or BINDING SITE III. Table 2 illustrates the complementarity of the nucleotide sequences of COL13A1 BINDING SITE1 through COL13A1 BINDING SITE7, designated SEQ ID:28065, SEQ ID:28067, SEQ ID:28069, SEQ ID:28071, SEQ ID:28073, SEQ ID:28075 and SEQ ID:11702 respectively, to the nucleotide sequence of VGAM1891 RNA, herein designated VGAM RNA, also designated SEQ ID:4602.

Another function of VGAM1891 is therefore inhibition of Collagen, Type XIII, Alpha 1 (COL13A1, Accession NM_080799), a gene which is specific for basement membranes. Accordingly, utilities of VGAM1891 include diagnosis, prevention and treatment of diseases and clinical conditions associated with COL13A1. The function of COL13A1 and its association with various diseases and clinical conditions, has been established by previous studies, as described hereinabove with reference to VGAM1680. KIAA0157 (Accession NM_032182) is another VGAM1891 host target gene. KIAA0157 BINDING SITE is HOST TARGET binding site found in the 3' untranslated region of mRNA encoded by KIAA0157, corresponding to a HOST TARGET binding site such as BINDING SITE I, BINDING SITE II or BINDING SITE III. Table 2 illustrates the complementarity of the nucleotide sequences of KIAA0157 BINDING SITE, designated SEQ ID:25896, to the nucleotide sequence of VGAM1891 RNA, herein designated VGAM RNA, also designated SEQ ID:4602.

Another function of VGAM1891 is therefore inhibition of KIAA0157 (Accession NM_032182). Accordingly, utilities of VGAM1891 include diagnosis, prevention and treatment of diseases and clinical conditions associated with KIAA0157. KIAA1193 (Accession XM_041843) is another VGAM1891 host target gene. KIAA1193 BINDING SITE is HOST TARGET binding site found in the 3' untranslated region of mRNA encoded by KIAA1193, corresponding to a HOST TARGET binding site such as BINDING SITE I, BINDING SITE II or BINDING SITE III. Table 2 illustrates the complementarity of the nucleotide sequences of KIAA1193 BINDING SITE, designated SEQ ID:33584, to the nucleotide sequence of VGAM1891 RNA, herein designated VGAM RNA, also designated SEQ ID:4602.

Another function of VGAM1891 is therefore inhibition of KIAA1193 (Accession XM_041843). Accordingly, utilities of VGAM1891 include diagnosis, prevention and treatment of diseases and clinical conditions associated with KIAA1193. MGC3248 (Accession NM_032486) is another VGAM1891 host target gene. MGC3248 BINDING SITE is HOST TARGET binding site found in the 3' untranslated region of mRNA encoded by MGC3248, corresponding to a HOST TARGET binding site such as BINDING SITE I, BINDING SITE II or BINDING SITE III. Table 2 illustrates the complementarity of the nucleotide sequences of MGC3248 BINDING SITE, designated SEQ ID:26235, to the nucleotide sequence of VGAM1891 RNA, herein designated VGAM RNA, also designated SEQ ID:4602.

Another function of VGAM1891 is therefore inhibition of MGC3248 (Accession NM_032486). Accordingly, utilities of VGAM1891 include diagnosis, prevention and treatment of diseases and clinical conditions associated with MGC3248. PGCP (Accession NM_016134) is another VGAM1891 host target gene. PGCP BINDING SITE is HOST TARGET binding site found in the 5' untranslated region of mRNA encoded by PGCP, corresponding to a HOST TARGET binding site such as BINDING SITE I, BINDING SITE II or BINDING SITE III. Table 2 illustrates the complementarity of the nucleotide sequences of PGCP BINDING SITE, designated SEQ ID:18220, to the nucleotide sequence of VGAM1891 RNA, herein designated VGAM RNA, also designated SEQ ID:4602.

Another function of VGAM1891 is therefore inhibition of PGCP (Accession NM_016134). Accordingly, utilities of VGAM1891 include diagnosis, prevention and treatment of diseases and clinical conditions associated with PGCP. PRO0529 (Accession NM_014074) is another VGAM1891 host target gene. PRO0529 BINDING SITE is HOST TARGET binding site found in the 3" untranslated region of mRNA encoded by PRO0529, corresponding to a HOST TARGET binding site such as BINDING SITE I, BINDING SITE II or BINDING SITE III. Table 2 illustrates the complementarity of the nucleotide sequences of PRO0529 BINDING SITE, designated SEQ ID:15297, to the nucleotide sequence of VGAM1891 RNA, herein designated VGAM RNA, also designated SEQ ID:4602.

Another function of VGAM1891 is therefore inhibition of PRO0529 (Accession NM_014074). Accordingly, utilities of VGAM1891 include diagnosis, prevention and treatment of diseases and clinical conditions associated with PRO0529. LOC149706 (Accession XM_097718) is another VGAM1891 host target gene. LOC149706 BINDING SITE is HOST TARGET binding site found in the 5' untranslated region of mRNA encoded by LOC149706, corresponding to a HOST TARGET binding site such as BINDING SITE I, BINDING SITE II or BINDING SITE III. Table 2 illustrates the complementarity of the nucleotide sequences of LOC149706 BINDING SITE, designated SEQ ID:41057, to the nucleotide sequence of VGAM1891 RNA, herein designated VGAM RNA, also designated SEQ ID:4602.

Another function of VGAM1891 is therefore inhibition of LOC149706 (Accession XM_097718). Accordingly, utilities of VGAM1891 include diagnosis, prevention and treatment of diseases and clinical conditions associated with LOC149706. LOC152373 (Accession XM_087449) is another VGAM1891 host target gene. LOC152373 BINDING SITE is HOST TARGET binding site found in the 5' untranslated region of mRNA encoded by LOC152373, corresponding to a HOST TARGET binding site such as BINDING SITE I, BINDING SITE II or BINDING SITE III. Table 2 illustrates the complementarity of the nucleotide sequences of LOC152373 BINDING SITE, designated SEQ ID:39271, to the nucleotide sequence of VGAM1891 RNA, herein designated VGAM RNA, also designated SEQ ID:4602.

Another function of VGAM1891 is therefore inhibition of LOC152373 (Accession XM_087449). Accordingly, utilities of VGAM1891 include diagnosis, prevention and treatment of diseases and clinical conditions associated with LOC152373. LOC221477 (Accession XM_166397) is another VGAM1891 host target gene. LOC221477 BINDING SITE is HOST TARGET binding site found in the 3' untranslated region of mRNA encoded by LOC221477, corresponding to a HOST TARGET binding site such as BINDING SITE I, BINDING SITE II or BINDING SITE III. Table 2 illustrates the complementarity of the nucleotide sequences of LOC221477 BINDING SITE, designated SEQ ID:44256, to the nucleotide sequence of VGAM1891 RNA, herein designated VGAM RNA, also designated SEQ ID:4602.

Another function of VGAM1891 is therefore inhibition of LOC221477 (Accession XM_166397). Accordingly, utilities of VGAM1891 include diagnosis, prevention and treatment of diseases and clinical conditions associated with LOC221477. LOC90167 (Accession XM_029570) is another VGAM1891 host target gene. LOC90167 BINDING SITE is HOST TARGET binding site found in the 3' untranslated region of mRNA encoded by LOC90167, corresponding to a HOST TARGET binding site such as BINDING SITE I, BINDING SITE II or BINDING SITE III. Table 2 illustrates the complementarity of the nucleotide sequences of LOC90167 BINDING SITE, designated SEQ ID:30905, to the nucleotide sequence of VGAM1891 RNA, herein designated VGAM RNA, also designated SEQ ID:4602.

Another function of VGAM1891 is therefore inhibition of LOC90167 (Accession XM_029570). Accordingly, utilities of VGAM1891 include diagnosis, prevention and treatment of diseases and clinical conditions associated with LOC90167. FIG. 1 further provides a conceptual description of a novel bioinformatically detected viral gene of the present invention, referred to here as Viral Genomic Address Messenger 1892 (VGAM1892) viral gene, which modulates expression of respective host target genes thereof, the function and utility of which host target genes is known in the art.

VGAM1892 is a novel bioinformatically detected regulatory, non protein coding, viral micro RNA (miRNA) gene. The method by which VGAM1892 was detected is described hereinabove with reference to FIGS. 1-8.

VGAM1892 gene, herein designated VGAM GENE, is a viral gene contained in the genome of Newcastle Disease Virus. VGAM1892 host target gene, herein designated VGAM HOST TARGET GENE, is a human gene contained in the human genome.

VGAM1892 gene encodes a VGAM1892 precursor RNA, herein designated VGAM PRECURSOR RNA. Similar to other miRNA genes, and unlike most ordinary genes, VGAM1892 precursor RNA does not encode a protein. A nucleotide sequence identical or highly similar to the nucleotide sequence of VGAM1892 precursor RNA is designated SEQ ID:1878, and is provided hereinbelow with reference to the sequence listing part. Nucleotide sequence SEQ ID:1878 is located at position 13642 relative to the genome of Newcastle Disease Virus.

VGAM1892 precursor RNA folds onto itself, forming VGAM1892 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1892 folded precursor RNA into VGAM1892 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM1892 RNA is designated SEQ ID:4603, and is provided hereinbelow with reference to the sequence listing part.

VGAM1892 host target gene, herein designated VGAM HOST TARGET GENE, encodes a corresponding messenger RNA, VGAM1892 host target RNA, herein designated VGAM HOST TARGET RNA. VGAM1892 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1892 RNA, herein designated VGAM RNA, binds complementarily to one or more host target binding sites located in untranslated regions of VGAM1892 host target RNA, herein designated VGAM HOST TARGET RNA. This complementary binding is due to the fact that the nucleotide sequence of VGAM1892 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1892 RNA, herein designated VGAM RNA, may have a different number of host target binding sites in untranslated regions of a VGAM1892 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1892 RNA, herein designated VGAM RNA, to host target binding sites on VGAM1892 host target RNA, herein designated VGAM HOST TARGET RNA, such as BINDING SITE I, BINDING SITE II and BINDING SITE III, inhibits translation of VGAM1892 host target RNA into VGAM1892 host target protein, herein designated VGAM HOST TARGET PRO- TEIN. VGAM host target protein is therefore outlined by a broken line.

It is appreciated that VGAM1892 host target gene, herein designated VGAM HOST TARGET GENE, in fact represents a plurality of VGAM1892 host target genes. The mRNA of each one of this plurality of VGAM1892 host target genes comprises one or more host target binding sites, each having a nucleotide sequence which is at least partly complementary to VGAM1892 RNA, herein designated VGAM RNA, and which when bound by VGAM1892 RNA causes inhibition of translation of respective one or more VGAM1892 host target proteins.

It is further appreciated by one skilled in the art that the mode of translational inhibition illustrated by FIG. 1 with specific reference to translational inhibition exerted by VGAM1892 gene, herein designated VGAM GENE, on one or more VGAM1892 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1892 is inhibition of expression of host target genes, as part of a novel viral mechanism of attacking a host. Accordingly, utilities of VGAM1892 include diagnosis, prevention and treatment of viral infection by Newcastle Disease Virus. Specific functions, and accordingly utilities, of VGAM1892 correlate with, and may be deduced from, the identity of the host target genes which VGAM1892 binds and inhibits, and the function of these host target genes, as elaborated hereinbelow.

Nucleotide sequences of the VGAM1892 precursor RNA, herein designated VGAM PRECURSOR RNA, and of the 'diced' VGAM1892 RNA, herein designated VGAM RNA, and a schematic representation of the secondary folding of VGAM1892 folded precursor RNA, herein designated VGAM FOLDED PRECURSOR RNA, of VGAM1892 are further described hereinbelow with reference to Table 1.

Nucleotide sequences of host target binding sites, such as BINDING SITE-I, BINDING SITE-II and BINDING SITE-III of FIG. 1, found on VGAM1892 host target RNA, and schematic representation of the complementarity of each of these host target binding sites to VGAM1892 RNA, herein designated VGAM RNA, are described hereinbelow with reference to Table 2.

As mentioned hereinabove with reference to FIG. 1, a function of VGAM1892 gene, herein designated VGAM is inhibition of expression of VGAM1892 target genes. It is appreciated that specific functions, and accordingly utilities, of VGAM1892 correlate with, and may be deduced from, the identity of the target genes which VGAM1892 binds and inhibits, and the function of these target genes, as elaborated hereinbelow.

Apoptotic Protease Activating Factor (APAF1, Accession NM_001160) is a VGAM1892 host target gene. APAF1 BINDING SITE1 and APAF1 BINDING SITE2 are HOST TARGET binding sites found in untranslated regions of mRNA encoded by APAF1, corresponding to HOST TARGET binding sites such as BINDING SITE I, BINDING SITE II or BINDING SITE III. Table 2 illustrates the complementarity of the nucleotide sequences of APAF1 BINDING SITE1 and APAF1 BINDING SITE2, designated SEQ ID:6828 and SEQ ID:14867 respectively, to the nucleotide sequence of VGAM1892 RNA, herein designated VGAM RNA, also designated SEQ ID:4603.

A function of VGAM1892 is therefore inhibition of Apoptotic Protease Activating Factor (APAF1, Accession NM_001160), a gene which functions in the mitochondrial apoptotic pathway that leads to caspase 9 dependent activation of caspase 3. Accordingly, utilities of VGAM1892 include diagnosis, prevention and treatment of diseases and clinical conditions associated with APAF1. The function of APAF1 and its association with various diseases and clinical conditions, has been established by previous studies, as described hereinabove with reference to VGAM552. Aquaporin 6, Kidney Specific (AQP6, Accession NM_053286) is another VGAM1892 host target gene. AQP6 BINDING SITE1 and AQP6 BINDING SITE2 are HOST TARGET binding sites found in untranslated regions of mRNA encoded by AQP6, corresponding to HOST TARGET binding sites such as BINDING SITE I, BINDING SITE II or BINDING SITE III. Table 2 illustrates the complementarity of the nucleotide sequences of AQP6 BINDING SITE1 and AQP6 BINDING SITE2, designated SEQ ID:27620 and SEQ ID:14511 respectively, to the nucleotide sequence of VGAM1892 RNA, herein designated VGAM RNA, also designated SEQ ID:4603.

Another function of VGAM1892 is therefore inhibition of Aquaporin 6, Kidney Specific (AQP6, Accession NM_053286), a gene which participates in distinct physiologic function such as glomerular filtration, tubular endocytosis, and acid-base metabolism. Accordingly, utilities of VGAM1892 include diagnosis, prevention and treatment of diseases and clinical conditions associated with AQP6. The function of AQP6 and its association with various diseases and clinical conditions, has been established by previous studies, as described hereinabove with reference to VGAM340. SORCS1 (Accession NM_052918) is another VGAM1892 host target gene. SORCS1 BINDING SITE is HOST TARGET binding site found in the 3' untranslated region of mRNA encoded by SORCS1, corresponding to a HOST TARGET binding site such as BINDING SITE I, BINDING SITE II or BINDING SITE III. Table 2 illustrates the complementarity of the nucleotide sequences of SORCS1 BINDING SITE, designated SEQ ID:27486, to the nucleotide sequence of VGAM1892 RNA, herein designated VGAM RNA, also designated SEQ ID:4603.

Another function of VGAM1892 is therefore inhibition of SORCS1 (Accession NM_052918). Accordingly, utilities of VGAM1892 include diagnosis, prevention and treatment of diseases and clinical conditions associated with SORCS1. Zic Family Member 3 Heterotaxy 1 (odd-paired homolog, Drosophila) (ZIC3, Accession NM_003413) is another VGAM1892 host target gene. ZIC3 BINDING SITE is HOST TARGET binding site found in the 3' untranslated region of mRNA encoded by ZIC3, corresponding to a HOST TARGET binding site such as BINDING SITE I, BINDING SITE II or BINDING SITE III. Table 2 illustrates the complementarity of the nucleotide sequences of ZIC3 BINDING SITE, designated SEQ ID:9451, to the nucleotide sequence of VGAM1892 RNA, herein designated VGAM RNA, also designated SEQ ID:4603.

Another function of VGAM1892 is therefore inhibition of Zic Family Member 3 Heterotaxy 1 (odd-paired homolog, Drosophila) (ZIC3, Accession NM_003413). Accordingly, utilities of VGAM1892 include diagnosis, prevention and treatment of diseases and clinical conditions associated with ZIC3. D21S2056E (Accession NM_003683) is another VGAM1892 host target gene. D21S2056E BINDING SITE is HOST TARGET binding site found in the 3' untranslated region of mRNA encoded by D21S2056E, corresponding to a HOST TARGET binding site such as BINDING SITE I, BINDING SITE II or BINDING SITE III. Table 2 illustrates the complementarity of the nucleotide sequences of D21S2056E BINDING SITE, designated SEQ ID:9789, to the nucleotide sequence of VGAM1892 RNA, herein designated VGAM RNA, also designated SEQ ID:4603.

Another function of VGAM1892 is therefore inhibition of D21S2056E (Accession NM_003683). Accordingly, utilities of VGAM1892 include diagnosis, prevention and treatment of diseases and clinical conditions associated with D21S2056E. FLJ12154 (Accession NM_021944) is another VGAM1892 host target gene. FLJ12154 BINDING SITE is HOST TARGET binding site found in the 5' untranslated region of mRNA encoded by FLJ12154, corresponding to a HOST TARGET binding site such as BINDING SITE I, BINDING SITE II or BINDING SITE III. Table 2 illustrates the complementarity of the nucleotide sequences of FLJ12154 BINDING SITE, designated SEQ ID:22463, to the nucleotide sequence of VGAM1892 RNA, herein designated VGAM RNA, also designated SEQ ID:4603.

Another function of VGAM1892 is therefore inhibition of FLJ12154 (Accession NM_021944). Accordingly, utilities of VGAM1892 include diagnosis, prevention and treatment of diseases and clinical conditions associated with FLJ12154. Syndecan 3 (N-syndecan) (SDC3, Accession NM_014654) is another VGAM1892 host target gene. SDC3 BINDING SITE is HOST TARGET binding site found in the 3' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16089, to the nucleotide sequence of VGAM1892 RNA, herein designated VGAM RNA, also designated SEQ ID:4603.

Another function of VGAM1892 is therefore inhibition of Syndecan 3 (N-syndecan) (SDC3, Accession NM_014654). Accordingly, utilities of VGAM1892 include diagnosis, prevention and treatment of diseases and clinical conditions associated with SDC3. Sema Domain, Immunoglobulin Domain (Ig), Transmembrane Domain (TM) and Short Cytoplasmic Domain, (semaphorin) 4C (SEMA4C, Accession NM_017789) is another VGAM1892 host target gene. SEMA4C BINDING SITE is HOST TARGET binding site found in the 3' untranslated region of mRNA encoded by SEMA4C, corresponding to a HOST TARGET binding site such as BINDING SITE I, BINDING SITE II or BINDING SITE III. Table 2 illustrates the complementarity of the nucleotide sequences of SEMA4C BINDING SITE, designated SEQ ID:19420, to the nucleotide sequence of VGAM1892 RNA, herein designated VGAM RNA, also designated SEQ ID:4603.

Another function of VGAM1892 is therefore inhibition of Sema Domain, Immunoglobulin Domain (Ig), Transmembrane Domain (TM) and Short Cytoplasmic Domain, (semaphorin) 4C (SEMA4C, Accession NM_017789). Accordingly, utilities of VGAM1892 include diagnosis, prevention and treatment of diseases and clinical conditions associated with SEMA4C. LOC130074 (Accession XM_072228) is another VGAM1892 host target gene. LOC130074 BINDING SITE is HOST TARGET binding site found in the 3' untranslated region of mRNA encoded by LOC130074, corresponding to a HOST TARGET binding site such as BINDING SITE I, BINDING SITE II or BINDING SITE III. Table 2 illustrates the complementarity of the nucleotide sequences of LOC130074 BINDING SITE, designated SEQ ID:37469, to the nucleotide sequence of VGAM1892 RNA, herein designated VGAM RNA, also designated SEQ ID:4603.

Another function of VGAM1892 is therefore inhibition of LOC130074 (Accession XM_072228). Accordingly, utilities of VGAM1892 include diagnosis, prevention and treatment of diseases and clinical conditions associated with LOC130074. LOC144681 (Accession XM_096654) is another VGAM1892 host target gene. LOC144681 BINDING SITE is HOST TARGET binding site found in the 5' untranslated region of mRNA encoded by LOC144681, corresponding to a HOST TARGET binding site such as BINDING SITE I, BINDING SITE II or BINDING SITE III. Table 2 illustrates the complementarity of the nucleotide sequences of LOC144681 BINDING SITE, designated SEQ ID:40453, to the nucleotide sequence of VGAM1892 RNA, herein designated VGAM RNA, also designated SEQ ID:4603.

Another function of VGAM1892 is therefore inhibition of LOC144681 (Accession XM_096654). Accordingly, utilities of VGAM1892 include diagnosis, prevention and treatment of diseases and clinical conditions associated with LOC144681. LOC148438 (Accession XM_097466) is another VGAM1892 host target gene. LOC148438 BINDING SITE is HOST TARGET binding site found in the 3' untranslated region of mRNA encoded by LOC148438, corresponding to a HOST TARGET binding site such as BINDING SITE I, BINDING SITE II or BINDING SITE III. Table 2 illustrates the complementarity of the nucleotide sequences of LOC148438 BINDING SITE, designated SEQ ID:40883, to the nucleotide sequence of VGAM1892 RNA, herein designated VGAM RNA, also designated SEQ ID:4603.

Another function of VGAM1892 is therefore inhibition of LOC148438 (Accession XM_097466). Accordingly, utilities of VGAM1892 include diagnosis, prevention and treatment of diseases and clinical conditions associated with LOC148438. LOC203276 (Accession XM_117523) is another VGAM1892 host target gene. LOC203276 BINDING SITE is HOST TARGET binding site found in the 3' untranslated region of mRNA encoded by LOC203276, corresponding to a HOST TARGET binding site such as BINDING SITE I, BINDING SITE II or BINDING SITE III. Table 2 illustrates the complementarity of the nucleotide sequences of LOC203276 BINDING SITE, designated SEQ ID:43490, to the nucleotide sequence of VGAM1892 RNA, herein designated VGAM RNA, also designated SEQ ID:4603.

Another function of VGAM1892 is therefore inhibition of LOC203276 (Accession XM_117523). Accordingly, utilities of VGAM1892 include diagnosis, prevention and treatment of diseases and clinical conditions associated with LOC203276. LOC203305 (Accession XM_117529) is another VGAM1892 host target gene. LOC203305 BINDING SITE is HOST TARGET binding site found in the 3' untranslated region of mRNA encoded by LOC203305, corresponding to a HOST TARGET binding site such as BINDING SITE I, BINDING SITE II or BINDING SITE III. Table 2 illustrates the complementarity of the nucleotide sequences of LOC203305 BINDING SITE, designated SEQ ID:43514, to the nucleotide sequence of VGAM1892 RNA, herein designated VGAM RNA, also designated SEQ ID:4603.

Another function of VGAM1892 is therefore inhibition of LOC203305 (Accession XM_117529). Accordingly, utilities of VGAM1892 include diagnosis, prevention and treatment of diseases and clinical conditions associated with LOC203305. LOC254243 (Accession XM_173233) is another VGAM1892 host target gene. LOC254243 BINDING SITE is HOST TARGET binding site found in the 3' untranslated region of mRNA encoded by LOC254243, corresponding to a HOST TARGET binding site such as BINDING SITE I, BINDING SITE II or BINDING SITE III. Table 2 illustrates the complementarity of the nucleotide sequences of LOC254243 BINDING SITE, designated SEQ ID:46516, to the nucleotide sequence of VGAM1892 RNA, herein designated VGAM RNA, also designated SEQ ID:4603.

Another function of VGAM1892 is therefore inhibition of LOC254243 (Accession XM_173233). Accordingly, utilities of VGAM1892 include diagnosis, prevention and treatment of diseases and clinical conditions associated with LOC254243. LOC254887 (Accession XM_172326) is another VGAM1892 host target gene. LOC254887 BINDING SITE is HOST TARGET binding site found in the 5' untranslated region of mRNA encoded by LOC254887, corresponding to a HOST TARGET binding site such as BINDING SITE I, BINDING SITE II or BINDING SITE III. Table 2 illustrates the complementarity of the nucleotide sequences of LOC254887 BINDING SITE, designated SEQ ID:46071, to the nucleotide sequence of VGAM1892 RNA, herein designated VGAM RNA, also designated SEQ ID:4603.

Another function of VGAM1892 is therefore inhibition of LOC254887 (Accession XM_172326). Accordingly, utilities of VGAM1892 include diagnosis, prevention and treatment of diseases and clinical conditions associated with LOC254887. LOC90038 (Accession XM_028305) is another VGAM1892 host target gene. LOC90038 BINDING SITE is HOST TARGET binding site found in the 3' untranslated region of mRNA encoded by LOC90038, corresponding to a HOST TARGET binding site such as BINDING SITE I, BINDING SITE II or BINDING SITE III. Table 2 illustrates the complementarity of the nucleotide sequences of LOC90038 BINDING SITE, designated SEQ ID:30653, to the nucleotide sequence of VGAM1892 RNA, herein designated VGAM RNA, also designated SEQ ID:4603.

Another function of VGAM1892 is therefore inhibition of LOC90038 (Accession XM_028305). Accordingly, utilities of VGAM1892 include diagnosis, prevention and treatment of diseases and clinical conditions associated with LOC90038. LOC92078 (Accession XM_042684) is another VGAM1892 host target gene. LOC92078 BINDING SITE is HOST TARGET binding site found in the 5' untranslated region of mRNA encoded by LOC92078, corresponding to a HOST TARGET binding site such as BINDING SITE I, BINDING SITE II or BINDING SITE III. Table 2 illustrates the complementarity of the nucleotide sequences of LOC92078 BINDING SITE, designated SEQ ID:33741, to the nucleotide sequence of VGAM1892 RNA, herein designated VGAM RNA, also designated SEQ ID:4603.

Another function of VGAM1892 is therefore inhibition of LOC92078 (Accession XM_042684). Accordingly, utilities of VGAM1892 include diagnosis, prevention and treatment of diseases and clinical conditions associated with LOC92078. FIG. 1 further provides a conceptual description of a novel bioinformatically detected viral gene of the present invention, referred to here as Viral Genomic Address Messenger 1893 (VGAM1893) viral gene, which modulates expression of respective host target genes thereof, the function and utility of which host target genes is known in the art.

VGAM1893 is a novel bioinformatically detected regulatory, non protein coding, viral micro RNA (miRNA) gene. The method by which VGAM1893 was detected is described hereinabove with reference to FIGS. 1-8.

VGAM1893 gene, herein designated VGAM GENE, is a viral gene contained in the genome of Newcastle Disease Virus. VGAM1893 host target gene, herein designated VGAM HOST TARGET GENE, is a human gene contained in the human genome.

VGAM1893 gene encodes a VGAM1893 precursor RNA, herein designated VGAM PRECURSOR RNA. Similar to other miRNA genes, and unlike most ordinary genes, VGAM1893 precursor RNA does not encode a protein. A nucleotide sequence identical or highly similar to the nucleotide sequence of VGAM1893 precursor RNA is designated SEQ ID:1879, and is provided hereinbelow with reference to the sequence listing part. Nucleotide sequence SEQ ID:1879 is located at position 2483 relative to the genome of Newcastle Disease Virus.

VGAM1893 precursor RNA folds onto itself, forming VGAM1893 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1893 folded precursor RNA into VGAM1893 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1893 RNA is designated SEQ ID:4604, and is provided hereinbelow with reference to the sequence listing part.

VGAM1893 host target gene, herein designated VGAM HOST TARGET GENE, encodes a corresponding messenger RNA, VGAM1893 host target RNA, herein designated VGAM HOST TARGET RNA. VGAM1893 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1893 RNA, herein designated VGAM RNA, binds complementarily to one or more host target binding sites located in untranslated regions of VGAM1893 host target RNA, herein designated VGAM HOST TARGET RNA. This complementary binding is due to the fact that the nucleotide sequence of VGAM1893 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1893 RNA, herein designated VGAM RNA, may have a different number of host target binding sites in untranslated regions of a VGAM1893 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1893 RNA, herein designated VGAM RNA, to host target binding sites on VGAM1893 host target RNA, herein designated VGAM HOST TARGET RNA, such as BINDING SITE I, BINDING SITE II and BINDING SITE III, inhibits translation of VGAM1893 host target RNA into VGAM1893 host target protein, herein designated VGAM HOST TARGET PRO- TEIN. VGAM host target protein is therefore outlined by a broken line.

It is appreciated that VGAM1893 host target gene, herein designated VGAM HOST TARGET GENE, in fact represents a plurality of VGAM1893 host target genes. The mRNA of each one of this plurality of VGAM1893 host target genes comprises one or more host target binding sites, each having a nucleotide sequence which is at least partly complementary to VGAM1893 RNA, herein designated VGAM RNA, and which when bound by VGAM1893 RNA causes inhibition of translation of respective one or more VGAM1893 host target proteins.

It is further appreciated by one skilled in the art that the mode of translational inhibition illustrated by FIG. 1 with specific reference to translational inhibition exerted by VGAM1893 gene, herein designated VGAM GENE, on one or more VGAM1893 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1893 is inhibition of expression of host target genes, as part of a novel viral mechanism of attacking a host. Accordingly, utilities of VGAM1893 include diagnosis, prevention and treatment of viral infection by Newcastle Disease Virus. Specific functions, and accordingly utilities, of VGAM1893 correlate with, and may be deduced from, the identity of the host target genes which VGAM1893 binds and inhibits, and the function of these host target genes, as elaborated hereinbelow.

Nucleotide sequences of the VGAM1893 precursor RNA, herein designated VGAM PRECURSOR RNA, and of the 'diced' VGAM1893 RNA, herein designated VGAM RNA, and a schematic representation of the secondary folding of VGAM1893 folded precursor RNA, herein designated VGAM FOLDED PRECURSOR RNA, of VGAM1893 are further described hereinbelow with reference to Table 1.

Nucleotide sequences of host target binding sites, such as BINDING SITE-I, BINDING SITE-II and BINDING SITE-III of FIG. 1, found on VGAM1893 host target RNA, and schematic representation of the complementarity of each of these host target binding sites to VGAM1893 RNA, herein designated VGAM RNA, are described hereinbelow with reference to Table 2.

As mentioned hereinabove with reference to FIG. 1, a function of VGAM1893 gene, herein designated VGAM is inhibition of expression of VGAM1893 target genes. It is appreciated that specific functions, and accordingly utilities, of VGAM1893 correlate with, and may be deduced from, the identity of the target genes which VGAM1893 binds and inhibits, and the function of these target genes, as elaborated hereinbelow.

S-adenosylmethionine Decarboxylase 1 (AMD1, Accession NM_001634) is a VGAM1893 host target gene. AMD1 BINDING SITE is HOST TARGET binding site found in the 3' untranslated region of mRNA encoded by AMD1, corresponding to a HOST TARGET binding site such as BINDING SITE I, BINDING SITE II or BINDING SITE III. Table 2 illustrates the complementarity of the nucleotide sequences of AMD1 BINDING SITE, designated SEQ ID:7349, to the nucleotide sequence of VGAM1893 RNA, herein designated VGAM RNA, also designated SEQ ID:4604.

A function of VGAM1893 is therefore inhibition of S-adenosylmethionine Decarboxylase 1 (AMD1, Accession NM_001634), a gene which catalyzes the removal of the carboxylate group of S-adenosylmethionine in the polyamine biosynthesis pathway. Accordingly, utilities of VGAM1893 include diagnosis, prevention and treatment of diseases and clinical conditions associated with AMD1. The function of AMD1 and its association with various diseases and clinical conditions, has been established by previous studies, as described hereinabove with reference to VGAM1016. Collagen, Type IV, Alpha 6 (COL4A6, Accession NM_033641) is another VGAM1893 host target gene. COL4A6 BINDING SITE is HOST TARGET binding site found in the 5' untranslated region of mRNA encoded by COL4A6, corresponding to a HOST TARGET binding site such as BINDING SITE I, BINDING SITE II or BINDING SITE III. Table 2 illustrates the complementarity of the nucleotide sequences of COL4A6 BINDING SITE, designated SEQ ID:27359, to the nucleotide sequence of VGAM1893 RNA, herein designated VGAM RNA, also designated SEQ ID:4604.

Another function of VGAM1893 is therefore inhibition of Collagen, Type IV, Alpha 6 (COL4A6, Accession NM_033641). Accordingly, utilities of VGAM1893 include diagnosis, prevention and treatment of diseases and clinical conditions associated with COL4A6. Coronin, Actin Binding Protein, 2B (CORO2B, Accession XM_035403) is another VGAM1893 host target gene. CORO2B BINDING SITE is HOST TARGET binding site found in the 3' untranslated region of mRNA encoded by CORO2B, corresponding to a HOST TARGET binding site such as BINDING SITE I, BINDING SITE II or BINDING SITE III. Table 2 illustrates the complementarity of the nucleotide sequences of CORO2B BINDING SITE, designated SEQ ID:32254, to the nucleotide sequence of VGAM1893 RNA, herein designated VGAM RNA, also designated SEQ ID:4604.

Another function of VGAM1893 is therefore inhibition of Coronin, Actin Binding Protein, 2B (CORO2B, Accession XM_035403), a gene which may play a role in the reorganization of neuronal actin structure. Accordingly, utilities of VGAM1893 include diagnosis, prevention and treatment of diseases and clinical conditions associated with CORO2B. The function of CORO2B and its association with various diseases and clinical conditions, has been established by previous studies, as described hereinabove with reference to VGAM923. FAT Tumor Suppressor Homolog 2 (Drosophila) (FAT2, Accession NM_001447) is another VGAM1893 host target gene. FAT2 BINDING SITE is HOST TARGET binding site found in the 3' untranslated region of mRNA encoded by FAT2, corresponding to a HOST TARGET binding site such as BINDING SITE I, BINDING SITE II or BINDING SITE III. Table 2 illustrates the complementarity of the nucleotide sequences of FAT2 BINDING SITE, designated SEQ ID:7175, to the nucleotide sequence of VGAM1893 RNA, herein designated VGAM RNA, also designated SEQ ID:4604.

Another function of VGAM1893 is therefore inhibition of FAT Tumor Suppressor Homolog 2 (Drosophila) (FAT2, Accession NM_001447), a gene which could function as a cell-adhesion protein. Accordingly, utilities of VGAM1893 include diagnosis, prevention and treatment of diseases and clinical conditions associated with FAT2. The function of FAT2 and its association with various diseases and clinical conditions, has been established by previous studies, as described hereinabove with reference to VGAM949. Neurotensin Receptor 1 (high affinity) (NTSR1, Accession NM_002531) is another VGAM1893 host target gene. NTSR1 BINDING SITE is HOST TARGET binding site found in the 3' untranslated region of mRNA encoded by NTSR1, corresponding to a HOST TARGET binding site such as BINDING SITE I, BINDING SITE II or BINDING SITE III. Table 2 illustrates the complementarity of the nucleotide sequences of NTSR1 BINDING SITE, designated SEQ ID:8366, to the nucleotide sequence of VGAM1893 RNA, herein designated VGAM RNA, also designated SEQ ID:4604.

Another function of VGAM1893 is therefore inhibition of Neurotensin Receptor 1 (high affinity) (NTSR1, Accession NM_002531), a gene which is associated with g proteins that activate a phosphatidylinositol- calcium second messenger system. Accordingly, utilities of VGAM1893 include diagnosis, prevention and treatment of diseases and clinical conditions associated with NTSR1. The function of NTSR1 and its association with various diseases and clinical conditions, has been established by previous studies, as described hereinabove with reference to VGAM200. Procollagen-proline, 2-oxoglutarate 4-dioxygenase (proline 4-hydroxylase), Beta Polypeptide (protein disulfide isomerase; thyroid hormone binding protein p55) (P4HB, Accession NM_000918) is another VGAM1893 host target gene. P4HB BINDING SITE is HOST TARGET binding site found in the 3' untranslated region of mRNA encoded by P4HB, corresponding to a HOST TARGET binding site such as BINDING SITE I, BINDING SITE II or BINDING SITE III. Table 2 illustrates the complementarity of the nucleotide sequences of P4HB BINDING SITE, designated SEQ ID:6630, to the nucleotide sequence of VGAM1893 RNA, herein designated VGAM RNA, also designated SEQ ID:4604.

Another function of VGAM1893 is therefore inhibition of Procollagen-proline, 2-oxoglutarate 4-dioxygenase (proline 4-hydroxylase), Beta Polypeptide (protein disulfide isomerase; thyroid hormone binding protein p55) (P4HB, Accession NM_000918), a gene which catalyzes formation of 4-hydroxyproline in collagens. Accordingly, utilities of VGAM1893 include diagnosis, prevention and treatment of diseases and clinical conditions associated with P4HB. The function of P4HB and its association with various diseases and clinical conditions, has been established by previous studies, as described hereinabove with reference to VGAM589. Pim-2 Oncogene (PIM2, Accession XM_010208) is another VGAM1893 host target gene. PIM2 BINDING SITE is HOST TARGET binding site found in the 3' untranslated region of mRNA encoded by PIM2, corresponding to a HOST TARGET binding site such as BINDING SITE I, BINDING SITE II or BINDING SITE III. Table 2 illustrates the complementarity of the nucleotide sequences of PIM2 BINDING SITE, designated SEQ ID:30134, to the nucleotide sequence of VGAM1893 RNA, herein designated VGAM RNA, also designated SEQ ID:4604.

Another function of VGAM1893 is therefore inhibition of Pim-2 Oncogene (PIM2, Accession XM_010208). Accordingly, utilities of VGAM1893 include diagnosis, prevention and treatment of diseases and clinical conditions associated with PIM2. Short Stature Homeobox (SHOX, Accession NM_000451) is another VGAM1893 host target gene. SHOX BINDING SITE is HOST TARGET binding site found in the 3' untranslated region of mRNA encoded by SHOX, corresponding to a HOST TARGET binding site such as BINDING SITE I, BINDING SITE II or BINDING SITE III. Table 2 illustrates the complementarity of the nucleotide sequences of SHOX BINDING SITE, designated SEQ ID:6059, to the nucleotide sequence of VGAM1893 RNA, herein designated VGAM RNA, also designated SEQ ID:4604.

Another function of VGAM1893 is therefore inhibition of Short Stature Homeobox (SHOX, Accession NM_000451). Accordingly, utilities of VGAM1893 include diagnosis, prevention and treatment of diseases and clinical conditions associated with SHOX. Chromosome 20 Open Reading Frame 39 (C20orf39, Accession NM_024893) is another VGAM1893 host target gene. C20orf39 BINDING SITE is HOST TARGET binding site found in the 3' untranslated region of mRNA encoded by C20orf39, corresponding to a HOST TARGET binding site such as BINDING SITE I, BINDING SITE II or BINDING SITE III. Table 2 illustrates the complementarity of the nucleotide sequences of C20orf39 BINDING SITE, designated SEQ ID:24368, to the nucleotide sequence of VGAM1893 RNA, herein designated VGAM RNA, also designated SEQ ID:4604.

Another function of VGAM1893 is therefore inhibition of Chromosome 20 Open Reading Frame 39 (C20orf39, Accession NM_024893). Accordingly, utilities of VGAM1893 include diagnosis, prevention and treatment of diseases and clinical conditions associated with C20orf39. Chromosome 20 Open Reading Frame 45 (C20orf45, Accession NM_016045) is another VGAM1893 host target gene. C20orf45 BINDING SITE is HOST TARGET binding site found in the 3' untranslated region of mRNA encoded by C20orf45, corresponding to a HOST TARGET binding site such as BINDING SITE I, BINDING SITE II or BINDING SITE III. Table 2 illustrates the complementarity of the nucleotide sequences of C20orf45 BINDING SITE, designated SEQ ID:18122, to the nucleotide sequence of VGAM1893 RNA, herein designated VGAM RNA, also designated SEQ ID:4604.

Another function of VGAM1893 is therefore inhibition of Chromosome 20 Open Reading Frame 45 (C20orf45, Accession NM_016045). Accordingly, utilities of VGAM1893 include diagnosis, prevention and treatment of diseases and clinical conditions associated with C20orf45. CLONE24945 (Accession NM_015683) is another VGAM1893 host target gene. CLONE24945 BINDING SITE is HOST TARGET binding site found in the 3' untranslated region of mRNA encoded by CLONE24945, corresponding to a HOST TARGET binding site such as BINDING SITE I, BINDING SITE II or BINDING SITE III. Table 2 illustrates the complementarity of the nucleotide sequences of CLONE24945 BINDING SITE, designated SEQ ID:17907, to the nucleotide sequence of VGAM1893 RNA, herein designated VGAM RNA, also designated SEQ ID:4604.

Another function of VGAM1893 is therefore inhibition of CLONE24945 (Accession NM_015683). Accordingly, utilities of VGAM1893 include diagnosis, prevention and treatment of diseases and clinical conditions associated with CLONE24945. FLJ11320 (Accession NM_018389) is another VGAM1893 host target gene. FLJ11320 BINDING SITE is HOST TARGET binding site found in the 3' untranslated region of mRNA encoded by FLJ11320, corresponding to a HOST TARGET binding site such as BINDING SITE I, BINDING SITE II or BINDING SITE III. Table 2 illustrates the complementarity of the nucleotide sequences of FLJ11320 BINDING SITE, designated SEQ ID:20429, to the nucleotide sequence of VGAM1893 RNA, herein designated VGAM RNA, also designated SEQ ID:4604.

Another function of VGAM1893 is therefore inhibition of FLJ11320 (Accession NM_018389). Accordingly, utilities of VGAM1893 include diagnosis, prevention and treatment of diseases and clinical conditions associated with FLJ11320. FLJ23112 (Accession NM_024929) is another VGAM1893 host target gene. FLJ23112 BINDING SITE is HOST TARGET binding site found in the 3' untranslated region of mRNA encoded by FLJ23112, corresponding to a HOST TARGET binding site such as BINDING SITE I, BINDING SITE II or BINDING SITE III. Table 2 illustrates the complementarity of the nucleotide sequences of FLJ23112 BINDING SITE, designated SEQ ID:24466, to the nucleotide sequence of VGAM1893 RNA, herein designated VGAM RNA, also designated SEQ ID:4604.

Another function of VGAM1893 is therefore inhibition of FLJ23112 (Accession NM_024929). Accordingly, utilities of VGAM1893 include diagnosis, prevention and treatment of diseases and clinical conditions associated with FLJ23112. G Protein-coupled Receptor Kinase-interactor 1 (GIT1, Accession NM_014030) is another VGAM1893 host target gene. GIT1 BINDING SITE is HOST TARGET binding site found in the 3' untranslated region of mRNA encoded by GIT1, corresponding to a HOST TARGET binding site such as BINDING SITE I, BINDING SITE II or BINDING SITE III. Table 2 illustrates the complementarity of the nucleotide sequences of GIT1 BINDING SITE, designated SEQ ID:15259, to the nucleotide sequence of VGAM1893 RNA, herein designated VGAM RNA, also designated SEQ ID:4604.

Another function of VGAM1893 is therefore inhibition of G Protein-coupled Receptor Kinase-interactor 1 (GIT1, Accession NM_014030). Accordingly, utilities of VGAM1893 include diagnosis, prevention and treatment of diseases and clinical conditions associated with GIT1. KIAA1203 (Accession XM_049683) is another VGAM1893 host target gene. KIAA1203 BINDING SITE is HOST TARGET binding site found in the 3' untranslated region of mRNA encoded by KIAA1203, corresponding to a HOST TARGET binding site such as BINDING SITE I, BINDING SITE II or BINDING SITE III. Table 2 illustrates the complementarity of the nucleotide sequences of KIAA1203 BINDING SITE, designated SEQ ID:35473, to the nucleotide sequence of VGAM1893 RNA, herein designated VGAM RNA, also designated SEQ ID:4604.

Another function of VGAM1893 is therefore inhibition of KIAA1203 (Accession XM_049683). Accordingly, utilities of VGAM1893 include diagnosis, prevention and treatment of diseases and clinical conditions associated with KIAA1203. KIAA1538 (Accession XM_049474) is another VGAM1893 host target gene. KIAA1538 BINDING SITE is HOST TARGET binding site found in the 3' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35434, to the nucleotide sequence of VGAM1893 RNA, herein designated VGAM RNA, also designated SEQ ID:4604.

Another function of VGAM1893 is therefore inhibition of KIAA1538 (Accession XM_049474). Accordingly, utilities of VGAM1893 include diagnosis, prevention and treatment of diseases and clinical conditions associated with KIAA1538. KIAA1655 (Accession XM_039442) is another VGAM1893 host target gene. KIAA1655 BINDING SITE is HOST TARGET binding site found in the 5' untranslated region of mRNA encoded by KIAA1655, corresponding to a HOST TARGET binding site such as BINDING SITE I, BINDING SITE II or BINDING SITE III. Table 2 illustrates the complementarity of the nucleotide sequences of KIAA1655 BINDING SITE, designated SEQ ID:33088, to the nucleotide sequence of VGAM1893 RNA, herein designated VGAM RNA, also designated SEQ ID:4604.

Another function of VGAM1893 is therefore inhibition of KIAA1655 (Accession XM_039442). Accordingly, utilities of VGAM1893 include diagnosis, prevention and treatment of diseases and clinical conditions associated with KIAA1655. KIAA1937 (Accession XM_057107) is another VGAM1893 host target gene. KIAA1937 BINDING SITE is HOST TARGET binding site found in the 3' untranslated region of mRNA encoded by KIAA1937, corresponding to a HOST TARGET binding site such as BINDING SITE I, BINDING SITE II or BINDING SITE III. Table 2 illustrates the complementarity of the nucleotide sequences of KIAA1937 BINDING SITE, designated SEQ ID:36483, to the nucleotide sequence of VGAM1893 RNA, herein designated VGAM RNA, also designated SEQ ID:4604.

Another function of VGAM1893 is therefore inhibition of KIAA1937 (Accession XM_057107). Accordingly, utilities of VGAM1893 include diagnosis, prevention and treatment of diseases and clinical conditions associated with KIAA1937. NDRG Family Member 4 (NDRG4, Accession NM_020465) is another VGAM1893 host target gene. NDRG4 BINDING SITE1 and NDRG4 BINDING SITE2 are HOST TARGET binding sites found in untranslated regions of mRNA encoded by NDRG4, corresponding to HOST TARGET binding sites such as BINDING SITE I, BINDING SITE II or BINDING SITE III. Table 2 illustrates the complementarity of the nucleotide sequences of NDRG4 BINDING SITE1 and NDRG4 BINDING SITE2, designated SEQ ID:21698 and SEQ ID:23213 respectively, to the nucleotide sequence of VGAM1893 RNA, herein designated VGAM RNA, also designated SEQ ID:4604.

Another function of VGAM1893 is therefore inhibition of NDRG Family Member 4 (NDRG4, Accession NM_020465). Accordingly, utilities of VGAM1893 include diagnosis, prevention and treatment of diseases and clinical conditions associated with NDRG4. Ubiquitin-like, Containing PHD and RING Finger Domains, 1 (UHRF1, Accession NM_013282) is another VGAM1893 host target gene. UHRF1 BINDING SITE is HOST TARGET binding site found in the 3' untranslated region of mRNA encoded by UHRF1, corresponding to a HOST TARGET binding site such as BINDING SITE I, BINDING SITE II or BINDING SITE III. Table 2 illustrates the complementarity of the nucleotide sequences of UHRF1 BINDING SITE, designated SEQ ID:14954, to the nucleotide sequence of VGAM1893 RNA, herein designated VGAM RNA, also designated SEQ ID:4604.

Another function of VGAM1893 is therefore inhibition of Ubiquitin-like, Containing PHD and RING Finger Domains, 1 (UHRF1, Accession NM_013282). Accordingly, utilities of VGAM1893 include diagnosis, prevention and treatment of diseases and clinical conditions associated with UHRF1. YME1-like 1 (S. cerevisiae) (YME1L1, Accession NM_014263) is another VGAM1893 host target gene. YME1L1 BINDING SITE1 and YME1L1 BINDING SITE2 are HOST TARGET binding sites found in untranslated regions of mRNA encoded by YME1L1, corresponding to HOST TARGET binding sites such as BINDING SITE I, BINDING SITE II or BINDING SITE III. Table 2 illustrates the complementarity of the nucleotide sequences of YME1L1 BINDING SITE1 and YME1L1 BINDING SITE2, designated SEQ ID:15539 and SEQ ID:29295 respectively, to the nucleotide sequence of VGAM1893 RNA, herein designated VGAM RNA, also designated SEQ ID:4604.

Another function of VGAM1893 is therefore inhibition of YME1-like 1 (S. cerevisiae) (YME1L1, Accession NM_014263). Accordingly, utilities of VGAM1893 include diagnosis, prevention and treatment of diseases and clinical conditions associated with YME1L1. LOC165405 (Accession XM_092567) is another VGAM1893 host target gene.

LOC165405 BINDING SITE is HOST TARGET binding site found in the 5' untranslated region of mRNA encoded by LOC165405, corresponding to a HOST TARGET binding site such as BINDING SITE I, BINDING SITE II or BINDING SITE III. Table 2 illustrates the complementarity of the nucleotide sequences of LOC165405 BINDING SITE, designated SEQ ID:40130, to the nucleotide sequence of VGAM1893 RNA, herein designated VGAM RNA, also designated SEQ ID:4604.

Another function of VGAM1893 is therefore inhibition of LOC165405 (Accession XM_092567). Accordingly, utilities of VGAM1893 include diagnosis, prevention and treatment of diseases and clinical conditions associated with LOC165405. LOC202908 (Accession XM_114602) is another VGAM1893 host target gene. LOC202908 BINDING SITE is HOST TARGET binding site found in the 5' untranslated region of mRNA encoded by LOC202908, corresponding to a HOST TARGET binding site such as BINDING SITE I, BINDING SITE II or BINDING SITE III. Table 2 illustrates the complementarity of the nucleotide sequences of LOC202908 BINDING SITE, designated SEQ ID:42997, to the nucleotide sequence of VGAM1893 RNA, herein designated VGAM RNA, also designated SEQ ID:4604.

Another function of VGAM1893 is therefore inhibition of LOC202908 (Accession XM_114602). Accordingly, utilities of VGAM1893 include diagnosis, prevention and treatment of diseases and clinical conditions associated with LOC202908. LOC91149 (Accession XM_036480) is another VGAM1893 host target gene. LOC91149 BINDING SITE is HOST TARGET binding site found in the 3' untranslated region of mRNA encoded by LOC91149, corresponding to a HOST TARGET binding site such as BINDING SITE I, BINDING SITE II or BINDING SITE III. Table 2 illustrates the complementarity of the nucleotide sequences of LOC91149 BINDING SITE, designated SEQ ID:32457, to the nucleotide sequence of VGAM1893 RNA, herein designated VGAM RNA, also designated SEQ ID:4604.

Another function of VGAM1893 is therefore inhibition of LOC91149 (Accession XM_036480). Accordingly, utilities of VGAM1893 include diagnosis, prevention and treatment of diseases and clinical conditions associated with LOC91149. LOC93276 (Accession XM_050200) is another VGAM1893 host target gene. LOC93276 BINDING SITE is HOST TARGET binding site found in the 5' untranslated region of mRNA encoded by LOC93276, corresponding to a HOST TARGET binding site such as BINDING SITE I, BINDING SITE II or BINDING SITE III. Table 2 illustrates the complementarity of the nucleotide sequences of LOC93276 BINDING SITE, designated SEQ ID:35590, to the nucleotide sequence of VGAM1893 RNA, herein designated VGAM RNA, also designated SEQ ID:4604.

Another function of VGAM1893 is therefore inhibition of LOC93276 (Accession XM_050200). Accordingly, utilities of VGAM1893 include diagnosis, prevention and treatment of diseases and clinical conditions associated with LOC93276. FIG. 1 further provides a conceptual description of a novel bioinformatically detected viral gene of the present invention, referred to here as Viral Genomic Address Messenger 1894 (VGAM1894) viral gene, which modulates expression of respective host target genes thereof, the function and utility of which host target genes is known in the art.

VGAM1894 is a novel bioinformatically detected regulatory, non protein coding, viral micro RNA (miRNA) gene. The method by which VGAM1894 was detected is described hereinabove with reference to FIGS. 1-8.

VGAM1894 gene, herein designated VGAM GENE, is a viral gene contained in the genome of Respiratory Syncytial Virus. VGAM1894 host target gene, herein designated VGAM HOST TARGET GENE, is a human gene contained in the human genome.

VGAM1894 gene encodes a VGAM1894 precursor RNA, herein designated VGAM PRECURSOR RNA. Similar to other miRNA genes, and unlike most ordinary genes, VGAM1894 precursor RNA does not encode a protein. A nucleotide sequence identical or highly similar to the nucleotide sequence of VGAM1894 precursor RNA is designated SEQ ID:1880, and is provided hereinbelow with reference to the sequence listing part. Nucleotide sequence SEQ ID:1880 is located at position 6434 relative to the genome of Respiratory Syncytial Virus.

VGAM1894 precursor RNA folds onto itself, forming VGAM1894 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1894 folded precursor RNA into VGAM1894 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1894 RNA is designated SEQ ID:4605, and is provided hereinbelow with reference to the sequence listing part.

VGAM1894 host target gene, herein designated VGAM HOST TARGET GENE, encodes a corresponding messenger RNA, VGAM1894 host target RNA, herein designated VGAM HOST TARGET RNA. VGAM1894 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1894 RNA, herein designated VGAM RNA, binds complementarily to one or more host target binding sites located in untranslated regions of VGAM1894 host target RNA, herein designated VGAM HOST TARGET RNA. This complementary binding is due to the fact that the nucleotide sequence of VGAM1894 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1894 RNA, herein designated VGAM RNA, may have a different number of host target binding sites in untranslated regions of a VGAM1894 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1894 RNA, herein designated VGAM RNA, to host target binding sites on VGAM1894 host target RNA, herein designated VGAM HOST TARGET RNA, such as BINDING SITE I, BINDING SITE II and BINDING SITE III, inhibits translation of VGAM1894 host target RNA into VGAM1894 host target protein, herein designated VGAM HOST TARGET PROTEIN. VGAM host target protein is therefore outlined by a broken line.

It is appreciated that VGAM1894 host target gene, herein designated VGAM HOST TARGET GENE, in fact represents a plurality of VGAM1894 host target genes. The mRNA of each one of this plurality of VGAM1894 host target genes comprises one or more host target binding sites, each having a nucleotide sequence which is at least partly complementary to VGAM1894 RNA, herein designated VGAM RNA, and which when bound by VGAM1894 RNA causes inhibition of translation of respective one or more VGAM1894 host target proteins.

It is further appreciated by one skilled in the art that the mode of translational inhibition illustrated by FIG. 1 with specific reference to translational inhibition exerted by VGAM1894 gene, herein designated VGAM GENE, on one or more VGAM1894 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1894 is inhibition of expression of host target genes, as part of a novel viral mechanism of attacking a host. Accordingly, utilities of VGAM1894 include diagnosis, prevention and treatment of viral infection by Respiratory Syncytial Virus. Specific functions, and accordingly utilities, of VGAM1894 correlate with, and may be deduced from, the identity of the host target genes which VGAM1894 binds and inhibits, and the function of these host target genes, as elaborated hereinbelow.

Nucleotide sequences of the VGAM1894 precursor RNA, herein designated VGAM PRECURSOR RNA, and of the 'diced' VGAM1894 RNA, herein designated VGAM RNA, and a schematic representation of the secondary folding of VGAM1894 folded precursor RNA, herein designated VGAM FOLDED PRECURSOR RNA, of VGAM1894 are further described hereinbelow with reference to Table 1.

Nucleotide sequences of host target binding sites, such as BINDING SITE-I, BINDING SITE-II and BINDING SITE-III of FIG. 1, found on VGAM1894 host target RNA, and schematic representation of the complementarity of each of these host target binding sites to VGAM1894 RNA, herein designated VGAM RNA, are described hereinbelow with reference to Table 2.

As mentioned hereinabove with reference to FIG. 1, a function of VGAM1894 gene, herein designated VGAM is inhibition of expression of VGAM1894 target genes. It is appreciated that specific functions, and accordingly utilities, of VGAM1894 correlate with, and may be deduced from, the identity of the target genes which VGAM1894 binds and inhibits, and the function of these target genes, as elaborated hereinbelow.

Lanosterol Synthase (2,3-oxidosqualene-lanosterol cyclase) (LSS, Accession NM_002340) is a VGAM1894 host target gene. LSS BINDING SITE is HOST TARGET binding site found in the 5' untranslated region of mRNA encoded by LSS, corresponding to a HOST TARGET binding site such as BINDING SITE I, BINDING SITE II or BINDING SITE III. Table 2 illustrates the complementarity of the nucleotide sequences of LSS BINDING SITE, designated SEQ ID:8140, to the nucleotide sequence of VGAM1894 RNA, herein designated VGAM RNA, also designated SEQ ID:4605.

A function of VGAM1894 is therefore inhibition of Lanosterol Synthase (2,3-oxidosqualene-lanosterol cyclase) (LSS, Accession NM_002340). Accordingly, utilities of VGAM1894 include diagnosis, prevention and treatment of diseases and clinical conditions associated with LSS. Chondrolectin (CHODL, Accession NM_024944) is another VGAM1894 host target gene. CHODL BINDING SITE is HOST TARGET binding site found in the 3' untranslated region of mRNA encoded by CHODL, corresponding to a HOST TARGET binding site such as BINDING SITE I, BINDING SITE II or BINDING SITE III. Table 2 illustrates the complementarity of the nucleotide sequences of CHODL BINDING SITE, designated SEQ ID:24492, to the nucleotide sequence of VGAM1894 RNA, herein designated VGAM RNA, also designated SEQ ID:4605.

Another function of VGAM1894 is therefore inhibition of Chondrolectin (CHODL, Accession NM_024944). Accordingly, utilities of VGAM1894 include diagnosis, prevention and treatment of diseases and clinical conditions associated with CHODL. FLJ12057 (Accession NM_024768) is another VGAM1894 host target gene. FLJ12057 BINDING SITE is HOST TARGET binding site found in the 5' untranslated region of mRNA encoded by FLJ12057, corresponding to a HOST TARGET binding site such as BINDING SITE I, BINDING SITE II or BINDING SITE III. Table 2 illustrates the complementarity of the nucleotide sequences of FLJ12057 BINDING SITE, designated SEQ ID:24124, to the nucleotide sequence of VGAM1894 RNA, herein designated VGAM RNA, also designated SEQ ID:4605.

Another function of VGAM1894 is therefore inhibition of FLJ12057 (Accession NM_024768). Accordingly, utilities of VGAM1894 include diagnosis, prevention and treatment of diseases and clinical conditions associated with FLJ12057. FLJ23360 (Accession NM_023076) is another VGAM1894 host target gene. FLJ23360 BINDING SITE is HOST TARGET binding site found in the 3' untranslated region of mRNA encoded by FLJ23360, corresponding to a HOST TARGET binding site such as BINDING SITE I, BINDING SITE II or BINDING SITE III. Table 2 illustrates the complementarity of the nucleotide sequences of FLJ23360 BINDING SITE, designated SEQ ID:23337, to the nucleotide sequence of VGAM1894 RNA, herein designated VGAM RNA, also designated SEQ ID:4605.

Another function of VGAM1894 is therefore inhibition of FLJ23360 (Accession NM_023076). Accordingly, utilities of VGAM1894 include diagnosis, prevention and treatment of diseases and clinical conditions associated with FLJ23360. Mitochondrial Ribosomal Protein L10 (MRPL10, Accession NM_145255) is another VGAM1894 host target gene. MRPL10 BINDING SITE is HOST TARGET binding site found in the 3' untranslated region of mRNA encoded by MRPL10, corresponding to a HOST TARGET binding site such as BINDING SITE I, BINDING SITE II or BINDING SITE III. Table 2 illustrates the complementarity of the nucleotide sequences of MRPL10 BINDING SITE, designated SEQ ID:29771, to the nucleotide sequence of VGAM1894 RNA, herein designated VGAM RNA, also designated SEQ ID:4605.

Another function of VGAM1894 is therefore inhibition of Mitochondrial Ribosomal Protein L10 (MRPL10, Accession NM_145255). Accordingly, utilities of VGAM1894 include diagnosis, prevention and treatment of diseases and clinical conditions associated with MRPL10. LOC143680 (Accession XM_096474) is another VGAM1894 host target gene. LOC143680 BINDING SITE is HOST TARGET binding site found in the 5' untranslated region of mRNA encoded by LOC143680, corresponding to a HOST TARGET binding site such as BINDING SITE I, BINDING SITE II or BINDING SITE III. Table 2 illustrates the complementarity of the nucleotide sequences of LOC143680 BINDING SITE, designated SEQ ID:40375, to the nucleotide sequence of VGAM1894 RNA, herein designated VGAM RNA, also designated SEQ ID:4605.

Another function of VGAM1894 is therefore inhibition of LOC143680 (Accession XM_096474). Accordingly, utilities of VGAM1894 include diagnosis, prevention and treatment of diseases and clinical conditions associated with LOC143680. LOC256433 (Accession XM_173657) is another VGAM1894 host target gene. LOC256433 BINDING SITE is HOST TARGET binding site found in the 5' untranslated region of mRNA encoded by LOC256433, corresponding to a HOST TARGET binding site such as BINDING SITE I, BINDING SITE II or BINDING SITE III. Table 2 illustrates the complementarity of the nucleotide sequences of LOC256433 BINDING SITE, designated SEQ ID:46553, to the nucleotide sequence of VGAM1894 RNA, herein designated VGAM RNA, also designated SEQ ID:4605.

Another function of VGAM1894 is therefore inhibition of LOC256433 (Accession XM_173657). Accordingly, utilities of VGAM1894 include diagnosis, prevention and treatment of diseases and clinical conditions associated with LOC256433. FIG. 1 further provides a conceptual description of a novel bioinformatically detected viral gene of the present invention, referred to here as Viral Genomic Address Messenger 1895 (VGAM1895) viral gene, which modulates expression of respective host target genes thereof, the function and utility of which host target genes is known in the art.

VGAM1895 is a novel bioinformatically detected regulatory, non protein coding, viral micro RNA (miRNA) gene. The method by which VGAM1895 was detected is described hereinabove with reference to FIGS. 1-8.

VGAM1895 gene, herein designated VGAM GENE, is a viral gene contained in the genome of Garlic Latent Virus. VGAM1895 host target gene, herein designated VGAM HOST TARGET GENE, is a human gene contained in the human genome.

VGAM1895 gene encodes a VGAM1895 precursor RNA, herein designated VGAM PRECURSOR RNA. Similar to other miRNA genes, and unlike most ordinary genes, VGAM1895 precursor RNA does not encode a protein. A nucleotide sequence identical or highly similar to the nucleotide sequence of VGAM1895 precursor RNA is designated SEQ ID:1881, and is provided hereinbelow with reference to the sequence listing part. Nucleotide sequence SEQ ID:1881 is located at position 2156 relative to the genome of Garlic Latent Virus.

VGAM1895 precursor RNA folds onto itself, forming VGAM1895 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1895 folded precursor RNA into VGAM1895 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 79%) nucleotide sequence of VGAM1895 RNA is designated SEQ ID:4606, and is provided hereinbelow with reference to the sequence listing part.

VGAM1895 host target gene, herein designated VGAM HOST TARGET GENE, encodes a corresponding messenger RNA, VGAM1895 host target RNA, herein designated VGAM HOST TARGET RNA. VGAM1895 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1895 RNA, herein designated VGAM RNA, binds complementarily to one or more host target binding sites located in untranslated regions of VGAM1895 host target RNA, herein designated VGAM HOST TARGET RNA. This complementary binding is due to the fact that the nucleotide sequence of VGAM1895 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1895 RNA, herein designated VGAM RNA, may have a different number of host target binding sites in untranslated regions of a VGAM1895 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1895 RNA, herein designated VGAM RNA, to host target binding sites on VGAM1895 host target RNA, herein designated VGAM HOST TARGET RNA, such as BINDING SITE I, BINDING SITE II and BINDING SITE III, inhibits translation of VGAM1895 host target RNA into VGAM1895 host target protein, herein designated VGAM HOST TARGET PROTEIN. VGAM host target protein is therefore outlined by a broken line.

It is appreciated that VGAM1895 host target gene, herein designated VGAM HOST TARGET GENE, in fact represents a plurality of VGAM1895 host target genes. The mRNA of each one of this plurality of VGAM1895 host target genes comprises one or more host target binding sites, each having a nucleotide sequence which is at least partly complementary to VGAM1895 RNA, herein designated VGAM RNA, and which when bound by VGAM1895 RNA causes inhibition of translation of respective one or more VGAM1895 host target proteins.

It is further appreciated by one skilled in the art that the mode of translational inhibition illustrated by FIG. 1 with specific reference to translational inhibition exerted by VGAM1895 gene, herein designated VGAM GENE, on one or more VGAM1895 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1895 is inhibition of expression of host target genes, as part of a novel viral mechanism of attacking a host. Accordingly, utilities of VGAM1895 include diagnosis, prevention and treatment of viral infection by Garlic Latent Virus. Specific functions, and accordingly utilities, of VGAM1895 correlate with, and may be deduced from, the identity of the host target genes which VGAM1895 binds and inhibits, and the function of these host target genes, as elaborated hereinbelow.

Nucleotide sequences of the VGAM1895 precursor RNA, herein designated VGAM PRECURSOR RNA, and of the 'diced' VGAM1895 RNA, herein designated VGAM RNA, and a schematic representation of the secondary folding of VGAM1895 folded precursor RNA, herein designated VGAM FOLDED PRECURSOR RNA, of VGAM1895 are further described hereinbelow with reference to Table 1.

Nucleotide sequences of host target binding sites, such as BINDING SITE-I, BINDING SITE-II and BINDING SITE-III of FIG. 1, found on VGAM1895 host target RNA, and schematic representation of the complementarity of each of these host target binding sites to VGAM1895 RNA, herein designated VGAM RNA, are described hereinbelow with reference to Table 2.

As mentioned hereinabove with reference to FIG. 1, a function of VGAM1895 gene, herein designated VGAM is inhibition of expression of VGAM1895 target genes. It is appreciated that specific functions, and accordingly utilities, of VGAM1895 correlate with, and may be deduced from, the identity of the target genes which VGAM1895 binds and inhibits, and the function of these target genes, as elaborated hereinbelow.

DKFZP434E2135 (Accession NM_030804) is a VGAM1895 host target gene. DKFZP434E2135 BINDING SITE is HOST TARGET binding site found in the 3' untranslated region of mRNA encoded by DKFZP434E2135, corresponding to a HOST TARGET binding site such as BINDING SITE I, BINDING SITE II or BINDING SITE III. Table 2 illustrates the complementarity of the nucleotide sequences of DKFZP434E2135 BINDING SITE, designated SEQ ID:25118, to the nucleotide sequence of VGAM1895 RNA, herein designated VGAM RNA, also designated SEQ ID:4606.

A function of VGAM1895 is therefore inhibition of DKFZP434E2135 (Accession NM_030804). Accordingly, utilities of VGAM1895 include diagnosis, prevention and treatment of diseases and clinical conditions associated with DKFZP434E2135. KIAA0563 (Accession NM_014834) is another VGAM1895 host target gene. KIAA0563 BINDING SITE is HOST TARGET binding site found in the 5' untranslated region of mRNA encoded by KIAA0563, corresponding to a HOST TARGET binding site such as BINDING SITE I, BINDING SITE II or BINDING SITE III. Table 2 illustrates the complementarity of the nucleotide sequences of KIAA0563 BINDING SITE, designated SEQ ID:16846, to the nucleotide sequence of VGAM1895 RNA, herein designated VGAM RNA, also designated SEQ ID:4606.

Another function of VGAM1895 is therefore inhibition of KIAA0563 (Accession NM_014834). Accordingly, utilities of VGAM1895 include diagnosis, prevention and treatment of diseases and clinical conditions associated with KIAA0563. KIAA1503 (Accession XM_043197) is another VGAM1895 host target gene. KIAA1503 BINDING SITE is HOST TARGET binding site found in the 5' untranslated region of mRNA encoded by KIAA1503, corresponding to a HOST TARGET binding site such as BINDING SITE I, BINDING SITE II or BINDING SITE III. Table 2 illustrates the complementarity of the nucleotide sequences of KIAA1503 BINDING SITE, designated SEQ ID:33918, to the nucleotide sequence of VGAM1895 RNA, herein designated VGAM RNA, also designated SEQ ID:4606.

Another function of VGAM1895 is therefore inhibition of KIAA1503 (Accession XM_043197). Accordingly, utilities of VGAM1895 include diagnosis, prevention and treatment of diseases and clinical conditions associated with KIAA1503. KIAA1958 (Accession XM_088566) is another VGAM1895 host target gene. KIAA1958 BINDING SITE is HOST TARGET binding site found in the 3' untranslated region of mRNA encoded by KIAA1958, corresponding to a HOST TARGET binding site such as BINDING SITE I, BINDING SITE II or BINDING SITE III. Table 2 illustrates the complementarity of the nucleotide sequences of KIAA1958 BINDING SITE, designated SEQ ID:39832, to the nucleotide sequence of VGAM1895 RNA, herein designated VGAM RNA, also designated SEQ ID:4606.

Another function of VGAM1895 is therefore inhibition of KIAA1958 (Accession XM_088566). Accordingly, utilities of VGAM1895 include diagnosis, prevention and treatment of diseases and clinical conditions associated with KIAA1958. LOC112609 (Accession XM_053013) is another VGAM1895 host target gene. LOC112609 BINDING SITE is HOST TARGET binding site found in the 3' untranslated region of mRNA encoded by LOC112609, corresponding to a HOST TARGET binding site such as BINDING SITE I, BINDING SITE II or BINDING SITE III. Table 2 illustrates the complementarity of the nucleotide sequences of LOC112609 BINDING SITE, designated SEQ ID:36057, to the nucleotide sequence of VGAM1895 RNA, herein designated VGAM RNA, also designated SEQ ID:4606.

Another function of VGAM1895 is therefore inhibition of LOC112609 (Accession XM_053013). Accordingly, utilities of VGAM1895 include diagnosis, prevention and treatment of diseases and clinical conditions associated with LOC112609. LOC147071 (Accession XM_054031) is another VGAM1895 host target gene. LOC147071 BINDING SITE is HOST TARGET binding site found in the 5' untranslated region of mRNA encoded by LOC147071, corresponding to a HOST TARGET binding site such as BINDING SITE I, BINDING SITE II or BINDING SITE III. Table 2 illustrates the complementarity of the nucleotide sequences of LOC147071 BINDING SITE, designated SEQ ID:36140, to the nucleotide sequence of VGAM1895 RNA, herein designated VGAM RNA, also designated SEQ ID:4606.

Another function of VGAM1895 is therefore inhibition of LOC147071 (Accession XM_054031). Accordingly, utilities of VGAM1895 include diagnosis, prevention and treatment of diseases and clinical conditions associated with LOC147071. LOC149271 (Accession XM_086475) is another VGAM1895 host target gene. LOC149271 BINDING SITE is HOST TARGET binding site found in the 5' untranslated region of mRNA encoded by LOC149271, corresponding to a HOST TARGET binding site such as BINDING SITE I, BINDING SITE II or BINDING SITE III. Table 2 illustrates the complementarity of the nucleotide sequences of LOC149271 BINDING SITE, designated SEQ ID:38677, to the nucleotide sequence of VGAM1895 RNA, herein designated VGAM RNA, also designated SEQ ID:4606.

Another function of VGAM1895 is therefore inhibition of LOC149271 (Accession XM_086475). Accordingly, utilities of VGAM1895 include diagnosis, prevention and treatment of diseases and clinical conditions associated with LOC149271. LOC221092 (Accession XM_167749) is another VGAM1895 host target gene. LOC221092 BINDING SITE is HOST TARGET binding site found in the 5' untranslated region of mRNA encoded by LOC221092, corresponding to a HOST TARGET binding site such as BINDING SITE I, BINDING SITE II or BINDING SITE III. Table 2 illustrates the complementarity of the nucleotide sequences of LOC221092 BINDING SITE, designated SEQ ID:44775, to the nucleotide sequence of VGAM1895 RNA, herein designated VGAM RNA, also designated SEQ ID:4606.

Another function of VGAM1895 is therefore inhibition of LOC221092 (Accession XM_167749). Accordingly, utilities of VGAM1895 include diagnosis, prevention and treatment of diseases and clinical conditions associated with LOC221092. LOC255328 (Accession XM_172920) is another VGAM1895 host target gene. LOC255328 BINDING SITE is HOST TARGET binding site found in the 3' untranslated region of mRNA encoded by LOC255328, corresponding to a HOST TARGET binding site such as BINDING SITE I, BINDING SITE II or BINDING SITE III. Table 2 illustrates the complementarity of the nucleotide sequences of LOC255328 BINDING SITE, designated SEQ ID:46180, to the nucleotide sequence of VGAM1895 RNA, herein designated VGAM RNA, also designated SEQ ID:4606.

Another function of VGAM1895 is therefore inhibition of LOC255328 (Accession XM_172920). Accordingly, utilities of VGAM1895 include diagnosis, prevention and treatment of diseases and clinical conditions associated with LOC255328. LOC92719 (Accession XM_046853) is another VGAM1895 host target gene. LOC92719 BINDING SITE is HOST TARGET binding site found in the 3' untranslated region of mRNA encoded by LOC92719, corresponding to a HOST TARGET binding site such as BINDING SITE I, BINDING SITE II or BINDING SITE III. Table 2 illustrates the complementarity of the nucleotide sequences of LOC92719 BINDING SITE, designated SEQ ID:34849, to the nucleotide sequence of VGAM1895 RNA, herein designated VGAM RNA, also designated SEQ ID:4606.

Another function of VGAM1895 is therefore inhibition of LOC92719 (Accession XM_046853). Accordingly, utilities of VGAM1895 include diagnosis, prevention and treatment of diseases and clinical conditions associated with LOC92719. FIG. 1 further provides a conceptual description of a novel bioinformatically detected viral gene of the present invention, referred to here as Viral Genomic Address Messenger 1896 (VGAM1896) viral gene, which modulates expression of respective host target genes thereof, the function and utility of which host target genes is known in the art.

VGAM1896 is a novel bioinformatically detected regulatory, non protein coding, viral micro RNA (miRNA) gene. The method by which VGAM1896 was detected is described hereinabove with reference to FIGS. 1-8.

VGAM1896 gene, herein designated VGAM GENE, is a viral gene contained in the genome of Respiratory Syncytial Virus. VGAM1896 host target gene, herein designated VGAM HOST TARGET GENE, is a human gene contained in the human genome.

VGAM1896 gene encodes a VGAM1896 precursor RNA, herein designated VGAM PRECURSOR RNA. Similar to other miRNA genes, and unlike most ordinary genes, VGAM1896 precursor RNA does not encode a protein. A nucleotide sequence identical or highly similar to the nucleotide sequence of VGAM1896 precursor RNA is designated SEQ ID:1882, and is provided hereinbelow with reference to the sequence listing part. Nucleotide sequence SEQ ID:1882 is located at position 4399 relative to the genome of Respiratory Syncytial Virus.

VGAM1896 precursor RNA folds onto itself, forming VGAM1896 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1896 folded precursor RNA into VGAM1896 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1896 RNA is designated SEQ ID:4607, and is provided hereinbelow with reference to the sequence listing part.

VGAM1896 host target gene, herein designated VGAM HOST TARGET GENE, encodes a corresponding messenger RNA, VGAM1896 host target RNA, herein designated VGAM HOST TARGET RNA. VGAM1896 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1896 RNA, herein designated VGAM RNA, binds complementarily to one or more host target binding sites located in untranslated regions of VGAM1896 host target RNA, herein designated VGAM HOST TARGET RNA. This complementary binding is due to the fact that the nucleotide sequence of VGAM1896 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1896 RNA, herein designated VGAM RNA, may have a different number of host target binding sites in untranslated regions of a VGAM1896 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1896 RNA, herein designated VGAM RNA, to host target binding sites on VGAM1896 host target RNA, herein designated VGAM HOST TARGET RNA, such as BINDING SITE I, BINDING SITE II and BINDING SITE III, inhibits translation of VGAM1896 host target RNA into VGAM1896 host target protein, herein designated VGAM HOST TARGET PROTEIN. VGAM host target protein is therefore outlined by a broken line.

It is appreciated that VGAM1896 host target gene, herein designated VGAM HOST TARGET GENE, in fact represents a plurality of VGAM1896 host target genes. The mRNA of each one of this plurality of VGAM1896 host target genes comprises one or more host target binding sites, each having a nucleotide sequence which is at least partly complementary to VGAM1896 RNA, herein designated VGAM RNA, and which when bound by VGAM1896 RNA causes inhibition of translation of respective one or more VGAM1896 host target proteins.

It is further appreciated by one skilled in the art that the mode of translational inhibition illustrated by FIG. 1 with specific reference to translational inhibition exerted by VGAM1896 gene, herein designated VGAM GENE, on one or more VGAM1896 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1896 is inhibition of expression of host target genes, as part of a novel viral mechanism of attacking a host. Accordingly, utilities of VGAM1896 include diagnosis, prevention and treatment of viral infection by Respiratory Syncytial Virus. Specific functions, and accordingly utilities, of VGAM1896 correlate with, and may be deduced from, the identity of the host target genes which VGAM1896 binds and inhibits, and the function of these host target genes, as elaborated hereinbelow.

Nucleotide sequences of the VGAM1896 precursor RNA, herein designated VGAM PRECURSOR RNA, and of the 'diced' VGAM1896 RNA, herein designated VGAM RNA, and a schematic representation of the secondary folding of VGAM1896 folded precursor RNA, herein designated VGAM FOLDED PRECURSOR RNA, of VGAM1896 are further described hereinbelow with reference to Table 1.

Nucleotide sequences of host target binding sites, such as BINDING SITE-I, BINDING SITE-II and BINDING SITE-III of FIG. 1, found on VGAM1896 host target RNA, and schematic representation of the complementarity of each of these host target binding sites to VGAM1896 RNA, herein designated VGAM RNA, are described hereinbelow with reference to Table 2.

As mentioned hereinabove with reference to FIG. 1, a function of VGAM1896 gene, herein designated VGAM is inhibition of expression of VGAM1896 target genes. It is appreciated that specific functions, and accordingly utilities, of VGAM1896 correlate with, and may be deduced from, the identity of the target genes which VGAM1896 binds and inhibits, and the function of these target genes, as elaborated hereinbelow.

Protein Phosphatase 1, Catalytic Subunit, Beta Isoform (PPP1CB, Accession NM_002709) is a VGAM1896 host target gene. PPP1CB BINDING SITE is HOST TARGET binding site found in the 3' untranslated region of mRNA encoded by PPP1CB, corresponding to a HOST TARGET binding site such as BINDING SITE I, BINDING SITE II or BINDING SITE III. Table 2 illustrates the complementarity of the nucleotide sequences of PPP1CB BINDING SITE, designated SEQ ID:8558, to the nucleotide sequence of VGAM1896 RNA, herein designated VGAM RNA, also designated SEQ ID:4607.

A function of VGAM1896 is therefore inhibition of Protein Phosphatase 1, Catalytic Subunit, Beta Isoform (PPP1CB, Accession NM_002709), a gene which is the catalytic subunit of protein phosphatase 1. Accordingly, utilities of VGAM1896 include diagnosis, prevention and treatment of diseases and clinical conditions associated with PPP1CB. The function of PPP1CB and its association with various diseases and clinical conditions, has been established by previous studies, as described hereinabove with reference to VGAM46. BY55 (Accession XM_001667) is another VGAM1896 host target gene. BY55 BINDING SITE is HOST TARGET binding site found in the 3' untranslated region of mRNA encoded by BY55, corresponding to a HOST TARGET binding site such as BINDING SITE I, BINDING SITE II or BINDING SITE III. Table 2 illustrates the complementarity of the nucleotide sequences of BY55 BINDING SITE, designated SEQ ID:29845, to the nucleotide sequence of VGAM1896 RNA, herein designated VGAM RNA, also designated SEQ ID:4607.

Another function of VGAM1896 is therefore inhibition of BY55 (Accession XM_001667). Accordingly, utilities of VGAM1896 include diagnosis, prevention and treatment of diseases and clinical conditions associated with BY55. KIAA1042 (Accession NM_014965) is another VGAM1896 host target gene. KIAA1042 BINDING SITE is HOST TARGET binding site found in the 3' untranslated region of mRNA encoded by KIAA1042, corresponding to a HOST TARGET binding site such as BINDING SITE I, BINDING SITE II or BINDING SITE III. Table 2 illustrates the complementarity of the nucleotide sequences of KIAA1042 BINDING SITE, designated SEQ ID:17353, to the nucleotide sequence of VGAM1896 RNA, herein designated VGAM RNA, also designated SEQ ID:4607.

Another function of VGAM1896 is therefore inhibition of KIAA1042 (Accession NM_014965). Accordingly, utilities of VGAM1896 include diagnosis, prevention and treatment of diseases and clinical conditions associated with KIAA1042. MAWBP (Accession NM_022129) is another VGAM1896 host target gene. MAWBP BINDING SITE is HOST TARGET binding site found in the 3' untranslated region of mRNA encoded by MAWBP, corresponding to a HOST TARGET binding site such as BINDING SITE I, BINDING SITE II or BINDING SITE III. Table 2 illustrates the complementarity of the nucleotide sequences of MAWBP BINDING SITE, designated SEQ ID:22681, to the nucleotide sequence of VGAM1896 RNA, herein designated VGAM RNA, also designated SEQ ID:4607.

Another function of VGAM1896 is therefore inhibition of MAWBP (Accession NM_022129). Accordingly, utilities of VGAM1896 include diagnosis, prevention and treatment of diseases and clinical conditions associated with MAWBP. MEGF10 (Accession NM_032446) is another VGAM1896 host target gene. MEGF10 BINDING SITE is HOST TARGET binding site found in the 3' untranslated region of mRNA encoded by MEGF10, corresponding to a HOST TARGET binding site such as BINDING SITE I, BINDING SITE II or BINDING SITE III. Table 2 illustrates the complementarity of the nucleotide sequences of MEGF10 BINDING SITE, designated SEQ ID:26209, to the nucleotide sequence of VGAM1896 RNA, herein designated VGAM RNA, also designated SEQ ID:4607.

Another function of VGAM1896 is therefore inhibition of MEGF10 (Accession NM_032446). Accordingly, utilities of VGAM1896 include diagnosis, prevention and treatment of diseases and clinical conditions associated with MEGF10. LOC151361 (Accession XM_098048) is another VGAM1896 host target gene. LOC151361 BINDING SITE is HOST TARGET binding site found in the 5' untranslated region of mRNA encoded by LOC151361, corresponding to a HOST TARGET binding site such as BINDING SITE I, BINDING SITE II or BINDING SITE III. Table 2 illustrates the complementarity of the nucleotide sequences of LOC151361 BINDING SITE, designated SEQ ID:41333, to the nucleotide sequence of VGAM1896 RNA, herein designated VGAM RNA, also designated SEQ ID:4607.

Another function of VGAM1896 is therefore inhibition of LOC151361 (Accession XM_098048). Accordingly, utilities of VGAM1896 include diagnosis, prevention and treatment of diseases and clinical conditions associated with LOC151361. LOC162333 (Accession XM_102591) is another VGAM1896 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42130, to the nucleotide sequence of VGAM1896 RNA, herein designated VGAM RNA, also designated SEQ ID:4607.

Another function of VGAM1896 is therefore inhibition of LOC162333 (Accession XM_102591). Accordingly, utilities of VGAM1896 include diagnosis, prevention and treatment of diseases and clinical conditions associated with LOC162333. LOC201725 (Accession XM_114370) is another VGAM1896 host target gene. LOC201725 BINDING SITE is HOST TARGET binding site found in the 3' untranslated region of mRNA encoded by LOC201725, corresponding to a HOST TARGET binding site such as BINDING SITE I, BINDING SITE II or BINDING SITE III. Table 2 illustrates the complementarity of the nucleotide sequences of LOC201725 BINDING SITE, designated SEQ ID:42905, to the nucleotide sequence of VGAM1896 RNA, herein designated VGAM RNA, also designated SEQ ID:4607.

Another function of VGAM1896 is therefore inhibition of LOC201725 (Accession XM_114370). Accordingly, utilities of VGAM1896 include diagnosis, prevention and treatment of diseases and clinical conditions associated with LOC201725. FIG. 1 further provides a conceptual description of a novel bioinformatically detected viral gene of the present invention, referred to here as Viral Genomic Address Messenger 1897 (VGAM1897) viral gene, which modulates expression of respective host target genes thereof, the function and utility of which host target genes is known in the art.

VGAM1897 is a novel bioinformatically detected regulatory, non protein coding, viral micro RNA (miRNA) gene. The method by which VGAM1897 was detected is described hereinabove with reference to FIGS. 1-8.

VGAM1897 gene, herein designated VGAM GENE, is a viral gene contained in the genome of Garlic Latent Virus. VGAM1897 host target gene, herein designated VGAM HOST TARGET GENE, is a human gene contained in the human genome.

VGAM1897 gene encodes a VGAM1897 precursor RNA, herein designated VGAM PRECURSOR RNA. Similar to other miRNA genes, and unlike most ordinary genes, VGAM1897 precursor RNA does not encode a protein. A nucleotide sequence identical or highly similar to the nucleotide sequence of VGAM1897 precursor RNA is designated SEQ ID:1883, and is provided hereinbelow with reference to the sequence listing part. Nucleotide sequence SEQ ID:1883 is located at position 5382 relative to the genome of Garlic Latent Virus.

VGAM1897 precursor RNA folds onto itself, forming VGAM1897 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1897 folded precursor RNA into VGAM1897 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1897 RNA is designated SEQ ID:4608, and is provided hereinbelow with reference to the sequence listing part.

VGAM1897 host target gene, herein designated VGAM HOST TARGET GENE, encodes a corresponding messenger RNA, VGAM1897 host target RNA, herein designated VGAM HOST TARGET RNA. VGAM1897 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1897 RNA, herein designated VGAM RNA, binds complementarily to one or more host target binding sites located in untranslated regions of VGAM1897 host target RNA, herein designated VGAM HOST TARGET RNA. This complementary binding is due to the fact that the nucleotide sequence of VGAM1897 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1897 RNA, herein designated VGAM RNA, may have a different number of host target binding sites in untranslated regions of a VGAM1897 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1897 RNA, herein designated VGAM RNA, to host target binding sites on VGAM1897 host target RNA, herein designated VGAM HOST TARGET RNA, such as BINDING SITE I, BINDING SITE II and BINDING SITE III, inhibits translation of VGAM1897 host target RNA into VGAM1897 host target protein, herein designated VGAM HOST TARGET PROTEIN. VGAM host target protein is therefore outlined by a broken line.

It is appreciated that VGAM1897 host target gene, herein designated VGAM HOST TARGET GENE, in fact represents a plurality of VGAM1897 host target genes. The mRNA of each one of this plurality of VGAM1897 host target genes comprises one or more host target binding sites, each having a nucleotide sequence which is at least partly complementary to VGAM1897 RNA, herein designated VGAM RNA, and which when bound by VGAM1897 RNA causes inhibition of translation of respective one or more VGAM1897 host target proteins.

It is further appreciated by one skilled in the art that the mode of translational inhibition illustrated by FIG. 1 with specific reference to translational inhibition exerted by VGAM1897 gene, herein designated VGAM GENE, on one or more VGAM1897 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1897 is inhibition of expression of host target genes, as part of a novel viral mechanism of attacking a host. Accordingly, utilities of VGAM1897 include diagnosis, prevention and treatment of viral infection by Garlic Latent Virus. Specific functions, and accordingly utilities, of VGAM1897 correlate with, and may be deduced from, the identity of the host target genes which VGAM1897 binds and inhibits, and the function of these host target genes, as elaborated hereinbelow.

Nucleotide sequences of the VGAM1897 precursor RNA, herein designated VGAM PRECURSOR RNA, and of the 'diced' VGAM1897 RNA, herein designated VGAM RNA, and a schematic representation of the secondary folding of VGAM1897 folded precursor RNA, herein designated VGAM FOLDED PRECURSOR RNA, of VGAM1897 are further described hereinbelow with reference to Table 1.

Nucleotide sequences of host target binding sites, such as BINDING SITE-I, BINDING SITE-II and BINDING SITE-III of FIG. 1, found on VGAM1897 host target RNA, and schematic representation of the complementarity of each of these host target binding sites to VGAM1897 RNA, herein designated VGAM RNA, are described hereinbelow with reference to Table 2.

As mentioned hereinabove with reference to FIG. 1, a function of VGAM1897 gene, herein designated VGAM is inhibition of expression of VGAM1897 target genes. It is appreciated that specific functions, and accordingly utilities, of VGAM1897 correlate with, and may be deduced from, the identity of the target genes which VGAM1897 binds and inhibits, and the function of these target genes, as elaborated hereinbelow.

Microfibrillar-associated Protein 3 (MFAP3, Accession NM_005927) is a VGAM1897 host target gene. MFAP3 BINDING SITE is HOST TARGET binding site found in the 5' untranslated region of mRNA encoded by MFAP3, corresponding to a HOST TARGET binding site such as BINDING SITE I, BINDING SITE II or BINDING SITE III. Table 2 illustrates the complementarity of the nucleotide sequences of MFAP3 BINDING SITE, designated SEQ ID:12555, to the nucleotide sequence of VGAM1897 RNA, herein designated VGAM RNA, also designated SEQ ID:4608.

A function of VGAM1897 is therefore inhibition of Microfibrillar-associated Protein 3 (MFAP3, Accession NM_005927). Accordingly, utilities of VGAM1897 include diagnosis, prevention and treatment of diseases and clinical conditions associated with MFAP3. Pro-melanin-concentrating Hormone-like 1 (PMCHL1, Accession NM_031887) is another VGAM1897 host target gene. PMCHL1 BINDING SITE is HOST TARGET binding site found in the 3' untranslated region of mRNA encoded by PMCHL1, corresponding to a HOST TARGET binding site such as BINDING SITE I, BINDING SITE II or BINDING SITE III. Table 2 illustrates the complementarity of the nucleotide sequences of PMCHL1 BINDING SITE, designated SEQ ID:25631, to the nucleotide sequence of VGAM1897 RNA, herein designated VGAM RNA, also designated SEQ ID:4608.

Another function of VGAM1897 is therefore inhibition of Pro-melanin-concentrating Hormone-like 1 (PMCHL1, Accession NM_031887). Accordingly, utilities of VGAM1897 include diagnosis, prevention and treatment of diseases and clinical conditions associated with PMCHL1. Calcium Binding Atopy-related Autoantigen 1 (CBARA1, Accession NM_006077) is another VGAM1897 host target gene. CBARA1 BINDING SITE is HOST TARGET binding site found in the 3' untranslated region of mRNA encoded by CBARA1, corresponding to a HOST TARGET binding site such as BINDING SITE I, BINDING SITE II or BINDING SITE III. Table 2 illustrates the complementarity of the nucleotide sequences of CBARA1 BINDING SITE, designated SEQ ID:12723, to the nucleotide sequence of VGAM1897 RNA, herein designated VGAM RNA, also designated SEQ ID:4608.

Another function of VGAM1897 is therefore inhibition of Calcium Binding Atopy-related Autoantigen 1 (CBARA1, Accession NM_006077). Accordingly, utilities of VGAM1897 include diagnosis, prevention and treatment of diseases and clinical conditions associated with CBARA1. FLJ10704 (Accession NM_018185) is another VGAM1897 host target gene. FLJ10704 BINDING SITE is HOST TARGET binding site found in the 3' untranslated region of mRNA encoded by FLJ10704, corresponding to a HOST TARGET binding site such as BINDING SITE I, BINDING SITE II or BINDING SITE III. Table 2 illustrates the complementarity of the nucleotide sequences of FLJ10704 BINDING SITE, designated SEQ ID:20033, to the nucleotide sequence of VGAM1897 RNA, herein designated VGAM RNA, also designated SEQ ID:4608.

Another function of VGAM1897 is therefore inhibition of FLJ10704 (Accession NM_018185). Accordingly, utilities of VGAM1897 include diagnosis, prevention and treatment of diseases and clinical conditions associated with FLJ10704. FLJ13456 (Accession XM_038291) is another VGAM1897 host target gene. FLJ13456 BINDING SITE is HOST TARGET binding site found in the 3' untranslated region of mRNA encoded by FLJ13456, corresponding to a HOST TARGET binding site such as BINDING SITE I, BINDING SITE II or BINDING SITE III. Table 2 illustrates the complementarity of the nucleotide sequences of FLJ13456 BINDING SITE, designated SEQ ID:32798, to the nucleotide sequence of VGAM1897 RNA, herein designated VGAM RNA, also designated SEQ ID:4608.

Another function of VGAM1897 is therefore inhibition of FLJ13456 (Accession XM_038291). Accordingly, utilities of VGAM1897 include diagnosis, prevention and treatment of diseases and clinical conditions associated with FLJ13456. KIAA1013 (Accession XM_114303) is another VGAM1897 host target gene. KIAA1013 BINDING SITE is HOST TARGET binding site found in the 3' untranslated region of mRNA encoded by KIAA1013, corresponding to a HOST TARGET binding site such as BINDING SITE I, BINDING SITE II or BINDING SITE III. Table 2 illustrates the complementarity of the nucleotide sequences of KIAA1013 BINDING SITE, designated SEQ ID:42857, to the nucleotide sequence of VGAM1897 RNA, herein designated VGAM RNA, also designated SEQ ID:4608.

Another function of VGAM1897 is therefore inhibition of KIAA1013 (Accession XM_114303). Accordingly, utilities of VGAM1897 include diagnosis, prevention and treatment of diseases and clinical conditions associated with KIAA1013. MGC32104 (Accession NM_144684) is another VGAM1897 host target gene. MGC32104 BINDING SITE is HOST TARGET binding site found in the 3' untranslated region of mRNA encoded by MGC32104, corresponding to a HOST TARGET binding site such as BINDING SITE I, BINDING SITE II or BINDING SITE III. Table 2 illustrates the complementarity of the nucleotide sequences of MGC32104 BINDING SITE, designated SEQ ID:29505, to the nucleotide sequence of VGAM1897 RNA, herein designated VGAM RNA, also designated SEQ ID:4608.

Another function of VGAM1897 is therefore inhibition of MGC32104 (Accession NM_144684). Accordingly, utilities of VGAM1897 include diagnosis, prevention and treatment of diseases and clinical conditions associated with MGC32104. Serine Palmitoyltransferase, Long Chain Base Subunit 2 (SPTLC2, Accession NM_004863) is another VGAM1897 host target gene. SPTLC2 BINDING SITE is HOST TARGET binding site found in the 3' untranslated region of mRNA encoded by SPTLC2, corresponding to a HOST TARGET binding site such as BINDING SITE I, BINDING SITE II or BINDING SITE III. Table 2 illustrates the complementarity of the nucleotide sequences of SPTLC2 BINDING SITE, designated SEQ ID:11277, to the nucleotide sequence of VGAM1897 RNA, herein designated VGAM RNA, also designated SEQ ID:4608.

Another function of VGAM1897 is therefore inhibition of Serine Palmitoyltransferase, Long Chain Base Subunit 2 (SPTLC2, Accession NM_004863). Accordingly, utilities of VGAM1897 include diagnosis, prevention and treatment of diseases and clinical conditions associated with SPTLC2. Upstream Binding Protein 1 (LBP-1a) (UBP1, Accession NM_014517) is another VGAM1897 host target gene. UBP1 BINDING SITE is HOST TARGET binding site found in the 3' untranslated region of mRNA encoded by UBP1, corresponding to a HOST TARGET binding site such as BINDING SITE I, BINDING SITE II or BINDING SITE III. Table 2 illustrates the complementarity of the nucleotide sequences of UBP1 BINDING SITE, designated SEQ ID:15846, to the nucleotide sequence of VGAM1897 RNA, herein designated VGAM RNA, also designated SEQ ID:4608.

Another function of VGAM1897 is therefore inhibition of Upstream Binding Protein 1 (LBP-1a) (UBP1, Accession NM_014517). Accordingly, utilities of VGAM1897 include diagnosis, prevention and treatment of diseases and clinical conditions associated with UBP1. LOC144348 (Accession XM_084826) is another VGAM1897 host target gene. LOC144348 BINDING SITE is HOST TARGET binding site found in the 5' untranslated region of mRNA encoded by LOC144348, corresponding to a HOST TARGET binding site such as BINDING SITE I, BINDING SITE II or BINDING SITE III. Table 2 illustrates the complementarity of the nucleotide sequences of LOC144348 BINDING SITE, designated SEQ ID:37721, to the nucleotide sequence of VGAM1897 RNA, herein designated VGAM RNA, also designated SEQ ID:4608.

Another function of VGAM1897 is therefore inhibition of LOC144348 (Accession XM_084826). Accordingly, utilities of VGAM1897 include diagnosis, prevention and treatment of diseases and clinical conditions associated with LOC144348. LOC196418 (Accession XM_113717) is another VGAM1897 host target gene. LOC196418 BINDING SITE is HOST TARGET binding site found in the 5' untranslated region of mRNA encoded by LOC196418, corresponding to a HOST TARGET binding site such as BINDING SITE I, BINDING SITE II or BINDING SITE III. Table 2 illustrates the complementarity of the nucleotide sequences of LOC196418 BINDING SITE, designated SEQ ID:42369, to the nucleotide sequence of VGAM1897 RNA, herein designated VGAM RNA, also designated SEQ ID:4608.

Another function of VGAM1897 is therefore inhibition of LOC196418 (Accession XM_113717). Accordingly, utilities of VGAM1897 include diagnosis, prevention and treatment of diseases and clinical conditions associated with LOC196418. LOC221362 (Accession XM_168093) is another VGAM1897 host target gene. LOC221362 BINDING SITE is HOST TARGET binding site found in the 3' untranslated region of mRNA encoded by LOC221362, corresponding to a HOST TARGET binding site such as BINDING SITE I, BINDING SITE II or BINDING SITE III. Table 2 illustrates the complementarity of the nucleotide sequences of LOC221362 BINDING SITE, designated SEQ ID:45020, to the nucleotide sequence of VGAM1897 RNA, herein designated VGAM RNA, also designated SEQ ID:4608.

Another function of VGAM1897 is therefore inhibition of LOC221362 (Accession XM_168093). Accordingly, utilities of VGAM1897 include diagnosis, prevention and treatment of diseases and clinical conditions associated with LOC221362. LOC254672 (Accession XM_170619) is another VGAM1897 host target gene. LOC254672 BINDING SITE is HOST TARGET binding site found in the 3' untranslated region of mRNA encoded by LOC254672, corresponding to a HOST TARGET binding site such as BINDING SITE I, BINDING SITE II or BINDING SITE III. Table 2 illustrates the complementarity of the nucleotide sequences of LOC254672 BINDING SITE, designated SEQ ID:45398, to the nucleotide sequence of VGAM1897 RNA, herein designated VGAM RNA, also designated SEQ ID:4608.

Another function of VGAM1897 is therefore inhibition of LOC254672 (Accession XM_170619). Accordingly, utilities of VGAM1897 include diagnosis, prevention and treatment of diseases and clinical conditions associated with LOC254672. FIG. 1 further provides a conceptual description of a novel bioinformatically detected viral gene of the present invention, referred to here as Viral Genomic Address Messenger 1898 (VGAM1898) viral gene, which modulates expression of respective host target genes thereof, the function and utility of which host target genes is known in the art.

VGAM1898 is a novel bioinformatically detected regulatory, non protein coding, viral micro RNA (miRNA) gene. The method by which VGAM1898 was detected is described hereinabove with reference to FIGS. 1-8.

VGAM1898 gene, herein designated VGAM GENE, is a viral gene contained in the genome of Garlic Latent Virus. VGAM1898 host target gene, herein designated VGAM HOST TARGET GENE, is a human gene contained in the human genome.

VGAM1898 gene encodes a VGAM1898 precursor RNA, herein designated VGAM PRECURSOR RNA. Similar to other miRNA genes, and unlike most ordinary genes, VGAM1898 precursor RNA does not encode a protein. A nucleotide sequence identical or highly similar to the nucleotide sequence of VGAM1898 precursor RNA is designated SEQ ID:1884, and is provided hereinbelow with reference to the sequence listing part. Nucleotide sequence SEQ ID:1884 is located at position 4971 relative to the genome of Garlic Latent Virus.

VGAM1898 precursor RNA folds onto itself, forming VGAM1898 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1898 folded precursor RNA into VGAM1898 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM1898 RNA is designated SEQ ID:4609, and is provided hereinbelow with reference to the sequence listing part.

VGAM1898 host target gene, herein designated VGAM HOST TARGET GENE, encodes a corresponding messenger RNA, VGAM1898 host target RNA, herein designated VGAM HOST TARGET RNA. VGAM1898 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1898 RNA, herein designated VGAM RNA, binds complementarily to one or more host target binding sites located in untranslated regions of VGAM1898 host target RNA, herein designated VGAM HOST TARGET RNA. This complementary binding is due to the fact that the nucleotide sequence of VGAM1898 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1898 RNA, herein designated VGAM RNA, may have a different number of host target binding sites in untranslated regions of a VGAM1898 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1898 RNA, herein designated VGAM RNA, to host target binding sites on VGAM1898 host target RNA, herein designated VGAM HOST TARGET RNA, such as BINDING SITE I, BINDING SITE II and BINDING SITE III, inhibits translation of VGAM1898 host target RNA into VGAM1898 host target protein, herein designated VGAM HOST TARGET PROTEIN. VGAM host target protein is therefore outlined by a broken line.

It is appreciated that VGAM1898 host target gene, herein designated VGAM HOST TARGET GENE, in fact represents a plurality of VGAM1898 host target genes. The mRNA of each one of this plurality of VGAM1898 host target genes comprises one or more host target binding sites, each having a nucleotide sequence which is at least partly complementary to VGAM1898 RNA, herein designated VGAM RNA, and which when bound by VGAM1898 RNA causes inhibition of translation of respective one or more VGAM1898 host target proteins.

It is further appreciated by one skilled in the art that the mode of translational inhibition illustrated by FIG. 1 with specific reference to translational inhibition exerted by VGAM1898 gene, herein designated VGAM GENE, on one or more VGAM1898 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1898 is inhibition of expression of host target genes, as part of a novel viral mechanism of attacking a host. Accordingly, utilities of VGAM1898 include diagnosis, prevention and treatment of viral infection by Garlic Latent Virus. Specific functions, and accordingly utilities, of VGAM1898 correlate with, and may be deduced from, the identity of the host target genes which VGAM1898 binds and inhibits, and the function of these host target genes, as elaborated hereinbelow.

Nucleotide sequences of the VGAM1898 precursor RNA, herein designated VGAM PRECURSOR RNA, and of the 'diced' VGAM1898 RNA, herein designated VGAM RNA, and a schematic representation of the secondary folding of VGAM1898 folded precursor RNA, herein designated VGAM FOLDED PRECURSOR RNA, of VGAM1898 are further described hereinbelow with reference to Table 1.

Nucleotide sequences of host target binding sites, such as BINDING SITE-I, BINDING SITE-II and BINDING SITE-III of FIG. 1, found on VGAM1898 host target RNA, and schematic representation of the complementarity of each of these host target binding sites to VGAM1898 RNA, herein designated VGAM RNA, are described hereinbelow with reference to Table 2.

As mentioned hereinabove with reference to FIG. 1, a function of VGAM1898 gene, herein designated VGAM is inhibition of expression of VGAM1898 target genes. It is appreciated that specific functions, and accordingly utilities, of VGAM1898 correlate with, and may be deduced from, the identity of the target genes which VGAM1898 binds and inhibits, and the function of these target genes, as elaborated hereinbelow.

Zinc Finger Protein 91 Homolog (mouse) (ZFP91, Accession NM_053023) is a VGAM1898 host target gene. ZFP91 BINDING SITE is HOST TARGET binding site found in the 3' untranslated region of mRNA encoded by ZFP91, corresponding to a HOST TARGET binding site such as BINDING SITE I, BINDING SITE II or BINDING SITE III. Table 2 illustrates the complementarity of the nucleotide sequences of ZFP91 BINDING SITE, designated SEQ ID:27571, to the nucleotide sequence of VGAM1898 RNA, herein designated VGAM RNA, also designated SEQ ID:4609.

A function of VGAM1898 is therefore inhibition of Zinc Finger Protein 91 Homolog (mouse) (ZFP91, Accession NM_053023). Accordingly, utilities of VGAM1898 include diagnosis, prevention and treatment of diseases and clinical conditions associated with ZFP91. FIG. 1 further provides a conceptual description of a novel bioinformatically detected viral gene of the present invention, referred to here as Viral Genomic Address Messenger 1899 (VGAM1899) viral gene, which modulates expression of respective host target genes thereof, the function and utility of which host target genes is known in the art.

VGAM1899 is a novel bioinformatically detected regulatory, non protein coding, viral micro RNA (miRNA) gene. The method by which VGAM1899 was detected is described hereinabove with reference to FIGS. 1-8.

VGAM1899 gene, herein designated VGAM GENE, is a viral gene contained in the genome of Respiratory Syncytial Virus. VGAM1899 host target gene, herein designated VGAM HOST TARGET GENE, is a human gene contained in the human genome.

VGAM1899 gene encodes a VGAM1899 precursor RNA, herein designated VGAM PRECURSOR RNA. Similar to other miRNA genes, and unlike most ordinary genes, VGAM1899 precursor RNA does not encode a protein. A nucleotide sequence identical or highly similar to the nucleotide sequence of VGAM1899 precursor RNA is designated SEQ ID:1885, and is provided hereinbelow with reference to the sequence listing part. Nucleotide sequence SEQ ID:1885 is located at position 7191 relative to the genome of Respiratory Syncytial Virus.

VGAM1899 precursor RNA folds onto itself, forming VGAM1899 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1899 folded precursor RNA into VGAM1899 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1899 RNA is designated SEQ ID:4610, and is provided hereinbelow with reference to the sequence listing part.

VGAM1899 host target gene, herein designated VGAM HOST TARGET GENE, encodes a corresponding messenger RNA, VGAM1899 host target RNA, herein designated VGAM HOST TARGET RNA. VGAM1899 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1899 RNA, herein designated VGAM RNA, binds complementarily to one or more host target binding sites located in untranslated regions of VGAM1899 host target RNA, herein designated VGAM HOST TARGET RNA. This complementary binding is due to the fact that the nucleotide sequence of VGAM1899 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1899 RNA, herein designated VGAM RNA, may have a different number of host target binding sites in untranslated regions of a VGAM1899 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1899 RNA, herein designated VGAM RNA, to host target binding sites on VGAM1899 host target RNA, herein designated VGAM HOST TARGET RNA, such as BINDING SITE I, BINDING SITE II and BINDING SITE III, inhibits translation of VGAM1899 host target RNA into VGAM1899 host target protein, herein designated VGAM HOST TARGET PROTEIN. VGAM host target protein is therefore outlined by a broken line.

It is appreciated that VGAM1899 host target gene, herein designated VGAM HOST TARGET GENE, in fact represents a plurality of VGAM1899 host target genes. The mRNA of each one of this plurality of VGAM1899 host target genes comprises one or more host target binding sites, each having a nucleotide sequence which is at least partly complementary to VGAM1899 RNA, herein designated VGAM RNA, and which when bound by VGAM1899 RNA causes inhibition of translation of respective one or more VGAM1899 host target proteins.

It is further appreciated by one skilled in the art that the mode of translational inhibition illustrated by FIG. 1 with specific reference to translational inhibition exerted by VGAM1899 gene, herein designated VGAM GENE, on one or more VGAM1899 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1899 is inhibition of expression of host target genes, as part of a novel viral mechanism of attacking a host. Accordingly, utilities of VGAM1899 include diagnosis, prevention and treatment of viral infection by Respiratory Syncytial Virus. Specific functions, and accordingly utilities, of VGAM1899 correlate with, and may be deduced from, the identity of the host target genes which VGAM1899 binds and inhibits, and the function of these host target genes, as elaborated hereinbelow.

Nucleotide sequences of the VGAM1899 precursor RNA, herein designated VGAM PRECURSOR RNA, and of the 'diced' VGAM1899 RNA, herein designated VGAM RNA, and a schematic representation of the secondary folding of VGAM1899 folded precursor RNA, herein designated VGAM FOLDED PRECURSOR RNA, of VGAM1899 are further described hereinbelow with reference to Table 1.

Nucleotide sequences of host target binding sites, such as BINDING SITE-I, BINDING SITE-II and BINDING SITE-III of FIG. 1, found on VGAM1899 host target RNA, and schematic representation of the complementarity of each of these host target binding sites to VGAM1899 RNA, herein designated VGAM RNA, are described hereinbelow with reference to Table 2.

As mentioned hereinabove with reference to FIG. 1, a function of VGAM1899 gene, herein designated VGAM is inhibition of expression of VGAM1899 target genes. It is appreciated that specific functions, and accordingly utilities, of VGAM1899 correlate with, and may be deduced from, the identity of the target genes which VGAM1899 binds and inhibits, and the function of these target genes, as elaborated hereinbelow.

Fibrillin 1 (Marfan syndrome) (FBN1, Accession XM_034890) is a VGAM1899 host target gene. FBN1 BINDING SITE is HOST TARGET binding site found in the 3' untranslated region of mRNA encoded by FBN1, corresponding to a HOST TARGET binding site such as BINDING SITE I, BINDING SITE II or BINDING SITE III. Table 2 illustrates the complementarity of the nucleotide sequences of FBN1 BINDING SITE, designated SEQ ID:32183, to the nucleotide sequence of VGAM1899 RNA, herein designated VGAM RNA, also designated SEQ ID:4610.

A function of VGAM1899 is therefore inhibition of Fibrillin 1 (Marfan syndrome) (FBN1, Accession XM_034890). Accordingly, utilities of VGAM1899 include diagnosis, prevention and treatment of diseases and clinical conditions associated with FBN1. GNAS Complex Locus (GNAS, Accession NM_016592) is another VGAM1899 host target gene. GNAS BINDING SITE is HOST TARGET binding site found in the 3' untranslated region of mRNA encoded by GNAS, corresponding to a HOST TARGET binding site such as BINDING SITE I, BINDING SITE II or BINDING SITE III. Table 2 illustrates the complementarity of the nucleotide sequences of GNAS BINDING SITE, designated SEQ ID:18678, to the nucleotide sequence of VGAM1899 RNA, herein designated VGAM RNA, also designated SEQ ID:4610.

Another function of VGAM1899 is therefore inhibition of GNAS Complex Locus (GNAS, Accession NM_016592), a gene which transduces signals from G protein-coupled receptors and activates adenylyl cyclase. Accordingly, utilities of VGAM1899 include diagnosis, prevention and treatment of diseases and clinical conditions associated with GNAS. The function of GNAS and its association with various diseases and clinical conditions, has been established by previous studies, as described hereinabove with reference to VGAM1205. Tropomodulin (TMOD, Accession NM_003275) is another VGAM1899 host target gene. TMOD BINDING SITE is HOST TARGET binding site found in the 3' untranslated region of mRNA encoded by TMOD, corresponding to a HOST TARGET binding site such as BINDING SITE I, BINDING SITE II or BINDING SITE III. Table 2 illustrates the complementarity of the nucleotide sequences of TMOD BINDING SITE, designated SEQ ID:9295, to the nucleotide sequence of VGAM1899 RNA, herein designated VGAM RNA, also designated SEQ ID:4610.

Another function of VGAM1899 is therefore inhibition of Tropomodulin (TMOD, Accession NM_003275), a gene which blocks the elongation and depolymerization of the actin filaments at the pointed end. Accordingly, utilities of VGAM1899 include diagnosis, prevention and treatment of diseases and clinical conditions associated with TMOD. The function of TMOD and its association with various diseases and clinical conditions, has been established by previous studies, as described hereinabove with reference to VGAM716. ATP-binding Cassette, Sub-family A (ABC1), Member 8 (ABCA8, Accession NM_007168) is another VGAM1899 host target gene. ABCA8 BINDING SITE is HOST TARGET binding site found in the 3' untranslated region of mRNA encoded by ABCA8, corresponding to a HOST TARGET binding site such as BINDING SITE I, BINDING SITE II or BINDING SITE III. Table 2 illustrates the complementarity of the nucleotide sequences of ABCA8 BINDING SITE, designated SEQ ID:14013, to the nucleotide sequence of VGAM1899 RNA, herein designated VGAM RNA, also designated SEQ ID:4610.

Another function of VGAM1899 is therefore inhibition of ATP-binding Cassette, Sub-family A (ABC1), Member 8 (ABCA8, Accession NM_007168). Accordingly, utilities of VGAM1899 include diagnosis, prevention and treatment of diseases and clinical conditions associated with ABCA8. Baculoviral IAP Repeat-containing 1 (BIRC1, Accession NM_004536) is another VGAM1899 host target gene. BIRC1 BINDING SITE is HOST TARGET binding site found in the 3' untranslated region of mRNA encoded by BIRC1, corresponding to a HOST TARGET binding site such as BINDING SITE I, BINDING SITE II or BINDING SITE III. Table 2 illustrates the complementarity of the nucleotide sequences of BIRC1 BINDING SITE, designated SEQ ID:10884, to the nucleotide sequence of VGAM1899 RNA, herein designated VGAM RNA, also designated SEQ ID:4610.

Another function of VGAM1899 is therefore inhibition of Baculoviral IAP Repeat-containing 1 (BIRC1, Accession NM_004536). Accordingly, utilities of VGAM1899 include diagnosis, prevention and treatment of diseases and clinical conditions associated with BIRC1. FLJ10508 (Accession NM_018118) is another VGAM1899 host target gene. FLJ10508 BINDING SITE is HOST TARGET binding site found in the 3' untranslated region of mRNA encoded by FLJ10508, corresponding to a HOST TARGET binding site such as BINDING SITE I, BINDING SITE II or BINDING SITE III. Table 2 illustrates the complementarity of the nucleotide sequences of FLJ10508 BINDING SITE, designated SEQ ID:19893, to the nucleotide sequence of VGAM1899 RNA, herein designated VGAM RNA, also designated SEQ ID:4610.

Another function of VGAM1899 is therefore inhibition of FLJ10508 (Accession NM_018118). Accordingly, utilities of VGAM1899 include diagnosis, prevention and treatment of diseases and clinical conditions associated with FLJ10508. FLJ12747 (Accession NM_032173) is another VGAM1899 host target gene. FLJ12747 BINDING SITE is HOST TARGET binding site found in the 3' untranslated region of mRNA encoded by FLJ12747, corresponding to a HOST TARGET binding site such as BINDING SITE I, BINDING SITE II or BINDING SITE III. Table 2 illustrates the complementarity of the nucleotide sequences of FLJ12747 BINDING SITE, designated SEQ ID:25878, to the nucleotide sequence of VGAM1899 RNA, herein designated VGAM RNA, also designated SEQ ID:4610.

Another function of VGAM1899 is therefore inhibition of FLJ12747 (Accession NM_032173). Accordingly, utilities of VGAM1899 include diagnosis, prevention and treatment of diseases and clinical conditions associated with FLJ12747. KIAA0527 (Accession XM_171054) is another VGAM1899 host target gene. KIAA0527 BINDING SITE is HOST TARGET binding site found in the 3' untranslated region of mRNA encoded by KIAA0527, corresponding to a HOST TARGET binding site such as BINDING SITE I, BINDING SITE II or BINDING SITE III. Table 2 illustrates the complementarity of the nucleotide sequences of KIAA0527 BINDING SITE, designated SEQ ID:45850, to the nucleotide sequence of VGAM1899 RNA, herein designated VGAM RNA, also designated SEQ ID:4610.

Another function of VGAM1899 is therefore inhibition of KIAA0527 (Accession XM_171054). Accordingly, utilities of VGAM1899 include diagnosis, prevention and treatment of diseases and clinical conditions associated with KIAA0527. KIAA1948 (Accession XM_091984) is another VGAM1899 host target gene. KIAA1948 BINDING SITE is HOST TARGET binding site found in the 3' untranslated region of mRNA encoded by KIAA1948, corresponding to a HOST TARGET binding site such as BINDING SITE I, BINDING SITE II or BINDING SITE III. Table 2 illustrates the complementarity of the nucleotide sequences of KIAA1948 BINDING SITE, designated SEQ ID:40077, to the nucleotide sequence of VGAM1899 RNA, herein designated VGAM RNA, also designated SEQ ID:4610.

Another function of VGAM1899 is therefore inhibition of KIAA1948 (Accession XM_091984). Accordingly, utilities of VGAM1899 include diagnosis, prevention and treatment of diseases and clinical conditions associated with KIAA1948. NESHBP (Accession NM_015429) is another VGAM1899 host target gene. NESHBP BINDING SITE is HOST TARGET binding site found in the 3' untranslated region of mRNA encoded by NESHBP, corresponding to a HOST TARGET binding site such as BINDING SITE I, BINDING SITE II or BINDING SITE III. Table 2 illustrates the complementarity of the nucleotide sequences of NESHBP BINDING SITE, designated SEQ ID:17728, to the nucleotide sequence of VGAM1899 RNA, herein designated VGAM RNA, also designated SEQ ID:4610.

Another function of VGAM1899 is therefore inhibition of NESHBP (Accession NM_015429). Accordingly, utilities of VGAM1899 include diagnosis, prevention and treatment of diseases and clinical conditions associated with NESHBP. P311 (Accession NM_004772) is another VGAM1899 host target gene. P311 BINDING SITE is HOST TARGET binding site found in the 3' untranslated region of mRNA encoded by P311, corresponding to a HOST TARGET binding site such as BINDING SITE I, BINDING SITE II or BINDING SITE III. Table 2 illustrates the complementarity of the nucleotide sequences of P311 BINDING SITE, designated SEQ ID:11161, to the nucleotide sequence of VGAM1899 RNA, herein designated VGAM RNA, also designated SEQ ID:4610.

Another function of VGAM1899 is therefore inhibition of P311 (Accession NM_004772). Accordingly, utilities of VGAM1899 include diagnosis, prevention and treatment of diseases and clinical conditions associated with P311. Pleckstrin Homology Domain Interacting Protein (PHIP, Accession NM_017934) is another VGAM1899 host target gene. PHIP BINDING SITE is HOST TARGET binding site found in the 5' untranslated region of mRNA encoded by PHIP, corresponding to a HOST TARGET binding site such as BINDING SITE I, BINDING SITE II or BINDING SITE III. Table 2 illustrates the complementarity of the nucleotide sequences of PHIP BINDING SITE, designated SEQ ID:19622, to the nucleotide sequence of VGAM1899 RNA, herein designated VGAM RNA, also designated SEQ ID:4610.

Another function of VGAM1899 is therefore inhibition of Pleckstrin Homology Domain Interacting Protein (PHIP, Accession NM_017934). Accordingly, utilities of VGAM1899 include diagnosis, prevention and treatment of diseases and clinical conditions associated with PHIP. Serine Palmitoyltransferase, Long Chain Base Subunit 2 (SPTLC2, Accession NM_004863) is another VGAM1899 host target gene. SPTLC2 BINDING SITE is HOST TARGET binding site found in the 3' untranslated region of mRNA encoded by SPTLC2, corresponding to a HOST TARGET binding site such as BINDING SITE I, BINDING SITE II or BINDING SITE III. Table 2 illustrates the complementarity of the nucleotide sequences of SPTLC2 BINDING SITE, designated SEQ ID:11273, to the nucleotide sequence of VGAM1899 RNA, herein designated VGAM RNA, also designated SEQ ID:4610.

Another function of VGAM1899 is therefore inhibition of Serine Palmitoyltransferase, Long Chain Base Subunit 2 (SPTLC2, Accession NM_004863). Accordingly, utilities of VGAM1899 include diagnosis, prevention and treatment of diseases and clinical conditions associated with SPTLC2. LOC144747 (Accession XM_084954) is another VGAM1899 host target gene. LOC144747 BINDING SITE is HOST TARGET binding site found in the 5' untranslated region of mRNA encoded by LOC144747, corresponding to a HOST TARGET binding site such as BINDING SITE I, BINDING SITE II or BINDING SITE III. Table 2 illustrates the complementarity of the nucleotide sequences of LOC144747 BINDING SITE, designated SEQ ID:37783, to the nucleotide sequence of VGAM1899 RNA, herein designated VGAM RNA, also designated SEQ ID:4610.

Another function of VGAM1899 is therefore inhibition of LOC144747 (Accession XM_084954). Accordingly, utilities of VGAM1899 include diagnosis, prevention and treatment of diseases and clinical conditions associated with LOC144747. LOC149372 (Accession XM_086509) is another VGAM1899 host target gene. LOC149372 BINDING SITE is HOST TARGET binding site found in the 5' untranslated region of mRNA encoded by LOC149372, corresponding to a HOST TARGET binding site such as BINDING SITE I, BINDING SITE II or BINDING SITE III. Table 2 illustrates the complementarity of the nucleotide sequences of LOC149372 BINDING SITE, designated SEQ ID:38723, to the nucleotide sequence of VGAM1899 RNA, herein designated VGAM RNA, also designated SEQ ID:4610.

Another function of VGAM1899 is therefore inhibition of LOC149372 (Accession XM_086509). Accordingly, utilities of VGAM1899 include diagnosis, prevention and treatment of diseases and clinical conditions associated with LOC149372. LOC257463 (Accession XM_048605) is another VGAM1899 host target gene. LOC257463 BINDING SITE is HOST TARGET binding site found in the 3' untranslated region of mRNA encoded by LOC257463, corresponding to a HOST TARGET binding site such as BINDING SITE I, BINDING SITE II or BINDING SITE III. Table 2 illustrates the complementarity of the nucleotide sequences of LOC257463 BINDING SITE, designated SEQ ID:35206, to the nucleotide sequence of VGAM1899 RNA, herein designated VGAM RNA, also designated SEQ ID:4610.

Another function of VGAM1899 is therefore inhibition of LOC257463 (Accession XM_048605). Accordingly, utilities of VGAM1899 include diagnosis, prevention and treatment of diseases and clinical conditions associated with LOC257463. FIG. 1 further provides a conceptual description of a novel bioinformatically detected viral gene of the present invention, referred to here as Viral Genomic Address Messenger 1900 (VGAM1900) viral gene, which modulates expression of respective host target genes thereof, the function and utility of which host target genes is known in the art.

VGAM1900 is a novel bioinformatically detected regulatory, non protein coding, viral micro RNA (miRNA) gene. The method by which VGAM1900 was detected is described hereinabove with reference to FIGS. 1-8.

VGAM1900 gene, herein designated VGAM GENE, is a viral gene contained in the genome of Respiratory Syncytial Virus. VGAM1900 host target gene, herein designated VGAM HOST TARGET GENE, is a human gene contained in the human genome.

VGAM1900 gene encodes a VGAM1900 precursor RNA, herein designated VGAM PRECURSOR RNA. Similar to other miRNA genes, and unlike most ordinary genes, VGAM1900 precursor RNA does not encode a protein. A nucleotide sequence identical or highly similar to the nucleotide sequence of VGAM1900 precursor RNA is designated SEQ ID:1886, and is provided hereinbelow with reference to the sequence listing part. Nucleotide sequence SEQ ID:1886 is located at position 438 relative to the genome of Respiratory Syncytial Virus.

VGAM1900 precursor RNA folds onto itself, forming VGAM1900 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1900 folded precursor RNA into VGAM1900 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM1900 RNA is designated SEQ ID:4611, and is provided hereinbelow with reference to the sequence listing part.

VGAM1900 host target gene, herein designated VGAM HOST TARGET GENE, encodes a corresponding messenger RNA, VGAM1900 host target RNA, herein designated VGAM HOST TARGET RNA. VGAM1900 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1900 RNA, herein designated VGAM RNA, binds complementarily to one or more host target binding sites located in untranslated regions of VGAM1900 host target RNA, herein designated VGAM HOST TARGET RNA. This complementary binding is due to the fact that the nucleotide sequence of VGAM1900 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1900 RNA, herein designated VGAM RNA, may have a different number of host target binding sites in untranslated regions of a VGAM1900 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1900 RNA, herein designated VGAM RNA, to host target binding sites on VGAM1900 host target RNA, herein designated VGAM HOST TARGET RNA, such as BINDING SITE I, BINDING SITE II and BINDING SITE III, inhibits translation of VGAM1900 host target RNA into VGAM1900 host target protein, herein designated VGAM HOST TARGET PROTEIN. VGAM host target protein is therefore outlined by a broken line.

It is appreciated that VGAM1900 host target gene, herein designated VGAM HOST TARGET GENE, in fact represents a plurality of VGAM1900 host target genes. The mRNA of each one of this plurality of VGAM1900 host target genes comprises one or more host target binding sites, each having a nucleotide sequence which is at least partly complementary to VGAM1900 RNA, herein designated VGAM RNA, and which when bound by VGAM1900 RNA causes inhibition of translation of respective one or more VGAM1900 host target proteins.

It is further appreciated by one skilled in the art that the mode of translational inhibition illustrated by FIG. 1 with specific reference to translational inhibition exerted by VGAM1900 gene, herein designated VGAM GENE, on one or more VGAM1900 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1900 is inhibition of expression of host target genes, as part of a novel viral mechanism of attacking a host. Accordingly, utilities of VGAM1900 include diagnosis, prevention and treatment of viral infection by Respiratory Syncytial Virus. Specific functions, and accordingly utilities, of VGAM1900 correlate with, and may be deduced from, the identity of the host target genes which VGAM1900 binds and inhibits, and the function of these host target genes, as elaborated hereinbelow.

Nucleotide sequences of the VGAM1900 precursor RNA, herein designated VGAM PRECURSOR RNA, and of the 'diced' VGAM1900 RNA, herein designated VGAM RNA, and a schematic representation of the secondary folding of VGAM1900 folded precursor RNA, herein designated VGAM FOLDED PRECURSOR RNA, of VGAM1900 are further described hereinbelow with reference to Table 1.

Nucleotide sequences of host target binding sites, such as BINDING SITE-I, BINDING SITE-II and BINDING SITE-III of FIG. 1, found on VGAM1900 host target RNA, and schematic representation of the complementarity of each of these host target binding sites to VGAM1900 RNA, herein designated VGAM RNA, are described hereinbelow with reference to Table 2.

As mentioned hereinabove with reference to FIG. 1, a function of VGAM1900 gene, herein designated VGAM is inhibition of expression of VGAM1900 target genes. It is appreciated that specific functions, and accordingly utilities, of VGAM1900 correlate with, and may be deduced from, the identity of the target genes which VGAM1900 binds and inhibits, and the function of these target genes, as elaborated hereinbelow.

Adenylate Cyclase 2 (brain) (ADCY2, Accession XM_036383) is a VGAM1900 host target gene. ADCY2 BINDING SITE is HOST TARGET binding site found in the 3' untranslated region of mRNA encoded by ADCY2, corresponding to a HOST TARGET binding site such as BINDING SITE I, BINDING SITE II or BINDING SITE III. Table 2 illustrates the complementarity of the nucleotide sequences of ADCY2 BINDING SITE, designated SEQ ID:32435, to the nucleotide sequence of VGAM1900 RNA, herein designated VGAM RNA, also designated SEQ ID:4611.

A function of VGAM1900 is therefore inhibition of Adenylate Cyclase 2 (brain) (ADCY2, Accession XM_036383), a gene which Adenylate cyclase (type 2), an ATP-pyrophosphate lyase; converts ATP to cAMP. Accordingly, utilities of VGAM1900 include diagnosis, prevention and treatment of diseases and clinical conditions associated with ADCY2. The function of ADCY2 and its association with various diseases and clinical conditions, has been established by previous studies, as described hereinabove with reference to VGAM120. EGF-like-domain, Multiple 5 (EGFL5, Accession XM_098838) is another VGAM1900 host target gene. EGFL5 BINDING SITE is HOST TARGET binding site found in the 3' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41886, to the nucleotide sequence of VGAM1900 RNA, herein designated VGAM RNA, also designated SEQ ID:4611.

Another function of VGAM1900 is therefore inhibition of EGF-like-domain, Multiple 5 (EGFL5, Accession XM_098838). Accordingly, utilities of VGAM1900 include diagnosis, prevention and treatment of diseases and clinical conditions associated with EGFL5. Interferon, Gamma-inducible Protein 16 (IFI16, Accession XM_048826) is another VGAM1900 host target gene. IFI16 BINDING SITE is HOST TARGET binding site found in the 5' untranslated region of mRNA encoded by IFI16, corresponding to a HOST TARGET binding site such as BINDING SITE I, BINDING SITE II or BINDING SITE III. Table 2 illustrates the complementarity of the nucleotide sequences of IFI16 BINDING SITE, designated SEQ ID:35282, to the nucleotide sequence of VGAM1900 RNA, herein designated VGAM RNA, also designated SEQ ID:4611.

Another function of VGAM1900 is therefore inhibition of Interferon, Gamma-inducible Protein 16 (IFI16, Accession XM_048826), a gene which could have a role in the regulation of hematopoeitic differentiation and controls cellular proliferation. Accordingly, utilities of VGAM1900 include diagnosis, prevention and treatment of diseases and clinical conditions associated with IFI16. The function of IFI16 and its association with various diseases and clinical conditions, has been established by previous studies, as described hereinabove with reference to VGAM1182. Chromosome 12 Open Reading Frame 22 (C12orf22, Accession NM_030809) is another VGAM1900 host target gene. C12orf22 BINDING SITE is HOST TARGET binding site found in the 3' untranslated region of mRNA encoded by C12orf22, corresponding to a HOST TARGET binding site such as BINDING SITE I, BINDING SITE II or BINDING SITE III. Table 2 illustrates the complementarity of the nucleotide sequences of C12orf22 BINDING SITE, designated SEQ ID:25124, to the nucleotide sequence of VGAM1900 RNA, herein designated VGAM RNA, also designated SEQ ID:4611.

Another function of VGAM1900 is therefore inhibition of Chromosome 12 Open Reading Frame 22 (C12orf22, Accession NM_030809). Accordingly, utilities of VGAM1900 include diagnosis, prevention and treatment of diseases and clinical conditions associated with C12orf22. Calcyphosphine 2 (CAPS2, Accession XM_047354) is another VGAM1900 host target gene. CAPS2 BINDING SITE is HOST TARGET binding site found in the 3' untranslated region of mRNA encoded by CAPS2, corresponding to a HOST TARGET binding site such as BINDING SITE I, BINDING SITE II or BINDING SITE III. Table 2 illustrates the complementarity of the nucleotide sequences of CAPS2 BINDING SITE, designated SEQ ID:34953, to the nucleotide sequence of VGAM1900 RNA, herein designated VGAM RNA, also designated SEQ ID:4611.

Another function of VGAM1900 is therefore inhibition of Calcyphosphine 2 (CAPS2, Accession XM_047354). Accordingly, utilities of VGAM1900 include diagnosis, prevention and treatment of diseases and clinical conditions associated with CAPS2. CTP Synthase II (CTPS2, Accession NM_019857) is another VGAM1900 host target gene. CTPS2 BINDING SITE is HOST TARGET binding site found in the 3' untranslated region of mRNA encoded by CTPS2, corresponding to a HOST TARGET binding site such as BINDING SITE I, BINDING SITE II or BINDING SITE III. Table 2 illustrates the complementarity of the nucleotide sequences of CTPS2 BINDING SITE, designated SEQ ID:21264, to the nucleotide sequence of VGAM1900 RNA, herein designated VGAM RNA, also designated SEQ ID:4611.

Another function of VGAM1900 is therefore inhibition of CTP Synthase II (CTPS2, Accession NM_019857). Accordingly, utilities of VGAM1900 include diagnosis, prevention and treatment of diseases and clinical conditions associated with CTPS2. FLJ10300 (Accession NM_018051) is another VGAM1900 host target gene. FLJ10300 BINDING SITE is HOST TARGET binding site found in the 5' untranslated region of mRNA encoded by FLJ10300, corresponding to a HOST TARGET binding site such as BINDING SITE I, BINDING SITE II or BINDING SITE III. Table 2 illustrates the complementarity of the nucleotide sequences of FLJ10300 BINDING SITE, designated SEQ ID:19811, to the nucleotide sequence of VGAM1900 RNA, herein designated VGAM RNA, also designated SEQ ID:4611.

Another function of VGAM1900 is therefore inhibition of FLJ10300 (Accession NM_018051). Accordingly, utilities of VGAM1900 include diagnosis, prevention and treatment of diseases and clinical conditions associated with FLJ10300. SCYA28 (Accession NM_019846) is another VGAM1900 host target gene. SCYA28 BINDING SITE is HOST TARGET binding site found in the 3' untranslated region of mRNA encoded by SCYA28, corresponding to a HOST TARGET binding site such as BINDING SITE I, BINDING SITE II or BINDING SITE III. Table 2 illustrates the complementarity of the nucleotide sequences of SCYA28 BINDING SITE, designated SEQ ID:21251, to the nucleotide sequence of VGAM1900 RNA, herein designated VGAM RNA, also designated SEQ ID:4611.

Another function of VGAM1900 is therefore inhibition of SCYA28 (Accession NM_019846). Accordingly, utilities of VGAM1900 include diagnosis, prevention and treatment of diseases and clinical conditions associated with SCYA28. STHM (Accession NM_006456) is another VGAM1900 host target gene. STHM BINDING SITE is HOST TARGET binding site found in the 3' untranslated region of mRNA encoded by STHM, corresponding to a HOST TARGET binding site such as BINDING SITE I, BINDING SITE II or BINDING SITE III. Table 2 illustrates the complementarity of the nucleotide sequences of STHM BINDING SITE, designated SEQ ID:13177, to the nucleotide sequence of VGAM1900 RNA, herein designated VGAM RNA, also designated SEQ ID:4611.

Another function of VGAM1900 is therefore inhibition of STHM (Accession NM_006456). Accordingly, utilities of VGAM1900 include diagnosis, prevention and treatment of diseases and clinical conditions associated with STHM. LOC151429 (Accession XM_098059) is another VGAM1900 host target gene. LOC151429 BINDING SITE is HOST TARGET binding site found in the 3' untranslated region of mRNA encoded by LOC151429, corresponding to a HOST TARGET binding site such as BINDING SITE I, BINDING SITE II or BINDING SITE III. Table 2 illustrates the complementarity of the nucleotide sequences of LOC151429 BINDING SITE, designated SEQ ID:41344, to the nucleotide sequence of VGAM1900 RNA, herein designated VGAM RNA, also designated SEQ ID:4611.

Another function of VGAM1900 is therefore inhibition of LOC151429 (Accession XM_098059). Accordingly, utilities of VGAM1900 include diagnosis, prevention and treatment of diseases and clinical conditions associated with LOC151429. LOC153454 (Accession XM_087672) is another VGAM1900 host target gene. LOC153454 BINDING SITE is HOST TARGET binding site found in the 5' untranslated region of mRNA encoded by LOC153454, corresponding to a HOST TARGET binding site such as BINDING SITE I, BINDING SITE II or BINDING SITE III. Table 2 illustrates the complementarity of the nucleotide sequences of LOC153454 BINDING SITE, designated SEQ ID:39376, to the nucleotide sequence of VGAM1900 RNA, herein designated VGAM RNA, also designated SEQ ID:4611.

Another function of VGAM1900 is therefore inhibition of LOC153454 (Accession XM_087672). Accordingly, utilities of VGAM1900 include diagnosis, prevention and treatment of diseases and clinical conditions associated with LOC153454. LOC203504 (Accession XM_117550) is another VGAM1900 host target gene. LOC203504 BINDING SITE is HOST TARGET binding site found in the 3' untranslated region of mRNA encoded by LOC203504, corresponding to a HOST TARGET binding site such as BINDING SITE I, BINDING SITE II or BINDING SITE III. Table 2 illustrates the complementarity of the nucleotide sequences of LOC203504 BINDING SITE, designated SEQ ID:43573, to the nucleotide sequence of VGAM1900 RNA, herein designated VGAM RNA, also designated SEQ ID:4611.

Another function of VGAM1900 is therefore inhibition of LOC203504 (Accession XM_117550). Accordingly, utilities of VGAM1900 include diagnosis, prevention and treatment of diseases and clinical conditions associated with LOC203504. FIG. 1 further provides a conceptual description of a novel bioinformatically detected viral gene of the present invention, referred to here as Viral Genomic Address Messenger 1901 (VGAM1901) viral gene, which modulates expression of respective host target genes thereof, the function and utility of which host target genes is known in the art.

VGAM1901 is a novel bioinformatically detected regulatory, non protein coding, viral micro RNA (miRNA) gene. The method by which VGAM1901 was detected is described hereinabove with reference to FIGS. 1-8.

VGAM1901 gene, herein designated VGAM GENE, is a viral gene contained in the genome of Respiratory Syncytial Virus. VGAM1901 host target gene, herein designated VGAM HOST TARGET GENE, is a human gene contained in the human genome.

VGAM1901 gene encodes a VGAM1901 precursor RNA, herein designated VGAM PRECURSOR RNA. Similar to other miRNA genes, and unlike most ordinary genes, VGAM1901 precursor RNA does not encode a protein. A nucleotide sequence identical or highly similar to the nucleotide sequence of VGAM1901 precursor RNA is designated SEQ ID:1887, and is provided hereinbelow with reference to the sequence listing part. Nucleotide sequence SEQ ID:1887 is located at position 2370 relative to the genome of Respiratory Syncytial Virus.

VGAM1901 precursor RNA folds onto itself, forming VGAM1901 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1901 folded precursor RNA into VGAM1901 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM1901 RNA is designated SEQ ID:4612, and is provided hereinbelow with reference to the sequence listing part.

VGAM1901 host target gene, herein designated VGAM HOST TARGET GENE, encodes a corresponding messenger RNA, VGAM1901 host target RNA, herein designated VGAM HOST TARGET RNA. VGAM1901 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1901 RNA, herein designated VGAM RNA, binds complementarily to one or more host target binding sites located in untranslated regions of VGAM1901 host target RNA, herein designated VGAM HOST TARGET RNA. This complementary binding is due to the fact that the nucleotide sequence of VGAM1901 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1901 RNA, herein designated VGAM RNA, may have a different number of host target binding sites in untranslated regions of a VGAM1901 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1901 RNA, herein designated VGAM RNA, to host target binding sites on VGAM1901 host target RNA, herein designated VGAM HOST TARGET RNA, such as BINDING SITE I, BINDING SITE II and BINDING SITE III, inhibits translation of VGAM1901 host target RNA into VGAM1901 host target protein, herein designated VGAM HOST TARGET PROTEIN. VGAM host target protein is therefore outlined by a broken line.

It is appreciated that VGAM1901 host target gene, herein designated VGAM HOST TARGET GENE, in fact represents a plurality of VGAM1901 host target genes. The mRNA of each one of this plurality of VGAM1901 host target genes comprises one or more host target binding sites, each having a nucleotide sequence which is at least partly complementary to VGAM1901 RNA, herein designated VGAM RNA, and which when bound by VGAM1901 RNA causes inhibition of translation of respective one or more VGAM1901 host target proteins.

It is further appreciated by one skilled in the art that the mode of translational inhibition illustrated by FIG. 1 with specific reference to translational inhibition exerted by VGAM1901 gene, herein designated VGAM GENE, on one or more VGAM1901 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1901 is inhibition of expression of host target genes, as part of a novel viral mechanism of attacking a host. Accordingly, utilities of VGAM1901 include diagnosis, prevention and treatment of viral infection by Respiratory Syncytial Virus. Specific functions, and accordingly utilities, of VGAM1901 correlate with, and may be deduced from, the identity of the host target genes which VGAM1901 binds and inhibits, and the function of these host target genes, as elaborated hereinbelow.

Nucleotide sequences of the VGAM1901 precursor RNA, herein designated VGAM PRECURSOR RNA, and of the 'diced' VGAM1901 RNA, herein designated VGAM RNA, and a schematic representation of the secondary folding of VGAM1901 folded precursor RNA, herein designated VGAM FOLDED PRECURSOR RNA, of VGAM1901 are further described hereinbelow with reference to Table 1.

Nucleotide sequences of host target binding sites, such as BINDING SITE-I, BINDING SITE-II and BINDING SITE-III of FIG. 1, found on VGAM1901 host target RNA, and schematic representation of the complementarity of each of these host target binding sites to VGAM1901 RNA, herein designated VGAM RNA, are described hereinbelow with reference to Table 2.

As mentioned hereinabove with reference to FIG. 1, a function of VGAM1901 gene, herein designated VGAM is inhibition of expression of VGAM1901 target genes. It is appreciated that specific functions, and accordingly utilities, of VGAM1901 correlate with, and may be deduced from, the identity of the target genes which VGAM1901 binds and inhibits, and the function of these target genes, as elaborated hereinbelow.

C-type (calcium dependent, carbohydrate-recognition domain) Lectin, Superfamily Member 5 (CLECSF5, Accession NM_013252) is a VGAM1901 host target gene. CLECSF5 BINDING SITE is HOST TARGET binding site found in the 3' untranslated region of mRNA encoded by CLECSF5, corresponding to a HOST TARGET binding site such as BINDING SITE I, BINDING SITE II or BINDING SITE III. Table 2 illustrates the complementarity of the nucleotide sequences of CLECSF5 BINDING SITE, designated SEQ ID:14915, to the nucleotide sequence of VGAM1901 RNA, herein designated VGAM RNA, also designated SEQ ID:4612.

A function of VGAM1901 is therefore inhibition of C-type (calcium dependent, carbohydrate-recognition domain) Lectin, Superfamily Member 5 (CLECSF5, Accession NM_013252). Accordingly, utilities of VGAM1901 include diagnosis, prevention and treatment of diseases and clinical conditions associated with CLECSF5. Estrogen-related Receptor Gamma (ESRRG, Accession XM_039053) is another VGAM1901 host target gene. ESRRG BINDING SITE is HOST TARGET binding site found in the 3' untranslated region of mRNA encoded by ESRRG, corresponding to a HOST TARGET binding site such as BINDING SITE I, BINDING SITE II or BINDING SITE III. Table 2 illustrates the complementarity of the nucleotide sequences of ESRRG BINDING SITE, designated SEQ ID:32993, to the nucleotide sequence of VGAM1901 RNA, herein designated VGAM RNA, also designated SEQ ID:4612.

Another function of VGAM1901 is therefore inhibition of Estrogen-related Receptor Gamma (ESRRG, Accession XM_039053), a gene which Estrogen-related receptor gamma. Accordingly, utilities of VGAM1901 include diagnosis, prevention and treatment of diseases and clinical conditions associated with ESRRG. The function of ESRRG and its association with various diseases and clinical conditions, has been established by previous studies, as described hereinabove with reference to VGAM359. F-box and WD-40 Domain Protein 1B (FBXW1B, Accession NM_033644) is another VGAM1901 host target gene. FBXW1B BINDING SITE1 through FBXW1B BINDING SITE3 are HOST TARGET binding sites found in untranslated regions of mRNA encoded by FBXW1B, corresponding to HOST TARGET binding sites such as BINDING SITE I, BINDING SITE II or BINDING SITE III. Table 2 illustrates the complementarity of the nucleotide sequences of FBXW1B BINDING SITE1 through FBXW1B BINDING SITE3, designated SEQ ID:27362, SEQ ID:27372 and SEQ ID:14660 respectively, to the nucleotide sequence of VGAM1901 RNA, herein designated VGAM RNA, also designated SEQ ID:4612.

Another function of VGAM1901 is therefore inhibition of F-box and WD-40 Domain Protein 1B (FBXW1B, Accession NM_033644), a gene which somehow is involved in the process of neuronal cell differentiation or brain development. Accordingly, utilities of VGAM1901 include diagnosis, prevention and treatment of diseases and clinical conditions associated with FBXW1B. The function of FBXW1B and its association with various diseases and clinical conditions, has been established by previous studies, as described hereinabove with reference to VGAM25. SMA3 (Accession NM_006780) is another VGAM1901 host target gene. SMA3 BINDING SITE is HOST TARGET binding site found in the 3' untranslated region of mRNA encoded by SMA3, corresponding to a HOST TARGET binding site such as BINDING SITE I, BINDING SITE II or BINDING SITE III. Table 2 illustrates the complementarity of the nucleotide sequences of SMA3 BINDING SITE, designated SEQ ID:13653, to the nucleotide sequence of VGAM1901 RNA, herein designated VGAM RNA, also designated SEQ ID:4612.

Another function of VGAM1901 is therefore inhibition of SMA3 (Accession NM_006780). Accordingly, utilities of VGAM1901 include diagnosis, prevention and treatment of diseases and clinical conditions associated with SMA3. LOC151056 (Accession XM_087088) is another VGAM1901 host target gene. LOC151056 BINDING SITE is HOST TARGET binding site found in the 3' untranslated region of mRNA encoded by LOC151056, corresponding to a HOST TARGET binding site such as BINDING SITE I, BINDING SITE II or BINDING SITE III. Table 2 illustrates the complementarity of the nucleotide sequences of LOC151056 BINDING SITE, designated SEQ ID:39046, to the nucleotide sequence of VGAM1901 RNA, herein designated VGAM RNA, also designated SEQ ID:4612.

Another function of VGAM1901 is therefore inhibition of LOC151056 (Accession XM_087088). Accordingly, utilities of VGAM1901 include diagnosis, prevention and treatment of diseases and clinical conditions associated with LOC151056. LOC157247 (Accession XM_088275) is another VGAM1901 host target gene. LOC157247 BINDING SITE is HOST TARGET binding site found in the 5' untranslated region of mRNA encoded by LOC157247, corresponding to a HOST TARGET binding site such as BINDING SITE I, BINDING SITE II or BINDING SITE III. Table 2 illustrates the complementarity of the nucleotide sequences of LOC157247 BINDING SITE, designated SEQ ID:39572, to the nucleotide sequence of VGAM1901 RNA, herein designated VGAM RNA, also designated SEQ ID:4612.

Another function of VGAM1901 is therefore inhibition of LOC157247 (Accession XM_088275). Accordingly, utilities of VGAM1901 include diagnosis, prevention and treatment of diseases and clinical conditions associated with LOC157247. LOC222066 (Accession XM_166582) is another VGAM1901 host target gene. LOC222066 BIND- ING SITE is HOST TARGET binding site found in the 3' untranslated region of mRNA encoded by LOC222066, corresponding to a HOST TARGET binding site such as BINDING SITE I, BINDING SITE II or BINDING SITE III. Table 2 illustrates the complementarity of the nucleotide sequences of LOC222066 BINDING SITE, designated SEQ ID:44553, to the nucleotide sequence of VGAM1901 RNA, herein designated VGAM RNA, also designated SEQ ID:4612.

Another function of VGAM1901 is therefore inhibition of LOC222066 (Accession XM_166582). Accordingly, utilities of VGAM1901 include diagnosis, prevention and treatment of diseases and clinical conditions associated with LOC222066. LOC254504 (Accession XM_173192) is another VGAM1901 host target gene. LOC254504 BINDING SITE is HOST TARGET binding site found in the 5' untranslated region of mRNA encoded by LOC254504, corresponding to a HOST TARGET binding site such as BINDING SITE I, BINDING SITE II or BINDING SITE III. Table 2 illustrates the complementarity of the nucleotide sequences of LOC254504 BINDING SITE, designated SEQ ID:46437, to the nucleotide sequence of VGAM1901 RNA, herein designated VGAM RNA, also designated SEQ ID:4612.

Another function of VGAM1901 is therefore inhibition of LOC254504 (Accession XM_173192). Accordingly, utilities of VGAM1901 include diagnosis, prevention and treatment of diseases and clinical conditions associated with LOC254504. LOC90520 (Accession XM_032277) is another VGAM1901 host target gene. LOC90520 BINDING SITE is HOST TARGET binding site found in the 3' untranslated region of mRNA encoded by LOC90520, corresponding to a HOST TARGET binding site such as BINDING SITE I, BINDING SITE II or BINDING SITE III. Table 2 illustrates the complementarity of the nucleotide sequences of LOC90520 BINDING SITE, designated SEQ ID:31629, to the nucleotide sequence of VGAM1901 RNA, herein designated VGAM RNA, also designated SEQ ID:4612.

Another function of VGAM1901 is therefore inhibition of LOC90520 (Accession XM_032277). Accordingly, utilities of VGAM1901 include diagnosis, prevention and treatment of diseases and clinical conditions associated with LOC90520. FIG. 1 further provides a conceptual description of a novel bioinformatically detected viral gene of the present invention, referred to here as Viral Genomic Address Messenger 1902 (VGAM1902) viral gene, which modulates expression of respective host target genes thereof, the function and utility of which host target genes is known in the art.

VGAM1902 is a novel bioinformatically detected regulatory, non protein coding, viral micro RNA (miRNA) gene. The method by which VGAM1902 was detected is described hereinabove with reference to FIGS. 1-8.

VGAM1902 gene, herein designated VGAM GENE, is a viral gene contained in the genome of Respiratory Syncytial Virus. VGAM1902 host target gene, herein designated VGAM HOST TARGET GENE, is a human gene contained in the human genome.

VGAM1902 gene encodes a VGAM1902 precursor RNA, herein designated VGAM PRECURSOR RNA. Similar to other miRNA genes, and unlike most ordinary genes, VGAM1902 precursor RNA does not encode a protein. A nucleotide sequence identical or highly similar to the nucleotide sequence of VGAM1902 precursor RNA is designated SEQ ID:1888, and is provided hereinbelow with reference to the sequence listing part. Nucleotide sequence SEQ ID:1888 is located at position 8673 relative to the genome of Respiratory Syncytial Virus.

VGAM1902 precursor RNA folds onto itself, forming VGAM1902 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1902 folded precursor RNA into VGAM1902 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1902 RNA is designated SEQ ID:4613, and is provided hereinbelow with reference to the sequence listing part.

VGAM1902 host target gene, herein designated VGAM HOST TARGET GENE, encodes a corresponding messenger RNA, VGAM1902 host target RNA, herein designated VGAM HOST TARGET RNA. VGAM1902 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1902 RNA, herein designated VGAM RNA, binds complementarily to one or more host target binding sites located in untranslated regions of VGAM1902 host target RNA, herein designated VGAM HOST TARGET RNA. This complementary binding is due to the fact that the nucleotide sequence of VGAM1902 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1902 RNA, herein designated VGAM RNA, may have a different number of host target binding sites in untranslated regions of a VGAM1902 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1902 RNA, herein designated VGAM RNA, to host target binding sites on VGAM1902 host target RNA, herein designated VGAM HOST TARGET RNA, such as BINDING SITE I, BINDING SITE II and BINDING SITE III, inhibits translation of VGAM1902 host target RNA into VGAM1902 host target protein, herein designated VGAM HOST TARGET PROTEIN. VGAM host target protein is therefore outlined by a broken line.

It is appreciated that VGAM1902 host target gene, herein designated VGAM HOST TARGET GENE, in fact represents a plurality of VGAM1902 host target genes. The mRNA of each one of this plurality of VGAM1902 host target genes comprises one or more host target binding sites, each having a nucleotide sequence which is at least partly complementary to VGAM1902 RNA, herein designated VGAM RNA, and which when bound by VGAM1902 RNA causes inhibition of translation of respective one or more VGAM1902 host target proteins.

It is further appreciated by one skilled in the art that the mode of translational inhibition illustrated by FIG. 1 with specific reference to translational inhibition exerted by VGAM1902 gene, herein designated VGAM GENE, on one or more VGAM1902 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1902 is inhibition of expression of host target genes, as part of a novel viral mechanism of attacking a host. Accordingly, utilities of VGAM1902 include diagnosis, prevention and treatment of viral infection by Respiratory Syncytial Virus. Specific functions, and accordingly utilities, of VGAM1902 correlate with, and may be deduced from, the identity of the host target genes which VGAM1902 binds and inhibits, and the function of these host target genes, as elaborated hereinbelow.

Nucleotide sequences of the VGAM1902 precursor RNA, herein designated VGAM PRECURSOR RNA, and of the 'diced' VGAM1902 RNA, herein designated VGAM RNA, and a schematic representation of the secondary folding of VGAM1902 folded precursor RNA, herein designated VGAM FOLDED PRECURSOR RNA, of VGAM1902 are further described hereinbelow with reference to Table 1.

Nucleotide sequences of host target binding sites, such as BINDING SITE-I, BINDING SITE-II and BINDING SITE-III of FIG. 1, found on VGAM1902 host target RNA, and schematic representation of the complementarity of each of these host target binding sites to VGAM1902 RNA, herein designated VGAM RNA, are described hereinbelow with reference to Table 2.

As mentioned hereinabove with reference to FIG. 1, a function of VGAM1902 gene, herein designated VGAM is inhibition of expression of VGAM1902 target genes. It is appreciated that specific functions, and accordingly utilities, of VGAM1902 correlate with, and may be deduced from, the identity of the target genes which VGAM1902 binds and inhibits, and the function of these target genes, as elaborated hereinbelow.

PRO2015 (Accession NM_018512) is a VGAM1902 host target gene. PRO2015 BINDING SITE is HOST TARGET binding site found in the 5' untranslated region of mRNA encoded by PRO2015, corresponding to a HOST TARGET binding site such as BINDING SITE I, BINDING SITE II or BINDING SITE III. Table 2 illustrates the complementarity of the nucleotide sequences of PRO2015 BINDING SITE, designated SEQ ID:20585, to the nucleotide sequence of VGAM1902 RNA, herein designated VGAM RNA, also designated SEQ ID:4613.

A function of VGAM1902 is therefore inhibition of PRO2015 (Accession NM_018512). Accordingly, utilities of VGAM1902 include diagnosis, prevention and treatment of diseases and clinical conditions associated with PRO2015. FIG. 1 further provides a conceptual description of a novel bioinformatically detected viral gene of the present invention, referred to here as Viral Genomic Address Messenger 1903 (VGAM1903) viral gene, which modulates expression of respective host target genes thereof, the function and utility of which host target genes is known in the art.

VGAM1903 is a novel bioinformatically detected regulatory, non protein coding, viral micro RNA (miRNA) gene. The method by which VGAM1903 was detected is described hereinabove with reference to FIGS. 1-8.

VGAM1903 gene, herein designated VGAM GENE, is a viral gene contained in the genome of Respiratory Syncytial Virus. VGAM1903 host target gene, herein designated VGAM HOST TARGET GENE, is a human gene contained in the human genome.

VGAM1903 gene encodes a VGAM1903 precursor RNA, herein designated VGAM PRECURSOR RNA. Similar to other miRNA genes, and unlike most ordinary genes, VGAM1903 precursor RNA does not encode a protein. A nucleotide sequence identical or highly similar to the nucleotide sequence of VGAM1903 precursor RNA is designated SEQ ID:1889, and is provided hereinbelow with reference to the sequence listing part. Nucleotide sequence SEQ ID:1889 is located at position 14231 relative to the genome of Respiratory Syncytial Virus.

VGAM1903 precursor RNA folds onto itself, forming VGAM1903 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1903 folded precursor RNA into VGAM1903 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1903 RNA is designated SEQ ID:4614, and is provided hereinbelow with reference to the sequence listing part.

VGAM1903 host target gene, herein designated VGAM HOST TARGET GENE, encodes a corresponding messenger RNA, VGAM1903 host target RNA, herein designated VGAM HOST TARGET RNA. VGAM1903 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1903 RNA, herein designated VGAM RNA, binds complementarily to one or more host target binding sites located in untranslated regions of VGAM1903 host target RNA, herein designated VGAM HOST TARGET RNA. This complementary binding is due to the fact that the nucleotide sequence of VGAM1903 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1903 RNA, herein designated VGAM RNA, may have a different number of host target binding sites in untranslated regions of a VGAM1903 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1903 RNA, herein designated VGAM RNA, to host target binding sites on VGAM1903 host target RNA, herein designated VGAM HOST TARGET RNA, such as BINDING SITE I, BINDING SITE II and BINDING SITE III, inhibits translation of VGAM1903 host target RNA into VGAM1903 host target protein, herein designated VGAM HOST TARGET PROTEIN. VGAM host target protein is therefore outlined by a broken line.

It is appreciated that VGAM1903 host target gene, herein designated VGAM HOST TARGET GENE, in fact represents a plurality of VGAM1903 host target genes. The mRNA of each one of this plurality of VGAM1903 host target genes comprises one or more host target binding sites, each having a nucleotide sequence which is at least partly complementary to VGAM1903 RNA, herein designated VGAM RNA, and which when bound by VGAM1903 RNA causes inhibition of translation of respective one or more VGAM1903 host target proteins.

It is further appreciated by one skilled in the art that the mode of translational inhibition illustrated by FIG. 1 with specific reference to translational inhibition exerted by VGAM1903 gene, herein designated VGAM GENE, on one or more VGAM1903 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1903 is inhibition of expression of host target genes, as part of a novel viral mechanism of attacking a host. Accordingly, utilities of VGAM1903 include diagnosis, prevention and treatment of viral infection by Respiratory Syncytial Virus. Specific functions, and accordingly utilities, of VGAM1903 correlate with, and may be deduced from, the identity of the host target genes which VGAM1903 binds and inhibits, and the function of these host target genes, as elaborated hereinbelow.

Nucleotide sequences of the VGAM1903 precursor RNA, herein designated VGAM PRECURSOR RNA, and of the 'diced' VGAM1903 RNA, herein designated VGAM RNA, and a schematic representation of the secondary folding of VGAM1903 folded precursor RNA, herein designated VGAM FOLDED PRECURSOR RNA, of VGAM1903 are further described hereinbelow with reference to Table 1.

Nucleotide sequences of host target binding sites, such as BINDING SITE-I, BINDING SITE-II and BINDING SITE-III of FIG. 1, found on VGAM1903 host target RNA, and schematic representation of the complementarity of each of these host target binding sites to VGAM1903 RNA, herein designated VGAM RNA, are described hereinbelow with reference to Table 2.

As mentioned hereinabove with reference to FIG. 1, a function of VGAM1903 gene, herein designated VGAM is inhibition of expression of VGAM1903 target genes. It is appreciated that specific functions, and accordingly utilities, of VGAM1903 correlate with, and may be deduced from, the identity of the target genes which VGAM1903 binds and inhibits, and the function of these target genes, as elaborated hereinbelow.

Mucin 3B (MUC3B, Accession XM_168578) is a VGAM1903 host target gene. MUC3B BINDING SITE is HOST TARGET binding site found in the 5' untranslated region of mRNA encoded by MUC3B, corresponding to a HOST TARGET binding site such as BINDING SITE I, BINDING SITE II or BINDING SITE III. Table 2 illustrates the complementarity of the nucleotide sequences of MUC3B BINDING SITE, designated SEQ ID:45254, to the nucleotide sequence of VGAM1903 RNA, herein designated VGAM RNA, also designated SEQ ID:4614.

A function of VGAM1903 is therefore inhibition of Mucin 3B (MUC3B, Accession XM_168578), a gene which provides a protective, lubricating barrier against particles and infectious agents at mucosal surfaces. Accordingly, utilities of VGAM1903 include diagnosis, prevention and treatment of diseases and clinical conditions associated with MUC3B. The function of MUC3B and its association with various diseases and clinical conditions, has been established by previous studies, as described hereinabove with reference to VGAM55. Reelin (RELN, Accession XM_168628) is another VGAM1903 host target gene. RELN BINDING SITE is HOST TARGET binding site found in the 3' untranslated region of mRNA encoded by RELN, corresponding to a HOST TARGET binding site such as BINDING SITE I, BINDING SITE II or BINDING SITE III. Table 2 illustrates the complementarity of the nucleotide sequences of RELN BINDING SITE, designated SEQ ID:45282, to the nucleotide sequence of VGAM1903 RNA, herein designated VGAM RNA, also designated SEQ ID:4614.

Another function of VGAM1903 is therefore inhibition of Reelin (RELN, Accession XM_168628), a gene which regulates microtubule function in neurons and neuronal migration. Accordingly, utilities of VGAM1903 include diagnosis, prevention and treatment of diseases and clinical conditions associated with RELN. The function of RELN and its association with various diseases and clinical conditions, has been established by previous studies, as described hereinabove with reference to VGAM35. Selectin L (lymphocyte adhesion molecule 1) (SELL, Accession NM_000655) is another VGAM1903 host target gene. SELL BINDING SITE is HOST TARGET binding site found in the 3' untranslated region of mRNA encoded by SELL, corresponding to a HOST TARGET binding site such as BINDING SITE I, BINDING SITE II or BINDING SITE III. Table 2 illustrates the complementarity of the nucleotide sequences of SELL BINDING SITE, designated SEQ ID:6315, to the nucleotide sequence of VGAM1903 RNA, herein designated VGAM RNA, also designated SEQ ID:4614.

Another function of VGAM1903 is therefore inhibition of Selectin L (lymphocyte adhesion molecule 1) (SELL, Accession NM_000655), a gene which is a cell surface adhesion protein. Accordingly, utilities of VGAM1903 include diagnosis, prevention and treatment of diseases and clinical conditions associated with SELL. The function of SELL and its association with various diseases and clinical conditions, has been established by previous studies, as described hereinabove with reference to VGAM374. WW Domain Containing Oxidoreductase (WWOX, Accession NM_016373) is another VGAM1903 host target gene. WWOX BINDING SITE is HOST TARGET binding site found in the 3' untranslated region of mRNA encoded by WWOX, corresponding to a HOST TARGET binding site such as BINDING SITE I, BINDING SITE II or BINDING SITE III. Table 2 illustrates the complementarity of the nucleotide sequences of WWOX BINDING SITE, designated SEQ ID:18505, to the nucleotide sequence of VGAM1903 RNA, herein designated VGAM RNA, also designated SEQ ID:4614.

Another function of VGAM1903 is therefore inhibition of WW Domain Containing Oxidoreductase (WWOX, Accession NM_016373), a gene which involves in in protein-protein interactions and may contribute to the biologic consequences of DNA instability. Accordingly, utilities of VGAM1903 include diagnosis, prevention and treatment of diseases and clinical conditions associated with WWOX. The function of WWOX and its association with various diseases and clinical conditions, has been established by previous studies, as described hereinabove with reference to VGAM644. DKFZP434C131 (Accession XM_044630) is another VGAM1903 host target gene. DKFZP434C131 BINDING SITE is HOST TARGET binding site found in the 3' untranslated region of mRNA encoded by DKFZP434C131, corresponding to a HOST TARGET binding site such as BINDING SITE I, BINDING SITE II or BINDING SITE III. Table 2 illustrates the complementarity of the nucleotide sequences of DKFZP434C131 BINDING SITE, designated SEQ ID:34242, to the nucleotide sequence of VGAM1903 RNA, herein designated VGAM RNA, also designated SEQ ID:4614.

Another function of VGAM1903 is therefore inhibition of DKFZP434C131 (Accession XM_044630). Accordingly, utilities of VGAM1903 include diagnosis, prevention and treatment of diseases and clinical conditions associated with DKFZP434C131. DKFZP564K0322 (Accession NM_032040) is another VGAM1903 host target gene. DKFZP564K0322 BINDING SITE is HOST TARGET binding site found in the 5' untranslated region of mRNA encoded by DKFZP564K0322, corresponding to a HOST TARGET binding site such as BINDING SITE I, BINDING SITE II or BINDING SITE III. Table 2 illustrates the complementarity of the nucleotide sequences of DKFZP564K0322 BINDING SITE, designated SEQ ID:25739, to the nucleotide sequence of VGAM1903 RNA, herein designated VGAM RNA, also designated SEQ ID:4614.

Another function of VGAM1903 is therefore inhibition of DKFZP564K0322 (Accession NM_032040). Accordingly, utilities of VGAM1903 include diagnosis, prevention and treatment of diseases and clinical conditions associated with DKFZP564K0322. F-box Only Protein 21 (FBXO21, Accession NM_033624) is another VGAM1903 host target gene. FBXO21 BINDING SITE is HOST TARGET binding site found in the 3' untranslated region of mRNA encoded by FBXO21, corresponding to a HOST TARGET binding site such as BINDING SITE I, BINDING SITE II or BINDING SITE III. Table 2 illustrates the complementarity of the nucleotide sequences of FBXO21 BINDING SITE, designated SEQ ID:27322, to the nucleotide sequence of VGAM1903 RNA, herein designated VGAM RNA, also designated SEQ ID:4614.

Another function of VGAM1903 is therefore inhibition of F-box Only Protein 21 (FBXO21, Accession NM_033624). Accordingly, utilities of VGAM1903 include diagnosis, prevention and treatment of diseases and clinical conditions associated with FBXO21. FLJ30927 (Accession NM_144690) is another VGAM1903 host target gene. FLJ30927 BINDING SITE is HOST TARGET binding site found in the 5' untranslated region of mRNA encoded by FLJ30927, corresponding to a HOST TARGET binding site such as BINDING SITE I, BINDING SITE II or BINDING SITE III. Table 2 illustrates the complementarity of the nucleotide sequences of FLJ30927 BINDING SITE, designated SEQ ID:29509, to the nucleotide sequence of VGAM1903 RNA, herein designated VGAM RNA, also designated SEQ ID:4614.

Another function of VGAM1903 is therefore inhibition of FLJ30927 (Accession NM_144690). Accordingly, utilities of VGAM1903 include diagnosis, prevention and treatment of diseases and clinical conditions associated with FLJ30927. KIAA1866 (Accession XM_027658) is another VGAM1903 host target gene. KIAA1866 BINDING SITE is HOST TARGET binding site found in the 3' untranslated region of mRNA encoded by KIAA1866, corresponding to a HOST TARGET binding site such as BINDING SITE I, BINDING SITE II or BINDING SITE III. Table 2 illustrates the complementarity of the nucleotide sequences of KIAA1866 BINDING SITE, designated SEQ ID:30553, to the nucleotide sequence of VGAM1903 RNA, herein designated VGAM RNA, also designated SEQ ID:4614.

Another function of VGAM1903 is therefore inhibition of KIAA1866 (Accession XM_027658). Accordingly, utilities of VGAM1903 include diagnosis, prevention and treatment of diseases and clinical conditions associated with KIAA1866. KIAA1954 (Accession XM_085375) is another VGAM1903 host target gene. KIAA1954 BINDING SITE is HOST TARGET binding site found in the 3' untranslated region of mRNA encoded by KIAA1954, corresponding to a HOST TARGET binding site such as BINDING SITE I, BINDING SITE II or BINDING SITE III. Table 2 illustrates the complementarity of the nucleotide sequences of KIAA1954 BINDING SITE, designated SEQ ID:38094, to the nucleotide sequence of VGAM1903 RNA, herein designated VGAM RNA, also designated SEQ ID:4614.

Another function of VGAM1903 is therefore inhibition of KIAA1954 (Accession XM_085375). Accordingly, utilities of VGAM1903 include diagnosis, prevention and treatment of diseases and clinical conditions associated with KIAA1954. MGC21675 (Accession NM_052861) is another VGAM1903 host target gene. MGC21675 BINDING SITE is HOST TARGET binding site found in the 5' untranslated region of mRNA encoded by MGC21675, corresponding to a HOST TARGET binding site such as BINDING SITE I, BINDING SITE II or BINDING SITE III. Table 2 illustrates the complementarity of the nucleotide sequences of MGC21675 BINDING SITE, designated SEQ ID:27442, to the nucleotide sequence of VGAM1903 RNA, herein designated VGAM RNA, also designated SEQ ID:4614.

Another function of VGAM1903 is therefore inhibition of MGC21675 (Accession NM_052861). Accordingly, utilities of VGAM1903 include diagnosis, prevention and treatment of diseases and clinical conditions associated with MGC21675. TBDN100 (Accession NM_025085) is another VGAM1903 host target gene. TBDN100 BINDING SITE is HOST TARGET binding site found in the 3' untranslated region of mRNA encoded by TBDN100, corresponding to a HOST TARGET binding site such as BINDING SITE I, BINDING SITE II or BINDING SITE III. Table 2 illustrates the complementarity of the nucleotide sequences of TBDN100 BINDING SITE, designated SEQ ID:24700, to the nucleotide sequence of VGAM1903 RNA, herein designated VGAM RNA, also designated SEQ ID:4614.

Another function of VGAM1903 is therefore inhibition of TBDN100 (Accession NM_025085). Accordingly, utilities of VGAM1903 include diagnosis, prevention and treatment of diseases and clinical conditions associated with TBDN100. LOC145815 (Accession XM_096874) is another VGAM1903 host target gene. LOC145815 BINDING SITE is HOST TARGET binding site found in the 3' untranslated region of mRNA encoded by LOC145815, corresponding to a HOST TARGET binding site such as BINDING SITE I, BINDING SITE II or BINDING SITE III. Table 2 illustrates the complementarity of the nucleotide sequences of LOC145815 BINDING SITE, designated SEQ ID:40601, to the nucleotide sequence of VGAM1903 RNA, herein designated VGAM RNA, also designated SEQ ID:4614.

Another function of VGAM1903 is therefore inhibition of LOC145815 (Accession XM_096874). Accordingly, utilities of VGAM1903 include diagnosis, prevention and treatment of diseases and clinical conditions associated with LOC145815. LOC164382 (Accession XM_104390) is another VGAM1903 host target gene. LOC164382 BINDING SITE is HOST TARGET binding site found in the 3' untranslated region of mRNA encoded by LOC164382, corresponding to a HOST TARGET binding site such as BINDING SITE I, BINDING SITE II or BINDING SITE III. Table 2 illustrates the complementarity of the nucleotide sequences of LOC164382 BINDING SITE, designated SEQ ID:42162, to the nucleotide sequence of VGAM1903 RNA, herein designated VGAM RNA, also designated SEQ ID:4614.

Another function of VGAM1903 is therefore inhibition of LOC164382 (Accession XM_104390). Accordingly, utilities of VGAM1903 include diagnosis, prevention and treatment of diseases and clinical conditions associated with LOC164382. LOC200169 (Accession XM_117200) is another VGAM1903 host target gene. LOC200169 BINDING SITE is HOST TARGET binding site found in the 3' untranslated region of mRNA encoded by LOC200169, corresponding to a HOST TARGET binding site such as BINDING SITE I, BINDING SITE II or BINDING SITE III. Table 2 illustrates the complementarity of the nucleotide sequences of LOC200169 BINDING SITE, designated SEQ ID:43282, to the nucleotide sequence of VGAM1903 RNA, herein designated VGAM RNA, also designated SEQ ID:4614.

Another function of VGAM1903 is therefore inhibition of LOC200169 (Accession XM_117200). Accordingly, utilities of VGAM1903 include diagnosis, prevention and treatment of diseases and clinical conditions associated with LOC200169. FIG. 1 further provides a conceptual description of a novel bioinformatically detected viral gene of the present invention, referred to here as Viral Genomic Address Messenger 1904 (VGAM1904) viral gene, which modulates expression of respective host target genes thereof, the function and utility of which host target genes is known in the art.

VGAM1904 is a novel bioinformatically detected regulatory, non protein coding, viral micro RNA (miRNA) gene. The method by which VGAM1904 was detected is described hereinabove with reference to FIGS. 1-8.

VGAM1904 gene, herein designated VGAM GENE, is a viral gene contained in the genome of Respiratory Syncytial Virus. VGAM1904 host target gene, herein designated VGAM HOST TARGET GENE, is a human gene contained in the human genome.

VGAM1904 gene encodes a VGAM1904 precursor RNA, herein designated VGAM PRECURSOR RNA. Similar to other miRNA genes, and unlike most ordinary genes, VGAM1904 precursor RNA does not encode a protein. A nucleotide sequence identical or highly similar to the nucleotide sequence of VGAM1904 precursor RNA is designated SEQ ID:1890, and is provided hereinbelow with reference to the sequence listing part. Nucleotide sequence SEQ ID:1890 is located at position 8364 relative to the genome of Respiratory Syncytial Virus.

VGAM1904 precursor RNA folds onto itself, forming VGAM1904 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1904 folded precursor RNA into VGAM1904 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1904 RNA is designated SEQ ID:4615, and is provided hereinbelow with reference to the sequence listing part.

VGAM1904 host target gene, herein designated VGAM HOST TARGET GENE, encodes a corresponding messenger RNA, VGAM1904 host target RNA, herein designated VGAM HOST TARGET RNA. VGAM1904 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1904 RNA, herein designated VGAM RNA, binds complementarily to one or more host target binding sites located in untranslated regions of VGAM1904 host target RNA, herein designated VGAM HOST TARGET RNA. This complementary binding is due to the fact that the nucleotide sequence of VGAM1904 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1904 RNA, herein designated VGAM RNA, may have a different number of host target binding sites in untranslated regions of a VGAM1904 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1904 RNA, herein designated VGAM RNA, to host target binding sites on VGAM1904 host target RNA, herein designated VGAM HOST TARGET RNA, such as BINDING SITE I, BINDING SITE II and BINDING SITE III, inhibits translation of VGAM1904 host target RNA into VGAM1904 host target protein, herein designated VGAM HOST TARGET PROTEIN. VGAM host target protein is therefore outlined by a broken line.

It is appreciated that VGAM1904 host target gene, herein designated VGAM HOST TARGET GENE, in fact represents a plurality of VGAM1904 host target genes. The mRNA of each one of this plurality of VGAM1904 host target genes comprises one or more host target binding sites, each having a nucleotide sequence which is at least partly complementary to VGAM1904 RNA, herein designated VGAM RNA, and which when bound by VGAM1904 RNA causes inhibition of translation of respective one or more VGAM1904 host target proteins.

It is further appreciated by one skilled in the art that the mode of translational inhibition illustrated by FIG. 1 with specific reference to translational inhibition exerted by VGAM1904 gene, herein designated VGAM GENE, on one or more VGAM1904 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1904 is inhibition of expression of host target genes, as part of a novel viral mechanism of attacking a host. Accordingly, utilities of VGAM1904 include diagnosis, prevention and treatment of viral infection by Respiratory Syncytial Virus. Specific functions, and accordingly utilities, of VGAM1904 correlate with, and may be deduced from, the identity of the host target genes which VGAM1904 binds and inhibits, and the function of these host target genes, as elaborated hereinbelow.

Nucleotide sequences of the VGAM1904 precursor RNA, herein designated VGAM PRECURSOR RNA, and of the 'diced' VGAM1904 RNA, herein designated VGAM RNA, and a schematic representation of the secondary folding of VGAM1904 folded precursor RNA, herein designated VGAM FOLDED PRECURSOR RNA, of VGAM1904 are further described hereinbelow with reference to Table 1.

Nucleotide sequences of host target binding sites, such as BINDING SITE-I, BINDING SITE-II and BINDING SITE-III of FIG. 1, found on VGAM1904 host target RNA, and schematic representation of the complementarity of each of these host target binding sites to VGAM1904 RNA, herein designated VGAM RNA, are described hereinbelow with reference to Table 2.

As mentioned hereinabove with reference to FIG. 1, a function of VGAM1904 gene, herein designated VGAM is inhibition of expression of VGAM1904 target genes. It is appreciated that specific functions, and accordingly utilities, of VGAM1904 correlate with, and may be deduced from, the identity of the target genes which VGAM1904 binds and inhibits, and the function of these target genes, as elaborated hereinbelow.

FLJ20034 (Accession NM_017630) is a VGAM1904 host target gene. FLJ20034 BINDING SITE is HOST TARGET binding site found in the 3' untranslated region of mRNA encoded by FLJ20034, corresponding to a HOST TARGET binding site such as BINDING SITE I, BINDING SITE II or BINDING SITE III. Table 2 illustrates the complementarity of the nucleotide sequences of FLJ20034 BINDING SITE, designated SEQ ID:19130, to the nucleotide sequence of VGAM1904 RNA, herein designated VGAM RNA, also designated SEQ ID:4615.

A function of VGAM1904 is therefore inhibition of FLJ20034 (Accession NM_017630). Accordingly, utilities of VGAM1904 include diagnosis, prevention and treatment of diseases and clinical conditions associated with FLJ20034. KIAA0534 (Accession XM_049349) is another VGAM1904 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35379, to the nucleotide sequence of VGAM1904 RNA, herein designated VGAM RNA, also designated SEQ ID:4615.

Another function of VGAM1904 is therefore inhibition of KIAA0534 (Accession XM_049349). Accordingly, utilities of VGAM1904 include diagnosis, prevention and treatment of diseases and clinical conditions associated with KIAA0534. FIG. 1 further provides a conceptual description of a novel bioinformatically detected viral gene of the present invention, referred to here as Viral Genomic Address Messenger 1905 (VGAM1905) viral gene, which modulates expression of respective host target genes thereof, the function and utility of which host target genes is known in the art.

VGAM1905 is a novel bioinformatically detected regulatory, non protein coding, viral micro RNA (miRNA) gene. The method by which VGAM1905 was detected is described hereinabove with reference to FIGS. 1-8.

VGAM1905 gene, herein designated VGAM GENE, is a viral gene contained in the genome of Sendai Virus. VGAM1905 host target gene, herein designated VGAM HOST TARGET GENE, is a human gene contained in the human genome.

VGAM1905 gene encodes a VGAM1905 precursor RNA, herein designated VGAM PRECURSOR RNA. Similar to other miRNA genes, and unlike most ordinary genes, VGAM1905 precursor RNA does not encode a protein. A nucleotide sequence identical or highly similar to the nucleotide sequence of VGAM1905 precursor RNA is designated SEQ ID:1891, and is provided hereinbelow with reference to the sequence listing part. Nucleotide sequence SEQ ID:1891 is located at position 5191 relative to the genome of Sendai Virus.

VGAM1905 precursor RNA folds onto itself, forming VGAM1905 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1905 folded precursor RNA into VGAM1905 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM1905 RNA is designated SEQ ID:4616, and is provided hereinbelow with reference to the sequence listing part.

VGAM1905 host target gene, herein designated VGAM HOST TARGET GENE, encodes a corresponding messenger RNA, VGAM1905 host target RNA, herein designated VGAM HOST TARGET RNA. VGAM1905 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1905 RNA, herein designated VGAM RNA, binds complementarily to one or more host target binding sites located in untranslated regions of VGAM1905 host target RNA, herein designated VGAM HOST TARGET RNA. This complementary binding is due to the fact that the nucleotide sequence of VGAM1905 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1905 RNA, herein designated VGAM RNA, may have a different number of host target binding sites in untranslated regions of a VGAM1905 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1905 RNA, herein designated VGAM RNA, to host target binding sites on VGAM1905 host target RNA, herein designated VGAM HOST TARGET RNA, such as BINDING SITE I, BINDING SITE II and BINDING SITE III, inhibits translation of VGAM1905 host target RNA into VGAM1905 host target protein, herein designated VGAM HOST TARGET PROTEIN. VGAM host target protein is therefore outlined by a broken line.

It is appreciated that VGAM1905 host target gene, herein designated VGAM HOST TARGET GENE, in fact represents a plurality of VGAM1905 host target genes. The mRNA of each one of this plurality of VGAM1905 host target genes comprises one or more host target binding sites, each having a nucleotide sequence which is at least partly complementary to VGAM1905 RNA, herein designated VGAM RNA, and which when bound by VGAM1905 RNA causes inhibition of translation of respective one or more VGAM1905 host target proteins.

It is further appreciated by one skilled in the art that the mode of translational inhibition illustrated by FIG. 1 with specific reference to translational inhibition exerted by VGAM1905 gene, herein designated VGAM GENE, on one or more VGAM1905 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1905 is inhibition of expression of host target genes, as part of a novel viral mechanism of attacking a host. Accordingly, utilities of VGAM1905 include diagnosis, prevention and treatment of viral infection by Sendai Virus. Specific functions, and accordingly utilities, of VGAM1905 correlate with, and may be deduced from, the identity of the host target genes which VGAM1905 binds and inhibits, and the function of these host target genes, as elaborated hereinbelow.

Nucleotide sequences of the VGAM1905 precursor RNA, herein designated VGAM PRECURSOR RNA, and of the 'diced' VGAM1905 RNA, herein designated VGAM RNA, and a schematic representation of the secondary folding of VGAM1905 folded precursor RNA, herein designated VGAM FOLDED PRECURSOR RNA, of VGAM1905 are further described hereinbelow with reference to Table 1.

Nucleotide sequences of host target binding sites, such as BINDING SITE-I, BINDING SITE-II and BINDING SITE-III of FIG. 1, found on VGAM1905 host target RNA, and schematic representation of the complementarity of each of these host target binding sites to VGAM1905 RNA, herein designated VGAM RNA, are described hereinbelow with reference to Table 2.

As mentioned hereinabove with reference to FIG. 1, a function of VGAM1905 gene, herein designated VGAM is inhibition of expression of VGAM1905 target genes. It is appreciated that specific functions, and accordingly utilities, of VGAM1905 correlate with, and may be deduced from, the identity of the target genes which VGAM1905 binds and inhibits, and the function of these target genes, as elaborated hereinbelow.

Cockayne Syndrome 1 (classical) (CKN1, Accession NM_000082) is a VGAM1905 host target gene. CKN1 BINDING SITE is HOST TARGET binding site found in the 3' untranslated region of mRNA encoded by CKN1, corresponding to a HOST TARGET binding site such as BINDING SITE I, BINDING SITE II or BINDING SITE III. Table 2 illustrates the complementarity of the nucleotide sequences of CKN1 BINDING SITE, designated SEQ ID:5530, to the nucleotide sequence of VGAM1905 RNA, herein designated VGAM RNA, also designated SEQ ID:4616.

A function of VGAM1905 is therefore inhibition of Cockayne Syndrome 1 (classical) (CKN1, Accession NM_000082). Accordingly, utilities of VGAM1905 include diagnosis, prevention and treatment of diseases and clinical conditions associated with CKN1. Pyrimidinergic Receptor P2Y, G-protein Coupled, 6 (P2RY6, Accession NM_004154) is another VGAM1905 host target gene. P2RY6 BINDING SITE is HOST TARGET binding site found in the 3' untranslated region of mRNA encoded by P2RY6, corresponding to a HOST TARGET binding site such as BINDING SITE I, BINDING SITE II or BINDING SITE III. Table 2 illustrates the complementarity of the nucleotide sequences of P2RY6 BINDING SITE, designated SEQ ID:10356, to the nucleotide sequence of VGAM1905 RNA, herein designated VGAM RNA, also designated SEQ ID:4616.

Another function of VGAM1905 is therefore inhibition of Pyrimidinergic Receptor P2Y, G-protein Coupled, 6 (P2RY6, Accession NM_004154), a gene which mediates cellular responses to nucleotides. Accordingly, utilities of VGAM1905 include diagnosis, prevention and treatment of diseases and clinical conditions associated with P2RY6. The function of P2RY6 and its association with various diseases and clinical conditions, has been established by previous studies, as described hereinabove with reference to VGAM445. Transmembrane Protein 2 (TMEM2, Accession NM_013390) is another VGAM1905 host target gene. TMEM2 BINDING SITE is HOST TARGET binding site found in the 3' untranslated region of mRNA encoded by TMEM2, corresponding to a HOST TARGET binding site such as BINDING SITE I, BINDING SITE II or BINDING SITE III. Table 2 illustrates the complementarity of the nucleotide sequences of TMEM2 BINDING SITE, designated SEQ ID:15040, to the nucleotide sequence of VGAM1905 RNA, herein designated VGAM RNA, also designated SEQ ID:4616.

Another function of VGAM1905 is therefore inhibition of Transmembrane Protein 2 (TMEM2, Accession NM_013390). Accordingly, utilities of VGAM1905 include diagnosis, prevention and treatment of diseases and clinical conditions associated with TMEM2. Chromosome 13 Open Reading Frame 1 (C13orf1, Accession NM_020456) is another VGAM1905 host target gene. C13orf1 BINDING SITE is HOST TARGET binding site found in the 3' untranslated region of mRNA encoded by C13orf1, corresponding to a HOST TARGET binding site such as BINDING SITE I, BINDING SITE II or BINDING SITE III. Table 2 illustrates the complementarity of the nucleotide sequences of C13orf1 BINDING SITE, designated SEQ ID:21692, to the nucleotide sequence of VGAM1905 RNA, herein designated VGAM RNA, also designated SEQ ID:4616.

Another function of VGAM1905 is therefore inhibition of Chromosome 13 Open Reading Frame 1 (C13orf1, Accession NM_020456). Accordingly, utilities of VGAM1905 include diagnosis, prevention and treatment of diseases and clinical conditions associated with C13orf1. FLJ22390 (Accession NM_022746) is another VGAM1905 host target gene. FLJ22390 BINDING SITE is HOST TARGET binding site found in the 3' untranslated region of mRNA encoded by FLJ22390, corresponding to a HOST TARGET binding site such as BINDING SITE I, BINDING SITE II or BINDING SITE III. Table 2 illustrates the complementarity of the nucleotide sequences of FLJ22390 BINDING SITE, designated SEQ ID:22956, to the nucleotide sequence of VGAM1905 RNA, herein designated VGAM RNA, also designated SEQ ID:4616.

Another function of VGAM1905 is therefore inhibition of FLJ22390 (Accession NM_022746). Accordingly, utilities of VGAM1905 include diagnosis, prevention and treatment of diseases and clinical conditions associated with FLJ22390. KIAA0748 (Accession NM_014796) is another VGAM1905 host target gene. KIAA0748 BINDING SITE is HOST TARGET binding site found in the 3' untranslated region of mRNA encoded by KIAA0748, corresponding to a HOST TARGET binding site such as BINDING SITE I, BINDING SITE II or BINDING SITE III. Table 2 illustrates the complementarity of the nucleotide sequences of KIAA0748 BINDING SITE, designated SEQ ID:16699, to the nucleotide sequence of VGAM1905 RNA, herein designated VGAM RNA, also designated SEQ ID:4616.

Another function of VGAM1905 is therefore inhibition of KIAA0748 (Accession NM_014796). Accordingly, utilities of VGAM1905 include diagnosis, prevention and treatment of diseases and clinical conditions associated with KIAA0748. KIAA1317 (Accession XM_098368) is another VGAM1905 host target gene. KIAA1317 BINDING SITE is HOST TARGET binding site found in the 3' untranslated region of mRNA encoded by KIAA1317, corresponding to a HOST TARGET binding site such as BINDING SITE I, BINDING SITE II or BINDING SITE III. Table 2 illustrates the complementarity of the nucleotide sequences of KIAA1317 BINDING SITE, designated SEQ ID:41628, to the nucleotide sequence of VGAM1905 RNA, herein designated VGAM RNA, also designated SEQ ID:4616.

Another function of VGAM1905 is therefore inhibition of KIAA1317 (Accession XM_098368). Accordingly, utilities of VGAM1905 include diagnosis, prevention and treatment of diseases and clinical conditions associated with KIAA1317. LOC122792 (Accession NM_145251) is another VGAM1905 host target gene. LOC122792 BINDING SITE is HOST TARGET binding site found in the 3' untranslated region of mRNA encoded by LOC122792, corresponding to a HOST TARGET binding site such as BINDING SITE I, BINDING SITE II or BINDING SITE III. Table 2 illustrates the complementarity of the nucleotide sequences of LOC122792 BINDING SITE, designated SEQ ID:29762, to the nucleotide sequence of VGAM1905 RNA, herein designated VGAM RNA, also designated SEQ ID:4616.

Another function of VGAM1905 is therefore inhibition of LOC122792 (Accession NM_145251). Accordingly, utilities of VGAM1905 include diagnosis, prevention and treatment of diseases and clinical conditions associated with LOC122792. LOC148697 (Accession XM_086276) is another VGAM1905 host target gene. LOC148697 BINDING SITE is HOST TARGET binding site found in the 5' untranslated region of mRNA encoded by LOC148697, corresponding to a HOST TARGET binding site such as BINDING SITE I, BINDING SITE II or BINDING SITE III. Table 2 illustrates the complementarity of the nucleotide sequences of LOC148697 BINDING SITE, designated SEQ ID:38571, to the nucleotide sequence of VGAM1905 RNA, herein designated VGAM RNA, also designated SEQ ID:4616.

Another function of VGAM1905 is therefore inhibition of LOC148697 (Accession XM_086276). Accordingly, utilities of VGAM1905 include diagnosis, prevention and treatment of diseases and clinical conditions associated with LOC148697. LOC221964 (Accession XM_168342) is another VGAM1905 host target gene. LOC221964 BINDING SITE is HOST TARGET binding site found in the 3' untranslated region of mRNA encoded by LOC221964, corresponding to a HOST TARGET binding site such as BINDING SITE I, BINDING SITE II or BINDING SITE III. Table 2 illustrates the complementarity of the nucleotide sequences of LOC221964 BINDING SITE, designated SEQ ID:45112, to the nucleotide sequence of VGAM1905 RNA, herein designated VGAM RNA, also designated SEQ ID:4616.

Another function of VGAM1905 is therefore inhibition of LOC221964 (Accession XM_168342). Accordingly, utilities of VGAM1905 include diagnosis, prevention and treatment of diseases and clinical conditions associated with LOC221964. LOC51134 (Accession NM_016122) is another VGAM1905 host target gene. LOC51134 BINDING SITE is HOST TARGET binding site found in the 3' untranslated region of mRNA encoded by LOC51134, corresponding to a HOST TARGET binding site such as BINDING SITE I, BINDING SITE II or BINDING SITE III. Table 2 illustrates the complementarity of the nucleotide sequences of LOC51134 BINDING SITE, designated SEQ ID:18210, to the nucleotide sequence of VGAM1905 RNA, herein designated VGAM RNA, also designated SEQ ID:4616.

Another function of VGAM1905 is therefore inhibition of LOC51134 (Accession NM_016122). Accordingly, utilities of VGAM1905 include diagnosis, prevention and treatment of diseases and clinical conditions associated with LOC51134. FIG. 1 further provides a conceptual description of a novel bioinformatically detected viral gene of the present invention, referred to here as Viral Genomic Address Messenger 1906 (VGAM1906) viral gene, which modulates expression of respective host target genes thereof, the function and utility of which host target genes is known in the art.

VGAM1906 is a novel bioinformatically detected regulatory, non protein coding, viral micro RNA (miRNA) gene. The method by which VGAM1906 was detected is described hereinabove with reference to FIGS. 1-8.

VGAM1906 gene, herein designated VGAM GENE, is a viral gene contained in the genome of Sendai Virus. VGAM1906 host target gene, herein designated VGAM HOST TARGET GENE, is a human gene contained in the human genome.

VGAM1906 gene encodes a VGAM1906 precursor RNA, herein designated VGAM PRECURSOR RNA. Similar to other miRNA genes, and unlike most ordinary genes, VGAM1906 precursor RNA does not encode a protein. A nucleotide sequence identical or highly similar to the nucleotide sequence of VGAM1906 precursor RNA is designated SEQ ID:1892, and is provided hereinbelow with reference to the sequence listing part. Nucleotide sequence SEQ ID:1892 is located at position 15052 relative to the genome of Sendai Virus.

VGAM1906 precursor RNA folds onto itself, forming VGAM1906 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1906 folded precursor RNA into VGAM1906 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1906 RNA is designated SEQ ID:4617, and is provided hereinbelow with reference to the sequence listing part.

VGAM1906 host target gene, herein designated VGAM HOST TARGET GENE, encodes a corresponding messenger RNA, VGAM1906 host target RNA, herein designated VGAM HOST TARGET RNA. VGAM1906 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1906 RNA, herein designated VGAM RNA, binds complementarily to one or more host target binding sites located in untranslated regions of VGAM1906 host target RNA, herein designated VGAM HOST TARGET RNA. This complementary binding is due to the fact that the nucleotide sequence of VGAM1906 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1906 RNA, herein designated VGAM RNA, may have a different number of host target binding sites in untranslated regions of a VGAM1906 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1906 RNA, herein designated VGAM RNA, to host target binding sites on VGAM1906 host target RNA, herein designated VGAM HOST TARGET RNA, such as BINDING SITE I, BINDING SITE II and BINDING SITE III, inhibits translation of VGAM1906 host target RNA into VGAM1906 host target protein, herein designated VGAM HOST TARGET PROTEIN. VGAM host target protein is therefore outlined by a broken line.

It is appreciated that VGAM1906 host target gene, herein designated VGAM HOST TARGET GENE, in fact represents a plurality of VGAM1906 host target genes. The mRNA of each one of this plurality of VGAM1906 host target genes comprises one or more host target binding sites, each having a nucleotide sequence which is at least partly complementary to VGAM1906 RNA, herein designated VGAM RNA, and which when bound by VGAM1906 RNA causes inhibition of translation of respective one or more VGAM1906 host target proteins.

It is further appreciated by one skilled in the art that the mode of translational inhibition illustrated by FIG. 1 with specific reference to translational inhibition exerted by VGAM1906 gene, herein designated VGAM GENE, on one or more VGAM1906 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1906 is inhibition of expression of host target genes, as part of a novel viral mechanism of attacking a host. Accordingly, utilities of VGAM1906 include diagnosis, prevention and treatment of viral infection by Sendai Virus. Specific functions, and accordingly utilities, of VGAM1906 correlate with, and may be deduced from, the identity of the host target genes which VGAM1906 binds and inhibits, and the function of these host target genes, as elaborated hereinbelow.

Nucleotide sequences of the VGAM1906 precursor RNA, herein designated VGAM PRECURSOR RNA, and of the 'diced' VGAM1906 RNA, herein designated VGAM RNA, and a schematic representation of the secondary folding of VGAM1906 folded precursor RNA, herein designated VGAM FOLDED PRECURSOR RNA, of VGAM1906 are further described hereinbelow with reference to Table 1.

Nucleotide sequences of host target binding sites, such as BINDING SITE-I, BINDING SITE-II and BINDING SITE-III of FIG. 1, found on VGAM1906 host target RNA, and schematic representation of the complementarity of each of these host target binding sites to VGAM1906 RNA, herein designated VGAM RNA, are described hereinbelow with reference to Table 2.

As mentioned hereinabove with reference to FIG. 1, a function of VGAM1906 gene, herein designated VGAM is inhibition of expression of VGAM1906 target genes. It is appreciated that specific functions, and accordingly utilities, of VGAM1906 correlate with, and may be deduced from, the identity of the target genes which VGAM1906 binds and inhibits, and the function of these target genes, as elaborated hereinbelow.

Glypican 4 (GPC4, Accession NM_001448) is a VGAM1906 host target gene. GPC4 BINDING SITE is HOST TARGET binding site found in the 3' untranslated region of mRNA encoded by GPC4, corresponding to a HOST TARGET binding site such as BINDING SITE I, BINDING SITE II or BINDING SITE III. Table 2 illustrates the complementarity of the nucleotide sequences of GPC4 BINDING SITE, designated SEQ ID:7178, to the nucleotide sequence of VGAM1906 RNA, herein designated VGAM RNA, also designated SEQ ID:4617.

A function of VGAM1906 is therefore inhibition of Glypican 4 (GPC4, Accession NM_001448), a gene which may play a role in growth control and cell division. Accordingly, utilities of VGAM1906 include diagnosis, prevention and treatment of diseases and clinical conditions associated with GPC4. The function of GPC4 and its association with various diseases and clinical conditions, has been established by previous studies, as described hereinabove with reference to VGAM538. LOC221540 (Accession XM_168133) is another VGAM1906 host target gene. LOC221540 BINDING SITE is HOST TARGET binding site found in the 3' untranslated region of mRNA encoded by LOC221540, corresponding to a HOST TARGET binding site such as BINDING SITE I, BINDING SITE II or BINDING SITE III. Table 2 illustrates the complementarity of the nucleotide sequences of LOC221540 BINDING SITE, designated SEQ ID:45042, to the nucleotide sequence of VGAM1906 RNA, herein designated VGAM RNA, also designated SEQ ID:4617.

Another function of VGAM1906 is therefore inhibition of LOC221540 (Accession XM_168133). Accordingly, utilities of VGAM1906 include diagnosis, prevention and treatment of diseases and clinical conditions associated with LOC221540. LOC257545 (Accession XM_175217) is another VGAM1906 host target gene. LOC257545 BINDING SITE is HOST TARGET binding site found in the 3' untranslated region of mRNA encoded by LOC257545, corresponding to a HOST TARGET binding site such as BINDING SITE I, BINDING SITE II or BINDING SITE III. Table 2 illustrates the complementarity of the nucleotide sequences of LOC257545 BINDING SITE, designated SEQ ID:46690, to the nucleotide sequence of VGAM1906 RNA, herein designated VGAM RNA, also designated SEQ ID:4617.

Another function of VGAM1906 is therefore inhibition of LOC257545 (Accession XM_175217). Accordingly, utilities of VGAM1906 include diagnosis, prevention and treatment of diseases and clinical conditions associated with LOC257545. LOC257598 (Accession XM_175295) is another VGAM1906 host target gene. LOC257598 BINDING SITE is HOST TARGET binding site found in the 3' untranslated region of mRNA encoded by LOC257598, corresponding to a HOST TARGET binding site such as BINDING SITE I, BINDING SITE II or BINDING SITE III. Table 2 illustrates the complementarity of the nucleotide sequences of LOC257598 BINDING SITE, designated SEQ ID:46747, to the nucleotide sequence of VGAM1906 RNA, herein designated VGAM RNA, also designated SEQ ID:4617.

Another function of VGAM1906 is therefore inhibition of LOC257598 (Accession XM_175295). Accordingly, utilities of VGAM1906 include diagnosis, prevention and treatment of diseases and clinical conditions associated with LOC257598. FIG. 1 further provides a conceptual description of a novel bioinformatically detected viral gene of the present invention, referred to here as Viral Genomic Address Messenger 1907 (VGAM1907) viral gene, which modulates expression of respective host target genes thereof, the function and utility of which host target genes is known in the art.

VGAM1907 is a novel bioinformatically detected regulatory, non protein coding, viral micro RNA (miRNA) gene. The method by which VGAM1907 was detected is described hereinabove with reference to FIGS. 1-8.

VGAM1907 gene, herein designated VGAM GENE, is a viral gene contained in the genome of Human Parainfluenza Virus 3. VGAM1907 host target gene, herein designated VGAM HOST TARGET GENE, is a human gene contained in the human genome.

VGAM1907 gene encodes a VGAM1907 precursor RNA, herein designated VGAM PRECURSOR RNA. Similar to other miRNA genes, and unlike most ordinary genes, VGAM1907 precursor RNA does not encode a protein. A nucleotide sequence identical or highly similar to the nucleotide sequence of VGAM1907 precursor RNA is designated SEQ ID:1893, and is provided hereinbelow with reference to the sequence listing part. Nucleotide sequence SEQ ID:1893 is located at position 7040 relative to the genome of Human Parainfluenza Virus 3.

VGAM1907 precursor RNA folds onto itself, forming VGAM1907 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1907 folded precursor RNA into VGAM1907 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 83%) nucleotide sequence of VGAM1907 RNA is designated SEQ ID:4618, and is provided hereinbelow with reference to the sequence listing part.

VGAM1907 host target gene, herein designated VGAM HOST TARGET GENE, encodes a corresponding messenger RNA, VGAM1907 host target RNA, herein designated VGAM HOST TARGET RNA. VGAM1907 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1907 RNA, herein designated VGAM RNA, binds complementarily to one or more host target binding sites located in untranslated regions of VGAM1907 host target RNA, herein designated VGAM HOST TARGET RNA. This complementary binding is due to the fact that the nucleotide sequence of VGAM1907 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1907 RNA, herein designated VGAM RNA, may have a different number of host target binding sites in untranslated regions of a VGAM1907 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1907 RNA, herein designated VGAM RNA, to host target binding sites on VGAM1907 host target RNA, herein designated VGAM HOST TARGET RNA, such as BINDING SITE I, BINDING SITE II and BINDING SITE III, inhibits translation of VGAM1907 host target RNA into VGAM1907 host target protein, herein designated VGAM HOST TARGET PROTEIN. VGAM host target protein is therefore outlined by a broken line.

It is appreciated that VGAM1907 host target gene, herein designated VGAM HOST TARGET GENE, in fact represents a plurality of VGAM1907 host target genes. The mRNA of each one of this plurality of VGAM1907 host target genes comprises one or more host target binding sites, each having a nucleotide sequence which is at least partly complementary to VGAM1907 RNA, herein designated VGAM RNA, and which when bound by VGAM1907 RNA causes inhibition of translation of respective one or more VGAM1907 host target proteins.

It is further appreciated by one skilled in the art that the mode of translational inhibition illustrated by FIG. 1 with specific reference to translational inhibition exerted by VGAM1907 gene, herein designated VGAM GENE, on one or more VGAM1907 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1907 is inhibition of expression of host target genes, as part of a novel viral mechanism of attacking a host. Accordingly, utilities of VGAM1907 include diagnosis, prevention and treatment of viral infection by Human Parainfluenza Virus 3. Specific functions, and accordingly utilities, of VGAM1907 correlate with, and may be deduced from, the identity of the host target genes which VGAM1907 binds and inhibits, and the function of these host target genes, as elaborated hereinbelow.

Nucleotide sequences of the VGAM1907 precursor RNA, herein designated VGAM PRECURSOR RNA, and of the 'diced' VGAM1907 RNA, herein designated VGAM RNA, and a schematic representation of the secondary folding of VGAM1907 folded precursor RNA, herein designated VGAM FOLDED PRECURSOR RNA, of VGAM1907 are further described hereinbelow with reference to Table 1.

Nucleotide sequences of host target binding sites, such as BINDING SITE-I, BINDING SITE-II and BINDING SITE-III of FIG. 1, found on VGAM1907 host target RNA, and schematic representation of the complementarity of each of these host target binding sites to VGAM1907 RNA, herein designated VGAM RNA, are described hereinbelow with reference to Table 2.

As mentioned hereinabove with reference to FIG. 1, a function of VGAM1907 gene, herein designated VGAM is inhibition of expression of VGAM1907 target genes. It is appreciated that specific functions, and accordingly utilities, of VGAM1907 correlate with, and may be deduced from, the identity of the target genes which VGAM1907 binds and inhibits, and the function of these target genes, as elaborated hereinbelow.

KIAA0471 (Accession NM_014857) is a VGAM1907 host target gene. KIAA0471 BINDING SITE is HOST TARGET binding site found in the 3' untranslated region of mRNA encoded by KIAA0471, corresponding to a HOST TARGET binding site such as BINDING SITE I, BINDING SITE II or BINDING SITE III. Table 2 illustrates the complementarity of the nucleotide sequences of KIAA0471 BINDING SITE, designated SEQ ID:16910, to the nucleotide sequence of VGAM1907 RNA, herein designated VGAM RNA, also designated SEQ ID:4618.

A function of VGAM1907 is therefore inhibition of KIAA0471 (Accession NM_014857). Accordingly, utilities of VGAM1907 include diagnosis, prevention and treatment of diseases and clinical conditions associated with KIAA0471. FIG. 1 further provides a conceptual description of a novel bioinformatically detected viral gene of the present invention, referred to here as Viral Genomic Address Messenger 1908 (VGAM1908) viral gene, which modulates expression of respective host target genes thereof, the function and utility of which host target genes is known in the art.

VGAM1908 is a novel bioinformatically detected regulatory, non protein coding, viral micro RNA (miRNA) gene. The method by which VGAM1908 was detected is described hereinabove with reference to FIGS. 1-8.

VGAM1908 gene, herein designated VGAM GENE, is a viral gene contained in the genome of Human Parainfluenza Virus 3. VGAM1908 host target gene, herein designated VGAM HOST TARGET GENE, is a human gene contained in the human genome.

VGAM1908 gene encodes a VGAM1908 precursor RNA, herein designated VGAM PRECURSOR RNA. Similar to other miRNA genes, and unlike most ordinary genes, VGAM1908 precursor RNA does not encode a protein. A nucleotide sequence identical or highly similar to the nucleotide sequence of VGAM1908 precursor RNA is designated SEQ ID:1894, and is provided hereinbelow with reference to the sequence listing part. Nucleotide sequence SEQ ID:1894 is located at position 8620 relative to the genome of Human Parainfluenza Virus 3.

VGAM1908 precursor RNA folds onto itself, forming VGAM1908 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1908 folded precursor RNA into VGAM1908 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1908 RNA is designated SEQ ID:4619, and is provided hereinbelow with reference to the sequence listing part.

VGAM1908 host target gene, herein designated VGAM HOST TARGET GENE, encodes a corresponding messenger RNA, VGAM1908 host target RNA, herein designated VGAM HOST TARGET RNA. VGAM1908 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1908 RNA, herein designated VGAM RNA, binds complementarily to one or more host target binding sites located in untranslated regions of VGAM1908 host target RNA, herein designated VGAM HOST TARGET RNA. This complementary binding is due to the fact that the nucleotide sequence of VGAM1908 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1908 RNA, herein designated VGAM RNA, may have a different number of host target binding sites in untranslated regions of a VGAM1908 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1908 RNA, herein designated VGAM RNA, to host target binding sites on VGAM1908 host target RNA, herein designated VGAM HOST TARGET RNA, such as BINDING SITE I, BINDING SITE II and BINDING SITE III, inhibits translation of VGAM1908 host target RNA into VGAM1908 host target protein, herein designated VGAM HOST TARGET PROTEIN. VGAM host target protein is therefore outlined by a broken line.

It is appreciated that VGAM1908 host target gene, herein designated VGAM HOST TARGET GENE, in fact represents a plurality of VGAM1908 host target genes. The mRNA of each one of this plurality of VGAM1908 host target genes comprises one or more host target binding sites, each having a nucleotide sequence which is at least partly complementary to VGAM1908 RNA, herein designated VGAM RNA, and which when bound by VGAM1908 RNA causes inhibition of translation of respective one or more VGAM1908 host target proteins.

It is further appreciated by one skilled in the art that the mode of translational inhibition illustrated by FIG. 1 with specific reference to translational inhibition exerted by VGAM1908 gene, herein designated VGAM GENE, on one or more VGAM1908 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1908 is inhibition of expression of host target genes, as part of a novel viral mechanism of attacking a host. Accordingly, utilities of VGAM1908 include diagnosis, prevention and treatment of viral infection by Human Parainfluenza Virus 3. Specific functions, and accordingly utilities, of VGAM1908 correlate with, and may be deduced from, the identity of the host target genes which VGAM1908 binds and inhibits, and the function of these target genes, as elaborated hereinbelow.

Nucleotide sequences of the VGAM1908 precursor RNA, herein designated VGAM PRECURSOR RNA, and of the 'diced' VGAM1908 RNA, herein designated VGAM RNA, and a schematic representation of the secondary folding of VGAM1908 folded precursor RNA, herein designated VGAM FOLDED PRECURSOR RNA, of VGAM1908 are further described hereinbelow with reference to Table 1.

Nucleotide sequences of host target binding sites, such as BINDING SITE-I, BINDING SITE-II and BINDING SITE-III of FIG. 1, found on VGAM1908 host target RNA, and schematic representation of the complementarity of each of these host target binding sites to VGAM1908 RNA, herein designated VGAM RNA, are described hereinbelow with reference to Table 2.

As mentioned hereinabove with reference to FIG. 1, a function of VGAM1908 gene, herein designated VGAM is inhibition of expression of VGAM1908 target genes. It is appreciated that specific functions, and accordingly utilities, of VGAM1908 correlate with, and may be deduced from, the identity of the target genes which VGAM1908 binds and inhibits, and the function of these target genes, as elaborated hereinbelow.

Solute Carrier Family 29 (nucleoside transporters), Member 1 (SLC29A1, Accession NM_004955) is a VGAM1908 host target gene. SLC29A1 BINDING SITE is HOST TARGET binding site found in the 3' untranslated region of mRNA encoded by SLC29A1, corresponding to a HOST TARGET binding site such as BINDING SITE I, BINDING SITE II or BINDING SITE III. Table 2 illustrates the complementarity of the nucleotide sequences of SLC29A1 BINDING SITE, designated SEQ ID:11401, to the nucleotide sequence of VGAM1908 RNA, herein designated VGAM RNA, also designated SEQ ID:4619.

A function of VGAM1908 is therefore inhibition of Solute Carrier Family 29 (nucleoside transporters), Member 1 (SLC29A1, Accession NM_004955), a gene which mediates both influx and efflux of nucleosides across the membrane. Accordingly, utilities of VGAM1908 include diagnosis, prevention and treatment of diseases and clinical conditions associated with SLC29A1. The function of SLC29A1 has been established by previous studies. An essential component of the action of nucleoside analog drugs used in anticancer therapies is the mediated uptake of the drug across the plasma membrane and into the cell. This is achieved by integral membrane proteins known as nucleoside transporters. There are 2 major families of nucleoside transporters, the concentrative and the equilibrative. The concentrative nucleoside transporters appear to be restricted in their distribution within cells and tissues and also in their selectivity of nucleoside permeants. In contrast, the equilibrative nucleoside transporters appear to be widely distributed and have a broad substrate specificity. Griffiths et al. (1997) cloned the cDNA for the prototypic equilibrative transporter ENT1 from human placenta. Choi et al. (2000) cloned and sequenced the mouse Ent1 gene. Northern blot analysis detected expression of Ent1 in all tissues except skeletal muscle, with highest levels in liver, heart, testis, spleen, lung, kidney, and brain.

Full details of the abovementioned studies are described in the following publications, the disclosure of which are hereby incorporated by reference:

Griffiths, M.; Beaumont, N.; Yao, S. Y. M.; Sundaram, M.; Boumah, C. E.; Davies, A.; Kwong, F. Y. P.; Coe, I.; Cass, C. E.; Young, J. D.; Baldwin, S. A.: Cloning of a human nucleoside transporter implicated in the cellular uptake of adenosine and chemotherapeutic drugs. Nature Med. 3:89-94, 1997; and Choi, D.-S.; Handa, M.; Young, H.; Gordon, A. S.; Diamond, I.; Messing, R. O.: Genomic organization and expression of the mouse equilibrative, nitrobenzylthioinosine-sensitive nucleoside.

Further studies establishing the function and utilities of SLC29A1 are found in John Hopkins OMIM database record ID 602193, and in sited publications numbered 5854-5856 listed in the bibliography section hereinbelow, which are also hereby incorporated by reference. Steroid Sulfatase (microsomal), Arylsulfatase C, Isozyme S (STS, Accession NM_000351) is another VGAM1908 host target gene. STS BINDING SITE is HOST TARGET binding site found in the 3' untranslated region of mRNA encoded by STS, corresponding to a HOST TARGET binding site such as BINDING SITE I, BINDING SITE II or BINDING SITE III. Table 2 illustrates the complementarity of the nucleotide sequences of STS BINDING SITE, designated SEQ ID:5912, to the nucleotide sequence of VGAM1908 RNA, herein designated VGAM RNA, also designated SEQ ID:4619.

Another function of VGAM1908 is therefore inhibition of Steroid Sulfatase (microsomal), Arylsulfatase C, Isozyme S (STS, Accession NM_000351). Accordingly, utilities of VGAM1908 include diagnosis, prevention and treatment of diseases and clinical conditions associated with STS. KIAA0543 (Accession XM_044213) is another VGAM1908 host target gene. KIAA0543 BINDING SITE is HOST TARGET binding site found in the 3' untranslated region of mRNA encoded by KIAA0543, corresponding to a HOST TARGET binding site such as BINDING SITE I, BINDING SITE II or BINDING SITE III. Table 2 illustrates the complementarity of the nucleotide sequences of KIAA0543 BINDING SITE, designated SEQ ID:34179, to the nucleotide sequence of VGAM1908 RNA, herein designated VGAM RNA, also designated SEQ ID:4619.

Another function of VGAM1908 is therefore inhibition of KIAA0543 (Accession XM_044213). Accordingly, utilities of VGAM1908 include diagnosis, prevention and treatment of diseases and clinical conditions associated with KIAA0543. UMP-CMPK (Accession NM_016308) is another VGAM1908 host target gene. UMP-CMPK BINDING SITE is HOST TARGET binding site found in the 3' untranslated region of mRNA encoded by UMP-CMPK, corresponding to a HOST TARGET binding site such as BINDING SITE I, BINDING SITE II or BINDING SITE III. Table 2 illustrates the complementarity of the nucleotide sequences of UMP-CMPK BINDING SITE, designated SEQ ID:18427, to the nucleotide sequence of VGAM1908 RNA, herein designated VGAM RNA, also designated SEQ ID:4619.

Another function of VGAM1908 is therefore inhibition of UMP-CMPK (Accession NM_016308). Accordingly, utilities of VGAM1908 include diagnosis, prevention and treatment of diseases and clinical conditions associated with UMP-CMPK. LOC152441 (Accession XM_098230) is another VGAM1908 host target gene. LOC152441 BINDING SITE is HOST TARGET binding site found in the 5' untranslated region of mRNA encoded by LOC152441, corresponding to a HOST TARGET binding site such as BINDING SITE I, BINDING SITE II or BINDING SITE III. Table 2 illustrates the complementarity of the nucleotide sequences of LOC152441 BINDING SITE, designated SEQ ID:41507, to the nucleotide sequence of VGAM1908 RNA, herein designated VGAM RNA, also designated SEQ ID:4619.

Another function of VGAM1908 is therefore inhibition of LOC152441 (Accession XM_098230). Accordingly, utilities of VGAM1908 include diagnosis, prevention and treatment of diseases and clinical conditions associated with LOC152441. LOC51313 (Accession NM_016613) is another VGAM1908 host target gene. LOC51313 BINDING SITE is HOST TARGET binding site found in the 3' untranslated region of mRNA encoded by LOC51313, corresponding to a HOST TARGET binding site such as BINDING SITE I, BINDING SITE II or BINDING SITE III. Table 2 illustrates the complementarity of the nucleotide sequences of LOC51313 BINDING SITE, designated SEQ ID:18721, to the nucleotide sequence of VGAM1908 RNA, herein designated VGAM RNA, also designated SEQ ID:4619.

Another function of VGAM1908 is therefore inhibition of LOC51313 (Accession NM_016613). Accordingly, utilities of VGAM1908 include diagnosis, prevention and treatment of diseases and clinical conditions associated with LOC51313. FIG. 1 further provides a conceptual description of a novel bioinformatically detected viral gene of the present invention, referred to here as Viral Genomic Address Messenger 1909 (VGAM1909) viral gene, which modulates expression of respective host target genes thereof, the function and utility of which host target genes is known in the art.

VGAM1909 is a novel bioinformatically detected regulatory, non protein coding, viral micro RNA (miRNA) gene. The method by which VGAM1909 was detected is described hereinabove with reference to FIGS. 1-8.

VGAM1909 gene, herein designated VGAM GENE, is a viral gene contained in the genome of Human Parainfluenza Virus 3. VGAM1909 host target gene, herein designated VGAM HOST TARGET GENE, is a human gene contained in the human genome.

VGAM1909 gene encodes a VGAM1909 precursor RNA, herein designated VGAM PRECURSOR RNA. Similar to other miRNA genes, and unlike most ordinary genes, VGAM1909 precursor RNA does not encode a protein. A nucleotide sequence identical or highly similar to the nucleotide sequence of VGAM1909 precursor RNA is designated SEQ ID:1895, and is provided hereinbelow with reference to the sequence listing part. Nucleotide sequence SEQ ID:1895 is located at position 5850 relative to the genome of Human Parainfluenza Virus 3.

VGAM1909 precursor RNA folds onto itself, forming VGAM1909 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1909 folded precursor RNA into VGAM1909 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1909 RNA is designated SEQ ID:4620, and is provided hereinbelow with reference to the sequence listing part.

VGAM1909 host target gene, herein designated VGAM HOST TARGET GENE, encodes a corresponding messenger RNA, VGAM1909 host target RNA, herein designated VGAM HOST TARGET RNA. VGAM1909 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1909 RNA, herein designated VGAM RNA, binds complementarily to one or more host target binding sites located in untranslated regions of VGAM1909 host target RNA, herein designated VGAM HOST TARGET RNA. This complementary binding is due to the fact that the nucleotide sequence of VGAM1909 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1909 RNA, herein designated VGAM RNA, may have a different number of host target binding sites in untranslated regions of a VGAM1909 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1909 RNA, herein designated VGAM RNA, to host target binding sites on VGAM1909 host target RNA, herein designated VGAM HOST TARGET RNA, such as BINDING SITE I, BINDING SITE II and BINDING SITE III, inhibits translation of VGAM1909 host target RNA into VGAM1909 host target protein, herein designated VGAM HOST TARGET PROTEIN. VGAM host target protein is therefore outlined by a broken line.

It is appreciated that VGAM1909 host target gene, herein designated VGAM HOST TARGET GENE, in fact represents a plurality of VGAM1909 host target genes. The mRNA of each one of this plurality of VGAM1909 host target genes comprises one or more host target binding sites, each having a nucleotide sequence which is at least partly complementary to VGAM1909 RNA, herein designated VGAM RNA, and which when bound by VGAM1909 RNA causes inhibition of translation of respective one or more VGAM1909 host target proteins.

It is further appreciated by one skilled in the art that the mode of translational inhibition illustrated by FIG. 1 with specific reference to translational inhibition exerted by VGAM1909 gene, herein designated VGAM GENE, on one or more VGAM1909 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1909 is inhibition of expression of host target genes, as part of a novel viral mechanism of attacking a host. Accordingly, utilities of VGAM1909 include diagnosis, prevention and treatment of viral infection by Human Parainfluenza Virus 3. Specific functions, and accordingly utilities, of VGAM1909 correlate with, and may be deduced from, the identity of the host target genes which VGAM1909 binds and inhibits, and the function of these host target genes, as elaborated hereinbelow.

Nucleotide sequences of the VGAM1909 precursor RNA, herein designated VGAM PRECURSOR RNA, and of the 'diced' VGAM1909 RNA, herein designated VGAM RNA, and a schematic representation of the secondary folding of VGAM1909 folded precursor RNA, herein designated VGAM FOLDED PRECURSOR RNA, of VGAM1909 are further described hereinbelow with reference to Table 1.

Nucleotide sequences of host target binding sites, such as BINDING SITE-I, BINDING SITE-II and BINDING SITE-III of FIG. 1, found on VGAM1909 host target RNA, and schematic representation of the complementarity of each of these host target binding sites to VGAM1909 RNA, herein designated VGAM RNA, are described hereinbelow with reference to Table 2.

As mentioned hereinabove with reference to FIG. 1, a function of VGAM1909 gene, herein designated VGAM is inhibition of expression of VGAM1909 target genes. It is appreciated that specific functions, and accordingly utilities, of VGAM1909 correlate with, and may be deduced from, the identity of the target genes which VGAM1909 binds and inhibits, and the function of these target genes, as elaborated hereinbelow.

High Mobility Group AT-hook 2 (HMGA2, Accession NM_003483) is a VGAM1909 host target gene. HMGA2 BINDING SITE is HOST TARGET binding site found in the 3' untranslated region of mRNA encoded by HMGA2, corresponding to a HOST TARGET binding site such as BINDING SITE I, BINDING SITE II or BINDING SITE III. Table 2 illustrates the complementarity of the nucleotide sequences of HMGA2 BINDING SITE, designated SEQ ID:9560, to the nucleotide sequence of VGAM1909 RNA, herein designated VGAM RNA, also designated SEQ ID:4620.

A function of VGAM1909 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM1909 include diagnosis, prevention and treatment of diseases and clinical conditions associated with HMGA2. The function of HMGA2 and its association with various diseases and clinical conditions, has been established by previous studies, as described hereinabove with reference to VGAM552. Myelin Protein Zero (Charcot-Marie-Tooth neuropathy 1B) (MPZ, Accession NM_000530) is another VGAM1909 host target gene. MPZ BINDING SITE is HOST TARGET binding site found in the 3' untranslated region of mRNA encoded by MPZ, corresponding to a HOST TARGET binding site such as BINDING SITE I, BINDING SITE II or BINDING SITE III. Table 2 illustrates the complementarity of the nucleotide sequences of MPZ BINDING SITE, designated SEQ ID:6129, to the nucleotide sequence of VGAM1909 RNA, herein designated VGAM RNA, also designated SEQ ID:4620.

Another function of VGAM1909 is therefore inhibition of Myelin Protein Zero (Charcot-Marie-Tooth neuropathy 1B) (MPZ, Accession NM_000530). Accordingly, utilities of VGAM1909 include diagnosis, prevention and treatment of diseases and clinical conditions associated with MPZ. Nucleoporin 98 kDa (NUP98, Accession NM_016320) is another VGAM1909 host target gene. NUP98 BINDING SITE is HOST TARGET binding site found in the 3' untranslated region of mRNA encoded by NUP98, corresponding to a HOST TARGET binding site such as BINDING SITE I, BINDING SITE II or BINDING SITE III. Table 2 illustrates the complementarity of the nucleotide sequences of NUP98 BINDING SITE, designated SEQ ID:18438, to the nucleotide sequence of VGAM1909 RNA, herein designated VGAM RNA, also designated SEQ ID:4620.

Another function of VGAM1909 is therefore inhibition of Nucleoporin 98kDa (NUP98, Accession NM_016320), a gene which functions in the nuclear transport of protein and RNA. Accordingly, utilities of VGAM1909 include diagnosis, prevention and treatment of diseases and clinical conditions associated with NUP98. The function of NUP98 and its association with various diseases and clinical conditions, has been established by previous studies, as described hereinabove with reference to VGAM55. FLJ20232 (Accession NM_019008) is another VGAM1909 host target gene. FLJ20232 BINDING SITE is HOST TARGET binding site found in the 5' untranslated region of mRNA encoded by FLJ20232, corresponding to a HOST TARGET binding site such as BINDING SITE I, BINDING SITE II or BINDING SITE III. Table 2 illustrates the complementarity of the nucleotide sequences of FLJ20232 BINDING SITE, designated SEQ ID:21081, to the nucleotide sequence of VGAM1909 RNA, herein designated VGAM RNA, also designated SEQ ID:4620.

Another function of VGAM1909 is therefore inhibition of FLJ20232 (Accession NM_019008). Accordingly, utilities of VGAM1909 include diagnosis, prevention and treatment of diseases and clinical conditions associated with FLJ20232. FLJ32389 (Accession NM_144617) is another VGAM1909 host target gene. FLJ32389 BINDING SITE is HOST TARGET binding site found in the 3' untranslated region of mRNA encoded by FLJ32389, corresponding to a HOST TARGET binding site such as BINDING SITE I, BINDING SITE II or BINDING SITE III. Table 2 illustrates the complementarity of the nucleotide sequences of FLJ32389 BINDING SITE, designated SEQ ID:29433, to the nucleotide sequence of VGAM1909 RNA, herein designated VGAM RNA, also designated SEQ ID:4620.

Another function of VGAM1909 is therefore inhibition of FLJ32389 (Accession NM_144617). Accordingly, utilities of VGAM1909 include diagnosis, prevention and treatment of diseases and clinical conditions associated with FLJ32389. KIAA1855 (Accession XM_166453) is another VGAM1909 host target gene. KIAA1855 BINDING SITE is HOST TARGET binding site found in the 3' untranslated region of mRNA encoded by KIAA1855, corresponding to a HOST TARGET binding site such as BINDING SITE I, BINDING SITE II or BINDING SITE III. Table 2 illustrates the complementarity of the nucleotide sequences of KIAA1855 BINDING SITE, designated SEQ ID:44351, to the nucleotide sequence of VGAM1909 RNA, herein designated VGAM RNA, also designated SEQ ID:4620.

Another function of VGAM1909 is therefore inhibition of KIAA1855 (Accession XM_166453). Accordingly, utilities of VGAM1909 include diagnosis, prevention and treatment of diseases and clinical conditions associated with KIAA1855. LOC144231 (Accession XM_096561) is another VGAM1909 host target gene. LOC144231 BINDING SITE is HOST TARGET binding site found in the 5' untranslated region of mRNA encoded by LOC144231, corresponding to a HOST TARGET binding site such as BINDING SITE I, BINDING SITE II or BINDING SITE III. Table 2 illustrates the complementarity of the nucleotide sequences of LOC144231 BINDING SITE, designated SEQ ID:40391, to the nucleotide sequence of VGAM1909 RNA, herein designated VGAM RNA, also designated SEQ ID:4620.

Another function of VGAM1909 is therefore inhibition of LOC144231 (Accession XM_096561). Accordingly, utilities of VGAM1909 include diagnosis, prevention and treatment of diseases and clinical conditions associated with LOC144231. LOC161823 (Accession XM_091156) is another VGAM1909 host target gene. LOC161823 BINDING SITE is HOST TARGET binding site found in the 3' untranslated region of mRNA encoded by LOC161823, corresponding to a HOST TARGET binding site such as BINDING SITE I, BINDING SITE II or BINDING SITE III. Table 2 illustrates the complementarity of the nucleotide sequences of LOC161823 BINDING SITE, designated SEQ ID:40034, to the nucleotide sequence of VGAM1909 RNA, herein designated VGAM RNA, also designated SEQ ID:4620.

Another function of VGAM1909 is therefore inhibition of LOC161823 (Accession XM_091156). Accordingly, utilities of VGAM1909 include diagnosis, prevention and treatment of diseases and clinical conditions associated with LOC161823. LOC201191 (Accession XM_117058) is another VGAM1909 host target gene. LOC201191 BINDING SITE is HOST TARGET binding site found in the 3' untranslated region of mRNA encoded by LOC201191, corresponding to a HOST TARGET binding site such as BINDING SITE I, BINDING SITE II or BINDING SITE III. Table 2 illustrates the complementarity of the nucleotide sequences of LOC201191 BINDING SITE, designated SEQ ID:43214, to the nucleotide sequence of VGAM1909 RNA, herein designated VGAM RNA, also designated SEQ ID:4620.

Another function of VGAM1909 is therefore inhibition of LOC201191 (Accession XM_117058). Accordingly, utilities of VGAM1909 include diagnosis, prevention and treatment of diseases and clinical conditions associated with LOC201191. LOC220776 (Accession XM_043388) is another VGAM1909 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33931, to the nucleotide sequence of VGAM1909 RNA, herein designated VGAM RNA, also designated SEQ ID:4620.

Another function of VGAM1909 is therefore inhibition of LOC220776 (Accession XM_043388). Accordingly, utilities of VGAM1909 include diagnosis, prevention and treatment of diseases and clinical conditions associated with LOC220776. LOC91409 (Accession XM_038298) is another VGAM1909 host target gene. LOC91409 BINDING SITE is HOST TARGET binding site found in the 3' untranslated region of mRNA encoded by LOC91409, corresponding to a HOST TARGET binding site such as BINDING SITE I, BINDING SITE II or BINDING SITE III. Table 2 illustrates the complementarity of the nucleotide sequences of LOC91409 BINDING SITE, designated SEQ ID:32802, to the nucleotide sequence of VGAM1909 RNA, herein designated VGAM RNA, also designated SEQ ID:4620.

Another function of VGAM1909 is therefore inhibition of LOC91409 (Accession XM_038298). Accordingly, utilities of VGAM1909 include diagnosis, prevention and treatment of diseases and clinical conditions associated with LOC91409. FIG. 1 further provides a conceptual description of a novel bioinformatically detected viral gene of the present invention, referred to here as Viral Genomic Address Messenger 1910 (VGAM1910) viral gene, which modulates expression of respective host target genes thereof, the function and utility of which host target genes is known in the art.

VGAM1910 is a novel bioinformatically detected regulatory, non protein coding, viral micro RNA (miRNA) gene. The method by which VGAM1910 was detected is described hereinabove with reference to FIGS. 1-8.

VGAM1910 gene, herein designated VGAM GENE, is a viral gene contained in the genome of Human Parainfluenza Virus 3. VGAM1910 host target gene, herein designated VGAM HOST TARGET GENE, is a human gene contained in the human genome.

VGAM1910 gene encodes a VGAM1910 precursor RNA, herein designated VGAM PRECURSOR RNA. Similar to other miRNA genes, and unlike most ordinary genes, VGAM1910 precursor RNA does not encode a protein. A nucleotide sequence identical or highly similar to the nucleotide sequence of VGAM1910 precursor RNA is designated SEQ ID:1896, and is provided hereinbelow with reference to the sequence listing part. Nucleotide sequence SEQ ID:1896 is located at position 8937 relative to the genome of Human Parainfluenza Virus 3.

VGAM1910 precursor RNA folds onto itself, forming VGAM1910 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1910 folded precursor RNA into VGAM1910 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1910 RNA is designated SEQ ID:4621, and is provided hereinbelow with reference to the sequence listing part.

VGAM1910 host target gene, herein designated VGAM HOST TARGET GENE, encodes a corresponding messenger RNA, VGAM1910 host target RNA, herein designated VGAM HOST TARGET RNA. VGAM1910 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1910 RNA, herein designated VGAM RNA, binds complementarily to one or more host target binding sites located in untranslated regions of VGAM1910 host target RNA, herein designated VGAM HOST TARGET RNA. This complementary binding is due to the fact that the nucleotide sequence of VGAM1910 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1910 RNA, herein designated VGAM RNA, may have a different number of host target binding sites in untranslated regions of a VGAM1910 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1910 RNA, herein designated VGAM RNA, to host target binding sites on VGAM1910 host target RNA, herein designated VGAM HOST TARGET RNA, such as BINDING SITE I, BINDING SITE II and BINDING SITE III, inhibits translation of VGAM1910 host target RNA into VGAM1910 host target protein, herein designated VGAM HOST TARGET PROTEIN. VGAM host target protein is therefore outlined by a broken line.

It is appreciated that VGAM1910 host target gene, herein designated VGAM HOST TARGET GENE, in fact represents a plurality of VGAM1910 host target genes. The mRNA of each one of this plurality of VGAM1910 host target genes comprises one or more host target binding sites, each having a nucleotide sequence which is at least partly complementary to VGAM1910 RNA, herein designated VGAM RNA, and which when bound by VGAM1910 RNA causes inhibition of translation of respective one or more VGAM1910 host target proteins.

It is further appreciated by one skilled in the art that the mode of translational inhibition illustrated by FIG. 1 with specific reference to translational inhibition exerted by VGAM1910 gene, herein designated VGAM GENE, on one or more VGAM1910 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1910 is inhibition of expression of host target genes, as part of a novel viral mechanism of attacking a host. Accordingly, utilities of VGAM1910 include diagnosis, prevention and treatment of viral infection by Human Parainfluenza Virus 3. Specific functions, and accordingly utilities, of VGAM1910 correlate with, and may be deduced from, the identity of the host target genes which VGAM1910 binds and inhibits, and the function of these host target genes, as elaborated hereinbelow.

Nucleotide sequences of the VGAM1910 precursor RNA, herein designated VGAM PRECURSOR RNA, and of the 'diced' VGAM1910 RNA, herein designated VGAM RNA, and a schematic representation of the secondary folding of VGAM1910 folded precursor RNA, herein designated VGAM FOLDED PRECURSOR RNA, of VGAM1910 are further described hereinbelow with reference to Table 1.

Nucleotide sequences of host target binding sites, such as BINDING SITE-I, BINDING SITE-II and BINDING SITE-III of FIG. 1, found on VGAM1910 host target RNA, and schematic representation of the complementarity of each of these host target binding sites to VGAM1910 RNA, herein designated VGAM RNA, are described hereinbelow with reference to Table 2.

As mentioned hereinabove with reference to FIG. 1, a function of VGAM1910 gene, herein designated VGAM is inhibition of expression of VGAM1910 target genes. It is appreciated that specific functions, and accordingly utilities, of VGAM1910 correlate with, and may be deduced from, the identity of the target genes which VGAM1910 binds and inhibits, and the function of these target genes, as elaborated hereinbelow.

Fibronectin Leucine Rich Transmembrane Protein 2 (FLRT2, Accession NM_013231) is a VGAM1910 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14884, to the nucleotide sequence of VGAM1910 RNA, herein designated VGAM RNA, also designated SEQ ID:4621.

A function of VGAM1910 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM1910 include diagnosis, prevention and treatment of diseases and clinical conditions associated with FLRT2. The function of FLRT2 and its association with various diseases and clinical conditions, has been established by previous studies, as described hereinabove with reference to VGAM247. Folate Receptor 1 (adult) (FOLR1, Accession NM_016730) is another VGAM1910 host target gene. FOLR1 BINDING SITE is HOST TARGET binding site found in the 5' untranslated region of mRNA encoded by FOLR1, corresponding to a HOST TARGET binding site such as BINDING SITE I, BINDING SITE II or BINDING SITE III. Table 2 illustrates the complementarity of the nucleotide sequences of FOLR1 BINDING SITE, designated SEQ ID:18783, to the nucleotide sequence of VGAM1910 RNA, herein designated VGAM RNA, also designated SEQ ID:4621.

Another function of VGAM1910 is therefore inhibition of Folate Receptor 1 (adult) (FOLR1, Accession NM_016730), a gene which binds and initiates transport of folate and methotrexate. Accordingly, utilities of VGAM1910 include diagnosis, prevention and treatment of diseases and clinical conditions associated with FOLR1. The function of FOLR1 and its association with various diseases and clinical conditions, has been established by previous studies, as described hereinabove with reference to VGAM399. Lipin 1 (LPIN1, Accession XM_041136) is another VGAM1910 host target gene. LPIN1 BINDING SITE is HOST TARGET binding site found in the 3' untranslated region of mRNA encoded by LPIN1, corresponding to a HOST TARGET binding site such as BINDING SITE I, BINDING SITE II or BINDING SITE III. Table 2 illustrates the complementarity of the nucleotide sequences of LPIN1 BINDING SITE, designated SEQ ID:33464, to the nucleotide sequence of VGAM1910 RNA, herein designated VGAM RNA, also designated SEQ ID:4621.

Another function of VGAM1910 is therefore inhibition of Lipin 1 (LPIN1, Accession XM_041136), a gene which is involved in adipocyte differenciation (by similarity). Accordingly, utilities of VGAM1910 include diagnosis, prevention and treatment of diseases and clinical conditions associated with LPIN1. The function of LPIN1 and its association with various diseases and clinical conditions, has been established by previous studies, as described hereinabove with reference to VGAM35. Phosphotidylinositol Transfer Protein, Beta (PITPNB, Accession NM_012399) is another VGAM1910 host target gene. PITPNB BINDING SITE is HOST TARGET binding site found in the 3' untranslated region of mRNA encoded by PITPNB, corresponding to a HOST TARGET binding site such as BINDING SITE I, BINDING SITE II or BINDING SITE III. Table 2 illustrates the complementarity of the nucleotide sequences of PITPNB BINDING SITE, designated SEQ ID:14765, to the nucleotide sequence of VGAM1910 RNA, herein designated VGAM RNA, also designated SEQ ID:4621.

Another function of VGAM1910 is therefore inhibition of Phosphotidylinositol Transfer Protein, Beta (PITPNB, Accession NM_012399), a gene which catalyzes the transfer of ptdins and phosphatidylcholine between membranes. Accordingly, utilities of VGAM1910 include diagnosis, prevention and treatment of diseases and clinical conditions associated with PITPNB. The function of PITPNB and its association with various diseases and clinical conditions, has been established by previous studies, as described hereinabove with reference to VGAM1016. EDR1 (Accession NM_004426) is another VGAM1910 host target gene. EDR1 BINDING SITE is HOST TARGET binding site found in the 3' untranslated region of mRNA encoded by EDR1, corresponding to a HOST TARGET binding site such as BINDING SITE I, BINDING SITE II or BINDING SITE III. Table 2 illustrates the complementarity of the nucleotide sequences of EDR1 BINDING SITE, designated SEQ ID:10701, to the nucleotide sequence of VGAM1910 RNA, herein designated VGAM RNA, also designated SEQ ID:4621.

Another function of VGAM1910 is therefore inhibition of EDR1 (Accession NM_004426). Accordingly, utilities of VGAM1910 include diagnosis, prevention and treatment of diseases and clinical conditions associated with EDR1. FLJ10201 (Accession NM_018023) is another VGAM1910 host target gene. FLJ10201 BINDING SITE is HOST TARGET binding site found in the 3' untranslated region of mRNA encoded by FLJ10201, corresponding to a HOST TARGET binding site such as BINDING SITE I, BINDING SITE II or BINDING SITE III. Table 2 illustrates the complementarity of the nucleotide sequences of FLJ10201 BINDING SITE, designated SEQ ID:19763, to the nucleotide sequence of VGAM1910 RNA, herein designated VGAM RNA, also designated SEQ ID:4621.

Another function of VGAM1910 is therefore inhibition of FLJ10201 (Accession NM_018023). Accordingly, utilities of VGAM1910 include diagnosis, prevention and treatment of diseases and clinical conditions associated with FLJ10201. KIAA1350 (Accession XM_052597) is another VGAM1910 host target gene. KIAA1350 BINDING SITE is HOST TARGET binding site found in the 3' untranslated region of mRNA encoded by KIAA1350, corresponding to a HOST TARGET binding site such as BINDING SITE I, BINDING SITE II or BINDING SITE III. Table 2 illustrates the complementarity of the nucleotide sequences of KIAA1350 BINDING SITE, designated SEQ ID:35999, to the nucleotide sequence of VGAM1910 RNA, herein designated VGAM RNA, also designated SEQ ID:4621.

Another function of VGAM1910 is therefore inhibition of KIAA1350 (Accession XM_052597). Accordingly, utilities of VGAM1910 include diagnosis, prevention and treatment of diseases and clinical conditions associated with KIAA1350. FIG. 1 further provides a conceptual description of a novel bioinformatically detected viral gene of the present invention, referred to here as Viral Genomic Address Messenger 1911 (VGAM1911) viral gene, which modulates expression of respective host target genes thereof, the function and utility of which host target genes is known in the art.

VGAM1911 is a novel bioinformatically detected regulatory, non protein coding, viral micro RNA (miRNA) gene. The method by which VGAM1911 was detected is described hereinabove with reference to FIGS. 1-8.

VGAM1911 gene, herein designated VGAM GENE, is a viral gene contained in the genome of Human Parainfluenza Virus 3. VGAM1911 host target gene, herein designated VGAM HOST TARGET GENE, is a human gene contained in the human genome.

VGAM1911 gene encodes a VGAM1911 precursor RNA, herein designated VGAM PRECURSOR RNA. Similar to other miRNA genes, and unlike most ordinary genes, VGAM1911 precursor RNA does not encode a protein. A nucleotide sequence identical or highly similar to the nucleotide sequence of VGAM1911 precursor RNA is designated SEQ ID:1897, and is provided hereinbelow with reference to the sequence listing part. Nucleotide sequence SEQ ID:1897 is located at position 1061 relative to the genome of Human Parainfluenza Virus 3.

VGAM1911 precursor RNA folds onto itself, forming VGAM1911 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1911 folded precursor RNA into VGAM1911 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1911 RNA is designated SEQ ID:4622, and is provided hereinbelow with reference to the sequence listing part.

VGAM1911 host target gene, herein designated VGAM HOST TARGET GENE, encodes a corresponding messenger RNA, VGAM1911 host target RNA, herein designated VGAM HOST TARGET RNA. VGAM1911 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1911 RNA, herein designated VGAM RNA, binds complementarily to one or more host target binding sites located in untranslated regions of VGAM1911 host target RNA, herein designated VGAM HOST TARGET RNA. This complementary binding is due to the fact that the nucleotide sequence of VGAM1911 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1911 RNA, herein designated VGAM RNA, may have a different number of host target binding sites in untranslated regions of a VGAM1911 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1911 RNA, herein designated VGAM RNA, to host target binding sites on VGAM1911 host target RNA, herein designated VGAM HOST TARGET RNA, such as BINDING SITE I, BINDING SITE II and BINDING SITE III, inhibits translation of VGAM1911 host target RNA into VGAM1911 host target protein, herein designated VGAM HOST TARGET PROTEIN. VGAM host target protein is therefore outlined by a broken line.

It is appreciated that VGAM1911 host target gene, herein designated VGAM HOST TARGET GENE, in fact represents a plurality of VGAM1911 host target genes. The mRNA of each one of this plurality of VGAM1911 host target genes comprises one or more host target binding sites, each having a nucleotide sequence which is at least partly complementary to VGAM1911 RNA, herein designated VGAM RNA, and which when bound by VGAM1911 RNA causes inhibition of translation of respective one or more VGAM1911 host target proteins.

It is further appreciated by one skilled in the art that the mode of translational inhibition illustrated by FIG. 1 with specific reference to translational inhibition exerted by VGAM1911 gene, herein designated VGAM GENE, on one or more VGAM1911 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1911 is inhibition of expression of host target genes, as part of a novel viral mechanism of attacking a host. Accordingly, utilities of VGAM1911 include diagnosis, prevention and treatment of viral infection by Human Parainfluenza Virus 3. Specific functions, and accordingly utilities, of VGAM1911 correlate with, and may be deduced from, the identity of the host target genes which VGAM1911 binds and inhibits, and the function of these host target genes, as elaborated hereinbelow.

Nucleotide sequences of the VGAM1911 precursor RNA, herein designated VGAM PRECURSOR RNA, and of the 'diced' VGAM1911 RNA, herein designated VGAM RNA, and a schematic representation of the secondary folding of VGAM1911 folded precursor RNA, herein designated VGAM FOLDED PRECURSOR RNA, of VGAM1911 are further described hereinbelow with reference to Table 1.

Nucleotide sequences of host target binding sites, such as BINDING SITE-I, BINDING SITE-II and BINDING SITE-III of FIG. 1, found on VGAM1911 host target RNA, and schematic representation of the complementarity of each of these host target binding sites to VGAM1911 RNA, herein designated VGAM RNA, are described hereinbelow with reference to Table 2.

As mentioned hereinabove with reference to FIG. 1, a function of VGAM1911 gene, herein designated VGAM is inhibition of expression of VGAM1911 target genes. It is appreciated that specific functions, and accordingly utilities, of VGAM1911 correlate with, and may be deduced from, the identity of the target genes which VGAM1911 binds and inhibits, and the function of these target genes, as elaborated hereinbelow.

Breast Cancer 1, Early Onset (BRCA1, Accession NM_007294) is a VGAM1911 host target gene. BRCA1 BINDING SITE1 through BRCA1 BINDING SITE10 are HOST TARGET binding sites found in untranslated regions of mRNA encoded by BRCA1, corresponding to HOST TARGET binding sites such as BINDING SITE I, BINDING SITE II or BINDING SITE III. Table 2 illustrates the complementarity of the nucleotide sequences of BRCA1 BINDING SITE1 through BRCA1 BINDING SITE10, designated SEQ ID:14166, SEQ ID:14172, SEQ ID:14178, SEQ ID:14185, SEQ ID:14191, SEQ ID:14197, SEQ ID:14205, SEQ ID:14211, SEQ ID:14217 and SEQ ID:14223 respectively, to the nucleotide sequence of VGAM1911 RNA, herein designated VGAM RNA, also designated SEQ ID:4622.

A function of VGAM1911 is therefore inhibition of Breast Cancer 1, Early Onset (BRCA1, Accession NM_007294). Accordingly, utilities of VGAM1911 include diagnosis, prevention and treatment of diseases and clinical conditions associated with BRCA1. Carbonic Anhydrase III, Muscle Specific (CA3, Accession NM_005181) is another VGAM1911 host target gene. CA3 BINDING SITE is HOST TARGET binding site found in the 5' untranslated region of mRNA encoded by CA3, corresponding to a HOST TARGET binding site such as BINDING SITE I, BINDING SITE II or BINDING SITE III. Table 2 illustrates the complementarity of the nucleotide sequences of CA3 BINDING SITE, designated SEQ ID:11680, to the nucleotide sequence of VGAM1911 RNA, herein designated VGAM RNA, also designated SEQ ID:4622.

Another function of VGAM1911 is therefore inhibition of Carbonic Anhydrase III, Muscle Specific (CA3, Accession NM_005181), a gene which has a muscle-specific function of reversible hydratation of carbon dioxide. Accordingly, utilities of VGAM1911 include diagnosis, prevention and treatment of diseases and clinical conditions associated with CA3. The function of CA3 has been established by previous studies. Carbonic anhydrases (CAs) are a family of zinc metalloenzymes. Carbonic anhydrase III is found in high concentration in muscle. It shows relatively poor hydratase and esterase activities compared to the red cell isozymes CA I (OMIM Ref. No. 114800) and CA II (OMIM Ref. No. 259730), but is similar in subunit structure (monomer) and molecular mass (28 kD). Heath et al. (1985) explored the use of CA III in conjunction with creatine kinase detection of the carrier state for Duchenne muscular dystrophy.

Full details of the abovementioned studies are described in the following publications, the disclosure of which are hereby incorporated by reference:

Heath, R.; Carter, N. D.; Jeffery, S.; Edwards, R. J.; Watts, D. C.; Watts, R. L. : Evaluation of carrier detection of Duchenne muscular dystrophy using carbonic anhydrase III and creatine kinase. Am. J. Med. Genet. 21:291-296, 1985; and Edwards, Y. H.; Lloyd, J. C.; Parkar, M.; Povey, S.: The gene for human muscle specific carbonic anhydrase (CAIII) is assigned to chromosome 8. Ann. Hum. Genet. 50:41-47, 1986.

Further studies establishing the function and utilities of CA3 are found in John Hopkins OMIM database record ID 114750, and in sited publications numbered 3710-371 and 11874 listed in the bibliography section hereinbelow, which are also hereby incorporated by reference. Interleukin 16 (lymphocyte chemoattractant factor) (IL16, Accession NM_004513) is another VGAM1911 host target gene. IL16 BINDING SITE is HOST TARGET binding site found in the 3' untranslated region of mRNA encoded by IL16, corresponding to a HOST TARGET binding site such as BINDING SITE I, BINDING SITE II or BINDING SITE III. Table 2 illustrates the complementarity of the nucleotide sequences of IL16 BINDING SITE, designated SEQ ID:10841, to the nucleotide sequence of VGAM1911 RNA, herein designated VGAM RNA, also designated SEQ ID:4622.

Another function of VGAM1911 is therefore inhibition of Interleukin 16 (lymphocyte chemoattractant factor) (IL16, Accession NM_004513), a gene which modulates T-cell activation. Accordingly, utilities of VGAM1911 include diagnosis, prevention and treatment of diseases and clinical conditions associated with IL16. The function of IL16 and its association with various diseases and clinical conditions, has been established by previous studies, as described hereinabove with reference to VGAM819. Meningioma Expressed Antigen 5 (hyaluronidase) (MGEA5, Accession NM_012215) is another VGAM1911 host target gene. MGEA5 BINDING SITE is HOST TARGET binding site found in the 3' untranslated region of mRNA encoded by MGEA5, corresponding to a HOST TARGET binding site such as BINDING SITE I, BINDING SITE II or BINDING SITE III. Table 2 illustrates the complementarity of the nucleotide sequences of MGEA5 BINDING SITE, designated SEQ ID:14520, to the nucleotide sequence of VGAM1911 RNA, herein designated VGAM RNA, also designated SEQ ID:4622.

Another function of VGAM1911 is therefore inhibition of Meningioma Expressed Antigen 5 (hyaluronidase) (MGEA5, Accession NM_012215), a gene which has a hyaluronidase activity. Accordingly, utilities of VGAM1911 include diagnosis, prevention and treatment of diseases and clinical conditions associated with MGEA5. The function of MGEA5 and its association with various diseases and clinical conditions, has been established by previous studies, as described hereinabove with reference to VGAM801. Chemokine (C-C motif) Receptor 6 (CCR6, Accession NM_031409) is another VGAM1911 host target gene. CCR6 BINDING SITE is HOST TARGET binding site found in the 5' untranslated region of mRNA encoded by CCR6, corresponding to a HOST TARGET binding site such as BINDING SITE I, BINDING SITE II or BINDING SITE III. Table 2 illustrates the complementarity of the nucleotide sequences of CCR6 BINDING SITE, designated SEQ ID:25375, to the nucleotide sequence of VGAM1911 RNA, herein designated VGAM RNA, also designated SEQ ID:4622.

Another function of VGAM1911 is therefore inhibition of Chemokine (C-C motif) Receptor 6 (CCR6, Accession NM_031409). Accordingly, utilities of VGAM1911 include diagnosis, prevention and treatment of diseases and clinical conditions associated with CCR6. DJ167A19.1 (Accession NM_018982) is another VGAM1911 host target gene. DJ167A19.1 BINDING SITE is HOST TARGET binding site found in the 3' untranslated region of mRNA encoded by DJ167A19.1, corresponding to a HOST TARGET binding site such as BINDING SITE I, BINDING SITE II or BINDING SITE III. Table 2 illustrates the complementarity of the nucleotide sequences of DJ167A19.1 BINDING SITE, designated SEQ ID:21052, to the nucleotide sequence of VGAM1911 RNA, herein designated VGAM RNA, also designated SEQ ID:4622.

Another function of VGAM1911 is therefore inhibition of DJ167A19.1 (Accession NM_018982). Accordingly, utilities of VGAM1911 include diagnosis, prevention and treatment of diseases and clinical conditions associated with DJ167A19.1. FLJ10579 (Accession NM_018145) is another VGAM1911 host target gene. FLJ10579 BINDING SITE is HOST TARGET binding site found in the 3' untranslated region of mRNA encoded by FLJ10579, corresponding to a HOST TARGET binding site such as BINDING SITE I, BINDING SITE II or BINDING SITE III. Table 2 illustrates the complementarity of the nucleotide sequences of FLJ10579 BINDING SITE, designated SEQ ID:19946, to the nucleotide sequence of VGAM1911 RNA, herein designated VGAM RNA, also designated SEQ ID:4622.

Another function of VGAM1911 is therefore inhibition of FLJ10579 (Accession NM_018145). Accordingly, utilities of VGAM1911 include diagnosis, prevention and treatment of diseases and clinical conditions associated with FLJ10579. FLJ10829 (Accession NM_018234) is another VGAM1911 host target gene. FLJ10829 BINDING SITE is HOST TARGET binding site found in the 3' untranslated region of mRNA encoded by FLJ10829, corresponding to a HOST TARGET binding site such as BINDING SITE I, BINDING SITE II or BINDING SITE III. Table 2 illustrates the complementarity of the nucleotide sequences of FLJ10829 BINDING SITE, designated SEQ ID:20181, to the nucleotide sequence of VGAM1911 RNA, herein designated VGAM RNA, also designated SEQ ID:4622.

Another function of VGAM1911 is therefore inhibition of FLJ10829 (Accession NM_018234). Accordingly, utilities of VGAM1911 include diagnosis, prevention and treatment of diseases and clinical conditions associated with FLJ10829. FLJ23462 (Accession NM_024843) is another VGAM1911 host target gene. FLJ23462 BINDING SITE is HOST TARGET binding site found in the 3' untranslated region of mRNA encoded by FLJ23462, corresponding to a HOST TARGET binding site such as BINDING SITE I, BINDING SITE II or BINDING SITE III. Table 2 illustrates the complementarity of the nucleotide sequences of FLJ23462 BINDING SITE, designated SEQ ID:24267, to the nucleotide sequence of VGAM1911 RNA, herein designated VGAM RNA, also designated SEQ ID:4622.

Another function of VGAM1911 is therefore inhibition of FLJ23462 (Accession NM_024843). Accordingly, utilities of VGAM1911 include diagnosis, prevention and treatment of diseases and clinical conditions associated with FLJ23462. KIAA0285 (Accession NM_014807) is another VGAM1911 host target gene. KIAA0285 BINDING SITE is HOST TARGET binding site found in the 3' untranslated region of mRNA encoded by KIAA0285, corresponding to a HOST TARGET binding site such as BINDING SITE I, BINDING SITE II or BINDING SITE III. Table 2 illustrates the complementarity of the nucleotide sequences of KIAA0285 BINDING SITE, designated SEQ ID:16756, to the nucleotide sequence of VGAM1911 RNA, herein designated VGAM RNA, also designated SEQ ID:4622.

Another function of VGAM1911 is therefore inhibition of KIAA0285 (Accession NM_014807). Accordingly, utilities of VGAM1911 include diagnosis, prevention and treatment of diseases and clinical conditions associated with KIAA0285. SEC15B (Accession XM_039570) is another VGAM1911 host target gene. SEC15B BINDING SITE is HOST TARGET binding site found in the 3' untranslated region of mRNA encoded by SEC15B, corresponding to a HOST TARGET binding site such as BINDING SITE I, BINDING SITE II or BINDING SITE III. Table 2 illustrates the complementarity of the nucleotide sequences of SEC15B BINDING SITE, designated SEQ ID:33129, to the nucleotide sequence of VGAM1911 RNA, herein designated VGAM RNA, also designated SEQ ID:4622.

Another function of VGAM1911 is therefore inhibition of SEC15B (Accession XM_039570). Accordingly, utilities of VGAM1911 include diagnosis, prevention and treatment of diseases and clinical conditions associated with SEC15B. LOC197131 (Accession XM_113823) is another VGAM1911 host target gene. LOC197131 BINDING SITE is HOST TARGET binding site found in the 3' untranslated region of mRNA encoded by LOC197131, corresponding to a HOST TARGET binding site such as BINDING SITE I, BINDING SITE II or BINDING SITE III. Table 2 illustrates the complementarity of the nucleotide sequences of LOC197131 BINDING SITE, designated SEQ ID:42449, to the nucleotide sequence of VGAM1911 RNA, herein designated VGAM RNA, also designated SEQ ID:4622.

Another function of VGAM1911 is therefore inhibition of LOC197131 (Accession XM_113823). Accordingly, utilities of VGAM1911 include diagnosis, prevention and treatment of diseases and clinical conditions associated with LOC197131. FIG. 1 further provides a conceptual description of a novel bioinformatically detected viral gene of the present invention, referred to here as Viral Genomic Address Messenger 1912 (VGAM1912) viral gene, which modulates expression of respective host target genes thereof, the function and utility of which host target genes is known in the art.

VGAM1912 is a novel bioinformatically detected regulatory, non protein coding, viral micro RNA (miRNA) gene. The method by which VGAM1912 was detected is described hereinabove with reference to FIGS. 1-8.

VGAM1912 gene, herein designated VGAM GENE, is a viral gene contained in the genome of Human Parainfluenza Virus 3. VGAM1912 host target gene, herein designated VGAM HOST TARGET GENE, is a human gene contained in the human genome.

VGAM1912 gene encodes a VGAM1912 precursor RNA, herein designated VGAM PRECURSOR RNA. Similar to other miRNA genes, and unlike most ordinary genes, VGAM1912 precursor RNA does not encode a protein. A nucleotide sequence identical or highly similar to the nucleotide sequence of VGAM1912 precursor RNA is designated SEQ ID:1898, and is provided hereinbelow with reference to the sequence listing part. Nucleotide sequence SEQ ID:1898 is located at position 12367 relative to the genome of Human Parainfluenza Virus 3.

VGAM1912 precursor RNA folds onto itself, forming VGAM1912 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1912 folded precursor RNA into VGAM1912 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM1912 RNA is designated SEQ ID:4623, and is provided hereinbelow with reference to the sequence listing part.

VGAM1912 host target gene, herein designated VGAM HOST TARGET GENE, encodes a corresponding messenger RNA, VGAM1912 host target RNA, herein designated VGAM HOST TARGET RNA. VGAM1912 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1912 RNA, herein designated VGAM RNA, binds complementarily to one or more host target binding sites located in untranslated regions of VGAM1912 host target RNA, herein designated VGAM HOST TARGET RNA. This complementary binding is due to the fact that the nucleotide sequence of VGAM1912 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1912 RNA, herein designated VGAM RNA, may have a different number of host target binding sites in untranslated regions of a VGAM1912 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1912 RNA, herein designated VGAM RNA, to host target binding sites on VGAM1912 host target RNA, herein designated VGAM HOST TARGET RNA, such as BINDING SITE I, BINDING SITE II and BINDING SITE III, inhibits translation of VGAM1912 host target RNA into VGAM1912 host target protein, herein designated VGAM HOST TARGET PROTEIN. VGAM host target protein is therefore outlined by a broken line.

It is appreciated that VGAM1912 host target gene, herein designated VGAM HOST TARGET GENE, in fact represents a plurality of VGAM1912 host target genes. The mRNA of each one of this plurality of VGAM1912 host target genes comprises one or more host target binding sites, each having a nucleotide sequence which is at least partly complementary to VGAM1912 RNA, herein designated VGAM RNA, and which when bound by VGAM1912 RNA causes inhibition of translation of respective one or more VGAM1912 host target proteins.

It is further appreciated by one skilled in the art that the mode of translational inhibition illustrated by FIG. 1 with specific reference to translational inhibition exerted by VGAM1912 gene, herein designated VGAM GENE, on one or more VGAM1912 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1912 is inhibition of expression of host target genes, as part of a novel viral mechanism of attacking a host. Accordingly, utilities of VGAM1912 include diagnosis, prevention and treatment of viral infection by Human Parainfluenza Virus 3. Specific functions, and accordingly utilities, of VGAM1912 correlate with, and may be deduced from, the identity of the host target genes which VGAM1912 binds and inhibits, and the function of these host target genes, as elaborated hereinbelow.

Nucleotide sequences of the VGAM1912 precursor RNA, herein designated VGAM PRECURSOR RNA, and of the 'diced' VGAM1912 RNA, herein designated VGAM RNA, and a schematic representation of the secondary folding of VGAM1912 folded precursor RNA, herein designated VGAM FOLDED PRECURSOR RNA, of VGAM1912 are further described hereinbelow with reference to Table 1.

Nucleotide sequences of host target binding sites, such as BINDING SITE-I, BINDING SITE-II and BINDING SITE-III of FIG. 1, found on VGAM1912 host target RNA, and schematic representation of the complementarity of each of these host target binding sites to VGAM1912 RNA, herein designated VGAM RNA, are described hereinbelow with reference to Table 2.

As mentioned hereinabove with reference to FIG. 1, a function of VGAM1912 gene, herein designated VGAM is inhibition of expression of VGAM1912 target genes. It is appreciated that specific functions, and accordingly utilities, of VGAM1912 correlate with, and may be deduced from, the identity of the target genes which VGAM1912 binds and inhibits, and the function of these target genes, as elaborated hereinbelow.

Cyclin-dependent Kinase Inhibitor 1A (p21, Cip1) (CDKN1A, Accession NM_078467) is a VGAM1912 host target gene. CDKN1A BINDING SITE is HOST TARGET binding site found in the 3' untranslated region of mRNA encoded by CDKN1A, corresponding to a HOST TARGET binding site such as BINDING SITE I, BINDING SITE II or BINDING SITE III. Table 2 illustrates the complementarity of the nucleotide sequences of CDKN1A BINDING SITE, designated SEQ ID:27783, to the nucleotide sequence of VGAM1912 RNA, herein designated VGAM RNA, also designated SEQ ID:4623.

A function of VGAM1912 is therefore inhibition of Cyclin-dependent Kinase Inhibitor 1A (p21, Cip1) (CDKN1A, Accession NM_078467), a gene which inhibits cyclin-kinase activity and probably serves as the effector of p53 cell cycle control. Accordingly, utilities of VGAM1912 include diagnosis, prevention and treatment of diseases and clinical conditions associated with CDKN1A. The function of CDKN1A has been established by previous studies. The preferred name and symbol for this gene are cyclin-dependent kinase inhibitor-1A (OMIM Ref. No. CDKN1A). Also referred to as p21 and as CDKN1, this protein inhibits cyclin-kinase activity, is tightly regulated at the transcriptional level by p53, and probably serves as the effector of p53 cell cycle control. The ability of p53 (OMIM Ref. No. 191170) to activate transcription from specific sequences suggests that genes induced by p53 may mediate its biologic role as a tumor suppressor. Using a subtractive hybridization approach, El-Deiry et al. (1993) identified a gene they called WAF1 (for wildtype p53-activated fragment 1), whose induction was associated with wildtype but not mutant p53 gene expression in a human brain tumor cell line. El-Deiry et al. (1993) found that the sequence, structure, and activation by p53 was conserved in rodents. Introduction of WAF1 cDNA suppressed the growth of human brain, lung, and colon tumor cells in culture. Using a yeast enhancer trap, they identified a p53-binding site 2.4 kb upstream of WAF1 coding sequences. The WAF1 promoter, including this p53-binding site, conferred p53-dependent inducibility upon a heterologous reporter gene. After acceptance of their paper for publication, El-Deiry et al. (1993) learned that Harper et al. (1993) had identified a gene, called CIP1, whose product binds to cyclin complexes and inhibits the function of cyclin-dependent kinases. They found that the sequence of CIP1, described by Harper et al. (1993) in the same issue of Cell, was identical to that of WAF1. The results provided a dramatic example of the interplay between tumor suppressor genes and the cell cycle.

Full details of the abovementioned studies are described in the following publications, the disclosure of which are hereby incorporated by reference:

El-Deiry, W. S.; Tokino, T.; Velculescu, V. E.; Levy, D. B.; Parsons, R.; Trent, J. M.; Lin, D.; Mercer, E.; Kinzler, K. W.; Vogelstein, B.: WAF1, a potential mediator of p53 tumor suppression. Cell 75:817-825, 1993; and Harper, J. W.; Adami, G. R.; Wei, N.; Keyomarsi, K.; Elledge, S. J.: The p21 Cdk-interacting protein Cip1 is a potent inhibitor of G1 cyclin-dependent kinases. Cell 75:805-816, 1993.

Further studies establishing the function and utilities of CDKN1A are found in John Hopkins OMIM database record ID 116899, and in sited publications numbered 4130, 9827-4132, 4342, 10700-4134, 7124-4136, 2969, 1276 and 3140 listed in the bibliography section hereinbelow, which are also hereby incorporated by reference. Chromosome Condensation 1-like (CHC1L, Accession NM_001268) is another VGAM1912 host target gene. CHC1L BINDING SITE is HOST TARGET binding site found in the 3' untranslated region of mRNA encoded by CHC1L, corresponding to a HOST TARGET binding site such as BINDING SITE I, BINDING SITE II or BINDING SITE III. Table 2 illustrates the complementarity of the nucleotide sequences of CHC1L BINDING SITE, designated SEQ ID:6930, to the nucleotide sequence of VGAM1912 RNA, herein designated VGAM RNA, also designated SEQ ID:4623.

Another function of VGAM1912 is therefore inhibition of Chromosome Condensation 1-like (CHC1L, Accession NM_001268). Accordingly, utilities of VGAM1912 include diagnosis, prevention and treatment of diseases and clinical conditions associated with CHC1L. EGF-containing Fibulin-like Extracellular Matrix Protein 1 (EFEMP1, Accession NM_004105) is another VGAM1912 host target gene. EFEMP1 BINDING SITE1 and EFEMP1 BINDING SITE2 are HOST TARGET binding sites found in untranslated regions of mRNA encoded by EFEMP1, corresponding to HOST TARGET binding sites such as BINDING SITE I, BINDING SITE II or BINDING SITE III. Table 2 illustrates the complementarity of the nucleotide sequences of EFEMP1 BINDING SITE1 and EFEMP1 BINDING SITE2, designated SEQ ID:10318 and SEQ ID:20838 respectively, to the nucleotide sequence of VGAM1912 RNA, herein designated VGAM RNA, also designated SEQ ID:4623.

Another function of VGAM1912 is therefore inhibition of EGF-containing Fibulin-like Extracellular Matrix Protein 1 (EFEMP1, Accession NM_004105). Accordingly, utilities of VGAM1912 include diagnosis, prevention and treatment of diseases and clinical conditions associated with EFEMP1. Potassium Voltage-gated Channel, Shaker-related Subfamily, Beta Member 1 (KCNAB1, Accession XM_027634) is another VGAM1912 host target gene. KCNAB1 BINDING SITE is HOST TARGET binding site found in the 3' untranslated region of mRNA encoded by KCNAB1, corresponding to a HOST TARGET binding site such as BINDING SITE I, BINDING SITE II or BINDING SITE III. Table 2 illustrates the complementarity of the nucleotide sequences of KCNAB1 BINDING SITE, designated SEQ ID:30548, to the nucleotide sequence of VGAM1912 RNA, herein designated VGAM RNA, also designated SEQ ID:4623.

Another function of VGAM1912 is therefore inhibition of Potassium Voltage-gated Channel, Shaker-related Subfamily, Beta Member 1 (KCNAB1, Accession XM_027634), a gene which is the regulatory beta subunit for a shaker-related voltage-gated potassium channel. Accordingly, utilities of VGAM1912 include diagnosis, prevention and treatment of diseases and clinical conditions associated with KCNAB1. The function of KCNAB1 and its association with various diseases and clinical conditions, has been established by previous studies, as described hereinabove with reference to VGAM727. RecQ Protein-like 5 (RECQL5, Accession NM_004259) is another VGAM1912 host target gene. RECQL5 BINDING SITE is HOST TARGET binding site found in the 3' untranslated region of mRNA encoded by RECQL5, corresponding to a HOST TARGET binding site such as BINDING SITE I, BINDING SITE II or BINDING SITE III. Table 2 illustrates the complementarity of the nucleotide sequences of RECQL5 BINDING SITE, designated SEQ ID:10450, to the nucleotide sequence of VGAM1912 RNA, herein designated VGAM RNA, also designated SEQ ID:4623.

Another function of VGAM1912 is therefore inhibition of RecQ Protein-like 5 (RECQL5, Accession NM_004259). Accordingly, utilities of VGAM1912 include diagnosis, prevention and treatment of diseases and clinical conditions associated with RECQL5. Solute Carrier Family 4, Sodium Bicarbonate Transporter-like, Member 10 (SLC4A10, Accession NM_022058) is another VGAM1912 host target gene. SLC4A10 BINDING SITE is HOST TARGET binding site found in the 3' untranslated region of mRNA encoded by SLC4A10, corresponding to a HOST TARGET binding site such as BINDING SITE I, BINDING SITE II or BINDING SITE III. Table 2 illustrates the complementarity of the nucleotide sequences of SLC4A10 BINDING SITE, designated SEQ ID:22595, to the nucleotide sequence of VGAM1912 RNA, herein designated VGAM RNA, also designated SEQ ID:4623.

Another function of VGAM1912 is therefore inhibition of Solute Carrier Family 4, Sodium Bicarbonate Transporter-like, Member 10 (SLC4A10, Accession NM_022058). Accordingly, utilities of VGAM1912 include diagnosis, prevention and treatment of diseases and clinical conditions associated with SLC4A10. Vasoactive Intestinal Peptide Receptor 1 (VIPR1, Accession NM_004624) is another VGAM1912 host target gene. VIPR1 BINDING SITE is HOST TARGET binding site found in the 3' untranslated region of mRNA encoded by VIPR1, corresponding to a HOST TARGET binding site such as BINDING SITE I, BINDING SITE II or BINDING SITE III. Table 2 illustrates the complementarity of the nucleotide sequences of VIPR1 BINDING SITE, designated SEQ ID:10993, to the nucleotide sequence of VGAM1912 RNA, herein designated VGAM RNA, also designated SEQ ID:4623.

Another function of VGAM1912 is therefore inhibition of Vasoactive Intestinal Peptide Receptor 1 (VIPR1, Accession NM_004624), a gene which binds vip and is mediated by g proteins which activate adenylyl cyclase. Accordingly, utilities of VGAM1912 include diagnosis, prevention and treatment of diseases and clinical conditions associated with VIPR1. The function of VIPR1 and its association with various diseases and clinical conditions, has been established by previous studies, as described hereinabove with reference to VGAM548. Chromosome 6 Open Reading Frame 37 (C6orf37, Accession XM_041375) is another VGAM1912 host target gene. C6orf37 BINDING SITE is HOST TARGET binding site found in the 3' untranslated region of mRNA encoded by C6orf37, corresponding to a HOST TARGET binding site such as BINDING SITE I, BINDING SITE II or BINDING SITE III. Table 2 illustrates the complementarity of the nucleotide sequences of C6orf37 BINDING SITE, designated SEQ ID:33515, to the nucleotide sequence of VGAM1912 RNA, herein designated VGAM RNA, also designated SEQ ID:4623.

Another function of VGAM1912 is therefore inhibition of Chromosome 6 Open Reading Frame 37 (C6orf37, Accession XM_041375). Accordingly, utilities of VGAM1912 include diagnosis, prevention and treatment of diseases and clinical conditions associated with C6orf37. Coenzyme Q7 Homolog, Ubiquinone (yeast) (COQ7, Accession NM_016138) is another VGAM1912 host target gene. COQ7 BINDING SITE is HOST TARGET binding site found in the 3' untranslated region of mRNA encoded by COQ7, corresponding to a HOST TARGET binding site such as BINDING SITE I, BINDING SITE II or BINDING SITE III. Table 2 illustrates the complementarity of the nucleotide sequences of COQ7 BINDING SITE, designated SEQ ID:18224, to the nucleotide sequence of VGAM1912 RNA, herein designated VGAM RNA, also designated SEQ ID:4623.

Another function of VGAM1912 is therefore inhibition of Coenzyme Q7 Homolog, Ubiquinone (yeast) (COQ7, Accession NM_016138). Accordingly, utilities of VGAM1912 include diagnosis, prevention and treatment of diseases and clinical conditions associated with COQ7. DKFZP434B172 (Accession XM_046264) is another VGAM1912 host target gene. DKFZP434B172 BINDING SITE is HOST TARGET binding site found in the 3' untranslated region of mRNA encoded by DKFZP434B172, corresponding to a HOST TARGET binding site such as BINDING SITE I, BINDING SITE II or BINDING SITE III. Table 2 illustrates the complementarity of the nucleotide sequences of DKFZP434B172 BINDING SITE, designated SEQ ID:34703, to the nucleotide sequence of VGAM1912 RNA, herein designated VGAM RNA, also designated SEQ ID:4623.

Another function of VGAM1912 is therefore inhibition of DKFZP434B172 (Accession XM_046264). Accordingly, utilities of VGAM1912 include diagnosis, prevention and treatment of diseases and clinical conditions associated with DKFZP434B172. DKFZP564D0462 (Accession XM_047080) is another VGAM1912 host target gene. DKFZP564D0462 BINDING SITE is HOST TARGET binding site found in the 3' untranslated region of mRNA encoded by DKFZP564D0462, corresponding to a HOST TARGET binding site such as BINDING SITE I, BINDING SITE II or BINDING SITE III. Table 2 illustrates the complementarity of the nucleotide sequences of DKFZP564D0462 BINDING SITE, designated SEQ ID:34898, to the nucleotide sequence of VGAM1912 RNA, herein designated VGAM RNA, also designated SEQ ID:4623.

Another function of VGAM1912 is therefore inhibition of DKFZP564D0462 (Accession XM_047080). Accordingly, utilities of VGAM1912 include diagnosis, prevention and treatment of diseases and clinical conditions associated with DKFZP564D0462. FLJ12707 (Accession NM_022067) is another VGAM1912 host target gene. FLJ12707 BINDING SITE is HOST TARGET binding site found in the 5' untranslated region of mRNA encoded by FLJ12707, corresponding to a HOST TARGET binding site such as BINDING SITE I, BINDING SITE II or BINDING SITE III. Table 2 illustrates the complementarity of the nucleotide sequences of FLJ12707 BINDING SITE, designated SEQ ID:22610, to the nucleotide sequence of VGAM1912 RNA, herein designated VGAM RNA, also designated SEQ ID:4623.

Another function of VGAM1912 is therefore inhibition of FLJ12707 (Accession NM_022067). Accordingly, utilities of VGAM1912 include diagnosis, prevention and treatment of diseases and clinical conditions associated with FLJ12707. FLJ20081 (Accession NM_017658) is another VGAM1912 host target gene. FLJ20081 BINDING SITE is HOST TARGET binding site found in the 3' untranslated region of mRNA encoded by FLJ20081, corresponding to a HOST TARGET binding site such as BINDING SITE I, BINDING SITE II or BINDING SITE III. Table 2 illustrates the complementarity of the nucleotide sequences of FLJ20081 BINDING SITE, designated SEQ ID:19181, to the nucleotide sequence of VGAM1912 RNA, herein designated VGAM RNA, also designated SEQ ID:4623.

Another function of VGAM1912 is therefore inhibition of FLJ20081 (Accession NM_017658). Accordingly, utilities of VGAM1912 include diagnosis, prevention and treatment of diseases and clinical conditions associated with FLJ20081. FLJ23499 (Accession NM_022761) is another VGAM1912 host target gene. FLJ23499 BINDING SITE is HOST TARGET binding site found in the 3' untranslated region of mRNA encoded by FLJ23499, corresponding to a HOST TARGET binding site such as BINDING SITE I, BINDING SITE II or BINDING SITE III. Table 2 illustrates the complementarity of the nucleotide sequences of FLJ23499 BINDING SITE, designated SEQ ID:23006, to the nucleotide sequence of VGAM1912 RNA, herein designated VGAM RNA, also designated SEQ ID:4623.

Another function of VGAM1912 is therefore inhibition of FLJ23499 (Accession NM_022761). Accordingly, utilities of VGAM1912 include diagnosis, prevention and treatment of diseases and clinical conditions associated with FLJ23499. KIAA0759 (Accession XM_041090) is another VGAM1912 host target gene. KIAA0759 BINDING SITE is HOST TARGET binding site found in the 3' untranslated region of mRNA encoded by KIAA0759, corresponding to a HOST TARGET binding site such as BINDING SITE I, BINDING SITE II or BINDING SITE III. Table 2 illustrates the complementarity of the nucleotide sequences of KIAA0759 BINDING SITE, designated SEQ ID:33442, to the nucleotide sequence of VGAM1912 RNA, herein designated VGAM RNA, also designated SEQ ID:4623.

Another function of VGAM1912 is therefore inhibition of KIAA0759 (Accession XM_041090). Accordingly, utilities of VGAM1912 include diagnosis, prevention and treatment of diseases and clinical conditions associated with KIAA0759. KIAA1908 (Accession XM_055834) is another VGAM1912 host target gene. KIAA1908 BINDING SITE is HOST TARGET binding site found in the 3' untranslated region of mRNA encoded by KIAA1908, corresponding to a HOST TARGET binding site such as BINDING SITE I, BINDING SITE II or BINDING SITE III. Table 2 illustrates the complementarity of the nucleotide sequences of KIAA1908 BINDING SITE, designated SEQ ID:36337, to the nucleotide sequence of VGAM1912 RNA, herein designated VGAM RNA, also designated SEQ ID:4623.

Another function of VGAM1912 is therefore inhibition of KIAA1908 (Accession XM_055834). Accordingly, utilities of VGAM1912 include diagnosis, prevention and treatment of diseases and clinical conditions associated with KIAA1908. Mitogen-activated Protein Kinase Kinase Kinase 2 (MAP3K2, Accession NM_006609) is another VGAM1912 host target gene. MAP3K2 BINDING SITE is HOST TARGET binding site found in the 3' untranslated region of mRNA encoded by MAP3K2, corresponding to a HOST TARGET binding site such as BINDING SITE I, BINDING SITE II or BINDING SITE III. Table 2 illustrates the complementarity of the nucleotide sequences of MAP3K2 BINDING SITE, designated SEQ ID:13385, to the nucleotide sequence of VGAM1912 RNA, herein designated VGAM RNA, also designated SEQ ID:4623.

Another function of VGAM1912 is therefore inhibition of Mitogen-activated Protein Kinase Kinase Kinase 2 (MAP3K2, Accession NM_006609). Accordingly, utilities of VGAM1912 include diagnosis, prevention and treatment of diseases and clinical conditions associated with MAP3K2. PP1665 (Accession NM_030792) is another VGAM1912 host target gene. PP1665 BINDING SITE is HOST TARGET binding site found in the 5' untranslated region of mRNA encoded by PP1665, corresponding to a HOST TARGET binding site such as BINDING SITE I, BINDING SITE II or BINDING SITE III. Table 2 illustrates the complementarity of the nucleotide sequences of PP1665 BINDING SITE, designated SEQ ID:25094, to the nucleotide sequence of VGAM1912 RNA, herein designated VGAM RNA, also designated SEQ ID:4623.

Another function of VGAM1912 is therefore inhibition of PP1665 (Accession NM_030792). Accordingly, utilities of VGAM1912 include diagnosis, prevention and treatment of diseases and clinical conditions associated with PP1665. PRO1728 (Accession NM_018505) is another VGAM1912 host target gene. PRO1728 BINDING SITE is HOST TARGET binding site found in the 3' untranslated region of mRNA encoded by PRO1728, corresponding to a HOST TARGET binding site such as BINDING SITE I, BINDING SITE II or BINDING SITE III. Table 2 illustrates the complementarity of the nucleotide sequences of PRO1728 BINDING SITE, designated SEQ ID:20571, to the nucleotide sequence of VGAM1912 RNA, herein designated VGAM RNA, also designated SEQ ID:4623.

Another function of VGAM1912 is therefore inhibition of PRO1728 (Accession NM_018505). Accordingly, utilities of VGAM1912 include diagnosis, prevention and treatment of diseases and clinical conditions associated with PRO1728. LOC134266 (Accession XM_059701) is another VGAM1912 host target gene. LOC134266 BINDING SITE is HOST TARGET binding site found in the 3' untranslated region of mRNA encoded by LOC134266, corresponding to a HOST TARGET binding site such as BINDING SITE I, BINDING SITE II or BINDING SITE III. Table 2 illustrates the complementarity of the nucleotide sequences of LOC134266 BINDING SITE, designated SEQ ID:37073, to the nucleotide sequence of VGAM1912 RNA, herein designated VGAM RNA, also designated SEQ ID:4623.

Another function of VGAM1912 is therefore inhibition of LOC134266 (Accession XM_059701). Accordingly, utilities of VGAM1912 include diagnosis, prevention and treatment of diseases and clinical conditions associated with LOC134266. LOC158314 (Accession XM_098920) is another VGAM1912 host target gene. LOC158314 BINDING SITE is HOST TARGET binding site found in the 3' untranslated region of mRNA encoded by LOC158314, corresponding to a HOST TARGET binding site such as BINDING SITE I, BINDING SITE II or BINDING SITE III. Table 2 illustrates the complementarity of the nucleotide sequences of LOC158314 BINDING SITE, designated SEQ ID:41955, to the nucleotide sequence of VGAM1912 RNA, herein designated VGAM RNA, also designated SEQ ID:4623.

Another function of VGAM1912 is therefore inhibition of LOC158314 (Accession XM_098920). Accordingly, utilities of VGAM1912 include diagnosis, prevention and treatment of diseases and clinical conditions associated with LOC158314. LOC90643 (Accession XM_033145) is another VGAM1912 host target gene. LOC90643 BINDING SITE is HOST TARGET binding site found in the 3' untranslated region of mRNA encoded by LOC90643, corresponding to a HOST TARGET binding site such as BINDING SITE I, BINDING SITE II or BINDING SITE III. Table 2 illustrates the complementarity of the nucleotide sequences of LOC90643 BINDING SITE, designated SEQ ID:31856, to the nucleotide sequence of VGAM1912 RNA, herein designated VGAM RNA, also designated SEQ ID:4623.

Another function of VGAM1912 is therefore inhibition of LOC90643 (Accession XM_033145). Accordingly, utilities of VGAM1912 include diagnosis, prevention and treatment of diseases and clinical conditions associated with LOC90643. FIG. 1 further provides a conceptual description of a novel bioinformatically detected viral gene of the present invention, referred to here as Viral Genomic Address Messenger 1913 (VGAM1913) viral gene, which modulates expression of respective host target genes thereof, the function and utility of which host target genes is known in the art.

VGAM1913 is a novel bioinformatically detected regulatory, non protein coding, viral micro RNA (miRNA) gene. The method by which VGAM1913 was detected is described hereinabove with reference to FIGS. 1-8.

VGAM1913 gene, herein designated VGAM GENE, is a viral gene contained in the genome of Human Parainfluenza Virus 3. VGAM1913 host target gene, herein designated VGAM HOST TARGET GENE, is a human gene contained in the human genome.

VGAM1913 gene encodes a VGAM1913 precursor RNA, herein designated VGAM PRECURSOR RNA. Similar to other miRNA genes, and unlike most ordinary genes, VGAM1913 precursor RNA does not encode a protein. A nucleotide sequence identical or highly similar to the nucleotide sequence of VGAM1913 precursor RNA is designated SEQ ID:1899, and is provided hereinbelow with reference to the sequence listing part. Nucleotide sequence SEQ ID:1899 is located at position 8166 relative to the genome of Human Parainfluenza Virus 3.

VGAM1913 precursor RNA folds onto itself, forming VGAM1913 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1913 folded precursor RNA into VGAM1913 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM1913 RNA is designated SEQ ID:4624, and is provided hereinbelow with reference to the sequence listing part.

VGAM1913 host target gene, herein designated VGAM HOST TARGET GENE, encodes a corresponding messenger RNA, VGAM1913 host target RNA, herein designated VGAM HOST TARGET RNA. VGAM1913 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1913 RNA, herein designated VGAM RNA, binds complementarily to one or more host target binding sites located in untranslated regions of VGAM1913 host target RNA, herein designated VGAM HOST TARGET RNA. This complementary binding is due to the fact that the nucleotide sequence of VGAM1913 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1913 RNA, herein designated VGAM RNA, may have a different number of host target binding sites in untranslated regions of a VGAM1913 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1913 RNA, herein designated VGAM RNA, to host target binding sites on VGAM1913 host target RNA, herein designated VGAM HOST TARGET RNA, such as BINDING SITE I, BINDING SITE II and BINDING SITE III, inhibits translation of VGAM1913 host target RNA into VGAM1913 host target protein, herein designated VGAM HOST TARGET PROTEIN. VGAM host target protein is therefore outlined by a broken line.

It is appreciated that VGAM1913 host target gene, herein designated VGAM HOST TARGET GENE, in fact represents a plurality of VGAM1913 host target genes. The mRNA of each one of this plurality of VGAM1913 host target genes comprises one or more host target binding sites, each having a nucleotide sequence which is at least partly complementary to VGAM1913 RNA, herein designated VGAM RNA, and which when bound by VGAM1913 RNA causes inhibition of translation of respective one or more VGAM1913 host target proteins.

It is further appreciated by one skilled in the art that the mode of translational inhibition illustrated by FIG. 1 with specific reference to translational inhibition exerted by VGAM1913 gene, herein designated VGAM GENE, on one or more VGAM1913 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1913 is inhibition of expression of host target genes, as part of a novel viral mechanism of attacking a host. Accordingly, utilities of VGAM1913 include diagnosis, prevention and treatment of viral infection by Human Parainfluenza Virus 3. Specific functions, and accordingly utilities, of VGAM1913 correlate with, and may be deduced from, the identity of the host target genes which VGAM1913 binds and inhibits, and the function of these host target genes, as elaborated hereinbelow.

Nucleotide sequences of the VGAM1913 precursor RNA, herein designated VGAM PRECURSOR RNA, and of the 'diced' VGAM1913 RNA, herein designated VGAM RNA, and a schematic representation of the secondary folding of VGAM1913 folded precursor RNA, herein designated VGAM FOLDED PRECURSOR RNA, of VGAM1913 are further described hereinbelow with reference to Table 1.

Nucleotide sequences of host target binding sites, such as BINDING SITE-I, BINDING SITE-II and BINDING SITE-III of FIG. 1, found on VGAM1913 host target RNA, and schematic representation of the complementarity of each of these host target binding sites to VGAM1913 RNA, herein designated VGAM RNA, are described hereinbelow with reference to Table 2.

As mentioned hereinabove with reference to FIG. 1, a function of VGAM1913 gene, herein designated VGAM is inhibition of expression of VGAM1913 target genes. It is appreciated that specific functions, and accordingly utilities, of VGAM1913 correlate with, and may be deduced from, the identity of the target genes which VGAM1913 binds and inhibits, and the function of these target genes, as elaborated hereinbelow.

Mesenchyme Homeo Box 2 (growth arrest-specific homeo box) (MEOX2, Accession NM_005924) is a VGAM1913 host target gene. MEOX2 BINDING SITE1 and MEOX2 BINDING SITE2 are HOST TARGET binding sites found in untranslated regions of mRNA encoded by MEOX2, corresponding to HOST TARGET binding sites such as BINDING SITE I, BINDING SITE II or BINDING SITE III. Table 2 illustrates the complementarity of the nucleotide sequences of MEOX2 BINDING SITE1 and MEOX2 BINDING SITE2, designated SEQ ID:12549 and SEQ ID:12550 respectively, to the nucleotide sequence of VGAM1913 RNA, herein designated VGAM RNA, also designated SEQ ID:4624.

A function of VGAM1913 is therefore inhibition of Mesenchyme Homeo Box 2 (growth arrest-specific homeo box) (MEOX2, Accession NM_005924), a gene which roles in mesoderm induction and, somitogenesis, and myogenic and sclerotomal differentiation. Accordingly, utilities of VGAM1913 include diagnosis, prevention and treatment of diseases and clinical conditions associated with MEOX2. The function of MEOX2 and its association with various diseases and clinical conditions, has been established by previous studies, as described hereinabove with reference to VGAM827. KIAA0971 (Accession NM_014929) is another VGAM1913 host target gene. KIAA0971 BINDING SITE is HOST TARGET binding site found in the 3' untranslated region of mRNA encoded by KIAA0971, corresponding to a HOST TARGET binding site such as BINDING SITE I, BINDING SITE II or BINDING SITE III. Table 2 illustrates the complementarity of the nucleotide sequences of KIAA0971 BINDING SITE, designated SEQ ID:17224, to the nucleotide sequence of VGAM1913 RNA, herein designated VGAM RNA, also designated SEQ ID:4624.

Another function of VGAM1913 is therefore inhibition of KIAA0971 (Accession NM_014929). Accordingly, utilities of VGAM1913 include diagnosis, prevention and treatment of diseases and clinical conditions associated with KIAA0971. LOC158435 (Accession NM_138497) is another VGAM1913 host target gene. LOC158435 BINDING SITE is HOST TARGET binding site found in the 3' untranslated region of mRNA encoded by LOC158435, corresponding to a HOST TARGET binding site such as BINDING SITE I, BINDING SITE II or BINDING SITE III. Table 2 illustrates the complementarity of the nucleotide sequences of LOC158435 BINDING SITE, designated SEQ ID:28845, to the nucleotide sequence of VGAM1913 RNA, herein designated VGAM RNA, also designated SEQ ID:4624.

Another function of VGAM1913 is therefore inhibition of LOC158435 (Accession NM_138497). Accordingly, utilities of VGAM1913 include diagnosis, prevention and treatment of diseases and clinical conditions associated with LOC158435. LOC220827 (Accession XM_166052) is another VGAM1913 host target gene. LOC220827 BINDING SITE is HOST TARGET binding site found in the 3' untranslated region of mRNA encoded by LOC220827, corresponding to a HOST TARGET binding site such as BINDING SITE I, BINDING SITE II or BINDING SITE III. Table 2 illustrates the complementarity of the nucleotide sequences of LOC220827 BINDING SITE, designated SEQ ID:43843, to the nucleotide sequence of VGAM1913 RNA, herein designated VGAM RNA, also designated SEQ ID:4624.

Another function of VGAM1913 is therefore inhibition of LOC220827 (Accession XM_166052). Accordingly, utilities of VGAM1913 include diagnosis, prevention and treatment of diseases and clinical conditions associated with LOC220827. FIG. 1 further provides a conceptual description of a novel bioinformatically detected viral gene of the present invention, referred to here as Viral Genomic Address Messenger 1914 (VGAM1914) viral gene, which modulates expression of respective host target genes thereof, the function and utility of which host target genes is known in the art.

VGAM1914 is a novel bioinformatically detected regulatory, non protein coding, viral micro RNA (miRNA) gene. The method by which VGAM1914 was detected is described hereinabove with reference to FIGS. 1-8.

VGAM1914 gene, herein designated VGAM GENE, is a viral gene contained in the genome of Human Parainfluenza Virus 3. VGAM1914 host target gene, herein designated VGAM HOST TARGET GENE, is a human gene contained in the human genome.

VGAM1914 gene encodes a VGAM1914 precursor RNA, herein designated VGAM PRECURSOR RNA. Similar to other miRNA genes, and unlike most ordinary genes, VGAM1914 precursor RNA does not encode a protein. A nucleotide sequence identical or highly similar to the nucleotide sequence of VGAM1914 precursor RNA is designated SEQ ID:1900, and is provided hereinbelow with reference to the sequence listing part. Nucleotide sequence SEQ ID:1900 is located at position 14210 relative to the genome of Human Parainfluenza Virus 3.

VGAM1914 precursor RNA folds onto itself, forming VGAM1914 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1914 folded precursor RNA into VGAM1914 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1914 RNA is designated SEQ ID:4625, and is provided hereinbelow with reference to the sequence listing part.

VGAM1914 host target gene, herein designated VGAM HOST TARGET GENE, encodes a corresponding messenger RNA, VGAM1914 host target RNA, herein designated VGAM HOST TARGET RNA. VGAM1914 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1914 RNA, herein designated VGAM RNA, binds complementarily to one or more host target binding sites located in untranslated regions of VGAM1914 host target RNA, herein designated VGAM HOST TARGET RNA. This complementary binding is due to the fact that the nucleotide sequence of VGAM1914 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1914 RNA, herein designated VGAM RNA, may have a different number of host target binding sites in untranslated regions of a VGAM1914 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1914 RNA, herein designated VGAM RNA, to host target binding sites on VGAM1914 host target RNA, herein designated VGAM HOST TARGET RNA, such as BINDING SITE I, BINDING SITE II and BINDING SITE III, inhibits translation of VGAM1914 host target RNA into VGAM1914 host target protein, herein designated VGAM HOST TARGET PROTEIN. VGAM host target protein is therefore outlined by a broken line.

It is appreciated that VGAM1914 host target gene, herein designated VGAM HOST TARGET GENE, in fact represents a plurality of VGAM1914 host target genes. The mRNA of each one of this plurality of VGAM1914 host target genes comprises one or more host target binding sites, each having a nucleotide sequence which is at least partly complementary to VGAM1914 RNA, herein designated VGAM RNA, and which when bound by VGAM1914 RNA causes inhibition of translation of respective one or more VGAM1914 host target proteins.

It is further appreciated by one skilled in the art that the mode of translational inhibition illustrated by FIG. 1 with specific reference to translational inhibition exerted by VGAM1914 gene, herein designated VGAM GENE, on one or more VGAM1914 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1914 is inhibition of expression of host target genes, as part of a novel viral mechanism of attacking a host. Accordingly, utilities of VGAM1914 include diagnosis, prevention and treatment of viral infection by Human Parainfluenza Virus 3. Specific functions, and accordingly utilities, of VGAM1914 correlate with, and may be deduced from, the identity of the host target genes which VGAM1914 binds and inhibits, and the function of these host target genes, as elaborated hereinbelow.

Nucleotide sequences of the VGAM1914 precursor RNA, herein designated VGAM PRECURSOR RNA, and of the 'diced' VGAM1914 RNA, herein designated VGAM RNA, and a schematic representation of the secondary folding of VGAM1914 folded precursor RNA, herein designated VGAM FOLDED PRECURSOR RNA, of VGAM1914 are further described hereinbelow with reference to Table 1.

Nucleotide sequences of host target binding sites, such as BINDING SITE-I, BINDING SITE-II and BINDING SITE-III of FIG. 1, found on VGAM1914 host target RNA, and schematic representation of the complementarity of each of these host target binding sites to VGAM1914 RNA, herein designated VGAM RNA, are described hereinbelow with reference to Table 2.

As mentioned hereinabove with reference to FIG. 1, a function of VGAM1914 gene, herein designated VGAM is inhibition of expression of VGAM1914 target genes. It is appreciated that specific functions, and accordingly utilities, of VGAM1914 correlate with, and may be deduced from, the identity of the target genes which VGAM1914 binds and inhibits, and the function of these target genes, as elaborated hereinbelow.

Cartilage Associated Protein (CRTAP, Accession NM_006371) is a VGAM1914 host target gene. CRTAP BINDING SITE is HOST TARGET binding site found in the 3' untranslated region of mRNA encoded by CRTAP, corresponding to a HOST TARGET binding site such as BINDING SITE I, BINDING SITE II or BINDING SITE III. Table 2 illustrates the complementarity of the nucleotide sequences of CRTAP BINDING SITE, designated SEQ ID:13060, to the nucleotide sequence of VGAM1914 RNA, herein designated VGAM RNA, also designated SEQ ID:4625.

A function of VGAM1914 is therefore inhibition of Cartilage Associated Protein (CRTAP, Accession NM_006371), a gene which is a novel developmentally regulated chick embryo protein. Accordingly, utilities of VGAM1914 include diagnosis, prevention and treatment of diseases and clinical conditions associated with CRTAP. The function of CRTAP and its association with various diseases and clinical conditions, has been established by previous studies, as described hereinabove with reference to VGAM152. Integrin, Alpha 5 (fibronectin receptor, alpha polypeptide) (ITGA5, Accession XM_028642) is another VGAM1914 host target gene. ITGA5 BINDING SITE is HOST TARGET binding site found in the 3' untranslated region of mRNA encoded by ITGA5, corresponding to a HOST TARGET binding site such as BINDING SITE I, BINDING SITE II or BINDING SITE III. Table 2 illustrates the complementarity of the nucleotide sequences of ITGA5 BINDING SITE, designated SEQ ID:30724, to the nucleotide sequence of VGAM1914 RNA, herein designated VGAM RNA, also designated SEQ ID:4625.

Another function of VGAM1914 is therefore inhibition of Integrin, Alpha 5 (fibronectin receptor, alpha polypeptide) (ITGA5, Accession XM_028642), a gene which is receptor for fibronectin and fibrinogen and recognizes the sequence r-g-d in its ligands. Accordingly, utilities of VGAM1914 include diagnosis, prevention and treatment of diseases and clinical conditions associated with ITGA5. The function of ITGA5 and its association with various diseases and clinical conditions, has been established by previous studies, as described hereinabove with reference to VGAM1220. Leptin (obesity homolog, mouse) (LEP, Accession NM_000230) is another VGAM1914 host target gene. LEP BINDING SITE is HOST TARGET binding site found in the 3' untranslated region of mRNA encoded by LEP, corresponding to a HOST TARGET binding site such as BINDING SITE I, BINDING SITE II or BINDING SITE III. Table 2 illustrates the complementarity of the nucleotide sequences of LEP BINDING SITE, designated SEQ ID:5739, to the nucleotide sequence of VGAM1914 RNA, herein designated VGAM RNA, also designated SEQ ID:4625.

Another function of VGAM1914 is therefore inhibition of Leptin (obesity homolog, mouse) (LEP, Accession NM_000230). Accordingly, utilities of VGAM1914 include diagnosis, prevention and treatment of diseases and clinical conditions associated with LEP. SRY (sex determining region Y)-box 4 (SOX4, Accession NM_003107) is another VGAM1914 host target gene. SOX4 BINDING SITE is HOST TARGET binding site found in the 3' untranslated region of mRNA encoded by SOX4, corresponding to a HOST TARGET binding site such as BINDING SITE I, BINDING SITE II or BINDING SITE III. Table 2 illustrates the complementarity of the nucleotide sequences of SOX4 BINDING SITE, designated SEQ ID:9076, to the nucleotide sequence of VGAM1914 RNA, herein designated VGAM RNA, also designated SEQ ID:4625.

Another function of VGAM1914 is therefore inhibition of SRY (sex determining region Y)-box 4 (SOX4, Accession NM_003107), a gene which binds with high affinity to the t-cell enhancer motif 5'-aacaaag-3' motif. Accordingly, utilities of VGAM1914 include diagnosis, prevention and treatment of diseases and clinical conditions associated with SOX4. The function of SOX4 and its association with various diseases and clinical conditions, has been established by previous studies, as described hereinabove with reference to VGAM409. T-cell Leukemia, Homeobox 1 (TLX1, Accession NM_005521) is another VGAM1914 host target gene. TLX1 BINDING SITE is HOST TARGET binding site found in the 3' untranslated region of mRNA encoded by TLX1, corresponding to a HOST TARGET binding site such as BINDING SITE I, BINDING SITE II or BINDING SITE III. Table 2 illustrates the complementarity of the nucleotide sequences of TLX1 BINDING SITE, designated SEQ ID:12043, to the nucleotide sequence of VGAM1914 RNA, herein designated VGAM RNA, also designated SEQ ID:4625.

Another function of VGAM1914 is therefore inhibition of T-cell Leukemia, Homeobox 1 (TLX1, Accession NM_005521), a gene which controls the spleen development. Accordingly, utilities of VGAM1914 include diagnosis, prevention and treatment of diseases and clinical conditions associated with TLX1. The function of TLX1 and its association with various diseases and clinical conditions, has been established by previous studies, as described hereinabove with reference to VGAM1505. TRHDE (Accession NM_013381) is another VGAM1914 host target gene. TRHDE BINDING SITE is HOST TARGET binding site found in the 3' untranslated region of mRNA encoded by TRHDE, corresponding to a HOST TARGET binding site such as BINDING SITE I, BINDING SITE II or BINDING SITE III. Table 2 illustrates the complementarity of the nucleotide sequences of TRHDE BINDING SITE, designated SEQ ID:15033, to the nucleotide sequence of VGAM1914 RNA, herein designated VGAM RNA, also designated SEQ ID:4625.

Another function of VGAM1914 is therefore inhibition of TRHDE (Accession NM_013381). Accordingly, utilities of VGAM1914 include diagnosis, prevention and treatment of diseases and clinical conditions associated with TRHDE. ATPase, Class II, Type 9A (ATP9A, Accession XM_030577) is another VGAM1914 host target gene. ATP9A BINDING SITE is HOST TARGET binding site found in the 3' untranslated region of mRNA encoded by ATP9A, corresponding to a HOST TARGET binding site such as BINDING SITE I, BINDING SITE II or BINDING SITE III. Table 2 illustrates the complementarity of the nucleotide sequences of ATP9A BINDING SITE, designated SEQ ID:31074, to the nucleotide sequence of VGAM1914 RNA, herein designated VGAM RNA, also designated SEQ ID:4625.

Another function of VGAM1914 is therefore inhibition of ATPase, Class II, Type 9A (ATP9A, Accession XM_030577). Accordingly, utilities of VGAM1914 include diagnosis, prevention and treatment of diseases and clinical conditions associated with ATP9A. AUT-like 1, Cysteine Endopeptidase (S. cerevisiae) (AUTL1, Accession NM_032852) is another VGAM1914 host target gene. AUTL1 BINDING SITE is HOST TARGET binding site found in the 3' untranslated region of mRNA encoded by AUTL1, corresponding to a HOST TARGET binding site such as BINDING SITE I, BINDING SITE II or BINDING SITE III. Table 2 illustrates the complementarity of the nucleotide sequences of AUTL1 BINDING SITE, designated SEQ ID:26648, to the nucleotide sequence of VGAM1914 RNA, herein designated VGAM RNA, also designated SEQ ID:4625.

Another function of VGAM1914 is therefore inhibition of AUT-like 1, Cysteine Endopeptidase (S. cerevisiae) (AUTL1, Accession NM_032852). Accordingly, utilities of VGAM1914 include diagnosis, prevention and treatment of diseases and clinical conditions associated with AUTL1. Chromosome 6 Open Reading Frame 33 (C6orf33, Accession NM_133367) is another VGAM1914 host target gene. C6orf33 BINDING SITE is HOST TARGET binding site found in the 3' untranslated region of mRNA encoded by C6orf33, corresponding to a HOST TARGET binding site such as BINDING SITE I, BINDING SITE II or BINDING SITE III. Table 2 illustrates the complementarity of the nucleotide sequences of C6orf33 BINDING SITE, designated SEQ ID:28491, to the nucleotide sequence of VGAM1914 RNA, herein designated VGAM RNA, also designated SEQ ID:4625.

Another function of VGAM1914 is therefore inhibition of Chromosome 6 Open Reading Frame 33 (C6orf33, Accession NM_133367). Accordingly, utilities of VGAM1914 include diagnosis, prevention and treatment of diseases and clinical conditions associated with C6orf33. DKFZP586N0721 (Accession NM_015400) is another VGAM1914 host target gene. DKFZP586N0721 BINDING SITE is HOST TARGET binding site found in the 5' untranslated region of mRNA encoded by DKFZP586N0721, corresponding to a HOST TARGET binding site such as BINDING SITE I, BINDING SITE II or BINDING SITE III. Table 2 illustrates the complementarity of the nucleotide sequences of DKFZP586N0721 BINDING SITE, designated SEQ ID:17709, to the nucleotide sequence of VGAM1914 RNA, herein designated VGAM RNA, also designated SEQ ID:4625.

Another function of VGAM1914 is therefore inhibition of DKFZP586N0721 (Accession NM_015400). Accordingly, utilities of VGAM1914 include diagnosis, prevention and treatment of diseases and clinical conditions associated with DKFZP586N0721. FLJ10450 (Accession NM_018095) is another VGAM1914 host target gene. FLJ10450 BINDING SITE is HOST TARGET binding site found in the 3' untranslated region of mRNA encoded by FLJ10450, corresponding to a HOST TARGET binding site such as BINDING SITE I, BINDING SITE II or BINDING SITE III. Table 2 illustrates the complementarity of the nucleotide sequences of FLJ10450 BINDING SITE, designated SEQ ID:19862, to the nucleotide sequence of VGAM1914 RNA, herein designated VGAM RNA, also designated SEQ ID:4625.

Another function of VGAM1914 is therefore inhibition of FLJ10450 (Accession NM_018095). Accordingly, utilities of VGAM1914 include diagnosis, prevention and treatment of diseases and clinical conditions associated with FLJ10450. GDNF Family Receptor Alpha 4 (GFRA4, Accession NM_022139) is another VGAM1914 host target gene. GFRA4 BINDING SITE is HOST TARGET binding site found in the 3' untranslated region of mRNA encoded by GFRA4, corresponding to a HOST TARGET binding site such as BINDING SITE I, BINDING SITE II or BINDING SITE III. Table 2 illustrates the complementarity of the nucleotide sequences of GFRA4 BINDING SITE, designated SEQ ID:22701, to the nucleotide sequence of VGAM1914 RNA, herein designated VGAM RNA, also designated SEQ ID:4625.

Another function of VGAM1914 is therefore inhibition of GDNF Family Receptor Alpha 4 (GFRA4, Accession NM_022139). Accordingly, utilities of VGAM1914 include diagnosis, prevention and treatment of diseases and clinical conditions associated with GFRA4. KIAA0599 (Accession XM_085127) is another VGAM1914 host target gene. KIAA0599 BINDING SITE is HOST TARGET binding site found in the 3' untranslated region of mRNA encoded by KIAA0599, corresponding to a HOST TARGET binding site such as BINDING SITE I, BINDING SITE II or BINDING SITE III. Table 2 illustrates the complementarity of the nucleotide sequences of KIAA0599 BINDING SITE, designated SEQ ID:37852, to the nucleotide sequence of VGAM1914 RNA, herein designated VGAM RNA, also designated SEQ ID:4625.

Another function of VGAM1914 is therefore inhibition of KIAA0599 (Accession XM_085127). Accordingly, utilities of VGAM1914 include diagnosis, prevention and treatment of diseases and clinical conditions associated with KIAA0599. KIAA0831 (Accession NM_014924) is another VGAM1914 host target gene. KIAA0831 BINDING SITE is HOST TARGET binding site found in the 3' untranslated region of mRNA encoded by KIAA0831, corresponding to a HOST TARGET binding site such as BINDING SITE I, BINDING SITE II or BINDING SITE III. Table 2 illustrates the complementarity of the nucleotide sequences of KIAA0831 BINDING SITE, designated SEQ ID:17207, to the nucleotide sequence of VGAM1914 RNA, herein designated VGAM RNA, also designated SEQ ID:4625.

Another function of VGAM1914 is therefore inhibition of KIAA0831 (Accession NM_014924). Accordingly, utilities of VGAM1914 include diagnosis, prevention and treatment of diseases and clinical conditions associated with KIAA0831. KIAA1493 (Accession XM_034415) is another VGAM1914 host target gene. KIAA1493 BINDING SITE is HOST TARGET binding site found in the 3' untranslated region of mRNA encoded by KIAA1493, corresponding to a HOST TARGET binding site such as BINDING SITE I, BINDING SITE II or BINDING SITE III. Table 2 illustrates the complementarity of the nucleotide sequences of KIAA1493 BINDING SITE, designated SEQ ID:32095, to the nucleotide sequence of VGAM1914 RNA, herein designated VGAM RNA, also designated SEQ ID:4625.

Another function of VGAM1914 is therefore inhibition of KIAA1493 (Accession XM_034415). Accordingly, utilities of VGAM1914 include diagnosis, prevention and treatment of diseases and clinical conditions associated with KIAA1493. KIAA1598 (Accession NM_018330) is another VGAM1914 host target gene. KIAA1598 BINDING SITE is HOST TARGET binding site found in the 3' untranslated region of mRNA encoded by KIAA1598, corresponding to a HOST TARGET binding site such as BINDING SITE I, BINDING SITE II or BINDING SITE III. Table 2 illustrates the complementarity of the nucleotide sequences of KIAA1598 BINDING SITE, designated SEQ ID:20332, to the nucleotide sequence of VGAM1914 RNA, herein designated VGAM RNA, also designated SEQ ID:4625.

Another function of VGAM1914 is therefore inhibition of KIAA1598 (Accession NM_018330). Accordingly, utilities of VGAM1914 include diagnosis, prevention and treatment of diseases and clinical conditions associated with KIAA1598. MacGAP (Accession NM_033515) is another VGAM1914 host target gene. MacGAP BINDING SITE is HOST TARGET binding site found in the 3' untranslated region of mRNA encoded by MacGAP, corresponding to a HOST TARGET binding site such as BINDING SITE I, BINDING SITE II or BINDING SITE III. Table 2 illustrates the complementarity of the nucleotide sequences of MacGAP BINDING SITE, designated SEQ ID:27291, to the nucleotide sequence of VGAM1914 RNA, herein designated VGAM RNA, also designated SEQ ID:4625.

Another function of VGAM1914 is therefore inhibition of MacGAP (Accession NM_033515). Accordingly, utilities of VGAM1914 include diagnosis, prevention and treatment of diseases and clinical conditions associated with MacGAP. PDZ Domain Containing 2 (PDZD2, Accession XM_087705) is another VGAM1914 host target gene. PDZD2 BINDING SITE is HOST TARGET binding site found in the 5' untranslated region of mRNA encoded by PDZD2, corresponding to a HOST TARGET binding site such as BINDING SITE I, BINDING SITE II or BINDING SITE III. Table 2 illustrates the complementarity of the nucleotide sequences of PDZD2 BINDING SITE, designated SEQ ID:39392, to the nucleotide sequence of VGAM1914 RNA, herein designated VGAM RNA, also designated SEQ ID:4625.

Another function of VGAM1914 is therefore inhibition of PDZ Domain Containing 2 (PDZD2, Accession XM_087705). Accordingly, utilities of VGAM1914 include diagnosis, prevention and treatment of diseases and clinical conditions associated with PDZD2. PRO1728 (Accession NM_018505) is another VGAM1914 host target gene. PRO1728 BINDING SITE is HOST TARGET binding site found in the 3' untranslated region of mRNA encoded by PRO1728, corresponding to a HOST TARGET binding site such as BINDING SITE I, BINDING SITE II or BINDING SITE III. Table 2 illustrates the complementarity of the nucleotide sequences of PRO1728 BINDING SITE, designated SEQ ID:20572, to the nucleotide sequence of VGAM1914 RNA, herein designated VGAM RNA, also designated SEQ ID:4625.

Another function of VGAM1914 is therefore inhibition of PRO1728 (Accession NM_018505). Accordingly, utilities of VGAM1914 include diagnosis, prevention and treatment of diseases and clinical conditions associated with PRO1728. RAB11B, Member RAS Oncogene Family (RAB11B, Accession XM_058232) is another VGAM1914 host target gene. RAB11B BINDING SITE is HOST TARGET binding site found in the 3' untranslated region of mRNA encoded by RAB11B, corresponding to a HOST TARGET binding site such as BINDING SITE I, BINDING SITE II or BINDING SITE III. Table 2 illustrates the complementarity of the nucleotide sequences of RAB11B BINDING SITE, designated SEQ ID:36588, to the nucleotide sequence of VGAM1914 RNA, herein designated VGAM RNA, also designated SEQ ID:4625.

Another function of VGAM1914 is therefore inhibition of RAB11B, Member RAS Oncogene Family (RAB11B, Accession XM_058232). Accordingly, utilities of VGAM1914 include diagnosis, prevention and treatment of diseases and clinical conditions associated with RAB11B. LOC150271 (Accession XM_097859) is another VGAM1914 host target gene. LOC150271 BINDING SITE is HOST TARGET binding site found in the 3' untranslated region of mRNA encoded by LOC150271, corresponding to a HOST TARGET binding site such as BINDING SITE I, BINDING SITE II or BINDING SITE III. Table 2 illustrates the complementarity of the nucleotide sequences of LOC150271 BINDING SITE, designated SEQ ID:41173, to the nucleotide sequence of VGAM1914 RNA, herein designated VGAM RNA, also designated SEQ ID:4625.

Another function of VGAM1914 is therefore inhibition of LOC150271 (Accession XM_097859). Accordingly, utilities of VGAM1914 include diagnosis, prevention and treatment of diseases and clinical conditions associated with LOC150271. LOC152048 (Accession XM_098158) is another VGAM1914 host target gene. LOC152048 BINDING SITE is HOST TARGET binding site found in the 3' untranslated region of mRNA encoded by LOC152048, corresponding to a HOST TARGET binding site such as BINDING SITE I, BINDING SITE II or BINDING SITE III. Table 2 illustrates the complementarity of the nucleotide sequences of LOC152048 BINDING SITE, designated SEQ ID:41428, to the nucleotide sequence of VGAM1914 RNA, herein designated VGAM RNA, also designated SEQ ID:4625.

Another function of VGAM1914 is therefore inhibition of LOC152048 (Accession XM_098158). Accordingly, utilities of VGAM1914 include diagnosis, prevention and treatment of diseases and clinical conditions associated with LOC152048. LOC153883 (Accession XM_087798) is another VGAM1914 host target gene. LOC153883 BINDING SITE is HOST TARGET binding site found in the 5' untranslated region of mRNA encoded by LOC153883, corresponding to a HOST TARGET binding site such as BINDING SITE I, BINDING SITE II or BINDING SITE III. Table 2 illustrates the complementarity of the nucleotide sequences of LOC153883 BINDING SITE, designated SEQ ID:39433, to the nucleotide sequence of VGAM1914 RNA, herein designated VGAM RNA, also designated SEQ ID:4625.

Another function of VGAM1914 is therefore inhibition of LOC153883 (Accession XM_087798). Accordingly, utilities of VGAM1914 include diagnosis, prevention and treatment of diseases and clinical conditions associated with LOC153883. LOC157869 (Accession XM_088409) is another VGAM1914 host target gene. LOC157869 BINDING SITE is HOST TARGET binding site found in the 3' untranslated region of mRNA encoded by LOC157869, corresponding to a HOST TARGET binding site such as BINDING SITE I, BINDING SITE II or BINDING SITE III. Table 2 illustrates the complementarity of the nucleotide sequences of LOC157869 BINDING SITE, designated SEQ ID:39675, to the nucleotide sequence of VGAM1914 RNA, herein designated VGAM RNA, also designated SEQ ID:4625.

Another function of VGAM1914 is therefore inhibition of LOC157869 (Accession XM_088409). Accordingly, utilities of VGAM1914 include diagnosis, prevention and treatment of diseases and clinical conditions associated with LOC157869. LOC196074 (Accession XM_113647) is another VGAM1914 host target gene. LOC196074 BINDING SITE is HOST TARGET binding site found in the 5' untranslated region of mRNA encoded by LOC196074, corresponding to a HOST TARGET binding site such as BINDING SITE I, BINDING SITE II or BINDING SITE III. Table 2 illustrates the complementarity of the nucleotide sequences of LOC196074 BINDING SITE, designated SEQ ID:42320, to the nucleotide sequence of VGAM1914 RNA, herein designated VGAM RNA, also designated SEQ ID:4625.

Another function of VGAM1914 is therefore inhibition of LOC196074 (Accession XM_113647). Accordingly, utilities of VGAM1914 include diagnosis, prevention and treatment of diseases and clinical conditions associated with LOC196074. LOC201292 (Accession XM_113949) is another VGAM1914 host target gene. LOC201292 BINDING SITE is HOST TARGET binding site found in the 3' untranslated region of mRNA encoded by LOC201292, corresponding to a HOST TARGET binding site such as BINDING SITE I, BINDING SITE II or BINDING SITE III. Table 2 illustrates the complementarity of the nucleotide sequences of LOC201292 BINDING SITE, designated SEQ ID:42561, to the nucleotide sequence of VGAM1914 RNA, herein designated VGAM RNA, also designated SEQ ID:4625.

Another function of VGAM1914 is therefore inhibition of LOC201292 (Accession XM_113949). Accordingly, utilities of VGAM1914 include diagnosis, prevention and treatment of diseases and clinical conditions associated with LOC201292. LOC221763 (Accession XM_168107) is another VGAM1914 host target gene. LOC221763 BINDING SITE is HOST TARGET binding site found in the 3' untranslated region of mRNA encoded by LOC221763, corresponding to a HOST TARGET binding site such as BINDING SITE I, BINDING SITE II or BINDING SITE III. Table 2 illustrates the complementarity of the nucleotide sequences of LOC221763 BINDING SITE, designated SEQ ID:45035, to the nucleotide sequence of VGAM1914 RNA, herein designated VGAM RNA, also designated SEQ ID:4625.

Another function of VGAM1914 is therefore inhibition of LOC221763 (Accession XM_168107). Accordingly, utilities of VGAM1914 include diagnosis, prevention and treatment of diseases and clinical conditions associated with LOC221763. LOC89231 (Accession XM_166577) is another VGAM1914 host target gene. LOC89231 BINDING SITE is HOST TARGET binding site found in the 3' untranslated region of mRNA encoded by LOC89231, corresponding to a HOST TARGET binding site such as BINDING SITE I, BINDING SITE II or BINDING SITE III. Table 2 illustrates the complementarity of the nucleotide sequences of LOC89231 BINDING SITE, designated SEQ ID:44549, to the nucleotide sequence of VGAM1914 RNA, herein designated VGAM RNA, also designated SEQ ID:4625.

Another function of VGAM1914 is therefore inhibition of LOC89231 (Accession XM_166577). Accordingly, utilities of VGAM1914 include diagnosis, prevention and treatment of diseases and clinical conditions associated with LOC89231. FIG. 1 further provides a conceptual description of a novel bioinformatically detected viral gene of the present invention, referred to here as Viral Genomic Address Messenger 1915 (VGAM1915) viral gene, which modulates expression of respective host target genes thereof, the function and utility of which host target genes is known in the art.

VGAM1915 is a novel bioinformatically detected regulatory, non protein coding, viral micro RNA (miRNA) gene. The method by which VGAM1915 was detected is described hereinabove with reference to FIGS. 1-8.

VGAM1915 gene, herein designated VGAM GENE, is a viral gene contained in the genome of Human Parainfluenza Virus 3. VGAM1915 host target gene, herein designated VGAM HOST TARGET GENE, is a human gene contained in the human genome.

VGAM1915 gene encodes a VGAM1915 precursor RNA, herein designated VGAM PRECURSOR RNA. Similar to other miRNA genes, and unlike most ordinary genes, VGAM1915 precursor RNA does not encode a protein. A nucleotide sequence identical or highly similar to the nucleotide sequence of VGAM1915 precursor RNA is designated SEQ ID:1901, and is provided hereinbelow with reference to the sequence listing part. Nucleotide sequence SEQ ID:1901 is located at position 225 relative to the genome of Human Parainfluenza Virus 3.

VGAM1915 precursor RNA folds onto itself, forming VGAM1915 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1915 folded precursor RNA into VGAM1915 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1915 RNA is designated SEQ ID:4626, and is provided hereinbelow with reference to the sequence listing part.

VGAM1915 host target gene, herein designated VGAM HOST TARGET GENE, encodes a corresponding messenger RNA, VGAM1915 host target RNA, herein designated VGAM HOST TARGET RNA. VGAM1915 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1915 RNA, herein designated VGAM RNA, binds complementarily to one or more host target binding sites located in untranslated regions of VGAM1915 host target RNA, herein designated VGAM HOST TARGET RNA. This complementary binding is due to the fact that the nucleotide sequence of VGAM1915 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1915 RNA, herein designated VGAM RNA, may have a different number of host target binding sites in untranslated regions of a VGAM1915 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1915 RNA, herein designated VGAM RNA, to host target binding sites on VGAM1915 host target RNA, herein designated VGAM HOST TARGET RNA, such as BINDING SITE I, BINDING SITE II and BINDING SITE III, inhibits translation of VGAM1915 host target RNA into VGAM1915 host target protein, herein designated VGAM HOST TARGET PROTEIN. VGAM host target protein is therefore outlined by a broken line.

It is appreciated that VGAM1915 host target gene, herein designated VGAM HOST TARGET GENE, in fact represents a plurality of VGAM1915 host target genes. The mRNA of each one of this plurality of VGAM1915 host target genes comprises one or more host target binding sites, each having a nucleotide sequence which is at least partly complementary to VGAM1915 RNA, herein designated VGAM RNA, and which when bound by VGAM1915 RNA causes inhibition of translation of respective one or more VGAM1915 host target proteins.

It is further appreciated by one skilled in the art that the mode of translational inhibition illustrated by FIG. 1 with specific reference to translational inhibition exerted by VGAM1915 gene, herein designated VGAM GENE, on one or more VGAM1915 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1915 is inhibition of expression of host target genes, as part of a novel viral mechanism of attacking a host. Accordingly, utilities of VGAM1915 include diagnosis, prevention and treatment of viral infection by Human Parainfluenza Virus 3. Specific functions, and accordingly utilities, of VGAM1915 correlate with, and may be deduced from, the identity of the host target genes which VGAM1915 binds and inhibits, and the function of these host target genes, as elaborated hereinbelow.

Nucleotide sequences of the VGAM1915 precursor RNA, herein designated VGAM PRECURSOR RNA, and of the 'diced' VGAM1915 RNA, herein designated VGAM RNA, and a schematic representation of the secondary folding of VGAM1915 folded precursor RNA, herein designated VGAM FOLDED PRECURSOR RNA, of VGAM1915 are further described hereinbelow with reference to Table 1.

Nucleotide sequences of host target binding sites, such as BINDING SITE-I, BINDING SITE-II and BINDING SITE-III of FIG. 1, found on VGAM1915 host target RNA, and schematic representation of the complementarity of each of these host target binding sites to VGAM1915 RNA, herein designated VGAM RNA, are described hereinbelow with reference to Table 2.

As mentioned hereinabove with reference to FIG. 1, a function of VGAM1915 gene, herein designated VGAM is inhibition of expression of VGAM1915 target genes. It is appreciated that specific functions, and accordingly utilities, of VGAM1915 correlate with, and may be deduced from, the identity of the target genes which VGAM1915 binds and inhibits, and the function of these target genes, as elaborated hereinbelow.

Adenosine Deaminase, RNA-specific, B1 (RED1 homolog rat) (ADARB1, Accession NM_015833) is a VGAM1915 host target gene. ADARB1 BINDING SITE is HOST TARGET binding site found in the 3' untranslated region of mRNA encoded by ADARB1, corresponding to a HOST TARGET binding site such as BINDING SITE I, BINDING SITE II or BINDING SITE III. Table 2 illustrates the complementarity of the nucleotide sequences of ADARB1 BINDING SITE, designated SEQ ID:17949, to the nucleotide sequence of VGAM1915 RNA, herein designated VGAM RNA, also designated SEQ ID:4626.

A function of VGAM1915 is therefore inhibition of Adenosine Deaminase, RNA-specific, B1 (RED1 homolog rat) (ADARB1, Accession NM_015833), a gene which RNA editing involves the deamination of adenosines at specific sites. Accordingly, utilities of VGAM1915 include diagnosis, prevention and treatment of diseases and clinical conditions associated with ADARB1. The function of ADARB1 and its association with various diseases and clinical conditions, has been established by previous studies, as described hereinabove with reference to VGAM1717. B29 (Accession NM_031939) is another VGAM1915 host target gene. B29 BINDING SITE is HOST TARGET binding site found in the 3' untranslated region of mRNA encoded by B29, corresponding to a HOST TARGET binding site such as BINDING SITE I, BINDING SITE II or BINDING SITE III. Table 2 illustrates the complementarity of the nucleotide sequences of B29 BINDING SITE, designated SEQ ID:25683, to the nucleotide sequence of VGAM1915 RNA, herein designated VGAM RNA, also designated SEQ ID:4626.

Another function of VGAM1915 is therefore inhibition of B29 (Accession NM_031939). Accordingly, utilities of VGAM1915 include diagnosis, prevention and treatment of diseases and clinical conditions associated with B29. B-cell CLL/lymphoma 11B (zinc finger protein) (BCL11B, Accession NM_022898) is another VGAM1915 host target gene. BCL11B BINDING SITE is HOST TARGET binding site found in the 3' untranslated region of mRNA encoded by BCL11B, corresponding to a HOST TARGET binding site such as BINDING SITE I, BINDING SITE II or BINDING SITE III. Table 2 illustrates the complementarity of the nucleotide sequences of BCL11B BINDING SITE, designated SEQ ID:23172, to the nucleotide sequence of VGAM1915 RNA, herein designated VGAM RNA, also designated SEQ ID:4626.

Another function of VGAM1915 is therefore inhibition of B-cell CLL/lymphoma 11B (zinc finger protein) (BCL11B, Accession NM_022898). Accordingly, utilities of VGAM1915 include diagnosis, prevention and treatment of diseases and clinical conditions associated with BCL11B. Calumenin (CALU, Accession NM_001219) is another VGAM1915 host target gene. CALU BINDING SITE is HOST TARGET binding site found in the 3' untranslated region of mRNA encoded by CALU, corresponding to a HOST TARGET binding site such as BINDING SITE I, BINDING SITE II or BINDING SITE III. Table 2 illustrates the complementarity of the nucleotide sequences of CALU BINDING SITE, designated SEQ ID:6883, to the nucleotide sequence of VGAM1915 RNA, herein designated VGAM RNA, also designated SEQ ID:4626.

Another function of VGAM1915 is therefore inhibition of Calumenin (CALU, Accession NM_001219), a gene which binds 7 calcium ions with a low affinity with unidtified function. Accordingly, utilities of VGAM1915 include diagnosis, prevention and treatment of diseases and clinical conditions associated with CALU. The function of CALU and its association with various diseases and clinical conditions, has been established by previous studies, as described hereinabove with reference to VGAM253. Cytoplasmic Linker Associated Protein 2 (CLASP2, Accession XM_035453) is another VGAM1915 host target gene. CLASP2 BINDING SITE is HOST TARGET binding site found in the 3' untranslated region of mRNA encoded by CLASP2, corresponding to a HOST TARGET binding site such as BINDING SITE I, BINDING SITE II or BINDING SITE III. Table 2 illustrates the complementarity of the nucleotide sequences of CLASP2 BINDING SITE, designated SEQ ID:32267, to the nucleotide sequence of VGAM1915 RNA, herein designated VGAM RNA, also designated SEQ ID:4626.

Another function of VGAM1915 is therefore inhibition of Cytoplasmic Linker Associated Protein 2 (CLASP2, Accession XM_035453), a gene which is involved in the regional regulation of microtubule dynamics in motile fibroblasts. Accordingly, utilities of VGAM1915 include diagnosis, prevention and treatment of diseases and clinical conditions associated with CLASP2. The function of CLASP2 and its association with various diseases and clinical conditions, has been established by previous studies, as described hereinabove with reference to VGAM897. DUTP Pyrophosphatase (DUT, Accession NM_001948) is another VGAM1915 host target gene. DUT BINDING SITE is HOST TARGET binding site found in the 3' untranslated region of mRNA encoded by DUT, corresponding to a HOST TARGET binding site such as BINDING SITE I, BINDING SITE II or BINDING SITE III. Table 2 illustrates the complementarity of the nucleotide sequences of DUT BINDING SITE, designated SEQ ID:7663, to the nucleotide sequence of VGAM1915 RNA, herein designated VGAM RNA, also designated SEQ ID:4626.

Another function of VGAM1915 is therefore inhibition of DUTP Pyrophosphatase (DUT, Accession NM_001948), a gene which is involved in nucleotide metabolism. Accordingly, utilities of VGAM1915 include diagnosis, prevention and treatment of diseases and clinical conditions associated with DUT. The function of DUT has been established by previous studies. Deoxyuridine triphosphate nucleotidohydrolase (dUTPase; EC 3.6.1.23) hydrolyzes dUTP to dUMP and pyrophosphate. Mutations in dUTPase of E. coli lead to increased dUTP levels and unusually high levels of dUMP incorporation into DNA during replication and repair which, in turn, causes DNA fragmentation and cell death (Lindahl, 1982; el-Hajj et al., 1988). Presumably for this reason, null mutants of dUTPase in yeast are lethal. A second function for dUTPase is to provide dUMP for synthesis of thymidylate. Canman et al. (1992, 1994) showed that increased dUTPase levels in some cancer cell lines accounted for their resistance to the thymidine synthase inhibitor fluorodeoxyuridine (FUdR). McIntosh et al. (1992) cloned 2 functional human dUTP pyrophosphatases from a cDNA expression library by genetic complementation in E. coli. The 2 different-sized cDNAs each contain a single long ORF encoding a 141-amino acid polypeptide with a calculated molecular mass of 16.6 kD. The human protein shares 35% homology with the E. coli dUTPase and 53% with the Saccharomyces cerevisiae enzyme. McIntosh et al. (1992) detected expression of the dUTPase gene in a variety of human tissues. Because of its possible essential role in DNA replication, the authors suggested that chemotherapeutics could be designed to target dUTPase in human cancers.

Full details of the abovementioned studies are described in the following publications, the disclosure of which are hereby incorporated by reference:

Canman, C. E.; Radany, E. H.; Parsels, L. A.; Davis, M. A.; Lawrence, T. S.; Maybaum, J.: Induction of resistance to fluorodeoxyuridine cytotoxicity and DNA damage in human tumor cells by expression of Escherichia coli deoxyuridinetriphosphatase. Cancer Res. 54:2296-2298, 1994; and McIntosh, E. M.; Ager, D. D.; Gadsden, M. H.; Haynes, R. H.: Human dUTP pyrophosphatase: cDNA sequence and potential biological importance of the enzyme. Proc. Nat. Acad. Sci. 89:8020.

Further studies establishing the function and utilities of DUT are found in John Hopkins OMIM database record ID 601266, and in sited publications numbered 9256-9264 listed in the bibliography section hereinbelow, which are also hereby incorporated by reference. Gardner-Rasheed Feline Sarcoma Viral (v-fgr) Oncogene Homolog (FGR, Accession NM_005248) is another VGAM1915 host target gene. FGR BINDING SITE is HOST TARGET binding site found in the 3' untranslated region of mRNA encoded by FGR, corresponding to a HOST TARGET binding site such as BINDING SITE I, BINDING SITE II or BINDING SITE III. Table 2 illustrates the complementarity of the nucleotide sequences of FGR BINDING SITE, designated SEQ ID:11757, to the nucleotide sequence of VGAM1915 RNA, herein designated VGAM RNA, also designated SEQ ID:4626.

Another function of VGAM1915 is therefore inhibition of Gardner-Rasheed Feline Sarcoma Viral (v-fgr) Oncogene Homolog (FGR, Accession NM_005248), a gene which Member of the tyrosine kinase family. Accordingly, utilities of VGAM1915 include diagnosis, prevention and treatment of diseases and clinical conditions associated with FGR. The function of FGR has been established by previous studies. The cell-derived domain of Gardner-Rasheed feline sarcoma virus consists of a gamma-actin sequence and a tyrosine-specific protein kinase sequence called v-fgr. By means of a v-fgr probe, Tronick et al. (1985) isolated a human homolog. Analysis showed that the human DNA is distinct from all other retroviral oncogenes. They localized the FGR oncogene to 1p36.2-p36.1 by in situ hybridization. By Southern analysis of somatic cell hybrids, Nishizawa et al. (1986) confirmed the assignment of the FGR locus to chromosome 1. FGR, which is the presently used designation, is the same as the oncogene earlier called SRC2. The latter was mapped to 1p36-p34 by Le Beau et al. (1984) using in situ hybridization and by Lebo et al. (1984) using dual-beam chromosome sorting and spot blot DNA analysis. Dracopoli et al. (1988) assigned SRC2 to 1p by analysis of DNA from a panel of somatic cell hybrids and by linkage analysis in the CEPH families. The latter studies showed that the SRC2 locus is 3.1 cM from the Rh blood group locus. They favored the gene order:1pter--PND--ALPL--FUCA1--SRC2(FGR)--Rh--D1S57--MYCL.

Full details of the abovementioned studies are described in the following publications, the disclosure of which are hereby incorporated by reference:

Dracopoli, N. C.; Stanger, B. Z.; Lager, M.; Housman, D. E.: Localization of the FGR proto-oncogene on the genetic linkage map of human chromosome 1p. Genomics 3:124-128, 1988; and Nishizawa, M.; Semba, K.; Yoshida, M. C.; Yamamoto, T.; Sasaki, M.; Toyoshima, K.: Structure, expression, and chromosomal location of the human c-fgr gene. Molec. Cell. Biol. 6:511-517.

Further studies establishing the function and utilities of FGR are found in John Hopkins OMIM database record ID 164940, and in sited publications numbered 10881-1088 and 10801-10802 listed in the bibliography section hereinbelow, which are also hereby incorporated by reference. Myeloperoxidase (MPO, Accession NM_000250) is another VGAM1915 host target gene. MPO BINDING SITE is HOST TARGET binding site found in the 3' untranslated region of mRNA encoded by MPO, corresponding to a HOST TARGET binding site such as BINDING SITE I, BINDING SITE II or BINDING SITE III. Table 2 illustrates the complementarity of the nucleotide sequences of MPO BINDING SITE, designated SEQ ID:5787, to the nucleotide sequence of VGAM1915 RNA, herein designated VGAM RNA, also designated SEQ ID:4626.

Another function of VGAM1915 is therefore inhibition of Myeloperoxidase (MPO, Accession NM_000250), a gene which is present in primary granules of neutrophilic granulocytes. Accordingly, utilities of VGAM1915 include diagnosis, prevention and treatment of diseases and clinical conditions associated with MPO. The function of MPO has been established by previous studies. Weil et al. (1988) found that the MPO gene was translocated to chromosome 15 in all cases of acute promyelocytic leukemia (subtype M3), which is consistently associated with the chromosomal translocation t (15;17)(q22; q11.2). In 2 of 4 cases examined by genomic blot analysis, rearrangement of the MPO gene was detected in leukemia cells. Weil et al. (1988) also suggested that MPO may be pivotal in the pathogenesis of APL. According to HGM10, the MPO gene is located at a distance from the breakpoint in APL, and the gene itself is probably usually not rearranged in APL. Myeloperoxidase has been detected in activated microglial macrophages and within amyloid plaques in the central nervous system. Using statistical analysis, Reynolds et al. (2000) examined the relationship between APOE (OMIM Ref. No. 107741) and MPO polymorphisms in the risk of Alzheimer disease (AD; 104300) in a genetically homogeneous Finnish population. They found that the presence of the MPO A allele in conjunction with APOE E4 significantly increased the risk of AD in men, but not in women (odds ratio for men with both alleles = 11.4 vs APOE E4 alone = 3.0). Reynolds et al. (2000) also found that estrogen receptor-alpha (OMIM Ref. No. 133430) binds to the MPO A promoter, which may explain the gender differences.

Full details of the abovementioned studies are described in the following publications, the disclosure of which are hereby incorporated by reference:

Reynolds, W. F.; Hiltunen, M.; Pirskanen, M.; Mannermaa, A.; Helisalmi, S.; Lehtovirta, M.; Alafuzoff, I.; Soininen, H.: MPO and APOE epsilon-4 polymorphisms interact to increase risk for AD in Finnish males. Neurology 55: 1284-1290, 2000; and Weil, S. C.; Rosner, G. L.; Reid, M. S.; Chisholm, R. L.; Lemons, R. S.; Swanson, M. S.; Carrino, J. J.; Diaz, M. O.; Le Beau, M. M.: Translocation and rearrangement of myeloperoxida.

Further studies establishing the function and utilities of MPO are found in John Hopkins OMIM database record ID 606989, and in sited publications numbered 5531-5541, 5569, 6146-615 and 9098-6160 listed in the bibliography section hereinbelow, which are also hereby incorporated by reference. Myotubularin Related Protein 8 (MTMR8, Accession NM_015458) is another VGAM1915 host target gene. MTMR8 BINDING SITE is HOST TARGET binding site found in the 3' untranslated region of mRNA encoded by MTMR8, corresponding to a HOST TARGET binding site such as BINDING SITE I, BINDING SITE II or BINDING SITE III. Table 2 illustrates the complementarity of the nucleotide sequences of MTMR8 BINDING SITE, designated SEQ ID:17750, to the nucleotide sequence of VGAM1915 RNA, herein designated VGAM RNA, also designated SEQ ID:4626.

Another function of VGAM1915 is therefore inhibition of Myotubularin Related Protein 8 (MTMR8, Accession NM_015458), a gene which could be a tyrosine-phosphatase. Accordingly, utilities of VGAM1915 include diagnosis, prevention and treatment of diseases and clinical conditions associated with MTMR8. The function of MTMR8 and its association with various diseases and clinical conditions, has been established by previous studies, as described hereinabove with reference to VGAM379. Nuclear Factor Related to Kappa B Binding Protein (NFRKB, Accession NM_006165) is another VGAM1915 host target gene. NFRKB BINDING SITE is HOST TARGET binding site found in the 5' untranslated region of mRNA encoded by NFRKB, corresponding to a HOST TARGET binding site such as BINDING SITE I, BINDING SITE II or BINDING SITE III. Table 2 illustrates the complementarity of the nucleotide sequences of NFRKB BINDING SITE, designated SEQ ID:12821, to the nucleotide sequence of VGAM1915 RNA, herein designated VGAM RNA, also designated SEQ ID:4626.

Another function of VGAM1915 is therefore inhibition of Nuclear Factor Related to Kappa B Binding Protein (NFRKB, Accession NM_006165). Accordingly, utilities of VGAM1915 include diagnosis, prevention and treatment of diseases and clinical conditions associated with NFRKB. 2'-5'-oligoadenylate Synthetase 2, 69/71 kDa (OAS2, Accession NM_016817) is another VGAM1915 host target gene. OAS2 BINDING SITE is HOST TARGET binding site found in the 3' untranslated region of mRNA encoded by OAS2, corresponding to a HOST TARGET binding site such as BINDING SITE I, BINDING SITE II or BINDING SITE III. Table 2 illustrates the complementarity of the nucleotide sequences of OAS2 BINDING SITE, designated SEQ ID:18805, to the nucleotide sequence of VGAM1915 RNA, herein designated VGAM RNA, also designated SEQ ID:4626.

Another function of VGAM1915 is therefore inhibition of 2'-5'-oligoadenylate Synthetase 2, 69/71 kDa (OAS2, Accession NM_016817), a gene which may play a role in mediating resistance to virus infection, control of cell growth, differentiation, and apoptosis. Accordingly, utilities of VGAM1915 include diagnosis, prevention and treatment of diseases and clinical conditions associated with OAS2. The function of OAS2 and its association with various diseases and clinical conditions, has been established by previous studies, as described hereinabove with reference to VGAM1498. Proteasome (prosome, macropain) Subunit, Beta Type, 9 (large multifunctional protease 2) (PSMB9, Accession NM_002800) is another VGAM1915 host target gene. PSMB9 BINDING SITE is HOST TARGET binding site found in the 3' untranslated region of mRNA encoded by PSMB9, corresponding to a HOST TARGET binding site such as BINDING SITE I, BINDING SITE II or BINDING SITE III. Table 2 illustrates the complementarity of the nucleotide sequences of PSMB9 BINDING SITE, designated SEQ ID:8675, to the nucleotide sequence of VGAM1915 RNA, herein designated VGAM RNA, also designated SEQ ID:4626.

Another function of VGAM1915 is therefore inhibition of Proteasome (prosome, macropain) Subunit, Beta Type, 9 (large multifunctional protease 2) (PSMB9, Accession NM_002800), a gene which is one component of a multicatalytic proteinase complex. Accordingly, utilities of VGAM1915 include diagnosis, prevention and treatment of diseases and clinical conditions associated with PSMB9. The function of PSMB9 has been established by previous studies. Driscoll et al. (1993) showed that the MHC-linked LMP2 and LMP7 subunits function to amplify specific endopeptidase activities of the proteasome. Gaczynska et al. (1993) presented experiments suggesting that gamma-interferon and expression of the LMP2 and LMP7 genes should favor the production by proteasomes of the types of peptides found on MHC class I molecules, which terminate almost exclusively with hydrophobic or basic residues. Animal model experiments lend further support to the function of PSMB9. Van Kaer et al. (1994) generated healthy mice with disrupted Lmp2 genes. Proteasomal peptidase activity against hydrophobic and basic substrates but not acidic substrates was lower in spleen and liver from mutant mice compared with wildtype mice. Differences in muscle and brain were not significant. Although flow cytometric analysis showed no difference in MHC class I expression, antigen-presenting cells from mutant mice were less able to stimulate a T-cell hybridoma specific for a nucleoprotein (NP) envelope antigen of an influenza A virus. Mutant mice also had less than half of the wildtype levels of CD8 (see OMIM Ref. No. 186910)-positive T lymphocytes and generated much lower levels of cytotoxic T-cell precursors specific for NP, though not for ovalbumin. Van Kaer et al. (1994) concluded that LMP2 selectively influences antigen processing of MHC class I-restricted antigens.

It is appreciated that the abovementioned animal model for PSMB9 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Van Kaer, L.; Ashton-Rickardt, P. G.; Eichelberger, M.; Gaczynska, M.; Nagashima, K.; Rock, K. L.; Goldberg, A. L.; Doherty, P. C.; Tonegawa, S.: Altered peptidase and viral-specific T cell response in LMP2 mutant mice. Immunity 1:533-541, 1994; and Driscoll, J.; Brown, M. G.; Finley, D.; Monaco, J. J.: MHC-linked LMP gene products specifically alter peptidase activities of the proteasome. Nature 365:262-264, 1993.

Further studies establishing the function and utilities of PSMB9 are found in John Hopkins OMIM database record ID 177045, and in sited publications numbered 1172-1175, 420 and 9736-9740 listed in the bibliography section hereinbelow, which are also hereby incorporated by reference. Protein Tyrosine Phosphatase, Receptor Type, O (PTPRO, Accession NM_030671) is another VGAM1915 host target gene. PTPRO BINDING SITE is HOST TARGET binding site found in the 3' untranslated region of mRNA encoded by PTPRO, corresponding to a HOST TARGET binding site such as BINDING SITE I, BINDING SITE II or BINDING SITE III. Table 2 illustrates the complementarity of the nucleotide sequences of PTPRO BINDING SITE, designated SEQ ID:25032, to the nucleotide sequence of VGAM1915 RNA, herein designated VGAM RNA, also designated SEQ ID:4626.

Another function of VGAM1915 is therefore inhibition of Protein Tyrosine Phosphatase, Receptor Type, O (PTPRO, Accession NM_030671), a gene which may function as a cell contact receptor that mediates and controls cell-cell signals. Accordingly, utilities of VGAM1915 include diagnosis, prevention and treatment of diseases and clinical conditions associated with PTPRO. The function of PTPRO and its association with various diseases and clinical conditions, has been established by previous studies, as described hereinabove with reference to VGAM140. Reticulon 1 (RTN1, Accession NM_021136) is another VGAM1915 host target gene. RTN1 BINDING SITE is HOST TARGET binding site found in the 3' untranslated region of mRNA encoded by RTN1, corresponding to a HOST TARGET binding site such as BINDING SITE I, BINDING SITE II or BINDING SITE III. Table 2 illustrates the complementarity of the nucleotide sequences of RTN1 BINDING SITE, designated SEQ ID:22108, to the nucleotide sequence of VGAM1915 RNA, herein designated VGAM RNA, also designated SEQ ID:4626.

Another function of VGAM1915 is therefore inhibition of Reticulon 1 (RTN1, Accession NM_021136), a gene which may be involved in neuroendocrine secretion or in membrane - membrane trafficking in neuroendocrine cells. Accordingly, utilities of VGAM1915 include diagnosis, prevention and treatment of diseases and clinical conditions associated with RTN1. The function of RTN1 and its association with various diseases and clinical conditions, has been established by previous studies, as described hereinabove with reference to VGAM337. Runt-related Transcription Factor 1 (acute myeloid leukemia 1; aml1 oncogene) (RUNX1, Accession NM_001754) is another VGAM1915 host target gene. RUNX1 BINDING SITE is HOST TARGET binding site found in the 3' untranslated region of mRNA encoded by RUNX1, corresponding to a HOST TARGET binding site such as BINDING SITE I, BINDING SITE II or BINDING SITE III. Table 2 illustrates the complementarity of the nucleotide sequences of RUNX1 BINDING SITE, designated SEQ ID:7494, to the nucleotide sequence of VGAM1915 RNA, herein designated VGAM RNA, also designated SEQ ID:4626.

Another function of VGAM1915 is therefore inhibition of Runt-related Transcription Factor 1 (acute myeloid leukemia 1; aml1 oncogene) (RUNX1, Accession NM_001754). Accordingly, utilities of VGAM1915 include diagnosis, prevention and treatment of diseases and clinical conditions associated with RUNX1. Tetratricopeptide Repeat Domain 3 (TTC3, Accession NM_003316) is another VGAM1915 host target gene. TTC3 BINDING SITE is HOST TARGET binding site found in the 5' untranslated region of mRNA encoded by TTC3, corresponding to a HOST TARGET binding site such as BINDING SITE I, BINDING SITE II or BINDING SITE III. Table 2 illustrates the complementarity of the nucleotide sequences of TTC3 BINDING SITE, designated SEQ ID:9318, to the nucleotide sequence of VGAM1915 RNA, herein designated VGAM RNA, also designated SEQ ID:4626.

Another function of VGAM1915 is therefore inhibition of Tetratricopeptide Repeat Domain 3 (TTC3, Accession NM_003316), a gene which contains tetratricopeptide repeat (TPR) motifs. Accordingly, utilities of VGAM1915 include diagnosis, prevention and treatment of diseases and clinical conditions associated with TTC3. The function of TTC3 and its association with various diseases and clinical conditions, has been established by previous studies, as described hereinabove with reference to VGAM699. Zic Family Member 3 Heterotaxy 1 (odd-paired homolog, Drosophila) (ZIC3, Accession NM_003413) is another VGAM1915 host target gene. ZIC3 BINDING SITE is HOST TARGET binding site found in the 3' untranslated region of mRNA encoded by ZIC3, corresponding to a HOST TARGET binding site such as BINDING SITE I, BINDING SITE II or BINDING SITE III. Table 2 illustrates the complementarity of the nucleotide sequences of ZIC3 BINDING SITE, designated SEQ ID:9450, to the nucleotide sequence of VGAM1915 RNA, herein designated VGAM RNA, also designated SEQ ID:4626.

Another function of VGAM1915 is therefore inhibition of Zic Family Member 3 Heterotaxy 1 (odd-paired homolog, Drosophila) (ZIC3, Accession NM_003413). Accordingly, utilities of VGAM1915 include diagnosis, prevention and treatment of diseases and clinical conditions associated with ZIC3. Chromosome 1 Open Reading Frame 19 (C1orf19, Accession XM_042962) is another VGAM1915 host target gene. C1orf19 BINDING SITE is HOST TARGET binding site found in the 3" untranslated region of mRNA encoded by C1orf19, corresponding to a HOST TARGET binding site such as BINDING SITE I, BINDING SITE II or BINDING SITE III. Table 2 illustrates the complementarity of the nucleotide sequences of C1orf19 BINDING SITE, designated SEQ ID:33840, to the nucleotide sequence of VGAM1915 RNA, herein designated VGAM RNA, also designated SEQ ID:4626.

Another function of VGAM1915 is therefore inhibition of Chromosome 1 Open Reading Frame 19 (C1orf19, Accession XM_042962). Accordingly, utilities of VGAM1915 include diagnosis, prevention and treatment of diseases and clinical conditions associated with C1orf19. DKFZP564I0422 (Accession NM_031435) is another VGAM1915 host target gene. DKFZP564I0422 BINDING SITE is HOST TARGET binding site found in the 3' untranslated region of mRNA encoded by DKFZP564I0422, corresponding to a HOST TARGET binding site such as BINDING SITE I, BINDING SITE II or BINDING SITE III. Table 2 illustrates the complementarity of the nucleotide sequences of DKFZP564I0422 BINDING SITE, designated SEQ ID:25432, to the nucleotide sequence of VGAM1915 RNA, herein designated VGAM RNA, also designated SEQ ID:4626.

Another function of VGAM1915 is therefore inhibition of DKFZP564I0422 (Accession NM_031435). Accordingly, utilities of VGAM1915 include diagnosis, prevention and treatment of diseases and clinical conditions associated with DKFZP564I0422. FACTP140 (Accession NM_007192) is another VGAM1915 host target gene. FACTP140 BINDING SITE is HOST TARGET binding site found in the 3' untranslated region of mRNA encoded by FACTP140, corresponding to a HOST TARGET binding site such as BINDING SITE I, BINDING SITE II or BINDING SITE III. Table 2 illustrates the complementarity of the nucleotide sequences of FACTP140 BINDING SITE, designated SEQ ID:14047, to the nucleotide sequence of VGAM1915 RNA, herein designated VGAM RNA, also designated SEQ ID:4626.

Another function of VGAM1915 is therefore inhibition of FACTP140 (Accession NM_007192). Accordingly, utilities of VGAM1915 include diagnosis, prevention and treatment of diseases and clinical conditions associated with FACTP140. FLJ12644 (Accession NM_023074) is another VGAM1915 host target gene. FLJ12644 BINDING SITE is HOST TARGET binding site found in the 3' untranslated region of mRNA encoded by FLJ12644, corresponding to a HOST TARGET binding site such as BINDING SITE I, BINDING SITE II or BINDING SITE III. Table 2 illustrates the complementarity of the nucleotide sequences of FLJ12644 BINDING SITE, designated SEQ ID:23330, to the nucleotide sequence of VGAM1915 RNA, herein designated VGAM RNA, also designated SEQ ID:4626.

Another function of VGAM1915 is therefore inhibition of FLJ12644 (Accession NM_023074). Accordingly, utilities of VGAM1915 include diagnosis, prevention and treatment of diseases and clinical conditions associated with FLJ12644. FLJ12806 (Accession NM_022831) is another VGAM1915 host target gene. FLJ12806 BINDING SITE is HOST TARGET binding site found in the 3' untranslated region of mRNA encoded by FLJ12806, corresponding to a HOST TARGET binding site such as BINDING SITE I, BINDING SITE II or BINDING SITE III. Table 2 illustrates the complementarity of the nucleotide sequences of FLJ12806 BINDING SITE, designated SEQ ID:23109, to the nucleotide sequence of VGAM1915 RNA, herein designated VGAM RNA, also designated SEQ ID:4626.

Another function of VGAM1915 is therefore inhibition of FLJ12806 (Accession NM_022831). Accordingly, utilities of VGAM1915 include diagnosis, prevention and treatment of diseases and clinical conditions associated with FLJ12806. FLJ22329 (Accession NM_024656) is another VGAM1915 host target gene. FLJ22329 BINDING SITE is HOST TARGET binding site found in the 3' untranslated region of mRNA encoded by FLJ22329, corresponding to a HOST TARGET binding site such as BINDING SITE I, BINDING SITE II or BINDING SITE III. Table 2 illustrates the complementarity of the nucleotide sequences of FLJ22329 BINDING SITE, designated SEQ ID:23960, to the nucleotide sequence of VGAM1915 RNA, herein designated VGAM RNA, also designated SEQ ID:4626.

Another function of VGAM1915 is therefore inhibition of FLJ22329 (Accession NM_024656). Accordingly, utilities of VGAM1915 include diagnosis, prevention and treatment of diseases and clinical conditions associated with FLJ22329. FLJ23045 (Accession NM_024704) is another VGAM1915 host target gene. FLJ23045 BINDING SITE is HOST TARGET binding site found in the 3' untranslated region of mRNA encoded by FLJ23045, corresponding to a HOST TARGET binding site such as BINDING SITE I, BINDING SITE II or BINDING SITE III. Table 2 illustrates the complementarity of the nucleotide sequences of FLJ23045 BINDING SITE, designated SEQ ID:24021, to the nucleotide sequence of VGAM1915 RNA, herein designated VGAM RNA, also designated SEQ ID:4626.

Another function of VGAM1915 is therefore inhibition of FLJ23045 (Accession NM_024704). Accordingly, utilities of VGAM1915 include diagnosis, prevention and treatment of diseases and clinical conditions associated with FLJ23045. Glia Maturation Factor, Beta (GMFB, Accession NM_004124) is another VGAM1915 host target gene. GMFB BINDING SITE is HOST TARGET binding site found in the 3' untranslated region of mRNA encoded by GMFB, corresponding to a HOST TARGET binding site such as BINDING SITE I, BINDING SITE II or BINDING SITE III. Table 2 illustrates the complementarity of the nucleotide sequences of GMFB BINDING SITE, designated SEQ ID:10329, to the nucleotide sequence of VGAM1915 RNA, herein designated VGAM RNA, also designated SEQ ID:4626.

Another function of VGAM1915 is therefore inhibition of Glia Maturation Factor, Beta (GMFB, Accession NM_004124). Accordingly, utilities of VGAM1915 include diagnosis, prevention and treatment of diseases and clinical conditions associated with GMFB. GOLGIN-67 (Accession XM_170772) is another VGAM1915 host target gene. GOLGIN-67 BINDING SITE is HOST TARGET binding site found in the 3' untranslated region of mRNA encoded by GOLGIN-67, corresponding to a HOST TARGET binding site such as BINDING SITE I, BINDING SITE II or BINDING SITE III. Table 2 illustrates the complementarity of the nucleotide sequences of GOLGIN-67 BINDING SITE, designated SEQ ID:45538, to the nucleotide sequence of VGAM1915 RNA, herein designated VGAM RNA, also designated SEQ ID:4626.

Another function of VGAM1915 is therefore inhibition of GOLGIN-67 (Accession XM_170772). Accordingly, utilities of VGAM1915 include diagnosis, prevention and treatment of diseases and clinical conditions associated with GOLGIN-67. KIAA0766 (Accession NM_014805) is another VGAM1915 host target gene. KIAA0766 BINDING SITE is HOST TARGET binding site found in the 3' untranslated region of mRNA encoded by KIAA0766, corresponding to a HOST TARGET binding site such as BINDING SITE I, BINDING SITE II or BINDING SITE III. Table 2 illustrates the complementarity of the nucleotide sequences of KIAA0766 BINDING SITE, designated SEQ ID:16741, to the nucleotide sequence of VGAM1915 RNA, herein designated VGAM RNA, also designated SEQ ID:4626.

Another function of VGAM1915 is therefore inhibition of KIAA0766 (Accession NM_014805). Accordingly, utilities of VGAM1915 include diagnosis, prevention and treatment of diseases and clinical conditions associated with KIAA0766. KIAA0855 (Accession NM_015003) is another VGAM1915 host target gene. KIAA0855 BINDING SITE is HOST TARGET binding site found in the 3' untranslated region of mRNA encoded by KIAA0855, corresponding to a HOST TARGET binding site such as BINDING SITE I, BINDING SITE II or BINDING SITE III. Table 2 illustrates the complementarity of the nucleotide sequences of KIAA0855 BINDING SITE, designated SEQ ID:17379, to the nucleotide sequence of VGAM1915 RNA, herein designated VGAM RNA, also designated SEQ ID:4626.

Another function of VGAM1915 is therefore inhibition of KIAA0855 (Accession NM_015003). Accordingly, utilities of VGAM1915 include diagnosis, prevention and treatment of diseases and clinical conditions associated with KIAA0855. KIAA0993 (Accession XM_034413) is another VGAM1915 host target gene. KIAA0993 BINDING SITE is HOST TARGET binding site found in the 3' untranslated region of mRNA encoded by KIAA0993, corresponding to a HOST TARGET binding site such as BINDING SITE I, BINDING SITE II or BINDING SITE III. Table 2 illustrates the complementarity of the nucleotide sequences of KIAA0993 BINDING SITE, designated SEQ ID:32076, to the nucleotide sequence of VGAM1915 RNA, herein designated VGAM RNA, also designated SEQ ID:4626.

Another function of VGAM1915 is therefore inhibition of KIAA0993 (Accession XM_034413). Accordingly, utilities of VGAM1915 include diagnosis, prevention and treatment of diseases and clinical conditions associated with KIAA0993. KIAA1323 (Accession XM_032146) is another VGAM1915 host target gene. KIAA1323 BINDING SITE is HOST TARGET binding site found in the 3' untranslated region of mRNA encoded by KIAA1323, corresponding to a HOST TARGET binding site such as BINDING SITE I, BINDING SITE II or BINDING SITE III. Table 2 illustrates the complementarity of the nucleotide sequences of KIAA1323 BINDING SITE, designated SEQ ID:31574, to the nucleotide sequence of VGAM1915 RNA, herein designated VGAM RNA, also designated SEQ ID:4626.

Another function of VGAM1915 is therefore inhibition of KIAA1323 (Accession XM_032146). Accordingly, utilities of VGAM1915 include diagnosis, prevention and treatment of diseases and clinical conditions associated with KIAA1323. Peroxisomal Biogenesis Factor 11B (PEX11B, Accession NM_003846) is another VGAM1915 host target gene. PEX11B BINDING SITE is HOST TARGET binding site found in the 3' untranslated region of mRNA encoded by PEX11B, corresponding to a HOST TARGET binding site such as BINDING SITE I, BINDING SITE II or BINDING SITE III. Table 2 illustrates the complementarity of the nucleotide sequences of PEX11B BINDING SITE, designated SEQ ID:9943, to the nucleotide sequence of VGAM1915 RNA, herein designated VGAM RNA, also designated SEQ ID:4626.

Another function of VGAM1915 is therefore inhibition of Peroxisomal Biogenesis Factor 11B (PEX11B, Accession NM_003846). Accordingly, utilities of VGAM1915 include diagnosis, prevention and treatment of diseases and clinical conditions associated with PEX11B. PRO1992 (Accession NM_014107) is another VGAM1915 host target gene. PRO1992 BINDING SITE is HOST TARGET binding site found in the 5' untranslated region of mRNA encoded by PRO1992, corresponding to a HOST TARGET binding site such as BINDING SITE I, BINDING SITE II or BINDING SITE III. Table 2 illustrates the complementarity of the nucleotide sequences of PRO1992 BINDING SITE, designated SEQ ID:15336, to the nucleotide sequence of VGAM1915 RNA, herein designated VGAM RNA, also designated SEQ ID:4626.

Another function of VGAM1915 is therefore inhibition of PRO1992 (Accession NM_014107). Accordingly, utilities of VGAM1915 include diagnosis, prevention and treatment of diseases and clinical conditions associated with PRO1992. RABEX5 (Accession NM_014504) is another VGAM1915 host target gene. RABEX5 BINDING SITE is HOST TARGET binding site found in the 3' untranslated region of mRNA encoded by RABEX5, corresponding to a HOST TARGET binding site such as BINDING SITE I, BINDING SITE II or BINDING SITE III. Table 2 illustrates the complementarity of the nucleotide sequences of RABEX5 BINDING SITE, designated SEQ ID:15841, to the nucleotide sequence of VGAM1915 RNA, herein designated VGAM RNA, also designated SEQ ID:4626.

Another function of VGAM1915 is therefore inhibition of RABEX5 (Accession NM_014504). Accordingly, utilities of VGAM1915 include diagnosis, prevention and treatment of diseases and clinical conditions associated with RABEX5. Retinoblastoma Binding Protein 4 (RBBP4, Accession NM_005610) is another VGAM1915 host target gene. RBBP4 BINDING SITE is HOST TARGET binding site found in the 3' untranslated region of mRNA encoded by RBBP4, corresponding to a HOST TARGET binding site such as BINDING SITE I, BINDING SITE II or BINDING SITE III. Table 2 illustrates the complementarity of the nucleotide sequences of RBBP4 BINDING SITE, designated SEQ ID:12131, to the nucleotide sequence of VGAM1915 RNA, herein designated VGAM RNA, also designated SEQ ID:4626.

Another function of VGAM1915 is therefore inhibition of Retinoblastoma Binding Protein 4 (RBBP4, Accession NM_005610). Accordingly, utilities of VGAM1915 include diagnosis, prevention and treatment of diseases and clinical conditions associated with RBBP4. Ring Finger Protein 24 (RNF24, Accession NM_007219) is another VGAM1915 host target gene. RNF24 BINDING SITE is HOST TARGET binding site found in the 3' untranslated region of mRNA encoded by RNF24, corresponding to a HOST TARGET binding site such as BINDING SITE I, BINDING SITE II or BINDING SITE III. Table 2 illustrates the complementarity of the nucleotide sequences of RNF24 BINDING SITE, designated SEQ ID:14085, to the nucleotide sequence of VGAM1915 RNA, herein designated VGAM RNA, also designated SEQ ID:4626.

Another function of VGAM1915 is therefore inhibition of Ring Finger Protein 24 (RNF24, Accession NM_007219). Accordingly, utilities of VGAM1915 include diagnosis, prevention and treatment of diseases and clinical conditions associated with RNF24. Solute Carrier Family 26, Member 10 (SLC26A10, Accession NM_133489) is another VGAM1915 host target gene. SLC26A10 BINDING SITE is HOST TARGET binding site found in the 5' untranslated region of mRNA encoded by SLC26A10, corresponding to a HOST TARGET binding site such as BINDING SITE I, BINDING SITE II or BINDING SITE III. Table 2 illustrates the complementarity of the nucleotide sequences of SLC26A10 BINDING SITE, designated SEQ ID:28558, to the nucleotide sequence of VGAM1915 RNA, herein designated VGAM RNA, also designated SEQ ID:4626.

Another function of VGAM1915 is therefore inhibition of Solute Carrier Family 26, Member 10 (SLC26A10, Accession NM_133489). Accordingly, utilities of VGAM1915 include diagnosis, prevention and treatment of diseases and clinical conditions associated with SLC26A10. Thioesterase, Adipose Associated (THEA, Accession XM_038922) is another VGAM1915 host target gene. THEA BINDING SITE is HOST TARGET binding site found in the 3' untranslated region of mRNA encoded by THEA, corresponding to a HOST TARGET binding site such as BINDING SITE I, BINDING SITE II or BINDING SITE III. Table 2 illustrates the complementarity of the nucleotide sequences of THEA BINDING SITE, designated SEQ ID:32946, to the nucleotide sequence of VGAM1915 RNA, herein designated VGAM RNA, also designated SEQ ID:4626.

Another function of VGAM1915 is therefore inhibition of Thioesterase, Adipose Associated (THEA, Accession XM_038922). Accordingly, utilities of VGAM1915 include diagnosis, prevention and treatment of diseases and clinical conditions associated with THEA. UPLC1 (Accession NM_017707) is another VGAM1915 host target gene. UPLC1 BINDING SITE is HOST TARGET binding site found in the 3' untranslated region of mRNA encoded by UPLC1, corresponding to a HOST TARGET binding site such as BINDING SITE I, BINDING SITE II or BINDING SITE III. Table 2 illustrates the complementarity of the nucleotide sequences of UPLC1 BINDING SITE, designated SEQ ID:19286, to the nucleotide sequence of VGAM1915 RNA, herein designated VGAM RNA, also designated SEQ ID:4626.

Another function of VGAM1915 is therefore inhibition of UPLC1 (Accession NM_017707). Accordingly, utilities of VGAM1915 include diagnosis, prevention and treatment of diseases and clinical conditions associated with UPLC1. LOC145988 (Accession XM_085290) is another VGAM1915 host target gene. LOC145988 BINDING SITE is HOST TARGET binding site found in the 3' untranslated region of mRNA encoded by LOC145988, corresponding to a HOST TARGET binding site such as BINDING SITE I, BINDING SITE II or BINDING SITE III. Table 2 illustrates the complementarity of the nucleotide sequences of LOC145988 BINDING SITE, designated SEQ ID:38044, to the nucleotide sequence of VGAM1915 RNA, herein designated VGAM RNA, also designated SEQ ID:4626.

Another function of VGAM1915 is therefore inhibition of LOC145988 (Accession XM_085290). Accordingly, utilities of VGAM1915 include diagnosis, prevention and treatment of diseases and clinical conditions associated with LOC145988. LOC146880 (Accession XM_085627) is another VGAM1915 host target gene. LOC146880 BINDING SITE is HOST TARGET binding site found in the 3' untranslated region of mRNA encoded by LOC146880, corresponding to a HOST TARGET binding site such as BINDING SITE I, BINDING SITE II or BINDING SITE III. Table 2 illustrates the complementarity of the nucleotide sequences of LOC146880 BINDING SITE, designated SEQ ID:38257, to the nucleotide sequence of VGAM1915 RNA, herein designated VGAM RNA, also designated SEQ ID:4626.

Another function of VGAM1915 is therefore inhibition of LOC146880 (Accession XM_085627). Accordingly, utilities of VGAM1915 include diagnosis, prevention and treatment of diseases and clinical conditions associated with LOC146880. LOC150519 (Accession XM_086937) is another VGAM1915 host target gene. LOC150519 BINDING SITE is HOST TARGET binding site found in the 3' untranslated region of mRNA encoded by LOC150519, corresponding to a HOST TARGET binding site such as BINDING SITE I, BINDING SITE II or BINDING SITE III. Table 2 illustrates the complementarity of the nucleotide sequences of LOC150519 BINDING SITE, designated SEQ ID:38988, to the nucleotide sequence of VGAM1915 RNA, herein designated VGAM RNA, also designated SEQ ID:4626.

Another function of VGAM1915 is therefore inhibition of LOC150519 (Accession XM_086937). Accordingly, utilities of VGAM1915 include diagnosis, prevention and treatment of diseases and clinical conditions associated with LOC150519. LOC152373 (Accession XM_087449) is another VGAM1915 host target gene. LOC152373 BINDING SITE is HOST TARGET binding site found in the 5' untranslated region of mRNA encoded by LOC152373, corresponding to a HOST TARGET binding site such as BINDING SITE I, BINDING SITE II or BINDING SITE III. Table 2 illustrates the complementarity of the nucleotide sequences of LOC152373 BINDING SITE, designated SEQ ID:39269, to the nucleotide sequence of VGAM1915 RNA, herein designated VGAM RNA, also designated SEQ ID:4626.

Another function of VGAM1915 is therefore inhibition of LOC152373 (Accession XM_087449). Accordingly, utilities of VGAM1915 include diagnosis, prevention and treatment of diseases and clinical conditions associated with LOC152373. LOC158969 (Accession XM_088728) is another VGAM1915 host target gene. LOC158969 BINDING SITE is HOST TARGET binding site found in the 5' untranslated region of mRNA encoded by LOC158969, corresponding to a HOST TARGET binding site such as BINDING SITE I, BINDING SITE II or BINDING SITE III. Table 2 illustrates the complementarity of the nucleotide sequences of LOC158969 BINDING SITE, designated SEQ ID:39917, to the nucleotide sequence of VGAM1915 RNA, herein designated VGAM RNA, also designated SEQ ID:4626.

Another function of VGAM1915 is therefore inhibition of LOC158969 (Accession XM_088728). Accordingly, utilities of VGAM1915 include diagnosis, prevention and treatment of diseases and clinical conditions associated with LOC158969. LOC220980 (Accession XM_167629) is another VGAM1915 host target gene. LOC220980 BINDING SITE is HOST TARGET binding site found in the 3' untranslated region of mRNA encoded by LOC220980, corresponding to a HOST TARGET binding site such as BINDING SITE I, BINDING SITE II or BINDING SITE III. Table 2 illustrates the complementarity of the nucleotide sequences of LOC220980 BINDING SITE, designated SEQ ID:44742, to the nucleotide sequence of VGAM1915 RNA, herein designated VGAM RNA, also designated SEQ ID:4626.

Another function of VGAM1915 is therefore inhibition of LOC220980 (Accession XM_167629). Accordingly, utilities of VGAM1915 include diagnosis, prevention and treatment of diseases and clinical conditions associated with LOC220980. LOC222999 (Accession XM_170185) is another VGAM1915 host target gene. LOC222999 BINDING SITE is HOST TARGET binding site found in the 5' untranslated region of mRNA encoded by LOC222999, corresponding to a HOST TARGET binding site such as BINDING SITE I, BINDING SITE II or BINDING SITE III. Table 2 illustrates the complementarity of the nucleotide sequences of LOC222999 BINDING SITE, designated SEQ ID:45312, to the nucleotide sequence of VGAM1915 RNA, herein designated VGAM RNA, also designated SEQ ID:4626.

Another function of VGAM1915 is therefore inhibition of LOC222999 (Accession XM_170185). Accordingly, utilities of VGAM1915 include diagnosis, prevention and treatment of diseases and clinical conditions associated with LOC222999. LOC51267 (Accession NM_016511) is another VGAM1915 host target gene. LOC51267 BINDING SITE is HOST TARGET binding site found in the 3' untranslated region of mRNA encoded by LOC51267, corresponding to a HOST TARGET binding site such as BINDING SITE I, BINDING SITE II or BINDING SITE III. Table 2 illustrates the complementarity of the nucleotide sequences of LOC51267 BINDING SITE, designated SEQ ID:18592, to the nucleotide sequence of VGAM1915 RNA, herein designated VGAM RNA, also designated SEQ ID:4626.

Another function of VGAM1915 is therefore inhibition of LOC51267 (Accession NM_016511). Accordingly, utilities of VGAM1915 include diagnosis, prevention and treatment of diseases and clinical conditions associated with LOC51267. LOC90268 (Accession XM_030424) is another VGAM1915 host target gene. LOC90268 BINDING SITE is HOST TARGET binding site found in the 3' untranslated region of mRNA encoded by LOC90268, corresponding to a HOST TARGET binding site such as BINDING SITE I, BINDING SITE II or BINDING SITE III. Table 2 illustrates the complementarity of the nucleotide sequences of LOC90268 BINDING SITE, designated SEQ ID:31044, to the nucleotide sequence of VGAM1915 RNA, herein designated VGAM RNA, also designated SEQ ID:4626.

Another function of VGAM1915 is therefore inhibition of LOC90268 (Accession XM_030424). Accordingly, utilities of VGAM1915 include diagnosis, prevention and treatment of diseases and clinical conditions associated with LOC90268. LOC91145 (Accession XM_036454) is another VGAM1915 host target gene. LOC91145 BINDING SITE is HOST TARGET binding site found in the 3' untranslated region of mRNA encoded by LOC91145, corresponding to a HOST TARGET binding site such as BINDING SITE I, BINDING SITE II or BINDING SITE III. Table 2 illustrates the complementarity of the nucleotide sequences of LOC91145 BINDING SITE, designated SEQ ID:32449, to the nucleotide sequence of VGAM1915 RNA, herein designated VGAM RNA, also designated SEQ ID:4626.

Another function of VGAM1915 is therefore inhibition of LOC91145 (Accession XM_036454). Accordingly, utilities of VGAM1915 include diagnosis, prevention and treatment of diseases and clinical conditions associated with LOC91145. LOC91963 (Accession XM_041902) is another VGAM1915 host target gene. LOC91963 BINDING SITE is HOST TARGET binding site found in the 3' untranslated region of mRNA encoded by LOC91963, corresponding to a HOST TARGET binding site such as BINDING SITE I, BINDING SITE II or BINDING SITE III. Table 2 illustrates the complementarity of the nucleotide sequences of LOC91963 BINDING SITE, designated SEQ ID:33627, to the nucleotide sequence of VGAM1915 RNA, herein designated VGAM RNA, also designated SEQ ID:4626.

Another function of VGAM1915 is therefore inhibition of LOC91963 (Accession XM_041902). Accordingly, utilities of VGAM1915 include diagnosis, prevention and treatment of diseases and clinical conditions associated with LOC91963. FIG. 1 further provides a conceptual description of a novel bioinformatically detected viral gene of the present invention, referred to here as Viral Genomic Address Messenger 1916 (VGAM1916) viral gene, which modulates expression of respective host target genes thereof, the function and utility of which host target genes is known in the art.

VGAM1916 is a novel bioinformatically detected regulatory, non protein coding, viral micro RNA (miRNA) gene. The method by which VGAM1916 was detected is described hereinabove with reference to FIGS. 1-8.

VGAM1916 gene, herein designated VGAM GENE, is a viral gene contained in the genome of Human Parainfluenza Virus 1 Strain Washington/1964. VGAM1916 host target gene, herein designated VGAM HOST TARGET GENE, is a human gene contained in the human genome.

VGAM1916 gene encodes a VGAM1916 precursor RNA, herein designated VGAM PRECURSOR RNA. Similar to other miRNA genes, and unlike most ordinary genes, VGAM1916 precursor RNA does not encode a protein. A nucleotide sequence identical or highly similar to the nucleotide sequence of VGAM1916 precursor RNA is designated SEQ ID:1902, and is provided hereinbelow with reference to the sequence listing part. Nucleotide sequence SEQ ID:1902 is located at position 4687 relative to the genome of Human Parainfluenza Virus 1 Strain Washington/1964.

VGAM1916 precursor RNA folds onto itself, forming VGAM1916 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1916 folded precursor RNA into VGAM1916 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1916 RNA is designated SEQ ID:4627, and is provided hereinbelow with reference to the sequence listing part.

VGAM1916 host target gene, herein designated VGAM HOST TARGET GENE, encodes a corresponding messenger RNA, VGAM1916 host target RNA, herein designated VGAM HOST TARGET RNA. VGAM1916 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1916 RNA, herein designated VGAM RNA, binds complementarily to one or more host target binding sites located in untranslated regions of VGAM1916 host target RNA, herein designated VGAM HOST TARGET RNA. This complementary binding is due to the fact that the nucleotide sequence of VGAM1916 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1916 RNA, herein designated VGAM RNA, may have a different number of host target binding sites in untranslated regions of a VGAM1916 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1916 RNA, herein designated VGAM RNA, to host target binding sites on VGAM1916 host target RNA, herein designated VGAM HOST TARGET RNA, such as BINDING SITE I, BINDING SITE II and BINDING SITE III, inhibits translation of VGAM1916 host target RNA into VGAM1916 host target protein, herein designated VGAM HOST TARGET PROTEIN. VGAM host target protein is therefore outlined by a broken line.

It is appreciated that VGAM1916 host target gene, herein designated VGAM HOST TARGET GENE, in fact represents a plurality of VGAM1916 host target genes. The mRNA of each one of this plurality of VGAM1916 host target genes comprises one or more host target binding sites, each having a nucleotide sequence which is at least partly complementary to VGAM1916 RNA, herein designated VGAM RNA, and which when bound by VGAM1916 RNA causes inhibition of translation of respective one or more VGAM1916 host target proteins.

It is further appreciated by one skilled in the art that the mode of translational inhibition illustrated by FIG. 1 with specific reference to translational inhibition exerted by VGAM1916 gene, herein designated VGAM GENE, on one or more VGAM1916 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1916 is inhibition of expression of host target genes, as part of a novel viral mechanism of attacking a host. Accordingly, utilities of VGAM1916 include diagnosis, prevention and treatment of viral infection by Human Parainfluenza Virus 1 Strain Washington/1964. Specific functions, and accordingly utilities, of VGAM1916 correlate with, and may be deduced from, the identity of the host target genes which VGAM1916 binds and inhibits, and the function of these host target genes, as elaborated hereinbelow.

Nucleotide sequences of the VGAM1916 precursor RNA, herein designated VGAM PRECURSOR RNA, and of the 'diced' VGAM1916 RNA, herein designated VGAM RNA, and a schematic representation of the secondary folding of VGAM1916 folded precursor RNA, herein designated VGAM FOLDED PRECURSOR RNA, of VGAM1916 are further described hereinbelow with reference to Table 1.

Nucleotide sequences of host target binding sites, such as BINDING SITE-I, BINDING SITE-II and BINDING SITE-III of FIG. 1, found on VGAM1916 host target RNA, and schematic representation of the complementarity of each of these host target binding sites to VGAM1916 RNA, herein designated VGAM RNA, are described hereinbelow with reference to Table 2.

As mentioned hereinabove with reference to FIG. 1, a function of VGAM1916 gene, herein designated VGAM is inhibition of expression of VGAM1916 target genes. It is appreciated that specific functions, and accordingly utilities, of VGAM1916 correlate with, and may be deduced from, the identity of the target genes which VGAM1916 binds and inhibits, and the function of these target genes, as elaborated hereinbelow.

AAT1 (Accession XM_087415) is a VGAM1916 host target gene. AAT1 BINDING SITE is HOST TARGET binding site found in the 3' untranslated region of mRNA encoded by AAT1, corresponding to a HOST TARGET binding site such as BINDING SITE I, BINDING SITE II or BINDING SITE III. Table 2 illustrates the complementarity of the nucleotide sequences of AAT1 BINDING SITE, designated SEQ ID:39227, to the nucleotide sequence of VGAM1916 RNA, herein designated VGAM RNA, also designated SEQ ID:4627.

A function of VGAM1916 is therefore inhibition of AAT1 (Accession XM_087415), a gene which linkage between A1BG and Lutheran blood group . Accordingly, utilities of VGAM1916 include diagnosis, prevention and treatment of diseases and clinical conditions associated with AAT1. The function of AAT1 and its association with various diseases and clinical conditions, has been established by previous studies, as described hereinabove with reference to VGAM357. Angiomotin Like 1 (AMOTL1, Accession XM_057045) is another VGAM1916 host target gene. AMOTL1 BINDING SITE is HOST TARGET binding site found in the 3' untranslated region of mRNA encoded by AMOTL1, corresponding to a HOST TARGET binding site such as BINDING SITE I, BINDING SITE II or BINDING SITE III. Table 2 illustrates the complementarity of the nucleotide sequences of AMOTL1 BINDING SITE, designated SEQ ID:36462, to the nucleotide sequence of VGAM1916 RNA, herein designated VGAM RNA, also designated SEQ ID:4627.

Another function of VGAM1916 is therefore inhibition of Angiomotin Like 1 (AMOTL1, Accession XM_057045). Accordingly, utilities of VGAM1916 include diagnosis, prevention and treatment of diseases and clinical conditions associated with AMOTL1. DKFZP564C196 (Accession XM_046405) is another VGAM1916 host target gene. DKFZP564C196 BINDING SITE is HOST TARGET binding site found in the 3' untranslated region of mRNA encoded by DKFZP564C196, corresponding to a HOST TARGET binding site such as BINDING SITE I, BINDING SITE II or BINDING SITE III. Table 2 illustrates the complementarity of the nucleotide sequences of DKFZP564C196 BINDING SITE, designated SEQ ID:34711, to the nucleotide sequence of VGAM1916 RNA, herein designated VGAM RNA, also designated SEQ ID:4627.

Another function of VGAM1916 is therefore inhibition of DKFZP564C196 (Accession XM_046405). Accordingly, utilities of VGAM1916 include diagnosis, prevention and treatment of diseases and clinical conditions associated with DKFZP564C196. EST-YD1 (Accession NM_021208) is another VGAM1916 host target gene. EST-YD1 BINDING SITE is HOST TARGET binding site found in the 5' untranslated region of mRNA encoded by EST-YD1, corresponding to a HOST TARGET binding site such as BINDING SITE I, BINDING SITE II or BINDING SITE III. Table 2 illustrates the complementarity of the nucleotide sequences of EST-YD1 BINDING SITE, designated SEQ ID:22186, to the nucleotide sequence of VGAM1916 RNA, herein designated VGAM RNA, also designated SEQ ID:4627.

Another function of VGAM1916 is therefore inhibition of EST-YD1 (Accession NM_021208). Accordingly, utilities of VGAM1916 include diagnosis, prevention and treatment of diseases and clinical conditions associated with EST-YD1. MGC4832 (Accession NM_145061) is another VGAM1916 host target gene. MGC4832 BINDING SITE is HOST TARGET binding site found in the 5' untranslated region of mRNA encoded by MGC4832, corresponding to a HOST TARGET binding site such as BINDING SITE I, BINDING SITE II or BINDING SITE III. Table 2 illustrates the complementarity of the nucleotide sequences of MGC4832 BINDING SITE, designated SEQ ID:29699, to the nucleotide sequence of VGAM1916 RNA, herein designated VGAM RNA, also designated SEQ ID:4627.

Another function of VGAM1916 is therefore inhibition of MGC4832 (Accession NM_145061). Accordingly, utilities of VGAM1916 include diagnosis, prevention and treatment of diseases and clinical conditions associated with MGC4832. SH3-domain Kinase Binding Protein 1 (SH3 kbP1, Accession XM_039010) is another VGAM1916 host target gene. SH3 kbP1 BINDING SITE is HOST TARGET binding site found in the 5' untranslated region of mRNA encoded by SH3 kbP1, corresponding to a HOST TARGET binding site such as BINDING SITE I, BINDING SITE II or BINDING SITE III. Table 2 illustrates the complementarity of the nucleotide sequences of SH3 kbP1 BINDING SITE, designated SEQ ID:32981, to the nucleotide sequence of VGAM1916 RNA, herein designated VGAM RNA, also designated SEQ ID:4627.

Another function of VGAM1916 is therefore inhibition of SH3-domain Kinase Binding Protein 1 (SH3 kbP1, Accession XM_039010). Accordingly, utilities of VGAM1916 include diagnosis, prevention and treatment of diseases and clinical conditions associated with SH3 kbP1. FIG. 1 further provides a conceptual description of a novel bioinformatically detected viral gene of the present invention, referred to here as Viral Genomic Address Messenger 1917 (VGAM1917) viral gene, which modulates expression of respective host target genes thereof, the function and utility of which host target genes is known in the art.

VGAM1917 is a novel bioinformatically detected regulatory, non protein coding, viral micro RNA (miRNA) gene. The method by which VGAM1917 was detected is described hereinabove with reference to FIGS. 1-8.

VGAM1917 gene, herein designated VGAM GENE, is a viral gene contained in the genome of Human Parainfluenza Virus 1 Strain Washington/1964. VGAM1917 host target gene, herein designated VGAM HOST TARGET GENE, is a human gene contained in the human genome.

VGAM1917 gene encodes a VGAM1917 precursor RNA, herein designated VGAM PRECURSOR RNA. Similar to other miRNA genes, and unlike most ordinary genes, VGAM1917 precursor RNA does not encode a protein. A nucleotide sequence identical or highly similar to the nucleotide sequence of VGAM1917 precursor RNA is designated SEQ ID:1903, and is provided hereinbelow with reference to the sequence listing part. Nucleotide sequence SEQ ID:1903 is located at position 14949 relative to the genome of Human Parainfluenza Virus 1 Strain Washington/1964.

VGAM1917 precursor RNA folds onto itself, forming VGAM1917 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1917 folded precursor RNA into VGAM1917 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM1917 RNA is designated SEQ ID:4628, and is provided hereinbelow with reference to the sequence listing part.

VGAM1917 host target gene, herein designated VGAM HOST TARGET GENE, encodes a corresponding messenger RNA, VGAM1917 host target RNA, herein designated VGAM HOST TARGET RNA. VGAM1917 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1917 RNA, herein designated VGAM RNA, binds complementarily to one or more host target binding sites located in untranslated regions of VGAM1917 host target RNA, herein designated VGAM HOST TARGET RNA. This complementary binding is due to the fact that the nucleotide sequence of VGAM1917 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1917 RNA, herein designated VGAM RNA, may have a different number of host target binding sites in untranslated regions of a VGAM1917 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1917 RNA, herein designated VGAM RNA, to host target binding sites on VGAM1917 host target RNA, herein designated VGAM HOST TARGET RNA, such as BINDING SITE I, BINDING SITE II and BINDING SITE III, inhibits translation of VGAM1917 host target RNA into VGAM1917 host target protein, herein designated VGAM HOST TARGET PROTEIN. VGAM host target protein is therefore outlined by a broken line.

It is appreciated that VGAM1917 host target gene, herein designated VGAM HOST TARGET GENE, in fact represents a plurality of VGAM1917 host target genes. The mRNA of each one of this plurality of VGAM1917 host target genes comprises one or more host target binding sites, each having a nucleotide sequence which is at least partly complementary to VGAM1917 RNA, herein designated VGAM RNA, and which when bound by VGAM1917 RNA causes inhibition of translation of respective one or more VGAM1917 host target proteins.

It is further appreciated by one skilled in the art that the mode of translational inhibition illustrated by FIG. 1 with specific reference to translational inhibition exerted by VGAM1917 gene, herein designated VGAM GENE, on one or more VGAM1917 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1917 is inhibition of expression of host target genes, as part of a novel viral mechanism of attacking a host. Accordingly, utilities of VGAM1917 include diagnosis, prevention and treatment of viral infection by Human Parainfluenza Virus 1 Strain Washington/1964. Specific functions, and accordingly utilities, of VGAM1917 correlate with, and may be deduced from, the identity of the host target genes which VGAM1917 binds and inhibits, and the function of these host target genes, as elaborated hereinbelow.

Nucleotide sequences of the VGAM1917 precursor RNA, herein designated VGAM PRECURSOR RNA, and of the 'diced' VGAM1917 RNA, herein designated VGAM RNA, and a schematic representation of the secondary folding of VGAM1917 folded precursor RNA, herein designated VGAM FOLDED PRECURSOR RNA, of VGAM1917 are further described hereinbelow with reference to Table 1.

Nucleotide sequences of host target binding sites, such as BINDING SITE-I, BINDING SITE-II and BINDING SITE-III of FIG. 1, found on VGAM1917 host target RNA, and schematic representation of the complementarity of each of these host target binding sites to VGAM1917 RNA, herein designated VGAM RNA, are described hereinbelow with reference to Table 2.

As mentioned hereinabove with reference to FIG. 1, a function of VGAM1917 gene, herein designated VGAM is inhibition of expression of VGAM1917 target genes. It is appreciated that specific functions, and accordingly utilities, of VGAM1917 correlate with, and may be deduced from, the identity of the target genes which VGAM1917 binds and inhibits, and the function of these target genes, as elaborated hereinbelow.

Adrenergic, Beta-3-, Receptor (ADRB3, Accession NM_000025) is a VGAM1917 host target gene. ADRB3 BINDING SITE is HOST TARGET binding site found in the 3' untranslated region of mRNA encoded by ADRB3, corresponding to a HOST TARGET binding site such as BINDING SITE I, BINDING SITE II or BINDING SITE III. Table 2 illustrates the complementarity of the nucleotide sequences of ADRB3 BINDING SITE, designated SEQ ID:5458, to the nucleotide sequence of VGAM1917 RNA, herein designated VGAM RNA, also designated SEQ ID:4628.

A function of VGAM1917 is therefore inhibition of Adrenergic, Beta-3-, Receptor (ADRB3, Accession NM_000025), a gene which stimulates adenylyl cyclase activity and regulates lipolysis. Accordingly, utilities of VGAM1917 include diagnosis, prevention and treatment of diseases and clinical conditions associated with ADRB3. The function of ADRB3 and its association with various diseases and clinical conditions, has been established by previous studies, as described hereinabove with reference to VGAM179. Fukuyama Type Congenital Muscular Dystrophy (fukutin) (FCMD, Accession NM_006731) is another VGAM1917 host target gene. FCMD BINDING SITE is HOST TARGET binding site found in the 3' untranslated region of mRNA encoded by FCMD, corresponding to a HOST TARGET binding site such as BINDING SITE I, BINDING SITE II or BINDING SITE III. Table 2 illustrates the complementarity of the nucleotide sequences of FCMD BINDING SITE, designated SEQ ID:13570, to the nucleotide sequence of VGAM1917 RNA, herein designated VGAM RNA, also designated SEQ ID:4628.

Another function of VGAM1917 is therefore inhibition of Fukuyama Type Congenital Muscular Dystrophy (fukutin) (FCMD, Accession NM_006731). Accordingly, utilities of VGAM1917 include diagnosis, prevention and treatment of diseases and clinical conditions associated with FCMD. Kallikrein 3, (prostate specific antigen) (KLK3, Accession NM_001648) is another VGAM1917 host target gene. KLK3 BINDING SITE is HOST TARGET binding site found in the 3' untranslated region of mRNA encoded by KLK3, corresponding to a HOST TARGET binding site such as BINDING SITE I, BINDING SITE II or BINDING SITE III. Table 2 illustrates the complementarity of the nucleotide sequences of KLK3 BINDING SITE, designated SEQ ID:7350, to the nucleotide sequence of VGAM1917 RNA, herein designated VGAM RNA, also designated SEQ ID:4628.

Another function of VGAM1917 is therefore inhibition of Kallikrein 3, (prostate specific antigen) (KLK3, Accession NM_001648), a gene which functions in the liquefaction of seminal coagulum. Accordingly, utilities of VGAM1917 include diagnosis, prevention and treatment of diseases and clinical conditions associated with KLK3. The function of KLK3 has been established by previous studies. Human prostate-specific antigen (APS) is a kallikrein-like protease present in seminal plasma. It is a single-chain glycoprotein with a molecular mass of about 33 kD which may function normally in the liquefaction of seminal coagulum. Radioimmunoassay of serum levels of this antigen (called PSA in the clinical setting) is useful in the diagnosis and monitoring of prostatic carcinoma (Stamey et al., 1987; Oesterling et al., 1988). (Because PSA is the symbol for the protein S alpha gene (OMIM Ref. No. 176880), APS is used as the gene symbol.) Lundwall and Lilja (1987) cloned a cDNA corresponding to APS, and Schulz et al. (1988) reported the complete sequence of a cDNA encompassing the immature human prostate-specific antigen and an unspliced leader sequence Bansal et al. (2000) investigated the interrelationships of age, PSA, and various zonal measurements in the prostate, and assessed the impact of heritable influences on total PSA. Eighty-four monozygotic twin pairs and 83 dizygotic twin pairs were studied, and serum total PSA, free PSA, and PSA-alpha-1-antichymotrypsin were measured. Their prostate volumes (total (TV), transition zone (TZ), and peripheral zone) were quantitated using transrectal ultrasound. Total PSA was significantly correlated with all zonal prostate measurements (TZ, peripheral zone, TV, and TZ/TV) and with age. When linear regression was applied, only age and TZ were retained in the final model. The proportion of variability in total PSA explained by these 2 factors, however, was below 24%. In contrast, estimates of heritability showed that approximately 45% of the variability in total PSA could be explained by inherited factors.

Full details of the abovementioned studies are described in the following publications, the disclosure of which are hereby incorporated by reference:

Bansal, A.; Murray, D. K.; Wu, J. T.; Stephenson, R. A.; Middleton, R. G.; Meikle, A. W.: Heritability of prostate-specific antigen and relationship with zonal prostate volumes in aging twins. J. Clin. Endocr. Metab. 85:1272-1276, 2000; and Sutherland, G. R.; Baker, E.; Hyland, V. J.; Callen, D. F.; Close, J. A.; Tregear, G. W.; Evans, B. A.; Richards, R. I.: Human prostate-specific antigen (APS) is a member of the gland.

Further studies establishing the function and utilities of KLK3 are found in John Hopkins OMIM database record ID 176820, and in sited publications numbered 1639-1640, 11095-11098, 10080-10081, 508 and 4159 listed in the bibliography section hereinbelow, which are also hereby incorporated by reference. LIM Domain Containing Preferred Translocation Partner In Lipoma (LPP, Accession NM_005578) is another VGAM1917 host target gene. LPP BINDING SITE is HOST TARGET binding site found in the 3' untranslated region of mRNA encoded by LPP, corresponding to a HOST TARGET binding site such as BINDING SITE I, BINDING SITE II or BINDING SITE III. Table 2 illustrates the complementarity of the nucleotide sequences of LPP BINDING SITE, designated SEQ ID:12105, to the nucleotide sequence of VGAM1917 RNA, herein designated VGAM RNA, also designated SEQ ID:4628.

Another function of VGAM1917 is therefore inhibition of LIM Domain Containing Preferred Translocation Partner In Lipoma (LPP, Accession NM_005578). Accordingly, utilities of VGAM1917 include diagnosis, prevention and treatment of diseases and clinical conditions associated with LPP. RAB11A, Member RAS Oncogene Family (RAB11A, Accession NM_004663) is another VGAM1917 host target gene. RAB11A BINDING SITE is HOST TARGET binding site found in the 3' untranslated region of mRNA encoded by RAB11A, corresponding to a HOST TARGET binding site such as BINDING SITE I, BINDING SITE II or BINDING SITE III. Table 2 illustrates the complementarity of the nucleotide sequences of RAB11A BINDING SITE, designated SEQ ID:11035, to the nucleotide sequence of VGAM1917 RNA, herein designated VGAM RNA, also designated SEQ ID:4628.

Another function of VGAM1917 is therefore inhibition of RAB11A, Member RAS Oncogene Family (RAB11A, Accession NM_004663). Accordingly, utilities of VGAM1917 include diagnosis, prevention and treatment of diseases and clinical conditions associated with RAB11A. HCC-4 (Accession NM_138611) is another VGAM1917 host target gene. HCC-4 BINDING SITE is HOST TARGET binding site found in the 3' untranslated region of mRNA encoded by HCC-4, corresponding to a HOST TARGET binding site such as BINDING SITE I, BINDING SITE II or BINDING SITE III. Table 2 illustrates the complementarity of the nucleotide sequences of HCC-4 BINDING SITE, designated SEQ ID:28899, to the nucleotide sequence of VGAM1917 RNA, herein designated VGAM RNA, also designated SEQ ID:4628.

Another function of VGAM1917 is therefore inhibition of HCC-4 (Accession NM_138611). Accordingly, utilities of VGAM1917 include diagnosis, prevention and treatment of diseases and clinical conditions associated with HCC-4. IBTK (Accession XM_041401) is another VGAM1917 host target gene. IBTK BINDING SITE is HOST TARGET binding site found in the 5' untranslated region of mRNA encoded by IBTK, corresponding to a HOST TARGET binding site such as BINDING SITE I, BINDING SITE II or BINDING SITE III. Table 2 illustrates the complementarity of the nucleotide sequences of IBTK BINDING SITE, designated SEQ ID:33517, to the nucleotide sequence of VGAM1917 RNA, herein designated VGAM RNA, also designated SEQ ID:4628.

Another function of VGAM1917 is therefore inhibition of IBTK (Accession XM_041401). Accordingly, utilities of VGAM1917 include diagnosis, prevention and treatment of diseases and clinical conditions associated with IBTK. KIAA1641 (Accession XM_087167) is another VGAM1917 host target gene. KIAA1641 BINDING SITE is HOST TARGET binding site found in the 3" untranslated region of mRNA encoded by KIAA1641, corresponding to a HOST TARGET binding site such as BINDING SITE I, BINDING SITE II or BINDING SITE III. Table 2 illustrates the complementarity of the nucleotide sequences of KIAA1641 BINDING SITE, designated SEQ ID:39099, to the nucleotide sequence of VGAM1917 RNA, herein designated VGAM RNA, also designated SEQ ID:4628.

Another function of VGAM1917 is therefore inhibition of KIAA1641 (Accession XM_087167). Accordingly, utilities of VGAM1917 include diagnosis, prevention and treatment of diseases and clinical conditions associated with KIAA1641. LOC220846 (Accession XM_165515) is another VGAM1917 host target gene. LOC220846 BINDING SITE is HOST TARGET binding site found in the 3' untranslated region of mRNA encoded by LOC220846, corresponding to a HOST TARGET binding site such as BINDING SITE I, BINDING SITE II or BINDING SITE III. Table 2 illustrates the complementarity of the nucleotide sequences of LOC220846 BINDING SITE, designated SEQ ID:43660, to the nucleotide sequence of VGAM1917 RNA, herein designated VGAM RNA, also designated SEQ ID:4628.

Another function of VGAM1917 is therefore inhibition of LOC220846 (Accession XM_165515). Accordingly, utilities of VGAM1917 include diagnosis, prevention and treatment of diseases and clinical conditions associated with LOC220846. FIG. 1 further provides a conceptual description of a novel bioinformatically detected viral gene of the present invention, referred to here as Viral Genomic Address Messenger 1918 (VGAM1918) viral gene, which modulates expression of respective host target genes thereof, the function and utility of which host target genes is known in the art.

VGAM1918 is a novel bioinformatically detected regulatory, non protein coding, viral micro RNA (miRNA) gene. The method by which VGAM1918 was detected is described hereinabove with reference to FIGS. 1-8.

VGAM1918 gene, herein designated VGAM GENE, is a viral gene contained in the genome of Human Parainfluenza Virus 1 Strain Washington/1964. VGAM1918 host target gene, herein designated VGAM HOST TARGET GENE, is a human gene contained in the human genome.

VGAM1918 gene encodes a VGAM1918 precursor RNA, herein designated VGAM PRECURSOR RNA. Similar to other miRNA genes, and unlike most ordinary genes, VGAM1918 precursor RNA does not encode a protein. A nucleotide sequence identical or highly similar to the nucleotide sequence of VGAM1918 precursor RNA is designated SEQ ID:1904, and is provided hereinbelow with reference to the sequence listing part. Nucleotide sequence SEQ ID:1904 is located at position 7051 relative to the genome of Human Parainfluenza Virus 1 Strain Washington/1964.

VGAM1918 precursor RNA folds onto itself, forming VGAM1918 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1918 folded precursor RNA into VGAM1918 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1918 RNA is designated SEQ ID:4629, and is provided hereinbelow with reference to the sequence listing part.

VGAM1918 host target gene, herein designated VGAM HOST TARGET GENE, encodes a corresponding messenger RNA, VGAM1918 host target RNA, herein designated VGAM HOST TARGET RNA. VGAM1918 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1918 RNA, herein designated VGAM RNA, binds complementarily to one or more host target binding sites located in untranslated regions of VGAM1918 host target RNA, herein designated VGAM HOST TARGET RNA. This complementary binding is due to the fact that the nucleotide sequence of VGAM1918 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1918 RNA, herein designated VGAM RNA, may have a different number of host target binding sites in untranslated regions of a VGAM1918 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1918 RNA, herein designated VGAM RNA, to host target binding sites on VGAM1918 host target RNA, herein designated VGAM HOST TARGET RNA, such as BINDING SITE I, BINDING SITE II and BINDING SITE III, inhibits translation of VGAM1918 host target RNA into VGAM1918 host target protein, herein designated VGAM HOST TARGET PROTEIN. VGAM host target protein is therefore outlined by a broken line.

It is appreciated that VGAM1918 host target gene, herein designated VGAM HOST TARGET GENE, in fact represents a plurality of VGAM1918 host target genes. The mRNA of each one of this plurality of VGAM1918 host target genes comprises one or more host target binding sites, each having a nucleotide sequence which is at least partly complementary to VGAM1918 RNA, herein designated VGAM RNA, and which when bound by VGAM1918 RNA causes inhibition of translation of respective one or more VGAM1918 host target proteins.

It is further appreciated by one skilled in the art that the mode of translational inhibition illustrated by FIG. 1 with specific reference to translational inhibition exerted by VGAM1918 gene, herein designated VGAM GENE, on one or more VGAM1918 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1918 is inhibition of expression of host target genes, as part of a novel viral mechanism of attacking a host. Accordingly, utilities of VGAM1918 include diagnosis, prevention and treatment of viral infection by Human Parainfluenza Virus 1 Strain Washington/1964. Specific functions, and accordingly utilities, of VGAM1918 correlate with, and may be deduced from, the identity of the host target genes which VGAM1918 binds and inhibits, and the function of these host target genes, as elaborated hereinbelow.

Nucleotide sequences of the VGAM1918 precursor RNA, herein designated VGAM PRECURSOR RNA, and of the 'diced' VGAM1918 RNA, herein designated VGAM RNA, and a schematic representation of the secondary folding of VGAM1918 folded precursor RNA, herein designated VGAM FOLDED PRECURSOR RNA, of VGAM1918 are further described hereinbelow with reference to Table 1.

Nucleotide sequences of host target binding sites, such as BINDING SITE-I, BINDING SITE-II and BINDING SITE-III of FIG. 1, found on VGAM1918 host target RNA, and schematic representation of the complementarity of each of these host target binding sites to VGAM1918 RNA, herein designated VGAM RNA, are described hereinbelow with reference to Table 2.

As mentioned hereinabove with reference to FIG. 1, a function of VGAM1918 gene, herein designated VGAM is inhibition of expression of VGAM1918 target genes. It is appreciated that specific functions, and accordingly utilities, of VGAM1918 correlate with, and may be deduced from, the identity of the target genes which VGAM1918 binds and inhibits, and the function of these target genes, as elaborated hereinbelow.

KIAA1036 (Accession NM_014909) is a VGAM1918 host target gene. KIAA1036 BINDING SITE is HOST TARGET binding site found in the 3' untranslated region of mRNA encoded by KIAA1036, corresponding to a HOST TARGET binding site such as BINDING SITE I, BINDING SITE II or BINDING SITE III. Table 2 illustrates the complementarity of the nucleotide sequences of KIAA1036 BINDING SITE, designated SEQ ID:17124, to the nucleotide sequence of VGAM1918 RNA, herein designated VGAM RNA, also designated SEQ ID:4629.

A function of VGAM1918 is therefore inhibition of KIAA1036 (Accession NM_014909). Accordingly, utilities of VGAM1918 include diagnosis, prevention and treatment of diseases and clinical conditions associated with KIAA1036. LOC146713 (Accession XM_097071) is another VGAM1918 host target gene. LOC146713 BINDING SITE is HOST TARGET binding site found in the 3' untranslated region of mRNA encoded by LOC146713, corresponding to a HOST TARGET binding site such as BINDING SITE I, BINDING SITE II or BINDING SITE III. Table 2 illustrates the complementarity of the nucleotide sequences of LOC146713 BINDING SITE, designated SEQ ID:40716, to the nucleotide sequence of VGAM1918 RNA, herein designated VGAM RNA, also designated SEQ ID:4629.

Another function of VGAM1918 is therefore inhibition of LOC146713 (Accession XM_097071). Accordingly, utilities of VGAM1918 include diagnosis, prevention and treatment of diseases and clinical conditions associated with LOC146713. FIG. 1 further provides a conceptual description of a novel bioinformatically detected viral gene of the present invention, referred to here as Viral Genomic Address Messenger 1919 (VGAM1919) viral gene, which modulates expression of respective host target genes thereof, the function and utility of which host target genes is known in the art.

VGAM1919 is a novel bioinformatically detected regulatory, non protein coding, viral micro RNA (miRNA) gene. The method by which VGAM1919 was detected is described hereinabove with reference to FIGS. 1-8.

VGAM1919 gene, herein designated VGAM GENE, is a viral gene contained in the genome of Equine Herpesvirus 1. VGAM1919 host target gene, herein designated VGAM HOST TARGET GENE, is a human gene contained in the human genome.

VGAM1919 gene encodes a VGAM1919 precursor RNA, herein designated VGAM PRECURSOR RNA. Similar to other miRNA genes, and unlike most ordinary genes, VGAM1919 precursor RNA does not encode a protein. A nucleotide sequence identical or highly similar to the nucleotide sequence of VGAM1919 precursor RNA is designated SEQ ID:1905, and is provided hereinbelow with reference to the sequence listing part. Nucleotide sequence SEQ ID:1905 is located at position 109925 relative to the genome of Equine Herpesvirus 1.

VGAM1919 precursor RNA folds onto itself, forming VGAM1919 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1919 folded precursor RNA into VGAM1919 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1919 RNA is designated SEQ ID:4630, and is provided hereinbelow with reference to the sequence listing part.

VGAM1919 host target gene, herein designated VGAM HOST TARGET GENE, encodes a corresponding messenger RNA, VGAM1919 host target RNA, herein designated VGAM HOST TARGET RNA. VGAM1919 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1919 RNA, herein designated VGAM RNA, binds complementarily to one or more host target binding sites located in untranslated regions of VGAM1919 host target RNA, herein designated VGAM HOST TARGET RNA. This complementary binding is due to the fact that the nucleotide sequence of VGAM1919 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1919 RNA, herein designated VGAM RNA, may have a different number of host target binding sites in untranslated regions of a VGAM1919 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1919 RNA, herein designated VGAM RNA, to host target binding sites on VGAM1919 host target RNA, herein designated VGAM HOST TARGET RNA, such as BINDING SITE I, BINDING SITE II and BINDING SITE III, inhibits translation of VGAM1919 host target RNA into VGAM1919 host target protein, herein designated VGAM HOST TARGET PROTEIN. VGAM host target protein is therefore outlined by a broken line.

It is appreciated that VGAM1919 host target gene, herein designated VGAM HOST TARGET GENE, in fact represents a plurality of VGAM1919 host target genes. The mRNA of each one of this plurality of VGAM1919 host target genes comprises one or more host target binding sites, each having a nucleotide sequence which is at least partly complementary to VGAM1919 RNA, herein designated VGAM RNA, and which when bound by VGAM1919 RNA causes inhibition of translation of respective one or more VGAM1919 host target proteins.

It is further appreciated by one skilled in the art that the mode of translational inhibition illustrated by FIG. 1 with specific reference to translational inhibition exerted by VGAM1919 gene, herein designated VGAM GENE, on one or more VGAM1919 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1919 is inhibition of expression of host target genes, as part of a novel viral mechanism of attacking a host. Accordingly, utilities of VGAM1919 include diagnosis, prevention and treatment of viral infection by Equine Herpesvirus 1. Specific functions, and accordingly utilities, of VGAM1919 correlate with, and may be deduced from, the identity of the host target genes which VGAM1919 binds and inhibits, and the function of these host target genes, as elaborated hereinbelow.

Nucleotide sequences of the VGAM1919 precursor RNA, herein designated VGAM PRECURSOR RNA, and of the 'diced' VGAM1919 RNA, herein designated VGAM RNA, and a schematic representation of the secondary folding of VGAM1919 folded precursor RNA, herein designated VGAM FOLDED PRECURSOR RNA, of VGAM1919 are further described hereinbelow with reference to Table 1.

Nucleotide sequences of host target binding sites, such as BINDING SITE-I, BINDING SITE-II and BINDING SITE-III of FIG. 1, found on VGAM1919 host target RNA, and schematic representation of the complementarity of each of these host target binding sites to VGAM1919 RNA, herein designated VGAM RNA, are described hereinbelow with reference to Table 2.

As mentioned hereinabove with reference to FIG. 1, a function of VGAM1919 gene, herein designated VGAM is inhibition of expression of VGAM1919 target genes. It is appreciated that specific functions, and accordingly utilities, of VGAM1919 correlate with, and may be deduced from, the identity of the target genes which VGAM1919 binds and inhibits, and the function of these target genes, as elaborated hereinbelow.

Solute Carrier Family 6 (neurotransmitter transporter, creatine), Member 8 (SLC6A8, Accession NM_005629) is a VGAM1919 host target gene. SLC6A8 BINDING SITE is HOST TARGET binding site found in the 3' untranslated region of mRNA encoded by SLC6A8, corresponding to a HOST TARGET binding site such as BINDING SITE I, BINDING SITE II or BINDING SITE III. Table 2 illustrates the complementarity of the nucleotide sequences of SLC6A8 BINDING SITE, designated SEQ ID:12147, to the nucleotide sequence of VGAM1919 RNA, herein designated VGAM RNA, also designated SEQ ID:4630.

A function of VGAM1919 is therefore inhibition of Solute Carrier Family 6 (neurotransmitter transporter, creatine), Member 8 (SLC6A8, Accession NM_005629). Accordingly, utilities of VGAM1919 include diagnosis, prevention and treatment of diseases and clinical conditions associated with SLC6A8. Telomeric Repeat Binding Factor (NIMA-interacting) 1 (TERF1, Accession NM_017489) is another VGAM1919 host target gene. TERF1 BINDING SITE is HOST TARGET binding site found in the 3' untranslated region of mRNA encoded by TERF1, corresponding to a HOST TARGET binding site such as BINDING SITE I, BINDING SITE II or BINDING SITE III. Table 2 illustrates the complementarity of the nucleotide sequences of TERF1 BINDING SITE, designated SEQ ID:18953, to the nucleotide sequence of VGAM1919 RNA, herein designated VGAM RNA, also designated SEQ ID:4630.

Another function of VGAM1919 is therefore inhibition of Telomeric Repeat Binding Factor (NIMA-interacting) 1 (TERF1, Accession NM_017489), a gene which negatively regulates telomere length, involves in regulation of the mitotic spindle. Accordingly, utilities of VGAM1919 include diagnosis, prevention and treatment of diseases and clinical conditions associated with TERF1. The function of TERF1 and its association with various diseases and clinical conditions, has been established by previous studies, as described hereinabove with reference to VGAM189. Microtubule-actin Crosslinking Factor 1 (MACF1, Accession NM_012090) is another VGAM1919 host target gene. MACF1 BINDING SITE is HOST TARGET binding site found in the 3' untranslated region of mRNA encoded by MACF1, corresponding to a HOST TARGET binding site such as BINDING SITE I, BINDING SITE II or BINDING SITE III. Table 2 illustrates the complementarity of the nucleotide sequences of MACF1 BINDING SITE, designated SEQ ID:14376, to the nucleotide sequence of VGAM1919 RNA, herein designated VGAM RNA, also designated SEQ ID:4630.

Another function of VGAM1919 is therefore inhibition of Microtubule-actin Crosslinking Factor 1 (MACF1, Accession NM_012090). Accordingly, utilities of VGAM1919 include diagnosis, prevention and treatment of diseases and clinical conditions associated with MACF1. Testis-specific Kinase 2 (TESK2, Accession XM_032399) is another VGAM1919 host target gene. TESK2 BINDING SITE is HOST TARGET binding site found in the 3' untranslated region of mRNA encoded by TESK2, corresponding to a HOST TARGET binding site such as BINDING SITE I, BINDING SITE II or BINDING SITE III. Table 2 illustrates the complementarity of the nucleotide sequences of TESK2 BINDING SITE, designated SEQ ID:31652, to the nucleotide sequence of VGAM1919 RNA, herein designated VGAM RNA, also designated SEQ ID:4630.

Another function of VGAM1919 is therefore inhibition of Testis-specific Kinase 2 (TESK2, Accession XM_032399). Accordingly, utilities of VGAM1919 include diagnosis, prevention and treatment of diseases and clinical conditions associated with TESK2. LOC146488 (Accession XM_047748) is another VGAM1919 host target gene. LOC146488 BINDING SITE is HOST TARGET binding site found in the 3' untranslated region of mRNA encoded by LOC146488, corresponding to a HOST TARGET binding site such as BINDING SITE I, BINDING SITE II or BINDING SITE III. Table 2 illustrates the complementarity of the nucleotide sequences of LOC146488 BINDING SITE, designated SEQ ID:35043, to the nucleotide sequence of VGAM1919 RNA, herein designated VGAM RNA, also designated SEQ ID:4630.

Another function of VGAM1919 is therefore inhibition of LOC146488 (Accession XM_047748). Accordingly, utilities of VGAM1919 include diagnosis, prevention and treatment of diseases and clinical conditions associated with LOC146488. LOC152620 (Accession XM_011108) is another VGAM1919 host target gene. LOC152620 BINDING SITE is HOST TARGET binding site found in the 3' untranslated region of mRNA encoded by LOC152620, corresponding to a HOST TARGET binding site such as BINDING SITE I, BINDING SITE II or BINDING SITE III. Table 2 illustrates the complementarity of the nucleotide sequences of LOC152620 BINDING SITE, designated SEQ ID:30175, to the nucleotide sequence of VGAM1919 RNA, herein designated VGAM RNA, also designated SEQ ID:4630.

Another function of VGAM1919 is therefore inhibition of LOC152620 (Accession XM_011108). Accordingly, utilities of VGAM1919 include diagnosis, prevention and treatment of diseases and clinical conditions associated with LOC152620. LOC158668 (Accession XM_045161) is another VGAM1919 host target gene. LOC158668 BINDING SITE is HOST TARGET binding site found in the 3' untranslated region of mRNA encoded by LOC158668, corresponding to a HOST TARGET binding site such as BINDING SITE I, BINDING SITE II or BINDING SITE III. Table 2 illustrates the complementarity of the nucleotide sequences of LOC158668 BINDING SITE, designated SEQ ID:34378, to the nucleotide sequence of VGAM1919 RNA, herein designated VGAM RNA, also designated SEQ ID:4630.

Another function of VGAM1919 is therefore inhibition of LOC158668 (Accession XM_045161). Accordingly, utilities of VGAM1919 include diagnosis, prevention and treatment of diseases and clinical conditions associated with LOC158668. LOC257000 (Accession XM_172999) is another VGAM1919 host target gene. LOC257000 BINDING SITE is HOST TARGET binding site found in the 3' untranslated region of mRNA encoded by LOC257000, corresponding to a HOST TARGET binding site such as BINDING SITE I, BINDING SITE II or BINDING SITE III. Table 2 illustrates the complementarity of the nucleotide sequences of LOC257000 BINDING SITE, designated SEQ ID:46273, to the nucleotide sequence of VGAM1919 RNA, herein designated VGAM RNA, also designated SEQ ID:4630.

Another function of VGAM1919 is therefore inhibition of LOC257000 (Accession XM_172999). Accordingly, utilities of VGAM1919 include diagnosis, prevention and treatment of diseases and clinical conditions associated with LOC257000. FIG. 1 further provides a conceptual description of a novel bioinformatically detected viral gene of the present invention, referred to here as Viral Genomic Address Messenger 1920 (VGAM1920) viral gene, which modulates expression of respective host target genes thereof, the function and utility of which host target genes is known in the art.

VGAM1920 is a novel bioinformatically detected regulatory, non protein coding, viral micro RNA (miRNA) gene. The method by which VGAM1920 was detected is described hereinabove with reference to FIGS. 1-8.

VGAM1920 gene, herein designated VGAM GENE, is a viral gene contained in the genome of Canine Distemper Virus. VGAM1920 host target gene, herein designated VGAM HOST TARGET GENE, is a human gene contained in the human genome.

VGAM1920 gene encodes a VGAM1920 precursor RNA, herein designated VGAM PRECURSOR RNA. Similar to other miRNA genes, and unlike most ordinary genes, VGAM1920 precursor RNA does not encode a protein. A nucleotide sequence identical or highly similar to the nucleotide sequence of VGAM1920 precursor RNA is designated SEQ ID:1906, and is provided hereinbelow with reference to the sequence listing part. Nucleotide sequence SEQ ID:1906 is located at position 12749 relative to the genome of Canine Distemper Virus.

VGAM1920 precursor RNA folds onto itself, forming VGAM1920 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1920 folded precursor RNA into VGAM1920 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1920 RNA is designated SEQ ID:4631, and is provided hereinbelow with reference to the sequence listing part.

VGAM1920 host target gene, herein designated VGAM HOST TARGET GENE, encodes a corresponding messenger RNA, VGAM1920 host target RNA, herein designated VGAM HOST TARGET RNA. VGAM1920 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1920 RNA, herein designated VGAM RNA, binds complementarily to one or more host target binding sites located in untranslated regions of VGAM1920 host target RNA, herein designated VGAM HOST TARGET RNA. This complementary binding is due to the fact that the nucleotide sequence of VGAM1920 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1920 RNA, herein designated VGAM RNA, may have a different number of host target binding sites in untranslated regions of a VGAM1920 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1920 RNA, herein designated VGAM RNA, to host target binding sites on VGAM1920 host target RNA, herein designated VGAM HOST TARGET RNA, such as BINDING SITE I, BINDING SITE II and BINDING SITE III, inhibits translation of VGAM1920 host target RNA into VGAM1920 host target protein, herein designated VGAM HOST TARGET PROTEIN. VGAM host target protein is therefore outlined by a broken line.

It is appreciated that VGAM1920 host target gene, herein designated VGAM HOST TARGET GENE, in fact represents a plurality of VGAM1920 host target genes. The mRNA of each one of this plurality of VGAM1920 host target genes comprises one or more host target binding sites, each having a nucleotide sequence which is at least partly complementary to VGAM1920 RNA, herein designated VGAM RNA, and which when bound by VGAM1920 RNA causes inhibition of translation of respective one or more VGAM1920 host target proteins.

It is further appreciated by one skilled in the art that the mode of translational inhibition illustrated by FIG. 1 with specific reference to translational inhibition exerted by VGAM1920 gene, herein designated VGAM GENE, on one or more VGAM1920 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1920 is inhibition of expression of host target genes, as part of a novel viral mechanism of attacking a host. Accordingly, utilities of VGAM1920 include diagnosis, prevention and treatment of viral infection by Canine Distemper Virus. Specific functions, and accordingly utilities, of VGAM1920 correlate with, and may be deduced from, the identity of the host target genes which VGAM1920 binds and inhibits, and the function of these host target genes, as elaborated hereinbelow.

Nucleotide sequences of the VGAM1920 precursor RNA, herein designated VGAM PRECURSOR RNA, and of the 'diced' VGAM1920 RNA, herein designated VGAM RNA, and a schematic representation of the secondary folding of VGAM1920 folded precursor RNA, herein designated VGAM FOLDED PRECURSOR RNA, of VGAM1920 are further described hereinbelow with reference to Table 1.

Nucleotide sequences of host target binding sites, such as BINDING SITE-I, BINDING SITE-II and BINDING SITE-III of FIG. 1, found on VGAM1920 host target RNA, and schematic representation of the complementarity of each of these host target binding sites to VGAM1920 RNA, herein designated VGAM RNA, are described hereinbelow with reference to Table 2.

As mentioned hereinabove with reference to FIG. 1, a function of VGAM1920 gene, herein designated VGAM is inhibition of expression of VGAM1920 target genes. It is appreciated that specific functions, and accordingly utilities, of VGAM1920 correlate with, and may be deduced from, the identity of the target genes which VGAM1920 binds and inhibits, and the function of these target genes, as elaborated hereinbelow.

Interleukin 22 Receptor, Alpha 2 (IL22RA2, Accession NM_052962) is a VGAM1920 host target gene. IL22RA2 BINDING SITE is HOST TARGET binding site found in the 3' untranslated region of mRNA encoded by IL22RA2, corresponding to a HOST TARGET binding site such as BINDING SITE I, BINDING SITE II or BINDING SITE III. Table 2 illustrates the complementarity of the nucleotide sequences of IL22RA2 BINDING SITE, designated SEQ ID:27520, to the nucleotide sequence of VGAM1920 RNA, herein designated VGAM RNA, also designated SEQ ID:4631.

A function of VGAM1920 is therefore inhibition of Interleukin 22 Receptor, Alpha 2 (IL22RA2, Accession NM_052962), a gene which induces the production of acute-phase reactants. Accordingly, utilities of VGAM1920 include diagnosis, prevention and treatment of diseases and clinical conditions associated with IL22RA2. The function of IL22RA2 and its association with various diseases and clinical conditions, has been established by previous studies, as described hereinabove with reference to VGAM167. DKFZp566D133 (Accession XM_050005) is another VGAM1920 host target gene. DKFZp566D133 BINDING SITE is HOST TARGET binding site found in the 5' untranslated region of mRNA encoded by DKFZp566D133, corresponding to a HOST TARGET binding site such as BINDING SITE I, BINDING SITE II or BINDING SITE III. Table 2 illustrates the complementarity of the nucleotide sequences of DKFZp566D133 BINDING SITE, designated SEQ ID:35542, to the nucleotide sequence of VGAM1920 RNA, herein designated VGAM RNA, also designated SEQ ID:4631.

Another function of VGAM1920 is therefore inhibition of DKFZp566D133 (Accession XM_050005). Accordingly, utilities of VGAM1920 include diagnosis, prevention and treatment of diseases and clinical conditions associated with DKFZp566D133. FLJ11160 (Accession NM_018344) is another VGAM1920 host target gene. FLJ11160 BINDING SITE is HOST TARGET binding site found in the 3' untranslated region of mRNA encoded by FLJ11160, corresponding to a HOST TARGET binding site such as BINDING SITE I, BINDING SITE II or BINDING SITE III. Table 2 illustrates the complementarity of the nucleotide sequences of FLJ11160 BINDING SITE, designated SEQ ID:20350, to the nucleotide sequence of VGAM1920 RNA, herein designated VGAM RNA, also designated SEQ ID:4631.

Another function of VGAM1920 is therefore inhibition of FLJ11160 (Accession NM_018344). Accordingly, utilities of VGAM1920 include diagnosis, prevention and treatment of diseases and clinical conditions associated with FLJ11160. FLJ14936 (Accession NM_032864) is another VGAM1920 host target gene. FLJ14936 BINDING SITE is HOST TARGET binding site found in the 3' untranslated region of mRNA encoded by FLJ14936, corresponding to a HOST TARGET binding site such as BINDING SITE I, BINDING SITE II or BINDING SITE III. Table 2 illustrates the complementarity of the nucleotide sequences of FLJ14936 BINDING SITE, designated SEQ ID:26668, to the nucleotide sequence of VGAM1920 RNA, herein designated VGAM RNA, also designated SEQ ID:4631.

Another function of VGAM1920 is therefore inhibition of FLJ14936 (Accession NM_032864). Accordingly, utilities of VGAM1920 include diagnosis, prevention and treatment of diseases and clinical conditions associated with FLJ14936. KIAA1522 (Accession XM_036299) is another VGAM1920 host target gene. KIAA1522 BINDING SITE is HOST TARGET binding site found in the 3' untranslated region of mRNA encoded by KIAA1522, corresponding to a HOST TARGET binding site such as BINDING SITE I, BINDING SITE II or BINDING SITE III. Table 2 illustrates the complementarity of the nucleotide sequences of KIAA1522 BINDING SITE, designated SEQ ID:32415, to the nucleotide sequence of VGAM1920 RNA, herein designated VGAM RNA, also designated SEQ ID:4631.

Another function of VGAM1920 is therefore inhibition of KIAA1522 (Accession XM_036299). Accordingly, utilities of VGAM1920 include diagnosis, prevention and treatment of diseases and clinical conditions associated with KIAA1522. Polymerase I and Transcript Release Factor (PTRF, Accession XM_032852) is another VGAM1920 host target gene. PTRF BINDING SITE is HOST TARGET binding site found in the 3' untranslated region of mRNA encoded by PTRF, corresponding to a HOST TARGET binding site such as BINDING SITE I, BINDING SITE II or BINDING SITE III. Table 2 illustrates the complementarity of the nucleotide sequences of PTRF BINDING SITE, designated SEQ ID:31781, to the nucleotide sequence of VGAM1920 RNA, herein designated VGAM RNA, also designated SEQ ID:4631.

Another function of VGAM1920 is therefore inhibition of Polymerase I and Transcript Release Factor (PTRF, Accession XM_032852). Accordingly, utilities of VGAM1920 include diagnosis, prevention and treatment of diseases and clinical conditions associated with PTRF. LOC253959 (Accession XM_170749) is another VGAM1920 host target gene. LOC253959 BINDING SITE is HOST TARGET binding site found in the 5' untranslated region of mRNA encoded by LOC253959, corresponding to a HOST TARGET binding site such as BINDING SITE I, BINDING SITE II or BINDING SITE III. Table 2 illustrates the complementarity of the nucleotide sequences of LOC253959 BINDING SITE, designated SEQ ID:45508, to the nucleotide sequence of VGAM1920 RNA, herein designated VGAM RNA, also designated SEQ ID:4631.

Another function of VGAM1920 is therefore inhibition of LOC253959 (Accession XM_170749). Accordingly, utilities of VGAM1920 include diagnosis, prevention and treatment of diseases and clinical conditions associated with LOC253959. FIG. 1 further provides a conceptual description of a novel bioinformatically detected viral gene of the present invention, referred to here as Viral Genomic Address Messenger 1921 (VGAM1921) viral gene, which modulates expression of respective host target genes thereof, the function and utility of which host target genes is known in the art.

VGAM1921 is a novel bioinformatically detected regulatory, non protein coding, viral micro RNA (miRNA) gene. The method by which VGAM1921 was detected is described hereinabove with reference to FIGS. 1-8.

VGAM1921 gene, herein designated VGAM GENE, is a viral gene contained in the genome of Canine Distemper Virus. VGAM1921 host target gene, herein designated VGAM HOST TARGET GENE, is a human gene contained in the human genome.

VGAM1921 gene encodes a VGAM1921 precursor RNA, herein designated VGAM PRECURSOR RNA. Similar to other miRNA genes, and unlike most ordinary genes, VGAM1921 precursor RNA does not encode a protein. A nucleotide sequence identical or highly similar to the nucleotide sequence of VGAM1921 precursor RNA is designated SEQ ID:1907, and is provided hereinbelow with reference to the sequence listing part. Nucleotide sequence SEQ ID:1907 is located at position 9746 relative to the genome of Canine Distemper Virus.

VGAM1921 precursor RNA folds onto itself, forming VGAM1921 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1921 folded precursor RNA into VGAM1921 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 43%) nucleotide sequence of VGAM1921 RNA is designated SEQ ID:4632, and is provided hereinbelow with reference to the sequence listing part.

VGAM1921 host target gene, herein designated VGAM HOST TARGET GENE, encodes a corresponding messenger RNA, VGAM1921 host target RNA, herein designated VGAM HOST TARGET RNA. VGAM1921 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1921 RNA, herein designated VGAM RNA, binds complementarily to one or more host target binding sites located in untranslated regions of VGAM1921 host target RNA, herein designated VGAM HOST TARGET RNA. This complementary binding is due to the fact that the nucleotide sequence of VGAM1921 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1921 RNA, herein designated VGAM RNA, may have a different number of host target binding sites in untranslated regions of a VGAM1921 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1921 RNA, herein designated VGAM RNA, to host target binding sites on VGAM1921 host target RNA, herein designated VGAM HOST TARGET RNA, such as BINDING SITE I, BINDING SITE II and BINDING SITE III, inhibits translation of VGAM1921 host target RNA into VGAM1921 host target protein, herein designated VGAM HOST TARGET PROTEIN. VGAM host target protein is therefore outlined by a broken line.

It is appreciated that VGAM1921 host target gene, herein designated VGAM HOST TARGET GENE, in fact represents a plurality of VGAM1921 host target genes. The mRNA of each one of this plurality of VGAM1921 host target genes comprises one or more host target binding sites, each having a nucleotide sequence which is at least partly complementary to VGAM1921 RNA, herein designated VGAM RNA, and which when bound by VGAM1921 RNA causes inhibition of translation of respective one or more VGAM1921 host target proteins.

It is further appreciated by one skilled in the art that the mode of translational inhibition illustrated by FIG. 1 with specific reference to translational inhibition exerted by VGAM1921 gene, herein designated VGAM GENE, on one or more VGAM1921 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1921 is inhibition of expression of host target genes, as part of a novel viral mechanism of attacking a host. Accordingly, utilities of VGAM1921 include diagnosis, prevention and treatment of viral infection by Canine Distemper Virus. Specific functions, and accordingly utilities, of VGAM1921 correlate with, and may be deduced from, the identity of the host target genes which VGAM1921 binds and inhibits, and the function of these host target genes, as elaborated hereinbelow.

Nucleotide sequences of the VGAM1921 precursor RNA, herein designated VGAM PRECURSOR RNA, and of the 'diced' VGAM1921 RNA, herein designated VGAM RNA, and a schematic representation of the secondary folding of VGAM1921 folded precursor RNA, herein designated VGAM FOLDED PRECURSOR RNA, of VGAM1921 are further described hereinbelow with reference to Table 1.

Nucleotide sequences of host target binding sites, such as BINDING SITE-I, BINDING SITE-II and BINDING SITE-III of FIG. 1, found on VGAM1921 host target RNA, and schematic representation of the complementarity of each of these host target binding sites to VGAM1921 RNA, herein designated VGAM RNA, are described hereinbelow with reference to Table 2.

As mentioned hereinabove with reference to FIG. 1, a function of VGAM1921 gene, herein designated VGAM is inhibition of expression of VGAM1921 target genes. It is appreciated that specific functions, and accordingly utilities, of VGAM1921 correlate with, and may be deduced from, the identity of the target genes which VGAM1921 binds and inhibits, and the function of these target genes, as elaborated hereinbelow.

Chromosome 20 Open Reading Frame 108 (C20orf108, Accession NM_080821) is a VGAM1921 host target gene. C20orf108 BINDING SITE is HOST TARGET binding site found in the 3' untranslated region of mRNA encoded by C20orf108, corresponding to a HOST TARGET binding site such as BINDING SITE I, BINDING SITE II or BINDING SITE III. Table 2 illustrates the complementarity of the nucleotide sequences of C20orf108 BINDING SITE, designated SEQ ID:28080, to the nucleotide sequence of VGAM1921 RNA, herein designated VGAM RNA, also designated SEQ ID:4632.

A function of VGAM1921 is therefore inhibition of Chromosome 20 Open Reading Frame 108 (C20orf108, Accession NM_080821). Accordingly, utilities of VGAM1921 include diagnosis, prevention and treatment of diseases and clinical conditions associated with C20orf108. FLJ10891 (Accession NM_018260) is another VGAM1921 host target gene. FLJ10891 BINDING SITE is HOST TARGET binding site found in the 3' untranslated region of mRNA encoded by FLJ10891, corresponding to a HOST TARGET binding site such as BINDING SITE I, BINDING SITE II or BINDING SITE III. Table 2 illustrates the complementarity of the nucleotide sequences of FLJ10891 BINDING SITE, designated SEQ ID:20225, to the nucleotide sequence of VGAM1921 RNA, herein designated VGAM RNA, also designated SEQ ID:4632.

Another function of VGAM1921 is therefore inhibition of FLJ10891 (Accession NM_018260). Accordingly, utilities of VGAM1921 include diagnosis, prevention and treatment of diseases and clinical conditions associated with FLJ10891. FLJ12985 (Accession NM_024924) is another VGAM1921 host target gene. FLJ12985 BINDING SITE is HOST TARGET binding site found in the 3' untranslated region of mRNA encoded by FLJ12985, corresponding to a HOST TARGET binding site such as BINDING SITE I, BINDING SITE II or BINDING SITE III. Table 2 illustrates the complementarity of the nucleotide sequences of FLJ12985 BINDING SITE, designated SEQ ID:24463, to the nucleotide sequence of VGAM1921 RNA, herein designated VGAM RNA, also designated SEQ ID:4632.

Another function of VGAM1921 is therefore inhibition of FLJ12985 (Accession NM_024924). Accordingly, utilities of VGAM1921 include diagnosis, prevention and treatment of diseases and clinical conditions associated with FLJ12985. FLJ25416 (Accession NM_145018) is another VGAM1921 host target gene. FLJ25416 BINDING SITE is HOST TARGET binding site found in the 3' untranslated region of mRNA encoded by FLJ25416, corresponding to a HOST TARGET binding site such as BINDING SITE I, BINDING SITE II or BINDING SITE III. Table 2 illustrates the complementarity of the nucleotide sequences of FLJ25416 BINDING SITE, designated SEQ ID:29624, to the nucleotide sequence of VGAM1921 RNA, herein designated VGAM RNA, also designated SEQ ID:4632.

Another function of VGAM1921 is therefore inhibition of FLJ25416 (Accession NM_145018). Accordingly, utilities of VGAM1921 include diagnosis, prevention and treatment of diseases and clinical conditions associated with FLJ25416. Potassium Inwardly-rectifying Channel, Subfamily J, Member 2 (KCNJ2, Accession NM_000891) is another VGAM1921 host target gene. KCNJ2 BINDING SITE is HOST TARGET binding site found in the 5' untranslated region of mRNA encoded by KCNJ2, corresponding to a HOST TARGET binding site such as BINDING SITE I, BINDING SITE II or BINDING SITE III. Table 2 illustrates the complementarity of the nucleotide sequences of KCNJ2 BINDING SITE, designated SEQ ID:6589, to the nucleotide sequence of VGAM1921 RNA, herein designated VGAM RNA, also designated SEQ ID:4632.

Another function of VGAM1921 is therefore inhibition of Potassium Inwardly-rectifying Channel, Subfamily J, Member 2 (KCNJ2, Accession NM_000891). Accordingly, utilities of VGAM1921 include diagnosis, prevention and treatment of diseases and clinical conditions associated with KCNJ2. KIAA0798 (Accession NM_014650) is another VGAM1921 host target gene. KIAA0798 BINDING SITE is HOST TARGET binding site found in the 3' untranslated region of mRNA encoded by KIAA0798, corresponding to a HOST TARGET binding site such as BINDING SITE I, BINDING SITE II or BINDING SITE III. Table 2 illustrates the complementarity of the nucleotide sequences of KIAA0798 BINDING SITE, designated SEQ ID:16064, to the nucleotide sequence of VGAM1921 RNA, herein designated VGAM RNA, also designated SEQ ID:4632.

Another function of VGAM1921 is therefore inhibition of KIAA0798 (Accession NM_014650). Accordingly, utilities of VGAM1921 include diagnosis, prevention and treatment of diseases and clinical conditions associated with KIAA0798. LOC145813 (Accession XM_096873) is another VGAM1921 host target gene. LOC145813 BINDING SITE is HOST TARGET binding site found in the 3' untranslated region of mRNA encoded by LOC145813, corresponding to a HOST TARGET binding site such as BINDING SITE I, BINDING SITE II or BINDING SITE III. Table 2 illustrates the complementarity of the nucleotide sequences of LOC145813 BINDING SITE, designated SEQ ID:40596, to the nucleotide sequence of VGAM1921 RNA, herein designated VGAM RNA, also designated SEQ ID:4632.

Another function of VGAM1921 is therefore inhibition of LOC145813 (Accession XM_096873). Accordingly, utilities of VGAM1921 include diagnosis, prevention and treatment of diseases and clinical conditions associated with LOC145813. LOC255624 (Accession XM_170531) is another VGAM1921 host target gene. LOC255624 BINDING SITE is HOST TARGET binding site found in the 3' untranslated region of mRNA encoded by LOC255624, corresponding to a HOST TARGET binding site such as BINDING SITE I, BINDING SITE II or BINDING SITE III. Table 2 illustrates the complementarity of the nucleotide sequences of LOC255624 BINDING SITE, designated SEQ ID:45351, to the nucleotide sequence of VGAM1921 RNA, herein designated VGAM RNA, also designated SEQ ID:4632.

Another function of VGAM1921 is therefore inhibition of LOC255624 (Accession XM_170531). Accordingly, utilities of VGAM1921 include diagnosis, prevention and treatment of diseases and clinical conditions associated with LOC255624. LOC64116 (Accession NM_022154) is another VGAM1921 host target gene. LOC64116 BINDING SITE is HOST TARGET binding site found in the 3' untranslated region of mRNA encoded by LOC64116, corresponding to a HOST TARGET binding site such as BINDING SITE I, BINDING SITE II or BINDING SITE III. Table 2 illustrates the complementarity of the nucleotide sequences of LOC64116 BINDING SITE, designated SEQ ID:22712, to the nucleotide sequence of VGAM1921 RNA, herein designated VGAM RNA, also designated SEQ ID:4632.

Another function of VGAM1921 is therefore inhibition of LOC64116 (Accession NM_022154). Accordingly, utilities of VGAM1921 include diagnosis, prevention and treatment of diseases and clinical conditions associated with LOC64116. FIG. 1 further provides a conceptual description of a novel bioinformatically detected viral gene of the present invention, referred to here as Viral Genomic Address Messenger 1922 (VGAM1922) viral gene, which modulates expression of respective host target genes thereof, the function and utility of which host target genes is known in the art.

VGAM1922 is a novel bioinformatically detected regulatory, non protein coding, viral micro RNA (miRNA) gene. The method by which VGAM1922 was detected is described hereinabove with reference to FIGS. 1-8.

VGAM1922 gene, herein designated VGAM GENE, is a viral gene contained in the genome of Canine Distemper Virus. VGAM1922 host target gene, herein designated VGAM HOST TARGET GENE, is a human gene contained in the human genome.

VGAM1922 gene encodes a VGAM1922 precursor RNA, herein designated VGAM PRECURSOR RNA. Similar to other miRNA genes, and unlike most ordinary genes, VGAM1922 precursor RNA does not encode a protein. A nucleotide sequence identical or highly similar to the nucleotide sequence of VGAM1922 precursor RNA is designated SEQ ID:1908, and is provided hereinbelow with reference to the sequence listing part. Nucleotide sequence SEQ ID:1908 is located at position 11765 relative to the genome of Canine Distemper Virus.

VGAM1922 precursor RNA folds onto itself, forming VGAM1922 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1922 folded precursor RNA into VGAM1922 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1922 RNA is designated SEQ ID:4633, and is provided hereinbelow with reference to the sequence listing part.

VGAM1922 host target gene, herein designated VGAM HOST TARGET GENE, encodes a corresponding messenger RNA, VGAM1922 host target RNA, herein designated VGAM HOST TARGET RNA. VGAM1922 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1922 RNA, herein designated VGAM RNA, binds complementarily to one or more host target binding sites located in untranslated regions of VGAM1922 host target RNA, herein designated VGAM HOST TARGET RNA. This complementary binding is due to the fact that the nucleotide sequence of VGAM1922 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1922 RNA, herein designated VGAM RNA, may have a different number of host target binding sites in untranslated regions of a VGAM1922 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1922 RNA, herein designated VGAM RNA, to host target binding sites on VGAM1922 host target RNA, herein designated VGAM HOST TARGET RNA, such as BINDING SITE I, BINDING SITE II and BINDING SITE III, inhibits translation of VGAM1922 host target RNA into VGAM1922 host target protein, herein designated VGAM HOST TARGET PROTEIN. VGAM host target protein is therefore outlined by a broken line.

It is appreciated that VGAM1922 host target gene, herein designated VGAM HOST TARGET GENE, in fact represents a plurality of VGAM1922 host target genes. The mRNA of each one of this plurality of VGAM1922 host target genes comprises one or more host target binding sites, each having a nucleotide sequence which is at least partly complementary to VGAM1922 RNA, herein designated VGAM RNA, and which when bound by VGAM1922 RNA causes inhibition of translation of respective one or more VGAM1922 host target proteins.

It is further appreciated by one skilled in the art that the mode of translational inhibition illustrated by FIG. 1 with specific reference to translational inhibition exerted by VGAM1922 gene, herein designated VGAM GENE, on one or more VGAM1922 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1922 is inhibition of expression of host target genes, as part of a novel viral mechanism of attacking a host. Accordingly, utilities of VGAM1922 include diagnosis, prevention and treatment of viral infection by Canine Distemper Virus. Specific functions, and accordingly utilities, of VGAM1922 correlate with, and may be deduced from, the identity of the host target genes which VGAM1922 binds and inhibits, and the function of these host target genes, as elaborated hereinbelow.

Nucleotide sequences of the VGAM1922 precursor RNA, herein designated VGAM PRECURSOR RNA, and of the 'diced' VGAM1922 RNA, herein designated VGAM RNA, and a schematic representation of the secondary folding of VGAM1922 folded precursor RNA, herein designated VGAM FOLDED PRECURSOR RNA, of VGAM1922 are further described hereinbelow with reference to Table 1.

Nucleotide sequences of host target binding sites, such as BINDING SITE-I, BINDING SITE-II and BINDING SITE-III of FIG. 1, found on VGAM1922 host target RNA, and schematic representation of the complementarity of each of these host target binding sites to VGAM1922 RNA, herein designated VGAM RNA, are described hereinbelow with reference to Table 2.

As mentioned hereinabove with reference to FIG. 1, a function of VGAM1922 gene, herein designated VGAM is inhibition of expression of VGAM1922 target genes. It is appreciated that specific functions, and accordingly utilities, of VGAM1922 correlate with, and may be deduced from, the identity of the target genes which VGAM1922 binds and inhibits, and the function of these target genes, as elaborated hereinbelow.

Nucleosome Assembly Protein 1-like 4 (NAP1L4, Accession NM_005969) is a VGAM1922 host target gene. NAP1L4 BINDING SITE is HOST TARGET binding site found in the 3' untranslated region of mRNA encoded by NAP1L4, corresponding to a HOST TARGET binding site such as BINDING SITE I, BINDING SITE II or BINDING SITE III. Table 2 illustrates the complementarity of the nucleotide sequences of NAP1L4 BINDING SITE, designated SEQ ID:12591, to the nucleotide sequence of VGAM1922 RNA, herein designated VGAM RNA, also designated SEQ ID:4633.

A function of VGAM1922 is therefore inhibition of Nucleosome Assembly Protein 1-like 4 (NAP1L4, Accession NM_005969), a gene which may have a role as a histone chaperone. Accordingly, utilities of VGAM1922 include diagnosis, prevention and treatment of diseases and clinical conditions associated with NAP1L4. The function of NAP1L4 and its association with various diseases and clinical conditions, has been established by previous studies, as described hereinabove with reference to VGAM949. NDRG Family Member 2 (NDRG2, Accession NM_016250) is another VGAM1922 host target gene. NDRG2 BINDING SITE is HOST TARGET binding site found in the 3' untranslated region of mRNA encoded by NDRG2, corresponding to a HOST TARGET binding site such as BINDING SITE I, BINDING SITE II or BINDING SITE III. Table 2 illustrates the complementarity of the nucleotide sequences of NDRG2 BINDING SITE, designated SEQ ID:18379, to the nucleotide sequence of VGAM1922 RNA, herein designated VGAM RNA, also designated SEQ ID:4633.

Another function of VGAM1922 is therefore inhibition of NDRG Family Member 2 (NDRG2, Accession NM_016250), a gene which belongs to the ndrg family. Accordingly, utilities of VGAM1922 include diagnosis, prevention and treatment of diseases and clinical conditions associated with NDRG2. The function of NDRG2 and its association with various diseases and clinical conditions, has been established by previous studies, as described hereinabove with reference to VGAM1130. Plastin 3 (T isoform) (PLS3, Accession NM_005032) is another VGAM1922 host target gene. PLS3 BINDING SITE is HOST TARGET binding site found in the 3' untranslated region of mRNA encoded by PLS3, corresponding to a HOST TARGET binding site such as BINDING SITE I, BINDING SITE II or BINDING SITE III. Table 2 illustrates the complementarity of the nucleotide sequences of PLS3 BINDING SITE, designated SEQ ID:11472, to the nucleotide sequence of VGAM1922 RNA, herein designated VGAM RNA, also designated SEQ ID:4633.

Another function of VGAM1922 is therefore inhibition of Plastin 3 (T isoform) (PLS3, Accession NM_005032), a gene which binds actin. Accordingly, utilities of VGAM1922 include diagnosis, prevention and treatment of diseases and clinical conditions associated with PLS3. The function of PLS3 and its association with various diseases and clinical conditions, has been established by previous studies, as described hereinabove with reference to VGAM1754. Rhodopsin (opsin 2, rod pigment) (retinitis pigmentosa 4, autosomal dominant) (RHO, Accession NM_000539) is another VGAM1922 host target gene. RHO BINDING SITE is HOST TARGET binding site found in the 3' untranslated region of mRNA encoded by RHO, corresponding to a HOST TARGET binding site such as BINDING SITE I, BINDING SITE II or BINDING SITE III. Table 2 illustrates the complementarity of the nucleotide sequences of RHO BINDING SITE, designated SEQ ID:6139, to the nucleotide sequence of VGAM1922 RNA, herein designated VGAM RNA, also designated SEQ ID:4633.

Another function of VGAM1922 is therefore inhibition of Rhodopsin (opsin 2, rod pigment) (retinitis pigmentosa 4, autosomal dominant) (RHO, Accession NM_000539). Accordingly, utilities of VGAM1922 include diagnosis, prevention and treatment of diseases and clinical conditions associated with RHO. CUB and Sushi Multiple Domains 1

(CSMD1, Accession XM_054838) is another VGAM1922 host target gene. CSMD1 BINDING SITE is HOST TARGET binding site found in the 3' untranslated region of mRNA encoded by CSMD1, corresponding to a HOST TARGET binding site such as BINDING SITE I, BINDING SITE II or BINDING SITE III. Table 2 illustrates the complementarity of the nucleotide sequences of CSMD1 BINDING SITE, designated SEQ ID:36192, to the nucleotide sequence of VGAM1922 RNA, herein designated VGAM RNA, also designated SEQ ID:4633.

Another function of VGAM1922 is therefore inhibition of CUB and Sushi Multiple Domains 1 (CSMD1, Accession XM_054838). Accordingly, utilities of VGAM1922 include diagnosis, prevention and treatment of diseases and clinical conditions associated with CSMD1. MKP-7 (Accession XM_039106) is another VGAM1922 host target gene. MKP-7 BINDING SITE is HOST TARGET binding site found in the 3' untranslated region of mRNA encoded by MKP-7, corresponding to a HOST TARGET binding site such as BINDING SITE I, BINDING SITE II or BINDING SITE III. Table 2 illustrates the complementarity of the nucleotide sequences of MKP-7 BINDING SITE, designated SEQ ID:33006, to the nucleotide sequence of VGAM1922 RNA, herein designated VGAM RNA, also designated SEQ ID:4633.

Another function of VGAM1922 is therefore inhibition of MKP-7 (Accession XM_039106). Accordingly, utilities of VGAM1922 include diagnosis, prevention and treatment of diseases and clinical conditions associated with MKP-7. Matrix Metalloproteinase 28 (MMP28, Accession NM_032950) is another VGAM1922 host target gene. MMP28 BINDING SITE1 and MMP28 BINDING SITE2 are HOST TARGET binding sites found in untranslated regions of mRNA encoded by MMP28, corresponding to HOST TARGET binding sites such as BINDING SITE I, BINDING SITE II or BINDING SITE III. Table 2 illustrates the complementarity of the nucleotide sequences of MMP28 BINDING SITE1 and MMP28 BINDING SITE2, designated SEQ ID:26763 and SEQ ID:23594 respectively, to the nucleotide sequence of VGAM1922 RNA, herein designated VGAM RNA, also designated SEQ ID:4633.

Another function of VGAM1922 is therefore inhibition of Matrix Metalloproteinase 28 (MMP28, Accession NM_032950). Accordingly, utilities of VGAM1922 include diagnosis, prevention and treatment of diseases and clinical conditions associated with MMP28. BCL2-like 2 (BCL2L2, Accession NM_004050) is another VGAM1923 host target gene. BCL2L2 BINDING SITE is HOST TARGET binding site found in the 3' untranslated region of mRNA encoded by BCL2L2, corresponding to a HOST TARGET binding site such as BINDING SITE I, BINDING SITE II or BINDING SITE III. Table 2 illustrates the complementarity of the nucleotide sequences of BCL2L2 BINDING SITE, designated SEQ ID:10266, to the nucleotide sequence of VGAM1923 RNA, herein designated VGAM RNA, also designated SEQ ID:4634.

Another function of VGAM1923 is therefore inhibition of BCL2-like 2 (BCL2L2, Accession NM_004050), a gene which promotes cell survival. Accordingly, utilities of VGAM1923 include diagnosis, prevention and treatment of diseases and clinical conditions associated with BCL2L2. The function of BCL2L2 and its association with various diseases and clinical conditions, has been established by previous studies, as described hereinabove with reference to VGAM431. Cyclin D2 (CCND2, Accession NM_001759) is another VGAM1923 host target gene. CCND2 BINDING SITE is HOST TARGET binding site found in the 3' untranslated region of mRNA encoded by CCND2, corresponding to a HOST TARGET binding site such as BINDING SITE I, BINDING SITE II or BINDING SITE III. Table 2 illustrates the complementarity of the nucleotide sequences of CCND2 BINDING SITE, designated SEQ ID:7519, to the nucleotide sequence of VGAM1923 RNA, herein designated VGAM RNA, also designated SEQ ID:4634.

Another function of VGAM1923 is therefore inhibition of Cyclin D2 (CCND2, Accession NM_001759), a gene which is essential for the control of the cell cycle at the g1/s (start) transition. Accordingly, utilities of VGAM1923 include diagnosis, prevention and treatment of diseases and clinical conditions associated with CCND2. The function of CCND2 and its association with various diseases and clinical conditions, has been established by previous studies, as described hereinabove with reference to VGAM128. CDK2-associated Protein 1 (CDK2AP1, Accession NM_004642) is another VGAM1923 host target gene. CDK2AP1 BINDING SITE is HOST TARGET binding site found in the 3' untranslated region of mRNA encoded by CDK2AP1, corresponding to a HOST TARGET binding site such as BINDING SITE I, BINDING SITE II or BINDING SITE III. Table 2 illustrates the complementarity of the nucleotide sequences of CDK2AP1 BINDING SITE, designated SEQ ID:11016, to the nucleotide sequence of VGAM1923 RNA, herein designated VGAM RNA, also designated SEQ ID:4634.

Another function of VGAM1923 is therefore inhibition of CDK2-associated Protein 1 (CDK2AP1, Accession NM_004642), a gene which negatively regulates CDK2 activity. Accordingly, utilities of VGAM1923 include diagnosis, prevention and treatment of diseases and clinical conditions associated with CDK2AP1. The function of CDK2AP1 has been established by previous studies. Todd et al. (1995) isolated an evolutionarily conserved gene that exhibits frequent losses of heterozygosity (LOH) and significant reduction in expression in malignant oral keratinocytes of the hamster (Mesocricetus auratus). They symbolized the gene doc-1 for 'deleted in oral cancer.' Transfection of normal doc-1 cDNA into malignant oral keratinocytes reversed the transformed phenotype in the hamster model. Daigo et al. (1997) isolated a human cDNA encoding a 115-amino acid polypeptide that shows 97% identity to the doc-1 gene of the hamster. It also shows a high degree of homology to a gene induced by TNF-alpha (OMIM Ref. No. 191160) in the mouse. To investigate its possible role in esophageal carcinogenesis, they examined genetic alterations in expression levels of the gene in 13 esophageal carcinoma cell lines and 10 primary esophageal carcinomas. No mutation or reduction of expression was observed in any of the 23 cancer materials examined. By fluorescence in situ hybridization, they mapped the human DOC1 gene to 12q24.31.

Full details of the abovementioned studies are described in the following publications, the disclosure of which are hereby incorporated by reference:

Daigo, Y.; Suzuki, K.; Maruyama, O.; Miyoshi, Y.; Yasuda, T.; Kabuto, T.; Imaoka, S.; Fujiwara, T.; Takahashi, E.; Fujino, M. A.; Nakamura, Y.: Isolation, mapping, and mutation analysis of a human cDNA homologous to the doc-1 gene of the Chinese hamster, a candidate tumor suppressor for oral cancer. Genes Chromosomes Cancer 20:204-207, 1997; and Todd, R.; McBride, J.; Tsuji, T.; Donoff, R. B.; Nagai, M.; Chou, M. Y.; Chiang, T.; Wong, D. T. W.: Deleted in oral cancer-1 (doc-1), a novel oral tumor suppressor gene. FASEB J. 1362.

Further studies establishing the function and utilities of CDK2AP1 are found in John Hopkins OMIM database record ID 602198, and in sited publications numbered 1226-

1227 listed in the bibliography section hereinbelow, which are also hereby incorporated by reference. Cadherin, EGF LAG Seven-pass G-type Receptor 1 (flamingo homolog, Drosophila) (CELSR1, Accession NM_014246) is another VGAM1923 host target gene. CELSR1 BINDING SITE is HOST TARGET binding site found in the 3' untranslated region of mRNA encoded by CELSR1, corresponding to a HOST TARGET binding site such as BINDING SITE I, BINDING SITE II or BINDING SITE III. Table 2 illustrates the complementarity of the nucleotide sequences of CELSR1 BINDING SITE, designated SEQ ID:15517, to the nucleotide sequence of VGAM1923 RNA, herein designated VGAM RNA, also designated SEQ ID:4634.

Another function of VGAM1923 is therefore inhibition of Cadherin, EGF LAG Seven-pass G-type Receptor 1 (flamingo homolog, Drosophila) (CELSR1, Accession NM_014246), a gene which is involved in contact-mediated communication. Accordingly, utilities of VGAM1923 include diagnosis, prevention and treatment of diseases and clinical conditions associated with CELSR1. The function of CELSR1 and its association with various diseases and clinical conditions, has been established by previous studies, as described hereinabove with reference to VGAM459. Chromosome Condensation 1-like (CHC1L, Accession NM_001268) is another VGAM1923 host target gene. CHC1L BINDING SITE is HOST TARGET binding site found in the 3' untranslated region of mRNA encoded by CHC1L, corresponding to a HOST TARGET binding site such as BINDING SITE I, BINDING SITE II or BINDING SITE III. Table 2 illustrates the complementarity of the nucleotide sequences of CHC1L BINDING SITE, designated SEQ ID:6931, to the nucleotide sequence of VGAM1923 RNA, herein designated VGAM RNA, also designated SEQ ID:4634.

Another function of VGAM1923 is therefore inhibition of Chromosome Condensation 1-like (CHC1L, Accession NM_001268). Accordingly, utilities of VGAM1923 include diagnosis, prevention and treatment of diseases and clinical conditions associated with CHC1L. C-type (calcium dependent, carbohydrate-recognition domain) Lectin, Superfamily Member 11 (CLECSF11, Accession NM_130441) is another VGAM1923 host target gene. CLECSF11 BINDING SITE is HOST TARGET binding site found in the 5' untranslated region of mRNA encoded by CLECSF11, corresponding to a HOST TARGET binding site such as BINDING SITE I, BINDING SITE II or BINDING SITE III. Table 2 illustrates the complementarity of the nucleotide sequences of CLECSF11 BINDING SITE, designated SEQ ID:28200, to the nucleotide sequence of VGAM1923 RNA, herein designated VGAM RNA, also designated SEQ ID:4634.

Another function of VGAM1923 is therefore inhibition of C-type (calcium dependent, carbohydrate-recognition domain) Lectin, Superfamily Member 11 (CLECSF11, Accession NM_130441), a gene which may play a role in ligand internalization and presentation. Accordingly, utilities of VGAM1923 include diagnosis, prevention and treatment of diseases and clinical conditions associated with CLECSF11. The function of CLECSF11 has been established by previous studies. CLONING By screening an EST database for sequences homologous to the CRD of DC immunoreceptor (DCIR; 605306), followed by 5-prime and 3-prime RACE, Arce et al. (2001) obtained a cDNA encoding DLEC. Sequence analysis predicted that DLEC is a 213-amino acid type II integral membrane protein with an N-terminal cytoplasmic tail, a transmembrane region, an extracellular stalk region, and a single C-terminal CRD. The CRD is 79% identical to that of DCIR and has 3 potential N-glycosylation sites and 1 conserved calcium-binding site that contains a mannose-binding EPN motif. RT-PCR analysis suggested the existence of a splice variant, DLEC-beta. Northern blot analysis did not detect expression of DLEC in immunologic tissues. RT-PCR analysis detected expression of DLEC only in peripheral blood mononuclear cells and immature dendritic cells. Northern blot analysis showed constitutive expression of DLEC in immature monocyte-derived DCs that was downregulated by maturation with lipopolysaccharide but not with tumor necrosis factor (TNF; 191160). By immunoscreening COS cells expressing cDNAs from plasmacytoid dendritic cells (PDCs), Dzionek et al. (2001) obtained a cDNA encoding DLEC, which they designated BDCA2. RT-PCR analysis detected expression of BDCA2 that was restricted to PDCs. Immunofluorescence microscopy and immunohistochemistry demonstrated expression of BDCA2 in CD123 (IL3RA; 308385)-positive tonsillar and lymph node cells. RT-PCR analysis suggested the existence of 5 BDCA2 splice variants, each lacking 1 or 2 exons. Immunoprecipitation and SDS-PAGE analyses showed expression of a 38-kD BDCA2 protein. Functional analysis indicated that BDCA2 mobilizes intracellular calcium. Immunoblot analysis established that anti-BDCA2 triggers protein-tyrosine phosphorylation of PDCs. ELISA showed that BDCA2 ligation inhibits IFNA (OMIM Ref. No. 147660)/IFNB (OMIM Ref. No. 147640) production by cells stimulated with influenza antigens or anti-DNA antibodies.

Full details of the abovementioned studies are described in the following publications, the disclosure of which are hereby incorporated by reference:

Arce, I.; Roda-Navarro, P.; Montoya, M. C.; Hernanz-Falcon, P.; Puig-Kroger, A.; Fernandez-Ruiz, E.: Molecular and genomic characterization of human DLEC, a novel member of the C-type lectin receptor gene family preferentially expressed on monocyte-derived dendritic cells. Europ. J. Immun. 31:2733-2740, 2001; and Dzionek, A.; Sohma, Y.; Nagafune, J.; Cella, M.; Colonna, M.; Facchetti, F.; Gunther, G.; Johnston, I.; Lanzavecchia, A.; Nagasaka, T.; Okada, T.; Vermi, W.; Winkels, G.; Yamamoto, T.

Further studies establishing the function and utilities of CLECSF11 are found in John Hopkins OMIM database record ID 606677, and in sited publications numbered 5543-5544 listed in the bibliography section hereinbelow, which are also hereby incorporated by reference. Cytochrome P450, Subfamily I (dioxin-inducible), Polypeptide 1 (glaucoma 3, primary infantile) (CYP1B1, Accession NM_000104) is another VGAM1923 host target gene. CYP1B1 BINDING SITE is HOST TARGET binding site found in the 3' untranslated region of mRNA encoded by CYP1B1, corresponding to a HOST TARGET binding site such as BINDING SITE I, BINDING SITE II or BINDING SITE III. Table 2 illustrates the complementarity of the nucleotide sequences of CYP1B1 BINDING SITE, designated SEQ ID:5565, to the nucleotide sequence of VGAM1923 RNA, herein designated VGAM RNA, also designated SEQ ID:4634.

Another function of VGAM1923 is therefore inhibition of Cytochrome P450, Subfamily I (dioxin-inducible), Polypeptide 1 (glaucoma 3, primary infantile) (CYP1B1, Accession NM_000104), a gene which participates in the metabolism of a molecule that is a participant in eye development. Accordingly, utilities of VGAM1923 include diagnosis, prevention and treatment of diseases and clinical conditions associated with CYP1B1. The function of CYP1B1 and its association with various diseases and clinical conditions, has been established by previous studies, as described hereinabove with reference to VGAM894. Cytochrome P450, Subfamily XXIV (vitamin D 24-hydroxylase) (CYP24, Accession NM_000782) is another VGAM1923 host target gene. CYP24 BINDING SITE is HOST TARGET binding site found in the 3' untranslated region of mRNA encoded by CYP24, corresponding to a HOST TARGET binding site such as BINDING SITE I, BINDING SITE II or BINDING SITE III. Table 2 illustrates the complementarity of the nucleotide sequences of CYP24 BINDING SITE, designated SEQ ID:6428, to the nucleotide sequence of VGAM1923 RNA, herein designated VGAM RNA, also designated SEQ ID:4634.

Another function of VGAM1923 is therefore inhibition of Cytochrome P450, Subfamily XXIV (vitamin D 24-hydroxylase) (CYP24, Accession NM_000782), a gene which induces the differentiation of promyelocytes into monocytes/macrophages. Accordingly, utilities of VGAM1923 include diagnosis, prevention and treatment of diseases and clinical conditions associated with CYP24. The function of CYP24 and its association with various diseases and clinical conditions, has been established by previous studies, as described hereinabove with reference to VGAM1204. Dystrophin (muscular dystrophy, Duchenne and Becker types) (DMD, Accession NM_000109) is another VGAM1923 host target gene. DMD BINDING SITE is HOST TARGET binding site found in the 5' untranslated region of mRNA encoded by DMD, corresponding to a HOST TARGET binding site such as BINDING SITE I, BINDING SITE II or BINDING SITE III. Table 2 illustrates the complementarity of the nucleotide sequences of DMD BINDING SITE, designated SEQ ID:5572, to the nucleotide sequence of VGAM1923 RNA, herein designated VGAM RNA, also designated SEQ ID:4634.

Another function of VGAM1923 is therefore inhibition of Dystrophin (muscular dystrophy, Duchenne and Becker types) (DMD, Accession NM_000109), a gene which muscular dystrophy. Accordingly, utilities of VGAM1923 include diagnosis, prevention and treatment of diseases and clinical conditions associated with DMD. The function of DMD and its association with various diseases and clinical conditions, has been established by previous studies, as described hereinabove with reference to VGAM218. DNA (cytosine-5-)-methyltransferase 2 (DNMT2, Accession NM_004412) is another VGAM1923 host target gene. DNMT2 BINDING SITE is HOST TARGET binding site found in the 3' untranslated region of mRNA encoded by DNMT2, corresponding to a HOST TARGET binding site such as BINDING SITE I, BINDING SITE II or BINDING SITE III. Table 2 illustrates the complementarity of the nucleotide sequences of DNMT2 BINDING SITE, designated SEQ ID:10672, to the nucleotide sequence of VGAM1923 RNA, herein designated VGAM RNA, also designated SEQ ID:4634.

Another function of VGAM1923 is therefore inhibition of DNA (cytosine-5-)-methyltransferase 2 (DNMT2, Accession NM_004412), a gene which may mark specific sequences in the genome. Accordingly, utilities of VGAM1923 include diagnosis, prevention and treatment of diseases and clinical conditions associated with DNMT2. The function of DNMT2 and its association with various diseases and clinical conditions, has been established by previous studies, as described hereinabove with reference to VGAM177. Diptheria Toxin Resistance Protein Required For Diphthamide Biosynthesis-like 2 (S. cerevisiae) (DPH2L2, Accession NM_001384) is another VGAM1923 host target gene. DPH2L2 BINDING SITE is HOST TARGET binding site found in the 3' untranslated region of mRNA encoded by DPH2L2, corresponding to a HOST TARGET binding site such as BINDING SITE I, BINDING SITE II or BINDING SITE III. Table 2 illustrates the complementarity of the nucleotide sequences of DPH2L2 BINDING SITE, designated SEQ ID:7058, to the nucleotide sequence of VGAM1923 RNA, herein designated VGAM RNA, also designated SEQ ID:4634.

Another function of VGAM1923 is therefore inhibition of Diptheria Toxin Resistance Protein Required For Diphthamide Biosynthesis-like 2 (S. cerevisiae) (DPH2L2, Accession NM_001384), a gene which is required for diphthamide biosynthesis. Accordingly, utilities of VGAM1923 include diagnosis, prevention and treatment of diseases and clinical conditions associated with DPH2L2. The function of DPH2L2 and its association with various diseases and clinical conditions, has been established by previous studies, as described hereinabove with reference to VGAM1221. Epidermal Growth Factor Receptor (erythroblastic leukemia viral (v-erb-b) Oncogene Homolog, Avian) (EGFR, Accession NM_005228) is another VGAM1923 host target gene. EGFR BINDING SITE is HOST TARGET binding site found in the 3' untranslated region of mRNA encoded by EGFR, corresponding to a HOST TARGET binding site such as BINDING SITE I, BINDING SITE II or BINDING SITE III. Table 2 illustrates the complementarity of the nucleotide sequences of EGFR BINDING SITE, designated SEQ ID:11726, to the nucleotide sequence of VGAM1923 RNA, herein designated VGAM RNA, also designated SEQ ID:4634.

Another function of VGAM1923 is therefore inhibition of Epidermal Growth Factor Receptor (erythroblastic leukemia viral (v-erb-b) Oncogene Homolog, Avian) (EGFR, Accession NM_005228), a gene which is a receptor for egf, but also for other members of the egf family. Accordingly, utilities of VGAM1923 include diagnosis, prevention and treatment of diseases and clinical conditions associated with EGFR. The function of EGFR and its association with various diseases and clinical conditions, has been established by previous studies, as described hereinabove with reference to VGAM229. Coagulation Factor II (thrombin) Receptor-like 3 (F2RL3, Accession NM_003950) is another VGAM1923 host target gene. F2RL3 BINDING SITE is HOST TARGET binding site found in the 3' untranslated region of mRNA encoded by F2RL3, corresponding to a HOST TARGET binding site such as BINDING SITE I, BINDING SITE II or BINDING SITE III. Table 2 illustrates the complementarity of the nucleotide sequences of F2RL3 BINDING SITE, designated SEQ ID:10084, to the nucleotide sequence of VGAM1923 RNA, herein designated VGAM RNA, also designated SEQ ID:4634.

Another function of VGAM1923 is therefore inhibition of Coagulation Factor II (thrombin) Receptor-like 3 (F2RL3, Accession NM_003950), a gene which Protease-activated receptor 4; G protein-coupled receptor that increases phosphoinositide hydrolysis. Accordingly, utilities of VGAM1923 include diagnosis, prevention and treatment of diseases and clinical conditions associated with F2RL3. The function of F2RL3 and its association with various diseases and clinical conditions, has been established by previous studies, as described hereinabove with reference to VGAM193. Fatty-acid-Coenzyme A Ligase, Long-chain 4 (FACL4, Accession NM_022977) is another VGAM1923 host target gene. FACL4 BINDING SITE1 and FACL4 BINDING SITE2 are HOST TARGET binding sites found in untranslated regions of mRNA encoded by FACL4, corresponding to HOST TARGET binding sites such as BINDING SITE I, BINDING SITE II or BINDING SITE III. Table 2 illustrates the complementarity of the nucleotide sequences of FACL4 BINDING SITE1 and FACL4 BINDING SITE2, designated SEQ ID:23254 and SEQ ID:10764 respectively, to the nucleotide sequence of VGAM1923 RNA, herein designated VGAM RNA, also designated SEQ ID:4634.

Another function of VGAM1923 is therefore inhibition of Fatty-acid-Coenzyme A Ligase, Long-chain 4 (FACL4, Accession NM_022977). Accordingly, utilities of VGAM1923 include diagnosis, prevention and treatment of diseases and clinical conditions associated with FACL4. G Protein-coupled Receptor 48 (GPR48, Accession NM_018490) is another VGAM1923 host target gene. GPR48 BINDING SITE is HOST TARGET binding site found in the 3' untranslated region of mRNA encoded by GPR48, corresponding to a HOST TARGET binding site such as BINDING SITE I, BINDING SITE II or BINDING SITE III. Table 2 illustrates the complementarity of the nucleotide sequences of GPR48 BINDING SITE, designated SEQ ID:20551, to the nucleotide sequence of VGAM1923 RNA, herein designated VGAM RNA, also designated SEQ ID:4634.

Another function of VGAM1923 is therefore inhibition of G Protein-coupled Receptor 48 (GPR48, Accession NM_018490), a gene which binds to follicle-stimulating hormone and thyroid-stimulating hormone. Accordingly, utilities of VGAM1923 include diagnosis, prevention and treatment of diseases and clinical conditions associated with GPR48. The function of GPR48 and its association with various diseases and clinical conditions, has been established by previous studies, as described hereinabove with reference to VGAM376. Histone Deacetylase 7A (HDAC7A, Accession NM_015401) is another VGAM1923 host target gene. HDAC7A BINDING SITE1 and HDAC7A BINDING SITE2 are HOST TARGET binding sites found in untranslated regions of mRNA encoded by HDAC7A, corresponding to HOST TARGET binding sites such as BINDING SITE I, BINDING SITE II or BINDING SITE III. Table 2 illustrates the complementarity of the nucleotide sequences of HDAC7A BINDING SITE1 and HDAC7A BINDING SITE2, designated SEQ ID:17713 and SEQ ID:18683 respectively, to the nucleotide sequence of VGAM1923 RNA, herein designated VGAM RNA, also designated SEQ ID:4634.

Another function of VGAM1923 is therefore inhibition of Histone Deacetylase 7A (HDAC7A, Accession NM_015401). Accordingly, utilities of VGAM1923 include diagnosis, prevention and treatment of diseases and clinical conditions associated with HDAC7A. Hypoxia-inducible Factor 1, Alpha Subunit (basic helix-loop-helix transcription factor) (HIF1A, Accession NM_001530) is another VGAM1923 host target gene. HIF1A BINDING SITE is HOST TARGET binding site found in the 3' untranslated region of mRNA encoded by HIF1A, corresponding to a HOST TARGET binding site such as BINDING SITE I, BINDING SITE II or BINDING SITE III. Table 2 illustrates the complementarity of the nucleotide sequences of HIF1A BINDING SITE, designated SEQ ID:7268, to the nucleotide sequence of VGAM1923 RNA, herein designated VGAM RNA, also designated SEQ ID:4634.

Another function of VGAM1923 is therefore inhibition of Hypoxia-inducible Factor 1, Alpha Subunit (basic helix-loop-helix transcription factor) (HIF1A, Accession NM_001530), a gene which is a basic helix-loop-helix transcription factor and mediates transcriptional responses to hypoxia and dioxin-signaling. Accordingly, utilities of VGAM1923 include diagnosis, prevention and treatment of diseases and clinical conditions associated with HIF1A. The function of HIF1A and its association with various diseases and clinical conditions, has been established by previous studies, as described hereinabove with reference to VGAM229. Hormonally Upregulated Neu-associated Kinase (HUNK, Accession NM_014586) is another VGAM1923 host target gene. HUNK BINDING SITE is HOST TARGET binding site found in the 3' untranslated region of mRNA encoded by HUNK, corresponding to a HOST TARGET binding site such as BINDING SITE I, BINDING SITE II or BINDING SITE III. Table 2 illustrates the complementarity of the nucleotide sequences of HUNK BINDING SITE, designated SEQ ID:15952, to the nucleotide sequence of VGAM1923 RNA, herein designated VGAM RNA, also designated SEQ ID:4634.

Another function of VGAM1923 is therefore inhibition of Hormonally Upregulated Neu-associated Kinase (HUNK, Accession NM_014586). Accordingly, utilities of VGAM1923 include diagnosis, prevention and treatment of diseases and clinical conditions associated with HUNK. Interleukin 8 Receptor, Alpha (IL8RA, Accession NM_000634) is another VGAM1923 host target gene. IL8RA BINDING SITE is HOST TARGET binding site found in the 3' untranslated region of mRNA encoded by IL8RA, corresponding to a HOST TARGET binding site such as BINDING SITE I, BINDING SITE II or BINDING SITE III. Table 2 illustrates the complementarity of the nucleotide sequences of IL8RA BINDING SITE, designated SEQ ID:6267, to the nucleotide sequence of VGAM1923 RNA, herein designated VGAM RNA, also designated SEQ ID:4634.

Another function of VGAM1923 is therefore inhibition of Interleukin 8 Receptor, Alpha (IL8RA, Accession NM_000634), a gene which is the receptor to interleukin-8, which is a powerful neutrophils chemotactic factor. Accordingly, utilities of VGAM1923 include diagnosis, prevention and treatment of diseases and clinical conditions associated with IL8RA. The function of IL8RA and its association with various diseases and clinical conditions, has been established by previous studies, as described hereinabove with reference to VGAM300.inositol (myo)-1(or 4)-monophosphatase 1 (IMPA1, Accession NM_005536) is another VGAM1923 host target gene. IMPA1 BINDING SITE is HOST TARGET binding site found in the 3' untranslated region of mRNA encoded by IMPA1, corresponding to a HOST TARGET binding site such as BINDING SITE I, BINDING SITE II or BINDING SITE III. Table 2 illustrates the complementarity of the nucleotide sequences of IMPA1 BINDING SITE, designated SEQ ID:12058, to the nucleotide sequence of VGAM1923 RNA, herein designated VGAM RNA, also designated SEQ ID:4634.

Another function of VGAM1923 is therefore inhibition of inositol (myo)-1(or 4)-monophosphatase 1 (IMPA1, Accession NM_005536), a gene which is responsible for the provision of inositol required for synthesis of phosphatidylinositol and polyphosphoinositides. Accordingly, utilities of VGAM1923 include diagnosis, prevention and treatment of diseases and clinical conditions associated with IMPA1. The function of IMPA1 and its association with various diseases and clinical conditions, has been established by previous studies, as described hereinabove with reference to VGAM134. Insulinoma-associated 1 (INSM1, Accession NM_002196) is another VGAM1923 host target gene. INSM1 BINDING SITE is HOST TARGET binding site found in the 3' untranslated region of mRNA encoded by INSM1, corresponding to a HOST TARGET binding site such as BINDING SITE I, BINDING SITE II or BINDING SITE III. Table 2 illustrates the complementarity of the nucleotide sequences of INSM1 BINDING SITE, designated SEQ ID:7952, to the nucleotide sequence of VGAM1923 RNA, herein designated VGAM RNA, also designated SEQ ID:4634.

Another function of VGAM1923 is therefore inhibition of Insulinoma-associated 1 (INSM1, Accession NM_002196). Accordingly, utilities of VGAM1923 include diagnosis, prevention and treatment of diseases and clinical conditions associated with INSM1. MAD, Mothers Against Decapentaplegic Homolog 7 (Drosophila) (MADH7, Accession NM_005904) is another VGAM1923 host target gene. MADH7 BINDING SITE is HOST TARGET binding site found in the 3' untranslated region of mRNA encoded by MADH7, corresponding to a HOST TARGET binding site such as BINDING SITE I, BINDING SITE II or BINDING SITE III. Table 2 illustrates the complementarity of the nucleotide sequences of MADH7 BINDING SITE, designated SEQ ID:12525, to the nucleotide sequence of VGAM1923 RNA, herein designated VGAM RNA, also designated SEQ ID:4634.

Another function of VGAM1923 is therefore inhibition of MAD, Mothers Against Decapentaplegic Homolog 7 (Drosophila) (MADH7, Accession NM_005904), a gene which may affect transcription in response to TGF-beta superfamily signaling pathways, inhibits BMP/Smad1 (MADH1) signaling. Accordingly, utilities of VGAM1923 include diagnosis, prevention and treatment of diseases and clinical conditions associated with MADH7. The function of MADH7 has been established by previous studies. Lallem and et al. (2001) showed that cells stably expressing SMAD7 had increased susceptibility to apoptosis induced by TGFB (OMIM Ref. No. 190180), TNFA (OMIM Ref. No. 191160), serum withdrawal, or loss of cell adhesion (anoikis). SMAD7 decreased NFKB (OMIM Ref. No. 164011) activity, providing a mechanism for the increased apoptosis. Stable expression of RAS (OMIM Ref. No. 190020) suppressed SMAD7 inhibition of NFKB and SMAD7 potentiation of apoptosis. Scleroderma is a chronic systemic disease that leads to fibrosis of the skin and other affected organs. TGFB has been implicated in the pathogenesis of scleroderma. SMAD proteins function as signaling transducers downstream from TGFB receptors. Dong et al. (2002) investigated the signaling components of the TGFB pathway and TGFB activity in scleroderma lesions in vivo and in scleroderma fibroblasts in vitro. Basal level and TGFB-inducible expression of SMAD7 were selectively decreased, whereas SMAD3 (OMIM Ref. No. 603109) expression was increased both in scleroderma skin and in explanted scleroderma fibroblasts in culture. TGFB signaling events were increased in scleroderma fibroblasts relative to normal fibroblasts. In vitro adenoviral gene transfer with SMAD7 restored normal TGFB signaling in scleroderma fibroblasts. These results suggested that alterations in the SMAD pathway, including marked SMAD7 deficiency and SMAD3 upregulation, may be responsible for TGFB hyperresponsiveness observed in scleroderma Full details of the abovementioned studies are described in the following publications, the disclosure of which are hereby incorporated by reference:

Lallemand, F.; Mazars, A.; Prunier, C.; Bertrand, F.; Kornprost, M.; Gallea, S.; Roman-Roman, S.; Cherqui, G.; Atfi, A.: Smad7 inhibits the survival nuclear factor kappa-B and potentiates apoptosis in epithelial cells. Oncogene 20:879-884, 2001; and Dong, C.; Zhu, S.; Wang, T.; Yoon, W.; Li, Z.; Alvarez, R. J.; ten Dijke, P.; White, B.; Wigley, F. M.; Goldschmidt-Clermont, P. J.: Deficient Smad7 expression: a putative molecular defec.

Further studies establishing the function and utilities of MADH7 are found in John Hopkins OMIM database record ID 602932, and in sited publications numbered 7970-797 and 7753 listed in the bibliography section hereinbelow, which are also hereby incorporated by reference. MAX Protein (MAX, Accession NM_002382) is another VGAM1923 host target gene. MAX BINDING SITE1 through MAX BINDING SITE4 are HOST TARGET binding sites found in untranslated regions of mRNA encoded by MAX, corresponding to HOST TARGET binding sites such as BINDING SITE I, BINDING SITE II or BINDING SITE III. Table 2 illustrates the complementarity of the nucleotide sequences of MAX BINDING SITE1 through MAX BINDING SITE4, designated SEQ ID:8201, SEQ ID:29718, SEQ ID:29720 and SEQ ID:29723 respectively, to the nucleotide sequence of VGAM1923 RNA, herein designated VGAM RNA, also designated SEQ ID:4634.

Another function of VGAM1923 is therefore inhibition of MAX Protein (MAX, Accession NM_002382), a gene which interacts specifically with the MYC (190080) protein. Accordingly, utilities of VGAM1923 include diagnosis, prevention and treatment of diseases and clinical conditions associated with MAX. The function of MAX has been established by previous studies. The MAX gene encodes a protein that interacts specifically with the MYC (OMIM Ref. No. 190080) protein to form a heterodimer with high affinity for the specific cognate DNA binding site of MYC. Wagner et al. (1992) demonstrated that 2 species of RNA hybridized specifically to a MAX cDNA probe in all human and murine cell lines tested. Unlike MYC, the steady state level of MAX RNA was not significantly modulated with respect to proliferation or differentiation. Unlike MYC RNA, MAX RNA was relatively stable with a half-life of more than 3 hours, and therefore it did not exhibit the characteristic short half-life of RNAs encoded by most immediate early genes. The predicted tertiary structure of MAX closely resembles that of MYC, and it was on the basis of the basic/helix-loop-helix/leucine-zipper homology that Prendergast et al. (1991) cloned the cDNA encoding MAX. Zervos et al. (1995) described MIX2 (OMIM Ref. No. 600601), a protein that interacts with the MAX protein. Grandori et al. (1996) identified DDX18 (OMIM Ref. No. 606355) as a direct in vivo target of Myc and Max and hypothesized that Myc may exert its effects on cell behavior through proteins that affect RNA structure and metabolism. By fluorescence in situ chromosomal hybridization, Wagner et al. (1992) demonstrated that the MAX gene is located in band 14q23. This region of chromosome 14 is involved in deletions in B-cell chronic lymphocytic leukemia and malignant lymphomas and in the 12;14 translocation in uterine leiomyomas. Gilladoga et al. (1992) similarly mapped the MAX gene to 14q22-q24 by isotopic in situ hybridization and to mouse chromosome 12 in region D.

Full details of the abovementioned studies are described in the following publications, the disclosure of which are hereby incorporated by reference:

Wagner, A. J.; Le Beau, M. M.; Diaz, M. O.; Hay, N.: Expression, regulation, and chromosomal localization of the Max gene. Proc. Nat. Acad. Sci. 89:3111-3115, 1992; and Prendergast, G. C.; Lawe, D.; Ziff, E. B.: Association of Myn, the murine homolog of Max, with c-Myc stimulates methylation-sensitive DNA binding and Ras cotransformation. Cell 65:395.

Further studies establishing the function and utilities of MAX are found in John Hopkins OMIM database record ID 154950, and in sited publications numbered 2965-2967, 1109 and 11099-11101 listed in the bibliography section hereinbelow, which are also hereby incorporated by reference. Nescient Helix Loop Helix 1 (NHLH1, Accession NM_005598) is another VGAM1923 host target gene.

NHLH1 BINDING SITE is HOST TARGET binding site found in the 5' untranslated region of mRNA encoded by NHLH1, corresponding to a HOST TARGET binding site such as BINDING SITE I, BINDING SITE II or BINDING SITE III. Table 2 illustrates the complementarity of the nucleotide sequences of NHLH1 BINDING SITE, designated SEQ ID:12126, to the nucleotide sequence of VGAM1923 RNA, herein designated VGAM RNA, also designated SEQ ID:4634.

Another function of VGAM1923 is therefore inhibition of Nescient Helix Loop Helix 1 (NHLH1, Accession NM_005598), a gene which may have a role in development of the nervous system. Accordingly, utilities of VGAM1923 include diagnosis, prevention and treatment of diseases and clinical conditions associated with NHLH1. The function of NHLH1 has been established by previous studies. Begley et al. (1992) identified a novel member of the HLH family based on its hybridization to SCL. SCL, also called TAL1, had been identified because of its involvement in a 1;14 translocation in a stem cell leukemia; it is disrupted in about one-fourth of cases of T-cell acute lymphoblastic leukemia. The novel gene was referred to as NSCL because of its expression in the developing nervous system. Murine Nscl cDNA clones had a coding region of 399 basepairs, predicting a protein of 14.8 kD. The nucleotide sequence showed 71% identity and the amino acid sequence 61% identity to murine Scl in the HLH domain. Animal model experiments lend further support to the function of NHLH1. Cogliati et al. (2002) developed Nhlh1 null mice. Homozygous mutant mice were predisposed to premature, adult-onset, unexpected death. Electrocardiograms revealed decreased heart rate variability, stress-induced arrhythmia, and impaired baroreceptor sensitivity. Heterozygosity for the closely related transcription factor Nhlh2 increased the severity of the Nhlh1 null phenotype. No signs of primary cardiac structural or conduction abnormalities were revealed in the Nhlh1 null mice. The pattern of altered heart rhythm observed in basal and experimental stress conditions suggested that a deficient parasympathetic tone contributed to the arrhythmia in the Nhlh1 null mice. Supporting their conclusion, Cogliati et al. (2002) found that Nhlh1 was expressed in the developing brain stem and vagal nuclei of wildtype mice.

It is appreciated that the abovementioned animal model for NHLH1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Begley, C. G.; Lipkowitz, S.; Gobel, V.; Mahon, K. A.; Bertness, V.; Green, A. R.; Gough, N. M.; Kirsch, I. R.: Molecular characterization of NSCL, a gene encoding a helix-loop-helix protein expressed in the developing nervous system. Proc. Nat. Acad. Sci. 89:38-42, 1992; and Cogliati, T.; Good, D. J.; Haigney, M.; Delgado-Romero, P.; Eckhaus, M. A.; Koch, W. J.; Kirsch, I. R.: Predisposition to arrhythmia and autonomic dysfunction in Nhlh1-deficient mice. M.

Further studies establishing the function and utilities of NHLH1 are found in John Hopkins OMIM database record ID 162360, and in sited publications numbered 11104-11108 listed in the bibliography section hereinbelow, which are also hereby incorporated by reference. NHP2 Non-histone Chromosome Protein 2-like 1 (S. cerevisiae) (NHP2L1, Accession NM_005008) is another VGAM1923 host target gene. NHP2L1 BINDING SITE is HOST TARGET binding site found in the 3' untranslated region of mRNA encoded by NHP2L1, corresponding to a HOST TARGET binding site such as BINDING SITE I, BINDING SITE II or BINDING SITE III. Table 2 illustrates the complementarity of the nucleotide sequences of NHP2L1 BINDING SITE, designated SEQ ID:11445, to the nucleotide sequence of VGAM1923 RNA, herein designated VGAM RNA, also designated SEQ ID:4634.

Another function of VGAM1923 is therefore inhibition of NHP2 Non-histone Chromosome Protein 2-like 1 (S. cerevisiae) (NHP2L1, Accession NM_005008), a gene which may play a role in the late stage of spliceosome assembly. Accordingly, utilities of VGAM1923 include diagnosis, prevention and treatment of diseases and clinical conditions associated with NHP2L1. The function of NHP2L1 has been established by previous studies. In the course of sequencing cDNA clones from fetal brain cDNA libraries, Saito et al. (1996) isolated a gene that encodes a protein highly homologous to NHP2 from Saccharomyces cerevisiae (Kolodrubetz and Burgum, 1991). NHP2 is a high-mobility group (HMG)-like protein which is located in the nucleus, although it shows weak homology to some ribosomal proteins. The cDNA cloned by Saito et al. (1996), symbolized NHP2L1, was expressed in all human tissues examined and was localized to 12q24.3 by fluorescence in situ hybridization.

Full details of the abovementioned studies are described in the following publications, the disclosure of which are hereby incorporated by reference:

Kolodrubetz, D.; Burgum, A.: Sequence and genetic analysis of NHP2: a moderately abundant high mobility group-like nuclear protein with an essential function in Saccharomyces cerevisiae. Yeast 7:79-90, 1991; and Saito, H.; Fujiwara, T.; Shin, S.; Okui, K.; Nakamura, Y.: Cloning and mapping of a human novel cDNA (NHP2L1) that encodes a protein highly homologous to yeast nuclear protein NHP2. Cy.

Further studies establishing the function and utilities of NHP2L1 are found in John Hopkins OMIM database record ID 601304, and in sited publications numbered 6510-6511 listed in the bibliography section hereinbelow, which are also hereby incorporated by reference. Nuclear Receptor Subfamily 3, Group C, Member 2 (NR3C2, Accession NM_000901) is another VGAM1923 host target gene. NR3C2 BINDING SITE is HOST TARGET binding site found in the 3' untranslated region of mRNA encoded by NR3C2, corresponding to a HOST TARGET binding site such as BINDING SITE I, BINDING SITE II or BINDING SITE III. Table 2 illustrates the complementarity of the nucleotide sequences of NR3C2 BINDING SITE, designated SEQ ID:6598, to the nucleotide sequence of VGAM1923 RNA, herein designated VGAM RNA, also designated SEQ ID:4634.

Another function of VGAM1923 is therefore inhibition of Nuclear Receptor Subfamily 3, Group C, Member 2 (NR3C2, Accession NM_000901), a gene which is to increase ion and water transport and thus raise extracellular fluid volume and blood pressure and lower potassium levels. Accordingly, utilities of VGAM1923 include diagnosis, prevention and treatment of diseases and clinical conditions associated with NR3C2. The function of NR3C2 and its association with various diseases and clinical conditions, has been established by previous studies, as described hereinabove with reference to VGAM186. Period Homolog 2 (Drosophila) (PER2, Accession NM_022817) is another VGAM1923 host target gene. PER2 BINDING SITE is HOST TARGET binding site found in the 3' untranslated region of mRNA encoded by PER2, corresponding to a HOST TARGET binding site such as BINDING SITE I, BINDING SITE II or BINDING SITE III. Table 2 illustrates the complementarity of the nucleotide sequences of PER2 BINDING SITE, designated SEQ ID:23093, to the nucleotide sequence of VGAM1923 RNA, herein designated VGAM RNA, also designated SEQ ID:4634.

Another function of VGAM1923 is therefore inhibition of Period Homolog 2 (Drosophila) (PER2, Accession NM_022817), a gene which Period homolog 2; putative circadian clock protein; has a PAS dimerization domain. Accordingly, utilities of VGAM1923 include diagnosis, prevention and treatment of diseases and clinical conditions associated with PER2. The function of PER2 and its association with various diseases and clinical conditions, has been established by previous studies, as described hereinabove with reference to VGAM74. RAB11A, Member RAS Oncogene Family (RAB11A, Accession NM_004663) is another VGAM1923 host target gene. RAB11A BINDING SITE is HOST TARGET binding site found in the 3' untranslated region of mRNA encoded by RAB11A, corresponding to a HOST TARGET binding site such as BINDING SITE I, BINDING SITE II or BINDING SITE III. Table 2 illustrates the complementarity of the nucleotide sequences of RAB11A BINDING SITE, designated SEQ ID:11034, to the nucleotide sequence of VGAM1923 RNA, herein designated VGAM RNA, also designated SEQ ID:4634.

Another function of VGAM1923 is therefore inhibition of RAB11A, Member RAS Oncogene Family (RAB11A, Accession NM_004663). Accordingly, utilities of VGAM1923 include diagnosis, prevention and treatment of diseases and clinical conditions associated with RAB11A. RAB6A, Member RAS Oncogene Family (RAB6A, Accession NM_002869) is another VGAM1923 host target gene. RAB6A BINDING SITE is HOST TARGET binding site found in the 3' untranslated region of mRNA encoded by RAB6A, corresponding to a HOST TARGET binding site such as BINDING SITE I, BINDING SITE II or BINDING SITE III. Table 2 illustrates the complementarity of the nucleotide sequences of RAB6A BINDING SITE, designated SEQ ID:8777, to the nucleotide sequence of VGAM1923 RNA, herein designated VGAM RNA, also designated SEQ ID:4634.

Another function of VGAM1923 is therefore inhibition of RAB6A, Member RAS Oncogene Family (RAB6A, Accession NM_002869), a gene which is involved in protein trafficking. Accordingly, utilities of VGAM1923 include diagnosis, prevention and treatment of diseases and clinical conditions associated with RAB6A. The function of RAB6A and its association with various diseases and clinical conditions, has been established by previous studies, as described hereinabove with reference to VGAM217. Arginine-glutamic Acid Dipeptide (RE) Repeats (RERE, Accession NM_012102) is another VGAM1923 host target gene. RERE BINDING SITE is HOST TARGET binding site found in the 3' untranslated region of mRNA encoded by RERE, corresponding to a HOST TARGET binding site such as BINDING SITE I, BINDING SITE II or BINDING SITE III. Table 2 illustrates the complementarity of the nucleotide sequences of RERE BINDING SITE, designated SEQ ID:14409, to the nucleotide sequence of VGAM1923 RNA, herein designated VGAM RNA, also designated SEQ ID:4634.

Another function of VGAM1923 is therefore inhibition of Arginine-glutamic Acid Dipeptide (RE) Repeats (RERE, Accession NM_012102), a gene which binds DRPLA and locates in the nucleus. Accordingly, utilities of VGAM1923 include diagnosis, prevention and treatment of diseases and clinical conditions associated with RERE. The function of RERE and its association with various diseases and clinical conditions, has been established by previous studies, as described hereinabove with reference to VGAM51. Sodium Channel, Voltage-gated, Type IV, Alpha Polypeptide (SCN4A, Accession NM_000334) is another VGAM1923 host target gene. SCN4A BINDING SITE is HOST TARGET binding site found in the 3' untranslated region of mRNA encoded by SCN4A, corresponding to a HOST TARGET binding site such as BINDING SITE I, BINDING SITE II or BINDING SITE III. Table 2 illustrates the complementarity of the nucleotide sequences of SCN4A BINDING SITE, designated SEQ ID:5891, to the nucleotide sequence of VGAM1923 RNA, herein designated VGAM RNA, also designated SEQ ID:4634.

Another function of VGAM1923 is therefore inhibition of Sodium Channel, Voltage-gated, Type IV, Alpha Polypeptide (SCN4A, Accession NM_000334). Accordingly, utilities of VGAM1923 include diagnosis, prevention and treatment of diseases and clinical conditions associated with SCN4A. Solute Carrier Family 1 (glutamate/neutral amino acid transporter), Member 4 (SLC1A4, Accession NM_003038) is another VGAM1923 host target gene. SLC1A4 BINDING SITE is HOST TARGET binding site found in the 3' untranslated region of mRNA encoded by SLC1A4, corresponding to a HOST TARGET binding site such as BINDING SITE I, BINDING SITE II or BINDING SITE III. Table 2 illustrates the complementarity of the nucleotide sequences of SLC1A4 BINDING SITE, designated SEQ ID:8998, to the nucleotide sequence of VGAM1923 RNA, herein designated VGAM RNA, also designated SEQ ID:4634.

Another function of VGAM1923 is therefore inhibition of Solute Carrier Family 1 (glutamate/neutral amino acid transporter), Member 4 (SLC1A4, Accession NM_003038), a gene which transports alanine, serine, cysteine, and threonine. exhibits sodium dependence. Accordingly, utilities of VGAM1923 include diagnosis, prevention and treatment of diseases and clinical conditions associated with SLC1A4. The function of SLC1A4 and its association with various diseases and clinical conditions, has been established by previous studies, as described hereinabove with reference to VGAM859. Synaptosomal-associated Protein, 23 kDa (SNAP23, Accession NM_003825) is another VGAM1923 host target gene. SNAP23 BINDING SITE1 and SNAP23 BINDING SITE2 are HOST TARGET binding sites found in untranslated regions of mRNA encoded by SNAP23, corresponding to HOST TARGET binding sites such as BINDING SITE I, BINDING SITE II or BINDING SITE III. Table 2 illustrates the complementarity of the nucleotide sequences of SNAP23 BINDING SITE1 and SNAP23 BINDING SITE2, designated SEQ ID:9920 and SEQ ID:28285 respectively, to the nucleotide sequence of VGAM1923 RNA, herein designated VGAM RNA, also designated SEQ ID:4634.

Another function of VGAM1923 is therefore inhibition of Synaptosomal-associated Protein, 23 kDa (SNAP23, Accession NM_003825), a gene which is essential component of the high affinity receptor for the general membrane fusion machinery. Accordingly, utilities of VGAM1923 include diagnosis, prevention and treatment of diseases and clinical conditions associated with SNAP23. The function of SNAP23 and its association with various diseases and clinical conditions, has been established by previous studies, as described hereinabove with reference to VGAM1533. Synaptotagmin I (SYT1, Accession NM_005639) is another VGAM1923 host target gene. SYT1 BINDING SITE is HOST TARGET binding site found in the 3' untranslated region of mRNA encoded by SYT1, corresponding to a HOST TARGET binding site such as BINDING SITE I, BINDING SITE II or BINDING SITE III. Table 2 illustrates the complementarity of the nucleotide sequences of SYT1 BINDING SITE, designated SEQ ID:12170, to the nucleotide sequence of VGAM1923 RNA, herein designated VGAM RNA, also designated SEQ ID:4634.

Another function of VGAM1923 is therefore inhibition of Synaptotagmin I (SYT1, Accession NM_005639), a gene which may have a regulatory role in the membrane interactions during trafficking of synaptic vesicles at the active zone of the synapse. Accordingly, utilities of VGAM1923 include diagnosis, prevention and treatment of diseases and clinical conditions associated with SYT1. The function of SYT1 and its association with various diseases and clinical conditions, has been established by previous studies, as described hereinabove with reference to VGAM739. Transcription Factor 8 (represses interleukin 2 expression) (TCF8, Accession NM_030751) is another VGAM1923 host target gene. TCF8 BINDING SITE is HOST TARGET binding site found in the 3' untranslated region of mRNA encoded by TCF8, corresponding to a HOST TARGET binding site such as BINDING SITE I, BINDING SITE II or BINDING SITE III. Table 2 illustrates the complementarity of the nucleotide sequences of TCF8 BINDING SITE, designated SEQ ID:25038, to the nucleotide sequence of VGAM1923 RNA, herein designated VGAM RNA, also designated SEQ ID:4634.

Another function of VGAM1923 is therefore inhibition of Transcription Factor 8 (represses interleukin 2 expression) (TCF8, Accession NM_030751), a gene which may be responsible for transcriptional repression of the il-2 gene and regulates the promoter activity of the atp1a1 gene. Accordingly, utilities of VGAM1923 include diagnosis, prevention and treatment of diseases and clinical conditions associated with TCF8. The function of TCF8 and its association with various diseases and clinical conditions, has been established by previous studies, as described hereinabove with reference to VGAM166. Tumor Necrosis Factor (ligand) Superfamily, Member 9 (TNFSF9, Accession NM_003811) is another VGAM1923 host target gene. TNFSF9 BINDING SITE is HOST TARGET binding site found in the 3' untranslated region of mRNA encoded by TNFSF9, corresponding to a HOST TARGET binding site such as BINDING SITE I, BINDING SITE II or BINDING SITE III. Table 2 illustrates the complementarity of the nucleotide sequences of TNFSF9 BINDING SITE, designated SEQ ID:9902, to the nucleotide sequence of VGAM1923 RNA, herein designated VGAM RNA, also designated SEQ ID:4634.

Another function of VGAM1923 is therefore inhibition of Tumor Necrosis Factor (ligand) Superfamily, Member 9 (TNFSF9, Accession NM_003811). Accordingly, utilities of VGAM1923 include diagnosis, prevention and treatment of diseases and clinical conditions associated with TNFSF9. Visual System Homeobox 1 Homolog, CHX10-like (zebrafish) (VSX1, Accession NM_014588) is another VGAM1923 host target gene. VSX1 BINDING SITE is HOST TARGET binding site found in the 3' untranslated region of mRNA encoded by VSX1, corresponding to a HOST TARGET binding site such as BINDING SITE I, BINDING SITE II or BINDING SITE III. Table 2 illustrates the complementarity of the nucleotide sequences of VSX1 BINDING SITE, designated SEQ ID:15956, to the nucleotide sequence of VGAM1923 RNA, herein designated VGAM RNA, also designated SEQ ID:4634.

Another function of VGAM1923 is therefore inhibition of Visual System Homeobox 1 Homolog, CHX10-like (zebrafish) (VSX1, Accession NM_014588), a gene which is implicated in ocular development. Accordingly, utilities of VGAM1923 include diagnosis, prevention and treatment of diseases and clinical conditions associated with VSX1. The function of VSX1 and its association with various diseases and clinical conditions, has been established by previous studies, as described hereinabove with reference to VGAM665. WSX1 (Accession NM_004843) is another VGAM1923 host target gene. WSX1 BINDING SITE is HOST TARGET binding site found in the 5' untranslated region of mRNA encoded by WSX1, corresponding to a HOST TARGET binding site such as BINDING SITE I, BINDING SITE II or BINDING SITE III. Table 2 illustrates the complementarity of the nucleotide sequences of WSX1 BINDING SITE, designated SEQ ID:11256, to the nucleotide sequence of VGAM1923 RNA, herein designated VGAM RNA, also designated SEQ ID:4634.

Another function of VGAM1923 is therefore inhibition of WSX1 (Accession NM_004843), a gene which is a member of the class I cytokine receptor family and involved in the modulation of the immune response. Accordingly, utilities of VGAM1923 include diagnosis, prevention and treatment of diseases and clinical conditions associated with WSX1. The function of WSX1 and its association with various diseases and clinical conditions, has been established by previous studies, as described hereinabove with reference to VGAM1125. Tyrosine 3-monooxygenase/tryptophan 5-monooxygenase Activation Protein, Eta Polypeptide (YWHAH, Accession NM_003405) is another VGAM1923 host target gene. YWHAH BINDING SITE is HOST TARGET binding site found in the 3" untranslated region of mRNA encoded by YWHAH, corresponding to a HOST TARGET binding site such as BINDING SITE I, BINDING SITE II or BINDING SITE III. Table 2 illustrates the complementarity of the nucleotide sequences of YWHAH BINDING SITE, designated SEQ ID:9439, to the nucleotide sequence of VGAM1923 RNA, herein designated VGAM RNA, also designated SEQ ID:4634.

Another function of VGAM1923 is therefore inhibition of Tyrosine 3-monooxygenase/tryptophan 5-monooxygenase Activation Protein, Eta Polypeptide (YWHAH, Accession NM_003405), a gene which activates tyrosine and tryptophan hydroxylases in the presence of and strongly activates protein kinase c. Accordingly, utilities of VGAM1923 include diagnosis, prevention and treatment of diseases and clinical conditions associated with YWHAH. The function of YWHAH has been established by previous studies. Protein 14-3-3 is a protein kinase-dependent activator of tyrosine and tryptophan hydroxylases (191290, 191060) and an endogenous inhibitor of protein kinase C (OMIM Ref. No. 176960). It was first described as a brain-specific bovine protein. It consists of acidic dimeric subunits of about 27 kD. Immunohistochemical analyses showed that the 14-3-3 protein is located exclusively in the cytoplasm of neurons in the cerebral cortex and is axonally transported to the nerve terminals. Electrophoresis and chromatography demonstrated that the 14-3-3 protein exists in at least 7 distinct forms: alpha, beta, gamma, delta, epsilon, zeta, and eta. Watanabe et al. (1994) found mRNA corresponding to an eighth subtype, which they termed theta, in rat brain. The mRNA theta subtype was found in the gray matter of cerebellar cortex and the hippocampus, as well as in white matter where cell bodies of glial cells predominate. In contrast, mRNA of the zeta subtype was distributed widely in the brain gray matter with high levels of transcripts in the neocortex, hippocampus, caudate-putamen, thalamus, cerebellar cortex, and several brain stem nuclei. A human protein with phospholipase A2 activity was shown to be the zeta subtype of the 14-3-3 protein (Zupan et al., 1992). The gene is also symbolized YWHAH. Muratake et al. (1996) determined that the human YWHAH gene has 2 exons separated by an intron of approximately 8 kb. Using S1 nuclease mapping, primer extension, and RACE PCR, Muratake et al. (1996) identified the transcription initiation site. They also identified several regulatory element sequences, including CRE, in the 5-prime noncoding region. Muratake et al. (1996) noted that the presence of a CRE binding element may indicate that this gene is involved in brain responses to narcotics. The authors also found changes in a 7-bp repeat sequence (GCCTGCA) located in the noncoding region of exon 1 and they speculated that these changes, or other changes in the sequence of this gene, may be associated with neuropsychiatric disorders.

Full details of the abovementioned studies are described in the following publications, the disclosure of which are hereby incorporated by reference:

Muratake, T.; Hayashi, S.; Ichikawa, T.; Kumanishi, T.; Ichimura, Y.; Kuwano, R.; Isobe, T.; Wang, Y.; Minoshima, S.; Shimizu, N.; Takahashi, Y.: Structural organization and chromosomal assignment of the human 14-3-3-eta chain gene (YWHAH). Genomics 36:63-69, 1996; and Zupan, L. A.; Steffens, D. L.; Berry, C. A.; Landt, M.; Gross, R. W.: Cloning and expression of a human 14-3-3 protein mediating phospholipolysis. J. Biol. Chem. 267: 8707-8710, 1992.

Further studies establishing the function and utilities of YWHAH are found in John Hopkins OMIM database record ID 113508, and in sited publications numbered 4188-4193 listed in the bibliography section hereinbelow, which are also hereby incorporated by reference. A Kinase (PRKA) Anchor Protein 11 (AKAP11, Accession NM_016248) is another VGAM1923 host target gene. AKAP11 BINDING SITE is HOST TARGET binding site found in the 3' untranslated region of mRNA encoded by AKAP11, corresponding to a HOST TARGET binding site such as BINDING SITE I, BINDING SITE II or BINDING SITE III. Table 2 illustrates the complementarity of the nucleotide sequences of AKAP11 BINDING SITE, designated SEQ ID:18369, to the nucleotide sequence of VGAM1923 RNA, herein designated VGAM RNA, also designated SEQ ID:4634.

Another function of VGAM1923 is therefore inhibition of A Kinase (PRKA) Anchor Protein 11 (AKAP11, Accession NM_016248). Accordingly, utilities of VGAM1923 include diagnosis, prevention and treatment of diseases and clinical conditions associated with AKAP11. AP1S3 (Accession XM_059421) is another VGAM1923 host target gene. AP1S3 BINDING SITE is HOST TARGET binding site found in the 3' untranslated region of mRNA encoded by AP1S3, corresponding to a HOST TARGET binding site such as BINDING SITE I, BINDING SITE II or BINDING SITE III. Table 2 illustrates the complementarity of the nucleotide sequences of AP1S3 BINDING SITE, designated SEQ ID:36987, to the nucleotide sequence of VGAM1923 RNA, herein designated VGAM RNA, also designated SEQ ID:4634.

Another function of VGAM1923 is therefore inhibition of AP1S3 (Accession XM_059421). Accordingly, utilities of VGAM1923 include diagnosis, prevention and treatment of diseases and clinical conditions associated with AP1S3. ARPP-19 (Accession NM_006628) is another VGAM1923 host target gene. ARPP-19 BINDING SITE is HOST TARGET binding site found in the 3' untranslated region of mRNA encoded by ARPP-19, corresponding to a HOST TARGET binding site such as BINDING SITE I, BINDING SITE II or BINDING SITE III. Table 2 illustrates the complementarity of the nucleotide sequences of ARPP-19 BINDING SITE, designated SEQ ID:13426, to the nucleotide sequence of VGAM1923 RNA, herein designated VGAM RNA, also designated SEQ ID:4634.

Another function of VGAM1923 is therefore inhibition of ARPP-19 (Accession NM_006628). Accordingly, utilities of VGAM1923 include diagnosis, prevention and treatment of diseases and clinical conditions associated with ARPP-19. ATPase, H+ Transporting, Lysosomal 56/58 kDa, V1 Subunit B, Isoform 2 (ATP6V1B2, Accession NM_001693) is another VGAM1923 host target gene. ATP6V1B2 BINDING SITE is HOST TARGET binding site found in the 3' untranslated region of mRNA encoded by ATP6V1B2, corresponding to a HOST TARGET binding site such as BINDING SITE I, BINDING SITE II or BINDING SITE III. Table 2 illustrates the complementarity of the nucleotide sequences of ATP6V1B2 BINDING SITE, designated SEQ ID:7415, to the nucleotide sequence of VGAM1923 RNA, herein designated VGAM RNA, also designated SEQ ID:4634.

Another function of VGAM1923 is therefore inhibition of ATPase, H+ Transporting, Lysosomal 56/58 kDa, V1 Subunit B, Isoform 2 (ATP6V1B2, Accession NM_001693). Accordingly, utilities of VGAM1923 include diagnosis, prevention and treatment of diseases and clinical conditions associated with ATP6V1B2. BLP2 (Accession NM_025141) is another VGAM1923 host target gene. BLP2 BINDING SITE1 and BLP2 BINDING SITE2 are HOST TARGET binding sites found in untranslated regions of mRNA encoded by BLP2, corresponding to HOST TARGET binding sites such as BINDING SITE I, BINDING SITE II or BINDING SITE III. Table 2 illustrates the complementarity of the nucleotide sequences of BLP2 BINDING SITE1 and BLP2 BINDING SITE2, designated SEQ ID:24780 and SEQ ID:27800 respectively, to the nucleotide sequence of VGAM1923 RNA, herein designated VGAM RNA, also designated SEQ ID:4634.

Another function of VGAM1923 is therefore inhibition of BLP2 (Accession NM_025141). Accordingly, utilities of VGAM1923 include diagnosis, prevention and treatment of diseases and clinical conditions associated with BLP2. Chromosome 20 Open Reading Frame 108 (C20orf108, Accession NM_080821) is another VGAM1923 host target gene. C20orf108 BINDING SITE is HOST TARGET binding site found in the 3' untranslated region of mRNA encoded by C20orf108, corresponding to a HOST TARGET binding site such as BINDING SITE I, BINDING SITE II or BINDING SITE III. Table 2 illustrates the complementarity of the nucleotide sequences of C20orf108 BINDING SITE, designated SEQ ID:28088, to the nucleotide sequence of VGAM1923 RNA, herein designated VGAM RNA, also designated SEQ ID:4634.

Another function of VGAM1923 is therefore inhibition of Chromosome 20 Open Reading Frame 108 (C20orf108, Accession NM_080821). Accordingly, utilities of VGAM1923 include diagnosis, prevention and treatment of diseases and clinical conditions associated with C20orf108. Chromosome 20 Open Reading Frame 140 (C20orf140, Accession NM_144628) is another VGAM1923 host target gene. C20orf140 BINDING SITE is HOST TARGET binding site found in the 3" untranslated region of mRNA encoded by C20orf140, corresponding to a HOST TARGET binding site such as BINDING SITE I, BINDING SITE II or BINDING SITE III. Table 2 illustrates the complementarity of the nucleotide sequences of C20orf140 BINDING SITE, designated SEQ ID:29443, to the nucleotide sequence of VGAM1923 RNA, herein designated VGAM RNA, also designated SEQ ID:4634.

Another function of VGAM1923 is therefore inhibition of Chromosome 20 Open Reading Frame 140 (C20orf140, Accession NM_144628). Accordingly, utilities of VGAM1923 include diagnosis, prevention and treatment of diseases and clinical conditions associated with C20orf140. Chromosome 20 Open Reading Frame 3 (C20orf3, Accession XM_042765) is another VGAM1923 host target gene. C20orf3 BINDING SITE is HOST TARGET binding site found in the 3' untranslated region of mRNA encoded by C20orf3, corresponding to a HOST TARGET binding site such as BINDING SITE I, BINDING SITE II or BINDING SITE III. Table 2 illustrates the complementarity of the nucleotide sequences of C20orf3 BINDING SITE, designated SEQ ID:33766, to the nucleotide sequence of VGAM1923 RNA, herein designated VGAM RNA, also designated SEQ ID:4634.

Another function of VGAM1923 is therefore inhibition of Chromosome 20 Open Reading Frame 3 (C20orf3, Accession XM_042765). Accordingly, utilities of VGAM1923 include diagnosis, prevention and treatment of diseases and clinical conditions associated with C20orf3. Chromosome 20 Open Reading Frame 81 (C20orf81, Accession NM_022760) is another VGAM1923 host target gene. C20orf81 BINDING SITE is HOST TARGET binding site found in the 5' untranslated region of mRNA encoded by C20orf81, corresponding to a HOST TARGET binding site such as BINDING SITE I, BINDING SITE II or BINDING SITE III. Table 2 illustrates the complementarity of the nucleotide sequences of C20orf81 BINDING SITE, designated SEQ ID:23004, to the nucleotide sequence of VGAM1923 RNA, herein designated VGAM RNA, also designated SEQ ID:4634.

Another function of VGAM1923 is therefore inhibition of Chromosome 20 Open Reading Frame 81 (C20orf81, Accession NM_022760). Accordingly, utilities of VGAM1923 include diagnosis, prevention and treatment of diseases and clinical conditions associated with C20orf81. CDW92 (Accession NM_080546) is another VGAM1923 host target gene. CDW92 BINDING SITE is HOST TARGET binding site found in the 3' untranslated region of mRNA encoded by CDW92, corresponding to a HOST TARGET binding site such as BINDING SITE I, BINDING SITE II or BINDING SITE III. Table 2 illustrates the complementarity of the nucleotide sequences of CDW92 BINDING SITE, designated SEQ ID:27868, to the nucleotide sequence of VGAM1923 RNA, herein designated VGAM RNA, also designated SEQ ID:4634.

Another function of VGAM1923 is therefore inhibition of CDW92 (Accession NM_080546). Accordingly, utilities of VGAM1923 include diagnosis, prevention and treatment of diseases and clinical conditions associated with CDW92. CED-6 (Accession NM_016315) is another VGAM1923 host target gene. CED-6 BINDING SITE is HOST TARGET binding site found in the 3' untranslated region of mRNA encoded by CED-6, corresponding to a HOST TARGET binding site such as BINDING SITE I, BINDING SITE II or BINDING SITE III. Table 2 illustrates the complementarity of the nucleotide sequences of CED-6 BINDING SITE, designated SEQ ID:18433, to the nucleotide sequence of VGAM1923 RNA, herein designated VGAM RNA, also designated SEQ ID:4634.

Another function of VGAM1923 is therefore inhibition of CED-6 (Accession NM_016315). Accordingly, utilities of VGAM1923 include diagnosis, prevention and treatment of diseases and clinical conditions associated with CED-6. CHCR (Accession NM_018388) is another VGAM1923 host target gene. CHCR BINDING SITE is HOST TARGET binding site found in the 3' untranslated region of mRNA encoded by CHCR, corresponding to a HOST TARGET binding site such as BINDING SITE I, BINDING SITE II or BINDING SITE III. Table 2 illustrates the complementarity of the nucleotide sequences of CHCR BINDING SITE, designated SEQ ID:20422, to the nucleotide sequence of VGAM1923 RNA, herein designated VGAM RNA, also designated SEQ ID:4634.

Another function of VGAM1923 is therefore inhibition of CHCR (Accession NM_018388). Accordingly, utilities of VGAM1923 include diagnosis, prevention and treatment of diseases and clinical conditions associated with CHCR. DCOHM (Accession NM_032151) is another VGAM1923 host target gene. DCOHM BINDING SITE is HOST TARGET binding site found in the 3' untranslated region of mRNA encoded by DCOHM, corresponding to a HOST TARGET binding site such as BINDING SITE I, BINDING SITE II or BINDING SITE III. Table 2 illustrates the complementarity of the nucleotide sequences of DCOHM BINDING SITE, designated SEQ ID:25848, to the nucleotide sequence of VGAM1923 RNA, herein designated VGAM RNA, also designated SEQ ID:4634.

Another function of VGAM1923 is therefore inhibition of DCOHM (Accession NM_032151). Accordingly, utilities of VGAM1923 include diagnosis, prevention and treatment of diseases and clinical conditions associated with DCOHM. DKFZP434C131 (Accession XM_044630) is another VGAM1923 host target gene. DKFZP434C131 BINDING SITE is HOST TARGET binding site found in the 3' untranslated region of mRNA encoded by DKFZP434C131, corresponding to a HOST TARGET binding site such as BINDING SITE I, BINDING SITE II or BINDING SITE III. Table 2 illustrates the complementarity of the nucleotide sequences of DKFZP434C131 BINDING SITE, designated SEQ ID:34245, to the nucleotide sequence of VGAM1923 RNA, herein designated VGAM RNA, also designated SEQ ID:4634.

Another function of VGAM1923 is therefore inhibition of DKFZP434C131 (Accession XM_044630). Accordingly, utilities of VGAM1923 include diagnosis, prevention and treatment of diseases and clinical conditions associated with DKFZP434C131. DKFZp761G0313 (Accession XM_038026) is another VGAM1923 host target gene. DKFZp761G0313 BINDING SITE is HOST TARGET binding site found in the 3' untranslated region of mRNA encoded by DKFZp761G0313, corresponding to a HOST TARGET binding site such as BINDING SITE I, BINDING SITE II or BINDING SITE III. Table 2 illustrates the complementarity of the nucleotide sequences of DKFZp761G0313 BINDING SITE, designated SEQ ID:32742, to the nucleotide sequence of VGAM1923 RNA, herein designated VGAM RNA, also designated SEQ ID:4634.

Another function of VGAM1923 is therefore inhibition of DKFZp761G0313 (Accession XM_038026). Accordingly, utilities of VGAM1923 include diagnosis, prevention and treatment of diseases and clinical conditions associated with DKFZp761G0313. DKFZp762M136 (Accession XM_035635) is another VGAM1923 host target gene. DKFZp762M136 BINDING SITE is HOST TARGET binding site found in the 3' untranslated region of mRNA encoded by DKFZp762M136, corresponding to a HOST TARGET binding site such as BINDING SITE I, BINDING SITE II or BINDING SITE III. Table 2 illustrates the complementarity of the nucleotide sequences of DKFZp762M136 BINDING SITE, designated SEQ ID:32304, to the nucleotide sequence of VGAM1923 RNA, herein designated VGAM RNA, also designated SEQ ID:4634.

Another function of VGAM1923 is therefore inhibition of DKFZp762M136 (Accession XM_035635). Accordingly, utilities of VGAM1923 include diagnosis, prevention and treatment of diseases and clinical conditions associated with DKFZp762M136. EDR2 (Accession XM_018136) is another VGAM1923 host target gene. EDR2 BINDING SITE is HOST TARGET binding site found in the 3' untranslated region of mRNA encoded by EDR2, corresponding to a HOST TARGET binding site such as BINDING SITE I, BINDING SITE II or BINDING SITE III. Table 2 illustrates the complementarity of the nucleotide sequences of EDR2 BINDING SITE, designated SEQ ID:30340, to the nucleotide sequence of VGAM1923 RNA, herein designated VGAM RNA, also designated SEQ ID:4634.

Another function of VGAM1923 is therefore inhibition of EDR2 (Accession XM_018136). Accordingly, utilities of VGAM1923 include diagnosis, prevention and treatment of diseases and clinical conditions associated with EDR2. EFA6R (Accession NM_015310) is another VGAM1923 host target gene. EFA6R BINDING SITE is HOST TARGET binding site found in the 3' untranslated region of mRNA encoded by EFA6R, corresponding to a HOST TARGET binding site such as BINDING SITE I, BINDING SITE II or BINDING SITE III. Table 2 illustrates the complementarity of the nucleotide sequences of EFA6R BINDING SITE, designated SEQ ID:17626, to the nucleotide sequence of VGAM1923 RNA, herein designated VGAM RNA, also designated SEQ ID:4634.

Another function of VGAM1923 is therefore inhibition of EFA6R (Accession NM_015310). Accordingly, utilities of VGAM1923 include diagnosis, prevention and treatment of diseases and clinical conditions associated with EFA6R. ESDN (Accession NM_080927) is another VGAM1923 host target gene. ESDN BINDING SITE is HOST TARGET binding site found in the 3' untranslated region of mRNA encoded by ESDN, corresponding to a HOST TARGET binding site such as BINDING SITE I, BINDING SITE II or BINDING SITE III. Table 2 illustrates the complementarity of the nucleotide sequences of ESDN BINDING SITE, designated SEQ ID:28154, to the nucleotide sequence of VGAM1923 RNA, herein designated VGAM RNA, also designated SEQ ID:4634.

Another function of VGAM1923 is therefore inhibition of ESDN (Accession NM_080927). Accordingly, utilities of VGAM1923 include diagnosis, prevention and treatment of diseases and clinical conditions associated with ESDN. FLJ00007 (Accession XM_048928) is another VGAM1923 host target gene. FLJ00007 BINDING SITE is HOST TARGET binding site found in the 3' untranslated region of mRNA encoded by FLJ00007, corresponding to a HOST TARGET binding site such as BINDING SITE I, BINDING SITE II or BINDING SITE III. Table 2 illustrates the complementarity of the nucleotide sequences of FLJ00007 BINDING SITE, designated SEQ ID:35312, to the nucleotide sequence of VGAM1923 RNA, herein designated VGAM RNA, also designated SEQ ID:4634.

Another function of VGAM1923 is therefore inhibition of FLJ00007 (Accession XM_048928). Accordingly, utilities of VGAM1923 include diagnosis, prevention and treatment of diseases and clinical conditions associated with FLJ00007. FLJ12587 (Accession NM_022480) is another VGAM1923 host target gene. FLJ12587 BINDING SITE is HOST TARGET binding site found in the 3' untranslated region of mRNA encoded by FLJ12587, corresponding to a HOST TARGET binding site such as BINDING SITE I, BINDING SITE II or BINDING SITE III. Table 2 illustrates the complementarity of the nucleotide sequences of FLJ12587 BINDING SITE, designated SEQ ID:22852, to the nucleotide sequence of VGAM1923 RNA, herein designated VGAM RNA, also designated SEQ ID:4634.

Another function of VGAM1923 is therefore inhibition of FLJ12587 (Accession NM_022480). Accordingly, utilities of VGAM1923 include diagnosis, prevention and treatment of diseases and clinical conditions associated with FLJ12587. FLJ13055 (Accession NM_022737) is another VGAM1923 host target gene. FLJ13055 BINDING SITE is HOST TARGET binding site found in the 3' untranslated region of mRNA encoded by FLJ13055, corresponding to a HOST TARGET binding site such as BINDING SITE I, BINDING SITE II or BINDING SITE III. Table 2 illustrates the complementarity of the nucleotide sequences of FLJ13055 BINDING SITE, designated SEQ ID:22945, to the nucleotide sequence of VGAM1923 RNA, herein designated VGAM RNA, also designated SEQ ID:4634.

Another function of VGAM1923 is therefore inhibition of FLJ13055 (Accession NM_022737). Accordingly, utilities of VGAM1923 include diagnosis, prevention and treatment of diseases and clinical conditions associated with FLJ13055. FLJ13315 (Accession NM_025005) is another VGAM1923 host target gene. FLJ13315 BINDING SITE is HOST TARGET binding site found in the 3' untranslated region of mRNA encoded by FLJ13315, corresponding to a HOST TARGET binding site such as BINDING SITE I, BINDING SITE II or BINDING SITE III. Table 2 illustrates the complementarity of the nucleotide sequences of FLJ13315 BINDING SITE, designated SEQ ID:24577, to the nucleotide sequence of VGAM1923 RNA, herein designated VGAM RNA, also designated SEQ ID:4634.

Another function of VGAM1923 is therefore inhibition of FLJ13315 (Accession NM_025005). Accordingly, utilities of VGAM1923 include diagnosis, prevention and treatment of diseases and clinical conditions associated with FLJ13315. FLJ13962 (Accession NM_024862) is another VGAM1923 host target gene. FLJ13962 BINDING SITE is HOST TARGET binding site found in the 3' untranslated region of mRNA encoded by FLJ13962, corresponding to a HOST TARGET binding site such as BINDING SITE I, BINDING SITE II or BINDING SITE III. Table 2 illustrates the complementarity of the nucleotide sequences of FLJ13962 BINDING SITE, designated SEQ ID:24299, to the nucleotide sequence of VGAM1923 RNA, herein designated VGAM RNA, also designated SEQ ID:4634.

Another function of VGAM1923 is therefore inhibition of FLJ13962 (Accession NM_024862). Accordingly, utilities of VGAM1923 include diagnosis, prevention and treatment of diseases and clinical conditions associated with FLJ13962. FLJ14084 (Accession NM_021637) is another VGAM1923 host target gene. FLJ14084 BINDING SITE is HOST TARGET binding site found in the 3' untranslated region of mRNA encoded by FLJ14084, corresponding to a HOST TARGET binding site such as BINDING SITE I, BINDING SITE II or BINDING SITE III. Table 2 illustrates the complementarity of the nucleotide sequences of FLJ14084 BINDING SITE, designated SEQ ID:22286, to the nucleotide sequence of VGAM1923 RNA, herein designated VGAM RNA, also designated SEQ ID:4634.

Another function of VGAM1923 is therefore inhibition of FLJ14084 (Accession NM_021637). Accordingly, utilities of VGAM1923 include diagnosis, prevention and treatment of diseases and clinical conditions associated with FLJ14084. FLJ20312 (Accession NM_017761) is another VGAM1923 host target gene. FLJ20312 BINDING SITE is HOST TARGET binding site found in the 3' untranslated region of mRNA encoded by FLJ20312, corresponding to a HOST TARGET binding site such as BINDING SITE I, BINDING SITE II or BINDING SITE III. Table 2 illustrates the complementarity of the nucleotide sequences of FLJ20312 BINDING SITE, designated SEQ ID:19376, to the nucleotide sequence of VGAM1923 RNA, herein designated VGAM RNA, also designated SEQ ID:4634.

Another function of VGAM1923 is therefore inhibition of FLJ20312 (Accession NM_017761). Accordingly, utilities of VGAM1923 include diagnosis, prevention and treatment of diseases and clinical conditions associated with FLJ20312. FLJ20445 (Accession NM_017824) is another VGAM1923 host target gene. FLJ20445 BINDING SITE is HOST TARGET binding site found in the 3' untranslated region of mRNA encoded by FLJ20445, corresponding to a HOST TARGET binding site such as BINDING SITE I, BINDING SITE II or BINDING SITE III. Table 2 illustrates the complementarity of the nucleotide sequences of FLJ20445 BINDING SITE, designated SEQ ID:19483, to the nucleotide sequence of VGAM1923 RNA, herein designated VGAM RNA, also designated SEQ ID:4634.

Another function of VGAM1923 is therefore inhibition of FLJ20445 (Accession NM_017824). Accordingly, utilities of VGAM1923 include diagnosis, prevention and treatment of diseases and clinical conditions associated with FLJ20445. FLJ22794 (Accession XM_166220) is another VGAM1923 host target gene. FLJ22794 BINDING SITE is HOST TARGET binding site found in the 5' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44034, to the nucleotide sequence of VGAM1923 RNA, herein designated VGAM RNA, also designated SEQ ID:4634.

Another function of VGAM1923 is therefore inhibition of FLJ22794 (Accession XM_166220). Accordingly, utilities of VGAM1923 include diagnosis, prevention and treatment of diseases and clinical conditions associated with FLJ22794. FLJ32783 (Accession NM_144968) is another VGAM1923 host target gene. FLJ32783 BINDING SITE is HOST TARGET binding site found in the 3' untranslated region of mRNA encoded by FLJ32783, corresponding to a HOST TARGET binding site such as BINDING SITE I, BINDING SITE II or BINDING SITE III. Table 2 illustrates the complementarity of the nucleotide sequences of FLJ32783 BINDING SITE, designated SEQ ID:29584, to the nucleotide sequence of VGAM1923 RNA, herein designated VGAM RNA, also designated SEQ ID:4634.

Another function of VGAM1923 is therefore inhibition of FLJ32783 (Accession NM_144968). Accordingly, utilities of VGAM1923 include diagnosis, prevention and treatment of diseases and clinical conditions associated with FLJ32783. GL004 (Accession XM_038373) is another VGAM1923 host target gene. GL004 BINDING SITE is HOST TARGET binding site found in the 3' untranslated region of mRNA encoded by GL004, corresponding to a HOST TARGET binding site such as BINDING SITE I, BINDING SITE II or BINDING SITE III. Table 2 illustrates the complementarity of the nucleotide sequences of GL004 BINDING SITE, designated SEQ ID:32828, to the nucleotide sequence of VGAM1923 RNA, herein designated VGAM RNA, also designated SEQ ID:4634.

Another function of VGAM1923 is therefore inhibition of GL004 (Accession XM_038373). Accordingly, utilities of VGAM1923 include diagnosis, prevention and treatment of diseases and clinical conditions associated with GL004. HSJ1 (Accession NM_006736) is another VGAM1923 host target gene. HSJ1 BINDING SITE is HOST TARGET binding site found in the 3' untranslated region of mRNA encoded by HSJ1, corresponding to a HOST TARGET binding site such as BINDING SITE I, BINDING SITE II or BINDING SITE III. Table 2 illustrates the complementarity of the nucleotide sequences of HSJ1 BINDING SITE, designated SEQ ID:13588, to the nucleotide sequence of VGAM1923 RNA, herein designated VGAM RNA, also designated SEQ ID:4634.

Another function of VGAM1923 is therefore inhibition of HSJ1 (Accession NM_006736). Accordingly, utilities of VGAM1923 include diagnosis, prevention and treatment of diseases and clinical conditions associated with HSJ1. IBTK (Accession XM_041401) is another VGAM1923 host target gene. IBTK BINDING SITE is HOST TARGET binding site found in the 3' untranslated region of mRNA encoded by IBTK, corresponding to a HOST TARGET binding site such as BINDING SITE I, BINDING SITE II or BINDING SITE III. Table 2 illustrates the complementarity of the nucleotide sequences of IBTK BINDING SITE, designated SEQ ID:33518, to the nucleotide sequence of VGAM1923 RNA, herein designated VGAM RNA, also designated SEQ ID:4634.

Another function of VGAM1923 is therefore inhibition of IBTK (Accession XM_041401). Accordingly, utilities of VGAM1923 include diagnosis, prevention and treatment of diseases and clinical conditions associated with IBTK. KIAA0016 (Accession NM_014765) is another VGAM1923 host target gene. KIAA0016 BINDING SITE is HOST TARGET binding site found in the 3" untranslated region of mRNA encoded by KIAA0016, corresponding to a HOST TARGET binding site such as BINDING SITE I, BINDING SITE II or BINDING SITE III. Table 2 illustrates the complementarity of the nucleotide sequences of KIAA0016 BINDING SITE, designated SEQ ID:16533, to the nucleotide sequence of VGAM1923 RNA, herein designated VGAM RNA, also designated SEQ ID:4634.

Another function of VGAM1923 is therefore inhibition of KIAA0016 (Accession NM_014765). Accordingly, utilities of VGAM1923 include diagnosis, prevention and treatment of diseases and clinical conditions associated with KIAA0016. KIAA0090 (Accession XM_114045) is another VGAM1923 host target gene. KIAA0090 BINDING SITE is HOST TARGET binding site found in the 3' untranslated region of mRNA encoded by KIAA0090, corresponding to a HOST TARGET binding site such as BINDING SITE I, BINDING SITE II or BINDING SITE III. Table 2 illustrates the complementarity of the nucleotide sequences of KIAA0090 BINDING SITE, designated SEQ ID:42653, to the nucleotide sequence of VGAM1923 RNA, herein designated VGAM RNA, also designated SEQ ID:4634.

Another function of VGAM1923 is therefore inhibition of KIAA0090 (Accession XM_114045). Accordingly, utilities of VGAM1923 include diagnosis, prevention and treatment of diseases and clinical conditions associated with KIAA0090. KIAA0152 (Accession NM_014730) is another VGAM1923 host target gene. KIAA0152 BINDING SITE is HOST TARGET binding site found in the 3' untranslated region of mRNA encoded by KIAA0152, corresponding to a HOST TARGET binding site such as BINDING SITE I, BINDING SITE II or BINDING SITE III. Table 2 illustrates the complementarity of the nucleotide sequences of KIAA0152 BINDING SITE, designated SEQ ID:16338, to the nucleotide sequence of VGAM1923 RNA, herein designated VGAM RNA, also designated SEQ ID:4634.

Another function of VGAM1923 is therefore inhibition of KIAA0152 (Accession NM_014730). Accordingly, utilities of VGAM1923 include diagnosis, prevention and treatment of diseases and clinical conditions associated with KIAA0152. KIAA0285 (Accession NM_014807) is another VGAM1923 host target gene. KIAA0285 BINDING SITE is HOST TARGET binding site found in the 3' untranslated region of mRNA encoded by KIAA0285, corresponding to a HOST TARGET binding site such as BINDING SITE I, BINDING SITE II or BINDING SITE III. Table 2 illustrates the complementarity of the nucleotide sequences of KIAA0285 BINDING SITE, designated SEQ ID:16748, to the nucleotide sequence of VGAM1923 RNA, herein designated VGAM RNA, also designated SEQ ID:4634.

Another function of VGAM1923 is therefore inhibition of KIAA0285 (Accession NM_014807). Accordingly, utilities of VGAM1923 include diagnosis, prevention and treatment of diseases and clinical conditions associated with KIAA0285. KIAA0459 (Accession XM_027862) is another VGAM1923 host target gene. KIAA0459 BINDING SITE is HOST TARGET binding site found in the 3' untranslated region of mRNA encoded by KIAA0459, corresponding to a HOST TARGET binding site such as BINDING SITE I, BINDING SITE II or BINDING SITE III. Table 2 illustrates the complementarity of the nucleotide sequences of KIAA0459 BINDING SITE, designated SEQ ID:30577, to the nucleotide sequence of VGAM1923 RNA, herein designated VGAM RNA, also designated SEQ ID:4634.

Another function of VGAM1923 is therefore inhibition of KIAA0459 (Accession XM_027862). Accordingly, utilities of VGAM1923 include diagnosis, prevention and treatment of diseases and clinical conditions associated with KIAA0459. KIAA0495 (Accession XM_031397) is another VGAM1923 host target gene. KIAA0495 BINDING SITE is HOST TARGET binding site found in the 3' untranslated region of mRNA encoded by KIAA0495, corresponding to a HOST TARGET binding site such as BINDING SITE I, BINDING SITE II or BINDING SITE III. Table 2 illustrates the complementarity of the nucleotide sequences of KIAA0495 BINDING SITE, designated SEQ ID:31361, to the nucleotide sequence of VGAM1923 RNA, herein designated VGAM RNA, also designated SEQ ID:4634.

Another function of VGAM1923 is therefore inhibition of KIAA0495 (Accession XM_031397). Accordingly, utilities of VGAM1923 include diagnosis, prevention and treatment of diseases and clinical conditions associated with KIAA0495. KIAA0574 (Accession XM_045076) is another VGAM1923 host target gene. KIAA0574 BINDING SITE is HOST TARGET binding site found in the 3' untranslated region of mRNA encoded by KIAA0574, corresponding to a HOST TARGET binding site such as BINDING SITE I, BINDING SITE II or BINDING SITE III. Table 2 illustrates the complementarity of the nucleotide sequences of KIAA0574 BINDING SITE, designated SEQ ID:34346, to the nucleotide sequence of VGAM1923 RNA, herein designated VGAM RNA, also designated SEQ ID:4634.

Another function of VGAM1923 is therefore inhibition of KIAA0574 (Accession XM_045076). Accordingly, utilities of VGAM1923 include diagnosis, prevention and treatment of diseases and clinical conditions associated with KIAA0574. KIAA0680 (Accession NM_014721) is another VGAM1923 host target gene. KIAA0680 BINDING SITE is HOST TARGET binding site found in the 3' untranslated region of mRNA encoded by KIAA0680, corresponding to a HOST TARGET binding site such as BINDING SITE I, BINDING SITE II or BINDING SITE III. Table 2 illustrates the complementarity of the nucleotide sequences of KIAA0680 BINDING SITE, designated SEQ ID:16285, to the nucleotide sequence of VGAM1923 RNA, herein designated VGAM RNA, also designated SEQ ID:4634.

Another function of VGAM1923 is therefore inhibition of KIAA0680 (Accession NM_014721). Accordingly, utilities of VGAM1923 include diagnosis, prevention and treatment of diseases and clinical conditions associated with KIAA0680. KIAA0800 (Accession NM_014703) is another VGAM1923 host target gene. KIAA0800 BINDING SITE is HOST TARGET binding site found in the 5' untranslated region of mRNA encoded by KIAA0800, corresponding to a HOST TARGET binding site such as BINDING SITE I, BINDING SITE II or BINDING SITE III. Table 2 illustrates the complementarity of the nucleotide sequences of KIAA0800 BINDING SITE, designated SEQ ID:16238, to the nucleotide sequence of VGAM1923 RNA, herein designated VGAM RNA, also designated SEQ ID:4634.

Another function of VGAM1923 is therefore inhibition of KIAA0800 (Accession NM_014703). Accordingly, utilities of VGAM1923 include diagnosis, prevention and treatment of diseases and clinical conditions associated with KIAA0800. KIAA0871 (Accession NM_014961) is another VGAM1923 host target gene. KIAA0871 BINDING SITE is HOST TARGET binding site found in the 5' untranslated region of mRNA encoded by KIAA0871, corresponding to a HOST TARGET binding site such as BINDING SITE I, BINDING SITE II or BINDING SITE III. Table 2 illustrates the complementarity of the nucleotide sequences of KIAA0871 BINDING SITE, designated SEQ ID:17333, to the nucleotide sequence of VGAM1923 RNA, herein designated VGAM RNA, also designated SEQ ID:4634.

Another function of VGAM1923 is therefore inhibition of KIAA0871 (Accession NM_014961). Accordingly, utilities of VGAM1923 include diagnosis, prevention and treatment of diseases and clinical conditions associated with KIAA0871. KIAA1096 (Accession XM_043678) is another VGAM1923 host target gene. KIAA1096 BINDING SITE is HOST TARGET binding site found in the 3' untranslated region of mRNA encoded by KIAA1096, corresponding to a HOST TARGET binding site such as BINDING SITE I, BINDING SITE II or BINDING SITE III. Table 2 illustrates the complementarity of the nucleotide sequences of KIAA1096 BINDING SITE, designated SEQ ID:33997, to the nucleotide sequence of VGAM1923 RNA, herein designated VGAM RNA, also designated SEQ ID:4634.

Another function of VGAM1923 is therefore inhibition of KIAA1096 (Accession XM_043678). Accordingly, utilities of VGAM1923 include diagnosis, prevention and treatment of diseases and clinical conditions associated with KIAA1096. KIAA1145 (Accession XM_037790) is another VGAM1923 host target gene. KIAA1145 BINDING SITE is HOST TARGET binding site found in the 3' untranslated region of mRNA encoded by KIAA1145, corresponding to a HOST TARGET binding site such as BINDING SITE I, BINDING SITE II or BINDING SITE III. Table 2 illustrates the complementarity of the nucleotide sequences of KIAA1145 BINDING SITE, designated SEQ ID:32683, to the nucleotide sequence of VGAM1923 RNA, herein designated VGAM RNA, also designated SEQ ID:4634.

Another function of VGAM1923 is therefore inhibition of KIAA1145 (Accession XM_037790). Accordingly, utilities of VGAM1923 include diagnosis, prevention and treatment of diseases and clinical conditions associated with KIAA1145. KIAA1198 (Accession XM_032674) is another VGAM1923 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31713, to the nucleotide sequence of VGAM1923 RNA, herein designated VGAM RNA, also designated SEQ ID:4634.

Another function of VGAM1923 is therefore inhibition of KIAA1198 (Accession XM_032674). Accordingly, utilities of VGAM1923 include diagnosis, prevention and treatment of diseases and clinical conditions associated with KIAA1198. KIAA1203 (Accession XM_049683) is another VGAM1923 host target gene. KIAA1203 BINDING SITE is HOST TARGET binding site found in the 3' untranslated region of mRNA encoded by KIAA1203, corresponding to a HOST TARGET binding site such as BINDING SITE I, BINDING SITE II or BINDING SITE III. Table 2 illustrates the complementarity of the nucleotide sequences of KIAA1203 BINDING SITE, designated SEQ ID:35471, to the nucleotide sequence of VGAM1923 RNA, herein designated VGAM RNA, also designated SEQ ID:4634.

Another function of VGAM1923 is therefore inhibition of KIAA1203 (Accession XM_049683). Accordingly, utilities of VGAM1923 include diagnosis, prevention and treatment of diseases and clinical conditions associated with KIAA1203. KIAA1209 (Accession XM_027307) is another VGAM1923 host target gene. KIAA1209 BINDING SITE is HOST TARGET binding site found in the 3' untranslated region of mRNA encoded by KIAA1209, corresponding to a HOST TARGET binding site such as BINDING SITE I, BINDING SITE II or BINDING SITE III. Table 2 illustrates the complementarity of the nucleotide sequences of KIAA1209 BINDING SITE, designated SEQ ID:30472, to the nucleotide sequence of VGAM1923 RNA, herein designated VGAM RNA, also designated SEQ ID:4634.

Another function of VGAM1923 is therefore inhibition of KIAA1209 (Accession XM_027307). Accordingly, utilities of VGAM1923 include diagnosis, prevention and treatment of diseases and clinical conditions associated with KIAA1209. KIAA1277 (Accession XM_035114) is another VGAM1923 host target gene. KIAA1277 BINDING SITE is HOST TARGET binding site found in the 3' untranslated region of mRNA encoded by KIAA1277, corresponding to a HOST TARGET binding site such as BINDING SITE I, BINDING SITE II or BINDING SITE III. Table 2 illustrates the complementarity of the nucleotide sequences of KIAA1277 BINDING SITE, designated SEQ ID:32206, to the nucleotide sequence of VGAM1923 RNA, herein designated VGAM RNA, also designated SEQ ID:4634.

Another function of VGAM1923 is therefore inhibition of KIAA1277 (Accession XM_035114). Accordingly, utilities of VGAM1923 include diagnosis, prevention and treatment of diseases and clinical conditions associated with KIAA1277. KIAA1301 (Accession XM_038999) is another VGAM1923 host target gene. KIAA1301 BINDING SITE is HOST TARGET binding site found in the 3' untranslated region of mRNA encoded by KIAA1301, corresponding to a HOST TARGET binding site such as BINDING SITE I, BINDING SITE II or BINDING SITE III. Table 2 illustrates the complementarity of the nucleotide sequences of KIAA1301 BINDING SITE, designated SEQ ID:32979, to the nucleotide sequence of VGAM1923 RNA, herein designated VGAM RNA, also designated SEQ ID:4634.

Another function of VGAM1923 is therefore inhibition of KIAA1301 (Accession XM_038999). Accordingly, utilities of VGAM1923 include diagnosis, prevention and treatment of diseases and clinical conditions associated with KIAA1301. KIAA1497 (Accession XM_041431) is another VGAM1923 host target gene. KIAA1497 BINDING SITE is HOST TARGET binding site found in the 5' untranslated region of mRNA encoded by KIAA1497, corresponding to a HOST TARGET binding site such as BINDING SITE I, BINDING SITE II or BINDING SITE III. Table 2 illustrates the complementarity of the nucleotide sequences of KIAA1497 BINDING SITE, designated SEQ ID:33530, to the nucleotide sequence of VGAM1923 RNA, herein designated VGAM RNA, also designated SEQ ID:4634.

Another function of VGAM1923 is therefore inhibition of KIAA1497 (Accession XM_041431). Accordingly, utilities of VGAM1923 include diagnosis, prevention and treatment of diseases and clinical conditions associated with KIAA1497. KIAA1677 (Accession XM_040383) is another VGAM1923 host target gene. KIAA1677 BINDING SITE is HOST TARGET binding site found in the 3' untranslated region of mRNA encoded by KIAA1677, corresponding to a HOST TARGET binding site such as BINDING SITE I, BINDING SITE II or BINDING SITE III. Table 2 illustrates the complementarity of the nucleotide sequences of KIAA1677 BINDING SITE, designated SEQ ID:33293, to the nucleotide sequence of VGAM1923 RNA, herein designated VGAM RNA, also designated SEQ ID:4634.

Another function of VGAM1923 is therefore inhibition of KIAA1677 (Accession XM_040383). Accordingly, utilities of VGAM1923 include diagnosis, prevention and treatment of diseases and clinical conditions associated with KIAA1677. KIAA1679 (Accession XM_046570) is another VGAM1923 host target gene. KIAA1679 BINDING SITE is HOST TARGET binding site found in the 3' untranslated region of mRNA encoded by KIAA1679, corresponding to a HOST TARGET binding site such as BINDING SITE I, BINDING SITE II or BINDING SITE III. Table 2 illustrates the complementarity of the nucleotide sequences of KIAA1679 BINDING SITE, designated SEQ ID:34753, to the nucleotide sequence of VGAM1923 RNA, herein designated VGAM RNA, also designated SEQ ID:4634.

Another function of VGAM1923 is therefore inhibition of KIAA1679 (Accession XM_046570). Accordingly, utilities of VGAM1923 include diagnosis, prevention and treatment of diseases and clinical conditions associated with KIAA1679. KIAA1701 (Accession XM_042087) is another VGAM1923 host target gene. KIAA1701 BINDING SITE is HOST TARGET binding site found in the 3' untranslated region of mRNA encoded by KIAA1701, corresponding to a HOST TARGET binding site such as BINDING SITE I, BINDING SITE II or BINDING SITE III. Table 2 illustrates the complementarity of the nucleotide sequences of KIAA1701 BINDING SITE, designated SEQ ID:33686, to the nucleotide sequence of VGAM1923 RNA, herein designated VGAM RNA, also designated SEQ ID:4634.

Another function of VGAM1923 is therefore inhibition of KIAA1701 (Accession XM_042087). Accordingly, utilities of VGAM1923 include diagnosis, prevention and treatment of diseases and clinical conditions associated with KIAA1701. KIAA1750 (Accession XM_043067) is another VGAM1923 host target gene. KIAA1750 BINDING SITE is HOST TARGET binding site found in the 3' untranslated region of mRNA encoded by KIAA1750, corresponding to a HOST TARGET binding site such as BINDING SITE I, BINDING SITE II or BINDING SITE III. Table 2 illustrates the complementarity of the nucleotide sequences of KIAA1750 BINDING SITE, designated SEQ ID:33878, to the nucleotide sequence of VGAM1923 RNA, herein designated VGAM RNA, also designated SEQ ID:4634.

Another function of VGAM1923 is therefore inhibition of KIAA1750 (Accession XM_043067). Accordingly, utilities of VGAM1923 include diagnosis, prevention and treatment of diseases and clinical conditions associated with KIAA1750. KIAA1753 (Accession XM_036115) is another VGAM1923 host target gene. KIAA1753 BINDING SITE is HOST TARGET binding site found in the 3' untranslated region of mRNA encoded by KIAA1753, corresponding to a HOST TARGET binding site such as BINDING SITE I, BINDING SITE II or BINDING SITE III. Table 2 illustrates the complementarity of the nucleotide sequences of KIAA1753 BINDING SITE, designated SEQ ID:32381, to the nucleotide sequence of VGAM1923 RNA, herein designated VGAM RNA, also designated SEQ ID:4634.

Another function of VGAM1923 is therefore inhibition of KIAA1753 (Accession XM_036115). Accordingly, utilities of VGAM1923 include diagnosis, prevention and treatment of diseases and clinical conditions associated with KIAA1753. LCP (Accession NM_014315) is another VGAM1923 host target gene. LCP BINDING SITE is HOST TARGET binding site found in the 5' untranslated region of mRNA encoded by LCP, corresponding to a HOST TARGET binding site such as BINDING SITE I, BINDING SITE II or BINDING SITE III. Table 2 illustrates the complementarity of the nucleotide sequences of LCP BINDING SITE, designated SEQ ID:15615, to the nucleotide sequence of VGAM1923 RNA, herein designated VGAM RNA, also designated SEQ ID:4634.

Another function of VGAM1923 is therefore inhibition of LCP (Accession NM_014315). Accordingly, utilities of VGAM1923 include diagnosis, prevention and treatment of diseases and clinical conditions associated with LCP. LNIR (Accession NM_030916) is another VGAM1923 host target gene. LNIR BINDING SITE is HOST TARGET binding site found in the 3' untranslated region of mRNA encoded by LNIR, corresponding to a HOST TARGET binding site such as BINDING SITE I, BINDING SITE II or BINDING SITE III. Table 2 illustrates the complementarity of the nucleotide sequences of LNIR BINDING SITE, designated SEQ ID:25187, to the nucleotide sequence of VGAM1923 RNA, herein designated VGAM RNA, also designated SEQ ID:4634.

Another function of VGAM1923 is therefore inhibition of LNIR (Accession NM_030916). Accordingly, utilities of VGAM1923 include diagnosis, prevention and treatment of diseases and clinical conditions associated with LNIR. Leucine-rich Repeat Protein, Neuronal 3 (LRRN3, Accession XM_045261) is another VGAM1923 host target gene. LRRN3 BINDING SITE is HOST TARGET binding site found in the 5' untranslated region of mRNA encoded by LRRN3, corresponding to a HOST TARGET binding site such as BINDING SITE I, BINDING SITE II or BINDING SITE III. Table 2 illustrates the complementarity of the nucleotide sequences of LRRN3 BINDING SITE, designated SEQ ID:34400, to the nucleotide sequence of VGAM1923 RNA, herein designated VGAM RNA, also designated SEQ ID:4634.

Another function of VGAM1923 is therefore inhibition of Leucine-rich Repeat Protein, Neuronal 3 (LRRN3, Accession XM_045261). Accordingly, utilities of VGAM1923 include diagnosis, prevention and treatment of diseases and clinical conditions associated with LRRN3. Mitogen-activated Protein Kinase 11 (MAPK11, Accession NM_002751) is another VGAM1923 host target gene. MAPK11 BINDING SITE is HOST TARGET binding site found in the 3' untranslated region of mRNA encoded by MAPK11, corresponding to a HOST TARGET binding site such as BINDING SITE I, BINDING SITE II or BINDING SITE III. Table 2 illustrates the complementarity of the nucleotide sequences of MAPK11 BINDING SITE, designated SEQ ID:8629, to the nucleotide sequence of VGAM1923 RNA, herein designated VGAM RNA, also designated SEQ ID:4634.

Another function of VGAM1923 is therefore inhibition of Mitogen-activated Protein Kinase 11 (MAPK11, Accession NM_002751). Accordingly, utilities of VGAM1923 include diagnosis, prevention and treatment of diseases and clinical conditions associated with MAPK11. MASA (Accession XM_035994) is another VGAM1923 host target gene. MASA BINDING SITE is HOST TARGET binding site found in the 3' untranslated region of mRNA encoded by MASA, corresponding to a HOST TARGET binding site such as BINDING SITE I, BINDING SITE II or BINDING SITE III. Table 2 illustrates the complementarity of the nucleotide sequences of MASA BINDING SITE, designated SEQ ID:32373, to the nucleotide sequence of VGAM1923 RNA, herein designated VGAM RNA, also designated SEQ ID:4634.

Another function of VGAM1923 is therefore inhibition of MASA (Accession XM_035994). Accordingly, utilities of VGAM1923 include diagnosis, prevention and treatment of diseases and clinical conditions associated with MASA. MGC26655 (Accession NM_138290) is another VGAM1923 host target gene. MGC26655 BINDING SITE is HOST TARGET binding site found in the 5' untranslated region of mRNA encoded by MGC26655, corresponding to a HOST TARGET binding site such as BINDING SITE I, BINDING SITE II or BINDING SITE III. Table 2 illustrates the complementarity of the nucleotide sequences of MGC26655 BINDING SITE, designated SEQ ID:28703, to the nucleotide sequence of VGAM1923 RNA, herein designated VGAM RNA, also designated SEQ ID:4634.

Another function of VGAM1923 is therefore inhibition of MGC26655 (Accession NM_138290). Accordingly, utilities of VGAM1923 include diagnosis, prevention and treatment of diseases and clinical conditions associated with MGC26655. MGC4677 (Accession NM_052871) is another VGAM1923 host target gene. MGC4677 BINDING SITE is HOST TARGET binding site found in the 5' untranslated region of mRNA encoded by MGC4677, corresponding to a HOST TARGET binding site such as BINDING SITE I, BINDING SITE II or BINDING SITE III. Table 2 illustrates the complementarity of the nucleotide sequences of MGC4677 BINDING SITE, designated SEQ ID:27453, to the nucleotide sequence of VGAM1923 RNA, herein designated VGAM RNA, also designated SEQ ID:4634.

Another function of VGAM1923 is therefore inhibition of MGC4677 (Accession NM_052871). Accordingly, utilities of VGAM1923 include diagnosis, prevention and treatment of diseases and clinical conditions associated with MGC4677. Mitochondrial Ribosomal Protein L10 (MRPL10, Accession NM_145255) is another VGAM1923 host target gene. MRPL10 BINDING SITE is HOST TARGET binding site found in the 3' untranslated region of mRNA encoded by MRPL10, corresponding to a HOST TARGET binding site such as BINDING SITE I, BINDING SITE II or BINDING SITE III. Table 2 illustrates the complementarity of the nucleotide sequences of MRPL10 BINDING SITE, designated SEQ ID:29770, to the nucleotide sequence of VGAM1923 RNA, herein designated VGAM RNA, also designated SEQ ID:4634.

Another function of VGAM1923 is therefore inhibition of Mitochondrial Ribosomal Protein L10 (MRPL10, Accession NM_145255). Accordingly, utilities of VGAM1923 include diagnosis, prevention and treatment of diseases and clinical conditions associated with MRPL10. MSTP028 (Accession NM_031954) is another VGAM1923 host target gene. MSTP028 BINDING SITE is HOST TARGET binding site found in the 3' untranslated region of mRNA encoded by MSTP028, corresponding to a HOST TARGET binding site such as BINDING SITE I, BINDING SITE II or BINDING SITE III. Table 2 illustrates the complementarity of the nucleotide sequences of MSTP028 BINDING SITE, designated SEQ ID:25696, to the nucleotide sequence of VGAM1923

RNA, herein designated VGAM RNA, also designated SEQ ID:4634.

Another function of VGAM1923 is therefore inhibition of MSTP028 (Accession NM_031954). Accordingly, utilities of VGAM1923 include diagnosis, prevention and treatment of diseases and clinical conditions associated with MSTP028. Phosphodiesterase 3A, CGMP-inhibited (PDE3A, Accession NM_000921) is another VGAM1923 host target gene. PDE3A BINDING SITE is HOST TARGET binding site found in the 3' untranslated region of mRNA encoded by PDE3A, corresponding to a HOST TARGET binding site such as BINDING SITE I, BINDING SITE II or BINDING SITE III. Table 2 illustrates the complementarity of the nucleotide sequences of PDE3A BINDING SITE, designated SEQ ID:6632, to the nucleotide sequence of VGAM1923 RNA, herein designated VGAM RNA, also designated SEQ ID:4634.

Another function of VGAM1923 is therefore inhibition of Phosphodiesterase 3A, CGMP-inhibited (PDE3A, Accession NM_000921). Accordingly, utilities of VGAM1923 include diagnosis, prevention and treatment of diseases and clinical conditions associated with PDE3A. Protein Tyrosine Phosphatase, Receptor Type, F Polypeptide (PTPRF), Interacting Protein (liprin), Alpha 4 (PPFIA4, Accession XM_046751) is another VGAM1923 host target gene. PPFIA4 BINDING SITE is HOST TARGET binding site found in the 3' untranslated region of mRNA encoded by PPFIA4, corresponding to a HOST TARGET binding site such as BINDING SITE I, BINDING SITE II or BINDING SITE III. Table 2 illustrates the complementarity of the nucleotide sequences of PPFIA4 BINDING SITE, designated SEQ ID:34821, to the nucleotide sequence of VGAM1923 RNA, herein designated VGAM RNA, also designated SEQ ID:4634.

Another function of VGAM1923 is therefore inhibition of Protein Tyrosine Phosphatase, Receptor Type, F Polypeptide (PTPRF), Interacting Protein (liprin), Alpha 4 (PPFIA4, Accession XM_046751). Accordingly, utilities of VGAM1923 include diagnosis, prevention and treatment of diseases and clinical conditions associated with PPFIA4. PR Domain Containing 12 (PRDM12, Accession NM_021619) is another VGAM1923 host target gene. PRDM12 BINDING SITE is HOST TARGET binding site found in the 3' untranslated region of mRNA encoded by PRDM12, corresponding to a HOST TARGET binding site such as BINDING SITE I, BINDING SITE II or BINDING SITE III. Table 2 illustrates the complementarity of the nucleotide sequences of PRDM12 BINDING SITE, designated SEQ ID:22254, to the nucleotide sequence of VGAM1923 RNA, herein designated VGAM RNA, also designated SEQ ID:4634.

Another function of VGAM1923 is therefore inhibition of PR Domain Containing 12 (PRDM12, Accession NM_021619). Accordingly, utilities of VGAM1923 include diagnosis, prevention and treatment of diseases and clinical conditions associated with PRDM12. RAB6C, Member RAS Oncogene Family (RAB6C, Accession NM_032144) is another VGAM1923 host target gene. RAB6C BINDING SITE is HOST TARGET binding site found in the 3' untranslated region of mRNA encoded by RAB6C, corresponding to a HOST TARGET binding site such as BINDING SITE I, BINDING SITE II or BINDING SITE III. Table 2 illustrates the complementarity of the nucleotide sequences of RAB6C BINDING SITE, designated SEQ ID:25834, to the nucleotide sequence of VGAM1923 RNA, herein designated VGAM RNA, also designated SEQ ID:4634.

Another function of VGAM1923 is therefore inhibition of RAB6C, Member RAS Oncogene Family (RAB6C, Accession NM_032144). Accordingly, utilities of VGAM1923 include diagnosis, prevention and treatment of diseases and clinical conditions associated with RAB6C. Sideroflexin 2 (SFXN2, Accession XM_058359) is another VGAM1923 host target gene. SFXN2 BINDING SITE is HOST TARGET binding site found in the 3' untranslated region of mRNA encoded by SFXN2, corresponding to a HOST TARGET binding site such as BINDING SITE I, BINDING SITE II or BINDING SITE III. Table 2 illustrates the complementarity of the nucleotide sequences of SFXN2 BINDING SITE, designated SEQ ID:36606, to the nucleotide sequence of VGAM1923 RNA, herein designated VGAM RNA, also designated SEQ ID:4634.

Another function of VGAM1923 is therefore inhibition of Sideroflexin 2 (SFXN2, Accession XM_058359). Accordingly, utilities of VGAM1923 include diagnosis, prevention and treatment of diseases and clinical conditions associated with SFXN2. Serum Response Factor (c-fos serum response element-binding transcription factor) (SRF, Accession NM_003131) is another VGAM1923 host target gene. SRF BINDING SITE is HOST TARGET binding site found in the 3' untranslated region of mRNA encoded by SRF, corresponding to a HOST TARGET binding site such as BINDING SITE I, BINDING SITE II or BINDING SITE III. Table 2 illustrates the complementarity of the nucleotide sequences of SRF BINDING SITE, designated SEQ ID:9104, to the nucleotide sequence of VGAM1923 RNA, herein designated VGAM RNA, also designated SEQ ID:4634.

Another function of VGAM1923 is therefore inhibition of Serum Response Factor (c-fos serum response element-binding transcription factor) (SRF, Accession NM_003131). Accordingly, utilities of VGAM1923 include diagnosis, prevention and treatment of diseases and clinical conditions associated with SRF. Synovial Sarcoma Translocation Gene On Chromosome 18-like 1 (SS18L1, Accession XM_037202) is another VGAM1923 host target gene. SS18L1 BINDING SITE is HOST TARGET binding site found in the 3' untranslated region of mRNA encoded by SS18L1, corresponding to a HOST TARGET binding site such as BINDING SITE I, BINDING SITE II or BINDING SITE III. Table 2 illustrates the complementarity of the nucleotide sequences of SS18L1 BINDING SITE, designated SEQ ID:32563, to the nucleotide sequence of VGAM1923 RNA, herein designated VGAM RNA, also designated SEQ ID:4634.

Another function of VGAM1923 is therefore inhibition of Synovial Sarcoma Translocation Gene On Chromosome 18-like 1 (SS18L1, Accession XM_037202). Accordingly, utilities of VGAM1923 include diagnosis, prevention and treatment of diseases and clinical conditions associated with SS18L1. START Domain Containing 7 (STARD7, Accession NM_139267) is another VGAM1923 host target gene. STARD7 BINDING SITE1 and STARD7 BINDING SITE2 are HOST TARGET binding sites found in untranslated regions of mRNA encoded by STARD7, corresponding to HOST TARGET binding sites such as BINDING SITE I, BINDING SITE II or BINDING SITE III. Table 2 illustrates the complementarity of the nucleotide sequences of STARD7 BINDING SITE1 and STARD7 BINDING SITE2, designated SEQ ID:29262 and SEQ ID:21360 respectively, to the nucleotide sequence of VGAM1923 RNA, herein designated VGAM RNA, also designated SEQ ID:4634.

Another function of VGAM1923 is therefore inhibition of START Domain Containing 7 (STARD7, Accession NM_139267). Accordingly, utilities of VGAM1923 include diagnosis, prevention and treatment of diseases and clinical conditions associated with STARD7. TUSP (Accession NM_020245) is another VGAM1923 host target gene. TUSP BINDING SITE is HOST TARGET binding site found in the 3' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21533, to the nucleotide sequence of VGAM1923 RNA, herein designated VGAM RNA, also designated SEQ ID:4634.

Another function of VGAM1923 is therefore inhibition of TUSP (Accession NM_020245). Accordingly, utilities of VGAM1923 include diagnosis, prevention and treatment of diseases and clinical conditions associated with TUSP. Williams-Beuren Syndrome Chromosome Region 17 (WBSCR17, Accession XM_088168) is another VGAM1923 host target gene. WBSCR17 BINDING SITE is HOST TARGET binding site found in the 3' untranslated region of mRNA encoded by WBSCR17, corresponding to a HOST TARGET binding site such as BINDING SITE I, BINDING SITE II or BINDING SITE III. Table 2 illustrates the complementarity of the nucleotide sequences of WBSCR17 BINDING SITE, designated SEQ ID:39548, to the nucleotide sequence of VGAM1923 RNA, herein designated VGAM RNA, also designated SEQ ID:4634.

Another function of VGAM1923 is therefore inhibition of Williams-Beuren Syndrome Chromosome Region 17 (WBSCR17, Accession XM_088168). Accordingly, utilities of VGAM1923 include diagnosis, prevention and treatment of diseases and clinical conditions associated with WBSCR17. Zinc Finger RNA Binding Protein (ZFR, Accession NM_016107) is another VGAM1923 host target gene. ZFR BINDING SITE is HOST TARGET binding site found in the 3" untranslated region of mRNA encoded by ZFR, corresponding to a HOST TARGET binding site such as BINDING SITE I, BINDING SITE II or BINDING SITE III. Table 2 illustrates the complementarity of the nucleotide sequences of ZFR BINDING SITE, designated SEQ ID:18188, to the nucleotide sequence of VGAM1923 RNA, herein designated VGAM RNA, also designated SEQ ID:4634.

Another function of VGAM1923 is therefore inhibition of Zinc Finger RNA Binding Protein (ZFR, Accession NM_016107). Accordingly, utilities of VGAM1923 include diagnosis, prevention and treatment of diseases and clinical conditions associated with ZFR. LOC115286 (Accession XM_055644) is another VGAM1923 host target gene. LOC115286 BINDING SITE is HOST TARGET binding site found in the 3' untranslated region of mRNA encoded by LOC115286, corresponding to a HOST TARGET binding site such as BINDING SITE I, BINDING SITE II or BINDING SITE III. Table 2 illustrates the complementarity of the nucleotide sequences of LOC115286 BINDING SITE, designated SEQ ID:36315, to the nucleotide sequence of VGAM1923 RNA, herein designated VGAM RNA, also designated SEQ ID:4634.

Another function of VGAM1923 is therefore inhibition of LOC115286 (Accession XM_055644). Accordingly, utilities of VGAM1923 include diagnosis, prevention and treatment of diseases and clinical conditions associated with LOC115286. LOC122830 (Accession XM_058661) is another VGAM1923 host target gene. LOC122830 BINDING SITE is HOST TARGET binding site found in the 3' untranslated region of mRNA encoded by LOC122830, corresponding to a HOST TARGET binding site such as BINDING SITE I, BINDING SITE II or BINDING SITE III. Table 2 illustrates the complementarity of the nucleotide sequences of LOC122830 BINDING SITE, designated SEQ ID:36708, to the nucleotide sequence of VGAM1923 RNA, herein designated VGAM RNA, also designated SEQ ID:4634.

Another function of VGAM1923 is therefore inhibition of LOC122830 (Accession XM_058661). Accordingly, utilities of VGAM1923 include diagnosis, prevention and treatment of diseases and clinical conditions associated with LOC122830. LOC126669 (Accession XM_060121) is another VGAM1923 host target gene. LOC126669 BINDING SITE is HOST TARGET binding site found in the 3' untranslated region of mRNA encoded by LOC126669, corresponding to a HOST TARGET binding site such as BINDING SITE I, BINDING SITE II or BINDING SITE III. Table 2 illustrates the complementarity of the nucleotide sequences of LOC126669 BINDING SITE, designated SEQ ID:37158, to the nucleotide sequence of VGAM1923 RNA, herein designated VGAM RNA, also designated SEQ ID:4634.

Another function of VGAM1923 is therefore inhibition of LOC126669 (Accession XM_060121). Accordingly, utilities of VGAM1923 include diagnosis, prevention and treatment of diseases and clinical conditions associated with LOC126669. LOC130639 (Accession XM_059464) is another VGAM1923 host target gene. LOC130639 BINDING SITE is HOST TARGET binding site found in the 5' untranslated region of mRNA encoded by LOC130639, corresponding to a HOST TARGET binding site such as BINDING SITE I, BINDING SITE II or BINDING SITE III. Table 2 illustrates the complementarity of the nucleotide sequences of LOC130639 BINDING SITE, designated SEQ ID:37002, to the nucleotide sequence of VGAM1923 RNA, herein designated VGAM RNA, also designated SEQ ID:4634.

Another function of VGAM1923 is therefore inhibition of LOC130639 (Accession XM_059464). Accordingly, utilities of VGAM1923 include diagnosis, prevention and treatment of diseases and clinical conditions associated with LOC130639. LOC143888 (Accession XM_084669) is another VGAM1923 host target gene. LOC143888 BINDING SITE is HOST TARGET binding site found in the 3' untranslated region of mRNA encoded by LOC143888, corresponding to a HOST TARGET binding site such as BINDING SITE I, BINDING SITE II or BINDING SITE III. Table 2 illustrates the complementarity of the nucleotide sequences of LOC143888 BINDING SITE, designated SEQ ID:37671, to the nucleotide sequence of VGAM1923 RNA, herein designated VGAM RNA, also designated SEQ ID:4634.

Another function of VGAM1923 is therefore inhibition of LOC143888 (Accession XM_084669). Accordingly, utilities of VGAM1923 include diagnosis, prevention and treatment of diseases and clinical conditions associated with LOC143888. LOC145009 (Accession XM_016472) is another VGAM1923 host target gene. LOC145009 BINDING SITE is HOST TARGET binding site found in the 5' untranslated region of mRNA encoded by LOC145009, corresponding to a HOST TARGET binding site such as BINDING SITE I, BINDING SITE II or BINDING SITE III. Table 2 illustrates the complementarity of the nucleotide sequences of LOC145009 BINDING SITE, designated SEQ ID:30263, to the nucleotide sequence of VGAM1923 RNA, herein designated VGAM RNA, also designated SEQ ID:4634.

Another function of VGAM1923 is therefore inhibition of LOC145009 (Accession XM_016472). Accordingly, utilities of VGAM1923 include diagnosis, prevention and treatment of diseases and clinical conditions associated with LOC145009. LOC145581 (Accession XM_085176) is another VGAM1923 host target gene. LOC145581 BINDING SITE is HOST TARGET binding site found in the 5' untranslated region of mRNA encoded by LOC145581, corresponding to a HOST TARGET binding site such as BINDING SITE I, BINDING SITE II or BINDING SITE III. Table 2 illustrates the complementarity of the nucleotide sequences of LOC145581 BINDING SITE, designated SEQ ID:37902, to the nucleotide sequence of VGAM1923 RNA, herein designated VGAM RNA, also designated SEQ ID:4634.

Another function of VGAM1923 is therefore inhibition of LOC145581 (Accession XM_085176). Accordingly, utilities of VGAM1923 include diagnosis, prevention and treatment of diseases and clinical conditions associated with LOC145581. LOC145820 (Accession XM_085246) is another VGAM1923 host target gene. LOC145820 BINDING SITE is HOST TARGET binding site found in the 3' untranslated region of mRNA encoded by LOC145820, corresponding to a HOST TARGET binding site such as BINDING SITE I, BINDING SITE II or BINDING SITE III. Table 2 illustrates the complementarity of the nucleotide sequences of LOC145820 BINDING SITE, designated SEQ ID:37991, to the nucleotide sequence of VGAM1923 RNA, herein designated VGAM RNA, also designated SEQ ID:4634.

Another function of VGAM1923 is therefore inhibition of LOC145820 (Accession XM_085246). Accordingly, utilities of VGAM1923 include diagnosis, prevention and treatment of diseases and clinical conditions associated with LOC145820. LOC146712 (Accession XM_097068) is another VGAM1923 host target gene. LOC146712 BINDING SITE is HOST TARGET binding site found in the 5' untranslated region of mRNA encoded by LOC146712, corresponding to a HOST TARGET binding site such as BINDING SITE I, BINDING SITE II or BINDING SITE III. Table 2 illustrates the complementarity of the nucleotide sequences of LOC146712 BINDING SITE, designated SEQ ID:40712, to the nucleotide sequence of VGAM1923 RNA, herein designated VGAM RNA, also designated SEQ ID:4634.

Another function of VGAM1923 is therefore inhibition of LOC146712 (Accession XM_097068). Accordingly, utilities of VGAM1923 include diagnosis, prevention and treatment of diseases and clinical conditions associated with LOC146712. LOC147136 (Accession XM_085716) is another VGAM1923 host target gene. LOC147136 BINDING SITE is HOST TARGET binding site found in the 3' untranslated region of mRNA encoded by LOC147136, corresponding to a HOST TARGET binding site such as BINDING SITE I, BINDING SITE II or BINDING SITE III. Table 2 illustrates the complementarity of the nucleotide sequences of LOC147136 BINDING SITE, designated SEQ ID:38306, to the nucleotide sequence of VGAM1923 RNA, herein designated VGAM RNA, also designated SEQ ID:4634.

Another function of VGAM1923 is therefore inhibition of LOC147136 (Accession XM_085716). Accordingly, utilities of VGAM1923 include diagnosis, prevention and treatment of diseases and clinical conditions associated with LOC147136. LOC147976 (Accession XM_085980) is another VGAM1923 host target gene. LOC147976 BINDING SITE is HOST TARGET binding site found in the 3' untranslated region of mRNA encoded by LOC147976, corresponding to a HOST TARGET binding site such as BINDING SITE I, BINDING SITE II or BINDING SITE III. Table 2 illustrates the complementarity of the nucleotide sequences of LOC147976 BINDING SITE, designated SEQ ID:38427, to the nucleotide sequence of VGAM1923 RNA, herein designated VGAM RNA, also designated SEQ ID:4634.

Another function of VGAM1923 is therefore inhibition of LOC147976 (Accession XM_085980). Accordingly, utilities of VGAM1923 include diagnosis, prevention and treatment of diseases and clinical conditions associated with LOC147976. LOC149401 (Accession XM_086511) is another VGAM1923 host target gene. LOC149401 BINDING SITE is HOST TARGET binding site found in the 5' untranslated region of mRNA encoded by LOC149401, corresponding to a HOST TARGET binding site such as BINDING SITE I, BINDING SITE II or BINDING SITE III. Table 2 illustrates the complementarity of the nucleotide sequences of LOC149401 BINDING SITE, designated SEQ ID:38738, to the nucleotide sequence of VGAM1923 RNA, herein designated VGAM RNA, also designated SEQ ID:4634.

Another function of VGAM1923 is therefore inhibition of LOC149401 (Accession XM_086511). Accordingly, utilities of VGAM1923 include diagnosis, prevention and treatment of diseases and clinical conditions associated with LOC149401. LOC149721 (Accession XM_086649) is another VGAM1923 host target gene. LOC149721 BINDING SITE is HOST TARGET binding site found in the 5' untranslated region of mRNA encoded by LOC149721, corresponding to a HOST TARGET binding site such as BINDING SITE I, BINDING SITE II or BINDING SITE III. Table 2 illustrates the complementarity of the nucleotide sequences of LOC149721 BINDING SITE, designated SEQ ID:38811, to the nucleotide sequence of VGAM1923 RNA, herein designated VGAM RNA, also designated SEQ ID:4634.

Another function of VGAM1923 is therefore inhibition of LOC149721 (Accession XM_086649). Accordingly, utilities of VGAM1923 include diagnosis, prevention and treatment of diseases and clinical conditions associated with LOC149721. LOC151475 (Accession XM_098063) is another VGAM1923 host target gene. LOC151475 BINDING SITE is HOST TARGET binding site found in the 3' untranslated region of mRNA encoded by LOC151475, corresponding to a HOST TARGET binding site such as BINDING SITE I, BINDING SITE II or BINDING SITE III. Table 2 illustrates the complementarity of the nucleotide sequences of LOC151475 BINDING SITE, designated SEQ ID:41359, to the nucleotide sequence of VGAM1923 RNA, herein designated VGAM RNA, also designated SEQ ID:4634.

Another function of VGAM1923 is therefore inhibition of LOC151475 (Accession XM_098063). Accordingly, utilities of VGAM1923 include diagnosis, prevention and treatment of diseases and clinical conditions associated with LOC151475. LOC153346 (Accession XM_098364) is another VGAM1923 host target gene. LOC153346 BINDING SITE is HOST TARGET binding site found in the 3' untranslated region of mRNA encoded by LOC153346, corresponding to a HOST TARGET binding site such as BINDING SITE I, BINDING SITE II or BINDING SITE III. Table 2 illustrates the complementarity of the nucleotide sequences of LOC153346 BINDING SITE, designated SEQ ID:41618, to the nucleotide sequence of VGAM1923 RNA, herein designated VGAM RNA, also designated SEQ ID:4634.

Another function of VGAM1923 is therefore inhibition of LOC153346 (Accession XM_098364). Accordingly, utilities of VGAM1923 include diagnosis, prevention and treatment of diseases and clinical conditions associated with LOC153346. LOC153592 (Accession XM_098396) is another VGAM1923 host target gene. LOC153592 BINDING SITE is HOST TARGET binding site found in the 3' untranslated region of mRNA encoded by LOC153592, corresponding to a HOST TARGET binding site such as BINDING SITE I, BINDING SITE II or BINDING SITE III. Table 2 illustrates the complementarity of the nucleotide sequences of LOC153592 BINDING SITE, designated SEQ ID:41649, to the nucleotide sequence of VGAM1923 RNA, herein designated VGAM RNA, also designated SEQ ID:4634.

Another function of VGAM1923 is therefore inhibition of LOC153592 (Accession XM_098396). Accordingly, utilities of VGAM1923 include diagnosis, prevention and treatment of diseases and clinical conditions associated with LOC153592. LOC157922 (Accession XM_098841) is another VGAM1923 host target gene. LOC157922 BINDING SITE is HOST TARGET binding site found in the 3' untranslated region of mRNA encoded by LOC157922, corresponding to a HOST TARGET binding site such as BINDING SITE I, BINDING SITE II or BINDING SITE III. Table 2 illustrates the complementarity of the nucleotide sequences of LOC157922 BINDING SITE, designated SEQ ID:41890, to the nucleotide sequence of VGAM1923 RNA, herein designated VGAM RNA, also designated SEQ ID:4634.

Another function of VGAM1923 is therefore inhibition of LOC157922 (Accession XM_098841). Accordingly, utilities of VGAM1923 include diagnosis, prevention and treatment of diseases and clinical conditions associated with LOC157922. LOC158476 (Accession XM_098955) is another VGAM1923 host target gene. LOC158476 BINDING SITE is HOST TARGET binding site found in the 3' untranslated region of mRNA encoded by LOC158476, corresponding to a HOST TARGET binding site such as BINDING SITE I, BINDING SITE II or BINDING SITE III. Table 2 illustrates the complementarity of the nucleotide sequences of LOC158476 BINDING SITE, designated SEQ ID:42000, to the nucleotide sequence of VGAM1923 RNA, herein designated VGAM RNA, also designated SEQ ID:4634.

Another function of VGAM1923 is therefore inhibition of LOC158476 (Accession XM_098955). Accordingly, utilities of VGAM1923 include diagnosis, prevention and treatment of diseases and clinical conditions associated with LOC158476. LOC158709 (Accession XM_088648) is another VGAM1923 host target gene. LOC158709 BINDING SITE is HOST TARGET binding site found in the 3' untranslated region of mRNA encoded by LOC158709, corresponding to a HOST TARGET binding site such as BINDING SITE I, BINDING SITE II or BINDING SITE III. Table 2 illustrates the complementarity of the nucleotide sequences of LOC158709 BINDING SITE, designated SEQ ID:39883, to the nucleotide sequence of VGAM1923 RNA, herein designated VGAM RNA, also designated SEQ ID:4634.

Another function of VGAM1923 is therefore inhibition of LOC158709 (Accession XM_088648). Accordingly, utilities of VGAM1923 include diagnosis, prevention and treatment of diseases and clinical conditions associated with LOC158709. LOC160418 (Accession XM_090286) is another VGAM1923 host target gene. LOC160418 BINDING SITE is HOST TARGET binding site found in the 5' untranslated region of mRNA encoded by LOC160418, corresponding to a HOST TARGET binding site such as BINDING SITE I, BINDING SITE II or BINDING SITE III. Table 2 illustrates the complementarity of the nucleotide sequences of LOC160418 BINDING SITE, designated SEQ ID:39997, to the nucleotide sequence of VGAM1923 RNA, herein designated VGAM RNA, also designated SEQ ID:4634.

Another function of VGAM1923 is therefore inhibition of LOC160418 (Accession XM_090286). Accordingly, utilities of VGAM1923 include diagnosis, prevention and treatment of diseases and clinical conditions associated with LOC160418. LOC196027 (Accession XM_113633) is another VGAM1923 host target gene. LOC196027 BINDING SITE is HOST TARGET binding site found in the 3' untranslated region of mRNA encoded by LOC196027, corresponding to a HOST TARGET binding site such as BINDING SITE I, BINDING SITE II or BINDING SITE III. Table 2 illustrates the complementarity of the nucleotide sequences of LOC196027 BINDING SITE, designated SEQ ID:42306, to the nucleotide sequence of VGAM1923 RNA, herein designated VGAM RNA, also designated SEQ ID:4634.

Another function of VGAM1923 is therefore inhibition of LOC196027 (Accession XM_113633). Accordingly, utilities of VGAM1923 include diagnosis, prevention and treatment of diseases and clinical conditions associated with LOC196027. LOC196955 (Accession XM_085210) is another VGAM1923 host target gene. LOC196955 BINDING SITE is HOST TARGET binding site found in the 5' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37941, to the nucleotide sequence of VGAM1923 RNA, herein designated VGAM RNA, also designated SEQ ID:4634.

Another function of VGAM1923 is therefore inhibition of LOC196955 (Accession XM_085210). Accordingly, utilities of VGAM1923 include diagnosis, prevention and treatment of diseases and clinical conditions associated with LOC196955. LOC199858 (Accession XM_114040) is another VGAM1923 host target gene. LOC199858 BINDING SITE is HOST TARGET binding site found in the 3' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42646, to the nucleotide sequence of VGAM1923 RNA, herein designated VGAM RNA, also designated SEQ ID:4634.

Another function of VGAM1923 is therefore inhibition of LOC199858 (Accession XM_114040). Accordingly, utilities of VGAM1923 include diagnosis, prevention and treatment of diseases and clinical conditions associated with LOC199858. LOC199957 (Accession XM_114068) is another VGAM1923 host target gene. LOC199957 BINDING SITE is HOST TARGET binding site found in the 3' untranslated region of mRNA encoded by LOC199957, corresponding to a HOST TARGET binding site such as BINDING SITE I, BINDING SITE II or BINDING SITE III. Table 2 illustrates the complementarity of the nucleotide sequences of LOC199957 BINDING SITE, designated SEQ ID:42676, to the nucleotide sequence of VGAM1923 RNA, herein designated VGAM RNA, also designated SEQ ID:4634.

Another function of VGAM1923 is therefore inhibition of LOC199957 (Accession XM_114068). Accordingly, utilities of VGAM1923 include diagnosis, prevention and treatment of diseases and clinical conditions associated with LOC199957. LOC219722 (Accession XM_167593) is another VGAM1923 host target gene. LOC219722 BINDING SITE is HOST TARGET binding site found in the 5' untranslated region of mRNA encoded by LOC219722, corresponding to a HOST TARGET binding site such as BINDING SITE I, BINDING SITE II or BINDING SITE III. Table 2 illustrates the complementarity of the nucleotide sequences of LOC219722 BINDING SITE, designated SEQ ID:44712, to the nucleotide sequence of VGAM1923 RNA, herein designated VGAM RNA, also designated SEQ ID:4634.

Another function of VGAM1923 is therefore inhibition of LOC219722 (Accession XM_167593). Accordingly, utilities of VGAM1923 include diagnosis, prevention and treatment of diseases and clinical conditions associated with LOC219722. LOC219735 (Accession XM_167601) is another VGAM1923 host target gene. LOC219735 BINDING SITE is HOST TARGET binding site found in the 3' untranslated region of mRNA encoded by LOC219735, corresponding to a HOST TARGET binding site such as BINDING SITE I, BINDING SITE II or BINDING SITE III. Table 2 illustrates the complementarity of the nucleotide sequences of LOC219735 BINDING SITE, designated SEQ ID:44721, to the nucleotide sequence of VGAM1923 RNA, herein designated VGAM RNA, also designated SEQ ID:4634.

Another function of VGAM1923 is therefore inhibition of LOC219735 (Accession XM_167601). Accordingly, utilities of VGAM1923 include diagnosis, prevention and treatment of diseases and clinical conditions associated with LOC219735. LOC220038 (Accession XM_166257) is another VGAM1923 host target gene. LOC220038 BINDING SITE is HOST TARGET binding site found in the 5' untranslated region of mRNA encoded by LOC220038, corresponding to a HOST TARGET binding site such as BINDING SITE I, BINDING SITE II or BINDING SITE III. Table 2 illustrates the complementarity of the nucleotide sequences of LOC220038 BINDING SITE, designated SEQ ID:44080, to the nucleotide sequence of VGAM1923 RNA, herein designated VGAM RNA, also designated SEQ ID:4634.

Another function of VGAM1923 is therefore inhibition of LOC220038 (Accession XM_166257). Accordingly, utilities of VGAM1923 include diagnosis, prevention and treatment of diseases and clinical conditions associated with LOC220038. LOC256087 (Accession XM_170823) is another VGAM1923 host target gene. LOC256087 BINDING SITE is HOST TARGET binding site found in the 5' untranslated region of mRNA encoded by LOC256087, corresponding to a HOST TARGET binding site such as BINDING SITE I, BINDING SITE II or BINDING SITE III. Table 2 illustrates the complementarity of the nucleotide sequences of LOC256087 BINDING SITE, designated SEQ ID:45602, to the nucleotide sequence of VGAM1923 RNA, herein designated VGAM RNA, also designated SEQ ID:4634.

Another function of VGAM1923 is therefore inhibition of LOC256087 (Accession XM_170823). Accordingly, utilities of VGAM1923 include diagnosis, prevention and treatment of diseases and clinical conditions associated with LOC256087. LOC51706 (Accession XM_046746) is another VGAM1923 host target gene. LOC51706 BINDING SITE is HOST TARGET binding site found in the 3' untranslated region of mRNA encoded by LOC51706, corresponding to a HOST TARGET binding site such as BINDING SITE I, BINDING SITE II or BINDING SITE III. Table 2 illustrates the complementarity of the nucleotide sequences of LOC51706 BINDING SITE, designated SEQ ID:34817, to the nucleotide sequence of VGAM1923 RNA, herein designated VGAM RNA, also designated SEQ ID:4634.

Another function of VGAM1923 is therefore inhibition of LOC51706 (Accession XM_046746). Accordingly, utilities of VGAM1923 include diagnosis, prevention and treatment of diseases and clinical conditions associated with LOC51706. LOC90075 (Accession XM_028742) is another VGAM1923 host target gene. LOC90075 BINDING SITE is HOST TARGET binding site found in the 5' untranslated region of mRNA encoded by LOC90075, corresponding to a HOST TARGET binding site such as BINDING SITE I, BINDING SITE II or BINDING SITE III. Table 2 illustrates the complementarity of the nucleotide sequences of LOC90075 BINDING SITE, designated SEQ ID:30739, to the nucleotide sequence of VGAM1923 RNA, herein designated VGAM RNA, also designated SEQ ID:4634.

Another function of VGAM1923 is therefore inhibition of LOC90075 (Accession XM_028742). Accordingly, utilities of VGAM1923 include diagnosis, prevention and treatment of diseases and clinical conditions associated with LOC90075. LOC91380 (Accession XM_038134) is another VGAM1923 host target gene. LOC91380 BINDING SITE is HOST TARGET binding site found in the 3' untranslated region of mRNA encoded by LOC91380, corresponding to a HOST TARGET binding site such as BINDING SITE I, BINDING SITE II or BINDING SITE III. Table 2 illustrates the complementarity of the nucleotide sequences of LOC91380 BINDING SITE, designated SEQ ID:32757, to the nucleotide sequence of VGAM1923 RNA, herein designated VGAM RNA, also designated SEQ ID:4634.

Another function of VGAM1923 is therefore inhibition of LOC91380 (Accession XM_038134). Accordingly, utilities of VGAM1923 include diagnosis, prevention and treatment of diseases and clinical conditions associated with LOC91380. LOC91496 (Accession XM_038788) is another VGAM1923 host target gene. LOC91496 BINDING SITE is HOST TARGET binding site found in the 5' untranslated region of mRNA encoded by LOC91496, corresponding to a HOST TARGET binding site such as BINDING SITE I, BINDING SITE II or BINDING SITE III. Table 2 illustrates the complementarity of the nucleotide sequences of LOC91496 BINDING SITE, designated SEQ ID:32918, to the nucleotide sequence of VGAM1923 RNA, herein designated VGAM RNA, also designated SEQ ID:4634.

Another function of VGAM1923 is therefore inhibition of LOC91496 (Accession XM_038788). Accordingly, utilities of VGAM1923 include diagnosis, prevention and treatment of diseases and clinical conditions associated with LOC91496. LOC92912 (Accession XM_047970) is another VGAM1923 host target gene. LOC92912 BINDING SITE is HOST TARGET binding site found in the 3' untranslated region of mRNA encoded by LOC92912, corresponding to a HOST TARGET binding site such as BINDING SITE I, BINDING SITE II or BINDING SITE III. Table 2 illustrates the complementarity of the nucleotide sequences of LOC92912 BINDING SITE, designated SEQ ID:35085, to the nucleotide sequence of VGAM1923 RNA, herein designated VGAM RNA, also designated SEQ ID:4634.

Another function of VGAM1923 is therefore inhibition of LOC92912 (Accession XM_047970). Accordingly, utilities of VGAM1923 include diagnosis, prevention and treatment of diseases and clinical conditions associated with LOC92912. FIG. 1 further provides a conceptual description of a novel bioinformatically detected viral gene of the present invention, referred to here as Viral Genomic Address Messenger 1924 (VGAM1924) viral gene, which modulates expression of respective host target genes thereof, the function and utility of which host target genes is known in the art.

VGAM1924 is a novel bioinformatically detected regulatory, non protein coding, viral micro RNA (miRNA) gene. The method by which VGAM1924 was detected is described hereinabove with reference to FIGS. 1-8.

VGAM1924 gene, herein designated VGAM GENE, is a viral gene contained in the genome of Canine Distemper Virus. VGAM1924 host target gene, herein designated VGAM HOST TARGET GENE, is a human gene contained in the human genome.

VGAM1924 gene encodes a VGAM1924 precursor RNA, herein designated VGAM PRECURSOR RNA. Similar to other miRNA genes, and unlike most ordinary genes, VGAM1924 precursor RNA does not encode a protein. A nucleotide sequence identical or highly similar to the nucleotide sequence of VGAM1924 precursor RNA is designated SEQ ID:1910, and is provided hereinbelow with reference to the sequence listing part. Nucleotide sequence SEQ ID:1910 is located at position 1287 relative to the genome of Canine Distemper Virus.

VGAM1924 precursor RNA folds onto itself, forming VGAM1924 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1924 folded precursor RNA into VGAM1924 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1924 RNA is designated SEQ ID:4635, and is provided hereinbelow with reference to the sequence listing part.

VGAM1924 host target gene, herein designated VGAM HOST TARGET GENE, encodes a corresponding messenger RNA, VGAM1924 host target RNA, herein designated VGAM HOST TARGET RNA. VGAM1924 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1924 RNA, herein designated VGAM RNA, binds complementarily to one or more host target binding sites located in untranslated regions of VGAM1924 host target RNA, herein designated VGAM HOST TARGET RNA. This complementary binding is due to the fact that the nucleotide sequence of VGAM1924 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1924 RNA, herein designated VGAM RNA, may have a different number of host target binding sites in untranslated regions of a VGAM1924 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1924 RNA, herein designated VGAM RNA, to host target binding sites on VGAM1924 host target RNA, herein designated VGAM HOST TARGET RNA, such as BINDING SITE I, BINDING SITE II and BINDING SITE III, inhibits translation of VGAM1924 host target RNA into VGAM1924 host target protein, herein designated VGAM HOST TARGET PROTEIN. VGAM host target protein is therefore outlined by a broken line.

It is appreciated that VGAM1924 host target gene, herein designated VGAM HOST TARGET GENE, in fact represents a plurality of VGAM1924 host target genes. The mRNA of each one of this plurality of VGAM1924 host target genes comprises one or more host target binding sites, each having a nucleotide sequence which is at least partly complementary to VGAM1924 RNA, herein designated VGAM RNA, and which when bound by VGAM1924 RNA causes inhibition of translation of respective one or more VGAM1924 host target proteins.

It is further appreciated by one skilled in the art that the mode of translational inhibition illustrated by FIG. 1 with specific reference to translational inhibition exerted by VGAM1924 gene, herein designated VGAM GENE, on one or more VGAM1924 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1924 is inhibition of expression of host target genes, as part of a novel viral mechanism of attacking a host. Accordingly, utilities of VGAM1924 include diagnosis, prevention and treatment of viral infection by Canine Distemper Virus. Specific functions, and accordingly utilities, of VGAM1924 correlate with, and may be deduced from, the identity of the host target genes which VGAM1924 binds and inhibits, and the function of these host target genes, as elaborated hereinbelow.

Nucleotide sequences of the VGAM1924 precursor RNA, herein designated VGAM PRECURSOR RNA, and of the 'diced' VGAM1924 RNA, herein designated VGAM RNA, and a schematic representation of the secondary folding of VGAM1924 folded precursor RNA, herein designated VGAM FOLDED PRECURSOR RNA, of VGAM1924 are further described hereinbelow with reference to Table 1.

Nucleotide sequences of host target binding sites, such as BINDING SITE-I, BINDING SITE-II and BINDING SITE-III of FIG. 1, found on VGAM1924 host target RNA, and schematic representation of the complementarity of each of these host target binding sites to VGAM1924 RNA, herein designated VGAM RNA, are described hereinbelow with reference to Table 2.

As mentioned hereinabove with reference to FIG. 1, a function of VGAM1924 gene, herein designated VGAM is inhibition of expression of VGAM1924 target genes. It is appreciated that specific functions, and accordingly utilities, of VGAM1924 correlate with, and may be deduced from, the identity of the target genes which VGAM1924 binds and inhibits, and the function of these target genes, as elaborated hereinbelow.

ATP-binding Cassette, Sub-family D (ALD), Member 3 (ABCD3, Accession NM_002858) is a VGAM1924 host target gene. ABCD3 BINDING SITE is HOST TARGET binding site found in the 3' untranslated region of mRNA encoded by ABCD3, corresponding to a HOST TARGET binding site such as BINDING SITE I, BINDING SITE II or BINDING SITE III. Table 2 illustrates the complementarity of the nucleotide sequences of ABCD3 BINDING SITE, designated SEQ ID:8754, to the nucleotide sequence of VGAM1924 RNA, herein designated VGAM RNA, also designated SEQ ID:4635.

A function of VGAM1924 is therefore inhibition of ATP-binding Cassette, Sub-family D (ALD), Member 3 (ABCD3, Accession NM_002858), a gene which a probable transporter. Accordingly, utilities of VGAM1924 include diagnosis, prevention and treatment of diseases and clinical conditions associated with ABCD3. The function of ABCD3 and its association with various diseases and clinical conditions, has been established by previous studies, as described hereinabove with reference to VGAM1775. ATP-binding Cassette, Sub-family D (ALD), Member 4 (ABCD4, Accession NM_020325) is another VGAM1924 host target gene. ABCD4 BINDING SITE1 through ABCD4 BINDING SITE4 are HOST TARGET binding sites found in untranslated regions of mRNA encoded by ABCD4, corresponding to HOST TARGET binding sites such as BINDING SITE I, BINDING SITE II or BINDING SITE III. Table 2 illustrates the complementarity of the nucleotide sequences of ABCD4 BINDING SITE1 through ABCD4 BINDING SITE4, designated SEQ ID:21587, SEQ ID:21589, SEQ ID:21582 and SEQ ID:21584 respectively, to the nucleotide sequence of VGAM1924 RNA, herein designated VGAM RNA, also designated SEQ ID:4635.

Another function of VGAM1924 is therefore inhibition of ATP-binding Cassette, Sub-family D (ALD), Member 4 (ABCD4, Accession NM_020325), a gene which Putative peroxisomal ATP binding cassette transporter. Accordingly, utilities of VGAM1924 include diagnosis, prevention and treatment of diseases and clinical conditions associated with ABCD4. The function of ABCD4 has been established by previous studies. The peroxisomal membrane contains several ATP-binding cassette (ABC) transporters, including PMP70 (PXMP1; 170995), ALDP (see OMIM Ref. No. 300100), and ALDR (ALDL1; 601081). All 3 proteins are ABC half-transporters, which dimerize to form an active transporter. See 603076. By searching an EST database for homologs of PMP70 and ALDP, Shani et al. (1997) and Holzinger et al. (1997) identified PXMP1L cDNAs. They respectively designated the gene P70R and PMP69. Shani et al. (1997) reported that the predicted 606-amino acid protein has the structure of an ABC half-transporter and shares 25 to 27% sequence identity with PMP70, ALDR, and ALDP. Antibodies against PXMP1L detected a 73-kD protein on Western blots. Immunofluorescence studies localized the protein to peroxisomes. Northern blot analysis revealed that PXMP1L was expressed as a 2.6-kb mRNA in all tissues examined. Holzinger et al. (1997) and Holzinger et al. (1998) found transcript variants resulting from alternative splicing and use of alternative polyadenylation sites. Holzinger et al. (1998) reported that the PXMP1L gene contains 19 exons and spans approximately 16 kb.

Full details of the abovementioned studies are described in the following publications, the disclosure of which are hereby incorporated by reference:

Holzinger, A.; Roscher, A. A.; Landgraf, P.; Lichtner, P.; Kammerer, S.: Genomic organization and chromosomal localization of the human peroxisomal membrane protein-1-like protein (PXMP1-L) gene encoding a peroxisomal ABC transporter. FEBS Lett. 426:238-242, 1998; and Shani, N.; Jimenez-Sanchez, G.; Steel, G.; Dean, M.; Valle, D.: Identification of a fourth half ABC transporter in the human peroxisomal membrane. Hum. Molec. Genet. 6:1925-1931, 1997.

Further studies establishing the function and utilities of ABCD4 are found in John Hopkins OMIM database record ID 603214, and in sited publications numbered 2432-2434 listed in the bibliography section hereinbelow, which are also hereby incorporated by reference. Acyl-Coenzyme A Dehydrogenase, Short/branched Chain (ACADSB, Accession NM_001609) is another VGAM1924 host target gene. ACADSB BINDING SITE is HOST TARGET binding site found in the 3' untranslated region of mRNA encoded by ACADSB, corresponding to a HOST TARGET binding site such as BINDING SITE I, BINDING SITE II or BINDING SITE III. Table 2 illustrates the complementarity of the nucleotide sequences of ACADSB BINDING SITE, designated SEQ ID:7313, to the nucleotide sequence of VGAM1924 RNA, herein designated VGAM RNA, also designated SEQ ID:4635.

Another function of VGAM1924 is therefore inhibition of Acyl-Coenzyme A Dehydrogenase, Short/branched Chain (ACADSB, Accession NM_001609). Accordingly, utilities of VGAM1924 include diagnosis, prevention and treatment of diseases and clinical conditions associated with ACADSB. Angiopoietin 1 (ANGPT1, Accession NM_001146) is another VGAM1924 host target gene. ANGPT1 BINDING SITE is HOST TARGET binding site found in the 3' untranslated region of mRNA encoded by ANGPT1, corresponding to a HOST TARGET binding site such as BINDING SITE I, BINDING SITE II or BINDING SITE III. Table 2 illustrates the complementarity of the nucleotide sequences of ANGPT1 BINDING SITE, designated SEQ ID:6814, to the nucleotide sequence of VGAM1924 RNA, herein designated VGAM RNA, also designated SEQ ID:4635.

Another function of VGAM1924 is therefore inhibition of Angiopoietin 1 (ANGPT1, Accession NM_001146), a gene which binds and activates tie2 receptor by inducing its tyrosine phosphorylation. Accordingly, utilities of VGAM1924 include diagnosis, prevention and treatment of diseases and clinical conditions associated with ANGPT1. The function of ANGPT1 and its association with various diseases and clinical conditions, has been established by previous studies, as described hereinabove with reference to VGAM291. Amine Oxidase, Copper Containing 3 (vascular adhesion protein 1) (AOC3, Accession NM_003734) is another VGAM1924 host target gene. AOC3 BINDING SITE is HOST TARGET binding site found in the 3' untranslated region of mRNA encoded by AOC3, corresponding to a HOST TARGET binding site such as BINDING SITE I, BINDING SITE II or BINDING SITE III. Table 2 illustrates the complementarity of the nucleotide sequences of AOC3 BINDING SITE, designated SEQ ID:9825, to the nucleotide sequence of VGAM1924 RNA, herein designated VGAM RNA, also designated SEQ ID:4635.

Another function of VGAM1924 is therefore inhibition of Amine Oxidase, Copper Containing 3 (vascular adhesion protein 1) (AOC3, Accession NM_003734), a gene which catalyze the oxidative conversion of amines to aldehydes in the presence of copper and quinone cofactor. Accordingly, utilities of VGAM1924 include diagnosis, prevention and treatment of diseases and clinical conditions associated with AOC3. The function of AOC3 and its association with various diseases and clinical conditions, has been established by previous studies, as described hereinabove with reference to VGAM175. Aldehyde Oxidase 1 (AOX1, Accession NM_001159) is another VGAM1924 host target gene. AOX1 BINDING SITE is HOST TARGET binding site found in the 3' untranslated region of mRNA encoded by AOX1, corresponding to a HOST TARGET binding site such as BINDING SITE I, BINDING SITE II or BINDING SITE III. Table 2 illustrates the complementarity of the nucleotide sequences of AOX1 BINDING SITE, designated SEQ ID:6826, to the nucleotide sequence of VGAM1924 RNA, herein designated VGAM RNA, also designated SEQ ID:4635.

Another function of VGAM1924 is therefore inhibition of Aldehyde Oxidase 1 (AOX1, Accession NM_001159), a gene which converts an aldehyde in the presence of O2 and H2O to an acid and HOOH. Accordingly, utilities of VGAM1924 include diagnosis, prevention and treatment of diseases and clinical conditions associated with AOX1. The function of AOX1 has been established by previous studies. Aldehyde oxidase (AO) produces hydrogen peroxide and, under certain conditions, can catalyze the formation of superoxide. By PCR of a human liver library with primers based on conserved regions of rat and fly xanthine dehydrogenase (XDH) proteins, Wright et al. (1993) isolated a cDNA fragment. Using this fragment as a probe, they identified human liver cDNAs encoding a predicted 1,336-amino acid protein. The human protein was 49% identical to rat XDH and contained several characteristic XDH signature sequences. However, both Turner et al. (1995) and Berger et al. (1995) identified the cDNA isolated by Wright et al. (1993) as AO, or AOX1. By Northern blot analysis, Wright et al. (1993) determined that AOX1 was expressed as a 5.1-kb mRNA predominantly in liver. They suggested that a 4.5-kb transcript observed in heart, brain, and kidney arose by use of an alternative polyadenylation site. Since defects in oxygen radical metabolism have been implicated in the pathogenesis of the autosomal dominant form of amyotrophic lateral sclerosis (ALS; 105400), Berger et al. (1995) analyzed other enzymes involved in oxygen radical metabolism for possible involvement in other forms of ALS. Analysis of a YAC contig revealed that the AOX1 gene is within 280 kb of the D2S116 marker, which is inseparable by recombination from the ALS2 (OMIM Ref. No. 205100) locus. Using in situ hybridization, Berger et al. (1995) found that AOX1 is expressed in the ventral horn of the spinal cord, primarily in the glial cells. Based on the tissue localization, linkage data, and the biochemical role of AOX1 in the free radical pathway, these authors suggested that AOX1 is a candidate gene for ALS2.

Full details of the abovementioned studies are described in the following publications, the disclosure of which are hereby incorporated by reference:

Berger, R.; Mezey, E.; Clancy, K. P.; Harta, G.; Wright, R. M.; Repine, J. E.; Brown, R. H.; Brownstein, M.; Patterson, D.: Analysis of aldehyde oxidase and xanthine dehydrogenase/oxidase as possible candidate genes for autosomal recessive familial amyotrophic lateral sclerosis. Somat. Cell Molec. Genet. 21:121-131, 1995; and Turner, N. A.; Doyle, W. A.; Ventom, A. M.; Bray, R. C.: Properties of rabbit liver aldehyde oxidase and the relationship of the enzyme to xanthine oxidase and dehydrogenase. Europ. J.

Further studies establishing the function and utilities of AOX1 are found in John Hopkins OMIM database record ID 602841, and in sited publications numbered 1131-113 and 8638 listed in the bibliography section hereinbelow, which are also hereby incorporated by reference. Rho Guanine Nucleotide Exchange Factor (GEF) 7 (ARHGEF7, Accession NM_003899) is another VGAM1924 host target gene. ARHGEF7 BINDING SITE is HOST TARGET binding site found in the 3' untranslated region of mRNA encoded by ARHGEF7, corresponding to a HOST TARGET binding site such as BINDING SITE I, BINDING SITE II or BINDING SITE III. Table 2 illustrates the complementarity of the nucleotide sequences of ARHGEF7 BINDING SITE, designated SEQ ID:9983, to the nucleotide sequence of VGAM1924 RNA, herein designated VGAM RNA, also designated SEQ ID:4635.

Another function of VGAM1924 is therefore inhibition of Rho Guanine Nucleotide Exchange Factor (GEF) 7 (ARHGEF7, Accession NM_003899), a gene which acts as a rac1 guanine nucleotide exchange factor (gef) and can induce membrane ruffling. Accordingly, utilities of VGAM1924 include diagnosis, prevention and treatment of diseases and clinical conditions associated with ARHGEF7. The function of ARHGEF7 and its association with various diseases and clinical conditions, has been established by previous studies, as described hereinabove with reference to VGAM297. AS3 (Accession NM_015928) is another VGAM1924 host target gene. AS3 BINDING SITE1 and AS3 BINDING SITE2 are HOST TARGET binding sites found in untranslated regions of mRNA encoded by AS3, corresponding to HOST TARGET binding sites such as BINDING SITE I, BINDING SITE II or BINDING SITE III. Table 2 illustrates the complementarity of the nucleotide sequences of AS3 BINDING SITE1 and AS3 BINDING SITE2, designated SEQ ID:18049 and SEQ ID:18052 respectively, to the nucleotide sequence of VGAM1924 RNA, herein designated VGAM RNA, also designated SEQ ID:4635.

Another function of VGAM1924 is therefore inhibition of AS3 (Accession NM_015928), a gene which inhibits cell proloferation. Accordingly, utilities of VGAM1924 include diagnosis, prevention and treatment of diseases and clinical conditions associated with AS3. The function of AS3 and its association with various diseases and clinical conditions, has been established by previous studies, as described hereinabove with reference to VGAM393. BCRP2 (Accession XM_031102) is another VGAM1924 host target gene. BCRP2 BINDING SITE is HOST TARGET binding site found in the 3' untranslated region of mRNA encoded by BCRP2, corresponding to a HOST TARGET binding site such as BINDING SITE I, BINDING SITE II or BINDING SITE III. Table 2 illustrates the complementarity of the nucleotide sequences of BCRP2 BINDING SITE, designated SEQ ID:31275, to the nucleotide sequence of VGAM1924 RNA, herein designated VGAM RNA, also designated SEQ ID:4635.

Another function of VGAM1924 is therefore inhibition of BCRP2 (Accession XM_031102). Accordingly, utilities of VGAM1924 include diagnosis, prevention and treatment of diseases and clinical conditions associated with BCRP2. Basic Helix-loop-helix Domain Containing, Class B, 3 (BHLHB3, Accession NM_030762) is another VGAM1924 host target gene. BHLHB3 BINDING SITE is HOST TARGET binding site found in the 3' untranslated region of mRNA encoded by BHLHB3, corresponding to a HOST TARGET binding site such as BINDING SITE I, BINDING SITE II or BINDING SITE III. Table 2 illustrates the complementarity of the nucleotide sequences of BHLHB3 BINDING SITE, designated SEQ ID:25044, to the nucleotide sequence of VGAM1924 RNA, herein designated VGAM RNA, also designated SEQ ID:4635.

Another function of VGAM1924 is therefore inhibition of Basic Helix-loop-helix Domain Containing, Class B, 3 (BHLHB3, Accession NM_030762), a gene which represses both basal and activated transcription. Accordingly, utilities of VGAM1924 include diagnosis, prevention and treatment of diseases and clinical conditions associated with BHLHB3. The function of BHLHB3 has been established by previous studies. By searching EST databases for sequences similar to DEC1, followed by 5-prime and 3-prime RACE with chondrocyte cDNA, Fujimoto et al. (2001) obtained cDNAs encoding human and mouse DEC2. The deduced 482-amino acid human DEC2 protein contains a bHLH domain and an Orange domain that are highly conserved with those of mouse Dec2 and rat Sharp1. DEC2 also has a C-terminal alanine/glycine-rich region not seen in DEC1. Northern blot analysis detected a 3.6-kb DEC2 transcript that was highly expressed in skeletal muscle and brain, moderately expressed in pancreas and heart, expressed at low levels in placenta and lung, and expressed at very low levels in liver and kidney. RT-PCR analysis detected ubiquitous but variable expression of DEC2. Using yeast 1-hybrid screens and reporter analysis, Garriga-Canut et al. (2001) showed that rat Sharp1 binds to the M1 muscarinic acetylcholine receptor (see OMIM Ref. No. CHRM1; 118510) and acts as a transcriptional repressor of both TATA-containing and TATA-less promoters. Repression occurs either via the bHLH domain or via a C-terminal domain that is sensitive to the histone deacetylase inhibitor trichostatin A.

Full details of the abovementioned studies are described in the following publications, the disclosure of which are hereby incorporated by reference:

Garriga-Canut, M.; Roopra, A.; Buckley, N. J.: The basic helix-loop-helix protein, SHARP-1, represses transcription by a histone deacetylase-dependent and histone deacetylase-independent mechanism. J. Biol. Chem. 276:14821-14828, 2001; and Fujimoto, K.; Shen, M.; Noshiro, M.; Matsubara, K.; Shingu, S.; Honda, K.; Yoshida, E.; Suardita, K.; Matsuda, Y.; Kato, Y.: Molecular cloning and characterization of DEC2, a new memb.

Further studies establishing the function and utilities of BHLHB3 are found in John Hopkins OMIM database record ID 606200, and in sited publications numbered 902-903 listed in the bibliography section hereinbelow, which are also hereby incorporated by reference. BLTR2 (Accession NM_019839) is another VGAM1924 host target gene. BLTR2 BINDING SITE is HOST TARGET binding site found in the 5' untranslated region of mRNA encoded by BLTR2, corresponding to a HOST TARGET binding site such as BINDING SITE I, BINDING SITE II or BINDING SITE III. Table 2 illustrates the complementarity of the nucleotide sequences of BLTR2 BINDING SITE, designated SEQ ID:21243, to the nucleotide sequence of VGAM1924 RNA, herein designated VGAM RNA, also designated SEQ ID:4635.

Another function of VGAM1924 is therefore inhibition of BLTR2 (Accession NM_019839). Accordingly, utilities of VGAM1924 include diagnosis, prevention and treatment of diseases and clinical conditions associated with BLTR2. BRIP1 (Accession NM_032043) is another VGAM1924 host target gene. BRIP1 BINDING SITE is HOST TARGET binding site found in the 3' untranslated region of mRNA encoded by BRIP1, corresponding to a HOST TARGET binding site such as BINDING SITE I, BINDING SITE II or BINDING SITE III. Table 2 illustrates the complementarity of the nucleotide sequences of BRIP1 BINDING SITE, designated SEQ ID:25754, to the nucleotide sequence of VGAM1924 RNA, herein designated VGAM RNA, also designated SEQ ID:4635.

Another function of VGAM1924 is therefore inhibition of BRIP1 (Accession NM_032043). Accordingly, utilities of VGAM1924 include diagnosis, prevention and treatment of diseases and clinical conditions associated with BRIP1. BTG Family, Member 2 (BTG2, Accession NM_006763) is another VGAM1924 host target gene. BTG2 BINDING SITE is HOST TARGET binding site found in the 3' untranslated region of mRNA encoded by BTG2, corresponding to a HOST TARGET binding site such as BINDING SITE I, BINDING SITE II or BINDING SITE III. Table 2 illustrates the complementarity of the nucleotide sequences of BTG2 BINDING SITE, designated SEQ ID:13625, to the nucleotide sequence of VGAM1924 RNA, herein designated VGAM RNA, also designated SEQ ID:4635.

Another function of VGAM1924 is therefore inhibition of BTG Family, Member 2 (BTG2, Accession NM_006763). Accordingly, utilities of VGAM1924 include diagnosis, prevention and treatment of diseases and clinical conditions associated with BTG2. Calnexin (CANX, Accession XM_113469) is another VGAM1924 host target gene. CANX BINDING SITE is HOST TARGET binding site found in the 3' untranslated region of mRNA encoded by CANX, corresponding to a HOST TARGET binding site such as BINDING SITE I, BINDING SITE II or BINDING SITE III. Table 2 illustrates the complementarity of the nucleotide sequences of CANX BINDING SITE, designated SEQ ID:42276, to the nucleotide sequence of VGAM1924 RNA, herein designated VGAM RNA, also designated SEQ ID:4635.

Another function of VGAM1924 is therefore inhibition of Calnexin (CANX, Accession XM_113469), a gene which may function as a chaperone in the endoplasmic reticulum, involved in the secretion of proteins from the ER to the outer cellular membrane. Accordingly, utilities of VGAM1924 include diagnosis, prevention and treatment of diseases and clinical conditions associated with CANX. The function of CANX and its association with various diseases and clinical conditions, has been established by previous studies, as described hereinabove with reference to VGAM116. Capping Protein (actin filament) Muscle Z-line, Alpha 1 (CAPZA1, Accession XM_052116) is another VGAM1924 host target gene. CAPZA1 BINDING SITE is HOST TARGET binding site found in the 3' untranslated region of mRNA encoded by CAPZA1, corresponding to a HOST TARGET binding site such as BINDING SITE I, BINDING SITE II or BINDING SITE III. Table 2 illustrates the complementarity of the nucleotide sequences of CAPZA1 BINDING SITE, designated SEQ ID:35953, to the nucleotide sequence of VGAM1924 RNA, herein designated VGAM RNA, also designated SEQ ID:4635.

Another function of VGAM1924 is therefore inhibition of Capping Protein (actin filament) Muscle Z-line, Alpha 1 (CAPZA1, Accession XM_052116), a gene which is alpha 1 subunit of actin filament capping protein; binds actin, has roles in cell motility and actin assembly. Accordingly, utilities of VGAM1924 include diagnosis, prevention and treatment of diseases and clinical conditions associated with CAPZA1. The function of CAPZA1 and its association with various diseases and clinical conditions, has been established by previous studies, as described hereinabove with reference to VGAM547. Caspase Recruitment Domain Family, Member 4 (CARD4, Accession NM_006092) is another VGAM1924 host target gene. CARD4 BINDING SITE is HOST TARGET binding site found in the 5' untranslated region of mRNA encoded by CARD4, corresponding to a HOST TARGET binding site such as BINDING SITE I, BINDING SITE II or BINDING SITE III. Table 2 illustrates the complementarity of the nucleotide sequences of CARD4 BINDING SITE, designated SEQ ID:12741, to the nucleotide sequence of VGAM1924 RNA, herein designated VGAM RNA, also designated SEQ ID:4635.

Another function of VGAM1924 is therefore inhibition of Caspase Recruitment Domain Family, Member 4 (CARD4, Accession NM_006092), a gene which Activates CASP9 to induce apoptosis, regulates activation of NF-kappaB. Accordingly, utilities of VGAM1924 include diagnosis, prevention and treatment of diseases and clinical conditions associated with CARD4. The function of CARD4 and its association with various diseases and clinical conditions, has been established by previous studies, as described hereinabove with reference to VGAM492. Core-binding Factor, Runt Domain, Alpha Subunit 2; Translocated To, 2 (CBFA2T2, Accession NM_005093) is another VGAM1924 host target gene. CBFA2T2 BINDING SITE is HOST TARGET binding site found in the 3' untranslated region of mRNA encoded by CBFA2T2, corresponding to a HOST TARGET binding site such as BINDING SITE I, BINDING SITE II or BINDING SITE III. Table 2 illustrates the complementarity of the nucleotide sequences of CBFA2T2 BINDING SITE, designated SEQ ID:11553, to the nucleotide sequence of VGAM1924 RNA, herein designated VGAM RNA, also designated SEQ ID:4635.

Another function of VGAM1924 is therefore inhibition of Core-binding Factor, Runt Domain, Alpha Subunit 2; Translocated To, 2 (CBFA2T2, Accession NM_005093), a gene which is a putative transcription factor. Accordingly, utilities of VGAM1924 include diagnosis, prevention and treatment of diseases and clinical conditions associated with CBFA2T2. The function of CBFA2T2 and its association with various diseases and clinical conditions, has been established by previous studies, as described hereinabove with reference to VGAM152. Core-binding Factor, Beta Subunit (CBFB, Accession NM_022845) is another VGAM1924 host target gene. CBFB BINDING SITE1 and CBFB BINDING SITE2 are HOST TARGET binding sites found in untranslated regions of mRNA encoded by CBFB, corresponding to HOST TARGET binding sites such as BINDING SITE I, BINDING SITE II or BINDING SITE III. Table 2 illustrates the complementarity of the nucleotide sequences of CBFB BINDING SITE1 and CBFB BINDING SITE2, designated SEQ ID:23148 and SEQ ID:7507 respectively, to the nucleotide sequence of VGAM1924 RNA, herein designated VGAM RNA, also designated SEQ ID:4635.

Another function of VGAM1924 is therefore inhibition of Core-binding Factor, Beta Subunit (CBFB, Accession NM_022845), a gene which is beta subunit of the transcription factor CBF which causes leukemia. Accordingly, utilities of VGAM1924 include diagnosis, prevention and treatment of diseases and clinical conditions associated with CBFB. The function of CBFB and its association with various diseases and clinical conditions, has been established by previous studies, as described hereinabove with reference to VGAM98. Cadherin 6, Type 2, K-cadherin (fetal kidney) (CDH6, Accession NM_004932) is another VGAM1924 host target gene. CDH6 BINDING SITE is HOST TARGET binding site found in the 3' untranslated region of mRNA encoded by CDH6, corresponding to a HOST TARGET binding site such as BINDING SITE I, BINDING SITE II or BINDING SITE III. Table 2 illustrates the complementarity of the nucleotide sequences of CDH6 BINDING SITE, designated SEQ ID:11376, to the nucleotide sequence of VGAM1924 RNA, herein designated VGAM RNA, also designated SEQ ID:4635.

Another function of VGAM1924 is therefore inhibition of Cadherin 6, Type 2, K-cadherin (fetal kidney) (CDH6, Accession NM_004932), a gene which is a calcium dependent cell adhesion protein. Accordingly, utilities of VGAM1924 include diagnosis, prevention and treatment of diseases and clinical conditions associated with CDH6. The function of CDH6 and its association with various diseases and clinical conditions, has been established by previous studies, as described hereinabove with reference to VGAM60. Centaurin, Delta 1 (CENTD1, Accession NM_015230) is another VGAM1924 host target gene. CENTD1 BINDING SITE1 and CENTD1 BINDING SITE2 are HOST TARGET binding sites found in untranslated regions of mRNA encoded by CENTD1, corresponding to HOST TARGET binding sites such as BINDING SITE I, BINDING SITE II or BINDING SITE III. Table 2 illustrates the complementarity of the nucleotide sequences of CENTD1 BINDING SITE1 and CENTD1 BINDING SITE2, designated SEQ ID:17564 and SEQ ID:29202 respectively, to the nucleotide sequence of VGAM1924 RNA, herein designated VGAM RNA, also designated SEQ ID:4635.

Another function of VGAM1924 is therefore inhibition of Centaurin, Delta 1 (CENTD1, Accession NM_015230), a gene which is nvolved in cell signaling/communication. Accordingly, utilities of VGAM1924 include diagnosis, prevention and treatment of diseases and clinical conditions associated with CENTD1. The function of CENTD1 and its association with various diseases and clinical conditions, has been established by previous studies, as described hereinabove with reference to VGAM445. Chorea Acanthocytosis (CHAC, Accession NM_033305) is another VGAM1924 host target gene. CHAC BINDING SITE is HOST TARGET binding site found in the 3' untranslated region of mRNA encoded by CHAC, corresponding to a HOST TARGET binding site such as BINDING SITE I, BINDING SITE II or BINDING SITE III. Table 2 illustrates the complementarity of the nucleotide sequences of CHAC BINDING SITE, designated SEQ ID:27140, to the nucleotide sequence of VGAM1924 RNA, herein designated VGAM RNA, also designated SEQ ID:4635.

Another function of VGAM1924 is therefore inhibition of Chorea Acanthocytosis (CHAC, Accession NM_033305), a gene which may regulate the cycling of proteins. Accordingly, utilities of VGAM1924 include diagnosis, prevention and treatment of diseases and clinical conditions associated with CHAC. The function of CHAC and its association with various diseases and clinical conditions, has been established by previous studies, as described hereinabove with reference to VGAM650. Cysteine Knot Superfamily 1, BMP Antagonist 1 (CKTSF1B1, Accession NM_013372) is another VGAM1924 host target gene. CKTSF1B1 BINDING SITE is HOST TARGET binding site found in the 3' untranslated region of mRNA encoded by CKTSF1B1, corresponding to a HOST TARGET binding site such as BINDING SITE I, BINDING SITE II or BINDING SITE III. Table 2 illustrates the complementarity of the nucleotide sequences of CKTSF1B1 BINDING SITE, designated SEQ ID:15024, to the nucleotide sequence of VGAM1924 RNA, herein designated VGAM RNA, also designated SEQ ID:4635.

Another function of VGAM1924 is therefore inhibition of Cysteine Knot Superfamily 1, BMP Antagonist 1 (CKTSF1B1, Accession NM_013372), a gene which blocks signaling of bone morphogenetic protein (BMP) . Accordingly, utilities of VGAM1924 include diagnosis, prevention and treatment of diseases and clinical conditions associated with CKTSF1B1. The function of CKTSF1B1 and its association with various diseases and clinical conditions, has been established by previous studies, as described hereinabove with reference to VGAM28. Ceroid-lipofuscinosis, Neuronal 2, Late Infantile (Jansky-Bielschowsky disease) (CLN2, Accession NM_000391) is another VGAM1924 host target gene. CLN2 BINDING SITE is HOST TARGET binding site found in the 3' untranslated region of mRNA encoded by CLN2, corresponding to a HOST TARGET binding site such as BINDING SITE I, BINDING SITE II or BINDING SITE III. Table 2 illustrates the complementarity of the nucleotide sequences of CLN2 BINDING SITE, designated SEQ ID:5966, to the nucleotide sequence of VGAM1924 RNA, herein designated VGAM RNA, also designated SEQ ID:4635.

Another function of VGAM1924 is therefore inhibition of Ceroid-lipofuscinosis, Neuronal 2, Late Infantile (Jansky-Bielschowsky disease) (CLN2, Accession NM_000391). Accordingly, utilities of VGAM1924 include diagnosis, prevention and treatment of diseases and clinical conditions associated with CLN2. Cystinosis, Nephropathic (CTNS, Accession NM_004937) is another VGAM1924 host target gene. CTNS BINDING SITE is HOST TARGET binding site found in the 5' untranslated region of mRNA encoded by CTNS, corresponding to a HOST TARGET binding site such as BINDING SITE I, BINDING SITE II or BINDING SITE III. Table 2 illustrates the complementarity of the nucleotide sequences of CTNS BINDING SITE, designated SEQ ID:11384, to the nucleotide sequence of VGAM1924 RNA, herein designated VGAM RNA, also designated SEQ ID:4635.

Another function of VGAM1924 is therefore inhibition of Cystinosis, Nephropathic (CTNS, Accession NM_004937). Accordingly, utilities of VGAM1924 include diagnosis, prevention and treatment of diseases and clinical conditions associated with CTNS. Cytochrome P450, Subfamily IIB (phenobarbital-inducible), Polypeptide 6 (CYP2B6, Accession NM_000767) is another VGAM1924 host target gene. CYP2B6 BINDING SITE is HOST TARGET binding site found in the 3' untranslated region of mRNA encoded by CYP2B6, corresponding to a HOST TARGET binding site such as BINDING SITE I, BINDING SITE II or BINDING SITE III. Table 2 illustrates the complementarity of the nucleotide sequences of CYP2B6 BINDING SITE, designated SEQ ID:6417, to the nucleotide sequence of VGAM1924 RNA, herein designated VGAM RNA, also designated SEQ ID:4635.

Another function of VGAM1924 is therefore inhibition of Cytochrome P450, Subfamily IIB (phenobarbital-inducible), Polypeptide 6 (CYP2B6, Accession NM_000767), a gene which oxidizes a variety of structurally unrelated compounds, including steroids, fatty acids, and xenobiotics. Accordingly, utilities of VGAM1924 include diagnosis, prevention and treatment of diseases and clinical conditions associated with CYP2B6. The function of CYP2B6 has been established by previous studies. Thum and Borlak (2000) investigated the gene expression of major human cytochrome P450 genes in various regions of explanted hearts from 6 patients with dilated cardiomyopathy and 1 with transposition of the arterial trunk and 2 samples of normal heart. mRNA for cytochrome 2B6 was predominantly expressed in the right ventricle. A strong correlation between tissue-specific gene expression and enzyme activity was found. Thum and Borlak (2000) concluded that their findings showed that expression of genes for cytochrome P450 monooxgenases and verapamil metabolism are found predominantly in the right side of the heart, and suggested that this observation may explain the lack of efficacy of certain cardioselective drugs. Using a cloned cDNA that codes for a human ortholog of the phenobarbital-inducible cytochrome P450IIB subfamily in rodents, Santisteban et al. (1988) localized the CYP2B gene family to 19cen-q13.3 by Southern blot hybridization to DNA extracted from a panel of human-rodent somatic cell hybrids. Miles et al. (1988) established the chromosomal localization of the CYP2B gene subfamily to be 19q12-q13.2, close to the location of CYP2A (OMIM Ref. No. 123960), by Southern blot analysis of human-rodent somatic cell hybrids.

Full details of the abovementioned studies are described in the following publications, the disclosure of which are hereby incorporated by reference:

Santisteban, I.; Povey, S.; Shephard, E. A.; Phillips, I. R.: The major phenobarbital-inducible cytochrome P-450 gene subfamily (P450IIB) mapped to the long arm of human chromosome 19. Ann. Hum. Genet. 52:129-135, 1988; and Thum, T.; Borlak, J.: Gene expression in distinct regions of the heart. Lancet 355:979-983, 2000.

Further studies establishing the function and utilities of CYP2B6 are found in John Hopkins OMIM database record ID 605059, and in sited publications numbered 4708-470 and 11783 listed in the bibliography section hereinbelow, which are also hereby incorporated by reference. Dystroglycan 1 (dystrophin-associated glycoprotein 1) (DAG1, Accession NM_004393) is another VGAM1924 host target gene. DAG1 BINDING SITE is HOST TARGET binding site found in the 3' untranslated region of mRNA encoded by DAG1, corresponding to a HOST TARGET binding site such as BINDING SITE I, BINDING SITE II or BINDING SITE III. Table 2 illustrates the complementarity of the nucleotide sequences of DAG1 BINDING SITE, designated SEQ ID:10637, to the nucleotide sequence of VGAM1924 RNA, herein designated VGAM RNA, also designated SEQ ID:4635.

Another function of VGAM1924 is therefore inhibition of Dystroglycan 1 (dystrophin-associated glycoprotein 1) (DAG1, Accession NM_004393), a gene which may provide linkage between the sarcolemma and extracellular matrix (ECM). Accordingly, utilities of VGAM1924 include diagnosis, prevention and treatment of diseases and clinical conditions associated with DAG1. The function of DAG1 and its association with various diseases and clinical conditions, has been established by previous studies, as described hereinabove with reference to VGAM1095. Diacylglycerol Kinase, Beta 90 kDa (DGKB, Accession XM_166516) is another VGAM1924 host target gene. DGKB BINDING SITE is HOST TARGET binding site found in the 3' untranslated region of mRNA encoded by DGKB, corresponding to a HOST TARGET binding site such as BINDING SITE I, BINDING SITE II or BINDING SITE III. Table 2 illustrates the complementarity of the nucleotide sequences of DGKB BINDING SITE, designated SEQ ID:44451, to the nucleotide sequence of VGAM1924 RNA, herein designated VGAM RNA, also designated SEQ ID:4635.

Another function of VGAM1924 is therefore inhibition of Diacylglycerol Kinase, Beta 90 kDa (DGKB, Accession XM_166516), a gene which regulates the intracellular concentration of the second messenger diacylglycerol (DAG). Accordingly, utilities of VGAM1924 include diagnosis, prevention and treatment of diseases and clinical conditions associated with DGKB. The function of DGKB and its association with various diseases and clinical conditions, has been established by previous studies, as described hereinabove with reference to VGAM497. Disrupted In Schizophrenia 1 (DISC1, Accession NM_018662) is another VGAM1924 host target gene. DISC1 BINDING SITE is HOST TARGET binding site found in the 3' untranslated region of mRNA encoded by DISC1, corresponding to a HOST TARGET binding site such as BINDING SITE I, BINDING SITE II or BINDING SITE III. Table 2 illustrates the complementarity of the nucleotide sequences of DISC1 BINDING SITE, designated SEQ ID:20742, to the nucleotide sequence of VGAM1924 RNA, herein designated VGAM RNA, also designated SEQ ID:4635.

Another function of VGAM1924 is therefore inhibition of Disrupted In Schizophrenia 1 (DISC1, Accession NM_018662), a gene which has globular N-terminal domain (s) and a helical C-terminal domain. Accordingly, utilities of VGAM1924 include diagnosis, prevention and treatment of diseases and clinical conditions associated with DISC1. The function of DISC1 and its association with various diseases and clinical conditions, has been established by previous studies, as described hereinabove with reference to VGAM74. DNA (cytosine-5-)-methyltransferase 3 Beta (DNMT3B, Accession NM_006892) is another VGAM1924 host target gene. DNMT3B BINDING SITE is HOST TARGET binding site found in the 3' untranslated region of mRNA encoded by DNMT3B, corresponding to a HOST TARGET binding site such as BINDING SITE I, BINDING SITE II or BINDING SITE III. Table 2 illustrates the complementarity of the nucleotide sequences of DNMT3B BINDING SITE, designated SEQ ID:13766, to the nucleotide sequence of VGAM1924 RNA, herein designated VGAM RNA, also designated SEQ ID:4635.

Another function of VGAM1924 is therefore inhibition of DNA (cytosine-5-)-methyltransferase 3 Beta (DNMT3B, Accession NM_006892), a gene which is required for genome wide de novo methylation. Accordingly, utilities of VGAM1924 include diagnosis, prevention and treatment of diseases and clinical conditions associated with DNMT3B. The function of DNMT3B and its association with various diseases and clinical conditions, has been established by previous studies, as described hereinabove with reference to VGAM280. Diphtheria Toxin Receptor (heparin-binding epidermal growth factor-like growth factor) (DTR, Accession NM_001945) is another VGAM1924 host target gene. DTR BINDING SITE is HOST TARGET binding site found in the 3' untranslated region of mRNA encoded by DTR, corresponding to a HOST TARGET binding site such as BINDING SITE I, BINDING SITE II or BINDING SITE III. Table 2 illustrates the complementarity of the nucleotide sequences of DTR BINDING SITE, designated SEQ ID:7660, to the nucleotide sequence of VGAM1924 RNA, herein designated VGAM RNA, also designated SEQ ID:4635.

Another function of VGAM1924 is therefore inhibition of Diphtheria Toxin Receptor (heparin-binding epidermal growth factor-like growth factor) (DTR, Accession NM_001945), a gene which may be involved in macrophage-mediated cellular proliferation. Accordingly, utilities of VGAM1924 include diagnosis, prevention and treatment of diseases and clinical conditions associated with DTR. The function of DTR and its association with various diseases and clinical conditions, has been established by previous studies, as described hereinabove with reference to VGAM242. DXS1283E (Accession XM_047871) is another VGAM1924 host target gene. DXS1283E BINDING SITE1 and DXS1283E BINDING SITE2 are HOST TARGET binding sites found in untranslated regions of mRNA encoded by DXS1283E, corresponding to HOST TARGET binding sites such as BINDING SITE I, BINDING SITE II or BINDING SITE III. Table 2 illustrates the complementarity of the nucleotide sequences of DXS1283E BINDING SITE1 and DXS1283E BINDING SITE2, designated SEQ ID:35066 and SEQ ID:35068 respectively, to the nucleotide sequence of VGAM1924 RNA, herein designated VGAM RNA, also designated SEQ ID:4635.

Another function of VGAM1924 is therefore inhibition of DXS1283E (Accession XM_047871). Accordingly, utilities of VGAM1924 include diagnosis, prevention and treatment of diseases and clinical conditions associated with DXS1283E. Dual-specificity tyrosine-(Y)-phosphorylation Regulated Kinase 1A (DYRK1A, Accession NM_130436) is another VGAM1924 host target gene. DYRK1A BINDING SITE1 through DYRK1A BINDING SITE3 are HOST TARGET binding sites found in untranslated regions of mRNA encoded by DYRK1A, corresponding to HOST TARGET binding sites such as BINDING SITE I, BINDING SITE II or BINDING SITE III. Table 2 illustrates the complementarity of the nucleotide sequences of DYRK1A BINDING SITE1 through DYRK1A BINDING SITE3, designated SEQ ID:28189, SEQ ID:7094 and SEQ ID:7679 respectively, to the nucleotide sequence of VGAM1924 RNA, herein designated VGAM RNA, also designated SEQ ID:4635.

Another function of VGAM1924 is therefore inhibition of Dual-specificity tyrosine-(Y)-phosphorylation Regulated Kinase 1A (DYRK1A, Accession NM_130436), a gene which regulates cell proliferation and may be involved in brain development. Accordingly, utilities of VGAM1924 include diagnosis, prevention and treatment of diseases and clinical conditions associated with DYRK1A. The function of DYRK1A and its association with various diseases and clinical conditions, has been established by previous studies, as described hereinabove with reference to VGAM42. Endothelin Receptor Type B (EDNRB, Accession NM_003991) is another VGAM1924 host target gene. EDNRB BINDING SITE is HOST TARGET binding site found in the 5' untranslated region of mRNA encoded by EDNRB, corresponding to a HOST TARGET binding site such as BINDING SITE I, BINDING SITE II or BINDING SITE III. Table 2 illustrates the complementarity of the nucleotide sequences of EDNRB BINDING SITE, designated SEQ ID:10148, to the nucleotide sequence of VGAM1924 RNA, herein designated VGAM RNA, also designated SEQ ID:4635.

Another function of VGAM1924 is therefore inhibition of Endothelin Receptor Type B (EDNRB, Accession NM_003991), a gene which is a non-specific receptor for endothelin 1, 2, and 3. Accordingly, utilities of VGAM1924 include diagnosis, prevention and treatment of diseases and clinical conditions associated with EDNRB. The function of EDNRB has been established by previous studies. The 5-prime region of EDNRB is a complex CpG island giving rise to 4 individual transcripts initiating within the island. Pao et al. (2001) analyzed the relationship between methylation and EDNRB expression in human tissues. The CpG island was unmethylated in normal prostate and bladder tissue, whereas it was methylated in colonic epithelium; DNA from tumors derived from these tissues was frequently hypermethylated. Analysis of 11 individual CpG sites in the CpG island showed that specific sites with high methylation levels in several tumors and cancer cell lines were also methylated in normal tissues, suggesting that these sites might serve as foci for further de novo methylation. A low methylation level in a small region within the 5-prime region correlated with expression of the 5-prime-most transcript, whereas almost complete methylation 200 to 1000 bp downstream of the transcriptional start site did not block expression of this transcript. Treatment with 5-aza-2-prime-deoxycytidine induced transcriptional activation of all 4 EDNRB transcripts. The authors concluded that there is differential, tissue-dependent methylation at the EDNRB 5-prime region, and that hypermethylation immediately 3-prime to the transcriptional start site does not prevent initiation. They further proposed a spreading mechanism for de novo methylation, starting from particular methylation hotspots. Animal model experiments lend further support to the function of EDNRB. The role of the endothelin-B receptor in vascular homeostasis is controversial because the receptor has both pressor and depressor effects in vivo. Spotting lethal rats carry a naturally occurring deletion in the endothelin-B receptor gene that completely abrogates functional receptor expression. Rats homozygous for this mutation die shortly after birth due to congenital distal intestinal aganglionosis. Genetic rescue of homozygous rats from this developmental defect using a dopamine hydroxylase-EDNRB transgene resulted in ETB-deficient adult rats Gariepy et al. (2000). On a sodium-deficient diet, the rats exhibited a normal arterial blood pressure, but on a high-sodium diet the homozygous sl rats became severely hypertensive. Normal pressure was restored in the salt-fed rats when the epithelial sodium channel was blocked with amiloride. Gariepy et al. (2000) concluded that the rescued sl/sl rats are a novel single-locus genetic model of severe salt-sensitive hypertension. The results suggested that these rats are hypertensive because they lack the normal tonic inhibition of the renal epithelial sodium channel.

It is appreciated that the abovementioned animal model for EDNRB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pao, M. M.; Tsutsumi, M.; Liang, G.; Uzvolgyi, E.; Gonzales, F. A.; Jones, P. A. : The endothelin receptor B (EDNRB) promoter displays heterogeneous, site specific methylation patterns in normal and tumor cells. Hum. Molec. Genet. 10:903-910, 2001; and Gariepy, C. E.; Ohuchi, T.; Williams, S. C.; Richardson, J. A.; Yanagisawa, M.: Salt-sensitive hypertension in endothelin-B receptor-deficient rats. J. Clin. Invest. 105:925-933, 200.

Further studies establishing the function and utilities of EDNRB are found in John Hopkins OMIM database record ID 131244, and in sited publications numbered 4040-4043, 2290, 12215-4053, 2642, 2587-2590, 2280, 2591-260 and 2286 listed in the bibliography section hereinbelow, which are also hereby incorporated by reference. Fatty Acid Binding Protein 2, Intestinal (FABP2, Accession NM_000134) is another VGAM1924 host target gene. FABP2 BINDING SITE is HOST TARGET binding site found in the 3' untranslated region of mRNA encoded by FABP2, corresponding to a HOST TARGET binding site such as BINDING SITE I, BINDING SITE II or BINDING SITE III. Table 2 illustrates the complementarity of the nucleotide sequences of FABP2 BINDING SITE, designated SEQ ID:5624, to the nucleotide sequence of VGAM1924 RNA, herein designated VGAM RNA, also designated SEQ ID:4635.

Another function of VGAM1924 is therefore inhibition of Fatty Acid Binding Protein 2, Intestinal (FABP2, Accession NM_000134), a gene which may have a role in dietary fat uptake or processing. Accordingly, utilities of VGAM1924 include diagnosis, prevention and treatment of diseases and clinical conditions associated with FABP2. The function of FABP2 and its association with various diseases and clinical conditions, has been established by previous studies, as described hereinabove with reference to VGAM951. Fibulin 5 (FBLN5, Accession NM_006329) is another VGAM1924 host target gene. FBLN5 BINDING SITE is HOST TARGET binding site found in the 3' untranslated region of mRNA encoded by FBLN5, corresponding to a HOST TARGET binding site such as BINDING SITE I, BINDING SITE II or BINDING SITE III. Table 2 illustrates the complementarity of the nucleotide sequences of FBLN5 BINDING SITE, designated SEQ ID:13023, to the nucleotide sequence of VGAM1924 RNA, herein designated VGAM RNA, also designated SEQ ID:4635.

Another function of VGAM1924 is therefore inhibition of Fibulin 5 (FBLN5, Accession NM_006329), a gene which promotes adhesion of endothelial cells through interaction of integrins and the rgd motif. Accordingly, utilities of VGAM1924 include diagnosis, prevention and treatment of diseases and clinical conditions associated with FBLN5. The function of FBLN5 and its association with various diseases and clinical conditions, has been established by previous studies, as described hereinabove with reference to VGAM1127. F-box and Leucine-rich Repeat Protein 7 (FBXL7, Accession NM_012304) is another VGAM1924 host target gene. FBXL7 BINDING SITE is HOST TARGET binding site found in the 3' untranslated region of mRNA encoded by FBXL7, corresponding to a HOST TARGET binding site such as BINDING SITE I, BINDING SITE II or BINDING SITE III. Table 2 illustrates the complementarity of the nucleotide sequences of FBXL7 BINDING SITE, designated SEQ ID:14671, to the nucleotide sequence of VGAM1924 RNA, herein designated VGAM RNA, also designated SEQ ID:4635.

Another function of VGAM1924 is therefore inhibition of F-box and Leucine-rich Repeat Protein 7 (FBXL7, Accession NM_012304), a gene which may be involved in in phosphorylation-dependent ubiquitination. Accordingly, utilities of VGAM1924 include diagnosis, prevention and treatment of diseases and clinical conditions associated with FBXL7. The function of FBXL7 has been established by previous studies. The F box, named after cyclin F (CCNF; 600227), in which it was originally observed, is an approximately 40-amino acid motif that binds SKP1 (OMIM Ref. No. 601434). F-box proteins are components of modular E3 ubiquitin protein ligases called SCFs (SKP1, OMIM Ref. No. 603134), F-box proteins), which function in phosphorylation-dependent ubiquitination. Using a yeast 2-hybrid screen with SKP1 as bait, followed by searching sequence databases, Winston et al. (1999) and Cenciarelli et al. (1999) identified 33 mammalian and 26 human F-box proteins, respectively. These contained C termini with leucine-rich repeats (FBXLs, e.g., SKP2 (OMIM Ref. No. 601436)), WD40 domains (FBXWs, e.g., BTRCP (OMIM Ref. No. 603482)), or no recognizable motifs (FBXOs, e.g., CCNF). Winston et al. (1999) predicted the presence of 12 leucine-rich repeats (LRRs) in FBXL7. RT-PCR analysis detected strong expression in all tissues tested, with highest levels in heart, kidney, liver, and lung.

Full details of the abovementioned studies are described in the following publications, the disclosure of which are hereby incorporated by reference:

Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human genes. XII. The complete sequences of 100 new cDNA clones from brain which code for large proteins in vitro. DNA Res. 5:355-364, 1998; and Winston, J. T.; Koepp, D. M.; Zhu, C.; Elledge, S. J.; Harper, J. W.: A family of mammalian F-box proteins. Curr. Biol. 9:1180-1182, 1999.

Further studies establishing the function and utilities of FBXL7 are found in John Hopkins OMIM database record ID 605656, and in sited publications numbered 40 and 8278 listed in the bibliography section hereinbelow, which are also hereby incorporated by reference. FCRH1 (Accession NM_052938) is another VGAM1924 host target gene. FCRH1 BINDING SITE is HOST TARGET binding site found in the 3' untranslated region of mRNA encoded by FCRH1, corresponding to a HOST TARGET binding site such as BINDING SITE I, BINDING SITE II or BINDING SITE III. Table 2 illustrates the complementarity of the nucleotide sequences of FCRH1 BINDING SITE, designated SEQ ID:27500, to the nucleotide sequence of VGAM1924 RNA, herein designated VGAM RNA, also designated SEQ ID:4635.

Another function of VGAM1924 is therefore inhibition of FCRH1 (Accession NM_052938). Accordingly, utilities of VGAM1924 include diagnosis, prevention and treatment of diseases and clinical conditions associated with FCRH1. Frizzled Homolog 8 (Drosophila) (FZD8, Accession NM_031866) is another VGAM1924 host target gene. FZD8 BINDING SITE is HOST TARGET binding site found in the 3' untranslated region of mRNA encoded by FZD8, corresponding to a HOST TARGET binding site such as BINDING SITE I, BINDING SITE II or BINDING SITE III. Table 2 illustrates the complementarity of the nucleotide sequences of FZD8 BINDING SITE, designated SEQ ID:25623, to the nucleotide sequence of VGAM1924 RNA, herein designated VGAM RNA, also designated SEQ ID:4635.

Another function of VGAM1924 is therefore inhibition of Frizzled Homolog 8 (Drosophila) (FZD8, Accession NM_031866), a gene which may be involved in transduction and intercellular transmission of polarity information during tissue morphogenesis and/or in differentiated tissues. Accordingly, utilities of VGAM1924 include diagnosis, prevention and treatment of diseases and clinical conditions associated with FZD8. The function of FZD8 and its association with various diseases and clinical conditions, has been established by previous studies, as described hereinabove with reference to VGAM503. UDP-N-acetyl-alpha-D-galactosamine:polypeptide N-acetylgalactosaminyltransferase 3 (GalNAc-T3) (GALNT3, Accession NM_004482) is another VGAM1924 host target gene. GALNT3 BINDING SITE1 and GALNT3 BINDING SITE2 are HOST TARGET binding sites found in untranslated regions of mRNA encoded by GALNT3, corresponding to HOST TARGET binding sites such as BINDING SITE I, BINDING SITE II or BINDING SITE III. Table 2 illustrates the complementarity of the nucleotide sequences of GALNT3 BINDING SITE1 and GALNT3 BINDING SITE2, designated SEQ ID:10803 and SEQ ID:10804 respectively, to the nucleotide sequence of VGAM1924 RNA, herein designated VGAM RNA, also designated SEQ ID:4635.

Another function of VGAM1924 is therefore inhibition of UDP-N-acetyl-alpha-D-galactosamine:polypeptide N-acetylgalactosaminyltransferase 3 (GalNAc-T3) (GALNT3, Accession NM_004482), a gene which initiates O-glycosylation of serine and threonine residues. Accordingly, utilities of VGAM1924 include diagnosis, prevention and treatment of diseases and clinical conditions associated with GALNT3. The function of GALNT3 and its association with various diseases and clinical conditions, has been established by previous studies, as described hereinabove with reference to VGAM1565. Glutamate-ammonia Ligase (glutamine synthase) (GLUL, Accession NM_002065) is another VGAM1924 host target gene. GLUL BINDING SITE is HOST TARGET binding site found in the 3' untranslated region of mRNA encoded by GLUL, corresponding to a HOST TARGET binding site such as BINDING SITE I, BINDING SITE II or BINDING SITE III. Table 2 illustrates the complementarity of the nucleotide sequences of GLUL BINDING SITE, designated SEQ ID:7837, to the nucleotide sequence of VGAM1924 RNA, herein designated VGAM RNA, also designated SEQ ID:4635.

Another function of VGAM1924 is therefore inhibition of Glutamate-ammonia Ligase (glutamine synthase) (GLUL, Accession NM_002065), a gene which catalyzes the condensation of glutamate and ammonia to form glutamine. Accordingly, utilities of VGAM1924 include diagnosis, prevention and treatment of diseases and clinical conditions associated with GLUL. The function of GLUL and its association with various diseases and clinical conditions, has been established by previous studies, as described hereinabove with reference to VGAM948. Guanine Nucleotide Binding Protein (G protein), Beta Polypeptide 1 (GNB1, Accession NM_002074) is another VGAM1924 host target gene. GNB1 BINDING SITE is HOST TARGET binding site found in the 3' untranslated region of mRNA encoded by GNB1, corresponding to a HOST TARGET binding site such as BINDING SITE I, BINDING SITE II or BINDING SITE III. Table 2 illustrates the complementarity of the nucleotide sequences of GNB1 BINDING SITE, designated SEQ ID:7851, to the nucleotide sequence of VGAM1924 RNA, herein designated VGAM RNA, also designated SEQ ID:4635.

Another function of VGAM1924 is therefore inhibition of Guanine Nucleotide Binding Protein (G protein), Beta Polypeptide 1 (GNB1, Accession NM_002074). Accordingly, utilities of VGAM1924 include diagnosis, prevention and treatment of diseases and clinical conditions associated with GNB1. Glutamate Receptor, Metabotropic 4 (GRM4, Accession NM_000841) is another VGAM1924 host target gene. GRM4 BINDING SITE is HOST TARGET binding site found in the 3' untranslated region of mRNA encoded by GRM4, corresponding to a HOST TARGET binding site such as BINDING SITE I, BINDING SITE II or BINDING SITE III. Table 2 illustrates the complementarity of the nucleotide sequences of GRM4 BINDING SITE, designated SEQ ID:6505, to the nucleotide sequence of VGAM1924 RNA, herein designated VGAM RNA, also designated SEQ ID:4635.

Another function of VGAM1924 is therefore inhibition of Glutamate Receptor, Metabotropic 4 (GRM4, Accession NM_000841), a gene which is mediated by a g-protein that inhibits adenylate cyclase activity. Accordingly, utilities of VGAM1924 include diagnosis, prevention and treatment of diseases and clinical conditions associated with GRM4. The function of GRM4 and its association with various diseases and clinical conditions, has been established by previous studies, as described hereinabove with reference to VGAM1052. Hepatocyte Growth Factor (hepapoietin A; scatter factor) (HGF, Accession XM_168542) is another VGAM1924 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45223, to the nucleotide sequence of VGAM1924 RNA, herein designated VGAM RNA, also designated SEQ ID:4635.

Another function of VGAM1924 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM1924 include diagnosis, prevention and treatment of diseases and clinical conditions associated with HGF. The function of HGF and its association with various diseases and clinical conditions, has been established by previous studies, as described hereinabove with reference to VGAM174. Homeo Box B3 (HOXB3, Accession NM_002146) is another VGAM1924 host target gene. HOXB3 BINDING SITE is HOST TARGET binding site found in the 5' untranslated region of mRNA encoded by HOXB3, corresponding to a HOST TARGET binding site such as BINDING SITE I, BINDING SITE II or BINDING SITE III. Table 2 illustrates the complementarity of the nucleotide sequences of HOXB3 BINDING SITE, designated SEQ ID:7922, to the nucleotide sequence of VGAM1924 RNA, herein designated VGAM RNA, also designated SEQ ID:4635.

Another function of VGAM1924 is therefore inhibition of Homeo Box B3 (HOXB3, Accession NM_002146). Accordingly, utilities of VGAM1924 include diagnosis, prevention and treatment of diseases and clinical conditions associated with HOXB3. Heat Shock 70 kDa Protein 8 (HSPA8, Accession NM_006597) is another VGAM1924 host target gene. HSPA8 BINDING SITE is HOST TARGET binding site found in the 5' untranslated region of mRNA encoded by HSPA8, corresponding to a HOST TARGET binding site such as BINDING SITE I, BINDING SITE II or BINDING SITE III. Table 2 illustrates the complementarity of the nucleotide sequences of HSPA8 BINDING SITE, designated SEQ ID:13371, to the nucleotide sequence of VGAM1924 RNA, herein designated VGAM RNA, also designated SEQ ID:4635.

Another function of VGAM1924 is therefore inhibition of Heat Shock 70kDa Protein 8 (HSPA8, Accession NM_006597), a gene which acts as a chaperone.plays an important role in cells by transiently associating with nascent polypeptides to facilitate correct folding. Accordingly, utilities of VGAM1924 include diagnosis, prevention and treatment of diseases and clinical conditions associated with HSPA8. The function of HSPA8 and its association with various diseases and clinical conditions, has been established by previous studies, as described hereinabove with reference to VGAM258. Inhibitor of DNA Binding 4, Dominant Negative Helix-loop-helix Protein (ID4, Accession NM_001546) is another VGAM1924 host target gene. ID4 BINDING SITE is HOST TARGET binding site found in the 3' untranslated region of mRNA encoded by ID4, corresponding to a HOST TARGET binding site such as BINDING SITE I, BINDING SITE II or BINDING SITE III. Table 2 illustrates the complementarity of the nucleotide sequences of ID4 BINDING SITE, designated SEQ ID:7272, to the nucleotide sequence of VGAM1924 RNA, herein designated VGAM RNA, also designated SEQ ID:4635.

Another function of VGAM1924 is therefore inhibition of Inhibitor of DNA Binding 4, Dominant Negative Helix-loop-helix Protein (ID4, Accession NM_001546), a gene which negatively regulates cell differentiation. Accordingly, utilities of VGAM1924 include diagnosis, prevention and treatment of diseases and clinical conditions associated with ID4. The function of ID4 and its association with various diseases and clinical conditions, has been established by previous studies, as described hereinabove with reference to VGAM931. Interleukin 10 Receptor, Alpha (IL10RA, Accession XM_006447) is another VGAM1924 host target gene. IL10RA BINDING SITE is HOST TARGET binding site found in the 3' untranslated region of mRNA encoded by IL10RA, corresponding to a HOST TARGET binding site such as BINDING SITE I, BINDING SITE II or BINDING SITE III. Table 2 illustrates the complementarity of the nucleotide sequences of IL10RA BINDING SITE, designated SEQ ID:29997, to the nucleotide sequence of VGAM1924 RNA, herein designated VGAM RNA, also designated SEQ ID:4635.

Another function of VGAM1924 is therefore inhibition of Interleukin 10 Receptor, Alpha (IL10RA, Accession XM_006447), a gene which is a receptor for il-10. Accordingly, utilities of VGAM1924 include diagnosis, prevention and treatment of diseases and clinical conditions associated with IL10RA. The function of IL10RA and its association with various diseases and clinical conditions, has been established by previous studies, as described hereinabove with reference to VGAM134. Interleukin 8 (IL8, Accession XM_170504) is another VGAM1924 host target gene. IL8 BINDING SITE is HOST TARGET binding site found in the 3' untranslated region of mRNA encoded by IL8, corresponding to a HOST TARGET binding site such as BINDING SITE I, BINDING SITE II or BINDING SITE III. Table 2 illustrates the complementarity of the nucleotide sequences of IL8 BINDING SITE, designated SEQ ID:45338, to the nucleotide sequence of VGAM1924 RNA, herein designated VGAM RNA, also designated SEQ ID:4635.

Another function of VGAM1924 is therefore inhibition of Interleukin 8 (IL8, Accession XM_170504). Accordingly, utilities of VGAM1924 include diagnosis, prevention and treatment of diseases and clinical conditions associated with IL8. inositol (myo)-1(or 4)-monophosphatase 1 (IMPA1, Accession NM_005536) is another VGAM1924 host target gene. IMPA1 BINDING SITE is HOST TARGET binding site found in the 3' untranslated region of mRNA encoded by IMPA1, corresponding to a HOST TARGET binding site such as BINDING SITE I, BINDING SITE II or BINDING SITE III. Table 2 illustrates the complementarity of the nucleotide sequences of IMPA1 BINDING SITE, designated SEQ ID:12057, to the nucleotide sequence of VGAM1924 RNA, herein designated VGAM RNA, also designated SEQ ID:4635.

Another function of VGAM1924 is therefore inhibition of inositol (myo)-1(or 4)-monophosphatase 1 (IMPA1, Accession NM_005536), a gene which is responsible for the provision of inositol required for synthesis of phosphatidylinositol and polyphosphoinositides. Accordingly, utilities of VGAM1924 include diagnosis, prevention and treatment of diseases and clinical conditions associated with IMPA1. The function of IMPA1 and its association with various diseases and clinical conditions, has been established by previous studies, as described hereinabove with reference to VGAM134. Inhibin, Beta B (activin AB beta polypeptide) (INHBB, Accession NM_002193) is another VGAM1924 host target gene. INHBB BINDING SITE is HOST TARGET binding site found in the 3' untranslated region of mRNA encoded by INHBB, corresponding to a HOST TARGET binding site such as BINDING SITE I, BINDING SITE II or BINDING SITE III. Table 2 illustrates the complementarity of the nucleotide sequences of INHBB BINDING SITE, designated SEQ ID:7949, to the nucleotide sequence of VGAM1924 RNA, herein designated VGAM RNA, also designated SEQ ID:4635.

Another function of VGAM1924 is therefore inhibition of Inhibin, Beta B (activin AB beta polypeptide) (INHBB, Accession NM_002193), a gene which inhibins inhibit the secretion of follitropin by the pituitary gland. Accordingly, utilities of VGAM1924 include diagnosis, prevention and treatment of diseases and clinical conditions associated with INHBB. The function of INHBB and its association with various diseases and clinical conditions, has been established by previous studies, as described hereinabove with reference to VGAM1465. Jerky Homolog-like (mouse) (JRKL, Accession NM_003772) is another VGAM1924 host target gene. JRKL BINDING SITE is HOST TARGET binding site found in the 3' untranslated region of mRNA encoded by JRKL, corresponding to a HOST TARGET binding site such as BINDING SITE I, BINDING SITE II or BINDING SITE III. Table 2 illustrates the complementarity of the nucleotide sequences of JRKL BINDING SITE, designated SEQ ID:9855, to the nucleotide sequence of VGAM1924 RNA, herein designated VGAM RNA, also designated SEQ ID:4635.

Another function of VGAM1924 is therefore inhibition of Jerky Homolog-like (mouse) (JRKL, Accession NM_003772), a gene which is a Jerky-related protein and similar to centromere binding protein-B and other nuclear regulators. Accordingly, utilities of VGAM1924 include diagnosis, prevention and treatment of diseases and clinical conditions associated with JRKL. The function of JRKL and its association with various diseases and clinical conditions, has been established by previous studies, as described hereinabove with reference to VGAM1546. Potassium Voltage-gated Channel, Shaker-related Subfamily, Member 3 (KCNA3, Accession NM_002232) is another VGAM1924 host target gene. KCNA3 BINDING SITE is HOST TARGET binding site found in the 3' untranslated region of mRNA encoded by KCNA3, corresponding to a HOST TARGET binding site such as BINDING SITE I, BINDING SITE II or BINDING SITE III. Table 2 illustrates the complementarity of the nucleotide sequences of KCNA3 BINDING SITE, designated SEQ ID:8013, to the nucleotide sequence of VGAM1924 RNA, herein designated VGAM RNA, also designated SEQ ID:4635.

Another function of VGAM1924 is therefore inhibition of Potassium Voltage-gated Channel, Shaker-related Subfamily, Member 3 (KCNA3, Accession NM_002232). Accordingly, utilities of VGAM1924 include diagnosis, prevention and treatment of diseases and clinical conditions associated with KCNA3. Potassium Inwardly-rectifying Channel, Subfamily J, Member 16 (KCNJ16, Accession NM_018658) is another VGAM1924 host target gene. KCNJ16 BINDING SITE is HOST TARGET binding site found in the 3' untranslated region of mRNA encoded by KCNJ16, corresponding to a HOST TARGET binding site such as BINDING SITE I, BINDING SITE II or BINDING SITE III. Table 2 illustrates the complementarity of the nucleotide sequences of KCNJ16 BINDING SITE, designated SEQ ID:20728, to the nucleotide sequence of VGAM1924 RNA, herein designated VGAM RNA, also designated SEQ ID:4635.

Another function of VGAM1924 is therefore inhibition of Potassium Inwardly-rectifying Channel, Subfamily J, Member 16 (KCNJ16, Accession NM_018658). Accordingly, utilities of VGAM1924 include diagnosis, prevention and treatment of diseases and clinical conditions associated with KCNJ16. Kynurenine 3-monooxygenase (kynurenine 3-hydroxylase) (KMO, Accession NM_003679) is another VGAM1924 host target gene. KMO BINDING SITE is HOST TARGET binding site found in the 3' untranslated region of mRNA encoded by KMO, corresponding to a HOST TARGET binding site such as BINDING SITE I, BINDING SITE II or BINDING SITE III. Table 2 illustrates the complementarity of the nucleotide sequences of KMO BINDING SITE, designated SEQ ID:9782, to the nucleotide sequence of VGAM1924 RNA, herein designated VGAM RNA, also designated SEQ ID:4635.

Another function of VGAM1924 is therefore inhibition of Kynurenine 3-monooxygenase (kynurenine 3-hydroxylase) (KMO, Accession NM_003679), a gene which may play a role in encephalic photoreception. Accordingly, utilities of VGAM1924 include diagnosis, prevention and treatment of diseases and clinical conditions associated with KMO. The function of KMO and its association with various diseases and clinical conditions, has been established by previous studies, as described hereinabove with reference to VGAM162. Like-glycosyltransferase (LARGE, Accession NM_004737) is another VGAM1924 host target gene. LARGE BINDING SITE1 and LARGE BINDING SITE2 are HOST TARGET binding sites found in untranslated regions of mRNA encoded by LARGE, corresponding to HOST TARGET binding sites such as BINDING SITE I, BINDING SITE II or BINDING SITE III. Table 2 illustrates the complementarity of the nucleotide sequences of LARGE BINDING SITE1 and LARGE BINDING SITE2, designated SEQ ID:11130 and SEQ ID:28602 respectively, to the nucleotide sequence of VGAM1924 RNA, herein designated VGAM RNA, also designated SEQ ID:4635.

Another function of VGAM1924 is therefore inhibition of Like-glycosyltransferase (LARGE, Accession NM_004737), a gene which is a member of the N-acetylglucosaminyltransferase family. Accordingly, utilities of VGAM1924 include diagnosis, prevention and treatment of diseases and clinical conditions associated with LARGE. The function of LARGE and its association with various diseases and clinical conditions, has been established by previous studies, as described hereinabove with reference to VGAM205. Methyl-CpG Binding Domain Protein 1 (MBD1, Accession NM_002384) is another VGAM1924 host target gene. MBD1 BINDING SITE1 through MBD1 BINDING SITE4 are HOST TARGET binding sites found in untranslated regions of mRNA encoded by MBD1, corresponding to HOST TARGET binding sites such as BINDING SITE I, BINDING SITE II or BINDING SITE III. Table 2 illustrates the complementarity of the nucleotide sequences of MBD1 BINDING SITE1 through MBD1 BINDING SITE4, designated SEQ ID:8202, SEQ ID:17972, SEQ ID:17973 and SEQ ID:17974 respectively, to the nucleotide sequence of VGAM1924 RNA, herein designated VGAM RNA, also designated SEQ ID:4635.

Another function of VGAM1924 is therefore inhibition of Methyl-CpG Binding Domain Protein 1 (MBD1, Accession NM_002384), a gene which bind specifically to methylated DNA via a methyl-CpG-binding domain (MBD). Accordingly, utilities of VGAM1924 include diagnosis, prevention and treatment of diseases and clinical conditions associated with MBD1. The function of MBD1 has been established by previous studies. Attempts to understand how DNA methylation prevents transcription have centered on 2 alternative mechanisms: direct interference of site-specific methylation with the binding of essential transcription factors, and indirect interference of promoter-proximal methylation with transcription via a protein that binds to methylated DNA. Methyl-CpG-binding protein-1 (MECP1) binds to a variety of methylated sequences in vitro, provided they contain at least 12 symmetrically methylated CpGs. MECP1 has been detected in crude nuclear extracts. Boyes and Bird (1991) and Levine et al. (1991) presented evidence suggesting that the MECP1 protein is a mediator of repression. Methylation of cytosines within the sequence CpG is essential for mouse development and has been linked to transcriptional suppression in vertebrate systems. Methyl-CpG-binding proteins MECP1 and MECP2 (OMIM Ref. No. 300005) bind preferentially to methylated DNA and can inhibit transcription. The rat Mecp2 gene was cloned by Nan et al. (1993) and its methyl-CpG-binding domain (MBD) defined. By searching DNA sequence databases with the MBD sequence, Cross et al. (1997) identified a human cDNA with potential to encode an MBD-like region. Sequencing of the complete cDNA revealed that the open reading frame also encodes 2 cysteine-rich domains that were found in animal DNA methyltransferases (see OMIM Ref. No. DNMT; 126375) and in the mammalian HRX protein, also known as MLL and ALL-1 (OMIM Ref. No. 159555). They designated the protein PCM1 for 'protein containing MBD.' Expressed in bacteria, it showed specific binding to methylated DNA. PCM1 also repressed transcription in vitro in a methylation-dependent manner. A polyclonal antibody raised against the protein was able to bind the native MECP1 complex from HeLa cells, indicating that PCM1 is a component of mammalian MECP1. Using PCR on a hybrid panel and FISH, Hendrich et al. (1999) mapped the MBD1 gene to chromosome 18q21, 2.1 cM distal to MBD2 (OMIM Ref. No. 603547). They mapped the murine gene to chromosome 18.

Full details of the abovementioned studies are described in the following publications, the disclosure of which are hereby incorporated by reference:

Boyes, J.; Bird, A.: DNA methylation inhibits transcription indirectly via a methyl-CpG binding protein. Cell 64:1123-1134, 1991; and Levine, A.; Cantoni, G. L.; Razin, A.: Inhibition of promoter activity by methylation: possible involvement of protein mediators. Proc. Nat. Acad. Sci. 88:6515-6518, 1991.

Further studies establishing the function and utilities of MBD1 are found in John Hopkins OMIM database record ID 156535, and in sited publications numbered 2224-222 and 12709-12711 listed in the bibliography section hereinbelow, which are also hereby incorporated by reference. Multiple Endocrine Neoplasia I (MEN1, Accession XM_167804) is another VGAM1924 host target gene. MEN1 BINDING SITE is HOST TARGET binding site found in the 5' untranslated region of mRNA encoded by MEN1, corresponding to a HOST TARGET binding site such as BINDING SITE I, BINDING SITE II or BINDING SITE III. Table 2 illustrates the complementarity of the nucleotide sequences of MEN1 BINDING SITE, designated SEQ ID:44845, to the nucleotide sequence of VGAM1924 RNA, herein designated VGAM RNA, also designated SEQ ID:4635.

Another function of VGAM1924 is therefore inhibition of Multiple Endocrine Neoplasia I (MEN1, Accession XM_167804). Accordingly, utilities of VGAM1924 include diagnosis, prevention and treatment of diseases and clinical conditions associated with MEN1. Myotubular Myopathy 1 (MTM1, Accession NM_000252) is another VGAM1924 host target gene. MTM1 BINDING SITE is HOST TARGET binding site found in the 3' untranslated region of mRNA encoded by MTM1, corresponding to a HOST TARGET binding site such as BINDING SITE I, BINDING SITE II or BINDING SITE III. Table 2 illustrates the complementarity of the nucleotide sequences of MTM1 BINDING SITE, designated SEQ ID:5792, to the nucleotide sequence of VGAM1924 RNA, herein designated VGAM RNA, also designated SEQ ID:4635.

Another function of VGAM1924 is therefore inhibition of Myotubular Myopathy 1 (MTM1, Accession NM_000252). Accordingly, utilities of VGAM1924 include diagnosis, prevention and treatment of diseases and clinical conditions associated with MTM1. 5-methyltetrahydrofolate-homocysteine Methyltransferase (MTR, Accession NM_000254) is another VGAM1924 host target gene. MTR BINDING SITE is HOST TARGET binding site found in the 3" untranslated region of mRNA encoded by MTR, corresponding to a HOST TARGET binding site such as BINDING SITE I, BINDING SITE II or BINDING SITE III. Table 2 illustrates the complementarity of the nucleotide sequences of MTR BINDING SITE, designated SEQ ID:5796, to the nucleotide sequence of VGAM1924 RNA, herein designated VGAM RNA, also designated SEQ ID:4635.

Another function of VGAM1924 is therefore inhibition of 5-methyltetrahydrofolate-homocysteine Methyltransferase (MTR, Accession NM_000254). Accordingly, utilities of VGAM1924 include diagnosis, prevention and treatment of diseases and clinical conditions associated with MTR. V-myc Myelocytomatosis Viral Related Oncogene, Neuroblastoma Derived (avian) (MYCN, Accession NM_005378) is another VGAM1924 host target gene. MYCN BINDING SITE is HOST TARGET binding site found in the 3' untranslated region of mRNA encoded by MYCN, corresponding to a HOST TARGET binding site such as BINDING SITE I, BINDING SITE II or BINDING SITE III. Table 2 illustrates the complementarity of the nucleotide sequences of MYCN BINDING SITE, designated SEQ ID:11860, to the nucleotide sequence of VGAM1924 RNA, herein designated VGAM RNA, also designated SEQ ID:4635.

Another function of VGAM1924 is therefore inhibition of V-myc Myelocytomatosis Viral Related Oncogene, Neuroblastoma Derived (avian) (MYCN, Accession NM_005378), a gene which may function as a transcription factor. Accordingly, utilities of VGAM1924 include diagnosis, prevention and treatment of diseases and clinical conditions associated with MYCN. The function of MYCN has been established by previous studies. Reiter and Brodeur (1996) generated a high-resolution restriction map of approximately 500 kb spanning the MYCN locus. They found that deletions and rearrangements of the amplicon occurred less often in primary tumors than in cell lines. They also defined a 130-kb common core region of the MYCN amplicon that was amplified in 32 of 33 neuroblastomas. The authors proposed that despite the large size of most MYCN amplicons, the core region that is consistently amplified in neuroblastomas probably contains the MYCN gene and little else. Armstrong and Krystal (1992) identified NCYM (OMIM Ref. No. 605374) as a gene that overlaps with MYCN; however, it is trancribed from the opposite DNA strand. The 2 genes appear to be coregulated in tumor cell lines. Guo et al. (1999) performed a comprehensive analysis of deletions of 11q in neuroblastomas:295 sporadic, 15 familial, and 21 tumor-derived cell lines. Loss of heterozygosity (LOH) analysis was performed at 24 microsatellite loci spanning 11q. LOH was observed at multiple 11q loci in 129 of 295 (44%) sporadic neuroblastomas, 5 of 15 (33%) familial neuroblastomas, and 5 of 21 (24%) neuroblastoma cell lines. A single region of 2.1 cM within 11q23.3, flanked by markers D11S1340 and D11S1299, was deleted in all specimens with 11q LOH. Allelic loss at 11q23 was inversely related to MYCN amplification (P less than 0.001). Within the subset of cases with a single copy of MYCN, 11q LOH was associated with advanced stage disease, unfavorable histopathology, and decreased overall survival probability. However, 11q LOH was not independently prognostic in multivariate analyses. These data were judged to support the hypothesis that a tumor suppressor gene mapping within 11q23.3 is commonly inactivated during the malignant evolution of a large subset of neuroblastomas, especially those with unamplified MYCN.

Full details of the abovementioned studies are described in the following publications, the disclosure of which are hereby incorporated by reference:

Guo, C.; White, P. S.; Weiss, M. J.; Hogarty, M. D.; Thompson, P. M.; Stram, D. O.; Gerbing, R.; Matthay, K. K.; Seeger, R. C.; Brodeur, G. M.; Maris, J. M.: Allelic deletion at 11q23 is common in MYCN single copy neuroblastomas. Oncogene 18:4948-4957, 1999; and Reiter, J. L.; Brodeur, G. M.: High-resolution mapping of a 130-kb core region of the MYCN amplicon in neuroblastomas. Genomics 32:97-103, 1996.

Further studies establishing the function and utilities of MYCN are found in John Hopkins OMIM database record ID 164840, and in sited publications numbered 1728-174 and 1814 listed in the bibliography section hereinbelow, which are also hereby incorporated by reference. Myeloid Differentiation Primary Response Gene (88) (MYD88, Accession NM_002468) is another VGAM1924 host target gene. MYD88 BINDING SITE is HOST TARGET binding site found in the 3' untranslated region of mRNA encoded by MYD88, corresponding to a HOST TARGET binding site such as BINDING SITE I, BINDING SITE II or BINDING SITE III. Table 2 illustrates the complementarity of the nucleotide sequences of MYD88 BINDING SITE, designated SEQ ID:8297, to the nucleotide sequence of VGAM1924 RNA, herein designated VGAM RNA, also designated SEQ ID:4635.

Another function of VGAM1924 is therefore inhibition of Myeloid Differentiation Primary Response Gene (88) (MYD88, Accession NM_002468), a gene which is involved in the toll-like receptor and il-1 receptor signaling pathway in the innate immune response. Accordingly, utilities of VGAM1924 include diagnosis, prevention and treatment of diseases and clinical conditions associated with MYD88. The function of MYD88 and its association with various diseases and clinical conditions, has been established by previous studies, as described hereinabove with reference to VGAM18. Sialidase 3 (membrane sialidase) (NEU3, Accession NM_006656) is another VGAM1924 host target gene. NEU3 BINDING SITE is HOST TARGET binding site found in the 3' untranslated region of mRNA encoded by NEU3, corresponding to a HOST TARGET binding site such as BINDING SITE I, BINDING SITE II or BINDING SITE III. Table 2 illustrates the complementarity of the nucleotide sequences of NEU3 BINDING SITE, designated SEQ ID:13458, to the nucleotide sequence of VGAM1924 RNA, herein designated VGAM RNA, also designated SEQ ID:4635.

Another function of VGAM1924 is therefore inhibition of Sialidase 3 (membrane sialidase) (NEU3, Accession NM_006656). Accordingly, utilities of VGAM1924 include diagnosis, prevention and treatment of diseases and clinical conditions associated with NEU3. Neuralized-like (Drosophila) (NEURL, Accession NM_004210) is another VGAM1924 host target gene. NEURL BINDING SITE is HOST TARGET binding site found in the 3' untranslated region of mRNA encoded by NEURL, corresponding to a HOST TARGET binding site such as BINDING SITE I, BINDING SITE II or BINDING SITE III. Table 2 illustrates the complementarity of the nucleotide sequences of NEURL BINDING SITE, designated SEQ ID:10413, to the nucleotide sequence of VGAM1924 RNA, herein designated VGAM RNA, also designated SEQ ID:4635.

Another function of VGAM1924 is therefore inhibition of Neuralized-like (Drosophila) (NEURL, Accession NM_004210). Accordingly, utilities of VGAM1924 include diagnosis, prevention and treatment of diseases and clinical conditions associated with NEURL. Neurogenic Differentiation 1 (NEUROD1, Accession NM_002500) is another VGAM1924 host target gene. NEUROD1 BINDING SITE is HOST TARGET binding site found in the 3' untranslated region of mRNA encoded by NEUROD1, corresponding to a HOST TARGET binding site such as BINDING SITE I, BINDING SITE II or BINDING SITE III. Table 2 illustrates the complementarity of the nucleotide sequences of NEUROD1 BINDING SITE, designated SEQ ID:8324, to the nucleotide sequence of VGAM1924 RNA, herein designated VGAM RNA, also designated SEQ ID:4635.

Another function of VGAM1924 is therefore inhibition of Neurogenic Differentiation 1 (NEUROD1, Accession NM_002500), a gene which acts as a differentiation factor during neurogenesis. Accordingly, utilities of VGAM1924 include diagnosis, prevention and treatment of diseases and clinical conditions associated with NEUROD1. The function of NEUROD1 and its association with various diseases and clinical conditions, has been established by previous studies, as described hereinabove with reference to VGAM130. Aminopeptidase Puromycin Sensitive (NPEPPS, Accession NM_006310) is another VGAM1924 host target gene. NPEPPS BINDING SITE is HOST TARGET binding site found in the 3' untranslated region of mRNA encoded by NPEPPS, corresponding to a HOST TARGET binding site such as BINDING SITE I, BINDING SITE II or BINDING SITE III. Table 2 illustrates the complementarity of the nucleotide sequences of NPEPPS BINDING SITE, designated SEQ ID:13001, to the nucleotide sequence of VGAM1924 RNA, herein designated VGAM RNA, also designated SEQ ID:4635.

Another function of VGAM1924 is therefore inhibition of Aminopeptidase Puromycin Sensitive (NPEPPS, Accession NM_006310), a gene which is puromycin-sensitive aminopeptidase and has metallopeptidase activity. Accordingly, utilities of VGAM1924 include diagnosis, prevention and treatment of diseases and clinical conditions associated with NPEPPS. The function of NPEPPS and its association with various diseases and clinical conditions, has been established by previous studies, as described hereinabove with reference to VGAM83. Nuclear Receptor Interacting Protein 1 (NRIP1, Accession XM_009699) is another VGAM1924 host target gene. NRIP1 BINDING SITE is HOST TARGET binding site found in the 3' untranslated region of mRNA encoded by NRIP1, corresponding to a HOST TARGET binding site such as BINDING SITE I, BINDING SITE II or BINDING SITE III. Table 2 illustrates the complementarity of the nucleotide sequences of NRIP1 BINDING SITE, designated SEQ ID:30119, to the nucleotide sequence of VGAM1924 RNA, herein designated VGAM RNA, also designated SEQ ID:4635.

Another function of VGAM1924 is therefore inhibition of Nuclear Receptor Interacting Protein 1 (NRIP1, Accession XM_009699), a gene which modulates transcriptional activation by the estrogen receptor. Accordingly, utilities of VGAM1924 include diagnosis, prevention and treatment of diseases and clinical conditions associated with NRIP1. The function of NRIP1 and its association with various diseases and clinical conditions, has been established by previous studies, as described hereinabove with reference to VGAM276. Ornithine Aminotransferase (gyrate atrophy) (OAT, Accession NM_000274) is another VGAM1924 host target gene. OAT BINDING SITE is HOST TARGET binding site found in the 3' untranslated region of mRNA encoded by OAT, corresponding to a HOST TARGET binding site such as BINDING SITE I, BINDING SITE II or BINDING SITE III. Table 2 illustrates the complementarity of the nucleotide sequences of OAT BINDING SITE, designated SEQ ID:5816, to the nucleotide sequence of VGAM1924 RNA, herein designated VGAM RNA, also designated SEQ ID:4635.

Another function of VGAM1924 is therefore inhibition of Ornithine Aminotransferase (gyrate atrophy) (OAT, Accession NM_000274). Accordingly, utilities of VGAM1924 include diagnosis, prevention and treatment of diseases and clinical conditions associated with OAT. Oligophrenin 1 (OPHN1, Accession NM_002547) is another VGAM1924 host target gene. OPHN1 BINDING SITE is HOST TARGET binding site found in the 3' untranslated region of mRNA encoded by OPHN1, corresponding to a HOST TARGET binding site such as BINDING SITE I, BINDING SITE II or BINDING SITE III. Table 2 illustrates the complementarity of the nucleotide sequences of OPHN1 BINDING SITE, designated SEQ ID:8400, to the nucleotide sequence of VGAM1924 RNA, herein designated VGAM RNA, also designated SEQ ID:4635.

Another function of VGAM1924 is therefore inhibition of Oligophrenin 1 (OPHN1, Accession NM_002547). Accordingly, utilities of VGAM1924 include diagnosis, prevention and treatment of diseases and clinical conditions associated with OPHN1. Oncostatin M (OSM, Accession NM_020530) is another VGAM1924 host target gene. OSM BINDING SITE is HOST TARGET binding site found in the 3' untranslated region of mRNA encoded by OSM, corresponding to a HOST TARGET binding site such as BINDING SITE I, BINDING SITE II or BINDING SITE III. Table 2 illustrates the complementarity of the nucleotide sequences of OSM BINDING SITE, designated SEQ ID:21755, to the nucleotide sequence of VGAM1924 RNA, herein designated VGAM RNA, also designated SEQ ID:4635.

Another function of VGAM1924 is therefore inhibition of Oncostatin M (OSM, Accession NM_020530), a gene which inhibits the proliferation of a number of tumor cell lines, caused an acute inflammatory reaction. Accordingly, utilities of VGAM1924 include diagnosis, prevention and treatment of diseases and clinical conditions associated with OSM. The function of OSM and its association with various diseases and clinical conditions, has been established by previous studies, as described hereinabove with reference to VGAM1078. Protocadherin Beta 12 (PCDHB12, Accession NM_018932) is another VGAM1924 host target gene. PCDHB12 BINDING SITE is HOST TARGET binding site found in the 3" untranslated region of mRNA encoded by PCDHB12, corresponding to a HOST TARGET binding site such as BINDING SITE I, BINDING SITE II or BINDING SITE III. Table 2 illustrates the complementarity of the nucleotide sequences of PCDHB12 BINDING SITE, designated SEQ ID:21004, to the nucleotide sequence of VGAM1924 RNA, herein designated VGAM RNA, also designated SEQ ID:4635.

Another function of VGAM1924 is therefore inhibition of Protocadherin Beta 12 (PCDHB12, Accession NM_018932). Accordingly, utilities of VGAM1924 include diagnosis, prevention and treatment of diseases and clinical conditions associated with PCDHB12. Protocadherin Beta 7 (PCDHB7, Accession NM_018940) is another VGAM1924 host target gene. PCDHB7 BINDING SITE1 and PCDHB7 BINDING SITE2 are HOST TARGET binding sites found in untranslated regions of mRNA encoded by PCDHB7, corresponding to HOST TARGET binding sites such as BINDING SITE I, BINDING SITE II or BINDING SITE III. Table 2 illustrates the complementarity of the nucleotide sequences of PCDHB7 BINDING SITE1 and PCDHB7 BINDING SITE2, designated SEQ ID:21006 and SEQ ID:21010 respectively, to the nucleotide sequence of VGAM1924 RNA, herein designated VGAM RNA, also designated SEQ ID:4635.

Another function of VGAM1924 is therefore inhibition of Protocadherin Beta 7 (PCDHB7, Accession NM_018940). Accordingly, utilities of VGAM1924 include diagnosis, prevention and treatment of diseases and clinical conditions associated with PCDHB7. Phosphoprotein Enriched In Astrocytes 15 (PEA15, Accession NM_003768) is another VGAM1924 host target gene. PEA15 BINDING SITE is HOST TARGET binding site found in the 3' untranslated region of mRNA encoded by PEA15, corresponding to a HOST TARGET binding site such as BINDING SITE I, BINDING SITE II or BINDING SITE III. Table 2 illustrates the complementarity of the nucleotide sequences of PEA15 BINDING SITE, designated SEQ ID:9847, to the nucleotide sequence of VGAM1924 RNA, herein designated VGAM RNA, also designated SEQ ID:4635.

Another function of VGAM1924 is therefore inhibition of Phosphoprotein Enriched In Astrocytes 15 (PEA15, Accession NM_003768), a gene which is a phosphoprotein and involved in glucose uptake. Accordingly, utilities of VGAM1924 include diagnosis, prevention and treatment of diseases and clinical conditions associated with PEA15. The function of PEA15 and its association with various diseases and clinical conditions, has been established by previous studies, as described hereinabove with reference to VGAM949. Pleckstrin Homology-like Domain, Family A, Member 3 (PHLDA3, Accession NM_012396) is another VGAM1924 host target gene. PHLDA3 BINDING SITE is HOST TARGET binding site found in the 3' untranslated region of mRNA encoded by PHLDA3, corresponding to a HOST TARGET binding site such as BINDING SITE I, BINDING SITE II or BINDING SITE III. Table 2 illustrates the complementarity of the nucleotide sequences of PHLDA3 BINDING SITE, designated SEQ ID:14759, to the nucleotide sequence of VGAM1924 RNA, herein designated VGAM RNA, also designated SEQ ID:4635.

Another function of VGAM1924 is therefore inhibition of Pleckstrin Homology-like Domain, Family A, Member 3 (PHLDA3, Accession NM_012396). Accordingly, utilities of VGAM1924 include diagnosis, prevention and treatment of diseases and clinical conditions associated with PHLDA3. Protein Phosphatase 1, Regulatory (inhibitor) Subunit 8 (PPP1R8, Accession NM_014110) is another VGAM1924 host target gene. PPP1R8 BINDING SITE1 through PPP1R8 BINDING SITE3 are HOST TARGET binding sites found in untranslated regions of mRNA encoded by PPP1R8, corresponding to HOST TARGET binding sites such as BINDING SITE I, BINDING SITE II or BINDING SITE III. Table 2 illustrates the complementarity of the nucleotide sequences of PPP1R8 BINDING SITE1 through PPP1R8 BINDING SITE3, designated SEQ ID:15341, SEQ ID:8571 and SEQ ID:28857 respectively, to the nucleotide sequence of VGAM1924 RNA, herein designated VGAM RNA, also designated SEQ ID:4635.

Another function of VGAM1924 is therefore inhibition of Protein Phosphatase 1, Regulatory (inhibitor) Subunit 8 (PPP1R8, Accession NM_014110), a gene which is an inhibitor subunit of the major nuclear protein phosphatase-1 (pp-1). Accordingly, utilities of VGAM1924 include diagnosis, prevention and treatment of diseases and clinical conditions associated with PPP1R8. The function of PPP1R8 and its association with various diseases and clinical conditions, has been established by previous studies, as described hereinabove with reference to VGAM101. Protein Kinase, CAMP-dependent, Regulatory, Type I, Alpha (tissue specific extinguisher 1) (PRKAR1A, Accession NM_002734) is another VGAM1924 host target gene. PRKAR1A BINDING SITE is HOST TARGET binding site found in the 3' untranslated region of mRNA encoded by PRKAR1A, corresponding to a HOST TARGET binding site such as BINDING SITE I, BINDING SITE II or BINDING SITE III. Table 2 illustrates the complementarity of the nucleotide sequences of PRKAR1A BINDING SITE, designated SEQ ID:8606, to the nucleotide sequence of VGAM1924 RNA, herein designated VGAM RNA, also designated SEQ ID:4635.

Another function of VGAM1924 is therefore inhibition of Protein Kinase, CAMP-dependent, Regulatory, Type I, Alpha (tissue specific extinguisher 1) (PRKAR1A, Accession NM_002734). Accordingly, utilities of VGAM1924 include diagnosis, prevention and treatment of diseases and clinical conditions associated with PRKAR1A. Phosphoribosyl Pyrophosphate Synthetase 2 (PRPS2, Accession NM_002765) is another VGAM1924 host target gene. PRPS2 BINDING SITE is HOST TARGET binding site found in the 3' untranslated region of mRNA encoded by PRPS2, corresponding to a HOST TARGET binding site such as BINDING SITE I, BINDING SITE II or BINDING SITE III. Table 2 illustrates the complementarity of the nucleotide sequences of PRPS2 BINDING SITE, designated SEQ ID:8656, to the nucleotide sequence of VGAM1924 RNA, herein designated VGAM RNA, also designated SEQ ID:4635.

Another function of VGAM1924 is therefore inhibition of Phosphoribosyl Pyrophosphate Synthetase 2 (PRPS2, Accession NM_002765), a gene which generates the PRPP needed for initiation of purine biosynthesis. Accordingly, utilities of VGAM1924 include diagnosis, prevention and treatment of diseases and clinical conditions associated with PRPS2. The function of PRPS2 and its association with various diseases and clinical conditions, has been established by previous studies, as described hereinabove with reference to VGAM828. PSA (Accession NM_058179) is another VGAM1924 host target gene. PSA BINDING SITE1 and PSA BINDING SITE2 are HOST TARGET binding sites found in untranslated regions of mRNA encoded by PSA, corresponding to HOST TARGET binding sites such as BINDING SITE I, BINDING SITE II or BINDING SITE III. Table 2 illustrates the complementarity of the nucleotide sequences of PSA BINDING SITE1 and PSA BINDING SITE2, designated SEQ ID:27739 and SEQ ID:22130 respectively, to the nucleotide sequence of VGAM1924 RNA, herein designated VGAM RNA, also designated SEQ ID:4635.

Another function of VGAM1924 is therefore inhibition of PSA (Accession NM_058179), a gene which is puromycin-sensitive aminopeptidase and has metallopeptidase activity. Accordingly, utilities of VGAM1924 include diagnosis, prevention and treatment of diseases and clinical conditions associated with PSA. The function of PSA and its association with various diseases and clinical conditions, has been established by previous studies, as described hereinabove with reference to VGAM65. Phosphotriesterase Related (PTER, Accession NM_030664) is another VGAM1924 host target gene. PTER BINDING SITE1 and PTER BINDING SITE2 are HOST TARGET binding sites found in untranslated regions of mRNA encoded by PTER, corresponding to HOST TARGET binding sites such as BINDING SITE I, BINDING SITE II or BINDING SITE III. Table 2 illustrates the complementarity of the nucleotide sequences of PTER BINDING SITE1 and PTER BINDING SITE2, designated SEQ ID:24996 and SEQ ID:24997 respectively, to the nucleotide sequence of VGAM1924 RNA, herein designated VGAM RNA, also designated SEQ ID:4635.

Another function of VGAM1924 is therefore inhibition of Phosphotriesterase Related (PTER, Accession NM_030664), a gene which is a phosphotriesterase homology protein. Accordingly, utilities of VGAM1924 include diagnosis, prevention and treatment of diseases and clinical conditions associated with PTER. The function of PTER and its association with various diseases and clinical conditions, has been established by previous studies, as described hereinabove with reference to VGAM713. Protein Tyrosine Phosphatase, Receptor Type, G (PTPRG, Accession NM_002841) is another VGAM1924 host target gene. PTPRG BINDING SITE is HOST TARGET binding site found in the 5' untranslated region of mRNA encoded by PTPRG, corresponding to a HOST TARGET binding site such as BINDING SITE I, BINDING SITE II or BINDING SITE III. Table 2 illustrates the complementarity of the nucleotide sequences of PTPRG BINDING SITE, designated SEQ ID:8727, to the nucleotide sequence of VGAM1924 RNA, herein designated VGAM RNA, also designated SEQ ID:4635.

Another function of VGAM1924 is therefore inhibition of Protein Tyrosine Phosphatase, Receptor Type, G (PTPRG, Accession NM_002841), a gene which is a candidate tumor suppressor and represents a subfamily of receptor tyrosine phosphatases. Accordingly, utilities of VGAM1924 include diagnosis, prevention and treatment of diseases and clinical conditions associated with PTPRG. The function of PTPRG has been established by previous studies. Changes in the level and pattern of phosphorylation of protein tyrosyl residues are implicated in the control of cellular proliferation. The level of phosphorylation within cells is the result of a balance between the opposing activities of protein-tyrosine kinases and protein-tyrosine phosphatases (PTPs). As more members of the PTP family are cloned, 2 distinct classes have emerged: one class, the cytoplasmic PTPs, are small soluble proteins; the other class, the receptor PTPs, are large transmembrane proteins. Kaplan et al. (1990) cloned 3 human receptor PTP genes. By analysis of rodent-human somatic cell hybrids retaining overlapping subsets of the entire human genome, LaForgia et al. (1991) mapped the PTPG gene to 3p21-p14. By comparison with other genes mapping to that region, they concluded that PTPG is located in band 3p21 centromeric to the 3p breakpoint in a t (3;8) chromosomal translocation. They showed that 1 PTPG allele was lost in 3 of 5 renal carcinoma cell lines and in 5 of 10 lung carcinoma tumor samples tested. PTPG mRNA was expressed in kidney cell lines and lung cell lines but not in several hematopoietic cell lines tested. Thus the PTPG gene appeared to have characteristics suggesting it as a candidate tumor suppressor gene in renal and lung carcinoma. Latif et al. (1993) localized the PTPRG gene to 3p14.2 by fluorescence in situ hybridization. D3S1249, which represents the PTPRG locus, was localized between D3S1187 and D3S1188 at a recombination fraction of 0.022 and 0.025, respectively, by linkage analysis using the CEPH pedigree panel (Tory et al., 1992). Barnea et al. (1993) cloned cDNAs for the human and mouse PTPRG gene (symbolized RPTP-gamma by them) from brain cDNA libraries and analyzed their predicted polypeptide sequences. The human (1,445-amino acid) and mouse (1,442-amino acid) sequences share 95% identity at the amino acid level and predict a putative extracellular domain, a single transmembrane domain, and a cytoplasmic region with 2 tandem catalytic tyrosine phosphatase domains. The extracellular domain contains a stretch of 266 amino acids that are highly similar to the zinc-containing enzyme carbonic anhydrase (OMIM Ref. No. 114800), suggesting that RPTP-gamma and RPTP-beta (PTPRZ; 176891) represent a subfamily of receptor tyrosine phosphatases.

Full details of the abovementioned studies are described in the following publications, the disclosure of which are hereby incorporated by reference:

Barnea, G.; Silvennoinen, O.; Shaanan, B.; Honegger, A. M.; Canoll, P. D.; d'Eustachio, P.; Morse, B.; Levy, J. B.; Laforgia, S.; Huebner, K.; Musacchio, J. M.; Sap, J.; Schlessinger, J.: Identification of a carbonic anhydrase-like domain in the extracellular region of RPTP-gamma defines a new subfamily of receptor tyrosine phosphatases. Molec. Cell. Biol. 13:1497-1506, 1993; and Latif, F.; Tory, K.; Modi, W.; Geil, L.; LaForgia, S.; Huebner, K.; Zbar, B.; Lerman, M. I.: A MspI polymorphism and linkage mapping of the human protein-tyrosine phosphatase G (PTPRG).

Further studies establishing the function and utilities of PTPRG are found in John Hopkins OMIM database record ID 176886, and in sited publications numbered 10580, 10890-1058 and 2450 listed in the bibliography section hereinbelow, which are also hereby incorporated by reference. Protein Tyrosine Phosphatase, Receptor Type, O (PTPRO, Accession NM_002848) is another VGAM1924 host target gene. PTPRO BINDING SITE1 through PTPRO BINDING SITE5 are HOST TARGET binding sites found in untranslated regions of mRNA encoded by PTPRO, corresponding to HOST TARGET binding sites such as BINDING SITE I, BINDING SITE II or BINDING SITE III. Table 2 illustrates the complementarity of the nucleotide sequences of PTPRO BINDING SITE1 through PTPRO BINDING SITE5, designated SEQ ID:8740, SEQ ID:25005, SEQ ID:25013, SEQ ID:25022 and SEQ ID:25033 respectively, to the nucleotide sequence of VGAM1924 RNA, herein designated VGAM RNA, also designated SEQ ID:4635.

Another function of VGAM1924 is therefore inhibition of Protein Tyrosine Phosphatase, Receptor Type, O (PTPRO, Accession NM_002848), a gene which may function as a cell contact receptor that mediates and controls cell-cell signals. Accordingly, utilities of VGAM1924 include diagnosis, prevention and treatment of diseases and clinical conditions associated with PTPRO. The function of PTPRO and its association with various diseases and clinical conditions, has been established by previous studies, as described hereinabove with reference to VGAM140. RGL (Accession NM_015149) is another VGAM1924 host target gene. RGL BINDING SITE is HOST TARGET binding site found in the 3' untranslated region of mRNA encoded by RGL, corresponding to a HOST TARGET binding site such as BINDING SITE I, BINDING SITE II or BINDING SITE III. Table 2 illustrates the complementarity of the nucleotide sequences of RGL BINDING SITE, designated SEQ ID:17506, to the nucleotide sequence of VGAM1924 RNA, herein designated VGAM RNA, also designated SEQ ID:4635.

Another function of VGAM1924 is therefore inhibition of RGL (Accession NM_015149), a gene which is involved in nucleotide exchange factor. Accordingly, utilities of VGAM1924 include diagnosis, prevention and treatment of diseases and clinical conditions associated with RGL. The function of RGL and its association with various diseases and clinical conditions, has been established by previous studies, as described hereinabove with reference to VGAM861. Ribonuclease, RNase A Family, 1 (pancreatic) (RNASE1, Accession XM_033595) is another VGAM1924 host target gene. RNASE1 BINDING SITE is HOST TARGET binding site found in the 5' untranslated region of mRNA encoded by RNASE1, corresponding to a HOST TARGET binding site such as BINDING SITE I, BINDING SITE II or BINDING SITE III. Table 2 illustrates the complementarity of the nucleotide sequences of RNASE1 BINDING SITE, designated SEQ ID:31944, to the nucleotide sequence of VGAM1924 RNA, herein designated VGAM RNA, also designated SEQ ID:4635.

Another function of VGAM1924 is therefore inhibition of Ribonuclease, RNase A Family, 1 (pancreatic) (RNASE1, Accession XM_033595), a gene which is a Pancreatic ribonuclease; a pyrimidine-specific endonuclease that generates 2',3'-cyclic phosphate products. Accordingly, utilities of VGAM1924 include diagnosis, prevention and treatment of diseases and clinical conditions associated with RNASE1. The function of RNASE1 and its association with various diseases and clinical conditions, has been established by previous studies, as described hereinabove with reference to VGAM210. Ring Finger Protein 14 (RNF14, Accession NM_004290) is another VGAM1924 host target gene. RNF14 BINDING SITE is HOST TARGET binding site found in the 3' untranslated region of mRNA encoded by RNF14, corresponding to a HOST TARGET binding site such as BINDING SITE I, BINDING SITE II or BINDING SITE III. Table 2 illustrates the complementarity of the nucleotide sequences of RNF14 BINDING SITE, designated SEQ ID:10504, to the nucleotide sequence of VGAM1924 RNA, herein designated VGAM RNA, also designated SEQ ID:4635.

Another function of VGAM1924 is therefore inhibition of Ring Finger Protein 14 (RNF14, Accession NM_004290), a gene which associates with the androgen receptor (AR); functions as a transcriptional coactivator. Accordingly, utilities of VGAM1924 include diagnosis, prevention and treatment of diseases and clinical conditions associated with RNF14. The function of RNF14 and its association with various diseases and clinical conditions, has been established by previous studies, as described hereinabove with reference to VGAM827. Retinoschisis (X-linked, juvenile) 1 (RS1, Accession NM_000330) is another VGAM1924 host target gene. RS1 BINDING SITE is HOST TARGET binding site found in the 3' untranslated region of mRNA encoded by RS1, corresponding to a HOST TARGET binding site such as BINDING SITE I, BINDING SITE II or BINDING SITE III. Table 2 illustrates the complementarity of the nucleotide sequences of RS1 BINDING SITE, designated SEQ ID:5874, to the nucleotide sequence of VGAM1924 RNA, herein designated VGAM RNA, also designated SEQ ID:4635.

Another function of VGAM1924 is therefore inhibition of Retinoschisis (X-linked, juvenile) 1 (RS1, Accession NM_000330). Accordingly, utilities of VGAM1924 include diagnosis, prevention and treatment of diseases and clinical conditions associated with RS1. Reticulon 1 (RTN1, Accession NM_021136) is another VGAM1924 host target gene. RTN1 BINDING SITE is HOST TARGET binding site found in the 3' untranslated region of mRNA encoded by RTN1, corresponding to a HOST TARGET binding site such as BINDING SITE I, BINDING SITE II or BINDING SITE III. Table 2 illustrates the complementarity of the nucleotide sequences of RTN1 BINDING SITE, designated SEQ ID:22109, to the nucleotide sequence of VGAM1924 RNA, herein designated VGAM RNA, also designated SEQ ID:4635.

Another function of VGAM1924 is therefore inhibition of Reticulon 1 (RTN1, Accession NM_021136), a gene which may be involved in neuroendocrine secretion or in membrane - membrane trafficking in neuroendocrine cells. Accordingly, utilities of VGAM1924 include diagnosis, prevention and treatment of diseases and clinical conditions associated with RTN1. The function of RTN1 and its association with various diseases and clinical conditions, has been established by previous studies, as described hereinabove with reference to VGAM337. Runt-related Transcription Factor 1 (acute myeloid leukemia 1; aml1 oncogene) (RUNX1, Accession NM_001754) is another VGAM1924 host target gene. RUNX1 BINDING SITE is HOST TARGET binding site found in the 3' untranslated region of mRNA encoded by RUNX1, corresponding to a HOST TARGET binding site such as BINDING SITE I, BINDING SITE II or BINDING SITE III. Table 2 illustrates the complementarity of the nucleotide sequences of RUNX1 BINDING SITE, designated SEQ ID:7498, to the nucleotide sequence of VGAM1924 RNA, herein designated VGAM RNA, also designated SEQ ID:4635.

Another function of VGAM1924 is therefore inhibition of Runt-related Transcription Factor 1 (acute myeloid leukemia 1; aml1 oncogene) (RUNX1, Accession NM_001754). Accordingly, utilities of VGAM1924 include diagnosis, prevention and treatment of diseases and clinical conditions associated with RUNX1. Runt-related Transcription Factor 3 (RUNX3, Accession NM_004350) is another VGAM1924 host target gene. RUNX3 BINDING SITE is HOST TARGET binding site found in the 3' untranslated region of mRNA encoded by RUNX3, corresponding to a HOST TARGET binding site such as BINDING SITE I, BINDING SITE II or BINDING SITE III. Table 2 illustrates the complementarity of the nucleotide sequences of RUNX3 BINDING SITE, designated SEQ ID:10549, to the nucleotide sequence of VGAM1924 RNA, herein designated VGAM RNA, also designated SEQ ID:4635.

Another function of VGAM1924 is therefore inhibition of Runt-related Transcription Factor 3 (RUNX3, Accession NM_004350), a gene which binds to the core site, 5'-pygpyggt-3', of a number of enhancers and promoters. Accordingly, utilities of VGAM1924 include diagnosis, prevention and treatment of diseases and clinical conditions associated with RUNX3. The function of RUNX3 and its association with various diseases and clinical conditions, has been established by previous studies, as described hereinabove with reference to VGAM1151. SAR1 (Accession NM_020150) is another VGAM1924 host target gene. SAR1 BINDING SITE is HOST TARGET binding site found in the 3' untranslated region of mRNA encoded by SAR1, corresponding to a HOST TARGET binding site such as BINDING SITE I, BINDING SITE II or BINDING SITE III. Table 2 illustrates the complementarity of the nucleotide sequences of SAR1 BINDING SITE, designated SEQ ID:21353, to the nucleotide sequence of VGAM1924 RNA, herein designated VGAM RNA, also designated SEQ ID:4635.

Another function of VGAM1924 is therefore inhibition of SAR1 (Accession NM_020150), a gene which is involved in transport from the endoplasmic reticulum to the golgi apparatus (by similarity). Accordingly, utilities of VGAM1924 include diagnosis, prevention and treatment of diseases and clinical conditions associated with SAR1. The function of SAR1 and its association with various diseases and clinical conditions, has been established by previous studies, as described hereinabove with reference to VGAM222. Syndecan 4 (amphiglycan, ryudocan) (SDC4, Accession NM_002999) is another VGAM1924 host target gene. SDC4 BINDING SITE is HOST TARGET binding site found in the 3' untranslated region of mRNA encoded by SDC4, corresponding to a HOST TARGET binding site such as BINDING SITE I, BINDING SITE II or BINDING SITE III. Table 2 illustrates the complementarity of the nucleotide sequences of SDC4 BINDING SITE, designated SEQ ID:8893, to the nucleotide sequence of VGAM1924 RNA, herein designated VGAM RNA, also designated SEQ ID:4635.

Another function of VGAM1924 is therefore inhibition of Syndecan 4 (amphiglycan, ryudocan) (SDC4, Accession NM_002999), a gene which is a cell surface proteoglycan. Accordingly, utilities of VGAM1924 include diagnosis, prevention and treatment of diseases and clinical conditions associated with SDC4. The function of SDC4 and its association with various diseases and clinical conditions, has been established by previous studies, as described hereinabove with reference to VGAM552. Serine (or cysteine) Proteinase Inhibitor, Clade B (ovalbumin), Member 13 (SERPINB13, Accession NM_012397) is another VGAM1924 host target gene. SERPINB13 BINDING SITE is HOST TARGET binding site found in the 3' untranslated region of mRNA encoded by SERPINB13, corresponding to a HOST TARGET binding site such as BINDING SITE I, BINDING SITE II or BINDING SITE III. Table 2 illustrates the complementarity of the nucleotide sequences of SERPINB13 BINDING SITE, designated SEQ ID:14762, to the nucleotide sequence of VGAM1924 RNA, herein designated VGAM RNA, also designated SEQ ID:4635.

Another function of VGAM1924 is therefore inhibition of Serine (or cysteine) Proteinase Inhibitor, Clade B (ovalbumin), Member 13 (SERPINB13, Accession NM_012397), a gene which plays a role in the proliferation or differentiation of keratinocytes. Accordingly, utilities of VGAM1924 include diagnosis, prevention and treatment of diseases and clinical conditions associated with SERPINB13. The function of SERPINB13 has been established by previous studies. Abts et al. (1999) reported the cloning and characterization of PI13, a novel keratinocyte-associated member of the ovalbumin (ov) family of serpins showing a predominant expression in cells of the human keratinocyte cell line HaCaT and in lesional keratinocytes from psoriatic skin. Initially identified as a UV-repressible gene in HaCaT cells (Abts et al., 1997), this novel serpin is also called 'HaCaT UV-repressible serpin,' or hurpin. Abts et al. (1999) found that the full-length PI13 cDNA encodes a putative 391-amino acid protein with a predicted molecular mass of approximately 44 kD. PI13 shares nearly 59% amino acid identity with SCCA1 (OMIM Ref. No. 600517) and SCCA2 (OMIM Ref. No. 600518). By differential display RT-PCR of oral cavity squamous epithelium, database searching, and screening a keratinocyte cDNA library, Spring et al. (1999) obtained a cDNA encoding PI13, which they termed headpin. Sequence analysis predicted that the 391-amino acid protein contains an inhibitory serpin hinge region, a reactive site loop near the C terminus, and a penultimate serine residue found in all ov-serpin family members. Northern blot analysis detected a 3.3-kb transcript in normal oral mucosa but not in tumor-derived oral mucosa; no expression was detected in any other tissue tested. Relative RT-PCR analysis confirmed low or undetectable expression in squamous carcinoma and head and neck tumor cell lines compared with normal oral mucosa.

Full details of the abovementioned studies are described in the following publications, the disclosure of which are hereby incorporated by reference:

Abts, H. F.; Welss, T.; Mirmohammadsadegh, A.; Kohrer, K.; Michel, G.; Ruzicka, T.: Cloning and characterization of hurpin (protease inhibitor 13): a new skin-specific, UV-repressible serine proteinase inhibitor of the ovalbumin serpin family. J. Molec. Biol. 293:29-39, 1999; and Spring, P.; Nakashima, T.; Frederick, M.; Henderson, Y.; Clayman, G.: Identification and cDNA cloning of headpin, a novel differentially expressed serpin that maps to chromosome 18q. B.

Further studies establishing the function and utilities of SERPINB13 are found in John Hopkins OMIM database record ID 604445, and in sited publications numbered 1092-1095 listed in the bibliography section hereinbelow, which are also hereby incorporated by reference. Splicing Factor 1 (SF1, Accession NM_004630) is another VGAM1924 host target gene. SF1 BINDING SITE is HOST TARGET binding site found in the 3' untranslated region of mRNA encoded by SF1, corresponding to a HOST TARGET binding site such as BINDING SITE I, BINDING SITE II or BINDING SITE III. Table 2 illustrates the complementarity of the nucleotide sequences of SF1 BINDING SITE, designated SEQ ID:11002, to the nucleotide sequence of VGAM1924 RNA, herein designated VGAM RNA, also designated SEQ ID:4635.

Another function of VGAM1924 is therefore inhibition of Splicing Factor 1 (SF1, Accession NM_004630), a gene which is a transcriptional repressor and splicing factor. Accordingly, utilities of VGAM1924 include diagnosis, prevention and treatment of diseases and clinical conditions associated with SF1. The function of SF1 and its association with various diseases and clinical conditions, has been established by previous studies, as described hereinabove with reference to VGAM934. SH3-domain GRB2-like 2 (SH3GL2, Accession NM_003026) is another VGAM1924 host target gene. SH3GL2 BINDING SITE is HOST TARGET binding site found in the 3' untranslated region of mRNA encoded by SH3GL2, corresponding to a HOST TARGET binding site such as BINDING SITE I, BINDING SITE II or BINDING SITE III. Table 2 illustrates the complementarity of the nucleotide sequences of SH3GL2 BINDING SITE, designated SEQ ID:8968, to the nucleotide sequence of VGAM1924 RNA, herein designated VGAM RNA, also designated SEQ ID:4635.

Another function of VGAM1924 is therefore inhibition of SH3-domain GRB2-like 2 (SH3GL2, Accession NM_003026), a gene which plays a role in synaptic vesicle recycling, in particular in clathrin-mediated vesicle endocytosis. Accordingly, utilities of VGAM1924 include diagnosis, prevention and treatment of diseases and clinical conditions associated with SH3GL2. The function of SH3GL2 and its association with various diseases and clinical conditions, has been established by previous studies, as described hereinabove with reference to VGAM982. Solute Carrier Family 29 (nucleoside transporters), Member 1 (SLC29A1, Accession NM_004955) is another VGAM1924 host target gene. SLC29A1 BINDING SITE is HOST TARGET binding site found in the 3' untranslated region of mRNA encoded by SLC29A1, corresponding to a HOST TARGET binding site such as BINDING SITE I, BINDING SITE II or BINDING SITE III. Table 2 illustrates the complementarity of the nucleotide sequences of SLC29A1 BINDING SITE, designated SEQ ID:11398, to the nucleotide sequence of VGAM1924 RNA, herein designated VGAM RNA, also designated SEQ ID:4635.

Another function of VGAM1924 is therefore inhibition of Solute Carrier Family 29 (nucleoside transporters), Member 1 (SLC29A1, Accession NM_004955), a gene which mediates both influx and efflux of nucleosides across the membrane. Accordingly, utilities of VGAM1924 include diagnosis, prevention and treatment of diseases and clinical conditions associated with SLC29A1. The function of SLC29A1 and its association with various diseases and clinical conditions, has been established by previous studies, as described hereinabove with reference to VGAM1908. Small Nuclear Ribonucleoprotein Polypeptide N (SNRPN, Accession NM_022807) is another VGAM1924 host target gene. SNRPN BINDING SITE1 and SNRPN BINDING SITE2 are HOST TARGET binding sites found in untranslated regions of mRNA encoded by SNRPN, corresponding to HOST TARGET binding sites such as BINDING SITE I, BINDING SITE II or BINDING SITE III. Table 2 illustrates the complementarity of the nucleotide sequences of SNRPN BINDING SITE1 and SNRPN BINDING SITE2, designated SEQ ID:23083 and SEQ ID:23085 respectively, to the nucleotide sequence of VGAM1924 RNA, herein designated VGAM RNA, also designated SEQ ID:4635.

Another function of VGAM1924 is therefore inhibition of Small Nuclear Ribonucleoprotein Polypeptide N (SNRPN, Accession NM_022807), a gene which may be involved in tissue-specific alternative RNA processing events. Accordingly, utilities of VGAM1924 include diagnosis, prevention and treatment of diseases and clinical conditions associated with SNRPN. The function of SNRPN has been established by previous studies. Cattanach et al. (1992) reported observations indicating that maternal duplication of the central part of mouse chromosome 7, where the Snrpn gene is located, causes an imprinting effect that may correspond to PWS. Paternal duplication was not associated with any detectable effect that might correspond with Angelman syndrome (AS; 105830). Mutirangura et al. (1993) constructed a complete YAC contig of the Prader-Willi/Angelman chromosome region and localized the SNRPN gene to specific YACs within the contig. The small nuclear ribonucleoprotein subunit SmN, thought to be involved in splicing of pre-mRNA, is predominantly expressed in brain. The mouse homolog of the SNRPN gene is functionally imprinted in mouse brain, being expressed only from the paternally derived chromosome. Glenn et al. (1993) demonstrated functional imprinting of the human SNRPN gene using RT-PCR. No expression was observed in cultured skin fibroblasts of patients with Prader-Willi syndrome but was found in all patients with Angelman syndrome and in normal controls. Glenn et al. (1993) also demonstrated a parent-specific DNA methylation imprint within intron 5 of the SNRPN gene, which suggested an epigenetic mechanism by which parent-specific expression of this gene might be inherited. Thus, the authors found that the pattern of imprinting fulfills one major criterion for SNRPN being involved in the pathogenesis of PWS. Reed and Leff (1994) characterized a sequence polymorphism within expressed portions of the human SNRPN gene and showed that the SNRPN gene is monoallelically expressed in fetal brain and heart and in adult brain. Analysis of maternal DNA and of SNRPN cDNA confirmed that the maternal allele is not expressed in fetal brain and heart. Thus, maternal imprinting of SNRPN supports the hypothesis that paternal absence of SNRPN is responsible for the PWS phenotype. Kuslich et al. (1999) likewise identified a de novo balanced translocation in a Prader-Willi syndrome patient: (4;15)(q27; q11.2) pat. The breakpoints lay between SNRPN exons 2 and 3. Parental-origin studies indicated that there was no uniparental disomy and no apparent deletion. The patient expressed ZNF127, SNRPN exons 1 and 2, IPW, and PAR1, but did not express either SNRPN exons 3 and 4 or PAR5, as assayed by RT-PCR, of peripheral blood cells. Kuslich et al. (1999) concluded that this patient and that reported by Sun et al. (1996) supported the contention that an intact genomic region and/or transcription of SNRPN exons 2 and 3 play a pivotal role in the manifestations of the major clinical phenotype in PWS. Prader-Willi syndrome and Angelman syndrome are neurogenetic disorders caused by the lack of a paternal or a maternal contribution from human 15q11-q13, respectively. They involve oppositely imprinted genes: the paternally expressed PWS gene (s) and the maternally expressed AS gene. Deletions in the transcription unit of the imprinted SNRPN gene occur in patients who have PWS or Angelman syndrome because of a parental imprint switch failure in this chromosomal domain. It has been suggested that the SNRPN exon 1 region, which is deleted in PWS patients, contains an imprint switch element from which the maternal and paternal epigenotypes of the 15q11-q13 domain originate. Using the model organism Drosophila, Lyko et al. (1998) showed that a fragment from this region can function as a silencer in transgenic flies. Repression was detected specifically from this element and could not be observed with control human sequences. Additional experiments allowed the delineation of the silencer to a fragment of 215 bp containing the SNRPN promoter region. These results provide an additional link between genomic imprinting and an evolutionarily conserved silencing mechanism. Lyko et al. (1998) suggested that the identified element participates in the long-range regulation of the imprinted 15q11-q13 domain or locally represses SNRPN expression from the maternal allele. Animal model experiments lend further support to the function of SNRPN. Cattanach et al. (1992) reported observations indicating that maternal duplication of the central part of mouse chromosome 7, where the Snrpn gene is located, causes an imprinting effect that may correspond to PWS. Paternal duplication was not associated with any detectable effect that might correspond with Angelman syndrome (AS; 105830).

It is appreciated that the abovementioned animal model for SNRPN is acknowledged by those skilled in the art as a scientifically valid animal model, as can be further appreciated from the publications sited hereinbelow.

Full details of the abovementioned studies are described in the following publications, the disclosure of which are hereby incorporated by reference:

Wirth, J.; Back, E.; Huttenhofer, A.; Nothwang, H.-G.; Lich, C.; Gross, S.; Menzel, C,; Schinzel, A.; Kioschis, P.; Tommerup, N.; Ropers, H.-H.; Horsthemke, B.; Buiting, K.: A translocation breakpoint cluster disrupts the newly defined 3-prime end of the SNURF-SNRPN transcription unit on chromosome 15. Hum. Molec. Genet. 10:201-210, 2001; and Sun, Y.; Nicholls, R. D.; Butler, M. G.; Saitoh, S.; Hainline, B. E.; Palmer, C. G.: Breakage in the SNRPN locus in a balanced 46, XY, t (15;19) Prader-Willi syndrome patient. Hum. Molec. Ge.

Further studies establishing the function and utilities of SNRPN are found in John Hopkins OMIM database record ID 182279, and in sited publications numbered 1631, 2993-2994, 4204-2998, 48, 2999-3007, 488 and 12400-12405 listed in the bibliography section hereinbelow, which are also hereby incorporated by reference. Sparc/osteonectin, Cwcv and Kazal-like Domains Proteoglycan (testican) (SPOCK, Accession XM_031696) is another VGAM1924 host target gene. SPOCK BINDING SITE is HOST TARGET binding site found in the 3' untranslated region of mRNA encoded by SPOCK, corresponding to a HOST TARGET binding site such as BINDING SITE I, BINDING SITE II or BINDING SITE III. Table 2 illustrates the complementarity of the nucleotide sequences of SPOCK BINDING SITE, designated SEQ ID:31456, to the nucleotide sequence of VGAM1924 RNA, herein designated VGAM RNA, also designated SEQ ID:4635.

Another function of VGAM1924 is therefore inhibition of Sparc/osteonectin, Cwcv and Kazal-like Domains Proteoglycan (testican) (SPOCK, Accession XM_031696). Accordingly, utilities of VGAM1924 include diagnosis, prevention and treatment of diseases and clinical conditions associated with SPOCK. ST3GALVI (Accession NM_006100) is another VGAM1924 host target gene. ST3GALVI BINDING SITE is HOST TARGET binding site found in the 5' untranslated region of mRNA encoded by ST3GALVI, corresponding to a HOST TARGET binding site such as BINDING SITE I, BINDING SITE II or BINDING SITE III. Table 2 illustrates the complementarity of the nucleotide sequences of ST3GALVI BINDING SITE, designated SEQ ID:12746, to the nucleotide sequence of VGAM1924 RNA, herein designated VGAM RNA, also designated SEQ ID:4635.

Another function of VGAM1924 is therefore inhibition of ST3GALVI (Accession NM_006100), a gene which has a role in synthesis of sialyl-paragloboside. Accordingly, utilities of VGAM1924 include diagnosis, prevention and treatment of diseases and clinical conditions associated with ST3GALVI. The function of ST3GALVI has been established by previous studies. Using mouse St3galv (SIAT9; 604402) as the probe, Okajima et al. (1999) cloned ST3GALVI from a human melanoma cDNA library. The deduced 331-amino acid protein has a calculated molecular mass of about 38 kD. It contains an N-terminal type II transmembrane domain, 2 sialylmotifs, a C-terminal motif conserved among ST3GAL subfamily members, and 6 potential N-linked glycosylation sites. The ST3GALVI protein shares 38%, 34%, and 33% identity with ST3GALIV, ST3GALIII, and mouse St3galv, respectively. Northern blot analysis revealed abundant expression of 1.8- and 3.0-kb transcripts in heart, placenta, and liver, with lower levels in most other tissues tested. Taniguchi et al. (2001) determined that the ST3GALVI gene contains 10 exons and spans more than 62 kb. They identified 2 unique promoter regions corresponding to 2 mRNA species. The promoters have different constellations of putative transcriptional factor-binding sites, and the type-2 mRNA promoter lacks a canonical TATA box found in the type-1 mRNA promoter.

Full details of the abovementioned studies are described in the following publications, the disclosure of which are hereby incorporated by reference:

Okajima, T.; Fukumoto, S.; Miyazaki, H.; Ishida, H.; Kiso, M.; Furukawa, K.; Urano, T.; Furukawa, K.: Molecular cloning of a novel alpha-2,3-sialyl transferase (ST3Gal VI) that sialylates type II lactosamine structures on glycoproteins and glycolipids. J. Biol. Chem. 274:11479-11486, 1999; and Taniguchi, A.; Kaneta, R.; Morishita, K.; Matsumoto, K.: Gene structure and transcriptional regulation of human Gal beta-1,4(3) GlcNac alpha-2,3-sialyl transferase VI (hST3Gal VI) gene.

Further studies establishing the function and utilities of ST3GALVI are found in John Hopkins OMIM database record ID 607156, and in sited publications numbered 557 and 5577 listed in the bibliography section hereinbelow, which are also hereby incorporated by reference. Signal Transducer and Activator of Transcription 3 (acute-phase response factor) (STAT3, Accession NM_003150) is another VGAM1924 host target gene. STAT3 BINDING SITE1 through STAT3 BINDING SITE4 are HOST TARGET binding sites found in untranslated regions of mRNA encoded by STAT3, corresponding to HOST TARGET binding sites such as BINDING SITE I, BINDING SITE II or BINDING SITE III. Table 2 illustrates the complementarity of the nucleotide sequences of STAT3 BINDING SITE1 through STAT3 BINDING SITE4, designated SEQ ID:9123, SEQ ID:9124, SEQ ID:29270 and SEQ ID:29271 respectively, to the nucleotide sequence of VGAM1924 RNA, herein designated VGAM RNA, also designated SEQ ID:4635.

Another function of VGAM1924 is therefore inhibition of Signal Transducer and Activator of Transcription 3 (acute-phase response factor) (STAT3, Accession NM_003150), a gene which carries out a dual function: signal transduction and activation of transcription. Accordingly, utilities of VGAM1924 include diagnosis, prevention and treatment of diseases and clinical conditions associated with STAT3. The function of STAT3 and its association with various diseases and clinical conditions, has been established by previous studies, as described hereinabove with reference to VGAM329. Transient Receptor Potential Cation Channel, Subfamily M, Member 6 (TRPM6, Accession NM_017662) is another VGAM1924 host target gene. TRPM6 BINDING SITE is HOST TARGET binding site found in the 3' untranslated region of mRNA encoded by TRPM6, corresponding to a HOST TARGET binding site such as BINDING SITE I, BINDING SITE II or BINDING SITE III. Table 2 illustrates the complementarity of the nucleotide sequences of TRPM6 BINDING SITE, designated SEQ ID:19202, to the nucleotide sequence of VGAM1924 RNA, herein designated VGAM RNA, also designated SEQ ID:4635.

Another function of VGAM1924 is therefore inhibition of Transient Receptor Potential Cation Channel, Subfamily M, Member 6 (TRPM6, Accession NM_017662), a gene which contains a predicted ion channel domain and a protein kinase domain. Accordingly, utilities of VGAM1924 include diagnosis, prevention and treatment of diseases and clinical conditions associated with TRPM6. The function of TRPM6 and its association with various diseases and clinical conditions, has been established by previous studies, as described hereinabove with reference to VGAM173. Translin (TSN, Accession NM_004622) is another VGAM1924 host target gene. TSN BINDING SITE is HOST TARGET binding site found in the 3' untranslated region of mRNA encoded by TSN, corresponding to a HOST TARGET binding site such as BINDING SITE I, BINDING SITE II or BINDING SITE III. Table 2 illustrates the complementarity of the nucleotide sequences of TSN BINDING SITE, designated SEQ ID:10989, to the nucleotide sequence of VGAM1924 RNA, herein designated VGAM RNA, also designated SEQ ID:4635.

Another function of VGAM1924 is therefore inhibition of Translin (TSN, Accession NM_004622), a gene which is a DNA binding protein and involved in DNA repair, replication, or recombination. Accordingly, utilities of VGAM1924 include diagnosis, prevention and treatment of diseases and clinical conditions associated with TSN. The function of TSN and its association with various diseases and clinical conditions, has been established by previous studies, as described hereinabove with reference to VGAM98. Tetratricopeptide Repeat Domain 3 (TTC3, Accession NM_003316) is another VGAM1924 host target gene. TTC3 BINDING SITE is HOST TARGET binding site found in the 5' untranslated region of mRNA encoded by TTC3, corresponding to a HOST TARGET binding site such as BINDING SITE I, BINDING SITE II or BINDING SITE III. Table 2 illustrates the complementarity of the nucleotide sequences of TTC3 BINDING SITE, designated SEQ ID:9315, to the nucleotide sequence of VGAM1924 RNA, herein designated VGAM RNA, also designated SEQ ID:4635.

Another function of VGAM1924 is therefore inhibition of Tetratricopeptide Repeat Domain 3 (TTC3, Accession NM_003316), a gene which contains tetratricopeptide repeat (TPR) motifs. Accordingly, utilities of VGAM1924 include diagnosis, prevention and treatment of diseases and clinical conditions associated with TTC3. The function of TTC3 and its association with various diseases and clinical conditions, has been established by previous studies, as described hereinabove with reference to VGAM699. UPF3B (Accession NM_080632) is another VGAM1924 host target gene. UPF3B BINDING SITE1 and UPF3B BINDING SITE2 are HOST TARGET binding sites found in untranslated regions of mRNA encoded by UPF3B, corresponding to HOST TARGET binding sites such as BINDING SITE I, BINDING SITE II or BINDING SITE III. Table 2 illustrates the complementarity of the nucleotide sequences of UPF3B BINDING SITE1 and UPF3B BINDING SITE2, designated SEQ ID:27935 and SEQ ID:23274 respectively, to the nucleotide sequence of VGAM1924 RNA, herein designated VGAM RNA, also designated SEQ ID:4635.

Another function of VGAM1924 is therefore inhibition of UPF3B (Accession NM_080632), a gene which facilitates the export of spliced mRNAs and may function as a positive regulator for mannosylphosphate transferase. Accordingly, utilities of VGAM1924 include diagnosis, prevention and treatment of diseases and clinical conditions associated with UPF3B. The function of UPF3B has been established by previous studies. Lykke-Andersen et al. (2000) found that UPF2, UPF3A, and UPF3B were complexed with UPF1 (RENT1; 601430) while in HeLa cell extracts. In intact cells, UPF3A and UPF3B were found to be nucleocytoplasmic shuttling proteins, while UPF2 was perinuclear, and UPF1 was cytoplasmic. UPF3A and UPF3B associated selectively with spliced beta-globin (OMIM Ref. No. 141900) mRNA in vivo, and tethering of any UPF protein to the 3-prime untranslated region of beta-globin mRNA elicited NMD. These data suggested that assembly of a dynamic human UPF complex initiates in the nucleus at mRNA exon-exon junctions and triggers NMD in the cytoplasm when recognized downstream of a translation termination site. By immunoprecipitation and immunoblot analyses of nucleoplasmic fractions, Kim et al. (2001) showed that UPF3A and UPF3B are associated in an RNase-resistant manner with Y14 (RBM8A; 605313), as well as with the mRNA export factors ALY (OMIM Ref. No. 604171) and TAP (NXF1; 602647), in mRNA-protein complexes. UPF3 proteins appeared to bind immediately upstream of exon-exon junctions. Kim et al. (2001) concluded that UPF3 proteins facilitate the export of spliced mRNAs by recruiting mRNA export proteins. They proposed that UPF3 functions in NMD and travels with the mRNA to the cytoplasm, where a leading translating ribosome displaces the UPF3-Y14 complexes from the mRNA.

Full details of the abovementioned studies are described in the following publications, the disclosure of which are hereby incorporated by reference:

Lykke-Andersen, J.; Shu, M.-D.; Steitz, J. A.: Human Upf proteins target an mRNA for nonsense-mediated decay when bound downstream of a termination codon. Cell 103:1121-1131, 2000; and Kim, V. N.; Kataoka, N.; Dreyfuss, G.: Role of the nonsense-mediated decay factor hUpf3 in the splicing-dependent exon-exon junction complex. Science 293:1832-1836, 2001.

Further studies establishing the function and utilities of UPF3B are found in John Hopkins OMIM database record ID 300298, and in sited publications numbered 9142-9145 listed in the bibliography section hereinbelow, which are also hereby incorporated by reference. Tyrosine 3-monooxygenase/tryptophan 5-monooxygenase Activation Protein, Gamma Polypeptide (YWHAG, Accession NM_012479) is another VGAM1924 host target gene. YWHAG BINDING SITE is HOST TARGET binding site found in the 3' untranslated region of mRNA encoded by YWHAG, corresponding to a HOST TARGET binding site such as BINDING SITE I, BINDING SITE II or BINDING SITE III. Table 2 illustrates the complementarity of the nucleotide sequences of YWHAG BINDING SITE, designated SEQ ID:14859, to the nucleotide sequence of VGAM1924 RNA, herein designated VGAM RNA, also designated SEQ ID:4635.

Another function of VGAM1924 is therefore inhibition of Tyrosine 3-monooxygenase/tryptophan 5-monooxygenase Activation Protein, Gamma Polypeptide (YWHAG, Accession NM_012479), a gene which mediates mitogenic signals of PDGF in vascular smooth muscle cells. Accordingly, utilities of VGAM1924 include diagnosis, prevention and treatment of diseases and clinical conditions associated with YWHAG. The function of YWHAG and its association with various diseases and clinical conditions, has been established by previous studies, as described hereinabove with reference to VGAM180. Tyrosine 3-monooxygenase/tryptophan 5-monooxygenase Activation Protein, Zeta Polypeptide (YWHAZ, Accession NM_003406) is another VGAM1924 host target gene. YWHAZ BINDING SITE is HOST TARGET binding site found in the 3' untranslated region of mRNA encoded by YWHAZ, corresponding to a HOST TARGET binding site such as BINDING SITE I, BINDING SITE II or BINDING SITE III. Table 2 illustrates the complementarity of the nucleotide sequences of YWHAZ BINDING SITE, designated SEQ ID:9446, to the nucleotide sequence of VGAM1924 RNA, herein designated VGAM RNA, also designated SEQ ID:4635.

Another function of VGAM1924 is therefore inhibition of Tyrosine 3-monooxygenase/tryptophan 5-monooxygenase Activation Protein, Zeta Polypeptide (YWHAZ, Accession NM_003406), a gene which mediates signal transduction by binding to phosphorylated serine residues on a variety of signaling molecules. Accordingly, utilities of VGAM1924 include diagnosis, prevention and treatment of diseases and clinical conditions associated with YWHAZ. The function of YWHAZ and its association with various diseases and clinical conditions, has been established by previous studies, as described hereinabove with reference to VGAM43. YY1 Transcription Factor (YY1, Accession NM_003403) is another VGAM1924 host target gene. YY1 BINDING SITE is HOST TARGET binding site found in the 3' untranslated region of mRNA encoded by YY1, corresponding to a HOST TARGET binding site such as BINDING SITE I, BINDING SITE II or BINDING SITE III. Table 2 illustrates the complementarity of the nucleotide sequences of YY1 BINDING SITE, designated SEQ ID:9438, to the nucleotide sequence of VGAM1924 RNA, herein designated VGAM RNA, also designated SEQ ID:4635.

Another function of VGAM1924 is therefore inhibition of YY1 Transcription Factor (YY1, Accession NM_003403), a gene which is involved in transcriptional regulation and may play an important role in development and differentiation. Accordingly, utilities of VGAM1924 include diagnosis, prevention and treatment of diseases and clinical conditions associated with YY1. The function of YY1 and its association with various diseases and clinical conditions, has been established by previous studies, as described hereinabove with reference to VGAM1032. Zinc Finger Protein 103 Homolog (mouse) (ZFP103, Accession NM_005667) is another VGAM1924 host target gene. ZFP103 BINDING SITE is HOST TARGET binding site found in the 5' untranslated region of mRNA encoded by ZFP103, corresponding to a HOST TARGET binding site such as BINDING SITE I, BINDING SITE II or BINDING SITE III. Table 2 illustrates the complementarity of the nucleotide sequences of ZFP103 BINDING SITE, designated SEQ ID:12219, to the nucleotide sequence of VGAM1924 RNA, herein designated VGAM RNA, also designated SEQ ID:4635.

Another function of VGAM1924 is therefore inhibition of Zinc Finger Protein 103 Homolog (mouse) (ZFP103, Accession NM_005667). Accordingly, utilities of VGAM1924 include diagnosis, prevention and treatment of diseases and clinical conditions associated with ZFP103. Zinc Finger Protein 135 (clone pHZ-17) (ZNF135, Accession NM_003436) is another VGAM1924 host target gene. ZNF135 BINDING SITE is HOST TARGET binding site found in the 3' untranslated region of mRNA encoded by ZNF135, corresponding to a HOST TARGET binding site such as BINDING SITE I, BINDING SITE II or BINDING SITE III. Table 2 illustrates the complementarity of the nucleotide sequences of ZNF135 BINDING SITE, designated SEQ ID:9491, to the nucleotide sequence of VGAM1924 RNA, herein designated VGAM RNA, also designated SEQ ID:4635.

Another function of VGAM1924 is therefore inhibition of Zinc Finger Protein 135 (clone pHZ-17) (ZNF135, Accession NM_003436). Accordingly, utilities of VGAM1924 include diagnosis, prevention and treatment of diseases and clinical conditions associated with ZNF135. Zinc Finger Protein 264 (ZNF264, Accession NM_003417) is another VGAM1924 host target gene. ZNF264 BINDING SITE is HOST TARGET binding site found in the 3' untranslated region of mRNA encoded by ZNF264, corresponding to a HOST TARGET binding site such as BINDING SITE I, BINDING SITE II or BINDING SITE III. Table 2 illustrates the complementarity of the nucleotide sequences of ZNF264 BINDING SITE, designated SEQ ID:9456, to the nucleotide sequence of VGAM1924 RNA, herein designated VGAM RNA, also designated SEQ ID:4635.

Another function of VGAM1924 is therefore inhibition of Zinc Finger Protein 264 (ZNF264, Accession NM_003417). Accordingly, utilities of VGAM1924 include diagnosis, prevention and treatment of diseases and clinical conditions associated with ZNF264. AF311304 (Accession NM_031214) is another VGAM1924 host target gene. AF311304 BINDING SITE is HOST TARGET binding site found in the 3' untranslated region of mRNA encoded by AF311304, corresponding to a HOST TARGET binding site such as BINDING SITE I, BINDING SITE II or BINDING SITE III. Table 2 illustrates the complementarity of the nucleotide sequences of AF311304 BINDING SITE, designated SEQ ID:25261, to the nucleotide sequence of VGAM1924 RNA, herein designated VGAM RNA, also designated SEQ ID:4635.

Another function of VGAM1924 is therefore inhibition of AF311304 (Accession NM_031214). Accordingly, utilities of VGAM1924 include diagnosis, prevention and treatment of diseases and clinical conditions associated with AF311304. A Kinase (PRKA) Anchor Protein 11 (AKAP11, Accession NM_016248) is another VGAM1924 host target gene. AKAP11 BINDING SITE is HOST TARGET binding site found in the 3' untranslated region of mRNA encoded by AKAP11, corresponding to a HOST TARGET binding site such as BINDING SITE I, BINDING SITE II or BINDING SITE III. Table 2 illustrates the complementarity of the nucleotide sequences of AKAP11 BINDING SITE, designated SEQ ID:18370, to the nucleotide sequence of VGAM1924 RNA, herein designated VGAM RNA, also designated SEQ ID:4635.

Another function of VGAM1924 is therefore inhibition of A Kinase (PRKA) Anchor Protein 11 (AKAP11, Accession NM_016248). Accordingly, utilities of VGAM1924 include diagnosis, prevention and treatment of diseases and clinical conditions associated with AKAP11. A Kinase (PRKA) Anchor Protein 5 (AKAP5, Accession NM_004857) is another VGAM1924 host target gene. AKAP5 BINDING SITE is HOST TARGET binding site found in the 5' untranslated region of mRNA encoded by AKAP5, corresponding to a HOST TARGET binding site such as BINDING SITE I, BINDING SITE II or BINDING SITE III. Table 2 illustrates the complementarity of the nucleotide sequences of AKAP5 BINDING SITE, designated SEQ ID:11266, to the nucleotide sequence of VGAM1924 RNA, herein designated VGAM RNA, also designated SEQ ID:4635.

Another function of VGAM1924 is therefore inhibition of A Kinase (PRKA) Anchor Protein 5 (AKAP5, Accession NM_004857). Accordingly, utilities of VGAM1924 include diagnosis, prevention and treatment of diseases and clinical conditions associated with AKAP5. Amyotrophic Lateral Sclerosis 2 (juvenile) Chromosome Region, Candidate 3 (ALS2CR3, Accession NM_015049) is another VGAM1924 host target gene. ALS2CR3 BINDING SITE is HOST TARGET binding site found in the 3" untranslated region of mRNA encoded by ALS2CR3, corresponding to a HOST TARGET binding site such as BINDING SITE I, BINDING SITE II or BINDING SITE III. Table 2 illustrates the complementarity of the nucleotide sequences of ALS2CR3 BINDING SITE, designated SEQ ID:17413, to the nucleotide sequence of VGAM1924 RNA, herein designated VGAM RNA, also designated SEQ ID:4635.

Another function of VGAM1924 is therefore inhibition of Amyotrophic Lateral Sclerosis 2 (juvenile) Chromosome Region, Candidate 3 (ALS2CR3, Accession NM_015049). Accordingly, utilities of VGAM1924 include diagnosis, prevention and treatment of diseases and clinical conditions associated with ALS2CR3. ARAP3 (Accession NM_022481) is another VGAM1924 host target gene. ARAP3 BINDING SITE is HOST TARGET binding site found in the 5' untranslated region of mRNA encoded by ARAP3, corresponding to a HOST TARGET binding site such as BINDING SITE I, BINDING SITE II or BINDING SITE III. Table 2 illustrates the complementarity of the nucleotide sequences of ARAP3 BINDING SITE, designated SEQ ID:22855, to the nucleotide sequence of VGAM1924 RNA, herein designated VGAM RNA, also designated SEQ ID:4635.

Another function of VGAM1924 is therefore inhibition of ARAP3 (Accession NM_022481). Accordingly, utilities of VGAM1924 include diagnosis, prevention and treatment of diseases and clinical conditions associated with ARAP3. ARTS-1 (Accession NM_016442) is another VGAM1924 host target gene. ARTS-1 BINDING SITE is HOST TARGET binding site found in the 3' untranslated region of mRNA encoded by ARTS-1, corresponding to a HOST TARGET binding site such as BINDING SITE I, BINDING SITE II or BINDING SITE III. Table 2 illustrates the complementarity of the nucleotide sequences of ARTS-1 BINDING SITE, designated SEQ ID:18563, to the nucleotide sequence of VGAM1924 RNA, herein designated VGAM RNA, also designated SEQ ID:4635.

Another function of VGAM1924 is therefore inhibition of ARTS-1 (Accession NM_016442). Accordingly, utilities of VGAM1924 include diagnosis, prevention and treatment of diseases and clinical conditions associated with ARTS-1. ATPase, (Na+)/K+ Transporting, Beta 4 Polypeptide (ATP1B4, Accession NM_012069) is another VGAM1924 host target gene. ATP1B4 BINDING SITE is HOST TARGET binding site found in the 3' untranslated region of mRNA encoded by ATP1B4, corresponding to a HOST TARGET binding site such as BINDING SITE I, BINDING SITE II or BINDING SITE III. Table 2 illustrates the complementarity of the nucleotide sequences of ATP1B4 BINDING SITE, designated SEQ ID:14326, to the nucleotide sequence of VGAM1924 RNA, herein designated VGAM RNA, also designated SEQ ID:4635.

Another function of VGAM1924 is therefore inhibition of ATPase, (Na+)/K+ Transporting, Beta 4 Polypeptide (ATP1B4, Accession NM_012069). Accordingly, utilities of VGAM1924 include diagnosis, prevention and treatment of diseases and clinical conditions associated with ATP1B4. ATPase, Class II, Type 9A (ATP9A, Accession XM_030577) is another VGAM1924 host target gene. ATP9A BINDING SITE is HOST TARGET binding site found in the 3' untranslated region of mRNA encoded by ATP9A, corresponding to a HOST TARGET binding site such as BINDING SITE I, BINDING SITE II or BINDING SITE III. Table 2 illustrates the complementarity of the nucleotide sequences of ATP9A BINDING SITE, designated SEQ ID:31082, to the nucleotide sequence of VGAM1924 RNA, herein designated VGAM RNA, also designated SEQ ID:4635.

Another function of VGAM1924 is therefore inhibition of ATPase, Class II, Type 9A (ATP9A, Accession XM_030577). Accordingly, utilities of VGAM1924 include diagnosis, prevention and treatment of diseases and clinical conditions associated with ATP9A. BCAA (Accession NM_016374) is another VGAM1924 host target gene. BCAA BINDING SITE is HOST TARGET binding site found in the 3' untranslated region of mRNA encoded by BCAA, corresponding to a HOST TARGET binding site such as BINDING SITE I, BINDING SITE II or BINDING SITE III. Table 2 illustrates the complementarity of the nucleotide sequences of BCAA BINDING SITE, designated SEQ ID:18511, to the nucleotide sequence of VGAM1924 RNA, herein designated VGAM RNA, also designated SEQ ID:4635.

Another function of VGAM1924 is therefore inhibition of BCAA (Accession NM_016374). Accordingly, utilities of VGAM1924 include diagnosis, prevention and treatment of diseases and clinical conditions associated with BCAA. Basic, Immunoglobulin-like Variable Motif Containing (BIVM, Accession NM_017693) is another VGAM1924 host target gene. BIVM BINDING SITE is HOST TARGET binding site found in the 3' untranslated region of mRNA encoded by BIVM, corresponding to a HOST TARGET binding site such as BINDING SITE I, BINDING SITE II or BINDING SITE III. Table 2 illustrates the complementarity of the nucleotide sequences of BIVM BINDING SITE, designated SEQ ID:19254, to the nucleotide sequence of VGAM1924 RNA, herein designated VGAM RNA, also designated SEQ ID:4635.

Another function of VGAM1924 is therefore inhibition of Basic, Immunoglobulin-like Variable Motif Containing (BIVM, Accession NM_017693). Accordingly, utilities of VGAM1924 include diagnosis, prevention and treatment of diseases and clinical conditions associated with BIVM. BS69 (Accession NM_006624) is another VGAM1924 host target gene. BS69 BINDING SITE is HOST TARGET binding site found in the 3' untranslated region of mRNA encoded by BS69, corresponding to a HOST TARGET binding site such as BINDING SITE I, BINDING SITE II or BINDING SITE III. Table 2 illustrates the complementarity of the nucleotide sequences of BS69 BINDING SITE, designated SEQ ID:13408, to the nucleotide sequence of VGAM1924 RNA, herein designated VGAM RNA, also designated SEQ ID:4635.

Another function of VGAM1924 is therefore inhibition of BS69 (Accession NM_006624). Accordingly, utilities of VGAM1924 include diagnosis, prevention and treatment of diseases and clinical conditions associated with BS69. Chromosome 11 Open Reading Frame 25 (C11orf25, Accession NM_031418) is another VGAM1924 host target gene. C11orf25 BINDING SITE is HOST TARGET binding site found in the 5' untranslated region of mRNA encoded by C11orf25, corresponding to a HOST TARGET binding site such as BINDING SITE I, BINDING SITE II or BINDING SITE III. Table 2 illustrates the complementarity of the nucleotide sequences of C11orf25 BINDING SITE, designated SEQ ID:25403, to the nucleotide sequence of VGAM1924 RNA, herein designated VGAM RNA, also designated SEQ ID:4635.

Another function of VGAM1924 is therefore inhibition of Chromosome 11 Open Reading Frame 25 (C11orf25, Accession NM_031418). Accordingly, utilities of VGAM1924 include diagnosis, prevention and treatment of diseases and clinical conditions associated with C11orf25. Chromosome 1 Open Reading Frame 16 (C1orf16, Accession NM_014837) is another VGAM1924 host target gene. C1orf16 BINDING SITE is HOST TARGET binding site found in the 3' untranslated region of mRNA encoded by C1orf16, corresponding to a HOST TARGET binding site such as BINDING SITE I, BINDING SITE II or BINDING SITE III. Table 2 illustrates the complementarity of the nucleotide sequences of C1orf16 BINDING SITE, designated SEQ ID:16856, to the nucleotide sequence of VGAM1924 RNA, herein designated VGAM RNA, also designated SEQ ID:4635.

Another function of VGAM1924 is therefore inhibition of Chromosome 1 Open Reading Frame 16 (C1orf16, Accession NM_014837). Accordingly, utilities of VGAM1924 include diagnosis, prevention and treatment of diseases and clinical conditions associated with C1orf16. Chromosome 1 Open Reading Frame 24 (C1orf24, Accession NM_052966) is another VGAM1924 host target gene. C1orf24 BINDING SITE is HOST TARGET binding site found in the 3' untranslated region of mRNA encoded by C1orf24, corresponding to a HOST TARGET binding site such as BINDING SITE I, BINDING SITE II or BINDING SITE III. Table 2 illustrates the complementarity of the nucleotide sequences of C1orf24 BINDING SITE, designated SEQ ID:27530, to the nucleotide sequence of VGAM1924 RNA, herein designated VGAM RNA, also designated SEQ ID:4635.

Another function of VGAM1924 is therefore inhibition of Chromosome 1 Open Reading Frame 24 (C1orf24, Accession NM_052966). Accordingly, utilities of VGAM1924 include diagnosis, prevention and treatment of diseases and clinical conditions associated with C1orf24. C1q and Tumor Necrosis Factor Related Protein 6 (C1QTNF6, Accession NM_031910) is another VGAM1924 host target gene. C1QTNF6 BINDING SITE is HOST TARGET binding site found in the 3" untranslated region of mRNA encoded by C1QTNF6, corresponding to a HOST TARGET binding site such as BINDING SITE I, BINDING SITE II or BINDING SITE III. Table 2 illustrates the complementarity of the nucleotide sequences of C1QTNF6 BINDING SITE, designated SEQ ID:25659, to the nucleotide sequence of VGAM1924 RNA, herein designated VGAM RNA, also designated SEQ ID:4635.

Another function of VGAM1924 is therefore inhibition of C1q and Tumor Necrosis Factor Related Protein 6 (C1QTNF6, Accession NM_031910). Accordingly, utilities of VGAM1924 include diagnosis, prevention and treatment of diseases and clinical conditions associated with C1QTNF6. Chromosome 20 Open Reading Frame 142 (C20orf142, Accession XM_059257) is another VGAM1924 host target gene. C20orf142 BINDING SITE is HOST TARGET binding site found in the 3" untranslated region of mRNA encoded by C20orf142, corresponding to a HOST TARGET binding site such as BINDING SITE I, BINDING SITE II or BINDING SITE III. Table 2 illustrates the complementarity of the nucleotide sequences of C20orf142 BINDING SITE, designated SEQ ID:36933, to the nucleotide sequence of VGAM1924 RNA, herein designated VGAM RNA, also designated SEQ ID:4635.

Another function of VGAM1924 is therefore inhibition of Chromosome 20 Open Reading Frame 142 (C20orf142, Accession XM_059257). Accordingly, utilities of VGAM1924 include diagnosis, prevention and treatment of diseases and clinical conditions associated with C20orf142. Chromosome 20 Open Reading Frame 36 (C20orf36, Accession NM_018257) is another VGAM1924 host target gene. C20orf36 BINDING SITE is HOST TARGET binding site found in the 3' untranslated region of mRNA encoded by C20orf36, corresponding to a HOST TARGET binding site such as BINDING SITE I, BINDING SITE II or BINDING SITE III. Table 2 illustrates the complementarity of the nucleotide sequences of C20orf36 BINDING SITE, designated SEQ ID:20224, to the nucleotide sequence of VGAM1924 RNA, herein designated VGAM RNA, also designated SEQ ID:4635.

Another function of VGAM1924 is therefore inhibition of Chromosome 20 Open Reading Frame 36 (C20orf36, Accession NM_018257). Accordingly, utilities of VGAM1924 include diagnosis, prevention and treatment of diseases and clinical conditions associated with C20orf36. Chromosome 20 Open Reading Frame 55 (C20orf55, Accession NM_031424) is another VGAM1924 host target gene. C20orf55 BINDING SITE is HOST TARGET binding site found in the 5' untranslated region of mRNA encoded by C20orf55, corresponding to a HOST TARGET binding site such as BINDING SITE I, BINDING SITE II or BINDING SITE III. Table 2 illustrates the complementarity of the nucleotide sequences of C20orf55 BINDING SITE, designated SEQ ID:25407, to the nucleotide sequence of VGAM1924 RNA, herein designated VGAM RNA, also designated SEQ ID:4635.

Another function of VGAM1924 is therefore inhibition of Chromosome 20 Open Reading Frame 55 (C20orf55, Accession NM_031424). Accordingly, utilities of VGAM1924 include diagnosis, prevention and treatment of diseases and clinical conditions associated with C20orf55. Calcium Binding Atopy-related Autoantigen 1 (CBARA1, Accession NM_006077) is another VGAM1924 host target gene. CBARA1 BINDING SITE is HOST TARGET binding site found in the 3' untranslated region of mRNA encoded by CBARA1, corresponding to a HOST TARGET binding site such as BINDING SITE I, BINDING SITE II or BINDING SITE III. Table 2 illustrates the complementarity of the nucleotide sequences of CBARA1 BINDING SITE, designated SEQ ID:12722, to the nucleotide sequence of VGAM1924 RNA, herein designated VGAM RNA, also designated SEQ ID:4635.

Another function of VGAM1924 is therefore inhibition of Calcium Binding Atopy-related Autoantigen 1 (CBARA1, Accession NM_006077). Accordingly, utilities of VGAM1924 include diagnosis, prevention and treatment of diseases and clinical conditions associated with CBARA1. Chemokine (C-C motif) Receptor 6 (CCR6, Accession NM_031409) is another VGAM1924 host target gene. CCR6 BINDING SITE is HOST TARGET binding site found in the 5' untranslated region of mRNA encoded by CCR6, corresponding to a HOST TARGET binding site such as BINDING SITE I, BINDING SITE II or BINDING SITE III. Table 2 illustrates the complementarity of the nucleotide sequences of CCR6 BINDING SITE, designated SEQ ID:25378, to the nucleotide sequence of VGAM1924 RNA, herein designated VGAM RNA, also designated SEQ ID:4635.

Another function of VGAM1924 is therefore inhibition of Chemokine (C-C motif) Receptor 6 (CCR6, Accession NM_031409). Accordingly, utilities of VGAM1924 include diagnosis, prevention and treatment of diseases and clinical conditions associated with CCR6. Cat Eye Syndrome Chromosome Region, Candidate 1 (CECR1, Accession NM_017424) is another VGAM1924 host target gene. CECR1 BINDING SITE is HOST TARGET binding site found in the 3' untranslated region of mRNA encoded by CECR1, corresponding to a HOST TARGET binding site such as BINDING SITE I, BINDING SITE II or BINDING SITE III. Table 2 illustrates the complementarity of the nucleotide sequences of CECR1 BINDING SITE, designated SEQ ID:18882, to the nucleotide sequence of VGAM1924 RNA, herein designated VGAM RNA, also designated SEQ ID:4635.

Another function of VGAM1924 is therefore inhibition of Cat Eye Syndrome Chromosome Region, Candidate 1 (CECR1, Accession NM_017424). Accordingly, utilities of VGAM1924 include diagnosis, prevention and treatment of diseases and clinical conditions associated with CECR1. CGI-127 (Accession NM_016061) is another VGAM1924 host target gene. CGI-127 BINDING SITE is HOST TARGET binding site found in the 3' untranslated region of mRNA encoded by CGI-127, corresponding to a HOST TARGET binding site such as BINDING SITE I, BINDING SITE II or BINDING SITE III. Table 2 illustrates the complementarity of the nucleotide sequences of CGI-127 BINDING SITE, designated SEQ ID:18137, to the nucleotide sequence of VGAM1924 RNA, herein designated VGAM RNA, also designated SEQ ID:4635.

Another function of VGAM1924 is therefore inhibition of CGI-127 (Accession NM_016061). Accordingly, utilities of VGAM1924 include diagnosis, prevention and treatment of diseases and clinical conditions associated with CGI-127. CIP29 (Accession NM_032364) is another VGAM1924 host target gene. CIP29 BINDING SITE is HOST TARGET binding site found in the 3' untranslated region of mRNA encoded by CIP29, corresponding to a HOST TARGET binding site such as BINDING SITE I, BINDING SITE II or BINDING SITE III. Table 2 illustrates the complementarity of the nucleotide sequences of CIP29 BINDING SITE, designated SEQ ID:26149, to the nucleotide sequence of VGAM1924 RNA, herein designated VGAM RNA, also designated SEQ ID:4635.

Another function of VGAM1924 is therefore inhibition of CIP29 (Accession NM_032364). Accordingly, utilities of VGAM1924 include diagnosis, prevention and treatment of diseases and clinical conditions associated with CIP29. Cyclin M4 (CNNM4, Accession NM_020184) is another VGAM1924 host target gene. CNNM4 BINDING SITE is HOST TARGET binding site found in the 3' untranslated region of mRNA encoded by CNNM4, corresponding to a HOST TARGET binding site such as BINDING SITE I, BINDING SITE II or BINDING SITE III. Table 2 illustrates the complementarity of the nucleotide sequences of CNNM4 BINDING SITE, designated SEQ ID:21426, to the nucleotide sequence of VGAM1924 RNA, herein designated VGAM RNA, also designated SEQ ID:4635.

Another function of VGAM1924 is therefore inhibition of Cyclin M4 (CNNM4, Accession NM_020184). Accordingly, utilities of VGAM1924 include diagnosis, prevention and treatment of diseases and clinical conditions associated with CNNM4. CCR4-NOT Transcription Complex, Subunit 8 (CNOT8, Accession NM_004779) is another VGAM1924 host target gene. CNOT8 BINDING SITE is HOST TARGET binding site found in the 3' untranslated region of mRNA encoded by CNOT8, corresponding to a HOST TARGET binding site such as BINDING SITE I, BINDING SITE II or BINDING SITE III. Table 2 illustrates the complementarity of the nucleotide sequences of CNOT8 BINDING SITE, designated SEQ ID:11182, to the nucleotide sequence of VGAM1924 RNA, herein designated VGAM RNA, also designated SEQ ID:4635.

Another function of VGAM1924 is therefore inhibition of CCR4-NOT Transcription Complex, Subunit 8 (CNOT8, Accession NM_004779). Accordingly, utilities of VGAM1924 include diagnosis, prevention and treatment of diseases and clinical conditions associated with CNOT8. Collectin Sub-family Member 12 (COLEC12, Accession NM_030781) is another VGAM1924 host target gene. COLEC12 BINDING SITE is HOST TARGET binding site found in the 3' untranslated region of mRNA encoded by COLEC12, corresponding to a HOST TARGET binding site such as BINDING SITE I, BINDING SITE II or BINDING SITE III. Table 2 illustrates the complementarity of the nucleotide sequences of COLEC12 BINDING SITE, designated SEQ ID:25072, to the nucleotide sequence of VGAM1924 RNA, herein designated VGAM RNA, also designated SEQ ID:4635.

Another function of VGAM1924 is therefore inhibition of Collectin Sub-family Member 12 (COLEC12, Accession NM_030781). Accordingly, utilities of VGAM1924 include diagnosis, prevention and treatment of diseases and clinical conditions associated with COLEC12. COP9 Constitutive Photomorphogenic Homolog Subunit 7B (Arabidopsis) (COPS7B, Accession NM_022730) is another VGAM1924 host target gene. COPS7B BINDING SITE is HOST TARGET binding site found in the 3' untranslated region of mRNA encoded by COPS7B, corresponding to a HOST TARGET binding site such as BINDING SITE I, BINDING SITE II or BINDING SITE III. Table 2 illustrates the complementarity of the nucleotide sequences of COPS7B BINDING SITE, designated SEQ ID:22934, to the nucleotide sequence of VGAM1924 RNA, herein designated VGAM RNA, also designated SEQ ID:4635.

Another function of VGAM1924 is therefore inhibition of COP9 Constitutive Photomorphogenic Homolog Subunit 7B (Arabidopsis) (COPS7B, Accession NM_022730). Accordingly, utilities of VGAM1924 include diagnosis, prevention and treatment of diseases and clinical conditions associated with COPS7B. CCCTC-binding Factor (zinc finger protein) (CTCF, Accession NM_006565) is another VGAM1924 host target gene. CTCF BINDING SITE is HOST TARGET binding site found in the 3' untranslated region of mRNA encoded by CTCF, corresponding to a HOST TARGET binding site such as BINDING SITE I, BINDING SITE II or BINDING SITE III. Table 2 illustrates the complementarity of the nucleotide sequences of CTCF BINDING SITE, designated SEQ ID:13335, to the nucleotide sequence of VGAM1924 RNA, herein designated VGAM RNA, also designated SEQ ID:4635.

Another function of VGAM1924 is therefore inhibition of CCCTC-binding Factor (zinc finger protein) (CTCF, Accession NM_006565). Accordingly, utilities of VGAM1924 include diagnosis, prevention and treatment of diseases and clinical conditions associated with CTCF. Chromosome Y Open Reading Frame 15B (CYorf15B, Accession NM_032576) is another VGAM1924 host target gene. CYorf15B BINDING SITE is HOST TARGET binding site found in the 5' untranslated region of mRNA encoded by CYorf15B, corresponding to a HOST TARGET binding site such as BINDING SITE I, BINDING SITE II or BINDING SITE III. Table 2 illustrates the complementarity of the nucleotide sequences of CYorf15B BINDING SITE, designated SEQ ID:26304, to the nucleotide sequence of VGAM1924 RNA, herein designated VGAM RNA, also designated SEQ ID:4635.

Another function of VGAM1924 is therefore inhibition of Chromosome Y Open Reading Frame 15B (CYorf15B, Accession NM_032576). Accordingly, utilities of VGAM1924 include diagnosis, prevention and treatment of diseases and clinical conditions associated with CYorf15B. DDM36 (Accession NM_020962) is another VGAM1924 host target gene. DDM36 BINDING SITE is HOST TARGET binding site found in the 3' untranslated region of mRNA encoded by DDM36, corresponding to a HOST TARGET binding site such as BINDING SITE I, BINDING SITE II or BINDING SITE III. Table 2 illustrates the complementarity of the nucleotide sequences of DDM36 BINDING SITE, designated SEQ ID:21956, to the nucleotide sequence of VGAM1924 RNA, herein designated VGAM RNA, also designated SEQ ID:4635.

Another function of VGAM1924 is therefore inhibition of DDM36 (Accession NM_020962). Accordingly, utilities of VGAM1924 include diagnosis, prevention and treatment of diseases and clinical conditions associated with DDM36. DEAD/H (Asp-Glu-Ala-Asp/His) Box Polypeptide 18 (Myc-regulated) (DDX18, Accession NM_006773) is another VGAM1924 host target gene. DDX18 BINDING SITE is HOST TARGET binding site found in the 3' untranslated region of mRNA encoded by DDX18, corresponding to a HOST TARGET binding site such as BINDING SITE I, BINDING SITE II or BINDING SITE III. Table 2 illustrates the complementarity of the nucleotide sequences of DDX18 BINDING SITE, designated SEQ ID:13646, to the nucleotide sequence of VGAM1924 RNA, herein designated VGAM RNA, also designated SEQ ID:4635.

Another function of VGAM1924 is therefore inhibition of DEAD/H (Asp-Glu-Ala-Asp/His) Box Polypeptide 18 (Myc-regulated) (DDX18, Accession NM_006773). Accordingly, utilities of VGAM1924 include diagnosis, prevention and treatment of diseases and clinical conditions associated with DDX18. DiGeorge Syndrome Critical Region Gene 8 (DGCR8, Accession NM_022720) is another VGAM1924 host target gene. DGCR8 BINDING SITE is HOST TARGET binding site found in the 5' untranslated region of mRNA encoded by DGCR8, corresponding to a HOST TARGET binding site such as BINDING SITE I, BINDING SITE II or BINDING SITE III. Table 2 illustrates the complementarity of the nucleotide sequences of DGCR8 BINDING SITE, designated SEQ ID:22920, to the nucleotide sequence of VGAM1924 RNA, herein designated VGAM RNA, also designated SEQ ID:4635.

Another function of VGAM1924 is therefore inhibition of DiGeorge Syndrome Critical Region Gene 8 (DGCR8, Accession NM_022720). Accordingly, utilities of VGAM1924 include diagnosis, prevention and treatment of diseases and clinical conditions associated with DGCR8. dJ309H15.1 (Accession NM_138574) is another VGAM1924 host target gene. dJ309H15.1 BINDING SITE is HOST TARGET binding site found in the 3" untranslated region of mRNA encoded by dJ309H15.1, corresponding to a HOST TARGET binding site such as BINDING SITE I, BINDING SITE II or BINDING SITE III. Table 2 illustrates the complementarity of the nucleotide sequences of dJ309H15.1 BINDING SITE, designated SEQ ID:28888, to the nucleotide sequence of VGAM1924 RNA, herein designated VGAM RNA, also designated SEQ ID:4635.

Another function of VGAM1924 is therefore inhibition of dJ309H15.1 (Accession NM_138574). Accordingly, utilities of VGAM1924 include diagnosis, prevention and treatment of diseases and clinical conditions associated with dJ309H15.1. DKFZp434D177 (Accession XM_086586) is another VGAM1924 host target gene. DKFZp434D177 BINDING SITE is HOST TARGET binding site found in the 5' untranslated region of mRNA encoded by DKFZp434D177, corresponding to a HOST TARGET binding site such as BINDING SITE I, BINDING SITE II or BINDING SITE III. Table 2 illustrates the complementarity of the nucleotide sequences of DKFZp434D177 BINDING SITE, designated SEQ ID:38779, to the nucleotide sequence of VGAM1924 RNA, herein designated VGAM RNA, also designated SEQ ID:4635.

Another function of VGAM1924 is therefore inhibition of DKFZp434D177 (Accession XM_086586). Accordingly, utilities of VGAM1924 include diagnosis, prevention and treatment of diseases and clinical conditions associated with DKFZp434D177. DKFZP564B1023 (Accession NM_031306) is another VGAM1924 host target gene. DKFZP564B1023 BINDING SITE is HOST TARGET binding site found in the 3' untranslated region of mRNA encoded by DKFZP564B1023, corresponding to a HOST TARGET binding site such as BINDING SITE I, BINDING SITE II or BINDING SITE III. Table 2 illustrates the complementarity of the nucleotide sequences of DKFZP564B1023 BINDING SITE, designated SEQ ID:25344, to the nucleotide sequence of VGAM1924 RNA, herein designated VGAM RNA, also designated SEQ ID:4635.

Another function of VGAM1924 is therefore inhibition of DKFZP564B1023 (Accession NM_031306). Accordingly, utilities of VGAM1924 include diagnosis, prevention and treatment of diseases and clinical conditions associated with DKFZP564B1023. DKFZP564I0422 (Accession NM_031435) is another VGAM1924 host target gene. DKFZP564I0422 BINDING SITE is HOST TARGET binding site found in the 3' untranslated region of mRNA encoded by DKFZP564I0422, corresponding to a HOST TARGET binding site such as BINDING SITE I, BINDING SITE II or BINDING SITE III. Table 2 illustrates the complementarity of the nucleotide sequences of DKFZP564I0422 BINDING SITE, designated SEQ ID:25437, to the nucleotide sequence of VGAM1924 RNA, herein designated VGAM RNA, also designated SEQ ID:4635.

Another function of VGAM1924 is therefore inhibition of DKFZP564I0422 (Accession NM_031435). Accordingly, utilities of VGAM1924 include diagnosis, prevention and treatment of diseases and clinical conditions associated with DKFZP564I0422. DKFZp566H0824 (Accession NM_017535) is another VGAM1924 host target gene. DKFZp566H0824 BINDING SITE is HOST TARGET binding site found in the 5' untranslated region of mRNA encoded by DKFZp566H0824, corresponding to a HOST TARGET binding site such as BINDING SITE I, BINDING SITE II or BINDING SITE III. Table 2 illustrates the complementarity of the nucleotide sequences of DKFZp566H0824 BINDING SITE, designated SEQ ID:18980, to the nucleotide sequence of VGAM1924 RNA, herein designated VGAM RNA, also designated SEQ ID:4635.

Another function of VGAM1924 is therefore inhibition of DKFZp566H0824 (Accession NM_017535). Accordingly, utilities of VGAM1924 include diagnosis, prevention and treatment of diseases and clinical conditions associated with DKFZp566H0824. DKFZp761D081 (Accession NM_017610) is another VGAM1924 host target gene. DKFZp761D081 BINDING SITE is HOST TARGET binding site found in the 3' untranslated region of mRNA encoded by DKFZp761D081, corresponding to a HOST TARGET binding site such as BINDING SITE I, BINDING SITE II or BINDING SITE III. Table 2 illustrates the complementarity of the nucleotide sequences of DKFZp761D081 BINDING SITE, designated SEQ ID:19104, to the nucleotide sequence of VGAM1924 RNA, herein designated VGAM RNA, also designated SEQ ID:4635.

Another function of VGAM1924 is therefore inhibition of DKFZp761D081 (Accession NM_017610). Accordingly, utilities of VGAM1924 include diagnosis, prevention and treatment of diseases and clinical conditions associated with DKFZp761D081. DKFZp761G0313 (Accession XM_038026) is another VGAM1924 host target gene. DKFZp761G0313 BINDING SITE is HOST TARGET binding site found in the 3' untranslated region of mRNA encoded by DKFZp761G0313, corresponding to a HOST TARGET binding site such as BINDING SITE I, BINDING SITE II or BINDING SITE III. Table 2 illustrates the complementarity of the nucleotide sequences of DKFZp761G0313 BINDING SITE, designated SEQ ID:32741, to the nucleotide sequence of VGAM1924 RNA, herein designated VGAM RNA, also designated SEQ ID:4635.

Another function of VGAM1924 is therefore inhibition of DKFZp761G0313 (Accession XM_038026). Accordingly, utilities of VGAM1924 include diagnosis, prevention and treatment of diseases and clinical conditions associated with DKFZp761G0313. DKFZp761G2113 (Accession XM_046017) is another VGAM1924 host target gene. DKFZp761G2113 BINDING SITE is HOST TARGET binding site found in the 3' untranslated region of mRNA encoded by DKFZp761G2113, corresponding to a HOST TARGET binding site such as BINDING SITE I, BINDING SITE II or BINDING SITE III. Table 2 illustrates the complementarity of the nucleotide sequences of DKFZp761G2113 BINDING SITE, designated SEQ ID:34643, to the nucleotide sequence of VGAM1924 RNA, herein designated VGAM RNA, also designated SEQ ID:4635.

Another function of VGAM1924 is therefore inhibition of DKFZp761G2113 (Accession XM_046017). Accordingly, utilities of VGAM1924 include diagnosis, prevention and treatment of diseases and clinical conditions associated with DKFZp761G2113. DKFZp761H079 (Accession NM_144996) is another VGAM1924 host target gene. DKFZp761H079 BINDING SITE is HOST TARGET binding site found in the 3' untranslated region of mRNA encoded by DKFZp761H079, corresponding to a HOST TARGET binding site such as BINDING SITE I, BINDING SITE II or BINDING SITE III. Table 2 illustrates the complementarity of the nucleotide sequences of DKFZp761H079 BINDING SITE, designated SEQ ID:29601, to the nucleotide sequence of VGAM1924 RNA, herein designated VGAM RNA, also designated SEQ ID:4635.

Another function of VGAM1924 is therefore inhibition of DKFZp761H079 (Accession NM_144996). Accordingly, utilities of VGAM1924 include diagnosis, prevention and treatment of diseases and clinical conditions associated with DKFZp761H079. DKFZp762A227 (Accession NM_017611) is another VGAM1924 host target gene. DKFZp762A227 BINDING SITE1 and DKFZp762A227 BINDING SITE2 are HOST TARGET binding sites found in untranslated regions of mRNA encoded by DKFZp762A227, corresponding to HOST TARGET binding sites such as BINDING SITE I, BINDING SITE II or BINDING SITE III. Table 2 illustrates the complementarity of the nucleotide sequences of DKFZp762A227 BINDING SITE1 and DKFZp762A227 BINDING SITE2, designated SEQ ID:19106 and SEQ ID:15318 respectively, to the nucleotide sequence of VGAM1924 RNA, herein designated VGAM RNA, also designated SEQ ID:4635.

Another function of VGAM1924 is therefore inhibition of DKFZp762A227 (Accession NM_017611). Accordingly, utilities of VGAM1924 include diagnosis, prevention and treatment of diseases and clinical conditions associated with DKFZp762A227. ELL2 (Accession NM_012081) is another VGAM1924 host target gene. ELL2 BINDING SITE is HOST TARGET binding site found in the 3' untranslated region of mRNA encoded by ELL2, corresponding to a HOST TARGET binding site such as BINDING SITE I, BINDING SITE II or BINDING SITE III. Table 2 illustrates the complementarity of the nucleotide sequences of ELL2 BINDING SITE, designated SEQ ID:14368, to the nucleotide sequence of VGAM1924 RNA, herein designated VGAM RNA, also designated SEQ ID:4635.

Another function of VGAM1924 is therefore inhibition of ELL2 (Accession NM_012081). Accordingly, utilities of VGAM1924 include diagnosis, prevention and treatment of diseases and clinical conditions associated with ELL2. Elongation of Very Long Chain Fatty Acids (FEN1/Elo2, SUR4/Elo3, yeast)-like 2 (ELOVL2, Accession NM_017770) is another VGAM1924 host target gene. ELOVL2 BINDING SITE is HOST TARGET binding site found in the 3' untranslated region of mRNA encoded by ELOVL2, corresponding to a HOST TARGET binding site such as BINDING SITE I, BINDING SITE II or BINDING SITE III. Table 2 illustrates the complementarity of the nucleotide sequences of ELOVL2 BINDING SITE, designated SEQ ID:19390, to the nucleotide sequence of VGAM1924 RNA, herein designated VGAM RNA, also designated SEQ ID:4635.

Another function of VGAM1924 is therefore inhibition of Elongation of Very Long Chain Fatty Acids (FEN1/Elo2, SUR4/Elo3, yeast)-like 2 (ELOVL2, Accession NM_017770). Accordingly, utilities of VGAM1924 include diagnosis, prevention and treatment of diseases and clinical conditions associated with ELOVL2. Fibroblast Growth Factor 19 (FGF19, Accession NM_005117) is another VGAM1924 host target gene. FGF19 BINDING SITE is HOST TARGET binding site found in the 3' untranslated region of mRNA encoded by FGF19, corresponding to a HOST TARGET binding site such as BINDING SITE I, BINDING SITE II or BINDING SITE III. Table 2 illustrates the complementarity of the nucleotide sequences of FGF19 BINDING SITE, designated SEQ ID:11596, to the nucleotide sequence of VGAM1924 RNA, herein designated VGAM RNA, also designated SEQ ID:4635.

Another function of VGAM1924 is therefore inhibition of Fibroblast Growth Factor 19 (FGF19, Accession NM_005117). Accordingly, utilities of VGAM1924 include diagnosis, prevention and treatment of diseases and clinical conditions associated with FGF19. FHX (Accession NM_018416) is another VGAM1924 host target gene. FHX BINDING SITE is HOST TARGET binding site found in the 3' untranslated region of mRNA encoded by FHX, corresponding to a HOST TARGET binding site such as BINDING SITE I, BINDING SITE II or BINDING SITE III. Table 2 illustrates the complementarity of the nucleotide sequences of FHX BINDING SITE, designated SEQ ID:20461, to the nucleotide sequence of VGAM1924 RNA, herein designated VGAM RNA, also designated SEQ ID:4635.

Another function of VGAM1924 is therefore inhibition of FHX (Accession NM_018416). Accordingly, utilities of VGAM1924 include diagnosis, prevention and treatment of diseases and clinical conditions associated with FHX. FLJ10246 (Accession NM_018038) is another VGAM1924 host target gene. FLJ10246 BINDING SITE is HOST TARGET binding site found in the 3' untranslated region of mRNA encoded by FLJ10246, corresponding to a HOST TARGET binding site such as BINDING SITE I, BINDING SITE II or BINDING SITE III. Table 2 illustrates the complementarity of the nucleotide sequences of FLJ10246 BINDING SITE, designated SEQ ID:19786, to the nucleotide sequence of VGAM1924 RNA, herein designated VGAM RNA, also designated SEQ ID:4635.

Another function of VGAM1924 is therefore inhibition of FLJ10246 (Accession NM_018038). Accordingly, utilities of VGAM1924 include diagnosis, prevention and treatment of diseases and clinical conditions associated with FLJ10246. FLJ10298 (Accession NM_018050) is another VGAM1924 host target gene. FLJ10298 BINDING SITE is HOST TARGET binding site found in the 3' untranslated region of mRNA encoded by FLJ10298, corresponding to a HOST TARGET binding site such as BINDING SITE I, BINDING SITE II or BINDING SITE III. Table 2 illustrates the complementarity of the nucleotide sequences of FLJ10298 BINDING SITE, designated SEQ ID:19808, to the nucleotide sequence of VGAM1924 RNA, herein designated VGAM RNA, also designated SEQ ID:4635.

Another function of VGAM1924 is therefore inhibition of FLJ10298 (Accession NM_018050). Accordingly, utilities of VGAM1924 include diagnosis, prevention and treatment of diseases and clinical conditions associated with FLJ10298. FLJ10535 (Accession NM_018129) is another VGAM1924 host target gene. FLJ10535 BINDING SITE1 and FLJ10535 BINDING SITE2 are HOST TARGET binding sites found in untranslated regions of mRNA encoded by FLJ10535, corresponding to HOST TARGET binding sites such as BINDING SITE I, BINDING SITE II or BINDING SITE III. Table 2 illustrates the complementarity of the nucleotide sequences of FLJ10535 BINDING SITE1 and FLJ10535 BINDING SITE2, designated SEQ ID:19918 and SEQ ID:19921 respectively, to the nucleotide sequence of VGAM1924 RNA, herein designated VGAM RNA, also designated SEQ ID:4635.

Another function of VGAM1924 is therefore inhibition of FLJ10535 (Accession NM_018129). Accordingly, utilities of VGAM1924 include diagnosis, prevention and treatment of diseases and clinical conditions associated with FLJ10535. FLJ10724 (Accession NM_018194) is another VGAM1924 host target gene. FLJ10724 BINDING SITE is HOST TAR- GET binding site found in the 3' untranslated region of mRNA encoded by FLJ10724, corresponding to a HOST TARGET binding site such as BINDING SITE I, BINDING SITE II or BINDING SITE III. Table 2 illustrates the complementarity of the nucleotide sequences of FLJ10724 BINDING SITE, designated SEQ ID:20052, to the nucleotide sequence of VGAM1924 RNA, herein designated VGAM RNA, also designated SEQ ID:4635.

Another function of VGAM1924 is therefore inhibition of FLJ10724 (Accession NM_018194). Accordingly, utilities of VGAM1924 include diagnosis, prevention and treatment of diseases and clinical conditions associated with FLJ10724. FLJ10898 (Accession XM_002486) is another VGAM1924 host target gene. FLJ10898 BINDING SITE is HOST TARGET binding site found in the 3' untranslated region of mRNA encoded by FLJ10898, corresponding to a HOST TARGET binding site such as BINDING SITE I, BINDING SITE II or BINDING SITE III. Table 2 illustrates the complementarity of the nucleotide sequences of FLJ10898 BINDING SITE, designated SEQ ID:29896, to the nucleotide sequence of VGAM1924 RNA, herein designated VGAM RNA, also designated SEQ ID:4635.

Another function of VGAM1924 is therefore inhibition of FLJ10898 (Accession XM_002486). Accordingly, utilities of VGAM1924 include diagnosis, prevention and treatment of diseases and clinical conditions associated with FLJ10898. FLJ10961 (Accession XM_032826) is another VGAM1924 host target gene. FLJ10961 BINDING SITE is HOST TARGET binding site found in the 3' untranslated region of mRNA encoded by FLJ10961, corresponding to a HOST TARGET binding site such as BINDING SITE I, BINDING SITE II or BINDING SITE III. Table 2 illustrates the complementarity of the nucleotide sequences of FLJ10961 BINDING SITE, designated SEQ ID:31776, to the nucleotide sequence of VGAM1924 RNA, herein designated VGAM RNA, also designated SEQ ID:4635.

Another function of VGAM1924 is therefore inhibition of FLJ10961 (Accession XM_032826). Accordingly, utilities of VGAM1924 include diagnosis, prevention and treatment of diseases and clinical conditions associated with FLJ10961. FLJ11040 (Accession NM_018307) is another VGAM1924 host target gene. FLJ11040 BINDING SITE is HOST TARGET binding site found in the 3' untranslated region of mRNA encoded by FLJ11040, corresponding to a HOST TARGET binding site such as BINDING SITE I, BINDING SITE II or BINDING SITE III. Table 2 illustrates the complementarity of the nucleotide sequences of FLJ11040 BINDING SITE, designated SEQ ID:20296, to the nucleotide sequence of VGAM1924 RNA, herein designated VGAM RNA, also designated SEQ ID:4635.

Another function of VGAM1924 is therefore inhibition of FLJ11040 (Accession NM_018307). Accordingly, utilities of VGAM1924 include diagnosis, prevention and treatment of diseases and clinical conditions associated with FLJ11040. FLJ11267 (Accession NM_019607) is another VGAM1924 host target gene. FLJ11267 BINDING SITE is HOST TARGET binding site found in the 3' untranslated region of mRNA encoded by FLJ11267, corresponding to a HOST TARGET binding site such as BINDING SITE I, BINDING SITE II or BINDING SITE III. Table 2 illustrates the complementarity of the nucleotide sequences of FLJ11267 BINDING SITE, designated SEQ ID:21226, to the nucleotide sequence of VGAM1924 RNA, herein designated VGAM RNA, also designated SEQ ID:4635.

Another function of VGAM1924 is therefore inhibition of FLJ11267 (Accession NM_019607). Accordingly, utilities of VGAM1924 include diagnosis, prevention and treatment of diseases and clinical conditions associated with FLJ11267. FLJ11275 (Accession NM_018376) is another VGAM1924 host target gene. FLJ11275 BINDING SITE is HOST TARGET binding site found in the 3' untranslated region of mRNA encoded by FLJ11275, corresponding to a HOST TARGET binding site such as BINDING SITE I, BINDING SITE II or BINDING SITE III. Table 2 illustrates the complementarity of the nucleotide sequences of FLJ11275 BINDING SITE, designated SEQ ID:20403, to the nucleotide sequence of VGAM1924 RNA, herein designated VGAM RNA, also designated SEQ ID:4635.

Another function of VGAM1924 is therefore inhibition of FLJ11275 (Accession NM_018376). Accordingly, utilities of VGAM1924 include diagnosis, prevention and treatment of diseases and clinical conditions associated with FLJ11275. FLJ11320 (Accession NM_018389) is another VGAM1924 host target gene. FLJ11320 BINDING SITE is HOST TARGET binding site found in the 3' untranslated region of mRNA encoded by FLJ11320, corresponding to a HOST TARGET binding site such as BINDING SITE I, BINDING SITE II or BINDING SITE III. Table 2 illustrates the complementarity of the nucleotide sequences of FLJ11320 BINDING SITE, designated SEQ ID:20426, to the nucleotide sequence of VGAM1924 RNA, herein designated VGAM RNA, also designated SEQ ID:4635.

Another function of VGAM1924 is therefore inhibition of FLJ11320 (Accession NM_018389). Accordingly, utilities of VGAM1924 include diagnosis, prevention and treatment of diseases and clinical conditions associated with FLJ11320. FLJ11506 (Accession NM_024666) is another VGAM1924 host target gene. FLJ11506 BINDING SITE is HOST TARGET binding site found in the 3' untranslated region of mRNA encoded by FLJ11506, corresponding to a HOST TARGET binding site such as BINDING SITE I, BINDING SITE II or BINDING SITE III. Table 2 illustrates the complementarity of the nucleotide sequences of FLJ11506 BINDING SITE, designated SEQ ID:23968, to the nucleotide sequence of VGAM1924 RNA, herein designated VGAM RNA, also designated SEQ ID:4635.

Another function of VGAM1924 is therefore inhibition of FLJ11506 (Accession NM_024666). Accordingly, utilities of VGAM1924 include diagnosis, prevention and treatment of diseases and clinical conditions associated with FLJ11506. FLJ12619 (Accession NM_030939) is another VGAM1924 host target gene. FLJ12619 BINDING SITE is HOST TARGET binding site found in the 3' untranslated region of mRNA encoded by FLJ12619, corresponding to a HOST TARGET binding site such as BINDING SITE I, BINDING SITE II or BINDING SITE III. Table 2 illustrates the complementarity of the nucleotide sequences of FLJ12619 BINDING SITE, designated SEQ ID:25209, to the nucleotide sequence of VGAM1924 RNA, herein designated VGAM RNA, also designated SEQ ID:4635.

Another function of VGAM1924 is therefore inhibition of FLJ12619 (Accession NM_030939). Accordingly, utilities of VGAM1924 include diagnosis, prevention and treatment of diseases and clinical conditions associated with FLJ12619. FLJ12960 (Accession NM_024638) is another VGAM1924 host target gene. FLJ12960 BINDING SITE is HOST TARGET binding site found in the 3' untranslated region of mRNA encoded by FLJ12960, corresponding to a HOST TARGET binding site such as BINDING SITE I, BINDING SITE II or BINDING SITE III. Table 2 illustrates the complementarity of the nucleotide sequences of FLJ12960 BINDING SITE, designated SEQ ID:23914, to the nucleotide sequence of VGAM1924 RNA, herein designated VGAM RNA, also designated SEQ ID:4635.

Another function of VGAM1924 is therefore inhibition of FLJ12960 (Accession NM_024638). Accordingly, utilities of VGAM1924 include diagnosis, prevention and treatment of diseases and clinical conditions associated with FLJ12960. FLJ13188 (Accession NM_022063) is another VGAM1924 host target gene. FLJ13188 BINDING SITE is HOST TARGET binding site found in the 3' untranslated region of mRNA encoded by FLJ13188, corresponding to a HOST TARGET binding site such as BINDING SITE I, BINDING SITE II or BINDING SITE III. Table 2 illustrates the complementarity of the nucleotide sequences of FLJ13188 BINDING SITE, designated SEQ ID:22606, to the nucleotide sequence of VGAM1924 RNA, herein designated VGAM RNA, also designated SEQ ID:4635.

Another function of VGAM1924 is therefore inhibition of FLJ13188 (Accession NM_022063). Accordingly, utilities of VGAM1924 include diagnosis, prevention and treatment of diseases and clinical conditions associated with FLJ13188. FLJ13213 (Accession NM_024755) is another VGAM1924 host target gene. FLJ13213 BINDING SITE is HOST TARGET binding site found in the 3' untranslated region of mRNA encoded by FLJ13213, corresponding to a HOST TARGET binding site such as BINDING SITE I, BINDING SITE II or BINDING SITE III. Table 2 illustrates the complementarity of the nucleotide sequences of FLJ13213 BINDING SITE, designated SEQ ID:24101, to the nucleotide sequence of VGAM1924 RNA, herein designated VGAM RNA, also designated SEQ ID:4635.

Another function of VGAM1924 is therefore inhibition of FLJ13213 (Accession NM_024755). Accordingly, utilities of VGAM1924 include diagnosis, prevention and treatment of diseases and clinical conditions associated with FLJ13213. FLJ13614 (Accession NM_139076) is another VGAM1924 host target gene. FLJ13614 BINDING SITE is HOST TARGET binding site found in the 3' untranslated region of mRNA encoded by FLJ13614, corresponding to a HOST TARGET binding site such as BINDING SITE I, BINDING SITE II or BINDING SITE III. Table 2 illustrates the complementarity of the nucleotide sequences of FLJ13614 BINDING SITE, designated SEQ ID:29152, to the nucleotide sequence of VGAM1924 RNA, herein designated VGAM RNA, also designated SEQ ID:4635.

Another function of VGAM1924 is therefore inhibition of FLJ13614 (Accession NM_139076). Accordingly, utilities of VGAM1924 include diagnosis, prevention and treatment of diseases and clinical conditions associated with FLJ13614. FLJ13646 (Accession NM_024584) is another VGAM1924 host target gene. FLJ13646 BINDING SITE is HOST TARGET binding site found in the 3' untranslated region of mRNA encoded by FLJ13646, corresponding to a HOST TARGET binding site such as BINDING SITE I, BINDING SITE II or BINDING SITE III. Table 2 illustrates the complementarity of the nucleotide sequences of FLJ13646 BINDING SITE, designated SEQ ID:23812, to the nucleotide sequence of VGAM1924 RNA, herein designated VGAM RNA, also designated SEQ ID:4635.

Another function of VGAM1924 is therefore inhibition of FLJ13646 (Accession NM_024584). Accordingly, utilities of VGAM1924 include diagnosis, prevention and treatment of diseases and clinical conditions associated with FLJ13646. FLJ14054 (Accession NM_024563) is another VGAM1924 host target gene. FLJ14054 BINDING SITE is HOST TARGET binding site found in the 5' untranslated region of mRNA encoded by FLJ14054, corresponding to a HOST TARGET binding site such as BINDING SITE I, BINDING SITE II or BINDING SITE III. Table 2 illustrates the complementarity of the nucleotide sequences of FLJ14054 BINDING SITE, designated SEQ ID:23784, to the nucleotide sequence of VGAM1924 RNA, herein designated VGAM RNA, also designated SEQ ID:4635.

Another function of VGAM1924 is therefore inhibition of FLJ14054 (Accession NM_024563). Accordingly, utilities of VGAM1924 include diagnosis, prevention and treatment of diseases and clinical conditions associated with FLJ14054. FLJ14100 (Accession NM_025025) is another VGAM1924 host target gene. FLJ14100 BINDING SITE is HOST TARGET binding site found in the 5' untranslated region of mRNA encoded by FLJ14100, corresponding to a HOST TARGET binding site such as BINDING SITE I, BINDING SITE II or BINDING SITE III. Table 2 illustrates the complementarity of the nucleotide sequences of FLJ14100 BINDING SITE, designated SEQ ID:24615, to the nucleotide sequence of VGAM1924 RNA, herein designated VGAM RNA, also designated SEQ ID:4635.

Another function of VGAM1924 is therefore inhibition of FLJ14100 (Accession NM_025025). Accordingly, utilities of VGAM1924 include diagnosis, prevention and treatment of diseases and clinical conditions associated with FLJ14100. FLJ14641 (Accession NM_032817) is another VGAM1924 host target gene. FLJ14641 BINDING SITE is HOST TARGET binding site found in the 3' untranslated region of mRNA encoded by FLJ14641, corresponding to a HOST TARGET binding site such as BINDING SITE I, BINDING SITE II or BINDING SITE III. Table 2 illustrates the complementarity of the nucleotide sequences of FLJ14641 BINDING SITE, designated SEQ ID:26588, to the nucleotide sequence of VGAM1924 RNA, herein designated VGAM RNA, also designated SEQ ID:4635.

Another function of VGAM1924 is therefore inhibition of FLJ14641 (Accession NM_032817). Accordingly, utilities of VGAM1924 include diagnosis, prevention and treatment of diseases and clinical conditions associated with FLJ14641. FLJ14803 (Accession NM_032842) is another VGAM1924 host target gene. FLJ14803 BINDING SITE is HOST TARGET binding site found in the 3' untranslated region of mRNA encoded by FLJ14803, corresponding to a HOST TARGET binding site such as BINDING SITE I, BINDING SITE II or BINDING SITE III. Table 2 illustrates the complementarity of the nucleotide sequences of FLJ14803 BINDING SITE, designated SEQ ID:26629, to the nucleotide sequence of VGAM1924 RNA, herein designated VGAM RNA, also designated SEQ ID:4635.

Another function of VGAM1924 is therefore inhibition of FLJ14803 (Accession NM_032842). Accordingly, utilities of VGAM1924 include diagnosis, prevention and treatment of diseases and clinical conditions associated with FLJ14803. FLJ20038 (Accession NM_017634) is another VGAM1924 host target gene. FLJ20038 BINDING SITE is HOST TARGET binding site found in the 3' untranslated region of mRNA encoded by FLJ20038, corresponding to a HOST TARGET binding site such as BINDING SITE I, BINDING SITE II or BINDING SITE III. Table 2 illustrates the complementarity of the nucleotide sequences of FLJ20038 BINDING SITE, designated SEQ ID:19140, to the nucleotide sequence of VGAM1924 RNA, herein designated VGAM RNA, also designated SEQ ID:4635.

Another function of VGAM1924 is therefore inhibition of FLJ20038 (Accession NM_017634). Accordingly, utilities of VGAM1924 include diagnosis, prevention and treatment of diseases and clinical conditions associated with FLJ20038. FLJ20051 (Accession NM_019087) is another VGAM1924 host target gene. FLJ20051 BINDING SITE is HOST TARGET binding site found in the 3' untranslated region of mRNA encoded by FLJ20051, corresponding to a HOST TARGET binding site such as BINDING SITE I, BINDING SITE II or BINDING SITE III. Table 2 illustrates the complementarity of the nucleotide sequences of FLJ20051 BINDING SITE, designated SEQ ID:21165, to the nucleotide sequence of VGAM1924 RNA, herein designated VGAM RNA, also designated SEQ ID:4635.

Another function of VGAM1924 is therefore inhibition of FLJ20051 (Accession NM_019087). Accordingly, utilities of VGAM1924 include diagnosis, prevention and treatment of diseases and clinical conditions associated with FLJ20051. FLJ20079 (Accession NM_017656) is another VGAM1924 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19173, to the nucleotide sequence of VGAM1924 RNA, herein designated VGAM RNA, also designated SEQ ID:4635.

Another function of VGAM1924 is therefore inhibition of FLJ20079 (Accession NM_017656). Accordingly, utilities of VGAM1924 include diagnosis, prevention and treatment of diseases and clinical conditions associated with FLJ20079. FLJ20136 (Accession NM_017684) is another VGAM1924 host target gene. FLJ20136 BINDING SITE is HOST TARGET binding site found in the 3' untranslated region of mRNA encoded by FLJ20136, corresponding to a HOST TARGET binding site such as BINDING SITE I, BINDING SITE II or BINDING SITE III. Table 2 illustrates the complementarity of the nucleotide sequences of FLJ20136 BINDING SITE, designated SEQ ID:19230, to the nucleotide sequence of VGAM1924 RNA, herein designated VGAM RNA, also designated SEQ ID:4635.

Another function of VGAM1924 is therefore inhibition of FLJ20136 (Accession NM_017684). Accordingly, utilities of VGAM1924 include diagnosis, prevention and treatment of diseases and clinical conditions associated with FLJ20136. FLJ20152 (Accession NM_019000) is another VGAM1924 host target gene. FLJ20152 BINDING SITE is HOST TARGET binding site found in the 5' untranslated region of mRNA encoded by FLJ20152, corresponding to a HOST TARGET binding site such as BINDING SITE I, BINDING SITE II or BINDING SITE III. Table 2 illustrates the complementarity of the nucleotide sequences of FLJ20152 BINDING SITE, designated SEQ ID:21072, to the nucleotide sequence of VGAM1924 RNA, herein designated VGAM RNA, also designated SEQ ID:4635.

Another function of VGAM1924 is therefore inhibition of FLJ20152 (Accession NM_019000). Accordingly, utilities of VGAM1924 include diagnosis, prevention and treatment of diseases and clinical conditions associated with FLJ20152. FLJ20277 (Accession NM_017739) is another VGAM1924 host target gene. FLJ20277 BINDING SITE is HOST TARGET binding site found in the 3' untranslated region of mRNA encoded by FLJ20277, corresponding to a HOST TARGET binding site such as BINDING SITE I, BINDING SITE II or BINDING SITE III. Table 2 illustrates the complementarity of the nucleotide sequences of FLJ20277 BINDING SITE, designated SEQ ID:19330, to the nucleotide sequence of VGAM1924 RNA, herein designated VGAM RNA, also designated SEQ ID:4635.

Another function of VGAM1924 is therefore inhibition of FLJ20277 (Accession NM_017739). Accordingly, utilities of VGAM1924 include diagnosis, prevention and treatment of diseases and clinical conditions associated with FLJ20277. FLJ20373 (Accession NM_017792) is another VGAM1924 host target gene. FLJ20373 BINDING SITE is HOST TARGET binding site found in the 3' untranslated region of mRNA encoded by FLJ20373, corresponding to a HOST TARGET binding site such as BINDING SITE I, BINDING SITE II or BINDING SITE III. Table 2 illustrates the complementarity of the nucleotide sequences of FLJ20373 BINDING SITE, designated SEQ ID:19428, to the nucleotide sequence of VGAM1924 RNA, herein designated VGAM RNA, also designated SEQ ID:4635.

Another function of VGAM1924 is therefore inhibition of FLJ20373 (Accession NM_017792). Accordingly, utilities of VGAM1924 include diagnosis, prevention and treatment of diseases and clinical conditions associated with FLJ20373. FLJ20396 (Accession NM_017801) is another VGAM1924 host target gene. FLJ20396 BINDING SITE is HOST TARGET binding site found in the 3' untranslated region of mRNA encoded by FLJ20396, corresponding to a HOST TARGET binding site such as BINDING SITE I, BINDING SITE II or BINDING SITE III. Table 2 illustrates the complementarity of the nucleotide sequences of FLJ20396 BINDING SITE, designated SEQ ID:19446, to the nucleotide sequence of VGAM1924 RNA, herein designated VGAM RNA, also designated SEQ ID:4635.

Another function of VGAM1924 is therefore inhibition of FLJ20396 (Accession NM_017801). Accordingly, utilities of VGAM1924 include diagnosis, prevention and treatment of diseases and clinical conditions associated with FLJ20396. FLJ20445 (Accession NM_017824) is another VGAM1924 host target gene. FLJ20445 BINDING SITE is HOST TARGET binding site found in the 3' untranslated region of mRNA encoded by FLJ20445, corresponding to a HOST TARGET binding site such as BINDING SITE I, BINDING SITE II or BINDING SITE III. Table 2 illustrates the complementarity of the nucleotide sequences of FLJ20445 BINDING SITE, designated SEQ ID:19478, to the nucleotide sequence of VGAM1924 RNA, herein designated VGAM RNA, also designated SEQ ID:4635.

Another function of VGAM1924 is therefore inhibition of FLJ20445 (Accession NM_017824). Accordingly, utilities of VGAM1924 include diagnosis, prevention and treatment of diseases and clinical conditions associated with FLJ20445. FLJ20449 (Accession NM_017826) is another VGAM1924 host target gene. FLJ20449 BINDING SITE is HOST TARGET binding site found in the 3' untranslated region of mRNA encoded by FLJ20449, corresponding to a HOST TARGET binding site such as BINDING SITE I, BINDING SITE II or BINDING SITE III. Table 2 illustrates the complementarity of the nucleotide sequences of FLJ20449 BINDING SITE, designated SEQ ID:19487, to the nucleotide sequence of VGAM1924 RNA, herein designated VGAM RNA, also designated SEQ ID:4635.

Another function of VGAM1924 is therefore inhibition of FLJ20449 (Accession NM_017826). Accordingly, utilities of VGAM1924 include diagnosis, prevention and treatment of diseases and clinical conditions associated with FLJ20449. FLJ21415 (Accession NM_024738) is another VGAM1924 host target gene. FLJ21415 BINDING SITE is HOST TARGET binding site found in the 3' untranslated region of mRNA encoded by FLJ21415, corresponding to a HOST TARGET binding site such as BINDING SITE I, BINDING SITE II or BINDING SITE III. Table 2 illustrates the complementarity of the nucleotide sequences of FLJ21415 BINDING SITE, designated SEQ ID:24078, to the nucleotide sequence of VGAM1924 RNA, herein designated VGAM RNA, also designated SEQ ID:4635.

Another function of VGAM1924 is therefore inhibition of FLJ21415 (Accession NM_024738). Accordingly, utilities of VGAM1924 include diagnosis, prevention and treatment of diseases and clinical conditions associated with FLJ21415. FLJ22029 (Accession NM_024949) is another VGAM1924 host target gene. FLJ22029 BINDING SITE is HOST TARGET binding site found in the 3' untranslated region of mRNA encoded by FLJ22029, corresponding to a HOST TARGET binding site such as BINDING SITE I, BINDING SITE II or BINDING SITE III. Table 2 illustrates the complementarity of the nucleotide sequences of FLJ22029 BINDING SITE, designated SEQ ID:24507, to the nucleotide sequence of VGAM1924 RNA, herein designated VGAM RNA, also designated SEQ ID:4635.

Another function of VGAM1924 is therefore inhibition of FLJ22029 (Accession NM_024949). Accordingly, utilities of VGAM1924 include diagnosis, prevention and treatment of diseases and clinical conditions associated with FLJ22029. FLJ23151 (Accession NM_024772) is another VGAM1924 host target gene. FLJ23151 BINDING SITE is HOST TARGET binding site found in the 3' untranslated region of mRNA encoded by FLJ23151, corresponding to a HOST TARGET binding site such as BINDING SITE I, BINDING SITE II or BINDING SITE III. Table 2 illustrates the complementarity of the nucleotide sequences of FLJ23151 BINDING SITE, designated SEQ ID:24137, to the nucleotide sequence of VGAM1924 RNA, herein designated VGAM RNA, also designated SEQ ID:4635.

Another function of VGAM1924 is therefore inhibition of FLJ23151 (Accession NM_024772). Accordingly, utilities of VGAM1924 include diagnosis, prevention and treatment of diseases and clinical conditions associated with FLJ23151. FLJ23511 (Accession NM_032239) is another VGAM1924 host target gene. FLJ23511 BINDING SITE is HOST TARGET binding site found in the 3' untranslated region of mRNA encoded by FLJ23511, corresponding to a HOST TARGET binding site such as BINDING SITE I, BINDING SITE II or BINDING SITE III. Table 2 illustrates the complementarity of the nucleotide sequences of FLJ23511 BINDING SITE, designated SEQ ID:25968, to the nucleotide sequence of VGAM1924 RNA, herein designated VGAM RNA, also designated SEQ ID:4635.

Another function of VGAM1924 is therefore inhibition of FLJ23511 (Accession NM_032239). Accordingly, utilities of VGAM1924 include diagnosis, prevention and treatment of diseases and clinical conditions associated with FLJ23511. FLJ23563 (Accession XM_041701) is another VGAM1924 host target gene. FLJ23563 BINDING SITE is HOST TARGET binding site found in the 3' untranslated region of mRNA encoded by FLJ23563, corresponding to a HOST TARGET binding site such as BINDING SITE I, BINDING SITE II or BINDING SITE III. Table 2 illustrates the complementarity of the nucleotide sequences of FLJ23563 BINDING SITE, designated SEQ ID:33565, to the nucleotide sequence of VGAM1924 RNA, herein designated VGAM RNA, also designated SEQ ID:4635.

Another function of VGAM1924 is therefore inhibition of FLJ23563 (Accession XM_041701). Accordingly, utilities of VGAM1924 include diagnosis, prevention and treatment of diseases and clinical conditions associated with FLJ23563. Far Upstream Element (FUSE) Binding Protein 3 (FUBP3, Accession XM_033327) is another VGAM1924 host target gene. FUBP3 BINDING SITE is HOST TARGET binding site found in the 3' untranslated region of mRNA encoded by FUBP3, corresponding to a HOST TARGET binding site such as BINDING SITE I, BINDING SITE II or BINDING SITE III. Table 2 illustrates the complementarity of the nucleotide sequences of FUBP3 BINDING SITE, designated SEQ ID:31876, to the nucleotide sequence of VGAM1924 RNA, herein designated VGAM RNA, also designated SEQ ID:4635.

Another function of VGAM1924 is therefore inhibition of Far Upstream Element (FUSE) Binding Protein 3 (FUBP3, Accession XM_033327). Accordingly, utilities of VGAM1924 include diagnosis, prevention and treatment of diseases and clinical conditions associated with FUBP3. Golgi Autoantigen, Golgin Subfamily A, 1 (GOLGA1, Accession NM_002077) is another VGAM1924 host target gene. GOLGA1 BINDING SITE is HOST TARGET binding site found in the 3' untranslated region of mRNA encoded by GOLGA1, corresponding to a HOST TARGET binding site such as BINDING SITE I, BINDING SITE II or BINDING SITE III. Table 2 illustrates the complementarity of the nucleotide sequences of GOLGA1 BINDING SITE, designated SEQ ID:7864, to the nucleotide sequence of VGAM1924 RNA, herein designated VGAM RNA, also designated SEQ ID:4635.

Another function of VGAM1924 is therefore inhibition of Golgi Autoantigen, Golgin Subfamily A, 1 (GOLGA1, Accession NM_002077). Accordingly, utilities of VGAM1924 include diagnosis, prevention and treatment of diseases and clinical conditions associated with GOLGA1. Golgi Phosphoprotein 3 (coat-protein) (GOLPH3, Accession NM_022130) is another VGAM1924 host target gene. GOLPH3 BINDING SITE is HOST TARGET binding site found in the 3' untranslated region of mRNA encoded by GOLPH3, corresponding to a HOST TARGET binding site such as BINDING SITE I, BINDING SITE II or BINDING SITE III. Table 2 illustrates the complementarity of the nucleotide sequences of GOLPH3 BINDING SITE, designated SEQ ID:22686, to the nucleotide sequence of VGAM1924 RNA, herein designated VGAM RNA, also designated SEQ ID:4635.

Another function of VGAM1924 is therefore inhibition of Golgi Phosphoprotein 3 (coat-protein) (GOLPH3, Accession NM_022130). Accordingly, utilities of VGAM1924 include diagnosis, prevention and treatment of diseases and clinical conditions associated with GOLPH3. GREB1 (Accession NM_014668) is another VGAM1924 host target gene. GREB1 BINDING SITE is HOST TARGET binding site found in the 3' untranslated region of mRNA encoded by GREB1, corresponding to a HOST TARGET binding site such as BINDING SITE I, BINDING SITE II or BINDING SITE III. Table 2 illustrates the complementarity of the nucleotide sequences of GREB1 BINDING SITE, designated SEQ ID:16125, to the nucleotide sequence of VGAM1924 RNA, herein designated VGAM RNA, also designated SEQ ID:4635.

Another function of VGAM1924 is therefore inhibition of GREB1 (Accession NM_014668). Accordingly, utilities of VGAM1924 include diagnosis, prevention and treatment of diseases and clinical conditions associated with GREB1. Glutamate Receptor, Ionotropic, Delta 1 (GRID1, Accession XM_043613) is another VGAM1924 host target gene. GRID1 BINDING SITE is HOST TARGET binding site found in the 3' untranslated region of mRNA encoded by GRID1, corresponding to a HOST TARGET binding site such as BINDING SITE I, BINDING SITE II or BINDING SITE III. Table 2 illustrates the complementarity of the nucleotide sequences of GRID1 BINDING SITE, designated SEQ ID:33979, to the nucleotide sequence of VGAM1924 RNA, herein designated VGAM RNA, also designated SEQ ID:4635.

Another function of VGAM1924 is therefore inhibition of Glutamate Receptor, Ionotropic, Delta 1 (GRID1, Accession XM_043613). Accordingly, utilities of VGAM1924 include diagnosis, prevention and treatment of diseases and clinical conditions associated with GRID1. H2AV (Accession NM_138635) is another VGAM1924 host target gene. H2AV BINDING SITE is HOST TARGET binding site found in the 3' untranslated region of mRNA encoded by H2AV, corresponding to a HOST TARGET binding site such as BINDING SITE I, BINDING SITE II or BINDING SITE III. Table 2 illustrates the complementarity of the nucleotide sequences of H2AV BINDING SITE, designated SEQ ID:28913, to the nucleotide sequence of VGAM1924 RNA, herein designated VGAM RNA, also designated SEQ ID:4635.

Another function of VGAM1924 is therefore inhibition of H2AV (Accession NM_138635). Accordingly, utilities of VGAM1924 include diagnosis, prevention and treatment of diseases and clinical conditions associated with H2AV. HH114 (Accession NM_032499) is another VGAM1924 host target gene. HH114 BINDING SITE is HOST TARGET binding site found in the 3' untranslated region of mRNA encoded by HH114, corresponding to a HOST TARGET binding site such as BINDING SITE I, BINDING SITE II or BINDING SITE III. Table 2 illustrates the complementarity of the nucleotide sequences of HH114 BINDING SITE, designated SEQ ID:26250, to the nucleotide sequence of VGAM1924 RNA, herein designated VGAM RNA, also designated SEQ ID:4635.

Another function of VGAM1924 is therefore inhibition of HH114 (Accession NM_032499). Accordingly, utilities of VGAM1924 include diagnosis, prevention and treatment of diseases and clinical conditions associated with HH114. Histamine Receptor H4 (HRH4, Accession NM_021624) is another VGAM1924 host target gene. HRH4 BINDING SITE is HOST TARGET binding site found in the 3' untranslated region of mRNA encoded by HRH4, corresponding to a HOST TARGET binding site such as BINDING SITE I, BINDING SITE II or BINDING SITE III. Table 2 illustrates the complementarity of the nucleotide sequences of HRH4 BINDING SITE, designated SEQ ID:22260, to the nucleotide sequence of VGAM1924 RNA, herein designated VGAM RNA, also designated SEQ ID:4635.

Another function of VGAM1924 is therefore inhibition of Histamine Receptor H4 (HRH4, Accession NM_021624). Accordingly, utilities of VGAM1924 include diagnosis, prevention and treatment of diseases and clinical conditions associated with HRH4. HSNOV1 (Accession NM_017515) is another VGAM1924 host target gene. HSNOV1 BINDING SITE is HOST TARGET binding site found in the 3' untranslated region of mRNA encoded by HSNOV1, corresponding to a HOST TARGET binding site such as BINDING SITE I, BINDING SITE II or BINDING SITE III. Table 2 illustrates the complementarity of the nucleotide sequences of HSNOV1 BINDING SITE, designated SEQ ID:18965, to the nucleotide sequence of VGAM1924 RNA, herein designated VGAM RNA, also designated SEQ ID:4635.

Another function of VGAM1924 is therefore inhibition of HSNOV1 (Accession NM_017515). Accordingly, utilities of VGAM1924 include diagnosis, prevention and treatment of diseases and clinical conditions associated with HSNOV1. HSPC019 (Accession NM_014028) is another VGAM1924 host target gene. HSPC019 BINDING SITE is HOST TARGET binding site found in the 3' untranslated region of mRNA encoded by HSPC019, corresponding to a HOST TARGET binding site such as BINDING SITE I, BINDING SITE II or BINDING SITE III. Table 2 illustrates the complementarity of the nucleotide sequences of HSPC019 BINDING SITE, designated SEQ ID:15252, to the nucleotide sequence of VGAM1924 RNA, herein designated VGAM RNA, also designated SEQ ID:4635.

Another function of VGAM1924 is therefore inhibition of HSPC019 (Accession NM_014028). Accordingly, utilities of VGAM1924 include diagnosis, prevention and treatment of diseases and clinical conditions associated with HSPC019. IBTK (Accession XM_041401) is another VGAM1924 host target gene. IBTK BINDING SITE is HOST TARGET binding site found in the 3' untranslated region of mRNA encoded by IBTK, corresponding to a HOST TARGET binding site such as BINDING SITE I, BINDING SITE II or BINDING SITE III. Table 2 illustrates the complementarity of the nucleotide sequences of IBTK BINDING SITE, designated SEQ ID:33519, to the nucleotide sequence of VGAM1924 RNA, herein designated VGAM RNA, also designated SEQ ID:4635.

Another function of VGAM1924 is therefore inhibition of IBTK (Accession XM_041401). Accordingly, utilities of VGAM1924 include diagnosis, prevention and treatment of diseases and clinical conditions associated with IBTK. Interleukin 14 (IL14, Accession XM_170924) is another VGAM1924 host target gene. IL14 BINDING SITE is HOST TARGET binding site found in the 5' untranslated region of mRNA encoded by IL14, corresponding to a HOST TARGET binding site such as BINDING SITE I, BINDING SITE II or BINDING SITE III. Table 2 illustrates the complementarity of the nucleotide sequences of IL14 BINDING SITE, designated SEQ ID:45707, to the nucleotide sequence of VGAM1924 RNA, herein designated VGAM RNA, also designated SEQ ID:4635.

Another function of VGAM1924 is therefore inhibition of Interleukin 14 (IL14, Accession XM_170924). Accordingly, utilities of VGAM1924 include diagnosis, prevention and treatment of diseases and clinical conditions associated with IL14. Potassium Voltage-gated Channel, Shal-related Subfamily, Member 1 (KCND1, Accession NM_004979) is another VGAM1924 host target gene. KCND1 BINDING SITE is HOST TARGET binding site found in the 5' untranslated region of mRNA encoded by KCND1, corresponding to a HOST TARGET binding site such as BINDING SITE I, BINDING SITE II or BINDING SITE III. Table 2 illustrates the complementarity of the nucleotide sequences of KCND1 BINDING SITE, designated SEQ ID:11428, to the nucleotide sequence of VGAM1924 RNA, herein designated VGAM RNA, also designated SEQ ID:4635.

Another function of VGAM1924 is therefore inhibition of Potassium Voltage-gated Channel, Shal-related Subfamily, Member 1 (KCND1, Accession NM_004979). Accordingly, utilities of VGAM1924 include diagnosis, prevention and treatment of diseases and clinical conditions associated with KCND1. KIAA0133 (Accession NM_014777) is another VGAM1924 host target gene. KIAA0133 BINDING SITE is HOST TARGET binding site found in the 3' untranslated region of mRNA encoded by KIAA0133, corresponding to a HOST TARGET binding site such as BINDING SITE I, BINDING SITE II or BINDING SITE III. Table 2 illustrates the complementarity of the nucleotide sequences of KIAA0133 BINDING SITE, designated SEQ ID:16611, to the nucleotide sequence of VGAM1924 RNA, herein designated VGAM RNA, also designated SEQ ID:4635.

Another function of VGAM1924 is therefore inhibition of KIAA0133 (Accession NM_014777). Accordingly, utilities of VGAM1924 include diagnosis, prevention and treatment of diseases and clinical conditions associated with KIAA0133. KIAA0210 (Accession NM_014744) is another VGAM1924 host target gene. KIAA0210 BINDING SITE is HOST TARGET binding site found in the 3' untranslated region of mRNA encoded by KIAA0210, corresponding to a HOST TARGET binding site such as BINDING SITE I, BINDING SITE II or BINDING SITE III. Table 2 illustrates the complementarity of the nucleotide sequences of KIAA0210 BINDING SITE, designated SEQ ID:16420, to the nucleotide sequence of VGAM1924 RNA, herein designated VGAM RNA, also designated SEQ ID:4635.

Another function of VGAM1924 is therefore inhibition of KIAA0210 (Accession NM_014744). Accordingly, utilities of VGAM1924 include diagnosis, prevention and treatment of diseases and clinical conditions associated with KIAA0210. KIAA0218 (Accession NM_014760) is another VGAM1924 host target gene. KIAA0218 BINDING SITE is HOST TARGET binding site found in the 5' untranslated region of mRNA encoded by KIAA0218, corresponding to a HOST TARGET binding site such as BINDING SITE I, BINDING SITE II or BINDING SITE III. Table 2 illustrates the complementarity of the nucleotide sequences of KIAA0218 BINDING SITE, designated SEQ ID:16520, to the nucleotide sequence of VGAM1924 RNA, herein designated VGAM RNA, also designated SEQ ID:4635.

Another function of VGAM1924 is therefore inhibition of KIAA0218 (Accession NM_014760). Accordingly, utilities of VGAM1924 include diagnosis, prevention and treatment of diseases and clinical conditions associated with KIAA0218. KIAA0232 (Accession XM_052627) is another VGAM1924 host target gene. KIAA0232 BINDING SITE is HOST TARGET binding site found in the 3' untranslated region of mRNA encoded by KIAA0232, corresponding to a HOST TARGET binding site such as BINDING SITE I, BINDING SITE II or BINDING SITE III. Table 2 illustrates the complementarity of the nucleotide sequences of KIAA0232 BINDING SITE, designated SEQ ID:36035, to the nucleotide sequence of VGAM1924 RNA, herein designated VGAM RNA, also designated SEQ ID:4635.

Another function of VGAM1924 is therefore inhibition of KIAA0232 (Accession XM_052627). Accordingly, utilities of VGAM1924 include diagnosis, prevention and treatment of diseases and clinical conditions associated with KIAA0232. KIAA0252 (Accession XM_031646) is another VGAM1924 host target gene. KIAA0252 BINDING SITE is HOST TARGET binding site found in the 3' untranslated region of mRNA encoded by KIAA0252, corresponding to a HOST TARGET binding site such as BINDING SITE I, BINDING SITE II or BINDING SITE III. Table 2 illustrates the complementarity of the nucleotide sequences of KIAA0252 BINDING SITE, designated SEQ ID:31450, to the nucleotide sequence of VGAM1924 RNA, herein designated VGAM RNA, also designated SEQ ID:4635.

Another function of VGAM1924 is therefore inhibition of KIAA0252 (Accession XM_031646). Accordingly, utilities of VGAM1924 include diagnosis, prevention and treatment of diseases and clinical conditions associated with KIAA0252. KIAA0322 (Accession XM_166591) is another VGAM1924 host target gene. KIAA0322 BINDING SITE is HOST TARGET binding site found in the 3' untranslated region of mRNA encoded by KIAA0322, corresponding to a HOST TARGET binding site such as BINDING SITE I, BINDING SITE II or BINDING SITE III. Table 2 illustrates the complementarity of the nucleotide sequences of KIAA0322 BINDING SITE, designated SEQ ID:44562, to the nucleotide sequence of VGAM1924 RNA, herein designated VGAM RNA, also designated SEQ ID:4635.

Another function of VGAM1924 is therefore inhibition of KIAA0322 (Accession XM_166591). Accordingly, utilities of VGAM1924 include diagnosis, prevention and treatment of diseases and clinical conditions associated with KIAA0322. KIAA0332 (Accession XM_031553) is another VGAM1924 host target gene. KIAA0332 BINDING SITE is HOST TARGET binding site found in the 3' untranslated region of mRNA encoded by KIAA0332, corresponding to a HOST TARGET binding site such as BINDING SITE I, BINDING SITE II or BINDING SITE III. Table 2 illustrates the complementarity of the nucleotide sequences of KIAA0332 BINDING SITE, designated SEQ ID:31421, to the nucleotide sequence of VGAM1924 RNA, herein designated VGAM RNA, also designated SEQ ID:4635.

Another function of VGAM1924 is therefore inhibition of KIAA0332 (Accession XM_031553). Accordingly, utilities of VGAM1924 include diagnosis, prevention and treatment of diseases and clinical conditions associated with KIAA0332. KIAA0408 (Accession NM_014702) is another VGAM1924 host target gene. KIAA0408 BINDING SITE is HOST TARGET binding site found in the 3' untranslated region of mRNA encoded by KIAA0408, corresponding to a HOST TARGET binding site such as BINDING SITE I, BINDING SITE II or BINDING SITE III. Table 2 illustrates the complementarity of the nucleotide sequences of KIAA0408 BINDING SITE, designated SEQ ID:16233, to the nucleotide sequence of VGAM1924 RNA, herein designated VGAM RNA, also designated SEQ ID:4635.

Another function of VGAM1924 is therefore inhibition of KIAA0408 (Accession NM_014702). Accordingly, utilities of VGAM1924 include diagnosis, prevention and treatment of diseases and clinical conditions associated with KIAA0408. KIAA0417 (Accession XM_048898) is another VGAM1924 host target gene. KIAA0417 BINDING SITE is HOST TARGET binding site found in the 3' untranslated region of mRNA encoded by KIAA0417, corresponding to a HOST TARGET binding site such as BINDING SITE I, BINDING SITE II or BINDING SITE III. Table 2 illustrates the complementarity of the nucleotide sequences of KIAA0417 BINDING SITE, designated SEQ ID:35289, to the nucleotide sequence of VGAM1924 RNA, herein designated VGAM RNA, also designated SEQ ID:4635.

Another function of VGAM1924 is therefore inhibition of KIAA0417 (Accession XM_048898). Accordingly, utilities of VGAM1924 include diagnosis, prevention and treatment of diseases and clinical conditions associated with KIAA0417. KIAA0438 (Accession NM_014819) is another VGAM1924 host target gene. KIAA0438 BINDING SITE is HOST TARGET binding site found in the 3' untranslated region of mRNA encoded by KIAA0438, corresponding to a HOST TARGET binding site such as BINDING SITE I, BINDING SITE II or BINDING SITE III. Table 2 illustrates the complementarity of the nucleotide sequences of KIAA0438 BINDING SITE, designated SEQ ID:16786, to the nucleotide sequence of VGAM1924 RNA, herein designated VGAM RNA, also designated SEQ ID:4635.

Another function of VGAM1924 is therefore inhibition of KIAA0438 (Accession NM_014819). Accordingly, utilities of VGAM1924 include diagnosis, prevention and treatment of diseases and clinical conditions associated with KIAA0438. KIAA0478 (Accession NM_014870) is another VGAM1924 host target gene. KIAA0478 BINDING SITE is HOST TARGET binding site found in the 3' untranslated region of mRNA encoded by KIAA0478, corresponding to a HOST TARGET binding site such as BINDING SITE I, BINDING SITE II or BINDING SITE III. Table 2 illustrates the complementarity of the nucleotide sequences of KIAA0478 BINDING SITE, designated SEQ ID:16986, to the nucleotide sequence of VGAM1924 RNA, herein designated VGAM RNA, also designated SEQ ID:4635.

Another function of VGAM1924 is therefore inhibition of KIAA0478 (Accession NM_014870). Accordingly, utilities of VGAM1924 include diagnosis, prevention and treatment of diseases and clinical conditions associated with KIAA0478. KIAA0493 (Accession XM_034717) is another VGAM1924 host target gene. KIAA0493 BINDING SITE is HOST TARGET binding site found in the 5' untranslated region of mRNA encoded by KIAA0493, corresponding to a HOST TARGET binding site such as BINDING SITE I, BINDING SITE II or BINDING SITE III. Table 2 illustrates the complementarity of the nucleotide sequences of KIAA0493 BINDING SITE, designated SEQ ID:32139, to the nucleotide sequence of VGAM1924 RNA, herein designated VGAM RNA, also designated SEQ ID:4635.

Another function of VGAM1924 is therefore inhibition of KIAA0493 (Accession XM_034717). Accordingly, utilities of VGAM1924 include diagnosis, prevention and treatment of diseases and clinical conditions associated with KIAA0493. KIAA0565 (Accession XM_039912) is another VGAM1924 host target gene. KIAA0565 BINDING SITE is HOST TARGET binding site found in the 3' untranslated region of mRNA encoded by KIAA0565, corresponding to a HOST TARGET binding site such as BINDING SITE I, BINDING SITE II or BINDING SITE III. Table 2 illustrates the complementarity of the nucleotide sequences of KIAA0565 BINDING SITE, designated SEQ ID:33224, to the nucleotide sequence of VGAM1924 RNA, herein designated VGAM RNA, also designated SEQ ID:4635.

Another function of VGAM1924 is therefore inhibition of KIAA0565 (Accession XM_039912). Accordingly, utilities of VGAM1924 include diagnosis, prevention and treatment of diseases and clinical conditions associated with KIAA0565. KIAA0648 (Accession XM_094043) is another VGAM1924 host target gene. KIAA0648 BINDING SITE is HOST TARGET binding site found in the 3' untranslated region of mRNA encoded by KIAA0648, corresponding to a HOST TARGET binding site such as BINDING SITE I, BINDING SITE II or BINDING SITE III. Table 2 illustrates the complementarity of the nucleotide sequences of KIAA0648 BINDING SITE, designated SEQ ID:40221, to the nucleotide sequence of VGAM1924 RNA, herein designated VGAM RNA, also designated SEQ ID:4635.

Another function of VGAM1924 is therefore inhibition of KIAA0648 (Accession XM_094043). Accordingly, utilities of VGAM1924 include diagnosis, prevention and treatment of diseases and clinical conditions associated with KIAA0648. KIAA0663 (Accession NM_014827) is another VGAM1924 host target gene. KIAA0663 BINDING SITE is HOST TARGET binding site found in the 3' untranslated region of mRNA encoded by KIAA0663, corresponding to a HOST TARGET binding site such as BINDING SITE I, BINDING SITE II or BINDING SITE III. Table 2 illustrates the complementarity of the nucleotide sequences of KIAA0663 BINDING SITE, designated SEQ ID:16812, to the nucleotide sequence of VGAM1924 RNA, herein designated VGAM RNA, also designated SEQ ID:4635.

Another function of VGAM1924 is therefore inhibition of KIAA0663 (Accession NM_014827). Accordingly, utilities of VGAM1924 include diagnosis, prevention and treatment of diseases and clinical conditions associated with KIAA0663. KIAA0779 (Accession XM_098229) is another VGAM1924 host target gene. KIAA0779 BINDING SITE is HOST TARGET binding site found in the 3' untranslated region of mRNA encoded by KIAA0779, corresponding to a HOST TARGET binding site such as BINDING SITE I, BINDING SITE II or BINDING SITE III. Table 2 illustrates the complementarity of the nucleotide sequences of KIAA0779 BINDING SITE, designated SEQ ID:41503, to the nucleotide sequence of VGAM1924 RNA, herein designated VGAM RNA, also designated SEQ ID:4635.

Another function of VGAM1924 is therefore inhibition of KIAA0779 (Accession XM_098229). Accordingly, utilities of VGAM1924 include diagnosis, prevention and treatment of diseases and clinical conditions associated with KIAA0779. KIAA0830 (Accession XM_045759) is another VGAM1924 host target gene. KIAA0830 BINDING SITE is HOST TARGET binding site found in the 3' untranslated region of mRNA encoded by KIAA0830, corresponding to a HOST TARGET binding site such as BINDING SITE I, BINDING SITE II or BINDING SITE III. Table 2 illustrates the complementarity of the nucleotide sequences of KIAA0830 BINDING SITE, designated SEQ ID:34546, to the nucleotide sequence of VGAM1924 RNA, herein designated VGAM RNA, also designated SEQ ID:4635.

Another function of VGAM1924 is therefore inhibition of KIAA0830 (Accession XM_045759). Accordingly, utilities of VGAM1924 include diagnosis, prevention and treatment of diseases and clinical conditions associated with KIAA0830. KIAA0854 (Accession NM_014943) is another VGAM1924 host target gene. KIAA0854 BINDING SITE is HOST TARGET binding site found in the 3' untranslated region of mRNA encoded by KIAA0854, corresponding to a HOST TARGET binding site such as BINDING SITE I, BINDING SITE II or BINDING SITE III. Table 2 illustrates the complementarity of the nucleotide sequences of KIAA0854 BINDING SITE, designated SEQ ID:17255, to the nucleotide sequence of VGAM1924 RNA, herein designated VGAM RNA, also designated SEQ ID:4635.

Another function of VGAM1924 is therefore inhibition of KIAA0854 (Accession NM_014943). Accordingly, utilities of VGAM1924 include diagnosis, prevention and treatment of diseases and clinical conditions associated with KIAA0854. KIAA0865 (Accession XM_028522) is another VGAM1924 host target gene. KIAA0865 BINDING SITE is HOST TARGET binding site found in the 3' untranslated region of mRNA encoded by KIAA0865, corresponding to a HOST TARGET binding site such as BINDING SITE I, BINDING SITE II or BINDING SITE III. Table 2 illustrates the complementarity of the nucleotide sequences of KIAA0865 BINDING SITE, designated SEQ ID:30710, to the nucleotide sequence of VGAM1924 RNA, herein designated VGAM RNA, also designated SEQ ID:4635.

Another function of VGAM1924 is therefore inhibition of KIAA0865 (Accession XM_028522). Accordingly, utilities of VGAM1924 include diagnosis, prevention and treatment of diseases and clinical conditions associated with KIAA0865. KIAA0884 (Accession XM_046660) is another VGAM1924 host target gene. KIAA0884 BINDING SITE is HOST TARGET binding site found in the 3' untranslated region of mRNA encoded by KIAA0884, corresponding to a HOST TARGET binding site such as BINDING SITE I, BINDING SITE II or BINDING SITE III. Table 2 illustrates the complementarity of the nucleotide sequences of KIAA0884 BINDING SITE, designated SEQ ID:34776, to the nucleotide sequence of VGAM1924 RNA, herein designated VGAM RNA, also designated SEQ ID:4635.

Another function of VGAM1924 is therefore inhibition of KIAA0884 (Accession XM_046660). Accordingly, utilities of VGAM1924 include diagnosis, prevention and treatment of diseases and clinical conditions associated with KIAA0884. KIAA0894 (Accession NM_014896) is another VGAM1924 host target gene. KIAA0894 BINDING SITE is HOST TARGET binding site found in the 3' untranslated region of mRNA encoded by KIAA0894, corresponding to a HOST TARGET binding site such as BINDING SITE I, BINDING SITE II or BINDING SITE III. Table 2 illustrates the complementarity of the nucleotide sequences of KIAA0894 BINDING SITE, designated SEQ ID:17058, to the nucleotide sequence of VGAM1924 RNA, herein designated VGAM RNA, also designated SEQ ID:4635.

Another function of VGAM1924 is therefore inhibition of KIAA0894 (Accession NM_014896). Accordingly, utilities of VGAM1924 include diagnosis, prevention and treatment of diseases and clinical conditions associated with KIAA0894. KIAA0907 (Accession NM_014949) is another VGAM1924 host target gene. KIAA0907 BINDING SITE is HOST TARGET binding site found in the 3' untranslated region of mRNA encoded by KIAA0907, corresponding to a HOST TARGET binding site such as BINDING SITE I, BINDING SITE II or BINDING SITE III. Table 2 illustrates the complementarity of the nucleotide sequences of KIAA0907 BINDING SITE, designated SEQ ID:17276, to the nucleotide sequence of VGAM1924 RNA, herein designated VGAM RNA, also designated SEQ ID:4635.

Another function of VGAM1924 is therefore inhibition of KIAA0907 (Accession NM_014949). Accordingly, utilities of VGAM1924 include diagnosis, prevention and treatment of diseases and clinical conditions associated with KIAA0907. KIAA0979 (Accession NM_015032) is another VGAM1924 host target gene. KIAA0979 BINDING SITE is HOST TARGET binding site found in the 3' untranslated region of mRNA encoded by KIAA0979, corresponding to a HOST TARGET binding site such as BINDING SITE I, BINDING SITE II or BINDING SITE III. Table 2 illustrates the complementarity of the nucleotide sequences of KIAA0979 BINDING SITE, designated SEQ ID:17386, to the nucleotide sequence of VGAM1924 RNA, herein designated VGAM RNA, also designated SEQ ID:4635.

Another function of VGAM1924 is therefore inhibition of KIAA0979 (Accession NM_015032). Accordingly, utilities of VGAM1924 include diagnosis, prevention and treatment of diseases and clinical conditions associated with KIAA0979. KIAA0981 (Accession XM_028867) is another VGAM1924 host target gene. KIAA0981 BINDING SITE is HOST TARGET binding site found in the 3' untranslated region of mRNA encoded by KIAA0981, corresponding to a HOST TARGET binding site such as BINDING SITE I, BINDING SITE II or BINDING SITE III. Table 2 illustrates the complementarity of the nucleotide sequences of KIAA0981 BINDING SITE, designated SEQ ID:30797, to the nucleotide sequence of VGAM1924 RNA, herein designated VGAM RNA, also designated SEQ ID:4635.

Another function of VGAM1924 is therefore inhibition of KIAA0981 (Accession XM_028867). Accordingly, utilities of VGAM1924 include diagnosis, prevention and treatment of diseases and clinical conditions associated with KIAA0981. KIAA1025 (Accession XM_034056) is another VGAM1924 host target gene. KIAA1025 BINDING SITE is HOST TARGET binding site found in the 3' untranslated region of mRNA encoded by KIAA1025, corresponding to a HOST TARGET binding site such as BINDING SITE I, BINDING SITE II or BINDING SITE III. Table 2 illustrates the complementarity of the nucleotide sequences of KIAA1025 BINDING SITE, designated SEQ ID:31997, to the nucleotide sequence of VGAM1924 RNA, herein designated VGAM RNA, also designated SEQ ID:4635.

Another function of VGAM1924 is therefore inhibition of KIAA1025 (Accession XM_034056). Accordingly, utilities of VGAM1924 include diagnosis, prevention and treatment of diseases and clinical conditions associated with KIAA1025. KIAA1026 (Accession XM_048825) is another VGAM1924 host target gene. KIAA1026 BINDING SITE is HOST TARGET binding site found in the 3' untranslated region of mRNA encoded by KIAA1026, corresponding to a HOST TARGET binding site such as BINDING SITE I, BINDING SITE II or BINDING SITE III. Table 2 illustrates the complementarity of the nucleotide sequences of KIAA1026 BINDING SITE, designated SEQ ID:35274, to the nucleotide sequence of VGAM1924 RNA, herein designated VGAM RNA, also designated SEQ ID:4635.

Another function of VGAM1924 is therefore inhibition of KIAA1026 (Accession XM_048825). Accordingly, utilities of VGAM1924 include diagnosis, prevention and treatment of diseases and clinical conditions associated with KIAA1026. KIAA1055 (Accession XM_038509) is another VGAM1924 host target gene. KIAA1055 BINDING SITE is HOST TARGET binding site found in the 3' untranslated region of mRNA encoded by KIAA1055, corresponding to a HOST TARGET binding site such as BINDING SITE I, BINDING SITE II or BINDING SITE III. Table 2 illustrates the complementarity of the nucleotide sequences of KIAA1055 BINDING SITE, designated SEQ ID:32850, to the nucleotide sequence of VGAM1924 RNA, herein designated VGAM RNA, also designated SEQ ID:4635.

Another function of VGAM1924 is therefore inhibition of KIAA1055 (Accession XM_038509). Accordingly, utilities of VGAM1924 include diagnosis, prevention and treatment of diseases and clinical conditions associated with KIAA1055. KIAA1145 (Accession XM_037790) is another VGAM1924 host target gene. KIAA1145 BINDING SITE is HOST TARGET binding site found in the 3' untranslated region of mRNA encoded by KIAA1145, corresponding to a HOST TARGET binding site such as BINDING SITE I, BINDING SITE II or BINDING SITE III. Table 2 illustrates the complementarity of the nucleotide sequences of KIAA1145 BINDING SITE, designated SEQ ID:32680, to the nucleotide sequence of VGAM1924 RNA, herein designated VGAM RNA, also designated SEQ ID:4635.

Another function of VGAM1924 is therefore inhibition of KIAA1145 (Accession XM_037790). Accordingly, utilities of VGAM1924 include diagnosis, prevention and treatment of diseases and clinical conditions associated with KIAA1145. KIAA1210 (Accession XM_172801) is another VGAM1924 host target gene. KIAA1210 BINDING SITE is HOST TARGET binding site found in the 3' untranslated region of mRNA encoded by KIAA1210, corresponding to a HOST TARGET binding site such as BINDING SITE I, BINDING SITE II or BINDING SITE III. Table 2 illustrates the complementarity of the nucleotide sequences of KIAA1210 BINDING SITE, designated SEQ ID:46088, to the nucleotide sequence of VGAM1924 RNA, herein designated VGAM RNA, also designated SEQ ID:4635.

Another function of VGAM1924 is therefore inhibition of KIAA1210 (Accession XM_172801). Accordingly, utilities of VGAM1924 include diagnosis, prevention and treatment of diseases and clinical conditions associated with KIAA1210. KIAA1233 (Accession XM_032181) is another VGAM1924 host target gene. KIAA1233 BINDING SITE is HOST TARGET binding site found in the 3' untranslated region of mRNA encoded by KIAA1233, corresponding to a HOST TARGET binding site such as BINDING SITE I, BINDING SITE II or BINDING SITE III. Table 2 illustrates the complementarity of the nucleotide sequences of KIAA1233 BINDING SITE, designated SEQ ID:31593, to the nucleotide sequence of VGAM1924 RNA, herein designated VGAM RNA, also designated SEQ ID:4635.

Another function of VGAM1924 is therefore inhibition of KIAA1233 (Accession XM_032181). Accordingly, utilities of VGAM1924 include diagnosis, prevention and treatment of diseases and clinical conditions associated with KIAA1233. KIAA1277 (Accession XM_035114) is another VGAM1924 host target gene. KIAA1277 BINDING SITE is HOST TARGET binding site found in the 3' untranslated region of mRNA encoded by KIAA1277, corresponding to a HOST TARGET binding site such as BINDING SITE I, BINDING SITE II or BINDING SITE III. Table 2 illustrates the complementarity of the nucleotide sequences of KIAA1277 BINDING SITE, designated SEQ ID:32205, to the nucleotide sequence of VGAM1924 RNA, herein designated VGAM RNA, also designated SEQ ID:4635.

Another function of VGAM1924 is therefore inhibition of KIAA1277 (Accession XM_035114). Accordingly, utilities of VGAM1924 include diagnosis, prevention and treatment of diseases and clinical conditions associated with KIAA1277. KIAA1323 (Accession XM_032146) is another VGAM1924 host target gene. KIAA1323 BINDING SITE is HOST TARGET binding site found in the 3' untranslated region of mRNA encoded by KIAA1323, corresponding to a HOST TARGET binding site such as BINDING SITE I, BINDING SITE II or BINDING SITE III. Table 2 illustrates the complementarity of the nucleotide sequences of KIAA1323 BINDING SITE, designated SEQ ID:31564, to the nucleotide sequence of VGAM1924 RNA, herein designated VGAM RNA, also designated SEQ ID:4635.

Another function of VGAM1924 is therefore inhibition of KIAA1323 (Accession XM_032146). Accordingly, utilities of VGAM1924 include diagnosis, prevention and treatment of diseases and clinical conditions associated with KIAA1323. KIAA1336 (Accession XM_051306) is another VGAM1924 host target gene. KIAA1336 BINDING SITE is HOST TARGET binding site found in the 3' untranslated region of mRNA encoded by KIAA1336, corresponding to a HOST TARGET binding site such as BINDING SITE I, BINDING SITE II or BINDING SITE III. Table 2 illustrates the complementarity of the nucleotide sequences of KIAA1336 BINDING SITE, designated SEQ ID:35801, to the nucleotide sequence of VGAM1924 RNA, herein designated VGAM RNA, also designated SEQ ID:4635.

Another function of VGAM1924 is therefore inhibition of KIAA1336 (Accession XM_051306). Accordingly, utilities of VGAM1924 include diagnosis, prevention and treatment of diseases and clinical conditions associated with KIAA1336. KIAA1357 (Accession XM_050421) is another VGAM1924 host target gene. KIAA1357 BINDING SITE is HOST TARGET binding site found in the 3' untranslated region of mRNA encoded by KIAA1357, corresponding to a HOST TARGET binding site such as BINDING SITE I, BINDING SITE II or BINDING SITE III. Table 2 illustrates the complementarity of the nucleotide sequences of KIAA1357 BINDING SITE, designated SEQ ID:35628, to the nucleotide sequence of VGAM1924 RNA, herein designated VGAM RNA, also designated SEQ ID:4635.

Another function of VGAM1924 is therefore inhibition of KIAA1357 (Accession XM_050421). Accordingly, utilities of VGAM1924 include diagnosis, prevention and treatment of diseases and clinical conditions associated with KIAA1357. KIAA1364 (Accession XM_032997) is another VGAM1924 host target gene. KIAA1364 BINDING SITE is HOST TARGET binding site found in the 3' untranslated region of mRNA encoded by KIAA1364, corresponding to a HOST TARGET binding site such as BINDING SITE I, BINDING SITE II or BINDING SITE III. Table 2 illustrates the complementarity of the nucleotide sequences of KIAA1364 BINDING SITE, designated SEQ ID:31813, to the nucleotide sequence of VGAM1924 RNA, herein designated VGAM RNA, also designated SEQ ID:4635.

Another function of VGAM1924 is therefore inhibition of KIAA1364 (Accession XM_032997). Accordingly, utilities of VGAM1924 include diagnosis, prevention and treatment of diseases and clinical conditions associated with KIAA1364. KIAA1432 (Accession XM_039698) is another VGAM1924 host target gene. KIAA1432 BINDING SITE is HOST TARGET binding site found in the 3' untranslated region of mRNA encoded by KIAA1432, corresponding to a HOST TARGET binding site such as BINDING SITE I, BINDING SITE II or BINDING SITE III. Table 2 illustrates the complementarity of the nucleotide sequences of KIAA1432 BINDING SITE, designated SEQ ID:33153, to the nucleotide sequence of VGAM1924 RNA, herein designated VGAM RNA, also designated SEQ ID:4635.

Another function of VGAM1924 is therefore inhibition of KIAA1432 (Accession XM_039698). Accordingly, utilities of VGAM1924 include diagnosis, prevention and treatment of diseases and clinical conditions associated with KIAA1432. KIAA1463 (Accession XM_051160) is another VGAM1924 host target gene. KIAA1463 BINDING SITE is HOST TARGET binding site found in the 3' untranslated region of mRNA encoded by KIAA1463, corresponding to a HOST TARGET binding site such as BINDING SITE I, BINDING SITE II or BINDING SITE III. Table 2 illustrates the complementarity of the nucleotide sequences of KIAA1463 BINDING SITE, designated SEQ ID:35775, to the nucleotide sequence of VGAM1924 RNA, herein designated VGAM RNA, also designated SEQ ID:4635.

Another function of VGAM1924 is therefore inhibition of KIAA1463 (Accession XM_051160). Accordingly, utilities of VGAM1924 include diagnosis, prevention and treatment of diseases and clinical conditions associated with KIAA1463. KIAA1495 (Accession XM_055080) is another VGAM1924 host target gene. KIAA1495 BINDING SITE is HOST TARGET binding site found in the 3' untranslated region of mRNA encoded by KIAA1495, corresponding to a HOST TARGET binding site such as BINDING SITE I, BINDING SITE II or BINDING SITE III. Table 2 illustrates the complementarity of the nucleotide sequences of KIAA1495 BINDING SITE, designated SEQ ID:36225, to the nucleotide sequence of VGAM1924 RNA, herein designated VGAM RNA, also designated SEQ ID:4635.

Another function of VGAM1924 is therefore inhibition of KIAA1495 (Accession XM_055080). Accordingly, utilities of VGAM1924 include diagnosis, prevention and treatment of diseases and clinical conditions associated with KIAA1495. KIAA1505 (Accession XM_168469) is another VGAM1924 host target gene. KIAA1505 BINDING SITE is HOST TARGET binding site found in the 5' untranslated region of mRNA encoded by KIAA1505, corresponding to a HOST TARGET binding site such as BINDING SITE I, BINDING SITE II or BINDING SITE III. Table 2 illustrates the complementarity of the nucleotide sequences of KIAA1505 BINDING SITE, designated SEQ ID:45194, to the nucleotide sequence of VGAM1924 RNA, herein designated VGAM RNA, also designated SEQ ID:4635.

Another function of VGAM1924 is therefore inhibition of KIAA1505 (Accession XM_168469). Accordingly, utilities of VGAM1924 include diagnosis, prevention and treatment of diseases and clinical conditions associated with KIAA1505. KIAA1509 (Accession XM_029353) is another VGAM1924 host target gene. KIAA1509 BINDING SITE is HOST TARGET binding site found in the 3' untranslated region of mRNA encoded by KIAA1509, corresponding to a HOST TARGET binding site such as BINDING SITE I, BINDING SITE II or BINDING SITE III. Table 2 illustrates the complementarity of the nucleotide sequences of KIAA1509 BINDING SITE, designated SEQ ID:30876, to the nucleotide sequence of VGAM1924 RNA, herein designated VGAM RNA, also designated SEQ ID:4635.

Another function of VGAM1924 is therefore inhibition of KIAA1509 (Accession XM_029353). Accordingly, utilities of VGAM1924 include diagnosis, prevention and treatment of diseases and clinical conditions associated with KIAA1509. KIAA1594 (Accession XM_050754) is another VGAM1924 host target gene. KIAA1594 BINDING SITE is HOST TARGET binding site found in the 3' untranslated region of mRNA encoded by KIAA1594, corresponding to a HOST TARGET binding site such as BINDING SITE I, BINDING SITE II or BINDING SITE III. Table 2 illustrates the complementarity of the nucleotide sequences of KIAA1594 BINDING SITE, designated SEQ ID:35674, to the nucleotide sequence of VGAM1924 RNA, herein designated VGAM RNA, also designated SEQ ID:4635.

Another function of VGAM1924 is therefore inhibition of KIAA1594 (Accession XM_050754). Accordingly, utilities of VGAM1924 include diagnosis, prevention and treatment of diseases and clinical conditions associated with KIAA1594. KIAA1610 (Accession XM_040622) is another VGAM1924 host target gene. KIAA1610 BINDING SITE is HOST TARGET binding site found in the 3' untranslated region of mRNA encoded by KIAA1610, corresponding to a HOST TARGET binding site such as BINDING SITE I, BINDING SITE II or BINDING SITE III. Table 2 illustrates the complementarity of the nucleotide sequences of KIAA1610 BINDING SITE, designated SEQ ID:33342, to the nucleotide sequence of VGAM1924 RNA, herein designated VGAM RNA, also designated SEQ ID:4635.

Another function of VGAM1924 is therefore inhibition of KIAA1610 (Accession XM_040622). Accordingly, utilities of VGAM1924 include diagnosis, prevention and treatment of diseases and clinical conditions associated with KIAA1610. KIAA1613 (Accession XM_035946) is another VGAM1924 host target gene. KIAA1613 BINDING SITE is HOST TARGET binding site found in the 3' untranslated region of mRNA encoded by KIAA1613, corresponding to a HOST TARGET binding site such as BINDING SITE I, BINDING SITE II or BINDING SITE III. Table 2 illustrates the complementarity of the nucleotide sequences of KIAA1613 BINDING SITE, designated SEQ ID:32359, to the nucleotide sequence of VGAM1924 RNA, herein designated VGAM RNA, also designated SEQ ID:4635.

Another function of VGAM1924 is therefore inhibition of KIAA1613 (Accession XM_035946). Accordingly, utilities of VGAM1924 include diagnosis, prevention and treatment of diseases and clinical conditions associated with KIAA1613. KIAA1727 (Accession XM_034262) is another VGAM1924 host target gene. KIAA1727 BINDING SITE is HOST TARGET binding site found in the 3' untranslated region of mRNA encoded by KIAA1727, corresponding to a HOST TARGET binding site such as BINDING SITE I, BINDING SITE II or BINDING SITE III. Table 2 illustrates the complementarity of the nucleotide sequences of KIAA1727 BINDING SITE, designated SEQ ID:32030, to the nucleotide sequence of VGAM1924 RNA, herein designated VGAM RNA, also designated SEQ ID:4635.

Another function of VGAM1924 is therefore inhibition of KIAA1727 (Accession XM_034262). Accordingly, utilities of VGAM1924 include diagnosis, prevention and treatment of diseases and clinical conditions associated with KIAA1727. KIAA1765 (Accession XM_047355) is another VGAM1924 host target gene. KIAA1765 BINDING SITE is HOST TARGET binding site found in the 3' untranslated region of mRNA encoded by KIAA1765, corresponding to a HOST TARGET binding site such as BINDING SITE I, BINDING SITE II or BINDING SITE III. Table 2 illustrates the complementarity of the nucleotide sequences of KIAA1765 BINDING SITE, designated SEQ ID:34956, to the nucleotide sequence of VGAM1924 RNA, herein designated VGAM RNA, also designated SEQ ID:4635.

Another function of VGAM1924 is therefore inhibition of KIAA1765 (Accession XM_047355). Accordingly, utilities of VGAM1924 include diagnosis, prevention and treatment of diseases and clinical conditions associated with KIAA1765. KIAA1822 (Accession XM_041566) is another VGAM1924 host target gene. KIAA1822 BINDING SITE is HOST TARGET binding site found in the 3' untranslated region of mRNA encoded by KIAA1822, corresponding to a HOST TARGET binding site such as BINDING SITE I, BINDING SITE II or BINDING SITE III. Table 2 illustrates the complementarity of the nucleotide sequences of KIAA1822 BINDING SITE, designated SEQ ID:33551, to the nucleotide sequence of VGAM1924 RNA, herein designated VGAM RNA, also designated SEQ ID:4635.

Another function of VGAM1924 is therefore inhibition of KIAA1822 (Accession XM_041566). Accordingly, utilities of VGAM1924 include diagnosis, prevention and treatment of diseases and clinical conditions associated with KIAA1822. KIAA1918 (Accession XM_054951) is another VGAM1924 host target gene. KIAA1918 BINDING SITE is HOST TARGET binding site found in the 3' untranslated region of mRNA encoded by KIAA1918, corresponding to a HOST TARGET binding site such as BINDING SITE I, BINDING SITE II or BINDING SITE III. Table 2 illustrates the complementarity of the nucleotide sequences of KIAA1918 BINDING SITE, designated SEQ ID:36217, to the nucleotide sequence of VGAM1924 RNA, herein designated VGAM RNA, also designated SEQ ID:4635.

Another function of VGAM1924 is therefore inhibition of KIAA1918 (Accession XM_054951). Accordingly, utilities of VGAM1924 include diagnosis, prevention and treatment of diseases and clinical conditions associated with KIAA1918. Keratin, Hair, Basic, 2 (KRTHB2, Accession NM_033033) is another VGAM1924 host target gene. KRTHB2 BINDING SITE is HOST TARGET binding site found in the 3' untranslated region of mRNA encoded by KRTHB2, corresponding to a HOST TARGET binding site such as BINDING SITE I, BINDING SITE II or BINDING SITE III. Table 2 illustrates the complementarity of the nucleotide sequences of KRTHB2 BINDING SITE, designated SEQ ID:26925, to the nucleotide sequence of VGAM1924 RNA, herein designated VGAM RNA, also designated SEQ ID:4635.

Another function of VGAM1924 is therefore inhibition of Keratin, Hair, Basic, 2 (KRTHB2, Accession NM_033033). Accordingly, utilities of VGAM1924 include diagnosis, prevention and treatment of diseases and clinical conditions associated with KRTHB2. LALP1 (Accession NM_020354) is another VGAM1924 host target gene. LALP1 BINDING SITE is HOST TARGET binding site found in the 3' untranslated region of mRNA encoded by LALP1, corresponding to a HOST TARGET binding site such as BINDING SITE I, BINDING SITE II or BINDING SITE III. Table 2 illustrates the complementarity of the nucleotide sequences of LALP1 BINDING SITE, designated SEQ ID:21623, to the nucleotide sequence of VGAM1924 RNA, herein designated VGAM RNA, also designated SEQ ID:4635.

Another function of VGAM1924 is therefore inhibition of LALP1 (Accession NM_020354). Accordingly, utilities of VGAM1924 include diagnosis, prevention and treatment of diseases and clinical conditions associated with LALP1. LIN-28 (Accession NM_024674) is another VGAM1924 host target gene. LIN-28 BINDING SITE is HOST TARGET binding site found in the 3' untranslated region of mRNA encoded by LIN-28, corresponding to a HOST TARGET binding site such as BINDING SITE I, BINDING SITE II or BINDING SITE III. Table 2 illustrates the complementarity of the nucleotide sequences of LIN-28 BINDING SITE, designated SEQ ID:23979, to the nucleotide sequence of VGAM1924 RNA, herein designated VGAM RNA, also designated SEQ ID:4635.

Another function of VGAM1924 is therefore inhibition of LIN-28 (Accession NM_024674). Accordingly, utilities of VGAM1924 include diagnosis, prevention and treatment of diseases and clinical conditions associated with LIN-28. Leucine Rich Repeat (in FLII) Interacting Protein 1 (LRRFIP1, Accession NM_004735) is another VGAM1924 host target gene. LRRFIP1 BINDING SITE is HOST TARGET binding site found in the 3' untranslated region of mRNA encoded by LRRFIP1, corresponding to a HOST TARGET binding site such as BINDING SITE I, BINDING SITE II or BINDING SITE III. Table 2 illustrates the complementarity of the nucleotide sequences of LRRFIP1 BINDING SITE, designated SEQ ID:11121, to the nucleotide sequence of VGAM1924 RNA, herein designated VGAM RNA, also designated SEQ ID:4635.

Another function of VGAM1924 is therefore inhibition of Leucine Rich Repeat (in FLII) Interacting Protein 1 (LRRFIP1, Accession NM_004735). Accordingly, utilities of VGAM1924 include diagnosis, prevention and treatment of diseases and clinical conditions associated with LRRFIP1. Mitogen-activated Protein Kinase Kinase 6 (MAP2K6, Accession NM_002758) is another VGAM1924 host target gene. MAP2K6 BINDING SITE1 and MAP2K6 BINDING SITE2 are HOST TARGET binding sites found in untranslated regions of mRNA encoded by MAP2K6, corresponding to HOST TARGET binding sites such as BINDING SITE I, BINDING SITE II or BINDING SITE III. Table 2 illustrates the complementarity of the nucleotide sequences of MAP2K6 BINDING SITE1 and MAP2K6 BINDING SITE2, designated SEQ ID:8643 and SEQ ID:25702 respectively, to the nucleotide sequence of VGAM1924 RNA, herein designated VGAM RNA, also designated SEQ ID:4635.

Another function of VGAM1924 is therefore inhibition of Mitogen-activated Protein Kinase Kinase 6 (MAP2K6, Accession NM_002758). Accordingly, utilities of VGAM1924 include diagnosis, prevention and treatment of diseases and clinical conditions associated with MAP2K6. Mitogen-activated Protein Kinase Kinase Kinase Kinase 3 (MAP4K3, Accession NM_003618) is another VGAM1924 host target gene. MAP4K3 BINDING SITE1 and MAP4K3 BINDING SITE2 are HOST TARGET binding sites found in untranslated regions of mRNA encoded by MAP4K3, corresponding to HOST TARGET binding sites such as BINDING SITE I, BINDING SITE II or BINDING SITE III. Table 2 illustrates the complementarity of the nucleotide sequences of MAP4K3 BINDING SITE1 and MAP4K3 BINDING SITE2, designated SEQ ID:9683 and SEQ ID:20595 respectively, to the nucleotide sequence of VGAM1924 RNA, herein designated VGAM RNA, also designated SEQ ID:4635.

Another function of VGAM1924 is therefore inhibition of Mitogen-activated Protein Kinase Kinase Kinase Kinase 3 (MAP4K3, Accession NM_003618). Accordingly, utilities of VGAM1924 include diagnosis, prevention and treatment of diseases and clinical conditions associated with MAP4K3. MGC11034 (Accession NM_031453) is another VGAM1924 host target gene. MGC11034 BINDING SITE is HOST TARGET binding site found in the 3' untranslated region of mRNA encoded by MGC11034, corresponding to a HOST TARGET binding site such as BINDING SITE I, BINDING SITE II or BINDING SITE III. Table 2 illustrates the complementarity of the nucleotide sequences of MGC11034 BINDING SITE, designated SEQ ID:25472, to the nucleotide sequence of VGAM1924 RNA, herein designated VGAM RNA, also designated SEQ ID:4635.

Another function of VGAM1924 is therefore inhibition of MGC11034 (Accession NM_031453). Accordingly, utilities of VGAM1924 include diagnosis, prevention and treatment of diseases and clinical conditions associated with MGC11034. MGC12335 (Accession NM_032744) is another VGAM1924 host target gene. MGC12335 BINDING SITE is HOST TARGET binding site found in the 3' untranslated region of mRNA encoded by MGC12335, corresponding to a HOST TARGET binding site such as BINDING SITE I, BINDING SITE II or BINDING SITE III. Table 2 illustrates the complementarity of the nucleotide sequences of MGC12335 BINDING SITE, designated SEQ ID:26476, to the nucleotide sequence of VGAM1924 RNA, herein designated VGAM RNA, also designated SEQ ID:4635.

Another function of VGAM1924 is therefore inhibition of MGC12335 (Accession NM_032744). Accordingly, utilities of VGAM1924 include diagnosis, prevention and treatment of diseases and clinical conditions associated with MGC12335. MGC12518 (Accession XM_034301) is another VGAM1924 host target gene. MGC12518 BINDING SITE is HOST TARGET binding site found in the 3' untranslated region of mRNA encoded by MGC12518, corresponding to a HOST TARGET binding site such as BINDING SITE I, BINDING SITE II or BINDING SITE III. Table 2 illustrates the complementarity of the nucleotide sequences of MGC12518 BINDING SITE, designated SEQ ID:32046, to the nucleotide sequence of VGAM1924 RNA, herein designated VGAM RNA, also designated SEQ ID:4635.

Another function of VGAM1924 is therefore inhibition of MGC12518 (Accession XM_034301). Accordingly, utilities of VGAM1924 include diagnosis, prevention and treatment of diseases and clinical conditions associated with MGC12518. MGC13090 (Accession NM_032711) is another VGAM1924 host target gene. MGC13090 BINDING SITE is HOST TARGET binding site found in the 3' untranslated region of mRNA encoded by MGC13090, corresponding to a HOST TARGET binding site such as BINDING SITE I, BINDING SITE II or BINDING SITE III. Table 2 illustrates the complementarity of the nucleotide sequences of MGC13090 BINDING SITE, designated SEQ ID:26429, to the nucleotide sequence of VGAM1924 RNA, herein designated VGAM RNA, also designated SEQ ID:4635.

Another function of VGAM1924 is therefore inhibition of MGC13090 (Accession NM_032711). Accordingly, utilities of VGAM1924 include diagnosis, prevention and treatment of diseases and clinical conditions associated with MGC13090. MGC13159 (Accession NM_032927) is another VGAM1924 host target gene. MGC13159 BINDING SITE is HOST TARGET binding site found in the 3' untranslated region of mRNA encoded by MGC13159, corresponding to a HOST TARGET binding site such as BINDING SITE I, BINDING SITE II or BINDING SITE III. Table 2 illustrates the complementarity of the nucleotide sequences of MGC13159 BINDING SITE, designated SEQ ID:26752, to the nucleotide sequence of VGAM1924 RNA, herein designated VGAM RNA, also designated SEQ ID:4635.

Another function of VGAM1924 is therefore inhibition of MGC13159 (Accession NM_032927). Accordingly, utilities of VGAM1924 include diagnosis, prevention and treatment of diseases and clinical conditions associated with MGC13159. MGC13183 (Accession NM_032358) is another VGAM1924 host target gene. MGC13183 BINDING SITE is HOST TARGET binding site found in the 3' untranslated region of mRNA encoded by MGC13183, corresponding to a HOST TARGET binding site such as BINDING SITE I, BINDING SITE II or BINDING SITE III. Table 2 illustrates the complementarity of the nucleotide sequences of MGC13183 BINDING SITE, designated SEQ ID:26145, to the nucleotide sequence of VGAM1924 RNA, herein designated VGAM RNA, also designated SEQ ID:4635.

Another function of VGAM1924 is therefore inhibition of MGC13183 (Accession NM_032358). Accordingly, utilities of VGAM1924 include diagnosis, prevention and treatment of diseases and clinical conditions associated with MGC13183. MGC14258 (Accession NM_032900) is another VGAM1924 host target gene. MGC14258 BINDING SITE is HOST TARGET binding site found in the 3' untranslated region of mRNA encoded by MGC14258, corresponding to a HOST TARGET binding site such as BINDING SITE I, BINDING SITE II or BINDING SITE III. Table 2 illustrates the complementarity of the nucleotide sequences of MGC14258 BINDING SITE, designated SEQ ID:26723, to the nucleotide sequence of VGAM1924 RNA, herein designated VGAM RNA, also designated SEQ ID:4635.

Another function of VGAM1924 is therefore inhibition of MGC14258 (Accession NM_032900). Accordingly, utilities of VGAM1924 include diagnosis, prevention and treatment of diseases and clinical conditions associated with MGC14258. MGC14433 (Accession NM_032904) is another VGAM1924 host target gene. MGC14433 BINDING SITE is HOST TARGET binding site found in the 3' untranslated region of mRNA encoded by MGC14433, corresponding to a HOST TARGET binding site such as BINDING SITE I, BINDING SITE II or BINDING SITE III. Table 2 illustrates the complementarity of the nucleotide sequences of MGC14433 BINDING SITE, designated SEQ ID:26726, to the nucleotide sequence of VGAM1924 RNA, herein designated VGAM RNA, also designated SEQ ID:4635.

Another function of VGAM1924 is therefore inhibition of MGC14433 (Accession NM_032904). Accordingly, utilities of VGAM1924 include diagnosis, prevention and treatment of diseases and clinical conditions associated with MGC14433. MGC15437 (Accession NM_032873) is another VGAM1924 host target gene. MGC15437 BINDING SITE is HOST TARGET binding site found in the 3' untranslated region of mRNA encoded by MGC15437, corresponding to a HOST TARGET binding site such as BINDING SITE I, BINDING SITE II or BINDING SITE III. Table 2 illustrates the complementarity of the nucleotide sequences of MGC15437 BINDING SITE, designated SEQ ID:26690, to the nucleotide sequence of VGAM1924 RNA, herein designated VGAM RNA, also designated SEQ ID:4635.

Another function of VGAM1924 is therefore inhibition of MGC15437 (Accession NM_032873). Accordingly, utilities of VGAM1924 include diagnosis, prevention and treatment of diseases and clinical conditions associated with MGC15437. MGC2508 (Accession NM_024327) is another VGAM1924 host target gene. MGC2508 BINDING SITE is HOST TARGET binding site found in the 3' untranslated region of mRNA encoded by MGC2508, corresponding to a HOST TARGET binding site such as BINDING SITE I, BINDING SITE II or BINDING SITE III. Table 2 illustrates the complementarity of the nucleotide sequences of MGC2508 BINDING SITE, designated SEQ ID:23620, to the nucleotide sequence of VGAM1924 RNA, herein designated VGAM RNA, also designated SEQ ID:4635.

Another function of VGAM1924 is therefore inhibition of MGC2508 (Accession NM_024327). Accordingly, utilities of VGAM1924 include diagnosis, prevention and treatment of diseases and clinical conditions associated with MGC2508. MGC2747 (Accession NM_024104) is another VGAM1924 host target gene. MGC2747 BINDING SITE is HOST TARGET binding site found in the 3' untranslated region of mRNA encoded by MGC2747, corresponding to a HOST TARGET binding site such as BINDING SITE I, BINDING SITE II or BINDING SITE III. Table 2 illustrates the complementarity of the nucleotide sequences of MGC2747 BINDING SITE, designated SEQ ID:23549, to the nucleotide sequence of VGAM1924 RNA, herein designated VGAM RNA, also designated SEQ ID:4635.

Another function of VGAM1924 is therefore inhibition of MGC2747 (Accession NM_024104). Accordingly, utilities of VGAM1924 include diagnosis, prevention and treatment of diseases and clinical conditions associated with MGC2747. MGC4643 (Accession NM_032715) is another VGAM1924 host target gene. MGC4643 BINDING SITE is HOST TARGET binding site found in the 3' untranslated region of mRNA encoded by MGC4643, corresponding to a HOST TARGET binding site such as BINDING SITE I, BINDING SITE II or BINDING SITE III. Table 2 illustrates the complementarity of the nucleotide sequences of MGC4643 BINDING SITE, designated SEQ ID:26439, to the nucleotide sequence of VGAM1924 RNA, herein designated VGAM RNA, also designated SEQ ID:4635.

Another function of VGAM1924 is therefore inhibition of MGC4643 (Accession NM_032715). Accordingly, utilities of VGAM1924 include diagnosis, prevention and treatment of diseases and clinical conditions associated with MGC4643. MGC4796 (Accession XM_029031) is another VGAM1924 host target gene. MGC4796 BINDING SITE is HOST TARGET binding site found in the 3' untranslated region of mRNA encoded by MGC4796, corresponding to a HOST TARGET binding site such as BINDING SITE I, BINDING SITE II or BINDING SITE III. Table 2 illustrates the complementarity of the nucleotide sequences of MGC4796 BINDING SITE, designated SEQ ID:30829, to the nucleotide sequence of VGAM1924 RNA, herein designated VGAM RNA, also designated SEQ ID:4635.

Another function of VGAM1924 is therefore inhibition of MGC4796 (Accession XM_029031). Accordingly, utilities of VGAM1924 include diagnosis, prevention and treatment of diseases and clinical conditions associated with MGC4796. MGC8721 (Accession XM_016499) is another VGAM1924 host target gene. MGC8721 BINDING SITE is HOST TARGET binding site found in the 3' untranslated region of mRNA encoded by MGC8721, corresponding to a HOST TARGET binding site such as BINDING SITE I, BINDING SITE II or BINDING SITE III. Table 2 illustrates the complementarity of the nucleotide sequences of MGC8721 BINDING SITE, designated SEQ ID:30267, to the nucleotide sequence of VGAM1924 RNA, herein designated VGAM RNA, also designated SEQ ID:4635.

Another function of VGAM1924 is therefore inhibition of MGC8721 (Accession XM_016499). Accordingly, utilities of VGAM1924 include diagnosis, prevention and treatment of diseases and clinical conditions associated with MGC8721. Meningioma Expressed Antigen 6 (coiled-coil proline-rich) (MGEA6, Accession NM_005930) is another VGAM1924 host target gene. MGEA6 BINDING SITE is HOST TARGET binding site found in the 3' untranslated region of mRNA encoded by MGEA6, corresponding to a HOST TARGET binding site such as BINDING SITE I, BINDING SITE II or BINDING SITE III. Table 2 illustrates the complementarity of the nucleotide sequences of MGEA6 BINDING SITE, designated SEQ ID:12562, to the nucleotide sequence of VGAM1924 RNA, herein designated VGAM RNA, also designated SEQ ID:4635.

Another function of VGAM1924 is therefore inhibition of Meningioma Expressed Antigen 6 (coiled-coil proline-rich) (MGEA6, Accession NM_005930). Accordingly, utilities of VGAM1924 include diagnosis, prevention and treatment of diseases and clinical conditions associated with MGEA6. MIDORI (Accession XM_057651) is another VGAM1924 host target gene. MIDORI BINDING SITE is HOST TARGET binding site found in the 3' untranslated region of mRNA encoded by MIDORI, corresponding to a HOST TARGET binding site such as BINDING SITE I, BINDING SITE II or BINDING SITE III. Table 2 illustrates the complementarity of the nucleotide sequences of MIDORI BINDING SITE, designated SEQ ID:36528, to the nucleotide sequence of VGAM1924 RNA, herein designated VGAM RNA, also designated SEQ ID:4635.

Another function of VGAM1924 is therefore inhibition of MIDORI (Accession XM_057651). Accordingly, utilities of VGAM1924 include diagnosis, prevention and treatment of diseases and clinical conditions associated with MIDORI. Methylene Tetrahydrofolate Dehydrogenase (NAD+ dependent), Methenyltetrahydrofolate Cyclohydrolase (MTHFD2, Accession NM_006636) is another VGAM1924 host target gene. MTHFD2 BINDING SITE is HOST TARGET binding site found in the 3' untranslated region of mRNA encoded by MTHFD2, corresponding to a HOST TARGET binding site such as BINDING SITE I, BINDING SITE II or BINDING SITE III. Table 2 illustrates the complementarity of the nucleotide sequences of MTHFD2 BINDING SITE, designated SEQ ID:13431, to the nucleotide sequence of VGAM1924 RNA, herein designated VGAM RNA, also designated SEQ ID:4635.

Another function of VGAM1924 is therefore inhibition of Methylene Tetrahydrofolate Dehydrogenase (NAD+ dependent), Methenyltetrahydrofolate Cyclohydrolase (MTHFD2, Accession NM_006636). Accordingly, utilities of VGAM1924 include diagnosis, prevention and treatment of diseases and clinical conditions associated with MTHFD2. Myelin Transcription Factor 1 (MYT1, Accession NM_004535) is another VGAM1924 host target gene. MYT1 BINDING SITE is HOST TARGET binding site found in the 3' untranslated region of mRNA encoded by MYT1, corresponding to a HOST TARGET binding site such as BINDING SITE I, BINDING SITE II or BINDING SITE III. Table 2 illustrates the complementarity of the nucleotide sequences of MYT1 BINDING SITE, designated SEQ ID:10878, to the nucleotide sequence of VGAM1924 RNA, herein designated VGAM RNA, also designated SEQ ID:4635.

Another function of VGAM1924 is therefore inhibition of Myelin Transcription Factor 1 (MYT1, Accession NM_004535). Accordingly, utilities of VGAM1924 include diagnosis, prevention and treatment of diseases and clinical conditions associated with MYT1. Nucleosome Assembly Protein 1-like 1 (NAP1L1, Accession NM_139207) is another VGAM1924 host target gene. NAP1L1 BINDING SITE is HOST TARGET binding site found in the 3' untranslated region of mRNA encoded by NAP1L1, corresponding to a HOST TARGET binding site such as BINDING SITE I, BINDING SITE II or BINDING SITE III. Table 2 illustrates the complementarity of the nucleotide sequences of NAP1L1 BINDING SITE, designated SEQ ID:29225, to the nucleotide sequence of VGAM1924 RNA, herein designated VGAM RNA, also designated SEQ ID:4635.

Another function of VGAM1924 is therefore inhibition of Nucleosome Assembly Protein 1-like 1 (NAP1L1, Accession NM_139207). Accordingly, utilities of VGAM1924 include diagnosis, prevention and treatment of diseases and clinical conditions associated with NAP1L1. Ninjurin 2 (NINJ2, Accession NM_016533) is another VGAM1924 host target gene. NINJ2 BINDING SITE is HOST TARGET binding site found in the 3' untranslated region of mRNA encoded by NINJ2, corresponding to a HOST TARGET binding site such as BINDING SITE I, BINDING SITE II or BINDING SITE III. Table 2 illustrates the complementarity of the nucleotide sequences of NINJ2 BINDING SITE, designated SEQ ID:18603, to the nucleotide sequence of VGAM1924 RNA, herein designated VGAM RNA, also designated SEQ ID:4635.

Another function of VGAM1924 is therefore inhibition of Ninjurin 2 (NINJ2, Accession NM_016533). Accordingly, utilities of VGAM1924 include diagnosis, prevention and treatment of diseases and clinical conditions associated with NINJ2. NIP30 (Accession NM_024946) is another VGAM1924 host target gene. NIP30 BINDING SITE is HOST TARGET binding site found in the 3' untranslated region of mRNA encoded by NIP30, corresponding to a HOST TARGET binding site such as BINDING SITE I, BINDING SITE II or BINDING SITE III. Table 2 illustrates the complementarity of the nucleotide sequences of NIP30 BINDING SITE, designated SEQ ID:24498, to the nucleotide sequence of VGAM1924 RNA, herein designated VGAM RNA, also designated SEQ ID:4635.

Another function of VGAM1924 is therefore inhibition of NIP30 (Accession NM_024946). Accordingly, utilities of VGAM1924 include diagnosis, prevention and treatment of diseases and clinical conditions associated with NIP30. Nudix (nucleoside diphosphate linked moiety X)-type Motif 13 (NUDT13, Accession XM_032512) is another VGAM1924 host target gene. NUDT13 BINDING SITE is HOST TARGET binding site found in the 3' untranslated region of mRNA encoded by NUDT13, corresponding to a HOST TARGET binding site such as BINDING SITE I, BINDING SITE II or BINDING SITE III. Table 2 illustrates the complementarity of the nucleotide sequences of NUDT13 BINDING SITE, designated SEQ ID:31665, to the nucleotide sequence of VGAM1924 RNA, herein designated VGAM RNA, also designated SEQ ID:4635.

Another function of VGAM1924 is therefore inhibition of Nudix (nucleoside diphosphate linked moiety X)-type Motif 13 (NUDT13, Accession XM_032512). Accordingly, utilities of VGAM1924 include diagnosis, prevention and treatment of diseases and clinical conditions associated with NUDT13. NY-REN-25 (Accession XM_027116) is another VGAM1924 host target gene. NY-REN-25 BINDING SITE is HOST TARGET binding site found in the 3' untranslated region of mRNA encoded by NY-REN-25, corresponding to a HOST TARGET binding site such as BINDING SITE I, BINDING SITE II or BINDING SITE III. Table 2 illustrates the complementarity of the nucleotide sequences of NY-REN-25 BINDING SITE, designated SEQ ID:30419, to the nucleotide sequence of VGAM1924 RNA, herein designated VGAM RNA, also designated SEQ ID:4635.

Another function of VGAM1924 is therefore inhibition of NY-REN-25 (Accession XM_027116). Accordingly, utilities of VGAM1924 include diagnosis, prevention and treatment of diseases and clinical conditions associated with NY-REN-25. Ornithine Decarboxylase Antizyme 2 (OAZ2, Accession NM_002537) is another VGAM1924 host target gene. OAZ2 BINDING SITE is HOST TARGET binding site found in the 3' untranslated region of mRNA encoded by OAZ2, corresponding to a HOST TARGET binding site such as BINDING SITE I, BINDING SITE II or BINDING SITE III. Table 2 illustrates the complementarity of the nucleotide sequences of OAZ2 BINDING SITE, designated SEQ ID:8376, to the nucleotide sequence of VGAM1924 RNA, herein designated VGAM RNA, also designated SEQ ID:4635.

Another function of VGAM1924 is therefore inhibition of Ornithine Decarboxylase Antizyme 2 (OAZ2, Accession NM_002537). Accordingly, utilities of VGAM1924 include diagnosis, prevention and treatment of diseases and clinical conditions associated with OAZ2. Oxysterol Binding Protein-like 11 (OSBPL11, Accession NM_022776) is another VGAM1924 host target gene. OSBPL11 BINDING SITE is HOST TARGET binding site found in the 3' untranslated region of mRNA encoded by OSBPL11, corresponding to a HOST TARGET binding site such as BINDING SITE I, BINDING SITE II or BINDING SITE III. Table 2 illustrates the complementarity of the nucleotide sequences of OSBPL11 BINDING SITE, designated SEQ ID:23047, to the nucleotide sequence of VGAM1924 RNA, herein designated VGAM RNA, also designated SEQ ID:4635.

Another function of VGAM1924 is therefore inhibition of Oxysterol Binding Protein-like 11 (OSBPL11, Accession NM_022776). Accordingly, utilities of VGAM1924 include diagnosis, prevention and treatment of diseases and clinical conditions associated with OSBPL11. Oxysterol Binding Protein-like 1A (OSBPL1A, Accession NM_018030) is another VGAM1924 host target gene. OSBPL1A BINDING SITE1 through OSBPL1A BINDING SITE3 are HOST TARGET binding sites found in untranslated regions of mRNA encoded by OSBPL1A, corresponding to HOST TARGET binding sites such as BINDING SITE I, BINDING SITE II or BINDING SITE III. Table 2 illustrates the complementarity of the nucleotide sequences of OSBPL1A BINDING SITE1 through OSBPL1A BINDING SITE3, designated SEQ ID:19770, SEQ ID:28422 and SEQ ID:27905 respectively, to the nucleotide sequence of VGAM1924 RNA, herein designated VGAM RNA, also designated SEQ ID:4635.

Another function of VGAM1924 is therefore inhibition of Oxysterol Binding Protein-like 1A (OSBPL1A, Accession NM_018030). Accordingly, utilities of VGAM1924 include diagnosis, prevention and treatment of diseases and clinical conditions associated with OSBPL1A. PBEF (Accession NM_005746) is another VGAM1924 host target gene. PBEF BINDING SITE is HOST TARGET binding site found in the 3' untranslated region of mRNA encoded by PBEF, corresponding to a HOST TARGET binding site such as BINDING SITE I, BINDING SITE II or BINDING SITE III. Table 2 illustrates the complementarity of the nucleotide sequences of PBEF BINDING SITE, designated SEQ ID:12308, to the nucleotide sequence of VGAM1924 RNA, herein designated VGAM RNA, also designated SEQ ID:4635.

Another function of VGAM1924 is therefore inhibition of PBEF (Accession NM_005746). Accordingly, utilities of VGAM1924 include diagnosis, prevention and treatment of diseases and clinical conditions associated with PBEF. Protocadherin 20 (PCDH20, Accession NM_022843) is another VGAM1924 host target gene. PCDH20 BINDING SITE is HOST TARGET binding site found in the 3' untranslated region of mRNA encoded by PCDH20, corresponding to a HOST TARGET binding site such as BINDING SITE I, BINDING SITE II or BINDING SITE III. Table 2 illustrates the complementarity of the nucleotide sequences of PCDH20 BINDING SITE, designated SEQ ID:23139, to the nucleotide sequence of VGAM1924 RNA, herein designated VGAM RNA, also designated SEQ ID:4635.

Another function of VGAM1924 is therefore inhibition of Protocadherin 20 (PCDH20, Accession NM_022843). Accordingly, utilities of VGAM1924 include diagnosis, prevention and treatment of diseases and clinical conditions associated with PCDH20. PDZ Domain Containing 2 (PDZD2, Accession XM_087705) is another VGAM1924 host target gene. PDZD2 BINDING SITE is HOST TARGET binding site found in the 3' untranslated region of mRNA encoded by PDZD2, corresponding to a HOST TARGET binding site such as BINDING SITE I, BINDING SITE II or BINDING SITE III. Table 2 illustrates the complementarity of the nucleotide sequences of PDZD2 BINDING SITE, designated SEQ ID:39397, to the nucleotide sequence of VGAM1924 RNA, herein designated VGAM RNA, also designated SEQ ID:4635.

Another function of VGAM1924 is therefore inhibition of PDZ Domain Containing 2 (PDZD2, Accession XM_087705). Accordingly, utilities of VGAM1924 include diagnosis, prevention and treatment of diseases and clinical conditions associated with PDZD2. Pellino Homolog 2 (Drosophila) (PELI2, Accession NM_021255) is another VGAM1924 host target gene. PELI2 BINDING SITE is HOST TARGET binding site found in the 3' untranslated region of mRNA encoded by PELI2, corresponding to a HOST TARGET binding site such as BINDING SITE I, BINDING SITE II or BINDING SITE III. Table 2 illustrates the complementarity of the nucleotide sequences of PELI2 BINDING SITE, designated SEQ ID:22229, to the nucleotide sequence of VGAM1924 RNA, herein designated VGAM RNA, also designated SEQ ID:4635.

Another function of VGAM1924 is therefore inhibition of Pellino Homolog 2 (Drosophila) (PELI2, Accession NM_021255). Accordingly, utilities of VGAM1924 include diagnosis, prevention and treatment of diseases and clinical conditions associated with PELI2. Peroxisomal Biogenesis Factor 11B (PEX11B, Accession NM_003846) is another VGAM1924 host target gene. PEX11B BINDING SITE is HOST TARGET binding site found in the 3' untranslated region of mRNA encoded by PEX11B, corresponding to a HOST TARGET binding site such as BINDING SITE I, BINDING SITE II or BINDING SITE III. Table 2 illustrates the complementarity of the nucleotide sequences of PEX11B BINDING SITE, designated SEQ ID:9944, to the nucleotide sequence of VGAM1924 RNA, herein designated VGAM RNA, also designated SEQ ID:4635.

Another function of VGAM1924 is therefore inhibition of Peroxisomal Biogenesis Factor 11B (PEX11B, Accession NM_003846). Accordingly, utilities of VGAM1924 include diagnosis, prevention and treatment of diseases and clinical conditions associated with PEX11B. Phytoceramidase, Alkaline (PHCA, Accession NM_018367) is another VGAM1924 host target gene. PHCA BINDING SITE is HOST TARGET binding site found in the 3' untranslated region of mRNA encoded by PHCA, corresponding to a HOST TARGET binding site such as BINDING SITE I, BINDING SITE II or BINDING SITE III. Table 2 illustrates the complementarity of the nucleotide sequences of PHCA BINDING SITE, designated SEQ ID:20377, to the nucleotide sequence of VGAM1924 RNA, herein designated VGAM RNA, also designated SEQ ID:4635.

Another function of VGAM1924 is therefore inhibition of Phytoceramidase, Alkaline (PHCA, Accession NM_018367). Accordingly, utilities of VGAM1924 include diagnosis, prevention and treatment of diseases and clinical conditions associated with PHCA. PBX/knotted 1 Homeobox 2 (PKNOX2, Accession XM_165574) is another VGAM1924 host target gene. PKNOX2 BINDING SITE is HOST TARGET binding site found in the 3' untranslated region of mRNA encoded by PKNOX2, corresponding to a HOST TARGET binding site such as BINDING SITE I, BINDING SITE II or BINDING SITE III. Table 2 illustrates the complementarity of the nucleotide sequences of PKNOX2 BINDING SITE, designated SEQ ID:43695, to the nucleotide sequence of VGAM1924 RNA, herein designated VGAM RNA, also designated SEQ ID:4635.

Another function of VGAM1924 is therefore inhibition of PBX/knotted 1 Homeobox 2 (PKNOX2, Accession XM_165574). Accordingly, utilities of VGAM1924 include diagnosis, prevention and treatment of diseases and clinical conditions associated with PKNOX2. Placenta-specific 3 (PLAC3, Accession XM_045115) is another VGAM1924 host target gene. PLAC3 BINDING SITE is HOST TARGET binding site found in the 5' untranslated region of mRNA encoded by PLAC3, corresponding to a HOST TARGET binding site such as BINDING SITE I, BINDING SITE II or BINDING SITE III. Table 2 illustrates the complementarity of the nucleotide sequences of PLAC3 BINDING SITE, designated SEQ ID:34370, to the nucleotide sequence of VGAM1924 RNA, herein designated VGAM RNA, also designated SEQ ID:4635.

Another function of VGAM1924 is therefore inhibition of Placenta-specific 3 (PLAC3, Accession XM_045115). Accordingly, utilities of VGAM1924 include diagnosis, prevention and treatment of diseases and clinical conditions associated with PLAC3. Protein Phosphatase 1, Regulatory (inhibitor) Subunit 1B (dopamine and cAMP regulated phosphoprotein, DARPP-32) (PPP1R1B, Accession NM_032192) is another VGAM1924 host target gene. PPP1R1B BINDING SITE is HOST TARGET binding site found in the 3' untranslated region of mRNA encoded by PPP1R1B, corresponding to a HOST TARGET binding site such as BINDING SITE I, BINDING SITE II or BINDING SITE III. Table 2 illustrates the complementarity of the nucleotide sequences of PPP1R1B BINDING SITE, designated SEQ ID:25908, to the nucleotide sequence of VGAM1924 RNA, herein designated VGAM RNA, also designated SEQ ID:4635.

Another function of VGAM1924 is therefore inhibition of Protein Phosphatase 1, Regulatory (inhibitor) Subunit 1B (dopamine and cAMP regulated phosphoprotein, DARPP-32) (PPP1R1B, Accession NM_032192). Accordingly, utilities of VGAM1924 include diagnosis, prevention and treatment of diseases and clinical conditions associated with PPP1R1B. Protein Phosphatase 2 (formerly 2A), Regulatory Subunit B (PR 52), Alpha Isoform (PPP2R2A, Accession NM_002717) is another VGAM1924 host target gene. PPP2R2A BINDING SITE is HOST TARGET binding site found in the 3' untranslated region of mRNA encoded by PPP2R2A, corresponding to a HOST TARGET binding site such as BINDING SITE I, BINDING SITE II or BINDING SITE III. Table 2 illustrates the complementarity of the nucleotide sequences of PPP2R2A BINDING SITE, designated SEQ ID:8583, to the nucleotide sequence of VGAM1924 RNA, herein designated VGAM RNA, also designated SEQ ID:4635.

Another function of VGAM1924 is therefore inhibition of Protein Phosphatase 2 (formerly 2A), Regulatory Subunit B (PR 52), Alpha Isoform (PPP2R2A, Accession NM_002717). Accordingly, utilities of VGAM1924 include diagnosis, prevention and treatment of diseases and clinical conditions associated with PPP2R2A. PRAX-1 (Accession NM_004758) is another VGAM1924 host target gene. PRAX-1 BINDING SITE is HOST TARGET binding site found in the 3' untranslated region of mRNA encoded by PRAX-1, corresponding to a HOST TARGET binding site such as BINDING SITE I, BINDING SITE II or BINDING SITE III. Table 2 illustrates the complementarity of the nucleotide sequences of PRAX-1 BINDING SITE, designated SEQ ID:11147, to the nucleotide sequence of VGAM1924 RNA, herein designated VGAM RNA, also designated SEQ ID:4635.

Another function of VGAM1924 is therefore inhibition of PRAX-1 (Accession NM_004758). Accordingly, utilities of VGAM1924 include diagnosis, prevention and treatment of diseases and clinical conditions associated with PRAX-1. PRO1048 (Accession NM_018497) is another VGAM1924 host target gene. PRO1048 BINDING SITE is HOST TARGET binding site found in the 3' untranslated region of mRNA encoded by PRO1048, corresponding to a HOST TARGET binding site such as BINDING SITE I, BINDING SITE II or BINDING SITE III. Table 2 illustrates the complementarity of the nucleotide sequences of PRO1048 BINDING SITE, designated SEQ ID:20564, to the nucleotide sequence of VGAM1924 RNA, herein designated VGAM RNA, also designated SEQ ID:4635.

Another function of VGAM1924 is therefore inhibition of PRO1048 (Accession NM_018497). Accordingly, utilities of VGAM1924 include diagnosis, prevention and treatment of diseases and clinical conditions associated with PRO1048. PRO1617 (Accession NM_018587) is another VGAM1924 host target gene. PRO1617 BINDING SITE is HOST TARGET binding site found in the 5' untranslated region of mRNA encoded by PRO1617, corresponding to a HOST TARGET binding site such as BINDING SITE I, BINDING SITE II or BINDING SITE III. Table 2 illustrates the complementarity of the nucleotide sequences of PRO1617 BINDING SITE, designated SEQ ID:20666, to the nucleotide sequence of VGAM1924 RNA, herein designated VGAM RNA, also designated SEQ ID:4635.

Another function of VGAM1924 is therefore inhibition of PRO1617 (Accession NM_018587). Accordingly, utilities of VGAM1924 include diagnosis, prevention and treatment of diseases and clinical conditions associated with PRO1617. Proteasome (prosome, macropain) Inhibitor Subunit 1 (PI31) (PSMF1, Accession NM_006814) is another VGAM1924 host target gene. PSMF1 BINDING SITE is HOST TARGET binding site found in the 3' untranslated region of mRNA encoded by PSMF1, corresponding to a HOST TARGET binding site such as BINDING SITE I, BINDING SITE II or BINDING SITE III. Table 2 illustrates the complementarity of the nucleotide sequences of PSMF1 BINDING SITE, designated SEQ ID:13691, to the nucleotide sequence of VGAM1924 RNA, herein designated VGAM RNA, also designated SEQ ID:4635.

Another function of VGAM1924 is therefore inhibition of Proteasome (prosome, macropain) Inhibitor Subunit 1 (PI31) (PSMF1, Accession NM_006814). Accordingly, utilities of VGAM1924 include diagnosis, prevention and treatment of diseases and clinical conditions associated with PSMF1. RAB10, Member RAS Oncogene Family (RAB10, Accession XM_097979) is another VGAM1924 host target gene. RAB10 BINDING SITE is HOST TARGET binding site found in the 3' untranslated region of mRNA encoded by RAB10, corresponding to a HOST TARGET binding site such as BINDING SITE I, BINDING SITE II or BINDING SITE III. Table 2 illustrates the complementarity of the nucleotide sequences of RAB10 BINDING SITE, designated SEQ ID:41283, to the nucleotide sequence of VGAM1924 RNA, herein designated VGAM RNA, also designated SEQ ID:4635.

Another function of VGAM1924 is therefore inhibition of RAB10, Member RAS Oncogene Family (RAB10, Accession XM_097979). Accordingly, utilities of VGAM1924 include diagnosis, prevention and treatment of diseases and clinical conditions associated with RAB10. Rab11-FIP2 (Accession NM_014904) is another VGAM1924 host target gene. Rab11-FIP2 BINDING SITE is HOST TARGET binding site found in the 3' untranslated region of mRNA encoded by Rab11-FIP2, corresponding to a HOST TARGET binding site such as BINDING SITE I, BINDING SITE II or BINDING SITE III. Table 2 illustrates the complementarity of the nucleotide sequences of Rab11-FIP2 BINDING SITE, designated SEQ ID:17102, to the nucleotide sequence of VGAM1924 RNA, herein designated VGAM RNA, also designated SEQ ID:4635.

Another function of VGAM1924 is therefore inhibition of Rab11-FIP2 (Accession NM_014904). Accordingly, utilities of VGAM1924 include diagnosis, prevention and treatment of diseases and clinical conditions associated with Rab11-FIP2. RBAK (Accession NM_021163) is another VGAM1924 host target gene. RBAK BINDING SITE is HOST TARGET binding site found in the 3' untranslated region of mRNA encoded by RBAK, corresponding to a HOST TARGET binding site such as BINDING SITE I, BINDING SITE II or BINDING SITE III. Table 2 illustrates the complementarity of the nucleotide sequences of RBAK BINDING SITE, designated SEQ ID:22143, to the nucleotide sequence of VGAM1924 RNA, herein designated VGAM RNA, also designated SEQ ID:4635.

Another function of VGAM1924 is therefore inhibition of RBAK (Accession NM_021163). Accordingly, utilities of VGAM1924 include diagnosis, prevention and treatment of diseases and clinical conditions associated with RBAK. RI58 (Accession NM_012420) is another VGAM1924 host target gene. RI58 BINDING SITE is HOST TARGET binding site found in the 3' untranslated region of mRNA encoded by RI58, corresponding to a HOST TARGET binding site such as BINDING SITE I, BINDING SITE II or BINDING SITE III. Table 2 illustrates the complementarity of the nucleotide sequences of RI58 BINDING SITE, designated SEQ ID:14793, to the nucleotide sequence of VGAM1924 RNA, herein designated VGAM RNA, also designated SEQ ID:4635.

Another function of VGAM1924 is therefore inhibition of RI58 (Accession NM_012420). Accordingly, utilities of VGAM1924 include diagnosis, prevention and treatment of diseases and clinical conditions associated with RI58. RMP (Accession NM_003796) is another VGAM1924 host target gene. RMP BINDING SITE1 and RMP BINDING SITE2 are HOST TARGET binding sites found in untranslated regions of mRNA encoded by RMP, corresponding to HOST TARGET binding sites such as BINDING SITE I, BINDING SITE II or BINDING SITE III. Table 2 illustrates the complementarity of the nucleotide sequences of RMP BINDING SITE1 and RMP BINDING SITE2, designated SEQ ID:9877 and SEQ ID:28680 respectively, to the nucleotide sequence of VGAM1924 RNA, herein designated VGAM RNA, also designated SEQ ID:4635.

Another function of VGAM1924 is therefore inhibition of RMP (Accession NM_003796). Accordingly, utilities of VGAM1924 include diagnosis, prevention and treatment of diseases and clinical conditions associated with RMP. Rpo1-2 (Accession NM_019014) is another VGAM1924 host target gene. Rpo1-2 BINDING SITE is HOST TARGET binding site found in the 3' untranslated region of mRNA encoded by Rpo1-2, corresponding to a HOST TARGET binding site such as BINDING SITE I, BINDING SITE II or BINDING SITE III. Table 2 illustrates the complementarity of the nucleotide sequences of Rpo1-2 BINDING SITE, designated SEQ ID:21099, to the nucleotide sequence of VGAM1924 RNA, herein designated VGAM RNA, also designated SEQ ID:4635.

Another function of VGAM1924 is therefore inhibition of Rpo1-2 (Accession NM_019014). Accordingly, utilities of VGAM1924 include diagnosis, prevention and treatment of diseases and clinical conditions associated with Rpo1-2. SCOP (Accession XM_166290) is another VGAM1924 host target gene. SCOP BINDING SITE is HOST TARGET binding site found in the 3' untranslated region of mRNA encoded by SCOP, corresponding to a HOST TARGET binding site such as BINDING SITE I, BINDING SITE II or BINDING SITE III. Table 2 illustrates the complementarity of the nucleotide sequences of SCOP BINDING SITE, designated SEQ ID:44104, to the nucleotide sequence of VGAM1924 RNA, herein designated VGAM RNA, also designated SEQ ID:4635.

Another function of VGAM1924 is therefore inhibition of SCOP (Accession XM_166290). Accordingly, utilities of VGAM1924 include diagnosis, prevention and treatment of diseases and clinical conditions associated with SCOP. SCYB11 (Accession XM_113426) is another VGAM1924 host target gene. SCYB11 BINDING SITE is HOST TARGET binding site found in the 3' untranslated region of mRNA encoded by SCYB11, corresponding to a HOST TARGET binding site such as BINDING SITE I, BINDING SITE II or BINDING SITE III. Table 2 illustrates the complementarity of the nucleotide sequences of SCYB11 BINDING SITE, designated SEQ ID:42259, to the nucleotide sequence of VGAM1924 RNA, herein designated VGAM RNA, also designated SEQ ID:4635.

Another function of VGAM1924 is therefore inhibition of SCYB11 (Accession XM_113426). Accordingly, utilities of VGAM1924 include diagnosis, prevention and treatment of diseases and clinical conditions associated with SCYB11. SDF1 (Accession XM_165565) is another VGAM1924 host target gene. SDF1 BINDING SITE is HOST TARGET binding site found in the 3' untranslated region of mRNA encoded by SDF1, corresponding to a HOST TARGET binding site such as BINDING SITE I, BINDING SITE II or BINDING SITE III. Table 2 illustrates the complementarity of the nucleotide sequences of SDF1 BINDING SITE, designated SEQ ID:43689, to the nucleotide sequence of VGAM1924 RNA, herein designated VGAM RNA, also designated SEQ ID:4635.

Another function of VGAM1924 is therefore inhibition of SDF1 (Accession XM_165565). Accordingly, utilities of VGAM1924 include diagnosis, prevention and treatment of diseases and clinical conditions associated with SDF1. Serine Hydrolase-like (SERHL, Accession XM_170987) is another VGAM1924 host target gene. SERHL BINDING SITE is HOST TARGET binding site found in the 3' untranslated region of mRNA encoded by SERHL, corresponding to a HOST TARGET binding site such as BINDING SITE I, BINDING SITE II or BINDING SITE III. Table 2 illustrates the complementarity of the nucleotide sequences of SERHL BINDING SITE, designated SEQ ID:45757, to the nucleotide sequence of VGAM1924 RNA, herein designated VGAM RNA, also designated SEQ ID:4635.

Another function of VGAM1924 is therefore inhibition of Serine Hydrolase-like (SERHL, Accession XM_170987). Accordingly, utilities of VGAM1924 include diagnosis, prevention and treatment of diseases and clinical conditions associated with SERHL. Solute Carrier Family 26, Member 7 (SLC26A7, Accession NM_052832) is another VGAM1924 host target gene. SLC26A7 BINDING SITE is HOST TARGET binding site found in the 3' untranslated region of mRNA encoded by SLC26A7, corresponding to a HOST TARGET binding site such as BINDING SITE I, BINDING SITE II or BINDING SITE III. Table 2 illustrates the complementarity of the nucleotide sequences of SLC26A7 BINDING SITE, designated SEQ ID:27413, to the nucleotide sequence of VGAM1924 RNA, herein designated VGAM RNA, also designated SEQ ID:4635.

Another function of VGAM1924 is therefore inhibition of Solute Carrier Family 26, Member 7 (SLC26A7, Accession NM_052832). Accordingly, utilities of VGAM1924 include diagnosis, prevention and treatment of diseases and clinical conditions associated with SLC26A7. Sorting Nexin 11 (SNX11, Accession NM_013323) is another VGAM1924 host target gene. SNX11 BINDING SITE is HOST TARGET binding site found in the 3' untranslated region of mRNA encoded by SNX11, corresponding to a HOST TARGET binding site such as BINDING SITE I, BINDING SITE II or BINDING SITE III. Table 2 illustrates the complementarity of the nucleotide sequences of SNX11 BINDING SITE, designated SEQ ID:14970, to the nucleotide sequence of VGAM1924 RNA, herein designated VGAM RNA, also designated SEQ ID:4635.

Another function of VGAM1924 is therefore inhibition of Sorting Nexin 11 (SNX11, Accession NM_013323). Accordingly, utilities of VGAM1924 include diagnosis, prevention and treatment of diseases and clinical conditions associated with SNX11. Spir-1 (Accession XM_035640) is another VGAM1924 host target gene. Spir-1 BINDING SITE is HOST TARGET binding site found in the 3' untranslated region of mRNA encoded by Spir-1, corresponding to a HOST TARGET binding site such as BINDING SITE I, BINDING SITE II or BINDING SITE III. Table 2 illustrates the complementarity of the nucleotide sequences of Spir-1 BINDING SITE, designated SEQ ID:32306, to the nucleotide sequence of VGAM1924 RNA, herein designated VGAM RNA, also designated SEQ ID:4635.

Another function of VGAM1924 is therefore inhibition of Spir-1 (Accession XM_035640). Accordingly, utilities of VGAM1924 include diagnosis, prevention and treatment of diseases and clinical conditions associated with Spir-1. Synaptopodin 2 (SYNPO2, Accession XM_050219) is another VGAM1924 host target gene. SYNPO2 BINDING SITE is HOST TARGET binding site found in the 3' untranslated region of mRNA encoded by SYNPO2, corresponding to a HOST TARGET binding site such as BINDING SITE I, BINDING SITE II or BINDING SITE III. Table 2 illustrates the complementarity of the nucleotide sequences of SYNPO2 BINDING SITE, designated SEQ ID:35594, to the nucleotide sequence of VGAM1924 RNA, herein designated VGAM RNA, also designated SEQ ID:4635.

Another function of VGAM1924 is therefore inhibition of Synaptopodin 2 (SYNPO2, Accession XM_050219). Accordingly, utilities of VGAM1924 include diagnosis, prevention and treatment of diseases and clinical conditions associated with SYNPO2. Synaptotagmin-like 4 (granuphilin-a) (SYTL4, Accession NM_080737) is another VGAM1924 host target gene. SYTL4 BINDING SITE is HOST TARGET binding site found in the 3' untranslated region of mRNA encoded by SYTL4, corresponding to a HOST TARGET binding site such as BINDING SITE I, BINDING SITE II or BINDING SITE III. Table 2 illustrates the complementarity of the nucleotide sequences of SYTL4 BINDING SITE, designated SEQ ID:28025, to the nucleotide sequence of VGAM1924 RNA, herein designated VGAM RNA, also designated SEQ ID:4635.

Another function of VGAM1924 is therefore inhibition of Synaptotagmin-like 4 (granuphilin-a) (SYTL4, Accession NM_080737). Accordingly, utilities of VGAM1924 include diagnosis, prevention and treatment of diseases and clinical conditions associated with SYTL4. TA-KRP (Accession NM_032505) is another VGAM1924 host target gene. TA-KRP BINDING SITE is HOST TARGET binding site found in the 3' untranslated region of mRNA encoded by TA-KRP, corresponding to a HOST TARGET binding site such as BINDING SITE I, BINDING SITE II or BINDING SITE III. Table 2 illustrates the complementarity of the nucleotide sequences of TA-KRP BINDING SITE, designated SEQ ID:26253, to the nucleotide sequence of VGAM1924 RNA, herein designated VGAM RNA, also designated SEQ ID:4635.

Another function of VGAM1924 is therefore inhibition of TA-KRP (Accession NM_032505). Accordingly, utilities of VGAM1924 include diagnosis, prevention and treatment of diseases and clinical conditions associated with TA-KRP. TEB4 (Accession XM_027156) is another VGAM1924 host target gene. TEB4 BINDING SITE is HOST TARGET binding site found in the 3' untranslated region of mRNA encoded by TEB4, corresponding to a HOST TARGET binding site such as BINDING SITE I, BINDING SITE II or BINDING SITE III. Table 2 illustrates the complementarity of the nucleotide sequences of TEB4 BINDING SITE, designated SEQ ID:30427, to the nucleotide sequence of VGAM1924 RNA, herein designated VGAM RNA, also designated SEQ ID:4635.

Another function of VGAM1924 is therefore inhibition of TEB4 (Accession XM_027156). Accordingly, utilities of VGAM1924 include diagnosis, prevention and treatment of diseases and clinical conditions associated with TEB4. TGFB-induced Factor 2 (TALE family homeobox) (TGIF2, Accession NM_021809) is another VGAM1924 host target gene. TGIF2 BINDING SITE is HOST TARGET binding site found in the 3' untranslated region of mRNA encoded by TGIF2, corresponding to a HOST TARGET binding site such as BINDING SITE I, BINDING SITE II or BINDING SITE III. Table 2 illustrates the complementarity of the nucleotide sequences of TGIF2 BINDING SITE, designated SEQ ID:22366, to the nucleotide sequence of VGAM1924 RNA, herein designated VGAM RNA, also designated SEQ ID:4635.

Another function of VGAM1924 is therefore inhibition of TGFB-induced Factor 2 (TALE family homeobox) (TGIF2, Accession NM_021809). Accordingly, utilities of VGAM1924 include diagnosis, prevention and treatment of diseases and clinical conditions associated with TGIF2. T-cell Lymphoma Invasion and Metastasis 2 (TIAM2, Accession NM_012454) is another VGAM1924 host target gene. TIAM2 BINDING SITE is HOST TARGET binding site found in the 3' untranslated region of mRNA encoded by TIAM2, corresponding to a HOST TARGET binding site such as BINDING SITE I, BINDING SITE II or BINDING SITE III. Table 2 illustrates the complementarity of the nucleotide sequences of TIAM2 BINDING SITE, designated SEQ ID:14825, to the nucleotide sequence of VGAM1924 RNA, herein designated VGAM RNA, also designated SEQ ID:4635.

Another function of VGAM1924 is therefore inhibition of T-cell Lymphoma Invasion and Metastasis 2 (TIAM2, Accession NM_012454). Accordingly, utilities of VGAM1924 include diagnosis, prevention and treatment of diseases and clinical conditions associated with TIAM2. Toll-like Receptor 10 (TLR10, Accession NM_030956) is another VGAM1924 host target gene. TLR10 BINDING SITE is HOST TARGET binding site found in the 5' untranslated region of mRNA encoded by TLR10, corresponding to a HOST TARGET binding site such as BINDING SITE I, BINDING SITE II or BINDING SITE III. Table 2 illustrates the complementarity of the nucleotide sequences of TLR10 BINDING SITE, designated SEQ ID:25230, to the nucleotide sequence of VGAM1924 RNA, herein designated VGAM RNA, also designated SEQ ID:4635.

Another function of VGAM1924 is therefore inhibition of Toll-like Receptor 10 (TLR10, Accession NM_030956). Accordingly, utilities of VGAM1924 include diagnosis, prevention and treatment of diseases and clinical conditions associated with TLR10. Tankyrase, TRF1-interacting Ankyrin-related ADP-ribose Polymerase 2 (TNKS2, Accession NM_025235) is another VGAM1924 host target gene. TNKS2 BINDING SITE is HOST TARGET binding site found in the 3' untranslated region of mRNA encoded by TNKS2, corresponding to a HOST TARGET binding site such as BINDING SITE I, BINDING SITE II or BINDING SITE III. Table 2 illustrates the complementarity of the nucleotide sequences of TNKS2 BINDING SITE, designated SEQ ID:24912, to the nucleotide sequence of VGAM1924 RNA, herein designated VGAM RNA, also designated SEQ ID:4635.

Another function of VGAM1924 is therefore inhibition of Tankyrase, TRF1-interacting Ankyrin-related ADP-ribose Polymerase 2 (TNKS2, Accession NM_025235). Accordingly, utilities of VGAM1924 include diagnosis, prevention and treatment of diseases and clinical conditions associated with TNKS2. TOPBP1 (Accession NM_007027) is another VGAM1924 host target gene. TOPBP1 BINDING SITE is HOST TARGET binding site found in the 5' untranslated region of mRNA encoded by TOPBP1, corresponding to a HOST TARGET binding site such as BINDING SITE I, BINDING SITE II or BINDING SITE III. Table 2 illustrates the complementarity of the nucleotide sequences of TOPBP1 BINDING SITE, designated SEQ ID:13887, to the nucleotide sequence of VGAM1924 RNA, herein designated VGAM RNA, also designated SEQ ID:4635.

Another function of VGAM1924 is therefore inhibition of TOPBP1 (Accession NM_007027). Accordingly, utilities of VGAM1924 include diagnosis, prevention and treatment of diseases and clinical conditions associated with TOPBP1. TRAD (Accession NM_007064) is another VGAM1924 host target gene. TRAD BINDING SITE is HOST TARGET binding site found in the 3' untranslated region of mRNA encoded by TRAD, corresponding to a HOST TARGET binding site such as BINDING SITE I, BINDING SITE II or BINDING SITE III. Table 2 illustrates the complementarity of the nucleotide sequences of TRAD BINDING SITE, designated SEQ ID:13930, to the nucleotide sequence of VGAM1924 RNA, herein designated VGAM RNA, also designated SEQ ID:4635.

Another function of VGAM1924 is therefore inhibition of TRAD (Accession NM_007064). Accordingly, utilities of VGAM1924 include diagnosis, prevention and treatment of diseases and clinical conditions associated with TRAD. Tripartite Motif-containing 4 (TRIM4, Accession NM_033017) is another VGAM1924 host target gene. TRIM4 BINDING SITE is HOST TARGET binding site found in the 3' untranslated region of mRNA encoded by TRIM4, corresponding to a HOST TARGET binding site such as BINDING SITE I, BINDING SITE II or BINDING SITE III. Table 2 illustrates the complementarity of the nucleotide sequences of TRIM4 BINDING SITE, designated SEQ ID:26902, to the nucleotide sequence of VGAM1924 RNA, herein designated VGAM RNA, also designated SEQ ID:4635.

Another function of VGAM1924 is therefore inhibition of Tripartite Motif-containing 4 (TRIM4, Accession NM_033017). Accordingly, utilities of VGAM1924 include diagnosis, prevention and treatment of diseases and clinical conditions associated with TRIM4. VDU1 (Accession NM_015017) is another VGAM1924 host target gene. VDU1 BINDING SITE is HOST TARGET binding site found in the 3' untranslated region of mRNA encoded by VDU1, corresponding to a HOST TARGET binding site such as BINDING SITE I, BINDING SITE II or BINDING SITE III. Table 2 illustrates the complementarity of the nucleotide sequences of VDU1 BINDING SITE, designated SEQ ID:17383, to the nucleotide sequence of VGAM1924 RNA, herein designated VGAM RNA, also designated SEQ ID:4635.

Another function of VGAM1924 is therefore inhibition of VDU1 (Accession NM_015017). Accordingly, utilities of VGAM1924 include diagnosis, prevention and treatment of diseases and clinical conditions associated with VDU1. VEZATIN (Accession NM_017599) is another VGAM1924 host target gene. VEZATIN BINDING SITE is HOST TARGET binding site found in the 3' untranslated region of mRNA encoded by VEZATIN, corresponding to a HOST TARGET binding site such as BINDING SITE I, BINDING SITE II or BINDING SITE III. Table 2 illustrates the complementarity of the nucleotide sequences of VEZATIN BINDING SITE, designated SEQ ID:19069, to the nucleotide sequence of VGAM1924 RNA, herein designated VGAM RNA, also designated SEQ ID:4635.

Another function of VGAM1924 is therefore inhibition of VEZATIN (Accession NM_017599). Accordingly, utilities of VGAM1924 include diagnosis, prevention and treatment of diseases and clinical conditions associated with VEZATIN. Vacuolar Protein Sorting 4B (yeast) (VPS4B, Accession NM_004869) is another VGAM1924 host target gene. VPS4B BINDING SITE is HOST TARGET binding site found in the 3' untranslated region of mRNA encoded by VPS4B, corresponding to a HOST TARGET binding site such as BINDING SITE I, BINDING SITE II or BINDING SITE III. Table 2 illustrates the complementarity of the nucleotide sequences of VPS4B BINDING SITE, designated SEQ ID:11296, to the nucleotide sequence of VGAM1924 RNA, herein designated VGAM RNA, also designated SEQ ID:4635.

Another function of VGAM1924 is therefore inhibition of Vacuolar Protein Sorting 4B (yeast) (VPS4B, Accession NM_004869). Accordingly, utilities of VGAM1924 include diagnosis, prevention and treatment of diseases and clinical conditions associated with VPS4B. Yes-associated Protein 1, 65 kDa (YAP1, Accession NM_006106) is another VGAM1924 host target gene. YAP1 BINDING SITE is HOST TARGET binding site found in the 3' untranslated region of mRNA encoded by YAP1, corresponding to a HOST TARGET binding site such as BINDING SITE I, BINDING SITE II or BINDING SITE III. Table 2 illustrates the complementarity of the nucleotide sequences of YAP1 BINDING SITE, designated SEQ ID:12748, to the nucleotide sequence of VGAM1924 RNA, herein designated VGAM RNA, also designated SEQ ID:4635.

Another function of VGAM1924 is therefore inhibition of Yes-associated Protein 1, 65 kDa (YAP1, Accession NM_006106). Accordingly, utilities of VGAM1924 include diagnosis, prevention and treatment of diseases and clinical conditions associated with YAP1. Zinc Finger, DHHC Domain Containing 2 (ZDHHC2, Accession NM_016353) is another VGAM1924 host target gene. ZDHHC2 BINDING SITE is HOST TARGET binding site found in the 3' untranslated region of mRNA encoded by ZDHHC2, corresponding to a HOST TARGET binding site such as BINDING SITE I, BINDING SITE II or BINDING SITE III. Table 2 illustrates the complementarity of the nucleotide sequences of ZDHHC2 BINDING SITE, designated SEQ ID:18493, to the nucleotide sequence of VGAM1924 RNA, herein designated VGAM RNA, also designated SEQ ID:4635.

Another function of VGAM1924 is therefore inhibition of Zinc Finger, DHHC Domain Containing 2 (ZDHHC2, Accession NM_016353). Accordingly, utilities of VGAM1924 include diagnosis, prevention and treatment of diseases and clinical conditions associated with ZDHHC2. LOC113763 (Accession NM_138434) is another VGAM1924 host target gene. LOC113763 BINDING SITE is HOST TARGET binding site found in the 3' untranslated region of mRNA encoded by LOC113763, corresponding to a HOST TARGET binding site such as BINDING SITE I, BINDING SITE II or BINDING SITE III. Table 2 illustrates the complementarity of the nucleotide sequences of LOC113763 BINDING SITE, designated SEQ ID:28803, to the nucleotide sequence of VGAM1924 RNA, herein designated VGAM RNA, also designated SEQ ID:4635.

Another function of VGAM1924 is therefore inhibition of LOC113763 (Accession NM_138434). Accordingly, utilities of VGAM1924 include diagnosis, prevention and treatment of diseases and clinical conditions associated with LOC113763. LOC115123 (Accession XM_055276) is another VGAM1924 host target gene. LOC115123 BINDING SITE is HOST TARGET binding site found in the 3' untranslated region of mRNA encoded by LOC115123, corresponding to a HOST TARGET binding site such as BINDING SITE I, BINDING SITE II or BINDING SITE III. Table 2 illustrates the complementarity of the nucleotide sequences of LOC115123 BINDING SITE, designated SEQ ID:36246, to the nucleotide sequence of VGAM1924 RNA, herein designated VGAM RNA, also designated SEQ ID:4635.

Another function of VGAM1924 is therefore inhibition of LOC115123 (Accession XM_055276). Accordingly, utilities of VGAM1924 include diagnosis, prevention and treatment of diseases and clinical conditions associated with LOC115123. LOC116437 (Accession XM_058185) is another VGAM1924 host target gene. LOC116437 BINDING SITE is HOST TARGET binding site found in the 3' untranslated region of mRNA encoded by LOC116437, corresponding to a HOST TARGET binding site such as BINDING SITE I, BINDING SITE II or BINDING SITE III. Table 2 illustrates the complementarity of the nucleotide sequences of LOC116437 BINDING SITE, designated SEQ ID:36580, to the nucleotide sequence of VGAM1924 RNA, herein designated VGAM RNA, also designated SEQ ID:4635.

Another function of VGAM1924 is therefore inhibition of LOC116437 (Accession XM_058185). Accordingly, utilities of VGAM1924 include diagnosis, prevention and treatment of diseases and clinical conditions associated with LOC116437. LOC119392 (Accession NM_145247) is another VGAM1924 host target gene. LOC119392 BINDING SITE is HOST TARGET binding site found in the 3' untranslated region of mRNA encoded by LOC119392, corresponding to a HOST TARGET binding site such as BINDING SITE I, BINDING SITE II or BINDING SITE III. Table 2 illustrates the complementarity of the nucleotide sequences of LOC119392 BINDING SITE, designated SEQ ID:29759, to the nucleotide sequence of VGAM1924 RNA, herein designated VGAM RNA, also designated SEQ ID:4635.

Another function of VGAM1924 is therefore inhibition of LOC119392 (Accession NM_145247). Accordingly, utilities of VGAM1924 include diagnosis, prevention and treatment of diseases and clinical conditions associated with LOC119392. LOC123283 (Accession XM_071829) is another VGAM1924 host target gene. LOC123283 BINDING SITE is HOST TARGET binding site found in the 3' untranslated region of mRNA encoded by LOC123283, corresponding to a HOST TARGET binding site such as BINDING SITE I, BINDING SITE II or BINDING SITE III. Table 2 illustrates the complementarity of the nucleotide sequences of LOC123283 BINDING SITE, designated SEQ ID:37425, to the nucleotide sequence of VGAM1924 RNA, herein designated VGAM RNA, also designated SEQ ID:4635.

Another function of VGAM1924 is therefore inhibition of LOC123283 (Accession XM_071829). Accordingly, utilities of VGAM1924 include diagnosis, prevention and treatment of diseases and clinical conditions associated with LOC123283. LOC125144 (Accession XM_058900) is another VGAM1924 host target gene. LOC125144 BINDING SITE1 and LOC125144 BINDING SITE2 are HOST TARGET binding sites found in untranslated regions of mRNA encoded by LOC125144, corresponding to HOST TARGET binding sites such as BINDING SITE I, BINDING SITE II or BINDING SITE III. Table 2 illustrates the complementarity of the nucleotide sequences of LOC125144 BINDING SITE1 and LOC125144 BINDING SITE2, designated SEQ ID:36788 and SEQ ID:36789 respectively, to the nucleotide sequence of VGAM1924 RNA, herein designated VGAM RNA, also designated SEQ ID:4635.

Another function of VGAM1924 is therefore inhibition of LOC125144 (Accession XM_058900). Accordingly, utilities of VGAM1924 include diagnosis, prevention and treatment of diseases and clinical conditions associated with LOC125144. LOC130589 (Accession NM_138801) is another VGAM1924 host target gene. LOC130589 BINDING SITE is HOST TARGET binding site found in the 3' untranslated region of mRNA encoded by LOC130589, corresponding to a HOST TARGET binding site such as BINDING SITE I, BINDING SITE II or BINDING SITE III. Table 2 illustrates the complementarity of the nucleotide sequences of LOC130589 BINDING SITE, designated SEQ ID:29024, to the nucleotide sequence of VGAM1924 RNA, herein designated VGAM RNA, also designated SEQ ID:4635.

Another function of VGAM1924 is therefore inhibition of LOC130589 (Accession NM_138801). Accordingly, utilities of VGAM1924 include diagnosis, prevention and treatment of diseases and clinical conditions associated with LOC130589. LOC131873 (Accession XM_067585) is another VGAM1924 host target gene. LOC131873 BINDING SITE is HOST TARGET binding site found in the 3' untranslated region of mRNA encoded by LOC131873, corresponding to a HOST TARGET binding site such as BINDING SITE I, BINDING SITE II or BINDING SITE III. Table 2 illustrates the complementarity of the nucleotide sequences of LOC131873 BINDING SITE, designated SEQ ID:37360, to the nucleotide sequence of VGAM1924 RNA, herein designated VGAM RNA, also designated SEQ ID:4635.

Another function of VGAM1924 is therefore inhibition of LOC131873 (Accession XM_067585). Accordingly, utilities of VGAM1924 include diagnosis, prevention and treatment of diseases and clinical conditions associated with LOC131873. LOC143465 (Accession XM_096430) is another VGAM1924 host target gene. LOC143465 BINDING SITE is HOST TARGET binding site found in the 3' untranslated region of mRNA encoded by LOC143465, corresponding to a HOST TARGET binding site such as BINDING SITE I, BINDING SITE II or BINDING SITE III. Table 2 illustrates the complementarity of the nucleotide sequences of LOC143465 BINDING SITE, designated SEQ ID:40364, to the nucleotide sequence of VGAM1924 RNA, herein designated VGAM RNA, also designated SEQ ID:4635.

Another function of VGAM1924 is therefore inhibition of LOC143465 (Accession XM_096430). Accordingly, utilities of VGAM1924 include diagnosis, prevention and treatment of diseases and clinical conditions associated with LOC143465. LOC143666 (Accession XM_096465) is another VGAM1924 host target gene. LOC143666 BINDING SITE is HOST TARGET binding site found in the 3' untranslated region of mRNA encoded by LOC143666, corresponding to a HOST TARGET binding site such as BINDING SITE I, BINDING SITE II or BINDING SITE III. Table 2 illustrates the complementarity of the nucleotide sequences of LOC143666 BINDING SITE, designated SEQ ID:40369, to the nucleotide sequence of VGAM1924 RNA, herein designated VGAM RNA, also designated SEQ ID:4635.

Another function of VGAM1924 is therefore inhibition of LOC143666 (Accession XM_096465). Accordingly, utilities of VGAM1924 include diagnosis, prevention and treatment of diseases and clinical conditions associated with LOC143666. LOC145134 (Accession XM_096722) is another VGAM1924 host target gene. LOC145134 BINDING SITE1 and LOC145134 BINDING SITE2 are HOST TARGET binding sites found in untranslated regions of mRNA encoded by LOC145134, corresponding to HOST TARGET binding sites such as BINDING SITE I, BINDING SITE II or BINDING SITE III. Table 2 illustrates the complementarity of the nucleotide sequences of LOC145134 BINDING SITE1 and LOC145134 BINDING SITE2, designated SEQ ID:40500 and SEQ ID:40501 respectively, to the nucleotide sequence of VGAM1924 RNA, herein designated VGAM RNA, also designated SEQ ID:4635.

Another function of VGAM1924 is therefore inhibition of LOC145134 (Accession XM_096722). Accordingly, utilities of VGAM1924 include diagnosis, prevention and treatment of diseases and clinical conditions associated with LOC145134. LOC145945 (Accession XM_096908) is another VGAM1924 host target gene. LOC145945 BINDING SITE is HOST TARGET binding site found in the 5' untranslated region of mRNA encoded by LOC145945, corresponding to a HOST TARGET binding site such as BINDING SITE I, BINDING SITE II or BINDING SITE III. Table 2 illustrates the complementarity of the nucleotide sequences of LOC145945 BINDING SITE, designated SEQ ID:40637, to the nucleotide sequence of VGAM1924 RNA, herein designated VGAM RNA, also designated SEQ ID:4635.

Another function of VGAM1924 is therefore inhibition of LOC145945 (Accession XM_096908). Accordingly, utilities of VGAM1924 include diagnosis, prevention and treatment of diseases and clinical conditions associated with LOC145945. LOC146268 (Accession XM_085397) is another VGAM1924 host target gene. LOC146268 BINDING SITE1 and LOC146268 BINDING SITE2 are HOST TARGET binding sites found in untranslated regions of mRNA encoded by LOC146268, corresponding to HOST TARGET binding sites such as BINDING SITE I, BINDING SITE II or BINDING SITE III. Table 2 illustrates the complementarity of the nucleotide sequences of LOC146268 BINDING SITE1 and LOC146268 BINDING SITE2, designated SEQ ID:38126 and SEQ ID:38123 respectively, to the nucleotide sequence of VGAM1924 RNA, herein designated VGAM RNA, also designated SEQ ID:4635.

Another function of VGAM1924 is therefore inhibition of LOC146268 (Accession XM_085397). Accordingly, utilities of VGAM1924 include diagnosis, prevention and treatment of diseases and clinical conditions associated with LOC146268. LOC146952 (Accession XM_097138) is another VGAM1924 host target gene. LOC146952 BINDING SITE is HOST TARGET binding site found in the 5' untranslated region of mRNA encoded by LOC146952, corresponding to a HOST TARGET binding site such as BINDING SITE I, BINDING SITE II or BINDING SITE III. Table 2 illustrates the complementarity of the nucleotide sequences of LOC146952 BINDING SITE, designated SEQ ID:40768, to the nucleotide sequence of VGAM1924 RNA, herein designated VGAM RNA, also designated SEQ ID:4635.

Another function of VGAM1924 is therefore inhibition of LOC146952 (Accession XM_097138). Accordingly, utilities of VGAM1924 include diagnosis, prevention and treatment of diseases and clinical conditions associated with LOC146952. LOC147219 (Accession XM_097214) is another VGAM1924 host target gene. LOC147219 BINDING SITE is HOST TARGET binding site found in the 3' untranslated region of mRNA encoded by LOC147219, corresponding to a HOST TARGET binding site such as BINDING SITE I, BINDING SITE II or BINDING SITE III. Table 2 illustrates the complementarity of the nucleotide sequences of LOC147219 BINDING SITE, designated SEQ ID:40820, to the nucleotide sequence of VGAM1924 RNA, herein designated VGAM RNA, also designated SEQ ID:4635.

Another function of VGAM1924 is therefore inhibition of LOC147219 (Accession XM_097214). Accordingly, utilities of VGAM1924 include diagnosis, prevention and treatment of diseases and clinical conditions associated with LOC147219. LOC147622 (Accession XM_097255) is another VGAM1924 host target gene. LOC147622 BINDING SITE is HOST TARGET binding site found in the 5' untranslated region of mRNA encoded by LOC147622, corresponding to a HOST TARGET binding site such as BINDING SITE I, BINDING SITE II or BINDING SITE III. Table 2 illustrates the complementarity of the nucleotide sequences of LOC147622 BINDING SITE, designated SEQ ID:40852, to the nucleotide sequence of VGAM1924 RNA, herein designated VGAM RNA, also designated SEQ ID:4635.

Another function of VGAM1924 is therefore inhibition of LOC147622 (Accession XM_097255). Accordingly, utilities of VGAM1924 include diagnosis, prevention and treatment of diseases and clinical conditions associated with LOC147622. LOC147694 (Accession XM_085843) is another VGAM1924 host target gene. LOC147694 BINDING SITE is HOST TARGET binding site found in the 3' untranslated region of mRNA encoded by LOC147694, corresponding to a HOST TARGET binding site such as BINDING SITE I, BINDING SITE II or BINDING SITE III. Table 2 illustrates the complementarity of the nucleotide sequences of LOC147694 BINDING SITE, designated SEQ ID:38370, to the nucleotide sequence of VGAM1924 RNA, herein designated VGAM RNA, also designated SEQ ID:4635.

Another function of VGAM1924 is therefore inhibition of LOC147694 (Accession XM_085843). Accordingly, utilities of VGAM1924 include diagnosis, prevention and treatment of diseases and clinical conditions associated with LOC147694. LOC148530 (Accession XM_097480) is another VGAM1924 host target gene. LOC148530 BINDING SITE is HOST TARGET binding site found in the 5' untranslated region of mRNA encoded by LOC148530, corresponding to a HOST TARGET binding site such as BINDING SITE I, BINDING SITE II or BINDING SITE III. Table 2 illustrates the complementarity of the nucleotide sequences of LOC148530 BINDING SITE, designated SEQ ID:40886, to the nucleotide sequence of VGAM1924 RNA, herein designated VGAM RNA, also designated SEQ ID:4635.

Another function of VGAM1924 is therefore inhibition of LOC148530 (Accession XM_097480). Accordingly, utilities of VGAM1924 include diagnosis, prevention and treatment of diseases and clinical conditions associated with LOC148530. LOC149302 (Accession XM_086489) is another VGAM1924 host target gene. LOC149302 BINDING SITE is HOST TARGET binding site found in the 5' untranslated region of mRNA encoded by LOC149302, corresponding to a HOST TARGET binding site such as BINDING SITE I, BINDING SITE II or BINDING SITE III. Table 2 illustrates the complementarity of the nucleotide sequences of LOC149302 BINDING SITE, designated SEQ ID:38705, to the nucleotide sequence of VGAM1924 RNA, herein designated VGAM RNA, also designated SEQ ID:4635.

Another function of VGAM1924 is therefore inhibition of LOC149302 (Accession XM_086489). Accordingly, utilities of VGAM1924 include diagnosis, prevention and treatment of diseases and clinical conditions associated with LOC149302. LOC149332 (Accession XM_097626) is another VGAM1924 host target gene. LOC149332 BINDING SITE is HOST TARGET binding site found in the 3' untranslated region of mRNA encoded by LOC149332, corresponding to a HOST TARGET binding site such as BINDING SITE I, BINDING SITE II or BINDING SITE III. Table 2 illustrates the complementarity of the nucleotide sequences of LOC149332 BINDING SITE, designated SEQ ID:40983, to the nucleotide sequence of VGAM1924 RNA, herein designated VGAM RNA, also designated SEQ ID:4635.

Another function of VGAM1924 is therefore inhibition of LOC149332 (Accession XM_097626). Accordingly, utilities of VGAM1924 include diagnosis, prevention and treatment of diseases and clinical conditions associated with LOC149332. LOC150170 (Accession XM_086799) is another VGAM1924 host target gene. LOC150170 BINDING SITE is HOST TARGET binding site found in the 5' untranslated region of mRNA encoded by LOC150170, corresponding to a HOST TARGET binding site such as BINDING SITE I, BINDING SITE II or BINDING SITE III. Table 2 illustrates the complementarity of the nucleotide sequences of LOC150170 BINDING SITE, designated SEQ ID:38863, to the nucleotide sequence of VGAM1924 RNA, herein designated VGAM RNA, also designated SEQ ID:4635.

Another function of VGAM1924 is therefore inhibition of LOC150170 (Accession XM_086799). Accordingly, utilities of VGAM1924 include diagnosis, prevention and treatment of diseases and clinical conditions associated with LOC150170. LOC150175 (Accession XM_086806) is another VGAM1924 host target gene. LOC150175 BINDING SITE is HOST TARGET binding site found in the 5' untranslated region of mRNA encoded by LOC150175, corresponding to a HOST TARGET binding site such as BINDING SITE I, BINDING SITE II or BINDING SITE III. Table 2 illustrates the complementarity of the nucleotide sequences of LOC150175 BINDING SITE, designated SEQ ID:38885, to the nucleotide sequence of VGAM1924 RNA, herein designated VGAM RNA, also designated SEQ ID:4635.

Another function of VGAM1924 is therefore inhibition of LOC150175 (Accession XM_086806). Accordingly, utilities of VGAM1924 include diagnosis, prevention and treatment of diseases and clinical conditions associated with LOC150175. LOC150215 (Accession XM_086813) is another VGAM1924 host target gene. LOC150215 BINDING SITE is HOST TARGET binding site found in the 5' untranslated region of mRNA encoded by LOC150215, corresponding to a HOST TARGET binding site such as BINDING SITE I, BINDING SITE II or BINDING SITE III. Table 2 illustrates the complementarity of the nucleotide sequences of LOC150215 BINDING SITE, designated SEQ ID:38889, to the nucleotide sequence of VGAM1924 RNA, herein designated VGAM RNA, also designated SEQ ID:4635.

Another function of VGAM1924 is therefore inhibition of LOC150215 (Accession XM_086813). Accordingly, utilities of VGAM1924 include diagnosis, prevention and treatment of diseases and clinical conditions associated with LOC150215. LOC150218 (Accession XM_086850) is another VGAM1924 host target gene. LOC150218 BINDING SITE is HOST TARGET binding site found in the 5' untranslated region of mRNA encoded by LOC150218, corresponding to a HOST TARGET binding site such as BINDING SITE I, BINDING SITE II or BINDING SITE III. Table 2 illustrates the complementarity of the nucleotide sequences of LOC150218 BINDING SITE, designated SEQ ID:38916, to the nucleotide sequence of VGAM1924 RNA, herein designated VGAM RNA, also designated SEQ ID:4635.

Another function of VGAM1924 is therefore inhibition of LOC150218 (Accession XM_086850). Accordingly, utilities of VGAM1924 include diagnosis, prevention and treatment of diseases and clinical conditions associated with LOC150218. LOC150225 (Accession XM_097870) is another VGAM1924 host target gene. LOC150225 BINDING SITE is HOST TARGET binding site found in the 5' untranslated region of mRNA encoded by LOC150225, corresponding to a HOST TARGET binding site such as BINDING SITE I, BINDING SITE II or BINDING SITE III. Table 2 illustrates the complementarity of the nucleotide sequences of LOC150225 BINDING SITE, designated SEQ ID:41191, to the nucleotide sequence of VGAM1924 RNA, herein designated VGAM RNA, also designated SEQ ID:4635.

Another function of VGAM1924 is therefore inhibition of LOC150225 (Accession XM_097870). Accordingly, utilities of VGAM1924 include diagnosis, prevention and treatment of diseases and clinical conditions associated with LOC150225. LOC150311 (Accession XM_086858) is another VGAM1924 host target gene. LOC150311 BINDING SITE is HOST TARGET binding site found in the 5' untranslated region of mRNA encoded by LOC150311, corresponding to a HOST TARGET binding site such as BINDING SITE I, BINDING SITE II or BINDING SITE III. Table 2 illustrates the complementarity of the nucleotide sequences of LOC150311 BINDING SITE, designated SEQ ID:38926, to the nucleotide sequence of VGAM1924 RNA, herein designated VGAM RNA, also designated SEQ ID:4635.

Another function of VGAM1924 is therefore inhibition of LOC150311 (Accession XM_086858). Accordingly, utilities of VGAM1924 include diagnosis, prevention and treatment of diseases and clinical conditions associated with LOC150311. LOC150397 (Accession XM_086907) is another VGAM1924 host target gene. LOC150397 BINDING SITE is HOST TARGET binding site found in the 3' untranslated region of mRNA encoded by LOC150397, corresponding to a HOST TARGET binding site such as BINDING SITE I, BINDING SITE II or BINDING SITE III. Table 2 illustrates the complementarity of the nucleotide sequences of LOC150397 BINDING SITE, designated SEQ ID:38963, to the nucleotide sequence of VGAM1924 RNA, herein designated VGAM RNA, also designated SEQ ID:4635.

Another function of VGAM1924 is therefore inhibition of LOC150397 (Accession XM_086907). Accordingly, utilities of VGAM1924 include diagnosis, prevention and treatment of diseases and clinical conditions associated with LOC150397. LOC150418 (Accession XM_037522) is another VGAM1924 host target gene. LOC150418 BINDING SITE is HOST TARGET binding site found in the 5' untranslated region of mRNA encoded by LOC150418, corresponding to a HOST TARGET binding site such as BIND- ING SITE I, BINDING SITE II or BINDING SITE III. Table 2 illustrates the complementarity of the nucleotide sequences of LOC150418 BINDING SITE, designated SEQ ID:32637, to the nucleotide sequence of VGAM1924 RNA, herein designated VGAM RNA, also designated SEQ ID:4635.

Another function of VGAM1924 is therefore inhibition of LOC150418 (Accession XM_037522). Accordingly, utilities of VGAM1924 include diagnosis, prevention and treatment of diseases and clinical conditions associated with LOC150418. LOC150630 (Accession XM_097931) is another VGAM1924 host target gene. LOC150630 BINDING SITE is HOST TARGET binding site found in the 5' untranslated region of mRNA encoded by LOC150630, corresponding to a HOST TARGET binding site such as BINDING SITE I, BINDING SITE II or BINDING SITE III. Table 2 illustrates the complementarity of the nucleotide sequences of LOC150630 BINDING SITE, designated SEQ ID:41240, to the nucleotide sequence of VGAM1924 RNA, herein designated VGAM RNA, also designated SEQ ID:4635.

Another function of VGAM1924 is therefore inhibition of LOC150630 (Accession XM_097931). Accordingly, utilities of VGAM1924 include diagnosis, prevention and treatment of diseases and clinical conditions associated with LOC150630. LOC150819 (Accession XM_097954) is another VGAM1924 host target gene. LOC150819 BINDING SITE is HOST TARGET binding site found in the 5' untranslated region of mRNA encoded by LOC150819, corresponding to a HOST TARGET binding site such as BINDING SITE I, BINDING SITE II or BINDING SITE III. Table 2 illustrates the complementarity of the nucleotide sequences of LOC150819 BINDING SITE, designated SEQ ID:41248, to the nucleotide sequence of VGAM1924 RNA, herein designated VGAM RNA, also designated SEQ ID:4635.

Another function of VGAM1924 is therefore inhibition of LOC150819 (Accession XM_097954). Accordingly, utilities of VGAM1924 include diagnosis, prevention and treatment of diseases and clinical conditions associated with LOC150819. LOC151283 (Accession XM_087154) is another VGAM1924 host target gene. LOC151283 BINDING SITE is HOST TARGET binding site found in the 3' untranslated region of mRNA encoded by LOC151283, corresponding to a HOST TARGET binding site such as BINDING SITE I, BINDING SITE II or BINDING SITE III. Table 2 illustrates the complementarity of the nucleotide sequences of LOC151283 BINDING SITE, designated SEQ ID:39092, to the nucleotide sequence of VGAM1924 RNA, herein designated VGAM RNA, also designated SEQ ID:4635.

Another function of VGAM1924 is therefore inhibition of LOC151283 (Accession XM_087154). Accordingly, utilities of VGAM1924 include diagnosis, prevention and treatment of diseases and clinical conditions associated with LOC151283. LOC151429 (Accession XM_098059) is another VGAM1924 host target gene. LOC151429 BINDING SITE is HOST TARGET binding site found in the 3' untranslated region of mRNA encoded by LOC151429, corresponding to a HOST TARGET binding site such as BINDING SITE I, BINDING SITE II or BINDING SITE III. Table 2 illustrates the complementarity of the nucleotide sequences of LOC151429 BINDING SITE, designated SEQ ID:41343, to the nucleotide sequence of VGAM1924 RNA, herein designated VGAM RNA, also designated SEQ ID:4635.

Another function of VGAM1924 is therefore inhibition of LOC151429 (Accession XM_098059). Accordingly, utilities of VGAM1924 include diagnosis, prevention and treatment of diseases and clinical conditions associated with LOC151429. LOC152024 (Accession XM_087365) is another VGAM1924 host target gene. LOC152024 BINDING SITE is HOST TARGET binding site found in the 5' untranslated region of mRNA encoded by LOC152024, corresponding to a HOST TARGET binding site such as BINDING SITE I, BINDING SITE II or BINDING SITE III. Table 2 illustrates the complementarity of the nucleotide sequences of LOC152024 BINDING SITE, designated SEQ ID:39199, to the nucleotide sequence of VGAM1924 RNA, herein designated VGAM RNA, also designated SEQ ID:4635.

Another function of VGAM1924 is therefore inhibition of LOC152024 (Accession XM_087365). Accordingly, utilities of VGAM1924 include diagnosis, prevention and treatment of diseases and clinical conditions associated with LOC152024. LOC152220 (Accession XM_098176) is another VGAM1924 host target gene. LOC152220 BINDING SITE1 and LOC152220 BINDING SITE2 are HOST TARGET binding sites found in untranslated regions of mRNA encoded by LOC152220, corresponding to HOST TARGET binding sites such as BINDING SITE I, BINDING SITE II or BINDING SITE III. Table 2 illustrates the complementarity of the nucleotide sequences of LOC152220 BINDING SITE1 and LOC152220 BINDING SITE2, designated SEQ ID:41445 and SEQ ID:41447 respectively, to the nucleotide sequence of VGAM1924 RNA, herein designated VGAM RNA, also designated SEQ ID:4635.

Another function of VGAM1924 is therefore inhibition of LOC152220 (Accession XM_098176). Accordingly, utilities of VGAM1924 include diagnosis, prevention and treatment of diseases and clinical conditions associated with LOC152220. LOC152926 (Accession XM_087562) is another VGAM1924 host target gene. LOC152926 BINDING SITE is HOST TARGET binding site found in the 3' untranslated region of mRNA encoded by LOC152926, corresponding to a HOST TARGET binding site such as BINDING SITE I, BINDING SITE II or BINDING SITE III. Table 2 illustrates the complementarity of the nucleotide sequences of LOC152926 BINDING SITE, designated SEQ ID:39341, to the nucleotide sequence of VGAM1924 RNA, herein designated VGAM RNA, also designated SEQ ID:4635.

Another function of VGAM1924 is therefore inhibition of LOC152926 (Accession XM_087562). Accordingly, utilities of VGAM1924 include diagnosis, prevention and treatment of diseases and clinical conditions associated with LOC152926. LOC154739 (Accession XM_098602) is another VGAM1924 host target gene. LOC154739 BINDING SITE is HOST TARGET binding site found in the 5' untranslated region of mRNA encoded by LOC154739, corresponding to a HOST TARGET binding site such as BINDING SITE I, BINDING SITE II or BINDING SITE III. Table 2 illustrates the complementarity of the nucleotide sequences of LOC154739 BINDING SITE, designated SEQ ID:41723, to the nucleotide sequence of VGAM1924 RNA, herein designated VGAM RNA, also designated SEQ ID:4635.

Another function of VGAM1924 is therefore inhibition of LOC154739 (Accession XM_098602). Accordingly, utilities of VGAM1924 include diagnosis, prevention and treatment of diseases and clinical conditions associated with LOC154739. LOC157858 (Accession XM_098833) is another VGAM1924 host target gene. LOC157858 BINDING SITE is HOST TARGET binding site found in the 5' untranslated region of mRNA encoded by LOC157858, corresponding to a HOST TARGET binding site such as BINDING SITE I, BINDING SITE II or BINDING SITE III. Table 2 illustrates the complementarity of the nucleotide sequences of LOC157858 BINDING SITE, designated SEQ ID:41866, to the nucleotide sequence of VGAM1924 RNA, herein designated VGAM RNA, also designated SEQ ID:4635.

Another function of VGAM1924 is therefore inhibition of LOC157858 (Accession XM_098833). Accordingly, utilities of VGAM1924 include diagnosis, prevention and treatment of diseases and clinical conditions associated with LOC157858. LOC157918 (Accession XM_098842) is another VGAM1924 host target gene. LOC157918 BINDING SITE is HOST TARGET binding site found in the 3' untranslated region of mRNA encoded by LOC157918, corresponding to a HOST TARGET binding site such as BINDING SITE I, BINDING SITE II or BINDING SITE III. Table 2 illustrates the complementarity of the nucleotide sequences of LOC157918 BINDING SITE, designated SEQ ID:41897, to the nucleotide sequence of VGAM1924 RNA, herein designated VGAM RNA, also designated SEQ ID:4635.

Another function of VGAM1924 is therefore inhibition of LOC157918 (Accession XM_098842). Accordingly, utilities of VGAM1924 include diagnosis, prevention and treatment of diseases and clinical conditions associated with LOC157918. LOC158014 (Accession XM_088442) is another VGAM1924 host target gene. LOC158014 BINDING SITE is HOST TARGET binding site found in the 5' untranslated region of mRNA encoded by LOC158014, corresponding to a HOST TARGET binding site such as BINDING SITE I, BINDING SITE II or BINDING SITE III. Table 2 illustrates the complementarity of the nucleotide sequences of LOC158014 BINDING SITE, designated SEQ ID:39698, to the nucleotide sequence of VGAM1924 RNA, herein designated VGAM RNA, also designated SEQ ID:4635.

Another function of VGAM1924 is therefore inhibition of LOC158014 (Accession XM_088442). Accordingly, utilities of VGAM1924 include diagnosis, prevention and treatment of diseases and clinical conditions associated with LOC158014. LOC158954 (Accession XM_017340) is another VGAM1924 host target gene. LOC158954 BINDING SITE is HOST TARGET binding site found in the 3' untranslated region of mRNA encoded by LOC158954, corresponding to a HOST TARGET binding site such as BINDING SITE I, BINDING SITE II or BINDING SITE III. Table 2 illustrates the complementarity of the nucleotide sequences of LOC158954 BINDING SITE, designated SEQ ID:30314, to the nucleotide sequence of VGAM1924 RNA, herein designated VGAM RNA, also designated SEQ ID:4635.

Another function of VGAM1924 is therefore inhibition of LOC158954 (Accession XM_017340). Accordingly, utilities of VGAM1924 include diagnosis, prevention and treatment of diseases and clinical conditions associated with LOC158954. LOC161003 (Accession NM_145286) is another VGAM1924 host target gene. LOC161003 BINDING SITE is HOST TARGET binding site found in the 3' untranslated region of mRNA encoded by LOC161003, corresponding to a HOST TARGET binding site such as BINDING SITE I, BINDING SITE II or BINDING SITE III. Table 2 illustrates the complementarity of the nucleotide sequences of LOC161003 BINDING SITE, designated SEQ ID:29803, to the nucleotide sequence of VGAM1924 RNA, herein designated VGAM RNA, also designated SEQ ID:4635.

Another function of VGAM1924 is therefore inhibition of LOC161003 (Accession NM_145286). Accordingly, utilities of VGAM1924 include diagnosis, prevention and treatment of diseases and clinical conditions associated with LOC161003. LOC164971 (Accession XM_092280) is another VGAM1924 host target gene. LOC164971 BINDING SITE is HOST TARGET binding site found in the 5' untranslated region of mRNA encoded by LOC164971, corresponding to a HOST TARGET binding site such as BINDING SITE I, BINDING SITE II or BINDING SITE III. Table 2 illustrates the complementarity of the nucleotide sequences of LOC164971 BINDING SITE, designated SEQ ID:40115, to the nucleotide sequence of VGAM1924 RNA, herein designated VGAM RNA, also designated SEQ ID:4635.

Another function of VGAM1924 is therefore inhibition of LOC164971 (Accession XM_092280). Accordingly, utilities of VGAM1924 include diagnosis, prevention and treatment of diseases and clinical conditions associated with LOC164971. LOC168667 (Accession XM_166592) is another VGAM1924 host target gene. LOC168667 BINDING SITE is HOST TARGET binding site found in the 3' untranslated region of mRNA encoded by LOC168667, corresponding to a HOST TARGET binding site such as BINDING SITE I, BINDING SITE II or BINDING SITE III. Table 2 illustrates the complementarity of the nucleotide sequences of LOC168667 BINDING SITE, designated SEQ ID:44565, to the nucleotide sequence of VGAM1924 RNA, herein designated VGAM RNA, also designated SEQ ID:4635.

Another function of VGAM1924 is therefore inhibition of LOC168667 (Accession XM_166592). Accordingly, utilities of VGAM1924 include diagnosis, prevention and treatment of diseases and clinical conditions associated with LOC168667. LOC196264 (Accession XM_113683) is another VGAM1924 host target gene. LOC196264 BINDING SITE is HOST TARGET binding site found in the 3' untranslated region of mRNA encoded by LOC196264, corresponding to a HOST TARGET binding site such as BINDING SITE I, BINDING SITE II or BINDING SITE III. Table 2 illustrates the complementarity of the nucleotide sequences of LOC196264 BINDING SITE, designated SEQ ID:42335, to the nucleotide sequence of VGAM1924 RNA, herein designated VGAM RNA, also designated SEQ ID:4635.

Another function of VGAM1924 is therefore inhibition of LOC196264 (Accession XM_113683). Accordingly, utilities of VGAM1924 include diagnosis, prevention and treatment of diseases and clinical conditions associated with LOC196264. LOC196812 (Accession XM_116868) is another VGAM1924 host target gene. LOC196812 BINDING SITE is HOST TARGET binding site found in the 3' untranslated region of mRNA encoded by LOC196812, corresponding to a HOST TARGET binding site such as BINDING SITE I, BINDING SITE II or BINDING SITE III. Table 2 illustrates the complementarity of the nucleotide sequences of LOC196812 BINDING SITE, designated SEQ ID:43138, to the nucleotide sequence of VGAM1924 RNA, herein designated VGAM RNA, also designated SEQ ID:4635.

Another function of VGAM1924 is therefore inhibition of LOC196812 (Accession XM_116868). Accordingly, utilities of VGAM1924 include diagnosis, prevention and treatment of diseases and clinical conditions associated with LOC196812. LOC197319 (Accession XM_113862) is another VGAM1924 host target gene. LOC197319 BINDING SITE is HOST TARGET binding site found in the 3' untranslated region of mRNA encoded by LOC197319, corresponding to a HOST TARGET binding site such as BINDING SITE I, BINDING SITE II or BINDING SITE III. Table 2 illustrates the complementarity of the nucleotide sequences of LOC197319 BINDING SITE, designated SEQ ID:42476, to the nucleotide sequence of VGAM1924 RNA, herein designated VGAM RNA, also designated SEQ ID:4635.

Another function of VGAM1924 is therefore inhibition of LOC197319 (Accession XM_113862). Accordingly, utilities of VGAM1924 include diagnosis, prevention and treatment of diseases and clinical conditions associated with LOC197319. LOC199678 (Accession XM_117111) is another VGAM1924 host target gene. LOC199678 BINDING SITE is HOST TARGET binding site found in the 3' untranslated region of mRNA encoded by LOC199678, corresponding to a HOST TARGET binding site such as BINDING SITE I, BINDING SITE II or BINDING SITE III. Table 2 illustrates the complementarity of the nucleotide sequences of LOC199678 BINDING SITE, designated SEQ ID:43229, to the nucleotide sequence of VGAM1924 RNA, herein designated VGAM RNA, also designated SEQ ID:4635.

Another function of VGAM1924 is therefore inhibition of LOC199678 (Accession XM_117111). Accordingly, utilities of VGAM1924 include diagnosis, prevention and treatment of diseases and clinical conditions associated with LOC199678. LOC200470 (Accession XM_117235) is another VGAM1924 host target gene. LOC200470 BINDING SITE is HOST TARGET binding site found in the 5' untranslated region of mRNA encoded by LOC200470, corresponding to a HOST TARGET binding site such as BINDING SITE I, BINDING SITE II or BINDING SITE III. Table 2 illustrates the complementarity of the nucleotide sequences of LOC200470 BINDING SITE, designated SEQ ID:43311, to the nucleotide sequence of VGAM1924 RNA, herein designated VGAM RNA, also designated SEQ ID:4635.

Another function of VGAM1924 is therefore inhibition of LOC200470 (Accession XM_117235). Accordingly, utilities of VGAM1924 include diagnosis, prevention and treatment of diseases and clinical conditions associated with LOC200470. LOC201895 (Accession XM_114396) is another VGAM1924 host target gene. LOC201895 BINDING SITE is HOST TARGET binding site found in the 3' untranslated region of mRNA encoded by LOC201895, corresponding to a HOST TARGET binding site such as BINDING SITE I, BINDING SITE II or BINDING SITE III. Table 2 illustrates the complementarity of the nucleotide sequences of LOC201895 BINDING SITE, designated SEQ ID:42927, to the nucleotide sequence of VGAM1924 RNA, herein designated VGAM RNA, also designated SEQ ID:4635.

Another function of VGAM1924 is therefore inhibition of LOC201895 (Accession XM_114396). Accordingly, utilities of VGAM1924 include diagnosis, prevention and treatment of diseases and clinical conditions associated with LOC201895. LOC202934 (Accession XM_117486) is another VGAM1924 host target gene. LOC202934 BINDING SITE is HOST TARGET binding site found in the 5' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43468, to the nucleotide sequence of VGAM1924 RNA, herein designated VGAM RNA, also designated SEQ ID:4635.

Another function of VGAM1924 is therefore inhibition of LOC202934 (Accession XM_117486). Accordingly, utilities of VGAM1924 include diagnosis, prevention and treatment of diseases and clinical conditions associated with LOC202934. LOC203536 (Accession XM_114716) is another VGAM1924 host target gene. LOC203536 BINDING SITE is HOST TARGET binding site found in the 3' untranslated region of mRNA encoded by LOC203536, corresponding to a HOST TARGET binding site such as BINDING SITE I, BINDING SITE II or BINDING SITE III. Table 2 illustrates the complementarity of the nucleotide sequences of LOC203536 BINDING SITE, designated SEQ ID:43058, to the nucleotide sequence of VGAM1924 RNA, herein designated VGAM RNA, also designated SEQ ID:4635.

Another function of VGAM1924 is therefore inhibition of LOC203536 (Accession XM_114716). Accordingly, utilities of VGAM1924 include diagnosis, prevention and treatment of diseases and clinical conditions associated with LOC203536. LOC219790 (Accession XM_166124) is another VGAM1924 host target gene. LOC219790 BINDING SITE is HOST TARGET binding site found in the 3' untranslated region of mRNA encoded by LOC219790, corresponding to a HOST TARGET binding site such as BINDING SITE I, BINDING SITE II or BINDING SITE III. Table 2 illustrates the complementarity of the nucleotide sequences of LOC219790 BINDING SITE, designated SEQ ID:43905, to the nucleotide sequence of VGAM1924 RNA, herein designated VGAM RNA, also designated SEQ ID:4635.

Another function of VGAM1924 is therefore inhibition of LOC219790 (Accession XM_166124). Accordingly, utilities of VGAM1924 include diagnosis, prevention and treatment of diseases and clinical conditions associated with LOC219790. LOC221061 (Accession XM_167709) is another VGAM1924 host target gene. LOC221061 BINDING SITE is HOST TARGET binding site found in the 3' untranslated region of mRNA encoded by LOC221061, corresponding to a HOST TARGET binding site such as BINDING SITE I, BINDING SITE II or BINDING SITE III. Table 2 illustrates the complementarity of the nucleotide sequences of LOC221061 BINDING SITE, designated SEQ ID:44771, to the nucleotide sequence of VGAM1924 RNA, herein designated VGAM RNA, also designated SEQ ID:4635.

Another function of VGAM1924 is therefore inhibition of LOC221061 (Accession XM_167709). Accordingly, utilities of VGAM1924 include diagnosis, prevention and treatment of diseases and clinical conditions associated with LOC221061. LOC221288 (Accession XM_168058) is another VGAM1924 host target gene. LOC221288 BINDING SITE is HOST TARGET binding site found in the 3' untranslated region of mRNA encoded by LOC221288, corresponding to a HOST TARGET binding site such as BINDING SITE I, BINDING SITE II or BINDING SITE III. Table 2 illustrates the complementarity of the nucleotide sequences of LOC221288 BINDING SITE, designated SEQ ID:44968, to the nucleotide sequence of VGAM1924 RNA, herein designated VGAM RNA, also designated SEQ ID:4635.

Another function of VGAM1924 is therefore inhibition of LOC221288 (Accession XM_168058). Accordingly, utilities of VGAM1924 include diagnosis, prevention and treatment of diseases and clinical conditions associated with LOC221288. LOC221474 (Accession XM_166464) is another VGAM1924 host target gene. LOC221474 BINDING SITE is HOST TARGET binding site found in the 5' untranslated region of mRNA encoded by LOC221474, corresponding to a HOST TARGET binding site such as BINDING SITE I, BINDING SITE II or BINDING SITE III. Table 2 illustrates the complementarity of the nucleotide sequences of LOC221474 BINDING SITE, designated SEQ ID:44384, to the nucleotide sequence of VGAM1924 RNA, herein designated VGAM RNA, also designated SEQ ID:4635.

Another function of VGAM1924 is therefore inhibition of LOC221474 (Accession XM_166464). Accordingly, utilities of VGAM1924 include diagnosis, prevention and treatment of diseases and clinical conditions associated with LOC221474. LOC221830 (Accession XM_166508) is another VGAM1924 host target gene. LOC221830 BINDING SITE1 and LOC221830 BINDING SITE2 are HOST TARGET binding sites found in untranslated regions of mRNA encoded by LOC221830, corresponding to HOST TARGET binding sites such as BINDING SITE I, BINDING SITE II or BINDING SITE III. Table 2 illustrates the complementarity of the nucleotide sequences of LOC221830 BINDING SITE1 and LOC221830 BINDING SITE2, designated SEQ ID:44436 and SEQ ID:44439 respectively, to the nucleotide sequence of VGAM1924 RNA, herein designated VGAM RNA, also designated SEQ ID:4635.

Another function of VGAM1924 is therefore inhibition of LOC221830 (Accession XM_166508). Accordingly, utilities of VGAM1924 include diagnosis, prevention and treatment of diseases and clinical conditions associated with LOC221830. LOC222008 (Accession XM_168361) is another VGAM1924 host target gene. LOC222008 BINDING SITE is HOST TARGET binding site found in the 3' untranslated region of mRNA encoded by LOC222008, corresponding to a HOST TARGET binding site such as BINDING SITE I, BINDING SITE II or BINDING SITE III. Table 2 illustrates the complementarity of the nucleotide sequences of LOC222008 BINDING SITE, designated SEQ ID:45127, to the nucleotide sequence of VGAM1924 RNA, herein designated VGAM RNA, also designated SEQ ID:4635.

Another function of VGAM1924 is therefore inhibition of LOC222008 (Accession XM_168361). Accordingly, utilities of VGAM1924 include diagnosis, prevention and treatment of diseases and clinical conditions associated with LOC222008. LOC222128 (Accession XM_166560) is another VGAM1924 host target gene. LOC222128 BINDING SITE is HOST TARGET binding site found in the 5' untranslated region of mRNA encoded by LOC222128, corresponding to a HOST TARGET binding site such as BINDING SITE I, BINDING SITE II or BINDING SITE III. Table 2 illustrates the complementarity of the nucleotide sequences of LOC222128 BINDING SITE, designated SEQ ID:44542, to the nucleotide sequence of VGAM1924 RNA, herein designated VGAM RNA, also designated SEQ ID:4635.

Another function of VGAM1924 is therefore inhibition of LOC222128 (Accession XM_166560). Accordingly, utilities of VGAM1924 include diagnosis, prevention and treatment of diseases and clinical conditions associated with LOC222128. LOC253019 (Accession XM_170907) is another VGAM1924 host target gene. LOC253019 BINDING SITE is HOST TARGET binding site found in the 3' untranslated region of mRNA encoded by LOC253019, corresponding to a HOST TARGET binding site such as BINDING SITE I, BINDING SITE II or BINDING SITE III. Table 2 illustrates the complementarity of the nucleotide sequences of LOC253019 BINDING SITE, designated SEQ ID:45667, to the nucleotide sequence of VGAM1924 RNA, herein designated VGAM RNA, also designated SEQ ID:4635.

Another function of VGAM1924 is therefore inhibition of LOC253019 (Accession XM_170907). Accordingly, utilities of VGAM1924 include diagnosis, prevention and treatment of diseases and clinical conditions associated with LOC253019. LOC253223 (Accession XM_170515) is another VGAM1924 host target gene. LOC253223 BINDING SITE is HOST TARGET binding site found in the 5' untranslated region of mRNA encoded by LOC253223, corresponding to a HOST TARGET binding site such as BINDING SITE I, BINDING SITE II or BINDING SITE III. Table 2 illustrates the complementarity of the nucleotide sequences of LOC253223 BINDING SITE, designated SEQ ID:45346, to the nucleotide sequence of VGAM1924 RNA, herein designated VGAM RNA, also designated SEQ ID:4635.

Another function of VGAM1924 is therefore inhibition of LOC253223 (Accession XM_170515). Accordingly, utilities of VGAM1924 include diagnosis, prevention and treatment of diseases and clinical conditions associated with LOC253223. LOC253258 (Accession XM_172870) is another VGAM1924 host target gene. LOC253258 BINDING SITE is HOST TARGET binding site found in the 3' untranslated region of mRNA encoded by LOC253258, corresponding to a HOST TARGET binding site such as BINDING SITE I, BINDING SITE II or BINDING SITE III. Table 2 illustrates the complementarity of the nucleotide sequences of LOC253258 BINDING SITE, designated SEQ ID:46147, to the nucleotide sequence of VGAM1924 RNA, herein designated VGAM RNA, also designated SEQ ID:4635.

Another function of VGAM1924 is therefore inhibition of LOC253258 (Accession XM_172870). Accordingly, utilities of VGAM1924 include diagnosis, prevention and treatment of diseases and clinical conditions associated with LOC253258. LOC253260 (Accession XM_171097) is another VGAM1924 host target gene. LOC253260 BINDING SITE is HOST TARGET binding site found in the 3' untranslated region of mRNA encoded by LOC253260, corresponding to a HOST TARGET binding site such as BINDING SITE I, BINDING SITE II or BINDING SITE III. Table 2 illustrates the complementarity of the nucleotide sequences of LOC253260 BINDING SITE, designated SEQ ID:45909, to the nucleotide sequence of VGAM1924 RNA, herein designated VGAM RNA, also designated SEQ ID:4635.

Another function of VGAM1924 is therefore inhibition of LOC253260 (Accession XM_171097). Accordingly, utilities of VGAM1924 include diagnosis, prevention and treatment of diseases and clinical conditions associated with LOC253260. LOC253975 (Accession XM_171130) is another VGAM1924 host target gene. LOC253975 BINDING SITE is HOST TARGET binding site found in the 3' untranslated region of mRNA encoded by LOC253975, corresponding to a HOST TARGET binding site such as BINDING SITE I, BINDING SITE II or BINDING SITE III. Table 2 illustrates the complementarity of the nucleotide sequences of LOC253975 BINDING SITE, designated SEQ ID:45934, to the nucleotide sequence of VGAM1924 RNA, herein designated VGAM RNA, also designated SEQ ID:4635.

Another function of VGAM1924 is therefore inhibition of LOC253975 (Accession XM_171130). Accordingly, utilities of VGAM1924 include diagnosis, prevention and treatment of diseases and clinical conditions associated with LOC253975. LOC255045 (Accession XM_171243) is another VGAM1924 host target gene. LOC255045 BINDING SITE is HOST TARGET binding site found in the 3' untranslated region of mRNA encoded by LOC255045, corresponding to a HOST TARGET binding site such as BINDING SITE I, BINDING SITE II or BINDING SITE III. Table 2 illustrates the complementarity of the nucleotide sequences of LOC255045 BINDING SITE, designated SEQ ID:46031, to the nucleotide sequence of VGAM1924 RNA, herein designated VGAM RNA, also designated SEQ ID:4635.

Another function of VGAM1924 is therefore inhibition of LOC255045 (Accession XM_171243). Accordingly, utilities of VGAM1924 include diagnosis, prevention and treatment of diseases and clinical conditions associated with LOC255045. LOC255326 (Accession XM_172832) is another VGAM1924 host target gene. LOC255326 BINDING SITE is HOST TARGET binding site found in the 3' untranslated region of mRNA encoded by LOC255326, corresponding to a HOST TARGET binding site such as BINDING SITE I, BINDING SITE II or BINDING SITE III. Table 2 illustrates the complementarity of the nucleotide sequences of LOC255326 BINDING SITE, designated SEQ ID:46106, to the nucleotide sequence of VGAM1924 RNA, herein designated VGAM RNA, also designated SEQ ID:4635.

Another function of VGAM1924 is therefore inhibition of LOC255326 (Accession XM_172832). Accordingly, utilities of VGAM1924 include diagnosis, prevention and treatment of diseases and clinical conditions associated with LOC255326. LOC255465 (Accession XM_173206) is another VGAM1924 host target gene. LOC255465 BINDING SITE1 and LOC255465 BINDING SITE2 are HOST TARGET binding sites found in untranslated regions of mRNA encoded by LOC255465, corresponding to HOST TARGET binding sites such as BINDING SITE I, BINDING SITE II or BINDING SITE III. Table 2 illustrates the complementarity of the nucleotide sequences of LOC255465 BINDING SITE1 and LOC255465 BINDING SITE2, designated SEQ ID:46460 and SEQ ID:46445 respectively, to the nucleotide sequence of VGAM1924 RNA, herein designated VGAM RNA, also designated SEQ ID:4635.

Another function of VGAM1924 is therefore inhibition of LOC255465 (Accession XM_173206). Accordingly, utilities of VGAM1924 include diagnosis, prevention and treatment of diseases and clinical conditions associated with LOC255465. LOC256273 (Accession XM_172847) is another VGAM1924 host target gene. LOC256273 BINDING SITE is HOST TARGET binding site found in the 5' untranslated region of mRNA encoded by LOC256273, corresponding to a HOST TARGET binding site such as BINDING SITE I, BINDING SITE II or BINDING SITE III. Table 2 illustrates the complementarity of the nucleotide sequences of LOC256273 BINDING SITE, designated SEQ ID:46125, to the nucleotide sequence of VGAM1924 RNA, herein designated VGAM RNA, also designated SEQ ID:4635.

Another function of VGAM1924 is therefore inhibition of LOC256273 (Accession XM_172847). Accordingly, utilities of VGAM1924 include diagnosis, prevention and treatment of diseases and clinical conditions associated with LOC256273. LOC256277 (Accession XM_170644) is another VGAM1924 host target gene. LOC256277 BINDING SITE is HOST TARGET binding site found in the 5' untranslated region of mRNA encoded by LOC256277, corresponding to a HOST TARGET binding site such as BINDING SITE I, BINDING SITE II or BINDING SITE III. Table 2 illustrates the complementarity of the nucleotide sequences of LOC256277 BINDING SITE, designated SEQ ID:45426, to the nucleotide sequence of VGAM1924 RNA, herein designated VGAM RNA, also designated SEQ ID:4635.

Another function of VGAM1924 is therefore inhibition of LOC256277 (Accession XM_170644). Accordingly, utilities of VGAM1924 include diagnosis, prevention and treatment of diseases and clinical conditions associated with LOC256277. LOC256733 (Accession XM_173116) is another VGAM1924 host target gene. LOC256733 BINDING SITE is HOST TARGET binding site found in the 5' untranslated region of mRNA encoded by LOC256733, corresponding to a HOST TARGET binding site such as BINDING SITE I, BINDING SITE II or BINDING SITE III. Table 2 illustrates the complementarity of the nucleotide sequences of LOC256733 BINDING SITE, designated SEQ ID:46368, to the nucleotide sequence of VGAM1924 RNA, herein designated VGAM RNA, also designated SEQ ID:4635.

Another function of VGAM1924 is therefore inhibition of LOC256733 (Accession XM_173116). Accordingly, utilities of VGAM1924 include diagnosis, prevention and treatment of diseases and clinical conditions associated with LOC256733. LOC257441 (Accession XM_170961) is another VGAM1924 host target gene. LOC257441 BINDING SITE is HOST TARGET binding site found in the 5' untranslated region of mRNA encoded by LOC257441, corresponding to a HOST TARGET binding site such as BINDING SITE I, BINDING SITE II or BINDING SITE III. Table 2 illustrates the complementarity of the nucleotide sequences of LOC257441 BINDING SITE, designated SEQ ID:45744, to the nucleotide sequence of VGAM1924 RNA, herein designated VGAM RNA, also designated SEQ ID:4635.

Another function of VGAM1924 is therefore inhibition of LOC257441 (Accession XM_170961). Accordingly, utilities of VGAM1924 include diagnosis, prevention and treatment of diseases and clinical conditions associated with LOC257441. LOC257486 (Accession XM_045029) is another VGAM1924 host target gene. LOC257486 BINDING SITE is HOST TARGET binding site found in the 3' untranslated region of mRNA encoded by LOC257486, corresponding to a HOST TARGET binding site such as BINDING SITE I, BINDING SITE II or BINDING SITE III. Table 2 illustrates the complementarity of the nucleotide sequences of LOC257486 BINDING SITE, designated SEQ ID:34326, to the nucleotide sequence of VGAM1924 RNA, herein designated VGAM RNA, also designated SEQ ID:4635.

Another function of VGAM1924 is therefore inhibition of LOC257486 (Accession XM_045029). Accordingly, utilities of VGAM1924 include diagnosis, prevention and treatment of diseases and clinical conditions associated with LOC257486. LOC257513 (Accession XM_175148) is another VGAM1924 host target gene. LOC257513 BINDING SITE is HOST TARGET binding site found in the 5' untranslated region of mRNA encoded by LOC257513, corresponding to a HOST TARGET binding site such as BINDING SITE I, BINDING SITE II or BINDING SITE III. Table 2 illustrates the complementarity of the nucleotide sequences of LOC257513 BINDING SITE, designated SEQ ID:46640, to the nucleotide sequence of VGAM1924 RNA, herein designated VGAM RNA, also designated SEQ ID:4635.

Another function of VGAM1924 is therefore inhibition of LOC257513 (Accession XM_175148). Accordingly, utilities of VGAM1924 include diagnosis, prevention and treatment of diseases and clinical conditions associated with LOC257513. LOC257567 (Accession XM_175241) is another VGAM1924 host target gene. LOC257567 BINDING SITE is HOST TARGET binding site found in the 5' untranslated region of mRNA encoded by LOC257567, corresponding to a HOST TARGET binding site such as BINDING SITE I, BINDING SITE II or BINDING SITE III. Table 2 illustrates the complementarity of the nucleotide sequences of LOC257567 BINDING SITE, designated SEQ ID:46699, to the nucleotide sequence of VGAM1924 RNA, herein designated VGAM RNA, also designated SEQ ID:4635.

Another function of VGAM1924 is therefore inhibition of LOC257567 (Accession XM_175241). Accordingly, utilities of VGAM1924 include diagnosis, prevention and treatment of diseases and clinical conditions associated with LOC257567. LOC51580 (Accession NM_015874) is another VGAM1924 host target gene. LOC51580 BINDING SITE is HOST TARGET binding site found in the 3' untranslated region of mRNA encoded by LOC51580, corresponding to a HOST TARGET binding site such as BINDING SITE I, BINDING SITE II or BINDING SITE III. Table 2 illustrates the complementarity of the nucleotide sequences of LOC51580 BINDING SITE, designated SEQ ID:18014, to the nucleotide sequence of VGAM1924 RNA, herein designated VGAM RNA, also designated SEQ ID:4635.

Another function of VGAM1924 is therefore inhibition of LOC51580 (Accession NM_015874). Accordingly, utilities of VGAM1924 include diagnosis, prevention and treatment of diseases and clinical conditions associated with LOC51580. LOC51634 (Accession NM_016024) is another VGAM1924 host target gene. LOC51634 BINDING SITE is HOST TARGET binding site found in the 3' untranslated region of mRNA encoded by LOC51634, corresponding to a HOST TARGET binding site such as BINDING SITE I, BINDING SITE II or BINDING SITE III. Table 2 illustrates the complementarity of the nucleotide sequences of LOC51634 BINDING SITE, designated SEQ ID:18103, to the nucleotide sequence of VGAM1924 RNA, herein designated VGAM RNA, also designated SEQ ID:4635.

Another function of VGAM1924 is therefore inhibition of LOC51634 (Accession NM_016024). Accordingly, utilities of VGAM1924 include diagnosis, prevention and treatment of diseases and clinical conditions associated with LOC51634. LOC54499 (Accession XM_047479) is another VGAM1924 host target gene. LOC54499 BINDING SITE is HOST TARGET binding site found in the 3' untranslated region of mRNA encoded by LOC54499, corresponding to a HOST TARGET binding site such as BINDING SITE I, BINDING SITE II or BINDING SITE III. Table 2 illustrates the complementarity of the nucleotide sequences of LOC54499 BINDING SITE, designated SEQ ID:34967, to the nucleotide sequence of VGAM1924 RNA, herein designated VGAM RNA, also designated SEQ ID:4635.

Another function of VGAM1924 is therefore inhibition of LOC54499 (Accession XM_047479). Accordingly, utilities of VGAM1924 include diagnosis, prevention and treatment of diseases and clinical conditions associated with LOC54499. LOC55885 (Accession NM_018640) is another VGAM1924 host target gene. LOC55885 BINDING SITE is HOST TARGET binding site found in the 3' untranslated region of mRNA encoded by LOC55885, corresponding to a HOST TARGET binding site such as BINDING SITE I, BINDING SITE II or BINDING SITE III. Table 2 illustrates the complementarity of the nucleotide sequences of LOC55885 BINDING SITE, designated SEQ ID:20713, to the nucleotide sequence of VGAM1924 RNA, herein designated VGAM RNA, also designated SEQ ID:4635.

Another function of VGAM1924 is therefore inhibition of LOC55885 (Accession NM_018640). Accordingly, utilities of VGAM1924 include diagnosis, prevention and treatment of diseases and clinical conditions associated with LOC55885. LOC56267 (Accession NM_019610) is another VGAM1924 host target gene. LOC56267 BINDING SITE is HOST TARGET binding site found in the 3' untranslated region of mRNA encoded by LOC56267, corresponding to a HOST TARGET binding site such as BINDING SITE I, BINDING SITE II or BINDING SITE III. Table 2 illustrates the complementarity of the nucleotide sequences of LOC56267 BINDING SITE, designated SEQ ID:21227, to the nucleotide sequence of VGAM1924 RNA, herein designated VGAM RNA, also designated SEQ ID:4635.

Another function of VGAM1924 is therefore inhibition of LOC56267 (Accession NM_019610). Accordingly, utilities of VGAM1924 include diagnosis, prevention and treatment of diseases and clinical conditions associated with LOC56267. LOC89932 (Accession XM_027341) is another VGAM1924 host target gene. LOC89932 BINDING SITE is HOST TARGET binding site found in the 3' untranslated region of mRNA encoded by LOC89932, corresponding to a HOST TARGET binding site such as BINDING SITE I, BINDING SITE II or BINDING SITE III. Table 2 illustrates the complementarity of the nucleotide sequences of LOC89932 BINDING SITE, designated SEQ ID:30489, to the nucleotide sequence of VGAM1924 RNA, herein designated VGAM RNA, also designated SEQ ID:4635.

Another function of VGAM1924 is therefore inhibition of LOC89932 (Accession XM_027341). Accordingly, utilities of VGAM1924 include diagnosis, prevention and treatment of diseases and clinical conditions associated with LOC89932. LOC90333 (Accession XM_030958) is another VGAM1924 host target gene. LOC90333 BINDING SITE is HOST TARGET binding site found in the 3' untranslated region of mRNA encoded by LOC90333, corresponding to a HOST TARGET binding site such as BINDING SITE I, BINDING SITE II or BINDING SITE III. Table 2 illustrates the complementarity of the nucleotide sequences of LOC90333 BINDING SITE, designated SEQ ID:31223, to the nucleotide sequence of VGAM1924 RNA, herein designated VGAM RNA, also designated SEQ ID:4635.

Another function of VGAM1924 is therefore inhibition of LOC90333 (Accession XM_030958). Accordingly, utilities of VGAM1924 include diagnosis, prevention and treatment of diseases and clinical conditions associated with LOC90333. LOC91149 (Accession XM_036480) is another VGAM1924 host target gene. LOC91149 BINDING SITE is HOST TARGET binding site found in the 3' untranslated region of mRNA encoded by LOC91149, corresponding to a HOST TARGET binding site such as BINDING SITE I, BINDING SITE II or BINDING SITE III. Table 2 illustrates the complementarity of the nucleotide sequences of LOC91149 BINDING SITE, designated SEQ ID:32458, to the nucleotide sequence of VGAM1924 RNA, herein designated VGAM RNA, also designated SEQ ID:4635.

Another function of VGAM1924 is therefore inhibition of LOC91149 (Accession XM_036480). Accordingly, utilities of VGAM1924 include diagnosis, prevention and treatment of diseases and clinical conditions associated with LOC91149. LOC91286 (Accession XM_037444) is another VGAM1924 host target gene. LOC91286 BINDING SITE is HOST TARGET binding site found in the 3' untranslated region of mRNA encoded by LOC91286, corresponding to a HOST TARGET binding site such as BINDING SITE I, BINDING SITE II or BINDING SITE III. Table 2 illustrates the complementarity of the nucleotide sequences of LOC91286 BINDING SITE, designated SEQ ID:32624, to the nucleotide sequence of VGAM1924 RNA, herein designated VGAM RNA, also designated SEQ ID:4635.

Another function of VGAM1924 is therefore inhibition of LOC91286 (Accession XM_037444). Accordingly, utilities of VGAM1924 include diagnosis, prevention and treatment of diseases and clinical conditions associated with LOC91286. LOC91496 (Accession XM_038788) is another VGAM1924 host target gene. LOC91496 BINDING SITE is HOST TARGET binding site found in the 5' untranslated region of mRNA encoded by LOC91496, corresponding to a HOST TARGET binding site such as BINDING SITE I, BINDING SITE II or BINDING SITE III. Table 2 illustrates the complementarity of the nucleotide sequences of LOC91496 BINDING SITE, designated SEQ ID:32915, to the nucleotide sequence of VGAM1924 RNA, herein designated VGAM RNA, also designated SEQ ID:4635.

Another function of VGAM1924 is therefore inhibition of LOC91496 (Accession XM_038788). Accordingly, utilities of VGAM1924 include diagnosis, prevention and treatment of diseases and clinical conditions associated with LOC91496. LOC91549 (Accession XM_039115) is another VGAM1924 host target gene. LOC91549 BINDING SITE is HOST TARGET binding site found in the 3' untranslated region of mRNA encoded by LOC91549, corresponding to a HOST TARGET binding site such as BINDING SITE I, BINDING SITE II or BINDING SITE III. Table 2 illustrates the complementarity of the nucleotide sequences of LOC91549 BINDING SITE, designated SEQ ID:33012, to the nucleotide sequence of VGAM1924 RNA, herein designated VGAM RNA, also designated SEQ ID:4635.

Another function of VGAM1924 is therefore inhibition of LOC91549 (Accession XM_039115). Accordingly, utilities of VGAM1924 include diagnosis, prevention and treatment of diseases and clinical conditions associated with LOC91549. LOC92231 (Accession XM_043734) is another VGAM1924 host target gene. LOC92231 BINDING SITE is HOST TARGET binding site found in the 3' untranslated region of mRNA encoded by LOC92231, corresponding to a HOST TARGET binding site such as BINDING SITE I, BINDING SITE II or BINDING SITE III. Table 2 illustrates the complementarity of the nucleotide sequences of LOC92231 BINDING SITE, designated SEQ ID:34009, to the nucleotide sequence of VGAM1924 RNA, herein designated VGAM RNA, also designated SEQ ID:4635.

Another function of VGAM1924 is therefore inhibition of LOC92231 (Accession XM_043734). Accordingly, utilities of VGAM1924 include diagnosis, prevention and treatment of diseases and clinical conditions associated with LOC92231. LOC92609 (Accession XM_053074) is another VGAM1924 host target gene. LOC92609 BINDING SITE is HOST TARGET binding site found in the 3' untranslated region of mRNA encoded by LOC92609, corresponding to a HOST TARGET binding site such as BINDING SITE I, BINDING SITE II or BINDING SITE III. Table 2 illustrates the complementarity of the nucleotide sequences of LOC92609 BINDING SITE, designated SEQ ID:36061, to the nucleotide sequence of VGAM1924 RNA, herein designated VGAM RNA, also designated SEQ ID:4635.

Another function of VGAM1924 is therefore inhibition of LOC92609 (Accession XM_053074). Accordingly, utilities of VGAM1924 include diagnosis, prevention and treatment of diseases and clinical conditions associated with LOC92609. LOC92973 (Accession XM_048529) is another VGAM1924 host target gene. LOC92973 BINDING SITE is HOST TARGET binding site found in the 5' untranslated region of mRNA encoded by LOC92973, corresponding to a HOST TARGET binding site such as BINDING SITE I, BINDING SITE II or BINDING SITE III. Table 2 illustrates the complementarity of the nucleotide sequences of LOC92973 BINDING SITE, designated SEQ ID:35189, to the nucleotide sequence of VGAM1924 RNA, herein designated VGAM RNA, also designated SEQ ID:4635.

Another function of VGAM1924 is therefore inhibition of LOC92973 (Accession XM_048529). Accordingly, utilities of VGAM1924 include diagnosis, prevention and treatment of diseases and clinical conditions associated with LOC92973. LOC93356 (Accession XM_050744) is another VGAM1924 host target gene. LOC93356 BINDING SITE is HOST TARGET binding site found in the 5' untranslated region of mRNA encoded by LOC93356, corresponding to a HOST TARGET binding site such as BINDING SITE I, BINDING SITE II or BINDING SITE III. Table 2 illustrates the complementarity of the nucleotide sequences of LOC93356 BINDING SITE, designated SEQ ID:35672, to the nucleotide sequence of VGAM1924 RNA, herein designated VGAM RNA, also designated SEQ ID:4635.

Another function of VGAM1924 is therefore inhibition of LOC93356 (Accession XM_050744). Accordingly, utilities of VGAM1924 include diagnosis, prevention and treatment of diseases and clinical conditions associated with LOC93356. LOC93380 (Accession XM_051020) is another VGAM1924 host target gene. LOC93380 BINDING SITE is HOST TARGET binding site found in the 3' untranslated region of mRNA encoded by LOC93380, corresponding to a HOST TARGET binding site such as BINDING SITE I, BINDING SITE II or BINDING SITE III. Table 2 illustrates the complementarity of the nucleotide sequences of LOC93380 BINDING SITE, designated SEQ ID:35725, to the nucleotide sequence of VGAM1924 RNA, herein designated VGAM RNA, also designated SEQ ID:4635.

Another function of VGAM1924 is therefore inhibition of LOC93380 (Accession XM_051020). Accordingly, utilities of VGAM1924 include diagnosis, prevention and treatment of diseases and clinical conditions associated with LOC93380. FIG. 1 further provides a conceptual description of a novel bioinformatically detected viral gene of the present invention, referred to here as Viral Genomic Address Messenger 1925 (VGAM1925) viral gene, which modulates expression of respective host target genes thereof, the function and utility of which host target genes is known in the art.

VGAM1925 is a novel bioinformatically detected regulatory, non protein coding, viral micro RNA (miRNA) gene. The method by which VGAM1925 was detected is described hereinabove with reference to FIGS. 1-8.

VGAM1925 gene, herein designated VGAM GENE, is a viral gene contained in the genome of Canine Distemper Virus. VGAM1925 host target gene, herein designated VGAM HOST TARGET GENE, is a human gene contained in the human genome.

VGAM1925 gene encodes a VGAM1925 precursor RNA, herein designated VGAM PRECURSOR RNA. Similar to other miRNA genes, and unlike most ordinary genes, VGAM1925 precursor RNA does not encode a protein. A nucleotide sequence identical or highly similar to the nucleotide sequence of VGAM1925 precursor RNA is designated SEQ ID:1911, and is provided hereinbelow with reference to the sequence listing part. Nucleotide sequence SEQ ID:1911 is located at position 5609 relative to the genome of Canine Distemper Virus.

VGAM1925 precursor RNA folds onto itself, forming VGAM1925 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1925 folded precursor RNA into VGAM1925 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1925 RNA is designated SEQ ID:4636, and is provided hereinbelow with reference to the sequence listing part.

VGAM1925 host target gene, herein designated VGAM HOST TARGET GENE, encodes a corresponding messenger RNA, VGAM1925 host target RNA, herein designated VGAM HOST TARGET RNA. VGAM1925 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1925 RNA, herein designated VGAM RNA, binds complementarily to one or more host target binding sites located in untranslated regions of VGAM1925 host target RNA, herein designated VGAM HOST TARGET RNA. This complementary binding is due to the fact that the nucleotide sequence of VGAM1925 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1925 RNA, herein designated VGAM RNA, may have a different number of host target binding sites in untranslated regions of a VGAM1925 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1925 RNA, herein designated VGAM RNA, to host target binding sites on VGAM1925 host target RNA, herein designated VGAM HOST TARGET RNA, such as BINDING SITE I, BINDING SITE II and BINDING SITE III, inhibits translation of VGAM1925 host target RNA into VGAM1925 host target protein, herein designated VGAM HOST TARGET PROTEIN. VGAM host target protein is therefore outlined by a broken line.

It is appreciated that VGAM1925 host target gene, herein designated VGAM HOST TARGET GENE, in fact represents a plurality of VGAM1925 host target genes. The mRNA of each one of this plurality of VGAM1925 host target genes comprises one or more host target binding sites, each having a nucleotide sequence which is at least partly complementary to VGAM1925 RNA, herein designated VGAM RNA, and which when bound by VGAM1925 RNA causes inhibition of translation of respective one or more VGAM1925 host target proteins.

It is further appreciated by one skilled in the art that the mode of translational inhibition illustrated by FIG. 1 with specific reference to translational inhibition exerted by VGAM1925 gene, herein designated VGAM GENE, on one or more VGAM1925 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1925 is inhibition of expression of host target genes, as part of a novel viral mechanism of attacking a host. Accordingly, utilities of VGAM1925 include diagnosis, prevention and treatment of viral infection by Canine Distemper Virus. Specific functions, and accordingly utilities, of VGAM1925 correlate with, and may be deduced from, the identity of the host target genes which VGAM1925 binds and inhibits, and the function of these target genes, as elaborated hereinbelow.

Nucleotide sequences of the VGAM1925 precursor RNA, herein designated VGAM PRECURSOR RNA, and of the 'diced' VGAM1925 RNA, herein designated VGAM RNA, and a schematic representation of the secondary folding of VGAM1925 folded precursor RNA, herein designated VGAM FOLDED PRECURSOR RNA, of VGAM1925 are further described hereinbelow with reference to Table 1.

Nucleotide sequences of host target binding sites, such as BINDING SITE-I, BINDING SITE-II and BINDING SITE-III of FIG. 1, found on VGAM1925 host target RNA, and schematic representation of the complementarity of each of these host target binding sites to VGAM1925 RNA, herein designated VGAM RNA, are described hereinbelow with reference to Table 2.

As mentioned hereinabove with reference to FIG. 1, a function of VGAM1925 gene, herein designated VGAM is inhibition of expression of VGAM1925 target genes. It is appreciated that specific functions, and accordingly utilities, of VGAM1925 correlate with, and may be deduced from, the identity of the target genes which VGAM1925 binds and inhibits, and the function of these target genes, as elaborated hereinbelow.

A Disintegrin and Metalloproteinase Domain 8 (ADAM8, Accession NM_001109) is a VGAM1925 host target gene. ADAM8 BINDING SITE is HOST TARGET binding site found in the 3' untranslated region of mRNA encoded by ADAM8, corresponding to a HOST TARGET binding site such as BINDING SITE I, BINDING SITE II or BINDING SITE III. Table 2 illustrates the complementarity of the nucleotide sequences of ADAM8 BINDING SITE, designated SEQ ID:6765, to the nucleotide sequence of VGAM1925 RNA, herein designated VGAM RNA, also designated SEQ ID:4636.

A function of VGAM1925 is therefore inhibition of A Disintegrin and Metalloproteinase Domain 8 (ADAM8, Accession NM_001109). Accordingly, utilities of VGAM1925 include diagnosis, prevention and treatment of diseases and clinical conditions associated with ADAM8. Adenomatosis Polyposis Coli (APC, Accession NM_000038) is another VGAM1925 host target gene. APC BINDING SITE is HOST TARGET binding site found in the 3" untranslated region of mRNA encoded by APC, corresponding to a HOST TARGET binding site such as BINDING SITE I, BINDING SITE II or BINDING SITE III. Table 2 illustrates the complementarity of the nucleotide sequences of APC BINDING SITE, designated SEQ ID:5483, to the nucleotide sequence of VGAM1925 RNA, herein designated VGAM RNA, also designated SEQ ID:4636.

Another function of VGAM1925 is therefore inhibition of Adenomatosis Polyposis Coli (APC, Accession NM_000038). Accordingly, utilities of VGAM1925 include diagnosis, prevention and treatment of diseases and clinical conditions associated with APC. ADP-ribosylation Factor 3 (ARF3, Accession NM_001659) is another VGAM1925 host target gene. ARF3 BINDING SITE is HOST TARGET binding site found in the 3' untranslated region of mRNA encoded by ARF3, corresponding to a HOST TARGET binding site such as BINDING SITE I, BINDING SITE II or BINDING SITE III. Table 2 illustrates the complementarity of the nucleotide sequences of ARF3 BINDING SITE, designated SEQ ID:7382, to the nucleotide sequence of VGAM1925 RNA, herein designated VGAM RNA, also designated SEQ ID:4636.

Another function of VGAM1925 is therefore inhibition of ADP-ribosylation Factor 3 (ARF3, Accession NM_001659). Accordingly, utilities of VGAM1925 include diagnosis, prevention and treatment of diseases and clinical conditions associated with ARF3. ATPase, Cu++ Transporting, Alpha Polypeptide (Menkes syndrome) (ATP7A, Accession NM_000052) is another VGAM1925 host target gene. ATP7A BINDING SITE is HOST TARGET binding site found in the 3' untranslated region of mRNA encoded by ATP7A, corresponding to a HOST TARGET binding site such as BINDING SITE I, BINDING SITE II or BINDING SITE III. Table 2 illustrates the complementarity of the nucleotide sequences of ATP7A BINDING SITE, designated SEQ ID:5498, to the nucleotide sequence of VGAM1925 RNA, herein designated VGAM RNA, also designated SEQ ID:4636.

Another function of VGAM1925 is therefore inhibition of ATPase, Cu++ Transporting, Alpha Polypeptide (Menkes syndrome) (ATP7A, Accession NM_000052). Accordingly, utilities of VGAM1925 include diagnosis, prevention and treatment of diseases and clinical conditions associated with ATP7A. Cyclin-dependent Kinase (CDC2-like) 10 (CDK10, Accession NM_052988) is another VGAM1925 host target gene. CDK10 BINDING SITE is HOST TARGET binding site found in the 3' untranslated region of mRNA encoded by CDK10, corresponding to a HOST TARGET binding site such as BINDING SITE I, BINDING SITE II or BINDING SITE III. Table 2 illustrates the complementarity of the nucleotide sequences of CDK10 BINDING SITE, designated SEQ ID:27555, to the nucleotide sequence of VGAM1925 RNA, herein designated VGAM RNA, also designated SEQ ID:4636.

Another function of VGAM1925 is therefore inhibition of Cyclin-dependent Kinase (CDC2-like) 10 (CDK10, Accession NM_052988), a gene which plays a pivotal role in the regulation of the eukaryotic cell cycle. Accordingly, utilities of VGAM1925 include diagnosis, prevention and treatment of diseases and clinical conditions associated with CDK10. The function of CDK10 and its association with various diseases and clinical conditions, has been established by previous studies, as described hereinabove with reference to VGAM193. Chromogranin A (parathyroid secretory protein 1) (CHGA, Accession NM_001275) is another VGAM1925 host target gene. CHGA BINDING SITE is HOST TARGET binding site found in the 5' untranslated region of mRNA encoded by CHGA, corresponding to a HOST TARGET binding site such as BINDING SITE I, BINDING SITE II or BINDING SITE III. Table 2 illustrates the complementarity of the nucleotide sequences of CHGA BINDING SITE, designated SEQ ID:6940, to the nucleotide sequence of VGAM1925 RNA, herein designated VGAM RNA, also designated SEQ ID:4636.

Another function of VGAM1925 is therefore inhibition of Chromogranin A (parathyroid secretory protein 1) (CHGA, Accession NM_001275), a gene which regulates dense-core secretory granule biogenesis and hormone sequestration. Accordingly, utilities of VGAM1925 include diagnosis, prevention and treatment of diseases and clinical conditions associated with CHGA. The function of CHGA and its association with various diseases and clinical conditions, has been established by previous studies, as described hereinabove with reference to VGAM440. Cysteine Knot Superfamily 1, BMP Antagonist 1 (CKTSF1B1, Accession NM_013372) is another VGAM1925 host target gene. CKTSF1B1 BINDING SITE is HOST TARGET binding site found in the 3' untranslated region of mRNA encoded by CKTSF1B1, corresponding to a HOST TARGET binding site such as BINDING SITE I, BINDING SITE II or BINDING SITE III. Table 2 illustrates the complementarity of the nucleotide sequences of CKTSF1B1 BINDING SITE, designated SEQ ID:15027, to the nucleotide sequence of VGAM1925 RNA, herein designated VGAM RNA, also designated SEQ ID:4636.

Another function of VGAM1925 is therefore inhibition of Cysteine Knot Superfamily 1, BMP Antagonist 1 (CKTSF1B1, Accession NM_013372), a gene which blocks signaling of bone morphogenetic protein (BMP). Accordingly, utilities of VGAM1925 include diagnosis, prevention and treatment of diseases and clinical conditions associated with CKTSF1B1. The function of CKTSF1B1 and its association with various diseases and clinical conditions, has been established by previous studies, as described hereinabove with reference to VGAM28. DNA (cytosine-5-)-methyltransferase 3 Beta (DNMT3B, Accession NM_006892) is another VGAM1925 host target gene. DNMT3B BINDING SITE is HOST TARGET binding site found in the 3" untranslated region of mRNA encoded by DNMT3B, corresponding to a HOST TARGET binding site such as BINDING SITE I, BINDING SITE II or BINDING SITE III. Table 2 illustrates the complementarity of the nucleotide sequences of DNMT3B BINDING SITE, designated SEQ ID:13765, to the nucleotide sequence of VGAM1925 RNA, herein designated VGAM RNA, also designated SEQ ID:4636.

Another function of VGAM1925 is therefore inhibition of DNA (cytosine-5-)-methyltransferase 3 Beta (DNMT3B, Accession NM_006892), a gene which is required for genome wide de novo methylation. Accordingly, utilities of VGAM1925 include diagnosis, prevention and treatment of diseases and clinical conditions associated with DNMT3B. The function of DNMT3B and its association with various diseases and clinical conditions, has been established by previous studies, as described hereinabove with reference to VGAM280. EGF-like-domain, Multiple 4 (EGFL4, Accession XM_029883) is another VGAM1925 host target gene. EGFL4 BINDING SITE is HOST TARGET binding site found in the 3' untranslated region of mRNA encoded by EGFL4, corresponding to a HOST TARGET binding site such as BINDING SITE I, BINDING SITE II or BINDING SITE III. Table 2 illustrates the complementarity of the nucleotide sequences of EGFL4 BINDING SITE, designated SEQ ID:30969, to the nucleotide sequence of VGAM1925 RNA, herein designated VGAM RNA, also designated SEQ ID:4636.

Another function of VGAM1925 is therefore inhibition of EGF-like-domain, Multiple 4 (EGFL4, Accession XM_029883). Accordingly, utilities of VGAM1925 include diagnosis, prevention and treatment of diseases and clinical conditions associated with EGFL4. Eukaryotic Translation Initiation Factor 4 Gamma, 2 (EIF4G2, Accession NM_001418) is another VGAM1925 host target gene. EIF4G2 BINDING SITE is HOST TARGET binding site found in the 3' untranslated region of mRNA encoded by EIF4G2, corresponding to a HOST TARGET binding site such as BINDING SITE I, BINDING SITE II or BINDING SITE III. Table 2 illustrates the complementarity of the nucleotide sequences of EIF4G2 BINDING SITE, designated SEQ ID:7117, to the nucleotide sequence of VGAM1925 RNA, herein designated VGAM RNA, also designated SEQ ID:4636.

Another function of VGAM1925 is therefore inhibition of Eukaryotic Translation Initiation Factor 4 Gamma, 2 (EIF4G2, Accession NM_001418), a gene which is a repressor of translation. Accordingly, utilities of VGAM1925 include diagnosis, prevention and treatment of diseases and clinical conditions associated with EIF4G2. The function of EIF4G2 and its association with various diseases and clinical conditions, has been established by previous studies, as described hereinabove with reference to VGAM1065. Homeo Box D3 (HOXD3, Accession NM_006898) is another VGAM1925 host target gene. HOXD3 BINDING SITE is HOST TARGET binding site found in the 3' untranslated region of mRNA encoded by HOXD3, corresponding to a HOST TARGET binding site such as BINDING SITE I, BINDING SITE II or BINDING SITE III. Table 2 illustrates the complementarity of the nucleotide sequences of HOXD3 BINDING SITE, designated SEQ ID:13774, to the nucleotide sequence of VGAM1925 RNA, herein designated VGAM RNA, also designated SEQ ID:4636.

Another function of VGAM1925 is therefore inhibition of Homeo Box D3 (HOXD3, Accession NM_006898), a gene which plays a role in the differentiation process of hematopoietic cells. Accordingly, utilities of VGAM1925 include diagnosis, prevention and treatment of diseases and clinical conditions associated with HOXD3. The function of HOXD3 and its association with various diseases and clinical conditions, has been established by previous studies, as described hereinabove with reference to VGAM1384. Hippocalcin (HPCA, Accession NM_002143) is another VGAM1925 host target gene. HPCA BINDING SITE is HOST TARGET binding site found in the 3' untranslated region of mRNA encoded by HPCA, corresponding to a HOST TARGET binding site such as BINDING SITE I, BINDING SITE II or BINDING SITE III. Table 2 illustrates the complementarity of the nucleotide sequences of HPCA BINDING SITE, designated SEQ ID:7920, to the nucleotide sequence of VGAM1925 RNA, herein designated VGAM RNA, also designated SEQ ID:4636.

Another function of VGAM1925 is therefore inhibition of Hippocalcin (HPCA, Accession NM_002143), a gene which may be an hippocampal calcium-binding protein. Accordingly, utilities of VGAM1925 include diagnosis, prevention and treatment of diseases and clinical conditions associated with HPCA. The function of HPCA and its association with various diseases and clinical conditions, has been established by previous studies, as described hereinabove with reference to VGAM114. Interleukin 13 Receptor, Alpha 1 (IL13RA1, Accession NM_001560) is another VGAM1925 host target gene. IL13RA1 BINDING SITE is HOST TARGET binding site found in the 3' untranslated region of mRNA encoded by IL13RA1, corresponding to a HOST TARGET binding site such as BINDING SITE I, BINDING SITE II or BINDING SITE III. Table 2 illustrates the complementarity of the nucleotide sequences of IL13RA1 BINDING SITE, designated SEQ ID:7286, to the nucleotide sequence of VGAM1925 RNA, herein designated VGAM RNA, also designated SEQ ID:4636.

Another function of VGAM1925 is therefore inhibition of Interleukin 13 Receptor, Alpha 1 (IL13RA1, Accession NM_001560), a gene which binds il-13 with a low affinity. together with il-4r- alpha can form a functional receptor for il-13. Accordingly, utilities of VGAM1925 include diagnosis, prevention and treatment of diseases and clinical conditions associated with IL13RA1. The function of IL13RA1 and its association with various diseases and clinical conditions, has been established by previous studies, as described hereinabove with reference to VGAM144. Interleukin-1 Receptor-associated Kinase 1 (IRAK1, Accession NM_001569) is another VGAM1925 host target gene. IRAK1 BINDING SITE is HOST TARGET binding site found in the 3' untranslated region of mRNA encoded by IRAK1, corresponding to a HOST TARGET binding site such as BINDING SITE I, BINDING SITE II or BINDING SITE III. Table 2 illustrates the complementarity of the nucleotide sequences of IRAK1 BINDING SITE, designated SEQ ID:7301, to the nucleotide sequence of VGAM1925 RNA, herein designated VGAM RNA, also designated SEQ ID:4636.

Another function of VGAM1925 is therefore inhibition of Interleukin-1 Receptor-associated Kinase 1 (IRAK1, Accession NM_001569). Accordingly, utilities of VGAM1925 include diagnosis, prevention and treatment of diseases and clinical conditions associated with IRAK1. Pyrroline-5-carboxylate Reductase 1 (PYCR1, Accession XM_046472) is another VGAM1925 host target gene. PYCR1 BINDING SITE is HOST TARGET binding site found in the 3' untranslated region of mRNA encoded by PYCR1, corresponding to a HOST TARGET binding site such as BINDING SITE I, BINDING SITE II or BINDING SITE III. Table 2 illustrates the complementarity of the nucleotide sequences of PYCR1 BINDING SITE, designated SEQ ID:34732, to the nucleotide sequence of VGAM1925 RNA, herein designated VGAM RNA, also designated SEQ ID:4636.

Another function of VGAM1925 is therefore inhibition of Pyrroline-5-carboxylate Reductase 1 (PYCR1, Accession XM_046472), a gene which catalyzes the NAD(P)H-dependent conversion of pyrroline-5-carboxylate to proline. Accordingly, utilities of VGAM1925 include diagnosis, prevention and treatment of diseases and clinical conditions associated with PYCR1. The function of PYCR1 and its association with various diseases and clinical conditions, has been established by previous studies, as described hereinabove with reference to VGAM178. RAB36, Member RAS Oncogene Family (RAB36, Accession NM_004914) is another VGAM1925 host target gene. RAB36 BINDING SITE is HOST TARGET binding site found in the 3' untranslated region of mRNA encoded by RAB36, corresponding to a HOST TARGET binding site such as BINDING SITE I, BINDING SITE II or BINDING SITE III. Table 2 illustrates the complementarity of the nucleotide sequences of RAB36 BINDING SITE, designated SEQ ID:11350, to the nucleotide sequence of VGAM1925 RNA, herein designated VGAM RNA, also designated SEQ ID:4636.

Another function of VGAM1925 is therefore inhibition of RAB36, Member RAS Oncogene Family (RAB36, Accession NM_004914), a gene which is involved in protein transport. Accordingly, utilities of VGAM1925 include diagnosis, prevention and treatment of diseases and clinical conditions associated with RAB36. The function of RAB36 and its association with various diseases and clinical conditions, has been established by previous studies, as described hereinabove with reference to VGAM129. Transcription Factor AP-2 Gamma (activating enhancer binding protein 2 gamma) (TFAP2C, Accession NM_003222) is another VGAM1925 host target gene. TFAP2C BINDING SITE is HOST TARGET binding site found in the 3' untranslated region of mRNA encoded by TFAP2C, corresponding to a HOST TARGET binding site such as BINDING SITE I, BINDING SITE II or BINDING SITE III. Table 2 illustrates the complementarity of the nucleotide sequences of TFAP2C BINDING SITE, designated SEQ ID:9223, to the nucleotide sequence of VGAM1925 RNA, herein designated VGAM RNA, also designated SEQ ID:4636.

Another function of VGAM1925 is therefore inhibition of Transcription Factor AP-2 Gamma (activating enhancer binding protein 2 gamma) (TFAP2C, Accession NM_003222), a gene which is a sequence-specific dna-binding protein that interacts with inducible viral and cellular enhancer elements to regulate transcription of selected genes. Accordingly, utilities of VGAM1925 include diagnosis, prevention and treatment of diseases and clinical conditions associated with TFAP2C. The function of TFAP2C and its association with various diseases and clinical conditions, has been established by previous studies, as described hereinabove with reference to VGAM379. Tumor Necrosis Factor (ligand) Superfamily, Member 6 (TNFSF6, Accession NM_000639) is another VGAM1925 host target gene. TNFSF6 BINDING SITE is HOST TARGET binding site found in the 3' untranslated region of mRNA encoded by TNFSF6, corresponding to a HOST TARGET binding site such as BINDING SITE I, BINDING SITE II or BINDING SITE III. Table 2 illustrates the complementarity of the nucleotide sequences of TNFSF6 BINDING SITE, designated SEQ ID:6276, to the nucleotide sequence of VGAM1925 RNA, herein designated VGAM RNA, also designated SEQ ID:4636.

Another function of VGAM1925 is therefore inhibition of Tumor Necrosis Factor (ligand) Superfamily, Member 6 (TNFSF6, Accession NM_000639). Accordingly, utilities of VGAM1925 include diagnosis, prevention and treatment of diseases and clinical conditions associated with TNFSF6. Werner Syndrome (WRN, Accession NM_000553) is another VGAM1925 host target gene. WRN BINDING SITE is HOST TARGET binding site found in the 5' untranslated region of mRNA encoded by WRN, corresponding to a HOST TARGET binding site such as BINDING SITE I, BINDING SITE II or BINDING SITE III. Table 2 illustrates the complementarity of the nucleotide sequences of WRN BINDING SITE, designated SEQ ID:6168, to the nucleotide sequence of VGAM1925 RNA, herein designated VGAM RNA, also designated SEQ ID:4636.

Another function of VGAM1925 is therefore inhibition of Werner Syndrome (WRN, Accession NM_000553). Accordingly, utilities of VGAM1925 include diagnosis, prevention and treatment of diseases and clinical conditions associated with WRN. Zic Family Member 3 Heterotaxy 1 (odd-paired homolog, Drosophila) (ZIC3, Accession NM_003413) is another VGAM1925 host target gene. ZIC3 BINDING SITE is HOST TARGET binding site found in the 5' untranslated region of mRNA encoded by ZIC3, corresponding to a HOST TARGET binding site such as BINDING SITE I, BINDING SITE II or BINDING SITE III. Table 2 illustrates the complementarity of the nucleotide sequences of ZIC3 BINDING SITE, designated SEQ ID:9452, to the nucleotide sequence of VGAM1925 RNA, herein designated VGAM RNA, also designated SEQ ID:4636.

Another function of VGAM1925 is therefore inhibition of Zic Family Member 3 Heterotaxy 1 (odd-paired homolog, Drosophila) (ZIC3, Accession NM_003413). Accordingly, utilities of VGAM1925 include diagnosis, prevention and treatment of diseases and clinical conditions associated with ZIC3. APCL (Accession NM_005883) is another VGAM1925 host target gene. APCL BINDING SITE is HOST TARGET binding site found in the 3' untranslated region of mRNA encoded by APCL, corresponding to a HOST TARGET binding site such as BINDING SITE I, BINDING SITE II or BINDING SITE III. Table 2 illustrates the complementarity of the nucleotide sequences of APCL BINDING SITE, designated SEQ ID:12504, to the nucleotide sequence of VGAM1925 RNA, herein designated VGAM RNA, also designated SEQ ID:4636.

Another function of VGAM1925 is therefore inhibition of APCL (Accession NM_005883). Accordingly, utilities of VGAM1925 include diagnosis, prevention and treatment of diseases and clinical conditions associated with APCL. Ras Homolog Gene Family, Member U (ARHU, Accession NM_021205) is another VGAM1925 host target gene. ARHU BINDING SITE is HOST TARGET binding site found in the 3' untranslated region of mRNA encoded by ARHU, corresponding to a HOST TARGET binding site such as BINDING SITE I, BINDING SITE II or BINDING SITE III. Table 2 illustrates the complementarity of the nucleotide sequences of ARHU BINDING SITE, designated SEQ ID:22185, to the nucleotide sequence of VGAM1925 RNA, herein designated VGAM RNA, also designated SEQ ID:4636.

Another function of VGAM1925 is therefore inhibition of Ras Homolog Gene Family, Member U (ARHU, Accession NM_021205). Accordingly, utilities of VGAM1925 include diagnosis, prevention and treatment of diseases and clinical conditions associated with ARHU. Chromosome 1 Open Reading Frame 34 (C1orf34, Accession XM_027172) is another VGAM1925 host target gene. C1orf34 BINDING SITE is HOST TARGET binding site found in the 3' untranslated region of mRNA encoded by C1orf34, corresponding to a HOST TARGET binding site such as BINDING SITE I, BINDING SITE II or BINDING SITE III. Table 2 illustrates the complementarity of the nucleotide sequences of C1orf34 BINDING SITE, designated SEQ ID:30437, to the nucleotide sequence of VGAM1925 RNA, herein designated VGAM RNA, also designated SEQ ID:4636.

Another function of VGAM1925 is therefore inhibition of Chromosome 1 Open Reading Frame 34 (C1orf34, Accession XM_027172). Accordingly, utilities of VGAM1925 include diagnosis, prevention and treatment of diseases and clinical conditions associated with C1orf34. Chromosome 20 Open Reading Frame 55 (C20orf55, Accession NM_031424) is another VGAM1925 host target gene. C20orf55 BINDING SITE is HOST TARGET binding site found in the 3' untranslated region of mRNA encoded by C20orf55, corresponding to a HOST TARGET binding site such as BINDING SITE I, BINDING SITE II or BINDING SITE III. Table 2 illustrates the complementarity of the nucleotide sequences of C20orf55 BINDING SITE, designated SEQ ID:25408, to the nucleotide sequence of VGAM1925 RNA, herein designated VGAM RNA, also designated SEQ ID:4636.

Another function of VGAM1925 is therefore inhibition of Chromosome 20 Open Reading Frame 55 (C20orf55, Accession NM_031424). Accordingly, utilities of VGAM1925 include diagnosis, prevention and treatment of diseases and clinical conditions associated with C20orf55. DKFZP434L1435 (Accession XM_166401) is another VGAM1925 host target gene. DKFZP434L1435 BINDING SITE1 through DKFZP434L1435 BINDING SITE3 are HOST TARGET binding sites found in untranslated regions of mRNA encoded by DKFZP434L1435, corresponding to HOST TARGET binding sites such as BINDING SITE I, BINDING SITE II or BINDING SITE III. Table 2 illustrates the complementarity of the nucleotide sequences of DKFZP434L1435 BINDING SITE1 through DKFZP434L1435 BINDING SITE3, designated SEQ ID:44270, SEQ ID:46666 and SEQ ID:46704 respectively, to the nucleotide sequence of VGAM1925 RNA, herein designated VGAM RNA, also designated SEQ ID:4636.

Another function of VGAM1925 is therefore inhibition of DKFZP434L1435 (Accession XM_166401). Accordingly, utilities of VGAM1925 include diagnosis, prevention and treatment of diseases and clinical conditions associated with DKFZP434L1435. ETAA16 (Accession NM_019002) is another VGAM1925 host target gene. ETAA16 BINDING SITE is HOST TARGET binding site found in the 5' untranslated region of mRNA encoded by ETAA16, corresponding to a HOST TARGET binding site such as BINDING SITE I, BINDING SITE II or BINDING SITE III. Table 2 illustrates the complementarity of the nucleotide sequences of ETAA16 BINDING SITE, designated SEQ ID:21074, to the nucleotide sequence of VGAM1925 RNA, herein designated VGAM RNA, also designated SEQ ID:4636.

Another function of VGAM1925 is therefore inhibition of ETAA16 (Accession NM_019002). Accordingly, utilities of VGAM1925 include diagnosis, prevention and treatment of diseases and clinical conditions associated with ETAA16. FASTK (Accession NM_025096) is another VGAM1925 host target gene. FASTK BINDING SITE is HOST TARGET binding site found in the 5' untranslated region of mRNA encoded by FASTK, corresponding to a HOST TARGET binding site such as BINDING SITE I, BINDING SITE II or BINDING SITE III. Table 2 illustrates the complementarity of the nucleotide sequences of FASTK BINDING SITE, designated SEQ ID:24731, to the nucleotide sequence of VGAM1925 RNA, herein designated VGAM RNA, also designated SEQ ID:4636.

Another function of VGAM1925 is therefore inhibition of FASTK (Accession NM_025096). Accordingly, utilities of VGAM1925 include diagnosis, prevention and treatment of diseases and clinical conditions associated with FASTK. FLJ13491 (Accession NM_024623) is another VGAM1925 host target gene. FLJ13491 BINDING SITE is HOST TAR- GET binding site found in the 3' untranslated region of mRNA encoded by FLJ13491, corresponding to a HOST TARGET binding site such as BINDING SITE I, BINDING SITE II or BINDING SITE III. Table 2 illustrates the complementarity of the nucleotide sequences of FLJ13491 BINDING SITE, designated SEQ ID:23890, to the nucleotide sequence of VGAM1925 RNA, herein designated VGAM RNA, also designated SEQ ID:4636.

Another function of VGAM1925 is therefore inhibition of FLJ13491 (Accession NM_024623). Accordingly, utilities of VGAM1925 include diagnosis, prevention and treatment of diseases and clinical conditions associated with FLJ13491. FLJ14154 (Accession NM_024845) is another VGAM1925 host target gene. FLJ14154 BINDING SITE is HOST TARGET binding site found in the 3' untranslated region of mRNA encoded by FLJ14154, corresponding to a HOST TARGET binding site such as BINDING SITE I, BINDING SITE II or BINDING SITE III. Table 2 illustrates the complementarity of the nucleotide sequences of FLJ14154 BINDING SITE, designated SEQ ID:24273, to the nucleotide sequence of VGAM1925 RNA, herein designated VGAM RNA, also designated SEQ ID:4636.

Another function of VGAM1925 is therefore inhibition of FLJ14154 (Accession NM_024845). Accordingly, utilities of VGAM1925 include diagnosis, prevention and treatment of diseases and clinical conditions associated with FLJ14154. FLJ20343 (Accession NM_017775) is another VGAM1925 host target gene. FLJ20343 BINDING SITE is HOST TARGET binding site found in the 3' untranslated region of mRNA encoded by FLJ20343, corresponding to a HOST TARGET binding site such as BINDING SITE I, BINDING SITE II or BINDING SITE III. Table 2 illustrates the complementarity of the nucleotide sequences of FLJ20343 BINDING SITE, designated SEQ ID:19401, to the nucleotide sequence of VGAM1925 RNA, herein designated VGAM RNA, also designated SEQ ID:4636.

Another function of VGAM1925 is therefore inhibition of FLJ20343 (Accession NM_017775). Accordingly, utilities of VGAM1925 include diagnosis, prevention and treatment of diseases and clinical conditions associated with FLJ20343. FLJ22479 (Accession NM_024900) is another VGAM1925 host target gene. FLJ22479 BINDING SITE is HOST TARGET binding site found in the 3' untranslated region of mRNA encoded by FLJ22479, corresponding to a HOST TARGET binding site such as BINDING SITE I, BINDING SITE II or BINDING SITE III. Table 2 illustrates the complementarity of the nucleotide sequences of FLJ22479 BINDING SITE, designated SEQ ID:24388, to the nucleotide sequence of VGAM1925 RNA, herein designated VGAM RNA, also designated SEQ ID:4636.

Another function of VGAM1925 is therefore inhibition of FLJ22479 (Accession NM_024900). Accordingly, utilities of VGAM1925 include diagnosis, prevention and treatment of diseases and clinical conditions associated with FLJ22479. FLJ23091 (Accession NM_024911) is another VGAM1925 host target gene. FLJ23091 BINDING SITE is HOST TARGET binding site found in the 3' untranslated region of mRNA encoded by FLJ23091, corresponding to a HOST TARGET binding site such as BINDING SITE I, BINDING SITE II or BINDING SITE III. Table 2 illustrates the complementarity of the nucleotide sequences of FLJ23091 BINDING SITE, designated SEQ ID:24419, to the nucleotide sequence of VGAM1925 RNA, herein designated VGAM RNA, also designated SEQ ID:4636.

Another function of VGAM1925 is therefore inhibition of FLJ23091 (Accession NM_024911). Accordingly, utilities of VGAM1925 include diagnosis, prevention and treatment of diseases and clinical conditions associated with FLJ23091. Guanine Nucleotide Binding Protein (G protein), Gamma 4 (GNG4, Accession NM_004485) is another VGAM1925 host target gene. GNG4 BINDING SITE is HOST TARGET binding site found in the 3' untranslated region of mRNA encoded by GNG4, corresponding to a HOST TARGET binding site such as BINDING SITE I, BINDING SITE II or BINDING SITE III. Table 2 illustrates the complementarity of the nucleotide sequences of GNG4 BINDING SITE, designated SEQ ID:10814, to the nucleotide sequence of VGAM1925 RNA, herein designated VGAM RNA, also designated SEQ ID:4636.

Another function of VGAM1925 is therefore inhibition of Guanine Nucleotide Binding Protein (G protein), Gamma 4 (GNG4, Accession NM_004485). Accordingly, utilities of VGAM1925 include diagnosis, prevention and treatment of diseases and clinical conditions associated with GNG4. HSPF2 (Accession NM_005528) is another VGAM1925 host target gene. HSPF2 BINDING SITE is HOST TARGET binding site found in the 5' untranslated region of mRNA encoded by HSPF2, corresponding to a HOST TARGET binding site such as BINDING SITE I, BINDING SITE II or BINDING SITE III. Table 2 illustrates the complementarity of the nucleotide sequences of HSPF2 BINDING SITE, designated SEQ ID:12049, to the nucleotide sequence of VGAM1925 RNA, herein designated VGAM RNA, also designated SEQ ID:4636.

Another function of VGAM1925 is therefore inhibition of HSPF2 (Accession NM_005528). Accordingly, utilities of VGAM1925 include diagnosis, prevention and treatment of diseases and clinical conditions associated with HSPF2. Interleukin 1 Receptor Accessory Protein-like 1 (IL1RAPL1, Accession NM_014271) is another VGAM1925 host target gene. IL1RAPL1 BINDING SITE is HOST TARGET binding site found in the 3' untranslated region of mRNA encoded by IL1RAPL1, corresponding to a HOST TARGET binding site such as BINDING SITE I, BINDING SITE II or BINDING SITE III. Table 2 illustrates the complementarity of the nucleotide sequences of IL1RAPL1 BINDING SITE, designated SEQ ID:15556, to the nucleotide sequence of VGAM1925 RNA, herein designated VGAM RNA, also designated SEQ ID:4636.

Another function of VGAM1925 is therefore inhibition of Interleukin 1 Receptor Accessory Protein-like 1 (IL1RAPL1, Accession NM_014271). Accordingly, utilities of VGAM1925 include diagnosis, prevention and treatment of diseases and clinical conditions associated with IL1RAPL1. KIAA0408 (Accession NM_014702) is another VGAM1925 host target gene. KIAA0408 BINDING SITE is HOST TARGET binding site found in the 3' untranslated region of mRNA encoded by KIAA0408, corresponding to a HOST TARGET binding site such as BINDING SITE I, BINDING SITE II or BINDING SITE III. Table 2 illustrates the complementarity of the nucleotide sequences of KIAA0408 BINDING SITE, designated SEQ ID:16236, to the nucleotide sequence of VGAM1925 RNA, herein designated VGAM RNA, also designated SEQ ID:4636.

Another function of VGAM1925 is therefore inhibition of KIAA0408 (Accession NM_014702). Accordingly, utilities of VGAM1925 include diagnosis, prevention and treatment of diseases and clinical conditions associated with KIAA0408. KIAA0855 (Accession NM_015003) is another VGAM1925 host target gene. KIAA0855 BINDING SITE is HOST TARGET binding site found in the 3' untranslated region of mRNA encoded by KIAA0855, corresponding to a HOST TARGET binding site such as BINDING SITE I, BINDING SITE II or BINDING SITE III. Table 2 illustrates the complementarity of the nucleotide sequences of KIAA0855 BINDING SITE, designated SEQ ID:17378, to the nucleotide sequence of VGAM1925 RNA, herein designated VGAM RNA, also designated SEQ ID:4636.

Another function of VGAM1925 is therefore inhibition of KIAA0855 (Accession NM_015003). Accordingly, utilities of VGAM1925 include diagnosis, prevention and treatment of diseases and clinical conditions associated with KIAA0855. KIAA1026 (Accession XM_048825) is another VGAM1925 host target gene. KIAA1026 BINDING SITE is HOST TARGET binding site found in the 3' untranslated region of mRNA encoded by KIAA1026, corresponding to a HOST TARGET binding site such as BINDING SITE I, BINDING SITE II or BINDING SITE III. Table 2 illustrates the complementarity of the nucleotide sequences of KIAA1026 BINDING SITE, designated SEQ ID:35278, to the nucleotide sequence of VGAM1925 RNA, herein designated VGAM RNA, also designated SEQ ID:4636.

Another function of VGAM1925 is therefore inhibition of KIAA1026 (Accession XM_048825). Accordingly, utilities of VGAM1925 include diagnosis, prevention and treatment of diseases and clinical conditions associated with KIAA1026. KIAA1203 (Accession XM_049683) is another VGAM1925 host target gene. KIAA1203 BINDING SITE is HOST TARGET binding site found in the 3' untranslated region of mRNA encoded by KIAA1203, corresponding to a HOST TARGET binding site such as BINDING SITE I, BINDING SITE II or BINDING SITE III. Table 2 illustrates the complementarity of the nucleotide sequences of KIAA1203 BINDING SITE, designated SEQ ID:35474, to the nucleotide sequence of VGAM1925 RNA, herein designated VGAM RNA, also designated SEQ ID:4636.

Another function of VGAM1925 is therefore inhibition of KIAA1203 (Accession XM_049683). Accordingly, utilities of VGAM1925 include diagnosis, prevention and treatment of diseases and clinical conditions associated with KIAA1203. KIAA1340 (Accession XM_044836) is another VGAM1925 host target gene. KIAA1340 BINDING SITE is HOST TARGET binding site found in the 3' untranslated region of mRNA encoded by KIAA1340, corresponding to a HOST TARGET binding site such as BINDING SITE I, BINDING SITE II or BINDING SITE III. Table 2 illustrates the complementarity of the nucleotide sequences of KIAA1340 BINDING SITE, designated SEQ ID:34301, to the nucleotide sequence of VGAM1925 RNA, herein designated VGAM RNA, also designated SEQ ID:4636.

Another function of VGAM1925 is therefore inhibition of KIAA1340 (Accession XM_044836). Accordingly, utilities of VGAM1925 include diagnosis, prevention and treatment of diseases and clinical conditions associated with KIAA1340. MGC10715 (Accession NM_024325) is another VGAM1925 host target gene. MGC10715 BINDING SITE is HOST TARGET binding site found in the 3' untranslated region of mRNA encoded by MGC10715, corresponding to a HOST TARGET binding site such as BINDING SITE I, BINDING SITE II or BINDING SITE III. Table 2 illustrates the complementarity of the nucleotide sequences of MGC10715 BINDING SITE, designated SEQ ID:23617, to the nucleotide sequence of VGAM1925 RNA, herein designated VGAM RNA, also designated SEQ ID:4636.

Another function of VGAM1925 is therefore inhibition of MGC10715 (Accession NM_024325). Accordingly, utilities of VGAM1925 include diagnosis, prevention and treatment of diseases and clinical conditions associated with MGC10715. MGC2603 (Accession NM_024037) is another VGAM1925 host target gene. MGC2603 BINDING SITE is HOST TARGET binding site found in the 3' untranslated region of mRNA encoded by MGC2603, corresponding to a HOST TARGET binding site such as BINDING SITE I, BINDING SITE II or BINDING SITE III. Table 2 illustrates the complementarity of the nucleotide sequences of MGC2603 BINDING SITE, designated SEQ ID:23472, to the nucleotide sequence of VGAM1925 RNA, herein designated VGAM RNA, also designated SEQ ID:4636.

Another function of VGAM1925 is therefore inhibition of MGC2603 (Accession NM_024037). Accordingly, utilities of VGAM1925 include diagnosis, prevention and treatment of diseases and clinical conditions associated with MGC2603. N4BP3 (Accession XM_038920) is another VGAM1925 host target gene. N4BP3 BINDING SITE is HOST TARGET binding site found in the 3' untranslated region of mRNA encoded by N4BP3, corresponding to a HOST TARGET binding site such as BINDING SITE I, BINDING SITE II or BINDING SITE III. Table 2 illustrates the complementarity of the nucleotide sequences of N4BP3 BINDING SITE, designated SEQ ID:32941, to the nucleotide sequence of VGAM1925 RNA, herein designated VGAM RNA, also designated SEQ ID:4636.

Another function of VGAM1925 is therefore inhibition of N4BP3 (Accession XM_038920). Accordingly, utilities of VGAM1925 include diagnosis, prevention and treatment of diseases and clinical conditions associated with N4BP3. PANK (Accession NM_138316) is another VGAM1925 host target gene. PANK BINDING SITE is HOST TARGET binding site found in the 5' untranslated region of mRNA encoded by PANK, corresponding to a HOST TARGET binding site such as BINDING SITE I, BINDING SITE II or BINDING SITE III. Table 2 illustrates the complementarity of the nucleotide sequences of PANK BINDING SITE, designated SEQ ID:28716, to the nucleotide sequence of VGAM1925 RNA, herein designated VGAM RNA, also designated SEQ ID:4636.

Another function of VGAM1925 is therefore inhibition of PANK (Accession NM_138316). Accordingly, utilities of VGAM1925 include diagnosis, prevention and treatment of diseases and clinical conditions associated with PANK. Protein Tyrosine Phosphatase, Receptor Type, F Polypeptide (PTPRF), Interacting Protein (liprin), Alpha 4 (PPFIA4, Accession XM_046751) is another VGAM1925 host target gene. PPFIA4 BINDING SITE is HOST TARGET binding site found in the 3' untranslated region of mRNA encoded by PPFIA4, corresponding to a HOST TARGET binding site such as BINDING SITE I, BINDING SITE II or BINDING SITE III. Table 2 illustrates the complementarity of the nucleotide sequences of PPFIA4 BINDING SITE, designated SEQ ID:34824, to the nucleotide sequence of VGAM1925 RNA, herein designated VGAM RNA, also designated SEQ ID:4636.

Another function of VGAM1925 is therefore inhibition of Protein Tyrosine Phosphatase, Receptor Type, F Polypeptide (PTPRF), Interacting Protein (liprin), Alpha 4 (PPFIA4, Accession XM_046751). Accordingly, utilities of VGAM1925 include diagnosis, prevention and treatment of diseases and clinical conditions associated with PPFIA4. RHO6 (Accession NM_014470) is another VGAM1925 host target gene. RHO6 BINDING SITE is HOST TARGET binding site found in the 3' untranslated region of mRNA encoded by RHO6, corresponding to a HOST TARGET binding site such as BINDING SITE I, BINDING SITE II or BINDING SITE III. Table 2 illustrates the complementarity of the nucleotide sequences of RHO6 BINDING SITE, designated SEQ ID:15821, to the nucleotide sequence of VGAM1925 RNA, herein designated VGAM RNA, also designated SEQ ID:4636.

Another function of VGAM1925 is therefore inhibition of RHO6 (Accession NM_014470). Accordingly, utilities of VGAM1925 include diagnosis, prevention and treatment of diseases and clinical conditions associated with RHO6. Ring Finger Protein 24 (RNF24, Accession NM_007219) is another VGAM1925 host target gene. RNF24 BINDING SITE is HOST TARGET binding site found in the 5' untranslated region of mRNA encoded by RNF24, corresponding to a HOST TARGET binding site such as BINDING SITE I, BINDING SITE II or BINDING SITE III. Table 2 illustrates the complementarity of the nucleotide sequences of RNF24 BINDING SITE, designated SEQ ID:14087, to the nucleotide sequence of VGAM1925 RNA, herein designated VGAM RNA, also designated SEQ ID:4636.

Another function of VGAM1925 is therefore inhibition of Ring Finger Protein 24 (RNF24, Accession NM_007219). Accordingly, utilities of VGAM1925 include diagnosis, prevention and treatment of diseases and clinical conditions associated with RNF24. RoXaN (Accession NM_025013) is another VGAM1925 host target gene. RoXaN BINDING SITE is HOST TARGET binding site found in the 3' untranslated region of mRNA encoded by RoXaN, corresponding to a HOST TARGET binding site such as BINDING SITE I, BINDING SITE II or BINDING SITE III. Table 2 illustrates the complementarity of the nucleotide sequences of RoXaN BINDING SITE, designated SEQ ID:24605, to the nucleotide sequence of VGAM1925 RNA, herein designated VGAM RNA, also designated SEQ ID:4636.

Another function of VGAM1925 is therefore inhibition of RoXaN (Accession NM_025013). Accordingly, utilities of VGAM1925 include diagnosis, prevention and treatment of diseases and clinical conditions associated with RoXaN. Signal Transducer and Activator of Transcription 5A (STAT5A, Accession NM_003152) is another VGAM1925 host target gene. STAT5A BINDING SITE is HOST TARGET binding site found in the 3' untranslated region of mRNA encoded by STAT5A, corresponding to a HOST TARGET binding site such as BINDING SITE I, BINDING SITE II or BINDING SITE III. Table 2 illustrates the complementarity of the nucleotide sequences of STAT5A BINDING SITE, designated SEQ ID:9129, to the nucleotide sequence of VGAM1925 RNA, herein designated VGAM RNA, also designated SEQ ID:4636.

Another function of VGAM1925 is therefore inhibition of Signal Transducer and Activator of Transcription 5A (STAT5A, Accession NM_003152). Accordingly, utilities of VGAM1925 include diagnosis, prevention and treatment of diseases and clinical conditions associated with STAT5A. Synaptotagmin-like 2 (SYTL2, Accession NM_032379) is another VGAM1925 host target gene. SYTL2 BINDING SITE1 and SYTL2 BINDING SITE2 are HOST TARGET binding sites found in untranslated regions of mRNA encoded by SYTL2, corresponding to HOST TARGET binding sites such as BINDING SITE I, BINDING SITE II or BINDING SITE III. Table 2 illustrates the complementarity of the nucleotide sequences of SYTL2 BINDING SITE1 and SYTL2 BINDING SITE2, designated SEQ ID:26175 and SEQ ID:26759 respectively, to the nucleotide sequence of VGAM1925 RNA, herein designated VGAM RNA, also designated SEQ ID:4636.

Another function of VGAM1925 is therefore inhibition of Synaptotagmin-like 2 (SYTL2, Accession NM_032379). Accordingly, utilities of VGAM1925 include diagnosis, prevention and treatment of diseases and clinical conditions associated with SYTL2. Tubulin, Gamma Complex Associated Protein 3 (TUBGCP3, Accession NM_006322) is another VGAM1925 host target gene. TUBGCP3 BINDING SITE is HOST TARGET binding site found in the 3' untranslated region of mRNA encoded by TUBGCP3, corresponding to a HOST TARGET binding site such as BINDING SITE I, BINDING SITE II or BINDING SITE III. Table 2 illustrates the complementarity of the nucleotide sequences of TUBGCP3 BINDING SITE, designated SEQ ID:13014, to the nucleotide sequence of VGAM1925 RNA, herein designated VGAM RNA, also designated SEQ ID:4636.

Another function of VGAM1925 is therefore inhibition of Tubulin, Gamma Complex Associated Protein 3 (TUBGCP3, Accession NM_006322). Accordingly, utilities of VGAM1925 include diagnosis, prevention and treatment of diseases and clinical conditions associated with TUBGCP3. UPLC1 (Accession NM_017707) is another VGAM1925 host target gene. UPLC1 BINDING SITE is HOST TARGET binding site found in the 3' untranslated region of mRNA encoded by UPLC1, corresponding to a HOST TARGET binding site such as BINDING SITE I, BINDING SITE II or BINDING SITE III. Table 2 illustrates the complementarity of the nucleotide sequences of UPLC1 BINDING SITE, designated SEQ ID:19285, to the nucleotide sequence of VGAM1925 RNA, herein designated VGAM RNA, also designated SEQ ID:4636.

Another function of VGAM1925 is therefore inhibition of UPLC1 (Accession NM_017707). Accordingly, utilities of VGAM1925 include diagnosis, prevention and treatment of diseases and clinical conditions associated with UPLC1. LOC121344 (Accession XM_058555) is another VGAM1925 host target gene. LOC121344 BINDING SITE is HOST TARGET binding site found in the 3' untranslated region of mRNA encoded by LOC121344, corresponding to a HOST TARGET binding site such as BINDING SITE I, BINDING SITE II or BINDING SITE III. Table 2 illustrates the complementarity of the nucleotide sequences of LOC121344 BINDING SITE, designated SEQ ID:36658, to the nucleotide sequence of VGAM1925 RNA, herein designated VGAM RNA, also designated SEQ ID:4636.

Another function of VGAM1925 is therefore inhibition of LOC121344 (Accession XM_058555). Accordingly, utilities of VGAM1925 include diagnosis, prevention and treatment of diseases and clinical conditions associated with LOC121344. LOC124976 (Accession XM_058879) is another VGAM1925 host target gene. LOC124976 BINDING SITE is HOST TARGET binding site found in the 3' untranslated region of mRNA encoded by LOC124976, corresponding to a HOST TARGET binding site such as BINDING SITE I, BINDING SITE II or BINDING SITE III. Table 2 illustrates the complementarity of the nucleotide sequences of LOC124976 BINDING SITE, designated SEQ ID:36785, to the nucleotide sequence of VGAM1925 RNA, herein designated VGAM RNA, also designated SEQ ID:4636.

Another function of VGAM1925 is therefore inhibition of LOC124976 (Accession XM_058879). Accordingly, utilities of VGAM1925 include diagnosis, prevention and treatment of diseases and clinical conditions associated with LOC124976. LOC127845 (Accession XM_059186) is another VGAM1925 host target gene. LOC127845 BINDING SITE is HOST TARGET binding site found in the 5' untranslated region of mRNA encoded by LOC127845, corresponding to a HOST TARGET binding site such as BINDING SITE I, BINDING SITE II or BINDING SITE III. Table 2 illustrates the complementarity of the nucleotide sequences of LOC127845 BINDING SITE, designated SEQ ID:36912, to the nucleotide sequence of VGAM1925 RNA, herein designated VGAM RNA, also designated SEQ ID:4636.

Another function of VGAM1925 is therefore inhibition of LOC127845 (Accession XM_059186). Accordingly, utilities of VGAM1925 include diagnosis, prevention and treatment of diseases and clinical conditions associated with LOC127845. LOC137964 (Accession XM_059933) is another VGAM1925 host target gene. LOC137964 BINDING SITE is HOST TARGET binding site found in the 3' untranslated region of mRNA encoded by LOC137964, corresponding to a HOST TARGET binding site such as BINDING SITE I, BINDING SITE II or BINDING SITE III. Table 2 illustrates the complementarity of the nucleotide sequences of LOC137964 BINDING SITE, designated SEQ ID:37113, to the nucleotide sequence of VGAM1925 RNA, herein designated VGAM RNA, also designated SEQ ID:4636.

Another function of VGAM1925 is therefore inhibition of LOC137964 (Accession XM_059933). Accordingly, utilities of VGAM1925 include diagnosis, prevention and treatment of diseases and clinical conditions associated with LOC137964. LOC139231 (Accession XM_060020) is another VGAM1925 host target gene. LOC139231 BINDING SITE is HOST TARGET binding site found in the 3' untranslated region of mRNA encoded by LOC139231, corresponding to a HOST TARGET binding site such as BINDING SITE I, BINDING SITE II or BINDING SITE III. Table 2 illustrates the complementarity of the nucleotide sequences of LOC139231 BINDING SITE, designated SEQ ID:37143, to the nucleotide sequence of VGAM1925 RNA, herein designated VGAM RNA, also designated SEQ ID:4636.

Another function of VGAM1925 is therefore inhibition of LOC139231 (Accession XM_060020). Accordingly, utilities of VGAM1925 include diagnosis, prevention and treatment of diseases and clinical conditions associated with LOC139231. LOC144266 (Accession XM_084795) is another VGAM1925 host target gene. LOC144266 BINDING SITE is HOST TARGET binding site found in the 5' untranslated region of mRNA encoded by LOC144266, corresponding to a HOST TARGET binding site such as BINDING SITE I, BINDING SITE II or BINDING SITE III. Table 2 illustrates the complementarity of the nucleotide sequences of LOC144266 BINDING SITE, designated SEQ ID:37712, to the nucleotide sequence of VGAM1925 RNA, herein designated VGAM RNA, also designated SEQ ID:4636.

Another function of VGAM1925 is therefore inhibition of LOC144266 (Accession XM_084795). Accordingly, utilities of VGAM1925 include diagnosis, prevention and treatment of diseases and clinical conditions associated with LOC144266. LOC145826 (Accession XM_096875) is another VGAM1925 host target gene. LOC145826 BINDING SITE is HOST TARGET binding site found in the 5' untranslated region of mRNA encoded by LOC145826, corresponding to a HOST TARGET binding site such as BINDING SITE I, BINDING SITE II or BINDING SITE III. Table 2 illustrates the complementarity of the nucleotide sequences of LOC145826 BINDING SITE, designated SEQ ID:40610, to the nucleotide sequence of VGAM1925 RNA, herein designated VGAM RNA, also designated SEQ ID:4636.

Another function of VGAM1925 is therefore inhibition of LOC145826 (Accession XM_096875). Accordingly, utilities of VGAM1925 include diagnosis, prevention and treatment of diseases and clinical conditions associated with LOC145826. LOC148113 (Accession XM_086058) is another VGAM1925 host target gene. LOC148113 BINDING SITE is HOST TARGET binding site found in the 3' untranslated region of mRNA encoded by LOC148113, corresponding to a HOST TARGET binding site such as BINDING SITE I, BINDING SITE II or BINDING SITE III. Table 2 illustrates the complementarity of the nucleotide sequences of LOC148113 BINDING SITE, designated SEQ ID:38472, to the nucleotide sequence of VGAM1925 RNA, herein designated VGAM RNA, also designated SEQ ID:4636.

Another function of VGAM1925 is therefore inhibition of LOC148113 (Accession XM_086058). Accordingly, utilities of VGAM1925 include diagnosis, prevention and treatment of diseases and clinical conditions associated with LOC148113. LOC149566 (Accession XM_097670) is another VGAM1925 host target gene. LOC149566 BINDING SITE is HOST TARGET binding site found in the 3' untranslated region of mRNA encoded by LOC149566, corresponding to a HOST TARGET binding site such as BINDING SITE I, BINDING SITE II or BINDING SITE III. Table 2 illustrates the complementarity of the nucleotide sequences of LOC149566 BINDING SITE, designated SEQ ID:41019, to the nucleotide sequence of VGAM1925 RNA, herein designated VGAM RNA, also designated SEQ ID:4636.

Another function of VGAM1925 is therefore inhibition of LOC149566 (Accession XM_097670). Accordingly, utilities of VGAM1925 include diagnosis, prevention and treatment of diseases and clinical conditions associated with LOC149566. LOC152633 (Accession XM_098248) is another VGAM1925 host target gene. LOC152633 BINDING SITE is HOST TARGET binding site found in the 5' untranslated region of mRNA encoded by LOC152633, corresponding to a HOST TARGET binding site such as BINDING SITE I, BINDING SITE II or BINDING SITE III. Table 2 illustrates the complementarity of the nucleotide sequences of LOC152633 BINDING SITE, designated SEQ ID:41535, to the nucleotide sequence of VGAM1925 RNA, herein designated VGAM RNA, also designated SEQ ID:4636.

Another function of VGAM1925 is therefore inhibition of LOC152633 (Accession XM_098248). Accordingly, utilities of VGAM1925 include diagnosis, prevention and treatment of diseases and clinical conditions associated with LOC152633. LOC153711 (Accession XM_098419) is another VGAM1925 host target gene. LOC153711 BINDING SITE is HOST TARGET binding site found in the 5' untranslated region of mRNA encoded by LOC153711, corresponding to a HOST TARGET binding site such as BINDING SITE I, BINDING SITE II or BINDING SITE III. Table 2 illustrates the complementarity of the nucleotide sequences of LOC153711 BINDING SITE, designated SEQ ID:41670, to the nucleotide sequence of VGAM1925 RNA, herein designated VGAM RNA, also designated SEQ ID:4636.

Another function of VGAM1925 is therefore inhibition of LOC153711 (Accession XM_098419). Accordingly, utilities of VGAM1925 include diagnosis, prevention and treatment of diseases and clinical conditions associated with LOC153711. LOC159148 (Accession XM_099030) is another VGAM1925 host target gene. LOC159148 BINDING SITE is HOST TARGET binding site found in the 5' untranslated region of mRNA encoded by LOC159148, corresponding to a HOST TARGET binding site such as BINDING SITE I, BINDING SITE II or BINDING SITE III. Table 2 illustrates the complementarity of the nucleotide sequences of LOC159148 BINDING SITE, designated SEQ ID:42079, to the nucleotide sequence of VGAM1925 RNA, herein designated VGAM RNA, also designated SEQ ID:4636.

Another function of VGAM1925 is therefore inhibition of LOC159148 (Accession XM_099030). Accordingly, utilities of VGAM1925 include diagnosis, prevention and treatment of diseases and clinical conditions associated with LOC159148. LOC196283 (Accession XM_113684) is another VGAM1925 host target gene. LOC196283 BINDING SITE is HOST TARGET binding site found in the 3' untranslated region of mRNA encoded by LOC196283, corresponding to a HOST TARGET binding site such as BIND- ING SITE I, BINDING SITE II or BINDING SITE III. Table 2 illustrates the complementarity of the nucleotide sequences of LOC196283 BINDING SITE, designated SEQ ID:42341, to the nucleotide sequence of VGAM1925 RNA, herein designated VGAM RNA, also designated SEQ ID:4636.

Another function of VGAM1925 is therefore inhibition of LOC196283 (Accession XM_113684). Accordingly, utilities of VGAM1925 include diagnosis, prevention and treatment of diseases and clinical conditions associated with LOC196283. LOC197358 (Accession XM_113872) is another VGAM1925 host target gene. LOC197358 BINDING SITE is HOST TARGET binding site found in the 3' untranslated region of mRNA encoded by LOC197358, corresponding to a HOST TARGET binding site such as BINDING SITE I, BINDING SITE II or BINDING SITE III. Table 2 illustrates the complementarity of the nucleotide sequences of LOC197358 BINDING SITE, designated SEQ ID:42511, to the nucleotide sequence of VGAM1925 RNA, herein designated VGAM RNA, also designated SEQ ID:4636.

Another function of VGAM1925 is therefore inhibition of LOC197358 (Accession XM_113872). Accordingly, utilities of VGAM1925 include diagnosis, prevention and treatment of diseases and clinical conditions associated with LOC197358. LOC201799 (Accession XM_114380) is another VGAM1925 host target gene. LOC201799 BINDING SITE is HOST TARGET binding site found in the 3' untranslated region of mRNA encoded by LOC201799, corresponding to a HOST TARGET binding site such as BINDING SITE I, BINDING SITE II or BINDING SITE III. Table 2 illustrates the complementarity of the nucleotide sequences of LOC201799 BINDING SITE, designated SEQ ID:42918, to the nucleotide sequence of VGAM1925 RNA, herein designated VGAM RNA, also designated SEQ ID:4636.

Another function of VGAM1925 is therefore inhibition of LOC201799 (Accession XM_114380). Accordingly, utilities of VGAM1925 include diagnosis, prevention and treatment of diseases and clinical conditions associated with LOC201799. LOC201965 (Accession XM_114412) is another VGAM1925 host target gene. LOC201965 BINDING SITE is HOST TARGET binding site found in the 3' untranslated region of mRNA encoded by LOC201965, corresponding to a HOST TARGET binding site such as BINDING SITE I, BINDING SITE II or BINDING SITE III. Table 2 illustrates the complementarity of the nucleotide sequences of LOC201965 BINDING SITE, designated SEQ ID:42936, to the nucleotide sequence of VGAM1925 RNA, herein designated VGAM RNA, also designated SEQ ID:4636.

Another function of VGAM1925 is therefore inhibition of LOC201965 (Accession XM_114412). Accordingly, utilities of VGAM1925 include diagnosis, prevention and treatment of diseases and clinical conditions associated with LOC201965. LOC253891 (Accession XM_170485) is another VGAM1925 host target gene. LOC253891 BINDING SITE is HOST TARGET binding site found in the 5' untranslated region of mRNA encoded by LOC253891, corresponding to a HOST TARGET binding site such as BINDING SITE I, BINDING SITE II or BINDING SITE III. Table 2 illustrates the complementarity of the nucleotide sequences of LOC253891 BINDING SITE, designated SEQ ID:45324, to the nucleotide sequence of VGAM1925 RNA, herein designated VGAM RNA, also designated SEQ ID:4636.

Another function of VGAM1925 is therefore inhibition of LOC253891 (Accession XM_170485). Accordingly, utilities of VGAM1925 include diagnosis, prevention and treatment of diseases and clinical conditions associated with LOC253891. LOC253897 (Accession XM_171187) is another VGAM1925 host target gene. LOC253897 BINDING SITE is HOST TARGET binding site found in the 3' untranslated region of mRNA encoded by LOC253897, corresponding to a HOST TARGET binding site such as BINDING SITE I, BINDING SITE II or BINDING SITE III. Table 2 illustrates the complementarity of the nucleotide sequences of LOC253897 BINDING SITE, designated SEQ ID:45969, to the nucleotide sequence of VGAM1925 RNA, herein designated VGAM RNA, also designated SEQ ID:4636.

Another function of VGAM1925 is therefore inhibition of LOC253897 (Accession XM_171187). Accordingly, utilities of VGAM1925 include diagnosis, prevention and treatment of diseases and clinical conditions associated with LOC253897. LOC256806 (Accession XM_172865) is another VGAM1925 host target gene. LOC256806 BINDING SITE is HOST TARGET binding site found in the 5' untranslated region of mRNA encoded by LOC256806, corresponding to a HOST TARGET binding site such as BINDING SITE I, BINDING SITE II or BINDING SITE III. Table 2 illustrates the complementarity of the nucleotide sequences of LOC256806 BINDING SITE, designated SEQ ID:46142, to the nucleotide sequence of VGAM1925 RNA, herein designated VGAM RNA, also designated SEQ ID:4636.

Another function of VGAM1925 is therefore inhibition of LOC256806 (Accession XM_172865). Accordingly, utilities of VGAM1925 include diagnosis, prevention and treatment of diseases and clinical conditions associated with LOC256806. LOC51608 (Accession XM_033102) is another VGAM1925 host target gene. LOC51608 BINDING SITE is HOST TARGET binding site found in the 3' untranslated region of mRNA encoded by LOC51608, corresponding to a HOST TARGET binding site such as BINDING SITE I, BINDING SITE II or BINDING SITE III. Table 2 illustrates the complementarity of the nucleotide sequences of LOC51608 BINDING SITE, designated SEQ ID:31841, to the nucleotide sequence of VGAM1925 RNA, herein designated VGAM RNA, also designated SEQ ID:4636.

Another function of VGAM1925 is therefore inhibition of LOC51608 (Accession XM_033102). Accordingly, utilities of VGAM1925 include diagnosis, prevention and treatment of diseases and clinical conditions associated with LOC51608. LOC91694 (Accession XM_040082) is another VGAM1925 host target gene. LOC91694 BINDING SITE is HOST TARGET binding site found in the 3' untranslated region of mRNA encoded by LOC91694, corresponding to a HOST TARGET binding site such as BINDING SITE I, BINDING SITE II or BINDING SITE III. Table 2 illustrates the complementarity of the nucleotide sequences of LOC91694 BINDING SITE, designated SEQ ID:33251, to the nucleotide sequence of VGAM1925 RNA, herein designated VGAM RNA, also designated SEQ ID:4636.

Another function of VGAM1925 is therefore inhibition of LOC91694 (Accession XM_040082). Accordingly, utilities of VGAM1925 include diagnosis, prevention and treatment of diseases and clinical conditions associated with LOC91694. FIG. 1 further provides a conceptual description of a novel bioinformatically detected viral gene of the present invention, referred to here as Viral Genomic Address Messenger 1926 (VGAM1926) viral gene, which modulates expression of respective host target genes thereof, the function and utility of which host target genes is known in the art.

VGAM1926 is a novel bioinformatically detected regulatory, non protein coding, viral micro RNA (miRNA) gene. The method by which VGAM1926 was detected is described hereinabove with reference to FIGS. 1-8.

VGAM1926 gene, herein designated VGAM GENE, is a viral gene contained in the genome of Canine Distemper Virus. VGAM1926 host target gene, herein designated VGAM HOST TARGET GENE, is a human gene contained in the human genome.

VGAM1926 gene encodes a VGAM1926 precursor RNA, herein designated VGAM PRECURSOR RNA. Similar to other miRNA genes, and unlike most ordinary genes, VGAM1926 precursor RNA does not encode a protein. A nucleotide sequence identical or highly similar to the nucleotide sequence of VGAM1926 precursor RNA is designated SEQ ID:1912, and is provided hereinbelow with reference to the sequence listing part. Nucleotide sequence SEQ ID:1912 is located at position 8304 relative to the genome of Canine Distemper Virus.

VGAM1926 precursor RNA folds onto itself, forming VGAM1926 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1926 folded precursor RNA into VGAM1926 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1926 RNA is designated SEQ ID:4637, and is provided hereinbelow with reference to the sequence listing part.

VGAM1926 host target gene, herein designated VGAM HOST TARGET GENE, encodes a corresponding messenger RNA, VGAM1926 host target RNA, herein designated VGAM HOST TARGET RNA. VGAM1926 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1926 RNA, herein designated VGAM RNA, binds complementarily to one or more host target binding sites located in untranslated regions of VGAM1926 host target RNA, herein designated VGAM HOST TARGET RNA. This complementary binding is due to the fact that the nucleotide sequence of VGAM1926 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1926 RNA, herein designated VGAM RNA, may have a different number of host target binding sites in untranslated regions of a VGAM1926 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1926 RNA, herein designated VGAM RNA, to host target binding sites on VGAM1926 host target RNA, herein designated VGAM HOST TARGET RNA, such as BINDING SITE I, BINDING SITE II and BINDING SITE III, inhibits translation of VGAM1926 host target RNA into VGAM1926 host target protein, herein designated VGAM HOST TARGET PROTEIN. VGAM host target protein is therefore outlined by a broken line.

It is appreciated that VGAM1926 host target gene, herein designated VGAM HOST TARGET GENE, in fact represents a plurality of VGAM1926 host target genes. The mRNA of each one of this plurality of VGAM1926 host target genes comprises one or more host target binding sites, each having a nucleotide sequence which is at least partly complementary to VGAM1926 RNA, herein designated VGAM RNA, and which when bound by VGAM1926 RNA causes inhibition of translation of respective one or more VGAM1926 host target proteins.

It is further appreciated by one skilled in the art that the mode of translational inhibition illustrated by FIG. 1 with specific reference to translational inhibition exerted by VGAM1926 gene, herein designated VGAM GENE, on one or more VGAM1926 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1926 is inhibition of expression of host target genes, as part of a novel viral mechanism of attacking a host. Accordingly, utilities of VGAM1926 include diagnosis, prevention and treatment of viral infection by Canine Distemper Virus. Specific functions, and accordingly utilities, of VGAM1926 correlate with, and may be deduced from, the identity of the host target genes which VGAM1926 binds and inhibits, and the function of these host target genes, as elaborated hereinbelow.

Nucleotide sequences of the VGAM1926 precursor RNA, herein designated VGAM PRECURSOR RNA, and of the 'diced' VGAM1926 RNA, herein designated VGAM RNA, and a schematic representation of the secondary folding of VGAM1926 folded precursor RNA, herein designated VGAM FOLDED PRECURSOR RNA, of VGAM1926 are further described hereinbelow with reference to Table 1.

Nucleotide sequences of host target binding sites, such as BINDING SITE-I, BINDING SITE-II and BINDING SITE-III of FIG. 1, found on VGAM1926 host target RNA, and schematic representation of the complementarity of each of these host target binding sites to VGAM1926 RNA, herein designated VGAM RNA, are described hereinbelow with reference to Table 2.

As mentioned hereinabove with reference to FIG. 1, a function of VGAM1926 gene, herein designated VGAM is inhibition of expression of VGAM1926 target genes. It is appreciated that specific functions, and accordingly utilities, of VGAM1926 correlate with, and may be deduced from, the identity of the target genes which VGAM1926 binds and inhibits, and the function of these target genes, as elaborated hereinbelow.

Glycoprotein A Repetitions Predominant (GARP, Accession NM_005512) is a VGAM1926 host target gene. GARP BINDING SITE is HOST TARGET binding site found in the 3' untranslated region of mRNA encoded by GARP, corresponding to a HOST TARGET binding site such as BINDING SITE I, BINDING SITE II or BINDING SITE III. Table 2 illustrates the complementarity of the nucleotide sequences of GARP BINDING SITE, designated SEQ ID:12035, to the nucleotide sequence of VGAM1926 RNA, herein designated VGAM RNA, also designated SEQ ID:4637.

A function of VGAM1926 is therefore inhibition of Glycoprotein A Repetitions Predominant (GARP, Accession NM_005512). Accordingly, utilities of VGAM1926 include diagnosis, prevention and treatment of diseases and clinical conditions associated with GARP. ARPP-21 (Accession NM_016300) is another VGAM1926 host target gene. ARPP-21 BINDING SITE is HOST TARGET binding site found in the 5' untranslated region of mRNA encoded by ARPP-21, corresponding to a HOST TARGET binding site such as BINDING SITE I, BINDING SITE II or BINDING SITE III. Table 2 illustrates the complementarity of the nucleotide sequences of ARPP-21 BINDING SITE, designated SEQ ID:18421, to the nucleotide sequence of VGAM1926 RNA, herein designated VGAM RNA, also designated SEQ ID:4637.

Another function of VGAM1926 is therefore inhibition of ARPP-21 (Accession NM_016300). Accordingly, utilities of VGAM1926 include diagnosis, prevention and treatment of diseases and clinical conditions associated with ARPP-21. KIAA1577 (Accession XM_035299) is another VGAM1926 host target gene. KIAA1577 BINDING SITE is HOST TARGET binding site found in the 5' untranslated region of mRNA encoded by KIAA1577, corresponding to a HOST TARGET binding site such as BINDING SITE I, BINDING SITE II or BINDING SITE III. Table 2 illustrates the complementarity of the nucleotide sequences of KIAA1577 BINDING SITE, designated SEQ ID:32209, to the nucleotide sequence of VGAM1926 RNA, herein designated VGAM RNA, also designated SEQ ID:4637.

Another function of VGAM1926 is therefore inhibition of KIAA1577 (Accession XM_035299). Accordingly, utilities of VGAM1926 include diagnosis, prevention and treatment of diseases and clinical conditions associated with KIAA1577. MGC4400 (Accession NM_032679) is another VGAM1926 host target gene. MGC4400 BINDING SITE is HOST TARGET binding site found in the 3' untranslated region of mRNA encoded by MGC4400, corresponding to a HOST TARGET binding site such as BINDING SITE I, BINDING SITE II or BINDING SITE III. Table 2 illustrates the complementarity of the nucleotide sequences of MGC4400 BINDING SITE, designated SEQ ID:26399, to the nucleotide sequence of VGAM1926 RNA, herein designated VGAM RNA, also designated SEQ ID:4637.

Another function of VGAM1926 is therefore inhibition of MGC4400 (Accession NM_032679). Accordingly, utilities of VGAM1926 include diagnosis, prevention and treatment of diseases and clinical conditions associated with MGC4400. LOC145622 (Accession XM_085186) is another VGAM1926 host target gene. LOC145622 BINDING SITE1 and LOC145622 BINDING SITE2 are HOST TARGET binding sites found in untranslated regions of mRNA encoded by LOC145622, corresponding to HOST TARGET binding sites such as BINDING SITE I, BINDING SITE II or BINDING SITE III. Table 2 illustrates the complementarity of the nucleotide sequences of LOC145622 BINDING SITE1 and LOC145622 BINDING SITE2, designated SEQ ID:37905 and SEQ ID:37906 respectively, to the nucleotide sequence of VGAM1926 RNA, herein designated VGAM RNA, also designated SEQ ID:4637.

Another function of VGAM1926 is therefore inhibition of LOC145622 (Accession XM_085186). Accordingly, utilities of VGAM1926 include diagnosis, prevention and treatment of diseases and clinical conditions associated with LOC145622. WSB1 (Accession NM_134265) is another VGAM1927 host target gene. WSB1 BINDING SITE1 and WSB1 BINDING SITE2 are HOST TARGET binding sites found in untranslated regions of mRNA encoded by WSB1, corresponding to HOST TARGET binding sites such as BINDING SITE I, BINDING SITE II or BINDING SITE III. Table 2 illustrates the complementarity of the nucleotide sequences of WSB1 BINDING SITE1 and WSB1 BINDING SITE2, designated SEQ ID:28620 and SEQ ID:28614 respectively, to the nucleotide sequence of VGAM1927 RNA, herein designated VGAM RNA, also designated SEQ ID:4638.

Another function of VGAM1927 is therefore inhibition of WSB1 (Accession NM_134265). Accordingly, utilities of VGAM1927 include diagnosis, prevention and treatment of diseases and clinical conditions associated with WSB1. LOC144997 (Accession XM_096702) is another VGAM1927 host target gene. LOC144997 BINDING SITE is HOST TARGET binding site found in the 3' untranslated region of mRNA encoded by LOC144997, corresponding to a HOST TARGET binding site such as BINDING SITE I, BINDING SITE II or BINDING SITE III. Table 2 illustrates the complementarity of the nucleotide sequences of LOC144997 BINDING SITE, designated SEQ ID:40482, to the nucleotide sequence of VGAM1927 RNA, herein designated VGAM RNA, also designated SEQ ID:4638.

Another function of VGAM1927 is therefore inhibition of LOC144997 (Accession XM_096702). Accordingly, utilities of VGAM1927 include diagnosis, prevention and treatment of diseases and clinical conditions associated with LOC144997. FIG. 1 further provides a conceptual description of a novel bioinformatically detected viral gene of the present invention, referred to here as Viral Genomic Address Messenger 1928 (VGAM1928) viral gene, which modulates expression of respective host target genes thereof, the function and utility of which host target genes is known in the art.

VGAM1928 is a novel bioinformatically detected regulatory, non protein coding, viral micro RNA (miRNA) gene. The method by which VGAM1928 was detected is described hereinabove with reference to FIGS. 1-8.

VGAM1928 gene, herein designated VGAM GENE, is a viral gene contained in the genome of Canine Distemper Virus. VGAM1928 host target gene, herein designated VGAM HOST TARGET GENE, is a human gene contained in the human genome.

VGAM1928 gene encodes a VGAM1928 precursor RNA, herein designated VGAM PRECURSOR RNA. Similar to other miRNA genes, and unlike most ordinary genes, VGAM1928 precursor RNA does not encode a protein. A nucleotide sequence identical or highly similar to the nucleotide sequence of VGAM1928 precursor RNA is designated SEQ ID:1914, and is provided hereinbelow with reference to the sequence listing part. Nucleotide sequence SEQ ID:1914 is located at position 5392 relative to the genome of Canine Distemper Virus.

VGAM1928 precursor RNA folds onto itself, forming VGAM1928 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1928 folded precursor RNA into VGAM1928 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1928 RNA is designated SEQ ID:4639, and is provided hereinbelow with reference to the sequence listing part.

VGAM1928 host target gene, herein designated VGAM HOST TARGET GENE, encodes a corresponding messenger RNA, VGAM1928 host target RNA, herein designated VGAM HOST TARGET RNA. VGAM1928 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1928 RNA, herein designated VGAM RNA, binds complementarily to one or more host target binding sites located in untranslated regions of VGAM1928 host target RNA, herein designated VGAM HOST TARGET RNA. This complementary binding is due to the fact that the nucleotide sequence of VGAM1928 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1928 RNA, herein designated VGAM RNA, may have a different number of host target binding sites in untranslated regions of a VGAM1928 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1928 RNA, herein designated VGAM RNA, to host target binding sites on VGAM1928 host target RNA, herein designated VGAM HOST TARGET RNA, such as BINDING SITE I, BINDING SITE II and BINDING SITE III, inhibits translation of VGAM1928 host target RNA into VGAM1928 host target protein, herein designated VGAM HOST TARGET PROTEIN. VGAM host target protein is therefore outlined by a broken line.

It is appreciated that VGAM1928 host target gene, herein designated VGAM HOST TARGET GENE, in fact represents a plurality of VGAM1928 host target genes. The mRNA of each one of this plurality of VGAM1928 host target genes comprises one or more host target binding sites, each having a nucleotide sequence which is at least partly complementary to VGAM1928 RNA, herein designated VGAM RNA, and which when bound by VGAM1928 RNA causes inhibition of translation of respective one or more VGAM1928 host target proteins.

It is further appreciated by one skilled in the art that the mode of translational inhibition illustrated by FIG. 1 with specific reference to translational inhibition exerted by VGAM1928 gene, herein designated VGAM GENE, on one or more VGAM1928 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1928 is inhibition of expression of host target genes, as part of a novel viral mechanism of attacking a host. Accordingly, utilities of VGAM1928 include diagnosis, prevention and treatment of viral infection by Canine Distemper Virus. Specific functions, and accordingly utilities, of VGAM1928 correlate with, and may be deduced from, the identity of the host target genes which VGAM1928 binds and inhibits, and the function of these host target genes, as elaborated hereinbelow.

Nucleotide sequences of the VGAM1928 precursor RNA, herein designated VGAM PRECURSOR RNA, and of the 'diced' VGAM1928 RNA, herein designated VGAM RNA, and a schematic representation of the secondary folding of VGAM1928 folded precursor RNA, herein designated VGAM FOLDED PRECURSOR RNA, of VGAM1928 are further described hereinbelow with reference to Table 1.

Nucleotide sequences of host target binding sites, such as BINDING SITE-I, BINDING SITE-II and BINDING SITE-III of FIG. 1, found on VGAM1928 host target RNA, and schematic representation of the complementarity of each of these host target binding sites to VGAM1928 RNA, herein designated VGAM RNA, are described hereinbelow with reference to Table 2.

As mentioned hereinabove with reference to FIG. 1, a function of VGAM1928 gene, herein designated VGAM is inhibition of expression of VGAM1928 target genes. It is appreciated that specific functions, and accordingly utilities, of VGAM1928 correlate with, and may be deduced from, the identity of the target genes which VGAM1928 binds and inhibits, and the function of these target genes, as elaborated hereinbelow.

Adenosine Deaminase, RNA-specific (ADAR, Accession NM_001111) is a VGAM1928 host target gene. ADAR BINDING SITE1 through ADAR BINDING SITE3 are HOST TARGET binding sites found in untranslated regions of mRNA encoded by ADAR, corresponding to HOST TARGET binding sites such as BINDING SITE I, BINDING SITE II or BINDING SITE III. Table 2 illustrates the complementarity of the nucleotide sequences of ADAR BINDING SITE1 through ADAR BINDING SITE3, designated SEQ ID:6772, SEQ ID:17958 and SEQ ID:17965 respectively, to the nucleotide sequence of VGAM1928 RNA, herein designated VGAM RNA, also designated SEQ ID:4639.

A function of VGAM1928 is therefore inhibition of Adenosine Deaminase, RNA-specific (ADAR, Accession NM_001111), a gene which converts adenosine to inosine in double-stranded RNA. Accordingly, utilities of VGAM1928 include diagnosis, prevention and treatment of diseases and clinical conditions associated with ADAR. The function of ADAR and its association with various diseases and clinical conditions, has been established by previous studies, as described hereinabove with reference to VGAM323. A Kinase (PRKA) Anchor Protein 2 (AKAP2, Accession NM_007203) is another VGAM1928 host target gene. AKAP2 BINDING SITE is HOST TARGET binding site found in the 3' untranslated region of mRNA encoded by AKAP2, corresponding to a HOST TARGET binding site such as BINDING SITE I, BINDING SITE II or BINDING SITE III. Table 2 illustrates the complementarity of the nucleotide sequences of AKAP2 BINDING SITE, designated SEQ ID:14061, to the nucleotide sequence of VGAM1928 RNA, herein designated VGAM RNA, also designated SEQ ID:4639.

Another function of VGAM1928 is therefore inhibition of A Kinase (PRKA) Anchor Protein 2 (AKAP2, Accession NM_007203), a gene which binds to regulatory subunit (rii) of protein kinase a. Accordingly, utilities of VGAM1928 include diagnosis, prevention and treatment of diseases and clinical conditions associated with AKAP2. The function of AKAP2 and its association with various diseases and clinical conditions, has been established by previous studies, as described hereinabove with reference to VGAM18. Aldehyde Dehydrogenase 3 Family, Member B2 (ALDH3B2, Accession NM_000695) is another VGAM1928 host target gene. ALDH3B2 BINDING SITE is HOST TARGET binding site found in the 3' untranslated region of mRNA encoded by ALDH3B2, corresponding to a HOST TARGET binding site such as BINDING SITE I, BINDING SITE II or BINDING SITE III. Table 2 illustrates the complementarity of the nucleotide sequences of ALDH3B2 BINDING SITE, designated SEQ ID:6357, to the nucleotide sequence of VGAM1928 RNA, herein designated VGAM RNA, also designated SEQ ID:4639.

Another function of VGAM1928 is therefore inhibition of Aldehyde Dehydrogenase 3 Family, Member B2 (ALDH3B2, Accession NM_000695), a gene which may play a role in alcohol detoxitation. Accordingly, utilities of VGAM1928 include diagnosis, prevention and treatment of diseases and clinical conditions associated with ALDH3B2. The function of ALDH3B2 and its association with various diseases and clinical conditions, has been established by previous studies, as described hereinabove with reference to VGAM251. Adaptor-related Protein Complex 2, Beta 1 Subunit (AP2B1, Accession NM_001282) is another VGAM1928 host target gene. AP2B1 BINDING SITE is HOST TARGET binding site found in the 3' untranslated region of mRNA encoded by AP2B1, corresponding to a HOST TARGET binding site such as BINDING SITE I, BINDING SITE II or BINDING SITE III. Table 2 illustrates the complementarity of the nucleotide sequences of AP2B1 BINDING SITE, designated SEQ ID:6954, to the nucleotide sequence of VGAM1928 RNA, herein designated VGAM RNA, also designated SEQ ID:4639.

Another function of VGAM1928 is therefore inhibition of Adaptor-related Protein Complex 2, Beta 1 Subunit (AP2B1, Accession NM_001282), a gene which links clathrin to receptors in coated vesicles. Accordingly, utilities of VGAM1928 include diagnosis, prevention and treatment of diseases and clinical conditions associated with AP2B1. The function of AP2B1 and its association with various diseases and clinical conditions, has been established by previous studies, as described hereinabove with reference to VGAM1126. Aprataxin (APTX, Accession NM_017692) is another VGAM1928 host target gene. APTX BINDING SITE is HOST TARGET binding site found in the 3' untranslated region of mRNA encoded by APTX, corresponding to a HOST TARGET binding site such as BINDING SITE I, BINDING SITE II or BINDING SITE III. Table 2 illustrates the complementarity of the nucleotide sequences of APTX BINDING SITE, designated SEQ ID:19248, to the nucleotide sequence of VGAM1928 RNA, herein designated VGAM RNA, also designated SEQ ID:4639.

Another function of VGAM1928 is therefore inhibition of Aprataxin (APTX, Accession NM_017692). Accordingly, utilities of VGAM1928 include diagnosis, prevention and treatment of diseases and clinical conditions associated with APTX. Apical Protein-like (Xenopus laevis) (APXL, Accession NM_001649) is another VGAM1928 host target gene. APXL BINDING SITE is HOST TARGET binding site found in the 3' untranslated region of mRNA encoded by APXL, corresponding to a HOST TARGET binding site such as BINDING SITE I, BINDING SITE II or BINDING SITE III. Table 2 illustrates the complementarity of the nucleotide sequences of APXL BINDING SITE, designated SEQ ID:7357, to the nucleotide sequence of VGAM1928 RNA, herein designated VGAM RNA, also designated SEQ ID:4639.

Another function of VGAM1928 is therefore inhibition of Apical Protein-like (Xenopus laevis) (APXL, Accession NM_001649), a gene which is implicated in amiloride-sensitive sodium channel activity. Accordingly, utilities of VGAM1928 include diagnosis, prevention and treatment of diseases and clinical conditions associated with APXL. The function of APXL and its association with various diseases and clinical conditions, has been established by previous studies, as described hereinabove with reference to VGAM152. Beta-1,3-glucuronyltransferase 1 (glucuronosyltransferase P) (B3GAT1, Accession NM_018644) is another VGAM1928 host target gene. B3GAT1 BINDING SITE1 and B3GAT1 BINDING SITE2 are HOST TARGET binding sites found in untranslated regions of mRNA encoded by B3GAT1, corresponding to HOST TARGET binding sites such as BINDING SITE I, BINDING SITE II or BINDING SITE III. Table 2 illustrates the complementarity of the nucleotide sequences of B3GAT1 BINDING SITE1 and B3GAT1 BINDING SITE2, designated SEQ ID:20719 and SEQ ID:27631 respectively, to the nucleotide sequence of VGAM1928 RNA, herein designated VGAM RNA, also designated SEQ ID:4639.

Another function of VGAM1928 is therefore inhibition of Beta-1,3-glucuronyltransferase 1 (glucuronosyltransferase P) (B3GAT1, Accession NM_018644). Accordingly, utilities of VGAM1928 include diagnosis, prevention and treatment of diseases and clinical conditions associated with B3GAT1. Brain and Acute Leukemia, Cytoplasmic (BAALC, Accession NM_024812) is another VGAM1928 host target gene. BAALC BINDING SITE is HOST TARGET binding site found in the 3' untranslated region of mRNA encoded by BAALC, corresponding to a HOST TARGET binding site such as BINDING SITE I, BINDING SITE II or BINDING SITE III. Table 2 illustrates the complementarity of the nucleotide sequences of BAALC BINDING SITE, designated SEQ ID:24196, to the nucleotide sequence of VGAM1928 RNA, herein designated VGAM RNA, also designated SEQ ID:4639.

Another function of VGAM1928 is therefore inhibition of Brain and Acute Leukemia, Cytoplasmic (BAALC, Accession NM_024812). Accordingly, utilities of VGAM1928 include diagnosis, prevention and treatment of diseases and clinical conditions associated with BAALC. B-cell CLL/lymphoma 2 (BCL2, Accession NM_000633) is another VGAM1928 host target gene. BCL2 BINDING SITE1 and BCL2 BINDING SITE2 are HOST TARGET binding sites found in untranslated regions of mRNA encoded by BCL2, corresponding to HOST TARGET binding sites such as BINDING SITE I, BINDING SITE II or BINDING SITE III. Table 2 illustrates the complementarity of the nucleotide sequences of BCL2 BINDING SITE1 and BCL2 BINDING SITE2, designated SEQ ID:6251 and SEQ ID:6258 respectively, to the nucleotide sequence of VGAM1928 RNA, herein designated VGAM RNA, also designated SEQ ID:4639.

Another function of VGAM1928 is therefore inhibition of B-cell CLL/lymphoma 2 (BCL2, Accession NM_000633). Accordingly, utilities of VGAM1928 include diagnosis, prevention and treatment of diseases and clinical conditions associated with BCL2. Core-binding Factor, Runt Domain, Alpha Subunit 2; Translocated To, 2 (CBFA2T2, Accession NM_005093) is another VGAM1928 host target gene. CBFA2T2 BINDING SITE is HOST TARGET binding site found in the 3' untranslated region of mRNA encoded by CBFA2T2, corresponding to a HOST TARGET binding site such as BINDING SITE I, BINDING SITE II or BINDING SITE III. Table 2 illustrates the complementarity of the nucleotide sequences of CBFA2T2 BINDING SITE, designated SEQ ID:11549, to the nucleotide sequence of VGAM1928 RNA, herein designated VGAM RNA, also designated SEQ ID:4639.

Another function of VGAM1928 is therefore inhibition of Core-binding Factor, Runt Domain, Alpha Subunit 2; Translocated To, 2 (CBFA2T2, Accession NM_005093), a gene which is a putative transcription factor. Accordingly, utilities of VGAM1928 include diagnosis, prevention and treatment of diseases and clinical conditions associated with CBFA2T2. The function of CBFA2T2 and its association with various diseases and clinical conditions, has been established by previous studies, as described hereinabove with reference to VGAM152. CD28 Antigen (Tp44) (CD28, Accession NM_006139) is another VGAM1928 host target gene. CD28 BINDING SITE is HOST TARGET binding site found in the 3' untranslated region of mRNA encoded by CD28, corresponding to a HOST TARGET binding site such as BINDING SITE I, BINDING SITE II or BINDING SITE III. Table 2 illustrates the complementarity of the nucleotide sequences of CD28 BINDING SITE, designated SEQ ID:12784, to the nucleotide sequence of VGAM1928 RNA, herein designated VGAM RNA, also designated SEQ ID:4639.

Another function of VGAM1928 is therefore inhibition of CD28 Antigen (Tp44) (CD28, Accession NM_006139), a gene which possibly involved in t-cell activation. Accordingly, utilities of VGAM1928 include diagnosis, prevention and treatment of diseases and clinical conditions associated with CD28. The function of CD28 and its association with various diseases and clinical conditions, has been established by previous studies, as described hereinabove with reference to VGAM281. CD44 Antigen (homing function and Indian blood group system) (CD44, Accession NM_000610) is another VGAM1928 host target gene. CD44 BINDING SITE is HOST TARGET binding site found in the 3' untranslated region of mRNA encoded by CD44, corresponding to a HOST TARGET binding site such as BINDING SITE I, BINDING SITE II or BINDING SITE III. Table 2 illustrates the complementarity of the nucleotide sequences of CD44 BINDING SITE, designated SEQ ID:6211, to the nucleotide sequence of VGAM1928 RNA, herein designated VGAM RNA, also designated SEQ ID:4639.

Another function of VGAM1928 is therefore inhibition of CD44 Antigen (homing function and Indian blood group system) (CD44, Accession NM_000610), a gene which is main cell surface receptor for hyaluronate, and involves in matrix adhesion, lymphocyte activation and lymph node homing. Accordingly, utilities of VGAM1928 include diagnosis, prevention and treatment of diseases and clinical conditions associated with CD44. The function of CD44 has been established by previous studies. Weber et al. (1996) noted that the CD44 gene encodes a transmembrane protein that is expressed as a family of molecular isoforms generated from alternative RNA splicing and posttranslational modifications. Certain CD44 isoforms that regulate activation and migration of lymphocytes and macrophages may also enhance local growth and metastatic spread of tumor cells. One ligand of CD44 is hyaluronic acid, binding of which to the NH2-terminal domain of CD44 enhances cellular aggregation and tumor cell growth. (Krainer et al. (1991) referred to CD44 as a 'hyaladherin' -- see 601269.) Weber et al. (1996) demonstrated that another ligand is osteopontin (OMIM Ref. No. 166490). Osteopontin induces cellular chemotaxis but not homotypic aggregation of cells, whereas the inverse is true for the interaction between CD44 and hyaluronate. The alternative responses to CD44 ligation may be exploited by tumor cells to allow OPN-mediated metastatic spread and hyaluronate-dependent growth in newly colonized tissues in the process of tumor metastasis Animal model experiments lend further support to the function of CD44. Schmits et al. (1997) generated mice deficient in all known isoforms of Cd44 by targeting exons encoding the invariant N-terminal region of the molecule. Mice were born in mendelian ratio without any obvious developmental or neurologic deficits. Hematologic impairment was evidenced by altered tissue distribution of myeloid progenitors with increased levels of colony-forming unit-granulocyte-macrophage in bone marrow and reduced numbers in spleen. Fetal liver colony-forming unit-spleen and granulocyte colony-stimulating factor mobilization assays, together with reduced colony-forming unit-granulocyte-macrophage in peripheral blood, suggested that progenitor egress from the bone marrow was defective. Mice also developed exaggerated granuloma responses to Cryotosporidium parvum infection. Tumor studies showed that SV40-transformed Cd44-deficient fibroblasts were highly tumorigenic in nude mice, whereas reintroduction of Cd44 expression into these fibroblasts resulted in a dramatic inhibition of tumor growth.

It is appreciated that the abovementioned animal model for CD44 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Weber, G. F.; Ashkar, S.; Glimcher, M. J.; Cantor, H.: Receptor-ligand interaction between CD44 and osteopontin (Eta-1). Science 271:509-512, 1996; and Schmits, R.; Filmus, J.; Gerwin, N.; Senaldi, G.; Kiefer, F.; Kundig, T.; Wakeham, A.; Shahinian, A.; Catzavelos, C.; Rak, J.; Furlonger, C.; Zakarian, A.; Simard, J. J.; Ohashi, P. S.

Further studies establishing the function and utilities of CD44 are found in John Hopkins OMIM database record ID 107269, and in sited publications numbered 210-215, 5262-223, 4163-416 and 4205 listed in the bibliography section hereinbelow, which are also hereby incorporated by reference. Cyclin-dependent Kinase Inhibitor 2A (melanoma, p16, inhibits CDK4) (CDKN2A, Accession NM_058195) is another VGAM1928 host target gene. CDKN2A BINDING SITE is HOST TARGET binding site found in the 5' untranslated region of mRNA encoded by CDKN2A, corresponding to a HOST TARGET binding site such as BINDING SITE I, BINDING SITE II or BINDING SITE III. Table 2 illustrates the complementarity of the nucleotide sequences of CDKN2A BINDING SITE, designated SEQ ID:27756, to the nucleotide sequence of VGAM1928 RNA, herein designated VGAM RNA, also designated SEQ ID:4639.

Another function of VGAM1928 is therefore inhibition of Cyclin-dependent Kinase Inhibitor 2A (melanoma, p16, inhibits CDK4) (CDKN2A, Accession NM_058195). Accordingly, utilities of VGAM1928 include diagnosis, prevention and treatment of diseases and clinical conditions associated with CDKN2A. Cadherin, EGF LAG Seven-pass G-type Receptor 1 (flamingo homolog, Drosophila) (CELSR1, Accession NM_014246) is another VGAM1928 host target gene. CELSR1 BINDING SITE is HOST TARGET binding site found in the 3' untranslated region of mRNA encoded by CELSR1, corresponding to a HOST TARGET binding site such as BINDING SITE I, BINDING SITE II or BINDING SITE III. Table 2 illustrates the complementarity of the nucleotide sequences of CELSR1 BINDING SITE, designated SEQ ID:15518, to the nucleotide sequence of VGAM1928 RNA, herein designated VGAM RNA, also designated SEQ ID:4639.

Another function of VGAM1928 is therefore inhibition of Cadherin, EGF LAG Seven-pass G-type Receptor 1 (flamingo homolog, Drosophila) (CELSR1, Accession NM_014246), a gene which is involved in contact-mediated communication. Accordingly, utilities of VGAM1928 include diagnosis, prevention and treatment of diseases and clinical conditions associated with CELSR1. The function of CELSR1 and its association with various diseases and clinical conditions, has been established by previous studies, as described hereinabove with reference to VGAM459. Chimerin (chimaerin) 1 (CHN1, Accession NM_001822) is another VGAM1928 host target gene. CHN1 BINDING SITE is HOST TARGET binding site found in the 5' untranslated region of mRNA encoded by CHN1, corresponding to a HOST TARGET binding site such as BINDING SITE I, BINDING SITE II or BINDING SITE III. Table 2 illustrates the complementarity of the nucleotide sequences of CHN1 BINDING SITE, designated SEQ ID:7561, to the nucleotide sequence of VGAM1928 RNA, herein designated VGAM RNA, also designated SEQ ID:4639.

Another function of VGAM1928 is therefore inhibition of Chimerin (chimaerin) 1 (CHN1, Accession NM_001822), a gene which may play an important role in neuronal signal-transduction mechanisms. Accordingly, utilities of VGAM1928 include diagnosis, prevention and treatment of diseases and clinical conditions associated with CHN1. The function of CHN1 and its association with various diseases and clinical conditions, has been established by previous studies, as described hereinabove with reference to VGAM632. Cytoskeleton-associated Protein 1 (CKAP1, Accession XM_056494) is another VGAM1928 host target gene. CKAP1 BINDING SITE is HOST TARGET binding site found in the 5' untranslated region of mRNA encoded by CKAP1, corresponding to a HOST TARGET binding site such as BINDING SITE I, BINDING SITE II or BINDING SITE III. Table 2 illustrates the complementarity of the nucleotide sequences of CKAP1 BINDING SITE, designated SEQ ID:36400, to the nucleotide sequence of VGAM1928 RNA, herein designated VGAM RNA, also designated SEQ ID:4639.

Another function of VGAM1928 is therefore inhibition of Cytoskeleton-associated Protein 1 (CKAP1, Accession XM_056494). Accordingly, utilities of VGAM1928 include diagnosis, prevention and treatment of diseases and clinical conditions associated with CKAP1. Chloride Channel 5 (nephrolithiasis 2, X-linked, Dent disease) (CLCN5, Accession NM_000084) is another VGAM1928 host target gene. CLCN5 BINDING SITE is HOST TARGET binding site found in the 3' untranslated region of mRNA encoded by CLCN5, corresponding to a HOST TARGET binding site such as BINDING SITE I, BINDING SITE II or BINDING SITE III. Table 2 illustrates the complementarity of the nucleotide sequences of CLCN5 BINDING SITE, designated SEQ ID:5536, to the nucleotide sequence of VGAM1928 RNA, herein designated VGAM RNA, also designated SEQ ID:4639.

Another function of VGAM1928 is therefore inhibition of Chloride Channel 5 (nephrolithiasis 2, X-linked, Dent disease) (CLCN5, Accession NM_000084), a gene which may interenes in renal tubular function. Accordingly, utilities of VGAM1928 include diagnosis, prevention and treatment of diseases and clinical conditions associated with CLCN5. The function of CLCN5 and its association with various diseases and clinical conditions, has been established by previous studies, as described hereinabove with reference to VGAM48. Collagen, Type IV, Alpha 4 (COL4A4, Accession NM_000092) is another VGAM1928 host target gene. COL4A4 BINDING SITE is HOST TARGET binding site found in the 5' untranslated region of mRNA encoded by COL4A4, corresponding to a HOST TARGET binding site such as BINDING SITE I, BINDING SITE II or BINDING SITE III. Table 2 illustrates the complementarity of the nucleotide sequences of COL4A4 BINDING SITE, designated SEQ ID:5551, to the nucleotide sequence of VGAM1928 RNA, herein designated VGAM RNA, also designated SEQ ID:4639.

Another function of VGAM1928 is therefore inhibition of Collagen, Type IV, Alpha 4 (COL4A4, Accession NM_000092). Accordingly, utilities of VGAM1928 include diagnosis, prevention and treatment of diseases and clinical conditions associated with COL4A4. Collagen, Type IV, Alpha 5 (Alport syndrome) (COL4A5, Accession NM_000495) is another VGAM1928 host target gene. COL4A5 BINDING SITE1 through COL4A5 BINDING SITE3 are HOST TARGET binding sites found in untranslated regions of mRNA encoded by COL4A5, corresponding to HOST TARGET binding sites such as BINDING SITE I, BINDING SITE II or BINDING SITE III. Table 2 illustrates the complementarity of the nucleotide sequences of COL4A5 BINDING SITE1 through COL4A5 BINDING SITE3, designated SEQ ID:6109, SEQ ID:27215 and SEQ ID:27212 respectively, to the nucleotide sequence of VGAM1928 RNA, herein designated VGAM RNA, also designated SEQ ID:4639.

Another function of VGAM1928 is therefore inhibition of Collagen, Type IV, Alpha 5 (Alport syndrome) (COL4A5, Accession NM_000495). Accordingly, utilities of VGAM1928 include diagnosis, prevention and treatment of diseases and clinical conditions associated with COL4A5. Cytochrome P450, 51 (lanosterol 14-alpha-demethylase) (CYP51, Accession NM_000786) is another VGAM1928 host target gene. CYP51 BINDING SITE is HOST TARGET binding site found in the 5' untranslated region of mRNA encoded by CYP51, corresponding to a HOST TARGET binding site such as BINDING SITE I, BINDING SITE II or BINDING SITE III. Table 2 illustrates the complementarity of the nucleotide sequences of CYP51 BINDING SITE, designated SEQ ID:6437, to the nucleotide sequence of VGAM1928 RNA, herein designated VGAM RNA, also designated SEQ ID:4639.

Another function of VGAM1928 is therefore inhibition of Cytochrome P450, 51 (lanosterol 14-alpha-demethylase) (CYP51, Accession NM_000786). Accordingly, utilities of VGAM1928 include diagnosis, prevention and treatment of diseases and clinical conditions associated with CYP51. Dishevelled Associated Activator of Morphogenesis 2 (DAAM2, Accession XM_166434) is another VGAM1928 host target gene. DAAM2 BINDING SITE is HOST TARGET binding site found in the 3' untranslated region of mRNA encoded by DAAM2, corresponding to a HOST TARGET binding site such as BINDING SITE I, BINDING SITE II or BINDING SITE III. Table 2 illustrates the complementarity of the nucleotide sequences of DAAM2 BINDING SITE, designated SEQ ID:44332, to the nucleotide sequence of VGAM1928 RNA, herein designated VGAM RNA, also designated SEQ ID:4639.

Another function of VGAM1928 is therefore inhibition of Dishevelled Associated Activator of Morphogenesis 2 (DAAM2, Accession XM_166434), a gene which controls cell polarity and movement during development. Accordingly, utilities of VGAM1928 include diagnosis, prevention and treatment of diseases and clinical conditions associated with DAAM2. The function of DAAM2 and its association with various diseases and clinical conditions, has been established by previous studies, as described hereinabove with reference to VGAM247. Diacylglycerol Kinase, Gamma 90 kDa (DGKG, Accession NM_001346) is another VGAM1928 host target gene. DGKG BINDING SITE is HOST TARGET binding site found in the 3' untranslated region of mRNA encoded by DGKG, corresponding to a HOST TARGET binding site such as BINDING SITE I, BINDING SITE II or BINDING SITE III. Table 2 illustrates the complementarity of the nucleotide sequences of DGKG BINDING SITE, designated SEQ ID:7028, to the nucleotide sequence of VGAM1928 RNA, herein designated VGAM RNA, also designated SEQ ID:4639.

Another function of VGAM1928 is therefore inhibition of Diacylglycerol Kinase, Gamma 90 kDa (DGKG, Accession NM_001346), a gene which may convert diacylglycerol to phosphatidic acid. Accordingly, utilities of VGAM1928 include diagnosis, prevention and treatment of diseases and clinical conditions associated with DGKG. The function of DGKG and its association with various diseases and clinical conditions, has been established by previous studies, as described hereinabove with reference to VGAM451. Dishevelled, Dsh Homolog 3 (Drosophila) (DVL3, Accession NM_004423) is another VGAM1928 host target gene. DVL3 BINDING SITE is HOST TARGET binding site found in the 3' untranslated region of mRNA encoded by DVL3, corresponding to a HOST TARGET binding site such as BINDING SITE I, BINDING SITE II or BINDING SITE III. Table 2 illustrates the complementarity of the nucleotide sequences of DVL3 BINDING SITE, designated SEQ ID:10700, to the nucleotide sequence of VGAM1928 RNA, herein designated VGAM RNA, also designated SEQ ID:4639.

Another function of VGAM1928 is therefore inhibition of Dishevelled, Dsh Homolog 3 (Drosophila) (DVL3, Accession NM_004423), a gene which regulates cell proliferation. Accordingly, utilities of VGAM1928 include diagnosis, prevention and treatment of diseases and clinical conditions associated with DVL3. The function of DVL3 and its association with various diseases and clinical conditions, has been established by previous studies, as described hereinabove with reference to VGAM57. EGF-like-domain, Multiple 5 (EGFL5, Accession XM_098838) is another VGAM1928 host target gene. EGFL5 BINDING SITE is HOST TARGET binding site found in the 3' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41884, to the nucleotide sequence of VGAM1928 RNA, herein designated VGAM RNA, also designated SEQ ID:4639.

Another function of VGAM1928 is therefore inhibition of EGF-like-domain, Multiple 5 (EGFL5, Accession XM_098838). Accordingly, utilities of VGAM1928 include diagnosis, prevention and treatment of diseases and clinical conditions associated with EGFL5. Epithelial Membrane Protein 1 (EMP1, Accession NM_001423) is another VGAM1928 host target gene. EMP1 BINDING SITE is HOST TARGET binding site found in the 3' untranslated region of mRNA encoded by EMP1, corresponding to a HOST TARGET binding site such as BINDING SITE I, BINDING SITE II or BINDING SITE III. Table 2 illustrates the complementarity of the nucleotide sequences of EMP1 BINDING SITE, designated SEQ ID:7132, to the nucleotide sequence of VGAM1928 RNA, herein designated VGAM RNA, also designated SEQ ID:4639.

Another function of VGAM1928 is therefore inhibition of Epithelial Membrane Protein 1 (EMP1, Accession NM_001423), a gene which plays a role in squamous cell differentiation; member of the PMP22/EMP/MP20 family of membrane glycoproteins. Accordingly, utilities of VGAM1928 include diagnosis, prevention and treatment of diseases and clinical conditions associated with EMP1. The function of EMP1 and its association with various diseases and clinical conditions, has been established by previous studies, as described hereinabove with reference to VGAM107. Ectodermal-neural Cortex (with BTB-like domain) (ENC1, Accession NM_003633) is another VGAM1928 host target gene. ENC1 BINDING SITE is HOST TARGET binding site found in the 3' untranslated region of mRNA encoded by ENC1, corresponding to a HOST TARGET binding site such as BINDING SITE I, BINDING SITE II or BINDING SITE III. Table 2 illustrates the complementarity of the nucleotide sequences of ENC1 BINDING SITE, designated SEQ ID:9700, to the nucleotide sequence of VGAM1928 RNA, herein designated VGAM RNA, also designated SEQ ID:4639.

Another function of VGAM1928 is therefore inhibition of Ectodermal-neural Cortex (with BTB-like domain) (ENC1, Accession NM_003633), a gene which is an actin-binding protein involved in the regulation of neuronal process formation and in differentiation of neural crest cells. Accordingly, utilities of VGAM1928 include diagnosis, prevention and treatment of diseases and clinical conditions associated with ENC1. The function of ENC1 and its association with various diseases and clinical conditions, has been established by previous studies, as described hereinabove with reference to VGAM233. Epidermal Growth Factor Receptor Pathway Substrate 8 (EPS8, Accession NM_004447) is another VGAM1928 host target gene. EPS8 BINDING SITE is HOST TARGET binding site found in the 3' untranslated region of mRNA encoded by EPS8, corresponding to a HOST TARGET binding site such as BINDING SITE I, BINDING SITE II or BINDING SITE III. Table 2 illustrates the complementarity of the nucleotide sequences of EPS8 BINDING SITE, designated SEQ ID:10742, to the nucleotide sequence of VGAM1928 RNA, herein designated VGAM RNA, also designated SEQ ID:4639.

Another function of VGAM1928 is therefore inhibition of Epidermal Growth Factor Receptor Pathway Substrate 8 (EPS8, Accession NM_004447), a gene which has a role in normal and neoplastic cell proliferation; contains an SH3 motif. Accordingly, utilities of VGAM1928 include diagnosis, prevention and treatment of diseases and clinical conditions associated with EPS8. The function of EPS8 and its association with various diseases and clinical conditions, has been established by previous studies, as described hereinabove with reference to VGAM1533. Exostoses (multiple) 2 (EXT2, Accession NM_000401) is another VGAM1928 host target gene. EXT2 BINDING SITE is HOST TARGET binding site found in the 3' untranslated region of mRNA encoded by EXT2, corresponding to a HOST TARGET binding site such as BINDING SITE I, BINDING SITE II or BINDING SITE III. Table 2 illustrates the complementarity of the nucleotide sequences of EXT2 BINDING SITE, designated SEQ ID:5975, to the nucleotide sequence of VGAM1928 RNA, herein designated VGAM RNA, also designated SEQ ID:4639.

Another function of VGAM1928 is therefore inhibition of Exostoses (multiple) 2 (EXT2, Accession NM_000401). Accordingly, utilities of VGAM1928 include diagnosis, prevention and treatment of diseases and clinical conditions associated with EXT2. Exostoses (multiple)-like 1 (EXTL1, Accession NM_004455) is another VGAM1928 host target gene. EXTL1 BINDING SITE is HOST TARGET binding site found in the 5' untranslated region of mRNA encoded by EXTL1, corresponding to a HOST TARGET binding site such as BINDING SITE I, BINDING SITE II or BINDING SITE III. Table 2 illustrates the complementarity of the nucleotide sequences of EXTL1 BINDING SITE, designated SEQ ID:10758, to the nucleotide sequence of VGAM1928 RNA, herein designated VGAM RNA, also designated SEQ ID:4639.

Another function of VGAM1928 is therefore inhibition of Exostoses (multiple)-like 1 (EXTL1, Accession NM_004455), a gene which probably contribute to the synthesis of heparan sulfate and heparin. Accordingly, utilities of VGAM1928 include diagnosis, prevention and treatment of diseases and clinical conditions associated with EXTL1. The function of EXTL1 and its association with various diseases and clinical conditions, has been established by previous studies, as described hereinabove with reference to VGAM806. Fibulin 1 (FBLN1, Accession NM_006485) is another VGAM1928 host target gene. FBLN1 BINDING SITE is HOST TARGET binding site found in the 3' untranslated region of mRNA encoded by FBLN1, corresponding to a HOST TARGET binding site such as BINDING SITE I, BINDING SITE II or BINDING SITE III. Table 2 illustrates the complementarity of the nucleotide sequences of FBLN1 BINDING SITE, designated SEQ ID:13211, to the nucleotide sequence of VGAM1928 RNA, herein designated VGAM RNA, also designated SEQ ID:4639.

Another function of VGAM1928 is therefore inhibition of Fibulin 1 (FBLN1, Accession NM_006485), a gene which secreted glycoprotein; has EGF-like repeats, similar to anaphylatoxins C3a, C4a, and C5a. Accordingly, utilities of VGAM1928 include diagnosis, prevention and treatment of diseases and clinical conditions associated with FBLN1. The function of FBLN1 and its association with various diseases and clinical conditions, has been established by previous studies, as described hereinabove with reference to VGAM1770. Fukuyama Type Congenital Muscular Dystrophy (fukutin) (FCMD, Accession NM_006731) is another VGAM1928 host target gene. FCMD BINDING SITE is HOST TARGET binding site found in the 3' untranslated region of mRNA encoded by FCMD, corresponding to a HOST TARGET binding site such as BINDING SITE I, BINDING SITE II or BINDING SITE III. Table 2 illustrates the complementarity of the nucleotide sequences of FCMD BINDING SITE, designated SEQ ID:13575, to the nucleotide sequence of VGAM1928 RNA, herein designated VGAM RNA, also designated SEQ ID:4639.

Another function of VGAM1928 is therefore inhibition of Fukuyama Type Congenital Muscular Dystrophy (fukutin) (FCMD, Accession NM_006731). Accordingly, utilities of VGAM1928 include diagnosis, prevention and treatment of diseases and clinical conditions associated with FCMD. Filaggrin (FLG, Accession XM_048104) is another VGAM1928 host target gene. FLG BINDING SITE is HOST TARGET binding site found in the 3' untranslated region of mRNA encoded by FLG, corresponding to a HOST TARGET binding site such as BINDING SITE I, BINDING SITE II or BINDING SITE III. Table 2 illustrates the complementarity of the nucleotide sequences of FLG BINDING SITE, designated SEQ ID:35108, to the nucleotide sequence of VGAM1928 RNA, herein designated VGAM RNA, also designated SEQ ID:4639.

Another function of VGAM1928 is therefore inhibition of Filaggrin (FLG, Accession XM_048104), a gene which aggregates keratin intermediate filaments. Accordingly, utilities of VGAM1928 include diagnosis, prevention and treatment of diseases and clinical conditions associated with FLG. The function of FLG and its association with various diseases and clinical conditions, has been established by previous studies, as described hereinabove with reference to VGAM899. Filamin B, Beta (actin binding protein 278) (FLNB, Accession XM_030806) is another VGAM1928 host target gene. FLNB BINDING SITE is HOST TARGET binding site found in the 3' untranslated region of mRNA encoded by FLNB, corresponding to a HOST TARGET binding site such as BINDING SITE I, BINDING SITE II or BINDING SITE III. Table 2 illustrates the complementarity of the nucleotide sequences of FLNB BINDING SITE, designated SEQ ID:31146, to the nucleotide sequence of VGAM1928 RNA, herein designated VGAM RNA, also designated SEQ ID:4639.

Another function of VGAM1928 is therefore inhibition of Filamin B, Beta (actin binding protein 278) (FLNB, Accession XM_030806), a gene which Filamin B, beta; binds actin, interacts with cytoplasmic domain of Ibalpha. Accordingly, utilities of VGAM1928 include diagnosis, prevention and treatment of diseases and clinical conditions associated with FLNB. The function of FLNB and its association with various diseases and clinical conditions, has been established by previous studies, as described hereinabove with reference to VGAM416. Follistatin-like 1 (FSTL1, Accession NM_007085) is another VGAM1928 host target gene. FSTL1 BINDING SITE is HOST TARGET binding site found in the 3' untranslated region of mRNA encoded by FSTL1, corresponding to a HOST TARGET binding site such as BINDING SITE I, BINDING SITE II or BINDING SITE III. Table 2 illustrates the complementarity of the nucleotide sequences of FSTL1 BINDING SITE, designated SEQ ID:13949, to the nucleotide sequence of VGAM1928 RNA, herein designated VGAM RNA, also designated SEQ ID:4639.

Another function of VGAM1928 is therefore inhibition of Follistatin-like 1 (FSTL1, Accession NM_007085), a gene which may modulate the action of some growth factors on cell proliferation and differentiation. Accordingly, utilities of VGAM1928 include diagnosis, prevention and treatment of diseases and clinical conditions associated with FSTL1. The function of FSTL1 and its association with various diseases and clinical conditions, has been established by previous studies, as described hereinabove with reference to VGAM791. Galanin Receptor 1 (GALR1, Accession NM_001480) is another VGAM1928 host target gene. GALR1 BINDING SITE is HOST TARGET binding site found in the 3' untranslated region of mRNA encoded by GALR1, corresponding to a HOST TARGET binding site such as BINDING SITE I, BINDING SITE II or BINDING SITE III. Table 2 illustrates the complementarity of the nucleotide sequences of GALR1 BINDING SITE, designated SEQ ID:7217, to the nucleotide sequence of VGAM1928 RNA, herein designated VGAM RNA, also designated SEQ ID:4639.

Another function of VGAM1928 is therefore inhibition of Galanin Receptor 1 (GALR1, Accession NM_001480), a gene which plays a role in regulating ion transport. Accordingly, utilities of VGAM1928 include diagnosis, prevention and treatment of diseases and clinical conditions associated with GALR1. The function of GALR1 and its association with various diseases and clinical conditions, has been established by previous studies, as described hereinabove with reference to VGAM1245. Gap Junction Protein, Beta 3, 31kDa (connexin 31) (GJB3, Accession NM_024009) is another VGAM1928 host target gene. GJB3 BINDING SITE is HOST TARGET binding site found in the 3' untranslated region of mRNA encoded by GJB3, corresponding to a HOST TARGET binding site such as BINDING SITE I, BINDING SITE II or BINDING SITE III. Table 2 illustrates the complementarity of the nucleotide sequences of GJB3 BINDING SITE, designated SEQ ID:23443, to the nucleotide sequence of VGAM1928 RNA, herein designated VGAM RNA, also designated SEQ ID:4639.

Another function of VGAM1928 is therefore inhibition of Gap Junction Protein, Beta 3, 31 kDa (connexin 31) (GJB3, Accession NM_024009). Accordingly, utilities of VGAM1928 include diagnosis, prevention and treatment of diseases and clinical conditions associated with GJB3. Guanine Nucleotide Binding Protein (G protein), Alpha Inhibiting Activity Polypeptide 1 (GNAI1, Accession NM_002069) is another VGAM1928 host target gene. GNAI1 BINDING SITE is HOST TARGET binding site found in the 5' untranslated region of mRNA encoded by GNAI1, corresponding to a HOST TARGET binding site such as BINDING SITE I, BINDING SITE II or BINDING SITE III. Table 2 illustrates the complementarity of the nucleotide sequences of GNAI1 BINDING SITE, designated SEQ ID:7840, to the nucleotide sequence of VGAM1928 RNA, herein designated VGAM RNA, also designated SEQ ID:4639.

Another function of VGAM1928 is therefore inhibition of Guanine Nucleotide Binding Protein (G protein), Alpha Inhibiting Activity Polypeptide 1 (GNAI1, Accession NM_002069), a gene which is involved as modulators or transducers in various transmembrane signaling systems. Accordingly, utilities of VGAM1928 include diagnosis, prevention and treatment of diseases and clinical conditions associated with GNAI1. The function of GNAI1 and its association with various diseases and clinical conditions, has been established by previous studies, as described hereinabove with reference to VGAM57. Golgi Reassembly Stacking Protein 1, 65 kDa (GORASP1, Accession NM_031899) is another VGAM1928 host target gene. GORASP1 BINDING SITE is HOST TARGET binding site found in the 3' untranslated region of mRNA encoded by GORASP1, corresponding to a HOST TARGET binding site such as BINDING SITE I, BINDING SITE II or BINDING SITE III. Table 2 illustrates the complementarity of the nucleotide sequences of GORASP1 BINDING SITE, designated SEQ ID:25645, to the nucleotide sequence of VGAM1928 RNA, herein designated VGAM RNA, also designated SEQ ID:4639.

Another function of VGAM1928 is therefore inhibition of Golgi Reassembly Stacking Protein 1, 65 kDa (GORASP1, Accession NM_031899), a gene which has some funtion with the Golgi apparatus. Accordingly, utilities of VGAM1928 include diagnosis, prevention and treatment of diseases and clinical conditions associated with GORASP1. The function of GORASP1 and its association with various diseases and clinical conditions, has been established by previous studies, as described hereinabove with reference to VGAM630. Glucocorticoid Receptor DNA Binding Factor 1 (GRLF1, Accession XM_085943) is another VGAM1928 host target gene. GRLF1 BINDING SITE is HOST TARGET binding site found in the 3' untranslated region of mRNA encoded by GRLF1, corresponding to a HOST TARGET binding site such as BINDING SITE I, BINDING SITE II or BINDING SITE III. Table 2 illustrates the complementarity of the nucleotide sequences of GRLF1 BINDING SITE, designated SEQ ID:38412, to the nucleotide sequence of VGAM1928 RNA, herein designated VGAM RNA, also designated SEQ ID:4639.

Another function of VGAM1928 is therefore inhibition of Glucocorticoid Receptor DNA Binding Factor 1 (GRLF1, Accession XM_085943), a gene which inhibits transcription of the glucocorticoid receptor gene. Accordingly, utilities of VGAM1928 include diagnosis, prevention and treatment of diseases and clinical conditions associated with GRLF1. The function of GRLF1 and its association with various diseases and clinical conditions, has been established by previous studies, as described hereinabove with reference to VGAM55. H3 Histone, Family 3B (H3.3B) (H3F3B, Accession NM_005324) is another VGAM1928 host target gene. H3F3B BINDING SITE is HOST TARGET binding site found in the 3' untranslated region of mRNA encoded by H3F3B, corresponding to a HOST TARGET binding site such as BINDING SITE I, BINDING SITE II or BINDING SITE III. Table 2 illustrates the complementarity of the nucleotide sequences of H3F3B BINDING SITE, designated SEQ ID:11796, to the nucleotide sequence of VGAM1928 RNA, herein designated VGAM RNA, also designated SEQ ID:4639.

Another function of VGAM1928 is therefore inhibition of H3 Histone, Family 3B (H3.3B) (H3F3B, Accession NM_005324). Accordingly, utilities of VGAM1928 include diagnosis, prevention and treatment of diseases and clinical conditions associated with H3F3B. Huntingtin (Huntington disease) (HD, Accession NM_002111) is another VGAM1928 host target gene. HD BINDING SITE is HOST TARGET binding site found in the 3' untranslated region of mRNA encoded by HD, corresponding to a HOST TARGET binding site such as BINDING SITE I, BINDING SITE II or BINDING SITE III. Table 2 illustrates the complementarity of the nucleotide sequences of HD BINDING SITE, designated SEQ ID:7893, to the nucleotide sequence of VGAM1928 RNA, herein designated VGAM RNA, also designated SEQ ID:4639.

Another function of VGAM1928 is therefore inhibition of Huntingtin (Huntington disease) (HD, Accession NM_002111). Accordingly, utilities of VGAM1928 include diagnosis, prevention and treatment of diseases and clinical conditions associated with HD. Heparan Sulfate (glucosamine) 3-O-sulfotransferase 3A1 (HS3ST3A1, Accession NM_006042) is another VGAM1928 host target gene. HS3ST3A1 BINDING SITE is HOST TARGET binding site found in the 5' untranslated region of mRNA encoded by HS3ST3A1, corresponding to a HOST TARGET binding site such as BINDING SITE I, BINDING SITE II or BINDING SITE III. Table 2 illustrates the complementarity of the nucleotide sequences of HS3ST3A1 BINDING SITE, designated SEQ ID:12678, to the nucleotide sequence of VGAM1928 RNA, herein designated VGAM RNA, also designated SEQ ID:4639.

Another function of VGAM1928 is therefore inhibition of Heparan Sulfate (glucosamine) 3-O-sulfotransferase 3A1 (HS3ST3A1, Accession NM_006042), a gene which plays a role in the generation of heparan sulfate proteoglycan. Accordingly, utilities of VGAM1928 include diagnosis, prevention and treatment of diseases and clinical conditions associated with HS3ST3A1. The function of HS3ST3A1 and its association with various diseases and clinical conditions, has been established by previous studies, as described hereinabove with reference to VGAM1454. Intercellular Adhesion Molecule 1 (CD54), Human Rhinovirus Receptor (ICAM1, Accession XM_049518) is another VGAM1928 host target gene. ICAM1 BINDING SITE is HOST TARGET binding site found in the 3' untranslated region of mRNA encoded by ICAM1, corresponding to a HOST TARGET binding site such as BINDING SITE I, BINDING SITE II or BINDING SITE III. Table 2 illustrates the complementarity of the nucleotide sequences of ICAM1 BINDING SITE, designated SEQ ID:35441, to the nucleotide sequence of VGAM1928 RNA, herein designated VGAM RNA, also designated SEQ ID:4639.

Another function of VGAM1928 is therefore inhibition of Intercellular Adhesion Molecule 1 (CD54), Human Rhinovirus Receptor (ICAM1, Accession XM_049518), a gene which binds the integrin LFA-1 (ITGB2) and promotes adhesion; member of the immunoglobulin superfamily. Accordingly, utilities of VGAM1928 include diagnosis, prevention and treatment of diseases and clinical conditions associated with ICAM1. The function of ICAM1 and its association with various diseases and clinical conditions, has been established by previous studies, as described hereinabove with reference to VGAM1677. Inhibitor of DNA Binding 4, Dominant Negative Helix-loop-helix Protein (ID4, Accession NM_001546) is another VGAM1928 host target gene. ID4 BINDING SITE is HOST TARGET binding site found in the 5' untranslated region of mRNA encoded by ID4, corresponding to a HOST TARGET binding site such as BINDING SITE I, BINDING SITE II or BINDING SITE III. Table 2 illustrates the complementarity of the nucleotide sequences of ID4 BINDING SITE, designated SEQ ID:7273, to the nucleotide sequence of VGAM1928 RNA, herein designated VGAM RNA, also designated SEQ ID:4639.

Another function of VGAM1928 is therefore inhibition of Inhibitor of DNA Binding 4, Dominant Negative Helix-loop-helix Protein (ID4, Accession NM_001546), a gene which negatively regulates cell differentiation. Accordingly, utilities of VGAM1928 include diagnosis, prevention and treatment of diseases and clinical conditions associated with ID4. The function of ID4 and its association with various diseases and clinical conditions, has been established by previous studies, as described hereinabove with reference to VGAM931. Isocitrate Dehydrogenase 1 (NADP+), Soluble (IDH1, Accession XM_028869) is another VGAM1928 host target gene. IDH1 BINDING SITE is HOST TARGET binding site found in the 5' untranslated region of mRNA encoded by IDH1, corresponding to a HOST TARGET binding site such as BINDING SITE I, BINDING SITE II or BINDING SITE III. Table 2 illustrates the complementarity of the nucleotide sequences of IDH1 BINDING SITE, designated SEQ ID:30801, to the nucleotide sequence of VGAM1928 RNA, herein designated VGAM RNA, also designated SEQ ID:4639.

Another function of VGAM1928 is therefore inhibition of Isocitrate Dehydrogenase 1 (NADP+), Soluble (IDH1, Accession XM_028869), a gene which decarboxylates isocitrate into alpha-ketoglutarate. Accordingly, utilities of VGAM1928 include diagnosis, prevention and treatment of diseases and clinical conditions associated with IDH1. The function of IDH1 has been established by previous studies. Henderson (1965) described electrophoretic polymorphism of this enzyme in mice. NADP-dependent IDH occurs in 2 structurally distinct forms: mitochondrial (OMIM Ref. No. 147650) and soluble (also called supernatant or cytoplasmic). Chen et al. (1972) found rare variants of the soluble form and concluded that the structural gene is probably autosomal and that it is distinct from the locus governing the mitochondrial form. Shows (1971) presented cell hybridization data suggesting that soluble malate dehydrogenase and isocitrate dehydrogenase are syntenic. Using the cell-hybrid method which relies on interspecies variation rather than polymorphism, Boone et al. (1972) concluded that the IDH locus is on chromosome 20. The assignment of soluble IDH and soluble MDH (OMIM Ref. No. 154100) to chromosome 20 was withdrawn (Ruddle, 1973). Creagan et al. (1974) presented evidence that these 2 syntenic loci are on chromosome 2. From study of a balanced reciprocal translocation (X;2)(p22;q32) in man-mouse hybrids, Van Cong (1976) concluded that IDH1 is located in the region 2q32-qter. By dosage effect in cases of chromosome 2 aberrations, Narahara et al. (1985) concluded that the IDH1 locus is in 2q33.3, probably in the proximal portion. Glass et al. (1989) described a 16-year-old boy with deletion of the 2q32.2-q33.1 segment and normal levels of isocitrate dehydrogenase. Specific features included microphthalmia, corneal anomalies, beaked nose, ptosis, and cleft palate. In addition, the patient had a distinctive pattern of scalloped skin pigmentation, present from birth, which was approximately symmetrical on the trunk and proximal limbs and clearly demarcated from the normal skin. The distribution of pigmentation did not follow Blaschko lines. There was no evidence of chromosomal mosaicism.

Full details of the abovementioned studies are described in the following publications, the disclosure of which are hereby incorporated by reference:

Glass, I. A.; Swindlehurst, C. A.; Aitken, D. A.; McCrea, W.; Boyd, E.: Interstitial deletion of the long arm of chromosome 2 with normal levels of isocitrate dehydrogenase. J. Med. Genet. 26:127-130, 1989; and Narahara, K.; Kimura, S.; Kikkawa, K.; Takahashi, Y.; Wakita, Y.; Kasai, R.; Nagai, S.; Nishibayashi, Y.; Kimoto, H.: Probable assignment of soluble isocitrate dehydrogenase (IDH-1) to.

Further studies establishing the function and utilities of IDH1 are found in John Hopkins OMIM database record ID 147700, and in sited publications numbered 5248-5260 listed in the bibliography section hereinbelow, which are also hereby incorporated by reference. Interleukin 11 (IL11, Accession NM_000641) is another VGAM1928 host target gene. IL11 BINDING SITE is HOST TARGET binding site found in the 3' untranslated region of mRNA encoded by IL11, corresponding to a HOST TARGET binding site such as BINDING SITE I, BINDING SITE II or BINDING SITE III. Table 2 illustrates the complementarity of the nucleotide sequences of IL11 BINDING SITE, designated SEQ ID:6279, to the nucleotide sequence of VGAM1928 RNA, herein designated VGAM RNA, also designated SEQ ID:4639.

Another function of VGAM1928 is therefore inhibition of Interleukin 11 (IL11, Accession NM_000641), a gene which stimulates the proliferation of hematopoietic stem cells and megakaryocyte progenitor cells and induces megakaryocyte maturation. Accordingly, utilities of VGAM1928 include diagnosis, prevention and treatment of diseases and clinical conditions associated with IL11. The function of IL11 and its association with various diseases and clinical conditions, has been established by previous studies, as described hereinabove with reference to VGAM178. Interleukin 13 Receptor, Alpha 1 (IL13RA1, Accession NM_001560) is another VGAM1928 host target gene. IL13RA1 BINDING SITE is HOST TARGET binding site found in the 3' untranslated region of mRNA encoded by IL13RA1, corresponding to a HOST TARGET binding site such as BINDING SITE I, BINDING SITE II or BINDING SITE III. Table 2 illustrates the complementarity of the nucleotide sequences of IL13RA1 BINDING SITE, designated SEQ ID:7285, to the nucleotide sequence of VGAM1928 RNA, herein designated VGAM RNA, also designated SEQ ID:4639.

Another function of VGAM1928 is therefore inhibition of Interleukin 13 Receptor, Alpha 1 (IL13RA1, Accession NM_001560), a gene which binds il-13 with a low affinity. together with il-4r- alpha can form a functional receptor for il-13. Accordingly, utilities of VGAM1928 include diagnosis, prevention and treatment of diseases and clinical conditions associated with IL13RA1. The function of IL13RA1 and its association with various diseases and clinical conditions, has been established by previous studies, as described hereinabove with reference to VGAM144. Integrin, Beta 3 (platelet glycoprotein IIIa, antigen CD61) (ITGB3, Accession NM_000212) is another VGAM1928 host target gene. ITGB3 BINDING SITE is HOST TARGET binding site found in the 3' untranslated region of mRNA encoded by ITGB3, corresponding to a HOST TARGET binding site such as BINDING SITE I, BINDING SITE II or BINDING SITE III. Table 2 illustrates the complementarity of the nucleotide sequences of ITGB3 BINDING SITE, designated SEQ ID:5709, to the nucleotide sequence of VGAM1928 RNA, herein designated VGAM RNA, also designated SEQ ID:4639.

Another function of VGAM1928 is therefore inhibition of Integrin, Beta 3 (platelet glycoprotein IIIa, antigen CD61) (ITGB3, Accession NM_000212). Accordingly, utilities of VGAM1928 include diagnosis, prevention and treatment of diseases and clinical conditions associated with ITGB3. Intersectin 1 (SH3 domain protein) (ITSN1, Accession NM_003024) is another VGAM1928 host target gene. ITSN1 BINDING SITE is HOST TARGET binding site found in the 3' untranslated region of mRNA encoded by ITSN1, corresponding to a HOST TARGET binding site such as BINDING SITE I, BINDING SITE II or BINDING SITE III. Table 2 illustrates the complementarity of the nucleotide sequences of ITSN1 BINDING SITE, designated SEQ ID:8956, to the nucleotide sequence of VGAM1928 RNA, herein designated VGAM RNA, also designated SEQ ID:4639.

Another function of VGAM1928 is therefore inhibition of Intersectin 1 (SH3 domain protein) (ITSN1, Accession NM_003024), a gene which may be involved in endocytosis and synaptic vesicle recycling. Accordingly, utilities of VGAM1928 include diagnosis, prevention and treatment of diseases and clinical conditions associated with ITSN1. The function of ITSN1 and its association with various diseases and clinical conditions, has been established by previous studies, as described hereinabove with reference to VGAM1233. Jerky Homolog (mouse) (JRK, Accession XM_098818) is another VGAM1928 host target gene. JRK BINDING SITE1 and JRK BINDING SITE2 are HOST TARGET binding sites found in untranslated regions of mRNA encoded by JRK, corresponding to HOST TARGET binding sites such as BINDING SITE I, BINDING SITE II or BINDING SITE III. Table 2 illustrates the complementarity of the nucleotide sequences of JRK BINDING SITE1 and JRK BINDING SITE2, designated SEQ ID:41839 and SEQ ID:41840 respectively, to the nucleotide sequence of VGAM1928 RNA, herein designated VGAM RNA, also designated SEQ ID:4639.

Another function of VGAM1928 is therefore inhibition of Jerky Homolog (mouse) (JRK, Accession XM_098818), a gene which might function as a DNA-binding protein. Accordingly, utilities of VGAM1928 include diagnosis, prevention and treatment of diseases and clinical conditions associated with JRK. The function of JRK and its association with various diseases and clinical conditions, has been established by previous studies, as described hereinabove with reference to VGAM210. Potassium Voltage-gated Channel, Shaker-related Subfamily, Member 7 (KCNA7, Accession NM_031886) is another VGAM1928 host target gene. KCNA7 BINDING SITE1 through KCNA7 BINDING SITE4 are HOST TARGET binding sites found in untranslated regions of mRNA encoded by KCNA7, corresponding to HOST TARGET binding sites such as BINDING SITE I, BINDING SITE II or BINDING SITE III. Table 2 illustrates the complementarity of the nucleotide sequences of KCNA7 BINDING SITE1 through KCNA7 BINDING SITE4, designated SEQ ID:25627, SEQ ID:25629, SEQ ID:25630 and SEQ ID:25628 respectively, to the nucleotide sequence of VGAM1928 RNA, herein designated VGAM RNA, also designated SEQ ID:4639.

Another function of VGAM1928 is therefore inhibition of Potassium Voltage-gated Channel, Shaker-related Subfamily, Member 7 (KCNA7, Accession NM_031886), a gene which allows nerve cells to efficiently repolarize following an action potential. Accordingly, utilities of VGAM1928 include diagnosis, prevention and treatment of diseases and clinical conditions associated with KCNA7. The function of KCNA7 and its association with various diseases and clinical conditions, has been established by previous studies, as described hereinabove with reference to VGAM126. V-maf Musculoaponeurotic Fibrosarcoma Oncogene Homolog F (avian) (MAFF, Accession NM_012323) is another VGAM1928 host target gene. MAFF BINDING SITE is HOST TARGET binding site found in the 3' untranslated region of mRNA encoded by MAFF, corresponding to a HOST TARGET binding site such as BINDING SITE I, BINDING SITE II or BINDING SITE III. Table 2 illustrates the complementarity of the nucleotide sequences of MAFF BINDING SITE, designated SEQ ID:14700, to the nucleotide sequence of VGAM1928 RNA, herein designated VGAM RNA, also designated SEQ ID:4639.

Another function of VGAM1928 is therefore inhibition of V-maf Musculoaponeurotic Fibrosarcoma Oncogene Homolog F (avian) (MAFF, Accession NM_012323), a gene which Binds to the US-2 motif of the oxytocin receptor gene; has a leucine zipper structure. Accordingly, utilities of VGAM1928 include diagnosis, prevention and treatment of diseases and clinical conditions associated with MAFF. The function of MAFF has been established by previous studies. Inoue et al. (1994) demonstrated that the US-2 element in the promoter of the human oxytocin receptor gene (OXTR; 167055) binds specifically nuclear proteins from human myometrium at parturition. Using the US-2 element in a yeast 1-hybrid system to screen a human myometrium cDNA library, Kimura et al. (1999) isolated a full-length cDNA encoding the homolog of chicken MafF. Human MAFF encodes a deduced 164-amino acid protein with a predicted molecular mass of 17.8 kD. Like other small MAF proteins (e.g., MAFG, 602020), it contains an extended leucine zipper structure and lacks an N-terminal transactivating domain. Northern blot analysis showed a strong 2.6-kb signal in mRNA from term myometrium and from kidney, but not from nonpregnant myometrium. The MAFF protein is also preferentially expressed in term myometrium. The authors concluded that MAFF plays a role in OXTR gene upregulation at term.

Full details of the abovementioned studies are described in the following publications, the disclosure of which are hereby incorporated by reference:

Dunham, I.; Shimizu, N.; Roe, B. A.; Chissoe, S.; Hunt, A. R.; Collins, J. E.; Bruskiewich, R.; Beare, D. M.; Clamp, M.; Smink, L. J.; Ainscough, R.; Almeida, J. P.; and 205 others. The DNA sequence of human chromosome 22. Nature 402: 489-495, 1999; and Inoue, T.; Kimura, T.; Azuma, C.; Inazawa, J.; Takemura, M.; Kikuchi, T.; Kubota, Y.; Ogita, K.; Saji, F.: Structural organization of the human oxytocin receptor gene. J. Biol. Chem. 2.

Further studies establishing the function and utilities of MAFF are found in John Hopkins OMIM database record ID 604877, and in sited publications numbered 675 and 6759 listed in the bibliography section hereinbelow, which are also hereby incorporated by reference. Microtubule-associated Protein, RP/EB Family, Member 2 (MAPRE2, Accession NM_014268) is another VGAM1928 host target gene. MAPRE2 BINDING SITE is HOST TARGET binding site found in the 3' untranslated region of mRNA encoded by MAPRE2, corresponding to a HOST TARGET binding site such as BINDING SITE I, BINDING SITE II or BINDING SITE III. Table 2 illustrates the complementarity of the nucleotide sequences of MAPRE2 BINDING SITE, designated SEQ ID:15544, to the nucleotide sequence of VGAM1928 RNA, herein designated VGAM RNA, also designated SEQ ID:4639.

Another function of VGAM1928 is therefore inhibition of Microtubule-associated Protein, RP/EB Family, Member 2 (MAPRE2, Accession NM_014268), a gene which The functional inactivation of the APC gene product is a key event in colorectal tumorigenesis. Accordingly, utilities of VGAM1928 include diagnosis, prevention and treatment of diseases and clinical conditions associated with MAPRE2. The function of MAPRE2 and its association with various diseases and clinical conditions, has been established by previous studies, as described hereinabove with reference to VGAM178. Microtubule-associated Protein, RP/EB Family, Member 3 (MAPRE3, Accession NM_012326) is another VGAM1928 host target gene. MAPRE3 BINDING SITE is HOST TARGET binding site found in the 3' untranslated region of mRNA encoded by MAPRE3, corresponding to a HOST TARGET binding site such as BINDING SITE I, BINDING SITE II or BINDING SITE III. Table 2 illustrates the complementarity of the nucleotide sequences of MAPRE3 BINDING SITE, designated SEQ ID:14716, to the nucleotide sequence of VGAM1928 RNA, herein designated VGAM RNA, also designated SEQ ID:4639.

Another function of VGAM1928 is therefore inhibition of Microtubule-associated Protein, RP/EB Family, Member 3 (MAPRE3, Accession NM_012326), a gene which interact with cytoplasmic microtubules, and with the adenomatous polyposis coli. Accordingly, utilities of VGAM1928 include diagnosis, prevention and treatment of diseases and clinical conditions associated with MAPRE3. The function of MAPRE3 and its association with various diseases and clinical conditions, has been established by previous studies, as described hereinabove with reference to VGAM340. Methionine Adenosyltransferase I, Alpha (MAT1A, Accession XM_165540) is another VGAM1928 host target gene. MAT1A BINDING SITE is HOST TARGET binding site found in the 3" untranslated region of mRNA encoded by MAT1A, corresponding to a HOST TARGET binding site such as BINDING SITE I, BINDING SITE II or BINDING SITE III. Table 2 illustrates the complementarity of the nucleotide sequences of MAT1A BINDING SITE, designated SEQ ID:43665, to the nucleotide sequence of VGAM1928 RNA, herein designated VGAM RNA, also designated SEQ ID:4639.

Another function of VGAM1928 is therefore inhibition of Methionine Adenosyltransferase I, Alpha (MAT1A, Accession XM_165540). Accordingly, utilities of VGAM1928 include diagnosis, prevention and treatment of diseases and clinical conditions associated with MAT1A. Mannosyl (alpha-1,3-)-glycoprotein Beta-1,2-N-acetylglucosaminyltransferase (MGAT1, Accession NM_002406) is another VGAM1928 host target gene. MGAT1 BINDING SITE is HOST TARGET binding site found in the 3' untranslated region of mRNA encoded by MGAT1, corresponding to a HOST TARGET binding site such as BINDING SITE I, BINDING SITE II or BINDING SITE III. Table 2 illustrates the complementarity of the nucleotide sequences of MGAT1 BINDING SITE, designated SEQ ID:8228, to the nucleotide sequence of VGAM1928 RNA, herein designated VGAM RNA, also designated SEQ ID:4639.

Another function of VGAM1928 is therefore inhibition of Mannosyl (alpha-1,3-)-glycoprotein Beta-1,2-N-acetylglucosaminyltransferase (MGAT1, Accession NM_002406), a gene which exists as a single protein-encoding exon. Accordingly, utilities of VGAM1928 include diagnosis, prevention and treatment of diseases and clinical conditions associated with MGAT1. The function of MGAT1 and its association with various diseases and clinical conditions, has been established by previous studies, as described hereinabove with reference to VGAM165. Meningioma Expressed Antigen 5 (hyaluronidase) (MGEA5, Accession NM_012215) is another VGAM1928 host target gene. MGEA5 BINDING SITE is HOST TARGET binding site found in the 3' untranslated region of mRNA encoded by MGEA5, corresponding to a HOST TARGET binding site such as BINDING SITE I, BINDING SITE II or BINDING SITE III. Table 2 illustrates the complementarity of the nucleotide sequences of MGEA5 BINDING SITE, designated SEQ ID:14518, to the nucleotide sequence of VGAM1928 RNA, herein designated VGAM RNA, also designated SEQ ID:4639.

Another function of VGAM1928 is therefore inhibition of Meningioma Expressed Antigen 5 (hyaluronidase) (MGEA5, Accession NM_012215), a gene which has a hyaluronidase activity. Accordingly, utilities of VGAM1928 include diagnosis, prevention and treatment of diseases and clinical conditions associated with MGEA5. The function of MGEA5 and its association with various diseases and clinical conditions, has been established by previous studies, as described hereinabove with reference to VGAM801. Myotubularin Related Protein 8 (MTMR8, Accession NM_015458) is another VGAM1928 host target gene. MTMR8 BINDING SITE is HOST TARGET binding site found in the 3' untranslated region of mRNA encoded by MTMR8, corresponding to a HOST TARGET binding site such as BINDING SITE I, BINDING SITE II or BINDING SITE III. Table 2 illustrates the complementarity of the nucleotide sequences of MTMR8 BINDING SITE, designated SEQ ID:17745, to the nucleotide sequence of VGAM1928 RNA, herein designated VGAM RNA, also designated SEQ ID:4639.

Another function of VGAM1928 is therefore inhibition of Myotubularin Related Protein 8 (MTMR8, Accession NM_015458), a gene which could be a tyrosine-phosphatase. Accordingly, utilities of VGAM1928 include diagnosis, prevention and treatment of diseases and clinical conditions associated with MTMR8. The function of MTMR8 and its association with various diseases and clinical conditions, has been established by previous studies, as described hereinabove with reference to VGAM379. Nuclear Factor I/B (NFIB, Accession NM_005596) is another VGAM1928 host target gene. NFIB BINDING SITE is HOST TARGET binding site found in the 5' untranslated region of mRNA encoded by NFIB, corresponding to a HOST TARGET binding site such as BINDING SITE I, BINDING SITE II or BINDING SITE III. Table 2 illustrates the complementarity of the nucleotide sequences of NFIB BINDING SITE, designated SEQ ID:12122, to the nucleotide sequence of VGAM1928 RNA, herein designated VGAM RNA, also designated SEQ ID:4639.

Another function of VGAM1928 is therefore inhibition of Nuclear Factor I/B (NFIB, Accession NM_005596), a gene which recognizes and binds the palindromic sequence 5'-ttggcnnnnngccaa-3' present in viral and cellular promoters. Accordingly, utilities of VGAM1928 include diagnosis, prevention and treatment of diseases and clinical conditions associated with NFIB. The function of NFIB and its association with various diseases and clinical conditions, has been established by previous studies, as described hereinabove with reference to VGAM100.5'-nucleotidase, Cytosolic III (NT5C3, Accession NM_016489) is another VGAM1928 host target gene. NT5C3 BINDING SITE is HOST TARGET binding site found in the 3' untranslated region of mRNA encoded by NT5C3, corresponding to a HOST TARGET binding site such as BINDING SITE I, BINDING SITE II or BINDING SITE III. Table 2 illustrates the complementarity of the nucleotide sequences of NT5C3 BINDING SITE, designated SEQ ID:18582, to the nucleotide sequence of VGAM1928 RNA, herein designated VGAM RNA, also designated SEQ ID:4639.

Another function of VGAM1928 is therefore inhibition of 5'-nucleotidase, Cytosolic III (NT5C3, Accession NM_016489). Accordingly, utilities of VGAM1928 include diagnosis, prevention and treatment of diseases and clinical conditions associated with NT5C3. Oxidative-stress Responsive 1 (OSR1, Accession NM_005109) is another VGAM1928 host target gene. OSR1 BINDING SITE is HOST TARGET binding site found in the 5' untranslated region of mRNA encoded by OSR1, corresponding to a HOST TARGET binding site such as BINDING SITE I, BINDING SITE II or BINDING SITE III. Table 2 illustrates the complementarity of the nucleotide sequences of OSR1 BINDING SITE, designated SEQ ID:11588, to the nucleotide sequence of VGAM1928 RNA, herein designated VGAM RNA, also designated SEQ ID:4639.

Another function of VGAM1928 is therefore inhibition of Oxidative-stress Responsive 1 (OSR1, Accession NM_005109), a gene which mediats stress-activated signals. Accordingly, utilities of VGAM1928 include diagnosis, prevention and treatment of diseases and clinical conditions associated with OSR1. The function of OSR1 and its association with various diseases and clinical conditions, has been established by previous studies, as described hereinabove with reference to VGAM538. Paired Box Gene 5 (B-cell lineage specific activator protein) (PAX5, Accession NM_016734) is another VGAM1928 host target gene. PAX5 BINDING SITE is HOST TARGET binding site found in the 3' untranslated region of mRNA encoded by PAX5, corresponding to a HOST TARGET binding site such as BINDING SITE I, BINDING SITE II or BINDING SITE III. Table 2 illustrates the complementarity of the nucleotide sequences of PAX5 BINDING SITE, designated SEQ ID:18789, to the nucleotide sequence of VGAM1928 RNA, herein designated VGAM RNA, also designated SEQ ID:4639.

Another function of VGAM1928 is therefore inhibition of Paired Box Gene 5 (B-cell lineage specific activator protein) (PAX5, Accession NM_016734), a gene which plays a role in B-cell differentiation, neural development and spermatogenesis. Accordingly, utilities of VGAM1928 include diagnosis, prevention and treatment of diseases and clinical conditions associated with PAX5. The function of PAX5 and its association with various diseases and clinical conditions, has been established by previous studies, as described hereinabove with reference to VGAM1151. Protocadherin 11 X-linked (PCDH11X, Accession NM_032968) is another VGAM1928 host target gene. PCDH11X BINDING SITE1 and PCDH11X BINDING SITE2 are HOST TARGET binding sites found in untranslated regions of mRNA encoded by PCDH11X, corresponding to HOST TARGET binding sites such as BINDING SITE I, BINDING SITE II or BINDING SITE III. Table 2 illustrates the complementarity of the nucleotide sequences of PCDH11X BINDING SITE1 and PCDH11X BINDING SITE2, designated SEQ ID:26789 and SEQ ID:26804 respectively, to the nucleotide sequence of VGAM1928 RNA, herein designated VGAM RNA, also designated SEQ ID:4639.

Another function of VGAM1928 is therefore inhibition of Protocadherin 11 X-linked (PCDH11X, Accession NM_032968), a gene which is thought to play a fundamental role in cell-cell recognition essential for the segmental development and function of the central nervous system. Accordingly, utilities of VGAM1928 include diagnosis, prevention and treatment of diseases and clinical conditions associated with PCDH11X. The function of PCDH11X and its association with various diseases and clinical conditions, has been established by previous studies, as described hereinabove with reference to VGAM433. Phosphogluconate Dehydrogenase (PGD, Accession XM_086151) is another VGAM1928 host target gene. PGD BINDING SITE is HOST TARGET binding site found in the 3' untranslated region of mRNA encoded by PGD, corresponding to a HOST TARGET binding site such as BINDING SITE I, BINDING SITE II or BINDING SITE III. Table 2 illustrates the complementarity of the nucleotide sequences of PGD BINDING SITE, designated SEQ ID:38522, to the nucleotide sequence of VGAM1928 RNA, herein designated VGAM RNA, also designated SEQ ID:4639.

Another function of VGAM1928 is therefore inhibition of Phosphogluconate Dehydrogenase (PGD, Accession XM_086151), a gene which catalyzes a step in the pentose phosphate pathway, oxidates glucose-6-phosphate into 6-phosphoglucono-lactone. Accordingly, utilities of VGAM1928 include diagnosis, prevention and treatment of diseases and clinical conditions associated with PGD. The function of PGD and its association with various diseases and clinical conditions, has been established by previous studies, as described hereinabove with reference to VGAM1224. Phosphoinositide-3-kinase, Catalytic, Gamma Polypeptide (PIK3CG, Accession NM_002649) is another VGAM1928 host target gene. PIK3CG BINDING SITE is HOST TARGET binding site found in the 3' untranslated region of mRNA encoded by PIK3CG, corresponding to a HOST TARGET binding site such as BINDING SITE I, BINDING SITE II or BINDING SITE III. Table 2 illustrates the complementarity of the nucleotide sequences of PIK3CG BINDING SITE, designated SEQ ID:8512, to the nucleotide sequence of VGAM1928 RNA, herein designated VGAM RNA, also designated SEQ ID:4639.

Another function of VGAM1928 is therefore inhibition of Phosphoinositide-3-kinase, Catalytic, Gamma Polypeptide (PIK3CG, Accession NM_002649), a gene which regulating cell growth. Accordingly, utilities of VGAM1928 include diagnosis, prevention and treatment of diseases and clinical conditions associated with PIK3CG. The function of PIK3CG and its association with various diseases and clinical conditions, has been established by previous studies, as described hereinabove with reference to VGAM1389. Phosphoinositide-3-kinase, Regulatory Subunit, Polypeptide 3 (p55, gamma) (PIK3R3, Accession XM_027982) is another VGAM1928 host target gene. PIK3R3 BINDING SITE is HOST TARGET binding site found in the 3' untranslated region of mRNA encoded by PIK3R3, corresponding to a HOST TARGET binding site such as BINDING SITE I, BINDING SITE II or BINDING SITE III. Table 2 illustrates the complementarity of the nucleotide sequences of PIK3R3 BINDING SITE, designated SEQ ID:30601, to the nucleotide sequence of VGAM1928 RNA, herein designated VGAM RNA, also designated SEQ ID:4639.

Another function of VGAM1928 is therefore inhibition of Phosphoinositide-3-kinase, Regulatory Subunit, Polypeptide 3 (p55, gamma) (PIK3R3, Accession XM_027982). Accordingly, utilities of VGAM1928 include diagnosis, prevention and treatment of diseases and clinical conditions associated with PIK3R3. Pleiomorphic Adenoma Gene-like 1 (PLAGL1, Accession NM_002656) is another VGAM1928 host target gene. PLAGL1 BINDING SITE is HOST TARGET binding site found in the 3' untranslated region of mRNA encoded by PLAGL1, corresponding to a HOST TARGET binding site such as BINDING SITE I, BINDING SITE II or BINDING SITE III. Table 2 illustrates the complementarity of the nucleotide sequences of PLAGL1 BINDING SITE, designated SEQ ID:8528, to the nucleotide sequence of VGAM1928 RNA, herein designated VGAM RNA, also designated SEQ ID:4639.

Another function of VGAM1928 is therefore inhibition of Pleiomorphic Adenoma Gene-like 1 (PLAGL1, Accession NM_002656), a gene which regulates apoptosis and cell cycle arrest. Accordingly, utilities of VGAM1928 include diagnosis, prevention and treatment of diseases and clinical conditions associated with PLAGL1. The function of PLAGL1 and its association with various diseases and clinical conditions, has been established by previous studies, as described hereinabove with reference to VGAM89. Plexin A1 (PLXNA1, Accession XM_051261) is another VGAM1928 host target gene. PLXNA1 BINDING SITE is HOST TARGET binding site found in the 3' untranslated region of mRNA encoded by PLXNA1, corresponding to a HOST TARGET binding site such as BINDING SITE I, BINDING SITE II or BINDING SITE III. Table 2 illustrates the complementarity of the nucleotide sequences of PLXNA1 BINDING SITE, designated SEQ ID:35790, to the nucleotide sequence of VGAM1928 RNA, herein designated VGAM RNA, also designated SEQ ID:4639.

Another function of VGAM1928 is therefore inhibition of Plexin A1 (PLXNA1, Accession XM_051261). Accordingly, utilities of VGAM1928 include diagnosis, prevention and treatment of diseases and clinical conditions associated with PLXNA1. Peanut-like 1 (Drosophila) (PNUTL1, Accession NM_002688) is another VGAM1928 host target gene. PNUTL1 BINDING SITE is HOST TARGET binding site found in the 3' untranslated region of mRNA encoded by PNUTL1, corresponding to a HOST TARGET binding site such as BINDING SITE I, BINDING SITE II or BINDING SITE III. Table 2 illustrates the complementarity of the nucleotide sequences of PNUTL1 BINDING SITE, designated SEQ ID:8547, to the nucleotide sequence of VGAM1928 RNA, herein designated VGAM RNA, also designated SEQ ID:4639.

Another function of VGAM1928 is therefore inhibition of Peanut-like 1 (Drosophila) (PNUTL1, Accession NM_002688). Accordingly, utilities of VGAM1928 include diagnosis, prevention and treatment of diseases and clinical conditions associated with PNUTL1. Peptidylprolyl Isomerase (cyclophilin)-like 1 (PPIL1, Accession NM_016059) is another VGAM1928 host target gene. PPIL1 BINDING SITE is HOST TARGET binding site found in the 3' untranslated region of mRNA encoded by PPIL1, corresponding to a HOST TARGET binding site such as BINDING SITE I, BINDING SITE II or BINDING SITE III. Table 2 illustrates the complementarity of the nucleotide sequences of PPIL1 BINDING SITE, designated SEQ ID:18133, to the nucleotide sequence of VGAM1928 RNA, herein designated VGAM RNA, also designated SEQ ID:4639.

Another function of VGAM1928 is therefore inhibition of Peptidylprolyl Isomerase (cyclophilin)-like 1 (PPIL1, Accession NM_016059), a gene which catalyzes the cis-trans isomerization of proline imidic peptide bonds in oligopeptides. Accordingly, utilities of VGAM1928 include diagnosis, prevention and treatment of diseases and clinical conditions associated with PPIL1. The function of PPIL1 and its association with various diseases and clinical conditions, has been established by previous studies, as described hereinabove with reference to VGAM1135. Protein Phosphatase 2, Regulatory Subunit B (B56), Epsilon Isoform (PPP2R5E, Accession NM_006246) is another VGAM1928 host target gene. PPP2R5E BINDING SITE is HOST TARGET binding site found in the 5' untranslated region of mRNA encoded by PPP2R5E, corresponding to a HOST TARGET binding site such as BINDING SITE I, BINDING SITE II or BINDING SITE III. Table 2 illustrates the complementarity of the nucleotide sequences of PPP2R5E BINDING SITE, designated SEQ ID:12922, to the nucleotide sequence of VGAM1928 RNA, herein designated VGAM RNA, also designated SEQ ID:4639.

Another function of VGAM1928 is therefore inhibition of Protein Phosphatase 2, Regulatory Subunit B (B56), Epsilon Isoform (PPP2R5E, Accession NM_006246), a gene which is a regulatory subunit of protein phosphatase 2A. Accordingly, utilities of VGAM1928 include diagnosis, prevention and treatment of diseases and clinical conditions associated with PPP2R5E. The function of PPP2R5E and its association with various diseases and clinical conditions, has been established by previous studies, as described hereinabove with reference to VGAM302. PR Domain Containing 4 (PRDM4, Accession NM_012406) is another VGAM1928 host target gene. PRDM4 BINDING SITE is HOST TARGET binding site found in the 3' untranslated region of mRNA encoded by PRDM4, corresponding to a HOST TARGET binding site such as BINDING SITE I, BINDING SITE II or BINDING SITE III. Table 2 illustrates the complementarity of the nucleotide sequences of PRDM4 BINDING SITE, designated SEQ ID:14784, to the nucleotide sequence of VGAM1928 RNA, herein designated VGAM RNA, also designated SEQ ID:4639.

Another function of VGAM1928 is therefore inhibition of PR Domain Containing 4 (PRDM4, Accession NM_012406). Accordingly, utilities of VGAM1928 include diagnosis, prevention and treatment of diseases and clinical conditions associated with PRDM4. PSA (Accession NM_021154) is another VGAM1928 host target gene. PSA BINDING SITE1 and PSA BINDING SITE2 are HOST TARGET binding sites found in untranslated regions of mRNA encoded by PSA, corresponding to HOST TARGET binding sites such as BINDING SITE I, BINDING SITE II or BINDING SITE III. Table 2 illustrates the complementarity of the nucleotide sequences of PSA BINDING SITE1 and PSA BINDING SITE2, designated SEQ ID:22132 and SEQ ID:27741 respectively, to the nucleotide sequence of VGAM1928 RNA, herein designated VGAM RNA, also designated SEQ ID:4639.

Another function of VGAM1928 is therefore inhibition of PSA (Accession NM_021154), a gene which is puromycin-sensitive aminopeptidase and has metallopeptidase activity. Accordingly, utilities of VGAM1928 include diagnosis, prevention and treatment of diseases and clinical conditions associated with PSA. The function of PSA and its association with various diseases and clinical conditions, has been established by previous studies, as described hereinabove with reference to VGAM65. Phosphatase and Tensin Homolog (mutated in multiple advanced cancers 1) (PTEN, Accession NM_000314) is another VGAM1928 host target gene. PTEN BINDING SITE is HOST TARGET binding site found in the 5' untranslated region of mRNA encoded by PTEN, corresponding to a HOST TARGET binding site such as BINDING SITE I, BINDING SITE II or BINDING SITE III. Table 2 illustrates the complementarity of the nucleotide sequences of PTEN BINDING SITE, designated SEQ ID:5850, to the nucleotide sequence of VGAM1928 RNA, herein designated VGAM RNA, also designated SEQ ID:4639.

Another function of VGAM1928 is therefore inhibition of Phosphatase and Tensin Homolog (mutated in multiple advanced cancers 1) (PTEN, Accession NM_000314). Accordingly, utilities of VGAM1928 include diagnosis, prevention and treatment of diseases and clinical conditions associated with PTEN. Prostaglandin-endoperoxide Synthase 1 (prostaglandin G/H synthase and cyclooxygenase) (PTGS1, Accession NM_000962) is another VGAM1928 host target gene. PTGS1 BINDING SITE1 and PTGS1 BINDING SITE2 are HOST TARGET binding sites found in untranslated regions of mRNA encoded by PTGS1, corresponding to HOST TARGET binding sites such as BINDING SITE I, BINDING SITE II or BINDING SITE III. Table 2 illustrates the complementarity of the nucleotide sequences of PTGS1 BINDING SITE1 and PTGS1 BINDING SITE2, designated SEQ ID:6675 and SEQ ID:27896 respectively, to the nucleotide sequence of VGAM1928 RNA, herein designated VGAM RNA, also designated SEQ ID:4639.

Another function of VGAM1928 is therefore inhibition of Prostaglandin-endoperoxide Synthase 1 (prostaglandin G/H synthase and cyclooxygenase) (PTGS1, Accession NM_000962), a gene which may play an important role in regulating or promoting cell proliferation in some normal and neoplastically transformed cells. Accordingly, utilities of VGAM1928 include diagnosis, prevention and treatment of diseases and clinical conditions associated with PTGS1. The function of PTGS1 and its association with various diseases and clinical conditions, has been established by previous studies, as described hereinabove with reference to VGAM1224. RAD17 Homolog (S. pombe) (RAD17, Accession NM_002873) is another VGAM1928 host target gene. RAD17 BINDING SITE1 through RAD17 BINDING SITE6 are HOST TARGET binding sites found in untranslated regions of mRNA encoded by RAD17, corresponding to HOST TARGET binding sites such as BINDING SITE I, BINDING SITE II or BINDING SITE III. Table 2 illustrates the complementarity of the nucleotide sequences of RAD17 BINDING SITE1 through RAD17 BINDING SITE6, designated SEQ ID:8782, SEQ ID:28487, SEQ ID:28483, SEQ ID:28485, SEQ ID:28479 and SEQ ID:28489 respectively, to the nucleotide sequence of VGAM1928 RNA, herein designated VGAM RNA, also designated SEQ ID:4639.

Another function of VGAM1928 is therefore inhibition of RAD17 Homolog (S. pombe) (RAD17, Accession NM_002873), a gene which may have a role in DNA damage-dependent and DNA replication-dependent cell cycle checkpoints. Accordingly, utilities of VGAM1928 include diagnosis, prevention and treatment of diseases and clinical conditions associated with RAD17. The function of RAD17 and its association with various diseases and clinical conditions, has been established by previous studies, as described hereinabove with reference to VGAM209. Regulatory Factor X-associated Protein (RFXAP, Accession NM_000538) is another VGAM1928 host target gene. RFXAP BINDING SITE is HOST TARGET binding site found in the 5' untranslated region of mRNA encoded by RFXAP, corresponding to a HOST TARGET binding site such as BINDING SITE I, BINDING SITE II or BINDING SITE III. Table 2 illustrates the complementarity of the nucleotide sequences of RFXAP BINDING SITE, designated SEQ ID:6135, to the nucleotide sequence of VGAM1928 RNA, herein designated VGAM RNA, also designated SEQ ID:4639.

Another function of VGAM1928 is therefore inhibition of Regulatory Factor X-associated Protein (RFXAP, Accession NM_000538), a gene which binds to the x-box of mhc ii promoters and is a transcriptional regulator. Accordingly, utilities of VGAM1928 include diagnosis, prevention and treatment of diseases and clinical conditions associated with RFXAP. The function of RFXAP and its association with various diseases and clinical conditions, has been established by previous studies, as described hereinabove with reference to VGAM797. Regulator of G-protein Signalling 2, 24 kDa (RGS2, Accession NM_002923) is another VGAM1928 host target gene. RGS2 BINDING SITE is HOST TARGET binding site found in the 3' untranslated region of mRNA encoded by RGS2, corresponding to a HOST TARGET binding site such as BINDING SITE I, BINDING SITE II or BINDING SITE III. Table 2 illustrates the complementarity of the nucleotide sequences of RGS2 BINDING SITE, designated SEQ ID:8827, to the nucleotide sequence of VGAM1928 RNA, herein designated VGAM RNA, also designated SEQ ID:4639.

Another function of VGAM1928 is therefore inhibition of Regulator of G-protein Signalling 2, 24 kDa (RGS2, Accession NM_002923), a gene which inhibits signal transduction by increasing the gtpase activity of g protein thereby driving them into their inactive gdp-bound form. Accordingly, utilities of VGAM1928 include diagnosis, prevention and treatment of diseases and clinical conditions associated with RGS2. The function of RGS2 has been established by previous studies. Genetic heterogeneity of Rieger syndrome has been suggested by the description of affected individuals with a variety of chromosomal abnormalities and by the report of failure to find linkage to 4q25 in 1 pedigree (Legius et al., 1994)Deletion of 13q14 was described in 2 cases (Akazawa et al., 1981; Stathacopoulos et al., 1987). Phillips et al. (1996) performed linkage analysis of a large 4 generation family and demonstrated that Rieger syndrome was not linked to 4q25 but to markers on 13q14. Phillips et al. (1996) pointed to forkhead (OMIM Ref. No. 136533) as an excellent candidate for the site of the mutation in this form of Rieger syndrome. They stated that if such mutations are found, this would be an example of a gene which can function both as an oncogene (producing rhabdomyosarcoma) and as a 'teratogene' (producing RIEG2).

Full details of the abovementioned studies are described in the following publications, the disclosure of which are hereby incorporated by reference:

Legius, E.; de Die-Smulders, C. E. M.; Verbraak, F.; Habex, H.; Decorte, R.; Marynen, P.; Fryns, J. P.; Cassiman, J. J.: Genetic heterogeneity in Rieger eye malformation. J. Med. Genet. 31:340-341, 1994; and Phillips, J. C.; Del Bono, E. A.; Haines, J. L.; Pralea, A. M.; Cohen, J. S.; Greff, L. J.; Wiggs, J. L.: A second locus for Rieger syndrome maps to chromosome 13q14. Am. J. Hum. Genet. 59.

Further studies establishing the function and utilities of RGS2 are found in John Hopkins OMIM database record ID 601499, and in sited publications numbered 9486-326 and 9487 listed in the bibliography section hereinbelow, which are also hereby incorporated by reference. Ring Finger Protein 14 (RNF14, Accession NM_004290) is another VGAM1928 host target gene. RNF14 BINDING SITE is HOST TARGET binding site found in the 5' untranslated region of mRNA encoded by RNF14, corresponding to a HOST TARGET binding site such as BINDING SITE I, BINDING SITE II or BINDING SITE III. Table 2 illustrates the complementarity of the nucleotide sequences of RNF14 BINDING SITE, designated SEQ ID:10503, to the nucleotide sequence of VGAM1928 RNA, herein designated VGAM RNA, also designated SEQ ID:4639.

Another function of VGAM1928 is therefore inhibition of Ring Finger Protein 14 (RNF14, Accession NM_004290), a gene which associates with the androgen receptor (AR); functions as a transcriptional coactivator. Accordingly, utilities of VGAM1928 include diagnosis, prevention and treatment of diseases and clinical conditions associated with RNF14. The function of RNF14 and its association with various diseases and clinical conditions, has been established by previous studies, as described hereinabove with reference to VGAM827. RNA (guanine-7-) Methyltransferase (RNMT, Accession NM_003799) is another VGAM1928 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9879, to the nucleotide sequence of VGAM1928 RNA, herein designated VGAM RNA, also designated SEQ ID:4639.

Another function of VGAM1928 is therefore inhibition of RNA (guanine-7-) Methyltransferase (RNMT, Accession NM_003799), a gene which catalyzes the methylation of GpppN- at the guanine N7 position. Accordingly, utilities of VGAM1928 include diagnosis, prevention and treatment of diseases and clinical conditions associated with RNMT. The function of RNMT and its association with various diseases and clinical conditions, has been established by previous studies, as described hereinabove with reference to VGAM178. Arginyl Aminopeptidase (aminopeptidase B)-like 1 (RNPEPL1, Accession NM_018226) is another VGAM1928 host target gene. RNPEPL1 BINDING SITE is HOST TARGET binding site found in the 3' untranslated region of mRNA encoded by RNPEPL1, corresponding to a HOST TARGET binding site such as BINDING SITE I, BINDING SITE II or BINDING SITE III. Table 2 illustrates the complementarity of the nucleotide sequences of RNPEPL1 BINDING SITE, designated SEQ ID:20163, to the nucleotide sequence of VGAM1928 RNA, herein designated VGAM RNA, also designated SEQ ID:4639.

Another function of VGAM1928 is therefore inhibition of Arginyl Aminopeptidase (aminopeptidase B)-like 1 (RNPEPL1, Accession NM_018226). Accordingly, utilities of VGAM1928 include diagnosis, prevention and treatment of diseases and clinical conditions associated with RNPEPL1. Retinitis Pigmentosa 2 (X-linked recessive) (RP2, Accession NM_006915) is another VGAM1928 host target gene. RP2 BINDING SITE is HOST TARGET binding site found in the 5' untranslated region of mRNA encoded by RP2, corresponding to a HOST TARGET binding site such as BINDING SITE I, BINDING SITE II or BINDING SITE III. Table 2 illustrates the complementarity of the nucleotide sequences of RP2 BINDING SITE, designated SEQ ID:13794, to the nucleotide sequence of VGAM1928 RNA, herein designated VGAM RNA, also designated SEQ ID:4639.

Another function of VGAM1928 is therefore inhibition of Retinitis Pigmentosa 2 (X-linked recessive) (RP2, Accession NM_006915). Accordingly, utilities of VGAM1928 include diagnosis, prevention and treatment of diseases and clinical conditions associated with RP2. Runt-related Transcription Factor 1 (acute myeloid leukemia 1; aml1 oncogene) (RUNX1, Accession NM_001754) is another VGAM1928 host target gene. RUNX1 BINDING SITE is HOST TARGET binding site found in the 3' untranslated region of mRNA encoded by RUNX1, corresponding to a HOST TARGET binding site such as BINDING SITE I, BINDING SITE II or BINDING SITE III. Table 2 illustrates the complementarity of the nucleotide sequences of RUNX1 BINDING SITE, designated SEQ ID:7501, to the nucleotide sequence of VGAM1928 RNA, herein designated VGAM RNA, also designated SEQ ID:4639.

Another function of VGAM1928 is therefore inhibition of Runt-related Transcription Factor 1 (acute myeloid leukemia 1; aml1 oncogene) (RUNX1, Accession NM_001754). Accordingly, utilities of VGAM1928 include diagnosis, prevention and treatment of diseases and clinical conditions associated with RUNX1. Secreted Frizzled-related Protein 1 (SFRP1, Accession NM_003012) is another VGAM1928 host target gene. SFRP1 BINDING SITE is HOST TARGET binding site found in the 3' untranslated region of mRNA encoded by SFRP1, corresponding to a HOST TARGET binding site such as BINDING SITE I, BINDING SITE II or BINDING SITE III. Table 2 illustrates the complementarity of the nucleotide sequences of SFRP1 BINDING SITE, designated SEQ ID:8926, to the nucleotide sequence of VGAM1928 RNA, herein designated VGAM RNA, also designated SEQ ID:4639.

Another function of VGAM1928 is therefore inhibition of Secreted Frizzled-related Protein 1 (SFRP1, Accession NM_003012), a gene which is a receptor for wnt proteins that may have an anti-apoptotic function. Accordingly, utilities of VGAM1928 include diagnosis, prevention and treatment of diseases and clinical conditions associated with SFRP1. The function of SFRP1 and its association with various diseases and clinical conditions, has been established by previous studies, as described hereinabove with reference to VGAM250. Splicing Factor, Arginine/serine-rich 7, 35 kDa (SFRS7, Accession XM_002575) is another VGAM1928 host target gene. SFRS7 BINDING SITE is HOST TARGET binding site found in the 3' untranslated region of mRNA encoded by SFRS7, corresponding to a HOST TARGET binding site such as BINDING SITE I, BINDING SITE II or BINDING SITE III. Table 2 illustrates the complementarity of the nucleotide sequences of SFRS7 BINDING SITE, designated SEQ ID:29897, to the nucleotide sequence of VGAM1928 RNA, herein designated VGAM RNA, also designated SEQ ID:4639.

Another function of VGAM1928 is therefore inhibition of Splicing Factor, Arginine/serine-rich 7, 35 kDa (SFRS7, Accession XM_002575), a gene which is required for pre-mnra splicing. Accordingly, utilities of VGAM1928 include diagnosis, prevention and treatment of diseases and clinical conditions associated with SFRS7. The function of SFRS7 and its association with various diseases and clinical conditions, has been established by previous studies, as described hereinabove with reference to VGAM191. Surfactant, Pulmonary-associated Protein A2 (SFTPA2, Accession NM_006926) is another VGAM1928 host target gene. SFTPA2 BINDING SITE is HOST TARGET binding site found in the 3' untranslated region of mRNA encoded by SFTPA2, corresponding to a HOST TARGET binding site such as BINDING SITE I, BINDING SITE II or BINDING SITE III. Table 2 illustrates the complementarity of the nucleotide sequences of SFTPA2 BINDING SITE, designated SEQ ID:13810, to the nucleotide sequence of VGAM1928 RNA, herein designated VGAM RNA, also designated SEQ ID:4639.

Another function of VGAM1928 is therefore inhibition of Surfactant, Pulmonary-associated Protein A2 (SFTPA2, Accession NM_006926), a gene which plays a role in innate host defense in the lung. Accordingly, utilities of VGAM1928 include diagnosis, prevention and treatment of diseases and clinical conditions associated with SFTPA2. The function of SFTPA2 and its association with various diseases and clinical conditions, has been established by previous studies, as described hereinabove with reference to VGAM148. Solute Carrier Family 11 (proton-coupled divalent metal ion transporters), Member 3 (SLC11A3, Accession NM_014585) is another VGAM1928 host target gene. SLC11A3 BINDING SITE is HOST TARGET binding site found in the 5' untranslated region of mRNA encoded by SLC11A3, corresponding to a HOST TARGET binding site such as BINDING SITE I, BINDING SITE II or BINDING SITE III. Table 2 illustrates the complementarity of the nucleotide sequences of SLC11A3 BINDING SITE, designated SEQ ID:15942, to the nucleotide sequence of VGAM1928 RNA, herein designated VGAM RNA, also designated SEQ ID:4639.

Another function of VGAM1928 is therefore inhibition of Solute Carrier Family 11 (proton-coupled divalent metal ion transporters), Member 3 (SLC11A3, Accession NM_014585). Accordingly, utilities of VGAM1928 include diagnosis, prevention and treatment of diseases and clinical conditions associated with SLC11A3. Solute Carrier Family 12 (potassium/chloride transporters), Member 7 (SLC12A7, Accession NM_006598) is another VGAM1928 host target gene. SLC12A7 BINDING SITE is HOST TARGET binding site found in the 3' untranslated region of mRNA encoded by SLC12A7, corresponding to a HOST TARGET binding site such as BINDING SITE I, BINDING SITE II or BINDING SITE III. Table 2 illustrates the complementarity of the nucleotide sequences of SLC12A7 BINDING SITE, designated SEQ ID:13377, to the nucleotide sequence of VGAM1928 RNA, herein designated VGAM RNA, also designated SEQ ID:4639.

Another function of VGAM1928 is therefore inhibition of Solute Carrier Family 12 (potassium/chloride transporters), Member 7 (SLC12A7, Accession NM_006598), a gene which is a potassium/chloride-cotransporter. Accordingly, utilities of VGAM1928 include diagnosis, prevention and treatment of diseases and clinical conditions associated with SLC12A7. The function of SLC12A7 and its association with various diseases and clinical conditions, has been established by previous studies, as described hereinabove with reference to VGAM200. Solute Carrier Family 19 (folate transporter), Member 1 (SLC19A1, Accession NM_003056) is another VGAM1928 host target gene. SLC19A1 BINDING SITE is HOST TARGET binding site found in the 3' untranslated region of mRNA encoded by SLC19A1, corresponding to a HOST TARGET binding site such as BINDING SITE I, BINDING SITE II or BINDING SITE III. Table 2 illustrates the complementarity of the nucleotide sequences of SLC19A1 BINDING SITE, designated SEQ ID:9023, to the nucleotide sequence of VGAM1928 RNA, herein designated VGAM RNA, also designated SEQ ID:4639.

Another function of VGAM1928 is therefore inhibition of Solute Carrier Family 19 (folate transporter), Member 1 (SLC19A1, Accession NM_003056). Accordingly, utilities of VGAM1928 include diagnosis, prevention and treatment of diseases and clinical conditions associated with SLC19A1. Solute Carrier Family 6 (neurotransmitter transporter, taurine), Member 6 (SLC6A6, Accession NM_003043) is another VGAM1928 host target gene. SLC6A6 BINDING SITE1 and SLC6A6 BINDING SITE2 are HOST TARGET binding sites found in untranslated regions of mRNA encoded by SLC6A6, corresponding to HOST TARGET binding sites such as BINDING SITE I, BINDING SITE II or BINDING SITE III. Table 2 illustrates the complementarity of the nucleotide sequences of SLC6A6 BINDING SITE1 and SLC6A6 BINDING SITE2, designated SEQ ID:9006 and SEQ ID:9007 respectively, to the nucleotide sequence of VGAM1928 RNA, herein designated VGAM RNA, also designated SEQ ID:4639.

Another function of VGAM1928 is therefore inhibition of Solute Carrier Family 6 (neurotransmitter transporter, taurine), Member 6 (SLC6A6, Accession NM_003043), a gene which transports taurine and other beta-amino acids like beta-alanine. Accordingly, utilities of VGAM1928 include diagnosis, prevention and treatment of diseases and clinical conditions associated with SLC6A6. The function of SLC6A6 and its association with various diseases and clinical conditions, has been established by previous studies, as described hereinabove with reference to VGAM36. SRP46 (Accession NM_032102) is another VGAM1928 host target gene. SRP46 BINDING SITE is HOST TARGET binding site found in the 3' untranslated region of mRNA encoded by SRP46, corresponding to a HOST TARGET binding site such as BINDING SITE I, BINDING SITE II or BINDING SITE III. Table 2 illustrates the complementarity of the nucleotide sequences of SRP46 BINDING SITE, designated SEQ ID:25792, to the nucleotide sequence of VGAM1928 RNA, herein designated VGAM RNA, also designated SEQ ID:4639.

Another function of VGAM1928 is therefore inhibition of SRP46 (Accession NM_032102). Accordingly, utilities of VGAM1928 include diagnosis, prevention and treatment of diseases and clinical conditions associated with SRP46. Suppression of Tumorigenicity 7 (ST7, Accession NM_021908) is another VGAM1928 host target gene. ST7 BINDING SITE is HOST TARGET binding site found in the 3' untranslated region of mRNA encoded by ST7, corresponding to a HOST TARGET binding site such as BINDING SITE I, BINDING SITE II or BINDING SITE III. Table 2 illustrates the complementarity of the nucleotide sequences of ST7 BINDING SITE, designated SEQ ID:22427, to the nucleotide sequence of VGAM1928 RNA, herein designated VGAM RNA, also designated SEQ ID:4639.

Another function of VGAM1928 is therefore inhibition of Suppression of Tumorigenicity 7 (ST7, Accession NM_021908), a gene which has a role in regulating cell-environment or cell-cell interactions. Accordingly, utilities of VGAM1928 include diagnosis, prevention and treatment of diseases and clinical conditions associated with ST7. The function of ST7 and its association with various diseases and clinical conditions, has been established by previous studies, as described hereinabove with reference to VGAM107. Transcription Factor 19 (SC1) (TCF19, Accession XM_175167) is another VGAM1928 host target gene. TCF19 BINDING SITE1 and TCF19 BINDING SITE2 are HOST TARGET binding sites found in untranslated regions of mRNA encoded by TCF19, corresponding to HOST TARGET binding sites such as BINDING SITE I, BINDING SITE II or BINDING SITE III. Table 2 illustrates the complementarity of the nucleotide sequences of TCF19 BINDING SITE1 and TCF19 BINDING SITE2, designated SEQ ID:46661 and SEQ ID:46710 respectively, to the nucleotide sequence of VGAM1928 RNA, herein designated VGAM RNA, also designated SEQ ID:4639.

Another function of VGAM1928 is therefore inhibition of Transcription Factor 19 (SC1) (TCF19, Accession XM_175167), a gene which plays an important role in the transcription of genes required for the later stages of cell cycle progression. Accordingly, utilities of VGAM1928 include diagnosis, prevention and treatment of diseases and clinical conditions associated with TCF19. The function of TCF19 and its association with various diseases and clinical conditions, has been established by previous studies, as described hereinabove with reference to VGAM299. TH1-like (Drosophila) (TH1L, Accession NM_016397) is another VGAM1928 host target gene. TH1L BINDING SITE is HOST TARGET binding site found in the 3' untranslated region of mRNA encoded by TH1L, corresponding to a HOST TARGET binding site such as BINDING SITE I, BINDING SITE II or BINDING SITE III. Table 2 illustrates the complementarity of the nucleotide sequences of TH1L BINDING SITE, designated SEQ ID:18536, to the nucleotide sequence of VGAM1928 RNA, herein designated VGAM RNA, also designated SEQ ID:4639.

Another function of VGAM1928 is therefore inhibition of TH1-like (Drosophila) (TH1L, Accession NM_016397). Accordingly, utilities of VGAM1928 include diagnosis, prevention and treatment of diseases and clinical conditions associated with TH1L. Tissue Inhibitor of Metalloproteinase 3 (Sorsby fundus dystrophy, pseudoinflammatory) (TIMP3, Accession NM_000362) is another VGAM1928 host target gene. TIMP3 BINDING SITE is HOST TARGET binding site found in the 5' untranslated region of mRNA encoded by TIMP3, corresponding to a HOST TARGET binding site such as BINDING SITE I, BINDING SITE II or BINDING SITE III. Table 2 illustrates the complementarity of the nucleotide sequences of TIMP3 BINDING SITE, designated SEQ ID:5927, to the nucleotide sequence of VGAM1928 RNA, herein designated VGAM RNA, also designated SEQ ID:4639.

Another function of VGAM1928 is therefore inhibition of Tissue Inhibitor of Metalloproteinase 3 (Sorsby fundus dystrophy, pseudoinflammatory) (TIMP3, Accession NM_000362). Accordingly, utilities of VGAM1928 include diagnosis, prevention and treatment of diseases and clinical conditions associated with TIMP3. Transmembrane Protein with EGF-like and Two Follistatin-like Domains 2 (TMEFF2, Accession NM_016192) is another VGAM1928 host target gene. TMEFF2 BINDING SITE is HOST TARGET binding site found in the 5' untranslated region of mRNA encoded by TMEFF2, corresponding to a HOST TARGET binding site such as BINDING SITE I, BINDING SITE II or BINDING SITE III. Table 2 illustrates the complementarity of the nucleotide sequences of TMEFF2 BINDING SITE, designated SEQ ID:18285, to the nucleotide sequence of VGAM1928 RNA, herein designated VGAM RNA, also designated SEQ ID:4639.

Another function of VGAM1928 is therefore inhibition of Transmembrane Protein with EGF-like and Two Follistatin-like Domains 2 (TMEFF2, Accession NM_016192), a gene which is a survival factor for hippocampal and mesencephalic neurons. Accordingly, utilities of VGAM1928 include diagnosis, prevention and treatment of diseases and clinical conditions associated with TMEFF2. The function of TMEFF2 has been established by previous studies. Horie et al. (2000) detected strong Tmeff2 signals in most regions of the brain including regions of the olfactory bulb, hippocampus, cerebellum, and substantia nigra. By Northern blot analysis with whole mouse embryos, Uchida et al. (1999) found that Tmeff2 expression was detectable by embryonic day 11 and increased by embryonic days 15-17. They also observed immunostaining of Tmeff2 in adult rat mesenchymal cells of the lamina propria and fibroblasts localized in lamina propria. Uchida et al. (1999) detected both membrane-bound and soluble TMEFF2 in analysis of A172 cells. Uchida et al. (1999) found that purified, soluble TMEFF2 stimulated ERBB4, but not ERBB2 (OMIM Ref. No. 164870) or ERBB3 (OMIM Ref. No. 190151), in gastric cancer cells. By treating fetal rat primary neuron cultures with a purified recombinant TMEFF2 protein fragment, Horie et al. (2000) observed that TMEFF2 promotes the survival of hippocampal and mesencephalic, but not cortical neurons in primary culture. Adenomas are the precursors of most colorectal cancers. Hyperplastic polyps have been linked to a subset of colorectal cancers showing DNA microsatellite instability. Using a strategy that isolates differentially methylated sequences from hyperplastic polyps and normal mucosa, Young et al. (2001) identified a 370-bp sequence containing the 5-prime untranslated region and the first exon of the TMEFF2 gene, which they called HPP1 (hyperplastic polyposis gene-1). They used rapid amplification of cDNA ends to isolate HPP1 from normal mucosa. Using RT-PCR, they found that HPP1 was expressed in 28 of 30 (93%) normal colonic samples but in only 7 of 30 (23%) colorectal cancers (P less than 0.001). The 5-prime region of HPP1 included a CpG island containing 49 CpG sites, of which 96% were found to be methylated by bisulfite sequencing of DNA from colonic tumor samples. In situ hybridization of HPP1 indicated that expression occurs in epithelial and stromal elements in normal mucosa but is silenced in both cell types in early colonic neoplasia. HPP1 is predicted to encode a transmembrane protein containing follistatin and epidermal growth factor-like domains. Silencing of HPP1 by methylation may increase the probability of neoplastic transformation.

Full details of the abovementioned studies are described in the following publications, the disclosure of which are hereby incorporated by reference:

Horie, M.; Mitsumoto, Y.; Kyushiki, H.; Kanemoto, N.; Watanabe, A.; Taniguchi, Y.; Nishino, N.; Okamoto, T.; Kondo, M.; Mori, T.; Noguchi, K.; Nakamura, Y.; Takahashi, E.; Tanigami, A.: Identification and characterization of TMEFF2, a novel survival factor for hippocampal and mesencephalic neurons. Genomics 67:146-152, 2000; and Young, J.; Biden, K. G.; Simms, L. A.; Huggard, P.; Karamatic, R.; Eyre, H. J.; Sutherland, G. R.; Herath, N.; Barker, M.; Anderson, G. J.; Fitzpatrick, D. R.; Ramm, G. A.; Jass, J. R.

Further studies establishing the function and utilities of TMEFF2 are found in John Hopkins OMIM database record ID 605734, and in sited publications numbered 6918-6920 listed in the bibliography section hereinbelow, which are also hereby incorporated by reference. Transmembrane Protein 1 (TMEM1, Accession NM_003274) is another VGAM1928 host target gene. TMEM1 BINDING SITE is HOST TARGET binding site found in the 5' untranslated region of mRNA encoded by TMEM1, corresponding to a HOST TARGET binding site such as BINDING SITE I, BINDING SITE II or BINDING SITE III. Table 2 illustrates the complementarity of the nucleotide sequences of TMEM1 BINDING SITE, designated SEQ ID:9291, to the nucleotide sequence of VGAM1928 RNA, herein designated VGAM RNA, also designated SEQ ID:4639.

Another function of VGAM1928 is therefore inhibition of Transmembrane Protein 1 (TMEM1, Accession NM_003274). Accordingly, utilities of VGAM1928 include diagnosis, prevention and treatment of diseases and clinical conditions associated with TMEM1. Tropomodulin 2 (neuronal) (TMOD2, Accession NM_014548) is another VGAM1928 host target gene. TMOD2 BINDING SITE is HOST TARGET binding site found in the 3' untranslated region of mRNA encoded by TMOD2, corresponding to a HOST TARGET binding site such as BINDING SITE I, BINDING SITE II or BINDING SITE III. Table 2 illustrates the complementarity of the nucleotide sequences of TMOD2 BINDING SITE, designated SEQ ID:15861, to the nucleotide sequence of VGAM1928 RNA, herein designated VGAM RNA, also designated SEQ ID:4639.

Another function of VGAM1928 is therefore inhibition of Tropomodulin 2 (neuronal) (TMOD2, Accession NM_014548), a gene which is an actin-capping protein for the slow-growing end of filamentous actin. Accordingly, utilities of VGAM1928 include diagnosis, prevention and treatment of diseases and clinical conditions associated with TMOD2. The function of TMOD2 and its association with various diseases and clinical conditions, has been established by previous studies, as described hereinabove with reference to VGAM791. Triosephosphate Isomerase 1 (TPI1, Accession NM_000365) is another VGAM1928 host target gene. TPI1 BINDING SITE is HOST TARGET binding site found in the 5' untranslated region of mRNA encoded by TPI1, corresponding to a HOST TARGET binding site such as BINDING SITE I, BINDING SITE II or BINDING SITE III. Table 2 illustrates the complementarity of the nucleotide sequences of TPI1 BINDING SITE, designated SEQ ID:5936, to the nucleotide sequence of VGAM1928 RNA, herein designated VGAM RNA, also designated SEQ ID:4639.

Another function of VGAM1928 is therefore inhibition of Triosephosphate Isomerase 1 (TPI1, Accession NM_000365). Accordingly, utilities of VGAM1928 include diagnosis, prevention and treatment of diseases and clinical conditions associated with TPI1. Tripartite Motif-containing 37 (TRIM37, Accession NM_015294) is another VGAM1928 host target gene. TRIM37 BINDING SITE is HOST TARGET binding site found in the 3' untranslated region of mRNA encoded by TRIM37, corresponding to a HOST TARGET binding site such as BINDING SITE I, BINDING SITE II or BINDING SITE III. Table 2 illustrates the complementarity of the nucleotide sequences of TRIM37 BINDING SITE, designated SEQ ID:17619, to the nucleotide sequence of VGAM1928 RNA, herein designated VGAM RNA, also designated SEQ ID:4639.

Another function of VGAM1928 is therefore inhibition of Tripartite Motif-containing 37 (TRIM37, Accession NM_015294). Accordingly, utilities of VGAM1928 include diagnosis, prevention and treatment of diseases and clinical conditions associated with TRIM37. Transient Receptor Potential Cation Channel, Subfamily C, Member 6 (TRPC6, Accession NM_004621) is another VGAM1928 host target gene. TRPC6 BINDING SITE is HOST TARGET binding site found in the 3' untranslated region of mRNA encoded by TRPC6, corresponding to a HOST TARGET binding site such as BINDING SITE I, BINDING SITE II or BINDING SITE III. Table 2 illustrates the complementarity of the nucleotide sequences of TRPC6 BINDING SITE, designated SEQ ID:10971, to the nucleotide sequence of VGAM1928 RNA, herein designated VGAM RNA, also designated SEQ ID:4639.

Another function of VGAM1928 is therefore inhibition of Transient Receptor Potential Cation Channel, Subfamily C, Member 6 (TRPC6, Accession NM_004621), a gene which has calcium channel activity. Accordingly, utilities of VGAM1928 include diagnosis, prevention and treatment of diseases and clinical conditions associated with TRPC6. The function of TRPC6 and its association with various diseases and clinical conditions, has been established by previous studies, as described hereinabove with reference to VGAM25. Transient Receptor Potential Cation Channel, Subfamily M, Member 2 (TRPM2, Accession NM_003307) is another VGAM1928 host target gene. TRPM2 BINDING SITE is HOST TARGET binding site found in the 5' untranslated region of mRNA encoded by TRPM2, corresponding to a HOST TARGET binding site such as BINDING SITE I, BINDING SITE II or BINDING SITE III. Table 2 illustrates the complementarity of the nucleotide sequences of TRPM2 BINDING SITE, designated SEQ ID:9310, to the nucleotide sequence of VGAM1928 RNA, herein designated VGAM RNA, also designated SEQ ID:4639.

Another function of VGAM1928 is therefore inhibition of Transient Receptor Potential Cation Channel, Subfamily M, Member 2 (TRPM2, Accession NM_003307), a gene which may be a calcium channel. Accordingly, utilities of VGAM1928 include diagnosis, prevention and treatment of diseases and clinical conditions associated with TRPM2. The function of TRPM2 has been established by previous studies. Perraud et al. (2001) demonstrated that a 350-amino acid protein, designated NUDT9 (OMIM Ref. No. 606022), and a homologous domain (NUDT9 homology domain) near the C terminus of the LTRPC2 putative cation channel both function as specific ADP-ribose pyrophosphatases. Whole-cell and single-channel analysis of HEK293 cells expressing LTRPC2 showed that LTRPC2 functions as a calcium-permeable cation channel that is specifically gated by free ADP-ribose. The expression of native LTRPC2 transcripts is detectable in many tissues, including the U937 monocyte cell line, in which ADP-ribose induces large cation currents that closely match those mediated by recombinant LTRPC2. Perraud et al. (2001) concluded that intracellular ADP-ribose regulates calcium entry into cells that express LTRPC2. Hara et al. (2002) reported that LTRPC2 is activated by micromolar levels of H2O2 and agents that produce reactive oxygen/nitrogen species. This sensitivity of LTRPC2 to redox state modifiers was attributable to an agonistic binding of beta-nicotinamide adenine dinucleotide to the MutT motif. Arachidonic acid and calcium were important positive regulators for LTRPC2. Heterologous LTRPC2 expression conferred susceptibility to death on HEK cells. Antisense oligonucleotide experiments revealed physiologic involvement of native LTRPC2 in H2O2- and TNF-alpha (OMIM Ref. No. 191160)-induced calcium influx and cell death. Thus, LTRPC2 represents an important intrinsic mechanism that mediates calcium and sodium overload in response to disturbance of redox state in cell death. Animal model experiments lend further support to the function of TRPM2.

It is appreciated that the abovementioned animal model for TRPM2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Perraud, A.-L.; Fleig, A.; Dunn, C. A.; Bagley, L. A.; Launay, P.; Schmitz, C.; Stokes, A. J.; Zhu, Q.; Bessman, M. J.; Penner, R.; Kinet, J.-P.; Scharenberg, A. M.: ADP-ribose gating of the calcium-permeable LTRPC2 channel revealed by Nudix motif homology. Nature 411:595-599, 2001; and Hara, Y.; Wakamori, M.; Ishii, M.; Maeno, E.; Nishida, M.; Yoshida, T.; Yamada, H.; Shimizu, S.; Mori, E.; Kudoh, J.; Shimizu, S.; Kurose, H.; Okada, Y.; Imoto, K.; Mori, Y.: LTRPC2 Ca (2+.

Further studies establishing the function and utilities of TRPM2 are found in John Hopkins OMIM database record ID 603749, and in sited publications numbered 7593-7598 listed in the bibliography section hereinbelow, which are also hereby incorporated by reference. Trichorhinophalangeal Syndrome I (TRPS1, Accession NM_014112) is another VGAM1928 host target gene. TRPS1 BINDING SITE is HOST TARGET binding site found in the 3' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15350, to the nucleotide sequence of VGAM1928 RNA, herein designated VGAM RNA, also designated SEQ ID:4639.

Another function of VGAM1928 is therefore inhibition of Trichorhinophalangeal Syndrome I (TRPS1, Accession NM_014112), a gene which may function as a transcriptional activator protein. Accordingly, utilities of VGAM1928 include diagnosis, prevention and treatment of diseases and clinical conditions associated with TRPS1. The function of TRPS1 and its association with various diseases and clinical conditions, has been established by previous studies, as described hereinabove with reference to VGAM172. WNT1 Inducible Signaling Pathway Protein 1 (WISP1, Accession NM_003882) is another VGAM1928 host target gene. WISP1 BINDING SITE is HOST TARGET binding site found in the 3' untranslated region of mRNA encoded by WISP1, corresponding to a HOST TARGET binding site such as BINDING SITE I, BINDING SITE II or BINDING SITE III. Table 2 illustrates the complementarity of the nucleotide sequences of WISP1 BINDING SITE, designated SEQ ID:9961, to the nucleotide sequence of VGAM1928 RNA, herein designated VGAM RNA, also designated SEQ ID:4639.

Another function of VGAM1928 is therefore inhibition of WNT1 Inducible Signaling Pathway Protein 1 (WISP1, Accession NM_003882), a gene which is a member of connective tissue growth factor family. Accordingly, utilities of VGAM1928 include diagnosis, prevention and treatment of diseases and clinical conditions associated with WISP1. The function of WISP1 and its association with various diseases and clinical conditions, has been established by previous studies, as described hereinabove with reference to VGAM1656. Wingless-type MMTV Integration Site Family, Member 5B (WNT5B, Accession NM_032642) is another VGAM1928 host target gene. WNT5B BINDING SITE1 and WNT5B BINDING SITE2 are HOST TARGET binding sites found in untranslated regions of mRNA encoded by WNT5B, corresponding to HOST TARGET binding sites such as BINDING SITE I, BINDING SITE II or BINDING SITE III. Table 2 illustrates the complementarity of the nucleotide sequences of WNT5B BINDING SITE1 and WNT5B BINDING SITE2, designated SEQ ID:26359 and SEQ ID:25057 respectively, to the nucleotide sequence of VGAM1928 RNA, herein designated VGAM RNA, also designated SEQ ID:4639.

Another function of VGAM1928 is therefore inhibition of Wingless-type MMTV Integration Site Family, Member 5B (WNT5B, Accession NM_032642), a gene which is the ligand for members of the frizzled family of seven transmembrane receptors and may be a signaling molecule. Accordingly, utilities of VGAM1928 include diagnosis, prevention and treatment of diseases and clinical conditions associated with WNT5B. The function of WNT5B has been established by previous studies. The WNT gene family consists of structurally related genes encoding secreted signaling molecules that have been implicated in oncogenesis and in several developmental processes, including regulation of cell fate and patterning during embryogenesis. For general information about WNT genes, see WNT1 (OMIM Ref. No. 164820). Using degenerate PCR and cDNA library screening to search for new members of the mouse Wnt family, Gavin et al. (1990) identified Wnt5b. Northern blot analysis detected expression of Wnt5b in all tissues tested, with the exception of adult spleen. In situ hybridization, detected expression of Wnt5b at low levels throughout the embryo and fetus from 6.5 to 14.5 days postcoitum. By searching human genome draft sequence for mouse Wnt5a homologs, Saitoh and Katoh (2001) identified WNT5B. Using database searches and PCR techniques, they assembled a WNT5B cDNA sequence. WNT5B encodes a deduced 359-amino acid protein with an N-terminal signal peptide, 4 N-linked glycosylation sites, and conserved residues of the WNT family. The WNT5B protein shares 80% sequence identity with WNT5A (OMIM Ref. No. 164975). Using Northern blot analysis, Saitoh and Katoh (2001) detected expression of 2.8- and 2.4-kb WNT5B transcripts at moderate levels in adult prostate and fetal brain and at low levels in fetal lung, kidney, adult liver, ovary, and small intestine. Using cDNA-PCR, the authors also detected WNT5B in gastric cancer and teratocarcinoma cell lines. Saitoh and Katoh (2001) determined that the WNT5B gene contains 4 exons and spans about 16 kb of genomic DNA. Exon-intron boundaries are conserved between WNT5B and WNT5A, suggesting that the 2 genes may have been generated by duplication of an ancestral gene.

Full details of the abovementioned studies are described in the following publications, the disclosure of which are hereby incorporated by reference:

Gavin, B. J.; McMahon, J. A.; McMahon, A. P.: Expression of multiple novel Wnt-1/int-1-related genes during fetal and adult mouse development. Genes Dev. 4:2319-2332, 1990; and Saitoh, T.; Katoh, M.: Molecular cloning and characterization of human WNT5B on chromosome 12p13.3 region. Int. J. Oncol. 19:347-351, 2001.

Further studies establishing the function and utilities of WNT5B are found in John Hopkins OMIM database record ID 606361, and in sited publications numbered 12747 listed in the bibliography section hereinbelow, which are also hereby incorporated by reference. Zic Family Member 1 (odd-paired homolog, Drosophila) (ZIC1, Accession NM_003412) is another VGAM1928 host target gene. ZIC1 BINDING SITE is HOST TARGET binding site found in the 3' untranslated region of mRNA encoded by ZIC1, corresponding to a HOST TARGET binding site such as BINDING SITE I, BINDING SITE II or BINDING SITE III. Table 2 illustrates the complementarity of the nucleotide sequences of ZIC1 BINDING SITE, designated SEQ ID:9449, to the nucleotide sequence of VGAM1928 RNA, herein designated VGAM RNA, also designated SEQ ID:4639.

Another function of VGAM1928 is therefore inhibition of Zic Family Member 1 (odd-paired homolog, Drosophila) (ZIC1, Accession NM_003412), a gene which may play a role in cerebellar development. Accordingly, utilities of VGAM1928 include diagnosis, prevention and treatment of diseases and clinical conditions associated with ZIC1. The function of ZIC1 and its association with various diseases and clinical conditions, has been established by previous studies, as described hereinabove with reference to VGAM381. Ankyrin Repeat and BTB (POZ) Domain Containing 1 (ABTB1, Accession NM_032548) is another VGAM1928 host target gene. ABTB1 BINDING SITE is HOST TARGET binding site found in the 5' untranslated region of mRNA encoded by ABTB1, corresponding to a HOST TARGET binding site such as BINDING SITE I, BINDING SITE II or BINDING SITE III. Table 2 illustrates the complementarity of the nucleotide sequences of ABTB1 BINDING SITE, designated SEQ ID:26273, to the nucleotide sequence of VGAM1928 RNA, herein designated VGAM RNA, also designated SEQ ID:4639.

Another function of VGAM1928 is therefore inhibition of Ankyrin Repeat and BTB (POZ) Domain Containing 1 (ABTB1, Accession NM_032548). Accordingly, utilities of VGAM1928 include diagnosis, prevention and treatment of diseases and clinical conditions associated with ABTB1. S-adenosylhomocysteine Hydrolase-like 1 (AHCYL1, Accession NM_006621) is another VGAM1928 host target gene. AHCYL1 BINDING SITE is HOST TARGET binding site found in the 3' untranslated region of mRNA encoded by AHCYL1, corresponding to a HOST TARGET binding site such as BINDING SITE I, BINDING SITE II or BINDING SITE III. Table 2 illustrates the complementarity of the nucleotide sequences of AHCYL1 BINDING SITE, designated SEQ ID:13404, to the nucleotide sequence of VGAM1928 RNA, herein designated VGAM RNA, also designated SEQ ID:4639.

Another function of VGAM1928 is therefore inhibition of S-adenosylhomocysteine Hydrolase-like 1 (AHCYL1, Accession NM_006621). Accordingly, utilities of VGAM1928 include diagnosis, prevention and treatment of diseases and clinical conditions associated with AHCYL1. Ras Homolog Gene Family, Member F (in filopodia) (ARHF, Accession NM_019034) is another VGAM1928 host target gene. ARHF BINDING SITE is HOST TARGET binding site found in the 3' untranslated region of mRNA encoded by ARHF, corresponding to a HOST TARGET binding site such as BINDING SITE I, BINDING SITE II or BINDING SITE III. Table 2 illustrates the complementarity of the nucleotide sequences of ARHF BINDING SITE, designated SEQ ID:21120, to the nucleotide sequence of VGAM1928 RNA, herein designated VGAM RNA, also designated SEQ ID:4639.

Another function of VGAM1928 is therefore inhibition of Ras Homolog Gene Family, Member F (in filopodia) (ARHF, Accession NM_019034). Accordingly, utilities of VGAM1928 include diagnosis, prevention and treatment of diseases and clinical conditions associated with ARHF. ARL8 (Accession XM_167671) is another VGAM1928 host target gene. ARL8 BINDING SITE is HOST TARGET binding site found in the 5' untranslated region of mRNA encoded by ARL8, corresponding to a HOST TARGET binding site such as BINDING SITE I, BINDING SITE II or BINDING SITE III. Table 2 illustrates the complementarity of the nucleotide sequences of ARL8 BINDING SITE, designated SEQ ID:44761, to the nucleotide sequence of VGAM1928 RNA, herein designated VGAM RNA, also designated SEQ ID:4639.

Another function of VGAM1928 is therefore inhibition of ARL8 (Accession XM_167671). Accordingly, utilities of VGAM1928 include diagnosis, prevention and treatment of diseases and clinical conditions associated with ARL8. ARNTL2 (Accession NM_020183) is another VGAM1928 host target gene. ARNTL2 BINDING SITE is HOST TARGET binding site found in the 3' untranslated region of mRNA encoded by ARNTL2, corresponding to a HOST TARGET binding site such as BINDING SITE I, BINDING SITE II or BINDING SITE III. Table 2 illustrates the complementarity of the nucleotide sequences of ARNTL2 BINDING SITE, designated SEQ ID:21419, to the nucleotide sequence of VGAM1928 RNA, herein designated VGAM RNA, also designated SEQ ID:4639.

Another function of VGAM1928 is therefore inhibition of ARNTL2 (Accession NM_020183). Accordingly, utilities of VGAM1928 include diagnosis, prevention and treatment of diseases and clinical conditions associated with ARNTL2. Activating Transcription Factor 3 (ATF3, Accession NM_004024) is another VGAM1928 host target gene. ATF3 BINDING SITE is HOST TARGET binding site found in the 3' untranslated region of mRNA encoded by ATF3, corresponding to a HOST TARGET binding site such as BINDING SITE I, BINDING SITE II or BINDING SITE III. Table 2 illustrates the complementarity of the nucleotide sequences of ATF3 BINDING SITE, designated SEQ ID:10242, to the nucleotide sequence of VGAM1928 RNA, herein designated VGAM RNA, also designated SEQ ID:4639.

Another function of VGAM1928 is therefore inhibition of Activating Transcription Factor 3 (ATF3, Accession NM_004024). Accordingly, utilities of VGAM1928 include diagnosis, prevention and treatment of diseases and clinical conditions associated with ATF3. Butyrophilin, Subfamily 1, Member A1 (BTN1A1, Accession NM_001732) is another VGAM1928 host target gene. BTN1A1 BINDING SITE is HOST TARGET binding site found in the 3' untranslated region of mRNA encoded by BTN1A1, corresponding to a HOST TARGET binding site such as BINDING SITE I, BINDING SITE II or BINDING SITE III. Table 2 illustrates the complementarity of the nucleotide sequences of BTN1A1 BINDING SITE, designated SEQ ID:7467, to the nucleotide sequence of VGAM1928 RNA, herein designated VGAM RNA, also designated SEQ ID:4639.

Another function of VGAM1928 is therefore inhibition of Butyrophilin, Subfamily 1, Member A1 (BTN1A1, Accession NM_001732). Accordingly, utilities of VGAM1928 include diagnosis, prevention and treatment of diseases and clinical conditions associated with BTN1A1. Butyrophilin, Subfamily 2, Member A2 (BTN2A2, Accession NM_006995) is another VGAM1928 host target gene. BTN2A2 BINDING SITE is HOST TARGET binding site found in the 3' untranslated region of mRNA encoded by BTN2A2, corresponding to a HOST TARGET binding site such as BINDING SITE I, BINDING SITE II or BINDING SITE III. Table 2 illustrates the complementarity of the nucleotide sequences of BTN2A2 BINDING SITE, designated SEQ ID:13861, to the nucleotide sequence of VGAM1928 RNA, herein designated VGAM RNA, also designated SEQ ID:4639.

Another function of VGAM1928 is therefore inhibition of Butyrophilin, Subfamily 2, Member A2 (BTN2A2, Accession NM_006995). Accordingly, utilities of VGAM1928 include diagnosis, prevention and treatment of diseases and clinical conditions associated with BTN2A2. Chromosome 11 Open Reading Frame 11 (C11orf11, Accession XM_167769) is another VGAM1928 host target gene. C11orf11 BINDING SITE is HOST TARGET binding site found in the 5' untranslated region of mRNA encoded by C11orf11, corresponding to a HOST TARGET binding site such as BINDING SITE I, BINDING SITE II or BINDING SITE III. Table 2 illustrates the complementarity of the nucleotide sequences of C11orf11 BINDING SITE, designated SEQ ID:44785, to the nucleotide sequence of VGAM1928 RNA, herein designated VGAM RNA, also designated SEQ ID:4639.

Another function of VGAM1928 is therefore inhibition of Chromosome 11 Open Reading Frame 11 (C11orf11, Accession XM_167769). Accordingly, utilities of VGAM1928 include diagnosis, prevention and treatment of diseases and clinical conditions associated with C11orf11. Chromosome 20 Open Reading Frame 178 (C20orf178, Accession XM_059282) is another VGAM1928 host target gene. C20orf178 BINDING SITE is HOST TARGET binding site found in the 3" untranslated region of mRNA encoded by C20orf178, corresponding to a HOST TARGET binding site such as BINDING SITE I, BINDING SITE II or BINDING SITE III. Table 2 illustrates the complementarity of the nucleotide sequences of C20orf178 BINDING SITE, designated SEQ ID:36936, to the nucleotide sequence of VGAM1928 RNA, herein designated VGAM RNA, also designated SEQ ID:4639.

Another function of VGAM1928 is therefore inhibition of Chromosome 20 Open Reading Frame 178 (C20orf178, Accession XM_059282). Accordingly, utilities of VGAM1928 include diagnosis, prevention and treatment of diseases and clinical conditions associated with C20orf178. Chromosome 20 Open Reading Frame 42 (C20orf42, Accession NM_017671) is another VGAM1928 host target gene. C20orf42 BINDING SITE is HOST TARGET binding site found in the 3' untranslated region of mRNA encoded by C20orf42, corresponding to a HOST TARGET binding site such as BINDING SITE I, BINDING SITE II or BINDING SITE III. Table 2 illustrates the complementarity of the nucleotide sequences of C20orf42 BINDING SITE, designated SEQ ID:19215, to the nucleotide sequence of VGAM1928 RNA, herein designated VGAM RNA, also designated SEQ ID:4639.

Another function of VGAM1928 is therefore inhibition of Chromosome 20 Open Reading Frame 42 (C20orf42, Accession NM_017671). Accordingly, utilities of VGAM1928 include diagnosis, prevention and treatment of diseases and clinical conditions associated with C20orf42. Chromosome 20 Open Reading Frame 98 (C20orf98, Accession XM_049398) is another VGAM1928 host target gene. C20orf98 BINDING SITE is HOST TARGET binding site found in the 3' untranslated region of mRNA encoded by C20orf98, corresponding to a HOST TARGET binding site such as BINDING SITE I, BINDING SITE II or BINDING SITE III. Table 2 illustrates the complementarity of the nucleotide sequences of C20orf98 BINDING SITE, designated SEQ ID:35412, to the nucleotide sequence of VGAM1928 RNA, herein designated VGAM RNA, also designated SEQ ID:4639.

Another function of VGAM1928 is therefore inhibition of Chromosome 20 Open Reading Frame 98 (C20orf98, Accession XM_049398). Accordingly, utilities of VGAM1928 include diagnosis, prevention and treatment of diseases and clinical conditions associated with C20orf98. Chromosome 21 Open Reading Frame 4 (C21orf4, Accession NM_006134) is another VGAM1928 host target gene. C21orf4 BINDING SITE is HOST TARGET binding site found in the 5' untranslated region of mRNA encoded by C21orf4, corresponding to a HOST TARGET binding site such as BINDING SITE I, BINDING SITE II or BINDING SITE III. Table 2 illustrates the complementarity of the nucleotide sequences of C21orf4 BINDING SITE, designated SEQ ID:12775, to the nucleotide sequence of VGAM1928 RNA, herein designated VGAM RNA, also designated SEQ ID:4639.

Another function of VGAM1928 is therefore inhibition of Chromosome 21 Open Reading Frame 4 (C21orf4, Accession NM_006134). Accordingly, utilities of VGAM1928 include diagnosis, prevention and treatment of diseases and clinical conditions associated with C21orf4. Cell Adhesion Molecule with Homology to L1CAM (close homolog of L1) (CHL1, Accession NM_006614) is another VGAM1928 host target gene. CHL1 BINDING SITE is HOST TARGET binding site found in the 3' untranslated region of mRNA encoded by CHL1, corresponding to a HOST TARGET binding site such as BINDING SITE I, BINDING SITE II or BINDING SITE III. Table 2 illustrates the complementarity of the nucleotide sequences of CHL1 BINDING SITE, designated SEQ ID:13391, to the nucleotide sequence of VGAM1928 RNA, herein designated VGAM RNA, also designated SEQ ID:4639.

Another function of VGAM1928 is therefore inhibition of Cell Adhesion Molecule with Homology to L1CAM (close homolog of L1) (CHL1, Accession NM_006614). Accordingly, utilities of VGAM1928 include diagnosis, prevention and treatment of diseases and clinical conditions associated with CHL1. Chondrolectin (CHODL, Accession NM_024944) is another VGAM1928 host target gene. CHODL BINDING SITE is HOST TARGET binding site found in the 5' untranslated region of mRNA encoded by CHODL, corresponding to a HOST TARGET binding site such as BINDING SITE I, BINDING SITE II or BINDING SITE III. Table 2 illustrates the complementarity of the nucleotide sequences of CHODL BINDING SITE, designated SEQ ID:24491, to the nucleotide sequence of VGAM1928 RNA, herein designated VGAM RNA, also designated SEQ ID:4639.

Another function of VGAM1928 is therefore inhibition of Chondrolectin (CHODL, Accession NM_024944). Accordingly, utilities of VGAM1928 include diagnosis, prevention and treatment of diseases and clinical conditions associated with CHODL. CCR4-NOT Transcription Complex, Subunit 7 (CNOT7, Accession NM_013354) is another VGAM1928 host target gene. CNOT7 BINDING SITE is HOST TARGET binding site found in the 3' untranslated region of mRNA encoded by CNOT7, corresponding to a HOST TARGET binding site such as BINDING SITE I, BINDING SITE II or BINDING SITE III. Table 2 illustrates the complementarity of the nucleotide sequences of CNOT7 BINDING SITE, designated SEQ ID:15004, to the nucleotide sequence of VGAM1928 RNA, herein designated VGAM RNA, also designated SEQ ID:4639.

Another function of VGAM1928 is therefore inhibition of CCR4-NOT Transcription Complex, Subunit 7 (CNOT7, Accession NM_013354). Accordingly, utilities of VGAM1928 include diagnosis, prevention and treatment of diseases and clinical conditions associated with CNOT7. CXYorf1 (Accession XM_088704) is another VGAM1928 host target gene. CXYorf1 BINDING SITE is HOST TARGET binding site found in the 5" untranslated region of mRNA encoded by CXYorf1, corresponding to a HOST TARGET binding site such as BINDING SITE I, BINDING SITE II or BINDING SITE III. Table 2 illustrates the complementarity of the nucleotide sequences of CXYorf1 BINDING SITE, designated SEQ ID:39915, to the nucleotide sequence of VGAM1928 RNA, herein designated VGAM RNA, also designated SEQ ID:4639.

Another function of VGAM1928 is therefore inhibition of CXYorf1 (Accession XM_088704). Accordingly, utilities of VGAM1928 include diagnosis, prevention and treatment of diseases and clinical conditions associated with CXYorf1. D4ST-1 (Accession NM_130468) is another VGAM1928 host target gene. D4ST-1 BINDING SITE1 and D4ST-1 BINDING SITE2 are HOST TARGET binding sites found in untranslated regions of mRNA encoded by D4ST-1, corresponding to HOST TARGET binding sites such as BINDING SITE I, BINDING SITE II or BINDING SITE III. Table 2 illustrates the complementarity of the nucleotide sequences of D4ST-1 BINDING SITE1 and D4ST-1 BINDING SITE2, designated SEQ ID:28226 and SEQ ID:28229 respectively, to the nucleotide sequence of VGAM1928 RNA, herein designated VGAM RNA, also designated SEQ ID:4639.

Another function of VGAM1928 is therefore inhibition of D4ST-1 (Accession NM_130468). Accordingly, utilities of VGAM1928 include diagnosis, prevention and treatment of diseases and clinical conditions associated with D4ST-1. DEAD/H (Asp-Glu-Ala-Asp/His) Box Polypeptide 34 (DDX34, Accession NM_014681) is another VGAM1928 host target gene. DDX34 BINDING SITE is HOST TARGET binding site found in the 3' untranslated region of mRNA encoded by DDX34, corresponding to a HOST TARGET binding site such as BINDING SITE I, BINDING SITE II or BINDING SITE III. Table 2 illustrates the complementarity of the nucleotide sequences of DDX34 BINDING SITE, designated SEQ ID:16167, to the nucleotide sequence of VGAM1928 RNA, herein designated VGAM RNA, also designated SEQ ID:4639.

Another function of VGAM1928 is therefore inhibition of DEAD/H (Asp-Glu-Ala-Asp/His) Box Polypeptide 34 (DDX34, Accession NM_014681). Accordingly, utilities of VGAM1928 include diagnosis, prevention and treatment of diseases and clinical conditions associated with DDX34. DEAD/H (Asp-Glu-Ala-Asp/His) Box Polypeptide 37 (DDX37, Accession NM_032656) is another VGAM1928 host target gene. DDX37 BINDING SITE is HOST TARGET binding site found in the 3' untranslated region of mRNA encoded by DDX37, corresponding to a HOST TARGET binding site such as BINDING SITE I, BINDING SITE II or BINDING SITE III. Table 2 illustrates the complementarity of the nucleotide sequences of DDX37 BINDING SITE, designated SEQ ID:26390, to the nucleotide sequence of VGAM1928 RNA, herein designated VGAM RNA, also designated SEQ ID:4639.

Another function of VGAM1928 is therefore inhibition of DEAD/H (Asp-Glu-Ala-Asp/His) Box Polypeptide 37 (DDX37, Accession NM_032656). Accordingly, utilities of VGAM1928 include diagnosis, prevention and treatment of diseases and clinical conditions associated with DDX37. DKFZP434C171 (Accession NM_015621) is another VGAM1928 host target gene. DKFZP434C171 BINDING SITE is HOST TARGET binding site found in the 5' untranslated region of mRNA encoded by DKFZP434C171, corresponding to a HOST TARGET binding site such as BINDING SITE I, BINDING SITE II or BINDING SITE III. Table 2 illustrates the complementarity of the nucleotide sequences of DKFZP434C171 BINDING SITE, designated SEQ ID:17882, to the nucleotide sequence of VGAM1928 RNA, herein designated VGAM RNA, also designated SEQ ID:4639.

Another function of VGAM1928 is therefore inhibition of DKFZP434C171 (Accession NM_015621). Accordingly, utilities of VGAM1928 include diagnosis, prevention and treatment of diseases and clinical conditions associated with DKFZP434C171. DKFZP434H0820 (Accession XM_033460) is another VGAM1928 host target gene. DKFZP434H0820 BINDING SITE is HOST TARGET binding site found in the 3' untranslated region of mRNA encoded by DKFZP434H0820, corresponding to a HOST TARGET binding site such as BINDING SITE I, BINDING SITE II or BINDING SITE III. Table 2 illustrates the complementarity of the nucleotide sequences of DKFZP434H0820 BINDING SITE, designated SEQ ID:31933, to the nucleotide sequence of VGAM1928 RNA, herein designated VGAM RNA, also designated SEQ ID:4639.

Another function of VGAM1928 is therefore inhibition of DKFZP434H0820 (Accession XM_033460). Accordingly, utilities of VGAM1928 include diagnosis, prevention and treatment of diseases and clinical conditions associated with DKFZP434H0820. DKFZp547G183 (Accession NM_018705) is another VGAM1928 host target gene. DKFZp547G183 BINDING SITE is HOST TARGET binding site found in the 3' untranslated region of mRNA encoded by DKFZp547G183, corresponding to a HOST TARGET binding site such as BINDING SITE I, BINDING SITE II or BINDING SITE III. Table 2 illustrates the complementarity of the nucleotide sequences of DKFZp547G183 BINDING SITE, designated SEQ ID:20790, to the nucleotide sequence of VGAM1928 RNA, herein designated VGAM RNA, also designated SEQ ID:4639.

Another function of VGAM1928 is therefore inhibition of DKFZp547G183 (Accession NM_018705). Accordingly, utilities of VGAM1928 include diagnosis, prevention and treatment of diseases and clinical conditions associated with DKFZp547G183. DKFZp547O146 (Accession NM_020224) is another VGAM1928 host target gene. DKFZp547O146 BINDING SITE is HOST TARGET binding site found in the 3' untranslated region of mRNA encoded by DKFZp547O146, corresponding to a HOST TARGET binding site such as BINDING SITE I, BINDING SITE II or BINDING SITE III. Table 2 illustrates the complementarity of the nucleotide sequences of DKFZp547O146 BINDING SITE, designated SEQ ID:21485, to the nucleotide sequence of VGAM1928 RNA, herein designated VGAM RNA, also designated SEQ ID:4639.

Another function of VGAM1928 is therefore inhibition of DKFZp547O146 (Accession NM_020224). Accordingly, utilities of VGAM1928 include diagnosis, prevention and treatment of diseases and clinical conditions associated with DKFZp547O146. DKFZP564C1940 (Accession NM_014045) is another VGAM1928 host target gene. DKFZP564C1940 BINDING SITE is HOST TARGET binding site found in the 5' untranslated region of mRNA encoded by DKFZP564C1940, corresponding to a HOST TARGET binding site such as BINDING SITE I, BINDING SITE II or BINDING SITE III. Table 2 illustrates the complementarity of the nucleotide sequences of DKFZP564C1940 BINDING SITE, designated SEQ ID:15272, to the nucleotide sequence of VGAM1928 RNA, herein designated VGAM RNA, also designated SEQ ID:4639.

Another function of VGAM1928 is therefore inhibition of DKFZP564C1940 (Accession NM_014045). Accordingly, utilities of VGAM1928 include diagnosis, prevention and treatment of diseases and clinical conditions associated with DKFZP564C1940. DKFZp564K142 (Accession NM_032121) is another VGAM1928 host target gene. DKFZp564K142 BINDING SITE is HOST TARGET binding site found in the 3' untranslated region of mRNA encoded by DKFZp564K142, corresponding to a HOST TARGET binding site such as BINDING SITE I, BINDING SITE II or BINDING SITE III. Table 2 illustrates the complementarity of the nucleotide sequences of DKFZp564K142 BINDING SITE, designated SEQ ID:25808, to the nucleotide sequence of VGAM1928 RNA, herein designated VGAM RNA, also designated SEQ ID:4639.

Another function of VGAM1928 is therefore inhibition of DKFZp564K142 (Accession NM_032121). Accordingly, utilities of VGAM1928 include diagnosis, prevention and treatment of diseases and clinical conditions associated with DKFZp564K142. DKFZP566K023 (Accession NM_015485) is another VGAM1928 host target gene. DKFZP566K023 BINDING SITE is HOST TARGET binding site found in the 3' untranslated region of mRNA encoded by DKFZP566K023, corresponding to a HOST TARGET binding site such as BINDING SITE I, BINDING SITE II or BINDING SITE III. Table 2 illustrates the complementarity of the nucleotide sequences of DKFZP566K023 BINDING SITE, designated SEQ ID:17757, to the nucleotide sequence of VGAM1928 RNA, herein designated VGAM RNA, also designated SEQ ID:4639.

Another function of VGAM1928 is therefore inhibition of DKFZP566K023 (Accession NM_015485). Accordingly, utilities of VGAM1928 include diagnosis, prevention and treatment of diseases and clinical conditions associated with DKFZP566K023. DKFZp761D221 (Accession NM_032291) is another VGAM1928 host target gene. DKFZp761D221 BINDING SITE is HOST TARGET binding site found in the 3' untranslated region of mRNA encoded by DKFZp761D221, corresponding to a HOST TARGET binding site such as BINDING SITE I, BINDING SITE II or BINDING SITE III. Table 2 illustrates the complementarity of the nucleotide sequences of DKFZp761D221 BINDING SITE, designated SEQ ID:26060, to the nucleotide sequence of VGAM1928 RNA, herein designated VGAM RNA, also designated SEQ ID:4639.

Another function of VGAM1928 is therefore inhibition of DKFZp761D221 (Accession NM_032291). Accordingly, utilities of VGAM1928 include diagnosis, prevention and treatment of diseases and clinical conditions associated with DKFZp761D221. DKFZP761G1913 (Accession NM_031474) is another VGAM1928 host target gene. DKFZP761G1913 BINDING SITE is HOST TARGET binding site found in the 3' untranslated region of mRNA encoded by DKFZP761G1913, corresponding to a HOST TARGET binding site such as BINDING SITE I, BINDING SITE II or BINDING SITE III. Table 2 illustrates the complementarity of the nucleotide sequences of DKFZP761G1913 BINDING SITE, designated SEQ ID:25546, to the nucleotide sequence of VGAM1928 RNA, herein designated VGAM RNA, also designated SEQ ID:4639.

Another function of VGAM1928 is therefore inhibition of DKFZP761G1913 (Accession NM_031474). Accordingly, utilities of VGAM1928 include diagnosis, prevention and treatment of diseases and clinical conditions associated with DKFZP761G1913. DKFZp761N0624 (Accession NM_032295) is another VGAM1928 host target gene. DKFZp761N0624 BINDING SITE is HOST TARGET binding site found in the 3' untranslated region of mRNA encoded by DKFZp761N0624, corresponding to a HOST TARGET binding site such as BINDING SITE I, BINDING SITE II or BINDING SITE III. Table 2 illustrates the complementarity of the nucleotide sequences of DKFZp761N0624 BINDING SITE, designated SEQ ID:26075, to the nucleotide sequence of VGAM1928 RNA, herein designated VGAM RNA, also designated SEQ ID:4639.

Another function of VGAM1928 is therefore inhibition of DKFZp761N0624 (Accession NM_032295). Accordingly, utilities of VGAM1928 include diagnosis, prevention and treatment of diseases and clinical conditions associated with DKFZp761N0624. DKFZp762A227 (Accession NM_017611) is another VGAM1928 host target gene. DKFZp762A227 BINDING SITE1 and DKFZp762A227 BINDING SITE2 are HOST TARGET binding sites found in untranslated regions of mRNA encoded by DKFZp762A227, corresponding to HOST TARGET binding sites such as BINDING SITE I, BINDING SITE II or BINDING SITE III. Table 2 illustrates the complementarity of the nucleotide sequences of DKFZp762A227 BINDING SITE1 and DKFZp762A227 BINDING SITE2, designated SEQ ID:19105 and SEQ ID:15316 respectively, to the nucleotide sequence of VGAM1928 RNA, herein designated VGAM RNA, also designated SEQ ID:4639.

Another function of VGAM1928 is therefore inhibition of DKFZp762A227 (Accession NM_017611). Accordingly, utilities of VGAM1928 include diagnosis, prevention and treatment of diseases and clinical conditions associated with DKFZp762A227. F-box Only Protein 27 (FBXO27, Accession XM_059045) is another VGAM1928 host target gene. FBXO27 BINDING SITE is HOST TARGET binding site found in the 3' untranslated region of mRNA encoded by FBXO27, corresponding to a HOST TARGET binding site such as BINDING SITE I, BINDING SITE II or BINDING SITE III. Table 2 illustrates the complementarity of the nucleotide sequences of FBXO27 BINDING SITE, designated SEQ ID:36837, to the nucleotide sequence of VGAM1928 RNA, herein designated VGAM RNA, also designated SEQ ID:4639.

Another function of VGAM1928 is therefore inhibition of F-box Only Protein 27 (FBXO27, Accession XM_059045). Accordingly, utilities of VGAM1928 include diagnosis, prevention and treatment of diseases and clinical conditions associated with FBXO27. FLJ10458 (Accession NM_018096) is another VGAM1928 host target gene. FLJ10458 BINDING SITE is HOST TARGET binding site found in the 3' untranslated region of mRNA encoded by FLJ10458, corresponding to a HOST TARGET binding site such as BINDING SITE I, BINDING SITE II or BINDING SITE III. Table 2 illustrates the complementarity of the nucleotide sequences of FLJ10458 BINDING SITE, designated SEQ ID:19865, to the nucleotide sequence of VGAM1928 RNA, herein designated VGAM RNA, also designated SEQ ID:4639.

Another function of VGAM1928 is therefore inhibition of FLJ10458 (Accession NM_018096). Accordingly, utilities of VGAM1928 include diagnosis, prevention and treatment of diseases and clinical conditions associated with FLJ10458. FLJ10460 (Accession NM_018097) is another VGAM1928 host target gene. FLJ10460 BINDING SITE is HOST TARGET binding site found in the 3' untranslated region of mRNA encoded by FLJ10460, corresponding to a HOST TARGET binding site such as BINDING SITE I, BINDING SITE II or BINDING SITE III. Table 2 illustrates the complementarity of the nucleotide sequences of FLJ10460 BINDING SITE, designated SEQ ID:19869, to the nucleotide sequence of VGAM1928 RNA, herein designated VGAM RNA, also designated SEQ ID:4639.

Another function of VGAM1928 is therefore inhibition of FLJ10460 (Accession NM_018097). Accordingly, utilities of VGAM1928 include diagnosis, prevention and treatment of diseases and clinical conditions associated with FLJ10460. FLJ10468 (Accession NM_018101) is another VGAM1928 host target gene. FLJ10468 BINDING SITE is HOST TARGET binding site found in the 3' untranslated region of mRNA encoded by FLJ10468, corresponding to a HOST TARGET binding site such as BINDING SITE I, BINDING SITE II or BINDING SITE III. Table 2 illustrates the complementarity of the nucleotide sequences of FLJ10468 BINDING SITE, designated SEQ ID:19874, to the nucleotide sequence of VGAM1928 RNA, herein designated VGAM RNA, also designated SEQ ID:4639.

Another function of VGAM1928 is therefore inhibition of FLJ10468 (Accession NM_018101). Accordingly, utilities of VGAM1928 include diagnosis, prevention and treatment of diseases and clinical conditions associated with FLJ10468. FLJ10830 (Accession NM_018235) is another VGAM1928 host target gene. FLJ10830 BINDING SITE is HOST TARGET binding site found in the 5' untranslated region of mRNA encoded by FLJ10830, corresponding to a HOST TARGET binding site such as BINDING SITE I, BINDING SITE II or BINDING SITE III. Table 2 illustrates the complementarity of the nucleotide sequences of FLJ10830 BINDING SITE, designated SEQ ID:20182, to the nucleotide sequence of VGAM1928 RNA, herein designated VGAM RNA, also designated SEQ ID:4639.

Another function of VGAM1928 is therefore inhibition of FLJ10830 (Accession NM_018235). Accordingly, utilities of VGAM1928 include diagnosis, prevention and treatment of diseases and clinical conditions associated with FLJ10830. FLJ10956 (Accession NM_018283) is another VGAM1928 host target gene. FLJ10956 BINDING SITE is HOST TARGET binding site found in the 3' untranslated region of mRNA encoded by FLJ10956, corresponding to a HOST TARGET binding site such as BINDING SITE I, BINDING SITE II or BINDING SITE III. Table 2 illustrates the complementarity of the nucleotide sequences of FLJ10956 BINDING SITE, designated SEQ ID:20273, to the nucleotide sequence of VGAM1928 RNA, herein designated VGAM RNA, also designated SEQ ID:4639.

Another function of VGAM1928 is therefore inhibition of FLJ10956 (Accession NM_018283). Accordingly, utilities of VGAM1928 include diagnosis, prevention and treatment of diseases and clinical conditions associated with FLJ10956. FLJ11126 (Accession NM_018332) is another VGAM1928 host target gene. FLJ11126 BINDING SITE is HOST TARGET binding site found in the 3' untranslated region of mRNA encoded by FLJ11126, corresponding to a HOST TARGET binding site such as BINDING SITE I, BINDING SITE II or BINDING SITE III. Table 2 illustrates the complementarity of the nucleotide sequences of FLJ11126 BINDING SITE, designated SEQ ID:20334, to the nucleotide sequence of VGAM1928 RNA, herein designated VGAM RNA, also designated SEQ ID:4639.

Another function of VGAM1928 is therefore inhibition of FLJ11126 (Accession NM_018332). Accordingly, utilities of VGAM1928 include diagnosis, prevention and treatment of diseases and clinical conditions associated with FLJ11126. FLJ11136 (Accession NM_018336) is another VGAM1928 host target gene. FLJ11136 BINDING SITE is HOST TARGET binding site found in the 3' untranslated region of mRNA encoded by FLJ11136, corresponding to a HOST TARGET binding site such as BINDING SITE I, BINDING SITE II or BINDING SITE III. Table 2 illustrates the complementarity of the nucleotide sequences of FLJ11136 BINDING SITE, designated SEQ ID:20339, to the nucleotide sequence of VGAM1928 RNA, herein designated VGAM RNA, also designated SEQ ID:4639.

Another function of VGAM1928 is therefore inhibition of FLJ11136 (Accession NM_018336). Accordingly, utilities of VGAM1928 include diagnosis, prevention and treatment of diseases and clinical conditions associated with FLJ11136. FLJ11186 (Accession NM_018353) is another VGAM1928 host target gene. FLJ11186 BINDING SITE is HOST TARGET binding site found in the 3' untranslated region of mRNA encoded by FLJ11186, corresponding to a HOST TARGET binding site such as BINDING SITE I, BINDING SITE II or BINDING SITE III. Table 2 illustrates the complementarity of the nucleotide sequences of FLJ11186 BINDING SITE, designated SEQ ID:20367, to the nucleotide sequence of VGAM1928 RNA, herein designated VGAM RNA, also designated SEQ ID:4639.

Another function of VGAM1928 is therefore inhibition of FLJ11186 (Accession NM_018353). Accordingly, utilities of VGAM1928 include diagnosis, prevention and treatment of diseases and clinical conditions associated with FLJ11186. FLJ11301 (Accession NM_018385) is another VGAM1928 host target gene. FLJ11301 BINDING SITE is HOST TARGET binding site found in the 3' untranslated region of mRNA encoded by FLJ11301, corresponding to a HOST TARGET binding site such as BINDING SITE I, BINDING SITE II or BINDING SITE III. Table 2 illustrates the complementarity of the nucleotide sequences of FLJ11301 BINDING SITE, designated SEQ ID:20417, to the nucleotide sequence of VGAM1928 RNA, herein designated VGAM RNA, also designated SEQ ID:4639.

Another function of VGAM1928 is therefore inhibition of FLJ11301 (Accession NM_018385). Accordingly, utilities of VGAM1928 include diagnosis, prevention and treatment of diseases and clinical conditions associated with FLJ11301. FLJ11726 (Accession NM_024971) is another VGAM1928 host target gene. FLJ11726 BINDING SITE is HOST TARGET binding site found in the 3' untranslated region of mRNA encoded by FLJ11726, corresponding to a HOST TARGET binding site such as BINDING SITE I, BINDING SITE II or BINDING SITE III. Table 2 illustrates the complementarity of the nucleotide sequences of FLJ11726 BINDING SITE, designated SEQ ID:24528, to the nucleotide sequence of VGAM1928 RNA, herein designated VGAM RNA, also designated SEQ ID:4639.

Another function of VGAM1928 is therefore inhibition of FLJ11726 (Accession NM_024971). Accordingly, utilities of VGAM1928 include diagnosis, prevention and treatment of diseases and clinical conditions associated with FLJ11726. FLJ12122 (Accession NM_024979) is another VGAM1928 host target gene. FLJ12122 BINDING SITE is HOST TARGET binding site found in the 3' untranslated region of mRNA encoded by FLJ12122, corresponding to a HOST TARGET binding site such as BINDING SITE I, BINDING SITE II or BINDING SITE III. Table 2 illustrates the complementarity of the nucleotide sequences of FLJ12122 BINDING SITE, designated SEQ ID:24540, to the nucleotide sequence of VGAM1928 RNA, herein designated VGAM RNA, also designated SEQ ID:4639.

Another function of VGAM1928 is therefore inhibition of FLJ12122 (Accession NM_024979). Accordingly, utilities of VGAM1928 include diagnosis, prevention and treatment of diseases and clinical conditions associated with FLJ12122. FLJ12484 (Accession XM_045681) is another VGAM1928 host target gene. FLJ12484 BINDING SITE1 and FLJ12484 BINDING SITE2 are HOST TARGET binding sites found in untranslated regions of mRNA encoded by FLJ12484, corresponding to HOST TARGET binding sites such as BINDING SITE I, BINDING SITE II or BINDING SITE III. Table 2 illustrates the complementarity of the nucleotide sequences of FLJ12484 BINDING SITE1 and FLJ12484 BINDING SITE2, designated SEQ ID:34521 and SEQ ID:23023 respectively, to the nucleotide sequence of VGAM1928 RNA, herein designated VGAM RNA, also designated SEQ ID:4639.

Another function of VGAM1928 is therefore inhibition of FLJ12484 (Accession XM_045681). Accordingly, utilities of VGAM1928 include diagnosis, prevention and treatment of diseases and clinical conditions associated with FLJ12484. FLJ13241 (Accession NM_025088) is another VGAM1928 host target gene. FLJ13241 BINDING SITE is HOST TARGET binding site found in the 3' untranslated region of mRNA encoded by FLJ13241, corresponding to a HOST TARGET binding site such as BINDING SITE I, BINDING SITE II or BINDING SITE III. Table 2 illustrates the complementarity of the nucleotide sequences of FLJ13241 BINDING SITE, designated SEQ ID:24709, to the nucleotide sequence of VGAM1928 RNA, herein designated VGAM RNA, also designated SEQ ID:4639.

Another function of VGAM1928 is therefore inhibition of FLJ13241 (Accession NM_025088). Accordingly, utilities of VGAM1928 include diagnosis, prevention and treatment of diseases and clinical conditions associated with FLJ13241.

FLJ13912 (Accession NM_022770) is another VGAM1928 host target gene. FLJ13912 BINDING SITE is HOST TARGET binding site found in the 3' untranslated region of mRNA encoded by FLJ13912, corresponding to a HOST TARGET binding site such as BINDING SITE I, BINDING SITE II or BINDING SITE III. Table 2 illustrates the complementarity of the nucleotide sequences of FLJ13912 BINDING SITE, designated SEQ ID:23028, to the nucleotide sequence of VGAM1928 RNA, herein designated VGAM RNA, also designated SEQ ID:4639.

Another function of VGAM1928 is therefore inhibition of FLJ13912 (Accession NM_022770). Accordingly, utilities of VGAM1928 include diagnosis, prevention and treatment of diseases and clinical conditions associated with FLJ13912. FLJ14327 (Accession NM_024912) is another VGAM1928 host target gene. FLJ14327 BINDING SITE is HOST TARGET binding site found in the 3' untranslated region of mRNA encoded by FLJ14327, corresponding to a HOST TARGET binding site such as BINDING SITE I, BINDING SITE II or BINDING SITE III. Table 2 illustrates the complementarity of the nucleotide sequences of FLJ14327 BINDING SITE, designated SEQ ID:24421, to the nucleotide sequence of VGAM1928 RNA, herein designated VGAM RNA, also designated SEQ ID:4639.

Another function of VGAM1928 is therefore inhibition of FLJ14327 (Accession NM_024912). Accordingly, utilities of VGAM1928 include diagnosis, prevention and treatment of diseases and clinical conditions associated with FLJ14327. FLJ14490 (Accession NM_032793) is another VGAM1928 host target gene. FLJ14490 BINDING SITE is HOST TARGET binding site found in the 3' untranslated region of mRNA encoded by FLJ14490, corresponding to a HOST TARGET binding site such as BINDING SITE I, BINDING SITE II or BINDING SITE III. Table 2 illustrates the complementarity of the nucleotide sequences of FLJ14490 BINDING SITE, designated SEQ ID:26546, to the nucleotide sequence of VGAM1928 RNA, herein designated VGAM RNA, also designated SEQ ID:4639.

Another function of VGAM1928 is therefore inhibition of FLJ14490 (Accession NM_032793). Accordingly, utilities of VGAM1928 include diagnosis, prevention and treatment of diseases and clinical conditions associated with FLJ14490. FLJ20069 (Accession NM_017651) is another VGAM1928 host target gene. FLJ20069 BINDING SITE is HOST TARGET binding site found in the 3' untranslated region of mRNA encoded by FLJ20069, corresponding to a HOST TARGET binding site such as BINDING SITE I, BINDING SITE II or BINDING SITE III. Table 2 illustrates the complementarity of the nucleotide sequences of FLJ20069 BINDING SITE, designated SEQ ID:19156, to the nucleotide sequence of VGAM1928 RNA, herein designated VGAM RNA, also designated SEQ ID:4639.

Another function of VGAM1928 is therefore inhibition of FLJ20069 (Accession NM_017651). Accordingly, utilities of VGAM1928 include diagnosis, prevention and treatment of diseases and clinical conditions associated with FLJ20069. FLJ20085 (Accession NM_017660) is another VGAM1928 host target gene. FLJ20085 BINDING SITE is HOST TARGET binding site found in the 3' untranslated region of mRNA encoded by FLJ20085, corresponding to a HOST TARGET binding site such as BINDING SITE I, BINDING SITE II or BINDING SITE III. Table 2 illustrates the complementarity of the nucleotide sequences of FLJ20085 BINDING SITE, designated SEQ ID:19184, to the nucleotide sequence of VGAM1928 RNA, herein designated VGAM RNA, also designated SEQ ID:4639.

Another function of VGAM1928 is therefore inhibition of FLJ20085 (Accession NM_017660). Accordingly, utilities of VGAM1928 include diagnosis, prevention and treatment of diseases and clinical conditions associated with FLJ20085. FLJ20584 (Accession NM_017891) is another VGAM1928 host target gene. FLJ20584 BINDING SITE is HOST TARGET binding site found in the 5' untranslated region of mRNA encoded by FLJ20584, corresponding to a HOST TARGET binding site such as BINDING SITE I, BINDING SITE II or BINDING SITE III. Table 2 illustrates the complementarity of the nucleotide sequences of FLJ20584 BINDING SITE, designated SEQ ID:19561, to the nucleotide sequence of VGAM1928 RNA, herein designated VGAM RNA, also designated SEQ ID:4639.

Another function of VGAM1928 is therefore inhibition of FLJ20584 (Accession NM_017891). Accordingly, utilities of VGAM1928 include diagnosis, prevention and treatment of diseases and clinical conditions associated with FLJ20584. FLJ20666 (Accession NM_017922) is another VGAM1928 host target gene. FLJ20666 BINDING SITE is HOST TARGET binding site found in the 3' untranslated region of mRNA encoded by FLJ20666, corresponding to a HOST TARGET binding site such as BINDING SITE I, BINDING SITE II or BINDING SITE III. Table 2 illustrates the complementarity of the nucleotide sequences of FLJ20666 BINDING SITE, designated SEQ ID:19585, to the nucleotide sequence of VGAM1928 RNA, herein designated VGAM RNA, also designated SEQ ID:4639.

Another function of VGAM1928 is therefore inhibition of FLJ20666 (Accession NM_017922). Accordingly, utilities of VGAM1928 include diagnosis, prevention and treatment of diseases and clinical conditions associated with FLJ20666. FLJ21324 (Accession XM_165988) is another VGAM1928 host target gene. FLJ21324 BINDING SITE is HOST TARGET binding site found in the 5' untranslated region of mRNA encoded by FLJ21324, corresponding to a HOST TARGET binding site such as BINDING SITE I, BINDING SITE II or BINDING SITE III. Table 2 illustrates the complementarity of the nucleotide sequences of FLJ21324 BINDING SITE, designated SEQ ID:43830, to the nucleotide sequence of VGAM1928 RNA, herein designated VGAM RNA, also designated SEQ ID:4639.

Another function of VGAM1928 is therefore inhibition of FLJ21324 (Accession XM_165988). Accordingly, utilities of VGAM1928 include diagnosis, prevention and treatment of diseases and clinical conditions associated with FLJ21324. FLJ21977 (Accession NM_032213) is another VGAM1928 host target gene. FLJ21977 BINDING SITE is HOST TARGET binding site found in the 3' untranslated region of mRNA encoded by FLJ21977, corresponding to a HOST TARGET binding site such as BINDING SITE I, BINDING SITE II or BINDING SITE III. Table 2 illustrates the complementarity of the nucleotide sequences of FLJ21977 BINDING SITE, designated SEQ ID:25940, to the nucleotide sequence of VGAM1928 RNA, herein designated VGAM RNA, also designated SEQ ID:4639.

Another function of VGAM1928 is therefore inhibition of FLJ21977 (Accession NM_032213). Accordingly, utilities of VGAM1928 include diagnosis, prevention and treatment of diseases and clinical conditions associated with FLJ21977. FLJ22202 (Accession NM_024883) is another VGAM1928 host target gene. FLJ22202 BINDING SITE is HOST TARGET binding site found in the 3' untranslated region of mRNA encoded by FLJ22202, corresponding to a HOST TARGET binding site such as BINDING SITE I, BINDING SITE II or BINDING SITE III. Table 2 illustrates the complementarity of the nucleotide sequences of FLJ22202 BIND- ING SITE, designated SEQ ID:24335, to the nucleotide sequence of VGAM1928 RNA, herein designated VGAM RNA, also designated SEQ ID:4639.

Another function of VGAM1928 is therefore inhibition of FLJ22202 (Accession NM_024883). Accordingly, utilities of VGAM1928 include diagnosis, prevention and treatment of diseases and clinical conditions associated with FLJ22202. FLJ22215 (Accession XM_173021) is another VGAM1928 host target gene. FLJ22215 BINDING SITE1 and FLJ22215 BINDING SITE2 are HOST TARGET binding sites found in untranslated regions of mRNA encoded by FLJ22215, corresponding to HOST TARGET binding sites such as BINDING SITE I, BINDING SITE II or BINDING SITE III. Table 2 illustrates the complementarity of the nucleotide sequences of FLJ22215 BINDING SITE1 and FLJ22215 BINDING SITE2, designated SEQ ID:46279 and SEQ ID:23116 respectively, to the nucleotide sequence of VGAM1928 RNA, herein designated VGAM RNA, also designated SEQ ID:4639.

Another function of VGAM1928 is therefore inhibition of FLJ22215 (Accession XM_173021). Accordingly, utilities of VGAM1928 include diagnosis, prevention and treatment of diseases and clinical conditions associated with FLJ22215. FLJ22494 (Accession NM_024815) is another VGAM1928 host target gene. FLJ22494 BINDING SITE is HOST TARGET binding site found in the 5' untranslated region of mRNA encoded by FLJ22494, corresponding to a HOST TARGET binding site such as BINDING SITE I, BINDING SITE II or BINDING SITE III. Table 2 illustrates the complementarity of the nucleotide sequences of FLJ22494 BINDING SITE, designated SEQ ID:24202, to the nucleotide sequence of VGAM1928 RNA, herein designated VGAM RNA, also designated SEQ ID:4639.

Another function of VGAM1928 is therefore inhibition of FLJ22494 (Accession NM_024815). Accordingly, utilities of VGAM1928 include diagnosis, prevention and treatment of diseases and clinical conditions associated with FLJ22494. FLJ22529 (Accession NM_024789) is another VGAM1928 host target gene. FLJ22529 BINDING SITE is HOST TARGET binding site found in the 5' untranslated region of mRNA encoded by FLJ22529, corresponding to a HOST TARGET binding site such as BINDING SITE I, BINDING SITE II or BINDING SITE III. Table 2 illustrates the complementarity of the nucleotide sequences of FLJ22529 BINDING SITE, designated SEQ ID:24169, to the nucleotide sequence of VGAM1928 RNA, herein designated VGAM RNA, also designated SEQ ID:4639.

Another function of VGAM1928 is therefore inhibition of FLJ22529 (Accession NM_024789). Accordingly, utilities of VGAM1928 include diagnosis, prevention and treatment of diseases and clinical conditions associated with FLJ22529. FLJ22746 (Accession NM_024785) is another VGAM1928 host target gene. FLJ22746 BINDING SITE is HOST TARGET binding site found in the 5' untranslated region of mRNA encoded by FLJ22746, corresponding to a HOST TARGET binding site such as BINDING SITE I, BINDING SITE II or BINDING SITE III. Table 2 illustrates the complementarity of the nucleotide sequences of FLJ22746 BINDING SITE, designated SEQ ID:24163, to the nucleotide sequence of VGAM1928 RNA, herein designated VGAM RNA, also designated SEQ ID:4639.

Another function of VGAM1928 is therefore inhibition of FLJ22746 (Accession NM_024785). Accordingly, utilities of VGAM1928 include diagnosis, prevention and treatment of diseases and clinical conditions associated with FLJ22746. FUS Interacting Protein (serine-arginine rich) 1 (FUSIP1, Accession NM_054016) is another VGAM1928 host target gene. FUSIP1 BINDING SITE is HOST TARGET binding site found in the 3' untranslated region of mRNA encoded by FUSIP1, corresponding to a HOST TARGET binding site such as BINDING SITE I, BINDING SITE II or BINDING SITE III. Table 2 illustrates the complementarity of the nucleotide sequences of FUSIP1 BINDING SITE, designated SEQ ID:27623, to the nucleotide sequence of VGAM1928 RNA, herein designated VGAM RNA, also designated SEQ ID:4639.

Another function of VGAM1928 is therefore inhibition of FUS Interacting Protein (serine-arginine rich) 1 (FUSIP1, Accession NM_054016). Accordingly, utilities of VGAM1928 include diagnosis, prevention and treatment of diseases and clinical conditions associated with FUSIP1. GBL (Accession NM_022372) is another VGAM1928 host target gene. GBL BINDING SITE is HOST TARGET binding site found in the 3' untranslated region of mRNA encoded by GBL, corresponding to a HOST TARGET binding site such as BINDING SITE I, BINDING SITE II or BINDING SITE III. Table 2 illustrates the complementarity of the nucleotide sequences of GBL BINDING SITE, designated SEQ ID:22760, to the nucleotide sequence of VGAM1928 RNA, herein designated VGAM RNA, also designated SEQ ID:4639.

Another function of VGAM1928 is therefore inhibition of GBL (Accession NM_022372). Accordingly, utilities of VGAM1928 include diagnosis, prevention and treatment of diseases and clinical conditions associated with GBL. GEMIN7 (Accession NM_024707) is another VGAM1928 host target gene. GEMIN7 BINDING SITE is HOST TARGET binding site found in the 3' untranslated region of mRNA encoded by GEMIN7, corresponding to a HOST TARGET binding site such as BINDING SITE I, BINDING SITE II or BINDING SITE III. Table 2 illustrates the complementarity of the nucleotide sequences of GEMIN7 BINDING SITE, designated SEQ ID:24024, to the nucleotide sequence of VGAM1928 RNA, herein designated VGAM RNA, also designated SEQ ID:4639.

Another function of VGAM1928 is therefore inhibition of GEMIN7 (Accession NM_024707). Accordingly, utilities of VGAM1928 include diagnosis, prevention and treatment of diseases and clinical conditions associated with GEMIN7. Glutamine-fructose-6-phosphate Transaminase 1 (GFPT1, Accession NM_002056) is another VGAM1928 host target gene. GFPT1 BINDING SITE is HOST TARGET binding site found in the 3' untranslated region of mRNA encoded by GFPT1, corresponding to a HOST TARGET binding site such as BINDING SITE I, BINDING SITE II or BINDING SITE III. Table 2 illustrates the complementarity of the nucleotide sequences of GFPT1 BINDING SITE, designated SEQ ID:7818, to the nucleotide sequence of VGAM1928 RNA, herein designated VGAM RNA, also designated SEQ ID:4639.

Another function of VGAM1928 is therefore inhibition of Glutamine-fructose-6-phosphate Transaminase 1 (GFPT1, Accession NM_002056). Accordingly, utilities of VGAM1928 include diagnosis, prevention and treatment of diseases and clinical conditions associated with GFPT1. G Protein Pathway Suppressor 2 (GPS2, Accession XM_102749) is another VGAM1928 host target gene. GPS2 BINDING SITE is HOST TARGET binding site found in the 5' untranslated region of mRNA encoded by GPS2, corresponding to a HOST TARGET binding site such as BINDING SITE I, BINDING SITE II or BINDING SITE III. Table 2 illustrates the complementarity of the nucleotide sequences of GPS2 BINDING SITE, designated SEQ ID:42147, to the nucleotide sequence of VGAM1928 RNA, herein designated VGAM RNA, also designated SEQ ID:4639.

Another function of VGAM1928 is therefore inhibition of G Protein Pathway Suppressor 2 (GPS2, Accession XM_102749). Accordingly, utilities of VGAM1928 include diagnosis, prevention and treatment of diseases and clinical conditions associated with GPS2. Glutamic Pyruvate Transaminase (alanine aminotransferase) 2 (GPT2, Accession NM_133443) is another VGAM1928 host target gene. GPT2 BINDING SITE is HOST TARGET binding site found in the 3' untranslated region of mRNA encoded by GPT2, corresponding to a HOST TARGET binding site such as BINDING SITE I, BINDING SITE II or BINDING SITE III. Table 2 illustrates the complementarity of the nucleotide sequences of GPT2 BINDING SITE, designated SEQ ID:28522, to the nucleotide sequence of VGAM1928 RNA, herein designated VGAM RNA, also designated SEQ ID:4639.

Another function of VGAM1928 is therefore inhibition of Glutamic Pyruvate Transaminase (alanine aminotransferase) 2 (GPT2, Accession NM_133443). Accordingly, utilities of VGAM1928 include diagnosis, prevention and treatment of diseases and clinical conditions associated with GPT2. Glutamic Receptor, Ionotropic, N-methyl-D-aspartate 3A (GRIN3A, Accession NM_133445) is another VGAM1928 host target gene. GRIN3A BINDING SITE is HOST TARGET binding site found in the 3' untranslated region of mRNA encoded by GRIN3A, corresponding to a HOST TARGET binding site such as BINDING SITE I, BINDING SITE II or BINDING SITE III. Table 2 illustrates the complementarity of the nucleotide sequences of GRIN3A BINDING SITE, designated SEQ ID:28530, to the nucleotide sequence of VGAM1928 RNA, herein designated VGAM RNA, also designated SEQ ID:4639.

Another function of VGAM1928 is therefore inhibition of Glutamate Receptor, Ionotropic, N-methyl-D-aspartate 3A (GRIN3A, Accession NM_133445). Accordingly, utilities of VGAM1928 include diagnosis, prevention and treatment of diseases and clinical conditions associated with GRIN3A. GRO2 (Accession XM_003510) is another VGAM1928 host target gene. GRO2 BINDING SITE is HOST TARGET binding site found in the 3' untranslated region of mRNA encoded by GRO2, corresponding to a HOST TARGET binding site such as BINDING SITE I, BINDING SITE II or BINDING SITE III. Table 2 illustrates the complementarity of the nucleotide sequences of GRO2 BINDING SITE, designated SEQ ID:29937, to the nucleotide sequence of VGAM1928 RNA, herein designated VGAM RNA, also designated SEQ ID:4639.

Another function of VGAM1928 is therefore inhibition of GRO2 (Accession XM_003510). Accordingly, utilities of VGAM1928 include diagnosis, prevention and treatment of diseases and clinical conditions associated with GRO2. Hypermethylated In Cancer 2 (HIC2, Accession XM_036937) is another VGAM1928 host target gene. HIC2 BINDING SITE is HOST TARGET binding site found in the 3' untranslated region of mRNA encoded by HIC2, corresponding to a HOST TARGET binding site such as BINDING SITE I, BINDING SITE II or BINDING SITE III. Table 2 illustrates the complementarity of the nucleotide sequences of HIC2 BINDING SITE, designated SEQ ID:32523, to the nucleotide sequence of VGAM1928 RNA, herein designated VGAM RNA, also designated SEQ ID:4639.

Another function of VGAM1928 is therefore inhibition of Hypermethylated In Cancer 2 (HIC2, Accession XM_036937). Accordingly, utilities of VGAM1928 include diagnosis, prevention and treatment of diseases and clinical conditions associated with HIC2. HSC3 (Accession NM_145174) is another VGAM1928 host target gene. HSC3 BINDING SITE is HOST TARGET binding site found in the 3' untranslated region of mRNA encoded by HSC3, corresponding to a HOST TARGET binding site such as BINDING SITE I, BINDING SITE II or BINDING SITE III. Table 2 illustrates the complementarity of the nucleotide sequences of HSC3 BINDING SITE, designated SEQ ID:29734, to the nucleotide sequence of VGAM1928 RNA, herein designated VGAM RNA, also designated SEQ ID:4639.

Another function of VGAM1928 is therefore inhibition of HSC3 (Accession NM_145174). Accordingly, utilities of VGAM1928 include diagnosis, prevention and treatment of diseases and clinical conditions associated with HSC3. HSPC067 (Accession NM_014158) is another VGAM1928 host target gene. HSPC067 BINDING SITE is HOST TARGET binding site found in the 5' untranslated region of mRNA encoded by HSPC067, corresponding to a HOST TARGET binding site such as BINDING SITE I, BINDING SITE II or BINDING SITE III. Table 2 illustrates the complementarity of the nucleotide sequences of HSPC067 BINDING SITE, designated SEQ ID:15458, to the nucleotide sequence of VGAM1928 RNA, herein designated VGAM RNA, also designated SEQ ID:4639.

Another function of VGAM1928 is therefore inhibition of HSPC067 (Accession NM_014158). Accordingly, utilities of VGAM1928 include diagnosis, prevention and treatment of diseases and clinical conditions associated with HSPC067. HSPC073 (Accession NM_014163) is another VGAM1928 host target gene. HSPC073 BINDING SITE is HOST TARGET binding site found in the 5' untranslated region of mRNA encoded by HSPC073, corresponding to a HOST TARGET binding site such as BINDING SITE I, BINDING SITE II or BINDING SITE III. Table 2 illustrates the complementarity of the nucleotide sequences of HSPC073 BINDING SITE, designated SEQ ID:15461, to the nucleotide sequence of VGAM1928 RNA, herein designated VGAM RNA, also designated SEQ ID:4639.

Another function of VGAM1928 is therefore inhibition of HSPC073 (Accession NM_014163). Accordingly, utilities of VGAM1928 include diagnosis, prevention and treatment of diseases and clinical conditions associated with HSPC073. HSPC156 (Accession NM_014178) is another VGAM1928 host target gene. HSPC156 BINDING SITE is HOST TARGET binding site found in the 3' untranslated region of mRNA encoded by HSPC156, corresponding to a HOST TARGET binding site such as BINDING SITE I, BINDING SITE II or BINDING SITE III. Table 2 illustrates the complementarity of the nucleotide sequences of HSPC156 BINDING SITE, designated SEQ ID:15464, to the nucleotide sequence of VGAM1928 RNA, herein designated VGAM RNA, also designated SEQ ID:4639.

Another function of VGAM1928 is therefore inhibition of HSPC156 (Accession NM_014178). Accordingly, utilities of VGAM1928 include diagnosis, prevention and treatment of diseases and clinical conditions associated with HSPC156. HUMZD58C02 (Accession XM_086862) is another VGAM1928 host target gene. HUMZD58C02 BINDING SITE is HOST TARGET binding site found in the 5' untranslated region of mRNA encoded by HUMZD58C02, corresponding to a HOST TARGET binding site such as BINDING SITE I, BINDING SITE II or BINDING SITE III. Table 2 illustrates the complementarity of the nucleotide sequences of HUMZD58C02 BINDING SITE, designated SEQ ID:38930, to the nucleotide sequence of VGAM1928 RNA, herein designated VGAM RNA, also designated SEQ ID:4639.

Another function of VGAM1928 is therefore inhibition of HUMZD58C02 (Accession XM_086862). Accordingly, utilities of VGAM1928 include diagnosis, prevention and treatment of diseases and clinical conditions associated with HUMZD58C02. IMAGE:4907098 (Accession XM_166247) is another VGAM1928 host target gene. IMAGE:4907098 BINDING SITE is HOST TARGET binding site found in the 3' untranslated region of mRNA encoded by IMAGE:4907098, corresponding to a HOST TARGET binding site such as BINDING SITE I, BINDING SITE II or BINDING SITE III. Table 2 illustrates the complementarity of the nucleotide sequences of IMAGE:4907098 BINDING SITE, designated SEQ ID:44058, to the nucleotide sequence of VGAM1928 RNA, herein designated VGAM RNA, also designated SEQ ID:4639.

Another function of VGAM1928 is therefore inhibition of IMAGE:4907098 (Accession XM_166247). Accordingly, utilities of VGAM1928 include diagnosis, prevention and treatment of diseases and clinical conditions associated with IMAGE:4907098. JDD1 (Accession XM_032515) is another VGAM1928 host target gene. JDD1 BINDING SITE is HOST TARGET binding site found in the 3' untranslated region of mRNA encoded by JDD1, corresponding to a HOST TARGET binding site such as BINDING SITE I, BINDING SITE II or BINDING SITE III. Table 2 illustrates the complementarity of the nucleotide sequences of JDD1 BINDING SITE, designated SEQ ID:31669, to the nucleotide sequence of VGAM1928 RNA, herein designated VGAM RNA, also designated SEQ ID:4639.

Another function of VGAM1928 is therefore inhibition of JDD1 (Accession XM_032515). Accordingly, utilities of VGAM1928 include diagnosis, prevention and treatment of diseases and clinical conditions associated with JDD1. Potassium Voltage-gated Channel, Isk-related Family, Member 4 (KCNE4, Accession NM_080671) is another VGAM1928 host target gene. KCNE4 BINDING SITE is HOST TARGET binding site found in the 3' untranslated region of mRNA encoded by KCNE4, corresponding to a HOST TARGET binding site such as BINDING SITE I, BINDING SITE II or BINDING SITE III. Table 2 illustrates the complementarity of the nucleotide sequences of KCNE4 BINDING SITE, designated SEQ ID:27969, to the nucleotide sequence of VGAM1928 RNA, herein designated VGAM RNA, also designated SEQ ID:4639.

Another function of VGAM1928 is therefore inhibition of Potassium Voltage-gated Channel, Isk-related Family, Member 4 (KCNE4, Accession NM_080671). Accordingly, utilities of VGAM1928 include diagnosis, prevention and treatment of diseases and clinical conditions associated with KCNE4. KIAA0205 (Accession NM_014873) is another VGAM1928 host target gene. KIAA0205 BINDING SITE is HOST TARGET binding site found in the 3' untranslated region of mRNA encoded by KIAA0205, corresponding to a HOST TARGET binding site such as BINDING SITE I, BINDING SITE II or BINDING SITE III. Table 2 illustrates the complementarity of the nucleotide sequences of KIAA0205 BINDING SITE, designated SEQ ID:17008, to the nucleotide sequence of VGAM1928 RNA, herein designated VGAM RNA, also designated SEQ ID:4639.

Another function of VGAM1928 is therefore inhibition of KIAA0205 (Accession NM_014873). Accordingly, utilities of VGAM1928 include diagnosis, prevention and treatment of diseases and clinical conditions associated with KIAA0205. KIAA0323 (Accession XM_032634) is another VGAM1928 host target gene. KIAA0323 BINDING SITE is HOST TARGET binding site found in the 3' untranslated region of mRNA encoded by KIAA0323, corresponding to a HOST TARGET binding site such as BINDING SITE I, BINDING SITE II or BINDING SITE III. Table 2 illustrates the complementarity of the nucleotide sequences of KIAA0323 BINDING SITE, designated SEQ ID:31696, to the nucleotide sequence of VGAM1928 RNA, herein designated VGAM RNA, also designated SEQ ID:4639.

Another function of VGAM1928 is therefore inhibition of KIAA0323 (Accession XM_032634). Accordingly, utilities of VGAM1928 include diagnosis, prevention and treatment of diseases and clinical conditions associated with KIAA0323. KIAA0332 (Accession XM_031553) is another VGAM1928 host target gene. KIAA0332 BINDING SITE is HOST TARGET binding site found in the 3' untranslated region of mRNA encoded by KIAA0332, corresponding to a HOST TARGET binding site such as BINDING SITE I, BINDING SITE II or BINDING SITE III. Table 2 illustrates the complementarity of the nucleotide sequences of KIAA0332 BINDING SITE, designated SEQ ID:31418, to the nucleotide sequence of VGAM1928 RNA, herein designated VGAM RNA, also designated SEQ ID:4639.

Another function of VGAM1928 is therefore inhibition of KIAA0332 (Accession XM_031553). Accordingly, utilities of VGAM1928 include diagnosis, prevention and treatment of diseases and clinical conditions associated with KIAA0332. KIAA0335 (Accession NM_014803) is another VGAM1928 host target gene. KIAA0335 BINDING SITE is HOST TARGET binding site found in the 3' untranslated region of mRNA encoded by KIAA0335, corresponding to a HOST TARGET binding site such as BINDING SITE I, BINDING SITE II or BINDING SITE III. Table 2 illustrates the complementarity of the nucleotide sequences of KIAA0335 BINDING SITE, designated SEQ ID:16729, to the nucleotide sequence of VGAM1928 RNA, herein designated VGAM RNA, also designated SEQ ID:4639.

Another function of VGAM1928 is therefore inhibition of KIAA0335 (Accession NM_014803). Accordingly, utilities of VGAM1928 include diagnosis, prevention and treatment of diseases and clinical conditions associated with KIAA0335. KIAA0376 (Accession XM_037759) is another VGAM1928 host target gene. KIAA0376 BINDING SITE is HOST TARGET binding site found in the 3' untranslated region of mRNA encoded by KIAA0376, corresponding to a HOST TARGET binding site such as BINDING SITE I, BINDING SITE II or BINDING SITE III. Table 2 illustrates the complementarity of the nucleotide sequences of KIAA0376 BINDING SITE, designated SEQ ID:32675, to the nucleotide sequence of VGAM1928 RNA, herein designated VGAM RNA, also designated SEQ ID:4639.

Another function of VGAM1928 is therefore inhibition of KIAA0376 (Accession XM_037759). Accordingly, utilities of VGAM1928 include diagnosis, prevention and treatment of diseases and clinical conditions associated with KIAA0376. KIAA0450 (Accession NM_014638) is another VGAM1928 host target gene. KIAA0450 BINDING SITE is HOST TARGET binding site found in the 3' untranslated region of mRNA encoded by KIAA0450, corresponding to a HOST TARGET binding site such as BINDING SITE I, BINDING SITE II or BINDING SITE III. Table 2 illustrates the complementarity of the nucleotide sequences of KIAA0450 BINDING SITE, designated SEQ ID:16030, to the nucleotide sequence of VGAM1928 RNA, herein designated VGAM RNA, also designated SEQ ID:4639.

Another function of VGAM1928 is therefore inhibition of KIAA0450 (Accession NM_014638). Accordingly, utilities of VGAM1928 include diagnosis, prevention and treatment of diseases and clinical conditions associated with KIAA0450. KIAA0478 (Accession NM_014870) is another VGAM1928 host target gene. KIAA0478 BINDING SITE is HOST TARGET binding site found in the 3' untranslated region of mRNA encoded by KIAA0478, corresponding to a HOST TARGET binding site such as BINDING SITE I, BINDING SITE II or BINDING SITE III. Table 2 illustrates the complementarity of the nucleotide sequences of KIAA0478 BINDING SITE, designated SEQ ID:16982, to the nucleotide sequence of VGAM1928 RNA, herein designated VGAM RNA, also designated SEQ ID:4639.

Another function of VGAM1928 is therefore inhibition of KIAA0478 (Accession NM_014870). Accordingly, utilities of VGAM1928 include diagnosis, prevention and treatment of diseases and clinical conditions associated with KIAA0478. KIAA0495 (Accession XM_031397) is another VGAM1928 host target gene. KIAA0495 BINDING SITE is HOST TARGET binding site found in the 5' untranslated region of mRNA encoded by KIAA0495, corresponding to a HOST TARGET binding site such as BINDING SITE I, BINDING SITE II or BINDING SITE III. Table 2 illustrates the complementarity of the nucleotide sequences of KIAA0495 BINDING SITE, designated SEQ ID:31355, to the nucleotide sequence of VGAM1928 RNA, herein designated VGAM RNA, also designated SEQ ID:4639.

Another function of VGAM1928 is therefore inhibition of KIAA0495 (Accession XM_031397). Accordingly, utilities of VGAM1928 include diagnosis, prevention and treatment of diseases and clinical conditions associated with KIAA0495. KIAA0514 (Accession NM_014696) is another VGAM1928 host target gene. KIAA0514 BINDING SITE is HOST TARGET binding site found in the 3' untranslated region of mRNA encoded by KIAA0514, corresponding to a HOST TARGET binding site such as BINDING SITE I, BINDING SITE II or BINDING SITE III. Table 2 illustrates the complementarity of the nucleotide sequences of KIAA0514 BINDING SITE, designated SEQ ID:16203, to the nucleotide sequence of VGAM1928 RNA, herein designated VGAM RNA, also designated SEQ ID:4639.

Another function of VGAM1928 is therefore inhibition of KIAA0514 (Accession NM_014696). Accordingly, utilities of VGAM1928 include diagnosis, prevention and treatment of diseases and clinical conditions associated with KIAA0514. KIAA0523 (Accession XM_041964) is another VGAM1928 host target gene. KIAA0523 BINDING SITE is HOST TARGET binding site found in the 3' untranslated region of mRNA encoded by KIAA0523, corresponding to a HOST TARGET binding site such as BINDING SITE I, BINDING SITE II or BINDING SITE III. Table 2 illustrates the complementarity of the nucleotide sequences of KIAA0523 BINDING SITE, designated SEQ ID:33648, to the nucleotide sequence of VGAM1928 RNA, herein designated VGAM RNA, also designated SEQ ID:4639.

Another function of VGAM1928 is therefore inhibition of KIAA0523 (Accession XM_041964). Accordingly, utilities of VGAM1928 include diagnosis, prevention and treatment of diseases and clinical conditions associated with KIAA0523. KIAA0685 (Accession NM_014678) is another VGAM1928 host target gene. KIAA0685 BINDING SITE is HOST TARGET binding site found in the 3' untranslated region of mRNA encoded by KIAA0685, corresponding to a HOST TARGET binding site such as BINDING SITE I, BINDING SITE II or BINDING SITE III. Table 2 illustrates the complementarity of the nucleotide sequences of KIAA0685 BINDING SITE, designated SEQ ID:16148, to the nucleotide sequence of VGAM1928 RNA, herein designated VGAM RNA, also designated SEQ ID:4639.

Another function of VGAM1928 is therefore inhibition of KIAA0685 (Accession NM_014678). Accordingly, utilities of VGAM1928 include diagnosis, prevention and treatment of diseases and clinical conditions associated with KIAA0685. KIAA0720 (Accession XM_030970) is another VGAM1928 host target gene. KIAA0720 BINDING SITE is HOST TARGET binding site found in the 3' untranslated region of mRNA encoded by KIAA0720, corresponding to a HOST TARGET binding site such as BINDING SITE I, BINDING SITE II or BINDING SITE III. Table 2 illustrates the complementarity of the nucleotide sequences of KIAA0720 BINDING SITE, designated SEQ ID:31235, to the nucleotide sequence of VGAM1928 RNA, herein designated VGAM RNA, also designated SEQ ID:4639.

Another function of VGAM1928 is therefore inhibition of KIAA0720 (Accession XM_030970). Accordingly, utilities of VGAM1928 include diagnosis, prevention and treatment of diseases and clinical conditions associated with KIAA0720. KIAA0961 (Accession NM_014898) is another VGAM1928 host target gene. KIAA0961 BINDING SITE is HOST TARGET binding site found in the 3' untranslated region of mRNA encoded by KIAA0961, corresponding to a HOST TARGET binding site such as BINDING SITE I, BINDING SITE II or BINDING SITE III. Table 2 illustrates the complementarity of the nucleotide sequences of KIAA0961 BINDING SITE, designated SEQ ID:17072, to the nucleotide sequence of VGAM1928 RNA, herein designated VGAM RNA, also designated SEQ ID:4639.

Another function of VGAM1928 is therefore inhibition of KIAA0961 (Accession NM_014898). Accordingly, utilities of VGAM1928 include diagnosis, prevention and treatment of diseases and clinical conditions associated with KIAA0961. KIAA1001 (Accession NM_014960) is another VGAM1928 host target gene. KIAA1001 BINDING SITE is HOST TARGET binding site found in the 3' untranslated region of mRNA encoded by KIAA1001, corresponding to a HOST TARGET binding site such as BINDING SITE I, BINDING SITE II or BINDING SITE III. Table 2 illustrates the complementarity of the nucleotide sequences of KIAA1001 BINDING SITE, designated SEQ ID:17324, to the nucleotide sequence of VGAM1928 RNA, herein designated VGAM RNA, also designated SEQ ID:4639.

Another function of VGAM1928 is therefore inhibition of KIAA1001 (Accession NM_014960). Accordingly, utilities of VGAM1928 include diagnosis, prevention and treatment of diseases and clinical conditions associated with KIAA1001. KIAA1018 (Accession NM_014967) is another VGAM1928 host target gene. KIAA1018 BINDING SITE is HOST TARGET binding site found in the 5' untranslated region of mRNA encoded by KIAA1018, corresponding to a HOST TARGET binding site such as BINDING SITE I, BINDING SITE II or BINDING SITE III. Table 2 illustrates the complementarity of the nucleotide sequences of KIAA1018 BINDING SITE, designated SEQ ID:17355, to the nucleotide sequence of VGAM1928 RNA, herein designated VGAM RNA, also designated SEQ ID:4639.

Another function of VGAM1928 is therefore inhibition of KIAA1018 (Accession NM_014967). Accordingly, utilities of VGAM1928 include diagnosis, prevention and treatment of diseases and clinical conditions associated with KIAA1018. KIAA1023 (Accession NM_017604) is another VGAM1928 host target gene. KIAA1023 BINDING SITE1 through KIAA1023 BINDING SITE3 are HOST TARGET binding sites found in untranslated regions of mRNA encoded by KIAA1023, corresponding to HOST TARGET binding sites such as BINDING SITE I, BINDING SITE II or BINDING SITE III. Table 2 illustrates the complementarity of the nucleotide sequences of KIAA1023 BINDING SITE1 through KIAA1023 BINDING SITE3, designated SEQ ID:19097, SEQ ID:19095 and SEQ ID:19096 respectively, to the nucleotide sequence of VGAM1928 RNA, herein designated VGAM RNA, also designated SEQ ID:4639.

Another function of VGAM1928 is therefore inhibition of KIAA1023 (Accession NM_017604). Accordingly, utilities of VGAM1928 include diagnosis, prevention and treatment of diseases and clinical conditions associated with KIAA1023. KIAA1036 (Accession NM_014909) is another VGAM1928 host target gene. KIAA1036 BINDING SITE is HOST TARGET binding site found in the 3' untranslated region of mRNA encoded by KIAA1036, corresponding to a HOST TARGET binding site such as BINDING SITE I, BINDING SITE II or BINDING SITE III. Table 2 illustrates the complementarity of the nucleotide sequences of KIAA1036 BINDING SITE, designated SEQ ID:17130, to the nucleotide sequence of VGAM1928 RNA, herein designated VGAM RNA, also designated SEQ ID:4639.

Another function of VGAM1928 is therefore inhibition of KIAA1036 (Accession NM_014909). Accordingly, utilities of VGAM1928 include diagnosis, prevention and treatment of diseases and clinical conditions associated with KIAA1036. KIAA1161 (Accession XM_088501) is another VGAM1928 host target gene. KIAA1161 BINDING SITE is HOST TARGET binding site found in the 5' untranslated region of mRNA encoded by KIAA1161, corresponding to a HOST TARGET binding site such as BINDING SITE I, BINDING SITE II or BINDING SITE III. Table 2 illustrates the complementarity of the nucleotide sequences of KIAA1161 BINDING SITE, designated SEQ ID:39747, to the nucleotide sequence of VGAM1928 RNA, herein designated VGAM RNA, also designated SEQ ID:4639.

Another function of VGAM1928 is therefore inhibition of KIAA1161 (Accession XM_088501). Accordingly, utilities of VGAM1928 include diagnosis, prevention and treatment of diseases and clinical conditions associated with KIAA1161. KIAA1170 (Accession XM_045907) is another VGAM1928 host target gene. KIAA1170 BINDING SITE is HOST TARGET binding site found in the 3' untranslated region of mRNA encoded by KIAA1170, corresponding to a HOST TARGET binding site such as BINDING SITE I, BINDING SITE II or BINDING SITE III. Table 2 illustrates the complementarity of the nucleotide sequences of KIAA1170 BINDING SITE, designated SEQ ID:34614, to the nucleotide sequence of VGAM1928 RNA, herein designated VGAM RNA, also designated SEQ ID:4639.

Another function of VGAM1928 is therefore inhibition of KIAA1170 (Accession XM_045907). Accordingly, utilities of VGAM1928 include diagnosis, prevention and treatment of diseases and clinical conditions associated with KIAA1170. KIAA1183 (Accession XM_031307) is another VGAM1928 host target gene. KIAA1183 BINDING SITE is HOST TARGET binding site found in the 3' untranslated region of mRNA encoded by KIAA1183, corresponding to a HOST TARGET binding site such as BINDING SITE I, BINDING SITE II or BINDING SITE III. Table 2 illustrates the complementarity of the nucleotide sequences of KIAA1183 BINDING SITE, designated SEQ ID:31336, to the nucleotide sequence of VGAM1928 RNA, herein designated VGAM RNA, also designated SEQ ID:4639.

Another function of VGAM1928 is therefore inhibition of KIAA1183 (Accession XM_031307). Accordingly, utilities of VGAM1928 include diagnosis, prevention and treatment of diseases and clinical conditions associated with KIAA1183. KIAA1233 (Accession XM_032181) is another VGAM1928 host target gene. KIAA1233 BINDING SITE is HOST TARGET binding site found in the 3' untranslated region of mRNA encoded by KIAA1233, corresponding to a HOST TARGET binding site such as BINDING SITE I, BINDING SITE II or BINDING SITE III. Table 2 illustrates the complementarity of the nucleotide sequences of KIAA1233 BINDING SITE, designated SEQ ID:31592, to the nucleotide sequence of VGAM1928 RNA, herein designated VGAM RNA, also designated SEQ ID:4639.

Another function of VGAM1928 is therefore inhibition of KIAA1233 (Accession XM_032181). Accordingly, utilities of VGAM1928 include diagnosis, prevention and treatment of diseases and clinical conditions associated with KIAA1233. KIAA1466 (Accession XM_050285) is another VGAM1928 host target gene. KIAA1466 BINDING SITE is HOST TARGET binding site found in the 5' untranslated region of mRNA encoded by KIAA1466, corresponding to a HOST TARGET binding site such as BINDING SITE I, BINDING SITE II or BINDING SITE III. Table 2 illustrates the complementarity of the nucleotide sequences of KIAA1466 BINDING SITE, designated SEQ ID:35603, to the nucleotide sequence of VGAM1928 RNA, herein designated VGAM RNA, also designated SEQ ID:4639.

Another function of VGAM1928 is therefore inhibition of KIAA1466 (Accession XM_050285). Accordingly, utilities of VGAM1928 include diagnosis, prevention and treatment of diseases and clinical conditions associated with KIAA1466. KIAA1656 (Accession XM_038022) is another VGAM1928 host target gene. KIAA1656 BINDING SITE is HOST TARGET binding site found in the 3' untranslated region of mRNA encoded by KIAA1656, corresponding to a HOST TARGET binding site such as BINDING SITE I, BINDING SITE II or BINDING SITE III. Table 2 illustrates the complementarity of the nucleotide sequences of KIAA1656 BINDING SITE, designated SEQ ID:32726, to the nucleotide sequence of VGAM1928 RNA, herein designated VGAM RNA, also designated SEQ ID:4639.

Another function of VGAM1928 is therefore inhibition of KIAA1656 (Accession XM_038022). Accordingly, utilities of VGAM1928 include diagnosis, prevention and treatment of diseases and clinical conditions associated with KIAA1656. KIAA1691 (Accession XM_166523) is another VGAM1928 host target gene. KIAA1691 BINDING SITE is HOST TARGET binding site found in the 3' untranslated region of mRNA encoded by KIAA1691, corresponding to a HOST TARGET binding site such as BINDING SITE I, BINDING SITE II or BINDING SITE III. Table 2 illustrates the complementarity of the nucleotide sequences of KIAA1691 BINDING SITE, designated SEQ ID:44463, to the nucleotide sequence of VGAM1928 RNA, herein designated VGAM RNA, also designated SEQ ID:4639.

Another function of VGAM1928 is therefore inhibition of KIAA1691 (Accession XM_166523). Accordingly, utilities of VGAM1928 include diagnosis, prevention and treatment of diseases and clinical conditions associated with KIAA1691. KIAA1913 (Accession XM_058167) is another VGAM1928 host target gene. KIAA1913 BINDING SITE is HOST TARGET binding site found in the 3' untranslated region of mRNA encoded by KIAA1913, corresponding to a HOST TARGET binding site such as BINDING SITE I, BINDING SITE II or BINDING SITE III. Table 2 illustrates the complementarity of the nucleotide sequences of KIAA1913 BINDING SITE, designated SEQ ID:36578, to the nucleotide sequence of VGAM1928 RNA, herein designated VGAM RNA, also designated SEQ ID:4639.

Another function of VGAM1928 is therefore inhibition of KIAA1913 (Accession XM_058167). Accordingly, utilities of VGAM1928 include diagnosis, prevention and treatment of diseases and clinical conditions associated with KIAA1913. Lectin, Galactoside-binding, Soluble, 8 (galectin 8) (LGALS8, Accession NM_006499) is another VGAM1928 host target gene. LGALS8 BINDING SITE is HOST TARGET binding site found in the 3' untranslated region of mRNA encoded by LGALS8, corresponding to a HOST TARGET binding site such as BINDING SITE I, BINDING SITE II or BINDING SITE III. Table 2 illustrates the complementarity of the nucleotide sequences of LGALS8 BINDING SITE, designated SEQ ID:13246, to the nucleotide sequence of VGAM1928 RNA, herein designated VGAM RNA, also designated SEQ ID:4639.

Another function of VGAM1928 is therefore inhibition of Lectin, Galactoside-binding, Soluble, 8 (galectin 8) (LGALS8, Accession NM_006499). Accordingly, utilities of VGAM1928 include diagnosis, prevention and treatment of diseases and clinical conditions associated with LGALS8. LIN-28 (Accession NM_024674) is another VGAM1928 host target gene. LIN-28 BINDING SITE is HOST TARGET binding site found in the 3' untranslated region of mRNA encoded by LIN-28, corresponding to a HOST TARGET binding site such as BINDING SITE I, BINDING SITE II or BINDING SITE III. Table 2 illustrates the complementarity of the nucleotide sequences of LIN-28 BINDING SITE, designated SEQ ID:23982, to the nucleotide sequence of VGAM1928 RNA, herein designated VGAM RNA, also designated SEQ ID:4639.

Another function of VGAM1928 is therefore inhibition of LIN-28 (Accession NM_024674). Accordingly, utilities of VGAM1928 include diagnosis, prevention and treatment of diseases and clinical conditions associated with LIN-28. Methyl-CpG Binding Domain Protein 2 (MBD2, Accession NM_015832) is another VGAM1928 host target gene. MBD2 BINDING SITE is HOST TARGET binding site found in the 5' untranslated region of mRNA encoded by MBD2, corresponding to a HOST TARGET binding site such as BINDING SITE I, BINDING SITE II or BINDING SITE III. Table 2 illustrates the complementarity of the nucleotide sequences of MBD2 BINDING SITE, designated SEQ ID:17945, to the nucleotide sequence of VGAM1928 RNA, herein designated VGAM RNA, also designated SEQ ID:4639.

Another function of VGAM1928 is therefore inhibition of Methyl-CpG Binding Domain Protein 2 (MBD2, Accession NM_015832). Accordingly, utilities of VGAM1928 include diagnosis, prevention and treatment of diseases and clinical conditions associated with MBD2. MGC10960 (Accession NM_032653) is another VGAM1928 host target gene. MGC10960 BINDING SITE is HOST TARGET binding site found in the 3' untranslated region of mRNA encoded by MGC10960, corresponding to a HOST TARGET binding site such as BINDING SITE I, BINDING SITE II or BINDING SITE III. Table 2 illustrates the complementarity of the nucleotide sequences of MGC10960 BINDING SITE, designated SEQ ID:26382, to the nucleotide sequence of VGAM1928 RNA, herein designated VGAM RNA, also designated SEQ ID:4639.

Another function of VGAM1928 is therefore inhibition of MGC10960 (Accession NM_032653). Accordingly, utilities of VGAM1928 include diagnosis, prevention and treatment of diseases and clinical conditions associated with MGC10960. MGC20496 (Accession NM_052845) is another VGAM1928 host target gene. MGC20496 BINDING SITE is HOST TARGET binding site found in the 3' untranslated region of mRNA encoded by MGC20496, corresponding to a HOST TARGET binding site such as BINDING SITE I, BINDING SITE II or BINDING SITE III. Table 2 illustrates the complementarity of the nucleotide sequences of MGC20496 BINDING SITE, designated SEQ ID:27424, to the nucleotide sequence of VGAM1928 RNA, herein designated VGAM RNA, also designated SEQ ID:4639.

Another function of VGAM1928 is therefore inhibition of MGC20496 (Accession NM_052845). Accordingly, utilities of VGAM1928 include diagnosis, prevention and treatment of diseases and clinical conditions associated with MGC20496. MGC2474 (Accession NM_023931) is another VGAM1928 host target gene. MGC2474 BINDING SITE is HOST TARGET binding site found in the 3' untranslated region of mRNA encoded by MGC2474, corresponding to a HOST TARGET binding site such as BINDING SITE I, BINDING SITE II or BINDING SITE III. Table 2 illustrates the complementarity of the nucleotide sequences of MGC2474 BINDING SITE, designated SEQ ID:23419, to the nucleotide sequence of VGAM1928 RNA, herein designated VGAM RNA, also designated SEQ ID:4639.

Another function of VGAM1928 is therefore inhibition of MGC2474 (Accession NM_023931). Accordingly, utilities of VGAM1928 include diagnosis, prevention and treatment of diseases and clinical conditions associated with MGC2474. MGC2628 (Accession NM_024076) is another VGAM1928 host target gene. MGC2628 BINDING SITE is HOST TARGET binding site found in the 3' untranslated region of mRNA encoded by MGC2628, corresponding to a HOST TARGET binding site such as BINDING SITE I, BINDING SITE II or BINDING SITE III. Table 2 illustrates the complementarity of the nucleotide sequences of MGC2628 BINDING SITE, designated SEQ ID:23510, to the nucleotide sequence of VGAM1928 RNA, herein designated VGAM RNA, also designated SEQ ID:4639.

Another function of VGAM1928 is therefore inhibition of MGC2628 (Accession NM_024076). Accordingly, utilities of VGAM1928 include diagnosis, prevention and treatment of diseases and clinical conditions associated with MGC2628. MGC26641 (Accession NM_144971) is another VGAM1928 host target gene. MGC26641 BINDING SITE is HOST TARGET binding site found in the 3' untranslated region of mRNA encoded by MGC26641, corresponding to a HOST TARGET binding site such as BINDING SITE I, BINDING SITE II or BINDING SITE III. Table 2 illustrates the complementarity of the nucleotide sequences of MGC26641 BINDING SITE, designated SEQ ID:29585, to the nucleotide sequence of VGAM1928 RNA, herein designated VGAM RNA, also designated SEQ ID:4639.

Another function of VGAM1928 is therefore inhibition of MGC26641 (Accession NM_144971). Accordingly, utilities of VGAM1928 include diagnosis, prevention and treatment of diseases and clinical conditions associated with MGC26641. MGC2752 (Accession XM_085842) is another VGAM1928 host target gene. MGC2752 BINDING SITE is HOST TARGET binding site found in the 5' untranslated region of mRNA encoded by MGC2752, corresponding to a HOST TARGET binding site such as BINDING SITE I, BINDING SITE II or BINDING SITE III. Table 2 illustrates the complementarity of the nucleotide sequences of MGC2752 BINDING SITE, designated SEQ ID:38368, to the nucleotide sequence of VGAM1928 RNA, herein designated VGAM RNA, also designated SEQ ID:4639.

Another function of VGAM1928 is therefore inhibition of MGC2752 (Accession XM_085842). Accordingly, utilities of VGAM1928 include diagnosis, prevention and treatment of diseases and clinical conditions associated with MGC2752. MGC35521 (Accession NM_145065) is another VGAM1928 host target gene. MGC35521 BINDING SITE is HOST TARGET binding site found in the 3' untranslated region of mRNA encoded by MGC35521, corresponding to a HOST TARGET binding site such as BINDING SITE I, BINDING SITE II or BINDING SITE III. Table 2 illustrates the complementarity of the nucleotide sequences of MGC35521 BINDING SITE, designated SEQ ID:29704, to the nucleotide sequence of VGAM1928 RNA, herein designated VGAM RNA, also designated SEQ ID:4639.

Another function of VGAM1928 is therefore inhibition of MGC35521 (Accession NM_145065). Accordingly, utilities of VGAM1928 include diagnosis, prevention and treatment of diseases and clinical conditions associated with MGC35521. MGC4677 (Accession NM_052871) is another VGAM1928 host target gene. MGC4677 BINDING SITE is HOST TARGET binding site found in the 5' untranslated region of mRNA encoded by MGC4677, corresponding to a HOST TARGET binding site such as BINDING SITE I, BINDING SITE II or BINDING SITE III. Table 2 illustrates the complementarity of the nucleotide sequences of MGC4677 BINDING SITE, designated SEQ ID:27450, to the nucleotide sequence of VGAM1928 RNA, herein designated VGAM RNA, also designated SEQ ID:4639.

Another function of VGAM1928 is therefore inhibition of MGC4677 (Accession NM_052871). Accordingly, utilities of VGAM1928 include diagnosis, prevention and treatment of diseases and clinical conditions associated with MGC4677. MGC7036 (Accession NM_145058) is another VGAM1928 host target gene. MGC7036 BINDING SITE is HOST TARGET binding site found in the 5' untranslated region of mRNA encoded by MGC7036, corresponding to a HOST TARGET binding site such as BINDING SITE I, BINDING SITE II or BINDING SITE III. Table 2 illustrates the complementarity of the nucleotide sequences of MGC7036 BINDING SITE, designated SEQ ID:29693, to the nucleotide sequence of VGAM1928 RNA, herein designated VGAM RNA, also designated SEQ ID:4639.

Another function of VGAM1928 is therefore inhibition of MGC7036 (Accession NM_145058). Accordingly, utilities of VGAM1928 include diagnosis, prevention and treatment of diseases and clinical conditions associated with MGC7036. MGC9753 (Accession NM_033419) is another VGAM1928 host target gene. MGC9753 BINDING SITE is HOST TARGET binding site found in the 3' untranslated region of mRNA encoded by MGC9753, corresponding to a HOST TARGET binding site such as BINDING SITE I, BINDING SITE II or BINDING SITE III. Table 2 illustrates the complementarity of the nucleotide sequences of MGC9753 BINDING SITE, designated SEQ ID:27246, to the nucleotide sequence of VGAM1928 RNA, herein designated VGAM RNA, also designated SEQ ID:4639.

Another function of VGAM1928 is therefore inhibition of MGC9753 (Accession NM_033419). Accordingly, utilities of VGAM1928 include diagnosis, prevention and treatment of diseases and clinical conditions associated with MGC9753. MIG (Accession NM_002416) is another VGAM1928 host target gene. MIG BINDING SITE is HOST TARGET binding site found in the 3' untranslated region of mRNA encoded by MIG, corresponding to a HOST TARGET binding site such as BINDING SITE I, BINDING SITE II or BINDING SITE III. Table 2 illustrates the complementarity of the nucleotide sequences of MIG BINDING SITE, designated SEQ ID:8250, to the nucleotide sequence of VGAM1928 RNA, herein designated VGAM RNA, also designated SEQ ID:4639.

Another function of VGAM1928 is therefore inhibition of MIG (Accession NM_002416). Accordingly, utilities of VGAM1928 include diagnosis, prevention and treatment of diseases and clinical conditions associated with MIG. Mitochondrial Ribosomal Protein L35 (MRPL35, Accession NM_016622) is another VGAM1928 host target gene. MRPL35 BINDING SITE is HOST TARGET binding site found in the 3' untranslated region of mRNA encoded by MRPL35, corresponding to a HOST TARGET binding site such as BINDING SITE I, BINDING SITE II or BINDING SITE III. Table 2 illustrates the complementarity of the nucleotide sequences of MRPL35 BINDING SITE, designated SEQ ID:18736, to the nucleotide sequence of VGAM1928 RNA, herein designated VGAM RNA, also designated SEQ ID:4639.

Another function of VGAM1928 is therefore inhibition of Mitochondrial Ribosomal Protein L35 (MRPL35, Accession NM_016622). Accordingly, utilities of VGAM1928 include diagnosis, prevention and treatment of diseases and clinical conditions associated with MRPL35. Mitochondrial Ribosomal Protein S27 (MRPS27, Accession NM_015084) is another VGAM1928 host target gene. MRPS27 BINDING SITE is HOST TARGET binding site found in the 3' untranslated region of mRNA encoded by MRPS27, corresponding to a HOST TARGET binding site such as BINDING SITE I, BINDING SITE II or BINDING SITE III. Table 2 illustrates the complementarity of the nucleotide sequences of MRPS27 BINDING SITE, designated SEQ ID:17474, to the nucleotide sequence of VGAM1928 RNA, herein designated VGAM RNA, also designated SEQ ID:4639.

Another function of VGAM1928 is therefore inhibition of Mitochondrial Ribosomal Protein S27 (MRPS27, Accession NM_015084). Accordingly, utilities of VGAM1928 include diagnosis, prevention and treatment of diseases and clinical conditions associated with MRPS27. Neuroblastoma, Suppression of Tumorigenicity 1 (NBL1, Accession XM_001434) is another VGAM1928 host target gene. NBL1 BINDING SITE is HOST TARGET binding site found in the 3' untranslated region of mRNA encoded by NBL1, corresponding to a HOST TARGET binding site such as BINDING SITE I, BINDING SITE II or BINDING SITE III. Table 2 illustrates the complementarity of the nucleotide sequences of NBL1 BINDING SITE, designated SEQ ID:29840, to the nucleotide sequence of VGAM1928 RNA, herein designated VGAM RNA, also designated SEQ ID:4639.

Another function of VGAM1928 is therefore inhibition of Neuroblastoma, Suppression of Tumorigenicity 1 (NBL1, Accession XM_001434). Accordingly, utilities of VGAM1928 include diagnosis, prevention and treatment of diseases and clinical conditions associated with NBL1. NCK Adaptor Protein 1 (NCK1, Accession NM_006153) is another VGAM1928 host target gene. NCK1 BINDING SITE is HOST TARGET binding site found in the 3' untranslated region of mRNA encoded by NCK1, corresponding to a HOST TARGET binding site such as BINDING SITE I, BINDING SITE II or BINDING SITE III. Table 2 illustrates the complementarity of the nucleotide sequences of NCK1 BINDING SITE, designated SEQ ID:12811, to the nucleotide sequence of VGAM1928 RNA, herein designated VGAM RNA, also designated SEQ ID:4639.

Another function of VGAM1928 is therefore inhibition of NCK Adaptor Protein 1 (NCK1, Accession NM_006153). Accordingly, utilities of VGAM1928 include diagnosis, prevention and treatment of diseases and clinical conditions associated with NCK1. NKX2C (Accession NM_145285) is another VGAM1928 host target gene. NKX2C BINDING SITE is HOST TARGET binding site found in the 3' untranslated region of mRNA encoded by NKX2C, corresponding to a HOST TARGET binding site such as BINDING SITE I, BINDING SITE II or BINDING SITE III. Table 2 illustrates the complementarity of the nucleotide sequences of NKX2C BINDING SITE, designated SEQ ID:29802, to the nucleotide sequence of VGAM1928 RNA, herein designated VGAM RNA, also designated SEQ ID:4639.

Another function of VGAM1928 is therefore inhibition of NKX2C (Accession NM_145285). Accordingly, utilities of VGAM1928 include diagnosis, prevention and treatment of diseases and clinical conditions associated with NKX2C. Obscurin, Cytoskeletal Calmodulin and Titin-interacting RhoGEF (OBSCN, Accession XM_047536) is another VGAM1928 host target gene. OBSCN BINDING SITE is HOST TARGET binding site found in the 3' untranslated region of mRNA encoded by OBSCN, corresponding to a HOST TARGET binding site such as BINDING SITE I, BINDING SITE II or BINDING SITE III. Table 2 illustrates the complementarity of the nucleotide sequences of OBSCN BINDING SITE, designated SEQ ID:34988, to the nucleotide sequence of VGAM1928 RNA, herein designated VGAM RNA, also designated SEQ ID:4639.

Another function of VGAM1928 is therefore inhibition of Obscurin, Cytoskeletal Calmodulin and Titin-interacting RhoGEF (OBSCN, Accession XM_047536). Accordingly, utilities of VGAM1928 include diagnosis, prevention and treatment of diseases and clinical conditions associated with OBSCN. ORM1-like 2 (S. cerevisiae) (ORMDL2, Accession NM_014182) is another VGAM1928 host target gene. ORMDL2 BINDING SITE is HOST TARGET binding site found in the 3' untranslated region of mRNA encoded by ORMDL2, corresponding to a HOST TARGET binding site such as BINDING SITE I, BINDING SITE II or BINDING SITE III. Table 2 illustrates the complementarity of the nucleotide sequences of ORMDL2 BINDING SITE, designated SEQ ID:15468, to the nucleotide sequence of VGAM1928 RNA, herein designated VGAM RNA, also designated SEQ ID:4639.

Another function of VGAM1928 is therefore inhibition of ORM1-like 2 (S. cerevisiae) (ORMDL2, Accession NM_014182). Accordingly, utilities of VGAM1928 include diagnosis, prevention and treatment of diseases and clinical conditions associated with ORMDL2. Oxysterol Binding Protein-like 8 (OSBPL8, Accession NM_020841) is another VGAM1928 host target gene. OSBPL8 BINDING SITE1 and OSBPL8 BINDING SITE2 are HOST TARGET binding sites found in untranslated regions of mRNA encoded by OSBPL8, corresponding to HOST TARGET binding sites such as BINDING SITE I, BINDING SITE II or BINDING SITE III. Table 2 illustrates the complementarity of the nucleotide sequences of OSBPL8 BINDING SITE1 and OSBPL8 BINDING SITE2, designated SEQ ID:21904 and SEQ ID:21905 respectively, to the nucleotide sequence of VGAM1928 RNA, herein designated VGAM RNA, also designated SEQ ID:4639.

Another function of VGAM1928 is therefore inhibition of Oxysterol Binding Protein-like 8 (OSBPL8, Accession NM_020841). Accordingly, utilities of VGAM1928 include diagnosis, prevention and treatment of diseases and clinical conditions associated with OSBPL8. Phosphodiesterase 4D Interacting Protein (myomegalin) (PDE4DIP, Accession NM_014644) is another VGAM1928 host target gene. PDE4DIP BINDING SITE is HOST TARGET binding site found in the 3' untranslated region of mRNA encoded by PDE4DIP, corresponding to a HOST TARGET binding site such as BINDING SITE I, BINDING SITE II or BINDING SITE III. Table 2 illustrates the complementarity of the nucleotide sequences of PDE4DIP BINDING SITE, designated SEQ ID:16053, to the nucleotide sequence of VGAM1928 RNA, herein designated VGAM RNA, also designated SEQ ID:4639.

Another function of VGAM1928 is therefore inhibition of Phosphodiesterase 4D Interacting Protein (myomegalin) (PDE4DIP, Accession NM_014644). Accordingly, utilities of VGAM1928 include diagnosis, prevention and treatment of diseases and clinical conditions associated with PDE4DIP. PEPP3 (Accession NM_014935) is another VGAM1928 host target gene. PEPP3 BINDING SITE is HOST TARGET binding site found in the 3' untranslated region of mRNA encoded by PEPP3, corresponding to a HOST TARGET binding site such as BINDING SITE I, BINDING SITE II or BINDING SITE III. Table 2 illustrates the complementarity of the nucleotide sequences of PEPP3 BINDING SITE, designated SEQ ID:17237, to the nucleotide sequence of VGAM1928 RNA, herein designated VGAM RNA, also designated SEQ ID:4639.

Another function of VGAM1928 is therefore inhibition of PEPP3 (Accession NM_014935). Accordingly, utilities of VGAM1928 include diagnosis, prevention and treatment of diseases and clinical conditions associated with PEPP3. PIP3-E (Accession XM_039749) is another VGAM1928 host target gene. PIP3-E BINDING SITE is HOST TARGET binding site found in the 3' untranslated region of mRNA encoded by PIP3-E, corresponding to a HOST TARGET binding site such as BINDING SITE I, BINDING SITE II or BINDING SITE III. Table 2 illustrates the complementarity of the nucleotide sequences of PIP3-E BINDING SITE, designated SEQ ID:33183, to the nucleotide sequence of VGAM1928 RNA, herein designated VGAM RNA, also designated SEQ ID:4639.

Another function of VGAM1928 is therefore inhibition of PIP3-E (Accession XM_039749). Accordingly, utilities of VGAM1928 include diagnosis, prevention and treatment of diseases and clinical conditions associated with PIP3-E. Protein-O-mannosyltransferase 1 (POMT1, Accession NM_007171) is another VGAM1928 host target gene. POMT1 BINDING SITE is HOST TARGET binding site found in the 3' untranslated region of mRNA encoded by POMT1, corresponding to a HOST TARGET binding site such as BINDING SITE I, BINDING SITE II or BINDING SITE III. Table 2 illustrates the complementarity of the nucleotide sequences of POMT1 BINDING SITE, designated SEQ ID:14017, to the nucleotide sequence of VGAM1928 RNA, herein designated VGAM RNA, also designated SEQ ID:4639.

Another function of VGAM1928 is therefore inhibition of Protein-O-mannosyltransferase 1 (POMT1, Accession NM_007171). Accordingly, utilities of VGAM1928 include diagnosis, prevention and treatment of diseases and clinical conditions associated with POMT1. Protein Tyrosine Phosphatase, Receptor Type, F Polypeptide (PTPRF), Interacting Protein (liprin), Alpha 4 (PPFIA4, Accession XM_046751) is another VGAM1928 host target gene. PPFIA4 BINDING SITE is HOST TARGET binding site found in the 3' untranslated region of mRNA encoded by PPFIA4, corresponding to a HOST TARGET binding site such as BINDING SITE I, BINDING SITE II or BINDING SITE III. Table 2 illustrates the complementarity of the nucleotide sequences of PPFIA4 BINDING SITE, designated SEQ ID:34818, to the nucleotide sequence of VGAM1928 RNA, herein designated VGAM RNA, also designated SEQ ID:4639.

Another function of VGAM1928 is therefore inhibition of Protein Tyrosine Phosphatase, Receptor Type, F Polypeptide (PTPRF), Interacting Protein (liprin), Alpha 4 (PPFIA4, Accession XM_046751). Accordingly, utilities of VGAM1928 include diagnosis, prevention and treatment of diseases and clinical conditions associated with PPFIA4. Protein Phosphatase 1, Regulatory (inhibitor) Subunit 14A (PPP1R14A, Accession NM_033256) is another VGAM1928 host target gene. PPP1R14A BINDING SITE is HOST TARGET binding site found in the 5' untranslated region of mRNA encoded by PPP1R14A, corresponding to a HOST TARGET binding site such as BINDING SITE I, BINDING SITE II or BINDING SITE III. Table 2 illustrates the complementarity of the nucleotide sequences of PPP1R14A BINDING SITE, designated SEQ ID:27088, to the nucleotide sequence of VGAM1928 RNA, herein designated VGAM RNA, also designated SEQ ID:4639.

Another function of VGAM1928 is therefore inhibition of Protein Phosphatase 1, Regulatory (inhibitor) Subunit 14A (PPP1R14A, Accession NM_033256). Accordingly, utilities of VGAM1928 include diagnosis, prevention and treatment of diseases and clinical conditions associated with PPP1R14A. Protein Phosphatase 1, Regulatory (inhibitor) Subunit 3B (PPP1R3B, Accession NM_024607) is another VGAM1928 host target gene. PPP1R3B BINDING SITE is HOST TARGET binding site found in the 3' untranslated region of mRNA encoded by PPP1R3B, corresponding to a HOST TARGET binding site such as BINDING SITE I, BINDING SITE II or BINDING SITE III. Table 2 illustrates the complementarity of the nucleotide sequences of PPP1R3B BINDING SITE, designated SEQ ID:23854, to the nucleotide sequence of VGAM1928 RNA, herein designated VGAM RNA, also designated SEQ ID:4639.

Another function of VGAM1928 is therefore inhibition of Protein Phosphatase 1, Regulatory (inhibitor) Subunit 3B (PPP1R3B, Accession NM_024607). Accordingly, utilities of VGAM1928 include diagnosis, prevention and treatment of diseases and clinical conditions associated with PPP1R3B. PRO0659 (Accession NM_014138) is another VGAM1928 host target gene. PRO0659 BINDING SITE is HOST TARGET binding site found in the 3' untranslated region of mRNA encoded by PRO0659, corresponding to a HOST TARGET binding site such as BINDING SITE I, BINDING SITE II or BINDING SITE III. Table 2 illustrates the complementarity of the nucleotide sequences of PRO0659 BINDING SITE, designated SEQ ID:15408, to the nucleotide sequence of VGAM1928 RNA, herein designated VGAM RNA, also designated SEQ ID:4639.

Another function of VGAM1928 is therefore inhibition of PRO0659 (Accession NM_014138). Accordingly, utilities of VGAM1928 include diagnosis, prevention and treatment of diseases and clinical conditions associated with PRO0659. PRO1855 (Accession NM_018509) is another VGAM1928 host target gene. PRO1855 BINDING SITE is HOST TARGET binding site found in the 3' untranslated region of mRNA encoded by PRO1855, corresponding to a HOST TARGET binding site such as BINDING SITE I, BINDING SITE II or BINDING SITE III. Table 2 illustrates the complementarity of the nucleotide sequences of PRO1855 BINDING SITE, designated SEQ ID:20576, to the nucleotide sequence of VGAM1928 RNA, herein designated VGAM RNA, also designated SEQ ID:4639.

Another function of VGAM1928 is therefore inhibition of PRO1855 (Accession NM_018509). Accordingly, utilities of VGAM1928 include diagnosis, prevention and treatment of diseases and clinical conditions associated with PRO1855. PRO2730 (Accession NM_025222) is another VGAM1928 host target gene. PRO2730 BINDING SITE is HOST TARGET binding site found in the 3' untranslated region of mRNA encoded by PRO2730, corresponding to a HOST TARGET binding site such as BINDING SITE I, BINDING SITE II or BINDING SITE III. Table 2 illustrates the complementarity of the nucleotide sequences of PRO2730 BINDING SITE, designated SEQ ID:24898, to the nucleotide sequence of VGAM1928 RNA, herein designated VGAM RNA, also designated SEQ ID:4639.

Another function of VGAM1928 is therefore inhibition of PRO2730 (Accession NM_025222). Accordingly, utilities of VGAM1928 include diagnosis, prevention and treatment of diseases and clinical conditions associated with PRO2730. RAB, Member of RAS Oncogene Family-like 4 (RABL4, Accession NM_006860) is another VGAM1928 host target gene. RABL4 BINDING SITE is HOST TARGET binding site found in the 5' untranslated region of mRNA encoded by RABL4, corresponding to a HOST TARGET binding site such as BINDING SITE I, BINDING SITE II or BINDING SITE III. Table 2 illustrates the complementarity of the nucleotide sequences of RABL4 BINDING SITE, designated SEQ ID:13728, to the nucleotide sequence of VGAM1928 RNA, herein designated VGAM RNA, also designated SEQ ID:4639.

Another function of VGAM1928 is therefore inhibition of RAB, Member of RAS Oncogene Family-like 4 (RABL4, Accession NM_006860). Accordingly, utilities of VGAM1928 include diagnosis, prevention and treatment of diseases and clinical conditions associated with RABL4. Roundabout Homolog 4, Magic Roundabout (Drosophila) (ROBO4, Accession NM_019055) is another VGAM1928 host target gene. ROBO4 BINDING SITE is HOST TARGET binding site found in the 3' untranslated region of mRNA encoded by ROBO4, corresponding to a HOST TARGET binding site such as BINDING SITE I, BINDING SITE II or BINDING SITE III. Table 2 illustrates the complementarity of the nucleotide sequences of ROBO4 BINDING SITE, designated SEQ ID:21132, to the nucleotide sequence of VGAM1928 RNA, herein designated VGAM RNA, also designated SEQ ID:4639.

Another function of VGAM1928 is therefore inhibition of Roundabout Homolog 4, Magic Roundabout (Drosophila) (ROBO4, Accession NM_019055). Accordingly, utilities of VGAM1928 include diagnosis, prevention and treatment of diseases and clinical conditions associated with ROBO4. RPP14 (Accession XM_003044) is another VGAM1928 host target gene. RPP14 BINDING SITE is HOST TARGET binding site found in the 3' untranslated region of mRNA encoded by RPP14, corresponding to a HOST TARGET binding site such as BINDING SITE I, BINDING SITE II or BINDING SITE III. Table 2 illustrates the complementarity of the nucleotide sequences of RPP14 BINDING SITE, designated SEQ ID:29925, to the nucleotide sequence of VGAM1928 RNA, herein designated VGAM RNA, also designated SEQ ID:4639.

Another function of VGAM1928 is therefore inhibition of RPP14 (Accession XM_003044). Accordingly, utilities of VGAM1928 include diagnosis, prevention and treatment of diseases and clinical conditions associated with RPP14. SBB103 (Accession NM_005785) is another VGAM1928 host target gene. SBB103 BINDING SITE is HOST TARGET binding site found in the 3' untranslated region of mRNA encoded by SBB103, corresponding to a HOST TARGET binding site such as BINDING SITE I, BINDING SITE II or BINDING SITE III. Table 2 illustrates the complementarity of the nucleotide sequences of SBB103 BINDING SITE, designated SEQ ID:12366, to the nucleotide sequence of VGAM1928 RNA, herein designated VGAM RNA, also designated SEQ ID:4639.

Another function of VGAM1928 is therefore inhibition of SBB103 (Accession NM_005785). Accordingly, utilities of VGAM1928 include diagnosis, prevention and treatment of diseases and clinical conditions associated with SBB103. Syndecan 3 (N-syndecan) (SDC3, Accession NM_014654) is another VGAM1928 host target gene. SDC3 BINDING SITE is HOST TARGET binding site found in the 5' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16076, to the nucleotide sequence of VGAM1928 RNA, herein designated VGAM RNA, also designated SEQ ID:4639.

Another function of VGAM1928 is therefore inhibition of Syndecan 3 (N-syndecan) (SDC3, Accession NM_014654). Accordingly, utilities of VGAM1928 include diagnosis, prevention and treatment of diseases and clinical conditions associated with SDC3. Syndecan Binding Protein (syntenin) (SDCBP, Accession NM_005625) is another VGAM1928 host target gene. SDCBP BINDING SITE is HOST TARGET binding site found in the 3' untranslated region of mRNA encoded by SDCBP, corresponding to a HOST TARGET binding site such as BINDING SITE I, BINDING SITE II or BINDING SITE III. Table 2 illustrates the complementarity of the nucleotide sequences of SDCBP BINDING SITE, designated SEQ ID:12136, to the nucleotide sequence of VGAM1928 RNA, herein designated VGAM RNA, also designated SEQ ID:4639.

Another function of VGAM1928 is therefore inhibition of Syndecan Binding Protein (syntenin) (SDCBP, Accession NM_005625). Accordingly, utilities of VGAM1928 include diagnosis, prevention and treatment of diseases and clinical conditions associated with SDCBP. Serologically Defined Colon Cancer Antigen 1 (SDCCAG1, Accession NM_004713) is another VGAM1928 host target gene. SDCCAG1 BINDING SITE is HOST TARGET binding site found in the 5' untranslated region of mRNA encoded by SDCCAG1, corresponding to a HOST TARGET binding site such as BINDING SITE I, BINDING SITE II or BINDING SITE III. Table 2 illustrates the complementarity of the nucleotide sequences of SDCCAG1 BINDING SITE, designated SEQ ID:11072, to the nucleotide sequence of VGAM1928 RNA, herein designated VGAM RNA, also designated SEQ ID:4639.

Another function of VGAM1928 is therefore inhibition of Serologically Defined Colon Cancer Antigen 1 (SDCCAG1, Accession NM_004713). Accordingly, utilities of VGAM1928 include diagnosis, prevention and treatment of diseases and clinical conditions associated with SDCCAG1. SES2 (Accession NM_031459) is another VGAM1928 host target gene. SES2 BINDING SITE is HOST TARGET binding site found in the 3' untranslated region of mRNA encoded by SES2, corresponding to a HOST TARGET binding site such as BINDING SITE I, BINDING SITE II or BINDING SITE III. Table 2 illustrates the complementarity of the nucleotide sequences of SES2 BINDING SITE, designated SEQ ID:25481, to the nucleotide sequence of VGAM1928 RNA, herein designated VGAM RNA, also designated SEQ ID:4639.

Another function of VGAM1928 is therefore inhibition of SES2 (Accession NM_031459). Accordingly, utilities of VGAM1928 include diagnosis, prevention and treatment of diseases and clinical conditions associated with SES2. SIPL (Accession NM_018269) is another VGAM1928 host target gene. SIPL BINDING SITE is HOST TARGET binding site found in the 3' untranslated region of mRNA encoded by SIPL, corresponding to a HOST TARGET binding site such as BINDING SITE I, BINDING SITE II or BINDING SITE III. Table 2 illustrates the complementarity of the nucleotide sequences of SIPL BINDING SITE, designated SEQ ID:20242, to the nucleotide sequence of VGAM1928 RNA, herein designated VGAM RNA, also designated SEQ ID:4639.

Another function of VGAM1928 is therefore inhibition of SIPL (Accession NM_018269). Accordingly, utilities of VGAM1928 include diagnosis, prevention and treatment of diseases and clinical conditions associated with SIPL. Solute Carrier Family 11 (proton-coupled divalent metal ion transporters), Member 2 (SLC11A2, Accession NM_000617) is another VGAM1928 host target gene. SLC11A2 BINDING SITE is HOST TARGET binding site found in the 3' untranslated region of mRNA encoded by SLC11A2, corresponding to a HOST TARGET binding site such as BINDING SITE I, BINDING SITE II or BINDING SITE III. Table 2 illustrates the complementarity of the nucleotide sequences of SLC11A2 BINDING SITE, designated SEQ ID:6225, to the nucleotide sequence of VGAM1928 RNA, herein designated VGAM RNA, also designated SEQ ID:4639.

Another function of VGAM1928 is therefore inhibition of Solute Carrier Family 11 (proton-coupled divalent metal ion transporters), Member 2 (SLC11A2, Accession NM_000617). Accordingly, utilities of VGAM1928 include diagnosis, prevention and treatment of diseases and clinical conditions associated with SLC11A2. SMC4 Structural Maintenance of Chromosomes 4-like 1 (yeast) (SMC4L1, Accession NM_005496) is another VGAM1928 host target gene. SMC4L1 BINDING SITE is HOST TARGET binding site found in the 3' untranslated region of mRNA encoded by SMC4L1, corresponding to a HOST TARGET binding site such as BINDING SITE I, BINDING SITE II or BINDING SITE III. Table 2 illustrates the complementarity of the nucleotide sequences of SMC4L1 BINDING SITE, designated SEQ ID:12001, to the nucleotide sequence of VGAM1928 RNA, herein designated VGAM RNA, also designated SEQ ID:4639.

Another function of VGAM1928 is therefore inhibition of SMC4 Structural Maintenance of Chromosomes 4-like 1 (yeast) (SMC4L1, Accession NM_005496). Accordingly, utilities of VGAM1928 include diagnosis, prevention and treatment of diseases and clinical conditions associated with SMC4L1. Serine Palmitoyltransferase, Long Chain Base Subunit 2 (SPTLC2, Accession NM_004863) is another VGAM1928 host target gene. SPTLC2 BINDING SITE1 and SPTLC2 BINDING SITE2 are HOST TARGET binding sites found in untranslated regions of mRNA encoded by SPTLC2, corresponding to HOST TARGET binding sites such as BINDING SITE I, BINDING SITE II or BINDING SITE III. Table 2 illustrates the complementarity of the nucleotide sequences of SPTLC2 BINDING SITE1 and SPTLC2 BINDING SITE2, designated SEQ ID:11286 and SEQ ID:11285 respectively, to the nucleotide sequence of VGAM1928 RNA, herein designated VGAM RNA, also designated SEQ ID:4639.

Another function of VGAM1928 is therefore inhibition of Serine Palmitoyltransferase, Long Chain Base Subunit 2 (SPTLC2, Accession NM_004863). Accordingly, utilities of VGAM1928 include diagnosis, prevention and treatment of diseases and clinical conditions associated with SPTLC2. Synaptotagmin XIII (SYT13, Accession XM_167880) is another VGAM1928 host target gene. SYT13 BINDING SITE is HOST TARGET binding site found in the 3' untranslated region of mRNA encoded by SYT13, corresponding to a HOST TARGET binding site such as BINDING SITE I, BINDING SITE II or BINDING SITE III. Table 2 illustrates the complementarity of the nucleotide sequences of SYT13 BINDING SITE, designated SEQ ID:44888, to the nucleotide sequence of VGAM1928 RNA, herein designated VGAM RNA, also designated SEQ ID:4639.

Another function of VGAM1928 is therefore inhibition of Synaptotagmin XIII (SYT13, Accession XM_167880). Accordingly, utilities of VGAM1928 include diagnosis, prevention and treatment of diseases and clinical conditions associated with SYT13. TAF5-like RNA Polymerase II, P300/CBP-associated Factor (PCAF)-associated Factor, 65 kDa (TAF5L, Accession NM_014409) is another VGAM1928 host target gene. TAF5L BINDING SITE is HOST TARGET binding site found in the 3' untranslated region of mRNA encoded by TAF5L, corresponding to a HOST TARGET binding site such as BINDING SITE I, BINDING SITE II or BINDING SITE III. Table 2 illustrates the complementarity of the nucleotide sequences of TAF5L BINDING SITE, designated SEQ ID:15751, to the nucleotide sequence of VGAM1928 RNA, herein designated VGAM RNA, also designated SEQ ID:4639.

Another function of VGAM1928 is therefore inhibition of TAF5-like RNA Polymerase II, P300/CBP-associated Factor (PCAF)-associated Factor, 65 kDa (TAF5L, Accession NM_014409). Accordingly, utilities of VGAM1928 include diagnosis, prevention and treatment of diseases and clinical conditions associated with TAF5L. TGFB-induced Factor 2 (TALE family homeobox) (TGIF2, Accession NM_021809) is another VGAM1928 host target gene. TGIF2 BINDING SITE is HOST TARGET binding site found in the 3' untranslated region of mRNA encoded by TGIF2, corresponding to a HOST TARGET binding site such as BINDING SITE I, BINDING SITE II or BINDING SITE III. Table 2 illustrates the complementarity of the nucleotide sequences of TGIF2 BINDING SITE, designated SEQ ID:22364, to the nucleotide sequence of VGAM1928 RNA, herein designated VGAM RNA, also designated SEQ ID:4639.

Another function of VGAM1928 is therefore inhibition of TGFB-induced Factor 2 (TALE family homeobox) (TGIF2, Accession NM_021809). Accordingly, utilities of VGAM1928 include diagnosis, prevention and treatment of diseases and clinical conditions associated with TGIF2. Thioesterase, Adipose Associated (THEA, Accession XM_038922) is another VGAM1928 host target gene. THEA BINDING SITE is HOST TARGET binding site found in the 3' untranslated region of mRNA encoded by THEA, corresponding to a HOST TARGET binding site such as BINDING SITE I, BINDING SITE II or BINDING SITE III. Table 2 illustrates the complementarity of the nucleotide sequences of THEA BINDING SITE, designated SEQ ID:32949, to the nucleotide sequence of VGAM1928 RNA, herein designated VGAM RNA, also designated SEQ ID:4639.

Another function of VGAM1928 is therefore inhibition of Thioesterase, Adipose Associated (THEA, Accession XM_038922). Accordingly, utilities of VGAM1928 include diagnosis, prevention and treatment of diseases and clinical conditions associated with THEA. Translocation Protein 1 (TLOC1, Accession NM_003262) is another VGAM1928 host target gene. TLOC1 BINDING SITE is HOST TARGET binding site found in the 5' untranslated region of mRNA encoded by TLOC1, corresponding to a HOST TARGET binding site such as BINDING SITE I, BINDING SITE II or BINDING SITE III. Table 2 illustrates the complementarity of the nucleotide sequences of TLOC1 BINDING SITE, designated SEQ ID:9274, to the nucleotide sequence of VGAM1928 RNA, herein designated VGAM RNA, also designated SEQ ID:4639.

Another function of VGAM1928 is therefore inhibition of Translocation Protein 1 (TLOC1, Accession NM_003262). Accordingly, utilities of VGAM1928 include diagnosis, prevention and treatment of diseases and clinical conditions associated with TLOC1. Trinucleotide Repeat Containing 5 (TNRC5, Accession NM_006586) is another VGAM1928 host target gene. TNRC5 BINDING SITE is HOST TARGET binding site found in the 5' untranslated region of mRNA encoded by TNRC5, corresponding to a HOST TARGET binding site such as BINDING SITE I, BINDING SITE II or BINDING SITE III. Table 2 illustrates the complementarity of the nucleotide sequences of TNRC5 BINDING SITE, designated SEQ ID:13345, to the nucleotide sequence of VGAM1928 RNA, herein designated VGAM RNA, also designated SEQ ID:4639.

Another function of VGAM1928 is therefore inhibition of Trinucleotide Repeat Containing 5 (TNRC5, Accession NM_006586). Accordingly, utilities of VGAM1928 include diagnosis, prevention and treatment of diseases and clinical conditions associated with TNRC5. TNF Receptor-associated Factor 3 (TRAF3, Accession XM_007256) is another VGAM1928 host target gene. TRAF3 BINDING SITE is HOST TARGET binding site found in the 3' untranslated region of mRNA encoded by TRAF3, corresponding to a HOST TARGET binding site such as BINDING SITE I, BINDING SITE II or BINDING SITE III. Table 2 illustrates the complementarity of the nucleotide sequences of TRAF3 BINDING SITE, designated SEQ ID:30041, to the nucleotide sequence of VGAM1928 RNA, herein designated VGAM RNA, also designated SEQ ID:4639.

Another function of VGAM1928 is therefore inhibition of TNF Receptor-associated Factor 3 (TRAF3, Accession XM_007256). Accordingly, utilities of VGAM1928 include diagnosis, prevention and treatment of diseases and clinical conditions associated with TRAF3. Tubby Homolog (mouse) (TUB, Accession NM_003320) is another VGAM1928 host target gene. TUB BINDING SITE is HOST TARGET binding site found in the 3' untranslated region of mRNA encoded by TUB, corresponding to a HOST TARGET binding site such as BINDING SITE I, BINDING SITE II or BINDING SITE III. Table 2 illustrates the complementarity of the nucleotide sequences of TUB BINDING SITE, designated SEQ ID:9320, to the nucleotide sequence of VGAM1928 RNA, herein designated VGAM RNA, also designated SEQ ID:4639.

Another function of VGAM1928 is therefore inhibition of Tubby Homolog (mouse) (TUB, Accession NM_003320). Accordingly, utilities of VGAM1928 include diagnosis, prevention and treatment of diseases and clinical conditions associated with TUB. Yes-associated Protein 1, 65 kDa (YAP1, Accession NM_006106) is another VGAM1928 host target gene. YAP1 BINDING SITE is HOST TARGET binding site found in the 3' untranslated region of mRNA encoded by YAP1, corresponding to a HOST TARGET binding site such as BINDING SITE I, BINDING SITE II or BINDING SITE III. Table 2 illustrates the complementarity of the nucleotide sequences of YAP1 BINDING SITE, designated SEQ ID:12751, to the nucleotide sequence of VGAM1928 RNA, herein designated VGAM RNA, also designated SEQ ID:4639.

Another function of VGAM1928 is therefore inhibition of Yes-associated Protein 1, 65 kDa (YAP1, Accession NM_006106). Accordingly, utilities of VGAM1928 include diagnosis, prevention and treatment of diseases and clinical conditions associated with YAP1. Zinc Finger Protein 91 Homolog (mouse) (ZFP91, Accession NM_053023) is another VGAM1928 host target gene. ZFP91 BINDING SITE is HOST TARGET binding site found in the 3' untranslated region of mRNA encoded by ZFP91, corresponding to a HOST TARGET binding site such as BINDING SITE I, BINDING SITE II or BINDING SITE III. Table 2 illustrates the complementarity of the nucleotide sequences of ZFP91

BINDING SITE, designated SEQ ID:27577, to the nucleotide sequence of VGAM1928 RNA, herein designated VGAM RNA, also designated SEQ ID:4639.

Another function of VGAM1928 is therefore inhibition of Zinc Finger Protein 91 Homolog (mouse) (ZFP91, Accession NM_053023). Accordingly, utilities of VGAM1928 include diagnosis, prevention and treatment of diseases and clinical conditions associated with ZFP91. Zinc Finger Protein 304 (ZNF304, Accession NM_020657) is another VGAM1928 host target gene. ZNF304 BINDING SITE is HOST TARGET binding site found in the 3' untranslated region of mRNA encoded by ZNF304, corresponding to a HOST TARGET binding site such as BINDING SITE I, BINDING SITE II or BINDING SITE III. Table 2 illustrates the complementarity of the nucleotide sequences of ZNF304 BINDING SITE, designated SEQ ID:21831, to the nucleotide sequence of VGAM1928 RNA, herein designated VGAM RNA, also designated SEQ ID:4639.

Another function of VGAM1928 is therefore inhibition of Zinc Finger Protein 304 (ZNF304, Accession NM_020657). Accordingly, utilities of VGAM1928 include diagnosis, prevention and treatment of diseases and clinical conditions associated with ZNF304. ZNF333 (Accession NM_032433) is another VGAM1928 host target gene. ZNF333 BINDING SITE is HOST TARGET binding site found in the 3' untranslated region of mRNA encoded by ZNF333, corresponding to a HOST TARGET binding site such as BINDING SITE I, BINDING SITE II or BINDING SITE III. Table 2 illustrates the complementarity of the nucleotide sequences of ZNF333 BINDING SITE, designated SEQ ID:26203, to the nucleotide sequence of VGAM1928 RNA, herein designated VGAM RNA, also designated SEQ ID:4639.

Another function of VGAM1928 is therefore inhibition of ZNF333 (Accession NM_032433). Accordingly, utilities of VGAM1928 include diagnosis, prevention and treatment of diseases and clinical conditions associated with ZNF333. Zinc Finger Protein 33a (KOX 31) (ZNF33A, Accession XM_166119) is another VGAM1928 host target gene. ZNF33A BINDING SITE is HOST TARGET binding site found in the 3' untranslated region of mRNA encoded by ZNF33A, corresponding to a HOST TARGET binding site such as BINDING SITE I, BINDING SITE II or BINDING SITE III. Table 2 illustrates the complementarity of the nucleotide sequences of ZNF33A BINDING SITE, designated SEQ ID:43900, to the nucleotide sequence of VGAM1928 RNA, herein designated VGAM RNA, also designated SEQ ID:4639.

Another function of VGAM1928 is therefore inhibition of Zinc Finger Protein 33a (KOX 31) (ZNF33A, Accession XM_166119). Accordingly, utilities of VGAM1928 include diagnosis, prevention and treatment of diseases and clinical conditions associated with ZNF33A. ZNF340 (Accession XM_097701) is another VGAM1928 host target gene. ZNF340 BINDING SITE is HOST TARGET binding site found in the 3' untranslated region of mRNA encoded by ZNF340, corresponding to a HOST TARGET binding site such as BINDING SITE I, BINDING SITE II or BINDING SITE III. Table 2 illustrates the complementarity of the nucleotide sequences of ZNF340 BINDING SITE, designated SEQ ID:41035, to the nucleotide sequence of VGAM1928 RNA, herein designated VGAM RNA, also designated SEQ ID:4639.

Another function of VGAM1928 is therefore inhibition of ZNF340 (Accession XM_097701). Accordingly, utilities of VGAM1928 include diagnosis, prevention and treatment of diseases and clinical conditions associated with ZNF340. LOC115574 (Accession XM_056240) is another VGAM1928 host target gene. LOC115574 BINDING SITE is HOST TARGET binding site found in the 3' untranslated region of mRNA encoded by LOC115574, corresponding to a HOST TARGET binding site such as BINDING SITE I, BINDING SITE II or BINDING SITE III. Table 2 illustrates the complementarity of the nucleotide sequences of LOC115574 BINDING SITE, designated SEQ ID:36368, to the nucleotide sequence of VGAM1928 RNA, herein designated VGAM RNA, also designated SEQ ID:4639.

Another function of VGAM1928 is therefore inhibition of LOC115574 (Accession XM_056240). Accordingly, utilities of VGAM1928 include diagnosis, prevention and treatment of diseases and clinical conditions associated with LOC115574. LOC116228 (Accession XM_057659) is another VGAM1928 host target gene. LOC116228 BINDING SITE is HOST TARGET binding site found in the 5' untranslated region of mRNA encoded by LOC116228, corresponding to a HOST TARGET binding site such as BINDING SITE I, BINDING SITE II or BINDING SITE III. Table 2 illustrates the complementarity of the nucleotide sequences of LOC116228 BINDING SITE, designated SEQ ID:36535, to the nucleotide sequence of VGAM1928 RNA, herein designated VGAM RNA, also designated SEQ ID:4639.

Another function of VGAM1928 is therefore inhibition of LOC116228 (Accession XM_057659). Accordingly, utilities of VGAM1928 include diagnosis, prevention and treatment of diseases and clinical conditions associated with LOC116228. LOC124044 (Accession XM_071871) is another VGAM1928 host target gene. LOC124044 BINDING SITE is HOST TARGET binding site found in the 3' untranslated region of mRNA encoded by LOC124044, corresponding to a HOST TARGET binding site such as BINDING SITE I, BINDING SITE II or BINDING SITE III. Table 2 illustrates the complementarity of the nucleotide sequences of LOC124044 BINDING SITE, designated SEQ ID:37430, to the nucleotide sequence of VGAM1928 RNA, herein designated VGAM RNA, also designated SEQ ID:4639.

Another function of VGAM1928 is therefore inhibition of LOC124044 (Accession XM_071871). Accordingly, utilities of VGAM1928 include diagnosis, prevention and treatment of diseases and clinical conditions associated with LOC124044. LOC126006 (Accession XM_058956) is another VGAM1928 host target gene. LOC126006 BINDING SITE is HOST TARGET binding site found in the 5' untranslated region of mRNA encoded by LOC126006, corresponding to a HOST TARGET binding site such as BINDING SITE I, BINDING SITE II or BINDING SITE III. Table 2 illustrates the complementarity of the nucleotide sequences of LOC126006 BINDING SITE, designated SEQ ID:36802, to the nucleotide sequence of VGAM1928 RNA, herein designated VGAM RNA, also designated SEQ ID:4639.

Another function of VGAM1928 is therefore inhibition of LOC126006 (Accession XM_058956). Accordingly, utilities of VGAM1928 include diagnosis, prevention and treatment of diseases and clinical conditions associated with LOC126006. LOC130497 (Accession XM_059439) is another VGAM1928 host target gene. LOC130497 BINDING SITE is HOST TARGET binding site found in the 3' untranslated region of mRNA encoded by LOC130497, corresponding to a HOST TARGET binding site such as BINDING SITE I, BINDING SITE II or BINDING SITE III. Table 2 illustrates the complementarity of the nucleotide sequences of LOC130497 BINDING SITE, designated SEQ ID:36991, to the nucleotide sequence of VGAM1928 RNA, herein designated VGAM RNA, also designated SEQ ID:4639.

Another function of VGAM1928 is therefore inhibition of LOC130497 (Accession XM_059439). Accordingly, utilities of VGAM1928 include diagnosis, prevention and treatment of diseases and clinical conditions associated with LOC130497. LOC130589 (Accession NM_138801) is another VGAM1928 host target gene. LOC130589 BINDING SITE is HOST TARGET binding site found in the 3' untranslated region of mRNA encoded by LOC130589, corresponding to a HOST TARGET binding site such as BINDING SITE I, BINDING SITE II or BINDING SITE III. Table 2 illustrates the complementarity of the nucleotide sequences of LOC130589 BINDING SITE, designated SEQ ID:29022, to the nucleotide sequence of VGAM1928 RNA, herein designated VGAM RNA, also designated SEQ ID:4639.

Another function of VGAM1928 is therefore inhibition of LOC130589 (Accession NM_138801). Accordingly, utilities of VGAM1928 include diagnosis, prevention and treatment of diseases and clinical conditions associated with LOC130589. LOC130612 (Accession XM_059461) is another VGAM1928 host target gene. LOC130612 BINDING SITE is HOST TARGET binding site found in the 3' untranslated region of mRNA encoded by LOC130612, corresponding to a HOST TARGET binding site such as BINDING SITE I, BINDING SITE II or BINDING SITE III. Table 2 illustrates the complementarity of the nucleotide sequences of LOC130612 BINDING SITE, designated SEQ ID:37000, to the nucleotide sequence of VGAM1928 RNA, herein designated VGAM RNA, also designated SEQ ID:4639.

Another function of VGAM1928 is therefore inhibition of LOC130612 (Accession XM_059461). Accordingly, utilities of VGAM1928 include diagnosis, prevention and treatment of diseases and clinical conditions associated with LOC130612. LOC132299 (Accession XM_059584) is another VGAM1928 host target gene. LOC132299 BINDING SITE is HOST TARGET binding site found in the 5' untranslated region of mRNA encoded by LOC132299, corresponding to a HOST TARGET binding site such as BINDING SITE I, BINDING SITE II or BINDING SITE III. Table 2 illustrates the complementarity of the nucleotide sequences of LOC132299 BINDING SITE, designated SEQ ID:37024, to the nucleotide sequence of VGAM1928 RNA, herein designated VGAM RNA, also designated SEQ ID:4639.

Another function of VGAM1928 is therefore inhibition of LOC132299 (Accession XM_059584). Accordingly, utilities of VGAM1928 include diagnosis, prevention and treatment of diseases and clinical conditions associated with LOC132299. LOC133362 (Accession XM_068305) is another VGAM1928 host target gene. LOC133362 BINDING SITE is HOST TARGET binding site found in the 5' untranslated region of mRNA encoded by LOC133362, corresponding to a HOST TARGET binding site such as BINDING SITE I, BINDING SITE II or BINDING SITE III. Table 2 illustrates the complementarity of the nucleotide sequences of LOC133362 BINDING SITE, designated SEQ ID:37378, to the nucleotide sequence of VGAM1928 RNA, herein designated VGAM RNA, also designated SEQ ID:4639.

Another function of VGAM1928 is therefore inhibition of LOC133362 (Accession XM_068305). Accordingly, utilities of VGAM1928 include diagnosis, prevention and treatment of diseases and clinical conditions associated with LOC133362. LOC137075 (Accession XM_059895) is another VGAM1928 host target gene. LOC137075 BINDING SITE is HOST TARGET binding site found in the 3' untranslated region of mRNA encoded by LOC137075, corresponding to a HOST TARGET binding site such as BINDING SITE I, BINDING SITE II or BINDING SITE III. Table 2 illustrates the complementarity of the nucleotide sequences of LOC137075 BINDING SITE, designated SEQ ID:37102, to the nucleotide sequence of VGAM1928 RNA, herein designated VGAM RNA, also designated SEQ ID:4639.

Another function of VGAM1928 is therefore inhibition of LOC137075 (Accession XM_059895). Accordingly, utilities of VGAM1928 include diagnosis, prevention and treatment of diseases and clinical conditions associated with LOC137075. LOC143286 (Accession XM_096412) is another VGAM1928 host target gene. LOC143286 BINDING SITE is HOST TARGET binding site found in the 5' untranslated region of mRNA encoded by LOC143286, corresponding to a HOST TARGET binding site such as BINDING SITE I, BINDING SITE II or BINDING SITE III. Table 2 illustrates the complementarity of the nucleotide sequences of LOC143286 BINDING SITE, designated SEQ ID:40354, to the nucleotide sequence of VGAM1928 RNA, herein designated VGAM RNA, also designated SEQ ID:4639.

Another function of VGAM1928 is therefore inhibition of LOC143286 (Accession XM_096412). Accordingly, utilities of VGAM1928 include diagnosis, prevention and treatment of diseases and clinical conditions associated with LOC143286. LOC143677 (Accession XM_096471) is another VGAM1928 host target gene. LOC143677 BINDING SITE is HOST TARGET binding site found in the 5' untranslated region of mRNA encoded by LOC143677, corresponding to a HOST TARGET binding site such as BINDING SITE I, BINDING SITE II or BINDING SITE III. Table 2 illustrates the complementarity of the nucleotide sequences of LOC143677 BINDING SITE, designated SEQ ID:40372, to the nucleotide sequence of VGAM1928 RNA, herein designated VGAM RNA, also designated SEQ ID:4639.

Another function of VGAM1928 is therefore inhibition of LOC143677 (Accession XM_096471). Accordingly, utilities of VGAM1928 include diagnosis, prevention and treatment of diseases and clinical conditions associated with LOC143677. LOC143916 (Accession XM_084664) is another VGAM1928 host target gene. LOC143916 BINDING SITE is HOST TARGET binding site found in the 5' untranslated region of mRNA encoded by LOC143916, corresponding to a HOST TARGET binding site such as BINDING SITE I, BINDING SITE II or BINDING SITE III. Table 2 illustrates the complementarity of the nucleotide sequences of LOC143916 BINDING SITE, designated SEQ ID:37653, to the nucleotide sequence of VGAM1928 RNA, herein designated VGAM RNA, also designated SEQ ID:4639.

Another function of VGAM1928 is therefore inhibition of LOC143916 (Accession XM_084664). Accordingly, utilities of VGAM1928 include diagnosis, prevention and treatment of diseases and clinical conditions associated with LOC143916. LOC144058 (Accession XM_084712) is another VGAM1928 host target gene. LOC144058 BINDING SITE is HOST TARGET binding site found in the 5' untranslated region of mRNA encoded by LOC144058, corresponding to a HOST TARGET binding site such as BINDING SITE I, BINDING SITE II or BINDING SITE III. Table 2 illustrates the complementarity of the nucleotide sequences of LOC144058 BINDING SITE, designated SEQ ID:37675, to the nucleotide sequence of VGAM1928 RNA, herein designated VGAM RNA, also designated SEQ ID:4639.

Another function of VGAM1928 is therefore inhibition of LOC144058 (Accession XM_084712). Accordingly, utilities of VGAM1928 include diagnosis, prevention and treatment of diseases and clinical conditions associated with LOC144058. LOC144308 (Accession XM_096575) is another VGAM1928 host target gene. LOC144308 BINDING SITE is HOST TARGET binding site found in the 5' untranslated region of mRNA encoded by LOC144308, corresponding to a HOST TARGET binding site such as BIND- ING SITE I, BINDING SITE II or BINDING SITE III. Table 2 illustrates the complementarity of the nucleotide sequences of LOC144308 BINDING SITE, designated SEQ ID:40406, to the nucleotide sequence of VGAM1928 RNA, herein designated VGAM RNA, also designated SEQ ID:4639.

Another function of VGAM1928 is therefore inhibition of LOC144308 (Accession XM_096575). Accordingly, utilities of VGAM1928 include diagnosis, prevention and treatment of diseases and clinical conditions associated with LOC144308. LOC144453 (Accession XM_084869) is another VGAM1928 host target gene. LOC144453 BINDING SITE is HOST TARGET binding site found in the 3' untranslated region of mRNA encoded by LOC144453, corresponding to a HOST TARGET binding site such as BINDING SITE I, BINDING SITE II or BINDING SITE III. Table 2 illustrates the complementarity of the nucleotide sequences of LOC144453 BINDING SITE, designated SEQ ID:37747, to the nucleotide sequence of VGAM1928 RNA, herein designated VGAM RNA, also designated SEQ ID:4639.

Another function of VGAM1928 is therefore inhibition of LOC144453 (Accession XM_084869). Accordingly, utilities of VGAM1928 include diagnosis, prevention and treatment of diseases and clinical conditions associated with LOC144453. LOC144486 (Accession XM_096608) is another VGAM1928 host target gene. LOC144486 BINDING SITE is HOST TARGET binding site found in the 3' untranslated region of mRNA encoded by LOC144486, corresponding to a HOST TARGET binding site such as BINDING SITE I, BINDING SITE II or BINDING SITE III. Table 2 illustrates the complementarity of the nucleotide sequences of LOC144486 BINDING SITE, designated SEQ ID:40417, to the nucleotide sequence of VGAM1928 RNA, herein designated VGAM RNA, also designated SEQ ID:4639.

Another function of VGAM1928 is therefore inhibition of LOC144486 (Accession XM_096608). Accordingly, utilities of VGAM1928 include diagnosis, prevention and treatment of diseases and clinical conditions associated with LOC144486. LOC144587 (Accession XM_040195) is another VGAM1928 host target gene. LOC144587 BINDING SITE is HOST TARGET binding site found in the 5' untranslated region of mRNA encoded by LOC144587, corresponding to a HOST TARGET binding site such as BINDING SITE I, BINDING SITE II or BINDING SITE III. Table 2 illustrates the complementarity of the nucleotide sequences of LOC144587 BINDING SITE, designated SEQ ID:33269, to the nucleotide sequence of VGAM1928 RNA, herein designated VGAM RNA, also designated SEQ ID:4639.

Another function of VGAM1928 is therefore inhibition of LOC144587 (Accession XM_040195). Accordingly, utilities of VGAM1928 include diagnosis, prevention and treatment of diseases and clinical conditions associated with LOC144587. LOC144920 (Accession XM_096688) is another VGAM1928 host target gene. LOC144920 BINDING SITE is HOST TARGET binding site found in the 3' untranslated region of mRNA encoded by LOC144920, corresponding to a HOST TARGET binding site such as BINDING SITE I, BINDING SITE II or BINDING SITE III. Table 2 illustrates the complementarity of the nucleotide sequences of LOC144920 BINDING SITE, designated SEQ ID:40466, to the nucleotide sequence of VGAM1928 RNA, herein designated VGAM RNA, also designated SEQ ID:4639.

Another function of VGAM1928 is therefore inhibition of LOC144920 (Accession XM_096688). Accordingly, utilities of VGAM1928 include diagnosis, prevention and treatment of diseases and clinical conditions associated with LOC144920. LOC145333 (Accession XM_096766) is another VGAM1928 host target gene. LOC145333 BINDING SITE is HOST TARGET binding site found in the 5' untranslated region of mRNA encoded by LOC145333, corresponding to a HOST TARGET binding site such as BINDING SITE I, BINDING SITE II or BINDING SITE III. Table 2 illustrates the complementarity of the nucleotide sequences of LOC145333 BINDING SITE, designated SEQ ID:40532, to the nucleotide sequence of VGAM1928 RNA, herein designated VGAM RNA, also designated SEQ ID:4639.

Another function of VGAM1928 is therefore inhibition of LOC145333 (Accession XM_096766). Accordingly, utilities of VGAM1928 include diagnosis, prevention and treatment of diseases and clinical conditions associated with LOC145333. LOC145566 (Accession XM_085174) is another VGAM1928 host target gene. LOC145566 BINDING SITE is HOST TARGET binding site found in the 5' untranslated region of mRNA encoded by LOC145566, corresponding to a HOST TARGET binding site such as BINDING SITE I, BINDING SITE II or BINDING SITE III. Table 2 illustrates the complementarity of the nucleotide sequences of LOC145566 BINDING SITE, designated SEQ ID:37899, to the nucleotide sequence of VGAM1928 RNA, herein designated VGAM RNA, also designated SEQ ID:4639.

Another function of VGAM1928 is therefore inhibition of LOC145566 (Accession XM_085174). Accordingly, utilities of VGAM1928 include diagnosis, prevention and treatment of diseases and clinical conditions associated with LOC145566. LOC145858 (Accession XM_085258) is another VGAM1928 host target gene. LOC145858 BINDING SITE is HOST TARGET binding site found in the 5' untranslated region of mRNA encoded by LOC145858, corresponding to a HOST TARGET binding site such as BINDING SITE I, BINDING SITE II or BINDING SITE III. Table 2 illustrates the complementarity of the nucleotide sequences of LOC145858 BINDING SITE, designated SEQ ID:38003, to the nucleotide sequence of VGAM1928 RNA, herein designated VGAM RNA, also designated SEQ ID:4639.

Another function of VGAM1928 is therefore inhibition of LOC145858 (Accession XM_085258). Accordingly, utilities of VGAM1928 include diagnosis, prevention and treatment of diseases and clinical conditions associated with LOC145858. LOC145899 (Accession XM_096899) is another VGAM1928 host target gene. LOC145899 BINDING SITE is HOST TARGET binding site found in the 5' untranslated region of mRNA encoded by LOC145899, corresponding to a HOST TARGET binding site such as BINDING SITE I, BINDING SITE II or BINDING SITE III. Table 2 illustrates the complementarity of the nucleotide sequences of LOC145899 BINDING SITE, designated SEQ ID:40624, to the nucleotide sequence of VGAM1928 RNA, herein designated VGAM RNA, also designated SEQ ID:4639.

Another function of VGAM1928 is therefore inhibition of LOC145899 (Accession XM_096899). Accordingly, utilities of VGAM1928 include diagnosis, prevention and treatment of diseases and clinical conditions associated with LOC145899. LOC145942 (Accession XM_085281) is another VGAM1928 host target gene. LOC145942 BINDING SITE is HOST TARGET binding site found in the 5' untranslated region of mRNA encoded by LOC145942, corresponding to a HOST TARGET binding site such as BINDING SITE I, BINDING SITE II or BINDING SITE III. Table 2 illustrates the complementarity of the nucleotide sequences of LOC145942 BINDING SITE, designated SEQ ID:38015, to the nucleotide sequence of VGAM1928 RNA, herein designated VGAM RNA, also designated SEQ ID:4639.

Another function of VGAM1928 is therefore inhibition of LOC145942 (Accession XM_085281). Accordingly, utilities of VGAM1928 include diagnosis, prevention and treatment of diseases and clinical conditions associated with LOC145942. LOC145945 (Accession XM_096908) is another VGAM1928 host target gene. LOC145945 BINDING SITE is HOST TARGET binding site found in the 5' untranslated region of mRNA encoded by LOC145945, corresponding to a HOST TARGET binding site such as BINDING SITE I, BINDING SITE II or BINDING SITE III. Table 2 illustrates the complementarity of the nucleotide sequences of LOC145945 BINDING SITE, designated SEQ ID:40633, to the nucleotide sequence of VGAM1928 RNA, herein designated VGAM RNA, also designated SEQ ID:4639.

Another function of VGAM1928 is therefore inhibition of LOC145945 (Accession XM_096908). Accordingly, utilities of VGAM1928 include diagnosis, prevention and treatment of diseases and clinical conditions associated with LOC145945. LOC146224 (Accession XM_085366) is another VGAM1928 host target gene. LOC146224 BINDING SITE is HOST TARGET binding site found in the 5' untranslated region of mRNA encoded by LOC146224, corresponding to a HOST TARGET binding site such as BINDING SITE I, BINDING SITE II or BINDING SITE III. Table 2 illustrates the complementarity of the nucleotide sequences of LOC146224 BINDING SITE, designated SEQ ID:38078, to the nucleotide sequence of VGAM1928 RNA, herein designated VGAM RNA, also designated SEQ ID:4639.

Another function of VGAM1928 is therefore inhibition of LOC146224 (Accession XM_085366). Accordingly, utilities of VGAM1928 include diagnosis, prevention and treatment of diseases and clinical conditions associated with LOC146224. LOC146603 (Accession XM_085514) is another VGAM1928 host target gene. LOC146603 BINDING SITE is HOST TARGET binding site found in the 5' untranslated region of mRNA encoded by LOC146603, corresponding to a HOST TARGET binding site such as BINDING SITE I, BINDING SITE II or BINDING SITE III. Table 2 illustrates the complementarity of the nucleotide sequences of LOC146603 BINDING SITE, designated SEQ ID:38216, to the nucleotide sequence of VGAM1928 RNA, herein designated VGAM RNA, also designated SEQ ID:4639.

Another function of VGAM1928 is therefore inhibition of LOC146603 (Accession XM_085514). Accordingly, utilities of VGAM1928 include diagnosis, prevention and treatment of diseases and clinical conditions associated with LOC146603. LOC146669 (Accession XM_085534) is another VGAM1928 host target gene. LOC146669 BINDING SITE is HOST TARGET binding site found in the 5' untranslated region of mRNA encoded by LOC146669, corresponding to a HOST TARGET binding site such as BINDING SITE I, BINDING SITE II or BINDING SITE III. Table 2 illustrates the complementarity of the nucleotide sequences of LOC146669 BINDING SITE, designated SEQ ID:38222, to the nucleotide sequence of VGAM1928 RNA, herein designated VGAM RNA, also designated SEQ ID:4639.

Another function of VGAM1928 is therefore inhibition of LOC146669 (Accession XM_085534). Accordingly, utilities of VGAM1928 include diagnosis, prevention and treatment of diseases and clinical conditions associated with LOC146669. LOC147077 (Accession XM_085699) is another VGAM1928 host target gene. LOC147077 BINDING SITE is HOST TARGET binding site found in the 3' untranslated region of mRNA encoded by LOC147077, corresponding to a HOST TARGET binding site such as BINDING SITE I, BINDING SITE II or BINDING SITE III. Table 2 illustrates the complementarity of the nucleotide sequences of LOC147077 BINDING SITE, designated SEQ ID:38293, to the nucleotide sequence of VGAM1928 RNA, herein designated VGAM RNA, also designated SEQ ID:4639.

Another function of VGAM1928 is therefore inhibition of LOC147077 (Accession XM_085699). Accordingly, utilities of VGAM1928 include diagnosis, prevention and treatment of diseases and clinical conditions associated with LOC147077. LOC147180 (Accession XM_097207) is another VGAM1928 host target gene. LOC147180 BINDING SITE is HOST TARGET binding site found in the 5' untranslated region of mRNA encoded by LOC147180, corresponding to a HOST TARGET binding site such as BINDING SITE I, BINDING SITE II or BINDING SITE III. Table 2 illustrates the complementarity of the nucleotide sequences of LOC147180 BINDING SITE, designated SEQ ID:40816, to the nucleotide sequence of VGAM1928 RNA, herein designated VGAM RNA, also designated SEQ ID:4639.

Another function of VGAM1928 is therefore inhibition of LOC147180 (Accession XM_097207). Accordingly, utilities of VGAM1928 include diagnosis, prevention and treatment of diseases and clinical conditions associated with LOC147180. LOC148113 (Accession XM_086058) is another VGAM1928 host target gene. LOC148113 BINDING SITE is HOST TARGET binding site found in the 3' untranslated region of mRNA encoded by LOC148113, corresponding to a HOST TARGET binding site such as BINDING SITE I, BINDING SITE II or BINDING SITE III. Table 2 illustrates the complementarity of the nucleotide sequences of LOC148113 BINDING SITE, designated SEQ ID:38473, to the nucleotide sequence of VGAM1928 RNA, herein designated VGAM RNA, also designated SEQ ID:4639.

Another function of VGAM1928 is therefore inhibition of LOC148113 (Accession XM_086058). Accordingly, utilities of VGAM1928 include diagnosis, prevention and treatment of diseases and clinical conditions associated with LOC148113. LOC148936 (Accession XM_097556) is another VGAM1928 host target gene. LOC148936 BINDING SITE is HOST TARGET binding site found in the 5' untranslated region of mRNA encoded by LOC148936, corresponding to a HOST TARGET binding site such as BINDING SITE I, BINDING SITE II or BINDING SITE III. Table 2 illustrates the complementarity of the nucleotide sequences of LOC148936 BINDING SITE, designated SEQ ID:40934, to the nucleotide sequence of VGAM1928 RNA, herein designated VGAM RNA, also designated SEQ ID:4639.

Another function of VGAM1928 is therefore inhibition of LOC148936 (Accession XM_097556). Accordingly, utilities of VGAM1928 include diagnosis, prevention and treatment of diseases and clinical conditions associated with LOC148936. LOC148938 (Accession XM_097555) is another VGAM1928 host target gene. LOC148938 BINDING SITE is HOST TARGET binding site found in the 5' untranslated region of mRNA encoded by LOC148938, corresponding to a HOST TARGET binding site such as BINDING SITE I, BINDING SITE II or BINDING SITE III. Table 2 illustrates the complementarity of the nucleotide sequences of LOC148938 BINDING SITE, designated SEQ ID:40927, to the nucleotide sequence of VGAM1928 RNA, herein designated VGAM RNA, also designated SEQ ID:4639.

Another function of VGAM1928 is therefore inhibition of LOC148938 (Accession XM_097555). Accordingly, utilities of VGAM1928 include diagnosis, prevention and treatment of diseases and clinical conditions associated with LOC148938. LOC149692 (Accession XM_097706) is another VGAM1928 host target gene. LOC149692 BINDING SITE1 and LOC149692 BINDING SITE2 are HOST TARGET binding sites found in untranslated regions of mRNA encoded by LOC149692, corresponding to HOST TARGET binding sites such as BINDING SITE I, BINDING SITE II or BINDING SITE III. Table 2 illustrates the complementarity of the nucleotide sequences of LOC149692 BINDING SITE1 and LOC149692 BINDING SITE2, designated SEQ ID:41038 and SEQ ID:41039 respectively, to the nucleotide sequence of VGAM1928 RNA, herein designated VGAM RNA, also designated SEQ ID:4639.

Another function of VGAM1928 is therefore inhibition of LOC149692 (Accession XM_097706). Accordingly, utilities of VGAM1928 include diagnosis, prevention and treatment of diseases and clinical conditions associated with LOC149692. LOC150095 (Accession XM_097805) is another VGAM1928 host target gene. LOC150095 BINDING SITE is HOST TARGET binding site found in the 5' untranslated region of mRNA encoded by LOC150095, corresponding to a HOST TARGET binding site such as BINDING SITE I, BINDING SITE II or BINDING SITE III. Table 2 illustrates the complementarity of the nucleotide sequences of LOC150095 BINDING SITE, designated SEQ ID:41129, to the nucleotide sequence of VGAM1928 RNA, herein designated VGAM RNA, also designated SEQ ID:4639.

Another function of VGAM1928 is therefore inhibition of LOC150095 (Accession XM_097805). Accordingly, utilities of VGAM1928 include diagnosis, prevention and treatment of diseases and clinical conditions associated with LOC150095. LOC150271 (Accession XM_097859) is another VGAM1928 host target gene. LOC150271 BINDING SITE is HOST TARGET binding site found in the 3' untranslated region of mRNA encoded by LOC150271, corresponding to a HOST TARGET binding site such as BINDING SITE I, BINDING SITE II or BINDING SITE III. Table 2 illustrates the complementarity of the nucleotide sequences of LOC150271 BINDING SITE, designated SEQ ID:41171, to the nucleotide sequence of VGAM1928 RNA, herein designated VGAM RNA, also designated SEQ ID:4639.

Another function of VGAM1928 is therefore inhibition of LOC150271 (Accession XM_097859). Accordingly, utilities of VGAM1928 include diagnosis, prevention and treatment of diseases and clinical conditions associated with LOC150271. LOC150407 (Accession XM_086906) is another VGAM1928 host target gene. LOC150407 BINDING SITE is HOST TARGET binding site found in the 5' untranslated region of mRNA encoded by LOC150407, corresponding to a HOST TARGET binding site such as BINDING SITE I, BINDING SITE II or BINDING SITE III. Table 2 illustrates the complementarity of the nucleotide sequences of LOC150407 BINDING SITE, designated SEQ ID:38948, to the nucleotide sequence of VGAM1928 RNA, herein designated VGAM RNA, also designated SEQ ID:4639.

Another function of VGAM1928 is therefore inhibition of LOC150407 (Accession XM_086906). Accordingly, utilities of VGAM1928 include diagnosis, prevention and treatment of diseases and clinical conditions associated with LOC150407. LOC151176 (Accession XM_098016) is another VGAM1928 host target gene. LOC151176 BINDING SITE is HOST TARGET binding site found in the 3' untranslated region of mRNA encoded by LOC151176, corresponding to a HOST TARGET binding site such as BINDING SITE I, BINDING SITE II or BINDING SITE III. Table 2 illustrates the complementarity of the nucleotide sequences of LOC151176 BINDING SITE, designated SEQ ID:41313, to the nucleotide sequence of VGAM1928 RNA, herein designated VGAM RNA, also designated SEQ ID:4639.

Another function of VGAM1928 is therefore inhibition of LOC151176 (Accession XM_098016). Accordingly, utilities of VGAM1928 include diagnosis, prevention and treatment of diseases and clinical conditions associated with LOC151176. LOC151571 (Accession XM_098088) is another VGAM1928 host target gene. LOC151571 BINDING SITE is HOST TARGET binding site found in the 5' untranslated region of mRNA encoded by LOC151571, corresponding to a HOST TARGET binding site such as BINDING SITE I, BINDING SITE II or BINDING SITE III. Table 2 illustrates the complementarity of the nucleotide sequences of LOC151571 BINDING SITE, designated SEQ ID:41371, to the nucleotide sequence of VGAM1928 RNA, herein designated VGAM RNA, also designated SEQ ID:4639.

Another function of VGAM1928 is therefore inhibition of LOC151571 (Accession XM_098088). Accordingly, utilities of VGAM1928 include diagnosis, prevention and treatment of diseases and clinical conditions associated with LOC151571. LOC151959 (Accession XM_098144) is another VGAM1928 host target gene. LOC151959 BINDING SITE is HOST TARGET binding site found in the 5' untranslated region of mRNA encoded by LOC151959, corresponding to a HOST TARGET binding site such as BINDING SITE I, BINDING SITE II or BINDING SITE III. Table 2 illustrates the complementarity of the nucleotide sequences of LOC151959 BINDING SITE, designated SEQ ID:41407, to the nucleotide sequence of VGAM1928 RNA, herein designated VGAM RNA, also designated SEQ ID:4639.

Another function of VGAM1928 is therefore inhibition of LOC151959 (Accession XM_098144). Accordingly, utilities of VGAM1928 include diagnosis, prevention and treatment of diseases and clinical conditions associated with LOC151959. LOC152185 (Accession NM_144718) is another VGAM1928 host target gene. LOC152185 BINDING SITE is HOST TARGET binding site found in the 5' untranslated region of mRNA encoded by LOC152185, corresponding to a HOST TARGET binding site such as BINDING SITE I, BINDING SITE II or BINDING SITE III. Table 2 illustrates the complementarity of the nucleotide sequences of LOC152185 BINDING SITE, designated SEQ ID:29539, to the nucleotide sequence of VGAM1928 RNA, herein designated VGAM RNA, also designated SEQ ID:4639.

Another function of VGAM1928 is therefore inhibition of LOC152185 (Accession NM_144718). Accordingly, utilities of VGAM1928 include diagnosis, prevention and treatment of diseases and clinical conditions associated with LOC152185. LOC154282 (Accession XM_098505) is another VGAM1928 host target gene. LOC154282 BINDING SITE is HOST TARGET binding site found in the 5' untranslated region of mRNA encoded by LOC154282, corresponding to a HOST TARGET binding site such as BINDING SITE I, BINDING SITE II or BINDING SITE III. Table 2 illustrates the complementarity of the nucleotide sequences of LOC154282 BINDING SITE, designated SEQ ID:41700, to the nucleotide sequence of VGAM1928 RNA, herein designated VGAM RNA, also designated SEQ ID:4639.

Another function of VGAM1928 is therefore inhibition of LOC154282 (Accession XM_098505). Accordingly, utilities of VGAM1928 include diagnosis, prevention and treatment of diseases and clinical conditions associated with LOC154282. LOC154881 (Accession XM_088063) is another VGAM1928 host target gene. LOC154881 BINDING SITE is HOST TARGET binding site found in the 3' untranslated region of mRNA encoded by LOC154881, corresponding to a HOST TARGET binding site such as BINDING SITE I, BINDING SITE II or BINDING SITE III. Table 2 illustrates the complementarity of the nucleotide sequences of LOC154881 BINDING SITE, designated SEQ ID:39501, to the nucleotide sequence of VGAM1928 RNA, herein designated VGAM RNA, also designated SEQ ID:4639.

Another function of VGAM1928 is therefore inhibition of LOC154881 (Accession XM_088063). Accordingly, utilities of VGAM1928 include diagnosis, prevention and treatment of diseases and clinical conditions associated with LOC154881. LOC158177 (Accession XM_088506) is another VGAM1928 host target gene. LOC158177 BINDING SITE is HOST TARGET binding site found in the 5' untranslated region of mRNA encoded by LOC158177, corresponding to a HOST TARGET binding site such as BINDING SITE I, BINDING SITE II or BINDING SITE III. Table 2 illustrates the complementarity of the nucleotide sequences of LOC158177 BINDING SITE, designated SEQ ID:39761, to the nucleotide sequence of VGAM1928 RNA, herein designated VGAM RNA, also designated SEQ ID:4639.

Another function of VGAM1928 is therefore inhibition of LOC158177 (Accession XM_088506). Accordingly, utilities of VGAM1928 include diagnosis, prevention and treatment of diseases and clinical conditions associated with LOC158177. LOC158969 (Accession XM_088728) is another VGAM1928 host target gene. LOC158969 BINDING SITE is HOST TARGET binding site found in the 3' untranslated region of mRNA encoded by LOC158969, corresponding to a HOST TARGET binding site such as BINDING SITE I, BINDING SITE II or BINDING SITE III. Table 2 illustrates the complementarity of the nucleotide sequences of LOC158969 BINDING SITE, designated SEQ ID:39924, to the nucleotide sequence of VGAM1928 RNA, herein designated VGAM RNA, also designated SEQ ID:4639.

Another function of VGAM1928 is therefore inhibition of LOC158969 (Accession XM_088728). Accordingly, utilities of VGAM1928 include diagnosis, prevention and treatment of diseases and clinical conditions associated with LOC158969. LOC163682 (Accession XM_099402) is another VGAM1928 host target gene. LOC163682 BINDING SITE is HOST TARGET binding site found in the 5' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42084, to the nucleotide sequence of VGAM1928 RNA, herein designated VGAM RNA, also designated SEQ ID:4639.

Another function of VGAM1928 is therefore inhibition of LOC163682 (Accession XM_099402). Accordingly, utilities of VGAM1928 include diagnosis, prevention and treatment of diseases and clinical conditions associated with LOC163682. LOC197408 (Accession XM_117031) is another VGAM1928 host target gene. LOC197408 BINDING SITE is HOST TARGET binding site found in the 5' untranslated region of mRNA encoded by LOC197408, corresponding to a HOST TARGET binding site such as BINDING SITE I, BINDING SITE II or BINDING SITE III. Table 2 illustrates the complementarity of the nucleotide sequences of LOC197408 BINDING SITE, designated SEQ ID:43208, to the nucleotide sequence of VGAM1928 RNA, herein designated VGAM RNA, also designated SEQ ID:4639.

Another function of VGAM1928 is therefore inhibition of LOC197408 (Accession XM_117031). Accordingly, utilities of VGAM1928 include diagnosis, prevention and treatment of diseases and clinical conditions associated with LOC197408. LOC199796 (Accession XM_058994) is another VGAM1928 host target gene. LOC199796 BINDING SITE is HOST TARGET binding site found in the 5' untranslated region of mRNA encoded by LOC199796, corresponding to a HOST TARGET binding site such as BINDING SITE I, BINDING SITE II or BINDING SITE III. Table 2 illustrates the complementarity of the nucleotide sequences of LOC199796 BINDING SITE, designated SEQ ID:36807, to the nucleotide sequence of VGAM1928 RNA, herein designated VGAM RNA, also designated SEQ ID:4639.

Another function of VGAM1928 is therefore inhibition of LOC199796 (Accession XM_058994). Accordingly, utilities of VGAM1928 include diagnosis, prevention and treatment of diseases and clinical conditions associated with LOC199796. LOC200609 (Accession XM_117256) is another VGAM1928 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43338, to the nucleotide sequence of VGAM1928 RNA, herein designated VGAM RNA, also designated SEQ ID:4639.

Another function of VGAM1928 is therefore inhibition of LOC200609 (Accession XM_117256). Accordingly, utilities of VGAM1928 include diagnosis, prevention and treatment of diseases and clinical conditions associated with LOC200609. LOC201164 (Accession XM_113904) is another VGAM1928 host target gene. LOC201164 BINDING SITE is HOST TARGET binding site found in the 3' untranslated region of mRNA encoded by LOC201164, corresponding to a HOST TARGET binding site such as BINDING SITE I, BINDING SITE II or BINDING SITE III. Table 2 illustrates the complementarity of the nucleotide sequences of LOC201164 BINDING SITE, designated SEQ ID:42531, to the nucleotide sequence of VGAM1928 RNA, herein designated VGAM RNA, also designated SEQ ID:4639.

Another function of VGAM1928 is therefore inhibition of LOC201164 (Accession XM_113904). Accordingly, utilities of VGAM1928 include diagnosis, prevention and treatment of diseases and clinical conditions associated with LOC201164. LOC201181 (Accession XM_113916) is another VGAM1928 host target gene. LOC201181 BINDING SITE is HOST TARGET binding site found in the 5' untranslated region of mRNA encoded by LOC201181, corresponding to a HOST TARGET binding site such as BINDING SITE I, BINDING SITE II or BINDING SITE III. Table 2 illustrates the complementarity of the nucleotide sequences of LOC201181 BINDING SITE, designated SEQ ID:42535, to the nucleotide sequence of VGAM1928 RNA, herein designated VGAM RNA, also designated SEQ ID:4639.

Another function of VGAM1928 is therefore inhibition of LOC201181 (Accession XM_113916). Accordingly, utilities of VGAM1928 include diagnosis, prevention and treatment of diseases and clinical conditions associated with LOC201181. LOC201191 (Accession XM_117058) is another VGAM1928 host target gene. LOC201191 BINDING SITE is HOST TARGET binding site found in the 3' untranslated region of mRNA encoded by LOC201191, corresponding to a HOST TARGET binding site such as BINDING SITE I, BINDING SITE II or BINDING SITE III. Table 2 illustrates the complementarity of the nucleotide sequences of LOC201191 BINDING SITE, designated SEQ ID:43215, to the nucleotide sequence of VGAM1928 RNA, herein designated VGAM RNA, also designated SEQ ID:4639.

Another function of VGAM1928 is therefore inhibition of LOC201191 (Accession XM_117058). Accordingly, utilities of VGAM1928 include diagnosis, prevention and treatment of diseases and clinical conditions associated with LOC201191. LOC201799 (Accession XM_114380) is another VGAM1928 host target gene. LOC201799 BINDING SITE is HOST TARGET binding site found in the 3' untranslated region of mRNA encoded by LOC201799, corresponding to a HOST TARGET binding site such as BINDING SITE I, BINDING SITE II or BINDING SITE III. Table 2 illustrates the complementarity of the nucleotide sequences of LOC201799 BINDING SITE, designated SEQ ID:42913, to the nucleotide sequence of VGAM1928 RNA, herein designated VGAM RNA, also designated SEQ ID:4639.

Another function of VGAM1928 is therefore inhibition of LOC201799 (Accession XM_114380). Accordingly, utilities of VGAM1928 include diagnosis, prevention and treatment of diseases and clinical conditions associated with LOC201799. LOC203292 (Accession XM_117527) is another VGAM1928 host target gene. LOC203292 BINDING SITE is HOST TARGET binding site found in the 5' untranslated region of mRNA encoded by LOC203292, corresponding to a HOST TARGET binding site such as BINDING SITE I, BINDING SITE II or BINDING SITE III. Table 2 illustrates the complementarity of the nucleotide sequences of LOC203292 BINDING SITE, designated SEQ ID:43501, to the nucleotide sequence of VGAM1928 RNA, herein designated VGAM RNA, also designated SEQ ID:4639.

Another function of VGAM1928 is therefore inhibition of LOC203292 (Accession XM_117527). Accordingly, utilities of VGAM1928 include diagnosis, prevention and treatment of diseases and clinical conditions associated with LOC203292. LOC204970 (Accession XM_114795) is another VGAM1928 host target gene. LOC204970 BINDING SITE is HOST TARGET binding site found in the 3' untranslated region of mRNA encoded by LOC204970, corresponding to a HOST TARGET binding site such as BINDING SITE I, BINDING SITE II or BINDING SITE III. Table 2 illustrates the complementarity of the nucleotide sequences of LOC204970 BINDING SITE, designated SEQ ID:43072, to the nucleotide sequence of VGAM1928 RNA, herein designated VGAM RNA, also designated SEQ ID:4639.

Another function of VGAM1928 is therefore inhibition of LOC204970 (Accession XM_114795). Accordingly, utilities of VGAM1928 include diagnosis, prevention and treatment of diseases and clinical conditions associated with LOC204970. LOC219649 (Accession XM_167562) is another VGAM1928 host target gene. LOC219649 BINDING SITE is HOST TARGET binding site found in the 3' untranslated region of mRNA encoded by LOC219649, corresponding to a HOST TARGET binding site such as BINDING SITE I, BINDING SITE II or BINDING SITE III. Table 2 illustrates the complementarity of the nucleotide sequences of LOC219649 BINDING SITE, designated SEQ ID:44668, to the nucleotide sequence of VGAM1928 RNA, herein designated VGAM RNA, also designated SEQ ID:4639.

Another function of VGAM1928 is therefore inhibition of LOC219649 (Accession XM_167562). Accordingly, utilities of VGAM1928 include diagnosis, prevention and treatment of diseases and clinical conditions associated with LOC219649. LOC219654 (Accession XM_166095) is another VGAM1928 host target gene. LOC219654 BINDING SITE is HOST TARGET binding site found in the 3' untranslated region of mRNA encoded by LOC219654, corresponding to a HOST TARGET binding site such as BINDING SITE I, BINDING SITE II or BINDING SITE III. Table 2 illustrates the complementarity of the nucleotide sequences of LOC219654 BINDING SITE, designated SEQ ID:43870, to the nucleotide sequence of VGAM1928 RNA, herein designated VGAM RNA, also designated SEQ ID:4639.

Another function of VGAM1928 is therefore inhibition of LOC219654 (Accession XM_166095). Accordingly, utilities of VGAM1928 include diagnosis, prevention and treatment of diseases and clinical conditions associated with LOC219654. LOC219690 (Accession XM_167572) is another VGAM1928 host target gene. LOC219690 BINDING SITE is HOST TARGET binding site found in the 3' untranslated region of mRNA encoded by LOC219690, corresponding to a HOST TARGET binding site such as BINDING SITE I, BINDING SITE II or BINDING SITE III. Table 2 illustrates the complementarity of the nucleotide sequences of LOC219690 BINDING SITE, designated SEQ ID:44706, to the nucleotide sequence of VGAM1928 RNA, herein designated VGAM RNA, also designated SEQ ID:4639.

Another function of VGAM1928 is therefore inhibition of LOC219690 (Accession XM_167572). Accordingly, utilities of VGAM1928 include diagnosis, prevention and treatment of diseases and clinical conditions associated with LOC219690. LOC219790 (Accession XM_166124) is another VGAM1928 host target gene. LOC219790 BINDING SITE is HOST TARGET binding site found in the 3' untranslated region of mRNA encoded by LOC219790, corresponding to a HOST TARGET binding site such as BINDING SITE I, BINDING SITE II or BINDING SITE III. Table 2 illustrates the complementarity of the nucleotide sequences of LOC219790 BINDING SITE, designated SEQ ID:43906, to the nucleotide sequence of VGAM1928 RNA, herein designated VGAM RNA, also designated SEQ ID:4639.

Another function of VGAM1928 is therefore inhibition of LOC219790 (Accession XM_166124). Accordingly, utilities of VGAM1928 include diagnosis, prevention and treatment of diseases and clinical conditions associated with LOC219790. LOC219920 (Accession XM_167787) is another VGAM1928 host target gene. LOC219920 BINDING SITE is HOST TARGET binding site found in the 5' untranslated region of mRNA encoded by LOC219920, corresponding to a HOST TARGET binding site such as BINDING SITE I, BINDING SITE II or BINDING SITE III. Table 2 illustrates the complementarity of the nucleotide sequences of LOC219920 BINDING SITE, designated SEQ ID:44810, to the nucleotide sequence of VGAM1928 RNA, herein designated VGAM RNA, also designated SEQ ID:4639.

Another function of VGAM1928 is therefore inhibition of LOC219920 (Accession XM_167787). Accordingly, utilities of VGAM1928 include diagnosis, prevention and treatment of diseases and clinical conditions associated with LOC219920. LOC220038 (Accession XM_166257) is another VGAM1928 host target gene. LOC220038 BINDING SITE is HOST TARGET binding site found in the 5' untranslated region of mRNA encoded by LOC220038, corresponding to a HOST TARGET binding site such as BINDING SITE I, BINDING SITE II or BINDING SITE III. Table 2 illustrates the complementarity of the nucleotide sequences of LOC220038 BINDING SITE, designated SEQ ID:44081, to the nucleotide sequence of VGAM1928 RNA, herein designated VGAM RNA, also designated SEQ ID:4639.

Another function of VGAM1928 is therefore inhibition of LOC220038 (Accession XM_166257). Accordingly, utilities of VGAM1928 include diagnosis, prevention and treatment of diseases and clinical conditions associated with LOC220038. LOC220763 (Accession XM_055551) is another VGAM1928 host target gene. LOC220763 BINDING SITE is HOST TARGET binding site found in the 5' untranslated region of mRNA encoded by LOC220763, corresponding to a HOST TARGET binding site such as BINDING SITE I, BINDING SITE II or BINDING SITE III. Table 2 illustrates the complementarity of the nucleotide sequences of LOC220763 BINDING SITE, designated SEQ ID:36300, to the nucleotide sequence of VGAM1928 RNA, herein designated VGAM RNA, also designated SEQ ID:4639.

Another function of VGAM1928 is therefore inhibition of LOC220763 (Accession XM_055551). Accordingly, utilities of VGAM1928 include diagnosis, prevention and treatment of diseases and clinical conditions associated with LOC220763. LOC220766 (Accession XM_165471) is another VGAM1928 host target gene. LOC220766 BINDING SITE is HOST TARGET binding site found in the 5' untranslated region of mRNA encoded by LOC220766, corresponding to a HOST TARGET binding site such as BINDING SITE I, BINDING SITE II or BINDING SITE III. Table 2 illustrates the complementarity of the nucleotide sequences of LOC220766 BINDING SITE, designated SEQ ID:43649, to the nucleotide sequence of VGAM1928 RNA, herein designated VGAM RNA, also designated SEQ ID:4639.

Another function of VGAM1928 is therefore inhibition of LOC220766 (Accession XM_165471). Accordingly, utilities of VGAM1928 include diagnosis, prevention and treatment of diseases and clinical conditions associated with LOC220766. LOC220776 (Accession XM_043388) is another VGAM1928 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33938, to the nucleotide sequence of VGAM1928 RNA, herein designated VGAM RNA, also designated SEQ ID:4639.

Another function of VGAM1928 is therefore inhibition of LOC220776 (Accession XM_043388). Accordingly, utilities of VGAM1928 include diagnosis, prevention and treatment of diseases and clinical conditions associated with LOC220776. LOC221431 (Accession XM_166380) is another VGAM1928 host target gene. LOC221431 BINDING SITE is HOST TARGET binding site found in the 3' untranslated region of mRNA encoded by LOC221431, corresponding to a HOST TARGET binding site such as BINDING SITE I, BINDING SITE II or BINDING SITE III. Table 2 illustrates the complementarity of the nucleotide sequences of LOC221431 BINDING SITE, designated SEQ ID:44219, to the nucleotide sequence of VGAM1928 RNA, herein designated VGAM RNA, also designated SEQ ID:4639.

Another function of VGAM1928 is therefore inhibition of LOC221431 (Accession XM_166380). Accordingly, utilities of VGAM1928 include diagnosis, prevention and treatment of diseases and clinical conditions associated with LOC221431. LOC221810 (Accession XM_168222) is another VGAM1928 host target gene. LOC221810 BINDING SITE is HOST TARGET binding site found in the 3' untranslated region of mRNA encoded by LOC221810, corresponding to a HOST TARGET binding site such as BINDING SITE I, BINDING SITE II or BINDING SITE III. Table 2 illustrates the complementarity of the nucleotide sequences of LOC221810 BINDING SITE, designated SEQ ID:45083, to the nucleotide sequence of VGAM1928 RNA, herein designated VGAM RNA, also designated SEQ ID:4639.

Another function of VGAM1928 is therefore inhibition of LOC221810 (Accession XM_168222). Accordingly, utilities of VGAM1928 include diagnosis, prevention and treatment of diseases and clinical conditions associated with LOC221810. LOC222183 (Accession XM_168436) is another VGAM1928 host target gene. LOC222183 BINDING SITE is HOST TARGET binding site found in the 3' untranslated region of mRNA encoded by LOC222183, corresponding to a HOST TARGET binding site such as BINDING SITE I, BINDING SITE II or BINDING SITE III. Table 2 illustrates the complementarity of the nucleotide sequences of LOC222183 BINDING SITE, designated SEQ ID:45187, to the nucleotide sequence of VGAM1928 RNA, herein designated VGAM RNA, also designated SEQ ID:4639.

Another function of VGAM1928 is therefore inhibition of LOC222183 (Accession XM_168436). Accordingly, utilities of VGAM1928 include diagnosis, prevention and treatment of diseases and clinical conditions associated with LOC222183. LOC222256 (Accession XM_168571) is another VGAM1928 host target gene. LOC222256 BINDING SITE is HOST TARGET binding site found in the 3' untranslated region of mRNA encoded by LOC222256, corresponding to a HOST TARGET binding site such as BINDING SITE I, BINDING SITE II or BINDING SITE III. Table 2 illustrates the complementarity of the nucleotide sequences of LOC222256 BINDING SITE, designated SEQ ID:45248, to the nucleotide sequence of VGAM1928 RNA, herein designated VGAM RNA, also designated SEQ ID:4639.

Another function of VGAM1928 is therefore inhibition of LOC222256 (Accession XM_168571). Accordingly, utilities of VGAM1928 include diagnosis, prevention and treatment of diseases and clinical conditions associated with LOC222256. LOC253296 (Accession XM_170512) is another VGAM1928 host target gene. LOC253296 BINDING SITE is HOST TARGET binding site found in the 5' untranslated region of mRNA encoded by LOC253296, corresponding to a HOST TARGET binding site such as BINDING SITE I, BINDING SITE II or BINDING SITE III. Table 2 illustrates the complementarity of the nucleotide sequences of LOC253296 BINDING SITE, designated SEQ ID:45345, to the nucleotide sequence of VGAM1928 RNA, herein designated VGAM RNA, also designated SEQ ID:4639.

Another function of VGAM1928 is therefore inhibition of LOC253296 (Accession XM_170512). Accordingly, utilities of VGAM1928 include diagnosis, prevention and treatment of diseases and clinical conditions associated with LOC253296. LOC253649 (Accession XM_171211) is another VGAM1928 host target gene. LOC253649 BINDING SITE is HOST TARGET binding site found in the 5' untranslated region of mRNA encoded by LOC253649, corresponding to a HOST TARGET binding site such as BINDING SITE I, BINDING SITE II or BINDING SITE III. Table 2 illustrates the complementarity of the nucleotide sequences of LOC253649 BINDING SITE, designated SEQ ID:45999, to the nucleotide sequence of VGAM1928 RNA, herein designated VGAM RNA, also designated SEQ ID:4639.

Another function of VGAM1928 is therefore inhibition of LOC253649 (Accession XM_171211). Accordingly, utilities of VGAM1928 include diagnosis, prevention and treatment of diseases and clinical conditions associated with LOC253649. LOC253650 (Accession XM_171210) is another VGAM1928 host target gene. LOC253650 BINDING SITE is HOST TARGET binding site found in the 5' untranslated region of mRNA encoded by LOC253650, corresponding to a HOST TARGET binding site such as BINDING SITE I, BINDING SITE II or BINDING SITE III. Table 2 illustrates the complementarity of the nucleotide sequences of LOC253650 BINDING SITE, designated SEQ ID:45997, to the nucleotide sequence of VGAM1928 RNA, herein designated VGAM RNA, also designated SEQ ID:4639.

Another function of VGAM1928 is therefore inhibition of LOC253650 (Accession XM_171210). Accordingly, utilities of VGAM1928 include diagnosis, prevention and treatment of diseases and clinical conditions associated with LOC253650. LOC255042 (Accession XM_170896) is another VGAM1928 host target gene. LOC255042 BINDING SITE is HOST TARGET binding site found in the 3' untranslated region of mRNA encoded by LOC255042, corresponding to a HOST TARGET binding site such as BINDING SITE I, BINDING SITE II or BINDING SITE III. Table 2 illustrates the complementarity of the nucleotide sequences of LOC255042 BINDING SITE, designated SEQ ID:45650, to the nucleotide sequence of VGAM1928 RNA, herein designated VGAM RNA, also designated SEQ ID:4639.

Another function of VGAM1928 is therefore inhibition of LOC255042 (Accession XM_170896). Accordingly, utilities of VGAM1928 include diagnosis, prevention and treatment of diseases and clinical conditions associated with LOC255042. LOC256306 (Accession XM_172976) is another VGAM1928 host target gene. LOC256306 BINDING SITE is HOST TARGET binding site found in the 3' untranslated region of mRNA encoded by LOC256306, corresponding to a HOST TARGET binding site such as BINDING SITE I, BINDING SITE II or BINDING SITE III. Table 2 illustrates the complementarity of the nucleotide sequences of LOC256306 BINDING SITE, designated SEQ ID:46237, to the nucleotide sequence of VGAM1928 RNA, herein designated VGAM RNA, also designated SEQ ID:4639.

Another function of VGAM1928 is therefore inhibition of LOC256306 (Accession XM_172976). Accordingly, utilities of VGAM1928 include diagnosis, prevention and treatment of diseases and clinical conditions associated with LOC256306. LOC256905 (Accession XM_173031) is another VGAM1928 host target gene. LOC256905 BINDING SITE is HOST TARGET binding site found in the 3' untranslated region of mRNA encoded by LOC256905, corresponding to a HOST TARGET binding site such as BINDING SITE I, BINDING SITE II or BINDING SITE III. Table 2 illustrates the complementarity of the nucleotide sequences of LOC256905 BINDING SITE, designated SEQ ID:46297, to the nucleotide sequence of VGAM1928 RNA, herein designated VGAM RNA, also designated SEQ ID:4639.

Another function of VGAM1928 is therefore inhibition of LOC256905 (Accession XM_173031). Accordingly, utilities of VGAM1928 include diagnosis, prevention and treatment of diseases and clinical conditions associated with LOC256905. LOC256925 (Accession XM_175065) is another VGAM1928 host target gene. LOC256925 BINDING SITE is HOST TARGET binding site found in the 5' untranslated region of mRNA encoded by LOC256925, corresponding to a HOST TARGET binding site such as BINDING SITE I, BINDING SITE II or BINDING SITE III. Table 2 illustrates the complementarity of the nucleotide sequences of LOC256925 BINDING SITE, designated SEQ ID:46610, to the nucleotide sequence of VGAM1928 RNA, herein designated VGAM RNA, also designated SEQ ID:4639.

Another function of VGAM1928 is therefore inhibition of LOC256925 (Accession XM_175065). Accordingly, utilities of VGAM1928 include diagnosis, prevention and treatment of diseases and clinical conditions associated with LOC256925. LOC256942 (Accession XM_170544) is another VGAM1928 host target gene. LOC256942 BINDING SITE is HOST TARGET binding site found in the 3' untranslated region of mRNA encoded by LOC256942, corresponding to a HOST TARGET binding site such as BINDING SITE I, BINDING SITE II or BINDING SITE III. Table 2 illustrates the complementarity of the nucleotide sequences of LOC256942 BINDING SITE, designated SEQ ID:45365, to the nucleotide sequence of VGAM1928 RNA, herein designated VGAM RNA, also designated SEQ ID:4639.

Another function of VGAM1928 is therefore inhibition of LOC256942 (Accession XM_170544). Accordingly, utilities of VGAM1928 include diagnosis, prevention and treatment of diseases and clinical conditions associated with LOC256942. LOC257408 (Accession XM_171176) is another VGAM1928 host target gene. LOC257408 BINDING SITE is HOST TARGET binding site found in the 5' untranslated region of mRNA encoded by LOC257408, corresponding to a HOST TARGET binding site such as BINDING SITE I, BINDING SITE II or BINDING SITE III. Table 2 illustrates the complementarity of the nucleotide sequences of LOC257408 BINDING SITE, designated SEQ ID:45956, to the nucleotide sequence of VGAM1928 RNA, herein designated VGAM RNA, also designated SEQ ID:4639.

Another function of VGAM1928 is therefore inhibition of LOC257408 (Accession XM_171176). Accordingly, utilities of VGAM1928 include diagnosis, prevention and treatment of diseases and clinical conditions associated with LOC257408. LOC257570 (Accession XM_175239) is another VGAM1928 host target gene. LOC257570 BINDING SITE is HOST TARGET binding site found in the 5' untranslated region of mRNA encoded by LOC257570, corresponding to a HOST TARGET binding site such as BINDING SITE I, BINDING SITE II or BINDING SITE III. Table 2 illustrates the complementarity of the nucleotide sequences of LOC257570 BINDING SITE, designated SEQ ID:46698, to the nucleotide sequence of VGAM1928 RNA, herein designated VGAM RNA, also designated SEQ ID:4639.

Another function of VGAM1928 is therefore inhibition of LOC257570 (Accession XM_175239). Accordingly, utilities of VGAM1928 include diagnosis, prevention and treatment of diseases and clinical conditions associated with LOC257570. LOC51157 (Accession NM_016202) is another VGAM1928 host target gene. LOC51157 BINDING SITE is HOST TARGET binding site found in the 5' untranslated region of mRNA encoded by LOC51157, corresponding to a HOST TARGET binding site such as BINDING SITE I, BINDING SITE II or BINDING SITE III. Table 2 illustrates the complementarity of the nucleotide sequences of LOC51157 BINDING SITE, designated SEQ ID:18298, to the nucleotide sequence of VGAM1928 RNA, herein designated VGAM RNA, also designated SEQ ID:4639.

Another function of VGAM1928 is therefore inhibition of LOC51157 (Accession NM_016202). Accordingly, utilities of VGAM1928 include diagnosis, prevention and treatment of diseases and clinical conditions associated with LOC51157. LOC51285 (Accession NM_016563) is another VGAM1928 host target gene. LOC51285 BINDING SITE is HOST TARGET binding site found in the 3' untranslated region of mRNA encoded by LOC51285, corresponding to a HOST TARGET binding site such as BINDING SITE I, BINDING SITE II or BINDING SITE III. Table 2 illustrates the complementarity of the nucleotide sequences of LOC51285 BINDING SITE, designated SEQ ID:18636, to the nucleotide sequence of VGAM1928 RNA, herein designated VGAM RNA, also designated SEQ ID:4639.

Another function of VGAM1928 is therefore inhibition of LOC51285 (Accession NM_016563). Accordingly, utilities of VGAM1928 include diagnosis, prevention and treatment of diseases and clinical conditions associated with LOC51285. LOC89890 (Accession XM_026976) is another VGAM1928 host target gene. LOC89890 BINDING SITE is HOST TARGET binding site found in the 3' untranslated region of mRNA encoded by LOC89890, corresponding to a HOST TARGET binding site such as BINDING SITE I, BINDING SITE II or BINDING SITE III. Table 2 illustrates the complementarity of the nucleotide sequences of LOC89890 BINDING SITE, designated SEQ ID:30381, to the nucleotide sequence of VGAM1928 RNA, herein designated VGAM RNA, also designated SEQ ID:4639.

Another function of VGAM1928 is therefore inhibition of LOC89890 (Accession XM_026976). Accordingly, utilities of VGAM1928 include diagnosis, prevention and treatment of diseases and clinical conditions associated with LOC89890. LOC90139 (Accession NM_130783) is another VGAM1928 host target gene. LOC90139 BINDING SITE is HOST TARGET binding site found in the 3' untranslated region of mRNA encoded by LOC90139, corresponding to a HOST TARGET binding site such as BINDING SITE I, BINDING SITE II or BINDING SITE III. Table 2 illustrates the complementarity of the nucleotide sequences of LOC90139 BINDING SITE, designated SEQ ID:28274, to the nucleotide sequence of VGAM1928 RNA, herein designated VGAM RNA, also designated SEQ ID:4639.

Another function of VGAM1928 is therefore inhibition of LOC90139 (Accession NM_130783). Accordingly, utilities of VGAM1928 include diagnosis, prevention and treatment of diseases and clinical conditions associated with LOC90139. LOC90499 (Accession XM_032170) is another VGAM1928 host target gene. LOC90499 BINDING SITE is HOST TARGET binding site found in the 5' untranslated region of mRNA encoded by LOC90499, corresponding to a HOST TARGET binding site such as BINDING SITE I, BINDING SITE II or BINDING SITE III. Table 2 illustrates the complementarity of the nucleotide sequences of LOC90499 BINDING SITE, designated SEQ ID:31582, to the nucleotide sequence of VGAM1928 RNA, herein designated VGAM RNA, also designated SEQ ID:4639.

Another function of VGAM1928 is therefore inhibition of LOC90499 (Accession XM_032170). Accordingly, utilities of VGAM1928 include diagnosis, prevention and treatment of diseases and clinical conditions associated with LOC90499. LOC91040 (Accession XM_035641) is another VGAM1928 host target gene. LOC91040 BINDING SITE is HOST TARGET binding site found in the 5' untranslated region of mRNA encoded by LOC91040, corresponding to a HOST TARGET binding site such as BINDING SITE I, BINDING SITE II or BINDING SITE III. Table 2 illustrates the complementarity of the nucleotide sequences of LOC91040 BINDING SITE, designated SEQ ID:32325, to the nucleotide sequence of VGAM1928 RNA, herein designated VGAM RNA, also designated SEQ ID:4639.

Another function of VGAM1928 is therefore inhibition of LOC91040 (Accession XM_035641). Accordingly, utilities of VGAM1928 include diagnosis, prevention and treatment of diseases and clinical conditions associated with LOC91040. LOC91291 (Accession XM_037478) is another VGAM1928 host target gene. LOC91291 BINDING SITE is HOST TARGET binding site found in the 5' untranslated region of mRNA encoded by LOC91291, corresponding to a HOST TARGET binding site such as BINDING SITE I, BINDING SITE II or BINDING SITE III. Table 2 illustrates the complementarity of the nucleotide sequences of LOC91291 BINDING SITE, designated SEQ ID:32631, to the nucleotide sequence of VGAM1928 RNA, herein designated VGAM RNA, also designated SEQ ID:4639.

Another function of VGAM1928 is therefore inhibition of LOC91291 (Accession XM_037478). Accordingly, utilities of VGAM1928 include diagnosis, prevention and treatment of diseases and clinical conditions associated with LOC91291. LOC91516 (Accession XM_038924) is another VGAM1928 host target gene. LOC91516 BINDING SITE is HOST TARGET binding site found in the 5' untranslated region of mRNA encoded by LOC91516, corresponding to a HOST TARGET binding site such as BINDING SITE I, BINDING SITE II or BINDING SITE III. Table 2 illustrates the complementarity of the nucleotide sequences of LOC91516 BINDING SITE, designated SEQ ID:32955, to the nucleotide sequence of VGAM1928 RNA, herein designated VGAM RNA, also designated SEQ ID:4639.

Another function of VGAM1928 is therefore inhibition of LOC91516 (Accession XM_038924). Accordingly, utilities of VGAM1928 include diagnosis, prevention and treatment of diseases and clinical conditions associated with LOC91516. LOC92078 (Accession XM_042684) is another VGAM1928 host target gene. LOC92078 BINDING SITE is HOST TARGET binding site found in the 3' untranslated region of mRNA encoded by LOC92078, corresponding to a HOST TARGET binding site such as BINDING SITE I, BINDING SITE II or BINDING SITE III. Table 2 illustrates the complementarity of the nucleotide sequences of LOC92078 BINDING SITE, designated SEQ ID:33742, to the nucleotide sequence of VGAM1928 RNA, herein designated VGAM RNA, also designated SEQ ID:4639.

Another function of VGAM1928 is therefore inhibition of LOC92078 (Accession XM_042684). Accordingly, utilities of VGAM1928 include diagnosis, prevention and treatment of diseases and clinical conditions associated with LOC92078. LOC92360 (Accession XM_044589) is another VGAM1928 host target gene. LOC92360 BINDING SITE is HOST TARGET binding site found in the 5' untranslated region of mRNA encoded by LOC92360, corresponding to a HOST TARGET binding site such as BINDING SITE I, BINDING SITE II or BINDING SITE III. Table 2 illustrates the complementarity of the nucleotide sequences of LOC92360 BINDING SITE, designated SEQ ID:34239, to the nucleotide sequence of VGAM1928 RNA, herein designated VGAM RNA, also designated SEQ ID:4639.

Another function of VGAM1928 is therefore inhibition of LOC92360 (Accession XM_044589). Accordingly, utilities of VGAM1928 include diagnosis, prevention and treatment of diseases and clinical conditions associated with LOC92360. LOC93550 (Accession XM_051999) is another VGAM1928 host target gene. LOC93550 BINDING SITE is HOST TARGET binding site found in the 5' untranslated region of mRNA encoded by LOC93550, corresponding to a HOST TARGET binding site such as BINDING SITE I, BINDING SITE II or BINDING SITE III. Table 2 illustrates the complementarity of the nucleotide sequences of LOC93550 BINDING SITE, designated SEQ ID:35933, to the nucleotide sequence of VGAM1928 RNA, herein designated VGAM RNA, also designated SEQ ID:4639.

Another function of VGAM1928 is therefore inhibition of LOC93550 (Accession XM_051999). Accordingly, utilities of VGAM1928 include diagnosis, prevention and treatment of diseases and clinical conditions associated with LOC93550. LOC93622 (Accession NM_138699) is another VGAM1928 host target gene. LOC93622 BINDING SITE is HOST TARGET binding site found in the 3' untranslated region of mRNA encoded by LOC93622, corresponding to a HOST TARGET binding site such as BINDING SITE I, BINDING SITE II or BINDING SITE III. Table 2 illustrates the complementarity of the nucleotide sequences of LOC93622 BINDING SITE, designated SEQ ID:28950, to the nucleotide sequence of VGAM1928 RNA, herein designated VGAM RNA, also designated SEQ ID:4639.

Another function of VGAM1928 is therefore inhibition of LOC93622 (Accession NM_138699). Accordingly, utilities of VGAM1928 include diagnosis, prevention and treatment of diseases and clinical conditions associated with LOC93622. FIG. 1 further provides a conceptual description of a novel bioinformatically detected viral gene of the present invention, referred to here as Viral Genomic Address Messenger 1929 (VGAM1929) viral gene, which modulates expression of respective host target genes thereof, the function and utility of which host target genes is known in the art.

VGAM1929 is a novel bioinformatically detected regulatory, non protein coding, viral micro RNA (miRNA) gene. The method by which VGAM1929 was detected is described hereinabove with reference to FIGS. 1-8.

VGAM1929 gene, herein designated VGAM GENE, is a viral gene contained in the genome of Simian Hemorrhagic Fever Virus. VGAM1929 host target gene, herein designated VGAM HOST TARGET GENE, is a human gene contained in the human genome.

VGAM1929 gene encodes a VGAM1929 precursor RNA, herein designated VGAM PRECURSOR RNA. Similar to other miRNA genes, and unlike most ordinary genes, VGAM1929 precursor RNA does not encode a protein. A nucleotide sequence identical or highly similar to the nucleotide sequence of VGAM1929 precursor RNA is designated SEQ ID:1915, and is provided hereinbelow with reference to the sequence listing part. Nucleotide sequence SEQ ID:1915 is located at position 11778 relative to the genome of Simian Hemorrhagic Fever Virus.

VGAM1929 precursor RNA folds onto itself, forming VGAM1929 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1929 folded precursor RNA into VGAM1929 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 87%) nucleotide sequence of VGAM1929 RNA is designated SEQ ID:4640, and is provided hereinbelow with reference to the sequence listing part.

VGAM1929 host target gene, herein designated VGAM HOST TARGET GENE, encodes a corresponding messenger RNA, VGAM1929 host target RNA, herein designated VGAM HOST TARGET RNA. VGAM1929 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1929 RNA, herein designated VGAM RNA, binds complementarily to one or more host target binding sites located in untranslated regions of VGAM1929 host target RNA, herein designated VGAM HOST TARGET RNA. This complementary binding is due to the fact that the nucleotide sequence of VGAM1929 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1929 RNA, herein designated VGAM RNA, may have a different number of host target binding sites in untranslated regions of a VGAM1929 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1929 RNA, herein designated VGAM RNA, to host target binding sites on VGAM1929 host target RNA, herein designated VGAM HOST TARGET RNA, such as BINDING SITE I, BINDING SITE II and BINDING SITE III, inhibits translation of VGAM1929 host target RNA into VGAM1929 host target protein, herein designated VGAM HOST TARGET PROTEIN. VGAM host target protein is therefore outlined by a broken line.

It is appreciated that VGAM1929 host target gene, herein designated VGAM HOST TARGET GENE, in fact represents a plurality of VGAM1929 host target genes. The mRNA of each one of this plurality of VGAM1929 host target genes comprises one or more host target binding sites, each having a nucleotide sequence which is at least partly complementary to VGAM1929 RNA, herein designated VGAM RNA, and which when bound by VGAM1929 RNA causes inhibition of translation of respective one or more VGAM1929 host target proteins.

It is further appreciated by one skilled in the art that the mode of translational inhibition illustrated by FIG. 1 with specific reference to translational inhibition exerted by VGAM1929 gene, herein designated VGAM GENE, on one or more VGAM1929 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1929 is inhibition of expression of host target genes, as part of a novel viral mechanism of attacking a host. Accordingly, utilities of VGAM1929 include diagnosis, prevention and treatment of viral infection by Simian Hemorrhagic Fever Virus. Specific functions, and accordingly utilities, of VGAM1929 correlate with, and may be deduced from, the identity of the host target genes which VGAM1929 binds and inhibits, and the function of these host target genes, as elaborated hereinbelow.

Nucleotide sequences of the VGAM1929 precursor RNA, herein designated VGAM PRECURSOR RNA, and of the 'diced' VGAM1929 RNA, herein designated VGAM RNA, and a schematic representation of the secondary folding of VGAM1929 folded precursor RNA, herein designated VGAM FOLDED PRECURSOR RNA, of VGAM1929 are further described hereinbelow with reference to Table 1.

Nucleotide sequences of host target binding sites, such as BINDING SITE-I, BINDING SITE-II and BINDING SITE-III of FIG. 1, found on VGAM1929 host target RNA, and schematic representation of the complementarity of each of these host target binding sites to VGAM1929 RNA, herein designated VGAM RNA, are described hereinbelow with reference to Table 2.

As mentioned hereinabove with reference to FIG. 1, a function of VGAM1929 gene, herein designated VGAM is inhibition of expression of VGAM1929 target genes. It is appreciated that specific functions, and accordingly utilities, of VGAM1929 correlate with, and may be deduced from, the identity of the target genes which VGAM1929 binds and inhibits, and the function of these target genes, as elaborated hereinbelow.

Adenylate Cyclase 7 (ADCY7, Accession NM_001114) is a VGAM1929 host target gene. ADCY7 BINDING SITE is HOST TARGET binding site found in the 3' untranslated region of mRNA encoded by ADCY7, corresponding to a HOST TARGET binding site such as BINDING SITE I, BINDING SITE II or BINDING SITE III. Table 2 illustrates the complementarity of the nucleotide sequences of ADCY7 BINDING SITE, designated SEQ ID:6786, to the nucleotide sequence of VGAM1929 RNA, herein designated VGAM RNA, also designated SEQ ID:4640.

A function of VGAM1929 is therefore inhibition of Adenylate Cyclase 7 (ADCY7, Accession NM_001114), a gene which this a membrane-bound, ca (2+)-inhibitable adenylyl cyclase. Accordingly, utilities of VGAM1929 include diagnosis, prevention and treatment of diseases and clinical conditions associated with ADCY7. The function of ADCY7 and its association with various diseases and clinical conditions, has been established by previous studies, as described hereinabove with reference to VGAM108. Adrenomedullin (ADM, Accession NM_001124) is another VGAM1929 host target gene. ADM BINDING SITE is HOST TARGET binding site found in the 3' untranslated region of mRNA encoded by ADM, corresponding to a HOST TARGET binding site such as BINDING SITE I, BINDING SITE II or BINDING SITE III. Table 2 illustrates the complementarity of the nucleotide sequences of ADM BINDING SITE, designated SEQ ID:6794, to the nucleotide sequence of VGAM1929 RNA, herein designated VGAM RNA, also designated SEQ ID:4640.

Another function of VGAM1929 is therefore inhibition of Adrenomedullin (ADM, Accession NM_001124), a gene which regulates blood pressure and heart rate. Accordingly, utilities of VGAM1929 include diagnosis, prevention and treatment of diseases and clinical conditions associated with ADM. The function of ADM and its association with various diseases and clinical conditions, has been established by previous studies, as described hereinabove with reference to VGAM842. V-akt Murine Thymoma Viral Oncogene Homolog 1 (AKT1, Accession NM_005163) is another VGAM1929 host target gene. AKT1 BINDING SITE is HOST TARGET binding site found in the 3' untranslated region of mRNA encoded by AKT1, corresponding to a HOST TARGET binding site such as BINDING SITE I, BINDING SITE II or BINDING SITE III. Table 2 illustrates the complementarity of the nucleotide sequences of AKT1 BINDING SITE, designated SEQ ID:11651, to the nucleotide sequence of VGAM1929 RNA, herein designated VGAM RNA, also designated SEQ ID:4640.

Another function of VGAM1929 is therefore inhibition of V-akt Murine Thymoma Viral Oncogene Homolog 1 (AKT1, Accession NM_005163), a gene which Serine-threonine protein kinase. Accordingly, utilities of VGAM1929 include diagnosis, prevention and treatment of diseases and clinical conditions associated with AKT1. The function of AKT1 and its association with various diseases and clinical conditions, has been established by previous studies, as described hereinabove with reference to VGAM188. Amyotrophic Lateral Sclerosis 2 (juvenile) (ALS2, Accession NM_020919) is another VGAM1929 host target gene. ALS2 BINDING SITE is HOST TARGET binding site found in the 3' untranslated region of mRNA encoded by ALS2, corresponding to a HOST TARGET binding site such as BINDING SITE I, BINDING SITE II or BINDING SITE III. Table 2 illustrates the complementarity of the nucleotide sequences of ALS2 BINDING SITE, designated SEQ ID:21929, to the nucleotide sequence of VGAM1929 RNA, herein designated VGAM RNA, also designated SEQ ID:4640.

Another function of VGAM1929 is therefore inhibition of Amyotrophic Lateral Sclerosis 2 (juvenile) (ALS2, Accession NM_020919). Accordingly, utilities of VGAM1929 include diagnosis, prevention and treatment of diseases and clinical conditions associated with ALS2. Adaptor-related Protein Complex 2, Beta 1 Subunit (AP2B1, Accession NM_001282) is another VGAM1929 host target gene. AP2B1 BINDING SITE is HOST TARGET binding site found in the 3' untranslated region of mRNA encoded by AP2B1, corresponding to a HOST TARGET binding site such as BINDING SITE I, BINDING SITE II or BINDING SITE III. Table 2 illustrates the complementarity of the nucleotide sequences of AP2B1 BINDING SITE, designated SEQ ID:6957, to the nucleotide sequence of VGAM1929 RNA, herein designated VGAM RNA, also designated SEQ ID:4640.

Another function of VGAM1929 is therefore inhibition of Adaptor-related Protein Complex 2, Beta 1 Subunit (AP2B1, Accession NM_001282), a gene which links clathrin to receptors in coated vesicles. Accordingly, utilities of VGAM1929 include diagnosis, prevention and treatment of diseases and clinical conditions associated with AP2B1. The function of AP2B1 and its association with various diseases and clinical conditions, has been established by previous studies, as described hereinabove with reference to VGAM1126. Amyloid Beta (A4) Precursor Protein-binding, Family A, Member 1 (X11) (APBA1, Accession XM_046018) is another VGAM1929 host target gene. APBA1 BINDING SITE is HOST TARGET binding site found in the 3' untranslated region of mRNA encoded by APBA1, corresponding to a HOST TARGET binding site such as BINDING SITE I, BINDING SITE II or BINDING SITE III. Table 2 illustrates the complementarity of the nucleotide sequences of APBA1 BINDING SITE, designated SEQ ID:34646, to the nucleotide sequence of VGAM1929 RNA, herein designated VGAM RNA, also designated SEQ ID:4640.

Another function of VGAM1929 is therefore inhibition of Amyloid Beta (A4) Precursor Protein-binding, Family A, Member 1 (X11) (APBA1, Accession XM_046018), a gene which stabilises APP and inhibits production of proteolytic APP fragments. Accordingly, utilities of VGAM1929 include diagnosis, prevention and treatment of diseases and clinical conditions associated with APBA1. The function of APBA1 and its association with various diseases and clinical conditions, has been established by previous studies, as described hereinabove with reference to VGAM247. Rho Guanine Nucleotide Exchange Factor (GEF) 12 (ARHGEF12, Accession NM_015313) is another VGAM1929 host target gene. ARHGEF12 BINDING SITE is HOST TARGET binding site found in the 3' untranslated region of mRNA encoded by ARHGEF12, corresponding to a HOST TARGET binding site such as BINDING SITE I, BINDING SITE II or BINDING SITE III. Table 2 illustrates the complementarity of the nucleotide sequences of ARHGEF12 BINDING SITE, designated SEQ ID:17631, to the nucleotide sequence of VGAM1929 RNA, herein designated VGAM RNA, also designated SEQ ID:4640.

Another function of VGAM1929 is therefore inhibition of Rho Guanine Nucleotide Exchange Factor (GEF) 12 (ARHGEF12, Accession NM_015313). Accordingly, utilities of VGAM1929 include diagnosis, prevention and treatment of diseases and clinical conditions associated with ARHGEF12. Ataxia Telangiectasia Mutated (includes complementation groups A, C and D) (ATM, Accession NM_138293) is another VGAM1929 host target gene. ATM BINDING SITE1 and ATM BINDING SITE2 are HOST TARGET binding sites found in untranslated regions of mRNA encoded by ATM, corresponding to HOST TARGET binding sites such as BINDING SITE I, BINDING SITE II or BINDING SITE III.

Table 2 illustrates the complementarity of the nucleotide sequences of ATM BINDING SITE1 and ATM BINDING SITE2, designated SEQ ID:28707 and SEQ ID:28705 respectively, to the nucleotide sequence of VGAM1929 RNA, herein designated VGAM RNA, also designated SEQ ID:4640.

Another function of VGAM1929 is therefore inhibition of Ataxia Telangiectasia Mutated (includes complementation groups A, C and D) (ATM, Accession NM_138293). Accordingly, utilities of VGAM1929 include diagnosis, prevention and treatment of diseases and clinical conditions associated with ATM. ATPase, Na+/K+ Transporting, Beta 2 Polypeptide (ATP1B2, Accession NM_001678) is another VGAM1929 host target gene. ATP1B2 BINDING SITE is HOST TARGET binding site found in the 3' untranslated region of mRNA encoded by ATP1B2, corresponding to a HOST TARGET binding site such as BINDING SITE I, BINDING SITE II or BINDING SITE III. Table 2 illustrates the complementarity of the nucleotide sequences of ATP1B2 BINDING SITE, designated SEQ ID:7394, to the nucleotide sequence of VGAM1929 RNA, herein designated VGAM RNA, also designated SEQ ID:4640.

Another function of VGAM1929 is therefore inhibition of ATPase, Na+/K+ Transporting, Beta 2 Polypeptide (ATP1B2, Accession NM_001678), a gene which catalyzes the hydrolysis of ATP coupled with the exchange of Na +/K+ ions across the plasma membrane. Accordingly, utilities of VGAM1929 include diagnosis, prevention and treatment of diseases and clinical conditions associated with ATP1B2. The function of ATP1B2 and its association with various diseases and clinical conditions, has been established by previous studies, as described hereinabove with reference to VGAM152. ATPase, H+ Transporting, Lysosomal 70 kDa, V1 Subunit A, Isoform 1 (ATP6V1A1, Accession NM_001690) is another VGAM1929 host target gene. ATP6V1A1 BINDING SITE is HOST TARGET binding site found in the 3' untranslated region of mRNA encoded by ATP6V1A1, corresponding to a HOST TARGET binding site such as BINDING SITE I, BINDING SITE II or BINDING SITE III. Table 2 illustrates the complementarity of the nucleotide sequences of ATP6V1A1 BINDING SITE, designated SEQ ID:7409, to the nucleotide sequence of VGAM1929 RNA, herein designated VGAM RNA, also designated SEQ ID:4640.

Another function of VGAM1929 is therefore inhibition of ATPase, H+ Transporting, Lysosomal 70 kDa, V1 Subunit A, Isoform 1 (ATP6V1A1, Accession NM_001690), a gene which is responsible for acidifying a variety of intracellular compartments in eukaryotic cells. Accordingly, utilities of VGAM1929 include diagnosis, prevention and treatment of diseases and clinical conditions associated with ATP6V1A1. The function of ATP6V1A1 and its association with various diseases and clinical conditions, has been established by previous studies, as described hereinabove with reference to VGAM827. ATPase, Cu++ Transporting, Alpha Polypeptide (Menkes syndrome) (ATP7A, Accession NM_000052) is another VGAM1929 host target gene. ATP7A BINDING SITE is HOST TARGET binding site found in the 3' untranslated region of mRNA encoded by ATP7A, corresponding to a HOST TARGET binding site such as BINDING SITE I, BINDING SITE II or BINDING SITE III. Table 2 illustrates the complementarity of the nucleotide sequences of ATP7A BINDING SITE, designated SEQ ID:5496, to the nucleotide sequence of VGAM1929 RNA, herein designated VGAM RNA, also designated SEQ ID:4640.

Another function of VGAM1929 is therefore inhibition of ATPase, Cu++ Transporting, Alpha Polypeptide (Menkes syndrome) (ATP7A, Accession NM_000052). Accordingly, utilities of VGAM1929 include diagnosis, prevention and treatment of diseases and clinical conditions associated with ATP7A. UDP-Gal:betaGlcNAc Beta 1,4-Galactosyltransferase, Polypeptide 5 (B4GALT5, Accession NM_004776) is another VGAM1929 host target gene. B4GALT5 BINDING SITE is HOST TARGET binding site found in the 3' untranslated region of mRNA encoded by B4GALT5, corresponding to a HOST TARGET binding site such as BINDING SITE I, BINDING SITE II or BINDING SITE III. Table 2 illustrates the complementarity of the nucleotide sequences of B4GALT5 BINDING SITE, designated SEQ ID:11169, to the nucleotide sequence of VGAM1929 RNA, herein designated VGAM RNA, also designated SEQ ID:4640.

Another function of VGAM1929 is therefore inhibition of UDP-Gal:betaGlcNAc Beta 1,4-Galactosyltransferase, Polypeptide 5 (B4GALT5, Accession NM_004776). Accordingly, utilities of VGAM1929 include diagnosis, prevention and treatment of diseases and clinical conditions associated with B4GALT5. BCRP2 (Accession XM_031102) is another VGAM1929 host target gene. BCRP2 BINDING SITE is HOST TARGET binding site found in the 3' untranslated region of mRNA encoded by BCRP2, corresponding to a HOST TARGET binding site such as BINDING SITE I, BINDING SITE II or BINDING SITE III. Table 2 illustrates the complementarity of the nucleotide sequences of BCRP2 BINDING SITE, designated SEQ ID:31277, to the nucleotide sequence of VGAM1929 RNA, herein designated VGAM RNA, also designated SEQ ID:4640.

Another function of VGAM1929 is therefore inhibition of BCRP2 (Accession XM_031102). Accordingly, utilities of VGAM1929 include diagnosis, prevention and treatment of diseases and clinical conditions associated with BCRP2. 2,3-bisphosphoglycerate Mutase (BPGM, Accession NM_001724) is another VGAM1929 host target gene. BPGM BINDING SITE is HOST TARGET binding site found in the 3' untranslated region of mRNA encoded by BPGM, corresponding to a HOST TARGET binding site such as BINDING SITE I, BINDING SITE II or BINDING SITE III. Table 2 illustrates the complementarity of the nucleotide sequences of BPGM BINDING SITE, designated SEQ ID:7456, to the nucleotide sequence of VGAM1929 RNA, herein designated VGAM RNA, also designated SEQ ID:4640.

Another function of VGAM1929 is therefore inhibition of 2,3-bisphosphoglycerate Mutase (BPGM, Accession NM_001724), a gene which plays a role in regulating hemoglobin oxygen affinity. Accordingly, utilities of VGAM1929 include diagnosis, prevention and treatment of diseases and clinical conditions associated with BPGM. The function of BPGM has been established by previous studies. Chen et al. (1971) described a genetically determined electrophoretic variant of 2,3-diphosphoglycerate mutase in a Canadian Eskimo family. The findings in heterozygotes were consistent with the view that the protein is a dimer of 2 identical subunits. Scott and Wright (1982) found DPGM to be polymorphic in 4 Alaskan ethnic groups. Hemoglobin and hematocrit were elevated in all deficient persons. Thus, both hemolytic anemia and polycythemia have been observed with deficiency of DPGM. Rosa et al. (1973, 1978) showed that the DPGM and 2,3-bisphosphoglycerate phosphatase activities of red cells are due to a single enzyme, bisphosphoglycerate mutase (EC 5.4.2.4). Joulin et al. (1986) cloned and sequenced cDNA for human red cell 2,3-bisphosphoglycerate mutase (EC 2.7.5.4). They presented a revised amino acid sequence of human BPGM based on the nucleotide sequence data. BPGM shows some phosphoglycerate mutase activity (Sasaki et al., 1975); nevertheless, the major portion of PGAM activity in the red cells is expressed by PGAMA (OMIM Ref. No. 172250), a protein genetically distinct from BPGM but structurally related to it. The PGAMA locus is situated on chromosome 10. Using a cDNA clone for human BPGM in in situ hybridization experiments, Joulin et al. (1987) and Barichard et al. (1987) mapped the BPGM gene to 7q22-q34. Joulin et al. (1988) isolated the 2,3-bisphosphoglycerate mutase gene from genomic libraries. By Southern blots and DNA sequencing, they determined that it extends over 22 kb and is composed of 2 introns and 3 exons. The second exon correlates with a functional subdomain of the protein. No GC-rich sequence or GC box was found in the 5-prime flanking region of the gene. Both amino acid and cDNA sequence studies show that DPGAM is homologous to PGAM (172250, 261670) (Joulin et al., 1986; Yanagawa et al., 1986).

Full details of the abovementioned studies are described in the following publications, the disclosure of which are hereby incorporated by reference:

Rosa, R.; Prehu, M.-O.; Beuzard, Y.; Rosa, J.: The first case of a complete deficiency of diphosphoglycerate mutase in human erythrocytes. J. Clin. Invest. 62:907-915, 1978; and Joulin, V.; Peduzzi, J.; Romeo, P.-H.; Rosa, R.; Valentin, C.; Dubart, A.; Lapeyre, B.; Blouquit, Y.; Garel, M.-C.; Goossens, M.; Rosa, J.; Cohen-Solal, M.: Molecular cloning and sequen.

Further studies establishing the function and utilities of BPGM are found in John Hopkins OMIM database record ID 222800, and in sited publications numbered 9987-9989, 1841, 9990-9995, 92, 9996-9998, 378 and 9999-10002 listed in the bibliography section hereinbelow, which are also hereby incorporated by reference. BTG Family, Member 2 (BTG2, Accession NM_006763) is another VGAM1929 host target gene. BTG2 BINDING SITE is HOST TARGET binding site found in the 3' untranslated region of mRNA encoded by BTG2, corresponding to a HOST TARGET binding site such as BINDING SITE I, BINDING SITE II or BINDING SITE III. Table 2 illustrates the complementarity of the nucleotide sequences of BTG2 BINDING SITE, designated SEQ ID:13627, to the nucleotide sequence of VGAM1929 RNA, herein designated VGAM RNA, also designated SEQ ID:4640.

Another function of VGAM1929 is therefore inhibition of BTG Family, Member 2 (BTG2, Accession NM_006763). Accordingly, utilities of VGAM1929 include diagnosis, prevention and treatment of diseases and clinical conditions associated with BTG2. Capping Protein (actin filament) Muscle Z-line, Alpha 1 (CAPZA1, Accession XM_052116) is another VGAM1929 host target gene. CAPZA1 BINDING SITE is HOST TARGET binding site found in the 3' untranslated region of mRNA encoded by CAPZA1, corresponding to a HOST TARGET binding site such as BINDING SITE I, BINDING SITE II or BINDING SITE III. Table 2 illustrates the complementarity of the nucleotide sequences of CAPZA1 BINDING SITE, designated SEQ ID:35949, to the nucleotide sequence of VGAM1929 RNA, herein designated VGAM RNA, also designated SEQ ID:4640.

Another function of VGAM1929 is therefore inhibition of Capping Protein (actin filament) Muscle Z-line, Alpha 1 (CAPZA1, Accession XM_052116), a gene which is alpha 1 subunit of actin filament capping protein; binds actin, has roles in cell motility and actin assembly. Accordingly, utilities of VGAM1929 include diagnosis, prevention and treatment of diseases and clinical conditions associated with CAPZA1. The function of CAPZA1 and its association with various diseases and clinical conditions, has been established by previous studies, as described hereinabove with reference to VGAM547. CD83 Antigen (activated B lymphocytes, immunoglobulin superfamily) (CD83, Accession NM_004233) is another VGAM1929 host target gene. CD83 BINDING SITE is HOST TARGET binding site found in the 3' untranslated region of mRNA encoded by CD83, corresponding to a HOST TARGET binding site such as BINDING SITE I, BINDING SITE II or BINDING SITE III. Table 2 illustrates the complementarity of the nucleotide sequences of CD83 BINDING SITE, designated SEQ ID:10427, to the nucleotide sequence of VGAM1929 RNA, herein designated VGAM RNA, also designated SEQ ID:4640.

Another function of VGAM1929 is therefore inhibition of CD83 Antigen (activated B lymphocytes, immunoglobulin superfamily) (CD83, Accession NM_004233), a gene which may play a significant role in antigen presentation or the cellular interactions that follow lymphocyte activation. Accordingly, utilities of VGAM1929 include diagnosis, prevention and treatment of diseases and clinical conditions associated with CD83. The function of CD83 has been established by previous studies. Many cell surface molecules that regulate immune responses contain conserved structural features similar to those found in immunoglobulins. These molecules are presumed to have evolved from a common precursor and are members of a large superfamily. Many of them are involved in cell-cell adhesion and signal transduction Using flow cytometric analysis, Scholler et al. (2001) showed that CD83 binds to monocytes but not lymphocytes and that the binding is enhanced by stress. Immunoprecipitation and immunoblot analysis indicated that CD83 binds to a 72-kD ligand containing sialic acid. Scholler et al. (2001) concluded that CD83 is an adhesion receptor belonging to the SIGLEC family (see OMIM Ref. No. 600751). Animal model experiments lend further support to the function of CD83. Fujimoto et al. (2002) found that CD4 (OMIM Ref. No. 186940)-positive T-cell generation requires engagement of CD83. Cd83 -/- mice had a specific block in Cd4 single-positive thymocyte development without increased Cd4/Cd8 (see OMIM Ref. No. 186910) double-positive or Cd8 single-positive thymocytes. This resulted in a selective 75 to 90% reduction in peripheral Cd4-positive T cells, predominantly within the naive subset. Wildtype thymocytes and bone marrow stem cells failed to differentiate into mature Cd4-positive T cells when transferred into Cd83 -/- mice, while Cd83 -/- thymocytes and stem cells developed normally in wildtype mice. The authors concluded that CD83 expression represents an additional regulatory component for CD4-positive T-cell development in the thymus It is appreciated that the abovementioned animal model for CD83 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Scholler, N.; Hayden-Ledbetter, M.; Hellstrom, K.-E.; Hellstrom, I.; Ledbetter, J. A.: CD83 is a sialic acid-binding Ig-like lectin (Siglec) adhesion receptor that binds monocytes and a subset of activated CD8(+) T cells. J. Immun. 166:3865-3872, 2001; and Fujimoto, Y.; Tu, L.; Miller, A. S.; Bock, C.; Fujimoto, M.; Doyle, C.; Steeber, D. A.; Tedder, T. F.: CD83 expression influences CD4+ T cell development in the thymus. Cell 108:755-76.

Further studies establishing the function and utilities of CD83 are found in John Hopkins OMIM database record ID 604534, and in sited publications numbered 7090-7094, 742 and 7460-7461 listed in the bibliography section hereinbelow, which are also hereby incorporated by reference. Cadherin 1, Type 1, E-cadherin (epithelial) (CDH1, Accession NM_004360) is another VGAM1929 host target gene. CDH1 BINDING SITE is HOST TARGET binding site found in the 3' untranslated region of mRNA encoded by CDH1, corresponding to a HOST TARGET binding site such as BINDING SITE I, BINDING SITE II or BINDING SITE III. Table 2 illustrates the complementarity of the nucleotide sequences of CDH1 BINDING SITE, designated SEQ ID:10564, to the nucleotide sequence of VGAM1929 RNA, herein designated VGAM RNA, also designated SEQ ID:4640.

Another function of VGAM1929 is therefore inhibition of Cadherin 1, Type 1, E-cadherin (epithelial) (CDH1, Accession NM_004360). Accordingly, utilities of VGAM1929 include diagnosis, prevention and treatment of diseases and clinical conditions associated with CDH1. Cadherin 6, Type 2, K-cadherin (fetal kidney) (CDH6, Accession NM_004932) is another VGAM1929 host target gene. CDH6 BINDING SITE is HOST TARGET binding site found in the 3' untranslated region of mRNA encoded by CDH6, corresponding to a HOST TARGET binding site such as BINDING SITE I, BINDING SITE II or BINDING SITE III. Table 2 illustrates the complementarity of the nucleotide sequences of CDH6 BINDING SITE, designated SEQ ID:11379, to the nucleotide sequence of VGAM1929 RNA, herein designated VGAM RNA, also designated SEQ ID:4640.

Another function of VGAM1929 is therefore inhibition of Cadherin 6, Type 2, K-cadherin (fetal kidney) (CDH6, Accession NM_004932), a gene which is a calcium dependent cell adhesion protein. Accordingly, utilities of VGAM1929 include diagnosis, prevention and treatment of diseases and clinical conditions associated with CDH6. The function of CDH6 and its association with various diseases and clinical conditions, has been established by previous studies, as described hereinabove with reference to VGAM60. CERD4 (Accession NM_012074) is another VGAM1929 host target gene. CERD4 BINDING SITE is HOST TARGET binding site found in the 3' untranslated region of mRNA encoded by CERD4, corresponding to a HOST TARGET binding site such as BINDING SITE I, BINDING SITE II or BINDING SITE III. Table 2 illustrates the complementarity of the nucleotide sequences of CERD4 BINDING SITE, designated SEQ ID:14346, to the nucleotide sequence of VGAM1929 RNA, herein designated VGAM RNA, also designated SEQ ID:4640.

Another function of VGAM1929 is therefore inhibition of CERD4 (Accession NM_012074). Accordingly, utilities of VGAM1929 include diagnosis, prevention and treatment of diseases and clinical conditions associated with CERD4. Chromodomain Helicase DNA Binding Protein 2 (CHD2, Accession NM_001271) is another VGAM1929 host target gene. CHD2 BINDING SITE is HOST TARGET binding site found in the 3' untranslated region of mRNA encoded by CHD2, corresponding to a HOST TARGET binding site such as BINDING SITE I, BINDING SITE II or BINDING SITE III. Table 2 illustrates the complementarity of the nucleotide sequences of CHD2 BINDING SITE, designated SEQ ID:6935, to the nucleotide sequence of VGAM1929 RNA, herein designated VGAM RNA, also designated SEQ ID:4640.

Another function of VGAM1929 is therefore inhibition of Chromodomain Helicase DNA Binding Protein 2 (CHD2, Accession NM_001271). Accordingly, utilities of VGAM1929 include diagnosis, prevention and treatment of diseases and clinical conditions associated with CHD2. CIS4 (Accession NM_004232) is another VGAM1929 host target gene. CIS4 BINDING SITE is HOST TARGET binding site found in the 3' untranslated region of mRNA encoded by CIS4, corresponding to a HOST TARGET binding site such as BINDING SITE I, BINDING SITE II or BINDING SITE III. Table 2 illustrates the complementarity of the nucleotide sequences of CIS4 BINDING SITE, designated SEQ ID:10424, to the nucleotide sequence of VGAM1929 RNA, herein designated VGAM RNA, also designated SEQ ID:4640.

Another function of VGAM1929 is therefore inhibition of CIS4 (Accession NM_004232). Accordingly, utilities of VGAM1929 include diagnosis, prevention and treatment of diseases and clinical conditions associated with CIS4. Chloride Channel 4 (CLCN4, Accession NM_001830) is another VGAM1929 host target gene. CLCN4 BINDING SITE is HOST TARGET binding site found in the 5' untranslated region of mRNA encoded by CLCN4, corresponding to a HOST TARGET binding site such as BINDING SITE I, BINDING SITE II or BINDING SITE III. Table 2 illustrates the complementarity of the nucleotide sequences of CLCN4 BINDING SITE, designated SEQ ID:7575, to the nucleotide sequence of VGAM1929 RNA, herein designated VGAM RNA, also designated SEQ ID:4640.

Another function of VGAM1929 is therefore inhibition of Chloride Channel 4 (CLCN4, Accession NM_001830), a gene which is regulation of cell volume; membrane potential stabilization, signal transduction and transepithelial transport. Accordingly, utilities of VGAM1929 include diagnosis, prevention and treatment of diseases and clinical conditions associated with CLCN4. The function of CLCN4 and its association with various diseases and clinical conditions, has been established by previous studies, as described hereinabove with reference to VGAM558. Chloride Channel 6 (CLCN6, Accession NM_001286) is another VGAM1929 host target gene. CLCN6 BINDING SITE1 through CLCN6 BINDING SITE3 are HOST TARGET binding sites found in untranslated regions of mRNA encoded by CLCN6, corresponding to HOST TARGET binding sites such as BINDING SITE I, BINDING SITE II or BINDING SITE III. Table 2 illustrates the complementarity of the nucleotide sequences of CLCN6 BINDING SITE1 through CLCN6 BINDING SITE3, designated SEQ ID:6961, SEQ ID:22338 and SEQ ID:22343 respectively, to the nucleotide sequence of VGAM1929 RNA, herein designated VGAM RNA, also designated SEQ ID:4640.

Another function of VGAM1929 is therefore inhibition of Chloride Channel 6 (CLCN6, Accession NM_001286), a gene which is a voltage-gated chloride channel. Accordingly, utilities of VGAM1929 include diagnosis, prevention and treatment of diseases and clinical conditions associated with CLCN6. The function of CLCN6 and its association with various diseases and clinical conditions, has been established by previous studies, as described hereinabove with reference to VGAM599. Ceroid-lipofuscinosis, Neuronal 5 (CLN5, Accession NM_006493) is another VGAM1929 host target gene. CLN5 BINDING SITE is HOST TARGET binding site found in the 3' untranslated region of mRNA encoded by CLN5, corresponding to a HOST TARGET binding site such as BINDING SITE I, BINDING SITE II or BINDING SITE III. Table 2 illustrates the complementarity of the nucleotide sequences of CLN5 BINDING SITE, designated SEQ ID:13227, to the nucleotide sequence of VGAM1929 RNA, herein designated VGAM RNA, also designated SEQ ID:4640.

Another function of VGAM1929 is therefore inhibition of Ceroid-lipofuscinosis, Neuronal 5 (CLN5, Accession NM_006493). Accordingly, utilities of VGAM1929 include diagnosis, prevention and treatment of diseases and clinical conditions associated with CLN5. Clock Homolog (mouse) (CLOCK, Accession NM_004898) is another VGAM1929 host target gene. CLOCK BINDING SITE is HOST TARGET binding site found in the 3' untranslated region of mRNA encoded by CLOCK, corresponding to a HOST TARGET binding site such as BINDING SITE I, BINDING SITE II or BINDING SITE III. Table 2 illustrates the complementarity of the nucleotide sequences of CLOCK BINDING SITE, designated SEQ ID:11332, to the nucleotide sequence of VGAM1929 RNA, herein designated VGAM RNA, also designated SEQ ID:4640.

Another function of VGAM1929 is therefore inhibition of Clock Homolog (mouse) (CLOCK, Accession NM_004898). Accordingly, utilities of VGAM1929 include diagnosis, prevention and treatment of diseases and clinical conditions associated with CLOCK. Calponin 2 (CNN2, Accession NM_004368) is another VGAM1929 host target gene. CNN2 BINDING SITE is HOST TARGET binding site found in the 3' untranslated region of mRNA encoded by CNN2, corresponding to a HOST TARGET binding site such as BINDING SITE I, BINDING SITE II or BINDING SITE III. Table 2 illustrates the complementarity of the nucleotide sequences of CNN2 BINDING SITE, designated SEQ ID:10585, to the nucleotide sequence of VGAM1929 RNA, herein designated VGAM RNA, also designated SEQ ID:4640.

Another function of VGAM1929 is therefore inhibition of Calponin 2 (CNN2, Accession NM_004368), a gene which may be involved in the structural organization and/or anchorage of actin filaments. Accordingly, utilities of VGAM1929 include diagnosis, prevention and treatment of diseases and clinical conditions associated with CNN2. The function of CNN2 and its association with various diseases and clinical conditions, has been established by previous studies, as described hereinabove with reference to VGAM1498. COX15 Homolog, Cytochrome C Oxidase Assembly Protein (yeast) (COX15, Accession NM_078470) is another VGAM1929 host target gene. COX15 BINDING SITE is HOST TARGET binding site found in the 3' untranslated region of mRNA encoded by COX15, corresponding to a HOST TARGET binding site such as BINDING SITE I, BINDING SITE II or BINDING SITE III. Table 2 illustrates the complementarity of the nucleotide sequences of COX15 BINDING SITE, designated SEQ ID:27795, to the nucleotide sequence of VGAM1929 RNA, herein designated VGAM RNA, also designated SEQ ID:4640.

Another function of VGAM1929 is therefore inhibition of COX15 Homolog, Cytochrome C Oxidase Assembly Protein (yeast) (COX15, Accession NM_078470). Accordingly, utilities of VGAM1929 include diagnosis, prevention and treatment of diseases and clinical conditions associated with COX15. Cytochrome B-561 (CYB561, Accession NM_001915) is another VGAM1929 host target gene. CYB561 BINDING SITE is HOST TARGET binding site found in the 3' untranslated region of mRNA encoded by CYB561, corresponding to a HOST TARGET binding site such as BINDING SITE I, BINDING SITE II or BINDING SITE III. Table 2 illustrates the complementarity of the nucleotide sequences of CYB561 BINDING SITE, designated SEQ ID:7631, to the nucleotide sequence of VGAM1929 RNA, herein designated VGAM RNA, also designated SEQ ID:4640.

Another function of VGAM1929 is therefore inhibition of Cytochrome B-561 (CYB561, Accession NM_001915), a gene which is a secretory vesicle-specific electron transport protein. Accordingly, utilities of VGAM1929 include diagnosis, prevention and treatment of diseases and clinical conditions associated with CYB561. The function of CYB561 has been established by previous studies. Cytochrome b561 is a major transmembrane protein that is specific to catecholamine and neuropeptide secretory vesicles of the adrenal medulla, pituitary gland, and other neuroendocrine tissues. This 30-kD cytochrome is present in both the small synaptic vesicles and the large dense core vesicles (chromaffin granules) of the tissues. Its role is to supply reducing equivalents to 2 monooxygenases, dopamine beta-hydroxylase (OMIM Ref. No. 223360) in chromaffin granules and peptidylglycine alpha-amidating monooxygenase (OMIM Ref. No. 170270) in neurosecretory vesicles. The cytochrome fulfills this role by catalyzing the transfer of electrons from a cytoplasmic donor, ascorbate, across a phospholipid bilayer to the luminal acceptor, semidehydroascorbate, in the interior of the vesicles. The continuously regenerated ascorbate within these vesicles is the immediate donor for the monooxygenases within the neuroendocrine secretory vesicles. Thus, cytochrome b561 is a transmembrane electron channel. Srivastava (1995) showed that the human CYB561 gene contains 5 exons spanning approximately 11 kb. Northern blots showed highest expression in colon cancer lines, T-cell lymphomas and K-562 cells.

Full details of the abovementioned studies are described in the following publications, the disclosure of which are hereby incorporated by reference:

McBride, O. W.; Yi, H. F.; Srivastava, M.: The human cytochrome b561 gene (CYB561) is located at 17q11-qter. Genomics 21:662-663, 1994; and Srivastava, M.: Genomic structure and expression of the human gene encoding cytochrome b (561), an integral protein of the cromaffin granule membrane. J. Biol. Chem. 270: 22714-22720, 1.

Further studies establishing the function and utilities of CYB561 are found in John Hopkins OMIM database record ID 600019, and in sited publications numbered 8789-8790 listed in the bibliography section hereinbelow, which are also hereby incorporated by reference. Cytochrome P450, Subfamily IVA, Polypeptide 11 (CYP4A11, Accession NM_000778) is another VGAM1929 host target gene. CYP4A11 BINDING SITE is HOST TARGET binding site found in the 3' untranslated region of mRNA encoded by CYP4A11, corresponding to a HOST TARGET binding site such as BINDING SITE I, BINDING SITE II or BINDING SITE III. Table 2 illustrates the complementarity of the nucleotide sequences of CYP4A11 BINDING SITE, designated SEQ ID:6419, to the nucleotide sequence of VGAM1929 RNA, herein designated VGAM RNA, also designated SEQ ID:4640.

Another function of VGAM1929 is therefore inhibition of Cytochrome P450, Subfamily IVA, Polypeptide 11 (CYP4A11, Accession NM_000778), a gene which catalyzes the omega- and (omega-1)-hydroxylation of various fatty acids. Accordingly, utilities of VGAM1929 include diagnosis, prevention and treatment of diseases and clinical conditions associated with CYP4A11. The function of CYP4A11 and its association with various diseases and clinical conditions, has been established by previous studies, as described hereinabove with reference to VGAM798. Cytochrome P450, Subfamily VIIIB (sterol 12-alpha-hydroxylase), Polypeptide 1 (CYP8B1, Accession NM_004391) is another VGAM1929 host target gene. CYP8B1 BINDING SITE is HOST TARGET binding site found in the 3' untranslated region of mRNA encoded by CYP8B1, corresponding to a HOST TARGET binding site such as BINDING SITE I, BINDING SITE II or BINDING SITE III. Table 2 illustrates the complementarity of the nucleotide sequences of CYP8B1 BINDING SITE, designated SEQ ID:10626, to the nucleotide sequence of VGAM1929 RNA, herein designated VGAM RNA, also designated SEQ ID:4640.

Another function of VGAM1929 is therefore inhibition of Cytochrome P450, Subfamily VIIIB (sterol 12-alpha-hydroxylase), Polypeptide 1 (CYP8B1, Accession NM_004391), a gene which functions in bile acid biosynthesis. Accordingly, utilities of VGAM1929 include diagnosis, prevention and treatment of diseases and clinical conditions associated with CYP8B1. The function of CYP8B1 and its association with various diseases and clinical conditions, has been established by previous studies, as described hereinabove with reference to VGAM923. Dachshund Homolog (Drosophila) (DACH, Accession NM_080759) is another VGAM1929 host target gene. DACH BINDING SITE is HOST TARGET binding site found in the 5' untranslated region of mRNA encoded by DACH, corresponding to a HOST TARGET binding site such as BINDING SITE I, BINDING SITE II or BINDING SITE III. Table 2 illustrates the complementarity of the nucleotide sequences of DACH BINDING SITE, designated SEQ ID:28036, to the nucleotide sequence of VGAM1929 RNA, herein designated VGAM RNA, also designated SEQ ID:4640.

Another function of VGAM1929 is therefore inhibition of Dachshund Homolog (Drosophila) (DACH, Accession NM_080759), a gene which regulates early progenitor cell proliferation during retinogenesis and pituitary development. Accordingly, utilities of VGAM1929 include diagnosis, prevention and treatment of diseases and clinical conditions associated with DACH. The function of DACH and its association with various diseases and clinical conditions, has been established by previous studies, as described hereinabove with reference to VGAM260. DEAD/H (Asp-Glu-Ala-Asp/His) Box Polypeptide 20, 103 kDa (DDX20, Accession NM_007204) is another VGAM1929 host target gene. DDX20 BINDING SITE is HOST TARGET binding site found in the 3' untranslated region of mRNA encoded by DDX20, corresponding to a HOST TARGET binding site such as BINDING SITE I, BINDING SITE II or BINDING SITE III. Table 2 illustrates the complementarity of the nucleotide sequences of DDX20 BINDING SITE, designated SEQ ID:14068, to the nucleotide sequence of VGAM1929 RNA, herein designated VGAM RNA, also designated SEQ ID:4640.

Another function of VGAM1929 is therefore inhibition of DEAD/H (Asp-Glu-Ala-Asp/His) Box Polypeptide 20, 103 kDa (DDX20, Accession NM_007204), a gene which interacts with SMN and is required for pre-mRNA splicing in the nucleus. Accordingly, utilities of VGAM1929 include diagnosis, prevention and treatment of diseases and clinical conditions associated with DDX20. The function of DDX20 has been established by previous studies. Using coimmunoprecipitation, gel filtration experiments, and in vitro protein-binding assays, Charroux et al. (1999) showed that DDX20 is in a complex with SMN, Gemin2 (SIP1; 602595), and several spliceosomal Sm proteins of snRNPs. Using deletion mutants, they determined that the C-terminal domain of DDX20 mediates the interaction with SMN. They concluded that DDX20 may play an important role in spliceosomal snRNP biogenesis. Klappacher et al. (2002) described a mechanism in which induction of the ETS repressor METS (ETV3; 164873) links terminal differentiation to cell cycle arrest. Using macrophages as a model, they provided evidence that METS blocks RAS (OMIM Ref. No. 190020)-dependent proliferation without inhibiting RAS-dependent expression of cell type-specific genes by selectively replacing ETS activators on the promoters of cell cycle control genes. The antiproliferative effects of METS required its interaction with DP103. Functional interactions between the METS/DP103 complex and E2F (see OMIM Ref. No. 189971)/RB (see OMIM Ref. No. 180200) family proteins were also necessary for inhibition of cellular proliferation, suggesting a combinatorial code that directs permanent cell cycle exit during terminal differentiation.

Full details of the abovementioned studies are described in the following publications, the disclosure of which are hereby incorporated by reference:

Charroux, B.; Pellizzoni, L.; Perkinson, R. A.; Shevchenko, A.; Mann, M.; Dreyfuss, G.: Gemin3: a novel DEAD box protein that interacts with SMN, the spinal muscular atrophy gene product, and is a component of gems. J. Cell Biol. 147:1181-1193, 1999; and Klappacher, G. W.; Lunyak, V. V.; Sykes, D. B.; Sawka-Verhelle, D.; Sage, J.; Brard, G.; Ngo, S. D.; Gangadharan, D.; Jacks, T.; Kamps, M. P.; Rose, D. W.; Rosenfeld, M. G.: An induced.

Further studies establishing the function and utilities of DDX20 are found in John Hopkins OMIM database record ID 606168, and in sited publications numbered 4108-410 and 3141 listed in the bibliography section hereinbelow, which are also hereby incorporated by reference. DEAD/H (Asp-Glu-Ala-Asp/His) Box Polypeptide 6 (RNA helicase, 54 kDa) (DDX6, Accession NM_004397) is another VGAM1929 host target gene. DDX6 BINDING SITE is HOST TARGET binding site found in the 3' untranslated region of mRNA encoded by DDX6, corresponding to a HOST TARGET binding site such as BINDING SITE I, BINDING SITE II or BINDING SITE III. Table 2 illustrates the complementarity of the nucleotide sequences of DDX6 BINDING SITE, designated SEQ ID:10649, to the nucleotide sequence of VGAM1929 RNA, herein designated VGAM RNA, also designated SEQ ID:4640.

Another function of VGAM1929 is therefore inhibition of DEAD/H (Asp-Glu-Ala-Asp/His) Box Polypeptide 6 (RNA helicase, 54 kDa) (DDX6, Accession NM_004397), a gene which is putative RNA helicases. Accordingly, utilities of VGAM1929 include diagnosis, prevention and treatment of diseases and clinical conditions associated with DDX6. The function of DDX6 and its association with various diseases and clinical conditions, has been established by previous studies, as described hereinabove with reference to VGAM179. Distal-less Homeobox 4 (DLX4, Accession NM_138281) is another VGAM1929 host target gene. DLX4 BINDING SITE1 and DLX4 BINDING SITE2 are HOST TARGET binding sites found in untranslated regions of mRNA encoded by DLX4, corresponding to HOST TARGET binding sites such as BINDING SITE I, BINDING SITE II or BINDING SITE III. Table 2 illustrates the complementarity of the nucleotide sequences of DLX4 BINDING SITE1 and DLX4 BINDING SITE2, designated SEQ ID:28695 and SEQ ID:7647 respectively, to the nucleotide sequence of VGAM1929 RNA, herein designated VGAM RNA, also designated SEQ ID:4640.

Another function of VGAM1929 is therefore inhibition of Distal-less Homeobox 4 (DLX4, Accession NM_138281), a gene which may regulate gene expression, morphogenesis, and differentiation. Accordingly, utilities of VGAM1929 include diagnosis, prevention and treatment of diseases and clinical conditions associated with DLX4. The function of DLX4 has been established by previous studies. Using degenerate PCR, Nakamura et al. (1996) cloned a gene, which they referred to as DLX7, from human and mouse that may represent the mammalian ortholog of the newt gene NuHBox-5. They isolated a human cDNA predicting a 167-amino acid protein. The homeodomains of these genes are highly similar to those of all other vertebrate DLX genes, but there is divergence upstream of the homeodomain between the human and mouse DLX7 genes and between DLX7 and other DLX genes. They presented evidence that the mouse Dlx7 gene is alternatively spliced. By Northern blot analysis, Nakamura et al. (1996) found that DLX7 is expressed as a 2.3-kb transcript in several human cell lines. By fluorescence in situ hybridization (FISH), Nakamura et al. (1996) mapped DLX7 to 17q21.3-q22. They stated that the human DLX7 and DLX3 (OMIM Ref. No. 600525) genes are 10 kb apart and are arranged in a tail-to-tail tandem orientation, similarly to that found in mouse. Using dual-color FISH, Nakamura et al. (1996) determined that human DLX7 and HOX9B (OMIM Ref. No. 142964) lie within 2 Mb of one another. Quinn et al. (1997) undertook a DNA binding site screen of a 32-week human placental cDNA library using a consensus homeodomain binding site as a probe. They claimed that this study represented the first library screen carried out to isolate homeo box genes from the human placenta. They found that 3 homeo box genes known to be expressed in embryo, HB24 (OMIM Ref. No. 142995), GAX (OMIM Ref. No. 600535), and MSX2 (OMIM Ref. No. 123101), are also expressed in the placenta. They also identified a novel homeo box gene, designated DLX4 by them, that showed 85% sequence identity with the homeodomain encoded by the Drosophila 'distal-less' gene. Using FISH, they assigned DLX4 to 17q21-q22. This placed DLX4 in the same region of chromosome 17 as a member of the distal-less family gene DLX3 (OMIM Ref. No. 600525) and the HOXB homeo box gene cluster (see OMIM Ref. No. HOXB1; 142968). DLX1 (OMIM Ref. No. 600029) and DLX2 (OMIM Ref. No. 126255) are closely linked on chromosome 2; DLX5 (OMIM Ref. No. 600028) and DLX6 (OMIM Ref. No. 600030) are closely linked on chromosome 7. Thus, Quinn et al. (1997) predicted that DLX3 and DLX4 are closely linked and that they arose through gene duplication and divergence from a common ancestral precursor.

Full details of the abovementioned studies are described in the following publications, the disclosure of which are hereby incorporated by reference:

Morasso, M. I.; Yonescu, R.; Griffin, C. A.; Sargent, T. D.: Localization of human DLX8 to chromosome 17q21.3-q22 by fluorescence in situ hybridization. Mammalian Genome 8:302-303, 1997; and Nakamura, S.; Stock, D. W.; Wydner, K. L.; Bollekens, J. A.; Takeshita, K.; Nagai, B. M.; Chiba, S.; Kitamura, T.; Freeland, T. M.; Zhao, Z.; Minowada, J.; Lawrence, J. B.; Weiss, K. M.

Further studies establishing the function and utilities of DLX4 are found in John Hopkins OMIM database record ID 601911, and in sited publications numbered 913 and 9133 listed in the bibliography section hereinbelow, which are also hereby incorporated by reference. Deoxyribonuclease I (DNASE1, Accession NM_005223) is another VGAM1929 host target gene. DNASE1 BINDING SITE is HOST TARGET binding site found in the 5' untranslated region of mRNA encoded by DNASE1, corresponding to a HOST TARGET binding site such as BINDING SITE I, BINDING SITE II or BINDING SITE III. Table 2 illustrates the complementarity of the nucleotide sequences of DNASE1 BINDING SITE, designated SEQ ID:11717, to the nucleotide sequence of VGAM1929 RNA, herein designated VGAM RNA, also designated SEQ ID:4640.

Another function of VGAM1929 is therefore inhibition of Deoxyribonuclease I (DNASE1, Accession NM_005223), a gene which seems to be involved in cell death. Accordingly, utilities of VGAM1929 include diagnosis, prevention and treatment of diseases and clinical conditions associated with DNASE1. The function of DNASE1 and its association with various diseases and clinical conditions, has been established by previous studies, as described hereinabove with reference to VGAM492. Desmoplakin (DPI, DPII) (DSP, Accession NM_004415) is another VGAM1929 host target gene. DSP BINDING SITE is HOST TARGET binding site found in the 3' untranslated region of mRNA encoded by DSP, corresponding to a HOST TARGET binding site such as BINDING SITE I, BINDING SITE II or BINDING SITE III. Table 2 illustrates the complementarity of the nucleotide sequences of DSP BINDING SITE, designated SEQ ID:10677, to the nucleotide sequence of VGAM1929 RNA, herein designated VGAM RNA, also designated SEQ ID:4640.

Another function of VGAM1929 is therefore inhibition of Desmoplakin (DPI, DPII) (DSP, Accession NM_004415). Accordingly, utilities of VGAM1929 include diagnosis, prevention and treatment of diseases and clinical conditions associated with DSP. Dual Specificity Phosphatase 6 (DUSP6, Accession XM_038308) is another VGAM1929 host target gene. DUSP6 BINDING SITE is HOST TARGET binding site found in the 3' untranslated region of mRNA encoded by DUSP6, corresponding to a HOST TARGET binding site such as BINDING SITE I, BINDING SITE II or BINDING SITE III. Table 2 illustrates the complementarity of the nucleotide sequences of DUSP6 BINDING SITE, designated SEQ ID:32811, to the nucleotide sequence of VGAM1929 RNA, herein designated VGAM RNA, also designated SEQ ID:4640.

Another function of VGAM1929 is therefore inhibition of Dual Specificity Phosphatase 6 (DUSP6, Accession XM_038308), a gene which inactivates map kinases. Accordingly, utilities of VGAM1929 include diagnosis, prevention and treatment of diseases and clinical conditions associated with DUSP6. The function of DUSP6 and its association with various diseases and clinical conditions, has been established by previous studies, as described hereinabove with reference to VGAM1763. Dishevelled, Dsh Homolog 3 (Drosophila) (DVL3, Accession NM_004423) is another VGAM1929 host target gene. DVL3 BINDING SITE is HOST TARGET binding site found in the 3' untranslated region of mRNA encoded by DVL3, corresponding to a HOST TARGET binding site such as BINDING SITE I, BINDING SITE II or BINDING SITE III. Table 2 illustrates the complementarity of the nucleotide sequences of DVL3 BINDING SITE, designated SEQ ID:10695, to the nucleotide sequence of VGAM1929 RNA, herein designated VGAM RNA, also designated SEQ ID:4640.

Another function of VGAM1929 is therefore inhibition of Dishevelled, Dsh Homolog 3 (Drosophila) (DVL3, Accession NM_004423), a gene which regulates cell proliferation. Accordingly, utilities of VGAM1929 include diagnosis, prevention and treatment of diseases and clinical conditions associated with DVL3. The function of DVL3 and its association with various diseases and clinical conditions, has been established by previous studies, as described hereinabove with reference to VGAM57. Dual-specificity tyrosine-(Y)-phosphorylation Regulated Kinase 2 (DYRK2, Accession NM_003583) is another VGAM1929 host target gene. DYRK2 BINDING SITE1 and DYRK2 BINDING SITE2 are HOST TARGET binding sites found in untranslated regions of mRNA encoded by DYRK2, corresponding to HOST TARGET binding sites such as BINDING SITE I, BINDING SITE II or BINDING SITE III. Table 2 illustrates the complementarity of the nucleotide sequences of DYRK2 BINDING SITE1 and DYRK2 BINDING SITE2, designated SEQ ID:9632 and SEQ ID:13208 respectively, to the nucleotide sequence of VGAM1929 RNA, herein designated VGAM RNA, also designated SEQ ID:4640.

Another function of VGAM1929 is therefore inhibition of Dual-specificity tyrosine-(Y)-phosphorylation Regulated Kinase 2 (DYRK2, Accession NM_003583). Accordingly, utilities of VGAM1929 include diagnosis, prevention and treatment of diseases and clinical conditions associated with DYRK2. Ephrin-B1 (EFNB1, Accession NM_004429) is another VGAM1929 host target gene. EFNB1 BINDING SITE is HOST TARGET binding site found in the 3' untranslated region of mRNA encoded by EFNB1, corresponding to a HOST TARGET binding site such as BINDING SITE I, BINDING SITE II or BINDING SITE III. Table 2 illustrates the complementarity of the nucleotide sequences of EFNB1 BINDING SITE, designated SEQ ID:10713, to the nucleotide sequence of VGAM1929 RNA, herein designated VGAM RNA, also designated SEQ ID:4640.

Another function of VGAM1929 is therefore inhibition of Ephrin-B1 (EFNB1, Accession NM_004429), a gene which is a transmembrane ligand of Eph-related receptor tyrosine kinases, has a role in cell adhesion. Accordingly, utilities of VGAM1929 include diagnosis, prevention and treatment of diseases and clinical conditions associated with EFNB1. The function of EFNB1 and its association with various diseases and clinical conditions, has been established by previous studies, as described hereinabove with reference to VGAM390. EH-domain Containing 3 (EHD3, Accession NM_014600) is another VGAM1929 host target gene. EHD3 BINDING SITE is HOST TARGET binding site found in the 3' untranslated region of mRNA encoded by EHD3, corresponding to a HOST TARGET binding site such as BINDING SITE I, BINDING SITE II or BINDING SITE III. Table 2 illustrates the complementarity of the nucleotide sequences of EHD3 BINDING SITE, designated SEQ ID:15958, to the nucleotide sequence of VGAM1929 RNA, herein designated VGAM RNA, also designated SEQ ID:4640.

Another function of VGAM1929 is therefore inhibition of EH-domain Containing 3 (EHD3, Accession NM_014600). Accordingly, utilities of VGAM1929 include diagnosis, prevention and treatment of diseases and clinical conditions associated with EHD3. EH-domain Containing 4 (EHD4, Accession NM_139265) is another VGAM1929 host target gene. EHD4 BINDING SITE is HOST TARGET binding site found in the 3' untranslated region of mRNA encoded by EHD4, corresponding to a HOST TARGET binding site such as BINDING SITE I, BINDING SITE II or BINDING SITE III. Table 2 illustrates the complementarity of the nucleotide sequences of EHD4 BINDING SITE, designated SEQ ID:29257, to the nucleotide sequence of VGAM1929 RNA, herein designated VGAM RNA, also designated SEQ ID:4640.

Another function of VGAM1929 is therefore inhibition of EH-domain Containing 4 (EHD4, Accession NM_139265). Accordingly, utilities of VGAM1929 include diagnosis, prevention and treatment of diseases and clinical conditions associated with EHD4. Eukaryotic Translation Initiation Factor 2C, 1 (EIF2C1, Accession NM_012199) is another VGAM1929 host target gene. EIF2C1 BINDING SITE is HOST TARGET binding site found in the 3' untranslated region of mRNA encoded by EIF2C1, corresponding to a HOST TARGET binding site such as BINDING SITE I, BINDING SITE II or BINDING SITE III. Table 2 illustrates the complementarity of the nucleotide sequences of EIF2C1 BINDING SITE, designated SEQ ID:14505, to the nucleotide sequence of VGAM1929 RNA, herein designated VGAM RNA, also designated SEQ ID:4640.

Another function of VGAM1929 is therefore inhibition of Eukaryotic Translation Initiation Factor 2C, 1 (EIF2C1, Accession NM_012199), a gene which plays an important role in the eukaryotic peptide chain initiation process. Accordingly, utilities of VGAM1929 include diagnosis, prevention and treatment of diseases and clinical conditions associated with EIF2C1. The function of EIF2C1 and its association with various diseases and clinical conditions, has been established by previous studies, as described hereinabove with reference to VGAM118. Eukaryotic Translation Initiation Factor 2, Subunit 3 Gamma, 52 kDa (EIF2S3, Accession NM_001415) is another VGAM1929 host target gene. EIF2S3 BINDING SITE is HOST TARGET binding site found in the 3' untranslated region of mRNA encoded by EIF2S3, corresponding to a HOST TARGET binding site such as BINDING SITE I, BINDING SITE II or BINDING SITE III. Table 2 illustrates the complementarity of the nucleotide sequences of EIF2S3 BINDING SITE, designated SEQ ID:7112, to the nucleotide sequence of VGAM1929 RNA, herein designated VGAM RNA, also designated SEQ ID:4640.

Another function of VGAM1929 is therefore inhibition of Eukaryotic Translation Initiation Factor 2, Subunit 3 Gamma, 52 kDa (EIF2S3, Accession NM_001415), a gene which functions in the early steps of protein synthesis. Accordingly, utilities of VGAM1929 include diagnosis, prevention and treatment of diseases and clinical conditions associated with EIF2S3. The function of EIF2S3 and its association with various diseases and clinical conditions, has been established by previous studies, as described hereinabove with reference to VGAM1254. Eukaryotic Translation Initiation Factor 4 Gamma, 2 (EIF4G2, Accession NM_001418) is another VGAM1929 host target gene. EIF4G2 BINDING SITE is HOST TARGET binding site found in the 3' untranslated region of mRNA encoded by EIF4G2, corresponding to a HOST TARGET binding site such as BINDING SITE I, BINDING SITE II or BINDING SITE III. Table 2 illustrates the complementarity of the nucleotide sequences of EIF4G2 BINDING SITE, designated SEQ ID:7118, to the nucleotide sequence of VGAM1929 RNA, herein designated VGAM RNA, also designated SEQ ID:4640.

Another function of VGAM1929 is therefore inhibition of Eukaryotic Translation Initiation Factor 4 Gamma, 2 (EIF4G2, Accession NM_001418), a gene which is a repressor of translation. Accordingly, utilities of VGAM1929 include diagnosis, prevention and treatment of diseases and clinical conditions associated with EIF4G2. The function of EIF4G2 and its association with various diseases and clinical conditions, has been established by previous studies, as described hereinabove with reference to VGAM1065. Eukaryotic Translation Initiation Factor 5A2 (EIF5A2, Accession NM_020390) is another VGAM1929 host target gene. EIF5A2 BINDING SITE is HOST TARGET binding site found in the 3' untranslated region of mRNA encoded by EIF5A2, corresponding to a HOST TARGET binding site such as BINDING SITE I, BINDING SITE II or BINDING SITE III. Table 2 illustrates the complementarity of the nucleotide sequences of EIF5A2 BINDING SITE, designated SEQ ID:21662, to the nucleotide sequence of VGAM1929 RNA, herein designated VGAM RNA, also designated SEQ ID:4640.

Another function of VGAM1929 is therefore inhibition of Eukaryotic Translation Initiation Factor 5A2 (EIF5A2, Accession NM_020390). Accordingly, utilities of VGAM1929 include diagnosis, prevention and treatment of diseases and clinical conditions associated with EIF5A2. Engulfment and Cell Motility 1 (ced-12 homolog, C. elegans)

(ELMO1, Accession NM_130442) is another VGAM1929 host target gene. ELMO1 BINDING SITE is HOST TARGET binding site found in the 3' untranslated region of mRNA encoded by ELMO1, corresponding to a HOST TARGET binding site such as BINDING SITE I, BINDING SITE II or BINDING SITE III. Table 2 illustrates the complementarity of the nucleotide sequences of ELMO1 BINDING SITE, designated SEQ ID:28202, to the nucleotide sequence of VGAM1929 RNA, herein designated VGAM RNA, also designated SEQ ID:4640.

Another function of VGAM1929 is therefore inhibition of Engulfment and Cell Motility 1 (ced-12 homolog, C. elegans) (ELMO1, Accession NM_130442). Accordingly, utilities of VGAM1929 include diagnosis, prevention and treatment of diseases and clinical conditions associated with ELMO1. Enamelin (ENAM, Accession NM_031889) is another VGAM1929 host target gene. ENAM BINDING SITE is HOST TARGET binding site found in the 3' untranslated region of mRNA encoded by ENAM, corresponding to a HOST TARGET binding site such as BINDING SITE I, BINDING SITE II or BINDING SITE III. Table 2 illustrates the complementarity of the nucleotide sequences of ENAM BINDING SITE, designated SEQ ID:25635, to the nucleotide sequence of VGAM1929 RNA, herein designated VGAM RNA, also designated SEQ ID:4640.

Another function of VGAM1929 is therefore inhibition of Enamelin (ENAM, Accession NM_031889). Accordingly, utilities of VGAM1929 include diagnosis, prevention and treatment of diseases and clinical conditions associated with ENAM. EphA3 (EPHA3, Accession NM_005233) is another VGAM1929 host target gene. EPHA3 BINDING SITE is HOST TARGET binding site found in the 3' untranslated region of mRNA encoded by EPHA3, corresponding to a HOST TARGET binding site such as BINDING SITE I, BINDING SITE II or BINDING SITE III. Table 2 illustrates the complementarity of the nucleotide sequences of EPHA3 BINDING SITE, designated SEQ ID:11742, to the nucleotide sequence of VGAM1929 RNA, herein designated VGAM RNA, also designated SEQ ID:4640.

Another function of VGAM1929 is therefore inhibition of EphA3 (EPHA3, Accession NM_005233), a gene which binds to ephrin-a2, -a3, -a4 and -a5. could play a role in lymphoid function. Accordingly, utilities of VGAM1929 include diagnosis, prevention and treatment of diseases and clinical conditions associated with EPHA3. The function of EPHA3 and its association with various diseases and clinical conditions, has been established by previous studies, as described hereinabove with reference to VGAM164. Erbb2 Interacting Protein (ERBB2IP, Accession NM_018695) is another VGAM1929 host target gene. ERBB2IP BINDING SITE1 and ERBB2IP BINDING SITE2 are HOST TARGET binding sites found in untranslated regions of mRNA encoded by ERBB2IP, corresponding to HOST TARGET binding sites such as BINDING SITE I, BINDING SITE II or BINDING SITE III. Table 2 illustrates the complementarity of the nucleotide sequences of ERBB2IP BINDING SITE1 and ERBB2IP BINDING SITE2, designated SEQ ID:20770 and SEQ ID:20773 respectively, to the nucleotide sequence of VGAM1929 RNA, herein designated VGAM RNA, also designated SEQ ID:4640.

Another function of VGAM1929 is therefore inhibition of Erbb2 Interacting Protein (ERBB2IP, Accession NM_018695), a gene which ERBB2 interacting protein; acts as an adaptor for the receptor ERBB2/HER2. Accordingly, utilities of VGAM1929 include diagnosis, prevention and treatment of diseases and clinical conditions associated with ERBB2IP. The function of ERBB2IP and its association with various diseases and clinical conditions, has been established by previous studies, as described hereinabove with reference to VGAM1019. Fatty-acid-Coenzyme A Ligase, Long-chain 4 (FACL4, Accession NM_004458) is another VGAM1929 host target gene. FACL4 BINDING SITE1 and FACL4 BINDING SITE2 are HOST TARGET binding sites found in untranslated regions of mRNA encoded by FACL4, corresponding to HOST TARGET binding sites such as BINDING SITE I, BINDING SITE II or BINDING SITE III. Table 2 illustrates the complementarity of the nucleotide sequences of FACL4 BINDING SITE1 and FACL4 BINDING SITE2, designated SEQ ID:10763 and SEQ ID:23253 respectively, to the nucleotide sequence of VGAM1929 RNA, herein designated VGAM RNA, also designated SEQ ID:4640.

Another function of VGAM1929 is therefore inhibition of Fatty-acid-Coenzyme A Ligase, Long-chain 4 (FACL4, Accession NM_004458). Accordingly, utilities of VGAM1929 include diagnosis, prevention and treatment of diseases and clinical conditions associated with FACL4. Flap Structure-specific Endonuclease 1 (FEN1, Accession NM_004111) is another VGAM1929 host target gene. FEN1 BINDING SITE is HOST TARGET binding site found in the 3' untranslated region of mRNA encoded by FEN1, corresponding to a HOST TARGET binding site such as BINDING SITE I, BINDING SITE II or BINDING SITE III. Table 2 illustrates the complementarity of the nucleotide sequences of FEN1 BINDING SITE, designated SEQ ID:10322, to the nucleotide sequence of VGAM1929 RNA, herein designated VGAM RNA, also designated SEQ ID:4640.

Another function of VGAM1929 is therefore inhibition of Flap Structure-specific Endonuclease 1 (FEN1, Accession NM_004111), a gene which Flap endonuclease; double-stranded DNA 5'-3' exonuclease. Accordingly, utilities of VGAM1929 include diagnosis, prevention and treatment of diseases and clinical conditions associated with FEN1. The function of FEN1 and its association with various diseases and clinical conditions, has been established by previous studies, as described hereinabove with reference to VGAM1217. Fibronectin Leucine Rich Transmembrane Protein 2 (FLRT2, Accession NM_013231) is another VGAM1929 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14889, to the nucleotide sequence of VGAM1929 RNA, herein designated VGAM RNA, also designated SEQ ID:4640.

Another function of VGAM1929 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM1929 include diagnosis, prevention and treatment of diseases and clinical conditions associated with FLRT2. The function of FLRT2 and its association with various diseases and clinical conditions, has been established by previous studies, as described hereinabove with reference to VGAM247. Forkhead Box F1 (FOXF1, Accession NM_001451) is another VGAM1929 host target gene. FOXF1 BINDING SITE is HOST TARGET binding site found in the 3' untranslated region of mRNA encoded by FOXF1, corresponding to a HOST TARGET binding site such as BINDING SITE I, BINDING SITE II or BINDING SITE III. Table 2 illustrates the complementarity of the nucleotide sequences of FOXF1 BINDING SITE, designated SEQ ID:7184, to the nucleotide sequence of VGAM1929 RNA, herein designated VGAM RNA, also designated SEQ ID:4640.

Another function of VGAM1929 is therefore inhibition of Forkhead Box F1 (FOXF1, Accession NM_001451), a gene which is a probable transcription activator for a number of lung-specific genes. Accordingly, utilities of VGAM1929 include diagnosis, prevention and treatment of diseases and clinical conditions associated with FOXF1. The function of FOXF1 and its association with various diseases and clinical conditions, has been established by previous studies, as described hereinabove with reference to VGAM292. FREB (Accession NM_032738) is another VGAM1929 host target gene. FREB BINDING SITE is HOST TARGET binding site found in the 3' untranslated region of mRNA encoded by FREB, corresponding to a HOST TARGET binding site such as BINDING SITE I, BINDING SITE II or BINDING SITE III. Table 2 illustrates the complementarity of the nucleotide sequences of FREB BINDING SITE, designated SEQ ID:26468, to the nucleotide sequence of VGAM1929 RNA, herein designated VGAM RNA, also designated SEQ ID:4640.

Another function of VGAM1929 is therefore inhibition of FREB (Accession NM_032738). Accordingly, utilities of VGAM1929 include diagnosis, prevention and treatment of diseases and clinical conditions associated with FREB. FXYD Domain Containing Ion Transport Regulator 6 (FXYD6, Accession NM_022003) is another VGAM1929 host target gene. FXYD6 BINDING SITE is HOST TARGET binding site found in the 3' untranslated region of mRNA encoded by FXYD6, corresponding to a HOST TARGET binding site such as BINDING SITE I, BINDING SITE II or BINDING SITE III. Table 2 illustrates the complementarity of the nucleotide sequences of FXYD6 BINDING SITE, designated SEQ ID:22549, to the nucleotide sequence of VGAM1929 RNA, herein designated VGAM RNA, also designated SEQ ID:4640.

Another function of VGAM1929 is therefore inhibition of FXYD Domain Containing Ion Transport Regulator 6 (FXYD6, Accession NM_022003). Accordingly, utilities of VGAM1929 include diagnosis, prevention and treatment of diseases and clinical conditions associated with FXYD6. GTP Cyclohydrolase 1 (dopa-responsive dystonia) (GCH1, Accession NM_000161) is another VGAM1929 host target gene. GCH1 BINDING SITE1 and GCH1 BINDING SITE2 are HOST TARGET binding sites found in untranslated regions of mRNA encoded by GCH1, corresponding to HOST TARGET binding sites such as BINDING SITE I, BINDING SITE II or BINDING SITE III. Table 2 illustrates the complementarity of the nucleotide sequences of GCH1 BINDING SITE1 and GCH1 BINDING SITE2, designated SEQ ID:5666 and SEQ ID:5667 respectively, to the nucleotide sequence of VGAM1929 RNA, herein designated VGAM RNA, also designated SEQ ID:4640.

Another function of VGAM1929 is therefore inhibition of GTP Cyclohydrolase 1 (dopa-responsive dystonia) (GCH1, Accession NM_000161). Accordingly, utilities of VGAM1929 include diagnosis, prevention and treatment of diseases and clinical conditions associated with GCH1. Glutamate Receptor, Metabotropic 1 (GRM1, Accession NM_000838) is another VGAM1929 host target gene. GRM1 BINDING SITE1 and GRM1 BINDING SITE2 are HOST TARGET binding sites found in untranslated regions of mRNA encoded by GRM1, corresponding to HOST TARGET binding sites such as BINDING SITE I, BINDING SITE II or BINDING SITE III. Table 2 illustrates the complementarity of the nucleotide sequences of GRM1 BINDING SITE1 and GRM1 BINDING SITE2, designated SEQ ID:6500 and SEQ ID:6501 respectively, to the nucleotide sequence of VGAM1929 RNA, herein designated VGAM RNA, also designated SEQ ID:4640.

Another function of VGAM1929 is therefore inhibition of Glutamate Receptor, Metabotropic 1 (GRM1, Accession NM_000838), a gene which promotes phosphoinositide hydrolysis. Accordingly, utilities of VGAM1929 include diagnosis, prevention and treatment of diseases and clinical conditions associated with GRM1. The function of GRM1 and its association with various diseases and clinical conditions, has been established by previous studies, as described hereinabove with reference to VGAM786. Histone Deacetylase 4 (HDAC4, Accession NM_006037) is another VGAM1929 host target gene. HDAC4 BINDING SITE is HOST TARGET binding site found in the 3' untranslated region of mRNA encoded by HDAC4, corresponding to a HOST TARGET binding site such as BINDING SITE I, BINDING SITE II or BINDING SITE III. Table 2 illustrates the complementarity of the nucleotide sequences of HDAC4 BINDING SITE, designated SEQ ID:12662, to the nucleotide sequence of VGAM1929 RNA, herein designated VGAM RNA, also designated SEQ ID:4640.

Another function of VGAM1929 is therefore inhibition of Histone Deacetylase 4 (HDAC4, Accession NM_006037), a gene which is responsible for the deacetylation of lysine residues on the n-terminal part of the core histones and may mediate transcriptional regulation. Accordingly, utilities of VGAM1929 include diagnosis, prevention and treatment of diseases and clinical conditions associated with HDAC4. The function of HDAC4 and its association with various diseases and clinical conditions, has been established by previous studies, as described hereinabove with reference to VGAM264. Hepatoma-derived Growth Factor (high-mobility group protein 1-like) (HDGF, Accession NM_004494) is another VGAM1929 host target gene. HDGF BINDING SITE is HOST TARGET binding site found in the 3' untranslated region of mRNA encoded by HDGF, corresponding to a HOST TARGET binding site such as BINDING SITE I, BINDING SITE II or BINDING SITE III. Table 2 illustrates the complementarity of the nucleotide sequences of HDGF BINDING SITE, designated SEQ ID:10833, to the nucleotide sequence of VGAM1929 RNA, herein designated VGAM RNA, also designated SEQ ID:4640.

Another function of VGAM1929 is therefore inhibition of Hepatoma-derived Growth Factor (high-mobility group protein 1-like) (HDGF, Accession NM_004494), a gene which is a heparin-binding protein, with mitogenic activity for fibroblasts. Accordingly, utilities of VGAM1929 include diagnosis, prevention and treatment of diseases and clinical conditions associated with HDGF. The function of HDGF has been established by previous studies. Nakamura et al. (1994) purified a novel hepatoma-derived growth factor from the conditioned medium of human hepatoma-derived cell line HuH-7. Molecular cloning of a cDNA from the cDNA library of the same cell line was done on the basis of the N-terminal amino acid sequence. The cDNA was 2.4 kb long and the deduced amino acid sequence contained 240 amino acids without a signal peptide-like N-terminal hydrophobic sequence. The primary sequence shared homology with the high mobility group-1 protein (OMIM Ref. No. 163905); they showed 23.4% amino acid identity and 35.6% amino acid similarity. Immunofluorescence study showed that HDGF is localized in the cytoplasm of hepatoma cells and northern blots showed that it is expressed ubiquitously in normal tissues and tumor cell lines. Nakamura et al. (1994) suggested that it is a novel heparin-binding protein with mitogenic activity for fibroblasts. HDGF is ubiquitously expressed in normal tissues and tumor cell lines. By PCR screening of a commercial monochromosomal hybrid panel, Wanschura et al. (1996) mapped HDGF to the X chromosome. By fluorescence in situ hybridization, they determined the subchromosomal localization to be Xq25. Whereas a major group of the HMG protein family has been mapped to chromosomal segments frequently involved in the tumorigenesis of benign solid tumors, no tumor association for the Xq25 region was known.

Full details of the abovementioned studies are described in the following publications, the disclosure of which are hereby incorporated by reference:

Nakamura, H.; Izumoto, Y.; Kambe, H.; Kuroda, T.; Mori, T.; Kawamura, K.; Yamamoto, H.; Kishimoto, T.: Molecular cloning of complementary DNA for a novel human hepatoma-derived growth factor: its homology with high mobility group-1 protein. J. Biol. Chem. 269:25143-25149, 1994; and Wanschura, S.; Schoenmakers, E. F. P. M.; Huysmans, C.; Bartnitzke, S.; Van de Ven, W. J. M.; Bullerdiek, J.: Mapping of the gene encoding the human hepatoma-derived growth factor (HDG.

Further studies establishing the function and utilities of HDGF are found in John Hopkins OMIM database record ID 300043, and in sited publications numbered 8839-8840 listed in the bibliography section hereinbelow, which are also hereby incorporated by reference. Hepatocyte Growth Factor (hepapoietin A; scatter factor) (HGF, Accession XM_168542) is another VGAM1929 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45222, to the nucleotide sequence of VGAM1929 RNA, herein designated VGAM RNA, also designated SEQ ID:4640.

Another function of VGAM1929 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM1929 include diagnosis, prevention and treatment of diseases and clinical conditions associated with HGF. The function of HGF and its association with various diseases and clinical conditions, has been established by previous studies, as described hereinabove with reference to VGAM174. Hypermethylated In Cancer 1 (HIC1, Accession XM_113307) is another VGAM1929 host target gene. HIC1 BINDING SITE is HOST TARGET binding site found in the 5' untranslated region of mRNA encoded by HIC1, corresponding to a HOST TARGET binding site such as BINDING SITE I, BINDING SITE II or BINDING SITE III. Table 2 illustrates the complementarity of the nucleotide sequences of HIC1 BINDING SITE, designated SEQ ID:42210, to the nucleotide sequence of VGAM1929 RNA, herein designated VGAM RNA, also designated SEQ ID:4640.

Another function of VGAM1929 is therefore inhibition of Hypermethylated In Cancer 1 (HIC1, Accession XM_113307), a gene which is a transcriptional repressor and may act as a tumor suppressor. Accordingly, utilities of VGAM1929 include diagnosis, prevention and treatment of diseases and clinical conditions associated with HIC1. The function of HIC1 has been established by previous studies. The human HIC1 (hypermethylated in cancer) gene maps to 17p13.3 and is deleted in the contiguous gene disorder Miller-Dieker syndrome (MDS; 247200) (Makos Wales et al., 1995; Chong et al., 1996). Grimm et al. (1999) isolated the murine Hic1 gene, which encodes a zinc finger protein with a poxvirus and zinc finger (POZ) domain. Comparison of genomic and cDNA sequences predicted 2 exons for the murine Hic1 gene. The second exon exhibits 88% identity at the DNA level to the corresponding region of the human HIC1 gene. During embryonic development, Hic1 is expressed in mesenchymes of the sclerotomes, lateral body wall, limb, and craniofacial regions embedding the outgrowing peripheral nerves during their differentiation. During fetal development, Hic1 is also expressed in mesenchymes apposed to the precartilaginous condensations, at many interfaces to budding epithelia of inner organs, and weakly in muscles. Grimm et al. (1999) observed activation of Hic1 expression in the embryonic anlagen of many tissues displaying anomalies in MDS patients. Besides lissencephaly, MDS patients exhibit facial dysmorphism and frequently additional birth defects, e.g., anomalies of the heart, kidney, gastrointestinal tract, and the limbs. Thus, HIC1 activity may correlate with the defective development of the nose, jaws, extremities, gastrointestinal tract, and kidney in MDS patients. Animal model experiments lend further support to the function of HIC1. The location of HIC1 in the Miller-Dieker syndrome critical deletion region on 17p13.3 makes it a candidate gene for involvement in the MDS gene deletion syndrome. To study the function of murine Hic1 in development, Carter et al. (2000) created Hic1-deficient mice. They found that these animals died perinatally and exhibited varying combinations of gross developmental defects throughout the second half of development, including acrania, exencephaly, cleft palate, limb anomalies, and omphalocele. These abnormalities demonstrated a role for Hic1 in the development of structures affected in the Miller-Dieker syndrome, and provided functional evidence to strengthen its candidacy as a gene involved in that disorder.

It is appreciated that the abovementioned animal model for HIC1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Carter, M. G.; Johns, M. A.; Zeng, X.; Zhou, L.; Zink, M. C.; Mankowski, J. L.; Donovan, D. M.; Baylin, S. B.: Mice deficient in the candidate tumor suppressor gene Hic1 exhibit developmental defects of structures affected in the Miller-Dieker syndrome. Hum. Molec. Genet. 9:413-419, 2000; and Grimm, C.; Sporle, R.; Schmid, T. E.; Adler, I.-D.; Adamski, J.; Schughart, K.; Graw, J.: Isolation and embryonic expression of the novel mouse gene Hic1, the homologue of HIC1, a cand.

Further studies establishing the function and utilities of HIC1 are found in John Hopkins OMIM database record ID 603825, and in sited publications numbered 5183-5186 listed in the bibliography section hereinbelow, which are also hereby incorporated by reference. Homeo Box B5 (HOXB5, Accession NM_002147) is another VGAM1929 host target gene. HOXB5 BINDING SITE is HOST TARGET binding site found in the 3' untranslated region of mRNA encoded by HOXB5, corresponding to a HOST TARGET binding site such as BINDING SITE I, BINDING SITE II or BINDING SITE III. Table 2 illustrates the complementarity of the nucleotide sequences of HOXB5 BINDING SITE, designated SEQ ID:7925, to the nucleotide sequence of VGAM1929 RNA, herein designated VGAM RNA, also designated SEQ ID:4640.

Another function of VGAM1929 is therefore inhibition of Homeo Box B5 (HOXB5, Accession NM_002147), a gene which may regulate gene expresion, morphogenesis and differentiation. Accordingly, utilities of VGAM1929 include diagnosis, prevention and treatment of diseases and clinical conditions associated with HOXB5. The function of HOXB5 has been established by previous studies. As reviewed by Acampora et al. (1989), the homeo box region 2 contains 9 homeo box genes in 180 kb of DNA on chromosome 17. The order, from 5-prime to 3-prime, is HOXB9 (HOX2E), HOXB8 (HOX2D), HOXB7 (HOX2C), HOXB6 (HOX2B), HOXB5 (HOX2A), HOXB4 (HOX2F), HOXB3 (HOX2G), HOXB2 (HOX2H), HOXB1 (HOX2I). Classical models of craniofacial development argue that the neural crest is pre-patterned or preprogrammed to make specific head structures before its migration from the neural tube. In contrast, recent studies in several vertebrates, including mouse, chick, and zebrafish, have provided evidence for plasticity in patterning neural crest populations. Using tissue transposition and molecular analyses in avian embryos, Trainor et al. (2002) reconciled these findings by demonstrating that classical manipulation experiments, which form the basis of the pre-patterning model, involved transplantation of a local signaling center, the isthmic organizer. FGF8 (OMIM Ref. No. 600483) signaling from the isthmus alters HOXA2 expression and consequently branchial arch patterning, demonstrating that neural crest cells are patterned by environmental signals.

Full details of the abovementioned studies are described in the following publications, the disclosure of which are hereby incorporated by reference:

Acampora, D.; d'Esposito, M.; Faiella, A.; Pannese, M.; Migliaccio, E.; Morelli, F.; Stornaiuolo, A.; Nigro, V.; Simeone, A.; Boncinelli, E.: The human HOX gene family. Nucleic Acids Res. 17:10385-10402, 1989; and Trainor, P. A.; Ariza-McNaughton, L.; Krumlauf, R.: Role of the isthmus and FGFs in resolving the paradox of neural crest plasticity and prepatterning. Science 295:1288-1291, 2002.

Further studies establishing the function and utilities of HOXB5 are found in John Hopkins OMIM database record ID 142960, and in sited publications numbered 5207-2646, 5213-2651, 5217-5218, 2652-265 and 11977 listed in the bibliography section hereinbelow, which are also hereby incorporated by reference. Homeo Box C4 (HOXC4, Accession NM_014620) is another VGAM1929 host target gene. HOXC4 BINDING SITE is HOST TARGET binding site found in the 5' untranslated region of mRNA encoded by HOXC4, corresponding to a HOST TARGET binding site such as BINDING SITE I, BINDING SITE II or BINDING SITE III. Table 2 illustrates the complementarity of the nucleotide sequences of HOXC4 BINDING SITE, designated SEQ ID:15974, to the nucleotide sequence of VGAM1929 RNA, herein designated VGAM RNA, also designated SEQ ID:4640.

Another function of VGAM1929 is therefore inhibition of Homeo Box C4 (HOXC4, Accession NM_014620), a gene which is part of a developmental regulatory system that provides cells with specific positional identities on the anterior-posterior axis. Accordingly, utilities of VGAM1929 include diagnosis, prevention and treatment of diseases and clinical conditions associated with HOXC4. The function of HOXC4 and its association with various diseases and clinical conditions, has been established by previous studies, as described hereinabove with reference to VGAM206. Heat Shock 70 kDa Protein 4 (HSPA4, Accession XM_114482) is another VGAM1929 host target gene. HSPA4 BINDING SITE is HOST TARGET binding site found in the 3' untranslated region of mRNA encoded by HSPA4, corresponding to a HOST TARGET binding site such as BINDING SITE I, BINDING SITE II or BINDING SITE III. Table 2 illustrates the complementarity of the nucleotide sequences of HSPA4 BINDING SITE, designated SEQ ID:42976, to the nucleotide sequence of VGAM1929 RNA, herein designated VGAM RNA, also designated SEQ ID:4640.

Another function of VGAM1929 is therefore inhibition of Heat Shock 70kDa Protein 4 (HSPA4, Accession XM_114482). Accordingly, utilities of VGAM1929 include diagnosis, prevention and treatment of diseases and clinical conditions associated with HSPA4. Isoprenylcysteine Carboxyl Methyltransferase (ICMT, Accession NM_012405) is another VGAM1929 host target gene. ICMT BINDING SITE is HOST TARGET binding site found in the 3' untranslated region of mRNA encoded by ICMT, corresponding to a HOST TARGET binding site such as BINDING SITE I, BINDING SITE II or BINDING SITE III. Table 2 illustrates the complementarity of the nucleotide sequences of ICMT BINDING SITE, designated SEQ ID:14782, to the nucleotide sequence of VGAM1929 RNA, herein designated VGAM RNA, also designated SEQ ID:4640.

Another function of VGAM1929 is therefore inhibition of Isoprenylcysteine Carboxyl Methyltransferase (ICMT, Accession NM_012405). Accordingly, utilities of VGAM1929 include diagnosis, prevention and treatment of diseases and clinical conditions associated with ICMT. Interleukin 2 Receptor, Beta (IL2RB, Accession NM_000878) is another VGAM1929 host target gene. IL2RB BINDING SITE is HOST TARGET binding site found in the 3' untranslated region of mRNA encoded by IL2RB, corresponding to a HOST TARGET binding site such as BINDING SITE I, BINDING SITE II or BINDING SITE III. Table 2 illustrates the complementarity of the nucleotide sequences of IL2RB BINDING SITE, designated SEQ ID:6576, to the nucleotide sequence of VGAM1929 RNA, herein designated VGAM RNA, also designated SEQ ID:4640.

Another function of VGAM1929 is therefore inhibition of Interleukin 2 Receptor, Beta (IL2RB, Accession NM_000878), a gene which is involved in receptor mediated endocytosis and transduces the mitogenic signals of il-2. Accordingly, utilities of VGAM1929 include diagnosis, prevention and treatment of diseases and clinical conditions associated with IL2RB. The function of IL2RB and its association with various diseases and clinical conditions, has been established by previous studies, as described hereinabove with reference to VGAM450. Integrin, Alpha 6 (ITGA6, Accession NM_000210) is another VGAM1929 host target gene. ITGA6 BINDING SITE is HOST TARGET binding site found in the 3' untranslated region of mRNA encoded by ITGA6, corresponding to a HOST TARGET binding site such as BINDING SITE I, BINDING SITE II or BINDING SITE III. Table 2 illustrates the complementarity of the nucleotide sequences of ITGA6 BINDING SITE, designated SEQ ID:5706, to the nucleotide sequence of VGAM1929 RNA, herein designated VGAM RNA, also designated SEQ ID:4640.

Another function of VGAM1929 is therefore inhibition of Integrin, Alpha 6 (ITGA6, Accession NM_000210). Accordingly, utilities of VGAM1929 include diagnosis, prevention and treatment of diseases and clinical conditions associated with ITGA6. Jagged 2 (JAG2, Accession NM_002226) is another VGAM1929 host target gene. JAG2 BINDING SITE is HOST TARGET binding site found in the 3' untranslated region of mRNA encoded by JAG2, corresponding to a HOST TARGET binding site such as BINDING SITE I, BINDING SITE II or BINDING SITE III. Table 2 illustrates the complementarity of the nucleotide sequences of JAG2 BINDING SITE, designated SEQ ID:8007, to the nucleotide sequence of VGAM1929 RNA, herein designated VGAM RNA, also designated SEQ ID:4640.

Another function of VGAM1929 is therefore inhibition of Jagged 2 (JAG2, Accession NM_002226), a gene which is a putative notch ligand involved in the mediation of notch signaling. Accordingly, utilities of VGAM1929 include diagnosis, prevention and treatment of diseases and clinical conditions associated with JAG2. The function of JAG2 and its association with various diseases and clinical conditions, has been established by previous studies, as described hereinabove with reference to VGAM136. Kinesin Family Member 1B (KIF1B, Accession NM_015074) is another VGAM1929 host target gene. KIF1B BINDING SITE is HOST TARGET binding site found in the 3" untranslated region of mRNA encoded by KIF1B, corresponding to a HOST TARGET binding site such as BINDING SITE I, BINDING SITE II or BINDING SITE III. Table 2 illustrates the complementarity of the nucleotide sequences of KIF1B BINDING SITE, designated SEQ ID:17448, to the nucleotide sequence of VGAM1929 RNA, herein designated VGAM RNA, also designated SEQ ID:4640.

Another function of VGAM1929 is therefore inhibition of Kinesin Family Member 1B (KIF1B, Accession NM_015074), a gene which motor for anterograde transport of mitochondria. has a microtubule plus end-directed motility. Accordingly, utilities of VGAM1929 include diagnosis, prevention and treatment of diseases and clinical conditions associated with KIF1B. The function of KIF1B and its association with various diseases and clinical conditions, has been established by previous studies, as described hereinabove with reference to VGAM1026. Laminin, Gamma 1 (formerly LAMB2) (LAMC1, Accession NM_002293) is another VGAM1929 host target gene. LAMC1 BINDING SITE is HOST TARGET binding site found in the 3' untranslated region of mRNA encoded by LAMC1, corresponding to a HOST TARGET binding site such as BINDING SITE I, BINDING SITE II or BINDING SITE III. Table 2 illustrates the complementarity of the nucleotide sequences of LAMC1 BINDING SITE, designated SEQ ID:8075, to the nucleotide sequence of VGAM1929 RNA, herein designated VGAM RNA, also designated SEQ ID:4640.

Another function of VGAM1929 is therefore inhibition of Laminin, Gamma 1 (formerly LAMB2) (LAMC1, Accession NM_002293), a gene which may mediate the attachment, migration, and organization of cells into tissues. Accordingly, utilities of VGAM1929 include diagnosis, prevention and treatment of diseases and clinical conditions associated with LAMC1. The function of LAMC1 and its association with various diseases and clinical conditions, has been established by previous studies, as described hereinabove with reference to VGAM812. LIM Domain Binding 3 (LDB3, Accession XM_084376) is another VGAM1929 host target gene. LDB3 BINDING SITE is HOST TARGET binding site found in the 3' untranslated region of mRNA encoded by LDB3, corresponding to a HOST TARGET binding site such as BINDING SITE I, BINDING SITE II or BINDING SITE III. Table 2 illustrates the complementarity of the nucleotide sequences of LDB3 BINDING SITE, designated SEQ ID:37562, to the nucleotide sequence of VGAM1929 RNA, herein designated VGAM RNA, also designated SEQ ID:4640.

Another function of VGAM1929 is therefore inhibition of LIM Domain Binding 3 (LDB3, Accession XM_084376), a gene which could play a role during mating. Accordingly, utilities of VGAM1929 include diagnosis, prevention and treatment of diseases and clinical conditions associated with LDB3. The function of LDB3 has been established by previous studies. PDZ domain-containing proteins interact with each other in cytoskeletal assembly or with other proteins involved in targeting and clustering of membrane proteins By screening a muscle cDNA library using a muscle EST sequence as the probe, Faulkner et al. (1999) obtained cDNAs encoding mouse and human ZASP. The deduced 283-amino acid human ZASP protein has an 85-residue N-terminal PDZ domain and shares significant similarity with the 734-amino acid protein encoded by the KIAA0613 cDNA isolated by Ishikawa et al. (1998). Database, PCR, and genomic DNA analyses indicated the presence of alternatively spliced isoforms of ZASP that encode proteins of 470, 617, and 727 (KIAA0613) amino acids. Northern blot analysis detected a major 1.9-kb ZASP transcript that was most abundant in skeletal muscle and heart but absent in other tissues tested. Additional transcripts of 4.0 and 5.4 kb were detected when using a 5-prime rather than a 3-prime probe. RT-PCR analysis detected wide expression of KIAA0613, with weak or undetectable expression in liver, pancreas, and spleen (Ishikawa et al., 1998). Western blot analysis showed expression of 32- and 78-kD proteins in heart and muscle. Immunofluorescence microscopy demonstrated that ZASP is expressed in pseudopodia and in the cytoplasm around the nucleus, and that it colocalizes with actin in the I-band. Immunoelectron microscopy localized ZASP within the Z-band. Yeast 2-hybrid analysis determined that the PDZ domain of ZASP interacts with the C terminus of alpha-actinin-2 (ACTN2; 102573

Full details of the abovementioned studies are described in the following publications, the disclosure of which are hereby incorporated by reference:

Faulkner, G.; Pallavicini, A.; Formentin, E.; Comelli, A.; Ievolella, C.; Trevisan, S.; Bortoletto, G.; Scannapieco, P.; Salamon, M.; Mouly, V.; Valle, G.; Lanfranchi, G. : ZASP: a new Z-band alternatively spliced PDZ-motif protein. J. Cell Biol. 146:465-475, 1999; and Ishikawa, K.; Nagase, T.; Suyama, M.; Miyajima, N.; Tanaka, A.; Kotani, H.; Nomura, N.; Ohara, O.: Prediction of the coding sequences of unidentified human genes. X. The complete sequence.

Further studies establishing the function and utilities of LDB3 are found in John Hopkins OMIM database record ID 605906, and in sited publications numbered 74 and 9440 listed in the bibliography section hereinbelow, which are also hereby incorporated by reference. LENG4 (Accession NM_024298) is another VGAM1929 host target gene. LENG4 BINDING SITE is HOST TARGET binding site found in the 3' untranslated region of mRNA encoded by LENG4, corresponding to a HOST TARGET binding site such as BINDING SITE I, BINDING SITE II or BINDING SITE III. Table 2 illustrates the complementarity of the nucleotide sequences of LENG4 BINDING SITE, designated SEQ ID:23587, to the nucleotide sequence of VGAM1929 RNA, herein designated VGAM RNA, also designated SEQ ID:4640.

Another function of VGAM1929 is therefore inhibition of LENG4 (Accession NM_024298), a gene which may be a transmembrane protein. Accordingly, utilities of VGAM1929 include diagnosis, prevention and treatment of diseases and clinical conditions associated with LENG4. The function of LENG4 and its association with various diseases and clinical conditions, has been established by previous studies, as described hereinabove with reference to VGAM259. Leukemia Inhibitory Factor Receptor (LIFR, Accession NM_002310) is another VGAM1929 host target gene. LIFR BINDING SITE is HOST TARGET binding site found in the 3' untranslated region of mRNA encoded by LIFR, corresponding to a HOST TARGET binding site such as BINDING SITE I, BINDING SITE II or BINDING SITE III. Table 2 illustrates the complementarity of the nucleotide sequences of LIFR BINDING SITE, designated SEQ ID:8101, to the nucleotide sequence of VGAM1929 RNA, herein designated VGAM RNA, also designated SEQ ID:4640.

Another function of VGAM1929 is therefore inhibition of Leukemia Inhibitory Factor Receptor (LIFR, Accession NM_002310). Accordingly, utilities of VGAM1929 include diagnosis, prevention and treatment of diseases and clinical conditions associated with LIFR. Low Density Lipoprotein Receptor-related Protein 8, Apolipoprotein E Receptor (LRP8, Accession NM_033300) is another VGAM1929 host target gene. LRP8 BINDING SITE1 and LRP8 BINDING SITE2 are HOST TARGET binding sites found in untranslated regions of mRNA encoded by LRP8, corresponding to HOST TARGET binding sites such as BINDING SITE I, BINDING SITE II or BINDING SITE III. Table 2 illustrates the complementarity of the nucleotide sequences of LRP8 BINDING SITE1 and LRP8 BINDING SITE2, designated SEQ ID:27129 and SEQ ID:11005 respectively, to the nucleotide sequence of VGAM1929 RNA, herein designated VGAM RNA, also designated SEQ ID:4640.

Another function of VGAM1929 is therefore inhibition of Low Density Lipoprotein Receptor-related Protein 8, Apolipoprotein E Receptor (LRP8, Accession NM_033300), a gene which binds vldl and transports it into cells by endocytosis. Accordingly, utilities of VGAM1929 include diagnosis, prevention and treatment of diseases and clinical conditions associated with LRP8. The function of LRP8 and its association with various diseases and clinical conditions, has been established by previous studies, as described hereinabove with reference to VGAM191. Leucine Zipper, Putative Tumor Suppressor 1 (LZTS1, Accession NM_021020) is another VGAM1929 host target gene. LZTS1 BINDING SITE is HOST TARGET binding site found in the 3' untranslated region of mRNA encoded by LZTS1, corresponding to a HOST TARGET binding site such as BINDING SITE I, BINDING SITE II or BINDING SITE III. Table 2 illustrates the complementarity of the nucleotide sequences of LZTS1 BINDING SITE, designated SEQ ID:22010, to the nucleotide sequence of VGAM1929 RNA, herein designated VGAM RNA, also designated SEQ ID:4640.

Another function of VGAM1929 is therefore inhibition of Leucine Zipper, Putative Tumor Suppressor 1 (LZTS1, Accession NM_021020), a gene which Zygin 1; may have a role in axonal outgrowth; has similarity to C. elegans UNC-76. Accordingly, utilities of VGAM1929 include diagnosis, prevention and treatment of diseases and clinical conditions associated with LZTS1. The function of LZTS1 and its association with various diseases and clinical conditions, has been established by previous studies, as described hereinabove with reference to VGAM890. MAP-kinase Activating Death Domain (MADD, Accession NM_130470) is another VGAM1929 host target gene. MADD BINDING SITE is HOST TARGET binding site found in the 5' untranslated region of mRNA encoded by MADD, corresponding to a HOST TARGET binding site such as BINDING SITE I, BINDING SITE II or BINDING SITE III. Table 2 illustrates the complementarity of the nucleotide sequences of MADD BINDING SITE, designated SEQ ID:28238, to the nucleotide sequence of VGAM1929 RNA, herein designated VGAM RNA, also designated SEQ ID:4640.

Another function of VGAM1929 is therefore inhibition of MAP-kinase Activating Death Domain (MADD, Accession NM_130470), a gene which may regulate two different pathways for neural activities.interacts with the type-1 tumor necrosis factor receptor (TNFR1); death domain-containing protein. Accordingly, utilities of VGAM1929 include diagnosis, prevention and treatment of diseases and clinical conditions associated with MADD. The function of MADD and its association with various diseases and clinical conditions, has been established by previous studies, as described hereinabove with reference to VGAM430. MAD, Mothers Against Decapentaplegic Homolog 4 (Drosophila) (MADH4, Accession NM_005359) is another VGAM1929 host target gene. MADH4 BINDING SITE is HOST TARGET binding site found in the 3' untranslated region of mRNA encoded by MADH4, corresponding to a HOST TARGET binding site such as BINDING SITE I, BINDING SITE II or BINDING SITE III. Table 2 illustrates the complementarity of the nucleotide sequences of MADH4 BINDING SITE, designated SEQ ID:11833, to the nucleotide sequence of VGAM1929 RNA, herein designated VGAM RNA, also designated SEQ ID:4640.

Another function of VGAM1929 is therefore inhibition of MAD, Mothers Against Decapentaplegic Homolog 4 (Drosophila) (MADH4, Accession NM_005359), a gene which common mediator of signal transduction by tgf-beta (transforming growth factor) superfamily; smad4 is the common smad (co-smad). promotes binding of the smad2/smad4/fast-1 complex to dna and provides an activation function required for smad1 or smad2 to stimulate transcription. may act as a tumor suppressor. Accordingly, utilities of VGAM1929 include diagnosis, prevention and treatment of diseases and clinical conditions associated with MADH4. The function of MADH4 and its association with various diseases and clinical conditions, has been established by previous studies, as described hereinabove with reference to VGAM217. Monoamine Oxidase B (MAOB, Accession XM_010261) is another VGAM1929 host target gene. MAOB BINDING SITE is HOST TARGET binding site found in the 3' untranslated region of mRNA encoded by MAOB, corresponding to a HOST TARGET binding site such as BINDING SITE I, BINDING SITE II or BINDING SITE III. Table 2 illustrates the complementarity of the nucleotide sequences of MAOB BINDING SITE, designated SEQ ID:30149, to the nucleotide sequence of VGAM1929 RNA, herein designated VGAM RNA, also designated SEQ ID:4640.

Another function of VGAM1929 is therefore inhibition of Monoamine Oxidase B (MAOB, Accession XM_010261). Accordingly, utilities of VGAM1929 include diagnosis, prevention and treatment of diseases and clinical conditions associated with MAOB. Mannose-binding Lectin (protein C) 2, Soluble (opsonic defect) (MBL2, Accession NM_000242) is another VGAM1929 host target gene. MBL2 BINDING SITE is HOST TARGET binding site found in the 3' untranslated region of mRNA encoded by MBL2, corresponding to a HOST TARGET binding site such as BINDING SITE I, BINDING SITE II or BINDING SITE III. Table 2 illustrates the complementarity of the nucleotide sequences of MBL2 BINDING SITE, designated SEQ ID:5762, to the nucleotide sequence of VGAM1929 RNA, herein designated VGAM RNA, also designated SEQ ID:4640.

Another function of VGAM1929 is therefore inhibition of Mannose-binding Lectin (protein C) 2, Soluble (opsonic defect) (MBL2, Accession NM_000242). Accordingly, utilities of VGAM1929 include diagnosis, prevention and treatment of diseases and clinical conditions associated with MBL2. Muscleblind-like (Drosophila) (MBNL, Accession NM_021038) is another VGAM1929 host target gene. MBNL BINDING SITE is HOST TARGET binding site found in the 3' untranslated region of mRNA encoded by MBNL, corresponding to a HOST TARGET binding site such as BINDING SITE I, BINDING SITE II or BINDING SITE III. Table 2 illustrates the complementarity of the nucleotide sequences of MBNL BINDING SITE, designated SEQ ID:22027, to the nucleotide sequence of VGAM1929 RNA, herein designated VGAM RNA, also designated SEQ ID:4640.

Another function of VGAM1929 is therefore inhibition of Muscleblind-like (Drosophila) (MBNL, Accession NM_021038), a gene which binds to cug triplet repeat expansion dsrna (by similarity). Accordingly, utilities of VGAM1929 include diagnosis, prevention and treatment of diseases and clinical conditions associated with MBNL. The function of MBNL and its association with various diseases and clinical conditions, has been established by previous studies, as described hereinabove with reference to VGAM95. MADS Box Transcription Enhancer Factor 2, Polypeptide C (myocyte enhancer factor 2C) (MEF2C, Accession NM_002397) is another VGAM1929 host target gene. MEF2C BINDING SITE is HOST TARGET binding site found in the 3' untranslated region of mRNA encoded by MEF2C, corresponding to a HOST TARGET binding site such as BINDING SITE I, BINDING SITE II or BINDING SITE III. Table 2 illustrates the complementarity of the nucleotide sequences of MEF2C BINDING SITE, designated SEQ ID:8213, to the nucleotide sequence of VGAM1929 RNA, herein designated VGAM RNA, also designated SEQ ID:4640.

Another function of VGAM1929 is therefore inhibition of MADS Box Transcription Enhancer Factor 2, Polypeptide C (myocyte enhancer factor 2C) (MEF2C, Accession NM_002397), a gene which regulates muscle-specific and mitogen-inducible genes. Accordingly, utilities of VGAM1929 include diagnosis, prevention and treatment of diseases and clinical conditions associated with MEF2C. The function of MEF2C and its association with various diseases and clinical conditions, has been established by previous studies, as described hereinabove with reference to VGAM386. Meis1, Myeloid Ecotropic Viral Integration Site 1 Homolog (mouse) (MEIS1, Accession NM_002398) is another VGAM1929 host target gene. MEIS1 BINDING SITE is HOST TARGET binding site found in the 3' untranslated region of mRNA encoded by MEIS1, corresponding to a HOST TARGET binding site such as BINDING SITE I, BINDING SITE II or BINDING SITE III. Table 2 illustrates the complementarity of the nucleotide sequences of MEIS1 BINDING SITE, designated SEQ ID:8220, to the nucleotide sequence of VGAM1929 RNA, herein designated VGAM RNA, also designated SEQ ID:4640.

Another function of VGAM1929 is therefore inhibition of Meis1, Myeloid Ecotropic Viral Integration Site 1 Homolog (mouse) (MEIS1, Accession NM_002398), a gene which may regulate gene expression and control cell differentiation. Accordingly, utilities of VGAM1929 include diagnosis, prevention and treatment of diseases and clinical conditions associated with MEIS1. The function of MEIS1 and its association with various diseases and clinical conditions, has been established by previous studies, as described hereinabove with reference to VGAM894. Meningioma Expressed Antigen 5 (hyaluronidase) (MGEA5, Accession NM_012215) is another VGAM1929 host target gene. MGEA5 BINDING SITE is HOST TARGET binding site found in the 3' untranslated region of mRNA encoded by MGEA5, corresponding to a HOST TARGET binding site such as BINDING SITE I, BINDING SITE II or BINDING SITE III. Table 2 illustrates the complementarity of the nucleotide sequences of MGEA5 BINDING SITE, designated SEQ ID:14521, to the nucleotide sequence of VGAM1929 RNA, herein designated VGAM RNA, also designated SEQ ID:4640.

Another function of VGAM1929 is therefore inhibition of Meningioma Expressed Antigen 5 (hyaluronidase) (MGEA5, Accession NM_012215), a gene which has a hyaluronidase activity. Accordingly, utilities of VGAM1929 include diagnosis, prevention and treatment of diseases and clinical conditions associated with MGEA5. The function of MGEA5 and its association with various diseases and clinical conditions, has been established by previous studies, as described hereinabove with reference to VGAM801. Midline 1 (Opitz/BBB syndrome) (MID1, Accession NM_000381) is another VGAM1929 host target gene. MID1 BINDING SITE is HOST TARGET binding site found in the 5' untranslated region of mRNA encoded by MID1, corresponding to a HOST TARGET binding site such as BINDING SITE I, BINDING SITE II or BINDING SITE III. Table 2 illustrates the complementarity of the nucleotide sequences of MID1 BINDING SITE, designated SEQ ID:5957, to the nucleotide sequence of VGAM1929 RNA, herein designated VGAM RNA, also designated SEQ ID:4640.

Another function of VGAM1929 is therefore inhibition of Midline 1 (Opitz/BBB syndrome) (MID1, Accession NM_000381). Accordingly, utilities of VGAM1929 include diagnosis, prevention and treatment of diseases and clinical conditions associated with MID1. Myeloid Leukemia Factor 2 (MLF2, Accession NM_005439) is another VGAM1929 host target gene. MLF2 BINDING SITE is HOST TARGET binding site found in the 3' untranslated region of mRNA encoded by MLF2, corresponding to a HOST TARGET binding site such as BINDING SITE I, BINDING SITE II or BINDING SITE III. Table 2 illustrates the complementarity of the nucleotide sequences of MLF2 BINDING SITE, designated SEQ ID:11925, to the nucleotide sequence of VGAM1929 RNA, herein designated VGAM RNA, also designated SEQ ID:4640.

Another function of VGAM1929 is therefore inhibition of Myeloid Leukemia Factor 2 (MLF2, Accession NM_005439). Accordingly, utilities of VGAM1929 include diagnosis, prevention and treatment of diseases and clinical conditions associated with MLF2. Matrix Metalloproteinase 19 (MMP19, Accession NM_022790) is another VGAM1929 host target gene. MMP19 BINDING SITE is HOST TARGET binding site found in the 5' untranslated region of mRNA encoded by MMP19, corresponding to a HOST TARGET binding site such as BINDING SITE I, BINDING SITE II or BINDING SITE III. Table 2 illustrates the complementarity of the nucleotide sequences of MMP19 BINDING SITE, designated SEQ ID:23075, to the nucleotide sequence of VGAM1929 RNA, herein designated VGAM RNA, also designated SEQ ID:4640.

Another function of VGAM1929 is therefore inhibition of Matrix Metalloproteinase 19 (MMP19, Accession NM_022790). Accordingly, utilities of VGAM1929 include diagnosis, prevention and treatment of diseases and clinical conditions associated with MMP19. MAX Binding Protein (MNT, Accession NM_020310) is another VGAM1929 host target gene. MNT BINDING SITE is HOST TARGET binding site found in the 3' untranslated region of mRNA encoded by MNT, corresponding to a HOST TARGET binding site such as BINDING SITE I, BINDING SITE II or BINDING SITE III. Table 2 illustrates the complementarity of the nucleotide sequences of MNT BINDING SITE, designated SEQ ID:21562, to the nucleotide sequence of VGAM1929 RNA, herein designated VGAM RNA, also designated SEQ ID:4640.

Another function of VGAM1929 is therefore inhibition of MAX Binding Protein (MNT, Accession NM_020310). Accordingly, utilities of VGAM1929 include diagnosis, prevention and treatment of diseases and clinical conditions associated with MNT. Antigen Identified By Monoclonal Antibody MRC OX-2 (MOX2, Accession XM_039962) is another VGAM1929 host target gene. MOX2 BINDING SITE is HOST TARGET binding site found in the 3' untranslated region of mRNA encoded by MOX2, corresponding to a HOST TARGET binding site such as BINDING SITE I, BINDING SITE II or BINDING SITE III. Table 2 illustrates the complementarity of the nucleotide sequences of MOX2 BINDING SITE, designated SEQ ID:33237, to the nucleotide sequence of VGAM1929 RNA, herein designated VGAM RNA, also designated SEQ ID:4640.

Another function of VGAM1929 is therefore inhibition of Antigen Identified By Monoclonal Antibody MRC OX-2 (MOX2, Accession XM_039962). Accordingly, utilities of VGAM1929 include diagnosis, prevention and treatment of diseases and clinical conditions associated with MOX2. Membrane-spanning 4-domains, Subfamily A, Member 1 (MS4A1, Accession NM_000139) is another VGAM1929 host target gene. MS4A1 BINDING SITE is HOST TARGET binding site found in the 3' untranslated region of mRNA encoded by MS4A1, corresponding to a HOST TARGET binding site such as BINDING SITE I, BINDING SITE II or BINDING SITE III. Table 2 illustrates the complementarity of the nucleotide sequences of MS4A1 BINDING SITE, designated SEQ ID:5632, to the nucleotide sequence of VGAM1929 RNA, herein designated VGAM RNA, also designated SEQ ID:4640.

Another function of VGAM1929 is therefore inhibition of Membrane-spanning 4-domains, Subfamily A, Member 1 (MS4A1, Accession NM_000139), a gene which may be involved in the regulation of b-cell activation and proliferation. Accordingly, utilities of VGAM1929 include diagnosis, prevention and treatment of diseases and clinical conditions associated with MS4A1. The function of MS4A1 and its association with various diseases and clinical conditions, has been established by previous studies, as described hereinabove with reference to VGAM362. Myotubularin Related Protein 3 (MTMR3, Accession NM_021090) is another VGAM1929 host target gene. MTMR3 BINDING SITE is HOST TARGET binding site found in the 3' untranslated region of mRNA encoded by MTMR3, corresponding to a HOST TARGET binding site such as BINDING SITE I, BINDING SITE II or BINDING SITE III. Table 2 illustrates the complementarity of the nucleotide sequences of MTMR3 BINDING SITE, designated SEQ ID:22071, to the nucleotide sequence of VGAM1929 RNA, herein designated VGAM RNA, also designated SEQ ID:4640.

Another function of VGAM1929 is therefore inhibition of Myotubularin Related Protein 3 (MTMR3, Accession NM_021090), a gene which could be a tyrosine-phosphatase. Accordingly, utilities of VGAM1929 include diagnosis, prevention and treatment of diseases and clinical conditions associated with MTMR3. The function of MTMR3 and its association with various diseases and clinical conditions, has been established by previous studies, as described hereinabove with reference to VGAM1718. MAX Interacting Protein 1 (MXI1, Accession NM_130439) is another VGAM1929 host target gene. MXI1 BINDING SITE1 and MXI1 BINDING SITE2 are HOST TARGET binding sites found in untranslated regions of mRNA encoded by MXI1, corresponding to HOST TARGET binding sites such as BINDING SITE I, BINDING SITE II or BINDING SITE III. Table 2 illustrates the complementarity of the nucleotide sequences of MXI1 BINDING SITE1 and MXI1 BINDING SITE2, designated SEQ ID:28194 and SEQ ID:12584 respectively, to the nucleotide sequence of VGAM1929 RNA, herein designated VGAM RNA, also designated SEQ ID:4640.

Another function of VGAM1929 is therefore inhibition of MAX Interacting Protein 1 (MXI1, Accession NM_130439), a gene which acts as a tumor suppressor in vivo, engages the MYC network in a functionally relevant manner. Accordingly, utilities of VGAM1929 include diagnosis, prevention and treatment of diseases and clinical conditions associated with MXI1. The function of MXI1 and its association with various diseases and clinical conditions, has been established by previous studies, as described hereinabove with reference to VGAM128. NCK-associated Protein 1 (NCKAP1, Accession NM_013436) is another VGAM1929 host target gene. NCKAP1 BINDING SITE is HOST TARGET binding site found in the 3' untranslated region of mRNA encoded by NCKAP1, corresponding to a HOST TARGET binding site such as BINDING SITE I, BINDING SITE II or BINDING SITE III. Table 2 illustrates the complementarity of the nucleotide sequences of NCKAP1 BINDING SITE, designated SEQ ID:15096, to the nucleotide sequence of VGAM1929 RNA, herein designated VGAM RNA, also designated SEQ ID:4640.

Another function of VGAM1929 is therefore inhibition of NCK-associated Protein 1 (NCKAP1, Accession NM_013436). Accordingly, utilities of VGAM1929 include diagnosis, prevention and treatment of diseases and clinical conditions associated with NCKAP1. Nuclear Receptor Coactivator 3 (NCOA3, Accession NM_006534) is another VGAM1929 host target gene. NCOA3 BINDING SITE is HOST TARGET binding site found in the 3' untranslated region of mRNA encoded by NCOA3, corresponding to a HOST TARGET binding site such as BINDING SITE I, BINDING SITE II or BINDING SITE III. Table 2 illustrates the complementarity of the nucleotide sequences of NCOA3 BINDING SITE, designated SEQ ID:13288, to the nucleotide sequence of VGAM1929 RNA, herein designated VGAM RNA, also designated SEQ ID:4640.

Another function of VGAM1929 is therefore inhibition of Nuclear Receptor Coactivator 3 (NCOA3, Accession NM_006534), a gene which directly binds nuclear receptors and stimulates the transcriptional activities in hormone-dependent fashion. Accordingly, utilities of VGAM1929 include diagnosis, prevention and treatment of diseases and clinical conditions associated with NCOA3. The function of NCOA3 and its association with various diseases and clinical conditions, has been established by previous studies, as described hereinabove with reference to VGAM215. Nebulin (NEB, Accession NM_004543) is another VGAM1929 host target gene. NEB BINDING SITE is HOST TARGET binding site found in the 5' untranslated region of mRNA encoded by NEB, corresponding to a HOST TARGET binding site such as BINDING SITE I, BINDING SITE II or BINDING SITE III. Table 2 illustrates the complementarity of the nucleotide sequences of NEB BINDING SITE, designated SEQ ID:10892, to the nucleotide sequence of VGAM1929 RNA, herein designated VGAM RNA, also designated SEQ ID:4640.

Another function of VGAM1929 is therefore inhibition of Nebulin (NEB, Accession NM_004543). Accordingly, utilities of VGAM1929 include diagnosis, prevention and treatment of diseases and clinical conditions associated with NEB. NIMA (never in mitosis gene a)-related Kinase 4 (NEK4, Accession NM_003157) is another VGAM1929 host target gene. NEK4 BINDING SITE is HOST TARGET binding site found in the 3' untranslated region of mRNA encoded by NEK4, corresponding to a HOST TARGET binding site such as BINDING SITE I, BINDING SITE II or BINDING SITE III. Table 2 illustrates the complementarity of the nucleotide sequences of NEK4 BINDING SITE, designated SEQ ID:9138, to the nucleotide sequence of VGAM1929 RNA, herein designated VGAM RNA, also designated SEQ ID:4640.

Another function of VGAM1929 is therefore inhibition of NIMA (never in mitosis gene a)-related Kinase 4 (NEK4, Accession NM_003157). Accordingly, utilities of VGAM1929 include diagnosis, prevention and treatment of diseases and clinical conditions associated with NEK4. Nuclear Factor (erythroid-derived 2)-like 1 (NFE2L1, Accession NM_003204) is another VGAM1929 host target gene. NFE2L1 BINDING SITE is HOST TARGET binding site found in the 3' untranslated region of mRNA encoded by NFE2L1, corresponding to a HOST TARGET binding site such as BINDING SITE I, BINDING SITE II or BINDING SITE III. Table 2 illustrates the complementarity of the nucleotide sequences of NFE2L1 BINDING SITE, designated SEQ ID:9199, to the nucleotide sequence of VGAM1929 RNA, herein designated VGAM RNA, also designated SEQ ID:4640.

Another function of VGAM1929 is therefore inhibition of Nuclear Factor (erythroid-derived 2)-like 1 (NFE2L1, Accession NM_003204), a gene which may regulate expression of ferritin genes. Accordingly, utilities of VGAM1929 include diagnosis, prevention and treatment of diseases and clinical conditions associated with NFE2L1. The function of NFE2L1 and its association with various diseases and clinical conditions, has been established by previous studies, as described hereinabove with reference to VGAM369. Nerve Growth Factor Receptor (TNFRSF16) Associated Protein 1 (NGFRAP1, Accession NM_014380) is another VGAM1929 host target gene. NGFRAP1 BINDING SITE is HOST TARGET binding site found in the 5' untranslated region of mRNA encoded by NGFRAP1, corresponding to a HOST TARGET binding site such as BINDING SITE I, BINDING SITE II or BINDING SITE III. Table 2 illustrates the complementarity of the nucleotide sequences of NGFRAP1 BINDING SITE, designated SEQ ID:15715, to the nucleotide sequence of VGAM1929 RNA, herein designated VGAM RNA, also designated SEQ ID:4640.

Another function of VGAM1929 is therefore inhibition of Nerve Growth Factor Receptor (TNFRSF16) Associated Protein 1 (NGFRAP1, Accession NM_014380), a gene which may play an important role in the pathogenesis of neurogenetic diseases. Accordingly, utilities of VGAM1929 include diagnosis, prevention and treatment of diseases and clinical conditions associated with NGFRAP1. The function of NGFRAP1 and its association with various diseases and clinical conditions, has been established by previous studies, as described hereinabove with reference to VGAM260. Nipsnap Homolog 1 (C. elegans) (NIPSNAP1, Accession NM_003634) is another VGAM1929 host target gene. NIPSNAP1 BINDING SITE is HOST TARGET binding site found in the 3' untranslated region of mRNA encoded by NIPSNAP1, corresponding to a HOST TARGET binding site such as BINDING SITE I, BINDING SITE II or BINDING SITE III. Table 2 illustrates the complementarity of the nucleotide sequences of NIPSNAP1 BINDING SITE, designated SEQ ID:9701, to the nucleotide sequence of VGAM1929 RNA, herein designated VGAM RNA, also designated SEQ ID:4640.

Another function of VGAM1929 is therefore inhibition of Nipsnap Homolog 1 (C. elegans) (NIPSNAP1, Accession NM_003634). Accordingly, utilities of VGAM1929 include diagnosis, prevention and treatment of diseases and clinical conditions associated with NIPSNAP1. Neuronal Cell Adhesion Molecule (NRCAM, Accession NM_005010) is another VGAM1929 host target gene. NRCAM BINDING SITE is HOST TARGET binding site found in the 3' untranslated region of mRNA encoded by NRCAM, corresponding to a HOST TARGET binding site such as BINDING SITE I, BINDING SITE II or BINDING SITE III. Table 2 illustrates the complementarity of the nucleotide sequences of NRCAM BINDING SITE, designated SEQ ID:11450, to the nucleotide sequence of VGAM1929 RNA, herein designated VGAM RNA, also designated SEQ ID:4640.

Another function of VGAM1929 is therefore inhibition of Neuronal Cell Adhesion Molecule (NRCAM, Accession NM_005010), a gene which functions as a cell surface protein and belongs to the immunoglobulin superfamily. Accordingly, utilities of VGAM1929 include diagnosis, prevention and treatment of diseases and clinical conditions associated with NRCAM. The function of NRCAM and its association with various diseases and clinical conditions, has been established by previous studies, as described hereinabove with reference to VGAM268.2'-5'-oligoadenylate Synthetase 2, 69/71 kDa (OAS2, Accession NM_016817) is another VGAM1929 host target gene. OAS2 BINDING SITE is HOST TARGET binding site found in the 3' untranslated region of mRNA encoded by OAS2, corresponding to a HOST TARGET binding site such as BINDING SITE I, BINDING SITE II or BINDING SITE III. Table 2 illustrates the complementarity of the nucleotide sequences of OAS2 BINDING SITE, designated SEQ ID:18806, to the nucleotide sequence of VGAM1929 RNA, herein designated VGAM RNA, also designated SEQ ID:4640.

Another function of VGAM1929 is therefore inhibition of 2'-5'-oligoadenylate Synthetase 2, 69/71 kDa (OAS2, Accession NM_016817), a gene which may play a role in mediating resistance to virus infection, control of cell growth, differentiation, and apoptosis. Accordingly, utilities of VGAM1929 include diagnosis, prevention and treatment of diseases and clinical conditions associated with OAS2. The function of OAS2 and its association with various diseases and clinical conditions, has been established by previous studies, as described hereinabove with reference to VGAM1498. Optic Atrophy 1 (autosomal dominant) (OPA1, Accession NM_130833) is another VGAM1929 host target gene. OPA1 BINDING SITE1 through OPA1 BINDING SITE5 are HOST TARGET binding sites found in untranslated regions of mRNA encoded by OPA1, corresponding to HOST TARGET binding sites such as BINDING SITE I, BINDING SITE II or BINDING SITE III. Table 2 illustrates the complementarity of the nucleotide sequences of OPA1 BINDING SITE1 through OPA1 BINDING SITE5, designated SEQ ID:28322, SEQ ID:28330, SEQ ID:28338, SEQ ID:28346 and SEQ ID:28354 respectively, to the nucleotide sequence of VGAM1929 RNA, herein designated VGAM RNA, also designated SEQ ID:4640.

Another function of VGAM1929 is therefore inhibition of Optic Atrophy 1 (autosomal dominant) (OPA1, Accession NM_130833). Accordingly, utilities of VGAM1929 include diagnosis, prevention and treatment of diseases and clinical conditions associated with OPA1. Purinergic Receptor P2Y, G-protein Coupled, 1 (P2RY1, Accession NM_002563) is another VGAM1929 host target gene. P2RY1 BINDING SITE is HOST TARGET binding site found in the 3' untranslated region of mRNA encoded by P2RY1, corresponding to a HOST TARGET binding site such as BINDING SITE I, BINDING SITE II or BINDING SITE III. Table 2 illustrates the complementarity of the nucleotide sequences of P2RY1 BINDING SITE, designated SEQ ID:8411, to the nucleotide sequence of VGAM1929 RNA, herein designated VGAM RNA, also designated SEQ ID:4640.

Another function of VGAM1929 is therefore inhibition of Purinergic Receptor P2Y, G-protein Coupled, 1 (P2RY1, Accession NM_002563), a gene which plays an essential role in thrombotic states. Accordingly, utilities of VGAM1929 include diagnosis, prevention and treatment of diseases and clinical conditions associated with P2RY1. The function of P2RY1 has been established by previous studies. P2 purinoceptors have been broadly classified as P2X receptors (e.g., 600843), which are ATP-gated channels; P2Z receptors, which mediate nonselective pores in mast cells; and P2Y receptors, a family of G protein-coupled receptors. Based on the recommendation for nomenclature of P2 purinoceptors, the P2Y purinoceptors were numbered in the order of cloning. Ayyanathan et al. (1996) noted that P2Y1, P2Y2 (PR2Y2; 600041), and P2Y3 have been cloned from a variety of species. P2Y1 responds to both ADP and ATP. The P2Y2 receptor cDNA was cloned in the human and this receptor was known as P2U under previous nomenclature. Ayyanathan et al. (1996) cloned the human P2Y1 receptor (P2RY1) and its 2 alternately polyadenylated forms of mRNA. The P2Y1 purinoceptor was also cloned from a human placenta cDNA library by Leon et al. (1996). They found that the gene encodes a 372-amino acid polypeptide. Northern blot analysis revealed 2 transcripts of 4.6 and 7.5 kb which were expressed in many tissues. Using oligonucleotide primers specific for the human P2Y1 purinergic receptor, Ayyanathan et al. (1996) amplified a region from genomic DNA from a panel of mouse/human somatic cell hybrid cell lines and localized the P2Y1 gene to human chromosome 3. By sequence tagged site (STS) mapping utilizing the National Center for Biotechnology Information (NCBI) database, Somers et al. (1997) mapped the P2RY1 gene between flanking markers D3S1279 and D3S1280 at a position 173 to 174 cM from the most telomeric markers on the short arm of chromosome 3. Animal model experiments lend further support to the function of P2RY1. Leon et al. (1999) generated P2Y1-null mice to define the physiologic role of the P2Y1 receptor. These mice were viable with no apparent abnormalities affecting their development, survival, reproduction, or morphology of platelets, and the platelet count in these animals was identical to that of wildtype mice. However, platelets from P2Y1-deficient mice were unable to aggregate in response to usual concentrations of ADP and displayed impaired aggregation to other agonists, while high concentrations of ADP induced platelet aggregation without shape change. In addition, ADP-induced inhibition of adenylyl cyclase still occurred, demonstrating the existence of an ADP receptor distinct from P2Y1. P2Y1-null mice had no spontaneous bleeding tendency but were resistant to thromboembolism induced by intravenous injection of ADP or collagen and adrenaline. Hence, the P2Y1 receptor plays an essential role in thrombotic states and represents a potential target for antithrombotic drugs.

It is appreciated that the abovementioned animal model for P2RY1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ayyanathan, K.; Webbs, T. E.; Sandhu, A. K.; Athwal, R. S.; Barnard, E. A.; Kunapuli, S. P.: Cloning and chromosomal localization of the human P2Y1 purinoceptor. Biochem. Biophys. Res. Commun. 218:783-788, 1996; and Leon, C.; Hechler, B.; Freund, M.; Eckly, A.; Vial, C.; Ohlmann, P.; Dierich, A.; LeMeur, M.; Cazenave, J.-P.; Gachet, C.: Defective platelet aggregation and increased resistance to thr.

Further studies establishing the function and utilities of P2RY1 are found in John Hopkins OMIM database record ID 601167, and in sited publications numbered 9467-947 and 7718 listed in the bibliography section hereinbelow, which are also hereby incorporated by reference. Phosphoribosylaminoimidazole Carboxylase, Phosphoribosylaminoimidazole Succinocarboxamide Synthetase (PAICS, Accession NM_006452) is another VGAM1929 host target gene. PAICS BINDING SITE is HOST TARGET binding site found in the 5' untranslated region of mRNA encoded by PAICS, corresponding to a HOST TARGET binding site such as BINDING SITE I, BINDING SITE II or BINDING SITE III. Table 2 illustrates the complementarity of the nucleotide sequences of PAICS BINDING SITE, designated SEQ ID:13165, to the nucleotide sequence of VGAM1929 RNA, herein designated VGAM RNA, also designated SEQ ID:4640.

Another function of VGAM1929 is therefore inhibition of Phosphoribosylaminoimidazole Carboxylase, Phosphoribosylaminoimidazole Succinocarboxamide Synthetase (PAICS, Accession NM_006452), a gene which is required for purine biosynthesis. Accordingly, utilities of VGAM1929 include diagnosis, prevention and treatment of diseases and clinical conditions associated with PAICS. The function of PAICS and its association with various diseases and clinical conditions, has been established by previous studies, as described hereinabove with reference to VGAM894. Phosphodiesterase 7A (PDE7A, Accession XM_037534) is another VGAM1929 host target gene. PDE7A BINDING SITE is HOST TARGET binding site found in the 3' untranslated region of mRNA encoded by PDE7A, corresponding to a HOST TARGET binding site such as BINDING SITE I, BINDING SITE II or BINDING SITE III. Table 2 illustrates the complementarity of the nucleotide sequences of PDE7A BINDING SITE, designated SEQ ID:32642, to the nucleotide sequence of VGAM1929 RNA, herein designated VGAM RNA, also designated SEQ ID:4640.

Another function of VGAM1929 is therefore inhibition of Phosphodiesterase 7A (PDE7A, Accession XM_037534), a gene which is a CAMP-specific phosphodiesterase 7A and plays a role in signal transduction. Accordingly, utilities of VGAM1929 include diagnosis, prevention and treatment of diseases and clinical conditions associated with PDE7A. The function of PDE7A and its association with various diseases and clinical conditions, has been established by previous studies, as described hereinabove with reference to VGAM1662. Phosphoprotein Enriched In Astrocytes 15 (PEA15, Accession NM_003768) is another VGAM1929 host target gene. PEA15 BINDING SITE is HOST TARGET binding site found in the 3' untranslated region of mRNA encoded by PEA15, corresponding to a HOST TARGET binding site such as BINDING SITE I, BINDING SITE II or BINDING SITE III. Table 2 illustrates the complementarity of the nucleotide sequences of PEA15 BINDING SITE, designated SEQ ID:9849, to the nucleotide sequence of VGAM1929 RNA, herein designated VGAM RNA, also designated SEQ ID:4640.

Another function of VGAM1929 is therefore inhibition of Phosphoprotein Enriched In Astrocytes 15 (PEA15, Accession NM_003768), a gene which is a phosphoprotein and involved in glucose uptake. Accordingly, utilities of VGAM1929 include diagnosis, prevention and treatment of diseases and clinical conditions associated with PEA15. The function of PEA15 and its association with various diseases and clinical conditions, has been established by previous studies, as described hereinabove with reference to VGAM949. Period Homolog 2 (Drosophila) (PER2, Accession NM_022817) is another VGAM1929 host target gene. PER2 BINDING SITE is HOST TARGET binding site found in the 3' untranslated region of mRNA encoded by PER2, corresponding to a HOST TARGET binding site such as BINDING SITE I, BINDING SITE II or BINDING SITE III. Table 2 illustrates the complementarity of the nucleotide sequences of PER2 BINDING SITE, designated SEQ ID:23094, to the nucleotide sequence of VGAM1929 RNA, herein designated VGAM RNA, also designated SEQ ID:4640.

Another function of VGAM1929 is therefore inhibition of Period Homolog 2 (Drosophila) (PER2, Accession NM_022817), a gene which Period homolog 2; putative circadian clock protein; has a PAS dimerization domain. Accordingly, utilities of VGAM1929 include diagnosis, prevention and treatment of diseases and clinical conditions associated with PER2. The function of PER2 and its association with various diseases and clinical conditions, has been established by previous studies, as described hereinabove with reference to VGAM74. Polycystic Kidney and Hepatic Disease 1 (autosomal recessive) (PKHD1, Accession NM_138694) is another VGAM1929 host target gene. PKHD1 BINDING SITE is HOST TARGET binding site found in the 3' untranslated region of mRNA encoded by PKHD1, corresponding to a HOST TARGET binding site such as BINDING SITE I, BINDING SITE II or BINDING SITE III. Table 2 illustrates the complementarity of the nucleotide sequences of PKHD1 BINDING SITE, designated SEQ ID:28939, to the nucleotide sequence of VGAM1929 RNA, herein designated VGAM RNA, also designated SEQ ID:4640.

Another function of VGAM1929 is therefore inhibition of Polycystic Kidney and Hepatic Disease 1 (autosomal recessive) (PKHD1, Accession NM_138694). Accordingly, utilities of VGAM1929 include diagnosis, prevention and treatment of diseases and clinical conditions associated with PKHD1. Pleiomorphic Adenoma Gene 1 (PLAG1, Accession NM_002655) is another VGAM1929 host target gene. PLAG1 BINDING SITE is HOST TARGET binding site found in the 5' untranslated region of mRNA encoded by PLAG1, corresponding to a HOST TARGET binding site such as BINDING SITE I, BINDING SITE II or BINDING SITE III. Table 2 illustrates the complementarity of the nucleotide sequences of PLAG1 BINDING SITE, designated SEQ ID:8519, to the nucleotide sequence of VGAM1929 RNA, herein designated VGAM RNA, also designated SEQ ID:4640.

Another function of VGAM1929 is therefore inhibition of Pleiomorphic Adenoma Gene 1 (PLAG1, Accession NM_002655), a gene which contains a zinc finger domain. Accordingly, utilities of VGAM1929 include diagnosis, prevention and treatment of diseases and clinical conditions associated with PLAG1. The function of PLAG1 and its association with various diseases and clinical conditions, has been established by previous studies, as described hereinabove with reference to VGAM29. Pleckstrin (PLEK, Accession NM_002664) is another VGAM1929 host target gene. PLEK BINDING SITE is HOST TARGET binding site found in the 3' untranslated region of mRNA encoded by PLEK, corresponding to a HOST TARGET binding site such as BINDING SITE I, BINDING SITE II or BINDING SITE III. Table 2 illustrates the complementarity of the nucleotide sequences of PLEK BINDING SITE, designated SEQ ID:8532, to the nucleotide sequence of VGAM1929 RNA, herein designated VGAM RNA, also designated SEQ ID:4640.

Another function of VGAM1929 is therefore inhibition of Pleckstrin (PLEK, Accession NM_002664), a gene which is the major protein kinase c substrate of platelets. Accordingly, utilities of VGAM1929 include diagnosis, prevention and treatment of diseases and clinical conditions associated with PLEK. The function of PLEK and its association with various diseases and clinical conditions, has been established by previous studies, as described hereinabove with reference to VGAM200. POU Domain, Class 3, Transcription Factor 1 (POU3F1, Accession XM_001334) is another VGAM1929 host target gene. POU3F1 BINDING SITE is HOST TARGET binding site found in the 3' untranslated region of mRNA encoded by POU3F1, corresponding to a HOST TARGET binding site such as BINDING SITE I, BINDING SITE II or BINDING SITE III. Table 2 illustrates the complementarity of the nucleotide sequences of POU3F1 BINDING SITE, designated SEQ ID:29833, to the nucleotide sequence of VGAM1929 RNA, herein designated VGAM RNA, also designated SEQ ID:4640.

Another function of VGAM1929 is therefore inhibition of POU Domain, Class 3, Transcription Factor 1 (POU3F1, Accession XM_001334), a gene which involves in early embryogenesis and neurogenesis. Accordingly, utilities of VGAM1929 include diagnosis, prevention and treatment of diseases and clinical conditions associated with POU3F1. The function of POU3F1 and its association with various diseases and clinical conditions, has been established by previous studies, as described hereinabove with reference to VGAM85. Peroxisome Proliferative Activated Receptor, Gamma, Coactivator 1 (PPARGC1, Accession NM_013261) is another VGAM1929 host target gene. PPARGC1 BINDING SITE is HOST TARGET binding site found in the 3' untranslated region of mRNA encoded by PPARGC1, corresponding to a HOST TARGET binding site such as BINDING SITE I, BINDING SITE II or BINDING SITE III. Table 2 illustrates the complementarity of the nucleotide sequences of PPARGC1 BINDING SITE, designated SEQ ID:14933, to the nucleotide sequence of VGAM1929 RNA, herein designated VGAM RNA, also designated SEQ ID:4640.

Another function of VGAM1929 is therefore inhibition of Peroxisome Proliferative Activated Receptor, Gamma, Coactivator 1 (PPARGC1, Accession NM_013261), a gene which may play a role in insulin sensitivity and thermogenesis. Accordingly, utilities of VGAM1929 include diagnosis, prevention and treatment of diseases and clinical conditions associated with PPARGC1. The function of PPARGC1 and its association with various diseases and clinical conditions, has been established by previous studies, as described hereinabove with reference to VGAM952. PR Domain Containing 2, with ZNF Domain (PRDM2, Accession NM_012231) is another VGAM1929 host target gene. PRDM2 BINDING SITE1 and PRDM2 BINDING SITE2 are HOST TARGET binding sites found in untranslated regions of mRNA encoded by PRDM2, corresponding to HOST TARGET binding sites such as BINDING SITE I, BINDING SITE II or BINDING SITE III. Table 2 illustrates the complementarity of the nucleotide sequences of PRDM2 BINDING SITE1 and PRDM2 BINDING SITE2, designated SEQ ID:14535 and SEQ ID:18003 respectively, to the nucleotide sequence of VGAM1929 RNA, herein designated VGAM RNA, also designated SEQ ID:4640.

Another function of VGAM1929 is therefore inhibition of PR Domain Containing 2, with ZNF Domain (PRDM2, Accession NM_012231), a gene which plays a role in transcriptional regulation during neuronal differentiation and pathogenesis of retinoblastoma. Accordingly, utilities of VGAM1929 include diagnosis, prevention and treatment of diseases and clinical conditions associated with PRDM2. The function of PRDM2 and its association with various diseases and clinical conditions, has been established by previous studies, as described hereinabove with reference to VGAM120. Protein Kinase, CAMP-dependent, Regulatory, Type I, Alpha (tissue specific extinguisher 1) (PRKAR1A, Accession NM_002734) is another VGAM1929 host target gene. PRKAR1A BINDING SITE is HOST TARGET binding site found in the 3' untranslated region of mRNA encoded by PRKAR1A, corresponding to a HOST TARGET binding site such as BINDING SITE I, BINDING SITE II or BINDING SITE III. Table 2 illustrates the complementarity of the nucleotide sequences of PRKAR1A BINDING SITE, designated SEQ ID:8608, to the nucleotide sequence of VGAM1929 RNA, herein designated VGAM RNA, also designated SEQ ID:4640.

Another function of VGAM1929 is therefore inhibition of Protein Kinase, CAMP-dependent, Regulatory, Type I, Alpha (tissue specific extinguisher 1) (PRKAR1A, Accession NM_002734). Accordingly, utilities of VGAM1929 include diagnosis, prevention and treatment of diseases and clinical conditions associated with PRKAR1A. Proteasome (prosome, macropain) Subunit, Beta Type, 9 (large multifunctional protease 2) (PSMB9, Accession NM_002800) is another VGAM1929 host target gene. PSMB9 BINDING SITE is HOST TARGET binding site found in the 3' untranslated region of mRNA encoded by PSMB9, corresponding to a HOST TARGET binding site such as BINDING SITE I, BINDING SITE II or BINDING SITE III. Table 2 illustrates the complementarity of the nucleotide sequences of PSMB9 BINDING SITE, designated SEQ ID:8676, to the nucleotide sequence of VGAM1929 RNA, herein designated VGAM RNA, also designated SEQ ID:4640.

Another function of VGAM1929 is therefore inhibition of Proteasome (prosome, macropain) Subunit, Beta Type, 9 (large multifunctional protease 2) (PSMB9, Accession NM_002800), a gene which is one component of a multicatalytic proteinase complex. Accordingly, utilities of VGAM1929 include diagnosis, prevention and treatment of diseases and clinical conditions associated with PSMB9. The function of PSMB9 and its association with various diseases and clinical conditions, has been established by previous studies, as described hereinabove with reference to VGAM1915. Pituitary Tumor-transforming 1 Interacting Protein (PTTG1IP, Accession NM_004339) is another VGAM1929 host target gene. PTTG1IP BINDING SITE is HOST TARGET binding site found in the 3' untranslated region of mRNA encoded by PTTG1IP, corresponding to a HOST TARGET binding site such as BINDING SITE I, BINDING SITE II or BINDING SITE III. Table 2 illustrates the complementarity of the nucleotide sequences of PTTG1IP BINDING SITE, designated SEQ ID:10534, to the nucleotide sequence of VGAM1929 RNA, herein designated VGAM RNA, also designated SEQ ID:4640.

Another function of VGAM1929 is therefore inhibition of Pituitary Tumor-transforming 1 Interacting Protein (PTTG1IP, Accession NM_004339), a gene which facilitates the translocation of PTTG to the nucleus. Accordingly, utilities of VGAM1929 include diagnosis, prevention and treatment of diseases and clinical conditions associated with PTTG1IP. The function of PTTG1IP and its association with various diseases and clinical conditions, has been established by previous studies, as described hereinabove with reference to VGAM131. RAD51-like 1 (S. cerevisiae) (RAD51L1, Accession NM_002877) is another VGAM1929 host target gene. RAD51L1 BINDING SITE1 and RAD51L1 BINDING SITE2 are HOST TARGET binding sites found in untranslated regions of mRNA encoded by RAD51L1, corresponding to HOST TARGET binding sites such as BINDING SITE I, BINDING SITE II or BINDING SITE III. Table 2 illustrates the complementarity of the nucleotide sequences of RAD51L1 BINDING SITE1 and RAD51L1 BINDING SITE2, designated SEQ ID:8788 and SEQ ID:28577 respectively, to the nucleotide sequence of VGAM1929 RNA, herein designated VGAM RNA, also designated SEQ ID:4640.

Another function of VGAM1929 is therefore inhibition of RAD51-like 1 (S. cerevisiae) (RAD51L1, Accession NM_002877), a gene which is a member of the RAD51 family of strand-transfer proteins. Accordingly, utilities of VGAM1929 include diagnosis, prevention and treatment of diseases and clinical conditions associated with RAD51L1. The function of RAD51L1 and its association with various diseases and clinical conditions, has been established by previous studies, as described hereinabove with reference to VGAM1020. RAD51-like 3 (S. cerevisiae) (RAD51L3, Accession NM_133630) is another VGAM1929 host target gene. RAD51L3 BINDING SITE1 through RAD51L3 BINDING SITE3 are HOST TARGET binding sites found in untranslated regions of mRNA encoded by RAD51L3, corresponding to HOST TARGET binding sites such as BINDING SITE I, BINDING SITE II or BINDING SITE III. Table 2 illustrates the complementarity of the nucleotide sequences of RAD51L3 BINDING SITE1 through RAD51L3 BINDING SITE3, designated SEQ ID:28580, SEQ ID:8789 and SEQ ID:8809 respectively, to the nucleotide sequence of VGAM1929 RNA, herein designated VGAM RNA, also designated SEQ ID:4640.

Another function of VGAM1929 is therefore inhibition of RAD51-like 3 (S. cerevisiae) (RAD51L3, Accession NM_133630), a gene which may have a role in dna repair and recombination. Accordingly, utilities of VGAM1929 include diagnosis, prevention and treatment of diseases and clinical conditions associated with RAD51L3. The function of RAD51L3 and its association with various diseases and clinical conditions, has been established by previous studies, as described hereinabove with reference to VGAM1310. Regulatory Factor X, 5 (influences HLA class II expression) (RFX5, Accession NM_000449) is another VGAM1929 host target gene. RFX5 BINDING SITE is HOST TARGET binding site found in the 3' untranslated region of mRNA encoded by RFX5, corresponding to a HOST TARGET binding site such as BINDING SITE I, BINDING SITE II or BINDING SITE III. Table 2 illustrates the complementarity of the nucleotide sequences of RFX5 BINDING SITE, designated SEQ ID:6047, to the nucleotide sequence of VGAM1929 RNA, herein designated VGAM RNA, also designated SEQ ID:4640.

Another function of VGAM1929 is therefore inhibition of Regulatory Factor X, 5 (influences HLA class II expression) (RFX5, Accession NM_000449), a gene which activates transcription from class ii mhc promoters. Accordingly, utilities of VGAM1929 include diagnosis, prevention and treatment of diseases and clinical conditions associated with RFX5. The function of RFX5 and its association with various diseases and clinical conditions, has been established by previous studies, as described hereinabove with reference to VGAM55. Retinal G Protein Coupled Receptor (RGR, Accession NM_002921) is another VGAM1929 host target gene. RGR BINDING SITE is HOST TARGET binding site found in the 3' untranslated region of mRNA encoded by RGR, corresponding to a HOST TARGET binding site such as BINDING SITE I, BINDING SITE II or BINDING SITE III. Table 2 illustrates the complementarity of the nucleotide sequences of RGR BINDING SITE, designated SEQ ID:8825, to the nucleotide sequence of VGAM1929 RNA, herein designated VGAM RNA, also designated SEQ ID:4640.

Another function of VGAM1929 is therefore inhibition of Retinal G Protein Coupled Receptor (RGR, Accession NM_002921), a gene which catalyse the isomerization of the chromophore by a retinochrome-like mechanism and act as a receptor for all-trans- and 11-cis-retinal. Accordingly, utilities of VGAM1929 include diagnosis, prevention and treatment of diseases and clinical conditions associated with RGR. The function of RGR and its association with various diseases and clinical conditions, has been established by previous studies, as described hereinabove with reference to VGAM1283. Ribonuclease, RNase A Family, K6 (RNASE6, Accession NM_005615) is another VGAM1929 host target gene. RNASE6 BINDING SITE is HOST TARGET binding site found in the 5' untranslated region of mRNA encoded by RNASE6, corresponding to a HOST TARGET binding site such as BINDING SITE I, BINDING SITE II or BINDING SITE III. Table 2 illustrates the complementarity of the nucleotide sequences of RNASE6 BINDING SITE, designated SEQ ID:12133, to the nucleotide sequence of VGAM1929 RNA, herein designated VGAM RNA, also designated SEQ ID:4640.

Another function of VGAM1929 is therefore inhibition of Ribonuclease, RNase A Family, K6 (RNASE6, Accession NM_005615). Accordingly, utilities of VGAM1929 include diagnosis, prevention and treatment of diseases and clinical conditions associated with RNASE6. Ring Finger Protein 4 (RNF4, Accession NM_002938) is another VGAM1929 host target gene. RNF4 BINDING SITE is HOST TARGET binding site found in the 3' untranslated region of mRNA encoded by RNF4, corresponding to a HOST TARGET binding site such as BINDING SITE I, BINDING SITE II or BINDING SITE III. Table 2 illustrates the complementarity of the nucleotide sequences of RNF4 BINDING SITE, designated SEQ ID:8842, to the nucleotide sequence of VGAM1929 RNA, herein designated VGAM RNA, also designated SEQ ID:4640.

Another function of VGAM1929 is therefore inhibition of Ring Finger Protein 4 (RNF4, Accession NM_002938). Accordingly, utilities of VGAM1929 include diagnosis, prevention and treatment of diseases and clinical conditions associated with RNF4. Ribosomal Protein L15 (RPL15, Accession NM_002948) is another VGAM1929 host target gene. RPL15 BINDING SITE is HOST TARGET binding site found in the 3' untranslated region of mRNA encoded by RPL15, corresponding to a HOST TARGET binding site such as BINDING SITE I, BINDING SITE II or BINDING SITE III. Table 2 illustrates the complementarity of the nucleotide sequences of RPL15 BINDING SITE, designated SEQ ID:8861, to the nucleotide sequence of VGAM1929 RNA, herein designated VGAM RNA, also designated SEQ ID:4640.

Another function of VGAM1929 is therefore inhibition of Ribosomal Protein L15 (RPL15, Accession NM_002948). Accordingly, utilities of VGAM1929 include diagnosis, prevention and treatment of diseases and clinical conditions associated with RPL15. Ribonucleotide Reductase M2 B (TP53 inducible) (RRM2B, Accession XM_042096) is another VGAM1929 host target gene. RRM2B BINDING SITE is HOST TARGET binding site found in the 3' untranslated region of mRNA encoded by RRM2B, corresponding to a HOST TARGET binding site such as BINDING SITE I, BINDING SITE II or BINDING SITE III. Table 2 illustrates the complementarity of the nucleotide sequences of RRM2B BINDING SITE, designated SEQ ID:33691, to the nucleotide sequence of VGAM1929 RNA, herein designated VGAM RNA, also designated SEQ ID:4640.

Another function of VGAM1929 is therefore inhibition of Ribonucleotide Reductase M2 B (TP53 inducible) (RRM2B, Accession XM_042096). Accordingly, utilities of VGAM1929 include diagnosis, prevention and treatment of diseases and clinical conditions associated with RRM2B. Runt-related Transcription Factor 1 (acute myeloid leukemia 1; aml1 oncogene) (RUNX1, Accession NM_001754) is another VGAM1929 host target gene. RUNX1 BINDING SITE1 and RUNX1 BINDING SITE2 are HOST TARGET binding sites found in untranslated regions of mRNA encoded by RUNX1, corresponding to HOST TARGET binding sites such as BINDING SITE I, BINDING SITE II or BINDING SITE III. Table 2 illustrates the complementarity of the nucleotide sequences of RUNX1 BINDING SITE1 and RUNX1 BINDING SITE2, designated SEQ ID:7499 and SEQ ID:7504 respectively, to the nucleotide sequence of VGAM1929 RNA, herein designated VGAM RNA, also designated SEQ ID:4640.

Another function of VGAM1929 is therefore inhibition of Runt-related Transcription Factor 1 (acute myeloid leukemia 1; aml1 oncogene) (RUNX1, Accession NM_001754). Accordingly, utilities of VGAM1929 include diagnosis, prevention and treatment of diseases and clinical conditions associated with RUNX1. Sodium Channel, Voltage-gated, Type III, Alpha Polypeptide (SCN3A, Accession NM_006922) is another VGAM1929 host target gene. SCN3A BINDING SITE is HOST TARGET binding site found in the 3' untranslated region of mRNA encoded by SCN3A, corresponding to a HOST TARGET binding site such as BINDING SITE I, BINDING SITE II or BINDING SITE III. Table 2 illustrates the complementarity of the nucleotide sequences of SCN3A BINDING SITE, designated SEQ ID:13799, to the nucleotide sequence of VGAM1929 RNA, herein designated VGAM RNA, also designated SEQ ID:4640.

Another function of VGAM1929 is therefore inhibition of Sodium Channel, Voltage-gated, Type III, Alpha Polypeptide (SCN3A, Accession NM_006922), a gene which may be important for maintaining neural membrane excitability. Accordingly, utilities of VGAM1929 include diagnosis, prevention and treatment of diseases and clinical conditions associated with SCN3A. The function of SCN3A and its association with various diseases and clinical conditions, has been established by previous studies, as described hereinabove with reference to VGAM124. Sirtuin Silent Mating Type Information Regulation 2 Homolog 1 (S. cerevisiae) (SIRT1, Accession NM_012238) is another VGAM1929 host target gene. SIRT1 BINDING SITE is HOST TARGET binding site found in the 3' untranslated region of mRNA encoded by SIRT1, corresponding to a HOST TARGET binding site such as BINDING SITE I, BINDING SITE II or BINDING SITE III. Table 2 illustrates the complementarity of the nucleotide sequences of SIRT1 BINDING SITE, designated SEQ ID:14544, to the nucleotide sequence of VGAM1929 RNA, herein designated VGAM RNA, also designated SEQ ID:4640.

Another function of VGAM1929 is therefore inhibition of Sirtuin Silent Mating Type Information Regulation 2 Homolog 1 (S. cerevisiae) (SIRT1, Accession NM_012238), a gene which may function as intracellular regulatory protein with mono-ADP-ribosyltransferase activity. Accordingly, utilities of VGAM1929 include diagnosis, prevention and treatment of diseases and clinical conditions associated with SIRT1. The function of SIRT1 and its association with various diseases and clinical conditions, has been established by previous studies, as described hereinabove with reference to VGAM244. Solute Carrier Family 20 (phosphate transporter), Member 2 (SLC20A2, Accession NM_006749) is another VGAM1929 host target gene. SLC20A2 BINDING SITE is HOST TARGET binding site found in the 3' untranslated region of mRNA encoded by SLC20A2, corresponding to a HOST TARGET binding site such as BINDING SITE I, BINDING SITE II or BINDING SITE III. Table 2 illustrates the complementarity of the nucleotide sequences of SLC20A2 BINDING SITE, designated SEQ ID:13601, to the nucleotide sequence of VGAM1929 RNA, herein designated VGAM RNA, also designated SEQ ID:4640.

Another function of VGAM1929 is therefore inhibition of Solute Carrier Family 20 (phosphate transporter), Member 2 (SLC20A2, Accession NM_006749), a gene which is a sodium-phosphate symporter. Accordingly, utilities of VGAM1929 include diagnosis, prevention and treatment of diseases and clinical conditions associated with SLC20A2. The function of SLC20A2 and its association with various diseases and clinical conditions, has been established by previous studies, as described hereinabove with reference to VGAM232. Solute Carrier Family 21 (organic anion transporter), Member 9 (SLC21A9, Accession NM_007256) is another VGAM1929 host target gene. SLC21A9 BINDING SITE is HOST TARGET binding site found in the 3' untranslated region of mRNA encoded by SLC21A9, corresponding to a HOST TARGET binding site such as BINDING SITE I, BINDING SITE II or BINDING SITE III. Table 2 illustrates the complementarity of the nucleotide sequences of SLC21A9 BINDING SITE, designated SEQ ID:14128, to the nucleotide sequence of VGAM1929 RNA, herein designated VGAM RNA, also designated SEQ ID:4640.

Another function of VGAM1929 is therefore inhibition of Solute Carrier Family 21 (organic anion transporter), Member 9 (SLC21A9, Accession NM_007256), a gene which is Moderately similar to SLC21A2 prostaglandin transporter. Accordingly, utilities of VGAM1929 include diagnosis, prevention and treatment of diseases and clinical conditions associated with SLC21A9. The function of SLC21A9 and its association with various diseases and clinical conditions, has been established by previous studies, as described hereinabove with reference to VGAM894. Solute Carrier Family 2 (facilitated glucose transporter), Member 2 (SLC2A2, Accession NM_000340) is another VGAM1929 host target gene. SLC2A2 BINDING SITE is HOST TARGET binding site found in the 3' untranslated region of mRNA encoded by SLC2A2, corresponding to a HOST TARGET binding site such as BINDING SITE I, BINDING SITE II or BINDING SITE III. Table 2 illustrates the complementarity of the nucleotide sequences of SLC2A2 BINDING SITE, designated SEQ ID:5892, to the nucleotide sequence of VGAM1929 RNA, herein designated VGAM RNA, also designated SEQ ID:4640.

Another function of VGAM1929 is therefore inhibition of Solute Carrier Family 2 (facilitated glucose transporter), Member 2 (SLC2A2, Accession NM_000340). Accordingly, utilities of VGAM1929 include diagnosis, prevention and treatment of diseases and clinical conditions associated with SLC2A2. Solute Carrier Family 4, Sodium Bicarbonate Cotransporter, Member 7 (SLC4A7, Accession NM_003615) is another VGAM1929 host target gene. SLC4A7 BINDING SITE is HOST TARGET binding site found in the 3' untranslated region of mRNA encoded by SLC4A7, corresponding to a HOST TARGET binding site such as BINDING SITE I, BINDING SITE II or BINDING SITE III. Table 2 illustrates the complementarity of the nucleotide sequences of SLC4A7 BINDING SITE, designated SEQ ID:9676, to the nucleotide sequence of VGAM1929 RNA, herein designated VGAM RNA, also designated SEQ ID:4640.

Another function of VGAM1929 is therefore inhibition of Solute Carrier Family 4, Sodium Bicarbonate Cotransporter, Member 7 (SLC4A7, Accession NM_003615), a gene which mediates the coupled movement of sodium and bicarbonate ions across the plasma membrane. Accordingly, utilities of VGAM1929 include diagnosis, prevention and treatment of diseases and clinical conditions associated with SLC4A7. The function of SLC4A7 and its association with various diseases and clinical conditions, has been established by previous studies, as described hereinabove with reference to VGAM66. Solute Carrier Family 4, Sodium Bicarbonate Cotransporter, Member 8 (SLC4A8, Accession NM_004858) is another VGAM1929 host target gene. SLC4A8 BINDING SITE is HOST TARGET binding site found in the 3' untranslated region of mRNA encoded by SLC4A8, corresponding to a HOST TARGET binding site such as BINDING SITE I, BINDING SITE II or BINDING SITE III. Table 2 illustrates the complementarity of the nucleotide sequences of SLC4A8 BINDING SITE, designated SEQ ID:11267, to the nucleotide sequence of VGAM1929 RNA, herein designated VGAM RNA, also designated SEQ ID:4640.

Another function of VGAM1929 is therefore inhibition of Solute Carrier Family 4, Sodium Bicarbonate Cotransporter, Member 8 (SLC4A8, Accession NM_004858), a gene which is a sodium bicarbonate cotransporter. Accordingly, utilities of VGAM1929 include diagnosis, prevention and treatment of diseases and clinical conditions associated with SLC4A8. The function of SLC4A8 has been established by previous studies. Sodium bicarbonate cotransporters (NBCs) mediate the coupled movement of sodium and bicarbonate ions across the plasma membrane. Soleimani and Burnham (2000) reviewed NBCs and their regulation in physiologic and pathophysiologic states. By screening human brain cDNAs for the potential to encode proteins that are at least 50 kD, Nagase et al. (1998) isolated a partial SLC4A8 cDNA, which they called KIAA0739, that lacks 5-prime coding sequence. The deduced 1,130-amino acid partial SLC4A8 protein shares 56.5% amino acid sequence identity with the human NBC1 (SLC4A4; 603345) variant kNBC across 953 residues. Analysis of SLC4A8 expression in 10 human tissues by RT-PCR followed by ELISA detected highest SLC4A8 expression in brain and testis, lower expression in pancreas, kidney, lung, and ovary, and no expression in heart, liver, spleen, or skeletal muscle Full details of the abovementioned studies are described in the following publications, the disclosure of which are hereby incorporated by reference:

Soleimani, M.; Burnham, C. E.: Physiologic and molecular aspects of the Na (+):HCO(3-) cotransporter in health and disease processes. Kidney Int. 57: 371-384, 2000; and Amlal, H.; Burnham, C. E.; Soleimani, M.: Characterization of Na (+)/HCO(3-) cotransporter isoform NBC-3. Am. J. Physiol. 276: F903-F913, 1999.

Further studies establishing the function and utilities of SLC4A8 are found in John Hopkins OMIM database record ID 605024, and in sited publications numbered 1083, 704 and 7959 listed in the bibliography section hereinbelow, which are also hereby incorporated by reference. SWI/SNF Related, Matrix Associated, Actin Dependent Regulator of Chromatin, Subfamily D, Member 1 (SMARCD1, Accession NM_139071) is another VGAM1929 host target gene. SMARCD1 BINDING SITE1 and SMARCD1 BINDING SITE2 are HOST TARGET binding sites found in untranslated regions of mRNA encoded by SMARCD1, corresponding to HOST TARGET binding sites such as BINDING SITE I, BINDING SITE II or BINDING SITE III. Table 2 illustrates the complementarity of the nucleotide sequences of SMARCD1 BINDING SITE1 and SMARCD1 BINDING SITE2, designated SEQ ID:29143 and SEQ ID:9045 respectively, to the nucleotide sequence of VGAM1929 RNA, herein designated VGAM RNA, also designated SEQ ID:4640.

Another function of VGAM1929 is therefore inhibition of SWI/SNF Related, Matrix Associated, Actin Dependent Regulator of Chromatin, Subfamily D, Member 1 (SMARCD1, Accession NM_139071), a gene which is involved in chromatin assembly and remodeling. Accordingly, utilities of VGAM1929 include diagnosis, prevention and treatment of diseases and clinical conditions associated with SMARCD1. The function of SMARCD1 and its association with various diseases and clinical conditions, has been established by previous studies, as described hereinabove with reference to VGAM152. SNL (Accession NM_003088) is another VGAM1929 host target gene. SNL BINDING SITE is HOST TARGET binding site found in the 3' untranslated region of mRNA encoded by SNL, corresponding to a HOST TARGET binding site such as BINDING SITE I, BINDING SITE II or BINDING SITE III. Table 2 illustrates the complementarity of the nucleotide sequences of SNL BINDING SITE, designated SEQ ID:9067, to the nucleotide sequence of VGAM1929 RNA, herein designated VGAM RNA, also designated SEQ ID:4640.

Another function of VGAM1929 is therefore inhibition of SNL (Accession NM_003088), a gene which organizes filamentous actin into bundles with a minimum of 4.1:1 actin/fascin ratio. Accordingly, utilities of VGAM1929 include diagnosis, prevention and treatment of diseases and clinical conditions associated with SNL. The function of SNL and its association with various diseases and clinical conditions, has been established by previous studies, as described hereinabove with reference to VGAM675. Sorting Nexin 9 (SNX9, Accession NM_016224) is another VGAM1929 host target gene. SNX9 BINDING SITE is HOST TARGET binding site found in the 3' untranslated region of mRNA encoded by SNX9, corresponding to a HOST TARGET binding site such as BINDING SITE I, BINDING SITE II or BINDING SITE III. Table 2 illustrates the complementarity of the nucleotide sequences of SNX9 BINDING SITE, designated SEQ ID:18330, to the nucleotide sequence of VGAM1929 RNA, herein designated VGAM RNA, also designated SEQ ID:4640.

Another function of VGAM1929 is therefore inhibition of Sorting Nexin 9 (SNX9, Accession NM_016224). Accordingly, utilities of VGAM1929 include diagnosis, prevention and treatment of diseases and clinical conditions associated with SNX9. Sorbin and SH3 Domain Containing 1 (SORBS1, Accession NM_015385) is another VGAM1929 host target gene. SORBS1 BINDING SITE is HOST TARGET binding site found in the 3' untranslated region of mRNA encoded by SORBS1, corresponding to a HOST TARGET binding site such as BINDING SITE I, BINDING SITE II or BINDING SITE III. Table 2 illustrates the complementarity of the nucleotide sequences of SORBS1 BINDING SITE, designated SEQ ID:17689, to the nucleotide sequence of VGAM1929 RNA, herein designated VGAM RNA, also designated SEQ ID:4640.

Another function of VGAM1929 is therefore inhibition of Sorbin and SH3 Domain Containing 1 (SORBS1, Accession NM_015385), a gene which necessary for cell polarization during vegetative growth. Accordingly, utilities of VGAM1929 include diagnosis, prevention and treatment of diseases and clinical conditions associated with SORBS1. The function of SORBS1 and its association with various diseases and clinical conditions, has been established by previous studies, as described hereinabove with reference to VGAM475. Spectrin, Beta, Non-erythrocytic 4 (SPTBN4, Accession NM_025213) is another VGAM1929 host target gene. SPTBN4 BINDING SITE is HOST TARGET binding site found in the 3' untranslated region of mRNA encoded by SPTBN4, corresponding to a HOST TARGET binding site such as BINDING SITE I, BINDING SITE II or BINDING SITE III. Table 2 illustrates the complementarity of the nucleotide sequences of SPTBN4 BINDING SITE, designated SEQ ID:24884, to the nucleotide sequence of VGAM1929 RNA, herein designated VGAM RNA, also designated SEQ ID:4640.

Another function of VGAM1929 is therefore inhibition of Spectrin, Beta, Non-erythrocytic 4 (SPTBN4, Accession NM_025213), a gene which is critical for the maintenance of plasma membrane shape and lipid asymmetry. Accordingly, utilities of VGAM1929 include diagnosis, prevention and treatment of diseases and clinical conditions associated with SPTBN4. The function of SPTBN4 and its association with various diseases and clinical conditions, has been established by previous studies, as described hereinabove with reference to VGAM958. Sarcospan (Kras oncogene-associated gene) (SSPN, Accession NM_005086) is another VGAM1929 host target gene. SSPN BINDING SITE is HOST TARGET binding site found in the 3' untranslated region of mRNA encoded by SSPN, corresponding to a HOST TARGET binding site such as BINDING SITE I, BINDING SITE II or BINDING SITE III. Table 2 illustrates the complementarity of the nucleotide sequences of SSPN BINDING SITE, designated SEQ ID:11537, to the nucleotide sequence of VGAM1929 RNA, herein designated VGAM RNA, also designated SEQ ID:4640.

Another function of VGAM1929 is therefore inhibition of Sarcospan (Kras oncogene-associated gene) (SSPN, Accession NM_005086), a gene which spans the muscle plasma membrane and forms a link between the f-actin cytoskeleton and the extracellular matrix. Accordingly, utilities of VGAM1929 include diagnosis, prevention and treatment of diseases and clinical conditions associated with SSPN. The function of SSPN and its association with various diseases and clinical conditions, has been established by previous studies, as described hereinabove with reference to VGAM996. Staufen, RNA Binding Protein, Homolog 2 (Drosophila) (STAU2, Accession NM_014393) is another VGAM1929 host target gene. STAU2 BINDING SITE is HOST TARGET binding site found in the 3' untranslated region of mRNA encoded by STAU2, corresponding to a HOST TARGET binding site such as BINDING SITE I, BINDING SITE II or BINDING SITE III. Table 2 illustrates the complementarity of the nucleotide sequences of STAU2 BINDING SITE, designated SEQ ID:15724, to the nucleotide sequence of VGAM1929 RNA, herein designated VGAM RNA, also designated SEQ ID:4640.

Another function of VGAM1929 is therefore inhibition of Staufen, RNA Binding Protein, Homolog 2 (Drosophila) (STAU2, Accession NM_014393). Accordingly, utilities of VGAM1929 include diagnosis, prevention and treatment of diseases and clinical conditions associated with STAU2. Transforming, Acidic Coiled-coil Containing Protein 1 (TACC1, Accession NM_006283) is another VGAM1929 host target gene. TACC1 BINDING SITE is HOST TARGET binding site found in the 3' untranslated region of mRNA encoded by TACC1, corresponding to a HOST TARGET binding site such as BINDING SITE I, BINDING SITE II or BINDING SITE III. Table 2 illustrates the complementarity of the nucleotide sequences of TACC1 BINDING SITE, designated SEQ ID:12969, to the nucleotide sequence of VGAM1929 RNA, herein designated VGAM RNA, also designated SEQ ID:4640.

Another function of VGAM1929 is therefore inhibition of Transforming, Acidic Coiled-coil Containing Protein 1 (TACC1, Accession NM_006283). Accordingly, utilities of VGAM1929 include diagnosis, prevention and treatment of diseases and clinical conditions associated with TACC1. T-box, Brain, 1 (TBR1, Accession NM_006593) is another VGAM1929 host target gene. TBR1 BINDING SITE is HOST TARGET binding site found in the 3' untranslated region of mRNA encoded by TBR1, corresponding to a HOST TARGET binding site such as BINDING SITE I, BINDING SITE II or BINDING SITE III. Table 2 illustrates the complementarity of the nucleotide sequences of TBR1 BINDING SITE, designated SEQ ID:13358, to the nucleotide sequence of VGAM1929 RNA, herein designated VGAM RNA, also designated SEQ ID:4640.

Another function of VGAM1929 is therefore inhibition of T-box, Brain, 1 (TBR1, Accession NM_006593), a gene which is of unknown function. Accordingly, utilities of VGAM1929 include diagnosis, prevention and treatment of diseases and clinical conditions associated with TBR1. The function of TBR1 and its association with various diseases and clinical conditions, has been established by previous studies, as described hereinabove with reference to VGAM719. Transforming Growth Factor, Beta Receptor II (70/80 kDa) (TGFBR2, Accession NM_003242) is another VGAM1929 host target gene. TGFBR2 BINDING SITE is HOST TARGET binding site found in the 3' untranslated region of mRNA encoded by TGFBR2, corresponding to a HOST TARGET binding site such as BINDING SITE I, BINDING SITE II or BINDING SITE III. Table 2 illustrates the complementarity of the nucleotide sequences of TGFBR2 BINDING SITE, designated SEQ ID:9242, to the nucleotide sequence of VGAM1929 RNA, herein designated VGAM RNA, also designated SEQ ID:4640.

Another function of VGAM1929 is therefore inhibition of Transforming Growth Factor, Beta Receptor II (70/80 kDa) (TGFBR2, Accession NM_003242). Accordingly, utilities of VGAM1929 include diagnosis, prevention and treatment of diseases and clinical conditions associated with TGFBR2. Thrombomodulin (THBD, Accession NM_000361) is another VGAM1929 host target gene. THBD BINDING SITE1 and THBD BINDING SITE2 are HOST TARGET binding sites found in untranslated regions of mRNA encoded by THBD, corresponding to HOST TARGET binding sites such as BINDING SITE I, BINDING SITE II or BINDING SITE III. Table 2 illustrates the complementarity of the nucleotide sequences of THBD BINDING SITE1 and THBD BINDING SITE2, designated SEQ ID:5923 and SEQ ID:5924 respectively, to the nucleotide sequence of VGAM1929 RNA, herein designated VGAM RNA, also designated SEQ ID:4640.

Another function of VGAM1929 is therefore inhibition of Thrombomodulin (THBD, Accession NM_000361). Accordingly, utilities of VGAM1929 include diagnosis, prevention and treatment of diseases and clinical conditions associated with THBD. TIA1 Cytotoxic Granule-associated RNA Binding Protein (TIA1, Accession NM_022173) is another VGAM1929 host target gene. TIA1 BINDING SITE1 and TIA1 BINDING SITE2 are HOST TARGET binding sites found in untranslated regions of mRNA encoded by TIA1, corresponding to HOST TARGET binding sites such as BINDING SITE I, BINDING SITE II or BINDING SITE III. Table 2 illustrates the complementarity of the nucleotide sequences of TIA1 BINDING SITE1 and TIA1 BINDING SITE2, designated SEQ ID:22735 and SEQ ID:14838 respectively, to the nucleotide sequence of VGAM1929 RNA, herein designated VGAM RNA, also designated SEQ ID:4640.

Another function of VGAM1929 is therefore inhibition of TIA1 Cytotoxic Granule-associated RNA Binding Protein (TIA1, Accession NM_022173), a gene which possesses nucleolytic activity against cytotoxic lymphocyte target cells. Accordingly, utilities of VGAM1929 include diagnosis, prevention and treatment of diseases and clinical conditions associated with TIA1. The function of TIA1 and its association with various diseases and clinical conditions, has been established by previous studies, as described hereinabove with reference to VGAM276. Tumor Necrosis Factor, Alpha-induced Protein 1 (endothelial) (TNFAIP1, Accession NM_021137) is another VGAM1929 host target gene. TNFAIP1 BINDING SITE is HOST TARGET binding site found in the 3' untranslated region of mRNA encoded by TNFAIP1, corresponding to a HOST TARGET binding site such as BINDING SITE I, BINDING SITE II or BINDING SITE III. Table 2 illustrates the complementarity of the nucleotide sequences of TNFAIP1 BINDING SITE, designated SEQ ID:22112, to the nucleotide sequence of VGAM1929 RNA, herein designated VGAM RNA, also designated SEQ ID:4640.

Another function of VGAM1929 is therefore inhibition of Tumor Necrosis Factor, Alpha-induced Protein 1 (endothelial) (TNFAIP1, Accession NM_021137). Accordingly, utilities of VGAM1929 include diagnosis, prevention and treatment of diseases and clinical conditions associated with TNFAIP1. TOX (Accession NM_014729) is another VGAM1929 host target gene. TOX BINDING SITE is HOST TARGET binding site found in the 3' untranslated region of mRNA encoded by TOX, corresponding to a HOST TARGET binding site such as BINDING SITE I, BINDING SITE II or BINDING SITE III. Table 2 illustrates the complementarity of the nucleotide sequences of TOX BINDING SITE, designated SEQ ID:16330, to the nucleotide sequence of VGAM1929 RNA, herein designated VGAM RNA, also designated SEQ ID:4640.

Another function of VGAM1929 is therefore inhibition of TOX (Accession NM_014729). Accordingly, utilities of VGAM1929 include diagnosis, prevention and treatment of diseases and clinical conditions associated with TOX. Tripartite Motif-containing 14 (TRIM14, Accession NM_014788) is another VGAM1929 host target gene. TRIM14 BINDING SITE is HOST TARGET binding site found in the 3' untranslated region of mRNA encoded by TRIM14, corresponding to a HOST TARGET binding site such as BINDING SITE I, BINDING SITE II or BINDING SITE III. Table 2 illustrates the complementarity of the nucleotide sequences of TRIM14 BINDING SITE, designated SEQ ID:16670, to the nucleotide sequence of VGAM1929 RNA, herein designated VGAM RNA, also designated SEQ ID:4640.

Another function of VGAM1929 is therefore inhibition of Tripartite Motif-containing 14 (TRIM14, Accession NM_014788), a gene which is composed of 3 zinc-binding domains and is involved in development and cell growth. Accordingly, utilities of VGAM1929 include diagnosis, prevention and treatment of diseases and clinical conditions associated with TRIM14. The function of TRIM14 and its association with various diseases and clinical conditions, has been established by previous studies, as described hereinabove with reference to VGAM180. Transient Receptor Potential Cation Channel, Subfamily C, Member 1 (TRPC1, Accession NM_003304) is another VGAM1929 host target gene. TRPC1 BINDING SITE1 and TRPC1 BINDING SITE2 are HOST TARGET binding sites found in untranslated regions of mRNA encoded by TRPC1, corresponding to HOST TARGET binding sites such as BINDING SITE I, BINDING SITE II or BINDING SITE III. Table 2 illustrates the complementarity of the nucleotide sequences of TRPC1 BINDING SITE1 and TRPC1 BINDING SITE2, designated SEQ ID:9306 and SEQ ID:9308 respectively, to the nucleotide sequence of VGAM1929 RNA, herein designated VGAM RNA, also designated SEQ ID:4640.

Another function of VGAM1929 is therefore inhibition of Transient Receptor Potential Cation Channel, Subfamily C, Member 1 (TRPC1, Accession NM_003304), a gene which acts as a non-voltage-sensitive store-operated Ca2+ channel. Accordingly, utilities of VGAM1929 include diagnosis, prevention and treatment of diseases and clinical conditions associated with TRPC1. The function of TRPC1 and its association with various diseases and clinical conditions, has been established by previous studies, as described hereinabove with reference to VGAM200. Translin (TSN, Accession NM_004622) is another VGAM1929 host target gene. TSN BINDING SITE is HOST TARGET binding site found in the 3' untranslated region of mRNA encoded by TSN, corresponding to a HOST TARGET binding site such as BINDING SITE I, BINDING SITE II or BINDING SITE III. Table 2 illustrates the complementarity of the nucleotide sequences of TSN BINDING SITE, designated SEQ ID:10990, to the nucleotide sequence of VGAM1929 RNA, herein designated VGAM RNA, also designated SEQ ID:4640.

Another function of VGAM1929 is therefore inhibition of Translin (TSN, Accession NM_004622), a gene which is a DNA binding protein and involved in DNA repair, replication, or recombination. Accordingly, utilities of VGAM1929 include diagnosis, prevention and treatment of diseases and clinical conditions associated with TSN. The function of TSN and its association with various diseases and clinical conditions, has been established by previous studies, as described hereinabove with reference to VGAM98. Thioredoxin Reductase 1 (TXNRD1, Accession NM_003330) is another VGAM1929 host target gene. TXNRD1 BINDING SITE is HOST TARGET binding site found in the 3' untranslated region of mRNA encoded by TXNRD1, corresponding to a HOST TARGET binding site such as BINDING SITE I, BINDING SITE II or BINDING SITE III. Table 2 illustrates the complementarity of the nucleotide sequences of TXNRD1 BINDING SITE, designated SEQ ID:9338, to the nucleotide sequence of VGAM1929 RNA, herein designated VGAM RNA, also designated SEQ ID:4640.

Another function of VGAM1929 is therefore inhibition of Thioredoxin Reductase 1 (TXNRD1, Accession NM_003330), a gene which acts as an antioxidant enzyme and is involved in maintaining redox balance. Accordingly, utilities of VGAM1929 include diagnosis, prevention and treatment of diseases and clinical conditions associated with TXNRD1. The function of TXNRD1 and its association with various diseases and clinical conditions, has been established by previous studies, as described hereinabove with reference to VGAM247. Tyrosinase-related Protein 1 (TYRP1, Accession XM_051267) is another VGAM1929 host target gene. TYRP1 BINDING SITE is HOST TARGET binding site found in the 3' untranslated region of mRNA encoded by TYRP1, corresponding to a HOST TARGET binding site such as BINDING SITE I, BINDING SITE II or BINDING SITE III. Table 2 illustrates the complementarity of the nucleotide sequences of TYRP1 BINDING SITE, designated SEQ ID:35796, to the nucleotide sequence of VGAM1929 RNA, herein designated VGAM RNA, also designated SEQ ID:4640.

Another function of VGAM1929 is therefore inhibition of Tyrosinase-related Protein 1 (TYRP1, Accession XM_051267). Accordingly, utilities of VGAM1929 include diagnosis, prevention and treatment of diseases and clinical conditions associated with TYRP1. Ubiquitin Protein Ligase E3A (human papilloma virus E6-associated protein, Angelman syndrome) (UBE3A, Accession NM_130839) is another VGAM1929 host target gene. UBE3A BINDING SITE1 through UBE3A BINDING SITE3 are HOST TARGET binding sites found in untranslated regions of mRNA encoded by UBE3A, corresponding to HOST TARGET binding sites such as BINDING SITE I, BINDING SITE II or BINDING SITE III. Table 2 illustrates the complementarity of the nucleotide sequences of UBE3A BINDING SITE1 through UBE3A BINDING SITE3, designated SEQ ID:28366, SEQ ID:28362 and SEQ ID:6081 respectively, to the nucleotide sequence of VGAM1929 RNA, herein designated VGAM RNA, also designated SEQ ID:4640.

Another function of VGAM1929 is therefore inhibition of Ubiquitin Protein Ligase E3A (human papilloma virus E6-associated protein, Angelman syndrome) (UBE3A, Accession NM_130839). Accordingly, utilities of VGAM1929 include diagnosis, prevention and treatment of diseases and clinical conditions associated with UBE3A. Uracil-DNA Glycosylase (UNG, Accession NM_003362) is another VGAM1929 host target gene. UNG BINDING SITE1 and UNG BINDING SITE2 are HOST TARGET binding sites found in untranslated regions of mRNA encoded by UNG, corresponding to HOST TARGET binding sites such as BINDING SITE I, BINDING SITE II or BINDING SITE III. Table 2 illustrates the complementarity of the nucleotide sequences of UNG BINDING SITE1 and UNG BINDING SITE2, designated SEQ ID:9389 and SEQ ID:9416 respectively, to the nucleotide sequence of VGAM1929 RNA, herein designated VGAM RNA, also designated SEQ ID:4640.

Another function of VGAM1929 is therefore inhibition of Uracil-DNA Glycosylase (UNG, Accession NM_003362), a gene which excises uracil residues from the dna to prevent mutagenesis and initiate the base-excision repair (BER) pathway. Accordingly, utilities of VGAM1929 include diagnosis, prevention and treatment of diseases and clinical conditions associated with UNG. The function of UNG and its association with various diseases and clinical conditions, has been established by previous studies, as described hereinabove with reference to VGAM206. Xylulokinase Homolog (H. influenzae) (XYLB, Accession NM_005108) is another VGAM1929 host target gene. XYLB BINDING SITE is HOST TARGET binding site found in the 3' untranslated region of mRNA encoded by XYLB, corresponding to a HOST TARGET binding site such as BINDING SITE I, BINDING SITE II or BINDING SITE III. Table 2 illustrates the complementarity of the nucleotide sequences of XYLB BINDING SITE, designated SEQ ID:11584, to the nucleotide sequence of VGAM1929 RNA, herein designated VGAM RNA, also designated SEQ ID:4640.

Another function of VGAM1929 is therefore inhibition of Xylulokinase Homolog (H. influenzae) (XYLB, Accession NM_005108), a gene which is similar to Haemophilus influenzae xylulokinase and may play a role in energy metabolism. Accordingly, utilities of VGAM1929 include diagnosis, prevention and treatment of diseases and clinical conditions associated with XYLB. The function of XYLB and its association with various diseases and clinical conditions, has been established by previous studies, as described hereinabove with reference to VGAM127. Tyrosine 3-monooxygenase/tryptophan 5-monooxygenase Activation Protein, Gamma Polypeptide (YWHAG, Accession NM_012479) is another VGAM1929 host target gene. YWHAG BINDING SITE is HOST TARGET binding site found in the 3' untranslated region of mRNA encoded by YWHAG, corresponding to a HOST TARGET binding site such as BINDING SITE I, BINDING SITE II or BINDING SITE III. Table 2 illustrates the complementarity of the nucleotide sequences of YWHAG BINDING SITE, designated SEQ ID:14854, to the nucleotide sequence of VGAM1929 RNA, herein designated VGAM RNA, also designated SEQ ID:4640.

Another function of VGAM1929 is therefore inhibition of Tyrosine 3-monooxygenase/tryptophan 5-monooxygenase Activation Protein, Gamma Polypeptide (YWHAG, Accession NM_012479), a gene which mediates mitogenic signals of PDGF in vascular smooth muscle cells. Accordingly, utilities of VGAM1929 include diagnosis, prevention and treatment of diseases and clinical conditions associated with YWHAG. The function of YWHAG and its association with various diseases and clinical conditions, has been established by previous studies, as described hereinabove with reference to VGAM180. Tyrosine 3-monooxygenase/tryptophan 5-monooxygenase Activation Protein, Eta Polypeptide (YWHAH, Accession NM_003405) is another VGAM1929 host target gene. YWHAH BINDING SITE is HOST TARGET binding site found in the 3' untranslated region of mRNA encoded by YWHAH, corresponding to a HOST TARGET binding site such as BINDING SITE I, BINDING SITE II or BINDING SITE III. Table 2 illustrates the complementarity of the nucleotide sequences of YWHAH BINDING SITE, designated SEQ ID:9441, to the nucleotide sequence of VGAM1929 RNA, herein designated VGAM RNA, also designated SEQ ID:4640.

Another function of VGAM1929 is therefore inhibition of Tyrosine 3-monooxygenase/tryptophan 5-monooxygenase Activation Protein, Eta Polypeptide (YWHAH, Accession NM_003405), a gene which activates tyrosine and tryptophan hydroxylases in the presence of and strongly activates protein kinase c. Accordingly, utilities of VGAM1929 include diagnosis, prevention and treatment of diseases and clinical conditions associated with YWHAH. The function of YWHAH and its association with various diseases and clinical conditions, has been established by previous studies, as described hereinabove with reference to VGAM1923. Zinc-fingers and Homeoboxes 1 (ZHX1, Accession NM_007222) is another VGAM1929 host target gene. ZHX1 BINDING SITE is HOST TARGET binding site found in the 3' untranslated region of mRNA encoded by ZHX1, corresponding to a HOST TARGET binding site such as BINDING SITE I, BINDING SITE II or BINDING SITE III. Table 2 illustrates the complementarity of the nucleotide sequences of ZHX1 BINDING SITE, designated SEQ ID:14093, to the nucleotide sequence of VGAM1929 RNA, herein designated VGAM RNA, also designated SEQ ID:4640.

Another function of VGAM1929 is therefore inhibition of Zinc-fingers and Homeoboxes 1 (ZHX1, Accession NM_007222). Accordingly, utilities of VGAM1929 include diagnosis, prevention and treatment of diseases and clinical conditions associated with ZHX1. Zinc Finger Protein 36 (KOX 18) (ZNF36, Accession XM_168302) is another VGAM1929 host target gene. ZNF36 BINDING SITE is HOST TARGET binding site found in the 3' untranslated region of mRNA encoded by ZNF36, corresponding to a HOST TARGET binding site such as BINDING SITE I, BINDING SITE II or BINDING SITE III. Table 2 illustrates the complementarity of the nucleotide sequences of ZNF36 BINDING SITE, designated SEQ ID:45104, to the nucleotide sequence of VGAM1929 RNA, herein designated VGAM RNA, also designated SEQ ID:4640.

Another function of VGAM1929 is therefore inhibition of Zinc Finger Protein 36 (KOX 18) (ZNF36, Accession XM_168302), a gene which may be involved in transcriptional regulation. Accordingly, utilities of VGAM1929 include diagnosis, prevention and treatment of diseases and clinical conditions associated with ZNF36. The function of ZNF36 and its association with various diseases and clinical conditions, has been established by previous studies, as described hereinabove with reference to VGAM804. Zinc Finger Protein 80 (pT17) (ZNF80, Accession NM_007136) is another VGAM1929 host target gene. ZNF80 BINDING SITE is HOST TARGET binding site found in the 3' untranslated region of mRNA encoded by ZNF80, corresponding to a HOST TARGET binding site such as BINDING SITE I, BINDING SITE II or BINDING SITE III. Table 2 illustrates the complementarity of the nucleotide sequences of ZNF80 BINDING SITE, designated SEQ ID:13988, to the nucleotide sequence of VGAM1929 RNA, herein designated VGAM RNA, also designated SEQ ID:4640.

Another function of VGAM1929 is therefore inhibition of Zinc Finger Protein 80 (pT17) (ZNF80, Accession NM_007136). Accordingly, utilities of VGAM1929 include diagnosis, prevention and treatment of diseases and clinical conditions associated with ZNF80. ACP33 (Accession NM_016630) is another VGAM1929 host target gene. ACP33 BINDING SITE is HOST TARGET binding site found in the 3' untranslated region of mRNA encoded by ACP33, corresponding to a HOST TARGET binding site such as BINDING SITE I, BINDING SITE II or BINDING SITE III. Table 2 illustrates the complementarity of the nucleotide sequences of ACP33 BINDING SITE, designated SEQ ID:18744, to the nucleotide sequence of VGAM1929 RNA, herein designated VGAM RNA, also designated SEQ ID:4640.

Another function of VGAM1929 is therefore inhibition of ACP33 (Accession NM_016630). Accordingly, utilities of VGAM1929 include diagnosis, prevention and treatment of diseases and clinical conditions associated with ACP33. AF311304 (Accession NM_031214) is another VGAM1929 host target gene. AF311304 BINDING SITE is HOST TARGET binding site found in the 3' untranslated region of mRNA encoded by AF311304, corresponding to a HOST TARGET binding site such as BINDING SITE I, BINDING SITE II or BINDING SITE III. Table 2 illustrates the complementarity of the nucleotide sequences of AF311304 BINDING SITE, designated SEQ ID:25260, to the nucleotide sequence of VGAM1929 RNA, herein designated VGAM RNA, also designated SEQ ID:4640.

Another function of VGAM1929 is therefore inhibition of AF311304 (Accession NM_031214). Accordingly, utilities of VGAM1929 include diagnosis, prevention and treatment of diseases and clinical conditions associated with AF311304. Agmatine Ureohydrolase (agmatinase) (AGMAT, Accession NM_024758) is another VGAM1929 host target gene. AGMAT BINDING SITE is HOST TARGET binding site found in the 3' untranslated region of mRNA encoded by AGMAT, corresponding to a HOST TARGET binding site such as BINDING SITE I, BINDING SITE II or BINDING SITE III. Table 2 illustrates the complementarity of the nucleotide sequences of AGMAT BINDING SITE, designated SEQ ID:24107, to the nucleotide sequence of VGAM1929 RNA, herein designated VGAM RNA, also designated SEQ ID:4640.

Another function of VGAM1929 is therefore inhibition of Agmatine Ureohydrolase (agmatinase) (AGMAT, Accession NM_024758). Accordingly, utilities of VGAM1929 include diagnosis, prevention and treatment of diseases and clinical conditions associated with AGMAT. A Kinase (PRKA) Anchor Protein 8 (AKAP8, Accession NM_005858) is another VGAM1929 host target gene. AKAP8 BINDING SITE is HOST TARGET binding site found in the 3' untranslated region of mRNA encoded by AKAP8, corresponding to a HOST TARGET binding site such as BINDING SITE I, BINDING SITE II or BINDING SITE III. Table 2 illustrates the complementarity of the nucleotide sequences of AKAP8 BINDING SITE, designated SEQ ID:12464, to the nucleotide sequence of VGAM1929 RNA, herein designated VGAM RNA, also designated SEQ ID:4640.

Another function of VGAM1929 is therefore inhibition of A Kinase (PRKA) Anchor Protein 8 (AKAP8, Accession NM_005858). Accordingly, utilities of VGAM1929 include diagnosis, prevention and treatment of diseases and clinical conditions associated with AKAP8. Adaptor-related Protein Complex 3, Mu 2 Subunit (AP3M2, Accession NM_006803) is another VGAM1929 host target gene. AP3M2 BINDING SITE is HOST TARGET binding site found in the 3' untranslated region of mRNA encoded by AP3M2, corresponding to a HOST TARGET binding site such as BINDING SITE I, BINDING SITE II or BINDING SITE III. Table 2 illustrates the complementarity of the nucleotide sequences of AP3M2 BINDING SITE, designated SEQ ID:13679, to the nucleotide sequence of VGAM1929 RNA, herein designated VGAM RNA, also designated SEQ ID:4640.

Another function of VGAM1929 is therefore inhibition of Adaptor-related Protein Complex 3, Mu 2 Subunit (AP3M2, Accession NM_006803). Accordingly, utilities of VGAM1929 include diagnosis, prevention and treatment of diseases and clinical conditions associated with AP3M2. Apolipoprotein L, 4 (APOL4, Accession NM_030643) is another VGAM1929 host target gene. APOL4 BINDING SITE is HOST TARGET binding site found in the 3' untranslated region of mRNA encoded by APOL4, corresponding to a HOST TARGET binding site such as BINDING SITE I, BINDING SITE II or BINDING SITE III. Table 2 illustrates the complementarity of the nucleotide sequences of APOL4 BINDING SITE, designated SEQ ID:24979, to the nucleotide sequence of VGAM1929 RNA, herein designated VGAM RNA, also designated SEQ ID:4640.

Another function of VGAM1929 is therefore inhibition of Apolipoprotein L, 4 (APOL4, Accession NM_030643). Accordingly, utilities of VGAM1929 include diagnosis, prevention and treatment of diseases and clinical conditions associated with APOL4. Ras Homolog Gene Family, Member E (ARHE, Accession NM_005168) is another VGAM1929 host target gene. ARHE BINDING SITE is HOST TARGET binding site found in the 3' untranslated region of mRNA encoded by ARHE, corresponding to a HOST TARGET binding site such as BINDING SITE I, BINDING SITE II or BINDING SITE III. Table 2 illustrates the complementarity of the nucleotide sequences of ARHE BINDING SITE, designated SEQ ID:11669, to the nucleotide sequence of VGAM1929 RNA, herein designated VGAM RNA, also designated SEQ ID:4640.

Another function of VGAM1929 is therefore inhibition of Ras Homolog Gene Family, Member E (ARHE, Accession NM_005168). Accordingly, utilities of VGAM1929 include diagnosis, prevention and treatment of diseases and clinical conditions associated with ARHE. Rho Guanine Nucleotide Exchange Factor (GEF) 3 (ARHGEF3, Accession NM_019555) is another VGAM1929 host target gene. ARHGEF3 BINDING SITE is HOST TARGET binding site found in the 3' untranslated region of mRNA encoded by ARHGEF3, corresponding to a HOST TARGET binding site such as BINDING SITE I, BINDING SITE II or BINDING SITE III. Table 2 illustrates the complementarity of the nucleotide sequences of ARHGEF3 BINDING SITE, designated SEQ ID:21209, to the nucleotide sequence of VGAM1929 RNA, herein designated VGAM RNA, also designated SEQ ID:4640.

Another function of VGAM1929 is therefore inhibition of Rho Guanine Nucleotide Exchange Factor (GEF) 3 (ARHGEF3, Accession NM_019555). Accordingly, utilities of VGAM1929 include diagnosis, prevention and treatment of diseases and clinical conditions associated with ARHGEF3. Cdc42 Guanine Nucleotide Exchange Factor (GEF) 9 (ARHGEF9, Accession NM_015185) is another VGAM1929 host target gene. ARHGEF9 BINDING SITE is HOST TARGET binding site found in the 3' untranslated region of mRNA encoded by ARHGEF9, corresponding to a HOST TARGET binding site such as BINDING SITE I, BINDING SITE II or BINDING SITE III. Table 2 illustrates the complementarity of the nucleotide sequences of ARHGEF9 BINDING SITE, designated SEQ ID:17540, to the nucleotide sequence of VGAM1929 RNA, herein designated VGAM RNA, also designated SEQ ID:4640.

Another function of VGAM1929 is therefore inhibition of Cdc42 Guanine Nucleotide Exchange Factor (GEF) 9 (ARHGEF9, Accession NM_015185). Accordingly, utilities of VGAM1929 include diagnosis, prevention and treatment of diseases and clinical conditions associated with ARHGEF9. ARL8 (Accession XM_167671) is another VGAM1929 host target gene. ARL8 BINDING SITE is HOST TARGET binding site found in the 3' untranslated region of mRNA encoded by ARL8, corresponding to a HOST TARGET binding site such as BINDING SITE I, BINDING SITE II or BINDING SITE III. Table 2 illustrates the complementarity of the nucleotide sequences of ARL8 BINDING SITE, designated SEQ ID:44762, to the nucleotide sequence of VGAM1929 RNA, herein designated VGAM RNA, also designated SEQ ID:4640.

Another function of VGAM1929 is therefore inhibition of ARL8 (Accession XM_167671). Accordingly, utilities of VGAM1929 include diagnosis, prevention and treatment of diseases and clinical conditions associated with ARL8. ARNTL2 (Accession NM_020183) is another VGAM1929 host target gene. ARNTL2 BINDING SITE is HOST TARGET binding site found in the 3' untranslated region of mRNA encoded by ARNTL2, corresponding to a HOST TARGET binding site such as BINDING SITE I, BINDING SITE II or BINDING SITE III. Table 2 illustrates the complementarity of the nucleotide sequences of ARNTL2 BINDING SITE, designated SEQ ID:21413, to the nucleotide sequence of VGAM1929 RNA, herein designated VGAM RNA, also designated SEQ ID:4640.

Another function of VGAM1929 is therefore inhibition of ARNTL2 (Accession NM_020183). Accordingly, utilities of VGAM1929 include diagnosis, prevention and treatment of diseases and clinical conditions associated with ARNTL2. ATPase, Class V, Type 10B (ATP10B, Accession XM_032721) is another VGAM1929 host target gene. ATP10B BINDING SITE is HOST TARGET binding site found in the 3' untranslated region of mRNA encoded by ATP10B, corresponding to a HOST TARGET binding site such as BINDING SITE I, BINDING SITE II or BINDING SITE III. Table 2 illustrates the complementarity of the nucleotide sequences of ATP10B BINDING SITE, designated SEQ ID:31737, to the nucleotide sequence of VGAM1929

RNA, herein designated VGAM RNA, also designated SEQ ID:4640.

Another function of VGAM1929 is therefore inhibition of ATPase, Class V, Type 10B (ATP10B, Accession XM_032721). Accordingly, utilities of VGAM1929 include diagnosis, prevention and treatment of diseases and clinical conditions associated with ATP10B. ATPase, Class II, Type 9A (ATP9A, Accession XM_030577) is another VGAM1929 host target gene. ATP9A BINDING SITE is HOST TARGET binding site found in the 3" untranslated region of mRNA encoded by ATP9A, corresponding to a HOST TARGET binding site such as BINDING SITE I, BINDING SITE II or BINDING SITE III. Table 2 illustrates the complementarity of the nucleotide sequences of ATP9A BINDING SITE, designated SEQ ID:31087, to the nucleotide sequence of VGAM1929 RNA, herein designated VGAM RNA, also designated SEQ ID:4640.

Another function of VGAM1929 is therefore inhibition of ATPase, Class II, Type 9A (ATP9A, Accession XM_030577). Accordingly, utilities of VGAM1929 include diagnosis, prevention and treatment of diseases and clinical conditions associated with ATP9A. BCMP1 (Accession NM_031442) is another VGAM1929 host target gene. BCMP1 BINDING SITE is HOST TARGET binding site found in the 3' untranslated region of mRNA encoded by BCMP1, corresponding to a HOST TARGET binding site such as BINDING SITE I, BINDING SITE II or BINDING SITE III. Table 2 illustrates the complementarity of the nucleotide sequences of BCMP1 BINDING SITE, designated SEQ ID:25456, to the nucleotide sequence of VGAM1929 RNA, herein designated VGAM RNA, also designated SEQ ID:4640.

Another function of VGAM1929 is therefore inhibition of BCMP1 (Accession NM_031442). Accordingly, utilities of VGAM1929 include diagnosis, prevention and treatment of diseases and clinical conditions associated with BCMP1. Chromosome 12 Open Reading Frame 22 (C12orf22, Accession NM_030809) is another VGAM1929 host target gene. C12orf22 BINDING SITE is HOST TARGET binding site found in the 3' untranslated region of mRNA encoded by C12orf22, corresponding to a HOST TARGET binding site such as BINDING SITE I, BINDING SITE II or BINDING SITE III. Table 2 illustrates the complementarity of the nucleotide sequences of C12orf22 BINDING SITE, designated SEQ ID:25126, to the nucleotide sequence of VGAM1929 RNA, herein designated VGAM RNA, also designated SEQ ID:4640.

Another function of VGAM1929 is therefore inhibition of Chromosome 12 Open Reading Frame 22 (C12orf22, Accession NM_030809). Accordingly, utilities of VGAM1929 include diagnosis, prevention and treatment of diseases and clinical conditions associated with C12orf22. Chromosome 13 Open Reading Frame 1 (C13orf1, Accession NM_020456) is another VGAM1929 host target gene. C13orf1 BINDING SITE is HOST TARGET binding site found in the 3' untranslated region of mRNA encoded by C13orf1, corresponding to a HOST TARGET binding site such as BINDING SITE I, BINDING SITE II or BINDING SITE III. Table 2 illustrates the complementarity of the nucleotide sequences of C13orf1 BINDING SITE, designated SEQ ID:21691, to the nucleotide sequence of VGAM1929 RNA, herein designated VGAM RNA, also designated SEQ ID:4640.

Another function of VGAM1929 is therefore inhibition of Chromosome 13 Open Reading Frame 1 (C13orf1, Accession NM_020456). Accordingly, utilities of VGAM1929 include diagnosis, prevention and treatment of diseases and clinical conditions associated with C13orf1. Chromosome 1 Open Reading Frame 22 (C1orf22, Accession NM_025191) is another VGAM1929 host target gene. C1orf22 BINDING SITE is HOST TARGET binding site found in the 3' untranslated region of mRNA encoded by C1orf22, corresponding to a HOST TARGET binding site such as BINDING SITE I, BINDING SITE II or BINDING SITE III. Table 2 illustrates the complementarity of the nucleotide sequences of C1orf22 BINDING SITE, designated SEQ ID:24839, to the nucleotide sequence of VGAM1929 RNA, herein designated VGAM RNA, also designated SEQ ID:4640.

Another function of VGAM1929 is therefore inhibition of Chromosome 1 Open Reading Frame 22 (C1orf22, Accession NM_025191). Accordingly, utilities of VGAM1929 include diagnosis, prevention and treatment of diseases and clinical conditions associated with C1orf22. Chromosome 1 Open Reading Frame 24 (C1orf24, Accession NM_052966) is another VGAM1929 host target gene. C1orf24 BINDING SITE is HOST TARGET binding site found in the 3' untranslated region of mRNA encoded by C1orf24, corresponding to a HOST TARGET binding site such as BINDING SITE I, BINDING SITE II or BINDING SITE III. Table 2 illustrates the complementarity of the nucleotide sequences of C1orf24 BINDING SITE, designated SEQ ID:27532, to the nucleotide sequence of VGAM1929 RNA, herein designated VGAM RNA, also designated SEQ ID:4640.

Another function of VGAM1929 is therefore inhibition of Chromosome 1 Open Reading Frame 24 (C1orf24, Accession NM_052966). Accordingly, utilities of VGAM1929 include diagnosis, prevention and treatment of diseases and clinical conditions associated with C1orf24. Chromosome 20 Open Reading Frame 130 (C20orf130, Accession XM_029741) is another VGAM1929 host target gene. C20orf130 BINDING SITE is HOST TARGET binding site found in the 3" untranslated region of mRNA encoded by C20orf130, corresponding to a HOST TARGET binding site such as BINDING SITE I, BINDING SITE II or BINDING SITE III. Table 2 illustrates the complementarity of the nucleotide sequences of C20orf130 BINDING SITE, designated SEQ ID:30938, to the nucleotide sequence of VGAM1929 RNA, herein designated VGAM RNA, also designated SEQ ID:4640.

Another function of VGAM1929 is therefore inhibition of Chromosome 20 Open Reading Frame 130 (C20orf130, Accession XM_029741). Accordingly, utilities of VGAM1929 include diagnosis, prevention and treatment of diseases and clinical conditions associated with C20orf130. Chromosome 21 Open Reading Frame 41 (C21orf41, Accession NM_138332) is another VGAM1929 host target gene. C21orf41 BINDING SITE is HOST TARGET binding site found in the 3' untranslated region of mRNA encoded by C21orf41, corresponding to a HOST TARGET binding site such as BINDING SITE I, BINDING SITE II or BINDING SITE III. Table 2 illustrates the complementarity of the nucleotide sequences of C21orf41 BINDING SITE, designated SEQ ID:28730, to the nucleotide sequence of VGAM1929 RNA, herein designated VGAM RNA, also designated SEQ ID:4640.

Another function of VGAM1929 is therefore inhibition of Chromosome 21 Open Reading Frame 41 (C21orf41, Accession NM_138332). Accordingly, utilities of VGAM1929 include diagnosis, prevention and treatment of diseases and clinical conditions associated with C21orf41. Chromosome 5 Open Reading Frame 6 (C5orf6, Accession NM_016605) is another VGAM1929 host target gene. C5orf6 BINDING SITE is HOST TARGET binding site found in the 3' untranslated region of mRNA encoded by C5orf6, corresponding to a HOST TARGET binding site such as BINDING SITE I, BINDING SITE II or BINDING SITE III. Table 2 illustrates the complementarity of the nucleotide sequences of C5orf6 BINDING SITE, designated SEQ ID:18702, to the nucleotide sequence of VGAM1929 RNA, herein designated VGAM RNA, also designated SEQ ID:4640.

Another function of VGAM1929 is therefore inhibition of Chromosome 5 Open Reading Frame 6 (C5orf6, Accession NM_016605). Accordingly, utilities of VGAM1929 include diagnosis, prevention and treatment of diseases and clinical conditions associated with C5orf6. Calcium/calmodulin-dependent Protein Kinase Kinase 1, Alpha (CAMKK1, Accession NM_032294) is another VGAM1929 host target gene. CAMKK1 BINDING SITE is HOST TARGET binding site found in the 3' untranslated region of mRNA encoded by CAMKK1, corresponding to a HOST TARGET binding site such as BINDING SITE I, BINDING SITE II or BINDING SITE III. Table 2 illustrates the complementarity of the nucleotide sequences of CAMKK1 BINDING SITE, designated SEQ ID:26070, to the nucleotide sequence of VGAM1929 RNA, herein designated VGAM RNA, also designated SEQ ID:4640.

Another function of VGAM1929 is therefore inhibition of Calcium/calmodulin-dependent Protein Kinase Kinase 1, Alpha (CAMKK1, Accession NM_032294). Accordingly, utilities of VGAM1929 include diagnosis, prevention and treatment of diseases and clinical conditions associated with CAMKK1. Chemokine (C-C motif) Receptor 6 (CCR6, Accession NM_031409) is another VGAM1929 host target gene. CCR6 BINDING SITE1 and CCR6 BINDING SITE2 are HOST TARGET binding sites found in untranslated regions of mRNA encoded by CCR6, corresponding to HOST TARGET binding sites such as BINDING SITE I, BINDING SITE II or BINDING SITE III. Table 2 illustrates the complementarity of the nucleotide sequences of CCR6 BINDING SITE1 and CCR6 BINDING SITE2, designated SEQ ID:25373 and SEQ ID:10579 respectively, to the nucleotide sequence of VGAM1929 RNA, herein designated VGAM RNA, also designated SEQ ID:4640.

Another function of VGAM1929 is therefore inhibition of Chemokine (C-C motif) Receptor 6 (CCR6, Accession NM_031409). Accordingly, utilities of VGAM1929 include diagnosis, prevention and treatment of diseases and clinical conditions associated with CCR6. CHFR (Accession NM_018223) is another VGAM1929 host target gene. CHFR BINDING SITE is HOST TARGET binding site found in the 3' untranslated region of mRNA encoded by CHFR, corresponding to a HOST TARGET binding site such as BINDING SITE I, BINDING SITE II or BINDING SITE III. Table 2 illustrates the complementarity of the nucleotide sequences of CHFR BINDING SITE, designated SEQ ID:20150, to the nucleotide sequence of VGAM1929 RNA, herein designated VGAM RNA, also designated SEQ ID:4640.

Another function of VGAM1929 is therefore inhibition of CHFR (Accession NM_018223). Accordingly, utilities of VGAM1929 include diagnosis, prevention and treatment of diseases and clinical conditions associated with CHFR. Carbohydrate (N-acetylglucosamine 6-O) Sulfotransferase 4 (CHST4, Accession NM_005769) is another VGAM1929 host target gene. CHST4 BINDING SITE is HOST TARGET binding site found in the 3' untranslated region of mRNA encoded by CHST4, corresponding to a HOST TARGET binding site such as BINDING SITE I, BINDING SITE II or BINDING SITE III. Table 2 illustrates the complementarity of the nucleotide sequences of CHST4 BINDING SITE, designated SEQ ID:12340, to the nucleotide sequence of VGAM1929 RNA, herein designated VGAM RNA, also designated SEQ ID:4640.

Another function of VGAM1929 is therefore inhibition of Carbohydrate (N-acetylglucosamine 6-O) Sulfotransferase 4 (CHST4, Accession NM_005769). Accordingly, utilities of VGAM1929 include diagnosis, prevention and treatment of diseases and clinical conditions associated with CHST4. Carbohydrate (chondroitin) Synthase 1 (CHSY1, Accession NM_014918) is another VGAM1929 host target gene. CHSY1 BINDING SITE is HOST TARGET binding site found in the 3' untranslated region of mRNA encoded by CHSY1, corresponding to a HOST TARGET binding site such as BINDING SITE I, BINDING SITE II or BINDING SITE III. Table 2 illustrates the complementarity of the nucleotide sequences of CHSY1 BINDING SITE, designated SEQ ID:17173, to the nucleotide sequence of VGAM1929 RNA, herein designated VGAM RNA, also designated SEQ ID:4640.

Another function of VGAM1929 is therefore inhibition of Carbohydrate (chondroitin) Synthase 1 (CHSY1, Accession NM_014918). Accordingly, utilities of VGAM1929 include diagnosis, prevention and treatment of diseases and clinical conditions associated with CHSY1. Cytoskeleton-associated Protein 4 (CKAP4, Accession NM_006825) is another VGAM1929 host target gene. CKAP4 BINDING SITE is HOST TARGET binding site found in the 3' untranslated region of mRNA encoded by CKAP4, corresponding to a HOST TARGET binding site such as BINDING SITE I, BINDING SITE II or BINDING SITE III. Table 2 illustrates the complementarity of the nucleotide sequences of CKAP4 BINDING SITE, designated SEQ ID:13705, to the nucleotide sequence of VGAM1929 RNA, herein designated VGAM RNA, also designated SEQ ID:4640.

Another function of VGAM1929 is therefore inhibition of Cytoskeleton-associated Protein 4 (CKAP4, Accession NM_006825). Accordingly, utilities of VGAM1929 include diagnosis, prevention and treatment of diseases and clinical conditions associated with CKAP4. Claudin 4 (CLDN4, Accession NM_001305) is another VGAM1929 host target gene. CLDN4 BINDING SITE is HOST TARGET binding site found in the 3' untranslated region of mRNA encoded by CLDN4, corresponding to a HOST TARGET binding site such as BINDING SITE I, BINDING SITE II or BINDING SITE III. Table 2 illustrates the complementarity of the nucleotide sequences of CLDN4 BINDING SITE, designated SEQ ID:6988, to the nucleotide sequence of VGAM1929 RNA, herein designated VGAM RNA, also designated SEQ ID:4640.

Another function of VGAM1929 is therefore inhibition of Claudin 4 (CLDN4, Accession NM_001305). Accordingly, utilities of VGAM1929 include diagnosis, prevention and treatment of diseases and clinical conditions associated with CLDN4. Crn, Crooked Neck-like 1 (Drosophila) (CRNKL1, Accession NM_016652) is another VGAM1929 host target gene. CRNKL1 BINDING SITE is HOST TARGET binding site found in the 3' untranslated region of mRNA encoded by CRNKL1, corresponding to a HOST TARGET binding site such as BINDING SITE I, BINDING SITE II or BINDING SITE III. Table 2 illustrates the complementarity of the nucleotide sequences of CRNKL1 BINDING SITE, designated SEQ ID:18774, to the nucleotide sequence of VGAM1929 RNA, herein designated VGAM RNA, also designated SEQ ID:4640.

Another function of VGAM1929 is therefore inhibition of Crn, Crooked Neck-like 1 (Drosophila) (CRNKL1, Accession NM_016652). Accordingly, utilities of VGAM1929 include diagnosis, prevention and treatment of diseases and clinical conditions associated with CRNKL1. CTP Synthase II (CTPS2, Accession NM_019857) is another VGAM1929 host target gene. CTPS2 BINDING SITE is HOST TARGET binding site found in the 3' untranslated region of mRNA encoded by CTPS2, corresponding to a HOST TARGET binding site such as BINDING SITE I, BINDING SITE II or BINDING SITE III. Table 2 illustrates the complementarity of the nucleotide sequences of CTPS2 BINDING SITE, designated SEQ ID:21262, to the nucleotide sequence of VGAM1929 RNA, herein designated VGAM RNA, also designated SEQ ID:4640.

Another function of VGAM1929 is therefore inhibition of CTP Synthase II (CTPS2, Accession NM_019857). Accordingly, utilities of VGAM1929 include diagnosis, prevention and treatment of diseases and clinical conditions associated with CTPS2. D2S448 (Accession XM_056455) is another VGAM1929 host target gene. D2S448 BINDING SITE is HOST TARGET binding site found in the 3' untranslated region of mRNA encoded by D2S448, corresponding to a HOST TARGET binding site such as BINDING SITE I, BINDING SITE II or BINDING SITE III. Table 2 illustrates the complementarity of the nucleotide sequences of D2S448 BINDING SITE, designated SEQ ID:36395, to the nucleotide sequence of VGAM1929 RNA, herein designated VGAM RNA, also designated SEQ ID:4640.

Another function of VGAM1929 is therefore inhibition of D2S448 (Accession XM_056455). Accordingly, utilities of VGAM1929 include diagnosis, prevention and treatment of diseases and clinical conditions associated with D2S448. DJ971N18.2 (Accession NM_021156) is another VGAM1929 host target gene. DJ971N18.2 BINDING SITE is HOST TARGET binding site found in the 3' untranslated region of mRNA encoded by DJ971N18.2, corresponding to a HOST TARGET binding site such as BINDING SITE I, BINDING SITE II or BINDING SITE III. Table 2 illustrates the complementarity of the nucleotide sequences of DJ971N18.2 BINDING SITE, designated SEQ ID:22134, to the nucleotide sequence of VGAM1929 RNA, herein designated VGAM RNA, also designated SEQ ID:4640.

Another function of VGAM1929 is therefore inhibition of DJ971N18.2 (Accession NM_021156). Accordingly, utilities of VGAM1929 include diagnosis, prevention and treatment of diseases and clinical conditions associated with DJ971N18.2. DKFZP434C0826 (Accession XM_097248) is another VGAM1929 host target gene. DKFZP434C0826 BINDING SITE is HOST TARGET binding site found in the 5' untranslated region of mRNA encoded by DKFZP434C0826, corresponding to a HOST TARGET binding site such as BINDING SITE I, BINDING SITE II or BINDING SITE III. Table 2 illustrates the complementarity of the nucleotide sequences of DKFZP434C0826 BINDING SITE, designated SEQ ID:40844, to the nucleotide sequence of VGAM1929 RNA, herein designated VGAM RNA, also designated SEQ ID:4640.

Another function of VGAM1929 is therefore inhibition of DKFZP434C0826 (Accession XM_097248). Accordingly, utilities of VGAM1929 include diagnosis, prevention and treatment of diseases and clinical conditions associated with DKFZP434C0826. DKFZP434D1335 (Accession XM_036578) is another VGAM1929 host target gene. DKFZP434D1335 BINDING SITE is HOST TARGET binding site found in the 3' untranslated region of mRNA encoded by DKFZP434D1335, corresponding to a HOST TARGET binding site such as BINDING SITE I, BINDING SITE II or BINDING SITE III. Table 2 illustrates the complementarity of the nucleotide sequences of DKFZP434D1335 BINDING SITE, designated SEQ ID:32468, to the nucleotide sequence of VGAM1929 RNA, herein designated VGAM RNA, also designated SEQ ID:4640.

Another function of VGAM1929 is therefore inhibition of DKFZP434D1335 (Accession XM_036578). Accordingly, utilities of VGAM1929 include diagnosis, prevention and treatment of diseases and clinical conditions associated with DKFZP434D1335. DKFZp434D177 (Accession NM_032264) is another VGAM1929 host target gene. DKFZp434D177 BINDING SITE is HOST TARGET binding site found in the 3' untranslated region of mRNA encoded by DKFZp434D177, corresponding to a HOST TARGET binding site such as BINDING SITE I, BINDING SITE II or BINDING SITE III. Table 2 illustrates the complementarity of the nucleotide sequences of DKFZp434D177 BINDING SITE, designated SEQ ID:26010, to the nucleotide sequence of VGAM1929 RNA, herein designated VGAM RNA, also designated SEQ ID:4640.

Another function of VGAM1929 is therefore inhibition of DKFZp434D177 (Accession NM_032264). Accordingly, utilities of VGAM1929 include diagnosis, prevention and treatment of diseases and clinical conditions associated with DKFZp434D177. DKFZP434J1813 (Accession XM_029798) is another VGAM1929 host target gene. DKFZP434J1813 BINDING SITE is HOST TARGET binding site found in the 3' untranslated region of mRNA encoded by DKFZP434J1813, corresponding to a HOST TARGET binding site such as BINDING SITE I, BINDING SITE II or BINDING SITE III. Table 2 illustrates the complementarity of the nucleotide sequences of DKFZP434J1813 BINDING SITE, designated SEQ ID:30949, to the nucleotide sequence of VGAM1929 RNA, herein designated VGAM RNA, also designated SEQ ID:4640.

Another function of VGAM1929 is therefore inhibition of DKFZP434J1813 (Accession XM_029798). Accordingly, utilities of VGAM1929 include diagnosis, prevention and treatment of diseases and clinical conditions associated with DKFZP434J1813. DKFZP434O125 (Accession XM_036284) is another VGAM1929 host target gene. DKFZP434O125 BINDING SITE is HOST TARGET binding site found in the 3' untranslated region of mRNA encoded by DKFZP434O125, corresponding to a HOST TARGET binding site such as BINDING SITE I, BINDING SITE II or BINDING SITE III. Table 2 illustrates the complementarity of the nucleotide sequences of DKFZP434O125 BINDING SITE, designated SEQ ID:32407, to the nucleotide sequence of VGAM1929 RNA, herein designated VGAM RNA, also designated SEQ ID:4640.

Another function of VGAM1929 is therefore inhibition of DKFZP434O125 (Accession XM_036284). Accordingly, utilities of VGAM1929 include diagnosis, prevention and treatment of diseases and clinical conditions associated with DKFZP434O125. DKFZp547I224 (Accession NM_020221) is another VGAM1929 host target gene. DKFZp547I224 BINDING SITE is HOST TARGET binding site found in the 5' untranslated region of mRNA encoded by DKFZp547I224, corresponding to a HOST TARGET binding site such as BINDING SITE I, BINDING SITE II or BINDING SITE III. Table 2 illustrates the complementarity of the nucleotide sequences of DKFZp547I224 BINDING SITE, designated SEQ ID:21477, to the nucleotide sequence of VGAM1929 RNA, herein designated VGAM RNA, also designated SEQ ID:4640.

Another function of VGAM1929 is therefore inhibition of DKFZp547I224 (Accession NM_020221). Accordingly, utilities of VGAM1929 include diagnosis, prevention and treatment of diseases and clinical conditions associated with DKFZp547I224. DKFZP564I0422 (Accession NM_031435) is another VGAM1929 host target gene. DKFZP564I0422 BINDING SITE is HOST TARGET binding site found in the 3' untranslated region of mRNA encoded by DKFZP564I0422, corresponding to a HOST TARGET binding site such as BINDING SITE I, BINDING SITE II or BINDING SITE III. Table 2 illustrates the complementarity of the nucleotide sequences of DKFZP564I0422 BINDING SITE, designated SEQ ID:25434, to the nucleotide sequence of VGAM1929 RNA, herein designated VGAM RNA, also designated SEQ ID:4640.

Another function of VGAM1929 is therefore inhibition of DKFZP564I0422 (Accession NM_031435). Accordingly, utilities of VGAM1929 include diagnosis, prevention and treatment of diseases and clinical conditions associated with DKFZP564I0422. DKFZP564L2423 (Accession XM_031015) is another VGAM1929 host target gene. DKFZP564L2423 BINDING SITE is HOST TARGET binding site found in the 3' untranslated region of mRNA encoded by DKFZP564L2423, corresponding to a HOST TARGET binding site such as BINDING SITE I, BINDING SITE II or BINDING SITE III. Table 2 illustrates the complementarity of the nucleotide sequences of DKFZP564L2423 BINDING SITE, designated SEQ ID:31259, to the nucleotide sequence of VGAM1929 RNA, herein designated VGAM RNA, also designated SEQ ID:4640.

Another function of VGAM1929 is therefore inhibition of DKFZP564L2423 (Accession XM_031015). Accordingly, utilities of VGAM1929 include diagnosis, prevention and treatment of diseases and clinical conditions associated with DKFZP564L2423. DKFZP564O0823 (Accession XM_003517) is another VGAM1929 host target gene. DKFZP564O0823 BINDING SITE is HOST TARGET binding site found in the 3' untranslated region of mRNA encoded by DKFZP564O0823, corresponding to a HOST TARGET binding site such as BINDING SITE I, BINDING SITE II or BINDING SITE III. Table 2 illustrates the complementarity of the nucleotide sequences of DKFZP564O0823 BINDING SITE, designated SEQ ID:29938, to the nucleotide sequence of VGAM1929 RNA, herein designated VGAM RNA, also designated SEQ ID:4640.

Another function of VGAM1929 is therefore inhibition of DKFZP564O0823 (Accession XM_003517). Accordingly, utilities of VGAM1929 include diagnosis, prevention and treatment of diseases and clinical conditions associated with DKFZP564O0823. DKFZp566H0824 (Accession NM_017535) is another VGAM1929 host target gene. DKFZp566H0824 BINDING SITE is HOST TARGET binding site found in the 5' untranslated region of mRNA encoded by DKFZp566H0824, corresponding to a HOST TARGET binding site such as BINDING SITE I, BINDING SITE II or BINDING SITE III. Table 2 illustrates the complementarity of the nucleotide sequences of DKFZp566H0824 BINDING SITE, designated SEQ ID:18979, to the nucleotide sequence of VGAM1929 RNA, herein designated VGAM RNA, also designated SEQ ID:4640.

Another function of VGAM1929 is therefore inhibition of DKFZp566H0824 (Accession NM_017535). Accordingly, utilities of VGAM1929 include diagnosis, prevention and treatment of diseases and clinical conditions associated with DKFZp566H0824. DKFZP727C091 (Accession XM_038689) is another VGAM1929 host target gene. DKFZP727C091 BINDING SITE is HOST TARGET binding site found in the 3' untranslated region of mRNA encoded by DKFZP727C091, corresponding to a HOST TARGET binding site such as BINDING SITE I, BINDING SITE II or BINDING SITE III. Table 2 illustrates the complementarity of the nucleotide sequences of DKFZP727C091 BINDING SITE, designated SEQ ID:32905, to the nucleotide sequence of VGAM1929 RNA, herein designated VGAM RNA, also designated SEQ ID:4640.

Another function of VGAM1929 is therefore inhibition of DKFZP727C091 (Accession XM_038689). Accordingly, utilities of VGAM1929 include diagnosis, prevention and treatment of diseases and clinical conditions associated with DKFZP727C091. DKFZp761D0614 (Accession XM_113634) is another VGAM1929 host target gene. DKFZp761D0614 BINDING SITE is HOST TARGET binding site found in the 3' untranslated region of mRNA encoded by DKFZp761D0614, corresponding to a HOST TARGET binding site such as BINDING SITE I, BINDING SITE II or BINDING SITE III. Table 2 illustrates the complementarity of the nucleotide sequences of DKFZp761D0614 BINDING SITE, designated SEQ ID:42310, to the nucleotide sequence of VGAM1929 RNA, herein designated VGAM RNA, also designated SEQ ID:4640.

Another function of VGAM1929 is therefore inhibition of DKFZp761D0614 (Accession XM_113634). Accordingly, utilities of VGAM1929 include diagnosis, prevention and treatment of diseases and clinical conditions associated with DKFZp761D0614. DKFZP761F241 (Accession NM_031455) is another VGAM1929 host target gene. DKFZP761F241 BINDING SITE is HOST TARGET binding site found in the 3' untranslated region of mRNA encoded by DKFZP761F241, corresponding to a HOST TARGET binding site such as BINDING SITE I, BINDING SITE II or BINDING SITE III. Table 2 illustrates the complementarity of the nucleotide sequences of DKFZP761F241 BINDING SITE, designated SEQ ID:25478, to the nucleotide sequence of VGAM1929 RNA, herein designated VGAM RNA, also designated SEQ ID:4640.

Another function of VGAM1929 is therefore inhibition of DKFZP761F241 (Accession NM_031455). Accordingly, utilities of VGAM1929 include diagnosis, prevention and treatment of diseases and clinical conditions associated with DKFZP761F241. DnaJ (Hsp40) Homolog, Subfamily A, Member 4 (DNAJA4, Accession NM_018602) is another VGAM1929 host target gene. DNAJA4 BINDING SITE is HOST TARGET binding site found in the 3' untranslated region of mRNA encoded by DNAJA4, corresponding to a HOST TARGET binding site such as BINDING SITE I, BINDING SITE II or BINDING SITE III. Table 2 illustrates the complementarity of the nucleotide sequences of DNAJA4 BINDING SITE, designated SEQ ID:20679, to the nucleotide sequence of VGAM1929 RNA, herein designated VGAM RNA, also designated SEQ ID:4640.

Another function of VGAM1929 is therefore inhibition of DnaJ (Hsp40) Homolog, Subfamily A, Member 4 (DNAJA4, Accession NM_018602). Accordingly, utilities of VGAM1929 include diagnosis, prevention and treatment of diseases and clinical conditions associated with DNAJA4. DnaJ (Hsp40) Homolog, Subfamily C, Member 6 (DNAJC6, Accession NM_014787) is another VGAM1929 host target gene. DNAJC6 BINDING SITE is HOST TARGET binding site found in the 3' untranslated region of mRNA encoded by DNAJC6, corresponding to a HOST TARGET binding site such as BINDING SITE I, BINDING SITE II or BINDING SITE III. Table 2 illustrates the complementarity of the nucleotide sequences of DNAJC6 BINDING SITE, designated SEQ ID:16663, to the nucleotide sequence of VGAM1929 RNA, herein designated VGAM RNA, also designated SEQ ID:4640.

Another function of VGAM1929 is therefore inhibition of DnaJ (Hsp40) Homolog, Subfamily C, Member 6 (DNAJC6, Accession NM_014787). Accordingly, utilities of VGAM1929 include diagnosis, prevention and treatment of diseases and clinical conditions associated with DNAJC6. Dual Specificity Phosphatase 9 (DUSP9, Accession NM_001395) is another VGAM1929 host target gene. DUSP9 BINDING SITE is HOST TARGET binding site found in the 3' untranslated region of mRNA encoded by DUSP9, corresponding to a HOST TARGET binding site such as BINDING SITE I, BINDING SITE II or BINDING SITE III. Table 2 illustrates the complementarity of the nucleotide sequences of DUSP9 BINDING SITE, designated SEQ ID:7091, to the nucleotide sequence of VGAM1929 RNA, herein designated VGAM RNA, also designated SEQ ID:4640.

Another function of VGAM1929 is therefore inhibition of Dual Specificity Phosphatase 9 (DUSP9, Accession NM_001395). Accordingly, utilities of VGAM1929 include diagnosis, prevention and treatment of diseases and clinical conditions associated with DUSP9. Eukaryotic Translation Initiation Factor 5 (EIF5, Accession NM_001969) is another VGAM1929 host target gene. EIF5 BINDING SITE is HOST TARGET binding site found in the 3' untranslated region of mRNA encoded by EIF5, corresponding to a HOST TARGET binding site such as BINDING SITE I, BINDING SITE II or BINDING SITE III. Table 2 illustrates the complementarity of the nucleotide sequences of EIF5 BINDING SITE, designated SEQ ID:7702, to the nucleotide sequence of VGAM1929 RNA, herein designated VGAM RNA, also designated SEQ ID:4640.

Another function of VGAM1929 is therefore inhibition of Eukaryotic Translation Initiation Factor 5 (EIF5, Accession NM_001969). Accordingly, utilities of VGAM1929 include diagnosis, prevention and treatment of diseases and clinical conditions associated with EIF5. ElaC Homolog 1 (E. coli) (ELAC1, Accession XM_165659) is another VGAM1929 host target gene. ELAC1 BINDING SITE is HOST TARGET binding site found in the 3' untranslated region of mRNA encoded by ELAC1, corresponding to a HOST TARGET binding site such as BINDING SITE I, BINDING SITE II or BINDING SITE III. Table 2 illustrates the complementarity of the nucleotide sequences of ELAC1 BINDING SITE, designated SEQ ID:43723, to the nucleotide sequence of VGAM1929 RNA, herein designated VGAM RNA, also designated SEQ ID:4640.

Another function of VGAM1929 is therefore inhibition of ElaC Homolog 1 (E. coli) (ELAC1, Accession XM_165659). Accordingly, utilities of VGAM1929 include diagnosis, prevention and treatment of diseases and clinical conditions associated with ELAC1. E74-like Factor 4 (ets domain transcription factor) (ELF4, Accession NM_001421) is another VGAM1929 host target gene. ELF4 BINDING SITE is HOST TARGET binding site found in the 3' untranslated region of mRNA encoded by ELF4, corresponding to a HOST TARGET binding site such as BINDING SITE I, BINDING SITE II or BINDING SITE III. Table 2 illustrates the complementarity of the nucleotide sequences of ELF4 BINDING SITE, designated SEQ ID:7128, to the nucleotide sequence of VGAM1929 RNA, herein designated VGAM RNA, also designated SEQ ID:4640.

Another function of VGAM1929 is therefore inhibition of E74-like Factor 4 (ets domain transcription factor) (ELF4, Accession NM_001421). Accordingly, utilities of VGAM1929 include diagnosis, prevention and treatment of diseases and clinical conditions associated with ELF4. ESDN (Accession NM_080927) is another VGAM1929 host target gene. ESDN BINDING SITE is HOST TARGET binding site found in the 3' untranslated region of mRNA encoded by ESDN, corresponding to a HOST TARGET binding site such as BINDING SITE I, BINDING SITE II or BINDING SITE III. Table 2 illustrates the complementarity of the nucleotide sequences of ESDN BINDING SITE, designated SEQ ID:28152, to the nucleotide sequence of VGAM1929 RNA, herein designated VGAM RNA, also designated SEQ ID:4640.

Another function of VGAM1929 is therefore inhibition of ESDN (Accession NM_080927). Accordingly, utilities of VGAM1929 include diagnosis, prevention and treatment of diseases and clinical conditions associated with ESDN. Ecotropic Viral Integration Site 5 (EVI5, Accession NM_005665) is another VGAM1929 host target gene. EVI5 BINDING SITE is HOST TARGET binding site found in the 3' untranslated region of mRNA encoded by EVI5, corresponding to a HOST TARGET binding site such as BINDING SITE I, BINDING SITE II or BINDING SITE III. Table 2 illustrates the complementarity of the nucleotide sequences of EVI5 BINDING SITE, designated SEQ ID:12209, to the nucleotide sequence of VGAM1929 RNA, herein designated VGAM RNA, also designated SEQ ID:4640.

Another function of VGAM1929 is therefore inhibition of Ecotropic Viral Integration Site 5 (EVI5, Accession NM_005665). Accordingly, utilities of VGAM1929 include diagnosis, prevention and treatment of diseases and clinical conditions associated with EVI5. FLJ10292 (Accession NM_018048) is another VGAM1929 host target gene. FLJ10292 BINDING SITE is HOST TARGET binding site found in the 3' untranslated region of mRNA encoded by FLJ10292, corresponding to a HOST TARGET binding site such as BINDING SITE I, BINDING SITE II or BINDING SITE III. Table 2 illustrates the complementarity of the nucleotide sequences of FLJ10292 BINDING SITE, designated SEQ ID:19803, to the nucleotide sequence of VGAM1929 RNA, herein designated VGAM RNA, also designated SEQ ID:4640.

Another function of VGAM1929 is therefore inhibition of FLJ10292 (Accession NM_018048). Accordingly, utilities of VGAM1929 include diagnosis, prevention and treatment of diseases and clinical conditions associated with FLJ10292. FLJ10493 (Accession NM_018112) is another VGAM1929 host target gene. FLJ10493 BINDING SITE is HOST TARGET binding site found in the 3' untranslated region of mRNA encoded by FLJ10493, corresponding to a HOST TARGET binding site such as BINDING SITE I, BINDING SITE II or BINDING SITE III. Table 2 illustrates the complementarity of the nucleotide sequences of FLJ10493 BINDING SITE, designated SEQ ID:19885, to the nucleotide sequence of VGAM1929 RNA, herein designated VGAM RNA, also designated SEQ ID:4640.

Another function of VGAM1929 is therefore inhibition of FLJ10493 (Accession NM_018112). Accordingly, utilities of VGAM1929 include diagnosis, prevention and treatment of diseases and clinical conditions associated with FLJ10493. FLJ10546 (Accession XM_002989) is another VGAM1929 host target gene. FLJ10546 BINDING SITE is HOST TARGET binding site found in the 3' untranslated region of mRNA encoded by FLJ10546, corresponding to a HOST TARGET binding site such as BINDING SITE I, BINDING SITE II or BINDING SITE III. Table 2 illustrates the complementarity of the nucleotide sequences of FLJ10546 BINDING SITE, designated SEQ ID:29913, to the nucleotide sequence of VGAM1929 RNA, herein designated VGAM RNA, also designated SEQ ID:4640.

Another function of VGAM1929 is therefore inhibition of FLJ10546 (Accession XM_002989). Accordingly, utilities of VGAM1929 include diagnosis, prevention and treatment of diseases and clinical conditions associated with FLJ10546. FLJ10726 (Accession NM_018195) is another VGAM1929 host target gene. FLJ10726 BINDING SITE is HOST TARGET binding site found in the 3' untranslated region of mRNA encoded by FLJ10726, corresponding to a HOST TARGET binding site such as BINDING SITE I, BINDING SITE II or BINDING SITE III. Table 2 illustrates the complementarity of the nucleotide sequences of FLJ10726 BINDING SITE, designated SEQ ID:20061, to the nucleotide sequence of VGAM1929 RNA, herein designated VGAM RNA, also designated SEQ ID:4640.

Another function of VGAM1929 is therefore inhibition of FLJ10726 (Accession NM_018195). Accordingly, utilities of VGAM1929 include diagnosis, prevention and treatment of diseases and clinical conditions associated with FLJ10726. FLJ10803 (Accession NM_018224) is another VGAM1929 host target gene. FLJ10803 BINDING SITE is HOST TARGET binding site found in the 3' untranslated region of mRNA encoded by FLJ10803, corresponding to a HOST TARGET binding site such as BINDING SITE I, BINDING SITE II or BINDING SITE III. Table 2 illustrates the complementarity of the nucleotide sequences of FLJ10803 BINDING SITE, designated SEQ ID:20154, to the nucleotide sequence of VGAM1929 RNA, herein designated VGAM RNA, also designated SEQ ID:4640.

Another function of VGAM1929 is therefore inhibition of FLJ10803 (Accession NM_018224). Accordingly, utilities of VGAM1929 include diagnosis, prevention and treatment of diseases and clinical conditions associated with FLJ10803. FLJ10852 (Accession NM_019028) is another VGAM1929 host target gene. FLJ10852 BINDING SITE is HOST TARGET binding site found in the 3' untranslated region of mRNA encoded by FLJ10852, corresponding to a HOST TARGET binding site such as BINDING SITE I, BINDING SITE II or BINDING SITE III. Table 2 illustrates the complementarity of the nucleotide sequences of FLJ10852 BINDING SITE, designated SEQ ID:21119, to the nucleotide sequence of VGAM1929 RNA, herein designated VGAM RNA, also designated SEQ ID:4640.

Another function of VGAM1929 is therefore inhibition of FLJ10852 (Accession NM_019028). Accordingly, utilities of VGAM1929 include diagnosis, prevention and treatment of diseases and clinical conditions associated with FLJ10852. FLJ10996 (Accession NM_019044) is another VGAM1929 host target gene. FLJ10996 BINDING SITE is HOST TARGET binding site found in the 3' untranslated region of mRNA encoded by FLJ10996, corresponding to a HOST TARGET binding site such as BINDING SITE I, BINDING SITE II or BINDING SITE III. Table 2 illustrates the complementarity of the nucleotide sequences of FLJ10996 BINDING SITE, designated SEQ ID:21128, to the nucleotide sequence of VGAM1929 RNA, herein designated VGAM RNA, also designated SEQ ID:4640.

Another function of VGAM1929 is therefore inhibition of FLJ10996 (Accession NM_019044). Accordingly, utilities of VGAM1929 include diagnosis, prevention and treatment of diseases and clinical conditions associated with FLJ10996. FLJ11184 (Accession NM_018352) is another VGAM1929 host target gene. FLJ11184 BINDING SITE is HOST TARGET binding site found in the 3' untranslated region of mRNA encoded by FLJ11184, corresponding to a HOST TARGET binding site such as BINDING SITE I, BINDING SITE II or BINDING SITE III. Table 2 illustrates the complementarity of the nucleotide sequences of FLJ11184 BINDING SITE, designated SEQ ID:20365, to the nucleotide sequence of VGAM1929 RNA, herein designated VGAM RNA, also designated SEQ ID:4640.

Another function of VGAM1929 is therefore inhibition of FLJ11184 (Accession NM_018352). Accordingly, utilities of VGAM1929 include diagnosis, prevention and treatment of diseases and clinical conditions associated with FLJ11184. FLJ12154 (Accession NM_021944) is another VGAM1929 host target gene. FLJ12154 BINDING SITE is HOST TARGET binding site found in the 5' untranslated region of mRNA encoded by FLJ12154, corresponding to a HOST TARGET binding site such as BINDING SITE I, BINDING SITE II or BINDING SITE III. Table 2 illustrates the complementarity of the nucleotide sequences of FLJ12154 BINDING SITE, designated SEQ ID:22464, to the nucleotide sequence of VGAM1929 RNA, herein designated VGAM RNA, also designated SEQ ID:4640.

Another function of VGAM1929 is therefore inhibition of FLJ12154 (Accession NM_021944). Accordingly, utilities of VGAM1929 include diagnosis, prevention and treatment of diseases and clinical conditions associated with FLJ12154. FLJ12425 (Accession XM_098290) is another VGAM1929 host target gene. FLJ12425 BINDING SITE is HOST TARGET binding site found in the 3' untranslated region of mRNA encoded by FLJ12425, corresponding to a HOST TARGET binding site such as BINDING SITE I, BINDING SITE II or BINDING SITE III. Table 2 illustrates the complementarity of the nucleotide sequences of FLJ12425 BINDING SITE, designated SEQ ID:41565, to the nucleotide sequence of VGAM1929 RNA, herein designated VGAM RNA, also designated SEQ ID:4640.

Another function of VGAM1929 is therefore inhibition of FLJ12425 (Accession XM_098290). Accordingly, utilities of VGAM1929 include diagnosis, prevention and treatment of diseases and clinical conditions associated with FLJ12425. FLJ12443 (Accession NM_024830) is another VGAM1929 host target gene. FLJ12443 BINDING SITE is HOST TARGET binding site found in the 3' untranslated region of mRNA encoded by FLJ12443, corresponding to a HOST TARGET binding site such as BINDING SITE I, BINDING SITE II or BINDING SITE III. Table 2 illustrates the complementarity of the nucleotide sequences of FLJ12443 BINDING SITE, designated SEQ ID:24226, to the nucleotide sequence of VGAM1929 RNA, herein designated VGAM RNA, also designated SEQ ID:4640.

Another function of VGAM1929 is therefore inhibition of FLJ12443 (Accession NM_024830). Accordingly, utilities of VGAM1929 include diagnosis, prevention and treatment of diseases and clinical conditions associated with FLJ12443. FLJ12581 (Accession NM_024865) is another VGAM1929 host target gene. FLJ12581 BINDING SITE is HOST TARGET binding site found in the 5' untranslated region of mRNA encoded by FLJ12581, corresponding to a HOST TARGET binding site such as BINDING SITE I, BINDING SITE II or BINDING SITE III. Table 2 illustrates the complementarity of the nucleotide sequences of FLJ12581 BINDING SITE, designated SEQ ID:24302, to the nucleotide sequence of VGAM1929 RNA, herein designated VGAM RNA, also designated SEQ ID:4640.

Another function of VGAM1929 is therefore inhibition of FLJ12581 (Accession NM_024865). Accordingly, utilities of VGAM1929 include diagnosis, prevention and treatment of diseases and clinical conditions associated with FLJ12581. FLJ12770 (Accession NM_032174) is another VGAM1929 host target gene. FLJ12770 BINDING SITE is HOST TARGET binding site found in the 3' untranslated region of mRNA encoded by FLJ12770, corresponding to a HOST TARGET binding site such as BINDING SITE I, BINDING SITE II or BINDING SITE III. Table 2 illustrates the complementarity of the nucleotide sequences of FLJ12770 BINDING SITE, designated SEQ ID:25888, to the nucleotide sequence of VGAM1929 RNA, herein designated VGAM RNA, also designated SEQ ID:4640.

Another function of VGAM1929 is therefore inhibition of FLJ12770 (Accession NM_032174). Accordingly, utilities of VGAM1929 include diagnosis, prevention and treatment of diseases and clinical conditions associated with FLJ12770. FLJ12895 (Accession NM_023926) is another VGAM1929 host target gene. FLJ12895 BINDING SITE is HOST TARGET binding site found in the 3' untranslated region of mRNA encoded by FLJ12895, corresponding to a HOST TARGET binding site such as BINDING SITE I, BINDING SITE II or BINDING SITE III. Table 2 illustrates the complementarity of the nucleotide sequences of FLJ12895 BINDING SITE, designated SEQ ID:23406, to the nucleotide sequence of VGAM1929 RNA, herein designated VGAM RNA, also designated SEQ ID:4640.

Another function of VGAM1929 is therefore inhibition of FLJ12895 (Accession NM_023926). Accordingly, utilities of VGAM1929 include diagnosis, prevention and treatment of diseases and clinical conditions associated with FLJ12895. FLJ12903 (Accession NM_022753) is another VGAM1929 host target gene. FLJ12903 BINDING SITE is HOST TARGET binding site found in the 3' untranslated region of mRNA encoded by FLJ12903, corresponding to a HOST TARGET binding site such as BINDING SITE I, BINDING SITE II or BINDING SITE III. Table 2 illustrates the complementarity of the nucleotide sequences of FLJ12903 BINDING SITE, designated SEQ ID:22981, to the nucleotide sequence of VGAM1929 RNA, herein designated VGAM RNA, also designated SEQ ID:4640.

Another function of VGAM1929 is therefore inhibition of FLJ12903 (Accession NM_022753). Accordingly, utilities of VGAM1929 include diagnosis, prevention and treatment of diseases and clinical conditions associated with FLJ12903. FLJ13213 (Accession NM_024755) is another VGAM1929 host target gene. FLJ13213 BINDING SITE is HOST TARGET binding site found in the 3' untranslated region of mRNA encoded by FLJ13213, corresponding to a HOST TARGET binding site such as BINDING SITE I, BINDING SITE II or BINDING SITE III. Table 2 illustrates the complementarity of the nucleotide sequences of FLJ13213 BINDING SITE, designated SEQ ID:24100, to the nucleotide sequence of VGAM1929 RNA, herein designated VGAM RNA, also designated SEQ ID:4640.

Another function of VGAM1929 is therefore inhibition of FLJ13213 (Accession NM_024755). Accordingly, utilities of VGAM1929 include diagnosis, prevention and treatment of diseases and clinical conditions associated with FLJ13213. FLJ13315 (Accession NM_025005) is another VGAM1929 host target gene. FLJ13315 BINDING SITE is HOST TARGET binding site found in the 3' untranslated region of mRNA encoded by FLJ13315, corresponding to a HOST TARGET binding site such as BINDING SITE I, BINDING SITE II or BINDING SITE III. Table 2 illustrates the complementarity of the nucleotide sequences of FLJ13315 BINDING SITE, designated SEQ ID:24578, to the nucleotide sequence of VGAM1929 RNA, herein designated VGAM RNA, also designated SEQ ID:4640.

Another function of VGAM1929 is therefore inhibition of FLJ13315 (Accession NM_025005). Accordingly, utilities of VGAM1929 include diagnosis, prevention and treatment of diseases and clinical conditions associated with FLJ13315. FLJ13646 (Accession NM_024584) is another VGAM1929 host target gene. FLJ13646 BINDING SITE is HOST TARGET binding site found in the 3' untranslated region of mRNA encoded by FLJ13646, corresponding to a HOST TARGET binding site such as BINDING SITE I, BINDING SITE II or BINDING SITE III. Table 2 illustrates the complementarity of the nucleotide sequences of FLJ13646 BINDING SITE, designated SEQ ID:23817, to the nucleotide sequence of VGAM1929 RNA, herein designated VGAM RNA, also designated SEQ ID:4640.

Another function of VGAM1929 is therefore inhibition of FLJ13646 (Accession NM_024584). Accordingly, utilities of VGAM1929 include diagnosis, prevention and treatment of diseases and clinical conditions associated with FLJ13646. FLJ13842 (Accession NM_024645) is another VGAM1929 host target gene. FLJ13842 BINDING SITE is HOST TARGET binding site found in the 3' untranslated region of mRNA encoded by FLJ13842, corresponding to a HOST TARGET binding site such as BINDING SITE I, BINDING SITE II or BINDING SITE III. Table 2 illustrates the complementarity of the nucleotide sequences of FLJ13842 BINDING SITE, designated SEQ ID:23931, to the nucleotide sequence of VGAM1929 RNA, herein designated VGAM RNA, also designated SEQ ID:4640.

Another function of VGAM1929 is therefore inhibition of FLJ13842 (Accession NM_024645). Accordingly, utilities of VGAM1929 include diagnosis, prevention and treatment of diseases and clinical conditions associated with FLJ13842. FLJ14466 (Accession NM_032790) is another VGAM1929 host target gene. FLJ14466 BINDING SITE is HOST TARGET binding site found in the 3' untranslated region of mRNA encoded by FLJ14466, corresponding to a HOST TARGET binding site such as BINDING SITE I, BINDING SITE II or BINDING SITE III. Table 2 illustrates the complementarity of the nucleotide sequences of FLJ14466 BINDING SITE, designated SEQ ID:26544, to the nucleotide sequence of VGAM1929 RNA, herein designated VGAM RNA, also designated SEQ ID:4640.

Another function of VGAM1929 is therefore inhibition of FLJ14466 (Accession NM_032790). Accordingly, utilities of VGAM1929 include diagnosis, prevention and treatment of diseases and clinical conditions associated with FLJ14466. FLJ14564 (Accession XM_084459) is another VGAM1929 host target gene. FLJ14564 BINDING SITE is HOST TARGET binding site found in the 3' untranslated region of mRNA encoded by FLJ14564, corresponding to a HOST TARGET binding site such as BINDING SITE I, BINDING SITE II or BINDING SITE III. Table 2 illustrates the complementarity of the nucleotide sequences of FLJ14564 BINDING SITE, designated SEQ ID:37597, to the nucleotide sequence of VGAM1929 RNA, herein designated VGAM RNA, also designated SEQ ID:4640.

Another function of VGAM1929 is therefore inhibition of FLJ14564 (Accession XM_084459). Accordingly, utilities of VGAM1929 include diagnosis, prevention and treatment of diseases and clinical conditions associated with FLJ14564. FLJ14621 (Accession NM_032811) is another VGAM1929 host target gene. FLJ14621 BINDING SITE is HOST TARGET binding site found in the 3' untranslated region of mRNA encoded by FLJ14621, corresponding to a HOST TARGET binding site such as BINDING SITE I, BINDING SITE II or BINDING SITE III. Table 2 illustrates the complementarity of the nucleotide sequences of FLJ14621 BINDING SITE, designated SEQ ID:26583, to the nucleotide sequence of VGAM1929 RNA, herein designated VGAM RNA, also designated SEQ ID:4640.

Another function of VGAM1929 is therefore inhibition of FLJ14621 (Accession NM_032811). Accordingly, utilities of VGAM1929 include diagnosis, prevention and treatment of diseases and clinical conditions associated with FLJ14621. FLJ20232 (Accession NM_019008) is another VGAM1929 host target gene. FLJ20232 BINDING SITE is HOST TAR- GET binding site found in the 3' untranslated region of mRNA encoded by FLJ20232, corresponding to a HOST TARGET binding site such as BINDING SITE I, BINDING SITE II or BINDING SITE III. Table 2 illustrates the complementarity of the nucleotide sequences of FLJ20232 BINDING SITE, designated SEQ ID:21084, to the nucleotide sequence of VGAM1929 RNA, herein designated VGAM RNA, also designated SEQ ID:4640.

Another function of VGAM1929 is therefore inhibition of FLJ20232 (Accession NM_019008). Accordingly, utilities of VGAM1929 include diagnosis, prevention and treatment of diseases and clinical conditions associated with FLJ20232. FLJ20273 (Accession NM_019027) is another VGAM1929 host target gene. FLJ20273 BINDING SITE is HOST TARGET binding site found in the 3' untranslated region of mRNA encoded by FLJ20273, corresponding to a HOST TARGET binding site such as BINDING SITE I, BINDING SITE II or BINDING SITE III. Table 2 illustrates the complementarity of the nucleotide sequences of FLJ20273 BINDING SITE, designated SEQ ID:21116, to the nucleotide sequence of VGAM1929 RNA, herein designated VGAM RNA, also designated SEQ ID:4640.

Another function of VGAM1929 is therefore inhibition of FLJ20273 (Accession NM_019027). Accordingly, utilities of VGAM1929 include diagnosis, prevention and treatment of diseases and clinical conditions associated with FLJ20273. FLJ20337 (Accession NM_017772) is another VGAM1929 host target gene. FLJ20337 BINDING SITE is HOST TARGET binding site found in the 3' untranslated region of mRNA encoded by FLJ20337, corresponding to a HOST TARGET binding site such as BINDING SITE I, BINDING SITE II or BINDING SITE III. Table 2 illustrates the complementarity of the nucleotide sequences of FLJ20337 BINDING SITE, designated SEQ ID:19393, to the nucleotide sequence of VGAM1929 RNA, herein designated VGAM RNA, also designated SEQ ID:4640.

Another function of VGAM1929 is therefore inhibition of FLJ20337 (Accession NM_017772). Accordingly, utilities of VGAM1929 include diagnosis, prevention and treatment of diseases and clinical conditions associated with FLJ20337. FLJ20508 (Accession NM_017850) is another VGAM1929 host target gene. FLJ20508 BINDING SITE is HOST TARGET binding site found in the 5' untranslated region of mRNA encoded by FLJ20508, corresponding to a HOST TARGET binding site such as BINDING SITE I, BINDING SITE II or BINDING SITE III. Table 2 illustrates the complementarity of the nucleotide sequences of FLJ20508 BINDING SITE, designated SEQ ID:19520, to the nucleotide sequence of VGAM1929 RNA, herein designated VGAM RNA, also designated SEQ ID:4640.

Another function of VGAM1929 is therefore inhibition of FLJ20508 (Accession NM_017850). Accordingly, utilities of VGAM1929 include diagnosis, prevention and treatment of diseases and clinical conditions associated with FLJ20508. FLJ20509 (Accession NM_017851) is another VGAM1929 host target gene. FLJ20509 BINDING SITE is HOST TARGET binding site found in the 3' untranslated region of mRNA encoded by FLJ20509, corresponding to a HOST TARGET binding site such as BINDING SITE I, BINDING SITE II or BINDING SITE III. Table 2 illustrates the complementarity of the nucleotide sequences of FLJ20509 BINDING SITE, designated SEQ ID:19524, to the nucleotide sequence of VGAM1929 RNA, herein designated VGAM RNA, also designated SEQ ID:4640.

Another function of VGAM1929 is therefore inhibition of FLJ20509 (Accession NM_017851). Accordingly, utilities of VGAM1929 include diagnosis, prevention and treatment of diseases and clinical conditions associated with FLJ20509. FLJ20542 (Accession NM_032179) is another VGAM1929 host target gene. FLJ20542 BINDING SITE is HOST TARGET binding site found in the 3' untranslated region of mRNA encoded by FLJ20542, corresponding to a HOST TARGET binding site such as BINDING SITE I, BINDING SITE II or BINDING SITE III. Table 2 illustrates the complementarity of the nucleotide sequences of FLJ20542 BINDING SITE, designated SEQ ID:25893, to the nucleotide sequence of VGAM1929 RNA, herein designated VGAM RNA, also designated SEQ ID:4640.

Another function of VGAM1929 is therefore inhibition of FLJ20542 (Accession NM_032179). Accordingly, utilities of VGAM1929 include diagnosis, prevention and treatment of diseases and clinical conditions associated with FLJ20542. FLJ20666 (Accession NM_018333) is another VGAM1929 host target gene. FLJ20666 BINDING SITE is HOST TARGET binding site found in the 3' untranslated region of mRNA encoded by FLJ20666, corresponding to a HOST TARGET binding site such as BINDING SITE I, BINDING SITE II or BINDING SITE III. Table 2 illustrates the complementarity of the nucleotide sequences of FLJ20666 BINDING SITE, designated SEQ ID:20338, to the nucleotide sequence of VGAM1929 RNA, herein designated VGAM RNA, also designated SEQ ID:4640.

Another function of VGAM1929 is therefore inhibition of FLJ20666 (Accession NM_018333). Accordingly, utilities of VGAM1929 include diagnosis, prevention and treatment of diseases and clinical conditions associated with FLJ20666. FLJ20700 (Accession NM_017932) is another VGAM1929 host target gene. FLJ20700 BINDING SITE is HOST TARGET binding site found in the 5' untranslated region of mRNA encoded by FLJ20700, corresponding to a HOST TARGET binding site such as BINDING SITE I, BINDING SITE II or BINDING SITE III. Table 2 illustrates the complementarity of the nucleotide sequences of FLJ20700 BINDING SITE, designated SEQ ID:19620, to the nucleotide sequence of VGAM1929 RNA, herein designated VGAM RNA, also designated SEQ ID:4640.

Another function of VGAM1929 is therefore inhibition of FLJ20700 (Accession NM_017932). Accordingly, utilities of VGAM1929 include diagnosis, prevention and treatment of diseases and clinical conditions associated with FLJ20700. FLJ20793 (Accession XM_166296) is another VGAM1929 host target gene. FLJ20793 BINDING SITE is HOST TARGET binding site found in the 3' untranslated region of mRNA encoded by FLJ20793, corresponding to a HOST TARGET binding site such as BINDING SITE I, BINDING SITE II or BINDING SITE III. Table 2 illustrates the complementarity of the nucleotide sequences of FLJ20793 BINDING SITE, designated SEQ ID:44109, to the nucleotide sequence of VGAM1929 RNA, herein designated VGAM RNA, also designated SEQ ID:4640.

Another function of VGAM1929 is therefore inhibition of FLJ20793 (Accession XM_166296). Accordingly, utilities of VGAM1929 include diagnosis, prevention and treatment of diseases and clinical conditions associated with FLJ20793. FLJ20972 (Accession NM_025030) is another VGAM1929 host target gene. FLJ20972 BINDING SITE is HOST TARGET binding site found in the 3' untranslated region of mRNA encoded by FLJ20972, corresponding to a HOST TARGET binding site such as BINDING SITE I, BINDING SITE II or BINDING SITE III. Table 2 illustrates the complementarity of the nucleotide sequences of FLJ20972 BINDING SITE, designated SEQ ID:24626, to the nucleotide sequence of VGAM1929 RNA, herein designated VGAM RNA, also designated SEQ ID:4640.

Another function of VGAM1929 is therefore inhibition of FLJ20972 (Accession NM_025030). Accordingly, utilities of VGAM1929 include diagnosis, prevention and treatment of diseases and clinical conditions associated with FLJ20972.

FLJ21032 (Accession NM_024906) is another VGAM1929 host target gene. FLJ21032 BINDING SITE is HOST TARGET binding site found in the 3' untranslated region of mRNA encoded by FLJ21032, corresponding to a HOST TARGET binding site such as BINDING SITE I, BINDING SITE II or BINDING SITE III. Table 2 illustrates the complementarity of the nucleotide sequences of FLJ21032 BINDING SITE, designated SEQ ID:24400, to the nucleotide sequence of VGAM1929 RNA, herein designated VGAM RNA, also designated SEQ ID:4640.

Another function of VGAM1929 is therefore inhibition of FLJ21032 (Accession NM_024906). Accordingly, utilities of VGAM1929 include diagnosis, prevention and treatment of diseases and clinical conditions associated with FLJ21032.

FLJ21477 (Accession NM_025153) is another VGAM1929 host target gene. FLJ21477 BINDING SITE is HOST TARGET binding site found in the 3' untranslated region of mRNA encoded by FLJ21477, corresponding to a HOST TARGET binding site such as BINDING SITE I, BINDING SITE II or BINDING SITE III. Table 2 illustrates the complementarity of the nucleotide sequences of FLJ21477 BINDING SITE, designated SEQ ID:24790, to the nucleotide sequence of VGAM1929 RNA, herein designated VGAM RNA, also designated SEQ ID:4640.

Another function of VGAM1929 is therefore inhibition of FLJ21477 (Accession NM_025153). Accordingly, utilities of VGAM1929 include diagnosis, prevention and treatment of diseases and clinical conditions associated with FLJ21477.

FLJ21551 (Accession NM_024801) is another VGAM1929 host target gene. FLJ21551 BINDING SITE is HOST TARGET binding site found in the 3' untranslated region of mRNA encoded by FLJ21551, corresponding to a HOST TARGET binding site such as BINDING SITE I, BINDING SITE II or BINDING SITE III. Table 2 illustrates the complementarity of the nucleotide sequences of FLJ21551 BINDING SITE, designated SEQ ID:24179, to the nucleotide sequence of VGAM1929 RNA, herein designated VGAM RNA, also designated SEQ ID:4640.

Another function of VGAM1929 is therefore inhibition of FLJ21551 (Accession NM_024801). Accordingly, utilities of VGAM1929 include diagnosis, prevention and treatment of diseases and clinical conditions associated with FLJ21551.

FLJ21615 (Accession NM_032205) is another VGAM1929 host target gene. FLJ21615 BINDING SITE is HOST TARGET binding site found in the 3' untranslated region of mRNA encoded by FLJ21615, corresponding to a HOST TARGET binding site such as BINDING SITE I, BINDING SITE II or BINDING SITE III. Table 2 illustrates the complementarity of the nucleotide sequences of FLJ21615 BINDING SITE, designated SEQ ID:25910, to the nucleotide sequence of VGAM1929 RNA, herein designated VGAM RNA, also designated SEQ ID:4640.

Another function of VGAM1929 is therefore inhibition of FLJ21615 (Accession NM_032205). Accordingly, utilities of VGAM1929 include diagnosis, prevention and treatment of diseases and clinical conditions associated with FLJ21615.

FLJ21777 (Accession NM_032209) is another VGAM1929 host target gene. FLJ21777 BINDING SITE is HOST TARGET binding site found in the 3' untranslated region of mRNA encoded by FLJ21777, corresponding to a HOST TARGET binding site such as BINDING SITE I, BINDING SITE II or BINDING SITE III. Table 2 illustrates the complementarity of the nucleotide sequences of FLJ21777 BINDING SITE, designated SEQ ID:25925, to the nucleotide sequence of VGAM1929 RNA, herein designated VGAM RNA, also designated SEQ ID:4640.

Another function of VGAM1929 is therefore inhibition of FLJ21777 (Accession NM_032209). Accordingly, utilities of VGAM1929 include diagnosis, prevention and treatment of diseases and clinical conditions associated with FLJ21777.

FLJ22028 (Accession NM_024854) is another VGAM1929 host target gene. FLJ22028 BINDING SITE is HOST TARGET binding site found in the 3' untranslated region of mRNA encoded by FLJ22028, corresponding to a HOST TARGET binding site such as BINDING SITE I, BINDING SITE II or BINDING SITE III. Table 2 illustrates the complementarity of the nucleotide sequences of FLJ22028 BINDING SITE, designated SEQ ID:24285, to the nucleotide sequence of VGAM1929 RNA, herein designated VGAM RNA, also designated SEQ ID:4640.

Another function of VGAM1929 is therefore inhibition of FLJ22028 (Accession NM_024854). Accordingly, utilities of VGAM1929 include diagnosis, prevention and treatment of diseases and clinical conditions associated with FLJ22028.

FLJ22055 (Accession NM_024779) is another VGAM1929 host target gene. FLJ22055 BINDING SITE is HOST TARGET binding site found in the 3' untranslated region of mRNA encoded by FLJ22055, corresponding to a HOST TARGET binding site such as BINDING SITE I, BINDING SITE II or BINDING SITE III. Table 2 illustrates the complementarity of the nucleotide sequences of FLJ22055 BINDING SITE, designated SEQ ID:24148, to the nucleotide sequence of VGAM1929 RNA, herein designated VGAM RNA, also designated SEQ ID:4640.

Another function of VGAM1929 is therefore inhibition of FLJ22055 (Accession NM_024779). Accordingly, utilities of VGAM1929 include diagnosis, prevention and treatment of diseases and clinical conditions associated with FLJ22055.

FLJ22169 (Accession NM_024085) is another VGAM1929 host target gene. FLJ22169 BINDING SITE is HOST TARGET binding site found in the 5' untranslated region of mRNA encoded by FLJ22169, corresponding to a HOST TARGET binding site such as BINDING SITE I, BINDING SITE II or BINDING SITE III. Table 2 illustrates the complementarity of the nucleotide sequences of FLJ22169 BINDING SITE, designated SEQ ID:23522, to the nucleotide sequence of VGAM1929 RNA, herein designated VGAM RNA, also designated SEQ ID:4640.

Another function of VGAM1929 is therefore inhibition of FLJ22169 (Accession NM_024085). Accordingly, utilities of VGAM1929 include diagnosis, prevention and treatment of diseases and clinical conditions associated with FLJ22169.

FLJ22724 (Accession NM_024532) is another VGAM1929 host target gene. FLJ22724 BINDING SITE is HOST TARGET binding site found in the 3' untranslated region of mRNA encoded by FLJ22724, corresponding to a HOST TARGET binding site such as BINDING SITE I, BINDING SITE II or BINDING SITE III. Table 2 illustrates the complementarity of the nucleotide sequences of FLJ22724 BINDING SITE, designated SEQ ID:23736, to the nucleotide sequence of VGAM1929 RNA, herein designated VGAM RNA, also designated SEQ ID:4640.

Another function of VGAM1929 is therefore inhibition of FLJ22724 (Accession NM_024532). Accordingly, utilities of VGAM1929 include diagnosis, prevention and treatment of diseases and clinical conditions associated with FLJ22724.

FLJ30058 (Accession NM_144967) is another VGAM1929 host target gene. FLJ30058 BINDING SITE is HOST TARGET binding site found in the 3' untranslated region of mRNA encoded by FLJ30058, corresponding to a HOST TARGET binding site such as BINDING SITE I, BINDING SITE II or BINDING SITE III. Table 2 illustrates the complementarity of the nucleotide sequences of FLJ30058 BINDING SITE, designated SEQ ID:29583, to the nucleotide sequence of VGAM1929 RNA, herein designated VGAM RNA, also designated SEQ ID:4640.

Another function of VGAM1929 is therefore inhibition of FLJ30058 (Accession NM_144967). Accordingly, utilities of VGAM1929 include diagnosis, prevention and treatment of diseases and clinical conditions associated with FLJ30058. Frequenin Homolog (Drosophila) (FREQ, Accession NM_014286) is another VGAM1929 host target gene. FREQ BINDING SITE is HOST TARGET binding site found in the 3' untranslated region of mRNA encoded by FREQ, corresponding to a HOST TARGET binding site such as BINDING SITE I, BINDING SITE II or BINDING SITE III. Table 2 illustrates the complementarity of the nucleotide sequences of FREQ BINDING SITE, designated SEQ ID:15565, to the nucleotide sequence of VGAM1929 RNA, herein designated VGAM RNA, also designated SEQ ID:4640.

Another function of VGAM1929 is therefore inhibition of Frequenin Homolog (Drosophila) (FREQ, Accession NM_014286). Accordingly, utilities of VGAM1929 include diagnosis, prevention and treatment of diseases and clinical conditions associated with FREQ. Far Upstream Element (FUSE) Binding Protein 3 (FUBP3, Accession XM_033327) is another VGAM1929 host target gene. FUBP3 BINDING SITE is HOST TARGET binding site found in the 3' untranslated region of mRNA encoded by FUBP3, corresponding to a HOST TARGET binding site such as BINDING SITE I, BINDING SITE II or BINDING SITE III. Table 2 illustrates the complementarity of the nucleotide sequences of FUBP3 BINDING SITE, designated SEQ ID:31878, to the nucleotide sequence of VGAM1929 RNA, herein designated VGAM RNA, also designated SEQ ID:4640.

Another function of VGAM1929 is therefore inhibition of Far Upstream Element (FUSE) Binding Protein 3 (FUBP3, Accession XM_033327). Accordingly, utilities of VGAM1929 include diagnosis, prevention and treatment of diseases and clinical conditions associated with FUBP3. Fucosyltransferase 10 (alpha (1,3) Fucosyltransferase) (FUT10, Accession NM_032664) is another VGAM1929 host target gene. FUT10 BINDING SITE is HOST TARGET binding site found in the 3' untranslated region of mRNA encoded by FUT10, corresponding to a HOST TARGET binding site such as BINDING SITE I, BINDING SITE II or BINDING SITE III. Table 2 illustrates the complementarity of the nucleotide sequences of FUT10 BINDING SITE, designated SEQ ID:26394, to the nucleotide sequence of VGAM1929 RNA, herein designated VGAM RNA, also designated SEQ ID:4640.

Another function of VGAM1929 is therefore inhibition of Fucosyltransferase 10 (alpha (1,3) Fucosyltransferase) (FUT10, Accession NM_032664). Accordingly, utilities of VGAM1929 include diagnosis, prevention and treatment of diseases and clinical conditions associated with FUT10. G2 (Accession XM_039515) is another VGAM1929 host target gene. G2 BINDING SITE is HOST TARGET binding site found in the 3" untranslated region of mRNA encoded by G2, corresponding to a HOST TARGET binding site such as BINDING SITE I, BINDING SITE II or BINDING SITE III. Table 2 illustrates the complementarity of the nucleotide sequences of G2 BINDING SITE, designated SEQ ID:33111, to the nucleotide sequence of VGAM1929 RNA, herein designated VGAM RNA, also designated SEQ ID:4640.

Another function of VGAM1929 is therefore inhibition of G2 (Accession XM_039515). Accordingly, utilities of VGAM1929 include diagnosis, prevention and treatment of diseases and clinical conditions associated with G2. Golgi Phosphoprotein 3 (coat-protein) (GOLPH3, Accession NM_022130) is another VGAM1929 host target gene. GOLPH3 BINDING SITE is HOST TARGET binding site found in the 3' untranslated region of mRNA encoded by GOLPH3, corresponding to a HOST TARGET binding site such as BINDING SITE I, BINDING SITE II or BINDING SITE III. Table 2 illustrates the complementarity of the nucleotide sequences of GOLPH3 BINDING SITE, designated SEQ ID:22690, to the nucleotide sequence of VGAM1929 RNA, herein designated VGAM RNA, also designated SEQ ID:4640.

Another function of VGAM1929 is therefore inhibition of Golgi Phosphoprotein 3 (coat-protein) (GOLPH3, Accession NM_022130). Accordingly, utilities of VGAM1929 include diagnosis, prevention and treatment of diseases and clinical conditions associated with GOLPH3. G Protein-coupled Receptor 107 (GPR107, Accession NM_020960) is another VGAM1929 host target gene. GPR107 BINDING SITE is HOST TARGET binding site found in the 3' untranslated region of mRNA encoded by GPR107, corresponding to a HOST TARGET binding site such as BINDING SITE I, BINDING SITE II or BINDING SITE III. Table 2 illustrates the complementarity of the nucleotide sequences of GPR107 BINDING SITE, designated SEQ ID:21949, to the nucleotide sequence of VGAM1929 RNA, herein designated VGAM RNA, also designated SEQ ID:4640.

Another function of VGAM1929 is therefore inhibition of G Protein-coupled Receptor 107 (GPR107, Accession NM_020960). Accordingly, utilities of VGAM1929 include diagnosis, prevention and treatment of diseases and clinical conditions associated with GPR107. GS3955 (Accession NM_021643) is another VGAM1929 host target gene. GS3955 BINDING SITE is HOST TARGET binding site found in the 3' untranslated region of mRNA encoded by GS3955, corresponding to a HOST TARGET binding site such as BINDING SITE I, BINDING SITE II or BINDING SITE III. Table 2 illustrates the complementarity of the nucleotide sequences of GS3955 BINDING SITE, designated SEQ ID:22307, to the nucleotide sequence of VGAM1929 RNA, herein designated VGAM RNA, also designated SEQ ID:4640.

Another function of VGAM1929 is therefore inhibition of GS3955 (Accession NM_021643). Accordingly, utilities of VGAM1929 include diagnosis, prevention and treatment of diseases and clinical conditions associated with GS3955. H2AV (Accession NM_138635) is another VGAM1929 host target gene. H2AV BINDING SITE is HOST TARGET binding site found in the 3' untranslated region of mRNA encoded by H2AV, corresponding to a HOST TARGET binding site such as BINDING SITE I, BINDING SITE II or BINDING SITE III. Table 2 illustrates the complementarity of the nucleotide sequences of H2AV BINDING SITE, designated SEQ ID:28910, to the nucleotide sequence of VGAM1929 RNA, herein designated VGAM RNA, also designated SEQ ID:4640.

Another function of VGAM1929 is therefore inhibition of H2AV (Accession NM_138635). Accordingly, utilities of VGAM1929 include diagnosis, prevention and treatment of diseases and clinical conditions associated with H2AV. H326 (Accession NM_015726) is another VGAM1929 host target gene. H326 BINDING SITE is HOST TARGET binding site found in the 3' untranslated region of mRNA encoded by H326, corresponding to a HOST TARGET binding site such as BINDING SITE I, BINDING SITE II or BINDING SITE III. Table 2 illustrates the complementarity of the nucleotide sequences of H326 BINDING SITE, designated SEQ ID:17941, to the nucleotide sequence of VGAM1929 RNA, herein designated VGAM RNA, also designated SEQ ID:4640.

Another function of VGAM1929 is therefore inhibition of H326 (Accession NM_015726). Accordingly, utilities of VGAM1929 include diagnosis, prevention and treatment of diseases and clinical conditions associated with H326. HEMK (Accession NM_016173) is another VGAM1929 host target gene. HEMK BINDING SITE is HOST TARGET binding site found in the 3' untranslated region of mRNA encoded by HEMK, corresponding to a HOST TARGET binding site such as BINDING SITE I, BINDING SITE II or BINDING SITE III. Table 2 illustrates the complementarity of the nucleotide sequences of HEMK BINDING SITE, designated SEQ ID:18268, to the nucleotide sequence of VGAM1929 RNA, herein designated VGAM RNA, also designated SEQ ID:4640.

Another function of VGAM1929 is therefore inhibition of HEMK (Accession NM_016173). Accordingly, utilities of VGAM1929 include diagnosis, prevention and treatment of diseases and clinical conditions associated with HEMK. Heterogeneous Nuclear Ribonucleoprotein A3 (HNRPA3, Accession NM_005758) is another VGAM1929 host target gene. HNRPA3 BINDING SITE is HOST TARGET binding site found in the 3' untranslated region of mRNA encoded by HNRPA3, corresponding to a HOST TARGET binding site such as BINDING SITE I, BINDING SITE II or BINDING SITE III. Table 2 illustrates the complementarity of the nucleotide sequences of HNRPA3 BINDING SITE, designated SEQ ID:12326, to the nucleotide sequence of VGAM1929 RNA, herein designated VGAM RNA, also designated SEQ ID:4640.

Another function of VGAM1929 is therefore inhibition of Heterogeneous Nuclear Ribonucleoprotein A3 (HNRPA3, Accession NM_005758). Accordingly, utilities of VGAM1929 include diagnosis, prevention and treatment of diseases and clinical conditions associated with HNRPA3. HOMER-2B (Accession NM_004839) is another VGAM1929 host target gene. HOMER-2B BINDING SITE is HOST TARGET binding site found in the 3' untranslated region of mRNA encoded by HOMER-2B, corresponding to a HOST TARGET binding site such as BINDING SITE I, BINDING SITE II or BINDING SITE III. Table 2 illustrates the complementarity of the nucleotide sequences of HOMER-2B BINDING SITE, designated SEQ ID:11247, to the nucleotide sequence of VGAM1929 RNA, herein designated VGAM RNA, also designated SEQ ID:4640.

Another function of VGAM1929 is therefore inhibition of HOMER-2B (Accession NM_004839). Accordingly, utilities of VGAM1929 include diagnosis, prevention and treatment of diseases and clinical conditions associated with HOMER-2B. HPIP (Accession NM_020524) is another VGAM1929 host target gene. HPIP BINDING SITE is HOST TARGET binding site found in the 3' untranslated region of mRNA encoded by HPIP, corresponding to a HOST TARGET binding site such as BINDING SITE I, BINDING SITE II or BINDING SITE III. Table 2 illustrates the complementarity of the nucleotide sequences of HPIP BINDING SITE, designated SEQ ID:21737, to the nucleotide sequence of VGAM1929 RNA, herein designated VGAM RNA, also designated SEQ ID:4640.

Another function of VGAM1929 is therefore inhibition of HPIP (Accession NM_020524). Accordingly, utilities of VGAM1929 include diagnosis, prevention and treatment of diseases and clinical conditions associated with HPIP. HSA249128 (Accession NM_017583) is another VGAM1929 host target gene. HSA249128 BINDING SITE is HOST TARGET binding site found in the 3' untranslated region of mRNA encoded by HSA249128, corresponding to a HOST TARGET binding site such as BINDING SITE I, BINDING SITE II or BINDING SITE III. Table 2 illustrates the complementarity of the nucleotide sequences of HSA249128 BINDING SITE, designated SEQ ID:19025, to the nucleotide sequence of VGAM1929 RNA, herein designated VGAM RNA, also designated SEQ ID:4640.

Another function of VGAM1929 is therefore inhibition of HSA249128 (Accession NM_017583). Accordingly, utilities of VGAM1929 include diagnosis, prevention and treatment of diseases and clinical conditions associated with HSA249128. HSA277841 (Accession NM_018553) is another VGAM1929 host target gene. HSA277841 BINDING SITE is HOST TARGET binding site found in the 3' untranslated region of mRNA encoded by HSA277841, corresponding to a HOST TARGET binding site such as BINDING SITE I, BINDING SITE II or BINDING SITE III. Table 2 illustrates the complementarity of the nucleotide sequences of HSA277841 BINDING SITE, designated SEQ ID:20633, to the nucleotide sequence of VGAM1929 RNA, herein designated VGAM RNA, also designated SEQ ID:4640.

Another function of VGAM1929 is therefore inhibition of HSA277841 (Accession NM_018553). Accordingly, utilities of VGAM1929 include diagnosis, prevention and treatment of diseases and clinical conditions associated with HSA277841. HSPC129 (Accession NM_016396) is another VGAM1929 host target gene. HSPC129 BINDING SITE is HOST TARGET binding site found in the 3' untranslated region of mRNA encoded by HSPC129, corresponding to a HOST TARGET binding site such as BINDING SITE I, BINDING SITE II or BINDING SITE III. Table 2 illustrates the complementarity of the nucleotide sequences of HSPC129 BINDING SITE, designated SEQ ID:18535, to the nucleotide sequence of VGAM1929 RNA, herein designated VGAM RNA, also designated SEQ ID:4640.

Another function of VGAM1929 is therefore inhibition of HSPC129 (Accession NM_016396). Accordingly, utilities of VGAM1929 include diagnosis, prevention and treatment of diseases and clinical conditions associated with HSPC129. Internexin Neuronal Intermediate Filament Protein, Alpha (INA, Accession NM_032727) is another VGAM1929 host target gene. INA BINDING SITE is HOST TARGET binding site found in the 3' untranslated region of mRNA encoded by INA, corresponding to a HOST TARGET binding site such as BINDING SITE I, BINDING SITE II or BINDING SITE III. Table 2 illustrates the complementarity of the nucleotide sequences of INA BINDING SITE, designated SEQ ID:26453, to the nucleotide sequence of VGAM1929 RNA, herein designated VGAM RNA, also designated SEQ ID:4640.

Another function of VGAM1929 is therefore inhibition of Internexin Neuronal Intermediate Filament Protein, Alpha (INA, Accession NM_032727). Accordingly, utilities of VGAM1929 include diagnosis, prevention and treatment of diseases and clinical conditions associated with INA. Inhibitor of Growth Family, Member 4 (ING4, Accession XM_006980) is another VGAM1929 host target gene. ING4 BINDING SITE is HOST TARGET binding site found in the 3' untranslated region of mRNA encoded by ING4, corresponding to a HOST TARGET binding site such as BINDING SITE I, BINDING SITE II or BINDING SITE III. Table 2 illustrates the complementarity of the nucleotide sequences of ING4 BINDING SITE, designated SEQ ID:30026, to the nucleotide sequence of VGAM1929 RNA, herein designated VGAM RNA, also designated SEQ ID:4640.

Another function of VGAM1929 is therefore inhibition of Inhibitor of Growth Family, Member 4 (ING4, Accession XM_006980). Accordingly, utilities of VGAM1929 include diagnosis, prevention and treatment of diseases and clinical conditions associated with ING4. K-ALPHA-1 (Accession XM_084866) is another VGAM1929 host target gene. K-ALPHA-1 BINDING SITE is HOST TARGET binding site found in the 5' untranslated region of mRNA encoded by K-ALPHA-1, corresponding to a HOST TARGET binding site such as BINDING SITE I, BINDING SITE II or BINDING SITE III. Table 2 illustrates the complementarity of the nucleotide sequences of K-ALPHA-1 BINDING SITE, designated SEQ ID:37742, to the nucleotide sequence of VGAM1929 RNA, herein designated VGAM RNA, also designated SEQ ID:4640.

Another function of VGAM1929 is therefore inhibition of K-ALPHA-1 (Accession XM_084866). Accordingly, utilities of VGAM1929 include diagnosis, prevention and treatment of diseases and clinical conditions associated with K-ALPHA-1. KIAA0087 (Accession NM_014769) is another VGAM1929 host target gene. KIAA0087 BINDING SITE is HOST TARGET binding site found in the 3' untranslated region of mRNA encoded by KIAA0087, corresponding to a HOST TARGET binding site such as BINDING SITE I, BINDING SITE II or BINDING SITE III. Table 2 illustrates the complementarity of the nucleotide sequences of KIAA0087 BINDING SITE, designated SEQ ID:16560, to the nucleotide sequence of VGAM1929 RNA, herein designated VGAM RNA, also designated SEQ ID:4640.

Another function of VGAM1929 is therefore inhibition of KIAA0087 (Accession NM_014769). Accordingly, utilities of VGAM1929 include diagnosis, prevention and treatment of diseases and clinical conditions associated with KIAA0087. KIAA0185 (Accession XM_031992) is another VGAM1929 host target gene. KIAA0185 BINDING SITE is HOST TARGET binding site found in the 3' untranslated region of mRNA encoded by KIAA0185, corresponding to a HOST TARGET binding site such as BINDING SITE I, BINDING SITE II or BINDING SITE III. Table 2 illustrates the complementarity of the nucleotide sequences of KIAA0185 BINDING SITE, designated SEQ ID:31538, to the nucleotide sequence of VGAM1929 RNA, herein designated VGAM RNA, also designated SEQ ID:4640.

Another function of VGAM1929 is therefore inhibition of KIAA0185 (Accession XM_031992). Accordingly, utilities of VGAM1929 include diagnosis, prevention and treatment of diseases and clinical conditions associated with KIAA0185. KIAA0186 (Accession NM_021067) is another VGAM1929 host target gene. KIAA0186 BINDING SITE is HOST TARGET binding site found in the 3' untranslated region of mRNA encoded by KIAA0186, corresponding to a HOST TARGET binding site such as BINDING SITE I, BINDING SITE II or BINDING SITE III. Table 2 illustrates the complementarity of the nucleotide sequences of KIAA0186 BINDING SITE, designated SEQ ID:22038, to the nucleotide sequence of VGAM1929 RNA, herein designated VGAM RNA, also designated SEQ ID:4640.

Another function of VGAM1929 is therefore inhibition of KIAA0186 (Accession NM_021067). Accordingly, utilities of VGAM1929 include diagnosis, prevention and treatment of diseases and clinical conditions associated with KIAA0186. KIAA0215 (Accession NM_014735) is another VGAM1929 host target gene. KIAA0215 BINDING SITE1 and KIAA0215 BINDING SITE2 are HOST TARGET binding sites found in untranslated regions of mRNA encoded by KIAA0215, corresponding to HOST TARGET binding sites such as BINDING SITE I, BINDING SITE II or BINDING SITE III. Table 2 illustrates the complementarity of the nucleotide sequences of KIAA0215 BINDING SITE1 and KIAA0215 BINDING SITE2, designated SEQ ID:16383 and SEQ ID:16386 respectively, to the nucleotide sequence of VGAM1929 RNA, herein designated VGAM RNA, also designated SEQ ID:4640.

Another function of VGAM1929 is therefore inhibition of KIAA0215 (Accession NM_014735). Accordingly, utilities of VGAM1929 include diagnosis, prevention and treatment of diseases and clinical conditions associated with KIAA0215. KIAA0255 (Accession NM_014742) is another VGAM1929 host target gene. KIAA0255 BINDING SITE1 and KIAA0255 BINDING SITE2 are HOST TARGET binding sites found in untranslated regions of mRNA encoded by KIAA0255, corresponding to HOST TARGET binding sites such as BINDING SITE I, BINDING SITE II or BINDING SITE III. Table 2 illustrates the complementarity of the nucleotide sequences of KIAA0255 BINDING SITE1 and KIAA0255 BINDING SITE2, designated SEQ ID:16418 and SEQ ID:34626 respectively, to the nucleotide sequence of VGAM1929 RNA, herein designated VGAM RNA, also designated SEQ ID:4640.

Another function of VGAM1929 is therefore inhibition of KIAA0255 (Accession NM_014742). Accordingly, utilities of VGAM1929 include diagnosis, prevention and treatment of diseases and clinical conditions associated with KIAA0255. KIAA0318 (Accession XM_044334) is another VGAM1929 host target gene. KIAA0318 BINDING SITE is HOST TARGET binding site found in the 3' untranslated region of mRNA encoded by KIAA0318, corresponding to a HOST TARGET binding site such as BINDING SITE I, BINDING SITE II or BINDING SITE III. Table 2 illustrates the complementarity of the nucleotide sequences of KIAA0318 BINDING SITE, designated SEQ ID:34190, to the nucleotide sequence of VGAM1929 RNA, herein designated VGAM RNA, also designated SEQ ID:4640.

Another function of VGAM1929 is therefore inhibition of KIAA0318 (Accession XM_044334). Accordingly, utilities of VGAM1929 include diagnosis, prevention and treatment of diseases and clinical conditions associated with KIAA0318. KIAA0323 (Accession XM_032634) is another VGAM1929 host target gene. KIAA0323 BINDING SITE is HOST TARGET binding site found in the 3' untranslated region of mRNA encoded by KIAA0323, corresponding to a HOST TARGET binding site such as BINDING SITE I, BINDING SITE II or BINDING SITE III. Table 2 illustrates the complementarity of the nucleotide sequences of KIAA0323 BINDING SITE, designated SEQ ID:31693, to the nucleotide sequence of VGAM1929 RNA, herein designated VGAM RNA, also designated SEQ ID:4640.

Another function of VGAM1929 is therefore inhibition of KIAA0323 (Accession XM_032634). Accordingly, utilities of VGAM1929 include diagnosis, prevention and treatment of diseases and clinical conditions associated with KIAA0323. KIAA0349 (Accession XM_166449) is another VGAM1929 host target gene. KIAA0349 BINDING SITE is HOST TARGET binding site found in the 3' untranslated region of mRNA encoded by KIAA0349, corresponding to a HOST TARGET binding site such as BINDING SITE I, BINDING SITE II or BINDING SITE III. Table 2 illustrates the complementarity of the nucleotide sequences of KIAA0349 BINDING SITE, designated SEQ ID:44343, to the nucleotide sequence of VGAM1929 RNA, herein designated VGAM RNA, also designated SEQ ID:4640.

Another function of VGAM1929 is therefore inhibition of KIAA0349 (Accession XM_166449). Accordingly, utilities of VGAM1929 include diagnosis, prevention and treatment of diseases and clinical conditions associated with KIAA0349. KIAA0417 (Accession XM_048898) is another VGAM1929 host target gene. KIAA0417 BINDING SITE is HOST TARGET binding site found in the 3' untranslated region of mRNA encoded by KIAA0417, corresponding to a HOST TARGET binding site such as BINDING SITE I, BINDING SITE II or BINDING SITE III. Table 2 illustrates the complementarity of the nucleotide sequences of KIAA0417 BINDING SITE, designated SEQ ID:35290, to the nucleotide sequence of VGAM1929 RNA, herein designated VGAM RNA, also designated SEQ ID:4640.

Another function of VGAM1929 is therefore inhibition of KIAA0417 (Accession XM_048898). Accordingly, utilities of VGAM1929 include diagnosis, prevention and treatment of diseases and clinical conditions associated with KIAA0417. KIAA0431 (Accession NM_015251) is another VGAM1929 host target gene. KIAA0431 BINDING SITE is HOST TARGET binding site found in the 3' untranslated region of mRNA encoded by KIAA0431, corresponding to a HOST TARGET binding site such as BINDING SITE I, BINDING SITE II or BINDING SITE III. Table 2 illustrates the complementarity of the nucleotide sequences of KIAA0431 BINDING SITE, designated SEQ ID:17579, to the nucleotide sequence of VGAM1929 RNA, herein designated VGAM RNA, also designated SEQ ID:4640.

Another function of VGAM1929 is therefore inhibition of KIAA0431 (Accession NM_015251). Accordingly, utilities of VGAM1929 include diagnosis, prevention and treatment of diseases and clinical conditions associated with KIAA0431. KIAA0435 (Accession NM_014801) is another VGAM1929 host target gene. KIAA0435 BINDING SITE is HOST TARGET binding site found in the 5' untranslated region of mRNA encoded by KIAA0435, corresponding to a HOST TARGET binding site such as BINDING SITE I, BINDING SITE II or BINDING SITE III. Table 2 illustrates the complementarity of the nucleotide sequences of KIAA0435 BINDING SITE, designated SEQ ID:16719, to the nucleotide sequence of VGAM1929 RNA, herein designated VGAM RNA, also designated SEQ ID:4640.

Another function of VGAM1929 is therefore inhibition of KIAA0435 (Accession NM_014801). Accordingly, utilities of VGAM1929 include diagnosis, prevention and treatment of diseases and clinical conditions associated with KIAA0435. KIAA0446 (Accession XM_044155) is another VGAM1929 host target gene. KIAA0446 BINDING SITE is HOST TARGET binding site found in the 3' untranslated region of mRNA encoded by KIAA0446, corresponding to a HOST TARGET binding site such as BINDING SITE I, BINDING SITE II or BINDING SITE III. Table 2 illustrates the complementarity of the nucleotide sequences of KIAA0446 BINDING SITE, designated SEQ ID:34156, to the nucleotide sequence of VGAM1929 RNA, herein designated VGAM RNA, also designated SEQ ID:4640.

Another function of VGAM1929 is therefore inhibition of KIAA0446 (Accession XM_044155). Accordingly, utilities of VGAM1929 include diagnosis, prevention and treatment of diseases and clinical conditions associated with KIAA0446. KIAA0494 (Accession NM_014774) is another VGAM1929 host target gene. KIAA0494 BINDING SITE is HOST TARGET binding site found in the 3' untranslated region of mRNA encoded by KIAA0494, corresponding to a HOST TARGET binding site such as BINDING SITE I, BINDING SITE II or BINDING SITE III. Table 2 illustrates the complementarity of the nucleotide sequences of KIAA0494 BINDING SITE, designated SEQ ID:16594, to the nucleotide sequence of VGAM1929 RNA, herein designated VGAM RNA, also designated SEQ ID:4640.

Another function of VGAM1929 is therefore inhibition of KIAA0494 (Accession NM_014774). Accordingly, utilities of VGAM1929 include diagnosis, prevention and treatment of diseases and clinical conditions associated with KIAA0494. KIAA0515 (Accession XM_033380) is another VGAM1929 host target gene. KIAA0515 BINDING SITE is HOST TARGET binding site found in the 3' untranslated region of mRNA encoded by KIAA0515, corresponding to a HOST TARGET binding site such as BINDING SITE I, BINDING SITE II or BINDING SITE III. Table 2 illustrates the complementarity of the nucleotide sequences of KIAA0515 BINDING SITE, designated SEQ ID:31923, to the nucleotide sequence of VGAM1929 RNA, herein designated VGAM RNA, also designated SEQ ID:4640.

Another function of VGAM1929 is therefore inhibition of KIAA0515 (Accession XM_033380). Accordingly, utilities of VGAM1929 include diagnosis, prevention and treatment of diseases and clinical conditions associated with KIAA0515. KIAA0522 (Accession XM_050404) is another VGAM1929 host target gene. KIAA0522 BINDING SITE is HOST TARGET binding site found in the 3' untranslated region of mRNA encoded by KIAA0522, corresponding to a HOST TARGET binding site such as BINDING SITE I, BINDING SITE II or BINDING SITE III. Table 2 illustrates the complementarity of the nucleotide sequences of KIAA0522 BINDING SITE, designated SEQ ID:35623, to the nucleotide sequence of VGAM1929 RNA, herein designated VGAM RNA, also designated SEQ ID:4640.

Another function of VGAM1929 is therefore inhibition of KIAA0522 (Accession XM_050404). Accordingly, utilities of VGAM1929 include diagnosis, prevention and treatment of diseases and clinical conditions associated with KIAA0522. KIAA0682 (Accession NM_014852) is another VGAM1929 host target gene. KIAA0682 BINDING SITE is HOST TARGET binding site found in the 3' untranslated region of mRNA encoded by KIAA0682, corresponding to a HOST TARGET binding site such as BINDING SITE I, BINDING SITE II or BINDING SITE III. Table 2 illustrates the complementarity of the nucleotide sequences of KIAA0682 BINDING SITE, designated SEQ ID:16902, to the nucleotide sequence of VGAM1929 RNA, herein designated VGAM RNA, also designated SEQ ID:4640.

Another function of VGAM1929 is therefore inhibition of KIAA0682 (Accession NM_014852). Accordingly, utilities of VGAM1929 include diagnosis, prevention and treatment of diseases and clinical conditions associated with KIAA0682. KIAA0802 (Accession XM_031357) is another VGAM1929 host target gene. KIAA0802 BINDING SITE is HOST TARGET binding site found in the 3' untranslated region of mRNA encoded by KIAA0802, corresponding to a HOST TARGET binding site such as BINDING SITE I, BINDING SITE II or BINDING SITE III. Table 2 illustrates the complementarity of the nucleotide sequences of KIAA0802 BINDING SITE, designated SEQ ID:31354, to the nucleotide sequence of VGAM1929 RNA, herein designated VGAM RNA, also designated SEQ ID:4640.

Another function of VGAM1929 is therefore inhibition of KIAA0802 (Accession XM_031357). Accordingly, utilities of VGAM1929 include diagnosis, prevention and treatment of diseases and clinical conditions associated with KIAA0802. KIAA0825 (Accession XM_027906) is another VGAM1929 host target gene. KIAA0825 BINDING SITE is HOST TARGET binding site found in the 3' untranslated region of mRNA encoded by KIAA0825, corresponding to a HOST TARGET binding site such as BINDING SITE I, BINDING SITE II or BINDING SITE III. Table 2 illustrates the complementarity of the nucleotide sequences of KIAA0825 BINDING SITE, designated SEQ ID:30595, to the nucleotide sequence of VGAM1929 RNA, herein designated VGAM RNA, also designated SEQ ID:4640.

Another function of VGAM1929 is therefore inhibition of KIAA0825 (Accession XM_027906). Accordingly, utilities of VGAM1929 include diagnosis, prevention and treatment of diseases and clinical conditions associated with KIAA0825. KIAA0844 (Accession NM_014951) is another VGAM1929 host target gene. KIAA0844 BINDING SITE is HOST TARGET binding site found in the 3' untranslated region of mRNA encoded by KIAA0844, corresponding to a HOST TARGET binding site such as BINDING SITE I, BINDING SITE II or BINDING SITE III. Table 2 illustrates the complementarity of the nucleotide sequences of KIAA0844 BINDING SITE, designated SEQ ID:17286, to the nucleotide sequence of VGAM1929 RNA, herein designated VGAM RNA, also designated SEQ ID:4640.

Another function of VGAM1929 is therefore inhibition of KIAA0844 (Accession NM_014951). Accordingly, utilities of VGAM1929 include diagnosis, prevention and treatment of diseases and clinical conditions associated with KIAA0844. KIAA0848 (Accession NM_014926) is another VGAM1929 host target gene. KIAA0848 BINDING SITE is HOST TARGET binding site found in the 3' untranslated region of mRNA encoded by KIAA0848, corresponding to a HOST TARGET binding site such as BINDING SITE I, BINDING SITE II or BINDING SITE III. Table 2 illustrates the complementarity of the nucleotide sequences of KIAA0848 BINDING SITE, designated SEQ ID:17215, to the nucleotide sequence of VGAM1929 RNA, herein designated VGAM RNA, also designated SEQ ID:4640.

Another function of VGAM1929 is therefore inhibition of KIAA0848 (Accession NM_014926). Accordingly, utilities of VGAM1929 include diagnosis, prevention and treatment of diseases and clinical conditions associated with KIAA0848. KIAA0854 (Accession NM_014943) is another VGAM1929 host target gene. KIAA0854 BINDING SITE is HOST TARGET binding site found in the 3' untranslated region of mRNA encoded by KIAA0854, corresponding to a HOST TARGET binding site such as BINDING SITE I, BINDING SITE II or BINDING SITE III. Table 2 illustrates the complementarity of the nucleotide sequences of KIAA0854 BINDING SITE, designated SEQ ID:17254, to the nucleotide sequence of VGAM1929 RNA, herein designated VGAM RNA, also designated SEQ ID:4640.

Another function of VGAM1929 is therefore inhibition of KIAA0854 (Accession NM_014943). Accordingly, utilities of VGAM1929 include diagnosis, prevention and treatment of diseases and clinical conditions associated with KIAA0854. KIAA0865 (Accession XM_028522) is another VGAM1929 host target gene. KIAA0865 BINDING SITE is HOST TARGET binding site found in the 3' untranslated region of mRNA encoded by KIAA0865, corresponding to a HOST TARGET binding site such as BINDING SITE I, BINDING SITE II or BINDING SITE III. Table 2 illustrates the complementarity of the nucleotide sequences of KIAA0865 BINDING SITE, designated SEQ ID:30712, to the nucleotide sequence of VGAM1929 RNA, herein designated VGAM RNA, also designated SEQ ID:4640.

Another function of VGAM1929 is therefore inhibition of KIAA0865 (Accession XM_028522). Accordingly, utilities of VGAM1929 include diagnosis, prevention and treatment of diseases and clinical conditions associated with KIAA0865. KIAA0882 (Accession XM_093895) is another VGAM1929 host target gene. KIAA0882 BINDING SITE is HOST TARGET binding site found in the 3' untranslated region of mRNA encoded by KIAA0882, corresponding to a HOST TARGET binding site such as BINDING SITE I, BINDING SITE II or BINDING SITE III. Table 2 illustrates the complementarity of the nucleotide sequences of KIAA0882 BINDING SITE, designated SEQ ID:40217, to the nucleotide sequence of VGAM1929 RNA, herein designated VGAM RNA, also designated SEQ ID:4640.

Another function of VGAM1929 is therefore inhibition of KIAA0882 (Accession XM_093895). Accordingly, utilities of VGAM1929 include diagnosis, prevention and treatment of diseases and clinical conditions associated with KIAA0882. KIAA0894 (Accession NM_014896) is another VGAM1929 host target gene. KIAA0894 BINDING SITE1 and KIAA0894 BINDING SITE2 are HOST TARGET binding sites found in untranslated regions of mRNA encoded by KIAA0894, corresponding to HOST TARGET binding sites such as BINDING SITE I, BINDING SITE II or BINDING SITE III. Table 2 illustrates the complementarity of the nucleotide sequences of KIAA0894 BINDING SITE1 and KIAA0894 BINDING SITE2, designated SEQ ID:17059 and SEQ ID:17060 respectively, to the nucleotide sequence of VGAM1929 RNA, herein designated VGAM RNA, also designated SEQ ID:4640.

Another function of VGAM1929 is therefore inhibition of KIAA0894 (Accession NM_014896). Accordingly, utilities of VGAM1929 include diagnosis, prevention and treatment of diseases and clinical conditions associated with KIAA0894. KIAA0931 (Accession XM_041191) is another VGAM1929 host target gene. KIAA0931 BINDING SITE is HOST TARGET binding site found in the 3' untranslated region of mRNA encoded by KIAA0931, corresponding to a HOST TARGET binding site such as BINDING SITE I, BINDING SITE II or BINDING SITE III. Table 2 illustrates the complementarity of the nucleotide sequences of KIAA0931 BINDING SITE, designated SEQ ID:33489, to the nucleotide sequence of VGAM1929 RNA, herein designated VGAM RNA, also designated SEQ ID:4640.

Another function of VGAM1929 is therefore inhibition of KIAA0931 (Accession XM_041191). Accordingly, utilities of VGAM1929 include diagnosis, prevention and treatment of diseases and clinical conditions associated with KIAA0931. KIAA1033 (Accession XM_035313) is another VGAM1929 host target gene. KIAA1033 BINDING SITE is HOST TARGET binding site found in the 3' untranslated region of mRNA encoded by KIAA1033, corresponding to a HOST TARGET binding site such as BINDING SITE I, BINDING SITE II or BINDING SITE III. Table 2 illustrates the complementarity of the nucleotide sequences of KIAA1033 BINDING SITE, designated SEQ ID:32230, to the nucleotide sequence of VGAM1929 RNA, herein designated VGAM RNA, also designated SEQ ID:4640.

Another function of VGAM1929 is therefore inhibition of KIAA1033 (Accession XM_035313). Accordingly, utilities of VGAM1929 include diagnosis, prevention and treatment of diseases and clinical conditions associated with KIAA1033. KIAA1034 (Accession XM_031223) is another VGAM1929 host target gene. KIAA1034 BINDING SITE1 and KIAA1034 BINDING SITE2 are HOST TARGET binding sites found in untranslated regions of mRNA encoded by KIAA1034, corresponding to HOST TARGET binding sites such as BINDING SITE I, BINDING SITE II or BINDING SITE III. Table 2 illustrates the complementarity of the nucleotide sequences of KIAA1034 BINDING SITE1 and KIAA1034 BINDING SITE2, designated SEQ ID:31309 and SEQ ID:31312 respectively, to the nucleotide sequence of VGAM1929 RNA, herein designated VGAM RNA, also designated SEQ ID:4640.

Another function of VGAM1929 is therefore inhibition of KIAA1034 (Accession XM_031223). Accordingly, utilities of VGAM1929 include diagnosis, prevention and treatment of diseases and clinical conditions associated with KIAA1034. KIAA1040 (Accession XM_051091) is another VGAM1929 host target gene. KIAA1040 BINDING SITE1 and KIAA1040 BINDING SITE2 are HOST TARGET binding sites found in untranslated regions of mRNA encoded by KIAA1040, corresponding to HOST TARGET binding sites such as BINDING SITE I, BINDING SITE II or BINDING SITE III. Table 2 illustrates the complementarity of the nucleotide sequences of KIAA1040 BINDING SITE1 and KIAA1040 BINDING SITE2, designated SEQ ID:35747 and SEQ ID:33954 respectively, to the nucleotide sequence of VGAM1929 RNA, herein designated VGAM RNA, also designated SEQ ID:4640.

Another function of VGAM1929 is therefore inhibition of KIAA1040 (Accession XM_051091). Accordingly, utilities of VGAM1929 include diagnosis, prevention and treatment of diseases and clinical conditions associated with KIAA1040. KIAA1164 (Accession XM_045358) is another VGAM1929 host target gene. KIAA1164 BINDING SITE is HOST TARGET binding site found in the 3' untranslated region of mRNA encoded by KIAA1164, corresponding to a HOST TARGET binding site such as BINDING SITE I, BINDING SITE II or BINDING SITE III. Table 2 illustrates the complementarity of the nucleotide sequences of KIAA1164 BINDING SITE, designated SEQ ID:34443, to the nucleotide sequence of VGAM1929 RNA, herein designated VGAM RNA, also designated SEQ ID:4640.

Another function of VGAM1929 is therefore inhibition of KIAA1164 (Accession XM_045358). Accordingly, utilities of VGAM1929 include diagnosis, prevention and treatment of diseases and clinical conditions associated with KIAA1164. KIAA1190 (Accession XM_048695) is another VGAM1929 host target gene. KIAA1190 BINDING SITE is HOST TARGET binding site found in the 3' untranslated region of mRNA encoded by KIAA1190, corresponding to a HOST TARGET binding site such as BINDING SITE I, BINDING SITE II or BINDING SITE III. Table 2 illustrates the complementarity of the nucleotide sequences of KIAA1190 BINDING SITE, designated SEQ ID:35227, to the nucleotide sequence of VGAM1929 RNA, herein designated VGAM RNA, also designated SEQ ID:4640.

Another function of VGAM1929 is therefore inhibition of KIAA1190 (Accession XM_048695). Accordingly, utilities of VGAM1929 include diagnosis, prevention and treatment of diseases and clinical conditions associated with KIAA1190. KIAA1200 (Accession XM_031054) is another VGAM1929 host target gene. KIAA1200 BINDING SITE is HOST TARGET binding site found in the 3' untranslated region of mRNA encoded by KIAA1200, corresponding to a HOST TARGET binding site such as BINDING SITE I, BINDING SITE II or BINDING SITE III. Table 2 illustrates the complementarity of the nucleotide sequences of KIAA1200 BINDING SITE, designated SEQ ID:31263, to the nucleotide sequence of VGAM1929 RNA, herein designated VGAM RNA, also designated SEQ ID:4640.

Another function of VGAM1929 is therefore inhibition of KIAA1200 (Accession XM_031054). Accordingly, utilities of VGAM1929 include diagnosis, prevention and treatment of diseases and clinical conditions associated with KIAA1200. KIAA1223 (Accession XM_048747) is another VGAM1929 host target gene. KIAA1223 BINDING SITE1 and KIAA1223 BINDING SITE2 are HOST TARGET binding sites found in untranslated regions of mRNA encoded by KIAA1223, corresponding to HOST TARGET binding sites such as BINDING SITE I, BINDING SITE II or BINDING SITE III. Table 2 illustrates the complementarity of the nucleotide sequences of KIAA1223 BINDING SITE1 and KIAA1223 BINDING SITE2, designated SEQ ID:35248 and SEQ ID:35251 respectively, to the nucleotide sequence of VGAM1929 RNA, herein designated VGAM RNA, also designated SEQ ID:4640.

Another function of VGAM1929 is therefore inhibition of KIAA1223 (Accession XM_048747). Accordingly, utilities of VGAM1929 include diagnosis, prevention and treatment of diseases and clinical conditions associated with KIAA1223. KIAA1280 (Accession XM_045766) is another VGAM1929 host target gene. KIAA1280 BINDING SITE is HOST TARGET binding site found in the 5' untranslated region of mRNA encoded by KIAA1280, corresponding to a HOST TARGET binding site such as BINDING SITE I, BINDING SITE II or BINDING SITE III. Table 2 illustrates the complementarity of the nucleotide sequences of KIAA1280 BINDING SITE, designated SEQ ID:34552, to the nucleotide sequence of VGAM1929 RNA, herein designated VGAM RNA, also designated SEQ ID:4640.

Another function of VGAM1929 is therefore inhibition of KIAA1280 (Accession XM_045766). Accordingly, utilities of VGAM1929 include diagnosis, prevention and treatment of diseases and clinical conditions associated with KIAA1280. KIAA1297 (Accession XM_051005) is another VGAM1929 host target gene. KIAA1297 BINDING SITE is HOST TARGET binding site found in the 3' untranslated region of mRNA encoded by KIAA1297, corresponding to a HOST TARGET binding site such as BINDING SITE I, BINDING SITE II or BINDING SITE III. Table 2 illustrates the complementarity of the nucleotide sequences of KIAA1297 BINDING SITE, designated SEQ ID:35721, to the nucleotide sequence of VGAM1929 RNA, herein designated VGAM RNA, also designated SEQ ID:4640.

Another function of VGAM1929 is therefore inhibition of KIAA1297 (Accession XM_051005). Accordingly, utilities of VGAM1929 include diagnosis, prevention and treatment of diseases and clinical conditions associated with KIAA1297. KIAA1318 (Accession XM_041080) is another VGAM1929 host target gene. KIAA1318 BINDING SITE1 and KIAA1318 BINDING SITE2 are HOST TARGET binding sites found in untranslated regions of mRNA encoded by KIAA1318, corresponding to HOST TARGET binding sites such as BINDING SITE I, BINDING SITE II or BINDING SITE III. Table 2 illustrates the complementarity of the nucleotide sequences of KIAA1318 BINDING SITE1 and KIAA1318 BINDING SITE2, designated SEQ ID:33430 and SEQ ID:33431 respectively, to the nucleotide sequence of VGAM1929 RNA, herein designated VGAM RNA, also designated SEQ ID:4640.

Another function of VGAM1929 is therefore inhibition of KIAA1318 (Accession XM_041080). Accordingly, utilities of VGAM1929 include diagnosis, prevention and treatment of diseases and clinical conditions associated with KIAA1318. KIAA1434 (Accession XM_045585) is another VGAM1929 host target gene. KIAA1434 BINDING SITE is HOST TARGET binding site found in the 3' untranslated region of mRNA encoded by KIAA1434, corresponding to a HOST TARGET binding site such as BINDING SITE I, BINDING SITE II or BINDING SITE III. Table 2 illustrates the complementarity of the nucleotide sequences of KIAA1434 BINDING SITE, designated SEQ ID:34490, to the nucleotide sequence of VGAM1929 RNA, herein designated VGAM RNA, also designated SEQ ID:4640.

Another function of VGAM1929 is therefore inhibition of KIAA1434 (Accession XM_045585). Accordingly, utilities of VGAM1929 include diagnosis, prevention and treatment of diseases and clinical conditions associated with KIAA1434. KIAA1437 (Accession XM_026998) is another VGAM1929 host target gene. KIAA1437 BINDING SITE is HOST TARGET binding site found in the 3' untranslated region of mRNA encoded by KIAA1437, corresponding to a HOST TARGET binding site such as BINDING SITE I, BINDING SITE II or BINDING SITE III. Table 2 illustrates the complementarity of the nucleotide sequences of KIAA1437 BINDING SITE, designated SEQ ID:30385, to the nucleotide sequence of VGAM1929 RNA, herein designated VGAM RNA, also designated SEQ ID:4640.

Another function of VGAM1929 is therefore inhibition of KIAA1437 (Accession XM_026998). Accordingly, utilities of VGAM1929 include diagnosis, prevention and treatment of diseases and clinical conditions associated with KIAA1437. KIAA1492 (Accession XM_035312) is another VGAM1929 host target gene. KIAA1492 BINDING SITE is HOST TARGET binding site found in the 3' untranslated region of mRNA encoded by KIAA1492, corresponding to a HOST TARGET binding site such as BINDING SITE I, BINDING SITE II or BINDING SITE III. Table 2 illustrates the complementarity of the nucleotide sequences of KIAA1492 BINDING SITE, designated SEQ ID:32227, to the nucleotide sequence of VGAM1929 RNA, herein designated VGAM RNA, also designated SEQ ID:4640.

Another function of VGAM1929 is therefore inhibition of KIAA1492 (Accession XM_035312). Accordingly, utilities of VGAM1929 include diagnosis, prevention and treatment of diseases and clinical conditions associated with KIAA1492. KIAA1495 (Accession XM_055080) is another VGAM1929 host target gene. KIAA1495 BINDING SITE is HOST TARGET binding site found in the 3' untranslated region of mRNA encoded by KIAA1495, corresponding to a HOST TARGET binding site such as BINDING SITE I, BINDING SITE II or BINDING SITE III. Table 2 illustrates the complementarity of the nucleotide sequences of KIAA1495 BINDING SITE, designated SEQ ID:36227, to the nucleotide sequence of VGAM1929 RNA, herein designated VGAM RNA, also designated SEQ ID:4640.

Another function of VGAM1929 is therefore inhibition of KIAA1495 (Accession XM_055080). Accordingly, utilities of VGAM1929 include diagnosis, prevention and treatment of diseases and clinical conditions associated with KIAA1495. KIAA1509 (Accession XM_029353) is another VGAM1929 host target gene. KIAA1509 BINDING SITE is HOST TARGET binding site found in the 3' untranslated region of mRNA encoded by KIAA1509, corresponding to a HOST TARGET binding site such as BINDING SITE I, BINDING SITE II or BINDING SITE III. Table 2 illustrates the complementarity of the nucleotide sequences of KIAA1509 BINDING SITE, designated SEQ ID:30878, to the nucleotide sequence of VGAM1929 RNA, herein designated VGAM RNA, also designated SEQ ID:4640.

Another function of VGAM1929 is therefore inhibition of KIAA1509 (Accession XM_029353). Accordingly, utilities of VGAM1929 include diagnosis, prevention and treatment of diseases and clinical conditions associated with KIAA1509. KIAA1511 (Accession XM_046581) is another VGAM1929 host target gene. KIAA1511 BINDING SITE is HOST TARGET binding site found in the 3' untranslated region of mRNA encoded by KIAA1511, corresponding to a HOST TARGET binding site such as BINDING SITE I, BINDING SITE II or BINDING SITE III. Table 2 illustrates the complementarity of the nucleotide sequences of KIAA1511 BINDING SITE, designated SEQ ID:34757, to the nucleotide sequence of VGAM1929 RNA, herein designated VGAM RNA, also designated SEQ ID:4640.

Another function of VGAM1929 is therefore inhibition of KIAA1511 (Accession XM_046581). Accordingly, utilities of VGAM1929 include diagnosis, prevention and treatment of diseases and clinical conditions associated with KIAA1511. KIAA1530 (Accession XM_042661) is another VGAM1929 host target gene. KIAA1530 BINDING SITE is HOST TARGET binding site found in the 3' untranslated region of mRNA encoded by KIAA1530, corresponding to a HOST TARGET binding site such as BINDING SITE I, BINDING SITE II or BINDING SITE III. Table 2 illustrates the complementarity of the nucleotide sequences of KIAA1530 BINDING SITE, designated SEQ ID:33732, to the nucleotide sequence of VGAM1929 RNA, herein designated VGAM RNA, also designated SEQ ID:4640.

Another function of VGAM1929 is therefore inhibition of KIAA1530 (Accession XM_042661). Accordingly, utilities of VGAM1929 include diagnosis, prevention and treatment of diseases and clinical conditions associated with KIAA1530. KIAA1559 (Accession XM_054472) is another VGAM1929 host target gene. KIAA1559 BINDING SITE is HOST TARGET binding site found in the 3' untranslated region of mRNA encoded by KIAA1559, corresponding to a HOST TARGET binding site such as BINDING SITE I, BINDING SITE II or BINDING SITE III. Table 2 illustrates the complementarity of the nucleotide sequences of KIAA1559 BINDING SITE, designated SEQ ID:36162, to the nucleotide sequence of VGAM1929 RNA, herein designated VGAM RNA, also designated SEQ ID:4640.

Another function of VGAM1929 is therefore inhibition of KIAA1559 (Accession XM_054472). Accordingly, utilities of VGAM1929 include diagnosis, prevention and treatment of diseases and clinical conditions associated with KIAA1559. KIAA1577 (Accession XM_035299) is another VGAM1929 host target gene. KIAA1577 BINDING SITE is HOST TARGET binding site found in the 3' untranslated region of mRNA encoded by KIAA1577, corresponding to a HOST TARGET binding site such as BINDING SITE I, BINDING SITE II or BINDING SITE III. Table 2 illustrates the complementarity of the nucleotide sequences of KIAA1577 BINDING SITE, designated SEQ ID:32211, to the nucleotide sequence of VGAM1929 RNA, herein designated VGAM RNA, also designated SEQ ID:4640.

Another function of VGAM1929 is therefore inhibition of KIAA1577 (Accession XM_035299). Accordingly, utilities of VGAM1929 include diagnosis, prevention and treatment of diseases and clinical conditions associated with KIAA1577. KIAA1677 (Accession XM_040383) is another VGAM1929 host target gene. KIAA1677 BINDING SITE1 and KIAA1677 BINDING SITE2 are HOST TARGET binding sites found in untranslated regions of mRNA encoded by KIAA1677, corresponding to HOST TARGET binding sites such as BINDING SITE I, BINDING SITE II or BINDING SITE III. Table 2 illustrates the complementarity of the nucleotide sequences of KIAA1677 BINDING SITE1 and KIAA1677 BINDING SITE2, designated SEQ ID:33291 and SEQ ID:33294 respectively, to the nucleotide sequence of VGAM1929 RNA, herein designated VGAM RNA, also designated SEQ ID:4640.

Another function of VGAM1929 is therefore inhibition of KIAA1677 (Accession XM_040383). Accordingly, utilities of VGAM1929 include diagnosis, prevention and treatment of diseases and clinical conditions associated with KIAA1677. KIAA1826 (Accession XM_040784) is another VGAM1929 host target gene. KIAA1826 BINDING SITE is HOST TARGET binding site found in the 3' untranslated region of mRNA encoded by KIAA1826, corresponding to a HOST TARGET binding site such as BINDING SITE I, BINDING SITE II or BINDING SITE III. Table 2 illustrates the complementarity of the nucleotide sequences of KIAA1826 BINDING SITE, designated SEQ ID:33379, to the nucleotide sequence of VGAM1929 RNA, herein designated VGAM RNA, also designated SEQ ID:4640.

Another function of VGAM1929 is therefore inhibition of KIAA1826 (Accession XM_040784). Accordingly, utilities of VGAM1929 include diagnosis, prevention and treatment of diseases and clinical conditions associated with KIAA1826. KIAA1831 (Accession XM_033366) is another VGAM1929 host target gene. KIAA1831 BINDING SITE is HOST TARGET binding site found in the 3' untranslated region of mRNA encoded by KIAA1831, corresponding to a HOST TARGET binding site such as BINDING SITE I, BINDING SITE II or BINDING SITE III. Table 2 illustrates the complementarity of the nucleotide sequences of KIAA1831 BINDING SITE, designated SEQ ID:31903, to the nucleotide sequence of VGAM1929 RNA, herein designated VGAM RNA, also designated SEQ ID:4640.

Another function of VGAM1929 is therefore inhibition of KIAA1831 (Accession XM_033366). Accordingly, utilities of VGAM1929 include diagnosis, prevention and treatment of diseases and clinical conditions associated with KIAA1831. KIAA1878 (Accession XM_166256) is another VGAM1929 host target gene. KIAA1878 BINDING SITE is HOST TARGET binding site found in the 3' untranslated region of mRNA encoded by KIAA1878, corresponding to a HOST TARGET binding site such as BINDING SITE I, BINDING SITE II or BINDING SITE III. Table 2 illustrates the complementarity of the nucleotide sequences of KIAA1878 BINDING SITE, designated SEQ ID:44076, to the nucleotide sequence of VGAM1929 RNA, herein designated VGAM RNA, also designated SEQ ID:4640.

Another function of VGAM1929 is therefore inhibition of KIAA1878 (Accession XM_166256). Accordingly, utilities of VGAM1929 include diagnosis, prevention and treatment of diseases and clinical conditions associated with KIAA1878. KIAA1987 (Accession XM_113870) is another VGAM1929 host target gene. KIAA1987 BINDING SITE is HOST TARGET binding site found in the 3' untranslated region of mRNA encoded by KIAA1987, corresponding to a HOST TARGET binding site such as BINDING SITE I, BINDING SITE II or BINDING SITE III. Table 2 illustrates the complementarity of the nucleotide sequences of KIAA1987 BINDING SITE, designated SEQ ID:42496, to the nucleotide sequence of VGAM1929 RNA, herein designated VGAM RNA, also designated SEQ ID:4640.

Another function of VGAM1929 is therefore inhibition of KIAA1987 (Accession XM_113870). Accordingly, utilities of VGAM1929 include diagnosis, prevention and treatment of diseases and clinical conditions associated with KIAA1987. Karyopherin (importin) Beta 3 (KPNB3, Accession NM_002271) is another VGAM1929 host target gene. KPNB3 BINDING SITE is HOST TARGET binding site found in the 3' untranslated region of mRNA encoded by KPNB3, corresponding to a HOST TARGET binding site such as BINDING SITE I, BINDING SITE II or BINDING SITE III. Table 2 illustrates the complementarity of the nucleotide sequences of KPNB3 BINDING SITE, designated SEQ ID:8064, to the nucleotide sequence of VGAM1929 RNA, herein designated VGAM RNA, also designated SEQ ID:4640.

Another function of VGAM1929 is therefore inhibition of Karyopherin (importin) Beta 3 (KPNB3, Accession NM_002271). Accordingly, utilities of VGAM1929 include diagnosis, prevention and treatment of diseases and clinical conditions associated with KPNB3. Leptin Receptor Overlapping Transcript-like 1 (LEPROTL1, Accession NM_015344) is another VGAM1929 host target gene. LEPROTL1 BINDING SITE is HOST TARGET binding site found in the 3' untranslated region of mRNA encoded by LEPROTL1, corresponding to a HOST TARGET binding site such as BINDING SITE I, BINDING SITE II or BINDING SITE III. Table 2 illustrates the complementarity of the nucleotide sequences of LEPROTL1 BINDING SITE, designated SEQ ID:17651, to the nucleotide sequence of VGAM1929 RNA, herein designated VGAM RNA, also designated SEQ ID:4640.

Another function of VGAM1929 is therefore inhibition of Leptin Receptor Overlapping Transcript-like 1 (LEPROTL1, Accession NM_015344). Accordingly, utilities of VGAM1929 include diagnosis, prevention and treatment of diseases and clinical conditions associated with LEPROTL1. LIG-1 (Accession XM_033712) is another VGAM1929 host target gene. LIG-1 BINDING SITE is HOST TARGET binding site found in the 3' untranslated region of mRNA encoded by LIG-1, corresponding to a HOST TARGET binding site such as BINDING SITE I, BINDING SITE II or BINDING SITE III. Table 2 illustrates the complementarity of the nucleotide sequences of LIG-1 BINDING SITE, designated SEQ ID:31955, to the nucleotide sequence of VGAM1929 RNA, herein designated VGAM RNA, also designated SEQ ID:4640.

Another function of VGAM1929 is therefore inhibition of LIG-1 (Accession XM_033712). Accordingly, utilities of VGAM1929 include diagnosis, prevention and treatment of diseases and clinical conditions associated with LIG-1. Low Density Lipoprotein-related Protein 1B (deleted in tumors) (LRP1B, Accession NM_018557) is another VGAM1929 host target gene. LRP1B BINDING SITE is HOST TARGET binding site found in the 5' untranslated region of mRNA encoded by LRP1B, corresponding to a HOST TARGET binding site such as BINDING SITE I, BINDING SITE II or BINDING SITE III. Table 2 illustrates the complementarity of the nucleotide sequences of LRP1B BINDING SITE, designated SEQ ID:20638, to the nucleotide sequence of VGAM1929 RNA, herein designated VGAM RNA, also designated SEQ ID:4640.

Another function of VGAM1929 is therefore inhibition of Low Density Lipoprotein-related Protein 1B (deleted in tumors) (LRP1B, Accession NM_018557). Accordingly, utilities of VGAM1929 include diagnosis, prevention and treatment of diseases and clinical conditions associated with LRP1B. Leucine Rich Repeat (in FLII) Interacting Protein 2 (LRRFIP2, Accession NM_017724) is another VGAM1929 host target gene. LRRFIP2 BINDING SITE is HOST TARGET binding site found in the 3' untranslated region of mRNA encoded by LRRFIP2, corresponding to a HOST TARGET binding site such as BINDING SITE I, BINDING SITE II or BINDING SITE III. Table 2 illustrates the complementarity of the nucleotide sequences of LRRFIP2 BINDING SITE, designated SEQ ID:19313, to the nucleotide sequence of VGAM1929 RNA, herein designated VGAM RNA, also designated SEQ ID:4640.

Another function of VGAM1929 is therefore inhibition of Leucine Rich Repeat (in FLII) Interacting Protein 2 (LRRFIP2, Accession NM_017724). Accordingly, utilities of VGAM1929 include diagnosis, prevention and treatment of diseases and clinical conditions associated with LRRFIP2. Microtubule-actin Crosslinking Factor 1 (MACF1, Accession NM_012090) is another VGAM1929 host target gene. MACF1 BINDING SITE is HOST TARGET binding site found in the 3' untranslated region of mRNA encoded by MACF1, corresponding to a HOST TARGET binding site such as BINDING SITE I, BINDING SITE II or BINDING SITE III. Table 2 illustrates the complementarity of the nucleotide sequences of MACF1 BINDING SITE, designated SEQ ID:14377, to the nucleotide sequence of VGAM1929 RNA, herein designated VGAM RNA, also designated SEQ ID:4640.

Another function of VGAM1929 is therefore inhibition of Microtubule-actin Crosslinking Factor 1 (MACF1, Accession NM_012090). Accordingly, utilities of VGAM1929 include diagnosis, prevention and treatment of diseases and clinical conditions associated with MACF1. Mitogen-activated Protein Kinase Kinase Kinase Kinase 3 (MAP4K3, Accession NM_003618) is another VGAM1929 host target gene. MAP4K3 BINDING SITE is HOST TARGET binding site found in the 3' untranslated region of mRNA encoded by MAP4K3, corresponding to a HOST TARGET binding site such as BINDING SITE I, BINDING SITE II or BINDING SITE III. Table 2 illustrates the complementarity of the nucleotide sequences of MAP4K3 BINDING SITE, designated SEQ ID:9681, to the nucleotide sequence of VGAM1929 RNA, herein designated VGAM RNA, also designated SEQ ID:4640.

Another function of VGAM1929 is therefore inhibition of Mitogen-activated Protein Kinase Kinase Kinase Kinase 3 (MAP4K3, Accession NM_003618). Accordingly, utilities of VGAM1929 include diagnosis, prevention and treatment of diseases and clinical conditions associated with MAP4K3. Methionine Adenosyltransferase II, Beta (MAT2B, Accession NM_013283) is another VGAM1929 host target gene. MAT2B BINDING SITE is HOST TARGET binding site found in the 3' untranslated region of mRNA encoded by MAT2B, corresponding to a HOST TARGET binding site such as BINDING SITE I, BINDING SITE II or BINDING SITE III. Table 2 illustrates the complementarity of the nucleotide sequences of MAT2B BINDING SITE, designated SEQ ID:14955, to the nucleotide sequence of VGAM1929 RNA, herein designated VGAM RNA, also designated SEQ ID:4640.

Another function of VGAM1929 is therefore inhibition of Methionine Adenosyltransferase II, Beta (MAT2B, Accession NM_013283). Accordingly, utilities of VGAM1929 include diagnosis, prevention and treatment of diseases and clinical conditions associated with MAT2B. MCM10 Minichromosome Maintenance Deficient 10 (S. cerevisiae) (MCM10, Accession NM_018518) is another VGAM1929 host target gene. MCM10 BINDING SITE is HOST TARGET binding site found in the 3' untranslated region of mRNA encoded by MCM10, corresponding to a HOST TARGET binding site such as BINDING SITE I, BINDING SITE II or BINDING SITE III. Table 2 illustrates the complementarity of the nucleotide sequences of MCM10 BINDING SITE, designated SEQ ID:20593, to the nucleotide sequence of VGAM1929 RNA, herein designated VGAM RNA, also designated SEQ ID:4640.

Another function of VGAM1929 is therefore inhibition of MCM10 Minichromosome Maintenance Deficient 10 (S. cerevisiae) (MCM10, Accession NM_018518). Accordingly, utilities of VGAM1929 include diagnosis, prevention and treatment of diseases and clinical conditions associated with MCM10. MGC1203 (Accession NM_024296) is another VGAM1929 host target gene. MGC1203 BINDING SITE is HOST TARGET binding site found in the 3' untranslated region of mRNA encoded by MGC1203, corresponding to a HOST TARGET binding site such as BINDING SITE I, BINDING SITE II or BINDING SITE III. Table 2 illustrates the complementarity of the nucleotide sequences of MGC1203 BINDING SITE, designated SEQ ID:23576, to the nucleotide sequence of VGAM1929 RNA, herein designated VGAM RNA, also designated SEQ ID:4640.

Another function of VGAM1929 is therefore inhibition of MGC1203 (Accession NM_024296). Accordingly, utilities of VGAM1929 include diagnosis, prevention and treatment of diseases and clinical conditions associated with MGC1203. MGC13090 (Accession NM_032711) is another VGAM1929 host target gene. MGC13090 BINDING SITE is HOST TARGET binding site found in the 3' untranslated region of mRNA encoded by MGC13090, corresponding to a HOST TARGET binding site such as BINDING SITE I, BINDING SITE II or BINDING SITE III. Table 2 illustrates the complementarity of the nucleotide sequences of MGC13090 BINDING SITE, designated SEQ ID:26426, to the nucleotide sequence of VGAM1929 RNA, herein designated VGAM RNA, also designated SEQ ID:4640.

Another function of VGAM1929 is therefore inhibition of MGC13090 (Accession NM_032711). Accordingly, utilities of VGAM1929 include diagnosis, prevention and treatment of diseases and clinical conditions associated with MGC13090. MGC16075 (Accession NM_032761) is another VGAM1929 host target gene. MGC16075 BINDING SITE is HOST TARGET binding site found in the 3' untranslated region of mRNA encoded by MGC16075, corresponding to a HOST TARGET binding site such as BINDING SITE I, BINDING SITE II or BINDING SITE III. Table 2 illustrates the complementarity of the nucleotide sequences of MGC16075 BINDING SITE, designated SEQ ID:26504, to the nucleotide sequence of VGAM1929 RNA, herein designated VGAM RNA, also designated SEQ ID:4640.

Another function of VGAM1929 is therefore inhibition of MGC16075 (Accession NM_032761). Accordingly, utilities of VGAM1929 include diagnosis, prevention and treatment of diseases and clinical conditions associated with MGC16075. MGC2474 (Accession NM_023931) is another VGAM1929 host target gene. MGC2474 BINDING SITE is HOST TARGET binding site found in the 3' untranslated region of mRNA encoded by MGC2474, corresponding to a HOST TARGET binding site such as BINDING SITE I, BINDING SITE II or BINDING SITE III. Table 2 illustrates the complementarity of the nucleotide sequences of MGC2474 BINDING SITE, designated SEQ ID:23418, to the nucleotide sequence of VGAM1929 RNA, herein designated VGAM RNA, also designated SEQ ID:4640.

Another function of VGAM1929 is therefore inhibition of MGC2474 (Accession NM_023931). Accordingly, utilities of VGAM1929 include diagnosis, prevention and treatment of diseases and clinical conditions associated with MGC2474. MGC3329 (Accession NM_024086) is another VGAM1929 host target gene. MGC3329 BINDING SITE1 and MGC3329 BINDING SITE2 are HOST TARGET binding sites found in untranslated regions of mRNA encoded by MGC3329, corresponding to HOST TARGET binding sites such as BINDING SITE I, BINDING SITE II or BINDING SITE III. Table 2 illustrates the complementarity of the nucleotide sequences of MGC3329 BINDING SITE1 and MGC3329 BINDING SITE2, designated SEQ ID:23527 and SEQ ID:23529 respectively, to the nucleotide sequence of VGAM1929 RNA, herein designated VGAM RNA, also designated SEQ ID:4640.

Another function of VGAM1929 is therefore inhibition of MGC3329 (Accession NM_024086). Accordingly, utilities of VGAM1929 include diagnosis, prevention and treatment of diseases and clinical conditions associated with MGC3329. MGC5508 (Accession NM_024092) is another VGAM1929 host target gene. MGC5508 BINDING SITE is HOST TARGET binding site found in the 3' untranslated region of mRNA encoded by MGC5508, corresponding to a HOST TARGET binding site such as BINDING SITE I, BINDING SITE II or BINDING SITE III. Table 2 illustrates the complementarity of the nucleotide sequences of MGC5508 BINDING SITE, designated SEQ ID:23535, to the nucleotide sequence of VGAM1929 RNA, herein designated VGAM RNA, also designated SEQ ID:4640.

Another function of VGAM1929 is therefore inhibition of MGC5508 (Accession NM_024092). Accordingly, utilities of VGAM1929 include diagnosis, prevention and treatment of diseases and clinical conditions associated with MGC5508. Myeloid/lymphoid Or Mixed-lineage Leukemia3 (MLL3, Accession NM_021230) is another VGAM1929 host target gene. MLL3 BINDING SITE is HOST TARGET binding site found in the 5' untranslated region of mRNA encoded by MLL3, corresponding to a HOST TARGET binding site such as BINDING SITE I, BINDING SITE II or BINDING SITE III. Table 2 illustrates the complementarity of the nucleotide sequences of MLL3 BINDING SITE, designated SEQ ID:22202, to the nucleotide sequence of VGAM1929 RNA, herein designated VGAM RNA, also designated SEQ ID:4640.

Another function of VGAM1929 is therefore inhibition of Myeloid/lymphoid Or Mixed-lineage Leukemia3 (MLL3, Accession NM_021230). Accordingly, utilities of VGAM1929 include diagnosis, prevention and treatment of diseases and clinical conditions associated with MLL3. N-acetylated Alpha-linked Acidic Dipeptidase 2 (NAALAD2, Accession NM_005467) is another VGAM1929 host target gene. NAALAD2 BINDING SITE is HOST TARGET binding site found in the 3' untranslated region of mRNA encoded by NAALAD2, corresponding to a HOST TARGET binding site such as BINDING SITE I, BINDING SITE II or BINDING SITE III. Table 2 illustrates the complementarity of the nucleotide sequences of NAALAD2 BINDING SITE, designated SEQ ID:11964, to the nucleotide sequence of VGAM1929 RNA, herein designated VGAM RNA, also designated SEQ ID:4640.

Another function of VGAM1929 is therefore inhibition of N-acetylated Alpha-linked Acidic Dipeptidase 2 (NAALAD2, Accession NM_005467). Accordingly, utilities of VGAM1929 include diagnosis, prevention and treatment of diseases and clinical conditions associated with NAALAD2. NFASC (Accession XM_046808) is another VGAM1929 host target gene. NFASC BINDING SITE is HOST TARGET binding site found in the 3' untranslated region of mRNA encoded by NFASC, corresponding to a HOST TARGET binding site such as BINDING SITE I, BINDING SITE II or BINDING SITE III. Table 2 illustrates the complementarity of the nucleotide sequences of NFASC BINDING SITE, designated SEQ ID:34830, to the nucleotide sequence of VGAM1929 RNA, herein designated VGAM RNA, also designated SEQ ID:4640.

Another function of VGAM1929 is therefore inhibition of NFASC (Accession XM_046808). Accordingly, utilities of VGAM1929 include diagnosis, prevention and treatment of diseases and clinical conditions associated with NFASC. NIBAN (Accession NM_022083) is another VGAM1929 host target gene. NIBAN BINDING SITE is HOST TARGET binding site found in the 3' untranslated region of mRNA encoded by NIBAN, corresponding to a HOST TARGET binding site such as BINDING SITE I, BINDING SITE II or BINDING SITE III. Table 2 illustrates the complementarity of the nucleotide sequences of NIBAN BINDING SITE, designated SEQ ID:22629, to the nucleotide sequence of VGAM1929 RNA, herein designated VGAM RNA, also designated SEQ ID:4640.

Another function of VGAM1929 is therefore inhibition of NIBAN (Accession NM_022083). Accordingly, utilities of VGAM1929 include diagnosis, prevention and treatment of diseases and clinical conditions associated with NIBAN. Nicolin 1 (NICN1, Accession NM_032316) is another VGAM1929 host target gene. NICN1 BINDING SITE is HOST TARGET binding site found in the 3' untranslated region of mRNA encoded by NICN1, corresponding to a HOST TARGET binding site such as BINDING SITE I, BINDING SITE II or BINDING SITE III. Table 2 illustrates the complementarity of the nucleotide sequences of NICN1 BINDING SITE, designated SEQ ID:26117, to the nucleotide sequence of VGAM1929 RNA, herein designated VGAM RNA, also designated SEQ ID:4640.

Another function of VGAM1929 is therefore inhibition of Nicolin 1 (NICN1, Accession NM_032316). Accordingly, utilities of VGAM1929 include diagnosis, prevention and treatment of diseases and clinical conditions associated with NICN1. NKX2B (Accession NM_002509) is another VGAM1929 host target gene. NKX2B BINDING SITE is HOST TARGET binding site found in the 3' untranslated region of mRNA encoded by NKX2B, corresponding to a HOST TARGET binding site such as BINDING SITE I, BINDING SITE II or BINDING SITE III. Table 2 illustrates the complementarity of the nucleotide sequences of NKX2B BINDING SITE, designated SEQ ID:8344, to the nucleotide sequence of VGAM1929 RNA, herein designated VGAM RNA, also designated SEQ ID:4640.

Another function of VGAM1929 is therefore inhibition of NKX2B (Accession NM_002509). Accordingly, utilities of VGAM1929 include diagnosis, prevention and treatment of diseases and clinical conditions associated with NKX2B. NRF (Accession NM_017544) is another VGAM1929 host target gene. NRF BINDING SITE is HOST TARGET binding site found in the 5' untranslated region of mRNA encoded by NRF, corresponding to a HOST TARGET binding site such as BINDING SITE I, BINDING SITE II or BINDING SITE III. Table 2 illustrates the complementarity of the nucleotide sequences of NRF BINDING SITE, designated SEQ ID:18989, to the nucleotide sequence of VGAM1929 RNA, herein designated VGAM RNA, also designated SEQ ID:4640.

Another function of VGAM1929 is therefore inhibition of NRF (Accession NM_017544). Accordingly, utilities of VGAM1929 include diagnosis, prevention and treatment of diseases and clinical conditions associated with NRF. NY-REN-25 (Accession XM_027116) is another VGAM1929 host target gene. NY-REN-25 BINDING SITE is HOST TARGET binding site found in the 3' untranslated region of mRNA encoded by NY-REN-25, corresponding to a HOST TARGET binding site such as BINDING SITE I, BINDING SITE II or BINDING SITE III. Table 2 illustrates the complementarity of the nucleotide sequences of NY-REN-25 BINDING SITE, designated SEQ ID:30416, to the nucleotide sequence of VGAM1929 RNA, herein designated VGAM RNA, also designated SEQ ID:4640.

Another function of VGAM1929 is therefore inhibition of NY-REN-25 (Accession XM_027116). Accordingly, utilities of VGAM1929 include diagnosis, prevention and treatment of diseases and clinical conditions associated with NY-REN-25. NY-REN-41 (Accession NM_080654) is another VGAM1929 host target gene. NY-REN-41 BINDING SITE is HOST TARGET binding site found in the 3' untranslated region of mRNA encoded by NY-REN-41, corresponding to a HOST TARGET binding site such as BINDING SITE I, BINDING SITE II or BINDING SITE III. Table 2 illustrates the complementarity of the nucleotide sequences of NY-REN-41 BINDING SITE, designated SEQ ID:27942, to the nucleotide sequence of VGAM1929 RNA, herein designated VGAM RNA, also designated SEQ ID:4640.

Another function of VGAM1929 is therefore inhibition of NY-REN-41 (Accession NM_080654). Accordingly, utilities of VGAM1929 include diagnosis, prevention and treatment of diseases and clinical conditions associated with NY-REN-41. Oxysterol Binding Protein-like 3 (OSBPL3, Accession NM_015550) is another VGAM1929 host target gene. OSBPL3 BINDING SITE is HOST TARGET binding site found in the 3' untranslated region of mRNA encoded by OSBPL3, corresponding to a HOST TARGET binding site such as BINDING SITE I, BINDING SITE II or BINDING SITE III. Table 2 illustrates the complementarity of the nucleotide sequences of OSBPL3 BINDING SITE, designated SEQ ID:17821, to the nucleotide sequence of VGAM1929 RNA, herein designated VGAM RNA, also designated SEQ ID:4640.

Another function of VGAM1929 is therefore inhibition of Oxysterol Binding Protein-like 3 (OSBPL3, Accession NM_015550). Accordingly, utilities of VGAM1929 include diagnosis, prevention and treatment of diseases and clinical conditions associated with OSBPL3. P450RAI-2 (Accession NM_019885) is another VGAM1929 host target gene. P450RAI-2 BINDING SITE is HOST TARGET binding site found in the 3' untranslated region of mRNA encoded by P450RAI-2, corresponding to a HOST TARGET binding site such as BINDING SITE I, BINDING SITE II or BINDING SITE III. Table 2 illustrates the complementarity of the nucleotide sequences of P450RAI-2 BINDING SITE, designated SEQ ID:21272, to the nucleotide sequence of VGAM1929 RNA, herein designated VGAM RNA, also designated SEQ ID:4640.

Another function of VGAM1929 is therefore inhibition of P450RAI-2 (Accession NM_019885). Accordingly, utilities of VGAM1929 include diagnosis, prevention and treatment of diseases and clinical conditions associated with P450RAI-2. poly (A) Binding Protein, Cytoplasmic 5 (PABPC5, Accession NM_080832) is another VGAM1929 host target gene. PABPC5 BINDING SITE is HOST TARGET binding site found in the 5' untranslated region of mRNA encoded by PABPC5, corresponding to a HOST TARGET binding site such as BINDING SITE I, BINDING SITE II or BINDING SITE III. Table 2 illustrates the complementarity of the nucleotide sequences of PABPC5 BINDING SITE, designated SEQ ID:28096, to the nucleotide sequence of VGAM1929 RNA, herein designated VGAM RNA, also designated SEQ ID:4640.

Another function of VGAM1929 is therefore inhibition of poly (A) Binding Protein, Cytoplasmic 5 (PABPC5, Accession NM_080832). Accordingly, utilities of VGAM1929 include diagnosis, prevention and treatment of diseases and clinical conditions associated with PABPC5. PC4 (Accession NM_006713) is another VGAM1929 host target gene. PC4 BINDING SITE is HOST TARGET binding site found in the 3' untranslated region of mRNA encoded by PC4, corresponding to a HOST TARGET binding site such as BINDING SITE I, BINDING SITE II or BINDING SITE III. Table 2 illustrates the complementarity of the nucleotide sequences of PC4 BINDING SITE, designated SEQ ID:13541, to the nucleotide sequence of VGAM1929 RNA, herein designated VGAM RNA, also designated SEQ ID:4640.

Another function of VGAM1929 is therefore inhibition of PC4 (Accession NM_006713). Accordingly, utilities of VGAM1929 include diagnosis, prevention and treatment of diseases and clinical conditions associated with PC4. Protocadherin 19 (PCDH19, Accession XM_033173) is another VGAM1929 host target gene. PCDH19 BINDING SITE is HOST TARGET binding site found in the 3' untranslated region of mRNA encoded by PCDH19, corresponding to a HOST TARGET binding site such as BINDING SITE I, BINDING SITE II or BINDING SITE III. Table 2 illustrates the complementarity of the nucleotide sequences of PCDH19 BINDING SITE, designated SEQ ID:31864, to the nucleotide sequence of VGAM1929 RNA, herein designated VGAM RNA, also designated SEQ ID:4640.

Another function of VGAM1929 is therefore inhibition of Protocadherin 19 (PCDH19, Accession XM_033173). Accordingly, utilities of VGAM1929 include diagnosis, prevention and treatment of diseases and clinical conditions associated with PCDH19. Period Homolog 3 (Drosophila) (PER3, Accession NM_016831) is another VGAM1929 host target gene. PER3 BINDING SITE is HOST TARGET binding site found in the 3' untranslated region of mRNA encoded by PER3, corresponding to a HOST TARGET binding site such as BINDING SITE I, BINDING SITE II or BINDING SITE III. Table 2 illustrates the complementarity of the nucleotide sequences of PER3 BINDING SITE, designated SEQ ID:18823, to the nucleotide sequence of VGAM1929 RNA, herein designated VGAM RNA, also designated SEQ ID:4640.

Another function of VGAM1929 is therefore inhibition of Period Homolog 3 (Drosophila) (PER3, Accession NM_016831). Accordingly, utilities of VGAM1929 include diagnosis, prevention and treatment of diseases and clinical conditions associated with PER3. Phytoceramidase, Alkaline (PHCA, Accession NM_018367) is another VGAM1929 host target gene. PHCA BINDING SITE is HOST TARGET binding site found in the 3' untranslated region of mRNA encoded by PHCA, corresponding to a HOST TARGET binding site such as BINDING SITE I, BINDING SITE II or BINDING SITE III. Table 2 illustrates the complementarity of the nucleotide sequences of PHCA BINDING SITE, designated SEQ ID:20379, to the nucleotide sequence of VGAM1929 RNA, herein designated VGAM RNA, also designated SEQ ID:4640.

Another function of VGAM1929 is therefore inhibition of Phytoceramidase, Alkaline (PHCA, Accession NM_018367). Accordingly, utilities of VGAM1929 include diagnosis, prevention and treatment of diseases and clinical conditions associated with PHCA. PHRET1 (Accession NM_021200) is another VGAM1929 host target gene. PHRET1 BINDING SITE is HOST TARGET binding site found in the 3' untranslated region of mRNA encoded by PHRET1, corresponding to a HOST TARGET binding site such as BINDING SITE I, BINDING SITE II or BINDING SITE III. Table 2 illustrates the complementarity of the nucleotide sequences of PHRET1 BINDING SITE, designated SEQ ID:22177, to the nucleotide sequence of VGAM1929 RNA, herein designated VGAM RNA, also designated SEQ ID:4640.

Another function of VGAM1929 is therefore inhibition of PHRET1 (Accession NM_021200). Accordingly, utilities of VGAM1929 include diagnosis, prevention and treatment of diseases and clinical conditions associated with PHRET1. Protease Inhibitor 15 (PI15, Accession NM_015886) is another VGAM1929 host target gene. PI15 BINDING SITE is HOST TARGET binding site found in the 5' untranslated region of mRNA encoded by PI15, corresponding to a HOST TARGET binding site such as BINDING SITE I, BINDING SITE II or BINDING SITE III. Table 2 illustrates the complementarity of the nucleotide sequences of PI15 BINDING SITE, designated SEQ ID:18030, to the nucleotide sequence of VGAM1929 RNA, herein designated VGAM RNA, also designated SEQ ID:4640.

Another function of VGAM1929 is therefore inhibition of Protease Inhibitor 15 (PI15, Accession NM_015886). Accordingly, utilities of VGAM1929 include diagnosis, prevention and treatment of diseases and clinical conditions associated with PI15. Phosphatidylinositol-4-phosphate 5-kinase, Type II, Beta (PIP5K2B, Accession NM_003559) is another VGAM1929 host target gene. PIP5K2B BINDING SITE is HOST TARGET binding site found in the 3' untranslated region of mRNA encoded by PIP5K2B, corresponding to a HOST TARGET binding site such as BINDING SITE I, BINDING SITE II or BINDING SITE III. Table 2 illustrates the complementarity of the nucleotide sequences of PIP5K2B BINDING SITE, designated SEQ ID:9610, to the nucleotide sequence of VGAM1929 RNA, herein designated VGAM RNA, also designated SEQ ID:4640.

Another function of VGAM1929 is therefore inhibition of Phosphatidylinositol-4-phosphate 5-kinase, Type II, Beta (PIP5K2B, Accession NM_003559). Accordingly, utilities of VGAM1929 include diagnosis, prevention and treatment of diseases and clinical conditions associated with PIP5K2B. PLPL (Accession NM_020181) is another VGAM1929 host target gene. PLPL BINDING SITE is HOST TARGET binding site found in the 3' untranslated region of mRNA encoded by PLPL, corresponding to a HOST TARGET binding site such as BINDING SITE I, BINDING SITE II or BINDING SITE III. Table 2 illustrates the complementarity of the nucleotide sequences of PLPL BINDING SITE, designated SEQ ID:21399, to the nucleotide sequence of VGAM1929 RNA, herein designated VGAM RNA, also designated SEQ ID:4640.

Another function of VGAM1929 is therefore inhibition of PLPL (Accession NM_020181). Accordingly, utilities of VGAM1929 include diagnosis, prevention and treatment of diseases and clinical conditions associated with PLPL. Paired Mesoderm Homeobox 2b (PMX2B, Accession NM_003924) is another VGAM1929 host target gene. PMX2B BINDING SITE is HOST TARGET binding site found in the 3' untranslated region of mRNA encoded by PMX2B, corresponding to a HOST TARGET binding site such as BINDING SITE I, BINDING SITE II or BINDING SITE III. Table 2 illustrates the complementarity of the nucleotide sequences of PMX2B BINDING SITE, designated SEQ ID:10016, to the nucleotide sequence of VGAM1929 RNA, herein designated VGAM RNA, also designated SEQ ID:4640.

Another function of VGAM1929 is therefore inhibition of Paired Mesoderm Homeobox 2b (PMX2B, Accession NM_003924). Accordingly, utilities of VGAM1929 include diagnosis, prevention and treatment of diseases and clinical conditions associated with PMX2B. Protein O-fucosyltransferase 1 (POFUT1, Accession XM_047011) is another VGAM1929 host target gene. POFUT1 BINDING SITE is HOST TARGET binding site found in the 3' untranslated region of mRNA encoded by POFUT1, corresponding to a HOST TARGET binding site such as BINDING SITE I, BINDING SITE II or BINDING SITE III. Table 2 illustrates the complementarity of the nucleotide sequences of POFUT1 BINDING SITE, designated SEQ ID:34885, to the nucleotide sequence of VGAM1929 RNA, herein designated VGAM RNA, also designated SEQ ID:4640.

Another function of VGAM1929 is therefore inhibition of Protein O-fucosyltransferase 1 (POFUT1, Accession XM_047011). Accordingly, utilities of VGAM1929 include diagnosis, prevention and treatment of diseases and clinical conditions associated with POFUT1. Protein Phosphatase 1, Regulatory (inhibitor) Subunit 1B (dopamine and cAMP regulated phosphoprotein, DARPP-32) (PPP1R1B, Accession NM_032192) is another VGAM1929 host target gene. PPP1R1B BINDING SITE is HOST TARGET binding site found in the 3' untranslated region of mRNA encoded by PPP1R1B, corresponding to a HOST TARGET binding site such as BINDING SITE I, BINDING SITE II or BINDING SITE III. Table 2 illustrates the complementarity of the nucleotide sequences of PPP1R1B BINDING SITE, designated SEQ ID:25907, to the nucleotide sequence of VGAM1929 RNA, herein designated VGAM RNA, also designated SEQ ID:4640.

Another function of VGAM1929 is therefore inhibition of Protein Phosphatase 1, Regulatory (inhibitor) Subunit 1B (dopamine and cAMP regulated phosphoprotein, DARPP-32) (PPP1R1B, Accession NM_032192). Accordingly, utilities of VGAM1929 include diagnosis, prevention and treatment of diseases and clinical conditions associated with PPP1R1B. Protein Phosphatase 1, Regulatory (inhibitor) Subunit 3B (PPP1R3B, Accession NM_024607) is another VGAM1929 host target gene. PPP1R3B BINDING SITE1 and PPP1R3B BINDING SITE2 are HOST TARGET binding sites found in untranslated regions of mRNA encoded by PPP1R3B, corresponding to HOST TARGET binding sites such as BINDING SITE I, BINDING SITE II or BINDING SITE III. Table 2 illustrates the complementarity of the nucleotide sequences of PPP1R3B BINDING SITE1 and PPP1R3B BINDING SITE2, designated SEQ ID:23861 and SEQ ID:23862 respectively, to the nucleotide sequence of VGAM1929 RNA, herein designated VGAM RNA, also designated SEQ ID:4640.

Another function of VGAM1929 is therefore inhibition of Protein Phosphatase 1, Regulatory (inhibitor) Subunit 3B (PPP1R3B, Accession NM_024607). Accordingly, utilities of VGAM1929 include diagnosis, prevention and treatment of diseases and clinical conditions associated with PPP1R3B. Preimplantation Protein 3 (PREI3, Accession XM_038960) is another VGAM1929 host target gene. PREI3 BINDING SITE is HOST TARGET binding site found in the 3' untranslated region of mRNA encoded by PREI3, corresponding to a HOST TARGET binding site such as BINDING SITE I, BINDING SITE II or BINDING SITE III. Table 2 illustrates the complementarity of the nucleotide sequences of PREI3 BINDING SITE, designated SEQ ID:32964, to the nucleotide sequence of VGAM1929 RNA, herein designated VGAM RNA, also designated SEQ ID:4640.

Another function of VGAM1929 is therefore inhibition of Preimplantation Protein 3 (PREI3, Accession XM_038960). Accordingly, utilities of VGAM1929 include diagnosis, prevention and treatment of diseases and clinical conditions associated with PREI3. PRMT3 (Accession XM_036392) is another VGAM1929 host target gene. PRMT3 BINDING SITE is HOST TARGET binding site found in the 3' untranslated region of mRNA encoded by PRMT3, corresponding to a HOST TARGET binding site such as BINDING SITE I, BINDING SITE II or BINDING SITE III. Table 2 illustrates the complementarity of the nucleotide sequences of PRMT3 BINDING SITE, designated SEQ ID:32437, to the nucleotide sequence of VGAM1929 RNA, herein designated VGAM RNA, also designated SEQ ID:4640.

Another function of VGAM1929 is therefore inhibition of PRMT3 (Accession XM_036392). Accordingly, utilities of VGAM1929 include diagnosis, prevention and treatment of diseases and clinical conditions associated with PRMT3. PRMT6 (Accession NM_018137) is another VGAM1929 host target gene. PRMT6 BINDING SITE is HOST TARGET binding site found in the 3' untranslated region of mRNA encoded by PRMT6, corresponding to a HOST TARGET binding site such as BINDING SITE I, BINDING SITE II or BINDING SITE III. Table 2 illustrates the complementarity of the nucleotide sequences of PRMT6 BINDING SITE, designated SEQ ID:19934, to the nucleotide sequence of VGAM1929 RNA, herein designated VGAM RNA, also designated SEQ ID:4640.

Another function of VGAM1929 is therefore inhibition of PRMT6 (Accession NM_018137). Accordingly, utilities of VGAM1929 include diagnosis, prevention and treatment of diseases and clinical conditions associated with PRMT6. PRO0246 (Accession NM_014123) is another VGAM1929 host target gene. PRO0246 BINDING SITE is HOST TARGET binding site found in the 5' untranslated region of mRNA encoded by PRO0246, corresponding to a HOST TARGET binding site such as BINDING SITE I, BINDING SITE II or BINDING SITE III. Table 2 illustrates the complementarity of the nucleotide sequences of PRO0246 BINDING SITE, designated SEQ ID:15381, to the nucleotide sequence of VGAM1929 RNA, herein designated VGAM RNA, also designated SEQ ID:4640.

Another function of VGAM1929 is therefore inhibition of PRO0246 (Accession NM_014123). Accordingly, utilities of VGAM1929 include diagnosis, prevention and treatment of diseases and clinical conditions associated with PRO0246. PRO0767 (Accession NM_014083) is another VGAM1929 host target gene. PRO0767 BINDING SITE is HOST TARGET binding site found in the 5' untranslated region of mRNA encoded by PRO0767, corresponding to a HOST TARGET binding site such as BINDING SITE I, BINDING SITE II or BINDING SITE III. Table 2 illustrates the complementarity of the nucleotide sequences of PRO0767 BINDING SITE, designated SEQ ID:15310, to the nucleotide sequence of VGAM1929 RNA, herein designated VGAM RNA, also designated SEQ ID:4640.

Another function of VGAM1929 is therefore inhibition of PRO0767 (Accession NM_014083). Accordingly, utilities of VGAM1929 include diagnosis, prevention and treatment of diseases and clinical conditions associated with PRO0767. Protein Tyrosine Phosphatase Type IVA, Member 1 (PTP4A1, Accession NM_003463) is another VGAM1929 host target gene. PTP4A1 BINDING SITE is HOST TARGET binding site found in the 3' untranslated region of mRNA encoded by PTP4A1, corresponding to a HOST TARGET binding site such as BINDING SITE I, BINDING SITE II or BINDING SITE III. Table 2 illustrates the complementarity of the nucleotide sequences of PTP4A1 BINDING SITE, designated SEQ ID:9533, to the nucleotide sequence of VGAM1929 RNA, herein designated VGAM RNA, also designated SEQ ID:4640.

Another function of VGAM1929 is therefore inhibition of Protein Tyrosine Phosphatase Type IVA, Member 1 (PTP4A1, Accession NM_003463). Accordingly, utilities of VGAM1929 include diagnosis, prevention and treatment of diseases and clinical conditions associated with PTP4A1. Rab11-FIP2 (Accession NM_014904) is another VGAM1929 host target gene. Rab11-FIP2 BINDING SITE is HOST TARGET binding site found in the 3' untranslated region of mRNA encoded by Rab11-FIP2, corresponding to a HOST TARGET binding site such as BINDING SITE I, BINDING SITE II or BINDING SITE III. Table 2 illustrates the complementarity of the nucleotide sequences of Rab11-FIP2 BINDING SITE, designated SEQ ID:17101, to the nucleotide sequence of VGAM1929 RNA, herein designated VGAM RNA, also designated SEQ ID:4640.

Another function of VGAM1929 is therefore inhibition of Rab11-FIP2 (Accession NM_014904). Accordingly, utilities of VGAM1929 include diagnosis, prevention and treatment of diseases and clinical conditions associated with Rab11-FIP2. RAB3GAP (Accession XM_040048) is another VGAM1929 host target gene. RAB3GAP BINDING SITE is HOST TARGET binding site found in the 3' untranslated region of mRNA encoded by RAB3GAP, corresponding to a HOST TARGET binding site such as BINDING SITE I, BINDING SITE II or BINDING SITE III. Table 2 illustrates the complementarity of the nucleotide sequences of RAB3GAP BINDING SITE, designated SEQ ID:33246, to the nucleotide sequence of VGAM1929 RNA, herein designated VGAM RNA, also designated SEQ ID:4640.

Another function of VGAM1929 is therefore inhibition of RAB3GAP (Accession XM_040048). Accordingly, utilities of VGAM1929 include diagnosis, prevention and treatment of diseases and clinical conditions associated with RAB3GAP. RAI (Accession NM_006663) is another VGAM1929 host target gene. RAI BINDING SITE is HOST TARGET binding site found in the 3' untranslated region of mRNA encoded by RAI, corresponding to a HOST TARGET binding site such as BINDING SITE I, BINDING SITE II or BINDING SITE III. Table 2 illustrates the complementarity of the nucleotide sequences of RAI BINDING SITE, designated SEQ ID:13474, to the nucleotide sequence of VGAM1929 RNA, herein designated VGAM RNA, also designated SEQ ID:4640.

Another function of VGAM1929 is therefore inhibition of RAI (Accession NM_006663). Accordingly, utilities of VGAM1929 include diagnosis, prevention and treatment of diseases and clinical conditions associated with RAI. Ras Association (RalGDS/AF-6) Domain Family 2 (RASSF2, Accession NM_014737) is another VGAM1929 host target gene. RASSF2 BINDING SITE is HOST TARGET binding site found in the 3' untranslated region of mRNA encoded by RASSF2, corresponding to a HOST TARGET binding site such as BINDING SITE I, BINDING SITE II or BINDING SITE III. Table 2 illustrates the complementarity of the nucleotide sequences of RASSF2 BINDING SITE, designated SEQ ID:16401, to the nucleotide sequence of VGAM1929 RNA, herein designated VGAM RNA, also designated SEQ ID:4640.

Another function of VGAM1929 is therefore inhibition of Ras Association (RalGDS/AF-6) Domain Family 2 (RASSF2, Accession NM_014737). Accordingly, utilities of VGAM1929 include diagnosis, prevention and treatment of diseases and clinical conditions associated with RASSF2. RAS-like, Estrogen-regulated, Growth-inhibitor (RERG, Accession NM_032918) is another VGAM1929 host target gene. RERG BINDING SITE is HOST TARGET binding site found in the 3' untranslated region of mRNA encoded by RERG, corresponding to a HOST TARGET binding site such as BINDING SITE I, BINDING SITE II or BINDING SITE III. Table 2 illustrates the complementarity of the nucleotide sequences of RERG BINDING SITE, designated SEQ ID:26740, to the nucleotide sequence of VGAM1929 RNA, herein designated VGAM RNA, also designated SEQ ID:4640.

Another function of VGAM1929 is therefore inhibition of RAS-like, Estrogen-regulated, Growth-inhibitor (RERG, Accession NM_032918). Accordingly, utilities of VGAM1929 include diagnosis, prevention and treatment of diseases and clinical conditions associated with RERG. Rho-related BTB Domain Containing 3 (RHOBTB3, Accession NM_014899) is another VGAM1929 host target gene. RHOBTB3 BINDING SITE is HOST TARGET binding site found in the 3' untranslated region of mRNA encoded by RHOBTB3, corresponding to a HOST TARGET binding site such as BINDING SITE I, BINDING SITE II or BINDING SITE III. Table 2 illustrates the complementarity of the nucleotide sequences of RHOBTB3 BINDING SITE, designated SEQ ID:17079, to the nucleotide sequence of VGAM1929 RNA, herein designated VGAM RNA, also designated SEQ ID:4640.

Another function of VGAM1929 is therefore inhibition of Rho-related BTB Domain Containing 3 (RHOBTB3, Accession NM_014899). Accordingly, utilities of VGAM1929 include diagnosis, prevention and treatment of diseases and clinical conditions associated with RHOBTB3. RI58 (Accession NM_012420) is another VGAM1929 host target gene. RI58 BINDING SITE is HOST TARGET binding site found in the 3' untranslated region of mRNA encoded by RI58, corresponding to a HOST TARGET binding site such as BINDING SITE I, BINDING SITE II or BINDING SITE III. Table 2 illustrates the complementarity of the nucleotide sequences of RI58 BINDING SITE, designated SEQ ID:14796, to the nucleotide sequence of VGAM1929 RNA, herein designated VGAM RNA, also designated SEQ ID:4640.

Another function of VGAM1929 is therefore inhibition of RI58 (Accession NM_012420). Accordingly, utilities of VGAM1929 include diagnosis, prevention and treatment of diseases and clinical conditions associated with RI58. RNAHP (Accession NM_007372) is another VGAM1929 host target gene. RNAHP BINDING SITE is HOST TARGET binding site found in the 3' untranslated region of mRNA encoded by RNAHP, corresponding to a HOST TARGET binding site such as BINDING SITE I, BINDING SITE II or BINDING SITE III. Table 2 illustrates the complementarity of the nucleotide sequences of RNAHP BINDING SITE, designated SEQ ID:14302, to the nucleotide sequence of VGAM1929 RNA, herein designated VGAM RNA, also designated SEQ ID:4640.

Another function of VGAM1929 is therefore inhibition of RNAHP (Accession NM_007372). Accordingly, utilities of VGAM1929 include diagnosis, prevention and treatment of diseases and clinical conditions associated with RNAHP. Ring Finger Protein 2 (RNF2, Accession NM_007212) is another VGAM1929 host target gene. RNF2 BINDING SITE is HOST TARGET binding site found in the 3' untranslated region of mRNA encoded by RNF2, corresponding to a HOST TARGET binding site such as BINDING SITE I, BINDING SITE II or BINDING SITE III. Table 2 illustrates the complementarity of the nucleotide sequences of RNF2 BINDING SITE, designated SEQ ID:14075, to the nucleotide sequence of VGAM1929 RNA, herein designated VGAM RNA, also designated SEQ ID:4640.

Another function of VGAM1929 is therefore inhibition of Ring Finger Protein 2 (RNF2, Accession NM_007212). Accordingly, utilities of VGAM1929 include diagnosis, prevention and treatment of diseases and clinical conditions associated with RNF2. RNA Binding Protein S1, Serine-rich Domain (RNPS1, Accession NM_006711) is another VGAM1929 host target gene. RNPS1 BINDING SITE1 and RNPS1 BINDING SITE2 are HOST TARGET binding sites found in untranslated regions of mRNA encoded by RNPS1, corresponding to HOST TARGET binding sites such as BINDING SITE I, BINDING SITE II or BINDING SITE III. Table 2 illustrates the complementarity of the nucleotide sequences of RNPS1 BINDING SITE1 and RNPS1 BINDING SITE2, designated SEQ ID:13539 and SEQ ID:27904 respectively, to the nucleotide sequence of VGAM1929 RNA, herein designated VGAM RNA, also designated SEQ ID:4640.

Another function of VGAM1929 is therefore inhibition of RNA Binding Protein S1, Serine-rich Domain (RNPS1, Accession NM_006711). Accordingly, utilities of VGAM1929 include diagnosis, prevention and treatment of diseases and clinical conditions associated with RNPS1. SCAN Domain Containing 2 (SCAND2, Accession NM_022050) is another VGAM1929 host target gene. SCAND2 BINDING SITE is HOST TARGET binding site found in the 3' untranslated region of mRNA encoded by SCAND2, corresponding to a HOST TARGET binding site such as BINDING SITE I, BINDING SITE II or BINDING SITE III. Table 2 illustrates the complementarity of the nucleotide sequences of SCAND2 BINDING SITE, designated SEQ ID:22575, to the nucleotide sequence of VGAM1929 RNA, herein designated VGAM RNA, also designated SEQ ID:4640.

Another function of VGAM1929 is therefore inhibition of SCAN Domain Containing 2 (SCAND2, Accession NM_022050). Accordingly, utilities of VGAM1929 include diagnosis, prevention and treatment of diseases and clinical conditions associated with SCAND2. SEC63L (Accession NM_007214) is another VGAM1929 host target gene. SEC63L BINDING SITE is HOST TARGET binding site found in the 3' untranslated region of mRNA encoded by SEC63L, corresponding to a HOST TARGET binding site such as BINDING SITE I, BINDING SITE II or BINDING SITE III. Table 2 illustrates the complementarity of the nucleotide sequences of SEC63L BINDING SITE, designated SEQ ID:14080, to the nucleotide sequence of VGAM1929 RNA, herein designated VGAM RNA, also designated SEQ ID:4640.

Another function of VGAM1929 is therefore inhibition of SEC63L (Accession NM_007214). Accordingly, utilities of VGAM1929 include diagnosis, prevention and treatment of diseases and clinical conditions associated with SEC63L. SH3 Domain Binding Glutamic Acid-rich Protein Like (SH3BGRL, Accession XM_030373) is another VGAM1929 host target gene. SH3BGRL BINDING SITE is HOST TARGET binding site found in the 3' untranslated region of mRNA encoded by SH3BGRL, corresponding to a HOST TARGET binding site such as BINDING SITE I, BINDING SITE II or BINDING SITE III. Table 2 illustrates the complementarity of the nucleotide sequences of SH3BGRL BINDING SITE, designated SEQ ID:31024, to the nucleotide sequence of VGAM1929 RNA, herein designated VGAM RNA, also designated SEQ ID:4640.

Another function of VGAM1929 is therefore inhibition of SH3 Domain Binding Glutamic Acid-rich Protein Like (SH3BGRL, Accession XM_030373). Accordingly, utilities of VGAM1929 include diagnosis, prevention and treatment of diseases and clinical conditions associated with SH3BGRL. SH3 Domain Binding Glutamic Acid-rich Protein Like 2 (SH3BGRL2, Accession NM_031469) is another VGAM1929 host target gene. SH3BGRL2 BINDING SITE is HOST TARGET binding site found in the 3" untranslated region of mRNA encoded by SH3BGRL2, corresponding to a HOST TARGET binding site such as BINDING SITE I, BINDING SITE II or BINDING SITE III. Table 2 illustrates the complementarity of the nucleotide sequences of SH3BGRL2 BINDING SITE, designated SEQ ID:25530, to the nucleotide sequence of VGAM1929 RNA, herein designated VGAM RNA, also designated SEQ ID:4640.

Another function of VGAM1929 is therefore inhibition of SH3 Domain Binding Glutamic Acid-rich Protein Like 2 (SH3BGRL2, Accession NM_031469). Accordingly, utilities of VGAM1929 include diagnosis, prevention and treatment of diseases and clinical conditions associated with SH3BGRL2. Solute Carrier Family 11 (proton-coupled divalent metal ion transporters), Member 2 (SLC11A2, Accession NM_000617) is another VGAM1929 host target gene. SLC11A2 BINDING SITE is HOST TARGET binding site found in the 3' untranslated region of mRNA encoded by SLC11A2, corresponding to a HOST TARGET binding site such as BINDING SITE I, BINDING SITE II or BINDING SITE III. Table 2 illustrates the complementarity of the nucleotide sequences of SLC11A2 BINDING SITE, designated SEQ ID:6224, to the nucleotide sequence of VGAM1929 RNA, herein designated VGAM RNA, also designated SEQ ID:4640.

Another function of VGAM1929 is therefore inhibition of Solute Carrier Family 11 (proton-coupled divalent metal ion transporters), Member 2 (SLC11A2, Accession NM_000617). Accordingly, utilities of VGAM1929 include diagnosis, prevention and treatment of diseases and clinical conditions associated with SLC11A2. SWI/SNF Related, Matrix Associated, Actin Dependent Regulator of Chromatin, Subfamily F, Member 1 (SMARCF1, Accession NM_018450) is another VGAM1929 host target gene. SMARCF1 BINDING SITE1 through SMARCF1 BINDING SITE3 are HOST TARGET binding sites found in untranslated regions of mRNA encoded by SMARCF1, corresponding to HOST TARGET binding sites such as BINDING SITE I, BINDING SITE II or BINDING SITE III. Table 2 illustrates the complementarity of the nucleotide sequences of SMARCF1 BINDING SITE1 through SMARCF1 BINDING SITE3, designated SEQ ID:20519, SEQ ID:29162 and SEQ ID:12624 respectively, to the nucleotide sequence of VGAM1929 RNA, herein designated VGAM RNA, also designated SEQ ID:4640.

Another function of VGAM1929 is therefore inhibition of SWI/SNF Related, Matrix Associated, Actin Dependent Regulator of Chromatin, Subfamily F, Member 1 (SMARCF1, Accession NM_018450). Accordingly, utilities of VGAM1929 include diagnosis, prevention and treatment of diseases and clinical conditions associated with SMARCF1. Serine Palmitoyltransferase, Long Chain Base Subunit 2 (SPTLC2, Accession NM_004863) is another VGAM1929 host target gene. SPTLC2 BINDING SITE1 and SPTLC2 BINDING SITE2 are HOST TARGET binding sites found in untranslated regions of mRNA encoded by SPTLC2, corresponding to HOST TARGET binding sites such as BINDING SITE I, BINDING SITE II or BINDING SITE III. Table 2 illustrates the complementarity of the nucleotide sequences of SPTLC2 BINDING SITE1 and SPTLC2 BINDING SITE2, designated SEQ ID:11279 and SEQ ID:11280 respectively, to the nucleotide sequence of VGAM1929 RNA, herein designated VGAM RNA, also designated SEQ ID:4640.

Another function of VGAM1929 is therefore inhibition of Serine Palmitoyltransferase, Long Chain Base Subunit 2 (SPTLC2, Accession NM_004863). Accordingly, utilities of VGAM1929 include diagnosis, prevention and treatment of diseases and clinical conditions associated with SPTLC2. Suppression of Tumorigenicity 13 (colon carcinoma) (Hsp70 interacting protein) (ST13, Accession NM_003932) is another VGAM1929 host target gene. ST13 BINDING SITE is HOST TARGET binding site found in the 3' untranslated region of mRNA encoded by ST13, corresponding to a HOST TARGET binding site such as BINDING SITE I, BINDING SITE II or BINDING SITE III. Table 2 illustrates the complementarity of the nucleotide sequences of ST13 BINDING SITE, designated SEQ ID:10035, to the nucleotide sequence of VGAM1929 RNA, herein designated VGAM RNA, also designated SEQ ID:4640.

Another function of VGAM1929 is therefore inhibition of Suppression of Tumorigenicity 13 (colon carcinoma) (Hsp70 interacting protein) (ST13, Accession NM_003932). Accordingly, utilities of VGAM1929 include diagnosis, prevention and treatment of diseases and clinical conditions associated with ST13. Suppression of Tumorigenicity 7 Like (ST7L, Accession NM_017744) is another VGAM1929 host target gene. ST7L BINDING SITE1 through ST7L BINDING SITE3 are HOST TARGET binding sites found in untranslated regions of mRNA encoded by ST7L, corresponding to HOST TARGET binding sites such as BINDING SITE I, BINDING SITE II or BINDING SITE III. Table 2 illustrates the complementarity of the nucleotide sequences of ST7L BINDING SITE1 through ST7L BINDING SITE3, designated SEQ ID:19338, SEQ ID:29211 and SEQ ID:28980 respectively, to the nucleotide sequence of VGAM1929 RNA, herein designated VGAM RNA, also designated SEQ ID:4640.

Another function of VGAM1929 is therefore inhibition of Suppression of Tumorigenicity 7 Like (ST7L, Accession NM_017744). Accordingly, utilities of VGAM1929 include diagnosis, prevention and treatment of diseases and clinical conditions associated with ST7L. Signal Transducer and Activator of Transcription 5A (STAT5A, Accession NM_003152) is another VGAM1929 host target gene. STAT5A BINDING SITE is HOST TARGET binding site found in the 3' untranslated region of mRNA encoded by STAT5A, corresponding to a HOST TARGET binding site such as BINDING SITE I, BINDING SITE II or BINDING SITE III. Table 2 illustrates the complementarity of the nucleotide sequences of STAT5A BINDING SITE, designated SEQ ID:9128, to the nucleotide sequence of VGAM1929 RNA, herein designated VGAM RNA, also designated SEQ ID:4640.

Another function of VGAM1929 is therefore inhibition of Signal Transducer and Activator of Transcription 5A (STAT5A, Accession NM_003152). Accordingly, utilities of VGAM1929 include diagnosis, prevention and treatment of diseases and clinical conditions associated with STAT5A. Serine/threonine Kinase 36 (fused homolog, Drosophila) (STK36, Accession XM_050803) is another VGAM1929 host target gene. STK36 BINDING SITE is HOST TARGET binding site found in the 3' untranslated region of mRNA encoded by STK36, corresponding to a HOST TARGET binding site such as BINDING SITE I, BINDING SITE II or BINDING SITE III. Table 2 illustrates the complementarity of the nucleotide sequences of STK36 BINDING SITE, designated SEQ ID:35691, to the nucleotide sequence of VGAM1929 RNA, herein designated VGAM RNA, also designated SEQ ID:4640.

Another function of VGAM1929 is therefore inhibition of Serine/threonine Kinase 36 (fused homolog, Drosophila) (STK36, Accession XM_050803). Accordingly, utilities of VGAM1929 include diagnosis, prevention and treatment of diseases and clinical conditions associated with STK36. STRIN (Accession NM_016271) is another VGAM1929 host target gene. STRIN BINDING SITE is HOST TARGET binding site found in the 3' untranslated region of mRNA encoded by STRIN, corresponding to a HOST TARGET binding site such as BINDING SITE I, BINDING SITE II or BINDING SITE III. Table 2 illustrates the complementarity of the nucleotide sequences of STRIN BINDING SITE, designated SEQ ID:18395, to the nucleotide sequence of VGAM1929 RNA, herein designated VGAM RNA, also designated SEQ ID:4640.

Another function of VGAM1929 is therefore inhibition of STRIN (Accession NM_016271). Accordingly, utilities of VGAM1929 include diagnosis, prevention and treatment of diseases and clinical conditions associated with STRIN. Striatin, Calmodulin Binding Protein 3 (STRN3, Accession NM_014574) is another VGAM1929 host target gene. STRN3 BINDING SITE is HOST TARGET binding site found in the 3' untranslated region of mRNA encoded by STRN3, corresponding to a HOST TARGET binding site such as BINDING SITE I, BINDING SITE II or BINDING SITE III. Table 2 illustrates the complementarity of the nucleotide sequences of STRN3 BINDING SITE, designated SEQ ID:15936, to the nucleotide sequence of VGAM1929 RNA, herein designated VGAM RNA, also designated SEQ ID:4640.

Another function of VGAM1929 is therefore inhibition of Striatin, Calmodulin Binding Protein 3 (STRN3, Accession NM_014574). Accordingly, utilities of VGAM1929 include diagnosis, prevention and treatment of diseases and clinical conditions associated with STRN3. Synaptophysin-like Protein (SYPL, Accession XM_167511) is another VGAM1929 host target gene. SYPL BINDING SITE is HOST TARGET binding site found in the 3' untranslated region of mRNA encoded by SYPL, corresponding to a HOST TARGET binding site such as BINDING SITE I, BINDING SITE II or BINDING SITE III. Table 2 illustrates the complementarity of the nucleotide sequences of SYPL BINDING SITE, designated SEQ ID:44646, to the nucleotide sequence of VGAM1929 RNA, herein designated VGAM RNA, also designated SEQ ID:4640.

Another function of VGAM1929 is therefore inhibition of Synaptophysin-like Protein (SYPL, Accession XM_167511). Accordingly, utilities of VGAM1929 include diagnosis, prevention and treatment of diseases and clinical conditions associated with SYPL. Synaptotagmin-like 2 (SYTL2, Accession NM_032943) is another VGAM1929 host target gene. SYTL2 BINDING SITE is HOST TARGET binding site found in the 5' untranslated region of mRNA encoded by SYTL2, corresponding to a HOST TARGET binding site such as BINDING SITE I, BINDING SITE II or BINDING SITE III. Table 2 illustrates the complementarity of the nucleotide sequences of SYTL2 BINDING SITE, designated SEQ ID:26760, to the nucleotide sequence of VGAM1929 RNA, herein designated VGAM RNA, also designated SEQ ID:4640.

Another function of VGAM1929 is therefore inhibition of Synaptotagmin-like 2 (SYTL2, Accession NM_032943). Accordingly, utilities of VGAM1929 include diagnosis, prevention and treatment of diseases and clinical conditions associated with SYTL2. TA-PP2C (Accession NM_139283) is another VGAM1929 host target gene. TA-PP2C BINDING SITE is HOST TARGET binding site found in the 3' untranslated region of mRNA encoded by TA-PP2C, corresponding to a HOST TARGET binding site such as BINDING SITE I, BINDING SITE II or BINDING SITE III. Table 2 illustrates the complementarity of the nucleotide sequences of TA-PP2C BINDING SITE, designated SEQ ID:29286, to the nucleotide sequence of VGAM1929 RNA, herein designated VGAM RNA, also designated SEQ ID:4640.

Another function of VGAM1929 is therefore inhibition of TA-PP2C (Accession NM_139283). Accordingly, utilities of VGAM1929 include diagnosis, prevention and treatment of diseases and clinical conditions associated with TA-PP2C. TAF5-like RNA Polymerase II, P300/CBP-associated Factor (PCAF)-associated Factor, 65 kDa (TAF5L, Accession NM_014409) is another VGAM1929 host target gene. TAF5L BINDING SITE is HOST TARGET binding site found in the 3' untranslated region of mRNA encoded by TAF5L, corresponding to a HOST TARGET binding site such as BINDING SITE I, BINDING SITE II or BINDING SITE III. Table 2 illustrates the complementarity of the nucleotide sequences of TAF5L BINDING SITE, designated SEQ ID:15750, to the nucleotide sequence of VGAM1929 RNA, herein designated VGAM RNA, also designated SEQ ID:4640.

Another function of VGAM1929 is therefore inhibition of TAF5-like RNA Polymerase II, P300/CBP-associated Factor (PCAF)-associated Factor, 65 kDa (TAF5L, Accession NM_014409). Accordingly, utilities of VGAM1929 include diagnosis, prevention and treatment of diseases and clinical conditions associated with TAF5L. TAF9-like RNA Polymerase II, TATA Box Binding Protein (TBP)-associated Factor, 31 kDa (TAF9L, Accession NM_015975) is another VGAM1929 host target gene. TAF9L BINDING SITE is HOST TARGET binding site found in the 3' untranslated region of mRNA encoded by TAF9L, corresponding to a HOST TARGET binding site such as BINDING SITE I, BINDING SITE II or BINDING SITE III. Table 2 illustrates the complementarity of the nucleotide sequences of TAF9L BINDING SITE, designated SEQ ID:18076, to the nucleotide sequence of VGAM1929 RNA, herein designated VGAM RNA, also designated SEQ ID:4640.

Another function of VGAM1929 is therefore inhibition of TAF9-like RNA Polymerase II, TATA Box Binding Protein (TBP)-associated Factor, 31 kDa (TAF9L, Accession NM_015975). Accordingly, utilities of VGAM1929 include diagnosis, prevention and treatment of diseases and clinical conditions associated with TAF9L. TBDN100 (Accession NM_025085) is another VGAM1929 host target gene. TBDN100 BINDING SITE is HOST TARGET binding site found in the 3' untranslated region of mRNA encoded by TBDN100, corresponding to a HOST TARGET binding site such as BINDING SITE I, BINDING SITE II or BINDING SITE III. Table 2 illustrates the complementarity of the nucleotide sequences of TBDN100 BINDING SITE, designated SEQ ID:24695, to the nucleotide sequence of VGAM1929 RNA, herein designated VGAM RNA, also designated SEQ ID:4640.

Another function of VGAM1929 is therefore inhibition of TBDN100 (Accession NM_025085). Accordingly, utilities of VGAM1929 include diagnosis, prevention and treatment of diseases and clinical conditions associated with TBDN100. Transcription Factor-like 5 (basic helix-loop-helix) (TCFL5, Accession NM_006602) is another VGAM1929 host target gene. TCFL5 BINDING SITE is HOST TARGET binding site found in the 3' untranslated region of mRNA encoded by TCFL5, corresponding to a HOST TARGET binding site such as BINDING SITE I, BINDING SITE II or BINDING SITE III. Table 2 illustrates the complementarity of the nucleotide sequences of TCFL5 BINDING SITE, designated SEQ ID:13382, to the nucleotide sequence of VGAM1929 RNA, herein designated VGAM RNA, also designated SEQ ID:4640.

Another function of VGAM1929 is therefore inhibition of Transcription Factor-like 5 (basic helix-loop-helix) (TCFL5, Accession NM_006602). Accordingly, utilities of VGAM1929 include diagnosis, prevention and treatment of diseases and clinical conditions associated with TCFL5. T-cell Leukemia/lymphoma 6 (TCL6, Accession NM_012468) is another VGAM1929 host target gene. TCL6 BINDING SITE1 through TCL6 BINDING SITE4 are HOST TARGET binding sites found in untranslated regions of mRNA encoded by TCL6, corresponding to HOST TARGET binding sites such as BINDING SITE I, BINDING SITE II or BINDING SITE III. Table 2 illustrates the complementarity of the nucleotide sequences of TCL6 BINDING SITE1 through TCL6 BINDING SITE4, designated SEQ ID:14846, SEQ ID:15770, SEQ ID:21772 and SEQ ID:21763 respectively, to the nucleotide sequence of VGAM1929 RNA, herein designated VGAM RNA, also designated SEQ ID:4640.

Another function of VGAM1929 is therefore inhibition of T-cell Leukemia/lymphoma 6 (TCL6, Accession NM_012468). Accordingly, utilities of VGAM1929 include diagnosis, prevention and treatment of diseases and clinical conditions associated with TCL6. TIP-1 (Accession NM_014604) is another VGAM1929 host target gene. TIP-1 BINDING SITE is HOST TARGET binding site found in the 3' untranslated region of mRNA encoded by TIP-1, corresponding to a HOST TARGET binding site such as BINDING SITE I, BINDING SITE II or BINDING SITE III. Table 2 illustrates the complementarity of the nucleotide sequences of TIP-1 BINDING SITE, designated SEQ ID:15966, to the nucleotide sequence of VGAM1929 RNA, herein designated VGAM RNA, also designated SEQ ID:4640.

Another function of VGAM1929 is therefore inhibition of TIP-1 (Accession NM_014604). Accordingly, utilities of VGAM1929 include diagnosis, prevention and treatment of diseases and clinical conditions associated with TIP-1. Trinucleotide Repeat Containing 5 (TNRC5, Accession NM_006586) is another VGAM1929 host target gene. TNRC5 BINDING SITE is HOST TARGET binding site found in the 5' untranslated region of mRNA encoded by TNRC5, corresponding to a HOST TARGET binding site such as BINDING SITE I, BINDING SITE II or BINDING SITE III. Table 2 illustrates the complementarity of the nucleotide sequences of TNRC5 BINDING SITE, designated SEQ ID:13346, to the nucleotide sequence of VGAM1929 RNA, herein designated VGAM RNA, also designated SEQ ID:4640.

Another function of VGAM1929 is therefore inhibition of Trinucleotide Repeat Containing 5 (TNRC5, Accession NM_006586). Accordingly, utilities of VGAM1929 include diagnosis, prevention and treatment of diseases and clinical conditions associated with TNRC5. Transducer of ERBB2, 2 (TOB2, Accession XM_170995) is another VGAM1929 host target gene. TOB2 BINDING SITE is HOST TARGET binding site found in the 3' untranslated region of mRNA encoded by TOB2, corresponding to a HOST TARGET binding site such as BINDING SITE I, BINDING SITE II or BINDING SITE III. Table 2 illustrates the complementarity of the nucleotide sequences of TOB2 BINDING SITE, designated SEQ ID:45768, to the nucleotide sequence of VGAM1929 RNA, herein designated VGAM RNA, also designated SEQ ID:4640.

Another function of VGAM1929 is therefore inhibition of Transducer of ERBB2, 2 (TOB2, Accession XM_170995). Accordingly, utilities of VGAM1929 include diagnosis, prevention and treatment of diseases and clinical conditions associated with TOB2. TOLLIP (Accession NM_019009) is another VGAM1929 host target gene. TOLLIP BINDING SITE is HOST TARGET binding site found in the 3' untranslated region of mRNA encoded by TOLLIP, corresponding to a HOST TARGET binding site such as BINDING SITE I, BINDING SITE II or BINDING SITE III. Table 2 illustrates the complementarity of the nucleotide sequences of TOLLIP BINDING SITE, designated SEQ ID:21093, to the nucleotide sequence of VGAM1929 RNA, herein designated VGAM RNA, also designated SEQ ID:4640.

Another function of VGAM1929 is therefore inhibition of TOLLIP (Accession NM_019009). Accordingly, utilities of VGAM1929 include diagnosis, prevention and treatment of diseases and clinical conditions associated with TOLLIP. TOPK (Accession NM_018492) is another VGAM1929 host target gene. TOPK BINDING SITE is HOST TARGET binding site found in the 3' untranslated region of mRNA encoded by TOPK, corresponding to a HOST TARGET binding site such as BINDING SITE I, BINDING SITE II or BINDING SITE III. Table 2 illustrates the complementarity of the nucleotide sequences of TOPK BINDING SITE, designated SEQ ID:20554, to the nucleotide sequence of VGAM1929 RNA, herein designated VGAM RNA, also designated SEQ ID:4640.

Another function of VGAM1929 is therefore inhibition of TOPK (Accession NM_018492). Accordingly, utilities of VGAM1929 include diagnosis, prevention and treatment of diseases and clinical conditions associated with TOPK. Testis-specific Transcript, Y-linked 9 (TTTY9, Accession NM_031927) is another VGAM1929 host target gene. TTTY9 BINDING SITE is HOST TARGET binding site found in the 3' untranslated region of mRNA encoded by TTTY9, corresponding to a HOST TARGET binding site such as BINDING SITE I, BINDING SITE II or BINDING SITE III. Table 2 illustrates the complementarity of the nucleotide sequences of TTTY9 BINDING SITE, designated SEQ ID:25679, to the nucleotide sequence of VGAM1929 RNA, herein designated VGAM RNA, also designated SEQ ID:4640.

Another function of VGAM1929 is therefore inhibition of Testis-specific Transcript, Y-linked 9 (TTTY9, Accession NM_031927). Accordingly, utilities of VGAM1929 include diagnosis, prevention and treatment of diseases and clinical conditions associated with TTTY9. Ubiquitin-conjugating Enzyme E2G 1 (UBC7 homolog, C. elegans) (UBE2G1, Accession NM_003342) is another VGAM1929 host target gene. UBE2G1 BINDING SITE is HOST TARGET binding site found in the 3' untranslated region of mRNA encoded by UBE2G1, corresponding to a HOST TARGET binding site such as BINDING SITE I, BINDING SITE II or BINDING SITE III. Table 2 illustrates the complementarity of the nucleotide sequences of UBE2G1 BINDING SITE, designated SEQ ID:9349, to the nucleotide sequence of VGAM1929 RNA, herein designated VGAM RNA, also designated SEQ ID:4640.

Another function of VGAM1929 is therefore inhibition of Ubiquitin-conjugating Enzyme E2G 1 (UBC7 homolog, C. elegans) (UBE2G1, Accession NM_003342). Accordingly, utilities of VGAM1929 include diagnosis, prevention and treatment of diseases and clinical conditions associated with UBE2G1. Unc-5 Homolog D (C. elegans) (UNC5D, Accession NM_080872) is another VGAM1929 host target gene. UNC5D BINDING SITE is HOST TARGET binding site found in the 3' untranslated region of mRNA encoded by UNC5D, corresponding to a HOST TARGET binding site such as BINDING SITE I, BINDING SITE II or BINDING SITE III. Table 2 illustrates the complementarity of the nucleotide sequences of UNC5D BINDING SITE, designated SEQ ID:28116, to the nucleotide sequence of VGAM1929 RNA, herein designated VGAM RNA, also designated SEQ ID:4640.

Another function of VGAM1929 is therefore inhibition of Unc-5 Homolog D (C. elegans) (UNC5D, Accession NM_080872). Accordingly, utilities of VGAM1929 include diagnosis, prevention and treatment of diseases and clinical conditions associated with UNC5D. Ubiquitin Specific Protease 15 (USP15, Accession NM_006313) is another VGAM1929 host target gene. USP15 BINDING SITE is HOST TARGET binding site found in the 3' untranslated region of mRNA encoded by USP15, corresponding to a HOST TARGET binding site such as BINDING SITE I, BINDING SITE II or BINDING SITE III. Table 2 illustrates the complementarity of the nucleotide sequences of USP15 BINDING SITE, designated SEQ ID:13007, to the nucleotide sequence of VGAM1929 RNA, herein designated VGAM RNA, also designated SEQ ID:4640.

Another function of VGAM1929 is therefore inhibition of Ubiquitin Specific Protease 15 (USP15, Accession NM_006313). Accordingly, utilities of VGAM1929 include diagnosis, prevention and treatment of diseases and clinical conditions associated with USP15. Ubiquitin Specific Protease 25 (USP25, Accession NM_013396) is another VGAM1929 host target gene. USP25 BINDING SITE is HOST TARGET binding site found in the 3' untranslated region of mRNA encoded by USP25, corresponding to a HOST TARGET binding site such as BINDING SITE I, BINDING SITE II or BINDING SITE III. Table 2 illustrates the complementarity of the nucleotide sequences of USP25 BINDING SITE, designated SEQ ID:15049, to the nucleotide sequence of VGAM1929 RNA, herein designated VGAM RNA, also designated SEQ ID:4640.

Another function of VGAM1929 is therefore inhibition of Ubiquitin Specific Protease 25 (USP25, Accession NM_013396). Accordingly, utilities of VGAM1929 include diagnosis, prevention and treatment of diseases and clinical conditions associated with USP25. Ubiquitin Specific Protease 8 (USP8, Accession NM_005154) is another VGAM1929 host target gene. USP8 BINDING SITE is HOST TARGET binding site found in the 3' untranslated region of mRNA encoded by USP8, corresponding to a HOST TARGET binding site such as BINDING SITE I, BINDING SITE II or BINDING SITE III. Table 2 illustrates the complementarity of the nucleotide sequences of USP8 BINDING SITE, designated SEQ ID:11630, to the nucleotide sequence of VGAM1929 RNA, herein designated VGAM RNA, also designated SEQ ID:4640.

Another function of VGAM1929 is therefore inhibition of Ubiquitin Specific Protease 8 (USP8, Accession NM_005154). Accordingly, utilities of VGAM1929 include diagnosis, prevention and treatment of diseases and clinical conditions associated with USP8. VEZATIN (Accession NM_017599) is another VGAM1929 host target gene. VEZATIN BINDING SITE is HOST TARGET binding site found in the 3' untranslated region of mRNA encoded by VEZATIN, corresponding to a HOST TARGET binding site such as BINDING SITE I, BINDING SITE II or BINDING SITE III. Table 2 illustrates the complementarity of the nucleotide sequences of VEZATIN BINDING SITE, designated SEQ ID:19073, to the nucleotide sequence of VGAM1929 RNA, herein designated VGAM RNA, also designated SEQ ID:4640.

Another function of VGAM1929 is therefore inhibition of VEZATIN (Accession NM_017599). Accordingly, utilities of VGAM1929 include diagnosis, prevention and treatment of diseases and clinical conditions associated with VEZATIN. VMP1 (Accession NM_030938) is another VGAM1929 host target gene. VMP1 BINDING SITE is HOST TARGET binding site found in the 3' untranslated region of mRNA encoded by VMP1, corresponding to a HOST TARGET binding site such as BINDING SITE I, BINDING SITE II or BINDING SITE III. Table 2 illustrates the complementarity of the nucleotide sequences of VMP1 BINDING SITE, designated SEQ ID:25208, to the nucleotide sequence of VGAM1929 RNA, herein designated VGAM RNA, also designated SEQ ID:4640.

Another function of VGAM1929 is therefore inhibition of VMP1 (Accession NM_030938). Accordingly, utilities of VGAM1929 include diagnosis, prevention and treatment of diseases and clinical conditions associated with VMP1. X123 (Accession XM_046023) is another VGAM1929 host target gene. X123 BINDING SITE is HOST TARGET binding site found in the 3' untranslated region of mRNA encoded by X123, corresponding to a HOST TARGET binding site such as BINDING SITE I, BINDING SITE II or BINDING SITE III. Table 2 illustrates the complementarity of the nucleotide sequences of X123 BINDING SITE, designated SEQ ID:34649, to the nucleotide sequence of VGAM1929 RNA, herein designated VGAM RNA, also designated SEQ ID:4640.

Another function of VGAM1929 is therefore inhibition of X123 (Accession XM_046023). Accordingly, utilities of VGAM1929 include diagnosis, prevention and treatment of diseases and clinical conditions associated with X123. Yes-associated Protein 1, 65 kDa (YAP1, Accession NM_006106) is another VGAM1929 host target gene. YAP1 BINDING SITE is HOST TARGET binding site found in the 3' untranslated region of mRNA encoded by YAP1, corresponding to a HOST TARGET binding site such as BINDING SITE I, BINDING SITE II or BINDING SITE III. Table 2 illustrates the complementarity of the nucleotide sequences of YAP1 BINDING SITE, designated SEQ ID:12753, to the nucleotide sequence of VGAM1929 RNA, herein designated VGAM RNA, also designated SEQ ID:4640.

Another function of VGAM1929 is therefore inhibition of Yes-associated Protein 1, 65 kDa (YAP1, Accession NM_006106). Accordingly, utilities of VGAM1929 include diagnosis, prevention and treatment of diseases and clinical conditions associated with YAP1. Tyrosine 3-monooxygenase/tryptophan 5-monooxygenase Activation Protein, Theta Polypeptide (YWHAQ, Accession NM_006826) is another VGAM1929 host target gene. YWHAQ BINDING SITE is HOST TARGET binding site found in the 3' untranslated region of mRNA encoded by YWHAQ, corresponding to a HOST TARGET binding site such as BINDING SITE I, BINDING SITE II or BINDING SITE III. Table 2 illustrates the complementarity of the nucleotide sequences of YWHAQ BINDING SITE, designated SEQ ID:13707, to the nucleotide sequence of VGAM1929 RNA, herein designated VGAM RNA, also designated SEQ ID:4640.

Another function of VGAM1929 is therefore inhibition of Tyrosine 3-monooxygenase/tryptophan 5-monooxygenase Activation Protein, Theta Polypeptide (YWHAQ, Accession NM_006826). Accordingly, utilities of VGAM1929 include diagnosis, prevention and treatment of diseases and clinical conditions associated with YWHAQ. Zinc Finger Protein 91 Homolog (mouse) (ZFP91, Accession NM_053023) is another VGAM1929 host target gene. ZFP91 BINDING SITE1 through ZFP91 BINDING SITE3 are HOST TARGET binding sites found in untranslated regions of mRNA encoded by ZFP91, corresponding to HOST TARGET binding sites such as BINDING SITE I, BINDING SITE II or BINDING SITE III. Table 2 illustrates the complementarity of the nucleotide sequences of ZFP91 BINDING SITE1 through ZFP91 BINDING SITE3, designated SEQ ID:27575, SEQ ID:27573 and SEQ ID:27574 respectively, to the nucleotide sequence of VGAM1929 RNA, herein designated VGAM RNA, also designated SEQ ID:4640.

Another function of VGAM1929 is therefore inhibition of Zinc Finger Protein 91 Homolog (mouse) (ZFP91, Accession NM_053023). Accordingly, utilities of VGAM1929 include diagnosis, prevention and treatment of diseases and clinical conditions associated with ZFP91. Zinc Finger Protein 323 (ZNF323, Accession NM_030899) is another VGAM1929 host target gene. ZNF323 BINDING SITE is HOST TARGET binding site found in the 3' untranslated region of mRNA encoded by ZNF323, corresponding to a HOST TARGET binding site such as BINDING SITE I, BINDING SITE II or BINDING SITE III. Table 2 illustrates the complementarity of the nucleotide sequences of ZNF323 BINDING SITE, designated SEQ ID:25169, to the nucleotide sequence of VGAM1929 RNA, herein designated VGAM RNA, also designated SEQ ID:4640.

Another function of VGAM1929 is therefore inhibition of Zinc Finger Protein 323 (ZNF323, Accession NM_030899). Accordingly, utilities of VGAM1929 include diagnosis, prevention and treatment of diseases and clinical conditions associated with ZNF323. ZNF361 (Accession NM_018555) is another VGAM1929 host target gene. ZNF361 BINDING SITE is HOST TARGET binding site found in the 5' untranslated region of mRNA encoded by ZNF361, corresponding to a HOST TARGET binding site such as BINDING SITE I, BINDING SITE II or BINDING SITE III. Table 2 illustrates the complementarity of the nucleotide sequences of ZNF361 BINDING SITE, designated SEQ ID:20636, to the nucleotide sequence of VGAM1929 RNA, herein designated VGAM RNA, also designated SEQ ID:4640.

Another function of VGAM1929 is therefore inhibition of ZNF361 (Accession NM_018555). Accordingly, utilities of VGAM1929 include diagnosis, prevention and treatment of diseases and clinical conditions associated with ZNF361. Zinc Finger Protein 363 (ZNF363, Accession XM_055989) is another VGAM1929 host target gene. ZNF363 BINDING SITE is HOST TARGET binding site found in the 3' untranslated region of mRNA encoded by ZNF363, corresponding to a HOST TARGET binding site such as BINDING SITE I, BINDING SITE II or BINDING SITE III. Table 2 illustrates the complementarity of the nucleotide sequences of ZNF363 BINDING SITE, designated SEQ ID:36358, to the nucleotide sequence of VGAM1929 RNA, herein designated VGAM RNA, also designated SEQ ID:4640.

Another function of VGAM1929 is therefore inhibition of Zinc Finger Protein 363 (ZNF363, Accession XM_055989). Accordingly, utilities of VGAM1929 include diagnosis, prevention and treatment of diseases and clinical conditions associated with ZNF363. LOC112885 (Accession NM_138415) is another VGAM1929 host target gene. LOC112885 BINDING SITE is HOST TARGET binding site found in the 3' untranslated region of mRNA encoded by LOC112885, corresponding to a HOST TARGET binding site such as BINDING SITE I, BINDING SITE II or BINDING SITE III. Table 2 illustrates the complementarity of the nucleotide sequences of LOC112885 BINDING SITE, designated SEQ ID:28786, to the nucleotide sequence of VGAM1929 RNA, herein designated VGAM RNA, also designated SEQ ID:4640.

Another function of VGAM1929 is therefore inhibition of LOC112885 (Accession NM_138415). Accordingly, utilities of VGAM1929 include diagnosis, prevention and treatment of diseases and clinical conditions associated with LOC112885. LOC115297 (Accession XM_053313) is another VGAM1929 host target gene. LOC115297 BINDING SITE is HOST TARGET binding site found in the 3' untranslated region of mRNA encoded by LOC115297, corresponding to a HOST TARGET binding site such as BINDING SITE I, BINDING SITE II or BINDING SITE III. Table 2 illustrates the complementarity of the nucleotide sequences of LOC115297 BINDING SITE, designated SEQ ID:36070, to the nucleotide sequence of VGAM1929 RNA, herein designated VGAM RNA, also designated SEQ ID:4640.

Another function of VGAM1929 is therefore inhibition of LOC115297 (Accession XM_053313). Accordingly, utilities of VGAM1929 include diagnosis, prevention and treatment of diseases and clinical conditions associated with LOC115297. LOC120856 (Accession XM_058509) is another VGAM1929 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36638, to the nucleotide sequence of VGAM1929 RNA, herein designated VGAM RNA, also designated SEQ ID:4640.

Another function of VGAM1929 is therefore inhibition of LOC120856 (Accession XM_058509). Accordingly, utilities of VGAM1929 include diagnosis, prevention and treatment of diseases and clinical conditions associated with LOC120856. LOC121219 (Accession XM_058544) is another VGAM1929 host target gene. LOC121219 BINDING SITE is HOST TARGET binding site found in the 5' untranslated region of mRNA encoded by LOC121219, corresponding to a HOST TARGET binding site such as BINDING SITE I, BINDING SITE II or BINDING SITE III. Table 2 illustrates the complementarity of the nucleotide sequences of LOC121219 BINDING SITE, designated SEQ ID:36650, to the nucleotide sequence of VGAM1929 RNA, herein designated VGAM RNA, also designated SEQ ID:4640.

Another function of VGAM1929 is therefore inhibition of LOC121219 (Accession XM_058544). Accordingly, utilities of VGAM1929 include diagnosis, prevention and treatment of diseases and clinical conditions associated with LOC121219. LOC121838 (Accession XM_071772) is another VGAM1929 host target gene. LOC121838 BINDING SITE is HOST TARGET binding site found in the 5' untranslated region of mRNA encoded by LOC121838, corresponding to a HOST TARGET binding site such as BINDING SITE I, BINDING SITE II or BINDING SITE III. Table 2 illustrates the complementarity of the nucleotide sequences of LOC121838 BINDING SITE, designated SEQ ID:37420, to the nucleotide sequence of VGAM1929 RNA, herein designated VGAM RNA, also designated SEQ ID:4640.

Another function of VGAM1929 is therefore inhibition of LOC121838 (Accession XM_071772). Accordingly, utilities of VGAM1929 include diagnosis, prevention and treatment of diseases and clinical conditions associated with LOC121838. LOC123036 (Accession XM_058676) is another VGAM1929 host target gene. LOC123036 BINDING SITE is HOST TARGET binding site found in the 3' untranslated region of mRNA encoded by LOC123036, corresponding to a HOST TARGET binding site such as BINDING SITE I, BINDING SITE II or BINDING SITE III. Table 2 illustrates the complementarity of the nucleotide sequences of LOC123036 BINDING SITE, designated SEQ ID:36717, to the nucleotide sequence of VGAM1929 RNA, herein designated VGAM RNA, also designated SEQ ID:4640.

Another function of VGAM1929 is therefore inhibition of LOC123036 (Accession XM_058676). Accordingly, utilities of VGAM1929 include diagnosis, prevention and treatment of diseases and clinical conditions associated with LOC123036. LOC126526 (Accession XM_059053) is another VGAM1929 host target gene. LOC126526 BINDING SITE is HOST TARGET binding site found in the 3' untranslated region of mRNA encoded by LOC126526, corresponding to a HOST TARGET binding site such as BINDING SITE I, BINDING SITE II or BINDING SITE III. Table 2 illustrates the complementarity of the nucleotide sequences of LOC126526 BINDING SITE, designated SEQ ID:36847, to the nucleotide sequence of VGAM1929 RNA, herein designated VGAM RNA, also designated SEQ ID:4640.

Another function of VGAM1929 is therefore inhibition of LOC126526 (Accession XM_059053). Accordingly, utilities of VGAM1929 include diagnosis, prevention and treatment of diseases and clinical conditions associated with LOC126526. LOC126528 (Accession XM_059052) is another VGAM1929 host target gene. LOC126528 BINDING SITE is HOST TARGET binding site found in the 5' untranslated region of mRNA encoded by LOC126528, corresponding to a HOST TARGET binding site such as BINDING SITE I, BINDING SITE II or BINDING SITE III. Table 2 illustrates the complementarity of the nucleotide sequences of LOC126528 BINDING SITE, designated SEQ ID:36844, to the nucleotide sequence of VGAM1929 RNA, herein designated VGAM RNA, also designated SEQ ID:4640.

Another function of VGAM1929 is therefore inhibition of LOC126528 (Accession XM_059052). Accordingly, utilities of VGAM1929 include diagnosis, prevention and treatment of diseases and clinical conditions associated with LOC126528. LOC131000 (Accession XM_067145) is another VGAM1929 host target gene. LOC131000 BINDING SITE1 and LOC131000 BINDING SITE2 are HOST TARGET binding sites found in untranslated regions of mRNA encoded by LOC131000, corresponding to HOST TARGET binding sites such as BINDING SITE I, BINDING SITE II or BINDING SITE III. Table 2 illustrates the complementarity of the nucleotide sequences of LOC131000 BINDING SITE1 and LOC131000 BINDING SITE2, designated SEQ ID:37352 and SEQ ID:37351 respectively, to the nucleotide sequence of VGAM1929 RNA, herein designated VGAM RNA, also designated SEQ ID:4640.

Another function of VGAM1929 is therefore inhibition of LOC131000 (Accession XM_067145). Accordingly, utilities of VGAM1929 include diagnosis, prevention and treatment of diseases and clinical conditions associated with LOC131000. LOC132235 (Accession XM_072302) is another VGAM1929 host target gene. LOC132235 BINDING SITE is HOST TARGET binding site found in the 5' untranslated region of mRNA encoded by LOC132235, corresponding to a HOST TARGET binding site such as BINDING SITE I, BINDING SITE II or BINDING SITE III. Table 2 illustrates the complementarity of the nucleotide sequences of LOC132235 BINDING SITE, designated SEQ ID:37482, to the nucleotide sequence of VGAM1929 RNA, herein designated VGAM RNA, also designated SEQ ID:4640.

Another function of VGAM1929 is therefore inhibition of LOC132235 (Accession XM_072302). Accordingly, utilities of VGAM1929 include diagnosis, prevention and treatment of diseases and clinical conditions associated with LOC132235. LOC135398 (Accession XM_069333) is another VGAM1929 host target gene. LOC135398 BINDING SITE is HOST TARGET binding site found in the 3' untranslated region of mRNA encoded by LOC135398, corresponding to a HOST TARGET binding site such as BINDING SITE I, BINDING SITE II or BINDING SITE III. Table 2 illustrates the complementarity of the nucleotide sequences of LOC135398 BINDING SITE, designated SEQ ID:37388, to the nucleotide sequence of VGAM1929 RNA, herein designated VGAM RNA, also designated SEQ ID:4640.

Another function of VGAM1929 is therefore inhibition of LOC135398 (Accession XM_069333). Accordingly, utilities of VGAM1929 include diagnosis, prevention and treatment of diseases and clinical conditions associated with LOC135398. LOC139673 (Accession XM_071645) is another VGAM1929 host target gene. LOC139673 BINDING SITE is HOST TARGET binding site found in the 3' untranslated region of mRNA encoded by LOC139673, corresponding to a HOST TARGET binding site such as BINDING SITE I, BINDING SITE II or BINDING SITE III. Table 2 illustrates the complementarity of the nucleotide sequences of LOC139673 BINDING SITE, designated SEQ ID:37404, to the nucleotide sequence of VGAM1929 RNA, herein designated VGAM RNA, also designated SEQ ID:4640.

Another function of VGAM1929 is therefore inhibition of LOC139673 (Accession XM_071645). Accordingly, utilities of VGAM1929 include diagnosis, prevention and treatment of diseases and clinical conditions associated with LOC139673. LOC143310 (Accession XM_084485) is another VGAM1929 host target gene. LOC143310 BINDING SITE is HOST TARGET binding site found in the 5' untranslated region of mRNA encoded by LOC143310, corresponding to a HOST TARGET binding site such as BINDING SITE I, BINDING SITE II or BINDING SITE III. Table 2 illustrates the complementarity of the nucleotide sequences of LOC143310 BINDING SITE, designated SEQ ID:37607, to the nucleotide sequence of VGAM1929 RNA, herein designated VGAM RNA, also designated SEQ ID:4640.

Another function of VGAM1929 is therefore inhibition of LOC143310 (Accession XM_084485). Accordingly, utilities of VGAM1929 include diagnosis, prevention and treatment of diseases and clinical conditions associated with LOC143310. LOC143888 (Accession XM_084669) is another VGAM1929 host target gene. LOC143888 BINDING SITE is HOST TARGET binding site found in the 3' untranslated region of mRNA encoded by LOC143888, corresponding to a HOST TARGET binding site such as BINDING SITE I, BINDING SITE II or BINDING SITE III. Table 2 illustrates the complementarity of the nucleotide sequences of LOC143888 BINDING SITE, designated SEQ ID:37669, to the nucleotide sequence of VGAM1929 RNA, herein designated VGAM RNA, also designated SEQ ID:4640.

Another function of VGAM1929 is therefore inhibition of LOC143888 (Accession XM_084669). Accordingly, utilities of VGAM1929 include diagnosis, prevention and treatment of diseases and clinical conditions associated with LOC143888. LOC145786 (Accession XM_096860) is another VGAM1929 host target gene. LOC145786 BINDING SITE is HOST TARGET binding site found in the 5' untranslated region of mRNA encoded by LOC145786, corresponding to a HOST TARGET binding site such as BINDING SITE I, BINDING SITE II or BINDING SITE III. Table 2 illustrates the complementarity of the nucleotide sequences of LOC145786 BINDING SITE, designated SEQ ID:40593, to the nucleotide sequence of VGAM1929 RNA, herein designated VGAM RNA, also designated SEQ ID:4640.

Another function of VGAM1929 is therefore inhibition of LOC145786 (Accession XM_096860). Accordingly, utilities of VGAM1929 include diagnosis, prevention and treatment of diseases and clinical conditions associated with LOC145786. LOC145845 (Accession XM_096884) is another VGAM1929 host target gene. LOC145845 BINDING SITE is HOST TARGET binding site found in the 3' untranslated region of mRNA encoded by LOC145845, corresponding to a HOST TARGET binding site such as BINDING SITE I, BINDING SITE II or BINDING SITE III. Table 2 illustrates the complementarity of the nucleotide sequences of LOC145845 BINDING SITE, designated SEQ ID:40616, to the nucleotide sequence of VGAM1929 RNA, herein designated VGAM RNA, also designated SEQ ID:4640.

Another function of VGAM1929 is therefore inhibition of LOC145845 (Accession XM_096884). Accordingly, utilities of VGAM1929 include diagnosis, prevention and treatment of diseases and clinical conditions associated with LOC145845. LOC146138 (Accession XM_096938) is another VGAM1929 host target gene. LOC146138 BIND- ING SITE is HOST TARGET binding site found in the 3' untranslated region of mRNA encoded by LOC146138, corresponding to a HOST TARGET binding site such as BINDING SITE I, BINDING SITE II or BINDING SITE III. Table 2 illustrates the complementarity of the nucleotide sequences of LOC146138 BINDING SITE, designated SEQ ID:40655, to the nucleotide sequence of VGAM1929 RNA, herein designated VGAM RNA, also designated SEQ ID:4640.

Another function of VGAM1929 is therefore inhibition of LOC146138 (Accession XM_096938). Accordingly, utilities of VGAM1929 include diagnosis, prevention and treatment of diseases and clinical conditions associated with LOC146138. LOC146515 (Accession XM_085493) is another VGAM1929 host target gene. LOC146515 BINDING SITE is HOST TARGET binding site found in the 3' untranslated region of mRNA encoded by LOC146515, corresponding to a HOST TARGET binding site such as BINDING SITE I, BINDING SITE II or BINDING SITE III. Table 2 illustrates the complementarity of the nucleotide sequences of LOC146515 BINDING SITE, designated SEQ ID:38196, to the nucleotide sequence of VGAM1929 RNA, herein designated VGAM RNA, also designated SEQ ID:4640.

Another function of VGAM1929 is therefore inhibition of LOC146515 (Accession XM_085493). Accordingly, utilities of VGAM1929 include diagnosis, prevention and treatment of diseases and clinical conditions associated with LOC146515. LOC146713 (Accession XM_097071) is another VGAM1929 host target gene. LOC146713 BINDING SITE is HOST TARGET binding site found in the 3' untranslated region of mRNA encoded by LOC146713, corresponding to a HOST TARGET binding site such as BINDING SITE I, BINDING SITE II or BINDING SITE III. Table 2 illustrates the complementarity of the nucleotide sequences of LOC146713 BINDING SITE, designated SEQ ID:40718, to the nucleotide sequence of VGAM1929 RNA, herein designated VGAM RNA, also designated SEQ ID:4640.

Another function of VGAM1929 is therefore inhibition of LOC146713 (Accession XM_097071). Accordingly, utilities of VGAM1929 include diagnosis, prevention and treatment of diseases and clinical conditions associated with LOC146713. LOC147136 (Accession XM_085716) is another VGAM1929 host target gene. LOC147136 BINDING SITE is HOST TARGET binding site found in the 3' untranslated region of mRNA encoded by LOC147136, corresponding to a HOST TARGET binding site such as BINDING SITE I, BINDING SITE II or BINDING SITE III. Table 2 illustrates the complementarity of the nucleotide sequences of LOC147136 BINDING SITE, designated SEQ ID:38304, to the nucleotide sequence of VGAM1929 RNA, herein designated VGAM RNA, also designated SEQ ID:4640.

Another function of VGAM1929 is therefore inhibition of LOC147136 (Accession XM_085716). Accordingly, utilities of VGAM1929 include diagnosis, prevention and treatment of diseases and clinical conditions associated with LOC147136. LOC147353 (Accession XM_097227) is another VGAM1929 host target gene. LOC147353 BINDING SITE is HOST TARGET binding site found in the 3' untranslated region of mRNA encoded by LOC147353, corresponding to a HOST TARGET binding site such as BINDING SITE I, BINDING SITE II or BINDING SITE III. Table 2 illustrates the complementarity of the nucleotide sequences of LOC147353 BINDING SITE, designated SEQ ID:40835, to the nucleotide sequence of VGAM1929 RNA, herein designated VGAM RNA, also designated SEQ ID:4640.

Another function of VGAM1929 is therefore inhibition of LOC147353 (Accession XM_097227). Accordingly, utilities of VGAM1929 include diagnosis, prevention and treatment of diseases and clinical conditions associated with LOC147353. LOC147515 (Accession XM_097243) is another VGAM1929 host target gene. LOC147515 BINDING SITE is HOST TARGET binding site found in the 3' untranslated region of mRNA encoded by LOC147515, corresponding to a HOST TARGET binding site such as BINDING SITE I, BINDING SITE II or BINDING SITE III. Table 2 illustrates the complementarity of the nucleotide sequences of LOC147515 BINDING SITE, designated SEQ ID:40843, to the nucleotide sequence of VGAM1929 RNA, herein designated VGAM RNA, also designated SEQ ID:4640.

Another function of VGAM1929 is therefore inhibition of LOC147515 (Accession XM_097243). Accordingly, utilities of VGAM1929 include diagnosis, prevention and treatment of diseases and clinical conditions associated with LOC147515. LOC147639 (Accession XM_085822) is another VGAM1929 host target gene. LOC147639 BINDING SITE is HOST TARGET binding site found in the 5' untranslated region of mRNA encoded by LOC147639, corresponding to a HOST TARGET binding site such as BINDING SITE I, BINDING SITE II or BINDING SITE III. Table 2 illustrates the complementarity of the nucleotide sequences of LOC147639 BINDING SITE, designated SEQ ID:38345, to the nucleotide sequence of VGAM1929 RNA, herein designated VGAM RNA, also designated SEQ ID:4640.

Another function of VGAM1929 is therefore inhibition of LOC147639 (Accession XM_085822). Accordingly, utilities of VGAM1929 include diagnosis, prevention and treatment of diseases and clinical conditions associated with LOC147639. LOC148809 (Accession XM_086325) is another VGAM1929 host target gene. LOC148809 BINDING SITE is HOST TARGET binding site found in the 5' untranslated region of mRNA encoded by LOC148809, corresponding to a HOST TARGET binding site such as BINDING SITE I, BINDING SITE II or BINDING SITE III. Table 2 illustrates the complementarity of the nucleotide sequences of LOC148809 BINDING SITE, designated SEQ ID:38595, to the nucleotide sequence of VGAM1929 RNA, herein designated VGAM RNA, also designated SEQ ID:4640.

Another function of VGAM1929 is therefore inhibition of LOC148809 (Accession XM_086325). Accordingly, utilities of VGAM1929 include diagnosis, prevention and treatment of diseases and clinical conditions associated with LOC148809. LOC148936 (Accession XM_097556) is another VGAM1929 host target gene. LOC148936 BINDING SITE is HOST TARGET binding site found in the 5' untranslated region of mRNA encoded by LOC148936, corresponding to a HOST TARGET binding site such as BINDING SITE I, BINDING SITE II or BINDING SITE III. Table 2 illustrates the complementarity of the nucleotide sequences of LOC148936 BINDING SITE, designated SEQ ID:40933, to the nucleotide sequence of VGAM1929 RNA, herein designated VGAM RNA, also designated SEQ ID:4640.

Another function of VGAM1929 is therefore inhibition of LOC148936 (Accession XM_097556). Accordingly, utilities of VGAM1929 include diagnosis, prevention and treatment of diseases and clinical conditions associated with LOC148936. LOC148938 (Accession XM_097555) is another VGAM1929 host target gene. LOC148938 BINDING SITE is HOST TARGET binding site found in the 5' untranslated region of mRNA encoded by LOC148938, corresponding to a HOST TARGET binding site such as BINDING SITE I, BINDING SITE II or BINDING SITE III. Table 2 illustrates the complementarity of the nucleotide sequences of LOC148938 BINDING SITE, designated SEQ ID:40926, to the nucleotide sequence of VGAM1929 RNA, herein designated VGAM RNA, also designated SEQ ID:4640.

Another function of VGAM1929 is therefore inhibition of LOC148938 (Accession XM_097555). Accordingly, utilities of VGAM1929 include diagnosis, prevention and treatment of diseases and clinical conditions associated with LOC148938. LOC149073 (Accession XM_097577) is another VGAM1929 host target gene. LOC149073 BINDING SITE is HOST TARGET binding site found in the 5' untranslated region of mRNA encoded by LOC149073, corresponding to a HOST TARGET binding site such as BINDING SITE I, BINDING SITE II or BINDING SITE III. Table 2 illustrates the complementarity of the nucleotide sequences of LOC149073 BINDING SITE, designated SEQ ID:40944, to the nucleotide sequence of VGAM1929 RNA, herein designated VGAM RNA, also designated SEQ ID:4640.

Another function of VGAM1929 is therefore inhibition of LOC149073 (Accession XM_097577). Accordingly, utilities of VGAM1929 include diagnosis, prevention and treatment of diseases and clinical conditions associated with LOC149073. LOC149113 (Accession XM_086425) is another VGAM1929 host target gene. LOC149113 BINDING SITE is HOST TARGET binding site found in the 3' untranslated region of mRNA encoded by LOC149113, corresponding to a HOST TARGET binding site such as BINDING SITE I, BINDING SITE II or BINDING SITE III. Table 2 illustrates the complementarity of the nucleotide sequences of LOC149113 BINDING SITE, designated SEQ ID:38641, to the nucleotide sequence of VGAM1929 RNA, herein designated VGAM RNA, also designated SEQ ID:4640.

Another function of VGAM1929 is therefore inhibition of LOC149113 (Accession XM_086425). Accordingly, utilities of VGAM1929 include diagnosis, prevention and treatment of diseases and clinical conditions associated with LOC149113. LOC149267 (Accession NM_138480) is another VGAM1929 host target gene. LOC149267 BINDING SITE is HOST TARGET binding site found in the 3' untranslated region of mRNA encoded by LOC149267, corresponding to a HOST TARGET binding site such as BINDING SITE I, BINDING SITE II or BINDING SITE III. Table 2 illustrates the complementarity of the nucleotide sequences of LOC149267 BINDING SITE, designated SEQ ID:28832, to the nucleotide sequence of VGAM1929 RNA, herein designated VGAM RNA, also designated SEQ ID:4640.

Another function of VGAM1929 is therefore inhibition of LOC149267 (Accession NM_138480). Accordingly, utilities of VGAM1929 include diagnosis, prevention and treatment of diseases and clinical conditions associated with LOC149267. LOC149322 (Accession XM_004762) is another VGAM1929 host target gene. LOC149322 BINDING SITE is HOST TARGET binding site found in the 5' untranslated region of mRNA encoded by LOC149322, corresponding to a HOST TARGET binding site such as BINDING SITE I, BINDING SITE II or BINDING SITE III. Table 2 illustrates the complementarity of the nucleotide sequences of LOC149322 BINDING SITE, designated SEQ ID:29946, to the nucleotide sequence of VGAM1929 RNA, herein designated VGAM RNA, also designated SEQ ID:4640.

Another function of VGAM1929 is therefore inhibition of LOC149322 (Accession XM_004762). Accordingly, utilities of VGAM1929 include diagnosis, prevention and treatment of diseases and clinical conditions associated with LOC149322. LOC149373 (Accession XM_086507) is another VGAM1929 host target gene. LOC149373 BINDING SITE is HOST TARGET binding site found in the 3' untranslated region of mRNA encoded by LOC149373, corresponding to a HOST TARGET binding site such as BINDING SITE I, BINDING SITE II or BINDING SITE III. Table 2 illustrates the complementarity of the nucleotide sequences of LOC149373 BINDING SITE, designated SEQ ID:38722, to the nucleotide sequence of VGAM1929 RNA, herein designated VGAM RNA, also designated SEQ ID:4640.

Another function of VGAM1929 is therefore inhibition of LOC149373 (Accession XM_086507). Accordingly, utilities of VGAM1929 include diagnosis, prevention and treatment of diseases and clinical conditions associated with LOC149373. LOC149670 (Accession XM_086647) is another VGAM1929 host target gene. LOC149670 BINDING SITE is HOST TARGET binding site found in the 3' untranslated region of mRNA encoded by LOC149670, corresponding to a HOST TARGET binding site such as BINDING SITE I, BINDING SITE II or BINDING SITE III. Table 2 illustrates the complementarity of the nucleotide sequences of LOC149670 BINDING SITE, designated SEQ ID:38806, to the nucleotide sequence of VGAM1929 RNA, herein designated VGAM RNA, also designated SEQ ID:4640.

Another function of VGAM1929 is therefore inhibition of LOC149670 (Accession XM_086647). Accordingly, utilities of VGAM1929 include diagnosis, prevention and treatment of diseases and clinical conditions associated with LOC149670. LOC149692 (Accession XM_097706) is another VGAM1929 host target gene. LOC149692 BINDING SITE is HOST TARGET binding site found in the 3' untranslated region of mRNA encoded by LOC149692, corresponding to a HOST TARGET binding site such as BINDING SITE I, BINDING SITE II or BINDING SITE III. Table 2 illustrates the complementarity of the nucleotide sequences of LOC149692 BINDING SITE, designated SEQ ID:41040, to the nucleotide sequence of VGAM1929 RNA, herein designated VGAM RNA, also designated SEQ ID:4640.

Another function of VGAM1929 is therefore inhibition of LOC149692 (Accession XM_097706). Accordingly, utilities of VGAM1929 include diagnosis, prevention and treatment of diseases and clinical conditions associated with LOC149692. LOC149995 (Accession XM_097798) is another VGAM1929 host target gene. LOC149995 BINDING SITE is HOST TARGET binding site found in the 3' untranslated region of mRNA encoded by LOC149995, corresponding to a HOST TARGET binding site such as BINDING SITE I, BINDING SITE II or BINDING SITE III. Table 2 illustrates the complementarity of the nucleotide sequences of LOC149995 BINDING SITE, designated SEQ ID:41128, to the nucleotide sequence of VGAM1929 RNA, herein designated VGAM RNA, also designated SEQ ID:4640.

Another function of VGAM1929 is therefore inhibition of LOC149995 (Accession XM_097798). Accordingly, utilities of VGAM1929 include diagnosis, prevention and treatment of diseases and clinical conditions associated with LOC149995. LOC150142 (Accession XM_086791) is another VGAM1929 host target gene. LOC150142 BINDING SITE is HOST TARGET binding site found in the 5' untranslated region of mRNA encoded by LOC150142, corresponding to a HOST TARGET binding site such as BINDING SITE I, BINDING SITE II or BINDING SITE III. Table 2 illustrates the complementarity of the nucleotide sequences of LOC150142 BINDING SITE, designated SEQ ID:38852, to the nucleotide sequence of VGAM1929 RNA, herein designated VGAM RNA, also designated SEQ ID:4640.

Another function of VGAM1929 is therefore inhibition of LOC150142 (Accession XM_086791). Accordingly, utilities of VGAM1929 include diagnosis, prevention and treatment of diseases and clinical conditions associated with LOC150142. LOC150271 (Accession XM_097859) is another VGAM1929 host target gene. LOC150271 BINDING SITE1 and LOC150271 BINDING SITE2 are HOST TARGET binding sites found in untranslated regions of mRNA encoded by LOC150271, corresponding to HOST TARGET binding sites such as BINDING SITE I, BINDING SITE II or BINDING SITE III. Table 2 illustrates the complementarity of the nucleotide sequences of LOC150271 BINDING SITE1 and LOC150271 BINDING SITE2, designated SEQ ID:41168 and SEQ ID:41177 respectively, to the nucleotide sequence of VGAM1929 RNA, herein designated VGAM RNA, also designated SEQ ID:4640.

Another function of VGAM1929 is therefore inhibition of LOC150271 (Accession XM_097859). Accordingly, utilities of VGAM1929 include diagnosis, prevention and treatment of diseases and clinical conditions associated with LOC150271. LOC150848 (Accession XM_097959) is another VGAM1929 host target gene. LOC150848 BINDING SITE is HOST TARGET binding site found in the 5' untranslated region of mRNA encoded by LOC150848, corresponding to a HOST TARGET binding site such as BINDING SITE I, BINDING SITE II or BINDING SITE III. Table 2 illustrates the complementarity of the nucleotide sequences of LOC150848 BINDING SITE, designated SEQ ID:41263, to the nucleotide sequence of VGAM1929 RNA, herein designated VGAM RNA, also designated SEQ ID:4640.

Another function of VGAM1929 is therefore inhibition of LOC150848 (Accession XM_097959). Accordingly, utilities of VGAM1929 include diagnosis, prevention and treatment of diseases and clinical conditions associated with LOC150848. LOC151277 (Accession XM_087155) is another VGAM1929 host target gene. LOC151277 BINDING SITE is HOST TARGET binding site found in the 5' untranslated region of mRNA encoded by LOC151277, corresponding to a HOST TARGET binding site such as BINDING SITE I, BINDING SITE II or BINDING SITE III. Table 2 illustrates the complementarity of the nucleotide sequences of LOC151277 BINDING SITE, designated SEQ ID:39095, to the nucleotide sequence of VGAM1929 RNA, herein designated VGAM RNA, also designated SEQ ID:4640.

Another function of VGAM1929 is therefore inhibition of LOC151277 (Accession XM_087155). Accordingly, utilities of VGAM1929 include diagnosis, prevention and treatment of diseases and clinical conditions associated with LOC151277. LOC151361 (Accession XM_098048) is another VGAM1929 host target gene. LOC151361 BINDING SITE is HOST TARGET binding site found in the 3' untranslated region of mRNA encoded by LOC151361, corresponding to a HOST TARGET binding site such as BINDING SITE I, BINDING SITE II or BINDING SITE III. Table 2 illustrates the complementarity of the nucleotide sequences of LOC151361 BINDING SITE, designated SEQ ID:41329, to the nucleotide sequence of VGAM1929 RNA, herein designated VGAM RNA, also designated SEQ ID:4640.

Another function of VGAM1929 is therefore inhibition of LOC151361 (Accession XM_098048). Accordingly, utilities of VGAM1929 include diagnosis, prevention and treatment of diseases and clinical conditions associated with LOC151361. LOC151556 (Accession XM_087239) is another VGAM1929 host target gene. LOC151556 BINDING SITE is HOST TARGET binding site found in the 5' untranslated region of mRNA encoded by LOC151556, corresponding to a HOST TARGET binding site such as BINDING SITE I, BINDING SITE II or BINDING SITE III. Table 2 illustrates the complementarity of the nucleotide sequences of LOC151556 BINDING SITE, designated SEQ ID:39132, to the nucleotide sequence of VGAM1929 RNA, herein designated VGAM RNA, also designated SEQ ID:4640.

Another function of VGAM1929 is therefore inhibition of LOC151556 (Accession XM_087239). Accordingly, utilities of VGAM1929 include diagnosis, prevention and treatment of diseases and clinical conditions associated with LOC151556. LOC151701 (Accession XM_098109) is another VGAM1929 host target gene. LOC151701 BINDING SITE is HOST TARGET binding site found in the 5' untranslated region of mRNA encoded by LOC151701, corresponding to a HOST TARGET binding site such as BINDING SITE I, BINDING SITE II or BINDING SITE III. Table 2 illustrates the complementarity of the nucleotide sequences of LOC151701 BINDING SITE, designated SEQ ID:41387, to the nucleotide sequence of VGAM1929 RNA, herein designated VGAM RNA, also designated SEQ ID:4640.

Another function of VGAM1929 is therefore inhibition of LOC151701 (Accession XM_098109). Accordingly, utilities of VGAM1929 include diagnosis, prevention and treatment of diseases and clinical conditions associated with LOC151701. LOC151827 (Accession XM_087317) is another VGAM1929 host target gene. LOC151827 BINDING SITE is HOST TARGET binding site found in the 5' untranslated region of mRNA encoded by LOC151827, corresponding to a HOST TARGET binding site such as BINDING SITE I, BINDING SITE II or BINDING SITE III. Table 2 illustrates the complementarity of the nucleotide sequences of LOC151827 BINDING SITE, designated SEQ ID:39169, to the nucleotide sequence of VGAM1929 RNA, herein designated VGAM RNA, also designated SEQ ID:4640.

Another function of VGAM1929 is therefore inhibition of LOC151827 (Accession XM_087317). Accordingly, utilities of VGAM1929 include diagnosis, prevention and treatment of diseases and clinical conditions associated with LOC151827. LOC152559 (Accession XM_087487) is another VGAM1929 host target gene. LOC152559 BINDING SITE is HOST TARGET binding site found in the 3' untranslated region of mRNA encoded by LOC152559, corresponding to a HOST TARGET binding site such as BINDING SITE I, BINDING SITE II or BINDING SITE III. Table 2 illustrates the complementarity of the nucleotide sequences of LOC152559 BINDING SITE, designated SEQ ID:39284, to the nucleotide sequence of VGAM1929 RNA, herein designated VGAM RNA, also designated SEQ ID:4640.

Another function of VGAM1929 is therefore inhibition of LOC152559 (Accession XM_087487). Accordingly, utilities of VGAM1929 include diagnosis, prevention and treatment of diseases and clinical conditions associated with LOC152559. LOC152804 (Accession XM_098266) is another VGAM1929 host target gene. LOC152804 BINDING SITE is HOST TARGET binding site found in the 3' untranslated region of mRNA encoded by LOC152804, corresponding to a HOST TARGET binding site such as BINDING SITE I, BINDING SITE II or BINDING SITE III. Table 2 illustrates the complementarity of the nucleotide sequences of LOC152804 BINDING SITE, designated SEQ ID:41555, to the nucleotide sequence of VGAM1929 RNA, herein designated VGAM RNA, also designated SEQ ID:4640.

Another function of VGAM1929 is therefore inhibition of LOC152804 (Accession XM_098266). Accordingly, utilities of VGAM1929 include diagnosis, prevention and treatment of diseases and clinical conditions associated with LOC152804. LOC153027 (Accession XM_041221) is another VGAM1929 host target gene. LOC153027 BINDING SITE is HOST TARGET binding site found in the 3' untranslated region of mRNA encoded by LOC153027, corresponding to a HOST TARGET binding site such as BINDING SITE I, BINDING SITE II or BINDING SITE III. Table 2 illustrates the complementarity of the nucleotide sequences of LOC153027 BINDING SITE, designated SEQ ID:33491, to the nucleotide sequence of VGAM1929 RNA, herein designated VGAM RNA, also designated SEQ ID:4640.

Another function of VGAM1929 is therefore inhibition of LOC153027 (Accession XM_041221). Accordingly, utilities of VGAM1929 include diagnosis, prevention and treatment of diseases and clinical conditions associated with LOC153027. LOC153196 (Accession XM_098323) is another VGAM1929 host target gene. LOC153196 BINDING SITE is HOST TARGET binding site found in the 3' untranslated region of mRNA encoded by LOC153196, corresponding to a HOST TARGET binding site such as BINDING SITE I, BINDING SITE II or BINDING SITE III. Table 2 illustrates the complementarity of the nucleotide sequences of LOC153196 BINDING SITE, designated SEQ ID:41596, to the nucleotide sequence of VGAM1929 RNA, herein designated VGAM RNA, also designated SEQ ID:4640.

Another function of VGAM1929 is therefore inhibition of LOC153196 (Accession XM_098323). Accordingly, utilities of VGAM1929 include diagnosis, prevention and treatment of diseases and clinical conditions associated with LOC153196. LOC153232 (Accession XM_098331) is another VGAM1929 host target gene. LOC153232 BINDING SITE is HOST TARGET binding site found in the 5' untranslated region of mRNA encoded by LOC153232, corresponding to a HOST TARGET binding site such as BINDING SITE I, BINDING SITE II or BINDING SITE III. Table 2 illustrates the complementarity of the nucleotide sequences of LOC153232 BINDING SITE, designated SEQ ID:41598, to the nucleotide sequence of VGAM1929 RNA, herein designated VGAM RNA, also designated SEQ ID:4640.

Another function of VGAM1929 is therefore inhibition of LOC153232 (Accession XM_098331). Accordingly, utilities of VGAM1929 include diagnosis, prevention and treatment of diseases and clinical conditions associated with LOC153232. LOC153346 (Accession XM_098364) is another VGAM1929 host target gene. LOC153346 BINDING SITE is HOST TARGET binding site found in the 3' untranslated region of mRNA encoded by LOC153346, corresponding to a HOST TARGET binding site such as BINDING SITE I, BINDING SITE II or BINDING SITE III. Table 2 illustrates the complementarity of the nucleotide sequences of LOC153346 BINDING SITE, designated SEQ ID:41619, to the nucleotide sequence of VGAM1929 RNA, herein designated VGAM RNA, also designated SEQ ID:4640.

Another function of VGAM1929 is therefore inhibition of LOC153346 (Accession XM_098364). Accordingly, utilities of VGAM1929 include diagnosis, prevention and treatment of diseases and clinical conditions associated with LOC153346. LOC154043 (Accession XM_087831) is another VGAM1929 host target gene. LOC154043 BINDING SITE is HOST TARGET binding site found in the 3' untranslated region of mRNA encoded by LOC154043, corresponding to a HOST TARGET binding site such as BINDING SITE I, BINDING SITE II or BINDING SITE III. Table 2 illustrates the complementarity of the nucleotide sequences of LOC154043 BINDING SITE, designated SEQ ID:39461, to the nucleotide sequence of VGAM1929 RNA, herein designated VGAM RNA, also designated SEQ ID:4640.

Another function of VGAM1929 is therefore inhibition of LOC154043 (Accession XM_087831). Accordingly, utilities of VGAM1929 include diagnosis, prevention and treatment of diseases and clinical conditions associated with LOC154043. LOC154403 (Accession XM_087919) is another VGAM1929 host target gene. LOC154403 BINDING SITE is HOST TARGET binding site found in the 3' untranslated region of mRNA encoded by LOC154403, corresponding to a HOST TARGET binding site such as BINDING SITE I, BINDING SITE II or BINDING SITE III. Table 2 illustrates the complementarity of the nucleotide sequences of LOC154403 BINDING SITE, designated SEQ ID:39469, to the nucleotide sequence of VGAM1929 RNA, herein designated VGAM RNA, also designated SEQ ID:4640.

Another function of VGAM1929 is therefore inhibition of LOC154403 (Accession XM_087919). Accordingly, utilities of VGAM1929 include diagnosis, prevention and treatment of diseases and clinical conditions associated with LOC154403. LOC154992 (Accession XM_088106) is another VGAM1929 host target gene. LOC154992 BINDING SITE is HOST TARGET binding site found in the 3' untranslated region of mRNA encoded by LOC154992, corresponding to a HOST TARGET binding site such as BINDING SITE I, BINDING SITE II or BINDING SITE III. Table 2 illustrates the complementarity of the nucleotide sequences of LOC154992 BINDING SITE, designated SEQ ID:39519, to the nucleotide sequence of VGAM1929 RNA, herein designated VGAM RNA, also designated SEQ ID:4640.

Another function of VGAM1929 is therefore inhibition of LOC154992 (Accession XM_088106). Accordingly, utilities of VGAM1929 include diagnosis, prevention and treatment of diseases and clinical conditions associated with LOC154992. LOC155081 (Accession XM_088145) is another VGAM1929 host target gene. LOC155081 BINDING SITE is HOST TARGET binding site found in the 3' untranslated region of mRNA encoded by LOC155081, corresponding to a HOST TARGET binding site such as BINDING SITE I, BINDING SITE II or BINDING SITE III. Table 2 illustrates the complementarity of the nucleotide sequences of LOC155081 BINDING SITE, designated SEQ ID:39545, to the nucleotide sequence of VGAM1929 RNA, herein designated VGAM RNA, also designated SEQ ID:4640.

Another function of VGAM1929 is therefore inhibition of LOC155081 (Accession XM_088145). Accordingly, utilities of VGAM1929 include diagnosis, prevention and treatment of diseases and clinical conditions associated with LOC155081. LOC157503 (Accession XM_098767) is another VGAM1929 host target gene. LOC157503 BINDING SITE is HOST TARGET binding site found in the 3' untranslated region of mRNA encoded by LOC157503, corresponding to a HOST TARGET binding site such as BINDING SITE I, BINDING SITE II or BINDING SITE III. Table 2 illustrates the complementarity of the nucleotide sequences of LOC157503 BINDING SITE, designated SEQ ID:41813, to the nucleotide sequence of VGAM1929 RNA, herein designated VGAM RNA, also designated SEQ ID:4640.

Another function of VGAM1929 is therefore inhibition of LOC157503 (Accession XM_098767). Accordingly, utilities of VGAM1929 include diagnosis, prevention and treatment of diseases and clinical conditions associated with LOC157503. LOC157653 (Accession XM_088353) is another VGAM1929 host target gene. LOC157653 BINDING SITE is HOST TARGET binding site found in the 5' untranslated region of mRNA encoded by LOC157653, corresponding to a HOST TARGET binding site such as BINDING SITE I, BINDING SITE II or BINDING SITE III. Table 2 illustrates the complementarity of the nucleotide sequences of LOC157653 BINDING SITE, designated SEQ ID:39635, to the nucleotide sequence of VGAM1929 RNA, herein designated VGAM RNA, also designated SEQ ID:4640.

Another function of VGAM1929 is therefore inhibition of LOC157653 (Accession XM_088353). Accordingly, utilities of VGAM1929 include diagnosis, prevention and treatment of diseases and clinical conditions associated with LOC157653. LOC158014 (Accession XM_088442) is another VGAM1929 host target gene. LOC158014 BINDING SITE is HOST TARGET binding site found in the 5' untranslated region of mRNA encoded by LOC158014, corresponding to a HOST TARGET binding site such as BINDING SITE I, BINDING SITE II or BINDING SITE III. Table 2 illustrates the complementarity of the nucleotide sequences of LOC158014 BINDING SITE, designated SEQ ID:39692, to the nucleotide sequence of VGAM1929 RNA, herein designated VGAM RNA, also designated SEQ ID:4640.

Another function of VGAM1929 is therefore inhibition of LOC158014 (Accession XM_088442). Accordingly, utilities of VGAM1929 include diagnosis, prevention and treatment of diseases and clinical conditions associated with LOC158014. LOC158055 (Accession XM_088453) is another VGAM1929 host target gene. LOC158055 BINDING SITE is HOST TARGET binding site found in the 3' untranslated region of mRNA encoded by LOC158055, corresponding to a HOST TARGET binding site such as BINDING SITE I, BINDING SITE II or BINDING SITE III. Table 2 illustrates the complementarity of the nucleotide sequences of LOC158055 BINDING SITE, designated SEQ ID:39704, to the nucleotide sequence of VGAM1929 RNA, herein designated VGAM RNA, also designated SEQ ID:4640.

Another function of VGAM1929 is therefore inhibition of LOC158055 (Accession XM_088453). Accordingly, utilities of VGAM1929 include diagnosis, prevention and treatment of diseases and clinical conditions associated with LOC158055. LOC158382 (Accession XM_098931) is another VGAM1929 host target gene. LOC158382 BINDING SITE is HOST TARGET binding site found in the 3' untranslated region of mRNA encoded by LOC158382, corresponding to a HOST TARGET binding site such as BINDING SITE I, BINDING SITE II or BINDING SITE III. Table 2 illustrates the complementarity of the nucleotide sequences of LOC158382 BINDING SITE, designated SEQ ID:41966, to the nucleotide sequence of VGAM1929 RNA, herein designated VGAM RNA, also designated SEQ ID:4640.

Another function of VGAM1929 is therefore inhibition of LOC158382 (Accession XM_098931). Accordingly, utilities of VGAM1929 include diagnosis, prevention and treatment of diseases and clinical conditions associated with LOC158382. LOC158549 (Accession XM_098963) is another VGAM1929 host target gene. LOC158549 BINDING SITE is HOST TARGET binding site found in the 5' untranslated region of mRNA encoded by LOC158549, corresponding to a HOST TARGET binding site such as BINDING SITE I, BINDING SITE II or BINDING SITE III. Table 2 illustrates the complementarity of the nucleotide sequences of LOC158549 BINDING SITE, designated SEQ ID:42006, to the nucleotide sequence of VGAM1929 RNA, herein designated VGAM RNA, also designated SEQ ID:4640.

Another function of VGAM1929 is therefore inhibition of LOC158549 (Accession XM_098963). Accordingly, utilities of VGAM1929 include diagnosis, prevention and treatment of diseases and clinical conditions associated with LOC158549. LOC196027 (Accession XM_113633) is another VGAM1929 host target gene. LOC196027 BINDING SITE is HOST TARGET binding site found in the 3' untranslated region of mRNA encoded by LOC196027, corresponding to a HOST TARGET binding site such as BINDING SITE I, BINDING SITE II or BINDING SITE III. Table 2 illustrates the complementarity of the nucleotide sequences of LOC196027 BINDING SITE, designated SEQ ID:42308, to the nucleotide sequence of VGAM1929 RNA, herein designated VGAM RNA, also designated SEQ ID:4640.

Another function of VGAM1929 is therefore inhibition of LOC196027 (Accession XM_113633). Accordingly, utilities of VGAM1929 include diagnosis, prevention and treatment of diseases and clinical conditions associated with LOC196027. LOC196446 (Accession XM_113722) is another VGAM1929 host target gene. LOC196446 BINDING SITE is HOST TARGET binding site found in the 3' untranslated region of mRNA encoded by LOC196446, corresponding to a HOST TARGET binding site such as BINDING SITE I, BINDING SITE II or BINDING SITE III. Table 2 illustrates the complementarity of the nucleotide sequences of LOC196446 BINDING SITE, designated SEQ ID:42373, to the nucleotide sequence of VGAM1929 RNA, herein designated VGAM RNA, also designated SEQ ID:4640.

Another function of VGAM1929 is therefore inhibition of LOC196446 (Accession XM_113722). Accordingly, utilities of VGAM1929 include diagnosis, prevention and treatment of diseases and clinical conditions associated with LOC196446. LOC196761 (Accession XM_116865) is another VGAM1929 host target gene. LOC196761 BINDING SITE1 and LOC196761 BINDING SITE2 are HOST TARGET binding sites found in untranslated regions of mRNA encoded by LOC196761, corresponding to HOST TARGET binding sites such as BINDING SITE I, BINDING SITE II or BINDING SITE III. Table 2 illustrates the complementarity of the nucleotide sequences of LOC196761 BINDING SITE1 and LOC196761 BINDING SITE2, designated SEQ ID:43128 and SEQ ID:43130 respectively, to the nucleotide sequence of VGAM1929 RNA, herein designated VGAM RNA, also designated SEQ ID:4640.

Another function of VGAM1929 is therefore inhibition of LOC196761 (Accession XM_116865). Accordingly, utilities of VGAM1929 include diagnosis, prevention and treatment of diseases and clinical conditions associated with LOC196761. LOC197131 (Accession XM_113823) is another VGAM1929 host target gene. LOC197131 BINDING SITE is HOST TARGET binding site found in the 3' untranslated region of mRNA encoded by LOC197131, corresponding to a HOST TARGET binding site such as BINDING SITE I, BINDING SITE II or BINDING SITE III. Table 2 illustrates the complementarity of the nucleotide sequences of LOC197131 BINDING SITE, designated SEQ ID:42446, to the nucleotide sequence of VGAM1929 RNA, herein designated VGAM RNA, also designated SEQ ID:4640.

Another function of VGAM1929 is therefore inhibition of LOC197131 (Accession XM_113823). Accordingly, utilities of VGAM1929 include diagnosis, prevention and treatment of diseases and clinical conditions associated with LOC197131. LOC197319 (Accession XM_113862) is another VGAM1929 host target gene. LOC197319 BINDING SITE is HOST TARGET binding site found in the 3' untranslated region of mRNA encoded by LOC197319, corresponding to a HOST TARGET binding site such as BINDING SITE I, BINDING SITE II or BINDING SITE III. Table 2 illustrates the complementarity of the nucleotide sequences of LOC197319 BINDING SITE, designated SEQ ID:42478, to the nucleotide sequence of VGAM1929 RNA, herein designated VGAM RNA, also designated SEQ ID:4640.

Another function of VGAM1929 is therefore inhibition of LOC197319 (Accession XM_113862). Accordingly, utilities of VGAM1929 include diagnosis, prevention and treatment of diseases and clinical conditions associated with LOC197319. LOC199699 (Accession XM_113990) is another VGAM1929 host target gene. LOC199699 BINDING SITE is HOST TARGET binding site found in the 3' untranslated region of mRNA encoded by LOC199699, corresponding to a HOST TARGET binding site such as BINDING SITE I, BINDING SITE II or BINDING SITE III. Table 2 illustrates the complementarity of the nucleotide sequences of LOC199699 BINDING SITE, designated SEQ ID:42595, to the nucleotide sequence of VGAM1929 RNA, herein designated VGAM RNA, also designated SEQ ID:4640.

Another function of VGAM1929 is therefore inhibition of LOC199699 (Accession XM_113990). Accordingly, utilities of VGAM1929 include diagnosis, prevention and treatment of diseases and clinical conditions associated with LOC199699. LOC199775 (Accession XM_114016) is another VGAM1929 host target gene. LOC199775 BINDING SITE is HOST TARGET binding site found in the 3' untranslated region of mRNA encoded by LOC199775, corresponding to a HOST TARGET binding site such as BINDING SITE I, BINDING SITE II or BINDING SITE III. Table 2 illustrates the complementarity of the nucleotide sequences of LOC199775 BINDING SITE, designated SEQ ID:42616, to the nucleotide sequence of VGAM1929 RNA, herein designated VGAM RNA, also designated SEQ ID:4640.

Another function of VGAM1929 is therefore inhibition of LOC199775 (Accession XM_114016). Accordingly, utilities of VGAM1929 include diagnosis, prevention and treatment of diseases and clinical conditions associated with LOC199775. LOC200014 (Accession XM_114087) is another VGAM1929 host target gene. LOC200014 BINDING SITE is HOST TARGET binding site found in the 3' untranslated region of mRNA encoded by LOC200014, corresponding to a HOST TARGET binding site such as BINDING SITE I, BINDING SITE II or BINDING SITE III. Table 2 illustrates the complementarity of the nucleotide sequences of LOC200014 BINDING SITE, designated SEQ ID:42697, to the nucleotide sequence of VGAM1929 RNA, herein designated VGAM RNA, also designated SEQ ID:4640.

Another function of VGAM1929 is therefore inhibition of LOC200014 (Accession XM_114087). Accordingly, utilities of VGAM1929 include diagnosis, prevention and treatment of diseases and clinical conditions associated with LOC200014. LOC200107 (Accession XM_114121) is another VGAM1929 host target gene. LOC200107 BINDING SITE is HOST TARGET binding site found in the 3' untranslated region of mRNA encoded by LOC200107, corresponding to a HOST TARGET binding site such as BINDING SITE I, BINDING SITE II or BINDING SITE III. Table 2 illustrates the complementarity of the nucleotide sequences of LOC200107 BINDING SITE, designated SEQ ID:42707, to the nucleotide sequence of VGAM1929 RNA, herein designated VGAM RNA, also designated SEQ ID:4640.

Another function of VGAM1929 is therefore inhibition of LOC200107 (Accession XM_114121). Accordingly, utilities of VGAM1929 include diagnosis, prevention and treatment of diseases and clinical conditions associated with LOC200107. LOC200138 (Accession XM_117194) is another VGAM1929 host target gene. LOC200138 BINDING SITE is HOST TARGET binding site found in the 3' untranslated region of mRNA encoded by LOC200138, corresponding to a HOST TARGET binding site such as BINDING SITE I, BINDING SITE II or BINDING SITE III. Table 2 illustrates the complementarity of the nucleotide sequences of LOC200138 BINDING SITE, designated SEQ ID:43281, to the nucleotide sequence of VGAM1929 RNA, herein designated VGAM RNA, also designated SEQ ID:4640.

Another function of VGAM1929 is therefore inhibition of LOC200138 (Accession XM_117194). Accordingly, utilities of VGAM1929 include diagnosis, prevention and treatment of diseases and clinical conditions associated with LOC200138. LOC200558 (Accession XM_114258) is another VGAM1929 host target gene. LOC200558 BINDING SITE is HOST TARGET binding site found in the 3' untranslated region of mRNA encoded by LOC200558, corresponding to a HOST TARGET binding site such as BINDING SITE I, BINDING SITE II or BINDING SITE III. Table 2 illustrates the complementarity of the nucleotide sequences of LOC200558 BINDING SITE, designated SEQ ID:42820, to the nucleotide sequence of VGAM1929 RNA, herein designated VGAM RNA, also designated SEQ ID:4640.

Another function of VGAM1929 is therefore inhibition of LOC200558 (Accession XM_114258). Accordingly, utilities of VGAM1929 include diagnosis, prevention and treatment of diseases and clinical conditions associated with LOC200558. LOC200563 (Accession XM_117251) is another VGAM1929 host target gene. LOC200563 BINDING SITE is HOST TARGET binding site found in the 5' untranslated region of mRNA encoded by LOC200563, corresponding to a HOST TARGET binding site such as BINDING SITE I, BINDING SITE II or BINDING SITE III. Table 2 illustrates the complementarity of the nucleotide sequences of LOC200563 BINDING SITE, designated SEQ ID:43319, to the nucleotide sequence of VGAM1929 RNA, herein designated VGAM RNA, also designated SEQ ID:4640.

Another function of VGAM1929 is therefore inhibition of LOC200563 (Accession XM_117251). Accordingly, utilities of VGAM1929 include diagnosis, prevention and treatment of diseases and clinical conditions associated with LOC200563. LOC200609 (Accession XM_117256) is another VGAM1929 host target gene. LOC200609 BINDING SITE1 and LOC200609 BINDING SITE2 are HOST TARGET binding sites found in untranslated regions of mRNA encoded by LOC200609, corresponding to HOST TARGET binding sites such as BINDING SITE I, BINDING SITE II or BINDING SITE III. Table 2 illustrates the complementarity of the nucleotide sequences of LOC200609 BINDING SITE1 and LOC200609 BINDING SITE2, designated SEQ ID:43329 and SEQ ID:43336 respectively, to the nucleotide sequence of VGAM1929 RNA, herein designated VGAM RNA, also designated SEQ ID:4640.

Another function of VGAM1929 is therefore inhibition of LOC200609 (Accession XM_117256). Accordingly, utilities of VGAM1929 include diagnosis, prevention and treatment of diseases and clinical conditions associated with LOC200609. LOC201182 (Accession XM_117055) is another VGAM1929 host target gene. LOC201182 BINDING SITE is HOST TARGET binding site found in the 5' untranslated region of mRNA encoded by LOC201182, corresponding to a HOST TARGET binding site such as BINDING SITE I, BINDING SITE II or BINDING SITE III. Table 2 illustrates the complementarity of the nucleotide sequences of LOC201182 BINDING SITE, designated SEQ ID:43212, to the nucleotide sequence of VGAM1929 RNA, herein designated VGAM RNA, also designated SEQ ID:4640.

Another function of VGAM1929 is therefore inhibition of LOC201182 (Accession XM_117055). Accordingly, utilities of VGAM1929 include diagnosis, prevention and treatment of diseases and clinical conditions associated with LOC201182. LOC201868 (Accession XM_114393) is another VGAM1929 host target gene. LOC201868 BINDING SITE is HOST TARGET binding site found in the 3' untranslated region of mRNA encoded by LOC201868, corresponding to a HOST TARGET binding site such as BINDING SITE I, BINDING SITE II or BINDING SITE III. Table 2 illustrates the complementarity of the nucleotide sequences of LOC201868 BINDING SITE, designated SEQ ID:42922, to the nucleotide sequence of VGAM1929 RNA, herein designated VGAM RNA, also designated SEQ ID:4640.

Another function of VGAM1929 is therefore inhibition of LOC201868 (Accession XM_114393). Accordingly, utilities of VGAM1929 include diagnosis, prevention and treatment of diseases and clinical conditions associated with LOC201868. LOC201965 (Accession XM_114412) is another VGAM1929 host target gene. LOC201965 BIND- ING SITE1 and LOC201965 BINDING SITE2 are HOST TARGET binding sites found in untranslated regions of mRNA encoded by LOC201965, corresponding to HOST TARGET binding sites such as BINDING SITE I, BINDING SITE II or BINDING SITE III. Table 2 illustrates the complementarity of the nucleotide sequences of LOC201965 BINDING SITE1 and LOC201965 BINDING SITE2, designated SEQ ID:42932 and SEQ ID:42933 respectively, to the nucleotide sequence of VGAM1929 RNA, herein designated VGAM RNA, also designated SEQ ID:4640.

Another function of VGAM1929 is therefore inhibition of LOC201965 (Accession XM_114412). Accordingly, utilities of VGAM1929 include diagnosis, prevention and treatment of diseases and clinical conditions associated with LOC201965. LOC202802 (Accession XM_114560) is another VGAM1929 host target gene. LOC202802 BINDING SITE is HOST TARGET binding site found in the 3' untranslated region of mRNA encoded by LOC202802, corresponding to a HOST TARGET binding site such as BINDING SITE I, BINDING SITE II or BINDING SITE III. Table 2 illustrates the complementarity of the nucleotide sequences of LOC202802 BINDING SITE, designated SEQ ID:42990, to the nucleotide sequence of VGAM1929 RNA, herein designated VGAM RNA, also designated SEQ ID:4640.

Another function of VGAM1929 is therefore inhibition of LOC202802 (Accession XM_114560). Accordingly, utilities of VGAM1929 include diagnosis, prevention and treatment of diseases and clinical conditions associated with LOC202802. LOC202934 (Accession XM_117486) is another VGAM1929 host target gene. LOC202934 BINDING SITE is HOST TARGET binding site found in the 5' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43457, to the nucleotide sequence of VGAM1929 RNA, herein designated VGAM RNA, also designated SEQ ID:4640.

Another function of VGAM1929 is therefore inhibition of LOC202934 (Accession XM_117486). Accordingly, utilities of VGAM1929 include diagnosis, prevention and treatment of diseases and clinical conditions associated with LOC202934. LOC203248 (Accession XM_114659) is another VGAM1929 host target gene. LOC203248 BINDING SITE is HOST TARGET binding site found in the 3' untranslated region of mRNA encoded by LOC203248, corresponding to a HOST TARGET binding site such as BINDING SITE I, BINDING SITE II or BINDING SITE III. Table 2 illustrates the complementarity of the nucleotide sequences of LOC203248 BINDING SITE, designated SEQ ID:43021, to the nucleotide sequence of VGAM1929 RNA, herein designated VGAM RNA, also designated SEQ ID:4640.

Another function of VGAM1929 is therefore inhibition of LOC203248 (Accession XM_114659). Accordingly, utilities of VGAM1929 include diagnosis, prevention and treatment of diseases and clinical conditions associated with LOC203248. LOC203536 (Accession XM_114716) is another VGAM1929 host target gene. LOC203536 BINDING SITE is HOST TARGET binding site found in the 3' untranslated region of mRNA encoded by LOC203536, corresponding to a HOST TARGET binding site such as BINDING SITE I, BINDING SITE II or BINDING SITE III. Table 2 illustrates the complementarity of the nucleotide sequences of LOC203536 BINDING SITE, designated SEQ ID:43057, to the nucleotide sequence of VGAM1929 RNA, herein designated VGAM RNA, also designated SEQ ID:4640.

Another function of VGAM1929 is therefore inhibition of LOC203536 (Accession XM_114716). Accordingly, utilities of VGAM1929 include diagnosis, prevention and treatment of diseases and clinical conditions associated with LOC203536. LOC205327 (Accession XM_115788) is another VGAM1929 host target gene. LOC205327 BINDING SITE is HOST TARGET binding site found in the 3' untranslated region of mRNA encoded by LOC205327, corresponding to a HOST TARGET binding site such as BINDING SITE I, BINDING SITE II or BINDING SITE III. Table 2 illustrates the complementarity of the nucleotide sequences of LOC205327 BINDING SITE, designated SEQ ID:43107, to the nucleotide sequence of VGAM1929 RNA, herein designated VGAM RNA, also designated SEQ ID:4640.

Another function of VGAM1929 is therefore inhibition of LOC205327 (Accession XM_115788). Accordingly, utilities of VGAM1929 include diagnosis, prevention and treatment of diseases and clinical conditions associated with LOC205327. LOC219654 (Accession XM_166095) is another VGAM1929 host target gene. LOC219654 BINDING SITE is HOST TARGET binding site found in the 3' untranslated region of mRNA encoded by LOC219654, corresponding to a HOST TARGET binding site such as BINDING SITE I, BINDING SITE II or BINDING SITE III. Table 2 illustrates the complementarity of the nucleotide sequences of LOC219654 BINDING SITE, designated SEQ ID:43880, to the nucleotide sequence of VGAM1929 RNA, herein designated VGAM RNA, also designated SEQ ID:4640.

Another function of VGAM1929 is therefore inhibition of LOC219654 (Accession XM_166095). Accordingly, utilities of VGAM1929 include diagnosis, prevention and treatment of diseases and clinical conditions associated with LOC219654. LOC219942 (Accession XM_167790) is another VGAM1929 host target gene. LOC219942 BINDING SITE is HOST TARGET binding site found in the 3' untranslated region of mRNA encoded by LOC219942, corresponding to a HOST TARGET binding site such as BINDING SITE I, BINDING SITE II or BINDING SITE III. Table 2 illustrates the complementarity of the nucleotide sequences of LOC219942 BINDING SITE, designated SEQ ID:44828, to the nucleotide sequence of VGAM1929 RNA, herein designated VGAM RNA, also designated SEQ ID:4640.

Another function of VGAM1929 is therefore inhibition of LOC219942 (Accession XM_167790). Accordingly, utilities of VGAM1929 include diagnosis, prevention and treatment of diseases and clinical conditions associated with LOC219942. LOC220469 (Accession XM_084334) is another VGAM1929 host target gene. LOC220469 BINDING SITE is HOST TARGET binding site found in the 5' untranslated region of mRNA encoded by LOC220469, corresponding to a HOST TARGET binding site such as BINDING SITE I, BINDING SITE II or BINDING SITE III. Table 2 illustrates the complementarity of the nucleotide sequences of LOC220469 BINDING SITE, designated SEQ ID:37557, to the nucleotide sequence of VGAM1929 RNA, herein designated VGAM RNA, also designated SEQ ID:4640.

Another function of VGAM1929 is therefore inhibition of LOC220469 (Accession XM_084334). Accordingly, utilities of VGAM1929 include diagnosis, prevention and treatment of diseases and clinical conditions associated with LOC220469. LOC220635 (Accession XM_165433) is another VGAM1929 host target gene. LOC220635 BINDING SITE is HOST TARGET binding site found in the 5' untranslated region of mRNA encoded by LOC220635, corresponding to a HOST TARGET binding site such as BINDING SITE I, BINDING SITE II or BINDING SITE III. Table 2 illustrates the complementarity of the nucleotide sequences of LOC220635 BINDING SITE, designated SEQ ID:43639, to the nucleotide sequence of VGAM1929 RNA, herein designated VGAM RNA, also designated SEQ ID:4640.

Another function of VGAM1929 is therefore inhibition of LOC220635 (Accession XM_165433). Accordingly, utilities of VGAM1929 include diagnosis, prevention and treatment of diseases and clinical conditions associated with LOC220635. LOC220729 (Accession XM_049575) is another VGAM1929 host target gene. LOC220729 BINDING SITE is HOST TARGET binding site found in the 5' untranslated region of mRNA encoded by LOC220729, corresponding to a HOST TARGET binding site such as BINDING SITE I, BINDING SITE II or BINDING SITE III. Table 2 illustrates the complementarity of the nucleotide sequences of LOC220729 BINDING SITE, designated SEQ ID:35447, to the nucleotide sequence of VGAM1929 RNA, herein designated VGAM RNA, also designated SEQ ID:4640.

Another function of VGAM1929 is therefore inhibition of LOC220729 (Accession XM_049575). Accordingly, utilities of VGAM1929 include diagnosis, prevention and treatment of diseases and clinical conditions associated with LOC220729. LOC220963 (Accession XM_166145) is another VGAM1929 host target gene. LOC220963 BINDING SITE is HOST TARGET binding site found in the 3' untranslated region of mRNA encoded by LOC220963, corresponding to a HOST TARGET binding site such as BINDING SITE I, BINDING SITE II or BINDING SITE III. Table 2 illustrates the complementarity of the nucleotide sequences of LOC220963 BINDING SITE, designated SEQ ID:43956, to the nucleotide sequence of VGAM1929 RNA, herein designated VGAM RNA, also designated SEQ ID:4640.

Another function of VGAM1929 is therefore inhibition of LOC220963 (Accession XM_166145). Accordingly, utilities of VGAM1929 include diagnosis, prevention and treatment of diseases and clinical conditions associated with LOC220963. LOC220988 (Accession XM_165561) is another VGAM1929 host target gene. LOC220988 BINDING SITE is HOST TARGET binding site found in the 3' untranslated region of mRNA encoded by LOC220988, corresponding to a HOST TARGET binding site such as BINDING SITE I, BINDING SITE II or BINDING SITE III. Table 2 illustrates the complementarity of the nucleotide sequences of LOC220988 BINDING SITE, designated SEQ ID:43686, to the nucleotide sequence of VGAM1929 RNA, herein designated VGAM RNA, also designated SEQ ID:4640.

Another function of VGAM1929 is therefore inhibition of LOC220988 (Accession XM_165561). Accordingly, utilities of VGAM1929 include diagnosis, prevention and treatment of diseases and clinical conditions associated with LOC220988. LOC221178 (Accession XM_167936) is another VGAM1929 host target gene. LOC221178 BINDING SITE is HOST TARGET binding site found in the 3' untranslated region of mRNA encoded by LOC221178, corresponding to a HOST TARGET binding site such as BINDING SITE I, BINDING SITE II or BINDING SITE III. Table 2 illustrates the complementarity of the nucleotide sequences of LOC221178 BINDING SITE, designated SEQ ID:44931, to the nucleotide sequence of VGAM1929 RNA, herein designated VGAM RNA, also designated SEQ ID:4640.

Another function of VGAM1929 is therefore inhibition of LOC221178 (Accession XM_167936). Accordingly, utilities of VGAM1929 include diagnosis, prevention and treatment of diseases and clinical conditions associated with LOC221178. LOC221312 (Accession XM_166314) is another VGAM1929 host target gene. LOC221312 BINDING SITE is HOST TARGET binding site found in the 3' untranslated region of mRNA encoded by LOC221312, corresponding to a HOST TARGET binding site such as BINDING SITE I, BINDING SITE II or BINDING SITE III. Table 2 illustrates the complementarity of the nucleotide sequences of LOC221312 BINDING SITE, designated SEQ ID:44139, to the nucleotide sequence of VGAM1929 RNA, herein designated VGAM RNA, also designated SEQ ID:4640.

Another function of VGAM1929 is therefore inhibition of LOC221312 (Accession XM_166314). Accordingly, utilities of VGAM1929 include diagnosis, prevention and treatment of diseases and clinical conditions associated with LOC221312. LOC221814 (Accession XM_168226) is another VGAM1929 host target gene. LOC221814 BINDING SITE is HOST TARGET binding site found in the 5' untranslated region of mRNA encoded by LOC221814, corresponding to a HOST TARGET binding site such as BINDING SITE I, BINDING SITE II or BINDING SITE III. Table 2 illustrates the complementarity of the nucleotide sequences of LOC221814 BINDING SITE, designated SEQ ID:45091, to the nucleotide sequence of VGAM1929 RNA, herein designated VGAM RNA, also designated SEQ ID:4640.

Another function of VGAM1929 is therefore inhibition of LOC221814 (Accession XM_168226). Accordingly, utilities of VGAM1929 include diagnosis, prevention and treatment of diseases and clinical conditions associated with LOC221814. LOC221815 (Accession XM_168225) is another VGAM1929 host target gene. LOC221815 BINDING SITE is HOST TARGET binding site found in the 5' untranslated region of mRNA encoded by LOC221815, corresponding to a HOST TARGET binding site such as BINDING SITE I, BINDING SITE II or BINDING SITE III. Table 2 illustrates the complementarity of the nucleotide sequences of LOC221815 BINDING SITE, designated SEQ ID:45087, to the nucleotide sequence of VGAM1929 RNA, herein designated VGAM RNA, also designated SEQ ID:4640.

Another function of VGAM1929 is therefore inhibition of LOC221815 (Accession XM_168225). Accordingly, utilities of VGAM1929 include diagnosis, prevention and treatment of diseases and clinical conditions associated with LOC221815. LOC222070 (Accession XM_168433) is another VGAM1929 host target gene. LOC222070 BINDING SITE is HOST TARGET binding site found in the 5' untranslated region of mRNA encoded by LOC222070, corresponding to a HOST TARGET binding site such as BINDING SITE I, BINDING SITE II or BINDING SITE III. Table 2 illustrates the complementarity of the nucleotide sequences of LOC222070 BINDING SITE, designated SEQ ID:45182, to the nucleotide sequence of VGAM1929 RNA, herein designated VGAM RNA, also designated SEQ ID:4640.

Another function of VGAM1929 is therefore inhibition of LOC222070 (Accession XM_168433). Accordingly, utilities of VGAM1929 include diagnosis, prevention and treatment of diseases and clinical conditions associated with LOC222070. LOC222159 (Accession XM_168421) is another VGAM1929 host target gene. LOC222159 BINDING SITE is HOST TARGET binding site found in the 5' untranslated region of mRNA encoded by LOC222159, corresponding to a HOST TARGET binding site such as BINDING SITE I, BINDING SITE II or BINDING SITE III. Table 2 illustrates the complementarity of the nucleotide sequences of LOC222159 BINDING SITE, designated SEQ ID:45148, to the nucleotide sequence of VGAM1929 RNA, herein designated VGAM RNA, also designated SEQ ID:4640.

Another function of VGAM1929 is therefore inhibition of LOC222159 (Accession XM_168421). Accordingly, utilities of VGAM1929 include diagnosis, prevention and treatment of diseases and clinical conditions associated with LOC222159. LOC222161 (Accession XM_166596) is another VGAM1929 host target gene. LOC222161 BINDING SITE is HOST TARGET binding site found in the 5' untranslated region of mRNA encoded by LOC222161, corresponding to a HOST TARGET binding site such as BINDING SITE I, BINDING SITE II or BINDING SITE III. Table 2 illustrates the complementarity of the nucleotide sequences of LOC222161 BINDING SITE, designated SEQ ID:44582, to the nucleotide sequence of VGAM1929 RNA, herein designated VGAM RNA, also designated SEQ ID:4640.

Another function of VGAM1929 is therefore inhibition of LOC222161 (Accession XM_166596). Accordingly, utilities of VGAM1929 include diagnosis, prevention and treatment of diseases and clinical conditions associated with LOC222161. LOC222178 (Accession XM_168453) is another VGAM1929 host target gene. LOC222178 BINDING SITE is HOST TARGET binding site found in the 3' untranslated region of mRNA encoded by LOC222178, corresponding to a HOST TARGET binding site such as BINDING SITE I, BINDING SITE II or BINDING SITE III. Table 2 illustrates the complementarity of the nucleotide sequences of LOC222178 BINDING SITE, designated SEQ ID:45189, to the nucleotide sequence of VGAM1929 RNA, herein designated VGAM RNA, also designated SEQ ID:4640.

Another function of VGAM1929 is therefore inhibition of LOC222178 (Accession XM_168453). Accordingly, utilities of VGAM1929 include diagnosis, prevention and treatment of diseases and clinical conditions associated with LOC222178. LOC222228 (Accession XM_168627) is another VGAM1929 host target gene. LOC222228 BINDING SITE is HOST TARGET binding site found in the 3' untranslated region of mRNA encoded by LOC222228, corresponding to a HOST TARGET binding site such as BINDING SITE I, BINDING SITE II or BINDING SITE III. Table 2 illustrates the complementarity of the nucleotide sequences of LOC222228 BINDING SITE, designated SEQ ID:45276, to the nucleotide sequence of VGAM1929 RNA, herein designated VGAM RNA, also designated SEQ ID:4640.

Another function of VGAM1929 is therefore inhibition of LOC222228 (Accession XM_168627). Accordingly, utilities of VGAM1929 include diagnosis, prevention and treatment of diseases and clinical conditions associated with LOC222228. LOC222233 (Accession XM_168560) is another VGAM1929 host target gene. LOC222233 BINDING SITE is HOST TARGET binding site found in the 3' untranslated region of mRNA encoded by LOC222233, corresponding to a HOST TARGET binding site such as BINDING SITE I, BINDING SITE II or BINDING SITE III. Table 2 illustrates the complementarity of the nucleotide sequences of LOC222233 BINDING SITE, designated SEQ ID:45245, to the nucleotide sequence of VGAM1929 RNA, herein designated VGAM RNA, also designated SEQ ID:4640.

Another function of VGAM1929 is therefore inhibition of LOC222233 (Accession XM_168560). Accordingly, utilities of VGAM1929 include diagnosis, prevention and treatment of diseases and clinical conditions associated with LOC222233. LOC222237 (Accession XM_168592) is another VGAM1929 host target gene. LOC222237 BINDING SITE is HOST TARGET binding site found in the 3' untranslated region of mRNA encoded by LOC222237, corresponding to a HOST TARGET binding site such as BINDING SITE I, BINDING SITE II or BINDING SITE III. Table 2 illustrates the complementarity of the nucleotide sequences of LOC222237 BINDING SITE, designated SEQ ID:45271, to the nucleotide sequence of VGAM1929 RNA, herein designated VGAM RNA, also designated SEQ ID:4640.

Another function of VGAM1929 is therefore inhibition of LOC222237 (Accession XM_168592). Accordingly, utilities of VGAM1929 include diagnosis, prevention and treatment of diseases and clinical conditions associated with LOC222237. LOC222256 (Accession XM_168571) is another VGAM1929 host target gene. LOC222256 BINDING SITE is HOST TARGET binding site found in the 3' untranslated region of mRNA encoded by LOC222256, corresponding to a HOST TARGET binding site such as BINDING SITE I, BINDING SITE II or BINDING SITE III. Table 2 illustrates the complementarity of the nucleotide sequences of LOC222256 BINDING SITE, designated SEQ ID:45249, to the nucleotide sequence of VGAM1929 RNA, herein designated VGAM RNA, also designated SEQ ID:4640.

Another function of VGAM1929 is therefore inhibition of LOC222256 (Accession XM_168571). Accordingly, utilities of VGAM1929 include diagnosis, prevention and treatment of diseases and clinical conditions associated with LOC222256. LOC253776 (Accession XM_173240) is another VGAM1929 host target gene. LOC253776 BINDING SITE is HOST TARGET binding site found in the 3' untranslated region of mRNA encoded by LOC253776, corresponding to a HOST TARGET binding site such as BINDING SITE I, BINDING SITE II or BINDING SITE III. Table 2 illustrates the complementarity of the nucleotide sequences of LOC253776 BINDING SITE, designated SEQ ID:46527, to the nucleotide sequence of VGAM1929 RNA, herein designated VGAM RNA, also designated SEQ ID:4640.

Another function of VGAM1929 is therefore inhibition of LOC253776 (Accession XM_173240). Accordingly, utilities of VGAM1929 include diagnosis, prevention and treatment of diseases and clinical conditions associated with LOC253776. LOC253786 (Accession XM_173109) is another VGAM1929 host target gene. LOC253786 BINDING SITE is HOST TARGET binding site found in the 5' untranslated region of mRNA encoded by LOC253786, corresponding to a HOST TARGET binding site such as BINDING SITE I, BINDING SITE II or BINDING SITE III. Table 2 illustrates the complementarity of the nucleotide sequences of LOC253786 BINDING SITE, designated SEQ ID:46364, to the nucleotide sequence of VGAM1929 RNA, herein designated VGAM RNA, also designated SEQ ID:4640.

Another function of VGAM1929 is therefore inhibition of LOC253786 (Accession XM_173109). Accordingly, utilities of VGAM1929 include diagnosis, prevention and treatment of diseases and clinical conditions associated with LOC253786. LOC253890 (Accession XM_171016) is another VGAM1929 host target gene. LOC253890 BINDING SITE is HOST TARGET binding site found in the 5' untranslated region of mRNA encoded by LOC253890, corresponding to a HOST TARGET binding site such as BINDING SITE I, BINDING SITE II or BINDING SITE III. Table 2 illustrates the complementarity of the nucleotide sequences of LOC253890 BINDING SITE, designated SEQ ID:45785, to the nucleotide sequence of VGAM1929 RNA, herein designated VGAM RNA, also designated SEQ ID:4640.

Another function of VGAM1929 is therefore inhibition of LOC253890 (Accession XM_171016). Accordingly, utilities of VGAM1929 include diagnosis, prevention and treatment of diseases and clinical conditions associated with LOC253890. LOC254532 (Accession XM_172961) is another VGAM1929 host target gene. LOC254532 BINDING SITE is HOST TARGET binding site found in the 3' untranslated region of mRNA encoded by LOC254532, corresponding to a HOST TARGET binding site such as BINDING SITE I, BINDING SITE II or BINDING SITE III. Table 2 illustrates the complementarity of the nucleotide sequences of LOC254532 BINDING SITE, designated SEQ ID:46215, to the nucleotide sequence of VGAM1929 RNA, herein designated VGAM RNA, also designated SEQ ID:4640.

Another function of VGAM1929 is therefore inhibition of LOC254532 (Accession XM_172961). Accordingly, utilities of VGAM1929 include diagnosis, prevention and treatment of diseases and clinical conditions associated with LOC254532. LOC255045 (Accession XM_171243) is another VGAM1929 host target gene. LOC255045 BINDING SITE is HOST TARGET binding site found in the 3' untranslated region of mRNA encoded by LOC255045, corresponding to a HOST TARGET binding site such as BINDING SITE I, BINDING SITE II or BINDING SITE III. Table 2 illustrates the complementarity of the nucleotide sequences of LOC255045 BINDING SITE, designated SEQ ID:46036, to the nucleotide sequence of VGAM1929 RNA, herein designated VGAM RNA, also designated SEQ ID:4640.

Another function of VGAM1929 is therefore inhibition of LOC255045 (Accession XM_171243). Accordingly, utilities of VGAM1929 include diagnosis, prevention and treatment of diseases and clinical conditions associated with LOC255045. LOC255465 (Accession XM_173206) is another VGAM1929 host target gene. LOC255465 BINDING SITE is HOST TARGET binding site found in the 5' untranslated region of mRNA encoded by LOC255465, corresponding to a HOST TARGET binding site such as BINDING SITE I, BINDING SITE II or BINDING SITE III. Table 2 illustrates the complementarity of the nucleotide sequences of LOC255465 BINDING SITE, designated SEQ ID:46450, to the nucleotide sequence of VGAM1929 RNA, herein designated VGAM RNA, also designated SEQ ID:4640.

Another function of VGAM1929 is therefore inhibition of LOC255465 (Accession XM_173206). Accordingly, utilities of VGAM1929 include diagnosis, prevention and treatment of diseases and clinical conditions associated with LOC255465. LOC255515 (Accession XM_171185) is another VGAM1929 host target gene. LOC255515 BINDING SITE is HOST TARGET binding site found in the 3' untranslated region of mRNA encoded by LOC255515, corresponding to a HOST TARGET binding site such as BINDING SITE I, BINDING SITE II or BINDING SITE III. Table 2 illustrates the complementarity of the nucleotide sequences of LOC255515 BINDING SITE, designated SEQ ID:45962, to the nucleotide sequence of VGAM1929 RNA, herein designated VGAM RNA, also designated SEQ ID:4640.

Another function of VGAM1929 is therefore inhibition of LOC255515 (Accession XM_171185). Accordingly, utilities of VGAM1929 include diagnosis, prevention and treatment of diseases and clinical conditions associated with LOC255515. LOC255520 (Accession XM_171073) is another VGAM1929 host target gene. LOC255520 BINDING SITE is HOST TARGET binding site found in the 3' untranslated region of mRNA encoded by LOC255520, corresponding to a HOST TARGET binding site such as BINDING SITE I, BINDING SITE II or BINDING SITE III. Table 2 illustrates the complementarity of the nucleotide sequences of LOC255520 BINDING SITE, designated SEQ ID:45882, to the nucleotide sequence of VGAM1929 RNA, herein designated VGAM RNA, also designated SEQ ID:4640.

Another function of VGAM1929 is therefore inhibition of LOC255520 (Accession XM_171073). Accordingly, utilities of VGAM1929 include diagnosis, prevention and treatment of diseases and clinical conditions associated with LOC255520. LOC256867 (Accession XM_170694) is another VGAM1929 host target gene. LOC256867 BINDING SITE is HOST TARGET binding site found in the 5' untranslated region of mRNA encoded by LOC256867, corresponding to a HOST TARGET binding site such as BINDING SITE I, BINDING SITE II or BINDING SITE III. Table 2 illustrates the complementarity of the nucleotide sequences of LOC256867 BINDING SITE, designated SEQ ID:45478, to the nucleotide sequence of VGAM1929 RNA, herein designated VGAM RNA, also designated SEQ ID:4640.

Another function of VGAM1929 is therefore inhibition of LOC256867 (Accession XM_170694). Accordingly, utilities of VGAM1929 include diagnosis, prevention and treatment of diseases and clinical conditions associated with LOC256867. LOC257017 (Accession XM_173227) is another VGAM1929 host target gene. LOC257017 BINDING SITE1 and LOC257017 BINDING SITE2 are HOST TARGET binding sites found in untranslated regions of mRNA encoded by LOC257017, corresponding to HOST TARGET binding sites such as BINDING SITE I, BINDING SITE II or BINDING SITE III. Table 2 illustrates the complementarity of the nucleotide sequences of LOC257017 BINDING SITE1 and LOC257017 BINDING SITE2, designated SEQ ID:46493 and SEQ ID:46499 respectively, to the nucleotide sequence of VGAM1929 RNA, herein designated VGAM RNA, also designated SEQ ID:4640.

Another function of VGAM1929 is therefore inhibition of LOC257017 (Accession XM_173227). Accordingly, utilities of VGAM1929 include diagnosis, prevention and treatment of diseases and clinical conditions associated with LOC257017. LOC51631 (Accession XM_042779) is another VGAM1929 host target gene. LOC51631 BINDING SITE is HOST TARGET binding site found in the 3' untranslated region of mRNA encoded by LOC51631, corresponding to a HOST TARGET binding site such as BINDING SITE I, BINDING SITE II or BINDING SITE III. Table 2 illustrates the complementarity of the nucleotide sequences of LOC51631 BINDING SITE, designated SEQ ID:33769, to the nucleotide sequence of VGAM1929 RNA, herein designated VGAM RNA, also designated SEQ ID:4640.

Another function of VGAM1929 is therefore inhibition of LOC51631 (Accession XM_042779). Accordingly, utilities of VGAM1929 include diagnosis, prevention and treatment of diseases and clinical conditions associated with LOC51631. LOC57149 (Accession NM_020424) is another VGAM1929 host target gene. LOC57149 BINDING SITE is HOST TARGET binding site found in the 3' untranslated region of mRNA encoded by LOC57149, corresponding to a HOST TARGET binding site such as BINDING SITE I, BINDING SITE II or BINDING SITE III. Table 2 illustrates the complementarity of the nucleotide sequences of LOC57149 BINDING SITE, designated SEQ ID:21682, to the nucleotide sequence of VGAM1929 RNA, herein designated VGAM RNA, also designated SEQ ID:4640.

Another function of VGAM1929 is therefore inhibition of LOC57149 (Accession NM_020424). Accordingly, utilities of VGAM1929 include diagnosis, prevention and treatment of diseases and clinical conditions associated with LOC57149. LOC84549 (Accession NM_032509) is another VGAM1929 host target gene. LOC84549 BINDING SITE is HOST TARGET binding site found in the 3' untranslated region of mRNA encoded by LOC84549, corresponding to a HOST TARGET binding site such as BINDING SITE I, BINDING SITE II or BINDING SITE III. Table 2 illustrates the complementarity of the nucleotide sequences of LOC84549 BINDING SITE, designated SEQ ID:26263, to the nucleotide sequence of VGAM1929 RNA, herein designated VGAM RNA, also designated SEQ ID:4640.

Another function of VGAM1929 is therefore inhibition of LOC84549 (Accession NM_032509). Accordingly, utilities of VGAM1929 include diagnosis, prevention and treatment of diseases and clinical conditions associated with LOC84549. LOC90309 (Accession XM_030830) is another VGAM1929 host target gene. LOC90309 BINDING SITE is HOST TARGET binding site found in the 5' untranslated region of mRNA encoded by LOC90309, corresponding to a HOST TARGET binding site such as BINDING SITE I, BINDING SITE II or BINDING SITE III. Table 2 illustrates the complementarity of the nucleotide sequences of LOC90309 BINDING SITE, designated SEQ ID:31152, to the nucleotide sequence of VGAM1929 RNA, herein designated VGAM RNA, also designated SEQ ID:4640.

Another function of VGAM1929 is therefore inhibition of LOC90309 (Accession XM_030830). Accordingly, utilities of VGAM1929 include diagnosis, prevention and treatment of diseases and clinical conditions associated with LOC90309. LOC90624 (Accession XM_033003) is another VGAM1929 host target gene. LOC90624 BINDING SITE is HOST TARGET binding site found in the 3' untranslated region of mRNA encoded by LOC90624, corresponding to a HOST TARGET binding site such as BINDING SITE I, BINDING SITE II or BINDING SITE III. Table 2 illustrates the complementarity of the nucleotide sequences of LOC90624 BINDING SITE, designated SEQ ID:31817, to the nucleotide sequence of VGAM1929 RNA, herein designated VGAM RNA, also designated SEQ ID:4640.

Another function of VGAM1929 is therefore inhibition of LOC90624 (Accession XM_033003). Accordingly, utilities of VGAM1929 include diagnosis, prevention and treatment of diseases and clinical conditions associated with LOC90624. LOC91012 (Accession XM_035503) is another VGAM1929 host target gene. LOC91012 BINDING SITE is HOST TARGET binding site found in the 3' untranslated region of mRNA encoded by LOC91012, corresponding to a HOST TARGET binding site such as BINDING SITE I, BINDING SITE II or BINDING SITE III. Table 2 illustrates the complementarity of the nucleotide sequences of LOC91012 BINDING SITE, designated SEQ ID:32282, to the nucleotide sequence of VGAM1929 RNA, herein designated VGAM RNA, also designated SEQ ID:4640.

Another function of VGAM1929 is therefore inhibition of LOC91012 (Accession XM_035503). Accordingly, utilities of VGAM1929 include diagnosis, prevention and treatment of diseases and clinical conditions associated with LOC91012. LOC91250 (Accession XM_037135) is another VGAM1929 host target gene. LOC91250 BINDING SITE is HOST TARGET binding site found in the 5' untranslated region of mRNA encoded by LOC91250, corresponding to a HOST TARGET binding site such as BINDING SITE I, BINDING SITE II or BINDING SITE III. Table 2 illustrates the complementarity of the nucleotide sequences of LOC91250 BINDING SITE, designated SEQ ID:32546, to the nucleotide sequence of VGAM1929 RNA, herein designated VGAM RNA, also designated SEQ ID:4640.

Another function of VGAM1929 is therefore inhibition of LOC91250 (Accession XM_037135). Accordingly, utilities of VGAM1929 include diagnosis, prevention and treatment of diseases and clinical conditions associated with LOC91250. LOC91300 (Accession NM_138774) is another VGAM1929 host target gene. LOC91300 BINDING SITE1 and LOC91300 BINDING SITE2 are HOST TARGET binding sites found in untranslated regions of mRNA encoded by LOC91300, corresponding to HOST TARGET binding sites such as BINDING SITE I, BINDING SITE II or BINDING SITE III. Table 2 illustrates the complementarity of the nucleotide sequences of LOC91300 BINDING SITE1 and LOC91300 BINDING SITE2, designated SEQ ID:29007 and SEQ ID:45388 respectively, to the nucleotide sequence of VGAM1929 RNA, herein designated VGAM RNA, also designated SEQ ID:4640.

Another function of VGAM1929 is therefore inhibition of LOC91300 (Accession NM_138774). Accordingly, utilities of VGAM1929 include diagnosis, prevention and treatment of diseases and clinical conditions associated with LOC91300. LOC92231 (Accession XM_043734) is another VGAM1929 host target gene. LOC92231 BINDING SITE is HOST TARGET binding site found in the 3' untranslated region of mRNA encoded by LOC92231, corresponding to a HOST TARGET binding site such as BINDING SITE I, BINDING SITE II or BINDING SITE III. Table 2 illustrates the complementarity of the nucleotide sequences of LOC92231 BINDING SITE, designated SEQ ID:34011, to the nucleotide sequence of VGAM1929 RNA, herein designated VGAM RNA, also designated SEQ ID:4640.

Another function of VGAM1929 is therefore inhibition of LOC92231 (Accession XM_043734). Accordingly, utilities of VGAM1929 include diagnosis, prevention and treatment of diseases and clinical conditions associated with LOC92231. LOC92597 (Accession XM_046066) is another VGAM1929 host target gene. LOC92597 BINDING SITE is HOST TARGET binding site found in the 3' untranslated region of mRNA encoded by LOC92597, corresponding to a HOST TARGET binding site such as BINDING SITE I, BINDING SITE II or BINDING SITE III. Table 2 illustrates the complementarity of the nucleotide sequences of LOC92597 BINDING SITE, designated SEQ ID:34674, to the nucleotide sequence of VGAM1929 RNA, herein designated VGAM RNA, also designated SEQ ID:4640.

Another function of VGAM1929 is therefore inhibition of LOC92597 (Accession XM_046066). Accordingly, utilities of VGAM1929 include diagnosis, prevention and treatment of diseases and clinical conditions associated with LOC92597. FIG. 1 further provides a conceptual description of a novel bioinformatically detected viral gene of the present invention, referred to here as Viral Genomic Address Messenger 1930 (VGAM1930) viral gene, which modulates expression of respective host target genes thereof, the function and utility of which host target genes is known in the art.

VGAM1930 is a novel bioinformatically detected regulatory, non protein coding, viral micro RNA (miRNA) gene. The method by which VGAM1930 was detected is described hereinabove with reference to FIGS. 1-8.

VGAM1930 gene, herein designated VGAM GENE, is a viral gene contained in the genome of Human Herpesvirus 4. VGAM1930 host target gene, herein designated VGAM HOST TARGET GENE, is a human gene contained in the human genome.

VGAM1930 gene encodes a VGAM1930 precursor RNA, herein designated VGAM PRECURSOR RNA. Similar to other miRNA genes, and unlike most ordinary genes, VGAM1930 precursor RNA does not encode a protein. A nucleotide sequence identical or highly similar to the nucleotide sequence of VGAM1930 precursor RNA is designated SEQ ID:1916, and is provided hereinbelow with reference to the sequence listing part. Nucleotide sequence SEQ ID:1916 is located at position 150946 relative to the genome of Human Herpesvirus 4.

VGAM1930 precursor RNA folds onto itself, forming VGAM1930 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1930 folded precursor RNA into VGAM1930 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1930 RNA is designated SEQ ID:4641, and is provided hereinbelow with reference to the sequence listing part.

VGAM1930 host target gene, herein designated VGAM HOST TARGET GENE, encodes a corresponding messenger RNA, VGAM1930 host target RNA, herein designated VGAM HOST TARGET RNA. VGAM1930 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1930 RNA, herein designated VGAM RNA, binds complementarily to one or more host target binding sites located in untranslated regions of VGAM1930 host target RNA, herein designated VGAM HOST TARGET RNA. This complementary binding is due to the fact that the nucleotide sequence of VGAM1930 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1930 RNA, herein designated VGAM RNA, may have a different number of host target binding sites in untranslated regions of a VGAM1930 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1930 RNA, herein designated VGAM RNA, to host target binding sites on VGAM1930 host target RNA, herein designated VGAM HOST TARGET RNA, such as BINDING SITE I, BINDING SITE II and BINDING SITE III, inhibits translation of VGAM1930 host target RNA into VGAM1930 host target protein, herein designated VGAM HOST TARGET PROTEIN. VGAM host target protein is therefore outlined by a broken line.

It is appreciated that VGAM1930 host target gene, herein designated VGAM HOST TARGET GENE, in fact represents a plurality of VGAM1930 host target genes. The mRNA of each one of this plurality of VGAM1930 host target genes comprises one or more host target binding sites, each having a nucleotide sequence which is at least partly complementary to VGAM1930 RNA, herein designated VGAM RNA, and which when bound by VGAM1930 RNA causes inhibition of translation of respective one or more VGAM1930 host target proteins.

It is further appreciated by one skilled in the art that the mode of translational inhibition illustrated by FIG. 1 with specific reference to translational inhibition exerted by VGAM1930 gene, herein designated VGAM GENE, on one or more VGAM1930 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1930 is inhibition of expression of host target genes, as part of a novel viral mechanism of attacking a host. Accordingly, utilities of VGAM1930 include diagnosis, prevention and treatment of viral infection by Human Herpesvirus 4. Specific functions, and accordingly utilities, of VGAM1930 correlate with, and may be deduced from, the identity of the host target genes which VGAM1930 binds and inhibits, and the function of these host target genes, as elaborated hereinbelow.

Nucleotide sequences of the VGAM1930 precursor RNA, herein designated VGAM PRECURSOR RNA, and of the 'diced' VGAM1930 RNA, herein designated VGAM RNA, and a schematic representation of the secondary folding of VGAM1930 folded precursor RNA, herein designated VGAM FOLDED PRECURSOR RNA, of VGAM1930 are further described hereinbelow with reference to Table 1.

Nucleotide sequences of host target binding sites, such as BINDING SITE-I, BINDING SITE-II and BINDING SITE-III of FIG. 1, found on VGAM1930 host target RNA, and schematic representation of the complementarity of each of these host target binding sites to VGAM1930 RNA, herein designated VGAM RNA, are described hereinbelow with reference to Table 2.

As mentioned hereinabove with reference to FIG. 1, a function of VGAM1930 gene, herein designated VGAM is inhibition of expression of VGAM1930 target genes. It is appreciated that specific functions, and accordingly utilities, of VGAM1930 correlate with, and may be deduced from, the identity of the target genes which VGAM1930 binds and inhibits, and the function of these target genes, as elaborated hereinbelow.

Chromosome 1 Open Reading Frame 34 (C1orf34, Accession XM_027172) is a VGAM1930 host target gene. C1orf34 BINDING SITE is HOST TARGET binding site found in the 3' untranslated region of mRNA encoded by C1orf34, corresponding to a HOST TARGET binding site such as BINDING SITE I, BINDING SITE II or BINDING SITE III. Table 2 illustrates the complementarity of the nucleotide sequences of C1orf34 BINDING SITE, designated SEQ ID:30435, to the nucleotide sequence of VGAM1930 RNA, herein designated VGAM RNA, also designated SEQ ID:4641.

A function of VGAM1930 is therefore inhibition of Chromosome 1 Open Reading Frame 34 (C1orf34, Accession XM_027172). Accordingly, utilities of VGAM1930 include diagnosis, prevention and treatment of diseases and clinical conditions associated with C1orf34. FLJ14106 (Accession NM_025067) is another VGAM1930 host target gene. FLJ14106 BINDING SITE is HOST TARGET binding site found in the 3' untranslated region of mRNA encoded by FLJ14106, corresponding to a HOST TARGET binding site such as BINDING SITE I, BINDING SITE II or BINDING SITE III. Table 2 illustrates the complementarity of the nucleotide sequences of FLJ14106 BINDING SITE, designated SEQ ID:24666, to the nucleotide sequence of VGAM1930 RNA, herein designated VGAM RNA, also designated SEQ ID:4641.

Another function of VGAM1930 is therefore inhibition of FLJ14106 (Accession NM_025067). Accordingly, utilities of VGAM1930 include diagnosis, prevention and treatment of diseases and clinical conditions associated with FLJ14106. GENX-3414 (Accession NM_003943) is another VGAM1930 host target gene. GENX-3414 BINDING SITE is HOST TARGET binding site found in the 3' untranslated region of mRNA encoded by GENX-3414, corresponding to a HOST TARGET binding site such as BINDING SITE I, BINDING SITE II or BINDING SITE III. Table 2 illustrates the complementarity of the nucleotide sequences of GENX-3414 BINDING SITE, designated SEQ ID:10061, to the nucleotide sequence of VGAM1930 RNA, herein designated VGAM RNA, also designated SEQ ID:4641.

Another function of VGAM1930 is therefore inhibition of GENX-3414 (Accession NM_003943). Accordingly, utilities of VGAM1930 include diagnosis, prevention and treatment of diseases and clinical conditions associated with GENX-3414. Smith-Magenis Syndrome Chromosome Region, Candidate 5 (SMCR5, Accession NM_144774) is another VGAM1930 host target gene. SMCR5 BINDING SITE is HOST TARGET binding site found in the 3' untranslated region of mRNA encoded by SMCR5, corresponding to a HOST TARGET binding site such as BINDING SITE I, BINDING SITE II or BINDING SITE III. Table 2 illustrates the complementarity of the nucleotide sequences of SMCR5 BINDING SITE, designated SEQ ID:29566, to the nucleotide sequence of VGAM1930 RNA, herein designated VGAM RNA, also designated SEQ ID:4641.

Another function of VGAM1930 is therefore inhibition of Smith-Magenis Syndrome Chromosome Region, Candidate 5 (SMCR5, Accession NM_144774). Accordingly, utilities of VGAM1930 include diagnosis, prevention and treatment of diseases and clinical conditions associated with SMCR5. Syntaphilin (SNPH, Accession NM_014723) is another VGAM1930 host target gene. SNPH BINDING SITE is HOST TARGET binding site found in the 3" untranslated region of mRNA encoded by SNPH, corresponding to a HOST TARGET binding site such as BINDING SITE I, BINDING SITE II or BINDING SITE III. Table 2 illustrates the complementarity of the nucleotide sequences of SNPH BINDING SITE, designated SEQ ID:16288, to the nucleotide sequence of VGAM1930 RNA, herein designated VGAM RNA, also designated SEQ ID:4641.

Another function of VGAM1930 is therefore inhibition of Syntaphilin (SNPH, Accession NM_014723). Accordingly, utilities of VGAM1930 include diagnosis, prevention and treatment of diseases and clinical conditions associated with SNPH. LOC145845 (Accession XM_096884) is another VGAM1930 host target gene. LOC145845 BINDING SITE is HOST TARGET binding site found in the 3' untranslated region of mRNA encoded by LOC145845, corresponding to a HOST TARGET binding site such as BINDING SITE I, BINDING SITE II or BINDING SITE III. Table 2 illustrates the complementarity of the nucleotide sequences of LOC145845 BINDING SITE, designated SEQ ID:40618, to the nucleotide sequence of VGAM1930 RNA, herein designated VGAM RNA, also designated SEQ ID:4641.

Another function of VGAM1930 is therefore inhibition of LOC145845 (Accession XM_096884). Accordingly, utilities of VGAM1930 include diagnosis, prevention and treatment of diseases and clinical conditions associated with LOC145845. LOC146229 (Accession XM_085387) is another VGAM1930 host target gene. LOC146229 BINDING SITE is HOST TARGET binding site found in the 3' untranslated region of mRNA encoded by LOC146229, corresponding to a HOST TARGET binding site such as BINDING SITE I, BINDING SITE II or BINDING SITE III. Table 2 illustrates the complementarity of the nucleotide sequences of LOC146229 BINDING SITE, designated SEQ ID:38117, to the nucleotide sequence of VGAM1930 RNA, herein designated VGAM RNA, also designated SEQ ID:4641.

Another function of VGAM1930 is therefore inhibition of LOC146229 (Accession XM_085387). Accordingly, utilities of VGAM1930 include diagnosis, prevention and treatment of diseases and clinical conditions associated with LOC146229. LOC148534 (Accession XM_086222) is another VGAM1930 host target gene. LOC148534 BINDING SITE is HOST TARGET binding site found in the 3' untranslated region of mRNA encoded by LOC148534, corresponding to a HOST TARGET binding site such as BINDING SITE I, BINDING SITE II or BINDING SITE III. Table 2 illustrates the complementarity of the nucleotide sequences of LOC148534 BINDING SITE, designated SEQ ID:38550, to the nucleotide sequence of VGAM1930 RNA, herein designated VGAM RNA, also designated SEQ ID:4641.

Another function of VGAM1930 is therefore inhibition of LOC148534 (Accession XM_086222). Accordingly, utilities of VGAM1930 include diagnosis, prevention and treatment of diseases and clinical conditions associated with LOC148534. LOC151201 (Accession XM_098021) is another VGAM1930 host target gene. LOC151201 BINDING SITE is HOST TARGET binding site found in the 3' untranslated region of mRNA encoded by LOC151201, corresponding to a HOST TARGET binding site such as BINDING SITE I, BINDING SITE II or BINDING SITE III. Table 2 illustrates the complementarity of the nucleotide sequences of LOC151201 BINDING SITE, designated SEQ ID:41326, to the nucleotide sequence of VGAM1930 RNA, herein designated VGAM RNA, also designated SEQ ID:4641.

Another function of VGAM1930 is therefore inhibition of LOC151201 (Accession XM_098021). Accordingly, utilities of VGAM1930 include diagnosis, prevention and treatment of diseases and clinical conditions associated with LOC151201. LOC152991 (Accession XM_098295) is another VGAM1930 host target gene. LOC152991 BINDING SITE is HOST TARGET binding site found in the 3' untranslated region of mRNA encoded by LOC152991, corresponding to a HOST TARGET binding site such as BINDING SITE I, BINDING SITE II or BINDING SITE III. Table 2 illustrates the complementarity of the nucleotide sequences of LOC152991 BINDING SITE, designated SEQ ID:41566, to the nucleotide sequence of VGAM1930 RNA, herein designated VGAM RNA, also designated SEQ ID:4641.

Another function of VGAM1930 is therefore inhibition of LOC152991 (Accession XM_098295). Accordingly, utilities of VGAM1930 include diagnosis, prevention and treatment of diseases and clinical conditions associated with LOC152991. LOC57406 (Accession NM_020676) is another VGAM1930 host target gene. LOC57406 BINDING SITE is HOST TARGET binding site found in the 3' untranslated region of mRNA encoded by LOC57406, corresponding to a HOST TARGET binding site such as BINDING SITE I, BINDING SITE II or BINDING SITE III. Table 2 illustrates the complementarity of the nucleotide sequences of LOC57406 BINDING SITE, designated SEQ ID:21839, to the nucleotide sequence of VGAM1930 RNA, herein designated VGAM RNA, also designated SEQ ID:4641.

Another function of VGAM1930 is therefore inhibition of LOC57406 (Accession NM_020676). Accordingly, utilities of VGAM1930 include diagnosis, prevention and treatment of diseases and clinical conditions associated with LOC57406. FIG. 1 further provides a conceptual description of a novel bioinformatically detected viral gene of the present invention, referred to here as Viral Genomic Address Messenger 1931 (VGAM1931) viral gene, which modulates expression of respective host target genes thereof, the function and utility of which host target genes is known in the art.

VGAM1931 is a novel bioinformatically detected regulatory, non protein coding, viral micro RNA (miRNA) gene. The method by which VGAM1931 was detected is described hereinabove with reference to FIGS. 1-8.

VGAM1931 gene, herein designated VGAM GENE, is a viral gene contained in the genome of Human Herpesvirus 4. VGAM1931 host target gene, herein designated VGAM HOST TARGET GENE, is a human gene contained in the human genome.

VGAM1931 gene encodes a VGAM1931 precursor RNA, herein designated VGAM PRECURSOR RNA. Similar to other miRNA genes, and unlike most ordinary genes, VGAM1931 precursor RNA does not encode a protein. A nucleotide sequence identical or highly similar to the nucleotide sequence of VGAM1931 precursor RNA is designated SEQ ID:1917, and is provided hereinbelow with reference to the sequence listing part. Nucleotide sequence SEQ ID:1917 is located at position 151629 relative to the genome of Human Herpesvirus 4.

VGAM1931 precursor RNA folds onto itself, forming VGAM1931 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1931 folded precursor RNA into VGAM1931 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM1931 RNA is designated SEQ ID:4642, and is provided hereinbelow with reference to the sequence listing part.

VGAM1931 host target gene, herein designated VGAM HOST TARGET GENE, encodes a corresponding messenger RNA, VGAM1931 host target RNA, herein designated VGAM HOST TARGET RNA. VGAM1931 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1931 RNA, herein designated VGAM RNA, binds complementarily to one or more host target binding sites located in untranslated regions of VGAM1931 host target RNA, herein designated VGAM HOST TARGET RNA. This complementary binding is due to the fact that the nucleotide sequence of VGAM1931 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1931 RNA, herein designated VGAM RNA, may have a different number of host target binding sites in untranslated regions of a VGAM1931 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1931 RNA, herein designated VGAM RNA, to host target binding sites on VGAM1931 host target RNA, herein designated VGAM HOST TARGET RNA, such as BINDING SITE I, BINDING SITE II and BINDING SITE III, inhibits translation of VGAM1931 host target RNA into VGAM1931 host target protein, herein designated VGAM HOST TARGET PROTEIN. VGAM host target protein is therefore outlined by a broken line.

It is appreciated that VGAM1931 host target gene, herein designated VGAM HOST TARGET GENE, in fact represents a plurality of VGAM1931 host target genes. The mRNA of each one of this plurality of VGAM1931 host target genes comprises one or more host target binding sites, each having a nucleotide sequence which is at least partly complementary to VGAM1931 RNA, herein designated VGAM RNA, and which when bound by VGAM1931 RNA causes inhibition of translation of respective one or more VGAM1931 host target proteins.

It is further appreciated by one skilled in the art that the mode of translational inhibition illustrated by FIG. 1 with specific reference to translational inhibition exerted by VGAM1931 gene, herein designated VGAM GENE, on one or more VGAM1931 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1931 is inhibition of expression of host target genes, as part of a novel viral mechanism of attacking a host. Accordingly, utilities of VGAM1931 include diagnosis, prevention and treatment of viral infection by Human Herpesvirus 4. Specific functions, and accordingly utilities, of VGAM1931 correlate with, and may be deduced from, the identity of the host target genes which VGAM1931 binds and inhibits, and the function of these host target genes, as elaborated hereinbelow.

Nucleotide sequences of the VGAM1931 precursor RNA, herein designated VGAM PRECURSOR RNA, and of the 'diced' VGAM1931 RNA, herein designated VGAM RNA, and a schematic representation of the secondary folding of VGAM1931 folded precursor RNA, herein designated VGAM FOLDED PRECURSOR RNA, of VGAM1931 are further described hereinbelow with reference to Table 1.

Nucleotide sequences of host target binding sites, such as BINDING SITE-I, BINDING SITE-II and BINDING SITE-III of FIG. 1, found on VGAM1931 host target RNA, and schematic representation of the complementarity of each of these host target binding sites to VGAM1931 RNA, herein designated VGAM RNA, are described hereinbelow with reference to Table 2.

As mentioned hereinabove with reference to FIG. 1, a function of VGAM1931 gene, herein designated VGAM is inhibition of expression of VGAM1931 target genes. It is appreciated that specific functions, and accordingly utilities, of VGAM1931 correlate with, and may be deduced from, the identity of the target genes which VGAM1931 binds and inhibits, and the function of these target genes, as elaborated hereinbelow.

Collagen, Type VI, Alpha 1 (COL6A1, Accession NM_001848) is a VGAM1931 host target gene. COL6A1 BINDING SITE is HOST TARGET binding site found in the 3' untranslated region of mRNA encoded by COL6A1, corresponding to a HOST TARGET binding site such as BINDING SITE I, BINDING SITE II or BINDING SITE III. Table 2 illustrates the complementarity of the nucleotide sequences of COL6A1 BINDING SITE, designated SEQ ID:7584, to the nucleotide sequence of VGAM1931 RNA, herein designated VGAM RNA, also designated SEQ ID:4642.

A function of VGAM1931 is therefore inhibition of Collagen, Type VI, Alpha 1 (COL6A1, Accession NM_001848). Accordingly, utilities of VGAM1931 include diagnosis, prevention and treatment of diseases and clinical conditions associated with COL6A1. HIP12 (Accession XM_038791) is another VGAM1931 host target gene. HIP12 BINDING SITE is HOST TARGET binding site found in the 3' untranslated region of mRNA encoded by HIP12, corresponding to a HOST TARGET binding site such as BINDING SITE I, BINDING SITE II or BINDING SITE III. Table 2 illustrates the complementarity of the nucleotide sequences of HIP12 BINDING SITE, designated SEQ ID:32922, to the nucleotide sequence of VGAM1931 RNA, herein designated VGAM RNA, also designated SEQ ID:4642.

Another function of VGAM1931 is therefore inhibition of HIP12 (Accession XM_038791), a gene which is a component of clathrin-coated pits and vesicles, that may link the endocytic machinery to the actin cytoskeleton. Accordingly, utilities of VGAM1931 include diagnosis, prevention and treatment of diseases and clinical conditions associated with HIP12. The function of HIP12 has been established by previous studies. Huntingtin-interacting protein-1 (HIP1; 601767) is a membrane-associated protein that interacts with huntingtin (OMIM Ref. No. 143100), the protein altered in Huntington disease. While attempting to isolate the mouse homolog of HIP1, Chopra et al. (2000) identified a homologous cDNA, which they designated Hip12. By screening a human frontal cortex cDNA library with an EST that showed homology to mouse Hip12, Chopra et al. (2000) cloned a full-length HIP12 cDNA encoding a deduced 1,068-amino acid protein that shares 47% sequence identity with HIP1. The highest degree of similarity occurs in the C-terminal region, which shows considerable homology to the cytoskeletal protein talin (OMIM Ref. No. 186745). Northern blot analysis detected expression of a 5-kb HIP12 transcript in brain, heart, kidney, pancreas, and liver, but not in lung or placenta. In ES cell-derived neurons, both HIP1 and HIP12 are highly expressed and distributed throughout the cytoplasm and cell processes with enrichment within the cis-Golgi. In contrast to HIP1, which is toxic in cell culture, HIP12 does not confer toxicity in the same assay systems. HIP12 does not interact with huntingtin but can interact with HIP1, suggesting a potential interaction in vivo that may influence the function of each respective protein. By searching EST databases for homologs of yeast Sla2p, Engqvist-Goldstein et al. (1999) identified mouse and human cDNAs encoding HIP1R. The deduced human protein, which is 91% identical to the mouse sequence, is identical to the KIAA0655 protein reported by Ishikawa et al. (1998). It is also identical to the shorter sequence reported by Seki et al. (1998) except that it contains approximately 180 additional amino acids in it N terminus, including a conserved domain implicated in the endocytic function of Sla2p. HIP1R has 3 predicted coiled coils and a C-terminal talin-like domain, which Engqvist-Goldstein et al. (1999) confirmed binds F-actin in vitro. Northern blot analysis revealed that mouse Hip1r is expressed ubiquitously, with reduced expression in skeletal muscle and heart, consistent with RT-PCR analysis of human HIP1R expression (Seki et al., 1998; Ishikawa et al., 1998). Fluorescence microscopy demonstrated that mouse Hip1r is expressed as punctate structures, enriched at the cell cortex and excluded from the nucleus, which colocalize with clathrin (see OMIM Ref. No. 118955) and other markers of receptor-mediated endocytosis.

Full details of the abovementioned studies are described in the following publications, the disclosure of which are hereby incorporated by reference:

Chopra, V. S.; Metzler, M.; Rasper, D. M.; Engqvist-Goldstein, A. E. Y.; Singaraja, R.; Gan, L.; Fichter, K. M.; McCutcheon, K.; Drubin, D.; Nicholson, D. W.; Hayden, M. R.: HIP12 is a non-proapoptotic member of a gene family including HIP1, an interacting protein with huntingtin. Mammalian Genome 11:1006-1015, 2000; and Engqvist-Goldstein, A. E. Y.; Kessels, M. M.; Chopra, V. S.; Hayden, M. R.; Drubin, D. G.: An actin-binding protein of the Sla2/Huntingtin interacting protein 1 family is a novel compo.

Further studies establishing the function and utilities of HIP12 are found in John Hopkins OMIM database record ID 605613, and in sited publications numbered 717 and 9440-6775 listed in the bibliography section hereinbelow, which are also hereby incorporated by reference. Splicing Factor, Arginine/serine-rich 1 (splicing factor 2, alternate splicing factor) (SFRS1, Accession NM_006924) is another VGAM1931 host target gene. SFRS1 BINDING SITE is HOST TARGET binding site found in the 3' untranslated region of mRNA encoded by SFRS1, corresponding to a HOST TARGET binding site such as BINDING SITE I, BINDING SITE II or BINDING SITE III. Table 2 illustrates the complementarity of the nucleotide sequences of SFRS1 BINDING SITE, designated SEQ ID:13801, to the nucleotide sequence of VGAM1931 RNA, herein designated VGAM RNA, also designated SEQ ID:4642.

Another function of VGAM1931 is therefore inhibition of Splicing Factor, Arginine/serine-rich 1 (splicing factor 2, alternate splicing factor) (SFRS1, Accession NM_006924), a gene which plays an essential role in pre-mRNA splicing. Accordingly, utilities of VGAM1931 include diagnosis, prevention and treatment of diseases and clinical conditions associated with SFRS1. The function of SFRS1 and its association with various diseases and clinical conditions, has been established by previous studies, as described hereinabove with reference to VGAM323. FLJ20436 (Accession NM_017822) is another VGAM1931 host target gene. FLJ20436 BINDING SITE is HOST TARGET binding site found in the 3' untranslated region of mRNA encoded by FLJ20436, corresponding to a HOST TARGET binding site such as BINDING SITE I, BINDING SITE II or BINDING SITE III. Table 2 illustrates the complementarity of the nucleotide sequences of FLJ20436 BINDING SITE, designated SEQ ID:19472, to the nucleotide sequence of VGAM1931 RNA, herein designated VGAM RNA, also designated SEQ ID:4642.

Another function of VGAM1931 is therefore inhibition of FLJ20436 (Accession NM_017822). Accordingly, utilities of VGAM1931 include diagnosis, prevention and treatment of diseases and clinical conditions associated with FLJ20436. KIAA1622 (Accession NM_058237) is another VGAM1931 host target gene. KIAA1622 BINDING SITE is HOST TARGET binding site found in the 3' untranslated region of mRNA encoded by KIAA1622, corresponding to a HOST TARGET binding site such as BINDING SITE I, BINDING SITE II or BINDING SITE III. Table 2 illustrates the complementarity of the nucleotide sequences of KIAA1622 BINDING SITE, designated SEQ ID:27766, to the nucleotide sequence of VGAM1931 RNA, herein designated VGAM RNA, also designated SEQ ID:4642.

Another function of VGAM1931 is therefore inhibition of KIAA1622 (Accession NM_058237). Accordingly, utilities of VGAM1931 include diagnosis, prevention and treatment of diseases and clinical conditions associated with KIAA1622. Zinc Finger Protein 212 (ZNF212, Accession NM_012256) is another VGAM1931 host target gene. ZNF212 BINDING SITE is HOST TARGET binding site found in the 3' untranslated region of mRNA encoded by ZNF212, corresponding to a HOST TARGET binding site such as BINDING SITE I, BINDING SITE II or BINDING SITE III. Table 2 illustrates the complementarity of the nucleotide sequences of ZNF212 BINDING SITE, designated SEQ ID:14557, to the nucleotide sequence of VGAM1931 RNA, herein designated VGAM RNA, also designated SEQ ID:4642.

Another function of VGAM1931 is therefore inhibition of Zinc Finger Protein 212 (ZNF212, Accession NM_012256). Accordingly, utilities of VGAM1931 include diagnosis, prevention and treatment of diseases and clinical conditions associated with ZNF212. LOC145761 (Accession XM_096855) is another VGAM1931 host target gene. LOC145761 BINDING SITE is HOST TARGET binding site found in the 5' untranslated region of mRNA encoded by LOC145761, corresponding to a HOST TARGET binding site such as BINDING SITE I, BINDING SITE II or BINDING SITE III. Table 2 illustrates the complementarity of the nucleotide sequences of LOC145761 BINDING SITE, designated SEQ ID:40584, to the nucleotide sequence of VGAM1931 RNA, herein designated VGAM RNA, also designated SEQ ID:4642.

Another function of VGAM1931 is therefore inhibition of LOC145761 (Accession XM_096855). Accordingly, utilities of VGAM1931 include diagnosis, prevention and treatment of diseases and clinical conditions associated with LOC145761. LOC146603 (Accession XM_085514) is another VGAM1931 host target gene. LOC146603 BINDING SITE is HOST TARGET binding site found in the 5' untranslated region of mRNA encoded by LOC146603, corresponding to a HOST TARGET binding site such as BINDING SITE I, BINDING SITE II or BINDING SITE III. Table 2 illustrates the complementarity of the nucleotide sequences of LOC146603 BINDING SITE, designated SEQ ID:38215, to the nucleotide sequence of VGAM1931 RNA, herein designated VGAM RNA, also designated SEQ ID:4642.

Another function of VGAM1931 is therefore inhibition of LOC146603 (Accession XM_085514). Accordingly, utilities of VGAM1931 include diagnosis, prevention and treatment of diseases and clinical conditions associated with LOC146603. LOC202986 (Accession XM_117489) is another VGAM1931 host target gene. LOC202986 BINDING SITE is HOST TARGET binding site found in the 3' untranslated region of mRNA encoded by LOC202986, corresponding to a HOST TARGET binding site such as BINDING SITE I, BINDING SITE II or BINDING SITE III. Table 2 illustrates the complementarity of the nucleotide sequences of LOC202986 BINDING SITE, designated SEQ ID:43470, to the nucleotide sequence of VGAM1931 RNA, herein designated VGAM RNA, also designated SEQ ID:4642.

Another function of VGAM1931 is therefore inhibition of LOC202986 (Accession XM_117489). Accordingly, utilities of VGAM1931 include diagnosis, prevention and treatment of diseases and clinical conditions associated with LOC202986. LOC51312 (Accession NM_018579) is another VGAM1931 host target gene. LOC51312 BINDING SITE is HOST TARGET binding site found in the 5' untranslated region of mRNA encoded by LOC51312, corresponding to a HOST TARGET binding site such as BINDING SITE I, BINDING SITE II or BINDING SITE III. Table 2 illustrates the complementarity of the nucleotide sequences of LOC51312 BINDING SITE, designated SEQ ID:20659, to the nucleotide sequence of VGAM1931 RNA, herein designated VGAM RNA, also designated SEQ ID:4642.

Another function of VGAM1931 is therefore inhibition of LOC51312 (Accession NM_018579). Accordingly, utilities of VGAM1931 include diagnosis, prevention and treatment of diseases and clinical conditions associated with LOC51312. LOC57105 (Accession NM_020377) is another VGAM1931 host target gene. LOC57105 BINDING SITE is HOST TARGET binding site found in the 3' untranslated region of mRNA encoded by LOC57105, corresponding to a HOST TARGET binding site such as BINDING SITE I, BINDING SITE II or BINDING SITE III. Table 2 illustrates the complementarity of the nucleotide sequences of LOC57105 BINDING SITE, designated SEQ ID:21639, to the nucleotide sequence of VGAM1931 RNA, herein designated VGAM RNA, also designated SEQ ID:4642.

Another function of VGAM1931 is therefore inhibition of LOC57105 (Accession NM_020377). Accordingly, utilities of VGAM1931 include diagnosis, prevention and treatment of diseases and clinical conditions associated with LOC57105. FIG. 1 further provides a conceptual description of a novel bioinformatically detected viral gene of the present invention, referred to here as Viral Genomic Address Messenger 1932 (VGAM1932) viral gene, which modulates expression of respective host target genes thereof, the function and utility of which host target genes is known in the art.

VGAM1932 is a novel bioinformatically detected regulatory, non protein coding, viral micro RNA (miRNA) gene. The method by which VGAM1932 was detected is described hereinabove with reference to FIGS. 1-8.

VGAM1932 gene, herein designated VGAM GENE, is a viral gene contained in the genome of Human Herpesvirus 4. VGAM1932 host target gene, herein designated VGAM HOST TARGET GENE, is a human gene contained in the human genome.

VGAM1932 gene encodes a VGAM1932 precursor RNA, herein designated VGAM PRECURSOR RNA. Similar to other miRNA genes, and unlike most ordinary genes, VGAM1932 precursor RNA does not encode a protein. A nucleotide sequence identical or highly similar to the nucleotide sequence of VGAM1932 precursor RNA is designated SEQ ID:1918, and is provided hereinbelow with reference to the sequence listing part. Nucleotide sequence SEQ ID:1918 is located at position 159902 relative to the genome of Human Herpesvirus 4.

VGAM1932 precursor RNA folds onto itself, forming VGAM1932 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1932 folded precursor RNA into VGAM1932 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1932 RNA is designated SEQ ID:4643, and is provided hereinbelow with reference to the sequence listing part.

VGAM1932 host target gene, herein designated VGAM HOST TARGET GENE, encodes a corresponding messenger RNA, VGAM1932 host target RNA, herein designated VGAM HOST TARGET RNA. VGAM1932 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1932 RNA, herein designated VGAM RNA, binds complementarily to one or more host target binding sites located in untranslated regions of VGAM1932 host target RNA, herein designated VGAM HOST TARGET RNA. This complementary binding is due to the fact that the nucleotide sequence of VGAM1932 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1932 RNA, herein designated VGAM RNA, may have a different number of host target binding sites in untranslated regions of a VGAM1932 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1932 RNA, herein designated VGAM RNA, to host target binding sites on VGAM1932 host target RNA, herein designated VGAM HOST TARGET RNA, such as BINDING SITE I, BINDING SITE II and BINDING SITE III, inhibits translation of VGAM1932 host target RNA into VGAM1932 host target protein, herein designated VGAM HOST TARGET PROTEIN. VGAM host target protein is therefore outlined by a broken line.

It is appreciated that VGAM1932 host target gene, herein designated VGAM HOST TARGET GENE, in fact represents a plurality of VGAM1932 host target genes. The mRNA of each one of this plurality of VGAM1932 host target genes comprises one or more host target binding sites, each having a nucleotide sequence which is at least partly complementary to VGAM1932 RNA, herein designated VGAM RNA, and which when bound by VGAM1932 RNA causes inhibition of translation of respective one or more VGAM1932 host target proteins.

It is further appreciated by one skilled in the art that the mode of translational inhibition illustrated by FIG. 1 with specific reference to translational inhibition exerted by VGAM1932 gene, herein designated VGAM GENE, on one or more VGAM1932 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1932 is inhibition of expression of host target genes, as part of a novel viral mechanism of attacking a host. Accordingly, utilities of VGAM1932 include diagnosis, prevention and treatment of viral infection by Human Herpesvirus 4. Specific functions, and accordingly utilities, of VGAM1932 correlate with, and may be deduced from, the identity of the host target genes which VGAM1932 binds and inhibits, and the function of these host target genes, as elaborated hereinbelow.

Nucleotide sequences of the VGAM1932 precursor RNA, herein designated VGAM PRECURSOR RNA, and of the 'diced' VGAM1932 RNA, herein designated VGAM RNA, and a schematic representation of the secondary folding of VGAM1932 folded precursor RNA, herein designated VGAM FOLDED PRECURSOR RNA, of VGAM1932 are further described hereinbelow with reference to Table 1.

Nucleotide sequences of host target binding sites, such as BINDING SITE-I, BINDING SITE-II and BINDING SITE-III of FIG. 1, found on VGAM1932 host target RNA, and schematic representation of the complementarity of each of these host target binding sites to VGAM1932 RNA, herein designated VGAM RNA, are described hereinbelow with reference to Table 2.

As mentioned hereinabove with reference to FIG. 1, a function of VGAM1932 gene, herein designated VGAM is inhibition of expression of VGAM1932 target genes. It is appreciated that specific functions, and accordingly utilities, of VGAM1932 correlate with, and may be deduced from, the identity of the target genes which VGAM1932 binds and inhibits, and the function of these target genes, as elaborated hereinbelow.

UDP-Gal:betaGlcNAc Beta 1,4-Galactosyltransferase, Polypeptide 4 (B4GALT4, Accession NM_003778) is a VGAM1932 host target gene. B4GALT4 BINDING SITE is HOST TARGET binding site found in the 5' untranslated region of mRNA encoded by B4GALT4, corresponding to a HOST TARGET binding site such as BINDING SITE I, BINDING SITE II or BINDING SITE III. Table 2 illustrates the complementarity of the nucleotide sequences of B4GALT4 BINDING SITE, designated SEQ ID:9858, to the nucleotide sequence of VGAM1932 RNA, herein designated VGAM RNA, also designated SEQ ID:4643.

A function of VGAM1932 is therefore inhibition of UDP-Gal:betaGlcNAc Beta 1,4-Galactosyltransferase, Polypeptide 4 (B4GALT4, Accession NM_003778). Accordingly, utilities of VGAM1932 include diagnosis, prevention and treatment of diseases and clinical conditions associated with B4GALT4. Glutamine-fructose-6-phosphate Transaminase 2 (GFPT2, Accession NM_005110) is another VGAM1932 host target gene. GFPT2 BINDING SITE is HOST TARGET binding site found in the 3' untranslated region of mRNA encoded by GFPT2, corresponding to a HOST TARGET binding site such as BINDING SITE I, BINDING SITE II or BINDING SITE III. Table 2 illustrates the complementarity of the nucleotide sequences of GFPT2 BINDING SITE, designated SEQ ID:11594, to the nucleotide sequence of VGAM1932 RNA, herein designated VGAM RNA, also designated SEQ ID:4643.

Another function of VGAM1932 is therefore inhibition of Glutamine-fructose-6-phosphate Transaminase 2 (GFPT2, Accession NM_005110). Accordingly, utilities of VGAM1932 include diagnosis, prevention and treatment of diseases and clinical conditions associated with GFPT2. Solute Carrier Family 1 (neutral amino acid transporter), Member 5 (SLC1A5, Accession NM_005628) is another VGAM1932 host target gene. SLC1A5 BINDING SITE1 and SLC1A5 BINDING SITE2 are HOST TARGET binding sites found in untranslated regions of mRNA encoded by SLC1A5, corresponding to HOST TARGET binding sites such as BINDING SITE I, BINDING SITE II or BINDING SITE III. Table 2 illustrates the complementarity of the nucleotide sequences of SLC1A5 BINDING SITE1 and SLC1A5 BINDING SITE2, designated SEQ ID:12142 and SEQ ID:38402 respectively, to the nucleotide sequence of VGAM1932 RNA, herein designated VGAM RNA, also designated SEQ ID:4643.

Another function of VGAM1932 is therefore inhibition of Solute Carrier Family 1 (neutral amino acid transporter), Member 5 (SLC1A5, Accession NM_005628). Accordingly, utilities of VGAM1932 include diagnosis, prevention and treatment of diseases and clinical conditions associated with SLC1A5. Potassium Channel, Subfamily T, Member 1 (KCNT1, Accession XM_029962) is another VGAM1932 host target gene. KCNT1 BINDING SITE is HOST TARGET binding site found in the 3' untranslated region of mRNA encoded by KCNT1, corresponding to a HOST TARGET binding site such as BINDING SITE I, BINDING SITE II or BINDING SITE III. Table 2 illustrates the complementarity of the nucleotide sequences of KCNT1 BINDING SITE, designated SEQ ID:30974, to the nucleotide sequence of VGAM1932 RNA, herein designated VGAM RNA, also designated SEQ ID:4643.

Another function of VGAM1932 is therefore inhibition of Potassium Channel, Subfamily T, Member 1 (KCNT1, Accession XM_029962). Accordingly, utilities of VGAM1932 include diagnosis, prevention and treatment of diseases and clinical conditions associated with KCNT1. KIAA0258 (Accession NM_014785) is another VGAM1932 host target gene. KIAA0258 BINDING SITE is HOST TARGET binding site found in the 3' untranslated region of mRNA encoded by KIAA0258, corresponding to a HOST TARGET binding site such as BINDING SITE I, BINDING SITE II or BINDING SITE III. Table 2 illustrates the complementarity of the nucleotide sequences of KIAA0258 BINDING SITE, designated SEQ ID:16648, to the nucleotide sequence of VGAM1932 RNA, herein designated VGAM RNA, also designated SEQ ID:4643.

Another function of VGAM1932 is therefore inhibition of KIAA0258 (Accession NM_014785). Accordingly, utilities of VGAM1932 include diagnosis, prevention and treatment of diseases and clinical conditions associated with KIAA0258. KIAA0514 (Accession NM_014696) is another VGAM1932 host target gene. KIAA0514 BINDING SITE is HOST TARGET binding site found in the 3' untranslated region of mRNA encoded by KIAA0514, corresponding to a HOST TARGET binding site such as BINDING SITE I, BINDING SITE II or BINDING SITE III. Table 2 illustrates the complementarity of the nucleotide sequences of KIAA0514 BINDING SITE, designated SEQ ID:16208, to the nucleotide sequence of VGAM1932 RNA, herein designated VGAM RNA, also designated SEQ ID:4643.

Another function of VGAM1932 is therefore inhibition of KIAA0514 (Accession NM_014696). Accordingly, utilities of VGAM1932 include diagnosis, prevention and treatment of diseases and clinical conditions associated with KIAA0514. KIAA1987 (Accession XM_113870) is another VGAM1932 host target gene. KIAA1987 BINDING SITE is HOST TARGET binding site found in the 3' untranslated region of mRNA encoded by KIAA1987, corresponding to a HOST TARGET binding site such as BINDING SITE I, BINDING SITE II or BINDING SITE III. Table 2 illustrates the complementarity of the nucleotide sequences of KIAA1987 BINDING SITE, designated SEQ ID:42498, to the nucleotide sequence of VGAM1932 RNA, herein designated VGAM RNA, also designated SEQ ID:4643.

Another function of VGAM1932 is therefore inhibition of KIAA1987 (Accession XM_113870). Accordingly, utilities of VGAM1932 include diagnosis, prevention and treatment of diseases and clinical conditions associated with KIAA1987. MGC15854 (Accession NM_145029) is another VGAM1932 host target gene. MGC15854 BINDING SITE is HOST TARGET binding site found in the 5' untranslated region of mRNA encoded by MGC15854, corresponding to a HOST TARGET binding site such as BINDING SITE I, BINDING SITE II or BINDING SITE III. Table 2 illustrates the complementarity of the nucleotide sequences of MGC15854 BINDING SITE, designated SEQ ID:29644, to the nucleotide sequence of VGAM1932 RNA, herein designated VGAM RNA, also designated SEQ ID:4643.

Another function of VGAM1932 is therefore inhibition of MGC15854 (Accession NM_145029). Accordingly, utilities of VGAM1932 include diagnosis, prevention and treatment of diseases and clinical conditions associated with MGC15854. MGC16279 (Accession XM_031808) is another VGAM1932 host target gene. MGC16279 BINDING SITE1 and MGC16279 BINDING SITE2 are HOST TARGET binding sites found in untranslated regions of mRNA encoded by MGC16279, corresponding to HOST TARGET binding sites such as BINDING SITE I, BINDING SITE II or BINDING SITE III. Table 2 illustrates the complementarity of the nucleotide sequences of MGC16279 BINDING SITE1 and MGC16279 BINDING SITE2, designated SEQ ID:31487 and SEQ ID:26733 respectively, to the nucleotide sequence of VGAM1932 RNA, herein designated VGAM RNA, also designated SEQ ID:4643.

Another function of VGAM1932 is therefore inhibition of MGC16279 (Accession XM_031808). Accordingly, utilities of VGAM1932 include diagnosis, prevention and treatment of diseases and clinical conditions associated with MGC16279. NY-REN-25 (Accession XM_027116) is another VGAM1932 host target gene. NY-REN-25 BINDING SITE is HOST TARGET binding site found in the 3' untranslated region of mRNA encoded by NY-REN-25, corresponding to a HOST TARGET binding site such as BINDING SITE I, BINDING SITE II or BINDING SITE III. Table 2 illustrates the complementarity of the nucleotide sequences of NY-REN-25 BINDING SITE, designated SEQ ID:30417, to the nucleotide sequence of VGAM1932 RNA, herein designated VGAM RNA, also designated SEQ ID:4643.

Another function of VGAM1932 is therefore inhibition of NY-REN-25 (Accession XM_027116). Accordingly, utilities of VGAM1932 include diagnosis, prevention and treatment of diseases and clinical conditions associated with NY-REN-25. Pleiomorphic Adenoma Gene-like 2 (PLAGL2, Accession XM_047007) is another VGAM1932 host target gene. PLAGL2 BINDING SITE is HOST TARGET binding site found in the 3' untranslated region of mRNA encoded by PLAGL2, corresponding to a HOST TARGET binding site such as BINDING SITE I, BINDING SITE II or BINDING SITE III. Table 2 illustrates the complementarity of the nucleotide sequences of PLAGL2 BINDING SITE, designated SEQ ID:34878, to the nucleotide sequence of VGAM1932 RNA, herein designated VGAM RNA, also designated SEQ ID:4643.

Another function of VGAM1932 is therefore inhibition of Pleiomorphic Adenoma Gene-like 2 (PLAGL2, Accession XM_047007). Accordingly, utilities of VGAM1932 include diagnosis, prevention and treatment of diseases and clinical conditions associated with PLAGL2. PRO0902 (Accession NM_053057) is another VGAM1932 host target gene. PRO0902 BINDING SITE is HOST TARGET binding site found in the 5' untranslated region of mRNA encoded by PRO0902, corresponding to a HOST TARGET binding site such as BINDING SITE I, BINDING SITE II or BINDING SITE III. Table 2 illustrates the complementarity of the nucleotide sequences of PRO0902 BINDING SITE, designated SEQ ID:27609, to the nucleotide sequence of VGAM1932 RNA, herein designated VGAM RNA, also designated SEQ ID:4643.

Another function of VGAM1932 is therefore inhibition of PRO0902 (Accession NM_053057). Accordingly, utilities of VGAM1932 include diagnosis, prevention and treatment of diseases and clinical conditions associated with PRO0902. Sideroflexin 2 (SFXN2, Accession XM_058359) is another VGAM1932 host target gene. SFXN2 BINDING SITE is HOST TARGET binding site found in the 3' untranslated region of mRNA encoded by SFXN2, corresponding to a HOST TARGET binding site such as BINDING SITE I, BINDING SITE II or BINDING SITE III. Table 2 illustrates the complementarity of the nucleotide sequences of SFXN2 BINDING SITE, designated SEQ ID:36604, to the nucleotide sequence of VGAM1932 RNA, herein designated VGAM RNA, also designated SEQ ID:4643.

Another function of VGAM1932 is therefore inhibition of Sideroflexin 2 (SFXN2, Accession XM_058359). Accordingly, utilities of VGAM1932 include diagnosis, prevention and treatment of diseases and clinical conditions associated with SFXN2. Ubc6p (Accession NM_058167) is another VGAM1932 host target gene. Ubc6p BINDING SITE is HOST TARGET binding site found in the 3' untranslated region of mRNA encoded by Ubc6p, corresponding to a HOST TARGET binding site such as BINDING SITE I, BINDING SITE II or BINDING SITE III. Table 2 illustrates the complementarity of the nucleotide sequences of Ubc6p BINDING SITE, designated SEQ ID:27715, to the nucleotide sequence of VGAM1932 RNA, herein designated VGAM RNA, also designated SEQ ID:4643.

Another function of VGAM1932 is therefore inhibition of Ubc6p (Accession NM_058167). Accordingly, utilities of VGAM1932 include diagnosis, prevention and treatment of diseases and clinical conditions associated with Ubc6p. LOC157450 (Accession XM_048209) is another VGAM1932 host target gene. LOC157450 BINDING SITE is HOST TARGET binding site found in the 5' untranslated region of mRNA encoded by LOC157450, corresponding to a HOST TARGET binding site such as BINDING SITE I, BINDING SITE II or BINDING SITE III. Table 2 illustrates the complementarity of the nucleotide sequences of LOC157450 BINDING SITE, designated SEQ ID:35148, to the nucleotide sequence of VGAM1932 RNA, herein designated VGAM RNA, also designated SEQ ID:4643.

Another function of VGAM1932 is therefore inhibition of LOC157450 (Accession XM_048209). Accordingly, utilities of VGAM1932 include diagnosis, prevention and treatment of diseases and clinical conditions associated with LOC157450. LOC51336 (Accession NM_016646) is another VGAM1932 host target gene. LOC51336 BINDING SITE is HOST TARGET binding site found in the 5' untranslated region of mRNA encoded by LOC51336, corresponding to a HOST TARGET binding site such as BINDING SITE I, BINDING SITE II or BINDING SITE III. Table 2 illustrates the complementarity of the nucleotide sequences of LOC51336 BINDING SITE, designated SEQ ID:18758, to the nucleotide sequence of VGAM1932 RNA, herein designated VGAM RNA, also designated SEQ ID:4643.

Another function of VGAM1932 is therefore inhibition of LOC51336 (Accession NM_016646). Accordingly, utilities of VGAM1932 include diagnosis, prevention and treatment of diseases and clinical conditions associated with LOC51336. LOC91409 (Accession XM_038298) is another VGAM1932 host target gene. LOC91409 BINDING SITE is HOST TARGET binding site found in the 3' untranslated region of mRNA encoded by LOC91409, corresponding to a HOST TARGET binding site such as BINDING SITE I, BINDING SITE II or BINDING SITE III. Table 2 illustrates the complementarity of the nucleotide sequences of LOC91409 BINDING SITE, designated SEQ ID:32805, to the nucleotide sequence of VGAM1932 RNA, herein designated VGAM RNA, also designated SEQ ID:4643.

Another function of VGAM1932 is therefore inhibition of LOC91409 (Accession XM_038298). Accordingly, utilities of VGAM1932 include diagnosis, prevention and treatment of diseases and clinical conditions associated with LOC91409. FIG. 1 further provides a conceptual description of a novel bioinformatically detected viral gene of the present invention, referred to here as Viral Genomic Address Messenger 1933 (VGAM1933) viral gene, which modulates expression of respective host target genes thereof, the function and utility of which host target genes is known in the art.

VGAM1933 is a novel bioinformatically detected regulatory, non protein coding, viral micro RNA (miRNA) gene. The method by which VGAM1933 was detected is described hereinabove with reference to FIGS. 1-8.

VGAM1933 gene, herein designated VGAM GENE, is a viral gene contained in the genome of Human Herpesvirus 4. VGAM1933 host target gene, herein designated VGAM HOST TARGET GENE, is a human gene contained in the human genome.

VGAM1933 gene encodes a VGAM1933 precursor RNA, herein designated VGAM PRECURSOR RNA. Similar to other miRNA genes, and unlike most ordinary genes, VGAM1933 precursor RNA does not encode a protein. A nucleotide sequence identical or highly similar to the nucleotide sequence of VGAM1933 precursor RNA is designated SEQ ID:1919, and is provided hereinbelow with reference to the sequence listing part. Nucleotide sequence SEQ ID:1919 is located at position 156037 relative to the genome of Human Herpesvirus 4.

VGAM1933 precursor RNA folds onto itself, forming VGAM1933 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1933 folded precursor RNA into VGAM1933 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1933 RNA is designated SEQ ID:4644, and is provided hereinbelow with reference to the sequence listing part.

VGAM1933 host target gene, herein designated VGAM HOST TARGET GENE, encodes a corresponding messenger RNA, VGAM1933 host target RNA, herein designated VGAM HOST TARGET RNA. VGAM1933 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1933 RNA, herein designated VGAM RNA, binds complementarily to one or more host target binding sites located in untranslated regions of VGAM1933 host target RNA, herein designated VGAM HOST TARGET RNA. This complementary binding is due to the fact that the nucleotide sequence of VGAM1933 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1933 RNA, herein designated VGAM RNA, may have a different number of host target binding sites in untranslated regions of a VGAM1933 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1933 RNA, herein designated VGAM RNA, to host target binding sites on VGAM1933 host target RNA, herein designated VGAM HOST TARGET RNA, such as BINDING SITE I, BINDING SITE II and BINDING SITE III, inhibits translation of VGAM1933 host target RNA into VGAM1933 host target protein, herein designated VGAM HOST TARGET PROTEIN. VGAM host target protein is therefore outlined by a broken line.

It is appreciated that VGAM1933 host target gene, herein designated VGAM HOST TARGET GENE, in fact represents a plurality of VGAM1933 host target genes. The mRNA of each one of this plurality of VGAM1933 host target genes comprises one or more host target binding sites, each having a nucleotide sequence which is at least partly complementary to VGAM1933 RNA, herein designated VGAM RNA, and which when bound by VGAM1933 RNA causes inhibition of translation of respective one or more VGAM1933 host target proteins.

It is further appreciated by one skilled in the art that the mode of translational inhibition illustrated by FIG. 1 with specific reference to translational inhibition exerted by VGAM1933 gene, herein designated VGAM GENE, on one or more VGAM1933 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1933 is inhibition of expression of host target genes, as part of a novel viral mechanism of attacking a host. Accordingly, utilities of VGAM1933 include diagnosis, prevention and treatment of viral infection by Human Herpesvirus 4. Specific functions, and accordingly utilities, of VGAM1933 correlate with, and may be deduced from, the identity of the host target genes which VGAM1933 binds and inhibits, and the function of these host target genes, as elaborated hereinbelow.

Nucleotide sequences of the VGAM1933 precursor RNA, herein designated VGAM PRECURSOR RNA, and of the 'diced' VGAM1933 RNA, herein designated VGAM RNA, and a schematic representation of the secondary folding of VGAM1933 folded precursor RNA, herein designated VGAM FOLDED PRECURSOR RNA, of VGAM1933 are further described hereinbelow with reference to Table 1.

Nucleotide sequences of host target binding sites, such as BINDING SITE-I, BINDING SITE-II and BINDING SITE-III of FIG. 1, found on VGAM1933 host target RNA, and schematic representation of the complementarity of each of these host target binding sites to VGAM1933 RNA, herein designated VGAM RNA, are described hereinbelow with reference to Table 2.

As mentioned hereinabove with reference to FIG. 1, a function of VGAM1933 gene, herein designated VGAM is inhibition of expression of VGAM1933 target genes. It is appreciated that specific functions, and accordingly utilities, of VGAM1933 correlate with, and may be deduced from, the identity of the target genes which VGAM1933 binds and inhibits, and the function of these target genes, as elaborated hereinbelow.

Cadherin 8, Type 2 (CDH8, Accession NM_001796) is a VGAM1933 host target gene. CDH8 BINDING SITE is HOST TARGET binding site found in the 5' untranslated region of mRNA encoded by CDH8, corresponding to a HOST TARGET binding site such as BINDING SITE I, BINDING SITE II or BINDING SITE III. Table 2 illustrates the complementarity of the nucleotide sequences of CDH8 BINDING SITE, designated SEQ ID:7550, to the nucleotide sequence of VGAM1933 RNA, herein designated VGAM RNA, also designated SEQ ID:4644.

A function of VGAM1933 is therefore inhibition of Cadherin 8, Type 2 (CDH8, Accession NM_001796), a gene which plays an important role in development and maintenance of tissues. Accordingly, utilities of VGAM1933 include diagnosis, prevention and treatment of diseases and clinical conditions associated with CDH8. The function of CDH8 has been established by previous studies. Cadherins are integral membrane proteins that mediate calcium-dependent cell-cell adhesion. They are thought to play an important role in development and maintenance of tissues and may be involved in the invasion and metastasis of malignant tumors. Mature cadherin proteins are composed of a large N-terminal extracellular domain, a single membrane-spanning domain, and a small C-terminal cytoplasmic domain. The extracellular domain consists of 5 subdomains, each containing a cadherin motif, and appears to determine the specificity of the homophilic cell adhesion activity of the cadherin; the amino acid sequence of the cytoplasmic domain is highly conserved among cadherins. By PCR using degenerate oligonucleotides based on highly conserved sequences of the cadherin cytoplasmic domain, followed by screening of a human fetal brain cDNA library, Suzuki et al. (1991) isolated a partial cDNA encoding CDH8. Northern blot analysis detected Cdh8 expression only in rat brain, with multiple transcripts present. Tanihara et al. (1994) isolated a human brain cDNA containing the entire coding sequence of CDH8. The predicted 793-amino acid CDH8 protein contains a signal sequence, prosequence, extracellular domain, transmembrane sequence, and cytoplasmic domain. The extracellular domain of CDH8 has 66%, 58%, and 40% amino acid identity with the extracellular domains of human CDH11 (OMIM Ref. No. 600023), CDH12 (OMIM Ref. No. 600562), and CDH5 (OMIM Ref. No. 601120), respectively Full details of the abovementioned studies are described in the following publications, the disclosure of which are hereby incorporated by reference:

Kremmidiotis, G.; Baker, E.; Crawford, J.; Eyre, H. J.; Nahmias, J.; Callen, D. F.: Localization of human cadherin genes to chromosome regions exhibiting cancer-related loss of heterozygosity. Genomics 49:467-471, 1998; and Suzuki, S.; Sano, K.; Tanihara, H.: Diversity of the cadherin family: evidence for eight new cadherins in nervous tissue. Cell Regul. 2:261-270, 1991.

Further studies establishing the function and utilities of CDH8 are found in John Hopkins OMIM database record ID 603008, and in sited publications numbered 1164 and 8336 listed in the bibliography section hereinbelow, which are also hereby incorporated by reference. Glutamate Receptor, Metabotropic 7 (GRM7, Accession NM_000844) is another VGAM1933 host target gene. GRM7 BINDING SITE is HOST TARGET binding site found in the 3' untranslated region of mRNA encoded by GRM7, corresponding to a HOST TARGET binding site such as BINDING SITE I, BINDING SITE II or BINDING SITE III. Table 2 illustrates the complementarity of the nucleotide sequences of GRM7 BINDING SITE, designated SEQ ID:6516, to the nucleotide sequence of VGAM1933 RNA, herein designated VGAM RNA, also designated SEQ ID:4644.

Another function of VGAM1933 is therefore inhibition of Glutamate Receptor, Metabotropic 7 (GRM7, Accession NM_000844), a gene which is mediated by a g-protein that inhibits adenylate cyclase activity. Accordingly, utilities of VGAM1933 include diagnosis, prevention and treatment of diseases and clinical conditions associated with GRM7. The function of GRM7 and its association with various diseases and clinical conditions, has been established by previous studies, as described hereinabove with reference to VGAM746. Molybdenum Cofactor Synthesis 1 (MOCS1, Accession XM_166358) is another VGAM1933 host target gene. MOCS1 BINDING SITE is HOST TARGET binding site found in the 3' untranslated region of mRNA encoded by MOCS1, corresponding to a HOST TARGET binding site such as BINDING SITE I, BINDING SITE II or BINDING SITE III. Table 2 illustrates the complementarity of the nucleotide sequences of MOCS1 BINDING SITE, designated SEQ ID:44186, to the nucleotide sequence of VGAM1933 RNA, herein designated VGAM RNA, also designated SEQ ID:4644.

Another function of VGAM1933 is therefore inhibition of Molybdenum Cofactor Synthesis 1 (MOCS1, Accession XM_166358). Accordingly, utilities of VGAM1933 include diagnosis, prevention and treatment of diseases and clinical conditions associated with MOCS1. Neuralized-like (Drosophila) (NEURL, Accession NM_004210) is another VGAM1933 host target gene. NEURL BINDING SITE is HOST TARGET binding site found in the 3' untranslated region of mRNA encoded by NEURL, corresponding to a HOST TARGET binding site such as BINDING SITE I, BINDING SITE II or BINDING SITE III. Table 2 illustrates the complementarity of the nucleotide sequences of NEURL BINDING SITE, designated SEQ ID:10410, to the nucleotide sequence of VGAM1933 RNA, herein designated VGAM RNA, also designated SEQ ID:4644.

Another function of VGAM1933 is therefore inhibition of Neuralized-like (Drosophila) (NEURL, Accession NM_004210). Accordingly, utilities of VGAM1933 include diagnosis, prevention and treatment of diseases and clinical conditions associated with NEURL. Runt-related Transcription Factor 1 (acute myeloid leukemia 1; aml1 oncogene) (RUNX1, Accession NM_001754) is another VGAM1933 host target gene. RUNX1 BINDING SITE is HOST TARGET binding site found in the 3' untranslated region of mRNA encoded by RUNX1, corresponding to a HOST TARGET binding site such as BINDING SITE I, BINDING SITE II or BINDING SITE III. Table 2 illustrates the complementarity of the nucleotide sequences of RUNX1 BINDING SITE, designated SEQ ID:7495, to the nucleotide sequence of VGAM1933 RNA, herein designated VGAM RNA, also designated SEQ ID:4644.

Another function of VGAM1933 is therefore inhibition of Runt-related Transcription Factor 1 (acute myeloid leukemia 1; aml1 oncogene) (RUNX1, Accession NM_001754). Accordingly, utilities of VGAM1933 include diagnosis, prevention and treatment of diseases and clinical conditions associated with RUNX1. Tripartite Motif-containing 8 (TRIM8, Accession NM_030912) is another VGAM1933 host target gene. TRIM8 BINDING SITE is HOST TARGET binding site found in the 3' untranslated region of mRNA encoded by TRIM8, corresponding to a HOST TARGET binding site such as BINDING SITE I, BINDING SITE II or BINDING SITE III. Table 2 illustrates the complementarity of the nucleotide sequences of TRIM8 BINDING SITE, designated SEQ ID:25179, to the nucleotide sequence of VGAM1933 RNA, herein designated VGAM RNA, also designated SEQ ID:4644.

Another function of VGAM1933 is therefore inhibition of Tripartite Motif-containing 8 (TRIM8, Accession NM_030912). Accordingly, utilities of VGAM1933 include diagnosis, prevention and treatment of diseases and clinical conditions associated with TRIM8. Aldehyde Dehydrogenase 5 Family, Member A1 (succinate-semialdehyde dehydrogenase) (ALDH5A1, Accession NM_001080) is another VGAM1933 host target gene. ALDH5A1 BINDING SITE is HOST TARGET binding site found in the 3' untranslated region of mRNA encoded by ALDH5A1, corresponding to a HOST TARGET binding site such as BINDING SITE I, BINDING SITE II or BINDING SITE III. Table 2 illustrates the complementarity of the nucleotide sequences of ALDH5A1 BINDING SITE, designated SEQ ID:6740, to the nucleotide sequence of VGAM1933 RNA, herein designated VGAM RNA, also designated SEQ ID:4644.

Another function of VGAM1933 is therefore inhibition of Aldehyde Dehydrogenase 5 Family, Member A1 (succinate-semialdehyde dehydrogenase) (ALDH5A1, Accession NM_001080). Accordingly, utilities of VGAM1933 include diagnosis, prevention and treatment of diseases and clinical conditions associated with ALDH5A1. Chromosome 22 Open Reading Frame 20 (C22orf20, Accession NM_025225) is another VGAM1933 host target gene. C22orf20 BINDING SITE is HOST TARGET binding site found in the 3' untranslated region of mRNA encoded by C22orf20, corresponding to a HOST TARGET binding site such as BINDING SITE I, BINDING SITE II or BINDING SITE III. Table 2 illustrates the complementarity of the nucleotide sequences of C22orf20 BINDING SITE, designated SEQ ID:24902, to the nucleotide sequence of VGAM1933 RNA, herein designated VGAM RNA, also designated SEQ ID:4644.

Another function of VGAM1933 is therefore inhibition of Chromosome 22 Open Reading Frame 20 (C22orf20, Accession NM_025225). Accordingly, utilities of VGAM1933 include diagnosis, prevention and treatment of diseases and clinical conditions associated with C22orf20. FLJ22969 (Accession XM_044006) is another VGAM1933 host target gene. FLJ22969 BINDING SITE is HOST TARGET binding site found in the 3' untranslated region of mRNA encoded by FLJ22969, corresponding to a HOST TARGET binding site such as BINDING SITE I, BINDING SITE II or BINDING SITE III. Table 2 illustrates the complementarity of the nucleotide sequences of FLJ22969 BINDING SITE, designated SEQ ID:34064, to the nucleotide sequence of VGAM1933 RNA, herein designated VGAM RNA, also designated SEQ ID:4644.

Another function of VGAM1933 is therefore inhibition of FLJ22969 (Accession XM_044006). Accordingly, utilities of VGAM1933 include diagnosis, prevention and treatment of diseases and clinical conditions associated with FLJ22969. KIAA0441 (Accession NM_014797) is another VGAM1933 host target gene. KIAA0441 BINDING SITE is HOST TARGET binding site found in the 3' untranslated region of mRNA encoded by KIAA0441, corresponding to a HOST TARGET binding site such as BINDING SITE I, BINDING SITE II or BINDING SITE III. Table 2 illustrates the complementarity of the nucleotide sequences of KIAA0441 BINDING SITE, designated SEQ ID:16707, to the nucleotide sequence of VGAM1933 RNA, herein designated VGAM RNA, also designated SEQ ID:4644.

Another function of VGAM1933 is therefore inhibition of KIAA0441 (Accession NM_014797). Accordingly, utilities of VGAM1933 include diagnosis, prevention and treatment of diseases and clinical conditions associated with KIAA0441. KIAA1265 (Accession XM_047707) is another VGAM1933 host target gene. KIAA1265 BINDING SITE is HOST TARGET binding site found in the 3' untranslated region of mRNA encoded by KIAA1265, corresponding to a HOST TARGET binding site such as BINDING SITE I, BINDING SITE II or BINDING SITE III. Table 2 illustrates the complementarity of the nucleotide sequences of KIAA1265 BINDING SITE, designated SEQ ID:35031, to the nucleotide sequence of VGAM1933 RNA, herein designated VGAM RNA, also designated SEQ ID:4644.

Another function of VGAM1933 is therefore inhibition of KIAA1265 (Accession XM_047707). Accordingly, utilities of VGAM1933 include diagnosis, prevention and treatment of diseases and clinical conditions associated with KIAA1265. KIAA1789 (Accession XM_040486) is another VGAM1933 host target gene. KIAA1789 BINDING SITE is HOST TARGET binding site found in the 5' untranslated region of mRNA encoded by KIAA1789, corresponding to a HOST TARGET binding site such as BINDING SITE I, BINDING SITE II or BINDING SITE III. Table 2 illustrates the complementarity of the nucleotide sequences of KIAA1789 BINDING SITE, designated SEQ ID:33309, to the nucleotide sequence of VGAM1933 RNA, herein designated VGAM RNA, also designated SEQ ID:4644.

Another function of VGAM1933 is therefore inhibition of KIAA1789 (Accession XM_040486). Accordingly, utilities of VGAM1933 include diagnosis, prevention and treatment of diseases and clinical conditions associated with KIAA1789. NFASC (Accession XM_046808) is another VGAM1933 host target gene. NFASC BINDING SITE is HOST TARGET binding site found in the 3' untranslated region of mRNA encoded by NFASC, corresponding to a HOST TARGET binding site such as BINDING SITE I, BINDING SITE II or BINDING SITE III. Table 2 illustrates the complementarity of the nucleotide sequences of NFASC BINDING SITE, designated SEQ ID:34827, to the nucleotide sequence of VGAM1933 RNA, herein designated VGAM RNA, also designated SEQ ID:4644.

Another function of VGAM1933 is therefore inhibition of NFASC (Accession XM_046808). Accordingly, utilities of VGAM1933 include diagnosis, prevention and treatment of diseases and clinical conditions associated with NFASC. Paired Mesoderm Homeobox 2b (PMX2B, Accession NM_003924) is another VGAM1933 host target gene. PMX2B BINDING SITE is HOST TARGET binding site found in the 3' untranslated region of mRNA encoded by PMX2B, corresponding to a HOST TARGET binding site such as BINDING SITE I, BINDING SITE II or BINDING SITE III. Table 2 illustrates the complementarity of the nucleotide sequences of PMX2B BINDING SITE, designated SEQ ID:10013, to the nucleotide sequence of VGAM1933 RNA, herein designated VGAM RNA, also designated SEQ ID:4644.

Another function of VGAM1933 is therefore inhibition of Paired Mesoderm Homeobox 2b (PMX2B, Accession NM_003924). Accordingly, utilities of VGAM1933 include diagnosis, prevention and treatment of diseases and clinical conditions associated with PMX2B. Protein Phosphatase 1, Regulatory (inhibitor) Subunit 16B (PPP1R16B, Accession XM_028840) is another VGAM1933 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30766, to the nucleotide sequence of VGAM1933 RNA, herein designated VGAM RNA, also designated SEQ ID:4644.

Another function of VGAM1933 is therefore inhibition of Protein Phosphatase 1, Regulatory (inhibitor) Subunit 16B (PPP1R16B, Accession XM_028840). Accordingly, utilities of VGAM1933 include diagnosis, prevention and treatment of diseases and clinical conditions associated with PPP1R16B. LOC146138 (Accession XM_096938) is another VGAM1933 host target gene. LOC146138 BINDING SITE is HOST TARGET binding site found in the 3' untranslated region of mRNA encoded by LOC146138, corresponding to a HOST TARGET binding site such as BINDING SITE I, BINDING SITE II or BINDING SITE III. Table 2 illustrates the complementarity of the nucleotide sequences of LOC146138 BINDING SITE, designated SEQ ID:40653, to the nucleotide sequence of VGAM1933 RNA, herein designated VGAM RNA, also designated SEQ ID:4644.

Another function of VGAM1933 is therefore inhibition of LOC146138 (Accession XM_096938). Accordingly, utilities of VGAM1933 include diagnosis, prevention and treatment of diseases and clinical conditions associated with LOC146138. LOC146332 (Accession XM_085413) is another VGAM1933 host target gene. LOC146332 BINDING SITE is HOST TARGET binding site found in the 3' untranslated region of mRNA encoded by LOC146332, corresponding to a HOST TARGET binding site such as BINDING SITE I, BINDING SITE II or BINDING SITE III. Table 2 illustrates the complementarity of the nucleotide sequences of LOC146332 BINDING SITE, designated SEQ ID:38127, to the nucleotide sequence of VGAM1933 RNA, herein designated VGAM RNA, also designated SEQ ID:4644.

Another function of VGAM1933 is therefore inhibition of LOC146332 (Accession XM_085413). Accordingly, utilities of VGAM1933 include diagnosis, prevention and treatment of diseases and clinical conditions associated with LOC146332. LOC150311 (Accession XM_086858) is another VGAM1933 host target gene. LOC150311 BINDING SITE is HOST TARGET binding site found in the 5' untranslated region of mRNA encoded by LOC150311, corresponding to a HOST TARGET binding site such as BINDING SITE I, BINDING SITE II or BINDING SITE III. Table 2 illustrates the complementarity of the nucleotide sequences of LOC150311 BINDING SITE, designated SEQ ID:38927, to the nucleotide sequence of VGAM1933 RNA, herein designated VGAM RNA, also designated SEQ ID:4644.

Another function of VGAM1933 is therefore inhibition of LOC150311 (Accession XM_086858). Accordingly, utilities of VGAM1933 include diagnosis, prevention and treatment of diseases and clinical conditions associated with LOC150311. LOC150383 (Accession XM_086905) is another VGAM1933 host target gene. LOC150383 BINDING SITE is HOST TARGET binding site found in the 3' untranslated region of mRNA encoded by LOC150383, corresponding to a HOST TARGET binding site such as BINDING SITE I, BINDING SITE II or BINDING SITE III. Table 2 illustrates the complementarity of the nucleotide sequences of LOC150383 BINDING SITE, designated SEQ ID:38944, to the nucleotide sequence of VGAM1933 RNA, herein designated VGAM RNA, also designated SEQ ID:4644.

Another function of VGAM1933 is therefore inhibition of LOC150383 (Accession XM_086905). Accordingly, utilities of VGAM1933 include diagnosis, prevention and treatment of diseases and clinical conditions associated with LOC150383. LOC154449 (Accession XM_087928) is another VGAM1933 host target gene. LOC154449 BINDING SITE is HOST TARGET binding site found in the 5' untranslated region of mRNA encoded by LOC154449, corresponding to a HOST TARGET binding site such as BINDING SITE I, BINDING SITE II or BINDING SITE III. Table 2 illustrates the complementarity of the nucleotide sequences of LOC154449 BINDING SITE, designated SEQ ID:39474, to the nucleotide sequence of VGAM1933 RNA, herein designated VGAM RNA, also designated SEQ ID:4644.

Another function of VGAM1933 is therefore inhibition of LOC154449 (Accession XM_087928). Accordingly, utilities of VGAM1933 include diagnosis, prevention and treatment of diseases and clinical conditions associated with LOC154449. LOC158654 (Accession XM_088632) is another VGAM1933 host target gene. LOC158654 BINDING SITE is HOST TARGET binding site found in the 5' untranslated region of mRNA encoded by LOC158654, corresponding to a HOST TARGET binding site such as BINDING SITE I, BINDING SITE II or BINDING SITE III. Table 2 illustrates the complementarity of the nucleotide sequences of LOC158654 BINDING SITE, designated SEQ ID:39875, to the nucleotide sequence of VGAM1933 RNA, herein designated VGAM RNA, also designated SEQ ID:4644.

Another function of VGAM1933 is therefore inhibition of LOC158654 (Accession XM_088632). Accordingly, utilities of VGAM1933 include diagnosis, prevention and treatment of diseases and clinical conditions associated with LOC158654. LOC253443 (Accession XM_171074) is another VGAM1933 host target gene. LOC253443 BINDING SITE is HOST TARGET binding site found in the 3' untranslated region of mRNA encoded by LOC253443, corresponding to a HOST TARGET binding site such as BINDING SITE I, BINDING SITE II or BINDING SITE III. Table 2 illustrates the complementarity of the nucleotide sequences of LOC253443 BINDING SITE, designated SEQ ID:45883, to the nucleotide sequence of VGAM1933 RNA, herein designated VGAM RNA, also designated SEQ ID:4644.

Another function of VGAM1933 is therefore inhibition of LOC253443 (Accession XM_171074). Accordingly, utilities of VGAM1933 include diagnosis, prevention and treatment of diseases and clinical conditions associated with LOC253443. LOC255388 (Accession XM_173161) is another VGAM1933 host target gene. LOC255388 BINDING SITE is HOST TARGET binding site found in the 5' untranslated region of mRNA encoded by LOC255388, corresponding to a HOST TARGET binding site such as BINDING SITE I, BINDING SITE II or BINDING SITE III. Table 2 illustrates the complementarity of the nucleotide sequences of LOC255388 BINDING SITE, designated SEQ ID:46418, to the nucleotide sequence of VGAM1933 RNA, herein designated VGAM RNA, also designated SEQ ID:4644.

Another function of VGAM1933 is therefore inhibition of LOC255388 (Accession XM_173161). Accordingly, utilities of VGAM1933 include diagnosis, prevention and treatment of diseases and clinical conditions associated with LOC255388. LOC256310 (Accession XM_172813) is another VGAM1933 host target gene. LOC256310 BINDING SITE is HOST TARGET binding site found in the 3' untranslated region of mRNA encoded by LOC256310, corresponding to a HOST TARGET binding site such as BINDING SITE I, BINDING SITE II or BINDING SITE III. Table 2 illustrates the complementarity of the nucleotide sequences of LOC256310 BINDING SITE, designated SEQ ID:46095, to the nucleotide sequence of VGAM1933 RNA, herein designated VGAM RNA, also designated SEQ ID:4644.

Another function of VGAM1933 is therefore inhibition of LOC256310 (Accession XM_172813). Accordingly, utilities of VGAM1933 include diagnosis, prevention and treatment of diseases and clinical conditions associated with LOC256310. LOC51701 (Accession NM_016231) is another VGAM1933 host target gene. LOC51701 BINDING SITE is HOST TARGET binding site found in the 3' untranslated region of mRNA encoded by LOC51701, corresponding to a HOST TARGET binding site such as BINDING SITE I, BINDING SITE II or BINDING SITE III. Table 2 illustrates the complementarity of the nucleotide sequences of LOC51701 BINDING SITE, designated SEQ ID:18345, to the nucleotide sequence of VGAM1933 RNA, herein designated VGAM RNA, also designated SEQ ID:4644.

Another function of VGAM1933 is therefore inhibition of LOC51701 (Accession NM_016231). Accordingly, utilities of VGAM1933 include diagnosis, prevention and treatment of diseases and clinical conditions associated with LOC51701. FIG. 1 further provides a conceptual description of a novel bioinformatically detected viral gene of the present invention, referred to here as Viral Genomic Address Messenger 1934 (VGAM1934) viral gene, which modulates expression of respective host target genes thereof, the function and utility of which host target genes is known in the art.

VGAM1934 is a novel bioinformatically detected regulatory, non protein coding, viral micro RNA (miRNA) gene. The method by which VGAM1934 was detected is described hereinabove with reference to FIGS. 1-8.

VGAM1934 gene, herein designated VGAM GENE, is a viral gene contained in the genome of Human Herpesvirus 4. VGAM1934 host target gene, herein designated VGAM HOST TARGET GENE, is a human gene contained in the human genome.

VGAM1934 gene encodes a VGAM1934 precursor RNA, herein designated VGAM PRECURSOR RNA. Similar to other miRNA genes, and unlike most ordinary genes, VGAM1934 precursor RNA does not encode a protein. A nucleotide sequence identical or highly similar to the nucleotide sequence of VGAM1934 precursor RNA is designated SEQ ID:1920, and is provided hereinbelow with reference to the sequence listing part. Nucleotide sequence SEQ ID:1920 is located at position 157308 relative to the genome of Human Herpesvirus 4.

VGAM1934 precursor RNA folds onto itself, forming VGAM1934 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1934 folded precursor RNA into VGAM1934 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM1934 RNA is designated SEQ ID:4645, and is provided hereinbelow with reference to the sequence listing part.

VGAM1934 host target gene, herein designated VGAM HOST TARGET GENE, encodes a corresponding messenger RNA, VGAM1934 host target RNA, herein designated VGAM HOST TARGET RNA. VGAM1934 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1934 RNA, herein designated VGAM RNA, binds complementarily to one or more host target binding sites located in untranslated regions of VGAM1934 host target RNA, herein designated VGAM HOST TARGET RNA. This complementary binding is due to the fact that the nucleotide sequence of VGAM1934 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1934 RNA, herein designated VGAM RNA, may have a different number of host target binding sites in untranslated regions of a VGAM1934 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1934 RNA, herein designated VGAM RNA, to host target binding sites on VGAM1934 host target RNA, herein designated VGAM HOST TARGET RNA, such as BINDING SITE I, BINDING SITE II and BINDING SITE III, inhibits translation of VGAM1934 host target RNA into VGAM1934 host target protein, herein designated VGAM HOST TARGET PROTEIN. VGAM host target protein is therefore outlined by a broken line.

It is appreciated that VGAM1934 host target gene, herein designated VGAM HOST TARGET GENE, in fact represents a plurality of VGAM1934 host target genes. The mRNA of each one of this plurality of VGAM1934 host target genes comprises one or more host target binding sites, each having a nucleotide sequence which is at least partly complementary to VGAM1934 RNA, herein designated VGAM RNA, and which when bound by VGAM1934 RNA causes inhibition of translation of respective one or more VGAM1934 host target proteins.

It is further appreciated by one skilled in the art that the mode of translational inhibition illustrated by FIG. 1 with specific reference to translational inhibition exerted by VGAM1934 gene, herein designated VGAM GENE, on one or more VGAM1934 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1934 is inhibition of expression of host target genes, as part of a novel viral mechanism of attacking a host. Accordingly, utilities of VGAM1934 include diagnosis, prevention and treatment of viral infection by Human Herpesvirus 4. Specific functions, and accordingly utilities, of VGAM1934 correlate with, and may be deduced from, the identity of the host target genes which VGAM1934 binds and inhibits, and the function of these host target genes, as elaborated hereinbelow.

Nucleotide sequences of the VGAM1934 precursor RNA, herein designated VGAM PRECURSOR RNA, and of the 'diced' VGAM1934 RNA, herein designated VGAM RNA, and a schematic representation of the secondary folding of VGAM1934 folded precursor RNA, herein designated VGAM FOLDED PRECURSOR RNA, of VGAM1934 are further described hereinbelow with reference to Table 1.

Nucleotide sequences of host target binding sites, such as BINDING SITE-I, BINDING SITE-II and BINDING SITE-III of FIG. 1, found on VGAM1934 host target RNA, and schematic representation of the complementarity of each of these host target binding sites to VGAM1934 RNA, herein designated VGAM RNA, are described hereinbelow with reference to Table 2.

As mentioned hereinabove with reference to FIG. 1, a function of VGAM1934 gene, herein designated VGAM is inhibition of expression of VGAM1934 target genes. It is appreciated that specific functions, and accordingly utilities, of VGAM1934 correlate with, and may be deduced from, the identity of the target genes which VGAM1934 binds and inhibits, and the function of these target genes, as elaborated hereinbelow.

Acyl-Coenzyme A Dehydrogenase, Short/branched Chain (ACADSB, Accession NM_001609) is a VGAM1934 host target gene. ACADSB BINDING SITE is HOST TARGET binding site found in the 3' untranslated region of mRNA encoded by ACADSB, corresponding to a HOST TARGET binding site such as BINDING SITE I, BINDING SITE II or BINDING SITE III. Table 2 illustrates the complementarity of the nucleotide sequences of ACADSB BINDING SITE, designated SEQ ID:7315, to the nucleotide sequence of VGAM1934 RNA, herein designated VGAM RNA, also designated SEQ ID:4645.

A function of VGAM1934 is therefore inhibition of Acyl-Coenzyme A Dehydrogenase, Short/branched Chain (ACADSB, Accession NM_001609). Accordingly, utilities of VGAM1934 include diagnosis, prevention and treatment of diseases and clinical conditions associated with ACADSB. Protein Phosphatase 1, Regulatory (inhibitor) Subunit 3A (glycogen and sarcoplasmic reticulum binding subunit, skeletal muscle) (PPP1R3A, Accession NM_002711) is another VGAM1934 host target gene. PPP1R3A BINDING SITE is HOST TARGET binding site found in the 3' untranslated region of mRNA encoded by PPP1R3A, corresponding to a HOST TARGET binding site such as BINDING SITE I, BINDING SITE II or BINDING SITE III. Table 2 illustrates the complementarity of the nucleotide sequences of PPP1R3A BINDING SITE, designated SEQ ID:8563, to the nucleotide sequence of VGAM1934 RNA, herein designated VGAM RNA, also designated SEQ ID:4645.

Another function of VGAM1934 is therefore inhibition of Protein Phosphatase 1, Regulatory (inhibitor) Subunit 3A (glycogen and sarcoplasmic reticulum binding subunit, skeletal muscle) (PPP1R3A, Accession NM_002711), a gene which regulates phosphatase activity towards glycogen synthase, active in skeletal muscle. Accordingly, utilities of VGAM1934 include diagnosis, prevention and treatment of diseases and clinical conditions associated with PPP1R3A. The function of PPP1R3A and its association with various diseases and clinical conditions, has been established by previous studies, as described hereinabove with reference to VGAM1872. DKFZP564C103 (Accession NM_015654) is another VGAM1934 host target gene. DKFZP564C103 BINDING SITE is HOST TARGET binding site found in the 3' untranslated region of mRNA encoded by DKFZP564C103, corresponding to a HOST TARGET binding site such as BINDING SITE I, BINDING SITE II or BINDING SITE III. Table 2 illustrates the complementarity of the nucleotide sequences of DKFZP564C103 BINDING SITE, designated SEQ ID:17900, to the nucleotide sequence of VGAM1934 RNA, herein designated VGAM RNA, also designated SEQ ID:4645.

Another function of VGAM1934 is therefore inhibition of DKFZP564C103 (Accession NM_015654). Accordingly, utilities of VGAM1934 include diagnosis, prevention and treatment of diseases and clinical conditions associated with DKFZP564C103. FLJ22479 (Accession NM_024900) is another VGAM1934 host target gene. FLJ22479 BINDING SITE is HOST TARGET binding site found in the 3' untranslated region of mRNA encoded by FLJ22479, corresponding to a HOST TARGET binding site such as BINDING SITE I, BINDING SITE II or BINDING SITE III. Table 2 illustrates the complementarity of the nucleotide sequences of FLJ22479 BINDING SITE, designated SEQ ID:24384, to the nucleotide sequence of VGAM1934 RNA, herein designated VGAM RNA, also designated SEQ ID:4645.

Another function of VGAM1934 is therefore inhibition of FLJ22479 (Accession NM_024900). Accordingly, utilities of VGAM1934 include diagnosis, prevention and treatment of diseases and clinical conditions associated with FLJ22479. Ganglioside Induced Differentiation Associated Protein 2 (GDAP2, Accession NM_017686) is another VGAM1934 host target gene. GDAP2 BINDING SITE is HOST TARGET binding site found in the 3' untranslated region of mRNA encoded by GDAP2, corresponding to a HOST TARGET binding site such as BINDING SITE I, BINDING SITE II or BINDING SITE III. Table 2 illustrates the complementarity of the nucleotide sequences of GDAP2 BINDING SITE, designated SEQ ID:19239, to the nucleotide sequence of VGAM1934 RNA, herein designated VGAM RNA, also designated SEQ ID:4645.

Another function of VGAM1934 is therefore inhibition of Ganglioside Induced Differentiation Associated Protein 2 (GDAP2, Accession NM_017686). Accordingly, utilities of VGAM1934 include diagnosis, prevention and treatment of diseases and clinical conditions associated with GDAP2. KIAA1317 (Accession XM_098368) is another VGAM1934 host target gene. KIAA1317 BINDING SITE is HOST TARGET binding site found in the 5" untranslated region of mRNA encoded by KIAA1317, corresponding to a HOST TARGET binding site such as BINDING SITE I, BINDING SITE II or BINDING SITE III. Table 2 illustrates the complementarity of the nucleotide sequences of KIAA1317 BINDING SITE, designated SEQ ID:41629, to the nucleotide sequence of VGAM1934 RNA, herein designated VGAM RNA, also designated SEQ ID:4645.

Another function of VGAM1934 is therefore inhibition of KIAA1317 (Accession XM_098368). Accordingly, utilities of VGAM1934 include diagnosis, prevention and treatment of diseases and clinical conditions associated with KIAA1317. Melanoma Antigen, Family B, 1 (MAGEB1, Accession NM_002363) is another VGAM1934 host target gene. MAGEB1 BINDING SITE is HOST TARGET binding site found in the 5' untranslated region of mRNA encoded by MAGEB1, corresponding to a HOST TARGET binding site such as BINDING SITE I, BINDING SITE II or BINDING SITE III. Table 2 illustrates the complementarity of the nucleotide sequences of MAGEB1 BINDING SITE, designated SEQ ID:8174, to the nucleotide sequence of VGAM1934 RNA, herein designated VGAM RNA, also designated SEQ ID:4645.

Another function of VGAM1934 is therefore inhibition of Melanoma Antigen, Family B, 1 (MAGEB1, Accession NM_002363). Accordingly, utilities of VGAM1934 include diagnosis, prevention and treatment of diseases and clinical conditions associated with MAGEB1. MISS (Accession NM_144578) is another VGAM1934 host target gene. MISS BINDING SITE is HOST TARGET binding site found in the 3' untranslated region of mRNA encoded by MISS, corresponding to a HOST TARGET binding site such as BINDING SITE I, BINDING SITE II or BINDING SITE III. Table 2 illustrates the complementarity of the nucleotide sequences of MISS BINDING SITE, designated SEQ ID:29382, to the nucleotide sequence of VGAM1934 RNA, herein designated VGAM RNA, also designated SEQ ID:4645.

Another function of VGAM1934 is therefore inhibition of MISS (Accession NM_144578). Accordingly, utilities of VGAM1934 include diagnosis, prevention and treatment of diseases and clinical conditions associated with MISS. LOC126669 (Accession XM_060121) is another VGAM1934 host target gene. LOC126669 BINDING SITE is HOST TARGET binding site found in the 3' untranslated region of mRNA encoded by LOC126669, corresponding to a HOST TARGET binding site such as BINDING SITE I, BINDING SITE II or BINDING SITE III. Table 2 illustrates the complementarity of the nucleotide sequences of LOC126669 BINDING SITE, designated SEQ ID:37156, to the nucleotide sequence of VGAM1934 RNA, herein designated VGAM RNA, also designated SEQ ID:4645.

Another function of VGAM1934 is therefore inhibition of LOC126669 (Accession XM_060121). Accordingly, utilities of VGAM1934 include diagnosis, prevention and treatment of diseases and clinical conditions associated with LOC126669. LOC149670 (Accession XM_086647) is another VGAM1934 host target gene. LOC149670 BINDING SITE is HOST TARGET binding site found in the 3' untranslated region of mRNA encoded by LOC149670, corresponding to a HOST TARGET binding site such as BINDING SITE I, BINDING SITE II or BINDING SITE III. Table 2 illustrates the complementarity of the nucleotide sequences of LOC149670 BINDING SITE, designated SEQ ID:38805, to the nucleotide sequence of VGAM1934 RNA, herein designated VGAM RNA, also designated SEQ ID:4645.

Another function of VGAM1934 is therefore inhibition of LOC149670 (Accession XM_086647). Accordingly, utilities of VGAM1934 include diagnosis, prevention and treatment of diseases and clinical conditions associated with LOC149670. LOC150174 (Accession XM_086802) is another VGAM1934 host target gene. LOC150174 BIND- ING SITE is HOST TARGET binding site found in the 5' untranslated region of mRNA encoded by LOC150174, corresponding to a HOST TARGET binding site such as BINDING SITE I, BINDING SITE II or BINDING SITE III. Table 2 illustrates the complementarity of the nucleotide sequences of LOC150174 BINDING SITE, designated SEQ ID:38870, to the nucleotide sequence of VGAM1934 RNA, herein designated VGAM RNA, also designated SEQ ID:4645.

Another function of VGAM1934 is therefore inhibition of LOC150174 (Accession XM_086802). Accordingly, utilities of VGAM1934 include diagnosis, prevention and treatment of diseases and clinical conditions associated with LOC150174. LOC153894 (Accession XM_087796) is another VGAM1934 host target gene. LOC153894 BINDING SITE is HOST TARGET binding site found in the 3' untranslated region of mRNA encoded by LOC153894, corresponding to a HOST TARGET binding site such as BINDING SITE I, BINDING SITE II or BINDING SITE III. Table 2 illustrates the complementarity of the nucleotide sequences of LOC153894 BINDING SITE, designated SEQ ID:39426, to the nucleotide sequence of VGAM1934 RNA, herein designated VGAM RNA, also designated SEQ ID:4645.

Another function of VGAM1934 is therefore inhibition of LOC153894 (Accession XM_087796). Accordingly, utilities of VGAM1934 include diagnosis, prevention and treatment of diseases and clinical conditions associated with LOC153894. LOC161357 (Accession XM_090827) is another VGAM1934 host target gene. LOC161357 BINDING SITE is HOST TARGET binding site found in the 3' untranslated region of mRNA encoded by LOC161357, corresponding to a HOST TARGET binding site such as BINDING SITE I, BINDING SITE II or BINDING SITE III. Table 2 illustrates the complementarity of the nucleotide sequences of LOC161357 BINDING SITE, designated SEQ ID:40018, to the nucleotide sequence of VGAM1934 RNA, herein designated VGAM RNA, also designated SEQ ID:4645.

Another function of VGAM1934 is therefore inhibition of LOC161357 (Accession XM_090827). Accordingly, utilities of VGAM1934 include diagnosis, prevention and treatment of diseases and clinical conditions associated with LOC161357. LOC255452 (Accession XM_174088) is another VGAM1934 host target gene. LOC255452 BINDING SITE is HOST TARGET binding site found in the 3' untranslated region of mRNA encoded by LOC255452, corresponding to a HOST TARGET binding site such as BINDING SITE I, BINDING SITE II or BINDING SITE III. Table 2 illustrates the complementarity of the nucleotide sequences of LOC255452 BINDING SITE, designated SEQ ID:46571, to the nucleotide sequence of VGAM1934 RNA, herein designated VGAM RNA, also designated SEQ ID:4645.

Another function of VGAM1934 is therefore inhibition of LOC255452 (Accession XM_174088). Accordingly, utilities of VGAM1934 include diagnosis, prevention and treatment of diseases and clinical conditions associated with LOC255452. LOC51652 (Accession NM_016079) is another VGAM1934 host target gene. LOC51652 BINDING SITE is HOST TARGET binding site found in the 3' untranslated region of mRNA encoded by LOC51652, corresponding to a HOST TARGET binding site such as BINDING SITE I, BINDING SITE II or BINDING SITE III. Table 2 illustrates the complementarity of the nucleotide sequences of LOC51652 BINDING SITE, designated SEQ ID:18151, to the nucleotide sequence of VGAM1934 RNA, herein designated VGAM RNA, also designated SEQ ID:4645.

Another function of VGAM1934 is therefore inhibition of LOC51652 (Accession NM_016079). Accordingly, utilities of VGAM1934 include diagnosis, prevention and treatment of diseases and clinical conditions associated with LOC51652. FIG. 1 further provides a conceptual description of a novel bioinformatically detected viral gene of the present invention, referred to here as Viral Genomic Address Messenger 1935 (VGAM1935) viral gene, which modulates expression of respective host target genes thereof, the function and utility of which host target genes is known in the art.

VGAM1935 is a novel bioinformatically detected regulatory, non protein coding, viral micro RNA (miRNA) gene. The method by which VGAM1935 was detected is described hereinabove with reference to FIGS. 1-8.

VGAM1935 gene, herein designated VGAM GENE, is a viral gene contained in the genome of Human Herpesvirus 4. VGAM1935 host target gene, herein designated VGAM HOST TARGET GENE, is a human gene contained in the human genome.

VGAM1935 gene encodes a VGAM1935 precursor RNA, herein designated VGAM PRECURSOR RNA. Similar to other miRNA genes, and unlike most ordinary genes, VGAM1935 precursor RNA does not encode a protein. A nucleotide sequence identical or highly similar to the nucleotide sequence of VGAM1935 precursor RNA is designated SEQ ID:1921, and is provided hereinbelow with reference to the sequence listing part. Nucleotide sequence SEQ ID:1921 is located at position 155556 relative to the genome of Human Herpesvirus 4.

VGAM1935 precursor RNA folds onto itself, forming VGAM1935 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1935 folded precursor RNA into VGAM1935 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1935 RNA is designated SEQ ID:4646, and is provided hereinbelow with reference to the sequence listing part.

VGAM1935 host target gene, herein designated VGAM HOST TARGET GENE, encodes a corresponding messenger RNA, VGAM1935 host target RNA, herein designated VGAM HOST TARGET RNA. VGAM1935 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1935 RNA, herein designated VGAM RNA, binds complementarily to one or more host target binding sites located in untranslated regions of VGAM1935 host target RNA, herein designated VGAM HOST TARGET RNA. This complementary binding is due to the fact that the nucleotide sequence of VGAM1935 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1935 RNA, herein designated VGAM RNA, may have a different number of host target binding sites in untranslated regions of a VGAM1935 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1935 RNA, herein designated VGAM RNA, to host target binding sites on VGAM1935 host target RNA, herein designated VGAM HOST TARGET RNA, such as BINDING SITE I, BINDING SITE II and BINDING SITE III, inhibits translation of VGAM1935 host target RNA into VGAM1935 host target protein, herein designated VGAM HOST TARGET PROTEIN. VGAM host target protein is therefore outlined by a broken line.

It is appreciated that VGAM1935 host target gene, herein designated VGAM HOST TARGET GENE, in fact represents a plurality of VGAM1935 host target genes. The mRNA of each one of this plurality of VGAM1935 host target genes comprises one or more host target binding sites, each having a nucleotide sequence which is at least partly complementary to VGAM1935 RNA, herein designated VGAM RNA, and which when bound by VGAM1935 RNA causes inhibition of translation of respective one or more VGAM1935 host target proteins.

It is further appreciated by one skilled in the art that the mode of translational inhibition illustrated by FIG. 1 with specific reference to translational inhibition exerted by VGAM1935 gene, herein designated VGAM GENE, on one or more VGAM1935 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1935 is inhibition of expression of host target genes, as part of a novel viral mechanism of attacking a host. Accordingly, utilities of VGAM1935 include diagnosis, prevention and treatment of viral infection by Human Herpesvirus 4. Specific functions, and accordingly utilities, of VGAM1935 correlate with, and may be deduced from, the identity of the host target genes which VGAM1935 binds and inhibits, and the function of these host target genes, as elaborated hereinbelow.

Nucleotide sequences of the VGAM1935 precursor RNA, herein designated VGAM PRECURSOR RNA, and of the 'diced' VGAM1935 RNA, herein designated VGAM RNA, and a schematic representation of the secondary folding of VGAM1935 folded precursor RNA, herein designated VGAM FOLDED PRECURSOR RNA, of VGAM1935 are further described hereinbelow with reference to Table 1.

Nucleotide sequences of host target binding sites, such as BINDING SITE-I, BINDING SITE-II and BINDING SITE-III of FIG. 1, found on VGAM1935 host target RNA, and schematic representation of the complementarity of each of these host target binding sites to VGAM1935 RNA, herein designated VGAM RNA, are described hereinbelow with reference to Table 2.

As mentioned hereinabove with reference to FIG. 1, a function of VGAM1935 gene, herein designated VGAM is inhibition of expression of VGAM1935 target genes. It is appreciated that specific functions, and accordingly utilities, of VGAM1935 correlate with, and may be deduced from, the identity of the target genes which VGAM1935 binds and inhibits, and the function of these target genes, as elaborated hereinbelow.

Carbonic Anhydrase XII (CA12, Accession NM_001218) is a VGAM1935 host target gene. CA12 BINDING SITE is HOST TARGET binding site found in the 3' untranslated region of mRNA encoded by CA12, corresponding to a HOST TARGET binding site such as BINDING SITE I, BINDING SITE II or BINDING SITE III. Table 2 illustrates the complementarity of the nucleotide sequences of CA12 BINDING SITE, designated SEQ ID:6880, to the nucleotide sequence of VGAM1935 RNA, herein designated VGAM RNA, also designated SEQ ID:4646.

A function of VGAM1935 is therefore inhibition of Carbonic Anhydrase XII (CA12, Accession NM_001218), a gene which functions in cellular transport and metabolic processes. Accordingly, utilities of VGAM1935 include diagnosis, prevention and treatment of diseases and clinical conditions associated with CA12. The function of CA12 and its association with various diseases and clinical conditions, has been established by previous studies, as described hereinabove with reference to VGAM508. Clathrin, Heavy Polypeptide-like 1 (CLTCL1, Accession XM_033096) is another VGAM1935 host target gene. CLTCL1 BINDING SITE is HOST TARGET binding site found in the 3' untranslated region of mRNA encoded by CLTCL1, corresponding to a HOST TARGET binding site such as BINDING SITE I, BINDING SITE II or BINDING SITE III. Table 2 illustrates the complementarity of the nucleotide sequences of CLTCL1 BINDING SITE, designated SEQ ID:31836, to the nucleotide sequence of VGAM1935 RNA, herein designated VGAM RNA, also designated SEQ ID:4646.

Another function of VGAM1935 is therefore inhibition of Clathrin, Heavy Polypeptide-like 1 (CLTCL1, Accession XM_033096), a gene which is involved in vesicle budding. Accordingly, utilities of VGAM1935 include diagnosis, prevention and treatment of diseases and clinical conditions associated with CLTCL1. The function of CLTCL1 and its association with various diseases and clinical conditions, has been established by previous studies, as described hereinabove with reference to VGAM42. Casein Kinase 1, Gamma 3 (CSNK1G3, Accession NM_004384) is another VGAM1935 host target gene. CSNK1G3 BINDING SITE is HOST TARGET binding site found in the 3' untranslated region of mRNA encoded by CSNK1G3, corresponding to a HOST TARGET binding site such as BINDING SITE I, BINDING SITE II or BINDING SITE III. Table 2 illustrates the complementarity of the nucleotide sequences of CSNK1G3 BINDING SITE, designated SEQ ID:10612, to the nucleotide sequence of VGAM1935 RNA, herein designated VGAM RNA, also designated SEQ ID:4646.

Another function of VGAM1935 is therefore inhibition of Casein Kinase 1, Gamma 3 (CSNK1G3, Accession NM_004384). Accordingly, utilities of VGAM1935 include diagnosis, prevention and treatment of diseases and clinical conditions associated with CSNK1G3. Endometrial Bleeding Associated Factor (left-right determination, factor A; transforming growth factor beta superfamily) (EBAF, Accession XM_037302) is another VGAM1935 host target gene. EBAF BINDING SITE is HOST TARGET binding site found in the 3' untranslated region of mRNA encoded by EBAF, corresponding to a HOST TARGET binding site such as BIND- ING SITE I, BINDING SITE II or BINDING SITE III. Table 2 illustrates the complementarity of the nucleotide sequences of EBAF BINDING SITE, designated SEQ ID:32610, to the nucleotide sequence of VGAM1935 RNA, herein designated VGAM RNA, also designated SEQ ID:4646.

Another function of VGAM1935 is therefore inhibition of Endometrial Bleeding Associated Factor (left-right determination, factor A; transforming growth factor beta superfamily) (EBAF, Accession XM_037302), a gene which LEFT-RIGHT AXIS MALFORMATIONS. Accordingly, utilities of VGAM1935 include diagnosis, prevention and treatment of diseases and clinical conditions associated with EBAF. The function of EBAF and its association with various diseases and clinical conditions, has been established by previous studies, as described hereinabove with reference to VGAM93. Glucagon-like Peptide 1 Receptor (GLP1R, Accession NM_002062) is another VGAM1935 host target gene. GLP1R BINDING SITE is HOST TARGET binding site found in the 3' untranslated region of mRNA encoded by GLP1R, corresponding to a HOST TARGET binding site such as BINDING SITE I, BINDING SITE II or BINDING SITE III. Table 2 illustrates the complementarity of the nucleotide sequences of GLP1R BINDING SITE, designated SEQ ID:7824, to the nucleotide sequence of VGAM1935 RNA, herein designated VGAM RNA, also designated SEQ ID:4646.

Another function of VGAM1935 is therefore inhibition of Glucagon-like Peptide 1 Receptor (GLP1R, Accession NM_002062), a gene which is mediated by g proteins which activate adenylyl cyclase. Accordingly, utilities of VGAM1935 include diagnosis, prevention and treatment of diseases and clinical conditions associated with GLP1R. The function of GLP1R and its association with various diseases and clinical conditions, has been established by previous studies, as described hereinabove with reference to VGAM1652. Interleukin 10 Receptor, Alpha (IL10RA, Accession XM_006447) is another VGAM1935 host target gene. IL10RA BINDING SITE is HOST TARGET binding site found in the 3' untranslated region of mRNA encoded by IL10RA, corresponding to a HOST TARGET binding site such as BINDING SITE I, BINDING SITE II or BINDING SITE III. Table 2 illustrates the complementarity of the nucleotide sequences of IL10RA BINDING SITE, designated SEQ ID:30000, to the nucleotide sequence of VGAM1935 RNA, herein designated VGAM RNA, also designated SEQ ID:4646.

Another function of VGAM1935 is therefore inhibition of Interleukin 10 Receptor, Alpha (IL10RA, Accession XM_006447), a gene which is a receptor for il-10. Accordingly, utilities of VGAM1935 include diagnosis, prevention and treatment of diseases and clinical conditions associated with IL10RA. The function of IL10RA and its association with various diseases and clinical conditions, has been established by previous studies, as described hereinabove with reference to VGAM134. Myeloproliferative Leukemia Virus Oncogene (MPL, Accession NM_005373) is another VGAM1935 host target gene. MPL BINDING SITE is HOST TARGET binding site found in the 3' untranslated region of mRNA encoded by MPL, corresponding to a HOST TARGET binding site such as BINDING SITE I, BINDING SITE II or BINDING SITE III. Table 2 illustrates the complementarity of the nucleotide sequences of MPL BINDING SITE, designated SEQ ID:11850, to the nucleotide sequence of VGAM1935 RNA, herein designated VGAM RNA, also designated SEQ ID:4646.

Another function of VGAM1935 is therefore inhibition of Myeloproliferative Leukemia Virus Oncogene (MPL, Accession NM_005373). Accordingly, utilities of VGAM1935 include diagnosis, prevention and treatment of diseases and clinical conditions associated with MPL. ARNTL2 (Accession NM_020183) is another VGAM1935 host target gene. ARNTL2 BINDING SITE is HOST TARGET binding site found in the 3' untranslated region of mRNA encoded by ARNTL2, corresponding to a HOST TARGET binding site such as BINDING SITE I, BINDING SITE II or BINDING SITE III. Table 2 illustrates the complementarity of the nucleotide sequences of ARNTL2 BINDING SITE, designated SEQ ID:21418, to the nucleotide sequence of VGAM1935 RNA, herein designated VGAM RNA, also designated SEQ ID:4646.

Another function of VGAM1935 is therefore inhibition of ARNTL2 (Accession NM_020183). Accordingly, utilities of VGAM1935 include diagnosis, prevention and treatment of diseases and clinical conditions associated with ARNTL2. BCL2-like 1 (BCL2L1, Accession NM_138578) is another VGAM1935 host target gene. BCL2L1 BINDING SITE is HOST TARGET binding site found in the 3' untranslated region of mRNA encoded by BCL2L1, corresponding to a HOST TARGET binding site such as BINDING SITE I, BINDING SITE II or BINDING SITE III. Table 2 illustrates the complementarity of the nucleotide sequences of BCL2L1 BINDING SITE, designated SEQ ID:28894, to the nucleotide sequence of VGAM1935 RNA, herein designated VGAM RNA, also designated SEQ ID:4646.

Another function of VGAM1935 is therefore inhibition of BCL2-like 1 (BCL2L1, Accession NM_138578). Accordingly, utilities of VGAM1935 include diagnosis, prevention and treatment of diseases and clinical conditions associated with BCL2L1. Casein Kinase 1, Gamma 1 (CSNK1G1, Accession NM_022048) is another VGAM1935 host target gene. CSNK1G1 BINDING SITE is HOST TARGET binding site found in the 3' untranslated region of mRNA encoded by CSNK1G1, corresponding to a HOST TARGET binding site such as BINDING SITE I, BINDING SITE II or BINDING SITE III. Table 2 illustrates the complementarity of the nucleotide sequences of CSNK1G1 BINDING SITE, designated SEQ ID:22570, to the nucleotide sequence of VGAM1935 RNA, herein designated VGAM RNA, also designated SEQ ID:4646.

Another function of VGAM1935 is therefore inhibition of Casein Kinase 1, Gamma 1 (CSNK1G1, Accession NM_022048). Accordingly, utilities of VGAM1935 include diagnosis, prevention and treatment of diseases and clinical conditions associated with CSNK1G1. DKFZP566G1424 (Accession XM_097771) is another VGAM1935 host target gene. DKFZP566G1424 BINDING SITE is HOST TARGET binding site found in the 5' untranslated region of mRNA encoded by DKFZP566G1424, corresponding to a HOST TARGET binding site such as BINDING SITE I, BINDING SITE II or BINDING SITE III. Table 2 illustrates the complementarity of the nucleotide sequences of DKFZP566G1424 BINDING SITE, designated SEQ ID:41117, to the nucleotide sequence of VGAM1935 RNA, herein designated VGAM RNA, also designated SEQ ID:4646.

Another function of VGAM1935 is therefore inhibition of DKFZP566G1424 (Accession XM_097771). Accordingly, utilities of VGAM1935 include diagnosis, prevention and treatment of diseases and clinical conditions associated with DKFZP566G1424. DKFZp586I021 (Accession NM_032271) is another VGAM1935 host target gene. DKFZp586I021 BINDING SITE is HOST TARGET binding site found in the 3' untranslated region of mRNA encoded by DKFZp586I021, corresponding to a HOST TARGET binding site such as BINDING SITE I, BINDING SITE II or BINDING SITE III. Table 2 illustrates the complementarity of the nucleotide sequences of DKFZp586I021 BINDING SITE, designated SEQ ID:26025, to the nucleotide sequence of VGAM1935 RNA, herein designated VGAM RNA, also designated SEQ ID:4646.

Another function of VGAM1935 is therefore inhibition of DKFZp586I021 (Accession NM_032271). Accordingly, utilities of VGAM1935 include diagnosis, prevention and treatment of diseases and clinical conditions associated with DKFZp586I021. FLJ12547 (Accession NM_024992) is another VGAM1935 host target gene. FLJ12547 BINDING SITE is HOST TARGET binding site found in the 3' untranslated region of mRNA encoded by FLJ12547, corresponding to a HOST TARGET binding site such as BINDING SITE I, BINDING SITE II or BINDING SITE III. Table 2 illustrates the complementarity of the nucleotide sequences of FLJ12547 BINDING SITE, designated SEQ ID:24549, to the nucleotide sequence of VGAM1935 RNA, herein designated VGAM RNA, also designated SEQ ID:4646.

Another function of VGAM1935 is therefore inhibition of FLJ12547 (Accession NM_024992). Accordingly, utilities of VGAM1935 include diagnosis, prevention and treatment of diseases and clinical conditions associated with FLJ12547. FLJ20281 (Accession XM_165663) is another VGAM1935 host target gene. FLJ20281 BINDING SITE is HOST TARGET binding site found in the 5' untranslated region of mRNA encoded by FLJ20281, corresponding to a HOST TARGET binding site such as BINDING SITE I, BINDING SITE II or BINDING SITE III. Table 2 illustrates the complementarity of the nucleotide sequences of FLJ20281 BINDING SITE, designated SEQ ID:43729, to the nucleotide sequence of VGAM1935 RNA, herein designated VGAM RNA, also designated SEQ ID:4646.

Another function of VGAM1935 is therefore inhibition of FLJ20281 (Accession XM_165663). Accordingly, utilities of VGAM1935 include diagnosis, prevention and treatment of diseases and clinical conditions associated with FLJ20281. FLJ22341 (Accession NM_024599) is another VGAM1935 host target gene. FLJ22341 BINDING SITE is HOST TARGET binding site found in the 3' untranslated region of mRNA encoded by FLJ22341, corresponding to a HOST TARGET binding site such as BINDING SITE I, BINDING SITE II or BINDING SITE III. Table 2 illustrates the complementarity of the nucleotide sequences of FLJ22341 BINDING SITE, designated SEQ ID:23848, to the nucleotide sequence of VGAM1935 RNA, herein designated VGAM RNA, also designated SEQ ID:4646.

Another function of VGAM1935 is therefore inhibition of FLJ22341 (Accession NM_024599). Accordingly, utilities of VGAM1935 include diagnosis, prevention and treatment of diseases and clinical conditions associated with FLJ22341. HEMK (Accession NM_016173) is another VGAM1935 host target gene. HEMK BINDING SITE is HOST TARGET binding site found in the 3' untranslated region of mRNA encoded by HEMK, corresponding to a HOST TARGET binding site such as BINDING SITE I, BINDING SITE II or BINDING SITE III. Table 2 illustrates the complementarity of the nucleotide sequences of HEMK BINDING SITE, designated SEQ ID:18271, to the nucleotide sequence of VGAM1935 RNA, herein designated VGAM RNA, also designated SEQ ID:4646.

Another function of VGAM1935 is therefore inhibition of HEMK (Accession NM_016173). Accordingly, utilities of VGAM1935 include diagnosis, prevention and treatment of diseases and clinical conditions associated with HEMK. Potassium Voltage-gated Channel, Shal-related Subfamily, Member 1 (KCND1, Accession NM_004979) is another VGAM1935 host target gene. KCND1 BINDING SITE is HOST TARGET binding site found in the 5' untranslated region of mRNA encoded by KCND1, corresponding to a HOST TARGET binding site such as BINDING SITE I, BINDING SITE II or BINDING SITE III. Table 2 illustrates the complementarity of the nucleotide sequences of KCND1 BINDING SITE, designated SEQ ID:11427, to the nucleotide sequence of VGAM1935 RNA, herein designated VGAM RNA, also designated SEQ ID:4646.

Another function of VGAM1935 is therefore inhibition of Potassium Voltage-gated Channel, Shal-related Subfamily, Member 1 (KCND1, Accession NM_004979). Accordingly, utilities of VGAM1935 include diagnosis, prevention and treatment of diseases and clinical conditions associated with KCND1. KIAA0939 (Accession XM_030524) is another VGAM1935 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31063, to the nucleotide sequence of VGAM1935 RNA, herein designated VGAM RNA, also designated SEQ ID:4646.

Another function of VGAM1935 is therefore inhibition of KIAA0939 (Accession XM_030524). Accordingly, utilities of VGAM1935 include diagnosis, prevention and treatment of diseases and clinical conditions associated with KIAA0939. KIAA1199 (Accession XM_051860) is another VGAM1935 host target gene. KIAA1199 BINDING SITE is HOST TARGET binding site found in the 3' untranslated region of mRNA encoded by KIAA1199, corresponding to a HOST TARGET binding site such as BINDING SITE I, BINDING SITE II or BINDING SITE III. Table 2 illustrates the complementarity of the nucleotide sequences of KIAA1199 BINDING SITE, designated SEQ ID:35899, to the nucleotide sequence of VGAM1935 RNA, herein designated VGAM RNA, also designated SEQ ID:4646.

Another function of VGAM1935 is therefore inhibition of KIAA1199 (Accession XM_051860). Accordingly, utilities of VGAM1935 include diagnosis, prevention and treatment of diseases and clinical conditions associated with KIAA1199. KIAA1280 (Accession XM_045766) is another VGAM1935 host target gene. KIAA1280 BINDING SITE is HOST TARGET binding site found in the 5' untranslated region of mRNA encoded by KIAA1280, corresponding to a HOST TARGET binding site such as BINDING SITE I, BINDING SITE II or BINDING SITE III. Table 2 illustrates the complementarity of the nucleotide sequences of KIAA1280 BINDING SITE, designated SEQ ID:34550, to the nucleotide sequence of VGAM1935 RNA, herein designated VGAM RNA, also designated SEQ ID:4646.

Another function of VGAM1935 is therefore inhibition of KIAA1280 (Accession XM_045766). Accordingly, utilities of VGAM1935 include diagnosis, prevention and treatment of diseases and clinical conditions associated with KIAA1280. Kelch-like 6 (Drosophila) (KLHL6, Accession NM_130446) is another VGAM1935 host target gene. KLHL6 BINDING SITE is HOST TARGET binding site found in the 3' untranslated region of mRNA encoded by KLHL6, corresponding to a HOST TARGET binding site such as BINDING SITE I, BINDING SITE II or BINDING SITE III. Table 2 illustrates the complementarity of the nucleotide sequences of KLHL6 BINDING SITE, designated SEQ ID:28214, to the nucleotide sequence of VGAM1935 RNA, herein designated VGAM RNA, also designated SEQ ID:4646.

Another function of VGAM1935 is therefore inhibition of Kelch-like 6 (Drosophila) (KLHL6, Accession NM_130446). Accordingly, utilities of VGAM1935 include diagnosis, prevention and treatment of diseases and clinical conditions associated with KLHL6. Karyopherin Alpha 6 (importin alpha 7) (KPNA6, Accession NM_012316) is another VGAM1935 host target gene. KPNA6 BINDING SITE is HOST TARGET binding site found in the 3' untranslated region of mRNA encoded by KPNA6, corresponding to a HOST TARGET binding site such as BINDING SITE I, BINDING SITE II or BINDING SITE III. Table 2 illustrates the complementarity of the nucleotide sequences of KPNA6 BINDING SITE, designated SEQ ID:14690, to the nucleotide sequence of VGAM1935 RNA, herein designated VGAM RNA, also designated SEQ ID:4646.

Another function of VGAM1935 is therefore inhibition of Karyopherin Alpha 6 (importin alpha 7) (KPNA6, Accession NM_012316). Accordingly, utilities of VGAM1935 include diagnosis, prevention and treatment of diseases and clinical conditions associated with KPNA6. MBLL39 (Accession NM_005757) is another VGAM1935 host target gene. MBLL39 BINDING SITE1 and MBLL39 BINDING SITE2 are HOST TARGET binding sites found in untranslated regions of mRNA encoded by MBLL39, corresponding to HOST TARGET binding sites such as BINDING SITE I, BINDING SITE II or BINDING SITE III. Table 2 illustrates the complementarity of the nucleotide sequences of MBLL39 BINDING SITE1 and MBLL39 BINDING SITE2, designated SEQ ID:12319 and SEQ ID:29576 respectively, to the nucleotide sequence of VGAM1935 RNA, herein designated VGAM RNA, also designated SEQ ID:4646.

Another function of VGAM1935 is therefore inhibition of MBLL39 (Accession NM_005757). Accordingly, utilities of VGAM1935 include diagnosis, prevention and treatment of diseases and clinical conditions associated with MBLL39. P66 (Accession NM_020699) is another VGAM1935 host target gene. P66 BINDING SITE is HOST TARGET binding site found in the 3' untranslated region of mRNA encoded by P66, corresponding to a HOST TARGET binding site such as BINDING SITE I, BINDING SITE II or BINDING SITE III. Table 2 illustrates the complementarity of the nucleotide sequences of P66 BINDING SITE, designated SEQ ID:21846, to the nucleotide sequence of VGAM1935 RNA, herein designated VGAM RNA, also designated SEQ ID:4646.

Another function of VGAM1935 is therefore inhibition of P66 (Accession NM_020699). Accordingly, utilities of VGAM1935 include diagnosis, prevention and treatment of diseases and clinical conditions associated with P66. Sialyltransferase 4B (beta-galactoside alpha-2,3-sialytransferase) (SIAT4B, Accession NM_006927) is another VGAM1935 host target gene. SIAT4B BINDING SITE is HOST TARGET binding site found in the 5' untranslated region of mRNA encoded by SIAT4B, corresponding to a HOST TARGET binding site such as BINDING SITE I, BINDING SITE II or BINDING SITE III. Table 2 illustrates the complementarity of the nucleotide sequences of SIAT4B BINDING SITE, designated SEQ ID:13813, to the nucleotide sequence of VGAM1935 RNA, herein designated VGAM RNA, also designated SEQ ID:4646.

Another function of VGAM1935 is therefore inhibition of Sialyltransferase 4B (beta-galactoside alpha-2,3-sialytransferase) (SIAT4B, Accession NM_006927). Accordingly, utilities of VGAM1935 include diagnosis, prevention and treatment of diseases and clinical conditions associated with SIAT4B. SSB-4 (Accession NM_080862) is another VGAM1935 host target gene. SSB-4 BINDING SITE is HOST TARGET binding site found in the 3' untranslated region of mRNA encoded by SSB-4, corresponding to a HOST TARGET binding site such as BINDING SITE I, BINDING SITE II or BINDING SITE III. Table 2 illustrates the complementarity of the nucleotide sequences of SSB-4 BINDING SITE, designated SEQ ID:28105, to the nucleotide sequence of VGAM1935 RNA, herein designated VGAM RNA, also designated SEQ ID:4646.

Another function of VGAM1935 is therefore inhibition of SSB-4 (Accession NM_080862). Accordingly, utilities of VGAM1935 include diagnosis, prevention and treatment of diseases and clinical conditions associated with SSB-4. UBE3B (Accession XM_084941) is another VGAM1935 host target gene. UBE3B BINDING SITE is HOST TARGET binding site found in the 3' untranslated region of mRNA encoded by UBE3B, corresponding to a HOST TARGET binding site such as BINDING SITE I, BINDING SITE II or BINDING SITE III. Table 2 illustrates the complementarity of the nucleotide sequences of UBE3B BINDING SITE, designated SEQ ID:37774, to the nucleotide sequence of VGAM1935 RNA, herein designated VGAM RNA, also designated SEQ ID:4646.

Another function of VGAM1935 is therefore inhibition of UBE3B (Accession XM_084941). Accordingly, utilities of VGAM1935 include diagnosis, prevention and treatment of diseases and clinical conditions associated with UBE3B. LOC129198 (Accession XM_072197) is another VGAM1935 host target gene. LOC129198 BINDING SITE is HOST TARGET binding site found in the 3' untranslated region of mRNA encoded by LOC129198, corresponding to a HOST TARGET binding site such as BINDING SITE I, BINDING SITE II or BINDING SITE III. Table 2 illustrates the complementarity of the nucleotide sequences of LOC129198 BINDING SITE, designated SEQ ID:37466, to the nucleotide sequence of VGAM1935 RNA, herein designated VGAM RNA, also designated SEQ ID:4646.

Another function of VGAM1935 is therefore inhibition of LOC129198 (Accession XM_072197). Accordingly, utilities of VGAM1935 include diagnosis, prevention and treatment of diseases and clinical conditions associated with LOC129198. LOC158972 (Accession XM_099009) is another VGAM1935 host target gene. LOC158972 BINDING SITE is HOST TARGET binding site found in the 3' untranslated region of mRNA encoded by LOC158972, corresponding to a HOST TARGET binding site such as BINDING SITE I, BINDING SITE II or BINDING SITE III. Table 2 illustrates the complementarity of the nucleotide sequences of LOC158972 BINDING SITE, designated SEQ ID:42044, to the nucleotide sequence of VGAM1935 RNA, herein designated VGAM RNA, also designated SEQ ID:4646.

Another function of VGAM1935 is therefore inhibition of LOC158972 (Accession XM_099009). Accordingly, utilities of VGAM1935 include diagnosis, prevention and treatment of diseases and clinical conditions associated with LOC158972. LOC164395 (Accession XM_092778) is another VGAM1935 host target gene. LOC164395 BINDING SITE is HOST TARGET binding site found in the 5' untranslated region of mRNA encoded by LOC164395, corresponding to a HOST TARGET binding site such as BINDING SITE I, BINDING SITE II or BINDING SITE III. Table 2 illustrates the complementarity of the nucleotide sequences of LOC164395 BINDING SITE, designated SEQ ID:40146, to the nucleotide sequence of VGAM1935 RNA, herein designated VGAM RNA, also designated SEQ ID:4646.

Another function of VGAM1935 is therefore inhibition of LOC164395 (Accession XM_092778). Accordingly, utilities of VGAM1935 include diagnosis, prevention and treatment of diseases and clinical conditions associated with LOC164395. LOC200261 (Accession XM_114172) is another VGAM1935 host target gene. LOC200261 BINDING SITE is HOST TARGET binding site found in the 3' untranslated region of mRNA encoded by LOC200261, corresponding to a HOST TARGET binding site such as BINDING SITE I, BINDING SITE II or BINDING SITE III. Table 2 illustrates the complementarity of the nucleotide sequences of LOC200261 BINDING SITE, designated SEQ ID:42750, to the nucleotide sequence of VGAM1935 RNA, herein designated VGAM RNA, also designated SEQ ID:4646.

Another function of VGAM1935 is therefore inhibition of LOC200261 (Accession XM_114172). Accordingly, utilities of VGAM1935 include diagnosis, prevention and treatment of diseases and clinical conditions associated with LOC200261. LOC221683 (Accession XM_168089) is another VGAM1935 host target gene. LOC221683 BINDING SITE is HOST TARGET binding site found in the 5' untranslated region of mRNA encoded by LOC221683, corresponding to a HOST TARGET binding site such as BINDING SITE I, BINDING SITE II or BINDING SITE III. Table 2 illustrates the complementarity of the nucleotide sequences of LOC221683 BINDING SITE, designated SEQ ID:45006, to the nucleotide sequence of VGAM1935 RNA, herein designated VGAM RNA, also designated SEQ ID:4646.

Another function of VGAM1935 is therefore inhibition of LOC221683 (Accession XM_168089). Accordingly, utilities of VGAM1935 include diagnosis, prevention and treatment of diseases and clinical conditions associated with LOC221683. LOC254428 (Accession XM_170932) is another VGAM1935 host target gene. LOC254428 BINDING SITE is HOST TARGET binding site found in the 3' untranslated region of mRNA encoded by LOC254428, corresponding to a HOST TARGET binding site such as BINDING SITE I, BINDING SITE II or BINDING SITE III. Table 2 illustrates the complementarity of the nucleotide sequences of LOC254428 BINDING SITE, designated SEQ ID:45720, to the nucleotide sequence of VGAM1935 RNA, herein designated VGAM RNA, also designated SEQ ID:4646.

Another function of VGAM1935 is therefore inhibition of LOC254428 (Accession XM_170932). Accordingly, utilities of VGAM1935 include diagnosis, prevention and treatment of diseases and clinical conditions associated with LOC254428. LOC84549 (Accession NM_032509) is another VGAM1935 host target gene. LOC84549 BINDING SITE is HOST TARGET binding site found in the 3' untranslated region of mRNA encoded by LOC84549, corresponding to a HOST TARGET binding site such as BINDING SITE I, BINDING SITE II or BINDING SITE III. Table 2 illustrates the complementarity of the nucleotide sequences of LOC84549 BINDING SITE, designated SEQ ID:26264, to the nucleotide sequence of VGAM1935 RNA, herein designated VGAM RNA, also designated SEQ ID:4646.

Another function of VGAM1935 is therefore inhibition of LOC84549 (Accession NM_032509). Accordingly, utilities of VGAM1935 include diagnosis, prevention and treatment of diseases and clinical conditions associated with LOC84549. LOC91056 (Accession XM_170662) is another VGAM1935 host target gene. LOC91056 BINDING SITE is HOST TARGET binding site found in the 3' untranslated region of mRNA encoded by LOC91056, corresponding to a HOST TARGET binding site such as BINDING SITE I, BINDING SITE II or BINDING SITE III. Table 2 illustrates the complementarity of the nucleotide sequences of LOC91056 BINDING SITE, designated SEQ ID:45440, to the nucleotide sequence of VGAM1935 RNA, herein designated VGAM RNA, also designated SEQ ID:4646.

Another function of VGAM1935 is therefore inhibition of LOC91056 (Accession XM_170662). Accordingly, utilities of VGAM1935 include diagnosis, prevention and treatment of diseases and clinical conditions associated with LOC91056. FIG. 1 further provides a conceptual description of a novel bioinformatically detected viral gene of the present invention, referred to here as Viral Genomic Address Messenger 1936 (VGAM1936) viral gene, which modulates expression of respective host target genes thereof, the function and utility of which host target genes is known in the art.

VGAM1936 is a novel bioinformatically detected regulatory, non protein coding, viral micro RNA (miRNA) gene. The method by which VGAM1936 was detected is described hereinabove with reference to FIGS. 1-8.

VGAM1936 gene, herein designated VGAM GENE, is a viral gene contained in the genome of Human Herpesvirus 4. VGAM1936 host target gene, herein designated VGAM HOST TARGET GENE, is a human gene contained in the human genome.

VGAM1936 gene encodes a VGAM1936 precursor RNA, herein designated VGAM PRECURSOR RNA. Similar to other miRNA genes, and unlike most ordinary genes, VGAM1936 precursor RNA does not encode a protein. A nucleotide sequence identical or highly similar to the nucleotide sequence of VGAM1936 precursor RNA is designated SEQ ID:1922, and is provided hereinbelow with reference to the sequence listing part. Nucleotide sequence SEQ ID:1922 is located at position 152064 relative to the genome of Human Herpesvirus 4.

VGAM1936 precursor RNA folds onto itself, forming VGAM1936 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1936 folded precursor RNA into VGAM1936 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1936 RNA is designated SEQ ID:4647, and is provided hereinbelow with reference to the sequence listing part.

VGAM1936 host target gene, herein designated VGAM HOST TARGET GENE, encodes a corresponding messenger RNA, VGAM1936 host target RNA, herein designated VGAM HOST TARGET RNA. VGAM1936 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1936 RNA, herein designated VGAM RNA, binds complementarily to one or more host target binding sites located in untranslated regions of VGAM1936 host target RNA, herein designated VGAM HOST TARGET RNA. This complementary binding is due to the fact that the nucleotide sequence of VGAM1936 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1936 RNA, herein designated VGAM RNA, may have a different number of host target binding sites in untranslated regions of a VGAM1936 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1936 RNA, herein designated VGAM RNA, to host target binding sites on VGAM1936 host target RNA, herein designated VGAM HOST TARGET RNA, such as BINDING SITE I, BINDING SITE II and BINDING SITE III, inhibits translation of VGAM1936 host target RNA into VGAM1936 host target protein, herein designated VGAM HOST TARGET PROTEIN. VGAM host target protein is therefore outlined by a broken line.

It is appreciated that VGAM1936 host target gene, herein designated VGAM HOST TARGET GENE, in fact represents a plurality of VGAM1936 host target genes. The mRNA of each one of this plurality of VGAM1936 host target genes comprises one or more host target binding sites, each having a nucleotide sequence which is at least partly complementary to VGAM1936 RNA, herein designated VGAM RNA, and which when bound by VGAM1936 RNA causes inhibition of translation of respective one or more VGAM1936 host target proteins.

It is further appreciated by one skilled in the art that the mode of translational inhibition illustrated by FIG. 1 with specific reference to translational inhibition exerted by VGAM1936 gene, herein designated VGAM GENE, on one or more VGAM1936 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1936 is inhibition of expression of host target genes, as part of a novel viral mechanism of attacking a host. Accordingly, utilities of VGAM1936 include diagnosis, prevention and treatment of viral infection by Human Herpesvirus 4. Specific functions, and accordingly utilities, of VGAM1936 correlate with, and may be deduced from, the identity of the host target genes which VGAM1936 binds and inhibits, and the function of these host target genes, as elaborated hereinbelow.

Nucleotide sequences of the VGAM1936 precursor RNA, herein designated VGAM PRECURSOR RNA, and of the 'diced' VGAM1936 RNA, herein designated VGAM RNA, and a schematic representation of the secondary folding of VGAM1936 folded precursor RNA, herein designated VGAM FOLDED PRECURSOR RNA, of VGAM1936 are further described hereinbelow with reference to Table 1.

Nucleotide sequences of host target binding sites, such as BINDING SITE-I, BINDING SITE-II and BINDING SITE-III of FIG. 1, found on VGAM1936 host target RNA, and schematic representation of the complementarity of each of these host target binding sites to VGAM1936 RNA, herein designated VGAM RNA, are described hereinbelow with reference to Table 2.

As mentioned hereinabove with reference to FIG. 1, a function of VGAM1936 gene, herein designated VGAM is inhibition of expression of VGAM1936 target genes. It is appreciated that specific functions, and accordingly utilities, of VGAM1936 correlate with, and may be deduced from, the identity of the target genes which VGAM1936 binds and inhibits, and the function of these target genes, as elaborated hereinbelow.

Adrenergic, Beta-3-, Receptor (ADRB3, Accession NM_000025) is a VGAM1936 host target gene. ADRB3 BINDING SITE is HOST TARGET binding site found in the 3' untranslated region of mRNA encoded by ADRB3, corresponding to a HOST TARGET binding site such as BINDING SITE I, BINDING SITE II or BINDING SITE III. Table 2 illustrates the complementarity of the nucleotide sequences of ADRB3 BINDING SITE, designated SEQ ID:5463, to the nucleotide sequence of VGAM1936 RNA, herein designated VGAM RNA, also designated SEQ ID:4647.

A function of VGAM1936 is therefore inhibition of Adrenergic, Beta-3-, Receptor (ADRB3, Accession NM_000025), a gene which stimulates adenylyl cyclase activity and regulates lipolysis. Accordingly, utilities of VGAM1936 include diagnosis, prevention and treatment of diseases and clinical conditions associated with ADRB3. The function of ADRB3 and its association with various diseases and clinical conditions, has been established by previous studies, as described hereinabove with reference to VGAM179. Heat Shock Transcription Factor 4 (HSF4, Accession XM_007871) is another VGAM1936 host target gene. HSF4 BINDING SITE is HOST TARGET binding site found in the 5' untranslated region of mRNA encoded by HSF4, corresponding to a HOST TARGET binding site such as BINDING SITE I, BINDING SITE II or BINDING SITE III. Table 2 illustrates the complementarity of the nucleotide sequences of HSF4 BINDING SITE, designated SEQ ID:30067, to the nucleotide sequence of VGAM1936 RNA, herein designated VGAM RNA, also designated SEQ ID:4647.

Another function of VGAM1936 is therefore inhibition of Heat Shock Transcription Factor 4 (HSF4, Accession XM_007871), a gene which activates heat-shock response genes under conditions of heat or other stressesfound that HSF4 bound specifically to the heat-shock response element but repressed, rather than activated, transcription. Accordingly, utilities of VGAM1936 include diagnosis, prevention and treatment of diseases and clinical conditions associated with HSF4. The function of HSF4 has been established by previous studies. Congenital cataracts cause 10 to 30% of all blindness in children, with one-third of cases estimated to have a genetic cause. Lamellar cataract (OMIM Ref. No. 116800) is the most common type of infantile cataract. Bu et al. (2002) carried out whole-genome linkage analysis of Chinese individuals with lamellar cataract, and found that the disorder is associated with inheritance of a 5.11-cM region on chromosome 16. This locus coincides with one previously described for Marner cataract (see OMIM Ref. No. 116800) by Eiberg et al. (1988). Bu et al. (2002) screened individuals of 3 Chinese families for mutations in HSF4 (a gene that maps to this locus) and discovered that in each family, a distinct missense mutation, predicted to affect the DNA-binding domain of the protein, segregated with the disorder. They also discovered an association between a missense mutation and Marner cataract in an extensive Danish family. Thus it appears that HSF4 is critical to lens development Heat-shock transcription factors (HSFs) activate heat-shock response genes under conditions of heat or other stresses. Other members of the HSF family include HSF1 (OMIM Ref. No. 140580) and HSF2 (OMIM Ref. No. 140581). Using chicken HSF3 as a probe to screen a human HeLa cDNA library, Nakai et al. (1997) isolated an additional family member, termed HSF4 by the authors. Based on the low level of amino acid identity between chicken HSF3 and HSF4, Nakai et al. (1997) concluded that HSF4 is a novel member of the HSF family, rather than the human homolog of chicken HSF3. They reported that the HSF4 sequence encodes a 463-amino acid polypeptide. Northern blotting revealed that HSF4 is expressed as a 2.5-kb mRNA in the heart, skeletal muscle, and brain, and at much lower levels in some other tissues. Nakai et al. (1997) found that HSF4 bound specifically to the heat-shock response element but repressed, rather than activated, transcription Full details of the abovementioned studies are described in the following publications, the disclosure of which are hereby incorporated by reference:

Bu, L.; Jin, Y.; Shi, Y.; Chu, R.; Ban, A.; Eiberg, H.; Andres, L.; Jiang, H.; Zheng, G.; Qian, M.; Cui, B.; Xia, Y.; Liu, J.; Hu, L.; Zhao, G.; Hayden, M. R.; Kong, X.: Mutant DNA-binding domain of HSF4 is associated with autosomal dominant lamellar and Marner cataract. Nature Genet. 31:276-278, 2002; and Nakai, A.; Tanabe, M.; Kawazoe, Y.; Inazawa, J.; Morimoto, R. I.; Nagata, K.: HSF4, a new member of the human heat shock factor family which lacks properties of a transcriptional activa.

Further studies establishing the function and utilities of HSF4 are found in John Hopkins OMIM database record ID 602438, and in sited publications numbered 2022-202 and 5609 listed in the bibliography section hereinbelow, which are also hereby incorporated by reference. Solute Carrier Family 17 (sodium-dependent inorganic phosphate cotransporter), Member 7 (SLC17A7, Accession NM_020309) is another VGAM1936 host target gene. SLC17A7 BINDING SITE is HOST TARGET binding site found in the 3" untranslated region of mRNA encoded by SLC17A7, corresponding to a HOST TARGET binding site such as BINDING SITE I, BINDING SITE II or BINDING SITE III. Table 2 illustrates the complementarity of the nucleotide sequences of SLC17A7 BINDING SITE, designated SEQ ID:21557, to the nucleotide sequence of VGAM1936 RNA, herein designated VGAM RNA, also designated SEQ ID:4647.

Another function of VGAM1936 is therefore inhibition of Solute Carrier Family 17 (sodium-dependent inorganic phosphate cotransporter), Member 7 (SLC17A7, Accession NM_020309), a gene which is a brain-specific Na-dependent inorganic phosphate cotransporter. Accordingly, utilities of VGAM1936 include diagnosis, prevention and treatment of diseases and clinical conditions associated with SLC17A7. The function of SLC17A7 has been established by previous studies. Bellocchio et al. (2000) demonstrated that BNPI transports glutamate into synaptic vesicles. In addition, they showed that this vesicular glutamate transporter, which they renamed VGLUT1, exhibits a conductance for chloride that is blocked by glutamate. Bellocchio et al. (2000) found that glutamate was transported by BNPI in the absence of sodium. Vesicular glutamate transport has a substantially lower apparent affinity than the plasma membrane excitatory amino acid transporters. Glutamate transport by BNPI is saturated with a K(m) of approximately 2 mM, in the same range as transport by synaptic vesicles. Finally, plasma membrane glutamate transporters recognize both aspartate and glutamate as substrates, whereas vesicular glutamate transport does not recognize aspartate. Vesicular glutamate transport has a biphasic dependence on chloride concentration that may reflect the presence of anion binding site distinct from the site of substrate recognition. Chloride concentrations of approximately 4 to 10 mM appear optimal for transport, with substantially lower activity detected at higher and lower levels. BNPI transports glutamate with all of the functional characteristics previously reported for glutamate transport into native synaptic vesicles from the brain. It localizes to synaptic vesicles, and the mutant C. elegans eat-4 (a BNPI ortholog) reduces glutamate release. BNPI thus functions as a vesicular glutamate transporter, VGLUT1. Only a subset of glutamate neurons expresses VGLUT1, but a closely related sequence has been identified that appears to be expressed in brain regions that lack VGLUT1 (Aihara et al., 2000). The 2 isoforms together may therefore account for the uptake of glutamate by synaptic vesicles from all glutamatergic neurons. VGLUT1 (BNPI1) may thus function as both a phosphate transporter, presumably at the plasma membrane, and a glutamate transporter in synaptic vesicles. Bellocchio et al. (2000) stated that the localization of VGLUT1 to synaptic vesicles, the phenotype of the eat-4 mutant, and biochemical evidence strongly suggest that vesicular glutamate transport is its primary role. Takamori et al. (2000) independently showed that expression of BNPI results in glutamate uptake by intracellular vesicles. Substrate specificity and energy dependence are very similar to glutamate uptake by synaptic vesicles. Stimulation of exocytosis resulted in quantal release of glutamate from BNPI-expressing cells. Furthermore, Takamori et al. (2000) expressed BNPI in neurons containing GABA (see OMIM Ref. No. 137150) and maintained them as cultures of single neurons that form synapses to themselves. After stimulation of these neurons, a component of the postsynaptic current is mediated by glutamate as it is blocked by a combination of the glutamate receptor antagonists, but is insensitive to a GABA-A receptor (see OMIM Ref. No. 137192) antagonist. Takamori et al. (2000) concluded that BNPI functions as a vesicular glutamate transporter and that expression of BNPI suffices to define a glutamatergic phenotype in neurons.

Full details of the abovementioned studies are described in the following publications, the disclosure of which are hereby incorporated by reference:

Bellocchio, E. E.; Reimer, R. J.; Fremeau, R. T., Jr.; Edwards, R. H.: Uptake of glutamate into synaptic vesicles by an inorganic phosphate transporter. Science 289:957-960, 2000; and Takamori, S.; Rhee, J. S.; Rosenmund, C.; Jahn, R.: Identification of a vesicular glutamate transporter that defines a glutamatergic phenotype in neurons. Nature 407:189-194, 2000.

Further studies establishing the function and utilities of SLC17A7 are found in John Hopkins OMIM database record ID 605208, and in sited publications numbered 6815-6818 listed in the bibliography section hereinbelow, which are also hereby incorporated by reference. Solute Carrier Family 7 (cationic amino acid transporter, y+ system), Member 5 (SLC7A5, Accession NM_003486) is another VGAM1936 host target gene. SLC7A5 BINDING SITE is HOST TARGET binding site found in the 3' untranslated region of mRNA encoded by SLC7A5, corresponding to a HOST TARGET binding site such as BINDING SITE I, BINDING SITE II or BINDING SITE III. Table 2 illustrates the complementarity of the nucleotide sequences of SLC7A5 BINDING SITE, designated SEQ ID:9577, to the nucleotide sequence of VGAM1936 RNA, herein designated VGAM RNA, also designated SEQ ID:4647.

Another function of VGAM1936 is therefore inhibition of Solute Carrier Family 7 (cationic amino acid transporter, y+ system), Member 5 (SLC7A5, Accession NM_003486), a gene which mediates transport of large and small neutral amino acids. Accordingly, utilities of VGAM1936 include diagnosis, prevention and treatment of diseases and clinical conditions associated with SLC7A5. The function of SLC7A5 and its association with various diseases and clinical conditions, has been established by previous studies, as described hereinabove with reference to VGAM430. Cell Division Cycle Associated 4 (CDCA4, Accession NM_017955) is another VGAM1936 host target gene. CDCA4 BINDING SITE is HOST TARGET binding site found in the 3' untranslated region of mRNA encoded by CDCA4, corresponding to a HOST TARGET binding site such as BINDING SITE I, BINDING SITE II or BINDING SITE III. Table 2 illustrates the complementarity of the nucleotide sequences of CDCA4 BINDING SITE, designated SEQ ID:19662, to the nucleotide sequence of VGAM1936 RNA, herein designated VGAM RNA, also designated SEQ ID:4647.

Another function of VGAM1936 is therefore inhibition of Cell Division Cycle Associated 4 (CDCA4, Accession NM_017955). Accordingly, utilities of VGAM1936 include diagnosis, prevention and treatment of diseases and clinical conditions associated with CDCA4. CTP Synthase II (CTPS2, Accession NM_019857) is another VGAM1936 host target gene. CTPS2 BINDING SITE is HOST TARGET binding site found in the 3' untranslated region of mRNA encoded by CTPS2, corresponding to a HOST TARGET binding site such as BINDING SITE I, BINDING SITE II or BINDING SITE III. Table 2 illustrates the complementarity of the nucleotide sequences of CTPS2 BINDING SITE, designated SEQ ID:21263, to the nucleotide sequence of VGAM1936 RNA, herein designated VGAM RNA, also designated SEQ ID:4647.

Another function of VGAM1936 is therefore inhibition of CTP Synthase II (CTPS2, Accession NM_019857). Accordingly, utilities of VGAM1936 include diagnosis, prevention and treatment of diseases and clinical conditions associated with CTPS2. dJ309H15.1 (Accession NM_138574) is another VGAM1936 host target gene. dJ309H15.1 BINDING SITE is HOST TARGET binding site found in the 3' untranslated region of mRNA encoded by dJ309H15.1, corresponding to a HOST TARGET binding site such as BINDING SITE I, BINDING SITE II or BINDING SITE III. Table 2 illustrates the complementarity of the nucleotide sequences of dJ309H15.1 BINDING SITE, designated SEQ ID:28887, to the nucleotide sequence of VGAM1936 RNA, herein designated VGAM RNA, also designated SEQ ID:4647.

Another function of VGAM1936 is therefore inhibition of dJ309H15.1 (Accession NM_138574). Accordingly, utilities of VGAM1936 include diagnosis, prevention and treatment of diseases and clinical conditions associated with dJ309H15.1. DKFZP434C171 (Accession NM_015621) is another VGAM1936 host target gene. DKFZP434C171 BINDING SITE is HOST TARGET binding site found in the 3' untranslated region of mRNA encoded by DKFZP434C171, corresponding to a HOST TARGET binding site such as BINDING SITE I, BINDING SITE II or BINDING SITE III. Table 2 illustrates the complementarity of the nucleotide sequences of DKFZP434C171 BINDING SITE, designated SEQ ID:17884, to the nucleotide sequence of VGAM1936 RNA, herein designated VGAM RNA, also designated SEQ ID:4647.

Another function of VGAM1936 is therefore inhibition of DKFZP434C171 (Accession NM_015621). Accordingly, utilities of VGAM1936 include diagnosis, prevention and treatment of diseases and clinical conditions associated with DKFZP434C171. DKFZP727C091 (Accession XM_038689) is another VGAM1936 host target gene. DKFZP727C091 BINDING SITE is HOST TARGET binding site found in the 3' untranslated region of mRNA encoded by DKFZP727C091, corresponding to a HOST TARGET binding site such as BINDING SITE I, BINDING SITE II or BINDING SITE III. Table 2 illustrates the complementarity of the nucleotide sequences of DKFZP727C091 BINDING SITE, designated SEQ ID:32903, to the nucleotide sequence of VGAM1936 RNA, herein designated VGAM RNA, also designated SEQ ID:4647.

Another function of VGAM1936 is therefore inhibition of DKFZP727C091 (Accession XM_038689). Accordingly, utilities of VGAM1936 include diagnosis, prevention and treatment of diseases and clinical conditions associated with DKFZP727C091. HSA243666 (Accession NM_017582) is another VGAM1936 host target gene. HSA243666 BINDING SITE is HOST TARGET binding site found in the 3' untranslated region of mRNA encoded by HSA243666, corresponding to a HOST TARGET binding site such as BINDING SITE I, BINDING SITE II or BINDING SITE III. Table 2 illustrates the complementarity of the nucleotide sequences of HSA243666 BINDING SITE, designated SEQ ID:19020, to the nucleotide sequence of VGAM1936 RNA, herein designated VGAM RNA, also designated SEQ ID:4647.

Another function of VGAM1936 is therefore inhibition of HSA243666 (Accession NM_017582). Accordingly, utilities of VGAM1936 include diagnosis, prevention and treatment of diseases and clinical conditions associated with HSA243666. KIAA0237 (Accession NM_014747) is another VGAM1936 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16446, to the nucleotide sequence of VGAM1936 RNA, herein designated VGAM RNA, also designated SEQ ID:4647.

Another function of VGAM1936 is therefore inhibition of KIAA0237 (Accession NM_014747). Accordingly, utilities of VGAM1936 include diagnosis, prevention and treatment of diseases and clinical conditions associated with KIAA0237. KIAA0953 (Accession XM_039733) is another VGAM1936 host target gene. KIAA0953 BINDING SITE is HOST TARGET binding site found in the 3' untranslated region of mRNA encoded by KIAA0953, corresponding to a HOST TARGET binding site such as BINDING SITE I, BINDING SITE II or BINDING SITE III. Table 2 illustrates the complementarity of the nucleotide sequences of KIAA0953 BINDING SITE, designated SEQ ID:33167, to the nucleotide sequence of VGAM1936 RNA, herein designated VGAM RNA, also designated SEQ ID:4647.

Another function of VGAM1936 is therefore inhibition of KIAA0953 (Accession XM_039733). Accordingly, utilities of VGAM1936 include diagnosis, prevention and treatment of diseases and clinical conditions associated with KIAA0953. KIAA1191 (Accession NM_020444) is another VGAM1936 host target gene. KIAA1191 BINDING SITE is HOST TARGET binding site found in the 3' untranslated region of mRNA encoded by KIAA1191, corresponding to a HOST TARGET binding site such as BINDING SITE I, BINDING SITE II or BINDING SITE III. Table 2 illustrates the complementarity of the nucleotide sequences of KIAA1191 BINDING SITE, designated SEQ ID:21685, to the nucleotide sequence of VGAM1936 RNA, herein designated VGAM RNA, also designated SEQ ID:4647.

Another function of VGAM1936 is therefore inhibition of KIAA1191 (Accession NM_020444). Accordingly, utilities of VGAM1936 include diagnosis, prevention and treatment of diseases and clinical conditions associated with KIAA1191. KIAA1719 (Accession XM_042936) is another VGAM1936 host target gene. KIAA1719 BINDING SITE is HOST TARGET binding site found in the 3' untranslated region of mRNA encoded by KIAA1719, corresponding to a HOST TARGET binding site such as BINDING SITE I, BINDING SITE II or BINDING SITE III. Table 2 illustrates the complementarity of the nucleotide sequences of KIAA1719 BINDING SITE, designated SEQ ID:33824, to the nucleotide sequence of VGAM1936 RNA, herein designated VGAM RNA, also designated SEQ ID:4647.

Another function of VGAM1936 is therefore inhibition of KIAA1719 (Accession XM_042936). Accordingly, utilities of VGAM1936 include diagnosis, prevention and treatment of diseases and clinical conditions associated with KIAA1719. KIAA1853 (Accession XM_045184) is another VGAM1936 host target gene. KIAA1853 BINDING SITE is HOST TARGET binding site found in the 5' untranslated region of mRNA encoded by KIAA1853, corresponding to a HOST TARGET binding site such as BINDING SITE I, BINDING SITE II or BINDING SITE III. Table 2 illustrates the complementarity of the nucleotide sequences of KIAA1853 BINDING SITE, designated SEQ ID:34388, to the nucleotide sequence of VGAM1936 RNA, herein designated VGAM RNA, also designated SEQ ID:4647.

Another function of VGAM1936 is therefore inhibition of KIAA1853 (Accession XM_045184). Accordingly, utilities of VGAM1936 include diagnosis, prevention and treatment of diseases and clinical conditions associated with KIAA1853. KIAA1922 (Accession XM_057040) is another VGAM1936 host target gene. KIAA1922 BINDING SITE is HOST TARGET binding site found in the 5' untranslated region of mRNA encoded by KIAA1922, corresponding to a HOST TARGET binding site such as BINDING SITE I, BINDING SITE II or BINDING SITE III. Table 2 illustrates the complementarity of the nucleotide sequences of KIAA1922 BINDING SITE, designated SEQ ID:36454, to the nucleotide sequence of VGAM1936 RNA, herein designated VGAM RNA, also designated SEQ ID:4647.

Another function of VGAM1936 is therefore inhibition of KIAA1922 (Accession XM_057040). Accordingly, utilities of VGAM1936 include diagnosis, prevention and treatment of diseases and clinical conditions associated with KIAA1922. Retinoic Acid Induced 17 (RAI17, Accession XM_166091) is another VGAM1936 host target gene. RAI17 BINDING SITE is HOST TARGET binding site found in the 3' untranslated region of mRNA encoded by RAI17, corresponding to a HOST TARGET binding site such as BINDING SITE I, BINDING SITE II or BINDING SITE III. Table 2 illustrates the complementarity of the nucleotide sequences of RAI17 BINDING SITE, designated SEQ ID:43860, to the nucleotide sequence of VGAM1936 RNA, herein designated VGAM RNA, also designated SEQ ID:4647.

Another function of VGAM1936 is therefore inhibition of Retinoic Acid Induced 17 (RAI17, Accession XM_166091). Accordingly, utilities of VGAM1936 include diagnosis, prevention and treatment of diseases and clinical conditions associated with RAI17. SCYA5 (Accession NM_002985) is another VGAM1936 host target gene. SCYA5 BINDING SITE is HOST TARGET binding site found in the 3' untranslated region of mRNA encoded by SCYA5, corresponding to a HOST TARGET binding site such as BINDING SITE I, BINDING SITE II or BINDING SITE III. Table 2 illustrates the complementarity of the nucleotide sequences of SCYA5 BINDING SITE, designated SEQ ID:8882, to the nucleotide sequence of VGAM1936 RNA, herein designated VGAM RNA, also designated SEQ ID:4647.

Another function of VGAM1936 is therefore inhibition of SCYA5 (Accession NM_002985). Accordingly, utilities of VGAM1936 include diagnosis, prevention and treatment of diseases and clinical conditions associated with SCYA5. Serine Threonine Kinase 39 (STE20/SPS1 homolog, yeast) (STK39, Accession NM_013233) is another VGAM1936 host target gene. STK39 BINDING SITE is HOST TARGET binding site found in the 3' untranslated region of mRNA encoded by STK39, corresponding to a HOST TARGET binding site such as BINDING SITE I, BINDING SITE II or BINDING SITE III. Table 2 illustrates the complementarity of the nucleotide sequences of STK39 BINDING SITE, designated SEQ ID:14893, to the nucleotide sequence of VGAM1936 RNA, herein designated VGAM RNA, also designated SEQ ID:4647.

Another function of VGAM1936 is therefore inhibition of Serine Threonine Kinase 39 (STE20/SPS1 homolog, yeast) (STK39, Accession NM_013233). Accordingly, utilities of VGAM1936 include diagnosis, prevention and treatment of diseases and clinical conditions associated with STK39. TGFB1-induced Anti-apoptotic Factor 1 (TIAF1, Accession NM_078471) is another VGAM1936 host target gene. TIAF1 BINDING SITE is HOST TARGET binding site found in the 3' untranslated region of mRNA encoded by TIAF1, corresponding to a HOST TARGET binding site such as BINDING SITE I, BINDING SITE II or BINDING SITE III. Table 2 illustrates the complementarity of the nucleotide sequences of TIAF1 BINDING SITE, designated SEQ ID:27799, to the nucleotide sequence of VGAM1936 RNA, herein designated VGAM RNA, also designated SEQ ID:4647.

Another function of VGAM1936 is therefore inhibition of TGFB1-induced Anti-apoptotic Factor 1 (TIAF1, Accession NM_078471). Accordingly, utilities of VGAM1936 include diagnosis, prevention and treatment of diseases and clinical conditions associated with TIAF1. LOC113763 (Accession NM_138434) is another VGAM1936 host target gene. LOC113763 BINDING SITE is HOST TARGET binding site found in the 3' untranslated region of mRNA encoded by LOC113763, corresponding to a HOST TARGET binding site such as BINDING SITE I, BINDING SITE II or BINDING SITE III. Table 2 illustrates the complementarity of the nucleotide sequences of LOC113763 BINDING SITE, designated SEQ ID:28799, to the nucleotide sequence of VGAM1936 RNA, herein designated VGAM RNA, also designated SEQ ID:4647.

Another function of VGAM1936 is therefore inhibition of LOC113763 (Accession NM_138434). Accordingly, utilities of VGAM1936 include diagnosis, prevention and treatment of diseases and clinical conditions associated with LOC113763. LOC138389 (Accession XM_072534) is another VGAM1936 host target gene. LOC138389 BINDING SITE is HOST TARGET binding site found in the 5' untranslated region of mRNA encoded by LOC138389, corresponding to a HOST TARGET binding site such as BINDING SITE I, BINDING SITE II or BINDING SITE III. Table 2 illustrates the complementarity of the nucleotide sequences of LOC138389 BINDING SITE, designated SEQ ID:37505, to the nucleotide sequence of VGAM1936 RNA, herein designated VGAM RNA, also designated SEQ ID:4647.

Another function of VGAM1936 is therefore inhibition of LOC138389 (Accession XM_072534). Accordingly, utilities of VGAM1936 include diagnosis, prevention and treatment of diseases and clinical conditions associated with LOC138389. LOC144465 (Accession XM_084874) is another VGAM1936 host target gene. LOC144465 BINDING SITE is HOST TARGET binding site found in the 3' untranslated region of mRNA encoded by LOC144465, corresponding to a HOST TARGET binding site such as BINDING SITE I, BINDING SITE II or BINDING SITE III. Table 2 illustrates the complementarity of the nucleotide sequences of LOC144465 BINDING SITE, designated SEQ ID:37752, to the nucleotide sequence of VGAM1936 RNA, herein designated VGAM RNA, also designated SEQ ID:4647.

Another function of VGAM1936 is therefore inhibition of LOC144465 (Accession XM_084874). Accordingly, utilities of VGAM1936 include diagnosis, prevention and treatment of diseases and clinical conditions associated with LOC144465. LOC146346 (Accession XM_085430) is another VGAM1936 host target gene. LOC146346 BINDING SITE is HOST TARGET binding site found in the 5' untranslated region of mRNA encoded by LOC146346, corresponding to a HOST TARGET binding site such as BINDING SITE I, BINDING SITE II or BINDING SITE III. Table 2 illustrates the complementarity of the nucleotide sequences of LOC146346 BINDING SITE, designated SEQ ID:38138, to the nucleotide sequence of VGAM1936 RNA, herein designated VGAM RNA, also designated SEQ ID:4647.

Another function of VGAM1936 is therefore inhibition of LOC146346 (Accession XM_085430). Accordingly, utilities of VGAM1936 include diagnosis, prevention and treatment of diseases and clinical conditions associated with LOC146346. LOC151176 (Accession XM_098016) is another VGAM1936 host target gene. LOC151176 BINDING SITE is HOST TARGET binding site found in the 3' untranslated region of mRNA encoded by LOC151176, corresponding to a HOST TARGET binding site such as BINDING SITE I, BINDING SITE II or BINDING SITE III. Table 2 illustrates the complementarity of the nucleotide sequences of LOC151176 BINDING SITE, designated SEQ ID:41316, to the nucleotide sequence of VGAM1936 RNA, herein designated VGAM RNA, also designated SEQ ID:4647.

Another function of VGAM1936 is therefore inhibition of LOC151176 (Accession XM_098016). Accordingly, utilities of VGAM1936 include diagnosis, prevention and treatment of diseases and clinical conditions associated with LOC151176. LOC163782 (Accession XM_089138) is another VGAM1936 host target gene. LOC163782 BINDING SITE is HOST TARGET binding site found in the 3' untranslated region of mRNA encoded by LOC163782, corresponding to a HOST TARGET binding site such as BINDING SITE I, BINDING SITE II or BINDING SITE III. Table 2 illustrates the complementarity of the nucleotide sequences of LOC163782 BINDING SITE, designated SEQ ID:39963, to the nucleotide sequence of VGAM1936 RNA, herein designated VGAM RNA, also designated SEQ ID:4647.

Another function of VGAM1936 is therefore inhibition of LOC163782 (Accession XM_089138). Accordingly, utilities of VGAM1936 include diagnosis, prevention and treatment of diseases and clinical conditions associated with LOC163782. LOC200953 (Accession XM_117302) is another VGAM1936 host target gene. LOC200953 BINDING SITE is HOST TARGET binding site found in the 5' untranslated region of mRNA encoded by LOC200953, corresponding to a HOST TARGET binding site such as BINDING SITE I, BINDING SITE II or BINDING SITE III. Table 2 illustrates the complementarity of the nucleotide sequences of LOC200953 BINDING SITE, designated SEQ ID:43369, to the nucleotide sequence of VGAM1936 RNA, herein designated VGAM RNA, also designated SEQ ID:4647.

Another function of VGAM1936 is therefore inhibition of LOC200953 (Accession XM_117302). Accordingly, utilities of VGAM1936 include diagnosis, prevention and treatment of diseases and clinical conditions associated with LOC200953. LOC220846 (Accession XM_165515) is another VGAM1936 host target gene. LOC220846 BINDING SITE is HOST TARGET binding site found in the 3' untranslated region of mRNA encoded by LOC220846, corresponding to a HOST TARGET binding site such as BINDING SITE I, BINDING SITE II or BINDING SITE III. Table 2 illustrates the complementarity of the nucleotide sequences of LOC220846 BINDING SITE, designated SEQ ID:43664, to the nucleotide sequence of VGAM1936 RNA, herein designated VGAM RNA, also designated SEQ ID:4647.

Another function of VGAM1936 is therefore inhibition of LOC220846 (Accession XM_165515). Accordingly, utilities of VGAM1936 include diagnosis, prevention and treatment of diseases and clinical conditions associated with LOC220846. LOC257000 (Accession XM_172999) is another VGAM1936 host target gene. LOC257000 BINDING SITE is HOST TARGET binding site found in the 3' untranslated region of mRNA encoded by LOC257000, corresponding to a HOST TARGET binding site such as BINDING SITE I, BINDING SITE II or BINDING SITE III. Table 2 illustrates the complementarity of the nucleotide sequences of LOC257000 BINDING SITE, designated SEQ ID:46274, to the nucleotide sequence of VGAM1936 RNA, herein designated VGAM RNA, also designated SEQ ID:4647.

Another function of VGAM1936 is therefore inhibition of LOC257000 (Accession XM_172999). Accordingly, utilities of VGAM1936 include diagnosis, prevention and treatment of diseases and clinical conditions associated with LOC257000. LOC92080 (Accession XM_042704) is another VGAM1936 host target gene. LOC92080 BINDING SITE is HOST TARGET binding site found in the 5' untranslated region of mRNA encoded by LOC92080, corresponding to a HOST TARGET binding site such as BINDING SITE I, BINDING SITE II or BINDING SITE III. Table 2 illustrates the complementarity of the nucleotide sequences of LOC92080 BINDING SITE, designated SEQ ID:33755, to the nucleotide sequence of VGAM1936 RNA, herein designated VGAM RNA, also designated SEQ ID:4647.

Another function of VGAM1936 is therefore inhibition of LOC92080 (Accession XM_042704). Accordingly, utilities of VGAM1936 include diagnosis, prevention and treatment of diseases and clinical conditions associated with LOC92080. FIG. 1 further provides a conceptual description of a novel bioinformatically detected viral gene of the present invention, referred to here as Viral Genomic Address Messenger 1937 (VGAM1937) viral gene, which modulates expression of respective host target genes thereof, the function and utility of which host target genes is known in the art.

VGAM1937 is a novel bioinformatically detected regulatory, non protein coding, viral micro RNA (miRNA) gene. The method by which VGAM1937 was detected is described hereinabove with reference to FIGS. 1-8.

VGAM1937 gene, herein designated VGAM GENE, is a viral gene contained in the genome of Human Herpesvirus 4. VGAM1937 host target gene, herein designated VGAM HOST TARGET GENE, is a human gene contained in the human genome.

VGAM1937 gene encodes a VGAM1937 precursor RNA, herein designated VGAM PRECURSOR RNA. Similar to other miRNA genes, and unlike most ordinary genes, VGAM1937 precursor RNA does not encode a protein. A nucleotide sequence identical or highly similar to the nucleotide sequence of VGAM1937 precursor RNA is designated SEQ ID:1923, and is provided hereinbelow with reference to the sequence listing part. Nucleotide sequence SEQ ID:1923 is located at position 161986 relative to the genome of Human Herpesvirus 4.

VGAM1937 precursor RNA folds onto itself, forming VGAM1937 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1937 folded precursor RNA into VGAM1937 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1937 RNA is designated SEQ ID:4648, and is provided hereinbelow with reference to the sequence listing part.

VGAM1937 host target gene, herein designated VGAM HOST TARGET GENE, encodes a corresponding messenger RNA, VGAM1937 host target RNA, herein designated VGAM HOST TARGET RNA. VGAM1937 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1937 RNA, herein designated VGAM RNA, binds complementarily to one or more host target binding sites located in untranslated regions of VGAM1937 host target RNA, herein designated VGAM HOST TARGET RNA. This complementary binding is due to the fact that the nucleotide sequence of VGAM1937 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1937 RNA, herein designated VGAM RNA, may have a different number of host target binding sites in untranslated regions of a VGAM1937 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1937 RNA, herein designated VGAM RNA, to host target binding sites on VGAM1937 host target RNA, herein designated VGAM HOST TARGET RNA, such as BINDING SITE I, BINDING SITE II and BINDING SITE III, inhibits translation of VGAM1937 host target RNA into VGAM1937 host target protein, herein designated VGAM HOST TARGET PROTEIN. VGAM host target protein is therefore outlined by a broken line.

It is appreciated that VGAM1937 host target gene, herein designated VGAM HOST TARGET GENE, in fact represents a plurality of VGAM1937 host target genes. The mRNA of each one of this plurality of VGAM1937 host target genes comprises one or more host target binding sites, each having a nucleotide sequence which is at least partly complementary to VGAM1937 RNA, herein designated VGAM RNA, and which when bound by VGAM1937 RNA causes inhibition of translation of respective one or more VGAM1937 host target proteins.

It is further appreciated by one skilled in the art that the mode of translational inhibition illustrated by FIG. 1 with specific reference to translational inhibition exerted by VGAM1937 gene, herein designated VGAM GENE, on one or more VGAM1937 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1937 is inhibition of expression of host target genes, as part of a novel viral mechanism of attacking a host. Accordingly, utilities of VGAM1937 include diagnosis, prevention and treatment of viral infection by Human Herpesvirus 4. Specific functions, and accordingly utilities, of VGAM1937 correlate with, and may be deduced from, the identity of the host target genes which VGAM1937 binds and inhibits, and the function of these host target genes, as elaborated hereinbelow.

Nucleotide sequences of the VGAM1937 precursor RNA, herein designated VGAM PRECURSOR RNA, and of the ‘diced’ VGAM1937 RNA, herein designated VGAM RNA, and a schematic representation of the secondary folding of VGAM1937 folded precursor RNA, herein designated VGAM FOLDED PRECURSOR RNA, of VGAM1937 are further described hereinbelow with reference to Table 1.

Nucleotide sequences of host target binding sites, such as BINDING SITE-I, BINDING SITE-II and BINDING SITE-III of FIG. 1, found on VGAM1937 host target RNA, and schematic representation of the complementarity of each of these host target binding sites to VGAM1937 RNA, herein designated VGAM RNA, are described hereinbelow with reference to Table 2.

As mentioned hereinabove with reference to FIG. 1, a function of VGAM1937 gene, herein designated VGAM is inhibition of expression of VGAM1937 target genes. It is appreciated that specific functions, and accordingly utilities, of VGAM1937 correlate with, and may be deduced from, the identity of the target genes which VGAM1937 binds and inhibits, and the function of these target genes, as elaborated hereinbelow.

RAN Binding Protein 3 (RANBP3, Accession NM_007321) is a VGAM1937 host target gene. RANBP3 BINDING SITE is HOST TARGET binding site found in the 5' untranslated region of mRNA encoded by RANBP3, corresponding to a HOST TARGET binding site such as BINDING SITE I, BINDING SITE II or BINDING SITE III. Table 2 illustrates the complementarity of the nucleotide sequences of RANBP3 BINDING SITE, designated SEQ ID:14238, to the nucleotide sequence of VGAM1937 RNA, herein designated VGAM RNA, also designated SEQ ID:4648.

A function of VGAM1937 is therefore inhibition of RAN Binding Protein 3 (RANBP3, Accession NM_007321). Accordingly, utilities of VGAM1937 include diagnosis, prevention and treatment of diseases and clinical conditions associated with RANBP3. TIM3 (Accession NM_032782) is another VGAM1937 host target gene. TIM3 BINDING SITE is HOST TARGET binding site found in the 3' untranslated region of mRNA encoded by TIM3, corresponding to a HOST TARGET binding site such as BINDING SITE I, BINDING SITE II or BINDING SITE III. Table 2 illustrates the complementarity of the nucleotide sequences of TIM3 BINDING SITE, designated SEQ ID:26523, to the nucleotide sequence of VGAM1937 RNA, herein designated VGAM RNA, also designated SEQ ID:4648.

Another function of VGAM1937 is therefore inhibition of TIM3 (Accession NM_032782), a gene which regulates macrophage activation and enhances the severity of experimental autoimmune encephalomyelitis in mice. Accordingly, utilities of VGAM1937 include diagnosis, prevention and treatment of diseases and clinical conditions associated with TIM3. The function of TIM3 and its association with various diseases and clinical conditions, has been established by previous studies, as described hereinabove with reference to VGAM909. ALK7 (Accession XM_065712) is another VGAM1937 host target gene. ALK7 BINDING SITE is HOST TARGET binding site found in the 5' untranslated region of mRNA encoded by ALK7, corresponding to a HOST TARGET binding site such as BINDING SITE I, BINDING SITE II or BINDING SITE III. Table 2 illustrates the complementarity of the nucleotide sequences of ALK7 BINDING SITE, designated SEQ ID:37295, to the nucleotide sequence of VGAM1937 RNA, herein designated VGAM RNA, also designated SEQ ID:4648.

Another function of VGAM1937 is therefore inhibition of ALK7 (Accession XM_065712). Accordingly, utilities of VGAM1937 include diagnosis, prevention and treatment of diseases and clinical conditions associated with ALK7. C3F (Accession NM_005768) is another VGAM1937 host target gene. C3F BINDING SITE is HOST TARGET binding site found in the 3' untranslated region of mRNA encoded by C3F, corresponding to a HOST TARGET binding site such as BINDING SITE I, BINDING SITE II or BINDING SITE III. Table 2 illustrates the complementarity of the nucleotide sequences of C3F BINDING SITE, designated SEQ ID:12332, to the nucleotide sequence of VGAM1937 RNA, herein designated VGAM RNA, also designated SEQ ID:4648.

Another function of VGAM1937 is therefore inhibition of C3F (Accession NM_005768). Accordingly, utilities of VGAM1937 include diagnosis, prevention and treatment of diseases and clinical conditions associated with C3F. DKFZP434N014 (Accession XM_027012) is another VGAM1937 host target gene. DKFZP434N014 BINDING SITE is HOST TARGET binding site found in the 5' untranslated region of mRNA encoded by DKFZP434N014, corresponding to a HOST TARGET binding site such as BINDING SITE I, BINDING SITE II or BINDING SITE III. Table 2 illustrates the complementarity of the nucleotide sequences of DKFZP434N014 BINDING SITE, designated SEQ ID:30390, to the nucleotide sequence of VGAM1937 RNA, herein designated VGAM RNA, also designated SEQ ID:4648.

Another function of VGAM1937 is therefore inhibition of DKFZP434N014 (Accession XM_027012). Accordingly, utilities of VGAM1937 include diagnosis, prevention and treatment of diseases and clinical conditions associated with DKFZP434N014. FLJ11565 (Accession NM_024657) is another VGAM1937 host target gene. FLJ11565 BINDING SITE is HOST TARGET binding site found in the 3' untranslated region of mRNA encoded by FLJ11565, corresponding to a HOST TARGET binding site such as BINDING SITE I, BINDING SITE II or BINDING SITE III. Table 2 illustrates the complementarity of the nucleotide sequences of FLJ11565 BINDING SITE, designated SEQ ID:23961, to the nucleotide sequence of VGAM1937 RNA, herein designated VGAM RNA, also designated SEQ ID:4648.

Another function of VGAM1937 is therefore inhibition of FLJ11565 (Accession NM_024657). Accordingly, utilities of VGAM1937 include diagnosis, prevention and treatment of diseases and clinical conditions associated with FLJ11565. FLJ14775 (Accession NM_032837) is another VGAM1937 host target gene. FLJ14775 BINDING SITE is HOST TARGET binding site found in the 3' untranslated region of mRNA encoded by FLJ14775, corresponding to a HOST TARGET binding site such as BINDING SITE I, BINDING SITE II or BINDING SITE III. Table 2 illustrates the complementarity of the nucleotide sequences of FLJ14775 BINDING SITE, designated SEQ ID:26618, to the nucleotide sequence of VGAM1937 RNA, herein designated VGAM RNA, also designated SEQ ID:4648.

Another function of VGAM1937 is therefore inhibition of FLJ14775 (Accession NM_032837). Accordingly, utilities of VGAM1937 include diagnosis, prevention and treatment of diseases and clinical conditions associated with FLJ14775. FLJ20174 (Accession NM_017699) is another VGAM1937 host target gene. FLJ20174 BINDING SITE is HOST TARGET binding site found in the 3' untranslated region of mRNA encoded by FLJ20174, corresponding to a HOST TARGET binding site such as BINDING SITE I, BINDING SITE II or BINDING SITE III. Table 2 illustrates the complementarity of the nucleotide sequences of FLJ20174 BINDING SITE, designated SEQ ID:19271, to the nucleotide sequence of VGAM1937 RNA, herein designated VGAM RNA, also designated SEQ ID:4648.

Another function of VGAM1937 is therefore inhibition of FLJ20174 (Accession NM_017699). Accordingly, utilities of VGAM1937 include diagnosis, prevention and treatment of diseases and clinical conditions associated with FLJ20174. KIAA0620 (Accession XM_030707) is another VGAM1937 host target gene. KIAA0620 BINDING SITE is HOST TARGET binding site found in the 3' untranslated region of mRNA encoded by KIAA0620, corresponding to a HOST TARGET binding site such as BINDING SITE I, BINDING SITE II or BINDING SITE III. Table 2 illustrates the complementarity of the nucleotide sequences of KIAA0620 BINDING SITE, designated SEQ ID:31124, to the nucleotide sequence of VGAM1937 RNA, herein designated VGAM RNA, also designated SEQ ID:4648.

Another function of VGAM1937 is therefore inhibition of KIAA0620 (Accession XM_030707). Accordingly, utilities of VGAM1937 include diagnosis, prevention and treatment of diseases and clinical conditions associated with KIAA0620. Mitogen-activated Protein Kinase Kinase Kinase 2 (MAP3K2, Accession NM_006609) is another VGAM1937 host target gene. MAP3K2 BINDING SITE is HOST TARGET binding site found in the 3' untranslated region of mRNA encoded by MAP3K2, corresponding to a HOST TARGET binding site such as BINDING SITE I, BINDING SITE II or BINDING SITE III. Table 2 illustrates the complementarity of the nucleotide sequences of MAP3K2 BINDING SITE, designated SEQ ID:13388, to the nucleotide sequence of VGAM1937 RNA, herein designated VGAM RNA, also designated SEQ ID:4648.

Another function of VGAM1937 is therefore inhibition of Mitogen-activated Protein Kinase Kinase Kinase 2 (MAP3K2, Accession NM_006609). Accordingly, utilities of VGAM1937 include diagnosis, prevention and treatment of diseases and clinical conditions associated with MAP3K2. Neurexophilin 3 (NXPH3, Accession XM_037847) is another VGAM1937 host target gene. NXPH3 BINDING SITE is HOST TARGET binding site found in the 3' untranslated region of mRNA encoded by NXPH3, corresponding to a HOST TARGET binding site such as BINDING SITE I, BINDING SITE II or BINDING SITE III. Table 2 illustrates the complementarity of the nucleotide sequences of NXPH3 BINDING SITE, designated SEQ ID:32719, to the nucleotide sequence of VGAM1937 RNA, herein designated VGAM RNA, also designated SEQ ID:4648.

Another function of VGAM1937 is therefore inhibition of Neurexophilin 3 (NXPH3, Accession XM_037847). Accordingly, utilities of VGAM1937 include diagnosis, prevention and treatment of diseases and clinical conditions associated with NXPH3. START Domain Containing 7 (STARD7, Accession NM_020151) is another VGAM1937 host target gene. STARD7 BINDING SITE is HOST TARGET binding site found in the 5' untranslated region of mRNA encoded by STARD7, corresponding to a HOST TARGET binding site such as BINDING SITE I, BINDING SITE II or BINDING SITE III. Table 2 illustrates the complementarity of the nucleotide sequences of STARD7 BINDING SITE, designated SEQ ID:21356, to the nucleotide sequence of VGAM1937 RNA, herein designated VGAM RNA, also designated SEQ ID:4648.

Another function of VGAM1937 is therefore inhibition of START Domain Containing 7 (STARD7, Accession NM_020151). Accordingly, utilities of VGAM1937 include diagnosis, prevention and treatment of diseases and clinical conditions associated with STARD7. Three Prime Repair Exonuclease 1 (TREX1, Accession NM_016381) is another VGAM1937 host target gene. TREX1 BINDING SITE1 through TREX1 BINDING SITE3 are HOST TARGET binding sites found in untranslated regions of mRNA encoded by TREX1, corresponding to HOST TARGET binding sites such as BINDING SITE I, BINDING SITE II or BINDING SITE III. Table 2 illustrates the complementarity of the nucleotide sequences of TREX1 BINDING SITE1 through TREX1 BINDING SITE3, designated SEQ ID:18520, SEQ ID:27345 and SEQ ID:27336 respectively, to the nucleotide sequence of VGAM1937 RNA, herein designated VGAM RNA, also designated SEQ ID:4648.

Another function of VGAM1937 is therefore inhibition of Three Prime Repair Exonuclease 1 (TREX1, Accession NM_016381). Accordingly, utilities of VGAM1937 include diagnosis, prevention and treatment of diseases and clinical conditions associated with TREX1. LOC149373 (Accession XM_086507) is another VGAM1937 host target gene. LOC149373 BINDING SITE is HOST TARGET binding site found in the 3' untranslated region of mRNA encoded by LOC149373, corresponding to a HOST TARGET binding site such as BINDING SITE I, BINDING SITE II or BINDING SITE III. Table 2 illustrates the complementarity of the nucleotide sequences of LOC149373 BINDING SITE, designated SEQ ID:38720, to the nucleotide sequence of VGAM1937 RNA, herein designated VGAM RNA, also designated SEQ ID:4648.

Another function of VGAM1937 is therefore inhibition of LOC149373 (Accession XM_086507). Accordingly, utilities of VGAM1937 include diagnosis, prevention and treatment of diseases and clinical conditions associated with LOC149373. LOC149668 (Accession XM_097692) is another VGAM1937 host target gene. LOC149668 BINDING SITE is HOST TARGET binding site found in the 5' untranslated region of mRNA encoded by LOC149668, corresponding to a HOST TARGET binding site such as BINDING SITE I, BINDING SITE II or BINDING SITE III. Table 2 illustrates the complementarity of the nucleotide sequences of LOC149668 BINDING SITE, designated SEQ ID:41031, to the nucleotide sequence of VGAM1937 RNA, herein designated VGAM RNA, also designated SEQ ID:4648.

Another function of VGAM1937 is therefore inhibition of LOC149668 (Accession XM_097692). Accordingly, utilities of VGAM1937 include diagnosis, prevention and treatment of diseases and clinical conditions associated with LOC149668. FIG. 1 further provides a conceptual description of a novel bioinformatically detected viral gene of the present invention, referred to here as Viral Genomic Address Messenger 1938 (VGAM1938) viral gene, which modulates expression of respective host target genes thereof, the function and utility of which host target genes is known in the art.

VGAM1938 is a novel bioinformatically detected regulatory, non protein coding, viral micro RNA (miRNA) gene. The method by which VGAM1938 was detected is described hereinabove with reference to FIGS. 1-8.

VGAM1938 gene, herein designated VGAM GENE, is a viral gene contained in the genome of Human Herpesvirus 4. VGAM1938 host target gene, herein designated VGAM HOST TARGET GENE, is a human gene contained in the human genome.

VGAM1938 gene encodes a VGAM1938 precursor RNA, herein designated VGAM PRECURSOR RNA. Similar to other miRNA genes, and unlike most ordinary genes, VGAM1938 precursor RNA does not encode a protein. A nucleotide sequence identical or highly similar to the nucleotide sequence of VGAM1938 precursor RNA is designated SEQ ID:1924, and is provided hereinbelow with reference to the sequence listing part. Nucleotide sequence SEQ ID:1924 is located at position 151796 relative to the genome of Human Herpesvirus 4.

VGAM1938 precursor RNA folds onto itself, forming VGAM1938 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1938 folded precursor RNA into VGAM1938 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM1938 RNA is designated SEQ ID:4649, and is provided hereinbelow with reference to the sequence listing part.

VGAM1938 host target gene, herein designated VGAM HOST TARGET GENE, encodes a corresponding messenger RNA, VGAM1938 host target RNA, herein designated VGAM HOST TARGET RNA. VGAM1938 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1938 RNA, herein designated VGAM RNA, binds complementarily to one or more host target binding sites located in untranslated regions of VGAM1938 host target RNA, herein designated VGAM HOST TARGET RNA. This complementary binding is due to the fact that the nucleotide sequence of VGAM1938 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1938 RNA, herein designated VGAM RNA, may have a different number of host target binding sites in untranslated regions of a VGAM1938 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1938 RNA, herein designated VGAM RNA, to host target binding sites on VGAM1938 host target RNA, herein designated VGAM HOST TARGET RNA, such as BINDING SITE I, BINDING SITE II and BINDING SITE III, inhibits translation of VGAM1938 host target RNA into VGAM1938 host target protein, herein designated VGAM HOST TARGET PROTEIN. VGAM host target protein is therefore outlined by a broken line.

It is appreciated that VGAM1938 host target gene, herein designated VGAM HOST TARGET GENE, in fact represents a plurality of VGAM1938 host target genes. The mRNA of each one of this plurality of VGAM1938 host target genes comprises one or more host target binding sites, each having a nucleotide sequence which is at least partly complementary to VGAM1938 RNA, herein designated VGAM RNA, and which when bound by VGAM1938 RNA causes inhibition of translation of respective one or more VGAM1938 host target proteins.

It is further appreciated by one skilled in the art that the mode of translational inhibition illustrated by FIG. 1 with specific reference to translational inhibition exerted by VGAM1938 gene, herein designated VGAM GENE, on one or more VGAM1938 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1938 is inhibition of expression of host target genes, as part of a novel viral mechanism of attacking a host. Accordingly, utilities of VGAM1938 include diagnosis, prevention and treatment of viral infection by Human Herpesvirus 4. Specific functions, and accordingly utilities, of VGAM1938 correlate with, and may be deduced from, the identity of the host target genes which VGAM1938 binds and inhibits, and the function of these host target genes, as elaborated hereinbelow.

Nucleotide sequences of the VGAM1938 precursor RNA, herein designated VGAM PRECURSOR RNA, and of the 'diced' VGAM1938 RNA, herein designated VGAM RNA, and a schematic representation of the secondary folding of VGAM1938 folded precursor RNA, herein designated VGAM FOLDED PRECURSOR RNA, of VGAM1938 are further described hereinbelow with reference to Table 1.

Nucleotide sequences of host target binding sites, such as BINDING SITE-I, BINDING SITE-II and BINDING SITE-III of FIG. 1, found on VGAM1938 host target RNA, and schematic representation of the complementarity of each of these host target binding sites to VGAM1938 RNA, herein designated VGAM RNA, are described hereinbelow with reference to Table 2.

As mentioned hereinabove with reference to FIG. 1, a function of VGAM1938 gene, herein designated VGAM is inhibition of expression of VGAM1938 target genes. It is appreciated that specific functions, and accordingly utilities, of VGAM1938 correlate with, and may be deduced from, the identity of the target genes which VGAM1938 binds and inhibits, and the function of these target genes, as elaborated hereinbelow.

Cyclin-dependent Kinase 2 (CDK2, Accession NM_001798) is a VGAM1938 host target gene. CDK2 BINDING SITE is HOST TARGET binding site found in the 3' untranslated region of mRNA encoded by CDK2, corresponding to a HOST TARGET binding site such as BINDING SITE I, BINDING SITE II or BINDING SITE III. Table 2 illustrates the complementarity of the nucleotide sequences of CDK2 BINDING SITE, designated SEQ ID:7553, to the nucleotide sequence of VGAM1938 RNA, herein designated VGAM RNA, also designated SEQ ID:4649.

A function of VGAM1938 is therefore inhibition of Cyclin-dependent Kinase 2 (CDK2, Accession NM_001798), a gene which plays a unique role in cell cycle regulation of vertebrate cells. Accordingly, utilities of VGAM1938 include diagnosis, prevention and treatment of diseases and clinical conditions associated with CDK2. The function of CDK2 and its association with various diseases and clinical conditions, has been established by previous studies, as described hereinabove with reference to VGAM1467. Zinc Finger Protein 83 (HPF1) (ZNF83, Accession NM_018300) is another VGAM1938 host target gene. ZNF83 BINDING SITE is HOST TARGET binding site found in the 3' untranslated region of mRNA encoded by ZNF83, corresponding to a HOST TARGET binding site such as BINDING SITE I, BINDING SITE II or BINDING SITE III. Table 2 illustrates the complementarity of the nucleotide sequences of ZNF83 BINDING SITE, designated SEQ ID:20293, to the nucleotide sequence of VGAM1938 RNA, herein designated VGAM RNA, also designated SEQ ID:4649.

Another function of VGAM1938 is therefore inhibition of Zinc Finger Protein 83 (HPF1) (ZNF83, Accession NM_018300). Accordingly, utilities of VGAM1938 include diagnosis, prevention and treatment of diseases and clinical conditions associated with ZNF83. Baculoviral IAP Repeat-containing 1 (BIRC1, Accession NM_004536) is another VGAM1938 host target gene. BIRC1 BINDING SITE is HOST TARGET binding site found in the 3' untranslated region of mRNA encoded by BIRC1, corresponding to a HOST TARGET binding site such as BINDING SITE I, BINDING SITE II or BINDING SITE III. Table 2 illustrates the complementarity of the nucleotide sequences of BIRC1 BINDING SITE, designated SEQ ID:10881, to the nucleotide sequence of VGAM1938 RNA, herein designated VGAM RNA, also designated SEQ ID:4649.

Another function of VGAM1938 is therefore inhibition of Baculoviral IAP Repeat-containing 1 (BIRC1, Accession NM_004536). Accordingly, utilities of VGAM1938 include diagnosis, prevention and treatment of diseases and clinical conditions associated with BIRC1. FLJ20651 (Accession NM_017919) is another VGAM1938 host target gene. FLJ20651 BINDING SITE is HOST TARGET binding site found in the 3' untranslated region of mRNA encoded by FLJ20651, corresponding to a HOST TARGET binding site such as BINDING SITE I, BINDING SITE II or BINDING SITE III. Table 2 illustrates the complementarity of the nucleotide sequences of FLJ20651 BINDING SITE, designated SEQ ID:19574, to the nucleotide sequence of VGAM1938 RNA, herein designated VGAM RNA, also designated SEQ ID:4649.

Another function of VGAM1938 is therefore inhibition of FLJ20651 (Accession NM_017919). Accordingly, utilities of VGAM1938 include diagnosis, prevention and treatment of diseases and clinical conditions associated with FLJ20651. KIAA0391 (Accession NM_014672) is another VGAM1938 host target gene. KIAA0391 BINDING SITE is HOST TARGET binding site found in the 3' untranslated region of mRNA encoded by KIAA0391, corresponding to a HOST TARGET binding site such as BINDING SITE I, BINDING SITE II or BINDING SITE III. Table 2 illustrates the complementarity of the nucleotide sequences of KIAA0391 BINDING SITE, designated SEQ ID:16140, to the nucleotide sequence of VGAM1938 RNA, herein designated VGAM RNA, also designated SEQ ID:4649.

Another function of VGAM1938 is therefore inhibition of KIAA0391 (Accession NM_014672). Accordingly, utilities of VGAM1938 include diagnosis, prevention and treatment of diseases and clinical conditions associated with KIAA0391. LATS, Large Tumor Suppressor, Homolog 1 (Drosophila) (LATS1, Accession XM_015547) is another VGAM1938 host target gene. LATS1 BINDING SITE is HOST TARGET binding site found in the 3' untranslated region of mRNA encoded by LATS1, corresponding to a HOST TARGET binding site such as BINDING SITE I, BINDING SITE II or BINDING SITE III. Table 2 illustrates the complementarity of the nucleotide sequences of LATS1 BINDING SITE, designated SEQ ID:30238, to the nucleotide sequence of VGAM1938 RNA, herein designated VGAM RNA, also designated SEQ ID:4649.

Another function of VGAM1938 is therefore inhibition of LATS, Large Tumor Suppressor, Homolog 1 (Drosophila) (LATS1, Accession XM_015547). Accordingly, utilities of VGAM1938 include diagnosis, prevention and treatment of diseases and clinical conditions associated with LATS1. MGC2452 (Accession NM_032644) is another VGAM1938 host target gene. MGC2452 BINDING SITE is HOST TARGET binding site found in the 5" untranslated region of mRNA encoded by MGC2452, corresponding to a HOST TARGET binding site such as BINDING SITE I, BINDING SITE II or BINDING SITE III. Table 2 illustrates the complementarity of the nucleotide sequences of MGC2452 BINDING SITE, designated SEQ ID:26375, to the nucleotide sequence of VGAM1938 RNA, herein designated VGAM RNA, also designated SEQ ID:4649.

Another function of VGAM1938 is therefore inhibition of MGC2452 (Accession NM_032644). Accordingly, utilities of VGAM1938 include diagnosis, prevention and treatment of diseases and clinical conditions associated with MGC2452. LOC144473 (Accession XM_096606) is another VGAM1938 host target gene. LOC144473 BINDING SITE is HOST TARGET binding site found in the 5' untranslated region of mRNA encoded by LOC144473, corresponding to a HOST TARGET binding site such as BINDING SITE I, BINDING SITE II or BINDING SITE III. Table 2 illustrates the complementarity of the nucleotide sequences of LOC144473 BINDING SITE, designated SEQ ID:40414, to the nucleotide sequence of VGAM1938 RNA, herein designated VGAM RNA, also designated SEQ ID:4649.

Another function of VGAM1938 is therefore inhibition of LOC144473 (Accession XM_096606). Accordingly, utilities of VGAM1938 include diagnosis, prevention and treatment of diseases and clinical conditions associated with LOC144473. FIG. 1 further provides a conceptual description of a novel bioinformatically detected viral gene of the present invention, referred to here as Viral Genomic Address Messenger 1939 (VGAM1939) viral gene, which modulates expression of respective host target genes thereof, the function and utility of which host target genes is known in the art.

VGAM1939 is a novel bioinformatically detected regulatory, non protein coding, viral micro RNA (miRNA) gene. The method by which VGAM1939 was detected is described hereinabove with reference to FIGS. 1-8.

VGAM1939 gene, herein designated VGAM GENE, is a viral gene contained in the genome of Measles Virus. VGAM1939 host target gene, herein designated VGAM HOST TARGET GENE, is a human gene contained in the human genome.

VGAM1939 gene encodes a VGAM1939 precursor RNA, herein designated VGAM PRECURSOR RNA. Similar to other miRNA genes, and unlike most ordinary genes, VGAM1939 precursor RNA does not encode a protein. A nucleotide sequence identical or highly similar to the nucleotide sequence of VGAM1939 precursor RNA is designated SEQ ID:1925, and is provided hereinbelow with reference to the sequence listing part. Nucleotide sequence SEQ ID:1925 is located at position 15073 relative to the genome of Measles Virus.

VGAM1939 precursor RNA folds onto itself, forming VGAM1939 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1939 folded precursor RNA into VGAM1939 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM1939 RNA is designated SEQ ID:4650, and is provided hereinbelow with reference to the sequence listing part.

VGAM1939 host target gene, herein designated VGAM HOST TARGET GENE, encodes a corresponding messenger RNA, VGAM1939 host target RNA, herein designated VGAM HOST TARGET RNA. VGAM1939 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1939 RNA, herein designated VGAM RNA, binds complementarily to one or more host target binding sites located in untranslated regions of VGAM1939 host target RNA, herein designated VGAM HOST TARGET RNA. This complementary binding is due to the fact that the nucleotide sequence of VGAM1939 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1939 RNA, herein designated VGAM RNA, may have a different number of host target binding sites in untranslated regions of a VGAM1939 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1939 RNA, herein designated VGAM RNA, to host target binding sites on VGAM1939 host target RNA, herein designated VGAM HOST TARGET RNA, such as BINDING SITE I, BINDING SITE II and BINDING SITE III, inhibits translation of VGAM1939 host target RNA into VGAM1939 host target protein, herein designated VGAM HOST TARGET PROTEIN. VGAM host target protein is therefore outlined by a broken line.

It is appreciated that VGAM1939 host target gene, herein designated VGAM HOST TARGET GENE, in fact represents a plurality of VGAM1939 host target genes. The mRNA of each one of this plurality of VGAM1939 host target genes comprises one or more host target binding sites, each having a nucleotide sequence which is at least partly complementary to VGAM1939 RNA, herein designated VGAM RNA, and which when bound by VGAM1939 RNA causes inhibition of translation of respective one or more VGAM1939 host target proteins.

It is further appreciated by one skilled in the art that the mode of translational inhibition illustrated by FIG. 1 with specific reference to translational inhibition exerted by VGAM1939 gene, herein designated VGAM GENE, on one or more VGAM1939 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1939 is inhibition of expression of host target genes, as part of a novel viral mechanism of attacking a host. Accordingly, utilities of VGAM1939 include diagnosis, prevention and treatment of viral infection by Measles Virus. Specific functions, and accordingly utilities, of VGAM1939 correlate with, and may be deduced from, the identity of the host target genes which VGAM1939 binds and inhibits, and the function of these host target genes, as elaborated hereinbelow.

Nucleotide sequences of the VGAM1939 precursor RNA, herein designated VGAM PRECURSOR RNA, and of the 'diced' VGAM1939 RNA, herein designated VGAM RNA, and a schematic representation of the secondary folding of VGAM1939 folded precursor RNA, herein designated VGAM FOLDED PRECURSOR RNA, of VGAM1939 are further described hereinbelow with reference to Table 1.

Nucleotide sequences of host target binding sites, such as BINDING SITE-I, BINDING SITE-II and BINDING SITE-III of FIG. 1, found on VGAM1939 host target RNA, and schematic representation of the complementarity of each of these host target binding sites to VGAM1939 RNA, herein designated VGAM RNA, are described hereinbelow with reference to Table 2.

As mentioned hereinabove with reference to FIG. 1, a function of VGAM1939 gene, herein designated VGAM is inhibition of expression of VGAM1939 target genes. It is appreciated that specific functions, and accordingly utilities, of VGAM1939 correlate with, and may be deduced from, the identity of the target genes which VGAM1939 binds and inhibits, and the function of these target genes, as elaborated hereinbelow.

Potassium Voltage-gated Channel, Shal-related Subfamily, Member 1 (KCND1, Accession NM_004979) is a VGAM1939 host target gene. KCND1 BINDING SITE is HOST TARGET binding site found in the 5' untranslated region of mRNA encoded by KCND1, corresponding to a HOST TARGET binding site such as BINDING SITE I, BINDING SITE II or BINDING SITE III. Table 2 illustrates the complementarity of the nucleotide sequences of KCND1 BINDING SITE, designated SEQ ID:11423, to the nucleotide sequence of VGAM1939 RNA, herein designated VGAM RNA, also designated SEQ ID:4650.

A function of VGAM1939 is therefore inhibition of Potassium Voltage-gated Channel, Shal-related Subfamily, Member 1 (KCND1, Accession NM_004979). Accordingly, utilities of VGAM1939 include diagnosis, prevention and treatment of diseases and clinical conditions associated with KCND1. LOC122553 (Accession XM_058630) is another VGAM1939 host target gene. LOC122553 BINDING SITE is HOST TARGET binding site found in the 3' untranslated region of mRNA encoded by LOC122553, corresponding to a HOST TARGET binding site such as BINDING SITE I, BINDING SITE II or BINDING SITE III. Table 2 illustrates the complementarity of the nucleotide sequences of LOC122553 BINDING SITE, designated SEQ ID:36686, to the nucleotide sequence of VGAM1939 RNA, herein designated VGAM RNA, also designated SEQ ID:4650.

Another function of VGAM1939 is therefore inhibition of LOC122553 (Accession XM_058630). Accordingly, utilities of VGAM1939 include diagnosis, prevention and treatment of diseases and clinical conditions associated with LOC122553. LOC157869 (Accession XM_088409) is another VGAM1939 host target gene. LOC157869 BINDING SITE is HOST TARGET binding site found in the 3' untranslated region of mRNA encoded by LOC157869, corresponding to a HOST TARGET binding site such as BINDING SITE I, BINDING SITE II or BINDING SITE III. Table 2 illustrates the complementarity of the nucleotide sequences of LOC157869 BINDING SITE, designated SEQ ID:39676, to the nucleotide sequence of VGAM1939 RNA, herein designated VGAM RNA, also designated SEQ ID:4650.

Another function of VGAM1939 is therefore inhibition of LOC157869 (Accession XM_088409). Accordingly, utilities of VGAM1939 include diagnosis, prevention and treatment of diseases and clinical conditions associated with LOC157869. FIG. 1 further provides a conceptual description of a novel bioinformatically detected viral gene of the present invention, referred to here as Viral Genomic Address Messenger 1940 (VGAM1940) viral gene, which modulates expression of respective host target genes thereof, the function and utility of which host target genes is known in the art.

VGAM1940 is a novel bioinformatically detected regulatory, non protein coding, viral micro RNA (miRNA) gene. The method by which VGAM1940 was detected is described hereinabove with reference to FIGS. 1-8.

VGAM1940 gene, herein designated VGAM GENE, is a viral gene contained in the genome of Variola Virus. VGAM1940 host target gene, herein designated VGAM HOST TARGET GENE, is a human gene contained in the human genome.

VGAM1940 gene encodes a VGAM1940 precursor RNA, herein designated VGAM PRECURSOR RNA. Similar to other miRNA genes, and unlike most ordinary genes, VGAM1940 precursor RNA does not encode a protein. A nucleotide sequence identical or highly similar to the nucleotide sequence of VGAM1940 precursor RNA is designated SEQ ID:1926, and is provided hereinbelow with reference to the sequence listing part. Nucleotide sequence SEQ ID:1926 is located at position 17783 relative to the genome of Variola Virus.

VGAM1940 precursor RNA folds onto itself, forming VGAM1940 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1940 folded precursor RNA into VGAM1940 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM1940 RNA is designated SEQ ID:4651, and is provided hereinbelow with reference to the sequence listing part.

VGAM1940 host target gene, herein designated VGAM HOST TARGET GENE, encodes a corresponding messenger RNA, VGAM1940 host target RNA, herein designated VGAM HOST TARGET RNA. VGAM1940 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1940 RNA, herein designated VGAM RNA, binds complementarily to one or more host target binding sites located in untranslated regions of VGAM1940 host target RNA, herein designated VGAM HOST TARGET RNA. This complementary binding is due to the fact that the nucleotide sequence of VGAM1940 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1940 RNA, herein designated VGAM RNA, may have a different number of host target binding sites in untranslated regions of a VGAM1940 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1940 RNA, herein designated VGAM RNA, to host target binding sites on VGAM1940 host target RNA, herein designated VGAM HOST TARGET RNA, such as BINDING SITE I, BINDING SITE II and BINDING SITE III, inhibits translation of VGAM1940 host target RNA into VGAM1940 host target protein, herein designated VGAM HOST TARGET PROTEIN. VGAM host target protein is therefore outlined by a broken line.

It is appreciated that VGAM1940 host target gene, herein designated VGAM HOST TARGET GENE, in fact represents a plurality of VGAM1940 host target genes. The mRNA of each one of this plurality of VGAM1940 host target genes comprises one or more host target binding sites, each having a nucleotide sequence which is at least partly complementary to VGAM1940 RNA, herein designated VGAM RNA, and which when bound by VGAM1940 RNA causes inhibition of translation of respective one or more VGAM1940 host target proteins.

It is further appreciated by one skilled in the art that the mode of translational inhibition illustrated by FIG. 1 with specific reference to translational inhibition exerted by VGAM1940 gene, herein designated VGAM GENE, on one or more VGAM1940 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1940 is inhibition of expression of host target genes, as part of a novel viral mechanism of attacking a host. Accordingly, utilities of VGAM1940 include diagnosis, prevention and treatment of viral infection by Variola Virus. Specific functions, and accordingly utilities, of VGAM1940 correlate with, and may be deduced from, the identity of the host target genes which VGAM1940 binds and inhibits, and the function of these host target genes, as elaborated hereinbelow.

Nucleotide sequences of the VGAM1940 precursor RNA, herein designated VGAM PRECURSOR RNA, and of the 'diced' VGAM1940 RNA, herein designated VGAM RNA, and a schematic representation of the secondary folding of VGAM1940 folded precursor RNA, herein designated VGAM FOLDED PRECURSOR RNA, of VGAM1940 are further described hereinbelow with reference to Table 1.

Nucleotide sequences of host target binding sites, such as BINDING SITE-I, BINDING SITE-II and BINDING SITE-III of FIG. 1, found on VGAM1940 host target RNA, and schematic representation of the complementarity of each of these host target binding sites to VGAM1940 RNA, herein designated VGAM RNA, are described hereinbelow with reference to Table 2.

As mentioned hereinabove with reference to FIG. 1, a function of VGAM1940 gene, herein designated VGAM is inhibition of expression of VGAM1940 target genes. It is appreciated that specific functions, and accordingly utilities, of VGAM1940 correlate with, and may be deduced from, the identity of the target genes which VGAM1940 binds and inhibits, and the function of these target genes, as elaborated hereinbelow.

C-type (calcium dependent, carbohydrate-recognition domain) Lectin, Superfamily Member 5 (CLECSF5, Accession NM_013252) is a VGAM1940 host target gene. CLECSF5 BINDING SITE is HOST TARGET binding site found in the 3' untranslated region of mRNA encoded by CLECSF5, corresponding to a HOST TARGET binding site such as BINDING SITE I, BINDING SITE II or BINDING SITE III. Table 2 illustrates the complementarity of the nucleotide sequences of CLECSF5 BINDING SITE, designated SEQ ID:14923, to the nucleotide sequence of VGAM1940 RNA, herein designated VGAM RNA, also designated SEQ ID:4651.

A function of VGAM1940 is therefore inhibition of C-type (calcium dependent, carbohydrate-recognition domain) Lectin, Superfamily Member 5 (CLECSF5, Accession NM_013252). Accordingly, utilities of VGAM1940 include diagnosis, prevention and treatment of diseases and clinical conditions associated with CLECSF5. Interleukin 21 Receptor (IL21R, Accession NM_021798) is another VGAM1940 host target gene. IL21R BINDING SITE is HOST TARGET binding site found in the 3' untranslated region of mRNA encoded by IL21R, corresponding to a HOST TARGET binding site such as BINDING SITE I, BINDING SITE II or BINDING SITE III. Table 2 illustrates the complementarity of the nucleotide sequences of IL21R BINDING SITE, designated SEQ ID:22354, to the nucleotide sequence of VGAM1940 RNA, herein designated VGAM RNA, also designated SEQ ID:4651.

Another function of VGAM1940 is therefore inhibition of Interleukin 21 Receptor (IL21R, Accession NM_021798), a gene which is involved in receptor mediated endocytosis and transduces the mitogenic signals of il-2. Accordingly, utilities of VGAM1940 include diagnosis, prevention and treatment of diseases and clinical conditions associated with IL21R. The function of IL21R has been established by previous studies. Type I cytokine receptors include receptors for hematopoietic growth factors as well as for many of the interleukins (e.g., IL2; 147680). Some type I receptors are capable of signaling through homodimerization. Others share a common beta chain or the common cytokine receptor gamma chain, gamma (c) (IL2RG; 308380), mutation of which results in X-linked severe combined immunodeficiency (300400 Ueda et al. (2002) found that the IL21R gene is the partner of BCL6 (OMIM Ref. No. 109565) in the t (3;16)(q27; p11) translocation. In 2 cases they found that the breakpoints on 16p11 were located within the 27-kb intron 1 of IL21R. As a result of t (3;16), the promoter region of IL21R was substituted for the regulatory sequences of BCL6 in the same transcriptional orientation. Fluorescence in situ chromosomal hybridization of lymphoma metaphase cells revealed fusion signals that contained both the BCL6 and IL21R sequences on the der (3) t (3;16) chromosome. To the list of nonimmunoglobulin partners of BCL6 translocations, this study added a new class of gene, i.e., cytokine receptor gene, the expression of which is closely associated with lymphoid cells Animal model experiments lend further support to the function of IL21R. Kasaian et al. (2002) generated Il21r-deficient mice by homologous recombination and deletion of exon 1. The mice had normal NK cell development and responses to poly I:C in vivo or IL15 in vitro, but not to IL21. In wildtype mice, IL21 limited the growth but not activation of NK cells, but not T cells, in response to IL15 or IL2 in antigen-free cultures. IL21 could boost the function of activated NK cells from these mice without promoting NK cell viability or preventing apoptosis. CD8 (see OMIM Ref. No. 186910)-positive T cells from either wildtype or Il21r -/- mice treated with IL15 proliferated and expressed high levels of CD44 (OMIM Ref. No. 107269), a marker for 'memory' T cells. Addition of IL21 counteracted the effects of IL15 in wildtype but not Il21r-deficient mice and also prevented the expansion of cells expressing the gamma-interferon (IFNG; 147570) receptor, CD119 (IFNGR1; 107470), as well as those expressing IL2RA (CD25; 147730) and IL2RB/IL15RB (CD122), but not IL2RG (CD132). IL21 enhanced proliferation and effector functions of wildtype cytolytic T cells stimulated with either anti-CD3 (see OMIM Ref. No. 186830) or allogeneic cells. Kasaian et al. (2002) proposed that IL21 promotes the transition between innate and adaptive immunity.

It is appreciated that the abovementioned animal model for IL21R is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ueda, C.; Akasaka, T.; Kurata, M.; Maesako, Y.; Nishikori, M.; Ichinohasama, R.; Imada, K.; Uchiyama, T.; Ohno, H.: The gene for interleukin-21 receptor is the partner of BCL6 in t (13;16)(q27; p11), which is recurrently observed in diffuse large B-cell lymphoma. Oncogene 21:368-376, 2002; and Kasaian, M. T.; Whitters, M. J.; Carter, L. L.; Lowe, L. D.; Jussif, J. M.; Deng, B.; Johnson, K. A.; Witek, J. S.; Senices, M.; Konz, R. F.; Wurster, A. L.; Donaldson, D. D.; Collins.

Further studies establishing the function and utilities of IL21R are found in John Hopkins OMIM database record ID 605383, and in sited publications numbered 9015, 4416-441 and 1383 listed in the bibliography section hereinbelow, which are also hereby incorporated by reference. Keratocan (KERA, Accession NM_007035) is another VGAM1940 host target gene. KERA BINDING SITE is HOST TARGET binding site found in the 3' untranslated region of mRNA encoded by KERA, corresponding to a HOST TARGET binding site such as BINDING SITE I, BINDING SITE II or BINDING SITE III. Table 2 illustrates the complementarity of the nucleotide sequences of KERA BINDING SITE, designated SEQ ID:13910, to the nucleotide sequence of VGAM1940 RNA, herein designated VGAM RNA, also designated SEQ ID:4651.

Another function of VGAM1940 is therefore inhibition of Keratocan (KERA, Accession NM_007035), a gene which may be important in developing and maintaining corneal transparency and for the structure of the stromal matrix. Accordingly, utilities of VGAM1940 include diagnosis, prevention and treatment of diseases and clinical conditions associated with KERA. The function of KERA and its association with various diseases and clinical conditions, has been established by previous studies, as described hereinabove with reference to VGAM723. V-yes-1 Yamaguchi Sarcoma Viral Oncogene Homolog 1 (YES1, Accession NM_005433) is another VGAM1940 host target gene. YES1 BINDING SITE is HOST TARGET binding site found in the 3' untranslated region of mRNA encoded by YES1, corresponding to a HOST TARGET binding site such as BINDING SITE I, BINDING SITE II or BINDING SITE III. Table 2 illustrates the complementarity of the nucleotide sequences of YES1 BINDING SITE, designated SEQ ID:11913, to the nucleotide sequence of VGAM1940 RNA, herein designated VGAM RNA, also designated SEQ ID:4651.

Another function of VGAM1940 is therefore inhibition of V-yes-1 Yamaguchi Sarcoma Viral Oncogene Homolog 1 (YES1, Accession NM_005433), a gene which is a putative protein-tyrosine kinase. Accordingly, utilities of VGAM1940 include diagnosis, prevention and treatment of diseases and clinical conditions associated with YES1. The function of YES1 and its association with various diseases and clinical conditions, has been established by previous studies, as described hereinabove with reference to VGAM74. LOC200059 (Accession XM_114104) is another VGAM1940 host target gene. LOC200059 BINDING SITE is HOST TARGET binding site found in the 3' untranslated region of mRNA encoded by LOC200059, corresponding to a HOST TARGET binding site such as BINDING SITE I, BINDING SITE II or BINDING SITE III. Table 2 illustrates the complementarity of the nucleotide sequences of LOC200059 BINDING SITE, designated SEQ ID:42700, to the nucleotide sequence of VGAM1940 RNA, herein designated VGAM RNA, also designated SEQ ID:4651.

Another function of VGAM1940 is therefore inhibition of LOC200059 (Accession XM_114104). Accordingly, utilities of VGAM1940 include diagnosis, prevention and treatment of diseases and clinical conditions associated with LOC200059. FIG. 1 further provides a conceptual description of a novel bioinformatically detected viral gene of the present invention, referred to here as Viral Genomic Address Messenger 1941 (VGAM1941) viral gene, which modulates expression of respective host target genes thereof, the function and utility of which host target genes is known in the art.

VGAM1941 is a novel bioinformatically detected regulatory, non protein coding, viral micro RNA (miRNA) gene. The method by which VGAM1941 was detected is described hereinabove with reference to FIGS. 1-8.

VGAM1941 gene, herein designated VGAM GENE, is a viral gene contained in the genome of Variola Virus. VGAM1941 host target gene, herein designated VGAM HOST TARGET GENE, is a human gene contained in the human genome.

VGAM1941 gene encodes a VGAM1941 precursor RNA, herein designated VGAM PRECURSOR RNA. Similar to other miRNA genes, and unlike most ordinary genes, VGAM1941 precursor RNA does not encode a protein. A nucleotide sequence identical or highly similar to the nucleotide sequence of VGAM1941 precursor RNA is designated SEQ ID:1927, and is provided hereinbelow with reference to the sequence listing part. Nucleotide sequence SEQ ID:1927 is located at position 17196 relative to the genome of Variola Virus.

VGAM1941 precursor RNA folds onto itself, forming VGAM1941 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1941 folded precursor RNA into VGAM1941 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1941 RNA is designated SEQ ID:4652, and is provided hereinbelow with reference to the sequence listing part.

VGAM1941 host target gene, herein designated VGAM HOST TARGET GENE, encodes a corresponding messenger RNA, VGAM1941 host target RNA, herein designated VGAM HOST TARGET RNA. VGAM1941 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1941 RNA, herein designated VGAM RNA, binds complementarily to one or more host target binding sites located in untranslated regions of VGAM1941 host target RNA, herein designated VGAM HOST TARGET RNA. This complementary binding is due to the fact that the nucleotide sequence of VGAM1941 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1941 RNA, herein designated VGAM RNA, may have a different number of host target binding sites in untranslated regions of a VGAM1941 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1941 RNA, herein designated VGAM RNA, to host target binding sites on VGAM1941 host target RNA, herein designated VGAM HOST TARGET RNA, such as BINDING SITE I, BINDING SITE II and BINDING SITE III, inhibits translation of VGAM1941 host target RNA into VGAM1941 host target protein, herein designated VGAM HOST TARGET PROTEIN. VGAM host target protein is therefore outlined by a broken line.

It is appreciated that VGAM1941 host target gene, herein designated VGAM HOST TARGET GENE, in fact represents a plurality of VGAM1941 host target genes. The mRNA of each one of this plurality of VGAM1941 host target genes comprises one or more host target binding sites, each having a nucleotide sequence which is at least partly complementary to VGAM1941 RNA, herein designated VGAM RNA, and which when bound by VGAM1941 RNA causes inhibition of translation of respective one or more VGAM1941 host target proteins.

It is further appreciated by one skilled in the art that the mode of translational inhibition illustrated by FIG. 1 with specific reference to translational inhibition exerted by VGAM1941 gene, herein designated VGAM GENE, on one or more VGAM1941 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1941 is inhibition of expression of host target genes, as part of a novel viral mechanism of attacking a host. Accordingly, utilities of VGAM1941 include diagnosis, prevention and treatment of viral infection by Variola Virus. Specific functions, and accordingly utilities, of VGAM1941 correlate with, and may be deduced from, the identity of the host target genes which VGAM1941 binds and inhibits, and the function of these host target genes, as elaborated hereinbelow.

Nucleotide sequences of the VGAM1941 precursor RNA, herein designated VGAM PRECURSOR RNA, and of the 'diced' VGAM1941 RNA, herein designated VGAM RNA, and a schematic representation of the secondary folding of VGAM1941 folded precursor RNA, herein designated VGAM FOLDED PRECURSOR RNA, of VGAM1941 are further described hereinbelow with reference to Table 1.

Nucleotide sequences of host target binding sites, such as BINDING SITE-I, BINDING SITE-II and BINDING SITE-III of FIG. 1, found on VGAM1941 host target RNA, and schematic representation of the complementarity of each of these host target binding sites to VGAM1941 RNA, herein designated VGAM RNA, are described hereinbelow with reference to Table 2.

As mentioned hereinabove with reference to FIG. 1, a function of VGAM1941 gene, herein designated VGAM is inhibition of expression of VGAM1941 target genes. It is appreciated that specific functions, and accordingly utilities, of VGAM1941 correlate with, and may be deduced from, the identity of the target genes which VGAM1941 binds and inhibits, and the function of these target genes, as elaborated hereinbelow.

Adenosine Deaminase, TRNA-specific 1 (ADAT1, Accession NM_012091) is a VGAM1941 host target gene. ADAT1 BINDING SITE is HOST TARGET binding site found in the 3' untranslated region of mRNA encoded by ADAT1, corresponding to a HOST TARGET binding site such as BINDING SITE I, BINDING SITE II or BINDING SITE III. Table 2 illustrates the complementarity of the nucleotide sequences of ADAT1 BINDING SITE, designated SEQ ID:14381, to the nucleotide sequence of VGAM1941 RNA, herein designated VGAM RNA, also designated SEQ ID:4652.

A function of VGAM1941 is therefore inhibition of Adenosine Deaminase, TRNA-specific 1 (ADAT1, Accession NM_012091), a gene which TRNA-specific adenosine deaminase; deaminates A(37) in the anticodon loop of tRNA (Ala). Accordingly, utilities of VGAM1941 include diagnosis, prevention and treatment of diseases and clinical conditions associated with ADAT1. The function of ADAT1 has been established by previous studies. The mammalian RNA-specific adenosine deaminases (ADARs; OMIM Ref. No. 601059) constitute a family of sequence-related proteins involved in pre-mRNA editing of nuclear transcripts through site-specific adenosine modification. Maas et al. (1999) identified and characterized a human ADAR-related protein that specifically deaminates adenosine-37 to inosine in eukaryotic tRNA(ala). They designated this predicted 502-amino acid protein 'adenosine deaminase acting on tRNA,' or ADAT1, and concluded that it probably represents the human counterpart of the yeast protein Tad1p. Southern blot analysis revealed that the ADAT1 enzyme is represented by a single gene. Northern blot analysis detected ADAT1 transcripts of approximately 5 and 6.5 kb in all human tissues, with highest expression levels in heart, brain, and pancreas. By radiation hybrid panel analysis, Maas et al. (2001) mapped the ADAT1 gene and the gene encoding lysyl tRNA synthetase (KARS; 601421) to 16q22.2-q22.3, with the gene for alanyl tRNA synthetase (AARS; 601065) positioned centromeric to the KARS and ADAT1 genes. They speculated that the clustering of 3 tRNA-specific genes, of which 2 are specific for tRNA (Ala), may indicate their evolutionary relatedness or common factors involved in regulating their expression.

Full details of the abovementioned studies are described in the following publications, the disclosure of which are hereby incorporated by reference:

Maas, S.; Gerber, A. P.; Rich, A.: Identification and characterization of a human tRNA-specific adenosine deaminase related to the ADAR family of pre-mRNA editing enzymes. Proc. Nat. Acad. Sci. 96:8895-8900, 1999; and Maas, S.; Kim, Y.-G.; Rich, A.: Genomic clustering of tRNA-specific adenosine deaminase ADAT1 and two tRNA synthetases. Mammalian Genome 12:387-393, 2001.

Further studies establishing the function and utilities of ADAT1 are found in John Hopkins OMIM database record ID 604230, and in sited publications numbered 519 and 7815 listed in the bibliography section hereinbelow, which are also hereby incorporated by reference. Nijmegen Breakage Syndrome 1 (nibrin) (NBS1, Accession XM_045343) is another VGAM1941 host target gene. NBS1 BINDING SITE is HOST TARGET binding site found in the 3' untranslated region of mRNA encoded by NBS1, corresponding to a HOST TARGET binding site such as BINDING SITE I, BINDING SITE II or BINDING SITE III. Table 2 illustrates the complementarity of the nucleotide sequences of NBS1 BINDING SITE, designated SEQ ID:34433, to the nucleotide sequence of VGAM1941 RNA, herein designated VGAM RNA, also designated SEQ ID:4652.

Another function of VGAM1941 is therefore inhibition of Nijmegen Breakage Syndrome 1 (nibrin) (NBS1, Accession XM_045343), a gene which may be involved in repair of DNA double-strand breaks. Accordingly, utilities of VGAM1941 include diagnosis, prevention and treatment of diseases and clinical conditions associated with NBS1. The function of NBS1 and its association with various diseases and clinical conditions, has been established by previous studies, as described hereinabove with reference to VGAM450. Nuclear Receptor Coactivator 3 (NCOA3, Accession NM_006534) is another VGAM1941 host target gene. NCOA3 BINDING SITE is HOST TARGET binding site found in the 5' untranslated region of mRNA encoded by NCOA3, corresponding to a HOST TARGET binding site such as BINDING SITE I, BINDING SITE II or BINDING SITE III. Table 2 illustrates the complementarity of the nucleotide sequences of NCOA3 BINDING SITE, designated SEQ ID:13285, to the nucleotide sequence of VGAM1941 RNA, herein designated VGAM RNA, also designated SEQ ID:4652.

Another function of VGAM1941 is therefore inhibition of Nuclear Receptor Coactivator 3 (NCOA3, Accession NM_006534), a gene which directly binds nuclear receptors and stimulates the transcriptional activities in hormone-dependent fashion. Accordingly, utilities of VGAM1941 include diagnosis, prevention and treatment of diseases and clinical conditions associated with NCOA3. The function of NCOA3 and its association with various diseases and clinical conditions, has been established by previous studies, as described hereinabove with reference to VGAM215. Protein Phosphatase 1, Regulatory (inhibitor) Subunit 2 (PPP1R2, Accession NM_006241) is another VGAM1941 host target gene. PPP1R2 BINDING SITE is HOST TARGET binding site found in the 3' untranslated region of mRNA encoded by PPP1R2, corresponding to a HOST TARGET binding site such as BINDING SITE I, BINDING SITE II or BINDING SITE III. Table 2 illustrates the complementarity of the nucleotide sequences of PPP1R2 BINDING SITE, designated SEQ ID:12906, to the nucleotide sequence of VGAM1941 RNA, herein designated VGAM RNA, also designated SEQ ID:4652.

Another function of VGAM1941 is therefore inhibition of Protein Phosphatase 1, Regulatory (inhibitor) Subunit 2 (PPP1R2, Accession NM_006241), a gene which suggests a housekeeping promoter structure. Accordingly, utilities of VGAM1941 include diagnosis, prevention and treatment of diseases and clinical conditions associated with PPP1R2. The function of PPP1R2 has been established by previous studies. Using a cosmid that contained the gene for phospholipase C-beta-3 (PLCB3; 600230), Lagercrantz et al. (1996) isolated and characterized a gene that they called PLCB3-neighboring gene (PNG). PLCB3 is located on 11q13. PNG had no striking similarity to other known genes at the DNA level, however, analysis of hybridization to a panel of somatic cell hybrids indicated the existence of related sequences on chromosomes 2, 4, 7, and 22. PNG showed expression of a 1-kb message in multiple tissues. The predicted protein is 119 amino acids long. The gene spans approximately 2.5 kb and is divided into 4 exons and 3 introns. It is located 4.4 kb upstream of PLCB3, with the 5-prime ends of each gene facing each other. The intragenic region showed separate CpG islands at each end separated by a stretch of 2 kb, characterized by periodic alteration of the GC content. A 5-prime flanking region of PNG did not contain TATA or CCAAT, suggesting to the authors a housekeeping promoter structure. Lagercrantz et al. (1996) described isolation and expression of the murine homolog. The predicted murine protein contains 203 amino acids Full details of the abovementioned studies are described in the following publications, the disclosure of which are hereby incorporated by reference:

Lagercrantz, J.; Carson, E.; Larsson, C.; Nordenskjold, M.; Weber, G.: Isolation and characterization of a novel gene close to the human phosphoinositide-specific phospholipase C beta-3 gene on chromosomal region 11q13. Genomics 31:380-384, 1996; and Lagercrantz, J.; Kedra, D.; Carson, E.; Nordenskjold, M.; Dumanski, J. P.; Weber, G.; Piehl, F.: Sequence and expression of the mouse homologue to human phospholipase C beta-3 neighbori.

Further studies establishing the function and utilities of PPP1R2 are found in John Hopkins OMIM database record ID 601792, and in sited publications numbered 5792-5799 listed in the bibliography section hereinbelow, which are also hereby incorporated by reference. Solute Carrier Family 10 (sodium/bile acid cotransporter family), Member 2 (SLC10A2, Accession NM_000452) is another VGAM1941 host target gene. SLC10A2 BINDING SITE1 and SLC10A2 BINDING SITE2 are HOST TARGET binding sites found in untranslated regions of mRNA encoded by SLC10A2, corresponding to HOST TARGET binding sites such as BINDING SITE I, BINDING SITE II or BINDING SITE III. Table 2 illustrates the complementarity of the nucleotide sequences of SLC10A2 BINDING SITE1 and SLC10A2 BINDING SITE2, designated SEQ ID:6062 and SEQ ID:6061 respectively, to the nucleotide sequence of VGAM1941 RNA, herein designated VGAM RNA, also designated SEQ ID:4652.

Another function of VGAM1941 is therefore inhibition of Solute Carrier Family 10 (sodium/bile acid cotransporter family), Member 2 (SLC10A2, Accession NM_000452). Accordingly, utilities of VGAM1941 include diagnosis, prevention and treatment of diseases and clinical conditions associated with SLC10A2. Zinc Finger Protein 141 (clone pHZ-44) (ZNF141, Accession NM_003441) is another VGAM1941 host target gene. ZNF141 BINDING SITE is HOST TARGET binding site found in the 3' untranslated region of mRNA encoded by ZNF141, corresponding to a HOST TARGET binding site such as BINDING SITE I, BINDING SITE II or BINDING SITE III. Table 2 illustrates the complementarity of the nucleotide sequences of ZNF141 BINDING SITE, designated SEQ ID:9498, to the nucleotide sequence of VGAM1941 RNA, herein designated VGAM RNA, also designated SEQ ID:4652.

Another function of VGAM1941 is therefore inhibition of Zinc Finger Protein 141 (clone pHZ-44) (ZNF141, Accession NM_003441). Accordingly, utilities of VGAM1941 include diagnosis, prevention and treatment of diseases and clinical conditions associated with ZNF141. Cellular Repressor of E1A-stimulated Genes (CREG, Accession NM_003851) is another VGAM1941 host target gene. CREG BINDING SITE is HOST TARGET binding site found in the 3' untranslated region of mRNA encoded by CREG, corresponding to a HOST TARGET binding site such as BINDING SITE I, BINDING SITE II or BINDING SITE III. Table 2 illustrates the complementarity of the nucleotide sequences of CREG BINDING SITE, designated SEQ ID:9946, to the nucleotide sequence of VGAM1941 RNA, herein designated VGAM RNA, also designated SEQ ID:4652.

Another function of VGAM1941 is therefore inhibition of Cellular Repressor of E1A-stimulated Genes (CREG, Accession NM_003851). Accordingly, utilities of VGAM1941 include diagnosis, prevention and treatment of diseases and clinical conditions associated with CREG. KIAA0349 (Accession XM_166449) is another VGAM1941 host target gene. KIAA0349 BINDING SITE is HOST TARGET binding site found in the 3' untranslated region of mRNA encoded by KIAA0349, corresponding to a HOST TARGET binding site such as BINDING SITE I, BINDING SITE II or BINDING SITE III. Table 2 illustrates the complementarity of the nucleotide sequences of KIAA0349 BINDING SITE, designated SEQ ID:44339, to the nucleotide sequence of VGAM1941 RNA, herein designated VGAM RNA, also designated SEQ ID:4652.

Another function of VGAM1941 is therefore inhibition of KIAA0349 (Accession XM_166449). Accordingly, utilities of VGAM1941 include diagnosis, prevention and treatment of diseases and clinical conditions associated with KIAA0349. LOC153743 (Accession XM_018216) is another VGAM1941 host target gene. LOC153743 BINDING SITE is HOST TARGET binding site found in the 3' untranslated region of mRNA encoded by LOC153743, corresponding to a HOST TARGET binding site such as BINDING SITE I, BINDING SITE II or BINDING SITE III. Table 2 illustrates the complementarity of the nucleotide sequences of LOC153743 BINDING SITE, designated SEQ ID:30348, to the nucleotide sequence of VGAM1941 RNA, herein designated VGAM RNA, also designated SEQ ID:4652.

Another function of VGAM1941 is therefore inhibition of LOC153743 (Accession XM_018216). Accordingly, utilities of VGAM1941 include diagnosis, prevention and treatment of diseases and clinical conditions associated with LOC153743. LOC200227 (Accession XM_114162) is another VGAM1941 host target gene. LOC200227 BINDING SITE is HOST TARGET binding site found in the 3' untranslated region of mRNA encoded by LOC200227, corresponding to a HOST TARGET binding site such as BINDING SITE I, BINDING SITE II or BINDING SITE III. Table 2 illustrates the complementarity of the nucleotide sequences of LOC200227 BINDING SITE, designated SEQ ID:42747, to the nucleotide sequence of VGAM1941 RNA, herein designated VGAM RNA, also designated SEQ ID:4652.

Another function of VGAM1941 is therefore inhibition of LOC200227 (Accession XM_114162). Accordingly, utilities of VGAM1941 include diagnosis, prevention and treatment of diseases and clinical conditions associated with LOC200227. FIG. 1 further provides a conceptual description of a novel bioinformatically detected viral gene of the present invention, referred to here as Viral Genomic Address Messenger 1942 (VGAM1942) viral gene, which modulates expression of respective host target genes thereof, the function and utility of which host target genes is known in the art.

VGAM1942 is a novel bioinformatically detected regulatory, non protein coding, viral micro RNA (miRNA) gene. The method by which VGAM1942 was detected is described hereinabove with reference to FIGS. 1-8.

VGAM1942 gene, herein designated VGAM GENE, is a viral gene contained in the genome of Variola Virus. VGAM1942 host target gene, herein designated VGAM HOST TARGET GENE, is a human gene contained in the human genome.

VGAM1942 gene encodes a VGAM1942 precursor RNA, herein designated VGAM PRECURSOR RNA. Similar to other miRNA genes, and unlike most ordinary genes, VGAM1942 precursor RNA does not encode a protein. A nucleotide sequence identical or highly similar to the nucleotide sequence of VGAM1942 precursor RNA is designated SEQ ID:1928, and is provided hereinbelow with reference to the sequence listing part. Nucleotide sequence SEQ ID:1928 is located at position 17313 relative to the genome of Variola Virus.

VGAM1942 precursor RNA folds onto itself, forming VGAM1942 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1942 folded precursor RNA into VGAM1942 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM1942 RNA is designated SEQ ID:4653, and is provided hereinbelow with reference to the sequence listing part.

VGAM1942 host target gene, herein designated VGAM HOST TARGET GENE, encodes a corresponding messenger RNA, VGAM1942 host target RNA, herein designated VGAM HOST TARGET RNA. VGAM1942 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1942 RNA, herein designated VGAM RNA, binds complementarily to one or more host target binding sites located in untranslated regions of VGAM1942 host target RNA, herein designated VGAM HOST TARGET RNA. This complementary binding is due to the fact that the nucleotide sequence of VGAM1942 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1942 RNA, herein designated VGAM RNA, may have a different number of host target binding sites in untranslated regions of a VGAM1942 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1942 RNA, herein designated VGAM RNA, to host target binding sites on VGAM1942 host target RNA, herein designated VGAM HOST TARGET RNA, such as BINDING SITE I, BINDING SITE II and BINDING SITE III, inhibits translation of VGAM1942 host target RNA into VGAM1942 host target protein, herein designated VGAM HOST TARGET PROTEIN. VGAM host target protein is therefore outlined by a broken line.

It is appreciated that VGAM1942 host target gene, herein designated VGAM HOST TARGET GENE, in fact represents a plurality of VGAM1942 host target genes. The mRNA of each one of this plurality of VGAM1942 host target genes comprises one or more host target binding sites, each having a nucleotide sequence which is at least partly complementary to VGAM1942 RNA, herein designated VGAM RNA, and which when bound by VGAM1942 RNA causes inhibition of translation of respective one or more VGAM1942 host target proteins.

It is further appreciated by one skilled in the art that the mode of translational inhibition illustrated by FIG. 1 with specific reference to translational inhibition exerted by VGAM1942 gene, herein designated VGAM GENE, on one or more VGAM1942 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1942 is inhibition of expression of host target genes, as part of a novel viral mechanism of attacking a host. Accordingly, utilities of VGAM1942 include diagnosis, prevention and treatment of viral infection by Variola Virus. Specific functions, and accordingly utilities, of VGAM1942 correlate with, and may be deduced from, the identity of the host target genes which VGAM1942 binds and inhibits, and the function of these host target genes, as elaborated hereinbelow.

Nucleotide sequences of the VGAM1942 precursor RNA, herein designated VGAM PRECURSOR RNA, and of the 'diced' VGAM1942 RNA, herein designated VGAM RNA, and a schematic representation of the secondary folding of VGAM1942 folded precursor RNA, herein designated VGAM FOLDED PRECURSOR RNA, of VGAM1942 are further described hereinbelow with reference to Table 1.

Nucleotide sequences of host target binding sites, such as BINDING SITE-I, BINDING SITE-II and BINDING SITE-III of FIG. 1, found on VGAM1942 host target RNA, and schematic representation of the complementarity of each of these host target binding sites to VGAM1942 RNA, herein designated VGAM RNA, are described hereinbelow with reference to Table 2.

As mentioned hereinabove with reference to FIG. 1, a function of VGAM1942 gene, herein designated VGAM is inhibition of expression of VGAM1942 target genes. It is appreciated that specific functions, and accordingly utilities, of VGAM1942 correlate with, and may be deduced from, the identity of the target genes which VGAM1942 binds and inhibits, and the function of these target genes, as elaborated hereinbelow.

Cyclin-dependent Kinase Inhibitor 1A (p21, Cip1) (CDKN1A, Accession NM_078467) is a VGAM1942 host target gene. CDKN1A BINDING SITE is HOST TARGET binding site found in the 3' untranslated region of mRNA encoded by CDKN1A, corresponding to a HOST TARGET binding site such as BINDING SITE I, BINDING SITE II or BINDING SITE III. Table 2 illustrates the complementarity of the nucleotide sequences of CDKN1A BINDING SITE, designated SEQ ID:27782, to the nucleotide sequence of VGAM1942 RNA, herein designated VGAM RNA, also designated SEQ ID:4653.

A function of VGAM1942 is therefore inhibition of Cyclin-dependent Kinase Inhibitor 1A (p21, Cip1) (CDKN1A, Accession NM_078467), a gene which inhibits cyclin-kinase activity and probably serves as the effector of p53 cell cycle control. Accordingly, utilities of VGAM1942 include diagnosis, prevention and treatment of diseases and clinical conditions associated with CDKN1A. The function of CDKN1A and its association with various diseases and clinical conditions, has been established by previous studies, as described hereinabove with reference to VGAM1912. Phosphatidylinositol-4-phosphate 5-kinase, Type I, Gamma (PIP5K1C, Accession XM_047620) is another VGAM1942 host target gene. PIP5K1C BINDING SITE is HOST TARGET binding site found in the 3' untranslated region of mRNA encoded by PIP5K1C, corresponding to a HOST TARGET binding site such as BINDING SITE I, BINDING SITE II or BINDING SITE III. Table 2 illustrates the complementarity of the nucleotide sequences of PIP5K1C BINDING SITE, designated SEQ ID:35014, to the nucleotide sequence of VGAM1942 RNA, herein designated VGAM RNA, also designated SEQ ID:4653.

Another function of VGAM1942 is therefore inhibition of Phosphatidylinositol-4-phosphate 5-kinase, Type I, Gamma (PIP5K1C, Accession XM_047620). Accordingly, utilities of VGAM1942 include diagnosis, prevention and treatment of diseases and clinical conditions associated with PIP5K1C. LOC253792 (Accession XM_173186) is another VGAM1942 host target gene. LOC253792 BINDING SITE is HOST TARGET binding site found in the 5' untranslated region of mRNA encoded by LOC253792, corresponding to a HOST TARGET binding site such as BINDING SITE I, BINDING SITE II or BINDING SITE III. Table 2 illustrates the complementarity of the nucleotide sequences of LOC253792 BINDING SITE, designated SEQ ID:46430, to the nucleotide sequence of VGAM1942 RNA, herein designated VGAM RNA, also designated SEQ ID:4653.

Another function of VGAM1942 is therefore inhibition of LOC253792 (Accession XM_173186). Accordingly, utilities of VGAM1942 include diagnosis, prevention and treatment of diseases and clinical conditions associated with LOC253792. FIG. 1 further provides a conceptual description of a novel bioinformatically detected viral gene of the present invention, referred to here as Viral Genomic Address Messenger 1943 (VGAM1943) viral gene, which modulates expression of respective host target genes thereof, the function and utility of which host target genes is known in the art.

VGAM1943 is a novel bioinformatically detected regulatory, non protein coding, viral micro RNA (miRNA) gene. The method by which VGAM1943 was detected is described hereinabove with reference to FIGS. 1-8.

VGAM1943 gene, herein designated VGAM GENE, is a viral gene contained in the genome of Variola Virus. VGAM1943 host target gene, herein designated VGAM HOST TARGET GENE, is a human gene contained in the human genome.

VGAM1943 gene encodes a VGAM1943 precursor RNA, herein designated VGAM PRECURSOR RNA. Similar to other miRNA genes, and unlike most ordinary genes, VGAM1943 precursor RNA does not encode a protein. A nucleotide sequence identical or highly similar to the nucleotide sequence of VGAM1943 precursor RNA is designated SEQ ID:1929, and is provided hereinbelow with reference to the sequence listing part. Nucleotide sequence SEQ ID:1929 is located at position 6220 relative to the genome of Variola Virus.

VGAM1943 precursor RNA folds onto itself, forming VGAM1943 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1943 folded precursor RNA into VGAM1943 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1943 RNA is designated SEQ ID:4654, and is provided hereinbelow with reference to the sequence listing part.

VGAM1943 host target gene, herein designated VGAM HOST TARGET GENE, encodes a corresponding messenger RNA, VGAM1943 host target RNA, herein designated VGAM HOST TARGET RNA. VGAM1943 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1943 RNA, herein designated VGAM RNA, binds complementarily to one or more host target binding sites located in untranslated regions of VGAM1943 host target RNA, herein designated VGAM HOST TARGET RNA. This complementary binding is due to the fact that the nucleotide sequence of VGAM1943 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1943 RNA, herein designated VGAM RNA, may have a different number of host target binding sites in untranslated regions of a VGAM1943 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1943 RNA, herein designated VGAM RNA, to host target binding sites on VGAM1943 host target RNA, herein designated VGAM HOST TARGET RNA, such as BINDING SITE I, BINDING SITE II and BINDING SITE III, inhibits translation of VGAM1943 host target RNA into VGAM1943 host target protein, herein designated VGAM HOST TARGET PROTEIN. VGAM host target protein is therefore outlined by a broken line.

It is appreciated that VGAM1943 host target gene, herein designated VGAM HOST TARGET GENE, in fact represents a plurality of VGAM1943 host target genes. The mRNA of each one of this plurality of VGAM1943 host target genes comprises one or more host target binding sites, each having a nucleotide sequence which is at least partly complementary to VGAM1943 RNA, herein designated VGAM RNA, and which when bound by VGAM1943 RNA causes inhibition of translation of respective one or more VGAM1943 host target proteins.

It is further appreciated by one skilled in the art that the mode of translational inhibition illustrated by FIG. 1 with specific reference to translational inhibition exerted by VGAM1943 gene, herein designated VGAM GENE, on one or more VGAM1943 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1943 is inhibition of expression of host target genes, as part of a novel viral mechanism of attacking a host. Accordingly, utilities of VGAM1943 include diagnosis, prevention and treatment of viral infection by Variola Virus. Specific functions, and accordingly utilities, of VGAM1943 correlate with, and may be deduced from, the identity of the host target genes which VGAM1943 binds and inhibits, and the function of these host target genes, as elaborated hereinbelow.

Nucleotide sequences of the VGAM1943 precursor RNA, herein designated VGAM PRECURSOR RNA, and of the 'diced' VGAM1943 RNA, herein designated VGAM RNA, and a schematic representation of the secondary folding of VGAM1943 folded precursor RNA, herein designated VGAM FOLDED PRECURSOR RNA, of VGAM1943 are further described hereinbelow with reference to Table 1.

Nucleotide sequences of host target binding sites, such as BINDING SITE-I, BINDING SITE-II and BINDING SITE-III of FIG. 1, found on VGAM1943 host target RNA, and schematic representation of the complementarity of each of these host target binding sites to VGAM1943 RNA, herein designated VGAM RNA, are described hereinbelow with reference to Table 2.

As mentioned hereinabove with reference to FIG. 1, a function of VGAM1943 gene, herein designated VGAM is inhibition of expression of VGAM1943 target genes. It is appreciated that specific functions, and accordingly utilities, of VGAM1943 correlate with, and may be deduced from, the identity of the target genes which VGAM1943 binds and inhibits, and the function of these target genes, as elaborated hereinbelow.

Protein Kinase, CAMP-dependent, Regulatory, Type II, Beta (PRKAR2B, Accession NM_002736) is a VGAM1943 host target gene. PRKAR2B BINDING SITE is HOST TARGET binding site found in the 3' untranslated region of mRNA encoded by PRKAR2B, corresponding to a HOST TARGET binding site such as BINDING SITE I, BINDING SITE II or BINDING SITE III. Table 2 illustrates the complementarity of the nucleotide sequences of PRKAR2B BINDING SITE, designated SEQ ID:8610, to the nucleotide sequence of VGAM1943 RNA, herein designated VGAM RNA, also designated SEQ ID:4654.

A function of VGAM1943 is therefore inhibition of Protein Kinase, CAMP-dependent, Regulatory, Type II, Beta (PRKAR2B, Accession NM_002736), a gene which type ii regulatory chains mediate membrane association by binding to anchoring proteins, including the map2 kinase. Accordingly, utilities of VGAM1943 include diagnosis, prevention and treatment of diseases and clinical conditions associated with PRKAR2B. The function of PRKAR2B and its association with various diseases and clinical conditions, has been established by previous studies, as described hereinabove with reference to VGAM120. FIG. 1 further provides a conceptual description of a novel bioinformatically detected viral gene of the present invention, referred to here as Viral Genomic Address Messenger 1944 (VGAM1944) viral gene, which modulates expression of respective host target genes thereof, the function and utility of which host target genes is known in the art.

VGAM1944 is a novel bioinformatically detected regulatory, non protein coding, viral micro RNA (miRNA) gene. The method by which VGAM1944 was detected is described hereinabove with reference to FIGS. 1-8.

VGAM1944 gene, herein designated VGAM GENE, is a viral gene contained in the genome of Variola Virus. VGAM1944 host target gene, herein designated VGAM HOST TARGET GENE, is a human gene contained in the human genome.

VGAM1944 gene encodes a VGAM1944 precursor RNA, herein designated VGAM PRECURSOR RNA. Similar to other miRNA genes, and unlike most ordinary genes, VGAM1944 precursor RNA does not encode a protein. A nucleotide sequence identical or highly similar to the nucleotide sequence of VGAM1944 precursor RNA is designated SEQ ID:1930, and is provided hereinbelow with reference to the sequence listing part. Nucleotide sequence SEQ ID:1930 is located at position 4789 relative to the genome of Variola Virus.

VGAM1944 precursor RNA folds onto itself, forming VGAM1944 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1944 folded precursor RNA into VGAM1944 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1944 RNA is designated SEQ ID:4655, and is provided hereinbelow with reference to the sequence listing part.

VGAM1944 host target gene, herein designated VGAM HOST TARGET GENE, encodes a corresponding messenger RNA, VGAM1944 host target RNA, herein designated VGAM HOST TARGET RNA. VGAM1944 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1944 RNA, herein designated VGAM RNA, binds complementarily to one or more host target binding sites located in untranslated regions of VGAM1944 host target RNA, herein designated VGAM HOST TARGET RNA. This complementary binding is due to the fact that the nucleotide sequence of VGAM1944 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1944 RNA, herein designated VGAM RNA, may have a different number of host target binding sites in untranslated regions of a VGAM1944 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1944 RNA, herein designated VGAM RNA, to host target binding sites on VGAM1944 host target RNA, herein designated VGAM HOST TARGET RNA, such as BINDING SITE I, BINDING SITE II and BINDING SITE III, inhibits translation of VGAM1944 host target RNA into VGAM1944 host target protein, herein designated VGAM HOST TARGET PROTEIN. VGAM host target protein is therefore outlined by a broken line.

It is appreciated that VGAM1944 host target gene, herein designated VGAM HOST TARGET GENE, in fact represents a plurality of VGAM1944 host target genes. The mRNA of each one of this plurality of VGAM1944 host target genes comprises one or more host target binding sites, each having a nucleotide sequence which is at least partly complementary to VGAM1944 RNA, herein designated VGAM RNA, and which when bound by VGAM1944 RNA causes inhibition of translation of respective one or more VGAM1944 host target proteins.

It is further appreciated by one skilled in the art that the mode of translational inhibition illustrated by FIG. 1 with specific reference to translational inhibition exerted by VGAM1944 gene, herein designated VGAM GENE, on one or more VGAM1944 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1944 is inhibition of expression of host target genes, as part of a novel viral mechanism of attacking a host. Accordingly, utilities of VGAM1944 include diagnosis, prevention and treatment of viral infection by Variola Virus. Specific functions, and accordingly utilities, of VGAM1944 correlate with, and may be deduced from, the identity of the host target genes which VGAM1944 binds and inhibits, and the function of these host target genes, as elaborated hereinbelow.

Nucleotide sequences of the VGAM1944 precursor RNA, herein designated VGAM PRECURSOR RNA, and of the 'diced' VGAM1944 RNA, herein designated VGAM RNA, and a schematic representation of the secondary folding of VGAM1944 folded precursor RNA, herein designated VGAM FOLDED PRECURSOR RNA, of VGAM1944 are further described hereinbelow with reference to Table 1.

Nucleotide sequences of host target binding sites, such as BINDING SITE-I, BINDING SITE-II and BINDING SITE-III of FIG. 1, found on VGAM1944 host target RNA, and schematic representation of the complementarity of each of these host target binding sites to VGAM1944 RNA, herein designated VGAM RNA, are described hereinbelow with reference to Table 2.

As mentioned hereinabove with reference to FIG. 1, a function of VGAM1944 gene, herein designated VGAM is inhibition of expression of VGAM1944 target genes. It is appreciated that specific functions, and accordingly utilities, of VGAM1944 correlate with, and may be deduced from, the identity of the target genes which VGAM1944 binds and inhibits, and the function of these target genes, as elaborated hereinbelow.

Osteoglycin (osteoinductive factor, mimecan) (OGN, Accession NM_014057) is a VGAM1944 host target gene. OGN BINDING SITE1 through OGN BINDING SITE3 are HOST TARGET binding sites found in untranslated regions of mRNA encoded by OGN, corresponding to HOST TARGET binding sites such as BINDING SITE I, BINDING SITE II or BINDING SITE III. Table 2 illustrates the complementarity of the nucleotide sequences of OGN BINDING SITE1 through OGN BINDING SITE3, designated SEQ ID:15276, SEQ ID:23656 and SEQ ID:26900 respectively, to the nucleotide sequence of VGAM1944 RNA, herein designated VGAM RNA, also designated SEQ ID:4655.

A function of VGAM1944 is therefore inhibition of Osteoglycin (osteoinductive factor, mimecan) (OGN, Accession NM_014057), a gene which induces ectopic bone formation in conjunction with transforming growth factor beta. Accordingly, utilities of VGAM1944 include diagnosis, prevention and treatment of diseases and clinical conditions associated with OGN. The function of OGN and its association with various diseases and clinical conditions, has been established by previous studies, as described hereinabove with reference to VGAM346. CCR4-NOT Transcription Complex, Subunit 7 (CNOT7, Accession NM_013354) is another VGAM1944 host target gene. CNOT7 BINDING SITE1 and CNOT7 BINDING SITE2 are HOST TARGET binding sites found in untranslated regions of mRNA encoded by CNOT7, corresponding to HOST TARGET binding sites such as BINDING SITE I, BINDING SITE II or BINDING SITE III. Table 2 illustrates the complementarity of the nucleotide sequences of CNOT7 BINDING SITE1 and CNOT7 BINDING SITE2, designated SEQ ID:15001 and SEQ ID:13526 respectively, to the nucleotide sequence of VGAM1944 RNA, herein designated VGAM RNA, also designated SEQ ID:4655.

Another function of VGAM1944 is therefore inhibition of CCR4-NOT Transcription Complex, Subunit 7 (CNOT7, Accession NM_013354). Accordingly, utilities of VGAM1944 include diagnosis, prevention and treatment of diseases and clinical conditions associated with CNOT7. FLJ13769 (Accession NM_025012) is another VGAM1944 host target gene. FLJ13769 BINDING SITE is HOST TARGET binding site found in the 3' untranslated region of mRNA encoded by FLJ13769, corresponding to a HOST TARGET binding site such as BINDING SITE I, BINDING SITE II or BINDING SITE III. Table 2 illustrates the complementarity of the nucleotide sequences of FLJ13769 BINDING SITE, designated SEQ ID:24597, to the nucleotide sequence of VGAM1944 RNA, herein designated VGAM RNA, also designated SEQ ID:4655.

Another function of VGAM1944 is therefore inhibition of FLJ13769 (Accession NM_025012). Accordingly, utilities of VGAM1944 include diagnosis, prevention and treatment of diseases and clinical conditions associated with FLJ13769. KIAA0750 (Accession NM_014632) is another VGAM1944 host target gene. KIAA0750 BINDING SITE is HOST TARGET binding site found in the 5' untranslated region of mRNA encoded by KIAA0750, corresponding to a HOST TARGET binding site such as BINDING SITE I, BINDING SITE II or BINDING SITE III. Table 2 illustrates the complementarity of the nucleotide sequences of KIAA0750 BINDING SITE, designated SEQ ID:16000, to the nucleotide sequence of VGAM1944 RNA, herein designated VGAM RNA, also designated SEQ ID:4655.

Another function of VGAM1944 is therefore inhibition of KIAA0750 (Accession NM_014632). Accordingly, utilities of VGAM1944 include diagnosis, prevention and treatment of diseases and clinical conditions associated with KIAA0750. Sp2 Transcription Factor (SP2, Accession NM_003110) is another VGAM1944 host target gene. SP2 BINDING SITE is HOST TARGET binding site found in the 3' untranslated region of mRNA encoded by SP2, corresponding to a HOST TARGET binding site such as BINDING SITE I, BINDING SITE II or BINDING SITE III. Table 2 illustrates the complementarity of the nucleotide sequences of SP2 BINDING SITE, designated SEQ ID:9079, to the nucleotide sequence of VGAM1944 RNA, herein designated VGAM RNA, also designated SEQ ID:4655.

Another function of VGAM1944 is therefore inhibition of Sp2 Transcription Factor (SP2, Accession NM_003110). Accordingly, utilities of VGAM1944 include diagnosis, prevention and treatment of diseases and clinical conditions associated with SP2. LOC120772 (Accession XM_058505) is another VGAM1944 host target gene. LOC120772 BINDING SITE is HOST TARGET binding site found in the 5' untranslated region of mRNA encoded by LOC120772, corresponding to a HOST TARGET binding site such as BINDING SITE I, BINDING SITE II or BINDING SITE III. Table 2 illustrates the complementarity of the nucleotide sequences of LOC120772 BINDING SITE, designated SEQ ID:36627, to the nucleotide sequence of VGAM1944 RNA, herein designated VGAM RNA, also designated SEQ ID:4655.

Another function of VGAM1944 is therefore inhibition of LOC120772 (Accession XM_058505). Accordingly, utilities of VGAM1944 include diagnosis, prevention and treatment of diseases and clinical conditions associated with LOC120772. LOC147929 (Accession XM_085961) is another VGAM1944 host target gene. LOC147929 BINDING SITE is HOST TARGET binding site found in the 5' untranslated region of mRNA encoded by LOC147929, corresponding to a HOST TARGET binding site such as BINDING SITE I, BINDING SITE II or BINDING SITE III. Table 2 illustrates the complementarity of the nucleotide sequences of LOC147929 BINDING SITE, designated SEQ ID:38419, to the nucleotide sequence of VGAM1944 RNA, herein designated VGAM RNA, also designated SEQ ID:4655.

Another function of VGAM1944 is therefore inhibition of LOC147929 (Accession XM_085961). Accordingly, utilities of VGAM1944 include diagnosis, prevention and treatment of diseases and clinical conditions associated with LOC147929. LOC256867 (Accession XM_170694) is another VGAM1944 host target gene. LOC256867 BINDING SITE is HOST TARGET binding site found in the 5' untranslated region of mRNA encoded by LOC256867, corresponding to a HOST TARGET binding site such as BINDING SITE I, BINDING SITE II or BINDING SITE III. Table 2 illustrates the complementarity of the nucleotide sequences of LOC256867 BINDING SITE, designated SEQ ID:45470, to the nucleotide sequence of VGAM1944 RNA, herein designated VGAM RNA, also designated SEQ ID:4655.

Another function of VGAM1944 is therefore inhibition of LOC256867 (Accession XM_170694). Accordingly, utilities of VGAM1944 include diagnosis, prevention and treatment of diseases and clinical conditions associated with LOC256867. FIG. 1 further provides a conceptual description of a novel bioinformatically detected viral gene of the present invention, referred to here as Viral Genomic Address Messenger 1945 (VGAM1945) viral gene, which modulates expression of respective host target genes thereof, the function and utility of which host target genes is known in the art.

VGAM1945 is a novel bioinformatically detected regulatory, non protein coding, viral micro RNA (miRNA) gene. The method by which VGAM1945 was detected is described hereinabove with reference to FIGS. 1-8.

VGAM1945 gene, herein designated VGAM GENE, is a viral gene contained in the genome of Variola Virus. VGAM1945 host target gene, herein designated VGAM HOST TARGET GENE, is a human gene contained in the human genome.

VGAM1945 gene encodes a VGAM1945 precursor RNA, herein designated VGAM PRECURSOR RNA. Similar to other miRNA genes, and unlike most ordinary genes, VGAM1945 precursor RNA does not encode a protein. A nucleotide sequence identical or highly similar to the nucleotide sequence of VGAM1945 precursor RNA is designated SEQ ID:1931, and is provided hereinbelow with reference to the sequence listing part. Nucleotide sequence SEQ ID:1931 is located at position 7746 relative to the genome of Variola Virus.

VGAM1945 precursor RNA folds onto itself, forming VGAM1945 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1945 folded precursor RNA into VGAM1945 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1945 RNA is designated SEQ ID:4656, and is provided hereinbelow with reference to the sequence listing part.

VGAM1945 host target gene, herein designated VGAM HOST TARGET GENE, encodes a corresponding messenger RNA, VGAM1945 host target RNA, herein designated VGAM HOST TARGET RNA. VGAM1945 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1945 RNA, herein designated VGAM RNA, binds complementarily to one or more host target binding sites located in untranslated regions of VGAM1945 host target RNA, herein designated VGAM HOST TARGET RNA. This complementary binding is due to the fact that the nucleotide sequence of VGAM1945 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1945 RNA, herein designated VGAM RNA, may have a different number of host target binding sites in untranslated regions of a VGAM1945 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1945 RNA, herein designated VGAM RNA, to host target binding sites on VGAM1945 host target RNA, herein designated VGAM HOST TARGET RNA, such as BINDING SITE I, BINDING SITE II and BINDING SITE III, inhibits translation of VGAM1945 host target RNA into VGAM1945 host target protein, herein designated VGAM HOST TARGET PROTEIN. VGAM host target protein is therefore outlined by a broken line.

It is appreciated that VGAM1945 host target gene, herein designated VGAM HOST TARGET GENE, in fact represents a plurality of VGAM1945 host target genes. The mRNA of each one of this plurality of VGAM1945 host target genes comprises one or more host target binding sites, each having a nucleotide sequence which is at least partly complementary to VGAM1945 RNA, herein designated VGAM RNA, and which when bound by VGAM1945 RNA causes inhibition of translation of respective one or more VGAM1945 host target proteins.

It is further appreciated by one skilled in the art that the mode of translational inhibition illustrated by FIG. 1 with specific reference to translational inhibition exerted by VGAM1945 gene, herein designated VGAM GENE, on one or more VGAM1945 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1945 is inhibition of expression of host target genes, as part of a novel viral mechanism of attacking a host. Accordingly, utilities of VGAM1945 include diagnosis, prevention and treatment of viral infection by Variola Virus. Specific functions, and accordingly utilities, of VGAM1945 correlate with, and may be deduced from, the identity of the host target genes which VGAM1945 binds and inhibits, and the function of these host target genes, as elaborated hereinbelow.

Nucleotide sequences of the VGAM1945 precursor RNA, herein designated VGAM PRECURSOR RNA, and of the 'diced' VGAM1945 RNA, herein designated VGAM RNA, and a schematic representation of the secondary folding of VGAM1945 folded precursor RNA, herein designated VGAM FOLDED PRECURSOR RNA, of VGAM1945 are further described hereinbelow with reference to Table 1.

Nucleotide sequences of host target binding sites, such as BINDING SITE-I, BINDING SITE-II and BINDING SITE-III of FIG. 1, found on VGAM1945 host target RNA, and schematic representation of the complementarity of each of these host target binding sites to VGAM1945 RNA, herein designated VGAM RNA, are described hereinbelow with reference to Table 2.

As mentioned hereinabove with reference to FIG. 1, a function of VGAM1945 gene, herein designated VGAM is inhibition of expression of VGAM1945 target genes. It is appreciated that specific functions, and accordingly utilities, of VGAM1945 correlate with, and may be deduced from, the identity of the target genes which VGAM1945 binds and inhibits, and the function of these target genes, as elaborated hereinbelow.

Retinitis Pigmentosa 2 (X-linked recessive) (RP2, Accession NM_006915) is a VGAM1945 host target gene. RP2 BINDING SITE is HOST TARGET binding site found in the 3' untranslated region of mRNA encoded by RP2, corresponding to a HOST TARGET binding site such as BINDING SITE I, BINDING SITE II or BINDING SITE III. Table 2 illustrates the complementarity of the nucleotide sequences of RP2 BINDING SITE, designated SEQ ID:13790, to the nucleotide sequence of VGAM1945 RNA, herein designated VGAM RNA, also designated SEQ ID:4656.

A function of VGAM1945 is therefore inhibition of Retinitis Pigmentosa 2 (X-linked recessive) (RP2, Accession NM_006915). Accordingly, utilities of VGAM1945 include diagnosis, prevention and treatment of diseases and clinical conditions associated with RP2. caspr5 (Accession NM_130773) is another VGAM1945 host target gene. caspr5 BINDING SITE is HOST TARGET binding site found in the 3' untranslated region of mRNA encoded by caspr5, corresponding to a HOST TARGET binding site such as BINDING SITE I, BINDING SITE II or BINDING SITE III. Table 2 illustrates the complementarity of the nucleotide sequences of caspr5 BINDING SITE, designated SEQ ID:28267, to the nucleotide sequence of VGAM1945 RNA, herein designated VGAM RNA, also designated SEQ ID:4656.

Another function of VGAM1945 is therefore inhibition of caspr5 (Accession NM_130773). Accordingly, utilities of VGAM1945 include diagnosis, prevention and treatment of diseases and clinical conditions associated with caspr5. FLJ11252 (Accession XM_041702) is another VGAM1945 host target gene. FLJ11252 BINDING SITE is HOST TARGET binding site found in the 3' untranslated region of mRNA encoded by FLJ11252, corresponding to a HOST TARGET binding site such as BINDING SITE I, BINDING SITE II or BINDING SITE III. Table 2 illustrates the complementarity of the nucleotide sequences of FLJ11252 BINDING SITE, designated SEQ ID:33566, to the nucleotide sequence of VGAM1945 RNA, herein designated VGAM RNA, also designated SEQ ID:4656.

Another function of VGAM1945 is therefore inhibition of FLJ11252 (Accession XM_041702). Accordingly, utilities of VGAM1945 include diagnosis, prevention and treatment of diseases and clinical conditions associated with FLJ11252. FIG. 1 further provides a conceptual description of a novel bioinformatically detected viral gene of the present invention, referred to here as Viral Genomic Address Messenger 1946 (VGAM1946) viral gene, which modulates expression of respective host target genes thereof, the function and utility of which host target genes is known in the art.

VGAM1946 is a novel bioinformatically detected regulatory, non protein coding, viral micro RNA (miRNA) gene. The method by which VGAM1946 was detected is described hereinabove with reference to FIGS. 1-8.

VGAM1946 gene, herein designated VGAM GENE, is a viral gene contained in the genome of Variola Virus. VGAM1946 host target gene, herein designated VGAM HOST TARGET GENE, is a human gene contained in the human genome.

VGAM1946 gene encodes a VGAM1946 precursor RNA, herein designated VGAM PRECURSOR RNA. Similar to other miRNA genes, and unlike most ordinary genes, VGAM1946 precursor RNA does not encode a protein. A nucleotide sequence identical or highly similar to the nucleotide sequence of VGAM1946 precursor RNA is designated SEQ ID:1932, and is provided hereinbelow with reference to the sequence listing part. Nucleotide sequence SEQ ID:1932 is located at position 11538 relative to the genome of Variola Virus.

VGAM1946 precursor RNA folds onto itself, forming VGAM1946 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1946 folded precursor RNA into VGAM1946 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1946 RNA is designated SEQ ID:4657, and is provided hereinbelow with reference to the sequence listing part.

VGAM1946 host target gene, herein designated VGAM HOST TARGET GENE, encodes a corresponding messenger RNA, VGAM1946 host target RNA, herein designated VGAM HOST TARGET RNA. VGAM1946 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1946 RNA, herein designated VGAM RNA, binds complementarily to one or more host target binding sites located in untranslated regions of VGAM1946 host target RNA, herein designated VGAM HOST TARGET RNA. This complementary binding is due to the fact that the nucleotide sequence of VGAM1946 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1946 RNA, herein designated VGAM RNA, may have a different number of host target binding sites in untranslated regions of a VGAM1946 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1946 RNA, herein designated VGAM RNA, to host target binding sites on VGAM1946 host target RNA, herein designated VGAM HOST TARGET RNA, such as BINDING SITE I, BINDING SITE II and BINDING SITE III, inhibits translation of VGAM1946 host target RNA into VGAM1946 host target protein, herein designated VGAM HOST TARGET PROTEIN. VGAM host target protein is therefore outlined by a broken line.

It is appreciated that VGAM1946 host target gene, herein designated VGAM HOST TARGET GENE, in fact represents a plurality of VGAM1946 host target genes. The mRNA of each one of this plurality of VGAM1946 host target genes comprises one or more host target binding sites, each having a nucleotide sequence which is at least partly complementary to VGAM1946 RNA, herein designated VGAM RNA, and which when bound by VGAM1946 RNA causes inhibition of translation of respective one or more VGAM1946 host target proteins.

It is further appreciated by one skilled in the art that the mode of translational inhibition illustrated by FIG. 1 with specific reference to translational inhibition exerted by VGAM1946 gene, herein designated VGAM GENE, on one or more VGAM1946 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1946 is inhibition of expression of host target genes, as part of a novel viral mechanism of attacking a host. Accordingly, utilities of VGAM1946 include diagnosis, prevention and treatment of viral infection by Variola Virus. Specific functions, and accordingly utilities, of VGAM1946 correlate with, and may be deduced from, the identity of the host target genes which VGAM1946 binds and inhibits, and the function of these host target genes, as elaborated hereinbelow.

Nucleotide sequences of the VGAM1946 precursor RNA, herein designated VGAM PRECURSOR RNA, and of the 'diced' VGAM1946 RNA, herein designated VGAM RNA, and a schematic representation of the secondary folding of VGAM1946 folded precursor RNA, herein designated VGAM FOLDED PRECURSOR RNA, of VGAM1946 are further described hereinbelow with reference to Table 1.

Nucleotide sequences of host target binding sites, such as BINDING SITE-I, BINDING SITE-II and BINDING SITE-III of FIG. 1, found on VGAM1946 host target RNA, and schematic representation of the complementarity of each of these host target binding sites to VGAM1946 RNA, herein designated VGAM RNA, are described hereinbelow with reference to Table 2.

As mentioned hereinabove with reference to FIG. 1, a function of VGAM1946 gene, herein designated VGAM is inhibition of expression of VGAM1946 target genes. It is appreciated that specific functions, and accordingly utilities, of VGAM1946 correlate with, and may be deduced from, the identity of the target genes which VGAM1946 binds and inhibits, and the function of these target genes, as elaborated hereinbelow.

Angiotensin II Receptor, Type 1 (AGTR1, Accession NM_000685) is a VGAM1946 host target gene. AGTR1 BINDING SITE1 through AGTR1 BINDING SITE5 are HOST TARGET binding sites found in untranslated regions of mRNA encoded by AGTR1, corresponding to HOST TARGET binding sites such as BINDING SITE I, BINDING SITE II or BINDING SITE III. Table 2 illustrates the complementarity of the nucleotide sequences of AGTR1 BINDING SITE1 through AGTR1 BINDING SITE5, designated SEQ ID:6343, SEQ ID:11244, SEQ ID:14310, SEQ ID:25595 and SEQ ID:25770 respectively, to the nucleotide sequence of VGAM1946 RNA, herein designated VGAM RNA, also designated SEQ ID:4657.

A function of VGAM1946 is therefore inhibition of Angiotensin II Receptor, Type 1 (AGTR1, Accession NM_000685), a gene which is an important effector controlling blood pressure and volume in the cardiovascular system. Accordingly, utilities of VGAM1946 include diagnosis, prevention and treatment of diseases and clinical conditions associated with AGTR1. The function of AGTR1 and its association with various diseases and clinical conditions, has been established by previous studies, as described hereinabove with reference to VGAM96. Hepatocyte Growth Factor (hepapoietin A; scatter factor) (HGF, Accession XM_168542) is another VGAM1946 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45231, to the nucleotide sequence of VGAM1946 RNA, herein designated VGAM RNA, also designated SEQ ID:4657.

Another function of VGAM1946 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM1946 include diagnosis, prevention and treatment of diseases and clinical conditions associated with HGF. The function of HGF and its association with various diseases and clinical conditions, has been established by previous studies, as described hereinabove with reference to VGAM174. MAP-kinase Activating Death Domain (MADD, Accession NM_130471) is another VGAM1946 host target gene. MADD BINDING SITE1 through MADD BINDING SITE6 are HOST TARGET binding sites found in untranslated regions of mRNA encoded by MADD, corresponding to HOST TARGET binding sites such as BINDING SITE I, BINDING SITE II or BINDING SITE III. Table 2 illustrates the complementarity of the nucleotide sequences of MADD BINDING SITE1 through MADD BINDING SITE6, designated SEQ ID:28241, SEQ ID:28246, SEQ ID:28251, SEQ ID:28256, SEQ ID:9786 and SEQ ID:28235 respectively, to the nucleotide sequence of VGAM1946 RNA, herein designated VGAM RNA, also designated SEQ ID:4657.

Another function of VGAM1946 is therefore inhibition of MAP-kinase Activating Death Domain (MADD, Accession NM_130471), a gene which may regulate two different pathways for neural activities.interacts with the type-1 tumor necrosis factor receptor (TNFR1); death domain-containing protein. Accordingly, utilities of VGAM1946 include diagnosis, prevention and treatment of diseases and clinical conditions associated with MADD. The function of MADD and its association with various diseases and clinical conditions, has been established by previous studies, as described hereinabove with reference to VGAM430. Ribulose-5-phosphate-3-epimerase (RPE, Accession XM_030834) is another VGAM1946 host target gene. RPE BINDING SITE is HOST TARGET binding site found in the 3" untranslated region of mRNA encoded by RPE, corresponding to a HOST TARGET binding site such as BINDING SITE I, BINDING SITE II or BINDING SITE III. Table 2 illustrates the complementarity of the nucleotide sequences of RPE BINDING SITE, designated SEQ ID:31158, to the nucleotide sequence of VGAM1946 RNA, herein designated VGAM RNA, also designated SEQ ID:4657.

Another function of VGAM1946 is therefore inhibition of Ribulose-5-phosphate-3-epimerase (RPE, Accession XM_030834). Accordingly, utilities of VGAM1946 include diagnosis, prevention and treatment of diseases and clinical conditions associated with RPE. Solute Carrier Family 6 (neurotransmitter transporter, dopamine), Member 3 (SLC6A3, Accession NM_001044) is another VGAM1946 host target gene. SLC6A3 BINDING SITE is HOST TARGET binding site found in the 3' untranslated region of mRNA encoded by SLC6A3, corresponding to a HOST TARGET binding site such as BINDING SITE I, BINDING SITE II or BINDING SITE III. Table 2 illustrates the complementarity of the nucleotide sequences of SLC6A3 BINDING SITE, designated SEQ ID:6712, to the nucleotide sequence of VGAM1946 RNA, herein designated VGAM RNA, also designated SEQ ID:4657.

Another function of VGAM1946 is therefore inhibition of Solute Carrier Family 6 (neurotransmitter transporter, dopamine), Member 3 (SLC6A3, Accession NM_001044), a gene which terminates the action of dopamine by its high affinity sodium-dependent reuptake into presynaptic terminals. Accordingly, utilities of VGAM1946 include diagnosis, prevention and treatment of diseases and clinical conditions associated with SLC6A3. The function of SLC6A3 and its association with various diseases and clinical conditions, has been established by previous studies, as described hereinabove with reference to VGAM1753. Tec Protein Tyrosine Kinase (TEC, Accession NM_003215) is another VGAM1946 host target gene. TEC BINDING SITE is HOST TARGET binding site found in the 3' untranslated region of mRNA encoded by TEC, corresponding to a HOST TARGET binding site such as BINDING SITE I, BINDING SITE II or BINDING SITE III. Table 2 illustrates the complementarity of the nucleotide sequences of TEC BINDING SITE, designated SEQ ID:9220, to the nucleotide sequence of VGAM1946 RNA, herein designated VGAM RNA, also designated SEQ ID:4657.

Another function of VGAM1946 is therefore inhibition of Tec Protein Tyrosine Kinase (TEC, Accession NM_003215). Accordingly, utilities of VGAM1946 include diagnosis, prevention and treatment of diseases and clinical conditions associated with TEC. Kell Blood Group Precursor (McLeod phenotype) (XK, Accession NM_021083) is another VGAM1946 host target gene. XK BINDING SITE is HOST TARGET binding site found in the 3' untranslated region of mRNA encoded by XK, corresponding to a HOST TARGET binding site such as BINDING SITE I, BINDING SITE II or BINDING SITE III. Table 2 illustrates the complementarity of the nucleotide sequences of XK BINDING SITE, designated SEQ ID:22053, to the nucleotide sequence of VGAM1946 RNA, herein designated VGAM RNA, also designated SEQ ID:4657.

Another function of VGAM1946 is therefore inhibition of Kell Blood Group Precursor (McLeod phenotype) (XK, Accession NM_021083). Accordingly, utilities of VGAM1946 include diagnosis, prevention and treatment of diseases and clinical conditions associated with XK. Cylindromatosis (turban tumor syndrome) (CYLD, Accession NM_015247) is another VGAM1946 host target gene. CYLD BINDING SITE is HOST TARGET binding site found in the 3' untranslated region of mRNA encoded by CYLD, corresponding to a HOST TARGET binding site such as BINDING SITE I, BINDING SITE II or BINDING SITE III. Table 2 illustrates the complementarity of the nucleotide sequences of CYLD BINDING SITE, designated SEQ ID:17576, to the nucleotide sequence of VGAM1946 RNA, herein designated VGAM RNA, also designated SEQ ID:4657.

Another function of VGAM1946 is therefore inhibition of Cylindromatosis (turban tumor syndrome) (CYLD, Accession NM_015247). Accordingly, utilities of VGAM1946 include diagnosis, prevention and treatment of diseases and clinical conditions associated with CYLD. FLJ10925 (Accession NM_018275) is another VGAM1946 host target gene. FLJ10925 BINDING SITE is HOST TARGET binding site found in the 3' untranslated region of mRNA encoded by FLJ10925, corresponding to a HOST TARGET binding site such as BINDING SITE I, BINDING SITE II or BINDING SITE III. Table 2 illustrates the complementarity of the nucleotide sequences of FLJ10925 BINDING SITE, designated SEQ ID:20261, to the nucleotide sequence of VGAM1946 RNA, herein designated VGAM RNA, also designated SEQ ID:4657.

Another function of VGAM1946 is therefore inhibition of FLJ10925 (Accession NM_018275). Accordingly, utilities of VGAM1946 include diagnosis, prevention and treatment of diseases and clinical conditions associated with FLJ10925. FLJ11274 (Accession NM_018375) is another VGAM1946 host target gene. FLJ11274 BINDING SITE is HOST TARGET binding site found in the 3' untranslated region of mRNA encoded by FLJ11274, corresponding to a HOST TARGET binding site such as BINDING SITE I, BINDING SITE II or BINDING SITE III. Table 2 illustrates the complementarity of the nucleotide sequences of FLJ11274 BINDING SITE, designated SEQ ID:20400, to the nucleotide sequence of VGAM1946 RNA, herein designated VGAM RNA, also designated SEQ ID:4657.

Another function of VGAM1946 is therefore inhibition of FLJ11274 (Accession NM_018375). Accordingly, utilities of VGAM1946 include diagnosis, prevention and treatment of diseases and clinical conditions associated with FLJ11274. KIAA0161 (Accession NM_014746) is another VGAM1946 host target gene. KIAA0161 BINDING SITE is HOST TARGET binding site found in the 3' untranslated region of mRNA encoded by KIAA0161, corresponding to a HOST TARGET binding site such as BINDING SITE I, BINDING SITE II or BINDING SITE III. Table 2 illustrates the complementarity of the nucleotide sequences of KIAA0161 BINDING SITE, designated SEQ ID:16435, to the nucleotide sequence of VGAM1946 RNA, herein designated VGAM RNA, also designated SEQ ID:4657.

Another function of VGAM1946 is therefore inhibition of KIAA0161 (Accession NM_014746). Accordingly, utilities of VGAM1946 include diagnosis, prevention and treatment of diseases and clinical conditions associated with KIAA0161. MGC15438 (Accession NM_032874) is another VGAM1946 host target gene. MGC15438 BINDING SITE is HOST TARGET binding site found in the 5' untranslated region of mRNA encoded by MGC15438, corresponding to a HOST TARGET binding site such as BINDING SITE I, BINDING SITE II or BINDING SITE III. Table 2 illustrates the complementarity of the nucleotide sequences of MGC15438 BINDING SITE, designated SEQ ID:26694, to the nucleotide sequence of VGAM1946 RNA, herein designated VGAM RNA, also designated SEQ ID:4657.

Another function of VGAM1946 is therefore inhibition of MGC15438 (Accession NM_032874). Accordingly, utilities of VGAM1946 include diagnosis, prevention and treatment of diseases and clinical conditions associated with MGC15438. PRO2214 (Accession NM_018517) is another VGAM1946 host target gene. PRO2214 BINDING SITE is HOST TARGET binding site found in the 5' untranslated region of mRNA encoded by PRO2214, corresponding to a HOST TARGET binding site such as BINDING SITE I, BINDING SITE II or BINDING SITE III. Table 2 illustrates the complementarity of the nucleotide sequences of PRO2214 BINDING SITE, designated SEQ ID:20588, to the nucleotide sequence of VGAM1946 RNA, herein designated VGAM RNA, also designated SEQ ID:4657.

Another function of VGAM1946 is therefore inhibition of PRO2214 (Accession NM_018517). Accordingly, utilities of VGAM1946 include diagnosis, prevention and treatment of diseases and clinical conditions associated with PRO2214. Solute Carrier Family 21 (organic anion transporter), Member 14 (SLC21A14, Accession NM_017435) is another VGAM1946 host target gene. SLC21A14 BINDING SITE is HOST TARGET binding site found in the 3' untranslated region of mRNA encoded by SLC21A14, corresponding to a HOST TARGET binding site such as BINDING SITE I, BINDING SITE II or BINDING SITE III. Table 2 illustrates the complementarity of the nucleotide sequences of SLC21A14 BINDING SITE, designated SEQ ID:18892, to the nucleotide sequence of VGAM1946 RNA, herein designated VGAM RNA, also designated SEQ ID:4657.

Another function of VGAM1946 is therefore inhibition of Solute Carrier Family 21 (organic anion transporter), Member 14 (SLC21A14, Accession NM_017435). Accordingly, utilities of VGAM1946 include diagnosis, prevention and treatment of diseases and clinical conditions associated with SLC21A14. X123 (Accession XM_046023) is another VGAM1946 host target gene. X123 BINDING SITE is HOST TARGET binding site found in the 3' untranslated region of mRNA encoded by X123, corresponding to a HOST TARGET binding site such as BINDING SITE I, BINDING SITE II or BINDING SITE III. Table 2 illustrates the complementarity of the nucleotide sequences of X123 BINDING SITE, designated SEQ ID:34651, to the nucleotide sequence of VGAM1946 RNA, herein designated VGAM RNA, also designated SEQ ID:4657.

Another function of VGAM1946 is therefore inhibition of X123 (Accession XM_046023). Accordingly, utilities of VGAM1946 include diagnosis, prevention and treatment of diseases and clinical conditions associated with X123. LOC120856 (Accession XM_058509) is another VGAM1946 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36646, to the nucleotide sequence of VGAM1946 RNA, herein designated VGAM RNA, also designated SEQ ID:4657.

Another function of VGAM1946 is therefore inhibition of LOC120856 (Accession XM_058509). Accordingly, utilities of VGAM1946 include diagnosis, prevention and treatment of diseases and clinical conditions associated with LOC120856. LOC153339 (Accession XM_098362) is another VGAM1946 host target gene. LOC153339 BINDING SITE is HOST TARGET binding site found in the 5' untranslated region of mRNA encoded by LOC153339, corresponding to a HOST TARGET binding site such as BINDING SITE I, BINDING SITE II or BINDING SITE III. Table 2 illustrates the complementarity of the nucleotide sequences of LOC153339 BINDING SITE, designated SEQ ID:41616, to the nucleotide sequence of VGAM1946 RNA, herein designated VGAM RNA, also designated SEQ ID:4657.

Another function of VGAM1946 is therefore inhibition of LOC153339 (Accession XM_098362). Accordingly, utilities of VGAM1946 include diagnosis, prevention and treatment of diseases and clinical conditions associated with LOC153339. LOC159091 (Accession NM_138819) is another VGAM1946 host target gene. LOC159091 BINDING SITE is HOST TARGET binding site found in the 5' untranslated region of mRNA encoded by LOC159091, corresponding to a HOST TARGET binding site such as BINDING SITE I, BINDING SITE II or BINDING SITE III. Table 2 illustrates the complementarity of the nucleotide sequences of LOC159091 BINDING SITE, designated SEQ ID:29038, to the nucleotide sequence of VGAM1946 RNA, herein designated VGAM RNA, also designated SEQ ID:4657.

Another function of VGAM1946 is therefore inhibition of LOC159091 (Accession NM_138819). Accordingly, utilities of VGAM1946 include diagnosis, prevention and treatment of diseases and clinical conditions associated with LOC159091. LOC255520 (Accession XM_171073) is another VGAM1946 host target gene. LOC255520 BINDING SITE is HOST TARGET binding site found in the 3' untranslated region of mRNA encoded by LOC255520, corresponding to a HOST TARGET binding site such as BINDING SITE I, BINDING SITE II or BINDING SITE III. Table 2 illustrates the complementarity of the nucleotide sequences of LOC255520 BINDING SITE, designated SEQ ID:45881, to the nucleotide sequence of VGAM1946 RNA, herein designated VGAM RNA, also designated SEQ ID:4657.

Another function of VGAM1946 is therefore inhibition of LOC255520 (Accession XM_171073). Accordingly, utilities of VGAM1946 include diagnosis, prevention and treatment of diseases and clinical conditions associated with LOC255520. FIG. 1 further provides a conceptual description of a novel bioinformatically detected viral gene of the present invention, referred to here as Viral Genomic Address Messenger 1947 (VGAM1947) viral gene, which modulates expression of respective host target genes thereof, the function and utility of which host target genes is known in the art.

VGAM1947 is a novel bioinformatically detected regulatory, non protein coding, viral micro RNA (miRNA) gene. The method by which VGAM1947 was detected is described hereinabove with reference to FIGS. 1-8.

VGAM1947 gene, herein designated VGAM GENE, is a viral gene contained in the genome of Variola Virus. VGAM1947 host target gene, herein designated VGAM HOST TARGET GENE, is a human gene contained in the human genome.

VGAM1947 gene encodes a VGAM1947 precursor RNA, herein designated VGAM PRECURSOR RNA. Similar to other miRNA genes, and unlike most ordinary genes, VGAM1947 precursor RNA does not encode a protein. A nucleotide sequence identical or highly similar to the nucleotide sequence of VGAM1947 precursor RNA is designated SEQ ID:1933, and is provided hereinbelow with reference to the sequence listing part. Nucleotide sequence SEQ ID:1933 is located at position 16704 relative to the genome of Variola Virus.

VGAM1947 precursor RNA folds onto itself, forming VGAM1947 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1947 folded precursor RNA into VGAM1947 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 68%) nucleotide sequence of VGAM1947 RNA is designated SEQ ID:4658, and is provided hereinbelow with reference to the sequence listing part.

VGAM1947 host target gene, herein designated VGAM HOST TARGET GENE, encodes a corresponding messenger RNA, VGAM1947 host target RNA, herein designated VGAM HOST TARGET RNA. VGAM1947 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1947 RNA, herein designated VGAM RNA, binds complementarily to one or more host target binding sites located in untranslated regions of VGAM1947 host target RNA, herein designated VGAM HOST TARGET RNA. This complementary binding is due to the fact that the nucleotide sequence of VGAM1947 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1947 RNA, herein designated VGAM RNA, may have a different number of host target binding sites in untranslated regions of a VGAM1947 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1947 RNA, herein designated VGAM RNA, to host target binding sites on VGAM1947 host target RNA, herein designated VGAM HOST TARGET RNA, such as BINDING SITE I, BINDING SITE II and BINDING SITE III, inhibits translation of VGAM1947 host target RNA into VGAM1947 host target protein, herein designated VGAM HOST TARGET PROTEIN. VGAM host target protein is therefore outlined by a broken line.

It is appreciated that VGAM1947 host target gene, herein designated VGAM HOST TARGET GENE, in fact represents a plurality of VGAM1947 host target genes. The mRNA of each one of this plurality of VGAM1947 host target genes comprises one or more host target binding sites, each having a nucleotide sequence which is at least partly complementary to VGAM1947 RNA, herein designated VGAM RNA, and which when bound by VGAM1947 RNA causes inhibition of translation of respective one or more VGAM1947 host target proteins.

It is further appreciated by one skilled in the art that the mode of translational inhibition illustrated by FIG. 1 with specific reference to translational inhibition exerted by VGAM1947 gene, herein designated VGAM GENE, on one or more VGAM1947 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1947 is inhibition of expression of host target genes, as part of a novel viral mechanism of attacking a host. Accordingly, utilities of VGAM1947 include diagnosis, prevention and treatment of viral infection by Variola Virus. Specific functions, and accordingly utilities, of VGAM1947 correlate with, and may be deduced from, the identity of the host target genes which VGAM1947 binds and inhibits, and the function of these host target genes, as elaborated hereinbelow.

Nucleotide sequences of the VGAM1947 precursor RNA, herein designated VGAM PRECURSOR RNA, and of the 'diced' VGAM1947 RNA, herein designated VGAM RNA, and a schematic representation of the secondary folding of VGAM1947 folded precursor RNA, herein designated VGAM FOLDED PRECURSOR RNA, of VGAM1947 are further described hereinbelow with reference to Table 1.

Nucleotide sequences of host target binding sites, such as BINDING SITE-I, BINDING SITE-II and BINDING SITE-III of FIG. 1, found on VGAM1947 host target RNA, and schematic representation of the complementarity of each of these host target binding sites to VGAM1947 RNA, herein designated VGAM RNA, are described hereinbelow with reference to Table 2.

As mentioned hereinabove with reference to FIG. 1, a function of VGAM1947 gene, herein designated VGAM is inhibition of expression of VGAM1947 target genes. It is appreciated that specific functions, and accordingly utilities, of VGAM1947 correlate with, and may be deduced from, the identity of the target genes which VGAM1947 binds and inhibits, and the function of these target genes, as elaborated hereinbelow.

Solute Carrier Family 19 (thiamine transporter), Member 2 (SLC19A2, Accession XM_044421) is a VGAM1947 host target gene. SLC19A2 BINDING SITE is HOST TARGET binding site found in the 3' untranslated region of mRNA encoded by SLC19A2, corresponding to a HOST TARGET binding site such as BINDING SITE I, BINDING SITE II or BINDING SITE III. Table 2 illustrates the complementarity of the nucleotide sequences of SLC19A2 BINDING SITE, designated SEQ ID:34194, to the nucleotide sequence of VGAM1947 RNA, herein designated VGAM RNA, also designated SEQ ID:4658.

A function of VGAM1947 is therefore inhibition of Solute Carrier Family 19 (thiamine transporter), Member 2 (SLC19A2, Accession XM_044421). Accordingly, utilities of VGAM1947 include diagnosis, prevention and treatment of diseases and clinical conditions associated with SLC19A2. FIG. 1 further provides a conceptual description of a novel bioinformatically detected viral gene of the present invention, referred to here as Viral Genomic Address Messenger 1948 (VGAM1948) viral gene, which modulates expression of respective host target genes thereof, the function and utility of which host target genes is known in the art.

VGAM1948 is a novel bioinformatically detected regulatory, non protein coding, viral micro RNA (miRNA) gene. The method by which VGAM1948 was detected is described hereinabove with reference to FIGS. 1-8.

VGAM1948 gene, herein designated VGAM GENE, is a viral gene contained in the genome of Avian Paramyxovirus 6. VGAM1948 host target gene, herein designated VGAM HOST TARGET GENE, is a human gene contained in the human genome.

VGAM1948 gene encodes a VGAM1948 precursor RNA, herein designated VGAM PRECURSOR RNA. Similar to other miRNA genes, and unlike most ordinary genes, VGAM1948 precursor RNA does not encode a protein. A nucleotide sequence identical or highly similar to the nucleotide sequence of VGAM1948 precursor RNA is designated SEQ ID:1934, and is provided hereinbelow with reference to the sequence listing part. Nucleotide sequence SEQ ID:1934 is located at position 4256 relative to the genome of Avian Paramyxovirus 6.

VGAM1948 precursor RNA folds onto itself, forming VGAM1948 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1948 folded precursor RNA into VGAM1948 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM1948 RNA is designated SEQ ID:4659, and is provided hereinbelow with reference to the sequence listing part.

VGAM1948 host target gene, herein designated VGAM HOST TARGET GENE, encodes a corresponding messenger RNA, VGAM1948 host target RNA, herein designated VGAM HOST TARGET RNA. VGAM1948 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1948 RNA, herein designated VGAM RNA, binds complementarily to one or more host target binding sites located in untranslated regions of VGAM1948 host target RNA, herein designated VGAM HOST TARGET RNA. This complementary binding is due to the fact that the nucleotide sequence of VGAM1948 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1948 RNA, herein designated VGAM RNA, may have a different number of host target binding sites in untranslated regions of a VGAM1948 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1948 RNA, herein designated VGAM RNA, to host target binding sites on VGAM1948 host target RNA, herein designated VGAM HOST TARGET RNA, such as BINDING SITE I, BINDING SITE II and BINDING SITE III, inhibits translation of VGAM1948 host target RNA into VGAM1948 host target protein, herein designated VGAM HOST TARGET PRO- TEIN. VGAM host target protein is therefore outlined by a broken line.

It is appreciated that VGAM1948 host target gene, herein designated VGAM HOST TARGET GENE, in fact represents a plurality of VGAM1948 host target genes. The mRNA of each one of this plurality of VGAM1948 host target genes comprises one or more host target binding sites, each having a nucleotide sequence which is at least partly complementary to VGAM1948 RNA, herein designated VGAM RNA, and which when bound by VGAM1948 RNA causes inhibition of translation of respective one or more VGAM1948 host target proteins.

It is further appreciated by one skilled in the art that the mode of translational inhibition illustrated by FIG. 1 with specific reference to translational inhibition exerted by VGAM1948 gene, herein designated VGAM GENE, on one or more VGAM1948 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1948 is inhibition of expression of host target genes, as part of a novel viral mechanism of attacking a host. Accordingly, utilities of VGAM1948 include diagnosis, prevention and treatment of viral infection by Avian Paramyxovirus 6. Specific functions, and accordingly utilities, of VGAM1948 correlate with, and may be deduced from, the identity of the host target genes which VGAM1948 binds and inhibits, and the function of these host target genes, as elaborated hereinbelow.

Nucleotide sequences of the VGAM1948 precursor RNA, herein designated VGAM PRECURSOR RNA, and of the 'diced' VGAM1948 RNA, herein designated VGAM RNA, and a schematic representation of the secondary folding of VGAM1948 folded precursor RNA, herein designated VGAM FOLDED PRECURSOR RNA, of VGAM1948 are further described hereinbelow with reference to Table 1.

Nucleotide sequences of host target binding sites, such as BINDING SITE-I, BINDING SITE-II and BINDING SITE-III of FIG. 1, found on VGAM1948 host target RNA, and schematic representation of the complementarity of each of these host target binding sites to VGAM1948 RNA, herein designated VGAM RNA, are described hereinbelow with reference to Table 2.

As mentioned hereinabove with reference to FIG. 1, a function of VGAM1948 gene, herein designated VGAM is inhibition of expression of VGAM1948 target genes. It is appreciated that specific functions, and accordingly utilities, of VGAM1948 correlate with, and may be deduced from, the identity of the target genes which VGAM1948 binds and inhibits, and the function of these target genes, as elaborated hereinbelow.

ATP-binding Cassette, Sub-family G (WHITE), Member 1 (ABCG1, Accession NM_004915) is a VGAM1948 host target gene. ABCG1 BINDING SITE is HOST TARGET binding site found in the 3' untranslated region of mRNA encoded by ABCG1, corresponding to a HOST TARGET binding site such as BINDING SITE I, BINDING SITE II or BINDING SITE III. Table 2 illustrates the complementarity of the nucleotide sequences of ABCG1 BINDING SITE, designated SEQ ID:11351, to the nucleotide sequence of VGAM1948 RNA, herein designated VGAM RNA, also designated SEQ ID:4659.

A function of VGAM1948 is therefore inhibition of ATP-binding Cassette, Sub-family G (WHITE), Member 1 (ABCG1, Accession NM_004915), a gene which transporter involved in macrophage lipid homeostasis. Accordingly, utilities of VGAM1948 include diagnosis, prevention and treatment of diseases and clinical conditions associated with ABCG1. The function of ABCG1 and its association with various diseases and clinical conditions, has been established by previous studies, as described hereinabove with reference to VGAM595. C-type (calcium dependent, carbohydrate-recognition domain) Lectin, Superfamily Member 5 (CLECSF5, Accession NM_013252) is another VGAM1948 host target gene. CLECSF5 BINDING SITE is HOST TARGET binding site found in the 3' untranslated region of mRNA encoded by CLECSF5, corresponding to a HOST TARGET binding site such as BINDING SITE I, BINDING SITE II or BINDING SITE III. Table 2 illustrates the complementarity of the nucleotide sequences of CLECSF5 BINDING SITE, designated SEQ ID:14917, to the nucleotide sequence of VGAM1948 RNA, herein designated VGAM RNA, also designated SEQ ID:4659.

Another function of VGAM1948 is therefore inhibition of C-type (calcium dependent, carbohydrate-recognition domain) Lectin, Superfamily Member 5 (CLECSF5, Accession NM_013252). Accordingly, utilities of VGAM1948 include diagnosis, prevention and treatment of diseases and clinical conditions associated with CLECSF5. 2'-5'-oligoadenylate Synthetase 3, 100 kDa (OAS3, Accession NM_006187) is another VGAM1948 host target gene. OAS3 BINDING SITE is HOST TARGET binding site found in the 3' untranslated region of mRNA encoded by OAS3, corresponding to a HOST TARGET binding site such as BINDING SITE I, BINDING SITE II or BINDING SITE III. Table 2 illustrates the complementarity of the nucleotide sequences of OAS3 BINDING SITE, designated SEQ ID:12858, to the nucleotide sequence of VGAM1948 RNA, herein designated VGAM RNA, also designated SEQ ID:4659.

Another function of VGAM1948 is therefore inhibition of 2'-5'-oligoadenylate Synthetase 3, 100 kDa (OAS3, Accession NM_006187), a gene which may play a role in mediating resistance to virus infection, control of cell growth, differentiation, and apoptosis. Accordingly, utilities of VGAM1948 include diagnosis, prevention and treatment of diseases and clinical conditions associated with OAS3. The function of OAS3 and its association with various diseases and clinical conditions, has been established by previous studies, as described hereinabove with reference to VGAM309. Polymerase (DNA directed), Eta (POLH, Accession NM_006502) is another VGAM1948 host target gene. POLH BINDING SITE is HOST TARGET binding site found in the 3' untranslated region of mRNA encoded by POLH, corresponding to a HOST TARGET binding site such as BINDING SITE I, BINDING SITE II or BINDING SITE III. Table 2 illustrates the complementarity of the nucleotide sequences of POLH BINDING SITE, designated SEQ ID:13249, to the nucleotide sequence of VGAM1948 RNA, herein designated VGAM RNA, also designated SEQ ID:4659.

Another function of VGAM1948 is therefore inhibition of Polymerase (DNA directed), Eta (POLH, Accession NM_006502). Accordingly, utilities of VGAM1948 include diagnosis, prevention and treatment of diseases and clinical conditions associated with POLH. HSA249128 (Accession NM_017583) is another VGAM1948 host target gene. HSA249128 BINDING SITE is HOST TARGET binding site found in the 3' untranslated region of mRNA encoded by HSA249128, corresponding to a HOST TARGET binding site such as BINDING SITE I, BINDING SITE II or BINDING SITE III. Table 2 illustrates the complementarity of the nucleotide sequences of HSA249128 BINDING SITE, designated SEQ ID:19024, to the nucleotide sequence of VGAM1948 RNA, herein designated VGAM RNA, also designated SEQ ID:4659.

Another function of VGAM1948 is therefore inhibition of HSA249128 (Accession NM_017583). Accordingly, utilities of VGAM1948 include diagnosis, prevention and treatment of diseases and clinical conditions associated with HSA249128. MGC4655 (Accession NM_033309) is another VGAM1948 host target gene. MGC4655 BINDING SITE is HOST TARGET binding site found in the 3' untranslated region of mRNA encoded by MGC4655, corresponding to a HOST TARGET binding site such as BINDING SITE I, BINDING SITE II or BINDING SITE III. Table 2 illustrates the complementarity of the nucleotide sequences of MGC4655 BINDING SITE, designated SEQ ID:27145, to the nucleotide sequence of VGAM1948 RNA, herein designated VGAM RNA, also designated SEQ ID:4659.

Another function of VGAM1948 is therefore inhibition of MGC4655 (Accession NM_033309). Accordingly, utilities of VGAM1948 include diagnosis, prevention and treatment of diseases and clinical conditions associated with MGC4655. Transducer of ERBB2, 2 (TOB2, Accession XM_170995) is another VGAM1948 host target gene. TOB2 BINDING SITE is HOST TARGET binding site found in the 3' untranslated region of mRNA encoded by TOB2, corresponding to a HOST TARGET binding site such as BINDING SITE I, BINDING SITE II or BINDING SITE III. Table 2 illustrates the complementarity of the nucleotide sequences of TOB2 BINDING SITE, designated SEQ ID:45763, to the nucleotide sequence of VGAM1948 RNA, herein designated VGAM RNA, also designated SEQ ID:4659.

Another function of VGAM1948 is therefore inhibition of Transducer of ERBB2, 2 (TOB2, Accession XM_170995). Accordingly, utilities of VGAM1948 include diagnosis, prevention and treatment of diseases and clinical conditions associated with TOB2. LOC90917 (Accession XM_034861) is another VGAM1948 host target gene. LOC90917 BINDING SITE is HOST TARGET binding site found in the 3' untranslated region of mRNA encoded by LOC90917, corresponding to a HOST TARGET binding site such as BINDING SITE I, BINDING SITE II or BINDING SITE III. Table 2 illustrates the complementarity of the nucleotide sequences of LOC90917 BINDING SITE, designated SEQ ID:32168, to the nucleotide sequence of VGAM1948 RNA, herein designated VGAM RNA, also designated SEQ ID:4659.

Another function of VGAM1948 is therefore inhibition of LOC90917 (Accession XM_034861). Accordingly, utilities of VGAM1948 include diagnosis, prevention and treatment of diseases and clinical conditions associated with LOC90917. FIG. 1 further provides a conceptual description of a novel bioinformatically detected viral gene of the present invention, referred to here as Viral Genomic Address Messenger 1949 (VGAM1949) viral gene, which modulates expression of respective host target genes thereof, the function and utility of which host target genes is known in the art.

VGAM1949 is a novel bioinformatically detected regulatory, non protein coding, viral micro RNA (miRNA) gene. The method by which VGAM1949 was detected is described hereinabove with reference to FIGS. 1-8.

VGAM1949 gene, herein designated VGAM GENE, is a viral gene contained in the genome of Avian Paramyxovirus 6. VGAM1949 host target gene, herein designated VGAM HOST TARGET GENE, is a human gene contained in the human genome.

VGAM1949 gene encodes a VGAM1949 precursor RNA, herein designated VGAM PRECURSOR RNA. Similar to other miRNA genes, and unlike most ordinary genes, VGAM1949 precursor RNA does not encode a protein. A nucleotide sequence identical or highly similar to the nucleotide sequence of VGAM1949 precursor RNA is designated SEQ ID:1935, and is provided hereinbelow with reference to the sequence listing part. Nucleotide sequence SEQ ID:1935 is located at position 14249 relative to the genome of Avian Paramyxovirus 6.

VGAM1949 precursor RNA folds onto itself, forming VGAM1949 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1949 folded precursor RNA into VGAM1949 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1949 RNA is designated SEQ ID:4660, and is provided hereinbelow with reference to the sequence listing part.

VGAM1949 host target gene, herein designated VGAM HOST TARGET GENE, encodes a corresponding messenger RNA, VGAM1949 host target RNA, herein designated VGAM HOST TARGET RNA. VGAM1949 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1949 RNA, herein designated VGAM RNA, binds complementarily to one or more host target binding sites located in untranslated regions of VGAM1949 host target RNA, herein designated VGAM HOST TARGET RNA. This complementary binding is due to the fact that the nucleotide sequence of VGAM1949 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1949 RNA, herein designated VGAM RNA, may have a different number of host target binding sites in untranslated regions of a VGAM1949 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1949 RNA, herein designated VGAM RNA, to host target binding sites on VGAM1949 host target RNA, herein designated VGAM HOST TARGET RNA, such as BINDING SITE I, BINDING SITE II and BINDING SITE III, inhibits translation of VGAM1949 host target RNA into VGAM1949 host target protein, herein designated VGAM HOST TARGET PROTEIN. VGAM host target protein is therefore outlined by a broken line.

It is appreciated that VGAM1949 host target gene, herein designated VGAM HOST TARGET GENE, in fact represents a plurality of VGAM1949 host target genes. The mRNA of each one of this plurality of VGAM1949 host target genes comprises one or more host target binding sites, each having a nucleotide sequence which is at least partly complementary to VGAM1949 RNA, herein designated VGAM RNA, and which when bound by VGAM1949 RNA causes inhibition of translation of respective one or more VGAM1949 host target proteins.

It is further appreciated by one skilled in the art that the mode of translational inhibition illustrated by FIG. 1 with specific reference to translational inhibition exerted by VGAM1949 gene, herein designated VGAM GENE, on one or more VGAM1949 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1949 is inhibition of expression of host target genes, as part of a novel viral mechanism of attacking a host. Accordingly, utilities of VGAM1949 include diagnosis, prevention and treatment of viral infection by Avian Paramyxovirus 6. Specific functions, and accordingly utilities, of VGAM1949 correlate with, and may be deduced from, the identity of the host target genes which VGAM1949 binds and inhibits, and the function of these host target genes, as elaborated hereinbelow.

Nucleotide sequences of the VGAM1949 precursor RNA, herein designated VGAM PRECURSOR RNA, and of the 'diced' VGAM1949 RNA, herein designated VGAM RNA, and a schematic representation of the secondary folding of VGAM1949 folded precursor RNA, herein designated VGAM FOLDED PRECURSOR RNA, of VGAM1949 are further described hereinbelow with reference to Table 1.

Nucleotide sequences of host target binding sites, such as BINDING SITE-I, BINDING SITE-II and BINDING SITE-III of FIG. 1, found on VGAM1949 host target RNA, and schematic representation of the complementarity of each of these host target binding sites to VGAM1949 RNA, herein designated VGAM RNA, are described hereinbelow with reference to Table 2.

As mentioned hereinabove with reference to FIG. 1, a function of VGAM1949 gene, herein designated VGAM is inhibition of expression of VGAM1949 target genes. It is appreciated that specific functions, and accordingly utilities, of VGAM1949 correlate with, and may be deduced from, the identity of the target genes which VGAM1949 binds and inhibits, and the function of these target genes, as elaborated hereinbelow.

Keratocan (KERA, Accession NM_007035) is a VGAM1949 host target gene. KERA BINDING SITE is HOST TARGET binding site found in the 3' untranslated region of mRNA encoded by KERA, corresponding to a HOST TARGET binding site such as BINDING SITE I, BINDING SITE II or BINDING SITE III. Table 2 illustrates the complementarity of the nucleotide sequences of KERA BINDING SITE, designated SEQ ID:13905, to the nucleotide sequence of VGAM1949 RNA, herein designated VGAM RNA, also designated SEQ ID:4660.

A function of VGAM1949 is therefore inhibition of Keratocan (KERA, Accession NM_007035), a gene which may be important in developing and maintaining corneal transparency and for the structure of the stromal matrix. Accordingly, utilities of VGAM1949 include diagnosis, prevention and treatment of diseases and clinical conditions associated with KERA. The function of KERA and its association with various diseases and clinical conditions, has been established by previous studies, as described hereinabove with reference to VGAM723. FIG. 1 further provides a conceptual description of a novel bioinformatically detected viral gene of the present invention, referred to here as Viral Genomic Address Messenger 1950 (VGAM1950) viral gene, which modulates expression of respective host target genes thereof, the function and utility of which host target genes is known in the art.

VGAM1950 is a novel bioinformatically detected regulatory, non protein coding, viral micro RNA (miRNA) gene. The method by which VGAM1950 was detected is described hereinabove with reference to FIGS. 1-8.

VGAM1950 gene, herein designated VGAM GENE, is a viral gene contained in the genome of Avian Paramyxovirus 6. VGAM1950 host target gene, herein designated VGAM HOST TARGET GENE, is a human gene contained in the human genome.

VGAM1950 gene encodes a VGAM1950 precursor RNA, herein designated VGAM PRECURSOR RNA. Similar to other miRNA genes, and unlike most ordinary genes, VGAM1950 precursor RNA does not encode a protein. A nucleotide sequence identical or highly similar to the nucleotide sequence of VGAM1950 precursor RNA is designated SEQ ID:1936, and is provided hereinbelow with reference to the sequence listing part. Nucleotide sequence SEQ ID:1936 is located at position 14024 relative to the genome of Avian Paramyxovirus 6.

VGAM1950 precursor RNA folds onto itself, forming VGAM1950 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1950 folded precursor RNA into VGAM1950 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1950 RNA is designated SEQ ID:4661, and is provided hereinbelow with reference to the sequence listing part.

VGAM1950 host target gene, herein designated VGAM HOST TARGET GENE, encodes a corresponding messenger RNA, VGAM1950 host target RNA, herein designated VGAM HOST TARGET RNA. VGAM1950 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1950 RNA, herein designated VGAM RNA, binds complementarily to one or more host target binding sites located in untranslated regions of VGAM1950 host target RNA, herein designated VGAM HOST TARGET RNA. This complementary binding is due to the fact that the nucleotide sequence of VGAM1950 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1950 RNA, herein designated VGAM RNA, may have a different number of host target binding sites in untranslated regions of a VGAM1950 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1950 RNA, herein designated VGAM RNA, to host target binding sites on VGAM1950 host target RNA, herein designated VGAM HOST TARGET RNA, such as BINDING SITE I, BINDING SITE II and BINDING SITE III, inhibits translation of VGAM1950 host target RNA into VGAM1950 host target protein, herein designated VGAM HOST TARGET PROTEIN. VGAM host target protein is therefore outlined by a broken line.

It is appreciated that VGAM1950 host target gene, herein designated VGAM HOST TARGET GENE, in fact represents a plurality of VGAM1950 host target genes. The mRNA of each one of this plurality of VGAM1950 host target genes comprises one or more host target binding sites, each having a nucleotide sequence which is at least partly complementary to VGAM1950 RNA, herein designated VGAM RNA, and which when bound by VGAM1950 RNA causes inhibition of translation of respective one or more VGAM1950 host target proteins.

It is further appreciated by one skilled in the art that the mode of translational inhibition illustrated by FIG. 1 with specific reference to translational inhibition exerted by VGAM1950 gene, herein designated VGAM GENE, on one or more VGAM1950 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1950 is inhibition of expression of host target genes, as part of a novel viral mechanism of attacking a host. Accordingly, utilities of VGAM1950 include diagnosis, prevention and treatment of viral infection by Avian Paramyxovirus 6. Specific functions, and accordingly utilities, of VGAM1950 correlate with, and may be deduced from, the identity of the host target genes which VGAM1950 binds and inhibits, and the function of these host target genes, as elaborated hereinbelow.

Nucleotide sequences of the VGAM1950 precursor RNA, herein designated VGAM PRECURSOR RNA, and of the 'diced' VGAM1950 RNA, herein designated VGAM RNA, and a schematic representation of the secondary folding of VGAM1950 folded precursor RNA, herein designated VGAM FOLDED PRECURSOR RNA, of VGAM1950 are further described hereinbelow with reference to Table 1.

Nucleotide sequences of host target binding sites, such as BINDING SITE-I, BINDING SITE-II and BINDING SITE-III of FIG. 1, found on VGAM1950 host target RNA, and schematic representation of the complementarity of each of these host target binding sites to VGAM1950 RNA, herein designated VGAM RNA, are described hereinbelow with reference to Table 2.

As mentioned hereinabove with reference to FIG. 1, a function of VGAM1950 gene, herein designated VGAM is inhibition of expression of VGAM1950 target genes. It is appreciated that specific functions, and accordingly utilities, of VGAM1950 correlate with, and may be deduced from, the identity of the target genes which VGAM1950 binds and inhibits, and the function of these target genes, as elaborated hereinbelow.

Cytochrome P450, Subfamily IVF, Polypeptide 3 (leukotriene B4 omega hydroxylase) (CYP4F3, Accession NM_000896) is a VGAM1950 host target gene. CYP4F3 BINDING SITE is HOST TARGET binding site found in the 3' untranslated region of mRNA encoded by CYP4F3, corresponding to a HOST TARGET binding site such as BINDING SITE I, BINDING SITE II or BINDING SITE III. Table 2 illustrates the complementarity of the nucleotide sequences of CYP4F3 BINDING SITE, designated SEQ ID:6594, to the nucleotide sequence of VGAM1950 RNA, herein designated VGAM RNA, also designated SEQ ID:4661.

A function of VGAM1950 is therefore inhibition of Cytochrome P450, Subfamily IVF, Polypeptide 3 (leukotriene B4 omega hydroxylase) (CYP4F3, Accession NM_000896), a gene which converts leukotriene B4 into the less active 20-hydroxy-leukotriene B4. Accordingly, utilities of VGAM1950 include diagnosis, prevention and treatment of diseases and clinical conditions associated with CYP4F3. The function of CYP4F3 and its association with various diseases and clinical conditions, has been established by previous studies, as described hereinabove with reference to VGAM186. Coagulation Factor II (thrombin) Receptor-like 3 (F2RL3, Accession NM_003950) is another VGAM1950 host target gene. F2RL3 BINDING SITE is HOST TARGET binding site found in the 3' untranslated region of mRNA encoded by F2RL3, corresponding to a HOST TARGET binding site such as BINDING SITE I, BINDING SITE II or BINDING SITE III. Table 2 illustrates the complementarity of the nucleotide sequences of F2RL3 BINDING SITE, designated SEQ ID:10085, to the nucleotide sequence of VGAM1950 RNA, herein designated VGAM RNA, also designated SEQ ID:4661.

Another function of VGAM1950 is therefore inhibition of Coagulation Factor II (thrombin) Receptor-like 3 (F2RL3, Accession NM_003950), a gene which Protease-activated receptor 4; G protein-coupled receptor that increases phosphoinositide hydrolysis. Accordingly, utilities of VGAM1950 include diagnosis, prevention and treatment of diseases and clinical conditions associated with F2RL3. The function of F2RL3 and its association with various diseases and clinical conditions, has been established by previous studies, as described hereinabove with reference to VGAM193. Mature T-cell Proliferation 1 (MTCP1, Accession NM_014221) is another VGAM1950 host target gene. MTCP1 BINDING SITE is HOST TARGET binding site found in the 5' untranslated region of mRNA encoded by MTCP1, corresponding to a HOST TARGET binding site such as BINDING SITE I, BINDING SITE II or BINDING SITE III. Table 2 illustrates the complementarity of the nucleotide sequences of MTCP1 BINDING SITE, designated SEQ ID:15488, to the nucleotide sequence of VGAM1950 RNA, herein designated VGAM RNA, also designated SEQ ID:4661.

Another function of VGAM1950 is therefore inhibition of Mature T-cell Proliferation 1 (MTCP1, Accession NM_014221). Accordingly, utilities of VGAM1950 include diagnosis, prevention and treatment of diseases and clinical conditions associated with MTCP1. Adaptor-related Protein Complex 4, Sigma 1 Subunit (AP4S1, Accession NM_007077) is another VGAM1950 host target gene. AP4S1 BINDING SITE is HOST TARGET binding site found in the 3' untranslated region of mRNA encoded by AP4S1, corresponding to a HOST TARGET binding site such as BINDING SITE I, BINDING SITE II or BINDING SITE III. Table 2 illustrates the complementarity of the nucleotide sequences of AP4S1 BINDING SITE, designated SEQ ID:13941, to the nucleotide sequence of VGAM1950 RNA, herein designated VGAM RNA, also designated SEQ ID:4661.

Another function of VGAM1950 is therefore inhibition of Adaptor-related Protein Complex 4, Sigma 1 Subunit (AP4S1, Accession NM_007077). Accordingly, utilities of VGAM1950 include diagnosis, prevention and treatment of diseases and clinical conditions associated with AP4S1. Caspase Recruitment Domain Family, Member 14 (CARD14, Accession NM_024110) is another VGAM1950 host target gene. CARD14 BINDING SITE is HOST TARGET binding site found in the 3' untranslated region of mRNA encoded by CARD14, corresponding to a HOST TARGET binding site such as BINDING SITE I, BINDING SITE II or BINDING SITE III. Table 2 illustrates the complementarity of the nucleotide sequences of CARD14 BINDING SITE, designated SEQ ID:23556, to the nucleotide sequence of VGAM1950 RNA, herein designated VGAM RNA, also designated SEQ ID:4661.

Another function of VGAM1950 is therefore inhibition of Caspase Recruitment Domain Family, Member 14 (CARD14, Accession NM_024110). Accordingly, utilities of VGAM1950 include diagnosis, prevention and treatment of diseases and clinical conditions associated with CARD14. KIAA0844 (Accession NM_014951) is another VGAM1950 host target gene. KIAA0844 BINDING SITE is HOST TARGET binding site found in the 3' untranslated region of mRNA encoded by KIAA0844, corresponding to a HOST TARGET binding site such as BINDING SITE I, BINDING SITE II or BINDING SITE III. Table 2 illustrates the complementarity of the nucleotide sequences of KIAA0844 BINDING SITE, designated SEQ ID:17287, to the nucleotide sequence of VGAM1950 RNA, herein designated VGAM RNA, also designated SEQ ID:4661.

Another function of VGAM1950 is therefore inhibition of KIAA0844 (Accession NM_014951). Accordingly, utilities of VGAM1950 include diagnosis, prevention and treatment of diseases and clinical conditions associated with KIAA0844. KIAA1952 (Accession XM_054983) is another VGAM1950 host target gene. KIAA1952 BINDING SITE is HOST TARGET binding site found in the 5' untranslated region of mRNA encoded by KIAA1952, corresponding to a HOST TARGET binding site such as BINDING SITE I, BINDING SITE II or BINDING SITE III. Table 2 illustrates the complementarity of the nucleotide sequences of KIAA1952 BINDING SITE, designated SEQ ID:36220, to the nucleotide sequence of VGAM1950 RNA, herein designated VGAM RNA, also designated SEQ ID:4661.

Another function of VGAM1950 is therefore inhibition of KIAA1952 (Accession XM_054983). Accordingly, utilities of VGAM1950 include diagnosis, prevention and treatment of diseases and clinical conditions associated with KIAA1952. Lipase, Endothelial (LIPG, Accession NM_006033) is another VGAM1950 host target gene. LIPG BINDING SITE is HOST TARGET binding site found in the 3' untranslated region of mRNA encoded by LIPG, corresponding to a HOST TARGET binding site such as BINDING SITE I, BINDING SITE II or BINDING SITE III. Table 2 illustrates the complementarity of the nucleotide sequences of LIPG BINDING SITE, designated SEQ ID:12655, to the nucleotide sequence of VGAM1950 RNA, herein designated VGAM RNA, also designated SEQ ID:4661.

Another function of VGAM1950 is therefore inhibition of Lipase, Endothelial (LIPG, Accession NM_006033). Accordingly, utilities of VGAM1950 include diagnosis, prevention and treatment of diseases and clinical conditions associated with LIPG. Mitochondrial Ribosomal Protein S10 (MRPS10, Accession NM_018141) is another VGAM1950 host target gene. MRPS10 BINDING SITE is HOST TARGET binding site found in the 3' untranslated region of mRNA encoded by MRPS10, corresponding to a HOST TARGET binding site such as BINDING SITE I, BINDING SITE II or BINDING SITE III. Table 2 illustrates the complementarity of the nucleotide sequences of MRPS10 BINDING SITE, designated SEQ ID:19940, to the nucleotide sequence of VGAM1950 RNA, herein designated VGAM RNA, also designated SEQ ID:4661.

Another function of VGAM1950 is therefore inhibition of Mitochondrial Ribosomal Protein S10 (MRPS10, Accession NM_018141). Accordingly, utilities of VGAM1950 include diagnosis, prevention and treatment of diseases and clinical conditions associated with MRPS10. Zinc Finger Protein 297B (ZNF297B, Accession NM_014007) is another VGAM1950 host target gene. ZNF297B BINDING SITE is HOST TARGET binding site found in the 5' untranslated region of mRNA encoded by ZNF297B, corresponding to a HOST TARGET binding site such as BINDING SITE I, BINDING SITE II or BINDING SITE III. Table 2 illustrates the complementarity of the nucleotide sequences of ZNF297B BINDING SITE, designated SEQ ID:15222, to the nucleotide sequence of VGAM1950 RNA, herein designated VGAM RNA, also designated SEQ ID:4661.

Another function of VGAM1950 is therefore inhibition of Zinc Finger Protein 297B (ZNF297B, Accession NM_014007). Accordingly, utilities of VGAM1950 include diagnosis, prevention and treatment of diseases and clinical conditions associated with ZNF297B. LOC113523 (Accession XM_054378) is another VGAM1950 host target gene. LOC113523 BINDING SITE is HOST TARGET binding site found in the 3' untranslated region of mRNA encoded by LOC113523, corresponding to a HOST TARGET binding site such as BINDING SITE I, BINDING SITE II or BINDING SITE III. Table 2 illustrates the complementarity of the nucleotide sequences of LOC113523 BINDING SITE, designated SEQ ID:36153, to the nucleotide sequence of VGAM1950 RNA, herein designated VGAM RNA, also designated SEQ ID:4661.

Another function of VGAM1950 is therefore inhibition of LOC113523 (Accession XM_054378). Accordingly, utilities of VGAM1950 include diagnosis, prevention and treatment of diseases and clinical conditions associated with LOC113523. LOC145387 (Accession XM_096791) is another VGAM1950 host target gene. LOC145387 BINDING SITE is HOST TARGET binding site found in the 3' untranslated region of mRNA encoded by LOC145387, corresponding to a HOST TARGET binding site such as BINDING SITE I, BINDING SITE II or BINDING SITE III. Table 2 illustrates the complementarity of the nucleotide sequences of LOC145387 BINDING SITE, designated SEQ ID:40539, to the nucleotide sequence of VGAM1950 RNA, herein designated VGAM RNA, also designated SEQ ID:4661.

Another function of VGAM1950 is therefore inhibition of LOC145387 (Accession XM_096791). Accordingly, utilities of VGAM1950 include diagnosis, prevention and treatment of diseases and clinical conditions associated with LOC145387. LOC153577 (Accession XM_098394) is another VGAM1950 host target gene. LOC153577 BINDING SITE is HOST TARGET binding site found in the 5' untranslated region of mRNA encoded by LOC153577, corresponding to a HOST TARGET binding site such as BINDING SITE I, BINDING SITE II or BINDING SITE III. Table 2 illustrates the complementarity of the nucleotide sequences of LOC153577 BINDING SITE, designated SEQ ID:41645, to the nucleotide sequence of VGAM1950 RNA, herein designated VGAM RNA, also designated SEQ ID:4661.

Another function of VGAM1950 is therefore inhibition of LOC153577 (Accession XM_098394). Accordingly, utilities of VGAM1950 include diagnosis, prevention and treatment of diseases and clinical conditions associated with LOC153577. LOC199733 (Accession XM_117123) is another VGAM1950 host target gene. LOC199733 BINDING SITE is HOST TARGET binding site found in the 3' untranslated region of mRNA encoded by LOC199733, corresponding to a HOST TARGET binding site such as BINDING SITE I, BINDING SITE II or BINDING SITE III. Table 2 illustrates the complementarity of the nucleotide sequences of LOC199733 BINDING SITE, designated SEQ ID:43246, to the nucleotide sequence of VGAM1950 RNA, herein designated VGAM RNA, also designated SEQ ID:4661.

Another function of VGAM1950 is therefore inhibition of LOC199733 (Accession XM_117123). Accordingly, utilities of VGAM1950 include diagnosis, prevention and treatment of diseases and clinical conditions associated with LOC199733. LOC221822 (Accession XM_167268) is another VGAM1950 host target gene. LOC221822 BINDING SITE is HOST TARGET binding site found in the 5' untranslated region of mRNA encoded by LOC221822, corresponding to a HOST TARGET binding site such as BINDING SITE I, BINDING SITE II or BINDING SITE III. Table 2 illustrates the complementarity of the nucleotide sequences of LOC221822 BINDING SITE, designated SEQ ID:44624, to the nucleotide sequence of VGAM1950 RNA, herein designated VGAM RNA, also designated SEQ ID:4661.

Another function of VGAM1950 is therefore inhibition of LOC221822 (Accession XM_167268). Accordingly, utilities of VGAM1950 include diagnosis, prevention and treatment of diseases and clinical conditions associated with LOC221822. LOC92973 (Accession XM_048529) is another VGAM1950 host target gene. LOC92973 BINDING SITE is HOST TARGET binding site found in the 5' untranslated region of mRNA encoded by LOC92973, corresponding to a HOST TARGET binding site such as BINDING SITE I, BINDING SITE II or BINDING SITE III. Table 2 illustrates the complementarity of the nucleotide sequences of LOC92973 BINDING SITE, designated SEQ ID:35187, to the nucleotide sequence of VGAM1950 RNA, herein designated VGAM RNA, also designated SEQ ID:4661.

Another function of VGAM1950 is therefore inhibition of LOC92973 (Accession XM_048529). Accordingly, utilities of VGAM1950 include diagnosis, prevention and treatment of diseases and clinical conditions associated with LOC92973. FIG. 1 further provides a conceptual description of a novel bioinformatically detected viral gene of the present invention, referred to here as Viral Genomic Address Messenger 1951 (VGAM1951) viral gene, which modulates expression of respective host target genes thereof, the function and utility of which host target genes is known in the art.

VGAM1951 is a novel bioinformatically detected regulatory, non protein coding, viral micro RNA (miRNA) gene. The method by which VGAM1951 was detected is described hereinabove with reference to FIGS. 1-8.

VGAM1951 gene, herein designated VGAM GENE, is a viral gene contained in the genome of Avian Paramyxovirus 6. VGAM1951 host target gene, herein designated VGAM HOST TARGET GENE, is a human gene contained in the human genome.

VGAM1951 gene encodes a VGAM1951 precursor RNA, herein designated VGAM PRECURSOR RNA. Similar to other miRNA genes, and unlike most ordinary genes, VGAM1951 precursor RNA does not encode a protein. A nucleotide sequence identical or highly similar to the nucleotide sequence of VGAM1951 precursor RNA is designated SEQ ID:1937, and is provided hereinbelow with reference to the sequence listing part. Nucleotide sequence SEQ ID:1937 is located at position 5552 relative to the genome of Avian Paramyxovirus 6.

VGAM1951 precursor RNA folds onto itself, forming VGAM1951 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1951 folded precursor RNA into VGAM1951 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 46%) nucleotide sequence of VGAM1951 RNA is designated SEQ ID:4662, and is provided hereinbelow with reference to the sequence listing part.

VGAM1951 host target gene, herein designated VGAM HOST TARGET GENE, encodes a corresponding messenger RNA, VGAM1951 host target RNA, herein designated VGAM HOST TARGET RNA. VGAM1951 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1951 RNA, herein designated VGAM RNA, binds complementarily to one or more host target binding sites located in untranslated regions of VGAM1951 host target RNA, herein designated VGAM HOST TARGET RNA. This complementary binding is due to the fact that the nucleotide sequence of VGAM1951 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1951 RNA, herein designated VGAM RNA, may have a different number of host target binding sites in untranslated regions of a VGAM1951 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1951 RNA, herein designated VGAM RNA, to host target binding sites on VGAM1951 host target RNA, herein designated VGAM HOST TARGET RNA, such as BINDING SITE I, BINDING SITE II and BINDING SITE III, inhibits translation of VGAM1951 host target RNA into VGAM1951 host target protein, herein designated VGAM HOST TARGET PROTEIN. VGAM host target protein is therefore outlined by a broken line.

It is appreciated that VGAM1951 host target gene, herein designated VGAM HOST TARGET GENE, in fact represents a plurality of VGAM1951 host target genes. The mRNA of each one of this plurality of VGAM1951 host target genes comprises one or more host target binding sites, each having a nucleotide sequence which is at least partly complementary to VGAM1951 RNA, herein designated VGAM RNA, and which when bound by VGAM1951 RNA causes inhibition of translation of respective one or more VGAM1951 host target proteins.

It is further appreciated by one skilled in the art that the mode of translational inhibition illustrated by FIG. 1 with specific reference to translational inhibition exerted by VGAM1951 gene, herein designated VGAM GENE, on one or more VGAM1951 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1951 is inhibition of expression of host target genes, as part of a novel viral mechanism of attacking a host. Accordingly, utilities of VGAM1951 include diagnosis, prevention and treatment of viral infection by Avian Paramyxovirus 6. Specific functions, and accordingly utilities, of VGAM1951 correlate with, and may be deduced from, the identity of the host target genes which VGAM1951 binds and inhibits, and the function of these host target genes, as elaborated hereinbelow.

Nucleotide sequences of the VGAM1951 precursor RNA, herein designated VGAM PRECURSOR RNA, and of the 'diced' VGAM1951 RNA, herein designated VGAM RNA, and a schematic representation of the secondary folding of VGAM1951 folded precursor RNA, herein designated VGAM FOLDED PRECURSOR RNA, of VGAM1951 are further described hereinbelow with reference to Table 1.

Nucleotide sequences of host target binding sites, such as BINDING SITE-I, BINDING SITE-II and BINDING SITE-III of FIG. 1, found on VGAM1951 host target RNA, and schematic representation of the complementarity of each of these host target binding sites to VGAM1951 RNA, herein designated VGAM RNA, are described hereinbelow with reference to Table 2.

As mentioned hereinabove with reference to FIG. 1, a function of VGAM1951 gene, herein designated VGAM is inhibition of expression of VGAM1951 target genes. It is appreciated that specific functions, and accordingly utilities, of VGAM1951 correlate with, and may be deduced from, the identity of the target genes which VGAM1951 binds and inhibits, and the function of these target genes, as elaborated hereinbelow.

ATP-binding Cassette, Sub-family B (MDR/TAP), Member 9 (ABCB9, Accession NM_019625) is a VGAM1951 host target gene. ABCB9 BINDING SITE is HOST TARGET binding site found in the 3' untranslated region of mRNA encoded by ABCB9, corresponding to a HOST TARGET binding site such as BINDING SITE I, BINDING SITE II or BINDING SITE III. Table 2 illustrates the complementarity of the nucleotide sequences of ABCB9 BINDING SITE, designated SEQ ID:21241, to the nucleotide sequence of VGAM1951 RNA, herein designated VGAM RNA, also designated SEQ ID:4662.

A function of VGAM1951 is therefore inhibition of ATP-binding Cassette, Sub-family B (MDR/TAP), Member 9 (ABCB9, Accession NM_019625), a gene which ATP binding cassette transporter B9; has transmembrane domain, nucleotide-binding domain with Walker motifs. Accordingly, utilities of VGAM1951 include diagnosis, prevention and treatment of diseases and clinical conditions associated with ABCB9. The function of ABCB9 has been established by previous studies. For background information on the ATP-binding cassette (ABC) family of transporter proteins, see ABCA4 (OMIM Ref. No. 601691). In addition to the 'full' ABC transporters with 2 transmembrane domains and 2 nucleotide-binding domains, there are 'half' proteins that contain only 1 of each domain (e.g., ABCB1; 171050). Full transporters are usually found in the plasma membrane, whereas half transporters are found in subcellular organelles. By searching an EST database and screening a T-lymphoblast cDNA library, Zhang et al. (2000) obtained a cDNA encoding ABCB9. Sequence analysis predicted that the 766-amino acid ABCB9 protein has 10 potential N-terminal transmembrane segments. ABCB9 shares 94% identity with the rodent sequences and is approximately 39% identical to 2 human endoplasmic reticulum half transporters, TAP1 (ABCB2; 170260) and TAP2 (ABCB3; 170261). RT-PCR and genomic sequence analysis established the existence of a splice variant with a 129-bp deletion expressed in testis and brain. Northern blot analysis detected low expression of a 3.7-kb transcript in most tissues tested, with an additional 2.2-kb transcript detected in tissues with relatively high expression, such as testis. Western blot analysis showed expression of a 72-kD nonglycosylated protein, significantly smaller than the predicted mass of 84.5 kD, that was enriched in lysosomes. Immunofluorescence microscopy demonstrated colocalization of ABCB9 with the lysosomal proteins LAMP1 (OMIM Ref. No. 153330) and LAMP2 (OMIM Ref. No. 309060). Immunohistochemical analysis detected ABCB9 expression in Sertoli cells of rodent seminiferous tubules. Allikmets et al. (1996) mapped an EST corresponding to the ABCB9 gene to 12q24.

Full details of the abovementioned studies are described in the following publications, the disclosure of which are hereby incorporated by reference:

Allikmets, R.; Gerrard, B.; Hutchinson, A.; Dean, M.: Characterization of the human ABC superfamily: isolation and mapping of 21 new genes using the expressed sequence tags database. Hum. Molec. Genet. 5:1649-1655, 1996; and Zhang, F.; Zhang, W.; Liu, L.; Fisher, C. L.; Hui, D.; Childs, S.; Dorovini-Zis, K.; Ling, V.: Characterization of ABCB9, an ATP binding cassette protein associated with lysosomes. J.

Further studies establishing the function and utilities of ABCB9 are found in John Hopkins OMIM database record ID 605453, and in sited publications numbered 2822 listed in the bibliography section hereinbelow, which are also hereby incorporated by reference. A Disintegrin and Metalloproteinase Domain 17 (tumor necrosis factor, alpha, converting enzyme) (ADAM17, Accession NM_021832) is another VGAM1951 host target gene. ADAM17 BINDING SITE1 and ADAM17 BINDING SITE2 are HOST TARGET binding sites found in untranslated regions of mRNA encoded by ADAM17, corresponding to HOST TARGET binding sites such as BINDING SITE I, BINDING SITE II or BINDING SITE III. Table 2 illustrates the complementarity of the nucleotide sequences of ADAM17 BINDING SITE1 and ADAM17 BINDING SITE2, designated SEQ ID:22408 and SEQ ID:9155 respectively, to the nucleotide sequence of VGAM1951 RNA, herein designated VGAM RNA, also designated SEQ ID:4662.

Another function of VGAM1951 is therefore inhibition of A Disintegrin and Metalloproteinase Domain 17 (tumor necrosis factor, alpha, converting enzyme) (ADAM17, Accession NM_021832), a gene which member of ADAM family of zinc metalloproteases. Accordingly, utilities of VGAM1951 include diagnosis, prevention and treatment of diseases and clinical conditions associated with ADAM17. The function of ADAM17 and its association with various diseases and clinical conditions, has been established by previous studies, as described hereinabove with reference to VGAM264. Fucosyltransferase 9 (alpha (1,3) Fucosyltransferase) (FUT9, Accession XM_042167) is another VGAM1951 host target gene. FUT9 BINDING SITE is HOST TARGET binding site found in the 3' untranslated region of mRNA encoded by FUT9, corresponding to a HOST TARGET binding site such as BINDING SITE I, BINDING SITE II or BINDING SITE III. Table 2 illustrates the complementarity of the nucleotide sequences of FUT9 BINDING SITE, designated SEQ ID:33698, to the nucleotide sequence of VGAM1951 RNA, herein designated VGAM RNA, also designated SEQ ID:4662.

Another function of VGAM1951 is therefore inhibition of Fucosyltransferase 9 (alpha (1,3) Fucosyltransferase) (FUT9, Accession XM_042167), a gene which catalyzes alpha-1,3 glycosidic linkages. Accordingly, utilities of VGAM1951 include diagnosis, prevention and treatment of diseases and clinical conditions associated with FUT9. The function of FUT9 and its association with various diseases and clinical conditions, has been established by previous studies, as described hereinabove with reference to VGAM206. Chromosome 20 Open Reading Frame 126 (C20orf126, Accession NM_030815) is another VGAM1951 host target gene. C20orf126 BINDING SITE is HOST TARGET binding site found in the 3' untranslated region of mRNA encoded by C20orf126, corresponding to a HOST TARGET binding site such as BINDING SITE I, BINDING SITE II or BINDING SITE III. Table 2 illustrates the complementarity of the nucleotide sequences of C20orf126 BINDING SITE, designated SEQ ID:25135, to the nucleotide sequence of VGAM1951 RNA, herein designated VGAM RNA, also designated SEQ ID:4662.

Another function of VGAM1951 is therefore inhibition of Chromosome 20 Open Reading Frame 126 (C20orf126, Accession NM_030815). Accordingly, utilities of VGAM1951 include diagnosis, prevention and treatment of diseases and clinical conditions associated with C20orf126. Chloride Intracellular Channel 5 (CLIC5, Accession NM_016929) is another VGAM1951 host target gene. CLIC5 BINDING SITE is HOST TARGET binding site found in the 3' untranslated region of mRNA encoded by CLIC5, corresponding to a HOST TARGET binding site such as BINDING SITE I, BINDING SITE II or BINDING SITE III. Table 2 illustrates the complementarity of the nucleotide sequences of CLIC5 BINDING SITE, designated SEQ ID:18846, to the nucleotide sequence of VGAM1951 RNA, herein designated VGAM RNA, also designated SEQ ID:4662.

Another function of VGAM1951 is therefore inhibition of Chloride Intracellular Channel 5 (CLIC5, Accession NM_016929). Accordingly, utilities of VGAM1951 include diagnosis, prevention and treatment of diseases and clinical conditions associated with CLIC5. FLJ31890 (Accession XM_166117) is another VGAM1951 host target gene. FLJ31890 BINDING SITE is HOST TARGET binding site found in the 3' untranslated region of mRNA encoded by FLJ31890, corresponding to a HOST TARGET binding site such as BINDING SITE I, BINDING SITE II or BINDING SITE III. Table 2 illustrates the complementarity of the nucleotide sequences of FLJ31890 BINDING SITE, designated SEQ ID:43894, to the nucleotide sequence of VGAM1951 RNA, herein designated VGAM RNA, also designated SEQ ID:4662.

Another function of VGAM1951 is therefore inhibition of FLJ31890 (Accession XM_166117). Accordingly, utilities of VGAM1951 include diagnosis, prevention and treatment of diseases and clinical conditions associated with FLJ31890. KIAA0365 (Accession XM_086055) is another VGAM1951 host target gene. KIAA0365 BINDING SITE is HOST TARGET binding site found in the 3' untranslated region of mRNA encoded by KIAA0365, corresponding to a HOST TARGET binding site such as BINDING SITE I, BINDING SITE II or BINDING SITE III. Table 2 illustrates the complementarity of the nucleotide sequences of KIAA0365 BINDING SITE, designated SEQ ID:38470, to the nucleotide sequence of VGAM1951 RNA, herein designated VGAM RNA, also designated SEQ ID:4662.

Another function of VGAM1951 is therefore inhibition of KIAA0365 (Accession XM_086055). Accordingly, utilities of VGAM1951 include diagnosis, prevention and treatment of diseases and clinical conditions associated with KIAA0365. PR Domain Containing 13 (PRDM13, Accession NM_021620) is another VGAM1951 host target gene. PRDM13 BINDING SITE is HOST TARGET binding site found in the 3' untranslated region of mRNA encoded by PRDM13, corresponding to a HOST TARGET binding site such as BINDING SITE I, BINDING SITE II or BINDING SITE III. Table 2 illustrates the complementarity of the nucleotide sequences of PRDM13 BINDING SITE, designated SEQ ID:22256, to the nucleotide sequence of VGAM1951 RNA, herein designated VGAM RNA, also designated SEQ ID:4662.

Another function of VGAM1951 is therefore inhibition of PR Domain Containing 13 (PRDM13, Accession NM_021620). Accordingly, utilities of VGAM1951 include diagnosis, prevention and treatment of diseases and clinical conditions associated with PRDM13. LOC143308 (Accession XM_096411) is another VGAM1951 host target gene. LOC143308 BINDING SITE is HOST TARGET binding site found in the 5' untranslated region of mRNA encoded by LOC143308, corresponding to a HOST TARGET binding site such as BINDING SITE I, BINDING SITE II or BINDING SITE III. Table 2 illustrates the complementarity of the nucleotide sequences of LOC143308 BINDING SITE, designated SEQ ID:40347, to the nucleotide sequence of VGAM1951 RNA, herein designated VGAM RNA, also designated SEQ ID:4662.

Another function of VGAM1951 is therefore inhibition of LOC143308 (Accession XM_096411). Accordingly, utilities of VGAM1951 include diagnosis, prevention and treatment of diseases and clinical conditions associated with LOC143308. FIG. 1 further provides a conceptual description of a novel bioinformatically detected viral gene of the present invention, referred to here as Viral Genomic Address Messenger 1952 (VGAM1952) viral gene, which modulates expression of respective host target genes thereof, the function and utility of which host target genes is known in the art.

VGAM1952 is a novel bioinformatically detected regulatory, non protein coding, viral micro RNA (miRNA) gene. The method by which VGAM1952 was detected is described hereinabove with reference to FIGS. 1-8.

VGAM1952 gene, herein designated VGAM GENE, is a viral gene contained in the genome of Avian Paramyxovirus 6. VGAM1952 host target gene, herein designated VGAM HOST TARGET GENE, is a human gene contained in the human genome.

VGAM1952 gene encodes a VGAM1952 precursor RNA, herein designated VGAM PRECURSOR RNA. Similar to other miRNA genes, and unlike most ordinary genes, VGAM1952 precursor RNA does not encode a protein. A nucleotide sequence identical or highly similar to the nucleotide sequence of VGAM1952 precursor RNA is designated SEQ ID:1938, and is provided hereinbelow with reference to the sequence listing part. Nucleotide sequence SEQ ID:1938 is located at position 12992 relative to the genome of Avian Paramyxovirus 6.

VGAM1952 precursor RNA folds onto itself, forming VGAM1952 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1952 folded precursor RNA into VGAM1952 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1952 RNA is designated SEQ ID:4663, and is provided hereinbelow with reference to the sequence listing part.

VGAM1952 host target gene, herein designated VGAM HOST TARGET GENE, encodes a corresponding messenger RNA, VGAM1952 host target RNA, herein designated VGAM HOST TARGET RNA. VGAM1952 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1952 RNA, herein designated VGAM RNA, binds complementarily to one or more host target binding sites located in untranslated regions of VGAM1952 host target RNA, herein designated VGAM HOST TARGET RNA. This complementary binding is due to the fact that the nucleotide sequence of VGAM1952 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1952 RNA, herein designated VGAM RNA, may have a different number of host target binding sites in untranslated regions of a VGAM1952 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1952 RNA, herein designated VGAM RNA, to host target binding sites on VGAM1952 host target RNA, herein designated VGAM HOST TARGET RNA, such as BINDING SITE I, BINDING SITE II and BINDING SITE III, inhibits translation of VGAM1952 host target RNA into VGAM1952 host target protein, herein designated VGAM HOST TARGET PROTEIN. VGAM host target protein is therefore outlined by a broken line.

It is appreciated that VGAM1952 host target gene, herein designated VGAM HOST TARGET GENE, in fact represents a plurality of VGAM1952 host target genes. The mRNA of each one of this plurality of VGAM1952 host target genes comprises one or more host target binding sites, each having a nucleotide sequence which is at least partly complementary to VGAM1952 RNA, herein designated VGAM RNA, and which when bound by VGAM1952 RNA causes inhibition of translation of respective one or more VGAM1952 host target proteins.

It is further appreciated by one skilled in the art that the mode of translational inhibition illustrated by FIG. 1 with specific reference to translational inhibition exerted by VGAM1952 gene, herein designated VGAM GENE, on one or more VGAM1952 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1952 is inhibition of expression of host target genes, as part of a novel viral mechanism of attacking a host. Accordingly, utilities of VGAM1952 include diagnosis, prevention and treatment of viral infection by Avian Paramyxovirus 6. Specific functions, and accordingly utilities, of VGAM1952 correlate with, and may be deduced from, the identity of the host target genes which VGAM1952 binds and inhibits, and the function of these host target genes, as elaborated hereinbelow.

Nucleotide sequences of the VGAM1952 precursor RNA, herein designated VGAM PRECURSOR RNA, and of the 'diced' VGAM1952 RNA, herein designated VGAM RNA, and a schematic representation of the secondary folding of VGAM1952 folded precursor RNA, herein designated VGAM FOLDED PRECURSOR RNA, of VGAM1952 are further described hereinbelow with reference to Table 1.

Nucleotide sequences of host target binding sites, such as BINDING SITE-I, BINDING SITE-II and BINDING SITE-III of FIG. 1, found on VGAM1952 host target RNA, and schematic representation of the complementarity of each of these host target binding sites to VGAM1952 RNA, herein designated VGAM RNA, are described hereinbelow with reference to Table 2.

As mentioned hereinabove with reference to FIG. 1, a function of VGAM1952 gene, herein designated VGAM is inhibition of expression of VGAM1952 target genes. It is appreciated that specific functions, and accordingly utilities, of VGAM1952 correlate with, and may be deduced from, the identity of the target genes which VGAM1952 binds and inhibits, and the function of these target genes, as elaborated hereinbelow.

Cytochrome P450, Subfamily VIIA (cholesterol 7 alpha-monooxygenase), Polypeptide 1 (CYP7A1, Accession NM_000780) is a VGAM1952 host target gene. CYP7A1 BINDING SITE is HOST TARGET binding site found in the 3' untranslated region of mRNA encoded by CYP7A1, corresponding to a HOST TARGET binding site such as BINDING SITE I, BINDING SITE II or BINDING SITE III. Table 2 illustrates the complementarity of the nucleotide sequences of CYP7A1 BINDING SITE, designated SEQ ID:6422, to the nucleotide sequence of VGAM1952 RNA, herein designated VGAM RNA, also designated SEQ ID:4663.

A function of VGAM1952 is therefore inhibition of Cytochrome P450, Subfamily VIIA (cholesterol 7 alpha-monooxygenase), Polypeptide 1 (CYP7A1, Accession NM_000780), a gene which functions in cholesterol and bile acid metabolism . Accordingly, utilities of VGAM1952 include diagnosis, prevention and treatment of diseases and clinical conditions associated with CYP7A1. The function of CYP7A1 and its association with various diseases and clinical conditions, has been established by previous studies, as described hereinabove with reference to VGAM414. F-box and WD-40 Domain Protein 1B (FBXW1B, Accession NM_012300) is another VGAM1952 host target gene. FBXW1B BINDING SITE1 through FBXW1B BINDING SITE3 are HOST TARGET binding sites found in untranslated regions of mRNA encoded by FBXW1B, corresponding to HOST TARGET binding sites such as BINDING SITE I, BINDING SITE II or BINDING SITE III. Table 2 illustrates the complementarity of the nucleotide sequences of FBXW1B BINDING SITE1 through FBXW1B BINDING SITE3, designated SEQ ID:14661, SEQ ID:27363 and SEQ ID:27373 respectively, to the nucleotide sequence of VGAM1952 RNA, herein designated VGAM RNA, also designated SEQ ID:4663.

Another function of VGAM1952 is therefore inhibition of F-box and WD-40 Domain Protein 1B (FBXW1B, Accession NM_012300), a gene which somehow is involved in the process of neuronal cell differentiation or brain development. Accordingly, utilities of VGAM1952 include diagnosis, prevention and treatment of diseases and clinical conditions associated with FBXW1B. The function of FBXW1B and its association with various diseases and clinical conditions, has been established by previous studies, as described hereinabove with reference to VGAM25. Inositol 1,4,5-triphosphate Receptor, Type 2 (ITPR2, Accession NM_002223) is another VGAM1952 host target gene. ITPR2 BINDING SITE is HOST TARGET binding site found in the 3' untranslated region of mRNA encoded by ITPR2, corresponding to a HOST TARGET binding site such as BINDING SITE I, BINDING SITE II or BINDING SITE III. Table 2 illustrates the complementarity of the nucleotide sequences of ITPR2 BINDING SITE, designated SEQ ID:7991, to the nucleotide sequence of VGAM1952 RNA, herein designated VGAM RNA, also designated SEQ ID:4663.

Another function of VGAM1952 is therefore inhibition of Inositol 1,4,5-triphosphate Receptor, Type 2 (ITPR2, Accession NM_002223). Accordingly, utilities of VGAM1952 include diagnosis, prevention and treatment of diseases and clinical conditions associated with ITPR2. FLJ10508 (Accession NM_018118) is another VGAM1952 host target gene. FLJ10508 BINDING SITE is HOST TARGET binding site found in the 3' untranslated region of mRNA encoded by FLJ10508, corresponding to a HOST TARGET binding site such as BINDING SITE I, BINDING SITE II or BINDING SITE III. Table 2 illustrates the complementarity of the nucleotide sequences of FLJ10508 BINDING SITE, designated SEQ ID:19890, to the nucleotide sequence of VGAM1952 RNA, herein designated VGAM RNA, also designated SEQ ID:4663.

Another function of VGAM1952 is therefore inhibition of FLJ10508 (Accession NM_018118). Accordingly, utilities of VGAM1952 include diagnosis, prevention and treatment of diseases and clinical conditions associated with FLJ10508. FLJ13110 (Accession NM_022912) is another VGAM1952 host target gene. FLJ13110 BINDING SITE is HOST TARGET binding site found in the 3' untranslated region of mRNA encoded by FLJ13110, corresponding to a HOST TARGET binding site such as BINDING SITE I, BINDING SITE II or BINDING SITE III. Table 2 illustrates the complementarity of the nucleotide sequences of FLJ13110 BINDING SITE, designated SEQ ID:23221, to the nucleotide sequence of VGAM1952 RNA, herein designated VGAM RNA, also designated SEQ ID:4663.

Another function of VGAM1952 is therefore inhibition of FLJ13110 (Accession NM_022912). Accordingly, utilities of VGAM1952 include diagnosis, prevention and treatment of diseases and clinical conditions associated with FLJ13110. Interleukin 17D (IL17D, Accession NM_138284) is another VGAM1952 host target gene. IL17D BINDING SITE is HOST TARGET binding site found in the 3' untranslated region of mRNA encoded by IL17D, corresponding to a HOST TARGET binding site such as BINDING SITE I, BINDING SITE II or BINDING SITE III. Table 2 illustrates the complementarity of the nucleotide sequences of IL17D BINDING SITE, designated SEQ ID:28701, to the nucleotide sequence of VGAM1952 RNA, herein designated VGAM RNA, also designated SEQ ID:4663.

Another function of VGAM1952 is therefore inhibition of Interleukin 17D (IL17D, Accession NM_138284). Accordingly, utilities of VGAM1952 include diagnosis, prevention and treatment of diseases and clinical conditions associated with IL17D. KIAA1600 (Accession XM_049351) is another VGAM1952 host target gene. KIAA1600 BINDING SITE is HOST TARGET binding site found in the 3' untranslated region of mRNA encoded by KIAA1600, corresponding to a HOST TARGET binding site such as BINDING SITE I, BINDING SITE II or BINDING SITE III. Table 2 illustrates the complementarity of the nucleotide sequences of KIAA1600 BINDING SITE, designated SEQ ID:35393, to the nucleotide sequence of VGAM1952 RNA, herein designated VGAM RNA, also designated SEQ ID:4663.

Another function of VGAM1952 is therefore inhibition of KIAA1600 (Accession XM_049351). Accordingly, utilities of VGAM1952 include diagnosis, prevention and treatment of diseases and clinical conditions associated with KIAA1600. Target of Myb1-like 1 (chicken) (TOM1L1, Accession NM_005486) is another VGAM1952 host target gene. TOM1L1 BINDING SITE is HOST TARGET binding site found in the 3' untranslated region of mRNA encoded by TOM1L1, corresponding to a HOST TARGET binding site such as BINDING SITE I, BINDING SITE II or BINDING SITE III. Table 2 illustrates the complementarity of the nucleotide sequences of TOM1L1 BINDING SITE, designated SEQ ID:11983, to the nucleotide sequence of VGAM1952 RNA, herein designated VGAM RNA, also designated SEQ ID:4663.

Another function of VGAM1952 is therefore inhibition of Target of Myb1-like 1 (chicken) (TOM1L1, Accession NM_005486). Accordingly, utilities of VGAM1952 include diagnosis, prevention and treatment of diseases and clinical conditions associated with TOM1L1. LOC221143 (Accession XM_167986) is another VGAM1952 host target gene. LOC221143 BINDING SITE is HOST TARGET binding site found in the 3' untranslated region of mRNA encoded by LOC221143, corresponding to a HOST TARGET binding site such as BINDING SITE I, BINDING SITE II or BINDING SITE III. Table 2 illustrates the complementarity of the nucleotide sequences of LOC221143 BINDING SITE, designated SEQ ID:44941, to the nucleotide sequence of VGAM1952 RNA, herein designated VGAM RNA, also designated SEQ ID:4663.

Another function of VGAM1952 is therefore inhibition of LOC221143 (Accession XM_167986). Accordingly, utilities of VGAM1952 include diagnosis, prevention and treatment of diseases and clinical conditions associated with LOC221143. FIG. 1 further provides a conceptual description of a novel bioinformatically detected viral gene of the present invention, referred to here as Viral Genomic Address Messenger 1953 (VGAM1953) viral gene, which modulates expression of respective host target genes thereof, the function and utility of which host target genes is known in the art.

VGAM1953 is a novel bioinformatically detected regulatory, non protein coding, viral micro RNA (miRNA) gene. The method by which VGAM1953 was detected is described hereinabove with reference to FIGS. 1-8.

VGAM1953 gene, herein designated VGAM GENE, is a viral gene contained in the genome of Avian Paramyxovirus 6. VGAM1953 host target gene, herein designated VGAM HOST TARGET GENE, is a human gene contained in the human genome.

VGAM1953 gene encodes a VGAM1953 precursor RNA, herein designated VGAM PRECURSOR RNA. Similar to other miRNA genes, and unlike most ordinary genes, VGAM1953 precursor RNA does not encode a protein. A nucleotide sequence identical or highly similar to the nucleotide sequence of VGAM1953 precursor RNA is designated SEQ ID:1939, and is provided hereinbelow with reference to the sequence listing part. Nucleotide sequence SEQ ID:1939 is located at position 3760 relative to the genome of Avian Paramyxovirus 6.

VGAM1953 precursor RNA folds onto itself, forming VGAM1953 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1953 folded precursor RNA into VGAM1953 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1953 RNA is designated SEQ ID:4664, and is provided hereinbelow with reference to the sequence listing part.

VGAM1953 host target gene, herein designated VGAM HOST TARGET GENE, encodes a corresponding messenger RNA, VGAM1953 host target RNA, herein designated VGAM HOST TARGET RNA. VGAM1953 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1953 RNA, herein designated VGAM RNA, binds complementarily to one or more host target binding sites located in untranslated regions of VGAM1953 host target RNA, herein designated VGAM HOST TARGET RNA. This complementary binding is due to the fact that the nucleotide sequence of VGAM1953 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1953 RNA, herein designated VGAM RNA, may have a different number of host target binding sites in untranslated regions of a VGAM1953 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1953 RNA, herein designated VGAM RNA, to host target binding sites on VGAM1953 host target RNA, herein designated VGAM HOST TARGET RNA, such as BINDING SITE I, BINDING SITE II and BINDING SITE III, inhibits translation of VGAM1953 host target RNA into VGAM1953 host target protein, herein designated VGAM HOST TARGET PROTEIN. VGAM host target protein is therefore outlined by a broken line.

It is appreciated that VGAM1953 host target gene, herein designated VGAM HOST TARGET GENE, in fact represents a plurality of VGAM1953 host target genes. The mRNA of each one of this plurality of VGAM1953 host target genes comprises one or more host target binding sites, each having a nucleotide sequence which is at least partly complementary to VGAM1953 RNA, herein designated VGAM RNA, and which when bound by VGAM1953 RNA causes inhibition of translation of respective one or more VGAM1953 host target proteins.

It is further appreciated by one skilled in the art that the mode of translational inhibition illustrated by FIG. 1 with specific reference to translational inhibition exerted by VGAM1953 gene, herein designated VGAM GENE, on one or more VGAM1953 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1953 is inhibition of expression of host target genes, as part of a novel viral mechanism of attacking a host. Accordingly, utilities of VGAM1953 include diagnosis, prevention and treatment of viral infection by Avian Paramyxovirus 6. Specific functions, and accordingly utilities, of VGAM1953 correlate with, and may be deduced from, the identity of the host target genes which VGAM1953 binds and inhibits, and the function of these host target genes, as elaborated hereinbelow.

Nucleotide sequences of the VGAM1953 precursor RNA, herein designated VGAM PRECURSOR RNA, and of the 'diced' VGAM1953 RNA, herein designated VGAM RNA, and a schematic representation of the secondary folding of VGAM1953 folded precursor RNA, herein designated VGAM FOLDED PRECURSOR RNA, of VGAM1953 are further described hereinbelow with reference to Table 1.

Nucleotide sequences of host target binding sites, such as BINDING SITE-I, BINDING SITE-II and BINDING SITE-III of FIG. 1, found on VGAM1953 host target RNA, and schematic representation of the complementarity of each of these host target binding sites to VGAM1953 RNA, herein designated VGAM RNA, are described hereinbelow with reference to Table 2.

As mentioned hereinabove with reference to FIG. 1, a function of VGAM1953 gene, herein designated VGAM is inhibition of expression of VGAM1953 target genes. It is appreciated that specific functions, and accordingly utilities, of VGAM1953 correlate with, and may be deduced from, the identity of the target genes which VGAM1953 binds and inhibits, and the function of these target genes, as elaborated hereinbelow.

Glucose-6-phosphate Dehydrogenase (G6PD, Accession NM_000402) is a VGAM1953 host target gene. G6PD BINDING SITE is HOST TARGET binding site found in the 3' untranslated region of mRNA encoded by G6PD, corresponding to a HOST TARGET binding site such as BINDING SITE I, BINDING SITE II or BINDING SITE III. Table 2 illustrates the complementarity of the nucleotide sequences of G6PD BINDING SITE, designated SEQ ID:5978, to the nucleotide sequence of VGAM1953 RNA, herein designated VGAM RNA, also designated SEQ ID:4664.

A function of VGAM1953 is therefore inhibition of Glucose-6-phosphate Dehydrogenase (G6PD, Accession NM_000402), a gene which produces pentose sugars for nucleic acid synthesis and main producer of nadph reducing power. Accordingly, utilities of VGAM1953 include diagnosis, prevention and treatment of diseases and clinical conditions associated with G6PD. The function of G6PD and its association with various diseases and clinical conditions, has been established by previous studies, as described hereinabove with reference to VGAM1027. PR Domain Containing 2, with ZNF Domain (PRDM2, Accession NM_012231) is another VGAM1953 host target gene. PRDM2 BINDING SITE is HOST TARGET binding site found in the 3' untranslated region of mRNA encoded by PRDM2, corresponding to a HOST TARGET binding site such as BINDING SITE I, BINDING SITE II or BINDING SITE III. Table 2 illustrates the complementarity of the nucleotide sequences of PRDM2 BINDING SITE, designated SEQ ID:14531, to the nucleotide sequence of VGAM1953 RNA, herein designated VGAM RNA, also designated SEQ ID:4664.

Another function of VGAM1953 is therefore inhibition of PR Domain Containing 2, with ZNF Domain (PRDM2, Accession NM_012231), a gene which plays a role in transcriptional regulation during neuronal differentiation and pathogenesis of retinoblastoma. Accordingly, utilities of VGAM1953 include diagnosis, prevention and treatment of diseases and clinical conditions associated with PRDM2. The function of PRDM2 and its association with various diseases and clinical conditions, has been established by previous studies, as described hereinabove with reference to VGAM120. FLJ20257 (Accession NM_019606) is another VGAM1953 host target gene. FLJ20257 BINDING SITE is HOST TARGET binding site found in the 5' untranslated region of mRNA encoded by FLJ20257, corresponding to a HOST TARGET binding site such as BINDING SITE I, BINDING SITE II or BINDING SITE III. Table 2 illustrates the complementarity of the nucleotide sequences of FLJ20257 BINDING SITE, designated SEQ ID:21221, to the nucleotide sequence of VGAM1953 RNA, herein designated VGAM RNA, also designated SEQ ID:4664.

Another function of VGAM1953 is therefore inhibition of FLJ20257 (Accession NM_019606). Accordingly, utilities of VGAM1953 include diagnosis, prevention and treatment of diseases and clinical conditions associated with FLJ20257. KIAA1030 (Accession XM_167789) is another VGAM1953 host target gene. KIAA1030 BINDING SITE is HOST TARGET binding site found in the 3' untranslated region of mRNA encoded by KIAA1030, corresponding to a HOST TARGET binding site such as BINDING SITE I, BINDING SITE II or BINDING SITE III. Table 2 illustrates the complementarity of the nucleotide sequences of KIAA1030 BINDING SITE, designated SEQ ID:44818, to the nucleotide sequence of VGAM1953 RNA, herein designated VGAM RNA, also designated SEQ ID:4664.

Another function of VGAM1953 is therefore inhibition of KIAA1030 (Accession XM_167789). Accordingly, utilities of VGAM1953 include diagnosis, prevention and treatment of diseases and clinical conditions associated with KIAA1030. Phosphodiesterase 8A (PDE8A, Accession XM_031443) is another VGAM1953 host target gene. PDE8A BINDING SITE is HOST TARGET binding site found in the 3' untranslated region of mRNA encoded by PDE8A, corresponding to a HOST TARGET binding site such as BINDING SITE I, BINDING SITE II or BINDING SITE III. Table 2 illustrates the complementarity of the nucleotide sequences of PDE8A BINDING SITE, designated SEQ ID:31379, to the nucleotide sequence of VGAM1953 RNA, herein designated VGAM RNA, also designated SEQ ID:4664.

Another function of VGAM1953 is therefore inhibition of Phosphodiesterase 8A (PDE8A, Accession XM_031443). Accordingly, utilities of VGAM1953 include diagnosis, prevention and treatment of diseases and clinical conditions associated with PDE8A. Paternally Expressed 10 (PEG10, Accession NM_015068) is another VGAM1953 host target gene. PEG10 BINDING SITE is HOST TARGET binding site found in the 3' untranslated region of mRNA encoded by PEG10, corresponding to a HOST TARGET binding site such as BINDING SITE I, BINDING SITE II or BINDING SITE III. Table 2 illustrates the complementarity of the nucleotide sequences of PEG10 BINDING SITE, designated SEQ ID:17428, to the nucleotide sequence of VGAM1953 RNA, herein designated VGAM RNA, also designated SEQ ID:4664.

Another function of VGAM1953 is therefore inhibition of Paternally Expressed 10 (PEG10, Accession NM_015068). Accordingly, utilities of VGAM1953 include diagnosis, prevention and treatment of diseases and clinical conditions associated with PEG10. LOC204084 (Accession XM_115181) is another VGAM1953 host target gene. LOC204084 BINDING SITE1 and LOC204084 BINDING SITE2 are HOST TARGET binding sites found in untranslated regions of mRNA encoded by LOC204084, corresponding to HOST TARGET binding sites such as BINDING SITE I, BINDING SITE II or BINDING SITE III. Table 2 illustrates the complementarity of the nucleotide sequences of LOC204084 BINDING SITE1 and LOC204084 BINDING SITE2, designated SEQ ID:43088 and SEQ ID:43087 respectively, to the nucleotide sequence of VGAM1953 RNA, herein designated VGAM RNA, also designated SEQ ID:4664.

Another function of VGAM1953 is therefore inhibition of LOC204084 (Accession XM_115181). Accordingly, utilities of VGAM1953 include diagnosis, prevention and treatment of diseases and clinical conditions associated with LOC204084. FIG. 1 further provides a conceptual description of a novel bioinformatically detected viral gene of the present invention, referred to here as Viral Genomic Address Messenger 1954 (VGAM1954) viral gene, which modulates expression of respective host target genes thereof, the function and utility of which host target genes is known in the art.

VGAM1954 is a novel bioinformatically detected regulatory, non protein coding, viral micro RNA (miRNA) gene. The method by which VGAM1954 was detected is described hereinabove with reference to FIGS. 1-8.

VGAM1954 gene, herein designated VGAM GENE, is a viral gene contained in the genome of Avian Paramyxovirus 6. VGAM1954 host target gene, herein designated VGAM HOST TARGET GENE, is a human gene contained in the human genome.

VGAM1954 gene encodes a VGAM1954 precursor RNA, herein designated VGAM PRECURSOR RNA. Similar to other miRNA genes, and unlike most ordinary genes, VGAM1954 precursor RNA does not encode a protein. A nucleotide sequence identical or highly similar to the nucleotide sequence of VGAM1954 precursor RNA is designated SEQ ID:1940, and is provided hereinbelow with reference to the sequence listing part. Nucleotide sequence SEQ ID:1940 is located at position 6741 relative to the genome of Avian Paramyxovirus 6.

VGAM1954 precursor RNA folds onto itself, forming VGAM1954 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1954 folded precursor RNA into VGAM1954 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM1954 RNA is designated SEQ ID:4665, and is provided hereinbelow with reference to the sequence listing part.

VGAM1954 host target gene, herein designated VGAM HOST TARGET GENE, encodes a corresponding messenger RNA, VGAM1954 host target RNA, herein designated VGAM HOST TARGET RNA. VGAM1954 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1954 RNA, herein designated VGAM RNA, binds complementarily to one or more host target binding sites located in untranslated regions of VGAM1954 host target RNA, herein designated VGAM HOST TARGET RNA. This complementary binding is due to the fact that the nucleotide sequence of VGAM1954 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1954 RNA, herein designated VGAM RNA, may have a different number of host target binding sites in untranslated regions of a VGAM1954 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1954 RNA, herein designated VGAM RNA, to host target binding sites on VGAM1954 host target RNA, herein designated VGAM HOST TARGET RNA, such as BINDING SITE I, BINDING SITE II and BINDING SITE III, inhibits translation of VGAM1954 host target RNA into VGAM1954 host target protein, herein designated VGAM HOST TARGET PROTEIN. VGAM host target protein is therefore outlined by a broken line.

It is appreciated that VGAM1954 host target gene, herein designated VGAM HOST TARGET GENE, in fact represents a plurality of VGAM1954 host target genes. The mRNA of each one of this plurality of VGAM1954 host target genes comprises one or more host target binding sites, each having a nucleotide sequence which is at least partly complementary to VGAM1954 RNA, herein designated VGAM RNA, and which when bound by VGAM1954 RNA causes inhibition of translation of respective one or more VGAM1954 host target proteins.

It is further appreciated by one skilled in the art that the mode of translational inhibition illustrated by FIG. 1 with specific reference to translational inhibition exerted by VGAM1954 gene, herein designated VGAM GENE, on one or more VGAM1954 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1954 is inhibition of expression of host target genes, as part of a novel viral mechanism of attacking a host. Accordingly, utilities of VGAM1954 include diagnosis, prevention and treatment of viral infection by Avian Paramyxovirus 6. Specific functions, and accordingly utilities, of VGAM1954 correlate with, and may be deduced from, the identity of the host target genes which VGAM1954 binds and inhibits, and the function of these host target genes, as elaborated hereinbelow.

Nucleotide sequences of the VGAM1954 precursor RNA, herein designated VGAM PRECURSOR RNA, and of the 'diced' VGAM1954 RNA, herein designated VGAM RNA, and a schematic representation of the secondary folding of VGAM1954 folded precursor RNA, herein designated VGAM FOLDED PRECURSOR RNA, of VGAM1954 are further described hereinbelow with reference to Table 1.

Nucleotide sequences of host target binding sites, such as BINDING SITE-I, BINDING SITE-II and BINDING SITE-III of FIG. 1, found on VGAM1954 host target RNA, and schematic representation of the complementarity of each of these host target binding sites to VGAM1954 RNA, herein designated VGAM RNA, are described hereinbelow with reference to Table 2.

As mentioned hereinabove with reference to FIG. 1, a function of VGAM1954 gene, herein designated VGAM is inhibition of expression of VGAM1954 target genes. It is appreciated that specific functions, and accordingly utilities, of VGAM1954 correlate with, and may be deduced from, the identity of the target genes which VGAM1954 binds and inhibits, and the function of these target genes, as elaborated hereinbelow.

COX15 Homolog, Cytochrome C Oxidase Assembly Protein (yeast) (COX15, Accession NM_004376) is a VGAM1954 host target gene. COX15 BINDING SITE is HOST TARGET binding site found in the 3' untranslated region of mRNA encoded by COX15, corresponding to a HOST TARGET binding site such as BINDING SITE I, BINDING SITE II or BINDING SITE III. Table 2 illustrates the complementarity of the nucleotide sequences of COX15 BINDING SITE, designated SEQ ID:10599, to the nucleotide sequence of VGAM1954 RNA, herein designated VGAM RNA, also designated SEQ ID:4665.

A function of VGAM1954 is therefore inhibition of COX15 Homolog, Cytochrome C Oxidase Assembly Protein (yeast) (COX15, Accession NM_004376). Accordingly, utilities of VGAM1954 include diagnosis, prevention and treatment of diseases and clinical conditions associated with COX15. Tumor Necrosis Factor Receptor Superfamily, Member 9 (TNFRSF9, Accession NM_001561) is another VGAM1954 host target gene. TNFRSF9 BINDING SITE is HOST TARGET binding site found in the 3' untranslated region of mRNA encoded by TNFRSF9, corresponding to a HOST TARGET binding site such as BINDING SITE I, BINDING SITE II or BINDING SITE III. Table 2 illustrates the complementarity of the nucleotide sequences of TNFRSF9 BINDING SITE, designated SEQ ID:7287, to the nucleotide sequence of VGAM1954 RNA, herein designated VGAM RNA, also designated SEQ ID:4665.

Another function of VGAM1954 is therefore inhibition of Tumor Necrosis Factor Receptor Superfamily, Member 9 (TNFRSF9, Accession NM_001561), a gene which inhibits proliferation of activated T lymphocytes. Accordingly, utilities of VGAM1954 include diagnosis, prevention and treatment of diseases and clinical conditions associated with TNFRSF9. The function of TNFRSF9 has been established by previous studies. Schwarz et al. (1996) reported that ILA inhibits proliferation of activated T lymphocytes and induces programmed cell death. Loo et al. (1997) reported that, unlike its mouse counterpart, human 4-1BB binds only to its ligand, TNFSF9, and not to extracellular matrix proteins such as laminin (see OMIM Ref. No. 150240). The authors attributed this species distinction to sequence differences in the N-terminal laminin-homologous domain of human 4-1BB.

Full details of the abovementioned studies are described in the following publications, the disclosure of which are hereby incorporated by reference:

Loo, D. T.; Chalupny, N. J.; Bajorath, J.; Shuford, W. W.; Mittler, R. S.; Aruffo, A.: Analysis of 4-1BBL and laminin binding to murine 4-1BB, a member of the tumor necrosis factor receptor superfamily, and comparison with human 4-1BB. J. Biol. Chem. 272:6448-6456, 1997; and Schwarz, H.; Arden, K.; Lotz, M.: CD137, a member of the tumor necrosis factor receptor family, is located on chromosome 1p36, in a cluster of related genes, and colocalizes with sever.

Further studies establishing the function and utilities of TNFRSF9 are found in John Hopkins OMIM database record ID 602250, and in sited publications numbered 6205-6210 listed in the bibliography section hereinbelow, which are also hereby incorporated by reference. Chromosome 20 Open Reading Frame 121 (C20orf121, Accession NM_024331) is another VGAM1954 host target gene. C20orf121 BINDING SITE is HOST TARGET binding site found in the 3' untranslated region of mRNA encoded by C20orf121, corresponding to a HOST TARGET binding site such as BINDING SITE I, BINDING SITE II or BINDING SITE III. Table 2 illustrates the complementarity of the nucleotide sequences of C20orf121 BINDING SITE, designated SEQ ID:23627, to the nucleotide sequence of VGAM1954 RNA, herein designated VGAM RNA, also designated SEQ ID:4665.

Another function of VGAM1954 is therefore inhibition of Chromosome 20 Open Reading Frame 121 (C20orf121, Accession NM_024331). Accordingly, utilities of VGAM1954 include diagnosis, prevention and treatment of diseases and clinical conditions associated with C20orf121. Ligand of Numb-protein X (LNX, Accession NM_032622) is another VGAM1954 host target gene. LNX BINDING SITE is HOST TARGET binding site found in the 3' untranslated region of mRNA encoded by LNX, corresponding to a HOST TARGET binding site such as BINDING SITE I, BINDING SITE II or BINDING SITE III. Table 2 illustrates the complementarity of the nucleotide sequences of LNX BINDING SITE, designated SEQ ID:26337, to the nucleotide sequence of VGAM1954 RNA, herein designated VGAM RNA, also designated SEQ ID:4665.

Another function of VGAM1954 is therefore inhibition of Ligand of Numb-protein X (LNX, Accession NM_032622). Accordingly, utilities of VGAM1954 include diagnosis, prevention and treatment of diseases and clinical conditions associated with LNX. LOC202181 (Accession XM_114456) is another VGAM1954 host target gene. LOC202181 BINDING SITE is HOST TARGET binding site found in the 5' untranslated region of mRNA encoded by LOC202181, corresponding to a HOST TARGET binding site such as BINDING SITE I, BINDING SITE II or BINDING SITE III. Table 2 illustrates the complementarity of the nucleotide sequences of LOC202181 BINDING SITE, designated SEQ ID:42967, to the nucleotide sequence of VGAM1954 RNA, herein designated VGAM RNA, also designated SEQ ID:4665.

Another function of VGAM1954 is therefore inhibition of LOC202181 (Accession XM_114456). Accordingly, utilities of VGAM1954 include diagnosis, prevention and treatment of diseases and clinical conditions associated with LOC202181. LOC93206 (Accession XM_049838) is another VGAM1954 host target gene. LOC93206 BINDING SITE is HOST TARGET binding site found in the 3' untranslated region of mRNA encoded by LOC93206, corresponding to a HOST TARGET binding site such as BINDING SITE I, BINDING SITE II or BINDING SITE III. Table 2 illustrates the complementarity of the nucleotide sequences of LOC93206 BINDING SITE, designated SEQ ID:35515, to the nucleotide sequence of VGAM1954 RNA, herein designated VGAM RNA, also designated SEQ ID:4665.

Another function of VGAM1954 is therefore inhibition of LOC93206 (Accession XM_049838). Accordingly, utilities of VGAM1954 include diagnosis, prevention and treatment of diseases and clinical conditions associated with LOC93206. FIG. 1 further provides a conceptual description of a novel bioinformatically detected viral gene of the present invention, referred to here as Viral Genomic Address Messenger 1955 (VGAM1955) viral gene, which modulates expression of respective host target genes thereof, the function and utility of which host target genes is known in the art.

VGAM1955 is a novel bioinformatically detected regulatory, non protein coding, viral micro RNA (miRNA) gene.

The method by which VGAM1955 was detected is described hereinabove with reference to FIGS. 1-8.

VGAM1955 gene, herein designated VGAM GENE, is a viral gene contained in the genome of Macaca Mulatta Rhadinovirus. VGAM1955 host target gene, herein designated VGAM HOST TARGET GENE, is a human gene contained in the human genome.

VGAM1955 gene encodes a VGAM1955 precursor RNA, herein designated VGAM PRECURSOR RNA. Similar to other miRNA genes, and unlike most ordinary genes, VGAM1955 precursor RNA does not encode a protein. A nucleotide sequence identical or highly similar to the nucleotide sequence of VGAM1955 precursor RNA is designated SEQ ID:1941, and is provided hereinbelow with reference to the sequence listing part. Nucleotide sequence SEQ ID:1941 is located at position 6373 relative to the genome of Macaca Mulatta Rhadinovirus.

VGAM1955 precursor RNA folds onto itself, forming VGAM1955 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1955 folded precursor RNA into VGAM1955 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM1955 RNA is designated SEQ ID:4666, and is provided hereinbelow with reference to the sequence listing part.

VGAM1955 host target gene, herein designated VGAM HOST TARGET GENE, encodes a corresponding messenger RNA, VGAM1955 host target RNA, herein designated VGAM HOST TARGET RNA. VGAM1955 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1955 RNA, herein designated VGAM RNA, binds complementarily to one or more host target binding sites located in untranslated regions of VGAM1955 host target RNA, herein designated VGAM HOST TARGET RNA. This complementary binding is due to the fact that the nucleotide sequence of VGAM1955 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1955 RNA, herein designated VGAM RNA, may have a different number of host target binding sites in untranslated regions of a VGAM1955 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1955 RNA, herein designated VGAM RNA, to host target binding sites on VGAM1955 host target RNA, herein designated VGAM HOST TARGET RNA, such as BINDING SITE I, BINDING SITE II and BINDING SITE III, inhibits translation of VGAM1955 host target RNA into VGAM1955 host target protein, herein designated VGAM HOST TARGET PROTEIN. VGAM host target protein is therefore outlined by a broken line.

It is appreciated that VGAM1955 host target gene, herein designated VGAM HOST TARGET GENE, in fact represents a plurality of VGAM1955 host target genes. The mRNA of each one of this plurality of VGAM1955 host target genes comprises one or more host target binding sites, each having a nucleotide sequence which is at least partly complementary to VGAM1955 RNA, herein designated VGAM RNA, and which when bound by VGAM1955 RNA causes inhibition of translation of respective one or more VGAM1955 host target proteins.

It is further appreciated by one skilled in the art that the mode of translational inhibition illustrated by FIG. 1 with specific reference to translational inhibition exerted by VGAM1955 gene, herein designated VGAM GENE, on one or more VGAM1955 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1955 is inhibition of expression of host target genes, as part of a novel viral mechanism of attacking a host. Accordingly, utilities of VGAM1955 include diagnosis, prevention and treatment of viral infection by Macaca Mulatta Rhadinovirus. Specific functions, and accordingly utilities, of VGAM1955 correlate with, and may be deduced from, the identity of the host target genes which VGAM1955 binds and inhibits, and the function of these host target genes, as elaborated hereinbelow.

Nucleotide sequences of the VGAM1955 precursor RNA, herein designated VGAM PRECURSOR RNA, and of the 'diced' VGAM1955 RNA, herein designated VGAM RNA, and a schematic representation of the secondary folding of VGAM1955 folded precursor RNA, herein designated VGAM FOLDED PRECURSOR RNA, of VGAM1955 are further described hereinbelow with reference to Table 1.

Nucleotide sequences of host target binding sites, such as BINDING SITE-I, BINDING SITE-II and BINDING SITE-III of FIG. 1, found on VGAM1955 host target RNA, and schematic representation of the complementarity of each of these host target binding sites to VGAM1955 RNA, herein designated VGAM RNA, are described hereinbelow with reference to Table 2.

As mentioned hereinabove with reference to FIG. 1, a function of VGAM1955 gene, herein designated VGAM is inhibition of expression of VGAM1955 target genes. It is appreciated that specific functions, and accordingly utilities, of VGAM1955 correlate with, and may be deduced from, the identity of the target genes which VGAM1955 binds and inhibits, and the function of these target genes, as elaborated hereinbelow.

Alpha Thalassemia/mental Retardation Syndrome X-linked (RAD54 homolog, S. cerevisiae) (ATRX, Accession NM_000489) is a VGAM1955 host target gene. ATRX BINDING SITE1 and ATRX BINDING SITE2 are HOST TARGET binding sites found in untranslated regions of mRNA encoded by ATRX, corresponding to HOST TARGET binding sites such as BINDING SITE I, BINDING SITE II or BINDING SITE III. Table 2 illustrates the complementarity of the nucleotide sequences of ATRX BINDING SITE1 and ATRX BINDING SITE2, designated SEQ ID:6098 and SEQ ID:28687 respectively, to the nucleotide sequence of VGAM1955 RNA, herein designated VGAM RNA, also designated SEQ ID:4666.

A function of VGAM1955 is therefore inhibition of Alpha Thalassemia/mental Retardation Syndrome X-linked (RAD54 homolog, S. cerevisiae) (ATRX, Accession NM_000489). Accordingly, utilities of VGAM1955 include diagnosis, prevention and treatment of diseases and clinical conditions associated with ATRX. Ceroid-lipofuscinosis, Neuronal 5 (CLN5, Accession NM_006493) is another VGAM1955 host target gene. CLN5 BINDING SITE is HOST TARGET binding site found in the 3' untranslated region of mRNA encoded by CLN5, corresponding to a HOST TARGET binding site such as BINDING SITE I, BINDING SITE II or BINDING SITE III. Table 2 illustrates the complementarity of the nucleotide sequences of CLN5 BINDING SITE, designated SEQ ID:13231, to the nucleotide sequence of VGAM1955 RNA, herein designated VGAM RNA, also designated SEQ ID:4666.

Another function of VGAM1955 is therefore inhibition of Ceroid-lipofuscinosis, Neuronal 5 (CLN5, Accession NM_006493). Accordingly, utilities of VGAM1955 include diagnosis, prevention and treatment of diseases and clinical conditions associated with CLN5. Calponin 2 (CNN2, Accession NM_004368) is another VGAM1955 host target gene. CNN2 BINDING SITE is HOST TARGET binding site found in the 3' untranslated region of mRNA encoded by CNN2, corresponding to a HOST TARGET binding site such as BINDING SITE I, BINDING SITE II or BINDING SITE III. Table 2 illustrates the complementarity of the nucleotide sequences of CNN2 BINDING SITE, designated SEQ ID:10583, to the nucleotide sequence of VGAM1955 RNA, herein designated VGAM RNA, also designated SEQ ID:4666.

Another function of VGAM1955 is therefore inhibition of Calponin 2 (CNN2, Accession NM_004368), a gene which may be involved in the structural organization and/or anchorage of actin filaments. Accordingly, utilities of VGAM1955 include diagnosis, prevention and treatment of diseases and clinical conditions associated with CNN2. The function of CNN2 and its association with various diseases and clinical conditions, has been established by previous studies, as described hereinabove with reference to VGAM1498. Chondroitin Sulfate Proteoglycan 3 (neurocan) (CSPG3, Accession NM_004386) is another VGAM1955 host target gene. CSPG3 BINDING SITE is HOST TARGET binding site found in the 3' untranslated region of mRNA encoded by CSPG3, corresponding to a HOST TARGET binding site such as BINDING SITE I, BINDING SITE II or BINDING SITE III. Table 2 illustrates the complementarity of the nucleotide sequences of CSPG3 BINDING SITE, designated SEQ ID:10616, to the nucleotide sequence of VGAM1955 RNA, herein designated VGAM RNA, also designated SEQ ID:4666.

Another function of VGAM1955 is therefore inhibition of Chondroitin Sulfate Proteoglycan 3 (neurocan) (CSPG3, Accession NM_004386), a gene which may play a role in modulating cell adhesion and migrationn. Accordingly, utilities of VGAM1955 include diagnosis, prevention and treatment of diseases and clinical conditions associated with CSPG3. The function of CSPG3 and its association with various diseases and clinical conditions, has been established by previous studies, as described hereinabove with reference to VGAM634. DMC1 Dosage Suppressor of Mck1 Homolog, Meiosis-specific Homologous Recombination (yeast) (DMC1, Accession NM_007068) is another VGAM1955 host target gene. DMC1 BINDING SITE is HOST TARGET binding site found in the 3' untranslated region of mRNA encoded by DMC1, corresponding to a HOST TARGET binding site such as BINDING SITE I, BINDING SITE II or BINDING SITE III. Table 2 illustrates the complementarity of the nucleotide sequences of DMC1 BINDING SITE, designated SEQ ID:13934, to the nucleotide sequence of VGAM1955 RNA, herein designated VGAM RNA, also designated SEQ ID:4666.

Another function of VGAM1955 is therefore inhibition of DMC1 Dosage Suppressor of Mck1 Homolog, Meiosis-specific Homologous Recombination (yeast) (DMC1, Accession NM_007068). Accordingly, utilities of VGAM1955 include diagnosis, prevention and treatment of diseases and clinical conditions associated with DMC1. DnaJ (Hsp40) Homolog, Subfamily B, Member 9 (DNAJB9, Accession NM_012328) is another VGAM1955 host target gene. DNAJB9 BINDING SITE is HOST TARGET binding site found in the 3' untranslated region of mRNA encoded by DNAJB9, corresponding to a HOST TARGET binding site such as BINDING SITE I, BINDING SITE II or BINDING SITE III. Table 2 illustrates the complementarity of the nucleotide sequences of DNAJB9 BINDING SITE, designated SEQ ID:14719, to the nucleotide sequence of VGAM1955 RNA, herein designated VGAM RNA, also designated SEQ ID:4666.

Another function of VGAM1955 is therefore inhibition of DnaJ (Hsp40) Homolog, Subfamily B, Member 9 (DNAJB9, Accession NM_012328). Accordingly, utilities of VGAM1955 include diagnosis, prevention and treatment of diseases and clinical conditions associated with DNAJB9. Dual Specificity Phosphatase 6 (DUSP6, Accession XM_038308) is another VGAM1955 host target gene. DUSP6 BINDING SITE is HOST TARGET binding site found in the 3' untranslated region of mRNA encoded by DUSP6, corresponding to a HOST TARGET binding site such as BINDING SITE I, BINDING SITE II or BINDING SITE III. Table 2 illustrates the complementarity of the nucleotide sequences of DUSP6 BINDING SITE, designated SEQ ID:32809, to the nucleotide sequence of VGAM1955 RNA, herein designated VGAM RNA, also designated SEQ ID:4666.

Another function of VGAM1955 is therefore inhibition of Dual Specificity Phosphatase 6 (DUSP6, Accession XM_038308), a gene which inactivates map kinases. Accordingly, utilities of VGAM1955 include diagnosis, prevention and treatment of diseases and clinical conditions associated with DUSP6. The function of DUSP6 and its association with various diseases and clinical conditions, has been established by previous studies, as described hereinabove with reference to VGAM1763. DXS1283E (Accession XM_047871) is another VGAM1955 host target gene. DXS1283E BINDING SITE is HOST TARGET binding site found in the 3' untranslated region of mRNA encoded by DXS1283E, corresponding to a HOST TARGET binding site such as BINDING SITE I, BINDING SITE II or BINDING SITE III. Table 2 illustrates the complementarity of the nucleotide sequences of DXS1283E BINDING SITE, designated SEQ ID:35063, to the nucleotide sequence of VGAM1955 RNA, herein designated VGAM RNA, also designated SEQ ID:4666.

Another function of VGAM1955 is therefore inhibition of DXS1283E (Accession XM_047871). Accordingly, utilities of VGAM1955 include diagnosis, prevention and treatment of diseases and clinical conditions associated with DXS1283E. F-box and WD-40 Domain Protein 1B (FBXW1B, Accession NM_012300) is another VGAM1955 host target gene. FBXW1B BINDING SITE1 through FBXW1B BINDING SITE6 are HOST TARGET binding sites found in untranslated regions of mRNA encoded by FBXW1B, corresponding to HOST TARGET binding sites such as BINDING SITE I, BINDING SITE II or BINDING SITE III. Table 2 illustrates the complementarity of the nucleotide sequences of FBXW1B BINDING SITE1 through FBXW1B BINDING SITE6, designated SEQ ID:14665, SEQ ID:27381, SEQ ID:27377, SEQ ID:14669, SEQ ID:27367 and SEQ ID:27371 respectively, to the nucleotide sequence of VGAM1955 RNA, herein designated VGAM RNA, also designated SEQ ID:4666.

Another function of VGAM1955 is therefore inhibition of F-box and WD-40 Domain Protein 1B (FBXW1B, Accession NM_012300), a gene which somehow is involved in the process of neuronal cell differentiation or brain development. Accordingly, utilities of VGAM1955 include diagnosis, prevention and treatment of diseases and clinical conditions associated with FBXW1B. The function of FBXW1B and its association with various diseases and clinical conditions, has been established by previous studies, as described hereinabove with reference to VGAM25. Glyoxalase I (GLO1, Accession NM_006708) is another VGAM1955 host target gene. GLO1 BINDING SITE is HOST TARGET binding site found in the 3' untranslated region of mRNA encoded by GLO1, corresponding to a HOST TARGET binding site such as BINDING SITE I, BINDING SITE II or BINDING SITE III. Table 2 illustrates the complementarity of the nucleotide sequences of GLO1 BINDING SITE, designated SEQ ID:13529, to the nucleotide sequence of VGAM1955 RNA, herein designated VGAM RNA, also designated SEQ ID:4666.

Another function of VGAM1955 is therefore inhibition of Glyoxalase I (GLO1, Accession NM_006708), a gene which converts methylglyoxal and glutathione to S-lactoylglutathione. Accordingly, utilities of VGAM1955 include diagnosis, prevention and treatment of diseases and clinical conditions associated with GLO1. The function of GLO1 and its association with various diseases and clinical conditions, has been established by previous studies, as described hereinabove with reference to VGAM786. Insulin Receptor Substrate 2 (IRS2, Accession XM_007095) is another VGAM1955 host target gene. IRS2 BINDING SITE is HOST TARGET binding site found in the 3' untranslated region of mRNA encoded by IRS2, corresponding to a HOST TARGET binding site such as BINDING SITE I, BINDING SITE II or BINDING SITE III. Table 2 illustrates the complementarity of the nucleotide sequences of IRS2 BINDING SITE, designated SEQ ID:30032, to the nucleotide sequence of VGAM1955 RNA, herein designated VGAM RNA, also designated SEQ ID:4666.

Another function of VGAM1955 is therefore inhibition of Insulin Receptor Substrate 2 (IRS2, Accession XM_007095), a gene which may mediate the control of various cellular processes by insulin. Accordingly, utilities of VGAM1955 include diagnosis, prevention and treatment of diseases and clinical conditions associated with IRS2. The function of IRS2 and its association with various diseases and clinical conditions, has been established by previous studies, as described hereinabove with reference to VGAM1217. Junctional Adhesion Molecule 3 (JAM3, Accession NM_032801) is another VGAM1955 host target gene. JAM3 BINDING SITE is HOST TARGET binding site found in the 3' untranslated region of mRNA encoded by JAM3, corresponding to a HOST TARGET binding site such as BINDING SITE I, BINDING SITE II or BINDING SITE III. Table 2 illustrates the complementarity of the nucleotide sequences of JAM3 BINDING SITE, designated SEQ ID:26554, to the nucleotide sequence of VGAM1955 RNA, herein designated VGAM RNA, also designated SEQ ID:4666.

Another function of VGAM1955 is therefore inhibition of Junctional Adhesion Molecule 3 (JAM3, Accession NM_032801), a gene which is a member of the junctional adhesion molecule protein family. Accordingly, utilities of VGAM1955 include diagnosis, prevention and treatment of diseases and clinical conditions associated with JAM3. The function of JAM3 and its association with various diseases and clinical conditions, has been established by previous studies, as described hereinabove with reference to VGAM200. Low Density Lipoprotein Receptor-related Protein 8, Apolipoprotein E Receptor (LRP8, Accession NM_004631) is another VGAM1955 host target gene. LRP8 BINDING SITE1 and LRP8 BINDING SITE2 are HOST TARGET binding sites found in untranslated regions of mRNA encoded by LRP8, corresponding to HOST TARGET binding sites such as BINDING SITE I, BINDING SITE II or BINDING SITE III. Table 2 illustrates the complementarity of the nucleotide sequences of LRP8 BINDING SITE1 and LRP8 BINDING SITE2, designated SEQ ID:11007 and SEQ ID:27131 respectively, to the nucleotide sequence of VGAM1955 RNA, herein designated VGAM RNA, also designated SEQ ID:4666.

Another function of VGAM1955 is therefore inhibition of Low Density Lipoprotein Receptor-related Protein 8, Apolipoprotein E Receptor (LRP8, Accession NM_004631), a gene which binds vldl and transports it into cells by endocytosis. Accordingly, utilities of VGAM1955 include diagnosis, prevention and treatment of diseases and clinical conditions associated with LRP8. The function of LRP8 and its association with various diseases and clinical conditions, has been established by previous studies, as described hereinabove with reference to VGAM191. Neural Precursor Cell Expressed, Developmentally Down-regulated 4 (NEDD4, Accession XM_046129) is another VGAM1955 host target gene. NEDD4 BINDING SITE is HOST TARGET binding site found in the 3' untranslated region of mRNA encoded by NEDD4, corresponding to a HOST TARGET binding site such as BINDING SITE I, BINDING SITE II or BINDING SITE III. Table 2 illustrates the complementarity of the nucleotide sequences of NEDD4 BINDING SITE, designated SEQ ID:34694, to the nucleotide sequence of VGAM1955 RNA, herein designated VGAM RNA, also designated SEQ ID:4666.

Another function of VGAM1955 is therefore inhibition of Neural Precursor Cell Expressed, Developmentally Down-regulated 4 (NEDD4, Accession XM_046129), a gene which ubiquitinates regulatory proteins involved in transcription. Accordingly, utilities of VGAM1955 include diagnosis, prevention and treatment of diseases and clinical conditions associated with NEDD4. The function of NEDD4 and its association with various diseases and clinical conditions, has been established by previous studies, as described hereinabove with reference to VGAM209. Protocadherin Alpha 9 (PCDHA9, Accession NM_014005) is another VGAM1955 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:15217, to the nucleotide sequence of VGAM1955 RNA, herein designated VGAM RNA, also designated SEQ ID:4666.

Another function of VGAM1955 is therefore inhibition of Protocadherin Alpha 9 (PCDHA9, Accession NM_014005), a gene which is a calcium-dependent cell-adhesion protein. Accordingly, utilities of VGAM1955 include diagnosis, prevention and treatment of diseases and clinical conditions associated with PCDHA9. The function of PCDHA9 and its association with various diseases and clinical conditions, has been established by previous studies, as described hereinabove with reference to VGAM71. Polycystic Kidney Disease (polycystin) and REJ (sperm receptor for egg jelly homolog, sea urchin)-like (PKDREJ, Accession NM_006071) is another VGAM1955 host target gene. PKDREJ BINDING SITE is HOST TARGET binding site found in the 3' untranslated region of mRNA encoded by PKDREJ, corresponding to a HOST TARGET binding site such as BINDING SITE I, BINDING SITE II or BINDING SITE III. Table 2 illustrates the complementarity of the nucleotide sequences of PKDREJ BINDING SITE, designated SEQ ID:12716, to the nucleotide sequence of VGAM1955 RNA, herein designated VGAM RNA, also designated SEQ ID:4666.

Another function of VGAM1955 is therefore inhibition of Polycystic Kidney Disease (polycystin) and REJ (sperm receptor for egg jelly homolog, sea urchin)-like (PKDREJ, Accession NM_006071), a gene which may intervene in fertilization. Accordingly, utilities of VGAM1955 include diagnosis, prevention and treatment of diseases and clinical conditions associated with PKDREJ. The function of PKDREJ and its association with various diseases and clinical conditions, has been established by previous studies, as described hereinabove with reference to VGAM641. Prion Protein (p27-30) (Creutzfeld-Jakob disease, Gerstmann-Strausler-Scheinker syndrome, fatal familial insomnia) (PRNP, Accession NM_000311) is another VGAM1955 host target gene. PRNP BINDING SITE is HOST TARGET binding site found in the 3' untranslated region of mRNA encoded by PRNP, corresponding to a HOST TARGET binding site such as BINDING SITE I, BINDING SITE II or BINDING SITE III. Table 2 illustrates the complementarity of the nucleotide sequences of PRNP BINDING SITE, designated SEQ ID:5848, to the nucleotide sequence of VGAM1955 RNA, herein designated VGAM RNA, also designated SEQ ID:4666.

Another function of VGAM1955 is therefore inhibition of Prion Protein (p27-30) (Creutzfeld-Jakob disease, Gerstmann-Strausler-Scheinker syndrome, fatal familial insomnia) (PRNP, Accession NM_000311), a gene which the function of prp is not known. prp is encoded in the host genome and is expressed both in normal and infected cells. Accordingly, utilities of VGAM1955 include diagnosis, prevention and treatment of diseases and clinical conditions associated with PRNP. The function of PRNP and its association with various diseases and clinical conditions, has been established by previous studies, as described hereinabove with reference to VGAM669. RAB1A, Member RAS Oncogene Family (RAB1A, Accession XM_046674) is another VGAM1955 host target gene. RAB1A BINDING SITE is HOST TARGET binding site found in the 3' untranslated region of mRNA encoded by RAB1A, corresponding to a HOST TARGET binding site such as BINDING SITE I, BINDING SITE II or BINDING SITE III. Table 2 illustrates the complementarity of the nucleotide sequences of RAB1A BINDING SITE, designated SEQ ID:34788, to the nucleotide sequence of VGAM1955 RNA, herein designated VGAM RNA, also designated SEQ ID:4666.

Another function of VGAM1955 is therefore inhibition of RAB1A, Member RAS Oncogene Family (RAB1A, Accession XM_046674), a gene which is involved in vesicle transport. Accordingly, utilities of VGAM1955 include diagnosis, prevention and treatment of diseases and clinical conditions associated with RAB1A. The function of RAB1A and its association with various diseases and clinical conditions, has been established by previous studies, as described hereinabove with reference to VGAM433. RNA (guanine-7-) Methyltransferase (RNMT, Accession NM_003799) is another VGAM1955 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9894, to the nucleotide sequence of VGAM1955 RNA, herein designated VGAM RNA, also designated SEQ ID:4666.

Another function of VGAM1955 is therefore inhibition of RNA (guanine-7-) Methyltransferase (RNMT, Accession NM_003799), a gene which catalyzes the methylation of GpppN- at the guanine N7 position. Accordingly, utilities of VGAM1955 include diagnosis, prevention and treatment of diseases and clinical conditions associated with RNMT. The function of RNMT and its association with various diseases and clinical conditions, has been established by previous studies, as described hereinabove with reference to VGAM178. RNTRE (Accession NM_014688) is another VGAM1955 host target gene. RNTRE BINDING SITE is HOST TARGET binding site found in the 3' untranslated region of mRNA encoded by RNTRE, corresponding to a HOST TARGET binding site such as BINDING SITE I, BINDING SITE II or BINDING SITE III. Table 2 illustrates the complementarity of the nucleotide sequences of RNTRE BINDING SITE, designated SEQ ID:16191, to the nucleotide sequence of VGAM1955 RNA, herein designated VGAM RNA, also designated SEQ ID:4666.

Another function of VGAM1955 is therefore inhibition of RNTRE (Accession NM_014688), a gene which may be involved in cell proliferation. Accordingly, utilities of VGAM1955 include diagnosis, prevention and treatment of diseases and clinical conditions associated with RNTRE. The function of RNTRE and its association with various diseases and clinical conditions, has been established by previous studies, as described hereinabove with reference to VGAM379. Solute Carrier Family 4, Sodium Bicarbonate Cotransporter, Member 7 (SLC4A7, Accession NM_003615) is another VGAM1955 host target gene. SLC4A7 BINDING SITE is HOST TARGET binding site found in the 3' untranslated region of mRNA encoded by SLC4A7, corresponding to a HOST TARGET binding site such as BINDING SITE I, BINDING SITE II or BINDING SITE III. Table 2 illustrates the complementarity of the nucleotide sequences of SLC4A7 BINDING SITE, designated SEQ ID:9675, to the nucleotide sequence of VGAM1955 RNA, herein designated VGAM RNA, also designated SEQ ID:4666.

Another function of VGAM1955 is therefore inhibition of Solute Carrier Family 4, Sodium Bicarbonate Cotransporter, Member 7 (SLC4A7, Accession NM_003615), a gene which mediates the coupled movement of sodium and bicarbonate ions across the plasma membrane. Accordingly, utilities of VGAM1955 include diagnosis, prevention and treatment of diseases and clinical conditions associated with SLC4A7. The function of SLC4A7 and its association with various diseases and clinical conditions, has been established by previous studies, as described hereinabove with reference to VGAM66. Sclerosteosis (SOST, Accession NM_025237) is another VGAM1955 host target gene. SOST BINDING SITE is HOST TARGET binding site found in the 3" untranslated region of mRNA encoded by SOST, corresponding to a HOST TARGET binding site such as BINDING SITE I, BINDING SITE II or BINDING SITE III. Table 2 illustrates the complementarity of the nucleotide sequences of SOST BINDING SITE, designated SEQ ID:24919, to the nucleotide sequence of VGAM1955 RNA, herein designated VGAM RNA, also designated SEQ ID:4666.

Another function of VGAM1955 is therefore inhibition of Sclerosteosis (SOST, Accession NM_025237). Accordingly, utilities of VGAM1955 include diagnosis, prevention and treatment of diseases and clinical conditions associated with SOST. TAP Binding Protein (tapasin) (TAPBP, Accession NM_003190) is another VGAM1955 host target gene. TAPBP BINDING SITE is HOST TARGET binding site found in the 3' untranslated region of mRNA encoded by TAPBP, corresponding to a HOST TARGET binding site such as BINDING SITE I, BINDING SITE II or BINDING SITE III. Table 2 illustrates the complementarity of the nucleotide sequences of TAPBP BINDING SITE, designated SEQ ID:9185, to the nucleotide sequence of VGAM1955 RNA, herein designated VGAM RNA, also designated SEQ ID:4666.

Another function of VGAM1955 is therefore inhibition of TAP Binding Protein (tapasin) (TAPBP, Accession NM_003190), a gene which is involved in MHC class I-restricted antigen processing. Accordingly, utilities of VGAM1955 include diagnosis, prevention and treatment of diseases and clinical conditions associated with TAPBP. The function of TAPBP and its association with various diseases and clinical conditions, has been established by previous studies, as described hereinabove with reference to VGAM122. TOX (Accession NM_014729) is another VGAM1955 host target gene. TOX BINDING SITE is HOST TARGET binding site found in the 3' untranslated region of mRNA encoded by TOX, corresponding to a HOST TARGET binding site such as BINDING SITE I, BINDING SITE II or BINDING SITE III. Table 2 illustrates the complementarity of the nucleotide sequences of TOX BINDING SITE, designated SEQ ID:16326, to the nucleotide sequence of VGAM1955 RNA, herein designated VGAM RNA, also designated SEQ ID:4666.

Another function of VGAM1955 is therefore inhibition of TOX (Accession NM_014729). Accordingly, utilities of VGAM1955 include diagnosis, prevention and treatment of diseases and clinical conditions associated with TOX. 5T4 (Accession NM_006670) is another VGAM1955 host target gene. 5T4 BINDING SITE is HOST TARGET binding site found in the 3' untranslated region of mRNA encoded by 5T4, corresponding to a HOST TARGET binding site such as BINDING SITE I, BINDING SITE II or BINDING SITE III. Table 2 illustrates the complementarity of the nucleotide sequences of 5T4 BINDING SITE, designated SEQ ID:13486, to the nucleotide sequence of VGAM1955 RNA, herein designated VGAM RNA, also designated SEQ ID:4666.

Another function of VGAM1955 is therefore inhibition of 5T4 (Accession NM_006670). Accordingly, utilities of VGAM1955 include diagnosis, prevention and treatment of diseases and clinical conditions associated with 5T4. Abhydrolase Domain Containing 3 (ABHD3, Accession NM_138340) is another VGAM1955 host target gene. ABHD3 BINDING SITE is HOST TARGET binding site found in the 3' untranslated region of mRNA encoded by ABHD3, corresponding to a HOST TARGET binding site such as BINDING SITE I, BINDING SITE II or BINDING SITE III. Table 2 illustrates the complementarity of the nucleotide sequences of ABHD3 BINDING SITE, designated SEQ ID:28741, to the nucleotide sequence of VGAM1955 RNA, herein designated VGAM RNA, also designated SEQ ID:4666.

Another function of VGAM1955 is therefore inhibition of Abhydrolase Domain Containing 3 (ABHD3, Accession NM_138340). Accordingly, utilities of VGAM1955 include diagnosis, prevention and treatment of diseases and clinical conditions associated with ABHD3. Acetyl-Coenzyme A Synthetase 2 (AMP forming)-like (ACAS2L, Accession XM_042770) is another VGAM1955 host target gene. ACAS2L BINDING SITE is HOST TARGET binding site found in the 3' untranslated region of mRNA encoded by ACAS2L, corresponding to a HOST TARGET binding site such as BINDING SITE I, BINDING SITE II or BINDING SITE III. Table 2 illustrates the complementarity of the nucleotide sequences of ACAS2L BINDING SITE, designated SEQ ID:33767, to the nucleotide sequence of VGAM1955 RNA, herein designated VGAM RNA, also designated SEQ ID:4666.

Another function of VGAM1955 is therefore inhibition of Acetyl-Coenzyme A Synthetase 2 (AMP forming)-like (ACAS2L, Accession XM_042770). Accordingly, utilities of VGAM1955 include diagnosis, prevention and treatment of diseases and clinical conditions associated with ACAS2L. Rho GTPase Activating Protein 5 (ARHGAP5, Accession XM_085082) is another VGAM1955 host target gene. ARHGAP5 BINDING SITE is HOST TARGET binding site found in the 3' untranslated region of mRNA encoded by ARHGAP5, corresponding to a HOST TARGET binding site such as BINDING SITE I, BINDING SITE II or BINDING SITE III. Table 2 illustrates the complementarity of the nucleotide sequences of ARHGAP5 BINDING SITE, designated SEQ ID:37819, to the nucleotide sequence of VGAM1955 RNA, herein designated VGAM RNA, also designated SEQ ID:4666.

Another function of VGAM1955 is therefore inhibition of Rho GTPase Activating Protein 5 (ARHGAP5, Accession XM_085082). Accordingly, utilities of VGAM1955 include diagnosis, prevention and treatment of diseases and clinical conditions associated with ARHGAP5. BM046 (Accession NM_018460) is another VGAM1955 host target gene. BM046 BINDING SITE is HOST TARGET binding site found in the 3' untranslated region of mRNA encoded by BM046, corresponding to a HOST TARGET binding site such as BINDING SITE I, BINDING SITE II or BINDING SITE III. Table 2 illustrates the complementarity of the nucleotide sequences of BM046 BINDING SITE, designated SEQ ID:20532, to the nucleotide sequence of VGAM1955 RNA, herein designated VGAM RNA, also designated SEQ ID:4666.

Another function of VGAM1955 is therefore inhibition of BM046 (Accession NM_018460). Accordingly, utilities of VGAM1955 include diagnosis, prevention and treatment of diseases and clinical conditions associated with BM046. BPES (Accession NM_023067) is another VGAM1955 host target gene. BPES BINDING SITE is HOST TARGET binding site found in the 3' untranslated region of mRNA encoded by BPES, corresponding to a HOST TARGET binding site such as BINDING SITE I, BINDING SITE II or BINDING SITE III. Table 2 illustrates the complementarity of the nucleotide sequences of BPES BINDING SITE, designated SEQ ID:23324, to the nucleotide sequence of VGAM1955 RNA, herein designated VGAM RNA, also designated SEQ ID:4666.

Another function of VGAM1955 is therefore inhibition of BPES (Accession NM_023067). Accordingly, utilities of VGAM1955 include diagnosis, prevention and treatment of diseases and clinical conditions associated with BPES. DJ473B4 (Accession NM_019556) is another VGAM1955 host target gene. DJ473B4 BINDING SITE is HOST TARGET binding site found in the 3' untranslated region of mRNA encoded by DJ473B4, corresponding to a HOST TARGET binding site such as BINDING SITE I, BINDING SITE II or BINDING SITE III. Table 2 illustrates the complementarity of the nucleotide sequences of DJ473B4 BINDING SITE, designated SEQ ID:21212, to the nucleotide sequence of VGAM1955 RNA, herein designated VGAM RNA, also designated SEQ ID:4666.

Another function of VGAM1955 is therefore inhibition of DJ473B4 (Accession NM_019556). Accordingly, utilities of VGAM1955 include diagnosis, prevention and treatment of diseases and clinical conditions associated with DJ473B4. DJ971N18.2 (Accession NM_021156) is another VGAM1955 host target gene. DJ971N18.2 BINDING SITE is HOST TARGET binding site found in the 3' untranslated region of mRNA encoded by DJ971N18.2, corresponding to a HOST TARGET binding site such as BINDING SITE I, BINDING SITE II or BINDING SITE III. Table 2 illustrates the complementarity of the nucleotide sequences of DJ971N18.2 BINDING SITE, designated SEQ ID:22136, to the nucleotide sequence of VGAM1955 RNA, herein designated VGAM RNA, also designated SEQ ID:4666.

Another function of VGAM1955 is therefore inhibition of DJ971N18.2 (Accession NM_021156). Accordingly, utilities of VGAM1955 include diagnosis, prevention and treatment of diseases and clinical conditions associated with DJ971N18.2. DKFZP434E2318 (Accession NM_032138) is another VGAM1955 host target gene. DKFZP434E2318 BINDING SITE is HOST TARGET binding site found in the 3' untranslated region of mRNA encoded by DKFZP434E2318, corresponding to a HOST TARGET binding site such as BINDING SITE I, BINDING SITE II or BINDING SITE III. Table 2 illustrates the complementarity of the nucleotide sequences of DKFZP434E2318 BINDING SITE, designated SEQ ID:25818, to the nucleotide sequence of VGAM1955 RNA, herein designated VGAM RNA, also designated SEQ ID:4666.

Another function of VGAM1955 is therefore inhibition of DKFZP434E2318 (Accession NM_032138). Accordingly, utilities of VGAM1955 include diagnosis, prevention and treatment of diseases and clinical conditions associated with DKFZP434E2318. DKFZP434I1735 (Accession XM_113763) is another VGAM1955 host target gene. DKFZP434I1735 BINDING SITE is HOST TARGET binding site found in the 3' untranslated region of mRNA encoded by DKFZP434I1735, corresponding to a HOST TARGET binding site such as BINDING SITE I, BINDING SITE II or BINDING SITE III. Table 2 illustrates the complementarity of the nucleotide sequences of DKFZP434I1735 BINDING SITE, designated SEQ ID:42423, to the nucleotide sequence of VGAM1955 RNA, herein designated VGAM RNA, also designated SEQ ID:4666.

Another function of VGAM1955 is therefore inhibition of DKFZP434I1735 (Accession XM_113763). Accordingly, utilities of VGAM1955 include diagnosis, prevention and treatment of diseases and clinical conditions associated with DKFZP434I1735. DKFZP434P0721 (Accession XM_033181) is another VGAM1955 host target gene. DKFZP434P0721 BINDING SITE is HOST TARGET binding site found in the 3' untranslated region of mRNA encoded by DKFZP434P0721, corresponding to a HOST TARGET binding site such as BINDING SITE I, BINDING SITE II or BINDING SITE III. Table 2 illustrates the complementarity of the nucleotide sequences of DKFZP434P0721 BINDING SITE, designated SEQ ID:31870, to the nucleotide sequence of VGAM1955 RNA, herein designated VGAM RNA, also designated SEQ ID:4666.

Another function of VGAM1955 is therefore inhibition of DKFZP434P0721 (Accession XM_033181). Accordingly, utilities of VGAM1955 include diagnosis, prevention and treatment of diseases and clinical conditions associated with DKFZP434P0721. DKFZP586M0622 (Accession NM_015583) is another VGAM1955 host target gene. DKFZP586M0622 BINDING SITE is HOST TARGET binding site found in the 5' untranslated region of mRNA encoded by DKFZP586M0622, corresponding to a HOST TARGET binding site such as BINDING SITE I, BINDING SITE II or BINDING SITE III. Table 2 illustrates the complementarity of the nucleotide sequences of DKFZP586M0622 BINDING SITE, designated SEQ ID:17848, to the nucleotide sequence of VGAM1955 RNA, herein designated VGAM RNA, also designated SEQ ID:4666.

Another function of VGAM1955 is therefore inhibition of DKFZP586M0622 (Accession NM_015583). Accordingly, utilities of VGAM1955 include diagnosis, prevention and treatment of diseases and clinical conditions associated with DKFZP586M0622. EFA6R (Accession NM_015310) is another VGAM1955 host target gene. EFA6R BINDING SITE is HOST TARGET binding site found in the 3' untranslated region of mRNA encoded by EFA6R, corresponding to a HOST TARGET binding site such as BINDING SITE I, BINDING SITE II or BINDING SITE III. Table 2 illustrates the complementarity of the nucleotide sequences of EFA6R BINDING SITE, designated SEQ ID:17629, to the nucleotide sequence of VGAM1955 RNA, herein designated VGAM RNA, also designated SEQ ID:4666.

Another function of VGAM1955 is therefore inhibition of EFA6R (Accession NM_015310). Accordingly, utilities of VGAM1955 include diagnosis, prevention and treatment of diseases and clinical conditions associated with EFA6R. ERp44 (Accession XM_088476) is another VGAM1955 host target gene. ERp44 BINDING SITE is HOST TARGET binding site found in the 3' untranslated region of mRNA encoded by ERp44, corresponding to a HOST TARGET binding site such as BINDING SITE I, BINDING SITE II or BINDING SITE III. Table 2 illustrates the complementarity of the nucleotide sequences of ERp44 BINDING SITE, designated SEQ ID:39727, to the nucleotide sequence of VGAM1955 RNA, herein designated VGAM RNA, also designated SEQ ID:4666.

Another function of VGAM1955 is therefore inhibition of ERp44 (Accession XM_088476). Accordingly, utilities of VGAM1955 include diagnosis, prevention and treatment of diseases and clinical conditions associated with ERp44. Formin Homology 2 Domain Containing 2 (FHOD2, Accession XM_057927) is another VGAM1955 host target gene. FHOD2 BINDING SITE is HOST TARGET binding site found in the 3' untranslated region of mRNA encoded by FHOD2, corresponding to a HOST TARGET binding site such as BINDING SITE I, BINDING SITE II or BINDING SITE III. Table 2 illustrates the complementarity of the nucleotide sequences of FHOD2 BINDING SITE, designated SEQ ID:36555, to the nucleotide sequence of VGAM1955 RNA, herein designated VGAM RNA, also designated SEQ ID:4666.

Another function of VGAM1955 is therefore inhibition of Formin Homology 2 Domain Containing 2 (FHOD2, Accession XM_057927). Accordingly, utilities of VGAM1955 include diagnosis, prevention and treatment of diseases and clinical conditions associated with FHOD2. FLJ10008 (Accession NM_017970) is another VGAM1955 host target gene. FLJ10008 BINDING SITE is HOST TARGET binding site found in the 3' untranslated region of mRNA encoded by FLJ10008, corresponding to a HOST TARGET binding site such as BINDING SITE I, BINDING SITE II or BINDING SITE III. Table 2 illustrates the complementarity of the nucleotide sequences of FLJ10008 BINDING SITE, designated SEQ ID:19693, to the nucleotide sequence of VGAM1955 RNA, herein designated VGAM RNA, also designated SEQ ID:4666.

Another function of VGAM1955 is therefore inhibition of FLJ10008 (Accession NM_017970). Accordingly, utilities of VGAM1955 include diagnosis, prevention and treatment of diseases and clinical conditions associated with FLJ10008. FLJ12587 (Accession NM_022480) is another VGAM1955 host target gene. FLJ12587 BINDING SITE is HOST TARGET binding site found in the 3' untranslated region of mRNA encoded by FLJ12587, corresponding to a HOST TARGET binding site such as BINDING SITE I, BINDING SITE II or BINDING SITE III. Table 2 illustrates the complementarity of the nucleotide sequences of FLJ12587 BINDING SITE, designated SEQ ID:22850, to the nucleotide sequence of VGAM1955 RNA, herein designated VGAM RNA, also designated SEQ ID:4666.

Another function of VGAM1955 is therefore inhibition of FLJ12587 (Accession NM_022480). Accordingly, utilities of VGAM1955 include diagnosis, prevention and treatment of diseases and clinical conditions associated with FLJ12587. FLJ13340 (Accession NM_057175) is another VGAM1955 host target gene. FLJ13340 BINDING SITE is HOST TARGET binding site found in the 3' untranslated region of mRNA encoded by FLJ13340, corresponding to a HOST TARGET binding site such as BINDING SITE I, BINDING SITE II or BINDING SITE III. Table 2 illustrates the complementarity of the nucleotide sequences of FLJ13340 BINDING SITE, designated SEQ ID:27705, to the nucleotide sequence of VGAM1955 RNA, herein designated VGAM RNA, also designated SEQ ID:4666.

Another function of VGAM1955 is therefore inhibition of FLJ13340 (Accession NM_057175). Accordingly, utilities of VGAM1955 include diagnosis, prevention and treatment of diseases and clinical conditions associated with FLJ13340. FLJ20276 (Accession NM_017738) is another VGAM1955 host target gene. FLJ20276 BINDING SITE is HOST TARGET binding site found in the 3' untranslated region of mRNA encoded by FLJ20276, corresponding to a HOST TARGET binding site such as BINDING SITE I, BINDING SITE II or BINDING SITE III. Table 2 illustrates the complementarity of the nucleotide sequences of FLJ20276 BINDING SITE, designated SEQ ID:19328, to the nucleotide sequence of VGAM1955 RNA, herein designated VGAM RNA, also designated SEQ ID:4666.

Another function of VGAM1955 is therefore inhibition of FLJ20276 (Accession NM_017738). Accordingly, utilities of VGAM1955 include diagnosis, prevention and treatment of diseases and clinical conditions associated with FLJ20276. FLJ20294 (Accession NM_017749) is another VGAM1955 host target gene. FLJ20294 BINDING SITE is HOST TARGET binding site found in the 3' untranslated region of mRNA encoded by FLJ20294, corresponding to a HOST TARGET binding site such as BINDING SITE I, BINDING SITE II or BINDING SITE III. Table 2 illustrates the complementarity of the nucleotide sequences of FLJ20294 BINDING SITE, designated SEQ ID:19346, to the nucleotide sequence of VGAM1955 RNA, herein designated VGAM RNA, also designated SEQ ID:4666.

Another function of VGAM1955 is therefore inhibition of FLJ20294 (Accession NM_017749). Accordingly, utilities of VGAM1955 include diagnosis, prevention and treatment of diseases and clinical conditions associated with FLJ20294. GT650 (Accession NM_052851) is another VGAM1955 host target gene. GT650 BINDING SITE is HOST TARGET binding site found in the 3' untranslated region of mRNA encoded by GT650, corresponding to a HOST TARGET binding site such as BINDING SITE I, BINDING SITE II or BINDING SITE III. Table 2 illustrates the complementarity of the nucleotide sequences of GT650 BINDING SITE, designated SEQ ID:27435, to the nucleotide sequence of VGAM1955 RNA, herein designated VGAM RNA, also designated SEQ ID:4666.

Another function of VGAM1955 is therefore inhibition of GT650 (Accession NM_052851). Accordingly, utilities of VGAM1955 include diagnosis, prevention and treatment of diseases and clinical conditions associated with GT650. KIAA0447 (Accession XM_049733) is another VGAM1955 host target gene. KIAA0447 BINDING SITE is HOST TARGET binding site found in the 3' untranslated region of mRNA encoded by KIAA0447, corresponding to a HOST TARGET binding site such as BINDING SITE I, BINDING SITE II or BINDING SITE III. Table 2 illustrates the complementarity of the nucleotide sequences of KIAA0447 BINDING SITE, designated SEQ ID:35496, to the nucleotide sequence of VGAM1955 RNA, herein designated VGAM RNA, also designated SEQ ID:4666.

Another function of VGAM1955 is therefore inhibition of KIAA0447 (Accession XM_049733). Accordingly, utilities of VGAM1955 include diagnosis, prevention and treatment of diseases and clinical conditions associated with KIAA0447. KIAA0753 (Accession NM_014804) is another VGAM1955 host target gene. KIAA0753 BINDING SITE is HOST TARGET binding site found in the 3' untranslated region of mRNA encoded by KIAA0753, corresponding to a HOST TARGET binding site such as BINDING SITE I, BINDING SITE II or BINDING SITE III. Table 2 illustrates the complementarity of the nucleotide sequences of KIAA0753 BINDING SITE, designated SEQ ID:16738, to the nucleotide sequence of VGAM1955 RNA, herein designated VGAM RNA, also designated SEQ ID:4666.

Another function of VGAM1955 is therefore inhibition of KIAA0753 (Accession NM_014804). Accordingly, utilities of VGAM1955 include diagnosis, prevention and treatment of diseases and clinical conditions associated with KIAA0753. KIAA0820 (Accession XM_044463) is another VGAM1955 host target gene. KIAA0820 BINDING SITE is HOST TARGET binding site found in the 3' untranslated region of mRNA encoded by KIAA0820, corresponding to a HOST TARGET binding site such as BINDING SITE I, BINDING SITE II or BINDING SITE III. Table 2 illustrates the complementarity of the nucleotide sequences of KIAA0820 BINDING SITE, designated SEQ ID:34223, to the nucleotide sequence of VGAM1955 RNA, herein designated VGAM RNA, also designated SEQ ID:4666.

Another function of VGAM1955 is therefore inhibition of KIAA0820 (Accession XM_044463). Accordingly, utilities of VGAM1955 include diagnosis, prevention and treatment of diseases and clinical conditions associated with KIAA0820. KIAA0836 (Accession XM_035390) is another VGAM1955 host target gene. KIAA0836 BINDING SITE is HOST TARGET binding site found in the 3' untranslated region of mRNA encoded by KIAA0836, corresponding to a HOST TARGET binding site such as BINDING SITE I, BINDING SITE II or BINDING SITE III. Table 2 illustrates the complementarity of the nucleotide sequences of KIAA0836 BINDING SITE, designated SEQ ID:32246, to the nucleotide sequence of VGAM1955 RNA, herein designated VGAM RNA, also designated SEQ ID:4666.

Another function of VGAM1955 is therefore inhibition of KIAA0836 (Accession XM_035390). Accordingly, utilities of VGAM1955 include diagnosis, prevention and treatment of diseases and clinical conditions associated with KIAA0836. KIAA1005 (Accession XM_051197) is another VGAM1955 host target gene. KIAA1005 BINDING SITE is HOST TARGET binding site found in the 3' untranslated region of mRNA encoded by KIAA1005, corresponding to a HOST TARGET binding site such as BINDING SITE I, BINDING SITE II or BINDING SITE III. Table 2 illustrates the complementarity of the nucleotide sequences of KIAA1005 BINDING SITE, designated SEQ ID:35780, to the nucleotide sequence of VGAM1955 RNA, herein designated VGAM RNA, also designated SEQ ID:4666.

Another function of VGAM1955 is therefore inhibition of KIAA1005 (Accession XM_051197). Accordingly, utilities of VGAM1955 include diagnosis, prevention and treatment of diseases and clinical conditions associated with KIAA1005. KIAA1041 (Accession NM_014947) is another VGAM1955 host target gene. KIAA1041 BINDING SITE is HOST TARGET binding site found in the 3' untranslated region of mRNA encoded by KIAA1041, corresponding to a HOST TARGET binding site such as BINDING SITE I, BINDING SITE II or BINDING SITE III. Table 2 illustrates the complementarity of the nucleotide sequences of KIAA1041 BINDING SITE, designated SEQ ID:17268, to the nucleotide sequence of VGAM1955 RNA, herein designated VGAM RNA, also designated SEQ ID:4666.

Another function of VGAM1955 is therefore inhibition of KIAA1041 (Accession NM_014947). Accordingly, utilities of VGAM1955 include diagnosis, prevention and treatment of diseases and clinical conditions associated with KIAA1041. KIAA1468 (Accession XM_166289) is another VGAM1955 host target gene. KIAA1468 BINDING SITE is HOST TARGET binding site found in the 3' untranslated region of mRNA encoded by KIAA1468, corresponding to a HOST TARGET binding site such as BINDING SITE I, BINDING SITE II or BINDING SITE III. Table 2 illustrates the complementarity of the nucleotide sequences of KIAA1468 BINDING SITE, designated SEQ ID:44101, to the nucleotide sequence of VGAM1955 RNA, herein designated VGAM RNA, also designated SEQ ID:4666.

Another function of VGAM1955 is therefore inhibition of KIAA1468 (Accession XM_166289). Accordingly, utilities of VGAM1955 include diagnosis, prevention and treatment of diseases and clinical conditions associated with KIAA1468. KIAA1546 (Accession XM_042301) is another VGAM1955 host target gene. KIAA1546 BINDING SITE is HOST TARGET binding site found in the 3' untranslated region of mRNA encoded by KIAA1546, corresponding to a HOST TARGET binding site such as BINDING SITE I, BINDING SITE II or BINDING SITE III. Table 2 illustrates the complementarity of the nucleotide sequences of KIAA1546 BINDING SITE, designated SEQ ID:33714, to the nucleotide sequence of VGAM1955 RNA, herein designated VGAM RNA, also designated SEQ ID:4666.

Another function of VGAM1955 is therefore inhibition of KIAA1546 (Accession XM_042301). Accordingly, utilities of VGAM1955 include diagnosis, prevention and treatment of diseases and clinical conditions associated with KIAA1546. KIAA1727 (Accession XM_034262) is another VGAM1955 host target gene. KIAA1727 BINDING SITE is HOST TARGET binding site found in the 3' untranslated region of mRNA encoded by KIAA1727, corresponding to a HOST TARGET binding site such as BINDING SITE I, BINDING SITE II or BINDING SITE III. Table 2 illustrates the complementarity of the nucleotide sequences of KIAA1727 BINDING SITE, designated SEQ ID:32039, to the nucleotide sequence of VGAM1955 RNA, herein designated VGAM RNA, also designated SEQ ID:4666.

Another function of VGAM1955 is therefore inhibition of KIAA1727 (Accession XM_034262). Accordingly, utilities of VGAM1955 include diagnosis, prevention and treatment of diseases and clinical conditions associated with KIAA1727. KIAA1764 (Accession XM_045086) is another VGAM1955 host target gene. KIAA1764 BINDING SITE is HOST TARGET binding site found in the 5' untranslated region of mRNA encoded by KIAA1764, corresponding to a HOST TARGET binding site such as BINDING SITE I, BINDING SITE II or BINDING SITE III. Table 2 illustrates the complementarity of the nucleotide sequences of KIAA1764 BINDING SITE, designated SEQ ID:34355, to the nucleotide sequence of VGAM1955 RNA, herein designated VGAM RNA, also designated SEQ ID:4666.

Another function of VGAM1955 is therefore inhibition of KIAA1764 (Accession XM_045086). Accordingly, utilities of VGAM1955 include diagnosis, prevention and treatment of diseases and clinical conditions associated with KIAA1764. KIAA1765 (Accession XM_047355) is another VGAM1955 host target gene. KIAA1765 BINDING SITE is HOST TARGET binding site found in the 3' untranslated region of mRNA encoded by KIAA1765, corresponding to a HOST TARGET binding site such as BINDING SITE I, BINDING SITE II or BINDING SITE III. Table 2 illustrates the complementarity of the nucleotide sequences of KIAA1765 BINDING SITE, designated SEQ ID:34958, to the nucleotide sequence of VGAM1955 RNA, herein designated VGAM RNA, also designated SEQ ID:4666.

Another function of VGAM1955 is therefore inhibition of KIAA1765 (Accession XM_047355). Accordingly, utilities of VGAM1955 include diagnosis, prevention and treatment of diseases and clinical conditions associated with KIAA1765. Kelch-like 8 (Drosophila) (KLHL8, Accession XM_031735) is another VGAM1955 host target gene. KLHL8 BINDING SITE is HOST TARGET binding site found in the 3' untranslated region of mRNA encoded by KLHL8, corresponding to a HOST TARGET binding site such as BINDING SITE I, BINDING SITE II or BINDING SITE III. Table 2 illustrates the complementarity of the nucleotide sequences of KLHL8 BINDING SITE, designated SEQ ID:31477, to the nucleotide sequence of VGAM1955 RNA, herein designated VGAM RNA, also designated SEQ ID:4666.

Another function of VGAM1955 is therefore inhibition of Kelch-like 8 (Drosophila) (KLHL8, Accession XM_031735). Accordingly, utilities of VGAM1955 include diagnosis, prevention and treatment of diseases and clinical conditions associated with KLHL8. LIN-28 (Accession NM_024674) is another VGAM1955 host target gene. LIN-28 BINDING SITE is HOST TARGET binding site found in the 3' untranslated region of mRNA encoded by LIN-28, corresponding to a HOST TARGET binding site such as BINDING SITE I, BINDING SITE II or BINDING SITE III. Table 2 illustrates the complementarity of the nucleotide sequences of LIN-28 BINDING SITE, designated SEQ ID:23981, to the nucleotide sequence of VGAM1955 RNA, herein designated VGAM RNA, also designated SEQ ID:4666.

Another function of VGAM1955 is therefore inhibition of LIN-28 (Accession NM_024674). Accordingly, utilities of VGAM1955 include diagnosis, prevention and treatment of diseases and clinical conditions associated with LIN-28. MGC12466 (Accession XM_086336) is another VGAM1955 host target gene. MGC12466 BINDING SITE is HOST TARGET binding site found in the 3' untranslated region of mRNA encoded by MGC12466, corresponding to a HOST TARGET binding site such as BINDING SITE I, BINDING SITE II or BINDING SITE III. Table 2 illustrates the complementarity of the nucleotide sequences of MGC12466 BINDING SITE, designated SEQ ID:38611, to the nucleotide sequence of VGAM1955 RNA, herein designated VGAM RNA, also designated SEQ ID:4666.

Another function of VGAM1955 is therefore inhibition of MGC12466 (Accession XM_086336). Accordingly, utilities of VGAM1955 include diagnosis, prevention and treatment of diseases and clinical conditions associated with MGC12466. MGC14859 (Accession XM_030295) is another VGAM1955 host target gene. MGC14859 BINDING SITE is HOST TARGET binding site found in the 3' untranslated region of mRNA encoded by MGC14859, corresponding to a HOST TARGET binding site such as BINDING SITE I, BINDING SITE II or BINDING SITE III. Table 2 illustrates the complementarity of the nucleotide sequences of MGC14859 BINDING SITE, designated SEQ ID:31007, to the nucleotide sequence of VGAM1955 RNA, herein designated VGAM RNA, also designated SEQ ID:4666.

Another function of VGAM1955 is therefore inhibition of MGC14859 (Accession XM_030295). Accordingly, utilities of VGAM1955 include diagnosis, prevention and treatment of diseases and clinical conditions associated with MGC14859. MGC23937 (Accession NM_145052) is another VGAM1955 host target gene. MGC23937 BINDING SITE is HOST TARGET binding site found in the 3' untranslated region of mRNA encoded by MGC23937, corresponding to a HOST TARGET binding site such as BINDING SITE I, BINDING SITE II or BINDING SITE III. Table 2 illustrates the complementarity of the nucleotide sequences of MGC23937 BINDING SITE, designated SEQ ID:29683, to the nucleotide sequence of VGAM1955 RNA, herein designated VGAM RNA, also designated SEQ ID:4666.

Another function of VGAM1955 is therefore inhibition of MGC23937 (Accession NM_145052). Accordingly, utilities of VGAM1955 include diagnosis, prevention and treatment of diseases and clinical conditions associated with MGC23937. MGC29898 (Accession NM_145048) is another VGAM1955 host target gene. MGC29898 BINDING SITE is HOST TARGET binding site found in the 3' untranslated region of mRNA encoded by MGC29898, corresponding to a HOST TARGET binding site such as BINDING SITE I, BINDING SITE II or BINDING SITE III. Table 2 illustrates the complementarity of the nucleotide sequences of MGC29898 BINDING SITE, designated SEQ ID:29680, to the nucleotide sequence of VGAM1955 RNA, herein designated VGAM RNA, also designated SEQ ID:4666.

Another function of VGAM1955 is therefore inhibition of MGC29898 (Accession NM_145048). Accordingly, utilities of VGAM1955 include diagnosis, prevention and treatment of diseases and clinical conditions associated with MGC29898. Nudix (nucleoside diphosphate linked moiety X)-type Motif 13 (NUDT13, Accession XM_032512) is another VGAM1955 host target gene. NUDT13 BINDING SITE is HOST TARGET binding site found in the 3' untranslated region of mRNA encoded by NUDT13, corresponding to a HOST TARGET binding site such as BINDING SITE I, BINDING SITE II or BINDING SITE III. Table 2 illustrates the complementarity of the nucleotide sequences of NUDT13 BINDING SITE, designated SEQ ID:31663, to the nucleotide sequence of VGAM1955 RNA, herein designated VGAM RNA, also designated SEQ ID:4666.

Another function of VGAM1955 is therefore inhibition of Nudix (nucleoside diphosphate linked moiety X)-type Motif 13 (NUDT13, Accession XM_032512). Accordingly, utilities of VGAM1955 include diagnosis, prevention and treatment of diseases and clinical conditions associated with NUDT13. OCT11 (Accession NM_014352) is another VGAM1955 host target gene. OCT11 BINDING SITE is HOST TARGET binding site found in the 3' untranslated region of mRNA encoded by OCT11, corresponding to a HOST TARGET binding site such as BINDING SITE I, BINDING SITE II or BINDING SITE III. Table 2 illustrates the complementarity of the nucleotide sequences of OCT11 BINDING SITE, designated SEQ ID:15681, to the nucleotide sequence of VGAM1955 RNA, herein designated VGAM RNA, also designated SEQ ID:4666.

Another function of VGAM1955 is therefore inhibition of OCT11 (Accession NM_014352). Accordingly, utilities of VGAM1955 include diagnosis, prevention and treatment of diseases and clinical conditions associated with OCT11. Pellino Homolog 2 (Drosophila) (PELI2, Accession NM_021255) is another VGAM1955 host target gene. PELI2 BINDING SITE is HOST TARGET binding site found in the 3' untranslated region of mRNA encoded by PELI2, corresponding to a HOST TARGET binding site such as BINDING SITE I, BINDING SITE II or BINDING SITE III. Table 2 illustrates the complementarity of the nucleotide sequences of PELI2 BINDING SITE, designated SEQ ID:22230, to the nucleotide sequence of VGAM1955 RNA, herein designated VGAM RNA, also designated SEQ ID:4666.

Another function of VGAM1955 is therefore inhibition of Pellino Homolog 2 (Drosophila) (PELI2, Accession NM_021255). Accordingly, utilities of VGAM1955 include diagnosis, prevention and treatment of diseases and clinical conditions associated with PELI2. RDC1 (Accession XM_051522) is another VGAM1955 host target gene. RDC1 BINDING SITE is HOST TARGET binding site found in the 3' untranslated region of mRNA encoded by RDC1, corresponding to a HOST TARGET binding site such as BINDING SITE I, BINDING SITE II or BINDING SITE III. Table 2 illustrates the complementarity of the nucleotide sequences of RDC1 BINDING SITE, designated SEQ ID:35848, to the nucleotide sequence of VGAM1955 RNA, herein designated VGAM RNA, also designated SEQ ID:4666.

Another function of VGAM1955 is therefore inhibition of RDC1 (Accession XM_051522). Accordingly, utilities of VGAM1955 include diagnosis, prevention and treatment of diseases and clinical conditions associated with RDC1. RES4-22 (Accession NM_003704) is another VGAM1955 host target gene. RES4-22 BINDING SITE is HOST TARGET binding site found in the 3' untranslated region of mRNA encoded by RES4-22, corresponding to a HOST TARGET binding site such as BINDING SITE I, BINDING SITE II or BINDING SITE III. Table 2 illustrates the complementarity of the nucleotide sequences of RES4-22 BINDING SITE, designated SEQ ID:9804, to the nucleotide sequence of VGAM1955 RNA, herein designated VGAM RNA, also designated SEQ ID:4666.

Another function of VGAM1955 is therefore inhibition of RES4-22 (Accession NM_003704). Accordingly, utilities of VGAM1955 include diagnosis, prevention and treatment of diseases and clinical conditions associated with RES4-22. SE57-1 (Accession NM_025214) is another VGAM1955 host target gene. SE57-1 BINDING SITE is HOST TARGET binding site found in the 3' untranslated region of mRNA encoded by SE57-1, corresponding to a HOST TARGET binding site such as BINDING SITE I, BINDING SITE II or BINDING SITE III. Table 2 illustrates the complementarity of the nucleotide sequences of SE57-1 BINDING SITE, designated SEQ ID:24894, to the nucleotide sequence of VGAM1955 RNA, herein designated VGAM RNA, also designated SEQ ID:4666.

Another function of VGAM1955 is therefore inhibition of SE57-1 (Accession NM_025214). Accordingly, utilities of VGAM1955 include diagnosis, prevention and treatment of diseases and clinical conditions associated with SE57-1. SP192 (Accession NM_021639) is another VGAM1955 host target gene. SP192 BINDING SITE is HOST TARGET binding site found in the 3' untranslated region of mRNA encoded by SP192, corresponding to a HOST TARGET binding site such as BINDING SITE I, BINDING SITE II or BINDING SITE III. Table 2 illustrates the complementarity of the nucleotide sequences of SP192 BINDING SITE, designated SEQ ID:22300, to the nucleotide sequence of VGAM1955 RNA, herein designated VGAM RNA, also designated SEQ ID:4666.

Another function of VGAM1955 is therefore inhibition of SP192 (Accession NM_021639). Accordingly, utilities of VGAM1955 include diagnosis, prevention and treatment of diseases and clinical conditions associated with SP192. TBDN100 (Accession NM_025085) is another VGAM1955 host target gene. TBDN100 BINDING SITE is HOST TARGET binding site found in the 3' untranslated region of mRNA encoded by TBDN100, corresponding to a HOST TARGET binding site such as BINDING SITE I, BINDING SITE II or BINDING SITE III. Table 2 illustrates the complementarity of the nucleotide sequences of TBDN100 BINDING SITE, designated SEQ ID:24696, to the nucleotide sequence of VGAM1955 RNA, herein designated VGAM RNA, also designated SEQ ID:4666.

Another function of VGAM1955 is therefore inhibition of TBDN100 (Accession NM_025085). Accordingly, utilities of VGAM1955 include diagnosis, prevention and treatment of diseases and clinical conditions associated with TBDN100. Tumor Necrosis Factor Receptor Superfamily, Member 21 (TNFRSF21, Accession NM_014452) is another VGAM1955 host target gene. TNFRSF21 BINDING SITE is HOST TARGET binding site found in the 3' untranslated region of mRNA encoded by TNFRSF21, corresponding to a HOST TARGET binding site such as BINDING SITE I, BINDING SITE II or BINDING SITE III. Table 2 illustrates the complementarity of the nucleotide sequences of TNFRSF21 BINDING SITE, designated SEQ ID:15804, to the nucleotide sequence of VGAM1955 RNA, herein designated VGAM RNA, also designated SEQ ID:4666.

Another function of VGAM1955 is therefore inhibition of Tumor Necrosis Factor Receptor Superfamily, Member 21 (TNFRSF21, Accession NM_014452). Accordingly, utilities of VGAM1955 include diagnosis, prevention and treatment of diseases and clinical conditions associated with TNFRSF21. UBF-fl (Accession NM_032828) is another VGAM1955 host target gene. UBF-fl BINDING SITE is HOST TARGET binding site found in the 3' untranslated region of mRNA encoded by UBF-fl, corresponding to a HOST TARGET binding site such as BINDING SITE I, BINDING SITE II or BINDING SITE III. Table 2 illustrates the complementarity of the nucleotide sequences of UBF-fl BINDING SITE, designated SEQ ID:26603, to the nucleotide sequence of VGAM1955 RNA, herein designated VGAM RNA, also designated SEQ ID:4666.

Another function of VGAM1955 is therefore inhibition of UBF-fl (Accession NM_032828). Accordingly, utilities of VGAM1955 include diagnosis, prevention and treatment of diseases and clinical conditions associated with UBF-fl. Upstream Binding Protein 1 (LBP-1a) (UBP1, Accession NM_014517) is another VGAM1955 host target gene. UBP1 BINDING SITE1 and UBP1 BINDING SITE2 are HOST TARGET binding sites found in untranslated regions of mRNA encoded by UBP1, corresponding to HOST TARGET binding sites such as BINDING SITE I, BINDING SITE II or BINDING SITE III. Table 2 illustrates the complementarity of the nucleotide sequences of UBP1 BINDING SITE1 and UBP1 BINDING SITE2, designated SEQ ID:15849 and SEQ ID:15848 respectively, to the nucleotide sequence of VGAM1955 RNA, herein designated VGAM RNA, also designated SEQ ID:4666.

Another function of VGAM1955 is therefore inhibition of Upstream Binding Protein 1 (LBP-1a) (UBP1, Accession NM_014517). Accordingly, utilities of VGAM1955 include diagnosis, prevention and treatment of diseases and clinical conditions associated with UBP1. ZFP106 (Accession NM_022473) is another VGAM1955 host target gene. ZFP106 BINDING SITE is HOST TARGET binding site found in the 3' untranslated region of mRNA encoded by ZFP106, corresponding to a HOST TARGET binding site such as BINDING SITE I, BINDING SITE II or BINDING SITE III. Table 2 illustrates the complementarity of the nucleotide sequences of ZFP106 BINDING SITE, designated SEQ ID:22838, to the nucleotide sequence of VGAM1955 RNA, herein designated VGAM RNA, also designated SEQ ID:4666.

Another function of VGAM1955 is therefore inhibition of ZFP106 (Accession NM_022473). Accordingly, utilities of VGAM1955 include diagnosis, prevention and treatment of diseases and clinical conditions associated with ZFP106. LOC120856 (Accession XM_058509) is another VGAM1955 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36631, to the nucleotide sequence of VGAM1955 RNA, herein designated VGAM RNA, also designated SEQ ID:4666.

Another function of VGAM1955 is therefore inhibition of LOC120856 (Accession XM_058509). Accordingly, utilities of VGAM1955 include diagnosis, prevention and treatment of diseases and clinical conditions associated with LOC120856. LOC122792 (Accession NM_145251) is another VGAM1955 host target gene. LOC122792 BINDING SITE is HOST TARGET binding site found in the 3' untranslated region of mRNA encoded by LOC122792, corresponding to a HOST TARGET binding site such as BINDING SITE I, BINDING SITE II or BINDING SITE III. Table 2 illustrates the complementarity of the nucleotide sequences of LOC122792 BINDING SITE, designated SEQ ID:29765, to the nucleotide sequence of VGAM1955 RNA, herein designated VGAM RNA, also designated SEQ ID:4666.

Another function of VGAM1955 is therefore inhibition of LOC122792 (Accession NM_145251). Accordingly, utilities of VGAM1955 include diagnosis, prevention and treatment of diseases and clinical conditions associated with LOC122792. LOC130074 (Accession XM_072228) is another VGAM1955 host target gene. LOC130074 BIND- ING SITE is HOST TARGET binding site found in the 3' untranslated region of mRNA encoded by LOC130074, corresponding to a HOST TARGET binding site such as BINDING SITE I, BINDING SITE II or BINDING SITE III. Table 2 illustrates the complementarity of the nucleotide sequences of LOC130074 BINDING SITE, designated SEQ ID:37473, to the nucleotide sequence of VGAM1955 RNA, herein designated VGAM RNA, also designated SEQ ID:4666.

Another function of VGAM1955 is therefore inhibition of LOC130074 (Accession XM_072228). Accordingly, utilities of VGAM1955 include diagnosis, prevention and treatment of diseases and clinical conditions associated with LOC130074. LOC135154 (Accession XM_059752) is another VGAM1955 host target gene. LOC135154 BINDING SITE is HOST TARGET binding site found in the 3' untranslated region of mRNA encoded by LOC135154, corresponding to a HOST TARGET binding site such as BINDING SITE I, BINDING SITE II or BINDING SITE III. Table 2 illustrates the complementarity of the nucleotide sequences of LOC135154 BINDING SITE, designated SEQ ID:37091, to the nucleotide sequence of VGAM1955 RNA, herein designated VGAM RNA, also designated SEQ ID:4666.

Another function of VGAM1955 is therefore inhibition of LOC135154 (Accession XM_059752). Accordingly, utilities of VGAM1955 include diagnosis, prevention and treatment of diseases and clinical conditions associated with LOC135154. LOC146880 (Accession XM_085627) is another VGAM1955 host target gene. LOC146880 BINDING SITE is HOST TARGET binding site found in the 3' untranslated region of mRNA encoded by LOC146880, corresponding to a HOST TARGET binding site such as BINDING SITE I, BINDING SITE II or BINDING SITE III. Table 2 illustrates the complementarity of the nucleotide sequences of LOC146880 BINDING SITE, designated SEQ ID:38260, to the nucleotide sequence of VGAM1955 RNA, herein designated VGAM RNA, also designated SEQ ID:4666.

Another function of VGAM1955 is therefore inhibition of LOC146880 (Accession XM_085627). Accordingly, utilities of VGAM1955 include diagnosis, prevention and treatment of diseases and clinical conditions associated with LOC146880. LOC151963 (Accession XM_087351) is another VGAM1955 host target gene. LOC151963 BINDING SITE is HOST TARGET binding site found in the 3' untranslated region of mRNA encoded by LOC151963, corresponding to a HOST TARGET binding site such as BINDING SITE I, BINDING SITE II or BINDING SITE III. Table 2 illustrates the complementarity of the nucleotide sequences of LOC151963 BINDING SITE, designated SEQ ID:39175, to the nucleotide sequence of VGAM1955 RNA, herein designated VGAM RNA, also designated SEQ ID:4666.

Another function of VGAM1955 is therefore inhibition of LOC151963 (Accession XM_087351). Accordingly, utilities of VGAM1955 include diagnosis, prevention and treatment of diseases and clinical conditions associated with LOC151963. LOC152580 (Accession XM_098240) is another VGAM1955 host target gene. LOC152580 BINDING SITE is HOST TARGET binding site found in the 3' untranslated region of mRNA encoded by LOC152580, corresponding to a HOST TARGET binding site such as BINDING SITE I, BINDING SITE II or BINDING SITE III. Table 2 illustrates the complementarity of the nucleotide sequences of LOC152580 BINDING SITE, designated SEQ ID:41525, to the nucleotide sequence of VGAM1955 RNA, herein designated VGAM RNA, also designated SEQ ID:4666.

Another function of VGAM1955 is therefore inhibition of LOC152580 (Accession XM_098240). Accordingly, utilities of VGAM1955 include diagnosis, prevention and treatment of diseases and clinical conditions associated with LOC152580. LOC158402 (Accession XM_098936) is another VGAM1955 host target gene. LOC158402 BINDING SITE is HOST TARGET binding site found in the 5' untranslated region of mRNA encoded by LOC158402, corresponding to a HOST TARGET binding site such as BINDING SITE I, BINDING SITE II or BINDING SITE III. Table 2 illustrates the complementarity of the nucleotide sequences of LOC158402 BINDING SITE, designated SEQ ID:41979, to the nucleotide sequence of VGAM1955 RNA, herein designated VGAM RNA, also designated SEQ ID:4666.

Another function of VGAM1955 is therefore inhibition of LOC158402 (Accession XM_098936). Accordingly, utilities of VGAM1955 include diagnosis, prevention and treatment of diseases and clinical conditions associated with LOC158402. LOC168667 (Accession XM_166592) is another VGAM1955 host target gene. LOC168667 BINDING SITE is HOST TARGET binding site found in the 3' untranslated region of mRNA encoded by LOC168667, corresponding to a HOST TARGET binding site such as BINDING SITE I, BINDING SITE II or BINDING SITE III. Table 2 illustrates the complementarity of the nucleotide sequences of LOC168667 BINDING SITE, designated SEQ ID:44567, to the nucleotide sequence of VGAM1955 RNA, herein designated VGAM RNA, also designated SEQ ID:4666.

Another function of VGAM1955 is therefore inhibition of LOC168667 (Accession XM_166592). Accordingly, utilities of VGAM1955 include diagnosis, prevention and treatment of diseases and clinical conditions associated with LOC168667. LOC253263 (Accession XM_173102) is another VGAM1955 host target gene. LOC253263 BINDING SITE is HOST TARGET binding site found in the 3' untranslated region of mRNA encoded by LOC253263, corresponding to a HOST TARGET binding site such as BINDING SITE I, BINDING SITE II or BINDING SITE III. Table 2 illustrates the complementarity of the nucleotide sequences of LOC253263 BINDING SITE, designated SEQ ID:46360, to the nucleotide sequence of VGAM1955 RNA, herein designated VGAM RNA, also designated SEQ ID:4666.

Another function of VGAM1955 is therefore inhibition of LOC253263 (Accession XM_173102). Accordingly, utilities of VGAM1955 include diagnosis, prevention and treatment of diseases and clinical conditions associated with LOC253263. LOC90161 (Accession XM_029551) is another VGAM1955 host target gene. LOC90161 BINDING SITE is HOST TARGET binding site found in the 3' untranslated region of mRNA encoded by LOC90161, corresponding to a HOST TARGET binding site such as BINDING SITE I, BINDING SITE II or BINDING SITE III. Table 2 illustrates the complementarity of the nucleotide sequences of LOC90161 BINDING SITE, designated SEQ ID:30904, to the nucleotide sequence of VGAM1955 RNA, herein designated VGAM RNA, also designated SEQ ID:4666.

Another function of VGAM1955 is therefore inhibition of LOC90161 (Accession XM_029551). Accordingly, utilities of VGAM1955 include diagnosis, prevention and treatment of diseases and clinical conditions associated with LOC90161. LOC90317 (Accession XM_030892) is another VGAM1955 host target gene. LOC90317 BINDING SITE is HOST TARGET binding site found in the 3' untranslated region of mRNA encoded by LOC90317, corresponding to a HOST TARGET binding site such as BINDING SITE I, BINDING SITE II or BINDING SITE III. Table 2 illustrates the complementarity of the nucleotide sequences of LOC90317 BINDING SITE, designated SEQ ID:31209, to the nucleotide sequence of VGAM1955 RNA, herein designated VGAM RNA, also designated SEQ ID:4666.

Another function of VGAM1955 is therefore inhibition of LOC90317 (Accession XM_030892). Accordingly, utilities of VGAM1955 include diagnosis, prevention and treatment of diseases and clinical conditions associated with LOC90317. LOC91351 (Accession XM_037817) is another VGAM1955 host target gene. LOC91351 BINDING SITE is HOST TARGET binding site found in the 3' untranslated region of mRNA encoded by LOC91351, corresponding to a HOST TARGET binding site such as BINDING SITE I, BINDING SITE II or BINDING SITE III. Table 2 illustrates the complementarity of the nucleotide sequences of LOC91351 BINDING SITE, designated SEQ ID:32697, to the nucleotide sequence of VGAM1955 RNA, herein designated VGAM RNA, also designated SEQ ID:4666.

Another function of VGAM1955 is therefore inhibition of LOC91351 (Accession XM_037817). Accordingly, utilities of VGAM1955 include diagnosis, prevention and treatment of diseases and clinical conditions associated with LOC91351. FIG. 1 further provides a conceptual description of a novel bioinformatically detected viral gene of the present invention, referred to here as Viral Genomic Address Messenger 1956 (VGAM1956) viral gene, which modulates expression of respective host target genes thereof, the function and utility of which host target genes is known in the art.

VGAM1956 is a novel bioinformatically detected regulatory, non protein coding, viral micro RNA (miRNA) gene. The method by which VGAM1956 was detected is described hereinabove with reference to FIGS. 1-8.

VGAM1956 gene, herein designated VGAM GENE, is a viral gene contained in the genome of Macaca Mulatta Rhadinovirus. VGAM1956 host target gene, herein designated VGAM HOST TARGET GENE, is a human gene contained in the human genome.

VGAM1956 gene encodes a VGAM1956 precursor RNA, herein designated VGAM PRECURSOR RNA. Similar to other miRNA genes, and unlike most ordinary genes, VGAM1956 precursor RNA does not encode a protein. A nucleotide sequence identical or highly similar to the nucleotide sequence of VGAM1956 precursor RNA is designated SEQ ID:1942, and is provided hereinbelow with reference to the sequence listing part. Nucleotide sequence SEQ ID:1942 is located at position 11662 relative to the genome of Macaca Mulatta Rhadinovirus.

VGAM1956 precursor RNA folds onto itself, forming VGAM1956 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1956 folded precursor RNA into VGAM1956 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1956 RNA is designated SEQ ID:4667, and is provided hereinbelow with reference to the sequence listing part.

VGAM1956 host target gene, herein designated VGAM HOST TARGET GENE, encodes a corresponding messenger RNA, VGAM1956 host target RNA, herein designated VGAM HOST TARGET RNA. VGAM1956 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1956 RNA, herein designated VGAM RNA, binds complementarily to one or more host target binding sites located in untranslated regions of VGAM1956 host target RNA, herein designated VGAM HOST TARGET RNA. This complementary binding is due to the fact that the nucleotide sequence of VGAM1956 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1956 RNA, herein designated VGAM RNA, may have a different number of host target binding sites in untranslated regions of a VGAM1956 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1956 RNA, herein designated VGAM RNA, to host target binding sites on VGAM1956 host target RNA, herein designated VGAM HOST TARGET RNA, such as BINDING SITE I, BINDING SITE II and BINDING SITE III, inhibits translation of VGAM1956 host target RNA into VGAM1956 host target protein, herein designated VGAM HOST TARGET PROTEIN. VGAM host target protein is therefore outlined by a broken line.

It is appreciated that VGAM1956 host target gene, herein designated VGAM HOST TARGET GENE, in fact represents a plurality of VGAM1956 host target genes. The mRNA of each one of this plurality of VGAM1956 host target genes comprises one or more host target binding sites, each having a nucleotide sequence which is at least partly complementary to VGAM1956 RNA, herein designated VGAM RNA, and which when bound by VGAM1956 RNA causes inhibition of translation of respective one or more VGAM1956 host target proteins.

It is further appreciated by one skilled in the art that the mode of translational inhibition illustrated by FIG. 1 with specific reference to translational inhibition exerted by VGAM1956 gene, herein designated VGAM GENE, on one or more VGAM1956 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1956 is inhibition of expression of host target genes, as part of a novel viral mechanism of attacking a host. Accordingly, utilities of VGAM1956 include diagnosis, prevention and treatment of viral infection by Macaca Mulatta Rhadinovirus. Specific functions, and accordingly utilities, of VGAM1956 correlate with, and may be deduced from, the identity of the host target genes which VGAM1956 binds and inhibits, and the function of these host target genes, as elaborated hereinbelow.

Nucleotide sequences of the VGAM1956 precursor RNA, herein designated VGAM PRECURSOR RNA, and of the 'diced' VGAM1956 RNA, herein designated VGAM RNA, and a schematic representation of the secondary folding of VGAM1956 folded precursor RNA, herein designated VGAM FOLDED PRECURSOR RNA, of VGAM1956 are further described hereinbelow with reference to Table 1.

Nucleotide sequences of host target binding sites, such as BINDING SITE-I, BINDING SITE-II and BINDING SITE-III of FIG. 1, found on VGAM1956 host target RNA, and schematic representation of the complementarity of each of these host target binding sites to VGAM1956 RNA, herein designated VGAM RNA, are described hereinbelow with reference to Table 2.

As mentioned hereinabove with reference to FIG. 1, a function of VGAM1956 gene, herein designated VGAM is inhibition of expression of VGAM1956 target genes. It is appreciated that specific functions, and accordingly utilities, of VGAM1956 correlate with, and may be deduced from, the identity of the target genes which VGAM1956 binds and inhibits, and the function of these target genes, as elaborated hereinbelow.

ATP-binding Cassette, Sub-family A (ABC1), Member 1 (ABCA1, Accession NM_005502) is a VGAM1956 host target gene. ABCA1 BINDING SITE is HOST TARGET binding site found in the 5' untranslated region of mRNA encoded by ABCA1, corresponding to a HOST TARGET binding site such as BINDING SITE I, BINDING SITE II or BINDING SITE III. Table 2 illustrates the complementarity of the nucleotide sequences of ABCA1 BINDING SITE, designated SEQ ID:12013, to the nucleotide sequence of VGAM1956 RNA, herein designated VGAM RNA, also designated SEQ ID:4667.

A function of VGAM1956 is therefore inhibition of ATP-binding Cassette, Sub-family A (ABC1), Member 1 (ABCA1, Accession NM_005502), a gene which camp-dependent and sulfonylurea-sensitive anion transporter. Accordingly, utilities of VGAM1956 include diagnosis, prevention and treatment of diseases and clinical conditions associated with ABCA1. The function of ABCA1 has been established by previous studies. By a PCR-based approach, Luciani et al. (1994) identified 2 novel mammalian members of the family of ATP-binding cassette (ABC) transporters designated ABC1 and ABC2 (OMIM Ref. No. 600047). They belong to a group of traffic ATPases encoded as a single multifunctional protein, such as CFTR (OMIM Ref. No. 602421) and P-glycoproteins (see OMIM Ref. No. 171050). Both ABC1 and ABC2 are large, internally symmetrical molecules that contain complete information for a functional 'channel-like' structure, a feature typical of the mammalian transporters at the plasma membrane. In both ABC1 and ABC2, the 2 halves of the molecules do not share extensive sequence similarity, apart from the nucleotide binding domains. This feature, shared with CFTR and with MRP1 (OMIM Ref. No. 158343), is in contrast with the high similarity shown by the 2 halves of P-glycoproteins. The finding argues against internal gene duplication as the event giving rise to the symmetric structure and favors the alternative hypothesis of the fusion of 2 independently evolved genes encoding the 2 halves. Santamarina-Fojo et al. (2000) found that the ABCA1 gene spans 149 kb and contains 50 exons. They identified 62 repetitive Alu sequences in the 49 introns. Comparative analysis of the mouse and human ABCA1 promoter sequences identified specific regulatory elements that are evolutionarily conserved. Pullinger et al. (2000) analyzed the promoter region of ABCA1. They identified 7 putative SP1 (OMIM Ref. No. 189906)-binding sites, 4 sterol regulatory elements (SREs) similar to the SRE of the low density lipoprotein receptor (LDLR; 606945) promoter region, a CpG island, a possible weak TATA box, 2 distal CCAAT sequences, and binding sites for several other transcription factors.

Full details of the abovementioned studies are described in the following publications, the disclosure of which are hereby incorporated by reference:

Luciani, M. F.; Denizot, F.; Savary, S.; Mattei, M. G.; Chimini, G.: Cloning of two novel ABC transporters mapping on human chromosome 9. Genomics 21: 150-159, 1994; and Santamarina-Fojo, S.; Peterson, K.; Knapper, C.; Qiu, Y.; Freeman, L.; Cheng, J.-F.; Osorio, J.; Remaley, A.; Yang, X.-P.; Haudenschild, C.; Prades, C.; Chimini, G.; Blackmon, E.; Franc.

Further studies establishing the function and utilities of ABCA1 are found in John Hopkins OMIM database record ID 600046, and in sited publications numbered 10228-9540, 10229, 10230-10231, 7375, 10232-10236, 10243, 10238-10240, 10244, 10249, 9586-7721, 1134 and 9587-7724 listed in the bibliography section hereinbelow, which are also hereby incorporated by reference. Aspartate Beta-hydroxylase (ASPH, Accession NM_032466) is another VGAM1956 host target gene. ASPH BINDING SITE is HOST TARGET binding site found in the 3' untranslated region of mRNA encoded by ASPH, corresponding to a HOST TARGET binding site such as BINDING SITE I, BINDING SITE II or BINDING SITE III. Table 2 illustrates the complementarity of the nucleotide sequences of ASPH BINDING SITE, designated SEQ ID:26225, to the nucleotide sequence of VGAM1956 RNA, herein designated VGAM RNA, also designated SEQ ID:4667.

Another function of VGAM1956 is therefore inhibition of Aspartate Beta-hydroxylase (ASPH, Accession NM_032466), a gene which specifically hydroxylates the beta carbon of aspartic acid or asparagine residues in certain epidermal growth factor (EGF)-like domains of a number of proteins. Accordingly, utilities of VGAM1956 include diagnosis, prevention and treatment of diseases and clinical conditions associated with ASPH. The function of ASPH and its association with various diseases and clinical conditions, has been established by previous studies, as described hereinabove with reference to VGAM47. BTB and CNC Homology 1, Basic Leucine Zipper Transcription Factor 1 (BACH1, Accession NM_001186) is another VGAM1956 host target gene. BACH1 BINDING SITE is HOST TARGET binding site found in the 3' untranslated region of mRNA encoded by BACH1, corresponding to a HOST TARGET binding site such as BINDING SITE I, BINDING SITE II or BINDING SITE III. Table 2 illustrates the complementarity of the nucleotide sequences of BACH1 BINDING SITE, designated SEQ ID:6859, to the nucleotide sequence of VGAM1956 RNA, herein designated VGAM RNA, also designated SEQ ID:4667.

Another function of VGAM1956 is therefore inhibition of BTB and CNC Homology 1, Basic Leucine Zipper Transcription Factor 1 (BACH1, Accession NM_001186), a gene which acts as repressor or activator, binds to nf-e2 binding sites. Accordingly, utilities of VGAM1956 include diagnosis, prevention and treatment of diseases and clinical conditions associated with BACH1. The function of BACH1 and its association with various diseases and clinical conditions, has been established by previous studies, as described hereinabove with reference to VGAM724. Breast Cancer 1, Early Onset (BRCA1, Accession NM_007297) is another VGAM1956 host target gene. BRCA1 BINDING SITE is HOST TARGET binding site found in the 5' untranslated region of mRNA encoded by BRCA1, corresponding to a HOST TARGET binding site such as BINDING SITE I, BINDING SITE II or BINDING SITE III. Table 2 illustrates the complementarity of the nucleotide sequences of BRCA1 BINDING SITE, designated SEQ ID:14183, to the nucleotide sequence of VGAM1956 RNA, herein designated VGAM RNA, also designated SEQ ID:4667.

Another function of VGAM1956 is therefore inhibition of Breast Cancer 1, Early Onset (BRCA1, Accession NM_007297). Accordingly, utilities of VGAM1956 include diagnosis, prevention and treatment of diseases and clinical conditions associated with BRCA1. Centrosomal Protein 2 (CEP2, Accession NM_006779) is another VGAM1956 host target gene. CEP2 BINDING SITE is HOST TARGET binding site found in the 5' untranslated region of mRNA encoded by CEP2, corresponding to a HOST TARGET binding site such as BINDING SITE I, BINDING SITE II or BINDING SITE III. Table 2 illustrates the complementarity of the nucleotide sequences of CEP2 BINDING SITE, designated SEQ ID:13651, to the nucleotide sequence of VGAM1956 RNA, herein designated VGAM RNA, also designated SEQ ID:4667.

Another function of VGAM1956 is therefore inhibition of Centrosomal Protein 2 (CEP2, Accession NM_006779), a gene which interacts with TC10 and CDC42. Accordingly, utilities of VGAM1956 include diagnosis, prevention and treatment of diseases and clinical conditions associated with CEP2. The function of CEP2 and its association with various diseases and clinical conditions, has been established by previous studies, as described hereinabove with reference to VGAM329. Carbamoyl-phosphate Synthetase 1, Mitochondrial (CPS1, Accession NM_001875) is another VGAM1956 host target gene. CPS1 BINDING SITE is HOST TARGET binding site found in the 3' untranslated region of mRNA encoded by CPS1, corresponding to a HOST TARGET binding site such as BINDING SITE I, BINDING SITE II or BINDING SITE III. Table 2 illustrates the complementarity of the nucleotide sequences of CPS1 BINDING SITE, designated SEQ ID:7603, to the nucleotide sequence of VGAM1956 RNA, herein designated VGAM RNA, also designated SEQ ID:4667.

Another function of VGAM1956 is therefore inhibition of Carbamoyl-phosphate Synthetase 1, Mitochondrial (CPS1, Accession NM_001875). Accordingly, utilities of VGAM1956 include diagnosis, prevention and treatment of diseases and clinical conditions associated with CPS1. DiGeorge Syndrome Critical Region Gene 2 (DGCR2, Accession NM_005137) is another VGAM1956 host target gene. DGCR2 BINDING SITE is HOST TARGET binding site found in the 3' untranslated region of mRNA encoded by DGCR2, corresponding to a HOST TARGET binding site such as BINDING SITE I, BINDING SITE II or BINDING SITE III. Table 2 illustrates the complementarity of the nucleotide sequences of DGCR2 BINDING SITE, designated SEQ ID:11613, to the nucleotide sequence of VGAM1956 RNA, herein designated VGAM RNA, also designated SEQ ID:4667.

Another function of VGAM1956 is therefore inhibition of DiGeorge Syndrome Critical Region Gene 2 (DGCR2, Accession NM_005137), a gene which could intervene in cell-cell or cell-matrix interactions. Accordingly, utilities of VGAM1956 include diagnosis, prevention and treatment of diseases and clinical conditions associated with DGCR2. The function of DGCR2 and its association with various diseases and clinical conditions, has been established by previous studies, as described hereinabove with reference to VGAM1485. Dihydropyrimidine Dehydrogenase (DPYD, Accession XM_017469) is another VGAM1956 host target gene. DPYD BINDING SITE is HOST TARGET binding site found in the 3' untranslated region of mRNA encoded by DPYD, corresponding to a HOST TARGET binding site such as BINDING SITE I, BINDING SITE II or BINDING SITE III. Table 2 illustrates the complementarity of the nucleotide sequences of DPYD BINDING SITE, designated SEQ ID:30318, to the nucleotide sequence of VGAM1956 RNA, herein designated VGAM RNA, also designated SEQ ID:4667.

Another function of VGAM1956 is therefore inhibition of Dihydropyrimidine Dehydrogenase (DPYD, Accession XM_017469). Accordingly, utilities of VGAM1956 include diagnosis, prevention and treatment of diseases and clinical conditions associated with DPYD. Dual-specificity tyrosine-(Y)-phosphorylation Regulated Kinase 1A (DYRK1A, Accession NM_101395) is another VGAM1956 host target gene. DYRK1A BINDING SITE1 and DYRK1A BINDING SITE2 are HOST TARGET binding sites found in untranslated regions of mRNA encoded by DYRK1A, corresponding to HOST TARGET binding sites such as BINDING SITE I, BINDING SITE II or BINDING SITE III. Table 2 illustrates the complementarity of the nucleotide sequences of DYRK1A BINDING SITE1 and DYRK1A BINDING SITE2, designated SEQ ID:28164 and SEQ ID:28187 respectively, to the nucleotide sequence of VGAM1956 RNA, herein designated VGAM RNA, also designated SEQ ID:4667.

Another function of VGAM1956 is therefore inhibition of Dual-specificity tyrosine-(Y)-phosphorylation Regulated Kinase 1A (DYRK1A, Accession NM_101395), a gene which regulates cell proliferation and may be involved in brain development. Accordingly, utilities of VGAM1956 include diagnosis, prevention and treatment of diseases and clinical conditions associated with DYRK1A. The function of DYRK1A and its association with various diseases and clinical conditions, has been established by previous studies, as described hereinabove with reference to VGAM42. EH-domain Containing 2 (EHD2, Accession NM_014601) is another VGAM1956 host target gene. EHD2 BINDING SITE is HOST TARGET binding site found in the 5' untranslated region of mRNA encoded by EHD2, corresponding to a HOST TARGET binding site such as BINDING SITE I, BINDING SITE II or BINDING SITE III. Table 2 illustrates the complementarity of the nucleotide sequences of EHD2 BINDING SITE, designated SEQ ID:15963, to the nucleotide sequence of VGAM1956 RNA, herein designated VGAM RNA, also designated SEQ ID:4667.

Another function of VGAM1956 is therefore inhibition of EH-domain Containing 2 (EHD2, Accession NM_014601). Accordingly, utilities of VGAM1956 include diagnosis, prevention and treatment of diseases and clinical conditions associated with EHD2. ELK4, ETS-domain Protein (SRF accessory protein 1) (ELK4, Accession NM_021795) is another VGAM1956 host target gene. ELK4 BINDING SITE is HOST TARGET binding site found in the 3' untranslated region of mRNA encoded by ELK4, corresponding to a HOST TARGET binding site such as BINDING SITE I, BINDING SITE II or BINDING SITE III. Table 2 illustrates the complementarity of the nucleotide sequences of ELK4 BINDING SITE, designated SEQ ID:22351, to the nucleotide sequence of VGAM1956 RNA, herein designated VGAM RNA, also designated SEQ ID:4667.

Another function of VGAM1956 is therefore inhibition of ELK4, ETS-domain Protein (SRF accessory protein 1) (ELK4, Accession NM_021795), a gene which may modulate SAP1 binding to DNA by interacting with its ETS domain. Accordingly, utilities of VGAM1956 include diagnosis, prevention and treatment of diseases and clinical conditions associated with ELK4. The function of ELK4 has been established by previous studies. Regulation of gene expression often involves the interaction of transcription factors to form multicomponent complexes at promoter and enhancer elements. For example, transcriptional regulation of the FOS gene (OMIM Ref. No. 164810) in response to growth factor stimulation appears to involve a multicomponent complex at the serum response element (SRE). This complex contains the ubiquitous nuclear protein SRF together with a second protein, ternary complex factor (TCF), which cannot bind the SRE by itself. Dalton and Treisman (1992) employed a genetic screen using yeast to identify SAP1, an SRF accessory protein, which has DNA binding properties identical to those of TCF. Subsequently, they identified a related protein, SAP2 (OMIM Ref. No. 600247), by its cDNA sequence homology with the SAP1 cDNA. These proteins contain 3 regions of homology to a third protein, ELK1 (OMIM Ref. No. 311040), which also functions as an SRF accessory protein and is immunologically related to HeLa cell TCF. The SAP1, SAP2, and ELK1 mRNAs are ubiquitous. Shipley et al. (1994) used cDNA probes to isolate cosmid and phage clones harboring genes encoding SAP1 and SAP2. With these clones, they mapped the genes to 1q32 and 12q23, respectively, by fluorescence in situ hybridization. Giovane et al. (1995) likewise mapped ELK4 to human 1q32 by in situ hybridization. By the same method, they mapped the mouse homolog to chromosome 1E3-G. Mo et al. (1998) determined the crystal structures of the conserved ETS domain of SAP1 bound to DNA sequences from the E74 and c-fos promoters. These structures revealed that a set of conserved residues contact a GGA core DNA sequence. Discrimination for sequences outside this core is mediated by DNA contacts from conserved and nonconserved protein residues and sequence-dependent DNA structural properties characteristic of A-form DNA structure. Modeling studies of a SAP1/SRF/DNA complex suggested that SRF may modulate SAP1 binding to DNA by interacting with its ETS domain.

Full details of the abovementioned studies are described in the following publications, the disclosure of which are hereby incorporated by reference:

Giovane, A.; Sobieszczuk, P.; Mignon, C.; Mattei, M.-G.; Wasylyk, B.: Locations of the ets subfamily members net, elk1, and sap1 (ELK3, ELK1, and ELK4) on three homologous regions of the mouse and human genomes. Genomics 29:769-772, 1995; and Mo, Y.; Vaessen, B.; Johnston, K.; Marmorstein, R.: Structures of SAP-1 bound to DNA targets from the E74 and c-fos promoters: insights into DNA sequence discrimination by Ets proteins.

Further studies establishing the function and utilities of ELK4 are found in John Hopkins OMIM database record ID 600246, and in sited publications numbered 791 and 8627-7920 listed in the bibliography section hereinbelow, which are also hereby incorporated by reference. E1A Binding Protein P300 (EP300, Accession NM_001429) is another VGAM1956 host target gene. EP300 BINDING SITE is HOST TARGET binding site found in the 5' untranslated region of mRNA encoded by EP300, corresponding to a HOST TARGET binding site such as BINDING SITE I, BINDING SITE II or BINDING SITE III. Table 2 illustrates the complementarity of the nucleotide sequences of EP300 BINDING SITE, designated SEQ ID:7151, to the nucleotide sequence of VGAM1956 RNA, herein designated VGAM RNA, also designated SEQ ID:4667.

Another function of VGAM1956 is therefore inhibition of E1A Binding Protein P300 (EP300, Accession NM_001429), a gene which may have a function in cell cycle regulation. Accordingly, utilities of VGAM1956 include diagnosis, prevention and treatment of diseases and clinical conditions associated with EP300. The function of EP300 and its association with various diseases and clinical conditions, has been established by previous studies, as described hereinabove with reference to VGAM191. EphA2 (EPHA2, Accession NM_004431) is another VGAM1956 host target gene. EPHA2 BINDING SITE is HOST TARGET binding site found in the 3' untranslated region of mRNA encoded by EPHA2, corresponding to a HOST TARGET binding site such as BINDING SITE I, BINDING SITE II or BINDING SITE III. Table 2 illustrates the complementarity of the nucleotide sequences of EPHA2 BINDING SITE, designated SEQ ID:10715, to the nucleotide sequence of VGAM1956 RNA, herein designated VGAM RNA, also designated SEQ ID:4667.

Another function of VGAM1956 is therefore inhibition of EphA2 (EPHA2, Accession NM_004431), a gene which binds to ephrin-a1, -a3, -a4 and -a5. Accordingly, utilities of VGAM1956 include diagnosis, prevention and treatment of diseases and clinical conditions associated with EPHA2. The function of EPHA2 and its association with various diseases and clinical conditions, has been established by previous studies, as described hereinabove with reference to VGAM1289. Ellis Van Creveld Syndrome (EVC, Accession NM_014556) is another VGAM1956 host target gene. EVC BINDING SITE is HOST TARGET binding site found in the 3' untranslated region of mRNA encoded by EVC, corresponding to a HOST TARGET binding site such as BINDING SITE I, BINDING SITE II or BINDING SITE III. Table 2 illustrates the complementarity of the nucleotide sequences of EVC BINDING SITE, designated SEQ ID:15894, to the nucleotide sequence of VGAM1956 RNA, herein designated VGAM RNA, also designated SEQ ID:4667.

Another function of VGAM1956 is therefore inhibition of Ellis Van Creveld Syndrome (EVC, Accession NM_014556). Accordingly, utilities of VGAM1956 include diagnosis, prevention and treatment of diseases and clinical conditions associated with EVC. Exostoses (multiple)-like 3 (EXTL3, Accession NM_001440) is another VGAM1956 host target gene. EXTL3 BINDING SITE is HOST TARGET binding site found in the 3' untranslated region of mRNA encoded by EXTL3, corresponding to a HOST TARGET binding site such as BINDING SITE I, BINDING SITE II or BINDING SITE III. Table 2 illustrates the complementarity of the nucleotide sequences of EXTL3 BINDING SITE, designated SEQ ID:7170, to the nucleotide sequence of VGAM1956 RNA, herein designated VGAM RNA, also designated SEQ ID:4667.

Another function of VGAM1956 is therefore inhibition of Exostoses (multiple)-like 3 (EXTL3, Accession NM_001440), a gene which a member of the multiple exostoses gene family. Accordingly, utilities of VGAM1956 include diagnosis, prevention and treatment of diseases and clinical conditions associated with EXTL3. The function of EXTL3 and its association with various diseases and clinical conditions, has been established by previous studies, as described hereinabove with reference to VGAM95. Fibroblast Growth Factor Receptor 1 (fms-related tyrosine kinase 2, Pfeiffer syndrome) (FGFR1, Accession NM_023107) is another VGAM1956 host target gene. FGFR1 BINDING SITE1 through FGFR1 BINDING SITE6 are HOST TARGET binding sites found in untranslated regions of mRNA encoded by FGFR1, corresponding to HOST TARGET binding sites such as BINDING SITE I, BINDING SITE II or BINDING SITE III. Table 2 illustrates the complementarity of the nucleotide sequences of FGFR1 BINDING SITE1 through FGFR1 BINDING SITE6, designated SEQ ID:23362, SEQ ID:23366, SEQ ID:23373, SEQ ID:17979, SEQ ID:6208 and SEQ ID:23377 respectively, to the nucleotide sequence of VGAM1956 RNA, herein designated VGAM RNA, also designated SEQ ID:4667.

Another function of VGAM1956 is therefore inhibition of Fibroblast Growth Factor Receptor 1 (fms-related tyrosine kinase 2, Pfeiffer syndrome) (FGFR1, Accession NM_023107). Accordingly, utilities of VGAM1956 include diagnosis, prevention and treatment of diseases and clinical conditions associated with FGFR1. Follistatin-like 3 (secreted glycoprotein) (FSTL3, Accession NM_005860) is another VGAM1956 host target gene. FSTL3 BINDING SITE is HOST TARGET binding site found in the 3' untranslated region of mRNA encoded by FSTL3, corresponding to a HOST TARGET binding site such as BINDING SITE I, BINDING SITE II or BINDING SITE III. Table 2 illustrates the complementarity of the nucleotide sequences of FSTL3 BINDING SITE, designated SEQ ID:12470, to the nucleotide sequence of VGAM1956 RNA, herein designated VGAM RNA, also designated SEQ ID:4667.

Another function of VGAM1956 is therefore inhibition of Follistatin-like 3 (secreted glycoprotein) (FSTL3, Accession NM_005860), a gene which is a member of the follistatin-module-protein family. Accordingly, utilities of VGAM1956 include diagnosis, prevention and treatment of diseases and clinical conditions associated with FSTL3. The function of FSTL3 and its association with various diseases and clinical conditions, has been established by previous studies, as described hereinabove with reference to VGAM200. Fucosyltransferase 5 (alpha (1,3) Fucosyltransferase) (FUT5, Accession NM_002034) is another VGAM1956 host target gene. FUT5 BINDING SITE is HOST TARGET binding site found in the 3' untranslated region of mRNA encoded by FUT5, corresponding to a HOST TARGET binding site such as BINDING SITE I, BINDING SITE II or BINDING SITE III. Table 2 illustrates the complementarity of the nucleotide sequences of FUT5 BINDING SITE, designated SEQ ID:7790, to the nucleotide sequence of VGAM1956 RNA, herein designated VGAM RNA, also designated SEQ ID:4667.

Another function of VGAM1956 is therefore inhibition of Fucosyltransferase 5 (alpha (1,3) Fucosyltransferase) (FUT5, Accession NM_002034), a gene which may catalyse alpha-1,3 glycosidic linkages involved in the expression of vim-2, lewis x/ssea-1 and sialyl lewis x antigens. Accordingly, utilities of VGAM1956 include diagnosis, prevention and treatment of diseases and clinical conditions associated with FUT5. The function of FUT5 and its association with various diseases and clinical conditions, has been established by previous studies, as described hereinabove with reference to VGAM1519. Fucosyltransferase 6 (alpha (1,3) Fucosyltransferase) (FUT6, Accession NM_000150) is another VGAM1956 host target gene. FUT6 BINDING SITE is HOST TARGET binding site found in the 3' untranslated region of mRNA encoded by FUT6, corresponding to a HOST TARGET binding site such as BINDING SITE I, BINDING SITE II or BINDING SITE III. Table 2 illustrates the complementarity of the nucleotide sequences of FUT6 BINDING SITE, designated SEQ ID:5650, to the nucleotide sequence of VGAM1956 RNA, herein designated VGAM RNA, also designated SEQ ID:4667.

Another function of VGAM1956 is therefore inhibition of Fucosyltransferase 6 (alpha (1,3) Fucosyltransferase) (FUT6, Accession NM_000150), a gene which is involved in the biosynthesis of the e-selectin ligand, sialyl-lewis x. catalyzes the transfer of fucose from gdp-beta-fucose to alpha-2,3 sialylated substrates. Accordingly, utilities of VGAM1956 include diagnosis, prevention and treatment of diseases and clinical conditions associated with FUT6. The function of FUT6 and its association with various diseases and clinical conditions, has been established by previous studies, as described hereinabove with reference to VGAM194. Glucose-6-phosphatase, Transport (glucose-6-phosphate) Protein 1 (G6PT1, Accession NM_001467) is another VGAM1956 host target gene. G6PT1 BINDING SITE is HOST TARGET binding site found in the 5' untranslated region of mRNA encoded by G6PT1, corresponding to a HOST TARGET binding site such as BINDING SITE I, BINDING SITE II or BINDING SITE III. Table 2 illustrates the complementarity of the nucleotide sequences of G6PT1 BINDING SITE, designated SEQ ID:7200, to the nucleotide sequence of VGAM1956 RNA, herein designated VGAM RNA, also designated SEQ ID:4667.

Another function of VGAM1956 is therefore inhibition of Glucose-6-phosphatase, Transport (glucose-6-phosphate) Protein 1 (G6PT1, Accession NM_001467). Accordingly, utilities of VGAM1956 include diagnosis, prevention and treatment of diseases and clinical conditions associated with G6PT1. Guanine Nucleotide Binding Protein (G protein), Alpha 11 (Gq class) (GNA11, Accession XM_072009) is another VGAM1956 host target gene. GNA11 BINDING SITE is HOST TARGET binding site found in the 3' untranslated region of mRNA encoded by GNA11, corresponding to a HOST TARGET binding site such as BINDING SITE I, BINDING SITE II or BINDING SITE III. Table 2 illustrates the complementarity of the nucleotide sequences of GNA11 BINDING SITE, designated SEQ ID:37455, to the nucleotide sequence of VGAM1956 RNA, herein designated VGAM RNA, also designated SEQ ID:4667.

Another function of VGAM1956 is therefore inhibition of Guanine Nucleotide Binding Protein (G protein), Alpha 11 (Gq class) (GNA11, Accession XM_072009), a gene which acts as an activator of phospholipase c. Accordingly, utilities of VGAM1956 include diagnosis, prevention and treatment of diseases and clinical conditions associated with GNA11. The function of GNA11 has been established by previous studies. Strathmann and Simon (1991) described the Gna11 gene in the mouse. The human gene was cloned by Jiang et al. (1991) and found to be 359 amino acids long. Mouse Gna11 and Gna15 (OMIM Ref. No. 139314) are tandemly duplicated in a head-to-tail array. Davignon et al. (1996) showed that the upstream gene, Gna11, is ubiquitously expressed, whereas expression of the downstream gene, Gna15, is restricted to hematopoietic cells. There was no evidence for alternative splicing within the coding sequence of either gene. Animal model experiments lend further support to the function of GNA11. Using gene targeting, Offermanns et al. (1998) generated Gna11-deficient mice that were viable and fertile with no apparent behavioral or morphologic defects. They bred Gnaq (OMIM Ref. No. 600998)-deficient mice with Gna11-deficient mice and observed gene dosage effects between Gnaq and Gna11. Embryos completely lacking both genes died in utero with heart malformations. Mice inheriting a single copy of either gene died within hours of birth with craniofacial and/or cardiac defects. Offermanns et al. (1998) concluded that at least 2 active alleles of these genes are required for extrauterine life. Genetic, morphologic, and pharmacologic analyses of intercross offspring inheriting different combinations of these 2 mutations indicated that Gnaq and Gna11 have overlapping functions in embryonic cardiomyocyte proliferation and craniofacial development.

It is appreciated that the abovementioned animal model for GNA11 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Offermanns, S.; Zhao, L.-P.; Gohla, A.; Sarosi, I.; Simon, M. I.; Wilkie, T. M.: Embryonic cardiomyocyte hypoplasia and craniofacial defects in G-alpha-q/G-alpha-11-mutant mice. EMBO J. 17:4304-4312, 1998; and Strathmann, M. P.; Simon, M. I.: G-alpha-12 and G-alpha-13 subunits define a fourth class of G protein alpha subunits. Proc. Nat. Acad. Sci. 88:5582-5586, 1991.

Further studies establishing the function and utilities of GNA11 are found in John Hopkins OMIM database record ID 139313, and in sited publications numbered 11937-1194 and 2186 listed in the bibliography section hereinbelow, which are also hereby incorporated by reference. Guanine Nucleotide Binding Protein (G protein), Alpha 15 (Gq class) (GNA15, Accession XM_009220) is another VGAM1956 host target gene. GNA15 BINDING SITE is HOST TARGET binding site found in the 3' untranslated region of mRNA encoded by GNA15, corresponding to a HOST TARGET binding site such as BINDING SITE I, BINDING SITE II or BINDING SITE III. Table 2 illustrates the complementarity of the nucleotide sequences of GNA15 BINDING SITE, designated SEQ ID:30105, to the nucleotide sequence of VGAM1956 RNA, herein designated VGAM RNA, also designated SEQ ID:4667.

Another function of VGAM1956 is therefore inhibition of Guanine Nucleotide Binding Protein (G protein), Alpha 15 (Gq class) (GNA15, Accession XM_009220). Accordingly, utilities of VGAM1956 include diagnosis, prevention and treatment of diseases and clinical conditions associated with GNA15. Glypican 6 (GPC6, Accession NM_005708) is another VGAM1956 host target gene. GPC6 BINDING SITE is HOST TARGET binding site found in the 5' untranslated region of mRNA encoded by GPC6, corresponding to a HOST TARGET binding site such as BINDING SITE I, BINDING SITE II or BINDING SITE III. Table 2 illustrates the complementarity of the nucleotide sequences of GPC6 BINDING SITE, designated SEQ ID:12260, to the nucleotide sequence of VGAM1956 RNA, herein designated VGAM RNA, also designated SEQ ID:4667.

Another function of VGAM1956 is therefore inhibition of Glypican 6 (GPC6, Accession NM_005708), a gene which may play a role in growth control and differentation. Accordingly, utilities of VGAM1956 include diagnosis, prevention and treatment of diseases and clinical conditions associated with GPC6. The function of GPC6 and its association with various diseases and clinical conditions, has been established by previous studies, as described hereinabove with reference to VGAM247. Glutamate Receptor, Metabotropic 1 (GRM1, Accession NM_000838) is another VGAM1956 host target gene. GRM1 BINDING SITE is HOST TARGET binding site found in the 3' untranslated region of mRNA encoded by GRM1, corresponding to a HOST TARGET binding site such as BINDING SITE I, BINDING SITE II or BINDING SITE III. Table 2 illustrates the complementarity of the nucleotide sequences of GRM1 BINDING SITE, designated SEQ ID:6497, to the nucleotide sequence of VGAM1956 RNA, herein designated VGAM RNA, also designated SEQ ID:4667.

Another function of VGAM1956 is therefore inhibition of Glutamate Receptor, Metabotropic 1 (GRM1, Accession NM_000838), a gene which promotes phosphoinositide hydrolysis. Accordingly, utilities of VGAM1956 include diagnosis, prevention and treatment of diseases and clinical conditions associated with GRM1. The function of GRM1 and its association with various diseases and clinical conditions, has been established by previous studies, as described hereinabove with reference to VGAM786. Histamine Receptor H1 (HRH1, Accession NM_000861) is another VGAM1956 host target gene. HRH1 BINDING SITE is HOST TARGET binding site found in the 3' untranslated region of mRNA encoded by HRH1, corresponding to a HOST TARGET binding site such as BINDING SITE I, BINDING SITE II or BINDING SITE III. Table 2 illustrates the complementarity of the nucleotide sequences of HRH1 BINDING SITE, designated SEQ ID:6526, to the nucleotide sequence of VGAM1956 RNA, herein designated VGAM RNA, also designated SEQ ID:4667.

Another function of VGAM1956 is therefore inhibition of Histamine Receptor H1 (HRH1, Accession NM_000861), a gene which stimulates the synthesis of inositol phosphate. Accordingly, utilities of VGAM1956 include diagnosis, prevention and treatment of diseases and clinical conditions associated with HRH1. The function of HRH1 and its association with various diseases and clinical conditions, has been established by previous studies, as described hereinabove with reference to VGAM766. Heparan Sulfate 2-O-sulfotransferase 1 (HS2ST1, Accession NM_012262) is another VGAM1956 host target gene. HS2ST1 BINDING SITE is HOST TARGET binding site found in the 5' untranslated region of mRNA encoded by HS2ST1, corresponding to a HOST TARGET binding site such as BINDING SITE I, BINDING SITE II or BINDING SITE III. Table 2 illustrates the complementarity of the nucleotide sequences of HS2ST1 BINDING SITE, designated SEQ ID:14575, to the nucleotide sequence of VGAM1956 RNA, herein designated VGAM RNA, also designated SEQ ID:4667.

Another function of VGAM1956 is therefore inhibition of Heparan Sulfate 2-O-sulfotransferase 1 (HS2ST1, Accession NM_012262). Accordingly, utilities of VGAM1956 include diagnosis, prevention and treatment of diseases and clinical conditions associated with HS2ST1. HTRA3 (Accession XM_114416) is another VGAM1956 host target gene. HTRA3 BINDING SITE is HOST TARGET binding site found in the 3' untranslated region of mRNA encoded by HTRA3, corresponding to a HOST TARGET binding site such as BINDING SITE I, BINDING SITE II or BINDING SITE III. Table 2 illustrates the complementarity of the nucleotide sequences of HTRA3 BINDING SITE, designated SEQ ID:42943, to the nucleotide sequence of VGAM1956 RNA, herein designated VGAM RNA, also designated SEQ ID:4667.

Another function of VGAM1956 is therefore inhibition of HTRA3 (Accession XM_114416). Accordingly, utilities of VGAM1956 include diagnosis, prevention and treatment of diseases and clinical conditions associated with HTRA3. Insulin Receptor Substrate 2 (IRS2, Accession XM_007095) is another VGAM1956 host target gene. IRS2 BINDING SITE is HOST TARGET binding site found in the 3' untranslated region of mRNA encoded by IRS2, corresponding to a HOST TARGET binding site such as BINDING SITE I, BINDING SITE II or BINDING SITE III. Table 2 illustrates the complementarity of the nucleotide sequences of IRS2 BINDING SITE, designated SEQ ID:30035, to the nucleotide sequence of VGAM1956 RNA, herein designated VGAM RNA, also designated SEQ ID:4667.

Another function of VGAM1956 is therefore inhibition of Insulin Receptor Substrate 2 (IRS2, Accession XM_007095), a gene which may mediate the control of various cellular processes by insulin. Accordingly, utilities of VGAM1956 include diagnosis, prevention and treatment of diseases and clinical conditions associated with IRS2. The function of IRS2 and its association with various diseases and clinical conditions, has been established by previous studies, as described hereinabove with reference to VGAM1217. Integrin, Alpha M (complement component receptor 3, alpha; also known as CD11b (p170), Macrophage Antigen Alpha Polypeptide) (ITGAM, Accession NM_000632) is another VGAM1956 host target gene. ITGAM BINDING SITE is HOST TARGET binding site found in the 3' untranslated region of mRNA encoded by ITGAM, corresponding to a HOST TARGET binding site such as BINDING SITE I, BINDING SITE II or BINDING SITE III. Table 2 illustrates the complementarity of the nucleotide sequences of ITGAM BINDING SITE, designated SEQ ID:6249, to the nucleotide sequence of VGAM1956 RNA, herein designated VGAM RNA, also designated SEQ ID:4667.

Another function of VGAM1956 is therefore inhibition of Integrin, Alpha M (complement component receptor 3, alpha; also known as CD11b (p170), Macrophage Antigen Alpha Polypeptide) (ITGAM, Accession NM_000632), a gene which is invovled in various adhesive interactions of monocytes, macrophages and granulocytes as well as in mediating the uptake of complement-coated particles. Accordingly, utilities of VGAM1956 include diagnosis, prevention and treatment of diseases and clinical conditions associated with ITGAM. The function of ITGAM and its association with various diseases and clinical conditions, has been established by previous studies, as described hereinabove with reference to VGAM1386. Lactate Dehydrogenase C (LDHC, Accession NM_002301) is another VGAM1956 host target gene. LDHC BINDING SITE is HOST TARGET binding site found in the 5' untranslated region of mRNA encoded by LDHC, corresponding to a HOST TARGET binding site such as BINDING SITE I, BINDING SITE II or BINDING SITE III. Table 2 illustrates the complementarity of the nucleotide sequences of LDHC BINDING SITE, designated SEQ ID:8092, to the nucleotide sequence of VGAM1956 RNA, herein designated VGAM RNA, also designated SEQ ID:4667.

Another function of VGAM1956 is therefore inhibition of Lactate Dehydrogenase C (LDHC, Accession NM_002301). Accordingly, utilities of VGAM1956 include diagnosis, prevention and treatment of diseases and clinical conditions associated with LDHC. Lysyl Oxidase-like 2 (LOXL2, Accession NM_002318) is another VGAM1956 host target gene. LOXL2 BINDING SITE is HOST TARGET binding site found in the 3' untranslated region of mRNA encoded by LOXL2, corresponding to a HOST TARGET binding site such as BINDING SITE I, BINDING SITE II or BINDING SITE III. Table 2 illustrates the complementarity of the nucleotide sequences of LOXL2 BINDING SITE, designated SEQ ID:8134, to the nucleotide sequence of VGAM1956 RNA, herein designated VGAM RNA, also designated SEQ ID:4667.

Another function of VGAM1956 is therefore inhibition of Lysyl Oxidase-like 2 (LOXL2, Accession NM_002318), a gene which may have roles in senescence and cell adhesion. Accordingly, utilities of VGAM1956 include diagnosis, prevention and treatment of diseases and clinical conditions associated with LOXL2. The function of LOXL2 and its association with various diseases and clinical conditions, has been established by previous studies, as described hereinabove with reference to VGAM147. Myeloma Overexpressed Gene (in a subset of t (11;14) Positive Multiple Myelomas) (MYEOV, Accession NM_138768) is another VGAM1956 host target gene. MYEOV BINDING SITE is HOST TARGET binding site found in the 5' untranslated region of mRNA encoded by MYEOV, corresponding to a HOST TARGET binding site such as BINDING SITE I, BINDING SITE II or BINDING SITE III. Table 2 illustrates the complementarity of the nucleotide sequences of MYEOV BINDING SITE, designated SEQ ID:29002, to the nucleotide sequence of VGAM1956 RNA, herein designated VGAM RNA, also designated SEQ ID:4667.

Another function of VGAM1956 is therefore inhibition of Myeloma Overexpressed Gene (in a subset of t (11;14) Positive Multiple Myelomas) (MYEOV, Accession NM_138768), a gene which is encoded by MYELOMA OVEREXPRESSED GENE. Accordingly, utilities of VGAM1956 include diagnosis, prevention and treatment of diseases and clinical conditions associated with MYEOV. The function of MYEOV and its association with various diseases and clinical conditions, has been established by previous studies, as described hereinabove with reference to VGAM471. Pericentriolar Material 1 (PCM1, Accession NM_006197) is another VGAM1956 host target gene. PCM1 BINDING SITE is HOST TARGET binding site found in the 5' untranslated region of mRNA encoded by PCM1, corresponding to a HOST TARGET binding site such as BINDING SITE I, BINDING SITE II or BINDING SITE III. Table 2 illustrates the complementarity of the nucleotide sequences of PCM1 BINDING SITE, designated SEQ ID:12870, to the nucleotide sequence of VGAM1956 RNA, herein designated VGAM RNA, also designated SEQ ID:4667.

Another function of VGAM1956 is therefore inhibition of Pericentriolar Material 1 (PCM1, Accession NM_006197), a gene which appears to play a role in cytokinesis, cell shape, and specialized functions such as secretion and capping. Accordingly, utilities of VGAM1956 include diagnosis, prevention and treatment of diseases and clinical conditions associated with PCM1. The function of PCM1 has been established by previous studies. Balczon et al. (1994) identified a 228-kD centrosome autoantigen designated PCM1 for pericentriolar material-1. In the course of investigating the region 8p22-p21.3, commonly involved in loss of heterozygosity in hepatocellular carcinomas, colorectal cancers, and non-small-cell lung cancers, Ohata et al. (1994) found a gene that was 100% identical to the nucleotide sequences of the cDNA for PCM1. The cosmid had previously been mapped to the 8p22-p21.3 region by fluorescence in situ hybridization and by pulsed field gel electrophoresis. Screening for rearrangements in Southern blots containing DNAs of a large number of cancers of the above-mentioned 3 types failed to demonstrate obvious rearrangements; however, a HindIII polymorphism in the PCM1 gene was found. The RET protooncogene (OMIM Ref. No. 164761) is often activated through somatic rearrangements in papillary thyroid carcinomas (OMIM Ref. No. 188550). Three main rearranged forms of RET have been described: RET/PTC1, in which the partner is called H4 (OMIM Ref. No. 601985) and RET/PTC3, in which the partner is called NCOA4 (OMIM Ref. No. 601984), both of which arise from a paracentric inversion on 10q; and RET/PTC2, in which the partner is PRKAR1A (OMIM Ref. No. 188830), which originates from a 10;17 translocation. Corvi et al. (2000) identified a rearrangement involving the RET tyrosine kinase domain and the 5-prime portion of PCM1. FISH analysis confirmed the chromosomal localization of PCM1 on 8p22-p21. Immunohistochemistry using an antibody specific for the C-terminal portion of PCM1 showed that the protein level was drastically decreased and its subcellular localization altered in papillary thyroid tumor tissue with respect to normal thyroid.

Full details of the abovementioned studies are described in the following publications, the disclosure of which are hereby incorporated by reference:

Corvi, R.; Berger, N.; Balczon, R.; Romeo, G.: RET/PCM-1: a novel fusion gene in papillary thyroid carcinoma. Oncogene 19:4236-4242, 2000. ; and Ohata, H.; Fujiwara, Y.; Koyama, K.; Nakamura, Y.: Mapping of the human autoantigen pericentriolar material 1 (PCM1) gene to chromosome 8p21.3-p22. Genomics 24:404-406, 1994.

Further studies establishing the function and utilities of PCM1 are found in John Hopkins OMIM database record ID 600299, and in sited publications numbered 158 and 1592-1593 listed in the bibliography section hereinbelow, which are also hereby incorporated by reference. Platelet-derived Growth Factor Receptor, Alpha Polypeptide (PDGFRA, Accession NM_006206) is another VGAM1956 host target gene. PDGFRA BINDING SITE is HOST TARGET binding site found in the 3' untranslated region of mRNA encoded by PDGFRA, corresponding to a HOST TARGET binding site such as BINDING SITE I, BINDING SITE II or BINDING SITE III. Table 2 illustrates the complementarity of the nucleotide sequences of PDGFRA BINDING SITE, designated SEQ ID:12885, to the nucleotide sequence of VGAM1956 RNA, herein designated VGAM RNA, also designated SEQ ID:4667.

Another function of VGAM1956 is therefore inhibition of Platelet-derived Growth Factor Receptor, Alpha Polypeptide (PDGFRA, Accession NM_006206), a gene which this receptor binds platelet-derived growth factor and has a tyrosine-protein kinase activity. Accordingly, utilities of VGAM1956 include diagnosis, prevention and treatment of diseases and clinical conditions associated with PDGFRA. The function of PDGFRA and its association with various diseases and clinical conditions, has been established by previous studies, as described hereinabove with reference to VGAM117. Pim-1 Oncogene (PIM1, Accession XM_165800) is another VGAM1956 host target gene. PIM1 BINDING SITE is HOST TARGET binding site found in the 3' untranslated region of mRNA encoded by PIM1, corresponding to a HOST TARGET binding site such as BINDING SITE I, BINDING SITE II or BINDING SITE III. Table 2 illustrates the complementarity of the nucleotide sequences of PIM1 BINDING SITE, designated SEQ ID:43757, to the nucleotide sequence of VGAM1956 RNA, herein designated VGAM RNA, also designated SEQ ID:4667.

Another function of VGAM1956 is therefore inhibition of Pim-1 Oncogene (PIM1, Accession XM_165800), a gene which is a proto-oncogene. Accordingly, utilities of VGAM1956 include diagnosis, prevention and treatment of diseases and clinical conditions associated with PIM1. The function of PIM1 and its association with various diseases and clinical conditions, has been established by previous studies, as described hereinabove with reference to VGAM95. Perilipin (PLIN, Accession NM_002666) is another VGAM1956 host target gene. PLIN BINDING SITE is HOST TARGET binding site found in the 3' untranslated region of mRNA encoded by PLIN, corresponding to a HOST TARGET binding site such as BINDING SITE I, BINDING SITE II or BINDING SITE III. Table 2 illustrates the complementarity of the nucleotide sequences of PLIN BINDING SITE, designated SEQ ID:8536, to the nucleotide sequence of VGAM1956 RNA, herein designated VGAM RNA, also designated SEQ ID:4667.

Another function of VGAM1956 is therefore inhibition of Perilipin (PLIN, Accession NM_002666). Accordingly, utilities of VGAM1956 include diagnosis, prevention and treatment of diseases and clinical conditions associated with PLIN. POM (POM121 homolog, rat) and ZP3 Fusion (POMZP3, Accession NM_012230) is another VGAM1956 host target gene. POMZP3 BINDING SITE is HOST TARGET binding site found in the 5' untranslated region of mRNA encoded by POMZP3, corresponding to a HOST TARGET binding site such as BINDING SITE I, BINDING SITE II or BINDING SITE III. Table 2 illustrates the complementarity of the nucleotide sequences of POMZP3 BINDING SITE, designated SEQ ID:14529, to the nucleotide sequence of VGAM1956 RNA, herein designated VGAM RNA, also designated SEQ ID:4667.

Another function of VGAM1956 is therefore inhibition of POM (POM121 homolog, rat) and ZP3 Fusion (POMZP3, Accession NM_012230). Accordingly, utilities of VGAM1956 include diagnosis, prevention and treatment of diseases and clinical conditions associated with POMZP3. Paraoxonase 1 (PON1, Accession NM_000446) is another VGAM1956 host target gene. PON1 BINDING SITE is HOST TARGET binding site found in the 3' untranslated region of mRNA encoded by PON1, corresponding to a HOST TARGET binding site such as BINDING SITE I, BINDING SITE II or BINDING SITE III. Table 2 illustrates the complementarity of the nucleotide sequences of PON1 BINDING SITE, designated SEQ ID:6033, to the nucleotide sequence of VGAM1956 RNA, herein designated VGAM RNA, also designated SEQ ID:4667.

Another function of VGAM1956 is therefore inhibition of Paraoxonase 1 (PON1, Accession NM_000446), a gene which hydrolyzes the toxic metabolites of a variety of organophosphorus insecticides. Accordingly, utilities of VGAM1956 include diagnosis, prevention and treatment of diseases and clinical conditions associated with PON1. The function of PON1 has been established by previous studies. Two factors result in large individual variations in PON serum levels: a substrate-dependent activity polymorphism and large individual differences in PON protein levels that are stable over time. Animal model studies indicated that PON activity levels are likely to play a major role in determining sensitivity to several organophosphate insecticides (Clendenning et al., 1996). The arg192 isoform (168820.0001) appears to be a risk factor in coronary artery disease. Serum paraoxonase is an esterase that is associated with high density lipoproteins (HDLs) in the plasma. It is involved in the detoxification of organophosphate insecticides such as parathion and chlorpyrifos. PON1 may also confer protection against coronary artery disease by destroying proinflammatory oxidized lipids present in oxidized low density lipoproteins (LDLs). To study the role of PON1 in vivo, Shih et al. (1998) created PON1-knockout mice by gene targeting. Compared with their wildtype littermates, PON1-deficient mice were extremely sensitive to the toxic effects of chlorpyrifos oxon, the activated form of chlorpyrifos, and were more sensitive to chlorpyrifos itself. HDLs isolated from PON1-deficient mice were unable to prevent LDL oxidation in a cocultured cell model of the artery wall, and both HDLs and LDLs isolated from PON1-knockout mice were more susceptible to oxidation by cocultured cells than were lipoproteins from wildtype littermates. When fed on a high-fat, high-cholesterol diet, PON1-null mice were more susceptible to atherosclerosis than were their wildtype littermates.

Full details of the abovementioned studies are described in the following publications, the disclosure of which are hereby incorporated by reference:

Clendenning, J. B.; Humbert, R.; Green, E. D.; Wood, C.; Traver, D.; Furlong, C. E.: Structural organization of the human PON1 gene. Genomics 35:586-589, 1996; and Shih, D. M.; Gu, L.; Xia, Y.-R.; Navab, M.; Li, W.-F.; Hama, S.; Castellani, L. W.; Furlong, C. E.; Costa, L. G.; Fogelman, A. M.; Lusis, A. J.: Mice lacking serum paraoxonase are suscepti.

Further studies establishing the function and utilities of PON1 are found in John Hopkins OMIM database record ID 168820, and in sited publications numbered 11543-11555, 9, 2465-2486, 3780-249 and 3251-3252 listed in the bibliography section hereinbelow, which are also hereby incorporated by reference. Prospero-related Homeobox 1 (PROX1, Accession NM_002763) is another VGAM1956 host target gene. PROX1 BINDING SITE is HOST TARGET binding site found in the 5' untranslated region of mRNA encoded by PROX1, corresponding to a HOST TARGET binding site such as BINDING SITE I, BINDING SITE II or BINDING SITE III. Table 2 illustrates the complementarity of the nucleotide sequences of PROX1 BINDING SITE, designated SEQ ID:8651, to the nucleotide sequence of VGAM1956 RNA, herein designated VGAM RNA, also designated SEQ ID:4667.

Another function of VGAM1956 is therefore inhibition of Prospero-related Homeobox 1 (PROX1, Accession NM_002763), a gene which may regulate gene expression and development of postmitotic undifferentiated young neurons. Accordingly, utilities of VGAM1956 include diagnosis, prevention and treatment of diseases and clinical conditions associated with PROX1. The function of PROX1 and its association with various diseases and clinical conditions, has been established by previous studies, as described hereinabove with reference to VGAM430. Prosaposin (variant Gaucher disease and variant metachromatic leukodystrophy) (PSAP, Accession XM_045140) is another VGAM1956 host target gene. PSAP BINDING SITE is HOST TARGET binding site found in the 3' untranslated region of mRNA encoded by PSAP, corresponding to a HOST TARGET binding site such as BINDING SITE I, BINDING SITE II or BINDING SITE III. Table 2 illustrates the complementarity of the nucleotide sequences of PSAP BINDING SITE, designated SEQ ID:34374, to the nucleotide sequence of VGAM1956 RNA, herein designated VGAM RNA, also designated SEQ ID:4667.

Another function of VGAM1956 is therefore inhibition of Prosaposin (variant Gaucher disease and variant metachromatic leukodystrophy) (PSAP, Accession XM_045140). Accordingly, utilities of VGAM1956 include diagnosis, prevention and treatment of diseases and clinical conditions associated with PSAP. Prostaglandin-endoperoxide Synthase 2 (prostaglandin G/H synthase and cyclooxygenase) (PTGS2, Accession NM_000963) is another VGAM1956 host target gene. PTGS2 BINDING SITE is HOST TARGET binding site found in the 3' untranslated region of mRNA encoded by PTGS2, corresponding to a HOST TARGET binding site such as BINDING SITE I, BINDING SITE II or BINDING SITE III. Table 2 illustrates the complementarity of the nucleotide sequences of PTGS2 BINDING SITE, designated SEQ ID:6684, to the nucleotide sequence of VGAM1956 RNA, herein designated VGAM RNA, also designated SEQ ID:4667.

Another function of VGAM1956 is therefore inhibition of Prostaglandin-endoperoxide Synthase 2 (prostaglandin G/H synthase and cyclooxygenase) (PTGS2, Accession NM_000963), a gene which may have a role as a major mediator of inflammation and/or a role for prostanoid signaling in activity-dependent plasticity. Accordingly, utilities of VGAM1956 include diagnosis, prevention and treatment of diseases and clinical conditions associated with PTGS2. The function of PTGS2 and its association with various diseases and clinical conditions, has been established by previous studies, as described hereinabove with reference to VGAM292. RalA Binding Protein 1 (RALBP1, Accession NM_006788) is another VGAM1956 host target gene. RALBP1 BINDING SITE is HOST TARGET binding site found in the 3' untranslated region of mRNA encoded by RALBP1, corresponding to a HOST TARGET binding site such as BINDING SITE I, BINDING SITE II or BINDING SITE III. Table 2 illustrates the complementarity of the nucleotide sequences of RALBP1 BINDING SITE, designated SEQ ID:13665, to the nucleotide sequence of VGAM1956 RNA, herein designated VGAM RNA, also designated SEQ ID:4667.

Another function of VGAM1956 is therefore inhibition of RalA Binding Protein 1 (RALBP1, Accession NM_006788), a gene which plays a role in signal transduction and catalyzes the transport of glutathione conjugates and xenobiotics. Accordingly, utilities of VGAM1956 include diagnosis, prevention and treatment of diseases and clinical conditions associated with RALBP1. The function of RALBP1 and its association with various diseases and clinical conditions, has been established by previous studies, as described hereinabove with reference to VGAM345. Retinoic Acid Receptor, Alpha (RARA, Accession NM_000964) is another VGAM1956 host target gene. RARA BINDING SITE is HOST TARGET binding site found in the 3' untranslated region of mRNA encoded by RARA, corresponding to a HOST TARGET binding site such as BINDING SITE I, BINDING SITE II or BINDING SITE III. Table 2 illustrates the complementarity of the nucleotide sequences of RARA BINDING SITE, designated SEQ ID:6689, to the nucleotide sequence of VGAM1956 RNA, herein designated VGAM RNA, also designated SEQ ID:4667.

Another function of VGAM1956 is therefore inhibition of Retinoic Acid Receptor, Alpha (RARA, Accession NM_000964). Accordingly, utilities of VGAM1956 include diagnosis, prevention and treatment of diseases and clinical conditions associated with RARA. RP42 (Accession NM_020640) is another VGAM1956 host target gene. RP42 BINDING SITE is HOST TARGET binding site found in the 3' untranslated region of mRNA encoded by RP42, corresponding to a HOST TARGET binding site such as BINDING SITE I, BINDING SITE II or BINDING SITE III. Table 2 illustrates the complementarity of the nucleotide sequences of RP42 BINDING SITE, designated SEQ ID:21802, to the nucleotide sequence of VGAM1956 RNA, herein designated VGAM RNA, also designated SEQ ID:4667.

Another function of VGAM1956 is therefore inhibition of RP42 (Accession NM_020640), a gene which not clear yet. Accordingly, utilities of VGAM1956 include diagnosis, prevention and treatment of diseases and clinical conditions associated with RP42. The function of RP42 and its association with various diseases and clinical conditions, has been established by previous studies, as described hereinabove with reference to VGAM47. Ribophorin II (RPN2, Accession NM_002951) is another VGAM1956 host target gene. RPN2 BINDING SITE is HOST TARGET binding site found in the 5' untranslated region of mRNA encoded by RPN2, corresponding to a HOST TARGET binding site such as BINDING SITE I, BINDING SITE II or BINDING SITE III. Table 2 illustrates the complementarity of the nucleotide sequences of RPN2 BINDING SITE, designated SEQ ID:8863, to the nucleotide sequence of VGAM1956 RNA, herein designated VGAM RNA, also designated SEQ ID:4667.

Another function of VGAM1956 is therefore inhibition of Ribophorin II (RPN2, Accession NM_002951). Accordingly, utilities of VGAM1956 include diagnosis, prevention and treatment of diseases and clinical conditions associated with RPN2. Spinocerebellar Ataxia 1 (olivopontocerebellar ataxia 1, autosomal dominant, ataxin 1) (SCA1, Accession NM_000332) is another VGAM1956 host target gene. SCA1 BINDING SITE is HOST TARGET binding site found in the 5' untranslated region of mRNA encoded by SCA1, corresponding to a HOST TARGET binding site such as BINDING SITE I, BINDING SITE II or BINDING SITE III. Table 2 illustrates the complementarity of the nucleotide sequences of SCA1 BINDING SITE, designated SEQ ID:5880, to the nucleotide sequence of VGAM1956 RNA, herein designated VGAM RNA, also designated SEQ ID:4667.

Another function of VGAM1956 is therefore inhibition of Spinocerebellar Ataxia 1 (olivopontocerebellar ataxia 1, autosomal dominant, ataxin 1) (SCA1, Accession NM_000332). Accordingly, utilities of VGAM1956 include diagnosis, prevention and treatment of diseases and clinical conditions associated with SCA1. Syndecan 1 (SDC1, Accession NM_002997) is another VGAM1956 host target gene. SDC1 BINDING SITE is HOST TARGET binding site found in the 3' untranslated region of mRNA encoded by SDC1, corresponding to a HOST TARGET binding site such as BINDING SITE I, BINDING SITE II or BINDING SITE III. Table 2 illustrates the complementarity of the nucleotide sequences of SDC1 BINDING SITE, designated SEQ ID:8888, to the nucleotide sequence of VGAM1956 RNA, herein designated VGAM RNA, also designated SEQ ID:4667.

Another function of VGAM1956 is therefore inhibition of Syndecan 1 (SDC1, Accession NM_002997), a gene which mediates cell behaviors like cell adhesion, action of growth factors. Accordingly, utilities of VGAM1956 include diagnosis, prevention and treatment of diseases and clinical conditions associated with SDC1. The function of SDC1 and its association with various diseases and clinical conditions, has been established by previous studies, as described hereinabove with reference to VGAM534. Suppressor of Cytokine Signaling 5 (SOCS5, Accession NM_014011) is another VGAM1956 host target gene. SOCS5 BINDING SITE is HOST TARGET binding site found in the 3' untranslated region of mRNA encoded by SOCS5, corresponding to a HOST TARGET binding site such as BINDING SITE I, BINDING SITE II or BINDING SITE III. Table 2 illustrates the complementarity of the nucleotide sequences of SOCS5 BINDING SITE, designated SEQ ID:15229, to the nucleotide sequence of VGAM1956 RNA, herein designated VGAM RNA, also designated SEQ ID:4667.

Another function of VGAM1956 is therefore inhibition of Suppressor of Cytokine Signaling 5 (SOCS5, Accession NM_014011). Accordingly, utilities of VGAM1956 include diagnosis, prevention and treatment of diseases and clinical conditions associated with SOCS5. SRY (sex determining region Y)-box 13 (SOX13, Accession NM_005686) is another VGAM1956 host target gene. SOX13 BINDING SITE is HOST TARGET binding site found in the 3' untranslated region of mRNA encoded by SOX13, corresponding to a HOST TARGET binding site such as BINDING SITE I, BINDING SITE II or BINDING SITE III. Table 2 illustrates the complementarity of the nucleotide sequences of SOX13 BINDING SITE, designated SEQ ID:12244, to the nucleotide sequence of VGAM1956 RNA, herein designated VGAM RNA, also designated SEQ ID:4667.

Another function of VGAM1956 is therefore inhibition of SRY (sex determining region Y)-box 13 (SOX13, Accession NM_005686). Accordingly, utilities of VGAM1956 include diagnosis, prevention and treatment of diseases and clinical conditions associated with SOX13. SWAP70 (Accession XM_049197) is another VGAM1956 host target gene. SWAP70 BINDING SITE is HOST TARGET binding site found in the 3' untranslated region of mRNA encoded by SWAP70, corresponding to a HOST TARGET binding site such as BINDING SITE I, BINDING SITE II or BINDING SITE III. Table 2 illustrates the complementarity of the nucleotide sequences of SWAP70 BINDING SITE, designated SEQ ID:35349, to the nucleotide sequence of VGAM1956 RNA, herein designated VGAM RNA, also designated SEQ ID:4667.

Another function of VGAM1956 is therefore inhibition of SWAP70 (Accession XM_049197), a gene which is involved not only in nuclear events but also in signaling in B-cell activation. Accordingly, utilities of VGAM1956 include diagnosis, prevention and treatment of diseases and clinical conditions associated with SWAP70. The function of SWAP70 and its association with various diseases and clinical conditions, has been established by previous studies, as described hereinabove with reference to VGAM1090. TAF6 RNA Polymerase II, TATA Box Binding Protein (TBP)-associated Factor, 80 kDa (TAF6, Accession NM_005641) is another VGAM1956 host target gene. TAF6 BINDING SITE is HOST TARGET binding site found in the 5' untranslated region of mRNA encoded by TAF6, corresponding to a HOST TARGET binding site such as BINDING SITE I, BINDING SITE II or BINDING SITE III. Table 2 illustrates the complementarity of the nucleotide sequences of TAF6 BINDING SITE, designated SEQ ID:12174, to the nucleotide sequence of VGAM1956 RNA, herein designated VGAM RNA, also designated SEQ ID:4667.

Another function of VGAM1956 is therefore inhibition of TAF6 RNA Polymerase II, TATA Box Binding Protein (TBP)-associated Factor, 80 kDa (TAF6, Accession NM_005641), a gene which plays a central role in mediating promoter responses to various activators and repressors. Accordingly, utilities of VGAM1956 include diagnosis, prevention and treatment of diseases and clinical conditions associated with TAF6. The function of TAF6 has been established by previous studies. TFIID is an essential general transcription factor (GTF) that binds stably to the TATA element of class II promoters and nucleates the assembly of other GTFs (e.g., 600519) and RNA polymerase II (see OMIM Ref. No. 180660) into a functional preinitiation complex. It is composed of a highly conserved TATA-binding polypeptide (TBP; 600075) and tightly associated polypeptides called TBP-associated factors (TAFs), which are required for activator-dependent transcription. By screening a HeLa cell cDNA library with a Drosophila TAFII60 cDNA, Weinzierl et al. (1993) isolated cDNAs encoding TAF2E, which they called TAFII70. Sequence analysis revealed 3 distinct TAFII70 cDNAs, and the authors suggested that they corresponded to alternatively spliced transcripts. Southern blot analysis of human genomic DNA confirmed that TAFII70 is a single-copy gene. The 3 predicted TAFII70 proteins have 667, 677, and 726 amino acids; Weinzierl et al. (1993) chose a cDNA encoding the 677-amino acid isoform for further characterization. Recombinant TAFII70 bound weakly to TBP and tightly to TAFII250 (TAF2A; 313650), the largest subunit of TFIID. In the presence of TAFII70, TBP, and TAFII250, a stable ternary complex was formed. Independently, Hisatake et al. (1995) isolated a cDNA encoding TAF2E, which they called TAFII80, by screening a human placenta cDNA library with a 'best-guess' oligonucleotide based on a peptide sequence of TAFII80. Northern blot analysis detected a 2.5-kb TAFII80 transcript. The predicted protein was identical to the deduced 677-amino acid protein of Weinzierl et al. (1993). TAFII80 is proline-rich overall and has a serine-, threonine-, and proline-rich region at its C terminus. The TAFII80 and Drosophila TAFII60 proteins share conserved regions of 50% and 64% sequence identity within their N-terminal and central sections, respectively. An N-terminal 55-amino acid segment of TAFII80 is 24% identical to a region of histone H4 that is believed to form part of the hydrophobic core of the histone octamer. TAFII80 from HeLa cell extracts had a molecular mass of 80 kD by Western blot analysis. Coimmunoprecipitation studies showed that TAFII80 interacted with TBP, TAFII250, TAFII31 (TAF2G; 600822), TAFII20 (TAF2J; 600773), TFIIE-alpha (GTF2E1; 189962), and TFIIF-alpha (GTF2F1; 189968); Hisatake et al. (1995) identified 3 distinct domains in TAFII80 that are involved in these interactions. TAFII80 did not interact with TAFII55 (TAF2F; 600573), TFIIB (GTF2B; 189963), TFIIE-beta (GTF2E2; 189964), or TFIIF-beta (GTF2F2; 189969).

Full details of the abovementioned studies are described in the following publications, the disclosure of which are hereby incorporated by reference:

Hisatake, K.; Ohta, T.; Takada, R.; Guermah, M.; Horikoshi, M.; Nakatani, Y.; Roeder, R. G.: Evolutionary conservation of human TATA-binding-polypeptide-associated factors TAFII31 and TAFII80 and interactions of TAFII80 with other TAFs and with general transcription factors. Proc. Nat. Acad. Sci. 92:8195-8199, 1995; and Weinzierl, R. O. J.; Ruppert, S.; Dynlacht, B. D.; Tanese, N.; Tjian, R.: Cloning and expression of Drosophila TAFII60 and human TAFII70 reveal conserved interactions with other subuni.

Further studies establishing the function and utilities of TAF6 are found in John Hopkins OMIM database record ID 602955, and in sited publications numbered 8641-8643 listed in the bibliography section hereinbelow, which are also hereby incorporated by reference. TNF Receptor-associated Factor 5 (TRAF5, Accession NM_004619) is another VGAM1956 host target gene. TRAF5 BINDING SITE is HOST TARGET binding site found in the 3' untranslated region of mRNA encoded by TRAF5, corresponding to a HOST TARGET binding site such as BINDING SITE I, BINDING SITE II or BINDING SITE III. Table 2 illustrates the complementarity of the nucleotide sequences of TRAF5 BINDING SITE, designated SEQ ID:10967, to the nucleotide sequence of VGAM1956 RNA, herein designated VGAM RNA, also designated SEQ ID:4667.

Another function of VGAM1956 is therefore inhibition of TNF Receptor-associated Factor 5 (TRAF5, Accession NM_004619), a gene which Member of a family of proteins that interact with TNF receptors; binds the lymphotoxin beta receptor (LTBR). Accordingly, utilities of VGAM1956 include diagnosis, prevention and treatment of diseases and clinical conditions associated with TRAF5. The function of TRAF5 and its association with various diseases and clinical conditions, has been established by previous studies, as described hereinabove with reference to VGAM76. UV Radiation Resistance Associated Gene (UVRAG, Accession NM_003369) is another VGAM1956 host target gene. UVRAG BINDING SITE is HOST TARGET binding site found in the 5' untranslated region of mRNA encoded by UVRAG, corresponding to a HOST TARGET binding site such as BINDING SITE I, BINDING SITE II or BINDING SITE III. Table 2 illustrates the complementarity of the nucleotide sequences of UVRAG BINDING SITE, designated SEQ ID:9394, to the nucleotide sequence of VGAM1956 RNA, herein designated VGAM RNA, also designated SEQ ID:4667.

Another function of VGAM1956 is therefore inhibition of UV Radiation Resistance Associated Gene (UVRAG, Accession NM_003369). Accordingly, utilities of VGAM1956 include diagnosis, prevention and treatment of diseases and clinical conditions associated with UVRAG. Vitamin D (1,25- dihydroxyvitamin D3) Receptor (VDR, Accession NM_000376) is another VGAM1956 host target gene. VDR BINDING SITE is HOST TARGET binding site found in the 3" untranslated region of mRNA encoded by VDR, corresponding to a HOST TARGET binding site such as BINDING SITE I, BINDING SITE II or BINDING SITE III. Table 2 illustrates the complementarity of the nucleotide sequences of VDR BINDING SITE, designated SEQ ID:5948, to the nucleotide sequence of VGAM1956 RNA, herein designated VGAM RNA, also designated SEQ ID:4667.

Another function of VGAM1956 is therefore inhibition of Vitamin D (1,25- dihydroxyvitamin D3) Receptor (VDR, Accession NM_000376). Accordingly, utilities of VGAM1956 include diagnosis, prevention and treatment of diseases and clinical conditions associated with VDR. Wolf-Hirschhorn Syndrome Candidate 1 (WHSC1, Accession NM_133332) is another VGAM1956 host target gene. WHSC1 BINDING SITE1 through WHSC1 BINDING SITE3 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE3, designated SEQ ID:28454, SEQ ID:28471 and SEQ ID:17190 respectively, to the nucleotide sequence of VGAM1956 RNA, herein designated VGAM RNA, also designated SEQ ID:4667.

Another function of VGAM1956 is therefore inhibition of Wolf-Hirschhorn Syndrome Candidate 1 (WHSC1, Accession NM_133332), a gene which binds covalently to and repairs g/t mismatches. Accordingly, utilities of VGAM1956 include diagnosis, prevention and treatment of diseases and clinical conditions associated with WHSC1. The function of WHSC1 and its association with various diseases and clinical conditions, has been established by previous studies, as described hereinabove with reference to VGAM200. ACF (Accession NM_138932) is another VGAM1956 host target gene. ACF BINDING SITE1 and ACF BINDING SITE2 are HOST TARGET binding sites found in untranslated regions of mRNA encoded by ACF, corresponding to HOST TARGET binding sites such as BINDING SITE I, BINDING SITE II or BINDING SITE III. Table 2 illustrates the complementarity of the nucleotide sequences of ACF BINDING SITE1 and ACF BINDING SITE2, designated SEQ ID:29059 and SEQ ID:15938 respectively, to the nucleotide sequence of VGAM1956 RNA, herein designated VGAM RNA, also designated SEQ ID:4667.

Another function of VGAM1956 is therefore inhibition of ACF (Accession NM_138932). Accordingly, utilities of VGAM1956 include diagnosis, prevention and treatment of diseases and clinical conditions associated with ACF. Bol, Boule-like (Drosophila) (BOLL, Accession NM_033030) is another VGAM1956 host target gene. BOLL BINDING SITE is HOST TARGET binding site found in the 5' untranslated region of mRNA encoded by BOLL, corresponding to a HOST TARGET binding site such as BINDING SITE I, BINDING SITE II or BINDING SITE III. Table 2 illustrates the complementarity of the nucleotide sequences of BOLL BINDING SITE, designated SEQ ID:26922, to the nucleotide sequence of VGAM1956 RNA, herein designated VGAM RNA, also designated SEQ ID:4667.

Another function of VGAM1956 is therefore inhibition of Bol, Boule-like (Drosophila) (BOLL, Accession NM_033030). Accordingly, utilities of VGAM1956 include diagnosis, prevention and treatment of diseases and clinical conditions associated with BOLL. Chromosome 22 Open Reading Frame 2 (C22orf2, Accession XM_170492) is another VGAM1956 host target gene. C22orf2 BINDING SITE is HOST TARGET binding site found in the 3' untranslated region of mRNA encoded by C22orf2, corresponding to a HOST TARGET binding site such as BINDING SITE I, BINDING SITE II or BINDING SITE III. Table 2 illustrates the complementarity of the nucleotide sequences of C22orf2 BINDING SITE, designated SEQ ID:45335, to the nucleotide sequence of VGAM1956 RNA, herein designated VGAM RNA, also designated SEQ ID:4667.

Another function of VGAM1956 is therefore inhibition of Chromosome 22 Open Reading Frame 2 (C22orf2, Accession XM_170492). Accordingly, utilities of VGAM1956 include diagnosis, prevention and treatment of diseases and clinical conditions associated with C22orf2. Chromobox Homolog 3 (HP1 gamma homolog, Drosophila) (CBX3, Accession NM_007276) is another VGAM1956 host target gene. CBX3 BINDING SITE1 and CBX3 BINDING SITE2 are HOST TARGET binding sites found in untranslated regions of mRNA encoded by CBX3, corresponding to HOST TARGET binding sites such as BINDING SITE I, BINDING SITE II or BINDING SITE III. Table 2 illustrates the complementarity of the nucleotide sequences of CBX3 BINDING SITE1 and CBX3 BINDING SITE2, designated SEQ ID:14142 and SEQ ID:18662 respectively, to the nucleotide sequence of VGAM1956 RNA, herein designated VGAM RNA, also designated SEQ ID:4667.

Another function of VGAM1956 is therefore inhibition of Chromobox Homolog 3 (HP1 gamma homolog, Drosophila) (CBX3, Accession NM_007276). Accordingly, utilities of VGAM1956 include diagnosis, prevention and treatment of diseases and clinical conditions associated with CBX3. Chromatin Accessibility Complex 1 (CHRAC1, Accession NM_017444) is another VGAM1956 host target gene. CHRAC1 BINDING SITE is HOST TARGET binding site found in the 3' untranslated region of mRNA encoded by CHRAC1, corresponding to a HOST TARGET binding site such as BINDING SITE I, BINDING SITE II or BINDING SITE III. Table 2 illustrates the complementarity of the nucleotide sequences of CHRAC1 BINDING SITE, designated SEQ ID:18909, to the nucleotide sequence of VGAM1956 RNA, herein designated VGAM RNA, also designated SEQ ID:4667.

Another function of VGAM1956 is therefore inhibition of Chromatin Accessibility Complex 1 (CHRAC1, Accession NM_017444). Accordingly, utilities of VGAM1956 include diagnosis, prevention and treatment of diseases and clinical conditions associated with CHRAC1. Carbohydrate (chondroitin 6) Sulfotransferase 3 (CHST3, Accession NM_004273) is another VGAM1956 host target gene. CHST3 BINDING SITE is HOST TARGET binding site found in the 5' untranslated region of mRNA encoded by CHST3, corresponding to a HOST TARGET binding site such as BINDING SITE I, BINDING SITE II or BINDING SITE III. Table 2 illustrates the complementarity of the nucleotide sequences of CHST3 BINDING SITE, designated SEQ ID:10484, to the nucleotide sequence of VGAM1956 RNA, herein designated VGAM RNA, also designated SEQ ID:4667.

Another function of VGAM1956 is therefore inhibition of Carbohydrate (chondroitin 6) Sulfotransferase 3 (CHST3, Accession NM_004273). Accordingly, utilities of VGAM1956 include diagnosis, prevention and treatment of diseases and clinical conditions associated with CHST3. CRMP5 (Accession NM_020134) is another VGAM1956 host target gene. CRMP5 BINDING SITE is HOST TARGET binding site found in the 3' untranslated region of mRNA encoded by CRMP5, corresponding to a HOST TARGET binding site such as BINDING SITE I, BINDING SITE II or BINDING SITE III. Table 2 illustrates the complementarity of the nucleotide sequences of CRMP5 BINDING SITE, designated SEQ ID:21334, to the nucleotide sequence of VGAM1956 RNA, herein designated VGAM RNA, also designated SEQ ID:4667.

Another function of VGAM1956 is therefore inhibition of CRMP5 (Accession NM_020134). Accordingly, utilities of VGAM1956 include diagnosis, prevention and treatment of diseases and clinical conditions associated with CRMP5. DEAD/H (Asp-Glu-Ala-Asp/His) Box Polypeptide 17, 72 kDa (DDX17, Accession NM_030881) is another VGAM1956 host target gene. DDX17 BINDING SITE is HOST TARGET binding site found in the 5' untranslated region of mRNA encoded by DDX17, corresponding to a HOST TARGET binding site such as BINDING SITE I, BINDING SITE II or BINDING SITE III. Table 2 illustrates the complementarity of the nucleotide sequences of DDX17 BINDING SITE, designated SEQ ID:25156, to the nucleotide sequence of VGAM1956 RNA, herein designated VGAM RNA, also designated SEQ ID:4667.

Another function of VGAM1956 is therefore inhibition of DEAD/H (Asp-Glu-Ala-Asp/His) Box Polypeptide 17, 72 kDa (DDX17, Accession NM_030881). Accordingly, utilities of VGAM1956 include diagnosis, prevention and treatment of diseases and clinical conditions associated with DDX17. DKFZP434B044 (Accession NM_031476) is another VGAM1956 host target gene. DKFZP434B044 BINDING SITE is HOST TARGET binding site found in the 3' untranslated region of mRNA encoded by DKFZP434B044, corresponding to a HOST TARGET binding site such as BINDING SITE I, BINDING SITE II or BINDING SITE III. Table 2 illustrates the complementarity of the nucleotide sequences of DKFZP434B044 BINDING SITE, designated SEQ ID:25554, to the nucleotide sequence of VGAM1956 RNA, herein designated VGAM RNA, also designated SEQ ID:4667.

Another function of VGAM1956 is therefore inhibition of DKFZP434B044 (Accession NM_031476). Accordingly, utilities of VGAM1956 include diagnosis, prevention and treatment of diseases and clinical conditions associated with DKFZP434B044. DKFZP762D096 (Accession XM_037662) is another VGAM1956 host target gene. DKFZP762D096 BINDING SITE is HOST TARGET binding site found in the 5' untranslated region of mRNA encoded by DKFZP762D096, corresponding to a HOST TARGET binding site such as BINDING SITE I, BINDING SITE II or BINDING SITE III. Table 2 illustrates the complementarity of the nucleotide sequences of DKFZP762D096 BINDING SITE, designated SEQ ID:32666, to the nucleotide sequence of VGAM1956 RNA, herein designated VGAM RNA, also designated SEQ ID:4667.

Another function of VGAM1956 is therefore inhibition of DKFZP762D096 (Accession XM_037662). Accordingly, utilities of VGAM1956 include diagnosis, prevention and treatment of diseases and clinical conditions associated with DKFZP762D096. Endothelial Cell-specific Molecule 1 (ESM1, Accession NM_007036) is another VGAM1956 host target gene. ESM1 BINDING SITE is HOST TARGET binding site found in the 3' untranslated region of mRNA encoded by ESM1, corresponding to a HOST TARGET binding site such as BINDING SITE I, BINDING SITE II or BINDING SITE III. Table 2 illustrates the complementarity of the nucleotide sequences of ESM1 BINDING SITE, designated SEQ ID:13913, to the nucleotide sequence of VGAM1956 RNA, herein designated VGAM RNA, also designated SEQ ID:4667.

Another function of VGAM1956 is therefore inhibition of Endothelial Cell-specific Molecule 1 (ESM1, Accession NM_007036). Accordingly, utilities of VGAM1956 include diagnosis, prevention and treatment of diseases and clinical conditions associated with ESM1. FENS-1 (Accession NM_020830) is another VGAM1956 host target gene. FENS-1 BINDING SITE is HOST TARGET binding site found in the 3' untranslated region of mRNA encoded by FENS-1, corresponding to a HOST TARGET binding site such as BINDING SITE I, BINDING SITE II or BINDING SITE III. Table 2 illustrates the complementarity of the nucleotide sequences of FENS-1 BINDING SITE, designated SEQ ID:21892, to the nucleotide sequence of VGAM1956 RNA, herein designated VGAM RNA, also designated SEQ ID:4667.

Another function of VGAM1956 is therefore inhibition of FENS-1 (Accession NM_020830). Accordingly, utilities of VGAM1956 include diagnosis, prevention and treatment of diseases and clinical conditions associated with FENS-1. FLB6421 (Accession NM_020119) is another VGAM1956 host target gene. FLB6421 BINDING SITE is HOST TARGET binding site found in the 3' untranslated region of mRNA encoded by FLB6421, corresponding to a HOST TARGET binding site such as BINDING SITE I, BINDING SITE II or BINDING SITE III. Table 2 illustrates the complementarity of the nucleotide sequences of FLB6421 BINDING SITE, designated SEQ ID:21302, to the nucleotide sequence of VGAM1956 RNA, herein designated VGAM RNA, also designated SEQ ID:4667.

Another function of VGAM1956 is therefore inhibition of FLB6421 (Accession NM_020119). Accordingly, utilities of VGAM1956 include diagnosis, prevention and treatment of diseases and clinical conditions associated with FLB6421. FLJ10521 (Accession NM_018125) is another VGAM1956 host target gene. FLJ10521 BINDING SITE is HOST TARGET binding site found in the 3' untranslated region of mRNA encoded by FLJ10521, corresponding to a HOST TARGET binding site such as BINDING SITE I, BINDING SITE II or BINDING SITE III. Table 2 illustrates the complementarity of the nucleotide sequences of FLJ10521 BINDING SITE, designated SEQ ID:19912, to the nucleotide sequence of VGAM1956 RNA, herein designated VGAM RNA, also designated SEQ ID:4667.

Another function of VGAM1956 is therefore inhibition of FLJ10521 (Accession NM_018125). Accordingly, utilities of VGAM1956 include diagnosis, prevention and treatment of diseases and clinical conditions associated with FLJ10521. FLJ10713 (Accession NM_018189) is another VGAM1956 host target gene. FLJ10713 BINDING SITE is HOST TARGET binding site found in the 3' untranslated region of mRNA encoded by FLJ10713, corresponding to a HOST TARGET binding site such as BINDING SITE I, BINDING SITE II or BINDING SITE III. Table 2 illustrates the complementarity of the nucleotide sequences of FLJ10713 BINDING SITE, designated SEQ ID:20042, to the nucleotide sequence of VGAM1956 RNA, herein designated VGAM RNA, also designated SEQ ID:4667.

Another function of VGAM1956 is therefore inhibition of FLJ10713 (Accession NM_018189). Accordingly, utilities of VGAM1956 include diagnosis, prevention and treatment of diseases and clinical conditions associated with FLJ10713. FLJ11164 (Accession NM_018346) is another VGAM1956 host target gene. FLJ11164 BINDING SITE is HOST TARGET binding site found in the 3' untranslated region of mRNA encoded by FLJ11164, corresponding to a HOST TARGET binding site such as BINDING SITE I, BINDING SITE II or BINDING SITE III. Table 2 illustrates the complementarity of the nucleotide sequences of FLJ11164 BINDING SITE, designated SEQ ID:20358, to the nucleotide sequence of VGAM1956 RNA, herein designated VGAM RNA, also designated SEQ ID:4667.

Another function of VGAM1956 is therefore inhibition of FLJ11164 (Accession NM_018346). Accordingly, utilities of VGAM1956 include diagnosis, prevention and treatment of diseases and clinical conditions associated with FLJ11164. FLJ11362 (Accession NM_021946) is another VGAM1956 host target gene. FLJ11362 BINDING SITE is HOST TARGET binding site found in the 5' untranslated region of mRNA encoded by FLJ11362, corresponding to a HOST TARGET binding site such as BINDING SITE I, BINDING SITE II or BINDING SITE III. Table 2 illustrates the complementarity of the nucleotide sequences of FLJ11362 BINDING SITE, designated SEQ ID:22471, to the nucleotide sequence of VGAM1956 RNA, herein designated VGAM RNA, also designated SEQ ID:4667.

Another function of VGAM1956 is therefore inhibition of FLJ11362 (Accession NM_021946). Accordingly, utilities of VGAM1956 include diagnosis, prevention and treatment of diseases and clinical conditions associated with FLJ11362. FLJ13197 (Accession NM_024614) is another VGAM1956 host target gene. FLJ13197 BINDING SITE is HOST TARGET binding site found in the 3' untranslated region of mRNA encoded by FLJ13197, corresponding to a HOST TARGET binding site such as BINDING SITE I, BINDING SITE II or BINDING SITE III. Table 2 illustrates the complementarity of the nucleotide sequences of FLJ13197 BINDING SITE, designated SEQ ID:23872, to the nucleotide sequence of VGAM1956 RNA, herein designated VGAM RNA, also designated SEQ ID:4667.

Another function of VGAM1956 is therefore inhibition of FLJ13197 (Accession NM_024614). Accordingly, utilities of VGAM1956 include diagnosis, prevention and treatment of diseases and clinical conditions associated with FLJ13197. FLJ13441 (Accession NM_023924) is another VGAM1956 host target gene. FLJ13441 BINDING SITE is HOST TARGET binding site found in the 3' untranslated region of mRNA encoded by FLJ13441, corresponding to a HOST TARGET binding site such as BINDING SITE I, BINDING SITE II or BINDING SITE III. Table 2 illustrates the complementarity of the nucleotide sequences of FLJ13441 BINDING SITE, designated SEQ ID:23394, to the nucleotide sequence of VGAM1956 RNA, herein designated VGAM RNA, also designated SEQ ID:4667.

Another function of VGAM1956 is therefore inhibition of FLJ13441 (Accession NM_023924). Accordingly, utilities of VGAM1956 include diagnosis, prevention and treatment of diseases and clinical conditions associated with FLJ13441. FLJ13993 (Accession XM_017638) is another VGAM1956 host target gene. FLJ13993 BINDING SITE is HOST TARGET binding site found in the 3' untranslated region of mRNA encoded by FLJ13993, corresponding to a HOST TARGET binding site such as BINDING SITE I, BINDING SITE II or BINDING SITE III. Table 2 illustrates the complementarity of the nucleotide sequences of FLJ13993 BINDING SITE, designated SEQ ID:30327, to the nucleotide sequence of VGAM1956 RNA, herein designated VGAM RNA, also designated SEQ ID:4667.

Another function of VGAM1956 is therefore inhibition of FLJ13993 (Accession XM_017638). Accordingly, utilities of VGAM1956 include diagnosis, prevention and treatment of diseases and clinical conditions associated with FLJ13993. FLJ14075 (Accession NM_024894) is another VGAM1956 host target gene. FLJ14075 BINDING SITE is HOST TARGET binding site found in the 3' untranslated region of mRNA encoded by FLJ14075, corresponding to a HOST TARGET binding site such as BINDING SITE I, BINDING SITE II or BINDING SITE III. Table 2 illustrates the complementarity of the nucleotide sequences of FLJ14075 BINDING SITE, designated SEQ ID:24376, to the nucleotide sequence of VGAM1956 RNA, herein designated VGAM RNA, also designated SEQ ID:4667.

Another function of VGAM1956 is therefore inhibition of FLJ14075 (Accession NM_024894). Accordingly, utilities of VGAM1956 include diagnosis, prevention and treatment of diseases and clinical conditions associated with FLJ14075. FLJ22548 (Accession NM_022456) is another VGAM1956 host target gene. FLJ22548 BINDING SITE is HOST TARGET binding site found in the 5' untranslated region of mRNA encoded by FLJ22548, corresponding to a HOST TARGET binding site such as BINDING SITE I, BINDING SITE II or BINDING SITE III. Table 2 illustrates the complementarity of the nucleotide sequences of FLJ22548 BINDING SITE, designated SEQ ID:22794, to the nucleotide sequence of VGAM1956 RNA, herein designated VGAM RNA, also designated SEQ ID:4667.

Another function of VGAM1956 is therefore inhibition of FLJ22548 (Accession NM_022456). Accordingly, utilities of VGAM1956 include diagnosis, prevention and treatment of diseases and clinical conditions associated with FLJ22548. FLJ23042 (Accession NM_025157) is another VGAM1956 host target gene. FLJ23042 BINDING SITE is HOST TARGET binding site found in the 3' untranslated region of mRNA encoded by FLJ23042, corresponding to a HOST TARGET binding site such as BINDING SITE I, BINDING SITE II or BINDING SITE III. Table 2 illustrates the complementarity of the nucleotide sequences of FLJ23042 BINDING SITE, designated SEQ ID:24797, to the nucleotide sequence of VGAM1956 RNA, herein designated VGAM RNA, also designated SEQ ID:4667.

Another function of VGAM1956 is therefore inhibition of FLJ23042 (Accession NM_025157). Accordingly, utilities of VGAM1956 include diagnosis, prevention and treatment of diseases and clinical conditions associated with FLJ23042. FLJ23360 (Accession NM_023076) is another VGAM1956 host target gene. FLJ23360 BINDING SITE is HOST TARGET binding site found in the 5' untranslated region of mRNA encoded by FLJ23360, corresponding to a HOST TARGET binding site such as BINDING SITE I, BINDING SITE II or BINDING SITE III. Table 2 illustrates the complementarity of the nucleotide sequences of FLJ23360 BINDING SITE, designated SEQ ID:23336, to the nucleotide sequence of VGAM1956 RNA, herein designated VGAM RNA, also designated SEQ ID:4667.

Another function of VGAM1956 is therefore inhibition of FLJ23360 (Accession NM_023076). Accordingly, utilities of VGAM1956 include diagnosis, prevention and treatment of diseases and clinical conditions associated with FLJ23360. FLJ30681 (Accession XM_166291) is another VGAM1956 host target gene. FLJ30681 BINDING SITE is HOST TARGET binding site found in the 3' untranslated region of mRNA encoded by FLJ30681, corresponding to a HOST TARGET binding site such as BINDING SITE I, BINDING SITE II or BINDING SITE III. Table 2 illustrates the complementarity of the nucleotide sequences of FLJ30681 BINDING SITE, designated SEQ ID:44106, to the nucleotide sequence of VGAM1956 RNA, herein designated VGAM RNA, also designated SEQ ID:4667.

Another function of VGAM1956 is therefore inhibition of FLJ30681 (Accession XM_166291). Accordingly, utilities of VGAM1956 include diagnosis, prevention and treatment of diseases and clinical conditions associated with FLJ30681. GMPPB (Accession XM_171044) is another VGAM1956 host target gene. GMPPB BINDING SITE is HOST TARGET binding site found in the 5' untranslated region of mRNA encoded by GMPPB, corresponding to a HOST TARGET binding site such as BINDING SITE I, BINDING SITE II or BINDING SITE III. Table 2 illustrates the complementarity of the nucleotide sequences of GMPPB BINDING SITE, designated SEQ ID:45817, to the nucleotide sequence of VGAM1956 RNA, herein designated VGAM RNA, also designated SEQ ID:4667.

Another function of VGAM1956 is therefore inhibition of GMPPB (Accession XM_171044). Accordingly, utilities of VGAM1956 include diagnosis, prevention and treatment of diseases and clinical conditions associated with GMPPB. GTP Binding Protein 2 (GTPBP2, Accession NM_019096) is another VGAM1956 host target gene. GTPBP2 BINDING SITE is HOST TARGET binding site found in the 3' untranslated region of mRNA encoded by GTPBP2, corresponding to a HOST TARGET binding site such as BINDING SITE I, BINDING SITE II or BINDING SITE III. Table 2 illustrates the complementarity of the nucleotide sequences of GTPBP2 BINDING SITE, designated SEQ ID:21173, to the nucleotide sequence of VGAM1956 RNA, herein designated VGAM RNA, also designated SEQ ID:4667.

Another function of VGAM1956 is therefore inhibition of GTP Binding Protein 2 (GTPBP2, Accession NM_019096). Accordingly, utilities of VGAM1956 include diagnosis, prevention and treatment of diseases and clinical conditions associated with GTPBP2. Hypermethylated In Cancer 2 (HIC2, Accession XM_036937) is another VGAM1956 host target gene. HIC2 BINDING SITE is HOST TARGET binding site found in the 3' untranslated region of mRNA encoded by HIC2, corresponding to a HOST TARGET binding site such as BINDING SITE I, BINDING SITE II or BINDING SITE III. Table 2 illustrates the complementarity of the nucleotide sequences of HIC2 BINDING SITE, designated SEQ ID:32531, to the nucleotide sequence of VGAM1956 RNA, herein designated VGAM RNA, also designated SEQ ID:4667.

Another function of VGAM1956 is therefore inhibition of Hypermethylated In Cancer 2 (HIC2, Accession XM_036937). Accordingly, utilities of VGAM1956 include diagnosis, prevention and treatment of diseases and clinical conditions associated with HIC2. HIG2 (Accession NM_013332) is another VGAM1956 host target gene. HIG2 BINDING SITE is HOST TARGET binding site found in the 5' untranslated region of mRNA encoded by HIG2, corresponding to a HOST TARGET binding site such as BINDING SITE I, BINDING SITE II or BINDING SITE III. Table 2 illustrates the complementarity of the nucleotide sequences of HIG2 BINDING SITE, designated SEQ ID:14978, to the nucleotide sequence of VGAM1956 RNA, herein designated VGAM RNA, also designated SEQ ID:4667.

Another function of VGAM1956 is therefore inhibition of HIG2 (Accession NM_013332). Accordingly, utilities of VGAM1956 include diagnosis, prevention and treatment of diseases and clinical conditions associated with HIG2. HSC3 (Accession NM_145174) is another VGAM1956 host target gene. HSC3 BINDING SITE is HOST TARGET binding site found in the 3' untranslated region of mRNA encoded by HSC3, corresponding to a HOST TARGET binding site such as BINDING SITE I, BINDING SITE II or BINDING SITE III. Table 2 illustrates the complementarity of the nucleotide sequences of HSC3 BINDING SITE, designated SEQ ID:29735, to the nucleotide sequence of VGAM1956 RNA, herein designated VGAM RNA, also designated SEQ ID:4667.

Another function of VGAM1956 is therefore inhibition of HSC3 (Accession NM_145174). Accordingly, utilities of VGAM1956 include diagnosis, prevention and treatment of diseases and clinical conditions associated with HSC3. HYPH (Accession XM_170722) is another VGAM1956 host target gene. HYPH BINDING SITE is HOST TARGET binding site found in the 3' untranslated region of mRNA encoded by HYPH, corresponding to a HOST TARGET binding site such as BINDING SITE I, BINDING SITE II or BINDING SITE III. Table 2 illustrates the complementarity of the nucleotide sequences of HYPH BINDING SITE, designated SEQ ID:45483, to the nucleotide sequence of VGAM1956 RNA, herein designated VGAM RNA, also designated SEQ ID:4667.

Another function of VGAM1956 is therefore inhibition of HYPH (Accession XM_170722). Accordingly, utilities of VGAM1956 include diagnosis, prevention and treatment of diseases and clinical conditions associated with HYPH. Interleukin 1 Family, Member 10 (theta) (IL1F10, Accession NM_032556) is another VGAM1956 host target gene. IL1F10 BINDING SITE is HOST TARGET binding site found in the 5' untranslated region of mRNA encoded by IL1F10, corresponding to a HOST TARGET binding site such as BINDING SITE I, BINDING SITE II or BINDING SITE III. Table 2 illustrates the complementarity of the nucleotide sequences of IL1F10 BINDING SITE, designated SEQ ID:26284, to the nucleotide sequence of VGAM1956 RNA, herein designated VGAM RNA, also designated SEQ ID:4667.

Another function of VGAM1956 is therefore inhibition of Interleukin 1 Family, Member 10 (theta) (IL1F10, Accession NM_032556). Accordingly, utilities of VGAM1956 include diagnosis, prevention and treatment of diseases and clinical conditions associated with IL1F10. KIAA0057 (Accession NM_012288) is another VGAM1956 host target gene. KIAA0057 BINDING SITE is HOST TARGET binding site found in the 3' untranslated region of mRNA encoded by KIAA0057, corresponding to a HOST TARGET binding site such as BINDING SITE I, BINDING SITE II or BINDING SITE III. Table 2 illustrates the complementarity of the nucleotide sequences of KIAA0057 BINDING SITE, designated SEQ ID:14624, to the nucleotide sequence of VGAM1956 RNA, herein designated VGAM RNA, also designated SEQ ID:4667.

Another function of VGAM1956 is therefore inhibition of KIAA0057 (Accession NM_012288). Accordingly, utilities of VGAM1956 include diagnosis, prevention and treatment of diseases and clinical conditions associated with KIAA0057. KIAA0317 (Accession NM_014821) is another VGAM1956 host target gene. KIAA0317 BINDING SITE is HOST TARGET binding site found in the 3' untranslated region of mRNA encoded by KIAA0317, corresponding to a HOST TARGET binding site such as BINDING SITE I, BINDING SITE II or BINDING SITE III. Table 2 illustrates the complementarity of the nucleotide sequences of KIAA0317 BINDING SITE, designated SEQ ID:16796, to the nucleotide sequence of VGAM1956 RNA, herein designated VGAM RNA, also designated SEQ ID:4667.

Another function of VGAM1956 is therefore inhibition of KIAA0317 (Accession NM_014821). Accordingly, utilities of VGAM1956 include diagnosis, prevention and treatment of diseases and clinical conditions associated with KIAA0317. KIAA0453 (Accession XM_044546) is another VGAM1956 host target gene. KIAA0453 BINDING SITE is HOST TARGET binding site found in the 3' untranslated region of mRNA encoded by KIAA0453, corresponding to a HOST TARGET binding site such as BINDING SITE I, BINDING SITE II or BINDING SITE III. Table 2 illustrates the complementarity of the nucleotide sequences of KIAA0453 BINDING SITE, designated SEQ ID:34230, to the nucleotide sequence of VGAM1956 RNA, herein designated VGAM RNA, also designated SEQ ID:4667.

Another function of VGAM1956 is therefore inhibition of KIAA0453 (Accession XM_044546). Accordingly, utilities of VGAM1956 include diagnosis, prevention and treatment of diseases and clinical conditions associated with KIAA0453. KIAA0618 (Accession NM_014833) is another VGAM1956 host target gene. KIAA0618 BINDING SITE is HOST TARGET binding site found in the 3' untranslated region of mRNA encoded by KIAA0618, corresponding to a HOST TARGET binding site such as BINDING SITE I, BINDING SITE II or BINDING SITE III. Table 2 illustrates the complementarity of the nucleotide sequences of KIAA0618 BINDING SITE, designated SEQ ID:16837, to the nucleotide sequence of VGAM1956 RNA, herein designated VGAM RNA, also designated SEQ ID:4667.

Another function of VGAM1956 is therefore inhibition of KIAA0618 (Accession NM_014833). Accordingly, utilities of VGAM1956 include diagnosis, prevention and treatment of diseases and clinical conditions associated with KIAA0618. KIAA0931 (Accession XM_041191) is another VGAM1956 host target gene. KIAA0931 BINDING SITE is HOST TARGET binding site found in the 3' untranslated region of mRNA encoded by KIAA0931, corresponding to a HOST TARGET binding site such as BINDING SITE I, BINDING SITE II or BINDING SITE III. Table 2 illustrates the complementarity of the nucleotide sequences of KIAA0931 BINDING SITE, designated SEQ ID:33487, to the nucleotide sequence of VGAM1956 RNA, herein designated VGAM RNA, also designated SEQ ID:4667.

Another function of VGAM1956 is therefore inhibition of KIAA0931 (Accession XM_041191). Accordingly, utilities of VGAM1956 include diagnosis, prevention and treatment of diseases and clinical conditions associated with KIAA0931. KIAA1013 (Accession XM_114303) is another VGAM1956 host target gene. KIAA1013 BINDING SITE is HOST TARGET binding site found in the 3' untranslated region of mRNA encoded by KIAA1013, corresponding to a HOST TARGET binding site such as BINDING SITE I, BINDING SITE II or BINDING SITE III. Table 2 illustrates the complementarity of the nucleotide sequences of KIAA1013 BINDING SITE, designated SEQ ID:42859, to the nucleotide sequence of VGAM1956 RNA, herein designated VGAM RNA, also designated SEQ ID:4667.

Another function of VGAM1956 is therefore inhibition of KIAA1013 (Accession XM_114303). Accordingly, utilities of VGAM1956 include diagnosis, prevention and treatment of diseases and clinical conditions associated with KIAA1013. KIAA1017 (Accession NM_007216) is another VGAM1956 host target gene. KIAA1017 BINDING SITE is HOST TARGET binding site found in the 5' untranslated region of mRNA encoded by KIAA1017, corresponding to a HOST TARGET binding site such as BINDING SITE I, BINDING SITE II or BINDING SITE III. Table 2 illustrates the complementarity of the nucleotide sequences of KIAA1017 BINDING SITE, designated SEQ ID:14081, to the nucleotide sequence of VGAM1956 RNA, herein designated VGAM RNA, also designated SEQ ID:4667.

Another function of VGAM1956 is therefore inhibition of KIAA1017 (Accession NM_007216). Accordingly, utilities of VGAM1956 include diagnosis, prevention and treatment of diseases and clinical conditions associated with KIAA1017. KIAA1193 (Accession XM_041843) is another VGAM1956 host target gene. KIAA1193 BINDING SITE1 through KIAA1193 BINDING SITE21 are HOST TARGET binding sites found in untranslated regions of mRNA encoded by KIAA1193, corresponding to HOST TARGET binding sites such as BINDING SITE I, BINDING SITE II or BINDING SITE III. Table 2 illustrates the complementarity of the nucleotide sequences of KIAA1193 BINDING SITE1 through KIAA1193 BINDING SITE21, designated SEQ ID:33591, SEQ ID:33606, SEQ ID:33604, SEQ ID:33605, SEQ ID:33600, SEQ ID:33603, SEQ ID:33590, SEQ ID:33592, SEQ ID:33594, SEQ ID:33597, SEQ ID:33586, SEQ ID:33587, SEQ ID:33588, SEQ ID:33589, SEQ ID:33595, SEQ ID:33596, SEQ ID:33593, SEQ ID:33601, SEQ ID:33602, SEQ ID:33598 and SEQ ID:33599 respectively, to the nucleotide sequence of VGAM1956 RNA, herein designated VGAM RNA, also designated SEQ ID:4667.

Another function of VGAM1956 is therefore inhibition of KIAA1193 (Accession XM_041843). Accordingly, utilities of VGAM1956 include diagnosis, prevention and treatment of diseases and clinical conditions associated with KIAA1193. KIAA1323 (Accession XM_032146) is another VGAM1956 host target gene. KIAA1323 BINDING SITE is HOST TARGET binding site found in the 3' untranslated region of mRNA encoded by KIAA1323, corresponding to a HOST TARGET binding site such as BINDING SITE I, BINDING SITE II or BINDING SITE III. Table 2 illustrates the complementarity of the nucleotide sequences of KIAA1323 BINDING SITE, designated SEQ ID:31568, to the nucleotide sequence of VGAM1956 RNA, herein designated VGAM RNA, also designated SEQ ID:4667.

Another function of VGAM1956 is therefore inhibition of KIAA1323 (Accession XM_032146). Accordingly, utilities of VGAM1956 include diagnosis, prevention and treatment of diseases and clinical conditions associated with KIAA1323. KIAA1332 (Accession XM_048774) is another VGAM1956 host target gene. KIAA1332 BINDING SITE is HOST TARGET binding site found in the 3' untranslated region of mRNA encoded by KIAA1332, corresponding to a HOST TARGET binding site such as BINDING SITE I, BINDING SITE II or BINDING SITE III. Table 2 illustrates the complementarity of the nucleotide sequences of KIAA1332 BINDING SITE, designated SEQ ID:35260, to the nucleotide sequence of VGAM1956 RNA, herein designated VGAM RNA, also designated SEQ ID:4667.

Another function of VGAM1956 is therefore inhibition of KIAA1332 (Accession XM_048774). Accordingly, utilities of VGAM1956 include diagnosis, prevention and treatment of diseases and clinical conditions associated with KIAA1332. KIAA1450 (Accession XM_038035) is another VGAM1956 host target gene. KIAA1450 BINDING SITE is HOST TARGET binding site found in the 3' untranslated region of mRNA encoded by KIAA1450, corresponding to a HOST TARGET binding site such as BINDING SITE I, BINDING SITE II or BINDING SITE III. Table 2 illustrates the complementarity of the nucleotide sequences of KIAA1450 BINDING SITE, designated SEQ ID:32749, to the nucleotide sequence of VGAM1956 RNA, herein designated VGAM RNA, also designated SEQ ID:4667.

Another function of VGAM1956 is therefore inhibition of KIAA1450 (Accession XM_038035). Accordingly, utilities of VGAM1956 include diagnosis, prevention and treatment of diseases and clinical conditions associated with KIAA1450. KIAA1627 (Accession XM_087571) is another VGAM1956 host target gene. KIAA1627 BINDING SITE is HOST TARGET binding site found in the 5' untranslated region of mRNA encoded by KIAA1627, corresponding to a HOST TARGET binding site such as BINDING SITE I, BINDING SITE II or BINDING SITE III. Table 2 illustrates the complementarity of the nucleotide sequences of KIAA1627 BINDING SITE, designated SEQ ID:39344, to the nucleotide sequence of VGAM1956 RNA, herein designated VGAM RNA, also designated SEQ ID:4667.

Another function of VGAM1956 is therefore inhibition of KIAA1627 (Accession XM_087571). Accordingly, utilities of VGAM1956 include diagnosis, prevention and treatment of diseases and clinical conditions associated with KIAA1627. KIAA1878 (Accession XM_166256) is another VGAM1956 host target gene. KIAA1878 BINDING SITE is HOST TARGET binding site found in the 3' untranslated region of mRNA encoded by KIAA1878, corresponding to a HOST TARGET binding site such as BINDING SITE I, BINDING SITE II or BINDING SITE III. Table 2 illustrates the complementarity of the nucleotide sequences of KIAA1878 BINDING SITE, designated SEQ ID:44078, to the nucleotide sequence of VGAM1956 RNA, herein designated VGAM RNA, also designated SEQ ID:4667.

Another function of VGAM1956 is therefore inhibition of KIAA1878 (Accession XM_166256). Accordingly, utilities of VGAM1956 include diagnosis, prevention and treatment of diseases and clinical conditions associated with KIAA1878. KIAA1900 (Accession XM_055299) is another VGAM1956 host target gene. KIAA1900 BINDING SITE is HOST TARGET binding site found in the 5' untranslated region of mRNA encoded by KIAA1900, corresponding to a HOST TARGET binding site such as BINDING SITE I, BINDING SITE II or BINDING SITE III. Table 2 illustrates the complementarity of the nucleotide sequences of KIAA1900 BINDING SITE, designated SEQ ID:36259, to the nucleotide sequence of VGAM1956 RNA, herein designated VGAM RNA, also designated SEQ ID:4667.

Another function of VGAM1956 is therefore inhibition of KIAA1900 (Accession XM_055299). Accordingly, utilities of VGAM1956 include diagnosis, prevention and treatment of diseases and clinical conditions associated with KIAA1900. KIAA1932 (Accession XM_055900) is another VGAM1956 host target gene. KIAA1932 BINDING SITE is HOST TARGET binding site found in the 5' untranslated region of mRNA encoded by KIAA1932, corresponding to a HOST TARGET binding site such as BINDING SITE I, BINDING SITE II or BINDING SITE III. Table 2 illustrates the complementarity of the nucleotide sequences of KIAA1932 BINDING SITE, designated SEQ ID:36350, to the nucleotide sequence of VGAM1956 RNA, herein designated VGAM RNA, also designated SEQ ID:4667.

Another function of VGAM1956 is therefore inhibition of KIAA1932 (Accession XM_055900). Accordingly, utilities of VGAM1956 include diagnosis, prevention and treatment of diseases and clinical conditions associated with KIAA1932. KR18 (Accession NM_033288) is another VGAM1956 host target gene. KR18 BINDING SITE is HOST TARGET binding site found in the 3' untranslated region of mRNA encoded by KR18, corresponding to a HOST TARGET binding site such as BINDING SITE I, BINDING SITE II or BINDING SITE III. Table 2 illustrates the complementarity of the nucleotide sequences of KR18 BINDING SITE, designated SEQ ID:27117, to the nucleotide sequence of VGAM1956 RNA, herein designated VGAM RNA, also designated SEQ ID:4667.

Another function of VGAM1956 is therefore inhibition of KR18 (Accession NM_033288). Accordingly, utilities of VGAM1956 include diagnosis, prevention and treatment of diseases and clinical conditions associated with KR18. LIG-1 (Accession XM_033712) is another VGAM1956 host target gene. LIG-1 BINDING SITE is HOST TARGET binding site found in the 3' untranslated region of mRNA encoded by LIG-1, corresponding to a HOST TARGET binding site such as BINDING SITE I, BINDING SITE II or BINDING SITE III. Table 2 illustrates the complementarity of the nucleotide sequences of LIG-1 BINDING SITE, designated SEQ ID:31953, to the nucleotide sequence of VGAM1956 RNA, herein designated VGAM RNA, also designated SEQ ID:4667.

Another function of VGAM1956 is therefore inhibition of LIG-1 (Accession XM_033712). Accordingly, utilities of VGAM1956 include diagnosis, prevention and treatment of diseases and clinical conditions associated with LIG-1. LIM Domain Kinase 2 (LIMK2, Accession NM_005569) is another VGAM1956 host target gene. LIMK2 BINDING SITE1 and LIMK2 BINDING SITE2 are HOST TARGET binding sites found in untranslated regions of mRNA encoded by LIMK2, corresponding to HOST TARGET binding sites such as BINDING SITE I, BINDING SITE II or BINDING SITE III. Table 2 illustrates the complementarity of the nucleotide sequences of LIMK2 BINDING SITE1 and LIMK2 BINDING SITE2, designated SEQ ID:12096 and SEQ ID:18787 respectively, to the nucleotide sequence of VGAM1956 RNA, herein designated VGAM RNA, also designated SEQ ID:4667.

Another function of VGAM1956 is therefore inhibition of LIM Domain Kinase 2 (LIMK2, Accession NM_005569). Accordingly, utilities of VGAM1956 include diagnosis, prevention and treatment of diseases and clinical conditions associated with LIMK2. Mitogen-activated Protein Kinase-activated Protein Kinase 2 (MAPKAPK2, Accession NM_004759) is another VGAM1956 host target gene. MAPKAPK2 BINDING SITE is HOST TARGET binding site found in the 3' untranslated region of mRNA encoded by MAPKAPK2, corresponding to a HOST TARGET binding site such as BINDING SITE I, BINDING SITE II or BINDING SITE III. Table 2 illustrates the complementarity of the nucleotide sequences of MAPKAPK2 BINDING SITE, designated SEQ ID:11151, to the nucleotide sequence of VGAM1956 RNA, herein designated VGAM RNA, also designated SEQ ID:4667.

Another function of VGAM1956 is therefore inhibition of Mitogen-activated Protein Kinase-activated Protein Kinase 2 (MAPKAPK2, Accession NM_004759). Accordingly, utilities of VGAM1956 include diagnosis, prevention and treatment of diseases and clinical conditions associated with MAPKAPK2. MGC13040 (Accession NM_032930) is another VGAM1956 host target gene. MGC13040 BINDING SITE is HOST TARGET binding site found in the 5' untranslated region of mRNA encoded by MGC13040, corresponding to a HOST TARGET binding site such as BINDING SITE I, BINDING SITE II or BINDING SITE III. Table 2 illustrates the complementarity of the nucleotide sequences of MGC13040 BINDING SITE, designated SEQ ID:26755, to the nucleotide sequence of VGAM1956 RNA, herein designated VGAM RNA, also designated SEQ ID:4667.

Another function of VGAM1956 is therefore inhibition of MGC13040 (Accession NM_032930). Accordingly, utilities of VGAM1956 include diagnosis, prevention and treatment of diseases and clinical conditions associated with MGC13040. MGC14386 (Accession NM_033544) is another VGAM1956 host target gene. MGC14386 BINDING SITE is HOST TARGET binding site found in the 5' untranslated region of mRNA encoded by MGC14386, corresponding to a HOST TARGET binding site such as BINDING SITE I, BINDING SITE II or BINDING SITE III. Table 2 illustrates the complementarity of the nucleotide sequences of MGC14386 BINDING SITE, designated SEQ ID:27307, to the nucleotide sequence of VGAM1956 RNA, herein designated VGAM RNA, also designated SEQ ID:4667.

Another function of VGAM1956 is therefore inhibition of MGC14386 (Accession NM_033544). Accordingly, utilities of VGAM1956 include diagnosis, prevention and treatment of diseases and clinical conditions associated with MGC14386. MGC20481 (Accession XM_031555) is another VGAM1956 host target gene. MGC20481 BINDING SITE is HOST TARGET binding site found in the 3' untranslated region of mRNA encoded by MGC20481, corresponding to a HOST TARGET binding site such as BINDING SITE I, BINDING SITE II or BINDING SITE III. Table 2 illustrates the complementarity of the nucleotide sequences of MGC20481 BINDING SITE, designated SEQ ID:31425, to the nucleotide sequence of VGAM1956 RNA, herein designated VGAM RNA, also designated SEQ ID:4667.

Another function of VGAM1956 is therefore inhibition of MGC20481 (Accession XM_031555). Accordingly, utilities of VGAM1956 include diagnosis, prevention and treatment of diseases and clinical conditions associated with MGC20481. MGC2477 (Accession NM_024099) is another VGAM1956 host target gene. MGC2477 BINDING SITE1 and MGC2477 BINDING SITE2 are HOST TARGET binding sites found in untranslated regions of mRNA encoded by MGC2477, corresponding to HOST TARGET binding sites such as BINDING SITE I, BINDING SITE II or BINDING SITE III. Table 2 illustrates the complementarity of the nucleotide sequences of MGC2477 BINDING SITE1 and MGC2477 BINDING SITE2, designated SEQ ID:23544 and SEQ ID:23543 respectively, to the nucleotide sequence of VGAM1956 RNA, herein designated VGAM RNA, also designated SEQ ID:4667.

Another function of VGAM1956 is therefore inhibition of MGC2477 (Accession NM_024099). Accordingly, utilities of VGAM1956 include diagnosis, prevention and treatment of diseases and clinical conditions associated with MGC2477. MGC4342 (Accession NM_024329) is another VGAM1956 host target gene. MGC4342 BINDING SITE is HOST TARGET binding site found in the 3' untranslated region of mRNA encoded by MGC4342, corresponding to a HOST TARGET binding site such as BINDING SITE I, BINDING SITE II or BINDING SITE III. Table 2 illustrates the complementarity of the nucleotide sequences of MGC4342 BINDING SITE, designated SEQ ID:23625, to the nucleotide sequence of VGAM1956 RNA, herein designated VGAM RNA, also designated SEQ ID:4667.

Another function of VGAM1956 is therefore inhibition of MGC4342 (Accession NM_024329). Accordingly, utilities of VGAM1956 include diagnosis, prevention and treatment of diseases and clinical conditions associated with MGC4342. MGC4701 (Accession XM_035378) is another VGAM1956 host target gene. MGC4701 BINDING SITE is HOST TARGET binding site found in the 5' untranslated region of mRNA encoded by MGC4701, corresponding to a HOST TARGET binding site such as BINDING SITE I, BINDING SITE II or BINDING SITE III. Table 2 illustrates the complementarity of the nucleotide sequences of MGC4701 BINDING SITE, designated SEQ ID:32242, to the nucleotide sequence of VGAM1956 RNA, herein designated VGAM RNA, also designated SEQ ID:4667.

Another function of VGAM1956 is therefore inhibition of MGC4701 (Accession XM_035378). Accordingly, utilities of VGAM1956 include diagnosis, prevention and treatment of diseases and clinical conditions associated with MGC4701. MGC9753 (Accession NM_033419) is another VGAM1956 host target gene. MGC9753 BINDING SITE is HOST TARGET binding site found in the 5' untranslated region of mRNA encoded by MGC9753, corresponding to a HOST TARGET binding site such as BINDING SITE I, BINDING SITE II or BINDING SITE III. Table 2 illustrates the complementarity of the nucleotide sequences of MGC9753 BINDING SITE, designated SEQ ID:27243, to the nucleotide sequence of VGAM1956 RNA, herein designated VGAM RNA, also designated SEQ ID:4667.

Another function of VGAM1956 is therefore inhibition of MGC9753 (Accession NM_033419). Accordingly, utilities of VGAM1956 include diagnosis, prevention and treatment of diseases and clinical conditions associated with MGC9753. MIC2 Like 1 (MIC2L1, Accession NM_031462) is another VGAM1956 host target gene. MIC2L1 BINDING SITE is HOST TARGET binding site found in the 3' untranslated region of mRNA encoded by MIC2L1, corresponding to a HOST TARGET binding site such as BINDING SITE I, BINDING SITE II or BINDING SITE III. Table 2 illustrates the complementarity of the nucleotide sequences of MIC2L1 BINDING SITE, designated SEQ ID:25494, to the nucleotide sequence of VGAM1956 RNA, herein designated VGAM RNA, also designated SEQ ID:4667.

Another function of VGAM1956 is therefore inhibition of MIC2 Like 1 (MIC2L1, Accession NM_031462). Accordingly, utilities of VGAM1956 include diagnosis, prevention and treatment of diseases and clinical conditions associated with MIC2L1. Neural Precursor Cell Expressed, Developmentally Down-regulated 5 (NEDD5, Accession NM_004404) is another VGAM1956 host target gene. NEDD5 BINDING SITE is HOST TARGET binding site found in the 3' untranslated region of mRNA encoded by NEDD5, corresponding to a HOST TARGET binding site such as BINDING SITE I, BINDING SITE II or BINDING SITE III. Table 2 illustrates the complementarity of the nucleotide sequences of NEDD5 BINDING SITE, designated SEQ ID:10658, to the nucleotide sequence of VGAM1956 RNA, herein designated VGAM RNA, also designated SEQ ID:4667.

Another function of VGAM1956 is therefore inhibition of Neural Precursor Cell Expressed, Developmentally Down-regulated 5 (NEDD5, Accession NM_004404). Accordingly, utilities of VGAM1956 include diagnosis, prevention and treatment of diseases and clinical conditions associated with NEDD5. Protein Phosphatase 1, Regulatory (inhibitor) Subunit 3B (PPP1R3B, Accession NM_024607) is another VGAM1956 host target gene. PPP1R3B BINDING SITE is HOST TARGET binding site found in the 3" untranslated region of mRNA encoded by PPP1R3B, corresponding to a HOST TARGET binding site such as BINDING SITE I, BINDING SITE II or BINDING SITE III. Table 2 illustrates the complementarity of the nucleotide sequences of PPP1R3B BINDING SITE, designated SEQ ID:23860, to the nucleotide sequence of VGAM1956 RNA, herein designated VGAM RNA, also designated SEQ ID:4667.

Another function of VGAM1956 is therefore inhibition of Protein Phosphatase 1, Regulatory (inhibitor) Subunit 3B (PPP1R3B, Accession NM_024607). Accordingly, utilities of VGAM1956 include diagnosis, prevention and treatment of diseases and clinical conditions associated with PPP1R3B. PRO0971 (Accession NM_018569) is another VGAM1956 host target gene. PRO0971 BINDING SITE is HOST TARGET binding site found in the 5' untranslated region of mRNA encoded by PRO0971, corresponding to a HOST TARGET binding site such as BINDING SITE I, BINDING SITE II or BINDING SITE III. Table 2 illustrates the complementarity of the nucleotide sequences of PRO0971 BINDING SITE, designated SEQ ID:20652, to the nucleotide sequence of VGAM1956 RNA, herein designated VGAM RNA, also designated SEQ ID:4667.

Another function of VGAM1956 is therefore inhibition of PRO0971 (Accession NM_018569). Accordingly, utilities of VGAM1956 include diagnosis, prevention and treatment of diseases and clinical conditions associated with PRO0971. Rho-related BTB Domain Containing 2 (RHOBTB2, Accession XM_027679) is another VGAM1956 host target gene. RHOBTB2 BINDING SITE is HOST TARGET binding site found in the 3' untranslated region of mRNA encoded by RHOBTB2, corresponding to a HOST TARGET binding site such as BINDING SITE I, BINDING SITE II or BINDING SITE III. Table 2 illustrates the complementarity of the nucleotide sequences of RHOBTB2 BINDING SITE, designated SEQ ID:30562, to the nucleotide sequence of VGAM1956 RNA, herein designated VGAM RNA, also designated SEQ ID:4667.

Another function of VGAM1956 is therefore inhibition of Rho-related BTB Domain Containing 2 (RHOBTB2, Accession XM_027679). Accordingly, utilities of VGAM1956 include diagnosis, prevention and treatment of diseases and clinical conditions associated with RHOBTB2. RNA-binding Region (RNP1, RRM) Containing 1 (RNPC1, Accession NM_017495) is another VGAM1956 host target gene. RNPC1 BINDING SITE is HOST TARGET binding site found in the 3' untranslated region of mRNA encoded by RNPC1, corresponding to a HOST TARGET binding site such as BINDING SITE I, BINDING SITE II or BINDING SITE III. Table 2 illustrates the complementarity of the nucleotide sequences of RNPC1 BINDING SITE, designated SEQ ID:18959, to the nucleotide sequence of VGAM1956 RNA, herein designated VGAM RNA, also designated SEQ ID:4667.

Another function of VGAM1956 is therefore inhibition of RNA-binding Region (RNP1, RRM) Containing 1 (RNPC1, Accession NM_017495). Accordingly, utilities of VGAM1956 include diagnosis, prevention and treatment of diseases and clinical conditions associated with RNPC1. Rpo1-2 (Accession NM_019014) is another VGAM1956 host target gene. Rpo1-2 BINDING SITE1 and Rpo1-2 BINDING SITE2 are HOST TARGET binding sites found in untranslated regions of mRNA encoded by Rpo1-2, corresponding to HOST TARGET binding sites such as BINDING SITE I, BINDING SITE II or BINDING SITE III. Table 2 illustrates the complementarity of the nucleotide sequences of Rpo1-2 BINDING SITE1 and Rpo1-2 BINDING SITE2, designated SEQ ID:21105 and SEQ ID:25935 respectively, to the nucleotide sequence of VGAM1956 RNA, herein designated VGAM RNA, also designated SEQ ID:4667.

Another function of VGAM1956 is therefore inhibition of Rpo1-2 (Accession NM_019014). Accordingly, utilities of VGAM1956 include diagnosis, prevention and treatment of diseases and clinical conditions associated with Rpo1-2. Serologically Defined Colon Cancer Antigen 3 (SDCCAG3, Accession NM_006643) is another VGAM1956 host target gene. SDCCAG3 BINDING SITE is HOST TARGET binding site found in the 3' untranslated region of mRNA encoded by SDCCAG3, corresponding to a HOST TARGET binding site such as BINDING SITE I, BINDING SITE II or BINDING SITE III. Table 2 illustrates the complementarity of the nucleotide sequences of SDCCAG3 BINDING SITE, designated SEQ ID:13435, to the nucleotide sequence of VGAM1956 RNA, herein designated VGAM RNA, also designated SEQ ID:4667.

Another function of VGAM1956 is therefore inhibition of Serologically Defined Colon Cancer Antigen 3 (SDCCAG3, Accession NM_006643). Accordingly, utilities of VGAM1956 include diagnosis, prevention and treatment of diseases and clinical conditions associated with SDCCAG3. SEC61A1 (Accession NM_013336) is another VGAM1956 host target gene. SEC61A1 BINDING SITE is HOST TARGET binding site found in the 3" untranslated region of mRNA encoded by SEC61A1, corresponding to a HOST TARGET binding site such as BINDING SITE I, BINDING SITE II or BINDING SITE III. Table 2 illustrates the complementarity of the nucleotide sequences of SEC61A1 BINDING SITE, designated SEQ ID:14985, to the nucleotide sequence of VGAM1956 RNA, herein designated VGAM RNA, also designated SEQ ID:4667.

Another function of VGAM1956 is therefore inhibition of SEC61A1 (Accession NM_013336). Accordingly, utilities of VGAM1956 include diagnosis, prevention and treatment of diseases and clinical conditions associated with SEC61A1. Sema Domain, Immunoglobulin Domain (Ig), Short Basic Domain, Secreted, (semaphorin) 3C (SEMA3C, Accession NM_006379) is another VGAM1956 host target gene. SEMA3C BINDING SITE is HOST TARGET binding site found in the 5' untranslated region of mRNA encoded by SEMA3C, corresponding to a HOST TARGET binding site such as BINDING SITE I, BINDING SITE II or BINDING SITE III. Table 2 illustrates the complementarity of the nucleotide sequences of SEMA3C BINDING SITE, designated SEQ ID:13074, to the nucleotide sequence of VGAM1956 RNA, herein designated VGAM RNA, also designated SEQ ID:4667.

Another function of VGAM1956 is therefore inhibition of Sema Domain, Immunoglobulin Domain (Ig), Short Basic Domain, Secreted, (semaphorin) 3C (SEMA3C, Accession NM_006379). Accordingly, utilities of VGAM1956 include diagnosis, prevention and treatment of diseases and clinical conditions associated with SEMA3C. SERP1 (Accession NM_014445) is another VGAM1956 host target gene. SERP1 BINDING SITE is HOST TARGET binding site found in the 3' untranslated region of mRNA encoded by SERP1, corresponding to a HOST TARGET binding site such as BINDING SITE I, BINDING SITE II or BINDING SITE III. Table 2 illustrates the complementarity of the nucleotide sequences of SERP1 BINDING SITE, designated SEQ ID:15797, to the nucleotide sequence of VGAM1956 RNA, herein designated VGAM RNA, also designated SEQ ID:4667.

Another function of VGAM1956 is therefore inhibition of SERP1 (Accession NM_014445). Accordingly, utilities of VGAM1956 include diagnosis, prevention and treatment of diseases and clinical conditions associated with SERP1. SHARP (Accession NM_015001) is another VGAM1956 host target gene. SHARP BINDING SITE is HOST TARGET binding site found in the 3' untranslated region of mRNA encoded by SHARP, corresponding to a HOST TARGET binding site such as BINDING SITE I, BINDING SITE II or BINDING SITE III. Table 2 illustrates the complementarity of the nucleotide sequences of SHARP BINDING SITE, designated SEQ ID:17368, to the nucleotide sequence of VGAM1956 RNA, herein designated VGAM RNA, also designated SEQ ID:4667.

Another function of VGAM1956 is therefore inhibition of SHARP (Accession NM_015001). Accordingly, utilities of VGAM1956 include diagnosis, prevention and treatment of diseases and clinical conditions associated with SHARP. SWI/SNF Related, Matrix Associated, Actin Dependent Regulator of Chromatin, Subfamily F, Member 1 (SMARCF1, Accession NM_018450) is another VGAM1956 host target gene. SMARCF1 BINDING SITE1 through SMARCF1 BINDING SITE3 are HOST TARGET binding sites found in untranslated regions of mRNA encoded by SMARCF1, corresponding to HOST TARGET binding sites such as BINDING SITE I, BINDING SITE II or BINDING SITE III. Table 2 illustrates the complementarity of the nucleotide sequences of SMARCF1 BINDING SITE1 through SMARCF1 BINDING SITE3, designated SEQ ID:20520, SEQ ID:12625 and SEQ ID:29163 respectively, to the nucleotide sequence of VGAM1956 RNA, herein designated VGAM RNA, also designated SEQ ID:4667.

Another function of VGAM1956 is therefore inhibition of SWI/SNF Related, Matrix Associated, Actin Dependent Regulator of Chromatin, Subfamily F, Member 1 (SMARCF1, Accession NM_018450). Accordingly, utilities of VGAM1956 include diagnosis, prevention and treatment of diseases and clinical conditions associated with SMARCF1. Synaptotagmin XIII (SYT13, Accession XM_167880) is another VGAM1956 host target gene. SYT13 BINDING SITE is HOST TARGET binding site found in the 3' untranslated region of mRNA encoded by SYT13, corresponding to a HOST TARGET binding site such as BINDING SITE I, BINDING SITE II or BINDING SITE III. Table 2 illustrates the complementarity of the nucleotide sequences of SYT13 BINDING SITE, designated SEQ ID:44892, to the nucleotide sequence of VGAM1956 RNA, herein designated VGAM RNA, also designated SEQ ID:4667.

Another function of VGAM1956 is therefore inhibition of Synaptotagmin XIII (SYT13, Accession XM_167880). Accordingly, utilities of VGAM1956 include diagnosis, prevention and treatment of diseases and clinical conditions associated with SYT13. SZF1 (Accession NM_016089) is another VGAM1956 host target gene. SZF1 BINDING SITE is HOST TARGET binding site found in the 3' untranslated region of mRNA encoded by SZF1, corresponding to a HOST TARGET binding site such as BINDING SITE I, BINDING SITE II or BINDING SITE III. Table 2 illustrates the complementarity of the nucleotide sequences of SZF1 BINDING SITE, designated SEQ ID:18174, to the nucleotide sequence of VGAM1956 RNA, herein designated VGAM RNA, also designated SEQ ID:4667.

Another function of VGAM1956 is therefore inhibition of SZF1 (Accession NM_016089). Accordingly, utilities of VGAM1956 include diagnosis, prevention and treatment of diseases and clinical conditions associated with SZF1. Testis Expressed Sequence 27 (TEX27, Accession NM_021943) is another VGAM1956 host target gene. TEX27 BINDING SITE is HOST TARGET binding site found in the 3' untranslated region of mRNA encoded by TEX27, corresponding to a HOST TARGET binding site such as BINDING SITE I, BINDING SITE II or BINDING SITE III. Table 2 illustrates the complementarity of the nucleotide sequences of TEX27 BINDING SITE, designated SEQ ID:22461, to the nucleotide sequence of VGAM1956 RNA, herein designated VGAM RNA, also designated SEQ ID:4667.

Another function of VGAM1956 is therefore inhibition of Testis Expressed Sequence 27 (TEX27, Accession NM_021943). Accordingly, utilities of VGAM1956 include diagnosis, prevention and treatment of diseases and clinical conditions associated with TEX27. Tripartite Motif-containing 11 (TRIM11, Accession XM_052974) is another VGAM1956 host target gene. TRIM11 BINDING SITE is HOST TARGET binding site found in the 3' untranslated region of mRNA encoded by TRIM11, corresponding to a HOST TARGET binding site such as BINDING SITE I, BINDING SITE II or BINDING SITE III. Table 2 illustrates the complementarity of the nucleotide sequences of TRIM11 BINDING SITE, designated SEQ ID:36055, to the nucleotide sequence of VGAM1956 RNA, herein designated VGAM RNA, also designated SEQ ID:4667.

Another function of VGAM1956 is therefore inhibition of Tripartite Motif-containing 11 (TRIM11, Accession XM_052974). Accordingly, utilities of VGAM1956 include diagnosis, prevention and treatment of diseases and clinical conditions associated with TRIM11. Tripartite Motif-containing 38 (TRIM38, Accession NM_006355) is another VGAM1956 host target gene. TRIM38 BINDING SITE is HOST TARGET binding site found in the 3' untranslated region of mRNA encoded by TRIM38, corresponding to a HOST TARGET binding site such as BINDING SITE I, BINDING SITE II or BINDING SITE III. Table 2 illustrates the complementarity of the nucleotide sequences of TRIM38 BINDING SITE, designated SEQ ID:13051, to the nucleotide sequence of VGAM1956 RNA, herein designated VGAM RNA, also designated SEQ ID:4667.

Another function of VGAM1956 is therefore inhibition of Tripartite Motif-containing 38 (TRIM38, Accession NM_006355). Accordingly, utilities of VGAM1956 include diagnosis, prevention and treatment of diseases and clinical conditions associated with TRIM38. Ubiquitin-conjugating Enzyme E2G 1 (UBC7 homolog, C. elegans) (UBE2G1, Accession NM_003342) is another VGAM1956 host target gene. UBE2G1 BINDING SITE is HOST TARGET binding site found in the 3' untranslated region of mRNA encoded by UBE2G1, corresponding to a HOST TARGET binding site such as BINDING SITE I, BINDING SITE II or BINDING SITE III. Table 2 illustrates the complementarity of the nucleotide sequences of UBE2G1 BINDING SITE, designated SEQ ID:9350, to the nucleotide sequence of VGAM1956 RNA, herein designated VGAM RNA, also designated SEQ ID:4667.

Another function of VGAM1956 is therefore inhibition of Ubiquitin-conjugating Enzyme E2G 1 (UBC7 homolog, C. elegans) (UBE2G1, Accession NM_003342). Accordingly, utilities of VGAM1956 include diagnosis, prevention and treatment of diseases and clinical conditions associated with UBE2G1. ZFD25 (Accession NM_016220) is another VGAM1956 host target gene. ZFD25 BINDING SITE is HOST TARGET binding site found in the 5' untranslated region of mRNA encoded by ZFD25, corresponding to a HOST TARGET binding site such as BINDING SITE I, BINDING SITE II or BINDING SITE III. Table 2 illustrates the complementarity of the nucleotide sequences of ZFD25 BINDING SITE, designated SEQ ID:18322, to the nucleotide sequence of VGAM1956 RNA, herein designated VGAM RNA, also designated SEQ ID:4667.

Another function of VGAM1956 is therefore inhibition of ZFD25 (Accession NM_016220). Accordingly, utilities of VGAM1956 include diagnosis, prevention and treatment of diseases and clinical conditions associated with ZFD25. Zinc Finger Protein 238 (ZNF238, Accession NM_006352) is another VGAM1956 host target gene. ZNF238 BINDING SITE is HOST TARGET binding site found in the 3' untranslated region of mRNA encoded by ZNF238, corresponding to a HOST TARGET binding site such as BINDING SITE I, BINDING SITE II or BINDING SITE III. Table 2 illustrates the complementarity of the nucleotide sequences of ZNF238 BINDING SITE, designated SEQ ID:13045, to the nucleotide sequence of VGAM1956 RNA, herein designated VGAM RNA, also designated SEQ ID:4667.

Another function of VGAM1956 is therefore inhibition of Zinc Finger Protein 238 (ZNF238, Accession NM_006352). Accordingly, utilities of VGAM1956 include diagnosis, prevention and treatment of diseases and clinical conditions associated with ZNF238. LOC124460 (Accession XM_071892) is another VGAM1956 host target gene. LOC124460 BINDING SITE is HOST TARGET binding site found in the 3' untranslated region of mRNA encoded by LOC124460, corresponding to a HOST TARGET binding site such as BINDING SITE I, BINDING SITE II or BINDING SITE III. Table 2 illustrates the complementarity of the nucleotide sequences of LOC124460 BINDING SITE, designated SEQ ID:37446, to the nucleotide sequence of VGAM1956 RNA, herein designated VGAM RNA, also designated SEQ ID:4667.

Another function of VGAM1956 is therefore inhibition of LOC124460 (Accession XM_071892). Accordingly, utilities of VGAM1956 include diagnosis, prevention and treatment of diseases and clinical conditions associated with LOC124460. LOC130412 (Accession XM_065708) is another VGAM1956 host target gene. LOC130412 BINDING SITE is HOST TARGET binding site found in the 5' untranslated region of mRNA encoded by LOC130412, corresponding to a HOST TARGET binding site such as BINDING SITE I, BINDING SITE II or BINDING SITE III. Table 2 illustrates the complementarity of the nucleotide sequences of LOC130412 BINDING SITE, designated SEQ ID:37292, to the nucleotide sequence of VGAM1956 RNA, herein designated VGAM RNA, also designated SEQ ID:4667.

Another function of VGAM1956 is therefore inhibition of LOC130412 (Accession XM_065708). Accordingly, utilities of VGAM1956 include diagnosis, prevention and treatment of diseases and clinical conditions associated with LOC130412. LOC144486 (Accession XM_096608) is another VGAM1956 host target gene. LOC144486 BINDING SITE is HOST TARGET binding site found in the 3' untranslated region of mRNA encoded by LOC144486, corresponding to a HOST TARGET binding site such as BINDING SITE I, BINDING SITE II or BINDING SITE III. Table 2 illustrates the complementarity of the nucleotide sequences of LOC144486 BINDING SITE, designated SEQ ID:40418, to the nucleotide sequence of VGAM1956 RNA, herein designated VGAM RNA, also designated SEQ ID:4667.

Another function of VGAM1956 is therefore inhibition of LOC144486 (Accession XM_096608). Accordingly, utilities of VGAM1956 include diagnosis, prevention and treatment of diseases and clinical conditions associated with LOC144486. LOC145082 (Accession XM_096719) is another VGAM1956 host target gene. LOC145082 BINDING SITE is HOST TARGET binding site found in the 5' untranslated region of mRNA encoded by LOC145082, corresponding to a HOST TARGET binding site such as BINDING SITE I, BINDING SITE II or BINDING SITE III. Table 2 illustrates the complementarity of the nucleotide sequences of LOC145082 BINDING SITE, designated SEQ ID:40496, to the nucleotide sequence of VGAM1956 RNA, herein designated VGAM RNA, also designated SEQ ID:4667.

Another function of VGAM1956 is therefore inhibition of LOC145082 (Accession XM_096719). Accordingly, utilities of VGAM1956 include diagnosis, prevention and treatment of diseases and clinical conditions associated with LOC145082. LOC145622 (Accession XM_085186) is another VGAM1956 host target gene. LOC145622 BINDING SITE is HOST TARGET binding site found in the 3' untranslated region of mRNA encoded by LOC145622, corresponding to a HOST TARGET binding site such as BINDING SITE I, BINDING SITE II or BINDING SITE III. Table 2 illustrates the complementarity of the nucleotide sequences of LOC145622 BINDING SITE, designated SEQ ID:37914, to the nucleotide sequence of VGAM1956 RNA, herein designated VGAM RNA, also designated SEQ ID:4667.

Another function of VGAM1956 is therefore inhibition of LOC145622 (Accession XM_085186). Accordingly, utilities of VGAM1956 include diagnosis, prevention and treatment of diseases and clinical conditions associated with LOC145622. LOC145955 (Accession XM_096912) is another VGAM1956 host target gene. LOC145955 BINDING SITE is HOST TARGET binding site found in the 3' untranslated region of mRNA encoded by LOC145955, corresponding to a HOST TARGET binding site such as BINDING SITE I, BINDING SITE II or BINDING SITE III. Table 2 illustrates the complementarity of the nucleotide sequences of LOC145955 BINDING SITE, designated SEQ ID:40645, to the nucleotide sequence of VGAM1956 RNA, herein designated VGAM RNA, also designated SEQ ID:4667.

Another function of VGAM1956 is therefore inhibition of LOC145955 (Accession XM_096912). Accordingly, utilities of VGAM1956 include diagnosis, prevention and treatment of diseases and clinical conditions associated with LOC145955. LOC146146 (Accession XM_085343) is another VGAM1956 host target gene. LOC146146 BINDING SITE is HOST TARGET binding site found in the 5' untranslated region of mRNA encoded by LOC146146, corresponding to a HOST TARGET binding site such as BINDING SITE I, BINDING SITE II or BINDING SITE III. Table 2 illustrates the complementarity of the nucleotide sequences of LOC146146 BINDING SITE, designated SEQ ID:38072, to the nucleotide sequence of VGAM1956 RNA, herein designated VGAM RNA, also designated SEQ ID:4667.

Another function of VGAM1956 is therefore inhibition of LOC146146 (Accession XM_085343). Accordingly, utilities of VGAM1956 include diagnosis, prevention and treatment of diseases and clinical conditions associated with LOC146146. LOC146774 (Accession XM_085584) is another VGAM1956 host target gene. LOC146774 BINDING SITE is HOST TARGET binding site found in the 3' untranslated region of mRNA encoded by LOC146774, corresponding to a HOST TARGET binding site such as BINDING SITE I, BINDING SITE II or BINDING SITE III. Table 2 illustrates the complementarity of the nucleotide sequences of LOC146774 BINDING SITE, designated SEQ ID:38236, to the nucleotide sequence of VGAM1956 RNA, herein designated VGAM RNA, also designated SEQ ID:4667.

Another function of VGAM1956 is therefore inhibition of LOC146774 (Accession XM_085584). Accordingly, utilities of VGAM1956 include diagnosis, prevention and treatment of diseases and clinical conditions associated with LOC146774. LOC148254 (Accession XM_086121) is another VGAM1956 host target gene. LOC148254 BINDING SITE is HOST TARGET binding site found in the 3' untranslated region of mRNA encoded by LOC148254, corresponding to a HOST TARGET binding site such as BINDING SITE I, BINDING SITE II or BINDING SITE III. Table 2 illustrates the complementarity of the nucleotide sequences of LOC148254 BINDING SITE, designated SEQ ID:38504, to the nucleotide sequence of VGAM1956 RNA, herein designated VGAM RNA, also designated SEQ ID:4667.

Another function of VGAM1956 is therefore inhibition of LOC148254 (Accession XM_086121). Accordingly, utilities of VGAM1956 include diagnosis, prevention and treatment of diseases and clinical conditions associated with LOC148254. LOC148938 (Accession XM_097555) is another VGAM1956 host target gene. LOC148938 BINDING SITE is HOST TARGET binding site found in the 3' untranslated region of mRNA encoded by LOC148938, corresponding to a HOST TARGET binding site such as BINDING SITE I, BINDING SITE II or BINDING SITE III. Table 2 illustrates the complementarity of the nucleotide sequences of LOC148938 BINDING SITE, designated SEQ ID:40928, to the nucleotide sequence of VGAM1956 RNA, herein designated VGAM RNA, also designated SEQ ID:4667.

Another function of VGAM1956 is therefore inhibition of LOC148938 (Accession XM_097555). Accordingly, utilities of VGAM1956 include diagnosis, prevention and treatment of diseases and clinical conditions associated with LOC148938. LOC149276 (Accession XM_097621) is another VGAM1956 host target gene. LOC149276 BINDING SITE is HOST TARGET binding site found in the 5' untranslated region of mRNA encoded by LOC149276, corresponding to a HOST TARGET binding site such as BINDING SITE I, BINDING SITE II or BINDING SITE III. Table 2 illustrates the complementarity of the nucleotide sequences of LOC149276 BINDING SITE, designated SEQ ID:40976, to the nucleotide sequence of VGAM1956 RNA, herein designated VGAM RNA, also designated SEQ ID:4667.

Another function of VGAM1956 is therefore inhibition of LOC149276 (Accession XM_097621). Accordingly, utilities of VGAM1956 include diagnosis, prevention and treatment of diseases and clinical conditions associated with LOC149276. LOC149705 (Accession XM_097711) is another VGAM1956 host target gene. LOC149705 BINDING SITE is HOST TARGET binding site found in the 3' untranslated region of mRNA encoded by LOC149705, corresponding to a HOST TARGET binding site such as BINDING SITE I, BINDING SITE II or BINDING SITE III. Table 2 illustrates the complementarity of the nucleotide sequences of LOC149705 BINDING SITE, designated SEQ ID:41053, to the nucleotide sequence of VGAM1956 RNA, herein designated VGAM RNA, also designated SEQ ID:4667.

Another function of VGAM1956 is therefore inhibition of LOC149705 (Accession XM_097711). Accordingly, utilities of VGAM1956 include diagnosis, prevention and treatment of diseases and clinical conditions associated with LOC149705. LOC152137 (Accession XM_087392) is another VGAM1956 host target gene. LOC152137 BINDING SITE is HOST TARGET binding site found in the 5' untranslated region of mRNA encoded by LOC152137, corresponding to a HOST TARGET binding site such as BINDING SITE I, BINDING SITE II or BINDING SITE III. Table 2 illustrates the complementarity of the nucleotide sequences of LOC152137 BINDING SITE, designated SEQ ID:39222, to the nucleotide sequence of VGAM1956 RNA, herein designated VGAM RNA, also designated SEQ ID:4667.

Another function of VGAM1956 is therefore inhibition of LOC152137 (Accession XM_087392). Accordingly, utilities of VGAM1956 include diagnosis, prevention and treatment of diseases and clinical conditions associated with LOC152137. LOC153811 (Accession XM_087779) is another VGAM1956 host target gene. LOC153811 BINDING SITE is HOST TARGET binding site found in the 3' untranslated region of mRNA encoded by LOC153811, corresponding to a HOST TARGET binding site such as BINDING SITE I, BINDING SITE II or BINDING SITE III. Table 2 illustrates the complementarity of the nucleotide sequences of LOC153811 BINDING SITE, designated SEQ ID:39418, to the nucleotide sequence of VGAM1956 RNA, herein designated VGAM RNA, also designated SEQ ID:4667.

Another function of VGAM1956 is therefore inhibition of LOC153811 (Accession XM_087779). Accordingly, utilities of VGAM1956 include diagnosis, prevention and treatment of diseases and clinical conditions associated with LOC153811. LOC157867 (Accession XM_098831) is another VGAM1956 host target gene. LOC157867 BINDING SITE is HOST TARGET binding site found in the 5' untranslated region of mRNA encoded by LOC157867, corresponding to a HOST TARGET binding site such as BINDING SITE I, BINDING SITE II or BINDING SITE III. Table 2 illustrates the complementarity of the nucleotide sequences of LOC157867 BINDING SITE, designated SEQ ID:41857, to the nucleotide sequence of VGAM1956 RNA, herein designated VGAM RNA, also designated SEQ ID:4667.

Another function of VGAM1956 is therefore inhibition of LOC157867 (Accession XM_098831). Accordingly, utilities of VGAM1956 include diagnosis, prevention and treatment of diseases and clinical conditions associated with LOC157867. LOC158308 (Accession XM_098917) is another VGAM1956 host target gene. LOC158308 BINDING SITE is HOST TARGET binding site found in the 3' untranslated region of mRNA encoded by LOC158308, corresponding to a HOST TARGET binding site such as BINDING SITE I, BINDING SITE II or BINDING SITE III. Table 2 illustrates the complementarity of the nucleotide sequences of LOC158308 BINDING SITE, designated SEQ ID:41941, to the nucleotide sequence of VGAM1956 RNA, herein designated VGAM RNA, also designated SEQ ID:4667.

Another function of VGAM1956 is therefore inhibition of LOC158308 (Accession XM_098917). Accordingly, utilities of VGAM1956 include diagnosis, prevention and treatment of diseases and clinical conditions associated with LOC158308. LOC159121 (Accession XM_099028) is another VGAM1956 host target gene. LOC159121 BINDING SITE is HOST TARGET binding site found in the 3' untranslated region of mRNA encoded by LOC159121, corresponding to a HOST TARGET binding site such as BINDING SITE I, BINDING SITE II or BINDING SITE III. Table 2 illustrates the complementarity of the nucleotide sequences of LOC159121 BINDING SITE, designated SEQ ID:42063, to the nucleotide sequence of VGAM1956 RNA, herein designated VGAM RNA, also designated SEQ ID:4667.

Another function of VGAM1956 is therefore inhibition of LOC159121 (Accession XM_099028). Accordingly, utilities of VGAM1956 include diagnosis, prevention and treatment of diseases and clinical conditions associated with LOC159121. LOC162022 (Accession XM_091293) is another VGAM1956 host target gene. LOC162022 BINDING SITE is HOST TARGET binding site found in the 5' untranslated region of mRNA encoded by LOC162022, corresponding to a HOST TARGET binding site such as BINDING SITE I, BINDING SITE II or BINDING SITE III. Table 2 illustrates the complementarity of the nucleotide sequences of LOC162022 BINDING SITE, designated SEQ ID:40043, to the nucleotide sequence of VGAM1956 RNA, herein designated VGAM RNA, also designated SEQ ID:4667.

Another function of VGAM1956 is therefore inhibition of LOC162022 (Accession XM_091293). Accordingly, utilities of VGAM1956 include diagnosis, prevention and treatment of diseases and clinical conditions associated with LOC162022. LOC169966 (Accession XM_093010) is another VGAM1956 host target gene. LOC169966 BINDING SITE is HOST TARGET binding site found in the 3' untranslated region of mRNA encoded by LOC169966, corresponding to a HOST TARGET binding site such as BINDING SITE I, BINDING SITE II or BINDING SITE III. Table 2 illustrates the complementarity of the nucleotide sequences of LOC169966 BINDING SITE, designated SEQ ID:40166, to the nucleotide sequence of VGAM1956 RNA, herein designated VGAM RNA, also designated SEQ ID:4667.

Another function of VGAM1956 is therefore inhibition of LOC169966 (Accession XM_093010). Accordingly, utilities of VGAM1956 include diagnosis, prevention and treatment of diseases and clinical conditions associated with LOC169966. LOC196500 (Accession XM_113734) is another VGAM1956 host target gene. LOC196500 BINDING SITE is HOST TARGET binding site found in the 3' untranslated region of mRNA encoded by LOC196500, corresponding to a HOST TARGET binding site such as BINDING SITE I, BINDING SITE II or BINDING SITE III. Table 2 illustrates the complementarity of the nucleotide sequences of LOC196500 BINDING SITE, designated SEQ ID:42391, to the nucleotide sequence of VGAM1956 RNA, herein designated VGAM RNA, also designated SEQ ID:4667.

Another function of VGAM1956 is therefore inhibition of LOC196500 (Accession XM_113734). Accordingly, utilities of VGAM1956 include diagnosis, prevention and treatment of diseases and clinical conditions associated with LOC196500. LOC199688 (Accession XM_117115) is another VGAM1956 host target gene. LOC199688 BINDING SITE is HOST TARGET binding site found in the 5' untranslated region of mRNA encoded by LOC199688, corresponding to a HOST TARGET binding site such as BINDING SITE I, BINDING SITE II or BINDING SITE III. Table 2 illustrates the complementarity of the nucleotide sequences of LOC199688 BINDING SITE, designated SEQ ID:43230, to the nucleotide sequence of VGAM1956 RNA, herein designated VGAM RNA, also designated SEQ ID:4667.

Another function of VGAM1956 is therefore inhibition of LOC199688 (Accession XM_117115). Accordingly, utilities of VGAM1956 include diagnosis, prevention and treatment of diseases and clinical conditions associated with LOC199688. LOC199699 (Accession XM_113990) is another VGAM1956 host target gene. LOC199699 BINDING SITE is HOST TARGET binding site found in the 3' untranslated region of mRNA encoded by LOC199699, corresponding to a HOST TARGET binding site such as BINDING SITE I, BINDING SITE II or BINDING SITE III. Table 2 illustrates the complementarity of the nucleotide sequences of LOC199699 BINDING SITE, designated SEQ ID:42596, to the nucleotide sequence of VGAM1956 RNA, herein designated VGAM RNA, also designated SEQ ID:4667.

Another function of VGAM1956 is therefore inhibition of LOC199699 (Accession XM_113990). Accordingly, utilities of VGAM1956 include diagnosis, prevention and treatment of diseases and clinical conditions associated with LOC199699. LOC199796 (Accession XM_058994) is another VGAM1956 host target gene. LOC199796 BINDING SITE is HOST TARGET binding site found in the 5' untranslated region of mRNA encoded by LOC199796, corresponding to a HOST TARGET binding site such as BINDING SITE I, BINDING SITE II or BINDING SITE III. Table 2 illustrates the complementarity of the nucleotide sequences of LOC199796 BINDING SITE, designated SEQ ID:36812, to the nucleotide sequence of VGAM1956 RNA, herein designated VGAM RNA, also designated SEQ ID:4667.

Another function of VGAM1956 is therefore inhibition of LOC199796 (Accession XM_058994). Accordingly, utilities of VGAM1956 include diagnosis, prevention and treatment of diseases and clinical conditions associated with LOC199796. LOC200035 (Accession XM_055305) is another VGAM1956 host target gene. LOC200035 BINDING SITE is HOST TARGET binding site found in the 5' untranslated region of mRNA encoded by LOC200035, corresponding to a HOST TARGET binding site such as BINDING SITE I, BINDING SITE II or BINDING SITE III. Table 2 illustrates the complementarity of the nucleotide sequences of LOC200035 BINDING SITE, designated SEQ ID:36263, to the nucleotide sequence of VGAM1956 RNA, herein designated VGAM RNA, also designated SEQ ID:4667.

Another function of VGAM1956 is therefore inhibition of LOC200035 (Accession XM_055305). Accordingly, utilities of VGAM1956 include diagnosis, prevention and treatment of diseases and clinical conditions associated with LOC200035. LOC201707 (Accession XM_114369) is another VGAM1956 host target gene. LOC201707 BINDING SITE is HOST TARGET binding site found in the 5' untranslated region of mRNA encoded by LOC201707, corresponding to a HOST TARGET binding site such as BINDING SITE I, BINDING SITE II or BINDING SITE III. Table 2 illustrates the complementarity of the nucleotide sequences of LOC201707 BINDING SITE, designated SEQ ID:42902, to the nucleotide sequence of VGAM1956 RNA, herein designated VGAM RNA, also designated SEQ ID:4667.

Another function of VGAM1956 is therefore inhibition of LOC201707 (Accession XM_114369). Accordingly, utilities of VGAM1956 include diagnosis, prevention and treatment of diseases and clinical conditions associated with LOC201707. LOC202020 (Accession XM_114419) is another VGAM1956 host target gene. LOC202020 BINDING SITE is HOST TARGET binding site found in the 5' untranslated region of mRNA encoded by LOC202020, corresponding to a HOST TARGET binding site such as BINDING SITE I, BINDING SITE II or BINDING SITE III. Table 2 illustrates the complementarity of the nucleotide sequences of LOC202020 BINDING SITE, designated SEQ ID:42953, to the nucleotide sequence of VGAM1956 RNA, herein designated VGAM RNA, also designated SEQ ID:4667.

Another function of VGAM1956 is therefore inhibition of LOC202020 (Accession XM_114419). Accordingly, utilities of VGAM1956 include diagnosis, prevention and treatment of diseases and clinical conditions associated with LOC202020. LOC202934 (Accession XM_117486) is another VGAM1956 host target gene. LOC202934 BINDING SITE is HOST TARGET binding site found in the 3' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43464, to the nucleotide sequence of VGAM1956 RNA, herein designated VGAM RNA, also designated SEQ ID:4667.

Another function of VGAM1956 is therefore inhibition of LOC202934 (Accession XM_117486). Accordingly, utilities of VGAM1956 include diagnosis, prevention and treatment of diseases and clinical conditions associated with LOC202934. LOC205085 (Accession XM_119810) is another VGAM1956 host target gene. LOC205085 BINDING SITE is HOST TARGET binding site found in the 5' untranslated region of mRNA encoded by LOC205085, corresponding to a HOST TARGET binding site such as BINDING SITE I, BINDING SITE II or BINDING SITE III. Table 2 illustrates the complementarity of the nucleotide sequences of LOC205085 BINDING SITE, designated SEQ ID:43599, to the nucleotide sequence of VGAM1956 RNA, herein designated VGAM RNA, also designated SEQ ID:4667.

Another function of VGAM1956 is therefore inhibition of LOC205085 (Accession XM_119810). Accordingly, utilities of VGAM1956 include diagnosis, prevention and treatment of diseases and clinical conditions associated with LOC205085. LOC219649 (Accession XM_167562) is another VGAM1956 host target gene. LOC219649 BINDING SITE is HOST TARGET binding site found in the 5' untranslated region of mRNA encoded by LOC219649, corresponding to a HOST TARGET binding site such as BINDING SITE I, BINDING SITE II or BINDING SITE III. Table 2 illustrates the complementarity of the nucleotide sequences of LOC219649 BINDING SITE, designated SEQ ID:44667, to the nucleotide sequence of VGAM1956 RNA, herein designated VGAM RNA, also designated SEQ ID:4667.

Another function of VGAM1956 is therefore inhibition of LOC219649 (Accession XM_167562). Accordingly, utilities of VGAM1956 include diagnosis, prevention and treatment of diseases and clinical conditions associated with LOC219649. LOC220020 (Accession XM_167821) is another VGAM1956 host target gene. LOC220020 BINDING SITE is HOST TARGET binding site found in the 5' untranslated region of mRNA encoded by LOC220020, corresponding to a HOST TARGET binding site such as BINDING SITE I, BINDING SITE II or BINDING SITE III. Table 2 illustrates the complementarity of the nucleotide sequences of LOC220020 BINDING SITE, designated SEQ ID:44866, to the nucleotide sequence of VGAM1956 RNA, herein designated VGAM RNA, also designated SEQ ID:4667.

Another function of VGAM1956 is therefore inhibition of LOC220020 (Accession XM_167821). Accordingly, utilities of VGAM1956 include diagnosis, prevention and treatment of diseases and clinical conditions associated with LOC220020. LOC220906 (Accession XM_166133) is another VGAM1956 host target gene. LOC220906 BINDING SITE is HOST TARGET binding site found in the 3' untranslated region of mRNA encoded by LOC220906, corresponding to a HOST TARGET binding site such as BINDING SITE I, BINDING SITE II or BINDING SITE III. Table 2 illustrates the complementarity of the nucleotide sequences of LOC220906 BINDING SITE, designated SEQ ID:43927, to the nucleotide sequence of VGAM1956 RNA, herein designated VGAM RNA, also designated SEQ ID:4667.

Another function of VGAM1956 is therefore inhibition of LOC220906 (Accession XM_166133). Accordingly, utilities of VGAM1956 include diagnosis, prevention and treatment of diseases and clinical conditions associated with LOC220906. LOC253758 (Accession XM_173067) is another VGAM1956 host target gene. LOC253758 BINDING SITE is HOST TARGET binding site found in the 5' untranslated region of mRNA encoded by LOC253758, corresponding to a HOST TARGET binding site such as BINDING SITE I, BINDING SITE II or BINDING SITE III. Table 2 illustrates the complementarity of the nucleotide sequences of LOC253758 BINDING SITE, designated SEQ ID:46319, to the nucleotide sequence of VGAM1956 RNA, herein designated VGAM RNA, also designated SEQ ID:4667.

Another function of VGAM1956 is therefore inhibition of LOC253758 (Accession XM_173067). Accordingly, utilities of VGAM1956 include diagnosis, prevention and treatment of diseases and clinical conditions associated with LOC253758. LOC253782 (Accession XM_171023) is another VGAM1956 host target gene. LOC253782 BINDING SITE is HOST TARGET binding site found in the 3' untranslated region of mRNA encoded by LOC253782, corresponding to a HOST TARGET binding site such as BINDING SITE I, BINDING SITE II or BINDING SITE III. Table 2 illustrates the complementarity of the nucleotide sequences of LOC253782 BINDING SITE, designated SEQ ID:45801, to the nucleotide sequence of VGAM1956 RNA, herein designated VGAM RNA, also designated SEQ ID:4667.

Another function of VGAM1956 is therefore inhibition of LOC253782 (Accession XM_171023). Accordingly, utilities of VGAM1956 include diagnosis, prevention and treatment of diseases and clinical conditions associated with LOC253782. LOC254170 (Accession XM_170746) is another VGAM1956 host target gene. LOC254170 BINDING SITE is HOST TARGET binding site found in the 3' untranslated region of mRNA encoded by LOC254170, corresponding to a HOST TARGET binding site such as BINDING SITE I, BINDING SITE II or BINDING SITE III. Table 2 illustrates the complementarity of the nucleotide sequences of LOC254170 BINDING SITE, designated SEQ ID:45504, to the nucleotide sequence of VGAM1956 RNA, herein designated VGAM RNA, also designated SEQ ID:4667.

Another function of VGAM1956 is therefore inhibition of LOC254170 (Accession XM_170746). Accordingly, utilities of VGAM1956 include diagnosis, prevention and treatment of diseases and clinical conditions associated with LOC254170. LOC255465 (Accession XM_173206) is another VGAM1956 host target gene. LOC255465 BINDING SITE is HOST TARGET binding site found in the 3' untranslated region of mRNA encoded by LOC255465, corresponding to a HOST TARGET binding site such as BINDING SITE I, BINDING SITE II or BINDING SITE III. Table 2 illustrates the complementarity of the nucleotide sequences of LOC255465 BINDING SITE, designated SEQ ID:46456, to the nucleotide sequence of VGAM1956 RNA, herein designated VGAM RNA, also designated SEQ ID:4667.

Another function of VGAM1956 is therefore inhibition of LOC255465 (Accession XM_173206). Accordingly, utilities of VGAM1956 include diagnosis, prevention and treatment of diseases and clinical conditions associated with LOC255465. LOC255520 (Accession XM_171073) is another VGAM1956 host target gene. LOC255520 BINDING SITE is HOST TARGET binding site found in the 5' untranslated region of mRNA encoded by LOC255520, corresponding to a HOST TARGET binding site such as BINDING SITE I, BINDING SITE II or BINDING SITE III. Table 2 illustrates the complementarity of the nucleotide sequences of LOC255520 BINDING SITE, designated SEQ ID:45879, to the nucleotide sequence of VGAM1956 RNA, herein designated VGAM RNA, also designated SEQ ID:4667.

Another function of VGAM1956 is therefore inhibition of LOC255520 (Accession XM_171073). Accordingly, utilities of VGAM1956 include diagnosis, prevention and treatment of diseases and clinical conditions associated with LOC255520. LOC54103 (Accession XM_168508) is another VGAM1956 host target gene. LOC54103 BINDING SITE is HOST TARGET binding site found in the 5' untranslated region of mRNA encoded by LOC54103, corresponding to a HOST TARGET binding site such as BINDING SITE I, BINDING SITE II or BINDING SITE III. Table 2 illustrates the complementarity of the nucleotide sequences of LOC54103 BINDING SITE, designated SEQ ID:45207, to the nucleotide sequence of VGAM1956 RNA, herein designated VGAM RNA, also designated SEQ ID:4667.

Another function of VGAM1956 is therefore inhibition of LOC54103 (Accession XM_168508). Accordingly, utilities of VGAM1956 include diagnosis, prevention and treatment of diseases and clinical conditions associated with LOC54103. LOC58525 (Accession XM_086045) is another VGAM1956 host target gene. LOC58525 BINDING SITE is HOST TARGET binding site found in the 5' untranslated region of mRNA encoded by LOC58525, corresponding to a HOST TARGET binding site such as BINDING SITE I, BINDING SITE II or BINDING SITE III. Table 2 illustrates the complementarity of the nucleotide sequences of LOC58525 BINDING SITE, designated SEQ ID:38459, to the nucleotide sequence of VGAM1956 RNA, herein designated VGAM RNA, also designated SEQ ID:4667.

Another function of VGAM1956 is therefore inhibition of LOC58525 (Accession XM_086045). Accordingly, utilities of VGAM1956 include diagnosis, prevention and treatment of diseases and clinical conditions associated with LOC58525. LOC84570 (Accession NM_032518) is another VGAM1956 host target gene. LOC84570 BINDING SITE is HOST TARGET binding site found in the 5' untranslated region of mRNA encoded by LOC84570, corresponding to a HOST TARGET binding site such as BINDING SITE I, BINDING SITE II or BINDING SITE III. Table 2 illustrates the complementarity of the nucleotide sequences of LOC84570 BINDING SITE, designated SEQ ID:26267, to the nucleotide sequence of VGAM1956 RNA, herein designated VGAM RNA, also designated SEQ ID:4667.

Another function of VGAM1956 is therefore inhibition of LOC84570 (Accession NM_032518). Accordingly, utilities of VGAM1956 include diagnosis, prevention and treatment of diseases and clinical conditions associated with LOC84570. LOC89985 (Accession XM_027892) is another VGAM1956 host target gene. LOC89985 BINDING SITE is HOST TARGET binding site found in the 3' untranslated region of mRNA encoded by LOC89985, corresponding to a HOST TARGET binding site such as BINDING SITE I, BINDING SITE II or BINDING SITE III. Table 2 illustrates the complementarity of the nucleotide sequences of LOC89985 BINDING SITE, designated SEQ ID:30584, to the nucleotide sequence of VGAM1956 RNA, herein designated VGAM RNA, also designated SEQ ID:4667.

Another function of VGAM1956 is therefore inhibition of LOC89985 (Accession XM_027892). Accordingly, utilities of VGAM1956 include diagnosis, prevention and treatment of diseases and clinical conditions associated with LOC89985. LOC90170 (Accession XM_029589) is another VGAM1956 host target gene. LOC90170 BINDING SITE is HOST TARGET binding site found in the 5' untranslated region of mRNA encoded by LOC90170, corresponding to a HOST TARGET binding site such as BINDING SITE I, BINDING SITE II or BINDING SITE III. Table 2 illustrates the complementarity of the nucleotide sequences of LOC90170 BINDING SITE, designated SEQ ID:30911, to the nucleotide sequence of VGAM1956 RNA, herein designated VGAM RNA, also designated SEQ ID:4667.

Another function of VGAM1956 is therefore inhibition of LOC90170 (Accession XM_029589). Accordingly, utilities of VGAM1956 include diagnosis, prevention and treatment of diseases and clinical conditions associated with LOC90170. LOC90408 (Accession XM_031517) is another VGAM1956 host target gene. LOC90408 BINDING SITE is HOST TARGET binding site found in the 5' untranslated region of mRNA encoded by LOC90408, corresponding to a HOST TARGET binding site such as BINDING SITE I, BINDING SITE II or BINDING SITE III. Table 2 illustrates the complementarity of the nucleotide sequences of LOC90408 BINDING SITE, designated SEQ ID:31398, to the nucleotide sequence of VGAM1956 RNA, herein designated VGAM RNA, also designated SEQ ID:4667.

Another function of VGAM1956 is therefore inhibition of LOC90408 (Accession XM_031517). Accordingly, utilities of VGAM1956 include diagnosis, prevention and treatment of diseases and clinical conditions associated with LOC90408. LOC90509 (Accession XM_032209) is another VGAM1956 host target gene. LOC90509 BINDING SITE is HOST TARGET binding site found in the 5' untranslated region of mRNA encoded by LOC90509, corresponding to a HOST TARGET binding site such as BINDING SITE I, BINDING SITE II or BINDING SITE III. Table 2 illustrates the complementarity of the nucleotide sequences of LOC90509 BINDING SITE, designated SEQ ID:31612, to the nucleotide sequence of VGAM1956 RNA, herein designated VGAM RNA, also designated SEQ ID:4667.

Another function of VGAM1956 is therefore inhibition of LOC90509 (Accession XM_032209). Accordingly, utilities of VGAM1956 include diagnosis, prevention and treatment of diseases and clinical conditions associated with LOC90509. LOC90624 (Accession XM_033003) is another VGAM1956 host target gene. LOC90624 BINDING SITE is HOST TARGET binding site found in the 3' untranslated region of mRNA encoded by LOC90624, corresponding to a HOST TARGET binding site such as BINDING SITE I, BINDING SITE II or BINDING SITE III. Table 2 illustrates the complementarity of the nucleotide sequences of LOC90624 BINDING SITE, designated SEQ ID:31816, to the nucleotide sequence of VGAM1956 RNA, herein designated VGAM RNA, also designated SEQ ID:4667.

Another function of VGAM1956 is therefore inhibition of LOC90624 (Accession XM_033003). Accordingly, utilities of VGAM1956 include diagnosis, prevention and treatment of diseases and clinical conditions associated with LOC90624. LOC90625 (Accession XM_033004) is another VGAM1956 host target gene. LOC90625 BINDING SITE is HOST TARGET binding site found in the 5' untranslated region of mRNA encoded by LOC90625, corresponding to a HOST TARGET binding site such as BINDING SITE I, BINDING SITE II or BINDING SITE III. Table 2 illustrates the complementarity of the nucleotide sequences of LOC90625 BINDING SITE, designated SEQ ID:31819, to the nucleotide sequence of VGAM1956 RNA, herein designated VGAM RNA, also designated SEQ ID:4667.

Another function of VGAM1956 is therefore inhibition of LOC90625 (Accession XM_033004). Accordingly, utilities of VGAM1956 include diagnosis, prevention and treatment of diseases and clinical conditions associated with LOC90625. LOC90785 (Accession XM_034110) is another VGAM1956 host target gene. LOC90785 BINDING SITE is HOST TARGET binding site found in the 3' untranslated region of mRNA encoded by LOC90785, corresponding to a HOST TARGET binding site such as BINDING SITE I, BINDING SITE II or BINDING SITE III. Table 2 illustrates the complementarity of the nucleotide sequences of LOC90785 BINDING SITE, designated SEQ ID:32008, to the nucleotide sequence of VGAM1956 RNA, herein designated VGAM RNA, also designated SEQ ID:4667.

Another function of VGAM1956 is therefore inhibition of LOC90785 (Accession XM_034110). Accordingly, utilities of VGAM1956 include diagnosis, prevention and treatment of diseases and clinical conditions associated with LOC90785. LOC91818 (Accession XM_040878) is another VGAM1956 host target gene. LOC91818 BINDING SITE is HOST TARGET binding site found in the 5' untranslated region of mRNA encoded by LOC91818, corresponding to a HOST TARGET binding site such as BINDING SITE I, BINDING SITE II or BINDING SITE III. Table 2 illustrates the complementarity of the nucleotide sequences of LOC91818 BINDING SITE, designated SEQ ID:33405, to the nucleotide sequence of VGAM1956 RNA, herein designated VGAM RNA, also designated SEQ ID:4667.

Another function of VGAM1956 is therefore inhibition of LOC91818 (Accession XM_040878). Accordingly, utilities of VGAM1956 include diagnosis, prevention and treatment of diseases and clinical conditions associated with LOC91818. LOC91948 (Accession XM_041723) is another VGAM1956 host target gene. LOC91948 BINDING SITE is HOST TARGET binding site found in the 3' untranslated region of mRNA encoded by LOC91948, corresponding to a HOST TARGET binding site such as BINDING SITE I, BINDING SITE II or BINDING SITE III. Table 2 illustrates the complementarity of the nucleotide sequences of LOC91948 BINDING SITE, designated SEQ ID:33575, to the nucleotide sequence of VGAM1956 RNA, herein designated VGAM RNA, also designated SEQ ID:4667.

Another function of VGAM1956 is therefore inhibition of LOC91948 (Accession XM_041723). Accordingly, utilities of VGAM1956 include diagnosis, prevention and treatment of diseases and clinical conditions associated with LOC91948. LOC92661 (Accession XM_046465) is another VGAM1956 host target gene. LOC92661 BINDING SITE is HOST TARGET binding site found in the 3' untranslated region of mRNA encoded by LOC92661, corresponding to a HOST TARGET binding site such as BINDING SITE I, BINDING SITE II or BINDING SITE III. Table 2 illustrates the complementarity of the nucleotide sequences of LOC92661 BINDING SITE, designated SEQ ID:34727, to the nucleotide sequence of VGAM1956 RNA, herein designated VGAM RNA, also designated SEQ ID:4667.

Another function of VGAM1956 is therefore inhibition of LOC92661 (Accession XM_046465). Accordingly, utilities of VGAM1956 include diagnosis, prevention and treatment of diseases and clinical conditions associated with LOC92661. LOC93626 (Accession XM_052635) is another VGAM1956 host target gene. LOC93626 BINDING SITE is HOST TARGET binding site found in the 3' untranslated region of mRNA encoded by LOC93626, corresponding to a HOST TARGET binding site such as BINDING SITE I, BINDING SITE II or BINDING SITE III. Table 2 illustrates the complementarity of the nucleotide sequences of LOC93626 BINDING SITE, designated SEQ ID:36044, to the nucleotide sequence of VGAM1956 RNA, herein designated VGAM RNA, also designated SEQ ID:4667.

Another function of VGAM1956 is therefore inhibition of LOC93626 (Accession XM_052635). Accordingly, utilities of VGAM1956 include diagnosis, prevention and treatment of diseases and clinical conditions associated with LOC93626. FIG. 1 further provides a conceptual description of a novel bioinformatically detected viral gene of the present invention, referred to here as Viral Genomic Address Messenger 1957 (VGAM1957) viral gene, which modulates expression of respective host target genes thereof, the function and utility of which host target genes is known in the art.

VGAM1957 is a novel bioinformatically detected regulatory, non protein coding, viral micro RNA (miRNA) gene. The method by which VGAM1957 was detected is described hereinabove with reference to FIGS. 1-8.

VGAM1957 gene, herein designated VGAM GENE, is a viral gene contained in the genome of Macaca Mulatta Rhadinovirus. VGAM1957 host target gene, herein designated VGAM HOST TARGET GENE, is a human gene contained in the human genome.

VGAM1957 gene encodes a VGAM1957 precursor RNA, herein designated VGAM PRECURSOR RNA. Similar to other miRNA genes, and unlike most ordinary genes, VGAM1957 precursor RNA does not encode a protein. A nucleotide sequence identical or highly similar to the nucleotide sequence of VGAM1957 precursor RNA is designated SEQ ID:1943, and is provided hereinbelow with reference to the sequence listing part. Nucleotide sequence SEQ ID:1943 is located at position 5479 relative to the genome of Macaca Mulatta Rhadinovirus.

VGAM1957 precursor RNA folds onto itself, forming VGAM1957 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1957 folded precursor RNA into VGAM1957 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1957 RNA is designated SEQ ID:4668, and is provided hereinbelow with reference to the sequence listing part.

VGAM1957 host target gene, herein designated VGAM HOST TARGET GENE, encodes a corresponding messenger RNA, VGAM1957 host target RNA, herein designated VGAM HOST TARGET RNA. VGAM1957 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1957 RNA, herein designated VGAM RNA, binds complementarily to one or more host target binding sites located in untranslated regions of VGAM1957 host target RNA, herein designated VGAM HOST TARGET RNA. This complementary binding is due to the fact that the nucleotide sequence of VGAM1957 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1957 RNA, herein designated VGAM RNA, may have a different number of host target binding sites in untranslated regions of a VGAM1957 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1957 RNA, herein designated VGAM RNA, to host target binding sites on VGAM1957 host target RNA, herein designated VGAM HOST TARGET RNA, such as BINDING SITE I, BINDING SITE II and BINDING SITE III, inhibits translation of VGAM1957 host target RNA into VGAM1957 host target protein, herein designated VGAM HOST TARGET PROTEIN. VGAM host target protein is therefore outlined by a broken line.

It is appreciated that VGAM1957 host target gene, herein designated VGAM HOST TARGET GENE, in fact represents a plurality of VGAM1957 host target genes. The mRNA of each one of this plurality of VGAM1957 host target genes comprises one or more host target binding sites, each having a nucleotide sequence which is at least partly complementary to VGAM1957 RNA, herein designated VGAM RNA, and which when bound by VGAM1957 RNA causes inhibition of translation of respective one or more VGAM1957 host target proteins.

It is further appreciated by one skilled in the art that the mode of translational inhibition illustrated by FIG. 1 with specific reference to translational inhibition exerted by VGAM1957 gene, herein designated VGAM GENE, on one or more VGAM1957 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1957 is inhibition of expression of host target genes, as part of a novel viral mechanism of attacking a host. Accordingly, utilities of VGAM1957 include diagnosis, prevention and treatment of viral infection by Macaca Mulatta Rhadinovirus. Specific functions, and accordingly utilities, of VGAM1957 correlate with, and may be deduced from, the identity of the host target genes which VGAM1957 binds and inhibits, and the function of these host target genes, as elaborated hereinbelow.

Nucleotide sequences of the VGAM1957 precursor RNA, herein designated VGAM PRECURSOR RNA, and of the 'diced' VGAM1957 RNA, herein designated VGAM RNA, and a schematic representation of the secondary folding of VGAM1957 folded precursor RNA, herein designated VGAM FOLDED PRECURSOR RNA, of VGAM1957 are further described hereinbelow with reference to Table 1.

Nucleotide sequences of host target binding sites, such as BINDING SITE-I, BINDING SITE-II and BINDING SITE-III of FIG. 1, found on VGAM1957 host target RNA, and schematic representation of the complementarity of each of these host target binding sites to VGAM1957 RNA, herein designated VGAM RNA, are described hereinbelow with reference to Table 2.

As mentioned hereinabove with reference to FIG. 1, a function of VGAM1957 gene, herein designated VGAM is inhibition of expression of VGAM1957 target genes. It is appreciated that specific functions, and accordingly utilities, of VGAM1957 correlate with, and may be deduced from, the identity of the target genes which VGAM1957 binds and inhibits, and the function of these target genes, as elaborated hereinbelow.

ATP-binding Cassette, Sub-family B (MDR/TAP), Member 4 (ABCB4, Accession NM_000443) is a VGAM1957 host target gene. ABCB4 BINDING SITE1 and ABCB4 BINDING SITE2 are HOST TARGET binding sites found in untranslated regions of mRNA encoded by ABCB4, corresponding to HOST TARGET binding sites such as BINDING SITE I, BINDING SITE II or BINDING SITE III. Table 2 illustrates the complementarity of the nucleotide sequences of ABCB4 BINDING SITE1 and ABCB4 BINDING SITE2, designated SEQ ID:6031 and SEQ ID:20836 respectively, to the nucleotide sequence of VGAM1957 RNA, herein designated VGAM RNA, also designated SEQ ID:4668.

A function of VGAM1957 is therefore inhibition of ATP-binding Cassette, Sub-family B (MDR/TAP), Member 4 (ABCB4, Accession NM_000443). Accordingly, utilities of VGAM1957 include diagnosis, prevention and treatment of diseases and clinical conditions associated with ABCB4. Adenylate Kinase 1 (AK1, Accession NM_000476) is another VGAM1957 host target gene. AK1 BINDING SITE is HOST TARGET binding site found in the 3' untranslated region of mRNA encoded by AK1, corresponding to a HOST TARGET binding site such as BINDING SITE I, BINDING SITE II or BINDING SITE III. Table 2 illustrates the complementarity of the nucleotide sequences of AK1 BINDING SITE, designated SEQ ID:6088, to the nucleotide sequence of VGAM1957 RNA, herein designated VGAM RNA, also designated SEQ ID:4668.

Another function of VGAM1957 is therefore inhibition of Adenylate Kinase 1 (AK1, Accession NM_000476). Accordingly, utilities of VGAM1957 include diagnosis, prevention and treatment of diseases and clinical conditions associated with AK1. Beta-site APP-cleaving Enzyme (BACE, Accession NM_012104) is another VGAM1957 host target gene. BACE BINDING SITE1 and BACE BINDING SITE2 are HOST TARGET binding sites found in untranslated regions of mRNA encoded by BACE, corresponding to HOST TARGET binding sites such as BINDING SITE I, BINDING SITE II or BINDING SITE III. Table 2 illustrates the complementarity of the nucleotide sequences of BACE BINDING SITE1 and BACE BINDING SITE2, designated SEQ ID:14417 and SEQ ID:29085 respectively, to the nucleotide sequence of VGAM1957 RNA, herein designated VGAM RNA, also designated SEQ ID:4668.

Another function of VGAM1957 is therefore inhibition of Beta-site APP-cleaving Enzyme (BACE, Accession NM_012104), a gene which is responsible for the proteolytic processing of the amyloid precursor protein. Accordingly, utilities of VGAM1957 include diagnosis, prevention and treatment of diseases and clinical conditions associated with BACE. The function of BACE and its association with various diseases and clinical conditions, has been established by previous studies, as described hereinabove with reference to VGAM173. BCLG (Accession NM_030766) is another VGAM1957 host target gene. BCLG BINDING SITE is HOST TARGET binding site found in the 3' untranslated region of mRNA encoded by BCLG, corresponding to a HOST TARGET binding site such as BINDING SITE I, BINDING SITE II or BINDING SITE III. Table 2 illustrates the complementarity of the nucleotide sequences of BCLG BINDING SITE, designated SEQ ID:25051, to the nucleotide sequence of VGAM1957 RNA, herein designated VGAM RNA, also designated SEQ ID:4668.

Another function of VGAM1957 is therefore inhibition of BCLG (Accession NM_030766). Accordingly, utilities of VGAM1957 include diagnosis, prevention and treatment of diseases and clinical conditions associated with BCLG. BN51 (BHK21) Temperature Sensitivity Complementing (BN51T, Accession XM_113557) is another VGAM1957 host target gene. BN51T BINDING SITE is HOST TARGET binding site found in the 3' untranslated region of mRNA encoded by BN51T, corresponding to a HOST TARGET binding site such as BINDING SITE I, BINDING SITE II or BINDING SITE III. Table 2 illustrates the complementarity of the nucleotide sequences of BN51T BINDING SITE, designated SEQ ID:42285, to the nucleotide sequence of VGAM1957 RNA, herein designated VGAM RNA, also designated SEQ ID:4668.

Another function of VGAM1957 is therefore inhibition of BN51 (BHK21) Temperature Sensitivity Complementing (BN51T, Accession XM_113557), a gene which complements a temperature-sensitive cell cycle mutation in BHK cells. Accordingly, utilities of VGAM1957 include diagnosis, prevention and treatment of diseases and clinical conditions associated with BN51T. The function of BN51T and its association with various diseases and clinical conditions, has been established by previous studies, as described hereinabove with reference to VGAM592. Cyclin-dependent Kinase Inhibitor 1B (p27, Kip1) (CDKN1B, Accession NM_004064) is another VGAM1957 host target gene. CDKN1B BINDING SITE is HOST TARGET binding site found in the 5' untranslated region of mRNA encoded by CDKN1B, corresponding to a HOST TARGET binding site such as BINDING SITE I, BINDING SITE II or BINDING SITE III. Table 2 illustrates the complementarity of the nucleotide sequences of CDKN1B BINDING SITE, designated SEQ ID:10273, to the nucleotide sequence of VGAM1957 RNA, herein designated VGAM RNA, also designated SEQ ID:4668.

Another function of VGAM1957 is therefore inhibition of Cyclin-dependent Kinase Inhibitor 1B (p27, Kip1) (CDKN1B, Accession NM_004064), a gene which is involved in g1 arrest and may mediate tgf beta-induced g1 arrest. Accordingly, utilities of VGAM1957 include diagnosis, prevention and treatment of diseases and clinical conditions associated with CDKN1B. The function of CDKN1B and its association with various diseases and clinical conditions, has been established by previous studies, as described hereinabove with reference to VGAM592. Casein Kinase 1, Epsilon (CSNK1E, Accession XM_170996) is another VGAM1957 host target gene. CSNK1E BINDING SITE is HOST TARGET binding site found in the 5' untranslated region of mRNA encoded by CSNK1E, corresponding to a HOST TARGET binding site such as BINDING SITE I, BINDING SITE II or BINDING SITE III. Table 2 illustrates the complementarity of the nucleotide sequences of CSNK1E BINDING SITE, designated SEQ ID:45773, to the nucleotide sequence of VGAM1957 RNA, herein designated VGAM RNA, also designated SEQ ID:4668.

Another function of VGAM1957 is therefore inhibition of Casein Kinase 1, Epsilon (CSNK1E, Accession XM_170996), a gene which can phosphorylate a large number of proteins. Accordingly, utilities of VGAM1957 include diagnosis, prevention and treatment of diseases and clinical conditions associated with CSNK1E. The function of CSNK1E has been established by previous studies. Casein kinase I is a member of the serine/threonine protein kinases. In fact, it consists of a family of related enzymes that are monomeric and widely distributed. Fish et al. (1995) cloned a member of the family, which they designated CKI-epsilon, from a human placenta cDNA library. The reading frame predicts a basic protein of 416 amino acids (43.7 kD) which is most closely related to CKI-delta (OMIM Ref. No. 600864). The authors mapped the gene to 22q12-q13 by fluorescence in situ hybridization. Northern blots showed a major 2.9-kb transcript in all human cell lines examined. Recombinantly expressed enzyme was shown to phosphorylate known CKI substrates and was inhibited by CKI-7, a CKI-specific inhibitor. The human gene was able to rescue yeast with a slow-growth phenotype caused by deletion of HRR25, a yeast CKI locus. Kloss et al. (1998) cloned the double-time (dbt) gene in Drosophila and noted that it is most closely related to human casein kinase I-epsilon. Drosophila dbtS and dbtL mutations, which alter period length of Drosophila circadian rhythms, produce single amino acid changes in conserved regions of the predicted kinase. The dbt mRNA appears to be expressed in the same cell types as are Drosophila ‘per’ (OMIM Ref. No. 602260) and ‘tim.’ Dbt is capable of binding to per in vitro and in Drosophila cells, suggesting that a physical association of per and dbt regulates per phosphorylation and accumulation in vivo Full details of the abovementioned studies are described in the following publications, the disclosure of which are hereby incorporated by reference:

Fish, K. J.; Cegielska, A.; Getman, M. E.; Landes, G. M.; Virshup, D. M.: Isolation and characterization of human casein kinase I-epsilon (CKI), a novel member of the CKI gene family. J. Biol. Chem. 270:14875-14883, 1995; and Kloss, B.; Price, J. L.; Saez, L.; Blau, J.; Rothenfluh, A.; Wesley, C. S.; Young, M. W.: The Drosophila clock gene double-time encodes a protein closely-related to human casein kinase.

Further studies establishing the function and utilities of CSNK1E are found in John Hopkins OMIM database record ID 600863, and in sited publications numbered 7013-7015 listed in the bibliography section hereinbelow, which are also hereby incorporated by reference. Dishevelled Associated Activator of Morphogenesis 2 (DAAM2, Accession XM_166434) is another VGAM1957 host target gene. DAAM2 BINDING SITE is HOST TARGET binding site found in the 3' untranslated region of mRNA encoded by DAAM2, corresponding to a HOST TARGET binding site such as BINDING SITE I, BINDING SITE II or BINDING SITE III. Table 2 illustrates the complementarity of the nucleotide sequences of DAAM2 BINDING SITE, designated SEQ ID:44331, to the nucleotide sequence of VGAM1957 RNA, herein designated VGAM RNA, also designated SEQ ID:4668.

Another function of VGAM1957 is therefore inhibition of Dishevelled Associated Activator of Morphogenesis 2 (DAAM2, Accession XM_166434), a gene which controls cell polarity and movement during development. Accordingly, utilities of VGAM1957 include diagnosis, prevention and treatment of diseases and clinical conditions associated with DAAM2. The function of DAAM2 and its association with various diseases and clinical conditions, has been established by previous studies, as described hereinabove with reference to VGAM247. Deoxycytidine Kinase (DCK, Accession NM_000788) is another VGAM1957 host target gene. DCK BINDING SITE is HOST TARGET binding site found in the 3" untranslated region of mRNA encoded by DCK, corresponding to a HOST TARGET binding site such as BINDING SITE I, BINDING SITE II or BINDING SITE III. Table 2 illustrates the complementarity of the nucleotide sequences of DCK BINDING SITE, designated SEQ ID:6441, to the nucleotide sequence of VGAM1957 RNA, herein designated VGAM RNA, also designated SEQ ID:4668.

Another function of VGAM1957 is therefore inhibition of Deoxycytidine Kinase (DCK, Accession NM_000788), a gene which mediates the phosphorylation of several deoxyribonucleosides and their analogs. Accordingly, utilities of VGAM1957 include diagnosis, prevention and treatment of diseases and clinical conditions associated with DCK. The function of DCK and its association with various diseases and clinical conditions, has been established by previous studies, as described hereinabove with reference to VGAM538. Death Effector Domain Containing (DEDD, Accession NM_032998) is another VGAM1957 host target gene. DEDD BINDING SITE is HOST TARGET binding site found in the 3' untranslated region of mRNA encoded by DEDD, corresponding to a HOST TARGET binding site such as BINDING SITE I, BINDING SITE II or BINDING SITE III. Table 2 illustrates the complementarity of the nucleotide sequences of DEDD BINDING SITE, designated SEQ ID:26881, to the nucleotide sequence of VGAM1957 RNA, herein designated VGAM RNA, also designated SEQ ID:4668.

Another function of VGAM1957 is therefore inhibition of Death Effector Domain Containing (DEDD, Accession NM_032998), a gene which intervenes in apoptosis. Accordingly, utilities of VGAM1957 include diagnosis, prevention and treatment of diseases and clinical conditions associated with DEDD. The function of DEDD and its association with various diseases and clinical conditions, has been established by previous studies, as described hereinabove with reference to VGAM1189. DNA (cytosine-5-)-methyltransferase 2 (DNMT2, Accession NM_004412) is another VGAM1957 host target gene. DNMT2 BINDING SITE is HOST TARGET binding site found in the 3' untranslated region of mRNA encoded by DNMT2, corresponding to a HOST TARGET binding site such as BINDING SITE I, BINDING SITE II or BINDING SITE III. Table 2 illustrates the complementarity of the nucleotide sequences of DNMT2 BINDING SITE, designated SEQ ID:10671, to the nucleotide sequence of VGAM1957 RNA, herein designated VGAM RNA, also designated SEQ ID:4668.

Another function of VGAM1957 is therefore inhibition of DNA (cytosine-5-)-methyltransferase 2 (DNMT2, Accession NM_004412), a gene which may mark specific sequences in the genome. Accordingly, utilities of VGAM1957 include diagnosis, prevention and treatment of diseases and clinical conditions associated with DNMT2. The function of DNMT2 and its association with various diseases and clinical conditions, has been established by previous studies, as described hereinabove with reference to VGAM177. Down Syndrome Critical Region Gene 4 (DSCR4, Accession NM_005867) is another VGAM1957 host target gene. DSCR4 BINDING SITE is HOST TARGET binding site found in the 3' untranslated region of mRNA encoded by DSCR4, corresponding to a HOST TARGET binding site such as BINDING SITE I, BINDING SITE II or BINDING SITE III. Table 2 illustrates the complementarity of the nucleotide sequences of DSCR4 BINDING SITE, designated SEQ ID:12488, to the nucleotide sequence of VGAM1957 RNA, herein designated VGAM RNA, also designated SEQ ID:4668.

Another function of VGAM1957 is therefore inhibition of Down Syndrome Critical Region Gene 4 (DSCR4, Accession NM_005867). Accordingly, utilities of VGAM1957 include diagnosis, prevention and treatment of diseases and clinical conditions associated with DSCR4. G Protein-coupled Receptor 81 (GPR81, Accession NM_032554) is another VGAM1957 host target gene. GPR81 BINDING SITE is HOST TARGET binding site found in the 3' untranslated region of mRNA encoded by GPR81, corresponding to a HOST TARGET binding site such as BINDING SITE I, BINDING SITE II or BINDING SITE III. Table 2 illustrates the complementarity of the nucleotide sequences of GPR81 BINDING SITE, designated SEQ ID:26279, to the nucleotide sequence of VGAM1957 RNA, herein designated VGAM RNA, also designated SEQ ID:4668.

Another function of VGAM1957 is therefore inhibition of G Protein-coupled Receptor 81 (GPR81, Accession NM_032554). Accordingly, utilities of VGAM1957 include diagnosis, prevention and treatment of diseases and clinical conditions associated with GPR81. Glutathione S-transferase M5 (GSTM5, Accession NM_000851) is another VGAM1957 host target gene. GSTM5 BINDING SITE is HOST TARGET binding site found in the 3' untranslated region of mRNA encoded by GSTM5, corresponding to a HOST TARGET binding site such as BINDING SITE I, BINDING SITE II or BINDING SITE III. Table 2 illustrates the complementarity of the nucleotide sequences of GSTM5 BINDING SITE, designated SEQ ID:6519, to the nucleotide sequence of VGAM1957 RNA, herein designated VGAM RNA, also designated SEQ ID:4668.

Another function of VGAM1957 is therefore inhibition of Glutathione S-transferase M5 (GSTM5, Accession NM_000851), a gene which conjugates reduced glutathione to a wide number of exogenous and endogenous hydrophobic electrophiles. Accordingly, utilities of VGAM1957 include diagnosis, prevention and treatment of diseases and clinical conditions associated with GSTM5. The function of GSTM5 has been established by previous studies. The glutathione S-transferases (GSTs) are dimeric enzymes that metabolize a broad range of xenobiotics and carcinogens. They are encoded by several multigene families. See GSTM1 (OMIM Ref. No. 138350) for additional background. By screening a human frontal cortex cDNA library with a rat cDNA that cross-hybridized with other rodent and human mu class GST cDNAs, Takahashi et al. (1993) isolated a cDNA encoding GSTM5. Northern blot analysis revealed that GSTM5 is expressed primarily in brain and lung and to a lesser extent in heart. The GSTM5 gene encodes a predicted 217-amino acid protein. By Western blot analysis using antibodies against the unique C-terminal region of GSTM5, Takahashi et al. (1993) detected GSTM5 in brain and testis but not liver.

Full details of the abovementioned studies are described in the following publications, the disclosure of which are hereby incorporated by reference:

Pearson, W. R.; Vorachek, W. R.; Xu, S.; Berger, R.; Hart, I.; Vannais, D.; Patterson, D.: Identification of class-mu glutathione transferase genes GSTM1-GSTM5 on human chromosome 1p13. Am. J. Hum. Genet. 53: 220-233, 1993; and Takahashi, Y.; Campbell, E. A.; Hirata, Y.; Takayama, T.; Listowsky, I.: A basis for differentiating among the multiple human mu-glutathione S-transferases and molecular cloning of bra.

Further studies establishing the function and utilities of GSTM5 are found in John Hopkins OMIM database record ID 138385, and in sited publications numbered 3730 listed in the bibliography section hereinbelow, which are also hereby incorporated by reference. Huntingtin (Huntington disease) (HD, Accession NM_002111) is another VGAM1957 host target gene. HD BINDING SITE is HOST TARGET binding site found in the 3' untranslated region of mRNA encoded by HD, corresponding to a HOST TARGET binding site such as BINDING SITE I, BINDING SITE II or BINDING SITE III. Table 2 illustrates the complementarity of the nucleotide sequences of HD BINDING SITE, designated SEQ ID:7896, to the nucleotide sequence of VGAM1957 RNA, herein designated VGAM RNA, also designated SEQ ID:4668.

Another function of VGAM1957 is therefore inhibition of Huntingtin (Huntington disease) (HD, Accession NM_002111). Accordingly, utilities of VGAM1957 include diagnosis, prevention and treatment of diseases and clinical conditions associated with HD. Homeo Box B9 (HOXB9, Accession NM_024017) is another VGAM1957 host target gene. HOXB9 BINDING SITE is HOST TARGET binding site found in the 3' untranslated region of mRNA encoded by HOXB9, corresponding to a HOST TARGET binding site such as BINDING SITE I, BINDING SITE II or BINDING SITE III. Table 2 illustrates the complementarity of the nucleotide sequences of HOXB9 BINDING SITE, designated SEQ ID:23447, to the nucleotide sequence of VGAM1957 RNA, herein designated VGAM RNA, also designated SEQ ID:4668.

Another function of VGAM1957 is therefore inhibition of Homeo Box B9 (HOXB9, Accession NM_024017). Accordingly, utilities of VGAM1957 include diagnosis, prevention and treatment of diseases and clinical conditions associated with HOXB9. HTRA3 (Accession XM_114416) is another VGAM1957 host target gene. HTRA3 BINDING SITE is HOST TARGET binding site found in the 3' untranslated region of mRNA encoded by HTRA3, corresponding to a HOST TARGET binding site such as BINDING SITE I, BINDING SITE II or BINDING SITE III. Table 2 illustrates the complementarity of the nucleotide sequences of HTRA3 BINDING SITE, designated SEQ ID:42938, to the nucleotide sequence of VGAM1957 RNA, herein designated VGAM RNA, also designated SEQ ID:4668.

Another function of VGAM1957 is therefore inhibition of HTRA3 (Accession XM_114416). Accordingly, utilities of VGAM1957 include diagnosis, prevention and treatment of diseases and clinical conditions associated with HTRA3. Interleukin 1 Family, Member 5 (delta) (IL1F5, Accession NM_012275) is another VGAM1957 host target gene. IL1F5 BINDING SITE is HOST TARGET binding site found in the 3' untranslated region of mRNA encoded by IL1F5, corresponding to a HOST TARGET binding site such as BINDING SITE I, BINDING SITE II or BINDING SITE III. Table 2 illustrates the complementarity of the nucleotide sequences of IL1F5 BINDING SITE, designated SEQ ID:14604, to the nucleotide sequence of VGAM1957 RNA, herein designated VGAM RNA, also designated SEQ ID:4668.

Another function of VGAM1957 is therefore inhibition of Interleukin 1 Family, Member 5 (delta) (IL1F5, Accession NM_012275), a gene which is a novel interleukin-1 receptor antagonist gene. Accordingly, utilities of VGAM1957 include diagnosis, prevention and treatment of diseases and clinical conditions associated with IL1F5. The function of IL1F5 and its association with various diseases and clinical conditions, has been established by previous studies, as described hereinabove with reference to VGAM263. Potassium Voltage-gated Channel, KQT-like Subfamily, Member 3 (KCNQ3, Accession NM_004519) is another VGAM1957 host target gene. KCNQ3 BINDING SITE is HOST TARGET binding site found in the 5' untranslated region of mRNA encoded by KCNQ3, corresponding to a HOST TARGET binding site such as BINDING SITE I, BINDING SITE II or BINDING SITE III. Table 2 illustrates the complementarity of the nucleotide sequences of KCNQ3 BINDING SITE, designated SEQ ID:10847, to the nucleotide sequence of VGAM1957 RNA, herein designated VGAM RNA, also designated SEQ ID:4668.

Another function of VGAM1957 is therefore inhibition of Potassium Voltage-gated Channel, KQT-like Subfamily, Member 3 (KCNQ3, Accession NM_004519), a gene which probably important in the regulation of neuronal excitability. Accordingly, utilities of VGAM1957 include diagnosis, prevention and treatment of diseases and clinical conditions associated with KCNQ3. The function of KCNQ3 has been established by previous studies. The KQT-like family is a family of voltage-gated potassium channels. The first human gene belonging to this family to be identified was that responsible for chromosome-11 long QT syndrome and the Jervell and Lange-Nielsen cardioauditory syndrome (KCNQ1; 192500). The second to be identified (KCNQ2; 602235) was the gene mutated in the chromosome-20 form of benign neonatal epilepsy (EBN1; 121200). To identify new members of that family, possibly implicated in other forms of idiopathic generalized epilepsy, Charlier et al. (1998) conducted a tBLASTx search with the KCNQ2 full-length cDNA against the expressed sequence tag (EST) database. In this way they identified a new gene, designated KCNQ3. They mapped the gene to chromosome 8 by analysis of a somatic cell hybrid panel and refined the assignment by analysis of radiation hybrids, which showed tight linkage of KCNQ3 to markers previously mapped to 8q24. The KCNQ3 gene was localized to the interval defined by markers previously linked to a family with chromosome-8 benign neonatal epilepsy (EBN2; 121201). Charlier et al. (1998) then sought mutations in the KCNQ3 gene in a member of a phenotypically well-characterized 3-generation Mexican-American family affected with BFNC2 reported by Ryan et al. (1991). They identified a single heterozygous missense mutation, glycine (GGC) to valine (GTC), in position 263 of the highly conserved pore region. The same glycine had been found to be mutated in KCNQ1 (gly177arg) in a patient with long QT syndrome (192500.0001). Defects in the KCNQ genes cause human disorders associated with altered regulation of excitability. KCNQ1 is expressed in the heart and inner ear; KCNQ2 and KCNQ3 are expressed in the brain Cooper et al. (2000) provided information regarding the in vivo distribution and biochemical characteristics of human brain KCNQ2 and KCNQ3, the 2 channel subunits that form M-channels when expressed in vitro, and, when mutated, cause the dominantly inherited epileptic syndrome, benign familial neonatal convulsions. They found that the KCNQ2 and KCNQ3 proteins are colocalized in a somatodendritic pattern on pyramidal and polymorphic neurons in the human cortex and hippocampus. Immunoreactivity for KCNQ2, but not KCNQ3, is also prominent in some terminal fields, suggesting a presynaptic role for a distinct subgroup of M-channels in the regulation of action potential propagation and neurotransmitter release. KCNQ2 and KCNQ3 could be coimmunoprecipitated from brain lysates. Further, both proteins were coassociated with tubulin (see OMIM Ref. No. 602529) and protein kinase A (see OMIM Ref. No. 176911) within a triton X-100-insoluble protein complex. Cooper et al. (2000) suggested that these studies provided a view of a signaling complex that may be important for cognitive function as well as epilepsy, and that analysis of this complex may shed light on the transduction pathway linking muscarinic acetylcholine receptor (see OMIM Ref. No. 118510) activation to M-channel inhibition.

Full details of the abovementioned studies are described in the following publications, the disclosure of which are hereby incorporated by reference:

Cooper, E. C.; Aldape, K. D.; Abosch, A.; Barbaro, N. M.; Berger, M. S.; Peacock, W. S.; Jan, Y. N.; Jan, L. Y.: Colocalization and coassembly of two human brain M-type potassium channel subunits that are mutated in epilepsy. Proc. Nat. Acad. Sci. 97:4914-4919, 2000; and Charlier, C.; Singh, N. A.; Ryan, S. G.; Lewis, T. B.; Reus, B. E.; Leach, R. J.; Leppert, M.: A pore mutation in a novel KQT-like potassium channel gene in an idiopathic epilepsy fami.

Further studies establishing the function and utilities of KCNQ3 are found in John Hopkins OMIM database record ID 602232, and in sited publications numbered 4664, 628 and 6290-6291 listed in the bibliography section hereinbelow, which are also hereby incorporated by reference. Potassium Voltage-gated Channel, Delayed-rectifier, Subfamily S, Member 2 (KCNS2, Accession XM_043106) is another VGAM1957 host target gene. KCNS2 BINDING SITE is HOST TARGET binding site found in the 3' untranslated region of mRNA encoded by KCNS2, corresponding to a HOST TARGET binding site such as BINDING SITE I, BINDING SITE II or BINDING SITE III. Table 2 illustrates the complementarity of the nucleotide sequences of KCNS2 BINDING SITE, designated SEQ ID:33898, to the nucleotide sequence of VGAM1957 RNA, herein designated VGAM RNA, also designated SEQ ID:4668.

Another function of VGAM1957 is therefore inhibition of Potassium Voltage-gated Channel, Delayed-rectifier, Subfamily S, Member 2 (KCNS2, Accession XM_043106), a gene which mediates the voltage-dependent potassium ion permeability of excitable membranes. Accordingly, utilities of VGAM1957 include diagnosis, prevention and treatment of diseases and clinical conditions associated with KCNS2. The function of KCNS2 and its association with various diseases and clinical conditions, has been established by previous studies, as described hereinabove with reference to VGAM419. Loss of Heterozygosity, 11, Chromosomal Region 2, Gene A (LOH11CR2A, Accession NM_014622) is another VGAM1957 host target gene. LOH11CR2A BINDING SITE is HOST TARGET binding site found in the 5' untranslated region of mRNA encoded by LOH11CR2A, corresponding to a HOST TARGET binding site such as BINDING SITE I, BINDING SITE II or BINDING SITE III. Table 2 illustrates the complementarity of the nucleotide sequences of LOH11CR2A BINDING SITE, designated SEQ ID:15989, to the nucleotide sequence of VGAM1957 RNA, herein designated VGAM RNA, also designated SEQ ID:4668.

Another function of VGAM1957 is therefore inhibition of Loss of Heterozygosity, 11, Chromosomal Region 2, Gene A (LOH11CR2A, Accession NM_014622). Accordingly, utilities of VGAM1957 include diagnosis, prevention and treatment of diseases and clinical conditions associated with LOH11CR2A. V-maf Musculoaponeurotic Fibrosarcoma Oncogene Homolog F (avian) (MAFF, Accession NM_012323) is another VGAM1957 host target gene. MAFF BINDING SITE is HOST TARGET binding site found in the 3' untranslated region of mRNA encoded by MAFF, corresponding to a HOST TARGET binding site such as BINDING SITE I, BINDING SITE II or BINDING SITE III. Table 2 illustrates the complementarity of the nucleotide sequences of MAFF BINDING SITE, designated SEQ ID:14702, to the nucleotide sequence of VGAM1957 RNA, herein designated VGAM RNA, also designated SEQ ID:4668.

Another function of VGAM1957 is therefore inhibition of V-maf Musculoaponeurotic Fibrosarcoma Oncogene Homolog F (avian) (MAFF, Accession NM_012323), a gene which Binds to the US-2 motif of the oxytocin receptor gene; has a leucine zipper structure. Accordingly, utilities of VGAM1957 include diagnosis, prevention and treatment of diseases and clinical conditions associated with MAFF. The function of MAFF and its association with various diseases and clinical conditions, has been established by previous studies, as described hereinabove with reference to VGAM1928. Mitogen-activated Protein Kinase 14 (MAPK14, Accession NM_139012) is another VGAM1957 host target gene. MAPK14 BINDING SITE1 through MAPK14 BINDING SITE3 are HOST TARGET binding sites found in untranslated regions of mRNA encoded by MAPK14, corresponding to HOST TARGET binding sites such as BINDING SITE I, BINDING SITE II or BINDING SITE III. Table 2 illustrates the complementarity of the nucleotide sequences of MAPK14 BINDING SITE1 through MAPK14 BINDING SITE3, designated SEQ ID:29108, SEQ ID:7004 and SEQ ID:29115 respectively, to the nucleotide sequence of VGAM1957 RNA, herein designated VGAM RNA, also designated SEQ ID:4668.

Another function of VGAM1957 is therefore inhibition of Mitogen-activated Protein Kinase 14 (MAPK14, Accession NM_139012), a gene which is important for cytokine production; responds to changes in extracellular osmolarity. Accordingly, utilities of VGAM1957 include diagnosis, prevention and treatment of diseases and clinical conditions associated with MAPK14. The function of MAPK14 and its association with various diseases and clinical conditions, has been established by previous studies, as described hereinabove with reference to VGAM107. MAX Protein (MAX, Accession NM_145112) is another VGAM1957 host target gene. MAX BINDING SITE1 through MAX BINDING SITE4 are HOST TARGET binding sites found in untranslated regions of mRNA encoded by MAX, corresponding to HOST TARGET binding sites such as BINDING SITE I, BINDING SITE II or BINDING SITE III. Table 2 illustrates the complementarity of the nucleotide sequences of MAX BINDING SITE1 through MAX BINDING SITE4, designated SEQ ID:29717, SEQ ID:29719, SEQ ID:29722 and SEQ ID:22487 respectively, to the nucleotide sequence of VGAM1957 RNA, herein designated VGAM RNA, also designated SEQ ID:4668.

Another function of VGAM1957 is therefore inhibition of MAX Protein (MAX, Accession NM_145112), a gene which interacts specifically with the MYC (190080) protein. Accordingly, utilities of VGAM1957 include diagnosis, prevention and treatment of diseases and clinical conditions associated with MAX. The function of MAX and its association with various diseases and clinical conditions, has been established by previous studies, as described hereinabove with reference to VGAM1923. Procollagen C-endopeptidase Enhancer 2 (PCOLCE2, Accession NM_013363) is another VGAM1957 host target gene. PCOLCE2 BINDING SITE is HOST TARGET binding site found in the 5' untranslated region of mRNA encoded by PCOLCE2, corresponding to a HOST TARGET binding site such as BINDING SITE I, BINDING SITE II or BINDING SITE III. Table 2 illustrates the complementarity of the nucleotide sequences of PCOLCE2 BINDING SITE, designated SEQ ID:15009, to the nucleotide sequence of VGAM1957 RNA, herein designated VGAM RNA, also designated SEQ ID:4668.

Another function of VGAM1957 is therefore inhibition of Procollagen C-endopeptidase Enhancer 2 (PCOLCE2, Accession NM_013363), a gene which binds to the cooh-terminal propeptide of type i procollagen and enhances procollagen c-proteinase activity. Accordingly, utilities of VGAM1957 include diagnosis, prevention and treatment of diseases and clinical conditions associated with PCOLCE2. The function of PCOLCE2 has been established by previous studies. Xu et al. (2000) cloned PCOLCE2 from trabecular meshwork cell mRNA followed by 5-prime RACE. The deduced 415-amino acid protein contains an N-terminal signal sequence, 2 CUB domains, and an NTR domain. It also contains a putative myristoylation site, several potential phosphorylation sites, a putative glycosylation site, and an RGD site. PCOLCE2 shares about 43% sequence identity with the PCOLCE protein (OMIM Ref. No. 600270). The secreted PCOLCE2 protein is calculated to have a molecular mass of about 47 kD. Northern blot analysis detected ubiquitous expression of a 2-kb transcript, with highest expression in heart, placenta, and trabecular meshwork, and very low expression in brain. Western blot analysis revealed a 52-kD form of PCOLCE2 in human fibroblast cells. Xu et al. (2000) identified the PCOLCE2 sequence within an EST mapped to chromosome 3q21-q24. Steiglitz and Greenspan (2001) noted identity between the PCOLCE2 sequence and the sequence of a BAC clone mapped to 3q23. They found that PCOLCE2 lies 5.2 kb and 102.5 kb centromeric to the transient receptor potential channel-1 (TRPC1; 602343) and plastin-1 (PLS1; 602734), respectively. By radiation hybrid analysis, they mapped the mouse gene to chromosome 9.

Full details of the abovementioned studies are described in the following publications, the disclosure of which are hereby incorporated by reference:

Steiglitz, B. M.; Greenspan, D. S.: Assignment of the mouse Pcolce2 gene, which encodes procollagen C-proteinase enhancer protein 2, to chromosome 9 and localization of PCOLCE2 to human chromosome 3q23. Cytogenet. Cell Genet. 95:244-245, 2001; and Xu, H.; Acott, T. S.; Wirtz, M. K.: Identification and expression of a novel type I procollagen C-proteinase enhancer protein gene from the glaucoma candidate region on 3q21-q24. Geno.

Further studies establishing the function and utilities of PCOLCE2 are found in John Hopkins OMIM database record ID 607064, and in sited publications numbered 5133-5134 listed in the bibliography section hereinbelow, which are also hereby incorporated by reference. Protein Phosphatase, EF Hand Calcium-binding Domain 2 (PPEF2, Accession NM_006239) is another VGAM1957 host target gene. PPEF2 BINDING SITE is HOST TARGET binding site found in the 3' untranslated region of mRNA encoded by PPEF2, corresponding to a HOST TARGET binding site such as BINDING SITE I, BINDING SITE II or BINDING SITE III. Table 2 illustrates the complementarity of the nucleotide sequences of PPEF2 BINDING SITE, designated SEQ ID:12904, to the nucleotide sequence of VGAM1957 RNA, herein designated VGAM RNA, also designated SEQ ID:4668.

Another function of VGAM1957 is therefore inhibition of Protein Phosphatase, EF Hand Calcium-binding Domain 2 (PPEF2, Accession NM_006239), a gene which is a homolog of Drosophila rdgC. Accordingly, utilities of VGAM1957 include diagnosis, prevention and treatment of diseases and clinical conditions associated with PPEF2. The function of PPEF2 and its association with various diseases and clinical conditions, has been established by previous studies, as described hereinabove with reference to VGAM1466. RAB3A, Member RAS Oncogene Family (RAB3A, Accession NM_002866) is another VGAM1957 host target gene. RAB3A BINDING SITE is HOST TARGET binding site found in the 3' untranslated region of mRNA encoded by RAB3A, corresponding to a HOST TARGET binding site such as BINDING SITE I, BINDING SITE II or BINDING SITE III. Table 2 illustrates the complementarity of the nucleotide sequences of RAB3A BINDING SITE, designated SEQ ID:8770, to the nucleotide sequence of VGAM1957 RNA, herein designated VGAM RNA, also designated SEQ ID:4668.

Another function of VGAM1957 is therefore inhibition of RAB3A, Member RAS Oncogene Family (RAB3A, Accession NM_002866), a gene which is involved in exocytosis, by regulating a late step in synaptic vesicle fusion. Accordingly, utilities of VGAM1957 include diagnosis, prevention and treatment of diseases and clinical conditions associated with RAB3A. The function of RAB3A has been established by previous studies. The RAS gene superfamily is divided into 3 main branches according to protein homology. In mammals the first branch includes the classic RAS genes as well as RAL (OMIM Ref. No. 179550) and RRAS (OMIM Ref. No. 165090). The RHO genes (165370, 165380, 165390) belong to the second branch and the RAB genes to the third. The RAB genes were so named because they were first isolated from a rat brain library. Zahraoui et al. (1989) isolated cDNAs encoding RAB3A and several other human RAB proteins. See RAB5A (OMIM Ref. No. 179512). The predicted 220-amino acid human RAB3A protein shares 99% and 78% identity with rat Rab3A and human RAB3B (OMIM Ref. No. 179510), respectively. Animal model experiments lend further support to the function of RAB3A. In brain, RAB3A is found specifically in synaptic vesicles. Geppert et al. (1997) generated Rab3A-deficient mice. They found that the size of the readily releasable pool of vesicles was normal, but that calcium-triggered fusion was altered in the absence of Rab3A such that a greater number of exocytic events occurred within a brief time after arrival of the nerve impulse. They concluded that Rab3A regulates a late step in synaptic vesicle fusion.

It is appreciated that the abovementioned animal model for RAB3A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Zahraoui, A.; Touchot, N.; Chardin, P.; Tavitian, A.: The human rab genes encode a family of GTP-binding proteins related to yeast YPT1 and SEC4 products involved in secretion. J. Biol. Chem. 264:12394-12401, 1989; and Geppert, M.; Goda, Y.; Stevens, C. F.; Sudhof, T. C.: The small GTP-binding protein Rab3A regulates a late step in synaptic vesicle fusion. Nature 387:810-814, 1997.

Further studies establishing the function and utilities of RAB3A are found in John Hopkins OMIM database record ID 179490, and in sited publications numbered 2718-272 and 5126 listed in the bibliography section hereinbelow, which are also hereby incorporated by reference. Retinoid X Receptor, Alpha (RXRA, Accession NM_002957) is another VGAM1957 host target gene. RXRA BINDING SITE is HOST TARGET binding site found in the 3' untranslated region of mRNA encoded by RXRA, corresponding to a HOST TARGET binding site such as BINDING SITE I, BINDING SITE II or BINDING SITE III. Table 2 illustrates the complementarity of the nucleotide sequences of RXRA BINDING SITE, designated SEQ ID:8871, to the nucleotide sequence of VGAM1957 RNA, herein designated VGAM RNA, also designated SEQ ID:4668.

Another function of VGAM1957 is therefore inhibition of Retinoid X Receptor, Alpha (RXRA, Accession NM_002957), a gene which activates genes required for vitamin A metabolism, binds 9-cis retinoic acid. Accordingly, utilities of VGAM1957 include diagnosis, prevention and treatment of diseases and clinical conditions associated with RXRA. The function of RXRA and its association with various diseases and clinical conditions, has been established by previous studies, as described hereinabove with reference to VGAM349. TEM6 (Accession NM_022748) is another VGAM1957 host target gene. TEM6 BINDING SITE is HOST TARGET binding site found in the 3' untranslated region of mRNA encoded by TEM6, corresponding to a HOST TARGET binding site such as BINDING SITE I, BINDING SITE II or BINDING SITE III. Table 2 illustrates the complementarity of the nucleotide sequences of TEM6 BINDING SITE, designated SEQ ID:22960, to the nucleotide sequence of VGAM1957 RNA, herein designated VGAM RNA, also designated SEQ ID:4668.

Another function of VGAM1957 is therefore inhibition of TEM6 (Accession NM_022748), a gene which displays elevated expression during tumor angiogenesis. Accordingly, utilities of VGAM1957 include diagnosis, prevention and treatment of diseases and clinical conditions associated with TEM6. The function of TEM6 and its association with various diseases and clinical conditions, has been established by previous studies, as described hereinabove with reference to VGAM175. Tumor Protein D52-like 2 (TPD52L2, Accession NM_003288) is another VGAM1957 host target gene. TPD52L2 BINDING SITE is HOST TARGET binding site found in the 3" untranslated region of mRNA encoded by TPD52L2, corresponding to a HOST TARGET binding site such as BINDING SITE I, BINDING SITE II or BINDING SITE III. Table 2 illustrates the complementarity of the nucleotide sequences of TPD52L2 BINDING SITE, designated SEQ ID:9298, to the nucleotide sequence of VGAM1957 RNA, herein designated VGAM RNA, also designated SEQ ID:4668.

Another function of VGAM1957 is therefore inhibition of Tumor Protein D52-like 2 (TPD52L2, Accession NM_003288). Accordingly, utilities of VGAM1957 include diagnosis, prevention and treatment of diseases and clinical conditions associated with TPD52L2. Tripartite Motif-containing 34 (TRIM34, Accession NM_021616) is another VGAM1957 host target gene. TRIM34 BINDING SITE1 and TRIM34 BINDING SITE2 are HOST TARGET binding sites found in untranslated regions of mRNA encoded by TRIM34, corresponding to HOST TARGET binding sites such as BINDING SITE I, BINDING SITE II or BINDING SITE III. Table 2 illustrates the complementarity of the nucleotide sequences of TRIM34 BINDING SITE1 and TRIM34 BINDING SITE2, designated SEQ ID:22251 and SEQ ID:28175 respectively, to the nucleotide sequence of VGAM1957 RNA, herein designated VGAM RNA, also designated SEQ ID:4668.

Another function of VGAM1957 is therefore inhibition of Tripartite Motif-containing 34 (TRIM34, Accession NM_021616). Accordingly, utilities of VGAM1957 include diagnosis, prevention and treatment of diseases and clinical conditions associated with TRIM34. Wolf-Hirschhorn Syndrome Candidate 1 (WHSC1, Accession NM_014919) is another VGAM1957 host target gene. WHSC1 BINDING SITE1 through WHSC1 BINDING SITE3 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE3, designated SEQ ID:17177, SEQ ID:28458 and SEQ ID:9448 respectively, to the nucleotide sequence of VGAM1957 RNA, herein designated VGAM RNA, also designated SEQ ID:4668.

Another function of VGAM1957 is therefore inhibition of Wolf-Hirschhorn Syndrome Candidate 1 (WHSC1, Accession NM_014919), a gene which binds covalently to and repairs g/t mismatches. Accordingly, utilities of VGAM1957 include diagnosis, prevention and treatment of diseases and clinical conditions associated with WHSC1. The function of WHSC1 and its association with various diseases and clinical conditions, has been established by previous studies, as described hereinabove with reference to VGAM200. ATPase, Class II, Type 9A (ATP9A, Accession XM_030577) is another VGAM1957 host target gene. ATP9A BINDING SITE is HOST TARGET binding site found in the 3' untranslated region of mRNA encoded by ATP9A, corresponding to a HOST TARGET binding site such as BINDING SITE I, BINDING SITE II or BINDING SITE III. Table 2 illustrates the complementarity of the nucleotide sequences of ATP9A BINDING SITE, designated SEQ ID:31076, to the nucleotide sequence of VGAM1957 RNA, herein designated VGAM RNA, also designated SEQ ID:4668.

Another function of VGAM1957 is therefore inhibition of ATPase, Class II, Type 9A (ATP9A, Accession XM_030577). Accordingly, utilities of VGAM1957 include diagnosis, prevention and treatment of diseases and clinical conditions associated with ATP9A. Bladder Cancer Associated Protein (BLCAP, Accession NM_006698) is another VGAM1957 host target gene. BLCAP BINDING SITE is HOST TARGET binding site found in the 3' untranslated region of mRNA encoded by BLCAP, corresponding to a HOST TARGET binding site such as BINDING SITE I, BINDING SITE II or BINDING SITE III. Table 2 illustrates the complementarity of the nucleotide sequences of BLCAP BINDING SITE, designated SEQ ID:13519, to the nucleotide sequence of VGAM1957 RNA, herein designated VGAM RNA, also designated SEQ ID:4668.

Another function of VGAM1957 is therefore inhibition of Bladder Cancer Associated Protein (BLCAP, Accession NM_006698). Accordingly, utilities of VGAM1957 include diagnosis, prevention and treatment of diseases and clinical conditions associated with BLCAP. Bromodomain Containing 4 (BRD4, Accession NM_058243) is another VGAM1957 host target gene. BRD4 BINDING SITE is HOST TARGET binding site found in the 3' untranslated region of mRNA encoded by BRD4, corresponding to a HOST TARGET binding site such as BINDING SITE I, BINDING SITE II or BINDING SITE III. Table 2 illustrates the complementarity of the nucleotide sequences of BRD4 BINDING SITE, designated SEQ ID:27774, to the nucleotide sequence of VGAM1957 RNA, herein designated VGAM RNA, also designated SEQ ID:4668.

Another function of VGAM1957 is therefore inhibition of Bromodomain Containing 4 (BRD4, Accession NM_058243). Accordingly, utilities of VGAM1957 include diagnosis, prevention and treatment of diseases and clinical conditions associated with BRD4. Catenin, Beta Interacting Protein 1 (CTNNBIP1, Accession NM_020248) is another VGAM1957 host target gene. CTNNBIP1 BINDING SITE is HOST TARGET binding site found in the 3' untranslated region of mRNA encoded by CTNNBIP1, corresponding to a HOST TARGET binding site such as BINDING SITE I, BINDING SITE II or BINDING SITE III. Table 2 illustrates the complementarity of the nucleotide sequences of CTNNBIP1 BINDING SITE, designated SEQ ID:21544, to the nucleotide sequence of VGAM1957 RNA, herein designated VGAM RNA, also designated SEQ ID:4668.

Another function of VGAM1957 is therefore inhibition of Catenin, Beta Interacting Protein 1 (CTNNBIP1, Accession NM_020248). Accordingly, utilities of VGAM1957 include diagnosis, prevention and treatment of diseases and clinical conditions associated with CTNNBIP1. DKFZP566K1924 (Accession XM_057469) is another VGAM1957 host target gene. DKFZP566K1924 BINDING SITE is HOST TARGET binding site found in the 3' untranslated region of mRNA encoded by DKFZP566K1924, corresponding to a HOST TARGET binding site such as BINDING SITE I, BINDING SITE II or BINDING SITE III. Table 2 illustrates the complementarity of the nucleotide sequences of DKFZP566K1924 BINDING SITE, designated SEQ ID:36517, to the nucleotide sequence of VGAM1957 RNA, herein designated VGAM RNA, also designated SEQ ID:4668.

Another function of VGAM1957 is therefore inhibition of DKFZP566K1924 (Accession XM_057469). Accordingly, utilities of VGAM1957 include diagnosis, prevention and treatment of diseases and clinical conditions associated with DKFZP566K1924. DKFZP667O116 (Accession XM_168586) is another VGAM1957 host target gene. DKFZP667O116 BINDING SITE is HOST TARGET binding site found in the 3' untranslated region of mRNA encoded by DKFZP667O116, corresponding to a HOST TARGET binding site such as BINDING SITE I, BINDING SITE II or BINDING SITE III. Table 2 illustrates the complementarity of the nucleotide sequences of DKFZP667O116 BINDING SITE, designated SEQ ID:45265, to the nucleotide sequence of VGAM1957 RNA, herein designated VGAM RNA, also designated SEQ ID:4668.

Another function of VGAM1957 is therefore inhibition of DKFZP667O116 (Accession XM_168586). Accordingly, utilities of VGAM1957 include diagnosis, prevention and treatment of diseases and clinical conditions associated with DKFZP667O116. FBX30 (Accession NM_033182) is another VGAM1957 host target gene. FBX30 BINDING SITE is HOST TARGET binding site found in the 3' untranslated region of mRNA encoded by FBX30, corresponding to a HOST TARGET binding site such as BINDING SITE I, BINDING SITE II or BINDING SITE III. Table 2 illustrates the complementarity of the nucleotide sequences of FBX30 BINDING SITE, designated SEQ ID:27041, to the nucleotide sequence of VGAM1957 RNA, herein designated VGAM RNA, also designated SEQ ID:4668.

Another function of VGAM1957 is therefore inhibition of FBX30 (Accession NM_033182). Accordingly, utilities of VGAM1957 include diagnosis, prevention and treatment of diseases and clinical conditions associated with FBX30. FLJ10079 (Accession XM_012540) is another VGAM1957 host target gene. FLJ10079 BINDING SITE is HOST TARGET binding site found in the 3' untranslated region of mRNA encoded by FLJ10079, corresponding to a HOST TARGET binding site such as BINDING SITE I, BINDING SITE II or BINDING SITE III. Table 2 illustrates the complementarity of the nucleotide sequences of FLJ10079 BINDING SITE, designated SEQ ID:30216, to the nucleotide sequence of VGAM1957 RNA, herein designated VGAM RNA, also designated SEQ ID:4668.

Another function of VGAM1957 is therefore inhibition of FLJ10079 (Accession XM_012540). Accordingly, utilities of VGAM1957 include diagnosis, prevention and treatment of diseases and clinical conditions associated with FLJ10079. FLJ11164 (Accession NM_018346) is another VGAM1957 host target gene. FLJ11164 BINDING SITE is HOST TARGET binding site found in the 3' untranslated region of mRNA encoded by FLJ11164, corresponding to a HOST TARGET binding site such as BINDING SITE I, BINDING SITE II or BINDING SITE III. Table 2 illustrates the complementarity of the nucleotide sequences of FLJ11164 BINDING SITE, designated SEQ ID:20357, to the nucleotide sequence of VGAM1957 RNA, herein designated VGAM RNA, also designated SEQ ID:4668.

Another function of VGAM1957 is therefore inhibition of FLJ11164 (Accession NM_018346). Accordingly, utilities of VGAM1957 include diagnosis, prevention and treatment of diseases and clinical conditions associated with FLJ11164. FLJ11506 (Accession NM_024666) is another VGAM1957 host target gene. FLJ11506 BINDING SITE is HOST TARGET binding site found in the 3' untranslated region of mRNA encoded by FLJ11506, corresponding to a HOST TARGET binding site such as BINDING SITE I, BINDING SITE II or BINDING SITE III. Table 2 illustrates the complementarity of the nucleotide sequences of FLJ11506 BINDING SITE, designated SEQ ID:23969, to the nucleotide sequence of VGAM1957 RNA, herein designated VGAM RNA, also designated SEQ ID:4668.

Another function of VGAM1957 is therefore inhibition of FLJ11506 (Accession NM_024666). Accordingly, utilities of VGAM1957 include diagnosis, prevention and treatment of diseases and clinical conditions associated with FLJ11506. FLJ11715 (Accession NM_024564) is another VGAM1957 host target gene. FLJ11715 BINDING SITE is HOST TARGET binding site found in the 3' untranslated region of mRNA encoded by FLJ11715, corresponding to a HOST TARGET binding site such as BINDING SITE I, BINDING SITE II or BINDING SITE III. Table 2 illustrates the complementarity of the nucleotide sequences of FLJ11715 BIND- ING SITE, designated SEQ ID:23788, to the nucleotide sequence of VGAM1957 RNA, herein designated VGAM RNA, also designated SEQ ID:4668.

Another function of VGAM1957 is therefore inhibition of FLJ11715 (Accession NM_024564). Accordingly, utilities of VGAM1957 include diagnosis, prevention and treatment of diseases and clinical conditions associated with FLJ11715.

FLJ12783 (Accession NM_031426) is another VGAM1957 host target gene. FLJ12783 BINDING SITE is HOST TARGET binding site found in the 3' untranslated region of mRNA encoded by FLJ12783, corresponding to a HOST TARGET binding site such as BINDING SITE I, BINDING SITE II or BINDING SITE III. Table 2 illustrates the complementarity of the nucleotide sequences of FLJ12783 BINDING SITE, designated SEQ ID:25419, to the nucleotide sequence of VGAM1957 RNA, herein designated VGAM RNA, also designated SEQ ID:4668.

Another function of VGAM1957 is therefore inhibition of FLJ12783 (Accession NM_031426). Accordingly, utilities of VGAM1957 include diagnosis, prevention and treatment of diseases and clinical conditions associated with FLJ12783.

FLJ14146 (Accession NM_024709) is another VGAM1957 host target gene. FLJ14146 BINDING SITE is HOST TARGET binding site found in the 3' untranslated region of mRNA encoded by FLJ14146, corresponding to a HOST TARGET binding site such as BINDING SITE I, BINDING SITE II or BINDING SITE III. Table 2 illustrates the complementarity of the nucleotide sequences of FLJ14146 BINDING SITE, designated SEQ ID:24030, to the nucleotide sequence of VGAM1957 RNA, herein designated VGAM RNA, also designated SEQ ID:4668.

Another function of VGAM1957 is therefore inhibition of FLJ14146 (Accession NM_024709). Accordingly, utilities of VGAM1957 include diagnosis, prevention and treatment of diseases and clinical conditions associated with FLJ14146.

FLJ20034 (Accession NM_017630) is another VGAM1957 host target gene. FLJ20034 BINDING SITE1 and FLJ20034 BINDING SITE2 are HOST TARGET binding sites found in untranslated regions of mRNA encoded by FLJ20034, corresponding to HOST TARGET binding sites such as BINDING SITE I, BINDING SITE II or BINDING SITE III. Table 2 illustrates the complementarity of the nucleotide sequences of FLJ20034 BINDING SITE1 and FLJ20034 BINDING SITE2, designated SEQ ID:19135 and SEQ ID:19136 respectively, to the nucleotide sequence of VGAM1957 RNA, herein designated VGAM RNA, also designated SEQ ID:4668.

Another function of VGAM1957 is therefore inhibition of FLJ20034 (Accession NM_017630). Accordingly, utilities of VGAM1957 include diagnosis, prevention and treatment of diseases and clinical conditions associated with FLJ20034.

FLJ20312 (Accession NM_017761) is another VGAM1957 host target gene. FLJ20312 BINDING SITE is HOST TARGET binding site found in the 3' untranslated region of mRNA encoded by FLJ20312, corresponding to a HOST TARGET binding site such as BINDING SITE I, BINDING SITE II or BINDING SITE III. Table 2 illustrates the complementarity of the nucleotide sequences of FLJ20312 BINDING SITE, designated SEQ ID:19374, to the nucleotide sequence of VGAM1957 RNA, herein designated VGAM RNA, also designated SEQ ID:4668.

Another function of VGAM1957 is therefore inhibition of FLJ20312 (Accession NM_017761). Accordingly, utilities of VGAM1957 include diagnosis, prevention and treatment of diseases and clinical conditions associated with FLJ20312.

FLJ20378 (Accession NM_017795) is another VGAM1957 host target gene. FLJ20378 BINDING SITE is HOST TARGET binding site found in the 3' untranslated region of mRNA encoded by FLJ20378, corresponding to a HOST TARGET binding site such as BINDING SITE I, BINDING SITE II or BINDING SITE III. Table 2 illustrates the complementarity of the nucleotide sequences of FLJ20378 BINDING SITE, designated SEQ ID:19437, to the nucleotide sequence of VGAM1957 RNA, herein designated VGAM RNA, also designated SEQ ID:4668.

Another function of VGAM1957 is therefore inhibition of FLJ20378 (Accession NM_017795). Accordingly, utilities of VGAM1957 include diagnosis, prevention and treatment of diseases and clinical conditions associated with FLJ20378.

FLJ20400 (Accession XM_039306) is another VGAM1957 host target gene. FLJ20400 BINDING SITE is HOST TARGET binding site found in the 3' untranslated region of mRNA encoded by FLJ20400, corresponding to a HOST TARGET binding site such as BINDING SITE I, BINDING SITE II or BINDING SITE III. Table 2 illustrates the complementarity of the nucleotide sequences of FLJ20400 BINDING SITE, designated SEQ ID:33046, to the nucleotide sequence of VGAM1957 RNA, herein designated VGAM RNA, also designated SEQ ID:4668.

Another function of VGAM1957 is therefore inhibition of FLJ20400 (Accession XM_039306). Accordingly, utilities of VGAM1957 include diagnosis, prevention and treatment of diseases and clinical conditions associated with FLJ20400.

FLJ20574 (Accession NM_017886) is another VGAM1957 host target gene. FLJ20574 BINDING SITE is HOST TARGET binding site found in the 3' untranslated region of mRNA encoded by FLJ20574, corresponding to a HOST TARGET binding site such as BINDING SITE I, BINDING SITE II or BINDING SITE III. Table 2 illustrates the complementarity of the nucleotide sequences of FLJ20574 BINDING SITE, designated SEQ ID:19555, to the nucleotide sequence of VGAM1957 RNA, herein designated VGAM RNA, also designated SEQ ID:4668.

Another function of VGAM1957 is therefore inhibition of FLJ20574 (Accession NM_017886). Accordingly, utilities of VGAM1957 include diagnosis, prevention and treatment of diseases and clinical conditions associated with FLJ20574.

FLJ22833 (Accession NM_022837) is another VGAM1957 host target gene. FLJ22833 BINDING SITE is HOST TARGET binding site found in the 3' untranslated region of mRNA encoded by FLJ22833, corresponding to a HOST TARGET binding site such as BINDING SITE I, BINDING SITE II or BINDING SITE III. Table 2 illustrates the complementarity of the nucleotide sequences of FLJ22833 BINDING SITE, designated SEQ ID:23122, to the nucleotide sequence of VGAM1957 RNA, herein designated VGAM RNA, also designated SEQ ID:4668.

Another function of VGAM1957 is therefore inhibition of FLJ22833 (Accession NM_022837). Accordingly, utilities of VGAM1957 include diagnosis, prevention and treatment of diseases and clinical conditions associated with FLJ22833.

FLJ23277 (Accession NM_032236) is another VGAM1957 host target gene. FLJ23277 BINDING SITE is HOST TARGET binding site found in the 3' untranslated region of mRNA encoded by FLJ23277, corresponding to a HOST TARGET binding site such as BINDING SITE I, BINDING SITE II or BINDING SITE III. Table 2 illustrates the complementarity of the nucleotide sequences of FLJ23277 BINDING SITE, designated SEQ ID:25955, to the nucleotide sequence of VGAM1957 RNA, herein designated VGAM RNA, also designated SEQ ID:4668.

Another function of VGAM1957 is therefore inhibition of FLJ23277 (Accession NM_032236). Accordingly, utilities of VGAM1957 include diagnosis, prevention and treatment of diseases and clinical conditions associated with FLJ23277. Glucocorticoid Modulatory Element Binding Protein 2 (GMEB2, Accession NM_012384) is another VGAM1957 host target gene. GMEB2 BINDING SITE is HOST TARGET binding site found in the 3' untranslated region of mRNA encoded by GMEB2, corresponding to a HOST TARGET binding site such as BINDING SITE I, BINDING SITE II or BINDING SITE III. Table 2 illustrates the complementarity of the nucleotide sequences of GMEB2 BINDING SITE, designated SEQ ID:14739, to the nucleotide sequence of VGAM1957 RNA, herein designated VGAM RNA, also designated SEQ ID:4668.

Another function of VGAM1957 is therefore inhibition of Glucocorticoid Modulatory Element Binding Protein 2 (GMEB2, Accession NM_012384). Accordingly, utilities of VGAM1957 include diagnosis, prevention and treatment of diseases and clinical conditions associated with GMEB2. G Protein Pathway Suppressor 2 (GPS2, Accession NM_004489) is another VGAM1957 host target gene. GPS2 BINDING SITE is HOST TARGET binding site found in the 5' untranslated region of mRNA encoded by GPS2, corresponding to a HOST TARGET binding site such as BINDING SITE I, BINDING SITE II or BINDING SITE III. Table 2 illustrates the complementarity of the nucleotide sequences of GPS2 BINDING SITE, designated SEQ ID:10827, to the nucleotide sequence of VGAM1957 RNA, herein designated VGAM RNA, also designated SEQ ID:4668.

Another function of VGAM1957 is therefore inhibition of G Protein Pathway Suppressor 2 (GPS2, Accession NM_004489). Accordingly, utilities of VGAM1957 include diagnosis, prevention and treatment of diseases and clinical conditions associated with GPS2. HSGP25L2G (Accession XM_030771) is another VGAM1957 host target gene. HSGP25L2G BINDING SITE is HOST TARGET binding site found in the 3' untranslated region of mRNA encoded by HSGP25L2G, corresponding to a HOST TARGET binding site such as BINDING SITE I, BINDING SITE II or BINDING SITE III. Table 2 illustrates the complementarity of the nucleotide sequences of HSGP25L2G BINDING SITE, designated SEQ ID:31135, to the nucleotide sequence of VGAM1957 RNA, herein designated VGAM RNA, also designated SEQ ID:4668.

Another function of VGAM1957 is therefore inhibition of HSGP25L2G (Accession XM_030771). Accordingly, utilities of VGAM1957 include diagnosis, prevention and treatment of diseases and clinical conditions associated with HSGP25L2G. KIAA0082 (Accession XM_166400) is another VGAM1957 host target gene. KIAA0082 BINDING SITE is HOST TARGET binding site found in the 3' untranslated region of mRNA encoded by KIAA0082, corresponding to a HOST TARGET binding site such as BINDING SITE I, BINDING SITE II or BINDING SITE III. Table 2 illustrates the complementarity of the nucleotide sequences of KIAA0082 BINDING SITE, designated SEQ ID:44262, to the nucleotide sequence of VGAM1957 RNA, herein designated VGAM RNA, also designated SEQ ID:4668.

Another function of VGAM1957 is therefore inhibition of KIAA0082 (Accession XM_166400). Accordingly, utilities of VGAM1957 include diagnosis, prevention and treatment of diseases and clinical conditions associated with KIAA0082. KIAA0092 (Accession NM_014679) is another VGAM1957 host target gene. KIAA0092 BINDING SITE is HOST TARGET binding site found in the 3' untranslated region of mRNA encoded by KIAA0092, corresponding to a HOST TARGET binding site such as BINDING SITE I, BINDING SITE II or BINDING SITE III. Table 2 illustrates the complementarity of the nucleotide sequences of KIAA0092 BINDING SITE, designated SEQ ID:16155, to the nucleotide sequence of VGAM1957 RNA, herein designated VGAM RNA, also designated SEQ ID:4668.

Another function of VGAM1957 is therefore inhibition of KIAA0092 (Accession NM_014679). Accordingly, utilities of VGAM1957 include diagnosis, prevention and treatment of diseases and clinical conditions associated with KIAA0092. KIAA0232 (Accession XM_052627) is another VGAM1957 host target gene. KIAA0232 BINDING SITE is HOST TARGET binding site found in the 3' untranslated region of mRNA encoded by KIAA0232, corresponding to a HOST TARGET binding site such as BINDING SITE I, BINDING SITE II or BINDING SITE III. Table 2 illustrates the complementarity of the nucleotide sequences of KIAA0232 BINDING SITE, designated SEQ ID:36037, to the nucleotide sequence of VGAM1957 RNA, herein designated VGAM RNA, also designated SEQ ID:4668.

Another function of VGAM1957 is therefore inhibition of KIAA0232 (Accession XM_052627). Accordingly, utilities of VGAM1957 include diagnosis, prevention and treatment of diseases and clinical conditions associated with KIAA0232. KIAA0275 (Accession NM_014767) is another VGAM1957 host target gene. KIAA0275 BINDING SITE is HOST TARGET binding site found in the 3' untranslated region of mRNA encoded by KIAA0275, corresponding to a HOST TARGET binding site such as BINDING SITE I, BINDING SITE II or BINDING SITE III. Table 2 illustrates the complementarity of the nucleotide sequences of KIAA0275 BINDING SITE, designated SEQ ID:16554, to the nucleotide sequence of VGAM1957 RNA, herein designated VGAM RNA, also designated SEQ ID:4668.

Another function of VGAM1957 is therefore inhibition of KIAA0275 (Accession NM_014767). Accordingly, utilities of VGAM1957 include diagnosis, prevention and treatment of diseases and clinical conditions associated with KIAA0275. KIAA0321 (Accession XM_031077) is another VGAM1957 host target gene. KIAA0321 BINDING SITE is HOST TARGET binding site found in the 3' untranslated region of mRNA encoded by KIAA0321, corresponding to a HOST TARGET binding site such as BINDING SITE I, BINDING SITE II or BINDING SITE III. Table 2 illustrates the complementarity of the nucleotide sequences of KIAA0321 BINDING SITE, designated SEQ ID:31270, to the nucleotide sequence of VGAM1957 RNA, herein designated VGAM RNA, also designated SEQ ID:4668.

Another function of VGAM1957 is therefore inhibition of KIAA0321 (Accession XM_031077). Accordingly, utilities of VGAM1957 include diagnosis, prevention and treatment of diseases and clinical conditions associated with KIAA0321. KIAA0418 (Accession NM_014631) is another VGAM1957 host target gene. KIAA0418 BINDING SITE is HOST TARGET binding site found in the 3' untranslated region of mRNA encoded by KIAA0418, corresponding to a HOST TARGET binding site such as BINDING SITE I, BINDING SITE II or BINDING SITE III. Table 2 illustrates the complementarity of the nucleotide sequences of KIAA0418 BINDING SITE, designated SEQ ID:15995, to the nucleotide sequence of VGAM1957 RNA, herein designated VGAM RNA, also designated SEQ ID:4668.

Another function of VGAM1957 is therefore inhibition of KIAA0418 (Accession NM_014631). Accordingly, utilities of VGAM1957 include diagnosis, prevention and treatment of diseases and clinical conditions associated with KIAA0418. KIAA0427 (Accession NM_014772) is another VGAM1957 host target gene. KIAA0427 BINDING SITE is HOST TARGET binding site found in the 3' untranslated region of mRNA encoded by KIAA0427, corresponding to a HOST TARGET binding site such as BINDING SITE I, BINDING SITE II or BINDING SITE III. Table 2 illustrates the complementarity of the nucleotide sequences of KIAA0427 BINDING SITE, designated SEQ ID:16580, to the nucleotide sequence of VGAM1957 RNA, herein designated VGAM RNA, also designated SEQ ID:4668.

Another function of VGAM1957 is therefore inhibition of KIAA0427 (Accession NM_014772). Accordingly, utilities of VGAM1957 include diagnosis, prevention and treatment of diseases and clinical conditions associated with KIAA0427. KIAA0478 (Accession NM_014870) is another VGAM1957 host target gene. KIAA0478 BINDING SITE is HOST TARGET binding site found in the 3' untranslated region of mRNA encoded by KIAA0478, corresponding to a HOST TARGET binding site such as BINDING SITE I, BINDING SITE II or BINDING SITE III. Table 2 illustrates the complementarity of the nucleotide sequences of KIAA0478 BINDING SITE, designated SEQ ID:16983, to the nucleotide sequence of VGAM1957 RNA, herein designated VGAM RNA, also designated SEQ ID:4668.

Another function of VGAM1957 is therefore inhibition of KIAA0478 (Accession NM_014870). Accordingly, utilities of VGAM1957 include diagnosis, prevention and treatment of diseases and clinical conditions associated with KIAA0478. KIAA0522 (Accession XM_050404) is another VGAM1957 host target gene. KIAA0522 BINDING SITE is HOST TARGET binding site found in the 3' untranslated region of mRNA encoded by KIAA0522, corresponding to a HOST TARGET binding site such as BINDING SITE I, BINDING SITE II or BINDING SITE III. Table 2 illustrates the complementarity of the nucleotide sequences of KIAA0522 BINDING SITE, designated SEQ ID:35625, to the nucleotide sequence of VGAM1957 RNA, herein designated VGAM RNA, also designated SEQ ID:4668.

Another function of VGAM1957 is therefore inhibition of KIAA0522 (Accession XM_050404). Accordingly, utilities of VGAM1957 include diagnosis, prevention and treatment of diseases and clinical conditions associated with KIAA0522. KIAA0537 (Accession NM_014840) is another VGAM1957 host target gene. KIAA0537 BINDING SITE is HOST TARGET binding site found in the 3' untranslated region of mRNA encoded by KIAA0537, corresponding to a HOST TARGET binding site such as BINDING SITE I, BINDING SITE II or BINDING SITE III. Table 2 illustrates the complementarity of the nucleotide sequences of KIAA0537 BINDING SITE, designated SEQ ID:16862, to the nucleotide sequence of VGAM1957 RNA, herein designated VGAM RNA, also designated SEQ ID:4668.

Another function of VGAM1957 is therefore inhibition of KIAA0537 (Accession NM_014840). Accordingly, utilities of VGAM1957 include diagnosis, prevention and treatment of diseases and clinical conditions associated with KIAA0537. KIAA0652 (Accession NM_014741) is another VGAM1957 host target gene. KIAA0652 BINDING SITE is HOST TARGET binding site found in the 3' untranslated region of mRNA encoded by KIAA0652, corresponding to a HOST TARGET binding site such as BINDING SITE I, BINDING SITE II or BINDING SITE III. Table 2 illustrates the complementarity of the nucleotide sequences of KIAA0652 BINDING SITE, designated SEQ ID:16406, to the nucleotide sequence of VGAM1957 RNA, herein designated VGAM RNA, also designated SEQ ID:4668.

Another function of VGAM1957 is therefore inhibition of KIAA0652 (Accession NM_014741). Accordingly, utilities of VGAM1957 include diagnosis, prevention and treatment of diseases and clinical conditions associated with KIAA0652. KIAA1274 (Accession XM_166125) is another VGAM1957 host target gene. KIAA1274 BINDING SITE is HOST TARGET binding site found in the 3' untranslated region of mRNA encoded by KIAA1274, corresponding to a HOST TARGET binding site such as BINDING SITE I, BINDING SITE II or BINDING SITE III. Table 2 illustrates the complementarity of the nucleotide sequences of KIAA1274 BINDING SITE, designated SEQ ID:43913, to the nucleotide sequence of VGAM1957 RNA, herein designated VGAM RNA, also designated SEQ ID:4668.

Another function of VGAM1957 is therefore inhibition of KIAA1274 (Accession XM_166125). Accordingly, utilities of VGAM1957 include diagnosis, prevention and treatment of diseases and clinical conditions associated with KIAA1274. KIAA1297 (Accession XM_051005) is another VGAM1957 host target gene. KIAA1297 BINDING SITE is HOST TARGET binding site found in the 3' untranslated region of mRNA encoded by KIAA1297, corresponding to a HOST TARGET binding site such as BINDING SITE I, BINDING SITE II or BINDING SITE III. Table 2 illustrates the complementarity of the nucleotide sequences of KIAA1297 BINDING SITE, designated SEQ ID:35707, to the nucleotide sequence of VGAM1957 RNA, herein designated VGAM RNA, also designated SEQ ID:4668.

Another function of VGAM1957 is therefore inhibition of KIAA1297 (Accession XM_051005). Accordingly, utilities of VGAM1957 include diagnosis, prevention and treatment of diseases and clinical conditions associated with KIAA1297. KIAA1522 (Accession XM_036299) is another VGAM1957 host target gene. KIAA1522 BINDING SITE is HOST TARGET binding site found in the 3' untranslated region of mRNA encoded by KIAA1522, corresponding to a HOST TARGET binding site such as BINDING SITE I, BINDING SITE II or BINDING SITE III. Table 2 illustrates the complementarity of the nucleotide sequences of KIAA1522 BINDING SITE, designated SEQ ID:32419, to the nucleotide sequence of VGAM1957 RNA, herein designated VGAM RNA, also designated SEQ ID:4668.

Another function of VGAM1957 is therefore inhibition of KIAA1522 (Accession XM_036299). Accordingly, utilities of VGAM1957 include diagnosis, prevention and treatment of diseases and clinical conditions associated with KIAA1522. KIAA1560 (Accession XM_034422) is another VGAM1957 host target gene. KIAA1560 BINDING SITE is HOST TARGET binding site found in the 3' untranslated region of mRNA encoded by KIAA1560, corresponding to a HOST TARGET binding site such as BINDING SITE I, BINDING SITE II or BINDING SITE III. Table 2 illustrates the complementarity of the nucleotide sequences of KIAA1560 BINDING SITE, designated SEQ ID:32104, to the nucleotide sequence of VGAM1957 RNA, herein designated VGAM RNA, also designated SEQ ID:4668.

Another function of VGAM1957 is therefore inhibition of KIAA1560 (Accession XM_034422). Accordingly, utilities of VGAM1957 include diagnosis, prevention and treatment of diseases and clinical conditions associated with KIAA1560. KIAA1580 (Accession XM_045271) is another VGAM1957 host target gene. KIAA1580 BINDING SITE is HOST TARGET binding site found in the 5' untranslated region of mRNA encoded by KIAA1580, corresponding to a HOST TARGET binding site such as BINDING SITE I, BINDING SITE II or BINDING SITE III. Table 2 illustrates the complementarity of the nucleotide sequences of KIAA1580 BINDING SITE, designated SEQ ID:34408, to the nucleotide sequence of VGAM1957 RNA, herein designated VGAM RNA, also designated SEQ ID:4668.

Another function of VGAM1957 is therefore inhibition of KIAA1580 (Accession XM_045271). Accordingly, utilities of VGAM1957 include diagnosis, prevention and treatment of diseases and clinical conditions associated with KIAA1580. KIAA1649 (Accession XM_040095) is another VGAM1957 host target gene. KIAA1649 BINDING SITE is HOST TARGET binding site found in the 3' untranslated region of mRNA encoded by KIAA1649, corresponding to a HOST TARGET binding site such as BINDING SITE I, BINDING SITE II or BINDING SITE III. Table 2 illustrates the complementarity of the nucleotide sequences of KIAA1649 BINDING SITE, designated SEQ ID:33258, to the nucleotide sequence of VGAM1957 RNA, herein designated VGAM RNA, also designated SEQ ID:4668.

Another function of VGAM1957 is therefore inhibition of KIAA1649 (Accession XM_040095). Accordingly, utilities of VGAM1957 include diagnosis, prevention and treatment of diseases and clinical conditions associated with KIAA1649. KIAA1691 (Accession XM_166523) is another VGAM1957 host target gene. KIAA1691 BINDING SITE is HOST TARGET binding site found in the 3' untranslated region of mRNA encoded by KIAA1691, corresponding to a HOST TARGET binding site such as BINDING SITE I, BINDING SITE II or BINDING SITE III. Table 2 illustrates the complementarity of the nucleotide sequences of KIAA1691 BINDING SITE, designated SEQ ID:44462, to the nucleotide sequence of VGAM1957 RNA, herein designated VGAM RNA, also designated SEQ ID:4668.

Another function of VGAM1957 is therefore inhibition of KIAA1691 (Accession XM_166523). Accordingly, utilities of VGAM1957 include diagnosis, prevention and treatment of diseases and clinical conditions associated with KIAA1691. KIAA1826 (Accession XM_040784) is another VGAM1957 host target gene. KIAA1826 BINDING SITE is HOST TARGET binding site found in the 3' untranslated region of mRNA encoded by KIAA1826, corresponding to a HOST TARGET binding site such as BINDING SITE I, BINDING SITE II or BINDING SITE III. Table 2 illustrates the complementarity of the nucleotide sequences of KIAA1826 BINDING SITE, designated SEQ ID:33377, to the nucleotide sequence of VGAM1957 RNA, herein designated VGAM RNA, also designated SEQ ID:4668.

Another function of VGAM1957 is therefore inhibition of KIAA1826 (Accession XM_040784). Accordingly, utilities of VGAM1957 include diagnosis, prevention and treatment of diseases and clinical conditions associated with KIAA1826. KIAA1831 (Accession XM_033366) is another VGAM1957 host target gene. KIAA1831 BINDING SITE is HOST TARGET binding site found in the 3' untranslated region of mRNA encoded by KIAA1831, corresponding to a HOST TARGET binding site such as BINDING SITE I, BINDING SITE II or BINDING SITE III. Table 2 illustrates the complementarity of the nucleotide sequences of KIAA1831 BINDING SITE, designated SEQ ID:31906, to the nucleotide sequence of VGAM1957 RNA, herein designated VGAM RNA, also designated SEQ ID:4668.

Another function of VGAM1957 is therefore inhibition of KIAA1831 (Accession XM_033366). Accordingly, utilities of VGAM1957 include diagnosis, prevention and treatment of diseases and clinical conditions associated with KIAA1831. MGC3248 (Accession NM_032486) is another VGAM1957 host target gene. MGC3248 BINDING SITE is HOST TARGET binding site found in the 3' untranslated region of mRNA encoded by MGC3248, corresponding to a HOST TARGET binding site such as BINDING SITE I, BINDING SITE II or BINDING SITE III. Table 2 illustrates the complementarity of the nucleotide sequences of MGC3248 BINDING SITE, designated SEQ ID:26240, to the nucleotide sequence of VGAM1957 RNA, herein designated VGAM RNA, also designated SEQ ID:4668.

Another function of VGAM1957 is therefore inhibition of MGC3248 (Accession NM_032486). Accordingly, utilities of VGAM1957 include diagnosis, prevention and treatment of diseases and clinical conditions associated with MGC3248. MGC4549 (Accession NM_032377) is another VGAM1957 host target gene. MGC4549 BINDING SITE is HOST TARGET binding site found in the 3' untranslated region of mRNA encoded by MGC4549, corresponding to a HOST TARGET binding site such as BINDING SITE I, BINDING SITE II or BINDING SITE III. Table 2 illustrates the complementarity of the nucleotide sequences of MGC4549 BINDING SITE, designated SEQ ID:26172, to the nucleotide sequence of VGAM1957 RNA, herein designated VGAM RNA, also designated SEQ ID:4668.

Another function of VGAM1957 is therefore inhibition of MGC4549 (Accession NM_032377). Accordingly, utilities of VGAM1957 include diagnosis, prevention and treatment of diseases and clinical conditions associated with MGC4549. MGC4655 (Accession NM_033309) is another VGAM1957 host target gene. MGC4655 BINDING SITE is HOST TARGET binding site found in the 3' untranslated region of mRNA encoded by MGC4655, corresponding to a HOST TARGET binding site such as BINDING SITE I, BINDING SITE II or BINDING SITE III. Table 2 illustrates the complementarity of the nucleotide sequences of MGC4655 BINDING SITE, designated SEQ ID:27146, to the nucleotide sequence of VGAM1957 RNA, herein designated VGAM RNA, also designated SEQ ID:4668.

Another function of VGAM1957 is therefore inhibition of MGC4655 (Accession NM_033309). Accordingly, utilities of VGAM1957 include diagnosis, prevention and treatment of diseases and clinical conditions associated with MGC4655. N4BP3 (Accession XM_038920) is another VGAM1957 host target gene. N4BP3 BINDING SITE is HOST TARGET binding site found in the 3' untranslated region of mRNA encoded by N4BP3, corresponding to a HOST TARGET binding site such as BINDING SITE I, BINDING SITE II or BINDING SITE III. Table 2 illustrates the complementarity of the nucleotide sequences of N4BP3 BINDING SITE, designated SEQ ID:32937, to the nucleotide sequence of VGAM1957 RNA, herein designated VGAM RNA, also designated SEQ ID:4668.

Another function of VGAM1957 is therefore inhibition of N4BP3 (Accession XM_038920). Accordingly, utilities of VGAM1957 include diagnosis, prevention and treatment of diseases and clinical conditions associated with N4BP3. poly (A) Polymerase Gamma (PAPOLG, Accession NM_022894) is another VGAM1957 host target gene. PAPOLG BINDING SITE is HOST TARGET binding site found in the 5' untranslated region of mRNA encoded by PAPOLG, corresponding to a HOST TARGET binding site such as BINDING SITE I, BINDING SITE II or BINDING SITE III. Table 2 illustrates the complementarity of the nucleotide sequences of PAPOLG BINDING SITE, designated SEQ ID:23154, to the nucleotide sequence of VGAM1957 RNA, herein designated VGAM RNA, also designated SEQ ID:4668.

Another function of VGAM1957 is therefore inhibition of poly (A) Polymerase Gamma (PAPOLG, Accession NM_022894). Accordingly, utilities of VGAM1957 include diagnosis, prevention and treatment of diseases and clinical conditions associated with PAPOLG. PR Domain Containing 10 (PRDM10, Accession NM_020228) is another VGAM1957 host target gene. PRDM10 BINDING SITE is HOST TARGET binding site found in the 3' untranslated region of mRNA encoded by PRDM10, corresponding to a HOST TARGET binding site such as BINDING SITE I, BINDING SITE II or BINDING SITE III. Table 2 illustrates the complementarity of the nucleotide sequences of PRDM10 BINDING SITE, designated SEQ ID:21497, to the nucleotide sequence of VGAM1957 RNA, herein designated VGAM RNA, also designated SEQ ID:4668.

Another function of VGAM1957 is therefore inhibition of PR Domain Containing 10 (PRDM10, Accession NM_020228). Accordingly, utilities of VGAM1957 include diagnosis, prevention and treatment of diseases and clinical conditions associated with PRDM10. PRTD-NY3 (Accession NM_030924) is another VGAM1957 host target gene. PRTD-NY3 BINDING SITE is HOST TARGET binding site found in the 5' untranslated region of mRNA encoded by PRTD-NY3, corresponding to a HOST TARGET binding site such as BINDING SITE I, BINDING SITE II or BINDING SITE III. Table 2 illustrates the complementarity of the nucleotide sequences of PRTD-NY3 BINDING SITE, designated SEQ ID:25194, to the nucleotide sequence of VGAM1957 RNA, herein designated VGAM RNA, also designated SEQ ID:4668.

Another function of VGAM1957 is therefore inhibition of PRTD-NY3 (Accession NM_030924). Accordingly, utilities of VGAM1957 include diagnosis, prevention and treatment of diseases and clinical conditions associated with PRTD-NY3. RAB10, Member RAS Oncogene Family (RAB10, Accession XM_097979) is another VGAM1957 host target gene. RAB10 BINDING SITE is HOST TARGET binding site found in the 3' untranslated region of mRNA encoded by RAB10, corresponding to a HOST TARGET binding site such as BINDING SITE I, BINDING SITE II or BINDING SITE III. Table 2 illustrates the complementarity of the nucleotide sequences of RAB10 BINDING SITE, designated SEQ ID:41281, to the nucleotide sequence of VGAM1957 RNA, herein designated VGAM RNA, also designated SEQ ID:4668.

Another function of VGAM1957 is therefore inhibition of RAB10, Member RAS Oncogene Family (RAB10, Accession XM_097979). Accordingly, utilities of VGAM1957 include diagnosis, prevention and treatment of diseases and clinical conditions associated with RAB10. RAS Protein Activator Like 2 (RASAL2, Accession NM_004841) is another VGAM1957 host target gene. RASAL2 BINDING SITE is HOST TARGET binding site found in the 3' untranslated region of mRNA encoded by RASAL2, corresponding to a HOST TARGET binding site such as BINDING SITE I, BINDING SITE II or BINDING SITE III. Table 2 illustrates the complementarity of the nucleotide sequences of RASAL2 BINDING SITE, designated SEQ ID:11250, to the nucleotide sequence of VGAM1957 RNA, herein designated VGAM RNA, also designated SEQ ID:4668.

Another function of VGAM1957 is therefore inhibition of RAS Protein Activator Like 2 (RASAL2, Accession NM_004841). Accordingly, utilities of VGAM1957 include diagnosis, prevention and treatment of diseases and clinical conditions associated with RASAL2. RAS Guanyl Releasing Protein 4 (RASGRP4, Accession NM_052949) is another VGAM1957 host target gene. RASGRP4 BINDING SITE is HOST TARGET binding site found in the 5' untranslated region of mRNA encoded by RASGRP4, corresponding to a HOST TARGET binding site such as BINDING SITE I, BINDING SITE II or BINDING SITE III. Table 2 illustrates the complementarity of the nucleotide sequences of RASGRP4 BINDING SITE, designated SEQ ID:27505, to the nucleotide sequence of VGAM1957 RNA, herein designated VGAM RNA, also designated SEQ ID:4668.

Another function of VGAM1957 is therefore inhibition of RAS Guanyl Releasing Protein 4 (RASGRP4, Accession NM_052949). Accordingly, utilities of VGAM1957 include diagnosis, prevention and treatment of diseases and clinical conditions associated with RASGRP4. RNA Binding Protein S1, Serine-rich Domain (RNPS1, Accession NM_080594) is another VGAM1957 host target gene. RNPS1 BINDING SITE1 and RNPS1 BINDING SITE2 are HOST TARGET binding sites found in untranslated regions of mRNA encoded by RNPS1, corresponding to HOST TARGET binding sites such as BINDING SITE I, BINDING SITE II or BINDING SITE III. Table 2 illustrates the complementarity of the nucleotide sequences of RNPS1 BINDING SITE1 and RNPS1 BINDING SITE2, designated SEQ ID:27902 and SEQ ID:13537 respectively, to the nucleotide sequence of VGAM1957 RNA, herein designated VGAM RNA, also designated SEQ ID:4668.

Another function of VGAM1957 is therefore inhibition of RNA Binding Protein S1, Serine-rich Domain (RNPS1, Accession NM_080594). Accordingly, utilities of VGAM1957 include diagnosis, prevention and treatment of diseases and clinical conditions associated with RNPS1. Sema Domain, Immunoglobulin Domain (Ig), Short Basic Domain, Secreted, (semaphorin) 3E (SEMA3E, Accession NM_012431) is another VGAM1957 host target gene. SEMA3E BINDING SITE is HOST TARGET binding site found in the 3' untranslated region of mRNA encoded by SEMA3E, corresponding to a HOST TARGET binding site such as BINDING SITE I, BINDING SITE II or BINDING SITE III. Table 2 illustrates the complementarity of the nucleotide sequences of SEMA3E BINDING SITE, designated SEQ ID:14808, to the nucleotide sequence of VGAM1957 RNA, herein designated VGAM RNA, also designated SEQ ID:4668.

Another function of VGAM1957 is therefore inhibition of Sema Domain, Immunoglobulin Domain (Ig), Short Basic Domain, Secreted, (semaphorin) 3E (SEMA3E, Accession NM_012431). Accordingly, utilities of VGAM1957 include diagnosis, prevention and treatment of diseases and clinical conditions associated with SEMA3E. Sialyltransferase 8A (alpha-N-acetylneuraminate: alpha-2,8-sialytransferase, GD3 synthase) (SIAT8A, Accession NM_003034) is another VGAM1957 host target gene. SIAT8A BINDING SITE is HOST TARGET binding site found in the 5' untranslated region of mRNA encoded by SIAT8A, corresponding to a HOST TARGET binding site such as BINDING SITE I, BINDING SITE II or BINDING SITE III. Table 2 illustrates the complementarity of the nucleotide sequences of SIAT8A BINDING SITE, designated SEQ ID:8983, to the nucleotide sequence of VGAM1957 RNA, herein designated VGAM RNA, also designated SEQ ID:4668.

Another function of VGAM1957 is therefore inhibition of Sialyltransferase 8A (alpha-N-acetylneuraminate: alpha-2,8-sialytransferase, GD3 synthase) (SIAT8A, Accession NM_003034). Accordingly, utilities of VGAM1957 include diagnosis, prevention and treatment of diseases and clinical conditions associated with SIAT8A. Serum Response Factor (c-fos serum response element-binding transcription factor) (SRF, Accession NM_003131) is another VGAM1957 host target gene. SRF BINDING SITE is HOST TARGET binding site found in the 3' untranslated region of mRNA encoded by SRF, corresponding to a HOST TARGET binding site such as BINDING SITE I, BINDING SITE II or BINDING SITE III. Table 2 illustrates the complementarity of the nucleotide sequences of SRF BINDING SITE, designated SEQ ID:9103, to the nucleotide sequence of VGAM1957 RNA, herein designated VGAM RNA, also designated SEQ ID:4668.

Another function of VGAM1957 is therefore inhibition of Serum Response Factor (c-fos serum response element-binding transcription factor) (SRF, Accession NM_003131). Accordingly, utilities of VGAM1957 include diagnosis, prevention and treatment of diseases and clinical conditions associated with SRF. Serine/threonine Kinase 38 Like (STK38L, Accession XM_044823) is another VGAM1957 host target gene. STK38L BINDING SITE is HOST TARGET binding site found in the 3' untranslated region of mRNA encoded by STK38L, corresponding to a HOST TARGET binding site such as BINDING SITE I, BINDING SITE II or BINDING SITE III. Table 2 illustrates the complementarity of the nucleotide sequences of STK38L BINDING SITE, designated SEQ ID:34286, to the nucleotide sequence of VGAM1957 RNA, herein designated VGAM RNA, also designated SEQ ID:4668.

Another function of VGAM1957 is therefore inhibition of Serine/threonine Kinase 38 Like (STK38L, Accession XM_044823). Accordingly, utilities of VGAM1957 include diagnosis, prevention and treatment of diseases and clinical conditions associated with STK38L. Sulfotransferase Family, Cytosolic, 1C, Member 2 (SULT1C2, Accession NM_006588) is another VGAM1957 host target gene. SULT1C2 BINDING SITE is HOST TARGET binding site found in the 3' untranslated region of mRNA encoded by SULT1C2, corresponding to a HOST TARGET binding site such as BINDING SITE I, BINDING SITE II or BINDING SITE III. Table 2 illustrates the complementarity of the nucleotide sequences of SULT1C2 BINDING SITE, designated SEQ ID:13354, to the nucleotide sequence of VGAM1957 RNA, herein designated VGAM RNA, also designated SEQ ID:4668.

Another function of VGAM1957 is therefore inhibition of Sulfotransferase Family, Cytosolic, 1C, Member 2 (SULT1C2, Accession NM_006588). Accordingly, utilities of VGAM1957 include diagnosis, prevention and treatment of diseases and clinical conditions associated with SULT1C2. Synaptotagmin-like 4 (granuphilin-a) (SYTL4, Accession NM_080737) is another VGAM1957 host target gene. SYTL4 BINDING SITE is HOST TARGET binding site found in the 5' untranslated region of mRNA encoded by SYTL4, corresponding to a HOST TARGET binding site such as BINDING SITE I, BINDING SITE II or BINDING SITE III. Table 2 illustrates the complementarity of the nucleotide sequences of SYTL4 BINDING SITE, designated SEQ ID:28023, to the nucleotide sequence of VGAM1957 RNA, herein designated VGAM RNA, also designated SEQ ID:4668.

Another function of VGAM1957 is therefore inhibition of Synaptotagmin-like 4 (granuphilin-a) (SYTL4, Accession NM_080737). Accordingly, utilities of VGAM1957 include diagnosis, prevention and treatment of diseases and clinical conditions associated with SYTL4. T-box 21 (TBX21, Accession NM_013351) is another VGAM1957 host target gene. TBX21 BINDING SITE is HOST TARGET binding site found in the 3' untranslated region of mRNA encoded by TBX21, corresponding to a HOST TARGET binding site such as BINDING SITE I, BINDING SITE II or BINDING SITE III. Table 2 illustrates the complementarity of the nucleotide sequences of TBX21 BINDING SITE, designated SEQ ID:14995, to the nucleotide sequence of VGAM1957 RNA, herein designated VGAM RNA, also designated SEQ ID:4668.

Another function of VGAM1957 is therefore inhibition of T-box 21 (TBX21, Accession NM_013351). Accordingly, utilities of VGAM1957 include diagnosis, prevention and treatment of diseases and clinical conditions associated with TBX21. TPRA40 (Accession NM_016372) is another VGAM1957 host target gene. TPRA40 BINDING SITE is HOST TARGET binding site found in the 5' untranslated region of mRNA encoded by TPRA40, corresponding to a HOST TARGET binding site such as BINDING SITE I, BINDING SITE II or BINDING SITE III. Table 2 illustrates the complementarity of the nucleotide sequences of TPRA40 BINDING SITE, designated SEQ ID:18502, to the nucleotide sequence of VGAM1957 RNA, herein designated VGAM RNA, also designated SEQ ID:4668.

Another function of VGAM1957 is therefore inhibition of TPRA40 (Accession NM_016372). Accordingly, utilities of VGAM1957 include diagnosis, prevention and treatment of diseases and clinical conditions associated with TPRA40. UDP-glucuronate Decarboxylase 1 (UXS1, Accession NM_025076) is another VGAM1957 host target gene. UXS1 BINDING SITE is HOST TARGET binding site found in the 5' untranslated region of mRNA encoded by UXS1, corresponding to a HOST TARGET binding site such as BINDING SITE I, BINDING SITE II or BINDING SITE III. Table 2 illustrates the complementarity of the nucleotide sequences of UXS1 BINDING SITE, designated SEQ ID:24676, to the nucleotide sequence of VGAM1957 RNA, herein designated VGAM RNA, also designated SEQ ID:4668.

Another function of VGAM1957 is therefore inhibition of UDP-glucuronate Decarboxylase 1 (UXS1, Accession NM_025076). Accordingly, utilities of VGAM1957 include diagnosis, prevention and treatment of diseases and clinical conditions associated with UXS1. Xylosyltransferase I (XYLT1, Accession XM_085432) is another VGAM1957 host target gene. XYLT1 BINDING SITE is HOST TARGET binding site found in the 3' untranslated region of mRNA encoded by XYLT1, corresponding to a HOST TARGET binding site such as BINDING SITE I, BINDING SITE II or BINDING SITE III. Table 2 illustrates the complementarity of the nucleotide sequences of XYLT1 BINDING SITE, designated SEQ ID:38139, to the nucleotide sequence of VGAM1957 RNA, herein designated VGAM RNA, also designated SEQ ID:4668.

Another function of VGAM1957 is therefore inhibition of Xylosyltransferase I (XYLT1, Accession XM_085432). Accordingly, utilities of VGAM1957 include diagnosis, prevention and treatment of diseases and clinical conditions associated with XYLT1. YF13H12 (Accession NM_014297) is another VGAM1957 host target gene. YF13H12 BINDING SITE is HOST TARGET binding site found in the 5' untranslated region of mRNA encoded by YF13H12, corresponding to a HOST TARGET binding site such as BINDING SITE I, BINDING SITE II or BINDING SITE III. Table 2 illustrates the complementarity of the nucleotide sequences of YF13H12 BINDING SITE, designated SEQ ID:15594, to the nucleotide sequence of VGAM1957 RNA, herein designated VGAM RNA, also designated SEQ ID:4668.

Another function of VGAM1957 is therefore inhibition of YF13H12 (Accession NM_014297). Accordingly, utilities of VGAM1957 include diagnosis, prevention and treatment of diseases and clinical conditions associated with YF13H12. LOC120114 (Accession XM_061871) is another VGAM1957 host target gene. LOC120114 BINDING SITE is HOST TARGET binding site found in the 3' untranslated region of mRNA encoded by LOC120114, corresponding to a HOST TARGET binding site such as BINDING SITE I, BINDING SITE II or BINDING SITE III. Table 2 illustrates the complementarity of the nucleotide sequences of LOC120114 BINDING SITE, designated SEQ ID:37211, to the nucleotide sequence of VGAM1957 RNA, herein designated VGAM RNA, also designated SEQ ID:4668.

Another function of VGAM1957 is therefore inhibition of LOC120114 (Accession XM_061871). Accordingly, utilities of VGAM1957 include diagnosis, prevention and treatment of diseases and clinical conditions associated with LOC120114. LOC130644 (Accession XM_065813) is another VGAM1957 host target gene. LOC130644 BINDING SITE is HOST TARGET binding site found in the 3' untranslated region of mRNA encoded by LOC130644, corresponding to a HOST TARGET binding site such as BINDING SITE I, BINDING SITE II or BINDING SITE III. Table 2 illustrates the complementarity of the nucleotide sequences of LOC130644 BINDING SITE, designated SEQ ID:37303, to the nucleotide sequence of VGAM1957 RNA, herein designated VGAM RNA, also designated SEQ ID:4668.

Another function of VGAM1957 is therefore inhibition of LOC130644 (Accession XM_065813). Accordingly, utilities of VGAM1957 include diagnosis, prevention and treatment of diseases and clinical conditions associated with LOC130644. LOC142955 (Accession XM_084389) is another VGAM1957 host target gene. LOC142955 BINDING SITE is HOST TARGET binding site found in the 5' untranslated region of mRNA encoded by LOC142955, corresponding to a HOST TARGET binding site such as BINDING SITE I, BINDING SITE II or BINDING SITE III. Table 2 illustrates the complementarity of the nucleotide sequences of LOC142955 BINDING SITE, designated SEQ ID:37571, to the nucleotide sequence of VGAM1957 RNA, herein designated VGAM RNA, also designated SEQ ID:4668.

Another function of VGAM1957 is therefore inhibition of LOC142955 (Accession XM_084389). Accordingly, utilities of VGAM1957 include diagnosis, prevention and treatment of diseases and clinical conditions associated with LOC142955. LOC143916 (Accession XM_084664) is another VGAM1957 host target gene. LOC143916 BINDING SITE is HOST TARGET binding site found in the 5' untranslated region of mRNA encoded by LOC143916, corresponding to a HOST TARGET binding site such as BINDING SITE I, BINDING SITE II or BINDING SITE III. Table 2 illustrates the complementarity of the nucleotide sequences of LOC143916 BINDING SITE, designated SEQ ID:37652, to the nucleotide sequence of VGAM1957 RNA, herein designated VGAM RNA, also designated SEQ ID:4668.

Another function of VGAM1957 is therefore inhibition of LOC143916 (Accession XM_084664). Accordingly, utilities of VGAM1957 include diagnosis, prevention and treatment of diseases and clinical conditions associated with LOC143916. LOC145371 (Accession XM_085123) is another VGAM1957 host target gene. LOC145371 BINDING SITE is HOST TARGET binding site found in the 3' untranslated region of mRNA encoded by LOC145371, corresponding to a HOST TARGET binding site such as BINDING SITE I, BINDING SITE II or BINDING SITE III. Table 2 illustrates the complementarity of the nucleotide sequences of LOC145371 BINDING SITE, designated SEQ ID:37849, to the nucleotide sequence of VGAM1957 RNA, herein designated VGAM RNA, also designated SEQ ID:4668.

Another function of VGAM1957 is therefore inhibition of LOC145371 (Accession XM_085123). Accordingly, utilities of VGAM1957 include diagnosis, prevention and treatment of diseases and clinical conditions associated with LOC145371. LOC148764 (Accession XM_086307) is another VGAM1957 host target gene. LOC148764 BINDING SITE is HOST TARGET binding site found in the 5' untranslated region of mRNA encoded by LOC148764, corresponding to a HOST TARGET binding site such as BINDING SITE I, BINDING SITE II or BINDING SITE III. Table 2 illustrates the complementarity of the nucleotide sequences of LOC148764 BINDING SITE, designated SEQ ID:38590, to the nucleotide sequence of VGAM1957 RNA, herein designated VGAM RNA, also designated SEQ ID:4668.

Another function of VGAM1957 is therefore inhibition of LOC148764 (Accession XM_086307). Accordingly, utilities of VGAM1957 include diagnosis, prevention and treatment of diseases and clinical conditions associated with LOC148764. LOC150577 (Accession XM_097918) is another VGAM1957 host target gene. LOC150577 BINDING SITE is HOST TARGET binding site found in the 3' untranslated region of mRNA encoded by LOC150577, corresponding to a HOST TARGET binding site such as BINDING SITE I, BINDING SITE II or BINDING SITE III. Table 2 illustrates the complementarity of the nucleotide sequences of LOC150577 BINDING SITE, designated SEQ ID:41222, to the nucleotide sequence of VGAM1957 RNA, herein designated VGAM RNA, also designated SEQ ID:4668.

Another function of VGAM1957 is therefore inhibition of LOC150577 (Accession XM_097918). Accordingly, utilities of VGAM1957 include diagnosis, prevention and treatment of diseases and clinical conditions associated with LOC150577. LOC150967 (Accession XM_087060) is another VGAM1957 host target gene. LOC150967 BINDING SITE is HOST TARGET binding site found in the 5' untranslated region of mRNA encoded by LOC150967, corresponding to a HOST TARGET binding site such as BINDING SITE I, BINDING SITE II or BINDING SITE III. Table 2 illustrates the complementarity of the nucleotide sequences of LOC150967 BINDING SITE, designated SEQ ID:39034, to the nucleotide sequence of VGAM1957 RNA, herein designated VGAM RNA, also designated SEQ ID:4668.

Another function of VGAM1957 is therefore inhibition of LOC150967 (Accession XM_087060). Accordingly, utilities of VGAM1957 include diagnosis, prevention and treatment of diseases and clinical conditions associated with LOC150967. LOC151475 (Accession XM_098063) is another VGAM1957 host target gene. LOC151475 BINDING SITE is HOST TARGET binding site found in the 3' untranslated region of mRNA encoded by LOC151475, corresponding to a HOST TARGET binding site such as BINDING SITE I, BINDING SITE II or BINDING SITE III. Table 2 illustrates the complementarity of the nucleotide sequences of LOC151475 BINDING SITE, designated SEQ ID:41358, to the nucleotide sequence of VGAM1957 RNA, herein designated VGAM RNA, also designated SEQ ID:4668.

Another function of VGAM1957 is therefore inhibition of LOC151475 (Accession XM_098063). Accordingly, utilities of VGAM1957 include diagnosis, prevention and treatment of diseases and clinical conditions associated with LOC151475. LOC157869 (Accession XM_088409) is another VGAM1957 host target gene. LOC157869 BINDING SITE is HOST TARGET binding site found in the 3' untranslated region of mRNA encoded by LOC157869, corresponding to a HOST TARGET binding site such as BINDING SITE I, BINDING SITE II or BINDING SITE III. Table 2 illustrates the complementarity of the nucleotide sequences of LOC157869 BINDING SITE, designated SEQ ID:39677, to the nucleotide sequence of VGAM1957 RNA, herein designated VGAM RNA, also designated SEQ ID:4668.

Another function of VGAM1957 is therefore inhibition of LOC157869 (Accession XM_088409). Accordingly, utilities of VGAM1957 include diagnosis, prevention and treatment of diseases and clinical conditions associated with LOC157869. LOC202025 (Accession XM_117353) is another VGAM1957 host target gene. LOC202025 BIND- ING SITE is HOST TARGET binding site found in the 5' untranslated region of mRNA encoded by LOC202025, corresponding to a HOST TARGET binding site such as BINDING SITE I, BINDING SITE II or BINDING SITE III. Table 2 illustrates the complementarity of the nucleotide sequences of LOC202025 BINDING SITE, designated SEQ ID:43404, to the nucleotide sequence of VGAM1957 RNA, herein designated VGAM RNA, also designated SEQ ID:4668.

Another function of VGAM1957 is therefore inhibition of LOC202025 (Accession XM_117353). Accordingly, utilities of VGAM1957 include diagnosis, prevention and treatment of diseases and clinical conditions associated with LOC202025. LOC255327 (Accession XM_171236) is another VGAM1957 host target gene. LOC255327 BINDING SITE is HOST TARGET binding site found in the 5' untranslated region of mRNA encoded by LOC255327, corresponding to a HOST TARGET binding site such as BINDING SITE I, BINDING SITE II or BINDING SITE III. Table 2 illustrates the complementarity of the nucleotide sequences of LOC255327 BINDING SITE, designated SEQ ID:46022, to the nucleotide sequence of VGAM1957 RNA, herein designated VGAM RNA, also designated SEQ ID:4668.

Another function of VGAM1957 is therefore inhibition of LOC255327 (Accession XM_171236). Accordingly, utilities of VGAM1957 include diagnosis, prevention and treatment of diseases and clinical conditions associated with LOC255327. LOC51336 (Accession NM_016646) is another VGAM1957 host target gene. LOC51336 BINDING SITE is HOST TARGET binding site found in the 3' untranslated region of mRNA encoded by LOC51336, corresponding to a HOST TARGET binding site such as BINDING SITE I, BINDING SITE II or BINDING SITE III. Table 2 illustrates the complementarity of the nucleotide sequences of LOC51336 BINDING SITE, designated SEQ ID:18754, to the nucleotide sequence of VGAM1957 RNA, herein designated VGAM RNA, also designated SEQ ID:4668.

Another function of VGAM1957 is therefore inhibition of LOC51336 (Accession NM_016646). Accordingly, utilities of VGAM1957 include diagnosis, prevention and treatment of diseases and clinical conditions associated with LOC51336. LOC55971 (Accession NM_018842) is another VGAM1957 host target gene. LOC55971 BINDING SITE is HOST TARGET binding site found in the 5' untranslated region of mRNA encoded by LOC55971, corresponding to a HOST TARGET binding site such as BINDING SITE I, BINDING SITE II or BINDING SITE III. Table 2 illustrates the complementarity of the nucleotide sequences of LOC55971 BINDING SITE, designated SEQ ID:20827, to the nucleotide sequence of VGAM1957 RNA, herein designated VGAM RNA, also designated SEQ ID:4668.

Another function of VGAM1957 is therefore inhibition of LOC55971 (Accession NM_018842). Accordingly, utilities of VGAM1957 include diagnosis, prevention and treatment of diseases and clinical conditions associated with LOC55971. FIG. 1 further provides a conceptual description of a novel bioinformatically detected viral gene of the present invention, referred to here as Viral Genomic Address Messenger 1958 (VGAM1958) viral gene, which modulates expression of respective host target genes thereof, the function and utility of which host target genes is known in the art.

VGAM1958 is a novel bioinformatically detected regulatory, non protein coding, viral micro RNA (miRNA) gene. The method by which VGAM1958 was detected is described hereinabove with reference to FIGS. 1-8.

VGAM1958 gene, herein designated VGAM GENE, is a viral gene contained in the genome of Macaca Mulatta Rhadinovirus. VGAM1958 host target gene, herein designated VGAM HOST TARGET GENE, is a human gene contained in the human genome.

VGAM1958 gene encodes a VGAM1958 precursor RNA, herein designated VGAM PRECURSOR RNA. Similar to other miRNA genes, and unlike most ordinary genes, VGAM1958 precursor RNA does not encode a protein. A nucleotide sequence identical or highly similar to the nucleotide sequence of VGAM1958 precursor RNA is designated SEQ ID:1944, and is provided hereinbelow with reference to the sequence listing part. Nucleotide sequence SEQ ID:1944 is located at position 13516 relative to the genome of Macaca Mulatta Rhadinovirus.

VGAM1958 precursor RNA folds onto itself, forming VGAM1958 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1958 folded precursor RNA into VGAM1958 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1958 RNA is designated SEQ ID:4669, and is provided hereinbelow with reference to the sequence listing part.

VGAM1958 host target gene, herein designated VGAM HOST TARGET GENE, encodes a corresponding messenger RNA, VGAM1958 host target RNA, herein designated VGAM HOST TARGET RNA. VGAM1958 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1958 RNA, herein designated VGAM RNA, binds complementarily to one or more host target binding sites located in untranslated regions of VGAM1958 host target RNA, herein designated VGAM HOST TARGET RNA. This complementary binding is due to the fact that the nucleotide sequence of VGAM1958 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1958 RNA, herein designated VGAM RNA, may have a different number of host target binding sites in untranslated regions of a VGAM1958 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1958 RNA, herein designated VGAM RNA, to host target binding sites on VGAM1958 host target RNA, herein designated VGAM HOST TARGET RNA, such as BINDING SITE I, BINDING SITE II and BINDING SITE III, inhibits translation of VGAM1958 host target RNA into VGAM1958 host target protein, herein designated VGAM HOST TARGET PROTEIN. VGAM host target protein is therefore outlined by a broken line.

It is appreciated that VGAM1958 host target gene, herein designated VGAM HOST TARGET GENE, in fact represents a plurality of VGAM1958 host target genes. The mRNA of each one of this plurality of VGAM1958 host target genes comprises one or more host target binding sites, each having a nucleotide sequence which is at least partly complementary to VGAM1958 RNA, herein designated VGAM RNA, and which when bound by VGAM1958 RNA causes inhibition of translation of respective one or more VGAM1958 host target proteins.

It is further appreciated by one skilled in the art that the mode of translational inhibition illustrated by FIG. 1 with specific reference to translational inhibition exerted by VGAM1958 gene, herein designated VGAM GENE, on one or more VGAM1958 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1958 is inhibition of expression of host target genes, as part of a novel viral mechanism of attacking a host. Accordingly, utilities of VGAM1958 include diagnosis, prevention and treatment of viral infection by Macaca Mulatta Rhadinovirus. Specific functions, and accordingly utilities, of VGAM1958 correlate with, and may be deduced from, the identity of the host target genes which VGAM1958 binds and inhibits, and the function of these host target genes, as elaborated hereinbelow.

Nucleotide sequences of the VGAM1958 precursor RNA, herein designated VGAM PRECURSOR RNA, and of the 'diced' VGAM1958 RNA, herein designated VGAM RNA, and a schematic representation of the secondary folding of VGAM1958 folded precursor RNA, herein designated VGAM FOLDED PRECURSOR RNA, of VGAM1958 are further described hereinbelow with reference to Table 1.

Nucleotide sequences of host target binding sites, such as BINDING SITE-I, BINDING SITE-II and BINDING SITE-III of FIG. 1, found on VGAM1958 host target RNA, and schematic representation of the complementarity of each of these host target binding sites to VGAM1958 RNA, herein designated VGAM RNA, are described hereinbelow with reference to Table 2.

As mentioned hereinabove with reference to FIG. 1, a function of VGAM1958 gene, herein designated VGAM is inhibition of expression of VGAM1958 target genes. It is appreciated that specific functions, and accordingly utilities, of VGAM1958 correlate with, and may be deduced from, the identity of the target genes which VGAM1958 binds and inhibits, and the function of these target genes, as elaborated hereinbelow.

Amiloride Binding Protein 1 (amine oxidase (copper-containing)) (ABP1, Accession XM_032220) is a VGAM1958 host target gene. ABP1 BINDING SITE is HOST TARGET binding site found in the 3' untranslated region of mRNA encoded by ABP1, corresponding to a HOST TARGET binding site such as BINDING SITE I, BINDING SITE II or BINDING SITE III. Table 2 illustrates the complementarity of the nucleotide sequences of ABP1 BINDING SITE, designated SEQ ID:31613, to the nucleotide sequence of VGAM1958 RNA, herein designated VGAM RNA, also designated SEQ ID:4669.

A function of VGAM1958 is therefore inhibition of Amiloride Binding Protein 1 (amine oxidase (copper-containing)) (ABP1, Accession XM_032220), a gene which catalyzes the degradation of compounds such as putrescine. Accordingly, utilities of VGAM1958 include diagnosis, prevention and treatment of diseases and clinical conditions associated with ABP1. The function of ABP1 has been established by previous studies. Amiloride acts as a diuretic via the closure of epithelial sodium ion channels. Phenamil, an analog of the diuretic amiloride, is a potent blocker of the epithelial sodium channel. Barbry et al. (1990) used phenamil to purify the porcine kidney amiloride-binding protein. They then used synthetic oligonucleotides derived from partial sequences to screen a human kidney cDNA library and to isolate the cDNA encoding the human amiloride-binding protein. Using this cDNA, Barbry et al. (1990) mapped the corresponding structural gene to 7q34-q36 by in situ hybridization. From studies of association between the ABP gene and cystic fibrosis (OMIM Ref. No. 219700) by means of RFLPs, Barbry et al. (1990) excluded the gene from involvement in that disorder. Barbry et al. (1990) pointed out that amiloride-sensitive Na+ channels are also present in airway epithelia, where they play an important role in fluid secretion. Amiloride inhibits the excessive absorption of Na+ and liquid that takes place in airway epithelia of patients with cystic fibrosis, and amiloride aerosol therapy has been tried for the treatment of lung disease in CF.

Full details of the abovementioned studies are described in the following publications, the disclosure of which are hereby incorporated by reference:

Barbry, P.; Champe, M.; Chassande, O.; Munemitsu, S.; Champigny, G.; Lingueglia, E.; Maes, P.; Frelin, C.; Tartar, A.; Ullrich, A.; Lazdunski, M.: Human kidney amiloride-binding protein: cDNA structure and functional expression. Proc. Nat. Acad. Sci. 87:7347-7351, 1990; and Novotny, W. F.; Chassande, O.; Baker, M.; Lazdunski, M.; Barbry, P.: Diamine oxidase is the amiloride-binding protein and is inhibited by amiloride analogues. J. Biol. Chem. 269: 9921-9.

Further studies establishing the function and utilities of ABP1 are found in John Hopkins OMIM database record ID 104610, and in sited publications numbered 202-205 listed in the bibliography section hereinbelow, which are also hereby incorporated by reference. ACK1 (Accession NM_005781) is another VGAM1958 host target gene. ACK1 BINDING SITE is HOST TARGET binding site found in the 3' untranslated region of mRNA encoded by ACK1, corresponding to a HOST TARGET binding site such as BINDING SITE I, BINDING SITE II or BINDING SITE III. Table 2 illustrates the complementarity of the nucleotide sequences of ACK1 BINDING SITE, designated SEQ ID:12358, to the nucleotide sequence of VGAM1958 RNA, herein designated VGAM RNA, also designated SEQ ID:4669.

Another function of VGAM1958 is therefore inhibition of ACK1 (Accession NM_005781). Accordingly, utilities of VGAM1958 include diagnosis, prevention and treatment of diseases and clinical conditions associated with ACK1. Adenosine Deaminase, RNA-specific (ADAR, Accession NM_001111) is another VGAM1958 host target gene. ADAR BINDING SITE1 through ADAR BINDING SITE3 are HOST TARGET binding sites found in untranslated regions of mRNA encoded by ADAR, corresponding to HOST TAR- GET binding sites such as BINDING SITE I, BINDING SITE II or BINDING SITE III. Table 2 illustrates the complementarity of the nucleotide sequences of ADAR BINDING SITE1 through ADAR BINDING SITE3, designated SEQ ID:6773, SEQ ID:17959 and SEQ ID:17966 respectively, to the nucleotide sequence of VGAM1958 RNA, herein designated VGAM RNA, also designated SEQ ID:4669.

Another function of VGAM1958 is therefore inhibition of Adenosine Deaminase, RNA-specific (ADAR, Accession NM_001111), a gene which converts adenosine to inosine in double-stranded RNA. Accordingly, utilities of VGAM1958 include diagnosis, prevention and treatment of diseases and clinical conditions associated with ADAR. The function of ADAR and its association with various diseases and clinical conditions, has been established by previous studies, as described hereinabove with reference to VGAM323. Adenylate Cyclase 6 (ADCY6, Accession NM_015270) is another VGAM1958 host target gene. ADCY6 BINDING SITE1 and ADCY6 BINDING SITE2 are HOST TARGET binding sites found in untranslated regions of mRNA encoded by ADCY6, corresponding to HOST TARGET binding sites such as BINDING SITE I, BINDING SITE II or BINDING SITE III. Table 2 illustrates the complementarity of the nucleotide sequences of ADCY6 BINDING SITE1 and ADCY6 BINDING SITE2, designated SEQ ID:17588 and SEQ ID:6331 respectively, to the nucleotide sequence of VGAM1958 RNA, herein designated VGAM RNA, also designated SEQ ID:4669.

Another function of VGAM1958 is therefore inhibition of Adenylate Cyclase 6 (ADCY6, Accession NM_015270), a gene which this a membrane-bound, ca (2+)-inhibitable adenylyl cyclase (by similarity). Accordingly, utilities of VGAM1958 include diagnosis, prevention and treatment of diseases and clinical conditions associated with ADCY6. The function of ADCY6 and its association with various diseases and clinical conditions, has been established by previous studies, as described hereinabove with reference to VGAM22. Annexin A5 (ANXA5, Accession NM_001154) is another VGAM1958 host target gene. ANXA5 BINDING SITE is HOST TARGET binding site found in the 5' untranslated region of mRNA encoded by ANXA5, corresponding to a HOST TARGET binding site such as BINDING SITE I, BINDING SITE II or BINDING SITE III. Table 2 illustrates the complementarity of the nucleotide sequences of ANXA5 BINDING SITE, designated SEQ ID:6823, to the nucleotide sequence of VGAM1958 RNA, herein designated VGAM RNA, also designated SEQ ID:4669.

Another function of VGAM1958 is therefore inhibition of Annexin A5 (ANXA5, Accession NM_001154), a gene which acts as an indirect inhibitor of the thromboplastin-specific complex. Accordingly, utilities of VGAM1958 include diagnosis, prevention and treatment of diseases and clinical conditions associated with ANXA5. The function of ANXA5 has been established by previous studies. PP4 is an anticoagulant protein that acts as an indirect inhibitor of the thromboplastin-specific complex, which is involved in the blood coagulation cascade. It has a relative molecular weight of about 35,000 and is present in placental tissue to the extent of about 50 mg per placenta with very little secretion into the maternal bloodstream. The PP4 cDNA encoded a protein of 320 amino acid residues. In addition to the PP4 cDNA, Grundmann et al. (1988) identified cDNA encoding a protein with 74% identity to PP4, which they termed PP4-X. PP4 and PP4-X belong to the lipocortin family, as judged by their homology to lipocortin I (OMIM Ref. No. 151690) and calpactin I (OMIM Ref. No. 151720). The placental anticoagulant protein called PAP, isolated by Funakoshi et al. (1987), may be the same protein. PP4 is also known as endonexin II. Endonexin II is a member of the family of Ca (2+)-dependent phospholipid binding proteins, known as annexins, which bind to the phospholipids that are preferentially located on the cytosolic face of the plasma membrane. Kaplan et al. (1988) cloned endonexin II cDNA and expressed it in Escherichia coli. A single mRNA, approximately 1.6 kb long, was found to be expressed in human cell lines and placenta. The length of the cDNA clone was 1.59 kb. The cDNA predicted a 320-amino acid protein with a sequence in agreement with the previously determined partial amino acid sequence of endonexin II isolated from placenta.

Full details of the abovementioned studies are described in the following publications, the disclosure of which are hereby incorporated by reference:

Grundmann, U.; Abel, K.-J.; Bohn, H.; Lobermann, H.; Lottspeich, F.; Kupper, H.: Characterization of cDNA encoding human placental anticoagulant protein (PP4): homology with the lipocortin family. Proc. Nat. Acad. Sci. 85:3708-3712, 1988; and Kaplan, R.; Jaye, M.; Burgess, W. H.; Schlaepfer, D. D.; Haigler, H. T.: Cloning and expression of cDNA for human endonexin II, a Ca (2+) and phospholipid binding protein. J. Biol. Chem.

Further studies establishing the function and utilities of ANXA5 are found in John Hopkins OMIM database record ID 131230, and in sited publications numbered 12203-12210 listed in the bibliography section hereinbelow, which are also hereby incorporated by reference. Amine Oxidase, Copper Containing 3 (vascular adhesion protein 1) (AOC3, Accession NM_003734) is another VGAM1958 host target gene. AOC3 BINDING SITE is HOST TARGET binding site found in the 3' untranslated region of mRNA encoded by AOC3, corresponding to a HOST TARGET binding site such as BINDING SITE I, BINDING SITE II or BINDING SITE III. Table 2 illustrates the complementarity of the nucleotide sequences of AOC3 BINDING SITE, designated SEQ ID:9824, to the nucleotide sequence of VGAM1958 RNA, herein designated VGAM RNA, also designated SEQ ID:4669.

Another function of VGAM1958 is therefore inhibition of Amine Oxidase, Copper Containing 3 (vascular adhesion protein 1) (AOC3, Accession NM_003734), a gene which catalyze the oxidative conversion of amines to aldehydes in the presence of copper and quinone cofactor. Accordingly, utilities of VGAM1958 include diagnosis, prevention and treatment of diseases and clinical conditions associated with AOC3. The function of AOC3 and its association with various diseases and clinical conditions, has been established by previous studies, as described hereinabove with reference to VGAM175. Adaptor-related Protein Complex 2, Beta 1 Subunit (AP2B1, Accession NM_001282) is another VGAM1958 host target gene. AP2B1 BINDING SITE is HOST TARGET binding site found in the 5' untranslated region of mRNA encoded by AP2B1, corresponding to a HOST TARGET binding site such as BINDING SITE I, BINDING SITE II or BINDING SITE III. Table 2 illustrates the complementarity of the nucleotide sequences of AP2B1 BINDING SITE, designated SEQ ID:6948, to the nucleotide sequence of VGAM1958 RNA, herein designated VGAM RNA, also designated SEQ ID:4669.

Another function of VGAM1958 is therefore inhibition of Adaptor-related Protein Complex 2, Beta 1 Subunit (AP2B1, Accession NM_001282), a gene which links clathrin to receptors in coated vesicles. Accordingly, utilities of VGAM1958 include diagnosis, prevention and treatment of diseases and clinical conditions associated with AP2B1. The function of AP2B1 and its association with various diseases and clinical conditions, has been established by previous studies, as described hereinabove with reference to VGAM1126. Ras Homolog Gene Family, Member A (ARHA, Accession XM_047561) is another VGAM1958 host target gene. ARHA BINDING SITE is HOST TARGET binding site found in the 3' untranslated region of mRNA encoded by ARHA, corresponding to a HOST TARGET binding site such as BINDING SITE I, BINDING SITE II or BINDING SITE III. Table 2 illustrates the complementarity of the nucleotide sequences of ARHA BINDING SITE, designated SEQ ID:35002, to the nucleotide sequence of VGAM1958 RNA, herein designated VGAM RNA, also designated SEQ ID:4669.

Another function of VGAM1958 is therefore inhibition of Ras Homolog Gene Family, Member A (ARHA, Accession XM_047561), a gene which regulates remodeling of the actin cytoskeleton during cell morphogenesis and motility. Accordingly, utilities of VGAM1958 include diagnosis, prevention and treatment of diseases and clinical conditions associated with ARHA. The function of ARHA has been established by previous studies. The small guanosine triphosphatase (GTP) Rho regulates remodeling of the actin cytoskeleton during cell morphogenesis and motility. In their FIG. 3C, Maekawa et al. (1999) diagrammed proposed signaling pathways for Rho-induced remodeling of the actin cytoskeleton. They demonstrated that active Rho signals to its downstream effector ROCK1 (OMIM Ref. No. 601702), which phosphorylates and activates LIM kinase (see OMIM Ref. No. 601329). LIM kinase, in turn, phosphorylates cofilin (OMIM Ref. No. 601442), inhibiting its actin-depolymerizing activity. Rao et al. (2001) investigated the role of Rho kinase in the modulation of aqueous humor outflow facility. The treatment of human trabecular meshwork and canal of Schlemm cells with a Rho kinase-specific inhibitor led to significant but reversible changes in cell shape and decreased actin stress fibers, focal adhesions, and protein phosphotyrosine staining. Based on the Rho kinase inhibitor-induced changes in myosin light chain phosphorylation and actomyosin organization, the authors suggested that cellular relaxation and loss of cell-substratum adhesions in the human trabecular meshwork and canal of Schlemm cells could result in either increased paracellular fluid flow across the canal of Schlemm or altered flow pathway through the juxtacanalicular tissue, thereby lowering resistance to outflow. They suggested Rho kinase as a potential target for the development of drugs to modulate intraocular pressure in glaucoma patients.

Full details of the abovementioned studies are described in the following publications, the disclosure of which are hereby incorporated by reference:

Maekawa, M.; Ishizaki, T.; Boku, S.; Watanabe, N.; Fujita, A.; Iwamatsu, A.; Obinata, T.; Ohashi, K.; Mizuno, K.; Narumiya, S.: Signaling from Rho to the actin cytoskeleton through protein kinases ROCK and LIM-kinase. Science 285: 895-898, 1999; and Rao, P. V.; Deng, P.-F.; Kumar, J.; Epstein, D. L.: Modulation of aqueous humor outflow facility by the Rho kinase-specific inhibitor Y-27632. Invest. Ophthal. Vis. Sci. 42:1029-1037.

Further studies establishing the function and utilities of ARHA are found in John Hopkins OMIM database record ID 165390, and in sited publications numbered 10904, 1090 and 10911-10913 listed in the bibliography section hereinbelow, which are also hereby incorporated by reference. Rho Guanine Nucleotide Exchange Factor (GEF) 7 (ARHGEF7, Accession NM_003899) is another VGAM1958 host target gene. ARHGEF7 BINDING SITE is HOST TARGET binding site found in the 3' untranslated region of mRNA encoded by ARHGEF7, corresponding to a HOST TARGET binding site such as BINDING SITE I, BINDING SITE II or BINDING SITE III. Table 2 illustrates the complementarity of the nucleotide sequences of ARHGEF7 BINDING SITE, designated SEQ ID:9981, to the nucleotide sequence of VGAM1958 RNA, herein designated VGAM RNA, also designated SEQ ID:4669.

Another function of VGAM1958 is therefore inhibition of Rho Guanine Nucleotide Exchange Factor (GEF) 7 (ARHGEF7, Accession NM_003899), a gene which acts as a rac1 guanine nucleotide exchange factor (gef) and can induce membrane ruffling. Accordingly, utilities of VGAM1958 include diagnosis, prevention and treatment of diseases and clinical conditions associated with ARHGEF7. The function of ARHGEF7 and its association with various diseases and clinical conditions, has been established by previous studies, as described hereinabove with reference to VGAM297. Arylsulfatase B (ARSB, Accession NM_000046) is another VGAM1958 host target gene. ARSB BINDING SITE is HOST TARGET binding site found in the 3' untranslated region of mRNA encoded by ARSB, corresponding to a HOST TARGET binding site such as BINDING SITE I, BINDING SITE II or BINDING SITE III. Table 2 illustrates the complementarity of the nucleotide sequences of ARSB BINDING SITE, designated SEQ ID:5488, to the nucleotide sequence of VGAM1958 RNA, herein designated VGAM RNA, also designated SEQ ID:4669.

Another function of VGAM1958 is therefore inhibition of Arylsulfatase B (ARSB, Accession NM_000046). Accordingly, utilities of VGAM1958 include diagnosis, prevention and treatment of diseases and clinical conditions associated with ARSB. Armadillo Repeat Gene Deletes In Velocardiofacial Syndrome (ARVCF, Accession NM_001670) is another VGAM1958 host target gene. ARVCF BINDING SITE is HOST TARGET binding site found in the 3' untranslated region of mRNA encoded by ARVCF, corresponding to a HOST TARGET binding site such as BINDING SITE I, BINDING SITE II or BINDING SITE III. Table 2 illustrates the complementarity of the nucleotide sequences of ARVCF BINDING SITE, designated SEQ ID:7383, to the nucleotide sequence of VGAM1958 RNA, herein designated VGAM RNA, also designated SEQ ID:4669.

Another function of VGAM1958 is therefore inhibition of Armadillo Repeat Gene Deletes In Velocardiofacial Syndrome (ARVCF, Accession NM_001670), a gene which is involved in protein-protein interactions at adherens junctions. Accordingly, utilities of VGAM1958 include diagnosis, prevention and treatment of diseases and clinical conditions associated with ARVCF. The function of ARVCF has been established by previous studies. Velocardiofacial syndrome (VCFS; 192430) and DiGeorge syndrome (DGS; 188400) are autosomal dominant disorders that share a wide spectrum of phenotypes, including cleft palate, conotruncal heart defects, and facial dysmorphology. Both syndromes are thought to result from a developmental field defect. Hemizygosity for a portion of 22q11 has been detected in 80 to 85% of VCFS/DGS patients. To identify genes in 22q11 that may contribute to the phenotype of VCFS, Sirotkin et al. (1997) used cDNA selection and cDNA library screening to clone the full-length human 'armadillo repeat gene deleted in VCFS' (ARVCF) cDNA. ARVCF encodes a 962-amino acid protein that contains 2 motifs involved in protein-protein interactions: a coiled-coil domain near the N terminus and 10 tandem armadillo repeats in the central region. Comparison of the ARVCF sequence with protein databases showed that the structure of ARVCF is most closely related to the catenin family. Members of this family play important roles in the formation of adherens junction complexes. These data suggest that ARVCF is involved in protein-protein interactions at adherens junctions. Unlike other catenin family members, ARVCF contains a nuclear localization signal (NLS), suggesting that ARVCF functions as a nuclear protein. Northern blotting showed that ARVCF is ubiquitously expressed as a 4.0- to 4.3-kb transcript in fetal and adult tissues, and Southern blotting revealed that ARVCF is conserved in vertebrates and Drosophila. Sirotkin et al. (1997) mapped the ARVCF gene to chromosome 22 by fluorescence in situ hybridization and to 22q11 using physical mapping methods. ARVCF is located within the region of 22q11 that is hemizygous in all VCFS/DGS patients who have interstitial deletions. Based on the physical location and potential functions of ARVCF, Sirotkin et al. (1997) suggested that hemizygosity of ARVCF plays a role in the etiology of some of the phenotypes associated with VCFS.

Full details of the abovementioned studies are described in the following publications, the disclosure of which are hereby incorporated by reference:

Bonne, S.; van Hengel, J.; van Roy, F.: Chromosomal mapping of human armadillo genes belonging to the p120 (ctn)/plakophilin subfamily. Genomics 51:452-454, 1998; and Sirotkin, H.; O'Donnell, H.; DasGupta, R.; Halford, S.; St. Jore, B.; Puech, A.; Parimoo, S.; Morrow, B.; Skoultchi, A.; Weissman, S. M.; Scambler, P.; Kucherlapati, R.: Identification.

Further studies establishing the function and utilities of ARVCF are found in John Hopkins OMIM database record ID 602269, and in sited publications numbered 702 and 8675 listed in the bibliography section hereinbelow, which are also hereby incorporated by reference. ATPase, Class VI, Type 11A (ATP11A, Accession XM_085028) is another VGAM1958 host target gene. ATP11A BINDING SITE is HOST TARGET binding site found in the 3' untranslated region of mRNA encoded by ATP11A, corresponding to a HOST TARGET binding site such as BINDING SITE I, BINDING SITE II or BINDING SITE III. Table 2 illustrates the complementarity of the nucleotide sequences of ATP11A BINDING SITE, designated SEQ ID:37807, to the nucleotide sequence of VGAM1958 RNA, herein designated VGAM RNA, also designated SEQ ID:4669.

Another function of VGAM1958 is therefore inhibition of ATPase, Class VI, Type 11A (ATP11A, Accession XM_085028). Accordingly, utilities of VGAM1958 include diagnosis, prevention and treatment of diseases and clinical conditions associated with ATP11A. ATPase, Cu++ Transporting, Beta Polypeptide (Wilson disease) (ATP7B, Accession NM_000053) is another VGAM1958 host target gene. ATP7B BINDING SITE is HOST TARGET binding site found in the 3' untranslated region of mRNA encoded by ATP7B, corresponding to a HOST TARGET binding site such as BINDING SITE I, BINDING SITE II or BINDING SITE III. Table 2 illustrates the complementarity of the nucleotide sequences of ATP7B BINDING SITE, designated SEQ ID:5506, to the nucleotide sequence of VGAM1958 RNA, herein designated VGAM RNA, also designated SEQ ID:4669.

Another function of VGAM1958 is therefore inhibition of ATPase, Cu++ Transporting, Beta Polypeptide (Wilson disease) (ATP7B, Accession NM_000053). Accordingly, utilities of VGAM1958 include diagnosis, prevention and treatment of diseases and clinical conditions associated with ATP7B. ATPase, Class I, Type 8B, Member 2 (ATP8B2, Accession XM_036933) is another VGAM1958 host target gene. ATP8B2 BINDING SITE is HOST TARGET binding site found in the 5' untranslated region of mRNA encoded by ATP8B2, corresponding to a HOST TARGET binding site such as BINDING SITE I, BINDING SITE II or BINDING SITE III. Table 2 illustrates the complementarity of the nucleotide sequences of ATP8B2 BINDING SITE, designated SEQ ID:32516, to the nucleotide sequence of VGAM1958 RNA, herein designated VGAM RNA, also designated SEQ ID:4669.

Another function of VGAM1958 is therefore inhibition of ATPase, Class I, Type 8B, Member 2 (ATP8B2, Accession XM_036933). Accordingly, utilities of VGAM1958 include diagnosis, prevention and treatment of diseases and clinical conditions associated with ATP8B2. Alpha Thalassemia/mental Retardation Syndrome X-linked (RAD54 homolog, S. cerevisiae) (ATRX, Accession NM_000489) is another VGAM1958 host target gene. ATRX BINDING SITE1 and ATRX BINDING SITE2 are HOST TARGET binding sites found in untranslated regions of mRNA encoded by ATRX, corresponding to HOST TARGET binding sites such as BINDING SITE I, BINDING SITE II or BINDING SITE III. Table 2 illustrates the complementarity of the nucleotide sequences of ATRX BINDING SITE1 and ATRX BINDING SITE2, designated SEQ ID:6093 and SEQ ID:28681 respectively, to the nucleotide sequence of VGAM1958 RNA, herein designated VGAM RNA, also designated SEQ ID:4669.

Another function of VGAM1958 is therefore inhibition of Alpha Thalassemia/mental Retardation Syndrome X-linked (RAD54 homolog, S. cerevisiae) (ATRX, Accession NM_000489). Accordingly, utilities of VGAM1958 include diagnosis, prevention and treatment of diseases and clinical conditions associated with ATRX. Beta-1,3-glucuronyltransferase 1 (glucuronosyltransferase P) (B3GAT1, Accession NM_054025) is another VGAM1958 host target gene. B3GAT1 BINDING SITE1 and B3GAT1 BINDING SITE2 are HOST TARGET binding sites found in untranslated regions of mRNA encoded by B3GAT1, corresponding to HOST TARGET binding sites such as BINDING SITE I, BINDING SITE II or BINDING SITE III. Table 2 illustrates the complementarity of the nucleotide sequences of B3GAT1 BINDING SITE1 and B3GAT1 BINDING SITE2, designated SEQ ID:27628 and SEQ ID:20716 respectively, to the nucleotide sequence of VGAM1958 RNA, herein designated VGAM RNA, also designated SEQ ID:4669.

Another function of VGAM1958 is therefore inhibition of Beta-1,3-glucuronyltransferase 1 (glucuronosyltransferase P) (B3GAT1, Accession NM_054025). Accordingly, utilities of VGAM1958 include diagnosis, prevention and treatment of diseases and clinical conditions associated with B3GAT1. UDP-Gal:betaGlcNAc Beta 1,4-Galactosyltransferase, Polypeptide 2 (B4GALT2, Accession NM_003780) is another VGAM1958 host target gene. B4GALT2 BINDING SITE1 and B4GALT2 BINDING SITE2 are HOST TARGET binding sites found in untranslated regions of mRNA encoded by B4GALT2, corresponding to HOST TARGET binding sites such as BINDING SITE I, BINDING SITE II or BINDING SITE III. Table 2 illustrates the complementarity of the nucleotide sequences of B4GALT2 BINDING SITE1 and B4GALT2 BINDING SITE2, designated SEQ ID:9865 and SEQ ID:6860 respectively, to the nucleotide sequence of VGAM1958 RNA, herein designated VGAM RNA, also designated SEQ ID:4669.

Another function of VGAM1958 is therefore inhibition of UDP-Gal:betaGlcNAc Beta 1,4-Galactosyltransferase, Polypeptide 2 (B4GALT2, Accession NM_003780). Accordingly, utilities of VGAM1958 include diagnosis, prevention and treatment of diseases and clinical conditions associated with B4GALT2. Bassoon (presynaptic cytomatrix protein) (BSN, Accession NM_003458) is another VGAM1958 host target gene. BSN BINDING SITE is HOST TARGET binding site found in the 3' untranslated region of mRNA encoded by BSN, corresponding to a HOST TARGET binding site such as BINDING SITE I, BINDING SITE II or BINDING SITE III. Table 2 illustrates the complementarity of the nucleotide sequences of BSN BINDING SITE, designated SEQ ID:9520, to the nucleotide sequence of VGAM1958 RNA, herein designated VGAM RNA, also designated SEQ ID:4669.

Another function of VGAM1958 is therefore inhibition of Bassoon (presynaptic cytomatrix protein) (BSN, Accession NM_003458), a gene which may be involved in cytomatrix organization at the site of neurotransmitter release. Accordingly, utilities of VGAM1958 include diagnosis, prevention and treatment of diseases and clinical conditions associated with BSN. The function of BSN and its association with various diseases and clinical conditions, has been established by previous studies, as described hereinabove with reference to VGAM638. Calcium Channel, Voltage-dependent, Alpha 2/delta Subunit 2 (CACNA2D2, Accession NM_006030) is another VGAM1958 host target gene. CACNA2D2 BINDING SITE1 and CACNA2D2 BINDING SITE2 are HOST TARGET binding sites found in untranslated regions of mRNA encoded by CACNA2D2, corresponding to HOST TARGET binding sites such as BINDING SITE I, BINDING SITE II or BINDING SITE III. Table 2 illustrates the complementarity of the nucleotide sequences of CACNA2D2 BINDING SITE1 and CACNA2D2 BINDING SITE2, designated SEQ ID:12651 and SEQ ID:12648 respectively, to the nucleotide sequence of VGAM1958 RNA, herein designated VGAM RNA, also designated SEQ ID:4669.

Another function of VGAM1958 is therefore inhibition of Calcium Channel, Voltage-dependent, Alpha 2/delta Subunit 2 (CACNA2D2, Accession NM_006030), a gene which is a calcium channel protein which plays an important role in excitation-contraction coupling. Accordingly, utilities of VGAM1958 include diagnosis, prevention and treatment of diseases and clinical conditions associated with CACNA2D2. The function of CACNA2D2 and its association with various diseases and clinical conditions, has been established by previous studies, as described hereinabove with reference to VGAM203. CARPX (Accession NM_020178) is another VGAM1958 host target gene. CARPX BINDING SITE is HOST TARGET binding site found in the 5' untranslated region of mRNA encoded by CARPX, corresponding to a HOST TARGET binding site such as BINDING SITE I, BINDING SITE II or BINDING SITE III. Table 2 illustrates the complementarity of the nucleotide sequences of CARPX BINDING SITE, designated SEQ ID:21395, to the nucleotide sequence of VGAM1958 RNA, herein designated VGAM RNA, also designated SEQ ID:4669.

Another function of VGAM1958 is therefore inhibition of CARPX (Accession NM_020178), a gene which is alpha-carbonic anhydrases-related protein. Accordingly, utilities of VGAM1958 include diagnosis, prevention and treatment of diseases and clinical conditions associated with CARPX. The function of CARPX and its association with various diseases and clinical conditions, has been established by previous studies, as described hereinabove with reference to VGAM904. Caspase 8, Apoptosis-related Cysteine Protease (CASP8, Accession NM_001228) is another VGAM1958 host target gene. CASP8 BINDING SITE1 and CASP8 BINDING SITE2 are HOST TARGET binding sites found in untranslated regions of mRNA encoded by CASP8, corresponding to HOST TARGET binding sites such as BINDING SITE I, BINDING SITE II or BINDING SITE III. Table 2 illustrates the complementarity of the nucleotide sequences of CASP8 BINDING SITE1 and CASP8 BINDING SITE2, designated SEQ ID:6897 and SEQ ID:27210 respectively, to the nucleotide sequence of VGAM1958 RNA, herein designated VGAM RNA, also designated SEQ ID:4669.

Another function of VGAM1958 is therefore inhibition of Caspase 8, Apoptosis-related Cysteine Protease (CASP8, Accession NM_001228), a gene which is an apoptosis-related caspase and an upstream component of Fas receptor and tumor necrosis factor (TNF) receptor-induced apoptosis. Accordingly, utilities of VGAM1958 include diagnosis, prevention and treatment of diseases and clinical conditions associated with CASP8. The function of CASP8 and its association with various diseases and clinical conditions, has been established by previous studies, as described hereinabove with reference to VGAM145. CD80 Antigen (CD28 antigen ligand 1, B7-1 antigen) (CD80, Accession NM_005191) is another VGAM1958 host target gene. CD80 BINDING SITE is HOST TARGET binding site found in the 5' untranslated region of mRNA encoded by CD80, corresponding to a HOST TARGET binding site such as BINDING SITE I, BINDING SITE II or BINDING SITE III. Table 2 illustrates the complementarity of the nucleotide sequences of CD80 BINDING SITE, designated SEQ ID:11695, to the nucleotide sequence of VGAM1958 RNA, herein designated VGAM RNA, also designated SEQ ID:4669.

Another function of VGAM1958 is therefore inhibition of CD80 Antigen (CD28 antigen ligand 1, B7-1 antigen) (CD80, Accession NM_005191), a gene which provides regulatory signals for T lymphocytes. Accordingly, utilities of VGAM1958 include diagnosis, prevention and treatment of diseases and clinical conditions associated with CD80. The function of CD80 has been established by previous studies. The B-lymphocyte activation antigen B7-1 (formerly referred to as B7) provides regulatory signals for T lymphocytes as a consequence of binding to the CD28 (OMIM Ref. No. 186760) and CTLA-4 (OMIM Ref. No. 123890) ligands of T cells. The cDNA for B7-1 predicts a type I membrane protein, i.e., one synthesized with a signal peptide that is cleaved upon translocation across the endoplasmic membrane. The protein is predicted to contain 2 extracellular domains structurally similar to those of Ig, a hydrophobic transmembrane region, and a short cytoplasmic domain. Selvakumar et al. (1992) found that the gene has 6 exons that span approximately 32 kb of genomic DNA. Exon 1 is not translated, and exon 2 contains the initiation ATG codon and encodes a predicted signal peptide. Exons 3 and 4 correspond to 2 Ig-like domains, whereas exons 5 and 6, respectively, encode the transmembrane portion and the cytoplasmic tail. This close relationship between exons and functional domains is a characteristic feature of genes of the Ig superfamily. As the ligand for CD28, LAB7-1 is also symbolized CD28LG1. Reeves et al. (1997) demonstrated that the CD80 and CD86 (OMIM Ref. No. 601020) genes are linked on human chromosome 3 and mouse chromosome 16. These 2 genes encode B7-1 and B7-2, respectively, which are structurally similar members of the immunoglobulin superfamily expressed on a variety of hematopoietic cell types. Reeves et al. (1997) stated that they provide a costimulatory signal to T cells by interacting with CD28 and CTLA4

Full details of the abovementioned studies are described in the following publications, the disclosure of which are hereby incorporated by reference:

Selvakumar, A.; Mohanraj, B. K.; Eddy, R. L.; Shows, T. B.; White, P. C.; Dupont, B.: Genomic organization and chromosomal location of the human gene encoding the B-lymphocyte activation antigen B7. Immunogenetics 36:175-181, 1992; and Reeves, R. H.; Patch, D.; Sharpe, A. H.; Borriello, F.; Freeman, G. J.; Edelhoff, S.; Disteche, C.: The costimulatory genes Cd80 and Cd86 are linked on mouse chromosome 16 and human chr.

Further studies establishing the function and utilities of CD80 are found in John Hopkins OMIM database record ID 112203, and in sited publications numbered 4548, 4549-455 and 4346 listed in the bibliography section hereinbelow, which are also hereby incorporated by reference. CD83 Antigen (activated B lymphocytes, immunoglobulin superfamily) (CD83, Accession NM_004233) is another VGAM1958 host target gene. CD83 BINDING SITE is HOST TARGET binding site found in the 3' untranslated region of mRNA encoded by CD83, corresponding to a HOST TARGET binding site such as BINDING SITE I, BINDING SITE II or BINDING SITE III. Table 2 illustrates the complementarity of the nucleotide sequences of CD83 BINDING SITE, designated SEQ ID:10426, to the nucleotide sequence of VGAM1958 RNA, herein designated VGAM RNA, also designated SEQ ID:4669.

Another function of VGAM1958 is therefore inhibition of CD83 Antigen (activated B lymphocytes, immunoglobulin superfamily) (CD83, Accession NM_004233), a gene which may play a significant role in antigen presentation or the cellular interactions that follow lymphocyte activation. Accordingly, utilities of VGAM1958 include diagnosis, prevention and treatment of diseases and clinical conditions associated with CD83. The function of CD83 and its association with various diseases and clinical conditions, has been established by previous studies, as described hereinabove with reference to VGAM1929. Cadherin Related 23 (CDH23, Accession NM_022124) is another VGAM1958 host target gene. CDH23 BINDING SITE is HOST TARGET binding site found in the 3' untranslated region of mRNA encoded by CDH23, corresponding to a HOST TARGET binding site such as BINDING SITE I, BINDING SITE II or BINDING SITE III. Table 2 illustrates the complementarity of the nucleotide sequences of CDH23 BINDING SITE, designated SEQ ID:22669, to the nucleotide sequence of VGAM1958 RNA, herein designated VGAM RNA, also designated SEQ ID:4669.

Another function of VGAM1958 is therefore inhibition of Cadherin Related 23 (CDH23, Accession NM_022124). Accordingly, utilities of VGAM1958 include diagnosis, prevention and treatment of diseases and clinical conditions associated with CDH23. Cyclin-dependent Kinase Inhibitor 1A (p21, Cip1) (CDKN1A, Accession NM_078467) is another VGAM1958 host target gene. CDKN1A BINDING SITE is HOST TARGET binding site found in the 3' untranslated region of mRNA encoded by CDKN1A, corresponding to a HOST TARGET binding site such as BINDING SITE I, BINDING SITE II or BINDING SITE III. Table 2 illustrates the complementarity of the nucleotide sequences of CDKN1A BINDING SITE, designated SEQ ID:27781, to the nucleotide sequence of VGAM1958 RNA, herein designated VGAM RNA, also designated SEQ ID:4669.

Another function of VGAM1958 is therefore inhibition of Cyclin-dependent Kinase Inhibitor 1A (p21, Cip1) (CDKN1A, Accession NM_078467), a gene which inhibits cyclin-kinase activity and probably serves as the effector of p53 cell cycle control. Accordingly, utilities of VGAM1958 include diagnosis, prevention and treatment of diseases and clinical conditions associated with CDKN1A. The function of CDKN1A and its association with various diseases and clinical conditions, has been established by previous studies, as described hereinabove with reference to VGAM1912. Centromere Protein B, 80kDa (CENPB, Accession XM_045451) is another VGAM1958 host target gene. CENPB BINDING SITE1 and CENPB BINDING SITE2 are HOST TARGET binding sites found in untranslated regions of mRNA encoded by CENPB, corresponding to HOST TARGET binding sites such as BINDING SITE I, BINDING SITE II or BINDING SITE III. Table 2 illustrates the complementarity of the nucleotide sequences of CENPB BINDING SITE1 and CENPB BINDING SITE2, designated SEQ ID:34463 and SEQ ID:34466 respectively, to the nucleotide sequence of VGAM1958 RNA, herein designated VGAM RNA, also designated SEQ ID:4669.

Another function of VGAM1958 is therefore inhibition of Centromere Protein B, 80 kDa (CENPB, Accession XM_045451), a gene which is the major centromere antigen. Accordingly, utilities of VGAM1958 include diagnosis, prevention and treatment of diseases and clinical conditions associated with CENPB. The function of CENPB and its association with various diseases and clinical conditions, has been established by previous studies, as described hereinabove with reference to VGAM206. Centrosomal Protein 2 (CEP2, Accession NM_007186) is another VGAM1958 host target gene. CEP2 BINDING SITE is HOST TARGET binding site found in the 5' untranslated region of mRNA encoded by CEP2, corresponding to a HOST TARGET binding site such as BINDING SITE I, BINDING SITE II or BINDING SITE III. Table 2 illustrates the complementarity of the nucleotide sequences of CEP2 BINDING SITE, designated SEQ ID:14042, to the nucleotide sequence of VGAM1958 RNA, herein designated VGAM RNA, also designated SEQ ID:4669.

Another function of VGAM1958 is therefore inhibition of Centrosomal Protein 2 (CEP2, Accession NM_007186), a gene which interacts with TC10 and CDC42. Accordingly, utilities of VGAM1958 include diagnosis, prevention and treatment of diseases and clinical conditions associated with CEP2. The function of CEP2 and its association with various diseases and clinical conditions, has been established by previous studies, as described hereinabove with reference to VGAM329. Cholinergic Receptor, Nicotinic, Beta Polypeptide 1 (muscle) (CHRNB1, Accession XM_018451) is another VGAM1958 host target gene. CHRNB1 BINDING SITE is HOST TARGET binding site found in the 3' untranslated region of mRNA encoded by CHRNB1, corresponding to a HOST TARGET binding site such as BINDING SITE I, BINDING SITE II or BINDING SITE III. Table 2 illustrates the complementarity of the nucleotide sequences of CHRNB1 BINDING SITE, designated SEQ ID:30360, to the nucleotide sequence of VGAM1958 RNA, herein designated VGAM RNA, also designated SEQ ID:4669.

Another function of VGAM1958 is therefore inhibition of Cholinergic Receptor, Nicotinic, Beta Polypeptide 1 (muscle) (CHRNB1, Accession XM_018451). Accordingly, utilities of VGAM1958 include diagnosis, prevention and treatment of diseases and clinical conditions associated with CHRNB1. Carbohydrate (N-acetylglucosamine 6-O) Sulfotransferase 5 (CHST5, Accession NM_012126) is another VGAM1958 host target gene. CHST5 BINDING SITE is HOST TARGET binding site found in the 3' untranslated region of mRNA encoded by CHST5, corresponding to a HOST TARGET binding site such as BINDING SITE I, BINDING SITE II or BINDING SITE III. Table 2 illustrates the complementarity of the nucleotide sequences of CHST5 BINDING SITE, designated SEQ ID:14439, to the nucleotide sequence of VGAM1958 RNA, herein designated VGAM RNA, also designated SEQ ID:4669.

Another function of VGAM1958 is therefore inhibition of Carbohydrate (N-acetylglucosamine 6-O) Sulfotransferase 5 (CHST5, Accession NM_012126), a gene which may be involved in sulfation of glycoproteins and proteoglycans. Accordingly, utilities of VGAM1958 include diagnosis, prevention and treatment of diseases and clinical conditions associated with CHST5. The function of CHST5 and its association with various diseases and clinical conditions, has been established by previous studies, as described hereinabove with reference to VGAM186. Chloride Channel 7 (CLCN7, Accession NM_001287) is another VGAM1958 host target gene. CLCN7 BINDING SITE is HOST TARGET binding site found in the 3' untranslated region of mRNA encoded by CLCN7, corresponding to a HOST TARGET binding site such as BINDING SITE I, BINDING SITE II or BINDING SITE III. Table 2 illustrates the complementarity of the nucleotide sequences of CLCN7 BINDING SITE, designated SEQ ID:6964, to the nucleotide sequence of VGAM1958 RNA, herein designated VGAM RNA, also designated SEQ ID:4669.

Another function of VGAM1958 is therefore inhibition of Chloride Channel 7 (CLCN7, Accession NM_001287), a gene which is voltage-gated chloride channel. Accordingly, utilities of VGAM1958 include diagnosis, prevention and treatment of diseases and clinical conditions associated with CLCN7. The function of CLCN7 and its association with various diseases and clinical conditions, has been established by previous studies, as described hereinabove with reference to VGAM623. C-type (calcium dependent, carbohydrate-recognition domain) Lectin, Superfamily Member 5 (CLECSF5, Accession NM_013252) is another VGAM1958 host target gene. CLECSF5 BINDING SITE is HOST TARGET binding site found in the 3' untranslated region of mRNA encoded by CLECSF5, corresponding to a HOST TARGET binding site such as BINDING SITE I, BINDING SITE II or BINDING SITE III. Table 2 illustrates the complementarity of the nucleotide sequences of CLECSF5 BINDING SITE, designated SEQ ID:14919, to the nucleotide sequence of VGAM1958 RNA, herein designated VGAM RNA, also designated SEQ ID:4669.

Another function of VGAM1958 is therefore inhibition of C-type (calcium dependent, carbohydrate-recognition domain) Lectin, Superfamily Member 5 (CLECSF5, Accession NM_013252). Accordingly, utilities of VGAM1958 include diagnosis, prevention and treatment of diseases and clinical conditions associated with CLECSF5. Clathrin, Heavy Polypeptide-like 1 (CLTCL1, Accession XM_033096) is another VGAM1958 host target gene. CLTCL1 BINDING SITE is HOST TARGET binding site found in the 3' untranslated region of mRNA encoded by CLTCL1, corresponding to a HOST TARGET binding site such as BINDING SITE I, BINDING SITE II or BINDING SITE III. Table 2 illustrates the complementarity of the nucleotide sequences of CLTCL1 BINDING SITE, designated SEQ ID:31838, to the nucleotide sequence of VGAM1958 RNA, herein designated VGAM RNA, also designated SEQ ID:4669.

Another function of VGAM1958 is therefore inhibition of Clathrin, Heavy Polypeptide-like 1 (CLTCL1, Accession XM_033096), a gene which is involved in vesicle budding. Accordingly, utilities of VGAM1958 include diagnosis, prevention and treatment of diseases and clinical conditions associated with CLTCL1. The function of CLTCL1 and its association with various diseases and clinical conditions, has been established by previous studies, as described hereinabove with reference to VGAM42. Collagen, Type XI, Alpha 2 (COL11A2, Accession NM_080681) is another VGAM1958 host target gene. COL11A2 BINDING SITE1 and COL11A2 BINDING SITE2 are HOST TARGET binding sites found in untranslated regions of mRNA encoded by COL11A2, corresponding to HOST TARGET binding sites such as BINDING SITE I, BINDING SITE II or BINDING SITE III. Table 2 illustrates the complementarity of the nucleotide sequences of COL11A2 BINDING SITE1 and COL11A2 BINDING SITE2, designated SEQ ID:27979 and SEQ ID:27974 respectively, to the nucleotide sequence of VGAM1958 RNA, herein designated VGAM RNA, also designated SEQ ID:4669.

Another function of VGAM1958 is therefore inhibition of Collagen, Type XI, Alpha 2 (COL11A2, Accession NM_080681). Accordingly, utilities of VGAM1958 include diagnosis, prevention and treatment of diseases and clinical conditions associated with COL11A2. Collagen-like Tail Subunit (single strand of homotrimer) of Asymmetric Acetylcholinesterase (COLQ, Accession NM_080539) is another VGAM1958 host target gene. COLQ BINDING SITE1 through COLQ BINDING SITE6 are HOST TARGET binding sites found in untranslated regions of mRNA encoded by COLQ, corresponding to HOST TARGET binding sites such as BINDING SITE I, BINDING SITE II or BINDING SITE III. Table 2 illustrates the complementarity of the nucleotide sequences of COLQ BINDING SITE1 through COLQ BINDING SITE6, designated SEQ ID:27855, SEQ ID:27858, SEQ ID:27864, SEQ ID:27852, SEQ ID:27861 and SEQ ID:12232 respectively, to the nucleotide sequence of VGAM1958 RNA, herein designated VGAM RNA, also designated SEQ ID:4669.

Another function of VGAM1958 is therefore inhibition of Collagen-like Tail Subunit (single strand of homotrimer) of Asymmetric Acetylcholinesterase (COLQ, Accession NM_080539). Accordingly, utilities of VGAM1958 include diagnosis, prevention and treatment of diseases and clinical conditions associated with COLQ. Copine VII (CPNE7, Accession NM_014427) is another VGAM1958 host target gene. CPNE7 BINDING SITE is HOST TARGET binding site found in the 3' untranslated region of mRNA encoded by CPNE7, corresponding to a HOST TARGET binding site such as BINDING SITE I, BINDING SITE II or BINDING SITE III. Table 2 illustrates the complementarity of the nucleotide sequences of CPNE7 BINDING SITE, designated SEQ ID:15787, to the nucleotide sequence of VGAM1958 RNA, herein designated VGAM RNA, also designated SEQ ID:4669.

Another function of VGAM1958 is therefore inhibition of Copine VII (CPNE7, Accession NM_014427). Accordingly, utilities of VGAM1958 include diagnosis, prevention and treatment of diseases and clinical conditions associated with CPNE7. Cofactor Required For Sp1 Transcriptional Activation, Subunit 6, 77 kDa (CRSP6, Accession NM_004268) is another VGAM1958 host target gene. CRSP6 BINDING SITE is HOST TARGET binding site found in the 5' untranslated region of mRNA encoded by CRSP6, corresponding to a HOST TARGET binding site such as BINDING SITE I, BINDING SITE II or BINDING SITE III. Table 2 illustrates the complementarity of the nucleotide sequences of CRSP6 BINDING SITE, designated SEQ ID:10471, to the nucleotide sequence of VGAM1958 RNA, herein designated VGAM RNA, also designated SEQ ID:4669.

Another function of VGAM1958 is therefore inhibition of Cofactor Required For Sp1 Transcriptional Activation, Subunit 6, 77 kDa (CRSP6, Accession NM_004268), a gene which is required for Sp1 mediated transcriptional activation with TAF(II) s. Accordingly, utilities of VGAM1958 include diagnosis, prevention and treatment of diseases and clinical conditions associated with CRSP6. The function of CRSP6 has been established by previous studies. Using a HeLa cell line, Ito et al. (1999) cloned TRAP80, the gene encoding the 80-kD subunit of the TRAP complex. (For background information on thyroid hormone receptor-associated proteins (TRAPs), see 300182). The TRAP80 cDNA encodes a 717-amino acid protein that has no obvious motifs other than a short leucine zipper in the middle of the sequence. The TRAP80 cDNA appears to be equivalent to the p78 component of the mouse Mediator (Jiang et al., 1998). Northern blot analysis of multiple human tissues showed that the TRAP80 gene is ubiquitously expressed as an approximately 3.0-kb transcript Gene transcription requires factors that recognize transcriptional enhancer sites in DNA. These factors work with coactivators to direct transcriptional initiation by the RNA polymerase II apparatus (see OMIM Ref. No. POLR2A, 180660). Transcriptional activation by enhancer-binding factors such as SP1 (OMIM Ref. No. 189906) requires interaction with the TFIID complex (see OMIM Ref. No. TAF2A, 313650). To identify other potential SP1 cofactors, Ryu et al. (1999) developed an in vitro transcription assay consisting of TFIIA (GTF2A1; 600520), RNA polII, and the basal transcription factors GTF2B (OMIM Ref. No. 189963), GTF2E (OMIM Ref. No. 189962), GTF2F (OMIM Ref. No. 189968), and GTF2H (OMIM Ref. No. 189972), supplemented with TFIID or TBP (OMIM Ref. No. 600075). By sequential chromatography, they excluded PC4 (OMIM Ref. No. 600503) as an SP1 cofactor and identified a multi-subunit cofactor, CRSP (cofactor required for SP1 activation), which, along with TFIID, is required for efficient activation by SP1. CRSP behaves as a single complex of approximately 700 kD. Ryu et al. (1999) tentatively identified 9 polypeptides as CRSP subunits (see OMIM Ref. No. also PPARBP, 604311). Using microsequence peptide analysis, they cloned a CRSP cDNA encoding a 77-kD protein, CRSP6, which they termed CRSP77

Full details of the abovementioned studies are described in the following publications, the disclosure of which are hereby incorporated by reference:

Ito, M.; Yuan, C.-X.; Malik, S.; Gu, W.; Fondell, J. D.; Yamamura, S.; Fu, Z.-Y.; Zhang, X.; Qin, J.; Roeder, R. G.: Identity between TRAP and SMCC complexes indicates novel pathways for the function of nuclear receptors and diverse mammalian activators. Molec. Cell 3:361-370, 1999; and Ryu, S.; Zhou, S.; Ladurner, A. G.; Tjian, R.: The transcriptional cofactor complex CRSP is required for activity of the enhancer-binding protein Sp1. Nature 397:446-450, 1999.

Further studies establishing the function and utilities of CRSP6 are found in John Hopkins OMIM database record ID 603810, and in sited publications numbered 11384 listed in the bibliography section hereinbelow, which are also hereby incorporated by reference. Cysteine and Glycine-rich Protein 1 (CSRP1, Accession NM_004078) is another VGAM1958 host target gene. CSRP1 BINDING SITE is HOST TARGET binding site found in the 3' untranslated region of mRNA encoded by CSRP1, corresponding to a HOST TARGET binding site such as BINDING SITE I, BINDING SITE II or BINDING SITE III. Table 2 illustrates the complementarity of the nucleotide sequences of CSRP1 BINDING SITE, designated SEQ ID:10277, to the nucleotide sequence of VGAM1958 RNA, herein designated VGAM RNA, also designated SEQ ID:4669.

Another function of VGAM1958 is therefore inhibition of Cysteine and Glycine-rich Protein 1 (CSRP1, Accession NM_004078), a gene which could play a role in neuronal development. Accordingly, utilities of VGAM1958 include diagnosis, prevention and treatment of diseases and clinical conditions associated with CSRP1. The function of CSRP1 and its association with various diseases and clinical conditions, has been established by previous studies, as described hereinabove with reference to VGAM743. Cathepsin D (lysosomal aspartyl protease) (CTSD, Accession NM_001909) is another VGAM1958 host target gene. CTSD BINDING SITE is HOST TARGET binding site found in the 3' untranslated region of mRNA encoded by CTSD, corresponding to a HOST TARGET binding site such as BINDING SITE I, BINDING SITE II or BINDING SITE III. Table 2 illustrates the complementarity of the nucleotide sequences of CTSD BINDING SITE, designated SEQ ID:7627, to the nucleotide sequence of VGAM1958 RNA, herein designated VGAM RNA, also designated SEQ ID:4669.

Another function of VGAM1958 is therefore inhibition of Cathepsin D (lysosomal aspartyl protease) (CTSD, Accession NM_001909). Accordingly, utilities of VGAM1958 include diagnosis, prevention and treatment of diseases and clinical conditions associated with CTSD. Cullin 4B (CUL4B, Accession NM_003588) is another VGAM1958 host target gene. CUL4B BINDING SITE is HOST TARGET binding site found in the 3' untranslated region of mRNA encoded by CUL4B, corresponding to a HOST TARGET binding site such as BINDING SITE I, BINDING SITE II or BINDING SITE III. Table 2 illustrates the complementarity of the nucleotide sequences of CUL4B BINDING SITE, designated SEQ ID:9639, to the nucleotide sequence of VGAM1958 RNA, herein designated VGAM RNA, also designated SEQ ID:4669.

Another function of VGAM1958 is therefore inhibition of Cullin 4B (CUL4B, Accession NM_003588), a gene which is a negative regulator of the cell cycle in C. elegans. Accordingly, utilities of VGAM1958 include diagnosis, prevention and treatment of diseases and clinical conditions associated with CUL4B. The function of CUL4B and its association with various diseases and clinical conditions, has been established by previous studies, as described hereinabove with reference to VGAM140. Chemokine (C-X-C motif) Ligand 16 (CXCL16, Accession NM_022059) is another VGAM1958 host target gene. CXCL16 BINDING SITE is HOST TARGET binding site found in the 3' untranslated region of mRNA encoded by CXCL16, corresponding to a HOST TARGET binding site such as BINDING SITE I, BINDING SITE II or BINDING SITE III. Table 2 illustrates the complementarity of the nucleotide sequences of CXCL16 BINDING SITE, designated SEQ ID:22600, to the nucleotide sequence of VGAM1958 RNA, herein designated VGAM RNA, also designated SEQ ID:4669.

Another function of VGAM1958 is therefore inhibition of Chemokine (C-X-C motif) Ligand 16 (CXCL16, Accession NM_022059), a gene which induces calcium mobilization. Accordingly, utilities of VGAM1958 include diagnosis, prevention and treatment of diseases and clinical conditions associated with CXCL16. The function of CXCL16 and its association with various diseases and clinical conditions, has been established by previous studies, as described hereinabove with reference to VGAM1845. Cytochrome P450, Subfamily I (aromatic compound-inducible), Polypeptide 1 (CYP1A1, Accession NM_000499) is another VGAM1958 host target gene. CYP1A1 BINDING SITE is HOST TARGET binding site found in the 3' untranslated region of mRNA encoded by CYP1A1, corresponding to a HOST TARGET binding site such as BINDING SITE I, BINDING SITE II or BINDING SITE III. Table 2 illustrates the complementarity of the nucleotide sequences of CYP1A1 BINDING SITE, designated SEQ ID:6112, to the nucleotide sequence of VGAM1958 RNA, herein designated VGAM RNA, also designated SEQ ID:4669.

Another function of VGAM1958 is therefore inhibition of Cytochrome P450, Subfamily I (aromatic compound-inducible), Polypeptide 1 (CYP1A1, Accession NM_000499), a gene which intervenes in an NADPH-dependent electron transport pathway. Accordingly, utilities of VGAM1958 include diagnosis, prevention and treatment of diseases and clinical conditions associated with CYP1A1. The function of CYP1A1 and its association with various diseases and clinical conditions, has been established by previous studies, as described hereinabove with reference to VGAM335. Cytochrome P450, Subfamily I (dioxin-inducible), Polypeptide 1 (glaucoma 3, primary infantile) (CYP1B1, Accession NM_000104) is another VGAM1958 host target gene. CYP1B1 BINDING SITE is HOST TARGET binding site found in the 3' untranslated region of mRNA encoded by CYP1B1, corresponding to a HOST TARGET binding site such as BINDING SITE I, BINDING SITE II or BINDING SITE III. Table 2 illustrates the complementarity of the nucleotide sequences of CYP1B1 BINDING SITE, designated SEQ ID:5564, to the nucleotide sequence of VGAM1958 RNA, herein designated VGAM RNA, also designated SEQ ID:4669.

Another function of VGAM1958 is therefore inhibition of Cytochrome P450, Subfamily I (dioxin-inducible), Polypeptide 1 (glaucoma 3, primary infantile) (CYP1B1, Accession NM_000104), a gene which participates in the metabolism of a molecule that is a participant in eye development. Accordingly, utilities of VGAM1958 include diagnosis, prevention and treatment of diseases and clinical conditions associated with CYP1B1. The function of CYP1B1 and its association with various diseases and clinical conditions, has been established by previous studies, as described hereinabove with reference to VGAM894. Cytochrome P450, Subfamily XXVIIB (25-hydroxyvitamin D-1-alpha-hydroxylase), Polypeptide 1 (CYP27B1, Accession NM_000785) is another VGAM1958 host target gene. CYP27B1 BINDING SITE is HOST TARGET binding site found in the 3" untranslated region of mRNA encoded by CYP27B1, corresponding to a HOST TARGET binding site such as BINDING SITE I, BINDING SITE II or BINDING SITE III. Table 2 illustrates the complementarity of the nucleotide sequences of CYP27B1 BINDING SITE, designated SEQ ID:6432, to the nucleotide sequence of VGAM1958 RNA, herein designated VGAM RNA, also designated SEQ ID:4669.

Another function of VGAM1958 is therefore inhibition of Cytochrome P450, Subfamily XXVIIB (25-hydroxyvitamin D-1-alpha-hydroxylase), Polypeptide 1 (CYP27B1, Accession NM_000785). Accordingly, utilities of VGAM1958 include diagnosis, prevention and treatment of diseases and clinical conditions associated with CYP27B1. Dystroglycan 1 (dystrophin-associated glycoprotein 1) (DAG1, Accession NM_004393) is another VGAM1958 host target gene. DAG1 BINDING SITE1 and DAG1 BINDING SITE2 are HOST TARGET binding sites found in untranslated regions of mRNA encoded by DAG1, corresponding to HOST TARGET binding sites such as BINDING SITE I, BINDING SITE II or BINDING SITE III. Table 2 illustrates the complementarity of the nucleotide sequences of DAG1 BINDING SITE1 and DAG1 BINDING SITE2, designated SEQ ID:10630 and SEQ ID:10634 respectively, to the nucleotide sequence of VGAM1958 RNA, herein designated VGAM RNA, also designated SEQ ID:4669.

Another function of VGAM1958 is therefore inhibition of Dystroglycan 1 (dystrophin-associated glycoprotein 1) (DAG1, Accession NM_004393), a gene which may provide linkage between the sarcolemma and extracellular matrix (ECM). Accordingly, utilities of VGAM1958 include diagnosis, prevention and treatment of diseases and clinical conditions associated with DAG1. The function of DAG1 and its association with various diseases and clinical conditions, has been established by previous studies, as described hereinabove with reference to VGAM1095. DEAD/H (Asp-Glu-Ala-Asp/His) Box Polypeptide 11 (CHL1-like helicase homolog, S. cerevisiae) (DDX11, Accession NM_004399) is another VGAM1958 host target gene. DDX11 BINDING SITE1 and DDX11 BINDING SITE2 are HOST TARGET binding sites found in untranslated regions of mRNA encoded by DDX11, corresponding to HOST TARGET binding sites such as BINDING SITE I, BINDING SITE II or BINDING SITE III. Table 2 illustrates the complementarity of the nucleotide sequences of DDX11 BINDING SITE1 and DDX11 BINDING SITE2, designated SEQ ID:10653 and SEQ ID:24986 respectively, to the nucleotide sequence of VGAM1958 RNA, herein designated VGAM RNA, also designated SEQ ID:4669.

Another function of VGAM1958 is therefore inhibition of DEAD/H (Asp-Glu-Ala-Asp/His) Box Polypeptide 11 (CHL1-like helicase homolog, S. cerevisiae) (DDX11, Accession NM_004399), a gene which could be an ATP-dependent DNA-binding helicase and may intervene in cell cycle regulation. Accordingly, utilities of VGAM1958 include diagnosis, prevention and treatment of diseases and clinical conditions associated with DDX11. The function of DDX11 and its association with various diseases and clinical conditions, has been established by previous studies, as described hereinabove with reference to VGAM1533. Dihydrofolate Reductase (DHFR, Accession NM_000791) is another VGAM1958 host target gene. DHFR BINDING SITE is HOST TARGET binding site found in the 3' untranslated region of mRNA encoded by DHFR, corresponding to a HOST TARGET binding site such as BINDING SITE I, BINDING SITE II or BINDING SITE III. Table 2 illustrates the complementarity of the nucleotide sequences of DHFR BINDING SITE, designated SEQ ID:6450, to the nucleotide sequence of VGAM1958 RNA, herein designated VGAM RNA, also designated SEQ ID:4669.

Another function of VGAM1958 is therefore inhibition of Dihydrofolate Reductase (DHFR, Accession NM_000791), a gene which converts dihydrofolate into tetrahydrofolate. Accordingly, utilities of VGAM1958 include diagnosis, prevention and treatment of diseases and clinical conditions associated with DHFR. The function of DHFR and its association with various diseases and clinical conditions, has been established by previous studies, as described hereinabove with reference to VGAM826. Dystrophia Myotonica-protein Kinase (DMPK, Accession NM_004409) is another VGAM1958 host target gene. DMPK BINDING SITE is HOST TARGET binding site found in the 5' untranslated region of mRNA encoded by DMPK, corresponding to a HOST TARGET binding site such as BINDING SITE I, BINDING SITE II or BINDING SITE III. Table 2 illustrates the complementarity of the nucleotide sequences of DMPK BINDING SITE, designated SEQ ID:10666, to the nucleotide sequence of VGAM1958 RNA, herein designated VGAM RNA, also designated SEQ ID:4669.

Another function of VGAM1958 is therefore inhibition of Dystrophia Myotonica-protein Kinase (DMPK, Accession NM_004409). Accordingly, utilities of VGAM1958 include diagnosis, prevention and treatment of diseases and clinical conditions associated with DMPK. DnaJ (Hsp40) Homolog, Subfmaily B, Member 1 (DNAJB1, Accession NM_006145) is another VGAM1958 host target gene. DNAJB1 BINDING SITE is HOST TARGET binding site found in the 3' untranslated region of mRNA encoded by DNAJB1, corresponding to a HOST TARGET binding site such as BINDING SITE I, BINDING SITE II or BINDING SITE III. Table 2 illustrates the complementarity of the nucleotide sequences of DNAJB1 BINDING SITE, designated SEQ ID:12787, to the nucleotide sequence of VGAM1958 RNA, herein designated VGAM RNA, also designated SEQ ID:4669.

Another function of VGAM1958 is therefore inhibition of DnaJ (Hsp40) Homolog, Subfmaily B, Member 1 (DNAJB1, Accession NM_006145), a gene which may prevent aggregation of newly translated proteins. Accordingly, utilities of VGAM1958 include diagnosis, prevention and treatment of diseases and clinical conditions associated with DNAJB1. The function of DNAJB1 and its association with various diseases and clinical conditions, has been established by previous studies, as described hereinabove with reference to VGAM1778. Diptheria Toxin Resistance Protein Required For Diphthamide Biosynthesis-like 1 (S. cerevisiae) (DPH2L1, Accession NM_001383) is another VGAM1958 host target gene. DPH2L1 BINDING SITE is HOST TARGET binding site found in the 5' untranslated region of mRNA encoded by DPH2L1, corresponding to a HOST TARGET binding site such as BINDING SITE I, BINDING SITE II or BINDING SITE III. Table 2 illustrates the complementarity of the nucleotide sequences of DPH2L1 BINDING SITE, designated SEQ ID:7054, to the nucleotide sequence of VGAM1958 RNA, herein designated VGAM RNA, also designated SEQ ID:4669.

Another function of VGAM1958 is therefore inhibition of Diptheria Toxin Resistance Protein Required For Diphthamide Biosynthesis-like 1 (S. cerevisiae) (DPH2L1, Accession NM_001383), a gene which may be involved in regulating global protein synthesis; has similarity to S. cerevisiae Dph2p. Accordingly, utilities of VGAM1958 include diagnosis, prevention and treatment of diseases and clinical conditions associated with DPH2L1. The function of DPH2L1 and its association with various diseases and clinical conditions, has been established by previous studies, as described hereinabove with reference to VGAM608. Dystrobrevin, Alpha (DTNA, Accession NM_001391) is another VGAM1958 host target gene. DTNA BINDING SITE1 through DTNA BINDING SITE4 are HOST TARGET binding sites found in untranslated regions of mRNA encoded by DTNA, corresponding to HOST TARGET binding sites such as BINDING SITE I, BINDING SITE II or BINDING SITE III. Table 2 illustrates the complementarity of the nucleotide sequences of DTNA BINDING SITE1 through DTNA BINDING SITE4, designated SEQ ID:7082, SEQ ID:26844, SEQ ID:26839 and SEQ ID:26849 respectively, to the nucleotide sequence of VGAM1958 RNA, herein designated VGAM RNA, also designated SEQ ID:4669.

Another function of VGAM1958 is therefore inhibition of Dystrobrevin, Alpha (DTNA, Accession NM_001391), a gene which may be involved in the formation and stability of synapses. Accordingly, utilities of VGAM1958 include diagnosis, prevention and treatment of diseases and clinical conditions associated with DTNA. The function of DTNA and its association with various diseases and clinical conditions, has been established by previous studies, as described hereinabove with reference to VGAM1021. Ectodermal Dysplasia 1, Anhidrotic (ED1, Accession NM_001399) is another VGAM1958 host target gene. ED1 BINDING SITE is HOST TARGET binding site found in the 3' untranslated region of mRNA encoded by ED1, corresponding to a HOST TARGET binding site such as BINDING SITE I, BINDING SITE II or BINDING SITE III. Table 2 illustrates the complementarity of the nucleotide sequences of ED1 BINDING SITE, designated SEQ ID:7098, to the nucleotide sequence of VGAM1958 RNA, herein designated VGAM RNA, also designated SEQ ID:4669.

Another function of VGAM1958 is therefore inhibition of Ectodermal Dysplasia 1, Anhidrotic (ED1, Accession NM_001399). Accordingly, utilities of VGAM1958 include diagnosis, prevention and treatment of diseases and clinical conditions associated with ED1. Ephrin-A3 (EFNA3, Accession NM_004952) is another VGAM1958 host target gene. EFNA3 BINDING SITE is HOST TARGET binding site found in the 3' untranslated region of mRNA encoded by EFNA3, corresponding to a HOST TARGET binding site such as BINDING SITE I, BINDING SITE II or BINDING SITE III. Table 2 illustrates the complementarity of the nucleotide sequences of EFNA3 BINDING SITE, designated SEQ ID:11394, to the nucleotide sequence of VGAM1958 RNA, herein designated VGAM RNA, also designated SEQ ID:4669.

Another function of VGAM1958 is therefore inhibition of Ephrin-A3 (EFNA3, Accession NM_004952), a gene which is a ligand of Eph-related receptor tyrosine kinases. Accordingly, utilities of VGAM1958 include diagnosis, prevention and treatment of diseases and clinical conditions associated with EFNA3. The function of EFNA3 and its association with various diseases and clinical conditions, has been established by previous studies, as described hereinabove with reference to VGAM1929. EGF-like-domain, Multiple 6 (EGFL6, Accession NM_015507) is another VGAM1958 host target gene. EGFL6 BINDING SITE is HOST TARGET binding site found in the 5' untranslated region of mRNA encoded by EGFL6, corresponding to a HOST TARGET binding site such as BINDING SITE I, BINDING SITE II or BINDING SITE III. Table 2 illustrates the complementarity of the nucleotide sequences of EGFL6 BINDING SITE, designated SEQ ID:17765, to the nucleotide sequence of VGAM1958 RNA, herein designated VGAM RNA, also designated SEQ ID:4669.

Another function of VGAM1958 is therefore inhibition of EGF-like-domain, Multiple 6 (EGFL6, Accession NM_015507), a gene which is a members of the epidermal growth factor (EGF) repeat superfamily which are often involved in the regulation of cell cycle, proliferation, and developmental processes. Accordingly, utilities of VGAM1958 include diagnosis, prevention and treatment of diseases and clinical conditions associated with EGFL6. The function of EGFL6 has been established by previous studies. Using a high-throughput screening-by-hybridization approach, Yeung et al. (1999) identified the EGFL6 gene. The predicted 553-amino acid EGFL6 protein has a putative N-terminal signal peptide, which suggests that it is secreted; an EGF repeat region containing 4 complete EGF-like repeats and 1 partial EGF-like repeat; an integrin association motif (RGD); 2 potential N-glycosylation sites; and a potential tyrosine phosphorylation site. Northern blot analysis of a variety of normal human tissues detected an approximately 2.4-kb EGFL6 transcript only in placenta. Among the cancer tissues tested, EGFL6 expression was found only in meningioma tumors. Screening-by-hybridization analysis of various cDNA libraries indicated EGFL6 expression in lung tumor, fetal lung, fetal skin, fetal umbilical cord, fetal liver/spleen, and placenta, but not in normal adult tissues, including lung. Buchner et al. (2000) determined that the MAEG gene contains 12 exons.

Full details of the abovementioned studies are described in the following publications, the disclosure of which are hereby incorporated by reference:

Yeung, G.; Mulero, J. J.; Berntsen, R. P.; Loeb, D. B.; Drmanac, R.; Ford, J. E.: Cloning of a novel epidermal growth factor repeat containing gene EGFL6: expressed in tumor and fetal tissues. Genomics 62:304-307, 1999; and Buchner, G.; Orfanelli, U.; Quaderi, N.; Bassi, M. T.; Andolfi, G.; Ballabio, A.; Franco, B.: Identification of a new EGF-repeat-containing gene from human Xp22: a candidate for develo.

Further studies establishing the function and utilities of EGFL6 are found in John Hopkins OMIM database record ID 300239, and in sited publications numbered 9013-9014 listed in the bibliography section hereinbelow, which are also hereby incorporated by reference. Egl Nine Homolog 1 (C. elegans) (EGLN1, Accession NM_022051) is another VGAM1958 host target gene. EGLN1 BINDING SITE is HOST TARGET binding site found in the 5' untranslated region of mRNA encoded by EGLN1, corresponding to a HOST TARGET binding site such as BINDING SITE I, BINDING SITE II or BINDING SITE III. Table 2 illustrates the complementarity of the nucleotide sequences of EGLN1 BINDING SITE, designated SEQ ID:22579, to the nucleotide sequence of VGAM1958 RNA, herein designated VGAM RNA, also designated SEQ ID:4669.

Another function of VGAM1958 is therefore inhibition of Egl Nine Homolog 1 (C. elegans) (EGLN1, Accession NM_022051), a gene which is expressed in the cytoplasm of arterial smooth muscle cells. Accordingly, utilities of VGAM1958 include diagnosis, prevention and treatment of diseases and clinical conditions associated with EGLN1. The function of EGLN1 and its association with various diseases and clinical conditions, has been established by previous studies, as described hereinabove with reference to VGAM216. Egl Nine Homolog 2 (C. elegans) (EGLN2, Accession NM_017555) is another VGAM1958 host target gene. EGLN2 BINDING SITE is HOST TARGET binding site found in the 3' untranslated region of mRNA encoded by EGLN2, corresponding to a HOST TARGET binding site such as BINDING SITE I, BINDING SITE II or BINDING SITE III. Table 2 illustrates the complementarity of the nucleotide sequences of EGLN2 BINDING SITE, designated SEQ ID:18991, to the nucleotide sequence of VGAM1958 RNA, herein designated VGAM RNA, also designated SEQ ID:4669.

Another function of VGAM1958 is therefore inhibition of Egl Nine Homolog 2 (C. elegans) (EGLN2, Accession NM_017555), a gene which is an essential component of the pathway. Accordingly, utilities of VGAM1958 include diagnosis, prevention and treatment of diseases and clinical conditions associated with EGLN2. The function of EGLN2 and its association with various diseases and clinical conditions, has been established by previous studies, as described hereinabove with reference to VGAM432. Egl Nine Homolog 3 (C. elegans) (EGLN3, Accession NM_022073) is another VGAM1958 host target gene. EGLN3 BINDING SITE is HOST TARGET binding site found in the 3' untranslated region of mRNA encoded by EGLN3, corresponding to a HOST TARGET binding site such as BINDING SITE I, BINDING SITE II or BINDING SITE III. Table 2 illustrates the complementarity of the nucleotide sequences of EGLN3 BINDING SITE, designated SEQ ID:22618, to the nucleotide sequence of VGAM1958 RNA, herein designated VGAM RNA, also designated SEQ ID:4669.

Another function of VGAM1958 is therefore inhibition of Egl Nine Homolog 3 (C. elegans) (EGLN3, Accession NM_022073), a gene which is an essential component of the pathway. Accordingly, utilities of VGAM1958 include diagnosis, prevention and treatment of diseases and clinical conditions associated with EGLN3. The function of EGLN3 and its association with various diseases and clinical conditions, has been established by previous studies, as described hereinabove with reference to VGAM206. EH-domain Containing 4 (EHD4, Accession NM_139265) is another VGAM1958 host target gene. EHD4 BINDING SITE is HOST TARGET binding site found in the 3' untranslated region of mRNA encoded by EHD4, corresponding to a HOST TARGET binding site such as BINDING SITE I, BINDING SITE II or BINDING SITE III. Table 2 illustrates the complementarity of the nucleotide sequences of EHD4 BINDING SITE, designated SEQ ID:29254, to the nucleotide sequence of VGAM1958 RNA, herein designated VGAM RNA, also designated SEQ ID:4669.

Another function of VGAM1958 is therefore inhibition of EH-domain Containing 4 (EHD4, Accession NM_139265). Accordingly, utilities of VGAM1958 include diagnosis, prevention and treatment of diseases and clinical conditions associated with EHD4. Eukaryotic Translation Initiation Factor 4A, Isoform 2 (EIF4A2, Accession NM_001967) is another VGAM1958 host target gene. EIF4A2 BINDING SITE is HOST TARGET binding site found in the 3' untranslated region of mRNA encoded by EIF4A2, corresponding to a HOST TARGET binding site such as BINDING SITE I, BINDING SITE II or BINDING SITE III. Table 2 illustrates the complementarity of the nucleotide sequences of EIF4A2 BINDING SITE, designated SEQ ID:7696, to the nucleotide sequence of VGAM1958 RNA, herein designated VGAM RNA, also designated SEQ ID:4669.

Another function of VGAM1958 is therefore inhibition of Eukaryotic Translation Initiation Factor 4A, Isoform 2 (EIF4A2, Accession NM_001967), a gene which is a subunit of a high molecular weight protein complex and is required as a single polypeptide chain for mrna binding to ribosome. Accordingly, utilities of VGAM1958 include diagnosis, prevention and treatment of diseases and clinical conditions associated with EIF4A2. The function of EIF4A2 has been established by previous studies. Eukaryotic initiation factor 4A plays an important role in the binding of mRNA to the 43S preinitiation complex when protein synthesis begins. Two highly homologous forms of functional EIF4A genes, Eif4a1 (OMIM Ref. No. 602641) and Eif4a2, have been isolated in mice (Nielsen and Trachsel, 1988); yeast cells also possess 2 EIF4A genes, TIF1 and TIF2 (OMIM Ref. No. 601993). The murine Eif4a and yeast TIF genes appear to belong to a DEAD-box gene family, whose members exhibit extensive amino acid similarity and contain the asp-glu-ala-asp (DEAD) sequence. DEAD-box genes have been identified in species ranging from E-coli to human S. Their function appears to be related to transcriptional/translational regulation. Sudo et al. (1995) isolated human cDNA highly homologous to murine Eif4a2, which encodes one of the protein-synthesis initiation factors involved in the binding of mRNA to the ribosome. The human homolog was expressed in all normal tissues examined, but in variable amounts, being highly expressed in skeletal muscle and ovary, and less abundantly in liver, kidney, and pancreas.

Full details of the abovementioned studies are described in the following publications, the disclosure of which are hereby incorporated by reference:

Nielsen, P. J.; Trachsel, H.: The mouse protein synthesis initiation factor 4A gene family includes two related functional genes which are differentially expressed. EMBO J. 7:2097-2105, 1988; and Sudo, K.; Takahashi, E.; Nakamura, Y.: Isolation and mapping of the human EIF4A2 gene homologous to the murine protein synthesis initiation factor 4A-II gene Eif4a2. Cytogenet. Cell Ge.

Further studies establishing the function and utilities of EIF4A2 are found in John Hopkins OMIM database record ID 601102, and in sited publications numbered 9632-9634 listed in the bibliography section hereinbelow, which are also hereby incorporated by reference. ELL (Accession NM_006532) is another VGAM1958 host target gene. ELL BINDING SITE is HOST TARGET binding site found in the 3' untranslated region of mRNA encoded by ELL, corresponding to a HOST TARGET binding site such as BINDING SITE I, BINDING SITE II or BINDING SITE III. Table 2 illustrates the complementarity of the nucleotide sequences of ELL BINDING SITE, designated SEQ ID:13280, to the nucleotide sequence of VGAM1958 RNA, herein designated VGAM RNA, also designated SEQ ID:4669.

Another function of VGAM1958 is therefore inhibition of ELL (Accession NM_006532). Accordingly, utilities of VGAM1958 include diagnosis, prevention and treatment of diseases and clinical conditions associated with ELL. Ectonucleoside Triphosphate Diphosphohydrolase 6 (putative function) (ENTPD6, Accession NM_001247) is another VGAM1958 host target gene. ENTPD6 BINDING SITE is HOST TARGET binding site found in the 3' untranslated region of mRNA encoded by ENTPD6, corresponding to a HOST TARGET binding site such as BINDING SITE I, BINDING SITE II or BINDING SITE III. Table 2 illustrates the complementarity of the nucleotide sequences of ENTPD6 BINDING SITE, designated SEQ ID:6918, to the nucleotide sequence of VGAM1958 RNA, herein designated VGAM RNA, also designated SEQ ID:4669.

Another function of VGAM1958 is therefore inhibition of Ectonucleoside Triphosphate Diphosphohydrolase 6 (putative function) (ENTPD6, Accession NM_001247), a gene which might support glycosylation reactions in the golgi apparatus and, when released from cells, might catalyze the hydrolysis of extracellular nucleotides. Accordingly, utilities of VGAM1958 include diagnosis, prevention and treatment of diseases and clinical conditions associated with ENTPD6. The function of ENTPD6 and its association with various diseases and clinical conditions, has been established by previous studies, as described hereinabove with reference to VGAM827. E1A Binding Protein P300 (EP300, Accession NM_001429) is another VGAM1958 host target gene. EP300 BINDING SITE is HOST TARGET binding site found in the 5' untranslated region of mRNA encoded by EP300, corresponding to a HOST TARGET binding site such as BINDING SITE I, BINDING SITE II or BINDING SITE III. Table 2 illustrates the complementarity of the nucleotide sequences of EP300 BINDING SITE, designated SEQ ID:7149, to the nucleotide sequence of VGAM1958 RNA, herein designated VGAM RNA, also designated SEQ ID:4669.

Another function of VGAM1958 is therefore inhibition of E1A Binding Protein P300 (EP300, Accession NM_001429), a gene which may have a function in cell cycle regulation. Accordingly, utilities of VGAM1958 include diagnosis, prevention and treatment of diseases and clinical conditions associated with EP300. The function of EP300 and its association with various diseases and clinical conditions, has been established by previous studies, as described hereinabove with reference to VGAM191. Erythrocyte Membrane Protein Band 4.9 (dematin) (EPB49, Accession NM_001978) is another VGAM1958 host target gene. EPB49 BINDING SITE is HOST TARGET binding site found in the 5' untranslated region of mRNA encoded by EPB49, corresponding to a HOST TARGET binding site such as BINDING SITE I, BINDING SITE II or BINDING SITE III. Table 2 illustrates the complementarity of the nucleotide sequences of EPB49 BINDING SITE, designated SEQ ID:7709, to the nucleotide sequence of VGAM1958 RNA, herein designated VGAM RNA, also designated SEQ ID:4669.

Another function of VGAM1958 is therefore inhibition of Erythrocyte Membrane Protein Band 4.9 (dematin) (EPB49, Accession NM_001978), a gene which is an actin-bundling protein. Accordingly, utilities of VGAM1958 include diagnosis, prevention and treatment of diseases and clinical conditions associated with EPB49. The function of EPB49 and its association with various diseases and clinical conditions, has been established by previous studies, as described hereinabove with reference to VGAM760. Epilepsy, Progressive Myoclonus Type 2, Lafora Disease (laforin) (EPM2A, Accession NM_005670) is another VGAM1958 host target gene. EPM2A BINDING SITE is HOST TARGET binding site found in the 5' untranslated region of mRNA encoded by EPM2A, corresponding to a HOST TARGET binding site such as BINDING SITE I, BINDING SITE II or BINDING SITE III. Table 2 illustrates the complementarity of the nucleotide sequences of EPM2A BINDING SITE, designated SEQ ID:12226, to the nucleotide sequence of VGAM1958 RNA, herein designated VGAM RNA, also designated SEQ ID:4669.

Another function of VGAM1958 is therefore inhibition of Epilepsy, Progressive Myoclonus Type 2, Lafora Disease (laforin) (EPM2A, Accession NM_005670), a gene which Laforin; protein tyrosine phosphatase that may have role in glycogen metabolism. Accordingly, utilities of VGAM1958 include diagnosis, prevention and treatment of diseases and clinical conditions associated with EPM2A. The function of EPM2A and its association with various diseases and clinical conditions, has been established by previous studies, as described hereinabove with reference to VGAM470. V-ets Erythroblastosis Virus E26 Oncogene Homolog 2 (avian) (ETS2, Accession NM_005239) is another VGAM1958 host target gene. ETS2 BINDING SITE is HOST TARGET binding site found in the 3' untranslated region of mRNA encoded by ETS2, corresponding to a HOST TARGET binding site such as BINDING SITE I, BINDING SITE II or BINDING SITE III. Table 2 illustrates the complementarity of the nucleotide sequences of ETS2 BINDING SITE, designated SEQ ID:11748, to the nucleotide sequence of VGAM1958 RNA, herein designated VGAM RNA, also designated SEQ ID:4669.

Another function of VGAM1958 is therefore inhibition of V-ets Erythroblastosis Virus E26 Oncogene Homolog 2 (avian) (ETS2, Accession NM_005239), a gene which Transcription factor. Accordingly, utilities of VGAM1958 include diagnosis, prevention and treatment of diseases and clinical conditions associated with ETS2. The function of ETS2 has been established by previous studies. See 164720. By in situ hybridization, Watson et al. (1985) mapped the ETS2 locus to 21q22.1-q22.3. Sacchi et al. (1986) found that the ETS2 gene was translocated to chromosome 8 in the translocation t (8;21)(q22; q22), which is commonly found in patients with acute myeloid leukemia with morphology M2 (OMIM Ref. No. AML-M2). In a case of t (8;21)(q22; q22), Le Beau et al. (1986) found that the ETS2 gene was translocated to chromosome 8. The MOS oncogene (OMIM Ref. No. 190060) was retained at the breakpoint on chromosome 8; thus, one or both of these genes may play a role in the pathogenesis of acute myelogenous leukemia. Using genetic linkage analysis, Sacchi et al. (1988) demonstrated the location of the ETS2 gene relative to other loci and established that the breakpoint in acute myeloid leukemia is about 17 cM from ETS2. Thus, the breakpoint does not affect the ETS2 gene structure. The actual DNA sequence involved in the t (8;21) may reside in a 3-cM genetic region between 2 markers used in these studies. By family linkage studies using RFLPs, Sacchi et al. (1988) demonstrated that ERG is situated just proximal to ETS2. Mavrothalassitis et al. (1990) demonstrated that the ETS2 gene has no TATA box or CAAT box in its promoter. It has an alternative structure that serves a comparable function. The p16(INK4A) cyclin-dependent kinase inhibitor (CDKN2A; 600160) is implicated in replicative senescence, the state of permanent growth arrest provoked by cumulative cell divisions or as a response to constitutive Ras-Raf-MEK signaling in somatic cells. Ohtani et al. (2001) demonstrated a role for the ETS1 and ETS2 transcription factors in regulating the expression of p16(INK4A) in these different contexts based on their ability to activate the p16(INK4A) promoter through an ETS binding site and their patterns of expression during the lifespan of human diploid fibroblasts. The induction of p16(INK4A) by ETS2, which is abundant in young human diploid fibroblasts, is potentiated by signaling through the Ras-Raf-MEK kinase cascade and inhibited by a direct interaction with the helix-loop-helix protein ID1 (OMIM Ref. No. 600349). In senescent cells, where the ETS2 levels and MEK signaling decline, the marked increase in p16(INK4A) expression is consistent with the reciprocal reduction of ID1 and accumulation of ETS1. Animal model experiments lend further support to the function of ETS2. Sumarsono et al. (1996) generated transgenic mice to investigate the consequences of overexpression of Ets2. They found that mice with less than 2-fold Ets2 overexpression in particular organs developed neurocranial, visceral cranial, and cervical skeletal abnormalities. These abnormalities had similarities with the skeletal anomalies found in trisomy-16 mice and in human S with Down syndrome (OMIM Ref. No. 190685), in which the gene dosage of ETS2 is increased. The results were interpreted as indicating that ETS2 has a role in skeletal development and that overexpression is involved in the genesis of some skeletal abnormalities that occur in Down syndrome.

It is appreciated that the abovementioned animal model for ETS2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Le Beau, M. M.; Rowley, J. D.; Sacchi, N.; Watson, D. K.; Papas, T. S.; Diaz, M. O.: Hu-ets-2 is translocated to chromosome 8 in the t (8;21) in acute myelogenous leukemia. Cancer Genet. Cytogenet. 23:269-274, 1986; and Sumarsono, S. H.; Wilson, T. J.; Tymms, M. J.; Venter, D. J.; Corrick, C. M.; Kola, R.; Lahoud, M. H.; Papas, T. S.; Seth, A.; Kola, I.: Down's syndrome-like skeletal abnormalities in E.

Further studies establishing the function and utilities of ETS2 are found in John Hopkins OMIM database record ID 164740, and in sited publications numbered 11230-11231, 11042, 1123 and 11233-11045 listed in the bibliography section hereinbelow, which are also hereby incorporated by reference. Exostoses (multiple)-like 1 (EXTL1, Accession NM_004455) is another VGAM1958 host target gene. EXTL1 BINDING SITE is HOST TARGET binding site found in the 3' untranslated region of mRNA encoded by EXTL1, corresponding to a HOST TARGET binding site such as BINDING SITE I, BINDING SITE II or BINDING SITE III. Table 2 illustrates the complementarity of the nucleotide sequences of EXTL1 BINDING SITE, designated SEQ ID:10756, to the nucleotide sequence of VGAM1958 RNA, herein designated VGAM RNA, also designated SEQ ID:4669.

Another function of VGAM1958 is therefore inhibition of Exostoses (multiple)-like 1 (EXTL1, Accession NM_004455), a gene which probably contribute to the synthesis of heparan sulfate and heparin. Accordingly, utilities of VGAM1958 include diagnosis, prevention and treatment of diseases and clinical conditions associated with EXTL1. The function of EXTL1 and its association with various diseases and clinical conditions, has been established by previous studies, as described hereinabove with reference to VGAM806. Exostoses (multiple)-like 2 (EXTL2, Accession NM_001439) is another VGAM1958 host target gene. EXTL2 BINDING SITE is HOST TARGET binding site found in the 3' untranslated region of mRNA encoded by EXTL2, corresponding to a HOST TARGET binding site such as BINDING SITE I, BINDING SITE II or BINDING SITE III. Table 2 illustrates the complementarity of the nucleotide sequences of EXTL2 BINDING SITE, designated SEQ ID:7162, to the nucleotide sequence of VGAM1958 RNA, herein designated VGAM RNA, also designated SEQ ID:4669.

Another function of VGAM1958 is therefore inhibition of Exostoses (multiple)-like 2 (EXTL2, Accession NM_001439), a gene which is homologous to the EXT and EXTL genes. Accordingly, utilities of VGAM1958 include diagnosis, prevention and treatment of diseases and clinical conditions associated with EXTL2. The function of EXTL2 and its association with various diseases and clinical conditions, has been established by previous studies, as described hereinabove with reference to VGAM743. Fanconi Anemia, Complementation Group F (FANCF, Accession NM_022725) is another VGAM1958 host target gene. FANCF BINDING SITE is HOST TARGET binding site found in the 3' untranslated region of mRNA encoded by FANCF, corresponding to a HOST TARGET binding site such as BINDING SITE I, BINDING SITE II or BINDING SITE III. Table 2 illustrates the complementarity of the nucleotide sequences of FANCF BINDING SITE, designated SEQ ID:22925, to the nucleotide sequence of VGAM1958 RNA, herein designated VGAM RNA, also designated SEQ ID:4669.

Another function of VGAM1958 is therefore inhibition of Fanconi Anemia, Complementation Group F (FANCF, Accession NM_022725). Accordingly, utilities of VGAM1958 include diagnosis, prevention and treatment of diseases and clinical conditions associated with FANCF. Fibroblast Growth Factor 1 (acidic) (FGF1, Accession NM_000800) is another VGAM1958 host target gene. FGF1 BINDING SITE1 through FGF1 BINDING SITE3 are HOST TARGET binding sites found in untranslated regions of mRNA encoded by FGF1, corresponding to HOST TARGET binding sites such as BINDING SITE I, BINDING SITE II or BINDING SITE III. Table 2 illustrates the complementarity of the nucleotide sequences of FGF1 BINDING SITE1 through FGF1 BINDING SITE3, designated SEQ ID:6470, SEQ ID:26987 and SEQ ID:26989 respectively, to the nucleotide sequence of VGAM1958 RNA, herein designated VGAM RNA, also designated SEQ ID:4669.

Another function of VGAM1958 is therefore inhibition of Fibroblast Growth Factor 1 (acidic) (FGF1, Accession NM_000800), a gene which potent mitogen for a variety of cell types. Accordingly, utilities of VGAM1958 include diagnosis, prevention and treatment of diseases and clinical conditions associated with FGF1. The function of FGF1 has been established by previous studies. The endothelium, which consists of a single cell layer, protects blood vessels from thrombogenesis. Endothelial cell growth factor is a modifier of endothelial cell migration and proliferation and thus may be important in neovascularization. From a human brain stem cDNA library, Jaye et al. (1986) isolated 2 overlapping clones encoding ECGF. Southern blot analysis suggested that there is a single copy of the ECGF gene. In DNA from human-rodent hybrid cells, the probes showed 100% concordance with chromosome 5 and 98% concordance with HEXB (OMIM Ref. No. 606873), a chromosome 5 marker. The complete amino acid sequence was deduced from the nucleic acid sequence of these clones. The structure of the gene shows similarities to that of interleukin-1 (OMIM Ref. No. 147720) with which it is about 30% homologous. To elucidate the structural determinants governing specificity in FGF signaling, Plotnikov et al. (2000) determined the crystal structures of FGF1 and FGF2 complexed with the immunoglobulin-like ligand-binding domains 2 and 3 (D2 and D3) of FGFR1 and FGFR2 (OMIM Ref. No. 176943), respectively. They found that highly conserved FGF-D2 and FGF-linker (between D2 and D3) interfaces define a general binding site for all FGF-FGFR complexes. Specificity is achieved through interactions between the N-terminal and central regions of FGFs and 2 loop regions in D3 that are subject to alternative splicing. These structures provide a molecular basis for FGF1 as a universal FGFR ligand and for modulation of FGF-FGFR specificity through primary sequence variations and alternative splicing. Pellegrini et al. (2000) reported the crystal structure of the FGFR2 ectodomain in a dimeric form that is induced by simultaneous binding to FGF1 and a heparin decasaccharide. The complex is assembled around a central heparin molecule linking 2 FGF1 ligands into a dimer that bridges between 2 receptor chains. The asymmetric heparin binding involves contacts with both FGF1 molecules but only 1 receptor chain. The structure of the FGF1-FGFR2-heparin ternary complex provides a structural basis for the essential role of heparan sulfate in FGF signaling.

Full details of the abovementioned studies are described in the following publications, the disclosure of which are hereby incorporated by reference:

Plotnikov, A. N.; Hubbard, S. R.; Schlessinger, J.; Mohammadi, M.: Crystal structures of two FGF-FGFR complexes reveal the determinants of ligand-receptor specificity. Cell 101:413-424, 2000; and Pellegrini, L.; Burke, D. F.; von Delft, F.; Mulloy, B.; Blundell, T. L.: Crystal structure of fibroblast growth factor receptor ectodomain bound to ligand and heparin. Nature 407:102.

Further studies establishing the function and utilities of FGF1 are found in John Hopkins OMIM database record ID 131220, and in sited publications numbered 11813-11817, 1166 and 11818-11821 listed in the bibliography section hereinbelow, which are also hereby incorporated by reference. Fragile X Mental Retardation 1 (FMR1, Accession NM_002024) is another VGAM1958 host target gene. FMR1 BINDING SITE is HOST TARGET binding site found in the 3' untranslated region of mRNA encoded by FMR1, corresponding to a HOST TARGET binding site such as BINDING SITE I, BINDING SITE II or BINDING SITE III. Table 2 illustrates the complementarity of the nucleotide sequences of FMR1 BINDING SITE, designated SEQ ID:7777, to the nucleotide sequence of VGAM1958 RNA, herein designated VGAM RNA, also designated SEQ ID:4669.

Another function of VGAM1958 is therefore inhibition of Fragile X Mental Retardation 1 (FMR1, Accession NM_002024). Accordingly, utilities of VGAM1958 include diagnosis, prevention and treatment of diseases and clinical conditions associated with FMR1. FBJ Murine Osteosarcoma Viral Oncogene Homolog B (FOSB, Accession NM_006732) is another VGAM1958 host target gene. FOSB BINDING SITE is HOST TARGET binding site found in the 5' untranslated region of mRNA encoded by FOSB, corresponding to a HOST TARGET binding site such as BINDING SITE I, BINDING SITE II or BINDING SITE III. Table 2 illustrates the complementarity of the nucleotide sequences of FOSB BINDING SITE, designated SEQ ID:13581, to the nucleotide sequence of VGAM1958 RNA, herein designated VGAM RNA, also designated SEQ ID:4669.

Another function of VGAM1958 is therefore inhibition of FBJ Murine Osteosarcoma Viral Oncogene Homolog B (FOSB, Accession NM_006732), a gene which interacts with jun proteins enhancing their dna binding activity. Accordingly, utilities of VGAM1958 include diagnosis, prevention and treatment of diseases and clinical conditions associated with FOSB. The function of FOSB and its association with various diseases and clinical conditions, has been established by previous studies, as described hereinabove with reference to VGAM747. Forkhead Box I1 (FOXI1, Accession NM_012188) is another VGAM1958 host target gene. FOXI1 BINDING SITE is HOST TARGET binding site found in the 3' untranslated region of mRNA encoded by FOXI1, corresponding to a HOST TARGET binding site such as BINDING SITE I, BINDING SITE II or BINDING SITE III. Table 2 illustrates the complementarity of the nucleotide sequences of FOXI1 BINDING SITE, designated SEQ ID:14474, to the nucleotide sequence of VGAM1958 RNA, herein designated VGAM RNA, also designated SEQ ID:4669.

Another function of VGAM1958 is therefore inhibition of Forkhead Box I1 (FOXI1, Accession NM_012188), a gene which plays an important role in the development of the cochlea and vestibulum, as well as embryogenesis. Accordingly, utilities of VGAM1958 include diagnosis, prevention and treatment of diseases and clinical conditions associated with FOXI1. The function of FOXI1 and its association with various diseases and clinical conditions, has been established by previous studies, as described hereinabove with reference to VGAM1107. Thyroid Autoantigen 70 kDa (Ku antigen) (G22P1, Accession NM_001469) is another VGAM1958 host target gene. G22P1 BINDING SITE is HOST TARGET binding site found in the 5' untranslated region of mRNA encoded by G22P1, corresponding to a HOST TARGET binding site such as BINDING SITE I, BINDING SITE II or BINDING SITE III. Table 2 illustrates the complementarity of the nucleotide sequences of G22P1 BINDING SITE, designated SEQ ID:7203, to the nucleotide sequence of VGAM1958 RNA, herein designated VGAM RNA, also designated SEQ ID:4669.

Another function of VGAM1958 is therefore inhibition of Thyroid Autoantigen 70 kDa (Ku antigen) (G22P1, Accession NM_001469), a gene which has a role in chromosome translocation. Accordingly, utilities of VGAM1958 include diagnosis, prevention and treatment of diseases and clinical conditions associated with G22P1. The function of G22P1 and its association with various diseases and clinical conditions, has been established by previous studies, as described hereinabove with reference to VGAM1052. Glucose-6-phosphatase, Catalytic (glycogen storage disease type I, von Gierke disease) (G6PC, Accession NM_000151) is another VGAM1958 host target gene. G6PC BINDING SITE is HOST TARGET binding site found in the 3' untranslated region of mRNA encoded by G6PC, corresponding to a HOST TARGET binding site such as BINDING SITE I, BINDING SITE II or BINDING SITE III. Table 2 illustrates the complementarity of the nucleotide sequences of G6PC BINDING SITE, designated SEQ ID:5660, to the nucleotide sequence of VGAM1958 RNA, herein designated VGAM RNA, also designated SEQ ID:4669.

Another function of VGAM1958 is therefore inhibition of Glucose-6-phosphatase, Catalytic (glycogen storage disease type I, von Gierke disease) (G6PC, Accession NM_000151). Accordingly, utilities of VGAM1958 include diagnosis, prevention and treatment of diseases and clinical conditions associated with G6PC. UDP-N-acetyl-alpha-D-galactosamine:polypeptide N-acetylgalactosaminyltransferase 2 (GalNAc-T2) (GALNT2, Accession NM_004481) is another VGAM1958 host target gene. GALNT2 BINDING SITE is HOST TARGET binding site found in the 3' untranslated region of mRNA encoded by GALNT2, corresponding to a HOST TARGET binding site such as BINDING SITE I, BINDING SITE II or BINDING SITE III. Table 2 illustrates the complementarity of the nucleotide sequences of GALNT2 BINDING SITE, designated SEQ ID:10797, to the nucleotide sequence of VGAM1958 RNA, herein designated VGAM RNA, also designated SEQ ID:4669.

Another function of VGAM1958 is therefore inhibition of UDP-N-acetyl-alpha-D-galactosamine:polypeptide N-acetylgalactosaminyltransferase 2 (GalNAc-T2) (GALNT2, Accession NM_004481), a gene which catalyzes the initial reaction in o-linked oligosaccharide biosynthesis. Accordingly, utilities of VGAM1958 include diagnosis, prevention and treatment of diseases and clinical conditions associated with GALNT2. The function of GALNT2 and its association with various diseases and clinical conditions, has been established by previous studies, as described hereinabove with reference to VGAM187. Glycoprotein A Repetitions Predominant (GARP, Accession NM_005512) is another VGAM1958 host target gene. GARP BINDING SITE is HOST TARGET binding site found in the 3' untranslated region of mRNA encoded by GARP, corresponding to a HOST TARGET binding site such as BINDING SITE I, BINDING SITE II or BINDING SITE III. Table 2 illustrates the complementarity of the nucleotide sequences of GARP BINDING SITE, designated SEQ ID:12033, to the nucleotide sequence of VGAM1958 RNA, herein designated VGAM RNA, also designated SEQ ID:4669.

Another function of VGAM1958 is therefore inhibition of Glycoprotein A Repetitions Predominant (GARP, Accession NM_005512). Accordingly, utilities of VGAM1958 include diagnosis, prevention and treatment of diseases and clinical conditions associated with GARP. GCN1 General Control of Amino-acid Synthesis 1-like 1 (yeast) (GCN1L1, Accession XM_045792) is another VGAM1958 host target gene. GCN1L1 BINDING SITE is HOST TARGET binding site found in the 3' untranslated region of mRNA encoded by GCN1L1, corresponding to a HOST TARGET binding site such as BINDING SITE I, BINDING SITE II or BINDING SITE III. Table 2 illustrates the complementarity of the nucleotide sequences of GCN1L1 BINDING SITE, designated SEQ ID:34568, to the nucleotide sequence of VGAM1958 RNA, herein designated VGAM RNA, also designated SEQ ID:4669.

Another function of VGAM1958 is therefore inhibition of GCN1 General Control of Amino-acid Synthesis 1-like 1 (yeast) (GCN1L1, Accession XM_045792), a gene which performs an EF3-related function on the ribosome by regulating GCN2 kinase activity. Accordingly, utilities of VGAM1958 include diagnosis, prevention and treatment of diseases and clinical conditions associated with GCN1L1. The function of GCN1L1 and its association with various diseases and clinical conditions, has been established by previous studies, as described hereinabove with reference to VGAM1438. Glucagon-like Peptide 1 Receptor (GLP1R, Accession NM_002062) is another VGAM1958 host target gene. GLP1R BINDING SITE is HOST TARGET binding site found in the 3' untranslated region of mRNA encoded by GLP1R, corresponding to a HOST TARGET binding site such as BINDING SITE I, BINDING SITE II or BINDING SITE III. Table 2 illustrates the complementarity of the nucleotide sequences of GLP1R BINDING SITE, designated SEQ ID:7828, to the nucleotide sequence of VGAM1958 RNA, herein designated VGAM RNA, also designated SEQ ID:4669.

Another function of VGAM1958 is therefore inhibition of Glucagon-like Peptide 1 Receptor (GLP1R, Accession NM_002062), a gene which is mediated by g proteins which activate adenylyl cyclase. Accordingly, utilities of VGAM1958 include diagnosis, prevention and treatment of diseases and clinical conditions associated with GLP1R. The function of GLP1R and its association with various diseases and clinical conditions, has been established by previous studies, as described hereinabove with reference to VGAM1652. Glutaminase (GLS, Accession NM_014905) is another VGAM1958 host target gene. GLS BINDING SITE is HOST TARGET binding site found in the 3' untranslated region of mRNA encoded by GLS, corresponding to a HOST TARGET binding site such as BINDING SITE I, BINDING SITE II or BINDING SITE III. Table 2 illustrates the complementarity of the nucleotide sequences of GLS BINDING SITE, designated SEQ ID:17104, to the nucleotide sequence of VGAM1958 RNA, herein designated VGAM RNA, also designated SEQ ID:4669.

Another function of VGAM1958 is therefore inhibition of Glutaminase (GLS, Accession NM_014905). Accordingly, utilities of VGAM1958 include diagnosis, prevention and treatment of diseases and clinical conditions associated with GLS. Glutamate-ammonia Ligase (glutamine synthase) (GLUL, Accession NM_002065) is another VGAM1958 host target gene. GLUL BINDING SITE is HOST TARGET binding site found in the 3' untranslated region of mRNA encoded by GLUL, corresponding to a HOST TARGET binding site such as BINDING SITE I, BINDING SITE II or BINDING SITE III. Table 2 illustrates the complementarity of the nucleotide sequences of GLUL BINDING SITE, designated SEQ ID:7836, to the nucleotide sequence of VGAM1958 RNA, herein designated VGAM RNA, also designated SEQ ID:4669.

Another function of VGAM1958 is therefore inhibition of Glutamate-ammonia Ligase (glutamine synthase) (GLUL, Accession NM_002065), a gene which catalyzes the condensation of glutamate and ammonia to form glutamine. Accordingly, utilities of VGAM1958 include diagnosis, prevention and treatment of diseases and clinical conditions associated with GLUL. The function of GLUL and its association with various diseases and clinical conditions, has been established by previous studies, as described hereinabove with reference to VGAM948. Glypican 1 (GPC1, Accession NM_002081) is another VGAM1958 host target gene. GPC1 BINDING SITE is HOST TARGET binding site found in the 3' untranslated region of mRNA encoded by GPC1, corresponding to a HOST TARGET binding site such as BINDING SITE I, BINDING SITE II or BINDING SITE III. Table 2 illustrates the complementarity of the nucleotide sequences of GPC1 BINDING SITE, designated SEQ ID:7868, to the nucleotide sequence of VGAM1958 RNA, herein designated VGAM RNA, also designated SEQ ID:4669.

Another function of VGAM1958 is therefore inhibition of Glypican 1 (GPC1, Accession NM_002081), a gene which may play a role in growth control and differentation. Accordingly, utilities of VGAM1958 include diagnosis, prevention and treatment of diseases and clinical conditions associated with GPC1. The function of GPC1 and its association with various diseases and clinical conditions, has been established by previous studies, as described hereinabove with reference to VGAM125. G Protein-coupled Receptor 61 (GPR61, Accession XM_086232) is another VGAM1958 host target gene. GPR61 BINDING SITE is HOST TARGET binding site found in the 3' untranslated region of mRNA encoded by GPR61, corresponding to a HOST TARGET binding site such as BINDING SITE I, BINDING SITE II or BINDING SITE III. Table 2 illustrates the complementarity of the nucleotide sequences of GPR61 BINDING SITE, designated SEQ ID:38563, to the nucleotide sequence of VGAM1958 RNA, herein designated VGAM RNA, also designated SEQ ID:4669.

Another function of VGAM1958 is therefore inhibition of G Protein-coupled Receptor 61 (GPR61, Accession XM_086232), a gene which transduces extracellular signals through heterotrimeric G proteins. Accordingly, utilities of VGAM1958 include diagnosis, prevention and treatment of diseases and clinical conditions associated with GPR61. The function of GPR61 has been established by previous studies. By PCR of genomic DNA, Lee et al. (2001) obtained a partial GPR61 clone using primers designed from the sequence of a rabbit G protein-coupled receptor (GPCR). They used the PCR products to screen a human brain cDNA library and found that GPR61 encodes a 417-amino acid protein that shares over 80% identity with the rabbit homolog and 44% similarity with GPR62 (OMIM Ref. No. 606917) in the transmembrane region. By Northern blot analysis of human brain areas, Lee et al. (2001) detected a 4.3-kb transcript in caudate, putamen, and thalamus, but not in hypothalamus, hippocampus, pons, frontal cortex, or cerebellum. No expression was found in liver or kidney. Lee et al. (2001) also cloned rat GPR61 and, by in situ hybridization, found widespread expression in rat brain. Cikos et al. (2001) independently cloned GPR61, which they called BALGR. A partial sequence was obtained by RT-PCR of human brain mRNA using degenerate oligonucleotides corresponding to a transmembrane sequence of GPR30 (OMIM Ref. No. 601805). They cloned the full-length cDNA from a hypothalamus cDNA library. They found that the deduced protein contains 451 amino acids and has a calculated molecular mass of about 49 kD. GPR61 contains 7 putative transmembrane domains, a potential N-glycosylation site, cysteine residues that may form a disulfide bridge, and several putative protein kinase sites. It also contains a conserved glu-arg-tyr sequence shared with other GPCRs. The highest sequence similarity (OMIM Ref. No. 28-31%) was found with biogenic amine GPCRs, i.e., serotonin, histamine, adrenergic, and dopamine GPCRs. By semiquantitative PCR of multiple human tissues, Cikos et al. (2001) found highest expression in brain and testes and low but detectable expression in all other tissues examined. Their results of Northern blot analysis of human brain regions differed from that reported by Lee et al. (2001). Strong expression of a 4.8-kb transcript was found in cerebral cortex, occipital pole, frontal lobe, temporal lobe, amygdala, and hippocampus, and lower expression in putamen and caudate nucleus. No message was detected in cerebellum, medulla oblongata, spinal cord, corpus callosum, substantia nigra, subthalamic nucleus, or thalamus.

Full details of the abovementioned studies are described in the following publications, the disclosure of which are hereby incorporated by reference:

Cikos, S.; Gregor, P.; Koppel, J.: Cloning of a novel biogenic amine receptor-like G protein-coupled receptor expressed in human brain. Biochim. Biophys. Acta 1521:66-72, 2001; and Lee, D. K.; George, S. R.; Cheng, R.; Nguyen, T.; Liu, Y.; Brown, M.; Lynch, K. R.; O'Dowd, B. F.: Identification of four novel human G protein-coupled receptors expressed in the brai.

Further studies establishing the function and utilities of GPR61 are found in John Hopkins OMIM database record ID 606916, and in sited publications numbered 5504 listed in the bibliography section hereinbelow, which are also hereby incorporated by reference. Growth Factor Receptor-bound Protein 10 (GRB10, Accession NM_005311) is another VGAM1958 host target gene. GRB10 BINDING SITE is HOST TARGET binding site found in the 3' untranslated region of mRNA encoded by GRB10, corresponding to a HOST TARGET binding site such as BINDING SITE I, BINDING SITE II or BINDING SITE III. Table 2 illustrates the complementarity of the nucleotide sequences of GRB10 BINDING SITE, designated SEQ ID:11786, to the nucleotide sequence of VGAM1958 RNA, herein designated VGAM RNA, also designated SEQ ID:4669.

Another function of VGAM1958 is therefore inhibition of Growth Factor Receptor-bound Protein 10 (GRB10, Accession NM_005311), a gene which plays a functional role in insulin and IGF-I signaling. Accordingly, utilities of VGAM1958 include diagnosis, prevention and treatment of diseases and clinical conditions associated with GRB10. The function of GRB10 and its association with various diseases and clinical conditions, has been established by previous studies, as described hereinabove with reference to VGAM441. Guanine Nucleotide-releasing Factor 2 (specific for crk proto-oncogene) (GRF2, Accession NM_005312) is another VGAM1958 host target gene. GRF2 BINDING SITE is HOST TARGET binding site found in the 3' untranslated region of mRNA encoded by GRF2, corresponding to a HOST TARGET binding site such as BINDING SITE I, BINDING SITE II or BINDING SITE III. Table 2 illustrates the complementarity of the nucleotide sequences of GRF2 BINDING SITE, designated SEQ ID:11789, to the nucleotide sequence of VGAM1958 RNA, herein designated VGAM RNA, also designated SEQ ID:4669.

Another function of VGAM1958 is therefore inhibition of Guanine Nucleotide-releasing Factor 2 (specific for crk proto-oncogene) (GRF2, Accession NM_005312), a gene which promotes the exchange of ras-bound gdp by gtp. Accordingly, utilities of VGAM1958 include diagnosis, prevention and treatment of diseases and clinical conditions associated with GRF2. The function of GRF2 has been established by previous studies. C3G is a guanine nucleotide-releasing protein (GNRP) identified as a CRK (OMIM Ref. No. 164762) SH3-binding protein. Tanaka et al. (1994) suggested that the complex of C3G and CRK or C3G and GRB2/ASH (OMIM Ref. No. 108355) transduces signals from tyrosine kinases to RAS in a number of different tissues. Using fluorescence in situ hybridization, Takai et al. (1994) mapped the GRF2 gene to 9q34.3, where chromosomal changes have been reported in human hematopoietic malignancies.

Full details of the abovementioned studies are described in the following publications, the disclosure of which are hereby incorporated by reference:

Takai, S.; Tanaka, M.; Sugimura, H.; Yamada, K.; Naito, Y.; Kino, I.; Matsuda, M.: Mapping of the human C3G gene coding a guanine nucleotide releasing protein for Ras family to 9q34.3 by fluorescence in situ hybridization. Hum. Genet. 94:549-550, 1994; and Tanaka, S.; Morishita, T.; Hashimoto, Y.; Hattori, S.; Nakamura, S.; Shibuya, M.; Matsuoka, K.; Takenawa, T.; Kurata, T.; Nagashima, K.; Matsuda, M.: C3G, a guanine nucleotide-releasin.

Further studies establishing the function and utilities of GRF2 are found in John Hopkins OMIM database record ID 600303, and in sited publications numbered 1594-1595 listed in the bibliography section hereinbelow, which are also hereby incorporated by reference. Glutamate Receptor, Metabotropic 7 (GRM7, Accession NM_000844) is another VGAM1958 host target gene. GRM7 BINDING SITE is HOST TARGET binding site found in the 3' untranslated region of mRNA encoded by GRM7, corresponding to a HOST TARGET binding site such as BINDING SITE I, BINDING SITE II or BINDING SITE III. Table 2 illustrates the complementarity of the nucleotide sequences of GRM7 BINDING SITE, designated SEQ ID:6514, to the nucleotide sequence of VGAM1958 RNA, herein designated VGAM RNA, also designated SEQ ID:4669.

Another function of VGAM1958 is therefore inhibition of Glutamate Receptor, Metabotropic 7 (GRM7, Accession NM_000844), a gene which is mediated by a g-protein that inhibits adenylate cyclase activity. Accordingly, utilities of VGAM1958 include diagnosis, prevention and treatment of diseases and clinical conditions associated with GRM7. The function of GRM7 and its association with various diseases and clinical conditions, has been established by previous studies, as described hereinabove with reference to VGAM746. Guanylate Cyclase 1, Soluble, Beta 2 (GUCY1B2, Accession NM_004129) is another VGAM1958 host target gene. GUCY1B2 BINDING SITE is HOST TARGET binding site found in the 3' untranslated region of mRNA encoded by GUCY1B2, corresponding to a HOST TARGET binding site such as BINDING SITE I, BINDING SITE II or BINDING SITE III. Table 2 illustrates the complementarity of the nucleotide sequences of GUCY1B2 BINDING SITE, designated SEQ ID:10334, to the nucleotide sequence of VGAM1958 RNA, herein designated VGAM RNA, also designated SEQ ID:4669.

Another function of VGAM1958 is therefore inhibition of Guanylate Cyclase 1, Soluble, Beta 2 (GUCY1B2, Accession NM_004129), a gene which is beta 2 subunit of soluble guanylate cyclase which converts GTP into the second messenger cGMP and plays a major role in the cardiovascular system as a receptor for nitric oxide. Accordingly, utilities of VGAM1958 include diagnosis, prevention and treatment of diseases and clinical conditions associated with GUCY1B2. The function of GUCY1B2 and its association with various diseases and clinical conditions, has been established by previous studies, as described hereinabove with reference to VGAM379. Glycogen Synthase 1 (muscle) (GYS1, Accession XM_114024) is another VGAM1958 host target gene. GYS1 BINDING SITE is HOST TARGET binding site found in the 3' untranslated region of mRNA encoded by GYS1, corresponding to a HOST TARGET binding site such as BINDING SITE I, BINDING SITE II or BINDING SITE III. Table 2 illustrates the complementarity of the nucleotide sequences of GYS1 BINDING SITE, designated SEQ ID:42624, to the nucleotide sequence of VGAM1958 RNA, herein designated VGAM RNA, also designated SEQ ID:4669.

Another function of VGAM1958 is therefore inhibition of Glycogen Synthase 1 (muscle) (GYS1, Accession XM_114024), a gene which transfers the glycosyl residue from udp-glc to the nonreducing end of alpha-1,4-glucan. Accordingly, utilities of VGAM1958 include diagnosis, prevention and treatment of diseases and clinical conditions associated with GYS1. The function of GYS1 and its association with various diseases and clinical conditions, has been established by previous studies, as described hereinabove with reference to VGAM1323. L-3-hydroxyacyl-Coenzyme A Dehydrogenase, Short Chain (HADHSC, Accession NM_005327) is another VGAM1958 host target gene. HADHSC BINDING SITE is HOST TARGET binding site found in the 3' untranslated region of mRNA encoded by HADHSC, corresponding to a HOST TARGET binding site such as BINDING SITE I, BINDING SITE II or BINDING SITE III. Table 2 illustrates the complementarity of the nucleotide sequences of HADHSC BINDING SITE, designated SEQ ID:11798, to the nucleotide sequence of VGAM1958 RNA, herein designated VGAM RNA, also designated SEQ ID:4669.

Another function of VGAM1958 is therefore inhibition of L-3-hydroxyacyl-Coenzyme A Dehydrogenase, Short Chain (HADHSC, Accession NM_005327). Accordingly, utilities of VGAM1958 include diagnosis, prevention and treatment of diseases and clinical conditions associated with HADHSC. Huntingtin-associated Protein 1 (neuroan 1) (HAP1, Accession NM_003949) is another VGAM1958 host target gene. HAP1 BINDING SITE is HOST TARGET binding site found in the 3' untranslated region of mRNA encoded by HAP1, corresponding to a HOST TARGET binding site such as BINDING SITE I, BINDING SITE II or BINDING SITE III. Table 2 illustrates the complementarity of the nucleotide sequences of HAP1 BINDING SITE, designated SEQ ID:10075, to the nucleotide sequence of VGAM1958 RNA, herein designated VGAM RNA, also designated SEQ ID:4669.

Another function of VGAM1958 is therefore inhibition of Huntingtin-associated Protein 1 (neuroan 1) (HAP1, Accession NM_003949), a gene which functions as an adaptor protein using coiled coils to mediate interactions among cytoskeletal, vascular, and motor proteins. Accordingly, utilities of VGAM1958 include diagnosis, prevention and treatment of diseases and clinical conditions associated with HAP1. The function of HAP1 and its association with various diseases and clinical conditions, has been established by previous studies, as described hereinabove with reference to VGAM126. Holocytochrome C Synthase (cytochrome c heme-lyase) (HCCS, Accession NM_005333) is another VGAM1958 host target gene. HCCS BINDING SITE is HOST TARGET binding site found in the 5' untranslated region of mRNA encoded by HCCS, corresponding to a HOST TARGET binding site such as BINDING SITE I, BINDING SITE II or BINDING SITE III. Table 2 illustrates the complementarity of the nucleotide sequences of HCCS BINDING SITE, designated SEQ ID:11806, to the nucleotide sequence of VGAM1958 RNA, herein designated VGAM RNA, also designated SEQ ID:4669.

Another function of VGAM1958 is therefore inhibition of Holocytochrome C Synthase (cytochrome c heme-lyase) (HCCS, Accession NM_005333), a gene which catalyzes the covalent addition of a heme group onto c-type cytochromes in mitochondria. Accordingly, utilities of VGAM1958 include diagnosis, prevention and treatment of diseases and clinical conditions associated with HCCS. The function of HCCS has been established by previous studies. Microphthalmia with linear skin defects syndrome (MLS; 309801) is an X-linked male-lethal disorder associated with X-chromosomal rearrangements resulting in monosomy from Xpter to Xp22. Features include microphthalmia, sclerocornea, linear skin defects, and agenesis of the corpus callosum. Using a cross-species conservation strategy, Schaefer et al. (1996) isolated an expressed sequence from the 450- to 550-kb MLS critical region on Xp22 by screening a human embryo cDNA library. Northern analysis demonstrated a transcript of approximately 2.6 kb in all tissues examined, with weaker expression of 1.2- and 5.2-kb transcripts. The strongest expression was observed in heart and skeletal muscle. Sequence analysis of a 3-kb cDNA contig revealed an 807-bp open reading frame encoding a putative 268-amino acid protein. Comparison of the sequence with sequences in databases revealed homology with holocytochrome c-type synthetases, which catalyze the covalent addition of a heme group onto c-type cytochromes in mitochondria. The c-type cytochromes are required for proper functioning of the electron transport pathway. The human gene, symbolized HCCS, and the corresponding murine gene characterized by Schaefer et al. (1996) share 83% nucleotide sequence identity and 85% amino acid identity. The authors stated that, because of the lack of a neuromuscular phenotype in MLS, it is uncertain how the deletion of a mitochondrial holocytochrome synthetase would contribute to phenotype seen in MLS. The expression pattern of the gene and knowledge of the function of holocytochrome synthetases suggested, however, that it is a good candidate for X-linked encephalomyopathies typically associated with mitochondrial dysfunction. Based on its chromosomal location and its role in the mitochondrial respiratory chain, HCCS was considered a candidate gene for Rett syndrome (RTT; 312750). The genomic structure of the gene, which occupies an 11-kb region and consists of 7 exons, was determined. No mutational abnormality of the gene was found in 20 RTT patients (Van den Veyver et al., 1998).

Full details of the abovementioned studies are described in the following publications, the disclosure of which are hereby incorporated by reference:

Schaefer, L.; Ballabio, A.; Zoghbi, H. Y.: Cloning and characterization of a putative human holocytochrome c-type synthetase gene (HCCS) isolated from the critical region for microphthalmia with linear skin defects (MLS). Genomics 34:166-172, 1996; and Van den Veyver, I. B.; Subramanian, S.; Zoghbi, H. Y.: Genomic structure of a human holocytochrome c-type synthetase gene in Xp22.3 and mutation analysis in patients with Rett syndrome.

Further studies establishing the function and utilities of HCCS are found in John Hopkins OMIM database record ID 300056, and in sited publications numbered 9005-9006 listed in the bibliography section hereinbelow, which are also hereby incorporated by reference. Histone Deacetylase 5 (HDAC5, Accession NM_139205) is another VGAM1958 host target gene. HDAC5 BINDING SITE is HOST TARGET binding site found in the 3' untranslated region of mRNA encoded by HDAC5, corresponding to a HOST TARGET binding site such as BINDING SITE I, BINDING SITE II or BINDING SITE III. Table 2 illustrates the complementarity of the nucleotide sequences of HDAC5 BINDING SITE, designated SEQ ID:29223, to the nucleotide sequence of VGAM1958 RNA, herein designated VGAM RNA, also designated SEQ ID:4669.

Another function of VGAM1958 is therefore inhibition of Histone Deacetylase 5 (HDAC5, Accession NM_139205), a gene which is responsible for the deacetylation of lysine residues on the n-terminal part of the core histones and mediate transcriptional regulation. Accordingly, utilities of VGAM1958 include diagnosis, prevention and treatment of diseases and clinical conditions associated with HDAC5. The function of HDAC5 and its association with various diseases and clinical conditions, has been established by previous studies, as described hereinabove with reference to VGAM263. Hepatoma-derived Growth Factor (high-mobility group protein 1-like) (HDGF, Accession NM_004494) is another VGAM1958 host target gene. HDGF BINDING SITE is HOST TARGET binding site found in the 3' untranslated region of mRNA encoded by HDGF, corresponding to a HOST TARGET binding site such as BINDING SITE I, BINDING SITE II or BINDING SITE III. Table 2 illustrates the complementarity of the nucleotide sequences of HDGF BINDING SITE, designated SEQ ID:10830, to the nucleotide sequence of VGAM1958 RNA, herein designated VGAM RNA, also designated SEQ ID:4669.

Another function of VGAM1958 is therefore inhibition of Hepatoma-derived Growth Factor (high-mobility group protein 1-like) (HDGF, Accession NM_004494), a gene which is a heparin-binding protein, with mitogenic activity for fibroblasts. Accordingly, utilities of VGAM1958 include diagnosis, prevention and treatment of diseases and clinical conditions associated with HDGF. The function of HDGF and its association with various diseases and clinical conditions, has been established by previous studies, as described hereinabove with reference to VGAM1929. Homeo Box B7 (HOXB7, Accession NM_004502) is another VGAM1958 host target gene. HOXB7 BINDING SITE is HOST TARGET binding site found in the 3' untranslated region of mRNA encoded by HOXB7, corresponding to a HOST TARGET binding site such as BINDING SITE I, BINDING SITE II or BINDING SITE III. Table 2 illustrates the complementarity of the nucleotide sequences of HOXB7 BINDING SITE, designated SEQ ID:10837, to the nucleotide sequence of VGAM1958 RNA, herein designated VGAM RNA, also designated SEQ ID:4669.

Another function of VGAM1958 is therefore inhibition of Homeo Box B7 (HOXB7, Accession NM_004502), a gene which is a member of homeodomain family of DNA binding proteins; may regulate gene expression, morphogenesis, and differentiation. Accordingly, utilities of VGAM1958 include diagnosis, prevention and treatment of diseases and clinical conditions associated with HOXB7. The function of HOXB7 has been established by previous studies. In mouse, Hoxb7 expression is confined to macrophages. Using RT-PCR, Lill et al. (1995) detected expression of HOXB7 in monocytes differentiated from HL60 cells by stimulation with vitamin D3. Overexpression of HOXB7 inhibited differentiation into granulocytes but not monocytes. However, RT-PCR analysis failed to detect HOXB7 expression in mature monocytes. HOX proteins have a conserved DNA-binding homeodomain, a pentapeptide motif that mediates interactions with PBX proteins (e.g., PBX1; 176310), and an N-terminal octapeptide motif. Yaron et al. (2001) found that wildtype HOXB7 inhibited differentiation of a murine myelomonocytic cell line, 32D, but that mutations in any of the conserved regions blocked this inhibitory effect. Mutations in casein kinase phosphorylation sites, the glutamate-rich C terminus, or the N-terminal 14 residues of HOXB7 enhanced 32D differentiation.

Full details of the abovementioned studies are described in the following publications, the disclosure of which are hereby incorporated by reference:

Lill, M. C.; Fuller, J. F.; Herzig, R.; Crooks, G. M.; Gasson, J. C.: The role of the homeobox gene, HOX B7, in human myelomonocytic differentiation. Blood 85:692-697, 1995; and Yaron, Y.; McAdara, J. K.; Lynch, M.; Hughes, E.; Gasson, J. C.: Identification of novel functional regions important for the activity of HOXB7 in mammalian cells. J. Immun. 166: 5058-5.

Further studies establishing the function and utilities of HOXB7 are found in John Hopkins OMIM database record ID 142962, and in sited publications numbered 5207-2659 listed in the bibliography section hereinbelow, which are also hereby incorporated by reference. Homeo Box C5 (HOXC5, Accession NM_018953) is another VGAM1958 host target gene. HOXC5 BINDING SITE is HOST TARGET binding site found in the 3' untranslated region of mRNA encoded by HOXC5, corresponding to a HOST TARGET binding site such as BINDING SITE I, BINDING SITE II or BINDING SITE III. Table 2 illustrates the complementarity of the nucleotide sequences of HOXC5 BINDING SITE, designated SEQ ID:21021, to the nucleotide sequence of VGAM1958 RNA, herein designated VGAM RNA, also designated SEQ ID:4669.

Another function of VGAM1958 is therefore inhibition of Homeo Box C5 (HOXC5, Accession NM_018953). Accordingly, utilities of VGAM1958 include diagnosis, prevention and treatment of diseases and clinical conditions associated with HOXC5. 5-hydroxytryptamine (serotonin) Receptor 2C (HTR2C, Accession NM_000868) is another VGAM1958 host target gene. HTR2C BINDING SITE is HOST TARGET binding site found in the 3' untranslated region of mRNA encoded by HTR2C, corresponding to a HOST TARGET binding site such as BINDING SITE I, BINDING SITE II or BINDING SITE III. Table 2 illustrates the complementarity of the nucleotide sequences of HTR2C BINDING SITE, designated SEQ ID:6531, to the nucleotide sequence of VGAM1958 RNA, herein designated VGAM RNA, also designated SEQ ID:4669.

Another function of VGAM1958 is therefore inhibition of 5-hydroxytryptamine (serotonin) Receptor 2C (HTR2C, Accession NM_000868), a gene which activates phospholipase C and regulates intracellular calcium flux. Accordingly, utilities of VGAM1958 include diagnosis, prevention and treatment of diseases and clinical conditions associated with HTR2C. The function of HTR2C and its association with various diseases and clinical conditions, has been established by previous studies, as described hereinabove with reference to VGAM1052. Islet Cell Autoantigen 1, 69 kDa (ICA1, Accession NM_022308) is another VGAM1958 host target gene. ICA1 BINDING SITE is HOST TARGET binding site found in the 3' untranslated region of mRNA encoded by ICA1, corresponding to a HOST TARGET binding site such as BINDING SITE I, BINDING SITE II or BINDING SITE III. Table 2 illustrates the complementarity of the nucleotide sequences of ICA1 BINDING SITE, designated SEQ ID:22738, to the nucleotide sequence of VGAM1958 RNA, herein designated VGAM RNA, also designated SEQ ID:4669.

Another function of VGAM1958 is therefore inhibition of Islet Cell Autoantigen 1, 69 kDa (ICA1, Accession NM_022308), a gene which Islet cell autoantigen 1. Accordingly, utilities of VGAM1958 include diagnosis, prevention and treatment of diseases and clinical conditions associated with ICA1. The function of ICA1 has been established by previous studies. Pietropaolo et al. (1993) identified a novel 69-kD peptide autoantigen (ICA69) associated with insulin-dependent diabetes mellitus (IDDM) by screening a human islet lambda-gt11 cDNA expression library with cytoplasmic islet cell antibody positive sera from relatives of IDDM patients who progressed to the overt disease. The deduced open reading frame of the ICA69 cDNA predicted a 483-amino acid protein. ICA69 showed no nucleotide or amino acid sequence relation to any known sequence in GenBank except for 2 short regions of similarity with bovine serum albumin (BSA). The ICA69 cDNA probe hybridized with a 2-kb mRNA in polyadenylated RNA from human pancreas, brain, heart, thyroid, and kidney. The structural gene for ICA69 was designated ICA1. A homolog in the mouse, designated Ica1, was mapped to the proximal end of chromosome 6, within 6 cM of the MET proto-oncogene (OMIM Ref. No. 164860). One can deduce from homology of synteny that the human ICA1 gene is probably located in the region 7q31, which is conserved between mouse and human. Thus, Pietropaolo et al. (1993) added another islet antigen to the isoforms of the neuroendocrine-associated enzyme glutamic acid decarboxylase (GAD; 138275) which react with sera from IDDM patients as well as from patients with stiff-man syndrome (OMIM Ref. No. 184850). However, by isotopic in situ hybridization, Gaedigk et al. (1994) demonstrated that the ICA1 gene maps to human 7p22. Gaedigk et al. (1996) reported that the mouse Ica1 gene is distributed over more than 100 kb on chromosome 6. The single murine genomic locus contains 14 coding exons, ranging from 39 to 271 bp in length. They found that the human and mouse intron/exon junctions are identical. They cloned cDNAs and identified alternatively spliced mRNA transcripts. All splice variants encoded the conserved T-cell epitope (in exon 2) recognized by autoreactive T cells in diabetic children and diabetes-prone NOD mice.

Full details of the abovementioned studies are described in the following publications, the disclosure of which are hereby incorporated by reference:

Gaedigk, R.; Duncan, A. M. V.; Miyazaki, I.; Robinson, B. H.; Dosch, H.-M.: ICA1 encoding p69, a protein linked to the development of type 1 diabetes, maps to human chromosome 7p22. Cytogenet. Cell Genet. 66: 274-276, 1994; and Gaedigk, R.; Karges, W.; Hui, M. F.; Scherer, S. W.; Dosch, H.-M.: Genomic organization and transcript analysis of ICAp69, a target antigen in diabetic autoimmunity. Genomics 38:382-39.

Further studies establishing the function and utilities of ICA1 are found in John Hopkins OMIM database record ID 147625, and in sited publications numbered 11408-11410 listed in the bibliography section hereinbelow, which are also hereby incorporated by reference. Inducible T-cell Co-stimulator (ICOS, Accession NM_012092) is another VGAM1958 host target gene. ICOS BINDING SITE is HOST TARGET binding site found in the 3' untranslated region of mRNA encoded by ICOS, corresponding to a HOST TARGET binding site such as BINDING SITE I, BINDING SITE II or BINDING SITE III. Table 2 illustrates the complementarity of the nucleotide sequences of ICOS BINDING SITE, designated SEQ ID:14385, to the nucleotide sequence of VGAM1958 RNA, herein designated VGAM RNA, also designated SEQ ID:4669.

Another function of VGAM1958 is therefore inhibition of Inducible T-cell Co-stimulator (ICOS, Accession NM_012092), a gene which forms homodimers and functions as an inducible T-cell co-stimulator. Accordingly, utilities of VGAM1958 include diagnosis, prevention and treatment of diseases and clinical conditions associated with ICOS. The function of ICOS and its association with various diseases and clinical conditions, has been established by previous studies, as described hereinabove with reference to VGAM18. Isocitrate Dehydrogenase 3 (NAD+) Alpha (IDH3A, Accession NM_005530) is another VGAM1958 host target gene. IDH3A BINDING SITE is HOST TARGET binding site found in the 3' untranslated region of mRNA encoded by IDH3A, corresponding to a HOST TARGET binding site such as BINDING SITE I, BINDING SITE II or BINDING SITE III. Table 2 illustrates the complementarity of the nucleotide sequences of IDH3A BINDING SITE, designated SEQ ID:12052, to the nucleotide sequence of VGAM1958 RNA, herein designated VGAM RNA, also designated SEQ ID:4669.

Another function of VGAM1958 is therefore inhibition of Isocitrate Dehydrogenase 3 (NAD+) Alpha (IDH3A, Accession NM_005530), a gene which decarboxylates isocitrate into alpha-ketoglutarate in the TCA cycle. Accordingly, utilities of VGAM1958 include diagnosis, prevention and treatment of diseases and clinical conditions associated with IDH3A. The function of IDH3A and its association with various diseases and clinical conditions, has been established by previous studies, as described hereinabove with reference to VGAM349. Interferon (alpha, beta and omega) Receptor 1 (IFNAR1, Accession NM_000629) is another VGAM1958 host target gene. IFNAR1 BINDING SITE is HOST TARGET binding site found in the 3' untranslated region of mRNA encoded by IFNAR1, corresponding to a HOST TARGET binding site such as BINDING SITE I, BINDING SITE II or BINDING SITE III. Table 2 illustrates the complementarity of the nucleotide sequences of IFNAR1 BINDING SITE, designated SEQ ID:6246, to the nucleotide sequence of VGAM1958 RNA, herein designated VGAM RNA, also designated SEQ ID:4669.

Another function of VGAM1958 is therefore inhibition of Interferon (alpha, beta and omega) Receptor 1 (IFNAR1, Accession NM_000629), a gene which is a receptor for interferons alpha and beta. Accordingly, utilities of VGAM1958 include diagnosis, prevention and treatment of diseases and clinical conditions associated with IFNAR1. The function of IFNAR1 and its association with various diseases and clinical conditions, has been established by previous studies, as described hereinabove with reference to VGAM904. Interleukin 1 Receptor, Type I (IL1R1, Accession NM_000877) is another VGAM1958 host target gene. IL1R1 BINDING SITE is HOST TARGET binding site found in the 3' untranslated region of mRNA encoded by IL1R1, corresponding to a HOST TARGET binding site such as BINDING SITE I, BINDING SITE II or BINDING SITE III. Table 2 illustrates the complementarity of the nucleotide sequences of IL1R1 BINDING SITE, designated SEQ ID:6562, to the nucleotide sequence of VGAM1958 RNA, herein designated VGAM RNA, also designated SEQ ID:4669.

Another function of VGAM1958 is therefore inhibition of Interleukin 1 Receptor, Type I (IL1R1, Accession NM_000877), a gene which is a receptor for interleukin-1 alpha (il-1a), beta (il-1b), and interleukin-1 receptor antagonist protein (il-1ra). Accordingly, utilities of VGAM1958 include diagnosis, prevention and treatment of diseases and clinical conditions associated with IL1R1. The function of IL1R1 and its association with various diseases and clinical conditions, has been established by previous studies, as described hereinabove with reference to VGAM704. Inhibin, Beta C (INHBC, Accession NM_005538) is another VGAM1958 host target gene. INHBC BINDING SITE is HOST TARGET binding site found in the 3' untranslated region of mRNA encoded by INHBC, corresponding to a HOST TARGET binding site such as BINDING SITE I, BINDING SITE II or BINDING SITE III. Table 2 illustrates the complementarity of the nucleotide sequences of INHBC BINDING SITE, designated SEQ ID:12063, to the nucleotide sequence of VGAM1958 RNA, herein designated VGAM RNA, also designated SEQ ID:4669.

Another function of VGAM1958 is therefore inhibition of Inhibin, Beta C (INHBC, Accession NM_005538), a gene which inhibits the secretion of follitropin by the pituitary gland. Accordingly, utilities of VGAM1958 include diagnosis, prevention and treatment of diseases and clinical conditions associated with INHBC. The function of INHBC and its association with various diseases and clinical conditions, has been established by previous studies, as described hereinabove with reference to VGAM89. Interleukin-1 Receptor-associated Kinase 4 (IRAK4, Accession XM_028349) is another VGAM1958 host target gene. IRAK4 BINDING SITE is HOST TARGET binding site found in the 3' untranslated region of mRNA encoded by IRAK4, corresponding to a HOST TARGET binding site such as BINDING SITE I, BINDING SITE II or BINDING SITE III. Table 2 illustrates the complementarity of the nucleotide sequences of IRAK4 BINDING SITE, designated SEQ ID:30694, to the nucleotide sequence of VGAM1958 RNA, herein designated VGAM RNA, also designated SEQ ID:4669.

Another function of VGAM1958 is therefore inhibition of Interleukin-1 Receptor-associated Kinase 4 (IRAK4, Accession XM_028349), a gene which may function as an IRAK1 kinase, triggering a cascade of phosphorylation events. Accordingly, utilities of VGAM1958 include diagnosis, prevention and treatment of diseases and clinical conditions associated with IRAK4. The function of IRAK4 and its association with various diseases and clinical conditions, has been established by previous studies, as described hereinabove with reference to VGAM1291. Integrin, Alpha 2 (CD49B, alpha 2 subunit of VLA-2 receptor) (ITGA2, Accession NM_002203) is another VGAM1958 host target gene. ITGA2 BINDING SITE is HOST TARGET binding site found in the 3' untranslated region of mRNA encoded by ITGA2, corresponding to a HOST TARGET binding site such as BINDING SITE I, BINDING SITE II or BINDING SITE III. Table 2 illustrates the complementarity of the nucleotide sequences of ITGA2 BINDING SITE, designated SEQ ID:7961, to the nucleotide sequence of VGAM1958 RNA, herein designated VGAM RNA, also designated SEQ ID:4669.

Another function of VGAM1958 is therefore inhibition of Integrin, Alpha 2 (CD49B, alpha 2 subunit of VLA-2 receptor) (ITGA2, Accession NM_002203), a gene which has roles in blood clotting and angiogenesis, acts as a collagen and laminin receptor. Accordingly, utilities of VGAM1958 include diagnosis, prevention and treatment of diseases and clinical conditions associated with ITGA2. The function of ITGA2 and its association with various diseases and clinical conditions, has been established by previous studies, as described hereinabove with reference to VGAM827. Integrin, Alpha 6 (ITGA6, Accession NM_000210) is another VGAM1958 host target gene. ITGA6 BINDING SITE is HOST TARGET binding site found in the 3' untranslated region of mRNA encoded by ITGA6, corresponding to a HOST TARGET binding site such as BINDING SITE I, BINDING SITE II or BINDING SITE III. Table 2 illustrates the complementarity of the nucleotide sequences of ITGA6 BINDING SITE, designated SEQ ID:5701, to the nucleotide sequence of VGAM1958 RNA, herein designated VGAM RNA, also designated SEQ ID:4669.

Another function of VGAM1958 is therefore inhibition of Integrin, Alpha 6 (ITGA6, Accession NM_000210). Accordingly, utilities of VGAM1958 include diagnosis, prevention and treatment of diseases and clinical conditions associated with ITGA6. JJAZ1 (Accession NM_015355) is another VGAM1958 host target gene. JJAZ1 BINDING SITE is HOST TARGET binding site found in the 3' untranslated region of mRNA encoded by JJAZ1, corresponding to a HOST TARGET binding site such as BINDING SITE I, BINDING SITE II or BINDING SITE III. Table 2 illustrates the complementarity of the nucleotide sequences of JJAZ1 BINDING SITE, designated SEQ ID:17655, to the nucleotide sequence of VGAM1958 RNA, herein designated VGAM RNA, also designated SEQ ID:4669.

Another function of VGAM1958 is therefore inhibition of JJAZ1 (Accession NM_015355), a gene which is a zinc finger protein. Accordingly, utilities of VGAM1958 include diagnosis, prevention and treatment of diseases and clinical conditions associated with JJAZ1. The function of JJAZ1 and its association with various diseases and clinical conditions, has been established by previous studies, as described hereinabove with reference to VGAM231. Jumonji Homolog (mouse) (JMJ, Accession NM_004973) is another VGAM1958 host target gene. JMJ BINDING SITE is HOST TARGET binding site found in the 3' untranslated region of mRNA encoded by JMJ, corresponding to a HOST TARGET binding site such as BINDING SITE I, BINDING SITE II or BINDING SITE III. Table 2 illustrates the complementarity of the nucleotide sequences of JMJ BINDING SITE, designated SEQ ID:11419, to the nucleotide sequence of VGAM1958 RNA, herein designated VGAM RNA, also designated SEQ ID:4669.

Another function of VGAM1958 is therefore inhibition of Jumonji Homolog (mouse) (JMJ, Accession NM_004973), a gene which participates in the negative regulation of cell growth. Accordingly, utilities of VGAM1958 include diagnosis, prevention and treatment of diseases and clinical conditions associated with JMJ. The function of JMJ and its association with various diseases and clinical conditions, has been established by previous studies, as described hereinabove with reference to VGAM523. Jerky Homolog (mouse) (JRK, Accession XM_098818) is another VGAM1958 host target gene. JRK BINDING SITE is HOST TARGET binding site found in the 3' untranslated region of mRNA encoded by JRK, corresponding to a HOST TARGET binding site such as BINDING SITE I, BINDING SITE II or BINDING SITE III. Table 2 illustrates the complementarity of the nucleotide sequences of JRK BINDING SITE, designated SEQ ID:41837, to the nucleotide sequence of VGAM1958 RNA, herein designated VGAM RNA, also designated SEQ ID:4669.

Another function of VGAM1958 is therefore inhibition of Jerky Homolog (mouse) (JRK, Accession XM_098818), a gene which might function as a DNA-binding protein. Accordingly, utilities of VGAM1958 include diagnosis, prevention and treatment of diseases and clinical conditions associated with JRK. The function of JRK and its association with various diseases and clinical conditions, has been established by previous studies, as described hereinabove with reference to VGAM210. Potassium Voltage-gated Channel, Shaker-related Subfamily, Beta Member 1 (KCNAB1, Accession XM_027634) is another VGAM1958 host target gene. KCNAB1 BINDING SITE is HOST TARGET binding site found in the 3' untranslated region of mRNA encoded by KCNAB1, corresponding to a HOST TARGET binding site such as BINDING SITE I, BINDING SITE II or BINDING SITE III. Table 2 illustrates the complementarity of the nucleotide sequences of KCNAB1 BINDING SITE, designated SEQ ID:30545, to the nucleotide sequence of VGAM1958 RNA, herein designated VGAM RNA, also designated SEQ ID:4669.

Another function of VGAM1958 is therefore inhibition of Potassium Voltage-gated Channel, Shaker-related Subfamily, Beta Member 1 (KCNAB1, Accession XM_027634), a gene which is the regulatory beta subunit for a shaker-related voltage-gated potassium channel. Accordingly, utilities of VGAM1958 include diagnosis, prevention and treatment of diseases and clinical conditions associated with KCNAB1. The function of KCNAB1 and its association with various diseases and clinical conditions, has been established by previous studies, as described hereinabove with reference to VGAM727. Potassium Inwardly-rectifying Channel, Subfamily J, Member 16 (KCNJ16, Accession NM_018658) is another VGAM1958 host target gene. KCNJ16 BINDING SITE is HOST TARGET binding site found in the 5' untranslated region of mRNA encoded by KCNJ16, corresponding to a HOST TARGET binding site such as BINDING SITE I, BINDING SITE II or BINDING SITE III. Table 2 illustrates the complementarity of the nucleotide sequences of KCNJ16 BINDING SITE, designated SEQ ID:20726, to the nucleotide sequence of VGAM1958 RNA, herein designated VGAM RNA, also designated SEQ ID:4669.

Another function of VGAM1958 is therefore inhibition of Potassium Inwardly-rectifying Channel, Subfamily J, Member 16 (KCNJ16, Accession NM_018658). Accordingly, utilities of VGAM1958 include diagnosis, prevention and treatment of diseases and clinical conditions associated with KCNJ16. Potassium Voltage-gated Channel, Delayed-rectifier, Subfamily S, Member 3 (KCNS3, Accession NM_002252) is another VGAM1958 host target gene. KCNS3 BINDING SITE is HOST TARGET binding site found in the 5' untranslated region of mRNA encoded by KCNS3, corresponding to a HOST TARGET binding site such as BINDING SITE I, BINDING SITE II or BINDING SITE III. Table 2 illustrates the complementarity of the nucleotide sequences of KCNS3 BINDING SITE, designated SEQ ID:8049, to the nucleotide sequence of VGAM1958 RNA, herein designated VGAM RNA, also designated SEQ ID:4669.

Another function of VGAM1958 is therefore inhibition of Potassium Voltage-gated Channel, Delayed-rectifier, Subfamily S, Member 3 (KCNS3, Accession NM_002252). Accordingly, utilities of VGAM1958 include diagnosis, prevention and treatment of diseases and clinical conditions associated with KCNS3. Ketohexokinase (fructokinase) (KHK, Accession NM_006488) is another VGAM1958 host target gene. KHK BINDING SITE1 and KHK BINDING SITE2 are HOST TARGET binding sites found in untranslated regions of mRNA encoded by KHK, corresponding to HOST TARGET binding sites such as BINDING SITE I, BINDING SITE II or BINDING SITE III. Table 2 illustrates the complementarity of the nucleotide sequences of KHK BINDING SITE1 and KHK BINDING SITE2, designated SEQ ID:13214 and SEQ ID:5729 respectively, to the nucleotide sequence of VGAM1958 RNA, herein designated VGAM RNA, also designated SEQ ID:4669.

Another function of VGAM1958 is therefore inhibition of Ketohexokinase (fructokinase) (KHK, Accession NM_006488). Accordingly, utilities of VGAM1958 include diagnosis, prevention and treatment of diseases and clinical conditions associated with KHK. Kinesin Family Member 5C (KIF5C, Accession NM_004522) is another VGAM1958 host target gene. KIF5C BINDING SITE is HOST TARGET binding site found in the 3' untranslated region of mRNA encoded by KIF5C, corresponding to a HOST TARGET binding site such as BINDING SITE I, BINDING SITE II or BINDING SITE III. Table 2 illustrates the complementarity of the nucleotide sequences of KIF5C BINDING SITE, designated SEQ ID:10853, to the nucleotide sequence of VGAM1958 RNA, herein designated VGAM RNA, also designated SEQ ID:4669.

Another function of VGAM1958 is therefore inhibition of Kinesin Family Member 5C (KIF5C, Accession NM_004522). Accordingly, utilities of VGAM1958 include diagnosis, prevention and treatment of diseases and clinical conditions associated with KIF5C. Kinesin-like 3 (KNSL3, Accession NM_005355) is another VGAM1958 host target gene. KNSL3 BINDING SITE1 and KNSL3 BINDING SITE2 are HOST TARGET binding sites found in untranslated regions of mRNA encoded by KNSL3, corresponding to HOST TARGET binding sites such as BINDING SITE I, BINDING SITE II or BINDING SITE III. Table 2 illustrates the complementarity of the nucleotide sequences of KNSL3 BINDING SITE1 and KNSL3 BINDING SITE2, designated SEQ ID:11824 and SEQ ID:24962 respectively, to the nucleotide sequence of VGAM1958 RNA, herein designated VGAM RNA, also designated SEQ ID:4669.

Another function of VGAM1958 is therefore inhibition of Kinesin-like 3 (KNSL3, Accession NM_005355), a gene which may function in intracellular transport and mitosis. Accordingly, utilities of VGAM1958 include diagnosis, prevention and treatment of diseases and clinical conditions associated with KNSL3. The function of KNSL3 has been established by previous studies. Janatipour et al. (1992) identified the HSET gene within a segment centromeric to the class II gene region of the human major histocompatibility complex. By screening a human testis library with a cDNA corresponding to Tctex7, the mouse homolog of HSET, Ando et al. (1994) isolated human HSET cDNAs. Northern blot analysis revealed that the 2.4-kb HSET mRNA is expressed in several human cell lines. The C-terminal 350 amino acids of the predicted HSET protein share extensive homology with the ATP-binding and motor domains of kinesin heavy chain (OMIM Ref. No. 148760) and the kinesin-related proteins CENPE (OMIM Ref. No. 117143) and MKLP1. Although the mechanochemical domain of kinesin and kinesin-like proteins is generally located within the N-terminal region, HSET contains a C-terminal mechanochemical domain. This 'reversed' structural organization is also found in the S. cerevisiae KAR3 and Drosophila Ncd kinesin-like proteins. Molecular motors move directionally to either the plus or the minus ends of microtubules or actin filaments. For example, kinesin (see OMIM Ref. No. 600025) moves towards the plus end, whereas the Drosophila Ncd motor moves towards the minus end. Endow and Higuchi (2000) showed that an asn340-to-lys mutation in the 'neck' (the region between the stalk and the C-terminal motor domain) of Ncd, which corresponds to a KAR3 mutation obtained in a yeast suppressor screen (Hoyt et al., 1993), causes the motor to abruptly reverse directions and move toward either the plus or minus end. Velocity in mutant and wildtype was identical, indicating that the neck was functional. Mutation of lys640, which is located in the motor-core region and touches asn340 in crystal structures, to asn caused the same phenotype. Analysis of a double mutant for these residues, which did not revert to minus-end directionality, indicated that the highly conserved residues do not interact normally in an inverted configuration. Endow and Higuchi (2000) concluded that directional bias is dependent on neck/motor-core interactions.

Full details of the abovementioned studies are described in the following publications, the disclosure of which are hereby incorporated by reference:

Janatipour, M.; Naumov, Y.; Ando, A.; Sugimura, K.; Okamoto, N.; Tsuji, K.; Abe, K.; Inoko, H.: Search for MHC-associated genes in human: five new genes centromeric to HLA-DP with yet unknown functions. Immunogenetics 35:272-278, 1992; and Janitz, K.; Wild, A.; Beck, S.; Savasta, S.; Beluffi, G.; Ziegler, A.; Volz, A.: Genomic organization of the HSET locus and the possible association of HLA-linked genes with immotile ci.

Further studies establishing the function and utilities of KNSL3 are found in John Hopkins OMIM database record ID 603815, and in sited publications numbered 491 and 12002 listed in the bibliography section hereinbelow, which are also hereby incorporated by reference. LANGERIN (Accession NM_015717) is another VGAM1958 host target gene. LANGERIN BINDING SITE is HOST TARGET binding site found in the 3' untranslated region of mRNA encoded by LANGERIN, corresponding to a HOST TARGET binding site such as BINDING SITE I, BINDING SITE II or BINDING SITE III. Table 2 illustrates the complementarity of the nucleotide sequences of LANGERIN BINDING SITE, designated SEQ ID:17931, to the nucleotide sequence of VGAM1958 RNA, herein designated VGAM RNA, also designated SEQ ID:4669.

Another function of VGAM1958 is therefore inhibition of LANGERIN (Accession NM_015717), a gene which could be involved in endocytosis. Accordingly, utilities of VGAM1958 include diagnosis, prevention and treatment of diseases and clinical conditions associated with LANGERIN. The function of LANGERIN and its association with various diseases and clinical conditions, has been established by previous studies, as described hereinabove with reference to VGAM688. Low Density Lipoprotein Receptor (familial hypercholesterolemia) (LDLR, Accession NM_000527) is another VGAM1958 host target gene. LDLR BINDING SITE is HOST TARGET binding site found in the 3' untranslated region of mRNA encoded by LDLR, corresponding to a HOST TARGET binding site such as BINDING SITE I, BINDING SITE II or BINDING SITE III. Table 2 illustrates the complementarity of the nucleotide sequences of LDLR BINDING SITE, designated SEQ ID:6128, to the nucleotide sequence of VGAM1958 RNA, herein designated VGAM RNA, also designated SEQ ID:4669.

Another function of VGAM1958 is therefore inhibition of Low Density Lipoprotein Receptor (familial hypercholesterolemia) (LDLR, Accession NM_000527), a gene which also acts as a tumor suppressor. Accordingly, utilities of VGAM1958 include diagnosis, prevention and treatment of diseases and clinical conditions associated with LDLR. The function of LDLR and its association with various diseases and clinical conditions, has been established by previous studies, as described hereinabove with reference to VGAM1030. LENG4 (Accession NM_024298) is another VGAM1958 host target gene. LENG4 BINDING SITE is HOST TARGET binding site found in the 3' untranslated region of mRNA encoded by LENG4, corresponding to a HOST TARGET binding site such as BINDING SITE I, BINDING SITE II or BINDING SITE III. Table 2 illustrates the complementarity of the nucleotide sequences of LENG4 BINDING SITE, designated SEQ ID:23584, to the nucleotide sequence of VGAM1958 RNA, herein designated VGAM RNA, also designated SEQ ID:4669.

Another function of VGAM1958 is therefore inhibition of LENG4 (Accession NM_024298), a gene which may be a transmembrane protein. Accordingly, utilities of VGAM1958 include diagnosis, prevention and treatment of diseases and clinical conditions associated with LENG4. The function of LENG4 and its association with various diseases and clinical conditions, has been established by previous studies, as described hereinabove with reference to VGAM259. LNK (Accession NM_005475) is another VGAM1958 host target gene. LNK BINDING SITE is HOST TARGET binding site found in the 3' untranslated region of mRNA encoded by LNK, corresponding to a HOST TARGET binding site such as BINDING SITE I, BINDING SITE II or BINDING SITE III. Table 2 illustrates the complementarity of the nucleotide sequences of LNK BINDING SITE, designated SEQ ID:11974, to the nucleotide sequence of VGAM1958 RNA, herein designated VGAM RNA, also designated SEQ ID:4669.

Another function of VGAM1958 is therefore inhibition of LNK (Accession NM_005475), a gene which links T-cell receptor activation signal to phospholipase c-gamma-1, grb-2 and phosphatidylinositol 3-kinase (by similarity). Accordingly, utilities of VGAM1958 include diagnosis, prevention and treatment of diseases and clinical conditions associated with LNK. The function of LNK and its association with various diseases and clinical conditions, has been established by previous studies, as described hereinabove with reference to VGAM115. Lipoprotein Lipase (LPL, Accession NM_000237) is another VGAM1958 host target gene. LPL BINDING SITE is HOST TARGET binding site found in the 3' untranslated region of mRNA encoded by LPL, corresponding to a HOST TARGET binding site such as BINDING SITE I, BINDING SITE II or BINDING SITE III. Table 2 illustrates the complementarity of the nucleotide sequences of LPL BINDING SITE, designated SEQ ID:5749, to the nucleotide sequence of VGAM1958 RNA, herein designated VGAM RNA, also designated SEQ ID:4669.

Another function of VGAM1958 is therefore inhibition of Lipoprotein Lipase (LPL, Accession NM_000237), a gene which is the hydrolysis of triglycerides of circulating chylomicrons and very low density lipoproteins (vldl). the enzyme functions in the presence of apolipoprotein c-2 on the luminal surface of vascular. Accordingly, utilities of VGAM1958 include diagnosis, prevention and treatment of diseases and clinical conditions associated with LPL. The function of LPL and its association with various diseases and clinical conditions, has been established by previous studies, as described hereinabove with reference to VGAM55. Lecithin Retinol Acyltransferase (phosphatidylcholine--retinol O-acyltransferase) (LRAT, Accession XM_011181) is another VGAM1958 host target gene. LRAT BINDING SITE is HOST TARGET binding site found in the 3' untranslated region of mRNA encoded by LRAT, corresponding to a HOST TARGET binding site such as BINDING SITE I, BINDING SITE II or BINDING SITE III. Table 2 illustrates the complementarity of the nucleotide sequences of LRAT BINDING SITE, designated SEQ ID:30180, to the nucleotide sequence of VGAM1958 RNA, herein designated VGAM RNA, also designated SEQ ID:4669.

Another function of VGAM1958 is therefore inhibition of Lecithin Retinol Acyltransferase (phosphatidylcholine--retinol O-acyltransferase) (LRAT, Accession XM_011181). Accordingly, utilities of VGAM1958 include diagnosis, prevention and treatment of diseases and clinical conditions associated with LRAT. Low Density Lipoprotein Receptor-related Protein 4 (LRP4, Accession XM_035037) is another VGAM1958 host target gene. LRP4 BINDING SITE is HOST TARGET binding site found in the 3' untranslated region of mRNA encoded by LRP4, corresponding to a HOST TARGET binding site such as BINDING SITE I, BINDING SITE II or BINDING SITE III. Table 2 illustrates the complementarity of the nucleotide sequences of LRP4 BINDING SITE, designated SEQ ID:32202, to the nucleotide sequence of VGAM1958 RNA, herein designated VGAM RNA, also designated SEQ ID:4669.

Another function of VGAM1958 is therefore inhibition of Low Density Lipoprotein Receptor-related Protein 4 (LRP4, Accession XM_035037). Accordingly, utilities of VGAM1958 include diagnosis, prevention and treatment of diseases and clinical conditions associated with LRP4. Leucine-zipper-like Transcriptional Regulator, 1 (LZTR1, Accession NM_006767) is another VGAM1958 host target gene. LZTR1 BINDING SITE is HOST TARGET binding site found in the 3' untranslated region of mRNA encoded by LZTR1, corresponding to a HOST TARGET binding site such as BINDING SITE I, BINDING SITE II or BINDING SITE III. Table 2 illustrates the complementarity of the nucleotide sequences of LZTR1 BINDING SITE, designated SEQ ID:13637, to the nucleotide sequence of VGAM1958 RNA, herein designated VGAM RNA, also designated SEQ ID:4669.

Another function of VGAM1958 is therefore inhibition of Leucine-zipper-like Transcriptional Regulator, 1 (LZTR1, Accession NM_006767). Accordingly, utilities of VGAM1958 include diagnosis, prevention and treatment of diseases and clinical conditions associated with LZTR1. V-maf Musculoaponeurotic Fibrosarcoma Oncogene Homolog F (avian) (MAFF, Accession NM_012323) is another VGAM1958 host target gene. MAFF BINDING SITE is HOST TARGET binding site found in the 3' untranslated region of mRNA encoded by MAFF, corresponding to a HOST TARGET binding site such as BINDING SITE I, BINDING SITE II or BINDING SITE III. Table 2 illustrates the complementarity of the nucleotide sequences of MAFF BINDING SITE, designated SEQ ID:14701, to the nucleotide sequence of VGAM1958 RNA, herein designated VGAM RNA, also designated SEQ ID:4669.

Another function of VGAM1958 is therefore inhibition of V-maf Musculoaponeurotic Fibrosarcoma Oncogene Homolog F (avian) (MAFF, Accession NM_012323), a gene which Binds to the US-2 motif of the oxytocin receptor gene; has a leucine zipper structure. Accordingly, utilities of VGAM1958 include diagnosis, prevention and treatment of diseases and clinical conditions associated with MAFF. The function of MAFF and its association with various diseases and clinical conditions, has been established by previous studies, as described hereinabove with reference to VGAM1928. Mannosidase, Alpha, Class 2A, Member 2 (MAN2A2, Accession NM_006122) is another VGAM1958 host target gene. MAN2A2 BINDING SITE is HOST TARGET binding site found in the 3' untranslated region of mRNA encoded by MAN2A2, corresponding to a HOST TARGET binding site such as BINDING SITE I, BINDING SITE II or BINDING SITE III. Table 2 illustrates the complementarity of the nucleotide sequences of MAN2A2 BINDING SITE, designated SEQ ID:12766, to the nucleotide sequence of VGAM1958 RNA, herein designated VGAM RNA, also designated SEQ ID:4669.

Another function of VGAM1958 is therefore inhibition of Mannosidase, Alpha, Class 2A, Member 2 (MAN2A2, Accession NM_006122), a gene which is an enzyme involved in the processing of N-linked glycans. Accordingly, utilities of VGAM1958 include diagnosis, prevention and treatment of diseases and clinical conditions associated with MAN2A2. The function of MAN2A2 and its association with various diseases and clinical conditions, has been established by previous studies, as described hereinabove with reference to VGAM1794. Microtubule-associated Protein 2 (MAP2, Accession NM_031846) is another VGAM1958 host target gene. MAP2 BINDING SITE is HOST TARGET binding site found in the 3' untranslated region of mRNA encoded by MAP2, corresponding to a HOST TARGET binding site such as BINDING SITE I, BINDING SITE II or BINDING SITE III. Table 2 illustrates the complementarity of the nucleotide sequences of MAP2 BINDING SITE, designated SEQ ID:25581, to the nucleotide sequence of VGAM1958 RNA, herein designated VGAM RNA, also designated SEQ ID:4669.

Another function of VGAM1958 is therefore inhibition of Microtubule-associated Protein 2 (MAP2, Accession NM_031846), a gene which may act in stabilizing microtubules against depolymerization. Also seems to have a stiffening effect on microtubules. Accordingly, utilities of VGAM1958 include diagnosis, prevention and treatment of diseases and clinical conditions associated with MAP2. The function of MAP2 has been established by previous studies. For nerve cells to develop their highly polarized form, appropriate structural molecules must be targeted to either axons or dendrites. This could be achieved by the synthesis of structural proteins in the cell body and their sorting to either axons or dendrites by specific transport mechanisms. For dendrites, an alternative possibility is that proteins could be synthesized locally in the dendritic cytoplasm. This would allow regulation of the production of structural molecules in response to local demand during dendritic development. The existence of dendritic polyribosomes and the demonstration that newly synthesized RNA is transported into the dendrites of neurons differentiating in culture support the feasibility of dendritic protein synthesis. By in situ hybridization with specific cDNA probes, Garner et al. (1988) showed that mRNA for the dendrite-specific microtubule-associated protein MAP2 was present in dendrites in the developing brain. By contrast, the mRNA for tubulin (OMIM Ref. No. 191120), a protein present in both axons and dendrites, was localized exclusively in neuronal cell bodies Animal model experiments lend further support to the function of MAP2. Marsden et al. (1996) produced transgenic mice that overexpress embryonic Map2 (referred to by them as MAP2c) without inducing detectable effects on the morphology of neurons. The transgenic MAP2c was present in dendrites but not in axons but transgenic MAP2c messenger RNA was limited to cell bodies. The authors concluded that dendritic localization of transgenic MAP2c protein was not the result of previous transport of its mRNA but implies the existence of a protein-based mechanism capable of sorting MAP2 protein isoforms It is appreciated that the abovementioned animal model for MAP2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Garner, C. C.; Tucker, R. P.; Matus, A.: Selective localization of messenger RNA for cytoskeletal protein MAP2 in dendrites. Nature 336:674-677, 1988; and Marsden, K. M.; Doll, T.; Ferralli, J.; Botteri, F.; Matus, A.: Transgenic expression of embryonic MAP2 in adult mouse brain: implications for neuronal polarization. J. Neurosci. 16:3265.

Further studies establishing the function and utilities of MAP2 are found in John Hopkins OMIM database record ID 157130, and in sited publications numbered 10752-10756 listed in the bibliography section hereinbelow, which are also hereby incorporated by reference. Mitogen-activated Protein Kinase Kinase 2 (MAP2K2, Accession NM_030662) is another VGAM1958 host target gene. MAP2K2 BINDING SITE is HOST TARGET binding site found in the 5' untranslated region of mRNA encoded by MAP2K2, corresponding to a HOST TARGET binding site such as BINDING SITE I, BINDING SITE II or BINDING SITE III. Table 2 illustrates the complementarity of the nucleotide sequences of MAP2K2 BINDING SITE, designated SEQ ID:24995, to the nucleotide sequence of VGAM1958 RNA, herein designated VGAM RNA, also designated SEQ ID:4669.

Another function of VGAM1958 is therefore inhibition of Mitogen-activated Protein Kinase Kinase 2 (MAP2K2, Accession NM_030662), a gene which is a signaling intermediate, activates ERK1. Accordingly, utilities of VGAM1958 include diagnosis, prevention and treatment of diseases and clinical conditions associated with MAP2K2. The function of MAP2K2 has been established by previous studies. See MEK1 (OMIM Ref. No. 176872). Zheng and Guan (1993) isolated and sequenced 2 human cDNAs encoding members of the MAP kinase kinase (MAP2K) family, designated MEK1 and MEK2 by them. The MEK2 cDNA encodes a predicted 400-amino acid protein that shares 80% sequence identity with human MEK1. Zheng and Guan (1993) showed that recombinant MEK2 and MEK1 both could activate human ERK1 (OMIM Ref. No. 601795) in vitro. They further characterized biochemically the 2 MAP2Ks. Influenza A viruses are significant causes of morbidity and mortality worldwide. Annually updated vaccines may prevent disease, and antivirals are effective treatment early in disease when symptoms are often nonspecific. Viral replication is supported by intracellular signaling events. Using U0126, a nontoxic inhibitor of MEK1 and MEK2, and thus an inhibitor of the RAF1 (OMIM Ref. No. 164760)/ MEK/ERK pathway (see OMIM Ref. No. Favata et al. (1998)), Pleschka et al. (2001) examined the cellular response to infection with influenza A. U0126 suppressed both the early and late ERK activation phases after virus infection. Inhibition of the signaling pathway occurred without impairing the synthesis of viral RNA or protein, or the import of viral ribonucleoprotein complexes (RNP) into the nucleus. Instead, U0126 inhibited RAF/MEK/ERK signaling and the export of viral RNP without affecting the cellular mRNA export pathway. Pleschka et al. (2001) proposed that ERK regulates a cellular factor involved in the viral nuclear export protein function. They suggested that local application of MEK inhibitors may have only minor toxic effects on the host while inhibiting viral replication without giving rise to drug-resistant virus variants Full details of the abovementioned studies are described in the following publications, the disclosure of which are hereby incorporated by reference:

Zheng, C. F.; Guan, K. L.: Cloning and characterization of two distinct human extracellular signal-regulated kinase activator kinases, MEK1 and MEK2. J. Biol. Chem. 268:11435-11439, 1993; and Pleschka, S.; Wolff, T.; Ehrhardt, C.; Hobom, G.; Planz, O.; Rapp, U. R.; Ludwig, S.: Influenza virus propagation is impaired by inhibition of the Raf/MEK/ERK signalling cascade. Nature Ce.

Further studies establishing the function and utilities of MAP2K2 are found in John Hopkins OMIM database record ID 601263, and in sited publications numbered 10344, 10346-10348, 1035 and 10356 listed in the bibliography section hereinbelow, which are also hereby incorporated by reference. Mitogen-activated Protein Kinase 1 (MAPK1, Accession NM_138957) is another VGAM1958 host target gene. MAPK1 BINDING SITE1 and MAPK1 BINDING SITE2 are HOST TARGET binding sites found in untranslated regions of mRNA encoded by MAPK1, corresponding to HOST TARGET binding sites such as BINDING SITE I, BINDING SITE II or BINDING SITE III. Table 2 illustrates the complementarity of the nucleotide sequences of MAPK1 BINDING SITE1 and MAPK1 BINDING SITE2, designated SEQ ID:29063 and SEQ ID:8616 respectively, to the nucleotide sequence of VGAM1958 RNA, herein designated VGAM RNA, also designated SEQ ID:4669.

Another function of VGAM1958 is therefore inhibition of Mitogen-activated Protein Kinase 1 (MAPK1, Accession NM_138957), a gene which phosphorylates microtubule-associated protein-2 (map2). myelin basic protein (mbp), and elk-1; may promote entry in the cell cycle. Accordingly, utilities of VGAM1958 include diagnosis, prevention and treatment of diseases and clinical conditions associated with MAPK1. The function of MAPK1 and its association with various diseases and clinical conditions, has been established by previous studies, as described hereinabove with reference to VGAM217. Mitogen-activated Protein Kinase 9 (MAPK9, Accession NM_139068) is another VGAM1958 host target gene. MAPK9 BINDING SITE1 through MAPK9 BINDING SITE4 are HOST TARGET binding sites found in untranslated regions of mRNA encoded by MAPK9, corresponding to HOST TARGET binding sites such as BINDING SITE I, BINDING SITE II or BINDING SITE III. Table 2 illustrates the complementarity of the nucleotide sequences of MAPK9 BINDING SITE1 through MAPK9 BINDING SITE4, designated SEQ ID:29135, SEQ ID:29137, SEQ ID:29139 and SEQ ID:8630 respectively, to the nucleotide sequence of VGAM1958 RNA, herein designated VGAM RNA, also designated SEQ ID:4669.

Another function of VGAM1958 is therefore inhibition of Mitogen-activated Protein Kinase 9 (MAPK9, Accession NM_139068), a gene which Member of the MAP kinase family, regulates c-Jun in response to proinflammatory cytokines and UV irradiation. Accordingly, utilities of VGAM1958 include diagnosis, prevention and treatment of diseases and clinical conditions associated with MAPK9. The function of MAPK9 has been established by previous studies. The transcriptional activity of the c-Jun protooncoprotein (see OMIM Ref. No. 165160) is augmented through phosphorylation at 2 sites by c-Jun amino-terminal kinases (JNKs). Using in-gel kinase assays, Hibi et al. (1993) identified 2 JNKs, 46 and 55 kD in size. The 46-kD protein JNK1 (OMIM Ref. No. 601158) was shown to be a member of the mitogen-activated protein kinase (MAPK) family. Using a JNK1 cDNA as a probe, Kallunki et al. (1994) and Sluss et al. (1994) isolated cDNAs encoding the 55-kD protein, which both designated JNK2. Kallunki et al. (1994) reported that the sequence of the predicted 424-amino acid JNK2 protein is 83% identical to that of JNK1. Both JNKs contain a Thr-Pro-Tyr phosphorylation motif. Expression of JNK2 in mammalian cells potentiated activation of a c-Jun-responsive promoter, while expression of JNK1 had no effect. Using in vitro binding assays, Kallunki et al. (1994) found that JNK2 bound c-Jun approximately 25 times more efficiently than did JNK1. The authors traced this difference to a small beta-strand-like region near the catalytic pocket of the enzyme. Northern blot analysis revealed that JNK2 is expressed as multiple transcripts in many cell types. Sluss et al. (1994) demonstrated that both UV radiation and the proinflammatory cytokine TNF-alpha (OMIM Ref. No. 191160) induce JNK1 and JNK2. Animal model experiments lend further support to the function of MAPK9. Tournier et al. (2000) demonstrated that JNK is required for UV-induced apoptosis in primary murine embryonic fibroblasts. Fibroblasts with simultaneous targeted disruptions of JNK1 and JNK2 genes were protected against UV-stimulated apoptosis. The absence of JNK caused a defect in the mitochondrial death signaling pathway, including the failure to release cytochrome c. These data indicated that mitochondria are influenced by proapoptotic signal transduction through the JNK pathway. Dong et al. (2000) used 3 new mouse models in which peripheral T cells completely lack JNK proteins or signaling to test whether the JNK signaling pathway is crucial for IL2 expression and T-cell activation. Unexpectedly, these T cells made more IL2 (OMIM Ref. No. 147680) and proliferated better than wildtype cells. However, production of effector T-cell cytokines did require JNK. Thus, Dong et al. (2000) concluded that JNK is necessary for T-cell differentiation but not for naive T-cell activation It is appreciated that the abovementioned animal model for MAPK9 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Dong, C.; Yang, D. D.; Tournier, C.; Whitmarsh, A. J.; Xu, J.; Davis, R. J.; Flavell, R. A.: JNK is required for effector T-cell function but not for T-cell activation. Nature 405:91-94, 2000; and Kallunki, T.; Su, B.; Tsigelny, I.; Sluss, H. K.; Derijard, B.; Moore, G.; Davis, R.; Karin, M.: JNK2 contains a specificity-determining region responsible for efficient c-Jun binding and.

Further studies establishing the function and utilities of MAPK9 are found in John Hopkins OMIM database record ID 602896, and in sited publications numbered 9463, 9464-590 and 9465 listed in the bibliography section hereinbelow, which are also hereby incorporated by reference. Microtubule-associated Protein Tau (MAPT, Accession NM_005910) is another VGAM1958 host target gene. MAPT BINDING SITE1 through MAPT BINDING SITE4 are HOST TARGET binding sites found in untranslated regions of mRNA encoded by MAPT, corresponding to HOST TARGET binding sites such as BINDING SITE I, BINDING SITE II or BINDING SITE III. Table 2 illustrates the complementarity of the nucleotide sequences of MAPT BINDING SITE1 through MAPT BINDING SITE4, designated SEQ ID:12541, SEQ ID:18829, SEQ ID:18835 and SEQ ID:18841 respectively, to the nucleotide sequence of VGAM1958 RNA, herein designated VGAM RNA, also designated SEQ ID:4669.

Another function of VGAM1958 is therefore inhibition of Microtubule-associated Protein Tau (MAPT, Accession NM_005910), a gene which Microtubule-associated protein tau; promotes microtubule assembly. Accordingly, utilities of VGAM1958 include diagnosis, prevention and treatment of diseases and clinical conditions associated with MAPT. The function of MAPT and its association with various diseases and clinical conditions, has been established by previous studies, as described hereinabove with reference to VGAM178. MAX Protein (MAX, Accession NM_145112) is another VGAM1958 host target gene. MAX BINDING SITE1 and MAX BINDING SITE2 are HOST TARGET binding sites found in untranslated regions of mRNA encoded by MAX, corresponding to HOST TARGET binding sites such as BINDING SITE I, BINDING SITE II or BINDING SITE III. Table 2 illustrates the complementarity of the nucleotide sequences of MAX BINDING SITE1 and MAX BINDING SITE2, designated SEQ ID:29716 and SEQ ID:8199 respectively, to the nucleotide sequence of VGAM1958 RNA, herein designated VGAM RNA, also designated SEQ ID:4669.

Another function of VGAM1958 is therefore inhibition of MAX Protein (MAX, Accession NM_145112), a gene which interacts specifically with the MYC (190080) protein. Accordingly, utilities of VGAM1958 include diagnosis, prevention and treatment of diseases and clinical conditions associated with MAX. The function of MAX and its association with various diseases and clinical conditions, has been established by previous studies, as described hereinabove with reference to VGAM1923. MCM2 Minichromosome Maintenance Deficient 2, Mitotin (S. cerevisiae) (MCM2, Accession XM_042618) is another VGAM1958 host target gene. MCM2 BINDING SITE is HOST TARGET binding site found in the 3' untranslated region of mRNA encoded by MCM2, corresponding to a HOST TARGET binding site such as BINDING SITE I, BINDING SITE II or BINDING SITE III. Table 2 illustrates the complementarity of the nucleotide sequences of MCM2 BINDING SITE, designated SEQ ID:33721, to the nucleotide sequence of VGAM1958 RNA, herein designated VGAM RNA, also designated SEQ ID:4669.

Another function of VGAM1958 is therefore inhibition of MCM2 Minichromosome Maintenance Deficient 2, Mitotin (S. cerevisiae) (MCM2, Accession XM_042618), a gene which Minichromosome maintenance protein; binds chromatin and regulates entry into S phase. Accordingly, utilities of VGAM1958 include diagnosis, prevention and treatment of diseases and clinical conditions associated with MCM2. The function of MCM2 has been established by previous studies. The replication of DNA occurs only once per cell cycle in eukaryotes. Blow and Laskey (1988) attempted to explain this tight control by proposing the existence of a hypothetical licensing factor that would bind to chromatin during mitosis to permit DNA replication during the ensuing S phase in Xenopus egg extracts. Kubota et al. (1995), Chong et al. (1995), and Madine et al. (1995) identified a replication licensing activity in a complex containing MCM/P1 family proteins in Xenopus oocytes. Burkhart et al. (1995) showed that human MCM2 and MCM5 (OMIM Ref. No. 602696) proteins form a complex. Hu et al. (1993) reported cDNA sequences for 5 MCM/P1 family members. MCM2, also called CDCL1 and BM28, is a human nuclear protein that may play an important role in 2 crucial steps of the cell cycle, namely, onset of DNA replication and cell division. It is similar to members of the family of early S-phase proteins. Using plasmid DNA containing the complete coding sequence of the CDCL1 gene as a probe for fluorescence in situ hybridization, Mincheva et al. (1994) mapped the gene to 3q21. From its localization, CDCL1 became a candidate for an oncogene affected by chromosomal breaks in acute myeloid leukemia (AML). Tsuruga et al. (1997) reported the comparative analysis of the human MCM proteins MCM2, MCM3 (OMIM Ref. No. 602693), MCM5, and MCM7 (OMIM Ref. No. 600592). The 4 MCM proteins underwent unequal regulation, suggesting that they play somewhat distinct roles in the regulation of the mammalian cell cycle. The mRNA levels of these genes underwent cell cycle-dependent oscillations with a peak at G1/S phase; they may be regulated by E2F motifs (see OMIM Ref. No. E2F1; 189971), 2 of which were detected in the 5-prime regulatory region of the MCM5 gene. In contrast, the levels of these MCM proteins remained rather constant during the HeLa cell cycle. However, their levels gradually increased in a variable manner as normal cells progressed from G0 into the G1/S phase. In the G0 stage, the MCM2 and MCM5 proteins were much less abundant than the MCM7 and MCM3 proteins. This suggests that the MCM proteins are not present in stoichiometric amounts and that only a proportion of these molecules actively participate in cell cycle regulation as part of MCM complexes. Using an improved method for constructing conditional degron mutants, Labib et al. (2000) demonstrated that depletion of minichromosome maintenance protein complexes after initiation irreversibly blocks the progression of replication forks in S. cerevisiae. Their experiments demonstrated that MCM complex is loaded at origins before initiation and is essential for elongation. Disruption of any one of the MCMs resulted in cells that were unable to complete the S phase, indicating that all MCM proteins are equally important for chromosome replication to continue after the activation of early origins of DNA replication. Labib et al. (2000) concluded that restricting MCM loading to the G1 phase ensures that initiation and elongation occur just once per cell cycle. Nomenclature: This gene has also been referred to as cdc19 and D3S3194. See MCM7 (OMIM Ref. No. 600592), which also has been referred to as MCM2.

Full details of the abovementioned studies are described in the following publications, the disclosure of which are hereby incorporated by reference:

Blow, J. J.; Laskey, R. A.: A role for the nuclear envelope in controlling DNA replication within the cell cycle. Nature 332:546-548, 1988; and Burkhart, R.; Schulte, D.; Hu, D.; Musahl, C.; Gohring, F.; Knippers, R.: Interactions of human nuclear proteins P1Mcm3 and P1Cdc46. Europ. J. Biochem. 228:431-438, 1995.

Further studies establishing the function and utilities of MCM2 are found in John Hopkins OMIM database record ID 116945, and in sited publications numbered 1923-1931 listed in the bibliography section hereinbelow, which are also hereby incorporated by reference. Multiple Endocrine Neoplasia I (MEN1, Accession XM_167804) is another VGAM1958 host target gene. MEN1 BINDING SITE is HOST TARGET binding site found in the 5' untranslated region of mRNA encoded by MEN1, corresponding to a HOST TARGET binding site such as BINDING SITE I, BINDING SITE II or BINDING SITE III. Table 2 illustrates the complementarity of the nucleotide sequences of MEN1 BINDING SITE, designated SEQ ID:44840, to the nucleotide sequence of VGAM1958 RNA, herein designated VGAM RNA, also designated SEQ ID:4669.

Another function of VGAM1958 is therefore inhibition of Multiple Endocrine Neoplasia I (MEN1, Accession XM_167804). Accordingly, utilities of VGAM1958 include diagnosis, prevention and treatment of diseases and clinical conditions associated with MEN1. Mesenchyme Homeo Box 1 (MEOX1, Accession NM_004527) is another VGAM1958 host target gene. MEOX1 BINDING SITE1 and MEOX1 BINDING SITE2 are HOST TARGET binding sites found in untranslated regions of mRNA encoded by MEOX1, corresponding to HOST TARGET binding sites such as BINDING SITE I, BINDING SITE II or BINDING SITE III. Table 2 illustrates the complementarity of the nucleotide sequences of MEOX1 BINDING SITE1 and MEOX1 BINDING SITE2, designated SEQ ID:10864 and SEQ ID:15188 respectively, to the nucleotide sequence of VGAM1958 RNA, herein designated VGAM RNA, also designated SEQ ID:4669.

Another function of VGAM1958 is therefore inhibition of Mesenchyme Homeo Box 1 (MEOX1, Accession NM_004527), a gene which plays a role in mesoderm induction and isomitogenesis, and sclerotomal differentiation. Accordingly, utilities of VGAM1958 include diagnosis, prevention and treatment of diseases and clinical conditions associated with MEOX1. The function of MEOX1 has been established by previous studies. Using the technique of solution hybridization coupled with magnetic bead capture for the generation of a transcript map for the BRCA1 (OMIM Ref. No. 113705) region of 17q21, Futreal et al. (1994) isolated the human homolog of the mouse Mox1 gene (termed MOX1 by them) which had previously been localized to a region of syntenic homology on mouse chromosome 11. MOX1 expression was observed in a variety of normal tissues examined, including breast and ovary. Because of this and because the gene contains a homeo box domain and has the potential to regulate growth and differentiation, MOX1 represented an attractive candidate for the BRCA1 gene. However, no evidence for mutation in the coding sequence was found in investigations of a series of BRCA1 kindreds and primary sporadic breast tumors. Nonetheless, the widespread expression of MOX1 in nonembryonic tissues suggests a role in normal cell biology. In the course of preparing a detailed physical and transcriptional map of the BRCA1 region, Jones et al. (1994) likewise located the MEOX1 gene, termed MOX1 by the authors. Another member of this gene family, MEOX2 (OMIM Ref. No. 600535), is located on chromosome 7p.

Full details of the abovementioned studies are described in the following publications, the disclosure of which are hereby incorporated by reference:

Futreal, P. A.; Cochran, C.; Rosenthal, J.; Miki, Y.; Swenson, J.; Hobbs, M.; Bennett, L. M.; Haugen-Strano, A.; Marks, J.; Barrett, J. C.; Tavtigian, S. V.; Shattuck-Eidens, D.; Kamb, A.; Skolnick, M.; Wiseman, R. W.: Isolation of a diverged homeobox gene, MOX1, from the BRCA1 region on 17q21 by solution hybrid capture. Hum. Molec. Genet. 3:1359-1364, 1994; and Jones, K. A.; Black, D. M.; Brown, M. A.; Griffiths, B. L.; Nicolai, H. M.; Chambers, J. A.; Bonjardim, M.; Xu, C.-F.; Boyd, M.; McFarlane, R.; Korn, B.; Poustka, A.; North, M. A.; Scha.

Further studies establishing the function and utilities of MEOX1 are found in John Hopkins OMIM database record ID 600147, and in sited publications numbered 1335-1336 listed in the bibliography section hereinbelow, which are also hereby incorporated by reference. Mannosyl (alpha-1,6-)-glycoprotein Beta-1,6-N-acetyl-glucosaminyltransferase (MGAT5, Accession NM_002410) is another VGAM1958 host target gene. MGAT5 BINDING SITE is HOST TARGET binding site found in the 5' untranslated region of mRNA encoded by MGAT5, corresponding to a HOST TARGET binding site such as BINDING SITE I, BINDING SITE II or BINDING SITE III. Table 2 illustrates the complementarity of the nucleotide sequences of MGAT5 BINDING SITE, designated SEQ ID:8238, to the nucleotide sequence of VGAM1958 RNA, herein designated VGAM RNA, also designated SEQ ID:4669.

Another function of VGAM1958 is therefore inhibition of Mannosyl (alpha-1,6-)-glycoprotein Beta-1,6-N-acetyl-glucosaminyltransferase (MGAT5, Accession NM_002410). Accordingly, utilities of VGAM1958 include diagnosis, prevention and treatment of diseases and clinical conditions associated with MGAT5. Antigen Identified By Monoclonal Antibody Ki-67 (MKI67, Accession NM_002417) is another VGAM1958 host target gene. MKI67 BINDING SITE is HOST TARGET binding site found in the 3' untranslated region of mRNA encoded by MKI67, corresponding to a HOST TARGET binding site such as BINDING SITE I, BINDING SITE II or BINDING SITE III. Table 2 illustrates the complementarity of the nucleotide sequences of MKI67 BINDING SITE, designated SEQ ID:8255, to the nucleotide sequence of VGAM1958 RNA, herein designated VGAM RNA, also designated SEQ ID:4669.

Another function of VGAM1958 is therefore inhibition of Antigen Identified By Monoclonal Antibody Ki-67 (MKI67, Accession NM_002417), a gene which thought to be required for maintaining cell proliferation. Accordingly, utilities of VGAM1958 include diagnosis, prevention and treatment of diseases and clinical conditions associated with MKI67. The function of MKI67 and its association with various diseases and clinical conditions, has been established by previous studies, as described hereinabove with reference to VGAM786. Matrix Metalloproteinase 15 (membrane-inserted) (MMP15, Accession NM_002428) is another VGAM1958 host target gene. MMP15 BINDING SITE is HOST TARGET binding site found in the 3' untranslated region of mRNA encoded by MMP15, corresponding to a HOST TARGET binding site such as BINDING SITE I, BINDING SITE II or BINDING SITE III. Table 2 illustrates the complementarity of the nucleotide sequences of MMP15 BINDING SITE, designated SEQ ID:8265, to the nucleotide sequence of VGAM1958 RNA, herein designated VGAM RNA, also designated SEQ ID:4669.

Another function of VGAM1958 is therefore inhibition of Matrix Metalloproteinase 15 (membrane-inserted) (MMP15, Accession NM_002428). Accordingly, utilities of VGAM1958 include diagnosis, prevention and treatment of diseases and clinical conditions associated with MMP15. MAX Binding Protein (MNT, Accession NM_020310) is another VGAM1958 host target gene. MNT BINDING SITE is HOST TARGET binding site found in the 3" untranslated region of mRNA encoded by MNT, corresponding to a HOST TARGET binding site such as BINDING SITE I, BINDING SITE II or BINDING SITE III. Table 2 illustrates the complementarity of the nucleotide sequences of MNT BINDING SITE, designated SEQ ID:21558, to the nucleotide sequence of VGAM1958 RNA, herein designated VGAM RNA, also designated SEQ ID:4669.

Another function of VGAM1958 is therefore inhibition of MAX Binding Protein (MNT, Accession NM_020310). Accordingly, utilities of VGAM1958 include diagnosis, prevention and treatment of diseases and clinical conditions associated with MNT. Myeloperoxidase (MPO, Accession NM_000250) is another VGAM1958 host target gene. MPO BINDING SITE is HOST TARGET binding site found in the 3' untranslated region of mRNA encoded by MPO, corresponding to a HOST TARGET binding site such as BINDING SITE I, BINDING SITE II or BINDING SITE III. Table 2 illustrates the complementarity of the nucleotide sequences of MPO BINDING SITE, designated SEQ ID:5786, to the nucleotide sequence of VGAM1958 RNA, herein designated VGAM RNA, also designated SEQ ID:4669.

Another function of VGAM1958 is therefore inhibition of Myeloperoxidase (MPO, Accession NM_000250), a gene which is present in primary granules of neutrophilic granulocytes. Accordingly, utilities of VGAM1958 include diagnosis, prevention and treatment of diseases and clinical conditions associated with MPO. The function of MPO and its association with various diseases and clinical conditions, has been established by previous studies, as described hereinabove with reference to VGAM1915. Metallothionein-like 5, Testis-specific (tesmin) (MTL5, Accession NM_004923) is another VGAM1958 host target gene. MTL5 BINDING SITE1 and MTL5 BINDING SITE2 are HOST TARGET binding sites found in untranslated regions of mRNA encoded by MTL5, corresponding to HOST TARGET binding sites such as BINDING SITE I, BINDING SITE II or BINDING SITE III. Table 2 illustrates the complementarity of the nucleotide sequences of MTL5 BINDING SITE1 and MTL5 BINDING SITE2, designated SEQ ID:11359 and SEQ ID:11358 respectively, to the nucleotide sequence of VGAM1958 RNA, herein designated VGAM RNA, also designated SEQ ID:4669.

Another function of VGAM1958 is therefore inhibition of Metallothionein-like 5, Testis-specific (tesmin) (MTL5, Accession NM_004923), a gene which functions in metal homeostasis and protects against heavy-metal toxicity. Accordingly, utilities of VGAM1958 include diagnosis, prevention and treatment of diseases and clinical conditions associated with MTL5. The function of MTL5 and its association with various diseases and clinical conditions, has been established by previous studies, as described hereinabove with reference to VGAM958. Myotubularin Related Protein 8 (MTMR8, Accession NM_015458) is another VGAM1958 host target gene. MTMR8 BINDING SITE is HOST TARGET binding site found in the 3' untranslated region of mRNA encoded by MTMR8, corresponding to a HOST TARGET binding site such as BINDING SITE I, BINDING SITE II or BINDING SITE III. Table 2 illustrates the complementarity of the nucleotide sequences of MTMR8 BINDING SITE, designated SEQ ID:17748, to the nucleotide sequence of VGAM1958 RNA, herein designated VGAM RNA, also designated SEQ ID:4669.

Another function of VGAM1958 is therefore inhibition of Myotubularin Related Protein 8 (MTMR8, Accession NM_015458), a gene which could be a tyrosine-phosphatase. Accordingly, utilities of VGAM1958 include diagnosis, prevention and treatment of diseases and clinical conditions associated with MTMR8. The function of MTMR8 and its association with various diseases and clinical conditions, has been established by previous studies, as described hereinabove with reference to VGAM379. Myosin X (MYO10, Accession NM_012334) is another VGAM1958 host target gene. MYO10 BINDING SITE is HOST TARGET binding site found in the 3' untranslated region of mRNA encoded by MYO10, corresponding to a HOST TARGET binding site such as BINDING SITE I, BINDING SITE II or BINDING SITE III. Table 2 illustrates the complementarity of the nucleotide sequences of MYO10 BINDING SITE, designated SEQ ID:14729, to the nucleotide sequence of VGAM1958 RNA, herein designated VGAM RNA, also designated SEQ ID:4669.

Another function of VGAM1958 is therefore inhibition of Myosin X (MYO10, Accession NM_012334), a gene which is an unconventional myosin. Accordingly, utilities of VGAM1958 include diagnosis, prevention and treatment of diseases and clinical conditions associated with MYO10. The function of MYO10 and its association with various diseases and clinical conditions, has been established by previous studies, as described hereinabove with reference to VGAM28. N-acetylglucosaminidase, Alpha- (Sanfilippo disease IIIB) (NAGLU, Accession NM_000263) is another VGAM1958 host target gene. NAGLU BINDING SITE is HOST TARGET binding site found in the 5' untranslated region of mRNA encoded by NAGLU, corresponding to a HOST TARGET binding site such as BINDING SITE I, BINDING SITE II or BINDING SITE III. Table 2 illustrates the complementarity of the nucleotide sequences of NAGLU BINDING SITE, designated SEQ ID:5804, to the nucleotide sequence of VGAM1958 RNA, herein designated VGAM RNA, also designated SEQ ID:4669.

Another function of VGAM1958 is therefore inhibition of N-acetylglucosaminidase, Alpha- (Sanfilippo disease IIIB) (NAGLU, Accession NM_000263). Accordingly, utilities of VGAM1958 include diagnosis, prevention and treatment of diseases and clinical conditions associated with NAGLU. N-ethylmaleimide-sensitive Factor Attachment Protein, Beta (NAPB, Accession XM_046652) is another VGAM1958 host target gene. NAPB BINDING SITE is HOST TARGET binding site found in the 3' untranslated region of mRNA encoded by NAPB, corresponding to a HOST TARGET binding site such as BINDING SITE I, BINDING SITE II or BINDING SITE III. Table 2 illustrates the complementarity of the nucleotide sequences of NAPB BINDING SITE, designated SEQ ID:34769, to the nucleotide sequence of VGAM1958 RNA, herein designated VGAM RNA, also designated SEQ ID:4669.

Another function of VGAM1958 is therefore inhibition of N-ethylmaleimide-sensitive Factor Attachment Protein, Beta (NAPB, Accession XM_046652). Accordingly, utilities of VGAM1958 include diagnosis, prevention and treatment of diseases and clinical conditions associated with NAPB. Neuron Navigator 2 (NAV2, Accession XM_012028) is another VGAM1958 host target gene. NAV2 BINDING SITE is HOST TARGET binding site found in the 3' untranslated region of mRNA encoded by NAV2, corresponding to a HOST TARGET binding site such as BINDING SITE I, BINDING SITE II or BINDING SITE III. Table 2 illustrates the complementarity of the nucleotide sequences of NAV2 BINDING SITE, designated SEQ ID:30206, to the nucleotide sequence of VGAM1958 RNA, herein designated VGAM RNA, also designated SEQ ID:4669.

Another function of VGAM1958 is therefore inhibition of Neuron Navigator 2 (NAV2, Accession XM_012028), a gene which plays an important role in neuronal development, including neurite outgrowth. Accordingly, utilities of VGAM1958 include diagnosis, prevention and treatment of diseases and clinical conditions associated with NAV2. The function of NAV2 and its association with various diseases and clinical conditions, has been established by previous studies, as described hereinabove with reference to VGAM481. Neurocalcin Delta (NCALD, Accession NM_032041) is another VGAM1958 host target gene. NCALD BINDING SITE is HOST TARGET binding site found in the 3' untranslated region of mRNA encoded by NCALD, corresponding to a HOST TARGET binding site such as BINDING SITE I, BINDING SITE II or BINDING SITE III. Table 2 illustrates the complementarity of the nucleotide sequences of NCALD BINDING SITE, designated SEQ ID:25744, to the nucleotide sequence of VGAM1958 RNA, herein designated VGAM RNA, also designated SEQ ID:4669.

Another function of VGAM1958 is therefore inhibition of Neurocalcin Delta (NCALD, Accession NM_032041). Accordingly, utilities of VGAM1958 include diagnosis, prevention and treatment of diseases and clinical conditions associated with NCALD. Neural Cell Adhesion Molecule 1 (NCAM1, Accession NM_000615) is another VGAM1958 host target gene. NCAM1 BINDING SITE is HOST TARGET binding site found in the 5' untranslated region of mRNA encoded by NCAM1, corresponding to a HOST TARGET binding site such as BINDING SITE I, BINDING SITE II or BINDING SITE III. Table 2 illustrates the complementarity of the nucleotide sequences of NCAM1 BINDING SITE, designated SEQ ID:6216, to the nucleotide sequence of VGAM1958 RNA, herein designated VGAM RNA, also designated SEQ ID:4669.

Another function of VGAM1958 is therefore inhibition of Neural Cell Adhesion Molecule 1 (NCAM1, Accession NM_000615), a gene which is nvolved in neuron-neuron adhesion, neurite fasciculation, outgrowth of neurites, etc. Accordingly, utilities of VGAM1958 include diagnosis, prevention and treatment of diseases and clinical conditions associated with NCAM1. The function of NCAM1 has been established by previous studies. Because of evidence indicating close homology of neural cell adhesion molecule (NCAM) in man and mouse, a murine cDNA probe for NCAM could be used directly for in situ hybridization to human metaphase chromosomes (Nguyen et al., 1985). This procedure indicated that the NCAM gene is located at 11q22-q23. Mietus-Snyder et al. (1989) corroborated the location of the NCAM gene to the 11q23 region by finding linkage to the apolipoprotein gene cluster, APOA1--APOC3--APOA4 (107680, 107720, 107690); a maximum lod score of 3.65 at theta=0.10 was observed. Further studies by Mietus-Snyder et al. (1990) showed a maximum lod score of 15.9 at a recombination fraction of 0.028. d'Eustachio et al. (1985) mapped the NCAM gene to mouse chromosome 9 by means of a genomic probe in somatic cell hybrids. The gene is close to two others on mouse 9 whose expression is related to the nervous system, namely Thy-1 (see OMIM Ref. No. 188230 for the human counterpart) and the cerebellar connectional mutant staggerer (sg); NCAM-associated DNA polymorphisms were used in recombinant inbred strains of mice to show these linkages as well as close linkage to Sep-1 (apolipoprotein 1) and Lap-1 (leucine aminopeptidase 1). Great structural diversity in NCAM is due to transcriptional variations of a single gene and posttranslational mechanisms which are under exquisite developmental control (Rutishauser and Goridis, 1986). The neural cell adhesion molecule appears on early embryonic cells and is important in the formation of cell collectives and their boundaries at sites of morphogenesis. Later in development it is found on various differentiated tissues and is a major CAM mediating adhesion among neurons and between neurons and muscle. NCAM is a membrane-bound glycoprotein that plays a role in cell-cell and cell-matrix adhesion through both its homophilic and heterophilic binding activity. To investigate the significance of this binding, Rabinowitz et al. (1996) used a gene targeting strategy in embryonic stem (ES) cells to replace the membrane-associated form of NCAM with a soluble, secreted form of its extracellular domain. Although the heterozygous mutant ES cells were able to generate low coat color chimeric mice, only the wildtype allele was transmitted, suggesting the possibility of dominant lethality. Analysis of chimeric embryos with a high level of ES cell contribution revealed severe growth retardation and morphologic defects by embryonic days 8.5-9.5. The second allele was also targeted and embryos derived almost entirely from the homozygous mutant ES cells exhibited the same lethal phenotype as observed with heterozygous chimeras Full details of the abovementioned studies are described in the following publications, the disclosure of which are hereby incorporated by reference:

D'Eustachio, P.; Owens, G. C.; Edelman, G. M.; Cunningham, B. A.: Chromosomal location of the gene encoding the neural cell adhesion molecule (N-CAM) in the mouse. Proc. Nat. Acad. Sci. 82:7631-7635, 1985; and Rabinowitz, J. E.; Rutishauser, U.; Magnuson, T.: Targeted mutation of Ncam to produce a secreted molecule results in a dominant embryonic lethality. Proc. Nat. Acad. Sci. 93:6421-64.

Further studies establishing the function and utilities of NCAM1 are found in John Hopkins OMIM database record ID 116930, and in sited publications numbered 11041, 12049-1205 and 12123-12130 listed in the bibliography section hereinbelow, which are also hereby incorporated by reference. Nuclear Receptor Coactivator 3 (NCOA3, Accession NM_006534) is another VGAM1958 host target gene. NCOA3 BINDING SITE is HOST TARGET binding site found in the 3' untranslated region of mRNA encoded by NCOA3, corresponding to a HOST TARGET binding site such as BINDING SITE I, BINDING SITE II or BINDING SITE III. Table 2 illustrates the complementarity of the nucleotide sequences of NCOA3 BINDING SITE, designated SEQ ID:13282, to the nucleotide sequence of VGAM1958 RNA, herein designated VGAM RNA, also designated SEQ ID:4669.

Another function of VGAM1958 is therefore inhibition of Nuclear Receptor Coactivator 3 (NCOA3, Accession NM_006534), a gene which directly binds nuclear receptors and stimulates the transcriptional activities in hormone-dependent fashion. Accordingly, utilities of VGAM1958 include diagnosis, prevention and treatment of diseases and clinical conditions associated with NCOA3. The function of NCOA3 and its association with various diseases and clinical conditions, has been established by previous studies, as described hereinabove with reference to VGAM215. N-myc Downstream Regulated Gene 1 (NDRG1, Accession XM_005243) is another VGAM1958 host target gene. NDRG1 BINDING SITE is HOST TARGET binding site found in the 3' untranslated region of mRNA encoded by NDRG1, corresponding to a HOST TARGET binding site such as BINDING SITE I, BINDING SITE II or BINDING SITE III. Table 2 illustrates the complementarity of the nucleotide sequences of NDRG1 BINDING SITE, designated SEQ ID:29968, to the nucleotide sequence of VGAM1958 RNA, herein designated VGAM RNA, also designated SEQ ID:4669.

Another function of VGAM1958 is therefore inhibition of N-myc Downstream Regulated Gene 1 (NDRG1, Accession XM_005243), a gene which may have a growth inhibitory role. Accordingly, utilities of VGAM1958 include diagnosis, prevention and treatment of diseases and clinical conditions associated with NDRG1. The function of NDRG1 and its association with various diseases and clinical conditions, has been established by previous studies, as described hereinabove with reference to VGAM144. Nuclear Factor of Activated T-cells, Cytoplasmic, Calcineurin-dependent 3 (NFATC3, Accession NM_004555) is another VGAM1958 host target gene. NFATC3 BINDING SITE is HOST TARGET binding site found in the 5' untranslated region of mRNA encoded by NFATC3, corresponding to a HOST TARGET binding site such as BINDING SITE I, BINDING SITE II or BINDING SITE III. Table 2 illustrates the complementarity of the nucleotide sequences of NFATC3 BINDING SITE, designated SEQ ID:10897, to the nucleotide sequence of VGAM1958 RNA, herein designated VGAM RNA, also designated SEQ ID:4669.

Another function of VGAM1958 is therefore inhibition of Nuclear Factor of Activated T-cells, Cytoplasmic, Calcineurin-dependent 3 (NFATC3, Accession NM_004555), a gene which plays a role in the inducible expression of cytokine genes in t cells. Accordingly, utilities of VGAM1958 include diagnosis, prevention and treatment of diseases and clinical conditions associated with NFATC3. The function of NFATC3 has been established by previous studies. The activation of NFAT proteins is controlled by calcineurin, the calmodulin-dependent phosphatase. Aramburu et al. (1998) identified a short conserved sequence in the NFATC3 protein (residues 110-122) that targets calcineurin to NFAT. Mutation of a single residue in this sequence impairs the calcineurin-mediated dephosphorylation and nuclear translocation of NFAT1. Peptides spanning the region inhibit the ability of calcineurin to bind to and dephosphorylate NFAT proteins, without affecting the phosphatase activity of calcineurin against other substrates. When expressed intracellularly, a corresponding peptide inhibits NFAT dephosphorylation, nuclear translocation, and NFAT-mediated expression in response to stimulation. Thus, disruption of the enzyme-substrate docking interaction that directs calcineurin to NFAT can effectively block NFAT-dependent functions Animal model experiments lend further support to the function of NFATC3. Rengarajan et al. (2002) generated Nfatc2 and Nfatc3 double-knockout (DKO) mice. They found that Nfatc2 and Nfatc3 are critical in the determination of the fate of precursor T helper (Th) cells. DKO T cells intrinsically differentiated into Th2 cytokine-secreting cells, even in the absence of IL4 (OMIM Ref. No. 147780). Treatment of DKOs with IL12 (OMIM Ref. No. 161561) and anti-IL4, however, enabled the cells to become gamma-interferon (IFNG; 147570)-secreting Th1 lymphocytes. In addition, the cells from the DKO mice were hyperresponsive to T-cell receptor (TCR; OMIM Ref. No. 186880)-mediated activation and did not require the engagement of the accessory receptor, CD28 (OMIM Ref. No. 186760), for prolifer It is appreciated that the abovementioned animal model for NFATC3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Rengarajan, J.; Tang, B.; Glimcher, L. H.: NFATc2 and NFATc3 regulate TH2 differentiation and modulate TCR-responsiveness of naive TH cells. Nature Immun. 3:48-54, 2002; and Aramburu, J.; Garcia-Cozar, F.; Raghavan, A.; Okamura, H.; Rao, A.; Hogan, P. G.: Selective inhibition of NFAT activation by a peptide spanning the calcineurin targeting site of NFAT. Mol.

Further studies establishing the function and utilities of NFATC3 are found in John Hopkins OMIM database record ID 602698, and in sited publications numbered 9903, 7968, 990 and 10195 listed in the bibliography section hereinbelow, which are also hereby incorporated by reference. Nuclear Factor (erythroid-derived 2), 45 kDa (NFE2, Accession NM_006163) is another VGAM1958 host target gene. NFE2 BINDING SITE is HOST TARGET binding site found in the 5' untranslated region of mRNA encoded by NFE2, corresponding to a HOST TARGET binding site such as BINDING SITE I, BINDING SITE II or BINDING SITE III. Table 2 illustrates the complementarity of the nucleotide sequences of NFE2 BINDING SITE, designated SEQ ID:12818, to the nucleotide sequence of VGAM1958 RNA, herein designated VGAM RNA, also designated SEQ ID:4669.

Another function of VGAM1958 is therefore inhibition of Nuclear Factor (erythroid-derived 2), 45 kDa (NFE2, Accession NM_006163), a gene which regulates expression of the beta globin gene. Accordingly, utilities of VGAM1958 include diagnosis, prevention and treatment of diseases and clinical conditions associated with NFE2. The function of NFE2 has been established by previous studies. Peters et al. (1993) demonstrated that the Nfe2 gene in the mouse maps to chromosome 15 in a region containing the microcytic anemia (mk) gene. Homozygous mk mice were shown by Bannerman et al. (1972) to have defective intestinal iron transport and severe anemia. Peters et al. (1993) demonstrated Nfe2 expression in the mouse small intestine and NF-E2 binding activity in nuclear extracts of a human colon carcinoma cell line (OMIM Ref. No. Caco-2). Caco-2 cells possess properties of the small intestine, including the ability to transport iron. These data together indicated that NF-E2 plays a role in all aspects of hemoglobin production: globin synthesis, heme synthesis, and the procurement of iron. (NF-E2 recognition sites are present not only in the locus control regions of the globin genes but also in the gene promoters of 2 heme biosynthetic enzymes, porphobilinogen deaminase (OMIM Ref. No. 176000) and ferrochelatase (OMIM Ref. No. 177000).) The 45-kD subunit of the human globin locus control region binding protein, NFE2, was cloned by homology to the murine gene. Immunoprecipitation experiments demonstrated in vivo association of the p45 subunit with an 18-kD protein (see OMIM Ref. No. MAFG, 602020, and MAFK, 600197). Because bZIP proteins bind DNA as dimers, it is likely that native NFE2 is a heterodimer of 45- and 18-kD subunits. By fluorescence in situ hybridization, Weremowicz et al. (1993) assigned the p45 subunit of NFE2 to 12q13. Chan et al. (1993) likewise cloned the human homolog of mouse NF-E2. Extensive survey of human tissue samples found that NFE2 expression is not limited to erythropoietic organs. Expression in the colon and testis suggested that NFE2 may participate in the regulation of genes other than globin Full details of the abovementioned studies are described in the following publications, the disclosure of which are hereby incorporated by reference:

Shivdasani, R. A.; Rosenblatt, M. F.; Zucker-Franklin, D.; Jackson, C. W.; Hunt, P.; Saris, C. J. M.; Orkin, S. H.: Transcription factor NF-E2 is required for platelet formation independent of the actions of thrombopoietin/MGDF in megakaryocyte development. Cell 81:695-704, 1995; and Weremowicz, S.; Andrews, N. C.; Orkin, S. H.; Morton, C. C.: Mapping the p45 subunit of human NFE2 to 12q13. (Abstract) Human Genome Mapping Workshop 93 25, 1993.

Further studies establishing the function and utilities of NFE2 are found in John Hopkins OMIM database record ID 601490, and in sited publications numbered 998 and 10585-1274 listed in the bibliography section hereinbelow, which are also hereby incorporated by reference. Nuclear Factor (erythroid-derived 2)-like 1 (NFE2L1, Accession NM_003204) is another VGAM1958 host target gene. NFE2L1 BINDING SITE is HOST TARGET binding site found in the 5' untranslated region of mRNA encoded by NFE2L1, corresponding to a HOST TARGET binding site such as BINDING SITE I, BINDING SITE II or BINDING SITE III. Table 2 illustrates the complementarity of the nucleotide sequences of NFE2L1 BINDING SITE, designated SEQ ID:9197, to the nucleotide sequence of VGAM1958 RNA, herein designated VGAM RNA, also designated SEQ ID:4669.

Another function of VGAM1958 is therefore inhibition of Nuclear Factor (erythroid-derived 2)-like 1 (NFE2L1, Accession NM_003204), a gene which may regulate expression of ferritin genes. Accordingly, utilities of VGAM1958 include diagnosis, prevention and treatment of diseases and clinical conditions associated with NFE2L1. The function of NFE2L1 and its association with various diseases and clinical conditions, has been established by previous studies, as described hereinabove with reference to VGAM369. NKX3A (Accession NM_006167) is another VGAM1958 host target gene. NKX3A BINDING SITE is HOST TARGET binding site found in the 3" untranslated region of mRNA encoded by NKX3A, corresponding to a HOST TARGET binding site such as BINDING SITE I, BINDING SITE II or BINDING SITE III. Table 2 illustrates the complementarity of the nucleotide sequences of NKX3A BINDING SITE, designated SEQ ID:12828, to the nucleotide sequence of VGAM1958 RNA, herein designated VGAM RNA, also designated SEQ ID:4669.

Another function of VGAM1958 is therefore inhibition of NKX3A (Accession NM_006167), a gene which may regulate gene expression and control cell differentiation. Accordingly, utilities of VGAM1958 include diagnosis, prevention and treatment of diseases and clinical conditions associated with NKX3A. The function of NKX3A and its association with various diseases and clinical conditions, has been established by previous studies, as described hereinabove with reference to VGAM481. Neuronal Pentraxin I (NPTX1, Accession NM_002522) is another VGAM1958 host target gene. NPTX1 BINDING SITE is HOST TARGET binding site found in the 3' untranslated region of mRNA encoded by NPTX1, corresponding to a HOST TARGET binding site such as BINDING SITE I, BINDING SITE II or BINDING SITE III. Table 2 illustrates the complementarity of the nucleotide sequences of NPTX1 BINDING SITE, designated SEQ ID:8357, to the nucleotide sequence of VGAM1958 RNA, herein designated VGAM RNA, also designated SEQ ID:4669.

Another function of VGAM1958 is therefore inhibition of Neuronal Pentraxin I (NPTX1, Accession NM_002522), a gene which may be involved in synaptic uptake of extracellular material and is very strongly similar to rat NP1. Accordingly, utilities of VGAM1958 include diagnosis, prevention and treatment of diseases and clinical conditions associated with NPTX1. The function of NPTX1 and its association with various diseases and clinical conditions, has been established by previous studies, as described hereinabove with reference to VGAM111. Nuclear Receptor Subfamily 4, Group A, Member 2 (NR4A2, Accession NM_006186) is another VGAM1958 host target gene. NR4A2 BINDING SITE is HOST TARGET binding site found in the 5' untranslated region of mRNA encoded by NR4A2, corresponding to a HOST TARGET binding site such as BINDING SITE I, BINDING SITE II or BINDING SITE III. Table 2 illustrates the complementarity of the nucleotide sequences of NR4A2 BINDING SITE, designated SEQ ID:12857, to the nucleotide sequence of VGAM1958 RNA, herein designated VGAM RNA, also designated SEQ ID:4669.

Another function of VGAM1958 is therefore inhibition of Nuclear Receptor Subfamily 4, Group A, Member 2 (NR4A2, Accession NM_006186), a gene which may be a general coactivator of transcription. Accordingly, utilities of VGAM1958 include diagnosis, prevention and treatment of diseases and clinical conditions associated with NR4A2. The function of NR4A2 and its association with various diseases and clinical conditions, has been established by previous studies, as described hereinabove with reference to VGAM127. Nebulin-related Anchoring Protein (Nrap, Accession NM_139235) is another VGAM1958 host target gene. Nrap BINDING SITE is HOST TARGET binding site found in the 3' untranslated region of mRNA encoded by Nrap, corresponding to a HOST TARGET binding site such as BINDING SITE I, BINDING SITE II or BINDING SITE III. Table 2 illustrates the complementarity of the nucleotide sequences of Nrap BINDING SITE, designated SEQ ID:29236, to the nucleotide sequence of VGAM1958 RNA, herein designated VGAM RNA, also designated SEQ ID:4669.

Another function of VGAM1958 is therefore inhibition of Nebulin-related Anchoring Protein (Nrap, Accession NM_139235), a gene which performs an anchoring function to link the terminal actin filaments of myofibrils to protein complexes located beneath the sarcolemma. Accordingly, utilities of VGAM1958 include diagnosis, prevention and treatment of diseases and clinical conditions associated with Nrap. The function of Nrap and its association with various diseases and clinical conditions, has been established by previous studies, as described hereinabove with reference to VGAM649. Neurotrophic Tyrosine Kinase, Receptor, Type 2 (NTRK2, Accession NM_006180) is another VGAM1958 host target gene. NTRK2 BINDING SITE is HOST TARGET binding site found in the 5' untranslated region of mRNA encoded by NTRK2, corresponding to a HOST TARGET binding site such as BINDING SITE I, BINDING SITE II or BINDING SITE III. Table 2 illustrates the complementarity of the nucleotide sequences of NTRK2 BINDING SITE, designated SEQ ID:12846, to the nucleotide sequence of VGAM1958 RNA, herein designated VGAM RNA, also designated SEQ ID:4669.

Another function of VGAM1958 is therefore inhibition of Neurotrophic Tyrosine Kinase, Receptor, Type 2 (NTRK2, Accession NM_006180), a gene which is involved in the development and/or maintenance of the nervous system. Accordingly, utilities of VGAM1958 include diagnosis, prevention and treatment of diseases and clinical conditions associated with NTRK2. The function of NTRK2 and its association with various diseases and clinical conditions, has been established by previous studies, as described hereinabove with reference to VGAM341. Nucleobindin 1 (NUCB1, Accession NM_006184) is another VGAM1958 host target gene. NUCB1 BINDING SITE is HOST TARGET binding site found in the 3' untranslated region of mRNA encoded by NUCB1, corresponding to a HOST TARGET binding site such as BINDING SITE I, BINDING SITE II or BINDING SITE III. Table 2 illustrates the complementarity of the nucleotide sequences of NUCB1 BINDING SITE, designated SEQ ID:12852, to the nucleotide sequence of VGAM1958 RNA, herein designated VGAM RNA, also designated SEQ ID:4669.

Another function of VGAM1958 is therefore inhibition of Nucleobindin 1 (NUCB1, Accession NM_006184), a gene which may have a role in calcium homeostasis. Accordingly, utilities of VGAM1958 include diagnosis, prevention and treatment of diseases and clinical conditions associated with NUCB1. The function of NUCB1 and its association with various diseases and clinical conditions, has been established by previous studies, as described hereinabove with reference to VGAM1523. Nuclear Mitotic Apparatus Protein 1 (NUMA1, Accession XM_167853) is another VGAM1958 host target gene. NUMA1 BINDING SITE is HOST TARGET binding site found in the 5' untranslated region of mRNA encoded by NUMA1, corresponding to a HOST TARGET binding site such as BINDING SITE I, BINDING SITE II or BINDING SITE III. Table 2 illustrates the complementarity of the nucleotide sequences of NUMA1 BINDING SITE, designated SEQ ID:44883, to the nucleotide sequence of VGAM1958 RNA, herein designated VGAM RNA, also designated SEQ ID:4669.

Another function of VGAM1958 is therefore inhibition of Nuclear Mitotic Apparatus Protein 1 (NUMA1, Accession XM_167853), a gene which is nuclear mitotic apparatus protein. Accordingly, utilities of VGAM1958 include diagnosis, prevention and treatment of diseases and clinical conditions associated with NUMA1. The function of NUMA1 and its association with various diseases and clinical conditions, has been established by previous studies, as described hereinabove with reference to VGAM192. Nucleoporin 98 kDa (NUP98, Accession NM_016320) is another VGAM1958 host target gene. NUP98 BINDING SITE is HOST TARGET binding site found in the 3' untranslated region of mRNA encoded by NUP98, corresponding to a HOST TARGET binding site such as BINDING SITE I, BINDING SITE II or BINDING SITE III. Table 2 illustrates the complementarity of the nucleotide sequences of NUP98 BINDING SITE, designated SEQ ID:18444, to the nucleotide sequence of VGAM1958 RNA, herein designated VGAM RNA, also designated SEQ ID:4669.

Another function of VGAM1958 is therefore inhibition of Nucleoporin 98kDa (NUP98, Accession NM_016320), a gene which functions in the nuclear transport of protein and RNA. Accordingly, utilities of VGAM1958 include diagnosis, prevention and treatment of diseases and clinical conditions associated with NUP98. The function of NUP98 and its association with various diseases and clinical conditions, has been established by previous studies, as described hereinabove with reference to VGAM55.2'-5'-oligoadenylate Synthetase 2, 69/71 kDa (OAS2, Accession NM_002535) is another VGAM1958 host target gene. OAS2 BINDING SITE is HOST TARGET binding site found in the 3' untranslated region of mRNA encoded by OAS2, corresponding to a HOST TARGET binding site such as BINDING SITE I, BINDING SITE II or BINDING SITE III. Table 2 illustrates the complementarity of the nucleotide sequences of OAS2 BINDING SITE, designated SEQ ID:8374, to the nucleotide sequence of VGAM1958 RNA, herein designated VGAM RNA, also designated SEQ ID:4669.

Another function of VGAM1958 is therefore inhibition of 2'-5'-oligoadenylate Synthetase 2, 69/71 kDa (OAS2, Accession NM_002535), a gene which may play a role in mediating resistance to virus infection, control of cell growth, differentiation, and apoptosis. Accordingly, utilities of VGAM1958 include diagnosis, prevention and treatment of diseases and clinical conditions associated with OAS2. The function of OAS2 and its association with various diseases and clinical conditions, has been established by previous studies, as described hereinabove with reference to VGAM1498. O-linked N-acetylglucosamine (GlcNAc) Transferase (UDP-N-acetylglucosamine:polypeptide-N-acetylglucosaminyl transferase) (OGT, Accession NM_003605) is another VGAM1958 host target gene. OGT BINDING SITE is HOST TARGET binding site found in the 5' untranslated region of mRNA encoded by OGT, corresponding to a HOST TARGET binding site such as BINDING SITE I, BINDING SITE II or BINDING SITE III. Table 2 illustrates the complementarity of the nucleotide sequences of OGT BINDING SITE, designated SEQ ID:9662, to the nucleotide sequence of VGAM1958 RNA, herein designated VGAM RNA, also designated SEQ ID:4669.

Another function of VGAM1958 is therefore inhibition of O-linked N-acetylglucosamine (GlcNAc) Transferase (UDP-N-acetylglucosamine:polypeptide-N-acetylglucosaminyl transferase) (OGT, Accession NM_003605), a gene which has a role in the glycosylation of nuclear and cytoplasmic proteins. Accordingly, utilities of VGAM1958 include diagnosis, prevention and treatment of diseases and clinical conditions associated with OGT. The function of OGT and its association with various diseases and clinical conditions, has been established by previous studies, as described hereinabove with reference to VGAM464. Oligodendrocyte Lineage Transcription Factor 2 (OLIG2, Accession NM_005806) is another VGAM1958 host target gene. OLIG2 BINDING SITE is HOST TARGET binding site found in the 3' untranslated region of mRNA encoded by OLIG2, corresponding to a HOST TARGET binding site such as BINDING SITE I, BINDING SITE II or BINDING SITE III. Table 2 illustrates the complementarity of the nucleotide sequences of OLIG2 BINDING SITE, designated SEQ ID:12381, to the nucleotide sequence of VGAM1958 RNA, herein designated VGAM RNA, also designated SEQ ID:4669.

Another function of VGAM1958 is therefore inhibition of Oligodendrocyte Lineage Transcription Factor 2 (OLIG2, Accession NM_005806), a gene which may bind DNA and contains a helix-loop-helix DNA-binding domain. Accordingly, utilities of VGAM1958 include diagnosis, prevention and treatment of diseases and clinical conditions associated with OLIG2. The function of OLIG2 and its association with various diseases and clinical conditions, has been established by previous studies, as described hereinabove with reference to VGAM1514. Oligophrenin 1 (OPHN1, Accession NM_002547) is another VGAM1958 host target gene. OPHN1 BINDING SITE is HOST TARGET binding site found in the 3' untranslated region of mRNA encoded by OPHN1, corresponding to a HOST TARGET binding site such as BINDING SITE I, BINDING SITE II or BINDING SITE III. Table 2 illustrates the complementarity of the nucleotide sequences of OPHN1 BINDING SITE, designated SEQ ID:8401, to the nucleotide sequence of VGAM1958 RNA, herein designated VGAM RNA, also designated SEQ ID:4669.

Another function of VGAM1958 is therefore inhibition of Oligophrenin 1 (OPHN1, Accession NM_002547). Accordingly, utilities of VGAM1958 include diagnosis, prevention and treatment of diseases and clinical conditions associated with OPHN1. Otoferlin (OTOF, Accession NM_004802) is another VGAM1958 host target gene. OTOF BINDING SITE is HOST TARGET binding site found in the 3' untranslated region of mRNA encoded by OTOF, corresponding to a HOST TARGET binding site such as BINDING SITE I, BINDING SITE II or BINDING SITE III. Table 2 illustrates the complementarity of the nucleotide sequences of OTOF BINDING SITE, designated SEQ ID:11225, to the nucleotide sequence of VGAM1958 RNA, herein designated VGAM RNA, also designated SEQ ID:4669.

Another function of VGAM1958 is therefore inhibition of Otoferlin (OTOF, Accession NM_004802), a gene which is involved in vesicle membrane fusion and required for inner ear function. Accordingly, utilities of VGAM1958 include diagnosis, prevention and treatment of diseases and clinical conditions associated with OTOF. The function of OTOF and its association with various diseases and clinical conditions, has been established by previous studies, as described hereinabove with reference to VGAM625. Protein Kinase C and Casein Kinase Substrate In Neurons 1 (PACSIN1, Accession XM_166424) is another VGAM1958 host target gene. PACSIN1 BINDING SITE is HOST TARGET binding site found in the 3' untranslated region of mRNA encoded by PACSIN1, corresponding to a HOST TARGET binding site such as BINDING SITE I, BINDING SITE II or BINDING SITE III. Table 2 illustrates the complementarity of the nucleotide sequences of PACSIN1 BINDING SITE, designated SEQ ID:44315, to the nucleotide sequence of VGAM1958 RNA, herein designated VGAM RNA, also designated SEQ ID:4669.

Another function of VGAM1958 is therefore inhibition of Protein Kinase C and Casein Kinase Substrate In Neurons 1 (PACSIN1, Accession XM_166424). Accordingly, utilities of VGAM1958 include diagnosis, prevention and treatment of diseases and clinical conditions associated with PACSIN1. Phosphoribosylaminoimidazole Carboxylase, Phosphoribosylaminoimidazole Succinocarboxamide Synthetase (PAICS, Accession NM_006452) is another VGAM1958 host target gene. PAICS BINDING SITE is HOST TARGET binding site found in the 5' untranslated region of mRNA encoded by PAICS, corresponding to a HOST TARGET binding site such as BINDING SITE I, BINDING SITE II or BINDING SITE III. Table 2 illustrates the complementarity of the nucleotide sequences of PAICS BINDING SITE, designated SEQ ID:13163, to the nucleotide sequence of VGAM1958 RNA, herein designated VGAM RNA, also designated SEQ ID:4669.

Another function of VGAM1958 is therefore inhibition of Phosphoribosylaminoimidazole Carboxylase, Phosphoribosylaminoimidazole Succinocarboxamide Synthetase (PAICS, Accession NM_006452), a gene which is required for purine biosynthesis. Accordingly, utilities of VGAM1958 include diagnosis, prevention and treatment of diseases and clinical conditions associated with PAICS. The function of PAICS and its association with various diseases and clinical conditions, has been established by previous studies, as described hereinabove with reference to VGAM894. PART1 (Accession NM_016590) is another VGAM1958 host target gene. PART1 BINDING SITE is HOST TARGET binding site found in the 3' untranslated region of mRNA encoded by PART1, corresponding to a HOST TARGET binding site such as BINDING SITE I, BINDING SITE II or BINDING SITE III. Table 2 illustrates the complementarity of the nucleotide sequences of PART1 BINDING SITE, designated SEQ ID:18666, to the nucleotide sequence of VGAM1958 RNA, herein designated VGAM RNA, also designated SEQ ID:4669.

Another function of VGAM1958 is therefore inhibition of PART1 (Accession NM_016590). Accordingly, utilities of VGAM1958 include diagnosis, prevention and treatment of diseases and clinical conditions associated with PART1. Prostatic Binding Protein (PBP, Accession NM_002567) is another VGAM1958 host target gene. PBP BINDING SITE is HOST TARGET binding site found in the 3' untranslated region of mRNA encoded by PBP, corresponding to a HOST TARGET binding site such as BINDING SITE I, BINDING SITE II or BINDING SITE III. Table 2 illustrates the complementarity of the nucleotide sequences of PBP BINDING SITE, designated SEQ ID:8415, to the nucleotide sequence of VGAM1958 RNA, herein designated VGAM RNA, also designated SEQ ID:4669.

Another function of VGAM1958 is therefore inhibition of Prostatic Binding Protein (PBP, Accession NM_002567), a gene which regulates the activity of the Raf/MEK/ERK module. Accordingly, utilities of VGAM1958 include diagnosis, prevention and treatment of diseases and clinical conditions associated with PBP. The function of PBP and its association with various diseases and clinical conditions, has been established by previous studies, as described hereinabove with reference to VGAM1332. Protocadherin Beta 16 (PCDHB16, Accession NM_020957) is another VGAM1958 host target gene. PCDHB16 BINDING SITE is HOST TARGET binding site found in the 5' untranslated region of mRNA encoded by PCDHB16, corresponding to a HOST TARGET binding site such as BINDING SITE I, BINDING SITE II or BINDING SITE III. Table 2 illustrates the complementarity of the nucleotide sequences of PCDHB16 BINDING SITE, designated SEQ ID:21943, to the nucleotide sequence of VGAM1958 RNA, herein designated VGAM RNA, also designated SEQ ID:4669.

Another function of VGAM1958 is therefore inhibition of Protocadherin Beta 16 (PCDHB16, Accession NM_020957), a gene which is a potential calcium-dependent cell-adhesion protein. Accordingly, utilities of VGAM1958 include diagnosis, prevention and treatment of diseases and clinical conditions associated with PCDHB16. The function of PCDHB16 and its association with various diseases and clinical conditions, has been established by previous studies, as described hereinabove with reference to VGAM931.6-phosphofructo-2-kinase/fructose-2,6-biphosphatase 3 (PFKFB3, Accession XM_096349) is another VGAM1958 host target gene. PFKFB3 BINDING SITE is HOST TARGET binding site found in the 3' untranslated region of mRNA encoded by PFKFB3, corresponding to a HOST TARGET binding site such as BINDING SITE I, BINDING SITE II or BINDING SITE III. Table 2 illustrates the complementarity of the nucleotide sequences of PFKFB3 BINDING SITE, designated SEQ ID:40318, to the nucleotide sequence of VGAM1958 RNA, herein designated VGAM RNA, also designated SEQ ID:4669.

Another function of VGAM1958 is therefore inhibition of 6-phosphofructo-2-kinase/fructose-2,6-biphosphatase 3 (PFKFB3, Accession XM_096349), a gene which catalizes synthesis and degradation of fructose 2,6-bisphosphate. Accordingly, utilities of VGAM1958 include diagnosis, prevention and treatment of diseases and clinical conditions associated with PFKFB3. The function of PFKFB3 has been established by previous studies. The bifunctional 6-phosphofructo-2-kinase (EC 2.7.1.105)/fructose-2,6-bisphosphatase (EC 3.1.3.46) (PFKFB) regulates the steady-state concentration of fructose-2,6-bisphosphate, a potent activator of a key regulatory enzyme of glycolysis, phosphofructokinase. Cancer cells maintain a high glycolytic rate even in the presence of oxygen, a phenomenon known as the Warburg effect (Warburg, 1956). The glycolytic rate in the placenta, another fast-growing tissue, is accelerated by anoxia and by maternal diabetes By screening a placental cDNA library with human and frog liver PFKFB (PFKFB1; 311790) as probes, Sakai et al. (1996) obtained a cDNA encoding PFKFB3, which they termed HP (human placental PFKFB). The predicted PFKFB3 protein, which is 61% similar to human liver PFKFB, contains 529 amino acids and 7 potential phosphorylation sites. Northern blot analysis of first-trimester and term placentas detected a 4.5-kb PFKFB3 transcript Full details of the abovementioned studies are described in the following publications, the disclosure of which are hereby incorporated by reference:

Sakai, A.; Kato, M.; Fukasawa, M.; Ishiguro, M.; Furuya, E.; Sakakibara, R.: Cloning of cDNA encoding for a novel isozyme of fructose 6-phosphate,2-kinase/fructose 2,6-bisphosphatase from human placenta. J. Biochem. 119: 506-511, 1996; and Warburg, O.: On the origin of cancer cells. Science 123: 309-314, 1956.

Further studies establishing the function and utilities of PFKFB3 are found in John Hopkins OMIM database record ID 605319, and in sited publications numbered 4485-4488, 449 and 7350 listed in the bibliography section hereinbelow, which are also hereby incorporated by reference. Phosphoinositide-3-kinase, Regulatory Subunit, Polypeptide 3 (p55, gamma) (PIK3R3, Accession XM_027982) is another VGAM1958 host target gene. PIK3R3 BINDING SITE is HOST TARGET binding site found in the 3' untranslated region of mRNA encoded by PIK3R3, corresponding to a HOST TARGET binding site such as BINDING SITE I, BINDING SITE II or BINDING SITE III. Table 2 illustrates the complementarity of the nucleotide sequences of PIK3R3 BINDING SITE, designated SEQ ID:30605, to the nucleotide sequence of VGAM1958 RNA, herein designated VGAM RNA, also designated SEQ ID:4669.

Another function of VGAM1958 is therefore inhibition of Phosphoinositide-3-kinase, Regulatory Subunit, Polypeptide 3 (p55, gamma) (PIK3R3, Accession XM_027982). Accordingly, utilities of VGAM1958 include diagnosis, prevention and treatment of diseases and clinical conditions associated with PIK3R3. Polycystic Kidney Disease 1 (autosomal dominant) (PKD1, Accession NM_000296) is another VGAM1958 host target gene. PKD1 BINDING SITE is HOST TARGET binding site found in the 5' untranslated region of mRNA encoded by PKD1, corresponding to a HOST TARGET binding site such as BINDING SITE I, BINDING SITE II or BINDING SITE III. Table 2 illustrates the complementarity of the nucleotide sequences of PKD1 BINDING SITE, designated SEQ ID:5841, to the nucleotide sequence of VGAM1958 RNA, herein designated VGAM RNA, also designated SEQ ID:4669.

Another function of VGAM1958 is therefore inhibition of Polycystic Kidney Disease 1 (autosomal dominant) (PKD1, Accession NM_000296). Accordingly, utilities of VGAM1958 include diagnosis, prevention and treatment of diseases and clinical conditions associated with PKD1. Phospholipase A2, Group IID (PLA2G2D, Accession NM_012400) is another VGAM1958 host target gene. PLA2G2D BINDING SITE1 and PLA2G2D BINDING SITE2 are HOST TARGET binding sites found in untranslated regions of mRNA encoded by PLA2G2D, corresponding to HOST TARGET binding sites such as BINDING SITE I, BINDING SITE II or BINDING SITE III. Table 2 illustrates the complementarity of the nucleotide sequences of PLA2G2D BINDING SITE1 and PLA2G2D BINDING SITE2, designated SEQ ID:14772 and SEQ ID:14769 respectively, to the nucleotide sequence of VGAM1958 RNA, herein designated VGAM RNA, also designated SEQ ID:4669.

Another function of VGAM1958 is therefore inhibition of Phospholipase A2, Group IID (PLA2G2D, Accession NM_012400), a gene which is involved in phospholipid digestion, remodeling of cell membranes, and host defense, as well as pathophysiologic processes. Accordingly, utilities of VGAM1958 include diagnosis, prevention and treatment of diseases and clinical conditions associated with PLA2G2D. The function of PLA2G2D and its association with various diseases and clinical conditions, has been established by previous studies, as described hereinabove with reference to VGAM74. Phospholipase C, Beta 2 (PLCB2, Accession NM_004573) is another VGAM1958 host target gene. PLCB2 BINDING SITE is HOST TARGET binding site found in the 5' untranslated region of mRNA encoded by PLCB2, corresponding to a HOST TARGET binding site such as BINDING SITE I, BINDING SITE II or BINDING SITE III. Table 2 illustrates the complementarity of the nucleotide sequences of PLCB2 BINDING SITE, designated SEQ ID:10916, to the nucleotide sequence of VGAM1958 RNA, herein designated VGAM RNA, also designated SEQ ID:4669.

Another function of VGAM1958 is therefore inhibition of Phospholipase C, Beta 2 (PLCB2, Accession NM_004573), a gene which is the beta 2 subunit of phospholipase C. Accordingly, utilities of VGAM1958 include diagnosis, prevention and treatment of diseases and clinical conditions associated with PLCB2. The function of PLCB2 and its association with various diseases and clinical conditions, has been established by previous studies, as described hereinabove with reference to VGAM1188. Protein Phosphatase 1, Catalytic Subunit, Beta Isoform (PPP1CB, Accession NM_002709) is another VGAM1958 host target gene. PPP1CB BINDING SITE is HOST TARGET binding site found in the 3' untranslated region of mRNA encoded by PPP1CB, corresponding to a HOST TARGET binding site such as BINDING SITE I, BINDING SITE II or BINDING SITE III. Table 2 illustrates the complementarity of the nucleotide sequences of PPP1CB BINDING SITE, designated SEQ ID:8556, to the nucleotide sequence of VGAM1958 RNA, herein designated VGAM RNA, also designated SEQ ID:4669.

Another function of VGAM1958 is therefore inhibition of Protein Phosphatase 1, Catalytic Subunit, Beta Isoform (PPP1CB, Accession NM_002709), a gene which is the catalytic subunit of protein phosphatase 1. Accordingly, utilities of VGAM1958 include diagnosis, prevention and treatment of diseases and clinical conditions associated with PPP1CB. The function of PPP1CB and its association with various diseases and clinical conditions, has been established by previous studies, as described hereinabove with reference to VGAM46. Protein Phosphatase 2, Regulatory Subunit B (B56), Alpha Isoform (PPP2R5A, Accession NM_006243) is another VGAM1958 host target gene. PPP2R5A BINDING SITE is HOST TARGET binding site found in the 3' untranslated region of mRNA encoded by PPP2R5A, corresponding to a HOST TARGET binding site such as BINDING SITE I, BINDING SITE II or BINDING SITE III. Table 2 illustrates the complementarity of the nucleotide sequences of PPP2R5A BINDING SITE, designated SEQ ID:12909, to the nucleotide sequence of VGAM1958 RNA, herein designated VGAM RNA, also designated SEQ ID:4669.

Another function of VGAM1958 is therefore inhibition of Protein Phosphatase 2, Regulatory Subunit B (B56), Alpha Isoform (PPP2R5A, Accession NM_006243), a gene which is a regulatory subunit of protein phosphatase 2A. Accordingly, utilities of VGAM1958 include diagnosis, prevention and treatment of diseases and clinical conditions associated with PPP2R5A. The function of PPP2R5A and its association with various diseases and clinical conditions, has been established by previous studies, as described hereinabove with reference to VGAM675. Palmitoyl-protein Thioesterase 1 (ceroid-lipofuscinosis, neuronal 1, infantile) (PPT1, Accession XM_029842) is another VGAM1958 host target gene. PPT1 BINDING SITE is HOST TARGET binding site found in the 3' untranslated region of mRNA encoded by PPT1, corresponding to a HOST TARGET binding site such as BINDING SITE I, BINDING SITE II or BINDING SITE III. Table 2 illustrates the complementarity of the nucleotide sequences of PPT1 BINDING SITE, designated SEQ ID:30956, to the nucleotide sequence of VGAM1958 RNA, herein designated VGAM RNA, also designated SEQ ID:4669.

Another function of VGAM1958 is therefore inhibition of Palmitoyl-protein Thioesterase 1 (ceroid-lipofuscinosis, neuronal 1, infantile) (PPT1, Accession XM_029842). Accordingly, utilities of VGAM1958 include diagnosis, prevention and treatment of diseases and clinical conditions associated with PPT1. Protein Kinase C, Alpha Binding Protein (PRKCABP, Accession NM_012407) is another VGAM1958 host target gene. PRKCABP BINDING SITE is HOST TARGET binding site found in the 5' untranslated region of mRNA encoded by PRKCABP, corresponding to a HOST TARGET binding site such as BINDING SITE I, BINDING SITE II or BINDING SITE III. Table 2 illustrates the complementarity of the nucleotide sequences of PRKCABP BINDING SITE, designated SEQ ID:14787, to the nucleotide sequence of VGAM1958 RNA, herein designated VGAM RNA, also designated SEQ ID:4669.

Another function of VGAM1958 is therefore inhibition of Protein Kinase C, Alpha Binding Protein (PRKCABP, Accession NM_012407), a gene which may interact with the catalytic domain of protein C kinase. Accordingly, utilities of VGAM1958 include diagnosis, prevention and treatment of diseases and clinical conditions associated with PRKCABP. The function of PRKCABP has been established by previous studies. Staudinger et al. (1995) obtained a mouse cDNA encoding Prkcabp, which they called Pick1 (protein interacting with C kinase-1), using a yeast 2-hybrid screen with the catalytic domain of the alpha isoform of activated protein kinase C (PRKCA; 176960) as bait. Immunofluorescence microscopy demonstrated intense perinuclear and diffuse cytoplasmic staining. Using a yeast 2-hybrid screen of a B-cell cDNA library with p67-phox (NCF2; 233710) as bait, Takeya et al. (2000) obtained a cDNA encoding human PRKCABP, which they called PICK1. Sequence analysis predicted that the 415-amino acid protein, which is 92% identical to the mouse protein, contains an N-terminal PDZ domain and a conserved arfaptin homology (AH) domain (see OMIM Ref. No. 601638). Northern blot analysis revealed ubiquitous expression of a 2.0-kb PICK1 transcript. Genomic sequence analysis determined that the PICK1 gene contains 13 exons and spans at least 18 kb. Yeast 2-hybrid analysis indicated that the PDZ domain, but not the AH domain, of PICK1 interacts with the C termini of the GTP-bound forms of ADP-ribosylation factor-1 (ARF1; 103180) and ARF3 (OMIM Ref. No. 103190). The interaction with ARF5 (OMIM Ref. No. 103188) and ARF6 (OMIM Ref. No. 600464) was weak, suggesting that the PICK1 interaction is specific for class I ARFs and that it may regulate Golgi-to-endoplasmic reticulum vesicle transport. Dev et al. (1999) showed that the PDZ domain of rat Pick1 interacts with the last 10 amino acids of the short C-terminal alternative splice variants of AMPA receptor subunits (e.g., GLUR2; 138248). They proposed that E-S-V/I-K-I, a sequence found in these 10 amino acids, is a novel PDZ-binding motif. Dev et al. (1999) noted that PRKCA phosphorylates Pick1 efficiently but binds Pick1 in both the phosphorylated and unphosphorylated states. Xia et al. (1999) reported that Pick1 interacts with mouse AMPA glutamate receptors and noted their colocalization at excitatory synapses in the brain. Using a yeast 2-hybrid system, Cowan et al. (2000) demonstrated that mouse Pick1 binds the C-terminal tail of Ephb2 (OMIM Ref. No. 600997). Metabotropic glutamate receptor-7 (mGluR7; 604101) localizes specifically to presynaptic active zones. Boudin et al. (2000) showed that the extreme C-terminal 3 amino acids of mGluR7 interact with the PDZ domain of Pick1. Immunofluorescence microscopy demonstrated that both proteins are localized at excitatory synapses in hippocampal neurons. The authors showed that the clustering of mGluR7 at synapses requires its C-terminal PDZ-binding residues. Mutant mGluR7 lacking the PDZ-binding residues localized diffusely along axons rather than at the synapse, suggesting a role for Pick1 as a scaffolding molecule at presynaptic sites. By its inclusion within a mapped clone, Takeya et al. (2000) mapped the PRKCABP gene to 22q12.3-q13.2.

Full details of the abovementioned studies are described in the following publications, the disclosure of which are hereby incorporated by reference:

Boudin, H.; Doan, A.; Xia, J.; Shigemoto, R.; Huganir, R. L.; Worley, P.; Craig, A. M.: Presynaptic clustering of mGluR7a requires the PICK1 PDZ domain binding site. Neuron 28:485-497, 2000; and Cowan, C. A.; Yokoyama, N.; Bianchi, L. M.; Henkemeyer, M.; Fritzsch, B.: EphB2 guides axons at the midline and is necessary for normal vestibular function. Neuron 26:417-430, 2000.

Further studies establishing the function and utilities of PRKCABP are found in John Hopkins OMIM database record ID 605926, and in sited publications numbered 644 and 12328-6444 listed in the bibliography section hereinbelow, which are also hereby incorporated by reference. Prostaglandin F Receptor (FP) (PTGFR, Accession NM_000959) is another VGAM1958 host target gene. PTGFR BINDING SITE is HOST TARGET binding site found in the 3' untranslated region of mRNA encoded by PTGFR, corresponding to a HOST TARGET binding site such as BINDING SITE I, BINDING SITE II or BINDING SITE III. Table 2 illustrates the complementarity of the nucleotide sequences of PTGFR BINDING SITE, designated SEQ ID:6664, to the nucleotide sequence of VGAM1958 RNA, herein designated VGAM RNA, also designated SEQ ID:4669.

Another function of VGAM1958 is therefore inhibition of Prostaglandin F Receptor (FP) (PTGFR, Accession NM_000959), a gene which mediates intracellular calcium flux, strongly similar to murine Ptgfr. Accordingly, utilities of VGAM1958 include diagnosis, prevention and treatment of diseases and clinical conditions associated with PTGFR. The function of PTGFR and its association with various diseases and clinical conditions, has been established by previous studies, as described hereinabove with reference to VGAM1781. Prostaglandin-endoperoxide Synthase 1 (prostaglandin G/H synthase and cyclooxygenase) (PTGS1, Accession NM_000962) is another VGAM1958 host target gene. PTGS1 BINDING SITE1 and PTGS1 BINDING SITE2 are HOST TARGET binding sites found in untranslated regions of mRNA encoded by PTGS1, corresponding to HOST TARGET binding sites such as BINDING SITE I, BINDING SITE II or BINDING SITE III. Table 2 illustrates the complementarity of the nucleotide sequences of PTGS1 BINDING SITE1 and PTGS1 BINDING SITE2, designated SEQ ID:6674 and SEQ ID:27895 respectively, to the nucleotide sequence of VGAM1958 RNA, herein designated VGAM RNA, also designated SEQ ID:4669.

Another function of VGAM1958 is therefore inhibition of Prostaglandin-endoperoxide Synthase 1 (prostaglandin G/H synthase and cyclooxygenase) (PTGS1, Accession NM_000962), a gene which may play an important role in regulating or promoting cell proliferation in some normal and neoplastically transformed cells. Accordingly, utilities of VGAM1958 include diagnosis, prevention and treatment of diseases and clinical conditions associated with PTGS1. The function of PTGS1 and its association with various diseases and clinical conditions, has been established by previous studies, as described hereinabove with reference to VGAM1224. Protein Tyrosine Phosphatase, Non-receptor Type 11 (Noonan syndrome 1) (PTPN11, Accession NM_002834) is another VGAM1958 host target gene. PTPN11 BINDING SITE1 and PTPN11 BINDING SITE2 are HOST TARGET binding sites found in untranslated regions of mRNA encoded by PTPN11, corresponding to HOST TARGET binding sites such as BINDING SITE I, BINDING SITE II or BINDING SITE III. Table 2 illustrates the complementarity of the nucleotide sequences of PTPN11 BINDING SITE1 and PTPN11 BINDING SITE2, designated SEQ ID:8712 and SEQ ID:10539 respectively, to the nucleotide sequence of VGAM1958 RNA, herein designated VGAM RNA, also designated SEQ ID:4669.

Another function of VGAM1958 is therefore inhibition of Protein Tyrosine Phosphatase, Non-receptor Type 11 (Noonan syndrome 1) (PTPN11, Accession NM_002834). Accordingly, utilities of VGAM1958 include diagnosis, prevention and treatment of diseases and clinical conditions associated with PTPN11. Phosphorylase, Glycogen; Brain (PYGB, Accession NM_002862) is another VGAM1958 host target gene. PYGB BINDING SITE is HOST TARGET binding site found in the 3' untranslated region of mRNA encoded by PYGB, corresponding to a HOST TARGET binding site such as BINDING SITE I, BINDING SITE II or BINDING SITE III. Table 2 illustrates the complementarity of the nucleotide sequences of PYGB BINDING SITE, designated SEQ ID:8764, to the nucleotide sequence of VGAM1958 RNA, herein designated VGAM RNA, also designated SEQ ID:4669.

Another function of VGAM1958 is therefore inhibition of Phosphorylase, Glycogen; Brain (PYGB, Accession NM_002862). Accordingly, utilities of VGAM1958 include diagnosis, prevention and treatment of diseases and clinical conditions associated with PYGB. PYGO2 (Accession XM_034083) is another VGAM1958 host target gene. PYGO2 BINDING SITE is HOST TARGET binding site found in the 3' untranslated region of mRNA encoded by PYGO2, corresponding to a HOST TARGET binding site such as BINDING SITE I, BINDING SITE II or BINDING SITE III. Table 2 illustrates the complementarity of the nucleotide sequences of PYGO2 BINDING SITE, designated SEQ ID:32000, to the nucleotide sequence of VGAM1958 RNA, herein designated VGAM RNA, also designated SEQ ID:4669.

Another function of VGAM1958 is therefore inhibition of PYGO2 (Accession XM_034083). Accordingly, utilities of VGAM1958 include diagnosis, prevention and treatment of diseases and clinical conditions associated with PYGO2. RAB, Member of RAS Oncogene Family-like 2A (RABL2A, Accession NM_013412) is another VGAM1958 host target gene. RABL2A BINDING SITE is HOST TARGET binding site found in the 3' untranslated region of mRNA encoded by RABL2A, corresponding to a HOST TARGET binding site such as BINDING SITE I, BINDING SITE II or BINDING SITE III. Table 2 illustrates the complementarity of the nucleotide sequences of RABL2A BINDING SITE, designated SEQ ID:15077, to the nucleotide sequence of VGAM1958 RNA, herein designated VGAM RNA, also designated SEQ ID:4669.

Another function of VGAM1958 is therefore inhibition of RAB, Member of RAS Oncogene Family-like 2A (RABL2A, Accession NM_013412). Accordingly, utilities of VGAM1958 include diagnosis, prevention and treatment of diseases and clinical conditions associated with RABL2A. RAB, Member of RAS Oncogene Family-like 2B (RABL2B, Accession NM_007081) is another VGAM1958 host target gene. RABL2B BINDING SITE is HOST TARGET binding site found in the 3' untranslated region of mRNA encoded by RABL2B, corresponding to a HOST TARGET binding site such as BINDING SITE I, BINDING SITE II or BINDING SITE III. Table 2 illustrates the complementarity of the nucleotide sequences of RABL2B BINDING SITE, designated SEQ ID:13944, to the nucleotide sequence of VGAM1958 RNA, herein designated VGAM RNA, also designated SEQ ID:4669.

Another function of VGAM1958 is therefore inhibition of RAB, Member of RAS Oncogene Family-like 2B (RABL2B, Accession NM_007081). Accordingly, utilities of VGAM1958 include diagnosis, prevention and treatment of diseases and clinical conditions associated with RABL2B. RAD1 Homolog (S. pombe) (RAD1, Accession NM_133377) is another VGAM1958 host target gene. RAD1 BINDING SITE is HOST TARGET binding site found in the 5' untranslated region of mRNA encoded by RAD1, corresponding to a HOST TARGET binding site such as BINDING SITE I, BINDING SITE II or BINDING SITE III. Table 2 illustrates the complementarity of the nucleotide sequences of RAD1 BINDING SITE, designated SEQ ID:28499, to the nucleotide sequence of VGAM1958 RNA, herein designated VGAM RNA, also designated SEQ ID:4669.

Another function of VGAM1958 is therefore inhibition of RAD1 Homolog (S. pombe) (RAD1, Accession NM_133377), a gene which has important roles in DNA damage-activated mitotic and meiotic cell cycle checkpoints. Accordingly, utilities of VGAM1958 include diagnosis, prevention and treatment of diseases and clinical conditions associated with RAD1. The function of RAD1 and its association with various diseases and clinical conditions, has been established by previous studies, as described hereinabove with reference to VGAM922. RAD54-like (S. cerevisiae) (RAD54L, Accession NM_003579) is another VGAM1958 host target gene. RAD54L BINDING SITE is HOST TARGET binding site found in the 5' untranslated region of mRNA encoded by RAD54L, corresponding to a HOST TARGET binding site such as BINDING SITE I, BINDING SITE II or BINDING SITE III. Table 2 illustrates the complementarity of the nucleotide sequences of RAD54L BINDING SITE, designated SEQ ID:9629, to the nucleotide sequence of VGAM1958 RNA, herein designated VGAM RNA, also designated SEQ ID:4669.

Another function of VGAM1958 is therefore inhibition of RAD54-like (S. cerevisiae) (RAD54L, Accession NM_003579), a gene which is involved in dna repair and mitotic recombination. Accordingly, utilities of VGAM1958 include diagnosis, prevention and treatment of diseases and clinical conditions associated with RAD54L. The function of RAD54L has been established by previous studies. Repair of double-stranded DNA breaks is essential for homologous recombination in somatic cells to protect DNA from damage by ionizing radiation and other genotoxins. The rad52 pathway is required for homologous recombination in the yeast S. cerevisiae. Kanaar et al. (1996) searched for mammalian homologs of yeast rad54, an essential component of this pathway and a member of the rad52 group. Using RT-PCR with degenerate primers, Kanaar et al. (1996) identified the mouse and human homologs of S. cerevisiae rad54. The human homolog, HR54, is 48% identical to the yeast protein and belongs to the SNF2/SWI2 family, which is characterized by amino acid motifs found in DNA-dependent ATPases. Proteins in the SNF2/SWI2 family are involved in many aspects of DNA metabolism, including transcription, repair, and recombination. HR54 protein is located in the nucleus, consistent with its nuclear localization signal and a potential function in DNA metabolism. Expression of HR54 increased approximately 3-fold in late G1 phase; this pattern is similar to that in yeast. HR54 was able to partially complement the DNA repair defect of S. cerevisiae rad54-deleted cells. By Northern blot analysis, Kanaar et al. (1996) showed that expression of the mouse homolog of HR54 is increased in organs of lymphoid and germ cell development. Mouse expression was 3-fold higher in spermatocytes than in spermatids, suggesting that HR54 plays a role in meiotic recombination. Kanaar et al. (1996) mapped the HR54 gene to chromosome 1p32 using fluorescence in situ hybridization. Association of the recombinational repair protein RAD51 (OMIM Ref. No. 179617) with tumor suppressors BRCA1 (OMIM Ref. No. 113705) and BRCA2 (OMIM Ref. No. 600185) suggested that defects in homologous recombination are responsible for tumor formation. This idea was supported by the fact that the protein associated with the MRE11/RAD50 repair complex (NBS1; 602667) is mutated in Nijmegen breakage syndrome (OMIM Ref. No. 251260), which is characterized by increased cancer incidence and sensitivity to ionizing radiation. Since RAD51 forms a complex with other members of the RAD52 (OMIM Ref. No. 600392) epistasis group and with BRCA proteins, it was reasonable to ask if alterations of members of the RAD52 epistasis group lead to tumor development. Matsuda et al. (1999) described missense mutations at functional regions of RAD54 and the absence of the wildtype RAD54 expression resulting from aberrant splicing in primary cancers. Since RAD54 is a recombination protein associated with RAD51, this was the first genetic evidence that cancer can arise from a defect in repair processes involving homologous recombination. They observed a pro63-to-his mutation (603615.0001) of the RAD54 gene in an adenocarcinoma of the colon and a val444-to-glu mutation (603615.0002) in a non-Hodgkin lymphoma. Although pro at codon 63 and val at codon 444 are outside helicase motifs, Matsuda et al. (1999) considered it likely that these amino acid substitutions affect the function of RAD54. The mutations demonstrated by Matsuda et al. (1999) were rare among the tumors studied:95 breast cancers, 13 colorectal cancers, and 24 lymphomas.

Full details of the abovementioned studies are described in the following publications, the disclosure of which are hereby incorporated by reference:

Kanaar, R.; Troelstra, C.; Swagemakers, S. M. A.; Essers, J.; Smit, B.; Franssen, J.-H.; Pastink, A.; Bezzubova, O. Y.; Buerstedde, J.-M.; Clever, B.; Heyer, W.-D.; Hoeijmakers, J. H. J.: Human and mouse homologs of the Saccharomyces cerevisiae RAD54 DNA repair gene: evidence for functional conservation. Curr. Biol. 6: 828-838, 1996; and Matsuda, M.; Miyagawa, K.; Takahashi, M.; Fukuda, T.; Kataoka, T.; Asahara, T.; Inui, H.; Watatani, M.; Yasutomi, M.; Kamada, N.; Dohi, K.; Kamiya, K.: Mutations in the RAD54 recombina.

Further studies establishing the function and utilities of RAD54L are found in John Hopkins OMIM database record ID 603615, and in sited publications numbered 7589-7590 listed in the bibliography section hereinbelow, which are also hereby incorporated by reference. Retinoic Acid Induced 3 (RAI3, Accession NM_003979) is another VGAM1958 host target gene. RAI3 BINDING SITE is HOST TARGET binding site found in the 3' untranslated region of mRNA encoded by RAI3, corresponding to a HOST TARGET binding site such as BINDING SITE I, BINDING SITE II or BINDING SITE III. Table 2 illustrates the complementarity of the nucleotide sequences of RAI3 BINDING SITE, designated SEQ ID:10115, to the nucleotide sequence of VGAM1958 RNA, herein designated VGAM RNA, also designated SEQ ID:4669.

Another function of VGAM1958 is therefore inhibition of Retinoic Acid Induced 3 (RAI3, Accession NM_003979). Accordingly, utilities of VGAM1958 include diagnosis, prevention and treatment of diseases and clinical conditions associated with RAI3. RalA Binding Protein 1 (RALBP1, Accession NM_006788) is another VGAM1958 host target gene. RALBP1 BINDING SITE1 and RALBP1 BINDING SITE2 are HOST TARGET binding sites found in untranslated regions of mRNA encoded by RALBP1, corresponding to HOST TARGET binding sites such as BINDING SITE I, BINDING SITE II or BINDING SITE III. Table 2 illustrates the complementarity of the nucleotide sequences of RALBP1 BINDING SITE1 and RALBP1 BINDING SITE2, designated SEQ ID:13660 and SEQ ID:13662 respectively, to the nucleotide sequence of VGAM1958 RNA, herein designated VGAM RNA, also designated SEQ ID:4669.

Another function of VGAM1958 is therefore inhibition of RalA Binding Protein 1 (RALBP1, Accession NM_006788), a gene which plays a role in signal transduction and catalyzes the transport of glutathione conjugates and xenobiotics. Accordingly, utilities of VGAM1958 include diagnosis, prevention and treatment of diseases and clinical conditions associated with RALBP1. The function of RALBP1 and its association with various diseases and clinical conditions, has been established by previous studies, as described hereinabove with reference to VGAM345. RecQ Protein-like 5 (RECQL5, Accession NM_004259) is another VGAM1958 host target gene. RECQL5 BINDING SITE1 and RECQL5 BINDING SITE2 are HOST TARGET binding sites found in untranslated regions of mRNA encoded by RECQL5, corresponding to HOST TARGET binding sites such as BINDING SITE I, BINDING SITE II or BINDING SITE III. Table 2 illustrates the complementarity of the nucleotide sequences of RECQL5 BINDING SITE1 and RECQL5 BINDING SITE2, designated SEQ ID:10449 and SEQ ID:10448 respectively, to the nucleotide sequence of VGAM1958 RNA, herein designated VGAM RNA, also designated SEQ ID:4669.

Another function of VGAM1958 is therefore inhibition of RecQ Protein-like 5 (RECQL5, Accession NM_004259). Accordingly, utilities of VGAM1958 include diagnosis, prevention and treatment of diseases and clinical conditions associated with RECQL5. Arginine-glutamic Acid Dipeptide (RE) Repeats (RERE, Accession NM_012102) is another VGAM1958 host target gene. RERE BINDING SITE1 and RERE BINDING SITE2 are HOST TARGET binding sites found in untranslated regions of mRNA encoded by RERE, corresponding to HOST TARGET binding sites such as BINDING SITE I, BINDING SITE II or BINDING SITE III. Table 2 illustrates the complementarity of the nucleotide sequences of RERE BINDING SITE1 and RERE BINDING SITE2, designated SEQ ID:14408 and SEQ ID:13261 respectively, to the nucleotide sequence of VGAM1958 RNA, herein designated VGAM RNA, also designated SEQ ID:4669.

Another function of VGAM1958 is therefore inhibition of Arginine-glutamic Acid Dipeptide (RE) Repeats (RERE, Accession NM_012102), a gene which binds DRPLA and locates in the nucleus. Accordingly, utilities of VGAM1958 include diagnosis, prevention and treatment of diseases and clinical conditions associated with RERE. The function of RERE and its association with various diseases and clinical conditions, has been established by previous studies, as described hereinabove with reference to VGAM51. Ribulose-5-phosphate-3-epimerase (RPE, Accession XM_030834) is another VGAM1958 host target gene. RPE BINDING SITE1 and RPE BINDING SITE2 are HOST TARGET binding sites found in untranslated regions of mRNA encoded by RPE, corresponding to HOST TARGET binding sites such as BINDING SITE I, BINDING SITE II or BINDING SITE III. Table 2 illustrates the complementarity of the nucleotide sequences of RPE BINDING SITE1 and RPE BINDING SITE2, designated SEQ ID:31156 and SEQ ID:31154 respectively, to the nucleotide sequence of VGAM1958 RNA, herein designated VGAM RNA, also designated SEQ ID:4669.

Another function of VGAM1958 is therefore inhibition of Ribulose-5-phosphate-3-epimerase (RPE, Accession XM_030834). Accordingly, utilities of VGAM1958 include diagnosis, prevention and treatment of diseases and clinical conditions associated with RPE. Sal-like 2 (Drosophila) (SALL2, Accession XM_033473) is another VGAM1958 host target gene. SALL2 BINDING SITE1 and SALL2 BINDING SITE2 are HOST TARGET binding sites found in untranslated regions of mRNA encoded by SALL2, corresponding to HOST TARGET binding sites such as BINDING SITE I, BINDING SITE II or BINDING SITE III. Table 2 illustrates the complementarity of the nucleotide sequences of SALL2 BINDING SITE1 and SALL2 BINDING SITE2, designated SEQ ID:31935 and SEQ ID:31936 respectively, to the nucleotide sequence of VGAM1958 RNA, herein designated VGAM RNA, also designated SEQ ID:4669.

Another function of VGAM1958 is therefore inhibition of Sal-like 2 (Drosophila) (SALL2, Accession XM_033473). Accordingly, utilities of VGAM1958 include diagnosis, prevention and treatment of diseases and clinical conditions associated with SALL2. Succinate Dehydrogenase Complex, Subunit C, Integral Membrane Protein, 15 kDa (SDHC, Accession XM_045183) is another VGAM1958 host target gene. SDHC BINDING SITE is HOST TARGET binding site found in the 3' untranslated region of mRNA encoded by SDHC, corresponding to a HOST TARGET binding site such as BINDING SITE I, BINDING SITE II or BINDING SITE III. Table 2 illustrates the complementarity of the nucleotide sequences of SDHC BINDING SITE, designated SEQ ID:34381, to the nucleotide sequence of VGAM1958 RNA, herein designated VGAM RNA, also designated SEQ ID:4669.

Another function of VGAM1958 is therefore inhibition of Succinate Dehydrogenase Complex, Subunit C, Integral Membrane Protein, 15 kDa (SDHC, Accession XM_045183). Accordingly, utilities of VGAM1958 include diagnosis, prevention and treatment of diseases and clinical conditions associated with SDHC. Serine (or cysteine) Proteinase Inhibitor, Clade B (ovalbumin), Member 13 (SERPINB13, Accession NM_012397) is another VGAM1958 host target gene. SERPINB13 BINDING SITE is HOST TARGET binding site found in the 3' untranslated region of mRNA encoded by SERPINB13, corresponding to a HOST TARGET binding site such as BINDING SITE I, BINDING SITE II or BINDING SITE III. Table 2 illustrates the complementarity of the nucleotide sequences of SERPINB13 BINDING SITE, designated SEQ ID:14761, to the nucleotide sequence of VGAM1958 RNA, herein designated VGAM RNA, also designated SEQ ID:4669.

Another function of VGAM1958 is therefore inhibition of Serine (or cysteine) Proteinase Inhibitor, Clade B (ovalbumin), Member 13 (SERPINB13, Accession NM_012397), a gene which plays a role in the proliferation or differentiation of keratinocytes. Accordingly, utilities of VGAM1958 include diagnosis, prevention and treatment of diseases and clinical conditions associated with SERPINB13. The function of SERPINB13 and its association with various diseases and clinical conditions, has been established by previous studies, as described hereinabove with reference to VGAM1924. Soc-2 Suppressor of Clear Homolog (C. elegans) (SHOC2, Accession NM_007373) is another VGAM1958 host target gene. SHOC2 BINDING SITE is HOST TARGET binding site found in the 3' untranslated region of mRNA encoded by SHOC2, corresponding to a HOST TARGET binding site such as BINDING SITE I, BINDING SITE II or BINDING SITE III. Table 2 illustrates the complementarity of the nucleotide sequences of SHOC2 BINDING SITE, designated SEQ ID:14303, to the nucleotide sequence of VGAM1958 RNA, herein designated VGAM RNA, also designated SEQ ID:4669.

Another function of VGAM1958 is therefore inhibition of Soc-2 Suppressor of Clear Homolog (C. elegans) (SHOC2, Accession NM_007373), a gene which may be a regulator of the let-60 ras pathway. Accordingly, utilities of VGAM1958 include diagnosis, prevention and treatment of diseases and clinical conditions associated with SHOC2. The function of SHOC2 and its association with various diseases and clinical conditions, has been established by previous studies, as described hereinabove with reference to VGAM464. Short Stature Homeobox (SHOX, Accession NM_000451) is another VGAM1958 host target gene. SHOX BINDING SITE is HOST TARGET binding site found in the 3' untranslated region of mRNA encoded by SHOX, corresponding to a HOST TARGET binding site such as BINDING SITE I, BINDING SITE II or BINDING SITE III. Table 2 illustrates the complementarity of the nucleotide sequences of SHOX BINDING SITE, designated SEQ ID:6055, to the nucleotide sequence of VGAM1958 RNA, herein designated VGAM RNA, also designated SEQ ID:4669.

Another function of VGAM1958 is therefore inhibition of Short Stature Homeobox (SHOX, Accession NM_000451). Accordingly, utilities of VGAM1958 include diagnosis, prevention and treatment of diseases and clinical conditions associated with SHOX. Single-minded Homolog 1 (Drosophila) (SIM1, Accession NM_005068) is another VGAM1958 host target gene. SIM1 BINDING SITE is HOST TARGET binding site found in the 3' untranslated region of mRNA encoded by SIM1, corresponding to a HOST TARGET binding site such as BINDING SITE I, BINDING SITE II or BINDING SITE III. Table 2 illustrates the complementarity of the nucleotide sequences of SIM1 BINDING SITE, designated SEQ ID:11511, to the nucleotide sequence of VGAM1958 RNA, herein designated VGAM RNA, also designated SEQ ID:4669.

Another function of VGAM1958 is therefore inhibition of Single-minded Homolog 1 (Drosophila) (SIM1, Accession NM_005068), a gene which may have pleiotropic effects during embryogenesis and in the adult. Accordingly, utilities of VGAM1958 include diagnosis, prevention and treatment of diseases and clinical conditions associated with SIM1. The function of SIM1 and its association with various diseases and clinical conditions, has been established by previous studies, as described hereinabove with reference to VGAM665. Solute Carrier Family 16 (monocarboxylic acid transporters), Member 2 (putative transporter) (SLC16A2, Accession NM_006517) is another VGAM1958 host target gene. SLC16A2 BINDING SITE is HOST TARGET binding site found in the 3' untranslated region of mRNA encoded by SLC16A2, corresponding to a HOST TARGET binding site such as BINDING SITE I, BINDING SITE II or BINDING SITE III. Table 2 illustrates the complementarity of the nucleotide sequences of SLC16A2 BINDING SITE, designated SEQ ID:13270, to the nucleotide sequence of VGAM1958 RNA, herein designated VGAM RNA, also designated SEQ ID:4669.

Another function of VGAM1958 is therefore inhibition of Solute Carrier Family 16 (monocarboxylic acid transporters), Member 2 (putative transporter) (SLC16A2, Accession NM_006517). Accordingly, utilities of VGAM1958 include diagnosis, prevention and treatment of diseases and clinical conditions associated with SLC16A2. Solute Carrier Family 18 (vesicular monoamine), Member 1 (SLC18A1, Accession NM_003053) is another VGAM1958 host target gene. SLC18A1 BINDING SITE is HOST TARGET binding site found in the 3' untranslated region of mRNA encoded by SLC18A1, corresponding to a HOST TARGET binding site such as BINDING SITE I, BINDING SITE II or BINDING SITE III. Table 2 illustrates the complementarity of the nucleotide sequences of SLC18A1 BINDING SITE, designated SEQ ID:9015, to the nucleotide sequence of VGAM1958 RNA, herein designated VGAM RNA, also designated SEQ ID:4669.

Another function of VGAM1958 is therefore inhibition of Solute Carrier Family 18 (vesicular monoamine), Member 1 (SLC18A1, Accession NM_003053), a gene which is involved in the vesicular transport of biogenic amines. Accordingly, utilities of VGAM1958 include diagnosis, prevention and treatment of diseases and clinical conditions associated with SLC18A1. The function of SLC18A1 and its association with various diseases and clinical conditions, has been established by previous studies, as described hereinabove with reference to VGAM18. Solute Carrier Family 1 (glutamate/neutral amino acid transporter), Member 4 (SLC1A4, Accession NM_003038) is another VGAM1958 host target gene. SLC1A4 BINDING SITE is HOST TARGET binding site found in the 3' untranslated region of mRNA encoded by SLC1A4, corresponding to a HOST TARGET binding site such as BINDING SITE I, BINDING SITE II or BINDING SITE III. Table 2 illustrates the complementarity of the nucleotide sequences of SLC1A4 BINDING SITE, designated SEQ ID:8995, to the nucleotide sequence of VGAM1958 RNA, herein designated VGAM RNA, also designated SEQ ID:4669.

Another function of VGAM1958 is therefore inhibition of Solute Carrier Family 1 (glutamate/neutral amino acid transporter), Member 4 (SLC1A4, Accession NM_003038), a gene which transports alanine, serine, cysteine, and threonine. exhibits sodium dependence. Accordingly, utilities of VGAM1958 include diagnosis, prevention and treatment of diseases and clinical conditions associated with SLC1A4. The function of SLC1A4 and its association with various diseases and clinical conditions, has been established by previous studies, as described hereinabove with reference to VGAM859. Solute Carrier Family 1 (neutral amino acid transporter), Member 5 (SLC1A5, Accession NM_005628) is another VGAM1958 host target gene. SLC1A5 BINDING SITE1 and SLC1A5 BINDING SITE2 are HOST TARGET binding sites found in untranslated regions of mRNA encoded by SLC1A5, corresponding to HOST TARGET binding sites such as BINDING SITE I, BINDING SITE II or BINDING SITE III. Table 2 illustrates the complementarity of the nucleotide sequences of SLC1A5 BINDING SITE1 and SLC1A5 BINDING SITE2, designated SEQ ID:12143 and SEQ ID:38403 respectively, to the nucleotide sequence of VGAM1958 RNA, herein designated VGAM RNA, also designated SEQ ID:4669.

Another function of VGAM1958 is therefore inhibition of Solute Carrier Family 1 (neutral amino acid transporter), Member 5 (SLC1A5, Accession NM_005628). Accordingly, utilities of VGAM1958 include diagnosis, prevention and treatment of diseases and clinical conditions associated with SLC1A5. Solute Carrier Family 25 (mitochondrial carrier, brain), Member 14 (SLC25A14, Accession NM_022810) is another VGAM1958 host target gene. SLC25A14 BINDING SITE1 and SLC25A14 BINDING SITE2 are HOST TARGET binding sites found in untranslated regions of mRNA encoded by SLC25A14, corresponding to HOST TARGET binding sites such as BINDING SITE I, BINDING SITE II or BINDING SITE III. Table 2 illustrates the complementarity of the nucleotide sequences of SLC25A14 BINDING SITE1 and SLC25A14 BINDING SITE2, designated SEQ ID:23086 and SEQ ID:10087 respectively, to the nucleotide sequence of VGAM1958 RNA, herein designated VGAM RNA, also designated SEQ ID:4669.

Another function of VGAM1958 is therefore inhibition of Solute Carrier Family 25 (mitochondrial carrier, brain), Member 14 (SLC25A14, Accession NM_022810), a gene which participates in the mitochondrial proton leak measured in brain mitochondria. Accordingly, utilities of VGAM1958 include diagnosis, prevention and treatment of diseases and clinical conditions associated with SLC25A14. The function of SLC25A14 has been established by previous studies. Uncoupling proteins (UCPs) are proton channel carrier proteins not coupled to oxidative phosphorylation. They are located in the inner membrane of mitochondria and have been linked to the generation of heat. UCP1 (OMIM Ref. No. 113730) is localized to brown adipose tissue, UCP2 (OMIM Ref. No. 601693) is widely expressed, and UCP3 (OMIM Ref. No. 602044) is largely found in skeletal muscle. By searching an EST database for UCPs and screening a brain cDNA library, Sanchis et al. (1998) obtained a cDNA encoding SLC25A14, which they called 'brain mitochondrial carrier protein-1,' or BMCP1. The deduced 325-amino acid SLC25A14 protein contains 6 transmembrane domains, 3 motifs characteristic of mitochondrial energy transfer proteins, and 20 amino acids at the N terminus that are absent in UCP1, UCP2, and UCP3. SLC25A14 shares 34, 38, and 39% amino acid identity with UCP1, UCP2, and UCP3, respectively. Northern blot analysis detected high expression of a 1.8-kb SLC25A14 transcript in brain. RNA dot-blot analysis detected SLC25A14 expression in testis and pituitary. In situ hybridization analysis in mouse brain showed Slc25a14 expression in hypothalamus, cortex, hippocampus, thalamus, and amygdala. Functional analysis in yeast showed that SLC25A14 expression correlates with impaired growth rate and a marked uncoupling of respiration, suggesting that SLC25A14 may be a member of the UCP family Sanchis et al. (1998) identified an STS (GenBank G23624) mapping to Xq24 within the SLC25A14 gene. By analysis of a backcross panel, they mapped the mouse Slc25a14 gene to the X chromosome as well Full details of the abovementioned studies are described in the following publications, the disclosure of which are hereby incorporated by reference:

Sanchis, D.; Fleury, C.; Chomiki, N.; Goubern, M.; Huang, Q.; Neverova, M.; Gregoire, F.; Easlick, J.; Raimbault, S.; Levi-Meyrueis, C.; Miroux, B.; Collins, S.; Seldin, M.; Richard, D.; Warden, C.; Bouillaud, F.; Ricquier, D.: BMCP1, a novel mitochondrial carrier with high expression in the central nervous system of human S and rodents, and respiration uncoupling activity in recombinant yeast. J. Biol. Chem. 273: 34611-34615, 1998; and Sanchis, D.; Fleury, C.; Chomiki, N.; Goubern, M.; Huang, Q.; Neverova, M.; Gregoire, F.; Easlick, J.; Raimbault, S.; Levi-Meyrueis, C.; Miroux, B.; Collins, S.; Seldin, M.; Richard, D.; Wa.

Further studies establishing the function and utilities of SLC25A14 are found in John Hopkins OMIM database record ID 300242, and in sited publications numbered 9160 listed in the bibliography section hereinbelow, which are also hereby incorporated by reference. Solute Carrier Family 29 (nucleoside transporters), Member 1 (SLC29A1, Accession NM_004955) is another VGAM1958 host target gene. SLC29A1 BINDING SITE1 and SLC29A1 BINDING SITE2 are HOST TARGET binding sites found in untranslated regions of mRNA encoded by SLC29A1, corresponding to HOST TARGET binding sites such as BINDING SITE I, BINDING SITE II or BINDING SITE III. Table 2 illustrates the complementarity of the nucleotide sequences of SLC29A1 BINDING SITE1 and SLC29A1 BINDING SITE2, designated SEQ ID:11400 and SEQ ID:19976 respectively, to the nucleotide sequence of VGAM1958 RNA, herein designated VGAM RNA, also designated SEQ ID:4669.

Another function of VGAM1958 is therefore inhibition of Solute Carrier Family 29 (nucleoside transporters), Member 1 (SLC29A1, Accession NM_004955), a gene which mediates both influx and efflux of nucleosides across the membrane. Accordingly, utilities of VGAM1958 include diagnosis, prevention and treatment of diseases and clinical conditions associated with SLC29A1. The function of SLC29A1 and its association with various diseases and clinical conditions, has been established by previous studies, as described hereinabove with reference to VGAM1908. Solute Carrier Family 7 (cationic amino acid transporter, y+ system), Member 6 (SLC7A6, Accession NM_003983) is another VGAM1958 host target gene. SLC7A6 BINDING SITE is HOST TARGET binding site found in the 5' untranslated region of mRNA encoded by SLC7A6, corresponding to a HOST TARGET binding site such as BINDING SITE I, BINDING SITE II or BINDING SITE III. Table 2 illustrates the complementarity of the nucleotide sequences of SLC7A6 BINDING SITE, designated SEQ ID:10123, to the nucleotide sequence of VGAM1958 RNA, herein designated VGAM RNA, also designated SEQ ID:4669.

Another function of VGAM1958 is therefore inhibition of Solute Carrier Family 7 (cationic amino acid transporter, y+ system), Member 6 (SLC7A6, Accession NM_003983), a gene which is involved in mediating amino acid transport. Accordingly, utilities of VGAM1958 include diagnosis, prevention and treatment of diseases and clinical conditions associated with SLC7A6. The function of SLC7A6 and its association with various diseases and clinical conditions, has been established by previous studies, as described hereinabove with reference to VGAM87. SWI/SNF Related, Matrix Associated, Actin Dependent Regulator of Chromatin, Subfamily A, Member 5 (SMARCA5, Accession NM_003601) is another VGAM1958 host target gene. SMARCA5 BINDING SITE is HOST TARGET binding site found in the 5' untranslated region of mRNA encoded by SMARCA5, corresponding to a HOST TARGET binding site such as BINDING SITE I, BINDING SITE II or BINDING SITE III. Table 2 illustrates the complementarity of the nucleotide sequences of SMARCA5 BINDING SITE, designated SEQ ID:9655, to the nucleotide sequence of VGAM1958 RNA, herein designated VGAM RNA, also designated SEQ ID:4669.

Another function of VGAM1958 is therefore inhibition of SWI/SNF Related, Matrix Associated, Actin Dependent Regulator of Chromatin, Subfamily A, Member 5 (SMARCA5, Accession NM_003601), a gene which is involved in chromatin assembly and remodeling. Accordingly, utilities of VGAM1958 include diagnosis, prevention and treatment of diseases and clinical conditions associated with SMARCA5. The function of SMARCA5 has been established by previous studies. Poot et al. (2000) identified SMARCA5, which they called SNF2H, within a chromatin remodeling complex, CHRAC, purified from HeLa cell nuclear extracts. They confirmed an interaction between SMARCA5 and ACF1 (BAZ1A). Two small histone-fold proteins, CHRAC17 (POLE3; 607267) and CHRAC15 (CHRAC1; 607268), copurified with the complex, and the authors showed that these proteins form a DNA-binding heterodimer. Poot et al. (2000) determined that the purified complex could mobilize nucleosomes into a regularly spaced nucleosomal array and that the spacing activity was strictly ATP-dependent. By Western blot analysis of protein expression levels in several human and mammalian cell lines, Bozhenok et al. (2002) determined that SMARCA5 interacts with BAZ1B (OMIM Ref. No. 605681). In vitro analysis of the mouse Smarca5-Baz1b complex showed that, in the presence of ATP, the complex can create regular nucleosomal arrays from irregular chromatin Full details of the abovementioned studies are described in the following publications, the disclosure of which are hereby incorporated by reference:

Bozhenok, L.; Wade, P. A.; Varga-Weisz, P.: WSTF-ISWI chromatin remodeling complex targets heterochromatic replication foci. EMBO J. 21:2231-2241, 2002; and Poot, R. A.; Dellaire, G.; Hulsmann, B. B.; Grimaldi, M. A.; Corona, D. F. V.; Becker, P. B.; Bickmore, W. A.; Varga-Weisz, P. D.: HuCHRAC, a human ISWI chromatin remodelling complex cont.

Further studies establishing the function and utilities of SMARCA5 are found in John Hopkins OMIM database record ID 603375, and in sited publications numbered 5070-507 and 7226-5074 listed in the bibliography section hereinbelow, which are also hereby incorporated by reference. SWI/SNF Related, Matrix Associated, Actin Dependent Regulator of Chromatin, Subfamily D, Member 1 (SMARCD1, Accession NM_003076) is another VGAM1958 host target gene. SMARCD1 BINDING SITE1 and SMARCD1 BINDING SITE2 are HOST TARGET binding sites found in untranslated regions of mRNA encoded by SMARCD1, corresponding to HOST TARGET binding sites such as BINDING SITE I, BINDING SITE II or BINDING SITE III. Table 2 illustrates the complementarity of the nucleotide sequences of SMARCD1 BINDING SITE1 and SMARCD1 BINDING SITE2, designated SEQ ID:9043 and SEQ ID:29141 respectively, to the nucleotide sequence of VGAM1958 RNA, herein designated VGAM RNA, also designated SEQ ID:4669.

Another function of VGAM1958 is therefore inhibition of SWI/SNF Related, Matrix Associated, Actin Dependent Regulator of Chromatin, Subfamily D, Member 1 (SMARCD1, Accession NM_003076), a gene which is involved in chromatin assembly and remodeling. Accordingly, utilities of VGAM1958 include diagnosis, prevention and treatment of diseases and clinical conditions associated with SMARCD1. The function of SMARCD1 and its association with various diseases and clinical conditions, has been established by previous studies, as described hereinabove with reference to VGAM152. SNL (Accession NM_003088) is another VGAM1958 host target gene. SNL BINDING SITE is HOST TARGET binding site found in the 3' untranslated region of mRNA encoded by SNL, corresponding to a HOST TARGET binding site such as BINDING SITE I, BINDING SITE II or BINDING SITE III. Table 2 illustrates the complementarity of the nucleotide sequences of SNL BINDING SITE, designated SEQ ID:9065, to the nucleotide sequence of VGAM1958 RNA, herein designated VGAM RNA, also designated SEQ ID:4669.

Another function of VGAM1958 is therefore inhibition of SNL (Accession NM_003088), a gene which organizes filamentous actin into bundles with a minimum of 4.1:1 actin/fascin ratio. Accordingly, utilities of VGAM1958 include diagnosis, prevention and treatment of diseases and clinical conditions associated with SNL. The function of SNL and its association with various diseases and clinical conditions, has been established by previous studies, as described hereinabove with reference to VGAM675. Sparc/osteonectin, Cwcv and Kazal-like Domains Proteoglycan (testican) (SPOCK, Accession XM_031696) is another VGAM1958 host target gene. SPOCK BINDING SITE is HOST TARGET binding site found in the 3' untranslated region of mRNA encoded by SPOCK, corresponding to a HOST TARGET binding site such as BINDING SITE I, BINDING SITE II or BINDING SITE III. Table 2 illustrates the complementarity of the nucleotide sequences of SPOCK BINDING SITE, designated SEQ ID:31458, to the nucleotide sequence of VGAM1958 RNA, herein designated VGAM RNA, also designated SEQ ID:4669.

Another function of VGAM1958 is therefore inhibition of Sparc/osteonectin, Cwcv and Kazal-like Domains Proteoglycan (testican) (SPOCK, Accession XM_031696). Accordingly, utilities of VGAM1958 include diagnosis, prevention and treatment of diseases and clinical conditions associated with SPOCK. Sequestosome 1 (SQSTM1, Accession NM_003900) is another VGAM1958 host target gene. SQSTM1 BINDING SITE is HOST TARGET binding site found in the 3' untranslated region of mRNA encoded by SQSTM1, corresponding to a HOST TARGET binding site such as BINDING SITE I, BINDING SITE II or BINDING SITE III. Table 2 illustrates the complementarity of the nucleotide sequences of SQSTM1 BINDING SITE, designated SEQ ID:9990, to the nucleotide sequence of VGAM1958 RNA, herein designated VGAM RNA, also designated SEQ ID:4669.

Another function of VGAM1958 is therefore inhibition of Sequestosome 1 (SQSTM1, Accession NM_003900), a gene which binds SH2 domain of p56lck and ubiquitin, and it is associated with a serine/threonine kinase activity. Accordingly, utilities of VGAM1958 include diagnosis, prevention and treatment of diseases and clinical conditions associated with SQSTM1. The function of SQSTM1 and its association with various diseases and clinical conditions, has been established by previous studies, as described hereinabove with reference to VGAM824. V-src Sarcoma (Schmidt-Ruppin A-2) Viral Oncogene Homolog (avian) (SRC, Accession NM_005417) is another VGAM1958 host target gene. SRC BINDING SITE is HOST TARGET binding site found in the 3" untranslated region of mRNA encoded by SRC, corresponding to a HOST TARGET binding site such as BINDING SITE I, BINDING SITE II or BINDING SITE III. Table 2 illustrates the complementarity of the nucleotide sequences of SRC BINDING SITE, designated SEQ ID:11888, to the nucleotide sequence of VGAM1958 RNA, herein designated VGAM RNA, also designated SEQ ID:4669.

Another function of VGAM1958 is therefore inhibition of V-src Sarcoma (Schmidt-Ruppin A-2) Viral Oncogene Homolog (avian) (SRC, Accession NM_005417), a gene which is a tyrosine kinase. Accordingly, utilities of VGAM1958 include diagnosis, prevention and treatment of diseases and clinical conditions associated with SRC. The function of SRC and its association with various diseases and clinical conditions, has been established by previous studies, as described hereinabove with reference to VGAM721. Signal Transducer and Activator of Transcription 6, Interleukin-4 Induced (STAT6, Accession NM_003153) is another VGAM1958 host target gene. STAT6 BINDING SITE is HOST TARGET binding site found in the 3' untranslated region of mRNA encoded by STAT6, corresponding to a HOST TARGET binding site such as BINDING SITE I, BINDING SITE II or BINDING SITE III. Table 2 illustrates the complementarity of the nucleotide sequences of STAT6 BINDING SITE, designated SEQ ID:9131, to the nucleotide sequence of VGAM1958 RNA, herein designated VGAM RNA, also designated SEQ ID:4669.

Another function of VGAM1958 is therefore inhibition of Signal Transducer and Activator of Transcription 6, Interleukin-4 Induced (STAT6, Accession NM_003153), a gene which carries out a dual function: signal transduction and activation of transcription. Accordingly, utilities of VGAM1958 include diagnosis, prevention and treatment of diseases and clinical conditions associated with STAT6. The function of STAT6 has been established by previous studies. By searching a database of expressed sequence tags (ESTs), Quelle et al. (1995) identified a number of expressed genes in the signal transducers and activators of a transcription (STAT) family. Human and murine full-length cDNA clones were obtained and sequenced. The sequence of the human cDNA was identical to the sequence published by Hou et al. (1994) for the interleukin-4-induced transcription factor (called by them IL4 Stat), while the murine STAT6 amino acid and nucleotide sequences reported by Quelle et al. (1995) were 83% and 84% identical to the human sequences, respectively. Using STAT6-specific antiserum, Quelle et al. (1995) demonstrated that STAT6 is rapidly tyrosine phosphorylated following stimulation of appropriate cell lines with IL4 (OMIM Ref. No. 147780) or IL3 (OMIM Ref. No. 147740), but is not detectably phosphorylated following stimulation with IL2 (OMIM Ref. No. 147680), IL12 (OMIM Ref. No. 161560), or erythropoietin (OMIM Ref. No. 133170). In contrast, IL2, IL3, and erythropoietin induced the tyrosine phosphorylation of STAT5 (OMIM Ref. No. 601511), while IL12 uniquely induced the tyrosine phosphorylation of STAT4 (OMIM Ref. No. 600558). Inducible tyrosine phosphorylation of STAT6 required the membrane-distal region of the IL4 receptor alpha chain (OMIM Ref. No. 147781). They found that this region of the receptor is not required for cell growth, demonstrating that STAT6 tyrosine phosphorylation does not contribute to mitogenesis. Ghilardi et al. (1996) demonstrated that along with STAT3 (OMIM Ref. No. 102582) and STAT5, STAT6 is involved in signaling from the leptin receptor (OMIM Ref. No. 601007) and that this signaling is defective in the db/db mouse which carries a point mutation within the leptin receptor gene. Darnell (1996) reflected on STAT3, STAT5, and STAT6 as 'fat STATs,' i.e., the involvement of these 3 STATs, but not STAT1, STAT2, and STAT4, in the physiologic action of leptin (OMIM Ref. No. 164160) as described by Ghilardi et al. (1996).

Full details of the abovementioned studies are described in the following publications, the disclosure of which are hereby incorporated by reference:

Ghilardi, N.; Ziegler, S.; Wiestner, A.; Stoffel, R.; Heim, M. H.; Skoda, R. C.: Defective STAT signaling by the leptin receptor in diabetic mice. Proc. Nat. Acad. Sci. 93:6231-6235, 1996; and Quelle, F. W.; Shimoda, K.; Thierfelder, W.; Fischer, C.; Kim, A.; Ruben, S. M.; Cleveland, J. L.; Pierce, J. H.; Keegan, A. D.; Nelms, K.; Paul, W. E.; Ihle, J. N.: Cloning of murin.

Further studies establishing the function and utilities of STAT6 are found in John Hopkins OMIM database record ID 601512, and in sited publications numbered 8096, 9451, 11335, 9452, 11336, 2772-277 and 10044 listed in the bibliography section hereinbelow, which are also hereby incorporated by reference. Serine/threonine Kinase 10 (STK10, Accession NM_005990) is another VGAM1958 host target gene. STK10 BINDING SITE is HOST TARGET binding site found in the 3' untranslated region of mRNA encoded by STK10, corresponding to a HOST TARGET binding site such as BINDING SITE I, BINDING SITE II or BINDING SITE III. Table 2 illustrates the complementarity of the nucleotide sequences of STK10 BINDING SITE, designated SEQ ID:12613, to the nucleotide sequence of VGAM1958 RNA, herein designated VGAM RNA, also designated SEQ ID:4669.

Another function of VGAM1958 is therefore inhibition of Serine/threonine Kinase 10 (STK10, Accession NM_005990), a gene which can act on substrates such as myelin basic protein and histone iia on serine and threonine residues. Accordingly, utilities of VGAM1958 include diagnosis, prevention and treatment of diseases and clinical conditions associated with STK10. The function of STK10 has been established by previous studies. Kuramochi et al. (1997) cloned the mouse gene Stk10, coding for a new serine/threonine kinase, designated LOK. Kuramochi et al. (1999) described the cloning of a cDNA encoding the human homolog and the detection of LOK proteins in human lymphoid cells. They deposited the sequence of a human LOK cDNA in GenBank (AB015718). They also determined the chromosomal location of the gene by fluorescence in situ hybridization:5q35.1 in human, 11A4 in mouse, and 10q12.3 in rat. By means of polymorphic CA repeats found in the 3-prime untranslated region of the mouse Stk10 gene and an intersubspecific backcross mapping panel, they mapped the Stk10 locus to a restricted region on chromosome 11 between D11Mit53 and D11Mit84. These results established STK10 as a new marker of human chromosome 5 to define the syntenic boundary of human chromosomes 5 and 16 on mouse chromosome 11.

Full details of the abovementioned studies are described in the following publications, the disclosure of which are hereby incorporated by reference:

Kuramochi, S.; Matsuda, Y.; Okamoto, M.; Kitamura, F.; Yonekawa, H.; Karasuyama, H.: Molecular cloning of the human gene STK10 encoding lymphocyte-oriented kinase, and comparative chromosomal mapping of the human, mouse, and rat homologues. Immunogenetics 49:369-375, 1999; and Kuramochi, S.; Moriguchi, T.; Kuida, K.; Endo, J.; Semba, K.; Nishida, E.; Karasuyama, H.: LOK is a novel mouse STE20-like protein kinase that is expressed predominantly in lymphocyte.

Further studies establishing the function and utilities of STK10 are found in John Hopkins OMIM database record ID 603919, and in sited publications numbered 1005-1006 listed in the bibliography section hereinbelow, which are also hereby incorporated by reference. Serine/threonine Kinase 11 (Peutz-Jeghers syndrome) (STK11, Accession NM_000455) is another VGAM1958 host target gene. STK11 BINDING SITE1 and STK11 BINDING SITE2 are HOST TARGET binding sites found in untranslated regions of mRNA encoded by STK11, corresponding to HOST TARGET binding sites such as BINDING SITE I, BINDING SITE II or BINDING SITE III. Table 2 illustrates the complementarity of the nucleotide sequences of STK11 BINDING SITE1 and STK11 BINDING SITE2, designated SEQ ID:6069 and SEQ ID:6070 respectively, to the nucleotide sequence of VGAM1958 RNA, herein designated VGAM RNA, also designated SEQ ID:4669.

Another function of VGAM1958 is therefore inhibition of Serine/threonine Kinase 11 (Peutz-Jeghers syndrome) (STK11, Accession NM_000455). Accordingly, utilities of VGAM1958 include diagnosis, prevention and treatment of diseases and clinical conditions associated with STK11. Surfeit 4 (SURF4, Accession NM_033161) is another VGAM1958 host target gene. SURF4 BINDING SITE is HOST TARGET binding site found in the 3' untranslated region of mRNA encoded by SURF4, corresponding to a HOST TARGET binding site such as BINDING SITE I, BINDING SITE II or BINDING SITE III. Table 2 illustrates the complementarity of the nucleotide sequences of SURF4 BINDING SITE, designated SEQ ID:27012, to the nucleotide sequence of VGAM1958 RNA, herein designated VGAM RNA, also designated SEQ ID:4669.

Another function of VGAM1958 is therefore inhibition of Surfeit 4 (SURF4, Accession NM_033161), a gene which is a conserved integral membrane protein containing multiple putative transmembrane regions. Accordingly, utilities of VGAM1958 include diagnosis, prevention and treatment of diseases and clinical conditions associated with SURF4. The function of SURF4 and its association with various diseases and clinical conditions, has been established by previous studies, as described hereinabove with reference to VGAM496. SWAP70 (Accession XM_049197) is another VGAM1958 host target gene. SWAP70 BINDING SITE is HOST TARGET binding site found in the 3' untranslated region of mRNA encoded by SWAP70, corresponding to a HOST TARGET binding site such as BINDING SITE I, BINDING SITE II or BINDING SITE III. Table 2 illustrates the complementarity of the nucleotide sequences of SWAP70 BINDING SITE, designated SEQ ID:35347, to the nucleotide sequence of VGAM1958 RNA, herein designated VGAM RNA, also designated SEQ ID:4669.

Another function of VGAM1958 is therefore inhibition of SWAP70 (Accession XM_049197), a gene which is involved not only in nuclear events but also in signaling in B-cell activation. Accordingly, utilities of VGAM1958 include diagnosis, prevention and treatment of diseases and clinical conditions associated with SWAP70. The function of SWAP70 and its association with various diseases and clinical conditions, has been established by previous studies, as described hereinabove with reference to VGAM1090. Synaptogyrin 1 (SYNGR1, Accession NM_004711) is another VGAM1958 host target gene. SYNGR1 BINDING SITE is HOST TARGET binding site found in the 3' untranslated region of mRNA encoded by SYNGR1, corresponding to a HOST TARGET binding site such as BINDING SITE I, BINDING SITE II or BINDING SITE III. Table 2 illustrates the complementarity of the nucleotide sequences of SYNGR1 BINDING SITE, designated SEQ ID:11066, to the nucleotide sequence of VGAM1958 RNA, herein designated VGAM RNA, also designated SEQ ID:4669.

Another function of VGAM1958 is therefore inhibition of Synaptogyrin 1 (SYNGR1, Accession NM_004711), a gene which belongs to transmembrane synaptic vesicle protein and may function in membrane recycling. Accordingly, utilities of VGAM1958 include diagnosis, prevention and treatment of diseases and clinical conditions associated with SYNGR1. The function of SYNGR1 and its association with various diseases and clinical conditions, has been established by previous studies, as described hereinabove with reference to VGAM107. Synaptogyrin 3 (SYNGR3, Accession NM_004209) is another VGAM1958 host target gene. SYNGR3 BINDING SITE is HOST TARGET binding site found in the 3' untranslated region of mRNA encoded by SYNGR3, corresponding to a HOST TARGET binding site such as BINDING SITE I, BINDING SITE II or BINDING SITE III. Table 2 illustrates the complementarity of the nucleotide sequences of SYNGR3 BINDING SITE, designated SEQ ID:10405, to the nucleotide sequence of VGAM1958 RNA, herein designated VGAM RNA, also designated SEQ ID:4669.

Another function of VGAM1958 is therefore inhibition of Synaptogyrin 3 (SYNGR3, Accession NM_004209). Accordingly, utilities of VGAM1958 include diagnosis, prevention and treatment of diseases and clinical conditions associated with SYNGR3. TATA Box Binding Protein (TBP)-associated Factor, RNA Polymerase I, C, 110 kDa (TAF1C, Accession NM_005679) is another VGAM1958 host target gene. TAF1C BINDING SITE is HOST TARGET binding site found in the 5' untranslated region of mRNA encoded by TAF1C, corresponding to a HOST TARGET binding site such as BINDING SITE I, BINDING SITE II or BINDING SITE III. Table 2 illustrates the complementarity of the nucleotide sequences of TAF1C BINDING SITE, designated SEQ ID:12236, to the nucleotide sequence of VGAM1958 RNA, herein designated VGAM RNA, also designated SEQ ID:4669.

Another function of VGAM1958 is therefore inhibition of TATA Box Binding Protein (TBP)-associated Factor, RNA Polymerase I, C, 110 kDa (TAF1C, Accession NM_005679), a gene which belongs to component of the RNA polymerase I and II SL1 transcription factor. Accordingly, utilities of VGAM1958 include diagnosis, prevention and treatment of diseases and clinical conditions associated with TAF1C. The function of TAF1C and its association with various diseases and clinical conditions, has been established by previous studies, as described hereinabove with reference to VGAM191. T-cell Acute Lymphocytic Leukemia 1 (TAL1, Accession NM_003189) is another VGAM1958 host target gene. TAL1 BINDING SITE is HOST TARGET binding site found in the 3' untranslated region of mRNA encoded by TAL1, corresponding to a HOST TARGET binding site such as BINDING SITE I, BINDING SITE II or BINDING SITE III. Table 2 illustrates the complementarity of the nucleotide sequences of TAL1 BINDING SITE, designated SEQ ID:9175, to the nucleotide sequence of VGAM1958 RNA, herein designated VGAM RNA, also designated SEQ ID:4669.

Another function of VGAM1958 is therefore inhibition of T-cell Acute Lymphocytic Leukemia 1 (TAL1, Accession NM_003189), a gene which may help control cell growth and differentiation. Accordingly, utilities of VGAM1958 include diagnosis, prevention and treatment of diseases and clinical conditions associated with TAL1. The function of TAL1 and its association with various diseases and clinical conditions, has been established by previous studies, as described hereinabove with reference to VGAM172. Tafazzin (cardiomyopathy, dilated 3A (X-linked); Endocardial Fibroelastosis 2; Barth Syndrome) (TAZ, Accession NM_000116) is another VGAM1958 host target gene. TAZ BINDING SITE is HOST TARGET binding site found in the 3' untranslated region of mRNA encoded by TAZ, corresponding to a HOST TARGET binding site such as BINDING SITE I, BINDING SITE II or BINDING SITE III. Table 2 illustrates the complementarity of the nucleotide sequences of TAZ BINDING SITE, designated SEQ ID:5586, to the nucleotide sequence of VGAM1958 RNA, herein designated VGAM RNA, also designated SEQ ID:4669.

Another function of VGAM1958 is therefore inhibition of Tafazzin (cardiomyopathy, dilated 3A (X-linked); Endocardial Fibroelastosis 2; Barth Syndrome) (TAZ, Accession NM_000116). Accordingly, utilities of VGAM1958 include diagnosis, prevention and treatment of diseases and clinical conditions associated with TAZ. Transducin (beta)-like 1X-linked (TBL1X, Accession NM_005647) is another VGAM1958 host target gene. TBL1X BINDING SITE is HOST TARGET binding site found in the 3' untranslated region of mRNA encoded by TBL1X, corresponding to a HOST TARGET binding site such as BINDING SITE I, BINDING SITE II or BINDING SITE III. Table 2 illustrates the complementarity of the nucleotide sequences of TBL1X BINDING SITE, designated SEQ ID:12187, to the nucleotide sequence of VGAM1958 RNA, herein designated VGAM RNA, also designated SEQ ID:4669.

Another function of VGAM1958 is therefore inhibition of Transducin (beta)-like 1X-linked (TBL1X, Accession NM_005647), a gene which activates latent HDAC3 activity. Accordingly, utilities of VGAM1958 include diagnosis, prevention and treatment of diseases and clinical conditions associated with TBL1X. The function of TBL1X and its association with various diseases and clinical conditions, has been established by previous studies, as described hereinabove with reference to VGAM1151. Transducin (beta)-like 2 (TBL2, Accession NM_032988) is another VGAM1958 host target gene. TBL2 BINDING SITE is HOST TARGET binding site found in the 3' untranslated region of mRNA encoded by TBL2, corresponding to a HOST TARGET binding site such as BINDING SITE I, BINDING SITE II or BINDING SITE III. Table 2 illustrates the complementarity of the nucleotide sequences of TBL2 BINDING SITE, designated SEQ ID:26868, to the nucleotide sequence of VGAM1958 RNA, herein designated VGAM RNA, also designated SEQ ID:4669.

Another function of VGAM1958 is therefore inhibition of Transducin (beta)-like 2 (TBL2, Accession NM_032988), a gene which is of unknown function. Accordingly, utilities of VGAM1958 include diagnosis, prevention and treatment of diseases and clinical conditions associated with TBL2. The function of TBL2 and its association with various diseases and clinical conditions, has been established by previous studies, as described hereinabove with reference to VGAM229. TATA Box Binding Protein (TBP, Accession XM_035700) is another VGAM1958 host target gene. TBP BINDING SITE is HOST TARGET binding site found in the 5' untranslated region of mRNA encoded by TBP, corresponding to a HOST TARGET binding site such as BINDING SITE I, BINDING SITE II or BINDING SITE III. Table 2 illustrates the complementarity of the nucleotide sequences of TBP BINDING SITE, designated SEQ ID:32330, to the nucleotide sequence of VGAM1958 RNA, herein designated VGAM RNA, also designated SEQ ID:4669.

Another function of VGAM1958 is therefore inhibition of TATA Box Binding Protein (TBP, Accession XM_035700), a gene which plays a central role in the initiation of eukaryotic mRNA synthesis. Accordingly, utilities of VGAM1958 include diagnosis, prevention and treatment of diseases and clinical conditions associated with TBP. The function of TBP has been established by previous studies. The TBP C-terminal domain of 180 amino acids is well conserved, and this domain is both necessary and sufficient for interaction with DNA and for assembly of the basal transcription apparatus (Peterson et al., 1990). Contrary to the previously hypothesized existence of a family of genes coding for DNA-binding proteins highly related to TBP, Purrello et al. (1994) showed that the segment coding for the evolutionarily conserved C-terminal DNA-binding domain is unique. When bound to the TATA box, it has a saddle-like shape, with the concave face contacting DNA and the convex interacting with the other subunits of TFIID, which are called TBP-associated factors (TAFs; OMIM Ref. No. 600475), with TFIIA (600519, 600520) and TFIIB (OMIM Ref. No. 189963), with the A form of RNA polymerase II CTD, and with positive and negative modulators of basal and activated transcription of class II genes (reviewed by Nikolov et al., 1992). The N terminus of TBP modulates the DNA-binding activity of the C terminus of the protein. It contains a long string of glutamine codons, which represents a common motif among other proteins involved in transcription, such as SP1 (OMIM Ref. No. 189906) and some homeo box proteins (Purrello et al., 1994). Animal model experiments lend further support to the function of TBP. Veenstra et al. (2000) tested the role of Tbp during the onset of embryonic transcription in Xenopus by antisense oligonucleotide-mediated turnover of maternal Tbp mRNA. Embryos without detectable Tbp initiated gastrulation but died before completing gastrulation. The expression of many genes transcribed by RNA polymerase II and III was reduced; however, some genes were transcribed with an efficiency identical to that of Tbp-containing embryos. Using a similar antisense strategy, Veenstra et al. (2000) found that the TBP-like factor Tlf/Trf2 (TBPL1; 605521) was essential for development past the midblastula stage. Because TBP and a TLF factor were found to play complementary roles in embryonic development, Veenstra et al. (2000) concluded that their results indicate that although similar mechanistic roles exist in common, TBP and TLF function differentially to control transcription of specific genes.

It is appreciated that the abovementioned animal model for TBP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Purrello, M.; Pietro, C. D.; Mirabile, E.; Rapisarda, A.; Rimini, R.; Tine, A.; Pavone, L.; Motta, S.; Grzeschik, K.-H.; Sichel, G.: Physical mapping at 6q27 of the locus for the TATA box-binding protein, the DNA-binding subunit of TFIID and a component of SL1 and TFIIIB, strongly suggests that it is single copy in the human genome. Genomics 22:94-100, 1994; and Veenstra, G. J. C.; Weeks, D. L.; Wolffe, A. P.: Distinct roles for TBP and TBP-like factor in early embryonic gene transcription in Xenopus. Science 290:2312-2314, 2000.

Further studies establishing the function and utilities of TBP are found in John Hopkins OMIM database record ID 600075, and in sited publications numbered 7663-7672, 7678-7675, 788 and 7895-7896 listed in the bibliography section hereinbelow, which are also hereby incorporated by reference. Tec Protein Tyrosine Kinase (TEC, Accession NM_003215) is another VGAM1958 host target gene. TEC BINDING SITE is HOST TARGET binding site found in the 3' untranslated region of mRNA encoded by TEC, corresponding to a HOST TARGET binding site such as BINDING SITE I, BINDING SITE II or BINDING SITE III. Table 2 illustrates the complementarity of the nucleotide sequences of TEC BINDING SITE, designated SEQ ID:9217, to the nucleotide sequence of VGAM1958 RNA, herein designated VGAM RNA, also designated SEQ ID:4669.

Another function of VGAM1958 is therefore inhibition of Tec Protein Tyrosine Kinase (TEC, Accession NM_003215). Accordingly, utilities of VGAM1958 include diagnosis, prevention and treatment of diseases and clinical conditions associated with TEC. Testis Derived Transcript (3 LIM domains) (TES, Accession XM_050430) is another VGAM1958 host target gene. TES BINDING SITE is HOST TARGET binding site found in the 3' untranslated region of mRNA encoded by TES, corresponding to a HOST TARGET binding site such as BINDING SITE I, BINDING SITE II or BINDING SITE III. Table 2 illustrates the complementarity of the nucleotide sequences of TES BINDING SITE, designated SEQ ID:35630, to the nucleotide sequence of VGAM1958 RNA, herein designated VGAM RNA, also designated SEQ ID:4669.

Another function of VGAM1958 is therefore inhibition of Testis Derived Transcript (3 LIM domains) (TES, Accession XM_050430), a gene which acts as a tumor suppressor. Accordingly, utilities of VGAM1958 include diagnosis, prevention and treatment of diseases and clinical conditions associated with TES. The function of TES and its association with various diseases and clinical conditions, has been established by previous studies, as described hereinabove with reference to VGAM363. Testis-specific Kinase 1 (TESK1, Accession NM_006285) is another VGAM1958 host target gene. TESK1 BINDING SITE is HOST TARGET binding site found in the 5' untranslated region of mRNA encoded by TESK1, corresponding to a HOST TARGET binding site such as BINDING SITE I, BINDING SITE II or BINDING SITE III. Table 2 illustrates the complementarity of the nucleotide sequences of TESK1 BINDING SITE, designated SEQ ID:12971, to the nucleotide sequence of VGAM1958 RNA, herein designated VGAM RNA, also designated SEQ ID:4669.

Another function of VGAM1958 is therefore inhibition of Testis-specific Kinase 1 (TESK1, Accession NM_006285), a gene which plays a central role at, and after the meiotic phase of spermatogenesis. Accordingly, utilities of VGAM1958 include diagnosis, prevention and treatment of diseases and clinical conditions associated with TESK1. The function of TESK1 has been established by previous studies. Toshima et al. (1995) isolated cDNA clones encoding the rat and human forms of testis-specific protein kinase-1 (TESK1). The deduced 626-amino acid human protein shares 92% sequence identity with its rat counterpart. The protein kinase domain is structurally similar to those of LIMK1 (OMIM Ref. No. 601329) and LIMK2 (OMIM Ref. No. 601988), with 49 to 50% sequence identity. Studying transgenic mice carrying a lacZ reporter plasmid for TESK1 expression, Toshima et al. (2001) found TESK1 in testicular germ cells only in postpubertal mice at the pachytene spermatocyte to sperm stage of maturation. No staining was detected in nongerminal cells or in germ cells at other stages. Expression was also found in adult renal proximal convoluted tubules, in cardiac myocytes, in pulmonary smooth muscle cells around bronchioles, and within neurons of several areas of the adult brain. Intense staining was also found in brain, spinal cord, and olfactory region of day 12.5 embryonic mice.

Full details of the abovementioned studies are described in the following publications, the disclosure of which are hereby incorporated by reference:

Toshima, J.; Ohashi, K.; Okano, I.; Nunoue, K.; Kishioka, M.; Kuma, K.; Miyata, T.; Hirai, M.; Baba, T.; Mizuno, K.: Identification and characterization of a novel protein kinase, TESK1, specifically expressed in testicular germ cells. J. Biol. Chem. 270:31331-31337, 1995; and Toshima, J.; Toshima, J. Y.; Suzuki, M.; Noda, T.; Mizuno, K.: Cell-type-specific expression of a TESK1 promoter-linked lacZ gene in transgenic mice. Biochem. Biophys. Res. Commun. 286.

Further studies establishing the function and utilities of TESK1 are found in John Hopkins OMIM database record ID 601782, and in sited publications numbered 1249-1250 listed in the bibliography section hereinbelow, which are also hereby incorporated by reference. Transcription Factor EB (TFEB, Accession XM_166390) is another VGAM1958 host target gene. TFEB BINDING SITE is HOST TARGET binding site found in the 3' untranslated region of mRNA encoded by TFEB, corresponding to a HOST TARGET binding site such as BINDING SITE I, BINDING SITE II or BINDING SITE III. Table 2 illustrates the complementarity of the nucleotide sequences of TFEB BINDING SITE, designated SEQ ID:44240, to the nucleotide sequence of VGAM1958 RNA, herein designated VGAM RNA, also designated SEQ ID:4669.

Another function of VGAM1958 is therefore inhibition of Transcription Factor EB (TFEB, Accession XM_166390), a gene which may function as a transcription factor. Accordingly, utilities of VGAM1958 include diagnosis, prevention and treatment of diseases and clinical conditions associated with TFEB. The function of TFEB has been established by previous studies. Transcription factors of the basic helix-loop-helix zipper (bHLH-Zip) family contain a basic domain, used for DNA binding, and HLH and Zip domains, both used for oligomerization. TFEB was isolated from a human B-cell cDNA library using a binding sequence from the adenovirus major late promoter (Carr and Sharp, 1990). By interspecific backcross analysis, Steingrimsson et al. (1995) mapped the Tcfeb gene in the mouse to chromosome 17 in a region of homology to human 6p21, which can be presumed to be the location of the human homolog.

Full details of the abovementioned studies are described in the following publications, the disclosure of which are hereby incorporated by reference:

Carr, C. S.; Sharp, P. A.: A helix-loop-helix protein related to the immunoglobulin E box-binding proteins. Molec. Cell. Biol. 10:4384-4388, 1990; and Steingrimsson, E.; Sawadogo, M.; Gilbert, D. J.; Zervos, A. S.; Brent, R.; Blanar, M. A.; Fisher, D. E.; Copeland, N. G.; Jenkins, N. A.: Murine chromosomal location of five bHLH-Zip t.

Further studies establishing the function and utilities of TFEB are found in John Hopkins OMIM database record ID 600744, and in sited publications numbered 758 and 12617 listed in the bibliography section hereinbelow, which are also hereby incorporated by reference. Transforming Growth Factor, Beta 3 (TGFB3, Accession NM_003239) is another VGAM1958 host target gene. TGFB3 BINDING SITE is HOST TARGET binding site found in the 5' untranslated region of mRNA encoded by TGFB3, corresponding to a HOST TARGET binding site such as BINDING SITE I, BINDING SITE II or BINDING SITE III. Table 2 illustrates the complementarity of the nucleotide sequences of TGFB3 BINDING SITE, designated SEQ ID:9232, to the nucleotide sequence of VGAM1958 RNA, herein designated VGAM RNA, also designated SEQ ID:4669.

Another function of VGAM1958 is therefore inhibition of Transforming Growth Factor, Beta 3 (TGFB3, Accession NM_003239), a gene which is involved in embryogenesis and cell differentiation. Accordingly, utilities of VGAM1958 include diagnosis, prevention and treatment of diseases and clinical conditions associated with TGFB3. The function of TGFB3 and its association with various diseases and clinical conditions, has been established by previous studies, as described hereinabove with reference to VGAM1126. Translocase of Inner Mitochondrial Membrane 23 Homolog (yeast) (TIMM23, Accession XM_011891) is another VGAM1958 host target gene. TIMM23 BINDING SITE is HOST TARGET binding site found in the 3' untranslated region of mRNA encoded by TIMM23, corresponding to a HOST TARGET binding site such as BINDING SITE I, BINDING SITE II or BINDING SITE III. Table 2 illustrates the complementarity of the nucleotide sequences of TIMM23 BINDING SITE, designated SEQ ID:30200, to the nucleotide sequence of VGAM1958 RNA, herein designated VGAM RNA, also designated SEQ ID:4669.

Another function of VGAM1958 is therefore inhibition of Translocase of Inner Mitochondrial Membrane 23 Homolog (yeast) (TIMM23, Accession XM_011891), a gene which translocates nuclear-encoded proteins into the mitochondrion. Accordingly, utilities of VGAM1958 include diagnosis, prevention and treatment of diseases and clinical conditions associated with TIMM23. The function of TIMM23 has been established by previous studies. By searching EST databases for homologs of yeast TIMs, Bauer et al. (1999) identified a cDNA encoding TIMM23. Sequence analysis predicted that the 209-amino acid TIMM23 protein shares 22% amino acid identity with yeast Tim23 and contains 4 hydrophobic membrane-spanning segments that conserve the N-out/C-out topology of yeast TIMs. TIMM23 also has a 74-amino acid N-terminal hydrophilic segment that is dissimilar to the N-terminal hydrophilic domain of yeast Tim23. Northern blot analysis detected a 2.9-kb TIMM23 transcript that was highly expressed in heart and skeletal muscle, intermediately expressed in brain, and weakly expressed in pancreas, placenta, kidney, and liver. Western blot analysis showed that TIMM23 colocalizes with the inner membrane fraction of mitochondria as a 23-kD protein. TIMM23 is organized into 2 distinct 110-kD complexes in the inner membrane, one containing TIMM17A (OMIM Ref. No. 605057) and the other containing TIMM17B (OMIM Ref. No. 300249). Tim23, a key component of the yeast mitochondrial preprotein translocase, is anchored in the inner membrane by its C-terminal domain and exposes an intermediate domain, which functions as a presequence receptor, in the intermembrane space. Donzeau et al. (2000) showed that the N-terminal domain of Tim23 is exposed on the surface of the outer membrane. The authors stated that the 2-membrane-spanning topology of Tim23 is a novel characteristic in membrane biology. By simultaneously integrating into 2 membranes, Tim23 forms contacts between the outer and inner mitochondrial membranes. Tethering the inner membrane translocase to the outer membrane facilitates the transfer of precursor proteins from the TOM complex to the TIM23 complex, thereby increasing the efficiency of protein import.

Full details of the abovementioned studies are described in the following publications, the disclosure of which are hereby incorporated by reference:

Bauer, M. F.; Gempel, K.; Reichert, A. S.; Rappold, G. A.; Lichtner, P.; Gerbitz, K.-D.; Neupert, W.; Brunner, M.; Hofmann, S.: Genetic and structural characterization of the human mitochondrial inner membrane translocase. J. Molec. Biol. 289: 69-82, 1999; and Donzeau, M.; Kaldi, K.; Adam, A.; Paschen, S.; Wanner, G.; Guiard, B.; Bauer, M. F.; Neupert, W.; Brunner, M.: Tim23 links the inner and outer mitochondrial membranes. Cell 101:401.

Further studies establishing the function and utilities of TIMM23 are found in John Hopkins OMIM database record ID 605034, and in sited publications numbered 9210 listed in the bibliography section hereinbelow, which are also hereby incorporated by reference. TIRAP (Accession NM_052887) is another VGAM1958 host target gene. TIRAP BINDING SITE is HOST TARGET binding site found in the 3' untranslated region of mRNA encoded by TIRAP, corresponding to a HOST TARGET binding site such as BINDING SITE I, BINDING SITE II or BINDING SITE III. Table 2 illustrates the complementarity of the nucleotide sequences of TIRAP BINDING SITE, designated SEQ ID:27472, to the nucleotide sequence of VGAM1958 RNA, herein designated VGAM RNA, also designated SEQ ID:4669.

Another function of VGAM1958 is therefore inhibition of TIRAP (Accession NM_052887), a gene which is a adapter involved in theTLR4 signaling pathway in the innate immune response. Accordingly, utilities of VGAM1958 include diagnosis, prevention and treatment of diseases and clinical conditions associated with TIRAP. The function of TIRAP and its association with various diseases and clinical conditions, has been established by previous studies, as described hereinabove with reference to VGAM189. Tight Junction Protein 1 (zona occludens 1) (TJP1, Accession NM_003257) is another VGAM1958 host target gene. TJP1 BINDING SITE1 and TJP1 BINDING SITE2 are HOST TARGET binding sites found in untranslated regions of mRNA encoded by TJP1, corresponding to HOST TARGET binding sites such as BINDING SITE I, BINDING SITE II or BINDING SITE III. Table 2 illustrates the complementarity of the nucleotide sequences of TJP1 BINDING SITE1 and TJP1 BINDING SITE2, designated SEQ ID:9266 and SEQ ID:9264 respectively, to the nucleotide sequence of VGAM1958 RNA, herein designated VGAM RNA, also designated SEQ ID:4669.

Another function of VGAM1958 is therefore inhibition of Tight Junction Protein 1 (zona occludens 1) (TJP1, Accession NM_003257), a gene which colocalizes and interacts with cadherins in cells lacking tight junctions. Accordingly, utilities of VGAM1958 include diagnosis, prevention and treatment of diseases and clinical conditions associated with TJP1. The function of TJP1 and its association with various diseases and clinical conditions, has been established by previous studies, as described hereinabove with reference to VGAM95. T-cell Leukemia, Homeobox 1 (TLX1, Accession NM_005521) is another VGAM1958 host target gene. TLX1 BINDING SITE1 and TLX1 BINDING SITE2 are HOST TARGET binding sites found in untranslated regions of mRNA encoded by TLX1, corresponding to HOST TARGET binding sites such as BINDING SITE I, BINDING SITE II or BINDING SITE III. Table 2 illustrates the complementarity of the nucleotide sequences of TLX1 BINDING SITE1 and TLX1 BINDING SITE2, designated SEQ ID:12045 and SEQ ID:30009 respectively, to the nucleotide sequence of VGAM1958 RNA, herein designated VGAM RNA, also designated SEQ ID:4669.

Another function of VGAM1958 is therefore inhibition of T-cell Leukemia, Homeobox 1 (TLX1, Accession NM_005521), a gene which controls the spleen development. Accordingly, utilities of VGAM1958 include diagnosis, prevention and treatment of diseases and clinical conditions associated with TLX1. The function of TLX1 and its association with various diseases and clinical conditions, has been established by previous studies, as described hereinabove with reference to VGAM1505. Tumor Necrosis Factor (ligand) Superfamily, Member 15 (TNFSF15, Accession NM_005118) is another VGAM1958 host target gene. TNFSF15 BINDING SITE is HOST TARGET binding site found in the 5' untranslated region of mRNA encoded by TNFSF15, corresponding to a HOST TARGET binding site such as BINDING SITE I, BINDING SITE II or BINDING SITE III. Table 2 illustrates the complementarity of the nucleotide sequences of TNFSF15 BINDING SITE, designated SEQ ID:11599, to the nucleotide sequence of VGAM1958 RNA, herein designated VGAM RNA, also designated SEQ ID:4669.

Another function of VGAM1958 is therefore inhibition of Tumor Necrosis Factor (ligand) Superfamily, Member 15 (TNFSF15, Accession NM_005118), a gene which acts as an autocrine factor to induce apoptosis in endothelial cells. Accordingly, utilities of VGAM1958 include diagnosis, prevention and treatment of diseases and clinical conditions associated with TNFSF15. The function of TNFSF15 and its association with various diseases and clinical conditions, has been established by previous studies, as described hereinabove with reference to VGAM350. Topoisomerase (DNA) III Alpha (TOP3A, Accession NM_004618) is another VGAM1958 host target gene. TOP3A BINDING SITE is HOST TARGET binding site found in the 5' untranslated region of mRNA encoded by TOP3A, corresponding to a HOST TARGET binding site such as BINDING SITE I, BINDING SITE II or BINDING SITE III. Table 2 illustrates the complementarity of the nucleotide sequences of TOP3A BINDING SITE, designated SEQ ID:10961, to the nucleotide sequence of VGAM1958 RNA, herein designated VGAM RNA, also designated SEQ ID:4669.

Another function of VGAM1958 is therefore inhibition of Topoisomerase (DNA) III Alpha (TOP3A, Accession NM_004618). Accordingly, utilities of VGAM1958 include diagnosis, prevention and treatment of diseases and clinical conditions associated with TOP3A. Translocated Promoter Region (to activated MET oncogene) (TPR, Accession NM_003292) is another VGAM1958 host target gene. TPR BINDING SITE is HOST TARGET binding site found in the 5' untranslated region of mRNA encoded by TPR, corresponding to a HOST TARGET binding site such as BINDING SITE I, BINDING SITE II or BINDING SITE III. Table 2 illustrates the complementarity of the nucleotide sequences of TPR BINDING SITE, designated SEQ ID:9302, to the nucleotide sequence of VGAM1958 RNA, herein designated VGAM RNA, also designated SEQ ID:4669.

Another function of VGAM1958 is therefore inhibition of Translocated Promoter Region (to activated MET oncogene) (TPR, Accession NM_003292), a gene which Large coiled coil protein; may be involved in nuclear protein import. Accordingly, utilities of VGAM1958 include diagnosis, prevention and treatment of diseases and clinical conditions associated with TPR. The function of TPR has been established by previous studies. The TPR locus, which has been mapped to chromosome 1, expresses a 10-kb RNA in all human cell lines tested (Dean et al., 1985). In a cell line rendered tumorigenic with the direct-acting carcinogen N-methyl-N-prime-nitronitrosoguanidine (MNNG), Dean et al. (1987) defined an activated MET oncogene that expresses a novel 5.0-kb RNA transcript which is a hybrid RNA derived from a DNA rearrangement involving the TPR locus and the MET locus (on 7q; 164860). Although most of the hybrid RNA is derived from the MET oncogene, the 5-prime portion uses some exons from the TPR gene, presumably the promoter region. Oncogenic activation of MET is reminiscent of the Philadelphia chromosomal translocation in chronic myeloid leukemia that generates the hybrid BCR/ABL tyrosine kinase p210 (see OMIM Ref. No. 151410). Gonzatti-Haces et al. (1988) identified the proteins encoded by the human TPR-MET oncogene and the human MET proto-oncogene. By fluorescence in situ hybridization, Miranda et al. (1994) assigned the TPR gene to 1q25.

Full details of the abovementioned studies are described in the following publications, the disclosure of which are hereby incorporated by reference:

Dean, M.; Park, M.; Vande Woude, G. F.: Characterization of the rearranged TPR-MET oncogene breakpoint. Molec. Cell. Biol. 7:921-924, 1987; and Gonzatti-Haces, M.; Seth, A.; Park, M.; Copeland, T.; Oroszlan, S.; Vande Woude, G. F.: Characterization of the TPR-MET oncogene p65 and the MET proto-oncogene p140 protein-tyrosine kina.

Further studies establishing the function and utilities of TPR are found in John Hopkins OMIM database record ID 189940, and in sited publications numbered 182 and 12345-602 listed in the bibliography section hereinbelow, which are also hereby incorporated by reference. Tripartite Motif-containing 14 (TRIM14, Accession NM_014788) is another VGAM1958 host target gene. TRIM14 BINDING SITE is HOST TARGET binding site found in the 3' untranslated region of mRNA encoded by TRIM14, corresponding to a HOST TARGET binding site such as BINDING SITE I, BINDING SITE II or BINDING SITE III. Table 2 illustrates the complementarity of the nucleotide sequences of TRIM14 BINDING SITE, designated SEQ ID:16666, to the nucleotide sequence of VGAM1958 RNA, herein designated VGAM RNA, also designated SEQ ID:4669.

Another function of VGAM1958 is therefore inhibition of Tripartite Motif-containing 14 (TRIM14, Accession NM_014788), a gene which is composed of 3 zinc-binding domains and is involved in development and cell growth. Accordingly, utilities of VGAM1958 include diagnosis, prevention and treatment of diseases and clinical conditions associated with TRIM14. The function of TRIM14 and its association with various diseases and clinical conditions, has been established by previous studies, as described hereinabove with reference to VGAM180. Transient Receptor Potential Cation Channel, Subfamily C, Member 6 (TRPC6, Accession NM_004621) is another VGAM1958 host target gene. TRPC6 BINDING SITE is HOST TARGET binding site found in the 3' untranslated region of mRNA encoded by TRPC6, corresponding to a HOST TARGET binding site such as BINDING SITE I, BINDING SITE II or BINDING SITE III. Table 2 illustrates the complementarity of the nucleotide sequences of TRPC6 BINDING SITE, designated SEQ ID:10972, to the nucleotide sequence of VGAM1958 RNA, herein designated VGAM RNA, also designated SEQ ID:4669.

Another function of VGAM1958 is therefore inhibition of Transient Receptor Potential Cation Channel, Subfamily C, Member 6 (TRPC6, Accession NM_004621), a gene which has calcium channel activity. Accordingly, utilities of VGAM1958 include diagnosis, prevention and treatment of diseases and clinical conditions associated with TRPC6. The function of TRPC6 and its association with various diseases and clinical conditions, has been established by previous studies, as described hereinabove with reference to VGAM25. Tuftelin 1 (TUFT1, Accession NM_020127) is another VGAM1958 host target gene. TUFT1 BINDING SITE is HOST TARGET binding site found in the 3' untranslated region of mRNA encoded by TUFT1, corresponding to a HOST TARGET binding site such as BINDING SITE I, BINDING SITE II or BINDING SITE III. Table 2 illustrates the complementarity of the nucleotide sequences of TUFT1 BINDING SITE, designated SEQ ID:21317, to the nucleotide sequence of VGAM1958 RNA, herein designated VGAM RNA, also designated SEQ ID:4669.

Another function of VGAM1958 is therefore inhibition of Tuftelin 1 (TUFT1, Accession NM_020127), a gene which appears to play a role in cytokinesis, cell shape, and specialized functions such as secretion and capping. Accordingly, utilities of VGAM1958 include diagnosis, prevention and treatment of diseases and clinical conditions associated with TUFT1. The function of TUFT1 and its association with various diseases and clinical conditions, has been established by previous studies, as described hereinabove with reference to VGAM1152. Twist Homolog (acrocephalosyndactyly 3; Saethre-Chotzen syndrome) (Drosophila) (TWIST, Accession NM_000474) is another VGAM1958 host target gene. TWIST BINDING SITE is HOST TARGET binding site found in the 3' untranslated region of mRNA encoded by TWIST, corresponding to a HOST TARGET binding site such as BINDING SITE I, BINDING SITE II or BINDING SITE III. Table 2 illustrates the complementarity of the nucleotide sequences of TWIST BINDING SITE, designated SEQ ID:6083, to the nucleotide sequence of VGAM1958 RNA, herein designated VGAM RNA, also designated SEQ ID:4669.

Another function of VGAM1958 is therefore inhibition of Twist Homolog (acrocephalosyndactyly 3; Saethre-Chotzen syndrome) (Drosophila) (TWIST, Accession NM_000474). Accordingly, utilities of VGAM1958 include diagnosis, prevention and treatment of diseases and clinical conditions associated with TWIST. Unc-119 Homolog (C. elegans) (UNC119, Accession NM_054035) is another VGAM1958 host target gene. UNC119 BINDING SITE1 and UNC119 BINDING SITE2 are HOST TARGET binding sites found in untranslated regions of mRNA encoded by UNC119, corresponding to HOST TARGET binding sites such as BINDING SITE I, BINDING SITE II or BINDING SITE III. Table 2 illustrates the complementarity of the nucleotide sequences of UNC119 BINDING SITE1 and UNC119 BINDING SITE2, designated SEQ ID:27648 and SEQ ID:11621 respectively, to the nucleotide sequence of VGAM1958 RNA, herein designated VGAM RNA, also designated SEQ ID:4669.

Another function of VGAM1958 is therefore inhibition of Unc-119 Homolog (C. elegans) (UNC119, Accession NM_054035), a gene which is expressed in the retina and may play a role in the mechanism of photoreceptor neurotransmitter release through the synaptic vesicle cycle. Accordingly, utilities of VGAM1958 include diagnosis, prevention and treatment of diseases and clinical conditions associated with UNC119. The function of UNC119 and its association with various diseases and clinical conditions, has been established by previous studies, as described hereinabove with reference to VGAM1044. Williams-Beuren Syndrome Chromosome Region 1 (WBSCR1, Accession NM_031992) is another VGAM1958 host target gene.

WBSCR1 BINDING SITE1 and WBSCR1 BINDING SITE2 are HOST TARGET binding sites found in untranslated regions of mRNA encoded by WBSCR1, corresponding to HOST TARGET binding sites such as BINDING SITE I, BINDING SITE II or BINDING SITE III. Table 2 illustrates the complementarity of the nucleotide sequences of WBSCR1 BINDING SITE1 and WBSCR1 BINDING SITE2, designated SEQ ID:25706 and SEQ ID:9649 respectively, to the nucleotide sequence of VGAM1958 RNA, herein designated VGAM RNA, also designated SEQ ID:4669.

Another function of VGAM1958 is therefore inhibition of Williams-Beuren Syndrome Chromosome Region 1 (WBSCR1, Accession NM_031992), a gene which stimulates protein translation. Accordingly, utilities of VGAM1958 include diagnosis, prevention and treatment of diseases and clinical conditions associated with WBSCR1. The function of WBSCR1 and its association with various diseases and clinical conditions, has been established by previous studies, as described hereinabove with reference to VGAM110. Wolf-Hirschhorn Syndrome Candidate 1 (WHSC1, Accession NM_014919) is another VGAM1958 host target gene. WHSC1 BINDING SITE1 through WHSC1 BINDING SITE5 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE5, designated SEQ ID:17182, SEQ ID:28463, SEQ ID:28474, SEQ ID:28446 and SEQ ID:10996 respectively, to the nucleotide sequence of VGAM1958 RNA, herein designated VGAM RNA, also designated SEQ ID:4669.

Another function of VGAM1958 is therefore inhibition of Wolf-Hirschhorn Syndrome Candidate 1 (WHSC1, Accession NM_014919), a gene which binds covalently to and repairs g/t mismatches. Accordingly, utilities of VGAM1958 include diagnosis, prevention and treatment of diseases and clinical conditions associated with WHSC1. The function of WHSC1 and its association with various diseases and clinical conditions, has been established by previous studies, as described hereinabove with reference to VGAM200. X-ray Repair Complementing Defective Repair In Chinese Hamster Cells 3 (XRCC3, Accession NM_005432) is another VGAM1958 host target gene. XRCC3 BINDING SITE is HOST TARGET binding site found in the 3' untranslated region of mRNA encoded by XRCC3, corresponding to a HOST TARGET binding site such as BINDING SITE I, BINDING SITE II or BINDING SITE III. Table 2 illustrates the complementarity of the nucleotide sequences of XRCC3 BINDING SITE, designated SEQ ID:11908, to the nucleotide sequence of VGAM1958 RNA, herein designated VGAM RNA, also designated SEQ ID:4669.

Another function of VGAM1958 is therefore inhibition of X-ray Repair Complementing Defective Repair In Chinese Hamster Cells 3 (XRCC3, Accession NM_005432), a gene which is required for meiotic recombination, synaptonemal complex formation and cell cycle progression. Accordingly, utilities of VGAM1958 include diagnosis, prevention and treatment of diseases and clinical conditions associated with XRCC3. The function of XRCC3 and its association with various diseases and clinical conditions, has been established by previous studies, as described hereinabove with reference to VGAM1290. Zinc Finger Protein 103 Homolog (mouse) (ZFP103, Accession NM_005667) is another VGAM1958 host target gene. ZFP103 BINDING SITE is HOST TARGET binding site found in the 5' untranslated region of mRNA encoded by ZFP103, corresponding to a HOST TARGET binding site such as BINDING SITE I, BINDING SITE II or BINDING SITE III. Table 2 illustrates the complementarity of the nucleotide sequences of ZFP103 BINDING SITE, designated SEQ ID:12218, to the nucleotide sequence of VGAM1958 RNA, herein designated VGAM RNA, also designated SEQ ID:4669.

Another function of VGAM1958 is therefore inhibition of Zinc Finger Protein 103 Homolog (mouse) (ZFP103, Accession NM_005667). Accordingly, utilities of VGAM1958 include diagnosis, prevention and treatment of diseases and clinical conditions associated with ZFP103. Zinc Finger Protein 136 (clone pHZ-20) (ZNF136, Accession XM_009075) is another VGAM1958 host target gene. ZNF136 BINDING SITE is HOST TARGET binding site found in the 3' untranslated region of mRNA encoded by ZNF136, corresponding to a HOST TARGET binding site such as BINDING SITE I, BINDING SITE II or BINDING SITE III. Table 2 illustrates the complementarity of the nucleotide sequences of ZNF136 BINDING SITE, designated SEQ ID:30098, to the nucleotide sequence of VGAM1958 RNA, herein designated VGAM RNA, also designated SEQ ID:4669.

Another function of VGAM1958 is therefore inhibition of Zinc Finger Protein 136 (clone pHZ-20) (ZNF136, Accession XM_009075). Accordingly, utilities of VGAM1958 include diagnosis, prevention and treatment of diseases and clinical conditions associated with ZNF136. Zinc Finger Protein 215 (ZNF215, Accession NM_013250) is another VGAM1958 host target gene. ZNF215 BINDING SITE is HOST TARGET binding site found in the 3' untranslated region of mRNA encoded by ZNF215, corresponding to a HOST TARGET binding site such as BINDING SITE I, BINDING SITE II or BINDING SITE III. Table 2 illustrates the complementarity of the nucleotide sequences of ZNF215 BINDING SITE, designated SEQ ID:14914, to the nucleotide sequence of VGAM1958 RNA, herein designated VGAM RNA, also designated SEQ ID:4669.

Another function of VGAM1958 is therefore inhibition of Zinc Finger Protein 215 (ZNF215, Accession NM_013250). Accordingly, utilities of VGAM1958 include diagnosis, prevention and treatment of diseases and clinical conditions associated with ZNF215. Zinc Finger Protein 261 (ZNF261, Accession NM_005096) is another VGAM1958 host target gene. ZNF261 BINDING SITE is HOST TARGET binding site found in the 3' untranslated region of mRNA encoded by ZNF261, corresponding to a HOST TARGET binding site such as BINDING SITE I, BINDING SITE II or BINDING SITE III. Table 2 illustrates the complementarity of the nucleotide sequences of ZNF261 BINDING SITE, designated SEQ ID:11562, to the nucleotide sequence of VGAM1958 RNA, herein designated VGAM RNA, also designated SEQ ID:4669.

Another function of VGAM1958 is therefore inhibition of Zinc Finger Protein 261 (ZNF261, Accession NM_005096). Accordingly, utilities of VGAM1958 include diagnosis, prevention and treatment of diseases and clinical conditions associated with ZNF261. Zinc Finger Protein 278 (ZNF278, Accession NM_032052) is another VGAM1958 host target gene. ZNF278 BINDING SITE is HOST TARGET binding site found in the 3' untranslated region of mRNA encoded by ZNF278, corresponding to a HOST TARGET binding site such as BINDING SITE I, BINDING SITE II or BINDING SITE III. Table 2 illustrates the complementarity of the nucleotide sequences of ZNF278 BINDING SITE, designated SEQ ID:25779, to the nucleotide sequence of VGAM1958 RNA, herein designated VGAM RNA, also designated SEQ ID:4669.

Another function of VGAM1958 is therefore inhibition of Zinc Finger Protein 278 (ZNF278, Accession NM_032052), a gene which represses basal transcription as well as RNF4-mediated activation. Accordingly, utilities of VGAM1958 include diagnosis, prevention and treatment of diseases and clinical conditions associated with ZNF278. The function of ZNF278 and its association with various diseases and clinical conditions, has been established by previous studies, as described hereinabove with reference to VGAM414. A2BP1 (Accession NM_018723) is another VGAM1958 host target gene. A2BP1 BINDING SITE is HOST TARGET binding site found in the 5' untranslated region of mRNA encoded by A2BP1, corresponding to a HOST TARGET binding site such as BINDING SITE I, BINDING SITE II or BINDING SITE III. Table 2 illustrates the complementarity of the nucleotide sequences of A2BP1 BINDING SITE, designated SEQ ID:20806, to the nucleotide sequence of VGAM1958 RNA, herein designated VGAM RNA, also designated SEQ ID:4669.

Another function of VGAM1958 is therefore inhibition of A2BP1 (Accession NM_018723). Accordingly, utilities of VGAM1958 include diagnosis, prevention and treatment of diseases and clinical conditions associated with A2BP1. ABIN-2 (Accession NM_024309) is another VGAM1958 host target gene. ABIN-2 BINDING SITE is HOST TARGET binding site found in the 3' untranslated region of mRNA encoded by ABIN-2, corresponding to a HOST TARGET binding site such as BINDING SITE I, BINDING SITE II or BINDING SITE III. Table 2 illustrates the complementarity of the nucleotide sequences of ABIN-2 BINDING SITE, designated SEQ ID:23603, to the nucleotide sequence of VGAM1958 RNA, herein designated VGAM RNA, also designated SEQ ID:4669.

Another function of VGAM1958 is therefore inhibition of ABIN-2 (Accession NM_024309). Accordingly, utilities of VGAM1958 include diagnosis, prevention and treatment of diseases and clinical conditions associated with ABIN-2. A Kinase (PRKA) Anchor Protein (gravin) 12 (AKAP12, Accession NM_005100) is another VGAM1958 host target gene. AKAP12 BINDING SITE1 and AKAP12 BINDING SITE2 are HOST TARGET binding sites found in untranslated regions of mRNA encoded by AKAP12, corresponding to HOST TARGET binding sites such as BINDING SITE I, BINDING SITE II or BINDING SITE III. Table 2 illustrates the complementarity of the nucleotide sequences of AKAP12 BINDING SITE1 and AKAP12 BINDING SITE2, designated SEQ ID:11571 and SEQ ID:29311 respectively, to the nucleotide sequence of VGAM1958 RNA, herein designated VGAM RNA, also designated SEQ ID:4669.

Another function of VGAM1958 is therefore inhibition of A Kinase (PRKA) Anchor Protein (gravin) 12 (AKAP12, Accession NM_005100). Accordingly, utilities of VGAM1958 include diagnosis, prevention and treatment of diseases and clinical conditions associated with AKAP12. AMSH (Accession NM_006463) is another VGAM1958 host target gene. AMSH BINDING SITE is HOST TARGET binding site found in the 3' untranslated region of mRNA encoded by AMSH, corresponding to a HOST TARGET binding site such as BINDING SITE I, BINDING SITE II or BINDING SITE III. Table 2 illustrates the complementarity of the nucleotide sequences of AMSH BINDING SITE, designated SEQ ID:13180, to the nucleotide sequence of VGAM1958 RNA, herein designated VGAM RNA, also designated SEQ ID:4669.

Another function of VGAM1958 is therefore inhibition of AMSH (Accession NM_006463). Accordingly, utilities of VGAM1958 include diagnosis, prevention and treatment of diseases and clinical conditions associated with AMSH. AND-1 (Accession NM_007086) is another VGAM1958 host target gene. AND-1 BINDING SITE is HOST TARGET binding site found in the 3' untranslated region of mRNA encoded by AND-1, corresponding to a HOST TARGET binding site such as BINDING SITE I, BINDING SITE II or BINDING SITE III. Table 2 illustrates the complementarity of the nucleotide sequences of AND-1 BINDING SITE, designated SEQ ID:13955, to the nucleotide sequence of VGAM1958 RNA, herein designated VGAM RNA, also designated SEQ ID:4669.

Another function of VGAM1958 is therefore inhibition of AND-1 (Accession NM_007086). Accordingly, utilities of VGAM1958 include diagnosis, prevention and treatment of diseases and clinical conditions associated with AND-1. Ankyrin Repeat Domain 5 (ANKRD5, Accession NM_022096) is another VGAM1958 host target gene. ANKRD5 BINDING SITE is HOST TARGET binding site found in the 5' untranslated region of mRNA encoded by ANKRD5, corresponding to a HOST TARGET binding site such as BINDING SITE I, BINDING SITE II or BINDING SITE III. Table 2 illustrates the complementarity of the nucleotide sequences of ANKRD5 BINDING SITE, designated SEQ ID:22635, to the nucleotide sequence of VGAM1958 RNA, herein designated VGAM RNA, also designated SEQ ID:4669.

Another function of VGAM1958 is therefore inhibition of Ankyrin Repeat Domain 5 (ANKRD5, Accession NM_022096). Accordingly, utilities of VGAM1958 include diagnosis, prevention and treatment of diseases and clinical conditions associated with ANKRD5. Adaptor-related Protein Complex 3, Mu 2 Subunit (AP3M2, Accession NM_006803) is another VGAM1958 host target gene. AP3M2 BINDING SITE1 and AP3M2 BINDING SITE2 are HOST TARGET binding sites found in untranslated regions of mRNA encoded by AP3M2, corresponding to HOST TARGET binding sites such as BINDING SITE I, BINDING SITE II or BINDING SITE III. Table 2 illustrates the complementarity of the nucleotide sequences of AP3M2 BINDING SITE1 and AP3M2 BINDING SITE2, designated SEQ ID:13674 and SEQ ID:13677 respectively, to the nucleotide sequence of VGAM1958 RNA, herein designated VGAM RNA, also designated SEQ ID:4669.

Another function of VGAM1958 is therefore inhibition of Adaptor-related Protein Complex 3, Mu 2 Subunit (AP3M2, Accession NM_006803). Accordingly, utilities of VGAM1958 include diagnosis, prevention and treatment of diseases and clinical conditions associated with AP3M2. APCL (Accession NM_005883) is another VGAM1958 host target gene. APCL BINDING SITE is HOST TARGET binding site found in the 3' untranslated region of mRNA encoded by APCL, corresponding to a HOST TARGET binding site such as BINDING SITE I, BINDING SITE II or BINDING SITE III. Table 2 illustrates the complementarity of the nucleotide sequences of APCL BINDING SITE, designated SEQ ID:12500, to the nucleotide sequence of VGAM1958 RNA, herein designated VGAM RNA, also designated SEQ ID:4669.

Another function of VGAM1958 is therefore inhibition of APCL (Accession NM_005883). Accordingly, utilities of VGAM1958 include diagnosis, prevention and treatment of diseases and clinical conditions associated with APCL. APH2 (Accession NM_032327) is another VGAM1958 host target gene. APH2 BINDING SITE is HOST TARGET binding site found in the 5' untranslated region of mRNA encoded by APH2, corresponding to a HOST TARGET binding site such as BINDING SITE I, BINDING SITE II or BINDING SITE III. Table 2 illustrates the complementarity of the nucleotide sequences of APH2 BINDING SITE, designated SEQ ID:26135, to the nucleotide sequence of VGAM1958 RNA, herein designated VGAM RNA, also designated SEQ ID:4669.

Another function of VGAM1958 is therefore inhibition of APH2 (Accession NM_032327). Accordingly, utilities of VGAM1958 include diagnosis, prevention and treatment of diseases and clinical conditions associated with APH2. ARHGAP11A (Accession NM_014783) is another VGAM1958 host target gene. ARHGAP11A BINDING SITE is HOST TARGET binding site found in the 5' untranslated region of mRNA encoded by ARHGAP11A, corresponding to a HOST TARGET binding site such as BINDING SITE I, BINDING SITE II or BINDING SITE III. Table 2 illustrates the complementarity of the nucleotide sequences of ARHGAP11A BINDING SITE, designated SEQ ID:16637, to the nucleotide sequence of VGAM1958 RNA, herein designated VGAM RNA, also designated SEQ ID:4669.

Another function of VGAM1958 is therefore inhibition of ARHGAP11A (Accession NM_014783). Accordingly, utilities of VGAM1958 include diagnosis, prevention and treatment of diseases and clinical conditions associated with ARHGAP11A. Rho Guanine Nucleotide Exchange Factor (GEF) 4 (ARHGEF4, Accession NM_032995) is another VGAM1958 host target gene. ARHGEF4 BINDING SITE is HOST TARGET binding site found in the 5' untranslated region of mRNA encoded by ARHGEF4, corresponding to a HOST TARGET binding site such as BINDING SITE I, BINDING SITE II or BINDING SITE III. Table 2 illustrates the complementarity of the nucleotide sequences of ARHGEF4 BINDING SITE, designated SEQ ID:26874, to the nucleotide sequence of VGAM1958 RNA, herein designated VGAM RNA, also designated SEQ ID:4669.

Another function of VGAM1958 is therefore inhibition of Rho Guanine Nucleotide Exchange Factor (GEF) 4 (ARHGEF4, Accession NM_032995). Accordingly, utilities of VGAM1958 include diagnosis, prevention and treatment of diseases and clinical conditions associated with ARHGEF4. ARL8 (Accession XM_167671) is another VGAM1958 host target gene. ARL8 BINDING SITE is HOST TARGET binding site found in the 3' untranslated region of mRNA encoded by ARL8, corresponding to a HOST TARGET binding site such as BINDING SITE I, BINDING SITE II or BINDING SITE III. Table 2 illustrates the complementarity of the nucleotide sequences of ARL8 BINDING SITE, designated SEQ ID:44765, to the nucleotide sequence of VGAM1958 RNA, herein designated VGAM RNA, also designated SEQ ID:4669.

Another function of VGAM1958 is therefore inhibition of ARL8 (Accession XM_167671). Accordingly, utilities of VGAM1958 include diagnosis, prevention and treatment of diseases and clinical conditions associated with ARL8. ATPase, H+ Transporting, Lysosomal V0 Subunit A Isoform 1 (ATP6V0A1, Accession NM_005177) is another VGAM1958 host target gene. ATP6V0A1 BINDING SITE is HOST TARGET binding site found in the 3' untranslated region of mRNA encoded by ATP6V0A1, corresponding to a HOST TARGET binding site such as BINDING SITE I, BINDING SITE II or BINDING SITE III. Table 2 illustrates the complementarity of the nucleotide sequences of ATP6V0A1 BINDING SITE, designated SEQ ID:11676, to the nucleotide sequence of VGAM1958 RNA, herein designated VGAM RNA, also designated SEQ ID:4669.

Another function of VGAM1958 is therefore inhibition of ATPase, H+ Transporting, Lysosomal V0 Subunit A Isoform 1 (ATP6V0A1, Accession NM_005177). Accordingly, utilities of VGAM1958 include diagnosis, prevention and treatment of diseases and clinical conditions associated with ATP6V0A1. ATPase, Class II, Type 9A (ATP9A, Accession XM_030577) is another VGAM1958 host target gene. ATP9A BINDING SITE is HOST TARGET binding site found in the 3' untranslated region of mRNA encoded by ATP9A, corresponding to a HOST TARGET binding site such as BINDING SITE I, BINDING SITE II or BINDING SITE III. Table 2 illustrates the complementarity of the nucleotide sequences of ATP9A BINDING SITE, designated SEQ ID:31077, to the nucleotide sequence of VGAM1958 RNA, herein designated VGAM RNA, also designated SEQ ID:4669.

Another function of VGAM1958 is therefore inhibition of ATPase, Class II, Type 9A (ATP9A, Accession XM_030577). Accordingly, utilities of VGAM1958 include diagnosis, prevention and treatment of diseases and clinical conditions associated with ATP9A. BANK (Accession NM_017935) is another VGAM1958 host target gene. BANK BINDING SITE is HOST TARGET binding site found in the 3' untranslated region of mRNA encoded by BANK, corresponding to a HOST TARGET binding site such as BINDING SITE I, BINDING SITE II or BINDING SITE III. Table 2 illustrates the complementarity of the nucleotide sequences of BANK BINDING SITE, designated SEQ ID:19627, to the nucleotide sequence of VGAM1958 RNA, herein designated VGAM RNA, also designated SEQ ID:4669.

Another function of VGAM1958 is therefore inhibition of BANK (Accession NM_017935). Accordingly, utilities of VGAM1958 include diagnosis, prevention and treatment of diseases and clinical conditions associated with BANK. BCMP1 (Accession NM_031442) is another VGAM1958 host target gene. BCMP1 BINDING SITE is HOST TARGET binding site found in the 3' untranslated region of mRNA encoded by BCMP1, corresponding to a HOST TARGET binding site such as BINDING SITE I, BINDING SITE II or BINDING SITE III. Table 2 illustrates the complementarity of the nucleotide sequences of BCMP1 BINDING SITE, designated SEQ ID:25459, to the nucleotide sequence of VGAM1958 RNA, herein designated VGAM RNA, also designated SEQ ID:4669.

Another function of VGAM1958 is therefore inhibition of BCMP1 (Accession NM_031442). Accordingly, utilities of VGAM1958 include diagnosis, prevention and treatment of diseases and clinical conditions associated with BCMP1. Baculoviral IAP Repeat-containing 1 (BIRC1, Accession NM_004536) is another VGAM1958 host target gene. BIRC1 BINDING SITE is HOST TARGET binding site found in the 5' untranslated region of mRNA encoded by BIRC1, corresponding to a HOST TARGET binding site such as BINDING SITE I, BINDING SITE II or BINDING SITE III. Table 2 illustrates the complementarity of the nucleotide sequences of BIRC1 BINDING SITE, designated SEQ ID:10885, to the nucleotide sequence of VGAM1958 RNA, herein designated VGAM RNA, also designated SEQ ID:4669.

Another function of VGAM1958 is therefore inhibition of Baculoviral IAP Repeat-containing 1 (BIRC1, Accession NM_004536). Accordingly, utilities of VGAM1958 include diagnosis, prevention and treatment of diseases and clinical conditions associated with BIRC1. BM045 (Accession NM_018459) is another VGAM1958 host target gene. BM045 BINDING SITE is HOST TARGET binding site found in the 3' untranslated region of mRNA encoded by BM045, corresponding to a HOST TARGET binding site such as BINDING SITE I, BINDING SITE II or BINDING SITE III. Table 2 illustrates the complementarity of the nucleotide sequences of BM045 BINDING SITE, designated SEQ ID:20531, to the nucleotide sequence of VGAM1958 RNA, herein designated VGAM RNA, also designated SEQ ID:4669.

Another function of VGAM1958 is therefore inhibition of BM045 (Accession NM_018459). Accordingly, utilities of VGAM1958 include diagnosis, prevention and treatment of diseases and clinical conditions associated with BM045. BCL2/adenovirus E1B 19 kDa Interacting Protein 2 (BNIP2, Accession XM_039703) is another VGAM1958 host target gene. BNIP2 BINDING SITE is HOST TARGET binding site found in the 3' untranslated region of mRNA encoded by BNIP2, corresponding to a HOST TARGET binding site such as BINDING SITE I, BINDING SITE II or BINDING SITE III. Table 2 illustrates the complementarity of the nucleotide sequences of BNIP2 BINDING SITE, designated SEQ ID:33162, to the nucleotide sequence of VGAM1958 RNA, herein designated VGAM RNA, also designated SEQ ID:4669.

Another function of VGAM1958 is therefore inhibition of BCL2/adenovirus E1B 19 kDa Interacting Protein 2 (BNIP2, Accession XM_039703). Accordingly, utilities of VGAM1958 include diagnosis, prevention and treatment of diseases and clinical conditions associated with BNIP2. Blepharophimosis, Epicanthus Inversus and Ptosis, Candidate 1 (BPESC1, Accession NM_021812) is another VGAM1958 host target gene. BPESC1 BINDING SITE is HOST TARGET binding site found in the 3' untranslated region of mRNA encoded by BPESC1, corresponding to a HOST TARGET binding site such as BINDING SITE I, BINDING SITE II or BINDING SITE III. Table 2 illustrates the complementarity of the nucleotide sequences of BPESC1 BINDING SITE, designated SEQ ID:22374, to the nucleotide sequence of VGAM1958 RNA, herein designated VGAM RNA, also designated SEQ ID:4669.

Another function of VGAM1958 is therefore inhibition of Blepharophimosis, Epicanthus Inversus and Ptosis, Candidate 1 (BPESC1, Accession NM_021812). Accordingly, utilities of VGAM1958 include diagnosis, prevention and treatment of diseases and clinical conditions associated with BPESC1. Chromosome 11 Open Reading Frame 11 (C11orf11, Accession XM_167769) is another VGAM1958 host target gene. C11orf11 BINDING SITE is HOST TARGET binding site found in the 5" untranslated region of mRNA encoded by C11orf11, corresponding to a HOST TARGET binding site such as BINDING SITE I, BINDING SITE II or BINDING SITE III. Table 2 illustrates the complementarity of the nucleotide sequences of C11orf11 BINDING SITE, designated SEQ ID:44781, to the nucleotide sequence of VGAM1958 RNA, herein designated VGAM RNA, also designated SEQ ID:4669.

Another function of VGAM1958 is therefore inhibition of Chromosome 11 Open Reading Frame 11 (C11orf11, Accession XM_167769). Accordingly, utilities of VGAM1958 include diagnosis, prevention and treatment of diseases and clinical conditions associated with C11orf11. C16orf5 (Accession NM_013399) is another VGAM1958 host target gene. C16orf5 BINDING SITE is HOST TARGET binding site found in the 3' untranslated region of mRNA encoded by C16orf5, corresponding to a HOST TARGET binding site such as BINDING SITE I, BINDING SITE II or BINDING SITE III. Table 2 illustrates the complementarity of the nucleotide sequences of C16orf5 BINDING SITE, designated SEQ ID:15057, to the nucleotide sequence of VGAM1958 RNA, herein designated VGAM RNA, also designated SEQ ID:4669.

Another function of VGAM1958 is therefore inhibition of C16orf5 (Accession NM_013399). Accordingly, utilities of VGAM1958 include diagnosis, prevention and treatment of diseases and clinical conditions associated with C16orf5. Chromosome 1 Open Reading Frame 24 (C1orf24, Accession NM_052966) is another VGAM1958 host target gene. C1orf24 BINDING SITE is HOST TARGET binding site found in the 3' untranslated region of mRNA encoded by C1orf24, corresponding to a HOST TARGET binding site such as BINDING SITE I, BINDING SITE II or BINDING SITE III. Table 2 illustrates the complementarity of the nucleotide sequences of C1orf24 BINDING SITE, designated SEQ ID:27529, to the nucleotide sequence of VGAM1958 RNA, herein designated VGAM RNA, also designated SEQ ID:4669.

Another function of VGAM1958 is therefore inhibition of Chromosome 1 Open Reading Frame 24 (C1orf24, Accession NM_052966). Accordingly, utilities of VGAM1958 include diagnosis, prevention and treatment of diseases and clinical conditions associated with C1orf24. Chromosome 20 Open Reading Frame 103 (C20orf103, Accession NM_012261) is another VGAM1958 host target gene. C20orf103 BINDING SITE is HOST TARGET binding site found in the 3" untranslated region of mRNA encoded by C20orf103, corresponding to a HOST TARGET binding site such as BINDING SITE I, BINDING SITE II or BINDING SITE III. Table 2 illustrates the complementarity of the nucleotide sequences of C20orf103 BINDING SITE, designated SEQ ID:14571, to the nucleotide sequence of VGAM1958 RNA, herein designated VGAM RNA, also designated SEQ ID:4669.

Another function of VGAM1958 is therefore inhibition of Chromosome 20 Open Reading Frame 103 (C20orf103, Accession NM_012261). Accordingly, utilities of VGAM1958 include diagnosis, prevention and treatment of diseases and clinical conditions associated with C20orf103. Chromosome 20 Open Reading Frame 160 (C20orf160, Accession NM_080625) is another VGAM1958 host target gene. C20orf160 BINDING SITE is HOST TARGET binding site found in the 3" untranslated region of mRNA encoded by C20orf160, corresponding to a HOST TARGET binding site such as BINDING SITE I, BINDING SITE II or BINDING SITE III. Table 2 illustrates the complementarity of the nucleotide sequences of C20orf160 BINDING SITE, designated SEQ ID:27932, to the nucleotide sequence of VGAM1958 RNA, herein designated VGAM RNA, also designated SEQ ID:4669.

Another function of VGAM1958 is therefore inhibition of Chromosome 20 Open Reading Frame 160 (C20orf160, Accession NM_080625). Accordingly, utilities of VGAM1958 include diagnosis, prevention and treatment of diseases and clinical conditions associated with C20orf160. Chromosome 20 Open Reading Frame 162 (C20orf162, Accession NM_080603) is another VGAM1958 host target gene. C20orf162 BINDING SITE1 and C20orf162 BINDING SITE2 are HOST TARGET binding sites found in untranslated regions of mRNA encoded by C20orf162, corresponding to HOST TARGET binding sites such as BINDING SITE I, BINDING SITE II or BINDING SITE III. Table 2 illustrates the complementarity of the nucleotide sequences of C20orf162 BINDING SITE1 and C20orf162 BINDING SITE2, designated SEQ ID:27912 and SEQ ID:27917 respectively, to the nucleotide sequence of VGAM1958 RNA, herein designated VGAM RNA, also designated SEQ ID:4669.

Another function of VGAM1958 is therefore inhibition of Chromosome 20 Open Reading Frame 162 (C20orf162, Accession NM_080603). Accordingly, utilities of VGAM1958 include diagnosis, prevention and treatment of diseases and clinical conditions associated with C20orf162. Chromosome 20 Open Reading Frame 54 (C20orf54, Accession NM_033409) is another VGAM1958 host target gene. C20orf54 BINDING SITE is HOST TARGET binding site found in the 5' untranslated region of mRNA encoded by C20orf54, corresponding to a HOST TARGET binding site such as BINDING SITE I, BINDING SITE II or BINDING SITE III. Table 2 illustrates the complementarity of the nucleotide sequences of C20orf54 BINDING SITE, designated SEQ ID:27227, to the nucleotide sequence of VGAM1958 RNA, herein designated VGAM RNA, also designated SEQ ID:4669.

Another function of VGAM1958 is therefore inhibition of Chromosome 20 Open Reading Frame 54 (C20orf54, Accession NM_033409). Accordingly, utilities of VGAM1958 include diagnosis, prevention and treatment of diseases and clinical conditions associated with C20orf54. Chromosome 21 Open Reading Frame 18 (C21orf18, Accession NM_017438) is another VGAM1958 host target gene. C21orf18 BINDING SITE is HOST TARGET binding site found in the 3' untranslated region of mRNA encoded by C21orf18, corresponding to a HOST TARGET binding site such as BINDING SITE I, BINDING SITE II or BINDING SITE III. Table 2 illustrates the complementarity of the nucleotide sequences of C21orf18 BINDING SITE, designated SEQ ID:18897, to the nucleotide sequence of VGAM1958 RNA, herein designated VGAM RNA, also designated SEQ ID:4669.

Another function of VGAM1958 is therefore inhibition of Chromosome 21 Open Reading Frame 18 (C21orf18, Accession NM_017438). Accordingly, utilities of VGAM1958 include diagnosis, prevention and treatment of diseases and clinical conditions associated with C21orf18. C3IP1 (Accession NM_021633) is another VGAM1958 host target gene. C3IP1 BINDING SITE is HOST TARGET binding site found in the 5' untranslated region of mRNA encoded by C3IP1, corresponding to a HOST TARGET binding site such as BINDING SITE I, BINDING SITE II or BINDING SITE III. Table 2 illustrates the complementarity of the nucleotide sequences of C3IP1 BINDING SITE, designated SEQ ID:22274, to the nucleotide sequence of VGAM1958 RNA, herein designated VGAM RNA, also designated SEQ ID:4669.

Another function of VGAM1958 is therefore inhibition of C3IP1 (Accession NM_021633). Accordingly, utilities of VGAM1958 include diagnosis, prevention and treatment of diseases and clinical conditions associated with C3IP1. Chromosome 5 Open Reading Frame 4 (C5orf4, Accession NM_032385) is another VGAM1958 host target gene. C5orf4 BINDING SITE1 and C5orf4 BINDING SITE2 are HOST TARGET binding sites found in untranslated regions of mRNA encoded by C5orf4, corresponding to HOST TARGET binding sites such as BINDING SITE I, BINDING SITE II or BINDING SITE III. Table 2 illustrates the complementarity of the nucleotide sequences of C5orf4 BINDING SITE1 and C5orf4 BINDING SITE2, designated SEQ ID:26178 and SEQ ID:18473 respectively, to the nucleotide sequence of VGAM1958 RNA, herein designated VGAM RNA, also designated SEQ ID:4669.

Another function of VGAM1958 is therefore inhibition of Chromosome 5 Open Reading Frame 4 (C5orf4, Accession NM_032385). Accordingly, utilities of VGAM1958 include diagnosis, prevention and treatment of diseases and clinical conditions associated with C5orf4. Chromosome 7 Open Reading Frame 13 (C7orf13, Accession NM_032625) is another VGAM1958 host target gene. C7orf13 BINDING SITE1 and C7orf13 BINDING SITE2 are HOST TARGET binding sites found in untranslated regions of mRNA encoded by C7orf13, corresponding to HOST TARGET binding sites such as BINDING SITE I, BINDING SITE II or BINDING SITE III. Table 2 illustrates the complementarity of the nucleotide sequences of C7orf13 BINDING SITE1 and C7orf13 BINDING SITE2, designated SEQ ID:26342 and SEQ ID:39656 respectively, to the nucleotide sequence of VGAM1958 RNA, herein designated VGAM RNA, also designated SEQ ID:4669.

Another function of VGAM1958 is therefore inhibition of Chromosome 7 Open Reading Frame 13 (C7orf13, Accession NM_032625). Accordingly, utilities of VGAM1958 include diagnosis, prevention and treatment of diseases and clinical conditions associated with C7orf13. Chromosome 9 Open Reading Frame 12 (C9orf12, Accession NM_022755) is another VGAM1958 host target gene. C9orf12 BINDING SITE is HOST TARGET binding site found in the 5' untranslated region of mRNA encoded by C9orf12, corresponding to a HOST TARGET binding site such as BINDING SITE I, BINDING SITE II or BINDING SITE III. Table 2 illustrates the complementarity of the nucleotide sequences of C9orf12 BINDING SITE, designated SEQ ID:22991, to the nucleotide sequence of VGAM1958 RNA, herein designated VGAM RNA, also designated SEQ ID:4669.

Another function of VGAM1958 is therefore inhibition of Chromosome 9 Open Reading Frame 12 (C9orf12, Accession NM_022755). Accordingly, utilities of VGAM1958 include diagnosis, prevention and treatment of diseases and clinical conditions associated with C9orf12. Chromosome 9 Open Reading Frame 7 (C9orf7, Accession NM_017586) is another VGAM1958 host target gene. C9orf7 BINDING SITE is HOST TARGET binding site found in the 3' untranslated region of mRNA encoded by C9orf7, corresponding to a HOST TARGET binding site such as BINDING SITE I, BINDING SITE II or BINDING SITE III. Table 2 illustrates the complementarity of the nucleotide sequences of C9orf7 BINDING SITE, designated SEQ ID:19033, to the nucleotide sequence of VGAM1958 RNA, herein designated VGAM RNA, also designated SEQ ID:4669.

Another function of VGAM1958 is therefore inhibition of Chromosome 9 Open Reading Frame 7 (C9orf7, Accession NM_017586). Accordingly, utilities of VGAM1958 include diagnosis, prevention and treatment of diseases and clinical conditions associated with C9orf7. Chromosome 9 Open Reading Frame 9 (C9orf9, Accession NM_018956) is another VGAM1958 host target gene. C9orf9 BINDING SITE is HOST TARGET binding site found in the 3' untranslated region of mRNA encoded by C9orf9, corresponding to a HOST TARGET binding site such as BINDING SITE I, BINDING SITE II or BINDING SITE III. Table 2 illustrates the complementarity of the nucleotide sequences of C9orf9 BINDING SITE, designated SEQ ID:21024, to the nucleotide sequence of VGAM1958 RNA, herein designated VGAM RNA, also designated SEQ ID:4669.

Another function of VGAM1958 is therefore inhibition of Chromosome 9 Open Reading Frame 9 (C9orf9, Accession NM_018956). Accordingly, utilities of VGAM1958 include diagnosis, prevention and treatment of diseases and clinical conditions associated with C9orf9. Calcium Channel, Voltage-dependent, Gamma Subunit 4 (CACNG4, Accession NM_014405) is another VGAM1958 host target gene. CACNG4 BINDING SITE is HOST TARGET binding site found in the 3' untranslated region of mRNA encoded by CACNG4, corresponding to a HOST TARGET binding site such as BINDING SITE I, BINDING SITE II or BINDING SITE III. Table 2 illustrates the complementarity of the nucleotide sequences of CACNG4 BINDING SITE, designated SEQ ID:15744, to the nucleotide sequence of VGAM1958 RNA, herein designated VGAM RNA, also designated SEQ ID:4669.

Another function of VGAM1958 is therefore inhibition of Calcium Channel, Voltage-dependent, Gamma Subunit 4 (CACNG4, Accession NM_014405). Accordingly, utilities of VGAM1958 include diagnosis, prevention and treatment of diseases and clinical conditions associated with CACNG4. Calneuron 1 (CALN1, Accession NM_031468) is another VGAM1958 host target gene. CALN1 BINDING SITE is HOST TARGET binding site found in the 3' untranslated region of mRNA encoded by CALN1, corresponding to a HOST TARGET binding site such as BINDING SITE I, BINDING SITE II or BINDING SITE III. Table 2 illustrates the complementarity of the nucleotide sequences of CALN1 BINDING SITE, designated SEQ ID:25521, to the nucleotide sequence of VGAM1958 RNA, herein designated VGAM RNA, also designated SEQ ID:4669.

Another function of VGAM1958 is therefore inhibition of Calneuron 1 (CALN1, Accession NM_031468). Accordingly, utilities of VGAM1958 include diagnosis, prevention and treatment of diseases and clinical conditions associated with CALN1. Calcium/calmodulin-dependent Protein Kinase Kinase 2, Beta (CAMKK2, Accession NM_006549) is another VGAM1958 host target gene. CAMKK2 BINDING SITE is HOST TARGET binding site found in the 3' untranslated region of mRNA encoded by CAMKK2, corresponding to a HOST TARGET binding site such as BINDING SITE I, BINDING SITE II or BINDING SITE III. Table 2 illustrates the complementarity of the nucleotide sequences of CAMKK2 BINDING SITE, designated SEQ ID:13312, to the nucleotide sequence of VGAM1958 RNA, herein designated VGAM RNA, also designated SEQ ID:4669.

Another function of VGAM1958 is therefore inhibition of Calcium/calmodulin-dependent Protein Kinase Kinase 2, Beta (CAMKK2, Accession NM_006549). Accordingly, utilities of VGAM1958 include diagnosis, prevention and treatment of diseases and clinical conditions associated with CAMKK2. Chromobox Homolog 1 (HP1 beta homolog Drosophila ) (CBX1, Accession NM_006807) is another VGAM1958 host target gene. CBX1 BINDING SITE is HOST TARGET binding site found in the 5' untranslated region of mRNA encoded by CBX1, corresponding to a HOST TARGET binding site such as BINDING SITE I, BINDING SITE II or BINDING SITE III. Table 2 illustrates the complementarity of the nucleotide sequences of CBX1 BINDING SITE, designated SEQ ID:13680, to the nucleotide sequence of VGAM1958 RNA, herein designated VGAM RNA, also designated SEQ ID:4669.

Another function of VGAM1958 is therefore inhibition of Chromobox Homolog 1 (HP1 beta homolog Drosophila ) (CBX1, Accession NM_006807). Accordingly, utilities of VGAM1958 include diagnosis, prevention and treatment of diseases and clinical conditions associated with CBX1. Chromobox Homolog 6 (CBX6, Accession NM_014292) is another VGAM1958 host target gene. CBX6 BINDING SITE is HOST TARGET binding site found in the 3' untranslated region of mRNA encoded by CBX6, corresponding to a HOST TARGET binding site such as BINDING SITE I, BINDING SITE II or BINDING SITE III. Table 2 illustrates the complementarity of the nucleotide sequences of CBX6 BINDING SITE, designated SEQ ID:15575, to the nucleotide sequence of VGAM1958 RNA, herein designated VGAM RNA, also designated SEQ ID:4669.

Another function of VGAM1958 is therefore inhibition of Chromobox Homolog 6 (CBX6, Accession NM_014292).

Accordingly, utilities of VGAM1958 include diagnosis, prevention and treatment of diseases and clinical conditions associated with CBX6. CD109 (Accession NM_133493) is another VGAM1958 host target gene. CD109 BINDING SITE is HOST TARGET binding site found in the 3' untranslated region of mRNA encoded by CD109, corresponding to a HOST TARGET binding site such as BINDING SITE I, BINDING SITE II or BINDING SITE III. Table 2 illustrates the complementarity of the nucleotide sequences of CD109 BINDING SITE, designated SEQ ID:28569, to the nucleotide sequence of VGAM1958 RNA, herein designated VGAM RNA, also designated SEQ ID:4669.

Another function of VGAM1958 is therefore inhibition of CD109 (Accession NM_133493). Accordingly, utilities of VGAM1958 include diagnosis, prevention and treatment of diseases and clinical conditions associated with CD109. Cadherin-like 24 (CDH24, Accession XM_170748) is another VGAM1958 host target gene. CDH24 BINDING SITE is HOST TARGET binding site found in the 3' untranslated region of mRNA encoded by CDH24, corresponding to a HOST TARGET binding site such as BINDING SITE I, BINDING SITE II or BINDING SITE III. Table 2 illustrates the complementarity of the nucleotide sequences of CDH24 BINDING SITE, designated SEQ ID:45506, to the nucleotide sequence of VGAM1958 RNA, herein designated VGAM RNA, also designated SEQ ID:4669.

Another function of VGAM1958 is therefore inhibition of Cadherin-like 24 (CDH24, Accession XM_170748). Accordingly, utilities of VGAM1958 include diagnosis, prevention and treatment of diseases and clinical conditions associated with CDH24. Cyclin-dependent Kinase-like 2 (CDC2-related kinase) (CDKL2, Accession NM_003948) is another VGAM1958 host target gene. CDKL2 BINDING SITE is HOST TARGET binding site found in the 5' untranslated region of mRNA encoded by CDKL2, corresponding to a HOST TARGET binding site such as BINDING SITE I, BINDING SITE II or BINDING SITE III. Table 2 illustrates the complementarity of the nucleotide sequences of CDKL2 BINDING SITE, designated SEQ ID:10071, to the nucleotide sequence of VGAM1958 RNA, herein designated VGAM RNA, also designated SEQ ID:4669.

Another function of VGAM1958 is therefore inhibition of Cyclin-dependent Kinase-like 2 (CDC2-related kinase) (CDKL2, Accession NM_003948). Accordingly, utilities of VGAM1958 include diagnosis, prevention and treatment of diseases and clinical conditions associated with CDKL2. Centaurin, Alpha 1 (CENTA1, Accession NM_006869) is another VGAM1958 host target gene. CENTA1 BINDING SITE is HOST TARGET binding site found in the 3' untranslated region of mRNA encoded by CENTA1, corresponding to a HOST TARGET binding site such as BINDING SITE I, BINDING SITE II or BINDING SITE III. Table 2 illustrates the complementarity of the nucleotide sequences of CENTA1 BINDING SITE, designated SEQ ID:13740, to the nucleotide sequence of VGAM1958 RNA, herein designated VGAM RNA, also designated SEQ ID:4669.

Another function of VGAM1958 is therefore inhibition of Centaurin, Alpha 1 (CENTA1, Accession NM_006869). Accordingly, utilities of VGAM1958 include diagnosis, prevention and treatment of diseases and clinical conditions associated with CENTA1. Centaurin, Gamma 1 (CENTG1, Accession NM_014770) is another VGAM1958 host target gene. CENTG1 BINDING SITE is HOST TARGET binding site found in the 3' untranslated region of mRNA encoded by CENTG1, corresponding to a HOST TARGET binding site such as BINDING SITE I, BINDING SITE II or BINDING SITE III. Table 2 illustrates the complementarity of the nucleotide sequences of CENTG1 BINDING SITE, designated SEQ ID:16567, to the nucleotide sequence of VGAM1958 RNA, herein designated VGAM RNA, also designated SEQ ID:4669.

Another function of VGAM1958 is therefore inhibition of Centaurin, Gamma 1 (CENTG1, Accession NM_014770). Accordingly, utilities of VGAM1958 include diagnosis, prevention and treatment of diseases and clinical conditions associated with CENTG1. CG012 (Accession XM_096710) is another VGAM1958 host target gene. CG012 BINDING SITE is HOST TARGET binding site found in the 5' untranslated region of mRNA encoded by CG012, corresponding to a HOST TARGET binding site such as BINDING SITE I, BINDING SITE II or BINDING SITE III. Table 2 illustrates the complementarity of the nucleotide sequences of CG012 BINDING SITE, designated SEQ ID:40485, to the nucleotide sequence of VGAM1958 RNA, herein designated VGAM RNA, also designated SEQ ID:4669.

Another function of VGAM1958 is therefore inhibition of CG012 (Accession XM_096710). Accordingly, utilities of VGAM1958 include diagnosis, prevention and treatment of diseases and clinical conditions associated with CG012. Chloride Intracellular Channel 4 (CLIC4, Accession NM_013943) is another VGAM1958 host target gene. CLIC4 BINDING SITE is HOST TARGET binding site found in the 3' untranslated region of mRNA encoded by CLIC4, corresponding to a HOST TARGET binding site such as BINDING SITE I, BINDING SITE II or BINDING SITE III. Table 2 illustrates the complementarity of the nucleotide sequences of CLIC4 BINDING SITE, designated SEQ ID:15132, to the nucleotide sequence of VGAM1958 RNA, herein designated VGAM RNA, also designated SEQ ID:4669.

Another function of VGAM1958 is therefore inhibition of Chloride Intracellular Channel 4 (CLIC4, Accession NM_013943). Accordingly, utilities of VGAM1958 include diagnosis, prevention and treatment of diseases and clinical conditions associated with CLIC4. Cyclin M4 (CNNM4, Accession NM_020184) is another VGAM1958 host target gene. CNNM4 BINDING SITE is HOST TARGET binding site found in the 3' untranslated region of mRNA encoded by CNNM4, corresponding to a HOST TARGET binding site such as BINDING SITE I, BINDING SITE II or BINDING SITE III. Table 2 illustrates the complementarity of the nucleotide sequences of CNNM4 BINDING SITE, designated SEQ ID:21427, to the nucleotide sequence of VGAM1958 RNA, herein designated VGAM RNA, also designated SEQ ID:4669.

Another function of VGAM1958 is therefore inhibition of Cyclin M4 (CNNM4, Accession NM_020184). Accordingly, utilities of VGAM1958 include diagnosis, prevention and treatment of diseases and clinical conditions associated with CNNM4. COP9 (Accession NM_006710) is another VGAM1958 host target gene. COP9 BINDING SITE is HOST TARGET binding site found in the 3' untranslated region of mRNA encoded by COP9, corresponding to a HOST TARGET binding site such as BINDING SITE I, BINDING SITE II or BINDING SITE III. Table 2 illustrates the complementarity of the nucleotide sequences of COP9 BINDING SITE, designated SEQ ID:13535, to the nucleotide sequence of VGAM1958 RNA, herein designated VGAM RNA, also designated SEQ ID:4669.

Another function of VGAM1958 is therefore inhibition of COP9 (Accession NM_006710). Accordingly, utilities of VGAM1958 include diagnosis, prevention and treatment of diseases and clinical conditions associated with COP9. CPR2 (Accession NM_030900) is another VGAM1958 host target gene. CPR2 BINDING SITE is HOST TARGET binding site found in the 3' untranslated region of mRNA encoded by CPR2, corresponding to a HOST TARGET binding site such as BINDING SITE I, BINDING SITE II or BINDING SITE III. Table 2 illustrates the complementarity of the nucleotide sequences of CPR2 BINDING SITE, designated SEQ ID:25172, to the nucleotide sequence of VGAM1958 RNA, herein designated VGAM RNA, also designated SEQ ID:4669.

Another function of VGAM1958 is therefore inhibition of CPR2 (Accession NM_030900). Accordingly, utilities of VGAM1958 include diagnosis, prevention and treatment of diseases and clinical conditions associated with CPR2. Cysteine-rich with EGF-like Domains 1 (CRELD1, Accession NM_015513) is another VGAM1958 host target gene. CRELD1 BINDING SITE is HOST TARGET binding site found in the 5' untranslated region of mRNA encoded by CRELD1, corresponding to a HOST TARGET binding site such as BINDING SITE I, BINDING SITE II or BINDING SITE III. Table 2 illustrates the complementarity of the nucleotide sequences of CRELD1 BINDING SITE, designated SEQ ID:17775, to the nucleotide sequence of VGAM1958 RNA, herein designated VGAM RNA, also designated SEQ ID:4669.

Another function of VGAM1958 is therefore inhibition of Cysteine-rich with EGF-like Domains 1 (CRELD1, Accession NM_015513). Accordingly, utilities of VGAM1958 include diagnosis, prevention and treatment of diseases and clinical conditions associated with CRELD1. CUB and Sushi Multiple Domains 1 (CSMD1, Accession XM_054838) is another VGAM1958 host target gene. CSMD1 BINDING SITE1 and CSMD1 BINDING SITE2 are HOST TARGET binding sites found in untranslated regions of mRNA encoded by CSMD1, corresponding to HOST TARGET binding sites such as BINDING SITE I, BINDING SITE II or BINDING SITE III. Table 2 illustrates the complementarity of the nucleotide sequences of CSMD1 BINDING SITE1 and CSMD1 BINDING SITE2, designated SEQ ID:36193 and SEQ ID:27070 respectively, to the nucleotide sequence of VGAM1958 RNA, herein designated VGAM RNA, also designated SEQ ID:4669.

Another function of VGAM1958 is therefore inhibition of CUB and Sushi Multiple Domains 1 (CSMD1, Accession XM_054838). Accordingly, utilities of VGAM1958 include diagnosis, prevention and treatment of diseases and clinical conditions associated with CSMD1. DDM36 (Accession NM_020962) is another VGAM1958 host target gene. DDM36 BINDING SITE is HOST TARGET binding site found in the 3' untranslated region of mRNA encoded by DDM36, corresponding to a HOST TARGET binding site such as BINDING SITE I, BINDING SITE II or BINDING SITE III. Table 2 illustrates the complementarity of the nucleotide sequences of DDM36 BINDING SITE, designated SEQ ID:21955, to the nucleotide sequence of VGAM1958 RNA, herein designated VGAM RNA, also designated SEQ ID:4669.

Another function of VGAM1958 is therefore inhibition of DDM36 (Accession NM_020962). Accordingly, utilities of VGAM1958 include diagnosis, prevention and treatment of diseases and clinical conditions associated with DDM36. DEAD/H (Asp-Glu-Ala-Asp/His) Box Polypeptide 12 (CHL1-like helicase homolog, S. cerevisiae) (DDX12, Accession XM_006936) is another VGAM1958 host target gene. DDX12 BINDING SITE is HOST TARGET binding site found in the 3' untranslated region of mRNA encoded by DDX12, corresponding to a HOST TARGET binding site such as BINDING SITE I, BINDING SITE II or BINDING SITE III. Table 2 illustrates the complementarity of the nucleotide sequences of DDX12 BINDING SITE, designated SEQ ID:30024, to the nucleotide sequence of VGAM1958 RNA, herein designated VGAM RNA, also designated SEQ ID:4669.

Another function of VGAM1958 is therefore inhibition of DEAD/H (Asp-Glu-Ala-Asp/His) Box Polypeptide 12 (CHL1-like helicase homolog, S. cerevisiae) (DDX12, Accession XM_006936). Accordingly, utilities of VGAM1958 include diagnosis, prevention and treatment of diseases and clinical conditions associated with DDX12. DEAD/H (Asp-Glu-Ala-Asp/His) Box Polypeptide 34 (DDX34, Accession NM_014681) is another VGAM1958 host target gene. DDX34 BINDING SITE is HOST TARGET binding site found in the 3' untranslated region of mRNA encoded by DDX34, corresponding to a HOST TARGET binding site such as BINDING SITE I, BINDING SITE II or BINDING SITE III. Table 2 illustrates the complementarity of the nucleotide sequences of DDX34 BINDING SITE, designated SEQ ID:16164, to the nucleotide sequence of VGAM1958 RNA, herein designated VGAM RNA, also designated SEQ ID:4669.

Another function of VGAM1958 is therefore inhibition of DEAD/H (Asp-Glu-Ala-Asp/His) Box Polypeptide 34 (DDX34, Accession NM_014681). Accordingly, utilities of VGAM1958 include diagnosis, prevention and treatment of diseases and clinical conditions associated with DDX34. Diacylglycerol Kinase, Delta 130 kDa (DGKD, Accession XM_002384) is another VGAM1958 host target gene. DGKD BINDING SITE1 and DGKD BINDING SITE2 are HOST TARGET binding sites found in untranslated regions of mRNA encoded by DGKD, corresponding to HOST TARGET binding sites such as BINDING SITE I, BINDING SITE II or BINDING SITE III. Table 2 illustrates the complementarity of the nucleotide sequences of DGKD BINDING SITE1 and DGKD BINDING SITE2, designated SEQ ID:29879 and SEQ ID:29884 respectively, to the nucleotide sequence of VGAM1958 RNA, herein designated VGAM RNA, also designated SEQ ID:4669.

Another function of VGAM1958 is therefore inhibition of Diacylglycerol Kinase, Delta 130 kDa (DGKD, Accession XM_002384). Accordingly, utilities of VGAM1958 include diagnosis, prevention and treatment of diseases and clinical conditions associated with DGKD. Deiodinase, Iodothyronine, Type II (DIO2, Accession NM_000793) is another VGAM1958 host target gene. DIO2 BINDING SITE1 and DIO2 BINDING SITE2 are HOST TARGET binding sites found in untranslated regions of mRNA encoded by DIO2, corresponding to HOST TARGET binding sites such as BINDING SITE I, BINDING SITE II or BINDING SITE III. Table 2 illustrates the complementarity of the nucleotide sequences of DIO2 BINDING SITE1 and DIO2 BINDING SITE2, designated SEQ ID:6452 and SEQ ID:17300 respectively, to the nucleotide sequence of VGAM1958 RNA, herein designated VGAM RNA, also designated SEQ ID:4669.

Another function of VGAM1958 is therefore inhibition of Deiodinase, Iodothyronine, Type II (DIO2, Accession NM_000793). Accordingly, utilities of VGAM1958 include diagnosis, prevention and treatment of diseases and clinical conditions associated with DIO2. DKFZp434C0328 (Accession NM_017577) is another VGAM1958 host target gene. DKFZp434C0328 BINDING SITE is HOST TARGET binding site found in the 3' untranslated region of mRNA encoded by DKFZp434C0328, corresponding to a HOST TARGET binding site such as BINDING SITE I, BINDING SITE II or BINDING SITE III. Table 2 illustrates the complementarity of the nucleotide sequences of DKFZp434C0328 BINDING SITE, designated SEQ ID:19012, to the nucleotide sequence of VGAM1958 RNA, herein designated VGAM RNA, also designated SEQ ID:4669.

Another function of VGAM1958 is therefore inhibition of DKFZp434C0328 (Accession NM_017577). Accordingly, utilities of VGAM1958 include diagnosis, prevention and treatment of diseases and clinical conditions associated with DKFZp434C0328. DKFZP434C0826 (Accession XM_097248) is another VGAM1958 host target gene. DKFZP434C0826 BINDING SITE is HOST TARGET binding site found in the 5' untranslated region of mRNA encoded by DKFZP434C0826, corresponding to a HOST TARGET binding site such as BINDING SITE I, BINDING SITE II or BINDING SITE III. Table 2 illustrates the complementarity of the nucleotide sequences of DKFZP434C0826 BINDING SITE, designated SEQ ID:40846, to the nucleotide sequence of VGAM1958 RNA, herein designated VGAM RNA, also designated SEQ ID:4669.

Another function of VGAM1958 is therefore inhibition of DKFZP434C0826 (Accession XM_097248). Accordingly, utilities of VGAM1958 include diagnosis, prevention and treatment of diseases and clinical conditions associated with DKFZP434C0826. DKFZP434C1715 (Accession XM_098421) is another VGAM1958 host target gene. DKFZP434C1715 BINDING SITE is HOST TARGET binding site found in the 3' untranslated region of mRNA encoded by DKFZP434C1715, corresponding to a HOST TARGET binding site such as BINDING SITE I, BINDING SITE II or BINDING SITE III. Table 2 illustrates the complementarity of the nucleotide sequences of DKFZP434C1715 BINDING SITE, designated SEQ ID:41674, to the nucleotide sequence of VGAM1958 RNA, herein designated VGAM RNA, also designated SEQ ID:4669.

Another function of VGAM1958 is therefore inhibition of DKFZP434C1715 (Accession XM_098421). Accordingly, utilities of VGAM1958 include diagnosis, prevention and treatment of diseases and clinical conditions associated with DKFZP434C1715. DKFZP434E2135 (Accession NM_030804) is another VGAM1958 host target gene. DKFZP434E2135 BINDING SITE is HOST TARGET binding site found in the 3' untranslated region of mRNA encoded by DKFZP434E2135, corresponding to a HOST TARGET binding site such as BINDING SITE I, BINDING SITE II or BINDING SITE III. Table 2 illustrates the complementarity of the nucleotide sequences of DKFZP434E2135 BINDING SITE, designated SEQ ID:25119, to the nucleotide sequence of VGAM1958 RNA, herein designated VGAM RNA, also designated SEQ ID:4669.

Another function of VGAM1958 is therefore inhibition of DKFZP434E2135 (Accession NM_030804). Accordingly, utilities of VGAM1958 include diagnosis, prevention and treatment of diseases and clinical conditions associated with DKFZP434E2135. DKFZp434F1719 (Accession NM_032248) is another VGAM1958 host target gene. DKFZp434F1719 BINDING SITE is HOST TARGET binding site found in the 3' untranslated region of mRNA encoded by DKFZp434F1719, corresponding to a HOST TARGET binding site such as BINDING SITE I, BINDING SITE II or BINDING SITE III. Table 2 illustrates the complementarity of the nucleotide sequences of DKFZp434F1719 BINDING SITE, designated SEQ ID:25986, to the nucleotide sequence of VGAM1958 RNA, herein designated VGAM RNA, also designated SEQ ID:4669.

Another function of VGAM1958 is therefore inhibition of DKFZp434F1719 (Accession NM_032248). Accordingly, utilities of VGAM1958 include diagnosis, prevention and treatment of diseases and clinical conditions associated with DKFZp434F1719. DKFZP434H204 (Accession XM_039153) is another VGAM1958 host target gene. DKFZP434H204 BINDING SITE is HOST TARGET binding site found in the 5' untranslated region of mRNA encoded by DKFZP434H204, corresponding to a HOST TARGET binding site such as BINDING SITE I, BINDING SITE II or BINDING SITE III. Table 2 illustrates the complementarity of the nucleotide sequences of DKFZP434H204 BINDING SITE, designated SEQ ID:33015, to the nucleotide sequence of VGAM1958 RNA, herein designated VGAM RNA, also designated SEQ ID:4669.

Another function of VGAM1958 is therefore inhibition of DKFZP434H204 (Accession XM_039153). Accordingly, utilities of VGAM1958 include diagnosis, prevention and treatment of diseases and clinical conditions associated with DKFZP434H204. DKFZP434I216 (Accession XM_085381) is another VGAM1958 host target gene. DKFZP434I216 BINDING SITE1 through DKFZP434I216 BINDING SITE3 are HOST TARGET binding sites found in untranslated regions of mRNA encoded by DKFZP434I216, corresponding to HOST TARGET binding sites such as BINDING SITE I, BINDING SITE II or BINDING SITE III. Table 2 illustrates the complementarity of the nucleotide sequences of DKFZP434I216 BINDING SITE1 through DKFZP434I216 BINDING SITE3, designated SEQ ID:38099, SEQ ID:38101 and SEQ ID:38102 respectively, to the nucleotide sequence of VGAM1958 RNA, herein designated VGAM RNA, also designated SEQ ID:4669.

Another function of VGAM1958 is therefore inhibition of DKFZP434I216 (Accession XM_085381). Accordingly, utilities of VGAM1958 include diagnosis, prevention and treatment of diseases and clinical conditions associated with DKFZP434I216. DKFZP434K2235 (Accession XM_096869) is another VGAM1958 host target gene. DKFZP434K2235 BINDING SITE is HOST TARGET binding site found in the 3' untranslated region of mRNA encoded by DKFZP434K2235, corresponding to a HOST TARGET binding site such as BINDING SITE I, BINDING SITE II or BINDING SITE III. Table 2 illustrates the complementarity of the nucleotide sequences of DKFZP434K2235 BINDING SITE, designated SEQ ID:40595, to the nucleotide sequence of VGAM1958 RNA, herein designated VGAM RNA, also designated SEQ ID:4669.

Another function of VGAM1958 is therefore inhibition of DKFZP434K2235 (Accession XM_096869). Accordingly, utilities of VGAM1958 include diagnosis, prevention and treatment of diseases and clinical conditions associated with DKFZP434K2235. DKFZp434O0320 (Accession XM_097012) is another VGAM1958 host target gene. DKFZp434O0320 BINDING SITE is HOST TARGET binding site found in the 3' untranslated region of mRNA encoded by DKFZp434O0320, corresponding to a HOST TARGET binding site such as BINDING SITE I, BINDING SITE II or BINDING SITE III. Table 2 illustrates the complementarity of the nucleotide sequences of DKFZp434O0320 BINDING SITE, designated SEQ ID:40706, to the nucleotide sequence of VGAM1958 RNA, herein designated VGAM RNA, also designated SEQ ID:4669.

Another function of VGAM1958 is therefore inhibition of DKFZp434O0320 (Accession XM_097012). Accordingly, utilities of VGAM1958 include diagnosis, prevention and treatment of diseases and clinical conditions associated with DKFZp434O0320. DKFZP434P0111 (Accession XM_041116) is another VGAM1958 host target gene. DKFZP434P0111 BINDING SITE1 and DKFZP434P0111 BINDING SITE2 are HOST TARGET binding sites found in untranslated regions of mRNA encoded by DKFZP434P0111, corresponding to HOST TARGET binding sites such as BINDING SITE I, BINDING SITE II or BINDING SITE III. Table 2 illustrates the complementarity of the nucleotide sequences of DKFZP434P0111 BINDING SITE1 and DKFZP434P0111 BINDING SITE2, designated SEQ ID:33457 and SEQ ID:33450 respectively, to the nucleotide sequence of VGAM1958 RNA, herein designated VGAM RNA, also designated SEQ ID:4669.

Another function of VGAM1958 is therefore inhibition of DKFZP434P0111 (Accession XM_041116). Accordingly, utilities of VGAM1958 include diagnosis, prevention and treatment of diseases and clinical conditions associated with DKFZP434P0111. DKFZP564O0463 (Accession NM_014156) is another VGAM1958 host target gene. DKFZP564O0463 BINDING SITE is HOST TARGET binding site found in the 3' untranslated region of mRNA encoded by DKFZP564O0463, corresponding to a HOST TARGET binding site such as BINDING SITE I, BINDING SITE II or BINDING SITE III. Table 2 illustrates the complementarity of the nucleotide sequences of DKFZP564O0463 BINDING SITE, designated SEQ ID:15445, to the nucleotide sequence of VGAM1958 RNA, herein designated VGAM RNA, also designated SEQ ID:4669.

Another function of VGAM1958 is therefore inhibition of DKFZP564O0463 (Accession NM_014156). Accordingly, utilities of VGAM1958 include diagnosis, prevention and treatment of diseases and clinical conditions associated with DKFZP564O0463. DKFZP566M1046 (Accession NM_032127) is another VGAM1958 host target gene. DKFZP566M1046 BINDING SITE is HOST TARGET binding site found in the 5' untranslated region of mRNA encoded by DKFZP566M1046, corresponding to a HOST TARGET binding site such as BINDING SITE I, BINDING SITE II or BINDING SITE III. Table 2 illustrates the complementarity of the nucleotide sequences of DKFZP566M1046 BINDING SITE, designated SEQ ID:25812, to the nucleotide sequence of VGAM1958 RNA, herein designated VGAM RNA, also designated SEQ ID:4669.

Another function of VGAM1958 is therefore inhibition of DKFZP566M1046 (Accession NM_032127). Accordingly, utilities of VGAM1958 include diagnosis, prevention and treatment of diseases and clinical conditions associated with DKFZP566M1046. DKFZP586F1524 (Accession NM_015584) is another VGAM1958 host target gene. DKFZP586F1524 BINDING SITE is HOST TARGET binding site found in the 3' untranslated region of mRNA encoded by DKFZP586F1524, corresponding to a HOST TARGET binding site such as BINDING SITE I, BINDING SITE II or BINDING SITE III. Table 2 illustrates the complementarity of the nucleotide sequences of DKFZP586F1524 BINDING SITE, designated SEQ ID:17853, to the nucleotide sequence of VGAM1958 RNA, herein designated VGAM RNA, also designated SEQ ID:4669.

Another function of VGAM1958 is therefore inhibition of DKFZP586F1524 (Accession NM_015584). Accordingly, utilities of VGAM1958 include diagnosis, prevention and treatment of diseases and clinical conditions associated with DKFZP586F1524. DKFZP727C091 (Accession XM_038689) is another VGAM1958 host target gene. DKFZP727C091 BINDING SITE is HOST TARGET binding site found in the 3' untranslated region of mRNA encoded by DKFZP727C091, corresponding to a HOST TARGET binding site such as BINDING SITE I, BINDING SITE II or BINDING SITE III. Table 2 illustrates the complementarity of the nucleotide sequences of DKFZP727C091 BINDING SITE, designated SEQ ID:32906, to the nucleotide sequence of VGAM1958 RNA, herein designated VGAM RNA, also designated SEQ ID:4669.

Another function of VGAM1958 is therefore inhibition of DKFZP727C091 (Accession XM_038689). Accordingly, utilities of VGAM1958 include diagnosis, prevention and treatment of diseases and clinical conditions associated with DKFZP727C091. DKFZp761G2113 (Accession XM_046017) is another VGAM1958 host target gene. DKFZp761G2113 BINDING SITE is HOST TARGET binding site found in the 3' untranslated region of mRNA encoded by DKFZp761G2113, corresponding to a HOST TARGET binding site such as BINDING SITE I, BINDING SITE II or BINDING SITE III. Table 2 illustrates the complementarity of the nucleotide sequences of DKFZp761G2113 BINDING SITE, designated SEQ ID:34644, to the nucleotide sequence of VGAM1958 RNA, herein designated VGAM RNA, also designated SEQ ID:4669.

Another function of VGAM1958 is therefore inhibition of DKFZp761G2113 (Accession XM_046017). Accordingly, utilities of VGAM1958 include diagnosis, prevention and treatment of diseases and clinical conditions associated with DKFZp761G2113. DKFZp761J139 (Accession NM_032280) is another VGAM1958 host target gene. DKFZp761J139 BINDING SITE is HOST TARGET binding site found in the 5' untranslated region of mRNA encoded by DKFZp761J139, corresponding to a HOST TARGET binding site such as BINDING SITE I, BINDING SITE II or BINDING SITE III. Table 2 illustrates the complementarity of the nucleotide sequences of DKFZp761J139 BINDING SITE, designated SEQ ID:26037, to the nucleotide sequence of VGAM1958 RNA, herein designated VGAM RNA, also designated SEQ ID:4669.

Another function of VGAM1958 is therefore inhibition of DKFZp761J139 (Accession NM_032280). Accordingly, utilities of VGAM1958 include diagnosis, prevention and treatment of diseases and clinical conditions associated with DKFZp761J139. DKFZp761K1423 (Accession NM_018422) is another VGAM1958 host target gene. DKFZp761K1423 BINDING SITE is HOST TARGET binding site found in the 5' untranslated region of mRNA encoded by DKFZp761K1423, corresponding to a HOST TARGET binding site such as BINDING SITE I, BINDING SITE II or BINDING SITE III. Table 2 illustrates the complementarity of the nucleotide sequences of DKFZp761K1423 BINDING SITE, designated SEQ ID:20469, to the nucleotide sequence of VGAM1958 RNA, herein designated VGAM RNA, also designated SEQ ID:4669.

Another function of VGAM1958 is therefore inhibition of DKFZp761K1423 (Accession NM_018422). Accordingly, utilities of VGAM1958 include diagnosis, prevention and treatment of diseases and clinical conditions associated with DKFZp761K1423. DKFZp762K222 (Accession XM_048721) is another VGAM1958 host target gene. DKFZp762K222 BINDING SITE is HOST TARGET binding site found in the 5' untranslated region of mRNA encoded by DKFZp762K222, corresponding to a HOST TARGET binding site such as BINDING SITE I, BINDING SITE II or BINDING SITE III. Table 2 illustrates the complementarity of the nucleotide sequences of DKFZp762K222 BINDING SITE, designated SEQ ID:35236, to the nucleotide sequence of VGAM1958 RNA, herein designated VGAM RNA, also designated SEQ ID:4669.

Another function of VGAM1958 is therefore inhibition of DKFZp762K222 (Accession XM_048721). Accordingly, utilities of VGAM1958 include diagnosis, prevention and treatment of diseases and clinical conditions associated with DKFZp762K222. DKFZp762P2111 (Accession XM_098654) is another VGAM1958 host target gene. DKFZp762P2111 BINDING SITE is HOST TARGET binding site found in the 3' untranslated region of mRNA encoded by DKFZp762P2111, corresponding to a HOST TARGET binding site such as BINDING SITE I, BINDING SITE II or BINDING SITE III. Table 2 illustrates the complementarity of the nucleotide sequences of DKFZp762P2111 BINDING SITE, designated SEQ ID:41755, to the nucleotide sequence of VGAM1958 RNA, herein designated VGAM RNA, also designated SEQ ID:4669.

Another function of VGAM1958 is therefore inhibition of DKFZp762P2111 (Accession XM_098654). Accordingly, utilities of VGAM1958 include diagnosis, prevention and treatment of diseases and clinical conditions associated with DKFZp762P2111. Dystrophia Myotonica-containing WD Repeat Motif (DMWD, Accession XM_027569) is another VGAM1958 host target gene. DMWD BINDING SITE is HOST TARGET binding site found in the 5' untranslated region of mRNA encoded by DMWD, corresponding to a HOST TARGET binding site such as BINDING SITE I, BINDING SITE II or BINDING SITE III. Table 2 illustrates the complementarity of the nucleotide sequences of DMWD BINDING SITE, designated SEQ ID:30532, to the nucleotide sequence of VGAM1958 RNA, herein designated VGAM RNA, also designated SEQ ID:4669.

Another function of VGAM1958 is therefore inhibition of Dystrophia Myotonica-containing WD Repeat Motif (DMWD, Accession XM_027569). Accordingly, utilities of VGAM1958 include diagnosis, prevention and treatment of diseases and clinical conditions associated with DMWD. DRIL2 (Accession NM_006465) is another VGAM1958 host target gene. DRIL2 BINDING SITE is HOST TARGET binding site found in the 3' untranslated region of mRNA encoded by DRIL2, corresponding to a HOST TARGET binding site such as BINDING SITE I, BINDING SITE II or BINDING SITE III. Table 2 illustrates the complementarity of the nucleotide sequences of DRIL2 BINDING SITE, designated SEQ ID:13189, to the nucleotide sequence of VGAM1958 RNA, herein designated VGAM RNA, also designated SEQ ID:4669.

Another function of VGAM1958 is therefore inhibition of DRIL2 (Accession NM_006465). Accordingly, utilities of VGAM1958 include diagnosis, prevention and treatment of diseases and clinical conditions associated with DRIL2. EAT2 (Accession XM_086490) is another VGAM1958 host target gene. EAT2 BINDING SITE is HOST TARGET binding site found in the 3' untranslated region of mRNA encoded by EAT2, corresponding to a HOST TARGET binding site such as BINDING SITE I, BINDING SITE II or BINDING SITE III. Table 2 illustrates the complementarity of the nucleotide sequences of EAT2 BINDING SITE, designated SEQ ID:38708, to the nucleotide sequence of VGAM1958 RNA, herein designated VGAM RNA, also designated SEQ ID:4669.

Another function of VGAM1958 is therefore inhibition of EAT2 (Accession XM_086490). Accordingly, utilities of VGAM1958 include diagnosis, prevention and treatment of diseases and clinical conditions associated with EAT2. EMILIN-2 (Accession NM_032048) is another VGAM1958 host target gene. EMILIN-2 BINDING SITE is HOST TARGET binding site found in the 3' untranslated region of mRNA encoded by EMILIN-2, corresponding to a HOST TARGET binding site such as BINDING SITE I, BINDING SITE II or BINDING SITE III. Table 2 illustrates the complementarity of the nucleotide sequences of EMILIN-2 BINDING SITE, designated SEQ ID:25767, to the nucleotide sequence of VGAM1958 RNA, herein designated VGAM RNA, also designated SEQ ID:4669.

Another function of VGAM1958 is therefore inhibition of EMILIN-2 (Accession NM_032048). Accordingly, utilities of VGAM1958 include diagnosis, prevention and treatment of diseases and clinical conditions associated with EMILIN-2. ENDOGLYX1 (Accession NM_024756) is another VGAM1958 host target gene. ENDOGLYX1 BINDING SITE is HOST TARGET binding site found in the 3' untranslated region of mRNA encoded by ENDOGLYX1, corresponding to a HOST TARGET binding site such as BINDING SITE I, BINDING SITE II or BINDING SITE III. Table 2 illustrates the complementarity of the nucleotide sequences of ENDOGLYX1 BINDING SITE, designated SEQ ID:24103, to the nucleotide sequence of VGAM1958 RNA, herein designated VGAM RNA, also designated SEQ ID:4669.

Another function of VGAM1958 is therefore inhibition of ENDOGLYX1 (Accession NM_024756). Accordingly, utilities of VGAM1958 include diagnosis, prevention and treatment of diseases and clinical conditions associated with ENDOGLYX1. Ets2 Repressor Factor (ERF, Accession NM_006494) is another VGAM1958 host target gene. ERF BINDING SITE is HOST TARGET binding site found in the 3' untranslated region of mRNA encoded by ERF, corresponding to a HOST TARGET binding site such as BINDING SITE I, BINDING SITE II or BINDING SITE III. Table 2 illustrates the complementarity of the nucleotide sequences of ERF BINDING SITE, designated SEQ ID:13234, to the nucleotide sequence of VGAM1958 RNA, herein designated VGAM RNA, also designated SEQ ID:4669.

Another function of VGAM1958 is therefore inhibition of Ets2 Repressor Factor (ERF, Accession NM_006494). Accordingly, utilities of VGAM1958 include diagnosis, prevention and treatment of diseases and clinical conditions associated with ERF. FEM-2 (Accession NM_014634) is another VGAM1958 host target gene. FEM-2 BINDING SITE is HOST TARGET binding site found in the 3' untranslated region of mRNA encoded by FEM-2, corresponding to a HOST TARGET binding site such as BINDING SITE I, BINDING SITE II or BINDING SITE III. Table 2 illustrates the complementarity of the nucleotide sequences of FEM-2 BINDING SITE, designated SEQ ID:16006, to the nucleotide sequence of VGAM1958 RNA, herein designated VGAM RNA, also designated SEQ ID:4669.

Another function of VGAM1958 is therefore inhibition of FEM-2 (Accession NM_014634). Accordingly, utilities of VGAM1958 include diagnosis, prevention and treatment of diseases and clinical conditions associated with FEM-2. Fidgetin-like 1 (FIGNL1, Accession NM_022116) is another VGAM1958 host target gene. FIGNL1 BINDING SITE is HOST TARGET binding site found in the 5' untranslated region of mRNA encoded by FIGNL1, corresponding to a HOST TARGET binding site such as BINDING SITE I, BINDING SITE II or BINDING SITE III. Table 2 illustrates the complementarity of the nucleotide sequences of FIGNL1 BINDING SITE, designated SEQ ID:22661, to the nucleotide sequence of VGAM1958 RNA, herein designated VGAM RNA, also designated SEQ ID:4669.

Another function of VGAM1958 is therefore inhibition of Fidgetin-like 1 (FIGNL1, Accession NM_022116). Accordingly, utilities of VGAM1958 include diagnosis, prevention and treatment of diseases and clinical conditions associated with FIGNL1. FKSG14 (Accession XM_042025) is another VGAM1958 host target gene. FKSG14 BINDING SITE is HOST TARGET binding site found in the 5' untranslated region of mRNA encoded by FKSG14, corresponding to a HOST TARGET binding site such as BINDING SITE I, BINDING SITE II or BINDING SITE III. Table 2 illustrates the complementarity of the nucleotide sequences of FKSG14 BINDING SITE, designated SEQ ID:33670, to the nucleotide sequence of VGAM1958 RNA, herein designated VGAM RNA, also designated SEQ ID:4669.

Another function of VGAM1958 is therefore inhibition of FKSG14 (Accession XM_042025). Accordingly, utilities of VGAM1958 include diagnosis, prevention and treatment of diseases and clinical conditions associated with FKSG14. FLJ00024 (Accession XM_033361) is another VGAM1958 host target gene. FLJ00024 BINDING SITE1 and FLJ00024 BINDING SITE2 are HOST TARGET binding sites found in untranslated regions of mRNA encoded by FLJ00024, corresponding to HOST TARGET binding sites such as BINDING SITE I, BINDING SITE II or BINDING SITE III. Table 2 illustrates the complementarity of the nucleotide sequences of FLJ00024 BINDING SITE1 and FLJ00024 BINDING SITE2, designated SEQ ID:31891 and SEQ ID:31894 respectively, to the nucleotide sequence of VGAM1958 RNA, herein designated VGAM RNA, also designated SEQ ID:4669.

Another function of VGAM1958 is therefore inhibition of FLJ00024 (Accession XM_033361). Accordingly, utilities of VGAM1958 include diagnosis, prevention and treatment of diseases and clinical conditions associated with FLJ00024. FLJ10101 (Accession NM_024718) is another VGAM1958 host target gene. FLJ10101 BINDING SITE1 and FLJ10101 BINDING SITE2 are HOST TARGET binding sites found in untranslated regions of mRNA encoded by FLJ10101, corresponding to HOST TARGET binding sites such as BINDING SITE I, BINDING SITE II or BINDING SITE III. Table 2 illustrates the complementarity of the nucleotide sequences of FLJ10101 BINDING SITE1 and FLJ10101 BINDING SITE2, designated SEQ ID:24044 and SEQ ID:24047 respectively, to the nucleotide sequence of VGAM1958 RNA, herein designated VGAM RNA, also designated SEQ ID:4669.

Another function of VGAM1958 is therefore inhibition of FLJ10101 (Accession NM_024718). Accordingly, utilities of VGAM1958 include diagnosis, prevention and treatment of diseases and clinical conditions associated with FLJ10101. FLJ10342 (Accession NM_018064) is another VGAM1958 host target gene. FLJ10342 BINDING SITE is HOST TARGET binding site found in the 5' untranslated region of mRNA encoded by FLJ10342, corresponding to a HOST TARGET binding site such as BINDING SITE I, BINDING SITE II or BINDING SITE III. Table 2 illustrates the complementarity of the nucleotide sequences of FLJ10342 BINDING SITE, designated SEQ ID:19834, to the nucleotide sequence of VGAM1958 RNA, herein designated VGAM RNA, also designated SEQ ID:4669.

Another function of VGAM1958 is therefore inhibition of FLJ10342 (Accession NM_018064). Accordingly, utilities of VGAM1958 include diagnosis, prevention and treatment of diseases and clinical conditions associated with FLJ10342. FLJ10388 (Accession NM_018082) is another VGAM1958 host target gene. FLJ10388 BINDING SITE is HOST TARGET binding site found in the 3' untranslated region of mRNA encoded by FLJ10388, corresponding to a HOST TARGET binding site such as BINDING SITE I, BINDING SITE II or BINDING SITE III. Table 2 illustrates the complementarity of the nucleotide sequences of FLJ10388 BINDING SITE, designated SEQ ID:19842, to the nucleotide sequence of VGAM1958 RNA, herein designated VGAM RNA, also designated SEQ ID:4669.

Another function of VGAM1958 is therefore inhibition of FLJ10388 (Accession NM_018082). Accordingly, utilities of VGAM1958 include diagnosis, prevention and treatment of diseases and clinical conditions associated with FLJ10388. FLJ10420 (Accession NM_018090) is another VGAM1958 host target gene. FLJ10420 BINDING SITE is HOST TARGET binding site found in the 3' untranslated region of mRNA encoded by FLJ10420, corresponding to a HOST TARGET binding site such as BINDING SITE I, BINDING SITE II or BINDING SITE III. Table 2 illustrates the complementarity of the nucleotide sequences of FLJ10420 BINDING SITE, designated SEQ ID:19858, to the nucleotide sequence of VGAM1958 RNA, herein designated VGAM RNA, also designated SEQ ID:4669.

Another function of VGAM1958 is therefore inhibition of FLJ10420 (Accession NM_018090). Accordingly, utilities of VGAM1958 include diagnosis, prevention and treatment of diseases and clinical conditions associated with FLJ10420. FLJ10713 (Accession NM_018189) is another VGAM1958 host target gene. FLJ10713 BINDING SITE is HOST TARGET binding site found in the 3' untranslated region of mRNA encoded by FLJ10713, corresponding to a HOST TARGET binding site such as BINDING SITE I, BINDING SITE II or BINDING SITE III. Table 2 illustrates the complementarity of the nucleotide sequences of FLJ10713 BINDING SITE, designated SEQ ID:20040, to the nucleotide sequence of VGAM1958 RNA, herein designated VGAM RNA, also designated SEQ ID:4669.

Another function of VGAM1958 is therefore inhibition of FLJ10713 (Accession NM_018189). Accordingly, utilities of VGAM1958 include diagnosis, prevention and treatment of diseases and clinical conditions associated with FLJ10713. FLJ10751 (Accession NM_018205) is another VGAM1958 host target gene. FLJ10751 BINDING SITE1 and FLJ10751 BINDING SITE2 are HOST TARGET binding sites found in untranslated regions of mRNA encoded by FLJ10751, corresponding to HOST TARGET binding sites such as BINDING SITE I, BINDING SITE II or BINDING SITE III. Table 2 illustrates the complementarity of the nucleotide sequences of FLJ10751 BINDING SITE1 and FLJ10751 BINDING SITE2, designated SEQ ID:20095 and SEQ ID:20194 respectively, to the nucleotide sequence of VGAM1958 RNA, herein designated VGAM RNA, also designated SEQ ID:4669.

Another function of VGAM1958 is therefore inhibition of FLJ10751 (Accession NM_018205). Accordingly, utilities of VGAM1958 include diagnosis, prevention and treatment of diseases and clinical conditions associated with FLJ10751. FLJ10803 (Accession NM_018224) is another VGAM1958 host target gene. FLJ10803 BINDING SITE is HOST TARGET binding site found in the 3' untranslated region of mRNA encoded by FLJ10803, corresponding to a HOST TARGET binding site such as BINDING SITE I, BINDING SITE II or BINDING SITE III. Table 2 illustrates the complementarity of the nucleotide sequences of FLJ10803 BINDING SITE, designated SEQ ID:20152, to the nucleotide sequence of VGAM1958 RNA, herein designated VGAM RNA, also designated SEQ ID:4669.

Another function of VGAM1958 is therefore inhibition of FLJ10803 (Accession NM_018224). Accordingly, utilities of VGAM1958 include diagnosis, prevention and treatment of diseases and clinical conditions associated with FLJ10803. FLJ10811 (Accession NM_018228) is another VGAM1958 host target gene. FLJ10811 BINDING SITE is HOST TARGET binding site found in the 3' untranslated region of mRNA encoded by FLJ10811, corresponding to a HOST TARGET binding site such as BINDING SITE I, BINDING SITE II or BINDING SITE III. Table 2 illustrates the complementarity of the nucleotide sequences of FLJ10811 BINDING SITE, designated SEQ ID:20165, to the nucleotide sequence of VGAM1958 RNA, herein designated VGAM RNA, also designated SEQ ID:4669.

Another function of VGAM1958 is therefore inhibition of FLJ10811 (Accession NM_018228). Accordingly, utilities of VGAM1958 include diagnosis, prevention and treatment of diseases and clinical conditions associated with FLJ10811. FLJ10829 (Accession NM_018234) is another VGAM1958 host target gene. FLJ10829 BINDING SITE is HOST TARGET binding site found in the 3' untranslated region of mRNA encoded by FLJ10829, corresponding to a HOST TARGET binding site such as BINDING SITE I, BINDING SITE II or BINDING SITE III. Table 2 illustrates the complementarity of the nucleotide sequences of FLJ10829 BINDING SITE, designated SEQ ID:20180, to the nucleotide sequence of VGAM1958 RNA, herein designated VGAM RNA, also designated SEQ ID:4669.

Another function of VGAM1958 is therefore inhibition of FLJ10829 (Accession NM_018234). Accordingly, utilities of VGAM1958 include diagnosis, prevention and treatment of diseases and clinical conditions associated with FLJ10829. FLJ10849 (Accession NM_018243) is another VGAM1958 host target gene. FLJ10849 BINDING SITE is HOST TARGET binding site found in the 3' untranslated region of mRNA encoded by FLJ10849, corresponding to a HOST TARGET binding site such as BINDING SITE I, BINDING SITE II or BINDING SITE III. Table 2 illustrates the complementarity of the nucleotide sequences of FLJ10849 BINDING SITE, designated SEQ ID:20205, to the nucleotide sequence of VGAM1958 RNA, herein designated VGAM RNA, also designated SEQ ID:4669.

Another function of VGAM1958 is therefore inhibition of FLJ10849 (Accession NM_018243). Accordingly, utilities of VGAM1958 include diagnosis, prevention and treatment of diseases and clinical conditions associated with FLJ10849. FLJ10895 (Accession NM_019084) is another VGAM1958 host target gene. FLJ10895 BINDING SITE is HOST TARGET binding site found in the 3' untranslated region of mRNA encoded by FLJ10895, corresponding to a HOST TARGET binding site such as BINDING SITE I, BINDING SITE II or BINDING SITE III. Table 2 illustrates the complementarity of the nucleotide sequences of FLJ10895 BINDING SITE, designated SEQ ID:21158, to the nucleotide sequence of VGAM1958 RNA, herein designated VGAM RNA, also designated SEQ ID:4669.

Another function of VGAM1958 is therefore inhibition of FLJ10895 (Accession NM_019084). Accordingly, utilities of VGAM1958 include diagnosis, prevention and treatment of diseases and clinical conditions associated with FLJ10895. FLJ10925 (Accession NM_018275) is another VGAM1958 host target gene. FLJ10925 BINDING SITE is HOST TARGET binding site found in the 3' untranslated region of mRNA encoded by FLJ10925, corresponding to a HOST TARGET binding site such as BINDING SITE I, BINDING SITE II or BINDING SITE III. Table 2 illustrates the complementarity of the nucleotide sequences of FLJ10925 BINDING SITE, designated SEQ ID:20260, to the nucleotide sequence of VGAM1958 RNA, herein designated VGAM RNA, also designated SEQ ID:4669.

Another function of VGAM1958 is therefore inhibition of FLJ10925 (Accession NM_018275). Accordingly, utilities of VGAM1958 include diagnosis, prevention and treatment of diseases and clinical conditions associated with FLJ10925. FLJ11362 (Accession NM_021946) is another VGAM1958 host target gene. FLJ11362 BINDING SITE1 and FLJ11362 BINDING SITE2 are HOST TARGET binding sites found in untranslated regions of mRNA encoded by FLJ11362, corresponding to HOST TARGET binding sites such as BINDING SITE I, BINDING SITE II or BINDING SITE III. Table 2 illustrates the complementarity of the nucleotide sequences of FLJ11362 BINDING SITE1 and FLJ11362 BINDING SITE2, designated SEQ ID:22470 and SEQ ID:22472 respectively, to the nucleotide sequence of VGAM1958 RNA, herein designated VGAM RNA, also designated SEQ ID:4669.

Another function of VGAM1958 is therefore inhibition of FLJ11362 (Accession NM_021946). Accordingly, utilities of VGAM1958 include diagnosis, prevention and treatment of diseases and clinical conditions associated with FLJ11362. FLJ11726 (Accession NM_024971) is another VGAM1958 host target gene. FLJ11726 BINDING SITE is HOST TARGET binding site found in the 3' untranslated region of mRNA encoded by FLJ11726, corresponding to a HOST TARGET binding site such as BINDING SITE I, BINDING SITE II or BINDING SITE III. Table 2 illustrates the complementarity of the nucleotide sequences of FLJ11726 BINDING SITE, designated SEQ ID:24527, to the nucleotide sequence of VGAM1958 RNA, herein designated VGAM RNA, also designated SEQ ID:4669.

Another function of VGAM1958 is therefore inhibition of FLJ11726 (Accession NM_024971). Accordingly, utilities of VGAM1958 include diagnosis, prevention and treatment of diseases and clinical conditions associated with FLJ11726. FLJ12057 (Accession NM_024768) is another VGAM1958 host target gene. FLJ12057 BINDING SITE is HOST TARGET binding site found in the 3' untranslated region of mRNA encoded by FLJ12057, corresponding to a HOST TARGET binding site such as BINDING SITE I, BINDING SITE II or BINDING SITE III. Table 2 illustrates the complementarity of the nucleotide sequences of FLJ12057 BINDING SITE, designated SEQ ID:24127, to the nucleotide sequence of VGAM1958 RNA, herein designated VGAM RNA, also designated SEQ ID:4669.

Another function of VGAM1958 is therefore inhibition of FLJ12057 (Accession NM_024768). Accordingly, utilities of VGAM1958 include diagnosis, prevention and treatment of diseases and clinical conditions associated with FLJ12057. FLJ12484 (Accession NM_022767) is another VGAM1958 host target gene. FLJ12484 BINDING SITE1 through FLJ12484 BINDING SITE4 are HOST TARGET binding sites found in untranslated regions of mRNA encoded by FLJ12484, corresponding to HOST TARGET binding sites such as BINDING SITE I, BINDING SITE II or BINDING SITE III. Table 2 illustrates the complementarity of the nucleotide sequences of FLJ12484 BINDING SITE1 through FLJ12484 BINDING SITE4, designated SEQ ID:23016, SEQ ID:23020, SEQ ID:34514 and SEQ ID:34518 respectively, to the nucleotide sequence of VGAM1958 RNA, herein designated VGAM RNA, also designated SEQ ID:4669.

Another function of VGAM1958 is therefore inhibition of FLJ12484 (Accession NM_022767). Accordingly, utilities of VGAM1958 include diagnosis, prevention and treatment of diseases and clinical conditions associated with FLJ12484. FLJ12700 (Accession NM_024910) is another VGAM1958 host target gene. FLJ12700 BINDING SITE is HOST TARGET binding site found in the 3' untranslated region of mRNA encoded by FLJ12700, corresponding to a HOST TARGET binding site such as BINDING SITE I, BINDING SITE II or BINDING SITE III. Table 2 illustrates the complementarity of the nucleotide sequences of FLJ12700 BINDING SITE, designated SEQ ID:24413, to the nucleotide sequence of VGAM1958 RNA, herein designated VGAM RNA, also designated SEQ ID:4669.

Another function of VGAM1958 is therefore inhibition of FLJ12700 (Accession NM_024910). Accordingly, utilities of VGAM1958 include diagnosis, prevention and treatment of diseases and clinical conditions associated with FLJ12700. FLJ12783 (Accession NM_031426) is another VGAM1958 host target gene. FLJ12783 BINDING SITE is HOST TARGET binding site found in the 3' untranslated region of mRNA encoded by FLJ12783, corresponding to a HOST TARGET binding site such as BINDING SITE I, BINDING SITE II or BINDING SITE III. Table 2 illustrates the complementarity of the nucleotide sequences of FLJ12783 BINDING SITE, designated SEQ ID:25422, to the nucleotide sequence of VGAM1958 RNA, herein designated VGAM RNA, also designated SEQ ID:4669.

Another function of VGAM1958 is therefore inhibition of FLJ12783 (Accession NM_031426). Accordingly, utilities of VGAM1958 include diagnosis, prevention and treatment of diseases and clinical conditions associated with FLJ12783. FLJ12960 (Accession NM_024638) is another VGAM1958 host target gene. FLJ12960 BINDING SITE1 and FLJ12960 BINDING SITE2 are HOST TARGET binding sites found in untranslated regions of mRNA encoded by FLJ12960, corresponding to HOST TARGET binding sites such as BINDING SITE I, BINDING SITE II or BINDING SITE III. Table 2 illustrates the complementarity of the nucleotide sequences of FLJ12960 BINDING SITE1 and FLJ12960 BINDING SITE2, designated SEQ ID:23912 and SEQ ID:23916 respectively, to the nucleotide sequence of VGAM1958 RNA, herein designated VGAM RNA, also designated SEQ ID:4669.

Another function of VGAM1958 is therefore inhibition of FLJ12960 (Accession NM_024638). Accordingly, utilities of VGAM1958 include diagnosis, prevention and treatment of diseases and clinical conditions associated with FLJ12960. FLJ13055 (Accession NM_022737) is another VGAM1958 host target gene. FLJ13055 BINDING SITE is HOST TARGET binding site found in the 3' untranslated region of mRNA encoded by FLJ13055, corresponding to a HOST TARGET binding site such as BINDING SITE I, BINDING SITE II or BINDING SITE III. Table 2 illustrates the complementarity of the nucleotide sequences of FLJ13055 BINDING SITE, designated SEQ ID:22944, to the nucleotide sequence of VGAM1958 RNA, herein designated VGAM RNA, also designated SEQ ID:4669.

Another function of VGAM1958 is therefore inhibition of FLJ13055 (Accession NM_022737). Accordingly, utilities of VGAM1958 include diagnosis, prevention and treatment of diseases and clinical conditions associated with FLJ13055. FLJ13114 (Accession NM_024541) is another VGAM1958 host target gene. FLJ13114 BINDING SITE is HOST TARGET binding site found in the 3' untranslated region of mRNA encoded by FLJ13114, corresponding to a HOST TARGET binding site such as BINDING SITE I, BINDING SITE II or BINDING SITE III. Table 2 illustrates the complementarity of the nucleotide sequences of FLJ13114 BINDING SITE, designated SEQ ID:23750, to the nucleotide sequence of VGAM1958 RNA, herein designated VGAM RNA, also designated SEQ ID:4669.

Another function of VGAM1958 is therefore inhibition of FLJ13114 (Accession NM_024541). Accordingly, utilities of VGAM1958 include diagnosis, prevention and treatment of diseases and clinical conditions associated with FLJ13114. FLJ13154 (Accession NM_024598) is another VGAM1958 host target gene. FLJ13154 BINDING SITE is HOST TARGET binding site found in the 3' untranslated region of mRNA encoded by FLJ13154, corresponding to a HOST TARGET binding site such as BINDING SITE I, BINDING SITE II or BINDING SITE III. Table 2 illustrates the complementarity of the nucleotide sequences of FLJ13154 BINDING SITE, designated SEQ ID:23836, to the nucleotide sequence of VGAM1958 RNA, herein designated VGAM RNA, also designated SEQ ID:4669.

Another function of VGAM1958 is therefore inhibition of FLJ13154 (Accession NM_024598). Accordingly, utilities of VGAM1958 include diagnosis, prevention and treatment of diseases and clinical conditions associated with FLJ13154. FLJ13189 (Accession NM_024882) is another VGAM1958 host target gene. FLJ13189 BINDING SITE is HOST TARGET binding site found in the 3' untranslated region of mRNA encoded by FLJ13189, corresponding to a HOST TARGET binding site such as BINDING SITE I, BINDING SITE II or BINDING SITE III. Table 2 illustrates the complementarity of the nucleotide sequences of FLJ13189 BINDING SITE, designated SEQ ID:24327, to the nucleotide sequence of VGAM1958 RNA, herein designated VGAM RNA, also designated SEQ ID:4669.

Another function of VGAM1958 is therefore inhibition of FLJ13189 (Accession NM_024882). Accordingly, utilities of VGAM1958 include diagnosis, prevention and treatment of diseases and clinical conditions associated with FLJ13189. FLJ13213 (Accession NM_024755) is another VGAM1958 host target gene. FLJ13213 BINDING SITE is HOST TARGET binding site found in the 3' untranslated region of mRNA encoded by FLJ13213, corresponding to a HOST TARGET binding site such as BINDING SITE I, BINDING SITE II or BINDING SITE III. Table 2 illustrates the complementarity of the nucleotide sequences of FLJ13213 BINDING SITE, designated SEQ ID:24099, to the nucleotide sequence of VGAM1958 RNA, herein designated VGAM RNA, also designated SEQ ID:4669.

Another function of VGAM1958 is therefore inhibition of FLJ13213 (Accession NM_024755). Accordingly, utilities of VGAM1958 include diagnosis, prevention and treatment of diseases and clinical conditions associated with FLJ13213. FLJ13224 (Accession NM_024799) is another VGAM1958 host target gene. FLJ13224 BINDING SITE is HOST TARGET binding site found in the 3' untranslated region of mRNA encoded by FLJ13224, corresponding to a HOST TARGET binding site such as BINDING SITE I, BINDING SITE II or BINDING SITE III. Table 2 illustrates the complementarity of the nucleotide sequences of FLJ13224 BINDING SITE, designated SEQ ID:24177, to the nucleotide sequence of VGAM1958 RNA, herein designated VGAM RNA, also designated SEQ ID:4669.

Another function of VGAM1958 is therefore inhibition of FLJ13224 (Accession NM_024799). Accordingly, utilities of VGAM1958 include diagnosis, prevention and treatment of diseases and clinical conditions associated with FLJ13224. FLJ13241 (Accession NM_025088) is another VGAM1958 host target gene. FLJ13241 BINDING SITE is HOST TARGET binding site found in the 3' untranslated region of mRNA encoded by FLJ13241, corresponding to a HOST TARGET binding site such as BINDING SITE I, BINDING SITE II or BINDING SITE III. Table 2 illustrates the complementarity of the nucleotide sequences of FLJ13241 BINDING SITE, designated SEQ ID:24708, to the nucleotide sequence of VGAM1958 RNA, herein designated VGAM RNA, also designated SEQ ID:4669.

Another function of VGAM1958 is therefore inhibition of FLJ13241 (Accession NM_025088). Accordingly, utilities of VGAM1958 include diagnosis, prevention and treatment of diseases and clinical conditions associated with FLJ13241.

FLJ13262 (Accession NM_024914) is another VGAM1958 host target gene. FLJ13262 BINDING SITE is HOST TARGET binding site found in the 3' untranslated region of mRNA encoded by FLJ13262, corresponding to a HOST TARGET binding site such as BINDING SITE I, BINDING SITE II or BINDING SITE III. Table 2 illustrates the complementarity of the nucleotide sequences of FLJ13262 BINDING SITE, designated SEQ ID:24432, to the nucleotide sequence of VGAM1958 RNA, herein designated VGAM RNA, also designated SEQ ID:4669.

Another function of VGAM1958 is therefore inhibition of FLJ13262 (Accession NM_024914). Accordingly, utilities of VGAM1958 include diagnosis, prevention and treatment of diseases and clinical conditions associated with FLJ13262. FLJ13615 (Accession NM_025114) is another VGAM1958 host target gene. FLJ13615 BINDING SITE is HOST TARGET binding site found in the 5' untranslated region of mRNA encoded by FLJ13615, corresponding to a HOST TARGET binding site such as BINDING SITE I, BINDING SITE II or BINDING SITE III. Table 2 illustrates the complementarity of the nucleotide sequences of FLJ13615 BINDING SITE, designated SEQ ID:24763, to the nucleotide sequence of VGAM1958 RNA, herein designated VGAM RNA, also designated SEQ ID:4669.

Another function of VGAM1958 is therefore inhibition of FLJ13615 (Accession NM_025114). Accordingly, utilities of VGAM1958 include diagnosis, prevention and treatment of diseases and clinical conditions associated with FLJ13615. FLJ13659 (Accession NM_025189) is another VGAM1958 host target gene. FLJ13659 BINDING SITE is HOST TARGET binding site found in the 5' untranslated region of mRNA encoded by FLJ13659, corresponding to a HOST TARGET binding site such as BINDING SITE I, BINDING SITE II or BINDING SITE III. Table 2 illustrates the complementarity of the nucleotide sequences of FLJ13659 BINDING SITE, designated SEQ ID:24832, to the nucleotide sequence of VGAM1958 RNA, herein designated VGAM RNA, also designated SEQ ID:4669.

Another function of VGAM1958 is therefore inhibition of FLJ13659 (Accession NM_025189). Accordingly, utilities of VGAM1958 include diagnosis, prevention and treatment of diseases and clinical conditions associated with FLJ13659. FLJ13693 (Accession NM_024807) is another VGAM1958 host target gene. FLJ13693 BINDING SITE is HOST TARGET binding site found in the 3' untranslated region of mRNA encoded by FLJ13693, corresponding to a HOST TARGET binding site such as BINDING SITE I, BINDING SITE II or BINDING SITE III. Table 2 illustrates the complementarity of the nucleotide sequences of FLJ13693 BINDING SITE, designated SEQ ID:24185, to the nucleotide sequence of VGAM1958 RNA, herein designated VGAM RNA, also designated SEQ ID:4669.

Another function of VGAM1958 is therefore inhibition of FLJ13693 (Accession NM_024807). Accordingly, utilities of VGAM1958 include diagnosis, prevention and treatment of diseases and clinical conditions associated with FLJ13693. FLJ13910 (Accession NM_022780) is another VGAM1958 host target gene. FLJ13910 BINDING SITE is HOST TARGET binding site found in the 3' untranslated region of mRNA encoded by FLJ13910, corresponding to a HOST TARGET binding site such as BINDING SITE I, BINDING SITE II or BINDING SITE III. Table 2 illustrates the complementarity of the nucleotide sequences of FLJ13910 BINDING SITE, designated SEQ ID:23057, to the nucleotide sequence of VGAM1958 RNA, herein designated VGAM RNA, also designated SEQ ID:4669.

Another function of VGAM1958 is therefore inhibition of FLJ13910 (Accession NM_022780). Accordingly, utilities of VGAM1958 include diagnosis, prevention and treatment of diseases and clinical conditions associated with FLJ13910. FLJ14106 (Accession NM_025067) is another VGAM1958 host target gene. FLJ14106 BINDING SITE is HOST TARGET binding site found in the 3' untranslated region of mRNA encoded by FLJ14106, corresponding to a HOST TARGET binding site such as BINDING SITE I, BINDING SITE II or BINDING SITE III. Table 2 illustrates the complementarity of the nucleotide sequences of FLJ14106 BINDING SITE, designated SEQ ID:24665, to the nucleotide sequence of VGAM1958 RNA, herein designated VGAM RNA, also designated SEQ ID:4669.

Another function of VGAM1958 is therefore inhibition of FLJ14106 (Accession NM_025067). Accordingly, utilities of VGAM1958 include diagnosis, prevention and treatment of diseases and clinical conditions associated with FLJ14106. FLJ14146 (Accession NM_024709) is another VGAM1958 host target gene. FLJ14146 BINDING SITE is HOST TARGET binding site found in the 3' untranslated region of mRNA encoded by FLJ14146, corresponding to a HOST TARGET binding site such as BINDING SITE I, BINDING SITE II or BINDING SITE III. Table 2 illustrates the complementarity of the nucleotide sequences of FLJ14146 BINDING SITE, designated SEQ ID:24033, to the nucleotide sequence of VGAM1958 RNA, herein designated VGAM RNA, also designated SEQ ID:4669.

Another function of VGAM1958 is therefore inhibition of FLJ14146 (Accession NM_024709). Accordingly, utilities of VGAM1958 include diagnosis, prevention and treatment of diseases and clinical conditions associated with FLJ14146. FLJ14327 (Accession NM_024912) is another VGAM1958 host target gene. FLJ14327 BINDING SITE is HOST TARGET binding site found in the 3' untranslated region of mRNA encoded by FLJ14327, corresponding to a HOST TARGET binding site such as BINDING SITE I, BINDING SITE II or BINDING SITE III. Table 2 illustrates the complementarity of the nucleotide sequences of FLJ14327 BINDING SITE, designated SEQ ID:24420, to the nucleotide sequence of VGAM1958 RNA, herein designated VGAM RNA, also designated SEQ ID:4669.

Another function of VGAM1958 is therefore inhibition of FLJ14327 (Accession NM_024912). Accordingly, utilities of VGAM1958 include diagnosis, prevention and treatment of diseases and clinical conditions associated with FLJ14327. FLJ14451 (Accession NM_032786) is another VGAM1958 host target gene. FLJ14451 BINDING SITE is HOST TARGET binding site found in the 3' untranslated region of mRNA encoded by FLJ14451, corresponding to a HOST TARGET binding site such as BINDING SITE I, BINDING SITE II or BINDING SITE III. Table 2 illustrates the complementarity of the nucleotide sequences of FLJ14451 BINDING SITE, designated SEQ ID:26539, to the nucleotide sequence of VGAM1958 RNA, herein designated VGAM RNA, also designated SEQ ID:4669.

Another function of VGAM1958 is therefore inhibition of FLJ14451 (Accession NM_032786). Accordingly, utilities of VGAM1958 include diagnosis, prevention and treatment of diseases and clinical conditions associated with FLJ14451. FLJ14564 (Accession XM_084459) is another VGAM1958 host target gene. FLJ14564 BINDING SITE is HOST TARGET binding site found in the 3' untranslated region of mRNA encoded by FLJ14564, corresponding to a HOST TARGET binding site such as BINDING SITE I, BINDING SITE II or BINDING SITE III. Table 2 illustrates the complementarity of the nucleotide sequences of FLJ14564 BIND- ING SITE, designated SEQ ID:37598, to the nucleotide sequence of VGAM1958 RNA, herein designated VGAM RNA, also designated SEQ ID:4669.

Another function of VGAM1958 is therefore inhibition of FLJ14564 (Accession XM_084459). Accordingly, utilities of VGAM1958 include diagnosis, prevention and treatment of diseases and clinical conditions associated with FLJ14564. FLJ14810 (Accession NM_032843) is another VGAM1958 host target gene. FLJ14810 BINDING SITE is HOST TARGET binding site found in the 3' untranslated region of mRNA encoded by FLJ14810, corresponding to a HOST TARGET binding site such as BINDING SITE I, BINDING SITE II or BINDING SITE III. Table 2 illustrates the complementarity of the nucleotide sequences of FLJ14810 BINDING SITE, designated SEQ ID:26630, to the nucleotide sequence of VGAM1958 RNA, herein designated VGAM RNA, also designated SEQ ID:4669.

Another function of VGAM1958 is therefore inhibition of FLJ14810 (Accession NM_032843). Accordingly, utilities of VGAM1958 include diagnosis, prevention and treatment of diseases and clinical conditions associated with FLJ14810. FLJ20034 (Accession NM_017630) is another VGAM1958 host target gene. FLJ20034 BINDING SITE is HOST TARGET binding site found in the 5' untranslated region of mRNA encoded by FLJ20034, corresponding to a HOST TARGET binding site such as BINDING SITE I, BINDING SITE II or BINDING SITE III. Table 2 illustrates the complementarity of the nucleotide sequences of FLJ20034 BINDING SITE, designated SEQ ID:19129, to the nucleotide sequence of VGAM1958 RNA, herein designated VGAM RNA, also designated SEQ ID:4669.

Another function of VGAM1958 is therefore inhibition of FLJ20034 (Accession NM_017630). Accordingly, utilities of VGAM1958 include diagnosis, prevention and treatment of diseases and clinical conditions associated with FLJ20034. FLJ20040 (Accession NM_018992) is another VGAM1958 host target gene. FLJ20040 BINDING SITE is HOST TARGET binding site found in the 3' untranslated region of mRNA encoded by FLJ20040, corresponding to a HOST TARGET binding site such as BINDING SITE I, BINDING SITE II or BINDING SITE III. Table 2 illustrates the complementarity of the nucleotide sequences of FLJ20040 BINDING SITE, designated SEQ ID:21068, to the nucleotide sequence of VGAM1958 RNA, herein designated VGAM RNA, also designated SEQ ID:4669.

Another function of VGAM1958 is therefore inhibition of FLJ20040 (Accession NM_018992). Accordingly, utilities of VGAM1958 include diagnosis, prevention and treatment of diseases and clinical conditions associated with FLJ20040. FLJ20294 (Accession NM_017749) is another VGAM1958 host target gene. FLJ20294 BINDING SITE is HOST TARGET binding site found in the 3' untranslated region of mRNA encoded by FLJ20294, corresponding to a HOST TARGET binding site such as BINDING SITE I, BINDING SITE II or BINDING SITE III. Table 2 illustrates the complementarity of the nucleotide sequences of FLJ20294 BINDING SITE, designated SEQ ID:19349, to the nucleotide sequence of VGAM1958 RNA, herein designated VGAM RNA, also designated SEQ ID:4669.

Another function of VGAM1958 is therefore inhibition of FLJ20294 (Accession NM_017749). Accordingly, utilities of VGAM1958 include diagnosis, prevention and treatment of diseases and clinical conditions associated with FLJ20294. FLJ20298 (Accession NM_017752) is another VGAM1958 host target gene. FLJ20298 BINDING SITE is HOST TARGET binding site found in the 3' untranslated region of mRNA encoded by FLJ20298, corresponding to a HOST TARGET binding site such as BINDING SITE I, BINDING SITE II or BINDING SITE III. Table 2 illustrates the complementarity of the nucleotide sequences of FLJ20298 BINDING SITE, designated SEQ ID:19364, to the nucleotide sequence of VGAM1958 RNA, herein designated VGAM RNA, also designated SEQ ID:4669.

Another function of VGAM1958 is therefore inhibition of FLJ20298 (Accession NM_017752). Accordingly, utilities of VGAM1958 include diagnosis, prevention and treatment of diseases and clinical conditions associated with FLJ20298. FLJ20320 (Accession NM_017765) is another VGAM1958 host target gene. FLJ20320 BINDING SITE is HOST TARGET binding site found in the 3' untranslated region of mRNA encoded by FLJ20320, corresponding to a HOST TARGET binding site such as BINDING SITE I, BINDING SITE II or BINDING SITE III. Table 2 illustrates the complementarity of the nucleotide sequences of FLJ20320 BINDING SITE, designated SEQ ID:19381, to the nucleotide sequence of VGAM1958 RNA, herein designated VGAM RNA, also designated SEQ ID:4669.

Another function of VGAM1958 is therefore inhibition of FLJ20320 (Accession NM_017765). Accordingly, utilities of VGAM1958 include diagnosis, prevention and treatment of diseases and clinical conditions associated with FLJ20320. FLJ20375 (Accession NM_017794) is another VGAM1958 host target gene. FLJ20375 BINDING SITE is HOST TARGET binding site found in the 3' untranslated region of mRNA encoded by FLJ20375, corresponding to a HOST TARGET binding site such as BINDING SITE I, BINDING SITE II or BINDING SITE III. Table 2 illustrates the complementarity of the nucleotide sequences of FLJ20375 BINDING SITE, designated SEQ ID:19432, to the nucleotide sequence of VGAM1958 RNA, herein designated VGAM RNA, also designated SEQ ID:4669.

Another function of VGAM1958 is therefore inhibition of FLJ20375 (Accession NM_017794). Accordingly, utilities of VGAM1958 include diagnosis, prevention and treatment of diseases and clinical conditions associated with FLJ20375. FLJ20401 (Accession NM_017805) is another VGAM1958 host target gene. FLJ20401 BINDING SITE is HOST TARGET binding site found in the 5' untranslated region of mRNA encoded by FLJ20401, corresponding to a HOST TARGET binding site such as BINDING SITE I, BINDING SITE II or BINDING SITE III. Table 2 illustrates the complementarity of the nucleotide sequences of FLJ20401 BINDING SITE, designated SEQ ID:19447, to the nucleotide sequence of VGAM1958 RNA, herein designated VGAM RNA, also designated SEQ ID:4669.

Another function of VGAM1958 is therefore inhibition of FLJ20401 (Accession NM_017805). Accordingly, utilities of VGAM1958 include diagnosis, prevention and treatment of diseases and clinical conditions associated with FLJ20401. FLJ20413 (Accession NM_017808) is another VGAM1958 host target gene. FLJ20413 BINDING SITE is HOST TARGET binding site found in the 3' untranslated region of mRNA encoded by FLJ20413, corresponding to a HOST TARGET binding site such as BINDING SITE I, BINDING SITE II or BINDING SITE III. Table 2 illustrates the complementarity of the nucleotide sequences of FLJ20413 BINDING SITE, designated SEQ ID:19452, to the nucleotide sequence of VGAM1958 RNA, herein designated VGAM RNA, also designated SEQ ID:4669.

Another function of VGAM1958 is therefore inhibition of FLJ20413 (Accession NM_017808). Accordingly, utilities of VGAM1958 include diagnosis, prevention and treatment of diseases and clinical conditions associated with FLJ20413. FLJ20421 (Accession NM_017813) is another VGAM1958 host target gene. FLJ20421 BINDING SITE is HOST TARGET binding site found in the 5' untranslated region of mRNA encoded by FLJ20421, corresponding to a HOST TARGET binding site such as BINDING SITE I, BINDING SITE II or BINDING SITE III. Table 2 illustrates the complementarity of the nucleotide sequences of FLJ20421 BINDING SITE, designated SEQ ID:19461, to the nucleotide sequence of VGAM1958 RNA, herein designated VGAM RNA, also designated SEQ ID:4669.

Another function of VGAM1958 is therefore inhibition of FLJ20421 (Accession NM_017813). Accordingly, utilities of VGAM1958 include diagnosis, prevention and treatment of diseases and clinical conditions associated with FLJ20421. FLJ20435 (Accession NM_017821) is another VGAM1958 host target gene. FLJ20435 BINDING SITE is HOST TARGET binding site found in the 3' untranslated region of mRNA encoded by FLJ20435, corresponding to a HOST TARGET binding site such as BINDING SITE I, BINDING SITE II or BINDING SITE III. Table 2 illustrates the complementarity of the nucleotide sequences of FLJ20435 BINDING SITE, designated SEQ ID:19470, to the nucleotide sequence of VGAM1958 RNA, herein designated VGAM RNA, also designated SEQ ID:4669.

Another function of VGAM1958 is therefore inhibition of FLJ20435 (Accession NM_017821). Accordingly, utilities of VGAM1958 include diagnosis, prevention and treatment of diseases and clinical conditions associated with FLJ20435. FLJ20508 (Accession NM_017850) is another VGAM1958 host target gene. FLJ20508 BINDING SITE is HOST TARGET binding site found in the 5' untranslated region of mRNA encoded by FLJ20508, corresponding to a HOST TARGET binding site such as BINDING SITE I, BINDING SITE II or BINDING SITE III. Table 2 illustrates the complementarity of the nucleotide sequences of FLJ20508 BINDING SITE, designated SEQ ID:19519, to the nucleotide sequence of VGAM1958 RNA, herein designated VGAM RNA, also designated SEQ ID:4669.

Another function of VGAM1958 is therefore inhibition of FLJ20508 (Accession NM_017850). Accordingly, utilities of VGAM1958 include diagnosis, prevention and treatment of diseases and clinical conditions associated with FLJ20508. FLJ20539 (Accession NM_017870) is another VGAM1958 host target gene. FLJ20539 BINDING SITE is HOST TARGET binding site found in the 5' untranslated region of mRNA encoded by FLJ20539, corresponding to a HOST TARGET binding site such as BINDING SITE I, BINDING SITE II or BINDING SITE III. Table 2 illustrates the complementarity of the nucleotide sequences of FLJ20539 BINDING SITE, designated SEQ ID:19542, to the nucleotide sequence of VGAM1958 RNA, herein designated VGAM RNA, also designated SEQ ID:4669.

Another function of VGAM1958 is therefore inhibition of FLJ20539 (Accession NM_017870). Accordingly, utilities of VGAM1958 include diagnosis, prevention and treatment of diseases and clinical conditions associated with FLJ20539. FLJ20584 (Accession NM_017891) is another VGAM1958 host target gene. FLJ20584 BINDING SITE is HOST TARGET binding site found in the 3' untranslated region of mRNA encoded by FLJ20584, corresponding to a HOST TARGET binding site such as BINDING SITE I, BINDING SITE II or BINDING SITE III. Table 2 illustrates the complementarity of the nucleotide sequences of FLJ20584 BINDING SITE, designated SEQ ID:19557, to the nucleotide sequence of VGAM1958 RNA, herein designated VGAM RNA, also designated SEQ ID:4669.

Another function of VGAM1958 is therefore inhibition of FLJ20584 (Accession NM_017891). Accordingly, utilities of VGAM1958 include diagnosis, prevention and treatment of diseases and clinical conditions associated with FLJ20584. FLJ20668 (Accession NM_017923) is another VGAM1958 host target gene. FLJ20668 BINDING SITE is HOST TARGET binding site found in the 3' untranslated region of mRNA encoded by FLJ20668, corresponding to a HOST TARGET binding site such as BINDING SITE I, BINDING SITE II or BINDING SITE III. Table 2 illustrates the complementarity of the nucleotide sequences of FLJ20668 BINDING SITE, designated SEQ ID:19588, to the nucleotide sequence of VGAM1958 RNA, herein designated VGAM RNA, also designated SEQ ID:4669.

Another function of VGAM1958 is therefore inhibition of FLJ20668 (Accession NM_017923). Accordingly, utilities of VGAM1958 include diagnosis, prevention and treatment of diseases and clinical conditions associated with FLJ20668. FLJ20671 (Accession NM_017924) is another VGAM1958 host target gene. FLJ20671 BINDING SITE is HOST TARGET binding site found in the 3' untranslated region of mRNA encoded by FLJ20671, corresponding to a HOST TARGET binding site such as BINDING SITE I, BINDING SITE II or BINDING SITE III. Table 2 illustrates the complementarity of the nucleotide sequences of FLJ20671 BINDING SITE, designated SEQ ID:19591, to the nucleotide sequence of VGAM1958 RNA, herein designated VGAM RNA, also designated SEQ ID:4669.

Another function of VGAM1958 is therefore inhibition of FLJ20671 (Accession NM_017924). Accordingly, utilities of VGAM1958 include diagnosis, prevention and treatment of diseases and clinical conditions associated with FLJ20671. FLJ20695 (Accession NM_017929) is another VGAM1958 host target gene. FLJ20695 BINDING SITE is HOST TARGET binding site found in the 3' untranslated region of mRNA encoded by FLJ20695, corresponding to a HOST TARGET binding site such as BINDING SITE I, BINDING SITE II or BINDING SITE III. Table 2 illustrates the complementarity of the nucleotide sequences of FLJ20695 BINDING SITE, designated SEQ ID:19614, to the nucleotide sequence of VGAM1958 RNA, herein designated VGAM RNA, also designated SEQ ID:4669.

Another function of VGAM1958 is therefore inhibition of FLJ20695 (Accession NM_017929). Accordingly, utilities of VGAM1958 include diagnosis, prevention and treatment of diseases and clinical conditions associated with FLJ20695. FLJ20783 (Accession NM_017958) is another VGAM1958 host target gene. FLJ20783 BINDING SITE is HOST TARGET binding site found in the 3' untranslated region of mRNA encoded by FLJ20783, corresponding to a HOST TARGET binding site such as BINDING SITE I, BINDING SITE II or BINDING SITE III. Table 2 illustrates the complementarity of the nucleotide sequences of FLJ20783 BINDING SITE, designated SEQ ID:19671, to the nucleotide sequence of VGAM1958 RNA, herein designated VGAM RNA, also designated SEQ ID:4669.

Another function of VGAM1958 is therefore inhibition of FLJ20783 (Accession NM_017958). Accordingly, utilities of VGAM1958 include diagnosis, prevention and treatment of diseases and clinical conditions associated with FLJ20783. FLJ21032 (Accession NM_024906) is another VGAM1958 host target gene. FLJ21032 BINDING SITE is HOST TARGET binding site found in the 3' untranslated region of mRNA encoded by FLJ21032, corresponding to a HOST TARGET binding site such as BINDING SITE I, BINDING SITE II or BINDING SITE III. Table 2 illustrates the complementarity of the nucleotide sequences of FLJ21032 BINDING SITE, designated SEQ ID:24399, to the nucleotide sequence of VGAM1958 RNA, herein designated VGAM RNA, also designated SEQ ID:4669.

Another function of VGAM1958 is therefore inhibition of FLJ21032 (Accession NM_024906). Accordingly, utilities of VGAM1958 include diagnosis, prevention and treatment of diseases and clinical conditions associated with FLJ21032. FLJ21324 (Accession XM_165988) is another VGAM1958 host target gene. FLJ21324 BINDING SITE1 and FLJ21324 BINDING SITE2 are HOST TARGET binding sites found in untranslated regions of mRNA encoded by FLJ21324, corresponding to HOST TARGET binding sites such as BINDING SITE I, BINDING SITE II or BINDING SITE III. Table 2 illustrates the complementarity of the nucleotide sequences of FLJ21324 BINDING SITE1 and FLJ21324 BINDING SITE2, designated SEQ ID:43827 and SEQ ID:43829 respectively, to the nucleotide sequence of VGAM1958 RNA, herein designated VGAM RNA, also designated SEQ ID:4669.

Another function of VGAM1958 is therefore inhibition of FLJ21324 (Accession XM_165988). Accordingly, utilities of VGAM1958 include diagnosis, prevention and treatment of diseases and clinical conditions associated with FLJ21324. FLJ21841 (Accession NM_024609) is another VGAM1958 host target gene. FLJ21841 BINDING SITE is HOST TARGET binding site found in the 3' untranslated region of mRNA encoded by FLJ21841, corresponding to a HOST TARGET binding site such as BINDING SITE I, BINDING SITE II or BINDING SITE III. Table 2 illustrates the complementarity of the nucleotide sequences of FLJ21841 BINDING SITE, designated SEQ ID:23863, to the nucleotide sequence of VGAM1958 RNA, herein designated VGAM RNA, also designated SEQ ID:4669.

Another function of VGAM1958 is therefore inhibition of FLJ21841 (Accession NM_024609). Accordingly, utilities of VGAM1958 include diagnosis, prevention and treatment of diseases and clinical conditions associated with FLJ21841. FLJ22167 (Accession NM_024533) is another VGAM1958 host target gene. FLJ22167 BINDING SITE is HOST TARGET binding site found in the 3' untranslated region of mRNA encoded by FLJ22167, corresponding to a HOST TARGET binding site such as BINDING SITE I, BINDING SITE II or BINDING SITE III. Table 2 illustrates the complementarity of the nucleotide sequences of FLJ22167 BINDING SITE, designated SEQ ID:23741, to the nucleotide sequence of VGAM1958 RNA, herein designated VGAM RNA, also designated SEQ ID:4669.

Another function of VGAM1958 is therefore inhibition of FLJ22167 (Accession NM_024533). Accordingly, utilities of VGAM1958 include diagnosis, prevention and treatment of diseases and clinical conditions associated with FLJ22167. FLJ22283 (Accession NM_032220) is another VGAM1958 host target gene. FLJ22283 BINDING SITE is HOST TARGET binding site found in the 5' untranslated region of mRNA encoded by FLJ22283, corresponding to a HOST TARGET binding site such as BINDING SITE I, BINDING SITE II or BINDING SITE III. Table 2 illustrates the complementarity of the nucleotide sequences of FLJ22283 BINDING SITE, designated SEQ ID:25945, to the nucleotide sequence of VGAM1958 RNA, herein designated VGAM RNA, also designated SEQ ID:4669.

Another function of VGAM1958 is therefore inhibition of FLJ22283 (Accession NM_032220). Accordingly, utilities of VGAM1958 include diagnosis, prevention and treatment of diseases and clinical conditions associated with FLJ22283. FLJ22405 (Accession NM_022485) is another VGAM1958 host target gene. FLJ22405 BINDING SITE is HOST TARGET binding site found in the 5' untranslated region of mRNA encoded by FLJ22405, corresponding to a HOST TARGET binding site such as BINDING SITE I, BINDING SITE II or BINDING SITE III. Table 2 illustrates the complementarity of the nucleotide sequences of FLJ22405 BINDING SITE, designated SEQ ID:22865, to the nucleotide sequence of VGAM1958 RNA, herein designated VGAM RNA, also designated SEQ ID:4669.

Another function of VGAM1958 is therefore inhibition of FLJ22405 (Accession NM_022485). Accordingly, utilities of VGAM1958 include diagnosis, prevention and treatment of diseases and clinical conditions associated with FLJ22405. FLJ22593 (Accession NM_024703) is another VGAM1958 host target gene. FLJ22593 BINDING SITE1 and FLJ22593 BINDING SITE2 are HOST TARGET binding sites found in untranslated regions of mRNA encoded by FLJ22593, corresponding to HOST TARGET binding sites such as BINDING SITE I, BINDING SITE II or BINDING SITE III. Table 2 illustrates the complementarity of the nucleotide sequences of FLJ22593 BINDING SITE1 and FLJ22593 BINDING SITE2, designated SEQ ID:24018 and SEQ ID:24019 respectively, to the nucleotide sequence of VGAM1958 RNA, herein designated VGAM RNA, also designated SEQ ID:4669.

Another function of VGAM1958 is therefore inhibition of FLJ22593 (Accession NM_024703). Accordingly, utilities of VGAM1958 include diagnosis, prevention and treatment of diseases and clinical conditions associated with FLJ22593. FLJ22969 (Accession XM_044006) is another VGAM1958 host target gene. FLJ22969 BINDING SITE is HOST TARGET binding site found in the 3' untranslated region of mRNA encoded by FLJ22969, corresponding to a HOST TARGET binding site such as BINDING SITE I, BINDING SITE II or BINDING SITE III. Table 2 illustrates the complementarity of the nucleotide sequences of FLJ22969 BINDING SITE, designated SEQ ID:34065, to the nucleotide sequence of VGAM1958 RNA, herein designated VGAM RNA, also designated SEQ ID:4669.

Another function of VGAM1958 is therefore inhibition of FLJ22969 (Accession XM_044006). Accordingly, utilities of VGAM1958 include diagnosis, prevention and treatment of diseases and clinical conditions associated with FLJ22969. FLJ23027 (Accession NM_032233) is another VGAM1958 host target gene. FLJ23027 BINDING SITE is HOST TARGET binding site found in the 3' untranslated region of mRNA encoded by FLJ23027, corresponding to a HOST TARGET binding site such as BINDING SITE I, BINDING SITE II or BINDING SITE III. Table 2 illustrates the complementarity of the nucleotide sequences of FLJ23027 BINDING SITE, designated SEQ ID:25954, to the nucleotide sequence of VGAM1958 RNA, herein designated VGAM RNA, also designated SEQ ID:4669.

Another function of VGAM1958 is therefore inhibition of FLJ23027 (Accession NM_032233). Accordingly, utilities of VGAM1958 include diagnosis, prevention and treatment of diseases and clinical conditions associated with FLJ23027. FLJ23058 (Accession NM_024696) is another VGAM1958 host target gene. FLJ23058 BINDING SITE is HOST TARGET binding site found in the 3' untranslated region of mRNA encoded by FLJ23058, corresponding to a HOST TARGET binding site such as BINDING SITE I, BINDING SITE II or BINDING SITE III. Table 2 illustrates the complementarity of the nucleotide sequences of FLJ23058 BINDING SITE, designated SEQ ID:24004, to the nucleotide sequence of VGAM1958 RNA, herein designated VGAM RNA, also designated SEQ ID:4669.

Another function of VGAM1958 is therefore inhibition of FLJ23058 (Accession NM_024696). Accordingly, utilities of VGAM1958 include diagnosis, prevention and treatment of diseases and clinical conditions associated with FLJ23058. FLJ23129 (Accession NM_024763) is another VGAM1958 host target gene. FLJ23129 BINDING SITE is HOST TARGET binding site found in the 3' untranslated region of mRNA encoded by FLJ23129, corresponding to a HOST TARGET binding site such as BINDING SITE I, BINDING SITE II or BINDING SITE III. Table 2 illustrates the complementarity of the nucleotide sequences of FLJ23129 BINDING SITE, designated SEQ ID:24121, to the nucleotide sequence of VGAM1958 RNA, herein designated VGAM RNA, also designated SEQ ID:4669.

Another function of VGAM1958 is therefore inhibition of FLJ23129 (Accession NM_024763). Accordingly, utilities of VGAM1958 include diagnosis, prevention and treatment of diseases and clinical conditions associated with FLJ23129. FLJ23309 (Accession NM_024896) is another VGAM1958 host target gene. FLJ23309 BINDING SITE is HOST TARGET binding site found in the 3' untranslated region of mRNA encoded by FLJ23309, corresponding to a HOST TARGET binding site such as BINDING SITE I, BINDING SITE II or BINDING SITE III. Table 2 illustrates the complementarity of the nucleotide sequences of FLJ23309 BINDING SITE, designated SEQ ID:24377, to the nucleotide sequence of VGAM1958 RNA, herein designated VGAM RNA, also designated SEQ ID:4669.

Another function of VGAM1958 is therefore inhibition of FLJ23309 (Accession NM_024896). Accordingly, utilities of VGAM1958 include diagnosis, prevention and treatment of diseases and clinical conditions associated with FLJ23309. FLJ25416 (Accession NM_145018) is another VGAM1958 host target gene. FLJ25416 BINDING SITE is HOST TARGET binding site found in the 5' untranslated region of mRNA encoded by FLJ25416, corresponding to a HOST TARGET binding site such as BINDING SITE I, BINDING SITE II or BINDING SITE III. Table 2 illustrates the complementarity of the nucleotide sequences of FLJ25416 BINDING SITE, designated SEQ ID:29626, to the nucleotide sequence of VGAM1958 RNA, herein designated VGAM RNA, also designated SEQ ID:4669.

Another function of VGAM1958 is therefore inhibition of FLJ25416 (Accession NM_145018). Accordingly, utilities of VGAM1958 include diagnosis, prevention and treatment of diseases and clinical conditions associated with FLJ25416. FLJ31101 (Accession NM_017964) is another VGAM1958 host target gene. FLJ31101 BINDING SITE is HOST TARGET binding site found in the 3' untranslated region of mRNA encoded by FLJ31101, corresponding to a HOST TARGET binding site such as BINDING SITE I, BINDING SITE II or BINDING SITE III. Table 2 illustrates the complementarity of the nucleotide sequences of FLJ31101 BINDING SITE, designated SEQ ID:19683, to the nucleotide sequence of VGAM1958 RNA, herein designated VGAM RNA, also designated SEQ ID:4669.

Another function of VGAM1958 is therefore inhibition of FLJ31101 (Accession NM_017964). Accordingly, utilities of VGAM1958 include diagnosis, prevention and treatment of diseases and clinical conditions associated with FLJ31101. FLJ32334 (Accession NM_144565) is another VGAM1958 host target gene. FLJ32334 BINDING SITE is HOST TARGET binding site found in the 3' untranslated region of mRNA encoded by FLJ32334, corresponding to a HOST TARGET binding site such as BINDING SITE I, BINDING SITE II or BINDING SITE III. Table 2 illustrates the complementarity of the nucleotide sequences of FLJ32334 BINDING SITE, designated SEQ ID:29364, to the nucleotide sequence of VGAM1958 RNA, herein designated VGAM RNA, also designated SEQ ID:4669.

Another function of VGAM1958 is therefore inhibition of FLJ32334 (Accession NM_144565). Accordingly, utilities of VGAM1958 include diagnosis, prevention and treatment of diseases and clinical conditions associated with FLJ32334. Frequenin Homolog (Drosophila) (FREQ, Accession NM_014286) is another VGAM1958 host target gene. FREQ BINDING SITE is HOST TARGET binding site found in the 3' untranslated region of mRNA encoded by FREQ, corresponding to a HOST TARGET binding site such as BINDING SITE I, BINDING SITE II or BINDING SITE III. Table 2 illustrates the complementarity of the nucleotide sequences of FREQ BINDING SITE, designated SEQ ID:15561, to the nucleotide sequence of VGAM1958 RNA, herein designated VGAM RNA, also designated SEQ ID:4669.

Another function of VGAM1958 is therefore inhibition of Frequenin Homolog (Drosophila) (FREQ, Accession NM_014286). Accordingly, utilities of VGAM1958 include diagnosis, prevention and treatment of diseases and clinical conditions associated with FREQ. Far Upstream Element (FUSE) Binding Protein 3 (FUBP3, Accession XM_033327) is another VGAM1958 host target gene. FUBP3 BINDING SITE is HOST TARGET binding site found in the 3' untranslated region of mRNA encoded by FUBP3, corresponding to a HOST TARGET binding site such as BINDING SITE I, BINDING SITE II or BINDING SITE III. Table 2 illustrates the complementarity of the nucleotide sequences of FUBP3 BINDING SITE, designated SEQ ID:31877, to the nucleotide sequence of VGAM1958 RNA, herein designated VGAM RNA, also designated SEQ ID:4669.

Another function of VGAM1958 is therefore inhibition of Far Upstream Element (FUSE) Binding Protein 3 (FUBP3, Accession XM_033327). Accordingly, utilities of VGAM1958 include diagnosis, prevention and treatment of diseases and clinical conditions associated with FUBP3. GAPCENA (Accession NM_012197) is another VGAM1958 host target gene. GAPCENA BINDING SITE is HOST TARGET binding site found in the 3' untranslated region of mRNA encoded by GAPCENA, corresponding to a HOST TARGET binding site such as BINDING SITE I, BINDING SITE II or BINDING SITE III. Table 2 illustrates the complementarity of the nucleotide sequences of GAPCENA BINDING SITE, designated SEQ ID:14495, to the nucleotide sequence of VGAM1958 RNA, herein designated VGAM RNA, also designated SEQ ID:4669.

Another function of VGAM1958 is therefore inhibition of GAPCENA (Accession NM_012197). Accordingly, utilities of VGAM1958 include diagnosis, prevention and treatment of diseases and clinical conditions associated with GAPCENA. GBTS1 (Accession NM_145173) is another VGAM1958 host target gene. GBTS1 BINDING SITE is HOST TARGET binding site found in the 3' untranslated region of mRNA encoded by GBTS1, corresponding to a HOST TARGET binding site such as BINDING SITE I, BINDING SITE II or BINDING SITE III. Table 2 illustrates the complementarity of the nucleotide sequences of GBTS1 BINDING SITE, designated SEQ ID:29730, to the nucleotide sequence of VGAM1958 RNA, herein designated VGAM RNA, also designated SEQ ID:4669.

Another function of VGAM1958 is therefore inhibition of GBTS1 (Accession NM_145173). Accordingly, utilities of VGAM1958 include diagnosis, prevention and treatment of diseases and clinical conditions associated with GBTS1. G Protein-coupled Receptor Kinase-interactor 1 (GIT1, Accession NM_014030) is another VGAM1958 host target gene. GIT1 BINDING SITE is HOST TARGET binding site found in the 3' untranslated region of mRNA encoded by GIT1, corresponding to a HOST TARGET binding site such as BINDING SITE I, BINDING SITE II or BINDING SITE III. Table 2 illustrates the complementarity of the nucleotide sequences of GIT1 BINDING SITE, designated SEQ ID:15255, to the nucleotide sequence of VGAM1958 RNA, herein designated VGAM RNA, also designated SEQ ID:4669.

Another function of VGAM1958 is therefore inhibition of G Protein-coupled Receptor Kinase-interactor 1 (GIT1, Accession NM_014030). Accordingly, utilities of VGAM1958 include diagnosis, prevention and treatment of diseases and clinical conditions associated with GIT1. Guanine Nucleotide Binding Protein (G protein), Gamma 4 (GNG4, Accession NM_004485) is another VGAM1958 host target gene. GNG4 BINDING SITE is HOST TARGET binding site found in the 5' untranslated region of mRNA encoded by GNG4, corresponding to a HOST TARGET binding site such as BINDING SITE I, BINDING SITE II or BINDING SITE III. Table 2 illustrates the complementarity of the nucleotide sequences of GNG4 BINDING SITE, designated SEQ ID:10809, to the nucleotide sequence of VGAM1958 RNA, herein designated VGAM RNA, also designated SEQ ID:4669.

Another function of VGAM1958 is therefore inhibition of Guanine Nucleotide Binding Protein (G protein), Gamma 4 (GNG4, Accession NM_004485). Accordingly, utilities of VGAM1958 include diagnosis, prevention and treatment of diseases and clinical conditions associated with GNG4. Glycoprotein V (platelet) (GP5, Accession NM_004488) is another VGAM1958 host target gene. GP5 BINDING SITE is HOST TARGET binding site found in the 3' untranslated region of mRNA encoded by GP5, corresponding to a HOST TARGET binding site such as BINDING SITE I, BINDING SITE II or BINDING SITE III. Table 2 illustrates the complementarity of the nucleotide sequences of GP5 BINDING SITE, designated SEQ ID:10823, to the nucleotide sequence of VGAM1958 RNA, herein designated VGAM RNA, also designated SEQ ID:4669.

Another function of VGAM1958 is therefore inhibition of Glycoprotein V (platelet) (GP5, Accession NM_004488). Accordingly, utilities of VGAM1958 include diagnosis, prevention and treatment of diseases and clinical conditions associated with GP5. Glycoprotein A33 (transmembrane) (GPA33, Accession NM_005814) is another VGAM1958 host target gene. GPA33 BINDING SITE is HOST TARGET binding site found in the 3' untranslated region of mRNA encoded by GPA33, corresponding to a HOST TARGET binding site such as BINDING SITE I, BINDING SITE II or BINDING SITE III. Table 2 illustrates the complementarity of the nucleotide sequences of GPA33 BINDING SITE, designated SEQ ID:12405, to the nucleotide sequence of VGAM1958 RNA, herein designated VGAM RNA, also designated SEQ ID:4669.

Another function of VGAM1958 is therefore inhibition of Glycoprotein A33 (transmembrane) (GPA33, Accession NM_005814). Accordingly, utilities of VGAM1958 include diagnosis, prevention and treatment of diseases and clinical conditions associated with GPA33. GR6 (Accession NM_007354) is another VGAM1958 host target gene. GR6 BINDING SITE is HOST TARGET binding site found in the 3' untranslated region of mRNA encoded by GR6, corresponding to a HOST TARGET binding site such as BINDING SITE I, BINDING SITE II or BINDING SITE III. Table 2 illustrates the complementarity of the nucleotide sequences of GR6 BINDING SITE, designated SEQ ID:14286, to the nucleotide sequence of VGAM1958 RNA, herein designated VGAM RNA, also designated SEQ ID:4669.

Another function of VGAM1958 is therefore inhibition of GR6 (Accession NM_007354). Accordingly, utilities of VGAM1958 include diagnosis, prevention and treatment of diseases and clinical conditions associated with GR6. GS3955 (Accession NM_021643) is another VGAM1958 host target gene. GS3955 BINDING SITE is HOST TARGET binding site found in the 3' untranslated region of mRNA encoded by GS3955, corresponding to a HOST TARGET binding site such as BINDING SITE I, BINDING SITE II or BINDING SITE III. Table 2 illustrates the complementarity of the nucleotide sequences of GS3955 BINDING SITE, designated SEQ ID:22304, to the nucleotide sequence of VGAM1958 RNA, herein designated VGAM RNA, also designated SEQ ID:4669.

Another function of VGAM1958 is therefore inhibition of GS3955 (Accession NM_021643). Accordingly, utilities of VGAM1958 include diagnosis, prevention and treatment of diseases and clinical conditions associated with GS3955. General Transcription Factor IIIC, Polypeptide 2, Beta 110 kDa (GTF3C2, Accession NM_001521) is another VGAM1958 host target gene. GTF3C2 BINDING SITE is HOST TARGET binding site found in the 3' untranslated region of mRNA encoded by GTF3C2, corresponding to a HOST TARGET binding site such as BINDING SITE I, BINDING SITE II or BINDING SITE III. Table 2 illustrates the complementarity of the nucleotide sequences of GTF3C2 BINDING SITE, designated SEQ ID:7262, to the nucleotide sequence of VGAM1958 RNA, herein designated VGAM RNA, also designated SEQ ID:4669.

Another function of VGAM1958 is therefore inhibition of General Transcription Factor IIIC, Polypeptide 2, Beta 110 kDa (GTF3C2, Accession NM_001521). Accordingly, utilities of VGAM1958 include diagnosis, prevention and treatment of diseases and clinical conditions associated with GTF3C2. H-L(3)MBT (Accession NM_015478) is another VGAM1958 host target gene. H-L(3)MBT BINDING SITE is HOST TARGET binding site found in the 3' untranslated region of mRNA encoded by H-L(3)MBT, corresponding to a HOST TARGET binding site such as BINDING SITE I, BINDING SITE II or BINDING SITE III. Table 2 illustrates the complementarity of the nucleotide sequences of H-L(3)MBT BINDING SITE, designated SEQ ID:17754, to the nucleotide sequence of VGAM1958 RNA, herein designated VGAM RNA, also designated SEQ ID:4669.

Another function of VGAM1958 is therefore inhibition of H-L(3)MBT (Accession NM_015478). Accordingly, utilities of VGAM1958 include diagnosis, prevention and treatment of diseases and clinical conditions associated with H-L(3)MBT. H-plk (Accession NM_015852) is another VGAM1958 host target gene. H-plk BINDING SITE is HOST TARGET binding site found in the 5' untranslated region of mRNA encoded by H-plk, corresponding to a HOST TARGET binding site such as BINDING SITE I, BINDING SITE II or BINDING SITE III. Table 2 illustrates the complementarity of the nucleotide sequences of H-plk BINDING SITE, designated SEQ ID:17982, to the nucleotide sequence of VGAM1958 RNA, herein designated VGAM RNA, also designated SEQ ID:4669.

Another function of VGAM1958 is therefore inhibition of H-plk (Accession NM_015852). Accordingly, utilities of VGAM1958 include diagnosis, prevention and treatment of diseases and clinical conditions associated with H-plk. HCA4 (Accession XM_085287) is another VGAM1958 host target gene. HCA4 BINDING SITE is HOST TARGET binding site found in the 3' untranslated region of mRNA encoded by HCA4, corresponding to a HOST TARGET binding site such as BINDING SITE I, BINDING SITE II or BINDING SITE III. Table 2 illustrates the complementarity of the nucleotide sequences of HCA4 BINDING SITE, designated SEQ ID:38028, to the nucleotide sequence of VGAM1958 RNA, herein designated VGAM RNA, also designated SEQ ID:4669.

Another function of VGAM1958 is therefore inhibition of HCA4 (Accession XM_085287). Accordingly, utilities of VGAM1958 include diagnosis, prevention and treatment of diseases and clinical conditions associated with HCA4. Hect Domain and RLD 3 (HERC3, Accession NM_014606) is another VGAM1958 host target gene. HERC3 BINDING SITE is HOST TARGET binding site found in the 3' untranslated region of mRNA encoded by HERC3, corresponding to a HOST TARGET binding site such as BINDING SITE I, BINDING SITE II or BINDING SITE III. Table 2 illustrates the complementarity of the nucleotide sequences of HERC3 BINDING SITE, designated SEQ ID:15971, to the nucleotide sequence of VGAM1958 RNA, herein designated VGAM RNA, also designated SEQ ID:4669.

Another function of VGAM1958 is therefore inhibition of Hect Domain and RLD 3 (HERC3, Accession NM_014606). Accordingly, utilities of VGAM1958 include diagnosis, prevention and treatment of diseases and clinical conditions associated with HERC3. Hairy/enhancer-of-split Related with YRPW Motif-like (HEYL, Accession NM_014571) is another VGAM1958 host target gene. HEYL BINDING SITE1 and HEYL BINDING SITE2 are HOST TARGET binding sites found in untranslated regions of mRNA encoded by HEYL, corresponding to HOST TARGET binding sites such as BINDING SITE I, BINDING SITE II or BINDING SITE III. Table 2 illustrates the complementarity of the nucleotide sequences of HEYL BINDING SITE1 and HEYL BINDING SITE2, designated SEQ ID:15927 and SEQ ID:15933 respectively, to the nucleotide sequence of VGAM1958 RNA, herein designated VGAM RNA, also designated SEQ ID:4669.

Another function of VGAM1958 is therefore inhibition of Hairy/enhancer-of-split Related with YRPW Motif-like (HEYL, Accession NM_014571). Accordingly, utilities of VGAM1958 include diagnosis, prevention and treatment of diseases and clinical conditions associated with HEYL. HRI-HFB2436 (Accession NM_014345) is another VGAM1958 host target gene. HRIHFB2436 BINDING SITE is HOST TARGET binding site found in the 5' untranslated region of mRNA encoded by HRIHFB2436, corresponding to a HOST TARGET binding site such as BINDING SITE I, BINDING SITE II or BINDING SITE III. Table 2 illustrates the complementarity of the nucleotide sequences of HRIHFB2436 BINDING SITE, designated SEQ ID:15664, to the nucleotide sequence of VGAM1958 RNA, herein designated VGAM RNA, also designated SEQ ID:4669.

Another function of VGAM1958 is therefore inhibition of HRIHFB2436 (Accession NM_014345). Accordingly, utilities of VGAM1958 include diagnosis, prevention and treatment of diseases and clinical conditions associated with HRI-HFB2436. HSA404617 (Accession XM_052600) is another VGAM1958 host target gene. HSA404617 BINDING SITE is HOST TARGET binding site found in the 5' untranslated region of mRNA encoded by HSA404617, corresponding to a HOST TARGET binding site such as BINDING SITE I, BINDING SITE II or BINDING SITE III. Table 2 illustrates the complementarity of the nucleotide sequences of HSA404617 BINDING SITE, designated SEQ ID:36002, to the nucleotide sequence of VGAM1958 RNA, herein designated VGAM RNA, also designated SEQ ID:4669.

Another function of VGAM1958 is therefore inhibition of HSA404617 (Accession XM_052600). Accordingly, utilities of VGAM1958 include diagnosis, prevention and treatment of diseases and clinical conditions associated with HSA404617. HSNOV1 (Accession NM_017515) is another VGAM1958 host target gene. HSNOV1 BINDING SITE is HOST TARGET binding site found in the 3' untranslated region of mRNA encoded by HSNOV1, corresponding to a HOST TARGET binding site such as BINDING SITE I, BINDING SITE II or BINDING SITE III. Table 2 illustrates the complementarity of the nucleotide sequences of HSNOV1 BINDING SITE, designated SEQ ID:18966, to the nucleotide sequence of VGAM1958 RNA, herein designated VGAM RNA, also designated SEQ ID:4669.

Another function of VGAM1958 is therefore inhibition of HSNOV1 (Accession NM_017515). Accordingly, utilities of VGAM1958 include diagnosis, prevention and treatment of diseases and clinical conditions associated with HSNOV1. Heat Shock 27 kDa Protein Family, Member 7 (cardiovascular) (HSPB7, Accession NM_014424) is another VGAM1958 host target gene. HSPB7 BINDING SITE is HOST TARGET binding site found in the 3' untranslated region of mRNA encoded by HSPB7, corresponding to a HOST TARGET binding site such as BINDING SITE I, BINDING SITE II or BINDING SITE III. Table 2 illustrates the complementarity of the nucleotide sequences of HSPB7 BINDING SITE, designated SEQ ID:15781, to the nucleotide sequence of VGAM1958 RNA, herein designated VGAM RNA, also designated SEQ ID:4669.

Another function of VGAM1958 is therefore inhibition of Heat Shock 27kDa Protein Family, Member 7 (cardiovascular) (HSPB7, Accession NM_014424). Accordingly, utilities of VGAM1958 include diagnosis, prevention and treatment of diseases and clinical conditions associated with HSPB7. HSPC055 (Accession NM_014153) is another VGAM1958 host target gene. HSPC055 BINDING SITE is HOST TARGET binding site found in the 5' untranslated region of mRNA encoded by HSPC055, corresponding to a HOST TARGET binding site such as BINDING SITE I, BINDING SITE II or BINDING SITE III. Table 2 illustrates the complementarity of the nucleotide sequences of HSPC055 BINDING SITE, designated SEQ ID:15435, to the nucleotide sequence of VGAM1958 RNA, herein designated VGAM RNA, also designated SEQ ID:4669.

Another function of VGAM1958 is therefore inhibition of HSPC055 (Accession NM_014153). Accordingly, utilities of VGAM1958 include diagnosis, prevention and treatment of diseases and clinical conditions associated with HSPC055. HSU79303 (Accession NM_013301) is another VGAM1958 host target gene. HSU79303 BINDING SITE is HOST TARGET binding site found in the 3' untranslated region of mRNA encoded by HSU79303, corresponding to a HOST TARGET binding site such as BINDING SITE I, BINDING SITE II or BINDING SITE III. Table 2 illustrates the complementarity of the nucleotide sequences of HSU79303 BINDING SITE, designated SEQ ID:14961, to the nucleotide sequence of VGAM1958 RNA, herein designated VGAM RNA, also designated SEQ ID:4669.

Another function of VGAM1958 is therefore inhibition of HSU79303 (Accession NM_013301). Accordingly, utilities of VGAM1958 include diagnosis, prevention and treatment of diseases and clinical conditions associated with HSU79303. Integrin, Beta 8 (ITGB8, Accession NM_002214) is another VGAM1958 host target gene. ITGB8 BINDING SITE is HOST TARGET binding site found in the 5' untranslated region of mRNA encoded by ITGB8, corresponding to a HOST TARGET binding site such as BINDING SITE I, BINDING SITE II or BINDING SITE III. Table 2 illustrates the complementarity of the nucleotide sequences of ITGB8 BINDING SITE, designated SEQ ID:7979, to the nucleotide sequence of VGAM1958 RNA, herein designated VGAM RNA, also designated SEQ ID:4669.

Another function of VGAM1958 is therefore inhibition of Integrin, Beta 8 (ITGB8, Accession NM_002214). Accordingly, utilities of VGAM1958 include diagnosis, prevention and treatment of diseases and clinical conditions associated with ITGB8. Junctional Adhesion Molecule 1 (JAM1, Accession NM_016946) is another VGAM1958 host target gene. JAM1 BINDING SITE1 through JAM1 BINDING SITE4 are HOST TARGET binding sites found in untranslated regions of mRNA encoded by JAM1, corresponding to HOST TARGET binding sites such as BINDING SITE I, BINDING SITE II or BINDING SITE III. Table 2 illustrates the complementarity of the nucleotide sequences of JAM1 BINDING SITE1 through JAM1 BINDING SITE4, designated SEQ ID:18858, SEQ ID:29325, SEQ ID:29334 and SEQ ID:29345 respectively, to the nucleotide sequence of VGAM1958 RNA, herein designated VGAM RNA, also designated SEQ ID:4669.

Another function of VGAM1958 is therefore inhibition of Junctional Adhesion Molecule 1 (JAM1, Accession NM_016946). Accordingly, utilities of VGAM1958 include diagnosis, prevention and treatment of diseases and clinical conditions associated with JAM1. Potassium Voltage-gated Channel, Delayed-rectifier, Subfamily S, Member 1 (KCNS1, Accession NM_002251) is another VGAM1958 host target gene. KCNS1 BINDING SITE1 and KCNS1 BINDING SITE2 are HOST TARGET binding sites found in untranslated regions of mRNA encoded by KCNS1, corresponding to HOST TARGET binding sites such as BINDING SITE I, BINDING SITE II or BINDING SITE III. Table 2 illustrates the complementarity of the nucleotide sequences of KCNS1 BINDING SITE1 and KCNS1 BINDING SITE2, designated SEQ ID:8044 and SEQ ID:8047 respectively, to the nucleotide sequence of VGAM1958 RNA, herein designated VGAM RNA, also designated SEQ ID:4669.

Another function of VGAM1958 is therefore inhibition of Potassium Voltage-gated Channel, Delayed-rectifier, Subfamily S, Member 1 (KCNS1, Accession NM_002251). Accordingly, utilities of VGAM1958 include diagnosis, prevention and treatment of diseases and clinical conditions associated with KCNS1. KH Domain Containing, RNA Binding, Signal Transduction Associated 3 (KHDRBS3, Accession NM_006558) is another VGAM1958 host target gene. KHDRBS3 BINDING SITE is HOST TARGET binding site found in the 5' untranslated region of mRNA encoded by KHDRBS3, corresponding to a HOST TARGET binding site such as BINDING SITE I, BINDING SITE II or BINDING SITE III. Table 2 illustrates the complementarity of the nucleotide sequences of KHDRBS3 BINDING SITE, designated SEQ ID:13326, to the nucleotide sequence of VGAM1958 RNA, herein designated VGAM RNA, also designated SEQ ID:4669.

Another function of VGAM1958 is therefore inhibition of KH Domain Containing, RNA Binding, Signal Transduction Associated 3 (KHDRBS3, Accession NM_006558). Accordingly, utilities of VGAM1958 include diagnosis, prevention and treatment of diseases and clinical conditions associated with KHDRBS3. KIAA0014 (Accession NM_014665) is another VGAM1958 host target gene. KIAA0014 BINDING SITE is HOST TARGET binding site found in the 3' untranslated region of mRNA encoded by KIAA0014, corresponding to a HOST TARGET binding site such as BINDING SITE I, BINDING SITE II or BINDING SITE III. Table 2 illustrates the complementarity of the nucleotide sequences of KIAA0014 BINDING SITE, designated SEQ ID:16115, to the nucleotide sequence of VGAM1958 RNA, herein designated VGAM RNA, also designated SEQ ID:4669.

Another function of VGAM1958 is therefore inhibition of KIAA0014 (Accession NM_014665). Accordingly, utilities of VGAM1958 include diagnosis, prevention and treatment of diseases and clinical conditions associated with KIAA0014. KIAA0053 (Accession NM_014882) is another VGAM1958 host target gene. KIAA0053 BINDING SITE is HOST TARGET binding site found in the 5' untranslated region of mRNA encoded by KIAA0053, corresponding to a HOST TARGET binding site such as BINDING SITE I, BINDING SITE II or BINDING SITE III. Table 2 illustrates the complementarity of the nucleotide sequences of KIAA0053 BINDING SITE, designated SEQ ID:17031, to the nucleotide sequence of VGAM1958 RNA, herein designated VGAM RNA, also designated SEQ ID:4669.

Another function of VGAM1958 is therefore inhibition of KIAA0053 (Accession NM_014882). Accordingly, utilities of VGAM1958 include diagnosis, prevention and treatment of diseases and clinical conditions associated with KIAA0053. KIAA0121 (Accession XM_052386) is another VGAM1958 host target gene. KIAA0121 BINDING SITE is HOST TARGET binding site found in the 3' untranslated region of mRNA encoded by KIAA0121, corresponding to a HOST TARGET binding site such as BINDING SITE I, BINDING SITE II or BINDING SITE III. Table 2 illustrates the complementarity of the nucleotide sequences of KIAA0121 BINDING SITE, designated SEQ ID:35970, to the nucleotide sequence of VGAM1958 RNA, herein designated VGAM RNA, also designated SEQ ID:4669.

Another function of VGAM1958 is therefore inhibition of KIAA0121 (Accession XM_052386). Accordingly, utilities of VGAM1958 include diagnosis, prevention and treatment of diseases and clinical conditions associated with KIAA0121. KIAA0141 (Accession NM_014773) is another VGAM1958 host target gene. KIAA0141 BINDING SITE1 and KIAA0141 BINDING SITE2 are HOST TARGET binding sites found in untranslated regions of mRNA encoded by KIAA0141, corresponding to HOST TARGET binding sites such as BINDING SITE I, BINDING SITE II or BINDING SITE III. Table 2 illustrates the complementarity of the nucleotide sequences of KIAA0141 BINDING SITE1 and KIAA0141 BINDING SITE2, designated SEQ ID:16583 and SEQ ID:16585 respectively, to the nucleotide sequence of VGAM1958 RNA, herein designated VGAM RNA, also designated SEQ ID:4669.

Another function of VGAM1958 is therefore inhibition of KIAA0141 (Accession NM_014773). Accordingly, utilities of VGAM1958 include diagnosis, prevention and treatment of diseases and clinical conditions associated with KIAA0141. KIAA0146 (Accession XM_088282) is another VGAM1958 host target gene. KIAA0146 BINDING SITE is HOST TARGET binding site found in the 5' untranslated region of mRNA encoded by KIAA0146, corresponding to a HOST TARGET binding site such as BINDING SITE I, BINDING SITE II or BINDING SITE III. Table 2 illustrates the complementarity of the nucleotide sequences of KIAA0146 BINDING SITE, designated SEQ ID:39583, to the nucleotide sequence of VGAM1958 RNA, herein designated VGAM RNA, also designated SEQ ID:4669.

Another function of VGAM1958 is therefore inhibition of KIAA0146 (Accession XM_088282). Accordingly, utilities of VGAM1958 include diagnosis, prevention and treatment of diseases and clinical conditions associated with KIAA0146. KIAA0152 (Accession NM_014730) is another VGAM1958 host target gene. KIAA0152 BINDING SITE1 and KIAA0152 BINDING SITE2 are HOST TARGET binding sites found in untranslated regions of mRNA encoded by KIAA0152, corresponding to HOST TARGET binding sites such as BINDING SITE I, BINDING SITE II or BINDING SITE III. Table 2 illustrates the complementarity of the nucleotide sequences of KIAA0152 BINDING SITE1 and KIAA0152 BINDING SITE2, designated SEQ ID:16334 and SEQ ID:16339 respectively, to the nucleotide sequence of VGAM1958 RNA, herein designated VGAM RNA, also designated SEQ ID:4669.

Another function of VGAM1958 is therefore inhibition of KIAA0152 (Accession NM_014730). Accordingly, utilities of VGAM1958 include diagnosis, prevention and treatment of diseases and clinical conditions associated with KIAA0152. KIAA0161 (Accession NM_014746) is another VGAM1958 host target gene. KIAA0161 BINDING SITE1 and KIAA0161 BINDING SITE2 are HOST TARGET binding sites found in untranslated regions of mRNA encoded by KIAA0161, corresponding to HOST TARGET binding sites such as BINDING SITE I, BINDING SITE II or BINDING SITE III. Table 2 illustrates the complementarity of the nucleotide sequences of KIAA0161 BINDING SITE1 and KIAA0161 BINDING SITE2, designated SEQ ID:16431 and SEQ ID:32824 respectively, to the nucleotide sequence of VGAM1958 RNA, herein designated VGAM RNA, also designated SEQ ID:4669.

Another function of VGAM1958 is therefore inhibition of KIAA0161 (Accession NM_014746). Accordingly, utilities of VGAM1958 include diagnosis, prevention and treatment of diseases and clinical conditions associated with KIAA0161. KIAA0247 (Accession NM_014734) is another VGAM1958 host target gene. KIAA0247 BINDING SITE is HOST TARGET binding site found in the 3' untranslated region of mRNA encoded by KIAA0247, corresponding to a HOST TARGET binding site such as BINDING SITE I, BINDING SITE II or BINDING SITE III. Table 2 illustrates the complementarity of the nucleotide sequences of KIAA0247 BINDING SITE, designated SEQ ID:16375, to the nucleotide sequence of VGAM1958 RNA, herein designated VGAM RNA, also designated SEQ ID:4669.

Another function of VGAM1958 is therefore inhibition of KIAA0247 (Accession NM_014734). Accordingly, utilities of VGAM1958 include diagnosis, prevention and treatment of diseases and clinical conditions associated with KIAA0247. KIAA0265 (Accession XM_045954) is another VGAM1958 host target gene. KIAA0265 BINDING SITE is HOST TARGET binding site found in the 3' untranslated region of mRNA encoded by KIAA0265, corresponding to a HOST TARGET binding site such as BINDING SITE I, BINDING SITE II or BINDING SITE III. Table 2 illustrates the complementarity of the nucleotide sequences of KIAA0265 BINDING SITE, designated SEQ ID:34623, to the nucleotide sequence of VGAM1958 RNA, herein designated VGAM RNA, also designated SEQ ID:4669.

Another function of VGAM1958 is therefore inhibition of KIAA0265 (Accession XM_045954). Accordingly, utilities of VGAM1958 include diagnosis, prevention and treatment of diseases and clinical conditions associated with KIAA0265. KIAA0266 (Accession NM_021645) is another VGAM1958 host target gene. KIAA0266 BINDING SITE is HOST TARGET binding site found in the 3' untranslated region of mRNA encoded by KIAA0266, corresponding to a HOST TARGET binding site such as BINDING SITE I, BINDING SITE II or BINDING SITE III. Table 2 illustrates the complementarity of the nucleotide sequences of KIAA0266 BINDING SITE, designated SEQ ID:22308, to the nucleotide sequence of VGAM1958 RNA, herein designated VGAM RNA, also designated SEQ ID:4669.

Another function of VGAM1958 is therefore inhibition of KIAA0266 (Accession NM_021645). Accordingly, utilities of VGAM1958 include diagnosis, prevention and treatment of diseases and clinical conditions associated with KIAA0266. KIAA0298 (Accession XM_084529) is another VGAM1958 host target gene. KIAA0298 BINDING SITE is HOST TARGET binding site found in the 3' untranslated region of mRNA encoded by KIAA0298, corresponding to a HOST TARGET binding site such as BINDING SITE I, BINDING SITE II or BINDING SITE III. Table 2 illustrates the complementarity of the nucleotide sequences of KIAA0298 BINDING SITE, designated SEQ ID:37626, to the nucleotide sequence of VGAM1958 RNA, herein designated VGAM RNA, also designated SEQ ID:4669.

Another function of VGAM1958 is therefore inhibition of KIAA0298 (Accession XM_084529). Accordingly, utilities of VGAM1958 include diagnosis, prevention and treatment of diseases and clinical conditions associated with KIAA0298. KIAA0318 (Accession XM_044334) is another VGAM1958 host target gene. KIAA0318 BINDING SITE is HOST TARGET binding site found in the 3' untranslated region of mRNA encoded by KIAA0318, corresponding to a HOST TARGET binding site such as BINDING SITE I, BINDING SITE II or BINDING SITE III. Table 2 illustrates the complementarity of the nucleotide sequences of KIAA0318 BINDING SITE, designated SEQ ID:34186, to the nucleotide sequence of VGAM1958 RNA, herein designated VGAM RNA, also designated SEQ ID:4669.

Another function of VGAM1958 is therefore inhibition of KIAA0318 (Accession XM_044334). Accordingly, utilities of VGAM1958 include diagnosis, prevention and treatment of diseases and clinical conditions associated with KIAA0318. KIAA0321 (Accession XM_031077) is another VGAM1958 host target gene. KIAA0321 BINDING SITE is HOST TARGET binding site found in the 3' untranslated region of mRNA encoded by KIAA0321, corresponding to a HOST TARGET binding site such as BINDING SITE I, BINDING SITE II or BINDING SITE III. Table 2 illustrates the complementarity of the nucleotide sequences of KIAA0321 BINDING SITE, designated SEQ ID:31266, to the nucleotide sequence of VGAM1958 RNA, herein designated VGAM RNA, also designated SEQ ID:4669.

Another function of VGAM1958 is therefore inhibition of KIAA0321 (Accession XM_031077). Accordingly, utilities of VGAM1958 include diagnosis, prevention and treatment of diseases and clinical conditions associated with KIAA0321. KIAA0335 (Accession NM_014803) is another VGAM1958 host target gene. KIAA0335 BINDING SITE is HOST TARGET binding site found in the 3' untranslated region of mRNA encoded by KIAA0335, corresponding to a HOST TARGET binding site such as BINDING SITE I, BINDING SITE II or BINDING SITE III. Table 2 illustrates the complementarity of the nucleotide sequences of KIAA0335 BINDING SITE, designated SEQ ID:16733, to the nucleotide sequence of VGAM1958 RNA, herein designated VGAM RNA, also designated SEQ ID:4669.

Another function of VGAM1958 is therefore inhibition of KIAA0335 (Accession NM_014803). Accordingly, utilities of VGAM1958 include diagnosis, prevention and treatment of diseases and clinical conditions associated with KIAA0335. KIAA0349 (Accession XM_166449) is another VGAM1958 host target gene. KIAA0349 BINDING SITE is HOST TARGET binding site found in the 3' untranslated region of mRNA encoded by KIAA0349, corresponding to a HOST TARGET binding site such as BINDING SITE I, BINDING SITE II or BINDING SITE III. Table 2 illustrates the complementarity of the nucleotide sequences of KIAA0349 BINDING SITE, designated SEQ ID:44341, to the nucleotide sequence of VGAM1958 RNA, herein designated VGAM RNA, also designated SEQ ID:4669.

Another function of VGAM1958 is therefore inhibition of KIAA0349 (Accession XM_166449). Accordingly, utilities of VGAM1958 include diagnosis, prevention and treatment of diseases and clinical conditions associated with KIAA0349. KIAA0390 (Accession NM_014717) is another VGAM1958 host target gene. KIAA0390 BINDING SITE is HOST TARGET binding site found in the 3' untranslated region of mRNA encoded by KIAA0390, corresponding to a HOST TARGET binding site such as BINDING SITE I, BINDING SITE II or BINDING SITE III. Table 2 illustrates the complementarity of the nucleotide sequences of KIAA0390 BINDING SITE, designated SEQ ID:16270, to the nucleotide sequence of VGAM1958 RNA, herein designated VGAM RNA, also designated SEQ ID:4669.

Another function of VGAM1958 is therefore inhibition of KIAA0390 (Accession NM_014717). Accordingly, utilities of VGAM1958 include diagnosis, prevention and treatment of diseases and clinical conditions associated with KIAA0390. KIAA0420 (Accession XM_032693) is another VGAM1958 host target gene. KIAA0420 BINDING SITE is HOST TARGET binding site found in the 3' untranslated region of mRNA encoded by KIAA0420, corresponding to a HOST TARGET binding site such as BINDING SITE I, BINDING SITE II or BINDING SITE III. Table 2 illustrates the complementarity of the nucleotide sequences of KIAA0420 BINDING SITE, designated SEQ ID:31722, to the nucleotide sequence of VGAM1958 RNA, herein designated VGAM RNA, also designated SEQ ID:4669.

Another function of VGAM1958 is therefore inhibition of KIAA0420 (Accession XM_032693). Accordingly, utilities of VGAM1958 include diagnosis, prevention and treatment of diseases and clinical conditions associated with KIAA0420. KIAA0430 (Accession NM_019081) is another VGAM1958 host target gene. KIAA0430 BINDING SITE is HOST TARGET binding site found in the 3' untranslated region of mRNA encoded by KIAA0430, corresponding to a HOST TARGET binding site such as BINDING SITE I, BINDING SITE II or BINDING SITE III. Table 2 illustrates the complementarity of the nucleotide sequences of KIAA0430 BINDING SITE, designated SEQ ID:21151, to the nucleotide sequence of VGAM1958 RNA, herein designated VGAM RNA, also designated SEQ ID:4669.

Another function of VGAM1958 is therefore inhibition of KIAA0430 (Accession NM_019081). Accordingly, utilities of VGAM1958 include diagnosis, prevention and treatment of diseases and clinical conditions associated with KIAA0430. KIAA0444 (Accession XM_030999) is another VGAM1958 host target gene. KIAA0444 BINDING SITE1 through KIAA0444 BINDING SITE4 are HOST TARGET binding sites found in untranslated regions of mRNA encoded by KIAA0444, corresponding to HOST TARGET binding sites such as BINDING SITE I, BINDING SITE II or BINDING SITE III. Table 2 illustrates the complementarity of the nucleotide sequences of KIAA0444 BINDING SITE1 through KIAA0444 BINDING SITE4, designated SEQ ID:31239, SEQ ID:31241, SEQ ID:31243 and SEQ ID:31245 respectively, to the nucleotide sequence of VGAM1958 RNA, herein designated VGAM RNA, also designated SEQ ID:4669.

Another function of VGAM1958 is therefore inhibition of KIAA0444 (Accession XM_030999). Accordingly, utilities of VGAM1958 include diagnosis, prevention and treatment of diseases and clinical conditions associated with KIAA0444. KIAA0493 (Accession XM_034717) is another VGAM1958 host target gene. KIAA0493 BINDING SITE1 and KIAA0493 BINDING SITE2 are HOST TARGET binding sites found in untranslated regions of mRNA encoded by KIAA0493, corresponding to HOST TARGET binding sites such as BINDING SITE I, BINDING SITE II or BINDING SITE III. Table 2 illustrates the complementarity of the nucleotide sequences of KIAA0493 BINDING SITE1 and KIAA0493 BINDING SITE2, designated SEQ ID:32136 and SEQ ID:32137 respectively, to the nucleotide sequence of VGAM1958 RNA, herein designated VGAM RNA, also designated SEQ ID:4669.

Another function of VGAM1958 is therefore inhibition of KIAA0493 (Accession XM_034717). Accordingly, utilities of VGAM1958 include diagnosis, prevention and treatment of diseases and clinical conditions associated with KIAA0493. KIAA0515 (Accession XM_033380) is another VGAM1958 host target gene. KIAA0515 BINDING SITE1 and KIAA0515 BINDING SITE2 are HOST TARGET binding sites found in untranslated regions of mRNA encoded by KIAA0515, corresponding to HOST TARGET binding sites such as BINDING SITE I, BINDING SITE II or BINDING SITE III. Table 2 illustrates the complementarity of the nucleotide sequences of KIAA0515 BINDING SITE1 and KIAA0515 BINDING SITE2, designated SEQ ID:31916 and SEQ ID:31919 respectively, to the nucleotide sequence of VGAM1958 RNA, herein designated VGAM RNA, also designated SEQ ID:4669.

Another function of VGAM1958 is therefore inhibition of KIAA0515 (Accession XM_033380). Accordingly, utilities of VGAM1958 include diagnosis, prevention and treatment of diseases and clinical conditions associated with KIAA0515. KIAA0552 (Accession NM_014731) is another VGAM1958 host target gene. KIAA0552 BINDING SITE is HOST TARGET binding site found in the 3' untranslated region of mRNA encoded by KIAA0552, corresponding to a HOST TARGET binding site such as BINDING SITE I, BINDING SITE II or BINDING SITE III. Table 2 illustrates the complementarity of the nucleotide sequences of KIAA0552 BINDING SITE, designated SEQ ID:16349, to the nucleotide sequence of VGAM1958 RNA, herein designated VGAM RNA, also designated SEQ ID:4669.

Another function of VGAM1958 is therefore inhibition of KIAA0552 (Accession NM_014731). Accordingly, utilities of VGAM1958 include diagnosis, prevention and treatment of diseases and clinical conditions associated with KIAA0552. KIAA0557 (Accession XM_085507) is another VGAM1958 host target gene. KIAA0557 BINDING SITE is HOST TARGET binding site found in the 3' untranslated region of mRNA encoded by KIAA0557, corresponding to a HOST TARGET binding site such as BINDING SITE I, BINDING SITE II or BINDING SITE III. Table 2 illustrates the complementarity of the nucleotide sequences of KIAA0557 BINDING SITE, designated SEQ ID:38205, to the nucleotide sequence of VGAM1958 RNA, herein designated VGAM RNA, also designated SEQ ID:4669.

Another function of VGAM1958 is therefore inhibition of KIAA0557 (Accession XM_085507). Accordingly, utilities of VGAM1958 include diagnosis, prevention and treatment of diseases and clinical conditions associated with KIAA0557. KIAA0560 (Accession XM_029045) is another VGAM1958 host target gene. KIAA0560 BINDING SITE is HOST TARGET binding site found in the 5' untranslated region of mRNA encoded by KIAA0560, corresponding to a HOST TARGET binding site such as BINDING SITE I, BINDING SITE II or BINDING SITE III. Table 2 illustrates the complementarity of the nucleotide sequences of KIAA0560 BINDING SITE, designated SEQ ID:30837, to the nucleotide sequence of VGAM1958 RNA, herein designated VGAM RNA, also designated SEQ ID:4669.

Another function of VGAM1958 is therefore inhibition of KIAA0560 (Accession XM_029045). Accordingly, utilities of VGAM1958 include diagnosis, prevention and treatment of diseases and clinical conditions associated with KIAA0560. KIAA0562 (Accession NM_014704) is another VGAM1958 host target gene. KIAA0562 BINDING SITE is HOST TARGET binding site found in the 3' untranslated region of mRNA encoded by KIAA0562, corresponding to a HOST TARGET binding site such as BINDING SITE I, BINDING SITE II or BINDING SITE III. Table 2 illustrates the complementarity of the nucleotide sequences of KIAA0562 BINDING SITE, designated SEQ ID:16240, to the nucleotide sequence of VGAM1958 RNA, herein designated VGAM RNA, also designated SEQ ID:4669.

Another function of VGAM1958 is therefore inhibition of KIAA0562 (Accession NM_014704). Accordingly, utilities of VGAM1958 include diagnosis, prevention and treatment of diseases and clinical conditions associated with KIAA0562. KIAA0596 (Accession XM_031706) is another VGAM1958 host target gene. KIAA0596 BINDING SITE is HOST TARGET binding site found in the 3' untranslated region of mRNA encoded by KIAA0596, corresponding to a HOST TARGET binding site such as BINDING SITE I, BINDING SITE II or BINDING SITE III. Table 2 illustrates the complementarity of the nucleotide sequences of KIAA0596 BINDING SITE, designated SEQ ID:31463, to the nucleotide sequence of VGAM1958 RNA, herein designated VGAM RNA, also designated SEQ ID:4669.

Another function of VGAM1958 is therefore inhibition of KIAA0596 (Accession XM_031706). Accordingly, utilities of VGAM1958 include diagnosis, prevention and treatment of diseases and clinical conditions associated with KIAA0596. KIAA0632 (Accession NM_015545) is another VGAM1958 host target gene. KIAA0632 BINDING SITE is HOST TARGET binding site found in the 3' untranslated region of mRNA encoded by KIAA0632, corresponding to a HOST TARGET binding site such as BINDING SITE I, BINDING SITE II or BINDING SITE III. Table 2 illustrates the complementarity of the nucleotide sequences of KIAA0632 BINDING SITE, designated SEQ ID:17808, to the nucleotide sequence of VGAM1958 RNA, herein designated VGAM RNA, also designated SEQ ID:4669.

Another function of VGAM1958 is therefore inhibition of KIAA0632 (Accession NM_015545). Accordingly, utilities of VGAM1958 include diagnosis, prevention and treatment of diseases and clinical conditions associated with KIAA0632. KIAA0638 (Accession XM_051489) is another VGAM1958 host target gene. KIAA0638 BINDING SITE is HOST TARGET binding site found in the 3' untranslated region of mRNA encoded by KIAA0638, corresponding to a HOST TARGET binding site such as BINDING SITE I, BINDING SITE II or BINDING SITE III. Table 2 illustrates the complementarity of the nucleotide sequences of KIAA0638 BINDING SITE, designated SEQ ID:35845, to the nucleotide sequence of VGAM1958 RNA, herein designated VGAM RNA, also designated SEQ ID:4669.

Another function of VGAM1958 is therefore inhibition of KIAA0638 (Accession XM_051489). Accordingly, utilities of VGAM1958 include diagnosis, prevention and treatment of diseases and clinical conditions associated with KIAA0638. KIAA0668 (Accession XM_039332) is another VGAM1958 host target gene. KIAA0668 BINDING SITE is HOST TARGET binding site found in the 5' untranslated region of mRNA encoded by KIAA0668, corresponding to a HOST TARGET binding site such as BINDING SITE I, BINDING SITE II or BINDING SITE III. Table 2 illustrates the complementarity of the nucleotide sequences of KIAA0668 BINDING SITE, designated SEQ ID:33051, to the nucleotide sequence of VGAM1958 RNA, herein designated VGAM RNA, also designated SEQ ID:4669.

Another function of VGAM1958 is therefore inhibition of KIAA0668 (Accession XM_039332). Accordingly, utilities of VGAM1958 include diagnosis, prevention and treatment of diseases and clinical conditions associated with KIAA0668. KIAA0676 (Accession NM_015043) is another VGAM1958 host target gene. KIAA0676 BINDING SITE is HOST TARGET binding site found in the 3' untranslated region of mRNA encoded by KIAA0676, corresponding to a HOST TARGET binding site such as BINDING SITE I, BINDING SITE II or BINDING SITE III. Table 2 illustrates the complementarity of the nucleotide sequences of KIAA0676 BINDING SITE, designated SEQ ID:17394, to the nucleotide sequence of VGAM1958 RNA, herein designated VGAM RNA, also designated SEQ ID:4669.

Another function of VGAM1958 is therefore inhibition of KIAA0676 (Accession NM_015043). Accordingly, utilities of VGAM1958 include diagnosis, prevention and treatment of diseases and clinical conditions associated with KIAA0676. KIAA0682 (Accession NM_014852) is another VGAM1958 host target gene. KIAA0682 BINDING SITE is HOST TARGET binding site found in the 3' untranslated region of mRNA encoded by KIAA0682, corresponding to a HOST TARGET binding site such as BINDING SITE I, BINDING SITE II or BINDING SITE III. Table 2 illustrates the complementarity of the nucleotide sequences of KIAA0682 BINDING SITE, designated SEQ ID:16899, to the nucleotide sequence of VGAM1958 RNA, herein designated VGAM RNA, also designated SEQ ID:4669.

Another function of VGAM1958 is therefore inhibition of KIAA0682 (Accession NM_014852). Accordingly, utilities of VGAM1958 include diagnosis, prevention and treatment of diseases and clinical conditions associated with KIAA0682. KIAA0720 (Accession XM_030970) is another VGAM1958 host target gene. KIAA0720 BINDING SITE is HOST TARGET binding site found in the 3' untranslated region of mRNA encoded by KIAA0720, corresponding to a HOST TARGET binding site such as BINDING SITE I, BINDING SITE II or BINDING SITE III. Table 2 illustrates the complementarity of the nucleotide sequences of KIAA0720 BINDING SITE, designated SEQ ID:31234, to the nucleotide sequence of VGAM1958 RNA, herein designated VGAM RNA, also designated SEQ ID:4669.

Another function of VGAM1958 is therefore inhibition of KIAA0720 (Accession XM_030970). Accordingly, utilities of VGAM1958 include diagnosis, prevention and treatment of diseases and clinical conditions associated with KIAA0720. KIAA0729 (Accession XM_171027) is another VGAM1958 host target gene. KIAA0729 BINDING SITE is HOST TARGET binding site found in the 3' untranslated region of mRNA encoded by KIAA0729, corresponding to a HOST TARGET binding site such as BINDING SITE I, BINDING SITE II or BINDING SITE III. Table 2 illustrates the complementarity of the nucleotide sequences of KIAA0729 BINDING SITE, designated SEQ ID:45805, to the nucleotide sequence of VGAM1958 RNA, herein designated VGAM RNA, also designated SEQ ID:4669.

Another function of VGAM1958 is therefore inhibition of KIAA0729 (Accession XM_171027). Accordingly, utilities of VGAM1958 include diagnosis, prevention and treatment of diseases and clinical conditions associated with KIAA0729. KIAA0759 (Accession XM_041090) is another VGAM1958 host target gene. KIAA0759 BINDING SITE is HOST TARGET binding site found in the 3' untranslated region of mRNA encoded by KIAA0759, corresponding to a HOST TARGET binding site such as BINDING SITE I, BINDING SITE II or BINDING SITE III. Table 2 illustrates the complementarity of the nucleotide sequences of KIAA0759 BINDING SITE, designated SEQ ID:33440, to the nucleotide sequence of VGAM1958 RNA, herein designated VGAM RNA, also designated SEQ ID:4669.

Another function of VGAM1958 is therefore inhibition of KIAA0759 (Accession XM_041090). Accordingly, utilities of VGAM1958 include diagnosis, prevention and treatment of diseases and clinical conditions associated with KIAA0759. KIAA0767 (Accession XM_027105) is another VGAM1958 host target gene. KIAA0767 BINDING SITE is HOST TARGET binding site found in the 3' untranslated region of mRNA encoded by KIAA0767, corresponding to a HOST TARGET binding site such as BINDING SITE I, BINDING SITE II or BINDING SITE III. Table 2 illustrates the complementarity of the nucleotide sequences of KIAA0767 BINDING SITE, designated SEQ ID:30408, to the nucleotide sequence of VGAM1958 RNA, herein designated VGAM RNA, also designated SEQ ID:4669.

Another function of VGAM1958 is therefore inhibition of KIAA0767 (Accession XM_027105). Accordingly, utilities of VGAM1958 include diagnosis, prevention and treatment of diseases and clinical conditions associated with KIAA0767. KIAA0773 (Accession NM_014690) is another VGAM1958 host target gene. KIAA0773 BINDING SITE is HOST TARGET binding site found in the 3' untranslated region of mRNA encoded by KIAA0773, corresponding to a HOST TARGET binding site such as BINDING SITE I, BINDING SITE II or BINDING SITE III. Table 2 illustrates the complementarity of the nucleotide sequences of KIAA0773 BINDING SITE, designated SEQ ID:16192, to the nucleotide sequence of VGAM1958 RNA, herein designated VGAM RNA, also designated SEQ ID:4669.

Another function of VGAM1958 is therefore inhibition of KIAA0773 (Accession NM_014690). Accordingly, utilities of VGAM1958 include diagnosis, prevention and treatment of diseases and clinical conditions associated with KIAA0773. KIAA0806 (Accession NM_014813) is another VGAM1958 host target gene. KIAA0806 BINDING SITE is HOST TARGET binding site found in the 3' untranslated region of mRNA encoded by KIAA0806, corresponding to a HOST TARGET binding site such as BINDING SITE I, BINDING SITE II or BINDING SITE III. Table 2 illustrates the complementarity of the nucleotide sequences of KIAA0806 BINDING SITE, designated SEQ ID:16780, to the nucleotide sequence of VGAM1958 RNA, herein designated VGAM RNA, also designated SEQ ID:4669.

Another function of VGAM1958 is therefore inhibition of KIAA0806 (Accession NM_014813). Accordingly, utilities of VGAM1958 include diagnosis, prevention and treatment of diseases and clinical conditions associated with KIAA0806. KIAA0819 (Accession XM_032996) is another VGAM1958 host target gene. KIAA0819 BINDING SITE is HOST TARGET binding site found in the 3' untranslated region of mRNA encoded by KIAA0819, corresponding to a HOST TARGET binding site such as BINDING SITE I, BINDING SITE II or BINDING SITE III. Table 2 illustrates the complementarity of the nucleotide sequences of KIAA0819 BINDING SITE, designated SEQ ID:31809, to the nucleotide sequence of VGAM1958 RNA, herein designated VGAM RNA, also designated SEQ ID:4669.

Another function of VGAM1958 is therefore inhibition of KIAA0819 (Accession XM_032996). Accordingly, utilities of VGAM1958 include diagnosis, prevention and treatment of diseases and clinical conditions associated with KIAA0819. KIAA0831 (Accession NM_014924) is another VGAM1958 host target gene. KIAA0831 BINDING SITE is HOST TARGET binding site found in the 3' untranslated region of mRNA encoded by KIAA0831, corresponding to a HOST TARGET binding site such as BINDING SITE I, BINDING SITE II or BINDING SITE III. Table 2 illustrates the complementarity of the nucleotide sequences of KIAA0831 BINDING SITE, designated SEQ ID:17208, to the nucleotide sequence of VGAM1958 RNA, herein designated VGAM RNA, also designated SEQ ID:4669.

Another function of VGAM1958 is therefore inhibition of KIAA0831 (Accession NM_014924). Accordingly, utilities of VGAM1958 include diagnosis, prevention and treatment of diseases and clinical conditions associated with KIAA0831. KIAA0870 (Accession XM_088315) is another VGAM1958 host target gene. KIAA0870 BINDING SITE is HOST TARGET binding site found in the 5' untranslated region of mRNA encoded by KIAA0870, corresponding to a HOST TARGET binding site such as BINDING SITE I, BINDING SITE II or BINDING SITE III. Table 2 illustrates the complementarity of the nucleotide sequences of KIAA0870 BINDING SITE, designated SEQ ID:39608, to the nucleotide sequence of VGAM1958 RNA, herein designated VGAM RNA, also designated SEQ ID:4669.

Another function of VGAM1958 is therefore inhibition of KIAA0870 (Accession XM_088315). Accordingly, utilities of VGAM1958 include diagnosis, prevention and treatment of diseases and clinical conditions associated with KIAA0870. KIAA0923 (Accession NM_014021) is another VGAM1958 host target gene. KIAA0923 BINDING SITE is HOST TARGET binding site found in the 3' untranslated region of mRNA encoded by KIAA0923, corresponding to a HOST TARGET binding site such as BINDING SITE I, BINDING SITE II or BINDING SITE III. Table 2 illustrates the complementarity of the nucleotide sequences of KIAA0923 BINDING SITE, designated SEQ ID:15245, to the nucleotide sequence of VGAM1958 RNA, herein designated VGAM RNA, also designated SEQ ID:4669.

Another function of VGAM1958 is therefore inhibition of KIAA0923 (Accession NM_014021). Accordingly, utilities of VGAM1958 include diagnosis, prevention and treatment of diseases and clinical conditions associated with KIAA0923. KIAA0924 (Accession NM_014897) is another VGAM1958 host target gene. KIAA0924 BINDING SITE is HOST TARGET binding site found in the 3' untranslated region of mRNA encoded by KIAA0924, corresponding to a HOST TARGET binding site such as BINDING SITE I, BINDING SITE II or BINDING SITE III. Table 2 illustrates the complementarity of the nucleotide sequences of KIAA0924 BINDING SITE, designated SEQ ID:17065, to the nucleotide sequence of VGAM1958 RNA, herein designated VGAM RNA, also designated SEQ ID:4669.

Another function of VGAM1958 is therefore inhibition of KIAA0924 (Accession NM_014897). Accordingly, utilities of VGAM1958 include diagnosis, prevention and treatment of diseases and clinical conditions associated with KIAA0924. KIAA0953 (Accession XM_039733) is another VGAM1958 host target gene. KIAA0953 BINDING SITE is HOST TARGET binding site found in the 3' untranslated region of mRNA encoded by KIAA0953, corresponding to a HOST TARGET binding site such as BINDING SITE I, BINDING SITE II or BINDING SITE III. Table 2 illustrates the complementarity of the nucleotide sequences of KIAA0953 BINDING SITE, designated SEQ ID:33165, to the nucleotide sequence of VGAM1958 RNA, herein designated VGAM RNA, also designated SEQ ID:4669.

Another function of VGAM1958 is therefore inhibition of KIAA0953 (Accession XM_039733). Accordingly, utilities of VGAM1958 include diagnosis, prevention and treatment of diseases and clinical conditions associated with KIAA0953. KIAA0978 (Accession XM_047013) is another VGAM1958 host target gene. KIAA0978 BINDING SITE is HOST TARGET binding site found in the 3' untranslated region of mRNA encoded by KIAA0978, corresponding to a HOST TARGET binding site such as BINDING SITE I, BINDING SITE II or BINDING SITE III. Table 2 illustrates the complementarity of the nucleotide sequences of KIAA0978 BINDING SITE, designated SEQ ID:34891, to the nucleotide sequence of VGAM1958 RNA, herein designated VGAM RNA, also designated SEQ ID:4669.

Another function of VGAM1958 is therefore inhibition of KIAA0978 (Accession XM_047013). Accordingly, utilities of VGAM1958 include diagnosis, prevention and treatment of diseases and clinical conditions associated with KIAA0978. KIAA1014 (Accession XM_037205) is another VGAM1958 host target gene. KIAA1014 BINDING SITE is HOST TARGET binding site found in the 3' untranslated region of mRNA encoded by KIAA1014, corresponding to a HOST TARGET binding site such as BINDING SITE I, BINDING SITE II or BINDING SITE III. Table 2 illustrates the complementarity of the nucleotide sequences of KIAA1014 BINDING SITE, designated SEQ ID:32569, to the nucleotide sequence of VGAM1958 RNA, herein designated VGAM RNA, also designated SEQ ID:4669.

Another function of VGAM1958 is therefore inhibition of KIAA1014 (Accession XM_037205). Accordingly, utilities of VGAM1958 include diagnosis, prevention and treatment of diseases and clinical conditions associated with KIAA1014. KIAA1036 (Accession NM_014909) is another VGAM1958 host target gene. KIAA1036 BINDING SITE is HOST TARGET binding site found in the 3' untranslated region of mRNA encoded by KIAA1036, corresponding to a HOST TARGET binding site such as BINDING SITE I, BINDING SITE II or BINDING SITE III. Table 2 illustrates the complementarity of the nucleotide sequences of KIAA1036 BINDING SITE, designated SEQ ID:17129, to the nucleotide sequence of VGAM1958 RNA, herein designated VGAM RNA, also designated SEQ ID:4669.

Another function of VGAM1958 is therefore inhibition of KIAA1036 (Accession NM_014909). Accordingly, utilities of VGAM1958 include diagnosis, prevention and treatment of diseases and clinical conditions associated with KIAA1036. KIAA1041 (Accession NM_014947) is another VGAM1958 host target gene. KIAA1041 BINDING SITE is HOST TARGET binding site found in the 3' untranslated region of mRNA encoded by KIAA1041, corresponding to a HOST TARGET binding site such as BINDING SITE I, BINDING SITE II or BINDING SITE III. Table 2 illustrates the complementarity of the nucleotide sequences of KIAA1041 BINDING SITE, designated SEQ ID:17267, to the nucleotide sequence of VGAM1958 RNA, herein designated VGAM RNA, also designated SEQ ID:4669.

Another function of VGAM1958 is therefore inhibition of KIAA1041 (Accession NM_014947). Accordingly, utilities of VGAM1958 include diagnosis, prevention and treatment of diseases and clinical conditions associated with KIAA1041. KIAA1045 (Accession XM_048592) is another VGAM1958 host target gene. KIAA1045 BINDING SITE is HOST TARGET binding site found in the 3' untranslated region of mRNA encoded by KIAA1045, corresponding to a HOST TARGET binding site such as BINDING SITE I, BINDING SITE II or BINDING SITE III. Table 2 illustrates the complementarity of the nucleotide sequences of KIAA1045 BINDING SITE, designated SEQ ID:35192, to the nucleotide sequence of VGAM1958 RNA, herein designated VGAM RNA, also designated SEQ ID:4669.

Another function of VGAM1958 is therefore inhibition of KIAA1045 (Accession XM_048592). Accordingly, utilities of VGAM1958 include diagnosis, prevention and treatment of diseases and clinical conditions associated with KIAA1045. KIAA1052 (Accession NM_014956) is another VGAM1958 host target gene. KIAA1052 BINDING SITE is HOST TARGET binding site found in the 3' untranslated region of mRNA encoded by KIAA1052, corresponding to a HOST TARGET binding site such as BINDING SITE I, BINDING SITE II or BINDING SITE III. Table 2 illustrates the complementarity of the nucleotide sequences of KIAA1052 BINDING SITE, designated SEQ ID:17313, to the nucleotide sequence of VGAM1958 RNA, herein designated VGAM RNA, also designated SEQ ID:4669.

Another function of VGAM1958 is therefore inhibition of KIAA1052 (Accession NM_014956). Accordingly, utilities of VGAM1958 include diagnosis, prevention and treatment of diseases and clinical conditions associated with KIAA1052. KIAA1077 (Accession XM_053496) is another VGAM1958 host target gene. KIAA1077 BINDING SITE is HOST TARGET binding site found in the 3' untranslated region of mRNA encoded by KIAA1077, corresponding to a HOST TARGET binding site such as BINDING SITE I, BINDING SITE II or BINDING SITE III. Table 2 illustrates the complementarity of the nucleotide sequences of KIAA1077 BINDING SITE, designated SEQ ID:36098, to the nucleotide sequence of VGAM1958 RNA, herein designated VGAM RNA, also designated SEQ ID:4669.

Another function of VGAM1958 is therefore inhibition of KIAA1077 (Accession XM_053496). Accordingly, utilities of VGAM1958 include diagnosis, prevention and treatment of diseases and clinical conditions associated with KIAA1077. KIAA1118 (Accession XM_045581) is another VGAM1958 host target gene. KIAA1118 BINDING SITE is HOST TARGET binding site found in the 5' untranslated region of mRNA encoded by KIAA1118, corresponding to a HOST TARGET binding site such as BINDING SITE I, BINDING SITE II or BINDING SITE III. Table 2 illustrates the complementarity of the nucleotide sequences of KIAA1118 BINDING SITE, designated SEQ ID:34486, to the nucleotide sequence of VGAM1958 RNA, herein designated VGAM RNA, also designated SEQ ID:4669.

Another function of VGAM1958 is therefore inhibition of KIAA1118 (Accession XM_045581). Accordingly, utilities of VGAM1958 include diagnosis, prevention and treatment of diseases and clinical conditions associated with KIAA1118. KIAA1128 (Accession XM_043596) is another VGAM1958 host target gene. KIAA1128 BINDING SITE is HOST TARGET binding site found in the 3' untranslated region of mRNA encoded by KIAA1128, corresponding to a HOST TARGET binding site such as BINDING SITE I, BINDING SITE II or BINDING SITE III. Table 2 illustrates the complementarity of the nucleotide sequences of KIAA1128 BINDING SITE, designated SEQ ID:33973, to the nucleotide sequence of VGAM1958 RNA, herein designated VGAM RNA, also designated SEQ ID:4669.

Another function of VGAM1958 is therefore inhibition of KIAA1128 (Accession XM_043596). Accordingly, utilities of VGAM1958 include diagnosis, prevention and treatment of diseases and clinical conditions associated with KIAA1128. KIAA1130 (Accession XM_031104) is another VGAM1958 host target gene. KIAA1130 BINDING SITE is HOST TARGET binding site found in the 3' untranslated region of mRNA encoded by KIAA1130, corresponding to a HOST TARGET binding site such as BINDING SITE I, BINDING SITE II or BINDING SITE III. Table 2 illustrates the complementarity of the nucleotide sequences of KIAA1130 BINDING SITE, designated SEQ ID:31284, to the nucleotide sequence of VGAM1958 RNA, herein designated VGAM RNA, also designated SEQ ID:4669.

Another function of VGAM1958 is therefore inhibition of KIAA1130 (Accession XM_031104). Accordingly, utilities of VGAM1958 include diagnosis, prevention and treatment of diseases and clinical conditions associated with KIAA1130. KIAA1143 (Accession XM_044014) is another VGAM1958 host target gene. KIAA1143 BINDING SITE is HOST TARGET binding site found in the 3' untranslated region of mRNA encoded by KIAA1143, corresponding to a HOST TARGET binding site such as BINDING SITE I, BINDING SITE II or BINDING SITE III. Table 2 illustrates the complementarity of the nucleotide sequences of KIAA1143 BINDING SITE, designated SEQ ID:34075, to the nucleotide sequence of VGAM1958 RNA, herein designated VGAM RNA, also designated SEQ ID:4669.

Another function of VGAM1958 is therefore inhibition of KIAA1143 (Accession XM_044014). Accordingly, utilities of VGAM1958 include diagnosis, prevention and treatment of diseases and clinical conditions associated with KIAA1143. KIAA1161 (Accession XM_088501) is another VGAM1958 host target gene. KIAA1161 BINDING SITE is HOST TARGET binding site found in the 5' untranslated region of mRNA encoded by KIAA1161, corresponding to a HOST TARGET binding site such as BINDING SITE I, BINDING SITE II or BINDING SITE III. Table 2 illustrates the complementarity of the nucleotide sequences of KIAA1161 BINDING SITE, designated SEQ ID:39746, to the nucleotide sequence of VGAM1958 RNA, herein designated VGAM RNA, also designated SEQ ID:4669.

Another function of VGAM1958 is therefore inhibition of KIAA1161 (Accession XM_088501). Accordingly, utilities of VGAM1958 include diagnosis, prevention and treatment of diseases and clinical conditions associated with KIAA1161. KIAA1181 (Accession XM_043340) is another VGAM1958 host target gene. KIAA1181 BINDING SITE is HOST TARGET binding site found in the 5' untranslated region of mRNA encoded by KIAA1181, corresponding to a HOST TARGET binding site such as BINDING SITE I, BINDING SITE II or BINDING SITE III. Table 2 illustrates the complementarity of the nucleotide sequences of KIAA1181 BINDING SITE, designated SEQ ID:33923, to the nucleotide sequence of VGAM1958 RNA, herein designated VGAM RNA, also designated SEQ ID:4669.

Another function of VGAM1958 is therefore inhibition of KIAA1181 (Accession XM_043340). Accordingly, utilities of VGAM1958 include diagnosis, prevention and treatment of diseases and clinical conditions associated with KIAA1181. KIAA1185 (Accession XM_031399) is another VGAM1958 host target gene. KIAA1185 BINDING SITE is HOST TARGET binding site found in the 3' untranslated region of mRNA encoded by KIAA1185, corresponding to a HOST TARGET binding site such as BINDING SITE I, BINDING SITE II or BINDING SITE III. Table 2 illustrates the complementarity of the nucleotide sequences of KIAA1185 BINDING SITE, designated SEQ ID:31370, to the nucleotide sequence of VGAM1958 RNA, herein designated VGAM RNA, also designated SEQ ID:4669.

Another function of VGAM1958 is therefore inhibition of KIAA1185 (Accession XM_031399). Accordingly, utilities of VGAM1958 include diagnosis, prevention and treatment of diseases and clinical conditions associated with KIAA1185. KIAA1196 (Accession XM_028968) is another VGAM1958 host target gene. KIAA1196 BINDING SITE is HOST TARGET binding site found in the 3' untranslated region of mRNA encoded by KIAA1196, corresponding to a HOST TARGET binding site such as BINDING SITE I, BINDING SITE II or BINDING SITE III. Table 2 illustrates the complementarity of the nucleotide sequences of KIAA1196 BINDING SITE, designated SEQ ID:30818, to the nucleotide sequence of VGAM1958 RNA, herein designated VGAM RNA, also designated SEQ ID:4669.

Another function of VGAM1958 is therefore inhibition of KIAA1196 (Accession XM_028968). Accordingly, utilities of VGAM1958 include diagnosis, prevention and treatment of diseases and clinical conditions associated with KIAA1196. KIAA1211 (Accession XM_044178) is another VGAM1958 host target gene. KIAA1211 BINDING SITE is HOST TARGET binding site found in the 3' untranslated region of mRNA encoded by KIAA1211, corresponding to a HOST TARGET binding site such as BINDING SITE I, BINDING SITE II or BINDING SITE III. Table 2 illustrates the complementarity of the nucleotide sequences of KIAA1211 BINDING SITE, designated SEQ ID:34165, to the nucleotide sequence of VGAM1958 RNA, herein designated VGAM RNA, also designated SEQ ID:4669.

Another function of VGAM1958 is therefore inhibition of KIAA1211 (Accession XM_044178). Accordingly, utilities of VGAM1958 include diagnosis, prevention and treatment of diseases and clinical conditions associated with KIAA1211. KIAA1228 (Accession XM_036408) is another VGAM1958 host target gene. KIAA1228 BINDING SITE is HOST TARGET binding site found in the 3' untranslated region of mRNA encoded by KIAA1228, corresponding to a HOST TARGET binding site such as BINDING SITE I, BINDING SITE II or BINDING SITE III. Table 2 illustrates the complementarity of the nucleotide sequences of KIAA1228 BINDING SITE, designated SEQ ID:32439, to the nucleotide sequence of VGAM1958 RNA, herein designated VGAM RNA, also designated SEQ ID:4669.

Another function of VGAM1958 is therefore inhibition of KIAA1228 (Accession XM_036408). Accordingly, utilities of VGAM1958 include diagnosis, prevention and treatment of diseases and clinical conditions associated with KIAA1228. KIAA1277 (Accession XM_035114) is another VGAM1958 host target gene. KIAA1277 BINDING SITE is HOST TARGET binding site found in the 3' untranslated region of mRNA encoded by KIAA1277, corresponding to a HOST TARGET binding site such as BINDING SITE I, BINDING SITE II or BINDING SITE III. Table 2 illustrates the complementarity of the nucleotide sequences of KIAA1277 BINDING SITE, designated SEQ ID:32204, to the nucleotide sequence of VGAM1958 RNA, herein designated VGAM RNA, also designated SEQ ID:4669.

Another function of VGAM1958 is therefore inhibition of KIAA1277 (Accession XM_035114). Accordingly, utilities of VGAM1958 include diagnosis, prevention and treatment of diseases and clinical conditions associated with KIAA1277. KIAA1280 (Accession XM_045766) is another VGAM1958 host target gene. KIAA1280 BINDING SITE is HOST TARGET binding site found in the 5' untranslated region of mRNA encoded by KIAA1280, corresponding to a HOST TARGET binding site such as BINDING SITE I, BINDING SITE II or BINDING SITE III. Table 2 illustrates the complementarity of the nucleotide sequences of KIAA1280 BINDING SITE, designated SEQ ID:34558, to the nucleotide sequence of VGAM1958 RNA, herein designated VGAM RNA, also designated SEQ ID:4669.

Another function of VGAM1958 is therefore inhibition of KIAA1280 (Accession XM_045766). Accordingly, utilities of VGAM1958 include diagnosis, prevention and treatment of diseases and clinical conditions associated with KIAA1280. KIAA1322 (Accession XM_052626) is another VGAM1958 host target gene. KIAA1322 BINDING SITE is HOST TARGET binding site found in the 3' untranslated region of mRNA encoded by KIAA1322, corresponding to a HOST TARGET binding site such as BINDING SITE I, BINDING SITE II or BINDING SITE III. Table 2 illustrates the complementarity of the nucleotide sequences of KIAA1322 BINDING SITE, designated SEQ ID:36032, to the nucleotide sequence of VGAM1958 RNA, herein designated VGAM RNA, also designated SEQ ID:4669.

Another function of VGAM1958 is therefore inhibition of KIAA1322 (Accession XM_052626). Accordingly, utilities of VGAM1958 include diagnosis, prevention and treatment of diseases and clinical conditions associated with KIAA1322. KIAA1332 (Accession XM_048774) is another VGAM1958 host target gene. KIAA1332 BINDING SITE is HOST TARGET binding site found in the 3' untranslated region of mRNA encoded by KIAA1332, corresponding to a HOST TARGET binding site such as BINDING SITE I, BINDING SITE II or BINDING SITE III. Table 2 illustrates the complementarity of the nucleotide sequences of KIAA1332 BINDING SITE, designated SEQ ID:35257, to the nucleotide sequence of VGAM1958 RNA, herein designated VGAM RNA, also designated SEQ ID:4669.

Another function of VGAM1958 is therefore inhibition of KIAA1332 (Accession XM_048774). Accordingly, utilities of VGAM1958 include diagnosis, prevention and treatment of diseases and clinical conditions associated with KIAA1332. KIAA1348 (Accession XM_043826) is another VGAM1958 host target gene. KIAA1348 BINDING SITE is HOST TARGET binding site found in the 3' untranslated region of mRNA encoded by KIAA1348, corresponding to a HOST TARGET binding site such as BINDING SITE I, BINDING SITE II or BINDING SITE III. Table 2 illustrates the complementarity of the nucleotide sequences of KIAA1348 BINDING SITE, designated SEQ ID:34029, to the nucleotide sequence of VGAM1958 RNA, herein designated VGAM RNA, also designated SEQ ID:4669.

Another function of VGAM1958 is therefore inhibition of KIAA1348 (Accession XM_043826). Accordingly, utilities of VGAM1958 include diagnosis, prevention and treatment of diseases and clinical conditions associated with KIAA1348. KIAA1432 (Accession XM_039698) is another VGAM1958 host target gene. KIAA1432 BINDING SITE1 and KIAA1432 BINDING SITE2 are HOST TARGET binding sites found in untranslated regions of mRNA encoded by KIAA1432, corresponding to HOST TARGET binding sites such as BINDING SITE I, BINDING SITE II or BINDING SITE III. Table 2 illustrates the complementarity of the nucleotide sequences of KIAA1432 BINDING SITE1 and KIAA1432 BINDING SITE2, designated SEQ ID:33145 and SEQ ID:33148 respectively, to the nucleotide sequence of VGAM1958 RNA, herein designated VGAM RNA, also designated SEQ ID:4669.

Another function of VGAM1958 is therefore inhibition of KIAA1432 (Accession XM_039698). Accordingly, utilities of VGAM1958 include diagnosis, prevention and treatment of diseases and clinical conditions associated with KIAA1432. KIAA1493 (Accession XM_034415) is another VGAM1958 host target gene. KIAA1493 BINDING SITE is HOST TARGET binding site found in the 3' untranslated region of mRNA encoded by KIAA1493, corresponding to a HOST TARGET binding site such as BINDING SITE I, BINDING SITE II or BINDING SITE III. Table 2 illustrates the complementarity of the nucleotide sequences of KIAA1493 BINDING SITE, designated SEQ ID:32086, to the nucleotide sequence of VGAM1958 RNA, herein designated VGAM RNA, also designated SEQ ID:4669.

Another function of VGAM1958 is therefore inhibition of KIAA1493 (Accession XM_034415). Accordingly, utilities of VGAM1958 include diagnosis, prevention and treatment of diseases and clinical conditions associated with KIAA1493. KIAA1560 (Accession XM_034422) is another VGAM1958 host target gene. KIAA1560 BINDING SITE is HOST TARGET binding site found in the 3' untranslated region of mRNA encoded by KIAA1560, corresponding to a HOST TARGET binding site such as BINDING SITE I, BINDING SITE II or BINDING SITE III. Table 2 illustrates the complementarity of the nucleotide sequences of KIAA1560 BINDING SITE, designated SEQ ID:32099, to the nucleotide sequence of VGAM1958 RNA, herein designated VGAM RNA, also designated SEQ ID:4669.

Another function of VGAM1958 is therefore inhibition of KIAA1560 (Accession XM_034422). Accordingly, utilities of VGAM1958 include diagnosis, prevention and treatment of diseases and clinical conditions associated with KIAA1560. KIAA1571 (Accession XM_027744) is another VGAM1958 host target gene. KIAA1571 BINDING SITE is HOST TARGET binding site found in the 3' untranslated region of mRNA encoded by KIAA1571, corresponding to a HOST TARGET binding site such as BINDING SITE I, BINDING SITE II or BINDING SITE III. Table 2 illustrates the complementarity of the nucleotide sequences of KIAA1571 BINDING SITE, designated SEQ ID:30563, to the nucleotide sequence of VGAM1958 RNA, herein designated VGAM RNA, also designated SEQ ID:4669.

Another function of VGAM1958 is therefore inhibition of KIAA1571 (Accession XM_027744). Accordingly, utilities of VGAM1958 include diagnosis, prevention and treatment of diseases and clinical conditions associated with KIAA1571. KIAA1576 (Accession XM_038186) is another VGAM1958 host target gene. KIAA1576 BINDING SITE is HOST TARGET binding site found in the 3' untranslated region of mRNA encoded by KIAA1576, corresponding to a HOST TARGET binding site such as BINDING SITE I, BINDING SITE II or BINDING SITE III. Table 2 illustrates the complementarity of the nucleotide sequences of KIAA1576 BINDING SITE, designated SEQ ID:32771, to the nucleotide sequence of VGAM1958 RNA, herein designated VGAM RNA, also designated SEQ ID:4669.

Another function of VGAM1958 is therefore inhibition of KIAA1576 (Accession XM_038186). Accordingly, utilities of VGAM1958 include diagnosis, prevention and treatment of diseases and clinical conditions associated with KIAA1576. KIAA1610 (Accession XM_040622) is another VGAM1958 host target gene. KIAA1610 BINDING SITE is HOST TARGET binding site found in the 3' untranslated region of mRNA encoded by KIAA1610, corresponding to a HOST TARGET binding site such as BINDING SITE I, BINDING SITE II or BINDING SITE III. Table 2 illustrates the complementarity of the nucleotide sequences of KIAA1610 BINDING SITE, designated SEQ ID:33337, to the nucleotide sequence of VGAM1958 RNA, herein designated VGAM RNA, also designated SEQ ID:4669.

Another function of VGAM1958 is therefore inhibition of KIAA1610 (Accession XM_040622). Accordingly, utilities of VGAM1958 include diagnosis, prevention and treatment of diseases and clinical conditions associated with KIAA1610. KIAA1656 (Accession XM_038022) is another VGAM1958 host target gene. KIAA1656 BINDING SITE is HOST TARGET binding site found in the 3' untranslated region of mRNA encoded by KIAA1656, corresponding to a HOST TARGET binding site such as BINDING SITE I, BINDING SITE II or BINDING SITE III. Table 2 illustrates the complementarity of the nucleotide sequences of KIAA1656 BINDING SITE, designated SEQ ID:32733, to the nucleotide sequence of VGAM1958 RNA, herein designated VGAM RNA, also designated SEQ ID:4669.

Another function of VGAM1958 is therefore inhibition of KIAA1656 (Accession XM_038022). Accordingly, utilities of VGAM1958 include diagnosis, prevention and treatment of diseases and clinical conditions associated with KIAA1656. KIAA1719 (Accession XM_042936) is another VGAM1958 host target gene. KIAA1719 BINDING SITE is HOST TARGET binding site found in the 3' untranslated region of mRNA encoded by KIAA1719, corresponding to a HOST TARGET binding site such as BINDING SITE I, BINDING SITE II or BINDING SITE III. Table 2 illustrates the complementarity of the nucleotide sequences of KIAA1719 BINDING SITE, designated SEQ ID:33820, to the nucleotide sequence of VGAM1958 RNA, herein designated VGAM RNA, also designated SEQ ID:4669.

Another function of VGAM1958 is therefore inhibition of KIAA1719 (Accession XM_042936). Accordingly, utilities of VGAM1958 include diagnosis, prevention and treatment of diseases and clinical conditions associated with KIAA1719. KIAA1750 (Accession XM_043067) is another VGAM1958 host target gene. KIAA1750 BINDING SITE is HOST TARGET binding site found in the 3' untranslated region of mRNA encoded by KIAA1750, corresponding to a HOST TARGET binding site such as BINDING SITE I, BINDING SITE II or BINDING SITE III. Table 2 illustrates the complementarity of the nucleotide sequences of KIAA1750 BINDING SITE, designated SEQ ID:33877, to the nucleotide sequence of VGAM1958 RNA, herein designated VGAM RNA, also designated SEQ ID:4669.

Another function of VGAM1958 is therefore inhibition of KIAA1750 (Accession XM_043067). Accordingly, utilities of VGAM1958 include diagnosis, prevention and treatment of diseases and clinical conditions associated with KIAA1750. KIAA1754 (Accession XM_032587) is another VGAM1958 host target gene. KIAA1754 BINDING SITE is HOST TARGET binding site found in the 3' untranslated region of mRNA encoded by KIAA1754, corresponding to a HOST TARGET binding site such as BINDING SITE I, BINDING SITE II or BINDING SITE III. Table 2 illustrates the complementarity of the nucleotide sequences of KIAA1754 BINDING SITE, designated SEQ ID:31680, to the nucleotide sequence of VGAM1958 RNA, herein designated VGAM RNA, also designated SEQ ID:4669.

Another function of VGAM1958 is therefore inhibition of KIAA1754 (Accession XM_032587). Accordingly, utilities of VGAM1958 include diagnosis, prevention and treatment of diseases and clinical conditions associated with KIAA1754. KIAA1814 (Accession XM_046822) is another VGAM1958 host target gene. KIAA1814 BINDING SITE is HOST TARGET binding site found in the 3' untranslated region of mRNA encoded by KIAA1814, corresponding to a HOST TARGET binding site such as BINDING SITE I, BINDING SITE II or BINDING SITE III. Table 2 illustrates the complementarity of the nucleotide sequences of KIAA1814 BINDING SITE, designated SEQ ID:34837, to the nucleotide sequence of VGAM1958 RNA, herein designated VGAM RNA, also designated SEQ ID:4669.

Another function of VGAM1958 is therefore inhibition of KIAA1814 (Accession XM_046822). Accordingly, utilities of VGAM1958 include diagnosis, prevention and treatment of diseases and clinical conditions associated with KIAA1814. KIAA1821 (Accession XM_050101) is another VGAM1958 host target gene. KIAA1821 BINDING SITE is HOST TARGET binding site found in the 3' untranslated region of mRNA encoded by KIAA1821, corresponding to a HOST TARGET binding site such as BINDING SITE I, BINDING SITE II or BINDING SITE III. Table 2 illustrates the complementarity of the nucleotide sequences of KIAA1821 BINDING SITE, designated SEQ ID:35550, to the nucleotide sequence of VGAM1958 RNA, herein designated VGAM RNA, also designated SEQ ID:4669.

Another function of VGAM1958 is therefore inhibition of KIAA1821 (Accession XM_050101). Accordingly, utilities of VGAM1958 include diagnosis, prevention and treatment of diseases and clinical conditions associated with KIAA1821. KIAA1854 (Accession XM_049884) is another VGAM1958 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35530, to the nucleotide sequence of VGAM1958 RNA, herein designated VGAM RNA, also designated SEQ ID:4669.

Another function of VGAM1958 is therefore inhibition of KIAA1854 (Accession XM_049884). Accordingly, utilities of VGAM1958 include diagnosis, prevention and treatment of diseases and clinical conditions associated with KIAA1854. KIAA1887 (Accession XM_084801) is another VGAM1958 host target gene. KIAA1887 BINDING SITE is HOST TARGET binding site found in the 5' untranslated region of mRNA encoded by KIAA1887, corresponding to a HOST TARGET binding site such as BINDING SITE I, BINDING SITE II or BINDING SITE III. Table 2 illustrates the complementarity of the nucleotide sequences of KIAA1887 BINDING SITE, designated SEQ ID:37713, to the nucleotide sequence of VGAM1958 RNA, herein designated VGAM RNA, also designated SEQ ID:4669.

Another function of VGAM1958 is therefore inhibition of KIAA1887 (Accession XM_084801). Accordingly, utilities of VGAM1958 include diagnosis, prevention and treatment of diseases and clinical conditions associated with KIAA1887. KIAA1894 (Accession XM_058025) is another VGAM1958 host target gene. KIAA1894 BINDING SITE is HOST TARGET binding site found in the 3' untranslated region of mRNA encoded by KIAA1894, corresponding to a HOST TARGET binding site such as BINDING SITE I, BINDING SITE II or BINDING SITE III. Table 2 illustrates the complementarity of the nucleotide sequences of KIAA1894 BINDING SITE, designated SEQ ID:36559, to the nucleotide sequence of VGAM1958 RNA, herein designated VGAM RNA, also designated SEQ ID:4669.

Another function of VGAM1958 is therefore inhibition of KIAA1894 (Accession XM_058025). Accordingly, utilities of VGAM1958 include diagnosis, prevention and treatment of diseases and clinical conditions associated with KIAA1894. KIAA1904 (Accession XM_056282) is another VGAM1958 host target gene. KIAA1904 BINDING SITE1 and KIAA1904 BINDING SITE2 are HOST TARGET binding sites found in untranslated regions of mRNA encoded by KIAA1904, corresponding to HOST TARGET binding sites such as BINDING SITE I, BINDING SITE II or BINDING SITE III. Table 2 illustrates the complementarity of the nucleotide sequences of KIAA1904 BINDING SITE1 and KIAA1904 BINDING SITE2, designated SEQ ID:36378 and SEQ ID:36379 respectively, to the nucleotide sequence of VGAM1958 RNA, herein designated VGAM RNA, also designated SEQ ID:4669.

Another function of VGAM1958 is therefore inhibition of KIAA1904 (Accession XM_056282). Accordingly, utilities of VGAM1958 include diagnosis, prevention and treatment of diseases and clinical conditions associated with KIAA1904. KIAA1924 (Accession XM_057091) is another VGAM1958 host target gene. KIAA1924 BINDING SITE is HOST TARGET binding site found in the 3' untranslated region of mRNA encoded by KIAA1924, corresponding to a HOST TARGET binding site such as BINDING SITE I, BINDING SITE II or BINDING SITE III. Table 2 illustrates the complementarity of the nucleotide sequences of KIAA1924 BINDING SITE, designated SEQ ID:36474, to the nucleotide sequence of VGAM1958 RNA, herein designated VGAM RNA, also designated SEQ ID:4669.

Another function of VGAM1958 is therefore inhibition of KIAA1924 (Accession XM_057091). Accordingly, utilities of VGAM1958 include diagnosis, prevention and treatment of diseases and clinical conditions associated with KIAA1924. KIAA1940 (Accession XM_086981) is another VGAM1958 host target gene. KIAA1940 BINDING SITE1 and KIAA1940 BINDING SITE2 are HOST TARGET binding sites found in untranslated regions of mRNA encoded by KIAA1940, corresponding to HOST TARGET binding sites such as BINDING SITE I, BINDING SITE II or BINDING SITE III. Table 2 illustrates the complementarity of the nucleotide sequences of KIAA1940 BINDING SITE1 and KIAA1940 BINDING SITE2, designated SEQ ID:39003 and SEQ ID:39007 respectively, to the nucleotide sequence of VGAM1958 RNA, herein designated VGAM RNA, also designated SEQ ID:4669.

Another function of VGAM1958 is therefore inhibition of KIAA1940 (Accession XM_086981). Accordingly, utilities of VGAM1958 include diagnosis, prevention and treatment of diseases and clinical conditions associated with KIAA1940. KOC1 (Accession XM_165847) is another VGAM1958 host target gene. KOC1 BINDING SITE is HOST TARGET binding site found in the 5' untranslated region of mRNA encoded by KOC1, corresponding to a HOST TARGET binding site such as BINDING SITE I, BINDING SITE II or BINDING SITE III. Table 2 illustrates the complementarity of the nucleotide sequences of KOC1 BINDING SITE, designated SEQ ID:43780, to the nucleotide sequence of VGAM1958 RNA, herein designated VGAM RNA, also designated SEQ ID:4669.

Another function of VGAM1958 is therefore inhibition of KOC1 (Accession XM_165847). Accordingly, utilities of VGAM1958 include diagnosis, prevention and treatment of diseases and clinical conditions associated with KOC1. Keratin Associated Protein 1-5 (KRTAP1-5, Accession NM_031957) is another VGAM1958 host target gene. KRTAP1-5 BINDING SITE is HOST TARGET binding site found in the 3' untranslated region of mRNA encoded by KRTAP1-5, corresponding to a HOST TARGET binding site such as BINDING SITE I, BINDING SITE II or BINDING SITE III. Table 2 illustrates the complementarity of the nucleotide sequences of KRTAP1-5 BINDING SITE, designated SEQ ID:25697, to the nucleotide sequence of VGAM1958 RNA, herein designated VGAM RNA, also designated SEQ ID:4669.

Another function of VGAM1958 is therefore inhibition of Keratin Associated Protein 1-5 (KRTAP1-5, Accession NM_031957). Accordingly, utilities of VGAM1958 include diagnosis, prevention and treatment of diseases and clinical conditions associated with KRTAP1-5. l (3) mbt-like (Drosophila) (L3MBTL, Accession XM_045421) is another VGAM1958 host target gene. L3MBTL BINDING SITE is HOST TARGET binding site found in the 3' untranslated region of mRNA encoded by L3MBTL, corresponding to a HOST TARGET binding site such as BINDING SITE I, BINDING SITE II or BINDING SITE III. Table 2 illustrates the complementarity of the nucleotide sequences of L3MBTL BINDING SITE, designated SEQ ID:34456, to the nucleotide sequence of VGAM1958 RNA, herein designated VGAM RNA, also designated SEQ ID:4669.

Another function of VGAM1958 is therefore inhibition of l (3) mbt-like (Drosophila) (L3MBTL, Accession XM_045421). Accordingly, utilities of VGAM1958 include diagnosis, prevention and treatment of diseases and clinical conditions associated with L3MBTL. l (3) mbt-like 2 (Drosophila) (L3MBTL2, Accession XM_114201) is another VGAM1958 host target gene. L3MBTL2 BINDING SITE is HOST TARGET binding site found in the 3' untranslated region of mRNA encoded by L3MBTL2, corresponding to a HOST TARGET binding site such as BINDING SITE I, BINDING SITE II or BINDING SITE III. Table 2 illustrates the complementarity of the nucleotide sequences of L3MBTL2 BINDING SITE, designated SEQ ID:42790, to the nucleotide sequence of VGAM1958 RNA, herein designated VGAM RNA, also designated SEQ ID:4669.

Another function of VGAM1958 is therefore inhibition of l (3) mbt-like 2 (Drosophila) (L3MBTL2, Accession XM_114201). Accordingly, utilities of VGAM1958 include diagnosis, prevention and treatment of diseases and clinical conditions associated with L3MBTL2. Lysosomal-associated Membrane Protein 3 (LAMP3, Accession XM_003022) is another VGAM1958 host target gene. LAMP3 BINDING SITE is HOST TARGET binding site found in the 3' untranslated region of mRNA encoded by LAMP3, corresponding to a HOST TARGET binding site such as BINDING SITE I, BINDING SITE II or BINDING SITE III. Table 2 illustrates the complementarity of the nucleotide sequences of LAMP3 BINDING SITE, designated SEQ ID:29919, to the nucleotide sequence of VGAM1958 RNA, herein designated VGAM RNA, also designated SEQ ID:4669.

Another function of VGAM1958 is therefore inhibition of Lysosomal-associated Membrane Protein 3 (LAMP3, Accession XM_003022). Accordingly, utilities of VGAM1958 include diagnosis, prevention and treatment of diseases and clinical conditions associated with LAMP3. LIM and SH3 Protein 1 (LASP1, Accession NM_006148) is another VGAM1958 host target gene. LASP1 BINDING SITE is HOST TARGET binding site found in the 3' untranslated region of mRNA encoded by LASP1, corresponding to a HOST TARGET binding site such as BINDING SITE I, BINDING SITE II or BINDING SITE III. Table 2 illustrates the complementarity of the nucleotide sequences of LASP1 BINDING SITE, designated SEQ ID:12797, to the nucleotide sequence of VGAM1958 RNA, herein designated VGAM RNA, also designated SEQ ID:4669.

Another function of VGAM1958 is therefore inhibition of LIM and SH3 Protein 1 (LASP1, Accession NM_006148). Accordingly, utilities of VGAM1958 include diagnosis, prevention and treatment of diseases and clinical conditions associated with LASP1. Leucine-rich Repeat LGI Family, Member 3 (LGI3, Accession NM_139278) is another VGAM1958 host target gene. LGI3 BINDING SITE is HOST TARGET binding site found in the 5' untranslated region of mRNA encoded by LGI3, corresponding to a HOST TARGET binding site such as BINDING SITE I, BINDING SITE II or BINDING SITE III. Table 2 illustrates the complementarity of the nucleotide sequences of LGI3 BINDING SITE, designated SEQ ID:29278, to the nucleotide sequence of VGAM1958 RNA, herein designated VGAM RNA, also designated SEQ ID:4669.

Another function of VGAM1958 is therefore inhibition of Leucine-rich Repeat LGI Family, Member 3 (LGI3, Accession NM_139278). Accordingly, utilities of VGAM1958 include diagnosis, prevention and treatment of diseases and clinical conditions associated with LGI3. Mitogen-activated Protein Kinase Kinase 3 (MAP2K3, Accession NM_145109) is another VGAM1958 host target gene. MAP2K3 BINDING SITE is HOST TARGET binding site found in the 5' untranslated region of mRNA encoded by MAP2K3, corresponding to a HOST TARGET binding site such as BINDING SITE I, BINDING SITE II or BINDING SITE III. Table 2 illustrates the complementarity of the nucleotide sequences of MAP2K3 BINDING SITE, designated SEQ ID:29715, to the nucleotide sequence of VGAM1958 RNA, herein designated VGAM RNA, also designated SEQ ID:4669.

Another function of VGAM1958 is therefore inhibition of Mitogen-activated Protein Kinase Kinase 3 (MAP2K3, Accession NM_145109). Accordingly, utilities of VGAM1958 include diagnosis, prevention and treatment of diseases and clinical conditions associated with MAP2K3. Mitogen-activated Protein Kinase Kinase Kinase 3 (MAP3K3, Accession NM_002401) is another VGAM1958 host target gene. MAP3K3 BINDING SITE is HOST TARGET binding site found in the 3' untranslated region of mRNA encoded by MAP3K3, corresponding to a HOST TARGET binding site such as BINDING SITE I, BINDING SITE II or BINDING SITE III. Table 2 illustrates the complementarity of the nucleotide sequences of MAP3K3 BINDING SITE, designated SEQ ID:8222, to the nucleotide sequence of VGAM1958 RNA, herein designated VGAM RNA, also designated SEQ ID:4669.

Another function of VGAM1958 is therefore inhibition of Mitogen-activated Protein Kinase Kinase Kinase 3 (MAP3K3, Accession NM_002401). Accordingly, utilities of VGAM1958 include diagnosis, prevention and treatment of diseases and clinical conditions associated with MAP3K3. MAWBP (Accession NM_022129) is another VGAM1958 host target gene. MAWBP BINDING SITE is HOST TARGET binding site found in the 5' untranslated region of mRNA encoded by MAWBP, corresponding to a HOST TARGET binding site such as BINDING SITE I, BINDING SITE II or BINDING SITE III. Table 2 illustrates the complementarity of the nucleotide sequences of MAWBP BINDING SITE, designated SEQ ID:22680, to the nucleotide sequence of VGAM1958 RNA, herein designated VGAM RNA, also designated SEQ ID:4669.

Another function of VGAM1958 is therefore inhibition of MAWBP (Accession NM_022129). Accordingly, utilities of VGAM1958 include diagnosis, prevention and treatment of diseases and clinical conditions associated with MAWBP. MBLL39 (Accession NM_144778) is another VGAM1958 host target gene. MBLL39 BINDING SITE1 through MBLL39 BINDING SITE7 are HOST TARGET binding sites found in untranslated regions of mRNA encoded by MBLL39, corresponding to HOST TARGET binding sites such as BINDING SITE I, BINDING SITE II or BINDING SITE III. Table 2 illustrates the complementarity of the nucleotide sequences of MBLL39 BINDING SITE1 through MBLL39 BINDING SITE7, designated SEQ ID:29568, SEQ ID:29571, SEQ ID:29572, SEQ ID:29578, SEQ ID:12317, SEQ ID:12318 and SEQ ID:12321 respectively, to the nucleotide sequence of VGAM1958 RNA, herein designated VGAM RNA, also designated SEQ ID:4669.

Another function of VGAM1958 is therefore inhibition of MBLL39 (Accession NM_144778). Accordingly, utilities of VGAM1958 include diagnosis, prevention and treatment of diseases and clinical conditions associated with MBLL39. MGC:5244 (Accession NM_031213) is another VGAM1958 host target gene. MGC:5244 BINDING SITE is HOST TARGET binding site found in the 5' untranslated region of mRNA encoded by MGC:5244, corresponding to a HOST TARGET binding site such as BINDING SITE I, BINDING SITE II or BINDING SITE III. Table 2 illustrates the complementarity of the nucleotide sequences of MGC:5244 BINDING SITE, designated SEQ ID:25258, to the nucleotide sequence of VGAM1958 RNA, herein designated VGAM RNA, also designated SEQ ID:4669.

Another function of VGAM1958 is therefore inhibition of MGC:5244 (Accession NM_031213). Accordingly, utilities of VGAM1958 include diagnosis, prevention and treatment of diseases and clinical conditions associated with MGC:5244. MGC10765 (Accession NM_024345) is another VGAM1958 host target gene. MGC10765 BINDING SITE is HOST TARGET binding site found in the 3' untranslated region of mRNA encoded by MGC10765, corresponding to a HOST TARGET binding site such as BINDING SITE I, BINDING SITE II or BINDING SITE III. Table 2 illustrates the complementarity of the nucleotide sequences of MGC10765 BINDING SITE, designated SEQ ID:23646, to the nucleotide sequence of VGAM1958 RNA, herein designated VGAM RNA, also designated SEQ ID:4669.

Another function of VGAM1958 is therefore inhibition of MGC10765 (Accession NM_024345). Accordingly, utilities of VGAM1958 include diagnosis, prevention and treatment of diseases and clinical conditions associated with MGC10765. MGC11034 (Accession NM_031453) is another VGAM1958 host target gene. MGC11034 BINDING SITE is HOST TARGET binding site found in the 3' untranslated region of mRNA encoded by MGC11034, corresponding to a HOST TARGET binding site such as BINDING SITE I, BINDING SITE II or BINDING SITE III. Table 2 illustrates the complementarity of the nucleotide sequences of MGC11034 BINDING SITE, designated SEQ ID:25470, to the nucleotide sequence of VGAM1958 RNA, herein designated VGAM RNA, also designated SEQ ID:4669.

Another function of VGAM1958 is therefore inhibition of MGC11034 (Accession NM_031453). Accordingly, utilities of VGAM1958 include diagnosis, prevention and treatment of diseases and clinical conditions associated with MGC11034. MGC12335 (Accession NM_032744) is another VGAM1958 host target gene. MGC12335 BINDING SITE is HOST TARGET binding site found in the 3' untranslated region of mRNA encoded by MGC12335, corresponding to a HOST TARGET binding site such as BINDING SITE I, BINDING SITE II or BINDING SITE III. Table 2 illustrates the complementarity of the nucleotide sequences of MGC12335 BINDING SITE, designated SEQ ID:26477, to the nucleotide sequence of VGAM1958 RNA, herein designated VGAM RNA, also designated SEQ ID:4669.

Another function of VGAM1958 is therefore inhibition of MGC12335 (Accession NM_032744). Accordingly, utilities of VGAM1958 include diagnosis, prevention and treatment of diseases and clinical conditions associated with MGC12335. MGC12679 (Accession NM_032733) is another VGAM1958 host target gene. MGC12679 BINDING SITE1 and MGC12679 BINDING SITE2 are HOST TARGET binding sites found in untranslated regions of mRNA encoded by MGC12679, corresponding to HOST TARGET binding sites such as BINDING SITE I, BINDING SITE II or BINDING SITE III. Table 2 illustrates the complementarity of the nucleotide sequences of MGC12679 BINDING SITE1 and MGC12679 BINDING SITE2, designated SEQ ID:26457 and SEQ ID:26459 respectively, to the nucleotide sequence of VGAM1958 RNA, herein designated VGAM RNA, also designated SEQ ID:4669.

Another function of VGAM1958 is therefore inhibition of MGC12679 (Accession NM_032733). Accordingly, utilities of VGAM1958 include diagnosis, prevention and treatment of diseases and clinical conditions associated with MGC12679. MGC13090 (Accession NM_032711) is another VGAM1958 host target gene. MGC13090 BINDING SITE is HOST TARGET binding site found in the 3' untranslated region of mRNA encoded by MGC13090, corresponding to a HOST TARGET binding site such as BINDING SITE I, BINDING SITE II or BINDING SITE III. Table 2 illustrates the complementarity of the nucleotide sequences of MGC13090 BINDING SITE, designated SEQ ID:26427, to the nucleotide sequence of VGAM1958 RNA, herein designated VGAM RNA, also designated SEQ ID:4669.

Another function of VGAM1958 is therefore inhibition of MGC13090 (Accession NM_032711). Accordingly, utilities of VGAM1958 include diagnosis, prevention and treatment of diseases and clinical conditions associated with MGC13090. MGC13170 (Accession NM_032712) is another VGAM1958 host target gene. MGC13170 BINDING SITE is HOST TARGET binding site found in the 5' untranslated region of mRNA encoded by MGC13170, corresponding to a HOST TARGET binding site such as BINDING SITE I, BINDING SITE II or BINDING SITE III. Table 2 illustrates the complementarity of the nucleotide sequences of MGC13170 BINDING SITE, designated SEQ ID:26432, to the nucleotide sequence of VGAM1958 RNA, herein designated VGAM RNA, also designated SEQ ID:4669.

Another function of VGAM1958 is therefore inhibition of MGC13170 (Accession NM_032712). Accordingly, utilities of VGAM1958 include diagnosis, prevention and treatment of diseases and clinical conditions associated with MGC13170. MGC14161 (Accession NM_032892) is another VGAM1958 host target gene. MGC14161 BINDING SITE is HOST TARGET binding site found in the 3' untranslated region of mRNA encoded by MGC14161, corresponding to a HOST TARGET binding site such as BINDING SITE I, BINDING SITE II or BINDING SITE III. Table 2 illustrates the complementarity of the nucleotide sequences of MGC14161 BINDING SITE, designated SEQ ID:26716, to the nucleotide sequence of VGAM1958 RNA, herein designated VGAM RNA, also designated SEQ ID:4669.

Another function of VGAM1958 is therefore inhibition of MGC14161 (Accession NM_032892). Accordingly, utilities of VGAM1958 include diagnosis, prevention and treatment of diseases and clinical conditions associated with MGC14161. MGC14407 (Accession NM_032908) is another VGAM1958 host target gene. MGC14407 BINDING SITE is HOST TARGET binding site found in the 5' untranslated region of mRNA encoded by MGC14407, corresponding to a HOST TARGET binding site such as BINDING SITE I, BINDING SITE II or BINDING SITE III. Table 2 illustrates the complementarity of the nucleotide sequences of MGC14407 BINDING SITE, designated SEQ ID:26729, to the nucleotide sequence of VGAM1958 RNA, herein designated VGAM RNA, also designated SEQ ID:4669.

Another function of VGAM1958 is therefore inhibition of MGC14407 (Accession NM_032908). Accordingly, utilities of VGAM1958 include diagnosis, prevention and treatment of diseases and clinical conditions associated with MGC14407. MGC15476 (Accession NM_145056) is another VGAM1958 host target gene. MGC15476 BINDING SITE is HOST TARGET binding site found in the 3' untranslated region of mRNA encoded by MGC15476, corresponding to a HOST TARGET binding site such as BINDING SITE I, BINDING SITE II or BINDING SITE III. Table 2 illustrates the complementarity of the nucleotide sequences of MGC15476 BINDING SITE, designated SEQ ID:29691, to the nucleotide sequence of VGAM1958 RNA, herein designated VGAM RNA, also designated SEQ ID:4669.

Another function of VGAM1958 is therefore inhibition of MGC15476 (Accession NM_145056). Accordingly, utilities of VGAM1958 include diagnosis, prevention and treatment of diseases and clinical conditions associated with MGC15476. MGC16169 (Accession NM_033115) is another VGAM1958 host target gene. MGC16169 BINDING SITE is HOST TARGET binding site found in the 5' untranslated region of mRNA encoded by MGC16169, corresponding to a HOST TARGET binding site such as BINDING SITE I, BINDING SITE II or BINDING SITE III. Table 2 illustrates the complementarity of the nucleotide sequences of MGC16169 BINDING SITE, designated SEQ ID:26963, to the nucleotide sequence of VGAM1958 RNA, herein designated VGAM RNA, also designated SEQ ID:4669.

Another function of VGAM1958 is therefore inhibition of MGC16169 (Accession NM_033115). Accordingly, utilities of VGAM1958 include diagnosis, prevention and treatment of diseases and clinical conditions associated with MGC16169. MGC16491 (Accession NM_052943) is another VGAM1958 host target gene. MGC16491 BINDING SITE is HOST TARGET binding site found in the 5' untranslated region of mRNA encoded by MGC16491, corresponding to a HOST TARGET binding site such as BINDING SITE I, BINDING SITE II or BINDING SITE III. Table 2 illustrates the complementarity of the nucleotide sequences of MGC16491 BINDING SITE, designated SEQ ID:27501, to the nucleotide sequence of VGAM1958 RNA, herein designated VGAM RNA, also designated SEQ ID:4669.

Another function of VGAM1958 is therefore inhibition of MGC16491 (Accession NM_052943). Accordingly, utilities of VGAM1958 include diagnosis, prevention and treatment of diseases and clinical conditions associated with MGC16491. MGC1842 (Accession XM_037797) is another VGAM1958 host target gene. MGC1842 BINDING SITE is HOST TARGET binding site found in the 5' untranslated region of mRNA encoded by MGC1842, corresponding to a HOST TARGET binding site such as BINDING SITE I, BINDING SITE II or BINDING SITE III. Table 2 illustrates the complementarity of the nucleotide sequences of MGC1842 BINDING SITE, designated SEQ ID:32685, to the nucleotide sequence of VGAM1958 RNA, herein designated VGAM RNA, also designated SEQ ID:4669.

Another function of VGAM1958 is therefore inhibition of MGC1842 (Accession XM_037797). Accordingly, utilities of VGAM1958 include diagnosis, prevention and treatment of diseases and clinical conditions associated with MGC1842. MGC20253 (Accession NM_144583) is another VGAM1958 host target gene. MGC20253 BINDING SITE is HOST TARGET binding site found in the 3' untranslated region of mRNA encoded by MGC20253, corresponding to a HOST TARGET binding site such as BINDING SITE I, BINDING SITE II or BINDING SITE III. Table 2 illustrates the complementarity of the nucleotide sequences of MGC20253 BINDING SITE, designated SEQ ID:29399, to the nucleotide sequence of VGAM1958 RNA, herein designated VGAM RNA, also designated SEQ ID:4669.

Another function of VGAM1958 is therefore inhibition of MGC20253 (Accession NM_144583). Accordingly, utilities of VGAM1958 include diagnosis, prevention and treatment of diseases and clinical conditions associated with MGC20253. MGC20470 (Accession NM_145053) is another VGAM1958 host target gene. MGC20470 BINDING SITE is HOST TARGET binding site found in the 3' untranslated region of mRNA encoded by MGC20470, corresponding to a HOST TARGET binding site such as BINDING SITE I, BINDING SITE II or BINDING SITE III. Table 2 illustrates the complementarity of the nucleotide sequences of MGC20470 BINDING SITE, designated SEQ ID:29687, to the nucleotide sequence of VGAM1958 RNA, herein designated VGAM RNA, also designated SEQ ID:4669.

Another function of VGAM1958 is therefore inhibition of MGC20470 (Accession NM_145053). Accordingly, utilities of VGAM1958 include diagnosis, prevention and treatment of diseases and clinical conditions associated with MGC20470. MGC21854 (Accession NM_052862) is another VGAM1958 host target gene. MGC21854 BINDING SITE is HOST TARGET binding site found in the 3' untranslated region of mRNA encoded by MGC21854, corresponding to a HOST TARGET binding site such as BINDING SITE I, BINDING SITE II or BINDING SITE III. Table 2 illustrates the complementarity of the nucleotide sequences of MGC21854 BINDING SITE, designated SEQ ID:27447, to the nucleotide sequence of VGAM1958 RNA, herein designated VGAM RNA, also designated SEQ ID:4669.

Another function of VGAM1958 is therefore inhibition of MGC21854 (Accession NM_052862). Accordingly, utilities of VGAM1958 include diagnosis, prevention and treatment of diseases and clinical conditions associated with MGC21854. MGC21945 (Accession NM_145057) is another VGAM1958 host target gene. MGC21945 BINDING SITE is HOST TARGET binding site found in the 5' untranslated region of mRNA encoded by MGC21945, corresponding to a HOST TARGET binding site such as BINDING SITE I, BINDING SITE II or BINDING SITE III. Table 2 illustrates the complementarity of the nucleotide sequences of MGC21945 BINDING SITE, designated SEQ ID:29692, to the nucleotide sequence of VGAM1958 RNA, herein designated VGAM RNA, also designated SEQ ID:4669.

Another function of VGAM1958 is therefore inhibition of MGC21945 (Accession NM_145057). Accordingly, utilities of VGAM1958 include diagnosis, prevention and treatment of diseases and clinical conditions associated with MGC21945. MGC22014 (Accession XM_035307) is another VGAM1958 host target gene. MGC22014 BINDING SITE is HOST TARGET binding site found in the 3' untranslated region of mRNA encoded by MGC22014, corresponding to a HOST TARGET binding site such as BINDING SITE I, BINDING SITE II or BINDING SITE III. Table 2 illustrates the complementarity of the nucleotide sequences of MGC22014 BINDING SITE, designated SEQ ID:32220, to the nucleotide sequence of VGAM1958 RNA, herein designated VGAM RNA, also designated SEQ ID:4669.

Another function of VGAM1958 is therefore inhibition of MGC22014 (Accession XM_035307). Accordingly, utilities of VGAM1958 include diagnosis, prevention and treatment of diseases and clinical conditions associated with MGC22014. MGC2306 (Accession NM_032638) is another VGAM1958 host target gene. MGC2306 BINDING SITE is HOST TARGET binding site found in the 3' untranslated region of mRNA encoded by MGC2306, corresponding to a HOST TARGET binding site such as BINDING SITE I, BINDING SITE II or BINDING SITE III. Table 2 illustrates the complementarity of the nucleotide sequences of MGC2306 BINDING SITE, designated SEQ ID:26354, to the nucleotide sequence of VGAM1958 RNA, herein designated VGAM RNA, also designated SEQ ID:4669.

Another function of VGAM1958 is therefore inhibition of MGC2306 (Accession NM_032638). Accordingly, utilities of VGAM1958 include diagnosis, prevention and treatment of diseases and clinical conditions associated with MGC2306. MGC2452 (Accession NM_032644) is another VGAM1958 host target gene. MGC2452 BINDING SITE is HOST TARGET binding site found in the 5' untranslated region of mRNA encoded by MGC2452, corresponding to a HOST TARGET binding site such as BINDING SITE I, BINDING SITE II or BINDING SITE III. Table 2 illustrates the complementarity of the nucleotide sequences of MGC2452 BINDING SITE, designated SEQ ID:26363, to the nucleotide sequence of VGAM1958 RNA, herein designated VGAM RNA, also designated SEQ ID:4669.

Another function of VGAM1958 is therefore inhibition of MGC2452 (Accession NM_032644). Accordingly, utilities of VGAM1958 include diagnosis, prevention and treatment of diseases and clinical conditions associated with MGC2452. MGC3113 (Accession NM_024035) is another VGAM1958 host target gene. MGC3113 BINDING SITE is HOST TARGET binding site found in the 5' untranslated region of mRNA encoded by MGC3113, corresponding to a HOST TARGET binding site such as BINDING SITE I, BINDING SITE II or BINDING SITE III. Table 2 illustrates the complementarity of the nucleotide sequences of MGC3113 BINDING SITE, designated SEQ ID:23468, to the nucleotide sequence of VGAM1958 RNA, herein designated VGAM RNA, also designated SEQ ID:4669.

Another function of VGAM1958 is therefore inhibition of MGC3113 (Accession NM_024035). Accordingly, utilities of VGAM1958 include diagnosis, prevention and treatment of diseases and clinical conditions associated with MGC3113. MGC33182 (Accession XM_062903) is another VGAM1958 host target gene. MGC33182 BINDING SITE is HOST TARGET binding site found in the 3' untranslated region of mRNA encoded by MGC33182, corresponding to a HOST TARGET binding site such as BINDING SITE I, BINDING SITE II or BINDING SITE III. Table 2 illustrates the complementarity of the nucleotide sequences of MGC33182 BINDING SITE, designated SEQ ID:37235, to the nucleotide sequence of VGAM1958 RNA, herein designated VGAM RNA, also designated SEQ ID:4669.

Another function of VGAM1958 is therefore inhibition of MGC33182 (Accession XM_062903). Accordingly, utilities of VGAM1958 include diagnosis, prevention and treatment of diseases and clinical conditions associated with MGC33182. MGC35558 (Accession NM_145013) is another VGAM1958 host target gene. MGC35558 BINDING SITE is HOST TARGET binding site found in the 3' untranslated region of mRNA encoded by MGC35558, corresponding to a HOST TARGET binding site such as BINDING SITE I, BINDING SITE II or BINDING SITE III. Table 2 illustrates the complementarity of the nucleotide sequences of MGC35558 BINDING SITE, designated SEQ ID:29613, to the nucleotide sequence of VGAM1958 RNA, herein designated VGAM RNA, also designated SEQ ID:4669.

Another function of VGAM1958 is therefore inhibition of MGC35558 (Accession NM_145013). Accordingly, utilities of VGAM1958 include diagnosis, prevention and treatment of diseases and clinical conditions associated with MGC35558. MGC4342 (Accession NM_024329) is another VGAM1958 host target gene. MGC4342 BINDING SITE is HOST TARGET binding site found in the 3' untranslated region of mRNA encoded by MGC4342, corresponding to a HOST TARGET binding site such as BINDING SITE I, BINDING SITE II or BINDING SITE III. Table 2 illustrates the complementarity of the nucleotide sequences of MGC4342 BINDING SITE, designated SEQ ID:23626, to the nucleotide sequence of VGAM1958 RNA, herein designated VGAM RNA, also designated SEQ ID:4669.

Another function of VGAM1958 is therefore inhibition of MGC4342 (Accession NM_024329). Accordingly, utilities of VGAM1958 include diagnosis, prevention and treatment of diseases and clinical conditions associated with MGC4342. MGC4504 (Accession NM_024111) is another VGAM1958 host target gene. MGC4504 BINDING SITE is HOST TARGET binding site found in the 3' untranslated region of mRNA encoded by MGC4504, corresponding to a HOST TARGET binding site such as BINDING SITE I, BINDING SITE II or BINDING SITE III. Table 2 illustrates the complementarity of the nucleotide sequences of MGC4504 BINDING SITE, designated SEQ ID:23561, to the nucleotide sequence of VGAM1958 RNA, herein designated VGAM RNA, also designated SEQ ID:4669.

Another function of VGAM1958 is therefore inhibition of MGC4504 (Accession NM_024111). Accordingly, utilities of VGAM1958 include diagnosis, prevention and treatment of diseases and clinical conditions associated with MGC4504. MGC4549 (Accession NM_032377) is another VGAM1958 host target gene. MGC4549 BINDING SITE is HOST TARGET binding site found in the 3' untranslated region of mRNA encoded by MGC4549, corresponding to a HOST TARGET binding site such as BINDING SITE I, BINDING SITE II or BINDING SITE III. Table 2 illustrates the complementarity of the nucleotide sequences of MGC4549 BINDING SITE, designated SEQ ID:26170, to the nucleotide sequence of VGAM1958 RNA, herein designated VGAM RNA, also designated SEQ ID:4669.

Another function of VGAM1958 is therefore inhibition of MGC4549 (Accession NM_032377). Accordingly, utilities of VGAM1958 include diagnosis, prevention and treatment of diseases and clinical conditions associated with MGC4549. MGC4604 (Accession NM_031487) is another VGAM1958 host target gene. MGC4604 BINDING SITE is HOST TARGET binding site found in the 5' untranslated region of mRNA encoded by MGC4604, corresponding to a HOST TARGET binding site such as BINDING SITE I, BINDING SITE II or BINDING SITE III. Table 2 illustrates the complementarity of the nucleotide sequences of MGC4604 BINDING SITE, designated SEQ ID:25577, to the nucleotide sequence of VGAM1958 RNA, herein designated VGAM RNA, also designated SEQ ID:4669.

Another function of VGAM1958 is therefore inhibition of MGC4604 (Accession NM_031487). Accordingly, utilities of VGAM1958 include diagnosis, prevention and treatment of diseases and clinical conditions associated with MGC4604. MGC4643 (Accession NM_032715) is another VGAM1958 host target gene. MGC4643 BINDING SITE is HOST TARGET binding site found in the 3' untranslated region of mRNA encoded by MGC4643, corresponding to a HOST TARGET binding site such as BINDING SITE I, BINDING SITE II or BINDING SITE III. Table 2 illustrates the complementarity of the nucleotide sequences of MGC4643 BINDING SITE, designated SEQ ID:26444, to the nucleotide sequence of VGAM1958 RNA, herein designated VGAM RNA, also designated SEQ ID:4669.

Another function of VGAM1958 is therefore inhibition of MGC4643 (Accession NM_032715). Accordingly, utilities of VGAM1958 include diagnosis, prevention and treatment of diseases and clinical conditions associated with MGC4643. MGC4796 (Accession XM_029031) is another VGAM1958 host target gene. MGC4796 BINDING SITE is HOST TARGET binding site found in the 3' untranslated region of mRNA encoded by MGC4796, corresponding to a HOST TARGET binding site such as BINDING SITE I, BINDING SITE II or BINDING SITE III. Table 2 illustrates the complementarity of the nucleotide sequences of MGC4796 BINDING SITE, designated SEQ ID:30833, to the nucleotide sequence of VGAM1958 RNA, herein designated VGAM RNA, also designated SEQ ID:4669.

Another function of VGAM1958 is therefore inhibition of MGC4796 (Accession XM_029031). Accordingly, utilities of VGAM1958 include diagnosis, prevention and treatment of diseases and clinical conditions associated with MGC4796. MGC5601 (Accession NM_025247) is another VGAM1958 host target gene. MGC5601 BINDING SITE is HOST TARGET binding site found in the 5' untranslated region of mRNA encoded by MGC5601, corresponding to a HOST TARGET binding site such as BINDING SITE I, BINDING SITE II or BINDING SITE III. Table 2 illustrates the complementarity of the nucleotide sequences of MGC5601 BINDING SITE, designated SEQ ID:24926, to the nucleotide sequence of VGAM1958 RNA, herein designated VGAM RNA, also designated SEQ ID:4669.

Another function of VGAM1958 is therefore inhibition of MGC5601 (Accession NM_025247). Accordingly, utilities of VGAM1958 include diagnosis, prevention and treatment of diseases and clinical conditions associated with MGC5601. MIC2 Like 1 (MIC2L1, Accession NM_031462) is another VGAM1958 host target gene. MIC2L1 BINDING SITE is HOST TARGET binding site found in the 3' untranslated region of mRNA encoded by MIC2L1, corresponding to a HOST TARGET binding site such as BINDING SITE I, BINDING SITE II or BINDING SITE III. Table 2 illustrates the complementarity of the nucleotide sequences of MIC2L1 BINDING SITE, designated SEQ ID:25488, to the nucleotide sequence of VGAM1958 RNA, herein designated VGAM RNA, also designated SEQ ID:4669.

Another function of VGAM1958 is therefore inhibition of MIC2 Like 1 (MIC2L1, Accession NM_031462). Accordingly, utilities of VGAM1958 include diagnosis, prevention and treatment of diseases and clinical conditions associated with MIC2L1. MIG-6 (Accession NM_018948) is another VGAM1958 host target gene. MIG-6 BINDING SITE is HOST TARGET binding site found in the 3' untranslated region of mRNA encoded by MIG-6, corresponding to a HOST TARGET binding site such as BINDING SITE I, BINDING SITE II or BINDING SITE III. Table 2 illustrates the complementarity of the nucleotide sequences of MIG-6 BINDING SITE, designated SEQ ID:21020, to the nucleotide sequence of VGAM1958 RNA, herein designated VGAM RNA, also designated SEQ ID:4669.

Another function of VGAM1958 is therefore inhibition of MIG-6 (Accession NM_018948). Accordingly, utilities of VGAM1958 include diagnosis, prevention and treatment of diseases and clinical conditions associated with MIG-6. MOST2 (Accession NM_020250) is another VGAM1958 host target gene. MOST2 BINDING SITE is HOST TARGET binding site found in the 5' untranslated region of mRNA encoded by MOST2, corresponding to a HOST TARGET binding site such as BINDING SITE I, BINDING SITE II or BINDING SITE III. Table 2 illustrates the complementarity of the nucleotide sequences of MOST2 BINDING SITE, designated SEQ ID:21549, to the nucleotide sequence of VGAM1958 RNA, herein designated VGAM RNA, also designated SEQ ID:4669.

Another function of VGAM1958 is therefore inhibition of MOST2 (Accession NM_020250). Accordingly, utilities of VGAM1958 include diagnosis, prevention and treatment of diseases and clinical conditions associated with MOST2. MST4 (Accession NM_016542) is another VGAM1958 host target gene. MST4 BINDING SITE is HOST TARGET binding site found in the 3' untranslated region of mRNA encoded by MST4, corresponding to a HOST TARGET binding site such as BINDING SITE I, BINDING SITE II or BINDING SITE III. Table 2 illustrates the complementarity of the nucleotide sequences of MST4 BINDING SITE, designated SEQ ID:18609, to the nucleotide sequence of VGAM1958 RNA, herein designated VGAM RNA, also designated SEQ ID:4669.

Another function of VGAM1958 is therefore inhibition of MST4 (Accession NM_016542). Accordingly, utilities of VGAM1958 include diagnosis, prevention and treatment of diseases and clinical conditions associated with MST4. MY014 (Accession NM_030918) is another VGAM1958 host target gene. MY014 BINDING SITE is HOST TARGET binding site found in the 3' untranslated region of mRNA encoded by MY014, corresponding to a HOST TARGET binding site such as BINDING SITE I, BINDING SITE II or BINDING SITE III. Table 2 illustrates the complementarity of the nucleotide sequences of MY014 BINDING SITE, designated SEQ ID:25188, to the nucleotide sequence of VGAM1958 RNA, herein designated VGAM RNA, also designated SEQ ID:4669.

Another function of VGAM1958 is therefore inhibition of MY014 (Accession NM_030918). Accordingly, utilities of VGAM1958 include diagnosis, prevention and treatment of diseases and clinical conditions associated with MY014. N4BP3 (Accession XM_038920) is another VGAM1958 host target gene. N4BP3 BINDING SITE is HOST TARGET binding site found in the 3' untranslated region of mRNA encoded by N4BP3, corresponding to a HOST TARGET binding site such as BINDING SITE I, BINDING SITE II or BINDING SITE III. Table 2 illustrates the complementarity of the nucleotide sequences of N4BP3 BINDING SITE, designated SEQ ID:32934, to the nucleotide sequence of VGAM1958 RNA, herein designated VGAM RNA, also designated SEQ ID:4669.

Another function of VGAM1958 is therefore inhibition of N4BP3 (Accession XM_038920). Accordingly, utilities of VGAM1958 include diagnosis, prevention and treatment of diseases and clinical conditions associated with N4BP3. Neuroblastoma, Suppression of Tumorigenicity 1 (NBL1, Accession XM_001434) is another VGAM1958 host target gene. NBL1 BINDING SITE is HOST TARGET binding site found in the 3' untranslated region of mRNA encoded by NBL1, corresponding to a HOST TARGET binding site such as BINDING SITE I, BINDING SITE II or BINDING SITE III. Table 2 illustrates the complementarity of the nucleotide sequences of NBL1 BINDING SITE, designated SEQ ID:29838, to the nucleotide sequence of VGAM1958 RNA, herein designated VGAM RNA, also designated SEQ ID:4669.

Another function of VGAM1958 is therefore inhibition of Neuroblastoma, Suppression of Tumorigenicity 1 (NBL1, Accession XM_001434). Accordingly, utilities of VGAM1958 include diagnosis, prevention and treatment of diseases and clinical conditions associated with NBL1. NCKX3 (Accession NM_020689) is another VGAM1958 host target gene. NCKX3 BINDING SITE is HOST TARGET binding site found in the 3' untranslated region of mRNA encoded by NCKX3, corresponding to a HOST TARGET binding site such as BINDING SITE I, BINDING SITE II or BINDING SITE III. Table 2 illustrates the complementarity of the nucleotide sequences of NCKX3 BINDING SITE, designated SEQ ID:21840, to the nucleotide sequence of VGAM1958 RNA, herein designated VGAM RNA, also designated SEQ ID:4669.

Another function of VGAM1958 is therefore inhibition of NCKX3 (Accession NM_020689). Accordingly, utilities of VGAM1958 include diagnosis, prevention and treatment of diseases and clinical conditions associated with NCKX3. NECL1 (Accession NM_021189) is another VGAM1958 host target gene. NECL1 BINDING SITE is HOST TARGET binding site found in the 3' untranslated region of mRNA encoded by NECL1, corresponding to a HOST TARGET binding site such as BINDING SITE I, BINDING SITE II or BINDING SITE III. Table 2 illustrates the complementarity of the nucleotide sequences of NECL1 BINDING SITE, designated SEQ ID:22165, to the nucleotide sequence of VGAM1958 RNA, herein designated VGAM RNA, also designated SEQ ID:4669.

Another function of VGAM1958 is therefore inhibition of NECL1 (Accession NM_021189). Accordingly, utilities of VGAM1958 include diagnosis, prevention and treatment of diseases and clinical conditions associated with NECL1. NIBAN (Accession NM_022083) is another VGAM1958 host target gene. NIBAN BINDING SITE is HOST TARGET binding site found in the 3' untranslated region of mRNA encoded by NIBAN, corresponding to a HOST TARGET binding site such as BINDING SITE I, BINDING SITE II or BINDING SITE III. Table 2 illustrates the complementarity of the nucleotide sequences of NIBAN BINDING SITE, designated SEQ ID:22627, to the nucleotide sequence of VGAM1958 RNA, herein designated VGAM RNA, also designated SEQ ID:4669.

Another function of VGAM1958 is therefore inhibition of NIBAN (Accession NM_022083). Accordingly, utilities of VGAM1958 include diagnosis, prevention and treatment of diseases and clinical conditions associated with NIBAN. NIN283 (Accession NM_032268) is another VGAM1958 host target gene. NIN283 BINDING SITE is HOST TARGET binding site found in the 3' untranslated region of mRNA encoded by NIN283, corresponding to a HOST TARGET binding site such as BINDING SITE I, BINDING SITE II or BINDING SITE III. Table 2 illustrates the complementarity of the nucleotide sequences of NIN283 BINDING SITE, designated SEQ ID:26012, to the nucleotide sequence of VGAM1958 RNA, herein designated VGAM RNA, also designated SEQ ID:4669.

Another function of VGAM1958 is therefore inhibition of NIN283 (Accession NM_032268). Accordingly, utilities of VGAM1958 include diagnosis, prevention and treatment of diseases and clinical conditions associated with NIN283. Ninjurin 2 (NINJ2, Accession NM_016533) is another VGAM1958 host target gene. NINJ2 BINDING SITE is HOST TARGET binding site found in the 3' untranslated region of mRNA encoded by NINJ2, corresponding to a HOST TARGET binding site such as BINDING SITE I, BINDING SITE II or BINDING SITE III. Table 2 illustrates the complementarity of the nucleotide sequences of NINJ2 BINDING SITE, designated SEQ ID:18604, to the nucleotide sequence of VGAM1958 RNA, herein designated VGAM RNA, also designated SEQ ID:4669.

Another function of VGAM1958 is therefore inhibition of Ninjurin 2 (NINJ2, Accession NM_016533). Accordingly, utilities of VGAM1958 include diagnosis, prevention and treatment of diseases and clinical conditions associated with NINJ2. NIP30 (Accession NM_024946) is another VGAM1958 host target gene. NIP30 BINDING SITE is HOST TARGET binding site found in the 3' untranslated region of mRNA encoded by NIP30, corresponding to a HOST TARGET binding site such as BINDING SITE I, BINDING SITE II or BINDING SITE III. Table 2 illustrates the complementarity of the nucleotide sequences of NIP30 BINDING SITE, designated SEQ ID:24499, to the nucleotide sequence of VGAM1958 RNA, herein designated VGAM RNA, also designated SEQ ID:4669.

Another function of VGAM1958 is therefore inhibition of NIP30 (Accession NM_024946). Accordingly, utilities of VGAM1958 include diagnosis, prevention and treatment of diseases and clinical conditions associated with NIP30. NKIR (Accession NM_139018) is another VGAM1958 host target gene. NKIR BINDING SITE is HOST TARGET binding site found in the 3' untranslated region of mRNA encoded by NKIR, corresponding to a HOST TARGET binding site such as BINDING SITE I, BINDING SITE II or BINDING SITE III. Table 2 illustrates the complementarity of the nucleotide sequences of NKIR BINDING SITE, designated SEQ ID:29117, to the nucleotide sequence of VGAM1958 RNA, herein designated VGAM RNA, also designated SEQ ID:4669.

Another function of VGAM1958 is therefore inhibition of NKIR (Accession NM_139018). Accordingly, utilities of VGAM1958 include diagnosis, prevention and treatment of diseases and clinical conditions associated with NKIR. NPD009 (Accession XM_170795) is another VGAM1958 host target gene. NPD009 BINDING SITE is HOST TARGET binding site found in the 5' untranslated region of mRNA encoded by NPD009, corresponding to a HOST TARGET binding site such as BINDING SITE I, BINDING SITE II or BINDING SITE III. Table 2 illustrates the complementarity of the nucleotide sequences of NPD009 BINDING SITE, designated SEQ ID:45560, to the nucleotide sequence of VGAM1958 RNA, herein designated VGAM RNA, also designated SEQ ID:4669.

Another function of VGAM1958 is therefore inhibition of NPD009 (Accession XM_170795). Accordingly, utilities of VGAM1958 include diagnosis, prevention and treatment of diseases and clinical conditions associated with NPD009. Neuronal Pentraxin Receptor (NPTXR, Accession NM_014293) is another VGAM1958 host target gene. NPTXR BINDING SITE1 and NPTXR BINDING SITE2 are HOST TARGET binding sites found in untranslated regions of mRNA encoded by NPTXR, corresponding to HOST TARGET binding sites such as BINDING SITE I, BINDING SITE II or BINDING SITE III. Table 2 illustrates the complementarity of the nucleotide sequences of NPTXR BINDING SITE1 and NPTXR BINDING SITE2, designated SEQ ID:15583 and SEQ ID:27731 respectively, to the nucleotide sequence of VGAM1958 RNA, herein designated VGAM RNA, also designated SEQ ID:4669.

Another function of VGAM1958 is therefore inhibition of Neuronal Pentraxin Receptor (NPTXR, Accession NM_014293). Accordingly, utilities of VGAM1958 include diagnosis, prevention and treatment of diseases and clinical conditions associated with NPTXR. Nucleoredoxin (NXN, Accession NM_022463) is another VGAM1958 host target gene. NXN BINDING SITE is HOST TARGET binding site found in the 3' untranslated region of mRNA encoded by NXN, corresponding to a HOST TARGET binding site such as BINDING SITE I, BINDING SITE II or BINDING SITE III. Table 2 illustrates the complementarity of the nucleotide sequences of NXN BINDING SITE, designated SEQ ID:22810, to the nucleotide sequence of VGAM1958 RNA, herein designated VGAM RNA, also designated SEQ ID:4669.

Another function of VGAM1958 is therefore inhibition of Nucleoredoxin (NXN, Accession NM_022463). Accordingly, utilities of VGAM1958 include diagnosis, prevention and treatment of diseases and clinical conditions associated with NXN. Neurexophilin 3 (NXPH3, Accession XM_037847) is another VGAM1958 host target gene. NXPH3 BINDING SITE is HOST TARGET binding site found in the 3' untranslated region of mRNA encoded by NXPH3, corresponding to a HOST TARGET binding site such as BINDING SITE I, BINDING SITE II or BINDING SITE III. Table 2 illustrates the complementarity of the nucleotide sequences of NXPH3 BINDING SITE, designated SEQ ID:32713, to the nucleotide sequence of VGAM1958 RNA, herein designated VGAM RNA, also designated SEQ ID:4669.

Another function of VGAM1958 is therefore inhibition of Neurexophilin 3 (NXPH3, Accession XM_037847). Accordingly, utilities of VGAM1958 include diagnosis, prevention and treatment of diseases and clinical conditions associated with NXPH3. NY-REN-25 (Accession XM_027116) is another VGAM1958 host target gene. NY-REN-25 BINDING SITE is HOST TARGET binding site found in the 5' untranslated region of mRNA encoded by NY-REN-25, corresponding to a HOST TARGET binding site such as BINDING SITE I, BINDING SITE II or BINDING SITE III. Table 2 illustrates the complementarity of the nucleotide sequences of NY-REN-25 BINDING SITE, designated SEQ ID:30421, to the nucleotide sequence of VGAM1958 RNA, herein designated VGAM RNA, also designated SEQ ID:4669.

Another function of VGAM1958 is therefore inhibition of NY-REN-25 (Accession XM_027116). Accordingly, utilities of VGAM1958 include diagnosis, prevention and treatment of diseases and clinical conditions associated with NY-REN-25. OCIA (Accession NM_017830) is another VGAM1958 host target gene. OCIA BINDING SITE is HOST TARGET binding site found in the 5' untranslated region of mRNA encoded by OCIA, corresponding to a HOST TARGET binding site such as BINDING SITE I, BINDING SITE II or BINDING SITE III. Table 2 illustrates the complementarity of the nucleotide sequences of OCIA BINDING SITE, designated SEQ ID:19492, to the nucleotide sequence of VGAM1958 RNA, herein designated VGAM RNA, also designated SEQ ID:4669.

Another function of VGAM1958 is therefore inhibition of OCIA (Accession NM_017830). Accordingly, utilities of VGAM1958 include diagnosis, prevention and treatment of diseases and clinical conditions associated with OCIA. Opiate Receptor-like 1 (OPRL1, Accession NM_000913) is another VGAM1958 host target gene. OPRL1 BINDING SITE is HOST TARGET binding site found in the 3' untranslated region of mRNA encoded by OPRL1, corresponding to a HOST TARGET binding site such as BINDING SITE I, BINDING SITE II or BINDING SITE III. Table 2 illustrates the complementarity of the nucleotide sequences of OPRL1 BINDING SITE, designated SEQ ID:6617, to the nucleotide sequence of VGAM1958 RNA, herein designated VGAM RNA, also designated SEQ ID:4669.

Another function of VGAM1958 is therefore inhibition of Opiate Receptor-like 1 (OPRL1, Accession NM_000913). Accordingly, utilities of VGAM1958 include diagnosis, prevention and treatment of diseases and clinical conditions associated with OPRL1. Purinergic Receptor P2X, Ligand-gated Ion Channel, 1 (P2RX1, Accession XM_040635) is another VGAM1958 host target gene. P2RX1 BINDING SITE1 and P2RX1 BINDING SITE2 are HOST TARGET binding sites found in untranslated regions of mRNA encoded by P2RX1, corresponding to HOST TARGET binding sites such as BINDING SITE I, BINDING SITE II or BINDING SITE III. Table 2 illustrates the complementarity of the nucleotide sequences of P2RX1 BINDING SITE1 and P2RX1 BINDING SITE2, designated SEQ ID:33356 and SEQ ID:33357 respectively, to the nucleotide sequence of VGAM1958 RNA, herein designated VGAM RNA, also designated SEQ ID:4669.

Another function of VGAM1958 is therefore inhibition of Purinergic Receptor P2X, Ligand-gated Ion Channel, 1 (P2RX1, Accession XM_040635). Accordingly, utilities of VGAM1958 include diagnosis, prevention and treatment of diseases and clinical conditions associated with P2RX1. Period Homolog 3 (Drosophila) (PER3, Accession NM_016831) is another VGAM1958 host target gene. PER3 BINDING SITE is HOST TARGET binding site found in the 5' untranslated region of mRNA encoded by PER3, corresponding to a HOST TARGET binding site such as BINDING SITE I, BINDING SITE II or BINDING SITE III. Table 2 illustrates the complementarity of the nucleotide sequences of PER3 BINDING SITE, designated SEQ ID:18824, to the nucleotide sequence of VGAM1958 RNA, herein designated VGAM RNA, also designated SEQ ID:4669.

Another function of VGAM1958 is therefore inhibition of Period Homolog 3 (Drosophila) (PER3, Accession NM_016831). Accordingly, utilities of VGAM1958 include diagnosis, prevention and treatment of diseases and clinical conditions associated with PER3. Protease Inhibitor 15 (PI15, Accession NM_015886) is another VGAM1958 host target gene. PI15 BINDING SITE is HOST TARGET binding site found in the 5' untranslated region of mRNA encoded by PI15, corresponding to a HOST TARGET binding site such as BINDING SITE I, BINDING SITE II or BINDING SITE III. Table 2 illustrates the complementarity of the nucleotide sequences of PI15 BINDING SITE, designated SEQ ID:18029, to the nucleotide sequence of VGAM1958 RNA, herein designated VGAM RNA, also designated SEQ ID:4669.

Another function of VGAM1958 is therefore inhibition of Protease Inhibitor 15 (PI15, Accession NM_015886). Accordingly, utilities of VGAM1958 include diagnosis, prevention and treatment of diseases and clinical conditions associated with PI15. PILR(ALPHA) (Accession NM_013439) is another VGAM1958 host target gene. PILR (ALPHA) BINDING SITE1 and PILR(ALPHA) BINDING SITE2 are HOST TARGET binding sites found in untranslated regions of mRNA encoded by PILR(ALPHA), corresponding to HOST TARGET binding sites such as BINDING SITE I, BINDING SITE II or BINDING SITE III. Table 2 illustrates the complementarity of the nucleotide sequences of PILR(ALPHA) BINDING SITE1 and PILR(ALPHA) BINDING SITE2, designated SEQ ID:15101 and SEQ ID:15102 respectively, to the nucleotide sequence of VGAM1958 RNA, herein designated VGAM RNA, also designated SEQ ID:4669.

Another function of VGAM1958 is therefore inhibition of PILR(ALPHA) (Accession NM_013439). Accordingly, utilities of VGAM1958 include diagnosis, prevention and treatment of diseases and clinical conditions associated with PILR (ALPHA). PIP3-E (Accession XM_039749) is another VGAM1958 host target gene. PIP3-E BINDING SITE is HOST TARGET binding site found in the 3' untranslated region of mRNA encoded by PIP3-E, corresponding to a HOST TARGET binding site such as BINDING SITE I, BINDING SITE II or BINDING SITE III. Table 2 illustrates the complementarity of the nucleotide sequences of PIP3-E BINDING SITE, designated SEQ ID:33177, to the nucleotide sequence of VGAM1958 RNA, herein designated VGAM RNA, also designated SEQ ID:4669.

Another function of VGAM1958 is therefore inhibition of PIP3-E (Accession XM_039749). Accordingly, utilities of VGAM1958 include diagnosis, prevention and treatment of diseases and clinical conditions associated with PIP3-E. Phosphatidylserine Decarboxylase (PISD, Accession NM_014338) is another VGAM1958 host target gene. PISD BINDING SITE is HOST TARGET binding site found in the 3' untranslated region of mRNA encoded by PISD, corresponding to a HOST TARGET binding site such as BINDING SITE I, BINDING SITE II or BINDING SITE III. Table 2 illustrates the complementarity of the nucleotide sequences of PISD BINDING SITE, designated SEQ ID:15653, to the nucleotide sequence of VGAM1958 RNA, herein designated VGAM RNA, also designated SEQ ID:4669.

Another function of VGAM1958 is therefore inhibition of Phosphatidylserine Decarboxylase (PISD, Accession NM_014338). Accordingly, utilities of VGAM1958 include diagnosis, prevention and treatment of diseases and clinical conditions associated with PISD. PM5 (Accession XM_027359) is another VGAM1958 host target gene. PM5 BINDING SITE is HOST TARGET binding site found in the 5' untranslated region of mRNA encoded by PM5, corresponding to a HOST TARGET binding site such as BINDING SITE I, BINDING SITE II or BINDING SITE III. Table 2 illustrates the complementarity of the nucleotide sequences of PM5 BINDING SITE, designated SEQ ID:30496, to the nucleotide sequence of VGAM1958 RNA, herein designated VGAM RNA, also designated SEQ ID:4669.

Another function of VGAM1958 is therefore inhibition of PM5 (Accession XM_027359). Accordingly, utilities of VGAM1958 include diagnosis, prevention and treatment of diseases and clinical conditions associated with PM5. Paraneoplastic Antigen Like 5 (PNMA5, Accession XM_057016) is another VGAM1958 host target gene. PNMA5 BINDING SITE is HOST TARGET binding site found in the 3' untranslated region of mRNA encoded by PNMA5, corresponding to a HOST TARGET binding site such as BINDING SITE I, BINDING SITE II or BINDING SITE III. Table 2 illustrates the complementarity of the nucleotide sequences of PNMA5 BINDING SITE, designated SEQ ID:36442, to the nucleotide sequence of VGAM1958 RNA, herein designated VGAM RNA, also designated SEQ ID:4669.

Another function of VGAM1958 is therefore inhibition of Paraneoplastic Antigen Like 5 (PNMA5, Accession XM_057016). Accordingly, utilities of VGAM1958 include diagnosis, prevention and treatment of diseases and clinical conditions associated with PNMA5. POLA2 (Accession NM_002689) is another VGAM1958 host target gene. POLA2 BINDING SITE is HOST TARGET binding site found in the 5' untranslated region of mRNA encoded by POLA2, corresponding to a HOST TARGET binding site such as BINDING SITE I, BINDING SITE II or BINDING SITE III. Table 2 illustrates the complementarity of the nucleotide sequences of POLA2 BINDING SITE, designated SEQ ID:8548, to the nucleotide sequence of VGAM1958 RNA, herein designated VGAM RNA, also designated SEQ ID:4669.

Another function of VGAM1958 is therefore inhibition of POLA2 (Accession NM_002689). Accordingly, utilities of VGAM1958 include diagnosis, prevention and treatment of diseases and clinical conditions associated with POLA2. PP2447 (Accession NM_025204) is another VGAM1958 host target gene. PP2447 BINDING SITE is HOST TARGET binding site found in the 3' untranslated region of mRNA encoded by PP2447, corresponding to a HOST TARGET binding site such as BINDING SITE I, BINDING SITE II or BINDING SITE III. Table 2 illustrates the complementarity of the nucleotide sequences of PP2447 BINDING SITE, designated SEQ ID:24869, to the nucleotide sequence of VGAM1958 RNA, herein designated VGAM RNA, also designated SEQ ID:4669.

Another function of VGAM1958 is therefore inhibition of PP2447 (Accession NM_025204). Accordingly, utilities of VGAM1958 include diagnosis, prevention and treatment of diseases and clinical conditions associated with PP2447. Protein Phosphatase 1A (formerly 2C), Magnesium-dependent, Alpha Isoform (PPM1A, Accession NM_021003) is another VGAM1958 host target gene. PPM1A BINDING SITE is HOST TARGET binding site found in the 5' untranslated region of mRNA encoded by PPM1A, corresponding to a HOST TARGET binding site such as BINDING SITE I, BINDING SITE II or BINDING SITE III. Table 2 illustrates the complementarity of the nucleotide sequences of PPM1A BINDING SITE, designated SEQ ID:21998, to the nucleotide sequence of VGAM1958 RNA, herein designated VGAM RNA, also designated SEQ ID:4669.

Another function of VGAM1958 is therefore inhibition of Protein Phosphatase 1A (formerly 2C), Magnesium-dependent, Alpha Isoform (PPM1A, Accession NM_021003). Accordingly, utilities of VGAM1958 include diagnosis, prevention and treatment of diseases and clinical conditions associated with PPM1A. Protein Phosphatase 1, Regulatory Subunit 10 (PPP1R10, Accession NM_002714) is another VGAM1958 host target gene. PPP1R10 BINDING SITE is HOST TARGET binding site found in the 3' untranslated region of mRNA encoded by PPP1R10, corresponding to a HOST TARGET binding site such as BINDING SITE I, BINDING SITE II or BINDING SITE III. Table 2 illustrates the complementarity of the nucleotide sequences of PPP1R10 BINDING SITE, designated SEQ ID:8573, to the nucleotide sequence of VGAM1958 RNA, herein designated VGAM RNA, also designated SEQ ID:4669.

Another function of VGAM1958 is therefore inhibition of Protein Phosphatase 1, Regulatory Subunit 10 (PPP1R10, Accession NM_002714). Accordingly, utilities of VGAM1958 include diagnosis, prevention and treatment of diseases and clinical conditions associated with PPP1R10. Protein Phosphatase 4, Regulatory Subunit 1-like (PPP4R1L, Accession XM_086650) is another VGAM1958 host target gene. PPP4R1L BINDING SITE is HOST TARGET binding site found in the 5' untranslated region of mRNA encoded by PPP4R1L, corresponding to a HOST TARGET binding site such as BINDING SITE I, BINDING SITE II or BINDING SITE III. Table 2 illustrates the complementarity of the nucleotide sequences of PPP4R1L BINDING SITE, designated SEQ ID:38815, to the nucleotide sequence of VGAM1958 RNA, herein designated VGAM RNA, also designated SEQ ID:4669.

Another function of VGAM1958 is therefore inhibition of Protein Phosphatase 4, Regulatory Subunit 1-like (PPP4R1L, Accession XM_086650). Accordingly, utilities of VGAM1958 include diagnosis, prevention and treatment of diseases and clinical conditions associated with PPP4R1L. PR Domain Containing 7 (PRDM7, Accession NM_052996) is another VGAM1958 host target gene. PRDM7 BINDING SITE is HOST TARGET binding site found in the 3' untranslated region of mRNA encoded by PRDM7, corresponding to a HOST TARGET binding site such as BINDING SITE I, BINDING SITE II or BINDING SITE III. Table 2 illustrates the complementarity of the nucleotide sequences of PRDM7 BINDING SITE, designated SEQ ID:27568, to the nucleotide sequence of VGAM1958 RNA, herein designated VGAM RNA, also designated SEQ ID:4669.

Another function of VGAM1958 is therefore inhibition of PR Domain Containing 7 (PRDM7, Accession NM_052996). Accordingly, utilities of VGAM1958 include diagnosis, prevention and treatment of diseases and clinical conditions associated with PRDM7. PRIC285 (Accession XM_028918) is another VGAM1958 host target gene. PRIC285 BINDING SITE is HOST TARGET binding site found in the 3' untranslated region of mRNA encoded by PRIC285, corresponding to a HOST TARGET binding site such as BINDING SITE I, BINDING SITE II or BINDING SITE III. Table 2 illustrates the complementarity of the nucleotide sequences of PRIC285 BINDING SITE, designated SEQ ID:30805, to the nucleotide sequence of VGAM1958 RNA, herein designated VGAM RNA, also designated SEQ ID:4669.

Another function of VGAM1958 is therefore inhibition of PRIC285 (Accession XM_028918). Accordingly, utilities of VGAM1958 include diagnosis, prevention and treatment of diseases and clinical conditions associated with PRIC285. Protein Kinase, Lysine Deficient 2 (PRKWNK2, Accession XM_117531) is another VGAM1958 host target gene. PRKWNK2 BINDING SITE1 and PRKWNK2 BINDING SITE2 are HOST TARGET binding sites found in untranslated regions of mRNA encoded by PRKWNK2, corresponding to HOST TARGET binding sites such as BINDING SITE I, BINDING SITE II or BINDING SITE III. Table 2 illustrates the complementarity of the nucleotide sequences of PRKWNK2 BINDING SITE1 and PRKWNK2 BINDING SITE2, designated SEQ ID:43518 and SEQ ID:43522 respectively, to the nucleotide sequence of VGAM1958 RNA, herein designated VGAM RNA, also designated SEQ ID:4669.

Another function of VGAM1958 is therefore inhibition of Protein Kinase, Lysine Deficient 2 (PRKWNK2, Accession XM_117531). Accordingly, utilities of VGAM1958 include diagnosis, prevention and treatment of diseases and clinical conditions associated with PRKWNK2. PRO1598 (Accession NM_018503) is another VGAM1958 host target gene. PRO1598 BINDING SITE is HOST TARGET binding site found in the 3' untranslated region of mRNA encoded by PRO1598, corresponding to a HOST TARGET binding site such as BINDING SITE I, BINDING SITE II or BINDING SITE III. Table 2 illustrates the complementarity of the nucleotide sequences of PRO1598 BINDING SITE, designated SEQ ID:20568, to the nucleotide sequence of VGAM1958 RNA, herein designated VGAM RNA, also designated SEQ ID:4669.

Another function of VGAM1958 is therefore inhibition of PRO1598 (Accession NM_018503). Accordingly, utilities of VGAM1958 include diagnosis, prevention and treatment of diseases and clinical conditions associated with PRO1598. PRO2214 (Accession NM_018517) is another VGAM1958 host target gene. PRO2214 BINDING SITE is HOST TARGET binding site found in the 5' untranslated region of mRNA encoded by PRO2214, corresponding to a HOST TARGET binding site such as BINDING SITE I, BINDING SITE II or BINDING SITE III. Table 2 illustrates the complementarity of the nucleotide sequences of PRO2214 BINDING SITE, designated SEQ ID:20587, to the nucleotide sequence of VGAM1958 RNA, herein designated VGAM RNA, also designated SEQ ID:4669.

Another function of VGAM1958 is therefore inhibition of PRO2214 (Accession NM_018517). Accordingly, utilities of VGAM1958 include diagnosis, prevention and treatment of diseases and clinical conditions associated with PRO2214. PRO2900 (Accession NM_018635) is another VGAM1958 host target gene. PRO2900 BINDING SITE is HOST TARGET binding site found in the 5' untranslated region of mRNA encoded by PRO2900, corresponding to a HOST TARGET binding site such as BINDING SITE I, BINDING SITE II or BINDING SITE III. Table 2 illustrates the complementarity of the nucleotide sequences of PRO2900 BINDING SITE, designated SEQ ID:20707, to the nucleotide sequence of VGAM1958 RNA, herein designated VGAM RNA, also designated SEQ ID:4669.

Another function of VGAM1958 is therefore inhibition of PRO2900 (Accession NM_018635). Accordingly, utilities of VGAM1958 include diagnosis, prevention and treatment of diseases and clinical conditions associated with PRO2900. PRP8 Pre-mRNA Processing Factor 8 Homolog (yeast) (PRPF8, Accession XM_028335) is another VGAM1958 host target gene. PRPF8 BINDING SITE1 and PRPF8 BINDING SITE2 are HOST TARGET binding sites found in untranslated regions of mRNA encoded by PRPF8, corresponding to HOST TARGET binding sites such as BINDING SITE I, BINDING SITE II or BINDING SITE III. Table 2 illustrates the complementarity of the nucleotide sequences of PRPF8 BINDING SITE1 and PRPF8 BINDING SITE2, designated SEQ ID:30674 and SEQ ID:30682 respectively, to the nucleotide sequence of VGAM1958 RNA, herein designated VGAM RNA, also designated SEQ ID:4669.

Another function of VGAM1958 is therefore inhibition of PRP8 Pre-mRNA Processing Factor 8 Homolog (yeast) (PRPF8, Accession XM_028335). Accordingly, utilities of VGAM1958 include diagnosis, prevention and treatment of diseases and clinical conditions associated with PRPF8. PSR (Accession XM_036784) is another VGAM1958 host target gene. PSR BINDING SITE1 and PSR BINDING SITE2 are HOST TARGET binding sites found in untranslated regions of mRNA encoded by PSR, corresponding to HOST TARGET binding sites such as BINDING SITE I, BINDING SITE II or BINDING SITE III. Table 2 illustrates the complementarity of the nucleotide sequences of PSR BINDING SITE1 and PSR BINDING SITE2, designated SEQ ID:32496 and SEQ ID:32499 respectively, to the nucleotide sequence of VGAM1958 RNA, herein designated VGAM RNA, also designated SEQ ID:4669.

Another function of VGAM1958 is therefore inhibition of PSR (Accession XM_036784). Accordingly, utilities of VGAM1958 include diagnosis, prevention and treatment of diseases and clinical conditions associated with PSR. PTK6 Protein Tyrosine Kinase 6 (PTK6, Accession NM_005975) is another VGAM1958 host target gene. PTK6 BINDING SITE is HOST TARGET binding site found in the 3' untranslated region of mRNA encoded by PTK6, corresponding to a HOST TARGET binding site such as BINDING SITE I, BINDING SITE II or BINDING SITE III. Table 2 illustrates the complementarity of the nucleotide sequences of PTK6 BINDING SITE, designated SEQ ID:12595, to the nucleotide sequence of VGAM1958 RNA, herein designated VGAM RNA, also designated SEQ ID:4669.

Another function of VGAM1958 is therefore inhibition of PTK6 Protein Tyrosine Kinase 6 (PTK6, Accession NM_005975). Accordingly, utilities of VGAM1958 include diagnosis, prevention and treatment of diseases and clinical conditions associated with PTK6. RA-GEF-2 (Accession NM_016340) is another VGAM1958 host target gene. RA-GEF-2 BINDING SITE is HOST TARGET binding site found in the 3' untranslated region of mRNA encoded by RA-GEF-2, corresponding to a HOST TARGET binding site such as BINDING SITE I, BINDING SITE II or BINDING SITE III. Table 2 illustrates the complementarity of the nucleotide sequences of RA-GEF-2 BINDING SITE, designated SEQ ID:18461, to the nucleotide sequence of VGAM1958 RNA, herein designated VGAM RNA, also designated SEQ ID:4669.

Another function of VGAM1958 is therefore inhibition of RA-GEF-2 (Accession NM_016340). Accordingly, utilities of VGAM1958 include diagnosis, prevention and treatment of diseases and clinical conditions associated with RA-GEF-2. RAB34, Member RAS Oncogene Family (RAB34, Accession NM_031934) is another VGAM1958 host target gene. RAB34 BINDING SITE is HOST TARGET binding site found in the 5' untranslated region of mRNA encoded by RAB34, corresponding to a HOST TARGET binding site such as BINDING SITE I, BINDING SITE II or BINDING SITE III. Table 2 illustrates the complementarity of the nucleotide sequences of RAB34 BINDING SITE, designated SEQ ID:25682, to the nucleotide sequence of VGAM1958 RNA, herein designated VGAM RNA, also designated SEQ ID:4669.

Another function of VGAM1958 is therefore inhibition of RAB34, Member RAS Oncogene Family (RAB34, Accession NM_031934). Accordingly, utilities of VGAM1958 include diagnosis, prevention and treatment of diseases and clinical conditions associated with RAB34. RAB3D, Member RAS Oncogene Family (RAB3D, Accession NM_004283) is another VGAM1958 host target gene. RAB3D BINDING SITE is HOST TARGET binding site found in the 3' untranslated region of mRNA encoded by RAB3D, corresponding to a HOST TARGET binding site such as BINDING SITE I, BINDING SITE II or BINDING SITE III. Table 2 illustrates the complementarity of the nucleotide sequences of RAB3D BINDING SITE, designated SEQ ID:10496, to the nucleotide sequence of VGAM1958 RNA, herein designated VGAM RNA, also designated SEQ ID:4669.

Another function of VGAM1958 is therefore inhibition of RAB3D, Member RAS Oncogene Family (RAB3D, Accession NM_004283). Accordingly, utilities of VGAM1958 include diagnosis, prevention and treatment of diseases and clinical conditions associated with RAB3D. RALGPS1A (Accession NM_014636) is another VGAM1958 host target gene. RALGPS1A BINDING SITE is HOST TARGET binding site found in the 3' untranslated region of mRNA encoded by RALGPS1A, corresponding to a HOST TARGET binding site such as BINDING SITE I, BINDING SITE II or BINDING SITE III. Table 2 illustrates the complementarity of the nucleotide sequences of RALGPS1A BINDING SITE, designated SEQ ID:16018, to the nucleotide sequence of VGAM1958 RNA, herein designated VGAM RNA, also designated SEQ ID:4669.

Another function of VGAM1958 is therefore inhibition of RALGPS1A (Accession NM_014636). Accordingly, utilities of VGAM1958 include diagnosis, prevention and treatment of diseases and clinical conditions associated with RALGPS1A. Ras Association (RalGDS/AF-6) Domain Family 2 (RASSF2, Accession NM_014737) is another VGAM1958 host target gene. RASSF2 BINDING SITE1 and RASSF2 BINDING SITE2 are HOST TARGET binding sites found in untranslated regions of mRNA encoded by RASSF2, corresponding to HOST TARGET binding sites such as BINDING SITE I, BINDING SITE II or BINDING SITE III. Table 2 illustrates the complementarity of the nucleotide sequences of RASSF2 BINDING SITE1 and RASSF2 BINDING SITE2, designated SEQ ID:16387 and SEQ ID:16395 respectively, to the nucleotide sequence of VGAM1958 RNA, herein designated VGAM RNA, also designated SEQ ID:4669.

Another function of VGAM1958 is therefore inhibition of Ras Association (RalGDS/AF-6) Domain Family 2 (RASSF2, Accession NM_014737). Accordingly, utilities of VGAM1958 include diagnosis, prevention and treatment of diseases and clinical conditions associated with RASSF2. RLUCL (Accession NM_058192) is another VGAM1958 host target gene. RLUCL BINDING SITE is HOST TARGET binding site found in the 3' untranslated region of mRNA encoded by RLUCL, corresponding to a HOST TARGET binding site such as BINDING SITE I, BINDING SITE II or BINDING SITE III. Table 2 illustrates the complementarity of the nucleotide sequences of RLUCL BINDING SITE, designated SEQ ID:27755, to the nucleotide sequence of VGAM1958 RNA, herein designated VGAM RNA, also designated SEQ ID:4669.

Another function of VGAM1958 is therefore inhibition of RLUCL (Accession NM_058192). Accordingly, utilities of VGAM1958 include diagnosis, prevention and treatment of diseases and clinical conditions associated with RLUCL. Roundabout Homolog 4, Magic Roundabout (Drosophila) (ROBO4, Accession NM_019055) is another VGAM1958 host target gene. ROBO4 BINDING SITE is HOST TARGET binding site found in the 3' untranslated region of mRNA encoded by ROBO4, corresponding to a HOST TARGET binding site such as BINDING SITE I, BINDING SITE II or BINDING SITE III. Table 2 illustrates the complementarity of the nucleotide sequences of ROBO4 BINDING SITE, designated SEQ ID:21135, to the nucleotide sequence of VGAM1958 RNA, herein designated VGAM RNA, also designated SEQ ID:4669.

Another function of VGAM1958 is therefore inhibition of Roundabout Homolog 4, Magic Roundabout (Drosophila) (ROBO4, Accession NM_019055). Accordingly, utilities of VGAM1958 include diagnosis, prevention and treatment of diseases and clinical conditions associated with ROBO4. SAD1 (Accession XM_034123) is another VGAM1958 host target gene. SAD1 BINDING SITE is HOST TARGET binding site found in the 5' untranslated region of mRNA encoded by SAD1, corresponding to a HOST TARGET binding site such as BINDING SITE I, BINDING SITE II or BINDING SITE III. Table 2 illustrates the complementarity of the nucleotide sequences of SAD1 BINDING SITE, designated SEQ ID:32009, to the nucleotide sequence of VGAM1958 RNA, herein designated VGAM RNA, also designated SEQ ID:4669.

Another function of VGAM1958 is therefore inhibition of SAD1 (Accession XM_034123). Accordingly, utilities of VGAM1958 include diagnosis, prevention and treatment of diseases and clinical conditions associated with SAD1. SAST (Accession XM_032034) is another VGAM1958 host target gene. SAST BINDING SITE is HOST TARGET binding site found in the 5' untranslated region of mRNA encoded by SAST, corresponding to a HOST TARGET binding site such as BINDING SITE I, BINDING SITE II or BINDING SITE III. Table 2 illustrates the complementarity of the nucleotide sequences of SAST BINDING SITE, designated SEQ ID:31541, to the nucleotide sequence of VGAM1958 RNA, herein designated VGAM RNA, also designated SEQ ID:4669.

Another function of VGAM1958 is therefore inhibition of SAST (Accession XM_032034). Accordingly, utilities of VGAM1958 include diagnosis, prevention and treatment of diseases and clinical conditions associated with SAST. SCAMP-4 (Accession NM_079834) is another VGAM1958 host target gene. SCAMP-4 BINDING SITE is HOST TARGET binding site found in the 3' untranslated region of mRNA encoded by SCAMP-4, corresponding to a HOST TARGET binding site such as BINDING SITE I, BINDING SITE II or BINDING SITE III. Table 2 illustrates the complementarity of the nucleotide sequences of SCAMP-4 BINDING SITE, designated SEQ ID:27821, to the nucleotide sequence of VGAM1958 RNA, herein designated VGAM RNA, also designated SEQ ID:4669.

Another function of VGAM1958 is therefore inhibition of SCAMP-4 (Accession NM_079834). Accordingly, utilities of VGAM1958 include diagnosis, prevention and treatment of diseases and clinical conditions associated with SCAMP-4. SCAMP5 (Accession NM_138967) is another VGAM1958 host target gene. SCAMP5 BINDING SITE1 and SCAMP5 BINDING SITE2 are HOST TARGET binding sites found in untranslated regions of mRNA encoded by SCAMP5, corresponding to HOST TARGET binding sites such as BINDING SITE I, BINDING SITE II or BINDING SITE III. Table 2 illustrates the complementarity of the nucleotide sequences of SCAMP5 BINDING SITE1 and SCAMP5 BINDING SITE2, designated SEQ ID:29076 and SEQ ID:29077 respectively, to the nucleotide sequence of VGAM1958 RNA, herein designated VGAM RNA, also designated SEQ ID:4669.

Another function of VGAM1958 is therefore inhibition of SCAMP5 (Accession NM_138967). Accordingly, utilities of VGAM1958 include diagnosis, prevention and treatment of diseases and clinical conditions associated with SCAMP5. Syndecan 3 (N-syndecan) (SDC3, Accession NM_014654) is another VGAM1958 host target gene. SDC3 BINDING SITE is HOST TARGET binding site found in the 3' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16087, to the nucleotide sequence of VGAM1958 RNA, herein designated VGAM RNA, also designated SEQ ID:4669.

Another function of VGAM1958 is therefore inhibition of Syndecan 3 (N-syndecan) (SDC3, Accession NM_014654). Accordingly, utilities of VGAM1958 include diagnosis, prevention and treatment of diseases and clinical conditions associated with SDC3. SEF (Accession XM_045300) is another VGAM1958 host target gene. SEF BINDING SITE is HOST TARGET binding site found in the 3' untranslated region of mRNA encoded by SEF, corresponding to a HOST TARGET binding site such as BINDING SITE I, BINDING SITE II or BINDING SITE III. Table 2 illustrates the complementarity of the nucleotide sequences of SEF BINDING SITE, designated SEQ ID:34427, to the nucleotide sequence of VGAM1958 RNA, herein designated VGAM RNA, also designated SEQ ID:4669.

Another function of VGAM1958 is therefore inhibition of SEF (Accession XM_045300). Accordingly, utilities of VGAM1958 include diagnosis, prevention and treatment of diseases and clinical conditions associated with SEF. Sema Domain, Immunoglobulin Domain (Ig), Transmembrane Domain (TM) and Short Cytoplasmic Domain, (semaphorin) 4B (SEMA4B, Accession XM_044533) is another VGAM1958 host target gene. SEMA4B BINDING SITE is HOST TARGET binding site found in the 3' untranslated region of mRNA encoded by SEMA4B, corresponding to a HOST TARGET binding site such as BINDING SITE I, BINDING SITE II or BINDING SITE III. Table 2 illustrates the complementarity of the nucleotide sequences of SEMA4B BINDING SITE, designated SEQ ID:34226, to the nucleotide sequence of VGAM1958 RNA, herein designated VGAM RNA, also designated SEQ ID:4669.

Another function of VGAM1958 is therefore inhibition of Sema Domain, Immunoglobulin Domain (Ig), Transmembrane Domain (TM) and Short Cytoplasmic Domain, (semaphorin) 4B (SEMA4B, Accession XM_044533). Accordingly, utilities of VGAM1958 include diagnosis, prevention and treatment of diseases and clinical conditions associated with SEMA4B. Sema Domain, Immunoglobulin Domain (Ig), Transmembrane Domain (TM) and Short Cytoplasmic Domain, (semaphorin) 4F (SEMA4F, Accession NM_004263) is another VGAM1958 host target gene. SEMA4F BINDING SITE is HOST TARGET binding site found in the 3" untranslated region of mRNA encoded by SEMA4F, corresponding to a HOST TARGET binding site such as BINDING SITE I, BINDING SITE II or BINDING SITE III. Table 2 illustrates the complementarity of the nucleotide sequences of SEMA4F BINDING SITE, designated SEQ ID:10457, to the nucleotide sequence of VGAM1958 RNA, herein designated VGAM RNA, also designated SEQ ID:4669.

Another function of VGAM1958 is therefore inhibition of Sema Domain, Immunoglobulin Domain (Ig), Transmembrane Domain (TM) and Short Cytoplasmic Domain, (semaphorin) 4F (SEMA4F, Accession NM_004263). Accordingly, utilities of VGAM1958 include diagnosis, prevention and treatment of diseases and clinical conditions associated with SEMA4F. Sema Domain, Immunoglobulin Domain (Ig), Transmembrane Domain (TM) and Short Cytoplasmic Domain, (semaphorin) 4G (SEMA4G, Accession XM_170638) is another VGAM1958 host target gene. SEMA4G BINDING SITE is HOST TARGET binding site found in the 5" untranslated region of mRNA encoded by SEMA4G, corresponding to a HOST TARGET binding site such as BINDING SITE I, BINDING SITE II or BINDING SITE III. Table 2 illustrates the complementarity of the nucleotide sequences of SEMA4G BINDING SITE, designated SEQ ID:45412, to the nucleotide sequence of VGAM1958 RNA, herein designated VGAM RNA, also designated SEQ ID:4669.

Another function of VGAM1958 is therefore inhibition of Sema Domain, Immunoglobulin Domain (Ig), Transmembrane Domain (TM) and Short Cytoplasmic Domain, (semaphorin) 4G (SEMA4G, Accession XM_170638). Accordingly, utilities of VGAM1958 include diagnosis, prevention and treatment of diseases and clinical conditions associated with SEMA4G. Sema Domain, Seven Thrombospondin Repeats (type 1 and type 1-like), Transmembrane Domain (TM) and Short Cytoplasmic Domain, (semaphorin) 5A (SEMA5A, Accession NM_003966) is another VGAM1958 host target gene. SEMA5A BINDING SITE1 and SEMA5A BINDING SITE2 are HOST TARGET binding sites found in untranslated regions of mRNA encoded by SEMA5A, corresponding to HOST TARGET binding sites such as BINDING SITE I, BINDING SITE II or BINDING SITE III. Table 2 illustrates the complementarity of the nucleotide sequences of SEMA5A BINDING SITE1 and SEMA5A BINDING SITE2, designated SEQ ID:10104 and SEQ ID:10106 respectively, to the nucleotide sequence of VGAM1958 RNA, herein designated VGAM RNA, also designated SEQ ID:4669.

Another function of VGAM1958 is therefore inhibition of Sema Domain, Seven Thrombospondin Repeats (type 1 and type 1-like), Transmembrane Domain (TM) and Short Cytoplasmic Domain, (semaphorin) 5A (SEMA5A, Accession NM_003966). Accordingly, utilities of VGAM1958 include diagnosis, prevention and treatment of diseases and clinical conditions associated with SEMA5A. SEP15 (Accession NM_004261) is another VGAM1958 host target gene. SEP15 BINDING SITE is HOST TARGET binding site found in the 3' untranslated region of mRNA encoded by SEP15, corresponding to a HOST TARGET binding site such as BINDING SITE I, BINDING SITE II or BINDING SITE III. Table 2 illustrates the complementarity of the nucleotide sequences of SEP15 BINDING SITE, designated SEQ ID:10452, to the nucleotide sequence of VGAM1958 RNA, herein designated VGAM RNA, also designated SEQ ID:4669.

Another function of VGAM1958 is therefore inhibition of SEP15 (Accession NM_004261). Accordingly, utilities of VGAM1958 include diagnosis, prevention and treatment of diseases and clinical conditions associated with SEP15. Small EDRK-rich Factor 1B (centromeric) (SERF1B, Accession NM_022978) is another VGAM1958 host target gene. SERF1B BINDING SITE is HOST TARGET binding site found in the 3' untranslated region of mRNA encoded by SERF1B, corresponding to a HOST TARGET binding site such as BINDING SITE I, BINDING SITE II or BINDING SITE III. Table 2 illustrates the complementarity of the nucleotide sequences of SERF1B BINDING SITE, designated SEQ ID:23260, to the nucleotide sequence of VGAM1958 RNA, herein designated VGAM RNA, also designated SEQ ID:4669.

Another function of VGAM1958 is therefore inhibition of Small EDRK-rich Factor 1B (centromeric) (SERF1B, Accession NM_022978). Accordingly, utilities of VGAM1958 include diagnosis, prevention and treatment of diseases and clinical conditions associated with SERF1B. Splicing Factor, Arginine/serine-rich 12 (SFRS12, Accession NM_139168) is another VGAM1958 host target gene. SFRS12 BINDING SITE is HOST TARGET binding site found in the 5' untranslated region of mRNA encoded by SFRS12, corresponding to a HOST TARGET binding site such as BINDING SITE I, BINDING SITE II or BINDING SITE III. Table 2 illustrates the complementarity of the nucleotide sequences of SFRS12 BINDING SITE, designated SEQ ID:29177, to the nucleotide sequence of VGAM1958 RNA, herein designated VGAM RNA, also designated SEQ ID:4669.

Another function of VGAM1958 is therefore inhibition of Splicing Factor, Arginine/serine-rich 12 (SFRS12, Accession NM_139168). Accordingly, utilities of VGAM1958 include diagnosis, prevention and treatment of diseases and clinical conditions associated with SFRS12. SH3 and Multiple Ankyrin Repeat Domains 3 (SHANK3, Accession XM_037493) is another VGAM1958 host target gene. SHANK3 BINDING SITE is HOST TARGET binding site found in the 5' untranslated region of mRNA encoded by SHANK3, corresponding to a HOST TARGET binding site such as BINDING SITE I, BINDING SITE II or BINDING SITE III. Table 2 illustrates the complementarity of the nucleotide sequences of SHANK3 BINDING SITE, designated SEQ ID:32634, to the nucleotide sequence of VGAM1958 RNA, herein designated VGAM RNA, also designated SEQ ID:4669.

Another function of VGAM1958 is therefore inhibition of SH3 and Multiple Ankyrin Repeat Domains 3 (SHANK3, Accession XM_037493). Accordingly, utilities of VGAM1958 include diagnosis, prevention and treatment of diseases and clinical conditions associated with SHANK3. ShrmL (Accession NM_020859) is another VGAM1958 host target gene. ShrmL BINDING SITE is HOST TARGET binding site found in the 3' untranslated region of mRNA encoded by ShrmL, corresponding to a HOST TARGET binding site such as BINDING SITE I, BINDING SITE II or BINDING SITE III. Table 2 illustrates the complementarity of the nucleotide sequences of ShrmL BINDING SITE, designated SEQ ID:21911, to the nucleotide sequence of VGAM1958 RNA, herein designated VGAM RNA, also designated SEQ ID:4669.

Another function of VGAM1958 is therefore inhibition of ShrmL (Accession NM_020859). Accordingly, utilities of VGAM1958 include diagnosis, prevention and treatment of diseases and clinical conditions associated with ShrmL. Solute Carrier Family 12, (potassium-chloride transporter) Member 5 (SLC12A5, Accession NM_020708) is another VGAM1958 host target gene. SLC12A5 BINDING SITE is HOST TARGET binding site found in the 3' untranslated region of mRNA encoded by SLC12A5, corresponding to a HOST TARGET binding site such as BINDING SITE I, BINDING SITE II or BINDING SITE III. Table 2 illustrates the complementarity of the nucleotide sequences of SLC12A5 BINDING SITE, designated SEQ ID:21852, to the nucleotide sequence of VGAM1958 RNA, herein designated VGAM RNA, also designated SEQ ID:4669.

Another function of VGAM1958 is therefore inhibition of Solute Carrier Family 12, (potassium-chloride transporter) Member 5 (SLC12A5, Accession NM_020708). Accordingly, utilities of VGAM1958 include diagnosis, prevention and treatment of diseases and clinical conditions associated with SLC12A5. Solute Carrier Family 26, Member 10 (SLC26A10, Accession NM_133489) is another VGAM1958 host target gene. SLC26A10 BINDING SITE is HOST TARGET binding site found in the 5' untranslated region of mRNA encoded by SLC26A10, corresponding to a HOST TARGET binding site such as BINDING SITE I, BINDING SITE II or BINDING SITE III. Table 2 illustrates the complementarity of the nucleotide sequences of SLC26A10 BINDING SITE, designated SEQ ID:28562, to the nucleotide sequence of VGAM1958 RNA, herein designated VGAM RNA, also designated SEQ ID:4669.

Another function of VGAM1958 is therefore inhibition of Solute Carrier Family 26, Member 10 (SLC26A10, Accession NM_133489). Accordingly, utilities of VGAM1958 include diagnosis, prevention and treatment of diseases and clinical conditions associated with SLC26A10. Solute Carrier Family 38, Member 5 (SLC38A5, Accession NM_033518) is another VGAM1958 host target gene. SLC38A5 BINDING SITE1 and SLC38A5 BINDING SITE2 are HOST TARGET binding sites found in untranslated regions of mRNA encoded by SLC38A5, corresponding to HOST TARGET binding sites such as BINDING SITE I, BINDING SITE II or BINDING SITE III. Table 2 illustrates the complementarity of the nucleotide sequences of SLC38A5 BINDING SITE1 and SLC38A5 BINDING SITE2, designated SEQ ID:27297 and SEQ ID:27299 respectively, to the nucleotide sequence of VGAM1958 RNA, herein designated VGAM RNA, also designated SEQ ID:4669.

Another function of VGAM1958 is therefore inhibition of Solute Carrier Family 38, Member 5 (SLC38A5, Accession NM_033518). Accordingly, utilities of VGAM1958 include diagnosis, prevention and treatment of diseases and clinical conditions associated with SLC38A5. Synaptosomal-associated Protein, 29 kDa (SNAP29, Accession NM_004782) is another VGAM1958 host target gene. SNAP29 BINDING SITE is HOST TARGET binding site found in the 3' untranslated region of mRNA encoded by SNAP29, corresponding to a HOST TARGET binding site such as BINDING SITE I, BINDING SITE II or BINDING SITE III. Table 2 illustrates the complementarity of the nucleotide sequences of SNAP29 BINDING SITE, designated SEQ ID:11188, to the nucleotide sequence of VGAM1958 RNA, herein designated VGAM RNA, also designated SEQ ID:4669.

Another function of VGAM1958 is therefore inhibition of Synaptosomal-associated Protein, 29 kDa (SNAP29, Accession NM_004782). Accordingly, utilities of VGAM1958 include diagnosis, prevention and treatment of diseases and clinical conditions associated with SNAP29. Synaptosomal-associated Protein, 91 kDa Homolog (mouse) (SNAP91, Accession NM_014841) is another VGAM1958 host target gene. SNAP91 BINDING SITE is HOST TARGET binding site found in the 3' untranslated region of mRNA encoded by SNAP91, corresponding to a HOST TARGET binding site such as BINDING SITE I, BINDING SITE II or BINDING SITE III. Table 2 illustrates the complementarity of the nucleotide sequences of SNAP91 BINDING SITE, designated SEQ ID:16870, to the nucleotide sequence of VGAM1958 RNA, herein designated VGAM RNA, also designated SEQ ID:4669.

Another function of VGAM1958 is therefore inhibition of Synaptosomal-associated Protein, 91 kDa Homolog (mouse) (SNAP91, Accession NM_014841). Accordingly, utilities of VGAM1958 include diagnosis, prevention and treatment of diseases and clinical conditions associated with SNAP91. Syntaphilin (SNPH, Accession NM_014723) is another VGAM1958 host target gene. SNPH BINDING SITE1 and SNPH BINDING SITE2 are HOST TARGET binding sites found in untranslated regions of mRNA encoded by SNPH, corresponding to HOST TARGET binding sites such as BINDING SITE I, BINDING SITE II or BINDING SITE III. Table 2 illustrates the complementarity of the nucleotide sequences of SNPH BINDING SITE1 and SNPH BINDING SITE2, designated SEQ ID:16287 and SEQ ID:16299 respectively, to the nucleotide sequence of VGAM1958 RNA, herein designated VGAM RNA, also designated SEQ ID:4669.

Another function of VGAM1958 is therefore inhibition of Syntaphilin (SNPH, Accession NM_014723). Accordingly, utilities of VGAM1958 include diagnosis, prevention and treatment of diseases and clinical conditions associated with SNPH. Serine Palmitoyltransferase, Long Chain Base Subunit 2 (SPTLC2, Accession NM_004863) is another VGAM1958 host target gene. SPTLC2 BINDING SITE is HOST TARGET binding site found in the 3' untranslated region of mRNA encoded by SPTLC2, corresponding to a HOST TARGET binding site such as BINDING SITE I, BINDING SITE II or BINDING SITE III. Table 2 illustrates the complementarity of the nucleotide sequences of SPTLC2 BINDING SITE, designated SEQ ID:11282, to the nucleotide sequence of VGAM1958 RNA, herein designated VGAM RNA, also designated SEQ ID:4669.

Another function of VGAM1958 is therefore inhibition of Serine Palmitoyltransferase, Long Chain Base Subunit 2 (SPTLC2, Accession NM_004863). Accordingly, utilities of VGAM1958 include diagnosis, prevention and treatment of diseases and clinical conditions associated with SPTLC2. SSH2 (Accession XM_030846) is another VGAM1958 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31183, to the nucleotide sequence of VGAM1958 RNA, herein designated VGAM RNA, also designated SEQ ID:4669.

Another function of VGAM1958 is therefore inhibition of SSH2 (Accession XM_030846). Accordingly, utilities of VGAM1958 include diagnosis, prevention and treatment of diseases and clinical conditions associated with SSH2. Signal Transducing Adaptor Molecule (SH3 domain and ITAM motif) 2 (STAM2, Accession NM_005843) is another VGAM1958 host target gene. STAM2 BINDING SITE is HOST TARGET binding site found in the 5' untranslated region of mRNA encoded by STAM2, corresponding to a HOST TARGET binding site such as BINDING SITE I, BINDING SITE II or BINDING SITE III. Table 2 illustrates the complementarity of the nucleotide sequences of STAM2 BINDING SITE, designated SEQ ID:12459, to the nucleotide sequence of VGAM1958 RNA, herein designated VGAM RNA, also designated SEQ ID:4669.

Another function of VGAM1958 is therefore inhibition of Signal Transducing Adaptor Molecule (SH3 domain and ITAM motif) 2 (STAM2, Accession NM_005843). Accordingly, utilities of VGAM1958 include diagnosis, prevention and treatment of diseases and clinical conditions associated with STAM2. START Domain Containing 7 (STARD7, Accession NM_020151) is another VGAM1958 host target gene. STARD7 BINDING SITE1 and STARD7 BINDING SITE2 are HOST TARGET binding sites found in untranslated regions of mRNA encoded by STARD7, corresponding to HOST TARGET binding sites such as BINDING SITE I, BINDING SITE II or BINDING SITE III. Table 2 illustrates the complementarity of the nucleotide sequences of STARD7 BINDING SITE1 and STARD7 BINDING SITE2, designated SEQ ID:21359 and SEQ ID:29261 respectively, to the nucleotide sequence of VGAM1958 RNA, herein designated VGAM RNA, also designated SEQ ID:4669.

Another function of VGAM1958 is therefore inhibition of START Domain Containing 7 (STARD7, Accession NM_020151). Accordingly, utilities of VGAM1958 include diagnosis, prevention and treatment of diseases and clinical conditions associated with STARD7. Stromal Interaction Molecule 2 (STIM2, Accession NM_020860) is another VGAM1958 host target gene. STIM2 BINDING SITE is HOST TARGET binding site found in the 5' untranslated region of mRNA encoded by STIM2, corresponding to a HOST TARGET binding site such as BINDING SITE I, BINDING SITE II or BINDING SITE III. Table 2 illustrates the complementarity of the nucleotide sequences of STIM2 BINDING SITE, designated SEQ ID:21914, to the nucleotide sequence of VGAM1958 RNA, herein designated VGAM RNA, also designated SEQ ID:4669.

Another function of VGAM1958 is therefore inhibition of Stromal Interaction Molecule 2 (STIM2, Accession NM_020860). Accordingly, utilities of VGAM1958 include diagnosis, prevention and treatment of diseases and clinical conditions associated with STIM2. Stomatin (EPB72)-like 1 (STOML1, Accession NM_004809) is another VGAM1958 host target gene. STOML1 BINDING SITE is HOST TARGET binding site found in the 3' untranslated region of mRNA encoded by STOML1, corresponding to a HOST TARGET binding site such as BINDING SITE I, BINDING SITE II or BINDING SITE III. Table 2 illustrates the complementarity of the nucleotide sequences of STOML1 BINDING SITE, designated SEQ ID:11232, to the nucleotide sequence of VGAM1958 RNA, herein designated VGAM RNA, also designated SEQ ID:4669.

Another function of VGAM1958 is therefore inhibition of Stomatin (EPB72)-like 1 (STOML1, Accession NM_004809). Accordingly, utilities of VGAM1958 include diagnosis, prevention and treatment of diseases and clinical conditions associated with STOML1. Synaptotagmin XIII (SYT13, Accession XM_167880) is another VGAM1958 host target gene. SYT13 BINDING SITE is HOST TARGET binding site found in the 3' untranslated region of mRNA encoded by SYT13, corresponding to a HOST TARGET binding site such as BINDING SITE I, BINDING SITE II or BINDING SITE III. Table 2 illustrates the complementarity of the nucleotide sequences of SYT13 BINDING SITE, designated SEQ ID:44891, to the nucleotide sequence of VGAM1958 RNA, herein designated VGAM RNA, also designated SEQ ID:4669.

Another function of VGAM1958 is therefore inhibition of Synaptotagmin XIII (SYT13, Accession XM_167880). Accordingly, utilities of VGAM1958 include diagnosis, prevention and treatment of diseases and clinical conditions associated with SYT13. TA-PP2C (Accession NM_139283) is another VGAM1958 host target gene. TA-PP2C BINDING SITE is HOST TARGET binding site found in the 3' untranslated region of mRNA encoded by TA-PP2C, corresponding to a HOST TARGET binding site such as BINDING SITE I, BINDING SITE II or BINDING SITE III. Table 2 illustrates the complementarity of the nucleotide sequences of TA-PP2C BINDING SITE, designated SEQ ID:29282, to the nucleotide sequence of VGAM1958 RNA, herein designated VGAM RNA, also designated SEQ ID:4669.

Another function of VGAM1958 is therefore inhibition of TA-PP2C (Accession NM_139283). Accordingly, utilities of VGAM1958 include diagnosis, prevention and treatment of diseases and clinical conditions associated with TA-PP2C. TBC1 Domain Family, Member 2 (TBC1D2, Accession NM_018421) is another VGAM1958 host target gene. TBC1D2 BINDING SITE is HOST TARGET binding site found in the 5' untranslated region of mRNA encoded by TBC1D2, corresponding to a HOST TARGET binding site such as BINDING SITE I, BINDING SITE II or BINDING SITE III. Table 2 illustrates the complementarity of the nucleotide sequences of TBC1D2 BINDING SITE, designated SEQ ID:20468, to the nucleotide sequence of VGAM1958 RNA, herein designated VGAM RNA, also designated SEQ ID:4669.

Another function of VGAM1958 is therefore inhibition of TBC1 Domain Family, Member 2 (TBC1D2, Accession NM_018421). Accordingly, utilities of VGAM1958 include diagnosis, prevention and treatment of diseases and clinical conditions associated with TBC1D2. T-cell Leukemia/lymphoma 6 (TCL6, Accession NM_012468) is another VGAM1958 host target gene. TCL6 BINDING SITE1 through TCL6 BINDING SITE6 are HOST TARGET binding sites found in untranslated regions of mRNA encoded by TCL6, corresponding to HOST TARGET binding sites such as BINDING SITE I, BINDING SITE II or BINDING SITE III. Table 2 illustrates the complementarity of the nucleotide sequences of TCL6 BINDING SITE1 through TCL6 BINDING SITE6, designated SEQ ID:14842, SEQ ID:14844, SEQ ID:21759, SEQ ID:21768, SEQ ID:15765 and SEQ ID:15768 respectively, to the nucleotide sequence of VGAM1958 RNA, herein designated VGAM RNA, also designated SEQ ID:4669.

Another function of VGAM1958 is therefore inhibition of T-cell Leukemia/lymphoma 6 (TCL6, Accession NM_012468). Accordingly, utilities of VGAM1958 include diagnosis, prevention and treatment of diseases and clinical conditions associated with TCL6. TIP-1 (Accession NM_014604) is another VGAM1958 host target gene. TIP-1 BINDING SITE is HOST TARGET binding site found in the 3' untranslated region of mRNA encoded by TIP-1, corresponding to a HOST TARGET binding site such as BINDING SITE I, BINDING SITE II or BINDING SITE III. Table 2 illustrates the complementarity of the nucleotide sequences of TIP-1 BINDING SITE, designated SEQ ID:15969, to the nucleotide sequence of VGAM1958 RNA, herein designated VGAM RNA, also designated SEQ ID:4669.

Another function of VGAM1958 is therefore inhibition of TIP-1 (Accession NM_014604). Accordingly, utilities of VGAM1958 include diagnosis, prevention and treatment of diseases and clinical conditions associated with TIP-1. Torsin Family 2, Member A (TOR2A, Accession NM_130459) is another VGAM1958 host target gene. TOR2A BINDING SITE is HOST TARGET binding site found in the 3' untranslated region of mRNA encoded by TOR2A, corresponding to a HOST TARGET binding site such as BINDING SITE I, BINDING SITE II or BINDING SITE III. Table 2 illustrates the complementarity of the nucleotide sequences of TOR2A BINDING SITE, designated SEQ ID:28217, to the nucleotide sequence of VGAM1958 RNA, herein designated VGAM RNA, also designated SEQ ID:4669.

Another function of VGAM1958 is therefore inhibition of Torsin Family 2, Member A (TOR2A, Accession NM_130459). Accordingly, utilities of VGAM1958 include diagnosis, prevention and treatment of diseases and clinical conditions associated with TOR2A. TNF Receptor-associated Factor 3 (TRAF3, Accession XM_007256) is another VGAM1958 host target gene. TRAF3 BINDING SITE1 through TRAF3 BINDING SITE4 are HOST TARGET binding sites found in untranslated regions of mRNA encoded by TRAF3, corresponding to HOST TARGET binding sites such as BINDING SITE I, BINDING SITE II or BINDING SITE III. Table 2 illustrates the complementarity of the nucleotide sequences of TRAF3 BINDING SITE1 through TRAF3 BINDING SITE4, designated SEQ ID:30046, SEQ ID:30047, SEQ ID:30049 and SEQ ID:9303 respectively, to the nucleotide sequence of VGAM1958 RNA, herein designated VGAM RNA, also designated SEQ ID:4669.

Another function of VGAM1958 is therefore inhibition of TNF Receptor-associated Factor 3 (TRAF3, Accession XM_007256). Accordingly, utilities of VGAM1958 include diagnosis, prevention and treatment of diseases and clinical conditions associated with TRAF3. Three Prime Repair Exonuclease 1 (TREX1, Accession NM_033627) is another VGAM1958 host target gene. TREX1 BINDING SITE1 through TREX1 BINDING SITE3 are HOST TARGET binding sites found in untranslated regions of mRNA encoded by TREX1, corresponding to HOST TARGET binding sites such as BINDING SITE I, BINDING SITE II or BINDING SITE III. Table 2 illustrates the complementarity of the nucleotide sequences of TREX1 BINDING SITE1 through TREX1 BINDING SITE3, designated SEQ ID:27342, SEQ ID:27349 and SEQ ID:13195 respectively, to the nucleotide sequence of VGAM1958 RNA, herein designated VGAM RNA, also designated SEQ ID:4669.

Another function of VGAM1958 is therefore inhibition of Three Prime Repair Exonuclease 1 (TREX1, Accession NM_033627). Accordingly, utilities of VGAM1958 include diagnosis, prevention and treatment of diseases and clinical conditions associated with TREX1. Tetratricopeptide Repeat Domain 4 (TTC4, Accession XM_038926) is another VGAM1958 host target gene. TTC4 BINDING SITE is HOST TARGET binding site found in the 3' untranslated region of mRNA encoded by TTC4, corresponding to a HOST TARGET binding site such as BINDING SITE I, BINDING SITE II or BINDING SITE III. Table 2 illustrates the complementarity of the nucleotide sequences of TTC4 BINDING SITE, designated SEQ ID:32958, to the nucleotide sequence of VGAM1958 RNA, herein designated VGAM RNA, also designated SEQ ID:4669.

Another function of VGAM1958 is therefore inhibition of Tetratricopeptide Repeat Domain 4 (TTC4, Accession XM_038926). Accordingly, utilities of VGAM1958 include diagnosis, prevention and treatment of diseases and clinical conditions associated with TTC4. Testis-specific Transcript, Y-linked 2 (TTTY2, Accession XM_099029) is another VGAM1958 host target gene. TTTY2 BINDING SITE1 and TTTY2 BINDING SITE2 are HOST TARGET binding sites found in untranslated regions of mRNA encoded by TTTY2, corresponding to HOST TARGET binding sites such as BINDING SITE I, BINDING SITE II or BINDING SITE III. Table 2 illustrates the complementarity of the nucleotide sequences of TTTY2 BINDING SITE1 and TTTY2 BINDING SITE2, designated SEQ ID:42069 and SEQ ID:42073 respectively, to the nucleotide sequence of VGAM1958 RNA, herein designated VGAM RNA, also designated SEQ ID:4669.

Another function of VGAM1958 is therefore inhibition of Testis-specific Transcript, Y-linked 2 (TTTY2, Accession XM_099029). Accordingly, utilities of VGAM1958 include diagnosis, prevention and treatment of diseases and clinical conditions associated with TTTY2. U5-116KD (Accession NM_004247) is another VGAM1958 host target gene. U5-116KD BINDING SITE is HOST TARGET binding site found in the 3' untranslated region of mRNA encoded by U5-116KD, corresponding to a HOST TARGET binding site such as BINDING SITE I, BINDING SITE II or BINDING SITE III. Table 2 illustrates the complementarity of the nucleotide sequences of U5-116KD BINDING SITE, designated SEQ ID:10439, to the nucleotide sequence of VGAM1958 RNA, herein designated VGAM RNA, also designated SEQ ID:4669.

Another function of VGAM1958 is therefore inhibition of U5-116KD (Accession NM_004247). Accordingly, utilities of VGAM1958 include diagnosis, prevention and treatment of diseases and clinical conditions associated with U5-116KD. UBAP (Accession XM_084277) is another VGAM1958 host target gene. UBAP BINDING SITE is HOST TARGET binding site found in the 5' untranslated region of mRNA encoded by UBAP, corresponding to a HOST TARGET binding site such as BINDING SITE I, BINDING SITE II or BINDING SITE III. Table 2 illustrates the complementarity of the nucleotide sequences of UBAP BINDING SITE, designated SEQ ID:37535, to the nucleotide sequence of VGAM1958 RNA, herein designated VGAM RNA, also designated SEQ ID:4669.

Another function of VGAM1958 is therefore inhibition of UBAP (Accession XM_084277). Accordingly, utilities of VGAM1958 include diagnosis, prevention and treatment of diseases and clinical conditions associated with UBAP. Ubiquitin-like, Containing PHD and RING Finger Domains, 1 (UHRF1, Accession NM_013282) is another VGAM1958 host target gene. UHRF1 BINDING SITE is HOST TARGET binding site found in the 3' untranslated region of mRNA encoded by UHRF1, corresponding to a HOST TARGET binding site such as BINDING SITE I, BINDING SITE II or BINDING SITE III. Table 2 illustrates the complementarity of the nucleotide sequences of UHRF1 BINDING SITE, designated SEQ ID:14952, to the nucleotide sequence of VGAM1958 RNA, herein designated VGAM RNA, also designated SEQ ID:4669.

Another function of VGAM1958 is therefore inhibition of Ubiquitin-like, Containing PHD and RING Finger Domains, 1 (UHRF1, Accession NM_013282). Accordingly, utilities of VGAM1958 include diagnosis, prevention and treatment of diseases and clinical conditions associated with UHRF1. VI (Accession NM_013443) is another VGAM1958 host target gene. VI BINDING SITE is HOST TARGET binding site found in the 3' untranslated region of mRNA encoded by VI, corresponding to a HOST TARGET binding site such as BINDING SITE I, BINDING SITE II or BINDING SITE III. Table 2 illustrates the complementarity of the nucleotide sequences of VI BINDING SITE, designated SEQ ID:15105, to the nucleotide sequence of VGAM1958 RNA, herein designated VGAM RNA, also designated SEQ ID:4669.

Another function of VGAM1958 is therefore inhibition of VI (Accession NM_013443). Accordingly, utilities of VGAM1958 include diagnosis, prevention and treatment of diseases and clinical conditions associated with VI. VMP1 (Accession NM_030938) is another VGAM1958 host target gene. VMP1 BINDING SITE is HOST TARGET binding site found in the 3' untranslated region of mRNA encoded by VMP1, corresponding to a HOST TARGET binding site such as BINDING SITE I, BINDING SITE II or BINDING SITE III. Table 2 illustrates the complementarity of the nucleotide sequences of VMP1 BINDING SITE, designated SEQ ID:25205, to the nucleotide sequence of VGAM1958 RNA, herein designated VGAM RNA, also designated SEQ ID:4669.

Another function of VGAM1958 is therefore inhibition of VMP1 (Accession NM_030938). Accordingly, utilities of VGAM1958 include diagnosis, prevention and treatment of diseases and clinical conditions associated with VMP1. VPS39 (Accession XM_031720) is another VGAM1958 host target gene. VPS39 BINDING SITE is HOST TARGET binding site found in the 3' untranslated region of mRNA encoded by VPS39, corresponding to a HOST TARGET binding site such as BINDING SITE I, BINDING SITE II or BINDING SITE III. Table 2 illustrates the complementarity of the nucleotide sequences of VPS39 BINDING SITE, designated SEQ ID:31473, to the nucleotide sequence of VGAM1958 RNA, herein designated VGAM RNA, also designated SEQ ID:4669.

Another function of VGAM1958 is therefore inhibition of VPS39 (Accession XM_031720). Accordingly, utilities of VGAM1958 include diagnosis, prevention and treatment of diseases and clinical conditions associated with VPS39. WD Repeat Domain 5B (WDR5B, Accession NM_019069) is another VGAM1958 host target gene. WDR5B BINDING SITE is HOST TARGET binding site found in the 5' untranslated region of mRNA encoded by WDR5B, corresponding to a HOST TARGET binding site such as BINDING SITE I, BINDING SITE II or BINDING SITE III. Table 2 illustrates the complementarity of the nucleotide sequences of WDR5B BINDING SITE, designated SEQ ID:21148, to the nucleotide sequence of VGAM1958 RNA, herein designated VGAM RNA, also designated SEQ ID:4669.

Another function of VGAM1958 is therefore inhibition of WD Repeat Domain 5B (WDR5B, Accession NM_019069). Accordingly, utilities of VGAM1958 include diagnosis, prevention and treatment of diseases and clinical conditions associated with WDR5B. Zinc Finger, DHHC Domain Containing 1 (ZDHHC1, Accession XM_085369) is another VGAM1958 host target gene. ZDHHC1 BINDING SITE is HOST TARGET binding site found in the 5' untranslated region of mRNA encoded by ZDHHC1, corresponding to a HOST TARGET binding site such as BINDING SITE I, BINDING SITE II or BINDING SITE III. Table 2 illustrates the complementarity of the nucleotide sequences of ZDHHC1 BINDING SITE, designated SEQ ID:38079, to the nucleotide sequence of VGAM1958 RNA, herein designated VGAM RNA, also designated SEQ ID:4669.

Another function of VGAM1958 is therefore inhibition of Zinc Finger, DHHC Domain Containing 1 (ZDHHC1, Accession XM_085369). Accordingly, utilities of VGAM1958 include diagnosis, prevention and treatment of diseases and clinical conditions associated with ZDHHC1. Zinc Finger, DHHC Domain Containing 3 (ZDHHC3, Accession NM_016598) is another VGAM1958 host target gene. ZDHHC3 BINDING SITE is HOST TARGET binding site found in the 3' untranslated region of mRNA encoded by ZDHHC3, corresponding to a HOST TARGET binding site such as BINDING SITE I, BINDING SITE II or BINDING SITE III. Table 2 illustrates the complementarity of the nucleotide sequences of ZDHHC3 BINDING SITE, designated SEQ ID:18686, to the nucleotide sequence of VGAM1958 RNA, herein designated VGAM RNA, also designated SEQ ID:4669.

Another function of VGAM1958 is therefore inhibition of Zinc Finger, DHHC Domain Containing 3 (ZDHHC3, Accession NM_016598). Accordingly, utilities of VGAM1958 include diagnosis, prevention and treatment of diseases and clinical conditions associated with ZDHHC3. ZF (Accession NM_021212) is another VGAM1958 host target gene. ZF BINDING SITE is HOST TARGET binding site found in the 3' untranslated region of mRNA encoded by ZF, corresponding to a HOST TARGET binding site such as BINDING SITE I, BINDING SITE II or BINDING SITE III. Table 2 illustrates the complementarity of the nucleotide sequences of ZF BINDING SITE, designated SEQ ID:22188, to the nucleotide sequence of VGAM1958 RNA, herein designated VGAM RNA, also designated SEQ ID:4669.

Another function of VGAM1958 is therefore inhibition of ZF (Accession NM_021212). Accordingly, utilities of VGAM1958 include diagnosis, prevention and treatment of diseases and clinical conditions associated with ZF. ZFD25 (Accession NM_016220) is another VGAM1958 host target gene. ZFD25 BINDING SITE is HOST TARGET binding site found in the 5' untranslated region of mRNA encoded by ZFD25, corresponding to a HOST TARGET binding site such as BINDING SITE I, BINDING SITE II or BINDING SITE III. Table 2 illustrates the complementarity of the nucleotide sequences of ZFD25 BINDING SITE, designated SEQ ID:18323, to the nucleotide sequence of VGAM1958 RNA, herein designated VGAM RNA, also designated SEQ ID:4669.

Another function of VGAM1958 is therefore inhibition of ZFD25 (Accession NM_016220). Accordingly, utilities of VGAM1958 include diagnosis, prevention and treatment of diseases and clinical conditions associated with ZFD25. Zinc Finger Protein 95 Homolog (mouse) (ZFP95, Accession NM_014569) is another VGAM1958 host target gene. ZFP95 BINDING SITE1 and ZFP95 BINDING SITE2 are HOST TARGET binding sites found in untranslated regions of mRNA encoded by ZFP95, corresponding to HOST TARGET binding sites such as BINDING SITE I, BINDING SITE II or BINDING SITE III. Table 2 illustrates the complementarity of the nucleotide sequences of ZFP95 BINDING SITE1 and ZFP95 BINDING SITE2, designated SEQ ID:15922 and SEQ ID:29712 respectively, to the nucleotide sequence of VGAM1958 RNA, herein designated VGAM RNA, also designated SEQ ID:4669.

Another function of VGAM1958 is therefore inhibition of Zinc Finger Protein 95 Homolog (mouse) (ZFP95, Accession NM_014569). Accordingly, utilities of VGAM1958 include diagnosis, prevention and treatment of diseases and clinical conditions associated with ZFP95. Zinc Finger Protein 197 (ZNF197, Accession NM_006991) is another VGAM1958 host target gene. ZNF197 BINDING SITE is HOST TARGET binding site found in the 3' untranslated region of mRNA encoded by ZNF197, corresponding to a HOST TARGET binding site such as BINDING SITE I, BINDING SITE II or BINDING SITE III. Table 2 illustrates the complementarity of the nucleotide sequences of ZNF197 BINDING SITE, designated SEQ ID:13854, to the nucleotide sequence of VGAM1958 RNA, herein designated VGAM RNA, also designated SEQ ID:4669.

Another function of VGAM1958 is therefore inhibition of Zinc Finger Protein 197 (ZNF197, Accession NM_006991). Accordingly, utilities of VGAM1958 include diagnosis, prevention and treatment of diseases and clinical conditions associated with ZNF197. Zinc Finger Protein 213 (ZNF213, Accession XM_036493) is another VGAM1958 host target gene. ZNF213 BINDING SITE1 and ZNF213 BINDING SITE2 are HOST TARGET binding sites found in untranslated regions of mRNA encoded by ZNF213, corresponding to HOST TARGET binding sites such as BINDING SITE I, BINDING SITE II or BINDING SITE III. Table 2 illustrates the complementarity of the nucleotide sequences of ZNF213 BINDING SITE1 and ZNF213 BINDING SITE2, designated SEQ ID:32462 and SEQ ID:32464 respectively, to the nucleotide sequence of VGAM1958 RNA, herein designated VGAM RNA, also designated SEQ ID:4669.

Another function of VGAM1958 is therefore inhibition of Zinc Finger Protein 213 (ZNF213, Accession XM_036493). Accordingly, utilities of VGAM1958 include diagnosis, prevention and treatment of diseases and clinical conditions associated with ZNF213. ZNF340 (Accession XM_097701) is another VGAM1958 host target gene. ZNF340 BINDING SITE is HOST TARGET binding site found in the 5' untranslated region of mRNA encoded by ZNF340, corresponding to a HOST TARGET binding site such as BINDING SITE I, BINDING SITE II or BINDING SITE III. Table 2 illustrates the complementarity of the nucleotide sequences of ZNF340 BINDING SITE, designated SEQ ID:41034, to the nucleotide sequence of VGAM1958 RNA, herein designated VGAM RNA, also designated SEQ ID:4669.

Another function of VGAM1958 is therefore inhibition of ZNF340 (Accession XM_097701). Accordingly, utilities of VGAM1958 include diagnosis, prevention and treatment of diseases and clinical conditions associated with ZNF340. LOC114987 (Accession NM_145241) is another VGAM1958 host target gene. LOC114987 BINDING SITE is HOST TARGET binding site found in the 3' untranslated region of mRNA encoded by LOC114987, corresponding to a HOST TARGET binding site such as BINDING SITE I, BINDING SITE II or BINDING SITE III. Table 2 illustrates the complementarity of the nucleotide sequences of LOC114987 BINDING SITE, designated SEQ ID:29755, to the nucleotide sequence of VGAM1958 RNA, herein designated VGAM RNA, also designated SEQ ID:4669.

Another function of VGAM1958 is therefore inhibition of LOC114987 (Accession NM_145241). Accordingly, utilities of VGAM1958 include diagnosis, prevention and treatment of diseases and clinical conditions associated with LOC114987. LOC115123 (Accession XM_055276) is another VGAM1958 host target gene. LOC115123 BINDING SITE is HOST TARGET binding site found in the 5' untranslated region of mRNA encoded by LOC115123, corresponding to a HOST TARGET binding site such as BINDING SITE I, BINDING SITE II or BINDING SITE III. Table 2 illustrates the complementarity of the nucleotide sequences of LOC115123 BINDING SITE, designated SEQ ID:36247, to the nucleotide sequence of VGAM1958 RNA, herein designated VGAM RNA, also designated SEQ ID:4669.

Another function of VGAM1958 is therefore inhibition of LOC115123 (Accession XM_055276). Accordingly, utilities of VGAM1958 include diagnosis, prevention and treatment of diseases and clinical conditions associated with LOC115123. LOC121642 (Accession XM_058581) is another VGAM1958 host target gene. LOC121642 BINDING SITE is HOST TARGET binding site found in the 5' untranslated region of mRNA encoded by LOC121642, corresponding to a HOST TARGET binding site such as BINDING SITE I, BINDING SITE II or BINDING SITE III. Table 2 illustrates the complementarity of the nucleotide sequences of LOC121642 BINDING SITE, designated SEQ ID:36674, to the nucleotide sequence of VGAM1958 RNA, herein designated VGAM RNA, also designated SEQ ID:4669.

Another function of VGAM1958 is therefore inhibition of LOC121642 (Accession XM_058581). Accordingly, utilities of VGAM1958 include diagnosis, prevention and treatment of diseases and clinical conditions associated with LOC121642. LOC122416 (Accession XM_058615) is another VGAM1958 host target gene. LOC122416 BINDING SITE is HOST TARGET binding site found in the 5' untranslated region of mRNA encoded by LOC122416, corresponding to a HOST TARGET binding site such as BINDING SITE I, BINDING SITE II or BINDING SITE III. Table 2 illustrates the complementarity of the nucleotide sequences of LOC122416 BINDING SITE, designated SEQ ID:36682, to the nucleotide sequence of VGAM1958 RNA, herein designated VGAM RNA, also designated SEQ ID:4669.

Another function of VGAM1958 is therefore inhibition of LOC122416 (Accession XM_058615). Accordingly, utilities of VGAM1958 include diagnosis, prevention and treatment of diseases and clinical conditions associated with LOC122416. LOC122525 (Accession XM_071793) is another VGAM1958 host target gene. LOC122525 BINDING SITE is HOST TARGET binding site found in the 5' untranslated region of mRNA encoded by LOC122525, corresponding to a HOST TARGET binding site such as BINDING SITE I, BINDING SITE II or BINDING SITE III. Table 2 illustrates the complementarity of the nucleotide sequences of LOC122525 BINDING SITE, designated SEQ ID:37422, to the nucleotide sequence of VGAM1958 RNA, herein designated VGAM RNA, also designated SEQ ID:4669.

Another function of VGAM1958 is therefore inhibition of LOC122525 (Accession XM_071793). Accordingly, utilities of VGAM1958 include diagnosis, prevention and treatment of diseases and clinical conditions associated with LOC122525. LOC124044 (Accession XM_071871) is another VGAM1958 host target gene. LOC124044 BINDING SITE is HOST TARGET binding site found in the 3' untranslated region of mRNA encoded by LOC124044, corresponding to a HOST TARGET binding site such as BINDING SITE I, BINDING SITE II or BINDING SITE III. Table 2 illustrates the complementarity of the nucleotide sequences of LOC124044 BINDING SITE, designated SEQ ID:37433, to the nucleotide sequence of VGAM1958 RNA, herein designated VGAM RNA, also designated SEQ ID:4669.

Another function of VGAM1958 is therefore inhibition of LOC124044 (Accession XM_071871). Accordingly, utilities of VGAM1958 include diagnosis, prevention and treatment of diseases and clinical conditions associated with LOC124044. LOC124460 (Accession XM_071892) is another VGAM1958 host target gene. LOC124460 BINDING SITE is HOST TARGET binding site found in the 5' untranslated region of mRNA encoded by LOC124460, corresponding to a HOST TARGET binding site such as BINDING SITE I, BINDING SITE II or BINDING SITE III. Table 2 illustrates the complementarity of the nucleotide sequences of LOC124460 BINDING SITE, designated SEQ ID:37444, to the nucleotide sequence of VGAM1958 RNA, herein designated VGAM RNA, also designated SEQ ID:4669.

Another function of VGAM1958 is therefore inhibition of LOC124460 (Accession XM_071892). Accordingly, utilities of VGAM1958 include diagnosis, prevention and treatment of diseases and clinical conditions associated with LOC124460. LOC126917 (Accession XM_059091) is another VGAM1958 host target gene. LOC126917 BINDING SITE1 and LOC126917 BINDING SITE2 are HOST TARGET binding sites found in untranslated regions of mRNA encoded by LOC126917, corresponding to HOST TARGET binding sites such as BINDING SITE I, BINDING SITE II or BINDING SITE III. Table 2 illustrates the complementarity of the nucleotide sequences of LOC126917 BINDING SITE1 and LOC126917 BINDING SITE2, designated SEQ ID:36866 and SEQ ID:36872 respectively, to the nucleotide sequence of VGAM1958 RNA, herein designated VGAM RNA, also designated SEQ ID:4669.

Another function of VGAM1958 is therefore inhibition of LOC126917 (Accession XM_059091). Accordingly, utilities of VGAM1958 include diagnosis, prevention and treatment of diseases and clinical conditions associated with LOC126917. LOC132332 (Accession XM_072306) is another VGAM1958 host target gene. LOC132332 BINDING SITE is HOST TARGET binding site found in the 3' untranslated region of mRNA encoded by LOC132332, corresponding to a HOST TARGET binding site such as BINDING SITE I, BINDING SITE II or BINDING SITE III. Table 2 illustrates the complementarity of the nucleotide sequences of LOC132332 BINDING SITE, designated SEQ ID:37487, to the nucleotide sequence of VGAM1958 RNA, herein designated VGAM RNA, also designated SEQ ID:4669.

Another function of VGAM1958 is therefore inhibition of LOC132332 (Accession XM_072306). Accordingly, utilities of VGAM1958 include diagnosis, prevention and treatment of diseases and clinical conditions associated with LOC132332. LOC133634 (Accession XM_059664) is another VGAM1958 host target gene. LOC133634 BINDING SITE is HOST TARGET binding site found in the 3' untranslated region of mRNA encoded by LOC133634, corresponding to a HOST TARGET binding site such as BINDING SITE I, BINDING SITE II or BINDING SITE III. Table 2 illustrates the complementarity of the nucleotide sequences of LOC133634 BINDING SITE, designated SEQ ID:37049, to the nucleotide sequence of VGAM1958 RNA, herein designated VGAM RNA, also designated SEQ ID:4669.

Another function of VGAM1958 is therefore inhibition of LOC133634 (Accession XM_059664). Accordingly, utilities of VGAM1958 include diagnosis, prevention and treatment of diseases and clinical conditions associated with LOC133634. LOC135398 (Accession XM_069333) is another VGAM1958 host target gene. LOC135398 BINDING SITE is HOST TARGET binding site found in the 3' untranslated region of mRNA encoded by LOC135398, corresponding to a HOST TARGET binding site such as BINDING SITE I, BINDING SITE II or BINDING SITE III. Table 2 illustrates the complementarity of the nucleotide sequences of LOC135398 BINDING SITE, designated SEQ ID:37386, to the nucleotide sequence of VGAM1958 RNA, herein designated VGAM RNA, also designated SEQ ID:4669.

Another function of VGAM1958 is therefore inhibition of LOC135398 (Accession XM_069333). Accordingly, utilities of VGAM1958 include diagnosis, prevention and treatment of diseases and clinical conditions associated with LOC135398. LOC135763 (Accession NM_138572) is another VGAM1958 host target gene. LOC135763 BINDING SITE is HOST TARGET binding site found in the 3' untranslated region of mRNA encoded by LOC135763, corresponding to a HOST TARGET binding site such as BINDING SITE I, BINDING SITE II or BINDING SITE III. Table 2 illustrates the complementarity of the nucleotide sequences of LOC135763 BINDING SITE, designated SEQ ID:28883, to the nucleotide sequence of VGAM1958 RNA, herein designated VGAM RNA, also designated SEQ ID:4669.

Another function of VGAM1958 is therefore inhibition of LOC135763 (Accession NM_138572). Accordingly, utilities of VGAM1958 include diagnosis, prevention and treatment of diseases and clinical conditions associated with LOC135763. LOC138617 (Accession XM_070997) is another VGAM1958 host target gene. LOC138617 BINDING SITE is HOST TARGET binding site found in the 5' untranslated region of mRNA encoded by LOC138617, corresponding to a HOST TARGET binding site such as BINDING SITE I, BINDING SITE II or BINDING SITE III. Table 2 illustrates the complementarity of the nucleotide sequences of LOC138617 BINDING SITE, designated SEQ ID:37396, to the nucleotide sequence of VGAM1958 RNA, herein designated VGAM RNA, also designated SEQ ID:4669.

Another function of VGAM1958 is therefore inhibition of LOC138617 (Accession XM_070997). Accordingly, utilities of VGAM1958 include diagnosis, prevention and treatment of diseases and clinical conditions associated with LOC138617. LOC142927 (Accession XM_084380) is another VGAM1958 host target gene. LOC142927 BINDING SITE is HOST TARGET binding site found in the 3' untranslated region of mRNA encoded by LOC142927, corresponding to a HOST TARGET binding site such as BINDING SITE I, BINDING SITE II or BINDING SITE III. Table 2 illustrates the complementarity of the nucleotide sequences of LOC142927 BINDING SITE, designated SEQ ID:37565, to the nucleotide sequence of VGAM1958 RNA, herein designated VGAM RNA, also designated SEQ ID:4669.

Another function of VGAM1958 is therefore inhibition of LOC142927 (Accession XM_084380). Accordingly, utilities of VGAM1958 include diagnosis, prevention and treatment of diseases and clinical conditions associated with LOC142927. LOC143381 (Accession XM_084501) is another VGAM1958 host target gene. LOC143381 BINDING SITE is HOST TARGET binding site found in the 3' untranslated region of mRNA encoded by LOC143381, corresponding to a HOST TARGET binding site such as BINDING SITE I, BINDING SITE II or BINDING SITE III. Table 2 illustrates the complementarity of the nucleotide sequences of LOC143381 BINDING SITE, designated SEQ ID:37611, to the nucleotide sequence of VGAM1958 RNA, herein designated VGAM RNA, also designated SEQ ID:4669.

Another function of VGAM1958 is therefore inhibition of LOC143381 (Accession XM_084501). Accordingly, utilities of VGAM1958 include diagnosis, prevention and treatment of diseases and clinical conditions associated with LOC143381. LOC143914 (Accession XM_084654) is another VGAM1958 host target gene. LOC143914 BINDING SITE is HOST TARGET binding site found in the 5' untranslated region of mRNA encoded by LOC143914, corresponding to a HOST TARGET binding site such as BINDING SITE I, BINDING SITE II or BINDING SITE III. Table 2 illustrates the complementarity of the nucleotide sequences of LOC143914 BINDING SITE, designated SEQ ID:37636, to the nucleotide sequence of VGAM1958 RNA, herein designated VGAM RNA, also designated SEQ ID:4669.

Another function of VGAM1958 is therefore inhibition of LOC143914 (Accession XM_084654). Accordingly, utilities of VGAM1958 include diagnosis, prevention and treatment of diseases and clinical conditions associated with LOC143914. LOC144305 (Accession XM_096572) is another VGAM1958 host target gene. LOC144305 BINDING SITE is HOST TARGET binding site found in the 3' untranslated region of mRNA encoded by LOC144305, corresponding to a HOST TARGET binding site such as BINDING SITE I, BINDING SITE II or BINDING SITE III. Table 2 illustrates the complementarity of the nucleotide sequences of LOC144305 BINDING SITE, designated SEQ ID:40400, to the nucleotide sequence of VGAM1958 RNA, herein designated VGAM RNA, also designated SEQ ID:4669.

Another function of VGAM1958 is therefore inhibition of LOC144305 (Accession XM_096572). Accordingly, utilities of VGAM1958 include diagnosis, prevention and treatment of diseases and clinical conditions associated with LOC144305. LOC144373 (Accession XM_084841) is another VGAM1958 host target gene. LOC144373 BINDING SITE is HOST TARGET binding site found in the 3' untranslated region of mRNA encoded by LOC144373, corresponding to a HOST TARGET binding site such as BINDING SITE I, BINDING SITE II or BINDING SITE III. Table 2 illustrates the complementarity of the nucleotide sequences of LOC144373 BINDING SITE, designated SEQ ID:37729, to the nucleotide sequence of VGAM1958 RNA, herein designated VGAM RNA, also designated SEQ ID:4669.

Another function of VGAM1958 is therefore inhibition of LOC144373 (Accession XM_084841). Accordingly, utilities of VGAM1958 include diagnosis, prevention and treatment of diseases and clinical conditions associated with LOC144373. LOC144577 (Accession XM_084911) is another VGAM1958 host target gene. LOC144577 BINDING SITE is HOST TARGET binding site found in the 3' untranslated region of mRNA encoded by LOC144577, corresponding to a HOST TARGET binding site such as BINDING SITE I, BINDING SITE II or BINDING SITE III. Table 2 illustrates the complementarity of the nucleotide sequences of LOC144577 BINDING SITE, designated SEQ ID:37768, to the nucleotide sequence of VGAM1958 RNA, herein designated VGAM RNA, also designated SEQ ID:4669.

Another function of VGAM1958 is therefore inhibition of LOC144577 (Accession XM_084911). Accordingly, utilities of VGAM1958 include diagnosis, prevention and treatment of diseases and clinical conditions associated with LOC144577. LOC144893 (Accession XM_096687) is another VGAM1958 host target gene. LOC144893 BINDING SITE is HOST TARGET binding site found in the 3' untranslated region of mRNA encoded by LOC144893, corresponding to a HOST TARGET binding site such as BINDING SITE I, BINDING SITE II or BINDING SITE III. Table 2 illustrates the complementarity of the nucleotide sequences of LOC144893 BINDING SITE, designated SEQ ID:40457, to the nucleotide sequence of VGAM1958 RNA, herein designated VGAM RNA, also designated SEQ ID:4669.

Another function of VGAM1958 is therefore inhibition of LOC144893 (Accession XM_096687). Accordingly, utilities of VGAM1958 include diagnosis, prevention and treatment of diseases and clinical conditions associated with LOC144893. LOC145195 (Accession XM_096731) is another VGAM1958 host target gene. LOC145195 BINDING SITE is HOST TARGET binding site found in the 3' untranslated region of mRNA encoded by LOC145195, corresponding to a HOST TARGET binding site such as BINDING SITE I, BINDING SITE II or BINDING SITE III. Table 2 illustrates the complementarity of the nucleotide sequences of LOC145195 BINDING SITE, designated SEQ ID:40515, to the nucleotide sequence of VGAM1958 RNA, herein designated VGAM RNA, also designated SEQ ID:4669.

Another function of VGAM1958 is therefore inhibition of LOC145195 (Accession XM_096731). Accordingly, utilities of VGAM1958 include diagnosis, prevention and treatment of diseases and clinical conditions associated with LOC145195. LOC145438 (Accession XM_096781) is another VGAM1958 host target gene. LOC145438 BINDING SITE is HOST TARGET binding site found in the 5' untranslated region of mRNA encoded by LOC145438, corresponding to a HOST TARGET binding site such as BINDING SITE I, BINDING SITE II or BINDING SITE III. Table 2 illustrates the complementarity of the nucleotide sequences of LOC145438 BINDING SITE, designated SEQ ID:40536, to the nucleotide sequence of VGAM1958 RNA, herein designated VGAM RNA, also designated SEQ ID:4669.

Another function of VGAM1958 is therefore inhibition of LOC145438 (Accession XM_096781). Accordingly, utilities of VGAM1958 include diagnosis, prevention and treatment of diseases and clinical conditions associated with LOC145438. LOC145608 (Accession XM_096818) is another VGAM1958 host target gene. LOC145608 BINDING SITE is HOST TARGET binding site found in the 5' untranslated region of mRNA encoded by LOC145608, corresponding to a HOST TARGET binding site such as BINDING SITE I, BINDING SITE II or BINDING SITE III. Table 2 illustrates the complementarity of the nucleotide sequences of LOC145608 BINDING SITE, designated SEQ ID:40541, to the nucleotide sequence of VGAM1958 RNA, herein designated VGAM RNA, also designated SEQ ID:4669.

Another function of VGAM1958 is therefore inhibition of LOC145608 (Accession XM_096818). Accordingly, utilities of VGAM1958 include diagnosis, prevention and treatment of diseases and clinical conditions associated with LOC145608. LOC145678 (Accession XM_096832) is another VGAM1958 host target gene. LOC145678 BINDING SITE is HOST TARGET binding site found in the 3' untranslated region of mRNA encoded by LOC145678, corresponding to a HOST TARGET binding site such as BINDING SITE I, BINDING SITE II or BINDING SITE III. Table 2 illustrates the complementarity of the nucleotide sequences of LOC145678 BINDING SITE, designated SEQ ID:40552, to the nucleotide sequence of VGAM1958 RNA, herein designated VGAM RNA, also designated SEQ ID:4669.

Another function of VGAM1958 is therefore inhibition of LOC145678 (Accession XM_096832). Accordingly, utilities of VGAM1958 include diagnosis, prevention and treatment of diseases and clinical conditions associated with LOC145678. LOC145815 (Accession XM_096874) is another VGAM1958 host target gene. LOC145815 BINDING SITE is HOST TARGET binding site found in the 5' untranslated region of mRNA encoded by LOC145815, corresponding to a HOST TARGET binding site such as BINDING SITE I, BINDING SITE II or BINDING SITE III. Table 2 illustrates the complementarity of the nucleotide sequences of LOC145815 BINDING SITE, designated SEQ ID:40600, to the nucleotide sequence of VGAM1958 RNA, herein designated VGAM RNA, also designated SEQ ID:4669.

Another function of VGAM1958 is therefore inhibition of LOC145815 (Accession XM_096874). Accordingly, utilities of VGAM1958 include diagnosis, prevention and treatment of diseases and clinical conditions associated with LOC145815. LOC145820 (Accession XM_085246) is another VGAM1958 host target gene. LOC145820 BINDING SITE is HOST TARGET binding site found in the 3' untranslated region of mRNA encoded by LOC145820, corresponding to a HOST TARGET binding site such as BINDING SITE I, BINDING SITE II or BINDING SITE III. Table 2 illustrates the complementarity of the nucleotide sequences of LOC145820 BINDING SITE, designated SEQ ID:37990, to the nucleotide sequence of VGAM1958 RNA, herein designated VGAM RNA, also designated SEQ ID:4669.

Another function of VGAM1958 is therefore inhibition of LOC145820 (Accession XM_085246). Accordingly, utilities of VGAM1958 include diagnosis, prevention and treatment of diseases and clinical conditions associated with LOC145820. LOC145826 (Accession XM_096875) is another VGAM1958 host target gene. LOC145826 BINDING SITE is HOST TARGET binding site found in the 5' untranslated region of mRNA encoded by LOC145826, corresponding to a HOST TARGET binding site such as BINDING SITE I, BINDING SITE II or BINDING SITE III. Table 2 illustrates the complementarity of the nucleotide sequences of LOC145826 BINDING SITE, designated SEQ ID:40609, to the nucleotide sequence of VGAM1958 RNA, herein designated VGAM RNA, also designated SEQ ID:4669.

Another function of VGAM1958 is therefore inhibition of LOC145826 (Accession XM_096875). Accordingly, utilities of VGAM1958 include diagnosis, prevention and treatment of diseases and clinical conditions associated with LOC145826. LOC145989 (Accession XM_004815) is another VGAM1958 host target gene. LOC145989 BINDING SITE is HOST TARGET binding site found in the 3' untranslated region of mRNA encoded by LOC145989, corresponding to a HOST TARGET binding site such as BINDING SITE I, BINDING SITE II or BINDING SITE III. Table 2 illustrates the complementarity of the nucleotide sequences of LOC145989 BINDING SITE, designated SEQ ID:29953, to the nucleotide sequence of VGAM1958 RNA, herein designated VGAM RNA, also designated SEQ ID:4669.

Another function of VGAM1958 is therefore inhibition of LOC145989 (Accession XM_004815). Accordingly, utilities of VGAM1958 include diagnosis, prevention and treatment of diseases and clinical conditions associated with LOC145989. LOC146050 (Accession XM_085301) is another VGAM1958 host target gene. LOC146050 BINDING SITE is HOST TARGET binding site found in the 3' untranslated region of mRNA encoded by LOC146050, corresponding to a HOST TARGET binding site such as BINDING SITE I, BINDING SITE II or BINDING SITE III. Table 2 illustrates the complementarity of the nucleotide sequences of LOC146050 BINDING SITE, designated SEQ ID:38057, to the nucleotide sequence of VGAM1958 RNA, herein designated VGAM RNA, also designated SEQ ID:4669.

Another function of VGAM1958 is therefore inhibition of LOC146050 (Accession XM_085301). Accordingly, utilities of VGAM1958 include diagnosis, prevention and treatment of diseases and clinical conditions associated with LOC146050. LOC146108 (Accession XM_085322) is another VGAM1958 host target gene. LOC146108 BINDING SITE1 and LOC146108 BINDING SITE2 are HOST TARGET binding sites found in untranslated regions of mRNA encoded by LOC146108, corresponding to HOST TARGET binding sites such as BINDING SITE I, BINDING SITE II or BINDING SITE III. Table 2 illustrates the complementarity of the nucleotide sequences of LOC146108 BINDING SITE1 and LOC146108 BINDING SITE2, designated SEQ ID:38059 and SEQ ID:38060 respectively, to the nucleotide sequence of VGAM1958 RNA, herein designated VGAM RNA, also designated SEQ ID:4669.

Another function of VGAM1958 is therefore inhibition of LOC146108 (Accession XM_085322). Accordingly, utilities of VGAM1958 include diagnosis, prevention and treatment of diseases and clinical conditions associated with LOC146108. LOC146445 (Accession XM_096999) is another VGAM1958 host target gene. LOC146445 BINDING SITE is HOST TARGET binding site found in the 3' untranslated region of mRNA encoded by LOC146445, corresponding to a HOST TARGET binding site such as BINDING SITE I, BINDING SITE II or BINDING SITE III. Table 2 illustrates the complementarity of the nucleotide sequences of LOC146445 BINDING SITE, designated SEQ ID:40698, to the nucleotide sequence of VGAM1958 RNA, herein designated VGAM RNA, also designated SEQ ID:4669.

Another function of VGAM1958 is therefore inhibition of LOC146445 (Accession XM_096999). Accordingly, utilities of VGAM1958 include diagnosis, prevention and treatment of diseases and clinical conditions associated with LOC146445. LOC146455 (Accession XM_085471) is another VGAM1958 host target gene. LOC146455 BINDING SITE is HOST TARGET binding site found in the 5' untranslated region of mRNA encoded by LOC146455, corresponding to a HOST TARGET binding site such as BINDING SITE I, BINDING SITE II or BINDING SITE III. Table 2 illustrates the complementarity of the nucleotide sequences of LOC146455 BINDING SITE, designated SEQ ID:38158, to the nucleotide sequence of VGAM1958 RNA, herein designated VGAM RNA, also designated SEQ ID:4669.

Another function of VGAM1958 is therefore inhibition of LOC146455 (Accession XM_085471). Accordingly, utilities of VGAM1958 include diagnosis, prevention and treatment of diseases and clinical conditions associated with LOC146455. LOC146488 (Accession XM_047748) is another VGAM1958 host target gene. LOC146488 BINDING SITE1 through LOC146488 BINDING SITE3 are HOST TARGET binding sites found in untranslated regions of mRNA encoded by LOC146488, corresponding to HOST TARGET binding sites such as BINDING SITE I, BINDING SITE II or BINDING SITE III. Table 2 illustrates the complementarity of the nucleotide sequences of LOC146488 BINDING SITE1 through LOC146488 BINDING SITE3, designated SEQ ID:35047, SEQ ID:35048 and SEQ ID:35049 respectively, to the nucleotide sequence of VGAM1958 RNA, herein designated VGAM RNA, also designated SEQ ID:4669.

Another function of VGAM1958 is therefore inhibition of LOC146488 (Accession XM_047748). Accordingly, utilities of VGAM1958 include diagnosis, prevention and treatment of diseases and clinical conditions associated with LOC146488. LOC146669 (Accession XM_085534) is another VGAM1958 host target gene. LOC146669 BINDING SITE is HOST TARGET binding site found in the 3' untranslated region of mRNA encoded by LOC146669, corresponding to a HOST TARGET binding site such as BINDING SITE I, BINDING SITE II or BINDING SITE III. Table 2 illustrates the complementarity of the nucleotide sequences of LOC146669 BINDING SITE, designated SEQ ID:38225, to the nucleotide sequence of VGAM1958 RNA, herein designated VGAM RNA, also designated SEQ ID:4669.

Another function of VGAM1958 is therefore inhibition of LOC146669 (Accession XM_085534). Accordingly, utilities of VGAM1958 include diagnosis, prevention and treatment of diseases and clinical conditions associated with LOC146669. LOC146756 (Accession XM_097085) is another VGAM1958 host target gene. LOC146756 BINDING SITE1 and LOC146756 BINDING SITE2 are HOST TARGET binding sites found in untranslated regions of mRNA encoded by LOC146756, corresponding to HOST TARGET binding sites such as BINDING SITE I, BINDING SITE II or BINDING SITE III. Table 2 illustrates the complementarity of the nucleotide sequences of LOC146756 BINDING SITE1 and LOC146756 BINDING SITE2, designated SEQ ID:40735 and SEQ ID:40738 respectively, to the nucleotide sequence of VGAM1958 RNA, herein designated VGAM RNA, also designated SEQ ID:4669.

Another function of VGAM1958 is therefore inhibition of LOC146756 (Accession XM_097085). Accordingly, utilities of VGAM1958 include diagnosis, prevention and treatment of diseases and clinical conditions associated with LOC146756. LOC146839 (Accession XM_097107) is another VGAM1958 host target gene. LOC146839 BINDING SITE is HOST TARGET binding site found in the 5' untranslated region of mRNA encoded by LOC146839, corresponding to a HOST TARGET binding site such as BIND- ING SITE I, BINDING SITE II or BINDING SITE III. Table 2 illustrates the complementarity of the nucleotide sequences of LOC146839 BINDING SITE, designated SEQ ID:40756, to the nucleotide sequence of VGAM1958 RNA, herein designated VGAM RNA, also designated SEQ ID:4669.

Another function of VGAM1958 is therefore inhibition of LOC146839 (Accession XM_097107). Accordingly, utilities of VGAM1958 include diagnosis, prevention and treatment of diseases and clinical conditions associated with LOC146839. LOC146990 (Accession XM_097149) is another VGAM1958 host target gene. LOC146990 BINDING SITE is HOST TARGET binding site found in the 5' untranslated region of mRNA encoded by LOC146990, corresponding to a HOST TARGET binding site such as BINDING SITE I, BINDING SITE II or BINDING SITE III. Table 2 illustrates the complementarity of the nucleotide sequences of LOC146990 BINDING SITE, designated SEQ ID:40776, to the nucleotide sequence of VGAM1958 RNA, herein designated VGAM RNA, also designated SEQ ID:4669.

Another function of VGAM1958 is therefore inhibition of LOC146990 (Accession XM_097149). Accordingly, utilities of VGAM1958 include diagnosis, prevention and treatment of diseases and clinical conditions associated with LOC146990. LOC147054 (Accession XM_097172) is another VGAM1958 host target gene. LOC147054 BINDING SITE is HOST TARGET binding site found in the 5' untranslated region of mRNA encoded by LOC147054, corresponding to a HOST TARGET binding site such as BINDING SITE I, BINDING SITE II or BINDING SITE III. Table 2 illustrates the complementarity of the nucleotide sequences of LOC147054 BINDING SITE, designated SEQ ID:40794, to the nucleotide sequence of VGAM1958 RNA, herein designated VGAM RNA, also designated SEQ ID:4669.

Another function of VGAM1958 is therefore inhibition of LOC147054 (Accession XM_097172). Accordingly, utilities of VGAM1958 include diagnosis, prevention and treatment of diseases and clinical conditions associated with LOC147054. LOC147057 (Accession XM_097166) is another VGAM1958 host target gene. LOC147057 BINDING SITE is HOST TARGET binding site found in the 3' untranslated region of mRNA encoded by LOC147057, corresponding to a HOST TARGET binding site such as BINDING SITE I, BINDING SITE II or BINDING SITE III. Table 2 illustrates the complementarity of the nucleotide sequences of LOC147057 BINDING SITE, designated SEQ ID:40784, to the nucleotide sequence of VGAM1958 RNA, herein designated VGAM RNA, also designated SEQ ID:4669.

Another function of VGAM1958 is therefore inhibition of LOC147057 (Accession XM_097166). Accordingly, utilities of VGAM1958 include diagnosis, prevention and treatment of diseases and clinical conditions associated with LOC147057. LOC147077 (Accession XM_085699) is another VGAM1958 host target gene. LOC147077 BINDING SITE is HOST TARGET binding site found in the 3' untranslated region of mRNA encoded by LOC147077, corresponding to a HOST TARGET binding site such as BINDING SITE I, BINDING SITE II or BINDING SITE III. Table 2 illustrates the complementarity of the nucleotide sequences of LOC147077 BINDING SITE, designated SEQ ID:38297, to the nucleotide sequence of VGAM1958 RNA, herein designated VGAM RNA, also designated SEQ ID:4669.

Another function of VGAM1958 is therefore inhibition of LOC147077 (Accession XM_085699). Accordingly, utilities of VGAM1958 include diagnosis, prevention and treatment of diseases and clinical conditions associated with LOC147077. LOC147136 (Accession XM_085716) is another VGAM1958 host target gene. LOC147136 BINDING SITE is HOST TARGET binding site found in the 3' untranslated region of mRNA encoded by LOC147136, corresponding to a HOST TARGET binding site such as BINDING SITE I, BINDING SITE II or BINDING SITE III. Table 2 illustrates the complementarity of the nucleotide sequences of LOC147136 BINDING SITE, designated SEQ ID:38305, to the nucleotide sequence of VGAM1958 RNA, herein designated VGAM RNA, also designated SEQ ID:4669.

Another function of VGAM1958 is therefore inhibition of LOC147136 (Accession XM_085716). Accordingly, utilities of VGAM1958 include diagnosis, prevention and treatment of diseases and clinical conditions associated with LOC147136. LOC147160 (Accession XM_097202) is another VGAM1958 host target gene. LOC147160 BINDING SITE is HOST TARGET binding site found in the 5' untranslated region of mRNA encoded by LOC147160, corresponding to a HOST TARGET binding site such as BINDING SITE I, BINDING SITE II or BINDING SITE III. Table 2 illustrates the complementarity of the nucleotide sequences of LOC147160 BINDING SITE, designated SEQ ID:40810, to the nucleotide sequence of VGAM1958 RNA, herein designated VGAM RNA, also designated SEQ ID:4669.

Another function of VGAM1958 is therefore inhibition of LOC147160 (Accession XM_097202). Accordingly, utilities of VGAM1958 include diagnosis, prevention and treatment of diseases and clinical conditions associated with LOC147160. LOC147353 (Accession XM_097227) is another VGAM1958 host target gene. LOC147353 BINDING SITE is HOST TARGET binding site found in the 3' untranslated region of mRNA encoded by LOC147353, corresponding to a HOST TARGET binding site such as BINDING SITE I, BINDING SITE II or BINDING SITE III. Table 2 illustrates the complementarity of the nucleotide sequences of LOC147353 BINDING SITE, designated SEQ ID:40833, to the nucleotide sequence of VGAM1958 RNA, herein designated VGAM RNA, also designated SEQ ID:4669.

Another function of VGAM1958 is therefore inhibition of LOC147353 (Accession XM_097227). Accordingly, utilities of VGAM1958 include diagnosis, prevention and treatment of diseases and clinical conditions associated with LOC147353. LOC148114 (Accession XM_086050) is another VGAM1958 host target gene. LOC148114 BINDING SITE is HOST TARGET binding site found in the 5' untranslated region of mRNA encoded by LOC148114, corresponding to a HOST TARGET binding site such as BINDING SITE I, BINDING SITE II or BINDING SITE III. Table 2 illustrates the complementarity of the nucleotide sequences of LOC148114 BINDING SITE, designated SEQ ID:38467, to the nucleotide sequence of VGAM1958 RNA, herein designated VGAM RNA, also designated SEQ ID:4669.

Another function of VGAM1958 is therefore inhibition of LOC148114 (Accession XM_086050). Accordingly, utilities of VGAM1958 include diagnosis, prevention and treatment of diseases and clinical conditions associated with LOC148114. LOC148479 (Accession XM_086204) is another VGAM1958 host target gene. LOC148479 BINDING SITE is HOST TARGET binding site found in the 3' untranslated region of mRNA encoded by LOC148479, corresponding to a HOST TARGET binding site such as BINDING SITE I, BINDING SITE II or BINDING SITE III. Table 2 illustrates the complementarity of the nucleotide sequences of LOC148479 BINDING SITE, designated SEQ ID:38542, to the nucleotide sequence of VGAM1958 RNA, herein designated VGAM RNA, also designated SEQ ID:4669.

Another function of VGAM1958 is therefore inhibition of LOC148479 (Accession XM_086204). Accordingly, utilities of VGAM1958 include diagnosis, prevention and treatment of diseases and clinical conditions associated with LOC148479. LOC148603 (Accession XM_086247) is another VGAM1958 host target gene. LOC148603 BINDING SITE is HOST TARGET binding site found in the 5' untranslated region of mRNA encoded by LOC148603, corresponding to a HOST TARGET binding site such as BINDING SITE I, BINDING SITE II or BINDING SITE III. Table 2 illustrates the complementarity of the nucleotide sequences of LOC148603 BINDING SITE, designated SEQ ID:38568, to the nucleotide sequence of VGAM1958 RNA, herein designated VGAM RNA, also designated SEQ ID:4669.

Another function of VGAM1958 is therefore inhibition of LOC148603 (Accession XM_086247). Accordingly, utilities of VGAM1958 include diagnosis, prevention and treatment of diseases and clinical conditions associated with LOC148603. LOC148697 (Accession XM_086276) is another VGAM1958 host target gene. LOC148697 BINDING SITE is HOST TARGET binding site found in the 3' untranslated region of mRNA encoded by LOC148697, corresponding to a HOST TARGET binding site such as BINDING SITE I, BINDING SITE II or BINDING SITE III. Table 2 illustrates the complementarity of the nucleotide sequences of LOC148697 BINDING SITE, designated SEQ ID:38570, to the nucleotide sequence of VGAM1958 RNA, herein designated VGAM RNA, also designated SEQ ID:4669.

Another function of VGAM1958 is therefore inhibition of LOC148697 (Accession XM_086276). Accordingly, utilities of VGAM1958 include diagnosis, prevention and treatment of diseases and clinical conditions associated with LOC148697. LOC148809 (Accession XM_086325) is another VGAM1958 host target gene. LOC148809 BINDING SITE is HOST TARGET binding site found in the 5' untranslated region of mRNA encoded by LOC148809, corresponding to a HOST TARGET binding site such as BINDING SITE I, BINDING SITE II or BINDING SITE III. Table 2 illustrates the complementarity of the nucleotide sequences of LOC148809 BINDING SITE, designated SEQ ID:38592, to the nucleotide sequence of VGAM1958 RNA, herein designated VGAM RNA, also designated SEQ ID:4669.

Another function of VGAM1958 is therefore inhibition of LOC148809 (Accession XM_086325). Accordingly, utilities of VGAM1958 include diagnosis, prevention and treatment of diseases and clinical conditions associated with LOC148809. LOC148894 (Accession XM_097542) is another VGAM1958 host target gene. LOC148894 BINDING SITE1 and LOC148894 BINDING SITE2 are HOST TARGET binding sites found in untranslated regions of mRNA encoded by LOC148894, corresponding to HOST TARGET binding sites such as BINDING SITE I, BINDING SITE II or BINDING SITE III. Table 2 illustrates the complementarity of the nucleotide sequences of LOC148894 BINDING SITE1 and LOC148894 BINDING SITE2, designated SEQ ID:40915 and SEQ ID:40918 respectively, to the nucleotide sequence of VGAM1958 RNA, herein designated VGAM RNA, also designated SEQ ID:4669.

Another function of VGAM1958 is therefore inhibition of LOC148894 (Accession XM_097542). Accordingly, utilities of VGAM1958 include diagnosis, prevention and treatment of diseases and clinical conditions associated with LOC148894. LOC149271 (Accession XM_086475) is another VGAM1958 host target gene. LOC149271 BINDING SITE is HOST TARGET binding site found in the 3' untranslated region of mRNA encoded by LOC149271, corresponding to a HOST TARGET binding site such as BINDING SITE I, BINDING SITE II or BINDING SITE III. Table 2 illustrates the complementarity of the nucleotide sequences of LOC149271 BINDING SITE, designated SEQ ID:38680, to the nucleotide sequence of VGAM1958 RNA, herein designated VGAM RNA, also designated SEQ ID:4669.

Another function of VGAM1958 is therefore inhibition of LOC149271 (Accession XM_086475). Accordingly, utilities of VGAM1958 include diagnosis, prevention and treatment of diseases and clinical conditions associated with LOC149271. LOC149332 (Accession XM_097626) is another VGAM1958 host target gene. LOC149332 BINDING SITE1 and LOC149332 BINDING SITE2 are HOST TARGET binding sites found in untranslated regions of mRNA encoded by LOC149332, corresponding to HOST TARGET binding sites such as BINDING SITE I, BINDING SITE II or BINDING SITE III. Table 2 illustrates the complementarity of the nucleotide sequences of LOC149332 BINDING SITE1 and LOC149332 BINDING SITE2, designated SEQ ID:40980 and SEQ ID:40981 respectively, to the nucleotide sequence of VGAM1958 RNA, herein designated VGAM RNA, also designated SEQ ID:4669.

Another function of VGAM1958 is therefore inhibition of LOC149332 (Accession XM_097626). Accordingly, utilities of VGAM1958 include diagnosis, prevention and treatment of diseases and clinical conditions associated with LOC149332. LOC149421 (Accession XM_086528) is another VGAM1958 host target gene. LOC149421 BINDING SITE is HOST TARGET binding site found in the 5' untranslated region of mRNA encoded by LOC149421, corresponding to a HOST TARGET binding site such as BINDING SITE I, BINDING SITE II or BINDING SITE III. Table 2 illustrates the complementarity of the nucleotide sequences of LOC149421 BINDING SITE, designated SEQ ID:38745, to the nucleotide sequence of VGAM1958 RNA, herein designated VGAM RNA, also designated SEQ ID:4669.

Another function of VGAM1958 is therefore inhibition of LOC149421 (Accession XM_086528). Accordingly, utilities of VGAM1958 include diagnosis, prevention and treatment of diseases and clinical conditions associated with LOC149421. LOC149501 (Accession XM_059930) is another VGAM1958 host target gene. LOC149501 BINDING SITE is HOST TARGET binding site found in the 3' untranslated region of mRNA encoded by LOC149501, corresponding to a HOST TARGET binding site such as BINDING SITE I, BINDING SITE II or BINDING SITE III. Table 2 illustrates the complementarity of the nucleotide sequences of LOC149501 BINDING SITE, designated SEQ ID:37108, to the nucleotide sequence of VGAM1958 RNA, herein designated VGAM RNA, also designated SEQ ID:4669.

Another function of VGAM1958 is therefore inhibition of LOC149501 (Accession XM_059930). Accordingly, utilities of VGAM1958 include diagnosis, prevention and treatment of diseases and clinical conditions associated with LOC149501. LOC149684 (Accession XM_097710) is another VGAM1958 host target gene. LOC149684 BINDING SITE is HOST TARGET binding site found in the 5' untranslated region of mRNA encoded by LOC149684, corresponding to a HOST TARGET binding site such as BINDING SITE I, BINDING SITE II or BINDING SITE III. Table 2 illustrates the complementarity of the nucleotide sequences of LOC149684 BINDING SITE, designated SEQ ID:41047, to the nucleotide sequence of VGAM1958 RNA, herein designated VGAM RNA, also designated SEQ ID:4669.

Another function of VGAM1958 is therefore inhibition of LOC149684 (Accession XM_097710). Accordingly, utilities of VGAM1958 include diagnosis, prevention and treatment of diseases and clinical conditions associated with LOC149684. LOC149773 (Accession XM_086628) is another VGAM1958 host target gene. LOC149773 BINDING SITE is HOST TARGET binding site found in the 5' untranslated region of mRNA encoded by LOC149773, corresponding to a HOST TARGET binding site such as BINDING SITE I, BINDING SITE II or BINDING SITE III. Table 2 illustrates the complementarity of the nucleotide sequences of LOC149773 BINDING SITE, designated SEQ ID:38800, to the nucleotide sequence of VGAM1958 RNA, herein designated VGAM RNA, also designated SEQ ID:4669.

Another function of VGAM1958 is therefore inhibition of LOC149773 (Accession XM_086628). Accordingly, utilities of VGAM1958 include diagnosis, prevention and treatment of diseases and clinical conditions associated with LOC149773. LOC149950 (Accession XM_086732) is another VGAM1958 host target gene. LOC149950 BINDING SITE is HOST TARGET binding site found in the 5' untranslated region of mRNA encoded by LOC149950, corresponding to a HOST TARGET binding site such as BINDING SITE I, BINDING SITE II or BINDING SITE III. Table 2 illustrates the complementarity of the nucleotide sequences of LOC149950 BINDING SITE, designated SEQ ID:38840, to the nucleotide sequence of VGAM1958 RNA, herein designated VGAM RNA, also designated SEQ ID:4669.

Another function of VGAM1958 is therefore inhibition of LOC149950 (Accession XM_086732). Accordingly, utilities of VGAM1958 include diagnosis, prevention and treatment of diseases and clinical conditions associated with LOC149950. LOC150135 (Accession XM_086785) is another VGAM1958 host target gene. LOC150135 BINDING SITE is HOST TARGET binding site found in the 3' untranslated region of mRNA encoded by LOC150135, corresponding to a HOST TARGET binding site such as BINDING SITE I, BINDING SITE II or BINDING SITE III. Table 2 illustrates the complementarity of the nucleotide sequences of LOC150135 BINDING SITE, designated SEQ ID:38846, to the nucleotide sequence of VGAM1958 RNA, herein designated VGAM RNA, also designated SEQ ID:4669.

Another function of VGAM1958 is therefore inhibition of LOC150135 (Accession XM_086785). Accordingly, utilities of VGAM1958 include diagnosis, prevention and treatment of diseases and clinical conditions associated with LOC150135. LOC150139 (Accession XM_086794) is another VGAM1958 host target gene. LOC150139 BINDING SITE is HOST TARGET binding site found in the 5' untranslated region of mRNA encoded by LOC150139, corresponding to a HOST TARGET binding site such as BINDING SITE I, BINDING SITE II or BINDING SITE III. Table 2 illustrates the complementarity of the nucleotide sequences of LOC150139 BINDING SITE, designated SEQ ID:38857, to the nucleotide sequence of VGAM1958 RNA, herein designated VGAM RNA, also designated SEQ ID:4669.

Another function of VGAM1958 is therefore inhibition of LOC150139 (Accession XM_086794). Accordingly, utilities of VGAM1958 include diagnosis, prevention and treatment of diseases and clinical conditions associated with LOC150139. LOC150150 (Accession XM_097820) is another VGAM1958 host target gene. LOC150150 BINDING SITE is HOST TARGET binding site found in the 5' untranslated region of mRNA encoded by LOC150150, corresponding to a HOST TARGET binding site such as BINDING SITE I, BINDING SITE II or BINDING SITE III. Table 2 illustrates the complementarity of the nucleotide sequences of LOC150150 BINDING SITE, designated SEQ ID:41133, to the nucleotide sequence of VGAM1958 RNA, herein designated VGAM RNA, also designated SEQ ID:4669.

Another function of VGAM1958 is therefore inhibition of LOC150150 (Accession XM_097820). Accordingly, utilities of VGAM1958 include diagnosis, prevention and treatment of diseases and clinical conditions associated with LOC150150. LOC150157 (Accession XM_097823) is another VGAM1958 host target gene. LOC150157 BINDING SITE is HOST TARGET binding site found in the 5' untranslated region of mRNA encoded by LOC150157, corresponding to a HOST TARGET binding site such as BINDING SITE I, BINDING SITE II or BINDING SITE III. Table 2 illustrates the complementarity of the nucleotide sequences of LOC150157 BINDING SITE, designated SEQ ID:41140, to the nucleotide sequence of VGAM1958 RNA, herein designated VGAM RNA, also designated SEQ ID:4669.

Another function of VGAM1958 is therefore inhibition of LOC150157 (Accession XM_097823). Accordingly, utilities of VGAM1958 include diagnosis, prevention and treatment of diseases and clinical conditions associated with LOC150157. LOC150166 (Accession XM_097824) is another VGAM1958 host target gene. LOC150166 BINDING SITE is HOST TARGET binding site found in the 5' untranslated region of mRNA encoded by LOC150166, corresponding to a HOST TARGET binding site such as BINDING SITE I, BINDING SITE II or BINDING SITE III. Table 2 illustrates the complementarity of the nucleotide sequences of LOC150166 BINDING SITE, designated SEQ ID:41148, to the nucleotide sequence of VGAM1958 RNA, herein designated VGAM RNA, also designated SEQ ID:4669.

Another function of VGAM1958 is therefore inhibition of LOC150166 (Accession XM_097824). Accordingly, utilities of VGAM1958 include diagnosis, prevention and treatment of diseases and clinical conditions associated with LOC150166. LOC150406 (Accession XM_086908) is another VGAM1958 host target gene. LOC150406 BINDING SITE is HOST TARGET binding site found in the 3' untranslated region of mRNA encoded by LOC150406, corresponding to a HOST TARGET binding site such as BINDING SITE I, BINDING SITE II or BINDING SITE III. Table 2 illustrates the complementarity of the nucleotide sequences of LOC150406 BINDING SITE, designated SEQ ID:38964, to the nucleotide sequence of VGAM1958 RNA, herein designated VGAM RNA, also designated SEQ ID:4669.

Another function of VGAM1958 is therefore inhibition of LOC150406 (Accession XM_086908). Accordingly, utilities of VGAM1958 include diagnosis, prevention and treatment of diseases and clinical conditions associated with LOC150406. LOC150445 (Accession XM_086916) is another VGAM1958 host target gene. LOC150445 BINDING SITE is HOST TARGET binding site found in the 3' untranslated region of mRNA encoded by LOC150445, corresponding to a HOST TARGET binding site such as BINDING SITE I, BINDING SITE II or BINDING SITE III. Table 2 illustrates the complementarity of the nucleotide sequences of LOC150445 BINDING SITE, designated SEQ ID:38971, to the nucleotide sequence of VGAM1958 RNA, herein designated VGAM RNA, also designated SEQ ID:4669.

Another function of VGAM1958 is therefore inhibition of LOC150445 (Accession XM_086916). Accordingly, utilities of VGAM1958 include diagnosis, prevention and treatment of diseases and clinical conditions associated with LOC150445. LOC150465 (Accession XM_086924) is another VGAM1958 host target gene. LOC150465 BINDING SITE is HOST TARGET binding site found in the 5' untranslated region of mRNA encoded by LOC150465, corresponding to a HOST TARGET binding site such as BINDING SITE I, BINDING SITE II or BINDING SITE III. Table 2 illustrates the complementarity of the nucleotide sequences of LOC150465 BINDING SITE, designated SEQ ID:38973, to the nucleotide sequence of VGAM1958 RNA, herein designated VGAM RNA, also designated SEQ ID:4669.

Another function of VGAM1958 is therefore inhibition of LOC150465 (Accession XM_086924). Accordingly, utilities of VGAM1958 include diagnosis, prevention and treatment of diseases and clinical conditions associated with LOC150465. LOC150568 (Accession XM_097911) is another VGAM1958 host target gene. LOC150568 BINDING SITE is HOST TARGET binding site found in the 5' untranslated region of mRNA encoded by LOC150568, corresponding to a HOST TARGET binding site such as BINDING SITE I, BINDING SITE II or BINDING SITE III. Table 2 illustrates the complementarity of the nucleotide sequences of LOC150568 BINDING SITE, designated SEQ ID:41205, to the nucleotide sequence of VGAM1958 RNA, herein designated VGAM RNA, also designated SEQ ID:4669.

Another function of VGAM1958 is therefore inhibition of LOC150568 (Accession XM_097911). Accordingly, utilities of VGAM1958 include diagnosis, prevention and treatment of diseases and clinical conditions associated with LOC150568. LOC150577 (Accession XM_097918) is another VGAM1958 host target gene. LOC150577 BINDING SITE is HOST TARGET binding site found in the 3' untranslated region of mRNA encoded by LOC150577, corresponding to a HOST TARGET binding site such as BINDING SITE I, BINDING SITE II or BINDING SITE III. Table 2 illustrates the complementarity of the nucleotide sequences of LOC150577 BINDING SITE, designated SEQ ID:41215, to the nucleotide sequence of VGAM1958 RNA, herein designated VGAM RNA, also designated SEQ ID:4669.

Another function of VGAM1958 is therefore inhibition of LOC150577 (Accession XM_097918). Accordingly, utilities of VGAM1958 include diagnosis, prevention and treatment of diseases and clinical conditions associated with LOC150577. LOC150587 (Accession XM_097917) is another VGAM1958 host target gene. LOC150587 BINDING SITE is HOST TARGET binding site found in the 3' untranslated region of mRNA encoded by LOC150587, corresponding to a HOST TARGET binding site such as BINDING SITE I, BINDING SITE II or BINDING SITE III. Table 2 illustrates the complementarity of the nucleotide sequences of LOC150587 BINDING SITE, designated SEQ ID:41212, to the nucleotide sequence of VGAM1958 RNA, herein designated VGAM RNA, also designated SEQ ID:4669.

Another function of VGAM1958 is therefore inhibition of LOC150587 (Accession XM_097917). Accordingly, utilities of VGAM1958 include diagnosis, prevention and treatment of diseases and clinical conditions associated with LOC150587. LOC150696 (Accession NM_144707) is another VGAM1958 host target gene. LOC150696 BINDING SITE is HOST TARGET binding site found in the 3' untranslated region of mRNA encoded by LOC150696, corresponding to a HOST TARGET binding site such as BINDING SITE I, BINDING SITE II or BINDING SITE III. Table 2 illustrates the complementarity of the nucleotide sequences of LOC150696 BINDING SITE, designated SEQ ID:29529, to the nucleotide sequence of VGAM1958 RNA, herein designated VGAM RNA, also designated SEQ ID:4669.

Another function of VGAM1958 is therefore inhibition of LOC150696 (Accession NM_144707). Accordingly, utilities of VGAM1958 include diagnosis, prevention and treatment of diseases and clinical conditions associated with LOC150696. LOC150837 (Accession XM_087019) is another VGAM1958 host target gene. LOC150837 BINDING SITE is HOST TARGET binding site found in the 3' untranslated region of mRNA encoded by LOC150837, corresponding to a HOST TARGET binding site such as BINDING SITE I, BINDING SITE II or BINDING SITE III. Table 2 illustrates the complementarity of the nucleotide sequences of LOC150837 BINDING SITE, designated SEQ ID:39015, to the nucleotide sequence of VGAM1958 RNA, herein designated VGAM RNA, also designated SEQ ID:4669.

Another function of VGAM1958 is therefore inhibition of LOC150837 (Accession XM_087019). Accordingly, utilities of VGAM1958 include diagnosis, prevention and treatment of diseases and clinical conditions associated with LOC150837. LOC150886 (Accession XM_097963) is another VGAM1958 host target gene. LOC150886 BINDING SITE is HOST TARGET binding site found in the 5' untranslated region of mRNA encoded by LOC150886, corresponding to a HOST TARGET binding site such as BINDING SITE I, BINDING SITE II or BINDING SITE III. Table 2 illustrates the complementarity of the nucleotide sequences of LOC150886 BINDING SITE, designated SEQ ID:41268, to the nucleotide sequence of VGAM1958 RNA, herein designated VGAM RNA, also designated SEQ ID:4669.

Another function of VGAM1958 is therefore inhibition of LOC150886 (Accession XM_097963). Accordingly, utilities of VGAM1958 include diagnosis, prevention and treatment of diseases and clinical conditions associated with LOC150886. LOC151361 (Accession XM_098048) is another VGAM1958 host target gene. LOC151361 BINDING SITE is HOST TARGET binding site found in the 3' untranslated region of mRNA encoded by LOC151361, corresponding to a HOST TARGET binding site such as BINDING SITE I, BINDING SITE II or BINDING SITE III. Table 2 illustrates the complementarity of the nucleotide sequences of LOC151361 BINDING SITE, designated SEQ ID:41331, to the nucleotide sequence of VGAM1958 RNA, herein designated VGAM RNA, also designated SEQ ID:4669.

Another function of VGAM1958 is therefore inhibition of LOC151361 (Accession XM_098048). Accordingly, utilities of VGAM1958 include diagnosis, prevention and treatment of diseases and clinical conditions associated with LOC151361. LOC151438 (Accession XM_098060) is another VGAM1958 host target gene. LOC151438 BINDING SITE is HOST TARGET binding site found in the 3' untranslated region of mRNA encoded by LOC151438, corresponding to a HOST TARGET binding site such as BINDING SITE I, BINDING SITE II or BINDING SITE III. Table 2 illustrates the complementarity of the nucleotide sequences of LOC151438 BINDING SITE, designated SEQ ID:41349, to the nucleotide sequence of VGAM1958 RNA, herein designated VGAM RNA, also designated SEQ ID:4669.

Another function of VGAM1958 is therefore inhibition of LOC151438 (Accession XM_098060). Accordingly, utilities of VGAM1958 include diagnosis, prevention and treatment of diseases and clinical conditions associated with LOC151438. LOC151457 (Accession XM_087203) is another VGAM1958 host target gene. LOC151457 BINDING SITE is HOST TARGET binding site found in the 5' untranslated region of mRNA encoded by LOC151457, corresponding to a HOST TARGET binding site such as BINDING SITE I, BINDING SITE II or BINDING SITE III. Table 2 illustrates the complementarity of the nucleotide sequences of LOC151457 BINDING SITE, designated SEQ ID:39116, to the nucleotide sequence of VGAM1958 RNA, herein designated VGAM RNA, also designated SEQ ID:4669.

Another function of VGAM1958 is therefore inhibition of LOC151457 (Accession XM_087203). Accordingly, utilities of VGAM1958 include diagnosis, prevention and treatment of diseases and clinical conditions associated with LOC151457. LOC151568 (Accession NM_138483) is another VGAM1958 host target gene. LOC151568 BINDING SITE is HOST TARGET binding site found in the 5' untranslated region of mRNA encoded by LOC151568, corresponding to a HOST TARGET binding site such as BINDING SITE I, BINDING SITE II or BINDING SITE III. Table 2 illustrates the complementarity of the nucleotide sequences of LOC151568 BINDING SITE, designated SEQ ID:28838, to the nucleotide sequence of VGAM1958 RNA, herein designated VGAM RNA, also designated SEQ ID:4669.

Another function of VGAM1958 is therefore inhibition of LOC151568 (Accession NM_138483). Accordingly, utilities of VGAM1958 include diagnosis, prevention and treatment of diseases and clinical conditions associated with LOC151568. LOC151647 (Accession XM_087261) is another VGAM1958 host target gene. LOC151647 BINDING SITE is HOST TARGET binding site found in the 3' untranslated region of mRNA encoded by LOC151647, corresponding to a HOST TARGET binding site such as BINDING SITE I, BINDING SITE II or BINDING SITE III. Table 2 illustrates the complementarity of the nucleotide sequences of LOC151647 BINDING SITE, designated SEQ ID:39158, to the nucleotide sequence of VGAM1958 RNA, herein designated VGAM RNA, also designated SEQ ID:4669.

Another function of VGAM1958 is therefore inhibition of LOC151647 (Accession XM_087261). Accordingly, utilities of VGAM1958 include diagnosis, prevention and treatment of diseases and clinical conditions associated with LOC151647. LOC152286 (Accession XM_098188) is another VGAM1958 host target gene. LOC152286 BINDING SITE is HOST TARGET binding site found in the 5' untranslated region of mRNA encoded by LOC152286, corresponding to a HOST TARGET binding site such as BINDING SITE I, BINDING SITE II or BINDING SITE III. Table 2 illustrates the complementarity of the nucleotide sequences of LOC152286 BINDING SITE, designated SEQ ID:41462, to the nucleotide sequence of VGAM1958 RNA, herein designated VGAM RNA, also designated SEQ ID:4669.

Another function of VGAM1958 is therefore inhibition of LOC152286 (Accession XM_098188). Accordingly, utilities of VGAM1958 include diagnosis, prevention and treatment of diseases and clinical conditions associated with LOC152286. LOC152317 (Accession XM_098189) is another VGAM1958 host target gene. LOC152317 BINDING SITE is HOST TARGET binding site found in the 5' untranslated region of mRNA encoded by LOC152317, corresponding to a HOST TARGET binding site such as BINDING SITE I, BINDING SITE II or BINDING SITE III. Table 2 illustrates the complementarity of the nucleotide sequences of LOC152317 BINDING SITE, designated SEQ ID:41464, to the nucleotide sequence of VGAM1958 RNA, herein designated VGAM RNA, also designated SEQ ID:4669.

Another function of VGAM1958 is therefore inhibition of LOC152317 (Accession XM_098189). Accordingly, utilities of VGAM1958 include diagnosis, prevention and treatment of diseases and clinical conditions associated with LOC152317. LOC152343 (Accession XM_087441) is another VGAM1958 host target gene. LOC152343 BINDING SITE is HOST TARGET binding site found in the 3' untranslated region of mRNA encoded by LOC152343, corresponding to a HOST TARGET binding site such as BINDING SITE I, BINDING SITE II or BINDING SITE III. Table 2 illustrates the complementarity of the nucleotide sequences of LOC152343 BINDING SITE, designated SEQ ID:39260, to the nucleotide sequence of VGAM1958 RNA, herein designated VGAM RNA, also designated SEQ ID:4669.

Another function of VGAM1958 is therefore inhibition of LOC152343 (Accession XM_087441). Accordingly, utilities of VGAM1958 include diagnosis, prevention and treatment of diseases and clinical conditions associated with LOC152343. LOC152426 (Accession XM_098225) is another VGAM1958 host target gene. LOC152426 BINDING SITE is HOST TARGET binding site found in the 5' untranslated region of mRNA encoded by LOC152426, corresponding to a HOST TARGET binding site such as BINDING SITE I, BINDING SITE II or BINDING SITE III. Table 2 illustrates the complementarity of the nucleotide sequences of LOC152426 BINDING SITE, designated SEQ ID:41500, to the nucleotide sequence of VGAM1958 RNA, herein designated VGAM RNA, also designated SEQ ID:4669.

Another function of VGAM1958 is therefore inhibition of LOC152426 (Accession XM_098225). Accordingly, utilities of VGAM1958 include diagnosis, prevention and treatment of diseases and clinical conditions associated with LOC152426. LOC152441 (Accession XM_098230) is another VGAM1958 host target gene. LOC152441 BINDING SITE is HOST TARGET binding site found in the 5' untranslated region of mRNA encoded by LOC152441, corresponding to a HOST TARGET binding site such as BINDING SITE I, BINDING SITE II or BINDING SITE III. Table 2 illustrates the complementarity of the nucleotide sequences of LOC152441 BINDING SITE, designated SEQ ID:41506, to the nucleotide sequence of VGAM1958 RNA, herein designated VGAM RNA, also designated SEQ ID:4669.

Another function of VGAM1958 is therefore inhibition of LOC152441 (Accession XM_098230). Accordingly, utilities of VGAM1958 include diagnosis, prevention and treatment of diseases and clinical conditions associated with LOC152441. LOC152453 (Accession XM_087475) is another VGAM1958 host target gene. LOC152453 BINDING SITE is HOST TARGET binding site found in the 5' untranslated region of mRNA encoded by LOC152453, corresponding to a HOST TARGET binding site such as BINDING SITE I, BINDING SITE II or BINDING SITE III. Table 2 illustrates the complementarity of the nucleotide sequences of LOC152453 BINDING SITE, designated SEQ ID:39277, to the nucleotide sequence of VGAM1958 RNA, herein designated VGAM RNA, also designated SEQ ID:4669.

Another function of VGAM1958 is therefore inhibition of LOC152453 (Accession XM_087475). Accordingly, utilities of VGAM1958 include diagnosis, prevention and treatment of diseases and clinical conditions associated with LOC152453. LOC152667 (Accession XM_087500) is another VGAM1958 host target gene. LOC152667 BINDING SITE is HOST TARGET binding site found in the 3' untranslated region of mRNA encoded by LOC152667, corresponding to a HOST TARGET binding site such as BINDING SITE I, BINDING SITE II or BINDING SITE III. Table 2 illustrates the complementarity of the nucleotide sequences of LOC152667 BINDING SITE, designated SEQ ID:39300, to the nucleotide sequence of VGAM1958 RNA, herein designated VGAM RNA, also designated SEQ ID:4669.

Another function of VGAM1958 is therefore inhibition of LOC152667 (Accession XM_087500). Accordingly, utilities of VGAM1958 include diagnosis, prevention and treatment of diseases and clinical conditions associated with LOC152667. LOC152926 (Accession XM_087562) is another VGAM1958 host target gene. LOC152926 BINDING SITE is HOST TARGET binding site found in the 5' untranslated region of mRNA encoded by LOC152926, corresponding to a HOST TARGET binding site such as BINDING SITE I, BINDING SITE II or BINDING SITE III. Table 2 illustrates the complementarity of the nucleotide sequences of LOC152926 BINDING SITE, designated SEQ ID:39342, to the nucleotide sequence of VGAM1958 RNA, herein designated VGAM RNA, also designated SEQ ID:4669.

Another function of VGAM1958 is therefore inhibition of LOC152926 (Accession XM_087562). Accordingly, utilities of VGAM1958 include diagnosis, prevention and treatment of diseases and clinical conditions associated with LOC152926. LOC152992 (Accession XM_087575) is another VGAM1958 host target gene. LOC152992 BINDING SITE is HOST TARGET binding site found in the 3' untranslated region of mRNA encoded by LOC152992, corresponding to a HOST TARGET binding site such as BINDING SITE I, BINDING SITE II or BINDING SITE III. Table 2 illustrates the complementarity of the nucleotide sequences of LOC152992 BINDING SITE, designated SEQ ID:39350, to the nucleotide sequence of VGAM1958 RNA, herein designated VGAM RNA, also designated SEQ ID:4669.

Another function of VGAM1958 is therefore inhibition of LOC152992 (Accession XM_087575). Accordingly, utilities of VGAM1958 include diagnosis, prevention and treatment of diseases and clinical conditions associated with LOC152992. LOC153505 (Accession XM_087693) is another VGAM1958 host target gene. LOC153505 BINDING SITE is HOST TARGET binding site found in the 3' untranslated region of mRNA encoded by LOC153505, corresponding to a HOST TARGET binding site such as BINDING SITE I, BINDING SITE II or BINDING SITE III. Table 2 illustrates the complementarity of the nucleotide sequences of LOC153505 BINDING SITE, designated SEQ ID:39381, to the nucleotide sequence of VGAM1958 RNA, herein designated VGAM RNA, also designated SEQ ID:4669.

Another function of VGAM1958 is therefore inhibition of LOC153505 (Accession XM_087693). Accordingly, utilities of VGAM1958 include diagnosis, prevention and treatment of diseases and clinical conditions associated with LOC153505. LOC153811 (Accession XM_087779) is another VGAM1958 host target gene. LOC153811 BINDING SITE is HOST TARGET binding site found in the 3' untranslated region of mRNA encoded by LOC153811, corresponding to a HOST TARGET binding site such as BINDING SITE I, BINDING SITE II or BINDING SITE III. Table 2 illustrates the complementarity of the nucleotide sequences of LOC153811 BINDING SITE, designated SEQ ID:39417, to the nucleotide sequence of VGAM1958 RNA, herein designated VGAM RNA, also designated SEQ ID:4669.

Another function of VGAM1958 is therefore inhibition of LOC153811 (Accession XM_087779). Accordingly, utilities of VGAM1958 include diagnosis, prevention and treatment of diseases and clinical conditions associated with LOC153811. LOC153914 (Accession XM_087799) is another VGAM1958 host target gene. LOC153914 BINDING SITE is HOST TARGET binding site found in the 5' untranslated region of mRNA encoded by LOC153914, corresponding to a HOST TARGET binding site such as BINDING SITE I, BINDING SITE II or BINDING SITE III. Table 2 illustrates the complementarity of the nucleotide sequences of LOC153914 BINDING SITE, designated SEQ ID:39434, to the nucleotide sequence of VGAM1958 RNA, herein designated VGAM RNA, also designated SEQ ID:4669.

Another function of VGAM1958 is therefore inhibition of LOC153914 (Accession XM_087799). Accordingly, utilities of VGAM1958 include diagnosis, prevention and treatment of diseases and clinical conditions associated with LOC153914. LOC154007 (Accession XM_087824) is another VGAM1958 host target gene. LOC154007 BINDING SITE is HOST TARGET binding site found in the 3' untranslated region of mRNA encoded by LOC154007, corresponding to a HOST TARGET binding site such as BINDING SITE I, BINDING SITE II or BINDING SITE III. Table 2 illustrates the complementarity of the nucleotide sequences of LOC154007 BINDING SITE, designated SEQ ID:39452, to the nucleotide sequence of VGAM1958 RNA, herein designated VGAM RNA, also designated SEQ ID:4669.

Another function of VGAM1958 is therefore inhibition of LOC154007 (Accession XM_087824). Accordingly, utilities of VGAM1958 include diagnosis, prevention and treatment of diseases and clinical conditions associated with LOC154007. LOC154222 (Accession XM_098497) is another VGAM1958 host target gene. LOC154222 BINDING SITE is HOST TARGET binding site found in the 3' untranslated region of mRNA encoded by LOC154222, corresponding to a HOST TARGET binding site such as BINDING SITE I, BINDING SITE II or BINDING SITE III. Table 2 illustrates the complementarity of the nucleotide sequences of LOC154222 BINDING SITE, designated SEQ ID:41691, to the nucleotide sequence of VGAM1958 RNA, herein designated VGAM RNA, also designated SEQ ID:4669.

Another function of VGAM1958 is therefore inhibition of LOC154222 (Accession XM_098497). Accordingly, utilities of VGAM1958 include diagnosis, prevention and treatment of diseases and clinical conditions associated with LOC154222. LOC154739 (Accession XM_098602) is another VGAM1958 host target gene. LOC154739 BINDING SITE is HOST TARGET binding site found in the 5' untranslated region of mRNA encoded by LOC154739, corresponding to a HOST TARGET binding site such as BINDING SITE I, BINDING SITE II or BINDING SITE III. Table 2 illustrates the complementarity of the nucleotide sequences of LOC154739 BINDING SITE, designated SEQ ID:41718, to the nucleotide sequence of VGAM1958 RNA, herein designated VGAM RNA, also designated SEQ ID:4669.

Another function of VGAM1958 is therefore inhibition of LOC154739 (Accession XM_098602). Accordingly, utilities of VGAM1958 include diagnosis, prevention and treatment of diseases and clinical conditions associated with LOC154739. LOC154877 (Accession XM_098626) is another VGAM1958 host target gene. LOC154877 BINDING SITE is HOST TARGET binding site found in the 5' untranslated region of mRNA encoded by LOC154877, corresponding to a HOST TARGET binding site such as BINDING SITE I, BINDING SITE II or BINDING SITE III. Table 2 illustrates the complementarity of the nucleotide sequences of LOC154877 BINDING SITE, designated SEQ ID:41741, to the nucleotide sequence of VGAM1958 RNA, herein designated VGAM RNA, also designated SEQ ID:4669.

Another function of VGAM1958 is therefore inhibition of LOC154877 (Accession XM_098626). Accordingly, utilities of VGAM1958 include diagnosis, prevention and treatment of diseases and clinical conditions associated with LOC154877. LOC155006 (Accession XM_088117) is another VGAM1958 host target gene. LOC155006 BINDING SITE is HOST TARGET binding site found in the 3' untranslated region of mRNA encoded by LOC155006, corresponding to a HOST TARGET binding site such as BINDING SITE I, BINDING SITE II or BINDING SITE III. Table 2 illustrates the complementarity of the nucleotide sequences of LOC155006 BINDING SITE, designated SEQ ID:39525, to the nucleotide sequence of VGAM1958 RNA, herein designated VGAM RNA, also designated SEQ ID:4669.

Another function of VGAM1958 is therefore inhibition of LOC155006 (Accession XM_088117). Accordingly, utilities of VGAM1958 include diagnosis, prevention and treatment of diseases and clinical conditions associated with LOC155006. LOC155036 (Accession XM_098651) is another VGAM1958 host target gene. LOC155036 BINDING SITE is HOST TARGET binding site found in the 5' untranslated region of mRNA encoded by LOC155036, corresponding to a HOST TARGET binding site such as BIND- ING SITE I, BINDING SITE II or BINDING SITE III. Table 2 illustrates the complementarity of the nucleotide sequences of LOC155036 BINDING SITE, designated SEQ ID:41754, to the nucleotide sequence of VGAM1958 RNA, herein designated VGAM RNA, also designated SEQ ID:4669.

Another function of VGAM1958 is therefore inhibition of LOC155036 (Accession XM_098651). Accordingly, utilities of VGAM1958 include diagnosis, prevention and treatment of diseases and clinical conditions associated with LOC155036. LOC155434 (Accession XM_098723) is another VGAM1958 host target gene. LOC155434 BINDING SITE is HOST TARGET binding site found in the 3' untranslated region of mRNA encoded by LOC155434, corresponding to a HOST TARGET binding site such as BINDING SITE I, BINDING SITE II or BINDING SITE III. Table 2 illustrates the complementarity of the nucleotide sequences of LOC155434 BINDING SITE, designated SEQ ID:41772, to the nucleotide sequence of VGAM1958 RNA, herein designated VGAM RNA, also designated SEQ ID:4669.

Another function of VGAM1958 is therefore inhibition of LOC155434 (Accession XM_098723). Accordingly, utilities of VGAM1958 include diagnosis, prevention and treatment of diseases and clinical conditions associated with LOC155434. LOC155435 (Accession XM_088257) is another VGAM1958 host target gene. LOC155435 BINDING SITE is HOST TARGET binding site found in the 3' untranslated region of mRNA encoded by LOC155435, corresponding to a HOST TARGET binding site such as BINDING SITE I, BINDING SITE II or BINDING SITE III. Table 2 illustrates the complementarity of the nucleotide sequences of LOC155435 BINDING SITE, designated SEQ ID:39570, to the nucleotide sequence of VGAM1958 RNA, herein designated VGAM RNA, also designated SEQ ID:4669.

Another function of VGAM1958 is therefore inhibition of LOC155435 (Accession XM_088257). Accordingly, utilities of VGAM1958 include diagnosis, prevention and treatment of diseases and clinical conditions associated with LOC155435. LOC157273 (Accession XM_098743) is another VGAM1958 host target gene. LOC157273 BINDING SITE is HOST TARGET binding site found in the 3' untranslated region of mRNA encoded by LOC157273, corresponding to a HOST TARGET binding site such as BINDING SITE I, BINDING SITE II or BINDING SITE III. Table 2 illustrates the complementarity of the nucleotide sequences of LOC157273 BINDING SITE, designated SEQ ID:41779, to the nucleotide sequence of VGAM1958 RNA, herein designated VGAM RNA, also designated SEQ ID:4669.

Another function of VGAM1958 is therefore inhibition of LOC157273 (Accession XM_098743). Accordingly, utilities of VGAM1958 include diagnosis, prevention and treatment of diseases and clinical conditions associated with LOC157273. LOC157556 (Accession XM_098783) is another VGAM1958 host target gene. LOC157556 BINDING SITE is HOST TARGET binding site found in the 5' untranslated region of mRNA encoded by LOC157556, corresponding to a HOST TARGET binding site such as BINDING SITE I, BINDING SITE II or BINDING SITE III. Table 2 illustrates the complementarity of the nucleotide sequences of LOC157556 BINDING SITE, designated SEQ ID:41820, to the nucleotide sequence of VGAM1958 RNA, herein designated VGAM RNA, also designated SEQ ID:4669.

Another function of VGAM1958 is therefore inhibition of LOC157556 (Accession XM_098783). Accordingly, utilities of VGAM1958 include diagnosis, prevention and treatment of diseases and clinical conditions associated with LOC157556. LOC157623 (Accession XM_088346) is another VGAM1958 host target gene. LOC157623 BINDING SITE is HOST TARGET binding site found in the 5' untranslated region of mRNA encoded by LOC157623, corresponding to a HOST TARGET binding site such as BINDING SITE I, BINDING SITE II or BINDING SITE III. Table 2 illustrates the complementarity of the nucleotide sequences of LOC157623 BINDING SITE, designated SEQ ID:39616, to the nucleotide sequence of VGAM1958 RNA, herein designated VGAM RNA, also designated SEQ ID:4669.

Another function of VGAM1958 is therefore inhibition of LOC157623 (Accession XM_088346). Accordingly, utilities of VGAM1958 include diagnosis, prevention and treatment of diseases and clinical conditions associated with LOC157623. LOC157753 (Accession XM_088381) is another VGAM1958 host target gene. LOC157753 BINDING SITE is HOST TARGET binding site found in the 3' untranslated region of mRNA encoded by LOC157753, corresponding to a HOST TARGET binding site such as BINDING SITE I, BINDING SITE II or BINDING SITE III. Table 2 illustrates the complementarity of the nucleotide sequences of LOC157753 BINDING SITE, designated SEQ ID:39660, to the nucleotide sequence of VGAM1958 RNA, herein designated VGAM RNA, also designated SEQ ID:4669.

Another function of VGAM1958 is therefore inhibition of LOC157753 (Accession XM_088381). Accordingly, utilities of VGAM1958 include diagnosis, prevention and treatment of diseases and clinical conditions associated with LOC157753. LOC157860 (Accession XM_098832) is another VGAM1958 host target gene. LOC157860 BINDING SITE is HOST TARGET binding site found in the 3' untranslated region of mRNA encoded by LOC157860, corresponding to a HOST TARGET binding site such as BINDING SITE I, BINDING SITE II or BINDING SITE III. Table 2 illustrates the complementarity of the nucleotide sequences of LOC157860 BINDING SITE, designated SEQ ID:41858, to the nucleotide sequence of VGAM1958 RNA, herein designated VGAM RNA, also designated SEQ ID:4669.

Another function of VGAM1958 is therefore inhibition of LOC157860 (Accession XM_098832). Accordingly, utilities of VGAM1958 include diagnosis, prevention and treatment of diseases and clinical conditions associated with LOC157860. LOC157922 (Accession XM_098841) is another VGAM1958 host target gene. LOC157922 BINDING SITE is HOST TARGET binding site found in the 5' untranslated region of mRNA encoded by LOC157922, corresponding to a HOST TARGET binding site such as BINDING SITE I, BINDING SITE II or BINDING SITE III. Table 2 illustrates the complementarity of the nucleotide sequences of LOC157922 BINDING SITE, designated SEQ ID:41888, to the nucleotide sequence of VGAM1958 RNA, herein designated VGAM RNA, also designated SEQ ID:4669.

Another function of VGAM1958 is therefore inhibition of LOC157922 (Accession XM_098841). Accordingly, utilities of VGAM1958 include diagnosis, prevention and treatment of diseases and clinical conditions associated with LOC157922. LOC157927 (Accession XM_098848) is another VGAM1958 host target gene. LOC157927 BINDING SITE is HOST TARGET binding site found in the 5' untranslated region of mRNA encoded by LOC157927, corresponding to a HOST TARGET binding site such as BINDING SITE I, BINDING SITE II or BINDING SITE III. Table 2 illustrates the complementarity of the nucleotide sequences of LOC157927 BINDING SITE, designated SEQ ID:41907, to the nucleotide sequence of VGAM1958 RNA, herein designated VGAM RNA, also designated SEQ ID:4669.

Another function of VGAM1958 is therefore inhibition of LOC157927 (Accession XM_098848). Accordingly, utilities of VGAM1958 include diagnosis, prevention and treatment of diseases and clinical conditions associated with LOC157927. LOC158046 (Accession NM_145283) is another VGAM1958 host target gene. LOC158046 BINDING SITE is HOST TARGET binding site found in the 5' untranslated region of mRNA encoded by LOC158046, corresponding to a HOST TARGET binding site such as BINDING SITE I, BINDING SITE II or BINDING SITE III. Table 2 illustrates the complementarity of the nucleotide sequences of LOC158046 BINDING SITE, designated SEQ ID:29800, to the nucleotide sequence of VGAM1958 RNA, herein designated VGAM RNA, also designated SEQ ID:4669.

Another function of VGAM1958 is therefore inhibition of LOC158046 (Accession NM_145283). Accordingly, utilities of VGAM1958 include diagnosis, prevention and treatment of diseases and clinical conditions associated with LOC158046. LOC158308 (Accession XM_098917) is another VGAM1958 host target gene. LOC158308 BINDING SITE is HOST TARGET binding site found in the 5' untranslated region of mRNA encoded by LOC158308, corresponding to a HOST TARGET binding site such as BINDING SITE I, BINDING SITE II or BINDING SITE III. Table 2 illustrates the complementarity of the nucleotide sequences of LOC158308 BINDING SITE, designated SEQ ID:41940, to the nucleotide sequence of VGAM1958 RNA, herein designated VGAM RNA, also designated SEQ ID:4669.

Another function of VGAM1958 is therefore inhibition of LOC158308 (Accession XM_098917). Accordingly, utilities of VGAM1958 include diagnosis, prevention and treatment of diseases and clinical conditions associated with LOC158308. LOC158310 (Accession XM_098919) is another VGAM1958 host target gene. LOC158310 BINDING SITE is HOST TARGET binding site found in the 5' untranslated region of mRNA encoded by LOC158310, corresponding to a HOST TARGET binding site such as BINDING SITE I, BINDING SITE II or BINDING SITE III. Table 2 illustrates the complementarity of the nucleotide sequences of LOC158310 BINDING SITE, designated SEQ ID:41947, to the nucleotide sequence of VGAM1958 RNA, herein designated VGAM RNA, also designated SEQ ID:4669.

Another function of VGAM1958 is therefore inhibition of LOC158310 (Accession XM_098919). Accordingly, utilities of VGAM1958 include diagnosis, prevention and treatment of diseases and clinical conditions associated with LOC158310. LOC158427 (Accession NM_139246) is another VGAM1958 host target gene. LOC158427 BINDING SITE is HOST TARGET binding site found in the 5' untranslated region of mRNA encoded by LOC158427, corresponding to a HOST TARGET binding site such as BINDING SITE I, BINDING SITE II or BINDING SITE III. Table 2 illustrates the complementarity of the nucleotide sequences of LOC158427 BINDING SITE, designated SEQ ID:29247, to the nucleotide sequence of VGAM1958 RNA, herein designated VGAM RNA, also designated SEQ ID:4669.

Another function of VGAM1958 is therefore inhibition of LOC158427 (Accession NM_139246). Accordingly, utilities of VGAM1958 include diagnosis, prevention and treatment of diseases and clinical conditions associated with LOC158427. LOC158563 (Accession XM_088606) is another VGAM1958 host target gene. LOC158563 BINDING SITE is HOST TARGET binding site found in the 3' untranslated region of mRNA encoded by LOC158563, corresponding to a HOST TARGET binding site such as BINDING SITE I, BINDING SITE II or BINDING SITE III. Table 2 illustrates the complementarity of the nucleotide sequences of LOC158563 BINDING SITE, designated SEQ ID:39870, to the nucleotide sequence of VGAM1958 RNA, herein designated VGAM RNA, also designated SEQ ID:4669.

Another function of VGAM1958 is therefore inhibition of LOC158563 (Accession XM_088606). Accordingly, utilities of VGAM1958 include diagnosis, prevention and treatment of diseases and clinical conditions associated with LOC158563. LOC158856 (Accession XM_098998) is another VGAM1958 host target gene. LOC158856 BINDING SITE is HOST TARGET binding site found in the 5' untranslated region of mRNA encoded by LOC158856, corresponding to a HOST TARGET binding site such as BINDING SITE I, BINDING SITE II or BINDING SITE III. Table 2 illustrates the complementarity of the nucleotide sequences of LOC158856 BINDING SITE, designated SEQ ID:42034, to the nucleotide sequence of VGAM1958 RNA, herein designated VGAM RNA, also designated SEQ ID:4669.

Another function of VGAM1958 is therefore inhibition of LOC158856 (Accession XM_098998). Accordingly, utilities of VGAM1958 include diagnosis, prevention and treatment of diseases and clinical conditions associated with LOC158856. LOC158969 (Accession XM_088728) is another VGAM1958 host target gene. LOC158969 BINDING SITE1 and LOC158969 BINDING SITE2 are HOST TARGET binding sites found in untranslated regions of mRNA encoded by LOC158969, corresponding to HOST TARGET binding sites such as BINDING SITE I, BINDING SITE II or BINDING SITE III. Table 2 illustrates the complementarity of the nucleotide sequences of LOC158969 BINDING SITE1 and LOC158969 BINDING SITE2, designated SEQ ID:39918 and SEQ ID:39920 respectively, to the nucleotide sequence of VGAM1958 RNA, herein designated VGAM RNA, also designated SEQ ID:4669.

Another function of VGAM1958 is therefore inhibition of LOC158969 (Accession XM_088728). Accordingly, utilities of VGAM1958 include diagnosis, prevention and treatment of diseases and clinical conditions associated with LOC158969. LOC159148 (Accession XM_099030) is another VGAM1958 host target gene. LOC159148 BINDING SITE1 and LOC159148 BINDING SITE2 are HOST TARGET binding sites found in untranslated regions of mRNA encoded by LOC159148, corresponding to HOST TARGET binding sites such as BINDING SITE I, BINDING SITE II or BINDING SITE III. Table 2 illustrates the complementarity of the nucleotide sequences of LOC159148 BINDING SITE1 and LOC159148 BINDING SITE2, designated SEQ ID:42080 and SEQ ID:39978 respectively, to the nucleotide sequence of VGAM1958 RNA, herein designated VGAM RNA, also designated SEQ ID:4669.

Another function of VGAM1958 is therefore inhibition of LOC159148 (Accession XM_099030). Accordingly, utilities of VGAM1958 include diagnosis, prevention and treatment of diseases and clinical conditions associated with LOC159148. LOC161877 (Accession XM_091190) is another VGAM1958 host target gene. LOC161877 BINDING SITE is HOST TARGET binding site found in the 5' untranslated region of mRNA encoded by LOC161877, corresponding to a HOST TARGET binding site such as BINDING SITE I, BINDING SITE II or BINDING SITE III. Table 2 illustrates the complementarity of the nucleotide sequences of LOC161877 BINDING SITE, designated SEQ ID:40042, to the nucleotide sequence of VGAM1958 RNA, herein designated VGAM RNA, also designated SEQ ID:4669.

Another function of VGAM1958 is therefore inhibition of LOC161877 (Accession XM_091190). Accordingly, utilities of VGAM1958 include diagnosis, prevention and treatment of diseases and clinical conditions associated with LOC161877. LOC163412 (Accession XM_088868) is another VGAM1958 host target gene. LOC163412 BINDING SITE is HOST TARGET binding site found in the 5' untranslated region of mRNA encoded by LOC163412, corresponding to a HOST TARGET binding site such as BINDING SITE I, BINDING SITE II or BINDING SITE III. Table 2 illustrates the complementarity of the nucleotide sequences of LOC163412 BINDING SITE, designated SEQ ID:39950, to the nucleotide sequence of VGAM1958 RNA, herein designated VGAM RNA, also designated SEQ ID:4669.

Another function of VGAM1958 is therefore inhibition of LOC163412 (Accession XM_088868). Accordingly, utilities of VGAM1958 include diagnosis, prevention and treatment of diseases and clinical conditions associated with LOC163412. LOC165246 (Accession XM_092473) is another VGAM1958 host target gene. LOC165246 BINDING SITE is HOST TARGET binding site found in the 5' untranslated region of mRNA encoded by LOC165246, corresponding to a HOST TARGET binding site such as BINDING SITE I, BINDING SITE II or BINDING SITE III. Table 2 illustrates the complementarity of the nucleotide sequences of LOC165246 BINDING SITE, designated SEQ ID:40125, to the nucleotide sequence of VGAM1958 RNA, herein designated VGAM RNA, also designated SEQ ID:4669.

Another function of VGAM1958 is therefore inhibition of LOC165246 (Accession XM_092473). Accordingly, utilities of VGAM1958 include diagnosis, prevention and treatment of diseases and clinical conditions associated with LOC165246. LOC169225 (Accession XM_108531) is another VGAM1958 host target gene. LOC169225 BINDING SITE is HOST TARGET binding site found in the 5' untranslated region of mRNA encoded by LOC169225, corresponding to a HOST TARGET binding site such as BINDING SITE I, BINDING SITE II or BINDING SITE III. Table 2 illustrates the complementarity of the nucleotide sequences of LOC169225 BINDING SITE, designated SEQ ID:42204, to the nucleotide sequence of VGAM1958 RNA, herein designated VGAM RNA, also designated SEQ ID:4669.

Another function of VGAM1958 is therefore inhibition of LOC169225 (Accession XM_108531). Accordingly, utilities of VGAM1958 include diagnosis, prevention and treatment of diseases and clinical conditions associated with LOC169225. LOC170425 (Accession XM_084330) is another VGAM1958 host target gene. LOC170425 BINDING SITE is HOST TARGET binding site found in the 5' untranslated region of mRNA encoded by LOC170425, corresponding to a HOST TARGET binding site such as BINDING SITE I, BINDING SITE II or BINDING SITE III. Table 2 illustrates the complementarity of the nucleotide sequences of LOC170425 BINDING SITE, designated SEQ ID:37549, to the nucleotide sequence of VGAM1958 RNA, herein designated VGAM RNA, also designated SEQ ID:4669.

Another function of VGAM1958 is therefore inhibition of LOC170425 (Accession XM_084330). Accordingly, utilities of VGAM1958 include diagnosis, prevention and treatment of diseases and clinical conditions associated with LOC170425. LOC196027 (Accession XM_113633) is another VGAM1958 host target gene. LOC196027 BINDING SITE is HOST TARGET binding site found in the 3' untranslated region of mRNA encoded by LOC196027, corresponding to a HOST TARGET binding site such as BINDING SITE I, BINDING SITE II or BINDING SITE III. Table 2 illustrates the complementarity of the nucleotide sequences of LOC196027 BINDING SITE, designated SEQ ID:42307, to the nucleotide sequence of VGAM1958 RNA, herein designated VGAM RNA, also designated SEQ ID:4669.

Another function of VGAM1958 is therefore inhibition of LOC196027 (Accession XM_113633). Accordingly, utilities of VGAM1958 include diagnosis, prevention and treatment of diseases and clinical conditions associated with LOC196027. LOC196205 (Accession XM_113676) is another VGAM1958 host target gene. LOC196205 BINDING SITE is HOST TARGET binding site found in the 3' untranslated region of mRNA encoded by LOC196205, corresponding to a HOST TARGET binding site such as BINDING SITE I, BINDING SITE II or BINDING SITE III. Table 2 illustrates the complementarity of the nucleotide sequences of LOC196205 BINDING SITE, designated SEQ ID:42325, to the nucleotide sequence of VGAM1958 RNA, herein designated VGAM RNA, also designated SEQ ID:4669.

Another function of VGAM1958 is therefore inhibition of LOC196205 (Accession XM_113676). Accordingly, utilities of VGAM1958 include diagnosis, prevention and treatment of diseases and clinical conditions associated with LOC196205. LOC196337 (Accession XM_113696) is another VGAM1958 host target gene. LOC196337 BINDING SITE is HOST TARGET binding site found in the 3' untranslated region of mRNA encoded by LOC196337, corresponding to a HOST TARGET binding site such as BINDING SITE I, BINDING SITE II or BINDING SITE III. Table 2 illustrates the complementarity of the nucleotide sequences of LOC196337 BINDING SITE, designated SEQ ID:42360, to the nucleotide sequence of VGAM1958 RNA, herein designated VGAM RNA, also designated SEQ ID:4669.

Another function of VGAM1958 is therefore inhibition of LOC196337 (Accession XM_113696). Accordingly, utilities of VGAM1958 include diagnosis, prevention and treatment of diseases and clinical conditions associated with LOC196337. LOC196738 (Accession XM_113588) is another VGAM1958 host target gene. LOC196738 BINDING SITE is HOST TARGET binding site found in the 3' untranslated region of mRNA encoded by LOC196738, corresponding to a HOST TARGET binding site such as BINDING SITE I, BINDING SITE II or BINDING SITE III. Table 2 illustrates the complementarity of the nucleotide sequences of LOC196738 BINDING SITE, designated SEQ ID:42287, to the nucleotide sequence of VGAM1958 RNA, herein designated VGAM RNA, also designated SEQ ID:4669.

Another function of VGAM1958 is therefore inhibition of LOC196738 (Accession XM_113588). Accordingly, utilities of VGAM1958 include diagnosis, prevention and treatment of diseases and clinical conditions associated with LOC196738. LOC196812 (Accession XM_116868) is another VGAM1958 host target gene. LOC196812 BINDING SITE is HOST TARGET binding site found in the 3' untranslated region of mRNA encoded by LOC196812, corresponding to a HOST TARGET binding site such as BINDING SITE I, BINDING SITE II or BINDING SITE III. Table 2 illustrates the complementarity of the nucleotide sequences of LOC196812 BINDING SITE, designated SEQ ID:43132, to the nucleotide sequence of VGAM1958 RNA, herein designated VGAM RNA, also designated SEQ ID:4669.

Another function of VGAM1958 is therefore inhibition of LOC196812 (Accession XM_116868). Accordingly, utilities of VGAM1958 include diagnosis, prevention and treatment of diseases and clinical conditions associated with LOC196812. LOC196955 (Accession XM_085210) is another VGAM1958 host target gene. LOC196955 BINDING SITE is HOST TARGET binding site found in the 5' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37929, to the nucleotide sequence of VGAM1958 RNA, herein designated VGAM RNA, also designated SEQ ID:4669.

Another function of VGAM1958 is therefore inhibition of LOC196955 (Accession XM_085210). Accordingly, utilities of VGAM1958 include diagnosis, prevention and treatment of diseases and clinical conditions associated with LOC196955. LOC197350 (Accession XM_113871) is another VGAM1958 host target gene. LOC197350 BINDING SITE1 and LOC197350 BINDING SITE2 are HOST TARGET binding sites found in untranslated regions of mRNA encoded by LOC197350, corresponding to HOST TARGET binding sites such as BINDING SITE I, BINDING SITE II or BINDING SITE III. Table 2 illustrates the complementarity of the nucleotide sequences of LOC197350 BINDING SITE1 and LOC197350 BINDING SITE2, designated SEQ ID:42503 and SEQ ID:42504 respectively, to the nucleotide sequence of VGAM1958 RNA, herein designated VGAM RNA, also designated SEQ ID:4669.

Another function of VGAM1958 is therefore inhibition of LOC197350 (Accession XM_113871). Accordingly, utilities of VGAM1958 include diagnosis, prevention and treatment of diseases and clinical conditions associated with LOC197350. LOC199858 (Accession XM_114040) is another VGAM1958 host target gene. LOC199858 BINDING SITE1 and LOC199858 BINDING SITE2 are HOST TARGET binding sites found in untranslated regions of mRNA encoded by LOC199858, corresponding to HOST TARGET binding sites such as BINDING SITE I, BINDING SITE II or BINDING SITE III. Table 2 illustrates the complementarity of the nucleotide sequences of LOC199858 BINDING SITE1 and LOC199858 BINDING SITE2, designated SEQ ID:42630 and SEQ ID:42631 respectively, to the nucleotide sequence of VGAM1958 RNA, herein designated VGAM RNA, also designated SEQ ID:4669.

Another function of VGAM1958 is therefore inhibition of LOC199858 (Accession XM_114040). Accordingly, utilities of VGAM1958 include diagnosis, prevention and treatment of diseases and clinical conditions associated with LOC199858. LOC200325 (Accession XM_117223) is another VGAM1958 host target gene. LOC200325 BINDING SITE is HOST TARGET binding site found in the 5' untranslated region of mRNA encoded by LOC200325, corresponding to a HOST TARGET binding site such as BINDING SITE I, BINDING SITE II or BINDING SITE III. Table 2 illustrates the complementarity of the nucleotide sequences of LOC200325 BINDING SITE, designated SEQ ID:43289, to the nucleotide sequence of VGAM1958 RNA, herein designated VGAM RNA, also designated SEQ ID:4669.

Another function of VGAM1958 is therefore inhibition of LOC200325 (Accession XM_117223). Accordingly, utilities of VGAM1958 include diagnosis, prevention and treatment of diseases and clinical conditions associated with LOC200325. LOC200470 (Accession XM_117235) is another VGAM1958 host target gene. LOC200470 BINDING SITE is HOST TARGET binding site found in the 5' untranslated region of mRNA encoded by LOC200470, corresponding to a HOST TARGET binding site such as BINDING SITE I, BINDING SITE II or BINDING SITE III. Table 2 illustrates the complementarity of the nucleotide sequences of LOC200470 BINDING SITE, designated SEQ ID:43308, to the nucleotide sequence of VGAM1958 RNA, herein designated VGAM RNA, also designated SEQ ID:4669.

Another function of VGAM1958 is therefore inhibition of LOC200470 (Accession XM_117235). Accordingly, utilities of VGAM1958 include diagnosis, prevention and treatment of diseases and clinical conditions associated with LOC200470. LOC200597 (Accession XM_114266) is another VGAM1958 host target gene. LOC200597 BINDING SITE is HOST TARGET binding site found in the 3' untranslated region of mRNA encoded by LOC200597, corresponding to a HOST TARGET binding site such as BINDING SITE I, BINDING SITE II or BINDING SITE III. Table 2 illustrates the complementarity of the nucleotide sequences of LOC200597 BINDING SITE, designated SEQ ID:42824, to the nucleotide sequence of VGAM1958 RNA, herein designated VGAM RNA, also designated SEQ ID:4669.

Another function of VGAM1958 is therefore inhibition of LOC200597 (Accession XM_114266). Accordingly, utilities of VGAM1958 include diagnosis, prevention and treatment of diseases and clinical conditions associated with LOC200597. LOC200853 (Accession XM_114308) is another VGAM1958 host target gene. LOC200853 BINDING SITE is HOST TARGET binding site found in the 5' untranslated region of mRNA encoded by LOC200853, corresponding to a HOST TARGET binding site such as BINDING SITE I, BINDING SITE II or BINDING SITE III. Table 2 illustrates the complementarity of the nucleotide sequences of LOC200853 BINDING SITE, designated SEQ ID:42867, to the nucleotide sequence of VGAM1958 RNA, herein designated VGAM RNA, also designated SEQ ID:4669.

Another function of VGAM1958 is therefore inhibition of LOC200853 (Accession XM_114308). Accordingly, utilities of VGAM1958 include diagnosis, prevention and treatment of diseases and clinical conditions associated with LOC200853. LOC201191 (Accession XM_117058) is another VGAM1958 host target gene. LOC201191 BINDING SITE is HOST TARGET binding site found in the 3' untranslated region of mRNA encoded by LOC201191, corresponding to a HOST TARGET binding site such as BINDING SITE I, BINDING SITE II or BINDING SITE III. Table 2 illustrates the complementarity of the nucleotide sequences of LOC201191 BINDING SITE, designated SEQ ID:43216, to the nucleotide sequence of VGAM1958 RNA, herein designated VGAM RNA, also designated SEQ ID:4669.

Another function of VGAM1958 is therefore inhibition of LOC201191 (Accession XM_117058). Accordingly, utilities of VGAM1958 include diagnosis, prevention and treatment of diseases and clinical conditions associated with LOC201191. LOC201627 (Accession XM_114353) is another VGAM1958 host target gene. LOC201627 BINDING SITE is HOST TARGET binding site found in the 3' untranslated region of mRNA encoded by LOC201627, corresponding to a HOST TARGET binding site such as BINDING SITE I, BINDING SITE II or BINDING SITE III. Table 2 illustrates the complementarity of the nucleotide sequences of LOC201627 BINDING SITE, designated SEQ ID:42895, to the nucleotide sequence of VGAM1958 RNA, herein designated VGAM RNA, also designated SEQ ID:4669.

Another function of VGAM1958 is therefore inhibition of LOC201627 (Accession XM_114353). Accordingly, utilities of VGAM1958 include diagnosis, prevention and treatment of diseases and clinical conditions associated with LOC201627. LOC202052 (Accession XM_117355) is another VGAM1958 host target gene. LOC202052 BINDING SITE is HOST TARGET binding site found in the 3' untranslated region of mRNA encoded by LOC202052, corresponding to a HOST TARGET binding site such as BINDING SITE I, BINDING SITE II or BINDING SITE III. Table 2 illustrates the complementarity of the nucleotide sequences of LOC202052 BINDING SITE, designated SEQ ID:43407, to the nucleotide sequence of VGAM1958 RNA, herein designated VGAM RNA, also designated SEQ ID:4669.

Another function of VGAM1958 is therefore inhibition of LOC202052 (Accession XM_117355). Accordingly, utilities of VGAM1958 include diagnosis, prevention and treatment of diseases and clinical conditions associated with LOC202052. LOC202451 (Accession XM_117401) is another VGAM1958 host target gene. LOC202451 BINDING SITE is HOST TARGET binding site found in the 5' untranslated region of mRNA encoded by LOC202451, corresponding to a HOST TARGET binding site such as BINDING SITE I, BINDING SITE II or BINDING SITE III. Table 2 illustrates the complementarity of the nucleotide sequences of LOC202451 BINDING SITE, designated SEQ ID:43439, to the nucleotide sequence of VGAM1958 RNA, herein designated VGAM RNA, also designated SEQ ID:4669.

Another function of VGAM1958 is therefore inhibition of LOC202451 (Accession XM_117401). Accordingly, utilities of VGAM1958 include diagnosis, prevention and treatment of diseases and clinical conditions associated with LOC202451. LOC203078 (Accession XM_114625) is another VGAM1958 host target gene. LOC203078 BINDING SITE is HOST TARGET binding site found in the 3' untranslated region of mRNA encoded by LOC203078, corresponding to a HOST TARGET binding site such as BINDING SITE I, BINDING SITE II or BINDING SITE III. Table 2 illustrates the complementarity of the nucleotide sequences of LOC203078 BINDING SITE, designated SEQ ID:43005, to the nucleotide sequence of VGAM1958 RNA, herein designated VGAM RNA, also designated SEQ ID:4669.

Another function of VGAM1958 is therefore inhibition of LOC203078 (Accession XM_114625). Accordingly, utilities of VGAM1958 include diagnosis, prevention and treatment of diseases and clinical conditions associated with LOC203078. LOC203246 (Accession XM_114658) is another VGAM1958 host target gene. LOC203246 BINDING SITE is HOST TARGET binding site found in the 3' untranslated region of mRNA encoded by LOC203246, corresponding to a HOST TARGET binding site such as BINDING SITE I, BINDING SITE II or BINDING SITE III. Table 2 illustrates the complementarity of the nucleotide sequences of LOC203246 BINDING SITE, designated SEQ ID:43015, to the nucleotide sequence of VGAM1958 RNA, herein designated VGAM RNA, also designated SEQ ID:4669.

Another function of VGAM1958 is therefore inhibition of LOC203246 (Accession XM_114658). Accordingly, utilities of VGAM1958 include diagnosis, prevention and treatment of diseases and clinical conditions associated with LOC203246. LOC203276 (Accession XM_117523) is another VGAM1958 host target gene. LOC203276 BINDING SITE is HOST TARGET binding site found in the 3' untranslated region of mRNA encoded by LOC203276, corresponding to a HOST TARGET binding site such as BINDING SITE I, BINDING SITE II or BINDING SITE III. Table 2 illustrates the complementarity of the nucleotide sequences of LOC203276 BINDING SITE, designated SEQ ID:43484, to the nucleotide sequence of VGAM1958 RNA, herein designated VGAM RNA, also designated SEQ ID:4669.

Another function of VGAM1958 is therefore inhibition of LOC203276 (Accession XM_117523). Accordingly, utilities of VGAM1958 include diagnosis, prevention and treatment of diseases and clinical conditions associated with LOC203276. LOC203305 (Accession XM_117529) is another VGAM1958 host target gene. LOC203305 BINDING SITE is HOST TARGET binding site found in the 3' untranslated region of mRNA encoded by LOC203305, corresponding to a HOST TARGET binding site such as BINDING SITE I, BINDING SITE II or BINDING SITE III. Table 2 illustrates the complementarity of the nucleotide sequences of LOC203305 BINDING SITE, designated SEQ ID:43508, to the nucleotide sequence of VGAM1958 RNA, herein designated VGAM RNA, also designated SEQ ID:4669.

Another function of VGAM1958 is therefore inhibition of LOC203305 (Accession XM_117529). Accordingly, utilities of VGAM1958 include diagnosis, prevention and treatment of diseases and clinical conditions associated with LOC203305. LOC203350 (Accession XM_117536) is another VGAM1958 host target gene. LOC203350 BINDING SITE is HOST TARGET binding site found in the 3' untranslated region of mRNA encoded by LOC203350, corresponding to a HOST TARGET binding site such as BINDING SITE I, BINDING SITE II or BINDING SITE III. Table 2 illustrates the complementarity of the nucleotide sequences of LOC203350 BINDING SITE, designated SEQ ID:43537, to the nucleotide sequence of VGAM1958 RNA, herein designated VGAM RNA, also designated SEQ ID:4669.

Another function of VGAM1958 is therefore inhibition of LOC203350 (Accession XM_117536). Accordingly, utilities of VGAM1958 include diagnosis, prevention and treatment of diseases and clinical conditions associated with LOC203350. LOC203378 (Accession XM_117541) is another VGAM1958 host target gene. LOC203378 BINDING SITE is HOST TARGET binding site found in the 5' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43548, to the nucleotide sequence of VGAM1958 RNA, herein designated VGAM RNA, also designated SEQ ID:4669.

Another function of VGAM1958 is therefore inhibition of LOC203378 (Accession XM_117541). Accordingly, utilities of VGAM1958 include diagnosis, prevention and treatment of diseases and clinical conditions associated with LOC203378. LOC204161 (Accession XM_118480) is another VGAM1958 host target gene. LOC204161 BINDING SITE is HOST TARGET binding site found in the 5' untranslated region of mRNA encoded by LOC204161, corresponding to a HOST TARGET binding site such as BINDING SITE I, BINDING SITE II or BINDING SITE III. Table 2 illustrates the complementarity of the nucleotide sequences of LOC204161 BINDING SITE, designated SEQ ID:43578, to the nucleotide sequence of VGAM1958 RNA, herein designated VGAM RNA, also designated SEQ ID:4669.

Another function of VGAM1958 is therefore inhibition of LOC204161 (Accession XM_118480). Accordingly, utilities of VGAM1958 include diagnosis, prevention and treatment of diseases and clinical conditions associated with LOC204161. LOC204804 (Accession XM_115599) is another VGAM1958 host target gene. LOC204804 BINDING SITE is HOST TARGET binding site found in the 3' untranslated region of mRNA encoded by LOC204804, corresponding to a HOST TARGET binding site such as BINDING SITE I, BINDING SITE II or BINDING SITE III. Table 2 illustrates the complementarity of the nucleotide sequences of LOC204804 BINDING SITE, designated SEQ ID:43098, to the nucleotide sequence of VGAM1958 RNA, herein designated VGAM RNA, also designated SEQ ID:4669.

Another function of VGAM1958 is therefore inhibition of LOC204804 (Accession XM_115599). Accordingly, utilities of VGAM1958 include diagnosis, prevention and treatment of diseases and clinical conditions associated with LOC204804. LOC204970 (Accession XM_114795) is another VGAM1958 host target gene. LOC204970 BINDING SITE is HOST TARGET binding site found in the 5' untranslated region of mRNA encoded by LOC204970, corresponding to a HOST TARGET binding site such as BINDING SITE I, BINDING SITE II or BINDING SITE III. Table 2 illustrates the complementarity of the nucleotide sequences of LOC204970 BINDING SITE, designated SEQ ID:43070, to the nucleotide sequence of VGAM1958 RNA, herein designated VGAM RNA, also designated SEQ ID:4669.

Another function of VGAM1958 is therefore inhibition of LOC204970 (Accession XM_114795). Accordingly, utilities of VGAM1958 include diagnosis, prevention and treatment of diseases and clinical conditions associated with LOC204970. LOC205327 (Accession XM_115788) is another VGAM1958 host target gene. LOC205327 BINDING SITE is HOST TARGET binding site found in the 3' untranslated region of mRNA encoded by LOC205327, corresponding to a HOST TARGET binding site such as BINDING SITE I, BINDING SITE II or BINDING SITE III. Table 2 illustrates the complementarity of the nucleotide sequences of LOC205327 BINDING SITE, designated SEQ ID:43105, to the nucleotide sequence of VGAM1958 RNA, herein designated VGAM RNA, also designated SEQ ID:4669.

Another function of VGAM1958 is therefore inhibition of LOC205327 (Accession XM_115788). Accordingly, utilities of VGAM1958 include diagnosis, prevention and treatment of diseases and clinical conditions associated with LOC205327. LOC219404 (Accession XM_167909) is another VGAM1958 host target gene. LOC219404 BINDING SITE is HOST TARGET binding site found in the 3' untranslated region of mRNA encoded by LOC219404, corresponding to a HOST TARGET binding site such as BINDING SITE I, BINDING SITE II or BINDING SITE III. Table 2 illustrates the complementarity of the nucleotide sequences of LOC219404 BINDING SITE, designated SEQ ID:44908, to the nucleotide sequence of VGAM1958 RNA, herein designated VGAM RNA, also designated SEQ ID:4669.

Another function of VGAM1958 is therefore inhibition of LOC219404 (Accession XM_167909). Accordingly, utilities of VGAM1958 include diagnosis, prevention and treatment of diseases and clinical conditions associated with LOC219404. LOC219686 (Accession XM_165544) is another VGAM1958 host target gene. LOC219686 BINDING SITE is HOST TARGET binding site found in the 5' untranslated region of mRNA encoded by LOC219686, corresponding to a HOST TARGET binding site such as BINDING SITE I, BINDING SITE II or BINDING SITE III. Table 2 illustrates the complementarity of the nucleotide sequences of LOC219686 BINDING SITE, designated SEQ ID:43673, to the nucleotide sequence of VGAM1958 RNA, herein designated VGAM RNA, also designated SEQ ID:4669.

Another function of VGAM1958 is therefore inhibition of LOC219686 (Accession XM_165544). Accordingly, utilities of VGAM1958 include diagnosis, prevention and treatment of diseases and clinical conditions associated with LOC219686. LOC219848 (Accession XM_166170) is another VGAM1958 host target gene. LOC219848 BINDING SITE is HOST TARGET binding site found in the 3' untranslated region of mRNA encoded by LOC219848, corresponding to a HOST TARGET binding site such as BINDING SITE I, BINDING SITE II or BINDING SITE III. Table 2 illustrates the complementarity of the nucleotide sequences of LOC219848 BINDING SITE, designated SEQ ID:43985, to the nucleotide sequence of VGAM1958 RNA, herein designated VGAM RNA, also designated SEQ ID:4669.

Another function of VGAM1958 is therefore inhibition of LOC219848 (Accession XM_166170). Accordingly, utilities of VGAM1958 include diagnosis, prevention and treatment of diseases and clinical conditions associated with LOC219848. LOC219942 (Accession XM_167790) is another VGAM1958 host target gene. LOC219942 BINDING SITE is HOST TARGET binding site found in the 3' untranslated region of mRNA encoded by LOC219942, corresponding to a HOST TARGET binding site such as BINDING SITE I, BINDING SITE II or BINDING SITE III. Table 2 illustrates the complementarity of the nucleotide sequences of LOC219942 BINDING SITE, designated SEQ ID:44825, to the nucleotide sequence of VGAM1958 RNA, herein designated VGAM RNA, also designated SEQ ID:4669.

Another function of VGAM1958 is therefore inhibition of LOC219942 (Accession XM_167790). Accordingly, utilities of VGAM1958 include diagnosis, prevention and treatment of diseases and clinical conditions associated with LOC219942. LOC220045 (Accession XM_167820) is another VGAM1958 host target gene. LOC220045 BINDING SITE is HOST TARGET binding site found in the 5' untranslated region of mRNA encoded by LOC220045, corresponding to a HOST TARGET binding site such as BINDING SITE I, BINDING SITE II or BINDING SITE III. Table 2 illustrates the complementarity of the nucleotide sequences of LOC220045 BINDING SITE, designated SEQ ID:44861, to the nucleotide sequence of VGAM1958 RNA, herein designated VGAM RNA, also designated SEQ ID:4669.

Another function of VGAM1958 is therefore inhibition of LOC220045 (Accession XM_167820). Accordingly, utilities of VGAM1958 include diagnosis, prevention and treatment of diseases and clinical conditions associated with LOC220045. LOC220143 (Accession XM_168046) is another VGAM1958 host target gene. LOC220143 BINDING SITE is HOST TARGET binding site found in the 3' untranslated region of mRNA encoded by LOC220143, corresponding to a HOST TARGET binding site such as BINDING SITE I, BINDING SITE II or BINDING SITE III. Table 2 illustrates the complementarity of the nucleotide sequences of LOC220143 BINDING SITE, designated SEQ ID:44953, to the nucleotide sequence of VGAM1958 RNA, herein designated VGAM RNA, also designated SEQ ID:4669.

Another function of VGAM1958 is therefore inhibition of LOC220143 (Accession XM_168046). Accordingly, utilities of VGAM1958 include diagnosis, prevention and treatment of diseases and clinical conditions associated with LOC220143. LOC220739 (Accession XM_167548) is another VGAM1958 host target gene. LOC220739 BINDING SITE is HOST TARGET binding site found in the 3' untranslated region of mRNA encoded by LOC220739, corresponding to a HOST TARGET binding site such as BINDING SITE I, BINDING SITE II or BINDING SITE III. Table 2 illustrates the complementarity of the nucleotide sequences of LOC220739 BINDING SITE, designated SEQ ID:44657, to the nucleotide sequence of VGAM1958 RNA, herein designated VGAM RNA, also designated SEQ ID:4669.

Another function of VGAM1958 is therefore inhibition of LOC220739 (Accession XM_167548). Accordingly, utilities of VGAM1958 include diagnosis, prevention and treatment of diseases and clinical conditions associated with LOC220739. LOC220776 (Accession XM_043388) is another VGAM1958 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33939, to the nucleotide sequence of VGAM1958 RNA, herein designated VGAM RNA, also designated SEQ ID:4669.

Another function of VGAM1958 is therefore inhibition of LOC220776 (Accession XM_043388). Accordingly, utilities of VGAM1958 include diagnosis, prevention and treatment of diseases and clinical conditions associated with LOC220776. LOC220929 (Accession XM_166134) is another VGAM1958 host target gene. LOC220929 BINDING SITE is HOST TARGET binding site found in the 5' untranslated region of mRNA encoded by LOC220929, corresponding to a HOST TARGET binding site such as BINDING SITE I, BINDING SITE II or BINDING SITE III. Table 2 illustrates the complementarity of the nucleotide sequences of LOC220929 BINDING SITE, designated SEQ ID:43928, to the nucleotide sequence of VGAM1958 RNA, herein designated VGAM RNA, also designated SEQ ID:4669.

Another function of VGAM1958 is therefore inhibition of LOC220929 (Accession XM_166134). Accordingly, utilities of VGAM1958 include diagnosis, prevention and treatment of diseases and clinical conditions associated with LOC220929. LOC221002 (Accession XM_166156) is another VGAM1958 host target gene. LOC221002 BINDING SITE is HOST TARGET binding site found in the 3' untranslated region of mRNA encoded by LOC221002, corresponding to a HOST TARGET binding site such as BINDING SITE I, BINDING SITE II or BINDING SITE III. Table 2 illustrates the complementarity of the nucleotide sequences of LOC221002 BINDING SITE, designated SEQ ID:43977, to the nucleotide sequence of VGAM1958 RNA, herein designated VGAM RNA, also designated SEQ ID:4669.

Another function of VGAM1958 is therefore inhibition of LOC221002 (Accession XM_166156). Accordingly, utilities of VGAM1958 include diagnosis, prevention and treatment of diseases and clinical conditions associated with LOC221002. LOC221042 (Accession XM_167669) is another VGAM1958 host target gene. LOC221042 BINDING SITE1 and LOC221042 BINDING SITE2 are HOST TARGET binding sites found in untranslated regions of mRNA encoded by LOC221042, corresponding to HOST TARGET binding sites such as BINDING SITE I, BINDING SITE II or BINDING SITE III. Table 2 illustrates the complementarity of the nucleotide sequences of LOC221042 BINDING SITE1 and LOC221042 BINDING SITE2, designated SEQ ID:44753 and SEQ ID:44754 respectively, to the nucleotide sequence of VGAM1958 RNA, herein designated VGAM RNA, also designated SEQ ID:4669.

Another function of VGAM1958 is therefore inhibition of LOC221042 (Accession XM_167669). Accordingly, utilities of VGAM1958 include diagnosis, prevention and treatment of diseases and clinical conditions associated with LOC221042. LOC221477 (Accession XM_166397) is another VGAM1958 host target gene. LOC221477 BINDING SITE1 and LOC221477 BINDING SITE2 are HOST TARGET binding sites found in untranslated regions of mRNA encoded by LOC221477, corresponding to HOST TARGET binding sites such as BINDING SITE I, BINDING SITE II or BINDING SITE III. Table 2 illustrates the complementarity of the nucleotide sequences of LOC221477 BINDING SITE1 and LOC221477 BINDING SITE2, designated SEQ ID:44249 and SEQ ID:44250 respectively, to the nucleotide sequence of VGAM1958 RNA, herein designated VGAM RNA, also designated SEQ ID:4669.

Another function of VGAM1958 is therefore inhibition of LOC221477 (Accession XM_166397). Accordingly, utilities of VGAM1958 include diagnosis, prevention and treatment of diseases and clinical conditions associated with LOC221477. LOC221687 (Accession XM_166423) is another VGAM1958 host target gene. LOC221687 BINDING SITE is HOST TARGET binding site found in the 5' untranslated region of mRNA encoded by LOC221687, corresponding to a HOST TARGET binding site such as BINDING SITE I, BINDING SITE II or BINDING SITE III. Table 2 illustrates the complementarity of the nucleotide sequences of LOC221687 BINDING SITE, designated SEQ ID:44304, to the nucleotide sequence of VGAM1958 RNA, herein designated VGAM RNA, also designated SEQ ID:4669.

Another function of VGAM1958 is therefore inhibition of LOC221687 (Accession XM_166423). Accordingly, utilities of VGAM1958 include diagnosis, prevention and treatment of diseases and clinical conditions associated with LOC221687. LOC221935 (Accession XM_166537) is another VGAM1958 host target gene. LOC221935 BINDING SITE is HOST TARGET binding site found in the 3' untranslated region of mRNA encoded by LOC221935, corresponding to a HOST TARGET binding site such as BINDING SITE I, BINDING SITE II or BINDING SITE III. Table 2 illustrates the complementarity of the nucleotide sequences of LOC221935 BINDING SITE, designated SEQ ID:44503, to the nucleotide sequence of VGAM1958 RNA, herein designated VGAM RNA, also designated SEQ ID:4669.

Another function of VGAM1958 is therefore inhibition of LOC221935 (Accession XM_166537). Accordingly, utilities of VGAM1958 include diagnosis, prevention and treatment of diseases and clinical conditions associated with LOC221935. LOC222237 (Accession XM_168592) is another VGAM1958 host target gene. LOC222237 BINDING SITE is HOST TARGET binding site found in the 3' untranslated region of mRNA encoded by LOC222237, corresponding to a HOST TARGET binding site such as BINDING SITE I, BINDING SITE II or BINDING SITE III. Table 2 illustrates the complementarity of the nucleotide sequences of LOC222237 BINDING SITE, designated SEQ ID:45269, to the nucleotide sequence of VGAM1958 RNA, herein designated VGAM RNA, also designated SEQ ID:4669.

Another function of VGAM1958 is therefore inhibition of LOC222237 (Accession XM_168592). Accordingly, utilities of VGAM1958 include diagnosis, prevention and treatment of diseases and clinical conditions associated with LOC222237. LOC253019 (Accession XM_170907) is another VGAM1958 host target gene. LOC253019 BINDING SITE is HOST TARGET binding site found in the 5' untranslated region of mRNA encoded by LOC253019, corresponding to a HOST TARGET binding site such as BINDING SITE I, BINDING SITE II or BINDING SITE III. Table 2 illustrates the complementarity of the nucleotide sequences of LOC253019 BINDING SITE, designated SEQ ID:45669, to the nucleotide sequence of VGAM1958 RNA, herein designated VGAM RNA, also designated SEQ ID:4669.

Another function of VGAM1958 is therefore inhibition of LOC253019 (Accession XM_170907). Accordingly, utilities of VGAM1958 include diagnosis, prevention and treatment of diseases and clinical conditions associated with LOC253019. LOC253502 (Accession XM_170561) is another VGAM1958 host target gene. LOC253502 BINDING SITE is HOST TARGET binding site found in the 3' untranslated region of mRNA encoded by LOC253502, corresponding to a HOST TARGET binding site such as BINDING SITE I, BINDING SITE II or BINDING SITE III. Table 2 illustrates the complementarity of the nucleotide sequences of LOC253502 BINDING SITE, designated SEQ ID:45380, to the nucleotide sequence of VGAM1958 RNA, herein designated VGAM RNA, also designated SEQ ID:4669.

Another function of VGAM1958 is therefore inhibition of LOC253502 (Accession XM_170561). Accordingly, utilities of VGAM1958 include diagnosis, prevention and treatment of diseases and clinical conditions associated with LOC253502. LOC253664 (Accession XM_170673) is another VGAM1958 host target gene. LOC253664 BINDING SITE is HOST TARGET binding site found in the 5' untranslated region of mRNA encoded by LOC253664, corresponding to a HOST TARGET binding site such as BIND- ING SITE I, BINDING SITE II or BINDING SITE III. Table 2 illustrates the complementarity of the nucleotide sequences of LOC253664 BINDING SITE, designated SEQ ID:45450, to the nucleotide sequence of VGAM1958 RNA, herein designated VGAM RNA, also designated SEQ ID:4669.

Another function of VGAM1958 is therefore inhibition of LOC253664 (Accession XM_170673). Accordingly, utilities of VGAM1958 include diagnosis, prevention and treatment of diseases and clinical conditions associated with LOC253664. LOC253975 (Accession XM_171130) is another VGAM1958 host target gene. LOC253975 BINDING SITE is HOST TARGET binding site found in the 5' untranslated region of mRNA encoded by LOC253975, corresponding to a HOST TARGET binding site such as BINDING SITE I, BINDING SITE II or BINDING SITE III. Table 2 illustrates the complementarity of the nucleotide sequences of LOC253975 BINDING SITE, designated SEQ ID:45936, to the nucleotide sequence of VGAM1958 RNA, herein designated VGAM RNA, also designated SEQ ID:4669.

Another function of VGAM1958 is therefore inhibition of LOC253975 (Accession XM_171130). Accordingly, utilities of VGAM1958 include diagnosis, prevention and treatment of diseases and clinical conditions associated with LOC253975. LOC253981 (Accession XM_171064) is another VGAM1958 host target gene. LOC253981 BINDING SITE is HOST TARGET binding site found in the 3' untranslated region of mRNA encoded by LOC253981, corresponding to a HOST TARGET binding site such as BINDING SITE I, BINDING SITE II or BINDING SITE III. Table 2 illustrates the complementarity of the nucleotide sequences of LOC253981 BINDING SITE, designated SEQ ID:45866, to the nucleotide sequence of VGAM1958 RNA, herein designated VGAM RNA, also designated SEQ ID:4669.

Another function of VGAM1958 is therefore inhibition of LOC253981 (Accession XM_171064). Accordingly, utilities of VGAM1958 include diagnosis, prevention and treatment of diseases and clinical conditions associated with LOC253981. LOC254015 (Accession XM_172977) is another VGAM1958 host target gene. LOC254015 BINDING SITE1 and LOC254015 BINDING SITE2 are HOST TARGET binding sites found in untranslated regions of mRNA encoded by LOC254015, corresponding to HOST TARGET binding sites such as BINDING SITE I, BINDING SITE II or BINDING SITE III. Table 2 illustrates the complementarity of the nucleotide sequences of LOC254015 BINDING SITE1 and LOC254015 BINDING SITE2, designated SEQ ID:46243 and SEQ ID:46245 respectively, to the nucleotide sequence of VGAM1958 RNA, herein designated VGAM RNA, also designated SEQ ID:4669.

Another function of VGAM1958 is therefore inhibition of LOC254015 (Accession XM_172977). Accordingly, utilities of VGAM1958 include diagnosis, prevention and treatment of diseases and clinical conditions associated with LOC254015. LOC254243 (Accession XM_173233) is another VGAM1958 host target gene. LOC254243 BINDING SITE is HOST TARGET binding site found in the 3' untranslated region of mRNA encoded by LOC254243, corresponding to a HOST TARGET binding site such as BINDING SITE I, BINDING SITE II or BINDING SITE III. Table 2 illustrates the complementarity of the nucleotide sequences of LOC254243 BINDING SITE, designated SEQ ID:46510, to the nucleotide sequence of VGAM1958 RNA, herein designated VGAM RNA, also designated SEQ ID:4669.

Another function of VGAM1958 is therefore inhibition of LOC254243 (Accession XM_173233). Accordingly, utilities of VGAM1958 include diagnosis, prevention and treatment of diseases and clinical conditions associated with LOC254243. LOC254531 (Accession XM_170773) is another VGAM1958 host target gene. LOC254531 BINDING SITE is HOST TARGET binding site found in the 5' untranslated region of mRNA encoded by LOC254531, corresponding to a HOST TARGET binding site such as BINDING SITE I, BINDING SITE II or BINDING SITE III. Table 2 illustrates the complementarity of the nucleotide sequences of LOC254531 BINDING SITE, designated SEQ ID:45540, to the nucleotide sequence of VGAM1958 RNA, herein designated VGAM RNA, also designated SEQ ID:4669.

Another function of VGAM1958 is therefore inhibition of LOC254531 (Accession XM_170773). Accordingly, utilities of VGAM1958 include diagnosis, prevention and treatment of diseases and clinical conditions associated with LOC254531. LOC254532 (Accession XM_172961) is another VGAM1958 host target gene. LOC254532 BINDING SITE is HOST TARGET binding site found in the 5' untranslated region of mRNA encoded by LOC254532, corresponding to a HOST TARGET binding site such as BINDING SITE I, BINDING SITE II or BINDING SITE III. Table 2 illustrates the complementarity of the nucleotide sequences of LOC254532 BINDING SITE, designated SEQ ID:46207, to the nucleotide sequence of VGAM1958 RNA, herein designated VGAM RNA, also designated SEQ ID:4669.

Another function of VGAM1958 is therefore inhibition of LOC254532 (Accession XM_172961). Accordingly, utilities of VGAM1958 include diagnosis, prevention and treatment of diseases and clinical conditions associated with LOC254532. LOC255057 (Accession XM_170903) is another VGAM1958 host target gene. LOC255057 BINDING SITE is HOST TARGET binding site found in the 3' untranslated region of mRNA encoded by LOC255057, corresponding to a HOST TARGET binding site such as BINDING SITE I, BINDING SITE II or BINDING SITE III. Table 2 illustrates the complementarity of the nucleotide sequences of LOC255057 BINDING SITE, designated SEQ ID:45661, to the nucleotide sequence of VGAM1958 RNA, herein designated VGAM RNA, also designated SEQ ID:4669.

Another function of VGAM1958 is therefore inhibition of LOC255057 (Accession XM_170903). Accordingly, utilities of VGAM1958 include diagnosis, prevention and treatment of diseases and clinical conditions associated with LOC255057. LOC255082 (Accession XM_172843) is another VGAM1958 host target gene. LOC255082 BINDING SITE1 and LOC255082 BINDING SITE2 are HOST TARGET binding sites found in untranslated regions of mRNA encoded by LOC255082, corresponding to HOST TARGET binding sites such as BINDING SITE I, BINDING SITE II or BINDING SITE III. Table 2 illustrates the complementarity of the nucleotide sequences of LOC255082 BINDING SITE1 and LOC255082 BINDING SITE2, designated SEQ ID:46118 and SEQ ID:46120 respectively, to the nucleotide sequence of VGAM1958 RNA, herein designated VGAM RNA, also designated SEQ ID:4669.

Another function of VGAM1958 is therefore inhibition of LOC255082 (Accession XM_172843). Accordingly, utilities of VGAM1958 include diagnosis, prevention and treatment of diseases and clinical conditions associated with LOC255082. LOC255645 (Accession XM_172967) is another VGAM1958 host target gene. LOC255645 BINDING SITE is HOST TARGET binding site found in the 3' untranslated region of mRNA encoded by LOC255645, corresponding to a HOST TARGET binding site such as BINDING SITE I, BINDING SITE II or BINDING SITE III. Table 2 illustrates the complementarity of the nucleotide sequences of LOC255645 BINDING SITE, designated SEQ ID:46222, to the nucleotide sequence of VGAM1958 RNA, herein designated VGAM RNA, also designated SEQ ID:4669.

Another function of VGAM1958 is therefore inhibition of LOC255645 (Accession XM_172967). Accordingly, utilities of VGAM1958 include diagnosis, prevention and treatment of diseases and clinical conditions associated with LOC255645. LOC255995 (Accession XM_173071) is another VGAM1958 host target gene. LOC255995 BINDING SITE is HOST TARGET binding site found in the 5' untranslated region of mRNA encoded by LOC255995, corresponding to a HOST TARGET binding site such as BINDING SITE I, BINDING SITE II or BINDING SITE III. Table 2 illustrates the complementarity of the nucleotide sequences of LOC255995 BINDING SITE, designated SEQ ID:46324, to the nucleotide sequence of VGAM1958 RNA, herein designated VGAM RNA, also designated SEQ ID:4669.

Another function of VGAM1958 is therefore inhibition of LOC255995 (Accession XM_173071). Accordingly, utilities of VGAM1958 include diagnosis, prevention and treatment of diseases and clinical conditions associated with LOC255995. LOC256158 (Accession XM_175125) is another VGAM1958 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46636, to the nucleotide sequence of VGAM1958 RNA, herein designated VGAM RNA, also designated SEQ ID:4669.

Another function of VGAM1958 is therefore inhibition of LOC256158 (Accession XM_175125). Accordingly, utilities of VGAM1958 include diagnosis, prevention and treatment of diseases and clinical conditions associated with LOC256158. LOC256790 (Accession XM_170679) is another VGAM1958 host target gene. LOC256790 BINDING SITE is HOST TARGET binding site found in the 5' untranslated region of mRNA encoded by LOC256790, corresponding to a HOST TARGET binding site such as BINDING SITE I, BINDING SITE II or BINDING SITE III. Table 2 illustrates the complementarity of the nucleotide sequences of LOC256790 BINDING SITE, designated SEQ ID:45460, to the nucleotide sequence of VGAM1958 RNA, herein designated VGAM RNA, also designated SEQ ID:4669.

Another function of VGAM1958 is therefore inhibition of LOC256790 (Accession XM_170679). Accordingly, utilities of VGAM1958 include diagnosis, prevention and treatment of diseases and clinical conditions associated with LOC256790. LOC256848 (Accession XM_174050) is another VGAM1958 host target gene. LOC256848 BINDING SITE is HOST TARGET binding site found in the 5' untranslated region of mRNA encoded by LOC256848, corresponding to a HOST TARGET binding site such as BINDING SITE I, BINDING SITE II or BINDING SITE III. Table 2 illustrates the complementarity of the nucleotide sequences of LOC256848 BINDING SITE, designated SEQ ID:46570, to the nucleotide sequence of VGAM1958 RNA, herein designated VGAM RNA, also designated SEQ ID:4669.

Another function of VGAM1958 is therefore inhibition of LOC256848 (Accession XM_174050). Accordingly, utilities of VGAM1958 include diagnosis, prevention and treatment of diseases and clinical conditions associated with LOC256848. LOC257054 (Accession XM_171010) is another VGAM1958 host target gene. LOC257054 BINDING SITE1 and LOC257054 BINDING SITE2 are HOST TARGET binding sites found in untranslated regions of mRNA encoded by LOC257054, corresponding to HOST TARGET binding sites such as BINDING SITE I, BINDING SITE II or BINDING SITE III. Table 2 illustrates the complementarity of the nucleotide sequences of LOC257054 BINDING SITE1 and LOC257054 BINDING SITE2, designated SEQ ID:45779 and SEQ ID:45784 respectively, to the nucleotide sequence of VGAM1958 RNA, herein designated VGAM RNA, also designated SEQ ID:4669.

Another function of VGAM1958 is therefore inhibition of LOC257054 (Accession XM_171010). Accordingly, utilities of VGAM1958 include diagnosis, prevention and treatment of diseases and clinical conditions associated with LOC257054. LOC257354 (Accession XM_170810) is another VGAM1958 host target gene. LOC257354 BINDING SITE is HOST TARGET binding site found in the 3' untranslated region of mRNA encoded by LOC257354, corresponding to a HOST TARGET binding site such as BINDING SITE I, BINDING SITE II or BINDING SITE III. Table 2 illustrates the complementarity of the nucleotide sequences of LOC257354 BINDING SITE, designated SEQ ID:45575, to the nucleotide sequence of VGAM1958 RNA, herein designated VGAM RNA, also designated SEQ ID:4669.

Another function of VGAM1958 is therefore inhibition of LOC257354 (Accession XM_170810). Accordingly, utilities of VGAM1958 include diagnosis, prevention and treatment of diseases and clinical conditions associated with LOC257354. LOC257451 (Accession XM_170960) is another VGAM1958 host target gene. LOC257451 BINDING SITE is HOST TARGET binding site found in the 3' untranslated region of mRNA encoded by LOC257451, corresponding to a HOST TARGET binding site such as BINDING SITE I, BINDING SITE II or BINDING SITE III. Table 2 illustrates the complementarity of the nucleotide sequences of LOC257451 BINDING SITE, designated SEQ ID:45743, to the nucleotide sequence of VGAM1958 RNA, herein designated VGAM RNA, also designated SEQ ID:4669.

Another function of VGAM1958 is therefore inhibition of LOC257451 (Accession XM_170960). Accordingly, utilities of VGAM1958 include diagnosis, prevention and treatment of diseases and clinical conditions associated with LOC257451. LOC257463 (Accession XM_048605) is another VGAM1958 host target gene. LOC257463 BINDING SITE is HOST TARGET binding site found in the 5' untranslated region of mRNA encoded by LOC257463, corresponding to a HOST TARGET binding site such as BINDING SITE I, BINDING SITE II or BINDING SITE III. Table 2 illustrates the complementarity of the nucleotide sequences of LOC257463 BINDING SITE, designated SEQ ID:35210, to the nucleotide sequence of VGAM1958 RNA, herein designated VGAM RNA, also designated SEQ ID:4669.

Another function of VGAM1958 is therefore inhibition of LOC257463 (Accession XM_048605). Accordingly, utilities of VGAM1958 include diagnosis, prevention and treatment of diseases and clinical conditions associated with LOC257463. LOC257472 (Accession XM_170812) is another VGAM1958 host target gene. LOC257472 BINDING SITE1 and LOC257472 BINDING SITE2 are HOST TARGET binding sites found in untranslated regions of mRNA encoded by LOC257472, corresponding to HOST TARGET binding sites such as BINDING SITE I, BINDING SITE II or BINDING SITE III. Table 2 illustrates the complementarity of the nucleotide sequences of LOC257472 BINDING SITE1 and LOC257472 BINDING SITE2, designated SEQ ID:45593 and SEQ ID:45594 respectively, to the nucleotide sequence of VGAM1958 RNA, herein designated VGAM RNA, also designated SEQ ID:4669.

Another function of VGAM1958 is therefore inhibition of LOC257472 (Accession XM_170812). Accordingly, utilities of VGAM1958 include diagnosis, prevention and treatment of diseases and clinical conditions associated with LOC257472. LOC51219 (Accession NM_016418) is another VGAM1958 host target gene. LOC51219 BINDING SITE is HOST TARGET binding site found in the 5' untranslated region of mRNA encoded by LOC51219, corresponding to a HOST TARGET binding site such as BINDING SITE I, BINDING SITE II or BINDING SITE III. Table 2 illustrates the complementarity of the nucleotide sequences of LOC51219 BINDING SITE, designated SEQ ID:18545, to the nucleotide sequence of VGAM1958 RNA, herein designated VGAM RNA, also designated SEQ ID:4669.

Another function of VGAM1958 is therefore inhibition of LOC51219 (Accession NM_016418). Accordingly, utilities of VGAM1958 include diagnosis, prevention and treatment of diseases and clinical conditions associated with LOC51219. LOC51236 (Accession NM_016458) is another VGAM1958 host target gene. LOC51236 BINDING SITE is HOST TARGET binding site found in the 3' untranslated region of mRNA encoded by LOC51236, corresponding to a HOST TARGET binding site such as BINDING SITE I, BINDING SITE II or BINDING SITE III. Table 2 illustrates the complementarity of the nucleotide sequences of LOC51236 BINDING SITE, designated SEQ ID:18571, to the nucleotide sequence of VGAM1958 RNA, herein designated VGAM RNA, also designated SEQ ID:4669.

Another function of VGAM1958 is therefore inhibition of LOC51236 (Accession NM_016458). Accordingly, utilities of VGAM1958 include diagnosis, prevention and treatment of diseases and clinical conditions associated with LOC51236. LOC51279 (Accession NM_016546) is another VGAM1958 host target gene. LOC51279 BINDING SITE is HOST TARGET binding site found in the 3' untranslated region of mRNA encoded by LOC51279, corresponding to a HOST TARGET binding site such as BINDING SITE I, BINDING SITE II or BINDING SITE III. Table 2 illustrates the complementarity of the nucleotide sequences of LOC51279 BINDING SITE, designated SEQ ID:18618, to the nucleotide sequence of VGAM1958 RNA, herein designated VGAM RNA, also designated SEQ ID:4669.

Another function of VGAM1958 is therefore inhibition of LOC51279 (Accession NM_016546). Accordingly, utilities of VGAM1958 include diagnosis, prevention and treatment of diseases and clinical conditions associated with LOC51279. LOC51644 (Accession NM_016057) is another VGAM1958 host target gene. LOC51644 BINDING SITE is HOST TARGET binding site found in the 3' untranslated region of mRNA encoded by LOC51644, corresponding to a HOST TARGET binding site such as BINDING SITE I, BINDING SITE II or BINDING SITE III. Table 2 illustrates the complementarity of the nucleotide sequences of LOC51644 BINDING SITE, designated SEQ ID:18129, to the nucleotide sequence of VGAM1958 RNA, herein designated VGAM RNA, also designated SEQ ID:4669.

Another function of VGAM1958 is therefore inhibition of LOC51644 (Accession NM_016057). Accordingly, utilities of VGAM1958 include diagnosis, prevention and treatment of diseases and clinical conditions associated with LOC51644. LOC54499 (Accession XM_047479) is another VGAM1958 host target gene. LOC54499 BINDING SITE is HOST TARGET binding site found in the 3' untranslated region of mRNA encoded by LOC54499, corresponding to a HOST TARGET binding site such as BINDING SITE I, BINDING SITE II or BINDING SITE III. Table 2 illustrates the complementarity of the nucleotide sequences of LOC54499 BINDING SITE, designated SEQ ID:34965, to the nucleotide sequence of VGAM1958 RNA, herein designated VGAM RNA, also designated SEQ ID:4669.

Another function of VGAM1958 is therefore inhibition of LOC54499 (Accession XM_047479). Accordingly, utilities of VGAM1958 include diagnosis, prevention and treatment of diseases and clinical conditions associated with LOC54499. LOC55580 (Accession NM_017571) is another VGAM1958 host target gene. LOC55580 BINDING SITE is HOST TARGET binding site found in the 5' untranslated region of mRNA encoded by LOC55580, corresponding to a HOST TARGET binding site such as BINDING SITE I, BINDING SITE II or BINDING SITE III. Table 2 illustrates the complementarity of the nucleotide sequences of LOC55580 BINDING SITE, designated SEQ ID:18994, to the nucleotide sequence of VGAM1958 RNA, herein designated VGAM RNA, also designated SEQ ID:4669.

Another function of VGAM1958 is therefore inhibition of LOC55580 (Accession NM_017571). Accordingly, utilities of VGAM1958 include diagnosis, prevention and treatment of diseases and clinical conditions associated with LOC55580. LOC56181 (Accession XM_170954) is another VGAM1958 host target gene. LOC56181 BINDING SITE is HOST TARGET binding site found in the 5' untranslated region of mRNA encoded by LOC56181, corresponding to a HOST TARGET binding site such as BINDING SITE I, BINDING SITE II or BINDING SITE III. Table 2 illustrates the complementarity of the nucleotide sequences of LOC56181 BINDING SITE, designated SEQ ID:45739, to the nucleotide sequence of VGAM1958 RNA, herein designated VGAM RNA, also designated SEQ ID:4669.

Another function of VGAM1958 is therefore inhibition of LOC56181 (Accession XM_170954). Accordingly, utilities of VGAM1958 include diagnosis, prevention and treatment of diseases and clinical conditions associated with LOC56181. LOC56270 (Accession NM_019613) is another VGAM1958 host target gene. LOC56270 BINDING SITE is HOST TARGET binding site found in the 3' untranslated region of mRNA encoded by LOC56270, corresponding to a HOST TARGET binding site such as BINDING SITE I, BINDING SITE II or BINDING SITE III. Table 2 illustrates the complementarity of the nucleotide sequences of LOC56270 BINDING SITE, designated SEQ ID:21231, to the nucleotide sequence of VGAM1958 RNA, herein designated VGAM RNA, also designated SEQ ID:4669.

Another function of VGAM1958 is therefore inhibition of LOC56270 (Accession NM_019613). Accordingly, utilities of VGAM1958 include diagnosis, prevention and treatment of diseases and clinical conditions associated with LOC56270. LOC56899 (Accession NM_020140) is another VGAM1958 host target gene. LOC56899 BINDING SITE is HOST TARGET binding site found in the 5' untranslated region of mRNA encoded by LOC56899, corresponding to a HOST TARGET binding site such as BINDING SITE I, BINDING SITE II or BINDING SITE III. Table 2 illustrates the complementarity of the nucleotide sequences of LOC56899 BINDING SITE, designated SEQ ID:21336, to the nucleotide sequence of VGAM1958 RNA, herein designated VGAM RNA, also designated SEQ ID:4669.

Another function of VGAM1958 is therefore inhibition of LOC56899 (Accession NM_020140). Accordingly, utilities of VGAM1958 include diagnosis, prevention and treatment of diseases and clinical conditions associated with LOC56899. LOC57826 (Accession NM_021183) is another VGAM1958 host target gene. LOC57826 BINDING SITE is HOST TARGET binding site found in the 3' untranslated region of mRNA encoded by LOC57826, corresponding to a HOST TARGET binding site such as BINDING SITE I, BINDING SITE II or BINDING SITE III. Table 2 illustrates the complementarity of the nucleotide sequences of LOC57826 BINDING SITE, designated SEQ ID:22158, to the nucleotide sequence of VGAM1958 RNA, herein designated VGAM RNA, also designated SEQ ID:4669.

Another function of VGAM1958 is therefore inhibition of LOC57826 (Accession NM_021183). Accordingly, utilities of VGAM1958 include diagnosis, prevention and treatment of diseases and clinical conditions associated with LOC57826. LOC64744 (Accession XM_029830) is another VGAM1958 host target gene. LOC64744 BINDING SITE is HOST TARGET binding site found in the 5' untranslated region of mRNA encoded by LOC64744, corresponding to a HOST TARGET binding site such as BINDING SITE I, BINDING SITE II or BINDING SITE III. Table 2 illustrates the complementarity of the nucleotide sequences of LOC64744 BINDING SITE, designated SEQ ID:30952, to the nucleotide sequence of VGAM1958 RNA, herein designated VGAM RNA, also designated SEQ ID:4669.

Another function of VGAM1958 is therefore inhibition of LOC64744 (Accession XM_029830). Accordingly, utilities of VGAM1958 include diagnosis, prevention and treatment of diseases and clinical conditions associated with LOC64744. LOC90038 (Accession XM_028305) is another VGAM1958 host target gene. LOC90038 BINDING SITE is HOST TARGET binding site found in the 3' untranslated region of mRNA encoded by LOC90038, corresponding to a HOST TARGET binding site such as BINDING SITE I, BINDING SITE II or BINDING SITE III. Table 2 illustrates the complementarity of the nucleotide sequences of LOC90038 BINDING SITE, designated SEQ ID:30647, to the nucleotide sequence of VGAM1958 RNA, herein designated VGAM RNA, also designated SEQ ID:4669.

Another function of VGAM1958 is therefore inhibition of LOC90038 (Accession XM_028305). Accordingly, utilities of VGAM1958 include diagnosis, prevention and treatment of diseases and clinical conditions associated with LOC90038. LOC90092 (Accession XM_028862) is another VGAM1958 host target gene. LOC90092 BINDING SITE is HOST TARGET binding site found in the 5' untranslated region of mRNA encoded by LOC90092, corresponding to a HOST TARGET binding site such as BINDING SITE I, BINDING SITE II or BINDING SITE III. Table 2 illustrates the complementarity of the nucleotide sequences of LOC90092 BINDING SITE, designated SEQ ID:30781, to the nucleotide sequence of VGAM1958 RNA, herein designated VGAM RNA, also designated SEQ ID:4669.

Another function of VGAM1958 is therefore inhibition of LOC90092 (Accession XM_028862). Accordingly, utilities of VGAM1958 include diagnosis, prevention and treatment of diseases and clinical conditions associated with LOC90092. LOC90133 (Accession XM_029323) is another VGAM1958 host target gene. LOC90133 BINDING SITE is HOST TARGET binding site found in the 3' untranslated region of mRNA encoded by LOC90133, corresponding to a HOST TARGET binding site such as BINDING SITE I, BINDING SITE II or BINDING SITE III. Table 2 illustrates the complementarity of the nucleotide sequences of LOC90133 BINDING SITE, designated SEQ ID:30868, to the nucleotide sequence of VGAM1958 RNA, herein designated VGAM RNA, also designated SEQ ID:4669.

Another function of VGAM1958 is therefore inhibition of LOC90133 (Accession XM_029323). Accordingly, utilities of VGAM1958 include diagnosis, prevention and treatment of diseases and clinical conditions associated with LOC90133. LOC90148 (Accession XM_029430) is another VGAM1958 host target gene. LOC90148 BINDING SITE is HOST TARGET binding site found in the 5' untranslated region of mRNA encoded by LOC90148, corresponding to a HOST TARGET binding site such as BINDING SITE I, BINDING SITE II or BINDING SITE III. Table 2 illustrates the complementarity of the nucleotide sequences of LOC90148 BINDING SITE, designated SEQ ID:30891, to the nucleotide sequence of VGAM1958 RNA, herein designated VGAM RNA, also designated SEQ ID:4669.

Another function of VGAM1958 is therefore inhibition of LOC90148 (Accession XM_029430). Accordingly, utilities of VGAM1958 include diagnosis, prevention and treatment of diseases and clinical conditions associated with LOC90148. LOC90170 (Accession XM_029589) is another VGAM1958 host target gene. LOC90170 BINDING SITE1 and LOC90170 BINDING SITE2 are HOST TARGET binding sites found in untranslated regions of mRNA encoded by LOC90170, corresponding to HOST TARGET binding sites such as BINDING SITE I, BINDING SITE II or BINDING SITE III. Table 2 illustrates the complementarity of the nucleotide sequences of LOC90170 BINDING SITE1 and LOC90170 BINDING SITE2, designated SEQ ID:30912 and SEQ ID:30914 respectively, to the nucleotide sequence of VGAM1958 RNA, herein designated VGAM RNA, also designated SEQ ID:4669.

Another function of VGAM1958 is therefore inhibition of LOC90170 (Accession XM_029589). Accordingly, utilities of VGAM1958 include diagnosis, prevention and treatment of diseases and clinical conditions associated with LOC90170. LOC90233 (Accession NM_138347) is another VGAM1958 host target gene. LOC90233 BINDING SITE is HOST TARGET binding site found in the 3' untranslated region of mRNA encoded by LOC90233, corresponding to a HOST TARGET binding site such as BINDING SITE I, BINDING SITE II or BINDING SITE III. Table 2 illustrates the complementarity of the nucleotide sequences of LOC90233 BINDING SITE, designated SEQ ID:28743, to the nucleotide sequence of VGAM1958 RNA, herein designated VGAM RNA, also designated SEQ ID:4669.

Another function of VGAM1958 is therefore inhibition of LOC90233 (Accession NM_138347). Accordingly, utilities of VGAM1958 include diagnosis, prevention and treatment of diseases and clinical conditions associated with LOC90233. LOC90249 (Accession XM_030300) is another VGAM1958 host target gene. LOC90249 BINDING SITE is HOST TARGET binding site found in the 5' untranslated region of mRNA encoded by LOC90249, corresponding to a HOST TARGET binding site such as BINDING SITE I, BINDING SITE II or BINDING SITE III. Table 2 illustrates the complementarity of the nucleotide sequences of LOC90249 BINDING SITE, designated SEQ ID:31012, to the nucleotide sequence of VGAM1958 RNA, herein designated VGAM RNA, also designated SEQ ID:4669.

Another function of VGAM1958 is therefore inhibition of LOC90249 (Accession XM_030300). Accordingly, utilities of VGAM1958 include diagnosis, prevention and treatment of diseases and clinical conditions associated with LOC90249. LOC90288 (Accession XM_030669) is another VGAM1958 host target gene. LOC90288 BINDING SITE1 and LOC90288 BINDING SITE2 are HOST TARGET binding sites found in untranslated regions of mRNA encoded by LOC90288, corresponding to HOST TARGET binding sites such as BINDING SITE I, BINDING SITE II or BINDING SITE III. Table 2 illustrates the complementarity of the nucleotide sequences of LOC90288 BINDING SITE1 and LOC90288 BINDING SITE2, designated SEQ ID:31109 and SEQ ID:31110 respectively, to the nucleotide sequence of VGAM1958 RNA, herein designated VGAM RNA, also designated SEQ ID:4669.

Another function of VGAM1958 is therefore inhibition of LOC90288 (Accession XM_030669). Accordingly, utilities of VGAM1958 include diagnosis, prevention and treatment of diseases and clinical conditions associated with LOC90288. LOC90485 (Accession XM_032059) is another VGAM1958 host target gene. LOC90485 BINDING SITE is HOST TARGET binding site found in the 3' untranslated region of mRNA encoded by LOC90485, corresponding to a HOST TARGET binding site such as BINDING SITE I, BINDING SITE II or BINDING SITE III. Table 2 illustrates the complementarity of the nucleotide sequences of LOC90485 BINDING SITE, designated SEQ ID:31554, to the nucleotide sequence of VGAM1958 RNA, herein designated VGAM RNA, also designated SEQ ID:4669.

Another function of VGAM1958 is therefore inhibition of LOC90485 (Accession XM_032059). Accordingly, utilities of VGAM1958 include diagnosis, prevention and treatment of diseases and clinical conditions associated with LOC90485. LOC90632 (Accession XM_033067) is another VGAM1958 host target gene. LOC90632 BINDING SITE is HOST TARGET binding site found in the 5' untranslated region of mRNA encoded by LOC90632, corresponding to a HOST TARGET binding site such as BINDING SITE I, BINDING SITE II or BINDING SITE III. Table 2 illustrates the complementarity of the nucleotide sequences of LOC90632 BINDING SITE, designated SEQ ID:31829, to the nucleotide sequence of VGAM1958 RNA, herein designated VGAM RNA, also designated SEQ ID:4669.

Another function of VGAM1958 is therefore inhibition of LOC90632 (Accession XM_033067). Accordingly, utilities of VGAM1958 include diagnosis, prevention and treatment of diseases and clinical conditions associated with LOC90632. LOC90777 (Accession XM_034052) is another VGAM1958 host target gene. LOC90777 BINDING SITE is HOST TARGET binding site found in the 3' untranslated region of mRNA encoded by LOC90777, corresponding to a HOST TARGET binding site such as BINDING SITE I, BINDING SITE II or BINDING SITE III. Table 2 illustrates the complementarity of the nucleotide sequences of LOC90777 BINDING SITE, designated SEQ ID:31993, to the nucleotide sequence of VGAM1958 RNA, herein designated VGAM RNA, also designated SEQ ID:4669.

Another function of VGAM1958 is therefore inhibition of LOC90777 (Accession XM_034052). Accordingly, utilities of VGAM1958 include diagnosis, prevention and treatment of diseases and clinical conditions associated with LOC90777. LOC90784 (Accession XM_034109) is another VGAM1958 host target gene. LOC90784 BINDING SITE is HOST TARGET binding site found in the 5' untranslated region of mRNA encoded by LOC90784, corresponding to a HOST TARGET binding site such as BINDING SITE I, BINDING SITE II or BINDING SITE III. Table 2 illustrates the complementarity of the nucleotide sequences of LOC90784 BINDING SITE, designated SEQ ID:32002, to the nucleotide sequence of VGAM1958 RNA, herein designated VGAM RNA, also designated SEQ ID:4669.

Another function of VGAM1958 is therefore inhibition of LOC90784 (Accession XM_034109). Accordingly, utilities of VGAM1958 include diagnosis, prevention and treatment of diseases and clinical conditions associated with LOC90784. LOC90786 (Accession XM_034127) is another VGAM1958 host target gene. LOC90786 BINDING SITE is HOST TARGET binding site found in the 5' untranslated region of mRNA encoded by LOC90786, corresponding to a HOST TARGET binding site such as BINDING SITE I, BINDING SITE II or BINDING SITE III. Table 2 illustrates the complementarity of the nucleotide sequences of LOC90786 BINDING SITE, designated SEQ ID:32011, to the nucleotide sequence of VGAM1958 RNA, herein designated VGAM RNA, also designated SEQ ID:4669.

Another function of VGAM1958 is therefore inhibition of LOC90786 (Accession XM_034127). Accordingly, utilities of VGAM1958 include diagnosis, prevention and treatment of diseases and clinical conditions associated with LOC90786. LOC90826 (Accession XM_034321) is another VGAM1958 host target gene. LOC90826 BINDING SITE is HOST TARGET binding site found in the 5' untranslated region of mRNA encoded by LOC90826, corresponding to a HOST TARGET binding site such as BINDING SITE I, BINDING SITE II or BINDING SITE III. Table 2 illustrates the complementarity of the nucleotide sequences of LOC90826 BINDING SITE, designated SEQ ID:32053, to the nucleotide sequence of VGAM1958 RNA, herein designated VGAM RNA, also designated SEQ ID:4669.

Another function of VGAM1958 is therefore inhibition of LOC90826 (Accession XM_034321). Accordingly, utilities of VGAM1958 include diagnosis, prevention and treatment of diseases and clinical conditions associated with LOC90826. LOC90906 (Accession XM_034809) is another VGAM1958 host target gene. LOC90906 BINDING SITE is HOST TARGET binding site found in the 5' untranslated region of mRNA encoded by LOC90906, corresponding to a HOST TARGET binding site such as BINDING SITE I, BINDING SITE II or BINDING SITE III. Table 2 illustrates the complementarity of the nucleotide sequences of LOC90906 BINDING SITE, designated SEQ ID:32147, to the nucleotide sequence of VGAM1958 RNA, herein designated VGAM RNA, also designated SEQ ID:4669.

Another function of VGAM1958 is therefore inhibition of LOC90906 (Accession XM_034809). Accordingly, utilities of VGAM1958 include diagnosis, prevention and treatment of diseases and clinical conditions associated with LOC90906. LOC91050 (Accession XM_035703) is another VGAM1958 host target gene. LOC91050 BINDING SITE is HOST TARGET binding site found in the 3' untranslated region of mRNA encoded by LOC91050, corresponding to a HOST TARGET binding site such as BINDING SITE I, BINDING SITE II or BINDING SITE III. Table 2 illustrates the complementarity of the nucleotide sequences of LOC91050 BINDING SITE, designated SEQ ID:32333, to the nucleotide sequence of VGAM1958 RNA, herein designated VGAM RNA, also designated SEQ ID:4669.

Another function of VGAM1958 is therefore inhibition of LOC91050 (Accession XM_035703). Accordingly, utilities of VGAM1958 include diagnosis, prevention and treatment of diseases and clinical conditions associated with LOC91050. LOC91097 (Accession XM_035977) is another VGAM1958 host target gene. LOC91097 BINDING SITE is HOST TARGET binding site found in the 3' untranslated region of mRNA encoded by LOC91097, corresponding to a HOST TARGET binding site such as BINDING SITE I, BINDING SITE II or BINDING SITE III. Table 2 illustrates the complementarity of the nucleotide sequences of LOC91097 BINDING SITE, designated SEQ ID:32369, to the nucleotide sequence of VGAM1958 RNA, herein designated VGAM RNA, also designated SEQ ID:4669.

Another function of VGAM1958 is therefore inhibition of LOC91097 (Accession XM_035977). Accordingly, utilities of VGAM1958 include diagnosis, prevention and treatment of diseases and clinical conditions associated with LOC91097. LOC91149 (Accession XM_036480) is another VGAM1958 host target gene. LOC91149 BINDING SITE is HOST TARGET binding site found in the 5' untranslated region of mRNA encoded by LOC91149, corresponding to a HOST TARGET binding site such as BINDING SITE I, BINDING SITE II or BINDING SITE III. Table 2 illustrates the complementarity of the nucleotide sequences of LOC91149 BINDING SITE, designated SEQ ID:32453, to the nucleotide sequence of VGAM1958 RNA, herein designated VGAM RNA, also designated SEQ ID:4669.

Another function of VGAM1958 is therefore inhibition of LOC91149 (Accession XM_036480). Accordingly, utilities of VGAM1958 include diagnosis, prevention and treatment of diseases and clinical conditions associated with LOC91149. LOC91301 (Accession XM_037564) is another VGAM1958 host target gene. LOC91301 BINDING SITE is HOST TARGET binding site found in the 5' untranslated region of mRNA encoded by LOC91301, corresponding to a HOST TARGET binding site such as BINDING SITE I, BINDING SITE II or BINDING SITE III. Table 2 illustrates the complementarity of the nucleotide sequences of LOC91301 BINDING SITE, designated SEQ ID:32650, to the nucleotide sequence of VGAM1958 RNA, herein designated VGAM RNA, also designated SEQ ID:4669.

Another function of VGAM1958 is therefore inhibition of LOC91301 (Accession XM_037564). Accordingly, utilities of VGAM1958 include diagnosis, prevention and treatment of diseases and clinical conditions associated with LOC91301. LOC91355 (Accession XM_037825) is another VGAM1958 host target gene. LOC91355 BINDING SITE is HOST TARGET binding site found in the 5' untranslated region of mRNA encoded by LOC91355, corresponding to a HOST TARGET binding site such as BINDING SITE I, BINDING SITE II or BINDING SITE III. Table 2 illustrates the complementarity of the nucleotide sequences of LOC91355 BINDING SITE, designated SEQ ID:32701, to the nucleotide sequence of VGAM1958 RNA, herein designated VGAM RNA, also designated SEQ ID:4669.

Another function of VGAM1958 is therefore inhibition of LOC91355 (Accession XM_037825). Accordingly, utilities of VGAM1958 include diagnosis, prevention and treatment of diseases and clinical conditions associated with LOC91355. LOC91445 (Accession XM_018516) is another VGAM1958 host target gene. LOC91445 BINDING SITE is HOST TARGET binding site found in the 3' untranslated region of mRNA encoded by LOC91445, corresponding to a HOST TARGET binding site such as BINDING SITE I, BINDING SITE II or BINDING SITE III. Table 2 illustrates the complementarity of the nucleotide sequences of LOC91445 BINDING SITE, designated SEQ ID:30365, to the nucleotide sequence of VGAM1958 RNA, herein designated VGAM RNA, also designated SEQ ID:4669.

Another function of VGAM1958 is therefore inhibition of LOC91445 (Accession XM_018516). Accordingly, utilities of VGAM1958 include diagnosis, prevention and treatment of diseases and clinical conditions associated with LOC91445. LOC91531 (Accession XM_038998) is another VGAM1958 host target gene. LOC91531 BINDING SITE is HOST TARGET binding site found in the 5' untranslated region of mRNA encoded by LOC91531, corresponding to a HOST TARGET binding site such as BINDING SITE I, BINDING SITE II or BINDING SITE III. Table 2 illustrates the complementarity of the nucleotide sequences of LOC91531 BINDING SITE, designated SEQ ID:32972, to the nucleotide sequence of VGAM1958 RNA, herein designated VGAM RNA, also designated SEQ ID:4669.

Another function of VGAM1958 is therefore inhibition of LOC91531 (Accession XM_038998). Accordingly, utilities of VGAM1958 include diagnosis, prevention and treatment of diseases and clinical conditions associated with LOC91531. LOC91632 (Accession XM_039721) is another VGAM1958 host target gene. LOC91632 BINDING SITE is HOST TARGET binding site found in the 5' untranslated region of mRNA encoded by LOC91632, corresponding to a HOST TARGET binding site such as BINDING SITE I, BINDING SITE II or BINDING SITE III. Table 2 illustrates the complementarity of the nucleotide sequences of LOC91632 BINDING SITE, designated SEQ ID:33164, to the nucleotide sequence of VGAM1958 RNA, herein designated VGAM RNA, also designated SEQ ID:4669.

Another function of VGAM1958 is therefore inhibition of LOC91632 (Accession XM_039721). Accordingly, utilities of VGAM1958 include diagnosis, prevention and treatment of diseases and clinical conditions associated with LOC91632. LOC91759 (Accession XM_040467) is another VGAM1958 host target gene. LOC91759 BINDING SITE is HOST TARGET binding site found in the 3' untranslated region of mRNA encoded by LOC91759, corresponding to a HOST TARGET binding site such as BINDING SITE I, BINDING SITE II or BINDING SITE III. Table 2 illustrates the complementarity of the nucleotide sequences of LOC91759 BINDING SITE, designated SEQ ID:33300, to the nucleotide sequence of VGAM1958 RNA, herein designated VGAM RNA, also designated SEQ ID:4669.

Another function of VGAM1958 is therefore inhibition of LOC91759 (Accession XM_040467). Accordingly, utilities of VGAM1958 include diagnosis, prevention and treatment of diseases and clinical conditions associated with LOC91759. LOC91812 (Accession XM_040857) is another VGAM1958 host target gene. LOC91812 BINDING SITE is HOST TARGET binding site found in the 5' untranslated region of mRNA encoded by LOC91812, corresponding to a HOST TARGET binding site such as BINDING SITE I, BINDING SITE II or BINDING SITE III. Table 2 illustrates the complementarity of the nucleotide sequences of LOC91812 BINDING SITE, designated SEQ ID:33391, to the nucleotide sequence of VGAM1958 RNA, herein designated VGAM RNA, also designated SEQ ID:4669.

Another function of VGAM1958 is therefore inhibition of LOC91812 (Accession XM_040857). Accordingly, utilities of VGAM1958 include diagnosis, prevention and treatment of diseases and clinical conditions associated with LOC91812. LOC91813 (Accession XM_040862) is another VGAM1958 host target gene. LOC91813 BINDING SITE1 and LOC91813 BINDING SITE2 are HOST TARGET binding sites found in untranslated regions of mRNA encoded by LOC91813, corresponding to HOST TARGET binding sites such as BINDING SITE I, BINDING SITE II or BINDING SITE III. Table 2 illustrates the complementarity of the nucleotide sequences of LOC91813 BINDING SITE1 and LOC91813 BINDING SITE2, designated SEQ ID:33394 and SEQ ID:33399 respectively, to the nucleotide sequence of VGAM1958 RNA, herein designated VGAM RNA, also designated SEQ ID:4669.

Another function of VGAM1958 is therefore inhibition of LOC91813 (Accession XM_040862). Accordingly, utilities of VGAM1958 include diagnosis, prevention and treatment of diseases and clinical conditions associated with LOC91813. LOC92249 (Accession XM_043814) is another VGAM1958 host target gene. LOC92249 BINDING SITE is HOST TARGET binding site found in the 5' untranslated region of mRNA encoded by LOC92249, corresponding to a HOST TARGET binding site such as BINDING SITE I, BINDING SITE II or BINDING SITE III. Table 2 illustrates the complementarity of the nucleotide sequences of LOC92249 BINDING SITE, designated SEQ ID:34018, to the nucleotide sequence of VGAM1958 RNA, herein designated VGAM RNA, also designated SEQ ID:4669.

Another function of VGAM1958 is therefore inhibition of LOC92249 (Accession XM_043814). Accordingly, utilities of VGAM1958 include diagnosis, prevention and treatment of diseases and clinical conditions associated with LOC92249. LOC92360 (Accession XM_044589) is another VGAM1958 host target gene. LOC92360 BINDING SITE is HOST TARGET binding site found in the 5' untranslated region of mRNA encoded by LOC92360, corresponding to a HOST TARGET binding site such as BINDING SITE I, BINDING SITE II or BINDING SITE III. Table 2 illustrates the complementarity of the nucleotide sequences of LOC92360 BINDING SITE, designated SEQ ID:34240, to the nucleotide sequence of VGAM1958 RNA, herein designated VGAM RNA, also designated SEQ ID:4669.

Another function of VGAM1958 is therefore inhibition of LOC92360 (Accession XM_044589). Accordingly, utilities of VGAM1958 include diagnosis, prevention and treatment of diseases and clinical conditions associated with LOC92360. LOC92492 (Accession XM_045396) is another VGAM1958 host target gene. LOC92492 BINDING SITE is HOST TARGET binding site found in the 5' untranslated region of mRNA encoded by LOC92492, corresponding to a HOST TARGET binding site such as BINDING SITE I, BINDING SITE II or BINDING SITE III. Table 2 illustrates the complementarity of the nucleotide sequences of LOC92492 BINDING SITE, designated SEQ ID:34453, to the nucleotide sequence of VGAM1958 RNA, herein designated VGAM RNA, also designated SEQ ID:4669.

Another function of VGAM1958 is therefore inhibition of LOC92492 (Accession XM_045396). Accordingly, utilities of VGAM1958 include diagnosis, prevention and treatment of diseases and clinical conditions associated with LOC92492. LOC92499 (Accession XM_045450) is another VGAM1958 host target gene. LOC92499 BINDING SITE is HOST TARGET binding site found in the 5' untranslated region of mRNA encoded by LOC92499, corresponding to a HOST TARGET binding site such as BINDING SITE I, BINDING SITE II or BINDING SITE III. Table 2 illustrates the complementarity of the nucleotide sequences of LOC92499 BINDING SITE, designated SEQ ID:34462, to the nucleotide sequence of VGAM1958 RNA, herein designated VGAM RNA, also designated SEQ ID:4669.

Another function of VGAM1958 is therefore inhibition of LOC92499 (Accession XM_045450). Accordingly, utilities of VGAM1958 include diagnosis, prevention and treatment of diseases and clinical conditions associated with LOC92499. LOC92973 (Accession XM_048529) is another VGAM1958 host target gene. LOC92973 BINDING SITE is HOST TARGET binding site found in the 5' untranslated region of mRNA encoded by LOC92973, corresponding to a HOST TARGET binding site such as BINDING SITE I, BINDING SITE II or BINDING SITE III. Table 2 illustrates the complementarity of the nucleotide sequences of LOC92973 BINDING SITE, designated SEQ ID:35186, to the nucleotide sequence of VGAM1958 RNA, herein designated VGAM RNA, also designated SEQ ID:4669.

Another function of VGAM1958 is therefore inhibition of LOC92973 (Accession XM_048529). Accordingly, utilities of VGAM1958 include diagnosis, prevention and treatment of diseases and clinical conditions associated with LOC92973. LOC93017 (Accession XM_048772) is another VGAM1958 host target gene. LOC93017 BINDING SITE is HOST TARGET binding site found in the 3' untranslated region of mRNA encoded by LOC93017, corresponding to a HOST TARGET binding site such as BINDING SITE I, BINDING SITE II or BINDING SITE III. Table 2 illustrates the complementarity of the nucleotide sequences of LOC93017 BINDING SITE, designated SEQ ID:35252, to the nucleotide sequence of VGAM1958 RNA, herein designated VGAM RNA, also designated SEQ ID:4669.

Another function of VGAM1958 is therefore inhibition of LOC93017 (Accession XM_048772). Accordingly, utilities of VGAM1958 include diagnosis, prevention and treatment of diseases and clinical conditions associated with LOC93017. LOC93052 (Accession XM_048905) is another VGAM1958 host target gene. LOC93052 BINDING SITE is HOST TARGET binding site found in the 5' untranslated region of mRNA encoded by LOC93052, corresponding to a HOST TARGET binding site such as BINDING SITE I, BINDING SITE II or BINDING SITE III. Table 2 illustrates the complementarity of the nucleotide sequences of LOC93052 BINDING SITE, designated SEQ ID:35303, to the nucleotide sequence of VGAM1958 RNA, herein designated VGAM RNA, also designated SEQ ID:4669.

Another function of VGAM1958 is therefore inhibition of LOC93052 (Accession XM_048905). Accordingly, utilities of VGAM1958 include diagnosis, prevention and treatment of diseases and clinical conditions associated with LOC93052. LOC93613 (Accession XM_052568) is another VGAM1958 host target gene. LOC93613 BINDING SITE is HOST TARGET binding site found in the 5' untranslated region of mRNA encoded by LOC93613, corresponding to a HOST TARGET binding site such as BINDING SITE I, BINDING SITE II or BINDING SITE III. Table 2 illustrates the complementarity of the nucleotide sequences of LOC93613 BINDING SITE, designated SEQ ID:35996, to the nucleotide sequence of VGAM1958 RNA, herein designated VGAM RNA, also designated SEQ ID:4669.

Another function of VGAM1958 is therefore inhibition of LOC93613 (Accession XM_052568). Accordingly, utilities of VGAM1958 include diagnosis, prevention and treatment of diseases and clinical conditions associated with LOC93613. LOC96597 (Accession XM_039922) is another VGAM1958 host target gene. LOC96597 BINDING SITE is HOST TARGET binding site found in the 3' untranslated region of mRNA encoded by LOC96597, corresponding to a HOST TARGET binding site such as BINDING SITE I, BINDING SITE II or BINDING SITE III. Table 2 illustrates the complementarity of the nucleotide sequences of LOC96597 BINDING SITE, designated SEQ ID:33226, to the nucleotide sequence of VGAM1958 RNA, herein designated VGAM RNA, also designated SEQ ID:4669.

Another function of VGAM1958 is therefore inhibition of LOC96597 (Accession XM_039922). Accordingly, utilities of VGAM1958 include diagnosis, prevention and treatment of diseases and clinical conditions associated with LOC96597. FIG. 1 further provides a conceptual description of a novel bioinformatically detected viral gene of the present invention, referred to here as Viral Genomic Address Messenger 1959 (VGAM1959) viral gene, which modulates expression of respective host target genes thereof, the function and utility of which host target genes is known in the art.

VGAM1959 is a novel bioinformatically detected regulatory, non protein coding, viral micro RNA (miRNA) gene. The method by which VGAM1959 was detected is described hereinabove with reference to FIGS. 1-8.

VGAM1959 gene, herein designated VGAM GENE, is a viral gene contained in the genome of Macaca Mulatta Rhadinovirus. VGAM1959 host target gene, herein designated VGAM HOST TARGET GENE, is a human gene contained in the human genome.

VGAM1959 gene encodes a VGAM1959 precursor RNA, herein designated VGAM PRECURSOR RNA. Similar to other miRNA genes, and unlike most ordinary genes, VGAM1959 precursor RNA does not encode a protein. A nucleotide sequence identical or highly similar to the nucleotide sequence of VGAM1959 precursor RNA is designated SEQ ID:1945, and is provided hereinbelow with reference to the sequence listing part. Nucleotide sequence SEQ ID:1945 is located at position 16300 relative to the genome of Macaca Mulatta Rhadinovirus.

VGAM1959 precursor RNA folds onto itself, forming VGAM1959 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1959 folded precursor RNA into VGAM1959 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1959 RNA is designated SEQ ID:4670, and is provided hereinbelow with reference to the sequence listing part.

VGAM1959 host target gene, herein designated VGAM HOST TARGET GENE, encodes a corresponding messenger RNA, VGAM1959 host target RNA, herein designated VGAM HOST TARGET RNA. VGAM1959 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1959 RNA, herein designated VGAM RNA, binds complementarily to one or more host target binding sites located in untranslated regions of VGAM1959 host target RNA, herein designated VGAM HOST TARGET RNA. This complementary binding is due to the fact that the nucleotide sequence of VGAM1959 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1959 RNA, herein designated VGAM RNA, may have a different number of host target binding sites in untranslated regions of a VGAM1959 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1959 RNA, herein designated VGAM RNA, to host target binding sites on VGAM1959 host target RNA, herein designated VGAM HOST TARGET RNA, such as BINDING SITE I, BINDING SITE II and BINDING SITE III, inhibits translation of VGAM1959 host target RNA into VGAM1959 host target protein, herein designated VGAM HOST TARGET PROTEIN. VGAM host target protein is therefore outlined by a broken line.

It is appreciated that VGAM1959 host target gene, herein designated VGAM HOST TARGET GENE, in fact represents a plurality of VGAM1959 host target genes. The mRNA of each one of this plurality of VGAM1959 host target genes comprises one or more host target binding sites, each having a nucleotide sequence which is at least partly complementary to VGAM1959 RNA, herein designated VGAM RNA, and which when bound by VGAM1959 RNA causes inhibition of translation of respective one or more VGAM1959 host target proteins.

It is further appreciated by one skilled in the art that the mode of translational inhibition illustrated by FIG. 1 with specific reference to translational inhibition exerted by VGAM1959 gene, herein designated VGAM GENE, on one or more VGAM1959 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1959 is inhibition of expression of host target genes, as part of a novel viral mechanism of attacking a host. Accordingly, utilities of VGAM1959 include diagnosis, prevention and treatment of viral infection by Macaca Mulatta Rhadinovirus. Specific functions, and accordingly utilities, of VGAM1959 correlate with, and may be deduced from, the identity of the host target genes which VGAM1959 binds and inhibits, and the function of these host target genes, as elaborated hereinbelow.

Nucleotide sequences of the VGAM1959 precursor RNA, herein designated VGAM PRECURSOR RNA, and of the 'diced' VGAM1959 RNA, herein designated VGAM RNA, and a schematic representation of the secondary folding of VGAM1959 folded precursor RNA, herein designated VGAM FOLDED PRECURSOR RNA, of VGAM1959 are further described hereinbelow with reference to Table 1.

Nucleotide sequences of host target binding sites, such as BINDING SITE-I, BINDING SITE-II and BINDING SITE-III of FIG. 1, found on VGAM1959 host target RNA, and schematic representation of the complementarity of each of these host target binding sites to VGAM1959 RNA, herein designated VGAM RNA, are described hereinbelow with reference to Table 2.

As mentioned hereinabove with reference to FIG. 1, a function of VGAM1959 gene, herein designated VGAM is inhibition of expression of VGAM1959 target genes. It is appreciated that specific functions, and accordingly utilities, of VGAM1959 correlate with, and may be deduced from, the identity of the target genes which VGAM1959 binds and inhibits, and the function of these target genes, as elaborated hereinbelow.

Amiloride-sensitive Cation Channel 2, Neuronal (ACCN2, Accession NM_020039) is a VGAM1959 host target gene. ACCN2 BINDING SITE is HOST TARGET binding site found in the 3' untranslated region of mRNA encoded by ACCN2, corresponding to a HOST TARGET binding site such as BINDING SITE I, BINDING SITE II or BINDING SITE III. Table 2 illustrates the complementarity of the nucleotide sequences of ACCN2 BINDING SITE, designated SEQ ID:21298, to the nucleotide sequence of VGAM1959 RNA, herein designated VGAM RNA, also designated SEQ ID:4670.

A function of VGAM1959 is therefore inhibition of Amiloride-sensitive Cation Channel 2, Neuronal (ACCN2, Accession NM_020039). Accordingly, utilities of VGAM1959 include diagnosis, prevention and treatment of diseases and clinical conditions associated with ACCN2. ACK1 (Accession NM_005781) is another VGAM1959 host target gene. ACK1 BINDING SITE is HOST TARGET binding site found in the 3' untranslated region of mRNA encoded by ACK1, corresponding to a HOST TARGET binding site such as BINDING SITE I, BINDING SITE II or BINDING SITE III. Table 2 illustrates the complementarity of the nucleotide sequences of ACK1 BINDING SITE, designated SEQ ID:12359, to the nucleotide sequence of VGAM1959 RNA, herein designated VGAM RNA, also designated SEQ ID:4670.

Another function of VGAM1959 is therefore inhibition of ACK1 (Accession NM_005781). Accordingly, utilities of VGAM1959 include diagnosis, prevention and treatment of diseases and clinical conditions associated with ACK1. A Disintegrin and Metalloproteinase Domain 19 (meltrin beta) (ADAM19, Accession NM_033274) is another VGAM1959 host target gene. ADAM19 BINDING SITE is HOST TARGET binding site found in the 3' untranslated region of mRNA encoded by ADAM19, corresponding to a HOST TARGET binding site such as BINDING SITE I, BINDING SITE II or BINDING SITE III. Table 2 illustrates the complementarity of the nucleotide sequences of ADAM19 BINDING SITE, designated SEQ ID:27096, to the nucleotide sequence of VGAM1959 RNA, herein designated VGAM RNA, also designated SEQ ID:4670.

Another function of VGAM1959 is therefore inhibition of A Disintegrin and Metalloproteinase Domain 19 (meltrin beta) (ADAM19, Accession NM_033274), a gene which participates in the proteolytic processing of beta-type neuregulin isoforms. Accordingly, utilities of VGAM1959 include diagnosis, prevention and treatment of diseases and clinical conditions associated with ADAM19. The function of ADAM19 and its association with various diseases and clinical conditions, has been established by previous studies, as described hereinabove with reference to VGAM179. A Disintegrin-like and Metalloprotease (reprolysin type) with Thrombospondin Type 1 Motif, 13 (ADAMTS13, Accession NM_139028) is another VGAM1959 host target gene. ADAMTS13 BINDING SITE is HOST TARGET binding site found in the 3' untranslated region of mRNA encoded by ADAMTS13, corresponding to a HOST TARGET binding site such as BINDING SITE I, BINDING SITE II or BINDING SITE III. Table 2 illustrates the complementarity of the nucleotide sequences of ADAMTS13 BINDING SITE, designated SEQ ID:29129, to the nucleotide sequence of VGAM1959 RNA, herein designated VGAM RNA, also designated SEQ ID:4670.

Another function of VGAM1959 is therefore inhibition of A Disintegrin-like and Metalloprotease (reprolysin type) with Thrombospondin Type 1 Motif, 13 (ADAMTS13, Accession NM_139028), a gene which cleaves aggrecan, a cartilage proteoglycan, and may be involved in its turnover. Accordingly, utilities of VGAM1959 include diagnosis, prevention and treatment of diseases and clinical conditions associated with ADAMTS13. The function of ADAMTS13 and its association with various diseases and clinical conditions, has been established by previous studies, as described hereinabove with reference to VGAM131. Adenylate Cyclase 6 (ADCY6, Accession NM_020983) is another VGAM1959 host target gene. ADCY6 BINDING SITE1 and ADCY6 BINDING SITE2 are HOST TARGET binding sites found in untranslated regions of mRNA encoded by ADCY6, corresponding to HOST TARGET binding sites such as BINDING SITE I, BINDING SITE II or BINDING SITE III. Table 2 illustrates the complementarity of the nucleotide sequences of ADCY6 BINDING SITE1 and ADCY6 BINDING SITE2, designated SEQ ID:21978 and SEQ ID:17591 respectively, to the nucleotide sequence of VGAM1959 RNA, herein designated VGAM RNA, also designated SEQ ID:4670.

Another function of VGAM1959 is therefore inhibition of Adenylate Cyclase 6 (ADCY6, Accession NM_020983), a gene which this a membrane-bound, ca (2+)-inhibitable adenylyl cyclase (by similarity). Accordingly, utilities of VGAM1959 include diagnosis, prevention and treatment of diseases and clinical conditions associated with ADCY6. The function of ADCY6 and its association with various diseases and clinical conditions, has been established by previous studies, as described hereinabove with reference to VGAM22. Adducin 2 (beta) (ADD2, Accession NM_017483) is another VGAM1959 host target gene. ADD2 BINDING SITE1 through ADD2 BINDING SITE7 are HOST TARGET binding sites found in untranslated regions of mRNA encoded by ADD2, corresponding to HOST TARGET binding sites such as BINDING SITE I, BINDING SITE II or BINDING SITE III. Table 2 illustrates the complementarity of the nucleotide sequences of ADD2 BINDING SITE1 through ADD2 BINDING SITE7, designated SEQ ID:18936, SEQ ID:18939, SEQ ID:18941, SEQ ID:18944, SEQ ID:18947, SEQ ID:18949 and SEQ ID:6793 respectively, to the nucleotide sequence of VGAM1959 RNA, herein designated VGAM RNA, also designated SEQ ID:4670.

Another function of VGAM1959 is therefore inhibition of Adducin 2 (beta) (ADD2, Accession NM_017483), a gene which membrane-cytoskeleton- protein that promotes the assembly of the spectrin-actin network. Accordingly, utilities of VGAM1959 include diagnosis, prevention and treatment of diseases and clinical conditions associated with ADD2. The function of ADD2 and its association with various diseases and clinical conditions, has been established by previous studies, as described hereinabove with reference to VGAM1185.1-acylglycerol-3-phosphate O-acyltransferase 2 (lysophosphatidic acid acyltransferase, beta) (AGPAT2, Accession XM_038030) is another VGAM1959 host target gene. AGPAT2 BINDING SITE1 and AGPAT2 BINDING SITE2 are HOST TARGET binding sites found in untranslated regions of mRNA encoded by AGPAT2, corresponding to HOST TARGET binding sites such as BINDING SITE I, BINDING SITE II or BINDING SITE III. Table 2 illustrates the complementarity of the nucleotide sequences of AGPAT2 BINDING SITE1 and AGPAT2 BINDING SITE2, designated SEQ ID:32746 and SEQ ID:13119 respectively, to the nucleotide sequence of VGAM1959 RNA, herein designated VGAM RNA, also designated SEQ ID:4670.

Another function of VGAM1959 is therefore inhibition of 1-acylglycerol-3-phosphate O-acyltransferase 2 (lysophosphatidic acid acyltransferase, beta) (AGPAT2, Accession XM_038030). Accordingly, utilities of VGAM1959 include diagnosis, prevention and treatment of diseases and clinical conditions associated with AGPAT2. A Kinase (PRKA) Anchor Protein 1 (AKAP1, Accession NM_003488) is another VGAM1959 host target gene. AKAP1 BINDING SITE is HOST TARGET binding site found in the 5' untranslated region of mRNA encoded by AKAP1, corresponding to a HOST TARGET binding site such as BINDING SITE I, BINDING SITE II or BINDING SITE III. Table 2 illustrates the complementarity of the nucleotide sequences of AKAP1 BINDING SITE, designated SEQ ID:9580, to the nucleotide sequence of VGAM1959 RNA, herein designated VGAM RNA, also designated SEQ ID:4670.

Another function of VGAM1959 is therefore inhibition of A Kinase (PRKA) Anchor Protein 1 (AKAP1, Accession NM_003488), a gene which binds to type i and ii regulatory subunits of protein kinase a. Accordingly, utilities of VGAM1959 include diagnosis, prevention and treatment of diseases and clinical conditions associated with AKAP1. The function of AKAP1 and its association with various diseases and clinical conditions, has been established by previous studies, as described hereinabove with reference to VGAM1392. Anaplastic Lymphoma Kinase (Ki-1) (ALK, Accession XM_055726) is another VGAM1959 host target gene. ALK BINDING SITE is HOST TARGET binding site found in the 5' untranslated region of mRNA encoded by ALK, corresponding to a HOST TARGET binding site such as BINDING SITE I, BINDING SITE II or BINDING SITE III. Table 2 illustrates the complementarity of the nucleotide sequences of ALK BINDING SITE, designated SEQ ID:36320, to the nucleotide sequence of VGAM1959 RNA, herein designated VGAM RNA, also designated SEQ ID:4670.

Another function of VGAM1959 is therefore inhibition of Anaplastic Lymphoma Kinase (Ki-1) (ALK, Accession XM_055726). Accordingly, utilities of VGAM1959 include diagnosis, prevention and treatment of diseases and clinical conditions associated with ALK. Autocrine Motility Factor Receptor (AMFR, Accession NM_138958) is another VGAM1959 host target gene. AMFR BINDING SITE is HOST TARGET binding site found in the 3' untranslated region of mRNA encoded by AMFR, corresponding to a HOST TARGET binding site such as BINDING SITE I, BINDING SITE II or BINDING SITE III. Table 2 illustrates the complementarity of the nucleotide sequences of AMFR BINDING SITE, designated SEQ ID:29065, to the nucleotide sequence of VGAM1959 RNA, herein designated VGAM RNA, also designated SEQ ID:4670.

Another function of VGAM1959 is therefore inhibition of Autocrine Motility Factor Receptor (AMFR, Accession NM_138958), a gene which acts to stimulate migration of fibrosarcoma cells. Accordingly, utilities of VGAM1959 include diagnosis, prevention and treatment of diseases and clinical conditions associated with AMFR. The function of AMFR and its association with various diseases and clinical conditions, has been established by previous studies, as described hereinabove with reference to VGAM440. Ankyrin 1, Erythrocytic (ANK1, Accession NM_020476) is another VGAM1959 host target gene. ANK1 BINDING SITE1 through ANK1 BINDING SITE3 are HOST TARGET binding sites found in untranslated regions of mRNA encoded by ANK1, corresponding to HOST TARGET binding sites such as BINDING SITE I, BINDING SITE II or BINDING SITE III. Table 2 illustrates the complementarity of the nucleotide sequences of ANK1 BINDING SITE1 through ANK1 BINDING SITE3, designated SEQ ID:21731, SEQ ID:30282 and SEQ ID:5478 respectively, to the nucleotide sequence of VGAM1959 RNA, herein designated VGAM RNA, also designated SEQ ID:4670.

Another function of VGAM1959 is therefore inhibition of Ankyrin 1, Erythrocytic (ANK1, Accession NM_020476). Accordingly, utilities of VGAM1959 include diagnosis, prevention and treatment of diseases and clinical conditions associated with ANK1. Apolipoprotein L, 1 (APOL1, Accession NM_003661) is another VGAM1959 host target gene. APOL1 BINDING SITE is HOST TARGET binding site found in the 3' untranslated region of mRNA encoded by APOL1, corresponding to a HOST TARGET binding site such as BINDING SITE I, BINDING SITE II or BINDING SITE III. Table 2 illustrates the complementarity of the nucleotide sequences of APOL1 BINDING SITE, designated SEQ ID:9734, to the nucleotide sequence of VGAM1959 RNA, herein designated VGAM RNA, also designated SEQ ID:4670.

Another function of VGAM1959 is therefore inhibition of Apolipoprotein L, 1 (APOL1, Accession NM_003661), a gene which may participate in reverse cholesterol transport from peripheral cells to the liver. Accordingly, utilities of VGAM1959 include diagnosis, prevention and treatment of diseases and clinical conditions associated with APOL1. The function of APOL1 and its association with various diseases and clinical conditions, has been established by previous studies, as described hereinabove with reference to VGAM235. Rho GTPase Activating Protein 6 (ARHGAP6, Accession NM_001174) is another VGAM1959 host target gene. ARHGAP6 BINDING SITE is HOST TARGET binding site found in the 3' untranslated region of mRNA encoded by ARHGAP6, corresponding to a HOST TARGET binding site such as BINDING SITE I, BINDING SITE II or BINDING SITE III. Table 2 illustrates the complementarity of the nucleotide sequences of ARHGAP6 BINDING SITE, designated SEQ ID:6849, to the nucleotide sequence of VGAM1959 RNA, herein designated VGAM RNA, also designated SEQ ID:4670.

Another function of VGAM1959 is therefore inhibition of Rho GTPase Activating Protein 6 (ARHGAP6, Accession NM_001174), a gene which activates the rho-type GTPases by converting them to an inactive GTP-bound state. Accordingly, utilities of VGAM1959 include diagnosis, prevention and treatment of diseases and clinical conditions associated with ARHGAP6. The function of ARHGAP6 and its association with various diseases and clinical conditions, has been established by previous studies, as described hereinabove with reference to VGAM55. ATPase, Na+/K+ Transporting, Beta 2 Polypeptide (ATP1B2, Accession NM_001678) is another VGAM1959 host target gene. ATP1B2 BINDING SITE is HOST TARGET binding site found in the 3' untranslated region of mRNA encoded by ATP1B2, corresponding to a HOST TARGET binding site such as BINDING SITE I, BINDING SITE II or BINDING SITE III. Table 2 illustrates the complementarity of the nucleotide sequences of ATP1B2 BINDING SITE, designated SEQ ID:7395, to the nucleotide sequence of VGAM1959 RNA, herein designated VGAM RNA, also designated SEQ ID:4670.

Another function of VGAM1959 is therefore inhibition of ATPase, Na+/K+ Transporting, Beta 2 Polypeptide (ATP1B2, Accession NM_001678), a gene which catalyzes the hydrolysis of ATP coupled with the exchange of Na +/K+ ions across the plasma membrane. Accordingly, utilities of VGAM1959 include diagnosis, prevention and treatment of diseases and clinical conditions associated with ATP1B2. The function of ATP1B2 and its association with various diseases and clinical conditions, has been established by previous studies, as described hereinabove with reference to VGAM152. ATPase, Ca++ Transporting, Ubiquitous (ATP2A3, Accession NM_005173) is another VGAM1959 host target gene. ATP2A3 BINDING SITE is HOST TARGET binding site found in the 3' untranslated region of mRNA encoded by ATP2A3, corresponding to a HOST TARGET binding site such as BINDING SITE I, BINDING SITE II or BINDING SITE III. Table 2 illustrates the complementarity of the nucleotide sequences of ATP2A3 BINDING SITE, designated SEQ ID:11674, to the nucleotide sequence of VGAM1959

RNA, herein designated VGAM RNA, also designated SEQ ID:4670.

Another function of VGAM1959 is therefore inhibition of ATPase, Ca++ Transporting, Ubiquitous (ATP2A3, Accession NM_005173). Accordingly, utilities of VGAM1959 include diagnosis, prevention and treatment of diseases and clinical conditions associated with ATP2A3. ATPase, Cu++ Transporting, Beta Polypeptide (Wilson disease) (ATP7B, Accession NM_000053) is another VGAM1959 host target gene. ATP7B BINDING SITE is HOST TARGET binding site found in the 3' untranslated region of mRNA encoded by ATP7B, corresponding to a HOST TARGET binding site such as BINDING SITE I, BINDING SITE II or BINDING SITE III. Table 2 illustrates the complementarity of the nucleotide sequences of ATP7B BINDING SITE, designated SEQ ID:5510, to the nucleotide sequence of VGAM1959 RNA, herein designated VGAM RNA, also designated SEQ ID:4670.

Another function of VGAM1959 is therefore inhibition of ATPase, Cu++ Transporting, Beta Polypeptide (Wilson disease) (ATP7B, Accession NM_000053). Accordingly, utilities of VGAM1959 include diagnosis, prevention and treatment of diseases and clinical conditions associated with ATP7B. ATPase, Class I, Type 8B, Member 2 (ATP8B2, Accession XM_036933) is another VGAM1959 host target gene. ATP8B2 BINDING SITE is HOST TARGET binding site found in the 5' untranslated region of mRNA encoded by ATP8B2, corresponding to a HOST TARGET binding site such as BINDING SITE I, BINDING SITE II or BINDING SITE III. Table 2 illustrates the complementarity of the nucleotide sequences of ATP8B2 BINDING SITE, designated SEQ ID:32512, to the nucleotide sequence of VGAM1959 RNA, herein designated VGAM RNA, also designated SEQ ID:4670.

Another function of VGAM1959 is therefore inhibition of ATPase, Class I, Type 8B, Member 2 (ATP8B2, Accession XM_036933). Accordingly, utilities of VGAM1959 include diagnosis, prevention and treatment of diseases and clinical conditions associated with ATP8B2. B-cell CLL/lymphoma 6 (zinc finger protein 51) (BCL6, Accession NM_001706) is another VGAM1959 host target gene. BCL6 BINDING SITE is HOST TARGET binding site found in the 5' untranslated region of mRNA encoded by BCL6, corresponding to a HOST TARGET binding site such as BINDING SITE I, BINDING SITE II or BINDING SITE III. Table 2 illustrates the complementarity of the nucleotide sequences of BCL6 BINDING SITE, designated SEQ ID:7429, to the nucleotide sequence of VGAM1959 RNA, herein designated VGAM RNA, also designated SEQ ID:4670.

Another function of VGAM1959 is therefore inhibition of B-cell CLL/lymphoma 6 (zinc finger protein 51) (BCL6, Accession NM_001706), a gene which is involved in the generation and maintenance of both T and B cells during immune responses. Accordingly, utilities of VGAM1959 include diagnosis, prevention and treatment of diseases and clinical conditions associated with BCL6. The function of BCL6 and its association with various diseases and clinical conditions, has been established by previous studies, as described hereinabove with reference to VGAM481. B-cell CLL/lymphoma 7A (BCL7A, Accession NM_020993) is another VGAM1959 host target gene. BCL7A BINDING SITE is HOST TARGET binding site found in the 3' untranslated region of mRNA encoded by BCL7A, corresponding to a HOST TARGET binding site such as BINDING SITE I, BINDING SITE II or BINDING SITE III. Table 2 illustrates the complementarity of the nucleotide sequences of BCL7A BINDING SITE, designated SEQ ID:21992, to the nucleotide sequence of VGAM1959 RNA, herein designated VGAM RNA, also designated SEQ ID:4670.

Another function of VGAM1959 is therefore inhibition of B-cell CLL/lymphoma 7A (BCL7A, Accession NM_020993). Accordingly, utilities of VGAM1959 include diagnosis, prevention and treatment of diseases and clinical conditions associated with BCL7A. BCRP2 (Accession XM_031102) is another VGAM1959 host target gene. BCRP2 BINDING SITE is HOST TARGET binding site found in the 3' untranslated region of mRNA encoded by BCRP2, corresponding to a HOST TARGET binding site such as BINDING SITE I, BINDING SITE II or BINDING SITE III. Table 2 illustrates the complementarity of the nucleotide sequences of BCRP2 BINDING SITE, designated SEQ ID:31273, to the nucleotide sequence of VGAM1959 RNA, herein designated VGAM RNA, also designated SEQ ID:4670.

Another function of VGAM1959 is therefore inhibition of BCRP2 (Accession XM_031102). Accordingly, utilities of VGAM1959 include diagnosis, prevention and treatment of diseases and clinical conditions associated with BCRP2. BLAME (Accession NM_020125) is another VGAM1959 host target gene. BLAME BINDING SITE is HOST TARGET binding site found in the 3' untranslated region of mRNA encoded by BLAME, corresponding to a HOST TARGET binding site such as BINDING SITE I, BINDING SITE II or BINDING SITE III. Table 2 illustrates the complementarity of the nucleotide sequences of BLAME BINDING SITE, designated SEQ ID:21308, to the nucleotide sequence of VGAM1959 RNA, herein designated VGAM RNA, also designated SEQ ID:4670.

Another function of VGAM1959 is therefore inhibition of BLAME (Accession NM_020125). Accordingly, utilities of VGAM1959 include diagnosis, prevention and treatment of diseases and clinical conditions associated with BLAME. Basonuclin (BNC, Accession NM_001717) is another VGAM1959 host target gene. BNC BINDING SITE is HOST TARGET binding site found in the 3" untranslated region of mRNA encoded by BNC, corresponding to a HOST TARGET binding site such as BINDING SITE I, BINDING SITE II or BINDING SITE III. Table 2 illustrates the complementarity of the nucleotide sequences of BNC BINDING SITE, designated SEQ ID:7451, to the nucleotide sequence of VGAM1959 RNA, herein designated VGAM RNA, also designated SEQ ID:4670.

Another function of VGAM1959 is therefore inhibition of Basonuclin (BNC, Accession NM_001717), a gene which plays a role in the maintenance of proliferative capacity and prevention of terminal differentiation of keratinocytes. Accordingly, utilities of VGAM1959 include diagnosis, prevention and treatment of diseases and clinical conditions associated with BNC. The function of BNC and its association with various diseases and clinical conditions, has been established by previous studies, as described hereinabove with reference to VGAM1514. BTG Family, Member 2 (BTG2, Accession NM_006763) is another VGAM1959 host target gene. BTG2 BINDING SITE1 and BTG2 BINDING SITE2 are HOST TARGET binding sites found in untranslated regions of mRNA encoded by BTG2, corresponding to HOST TARGET binding sites such as BINDING SITE I, BINDING SITE II or BINDING SITE III. Table 2 illustrates the complementarity of the nucleotide sequences of BTG2 BINDING SITE1 and BTG2 BINDING SITE2, designated SEQ ID:13623 and SEQ ID:13624 respectively, to the nucleotide sequence of VGAM1959 RNA, herein designated VGAM RNA, also designated SEQ ID:4670.

Another function of VGAM1959 is therefore inhibition of BTG Family, Member 2 (BTG2, Accession NM_006763). Accordingly, utilities of VGAM1959 include diagnosis, prevention and treatment of diseases and clinical conditions associated with BTG2. Caspase 10, Apoptosis-related Cysteine Protease (CASP10, Accession NM_032976) is another VGAM1959 host target gene. CASP10 BINDING SITE is HOST TARGET binding site found in the 3' untranslated region of mRNA encoded by CASP10, corresponding to a HOST TARGET binding site such as BINDING SITE I, BINDING SITE II or BINDING SITE III. Table 2 illustrates the complementarity of the nucleotide sequences of CASP10 BINDING SITE, designated SEQ ID:26834, to the nucleotide sequence of VGAM1959 RNA, herein designated VGAM RNA, also designated SEQ ID:4670.

Another function of VGAM1959 is therefore inhibition of Caspase 10, Apoptosis-related Cysteine Protease (CASP10, Accession NM_032976), a gene which is one aspartate-specific cysteine protease and important in death receptor signaling or other cellular processes. Accordingly, utilities of VGAM1959 include diagnosis, prevention and treatment of diseases and clinical conditions associated with CASP10. The function of CASP10 has been established by previous studies. Wang et al. (2001) showed that caspase-10 can function independently of caspase-8 in initiating FAS- and tumor necrosis factor-related apoptosis-inducing ligand-receptor-mediated apoptosis. Moreover, FAS crosslinking in primary human T cells leads to the recruitment and activation of caspase-10. They showed that the death-effector domains of caspases 8 and 10 interact with the death-effector domain of FADD. Nonetheless, they found that caspases 8 and 10 may have different apoptosis substrates and therefore potentially distinct roles in death receptor signaling or other cellular processes. By a candidate gene mutation search strategy, Wang et al. (1999) identified independent missense mutations in the CASP10 gene in 2 kindreds with type II autoimmune lymphoproliferative syndrome (ALPS2; 603909) characterized by abnormal lymphocyte and dendritic cell homeostasis and immune regulatory defects. The mutations (601762.0001 and 601762.0002) resulted in amino acid substitutions that decreased caspase activity and interfered with death receptor-induced apoptosis, particularly that stimulated by Fas ligand (OMIM Ref. No. 134638) and TRAIL (OMIM Ref. No. 603598). These results provided evidence that inherited nonlethal caspase abnormalities cause pleiotropic apoptosis defects underlying autoimmunity in ALPS2. To explore the possibility that mutation in the CASP10 gene might be involved in the development of non-Hodgkin lymphoma (NHL; 605027), Shin et al. (2002) analyzed the entire coding region and all splice sites of the CASP10 gene for the detection of somatic mutations in 117 human NHLs. Seventeen NHLs (14.5%) had CASP10 mutations, of which 3 were identified in the coding regions of the prodomain, 11 in the p17 large protease subunit, and 3 in the p12 small protease subunit. There were 2 frameshift mutations and 1 nonsense mutation; the remaining 14 were missense mutations. Shin et al. (2002) expressed the tumor-derived CASP10 mutants in 293 cells and found that apoptosis was suppressed. These data suggested that the inactivating mutations of the CASP10 gene may lead to the loss of its apoptotic function and contribute to the pathogenesis of some human NHLs.

Full details of the abovementioned studies are described in the following publications, the disclosure of which are hereby incorporated by reference:

Wang, J.; Chun, H. J.; Wong, W.; Spencer, D. M.; Lenardo, M. J.: Caspase-10 is an initiator caspase in death receptor signaling. Proc. Nat. Acad. Sci. 98:13884-13888, 2001; and Wang, J.; Zheng, L.; Lobito, A.; Chan, F. K.; Dale, J.; Sneller, M.; Yao, X.; Puck, J. M.; Straus, S. E.; Lenardo, M. J.: Inherited human caspase 10 mutations underlie defective lympho.

Further studies establishing the function and utilities of CASP10 are found in John Hopkins OMIM database record ID 601762, and in sited publications numbered 7119-6717 listed in the bibliography section hereinbelow, which are also hereby incorporated by reference. Cyclin F (CCNF, Accession NM_001761) is another VGAM1959 host target gene. CCNF BINDING SITE is HOST TARGET binding site found in the 3' untranslated region of mRNA encoded by CCNF, corresponding to a HOST TARGET binding site such as BINDING SITE I, BINDING SITE II or BINDING SITE III. Table 2 illustrates the complementarity of the nucleotide sequences of CCNF BINDING SITE, designated SEQ ID:7526, to the nucleotide sequence of VGAM1959 RNA, herein designated VGAM RNA, also designated SEQ ID:4670.

Another function of VGAM1959 is therefore inhibition of Cyclin F (CCNF, Accession NM_001761), a gene which likely to be involved in the control of the cell cycle during s phase and g2. Accordingly, utilities of VGAM1959 include diagnosis, prevention and treatment of diseases and clinical conditions associated with CCNF. The function of CCNF and its association with various diseases and clinical conditions, has been established by previous studies, as described hereinabove with reference to VGAM367. Cadherin 5, Type 2, VE-cadherin (vascular epithelium) (CDH5, Accession NM_001795) is another VGAM1959 host target gene. CDH5 BINDING SITE is HOST TARGET binding site found in the 3' untranslated region of mRNA encoded by CDH5, corresponding to a HOST TARGET binding site such as BINDING SITE I, BINDING SITE II or BINDING SITE III. Table 2 illustrates the complementarity of the nucleotide sequences of CDH5 BINDING SITE, designated SEQ ID:7549, to the nucleotide sequence of VGAM1959 RNA, herein designated VGAM RNA, also designated SEQ ID:4670.

Another function of VGAM1959 is therefore inhibition of Cadherin 5, Type 2, VE-cadherin (vascular epithelium) (CDH5, Accession NM_001795), a gene which associates with alpha-catenin forming a link to the cytoskeleton. Accordingly, utilities of VGAM1959 include diagnosis, prevention and treatment of diseases and clinical conditions associated with CDH5. The function of CDH5 and its association with various diseases and clinical conditions, has been established by previous studies, as described hereinabove with reference to VGAM1342. Cyclin-dependent Kinase (CDC2-like) 10 (CDK10, Accession NM_052988) is another VGAM1959 host target gene. CDK10 BINDING SITE is HOST TARGET binding site found in the 3' untranslated region of mRNA encoded by CDK10, corresponding to a HOST TARGET binding site such as BINDING SITE I, BINDING SITE II or BINDING SITE III. Table 2 illustrates the complementarity of the nucleotide sequences of CDK10 BINDING SITE, designated SEQ ID:27556, to the nucleotide sequence of VGAM1959 RNA, herein designated VGAM RNA, also designated SEQ ID:4670.

Another function of VGAM1959 is therefore inhibition of Cyclin-dependent Kinase (CDC2-like) 10 (CDK10, Accession NM_052988), a gene which plays a pivotal role in the regulation of the eukaryotic cell cycle. Accordingly, utilities of VGAM1959 include diagnosis, prevention and treatment of diseases and clinical conditions associated with CDK10. The function of CDK10 and its association with various diseases and clinical conditions, has been established by previous studies, as described hereinabove with reference to VGAM193. Cerebellar Degeneration-related Protein 2, 62 kDa (CDR2, Accession XM_071866) is another VGAM1959 host target gene. CDR2 BINDING SITE is HOST TARGET binding site found in the 3' untranslated region of mRNA encoded by CDR2, corresponding to a HOST TARGET binding site such as BINDING SITE I, BINDING SITE II or BINDING SITE III. Table 2 illustrates the complementarity of the nucleotide sequences of CDR2 BINDING SITE, designated SEQ ID:37428, to the nucleotide sequence of VGAM1959 RNA, herein designated VGAM RNA, also designated SEQ ID:4670.

Another function of VGAM1959 is therefore inhibition of Cerebellar Degeneration-related Protein 2, 62 kDa (CDR2, Accession XM_071866), a gene which plays a role in cytokinesis, cell shape, and functions such as secretion and capping. Accordingly, utilities of VGAM1959 include diagnosis, prevention and treatment of diseases and clinical conditions associated with CDR2. The function of CDR2 and its association with various diseases and clinical conditions, has been established by previous studies, as described hereinabove with reference to VGAM128. Carcinoembryonic Antigen-related Cell Adhesion Molecule 1 (biliary glycoprotein) (CEACAM1, Accession NM_001712) is another VGAM1959 host target gene. CEACAM1 BINDING SITE is HOST TARGET binding site found in the 3' untranslated region of mRNA encoded by CEACAM1, corresponding to a HOST TARGET binding site such as BINDING SITE I, BINDING SITE II or BINDING SITE III. Table 2 illustrates the complementarity of the nucleotide sequences of CEACAM1 BINDING SITE, designated SEQ ID:7441, to the nucleotide sequence of VGAM1959 RNA, herein designated VGAM RNA, also designated SEQ ID:4670.

Another function of VGAM1959 is therefore inhibition of Carcinoembryonic Antigen-related Cell Adhesion Molecule 1 (biliary glycoprotein) (CEACAM1, Accession NM_001712), a gene which is a major effector of VEGF and may be a target for the inhibition of tumor angiogenesis. Accordingly, utilities of VGAM1959 include diagnosis, prevention and treatment of diseases and clinical conditions associated with CEACAM1. The function of CEACAM1 and its association with various diseases and clinical conditions, has been established by previous studies, as described hereinabove with reference to VGAM93. Cadherin, EGF LAG Seven-pass G-type Receptor 3 (flamingo homolog, Drosophila) (CELSR3, Accession NM_001407) is another VGAM1959 host target gene. CELSR3 BINDING SITE is HOST TARGET binding site found in the 3' untranslated region of mRNA encoded by CELSR3, corresponding to a HOST TARGET binding site such as BINDING SITE I, BINDING SITE II or BINDING SITE III. Table 2 illustrates the complementarity of the nucleotide sequences of CELSR3 BINDING SITE, designated SEQ ID:7103, to the nucleotide sequence of VGAM1959 RNA, herein designated VGAM RNA, also designated SEQ ID:4670.

Another function of VGAM1959 is therefore inhibition of Cadherin, EGF LAG Seven-pass G-type Receptor 3 (flamingo homolog, Drosophila) (CELSR3, Accession NM_001407), a gene which interacts in a homophilic manner in connecting cells. Accordingly, utilities of VGAM1959 include diagnosis, prevention and treatment of diseases and clinical conditions associated with CELSR3. The function of CELSR3 and its association with various diseases and clinical conditions, has been established by previous studies, as described hereinabove with reference to VGAM893. Centrosomal Protein 2 (CEP2, Accession NM_007186) is another VGAM1959 host target gene. CEP2 BINDING SITE is HOST TARGET binding site found in the 5' untranslated region of mRNA encoded by CEP2, corresponding to a HOST TARGET binding site such as BINDING SITE I, BINDING SITE II or BINDING SITE III. Table 2 illustrates the complementarity of the nucleotide sequences of CEP2 BINDING SITE, designated SEQ ID:14043, to the nucleotide sequence of VGAM1959 RNA, herein designated VGAM RNA, also designated SEQ ID:4670.

Another function of VGAM1959 is therefore inhibition of Centrosomal Protein 2 (CEP2, Accession NM_007186), a gene which interacts with TC10 and CDC42. Accordingly, utilities of VGAM1959 include diagnosis, prevention and treatment of diseases and clinical conditions associated with CEP2. The function of CEP2 and its association with various diseases and clinical conditions, has been established by previous studies, as described hereinabove with reference to VGAM329. Chorionic Gonadotropin, Beta Polypeptide (CGB, Accession NM_000737) is another VGAM1959 host target gene. CGB BINDING SITE is HOST TARGET binding site found in the 5' untranslated region of mRNA encoded by CGB, corresponding to a HOST TARGET binding site such as BINDING SITE I, BINDING SITE II or BINDING SITE III. Table 2 illustrates the complementarity of the nucleotide sequences of CGB BINDING SITE, designated SEQ ID:6394, to the nucleotide sequence of VGAM1959 RNA, herein designated VGAM RNA, also designated SEQ ID:4670.

Another function of VGAM1959 is therefore inhibition of Chorionic Gonadotropin, Beta Polypeptide (CGB, Accession NM_000737), a gene which stimulates the ovaries to synthesize the steroids. Accordingly, utilities of VGAM1959 include diagnosis, prevention and treatment of diseases and clinical conditions associated with CGB. The function of CGB has been established by previous studies. Human chorionic gonadotropin (hCG) is a glycoprotein hormone produced by trophoblastic cells of the placenta beginning 10 to 12 days after conception. Maintenance of the fetus in the first trimester of pregnancy requires the production of hCG, which binds to the corpus luteum of the ovary which is stimulated to produce progesterone which in turn maintains the secretory endometrium. See 118850. Boorstein et al. (1982) concluded that the beta subunit of CG is encoded by at least 8 genes arranged in tandem and inverted pairs. They stated that 'until sequence analysis is complete, we cannot exclude the possibility that the eight genes include some pseudogenes or the related gene, beta-LH.' The beta subunits of luteinizing hormone (LHB) and CG show about 82% amino acid homology. The homology with beta-FSH and beta-TSH is much lower. Policastro et al. (1983, 1986) found 6 nonallelic copies of the CGB gene and a single-copy LHB gene. All were contained in a single 58-kb EcoRI fragment. The hCG beta-subunit is unique in the family of beta-containing glycoprotein hormones in that it contains an extension of 29 amino acids at its COOH end. Amato et al. (2002) reported a patient with a 9-year history of secondary infertility due to an anti-CG autoantibody. Although she had regular menstrual cycles, had conceived spontaneously, and had good hormonal and follicular responses to gonadotropic stimulation regimens during the in vitro fertilization workup, she presented with apparent recurrent pregnancy loss associated with prolonged raised CG levels. She was found to have specific, low-affinity, but high-capacity anti-CG antibody. Crossreaction with recombinant FSH, recombinant LH, CG-alpha, and CG-beta was low. In addition, heat-inactivated serum and the affinity-purified IgG were shown to inhibit the action of CG in an in vitro bioassay. The authors concluded that the persisting titer of the antibody was responsible for the patient's infertility.

Full details of the abovementioned studies are described in the following publications, the disclosure of which are hereby incorporated by reference:

Policastro, P. F.; Daniels-McQueen, S.; Carle, G.; Boime, I.: A map of the hCG-beta-LH-beta gene cluster. J. Biol. Chem. 261:5907-5916, 1986; and Amato, F.; Warnes, G. M.; Kirby, C. A.; Norman, R. J.: Infertility caused by hCG autoantibody. J. Clin. Endocr. Metab. 87:993-997, 2002.

Further studies establishing the function and utilities of CGB are found in John Hopkins OMIM database record ID 118860, and in sited publications numbered 12221, 12289-12294, 10886, 1222 and 12295-12298 listed in the bibliography section hereinbelow, which are also hereby incorporated by reference. CGTHBA (Accession NM_012075) is another VGAM1959 host target gene. CGTHBA BINDING SITE is HOST TARGET binding site found in the 3" untranslated region of mRNA encoded by CGTHBA, corresponding to a HOST TARGET binding site such as BINDING SITE I, BINDING SITE II or BINDING SITE III. Table 2 illustrates the complementarity of the nucleotide sequences of CGTHBA BINDING SITE, designated SEQ ID:14356, to the nucleotide sequence of VGAM1959 RNA, herein designated VGAM RNA, also designated SEQ ID:4670.

Another function of VGAM1959 is therefore inhibition of CGTHBA (Accession NM_012075). Accordingly, utilities of VGAM1959 include diagnosis, prevention and treatment of diseases and clinical conditions associated with CGTHBA. Chromodomain Helicase DNA Binding Protein 2 (CHD2, Accession NM_001271) is another VGAM1959 host target gene. CHD2 BINDING SITE is HOST TARGET binding site found in the 3' untranslated region of mRNA encoded by CHD2, corresponding to a HOST TARGET binding site such as BINDING SITE I, BINDING SITE II or BINDING SITE III. Table 2 illustrates the complementarity of the nucleotide sequences of CHD2 BINDING SITE, designated SEQ ID:6938, to the nucleotide sequence of VGAM1959 RNA, herein designated VGAM RNA, also designated SEQ ID:4670.

Another function of VGAM1959 is therefore inhibition of Chromodomain Helicase DNA Binding Protein 2 (CHD2, Accession NM_001271). Accordingly, utilities of VGAM1959 include diagnosis, prevention and treatment of diseases and clinical conditions associated with CHD2. Cholinergic Receptor, Nicotinic, Epsilon Polypeptide (CHRNE, Accession NM_000080) is another VGAM1959 host target gene. CHRNE BINDING SITE is HOST TARGET binding site found in the 3' untranslated region of mRNA encoded by CHRNE, corresponding to a HOST TARGET binding site such as BINDING SITE I, BINDING SITE II or BINDING SITE III. Table 2 illustrates the complementarity of the nucleotide sequences of CHRNE BINDING SITE, designated SEQ ID:5522, to the nucleotide sequence of VGAM1959 RNA, herein designated VGAM RNA, also designated SEQ ID:4670.

Another function of VGAM1959 is therefore inhibition of Cholinergic Receptor, Nicotinic, Epsilon Polypeptide (CHRNE, Accession NM_000080), a gene which leads to opening of an ion-conducting channel across the plasma membrane. Accordingly, utilities of VGAM1959 include diagnosis, prevention and treatment of diseases and clinical conditions associated with CHRNE. The function of CHRNE has been established by previous studies. Witzemann et al. (1996) noted that in mammalian muscle the functional properties of end-plate channels change during postnatal development. The length of channel-opening bursts decreases and, as a consequence, the duration of miniature end-plate current (mEPC) decreases, whereas the conductance and the Ca (2+) permeability of end-plate channels increase. The underlying molecular mechanism is a switch in the expression of acetylcholine receptor subunit genes shortly after birth. The gamma-subunit (CHRNG) is repressed while the epsilon-subunit gene is activated selectively in the myonuclei underlying the synapse. To investigate the significance of the CHRNG/CHRNE switch for motor behavior, Witzemann et al. (1996) ablated the Chrne gene in mouse embryonic stem (es) cells by homologous recombination and injected correctly engineered cells of 2 independently isolated clones into C57BL/6 blastocysts. Chimeric male mice derived from both clones showed germline transmission of the targeted allele. Homozygous mutant animals showed that after apparently normal development in early neonatal life, neuromuscular transmission was progressively impaired. The lack of epsilon subunits caused muscle weakness, defects in motor behavior, and premature death 2 to 3 months after birth. Their results demonstrated that postnatal incorporation of epsilon subunits in acetylcholine receptors into the end plate is essential for normal development of skeletal muscle. Ohno et al. (1997) found that each of 3 unrelated patients with the congenital myasthenic syndrome (OMIM Ref. No. 601462) were compound heterozygotes (heteroallelic) for a nonsense mutation and a missense mutation. Each nonsense mutation predicted truncation of the epsilon subunit in its extracellular domain, and expression studies in human embryonic kidney fibroblasts (HEK cells) indicated that they were null mutations. Each missense mutation significantly reduced acetylcholine receptor expression; 2 of the missense mutations resulted in kinetic abnormalities of the receptor and 1 was kinetically benign. One patient was an 11-year-old male who had decreased movements in utero, a weak cry and a feeble suck at birth, ptosis of the eyelids beginning at 5 months of age, and ophthalmoparesis beginning at 2 years of age. He always fatigued easily, could never run well, and had difficulty climbing steps. The nonsense mutation in this patient was a 190C-T transition that converted an arginine codon to a TGA stop codon at position 64 (R64X) of the CHRNE gene. The mutated arginine is conserved across epsilon subunits of other species, but not in other subunits. The other mutation in the CHRNE gene was a 440G-T transversion that predicted to result in an R147L amino acid substitution (100725.0005). Since this transversion altered a nucleotide at the end of exon 5, aberrant splicing was sought but not detected. An affected brother had both mutations; the asymptomatic mother had the R64X allele and the asymptomatic father and brother had the R147L allele.

Full details of the abovementioned studies are described in the following publications, the disclosure of which are hereby incorporated by reference:

Ohno, K.; Quiram, P. A.; Milone, M.; Wang, H.-L.; Harper, M. C.; Pruitt, J. N., II; Brengman, J. M.; Pao, L.; Fischbeck, K. H.; Crawford, T. O.; Sine, S. M.; Engel, A. G. : Congenital myasthenic syndromes due to heteroallelic nonsense/missense mutations in the acetylcholine receptor epsilon subunit gene: identification and functional characterization of six new mutations. Hum. Molec. Genet. 6:753-766, 1997; and Witzemann, V.; Schwarz, H.; Koenen, M.; Berberich, C.; Villarroel, A.; Wernig, A.; Brenner, H. R.; Sakmann, B.: Acetylcholine receptor epsilon-subunit deletion causes muscle weakness a.

Further studies establishing the function and utilities of CHRNE are found in John Hopkins OMIM database record ID 100725, and in sited publications numbered 4113-24 and 11575-4119 listed in the bibliography section hereinbelow, which are also hereby incorporated by reference.2',3'-cyclic Nucleotide 3' Phosphodiesterase (CNP, Accession NM_033133) is another VGAM1959 host target gene. CNP BINDING SITE is HOST TARGET binding site found in the 3' untranslated region of mRNA encoded by CNP, corresponding to a HOST TARGET binding site such as BINDING SITE I, BINDING SITE II or BINDING SITE III. Table 2 illustrates the complementarity of the nucleotide sequences of CNP BINDING SITE, designated SEQ ID:26977, to the nucleotide sequence of VGAM1959 RNA, herein designated VGAM RNA, also designated SEQ ID:4670.

Another function of VGAM1959 is therefore inhibition of 2',3'-cyclic Nucleotide 3' Phosphodiesterase (CNP, Accession NM_033133), a gene which can link tubulin to membranes and may regulate cytoplasmic microtubule distribution. Accordingly, utilities of VGAM1959 include diagnosis, prevention and treatment of diseases and clinical conditions associated with CNP. The function of CNP and its association with various diseases and clinical conditions, has been established by previous studies, as described hereinabove with reference to VGAM443. Contactin 2 (axonal) (CNTN2, Accession NM_005076) is another VGAM1959 host target gene. CNTN2 BINDING SITE is HOST TARGET binding site found in the 3' untranslated region of mRNA encoded by CNTN2, corresponding to a HOST TARGET binding site such as BINDING SITE I, BINDING SITE II or BINDING SITE III. Table 2 illustrates the complementarity of the nucleotide sequences of CNTN2 BINDING SITE, designated SEQ ID:11526, to the nucleotide sequence of VGAM1959 RNA, herein designated VGAM RNA, also designated SEQ ID:4670.

Another function of VGAM1959 is therefore inhibition of Contactin 2 (axonal) (CNTN2, Accession NM_005076), a gene which may play a role in axonal growth and cell adhesion. Accordingly, utilities of VGAM1959 include diagnosis, prevention and treatment of diseases and clinical conditions associated with CNTN2. The function of CNTN2 and its association with various diseases and clinical conditions, has been established by previous studies, as described hereinabove with reference to VGAM259. Collagen, Type I, Alpha 1 (COL1A1, Accession NM_000088) is another VGAM1959 host target gene. COL1A1 BINDING SITE is HOST TARGET binding site found in the 3' untranslated region of mRNA encoded by COL1A1, corresponding to a HOST TARGET binding site such as BINDING SITE I, BINDING SITE II or BINDING SITE III. Table 2 illustrates the complementarity of the nucleotide sequences of COL1A1 BINDING SITE, designated SEQ ID:5540, to the nucleotide sequence of VGAM1959 RNA, herein designated VGAM RNA, also designated SEQ ID:4670.

Another function of VGAM1959 is therefore inhibition of Collagen, Type I, Alpha 1 (COL1A1, Accession NM_000088). Accordingly, utilities of VGAM1959 include diagnosis, prevention and treatment of diseases and clinical conditions associated with COL1A1. COX11 Homolog, Cytochrome C Oxidase Assembly Protein (yeast) (COX11, Accession NM_004375) is another VGAM1959 host target gene. COX11 BINDING SITE is HOST TARGET binding site found in the 3' untranslated region of mRNA encoded by COX11, corresponding to a HOST TARGET binding site such as BINDING SITE I, BINDING SITE II or BINDING SITE III. Table 2 illustrates the complementarity of the nucleotide sequences of COX11 BINDING SITE, designated SEQ ID:10594, to the nucleotide sequence of VGAM1959 RNA, herein designated VGAM RNA, also designated SEQ ID:4670.

Another function of VGAM1959 is therefore inhibition of COX11 Homolog, Cytochrome C Oxidase Assembly Protein (yeast) (COX11, Accession NM_004375). Accordingly, utilities of VGAM1959 include diagnosis, prevention and treatment of diseases and clinical conditions associated with COX11. Collapsin Response Mediator Protein 1 (CRMP1, Accession NM_001313) is another VGAM1959 host target gene. CRMP1 BINDING SITE is HOST TARGET binding site found in the 3' untranslated region of mRNA encoded by CRMP1, corresponding to a HOST TARGET binding site such as BINDING SITE I, BINDING SITE II or BINDING SITE III. Table 2 illustrates the complementarity of the nucleotide sequences of CRMP1 BINDING SITE, designated SEQ ID:6999, to the nucleotide sequence of VGAM1959 RNA, herein designated VGAM RNA, also designated SEQ ID:4670.

Another function of VGAM1959 is therefore inhibition of Collapsin Response Mediator Protein 1 (CRMP1, Accession NM_001313), a gene which is a member of dihydropyrimidinase family. Accordingly, utilities of VGAM1959 include diagnosis, prevention and treatment of diseases and clinical conditions associated with CRMP1. The function of CRMP1 and its association with various diseases and clinical conditions, has been established by previous studies, as described hereinabove with reference to VGAM1146. Chemokine (C-X-C motif) Ligand 16 (CXCL16, Accession NM_022059) is another VGAM1959 host target gene. CXCL16 BINDING SITE is HOST TARGET binding site found in the 3' untranslated region of mRNA encoded by CXCL16, corresponding to a HOST TARGET binding site such as BINDING SITE I, BINDING SITE II or BINDING SITE III. Table 2 illustrates the complementarity of the nucleotide sequences of CXCL16 BINDING SITE, designated SEQ ID:22597, to the nucleotide sequence of VGAM1959 RNA, herein designated VGAM RNA, also designated SEQ ID:4670.

Another function of VGAM1959 is therefore inhibition of Chemokine (C-X-C motif) Ligand 16 (CXCL16, Accession NM_022059), a gene which induces calcium mobilization. Accordingly, utilities of VGAM1959 include diagnosis, prevention and treatment of diseases and clinical conditions associated with CXCL16. The function of CXCL16 and its association with various diseases and clinical conditions, has been established by previous studies, as described hereinabove with reference to VGAM1845. Chromosome X Open Reading Frame 6 (CXorf6, Accession NM_005491) is another VGAM1959 host target gene. CXorf6 BINDING SITE is HOST TARGET binding site found in the 3' untranslated region of mRNA encoded by CXorf6, corresponding to a HOST TARGET binding site such as BINDING SITE I, BINDING SITE II or BINDING SITE III. Table 2 illustrates the complementarity of the nucleotide sequences of CXorf6 BINDING SITE, designated SEQ ID:11991, to the nucleotide sequence of VGAM1959 RNA, herein designated VGAM RNA, also designated SEQ ID:4670.

Another function of VGAM1959 is therefore inhibition of Chromosome X Open Reading Frame 6 (CXorf6, Accession NM_005491). Accordingly, utilities of VGAM1959 include diagnosis, prevention and treatment of diseases and clinical conditions associated with CXorf6. Drebrin 1 (DBN1, Accession NM_080881) is another VGAM1959 host target gene. DBN1 BINDING SITE is HOST TARGET binding site found in the 5' untranslated region of mRNA encoded by DBN1, corresponding to a HOST TARGET binding site such as BINDING SITE I, BINDING SITE II or BINDING SITE III. Table 2 illustrates the complementarity of the nucleotide sequences of DBN1 BINDING SITE, designated SEQ ID:28123, to the nucleotide sequence of VGAM1959 RNA, herein designated VGAM RNA, also designated SEQ ID:4670.

Another function of VGAM1959 is therefore inhibition of Drebrin 1 (DBN1, Accession NM_080881). Accordingly, utilities of VGAM1959 include diagnosis, prevention and treatment of diseases and clinical conditions associated with DBN1. Discs, Large (Drosophila) Homolog 5 (DLG5, Accession XM_096398) is another VGAM1959 host target gene. DLG5 BINDING SITE is HOST TARGET binding site found in the 3' untranslated region of mRNA encoded by DLG5, corresponding to a HOST TARGET binding site such as BINDING SITE I, BINDING SITE II or BINDING SITE III. Table 2 illustrates the complementarity of the nucleotide sequences of DLG5 BINDING SITE, designated SEQ ID:40335, to the nucleotide sequence of VGAM1959 RNA, herein designated VGAM RNA, also designated SEQ ID:4670.

Another function of VGAM1959 is therefore inhibition of Discs, Large (Drosophila) Homolog 5 (DLG5, Accession XM_096398), a gene which may transmit extracellular signals to inhibit cell proliferation. Accordingly, utilities of VGAM1959 include diagnosis, prevention and treatment of diseases and clinical conditions associated with DLG5. The function of DLG5 and its association with various diseases and clinical conditions, has been established by previous studies, as described hereinabove with reference to VGAM444. Dystrophin (muscular dystrophy, Duchenne and Becker types) (DMD, Accession NM_004013) is another VGAM1959 host target gene. DMD BINDING SITE1 through DMD BINDING SITE3 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 through DMD BINDING SITE3, designated SEQ ID:10192, SEQ ID:10219 and SEQ ID:10231 respectively, to the nucleotide sequence of VGAM1959 RNA, herein designated VGAM RNA, also designated SEQ ID:4670.

Another function of VGAM1959 is therefore inhibition of Dystrophin (muscular dystrophy, Duchenne and Becker types) (DMD, Accession NM_004013), a gene which muscular dystrophy. Accordingly, utilities of VGAM1959 include diagnosis, prevention and treatment of diseases and clinical conditions associated with DMD. The function of DMD and its association with various diseases and clinical conditions, has been established by previous studies, as described hereinabove with reference to VGAM218. DXS1283E (Accession XM_047871) is another VGAM1959 host target gene. DXS1283E BINDING SITE is HOST TARGET binding site found in the 5' untranslated region of mRNA encoded by DXS1283E, corresponding to a HOST TARGET binding site such as BINDING SITE I, BINDING SITE II or BINDING SITE III. Table 2 illustrates the complementarity of the nucleotide sequences of DXS1283E BINDING SITE, designated SEQ ID:35061, to the nucleotide sequence of VGAM1959 RNA, herein designated VGAM RNA, also designated SEQ ID:4670.

Another function of VGAM1959 is therefore inhibition of DXS1283E (Accession XM_047871). Accordingly, utilities of VGAM1959 include diagnosis, prevention and treatment of diseases and clinical conditions associated with DXS1283E. Ephrin-B1 (EFNB1, Accession NM_004429) is another VGAM1959 host target gene. EFNB1 BINDING SITE1 and EFNB1 BINDING SITE2 are HOST TARGET binding sites found in untranslated regions of mRNA encoded by EFNB1, corresponding to HOST TARGET binding sites such as BINDING SITE I, BINDING SITE II or BINDING SITE III. Table 2 illustrates the complementarity of the nucleotide sequences of EFNB1 BINDING SITE1 and EFNB1 BINDING SITE2, designated SEQ ID:10710 and SEQ ID:10711 respectively, to the nucleotide sequence of VGAM1959 RNA, herein designated VGAM RNA, also designated SEQ ID:4670.

Another function of VGAM1959 is therefore inhibition of Ephrin-B1 (EFNB1, Accession NM_004429), a gene which is a transmembrane ligand of Eph-related receptor tyrosine kinases, has a role in cell adhesion. Accordingly, utilities of VGAM1959 include diagnosis, prevention and treatment of diseases and clinical conditions associated with EFNB1. The function of EFNB1 and its association with various diseases and clinical conditions, has been established by previous studies, as described hereinabove with reference to VGAM390. Egl Nine Homolog 2 (C. elegans) (EGLN2, Accession NM_017555) is another VGAM1959 host target gene. EGLN2 BINDING SITE is HOST TARGET binding site found in the 5' untranslated region of mRNA encoded by EGLN2, corresponding to a HOST TARGET binding site such as BINDING SITE I, BINDING SITE II or BINDING SITE III. Table 2 illustrates the complementarity of the nucleotide sequences of EGLN2 BINDING SITE, designated SEQ ID:18992, to the nucleotide sequence of VGAM1959 RNA, herein designated VGAM RNA, also designated SEQ ID:4670.

Another function of VGAM1959 is therefore inhibition of Egl Nine Homolog 2 (C. elegans) (EGLN2, Accession NM_017555), a gene which is an essential component of the pathway. Accordingly, utilities of VGAM1959 include diagnosis, prevention and treatment of diseases and clinical conditions associated with EGLN2. The function of EGLN2 and its association with various diseases and clinical conditions, has been established by previous studies, as described hereinabove with reference to VGAM432. Enoyl-Coenzyme A, Hydratase/3-hydroxyacyl Coenzyme A Dehydrogenase (EHHADH, Accession NM_001966) is another VGAM1959 host target gene. EHHADH BINDING SITE is HOST TARGET binding site found in the 3' untranslated region of mRNA encoded by EHHADH, corresponding to a HOST TARGET binding site such as BINDING SITE I, BINDING SITE II or BINDING SITE III. Table 2 illustrates the complementarity of the nucleotide sequences of EHHADH BINDING SITE, designated SEQ ID:7695, to the nucleotide sequence of VGAM1959 RNA, herein designated VGAM RNA, also designated SEQ ID:4670.

Another function of VGAM1959 is therefore inhibition of Enoyl-Coenzyme A, Hydratase/3-hydroxyacyl Coenzyme A Dehydrogenase (EHHADH, Accession NM_001966), a gene which functions in the peroxisomal beta-oxidation pathway. Accordingly, utilities of VGAM1959 include diagnosis, prevention and treatment of diseases and clinical conditions associated with EHHADH. The function of EHHADH has been established by previous studies. Hoefler et al. (1994) reported the full-length cDNA sequence of the enoyl-CoA-hydratase:3-hydroxyacyl-CoA dehydrogenase bifunctional enzyme. The cDNA sequence spans 3,779 nucleotides with an open reading frame of 2,169 nucleotides. Animal model experiments lend further support to the function of EHHADH. Qi et al. (1999) generated Lpb null mice. Mutant mice were viable and fertile and exhibited no detectable gross phenotypic defects. The only defect was a blunting of peroxisome proliferative response upon challenge with a peroxisome proliferator. The absence of appreciable changes in lipid metabolism indicated that enoyl-CoAs, generated in the classical system in Lpb null mice, were diverted to the D-hydroxy-specific system for metabolism by Dpb (OMIM Ref. No. 601860).

It is appreciated that the abovementioned animal model for EHHADH is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hoefler, G.; Forstner, M.; McGuinness, M. C.; Hulla, W.; Hiden, M.; Krisper, P.; Kenner, L.; Ried, T.; Lengauer, C.; Zechner, R.; mOser, H. W.; Chen, G. L.: cDNA cloning of the human peroxisomal enoyl-CoA hydratase:3-hydroxyacyl-CoA dehydrogenase bifunctional enzyme and localization to chromosome 3q26.3-3q28: a free left Alu arm is inserted in the 3-prime noncoding region. Genomics 19:60-67, 1994; and Qi, C.; Zhu, Y.; Pan, J.; Usuda, N.; Maeda, N.; Yeldandi, A. V.; Rao, M. S.; Hashimoto, T.; Reddy, J. K.: Absence of spontaneous peroxisome proliferation in enoyl-CoA hydratase/L-3-hyd.

Further studies establishing the function and utilities of EHHADH are found in John Hopkins OMIM database record ID 607037, and in sited publications numbered 5170 listed in the bibliography section hereinbelow, which are also hereby incorporated by reference. ELAV (embryonic lethal, abnormal vision, Drosophila)-like 3 (Hu antigen C) (ELAVL3, Accession NM_001420) is another VGAM1959 host target gene. ELAVL3 BINDING SITE is HOST TARGET binding site found in the 3' untranslated region of mRNA encoded by ELAVL3, corresponding to a HOST TARGET binding site such as BINDING SITE I, BINDING SITE II or BINDING SITE III. Table 2 illustrates the complementarity of the nucleotide sequences of ELAVL3 BINDING SITE, designated SEQ ID:7119, to the nucleotide sequence of VGAM1959 RNA, herein designated VGAM RNA, also designated SEQ ID:4670.

Another function of VGAM1959 is therefore inhibition of ELAV (embryonic lethal, abnormal vision, Drosophila)-like 3 (Hu antigen C) (ELAVL3, Accession NM_001420), a gene which arises when an immune response to systemic tumors expressing neuronal proteins develops into an autoimmune neuronal degeneration. Accordingly, utilities of VGAM1959 include diagnosis, prevention and treatment of diseases and clinical conditions associated with ELAVL3. The function of ELAVL3 and its association with various diseases and clinical conditions, has been established by previous studies, as described hereinabove with reference to VGAM883. Endonuclease G (ENDOG, Accession NM_004435) is another VGAM1959 host target gene. ENDOG BINDING SITE is HOST TARGET binding site found in the 5' untranslated region of mRNA encoded by ENDOG, corresponding to a HOST TARGET binding site such as BINDING SITE I, BINDING SITE II or BINDING SITE III. Table 2 illustrates the complementarity of the nucleotide sequences of ENDOG BINDING SITE, designated SEQ ID:10720, to the nucleotide sequence of VGAM1959 RNA, herein designated VGAM RNA, also designated SEQ ID:4670.

Another function of VGAM1959 is therefore inhibition of Endonuclease G (ENDOG, Accession NM_004435), a gene which cleaves double and single stranded dna. also has ribonuclease (rnase) and rnase h activities. capable of generating the rna primers required to initiate replication of mitochondrial dna. Accordingly, utilities of VGAM1959 include diagnosis, prevention and treatment of diseases and clinical conditions associated with ENDOG. The function of ENDOG has been established by previous studies. Tiranti et al. (1995) mapped 3 human housekeeping genes involved in mitochondrial biogenesis. One of these was the gene encoding a mitochondrion-specific endonuclease, designated ENDOG, that preferentially cleaves DNA stretches rich in C and G residues. The authors hypothesized that this endonuclease could play a role in the maturation of RNA complementary stretches serving as primers for mtDNA replication, in the splicing process of polycistronic transcripts, or in mtDNA repair. By PCR-based screening of a somatic cell hybrid panel and by fluorescence in situ hybridization, Tiranti et al. (1995) assigned the ENDOG locus to 9q34.1. Li et al. (2001) identified endoG as the nuclease specifically activated by apoptotic stimuli and able to induce nucleosomal fragmentation of DNA in fibroblast cells from embryonic mice lacking DFF45 (OMIM Ref. No. 601882). EndoG is a mitochondrion-specific nuclease that translocates to the nucleus during apoptosis. Once released from mitochondria, endoG cleaves chromatin DNA into nucleosomal fragments independently of caspases (see OMIM Ref. No. 147678). Therefore, ENDOG represents a caspase-independent apoptotic pathway initiated from the mitochondria. In C. elegans, Parrish et al. (2001) found that reduction of activity of cps6, a homolog of ENDOG, affected normal DNA degradation and resulted in delayed appearance of cell corpses during development. This observation provided in vivo evidence that the DNA degradation process is important for proper progression of apoptosis. Parrish et al. (2001) stated that CPS6 is the first mitochondrial protein identified to be involved in programmed cell death in C. elegans, underscoring the conserved and important role of mitochondria in the execution of apoptosis Full details of the abovementioned studies are described in the following publications, the disclosure of which are hereby incorporated by reference:

Li, L. Y.; Luo, X.; Wang, X.: Endonuclease G is an apoptotic DNase when released from mitochondria. Nature 412: 95-99, 2001; and Parrish, J.; Li, L.; Klotz, K.; Ledwich, D.; Wang, X.; Xue, D.: Mitochondrial endonuclease G is important for apoptosis in C. elegans. Nature 412:90-94, 2001.

Further studies establishing the function and utilities of ENDOG are found in John Hopkins OMIM database record ID 600440, and in sited publications numbered 7707-770 and 7706 listed in the bibliography section hereinbelow, which are also hereby incorporated by reference. Epidermal Growth Factor Receptor Pathway Substrate 15 (EPS15, Accession NM_001981) is another VGAM1959 host target gene. EPS15 BINDING SITE is HOST TARGET binding site found in the 3' untranslated region of mRNA encoded by EPS15, corresponding to a HOST TARGET binding site such as BINDING SITE I, BINDING SITE II or BINDING SITE III. Table 2 illustrates the complementarity of the nucleotide sequences of EPS15 BINDING SITE, designated SEQ ID:7712, to the nucleotide sequence of VGAM1959 RNA, herein designated VGAM RNA, also designated SEQ ID:4670.

Another function of VGAM1959 is therefore inhibition of Epidermal Growth Factor Receptor Pathway Substrate 15 (EPS15, Accession NM_001981), a gene which involved in cell growth regulation. Accordingly, utilities of VGAM1959 include diagnosis, prevention and treatment of diseases and clinical conditions associated with EPS15. The function of EPS15 has been established by previous studies. Fazioli et al. (1993) developed an expression cloning approach which, applied to the study of epidermal growth factor receptor (EGFR)-activated signaling, yielded a number of murine cDNA clones, referred to as eps (for egfr-pathway-substrate) clones. One of these clones, eps15, encoded a protein of 140 to 150 kD which was phosphorylated on tyrosine following activation of the EGFR (OMIM Ref. No. 131550) and platelet-derived growth factor receptor (PDGFR; 173410). Phosphorylation of eps15 appeared relatively receptor-specific since the erbB-2 receptor (OMIM Ref. No. 164870), which is highly related to EGFR, was not able to phosphorylate it efficiently. Wong et al. (1994) cloned the human homolog and mapped the EPS15 gene to 1p32-p31 by analysis of human/rodent hybrids retaining various segments of human chromosome 1. The region of assignment is one involved in deletion in neuroblastoma, translocations in acute lymphoblastic leukemia, and a fragile site. Most of the translocations affecting the chromosome band 11q23 in human acute leukemias involve a restricted area of the HRX gene, also known as MLL for myeloid/lymphoid, or mixed-lineage leukemia (OMIM Ref. No. 159555). Other partners in the fused gene created by the translocation include AF4 (OMIM Ref. No. 159557) on chromosome 4, AF9 (OMIM Ref. No. 159558) on chromosome 9, and ENL (OMIM Ref. No. 159556) on chromosome 19. Indeed, at least 15 different chromosomal partners have been involved with MLL (also known as ALL1) in leukemia-producing translocations. In 2 myeloid leukemias, the derivative chromosome 11 expressed the 1368 N-terminal amino acids MLL fused to almost all the AF1P product. The predicted wildtype AF1P product was a 98-kD acidic protein that exhibited no similarity to AF4, AF9, and ENL gene products. It was highly similar to the murine EPS15 gene product. Bernard et al. (1994) characterized 2 t (1;11)(p32; q11) translocations that fused the MML gene to a novel gene, tentatively designated AF1P, on 1p32. Their AF1P is clearly the same gene as EPS15.

Full details of the abovementioned studies are described in the following publications, the disclosure of which are hereby incorporated by reference:

Fazioli, F.; Minichiello, L.; Matoska, V.; Castagnino, P.; Miki, T.; Wong, W. T.; Di Fiore, P. P.: Eps8, a substrate for the epidermal growth factor receptor kinase, enhances EGF-dependent mitogenic signals. EMBO J. 12:3799-3808, 1993; and Bernard, O. A.; Mauchauffe, M.; Mecucci, C.; Van Den Berghe, H.; Berger, R.: A novel gene, AF-1p, fused to HRX in t (1;11)(p32; q23), is not related to AF-4, AF-9 nor ENL. Oncogene 9:103.

Further studies establishing the function and utilities of EPS15 are found in John Hopkins OMIM database record ID 600051, and in sited publications numbered 7726-7730 listed in the bibliography section hereinbelow, which are also hereby incorporated by reference. Ets Variant Gene 5 (ets-related molecule) (ETV5, Accession NM_004454) is another VGAM1959 host target gene. ETV5 BINDING SITE is HOST TARGET binding site found in the 3' untranslated region of mRNA encoded by ETV5, corresponding to a HOST TARGET binding site such as BINDING SITE I, BINDING SITE II or BINDING SITE III. Table 2 illustrates the complementarity of the nucleotide sequences of ETV5 BINDING SITE, designated SEQ ID:10750, to the nucleotide sequence of VGAM1959 RNA, herein designated VGAM RNA, also designated SEQ ID:4670.

Another function of VGAM1959 is therefore inhibition of Ets Variant Gene 5 (ets-related molecule) (ETV5, Accession NM_004454), a gene which DNA binding protein of the Ets oncoprotein family. Accordingly, utilities of VGAM1959 include diagnosis, prevention and treatment of diseases and clinical conditions associated with ETV5. The function of ETV5 and its association with various diseases and clinical conditions, has been established by previous studies, as described hereinabove with reference to VGAM1171. Ellis Van Creveld Syndrome (EVC, Accession NM_014556) is another VGAM1959 host target gene. EVC BINDING SITE is HOST TARGET binding site found in the 3' untranslated region of mRNA encoded by EVC, corresponding to a HOST TARGET binding site such as BINDING SITE I, BINDING SITE II or BINDING SITE III. Table 2 illustrates the complementarity of the nucleotide sequences of EVC BINDING SITE, designated SEQ ID:15896, to the nucleotide sequence of VGAM1959 RNA, herein designated VGAM RNA, also designated SEQ ID:4670.

Another function of VGAM1959 is therefore inhibition of Ellis Van Creveld Syndrome (EVC, Accession NM_014556). Accordingly, utilities of VGAM1959 include diagnosis, prevention and treatment of diseases and clinical conditions associated with EVC. Exostoses (multiple) 1 (EXT1, Accession NM_000127) is another VGAM1959 host target gene. EXT1 BINDING SITE is HOST TARGET binding site found in the 5' untranslated region of mRNA encoded by EXT1, corresponding to a HOST TARGET binding site such as BINDING SITE I, BINDING SITE II or BINDING SITE III. Table 2 illustrates the complementarity of the nucleotide sequences of EXT1 BINDING SITE, designated SEQ ID:5603, to the nucleotide sequence of VGAM1959 RNA, herein designated VGAM RNA, also designated SEQ ID:4670.

Another function of VGAM1959 is therefore inhibition of Exostoses (multiple) 1 (EXT1, Accession NM_000127). Accordingly, utilities of VGAM1959 include diagnosis, prevention and treatment of diseases and clinical conditions associated with EXT1. Enhancer of Zeste Homolog 1 (Drosophila) (EZH1, Accession NM_001991) is another VGAM1959 host target gene. EZH1 BINDING SITE is HOST TARGET binding site found in the 3' untranslated region of mRNA encoded by EZH1, corresponding to a HOST TARGET binding site such as BINDING SITE I, BINDING SITE II or BINDING SITE III. Table 2 illustrates the complementarity of the nucleotide sequences of EZH1 BINDING SITE, designated SEQ ID:7718, to the nucleotide sequence of VGAM1959 RNA, herein designated VGAM RNA, also designated SEQ ID:4670.

Another function of VGAM1959 is therefore inhibition of Enhancer of Zeste Homolog 1 (Drosophila) (EZH1, Accession NM_001991), a gene which may act in transcriptional regulation and heterochromatin maintenance. Accordingly, utilities of VGAM1959 include diagnosis, prevention and treatment of diseases and clinical conditions associated with EZH1. The function of EZH1 and its association with various diseases and clinical conditions, has been established by previous studies, as described hereinabove with reference to VGAM251. Fanconi Anemia, Complementation Group F (FANCF, Accession NM_022725) is another VGAM1959 host target gene. FANCF BINDING SITE is HOST TARGET binding site found in the 3' untranslated region of mRNA encoded by FANCF, corresponding to a HOST TARGET binding site such as BINDING SITE I, BINDING SITE II or BINDING SITE III. Table 2 illustrates the complementarity of the nucleotide sequences of FANCF BINDING SITE, designated SEQ ID:22921, to the nucleotide sequence of VGAM1959 RNA, herein designated VGAM RNA, also designated SEQ ID:4670.

Another function of VGAM1959 is therefore inhibition of Fanconi Anemia, Complementation Group F (FANCF, Accession NM_022725). Accordingly, utilities of VGAM1959 include diagnosis, prevention and treatment of diseases and clinical conditions associated with FANCF. Fatty Acid Synthase (FASN, Accession NM_004104) is another VGAM1959 host target gene. FASN BINDING SITE is HOST TARGET binding site found in the 3' untranslated region of mRNA encoded by FASN, corresponding to a HOST TARGET binding site such as BINDING SITE I, BINDING SITE II or BINDING SITE III. Table 2 illustrates the complementarity of the nucleotide sequences of FASN BINDING SITE, designated SEQ ID:10316, to the nucleotide sequence of VGAM1959 RNA, herein designated VGAM RNA, also designated SEQ ID:4670.

Another function of VGAM1959 is therefore inhibition of Fatty Acid Synthase (FASN, Accession NM_004104), a gene which catalyzes the formation of long-chain fatty acids from acetyl-coa, malonyl-coa and nadph. Accordingly, utilities of VGAM1959 include diagnosis, prevention and treatment of diseases and clinical conditions associated with FASN. The function of FASN and its association with various diseases and clinical conditions, has been established by previous studies, as described hereinabove with reference to VGAM477. Fibroblast Growth Factor 23 (FGF23, Accession NM_020638) is another VGAM1959 host target gene. FGF23 BINDING SITE is HOST TARGET binding site found in the 3' untranslated region of mRNA encoded by FGF23, corresponding to a HOST TARGET binding site such as BINDING SITE I, BINDING SITE II or BINDING SITE III. Table 2 illustrates the complementarity of the nucleotide sequences of FGF23 BINDING SITE, designated SEQ ID:21792, to the nucleotide sequence of VGAM1959 RNA, herein designated VGAM RNA, also designated SEQ ID:4670.

Another function of VGAM1959 is therefore inhibition of Fibroblast Growth Factor 23 (FGF23, Accession NM_020638), a gene which a member of the fibroblast growth factor family. Accordingly, utilities of VGAM1959 include diagnosis, prevention and treatment of diseases and clinical conditions associated with FGF23. The function of FGF23 and its association with various diseases and clinical conditions, has been established by previous studies, as described hereinabove with reference to VGAM24. Filamin B, Beta (actin binding protein 278) (FLNB, Accession XM_030806) is another VGAM1959 host target gene. FLNB BINDING SITE1 and FLNB BINDING SITE2 are HOST TARGET binding sites found in untranslated regions of mRNA encoded by FLNB, corresponding to HOST TARGET binding sites such as BINDING SITE I, BINDING SITE II or BINDING SITE III. Table 2 illustrates the complementarity of the nucleotide sequences of FLNB BINDING SITE1 and FLNB BINDING SITE2, designated SEQ ID:31140 and SEQ ID:31141 respectively, to the nucleotide sequence of VGAM1959 RNA, herein designated VGAM RNA, also designated SEQ ID:4670.

Another function of VGAM1959 is therefore inhibition of Filamin B, Beta (actin binding protein 278) (FLNB, Accession XM_030806), a gene which Filamin B, beta; binds actin, interacts with cytoplasmic domain of Ibalpha. Accordingly, utilities of VGAM1959 include diagnosis, prevention and treatment of diseases and clinical conditions associated with FLNB. The function of FLNB and its association with various diseases and clinical conditions, has been established by previous studies, as described hereinabove with reference to VGAM416. Follistatin-like 3 (secreted glycoprotein) (FSTL3, Accession NM_005860) is another VGAM1959 host target gene. FSTL3 BINDING SITE is HOST TARGET binding site found in the 3' untranslated region of mRNA encoded by FSTL3, corresponding to a HOST TARGET binding site such as BINDING SITE I, BINDING SITE II or BINDING SITE III. Table 2 illustrates the complementarity of the nucleotide sequences of FSTL3 BINDING SITE, designated SEQ ID:12468, to the nucleotide sequence of VGAM1959 RNA, herein designated VGAM RNA, also designated SEQ ID:4670.

Another function of VGAM1959 is therefore inhibition of Follistatin-like 3 (secreted glycoprotein) (FSTL3, Accession NM_005860), a gene which is a member of the follistatin-module-protein family. Accordingly, utilities of VGAM1959 include diagnosis, prevention and treatment of diseases and clinical conditions associated with FSTL3. The function of FSTL3 and its association with various diseases and clinical conditions, has been established by previous studies, as described hereinabove with reference to VGAM200. FXYD Domain Containing Ion Transport Regulator 6 (FXYD6, Accession NM_022003) is another VGAM1959 host target gene. FXYD6 BINDING SITE is HOST TARGET binding site found in the 3' untranslated region of mRNA encoded by FXYD6, corresponding to a HOST TARGET binding site such as BINDING SITE I, BINDING SITE II or BINDING SITE III. Table 2 illustrates the complementarity of the nucleotide sequences of FXYD6 BINDING SITE, designated SEQ ID:22553, to the nucleotide sequence of VGAM1959 RNA, herein designated VGAM RNA, also designated SEQ ID:4670.

Another function of VGAM1959 is therefore inhibition of FXYD Domain Containing Ion Transport Regulator 6 (FXYD6, Accession NM_022003). Accordingly, utilities of VGAM1959 include diagnosis, prevention and treatment of diseases and clinical conditions associated with FXYD6. Giant Axonal Neuropathy (gigaxonin) (GAN, Accession NM_022041) is another VGAM1959 host target gene. GAN BINDING SITE is HOST TARGET binding site found in the 3' untranslated region of mRNA encoded by GAN, corresponding to a HOST TARGET binding site such as BINDING SITE I, BINDING SITE II or BINDING SITE III. Table 2 illustrates the complementarity of the nucleotide sequences of GAN BINDING SITE, designated SEQ ID:22566, to the nucleotide sequence of VGAM1959 RNA, herein designated VGAM RNA, also designated SEQ ID:4670.

Another function of VGAM1959 is therefore inhibition of Giant Axonal Neuropathy (gigaxonin) (GAN, Accession NM_022041), a gene which plays an important role in neurofilament architecture. Accordingly, utilities of VGAM1959 include diagnosis, prevention and treatment of diseases and clinical conditions associated with GAN. The function of GAN and its association with various diseases and clinical conditions, has been established by previous studies, as described hereinabove with reference to VGAM606. GATA Binding Protein 2 (GATA2, Accession NM_002050) is another VGAM1959 host target gene. GATA2 BINDING SITE1 and GATA2 BINDING SITE2 are HOST TARGET binding sites found in untranslated regions of mRNA encoded by GATA2, corresponding to HOST TARGET binding sites such as BINDING SITE I, BINDING SITE II or BINDING SITE III. Table 2 illustrates the complementarity of the nucleotide sequences of GATA2 BINDING SITE1 and GATA2 BINDING SITE2, designated SEQ ID:7803 and SEQ ID:7807 respectively, to the nucleotide sequence of VGAM1959 RNA, herein designated VGAM RNA, also designated SEQ ID:4670.

Another function of VGAM1959 is therefore inhibition of GATA Binding Protein 2 (GATA2, Accession NM_002050). Accordingly, utilities of VGAM1959 include diagnosis, prevention and treatment of diseases and clinical conditions associated with GATA2. Glyoxalase I (GLO1, Accession NM_006708) is another VGAM1959 host target gene. GLO1 BINDING SITE is HOST TARGET binding site found in the 3' untranslated region of mRNA encoded by GLO1, corresponding to a HOST TARGET binding site such as BIND- ING SITE I, BINDING SITE II or BINDING SITE III. Table 2 illustrates the complementarity of the nucleotide sequences of GLO1 BINDING SITE, designated SEQ ID:13528, to the nucleotide sequence of VGAM1959 RNA, herein designated VGAM RNA, also designated SEQ ID:4670.

Another function of VGAM1959 is therefore inhibition of Glyoxalase I (GLO1, Accession NM_006708), a gene which converts methylglyoxal and glutathione to S-lactoylglutathione. Accordingly, utilities of VGAM1959 include diagnosis, prevention and treatment of diseases and clinical conditions associated with GLO1. The function of GLO1 and its association with various diseases and clinical conditions, has been established by previous studies, as described hereinabove with reference to VGAM786. Guanine Nucleotide Binding Protein (G protein), Alpha Inhibiting Activity Polypeptide 3 (GNAI3, Accession NM_006496) is another VGAM1959 host target gene. GNAI3 BINDING SITE is HOST TARGET binding site found in the 3' untranslated region of mRNA encoded by GNAI3, corresponding to a HOST TARGET binding site such as BINDING SITE I, BINDING SITE II or BINDING SITE III. Table 2 illustrates the complementarity of the nucleotide sequences of GNAI3 BINDING SITE, designated SEQ ID:13242, to the nucleotide sequence of VGAM1959 RNA, herein designated VGAM RNA, also designated SEQ ID:4670.

Another function of VGAM1959 is therefore inhibition of Guanine Nucleotide Binding Protein (G protein), Alpha Inhibiting Activity Polypeptide 3 (GNAI3, Accession NM_006496), a gene which stimulates receptor regulated K+-channels. Accordingly, utilities of VGAM1959 include diagnosis, prevention and treatment of diseases and clinical conditions associated with GNAI3. The function of GNAI3 and its association with various diseases and clinical conditions, has been established by previous studies, as described hereinabove with reference to VGAM45. G Protein-coupled Receptor 44 (GPR44, Accession NM_004778) is another VGAM1959 host target gene. GPR44 BINDING SITE is HOST TARGET binding site found in the 3' untranslated region of mRNA encoded by GPR44, corresponding to a HOST TARGET binding site such as BINDING SITE I, BINDING SITE II or BINDING SITE III. Table 2 illustrates the complementarity of the nucleotide sequences of GPR44 BINDING SITE, designated SEQ ID:11176, to the nucleotide sequence of VGAM1959 RNA, herein designated VGAM RNA, also designated SEQ ID:4670.

Another function of VGAM1959 is therefore inhibition of G Protein-coupled Receptor 44 (GPR44, Accession NM_004778), a gene which mediates signals to the interior of the cell via activation of heterotrimeric G proteins. Accordingly, utilities of VGAM1959 include diagnosis, prevention and treatment of diseases and clinical conditions associated with GPR44. The function of GPR44 and its association with various diseases and clinical conditions, has been established by previous studies, as described hereinabove with reference to VGAM1669. G Protein-coupled Receptor Kinase 7 (GPRK7, Accession NM_139209) is another VGAM1959 host target gene. GPRK7 BINDING SITE1 and GPRK7 BINDING SITE2 are HOST TARGET binding sites found in untranslated regions of mRNA encoded by GPRK7, corresponding to HOST TARGET binding sites such as BINDING SITE I, BINDING SITE II or BINDING SITE III. Table 2 illustrates the complementarity of the nucleotide sequences of GPRK7 BINDING SITE1 and GPRK7 BINDING SITE2, designated SEQ ID:29227 and SEQ ID:29230 respectively, to the nucleotide sequence of VGAM1959 RNA, herein designated VGAM RNA, also designated SEQ ID:4670.

Another function of VGAM1959 is therefore inhibition of G Protein-coupled Receptor Kinase 7 (GPRK7, Accession NM_139209), a gene which may play a role in signal transduction pathways that involve calcium as a second messenger. Accordingly, utilities of VGAM1959 include diagnosis, prevention and treatment of diseases and clinical conditions associated with GPRK7. The function of GPRK7 and its association with various diseases and clinical conditions, has been established by previous studies, as described hereinabove with reference to VGAM640. Histone Deacetylase 4 (HDAC4, Accession NM_006037) is another VGAM1959 host target gene. HDAC4 BINDING SITE is HOST TARGET binding site found in the 3' untranslated region of mRNA encoded by HDAC4, corresponding to a HOST TARGET binding site such as BINDING SITE I, BINDING SITE II or BINDING SITE III. Table 2 illustrates the complementarity of the nucleotide sequences of HDAC4 BINDING SITE, designated SEQ ID:12661, to the nucleotide sequence of VGAM1959 RNA, herein designated VGAM RNA, also designated SEQ ID:4670.

Another function of VGAM1959 is therefore inhibition of Histone Deacetylase 4 (HDAC4, Accession NM_006037), a gene which is responsible for the deacetylation of lysine residues on the n-terminal part of the core histones and may mediate transcriptional regulation. Accordingly, utilities of VGAM1959 include diagnosis, prevention and treatment of diseases and clinical conditions associated with HDAC4. The function of HDAC4 and its association with various diseases and clinical conditions, has been established by previous studies, as described hereinabove with reference to VGAM264. Histone Deacetylase 7A (HDAC7A, Accession NM_015401) is another VGAM1959 host target gene. HDAC7A BINDING SITE1 and HDAC7A BINDING SITE2 are HOST TARGET binding sites found in untranslated regions of mRNA encoded by HDAC7A, corresponding to HOST TARGET binding sites such as BINDING SITE I, BINDING SITE II or BINDING SITE III. Table 2 illustrates the complementarity of the nucleotide sequences of HDAC7A BINDING SITE1 and HDAC7A BINDING SITE2, designated SEQ ID:17714 and SEQ ID:18684 respectively, to the nucleotide sequence of VGAM1959 RNA, herein designated VGAM RNA, also designated SEQ ID:4670.

Another function of VGAM1959 is therefore inhibition of Histone Deacetylase 7A (HDAC7A, Accession NM_015401). Accordingly, utilities of VGAM1959 include diagnosis, prevention and treatment of diseases and clinical conditions associated with HDAC7A. Interferon (alpha, beta and omega) Receptor 2 (IFNAR2, Accession NM_000874) is another VGAM1959 host target gene. IFNAR2 BINDING SITE is HOST TARGET binding site found in the 3' untranslated region of mRNA encoded by IFNAR2, corresponding to a HOST TARGET binding site such as BINDING SITE I, BINDING SITE II or BINDING SITE III. Table 2 illustrates the complementarity of the nucleotide sequences of IFNAR2 BINDING SITE, designated SEQ ID:6555, to the nucleotide sequence of VGAM1959 RNA, herein designated VGAM RNA, also designated SEQ ID:4670.

Another function of VGAM1959 is therefore inhibition of Interferon (alpha, beta and omega) Receptor 2 (IFNAR2, Accession NM_000874), a gene which is a receptor for interferons alpha and beta. Accordingly, utilities of VGAM1959 include diagnosis, prevention and treatment of diseases and clinical conditions associated with IFNAR2. The function of IFNAR2 and its association with various diseases and clinical conditions, has been established by previous studies, as described hereinabove with reference to VGAM487. Insulin-like Growth Factor Binding Protein 5 (IGFBP5, Accession NM_000599) is another VGAM1959 host target gene. IGFBP5 BINDING SITE is HOST TARGET binding site found in the 5' untranslated region of mRNA encoded by IGFBP5, corresponding to a HOST TARGET binding site such as BINDING SITE I, BINDING SITE II or BINDING SITE III. Table 2 illustrates the complementarity of the nucleotide sequences of IGFBP5 BINDING SITE, designated SEQ ID:6203, to the nucleotide sequence of VGAM1959 RNA, herein designated VGAM RNA, also designated SEQ ID:4670.

Another function of VGAM1959 is therefore inhibition of Insulin-like Growth Factor Binding Protein 5 (IGFBP5, Accession NM_000599), a gene which either inhibits or stimulates the growth promoting effects of the igfs on cell culture. Accordingly, utilities of VGAM1959 include diagnosis, prevention and treatment of diseases and clinical conditions associated with IGFBP5. The function of IGFBP5 and its association with various diseases and clinical conditions, has been established by previous studies, as described hereinabove with reference to VGAM1233. Interleukin 2 Receptor, Beta (IL2RB, Accession NM_000878) is another VGAM1959 host target gene. IL2RB BINDING SITE1 and IL2RB BINDING SITE2 are HOST TARGET binding sites found in untranslated regions of mRNA encoded by IL2RB, corresponding to HOST TARGET binding sites such as BINDING SITE I, BINDING SITE II or BINDING SITE III. Table 2 illustrates the complementarity of the nucleotide sequences of IL2RB BINDING SITE1 and IL2RB BINDING SITE2, designated SEQ ID:6571 and SEQ ID:6572 respectively, to the nucleotide sequence of VGAM1959 RNA, herein designated VGAM RNA, also designated SEQ ID:4670.

Another function of VGAM1959 is therefore inhibition of Interleukin 2 Receptor, Beta (IL2RB, Accession NM_000878), a gene which is involved in receptor mediated endocytosis and transduces the mitogenic signals of il-2. Accordingly, utilities of VGAM1959 include diagnosis, prevention and treatment of diseases and clinical conditions associated with IL2RB. The function of IL2RB and its association with various diseases and clinical conditions, has been established by previous studies, as described hereinabove with reference to VGAM450. IRTA1 (Accession NM_031282) is another VGAM1959 host target gene. IRTA1 BINDING SITE is HOST TARGET binding site found in the 3' untranslated region of mRNA encoded by IRTA1, corresponding to a HOST TARGET binding site such as BINDING SITE I, BINDING SITE II or BINDING SITE III. Table 2 illustrates the complementarity of the nucleotide sequences of IRTA1 BINDING SITE, designated SEQ ID:25305, to the nucleotide sequence of VGAM1959 RNA, herein designated VGAM RNA, also designated SEQ ID:4670.

Another function of VGAM1959 is therefore inhibition of IRTA1 (Accession NM_031282). Accordingly, utilities of VGAM1959 include diagnosis, prevention and treatment of diseases and clinical conditions associated with IRTA1. Immunoglobulin Superfamily Containing Leucine-rich Repeat (ISLR, Accession NM_005545) is another VGAM1959 host target gene. ISLR BINDING SITE is HOST TARGET binding site found in the 3' untranslated region of mRNA encoded by ISLR, corresponding to a HOST TARGET binding site such as BINDING SITE I, BINDING SITE II or BINDING SITE III. Table 2 illustrates the complementarity of the nucleotide sequences of ISLR BINDING SITE, designated SEQ ID:12073, to the nucleotide sequence of VGAM1959 RNA, herein designated VGAM RNA, also designated SEQ ID:4670.

Another function of VGAM1959 is therefore inhibition of Immunoglobulin Superfamily Containing Leucine-rich Repeat (ISLR, Accession NM_005545). Accordingly, utilities of VGAM1959 include diagnosis, prevention and treatment of diseases and clinical conditions associated with ISLR. IL2-inducible T-cell Kinase (ITK, Accession NM_005546) is another VGAM1959 host target gene. ITK BINDING SITE is HOST TARGET binding site found in the 3" untranslated region of mRNA encoded by ITK, corresponding to a HOST TARGET binding site such as BINDING SITE I, BINDING SITE II or BINDING SITE III. Table 2 illustrates the complementarity of the nucleotide sequences of ITK BINDING SITE, designated SEQ ID:12075, to the nucleotide sequence of VGAM1959 RNA, herein designated VGAM RNA, also designated SEQ ID:4670.

Another function of VGAM1959 is therefore inhibition of IL2-inducible T-cell Kinase (ITK, Accession NM_005546), a gene which plays a role in t cell proliferation and differentiation. Accordingly, utilities of VGAM1959 include diagnosis, prevention and treatment of diseases and clinical conditions associated with ITK. The function of ITK and its association with various diseases and clinical conditions, has been established by previous studies, as described hereinabove with reference to VGAM288. Inositol 1,4,5-triphosphate Receptor, Type 3 (ITPR3, Accession NM_002224) is another VGAM1959 host target gene. ITPR3 BINDING SITE is HOST TARGET binding site found in the 3' untranslated region of mRNA encoded by ITPR3, corresponding to a HOST TARGET binding site such as BINDING SITE I, BINDING SITE II or BINDING SITE III. Table 2 illustrates the complementarity of the nucleotide sequences of ITPR3 BINDING SITE, designated SEQ ID:8001, to the nucleotide sequence of VGAM1959 RNA, herein designated VGAM RNA, also designated SEQ ID:4670.

Another function of VGAM1959 is therefore inhibition of Inositol 1,4,5-triphosphate Receptor, Type 3 (ITPR3, Accession NM_002224), a gene which may be responsible for calcium release from intracellular stores. Accordingly, utilities of VGAM1959 include diagnosis, prevention and treatment of diseases and clinical conditions associated with ITPR3. The function of ITPR3 and its association with various diseases and clinical conditions, has been established by previous studies, as described hereinabove with reference to VGAM310. Intersectin 1 (SH3 domain protein) (ITSN1, Accession NM_003024) is another VGAM1959 host target gene. ITSN1 BINDING SITE is HOST TARGET binding site found in the 3' untranslated region of mRNA encoded by ITSN1, corresponding to a HOST TARGET binding site such as BINDING SITE I, BINDING SITE II or BINDING SITE III. Table 2 illustrates the complementarity of the nucleotide sequences of ITSN1 BINDING SITE, designated SEQ ID:8958, to the nucleotide sequence of VGAM1959 RNA, herein designated VGAM RNA, also designated SEQ ID:4670.

Another function of VGAM1959 is therefore inhibition of Intersectin 1 (SH3 domain protein) (ITSN1, Accession NM_003024), a gene which may be involved in endocytosis and synaptic vesicle recycling. Accordingly, utilities of VGAM1959 include diagnosis, prevention and treatment of diseases and clinical conditions associated with ITSN1. The function of ITSN1 and its association with various diseases and clinical conditions, has been established by previous studies, as described hereinabove with reference to VGAM1233. Potassium Inwardly-rectifying Channel, Subfamily J, Member 10 (KCNJ10, Accession NM_002241) is another VGAM1959 host target gene. KCNJ10 BINDING SITE is HOST TARGET binding site found in the 3' untranslated region of mRNA encoded by KCNJ10, corresponding to a HOST TARGET binding site such as BINDING SITE I, BINDING SITE II or BINDING SITE III. Table 2 illustrates the complementarity of the nucleotide sequences of KCNJ10 BINDING SITE, designated SEQ ID:8026, to the nucleotide sequence of VGAM1959 RNA, herein designated VGAM RNA, also designated SEQ ID:4670.

Another function of VGAM1959 is therefore inhibition of Potassium Inwardly-rectifying Channel, Subfamily J, Member 10 (KCNJ10, Accession NM_002241), a gene which may be responsible for potassium buffering action of glial cells in the brain. Accordingly, utilities of VGAM1959 include diagnosis, prevention and treatment of diseases and clinical conditions associated with KCNJ10. The function of KCNJ10 and its association with various diseases and clinical conditions, has been established by previous studies, as described hereinabove with reference to VGAM167. Potassium Channel, Subfamily K, Member 1 (KCNK1, Accession NM_002245) is another VGAM1959 host target gene. KCNK1 BINDING SITE is HOST TARGET binding site found in the 5' untranslated region of mRNA encoded by KCNK1, corresponding to a HOST TARGET binding site such as BINDING SITE I, BINDING SITE II or BINDING SITE III. Table 2 illustrates the complementarity of the nucleotide sequences of KCNK1 BINDING SITE, designated SEQ ID:8033, to the nucleotide sequence of VGAM1959 RNA, herein designated VGAM RNA, also designated SEQ ID:4670.

Another function of VGAM1959 is therefore inhibition of Potassium Channel, Subfamily K, Member 1 (KCNK1, Accession NM_002245), a gene which is an inward rectifying potassium channel. Accordingly, utilities of VGAM1959 include diagnosis, prevention and treatment of diseases and clinical conditions associated with KCNK1. The function of KCNK1 has been established by previous studies. Potassium channels are functionally important to a large number of cellular processes including maintenance of the action potential, muscle contraction, hormone secretion, osmotic regulation, and ion flow. Lesage et al. (1996) cloned a member of a new class of potassium channels by computer identification of an EST with predicted sequence similarity to the P domain (a region involved in the potassium conduction pathway) of previously known channels. A cDNA, designated TWIK1 by the authors, was obtained from a human kidney library and shown to encode a predicted 336-amino acid protein. Unlike other potassium channels, TWIK1 has 4 (rather than 6) transmembrane domains and 2 (rather than 1) P domains. Two genes from C. elegans are related. When expressed in Xenopus oocytes, TWIK1 is able to direct expression of weakly inward-rectifying potassium currents. Northern blots showed that the gene is transcribed in a large number of tissues but is especially highly expressed in the brain and heart. The authors speculated that TWIK1 channels may be involved in the control of background potassium membrane conductances. Lesage et al. (1996) mapped the gene by in situ hybridization to 1q42-q43.

Full details of the abovementioned studies are described in the following publications, the disclosure of which are hereby incorporated by reference:

Lesage, F.; Guillemare, E.; Fink, M.; Duprat, F.; Lazdunski, M.; Romey, G.; Barhanin, J.: TWIK-1, a ubiquitous human weakly inward rectifying K+ channel with a novel structure. EMBO J. 15:1004-1011, 1996; and Lesage, F.; Mattei, M.-G.; Fink, M.; Barhanin, J.; Lazdunski, M.: Assignment of the human weak inward rectifier K+ channel TWIK-1 gene to chromosome 1q42-q43. Genomics 34:153-155, 1996.

Further studies establishing the function and utilities of KCNK1 are found in John Hopkins OMIM database record ID 601745, and in sited publications numbered 6203-6204 listed in the bibliography section hereinbelow, which are also hereby incorporated by reference. Potassium Channel, Subfamily K, Member 5 (KCNK5, Accession NM_003740) is another VGAM1959 host target gene. KCNK5 BINDING SITE is HOST TARGET binding site found in the 3' untranslated region of mRNA encoded by KCNK5, corresponding to a HOST TARGET binding site such as BINDING SITE I, BINDING SITE II or BINDING SITE III. Table 2 illustrates the complementarity of the nucleotide sequences of KCNK5 BINDING SITE, designated SEQ ID:9829, to the nucleotide sequence of VGAM1959 RNA, herein designated VGAM RNA, also designated SEQ ID:4670.

Another function of VGAM1959 is therefore inhibition of Potassium Channel, Subfamily K, Member 5 (KCNK5, Accession NM_003740). Accordingly, utilities of VGAM1959 include diagnosis, prevention and treatment of diseases and clinical conditions associated with KCNK5. Potassium Voltage-gated Channel, Delayed-rectifier, Subfamily S, Member 2 (KCNS2, Accession XM_043106) is another VGAM1959 host target gene. KCNS2 BINDING SITE is HOST TARGET binding site found in the 3' untranslated region of mRNA encoded by KCNS2, corresponding to a HOST TARGET binding site such as BINDING SITE I, BINDING SITE II or BINDING SITE III. Table 2 illustrates the complementarity of the nucleotide sequences of KCNS2 BINDING SITE, designated SEQ ID:33901, to the nucleotide sequence of VGAM1959 RNA, herein designated VGAM RNA, also designated SEQ ID:4670.

Another function of VGAM1959 is therefore inhibition of Potassium Voltage-gated Channel, Delayed-rectifier, Subfamily S, Member 2 (KCNS2, Accession XM_043106), a gene which mediates the voltage-dependent potassium ion permeability of excitable membranes. Accordingly, utilities of VGAM1959 include diagnosis, prevention and treatment of diseases and clinical conditions associated with KCNS2. The function of KCNS2 and its association with various diseases and clinical conditions, has been established by previous studies, as described hereinabove with reference to VGAM419. Kinase Insert Domain Receptor (a type III receptor tyrosine kinase) (KDR, Accession NM_002253) is another VGAM1959 host target gene. KDR BINDING SITE is HOST TARGET binding site found in the 3' untranslated region of mRNA encoded by KDR, corresponding to a HOST TARGET binding site such as BINDING SITE I, BINDING SITE II or BINDING SITE III. Table 2 illustrates the complementarity of the nucleotide sequences of KDR BINDING SITE, designated SEQ ID:8053, to the nucleotide sequence of VGAM1959 RNA, herein designated VGAM RNA, also designated SEQ ID:4670.

Another function of VGAM1959 is therefore inhibition of Kinase Insert Domain Receptor (a type III receptor tyrosine kinase) (KDR, Accession NM_002253). Accordingly, utilities of VGAM1959 include diagnosis, prevention and treatment of diseases and clinical conditions associated with KDR. KIAA0857 (Accession XM_039552) is another VGAM1959 host target gene. KIAA0857 BINDING SITE is HOST TARGET binding site found in the 3' untranslated region of mRNA encoded by KIAA0857, corresponding to a HOST TARGET binding site such as BINDING SITE I, BINDING SITE II or BINDING SITE III. Table 2 illustrates the complementarity of the nucleotide sequences of KIAA0857 BINDING SITE, designated SEQ ID:33121, to the nucleotide sequence of VGAM1959 RNA, herein designated VGAM RNA, also designated SEQ ID:4670.

Another function of VGAM1959 is therefore inhibition of KIAA0857 (Accession XM_039552), a gene which is involved in cytoskeletal organization and cellular growth. Accordingly, utilities of VGAM1959 include diagnosis, prevention and treatment of diseases and clinical conditions associated with KIAA0857. The function of KIAA0857 and its association with various diseases and clinical conditions, has been established by previous studies, as described hereinabove with reference to VGAM548. Kinesin Family Member 5C (KIF5C, Accession NM_004522) is another VGAM1959 host target gene. KIF5C BINDING SITE is HOST TARGET binding site found in the 3' untranslated region of mRNA encoded by KIF5C, corresponding to a HOST TARGET binding site such as BINDING SITE I, BINDING SITE II or BINDING SITE III. Table 2 illustrates the complementarity of the nucleotide sequences of KIF5C BINDING SITE, designated SEQ ID:10854, to the nucleotide sequence of VGAM1959 RNA, herein designated VGAM RNA, also designated SEQ ID:4670.

Another function of VGAM1959 is therefore inhibition of Kinesin Family Member 5C (KIF5C, Accession NM_004522). Accordingly, utilities of VGAM1959 include diagnosis, prevention and treatment of diseases and clinical conditions associated with KIF5C. Kinesin Family Member C3 (KIFC3, Accession NM_005550) is another VGAM1959 host target gene. KIFC3 BINDING SITE is HOST TARGET binding site found in the 5' untranslated region of mRNA encoded by KIFC3, corresponding to a HOST TARGET binding site such as BINDING SITE I, BINDING SITE II or BINDING SITE III. Table 2 illustrates the complementarity of the nucleotide sequences of KIFC3 BINDING SITE, designated SEQ ID:12081, to the nucleotide sequence of VGAM1959 RNA, herein designated VGAM RNA, also designated SEQ ID:4670.

Another function of VGAM1959 is therefore inhibition of Kinesin Family Member C3 (KIFC3, Accession NM_005550), a gene which may function in intracellular transport and mitosis. Accordingly, utilities of VGAM1959 include diagnosis, prevention and treatment of diseases and clinical conditions associated with KIFC3. The function of KIFC3 and its association with various diseases and clinical conditions, has been established by previous studies, as described hereinabove with reference to VGAM1006. Laminin, Gamma 1 (formerly LAMB2) (LAMC1, Accession NM_002293) is another VGAM1959 host target gene. LAMC1 BINDING SITE is HOST TARGET binding site found in the 3' untranslated region of mRNA encoded by LAMC1, corresponding to a HOST TARGET binding site such as BINDING SITE I, BINDING SITE II or BINDING SITE III. Table 2 illustrates the complementarity of the nucleotide sequences of LAMC1 BINDING SITE, designated SEQ ID:8078, to the nucleotide sequence of VGAM1959 RNA, herein designated VGAM RNA, also designated SEQ ID:4670.

Another function of VGAM1959 is therefore inhibition of Laminin, Gamma 1 (formerly LAMB2) (LAMC1, Accession NM_002293), a gene which may mediate the attachment, migration, and organization of cells into tissues. Accordingly, utilities of VGAM1959 include diagnosis, prevention and treatment of diseases and clinical conditions associated with LAMC1. The function of LAMC1 and its association with various diseases and clinical conditions, has been established by previous studies, as described hereinabove with reference to VGAM812. Lamin B Receptor (LBR, Accession XM_001795) is another VGAM1959 host target gene. LBR BINDING SITE is HOST TARGET binding site found in the 3" untranslated region of mRNA encoded by LBR, corresponding to a HOST TARGET binding site such as BINDING SITE I, BINDING SITE II or BINDING SITE III. Table 2 illustrates the complementarity of the nucleotide sequences of LBR BINDING SITE, designated SEQ ID:29854, to the nucleotide sequence of VGAM1959 RNA, herein designated VGAM RNA, also designated SEQ ID:4670.

Another function of VGAM1959 is therefore inhibition of Lamin B Receptor (LBR, Accession XM_001795). Accordingly, utilities of VGAM1959 include diagnosis, prevention and treatment of diseases and clinical conditions associated with LBR. Lunatic Fringe Homolog (Drosophila) (LFNG, Accession XM_166539) is another VGAM1959 host target gene. LFNG BINDING SITE is HOST TARGET binding site found in the 3' untranslated region of mRNA encoded by LFNG, corresponding to a HOST TARGET binding site such as BINDING SITE I, BINDING SITE II or BINDING SITE III. Table 2 illustrates the complementarity of the nucleotide sequences of LFNG BINDING SITE, designated SEQ ID:44509, to the nucleotide sequence of VGAM1959 RNA, herein designated VGAM RNA, also designated SEQ ID:4670.

Another function of VGAM1959 is therefore inhibition of Lunatic Fringe Homolog (Drosophila) (LFNG, Accession XM_166539). Accordingly, utilities of VGAM1959 include diagnosis, prevention and treatment of diseases and clinical conditions associated with LFNG. Leukemia Inhibitory Factor (cholinergic differentiation factor) (LIF, Accession NM_002309) is another VGAM1959 host target gene. LIF BINDING SITE is HOST TARGET binding site found in the 3' untranslated region of mRNA encoded by LIF, corresponding to a HOST TARGET binding site such as BINDING SITE I, BINDING SITE II or BINDING SITE III. Table 2 illustrates the complementarity of the nucleotide sequences of LIF BINDING SITE, designated SEQ ID:8095, to the nucleotide sequence of VGAM1959 RNA, herein designated VGAM RNA, also designated SEQ ID:4670.

Another function of VGAM1959 is therefore inhibition of Leukemia Inhibitory Factor (cholinergic differentiation factor) (LIF, Accession NM_002309). Accordingly, utilities of VGAM1959 include diagnosis, prevention and treatment of diseases and clinical conditions associated with LIF. Leukemia Inhibitory Factor Receptor (LIFR, Accession NM_002310) is another VGAM1959 host target gene. LIFR BINDING SITE1 and LIFR BINDING SITE2 are HOST TARGET binding sites found in untranslated regions of mRNA encoded by LIFR, corresponding to HOST TARGET binding sites such as BINDING SITE I, BINDING SITE II or BINDING SITE III. Table 2 illustrates the complementarity of the nucleotide sequences of LIFR BINDING SITE1 and LIFR BINDING SITE2, designated SEQ ID:8104 and SEQ ID:8106 respectively, to the nucleotide sequence of VGAM1959 RNA, herein designated VGAM RNA, also designated SEQ ID:4670.

Another function of VGAM1959 is therefore inhibition of Leukemia Inhibitory Factor Receptor (LIFR, Accession NM_002310). Accordingly, utilities of VGAM1959 include diagnosis, prevention and treatment of diseases and clinical conditions associated with LIFR. Lymphotoxin Beta (TNF superfamily, member 3) (LTB, Accession NM_009588) is another VGAM1959 host target gene. LTB BINDING SITE is HOST TARGET binding site found in the 3' untranslated region of mRNA encoded by LTB, corresponding to a HOST TARGET binding site such as BINDING SITE I, BINDING SITE II or BINDING SITE III. Table 2 illustrates the complementarity of the nucleotide sequences of LTB BINDING SITE, designated SEQ ID:14315, to the nucleotide sequence of VGAM1959 RNA, herein designated VGAM RNA, also designated SEQ ID:4670.

Another function of VGAM1959 is therefore inhibition of Lymphotoxin Beta (TNF superfamily, member 3) (LTB, Accession NM_009588). Accordingly, utilities of VGAM1959 include diagnosis, prevention and treatment of diseases and clinical conditions associated with LTB. Mannose-6-phosphate Receptor (cation dependent) (M6PR, Accession NM_002355) is another VGAM1959 host target gene. M6PR BINDING SITE is HOST TARGET binding site found in the 5' untranslated region of mRNA encoded by M6PR, corresponding to a HOST TARGET binding site such as BINDING SITE I, BINDING SITE II or BINDING SITE III. Table 2 illustrates the complementarity of the nucleotide sequences of M6PR BINDING SITE, designated SEQ ID:8164, to the nucleotide sequence of VGAM1959 RNA, herein designated VGAM RNA, also designated SEQ ID:4670.

Another function of VGAM1959 is therefore inhibition of Mannose-6-phosphate Receptor (cation dependent) (M6PR, Accession NM_002355), a gene which is nvolved in intracellular sorting and transport of acid hydrolases. Accordingly, utilities of VGAM1959 include diagnosis, prevention and treatment of diseases and clinical conditions associated with M6PR. The function of M6PR and its association with various diseases and clinical conditions, has been established by previous studies, as described hereinabove with reference to VGAM1924. MAD, Mothers Against Decapentaplegic Homolog 5 (Drosophila) (MADH5, Accession NM_005903) is another VGAM1959 host target gene. MADH5 BINDING SITE is HOST TARGET binding site found in the 5' untranslated region of mRNA encoded by MADH5, corresponding to a HOST TARGET binding site such as BINDING SITE I, BINDING SITE II or BINDING SITE III. Table 2 illustrates the complementarity of the nucleotide sequences of MADH5 BINDING SITE, designated SEQ ID:12523, to the nucleotide sequence of VGAM1959 RNA, herein designated VGAM RNA, also designated SEQ ID:4670.

Another function of VGAM1959 is therefore inhibition of MAD, Mothers Against Decapentaplegic Homolog 5 (Drosophila) (MADH5, Accession NM_005903), a gene which is a transcriptional modulator activated by bmp (bone morphogenetic proteins) type 1 receptor kinase. smad5 is a receptor-regulated smad (r-smad). Accordingly, utilities of VGAM1959 include diagnosis, prevention and treatment of diseases and clinical conditions associated with MADH5. The function of MADH5 has been established by previous studies. Gemma et al. (1998) determined the full-length cDNA sequence of human MADH5, which they called SMAD5. Comparison of the cDNA sequence with the SMAD5 genomic sequence, obtained from YAC clones, showed that the SMAD5 gene has 8 exons, with the coding sequence contained in exons 3 to 8. By 5-prime RACE, the authors identified a SMAD5 cDNA derived from an alternatively spliced transcript that lacks the 75-bp exon 2. Using PCR-SSCP analysis to investigate the frequency of SMAD5 somatic mutations in human cancers, Gemma et al. (1998) did not detect either homozygous deletions or point mutations in 40 primary gastric tumors or 51 cell lines derived from diverse types of cancer, including 20 cell lines resistant to the growth inhibitory effects of TGF-beta. The SMAD5 protein has strong homology with SMAD1 (OMIM Ref. No. 601595), SMAD2 (OMIM Ref. No. 601366), SMAD3 (OMIM Ref. No. 603109), and SMAD4 (OMIM Ref. No. 600993) in the N- and C-terminal domains, which are separated by a proline-rich sequence; SMAD5 shows the greatest homology to SMAD1. Bruno et al. (1998) showed that SMAD5 plays a critical role in the signaling pathway by which TGF-beta inhibits the proliferation of human hematopoietic progenitor cells.

Full details of the abovementioned studies are described in the following publications, the disclosure of which are hereby incorporated by reference:

Bruno, E.; Horrigan, S. K.; Van Den Berg, D.; Rozler, E.; Fitting, P. R.; Moss, S. T.; Westbrook, C.; Hoffman, R.: The Smad5 gene is involved in the intracellular signaling pathways that mediate the inhibitory effects of transforming growth factor-beta on human hematopoiesis. Blood 91:1917-1923, 1998; and Riggins, G. J.; Thiagalingam, S.; Rozenblum, E.; Weinstein, C. L.; Kern, S. E.; Hamilton, S. R.; Willson, J. K. V.; Markowitz, S. D.; Kinzler, K. W.; Vogelstein, B.: Mad-related genes in t.

Further studies establishing the function and utilities of MADH5 are found in John Hopkins OMIM database record ID 603110, and in sited publications numbered 8582-858 and 6480 listed in the bibliography section hereinbelow, which are also hereby incorporated by reference. Mastermind-like 1 (Drosophila) (MAML1, Accession NM_014757) is another VGAM1959 host target gene. MAML1 BINDING SITE is HOST TARGET binding site found in the 3' untranslated region of mRNA encoded by MAML1, corresponding to a HOST TARGET binding site such as BINDING SITE I, BINDING SITE II or BINDING SITE III. Table 2 illustrates the complementarity of the nucleotide sequences of MAML1 BINDING SITE, designated SEQ ID:16497, to the nucleotide sequence of VGAM1959 RNA, herein designated VGAM RNA, also designated SEQ ID:4670.

Another function of VGAM1959 is therefore inhibition of Mastermind-like 1 (Drosophila) (MAML1, Accession NM_014757), a gene which MAML1 functions as a transcriptional coactivator for Notch signaling. Accordingly, utilities of VGAM1959 include diagnosis, prevention and treatment of diseases and clinical conditions associated with MAML1. The function of MAML1 and its association with various diseases and clinical conditions, has been established by previous studies, as described hereinabove with reference to VGAM556. Microtubule-associated Protein 1A (MAP1A, Accession NM_002373) is another VGAM1959 host target gene. MAP1A BINDING SITE is HOST TARGET binding site found in the 3' untranslated region of mRNA encoded by MAP1A, corresponding to a HOST TARGET binding site such as BINDING SITE I, BINDING SITE II or BINDING SITE III. Table 2 illustrates the complementarity of the nucleotide sequences of MAP1A BINDING SITE, designated SEQ ID:8187, to the nucleotide sequence of VGAM1959 RNA, herein designated VGAM RNA, also designated SEQ ID:4670.

Another function of VGAM1959 is therefore inhibition of Microtubule-associated Protein 1A (MAP1A, Accession NM_002373), a gene which is a structural protein involved in the filamentous cross- bridging between microtubules and other skeletal elements. Accordingly, utilities of VGAM1959 include diagnosis, prevention and treatment of diseases and clinical conditions associated with MAP1A. The function of MAP1A and its association with various diseases and clinical conditions, has been established by previous studies, as described hereinabove with reference to VGAM315. Methyl-CpG Binding Domain Protein 3 (MBD3, Accession NM_003926) is another VGAM1959 host target gene. MBD3 BINDING SITE is HOST TARGET binding site found in the 3' untranslated region of mRNA encoded by MBD3, corresponding to a HOST TARGET binding site such as BINDING SITE I, BINDING SITE II or BINDING SITE III. Table 2 illustrates the complementarity of the nucleotide sequences of MBD3 BINDING SITE, designated SEQ ID:10018, to the nucleotide sequence of VGAM1959 RNA, herein designated VGAM RNA, also designated SEQ ID:4670.

Another function of VGAM1959 is therefore inhibition of Methyl-CpG Binding Domain Protein 3 (MBD3, Accession NM_003926), a gene which are subunits of the NURD (nucleosome remodeling and histone deacetylase) complex. Accordingly, utilities of VGAM1959 include diagnosis, prevention and treatment of diseases and clinical conditions associated with MBD3. The function of MBD3 and its association with various diseases and clinical conditions, has been established by previous studies, as described hereinabove with reference to VGAM247. Myelin Basic Protein (MBP, Accession XM_117096) is another VGAM1959 host target gene. MBP BINDING SITE is HOST TARGET binding site found in the 3" untranslated region of mRNA encoded by MBP, corresponding to a HOST TARGET binding site such as BINDING SITE I, BINDING SITE II or BINDING SITE III. Table 2 illustrates the complementarity of the nucleotide sequences of MBP BINDING SITE, designated SEQ ID:43221, to the nucleotide sequence of VGAM1959 RNA, herein designated VGAM RNA, also designated SEQ ID:4670.

Another function of VGAM1959 is therefore inhibition of Myelin Basic Protein (MBP, Accession XM_117096), a gene which Myelin basic protein; a constituent of myelin, plays a role in nerve function. Accordingly, utilities of VGAM1959 include diagnosis, prevention and treatment of diseases and clinical conditions associated with MBP. The function of MBP has been established by previous studies. Eosinophil granule major basic protein (MBP) comprises the crystalloid core of the eosinophil granule. Wasmoen et al. (1988) and Weller et al. (1988) published a partial amino acid sequence for MBP, also designated proteoglycan-2 (PRG2). Using this partial sequence, Barker et al. (1988) isolated a full-length PRG2 cDNA from a human promyelocytic leukemia cell line (HL60) cDNA library. McGrogan et al. (1988) independently isolated a PRG2 cDNA from an HL60 cell line cDNA. Yoshimatsu et al. (1992) also identified PRG2 in a search for a natural killer (NK) cell-activating factor purified from the supernatant of a T-cell hybridoma. McGrogan et al. (1988) and Barker et al. (1988) determined that the PRG2 cDNA encodes a deduced 222-amino acid protein with a 15-amino acid hydrophobic signal sequence. PRG2 is initially translated as a 25-kD preproprotein that is posttranslationally modified to a proprotein. Posttranslational modification results in the mature form of PRG2, which is encoded by the carboxy 117 amino acids of the preproprotein and has a molecular mass of 14 kD. The 90-amino acid N-terminal domain has 1 potential N-linked glycosylation site. Yoshimatsu et al. (1992) reported that the C-terminal end of PRG2 shares homology with animal lectins. McGrogan et al. (1988) determined that the putative PRG2 proprotein is a bipolar molecule. The amino-terminal half is hydrophilic, whereas the mature PRG2 is hydrophobic. Barker et al. (1988) hypothesized that the translation of PRG2 as a bipolar proprotein may mask the toxic effects of the mature PRG2 and protect the eosinophil from damage while the protein is processed through the endoplasmic reticulum to its sequestered site in the eosinophil granule. Using Northern blot analysis, McGrogan et al. (1988) detected a major 1-kb transcript and a minor 0.5-kb PRG2 transcript in HL60 cells. By the same method, Li et al. (1995) detected a 1-kb transcript in immature cells including bone-marrow and HL60 cells, but not in purified blood eosinophils. Using RT-PCR, Li et al. (1995) detected an additional 1.6-kb transcript in bone marrow cells and HL60 cells at lower levels than the 1-kb transcript. In differentiated blood eosinophils from idiopathic hypereosinophilic syndrome patients, the 1.6-kb transcript predominated. The International Radiation Hybrid Mapping Consortium mapped the PRG2 gene to chromosome 11 (A005W41). By FISH, Plager et al. (2001) mapped the PRG2 and PRG3 (OMIM Ref. No. 606814) genes to chromosome 11cen-q12. Animal model experiments lend further support to the function of MBP.

It is appreciated that the abovementioned animal model for MBP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Li, M.-S.; Sun, L.; Satoh, T.; Fisher, L. M.; Spry, C. J. F.: Human eosinophil major basic protein, a mediator of allergic inflammation, is expressed by alternative splicing from two promoters. Biochem. J. 305:921-927, 1995; and Plager, D. A.; Weiler, D. A.; Loegering, D. A.; Johnson, W. B.; Haley, L.; Eddy, R. L.; Shows, T. B.; Gleich, G. J.: Comparative structure, proximal promoter elements, and chromosome lo.

Further studies establishing the function and utilities of MBP are found in John Hopkins OMIM database record ID 605601, and in sited publications numbered 6995-7001 listed in the bibliography section hereinbelow, which are also hereby incorporated by reference. MADS Box Transcription Enhancer Factor 2, Polypeptide C (myocyte enhancer factor 2C) (MEF2C, Accession NM_002397) is another VGAM1959 host target gene. MEF2C BINDING SITE is HOST TARGET binding site found in the 3' untranslated region of mRNA encoded by MEF2C, corresponding to a HOST TARGET binding site such as BINDING SITE I, BINDING SITE II or BINDING SITE III. Table 2 illustrates the complementarity of the nucleotide sequences of MEF2C BINDING SITE, designated SEQ ID:8214, to the nucleotide sequence of VGAM1959 RNA, herein designated VGAM RNA, also designated SEQ ID:4670.

Another function of VGAM1959 is therefore inhibition of MADS Box Transcription Enhancer Factor 2, Polypeptide C (myocyte enhancer factor 2C) (MEF2C, Accession NM_002397), a gene which regulates muscle-specific and mitogen-inducible genes. Accordingly, utilities of VGAM1959 include diagnosis, prevention and treatment of diseases and clinical conditions associated with MEF2C. The function of MEF2C and its association with various diseases and clinical conditions, has been established by previous studies, as described hereinabove with reference to VGAM386. MADS Box Transcription Enhancer Factor 2, Polypeptide D (myocyte enhancer factor 2D) (MEF2D, Accession XM_173049) is another VGAM1959 host target gene. MEF2D BINDING SITE is HOST TARGET binding site found in the 3' untranslated region of mRNA encoded by MEF2D, corresponding to a HOST TARGET binding site such as BINDING SITE I, BINDING SITE II or BINDING SITE III. Table 2 illustrates the complementarity of the nucleotide sequences of MEF2D BINDING SITE, designated SEQ ID:46307, to the nucleotide sequence of VGAM1959 RNA, herein designated VGAM RNA, also designated SEQ ID:4670.

Another function of VGAM1959 is therefore inhibition of MADS Box Transcription Enhancer Factor 2, Polypeptide D (myocyte enhancer factor 2D) (MEF2D, Accession XM_173049), a gene which regulates muscle-specific and mitogen-inducible genes. Accordingly, utilities of VGAM1959 include diagnosis, prevention and treatment of diseases and clinical conditions associated with MEF2D. The function of MEF2D and its association with various diseases and clinical conditions, has been established by previous studies, as described hereinabove with reference to VGAM1306. Methyltransferase-like 1 (METTL1, Accession NM_023032) is another VGAM1959 host target gene. METTL1 BINDING SITE1 and METTL1 BINDING SITE2 are HOST TARGET binding sites found in untranslated regions of mRNA encoded by METTL1, corresponding to HOST TARGET binding sites such as BINDING SITE I, BINDING SITE II or BINDING SITE III. Table 2 illustrates the complementarity of the nucleotide sequences of METTL1 BINDING SITE1 and METTL1 BINDING SITE2, designated SEQ ID:23307 and SEQ ID:23312 respectively, to the nucleotide sequence of VGAM1959 RNA, herein designated VGAM RNA, also designated SEQ ID:4670.

Another function of VGAM1959 is therefore inhibition of Methyltransferase-like 1 (METTL1, Accession NM_023032). Accordingly, utilities of VGAM1959 include diagnosis, prevention and treatment of diseases and clinical conditions associated with METTL1. Megalencephalic Leukoencephalopathy with Subcortical Cysts 1 (MLC1, Accession NM_015166) is another VGAM1959 host target gene. MLC1 BINDING SITE1 and MLC1 BINDING SITE2 are HOST TARGET binding sites found in untranslated regions of mRNA encoded by MLC1, corresponding to HOST TARGET binding sites such as BINDING SITE I, BINDING SITE II or BINDING SITE III. Table 2 illustrates the complementarity of the nucleotide sequences of MLC1 BINDING SITE1 and MLC1 BINDING SITE2, designated SEQ ID:17523 and SEQ ID:29217 respectively, to the nucleotide sequence of VGAM1959 RNA, herein designated VGAM RNA, also designated SEQ ID:4670.

Another function of VGAM1959 is therefore inhibition of Megalencephalic Leukoencephalopathy with Subcortical Cysts 1 (MLC1, Accession NM_015166). Accordingly, utilities of VGAM1959 include diagnosis, prevention and treatment of diseases and clinical conditions associated with MLC1. Mature T-cell Proliferation 1 (MTCP1, Accession NM_014221) is another VGAM1959 host target gene. MTCP1 BINDING SITE is HOST TARGET binding site found in the 5' untranslated region of mRNA encoded by MTCP1, corresponding to a HOST TARGET binding site such as BINDING SITE I, BINDING SITE II or BINDING SITE III. Table 2 illustrates the complementarity of the nucleotide sequences of MTCP1 BINDING SITE, designated SEQ ID:15486, to the nucleotide sequence of VGAM1959 RNA, herein designated VGAM RNA, also designated SEQ ID:4670.

Another function of VGAM1959 is therefore inhibition of Mature T-cell Proliferation 1 (MTCP1, Accession NM_014221). Accordingly, utilities of VGAM1959 include diagnosis, prevention and treatment of diseases and clinical conditions associated with MTCP1. Myotubularin Related Protein 8 (MTMR8, Accession NM_015458) is another VGAM1959 host target gene. MTMR8 BINDING SITE is HOST TARGET binding site found in the 3' untranslated region of mRNA encoded by MTMR8, corresponding to a HOST TARGET binding site such as BINDING SITE I, BINDING SITE II or BINDING SITE III. Table 2 illustrates the complementarity of the nucleotide sequences of MTMR8 BINDING SITE, designated SEQ ID:17747, to the nucleotide sequence of VGAM1959 RNA, herein designated VGAM RNA, also designated SEQ ID:4670.

Another function of VGAM1959 is therefore inhibition of Myotubularin Related Protein 8 (MTMR8, Accession NM_015458), a gene which could be a tyrosine-phosphatase. Accordingly, utilities of VGAM1959 include diagnosis, prevention and treatment of diseases and clinical conditions associated with MTMR8. The function of MTMR8 and its association with various diseases and clinical conditions, has been established by previous studies, as described hereinabove with reference to VGAM379. Mevalonate Kinase (mevalonic aciduria) (MVK, Accession XM_027151) is another VGAM1959 host target gene. MVK BINDING SITE is HOST TARGET binding site found in the 3' untranslated region of mRNA encoded by MVK, corresponding to a HOST TARGET binding site such as BINDING SITE I, BINDING SITE II or BINDING SITE III. Table 2 illustrates the complementarity of the nucleotide sequences of MVK BINDING SITE, designated SEQ ID:30425, to the nucleotide sequence of VGAM1959 RNA, herein designated VGAM RNA, also designated SEQ ID:4670.

Another function of VGAM1959 is therefore inhibition of Mevalonate Kinase (mevalonic aciduria) (MVK, Accession XM_027151). Accordingly, utilities of VGAM1959 include diagnosis, prevention and treatment of diseases and clinical conditions associated with MVK. N-acetylgalactosaminidase, Alpha- (NAGA, Accession NM_000262) is another VGAM1959 host target gene. NAGA BINDING SITE1 and NAGA BINDING SITE2 are HOST TARGET binding sites found in untranslated regions of mRNA encoded by NAGA, corresponding to HOST TARGET binding sites such as BINDING SITE I, BINDING SITE II or BINDING SITE III. Table 2 illustrates the complementarity of the nucleotide sequences of NAGA BINDING SITE1 and NAGA BINDING SITE2, designated SEQ ID:5799 and SEQ ID:5802 respectively, to the nucleotide sequence of VGAM1959 RNA, herein designated VGAM RNA, also designated SEQ ID:4670.

Another function of VGAM1959 is therefore inhibition of N-acetylgalactosaminidase, Alpha- (NAGA, Accession NM_000262). Accordingly, utilities of VGAM1959 include diagnosis, prevention and treatment of diseases and clinical conditions associated with NAGA. Niemann-Pick Disease, Type C1 (NPC1, Accession NM_000271) is another VGAM1959 host target gene. NPC1 BINDING SITE is HOST TARGET binding site found in the 3' untranslated region of mRNA encoded by NPC1, corresponding to a HOST TARGET binding site such as BINDING SITE I, BINDING SITE II or BINDING SITE III. Table 2 illustrates the complementarity of the nucleotide sequences of NPC1 BINDING SITE, designated SEQ ID:5814, to the nucleotide sequence of VGAM1959 RNA, herein designated VGAM RNA, also designated SEQ ID:4670.

Another function of VGAM1959 is therefore inhibition of Niemann-Pick Disease, Type C1 (NPC1, Accession NM_000271). Accordingly, utilities of VGAM1959 include diagnosis, prevention and treatment of diseases and clinical conditions associated with NPC1. Neuronal Pentraxin II (NPTX2, Accession XM_166492) is another VGAM1959 host target gene. NPTX2 BINDING SITE is HOST TARGET binding site found in the 3' untranslated region of mRNA encoded by NPTX2, corresponding to a HOST TARGET binding site such as BINDING SITE I, BINDING SITE II or BINDING SITE III. Table 2 illustrates the complementarity of the nucleotide sequences of NPTX2 BINDING SITE, designated SEQ ID:44425, to the nucleotide sequence of VGAM1959 RNA, herein designated VGAM RNA, also designated SEQ ID:4670.

Another function of VGAM1959 is therefore inhibition of Neuronal Pentraxin II (NPTX2, Accession XM_166492), a gene which is likely to play role in the modification of cellular properties that underlie long-term plasticity. Accordingly, utilities of VGAM1959 include diagnosis, prevention and treatment of diseases and clinical conditions associated with NPTX2. The function of NPTX2 has been established by previous studies. Pentraxins constitute a family of proteins that include C-reactive protein (CRP; 123260) and serum amyloid P protein (APCS; 104770). Hsu and Perin (1995) noted that the prototypic pentraxin, C-reactive protein, was first identified as a serum component that binds Streptococcus pneumoniae (Tillett and Francis, 1930 and Abernethy and Avery, 1941) and whose serum concentration increases up to 1,000-fold during an acute phase response. Pentraxins acquired their name from their ability to form pentameric (or decameric) complexes and have been characterized by their ability to bind numerous ligands. The latter property raises the possibility that these proteins may mediate a nonspecific uptake of bacteria and cell debris that may be associated with inflammation and immune responses. Schlimgen et al. (1995) identified a novel neuronal pentraxin in rat as a potential receptor mediating the uptake of the presynaptic snake venom toxin taipoxin (see OMIM Ref. No. NPTX1, 602367). Based on the low identity to other pentraxins and the hypothesis that this neuronal pentraxin may mediate uptake of degraded synaptic material, Hsu and Perin (1995) sought to identify additional members of what they suspected represents a new family of pentraxins. They reported the cDNA and genomic sequences of a second neuronal pentraxin in human S, for which they proposed the name neuronal pentraxin II (NPTX2). They found that it shows 54% amino acid identity to rat neuronal pentraxin I, with 69% identity over the carboxy-terminal half of NP I, and is 88% identical to a sperm acrosomal pentraxin. Northern blot analysis demonstrated that NPTX2 message is present in brain, testis, pancreas, liver, heart, and skeletal muscle; thus, unlike NP I, NP II is not exclusively localized to neurons. Like NP I, NP II has potential N-linked glycosylation sites. The human NPTX2 gene is 11 kb long and contains 4 introns. By fluorescence in situ hybridization, Hsu and Perin (1995) mapped the NPTX2 gene to 7q21.3-q22.1.

Full details of the abovementioned studies are described in the following publications, the disclosure of which are hereby incorporated by reference:

Hsu, Y.-C.; Perin, M. S.: Human neuronal pentraxin II (NPTX2): conservation, genomic structure, and chromosomal localization. Genomics 28:220-227, 1995; and Schlimgen, A. K.; Helms, J. A.; Vogel, H.; Perin, M. S.: Neuronal pentraxin, a secreted protein with homology to acute phase proteins of the immune system. Neuron 14:519-526, 1995.

Further studies establishing the function and utilities of NPTX2 are found in John Hopkins OMIM database record ID 600750, and in sited publications numbered 3786, 7571-757 and 3787 listed in the bibliography section hereinbelow, which are also hereby incorporated by reference. Nuclear Receptor Subfamily 3, Group C, Member 2 (NR3C2, Accession NM_000901) is another VGAM1959 host target gene. NR3C2 BINDING SITE is HOST TARGET binding site found in the 3' untranslated region of mRNA encoded by NR3C2, corresponding to a HOST TARGET binding site such as BINDING SITE I, BINDING SITE II or BINDING SITE III. Table 2 illustrates the complementarity of the nucleotide sequences of NR3C2 BINDING SITE, designated SEQ ID:6595, to the nucleotide sequence of VGAM1959 RNA, herein designated VGAM RNA, also designated SEQ ID:4670.

Another function of VGAM1959 is therefore inhibition of Nuclear Receptor Subfamily 3, Group C, Member 2 (NR3C2, Accession NM_000901), a gene which is to increase ion and water transport and thus raise extracellular fluid volume and blood pressure and lower potassium levels. Accordingly, utilities of VGAM1959 include diagnosis, prevention and treatment of diseases and clinical conditions associated with NR3C2. The function of NR3C2 and its association with various diseases and clinical conditions, has been established by previous studies, as described hereinabove with reference to VGAM186. Nebulin-related Anchoring Protein (Nrap, Accession NM_139235) is another VGAM1959 host target gene. Nrap BINDING SITE is HOST TARGET binding site found in the 3' untranslated region of mRNA encoded by Nrap, corresponding to a HOST TARGET binding site such as BINDING SITE I, BINDING SITE II or BINDING SITE III. Table 2 illustrates the complementarity of the nucleotide sequences of Nrap BINDING SITE, designated SEQ ID:29239, to the nucleotide sequence of VGAM1959 RNA, herein designated VGAM RNA, also designated SEQ ID:4670.

Another function of VGAM1959 is therefore inhibition of Nebulin-related Anchoring Protein (Nrap, Accession NM_139235), a gene which performs an anchoring function to link the terminal actin filaments of myofibrils to protein complexes located beneath the sarcolemma. Accordingly, utilities of VGAM1959 include diagnosis, prevention and treatment of diseases and clinical conditions associated with Nrap. The function of Nrap and its association with various diseases and clinical conditions, has been established by previous studies, as described hereinabove with reference to VGAM649. Nuclear Receptor Interacting Protein 1 (NRIP1, Accession XM_009699) is another VGAM1959 host target gene. NRIP1 BINDING SITE is HOST TARGET binding site found in the 3' untranslated region of mRNA encoded by NRIP1, corresponding to a HOST TARGET binding site such as BINDING SITE I, BINDING SITE II or BINDING SITE III. Table 2 illustrates the complementarity of the nucleotide sequences of NRIP1 BINDING SITE, designated SEQ ID:30121, to the nucleotide sequence of VGAM1959 RNA, herein designated VGAM RNA, also designated SEQ ID:4670.

Another function of VGAM1959 is therefore inhibition of Nuclear Receptor Interacting Protein 1 (NRIP1, Accession XM_009699), a gene which modulates transcriptional activation by the estrogen receptor. Accordingly, utilities of VGAM1959 include diagnosis, prevention and treatment of diseases and clinical conditions associated with NRIP1. The function of NRIP1 and its association with various diseases and clinical conditions, has been established by previous studies, as described hereinabove with reference to VGAM276.8-oxoguanine DNA Glycosylase (OGG1, Accession NM_016819) is another VGAM1959 host target gene. OGG1 BINDING SITE1 through OGG1 BINDING SITE3 are HOST TARGET binding sites found in untranslated regions of mRNA encoded by OGG1, corresponding to HOST TARGET binding sites such as BINDING SITE I, BINDING SITE II or BINDING SITE III. Table 2 illustrates the complementarity of the nucleotide sequences of OGG1 BINDING SITE1 through OGG1 BINDING SITE3, designated SEQ ID:18811, SEQ ID:18816 and SEQ ID:8394 respectively, to the nucleotide sequence of VGAM1959 RNA, herein designated VGAM RNA, also designated SEQ ID:4670.

Another function of VGAM1959 is therefore inhibition of 8-oxoguanine DNA Glycosylase (OGG1, Accession NM_016819), a gene which is involved in base excision DNA repair and removal of 8-oxyguanine. Accordingly, utilities of VGAM1959 include diagnosis, prevention and treatment of diseases and clinical conditions associated with OGG1. The function of OGG1 and its association with various diseases and clinical conditions, has been established by previous studies, as described hereinabove with reference to VGAM390. Oncostatin M (OSM, Accession NM_020530) is another VGAM1959 host target gene. OSM BINDING SITE is HOST TARGET binding site found in the 3' untranslated region of mRNA encoded by OSM, corresponding to a HOST TARGET binding site such as BINDING SITE I, BINDING SITE II or BINDING SITE III. Table 2 illustrates the complementarity of the nucleotide sequences of OSM BINDING SITE, designated SEQ ID:21754, to the nucleotide sequence of VGAM1959 RNA, herein designated VGAM RNA, also designated SEQ ID:4670.

Another function of VGAM1959 is therefore inhibition of Oncostatin M (OSM, Accession NM_020530), a gene which inhibits the proliferation of a number of tumor cell lines, caused an acute inflammatory reaction. Accordingly, utilities of VGAM1959 include diagnosis, prevention and treatment of diseases and clinical conditions associated with OSM. The function of OSM and its association with various diseases and clinical conditions, has been established by previous studies, as described hereinabove with reference to VGAM1078. Pyrimidinergic Receptor P2Y, G-protein Coupled, 6 (P2RY6, Accession NM_004154) is another VGAM1959 host target gene. P2RY6 BINDING SITE is HOST TARGET binding site found in the 3' untranslated region of mRNA encoded by P2RY6, corresponding to a HOST TARGET binding site such as BINDING SITE I, BINDING SITE II or BINDING SITE III. Table 2 illustrates the complementarity of the nucleotide sequences of P2RY6 BINDING SITE, designated SEQ ID:10355, to the nucleotide sequence of VGAM1959 RNA, herein designated VGAM RNA, also designated SEQ ID:4670.

Another function of VGAM1959 is therefore inhibition of Pyrimidinergic Receptor P2Y, G-protein Coupled, 6 (P2RY6, Accession NM_004154), a gene which mediates cellular responses to nucleotides. Accordingly, utilities of VGAM1959 include diagnosis, prevention and treatment of diseases and clinical conditions associated with P2RY6. The function of P2RY6 and its association with various diseases and clinical conditions, has been established by previous studies, as described hereinabove with reference to VGAM445. Protocadherin 11 X-linked (PCDH11X, Accession NM_032968) is another VGAM1959 host target gene. PCDH11X BINDING SITE1 and PCDH11X BINDING SITE2 are HOST TARGET binding sites found in untranslated regions of mRNA encoded by PCDH11X, corresponding to HOST TARGET binding sites such as BINDING SITE I, BINDING SITE II or BINDING SITE III. Table 2 illustrates the complementarity of the nucleotide sequences of PCDH11X BINDING SITE1 and PCDH11X BINDING SITE2, designated SEQ ID:26795 and SEQ ID:26810 respectively, to the nucleotide sequence of VGAM1959 RNA, herein designated VGAM RNA, also designated SEQ ID:4670.

Another function of VGAM1959 is therefore inhibition of Protocadherin 11 X-linked (PCDH11X, Accession NM_032968), a gene which is thought to play a fundamental role in cell-cell recognition essential for the segmental development and function of the central nervous system. Accordingly, utilities of VGAM1959 include diagnosis, prevention and treatment of diseases and clinical conditions associated with PCDH11X. The function of PCDH11X and its association with various diseases and clinical conditions, has been established by previous studies, as described hereinabove with reference to VGAM433. Protocadherin 11 Y-linked (PCDH11Y, Accession NM_032973) is another VGAM1959 host target gene. PCDH11Y BINDING SITE1 and PCDH11Y BINDING SITE2 are HOST TARGET binding sites found in untranslated regions of mRNA encoded by PCDH11Y, corresponding to HOST TARGET binding sites such as BINDING SITE I, BINDING SITE II or BINDING SITE III. Table 2 illustrates the complementarity of the nucleotide sequences of PCDH11Y BINDING SITE1 and PCDH11Y BINDING SITE2, designated SEQ ID:26829 and SEQ ID:9851 respectively, to the nucleotide sequence of VGAM1959 RNA, herein designated VGAM RNA, also designated SEQ ID:4670.

Another function of VGAM1959 is therefore inhibition of Protocadherin 11 Y-linked (PCDH11Y, Accession NM_032973). Accordingly, utilities of VGAM1959 include diagnosis, prevention and treatment of diseases and clinical conditions associated with PCDH11Y. Prohibitin (PHB, Accession NM_002634) is another VGAM1959 host target gene. PHB BINDING SITE is HOST TARGET binding site found in the 3' untranslated region of mRNA encoded by PHB, corresponding to a HOST TARGET binding site such as BINDING SITE I, BINDING SITE II or BINDING SITE III. Table 2 illustrates the complementarity of the nucleotide sequences of PHB BINDING SITE, designated SEQ ID:8494, to the nucleotide sequence of VGAM1959 RNA, herein designated VGAM RNA, also designated SEQ ID:4670.

Another function of VGAM1959 is therefore inhibition of Prohibitin (PHB, Accession NM_002634). Accordingly, utilities of VGAM1959 include diagnosis, prevention and treatment of diseases and clinical conditions associated with PHB. PIG8 (Accession NM_004879) is another VGAM1959 host target gene. PIG8 BINDING SITE is HOST TARGET binding site found in the 3' untranslated region of mRNA encoded by PIG8, corresponding to a HOST TARGET binding site such as BINDING SITE I, BINDING SITE II or BINDING SITE III. Table 2 illustrates the complementarity of the nucleotide sequences of PIG8 BINDING SITE, designated SEQ ID:11315, to the nucleotide sequence of VGAM1959 RNA, herein designated VGAM RNA, also designated SEQ ID:4670.

Another function of VGAM1959 is therefore inhibition of PIG8 (Accession NM_004879), a gene which is induced by p53 and may be involved in apoptosis. Accordingly, utilities of VGAM1959 include diagnosis, prevention and treatment of diseases and clinical conditions associated with PIG8. The function of PIG8 and its association with various diseases and clinical conditions, has been established by previous studies, as described hereinabove with reference to VGAM737. Phosphoinositide-3-kinase, Class 2, Beta Polypeptide (PIK3C2B, Accession NM_002646) is another VGAM1959 host target gene. PIK3C2B BINDING SITE is HOST TARGET binding site found in the 3' untranslated region of mRNA encoded by PIK3C2B, corresponding to a HOST TARGET binding site such as BINDING SITE I, BINDING SITE II or BINDING SITE III. Table 2 illustrates the complementarity of the nucleotide sequences of PIK3C2B BINDING SITE, designated SEQ ID:8509, to the nucleotide sequence of VGAM1959 RNA, herein designated VGAM RNA, also designated SEQ ID:4670.

Another function of VGAM1959 is therefore inhibition of Phosphoinositide-3-kinase, Class 2, Beta Polypeptide (PIK3C2B, Accession NM_002646). Accordingly, utilities of VGAM1959 include diagnosis, prevention and treatment of diseases and clinical conditions associated with PIK3C2B. Polycystic Kidney Disease 1 (autosomal dominant) (PKD1, Accession NM_000296) is another VGAM1959 host target gene. PKD1 BINDING SITE is HOST TARGET binding site found in the 3' untranslated region of mRNA encoded by PKD1, corresponding to a HOST TARGET binding site such as BINDING SITE I, BINDING SITE II or BINDING SITE III. Table 2 illustrates the complementarity of the nucleotide sequences of PKD1 BINDING SITE, designated SEQ ID:5842, to the nucleotide sequence of VGAM1959 RNA, herein designated VGAM RNA, also designated SEQ ID:4670.

Another function of VGAM1959 is therefore inhibition of Polycystic Kidney Disease 1 (autosomal dominant) (PKD1, Accession NM_000296). Accordingly, utilities of VGAM1959 include diagnosis, prevention and treatment of diseases and clinical conditions associated with PKD1. Phosphomannomutase 2 (PMM2, Accession XM_050755) is another VGAM1959 host target gene. PMM2 BINDING SITE is HOST TARGET binding site found in the 3' untranslated region of mRNA encoded by PMM2, corresponding to a HOST TARGET binding site such as BINDING SITE I, BINDING SITE II or BINDING SITE III. Table 2 illustrates the complementarity of the nucleotide sequences of PMM2 BINDING SITE, designated SEQ ID:35679, to the nucleotide sequence of VGAM1959 RNA, herein designated VGAM RNA, also designated SEQ ID:4670.

Another function of VGAM1959 is therefore inhibition of Phosphomannomutase 2 (PMM2, Accession XM_050755). Accordingly, utilities of VGAM1959 include diagnosis, prevention and treatment of diseases and clinical conditions associated with PMM2. Peroxisome Proliferative Activated Receptor, Gamma, Coactivator 1 (PPARGC1, Accession NM_013261) is another VGAM1959 host target gene. PPARGC1 BINDING SITE is HOST TARGET binding site found in the 3' untranslated region of mRNA encoded by PPARGC1, corresponding to a HOST TARGET binding site such as BINDING SITE I, BINDING SITE II or BINDING SITE III. Table 2 illustrates the complementarity of the nucleotide sequences of PPARGC1 BINDING SITE, designated SEQ ID:14932, to the nucleotide sequence of VGAM1959 RNA, herein designated VGAM RNA, also designated SEQ ID:4670.

Another function of VGAM1959 is therefore inhibition of Peroxisome Proliferative Activated Receptor, Gamma, Coactivator 1 (PPARGC1, Accession NM_013261), a gene which may play a role in insulin sensitivity and thermogenesis. Accordingly, utilities of VGAM1959 include diagnosis, prevention and treatment of diseases and clinical conditions associated with PPARGC1. The function of PPARGC1 and its association with various diseases and clinical conditions, has been established by previous studies, as described hereinabove with reference to VGAM952. Peptidyl-prolyl Isomerase G (cyclophilin G) (PPIG, Accession NM_004792) is another VGAM1959 host target gene. PPIG BINDING SITE is HOST TARGET binding site found in the 5' untranslated region of mRNA encoded by PPIG, corresponding to a HOST TARGET binding site such as BINDING SITE I, BINDING SITE II or BINDING SITE III. Table 2 illustrates the complementarity of the nucleotide sequences of PPIG BINDING SITE, designated SEQ ID:11202, to the nucleotide sequence of VGAM1959 RNA, herein designated VGAM RNA, also designated SEQ ID:4670.

Another function of VGAM1959 is therefore inhibition of Peptidyl-prolyl Isomerase G (cyclophilin G) (PPIG, Accession NM_004792), a gene which catalyzes the cis-trans isomerization of proline imidic peptide bonds in oligopeptides. Accordingly, utilities of VGAM1959 include diagnosis, prevention and treatment of diseases and clinical conditions associated with PPIG. The function of PPIG has been established by previous studies. The peptidyl-prolyl cis/trans isomerase protein family (PPIases) includes the cyclophilin, FK506-binding protein (e.g., FKBP1A; 186945), and parvulin (e.g., PIN4, 300252) subfamilies. The cyclophilins have been implicated in the folding, transport, and assembly of proteins. Using a yeast 2-hybrid screen to identify proteins that interact with Clk (CLK1; 601951), Nestel et al. (1996) isolated partial clones of a mouse gene, which they called CARS-Cyp. By screening a thymus cDNA library with the mouse clone, they assembled a full-length cDNA of the human homolog, PPIG. Using a yeast 2-hybrid screen to identify proteins that interact with the phosphorylated C-terminal domain (CTD) of the largest subunit of RNA polymerase II (POLR2A; 180660), Bourquin et al. (1997) independently cloned PPIG, which they called SRcyp/CASP10, from a B-lymphocyte cDNA library. PPIG is predicted to encode a 754-amino acid protein containing 2 NopP140 (nucleolar phosphoprotein of 140 kD)-related domains and a large C-terminal serine/arginine (SR)-rich domain found predominantly in pre-mRNA splicing factors. The N-terminal region of PPIG contains a peptidyl-prolyl cis-trans isomerase domain characteristic of immunophilins/cyclophilins. PPIG shares 37.8% sequence identity with NKTR (OMIM Ref. No. 161565), a myeloid-specific nuclear protein. By Northern blot analysis, Nestel et al. (1996) detected PPIG expression at similar levels in lung, liver, kidney, small intestine, testis, and brain. They detected major 4-kb and minor 10-kb PPIG transcripts in human B-cell RNA. Although PPIG was widely expressed, it appeared to be absent from NK cells. By Northern blot analysis, Bourquin et al. (1997) detected a broadly expressed single 3.0-kb PPIG transcript. Using deletion mutant analysis, Bourquin et al. (1997) determined that the SR domain of PPIG is required for interaction with the CTD of POLR2A in yeast 2-hybrid assays. Using GST fusion proteins, they confirmed that PPIG directly interacts with the CTD. Using immunostaining, they demonstrated that PPIG is distributed in nuclear speckles, a nuclear compartment rich in splicing factors, and colocalizes with the splicing factor SC35 (SFRS2; 600813). They concluded that PPIG may be a component of splicing factor complexes that bind the CTD, thereby linking RNA processing to transcription.

Full details of the abovementioned studies are described in the following publications, the disclosure of which are hereby incorporated by reference:

Bourquin, J.-P.; Stagljar, I.; Meier, P.; Moosmann, P.; Silke, J.; Baechi, T.; Georgiev, O.; Schaffner, W.: A serine/arginine-rich nuclear matrix cyclophilin interacts with the C-terminal domain of RNA polymerase II. Nucleic Acids Res. 25:2055-2061, 1997; and Nestel, F. P.; Colwill, K.; Harper, S.; Pawson, T.; Anderson, S. K.: RS cyclophilins: identification of an NK-TR(1)-related cyclophilin. Gene 180:151-155, 1996.

Further studies establishing the function and utilities of PPIG are found in John Hopkins OMIM database record ID 606093, and in sited publications numbered 12399 listed in the bibliography section hereinbelow, which are also hereby incorporated by reference. PR Domain Containing 4 (PRDM4, Accession NM_012406) is another VGAM1959 host target gene. PRDM4 BINDING SITE is HOST TARGET binding site found in the 3' untranslated region of mRNA encoded by PRDM4, corresponding to a HOST TARGET binding site such as BINDING SITE I, BINDING SITE II or BINDING SITE III. Table 2 illustrates the complementarity of the nucleotide sequences of PRDM4 BINDING SITE, designated SEQ ID:14785, to the nucleotide sequence of VGAM1959 RNA, herein designated VGAM RNA, also designated SEQ ID:4670.

Another function of VGAM1959 is therefore inhibition of PR Domain Containing 4 (PRDM4, Accession NM_012406). Accordingly, utilities of VGAM1959 include diagnosis, prevention and treatment of diseases and clinical conditions associated with PRDM4. PRex1 (Accession NM_020820) is another VGAM1959 host target gene. PRex1 BINDING SITE is HOST TARGET binding site found in the 3' untranslated region of mRNA encoded by PRex1, corresponding to a HOST TARGET binding site such as BINDING SITE I, BINDING SITE II or BINDING SITE III. Table 2 illustrates the complementarity of the nucleotide sequences of PRex1 BINDING SITE, designated SEQ ID:21885, to the nucleotide sequence of VGAM1959 RNA, herein designated VGAM RNA, also designated SEQ ID:4670.

Another function of VGAM1959 is therefore inhibition of PRex1 (Accession NM_020820). Accordingly, utilities of VGAM1959 include diagnosis, prevention and treatment of diseases and clinical conditions associated with PRex1. Prokineticin 1 (PROK1, Accession NM_032414) is another VGAM1959 host target gene. PROK1 BINDING SITE is HOST TARGET binding site found in the 3' untranslated region of mRNA encoded by PROK1, corresponding to a HOST TARGET binding site such as BINDING SITE I, BINDING SITE II or BINDING SITE III. Table 2 illustrates the complementarity of the nucleotide sequences of PROK1 BINDING SITE, designated SEQ ID:26199, to the nucleotide sequence of VGAM1959 RNA, herein designated VGAM RNA, also designated SEQ ID:4670.

Another function of VGAM1959 is therefore inhibition of Prokineticin 1 (PROK1, Accession NM_032414), a gene which induces proliferation, migration and fenestration in capillary endothelial cells derived from endocrine glands. Accordingly, utilities of VGAM1959 include diagnosis, prevention and treatment of diseases and clinical conditions associated with PROK1. The function of PROK1 and its association with various diseases and clinical conditions, has been established by previous studies, as described hereinabove with reference to VGAM1000. Prosaposin (variant Gaucher disease and variant metachromatic leukodystrophy) (PSAP, Accession XM_045140) is another VGAM1959 host target gene. PSAP BINDING SITE is HOST TARGET binding site found in the 3' untranslated region of mRNA encoded by PSAP, corresponding to a HOST TARGET binding site such as BINDING SITE I, BINDING SITE II or BINDING SITE III. Table 2 illustrates the complementarity of the nucleotide sequences of PSAP BINDING SITE, designated SEQ ID:34373, to the nucleotide sequence of VGAM1959 RNA, herein designated VGAM RNA, also designated SEQ ID:4670.

Another function of VGAM1959 is therefore inhibition of Prosaposin (variant Gaucher disease and variant metachromatic leukodystrophy) (PSAP, Accession XM_045140). Accordingly, utilities of VGAM1959 include diagnosis, prevention and treatment of diseases and clinical conditions associated with PSAP. Prostaglandin F2 Receptor Negative Regulator (PTGFRN, Accession XM_040709) is another VGAM1959 host target gene. PTGFRN BINDING SITE is HOST TARGET binding site found in the 3' untranslated region of mRNA encoded by PTGFRN, corresponding to a HOST TARGET binding site such as BINDING SITE I, BINDING SITE II or BINDING SITE III. Table 2 illustrates the complementarity of the nucleotide sequences of PTGFRN BINDING SITE, designated SEQ ID:33363, to the nucleotide sequence of VGAM1959 RNA, herein designated VGAM RNA, also designated SEQ ID:4670.

Another function of VGAM1959 is therefore inhibition of Prostaglandin F2 Receptor Negative Regulator (PTGFRN, Accession XM_040709), a gene which inhibits the binding of prostaglandin f2-alpha (pgf2- alpha) to its specific fp receptor. Accordingly, utilities of VGAM1959 include diagnosis, prevention and treatment of diseases and clinical conditions associated with PTGFRN. The function of PTGFRN and its association with various diseases and clinical conditions, has been established by previous studies, as described hereinabove with reference to VGAM125. Prostaglandin-endoperoxide Synthase 1 (prostaglandin G/H synthase and cyclooxygenase) (PTGS1, Accession NM_080591) is another VGAM1959 host target gene. PTGS1 BINDING SITE1 and PTGS1 BINDING SITE2 are HOST TARGET binding sites found in untranslated regions of mRNA encoded by PTGS1, corresponding to HOST TARGET binding sites such as BINDING SITE I, BINDING SITE II or BINDING SITE III. Table 2 illustrates the complementarity of the nucleotide sequences of PTGS1 BINDING SITE1 and PTGS1 BINDING SITE2, designated SEQ ID:27901 and SEQ ID:6680 respectively, to the nucleotide sequence of VGAM1959 RNA, herein designated VGAM RNA, also designated SEQ ID:4670.

Another function of VGAM1959 is therefore inhibition of Prostaglandin-endoperoxide Synthase 1 (prostaglandin G/H synthase and cyclooxygenase) (PTGS1, Accession NM_080591), a gene which may play an important role in regulating or promoting cell proliferation in some normal and neoplastically transformed cells. Accordingly, utilities of VGAM1959 include diagnosis, prevention and treatment of diseases and clinical conditions associated with PTGS1. The function of PTGS1 and its association with various diseases and clinical conditions, has been established by previous studies, as described hereinabove with reference to VGAM1224. Protein Tyrosine Phosphatase, Receptor Type, G (PTPRG, Accession NM_002841) is another VGAM1959 host target gene. PTPRG BINDING SITE is HOST TARGET binding site found in the 5' untranslated region of mRNA encoded by PTPRG, corresponding to a HOST TARGET binding site such as BINDING SITE I, BINDING SITE II or BINDING SITE III. Table 2 illustrates the complementarity of the nucleotide sequences of PTPRG BINDING SITE, designated SEQ ID:8726, to the nucleotide sequence of VGAM1959 RNA, herein designated VGAM RNA, also designated SEQ ID:4670.

Another function of VGAM1959 is therefore inhibition of Protein Tyrosine Phosphatase, Receptor Type, G (PTPRG, Accession NM_002841), a gene which is a candidate tumor suppressor and represents a subfamily of receptor tyrosine phosphatases. Accordingly, utilities of VGAM1959 include diagnosis, prevention and treatment of diseases and clinical conditions associated with PTPRG. The function of PTPRG and its association with various diseases and clinical conditions, has been established by previous studies, as described hereinabove with reference to VGAM1924. RAD9 Homolog (S. pombe) (RAD9, Accession NM_004584) is another VGAM1959 host target gene. RAD9 BINDING SITE is HOST TARGET binding site found in the 3' untranslated region of mRNA encoded by RAD9, corresponding to a HOST TARGET binding site such as BINDING SITE I, BINDING SITE II or BINDING SITE III. Table 2 illustrates the complementarity of the nucleotide sequences of RAD9 BINDING SITE, designated SEQ ID:10932, to the nucleotide sequence of VGAM1959 RNA, herein designated VGAM RNA, also designated SEQ ID:4670.

Another function of VGAM1959 is therefore inhibition of RAD9 Homolog (S. pombe) (RAD9, Accession NM_004584), a gene which may function as a cell cycle checkpoint protein. Accordingly, utilities of VGAM1959 include diagnosis, prevention and treatment of diseases and clinical conditions associated with RAD9. The function of RAD9 has been established by previous studies. In S. pombe, rad9 is one of 6 genes essential for both the incomplete DNA replication (S-M) and DNA damage checkpoints. See HUS1 (OMIM Ref. No. 603760). By searching an EST database, Lieberman et al. (1996) identified a partial cDNA encoding HRAD9, a human rad9 homolog. The authors used the partial cDNA to recover additional human RAD9 cDNAs corresponding to the entire coding region. The predicted 391-amino acid human protein is 25% identical to S. pombe rad9. The human RAD9 gene partially complemented the hydroxyurea sensitivity, radiosensitivity, and checkpoint defects of rad9-null mutant cells. On immunoblots of mammalian cell extracts, Volkmer and Karnitz (1999) found that human RAD9 migrated at 70 kD, even though it has a predicted molecular mass of 45 kD. The authors attributed this discrepancy to complex posttranslational modifications. In vivo, the human RAD9 protein was phosphorylated in response to DNA damage, suggesting that it participates in a DNA damage-inducible signaling pathway. Immunoprecipitation studies demonstrated that the fully modified form of RAD9 interacts selectively with RAD1 (OMIM Ref. No. 603153) and HUS1 in a stable complex. Volkmer and Karnitz (1999) concluded that these 3 proteins are central components of a DNA damage-responsive protein complex in human cells.

Full details of the abovementioned studies are described in the following publications, the disclosure of which are hereby incorporated by reference:

Lieberman, H. B.; Hopkins, K. M.; Nass, M.; Demetrick, D.; Davey, S.: A human homolog of the Schizosaccharomyces pombe rad9+ checkpoint control gene. Proc. Nat. Acad. Sci. 93:13890-13895, 1996; and Volkmer, E.; Karnitz, L. M.: Human homologs of Schizosaccharomyces pombe Rad1, Hus1, and Rad9 form a DNA damage-responsive protein complex. J. Biol. Chem. 274:567-570, 1999.

Further studies establishing the function and utilities of RAD9 are found in John Hopkins OMIM database record ID 603761, and in sited publications numbered 7626 listed in the bibliography section hereinbelow, which are also hereby incorporated by reference. RalA Binding Protein 1 (RALBP1, Accession NM_006788) is another VGAM1959 host target gene. RALBP1 BINDING SITE is HOST TARGET binding site found in the 3' untranslated region of mRNA encoded by RALBP1, corresponding to a HOST TARGET binding site such as BINDING SITE I, BINDING SITE II or BINDING SITE III. Table 2 illustrates the complementarity of the nucleotide sequences of RALBP1 BINDING SITE, designated SEQ ID:13659, to the nucleotide sequence of VGAM1959 RNA, herein designated VGAM RNA, also designated SEQ ID:4670.

Another function of VGAM1959 is therefore inhibition of RalA Binding Protein 1 (RALBP1, Accession NM_006788), a gene which plays a role in signal transduction and catalyzes the transport of glutathione conjugates and xenobiotics. Accordingly, utilities of VGAM1959 include diagnosis, prevention and treatment of diseases and clinical conditions associated with RALBP1. The function of RALBP1 and its association with various diseases and clinical conditions, has been established by previous studies, as described hereinabove with reference to VGAM345. RAN Binding Protein 3 (RANBP3, Accession NM_007321) is another VGAM1959 host target gene. RANBP3 BINDING SITE is HOST TARGET binding site found in the 5' untranslated region of mRNA encoded by RANBP3, corresponding to a HOST TARGET binding site such as BINDING SITE I, BINDING SITE II or BINDING SITE III. Table 2 illustrates the complementarity of the nucleotide sequences of RANBP3 BINDING SITE, designated SEQ ID:14237, to the nucleotide sequence of VGAM1959 RNA, herein designated VGAM RNA, also designated SEQ ID:4670.

Another function of VGAM1959 is therefore inhibition of RAN Binding Protein 3 (RANBP3, Accession NM_007321). Accordingly, utilities of VGAM1959 include diagnosis, prevention and treatment of diseases and clinical conditions associated with RANBP3. Ras Association (RalGDS/AF-6) Domain Family 1 (RASSF1, Accession NM_007182) is another VGAM1959 host target gene. RASSF1 BINDING SITE is HOST TARGET binding site found in the 3' untranslated region of mRNA encoded by RASSF1, corresponding to a HOST TARGET binding site such as BINDING SITE I, BINDING SITE II or BINDING SITE III. Table 2 illustrates the complementarity of the nucleotide sequences of RASSF1 BINDING SITE, designated SEQ ID:14038, to the nucleotide sequence of VGAM1959 RNA, herein designated VGAM RNA, also designated SEQ ID:4670.

Another function of VGAM1959 is therefore inhibition of Ras Association (RalGDS/AF-6) Domain Family 1 (RASSF1, Accession NM_007182), a gene which is a candidate renal tumor suppressor. Accordingly, utilities of VGAM1959 include diagnosis, prevention and treatment of diseases and clinical conditions associated with RASSF1. The function of RASSF1 has been established by previous studies. Allelic loss at the short arm of chromosome 3 is one of the most common and earliest events in the pathogenesis of lung cancer, and is observed in more than 90% of small cell lung cancers (SCLCs) and in 50 to 80% of non-small cell lung cancers (OMIM Ref. No. NSCLCs). Frequent and early loss of heterozygosity and the presence of homozygous deletions suggested a critical role of the region 3p21.3 in tumorigenesis, and a region of common homozygous deletion in 3p21.3 was narrowed to 120 kb by Sekido et al. (1998). Several putative tumor-suppressor genes located at 3p21 had been characterized, but none of these appeared to be altered in lung cancer. Dammann et al. (2000) described the cloning and characterization of a human RAS effector homolog, RASSF1, located in the 120-kb region of minimal homozygous deletion. They identified the RASSF1 protein through its interaction with the human DNA repair protein XPA (OMIM Ref. No. 278700) in a yeast 2-hybrid screen. Dammann et al. (2000) detected 3 transcripts, A, B, and C, derived from alternative splicing and promoter usage. The major transcripts A and C were expressed in all normal tissues tested. Transcript A was missing in all SCLC cell lines analyzed and in several other cancer cell lines. Loss of expression was correlated with methylation of the CpG island promoter sequence of RASSF1A. The promoter was highly methylated in 24 of 60 (40%) primary lung tumors, and 4 of 41 tumors analyzed carried missense mutations. Reexpression of transcript A in lung carcinoma cells reduced colony formation, suppressed anchorage-independent growth, and inhibited tumor formation in nude mice. These characteristics indicated a potential role for RASSF1A as a lung tumor suppressor. Dammann et al. (2000) found no mutations in 17 SCLC cell lines, but found 4 missense mutations in 41 primary NSCLCs.

Full details of the abovementioned studies are described in the following publications, the disclosure of which are hereby incorporated by reference:

Dammann, R.; Li, C.; Yoon, J.-H.; Chin, P. L.; Bates, S.; Pfeifer, G. P.: Epigenetic inactivation of a RAS association domain family protein from the lung tumour suppressor locus 3p21.3. Nature Genet. 25:315-319, 2000; and Sekido, Y.; Ahmadian, M.; Wistuba, I. I.; Latif, F.; Bader, S.; Wei, M.-H.; Duh, F.-M.; Gazdar, A. F.; Lerman, M. I.; Minna, J. D.: Cloning of a breast cancer homozygous deletion jun.

Further studies establishing the function and utilities of RASSF1 are found in John Hopkins OMIM database record ID 605082, and in sited publications numbered 6597-6599, 10 and 6600 listed in the bibliography section hereinbelow, which are also hereby incorporated by reference. Retinoblastoma Binding Protein 5 (RBBP5, Accession NM_005057) is another VGAM1959 host target gene. RBBP5 BINDING SITE is HOST TARGET binding site found in the 3' untranslated region of mRNA encoded by RBBP5, corresponding to a HOST TARGET binding site such as BINDING SITE I, BINDING SITE II or BINDING SITE III. Table 2 illustrates the complementarity of the nucleotide sequences of RBBP5 BINDING SITE, designated SEQ ID:11486, to the nucleotide sequence of VGAM1959 RNA, herein designated VGAM RNA, also designated SEQ ID:4670.

Another function of VGAM1959 is therefore inhibition of Retinoblastoma Binding Protein 5 (RBBP5, Accession NM_005057). Accordingly, utilities of VGAM1959 include diagnosis, prevention and treatment of diseases and clinical conditions associated with RBBP5. Regulator of Nonsense Transcripts 1 (RENT1, Accession NM_002911) is another VGAM1959 host target gene. RENT1 BINDING SITE is HOST TARGET binding site found in the 3' untranslated region of mRNA encoded by RENT1, corresponding to a HOST TARGET binding site such as BINDING SITE I, BINDING SITE II or BINDING SITE III. Table 2 illustrates the complementarity of the nucleotide sequences of RENT1 BINDING SITE, designated SEQ ID:8814, to the nucleotide sequence of VGAM1959 RNA, herein designated VGAM RNA, also designated SEQ ID:4670.

Another function of VGAM1959 is therefore inhibition of Regulator of Nonsense Transcripts 1 (RENT1, Accession NM_002911), a gene which eliminates the production of nonsense-containing RNAs in mammalian cells. Accordingly, utilities of VGAM1959 include diagnosis, prevention and treatment of diseases and clinical conditions associated with RENT1. The function of RENT1 has been established by previous studies. Sun et al. (1998) provided evidence for a factor that functions to eliminate the production of nonsense-containing RNAs in mammalian cells. They identified the factor, variously referred to as RENT1 and HUPF1, by isolating cDNA for a human homolog of S. cerevisiae Upf1p, which is a group I RNA helicase that functions in the nonsense-mediated decay of mRNA in yeast. Using monkey COS cells and human HeLa cells, Sun et al. (1998) demonstrated that expression of human Upf1 protein harboring an arginine-to-cysteine mutation at residue 844 within the RNA helicase domain acts in a dominant-negative fashion to abrogate the decay of nonsense-containing mRNA that takes place in association with nuclei or in the cytoplasm. These findings provided evidence that nonsense-mediated mRNA decay is related mechanistically in yeast and in mammalian cells, regardless of the cellular site of decay. Animal model experiments lend further support to the function of RENT1. Medghalchi et al. (2001) explored the consequences of loss of NMRD function in vertebrates through targeted disruption of the Rent1 gene, which encodes a mammalian ortholog of Upf1p, in murine embryonic stem cells. Mice heterozygous for the targeted allele showed no apparent phenotypic abnormalities but homozygosity was never observed, demonstrating that Rent1 is essential for embryonic viability. Homozygous targeted embryos showed complete loss of NMRD and were viable in the preimplantation period, but resorbed shortly after implantation. Furthermore, Rent1 -/- blastocysts isolated at 3.5 days postcoitum underwent apoptosis in culture following a brief phase of cellular expansion. The authors hypothesized that NMRD is essential for mammalian cellular viability and supports a critical role for the pathway in the regulated expression of selected physiologic transcripts.

It is appreciated that the abovementioned animal model for RENT1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sun, X.; Perlick, H. A.; Dietz, H. C.; Maquat, L. E.: A mutated human homologue to yeast Upf1 protein has a dominant-negative effect on the decay of nonsense-containing mRNAs in mammalian cells. Proc. Nat. Acad. Sci. 95:10009-10014, 1998; and Medghalchi, S. M.; Frischmeyer, P. A.; Mendell, J. T.; Kelly, A. G.; Lawler, A. M.; Dietz, H. C.: Rent1, a trans-effector of nonsense-mediated mRNA decay, is essential for mammalian em.

Further studies establishing the function and utilities of RENT1 are found in John Hopkins OMIM database record ID 601430, and in sited publications numbered 9277-9282 listed in the bibliography section hereinbelow, which are also hereby incorporated by reference. Regulator of G-protein Signalling 3 (RGS3, Accession NM_144488) is another VGAM1959 host target gene. RGS3 BINDING SITE1 through RGS3 BINDING SITE6 are HOST TARGET binding sites found in untranslated regions of mRNA encoded by RGS3, corresponding to HOST TARGET binding sites such as BINDING SITE I, BINDING SITE II or BINDING SITE III. Table 2 illustrates the complementarity of the nucleotide sequences of RGS3 BINDING SITE1 through RGS3 BINDING SITE6, designated SEQ ID:29306, SEQ ID:29308, SEQ ID:28282, SEQ ID:28668, SEQ ID:19423 and SEQ ID:22088 respectively, to the nucleotide sequence of VGAM1959 RNA, herein designated VGAM RNA, also designated SEQ ID:4670.

Another function of VGAM1959 is therefore inhibition of Regulator of G-protein Signalling 3 (RGS3, Accession NM_144488), a gene which negatively regulates G protein-coupled receptor signalling. Accordingly, utilities of VGAM1959 include diagnosis, prevention and treatment of diseases and clinical conditions associated with RGS3. The function of RGS3 and its association with various diseases and clinical conditions, has been established by previous studies, as described hereinabove with reference to VGAM404. RP42 (Accession NM_020640) is another VGAM1959 host target gene. RP42 BINDING SITE is HOST TARGET binding site found in the 3' untranslated region of mRNA encoded by RP42, corresponding to a HOST TARGET binding site such as BINDING SITE I, BINDING SITE II or BINDING SITE III. Table 2 illustrates the complementarity of the nucleotide sequences of RP42 BINDING SITE, designated SEQ ID:21803, to the nucleotide sequence of VGAM1959 RNA, herein designated VGAM RNA, also designated SEQ ID:4670.

Another function of VGAM1959 is therefore inhibition of RP42 (Accession NM_020640), a gene which not clear yet. Accordingly, utilities of VGAM1959 include diagnosis, prevention and treatment of diseases and clinical conditions associated with RP42. The function of RP42 and its association with various diseases and clinical conditions, has been established by previous studies, as described hereinabove with reference to VGAM47. Ribulose-5-phosphate-3-epimerase (RPE, Accession XM_030834) is another VGAM1959 host target gene. RPE BINDING SITE is HOST TARGET binding site found in the 3" untranslated region of mRNA encoded by RPE, corresponding to a HOST TARGET binding site such as BINDING SITE I, BINDING SITE II or BINDING SITE III. Table 2 illustrates the complementarity of the nucleotide sequences of RPE BINDING SITE, designated SEQ ID:31153, to the nucleotide sequence of VGAM1959 RNA, herein designated VGAM RNA, also designated SEQ ID:4670.

Another function of VGAM1959 is therefore inhibition of Ribulose-5-phosphate-3-epimerase (RPE, Accession XM_030834). Accordingly, utilities of VGAM1959 include diagnosis, prevention and treatment of diseases and clinical conditions associated with RPE. Stearoyl-CoA Desaturase (delta-9-desaturase) (SCD, Accession NM_005063) is another VGAM1959 host target gene. SCD BINDING SITE is HOST TARGET binding site found in the 3' untranslated region of mRNA encoded by SCD, corresponding to a HOST TARGET binding site such as BINDING SITE I, BINDING SITE II or BINDING SITE III. Table 2 illustrates the complementarity of the nucleotide sequences of SCD BINDING SITE, designated SEQ ID:11499, to the nucleotide sequence of VGAM1959 RNA, herein designated VGAM RNA, also designated SEQ ID:4670.

Another function of VGAM1959 is therefore inhibition of Stearoyl-CoA Desaturase (delta-9-desaturase) (SCD, Accession NM_005063), a gene which functions in the synthesis of unsaturated fatty acids. Accordingly, utilities of VGAM1959 include diagnosis, prevention and treatment of diseases and clinical conditions associated with SCD. The function of SCD and its association with various diseases and clinical conditions, has been established by previous studies, as described hereinabove with reference to VGAM314. Sodium Channel, Voltage-gated, Type I, Alpha Polypeptide (SCN1A, Accession XM_114281) is another VGAM1959 host target gene. SCN1A BINDING SITE is HOST TARGET binding site found in the 5' untranslated region of mRNA encoded by SCN1A, corresponding to a HOST TARGET binding site such as BINDING SITE I, BINDING SITE II or BINDING SITE III. Table 2 illustrates the complementarity of the nucleotide sequences of SCN1A BINDING SITE, designated SEQ ID:42834, to the nucleotide sequence of VGAM1959 RNA, herein designated VGAM RNA, also designated SEQ ID:4670.

Another function of VGAM1959 is therefore inhibition of Sodium Channel, Voltage-gated, Type I, Alpha Polypeptide (SCN1A, Accession XM_114281). Accordingly, utilities of VGAM1959 include diagnosis, prevention and treatment of diseases and clinical conditions associated with SCN1A. Succinate Dehydrogenase Complex, Subunit D, Integral Membrane Protein (SDHD, Accession NM_003002) is another VGAM1959 host target gene. SDHD BINDING SITE is HOST TARGET binding site found in the 3' untranslated region of mRNA encoded by SDHD, corresponding to a HOST TARGET binding site such as BINDING SITE I, BINDING SITE II or BINDING SITE III. Table 2 illustrates the complementarity of the nucleotide sequences of SDHD BINDING SITE, designated SEQ ID:8896, to the nucleotide sequence of VGAM1959 RNA, herein designated VGAM RNA, also designated SEQ ID:4670.

Another function of VGAM1959 is therefore inhibition of Succinate Dehydrogenase Complex, Subunit D, Integral Membrane Protein (SDHD, Accession NM_003002). Accordingly, utilities of VGAM1959 include diagnosis, prevention and treatment of diseases and clinical conditions associated with SDHD. Serine (or cysteine) Proteinase Inhibitor, Clade B (ovalbumin), Member 5 (SERPINB5, Accession NM_002639) is another VGAM1959 host target gene. SERPINB5 BINDING SITE is HOST TARGET binding site found in the 3' untranslated region of mRNA encoded by SERPINB5, corresponding to a HOST TARGET binding site such as BINDING SITE I, BINDING SITE II or BINDING SITE III. Table 2 illustrates the complementarity of the nucleotide sequences of SERPINB5 BINDING SITE, designated SEQ ID:8495, to the nucleotide sequence of VGAM1959 RNA, herein designated VGAM RNA, also designated SEQ ID:4670.

Another function of VGAM1959 is therefore inhibition of Serine (or cysteine) Proteinase Inhibitor, Clade B (ovalbumin), Member 5 (SERPINB5, Accession NM_002639), a gene which may be a serpin serine protease inhibitor and supresses tumor metastasis. Accordingly, utilities of VGAM1959 include diagnosis, prevention and treatment of diseases and clinical conditions associated with SERPINB5. The function of SERPINB5 has been established by previous studies. The nucleotide 5-methylcytosine is involved in processes crucial to mammalian development, such as X-chromosome inactivation and gene imprinting. In addition, cytosine methylation may be involved in the establishment and maintenance of cell type-specific expression of developmentally regulated genes; however, it is difficult to identify clear examples of such genes, particularly in human S. Futscher et al. (2002) provided evidence that cytosine methylation of the maspin gene promoter controls, in part, normal cell type-specific SERPINB5 expression. In normal cells expressing SERPINB5, the SERPINB5 promoter is unmethylated and the promoter region has acetylated histones and an accessible chromatin structure. In contrast, normal cells that do not express SERPINB5 have a completely methylated SERPINB5 promoter with hypoacetylated histones, an inaccessible chromatin structure, and a transcriptional repression that is relieved by inhibition of DNA methylation. These findings indicated that cytosine methylation is important in the establishment and maintenance of cell type-restricted gene expression. Zou et al. (1994) used subtractive hybridization and the 'differential display' method to identify candidate tumor suppressor genes that are defective in human breast carcinoma cells. These genes were identified initially by searching for mRNAs whose expression is reduced or absent in tumor cells compared with normal cells grown under similar conditions. Zou et al. (1994) reported the characteristics of one of the more than 30 genes so identified, a member of the serpin family of protease inhibitors which they termed maspin. A single 3.0-kb maspin mRNA was expressed in normal mammary epithelial cell strains, but not in most mammary tumor cell lines examined. Southern blot analysis of XbaI-restricted DNA from normal and tumor cells with a maspin cDNA probe revealed no gross structural alterations of the maspin gene in the tumor cells. This result suggested that the maspin gene is downregulated but not mutated in cancer cells. Transfection of mammary carcinoma cells with the maspin gene did not alter the growth properties of the cells in vitro, but reduced their ability to induce tumors and metastasize in nude mice and to invade through a basement membrane matrix in vitro. Analysis of human breast cancer specimens demonstrated that loss of maspin expression occurred most frequently in advanced cancers. These results supported the hypothesis that maspin functions as a tumor suppressor.

Full details of the abovementioned studies are described in the following publications, the disclosure of which are hereby incorporated by reference:

Zou, Z.; Anisowicz, A.; Hendrix, M. J. C.; Thor, A.; Neveu, M.; Sheng, S.; Rafidi, K.; Seftor, E.; Sager, R.: Maspin, a serpin with tumor-suppressing activity in human mammary epithelial cells. Science 263:526-529, 1994; and Futscher, B. W.; Oshiro, M. M.; Wozniak, R. J.; Holtan, N.; Hanigan, C. L.; Duan, H.; Domann, F. E.: Role for DNA methylation in the control of cell type-specific maspin expression. Nat.

Further studies establishing the function and utilities of SERPINB5 are found in John Hopkins OMIM database record ID 154790, and in sited publications numbered 2962-2963, 36 and 2964 listed in the bibliography section hereinbelow, which are also hereby incorporated by reference. Splicing Factor 1 (SF1, Accession NM_004630) is another VGAM1959 host target gene. SF1 BINDING SITE is HOST TARGET binding site found in the 5' untranslated region of mRNA encoded by SF1, corresponding to a HOST TARGET binding site such as BINDING SITE I, BINDING SITE II or BINDING SITE III. Table 2 illustrates the complementarity of the nucleotide sequences of SF1 BINDING SITE, designated SEQ ID:11001, to the nucleotide sequence of VGAM1959 RNA, herein designated VGAM RNA, also designated SEQ ID:4670.

Another function of VGAM1959 is therefore inhibition of Splicing Factor 1 (SF1, Accession NM_004630), a gene which is a transcriptional repressor and splicing factor. Accordingly, utilities of VGAM1959 include diagnosis, prevention and treatment of diseases and clinical conditions associated with SF1. The function of SF1 and its association with various diseases and clinical conditions, has been established by previous studies, as described hereinabove with reference to VGAM934. SH3-domain Binding Protein 2 (SH3BP2, Accession NM_003023) is another VGAM1959 host target gene. SH3BP2 BINDING SITE is HOST TARGET binding site found in the 3' untranslated region of mRNA encoded by SH3BP2, corresponding to a HOST TARGET binding site such as BINDING SITE I, BINDING SITE II or BINDING SITE III. Table 2 illustrates the complementarity of the nucleotide sequences of SH3BP2 BINDING SITE, designated SEQ ID:8951, to the nucleotide sequence of VGAM1959 RNA, herein designated VGAM RNA, also designated SEQ ID:4670.

Another function of VGAM1959 is therefore inhibition of SH3-domain Binding Protein 2 (SH3BP2, Accession NM_003023). Accordingly, utilities of VGAM1959 include diagnosis, prevention and treatment of diseases and clinical conditions associated with SH3BP2. Single-minded Homolog 2 (Drosophila) (SIM2, Accession NM_005069) is another VGAM1959 host target gene. SIM2 BINDING SITE1 and SIM2 BINDING SITE2 are HOST TARGET binding sites found in untranslated regions of mRNA encoded by SIM2, corresponding to HOST TARGET binding sites such as BINDING SITE I, BINDING SITE II or BINDING SITE III. Table 2 illustrates the complementarity of the nucleotide sequences of SIM2 BINDING SITE1 and SIM2 BINDING SITE2, designated SEQ ID:11518 and SEQ ID:14311 respectively, to the nucleotide sequence of VGAM1959 RNA, herein designated VGAM RNA, also designated SEQ ID:4670.

Another function of VGAM1959 is therefore inhibition of Single-minded Homolog 2 (Drosophila) (SIM2, Accession NM_005069), a gene which may be a master gene of cns development. Accordingly, utilities of VGAM1959 include diagnosis, prevention and treatment of diseases and clinical conditions associated with SIM2. The function of SIM2 and its association with various diseases and clinical conditions, has been established by previous studies, as described hereinabove with reference to VGAM369. Solute Carrier Family 1 (neutral amino acid transporter), Member 5 (SLC1A5, Accession NM_005628) is another VGAM1959 host target gene. SLC1A5 BINDING SITE1 and SLC1A5 BINDING SITE2 are HOST TARGET binding sites found in untranslated regions of mRNA encoded by SLC1A5, corresponding to HOST TARGET binding sites such as BINDING SITE I, BINDING SITE II or BINDING SITE III. Table 2 illustrates the complementarity of the nucleotide sequences of SLC1A5 BINDING SITE1 and SLC1A5 BINDING SITE2, designated SEQ ID:12144 and SEQ ID:9525 respectively, to the nucleotide sequence of VGAM1959 RNA, herein designated VGAM RNA, also designated SEQ ID:4670.

Another function of VGAM1959 is therefore inhibition of Solute Carrier Family 1 (neutral amino acid transporter), Member 5 (SLC1A5, Accession NM_005628). Accordingly, utilities of VGAM1959 include diagnosis, prevention and treatment of diseases and clinical conditions associated with SLC1A5. Solute Carrier Family 7 (cationic amino acid transporter, y+ system), Member 6 (SLC7A6, Accession NM_003983) is another VGAM1959 host target gene. SLC7A6 BINDING SITE is HOST TARGET binding site found in the 3' untranslated region of mRNA encoded by SLC7A6, corresponding to a HOST TARGET binding site such as BINDING SITE I, BINDING SITE II or BINDING SITE III. Table 2 illustrates the complementarity of the nucleotide sequences of SLC7A6 BINDING SITE, designated SEQ ID:10133, to the nucleotide sequence of VGAM1959 RNA, herein designated VGAM RNA, also designated SEQ ID:4670.

Another function of VGAM1959 is therefore inhibition of Solute Carrier Family 7 (cationic amino acid transporter, y+ system), Member 6 (SLC7A6, Accession NM_003983), a gene which is involved in mediating amino acid transport. Accordingly, utilities of VGAM1959 include diagnosis, prevention and treatment of diseases and clinical conditions associated with SLC7A6. The function of SLC7A6 and its association with various diseases and clinical conditions, has been established by previous studies, as described hereinabove with reference to VGAM87. SRY (sex determining region Y)-box 12 (SOX12, Accession NM_006943) is another VGAM1959 host target gene. SOX12 BINDING SITE is HOST TARGET binding site found in the 3' untranslated region of mRNA encoded by SOX12, corresponding to a HOST TARGET binding site such as BINDING SITE I, BINDING SITE II or BINDING SITE III. Table 2 illustrates the complementarity of the nucleotide sequences of SOX12 BINDING SITE, designated SEQ ID:13831, to the nucleotide sequence of VGAM1959 RNA, herein designated VGAM RNA, also designated SEQ ID:4670.

Another function of VGAM1959 is therefore inhibition of SRY (sex determining region Y)-box 12 (SOX12, Accession NM_006943). Accordingly, utilities of VGAM1959 include diagnosis, prevention and treatment of diseases and clinical conditions associated with SOX12. SRGAP2 (Accession XM_059095) is another VGAM1959 host target gene. SRGAP2 BINDING SITE is HOST TARGET binding site found in the 3' untranslated region of mRNA encoded by SRGAP2, corresponding to a HOST TARGET binding site such as BINDING SITE I, BINDING SITE II or BINDING SITE III. Table 2 illustrates the complementarity of the nucleotide sequences of SRGAP2 BINDING SITE, designated SEQ ID:36879, to the nucleotide sequence of VGAM1959 RNA, herein designated VGAM RNA, also designated SEQ ID:4670.

Another function of VGAM1959 is therefore inhibition of SRGAP2 (Accession XM_059095). Accordingly, utilities of VGAM1959 include diagnosis, prevention and treatment of diseases and clinical conditions associated with SRGAP2.

Signal Transducing Adaptor Molecule (SH3 domain and ITAM motif) 1 (STAM, Accession NM_003473) is another VGAM1959 host target gene. STAM BINDING SITE is HOST TARGET binding site found in the 3' untranslated region of mRNA encoded by STAM, corresponding to a HOST TARGET binding site such as BINDING SITE I, BINDING SITE II or BINDING SITE III. Table 2 illustrates the complementarity of the nucleotide sequences of STAM BINDING SITE, designated SEQ ID:9542, to the nucleotide sequence of VGAM1959 RNA, herein designated VGAM RNA, also designated SEQ ID:4670.

Another function of VGAM1959 is therefore inhibition of Signal Transducing Adaptor Molecule (SH3 domain and ITAM motif) 1 (STAM, Accession NM_003473), a gene which is as an adaptor molecule involved in the downstream signaling of cytokine receptors. Accordingly, utilities of VGAM1959 include diagnosis, prevention and treatment of diseases and clinical conditions associated with STAM. The function of STAM and its association with various diseases and clinical conditions, has been established by previous studies, as described hereinabove with reference to VGAM927. Suppressor of Ty 6 Homolog (S. cerevisiae) (SUPT6H, Accession XM_017037) is another VGAM1959 host target gene. SUPT6H BINDING SITE is HOST TARGET binding site found in the 5' untranslated region of mRNA encoded by SUPT6H, corresponding to a HOST TARGET binding site such as BINDING SITE I, BINDING SITE II or BINDING SITE III. Table 2 illustrates the complementarity of the nucleotide sequences of SUPT6H BINDING SITE, designated SEQ ID:30293, to the nucleotide sequence of VGAM1959 RNA, herein designated VGAM RNA, also designated SEQ ID:4670.

Another function of VGAM1959 is therefore inhibition of Suppressor of Ty 6 Homolog (S. cerevisiae) (SUPT6H, Accession XM_017037), a gene which may normally act to repress transcription at a variety of loci, and also plays a role in chromatin structure or assembly. Accordingly, utilities of VGAM1959 include diagnosis, prevention and treatment of diseases and clinical conditions associated with SUPT6H. The function of SUPT6H has been established by previous studies. Chiang et al. (1996) isolated and sequenced SUPT6H and Supt6h, the human and murine homologs of the Saccharomyces cerevisiae and Caenorhabditis elegans genes SPT6 and emb-5, respectively. The human and murine SPT6 homologs are virtually identical, as they share more than 98% identity and more than 99% similarity at the protein level. The derived amino acid sequences of these 2 genes predicted a 1,603-amino acid polypeptide in human and a 1,726-amino acid polypeptide in mouse, respectively. The proteins have a highly acidic 5-prime region, a degenerate SH2 domain, and a leucine zipper, features consistent with a nuclear protein that regulates transcription. Northern blotting revealed a 7.0-kb transcript that was expressed constitutively in both mouse and human. Chiang et al. (1996) commented that SUPT6H appears to be functionally analogous to SPT6 and emb-5 and may therefore regulate transcription through establishment or maintenance of chromatin structure. By PCR-based analysis of somatic cell hybrids and by fluorescence in situ hybridization, Chiang et al. (1996) mapped the human homolog to 17q11.2. Segre et al. (1995) detected a cDNA fragment from the Supt6h gene on a mouse YAC that also contained the 'nude' locus. Their data placed Supt6h approximately 100 kb from whn (OMIM Ref. No. 600838), which is located on mouse chromosome 11. Thus, the Supt6h gene was mapped to mouse chromosome 11B1, which exhibits extensive homology of synteny with proximal human 17q.

Full details of the abovementioned studies are described in the following publications, the disclosure of which are hereby incorporated by reference:

Chiang, P.-W.; Wang, S.; Smithivas, P.; Song, W.-J.; Ramamoorthy, S.; Hillman, J.; Puett, S.; Van Keuren, M. L.; Crombez, E.; Kumar, A.; Glover, T. W.; Miller, D. E.; Tsai, C.-H.; Blackburn, C. C.; Chen, X.-N.; Sun, Z.; Cheng, J.-F.; Korenberg, J. R.; Kurnit, D. M.: Identification and analysis of the human and murine putative chromatin structure regulator SUPT6H and Supt6h. Genomics 34:328-333, 1996; and Segre, J. A.; Nemhauser, J. L.; Taylor, B. A.; Nadeau, J. H.; Lander, E. S.: Positional cloning of the nude locus: genetic, physical and transcription maps of the region and mutations.

Further studies establishing the function and utilities of SUPT6H are found in John Hopkins OMIM database record ID 601333, and in sited publications numbered 9480-9481 listed in the bibliography section hereinbelow, which are also hereby incorporated by reference. TATA Box Binding Protein (TBP)-associated Factor, RNA Polymerase I, C, 110 kDa (TAF1C, Accession NM_005679) is another VGAM1959 host target gene. TAF1C BINDING SITE is HOST TARGET binding site found in the 5' untranslated region of mRNA encoded by TAF1C, corresponding to a HOST TARGET binding site such as BINDING SITE I, BINDING SITE II or BINDING SITE III. Table 2 illustrates the complementarity of the nucleotide sequences of TAF1C BINDING SITE, designated SEQ ID:12237, to the nucleotide sequence of VGAM1959 RNA, herein designated VGAM RNA, also designated SEQ ID:4670.

Another function of VGAM1959 is therefore inhibition of TATA Box Binding Protein (TBP)-associated Factor, RNA Polymerase I, C, 110 kDa (TAF1C, Accession NM_005679), a gene which belongs to component of the RNA polymerase I and II SL1 transcription factor. Accordingly, utilities of VGAM1959 include diagnosis, prevention and treatment of diseases and clinical conditions associated with TAF1C. The function of TAF1C and its association with various diseases and clinical conditions, has been established by previous studies, as described hereinabove with reference to VGAM191. TAF7 RNA Polymerase II, TATA Box Binding Protein (TBP)-associated Factor, 55 kDa (TAF7, Accession NM_005642) is another VGAM1959 host target gene. TAF7 BINDING SITE1 and TAF7 BINDING SITE2 are HOST TARGET binding sites found in untranslated regions of mRNA encoded by TAF7, corresponding to HOST TARGET binding sites such as BINDING SITE I, BINDING SITE II or BINDING SITE III. Table 2 illustrates the complementarity of the nucleotide sequences of TAF7 BINDING SITE1 and TAF7 BINDING SITE2, designated SEQ ID:12175 and SEQ ID:12177 respectively, to the nucleotide sequence of VGAM1959 RNA, herein designated VGAM RNA, also designated SEQ ID:4670.

Another function of VGAM1959 is therefore inhibition of TAF7 RNA Polymerase II, TATA Box Binding Protein (TBP)-associated Factor, 55 kDa (TAF7, Accession NM_005642), a gene which may function as a coactivator of transcription with some activators. Accordingly, utilities of VGAM1959 include diagnosis, prevention and treatment of diseases and clinical conditions associated with TAF7. The function of TAF7 and its association with various diseases and clinical conditions, has been established by previous studies, as described hereinabove with reference to VGAM1316. Transcription Factor 2, Hepatic; LF-B3; Variant Hepatic Nuclear Factor (TCF2, Accession NM_006481) is another VGAM1959 host target gene. TCF2 BINDING SITE1 and TCF2 BINDING SITE2 are HOST TARGET binding sites found in untranslated regions of mRNA encoded by TCF2, corresponding to HOST TARGET binding sites such as BINDING SITE I, BINDING SITE II or BINDING SITE III. Table 2 illustrates the complementarity of the nucleotide sequences of TCF2 BINDING SITE1 and TCF2 BINDING SITE2, designated SEQ ID:13204 and SEQ ID:13205 respectively, to the nucleotide sequence of VGAM1959 RNA, herein designated VGAM RNA, also designated SEQ ID:4670.

Another function of VGAM1959 is therefore inhibition of Transcription Factor 2, Hepatic; LF-B3; Variant Hepatic Nuclear Factor (TCF2, Accession NM_006481), a gene which probably binds to the inverted palindrome 5'-gttaatnattaac-3'. Accordingly, utilities of VGAM1959 include diagnosis, prevention and treatment of diseases and clinical conditions associated with TCF2. The function of TCF2 and its association with various diseases and clinical conditions, has been established by previous studies, as described hereinabove with reference to VGAM118. Transcription Factor 4 (TCF4, Accession NM_003199) is another VGAM1959 host target gene. TCF4 BINDING SITE is HOST TARGET binding site found in the 5' untranslated region of mRNA encoded by TCF4, corresponding to a HOST TARGET binding site such as BINDING SITE I, BINDING SITE II or BINDING SITE III. Table 2 illustrates the complementarity of the nucleotide sequences of TCF4 BINDING SITE, designated SEQ ID:9187, to the nucleotide sequence of VGAM1959 RNA, herein designated VGAM RNA, also designated SEQ ID:4670.

Another function of VGAM1959 is therefore inhibition of Transcription Factor 4 (TCF4, Accession NM_003199), a gene which is a transcriptional activator; interacts with ITF1 (TCF3); and contains basic helix-loop-helix domain. Accordingly, utilities of VGAM1959 include diagnosis, prevention and treatment of diseases and clinical conditions associated with TCF4. The function of TCF4 has been established by previous studies. The high mobility group (HMG) box is a DNA-binding domain. TCF7 (OMIM Ref. No. 189908), also called TCF1, and LEF1 (OMIM Ref. No. 153245), also called TCF1-alpha, are human lymphoid transcription factors that contain a virtually identical HMG box. By PCR of human genomic DNA using degenerate oligonucleotides based on the HMG boxes of TCF7 and LEF1, Castrop et al. (1992) identified the TCF7L1 (OMIM Ref. No. 604652) and TCF7L2 genes, which they called TCF3 and TCF4, respectively. TCF7L1 and TCF7L2 were not expressed in cells of the lymphoid lineage. The deduced amino acid sequences of the HMG boxes of TCF7L1, TCF7L2, and TCF7 show striking homology. The authors suggested the existence of a subfamily of TCF7-like HMG box-containing transcription factors. Animal model experiments lend further support to the function of TCF4. To study the physiologic role of Tcf4 (which is encoded by the Tcf7l2 gene), Korinek et al. (1998) disrupted Tcf7l2 by homologous recombination. The homozygous null mice died shortly after birth. A single histopathologic abnormality was observed. An apparently normal transition of intestinal endoderm into epithelium occurred at approximately embryonic day (E) 14.5. However, no proliferative compartments were maintained in the prospective crypt regions between the villi. As a consequence, the neonatal epithelium was composed entirely of differentiated, nondividing villus cells. Korinek et al. (1998) concluded that the genetic program controlled by Tcf7l2 maintains the crypt stem cells of the small intestine. The constitutive activity of Tcf4 in APC-deficient epithelial cells may contribute to their malignant transformation by maintaining stem cell characteristics.

It is appreciated that the abovementioned animal model for TCF4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Castrop, J.; van Norren, K.; Clevers, H.: A gene family of HMG-box transcription factors with homology to TCF-1. Nucleic Acids Res. 20:611 only, 1992; and Korinek, V.; Barker, N.; Moerer, P.; van Donselaar, E.; Huls, G.; Peters, P. J.; Clevers, H.: Depletion of epithelial stem-cell compartments in the small intestine of mice lacking Tcf-4.

Further studies establishing the function and utilities of TCF4 are found in John Hopkins OMIM database record ID 602228, and in sited publications numbered 5893-589 and 2303-2305 listed in the bibliography section hereinbelow, which are also hereby incorporated by reference. T-cell, Immune Regulator 1, ATPase, H+ Transporting, Lysosomal V0 Protein A Isoform 3 (TCIRG1, Accession NM_006053) is another VGAM1959 host target gene. TCIRG1 BINDING SITE is HOST TARGET binding site found in the 5' untranslated region of mRNA encoded by TCIRG1, corresponding to a HOST TARGET binding site such as BINDING SITE I, BINDING SITE II or BINDING SITE III. Table 2 illustrates the complementarity of the nucleotide sequences of TCIRG1 BINDING SITE, designated SEQ ID:12690, to the nucleotide sequence of VGAM1959 RNA, herein designated VGAM RNA, also designated SEQ ID:4670.

Another function of VGAM1959 is therefore inhibition of T-cell, Immune Regulator 1, ATPase, H+ Transporting, Lysosomal V0 Protein A Isoform 3 (TCIRG1, Accession NM_006053), a gene which seems to be directly involved in t cell activation. Accordingly, utilities of VGAM1959 include diagnosis, prevention and treatment of diseases and clinical conditions associated with TCIRG1. The function of TCIRG1 and its association with various diseases and clinical conditions, has been established by previous studies, as described hereinabove with reference to VGAM1707. Thyroid Hormone Receptor, Alpha (erythroblastic leukemia viral (v-erb-a) Oncogene Homolog, Avian) (THRA, Accession NM_003250) is another VGAM1959 host target gene. THRA BINDING SITE is HOST TARGET binding site found in the 5' untranslated region of mRNA encoded by THRA, corresponding to a HOST TARGET binding site such as BINDING SITE I, BINDING SITE II or BINDING SITE III. Table 2 illustrates the complementarity of the nucleotide sequences of THRA BINDING SITE, designated SEQ ID:9258, to the nucleotide sequence of VGAM1959 RNA, herein designated VGAM RNA, also designated SEQ ID:4670.

Another function of VGAM1959 is therefore inhibition of Thyroid Hormone Receptor, Alpha (erythroblastic leukemia viral (v-erb-a) Oncogene Homolog, Avian) (THRA, Accession NM_003250), a gene which is a high affinity receptor for thyroid hormone. Accordingly, utilities of VGAM1959 include diagnosis, prevention and treatment of diseases and clinical conditions associated with THRA. The function of THRA has been established by previous studies. Debuire et al. (1984) found that ERBA, which potentiates ERBB (OMIM Ref. No. 131550), has an amino acid sequence different from that of other known oncogene products and related to those of the carbonic anhydrases. ERBA potentiates ERBB by blocking differentiation of erythroblasts at an immature stage. Carbonic anhydrases participate in the transport of carbon dioxide in erythrocytes. Sap et al. (1986) and Weinberger et al. (1986) showed that the ERBA protein is a high-affinity receptor for thyroid hormone. The cDNA sequence indicates a relationship to steroid-hormone receptors, and binding studies indicate that it is a receptor for thyroid hormones. It is located in the nucleus, where it binds to DNA and activates transcription. McCabe et al. (1999) hypothesized that aberrant THRA expression in nonfunctioning pituitary tumors may reflect mutations in the receptor coding and regulatory sequences. They screened THRA mRNA and THRB response elements and ligand-binding domains for sequence anomalies. Screening THRA mRNA from 23 tumors by RNase mismatch and sequencing candidate fragments identified 1 silent and 3 missense mutations, 2 in the common THRA region (190120.0001, 190120.0002) and 1 that was specific for the alpha-2 isoform (190120.0003). No THRB response element differences were detected in 14 nonfunctioning tumors, and no THRB ligand-binding domain differences were detected in 23 nonfunctioning tumors. The authors suggested that the novel thyroid receptor mutations may be of functional significance in terms of thyroid receptor action, and further definition of their functional properties may provide insight into the role of thyroid receptors in growth control in pituitary cells. Animal model experiments lend further support to the function of THRA. To evaluate the respective contributions of THRA and THRB in the regulation of CYP7A (OMIM Ref. No. 118455), the rate-limiting enzyme in the synthesis of bile acids, Gullberg et al. (2000) studied the responses to 2% dietary cholesterol and T3 in THRA and THRB knockout mice under hypo- and hyperthyroid conditions. Their experiments showed that the normal stimulation in CYP7A activity and mRNA level by T3 is lost in THRB -/-, but not in THRA -/-, mice, identifying THRB as the mediator of T3 action on CYP7A and, consequently, as a major regulator of cholesterol metabolism in vivo. Somewhat unexpectedly, T3-deficient THRB -/- mice showed an augmented CYP7A response after challenge with dietary cholesterol, and these animals did not develop hypercholesterolemia to the extent that wildtype controls did. The authors concluded that the latter results lend strong support to the concept that THRs may exert regulatory effects in vivo independent of T3.

It is appreciated that the abovementioned animal model for THRA is acknowledged by those skilled in the art as a scientifically valid animal model, as can be further appreciated from the publications sited hereinbelow.

Full details of the abovementioned studies are described in the following publications, the disclosure of which are hereby incorporated by reference:

Weinberger, C.; Thompson, C. C.; Ong, E. S.; Lebo, R.; Gruol, D. J.; Evans, R. M.: The c-erb-A gene encodes a thyroid hormone receptor. Nature 324:641-646, 1986; and Gullberg, H.; Rudling, M.; Forrest, D.; Angelin, B.; Vennstrom, B.: Thyroid hormone receptor beta-deficient mice show complete loss of the normal cholesterol 7-alpha-hydroxylase (CYP7A).

Further studies establishing the function and utilities of THRA are found in John Hopkins OMIM database record ID 190120, and in sited publications numbered 11591-9823, 10340, 1074 and 10569-10571 listed in the bibliography section hereinbelow, which are also hereby incorporated by reference. TIC (Accession NM_012455) is another VGAM1959 host target gene. TIC BINDING SITE is HOST TARGET binding site found in the 3' untranslated region of mRNA encoded by TIC, corresponding to a HOST TARGET binding site such as BINDING SITE I, BINDING SITE II or BINDING SITE III. Table 2 illustrates the complementarity of the nucleotide sequences of TIC BINDING SITE, designated SEQ ID:14830, to the nucleotide sequence of VGAM1959 RNA, herein designated VGAM RNA, also designated SEQ ID:4670.

Another function of VGAM1959 is therefore inhibition of TIC (Accession NM_012455). Accordingly, utilities of VGAM1959 include diagnosis, prevention and treatment of diseases and clinical conditions associated with TIC. TIM3 (Accession NM_032782) is another VGAM1959 host target gene. TIM3 BINDING SITE is HOST TARGET binding site found in the 3' untranslated region of mRNA encoded by TIM3, corresponding to a HOST TARGET binding site such as BINDING SITE I, BINDING SITE II or BINDING SITE III. Table 2 illustrates the complementarity of the nucleotide sequences of TIM3 BINDING SITE, designated SEQ ID:26526, to the nucleotide sequence of VGAM1959 RNA, herein designated VGAM RNA, also designated SEQ ID:4670.

Another function of VGAM1959 is therefore inhibition of TIM3 (Accession NM_032782), a gene which regulates macrophage activation and enhances the severity of experimental autoimmune encephalomyelitis in mice. Accordingly, utilities of VGAM1959 include diagnosis, prevention and treatment of diseases and clinical conditions associated with TIM3. The function of TIM3 and its association with various diseases and clinical conditions, has been established by previous studies, as described hereinabove with reference to VGAM909. Translocase of Outer Mitochondrial Membrane 22 Homolog (yeast) (TOMM22, Accession NM_020243) is another VGAM1959 host target gene. TOMM22 BINDING SITE is HOST TARGET binding site found in the 3' untranslated region of mRNA encoded by TOMM22, corresponding to a HOST TARGET binding site such as BINDING SITE I, BINDING SITE II or BINDING SITE III. Table 2 illustrates the complementarity of the nucleotide sequences of TOMM22 BINDING SITE, designated SEQ ID:21517, to the nucleotide sequence of VGAM1959 RNA, herein designated VGAM RNA, also designated SEQ ID:4670.

Another function of VGAM1959 is therefore inhibition of Translocase of Outer Mitochondrial Membrane 22 Homolog (yeast) (TOMM22, Accession NM_020243). Accordingly, utilities of VGAM1959 include diagnosis, prevention and treatment of diseases and clinical conditions associated with TOMM22. Topoisomerase (DNA) III Beta (TOP3B, Accession NM_003935) is another VGAM1959 host target gene. TOP3B BINDING SITE is HOST TARGET binding site found in the 5' untranslated region of mRNA encoded by TOP3B, corresponding to a HOST TARGET binding site such as BINDING SITE I, BINDING SITE II or BINDING SITE III. Table 2 illustrates the complementarity of the nucleotide sequences of TOP3B BINDING SITE, designated SEQ ID:10039, to the nucleotide sequence of VGAM1959 RNA, herein designated VGAM RNA, also designated SEQ ID:4670.

Another function of VGAM1959 is therefore inhibition of Topoisomerase (DNA) III Beta (TOP3B, Accession NM_003935). Accordingly, utilities of VGAM1959 include diagnosis, prevention and treatment of diseases and clinical conditions associated with TOP3B. Tripartite Motif-containing 9 (TRIM9, Accession NM_015163) is another VGAM1959 host target gene. TRIM9 BINDING SITE is HOST TARGET binding site found in the 3' untranslated region of mRNA encoded by TRIM9, corresponding to a HOST TARGET binding site such as BINDING SITE I, BINDING SITE II or BINDING SITE III. Table 2 illustrates the complementarity of the nucleotide sequences of TRIM9 BINDING SITE, designated SEQ ID:17520, to the nucleotide sequence of VGAM1959 RNA, herein designated VGAM RNA, also designated SEQ ID:4670.

Another function of VGAM1959 is therefore inhibition of Tripartite Motif-containing 9 (TRIM9, Accession NM_015163), a gene which may function as a positive regulator for mannosylphosphate transferase and is required to mediate mannosylphosphate transfer in both the core and outer chain portions of n-linked. oligosaccharides. Accordingly, utilities of VGAM1959 include diagnosis, prevention and treatment of diseases and clinical conditions associated with TRIM9. The function of TRIM9 and its association with various diseases and clinical conditions, has been established by previous studies, as described hereinabove with reference to VGAM74. Transient Receptor Potential Cation Channel, Subfamily M, Member 6 (TRPM6, Accession NM_017662) is another VGAM1959 host target gene. TRPM6 BINDING SITE is HOST TARGET binding site found in the 5' untranslated region of mRNA encoded by TRPM6, corresponding to a HOST TARGET binding site such as BINDING SITE I, BINDING SITE II or BINDING SITE III. Table 2 illustrates the complementarity of the nucleotide sequences of TRPM6 BINDING SITE, designated SEQ ID:19199, to the nucleotide sequence of VGAM1959 RNA, herein designated VGAM RNA, also designated SEQ ID:4670.

Another function of VGAM1959 is therefore inhibition of Transient Receptor Potential Cation Channel, Subfamily M, Member 6 (TRPM6, Accession NM_017662), a gene which contains a predicted ion channel domain and a protein kinase domain. Accordingly, utilities of VGAM1959 include diagnosis, prevention and treatment of diseases and clinical conditions associated with TRPM6. The function of TRPM6 and its association with various diseases and clinical conditions, has been established by previous studies, as described hereinabove with reference to VGAM173. Ubiquitin-conjugating Enzyme E2L 3 (UBE2L3, Accession NM_003347) is another VGAM1959 host target gene. UBE2L3 BINDING SITE is HOST TARGET binding site found in the 3' untranslated region of mRNA encoded by UBE2L3, corresponding to a HOST TARGET binding site such as BINDING SITE I, BINDING SITE II or BINDING SITE III. Table 2 illustrates the complementarity of the nucleotide sequences of UBE2L3 BINDING SITE, designated SEQ ID:9358, to the nucleotide sequence of VGAM1959 RNA, herein designated VGAM RNA, also designated SEQ ID:4670.

Another function of VGAM1959 is therefore inhibition of Ubiquitin-conjugating Enzyme E2L 3 (UBE2L3, Accession NM_003347), a gene which catalyzes the covalent attachment of ubiquitin to other proteins. Accordingly, utilities of VGAM1959 include diagnosis, prevention and treatment of diseases and clinical conditions associated with UBE2L3. The function of UBE2L3 and its association with various diseases and clinical conditions, has been established by previous studies, as described hereinabove with reference to VGAM215. Ubiquitin-conjugating Enzyme E2 Variant 1 (UBE2V1, Accession NM_003349) is another VGAM1959 host target gene. UBE2V1 BINDING SITE1 through UBE2V1 BINDING SITE6 are HOST TARGET binding sites found in untranslated regions of mRNA encoded by UBE2V1, corresponding to HOST TARGET binding sites such as BINDING SITE I, BINDING SITE II or BINDING SITE III. Table 2 illustrates the complementarity of the nucleotide sequences of UBE2V1 BINDING SITE1 through UBE2V1 BINDING SITE6, designated SEQ ID:9370, SEQ ID:9372, SEQ ID:22769, SEQ ID:22771, SEQ ID:22522 and SEQ ID:22524 respectively, to the nucleotide sequence of VGAM1959 RNA, herein designated VGAM RNA, also designated SEQ ID:4670.

Another function of VGAM1959 is therefore inhibition of Ubiquitin-conjugating Enzyme E2 Variant 1 (UBE2V1, Accession NM_003349), a gene which may play a role in signaling for DNA repair. Accordingly, utilities of VGAM1959 include diagnosis, prevention and treatment of diseases and clinical conditions associated with UBE2V1. The function of UBE2V1 and its association with various diseases and clinical conditions, has been established by previous studies, as described hereinabove with reference to VGAM155. Ubiquitin Specific Protease 11 (USP11, Accession NM_004651) is another VGAM1959 host target gene. USP11 BINDING SITE is HOST TARGET binding site found in the 5' untranslated region of mRNA encoded by USP11, corresponding to a HOST TARGET binding site such as BINDING SITE I, BINDING SITE II or BINDING SITE III. Table 2 illustrates the complementarity of the nucleotide sequences of USP11 BINDING SITE, designated SEQ ID:11020, to the nucleotide sequence of VGAM1959 RNA, herein designated VGAM RNA, also designated SEQ ID:4670.

Another function of VGAM1959 is therefore inhibition of Ubiquitin Specific Protease 11 (USP11, Accession NM_004651), a gene which removes ubiquitin from ubiquitin-conjugated proteins. Accordingly, utilities of VGAM1959 include diagnosis, prevention and treatment of diseases and clinical conditions associated with USP11. The function of USP11 and its association with various diseases and clinical conditions, has been established by previous studies, as described hereinabove with reference to VGAM429. Vang-like 2 (van gogh, Drosophila) (VANGL2, Accession XM_049695) is another VGAM1959 host target gene. VANGL2 BINDING SITE is HOST TARGET binding site found in the 3' untranslated region of mRNA encoded by VANGL2, corresponding to a HOST TARGET binding site such as BINDING SITE I, BINDING SITE II or BINDING SITE III. Table 2 illustrates the complementarity of the nucleotide sequences of VANGL2 BINDING SITE, designated SEQ ID:35478, to the nucleotide sequence of VGAM1959 RNA, herein designated VGAM RNA, also designated SEQ ID:4670.

Another function of VGAM1959 is therefore inhibition of Vang-like 2 (van gogh, Drosophila) (VANGL2, Accession XM_049695), a gene which may take part in defining the lateral boundary of floorplate differentiation. Accordingly, utilities of VGAM1959 include diagnosis, prevention and treatment of diseases and clinical conditions associated with VANGL2. The function of VANGL2 and its association with various diseases and clinical conditions, has been established by previous studies, as described hereinabove with reference to VGAM111. Vasoactive Intestinal Peptide Receptor 2 (VIPR2, Accession NM_003382) is another VGAM1959 host target gene. VIPR2 BINDING SITE is HOST TARGET binding site found in the 3' untranslated region of mRNA encoded by VIPR2, corresponding to a HOST TARGET binding site such as BINDING SITE I, BINDING SITE II or BINDING SITE III. Table 2 illustrates the complementarity of the nucleotide sequences of VIPR2 BINDING SITE, designated SEQ ID:9413, to the nucleotide sequence of VGAM1959 RNA, herein designated VGAM RNA, also designated SEQ ID:4670.

Another function of VGAM1959 is therefore inhibition of Vasoactive Intestinal Peptide Receptor 2 (VIPR2, Accession NM_003382). Accordingly, utilities of VGAM1959 include diagnosis, prevention and treatment of diseases and clinical conditions associated with VIPR2. Very Low Density Lipoprotein Receptor (VLDLR, Accession XM_045386) is another VGAM1959 host target gene. VLDLR BINDING SITE is HOST TARGET binding site found in the 3' untranslated region of mRNA encoded by VLDLR, corresponding to a HOST TARGET binding site such as BINDING SITE I, BINDING SITE II or BINDING SITE III. Table 2 illustrates the complementarity of the nucleotide sequences of VLDLR BINDING SITE, designated SEQ ID:34451, to the nucleotide sequence of VGAM1959 RNA, herein designated VGAM RNA, also designated SEQ ID:4670.

Another function of VGAM1959 is therefore inhibition of Very Low Density Lipoprotein Receptor (VLDLR, Accession XM_045386), a gene which may play a crucial role in triglyceride metabolism. Accordingly, utilities of VGAM1959 include diagnosis, prevention and treatment of diseases and clinical conditions associated with VLDLR. The function of VLDLR and its association with various diseases and clinical conditions, has been established by previous studies, as described hereinabove with reference to VGAM103. WWP2 (Accession XM_028151) is another VGAM1959 host target gene. WWP2 BINDING SITE is HOST TARGET binding site found in the 3' untranslated region of mRNA encoded by WWP2, corresponding to a HOST TARGET binding site such as BINDING SITE I, BINDING SITE II or BINDING SITE III. Table 2 illustrates the complementarity of the nucleotide sequences of WWP2 BINDING SITE, designated SEQ ID:30623, to the nucleotide sequence of VGAM1959 RNA, herein designated VGAM RNA, also designated SEQ ID:4670.

Another function of VGAM1959 is therefore inhibition of WWP2 (Accession XM_028151), a gene which exhibits ubiquitin-protein ligase activity and contains WW and HECT domains. Accordingly, utilities of VGAM1959 include diagnosis, prevention and treatment of diseases and clinical conditions associated with WWP2. The function of WWP2 has been established by previous studies. The WW domain is a protein motif consisting of 35 to 40 amino acids and is characterized by 4 conserved aromatic residues, 2 of which are tryptophan. Pirozzi et al. (1997) suggested that WW domains mediate specific protein-protein interactions. Pirozzi et al. (1997) identified WWP2 by screening for WW-domain containing proteins (see OMIM Ref. No. WWP1; 602307). WWP2 contains 4 tandem WW domains, a complete HECT (homologous to the E6-associated protein carboxyl terminus) domain, associated with ubiquitin-protein ligase activity, and a C2 (calcium-dependent phospholipid-binding)-like domain characteristic of a large family of proteins including protein kinase C (see OMIM Ref. No. 176960). Based on similarities in structure between NEDD4 (OMIM Ref. No. 602278) and WWP2, Pirozzi et al. (1997) suggested that WWP2 belongs to a family of NEDD4-like proteins. Using in vitro assays, Pirozzi et al. (1997) showed that individual WW domains can selectively bind particular peptide ligands. By Northern blot analysis, Wood et al. (1998) detected a 5-kb WWP2 transcript in heart, brain, placenta, lung, liver, muscle, kidney, pancreas. Using yeast 2-hybrid and in vitro binding studies, Wood et al. (1998) demonstrated that WWP2, which they called AIP2, binds to atrophin-1 (DRPLA; 125370).

Full details of the abovementioned studies are described in the following publications, the disclosure of which are hereby incorporated by reference:

Pirozzi, G.; McConnell, S. J.; Uveges, A. J.; Carter, J. M.; Sparks, A. B.; Kay, B. K.; Fowlkes, D. M.: Identification of novel human WW domain-containing proteins by cloning of ligand targets. J. Biol. Chem. 272:14611-14616, 1997; and Wood, J. D.; Yuan, J.; Margolis, R. L.; Colomer, V.; Duan, K.; Kushi, J.; Kaminsky, Z.; Kleiderlein, J. J., Jr.; Sharp, A. H.; Ross, C. A.: Atrophin-1, the DRPLA gene product, interacts.

Further studies establishing the function and utilities of WWP2 are found in John Hopkins OMIM database record ID 602308, and in sited publications numbered 5898 listed in the bibliography section hereinbelow, which are also hereby incorporated by reference. Zinc Finger Protein 132 (clone pHZ-12) (ZNF132, Accession NM_003433) is another VGAM1959 host target gene. ZNF132 BINDING SITE is HOST TARGET binding site found in the 5' untranslated region of mRNA encoded by ZNF132, corresponding to a HOST TARGET binding site such as BINDING SITE I, BINDING SITE II or BINDING SITE III. Table 2 illustrates the complementarity of the nucleotide sequences of ZNF132 BINDING SITE, designated SEQ ID:9485, to the nucleotide sequence of VGAM1959 RNA, herein designated VGAM RNA, also designated SEQ ID:4670.

Another function of VGAM1959 is therefore inhibition of Zinc Finger Protein 132 (clone pHZ-12) (ZNF132, Accession NM_003433). Accordingly, utilities of VGAM1959 include diagnosis, prevention and treatment of diseases and clinical conditions associated with ZNF132. Zinc Finger Protein 24 (KOX 17) (ZNF24, Accession NM_006965) is another VGAM1959 host target gene. ZNF24 BINDING SITE is HOST TARGET binding site found in the 5' untranslated region of mRNA encoded by ZNF24, corresponding to a HOST TARGET binding site such as BINDING SITE I, BINDING SITE II or BINDING SITE III. Table 2 illustrates the complementarity of the nucleotide sequences of ZNF24 BINDING SITE, designated SEQ ID:13839, to the nucleotide sequence of VGAM1959 RNA, herein designated VGAM RNA, also designated SEQ ID:4670.

Another function of VGAM1959 is therefore inhibition of Zinc Finger Protein 24 (KOX 17) (ZNF24, Accession NM_006965). Accordingly, utilities of VGAM1959 include diagnosis, prevention and treatment of diseases and clinical conditions associated with ZNF24. Zinc Finger Protein 266 (ZNF266, Accession XM_113992) is another VGAM1959 host target gene. ZNF266 BINDING SITE is HOST TARGET binding site found in the 5' untranslated region of mRNA encoded by ZNF266, corresponding to a HOST TARGET binding site such as BINDING SITE I, BINDING SITE II or BINDING SITE III. Table 2 illustrates the complementarity of the nucleotide sequences of ZNF266 BINDING SITE, designated SEQ ID:42601, to the nucleotide sequence of VGAM1959 RNA, herein designated VGAM RNA, also designated SEQ ID:4670.

Another function of VGAM1959 is therefore inhibition of Zinc Finger Protein 266 (ZNF266, Accession XM_113992). Accordingly, utilities of VGAM1959 include diagnosis, prevention and treatment of diseases and clinical conditions associated with ZNF266. Zinc Finger Protein 268 (ZNF268, Accession XM_031851) is another VGAM1959 host target gene. ZNF268 BINDING SITE is HOST TARGET binding site found in the 5' untranslated region of mRNA encoded by ZNF268, corresponding to a HOST TARGET binding site such as BINDING SITE I, BINDING SITE II or BINDING SITE III. Table 2 illustrates the complementarity of the nucleotide sequences of ZNF268 BINDING SITE, designated SEQ ID:31502, to the nucleotide sequence of VGAM1959 RNA, herein designated VGAM RNA, also designated SEQ ID:4670.

Another function of VGAM1959 is therefore inhibition of Zinc Finger Protein 268 (ZNF268, Accession XM_031851). Accordingly, utilities of VGAM1959 include diagnosis, prevention and treatment of diseases and clinical conditions associated with ZNF268. Zinc Finger Protein 35 (clone HF.10) (ZNF35, Accession NM_003420) is another VGAM1959 host target gene. ZNF35 BINDING SITE is HOST TARGET binding site found in the 3' untranslated region of mRNA encoded by ZNF35, corresponding to a HOST TARGET binding site such as BINDING SITE I, BINDING SITE II or BINDING SITE III. Table 2 illustrates the complementarity of the nucleotide sequences of ZNF35 BINDING SITE, designated SEQ ID:9464, to the nucleotide sequence of VGAM1959 RNA, herein designated VGAM RNA, also designated SEQ ID:4670.

Another function of VGAM1959 is therefore inhibition of Zinc Finger Protein 35 (clone HF.10) (ZNF35, Accession NM_003420). Accordingly, utilities of VGAM1959 include diagnosis, prevention and treatment of diseases and clinical conditions associated with ZNF35. Alpha 1,4-galactosyltransferase (A4GALT, Accession NM_017436) is another VGAM1959 host target gene. A4GALT BINDING SITE is HOST TARGET binding site found in the 3' untranslated region of mRNA encoded by A4GALT, corresponding to a HOST TARGET binding site such as BINDING SITE I, BINDING SITE II or BINDING SITE III. Table 2 illustrates the complementarity of the nucleotide sequences of A4GALT BINDING SITE, designated SEQ ID:18895, to the nucleotide sequence of VGAM1959 RNA, herein designated VGAM RNA, also designated SEQ ID:4670.

Another function of VGAM1959 is therefore inhibition of Alpha 1,4-galactosyltransferase (A4GALT, Accession NM_017436). Accordingly, utilities of VGAM1959 include diagnosis, prevention and treatment of diseases and clinical conditions associated with A4GALT. Acetyl-Coenzyme A Synthetase 2 (ADP forming) (ACAS2, Accession NM_139274) is another VGAM1959 host target gene. ACAS2 BINDING SITE is HOST TARGET binding site found in the 5' untranslated region of mRNA encoded by ACAS2, corresponding to a HOST TARGET binding site such as BINDING SITE I, BINDING SITE II or BINDING SITE III. Table 2 illustrates the complementarity of the nucleotide sequences of ACAS2 BINDING SITE, designated SEQ ID:29265, to the nucleotide sequence of VGAM1959 RNA, herein designated VGAM RNA, also designated SEQ ID:4670.

Another function of VGAM1959 is therefore inhibition of Acetyl-Coenzyme A Synthetase 2 (ADP forming) (ACAS2, Accession NM_139274). Accordingly, utilities of VGAM1959 include diagnosis, prevention and treatment of diseases and clinical conditions associated with ACAS2. ARP1 Actin-related Protein 1 Homolog A, Centractin Alpha (yeast) (ACTR1A, Accession XM_031949) is another VGAM1959 host target gene. ACTR1A BINDING SITE is HOST TARGET binding site found in the 3' untranslated region of mRNA encoded by ACTR1A, corresponding to a HOST TARGET binding site such as BINDING SITE I, BINDING SITE II or BINDING SITE III. Table 2 illustrates the complementarity of the nucleotide sequences of ACTR1A BINDING SITE, designated SEQ ID:31534, to the nucleotide sequence of VGAM1959 RNA, herein designated VGAM RNA, also designated SEQ ID:4670.

Another function of VGAM1959 is therefore inhibition of ARP1 Actin-related Protein 1 Homolog A, Centractin Alpha (yeast) (ACTR1A, Accession XM_031949). Accordingly, utilities of VGAM1959 include diagnosis, prevention and treatment of diseases and clinical conditions associated with ACTR1A. AF053356_CDS3 (Accession NM_023948) is another VGAM1959 host target gene. AF053356_CDS3 BINDING SITE is HOST TARGET binding site found in the 5' untranslated region of mRNA encoded by AF053356_CDS3, corresponding to a HOST TARGET binding site such as BINDING SITE I, BINDING SITE II or BINDING SITE III. Table 2 illustrates the complementarity of the nucleotide sequences of AF053356_CDS3 BINDING SITE, designated SEQ ID:23428, to the nucleotide sequence of VGAM1959 RNA, herein designated VGAM RNA, also designated SEQ ID:4670.

Another function of VGAM1959 is therefore inhibition of AF053356_CDS3 (Accession NM_023948). Accordingly, utilities of VGAM1959 include diagnosis, prevention and treatment of diseases and clinical conditions associated with AF053356_CDS3. A Kinase (PRKA) Anchor Protein 7 (AKAP7, Accession NM_004842) is another VGAM1959 host target gene. AKAP7 BINDING SITE1 through AKAP7 BINDING SITE3 are HOST TARGET binding sites found in untranslated regions of mRNA encoded by AKAP7, corresponding to HOST TARGET binding sites such as BINDING SITE I, BINDING SITE II or BINDING SITE III. Table 2 illustrates the complementarity of the nucleotide sequences of AKAP7 BINDING SITE1 through AKAP7 BINDING SITE3, designated SEQ ID:11254, SEQ ID:28907 and SEQ ID:18517 respectively, to the nucleotide sequence of VGAM1959 RNA, herein designated VGAM RNA, also designated SEQ ID:4670.

Another function of VGAM1959 is therefore inhibition of A Kinase (PRKA) Anchor Protein 7 (AKAP7, Accession NM_004842). Accordingly, utilities of VGAM1959 include diagnosis, prevention and treatment of diseases and clinical conditions associated with AKAP7. Adaptor-related Protein Complex 3, Delta 1 Subunit (AP3D1, Accession NM_003938) is another VGAM1959 host target gene. AP3D1 BINDING SITE1 and AP3D1 BINDING SITE2 are HOST TARGET binding sites found in untranslated regions of mRNA encoded by AP3D1, corresponding to HOST TARGET binding sites such as BINDING SITE I, BINDING SITE II or BINDING SITE III. Table 2 illustrates the complementarity of the nucleotide sequences of AP3D1 BINDING SITE1 and AP3D1 BINDING SITE2, designated SEQ ID:10045 and SEQ ID:10050 respectively, to the nucleotide sequence of VGAM1959 RNA, herein designated VGAM RNA, also designated SEQ ID:4670.

Another function of VGAM1959 is therefore inhibition of Adaptor-related Protein Complex 3, Delta 1 Subunit (AP3D1, Accession NM_003938). Accordingly, utilities of VGAM1959 include diagnosis, prevention and treatment of diseases and clinical conditions associated with AP3D1. Apoptosis Inhibitor 5 (API5, Accession NM_006595) is another VGAM1959 host target gene. API5 BINDING SITE is HOST TARGET binding site found in the 3' untranslated region of mRNA encoded by API5, corresponding to a HOST TARGET binding site such as BINDING SITE I, BINDING SITE II or BINDING SITE III. Table 2 illustrates the complementarity of the nucleotide sequences of API5 BINDING SITE, designated SEQ ID:13360, to the nucleotide sequence of VGAM1959 RNA, herein designated VGAM RNA, also designated SEQ ID:4670.

Another function of VGAM1959 is therefore inhibition of Apoptosis Inhibitor 5 (API5, Accession NM_006595). Accordingly, utilities of VGAM1959 include diagnosis, prevention and treatment of diseases and clinical conditions associated with API5. APOARGC (Accession NM_024492) is another VGAM1959 host target gene. APOARGC BINDING SITE is HOST TARGET binding site found in the 3' untranslated region of mRNA encoded by APOARGC, corresponding to a HOST TARGET binding site such as BINDING SITE I, BINDING SITE II or BINDING SITE III. Table 2 illustrates the complementarity of the nucleotide sequences of APOARGC BINDING SITE, designated SEQ ID:23690, to the nucleotide sequence of VGAM1959 RNA, herein designated VGAM RNA, also designated SEQ ID:4670.

Another function of VGAM1959 is therefore inhibition of APOARGC (Accession NM_024492). Accordingly, utilities of VGAM1959 include diagnosis, prevention and treatment of diseases and clinical conditions associated with APOARGC. Apolipoprotein L, 3 (APOL3, Accession NM_014349) is another VGAM1959 host target gene. APOL3 BINDING SITE is HOST TARGET binding site found in the 3' untranslated region of mRNA encoded by APOL3, corresponding to a HOST TARGET binding site such as BINDING SITE I, BINDING SITE II or BINDING SITE III. Table 2 illustrates the complementarity of the nucleotide sequences of APOL3 BINDING SITE, designated SEQ ID:15675, to the nucleotide sequence of VGAM1959 RNA, herein designated VGAM RNA, also designated SEQ ID:4670.

Another function of VGAM1959 is therefore inhibition of Apolipoprotein L, 3 (APOL3, Accession NM_014349). Accordingly, utilities of VGAM1959 include diagnosis, prevention and treatment of diseases and clinical conditions associated with APOL3. ASAH (Accession NM_004315) is another VGAM1959 host target gene. ASAH BINDING SITE is HOST TARGET binding site found in the 3' untranslated region of mRNA encoded by ASAH, corresponding to a HOST TARGET binding site such as BINDING SITE I, BINDING SITE II or BINDING SITE III. Table 2 illustrates the complementarity of the nucleotide sequences of ASAH BINDING SITE, designated SEQ ID:10517, to the nucleotide sequence of VGAM1959 RNA, herein designated VGAM RNA, also designated SEQ ID:4670.

Another function of VGAM1959 is therefore inhibition of ASAH (Accession NM_004315). Accordingly, utilities of VGAM1959 include diagnosis, prevention and treatment of diseases and clinical conditions associated with ASAH. ATIP1 (Accession NM_020749) is another VGAM1959 host target gene. ATIP1 BINDING SITE is HOST TARGET binding site found in the 3' untranslated region of mRNA encoded by ATIP1, corresponding to a HOST TARGET binding site such as BINDING SITE I, BINDING SITE II or BINDING SITE III. Table 2 illustrates the complementarity of the nucleotide sequences of ATIP1 BINDING SITE, designated SEQ ID:21863, to the nucleotide sequence of VGAM1959 RNA, herein designated VGAM RNA, also designated SEQ ID:4670.

Another function of VGAM1959 is therefore inhibition of ATIP1 (Accession NM_020749). Accordingly, utilities of VGAM1959 include diagnosis, prevention and treatment of diseases and clinical conditions associated with ATIP1. ATPase, Class II, Type 9A (ATP9A, Accession XM_030577) is another VGAM1959 host target gene. ATP9A BINDING SITE1 and ATP9A BINDING SITE2 are HOST TARGET binding sites found in untranslated regions of mRNA encoded by ATP9A, corresponding to HOST TARGET binding sites such as BINDING SITE I, BINDING SITE II or BINDING SITE III. Table 2 illustrates the complementarity of the nucleotide sequences of ATP9A BINDING SITE1 and ATP9A BINDING SITE2, designated SEQ ID:31083 and SEQ ID:31089 respectively, to the nucleotide sequence of VGAM1959 RNA, herein designated VGAM RNA, also designated SEQ ID:4670.

Another function of VGAM1959 is therefore inhibition of ATPase, Class II, Type 9A (ATP9A, Accession XM_030577). Accordingly, utilities of VGAM1959 include diagnosis, prevention and treatment of diseases and clinical conditions associated with ATP9A. Burkitt Lymphoma Receptor 1, GTP Binding Protein (chemokine (C-X-C motif) Receptor 5) (BLR1, Accession NM_032966) is another VGAM1959 host target gene. BLR1 BINDING SITE1 and BLR1 BINDING SITE2 are HOST TARGET binding sites found in untranslated regions of mRNA encoded by BLR1, corresponding to HOST TARGET binding sites such as BINDING SITE I, BINDING SITE II or BINDING SITE III. Table 2 illustrates the complementarity of the nucleotide sequences of BLR1 BINDING SITE1 and BLR1 BINDING SITE2, designated SEQ ID:26778 and SEQ ID:7448 respectively, to the nucleotide sequence of VGAM1959 RNA, herein designated VGAM RNA, also designated SEQ ID:4670.

Another function of VGAM1959 is therefore inhibition of Burkitt Lymphoma Receptor 1, GTP Binding Protein (chemokine (C-X-C motif) Receptor 5) (BLR1, Accession NM_032966). Accordingly, utilities of VGAM1959 include diagnosis, prevention and treatment of diseases and clinical conditions associated with BLR1. Chromosome 11 Open Reading Frame 11 (C11orf11, Accession XM_167769) is another VGAM1959 host target gene. C11orf11 BINDING SITE is HOST TARGET binding site found in the 3' untranslated region of mRNA encoded by C11orf11, corresponding to a HOST TARGET binding site such as BINDING SITE I, BINDING SITE II or BINDING SITE III. Table 2 illustrates the complementarity of the nucleotide sequences of C11orf11 BINDING SITE, designated SEQ ID:44786, to the nucleotide sequence of VGAM1959 RNA, herein designated VGAM RNA, also designated SEQ ID:4670.

Another function of VGAM1959 is therefore inhibition of Chromosome 11 Open Reading Frame 11 (C11orf11, Accession XM_167769). Accordingly, utilities of VGAM1959 include diagnosis, prevention and treatment of diseases and clinical conditions associated with C11orf11. Chromosome 15 Open Reading Frame 5 (C15orf5, Accession NM_030944) is another VGAM1959 host target gene. C15orf5 BINDING SITE is HOST TARGET binding site found in the 5' untranslated region of mRNA encoded by C15orf5, corresponding to a HOST TARGET binding site such as BINDING SITE I, BINDING SITE II or BINDING SITE III. Table 2 illustrates the complementarity of the nucleotide sequences of C15orf5 BINDING SITE, designated SEQ ID:25216, to the nucleotide sequence of VGAM1959 RNA, herein designated VGAM RNA, also designated SEQ ID:4670.

Another function of VGAM1959 is therefore inhibition of Chromosome 15 Open Reading Frame 5 (C15orf5, Accession NM_030944). Accordingly, utilities of VGAM1959 include diagnosis, prevention and treatment of diseases and clinical conditions associated with C15orf5. Complement Component 1, Q Subcomponent, Receptor 1 (C1QR1, Accession NM_012072) is another VGAM1959 host target gene. C1QR1 BINDING SITE is HOST TARGET binding site found in the 3' untranslated region of mRNA encoded by C1QR1, corresponding to a HOST TARGET binding site such as BINDING SITE I, BINDING SITE II or BINDING SITE III. Table 2 illustrates the complementarity of the nucleotide sequences of C1QR1 BINDING SITE, designated SEQ ID:14339, to the nucleotide sequence of VGAM1959 RNA, herein designated VGAM RNA, also designated SEQ ID:4670.

Another function of VGAM1959 is therefore inhibition of Complement Component 1, Q Subcomponent, Receptor 1 (C1QR1, Accession NM_012072). Accordingly, utilities of VGAM1959 include diagnosis, prevention and treatment of diseases and clinical conditions associated with C1QR1. Chromosome 20 Open Reading Frame 100 (C20orf100, Accession NM_032883) is another VGAM1959 host target gene. C20orf100 BINDING SITE is HOST TARGET binding site found in the 5" untranslated region of mRNA encoded by C20orf100, corresponding to a HOST TARGET binding site such as BINDING SITE I, BINDING SITE II or BINDING SITE III. Table 2 illustrates the complementarity of the nucleotide sequences of C20orf100 BINDING SITE, designated SEQ ID:26705, to the nucleotide sequence of VGAM1959 RNA, herein designated VGAM RNA, also designated SEQ ID:4670.

Another function of VGAM1959 is therefore inhibition of Chromosome 20 Open Reading Frame 100 (C20orf100, Accession NM_032883). Accordingly, utilities of VGAM1959 include diagnosis, prevention and treatment of diseases and clinical conditions associated with C20orf100. Chromosome 20 Open Reading Frame 108 (C20orf108, Accession NM_080821) is another VGAM1959 host target gene. C20orf108 BINDING SITE is HOST TARGET binding site found in the 3" untranslated region of mRNA encoded by C20orf108, corresponding to a HOST TARGET binding site such as BINDING SITE I, BINDING SITE II or BINDING SITE III. Table 2 illustrates the complementarity of the nucleotide sequences of C20orf108 BINDING SITE, designated SEQ ID:28084, to the nucleotide sequence of VGAM1959 RNA, herein designated VGAM RNA, also designated SEQ ID:4670.

Another function of VGAM1959 is therefore inhibition of Chromosome 20 Open Reading Frame 108 (C20orf108, Accession NM_080821). Accordingly, utilities of VGAM1959 include diagnosis, prevention and treatment of diseases and clinical conditions associated with C20orf108. Chromosome 20 Open Reading Frame 162 (C20orf162, Accession NM_080603) is another VGAM1959 host target gene. C20orf162 BINDING SITE1 and C20orf162 BINDING SITE2 are HOST TARGET binding sites found in untranslated regions of mRNA encoded by C20orf162, corresponding to HOST TARGET binding sites such as BINDING SITE I, BINDING SITE II or BINDING SITE III. Table 2 illustrates the complementarity of the nucleotide sequences of C20orf162 BINDING SITE1 and C20orf162 BINDING SITE2, designated SEQ ID:27915 and SEQ ID:27918 respectively, to the nucleotide sequence of VGAM1959 RNA, herein designated VGAM RNA, also designated SEQ ID:4670.

Another function of VGAM1959 is therefore inhibition of Chromosome 20 Open Reading Frame 162 (C20orf162, Accession NM_080603). Accordingly, utilities of VGAM1959 include diagnosis, prevention and treatment of diseases and clinical conditions associated with C20orf162. Chromosome 21 Open Reading Frame 108 (C21orf108, Accession XM_114191) is another VGAM1959 host target gene. C21orf108 BINDING SITE is HOST TARGET binding site found in the 3" untranslated region of mRNA encoded by C21orf108, corresponding to a HOST TARGET binding site such as BINDING SITE I, BINDING SITE II or BINDING SITE III. Table 2 illustrates the complementarity of the nucleotide sequences of C21orf108 BINDING SITE, designated SEQ ID:42768, to the nucleotide sequence of VGAM1959 RNA, herein designated VGAM RNA, also designated SEQ ID:4670.

Another function of VGAM1959 is therefore inhibition of Chromosome 21 Open Reading Frame 108 (C21orf108, Accession XM_114191). Accordingly, utilities of VGAM1959 include diagnosis, prevention and treatment of diseases and clinical conditions associated with C21orf108. Chromosome 5 Open Reading Frame 5 (C5orf5, Accession NM_016603) is another VGAM1959 host target gene. C5orf5 BINDING SITE is HOST TARGET binding site found in the 3' untranslated region of mRNA encoded by C5orf5, corresponding to a HOST TARGET binding site such as BINDING SITE I, BINDING SITE II or BINDING SITE III. Table 2 illustrates the complementarity of the nucleotide sequences of C5orf5 BINDING SITE, designated SEQ ID:18696, to the nucleotide sequence of VGAM1959 RNA, herein designated VGAM RNA, also designated SEQ ID:4670.

Another function of VGAM1959 is therefore inhibition of Chromosome 5 Open Reading Frame 5 (C5orf5, Accession NM_016603). Accordingly, utilities of VGAM1959 include diagnosis, prevention and treatment of diseases and clinical conditions associated with C5orf5. Calcium Channel, Voltage-dependent, Gamma Subunit 4 (CACNG4, Accession NM_014405) is another VGAM1959 host target gene. CACNG4 BINDING SITE is HOST TARGET binding site found in the 3' untranslated region of mRNA encoded by CACNG4, corresponding to a HOST TARGET binding site such as BINDING SITE I, BINDING SITE II or BINDING SITE III. Table 2 illustrates the complementarity of the nucleotide sequences of CACNG4 BINDING SITE, designated SEQ ID:15747, to the nucleotide sequence of VGAM1959 RNA, herein designated VGAM RNA, also designated SEQ ID:4670.

Another function of VGAM1959 is therefore inhibition of Calcium Channel, Voltage-dependent, Gamma Subunit 4 (CACNG4, Accession NM_014405). Accordingly, utilities of VGAM1959 include diagnosis, prevention and treatment of diseases and clinical conditions associated with CACNG4. CAT56 (Accession NM_025263) is another VGAM1959 host target gene. CAT56 BINDING SITE is HOST TARGET binding site found in the 3' untranslated region of mRNA encoded by CAT56, corresponding to a HOST TARGET binding site such as BINDING SITE I, BINDING SITE II or BINDING SITE III. Table 2 illustrates the complementarity of the nucleotide sequences of CAT56 BINDING SITE, designated SEQ ID:24932, to the nucleotide sequence of VGAM1959 RNA, herein designated VGAM RNA, also designated SEQ ID:4670.

Another function of VGAM1959 is therefore inhibition of CAT56 (Accession NM_025263). Accordingly, utilities of VGAM1959 include diagnosis, prevention and treatment of diseases and clinical conditions associated with CAT56. CDC14 Cell Division Cycle 14 Homolog B (S. cerevisiae) (CDC14B, Accession NM_033332) is another VGAM1959 host target gene. CDC14B BINDING SITE is HOST TARGET binding site found in the 3' untranslated region of mRNA encoded by CDC14B, corresponding to a HOST TARGET binding site such as BINDING SITE I, BINDING SITE II or BINDING SITE III. Table 2 illustrates the complementarity of the nucleotide sequences of CDC14B BINDING SITE, designated SEQ ID:27169, to the nucleotide sequence of VGAM1959 RNA, herein designated VGAM RNA, also designated SEQ ID:4670.

Another function of VGAM1959 is therefore inhibition of CDC14 Cell Division Cycle 14 Homolog B (S. cerevisiae) (CDC14B, Accession NM_033332). Accordingly, utilities of VGAM1959 include diagnosis, prevention and treatment of diseases and clinical conditions associated with CDC14B. Chorionic Gonadotropin, Beta Polypeptide 5 (CGB5, Accession NM_033043) is another VGAM1959 host target gene. CGB5 BINDING SITE is HOST TARGET binding site found in the 5' untranslated region of mRNA encoded by CGB5, corresponding to a HOST TARGET binding site such as BINDING SITE I, BINDING SITE II or BINDING SITE III. Table 2 illustrates the complementarity of the nucleotide sequences of CGB5 BINDING SITE, designated SEQ ID:26931, to the nucleotide sequence of VGAM1959 RNA, herein designated VGAM RNA, also designated SEQ ID:4670.

Another function of VGAM1959 is therefore inhibition of Chorionic Gonadotropin, Beta Polypeptide 5 (CGB5, Accession NM_033043). Accordingly, utilities of VGAM1959 include diagnosis, prevention and treatment of diseases and clinical conditions associated with CGB5. Chorionic Gonadotropin, Beta Polypeptide 8 (CGB8, Accession NM_033183) is another VGAM1959 host target gene. CGB8 BINDING SITE is HOST TARGET binding site found in the 5' untranslated region of mRNA encoded by CGB8, corresponding to a HOST TARGET binding site such as BINDING SITE I, BINDING SITE II or BINDING SITE III. Table 2 illustrates the complementarity of the nucleotide sequences of CGB8 BINDING SITE, designated SEQ ID:27046, to the nucleotide sequence of VGAM1959 RNA, herein designated VGAM RNA, also designated SEQ ID:4670.

Another function of VGAM1959 is therefore inhibition of Chorionic Gonadotropin, Beta Polypeptide 8 (CGB8, Accession NM_033183). Accordingly, utilities of VGAM1959 include diagnosis, prevention and treatment of diseases and clinical conditions associated with CGB8. Calcium Homeostasis Endoplasmic Reticulum Protein (CHERP, Accession NM_006387) is another VGAM1959 host target gene. CHERP BINDING SITE is HOST TARGET binding site found in the 3' untranslated region of mRNA encoded by CHERP, corresponding to a HOST TARGET binding site such as BINDING SITE I, BINDING SITE II or BINDING SITE III. Table 2 illustrates the complementarity of the nucleotide sequences of CHERP BINDING SITE, designated SEQ ID:13093, to the nucleotide sequence of VGAM1959 RNA, herein designated VGAM RNA, also designated SEQ ID:4670.

Another function of VGAM1959 is therefore inhibition of Calcium Homeostasis Endoplasmic Reticulum Protein (CHERP, Accession NM_006387). Accordingly, utilities of VGAM1959 include diagnosis, prevention and treatment of diseases and clinical conditions associated with CHERP. CSE-C (Accession XM_166163) is another VGAM1959 host target gene. CSE-C BINDING SITE is HOST TARGET binding site found in the 5' untranslated region of mRNA encoded by CSE-C, corresponding to a HOST TARGET binding site such as BINDING SITE I, BINDING SITE II or BINDING SITE III. Table 2 illustrates the complementarity of the nucleotide sequences of CSE-C BINDING SITE, designated SEQ ID:43981, to the nucleotide sequence of VGAM1959 RNA, herein designated VGAM RNA, also designated SEQ ID:4670.

Another function of VGAM1959 is therefore inhibition of CSE-C (Accession XM_166163). Accordingly, utilities of VGAM1959 include diagnosis, prevention and treatment of diseases and clinical conditions associated with CSE-C. Calsenilin, Presenilin Binding Protein, EF Hand Transcription Factor (CSEN, Accession NM_013434) is another VGAM1959 host target gene. CSEN BINDING SITE is HOST TARGET binding site found in the 3' untranslated region of mRNA encoded by CSEN, corresponding to a HOST TARGET binding site such as BINDING SITE I, BINDING SITE II or BINDING SITE III. Table 2 illustrates the complementarity of the nucleotide sequences of CSEN BINDING SITE, designated SEQ ID:15090, to the nucleotide sequence of VGAM1959 RNA, herein designated VGAM RNA, also designated SEQ ID:4670.

Another function of VGAM1959 is therefore inhibition of Calsenilin, Presenilin Binding Protein, EF Hand Transcription Factor (CSEN, Accession NM_013434). Accordingly, utilities of VGAM1959 include diagnosis, prevention and treatment of diseases and clinical conditions associated with CSEN. Catenin, Beta Interacting Protein 1 (CTNNBIP1, Accession NM_020248) is another VGAM1959 host target gene. CTNNBIP1 BINDING SITE is HOST TARGET binding site found in the 3' untranslated region of mRNA encoded by CTNNBIP1, corresponding to a HOST TARGET binding site such as BINDING SITE I, BINDING SITE II or BINDING SITE III. Table 2 illustrates the complementarity of the nucleotide sequences of CTNNBIP1 BINDING SITE, designated SEQ ID:21543, to the nucleotide sequence of VGAM1959 RNA, herein designated VGAM RNA, also designated SEQ ID:4670.

Another function of VGAM1959 is therefore inhibition of Catenin, Beta Interacting Protein 1 (CTNNBIP1, Accession NM_020248). Accordingly, utilities of VGAM1959 include diagnosis, prevention and treatment of diseases and clinical conditions associated with CTNNBIP1. CXYorf1 (Accession XM_088704) is another VGAM1959 host target gene. CXYorf1 BINDING SITE1 and CXYorf1 BINDING SITE2 are HOST TARGET binding sites found in untranslated regions of mRNA encoded by CXYorf1, corresponding to HOST TARGET binding sites such as BINDING SITE I, BINDING SITE II or BINDING SITE III. Table 2 illustrates the complementarity of the nucleotide sequences of CXYorf1 BINDING SITE1 and CXYorf1 BINDING SITE2, designated SEQ ID:39906 and SEQ ID:39913 respectively, to the nucleotide sequence of VGAM1959 RNA, herein designated VGAM RNA, also designated SEQ ID:4670.

Another function of VGAM1959 is therefore inhibition of CXYorf1 (Accession XM_088704). Accordingly, utilities of VGAM1959 include diagnosis, prevention and treatment of diseases and clinical conditions associated with CXYorf1. Death-associated Protein Kinase 3 (DAPK3, Accession NM_001348) is another VGAM1959 host target gene. DAPK3 BINDING SITE is HOST TARGET binding site found in the 3' untranslated region of mRNA encoded by DAPK3, corresponding to a HOST TARGET binding site such as BINDING SITE I, BINDING SITE II or BINDING SITE III. Table 2 illustrates the complementarity of the nucleotide sequences of DAPK3 BINDING SITE, designated SEQ ID:7029, to the nucleotide sequence of VGAM1959 RNA, herein designated VGAM RNA, also designated SEQ ID:4670.

Another function of VGAM1959 is therefore inhibition of Death-associated Protein Kinase 3 (DAPK3, Accession NM_001348). Accordingly, utilities of VGAM1959 include diagnosis, prevention and treatment of diseases and clinical conditions associated with DAPK3. DEAD/H (Asp-Glu-Ala-Asp/His) Box Polypeptide 34 (DDX34, Accession NM_014681) is another VGAM1959 host target gene. DDX34 BINDING SITE1 and DDX34 BINDING SITE2 are HOST TARGET binding sites found in untranslated regions of mRNA encoded by DDX34, corresponding to HOST TARGET binding sites such as BINDING SITE I, BINDING SITE II or BINDING SITE III. Table 2 illustrates the complementarity of the nucleotide sequences of DDX34 BINDING SITE1 and DDX34 BINDING SITE2, designated SEQ ID:16160 and SEQ ID:16166 respectively, to the nucleotide sequence of VGAM1959 RNA, herein designated VGAM RNA, also designated SEQ ID:4670.

Another function of VGAM1959 is therefore inhibition of DEAD/H (Asp-Glu-Ala-Asp/His) Box Polypeptide 34 (DDX34, Accession NM_014681). Accordingly, utilities of VGAM1959 include diagnosis, prevention and treatment of diseases and clinical conditions associated with DDX34. DKFZP434B195 (Accession NM_031284) is another VGAM1959 host target gene. DKFZP434B195 BINDING SITE is HOST TARGET binding site found in the 5' untranslated region of mRNA encoded by DKFZP434B195, corresponding to a HOST TARGET binding site such as BINDING SITE I, BINDING SITE II or BINDING SITE III. Table 2 illustrates the complementarity of the nucleotide sequences of DKFZP434B195 BINDING SITE, designated SEQ ID:25308, to the nucleotide sequence of VGAM1959 RNA, herein designated VGAM RNA, also designated SEQ ID:4670.

Another function of VGAM1959 is therefore inhibition of DKFZP434B195 (Accession NM_031284). Accordingly, utilities of VGAM1959 include diagnosis, prevention and treatment of diseases and clinical conditions associated with DKFZP434B195. DKFZp434C0923 (Accession NM_017598) is another VGAM1959 host target gene. DKFZp434C0923 BINDING SITE1 and DKFZp434C0923 BINDING SITE2 are HOST TARGET binding sites found in untranslated regions of mRNA encoded by DKFZp434C0923, corresponding to HOST TARGET binding sites such as BINDING SITE I, BINDING SITE II or BINDING SITE III. Table 2 illustrates the complementarity of the nucleotide sequences of DKFZp434C0923 BINDING SITE1 and DKFZp434C0923 BINDING SITE2, designated SEQ ID:19064 and SEQ ID:19067 respectively, to the nucleotide sequence of VGAM1959 RNA, herein designated VGAM RNA, also designated SEQ ID:4670.

Another function of VGAM1959 is therefore inhibition of DKFZp434C0923 (Accession NM_017598). Accordingly, utilities of VGAM1959 include diagnosis, prevention and treatment of diseases and clinical conditions associated with DKFZp434C0923. DKFZP434C212 (Accession XM_044196) is another VGAM1959 host target gene. DKFZP434C212 BINDING SITE is HOST TARGET binding site found in the 3' untranslated region of mRNA encoded by DKFZP434C212, corresponding to a HOST TARGET binding site such as BINDING SITE I, BINDING SITE II or BINDING SITE III. Table 2 illustrates the complementarity of the nucleotide sequences of DKFZP434C212 BINDING SITE, designated SEQ ID:34169, to the nucleotide sequence of VGAM1959 RNA, herein designated VGAM RNA, also designated SEQ ID:4670.

Another function of VGAM1959 is therefore inhibition of DKFZP434C212 (Accession XM_044196). Accordingly, utilities of VGAM1959 include diagnosis, prevention and treatment of diseases and clinical conditions associated with DKFZP434C212. DKFZP434I092 (Accession XM_042042) is another VGAM1959 host target gene. DKFZP434I092 BINDING SITE is HOST TARGET binding site found in the 3' untranslated region of mRNA encoded by DKFZP434I092, corresponding to a HOST TARGET binding site such as BINDING SITE I, BINDING SITE II or BINDING SITE III. Table 2 illustrates the complementarity of the nucleotide sequences of DKFZP434I092 BINDING SITE, designated SEQ ID:33676, to the nucleotide sequence of VGAM1959 RNA, herein designated VGAM RNA, also designated SEQ ID:4670.

Another function of VGAM1959 is therefore inhibition of DKFZP434I092 (Accession XM_042042). Accordingly, utilities of VGAM1959 include diagnosis, prevention and treatment of diseases and clinical conditions associated with DKFZP434I092. DKFZP434I2117 (Accession NM_031478) is another VGAM1959 host target gene. DKFZP434I2117 BINDING SITE is HOST TARGET binding site found in the 3' untranslated region of mRNA encoded by DKFZP434I2117, corresponding to a HOST TARGET binding site such as BINDING SITE I, BINDING SITE II or BINDING SITE III. Table 2 illustrates the complementarity of the nucleotide sequences of DKFZP434I2117 BINDING SITE, designated SEQ ID:25555, to the nucleotide sequence of VGAM1959 RNA, herein designated VGAM RNA, also designated SEQ ID:4670.

Another function of VGAM1959 is therefore inhibition of DKFZP434I2117 (Accession NM_031478). Accordingly, utilities of VGAM1959 include diagnosis, prevention and treatment of diseases and clinical conditions associated with DKFZP434I2117. DKFZP434K1772 (Accession XM_041936) is another VGAM1959 host target gene. DKFZP434K1772 BINDING SITE1 and DKFZP434K1772 BINDING SITE2 are HOST TARGET binding sites found in untranslated regions of mRNA encoded by DKFZP434K1772, corresponding to HOST TARGET binding sites such as BINDING SITE I, BINDING SITE II or BINDING SITE III. Table 2 illustrates the complementarity of the nucleotide sequences of DKFZP434K1772 BINDING SITE1 and DKFZP434K1772 BINDING SITE2, designated SEQ ID:33631 and SEQ ID:33634 respectively, to the nucleotide sequence of VGAM1959 RNA, herein designated VGAM RNA, also designated SEQ ID:4670.

Another function of VGAM1959 is therefore inhibition of DKFZP434K1772 (Accession XM_041936). Accordingly, utilities of VGAM1959 include diagnosis, prevention and treatment of diseases and clinical conditions associated with DKFZP434K1772. DKFZp434N2435 (Accession XM_172806) is another VGAM1959 host target gene. DKFZp434N2435 BINDING SITE is HOST TARGET binding site found in the 5' untranslated region of mRNA encoded by DKFZp434N2435, corresponding to a HOST TARGET binding site such as BINDING SITE I, BINDING SITE II or BINDING SITE III. Table 2 illustrates the complementarity of the nucleotide sequences of DKFZp434N2435 BINDING SITE, designated SEQ ID:46090, to the nucleotide sequence of VGAM1959 RNA, herein designated VGAM RNA, also designated SEQ ID:4670.

Another function of VGAM1959 is therefore inhibition of DKFZp434N2435 (Accession XM_172806). Accordingly, utilities of VGAM1959 include diagnosis, prevention and treatment of diseases and clinical conditions associated with DKFZp434N2435. DKFZp434O0320 (Accession XM_097012) is another VGAM1959 host target gene. DKFZp434O0320 BINDING SITE is HOST TARGET binding site found in the 3' untranslated region of mRNA encoded by DKFZp434O0320, corresponding to a HOST TARGET binding site such as BINDING SITE I, BINDING SITE II or BINDING SITE III. Table 2 illustrates the complementarity of the nucleotide sequences of DKFZp434O0320 BINDING SITE, designated SEQ ID:40703, to the nucleotide sequence of VGAM1959 RNA, herein designated VGAM RNA, also designated SEQ ID:4670.

Another function of VGAM1959 is therefore inhibition of DKFZp434O0320 (Accession XM_097012). Accordingly, utilities of VGAM1959 include diagnosis, prevention and treatment of diseases and clinical conditions associated with DKFZp434O0320. DKFZP434O047 (Accession NM_015594) is another VGAM1959 host target gene. DKFZP434O047 BINDING SITE is HOST TARGET binding site found in the 5' untranslated region of mRNA encoded by DKFZP434O047, corresponding to a HOST TARGET binding site such as BINDING SITE I, BINDING SITE II or BINDING SITE III. Table 2 illustrates the complementarity of the nucleotide sequences of DKFZP434O047 BINDING SITE, designated SEQ ID:17866, to the nucleotide sequence of VGAM1959 RNA, herein designated VGAM RNA, also designated SEQ ID:4670.

Another function of VGAM1959 is therefore inhibition of DKFZP434O047 (Accession NM_015594). Accordingly, utilities of VGAM1959 include diagnosis, prevention and treatment of diseases and clinical conditions associated with DKFZP434O047. DKFZP434P1750 (Accession NM_015527) is another VGAM1959 host target gene. DKFZP434P1750 BINDING SITE is HOST TARGET binding site found in the 3' untranslated region of mRNA encoded by DKFZP434P1750, corresponding to a HOST TARGET binding site such as BINDING SITE I, BINDING SITE II or BINDING SITE III. Table 2 illustrates the complementarity of the nucleotide sequences of DKFZP434P1750 BINDING SITE, designated SEQ ID:17795, to the nucleotide sequence of VGAM1959 RNA, herein designated VGAM RNA, also designated SEQ ID:4670.

Another function of VGAM1959 is therefore inhibition of DKFZP434P1750 (Accession NM_015527). Accordingly, utilities of VGAM1959 include diagnosis, prevention and treatment of diseases and clinical conditions associated with DKFZP434P1750. DKFZP564F013 (Accession XM_168479) is another VGAM1959 host target gene. DKFZP564F013 BINDING SITE is HOST TARGET binding site found in the 3' untranslated region of mRNA encoded by DKFZP564F013, corresponding to a HOST TARGET binding site such as BINDING SITE I, BINDING SITE II or BINDING SITE III. Table 2 illustrates the complementarity of the nucleotide sequences of DKFZP564F013 BINDING SITE, designated SEQ ID:45201, to the nucleotide sequence of VGAM1959 RNA, herein designated VGAM RNA, also designated SEQ ID:4670.

Another function of VGAM1959 is therefore inhibition of DKFZP564F013 (Accession XM_168479). Accordingly, utilities of VGAM1959 include diagnosis, prevention and treatment of diseases and clinical conditions associated with DKFZP564F013. DKFZP564J157 (Accession NM_018457) is another VGAM1959 host target gene. DKFZP564J157 BINDING SITE is HOST TARGET binding site found in the 3' untranslated region of mRNA encoded by DKFZP564J157, corresponding to a HOST TARGET binding site such as BINDING SITE I, BINDING SITE II or BINDING SITE III. Table 2 illustrates the complementarity of the nucleotide sequences of DKFZP564J157 BINDING SITE, designated SEQ ID:20529, to the nucleotide sequence of VGAM1959 RNA, herein designated VGAM RNA, also designated SEQ ID:4670.

Another function of VGAM1959 is therefore inhibition of DKFZP564J157 (Accession NM_018457). Accordingly, utilities of VGAM1959 include diagnosis, prevention and treatment of diseases and clinical conditions associated with DKFZP564J157. DKFZP564P1916 (Accession NM_015652) is another VGAM1959 host target gene. DKFZP564P1916 BINDING SITE is HOST TARGET binding site found in the 5' untranslated region of mRNA encoded by DKFZP564P1916, corresponding to a HOST TARGET binding site such as BINDING SITE I, BINDING SITE II or BINDING SITE III. Table 2 illustrates the complementarity of the nucleotide sequences of DKFZP564P1916 BINDING SITE, designated SEQ ID:17899, to the nucleotide sequence of VGAM1959 RNA, herein designated VGAM RNA, also designated SEQ ID:4670.

Another function of VGAM1959 is therefore inhibition of DKFZP564P1916 (Accession NM_015652). Accordingly, utilities of VGAM1959 include diagnosis, prevention and treatment of diseases and clinical conditions associated with DKFZP564P1916. DKFZp566H0824 (Accession NM_017535) is another VGAM1959 host target gene. DKFZp566H0824 BINDING SITE is HOST TARGET binding site found in the 5' untranslated region of mRNA encoded by DKFZp566H0824, corresponding to a HOST TARGET binding site such as BINDING SITE I, BINDING SITE II or BINDING SITE III. Table 2 illustrates the complementarity of the nucleotide sequences of DKFZp566H0824 BINDING SITE, designated SEQ ID:18978, to the nucleotide sequence of VGAM1959 RNA, herein designated VGAM RNA, also designated SEQ ID:4670.

Another function of VGAM1959 is therefore inhibition of DKFZp566H0824 (Accession NM_017535). Accordingly, utilities of VGAM1959 include diagnosis, prevention and treatment of diseases and clinical conditions associated with DKFZp566H0824. DKFZp586I021 (Accession NM_032271) is another VGAM1959 host target gene. DKFZp586I021 BINDING SITE is HOST TARGET binding site found in the 3' untranslated region of mRNA encoded by DKFZp586I021, corresponding to a HOST TARGET binding site such as BINDING SITE I, BINDING SITE II or BINDING SITE III. Table 2 illustrates the complementarity of the nucleotide sequences of DKFZp586I021 BINDING SITE, designated SEQ ID:26024, to the nucleotide sequence of VGAM1959 RNA, herein designated VGAM RNA, also designated SEQ ID:4670.

Another function of VGAM1959 is therefore inhibition of DKFZp586I021 (Accession NM_032271). Accordingly, utilities of VGAM1959 include diagnosis, prevention and treatment of diseases and clinical conditions associated with DKFZp586I021. DKFZP586M1120 (Accession NM_031294) is another VGAM1959 host target gene. DKFZP586M1120 BINDING SITE is HOST TARGET binding site found in the 3' untranslated region of mRNA encoded by DKFZP586M1120, corresponding to a HOST TARGET binding site such as BINDING SITE I, BINDING SITE II or BINDING SITE III. Table 2 illustrates the complementarity of the nucleotide sequences of DKFZP586M1120 BINDING SITE, designated SEQ ID:25320, to the nucleotide sequence of VGAM1959 RNA, herein designated VGAM RNA, also designated SEQ ID:4670.

Another function of VGAM1959 is therefore inhibition of DKFZP586M1120 (Accession NM_031294). Accordingly, utilities of VGAM1959 include diagnosis, prevention and treatment of diseases and clinical conditions associated with DKFZP586M1120. DKFZP761D0211 (Accession NM_032039) is another VGAM1959 host target gene. DKFZP761D0211 BINDING SITE is HOST TARGET binding site found in the 3' untranslated region of mRNA encoded by DKFZP761D0211, corresponding to a HOST TARGET binding site such as BINDING SITE I, BINDING SITE II or BINDING SITE III. Table 2 illustrates the complementarity of the nucleotide sequences of DKFZP761D0211 BINDING SITE, designated SEQ ID:25738, to the nucleotide sequence of VGAM1959 RNA, herein designated VGAM RNA, also designated SEQ ID:4670.

Another function of VGAM1959 is therefore inhibition of DKFZP761D0211 (Accession NM_032039). Accordingly, utilities of VGAM1959 include diagnosis, prevention and treatment of diseases and clinical conditions associated with DKFZP761D0211. DKFZp762M136 (Accession XM_035635) is another VGAM1959 host target gene. DKFZp762M136 BINDING SITE is HOST TARGET binding site found in the 3' untranslated region of mRNA encoded by DKFZp762M136, corresponding to a HOST TARGET binding site such as BINDING SITE I, BINDING SITE II or BINDING SITE III. Table 2 illustrates the complementarity of the nucleotide sequences of DKFZp762M136 BINDING SITE, designated SEQ ID:32303, to the nucleotide sequence of VGAM1959 RNA, herein designated VGAM RNA, also designated SEQ ID:4670.

Another function of VGAM1959 is therefore inhibition of DKFZp762M136 (Accession XM_035635). Accordingly, utilities of VGAM1959 include diagnosis, prevention and treatment of diseases and clinical conditions associated with DKFZp762M136. DKFZp762P2111 (Accession XM_098654) is another VGAM1959 host target gene. DKFZp762P2111 BINDING SITE is HOST TARGET binding site found in the 3' untranslated region of mRNA encoded by DKFZp762P2111, corresponding to a HOST TARGET binding site such as BINDING SITE I, BINDING SITE II or BINDING SITE III. Table 2 illustrates the complementarity of the nucleotide sequences of DKFZp762P2111 BINDING SITE, designated SEQ ID:41756, to the nucleotide sequence of VGAM1959 RNA, herein designated VGAM RNA, also designated SEQ ID:4670.

Another function of VGAM1959 is therefore inhibition of DKFZp762P2111 (Accession XM_098654). Accordingly, utilities of VGAM1959 include diagnosis, prevention and treatment of diseases and clinical conditions associated with DKFZp762P2111. Dihydrolipoamide S-acetyltransferase (E2 component of pyruvate dehydrogenase complex) (DLAT, Accession XM_041355) is another VGAM1959 host target gene. DLAT BINDING SITE is HOST TARGET binding site found in the 3' untranslated region of mRNA encoded by DLAT, corresponding to a HOST TARGET binding site such as BINDING SITE I, BINDING SITE II or BINDING SITE III. Table 2 illustrates the complementarity of the nucleotide sequences of DLAT BINDING SITE, designated SEQ ID:33502, to the nucleotide sequence of VGAM1959 RNA, herein designated VGAM RNA, also designated SEQ ID:4670.

Another function of VGAM1959 is therefore inhibition of Dihydrolipoamide S-acetyltransferase (E2 component of pyruvate dehydrogenase complex) (DLAT, Accession XM_041355). Accordingly, utilities of VGAM1959 include diagnosis, prevention and treatment of diseases and clinical conditions associated with DLAT. DRIL2 (Accession NM_006465) is another VGAM1959 host target gene. DRIL2 BINDING SITE is HOST TARGET binding site found in the 3' untranslated region of mRNA encoded by DRIL2, corresponding to a HOST TARGET binding site such as BINDING SITE I, BINDING SITE II or BINDING SITE III. Table 2 illustrates the complementarity of the nucleotide sequences of DRIL2 BINDING SITE, designated SEQ ID:13187, to the nucleotide sequence of VGAM1959 RNA, herein designated VGAM RNA, also designated SEQ ID:4670.

Another function of VGAM1959 is therefore inhibition of DRIL2 (Accession NM_006465). Accordingly, utilities of VGAM1959 include diagnosis, prevention and treatment of diseases and clinical conditions associated with DRIL2. DT1P1A10 (Accession XM_029187) is another VGAM1959 host target gene. DT1P1A10 BINDING SITE is HOST TARGET binding site found in the 3' untranslated region of mRNA encoded by DT1P1A10, corresponding to a HOST TARGET binding site such as BINDING SITE I, BINDING SITE II or BINDING SITE III. Table 2 illustrates the complementarity of the nucleotide sequences of DT1P1A10 BINDING SITE, designated SEQ ID:30860, to the nucleotide sequence of VGAM1959 RNA, herein designated VGAM RNA, also designated SEQ ID:4670.

Another function of VGAM1959 is therefore inhibition of DT1P1A10 (Accession XM_029187). Accordingly, utilities of VGAM1959 include diagnosis, prevention and treatment of diseases and clinical conditions associated with DT1P1A10. DVS27 (Accession NM_033439) is another VGAM1959 host target gene. DVS27 BINDING SITE is HOST TARGET binding site found in the 3' untranslated region of mRNA encoded by DVS27, corresponding to a HOST TARGET binding site such as BINDING SITE I, BINDING SITE II or BINDING SITE III. Table 2 illustrates the complementarity of the nucleotide sequences of DVS27 BINDING SITE, designated SEQ ID:27251, to the nucleotide sequence of VGAM1959 RNA, herein designated VGAM RNA, also designated SEQ ID:4670.

Another function of VGAM1959 is therefore inhibition of DVS27 (Accession NM_033439). Accordingly, utilities of VGAM1959 include diagnosis, prevention and treatment of diseases and clinical conditions associated with DVS27. Erythrocyte Membrane Protein Band 4.1-like 1 (EPB41L1, Accession XM_047295) is another VGAM1959 host target gene. EPB41L1 BINDING SITE is HOST TARGET binding site found in the 3' untranslated region of mRNA encoded by EPB41L1, corresponding to a HOST TARGET binding site such as BINDING SITE I, BINDING SITE II or BINDING SITE III. Table 2 illustrates the complementarity of the nucleotide sequences of EPB41L1 BINDING SITE, designated SEQ ID:34940, to the nucleotide sequence of VGAM1959 RNA, herein designated VGAM RNA, also designated SEQ ID:4670.

Another function of VGAM1959 is therefore inhibition of Erythrocyte Membrane Protein Band 4.1-like 1 (EPB41L1, Accession XM_047295). Accordingly, utilities of VGAM1959 include diagnosis, prevention and treatment of diseases and clinical conditions associated with EPB41L1. F-box Only Protein 27 (FBXO27, Accession XM_059045) is another VGAM1959 host target gene. FBXO27 BINDING SITE is HOST TARGET binding site found in the 3' untranslated region of mRNA encoded by FBXO27, corresponding to a HOST TARGET binding site such as BINDING SITE I, BINDING SITE II or BINDING SITE III. Table 2 illustrates the complementarity of the nucleotide sequences of FBXO27 BINDING SITE, designated SEQ ID:36835, to the nucleotide sequence of VGAM1959 RNA, herein designated VGAM RNA, also designated SEQ ID:4670.

Another function of VGAM1959 is therefore inhibition of F-box Only Protein 27 (FBXO27, Accession XM_059045). Accordingly, utilities of VGAM1959 include diagnosis, prevention and treatment of diseases and clinical conditions associated with FBXO27. FK506 Binding Protein 14, 22 KDa (FKBP14, Accession NM_017946) is another VGAM1959 host target gene. FKBP14 BINDING SITE is HOST TARGET binding site found in the 3' untranslated region of mRNA encoded by FKBP14, corresponding to a HOST TARGET binding site such as BINDING SITE I, BINDING SITE II or BINDING SITE III. Table 2 illustrates the complementarity of the nucleotide sequences of FKBP14 BINDING SITE, designated SEQ ID:19644, to the nucleotide sequence of VGAM1959 RNA, herein designated VGAM RNA, also designated SEQ ID:4670.

Another function of VGAM1959 is therefore inhibition of FK506 Binding Protein 14, 22 KDa (FKBP14, Accession NM_017946). Accordingly, utilities of VGAM1959 include diagnosis, prevention and treatment of diseases and clinical conditions associated with FKBP14. FK506 Binding Protein 5 (FKBP5, Accession NM_004117) is another VGAM1959 host target gene. FKBP5 BINDING SITE is HOST TARGET binding site found in the 3' untranslated region of mRNA encoded by FKBP5, corresponding to a HOST TARGET binding site such as BINDING SITE I, BINDING SITE II or BINDING SITE III. Table 2 illustrates the complementarity of the nucleotide sequences of FKBP5 BINDING SITE, designated SEQ ID:10325, to the nucleotide sequence of VGAM1959 RNA, herein designated VGAM RNA, also designated SEQ ID:4670.

Another function of VGAM1959 is therefore inhibition of FK506 Binding Protein 5 (FKBP5, Accession NM_004117). Accordingly, utilities of VGAM1959 include diagnosis, prevention and treatment of diseases and clinical conditions associated with FKBP5. FK506 Binding Protein 9, 63 KDa (FKBP9, Accession XM_168403) is another VGAM1959 host target gene. FKBP9 BINDING SITE is HOST TARGET binding site found in the 5' untranslated region of mRNA encoded by FKBP9, corresponding to a HOST TARGET binding site such as BINDING SITE I, BINDING SITE II or BINDING SITE III. Table 2 illustrates the complementarity of the nucleotide sequences of FKBP9 BINDING SITE, designated SEQ ID:45145, to the nucleotide sequence of VGAM1959 RNA, herein designated VGAM RNA, also designated SEQ ID:4670.

Another function of VGAM1959 is therefore inhibition of FK506 Binding Protein 9, 63 KDa (FKBP9, Accession XM_168403). Accordingly, utilities of VGAM1959 include diagnosis, prevention and treatment of diseases and clinical conditions associated with FKBP9. FKSG28 (Accession NM_030929) is another VGAM1959 host target gene. FKSG28 BINDING SITE is HOST TARGET binding site found in the 3' untranslated region of mRNA encoded by FKSG28, corresponding to a HOST TARGET binding site such as BINDING SITE I, BINDING SITE II or BINDING SITE III. Table 2 illustrates the complementarity of the nucleotide sequences of FKSG28 BINDING SITE, designated SEQ ID:25203, to the nucleotide sequence of VGAM1959 RNA, herein designated VGAM RNA, also designated SEQ ID:4670.

Another function of VGAM1959 is therefore inhibition of FKSG28 (Accession NM_030929). Accordingly, utilities of VGAM1959 include diagnosis, prevention and treatment of diseases and clinical conditions associated with FKSG28. FLJ00026 (Accession XM_036307) is another VGAM1959 host target gene. FLJ00026 BINDING SITE is HOST TARGET binding site found in the 3' untranslated region of mRNA encoded by FLJ00026, corresponding to a HOST TARGET binding site such as BINDING SITE I, BINDING SITE II or BINDING SITE III. Table 2 illustrates the complementarity of the nucleotide sequences of FLJ00026 BINDING SITE, designated SEQ ID:32426, to the nucleotide sequence of VGAM1959 RNA, herein designated VGAM RNA, also designated SEQ ID:4670.

Another function of VGAM1959 is therefore inhibition of FLJ00026 (Accession XM_036307). Accordingly, utilities of VGAM1959 include diagnosis, prevention and treatment of diseases and clinical conditions associated with FLJ00026. FLJ00060 (Accession XM_028154) is another VGAM1959 host target gene. FLJ00060 BINDING SITE is HOST TARGET binding site found in the 5' untranslated region of mRNA encoded by FLJ00060, corresponding to a HOST TARGET binding site such as BINDING SITE I, BINDING SITE II or BINDING SITE III. Table 2 illustrates the complementarity of the nucleotide sequences of FLJ00060 BINDING SITE, designated SEQ ID:30629, to the nucleotide sequence of VGAM1959 RNA, herein designated VGAM RNA, also designated SEQ ID:4670.

Another function of VGAM1959 is therefore inhibition of FLJ00060 (Accession XM_028154). Accordingly, utilities of VGAM1959 include diagnosis, prevention and treatment of diseases and clinical conditions associated with FLJ00060. FLJ10159 (Accession NM_018013) is another VGAM1959 host target gene. FLJ10159 BINDING SITE is HOST TARGET binding site found in the 3' untranslated region of mRNA encoded by FLJ10159, corresponding to a HOST TARGET binding site such as BINDING SITE I, BINDING SITE II or BINDING SITE III. Table 2 illustrates the complementarity of the nucleotide sequences of FLJ10159 BINDING SITE, designated SEQ ID:19750, to the nucleotide sequence of VGAM1959 RNA, herein designated VGAM RNA, also designated SEQ ID:4670.

Another function of VGAM1959 is therefore inhibition of FLJ10159 (Accession NM_018013). Accordingly, utilities of VGAM1959 include diagnosis, prevention and treatment of diseases and clinical conditions associated with FLJ10159. FLJ10656 (Accession NM_018170) is another VGAM1959 host target gene. FLJ10656 BINDING SITE is HOST TARGET binding site found in the 3' untranslated region of mRNA encoded by FLJ10656, corresponding to a HOST TARGET binding site such as BINDING SITE I, BINDING SITE II or BINDING SITE III. Table 2 illustrates the complementarity of the nucleotide sequences of FLJ10656 BINDING SITE, designated SEQ ID:19990, to the nucleotide sequence of VGAM1959 RNA, herein designated VGAM RNA, also designated SEQ ID:4670.

Another function of VGAM1959 is therefore inhibition of FLJ10656 (Accession NM_018170). Accordingly, utilities of VGAM1959 include diagnosis, prevention and treatment of diseases and clinical conditions associated with FLJ10656. FLJ10724 (Accession NM_018194) is another VGAM1959 host target gene. FLJ10724 BINDING SITE is HOST TARGET binding site found in the 3' untranslated region of mRNA encoded by FLJ10724, corresponding to a HOST TARGET binding site such as BINDING SITE I, BINDING SITE II or BINDING SITE III. Table 2 illustrates the complementarity of the nucleotide sequences of FLJ10724 BINDING SITE, designated SEQ ID:20050, to the nucleotide sequence of VGAM1959 RNA, herein designated VGAM RNA, also designated SEQ ID:4670.

Another function of VGAM1959 is therefore inhibition of FLJ10724 (Accession NM_018194). Accordingly, utilities of VGAM1959 include diagnosis, prevention and treatment of diseases and clinical conditions associated with FLJ10724. FLJ10737 (Accession NM_018198) is another VGAM1959 host target gene. FLJ10737 BINDING SITE is HOST TARGET binding site found in the 3' untranslated region of mRNA encoded by FLJ10737, corresponding to a HOST TARGET binding site such as BINDING SITE I, BINDING SITE II or BINDING SITE III. Table 2 illustrates the complementarity of the nucleotide sequences of FLJ10737 BINDING SITE, designated SEQ ID:20066, to the nucleotide sequence of VGAM1959 RNA, herein designated VGAM RNA, also designated SEQ ID:4670.

Another function of VGAM1959 is therefore inhibition of FLJ10737 (Accession NM_018198). Accordingly, utilities of VGAM1959 include diagnosis, prevention and treatment of diseases and clinical conditions associated with FLJ10737. FLJ10803 (Accession NM_018224) is another VGAM1959 host target gene. FLJ10803 BINDING SITE is HOST TARGET binding site found in the 3' untranslated region of mRNA encoded by FLJ10803, corresponding to a HOST TARGET binding site such as BINDING SITE I, BINDING SITE II or BINDING SITE III. Table 2 illustrates the complementarity of the nucleotide sequences of FLJ10803 BINDING SITE, designated SEQ ID:20151, to the nucleotide sequence of VGAM1959 RNA, herein designated VGAM RNA, also designated SEQ ID:4670.

Another function of VGAM1959 is therefore inhibition of FLJ10803 (Accession NM_018224). Accordingly, utilities of VGAM1959 include diagnosis, prevention and treatment of diseases and clinical conditions associated with FLJ10803. FLJ11252 (Accession XM_041702) is another VGAM1959 host target gene. FLJ11252 BINDING SITE is HOST TARGET binding site found in the 3' untranslated region of mRNA encoded by FLJ11252, corresponding to a HOST TARGET binding site such as BINDING SITE I, BINDING SITE II or BINDING SITE III. Table 2 illustrates the complementarity of the nucleotide sequences of FLJ11252 BINDING SITE, designated SEQ ID:33567, to the nucleotide sequence of VGAM1959 RNA, herein designated VGAM RNA, also designated SEQ ID:4670.

Another function of VGAM1959 is therefore inhibition of FLJ11252 (Accession XM_041702). Accordingly, utilities of VGAM1959 include diagnosis, prevention and treatment of diseases and clinical conditions associated with FLJ11252. FLJ11710 (Accession NM_024846) is another VGAM1959 host target gene. FLJ11710 BINDING SITE is HOST TARGET binding site found in the 3' untranslated region of mRNA encoded by FLJ11710, corresponding to a HOST TARGET binding site such as BINDING SITE I, BINDING SITE II or BINDING SITE III. Table 2 illustrates the complementarity of the nucleotide sequences of FLJ11710 BINDING SITE, designated SEQ ID:24274, to the nucleotide sequence of VGAM1959 RNA, herein designated VGAM RNA, also designated SEQ ID:4670.

Another function of VGAM1959 is therefore inhibition of FLJ11710 (Accession NM_024846). Accordingly, utilities of VGAM1959 include diagnosis, prevention and treatment of diseases and clinical conditions associated with FLJ11710. FLJ12122 (Accession NM_024979) is another VGAM1959 host target gene. FLJ12122 BINDING SITE is HOST TARGET binding site found in the 3' untranslated region of mRNA encoded by FLJ12122, corresponding to a HOST TARGET binding site such as BINDING SITE I, BINDING SITE II or BINDING SITE III. Table 2 illustrates the complementarity of the nucleotide sequences of FLJ12122 BINDING SITE, designated SEQ ID:24539, to the nucleotide sequence of VGAM1959 RNA, herein designated VGAM RNA, also designated SEQ ID:4670.

Another function of VGAM1959 is therefore inhibition of FLJ12122 (Accession NM_024979). Accordingly, utilities of VGAM1959 include diagnosis, prevention and treatment of diseases and clinical conditions associated with FLJ12122. FLJ12190 (Accession NM_025071) is another VGAM1959 host target gene. FLJ12190 BINDING SITE is HOST TARGET binding site found in the 3' untranslated region of mRNA encoded by FLJ12190, corresponding to a HOST TARGET binding site such as BINDING SITE I, BINDING SITE II or BINDING SITE III. Table 2 illustrates the complementarity of the nucleotide sequences of FLJ12190 BINDING SITE, designated SEQ ID:24668, to the nucleotide sequence of VGAM1959 RNA, herein designated VGAM RNA, also designated SEQ ID:4670.

Another function of VGAM1959 is therefore inhibition of FLJ12190 (Accession NM_025071). Accordingly, utilities of VGAM1959 include diagnosis, prevention and treatment of diseases and clinical conditions associated with FLJ12190. FLJ12287 (Accession NM_022367) is another VGAM1959 host target gene. FLJ12287 BINDING SITE is HOST TARGET binding site found in the 5' untranslated region of mRNA encoded by FLJ12287, corresponding to a HOST TARGET binding site such as BINDING SITE I, BINDING SITE II or BINDING SITE III. Table 2 illustrates the complementarity of the nucleotide sequences of FLJ12287 BINDING SITE, designated SEQ ID:22754, to the nucleotide sequence of VGAM1959 RNA, herein designated VGAM RNA, also designated SEQ ID:4670.

Another function of VGAM1959 is therefore inhibition of FLJ12287 (Accession NM_022367). Accordingly, utilities of VGAM1959 include diagnosis, prevention and treatment of diseases and clinical conditions associated with FLJ12287. FLJ12443 (Accession NM_024830) is another VGAM1959 host target gene. FLJ12443 BINDING SITE is HOST TARGET binding site found in the 3' untranslated region of mRNA encoded by FLJ12443, corresponding to a HOST TARGET binding site such as BINDING SITE I, BINDING SITE II or BINDING SITE III. Table 2 illustrates the complementarity of the nucleotide sequences of FLJ12443 BINDING SITE, designated SEQ ID:24223, to the nucleotide sequence of VGAM1959 RNA, herein designated VGAM RNA, also designated SEQ ID:4670.

Another function of VGAM1959 is therefore inhibition of FLJ12443 (Accession NM_024830). Accordingly, utilities of VGAM1959 include diagnosis, prevention and treatment of diseases and clinical conditions associated with FLJ12443. FLJ12517 (Accession NM_023007) is another VGAM1959 host target gene. FLJ12517 BINDING SITE is HOST TARGET binding site found in the 3' untranslated region of mRNA encoded by FLJ12517, corresponding to a HOST TARGET binding site such as BINDING SITE I, BINDING SITE II or BINDING SITE III. Table 2 illustrates the complementarity of the nucleotide sequences of FLJ12517 BINDING SITE, designated SEQ ID:23268, to the nucleotide sequence of VGAM1959 RNA, herein designated VGAM RNA, also designated SEQ ID:4670.

Another function of VGAM1959 is therefore inhibition of FLJ12517 (Accession NM_023007). Accordingly, utilities of VGAM1959 include diagnosis, prevention and treatment of diseases and clinical conditions associated with FLJ12517. FLJ12547 (Accession NM_024992) is another VGAM1959 host target gene. FLJ12547 BINDING SITE is HOST TARGET binding site found in the 3' untranslated region of mRNA encoded by FLJ12547, corresponding to a HOST TARGET binding site such as BINDING SITE I, BINDING SITE II or BINDING SITE III. Table 2 illustrates the complementarity of the nucleotide sequences of FLJ12547 BINDING SITE, designated SEQ ID:24548, to the nucleotide sequence of VGAM1959 RNA, herein designated VGAM RNA, also designated SEQ ID:4670.

Another function of VGAM1959 is therefore inhibition of FLJ12547 (Accession NM_024992). Accordingly, utilities of VGAM1959 include diagnosis, prevention and treatment of diseases and clinical conditions associated with FLJ12547. FLJ12650 (Accession NM_024522) is another VGAM1959 host target gene. FLJ12650 BINDING SITE is HOST TARGET binding site found in the 3' untranslated region of mRNA encoded by FLJ12650, corresponding to a HOST TARGET binding site such as BINDING SITE I, BINDING SITE II or BINDING SITE III. Table 2 illustrates the complementarity of the nucleotide sequences of FLJ12650 BINDING SITE, designated SEQ ID:23724, to the nucleotide sequence of VGAM1959 RNA, herein designated VGAM RNA, also designated SEQ ID:4670.

Another function of VGAM1959 is therefore inhibition of FLJ12650 (Accession NM_024522). Accordingly, utilities of VGAM1959 include diagnosis, prevention and treatment of diseases and clinical conditions associated with FLJ12650. FLJ12687 (Accession NM_024917) is another VGAM1959 host target gene. FLJ12687 BINDING SITE is HOST TARGET binding site found in the 3' untranslated region of mRNA encoded by FLJ12687, corresponding to a HOST TARGET binding site such as BINDING SITE I, BINDING SITE II or BINDING SITE III. Table 2 illustrates the complementarity of the nucleotide sequences of FLJ12687 BINDING SITE, designated SEQ ID:24445, to the nucleotide sequence of VGAM1959 RNA, herein designated VGAM RNA, also designated SEQ ID:4670.

Another function of VGAM1959 is therefore inhibition of FLJ12687 (Accession NM_024917). Accordingly, utilities of VGAM1959 include diagnosis, prevention and treatment of diseases and clinical conditions associated with FLJ12687. FLJ12800 (Accession NM_022903) is another VGAM1959 host target gene. FLJ12800 BINDING SITE is HOST TARGET binding site found in the 3' untranslated region of mRNA encoded by FLJ12800, corresponding to a HOST TARGET binding site such as BINDING SITE I, BINDING SITE II or BINDING SITE III. Table 2 illustrates the complementarity of the nucleotide sequences of FLJ12800 BINDING SITE, designated SEQ ID:23190, to the nucleotide sequence of VGAM1959 RNA, herein designated VGAM RNA, also designated SEQ ID:4670.

Another function of VGAM1959 is therefore inhibition of FLJ12800 (Accession NM_022903). Accordingly, utilities of VGAM1959 include diagnosis, prevention and treatment of diseases and clinical conditions associated with FLJ12800. FLJ12895 (Accession NM_023926) is another VGAM1959 host target gene. FLJ12895 BINDING SITE is HOST TARGET binding site found in the 5' untranslated region of mRNA encoded by FLJ12895, corresponding to a HOST TARGET binding site such as BINDING SITE I, BINDING SITE II or BINDING SITE III. Table 2 illustrates the complementarity of the nucleotide sequences of FLJ12895 BINDING SITE, designated SEQ ID:23404, to the nucleotide sequence of VGAM1959 RNA, herein designated VGAM RNA, also designated SEQ ID:4670.

Another function of VGAM1959 is therefore inhibition of FLJ12895 (Accession NM_023926). Accordingly, utilities of VGAM1959 include diagnosis, prevention and treatment of diseases and clinical conditions associated with FLJ12895. FLJ13072 (Accession XM_117117) is another VGAM1959 host target gene. FLJ13072 BINDING SITE is HOST TARGET binding site found in the 5' untranslated region of mRNA encoded by FLJ13072, corresponding to a HOST TARGET binding site such as BINDING SITE I, BINDING SITE II or BINDING SITE III. Table 2 illustrates the complementarity of the nucleotide sequences of FLJ13072 BINDING SITE, designated SEQ ID:43239, to the nucleotide sequence of VGAM1959 RNA, herein designated VGAM RNA, also designated SEQ ID:4670.

Another function of VGAM1959 is therefore inhibition of FLJ13072 (Accession XM_117117). Accordingly, utilities of VGAM1959 include diagnosis, prevention and treatment of diseases and clinical conditions associated with FLJ13072. FLJ13158 (Accession NM_024909) is another VGAM1959 host target gene. FLJ13158 BINDING SITE is HOST TARGET binding site found in the 3' untranslated region of mRNA encoded by FLJ13158, corresponding to a HOST TARGET binding site such as BINDING SITE I, BINDING SITE II or BINDING SITE III. Table 2 illustrates the complementarity of the nucleotide sequences of FLJ13158 BINDING SITE, designated SEQ ID:24409, to the nucleotide sequence of VGAM1959 RNA, herein designated VGAM RNA, also designated SEQ ID:4670.

Another function of VGAM1959 is therefore inhibition of FLJ13158 (Accession NM_024909). Accordingly, utilities of VGAM1959 include diagnosis, prevention and treatment of diseases and clinical conditions associated with FLJ13158. FLJ13181 (Accession NM_025188) is another VGAM1959 host target gene. FLJ13181 BINDING SITE is HOST TARGET binding site found in the 5' untranslated region of mRNA encoded by FLJ13181, corresponding to a HOST TARGET binding site such as BINDING SITE I, BINDING SITE II or BINDING SITE III. Table 2 illustrates the complementarity of the nucleotide sequences of FLJ13181 BINDING SITE, designated SEQ ID:24828, to the nucleotide sequence of VGAM1959 RNA, herein designated VGAM RNA, also designated SEQ ID:4670.

Another function of VGAM1959 is therefore inhibition of FLJ13181 (Accession NM_025188). Accordingly, utilities of VGAM1959 include diagnosis, prevention and treatment of diseases and clinical conditions associated with FLJ13181. FLJ13544 (Accession NM_025008) is another VGAM1959 host target gene. FLJ13544 BINDING SITE is HOST TARGET binding site found in the 5' untranslated region of mRNA encoded by FLJ13544, corresponding to a HOST TARGET binding site such as BINDING SITE I, BINDING SITE II or BINDING SITE III. Table 2 illustrates the complementarity of the nucleotide sequences of FLJ13544 BINDING SITE, designated SEQ ID:24579, to the nucleotide sequence of VGAM1959 RNA, herein designated VGAM RNA, also designated SEQ ID:4670.

Another function of VGAM1959 is therefore inhibition of FLJ13544 (Accession NM_025008). Accordingly, utilities of VGAM1959 include diagnosis, prevention and treatment of diseases and clinical conditions associated with FLJ13544. FLJ13910 (Accession NM_022780) is another VGAM1959 host target gene. FLJ13910 BINDING SITE is HOST TARGET binding site found in the 3' untranslated region of mRNA encoded by FLJ13910, corresponding to a HOST TARGET binding site such as BINDING SITE I, BINDING SITE II or BINDING SITE III. Table 2 illustrates the complementarity of the nucleotide sequences of FLJ13910 BINDING SITE, designated SEQ ID:23056, to the nucleotide sequence of VGAM1959 RNA, herein designated VGAM RNA, also designated SEQ ID:4670.

Another function of VGAM1959 is therefore inhibition of FLJ13910 (Accession NM_022780). Accordingly, utilities of VGAM1959 include diagnosis, prevention and treatment of diseases and clinical conditions associated with FLJ13910. FLJ14084 (Accession NM_021637) is another VGAM1959 host target gene. FLJ14084 BINDING SITE is HOST TARGET binding site found in the 3' untranslated region of mRNA encoded by FLJ14084, corresponding to a HOST TARGET binding site such as BINDING SITE I, BINDING SITE II or BINDING SITE III. Table 2 illustrates the complementarity of the nucleotide sequences of FLJ14084 BINDING SITE, designated SEQ ID:22284, to the nucleotide sequence of VGAM1959 RNA, herein designated VGAM RNA, also designated SEQ ID:4670.

Another function of VGAM1959 is therefore inhibition of FLJ14084 (Accession NM_021637). Accordingly, utilities of VGAM1959 include diagnosis, prevention and treatment of diseases and clinical conditions associated with FLJ14084. FLJ14213 (Accession NM_024841) is another VGAM1959 host target gene. FLJ14213 BINDING SITE1 and FLJ14213 BINDING SITE2 are HOST TARGET binding sites found in untranslated regions of mRNA encoded by FLJ14213, corresponding to HOST TARGET binding sites such as BINDING SITE I, BINDING SITE II or BINDING SITE III. Table 2 illustrates the complementarity of the nucleotide sequences of FLJ14213 BINDING SITE1 and FLJ14213 BINDING SITE2, designated SEQ ID:24256 and SEQ ID:24257 respectively, to the nucleotide sequence of VGAM1959 RNA, herein designated VGAM RNA, also designated SEQ ID:4670.

Another function of VGAM1959 is therefore inhibition of FLJ14213 (Accession NM_024841). Accordingly, utilities of VGAM1959 include diagnosis, prevention and treatment of diseases and clinical conditions associated with FLJ14213. FLJ14641 (Accession NM_032817) is another VGAM1959 host target gene. FLJ14641 BINDING SITE is HOST TARGET binding site found in the 3' untranslated region of mRNA encoded by FLJ14641, corresponding to a HOST TARGET binding site such as BINDING SITE I, BINDING SITE II or BINDING SITE III. Table 2 illustrates the complementarity of the nucleotide sequences of FLJ14641 BINDING SITE, designated SEQ ID:26589, to the nucleotide sequence of VGAM1959 RNA, herein designated VGAM RNA, also designated SEQ ID:4670.

Another function of VGAM1959 is therefore inhibition of FLJ14641 (Accession NM_032817). Accordingly, utilities of VGAM1959 include diagnosis, prevention and treatment of diseases and clinical conditions associated with FLJ14641.

FLJ14681 (Accession NM_032824) is another VGAM1959 host target gene. FLJ14681 BINDING SITE is HOST TARGET binding site found in the 3' untranslated region of mRNA encoded by FLJ14681, corresponding to a HOST TARGET binding site such as BINDING SITE I, BINDING SITE II or BINDING SITE III. Table 2 illustrates the complementarity of the nucleotide sequences of FLJ14681 BINDING SITE, designated SEQ ID:26597, to the nucleotide sequence of VGAM1959 RNA, herein designated VGAM RNA, also designated SEQ ID:4670.

Another function of VGAM1959 is therefore inhibition of FLJ14681 (Accession NM_032824). Accordingly, utilities of VGAM1959 include diagnosis, prevention and treatment of diseases and clinical conditions associated with FLJ14681.

FLJ14743 (Accession XM_042708) is another VGAM1959 host target gene. FLJ14743 BINDING SITE is HOST TARGET binding site found in the 3' untranslated region of mRNA encoded by FLJ14743, corresponding to a HOST TARGET binding site such as BINDING SITE I, BINDING SITE II or BINDING SITE III. Table 2 illustrates the complementarity of the nucleotide sequences of FLJ14743 BINDING SITE, designated SEQ ID:33764, to the nucleotide sequence of VGAM1959 RNA, herein designated VGAM RNA, also designated SEQ ID:4670.

Another function of VGAM1959 is therefore inhibition of FLJ14743 (Accession XM_042708). Accordingly, utilities of VGAM1959 include diagnosis, prevention and treatment of diseases and clinical conditions associated with FLJ14743.

FLJ14816 (Accession NM_032845) is another VGAM1959 host target gene. FLJ14816 BINDING SITE is HOST TARGET binding site found in the 3' untranslated region of mRNA encoded by FLJ14816, corresponding to a HOST TARGET binding site such as BINDING SITE I, BINDING SITE II or BINDING SITE III. Table 2 illustrates the complementarity of the nucleotide sequences of FLJ14816 BINDING SITE, designated SEQ ID:26639, to the nucleotide sequence of VGAM1959 RNA, herein designated VGAM RNA, also designated SEQ ID:4670.

Another function of VGAM1959 is therefore inhibition of FLJ14816 (Accession NM_032845). Accordingly, utilities of VGAM1959 include diagnosis, prevention and treatment of diseases and clinical conditions associated with FLJ14816.

FLJ14957 (Accession NM_032866) is another VGAM1959 host target gene. FLJ14957 BINDING SITE1 and FLJ14957 BINDING SITE2 are HOST TARGET binding sites found in untranslated regions of mRNA encoded by FLJ14957, corresponding to HOST TARGET binding sites such as BINDING SITE I, BINDING SITE II or BINDING SITE III. Table 2 illustrates the complementarity of the nucleotide sequences of FLJ14957 BINDING SITE1 and FLJ14957 BINDING SITE2, designated SEQ ID:26681 and SEQ ID:26684 respectively, to the nucleotide sequence of VGAM1959 RNA, herein designated VGAM RNA, also designated SEQ ID:4670.

Another function of VGAM1959 is therefore inhibition of FLJ14957 (Accession NM_032866). Accordingly, utilities of VGAM1959 include diagnosis, prevention and treatment of diseases and clinical conditions associated with FLJ14957.

FLJ20209 (Accession XM_098142) is another VGAM1959 host target gene. FLJ20209 BINDING SITE is HOST TARGET binding site found in the 3' untranslated region of mRNA encoded by FLJ20209, corresponding to a HOST TARGET binding site such as BINDING SITE I, BINDING SITE II or BINDING SITE III. Table 2 illustrates the complementarity of the nucleotide sequences of FLJ20209 BINDING SITE, designated SEQ ID:41405, to the nucleotide sequence of VGAM1959 RNA, herein designated VGAM RNA, also designated SEQ ID:4670.

Another function of VGAM1959 is therefore inhibition of FLJ20209 (Accession XM_098142). Accordingly, utilities of VGAM1959 include diagnosis, prevention and treatment of diseases and clinical conditions associated with FLJ20209.

FLJ20297 (Accession NM_017951) is another VGAM1959 host target gene. FLJ20297 BINDING SITE1 and FLJ20297 BINDING SITE2 are HOST TARGET binding sites found in untranslated regions of mRNA encoded by FLJ20297, corresponding to HOST TARGET binding sites such as BINDING SITE I, BINDING SITE II or BINDING SITE III. Table 2 illustrates the complementarity of the nucleotide sequences of FLJ20297 BINDING SITE1 and FLJ20297 BINDING SITE2, designated SEQ ID:19651 and SEQ ID:19360 respectively, to the nucleotide sequence of VGAM1959 RNA, herein designated VGAM RNA, also designated SEQ ID:4670.

Another function of VGAM1959 is therefore inhibition of FLJ20297 (Accession NM_017951). Accordingly, utilities of VGAM1959 include diagnosis, prevention and treatment of diseases and clinical conditions associated with FLJ20297.

FLJ20477 (Accession NM_017837) is another VGAM1959 host target gene. FLJ20477 BINDING SITE is HOST TARGET binding site found in the 5' untranslated region of mRNA encoded by FLJ20477, corresponding to a HOST TARGET binding site such as BINDING SITE I, BINDING SITE II or BINDING SITE III. Table 2 illustrates the complementarity of the nucleotide sequences of FLJ20477 BINDING SITE, designated SEQ ID:19502, to the nucleotide sequence of VGAM1959 RNA, herein designated VGAM RNA, also designated SEQ ID:4670.

Another function of VGAM1959 is therefore inhibition of FLJ20477 (Accession NM_017837). Accordingly, utilities of VGAM1959 include diagnosis, prevention and treatment of diseases and clinical conditions associated with FLJ20477.

FLJ20509 (Accession NM_017851) is another VGAM1959 host target gene. FLJ20509 BINDING SITE is HOST TARGET binding site found in the 5' untranslated region of mRNA encoded by FLJ20509, corresponding to a HOST TARGET binding site such as BINDING SITE I, BINDING SITE II or BINDING SITE III. Table 2 illustrates the complementarity of the nucleotide sequences of FLJ20509 BINDING SITE, designated SEQ ID:19523, to the nucleotide sequence of VGAM1959 RNA, herein designated VGAM RNA, also designated SEQ ID:4670.

Another function of VGAM1959 is therefore inhibition of FLJ20509 (Accession NM_017851). Accordingly, utilities of VGAM1959 include diagnosis, prevention and treatment of diseases and clinical conditions associated with FLJ20509.

FLJ21276 (Accession NM_024633) is another VGAM1959 host target gene. FLJ21276 BINDING SITE is HOST TARGET binding site found in the 5' untranslated region of mRNA encoded by FLJ21276, corresponding to a HOST TARGET binding site such as BINDING SITE I, BINDING SITE II or BINDING SITE III. Table 2 illustrates the complementarity of the nucleotide sequences of FLJ21276 BINDING SITE, designated SEQ ID:23904, to the nucleotide sequence of VGAM1959 RNA, herein designated VGAM RNA, also designated SEQ ID:4670.

Another function of VGAM1959 is therefore inhibition of FLJ21276 (Accession NM_024633). Accordingly, utilities of VGAM1959 include diagnosis, prevention and treatment of diseases and clinical conditions associated with FLJ21276.
FLJ21313 (Accession NM_023927) is another VGAM1959 host target gene. FLJ21313 BINDING SITE is HOST TARGET binding site found in the 3' untranslated region of mRNA encoded by FLJ21313, corresponding to a HOST TARGET binding site such as BINDING SITE I, BINDING SITE II or BINDING SITE III. Table 2 illustrates the complementarity of the nucleotide sequences of FLJ21313 BINDING SITE, designated SEQ ID:23408, to the nucleotide sequence of VGAM1959 RNA, herein designated VGAM RNA, also designated SEQ ID:4670.

Another function of VGAM1959 is therefore inhibition of FLJ21313 (Accession NM_023927). Accordingly, utilities of VGAM1959 include diagnosis, prevention and treatment of diseases and clinical conditions associated with FLJ21313.
FLJ21551 (Accession NM_024801) is another VGAM1959 host target gene. FLJ21551 BINDING SITE is HOST TARGET binding site found in the 3' untranslated region of mRNA encoded by FLJ21551, corresponding to a HOST TARGET binding site such as BINDING SITE I, BINDING SITE II or BINDING SITE III. Table 2 illustrates the complementarity of the nucleotide sequences of FLJ21551 BINDING SITE, designated SEQ ID:24180, to the nucleotide sequence of VGAM1959 RNA, herein designated VGAM RNA, also designated SEQ ID:4670.

Another function of VGAM1959 is therefore inhibition of FLJ21551 (Accession NM_024801). Accordingly, utilities of VGAM1959 include diagnosis, prevention and treatment of diseases and clinical conditions associated with FLJ21551.
FLJ21865 (Accession NM_022759) is another VGAM1959 host target gene. FLJ21865 BINDING SITE is HOST TARGET binding site found in the 3' untranslated region of mRNA encoded by FLJ21865, corresponding to a HOST TARGET binding site such as BINDING SITE I, BINDING SITE II or BINDING SITE III. Table 2 illustrates the complementarity of the nucleotide sequences of FLJ21865 BINDING SITE, designated SEQ ID:23000, to the nucleotide sequence of VGAM1959 RNA, herein designated VGAM RNA, also designated SEQ ID:4670.

Another function of VGAM1959 is therefore inhibition of FLJ21865 (Accession NM_022759). Accordingly, utilities of VGAM1959 include diagnosis, prevention and treatment of diseases and clinical conditions associated with FLJ21865.
FLJ22035 (Accession NM_024523) is another VGAM1959 host target gene. FLJ22035 BINDING SITE is HOST TARGET binding site found in the 3' untranslated region of mRNA encoded by FLJ22035, corresponding to a HOST TARGET binding site such as BINDING SITE I, BINDING SITE II or BINDING SITE III. Table 2 illustrates the complementarity of the nucleotide sequences of FLJ22035 BINDING SITE, designated SEQ ID:23725, to the nucleotide sequence of VGAM1959 RNA, herein designated VGAM RNA, also designated SEQ ID:4670.

Another function of VGAM1959 is therefore inhibition of FLJ22035 (Accession NM_024523). Accordingly, utilities of VGAM1959 include diagnosis, prevention and treatment of diseases and clinical conditions associated with FLJ22035.
FLJ22233 (Accession NM_024959) is another VGAM1959 host target gene. FLJ22233 BINDING SITE is HOST TARGET binding site found in the 3' untranslated region of mRNA encoded by FLJ22233, corresponding to a HOST TARGET binding site such as BINDING SITE I, BINDING SITE II or BINDING SITE III. Table 2 illustrates the complementarity of the nucleotide sequences of FLJ22233 BINDING SITE, designated SEQ ID:24515, to the nucleotide sequence of VGAM1959 RNA, herein designated VGAM RNA, also designated SEQ ID:4670.

Another function of VGAM1959 is therefore inhibition of FLJ22233 (Accession NM_024959). Accordingly, utilities of VGAM1959 include diagnosis, prevention and treatment of diseases and clinical conditions associated with FLJ22233.
FLJ22341 (Accession NM_024599) is another VGAM1959 host target gene. FLJ22341 BINDING SITE is HOST TARGET binding site found in the 3' untranslated region of mRNA encoded by FLJ22341, corresponding to a HOST TARGET binding site such as BINDING SITE I, BINDING SITE II or BINDING SITE III. Table 2 illustrates the complementarity of the nucleotide sequences of FLJ22341 BINDING SITE, designated SEQ ID:23849, to the nucleotide sequence of VGAM1959 RNA, herein designated VGAM RNA, also designated SEQ ID:4670.

Another function of VGAM1959 is therefore inhibition of FLJ22341 (Accession NM_024599). Accordingly, utilities of VGAM1959 include diagnosis, prevention and treatment of diseases and clinical conditions associated with FLJ22341.
FLJ22474 (Accession NM_024719) is another VGAM1959 host target gene. FLJ22474 BINDING SITE is HOST TARGET binding site found in the 3' untranslated region of mRNA encoded by FLJ22474, corresponding to a HOST TARGET binding site such as BINDING SITE I, BINDING SITE II or BINDING SITE III. Table 2 illustrates the complementarity of the nucleotide sequences of FLJ22474 BINDING SITE, designated SEQ ID:24050, to the nucleotide sequence of VGAM1959 RNA, herein designated VGAM RNA, also designated SEQ ID:4670.

Another function of VGAM1959 is therefore inhibition of FLJ22474 (Accession NM_024719). Accordingly, utilities of VGAM1959 include diagnosis, prevention and treatment of diseases and clinical conditions associated with FLJ22474.
FLJ22479 (Accession NM_024900) is another VGAM1959 host target gene. FLJ22479 BINDING SITE is HOST TARGET binding site found in the 3' untranslated region of mRNA encoded by FLJ22479, corresponding to a HOST TARGET binding site such as BINDING SITE I, BINDING SITE II or BINDING SITE III. Table 2 illustrates the complementarity of the nucleotide sequences of FLJ22479 BINDING SITE, designated SEQ ID:24387, to the nucleotide sequence of VGAM1959 RNA, herein designated VGAM RNA, also designated SEQ ID:4670.

Another function of VGAM1959 is therefore inhibition of FLJ22479 (Accession NM_024900). Accordingly, utilities of VGAM1959 include diagnosis, prevention and treatment of diseases and clinical conditions associated with FLJ22479.
FLJ22679 (Accession NM_032227) is another VGAM1959 host target gene. FLJ22679 BINDING SITE is HOST TARGET binding site found in the 5' untranslated region of mRNA encoded by FLJ22679, corresponding to a HOST TARGET binding site such as BINDING SITE I, BINDING SITE II or BINDING SITE III. Table 2 illustrates the complementarity of the nucleotide sequences of FLJ22679 BINDING SITE, designated SEQ ID:25949, to the nucleotide sequence of VGAM1959 RNA, herein designated VGAM RNA, also designated SEQ ID:4670.

Another function of VGAM1959 is therefore inhibition of FLJ22679 (Accession NM_032227). Accordingly, utilities of VGAM1959 include diagnosis, prevention and treatment of diseases and clinical conditions associated with FLJ22679.
FLJ22761 (Accession NM_025130) is another VGAM1959 host target gene. FLJ22761 BINDING SITE is HOST TAR- GET binding site found in the 5' untranslated region of mRNA encoded by FLJ22761, corresponding to a HOST TARGET binding site such as BINDING SITE I, BINDING SITE II or BINDING SITE III. Table 2 illustrates the complementarity of the nucleotide sequences of FLJ22761 BINDING SITE, designated SEQ ID:24773, to the nucleotide sequence of VGAM1959 RNA, herein designated VGAM RNA, also designated SEQ ID:4670.

Another function of VGAM1959 is therefore inhibition of FLJ22761 (Accession NM_025130). Accordingly, utilities of VGAM1959 include diagnosis, prevention and treatment of diseases and clinical conditions associated with FLJ22761. FLJ22940 (Accession NM_024571) is another VGAM1959 host target gene. FLJ22940 BINDING SITE is HOST TARGET binding site found in the 5' untranslated region of mRNA encoded by FLJ22940, corresponding to a HOST TARGET binding site such as BINDING SITE I, BINDING SITE II or BINDING SITE III. Table 2 illustrates the complementarity of the nucleotide sequences of FLJ22940 BINDING SITE, designated SEQ ID:23798, to the nucleotide sequence of VGAM1959 RNA, herein designated VGAM RNA, also designated SEQ ID:4670.

Another function of VGAM1959 is therefore inhibition of FLJ22940 (Accession NM_024571). Accordingly, utilities of VGAM1959 include diagnosis, prevention and treatment of diseases and clinical conditions associated with FLJ22940. FLJ23091 (Accession NM_024911) is another VGAM1959 host target gene. FLJ23091 BINDING SITE is HOST TARGET binding site found in the 3' untranslated region of mRNA encoded by FLJ23091, corresponding to a HOST TARGET binding site such as BINDING SITE I, BINDING SITE II or BINDING SITE III. Table 2 illustrates the complementarity of the nucleotide sequences of FLJ23091 BINDING SITE, designated SEQ ID:24418, to the nucleotide sequence of VGAM1959 RNA, herein designated VGAM RNA, also designated SEQ ID:4670.

Another function of VGAM1959 is therefore inhibition of FLJ23091 (Accession NM_024911). Accordingly, utilities of VGAM1959 include diagnosis, prevention and treatment of diseases and clinical conditions associated with FLJ23091. FLJ23309 (Accession NM_024896) is another VGAM1959 host target gene. FLJ23309 BINDING SITE is HOST TARGET binding site found in the 3' untranslated region of mRNA encoded by FLJ23309, corresponding to a HOST TARGET binding site such as BINDING SITE I, BINDING SITE II or BINDING SITE III. Table 2 illustrates the complementarity of the nucleotide sequences of FLJ23309 BINDING SITE, designated SEQ ID:24380, to the nucleotide sequence of VGAM1959 RNA, herein designated VGAM RNA, also designated SEQ ID:4670.

Another function of VGAM1959 is therefore inhibition of FLJ23309 (Accession NM_024896). Accordingly, utilities of VGAM1959 include diagnosis, prevention and treatment of diseases and clinical conditions associated with FLJ23309. FLJ23499 (Accession NM_022761) is another VGAM1959 host target gene. FLJ23499 BINDING SITE is HOST TARGET binding site found in the 3' untranslated region of mRNA encoded by FLJ23499, corresponding to a HOST TARGET binding site such as BINDING SITE I, BINDING SITE II or BINDING SITE III. Table 2 illustrates the complementarity of the nucleotide sequences of FLJ23499 BINDING SITE, designated SEQ ID:23007, to the nucleotide sequence of VGAM1959 RNA, herein designated VGAM RNA, also designated SEQ ID:4670.

Another function of VGAM1959 is therefore inhibition of FLJ23499 (Accession NM_022761). Accordingly, utilities of VGAM1959 include diagnosis, prevention and treatment of diseases and clinical conditions associated with FLJ23499. FLJ23556 (Accession NM_024880) is another VGAM1959 host target gene. FLJ23556 BINDING SITE is HOST TARGET binding site found in the 3' untranslated region of mRNA encoded by FLJ23556, corresponding to a HOST TARGET binding site such as BINDING SITE I, BINDING SITE II or BINDING SITE III. Table 2 illustrates the complementarity of the nucleotide sequences of FLJ23556 BINDING SITE, designated SEQ ID:24320, to the nucleotide sequence of VGAM1959 RNA, herein designated VGAM RNA, also designated SEQ ID:4670.

Another function of VGAM1959 is therefore inhibition of FLJ23556 (Accession NM_024880). Accordingly, utilities of VGAM1959 include diagnosis, prevention and treatment of diseases and clinical conditions associated with FLJ23556. FLJ25442 (Accession NM_145026) is another VGAM1959 host target gene. FLJ25442 BINDING SITE is HOST TARGET binding site found in the 5' untranslated region of mRNA encoded by FLJ25442, corresponding to a HOST TARGET binding site such as BINDING SITE I, BINDING SITE II or BINDING SITE III. Table 2 illustrates the complementarity of the nucleotide sequences of FLJ25442 BINDING SITE, designated SEQ ID:29641, to the nucleotide sequence of VGAM1959 RNA, herein designated VGAM RNA, also designated SEQ ID:4670.

Another function of VGAM1959 is therefore inhibition of FLJ25442 (Accession NM_145026). Accordingly, utilities of VGAM1959 include diagnosis, prevention and treatment of diseases and clinical conditions associated with FLJ25442. FLJ31709 (Accession NM_144636) is another VGAM1959 host target gene. FLJ31709 BINDING SITE is HOST TARGET binding site found in the 3' untranslated region of mRNA encoded by FLJ31709, corresponding to a HOST TARGET binding site such as BINDING SITE I, BINDING SITE II or BINDING SITE III. Table 2 illustrates the complementarity of the nucleotide sequences of FLJ31709 BINDING SITE, designated SEQ ID:29460, to the nucleotide sequence of VGAM1959 RNA, herein designated VGAM RNA, also designated SEQ ID:4670.

Another function of VGAM1959 is therefore inhibition of FLJ31709 (Accession NM_144636). Accordingly, utilities of VGAM1959 include diagnosis, prevention and treatment of diseases and clinical conditions associated with FLJ31709. FLJ31951 (Accession NM_144726) is another VGAM1959 host target gene. FLJ31951 BINDING SITE is HOST TARGET binding site found in the 3' untranslated region of mRNA encoded by FLJ31951, corresponding to a HOST TARGET binding site such as BINDING SITE I, BINDING SITE II or BINDING SITE III. Table 2 illustrates the complementarity of the nucleotide sequences of FLJ31951 BINDING SITE, designated SEQ ID:29551, to the nucleotide sequence of VGAM1959 RNA, herein designated VGAM RNA, also designated SEQ ID:4670.

Another function of VGAM1959 is therefore inhibition of FLJ31951 (Accession NM_144726). Accordingly, utilities of VGAM1959 include diagnosis, prevention and treatment of diseases and clinical conditions associated with FLJ31951. FLJ32334 (Accession NM_144565) is another VGAM1959 host target gene. FLJ32334 BINDING SITE is HOST TARGET binding site found in the 3' untranslated region of mRNA encoded by FLJ32334, corresponding to a HOST TARGET binding site such as BINDING SITE I, BINDING SITE II or BINDING SITE III. Table 2 illustrates the complementarity of the nucleotide sequences of FLJ32334 BINDING SITE, designated SEQ ID:29369, to the nucleotide sequence of VGAM1959 RNA, herein designated VGAM RNA, also designated SEQ ID:4670.

Another function of VGAM1959 is therefore inhibition of FLJ32334 (Accession NM_144565). Accordingly, utilities of VGAM1959 include diagnosis, prevention and treatment of diseases and clinical conditions associated with FLJ32334. Forkhead Box O3A (FOXO3A, Accession NM_001455) is another VGAM1959 host target gene. FOXO3A BINDING SITE is HOST TARGET binding site found in the 5' untranslated region of mRNA encoded by FOXO3A, corresponding to a HOST TARGET binding site such as BINDING SITE I, BINDING SITE II or BINDING SITE III. Table 2 illustrates the complementarity of the nucleotide sequences of FOXO3A BINDING SITE, designated SEQ ID:7190, to the nucleotide sequence of VGAM1959 RNA, herein designated VGAM RNA, also designated SEQ ID:4670.

Another function of VGAM1959 is therefore inhibition of Forkhead Box O3A (FOXO3A, Accession NM_001455). Accordingly, utilities of VGAM1959 include diagnosis, prevention and treatment of diseases and clinical conditions associated with FOXO3A. Frequenin Homolog (Drosophila) (FREQ, Accession NM_014286) is another VGAM1959 host target gene. FREQ BINDING SITE is HOST TARGET binding site found in the 3' untranslated region of mRNA encoded by FREQ, corresponding to a HOST TARGET binding site such as BINDING SITE I, BINDING SITE II or BINDING SITE III. Table 2 illustrates the complementarity of the nucleotide sequences of FREQ BINDING SITE, designated SEQ ID:15564, to the nucleotide sequence of VGAM1959 RNA, herein designated VGAM RNA, also designated SEQ ID:4670.

Another function of VGAM1959 is therefore inhibition of Frequenin Homolog (Drosophila) (FREQ, Accession NM_014286). Accordingly, utilities of VGAM1959 include diagnosis, prevention and treatment of diseases and clinical conditions associated with FREQ. FUS Interacting Protein (serine-arginine rich) 1 (FUSIP1, Accession NM_054016) is another VGAM1959 host target gene. FUSIP1 BINDING SITE is HOST TARGET binding site found in the 3' untranslated region of mRNA encoded by FUSIP1, corresponding to a HOST TARGET binding site such as BINDING SITE I, BINDING SITE II or BINDING SITE III. Table 2 illustrates the complementarity of the nucleotide sequences of FUSIP1 BINDING SITE, designated SEQ ID:27625, to the nucleotide sequence of VGAM1959 RNA, herein designated VGAM RNA, also designated SEQ ID:4670.

Another function of VGAM1959 is therefore inhibition of FUS Interacting Protein (serine-arginine rich) 1 (FUSIP1, Accession NM_054016). Accordingly, utilities of VGAM1959 include diagnosis, prevention and treatment of diseases and clinical conditions associated with FUSIP1. Glutamine-fructose-6-phosphate Transaminase 1 (GFPT1, Accession NM_002056) is another VGAM1959 host target gene. GFPT1 BINDING SITE is HOST TARGET binding site found in the 3' untranslated region of mRNA encoded by GFPT1, corresponding to a HOST TARGET binding site such as BINDING SITE I, BINDING SITE II or BINDING SITE III. Table 2 illustrates the complementarity of the nucleotide sequences of GFPT1 BINDING SITE, designated SEQ ID:7820, to the nucleotide sequence of VGAM1959 RNA, herein designated VGAM RNA, also designated SEQ ID:4670.

Another function of VGAM1959 is therefore inhibition of Glutamine-fructose-6-phosphate Transaminase 1 (GFPT1, Accession NM_002056). Accordingly, utilities of VGAM1959 include diagnosis, prevention and treatment of diseases and clinical conditions associated with GFPT1. Gamma-glutamyltransferase-like Activity 4 (GGTLA4, Accession NM_080920) is another VGAM1959 host target gene. GGTLA4 BINDING SITE is HOST TARGET binding site found in the 5' untranslated region of mRNA encoded by GGTLA4, corresponding to a HOST TARGET binding site such as BINDING SITE I, BINDING SITE II or BINDING SITE III. Table 2 illustrates the complementarity of the nucleotide sequences of GGTLA4 BINDING SITE, designated SEQ ID:28142, to the nucleotide sequence of VGAM1959 RNA, herein designated VGAM RNA, also designated SEQ ID:4670.

Another function of VGAM1959 is therefore inhibition of Gamma-glutamyltransferase-like Activity 4 (GGTLA4, Accession NM_080920). Accordingly, utilities of VGAM1959 include diagnosis, prevention and treatment of diseases and clinical conditions associated with GGTLA4. Guanine Nucleotide Binding Protein (G protein), Gamma 11 (GNG11, Accession NM_004126) is another VGAM1959 host target gene. GNG11 BINDING SITE is HOST TARGET binding site found in the 5' untranslated region of mRNA encoded by GNG11, corresponding to a HOST TARGET binding site such as BINDING SITE I, BINDING SITE II or BINDING SITE III. Table 2 illustrates the complementarity of the nucleotide sequences of GNG11 BINDING SITE, designated SEQ ID:10333, to the nucleotide sequence of VGAM1959 RNA, herein designated VGAM RNA, also designated SEQ ID:4670.

Another function of VGAM1959 is therefore inhibition of Guanine Nucleotide Binding Protein (G protein), Gamma 11 (GNG11, Accession NM_004126). Accordingly, utilities of VGAM1959 include diagnosis, prevention and treatment of diseases and clinical conditions associated with GNG11. Glutamic Pyruvate Transaminase (alanine aminotransferase) 2 (GPT2, Accession NM_133443) is another VGAM1959 host target gene. GPT2 BINDING SITE is HOST TARGET binding site found in the 3' untranslated region of mRNA encoded by GPT2, corresponding to a HOST TARGET binding site such as BINDING SITE I, BINDING SITE II or BINDING SITE III. Table 2 illustrates the complementarity of the nucleotide sequences of GPT2 BINDING SITE, designated SEQ ID:28523, to the nucleotide sequence of VGAM1959 RNA, herein designated VGAM RNA, also designated SEQ ID:4670.

Another function of VGAM1959 is therefore inhibition of Glutamic Pyruvate Transaminase (alanine aminotransferase) 2 (GPT2, Accession NM_133443). Accordingly, utilities of VGAM1959 include diagnosis, prevention and treatment of diseases and clinical conditions associated with GPT2. GR6 (Accession NM_007354) is another VGAM1959 host target gene. GR6 BINDING SITE is HOST TARGET binding site found in the 5' untranslated region of mRNA encoded by GR6, corresponding to a HOST TARGET binding site such as BINDING SITE I, BINDING SITE II or BINDING SITE III. Table 2 illustrates the complementarity of the nucleotide sequences of GR6 BINDING SITE, designated SEQ ID:14282, to the nucleotide sequence of VGAM1959 RNA, herein designated VGAM RNA, also designated SEQ ID:4670.

Another function of VGAM1959 is therefore inhibition of GR6 (Accession NM_007354). Accordingly, utilities of VGAM1959 include diagnosis, prevention and treatment of diseases and clinical conditions associated with GR6. Glutamate Receptor, Ionotropic, N-methyl-D-aspartate 3A (GRIN3A, Accession NM_133445) is another VGAM1959 host target gene. GRIN3A BINDING SITE is HOST TARGET binding site found in the 3" untranslated region of mRNA encoded by GRIN3A, corresponding to a HOST TARGET binding site such as BINDING SITE I, BINDING SITE II or BINDING SITE III. Table 2 illustrates the complementarity of the nucleotide sequences of GRIN3A BINDING SITE, designated SEQ ID:28533, to the nucleotide sequence of VGAM1959 RNA, herein designated VGAM RNA, also designated SEQ ID:4670.

Another function of VGAM1959 is therefore inhibition of Glutamate Receptor, Ionotropic, N-methyl-D-aspartate 3A (GRIN3A, Accession NM_133445). Accordingly, utilities of VGAM1959 include diagnosis, prevention and treatment of diseases and clinical conditions associated with GRIN3A. GS3955 (Accession NM_021643) is another VGAM1959 host target gene. GS3955 BINDING SITE is HOST TARGET binding site found in the 3' untranslated region of mRNA encoded by GS3955, corresponding to a HOST TARGET binding site such as BINDING SITE I, BINDING SITE II or BINDING SITE III. Table 2 illustrates the complementarity of the nucleotide sequences of GS3955 BINDING SITE, designated SEQ ID:22306, to the nucleotide sequence of VGAM1959 RNA, herein designated VGAM RNA, also designated SEQ ID:4670.

Another function of VGAM1959 is therefore inhibition of GS3955 (Accession NM_021643). Accordingly, utilities of VGAM1959 include diagnosis, prevention and treatment of diseases and clinical conditions associated with GS3955. General Transcription Factor IIIC, Polypeptide 1, Alpha 220 kDa (GTF3C1, Accession NM_001520) is another VGAM1959 host target gene. GTF3C1 BINDING SITE is HOST TARGET binding site found in the 3' untranslated region of mRNA encoded by GTF3C1, corresponding to a HOST TARGET binding site such as BINDING SITE I, BINDING SITE II or BINDING SITE III. Table 2 illustrates the complementarity of the nucleotide sequences of GTF3C1 BINDING SITE, designated SEQ ID:7260, to the nucleotide sequence of VGAM1959 RNA, herein designated VGAM RNA, also designated SEQ ID:4670.

Another function of VGAM1959 is therefore inhibition of General Transcription Factor IIIC, Polypeptide 1, Alpha 220 kDa (GTF3C1, Accession NM_001520). Accordingly, utilities of VGAM1959 include diagnosis, prevention and treatment of diseases and clinical conditions associated with GTF3C1. HCCA2 (Accession XM_039894) is another VGAM1959 host target gene. HCCA2 BINDING SITE is HOST TARGET binding site found in the 5' untranslated region of mRNA encoded by HCCA2, corresponding to a HOST TARGET binding site such as BINDING SITE I, BINDING SITE II or BINDING SITE III. Table 2 illustrates the complementarity of the nucleotide sequences of HCCA2 BINDING SITE, designated SEQ ID:33203, to the nucleotide sequence of VGAM1959 RNA, herein designated VGAM RNA, also designated SEQ ID:4670.

Another function of VGAM1959 is therefore inhibition of HCCA2 (Accession XM_039894). Accordingly, utilities of VGAM1959 include diagnosis, prevention and treatment of diseases and clinical conditions associated with HCCA2. HEMK (Accession NM_016173) is another VGAM1959 host target gene. HEMK BINDING SITE1 and HEMK BINDING SITE2 are HOST TARGET binding sites found in untranslated regions of mRNA encoded by HEMK, corresponding to HOST TARGET binding sites such as BINDING SITE I, BINDING SITE II or BINDING SITE III. Table 2 illustrates the complementarity of the nucleotide sequences of HEMK BINDING SITE1 and HEMK BINDING SITE2, designated SEQ ID:18267 and SEQ ID:18274 respectively, to the nucleotide sequence of VGAM1959 RNA, herein designated VGAM RNA, also designated SEQ ID:4670.

Another function of VGAM1959 is therefore inhibition of HEMK (Accession NM_016173). Accordingly, utilities of VGAM1959 include diagnosis, prevention and treatment of diseases and clinical conditions associated with HEMK. HN1L (Accession NM_144570) is another VGAM1959 host target gene. HN1L BINDING SITE is HOST TARGET binding site found in the 3' untranslated region of mRNA encoded by HN1L, corresponding to a HOST TARGET binding site such as BINDING SITE I, BINDING SITE II or BINDING SITE III. Table 2 illustrates the complementarity of the nucleotide sequences of HN1L BINDING SITE, designated SEQ ID:29376, to the nucleotide sequence of VGAM1959 RNA, herein designated VGAM RNA, also designated SEQ ID:4670.

Another function of VGAM1959 is therefore inhibition of HN1L (Accession NM_144570). Accordingly, utilities of VGAM1959 include diagnosis, prevention and treatment of diseases and clinical conditions associated with HN1L. HPIP (Accession NM_020524) is another VGAM1959 host target gene. HPIP BINDING SITE is HOST TARGET binding site found in the 3' untranslated region of mRNA encoded by HPIP, corresponding to a HOST TARGET binding site such as BINDING SITE I, BINDING SITE II or BINDING SITE III. Table 2 illustrates the complementarity of the nucleotide sequences of HPIP BINDING SITE, designated SEQ ID:21740, to the nucleotide sequence of VGAM1959 RNA, herein designated VGAM RNA, also designated SEQ ID:4670.

Another function of VGAM1959 is therefore inhibition of HPIP (Accession NM_020524). Accordingly, utilities of VGAM1959 include diagnosis, prevention and treatment of diseases and clinical conditions associated with HPIP. HRIHFB2122 (Accession NM_007032) is another VGAM1959 host target gene. HRIHFB2122 BINDING SITE is HOST TARGET binding site found in the 3' untranslated region of mRNA encoded by HRIHFB2122, corresponding to a HOST TARGET binding site such as BINDING SITE I, BINDING SITE II or BINDING SITE III. Table 2 illustrates the complementarity of the nucleotide sequences of HRIHFB2122 BINDING SITE, designated SEQ ID:13898, to the nucleotide sequence of VGAM1959 RNA, herein designated VGAM RNA, also designated SEQ ID:4670.

Another function of VGAM1959 is therefore inhibition of HRIHFB2122 (Accession NM_007032). Accordingly, utilities of VGAM1959 include diagnosis, prevention and treatment of diseases and clinical conditions associated with HRIHFB2122. HS6ST (Accession XM_030529) is another VGAM1959 host target gene. HS6ST BINDING SITE is HOST TARGET binding site found in the 3' untranslated region of mRNA encoded by HS6ST, corresponding to a HOST TARGET binding site such as BINDING SITE I, BINDING SITE II or BINDING SITE III. Table 2 illustrates the complementarity of the nucleotide sequences of HS6ST BINDING SITE, designated SEQ ID:31073, to the nucleotide sequence of VGAM1959 RNA, herein designated VGAM RNA, also designated SEQ ID:4670.

Another function of VGAM1959 is therefore inhibition of HS6ST (Accession XM_030529). Accordingly, utilities of VGAM1959 include diagnosis, prevention and treatment of diseases and clinical conditions associated with HS6ST. HSP105B (Accession NM_006644) is another VGAM1959 host target gene. HSP105B BINDING SITE is HOST TARGET binding site found in the 5' untranslated region of mRNA encoded by HSP105B, corresponding to a HOST TARGET binding site such as BINDING SITE I, BINDING SITE II or BINDING SITE III. Table 2 illustrates the complementarity of the nucleotide sequences of HSP105B BINDING SITE, designated SEQ ID:13438, to the nucleotide sequence of VGAM1959 RNA, herein designated VGAM RNA, also designated SEQ ID:4670.

Another function of VGAM1959 is therefore inhibition of HSP105B (Accession NM_006644). Accordingly, utilities of VGAM1959 include diagnosis, prevention and treatment of diseases and clinical conditions associated with HSP105B. HT002 (Accession NM_014066) is another VGAM1959 host target gene. HT002 BINDING SITE is HOST TARGET binding site found in the 3' untranslated region of mRNA encoded by HT002, corresponding to a HOST TARGET binding site such as BINDING SITE I, BINDING SITE II or BINDING SITE III. Table 2 illustrates the complementarity of the nucleotide sequences of HT002 BINDING SITE, designated SEQ ID:15284, to the nucleotide sequence of VGAM1959 RNA, herein designated VGAM RNA, also designated SEQ ID:4670.

Another function of VGAM1959 is therefore inhibition of HT002 (Accession NM_014066). Accordingly, utilities of VGAM1959 include diagnosis, prevention and treatment of diseases and clinical conditions associated with HT002. HU-K4 (Accession NM_012268) is another VGAM1959 host target gene. HU-K4 BINDING SITE is HOST TARGET binding site found in the 5' untranslated region of mRNA encoded by HU-K4, corresponding to a HOST TARGET binding site such as BINDING SITE I, BINDING SITE II or BINDING SITE III. Table 2 illustrates the complementarity of the nucleotide sequences of HU-K4 BINDING SITE, designated SEQ ID:14592, to the nucleotide sequence of VGAM1959 RNA, herein designated VGAM RNA, also designated SEQ ID:4670.

Another function of VGAM1959 is therefore inhibition of HU-K4 (Accession NM_012268). Accordingly, utilities of VGAM1959 include diagnosis, prevention and treatment of diseases and clinical conditions associated with HU-K4. Integrin, Alpha 10 (ITGA10, Accession XM_002097) is another VGAM1959 host target gene. ITGA10 BINDING SITE is HOST TARGET binding site found in the 3' untranslated region of mRNA encoded by ITGA10, corresponding to a HOST TARGET binding site such as BINDING SITE I, BINDING SITE II or BINDING SITE III. Table 2 illustrates the complementarity of the nucleotide sequences of ITGA10 BINDING SITE, designated SEQ ID:29861, to the nucleotide sequence of VGAM1959 RNA, herein designated VGAM RNA, also designated SEQ ID:4670.

Another function of VGAM1959 is therefore inhibition of Integrin, Alpha 10 (ITGA10, Accession XM_002097). Accordingly, utilities of VGAM1959 include diagnosis, prevention and treatment of diseases and clinical conditions associated with ITGA10. JM11 (Accession NM_033626) is another VGAM1959 host target gene. JM11 BINDING SITE is HOST TARGET binding site found in the 3' untranslated region of mRNA encoded by JM11, corresponding to a HOST TARGET binding site such as BINDING SITE I, BINDING SITE II or BINDING SITE III. Table 2 illustrates the complementarity of the nucleotide sequences of JM11 BINDING SITE, designated SEQ ID:27331, to the nucleotide sequence of VGAM1959 RNA, herein designated VGAM RNA, also designated SEQ ID:4670.

Another function of VGAM1959 is therefore inhibition of JM11 (Accession NM_033626). Accordingly, utilities of VGAM1959 include diagnosis, prevention and treatment of diseases and clinical conditions associated with JM11. Potassium Inwardly-rectifying Channel, Subfamily J, Member 9 (KCNJ9, Accession NM_004983) is another VGAM1959 host target gene. KCNJ9 BINDING SITE is HOST TARGET binding site found in the 5' untranslated region of mRNA encoded by KCNJ9, corresponding to a HOST TARGET binding site such as BINDING SITE I, BINDING SITE II or BINDING SITE III. Table 2 illustrates the complementarity of the nucleotide sequences of KCNJ9 BINDING SITE, designated SEQ ID:11430, to the nucleotide sequence of VGAM1959 RNA, herein designated VGAM RNA, also designated SEQ ID:4670.

Another function of VGAM1959 is therefore inhibition of Potassium Inwardly-rectifying Channel, Subfamily J, Member 9 (KCNJ9, Accession NM_004983). Accordingly, utilities of VGAM1959 include diagnosis, prevention and treatment of diseases and clinical conditions associated with KCNJ9. Potassium Channel, Subfamily T, Member 1 (KCNT1, Accession XM_029962) is another VGAM1959 host target gene. KCNT1 BINDING SITE is HOST TARGET binding site found in the 3' untranslated region of mRNA encoded by KCNT1, corresponding to a HOST TARGET binding site such as BINDING SITE I, BINDING SITE II or BINDING SITE III. Table 2 illustrates the complementarity of the nucleotide sequences of KCNT1 BINDING SITE, designated SEQ ID:30978, to the nucleotide sequence of VGAM1959 RNA, herein designated VGAM RNA, also designated SEQ ID:4670.

Another function of VGAM1959 is therefore inhibition of Potassium Channel, Subfamily T, Member 1 (KCNT1, Accession XM_029962). Accordingly, utilities of VGAM1959 include diagnosis, prevention and treatment of diseases and clinical conditions associated with KCNT1. KH Domain Containing, RNA Binding, Signal Transduction Associated 1 (KHDRBS1, Accession NM_006559) is another VGAM1959 host target gene. KHDRBS1 BINDING SITE is HOST TARGET binding site found in the 3' untranslated region of mRNA encoded by KHDRBS1, corresponding to a HOST TARGET binding site such as BINDING SITE I, BINDING SITE II or BINDING SITE III. Table 2 illustrates the complementarity of the nucleotide sequences of KHDRBS1 BINDING SITE, designated SEQ ID:13330, to the nucleotide sequence of VGAM1959 RNA, herein designated VGAM RNA, also designated SEQ ID:4670.

Another function of VGAM1959 is therefore inhibition of KH Domain Containing, RNA Binding, Signal Transduction Associated 1 (KHDRBS1, Accession NM_006559). Accordingly, utilities of VGAM1959 include diagnosis, prevention and treatment of diseases and clinical conditions associated with KHDRBS1. KIAA0052 (Accession XM_042108) is another VGAM1959 host target gene. KIAA0052 BINDING SITE is HOST TARGET binding site found in the 3' untranslated region of mRNA encoded by KIAA0052, corresponding to a HOST TARGET binding site such as BINDING SITE I, BINDING SITE II or BINDING SITE III. Table 2 illustrates the complementarity of the nucleotide sequences of KIAA0052 BINDING SITE, designated SEQ ID:33692, to the nucleotide sequence of VGAM1959 RNA, herein designated VGAM RNA, also designated SEQ ID:4670.

Another function of VGAM1959 is therefore inhibition of KIAA0052 (Accession XM_042108). Accordingly, utilities of VGAM1959 include diagnosis, prevention and treatment of diseases and clinical conditions associated with KIAA0052. KIAA0057 (Accession NM_012288) is another VGAM1959 host target gene. KIAA0057 BINDING SITE is HOST TARGET binding site found in the 3' untranslated region of mRNA encoded by KIAA0057, corresponding to a HOST TARGET binding site such as BINDING SITE I, BINDING SITE II or BINDING SITE III. Table 2 illustrates the complementarity of the nucleotide sequences of KIAA0057 BINDING SITE, designated SEQ ID:14618, to the nucleotide sequence of VGAM1959 RNA, herein designated VGAM RNA, also designated SEQ ID:4670.

Another function of VGAM1959 is therefore inhibition of KIAA0057 (Accession NM_012288). Accordingly, utilities of VGAM1959 include diagnosis, prevention and treatment of diseases and clinical conditions associated with KIAA0057. KIAA0087 (Accession NM_014769) is another VGAM1959 host target gene. KIAA0087 BINDING SITE is HOST TARGET binding site found in the 3' untranslated region of mRNA encoded by KIAA0087, corresponding to a HOST TARGET binding site such as BINDING SITE I, BINDING SITE II or BINDING SITE III. Table 2 illustrates the complementarity of the nucleotide sequences of KIAA0087 BINDING SITE, designated SEQ ID:16557, to the nucleotide sequence of VGAM1959 RNA, herein designated VGAM RNA, also designated SEQ ID:4670.

Another function of VGAM1959 is therefore inhibition of KIAA0087 (Accession NM_014769). Accordingly, utilities of VGAM1959 include diagnosis, prevention and treatment of diseases and clinical conditions associated with KIAA0087. KIAA0140 (Accession NM_014661) is another VGAM1959 host target gene. KIAA0140 BINDING SITE is HOST TARGET binding site found in the 3' untranslated region of mRNA encoded by KIAA0140, corresponding to a HOST TARGET binding site such as BINDING SITE I, BINDING SITE II or BINDING SITE III. Table 2 illustrates the complementarity of the nucleotide sequences of KIAA0140 BINDING SITE, designated SEQ ID:16108, to the nucleotide sequence of VGAM1959 RNA, herein designated VGAM RNA, also designated SEQ ID:4670.

Another function of VGAM1959 is therefore inhibition of KIAA0140 (Accession NM_014661). Accordingly, utilities of VGAM1959 include diagnosis, prevention and treatment of diseases and clinical conditions associated with KIAA0140. KIAA0146 (Accession XM_088282) is another VGAM1959 host target gene. KIAA0146 BINDING SITE is HOST TARGET binding site found in the 5' untranslated region of mRNA encoded by KIAA0146, corresponding to a HOST TARGET binding site such as BINDING SITE I, BINDING SITE II or BINDING SITE III. Table 2 illustrates the complementarity of the nucleotide sequences of KIAA0146 BINDING SITE, designated SEQ ID:39584, to the nucleotide sequence of VGAM1959 RNA, herein designated VGAM RNA, also designated SEQ ID:4670.

Another function of VGAM1959 is therefore inhibition of KIAA0146 (Accession XM_088282). Accordingly, utilities of VGAM1959 include diagnosis, prevention and treatment of diseases and clinical conditions associated with KIAA0146. KIAA0218 (Accession NM_014760) is another VGAM1959 host target gene. KIAA0218 BINDING SITE is HOST TARGET binding site found in the 3' untranslated region of mRNA encoded by KIAA0218, corresponding to a HOST TARGET binding site such as BINDING SITE I, BINDING SITE II or BINDING SITE III. Table 2 illustrates the complementarity of the nucleotide sequences of KIAA0218 BINDING SITE, designated SEQ ID:16519, to the nucleotide sequence of VGAM1959 RNA, herein designated VGAM RNA, also designated SEQ ID:4670.

Another function of VGAM1959 is therefore inhibition of KIAA0218 (Accession NM_014760). Accordingly, utilities of VGAM1959 include diagnosis, prevention and treatment of diseases and clinical conditions associated with KIAA0218. KIAA0247 (Accession NM_014734) is another VGAM1959 host target gene. KIAA0247 BINDING SITE is HOST TARGET binding site found in the 3' untranslated region of mRNA encoded by KIAA0247, corresponding to a HOST TARGET binding site such as BINDING SITE I, BINDING SITE II or BINDING SITE III. Table 2 illustrates the complementarity of the nucleotide sequences of KIAA0247 BINDING SITE, designated SEQ ID:16374, to the nucleotide sequence of VGAM1959 RNA, herein designated VGAM RNA, also designated SEQ ID:4670.

Another function of VGAM1959 is therefore inhibition of KIAA0247 (Accession NM_014734). Accordingly, utilities of VGAM1959 include diagnosis, prevention and treatment of diseases and clinical conditions associated with KIAA0247. KIAA0261 (Accession XM_042946) is another VGAM1959 host target gene. KIAA0261 BINDING SITE is HOST TARGET binding site found in the 3' untranslated region of mRNA encoded by KIAA0261, corresponding to a HOST TARGET binding site such as BINDING SITE I, BINDING SITE II or BINDING SITE III. Table 2 illustrates the complementarity of the nucleotide sequences of KIAA0261 BINDING SITE, designated SEQ ID:33838, to the nucleotide sequence of VGAM1959 RNA, herein designated VGAM RNA, also designated SEQ ID:4670.

Another function of VGAM1959 is therefore inhibition of KIAA0261 (Accession XM_042946). Accordingly, utilities of VGAM1959 include diagnosis, prevention and treatment of diseases and clinical conditions associated with KIAA0261. KIAA0286 (Accession XM_043118) is another VGAM1959 host target gene. KIAA0286 BINDING SITE is HOST TARGET binding site found in the 3' untranslated region of mRNA encoded by KIAA0286, corresponding to a HOST TARGET binding site such as BINDING SITE I, BINDING SITE II or BINDING SITE III. Table 2 illustrates the complementarity of the nucleotide sequences of KIAA0286 BINDING SITE, designated SEQ ID:33909, to the nucleotide sequence of VGAM1959 RNA, herein designated VGAM RNA, also designated SEQ ID:4670.

Another function of VGAM1959 is therefore inhibition of KIAA0286 (Accession XM_043118). Accordingly, utilities of VGAM1959 include diagnosis, prevention and treatment of diseases and clinical conditions associated with KIAA0286. KIAA0316 (Accession XM_045712) is another VGAM1959 host target gene. KIAA0316 BINDING SITE is HOST TARGET binding site found in the 3' untranslated region of mRNA encoded by KIAA0316, corresponding to a HOST TARGET binding site such as BINDING SITE I, BINDING SITE II or BINDING SITE III. Table 2 illustrates the complementarity of the nucleotide sequences of KIAA0316 BINDING SITE, designated SEQ ID:34531, to the nucleotide sequence of VGAM1959 RNA, herein designated VGAM RNA, also designated SEQ ID:4670.

Another function of VGAM1959 is therefore inhibition of KIAA0316 (Accession XM_045712). Accordingly, utilities of VGAM1959 include diagnosis, prevention and treatment of diseases and clinical conditions associated with KIAA0316. KIAA0323 (Accession XM_032634) is another VGAM1959 host target gene. KIAA0323 BINDING SITE is HOST TARGET binding site found in the 3' untranslated region of mRNA encoded by KIAA0323, corresponding to a HOST TARGET binding site such as BINDING SITE I, BINDING SITE II or BINDING SITE III. Table 2 illustrates the complementarity of the nucleotide sequences of KIAA0323 BINDING SITE, designated SEQ ID:31691, to the nucleotide sequence of VGAM1959 RNA, herein designated VGAM RNA, also designated SEQ ID:4670.

Another function of VGAM1959 is therefore inhibition of KIAA0323 (Accession XM_032634). Accordingly, utilities of VGAM1959 include diagnosis, prevention and treatment of diseases and clinical conditions associated with KIAA0323. KIAA0326 (Accession XM_034819) is another VGAM1959 host target gene. KIAA0326 BINDING SITE is HOST TARGET binding site found in the 3' untranslated region of mRNA encoded by KIAA0326, corresponding to a HOST TARGET binding site such as BINDING SITE I, BINDING SITE II or BINDING SITE III. Table 2 illustrates the complementarity of the nucleotide sequences of KIAA0326 BINDING SITE, designated SEQ ID:32160, to the nucleotide sequence of VGAM1959 RNA, herein designated VGAM RNA, also designated SEQ ID:4670.

Another function of VGAM1959 is therefore inhibition of KIAA0326 (Accession XM_034819). Accordingly, utilities of VGAM1959 include diagnosis, prevention and treatment of diseases and clinical conditions associated with KIAA0326. KIAA0342 (Accession XM_047357) is another VGAM1959 host target gene. KIAA0342 BINDING SITE is HOST TARGET binding site found in the 3' untranslated region of mRNA encoded by KIAA0342, corresponding to a HOST TARGET binding site such as BINDING SITE I, BINDING SITE II or BINDING SITE III. Table 2 illustrates the complementarity of the nucleotide sequences of KIAA0342 BINDING SITE, designated SEQ ID:34961, to the nucleotide sequence of VGAM1959 RNA, herein designated VGAM RNA, also designated SEQ ID:4670.

Another function of VGAM1959 is therefore inhibition of KIAA0342 (Accession XM_047357). Accordingly, utilities of VGAM1959 include diagnosis, prevention and treatment of diseases and clinical conditions associated with KIAA0342. KIAA0418 (Accession NM_014631) is another VGAM1959 host target gene. KIAA0418 BINDING SITE is HOST TARGET binding site found in the 3' untranslated region of mRNA encoded by KIAA0418, corresponding to a HOST TARGET binding site such as BINDING SITE I, BINDING SITE II or BINDING SITE III. Table 2 illustrates the complementarity of the nucleotide sequences of KIAA0418 BINDING SITE, designated SEQ ID:15999, to the nucleotide sequence of VGAM1959 RNA, herein designated VGAM RNA, also designated SEQ ID:4670.

Another function of VGAM1959 is therefore inhibition of KIAA0418 (Accession NM_014631). Accordingly, utilities of VGAM1959 include diagnosis, prevention and treatment of diseases and clinical conditions associated with KIAA0418. KIAA0444 (Accession XM_030999) is another VGAM1959 host target gene. KIAA0444 BINDING SITE is HOST TARGET binding site found in the 3' untranslated region of mRNA encoded by KIAA0444, corresponding to a HOST TARGET binding site such as BINDING SITE I, BINDING SITE II or BINDING SITE III. Table 2 illustrates the complementarity of the nucleotide sequences of KIAA0444 BINDING SITE, designated SEQ ID:31240, to the nucleotide sequence of VGAM1959 RNA, herein designated VGAM RNA, also designated SEQ ID:4670.

Another function of VGAM1959 is therefore inhibition of KIAA0444 (Accession XM_030999). Accordingly, utilities of VGAM1959 include diagnosis, prevention and treatment of diseases and clinical conditions associated with KIAA0444. KIAA0450 (Accession NM_014638) is another VGAM1959 host target gene. KIAA0450 BINDING SITE is HOST TARGET binding site found in the 5' untranslated region of mRNA encoded by KIAA0450, corresponding to a HOST TARGET binding site such as BINDING SITE I, BINDING SITE II or BINDING SITE III. Table 2 illustrates the complementarity of the nucleotide sequences of KIAA0450 BINDING SITE, designated SEQ ID:16033, to the nucleotide sequence of VGAM1959 RNA, herein designated VGAM RNA, also designated SEQ ID:4670.

Another function of VGAM1959 is therefore inhibition of KIAA0450 (Accession NM_014638). Accordingly, utilities of VGAM1959 include diagnosis, prevention and treatment of diseases and clinical conditions associated with KIAA0450. KIAA0469 (Accession NM_014851) is another VGAM1959 host target gene. KIAA0469 BINDING SITE is HOST TARGET binding site found in the 3' untranslated region of mRNA encoded by KIAA0469, corresponding to a HOST TARGET binding site such as BINDING SITE I, BINDING SITE II or BINDING SITE III. Table 2 illustrates the complementarity of the nucleotide sequences of KIAA0469 BINDING SITE, designated SEQ ID:16889, to the nucleotide sequence of VGAM1959 RNA, herein designated VGAM RNA, also designated SEQ ID:4670.

Another function of VGAM1959 is therefore inhibition of KIAA0469 (Accession NM_014851). Accordingly, utilities of VGAM1959 include diagnosis, prevention and treatment of diseases and clinical conditions associated with KIAA0469. KIAA0495 (Accession XM_031397) is another VGAM1959 host target gene. KIAA0495 BINDING SITE is HOST TARGET binding site found in the 5' untranslated region of mRNA encoded by KIAA0495, corresponding to a HOST TARGET binding site such as BINDING SITE I, BINDING SITE II or BINDING SITE III. Table 2 illustrates the complementarity of the nucleotide sequences of KIAA0495 BINDING SITE, designated SEQ ID:31357, to the nucleotide sequence of VGAM1959 RNA, herein designated VGAM RNA, also designated SEQ ID:4670.

Another function of VGAM1959 is therefore inhibition of KIAA0495 (Accession XM_031397). Accordingly, utilities of VGAM1959 include diagnosis, prevention and treatment of diseases and clinical conditions associated with KIAA0495. KIAA0514 (Accession NM_014696) is another VGAM1959 host target gene. KIAA0514 BINDING SITE is HOST TARGET binding site found in the 5' untranslated region of mRNA encoded by KIAA0514, corresponding to a HOST TARGET binding site such as BINDING SITE I, BINDING SITE II or BINDING SITE III. Table 2 illustrates the complementarity of the nucleotide sequences of KIAA0514 BINDING SITE, designated SEQ ID:16205, to the nucleotide sequence of VGAM1959 RNA, herein designated VGAM RNA, also designated SEQ ID:4670.

Another function of VGAM1959 is therefore inhibition of KIAA0514 (Accession NM_014696). Accordingly, utilities of VGAM1959 include diagnosis, prevention and treatment of diseases and clinical conditions associated with KIAA0514. KIAA0775 (Accession NM_014726) is another VGAM1959 host target gene. KIAA0775 BINDING SITE is HOST TARGET binding site found in the 5' untranslated region of mRNA encoded by KIAA0775, corresponding to a HOST TARGET binding site such as BINDING SITE I, BINDING SITE II or BINDING SITE III. Table 2 illustrates the complementarity of the nucleotide sequences of KIAA0775 BINDING SITE, designated SEQ ID:16321, to the nucleotide sequence of VGAM1959 RNA, herein designated VGAM RNA, also designated SEQ ID:4670.

Another function of VGAM1959 is therefore inhibition of KIAA0775 (Accession NM_014726). Accordingly, utilities of VGAM1959 include diagnosis, prevention and treatment of diseases and clinical conditions associated with KIAA0775. KIAA0794 (Accession XM_087353) is another VGAM1959 host target gene. KIAA0794 BINDING SITE is HOST TARGET binding site found in the 3' untranslated region of mRNA encoded by KIAA0794, corresponding to a HOST TARGET binding site such as BINDING SITE I, BINDING SITE II or BINDING SITE III. Table 2 illustrates the complementarity of the nucleotide sequences of KIAA0794 BINDING SITE, designated SEQ ID:39186, to the nucleotide sequence of VGAM1959 RNA, herein designated VGAM RNA, also designated SEQ ID:4670.

Another function of VGAM1959 is therefore inhibition of KIAA0794 (Accession XM_087353). Accordingly, utilities of VGAM1959 include diagnosis, prevention and treatment of diseases and clinical conditions associated with KIAA0794. KIAA0802 (Accession XM_031357) is another VGAM1959 host target gene. KIAA0802 BINDING SITE1 and KIAA0802 BINDING SITE2 are HOST TARGET binding sites found in untranslated regions of mRNA encoded by KIAA0802, corresponding to HOST TARGET binding sites such as BINDING SITE I, BINDING SITE II or BINDING SITE III. Table 2 illustrates the complementarity of the nucleotide sequences of KIAA0802 BINDING SITE1 and KIAA0802 BINDING SITE2, designated SEQ ID:31350 and SEQ ID:31353 respectively, to the nucleotide sequence of VGAM1959 RNA, herein designated VGAM RNA, also designated SEQ ID:4670.

Another function of VGAM1959 is therefore inhibition of KIAA0802 (Accession XM_031357). Accordingly, utilities of VGAM1959 include diagnosis, prevention and treatment of diseases and clinical conditions associated with KIAA0802. KIAA0918 (Accession XM_054869) is another VGAM1959 host target gene. KIAA0918 BINDING SITE is HOST TARGET binding site found in the 3' untranslated region of mRNA encoded by KIAA0918, corresponding to a HOST TARGET binding site such as BINDING SITE I, BINDING SITE II or BINDING SITE III. Table 2 illustrates the complementarity of the nucleotide sequences of KIAA0918 BINDING SITE, designated SEQ ID:36198, to the nucleotide sequence of VGAM1959 RNA, herein designated VGAM RNA, also designated SEQ ID:4670.

Another function of VGAM1959 is therefore inhibition of KIAA0918 (Accession XM_054869). Accordingly, utilities of VGAM1959 include diagnosis, prevention and treatment of diseases and clinical conditions associated with KIAA0918. KIAA0924 (Accession NM_014897) is another VGAM1959 host target gene. KIAA0924 BINDING SITE is HOST TARGET binding site found in the 3' untranslated region of mRNA encoded by KIAA0924, corresponding to a HOST TARGET binding site such as BINDING SITE I, BINDING SITE II or BINDING SITE III. Table 2 illustrates the complementarity of the nucleotide sequences of KIAA0924 BINDING SITE, designated SEQ ID:17064, to the nucleotide sequence of VGAM1959 RNA, herein designated VGAM RNA, also designated SEQ ID:4670.

Another function of VGAM1959 is therefore inhibition of KIAA0924 (Accession NM_014897). Accordingly, utilities of VGAM1959 include diagnosis, prevention and treatment of diseases and clinical conditions associated with KIAA0924. KIAA0939 (Accession XM_030524) is another VGAM1959 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31064, to the nucleotide sequence of VGAM1959 RNA, herein designated VGAM RNA, also designated SEQ ID:4670.

Another function of VGAM1959 is therefore inhibition of KIAA0939 (Accession XM_030524). Accordingly, utilities of VGAM1959 include diagnosis, prevention and treatment of diseases and clinical conditions associated with KIAA0939. KIAA0945 (Accession NM_014952) is another VGAM1959 host target gene. KIAA0945 BINDING SITE1 and KIAA0945 BINDING SITE2 are HOST TARGET binding sites found in untranslated regions of mRNA encoded by KIAA0945, corresponding to HOST TARGET binding sites such as BINDING SITE I, BINDING SITE II or BINDING SITE III. Table 2 illustrates the complementarity of the nucleotide sequences of KIAA0945 BINDING SITE1 and KIAA0945 BINDING SITE2, designated SEQ ID:17292 and SEQ ID:17293 respectively, to the nucleotide sequence of VGAM1959 RNA, herein designated VGAM RNA, also designated SEQ ID:4670.

Another function of VGAM1959 is therefore inhibition of KIAA0945 (Accession NM_014952). Accordingly, utilities of VGAM1959 include diagnosis, prevention and treatment of diseases and clinical conditions associated with KIAA0945. KIAA0981 (Accession XM_028867) is another VGAM1959 host target gene. KIAA0981 BINDING SITE is HOST TARGET binding site found in the 3' untranslated region of mRNA encoded by KIAA0981, corresponding to a HOST TARGET binding site such as BINDING SITE I, BINDING SITE II or BINDING SITE III. Table 2 illustrates the complementarity of the nucleotide sequences of KIAA0981 BINDING SITE, designated SEQ ID:30798, to the nucleotide sequence of VGAM1959 RNA, herein designated VGAM RNA, also designated SEQ ID:4670.

Another function of VGAM1959 is therefore inhibition of KIAA0981 (Accession XM_028867). Accordingly, utilities of VGAM1959 include diagnosis, prevention and treatment of diseases and clinical conditions associated with KIAA0981. KIAA0982 (Accession NM_014023) is another VGAM1959 host target gene. KIAA0982 BINDING SITE is HOST TARGET binding site found in the 3' untranslated region of mRNA encoded by KIAA0982, corresponding to a HOST TARGET binding site such as BINDING SITE I, BINDING SITE II or BINDING SITE III. Table 2 illustrates the complementarity of the nucleotide sequences of KIAA0982 BINDING SITE, designated SEQ ID:15249, to the nucleotide sequence of VGAM1959 RNA, herein designated VGAM RNA, also designated SEQ ID:4670.

Another function of VGAM1959 is therefore inhibition of KIAA0982 (Accession NM_014023). Accordingly, utilities of VGAM1959 include diagnosis, prevention and treatment of diseases and clinical conditions associated with KIAA0982. KIAA1016 (Accession XM_166260) is another VGAM1959 host target gene. KIAA1016 BINDING SITE is HOST TARGET binding site found in the 5' untranslated region of mRNA encoded by KIAA1016, corresponding to a HOST TARGET binding site such as BINDING SITE I, BINDING SITE II or BINDING SITE III. Table 2 illustrates the complementarity of the nucleotide sequences of KIAA1016 BINDING SITE, designated SEQ ID:44086, to the nucleotide sequence of VGAM1959 RNA, herein designated VGAM RNA, also designated SEQ ID:4670.

Another function of VGAM1959 is therefore inhibition of KIAA1016 (Accession XM_166260). Accordingly, utilities of VGAM1959 include diagnosis, prevention and treatment of diseases and clinical conditions associated with KIAA1016. KIAA1024 (Accession XM_044580) is another VGAM1959 host target gene. KIAA1024 BINDING SITE is HOST TARGET binding site found in the 3' untranslated region of mRNA encoded by KIAA1024, corresponding to a HOST TARGET binding site such as BINDING SITE I, BINDING SITE II or BINDING SITE III. Table 2 illustrates the complementarity of the nucleotide sequences of KIAA1024 BINDING SITE, designated SEQ ID:34238, to the nucleotide sequence of VGAM1959 RNA, herein designated VGAM RNA, also designated SEQ ID:4670.

Another function of VGAM1959 is therefore inhibition of KIAA1024 (Accession XM_044580). Accordingly, utilities of VGAM1959 include diagnosis, prevention and treatment of diseases and clinical conditions associated with KIAA1024. KIAA1026 (Accession XM_048825) is another VGAM1959 host target gene. KIAA1026 BINDING SITE is HOST TARGET binding site found in the 3' untranslated region of mRNA encoded by KIAA1026, corresponding to a HOST TARGET binding site such as BINDING SITE I, BINDING SITE II or BINDING SITE III. Table 2 illustrates the complementarity of the nucleotide sequences of KIAA1026 BINDING SITE, designated SEQ ID:35280, to the nucleotide sequence of VGAM1959 RNA, herein designated VGAM RNA, also designated SEQ ID:4670.

Another function of VGAM1959 is therefore inhibition of KIAA1026 (Accession XM_048825). Accordingly, utilities of VGAM1959 include diagnosis, prevention and treatment of diseases and clinical conditions associated with KIAA1026. KIAA1032 (Accession XM_038604) is another VGAM1959 host target gene. KIAA1032 BINDING SITE is HOST TARGET binding site found in the 3' untranslated region of mRNA encoded by KIAA1032, corresponding to a HOST TARGET binding site such as BINDING SITE I, BINDING SITE II or BINDING SITE III. Table 2 illustrates the complementarity of the nucleotide sequences of KIAA1032 BINDING SITE, designated SEQ ID:32877, to the nucleotide sequence of VGAM1959 RNA, herein designated VGAM RNA, also designated SEQ ID:4670.

Another function of VGAM1959 is therefore inhibition of KIAA1032 (Accession XM_038604). Accordingly, utilities of VGAM1959 include diagnosis, prevention and treatment of diseases and clinical conditions associated with KIAA1032. KIAA1052 (Accession NM_014956) is another VGAM1959 host target gene. KIAA1052 BINDING SITE is HOST TARGET binding site found in the 3' untranslated region of mRNA encoded by KIAA1052, corresponding to a HOST TARGET binding site such as BINDING SITE I, BINDING SITE II or BINDING SITE III. Table 2 illustrates the complementarity of the nucleotide sequences of KIAA1052 BINDING SITE, designated SEQ ID:17311, to the nucleotide sequence of VGAM1959 RNA, herein designated VGAM RNA, also designated SEQ ID:4670.

Another function of VGAM1959 is therefore inhibition of KIAA1052 (Accession NM_014956). Accordingly, utilities of VGAM1959 include diagnosis, prevention and treatment of diseases and clinical conditions associated with KIAA1052. KIAA1068 (Accession NM_015332) is another VGAM1959 host target gene. KIAA1068 BINDING SITE is HOST TARGET binding site found in the 3' untranslated region of mRNA encoded by KIAA1068, corresponding to a HOST TARGET binding site such as BINDING SITE I, BINDING SITE II or BINDING SITE III. Table 2 illustrates the complementarity of the nucleotide sequences of KIAA1068 BINDING SITE, designated SEQ ID:17643, to the nucleotide sequence of VGAM1959 RNA, herein designated VGAM RNA, also designated SEQ ID:4670.

Another function of VGAM1959 is therefore inhibition of KIAA1068 (Accession NM_015332). Accordingly, utilities of VGAM1959 include diagnosis, prevention and treatment of diseases and clinical conditions associated with KIAA1068. KIAA1130 (Accession XM_031104) is another VGAM1959 host target gene. KIAA1130 BINDING SITE is HOST TARGET binding site found in the 3' untranslated region of mRNA encoded by KIAA1130, corresponding to a HOST TARGET binding site such as BINDING SITE I, BINDING SITE II or BINDING SITE III. Table 2 illustrates the complementarity of the nucleotide sequences of KIAA1130 BINDING SITE, designated SEQ ID:31283, to the nucleotide sequence of VGAM1959 RNA, herein designated VGAM RNA, also designated SEQ ID:4670.

Another function of VGAM1959 is therefore inhibition of KIAA1130 (Accession XM_031104). Accordingly, utilities of VGAM1959 include diagnosis, prevention and treatment of diseases and clinical conditions associated with KIAA1130. KIAA1185 (Accession XM_031399) is another VGAM1959 host target gene. KIAA1185 BINDING SITE is HOST TARGET binding site found in the 3' untranslated region of mRNA encoded by KIAA1185, corresponding to a HOST TARGET binding site such as BINDING SITE I, BINDING SITE II or BINDING SITE III. Table 2 illustrates the complementarity of the nucleotide sequences of KIAA1185 BINDING SITE, designated SEQ ID:31372, to the nucleotide sequence of VGAM1959 RNA, herein designated VGAM RNA, also designated SEQ ID:4670.

Another function of VGAM1959 is therefore inhibition of KIAA1185 (Accession XM_031399). Accordingly, utilities of VGAM1959 include diagnosis, prevention and treatment of diseases and clinical conditions associated with KIAA1185. KIAA1190 (Accession XM_048695) is another VGAM1959 host target gene. KIAA1190 BINDING SITE is HOST TARGET binding site found in the 3' untranslated region of mRNA encoded by KIAA1190, corresponding to a HOST TARGET binding site such as BINDING SITE I, BINDING SITE II or BINDING SITE III. Table 2 illustrates the complementarity of the nucleotide sequences of KIAA1190 BINDING SITE, designated SEQ ID:35224, to the nucleotide sequence of VGAM1959 RNA, herein designated VGAM RNA, also designated SEQ ID:4670.

Another function of VGAM1959 is therefore inhibition of KIAA1190 (Accession XM_048695). Accordingly, utilities of VGAM1959 include diagnosis, prevention and treatment of diseases and clinical conditions associated with KIAA1190. KIAA1199 (Accession XM_051860) is another VGAM1959 host target gene. KIAA1199 BINDING SITE is HOST TARGET binding site found in the 3' untranslated region of mRNA encoded by KIAA1199, corresponding to a HOST TARGET binding site such as BINDING SITE I, BINDING SITE II or BINDING SITE III. Table 2 illustrates the complementarity of the nucleotide sequences of KIAA1199 BINDING SITE, designated SEQ ID:35900, to the nucleotide sequence of VGAM1959 RNA, herein designated VGAM RNA, also designated SEQ ID:4670.

Another function of VGAM1959 is therefore inhibition of KIAA1199 (Accession XM_051860). Accordingly, utilities of VGAM1959 include diagnosis, prevention and treatment of diseases and clinical conditions associated with KIAA1199. KIAA1233 (Accession XM_032181) is another VGAM1959 host target gene. KIAA1233 BINDING SITE is HOST TARGET binding site found in the 3' untranslated region of mRNA encoded by KIAA1233, corresponding to a HOST TARGET binding site such as BINDING SITE I, BINDING SITE II or BINDING SITE III. Table 2 illustrates the complementarity of the nucleotide sequences of KIAA1233 BINDING SITE, designated SEQ ID:31589, to the nucleotide sequence of VGAM1959 RNA, herein designated VGAM RNA, also designated SEQ ID:4670.

Another function of VGAM1959 is therefore inhibition of KIAA1233 (Accession XM_032181). Accordingly, utilities of VGAM1959 include diagnosis, prevention and treatment of diseases and clinical conditions associated with KIAA1233. KIAA1247 (Accession XM_030036) is another VGAM1959 host target gene. KIAA1247 BINDING SITE is HOST TARGET binding site found in the 5' untranslated region of mRNA encoded by KIAA1247, corresponding to a HOST TARGET binding site such as BINDING SITE I, BINDING SITE II or BINDING SITE III. Table 2 illustrates the complementarity of the nucleotide sequences of KIAA1247 BINDING SITE, designated SEQ ID:30988, to the nucleotide sequence of VGAM1959 RNA, herein designated VGAM RNA, also designated SEQ ID:4670.

Another function of VGAM1959 is therefore inhibition of KIAA1247 (Accession XM_030036). Accordingly, utilities of VGAM1959 include diagnosis, prevention and treatment of diseases and clinical conditions associated with KIAA1247. KIAA1280 (Accession XM_045766) is another VGAM1959 host target gene. KIAA1280 BINDING SITE is HOST TARGET binding site found in the 5' untranslated region of mRNA encoded by KIAA1280, corresponding to a HOST TARGET binding site such as BINDING SITE I, BINDING SITE II or BINDING SITE III. Table 2 illustrates the complementarity of the nucleotide sequences of KIAA1280 BINDING SITE, designated SEQ ID:34553, to the nucleotide sequence of VGAM1959 RNA, herein designated VGAM RNA, also designated SEQ ID:4670.

Another function of VGAM1959 is therefore inhibition of KIAA1280 (Accession XM_045766). Accordingly, utilities of VGAM1959 include diagnosis, prevention and treatment of diseases and clinical conditions associated with KIAA1280. KIAA1322 (Accession XM_052626) is another VGAM1959 host target gene. KIAA1322 BINDING SITE is HOST TARGET binding site found in the 3' untranslated region of mRNA encoded by KIAA1322, corresponding to a HOST TARGET binding site such as BINDING SITE I, BINDING SITE II or BINDING SITE III. Table 2 illustrates the complementarity of the nucleotide sequences of KIAA1322 BINDING SITE, designated SEQ ID:36023, to the nucleotide sequence of VGAM1959 RNA, herein designated VGAM RNA, also designated SEQ ID:4670.

Another function of VGAM1959 is therefore inhibition of KIAA1322 (Accession XM_052626). Accordingly, utilities of VGAM1959 include diagnosis, prevention and treatment of diseases and clinical conditions associated with KIAA1322. KIAA1332 (Accession XM_048774) is another VGAM1959 host target gene. KIAA1332 BINDING SITE is HOST TARGET binding site found in the 3' untranslated region of mRNA encoded by KIAA1332, corresponding to a HOST TARGET binding site such as BINDING SITE I, BINDING SITE II or BINDING SITE III. Table 2 illustrates the complementarity of the nucleotide sequences of KIAA1332 BINDING SITE, designated SEQ ID:35255, to the nucleotide sequence of VGAM1959 RNA, herein designated VGAM RNA, also designated SEQ ID:4670.

Another function of VGAM1959 is therefore inhibition of KIAA1332 (Accession XM_048774). Accordingly, utilities of VGAM1959 include diagnosis, prevention and treatment of diseases and clinical conditions associated with KIAA1332. KIAA1399 (Accession XM_046685) is another VGAM1959 host target gene. KIAA1399 BINDING SITE is HOST TARGET binding site found in the 3' untranslated region of mRNA encoded by KIAA1399, corresponding to a HOST TARGET binding site such as BINDING SITE I, BINDING SITE II or BINDING SITE III. Table 2 illustrates the complementarity of the nucleotide sequences of KIAA1399 BINDING SITE, designated SEQ ID:34796, to the nucleotide sequence of VGAM1959 RNA, herein designated VGAM RNA, also designated SEQ ID:4670.

Another function of VGAM1959 is therefore inhibition of KIAA1399 (Accession XM_046685). Accordingly, utilities of VGAM1959 include diagnosis, prevention and treatment of diseases and clinical conditions associated with KIAA1399. KIAA1449 (Accession NM_020839) is another VGAM1959 host target gene. KIAA1449 BINDING SITE is HOST TARGET binding site found in the 3' untranslated region of mRNA encoded by KIAA1449, corresponding to a HOST TARGET binding site such as BINDING SITE I, BINDING SITE II or BINDING SITE III. Table 2 illustrates the complementarity of the nucleotide sequences of KIAA1449 BINDING SITE, designated SEQ ID:21899, to the nucleotide sequence of VGAM1959 RNA, herein designated VGAM RNA, also designated SEQ ID:4670.

Another function of VGAM1959 is therefore inhibition of KIAA1449 (Accession NM_020839). Accordingly, utilities of VGAM1959 include diagnosis, prevention and treatment of diseases and clinical conditions associated with KIAA1449. KIAA1458 (Accession XM_044434) is another VGAM1959 host target gene. KIAA1458 BINDING SITE is HOST TARGET binding site found in the 5' untranslated region of mRNA encoded by KIAA1458, corresponding to a HOST TARGET binding site such as BINDING SITE I, BINDING SITE II or BINDING SITE III. Table 2 illustrates the complementarity of the nucleotide sequences of KIAA1458 BINDING SITE, designated SEQ ID:34204, to the nucleotide sequence of VGAM1959 RNA, herein designated VGAM RNA, also designated SEQ ID:4670.

Another function of VGAM1959 is therefore inhibition of KIAA1458 (Accession XM_044434). Accordingly, utilities of VGAM1959 include diagnosis, prevention and treatment of diseases and clinical conditions associated with KIAA1458. KIAA1465 (Accession XM_027396) is another VGAM1959 host target gene. KIAA1465 BINDING SITE is HOST TARGET binding site found in the 3' untranslated region of mRNA encoded by KIAA1465, corresponding to a HOST TARGET binding site such as BINDING SITE I, BINDING SITE II or BINDING SITE III. Table 2 illustrates the complementarity of the nucleotide sequences of KIAA1465 BINDING SITE, designated SEQ ID:30502, to the nucleotide sequence of VGAM1959 RNA, herein designated VGAM RNA, also designated SEQ ID:4670.

Another function of VGAM1959 is therefore inhibition of KIAA1465 (Accession XM_027396). Accordingly, utilities of VGAM1959 include diagnosis, prevention and treatment of diseases and clinical conditions associated with KIAA1465. KIAA1467 (Accession XM_049605) is another VGAM1959 host target gene. KIAA1467 BINDING SITE is HOST TARGET binding site found in the 3' untranslated region of mRNA encoded by KIAA1467, corresponding to a HOST TARGET binding site such as BINDING SITE I, BINDING SITE II or BINDING SITE III. Table 2 illustrates the complementarity of the nucleotide sequences of KIAA1467 BINDING SITE, designated SEQ ID:35451, to the nucleotide sequence of VGAM1959 RNA, herein designated VGAM RNA, also designated SEQ ID:4670.

Another function of VGAM1959 is therefore inhibition of KIAA1467 (Accession XM_049605). Accordingly, utilities of VGAM1959 include diagnosis, prevention and treatment of diseases and clinical conditions associated with KIAA1467. KIAA1509 (Accession XM_029353) is another VGAM1959 host target gene. KIAA1509 BINDING SITE is HOST TARGET binding site found in the 3' untranslated region of mRNA encoded by KIAA1509, corresponding to a HOST TARGET binding site such as BINDING SITE I, BINDING SITE II or BINDING SITE III. Table 2 illustrates the complementarity of the nucleotide sequences of KIAA1509 BINDING SITE, designated SEQ ID:30877, to the nucleotide sequence of VGAM1959 RNA, herein designated VGAM RNA, also designated SEQ ID:4670.

Another function of VGAM1959 is therefore inhibition of KIAA1509 (Accession XM_029353). Accordingly, utilities of VGAM1959 include diagnosis, prevention and treatment of diseases and clinical conditions associated with KIAA1509. KIAA1576 (Accession XM_038186) is another VGAM1959 host target gene. KIAA1576 BINDING SITE is HOST TARGET binding site found in the 3' untranslated region of mRNA encoded by KIAA1576, corresponding to a HOST TARGET binding site such as BINDING SITE I, BINDING SITE II or BINDING SITE III. Table 2 illustrates the complementarity of the nucleotide sequences of KIAA1576 BINDING SITE, designated SEQ ID:32772, to the nucleotide sequence of VGAM1959 RNA, herein designated VGAM RNA, also designated SEQ ID:4670.

Another function of VGAM1959 is therefore inhibition of KIAA1576 (Accession XM_038186). Accordingly, utilities of VGAM1959 include diagnosis, prevention and treatment of diseases and clinical conditions associated with KIAA1576. KIAA1580 (Accession XM_045271) is another VGAM1959 host target gene. KIAA1580 BINDING SITE is HOST TARGET binding site found in the 5' untranslated region of mRNA encoded by KIAA1580, corresponding to a HOST TARGET binding site such as BINDING SITE I, BINDING SITE II or BINDING SITE III. Table 2 illustrates the complementarity of the nucleotide sequences of KIAA1580 BINDING SITE, designated SEQ ID:34412, to the nucleotide sequence of VGAM1959 RNA, herein designated VGAM RNA, also designated SEQ ID:4670.

Another function of VGAM1959 is therefore inhibition of KIAA1580 (Accession XM_045271). Accordingly, utilities of VGAM1959 include diagnosis, prevention and treatment of diseases and clinical conditions associated with KIAA1580. KIAA1656 (Accession XM_038022) is another VGAM1959 host target gene. KIAA1656 BINDING SITE is HOST TARGET binding site found in the 3' untranslated region of mRNA encoded by KIAA1656, corresponding to a HOST TARGET binding site such as BINDING SITE I, BINDING SITE II or BINDING SITE III. Table 2 illustrates the complementarity of the nucleotide sequences of KIAA1656 BINDING SITE, designated SEQ ID:32732, to the nucleotide sequence of VGAM1959 RNA, herein designated VGAM RNA, also designated SEQ ID:4670.

Another function of VGAM1959 is therefore inhibition of KIAA1656 (Accession XM_038022). Accordingly, utilities of VGAM1959 include diagnosis, prevention and treatment of diseases and clinical conditions associated with KIAA1656. KIAA1679 (Accession XM_046570) is another VGAM1959 host target gene. KIAA1679 BINDING SITE is HOST TARGET binding site found in the 3' untranslated region of mRNA encoded by KIAA1679, corresponding to a HOST TARGET binding site such as BINDING SITE I, BINDING SITE II or BINDING SITE III. Table 2 illustrates the complementarity of the nucleotide sequences of KIAA1679 BINDING SITE, designated SEQ ID:34754, to the nucleotide sequence of VGAM1959 RNA, herein designated VGAM RNA, also designated SEQ ID:4670.

Another function of VGAM1959 is therefore inhibition of KIAA1679 (Accession XM_046570). Accordingly, utilities of VGAM1959 include diagnosis, prevention and treatment of diseases and clinical conditions associated with KIAA1679. KIAA1729 (Accession XM_114418) is another VGAM1959 host target gene. KIAA1729 BINDING SITE is HOST TARGET binding site found in the 3' untranslated region of mRNA encoded by KIAA1729, corresponding to a HOST TARGET binding site such as BINDING SITE I, BINDING SITE II or BINDING SITE III. Table 2 illustrates the complementarity of the nucleotide sequences of KIAA1729 BINDING SITE, designated SEQ ID:42950, to the nucleotide sequence of VGAM1959 RNA, herein designated VGAM RNA, also designated SEQ ID:4670.

Another function of VGAM1959 is therefore inhibition of KIAA1729 (Accession XM_114418). Accordingly, utilities of VGAM1959 include diagnosis, prevention and treatment of diseases and clinical conditions associated with KIAA1729. KIAA1755 (Accession XM_028810) is another VGAM1959 host target gene. KIAA1755 BINDING SITE is HOST TARGET binding site found in the 3' untranslated region of mRNA encoded by KIAA1755, corresponding to a HOST TARGET binding site such as BINDING SITE I, BINDING SITE II or BINDING SITE III. Table 2 illustrates the complementarity of the nucleotide sequences of KIAA1755 BINDING SITE, designated SEQ ID:30752, to the nucleotide sequence of VGAM1959 RNA, herein designated VGAM RNA, also designated SEQ ID:4670.

Another function of VGAM1959 is therefore inhibition of KIAA1755 (Accession XM_028810). Accordingly, utilities of VGAM1959 include diagnosis, prevention and treatment of diseases and clinical conditions associated with KIAA1755. KIAA1789 (Accession XM_040486) is another VGAM1959 host target gene. KIAA1789 BINDING SITE is HOST TARGET binding site found in the 5' untranslated region of mRNA encoded by KIAA1789, corresponding to a HOST TARGET binding site such as BINDING SITE I, BINDING SITE II or BINDING SITE III. Table 2 illustrates the complementarity of the nucleotide sequences of KIAA1789 BINDING SITE, designated SEQ ID:33313, to the nucleotide sequence of VGAM1959 RNA, herein designated VGAM RNA, also designated SEQ ID:4670.

Another function of VGAM1959 is therefore inhibition of KIAA1789 (Accession XM_040486). Accordingly, utilities of VGAM1959 include diagnosis, prevention and treatment of diseases and clinical conditions associated with KIAA1789. KIAA1798 (Accession XM_027074) is another VGAM1959 host target gene. KIAA1798 BINDING SITE is HOST TARGET binding site found in the 5' untranslated region of mRNA encoded by KIAA1798, corresponding to a HOST TARGET binding site such as BINDING SITE I, BINDING SITE II or BINDING SITE III. Table 2 illustrates the complementarity of the nucleotide sequences of KIAA1798 BINDING SITE, designated SEQ ID:30401, to the nucleotide sequence of VGAM1959 RNA, herein designated VGAM RNA, also designated SEQ ID:4670.

Another function of VGAM1959 is therefore inhibition of KIAA1798 (Accession XM_027074). Accordingly, utilities of VGAM1959 include diagnosis, prevention and treatment of diseases and clinical conditions associated with KIAA1798. KIAA1805 (Accession XM_086976) is another VGAM1959 host target gene. KIAA1805 BINDING SITE is HOST TARGET binding site found in the 3' untranslated region of mRNA encoded by KIAA1805, corresponding to a HOST TARGET binding site such as BINDING SITE I, BINDING SITE II or BINDING SITE III. Table 2 illustrates the complementarity of the nucleotide sequences of KIAA1805 BINDING SITE, designated SEQ ID:39002, to the nucleotide sequence of VGAM1959 RNA, herein designated VGAM RNA, also designated SEQ ID:4670.

Another function of VGAM1959 is therefore inhibition of KIAA1805 (Accession XM_086976). Accordingly, utilities of VGAM1959 include diagnosis, prevention and treatment of diseases and clinical conditions associated with KIAA1805. KIAA1870 (Accession NM_032888) is another VGAM1959 host target gene. KIAA1870 BINDING SITE is HOST TARGET binding site found in the 5' untranslated region of mRNA encoded by KIAA1870, corresponding to a HOST TARGET binding site such as BINDING SITE I, BINDING SITE II or BINDING SITE III. Table 2 illustrates the complementarity of the nucleotide sequences of KIAA1870 BINDING SITE, designated SEQ ID:26709, to the nucleotide sequence of VGAM1959 RNA, herein designated VGAM RNA, also designated SEQ ID:4670.

Another function of VGAM1959 is therefore inhibition of KIAA1870 (Accession NM_032888). Accordingly, utilities of VGAM1959 include diagnosis, prevention and treatment of diseases and clinical conditions associated with KIAA1870. KIAA1904 (Accession XM_056282) is another VGAM1959 host target gene. KIAA1904 BINDING SITE is HOST TARGET binding site found in the 3' untranslated region of mRNA encoded by KIAA1904, corresponding to a HOST TARGET binding site such as BINDING SITE I, BINDING SITE II or BINDING SITE III. Table 2 illustrates the complementarity of the nucleotide sequences of KIAA1904 BINDING SITE, designated SEQ ID:36374, to the nucleotide sequence of VGAM1959 RNA, herein designated VGAM RNA, also designated SEQ ID:4670.

Another function of VGAM1959 is therefore inhibition of KIAA1904 (Accession XM_056282). Accordingly, utilities of VGAM1959 include diagnosis, prevention and treatment of diseases and clinical conditions associated with KIAA1904. KIAA1906 (Accession XM_055095) is another VGAM1959 host target gene. KIAA1906 BINDING SITE is HOST TARGET binding site found in the 3' untranslated region of mRNA encoded by KIAA1906, corresponding to a HOST TARGET binding site such as BINDING SITE I, BINDING SITE II or BINDING SITE III. Table 2 illustrates the complementarity of the nucleotide sequences of KIAA1906 BINDING SITE, designated SEQ ID:36229, to the nucleotide sequence of VGAM1959 RNA, herein designated VGAM RNA, also designated SEQ ID:4670.

Another function of VGAM1959 is therefore inhibition of KIAA1906 (Accession XM_055095). Accordingly, utilities of VGAM1959 include diagnosis, prevention and treatment of diseases and clinical conditions associated with KIAA1906. KIAA1908 (Accession XM_055834) is another VGAM1959 host target gene. KIAA1908 BINDING SITE is HOST TARGET binding site found in the 5' untranslated region of mRNA encoded by KIAA1908, corresponding to a HOST TARGET binding site such as BINDING SITE I, BINDING SITE II or BINDING SITE III. Table 2 illustrates the complementarity of the nucleotide sequences of KIAA1908 BINDING SITE, designated SEQ ID:36340, to the nucleotide sequence of VGAM1959 RNA, herein designated VGAM RNA, also designated SEQ ID:4670.

Another function of VGAM1959 is therefore inhibition of KIAA1908 (Accession XM_055834). Accordingly, utilities of VGAM1959 include diagnosis, prevention and treatment of diseases and clinical conditions associated with KIAA1908. KIAA1924 (Accession XM_057091) is another VGAM1959 host target gene. KIAA1924 BINDING SITE is HOST TARGET binding site found in the 3' untranslated region of mRNA encoded by KIAA1924, corresponding to a HOST TARGET binding site such as BINDING SITE I, BINDING SITE II or BINDING SITE III. Table 2 illustrates the complementarity of the nucleotide sequences of KIAA1924 BINDING SITE, designated SEQ ID:36476, to the nucleotide sequence of VGAM1959 RNA, herein designated VGAM RNA, also designated SEQ ID:4670.

Another function of VGAM1959 is therefore inhibition of KIAA1924 (Accession XM_057091). Accordingly, utilities of VGAM1959 include diagnosis, prevention and treatment of diseases and clinical conditions associated with KIAA1924. KIAA1941 (Accession XM_059318) is another VGAM1959 host target gene. KIAA1941 BINDING SITE is HOST TARGET binding site found in the 3' untranslated region of mRNA encoded by KIAA1941, corresponding to a HOST TARGET binding site such as BINDING SITE I, BINDING SITE II or BINDING SITE III. Table 2 illustrates the complementarity of the nucleotide sequences of KIAA1941 BINDING SITE, designated SEQ ID:36954, to the nucleotide sequence of VGAM1959 RNA, herein designated VGAM RNA, also designated SEQ ID:4670.

Another function of VGAM1959 is therefore inhibition of KIAA1941 (Accession XM_059318). Accordingly, utilities of VGAM1959 include diagnosis, prevention and treatment of diseases and clinical conditions associated with KIAA1941. KIAA1948 (Accession XM_091984) is another VGAM1959 host target gene. KIAA1948 BINDING SITE is HOST TARGET binding site found in the 5' untranslated region of mRNA encoded by KIAA1948, corresponding to a HOST TARGET binding site such as BINDING SITE I, BINDING SITE II or BINDING SITE III. Table 2 illustrates the complementarity of the nucleotide sequences of KIAA1948 BINDING SITE, designated SEQ ID:40079, to the nucleotide sequence of VGAM1959 RNA, herein designated VGAM RNA, also designated SEQ ID:4670.

Another function of VGAM1959 is therefore inhibition of KIAA1948 (Accession XM_091984). Accordingly, utilities of VGAM1959 include diagnosis, prevention and treatment of diseases and clinical conditions associated with KIAA1948. KIAA1950 (Accession XM_166532) is another VGAM1959 host target gene. KIAA1950 BINDING SITE is HOST TARGET binding site found in the 3' untranslated region of mRNA encoded by KIAA1950, corresponding to a HOST TARGET binding site such as BINDING SITE I, BINDING SITE II or BINDING SITE III. Table 2 illustrates the complementarity of the nucleotide sequences of KIAA1950 BINDING SITE, designated SEQ ID:44486, to the nucleotide sequence of VGAM1959 RNA, herein designated VGAM RNA, also designated SEQ ID:4670.

Another function of VGAM1959 is therefore inhibition of KIAA1950 (Accession XM_166532). Accordingly, utilities of VGAM1959 include diagnosis, prevention and treatment of diseases and clinical conditions associated with KIAA1950. KIAA1977 (Accession XM_058800) is another VGAM1959 host target gene. KIAA1977 BINDING SITE is HOST TARGET binding site found in the 5' untranslated region of mRNA encoded by KIAA1977, corresponding to a HOST TARGET binding site such as BINDING SITE I, BINDING SITE II or BINDING SITE III. Table 2 illustrates the complementarity of the nucleotide sequences of KIAA1977 BINDING SITE, designated SEQ ID:36745, to the nucleotide sequence of VGAM1959 RNA, herein designated VGAM RNA, also designated SEQ ID:4670.

Another function of VGAM1959 is therefore inhibition of KIAA1977 (Accession XM_058800). Accordingly, utilities of VGAM1959 include diagnosis, prevention and treatment of diseases and clinical conditions associated with KIAA1977. KIAA1981 (Accession XM_114000) is another VGAM1959 host target gene. KIAA1981 BINDING SITE1 and KIAA1981 BINDING SITE2 are HOST TARGET binding sites found in untranslated regions of mRNA encoded by KIAA1981, corresponding to HOST TARGET binding sites such as BINDING SITE I, BINDING SITE II or BINDING SITE III. Table 2 illustrates the complementarity of the nucleotide sequences of KIAA1981 BINDING SITE1 and KIAA1981 BINDING SITE2, designated SEQ ID:42608 and SEQ ID:42611 respectively, to the nucleotide sequence of VGAM1959 RNA, herein designated VGAM RNA, also designated SEQ ID:4670.

Another function of VGAM1959 is therefore inhibition of KIAA1981 (Accession XM_114000). Accordingly, utilities of VGAM1959 include diagnosis, prevention and treatment of diseases and clinical conditions associated with KIAA1981. Kinesin Family Member 13B (KIF13B, Accession NM_015254) is another VGAM1959 host target gene. KIF13B BINDING SITE1 and KIF13B BINDING SITE2 are HOST TARGET binding sites found in untranslated regions of mRNA encoded by KIF13B, corresponding to HOST TARGET binding sites such as BINDING SITE I, BINDING SITE II or BINDING SITE III. Table 2 illustrates the complementarity of the nucleotide sequences of KIF13B BINDING SITE1 and KIF13B BINDING SITE2, designated SEQ ID:17583 and SEQ ID:42788 respectively, to the nucleotide sequence of VGAM1959 RNA, herein designated VGAM RNA, also designated SEQ ID:4670.

Another function of VGAM1959 is therefore inhibition of Kinesin Family Member 13B (KIF13B, Accession NM_015254). Accordingly, utilities of VGAM1959 include diagnosis, prevention and treatment of diseases and clinical conditions associated with KIF13B. LIM and SH3 Protein 1 (LASP1, Accession NM_006148) is another VGAM1959 host target gene. LASP1 BINDING SITE is HOST TARGET binding site found in the 3' untranslated region of mRNA encoded by LASP1, corresponding to a HOST TARGET binding site such as BINDING SITE I, BINDING SITE II or BINDING SITE III. Table 2 illustrates the complementarity of the nucleotide sequences of LASP1 BINDING SITE, designated SEQ ID:12795, to the nucleotide sequence of VGAM1959 RNA, herein designated VGAM RNA, also designated SEQ ID:4670.

Another function of VGAM1959 is therefore inhibition of LIM and SH3 Protein 1 (LASP1, Accession NM_006148). Accordingly, utilities of VGAM1959 include diagnosis, prevention and treatment of diseases and clinical conditions associated with LASP1. LATS, Large Tumor Suppressor, Homolog 1 (Drosophila) (LATS1, Accession XM_015547) is another VGAM1959 host target gene. LATS1 BINDING SITE is HOST TARGET binding site found in the 3' untranslated region of mRNA encoded by LATS1, corresponding to a HOST TARGET binding site such as BINDING SITE I, BINDING SITE II or BINDING SITE III. Table 2 illustrates the complementarity of the nucleotide sequences of LATS1 BINDING SITE, designated SEQ ID:30239, to the nucleotide sequence of VGAM1959 RNA, herein designated VGAM RNA, also designated SEQ ID:4670.

Another function of VGAM1959 is therefore inhibition of LATS, Large Tumor Suppressor, Homolog 1 (Drosophila) (LATS1, Accession XM_015547). Accordingly, utilities of VGAM1959 include diagnosis, prevention and treatment of diseases and clinical conditions associated with LATS1. LIM Domain Kinase 2 (LIMK2, Accession NM_016733) is another VGAM1959 host target gene. LIMK2 BINDING SITE1 and LIMK2 BINDING SITE2 are HOST TARGET binding sites found in untranslated regions of mRNA encoded by LIMK2, corresponding to HOST TARGET binding sites such as BINDING SITE I, BINDING SITE II or BINDING SITE III. Table 2 illustrates the complementarity of the nucleotide sequences of LIMK2 BINDING SITE1 and LIMK2 BINDING SITE2, designated SEQ ID:18784 and SEQ ID:12094 respectively, to the nucleotide sequence of VGAM1959 RNA, herein designated VGAM RNA, also designated SEQ ID:4670.

Another function of VGAM1959 is therefore inhibition of LIM Domain Kinase 2 (LIMK2, Accession NM_016733). Accordingly, utilities of VGAM1959 include diagnosis, prevention and treatment of diseases and clinical conditions associated with LIMK2. Mitogen-activated Protein Kinase 8 Interacting Protein 2 (MAPK8IP2, Accession NM_016431) is another VGAM1959 host target gene. MAPK8IP2 BINDING SITE1 through MAPK8IP2 BINDING SITE3 are HOST TARGET binding sites found in untranslated regions of mRNA encoded by MAPK8IP2, corresponding to HOST TARGET binding sites such as BINDING SITE I, BINDING SITE II or BINDING SITE III. Table 2 illustrates the complementarity of the nucleotide sequences of MAPK8IP2 BINDING SITE1 through MAPK8IP2 BINDING SITE3, designated SEQ ID:18552, SEQ ID:14704 and SEQ ID:29155 respectively, to the nucleotide sequence of VGAM1959 RNA, herein designated VGAM RNA, also designated SEQ ID:4670.

Another function of VGAM1959 is therefore inhibition of Mitogen-activated Protein Kinase 8 Interacting Protein 2 (MAPK8IP2, Accession NM_016431). Accordingly, utilities of VGAM1959 include diagnosis, prevention and treatment of diseases and clinical conditions associated with MAPK8IP2. MGC10471 (Accession NM_030818) is another VGAM1959 host target gene. MGC10471 BINDING SITE is HOST TARGET binding site found in the 5' untranslated region of mRNA encoded by MGC10471, corresponding to a HOST TARGET binding site such as BINDING SITE I, BINDING SITE II or BINDING SITE III. Table 2 illustrates the complementarity of the nucleotide sequences of MGC10471 BINDING SITE, designated SEQ ID:25147, to the nucleotide sequence of VGAM1959 RNA, herein designated VGAM RNA, also designated SEQ ID:4670.

Another function of VGAM1959 is therefore inhibition of MGC10471 (Accession NM_030818). Accordingly, utilities of VGAM1959 include diagnosis, prevention and treatment of diseases and clinical conditions associated with MGC10471. MGC10715 (Accession NM_024325) is another VGAM1959 host target gene. MGC10715 BINDING SITE is HOST TARGET binding site found in the 3' untranslated region of mRNA encoded by MGC10715, corresponding to a HOST TARGET binding site such as BINDING SITE I, BINDING SITE II or BINDING SITE III. Table 2 illustrates the complementarity of the nucleotide sequences of MGC10715 BINDING SITE, designated SEQ ID:23614, to the nucleotide sequence of VGAM1959 RNA, herein designated VGAM RNA, also designated SEQ ID:4670.

Another function of VGAM1959 is therefore inhibition of MGC10715 (Accession NM_024325). Accordingly, utilities of VGAM1959 include diagnosis, prevention and treatment of diseases and clinical conditions associated with MGC10715. MGC12760 (Accession NM_032723) is another VGAM1959 host target gene. MGC12760 BINDING SITE is HOST TARGET binding site found in the 3' untranslated region of mRNA encoded by MGC12760, corresponding to a HOST TARGET binding site such as BINDING SITE I, BINDING SITE II or BINDING SITE III. Table 2 illustrates the complementarity of the nucleotide sequences of MGC12760 BINDING SITE, designated SEQ ID:26448, to the nucleotide sequence of VGAM1959 RNA, herein designated VGAM RNA, also designated SEQ ID:4670.

Another function of VGAM1959 is therefore inhibition of MGC12760 (Accession NM_032723). Accordingly, utilities of VGAM1959 include diagnosis, prevention and treatment of diseases and clinical conditions associated with MGC12760. MGC13114 (Accession NM_032366) is another VGAM1959 host target gene. MGC13114 BINDING SITE1 and MGC13114 BINDING SITE2 are HOST TARGET binding sites found in untranslated regions of mRNA encoded by MGC13114, corresponding to HOST TARGET binding sites such as BINDING SITE I, BINDING SITE II or BINDING SITE III. Table 2 illustrates the complementarity of the nucleotide sequences of MGC13114 BINDING SITE1 and MGC13114 BINDING SITE2, designated SEQ ID:26151 and SEQ ID:26152 respectively, to the nucleotide sequence of VGAM1959 RNA, herein designated VGAM RNA, also designated SEQ ID:4670.

Another function of VGAM1959 is therefore inhibition of MGC13114 (Accession NM_032366). Accordingly, utilities of VGAM1959 include diagnosis, prevention and treatment of diseases and clinical conditions associated with MGC13114. MGC15873 (Accession NM_032920) is another VGAM1959 host target gene. MGC15873 BINDING SITE is HOST TARGET binding site found in the 3' untranslated region of mRNA encoded by MGC15873, corresponding to a HOST TARGET binding site such as BINDING SITE I, BINDING SITE II or BINDING SITE III. Table 2 illustrates the complementarity of the nucleotide sequences of MGC15873 BINDING SITE, designated SEQ ID:26741, to the nucleotide sequence of VGAM1959 RNA, herein designated VGAM RNA, also designated SEQ ID:4670.

Another function of VGAM1959 is therefore inhibition of MGC15873 (Accession NM_032920). Accordingly, utilities of VGAM1959 include diagnosis, prevention and treatment of diseases and clinical conditions associated with MGC15873. MGC2306 (Accession NM_032638) is another VGAM1959 host target gene. MGC2306 BINDING SITE is HOST TARGET binding site found in the 3' untranslated region of mRNA encoded by MGC2306, corresponding to a HOST TARGET binding site such as BINDING SITE I, BINDING SITE II or BINDING SITE III. Table 2 illustrates the complementarity of the nucleotide sequences of MGC2306 BINDING SITE, designated SEQ ID:26352, to the nucleotide sequence of VGAM1959 RNA, herein designated VGAM RNA, also designated SEQ ID:4670.

Another function of VGAM1959 is therefore inhibition of MGC2306 (Accession NM_032638). Accordingly, utilities of VGAM1959 include diagnosis, prevention and treatment of diseases and clinical conditions associated with MGC2306. MGC2721 (Accession NM_032737) is another VGAM1959 host target gene. MGC2721 BINDING SITE is HOST TARGET binding site found in the 3' untranslated region of mRNA encoded by MGC2721, corresponding to a HOST TARGET binding site such as BINDING SITE I, BINDING SITE II or BINDING SITE III. Table 2 illustrates the complementarity of the nucleotide sequences of MGC2721 BINDING SITE, designated SEQ ID:26462, to the nucleotide sequence of VGAM1959 RNA, herein designated VGAM RNA, also designated SEQ ID:4670.

Another function of VGAM1959 is therefore inhibition of MGC2721 (Accession NM_032737). Accordingly, utilities of VGAM1959 include diagnosis, prevention and treatment of diseases and clinical conditions associated with MGC2721. MGC3222 (Accession NM_024334) is another VGAM1959 host target gene. MGC3222 BINDING SITE is HOST TARGET binding site found in the 3' untranslated region of mRNA encoded by MGC3222, corresponding to a HOST TARGET binding site such as BINDING SITE I, BINDING SITE II or BINDING SITE III. Table 2 illustrates the complementarity of the nucleotide sequences of MGC3222 BINDING SITE, designated SEQ ID:23643, to the nucleotide sequence of VGAM1959 RNA, herein designated VGAM RNA, also designated SEQ ID:4670.

Another function of VGAM1959 is therefore inhibition of MGC3222 (Accession NM_024334). Accordingly, utilities of VGAM1959 include diagnosis, prevention and treatment of diseases and clinical conditions associated with MGC3222. MGC4415 (Accession NM_031484) is another VGAM1959 host target gene. MGC4415 BINDING SITE is HOST TARGET binding site found in the 3' untranslated region of mRNA encoded by MGC4415, corresponding to a HOST TARGET binding site such as BINDING SITE I, BINDING SITE II or BINDING SITE III. Table 2 illustrates the complementarity of the nucleotide sequences of MGC4415 BINDING SITE, designated SEQ ID:25574, to the nucleotide sequence of VGAM1959 RNA, herein designated VGAM RNA, also designated SEQ ID:4670.

Another function of VGAM1959 is therefore inhibition of MGC4415 (Accession NM_031484). Accordingly, utilities of VGAM1959 include diagnosis, prevention and treatment of diseases and clinical conditions associated with MGC4415. MGC4796 (Accession XM_029031) is another VGAM1959 host target gene. MGC4796 BINDING SITE is HOST TARGET binding site found in the 3' untranslated region of mRNA encoded by MGC4796, corresponding to a HOST TARGET binding site such as BINDING SITE I, BINDING SITE II or BINDING SITE III. Table 2 illustrates the complementarity of the nucleotide sequences of MGC4796 BINDING SITE, designated SEQ ID:30832, to the nucleotide sequence of VGAM1959 RNA, herein designated VGAM RNA, also designated SEQ ID:4670.

Another function of VGAM1959 is therefore inhibition of MGC4796 (Accession XM_029031). Accordingly, utilities of VGAM1959 include diagnosis, prevention and treatment of diseases and clinical conditions associated with MGC4796. MGC8407 (Accession NM_024046) is another VGAM1959 host target gene. MGC8407 BINDING SITE is HOST TARGET binding site found in the 3' untranslated region of mRNA encoded by MGC8407, corresponding to a HOST TARGET binding site such as BINDING SITE I, BINDING SITE II or BINDING SITE III. Table 2 illustrates the complementarity of the nucleotide sequences of MGC8407 BINDING SITE, designated SEQ ID:23480, to the nucleotide sequence of VGAM1959 RNA, herein designated VGAM RNA, also designated SEQ ID:4670.

Another function of VGAM1959 is therefore inhibition of MGC8407 (Accession NM_024046). Accordingly, utilities of VGAM1959 include diagnosis, prevention and treatment of diseases and clinical conditions associated with MGC8407. MIDORI (Accession XM_057651) is another VGAM1959 host target gene. MIDORI BINDING SITE is HOST TARGET binding site found in the 3' untranslated region of mRNA encoded by MIDORI, corresponding to a HOST TARGET binding site such as BINDING SITE I, BINDING SITE II or BINDING SITE III. Table 2 illustrates the complementarity of the nucleotide sequences of MIDORI BINDING SITE, designated SEQ ID:36531, to the nucleotide sequence of VGAM1959 RNA, herein designated VGAM RNA, also designated SEQ ID:4670.

Another function of VGAM1959 is therefore inhibition of MIDORI (Accession XM_057651). Accordingly, utilities of VGAM1959 include diagnosis, prevention and treatment of diseases and clinical conditions associated with MIDORI. MRF2 (Accession XM_084482) is another VGAM1959 host target gene. MRF2 BINDING SITE is HOST TARGET binding site found in the 5' untranslated region of mRNA encoded by MRF2, corresponding to a HOST TARGET binding site such as BINDING SITE I, BINDING SITE II or BINDING SITE III. Table 2 illustrates the complementarity of the nucleotide sequences of MRF2 BINDING SITE, designated SEQ ID:37601, to the nucleotide sequence of VGAM1959 RNA, herein designated VGAM RNA, also designated SEQ ID:4670.

Another function of VGAM1959 is therefore inhibition of MRF2 (Accession XM_084482). Accordingly, utilities of VGAM1959 include diagnosis, prevention and treatment of diseases and clinical conditions associated with MRF2. MY038 (Accession NM_032626) is another VGAM1959 host target gene. MY038 BINDING SITE1 and MY038 BINDING SITE2 are HOST TARGET binding sites found in untranslated regions of mRNA encoded by MY038, corresponding to HOST TARGET binding sites such as BINDING SITE I, BINDING SITE II or BINDING SITE III. Table 2 illustrates the complementarity of the nucleotide sequences of MY038 BINDING SITE1 and MY038 BINDING SITE2, designated SEQ ID:26345 and SEQ ID:26346 respectively, to the nucleotide sequence of VGAM1959 RNA, herein designated VGAM RNA, also designated SEQ ID:4670.

Another function of VGAM1959 is therefore inhibition of MY038 (Accession NM_032626). Accordingly, utilities of VGAM1959 include diagnosis, prevention and treatment of diseases and clinical conditions associated with MY038. NDRG Family Member 4 (NDRG4, Accession NM_022910) is another VGAM1959 host target gene. NDRG4 BINDING SITE1 and NDRG4 BINDING SITE2 are HOST TARGET binding sites found in untranslated regions of mRNA encoded by NDRG4, corresponding to HOST TARGET binding sites such as BINDING SITE I, BINDING SITE II or BINDING SITE III. Table 2 illustrates the complementarity of the nucleotide sequences of NDRG4 BINDING SITE1 and NDRG4 BINDING SITE2, designated SEQ ID:23212 and SEQ ID:21697 respectively, to the nucleotide sequence of VGAM1959 RNA, herein designated VGAM RNA, also designated SEQ ID:4670.

Another function of VGAM1959 is therefore inhibition of NDRG Family Member 4 (NDRG4, Accession NM_022910). Accordingly, utilities of VGAM1959 include diagnosis, prevention and treatment of diseases and clinical conditions associated with NDRG4. NUDEL (Accession NM_030808) is another VGAM1959 host target gene. NUDEL BINDING SITE is HOST TARGET binding site found in the 3' untranslated region of mRNA encoded by NUDEL, corresponding to a HOST TARGET binding site such as BINDING SITE I, BINDING SITE II or BINDING SITE III. Table 2 illustrates the complementarity of the nucleotide sequences of NUDEL BINDING SITE, designated SEQ ID:25123, to the nucleotide sequence of VGAM1959 RNA, herein designated VGAM RNA, also designated SEQ ID:4670.

Another function of VGAM1959 is therefore inhibition of NUDEL (Accession NM_030808). Accordingly, utilities of VGAM1959 include diagnosis, prevention and treatment of diseases and clinical conditions associated with NUDEL. Nucleoredoxin (NXN, Accession NM_022463) is another VGAM1959 host target gene. NXN BINDING SITE is HOST TARGET binding site found in the 3" untranslated region of mRNA encoded by NXN, corresponding to a HOST TARGET binding site such as BINDING SITE I, BINDING SITE II or BINDING SITE III. Table 2 illustrates the complementarity of the nucleotide sequences of NXN BINDING SITE, designated SEQ ID:22813, to the nucleotide sequence of VGAM1959 RNA, herein designated VGAM RNA, also designated SEQ ID:4670.

Another function of VGAM1959 is therefore inhibition of Nucleoredoxin (NXN, Accession NM_022463). Accordingly, utilities of VGAM1959 include diagnosis, prevention and treatment of diseases and clinical conditions associated with NXN. Ornithine Decarboxylase Antizyme 2 (OAZ2, Accession NM_002537) is another VGAM1959 host target gene. OAZ2 BINDING SITE is HOST TARGET binding site found in the 3' untranslated region of mRNA encoded by OAZ2, corresponding to a HOST TARGET binding site such as BINDING SITE I, BINDING SITE II or BINDING SITE III. Table 2 illustrates the complementarity of the nucleotide sequences of OAZ2 BINDING SITE, designated SEQ ID:8377, to the nucleotide sequence of VGAM1959 RNA, herein designated VGAM RNA, also designated SEQ ID:4670.

Another function of VGAM1959 is therefore inhibition of Ornithine Decarboxylase Antizyme 2 (OAZ2, Accession NM_002537). Accordingly, utilities of VGAM1959 include diagnosis, prevention and treatment of diseases and clinical conditions associated with OAZ2. Obscurin, Cytoskeletal Calmodulin and Titin-interacting RhoGEF (OBSCN, Accession XM_047536) is another VGAM1959 host target gene. OBSCN BINDING SITE is HOST TARGET binding site found in the 3' untranslated region of mRNA encoded by OBSCN, corresponding to a HOST TARGET binding site such as BINDING SITE I, BINDING SITE II or BINDING SITE III. Table 2 illustrates the complementarity of the nucleotide sequences of OBSCN BINDING SITE, designated SEQ ID:34989, to the nucleotide sequence of VGAM1959 RNA, herein designated VGAM RNA, also designated SEQ ID:4670.

Another function of VGAM1959 is therefore inhibition of Obscurin, Cytoskeletal Calmodulin and Titin-interacting RhoGEF (OBSCN, Accession XM_047536). Accordingly, utilities of VGAM1959 include diagnosis, prevention and treatment of diseases and clinical conditions associated with OBSCN. Olfactomedin 3 (OLFM3, Accession XM_088951) is another VGAM1959 host target gene. OLFM3 BINDING SITE is HOST TARGET binding site found in the 5' untranslated region of mRNA encoded by OLFM3, corresponding to a HOST TARGET binding site such as BINDING SITE I, BINDING SITE II or BINDING SITE III. Table 2 illustrates the complementarity of the nucleotide sequences of OLFM3 BINDING SITE, designated SEQ ID:39962, to the nucleotide sequence of VGAM1959 RNA, herein designated VGAM RNA, also designated SEQ ID:4670.

Another function of VGAM1959 is therefore inhibition of Olfactomedin 3 (OLFM3, Accession XM_088951). Accordingly, utilities of VGAM1959 include diagnosis, prevention and treatment of diseases and clinical conditions associated with OLFM3. p25 (Accession NM_007030) is another VGAM1959 host target gene. p25 BINDING SITE is HOST TARGET binding site found in the 3' untranslated region of mRNA encoded by p25, corresponding to a HOST TARGET binding site such as BINDING SITE I, BINDING SITE II or BINDING SITE III. Table 2 illustrates the complementarity of the nucleotide sequences of p25 BINDING SITE, designated SEQ ID:13891, to the nucleotide sequence of VGAM1959 RNA, herein designated VGAM RNA, also designated SEQ ID:4670.

Another function of VGAM1959 is therefore inhibition of p25 (Accession NM_007030). Accordingly, utilities of VGAM1959 include diagnosis, prevention and treatment of diseases and clinical conditions associated with p25. Purinergic Receptor P2X-like 1, Orphan Receptor (P2RXL1, Accession NM_005446) is another VGAM1959 host target gene. P2RXL1 BINDING SITE1 and P2RXL1 BINDING SITE2 are HOST TARGET binding sites found in untranslated regions of mRNA encoded by P2RXL1, corresponding to HOST TARGET binding sites such as BINDING SITE I, BINDING SITE II or BINDING SITE III. Table 2 illustrates the complementarity of the nucleotide sequences of P2RXL1 BINDING SITE1 and P2RXL1 BINDING SITE2, designated SEQ ID:11930 and SEQ ID:11934 respectively, to the nucleotide sequence of VGAM1959 RNA, herein designated VGAM RNA, also designated SEQ ID:4670.

Another function of VGAM1959 is therefore inhibition of Purinergic Receptor P2X-like 1, Orphan Receptor (P2RXL1, Accession NM_005446). Accordingly, utilities of VGAM1959 include diagnosis, prevention and treatment of diseases and clinical conditions associated with P2RXL1. PC2 (positive cofactor 2, multiprotein complex) Glutamine/

Q-rich-associated Protein (PCQAP, Accession NM_015889) is another VGAM1959 host target gene. PCQAP BINDING SITE is HOST TARGET binding site found in the 3' untranslated region of mRNA encoded by PCQAP, corresponding to a HOST TARGET binding site such as BINDING SITE I, BINDING SITE II or BINDING SITE III. Table 2 illustrates the complementarity of the nucleotide sequences of PCQAP BINDING SITE, designated SEQ ID:18035, to the nucleotide sequence of VGAM1959 RNA, herein designated VGAM RNA, also designated SEQ ID:4670.

Another function of VGAM1959 is therefore inhibition of PC2 (positive cofactor 2, multiprotein complex) Glutamine/Q-rich-associated Protein (PCQAP, Accession NM_015889). Accordingly, utilities of VGAM1959 include diagnosis, prevention and treatment of diseases and clinical conditions associated with PCQAP. Phosphodiesterase 11A (PDE11A, Accession NM_016953) is another VGAM1959 host target gene. PDE11A BINDING SITE is HOST TARGET binding site found in the 3' untranslated region of mRNA encoded by PDE11A, corresponding to a HOST TARGET binding site such as BINDING SITE I, BINDING SITE II or BINDING SITE III. Table 2 illustrates the complementarity of the nucleotide sequences of PDE11A BINDING SITE, designated SEQ ID:18867, to the nucleotide sequence of VGAM1959 RNA, herein designated VGAM RNA, also designated SEQ ID:4670.

Another function of VGAM1959 is therefore inhibition of Phosphodiesterase 11A (PDE11A, Accession NM_016953). Accordingly, utilities of VGAM1959 include diagnosis, prevention and treatment of diseases and clinical conditions associated with PDE11A. Phosphodiesterase 4D Interacting Protein (myomegalin) (PDE4DIP, Accession NM_014644) is another VGAM1959 host target gene. PDE4DIP BINDING SITE is HOST TARGET binding site found in the 3' untranslated region of mRNA encoded by PDE4DIP, corresponding to a HOST TARGET binding site such as BINDING SITE I, BINDING SITE II or BINDING SITE III. Table 2 illustrates the complementarity of the nucleotide sequences of PDE4DIP BINDING SITE, designated SEQ ID:16051, to the nucleotide sequence of VGAM1959 RNA, herein designated VGAM RNA, also designated SEQ ID:4670.

Another function of VGAM1959 is therefore inhibition of Phosphodiesterase 4D Interacting Protein (myomegalin) (PDE4DIP, Accession NM_014644). Accordingly, utilities of VGAM1959 include diagnosis, prevention and treatment of diseases and clinical conditions associated with PDE4DIP. PIF1 (Accession XM_027898) is another VGAM1959 host target gene. PIF1 BINDING SITE is HOST TARGET binding site found in the 3' untranslated region of mRNA encoded by PIF1, corresponding to a HOST TARGET binding site such as BINDING SITE I, BINDING SITE II or BINDING SITE III. Table 2 illustrates the complementarity of the nucleotide sequences of PIF1 BINDING SITE, designated SEQ ID:30587, to the nucleotide sequence of VGAM1959 RNA, herein designated VGAM RNA, also designated SEQ ID:4670.

Another function of VGAM1959 is therefore inhibition of PIF1 (Accession XM_027898). Accordingly, utilities of VGAM1959 include diagnosis, prevention and treatment of diseases and clinical conditions associated with PIF1. PTEN Induced Putative Kinase 1 (PINK1, Accession NM_032409) is another VGAM1959 host target gene. PINK1 BINDING SITE is HOST TARGET binding site found in the 3' untranslated region of mRNA encoded by PINK1, corresponding to a HOST TARGET binding site such as BINDING SITE I, BINDING SITE II or BINDING SITE III. Table 2 illustrates the complementarity of the nucleotide sequences of PINK1 BINDING SITE, designated SEQ ID:26194, to the nucleotide sequence of VGAM1959 RNA, herein designated VGAM RNA, also designated SEQ ID:4670.

Another function of VGAM1959 is therefore inhibition of PTEN Induced Putative Kinase 1 (PINK1, Accession NM_032409). Accordingly, utilities of VGAM1959 include diagnosis, prevention and treatment of diseases and clinical conditions associated with PINK1. Phosphatidylserine Decarboxylase (PISD, Accession NM_014338) is another VGAM1959 host target gene. PISD BINDING SITE is HOST TARGET binding site found in the 5' untranslated region of mRNA encoded by PISD, corresponding to a HOST TARGET binding site such as BINDING SITE I, BINDING SITE II or BINDING SITE III. Table 2 illustrates the complementarity of the nucleotide sequences of PISD BINDING SITE, designated SEQ ID:15655, to the nucleotide sequence of VGAM1959 RNA, herein designated VGAM RNA, also designated SEQ ID:4670.

Another function of VGAM1959 is therefore inhibition of Phosphatidylserine Decarboxylase (PISD, Accession NM_014338). Accordingly, utilities of VGAM1959 include diagnosis, prevention and treatment of diseases and clinical conditions associated with PISD. Phospholipase C-like 2 (PLCL2, Accession XM_042836) is another VGAM1959 host target gene. PLCL2 BINDING SITE is HOST TARGET binding site found in the 3' untranslated region of mRNA encoded by PLCL2, corresponding to a HOST TARGET binding site such as BINDING SITE I, BINDING SITE II or BINDING SITE III. Table 2 illustrates the complementarity of the nucleotide sequences of PLCL2 BINDING SITE, designated SEQ ID:33796, to the nucleotide sequence of VGAM1959 RNA, herein designated VGAM RNA, also designated SEQ ID:4670.

Another function of VGAM1959 is therefore inhibition of Phospholipase C-like 2 (PLCL2, Accession XM_042836). Accordingly, utilities of VGAM1959 include diagnosis, prevention and treatment of diseases and clinical conditions associated with PLCL2. PM5 (Accession XM_027359) is another VGAM1959 host target gene. PM5 BINDING SITE is HOST TARGET binding site found in the 5' untranslated region of mRNA encoded by PM5, corresponding to a HOST TARGET binding site such as BINDING SITE I, BINDING SITE II or BINDING SITE III. Table 2 illustrates the complementarity of the nucleotide sequences of PM5 BINDING SITE, designated SEQ ID:30498, to the nucleotide sequence of VGAM1959 RNA, herein designated VGAM RNA, also designated SEQ ID:4670.

Another function of VGAM1959 is therefore inhibition of PM5 (Accession XM_027359). Accordingly, utilities of VGAM1959 include diagnosis, prevention and treatment of diseases and clinical conditions associated with PM5. PP3501 (Accession NM_021731) is another VGAM1959 host target gene. PP3501 BINDING SITE is HOST TARGET binding site found in the 3' untranslated region of mRNA encoded by PP3501, corresponding to a HOST TARGET binding site such as BINDING SITE I, BINDING SITE II or BINDING SITE III. Table 2 illustrates the complementarity of the nucleotide sequences of PP3501 BINDING SITE, designated SEQ ID:22333, to the nucleotide sequence of VGAM1959 RNA, herein designated VGAM RNA, also designated SEQ ID:4670.

Another function of VGAM1959 is therefore inhibition of PP3501 (Accession NM_021731). Accordingly, utilities of VGAM1959 include diagnosis, prevention and treatment of diseases and clinical conditions associated with PP3501. PTPRF Interacting Protein, Binding Protein 1 (liprin beta 1) (PPFIBP1, Accession NM_003622) is another VGAM1959 host target gene. PPFIBP1 BINDING SITE is HOST TARGET binding site found in the 3' untranslated region of mRNA encoded by PPFIBP1, corresponding to a HOST TARGET binding site such as BINDING SITE I, BINDING SITE II or BINDING SITE III. Table 2 illustrates the complementarity of the nucleotide sequences of PPFIBP1 BINDING SITE, designated SEQ ID:9686, to the nucleotide sequence of VGAM1959 RNA, herein designated VGAM RNA, also designated SEQ ID:4670.

Another function of VGAM1959 is therefore inhibition of PTPRF Interacting Protein, Binding Protein 1 (liprin beta 1) (PPFIBP1, Accession NM_003622). Accordingly, utilities of VGAM1959 include diagnosis, prevention and treatment of diseases and clinical conditions associated with PPFIBP1. Protein Phosphatase 4, Regulatory Subunit 1-like (PPP4R1L, Accession XM_086650) is another VGAM1959 host target gene. PPP4R1L BINDING SITE is HOST TARGET binding site found in the 5' untranslated region of mRNA encoded by PPP4R1L, corresponding to a HOST TARGET binding site such as BINDING SITE I, BINDING SITE II or BINDING SITE III. Table 2 illustrates the complementarity of the nucleotide sequences of PPP4R1L BINDING SITE, designated SEQ ID:38817, to the nucleotide sequence of VGAM1959 RNA, herein designated VGAM RNA, also designated SEQ ID:4670.

Another function of VGAM1959 is therefore inhibition of Protein Phosphatase 4, Regulatory Subunit 1-like (PPP4R1L, Accession XM_086650). Accordingly, utilities of VGAM1959 include diagnosis, prevention and treatment of diseases and clinical conditions associated with PPP4R1L. Protein Regulator of Cytokinesis 1 (PRC1, Accession NM_003981) is another VGAM1959 host target gene. PRC1 BINDING SITE is HOST TARGET binding site found in the 3' untranslated region of mRNA encoded by PRC1, corresponding to a HOST TARGET binding site such as BINDING SITE I, BINDING SITE II or BINDING SITE III. Table 2 illustrates the complementarity of the nucleotide sequences of PRC1 BINDING SITE, designated SEQ ID:10120, to the nucleotide sequence of VGAM1959 RNA, herein designated VGAM RNA, also designated SEQ ID:4670.

Another function of VGAM1959 is therefore inhibition of Protein Regulator of Cytokinesis 1 (PRC1, Accession NM_003981). Accordingly, utilities of VGAM1959 include diagnosis, prevention and treatment of diseases and clinical conditions associated with PRC1. PRO2405 (Accession NM_018627) is another VGAM1959 host target gene. PRO2405 BINDING SITE1 and PRO2405 BINDING SITE2 are HOST TARGET binding sites found in untranslated regions of mRNA encoded by PRO2405, corresponding to HOST TARGET binding sites such as BINDING SITE I, BINDING SITE II or BINDING SITE III. Table 2 illustrates the complementarity of the nucleotide sequences of PRO2405 BINDING SITE1 and PRO2405 BINDING SITE2, designated SEQ ID:20698 and SEQ ID:20699 respectively, to the nucleotide sequence of VGAM1959 RNA, herein designated VGAM RNA, also designated SEQ ID:4670.

Another function of VGAM1959 is therefore inhibition of PRO2405 (Accession NM_018627). Accordingly, utilities of VGAM1959 include diagnosis, prevention and treatment of diseases and clinical conditions associated with PRO2405. PRRDH (Accession NM_015725) is another VGAM1959 host target gene. PRRDH BINDING SITE1 and PRRDH BINDING SITE2 are HOST TARGET binding sites found in untranslated regions of mRNA encoded by PRRDH, corresponding to HOST TARGET binding sites such as BINDING SITE I, BINDING SITE II or BINDING SITE III. Table 2 illustrates the complementarity of the nucleotide sequences of PRRDH BINDING SITE1 and PRRDH BINDING SITE2, designated SEQ ID:17935 and SEQ ID:17936 respectively, to the nucleotide sequence of VGAM1959 RNA, herein designated VGAM RNA, also designated SEQ ID:4670.

Another function of VGAM1959 is therefore inhibition of PRRDH (Accession NM_015725). Accordingly, utilities of VGAM1959 include diagnosis, prevention and treatment of diseases and clinical conditions associated with PRRDH. Protein Tyrosine Phosphatase, Receptor Type, R (PTPRR, Accession NM_002849) is another VGAM1959 host target gene. PTPRR BINDING SITE1 and PTPRR BINDING SITE2 are HOST TARGET binding sites found in untranslated regions of mRNA encoded by PTPRR, corresponding to HOST TARGET binding sites such as BINDING SITE I, BINDING SITE II or BINDING SITE III. Table 2 illustrates the complementarity of the nucleotide sequences of PTPRR BINDING SITE1 and PTPRR BINDING SITE2, designated SEQ ID:8743 and SEQ ID:8697 respectively, to the nucleotide sequence of VGAM1959 RNA, herein designated VGAM RNA, also designated SEQ ID:4670.

Another function of VGAM1959 is therefore inhibition of Protein Tyrosine Phosphatase, Receptor Type, R (PTPRR, Accession NM_002849). Accordingly, utilities of VGAM1959 include diagnosis, prevention and treatment of diseases and clinical conditions associated with PTPRR. RAB3D, Member RAS Oncogene Family (RAB3D, Accession NM_004283) is another VGAM1959 host target gene. RAB3D BINDING SITE is HOST TARGET binding site found in the 3" untranslated region of mRNA encoded by RAB3D, corresponding to a HOST TARGET binding site such as BINDING SITE I, BINDING SITE II or BINDING SITE III. Table 2 illustrates the complementarity of the nucleotide sequences of RAB3D BINDING SITE, designated SEQ ID:10495, to the nucleotide sequence of VGAM1959 RNA, herein designated VGAM RNA, also designated SEQ ID:4670.

Another function of VGAM1959 is therefore inhibition of RAB3D, Member RAS Oncogene Family (RAB3D, Accession NM_004283). Accordingly, utilities of VGAM1959 include diagnosis, prevention and treatment of diseases and clinical conditions associated with RAB3D. RAI (Accession NM_006663) is another VGAM1959 host target gene. RAI BINDING SITE is HOST TARGET binding site found in the 3' untranslated region of mRNA encoded by RAI, corresponding to a HOST TARGET binding site such as BINDING SITE I, BINDING SITE II or BINDING SITE III. Table 2 illustrates the complementarity of the nucleotide sequences of RAI BINDING SITE, designated SEQ ID:13469, to the nucleotide sequence of VGAM1959 RNA, herein designated VGAM RNA, also designated SEQ ID:4670.

Another function of VGAM1959 is therefore inhibition of RAI (Accession NM_006663). Accordingly, utilities of VGAM1959 include diagnosis, prevention and treatment of diseases and clinical conditions associated with RAI. Retinoic Acid Induced 17 (RAI17, Accession XM_166091) is another VGAM1959 host target gene. RAI17 BINDING SITE is HOST TARGET binding site found in the 3' untranslated region of mRNA encoded by RAI17, corresponding to a HOST TARGET binding site such as BINDING SITE I, BINDING SITE II or BINDING SITE III. Table 2 illustrates the complementarity of the nucleotide sequences of RAI17 BINDING SITE, designated SEQ ID:43864, to the nucleotide sequence of VGAM1959 RNA, herein designated VGAM RNA, also designated SEQ ID:4670.

Another function of VGAM1959 is therefore inhibition of Retinoic Acid Induced 17 (RAI17, Accession XM_166091).

Accordingly, utilities of VGAM1959 include diagnosis, prevention and treatment of diseases and clinical conditions associated with RAI17. RAS Guanyl Releasing Protein 4 (RASGRP4, Accession NM_052949) is another VGAM1959 host target gene. RASGRP4 BINDING SITE is HOST TARGET binding site found in the 3' untranslated region of mRNA encoded by RASGRP4, corresponding to a HOST TARGET binding site such as BINDING SITE I, BINDING SITE II or BINDING SITE III. Table 2 illustrates the complementarity of the nucleotide sequences of RASGRP4 BINDING SITE, designated SEQ ID:27506, to the nucleotide sequence of VGAM1959 RNA, herein designated VGAM RNA, also designated SEQ ID:4670.

Another function of VGAM1959 is therefore inhibition of RAS Guanyl Releasing Protein 4 (RASGRP4, Accession NM_052949). Accordingly, utilities of VGAM1959 include diagnosis, prevention and treatment of diseases and clinical conditions associated with RASGRP4. Regulator of G-protein Signalling 12 (RGS12, Accession NM_002926) is another VGAM1959 host target gene. RGS12 BINDING SITE is HOST TARGET binding site found in the 3' untranslated region of mRNA encoded by RGS12, corresponding to a HOST TARGET binding site such as BINDING SITE I, BINDING SITE II or BINDING SITE III. Table 2 illustrates the complementarity of the nucleotide sequences of RGS12 BINDING SITE, designated SEQ ID:8830, to the nucleotide sequence of VGAM1959 RNA, herein designated VGAM RNA, also designated SEQ ID:4670.

Another function of VGAM1959 is therefore inhibition of Regulator of G-protein Signalling 12 (RGS12, Accession NM_002926). Accordingly, utilities of VGAM1959 include diagnosis, prevention and treatment of diseases and clinical conditions associated with RGS12. RLUCL (Accession NM_058192) is another VGAM1959 host target gene. RLUCL BINDING SITE is HOST TARGET binding site found in the 5' untranslated region of mRNA encoded by RLUCL, corresponding to a HOST TARGET binding site such as BINDING SITE I, BINDING SITE II or BINDING SITE III. Table 2 illustrates the complementarity of the nucleotide sequences of RLUCL BINDING SITE, designated SEQ ID:27754, to the nucleotide sequence of VGAM1959 RNA, herein designated VGAM RNA, also designated SEQ ID:4670.

Another function of VGAM1959 is therefore inhibition of RLUCL (Accession NM_058192). Accordingly, utilities of VGAM1959 include diagnosis, prevention and treatment of diseases and clinical conditions associated with RLUCL. RPP14 (Accession XM_003044) is another VGAM1959 host target gene. RPP14 BINDING SITE is HOST TARGET binding site found in the 3' untranslated region of mRNA encoded by RPP14, corresponding to a HOST TARGET binding site such as BINDING SITE I, BINDING SITE II or BINDING SITE III. Table 2 illustrates the complementarity of the nucleotide sequences of RPP14 BINDING SITE, designated SEQ ID:29926, to the nucleotide sequence of VGAM1959 RNA, herein designated VGAM RNA, also designated SEQ ID:4670.

Another function of VGAM1959 is therefore inhibition of RPP14 (Accession XM_003044). Accordingly, utilities of VGAM1959 include diagnosis, prevention and treatment of diseases and clinical conditions associated with RPP14. SAM Domain and HD Domain 1 (SAMHD1, Accession XM_028704) is another VGAM1959 host target gene. SAMHD1 BINDING SITE is HOST TARGET binding site found in the 3' untranslated region of mRNA encoded by SAMHD1, corresponding to a HOST TARGET binding site such as BINDING SITE I, BINDING SITE II or BINDING SITE III. Table 2 illustrates the complementarity of the nucleotide sequences of SAMHD1 BINDING SITE, designated SEQ ID:30737, to the nucleotide sequence of VGAM1959 RNA, herein designated VGAM RNA, also designated SEQ ID:4670.

Another function of VGAM1959 is therefore inhibition of SAM Domain and HD Domain 1 (SAMHD1, Accession XM_028704). Accordingly, utilities of VGAM1959 include diagnosis, prevention and treatment of diseases and clinical conditions associated with SAMHD1. Sema Domain, Immunoglobulin Domain (Ig), Transmembrane Domain (TM) and Short Cytoplasmic Domain, (semaphorin) 4F (SEMA4F, Accession NM_004263) is another VGAM1959 host target gene. SEMA4F BINDING SITE1 and SEMA4F BINDING SITE2 are HOST TARGET binding sites found in untranslated regions of mRNA encoded by SEMA4F, corresponding to HOST TARGET binding sites such as BINDING SITE I, BINDING SITE II or BINDING SITE III. Table 2 illustrates the complementarity of the nucleotide sequences of SEMA4F BINDING SITE1 and SEMA4F BINDING SITE2, designated SEQ ID:10456 and SEQ ID:10458 respectively, to the nucleotide sequence of VGAM1959 RNA, herein designated VGAM RNA, also designated SEQ ID:4670.

Another function of VGAM1959 is therefore inhibition of Sema Domain, Immunoglobulin Domain (Ig), Transmembrane Domain (TM) and Short Cytoplasmic Domain, (semaphorin) 4F (SEMA4F, Accession NM_004263). Accordingly, utilities of VGAM1959 include diagnosis, prevention and treatment of diseases and clinical conditions associated with SEMA4F. Solute Carrier Family 39 (zinc transporter), Member 3 (SLC39A3, Accession NM_144564) is another VGAM1959 host target gene. SLC39A3 BINDING SITE is HOST TARGET binding site found in the 3' untranslated region of mRNA encoded by SLC39A3, corresponding to a HOST TARGET binding site such as BINDING SITE I, BINDING SITE II or BINDING SITE III. Table 2 illustrates the complementarity of the nucleotide sequences of SLC39A3 BINDING SITE, designated SEQ ID:29357, to the nucleotide sequence of VGAM1959 RNA, herein designated VGAM RNA, also designated SEQ ID:4670.

Another function of VGAM1959 is therefore inhibition of Solute Carrier Family 39 (zinc transporter), Member 3 (SLC39A3, Accession NM_144564). Accordingly, utilities of VGAM1959 include diagnosis, prevention and treatment of diseases and clinical conditions associated with SLC39A3. SMC1 Structural Maintenance of Chromosomes 1-like 1 (yeast) (SMC1L1, Accession XM_050403) is another VGAM1959 host target gene. SMC1L1 BINDING SITE is HOST TARGET binding site found in the 3' untranslated region of mRNA encoded by SMC1L1, corresponding to a HOST TARGET binding site such as BINDING SITE I, BINDING SITE II or BINDING SITE III. Table 2 illustrates the complementarity of the nucleotide sequences of SMC1L1 BINDING SITE, designated SEQ ID:35618, to the nucleotide sequence of VGAM1959 RNA, herein designated VGAM RNA, also designated SEQ ID:4670.

Another function of VGAM1959 is therefore inhibition of SMC1 Structural Maintenance of Chromosomes 1-like 1 (yeast) (SMC1L1, Accession XM_050403). Accordingly, utilities of VGAM1959 include diagnosis, prevention and treatment of diseases and clinical conditions associated with SMC1L1. Syntrophin, Gamma 1 (SNTG1, Accession NM_018967) is another VGAM1959 host target gene. SNTG1 BINDING SITE is HOST TARGET binding site found in the 3' untranslated region of mRNA encoded by SNTG1, corresponding to a HOST TARGET binding site such as BINDING SITE I, BINDING SITE II or BINDING SITE III. Table 2 illustrates the complementarity of the nucleotide sequences of SNTG1 BINDING SITE, designated SEQ ID:21041, to the nucleotide sequence of VGAM1959 RNA, herein designated VGAM RNA, also designated SEQ ID:4670.

Another function of VGAM1959 is therefore inhibition of Syntrophin, Gamma 1 (SNTG1, Accession NM_018967). Accordingly, utilities of VGAM1959 include diagnosis, prevention and treatment of diseases and clinical conditions associated with SNTG1. SR-BP1 (Accession NM_005866) is another VGAM1959 host target gene. SR-BP1 BINDING SITE is HOST TARGET binding site found in the 3' untranslated region of mRNA encoded by SR-BP1, corresponding to a HOST TARGET binding site such as BINDING SITE I, BINDING SITE II or BINDING SITE III. Table 2 illustrates the complementarity of the nucleotide sequences of SR-BP1 BINDING SITE, designated SEQ ID:12485, to the nucleotide sequence of VGAM1959 RNA, herein designated VGAM RNA, also designated SEQ ID:4670.

Another function of VGAM1959 is therefore inhibition of SR-BP1 (Accession NM_005866). Accordingly, utilities of VGAM1959 include diagnosis, prevention and treatment of diseases and clinical conditions associated with SR-BP1. SSB-3 (Accession NM_080861) is another VGAM1959 host target gene. SSB-3 BINDING SITE is HOST TARGET binding site found in the 3' untranslated region of mRNA encoded by SSB-3, corresponding to a HOST TARGET binding site such as BINDING SITE I, BINDING SITE II or BINDING SITE III. Table 2 illustrates the complementarity of the nucleotide sequences of SSB-3 BINDING SITE, designated SEQ ID:28102, to the nucleotide sequence of VGAM1959 RNA, herein designated VGAM RNA, also designated SEQ ID:4670.

Another function of VGAM1959 is therefore inhibition of SSB-3 (Accession NM_080861). Accordingly, utilities of VGAM1959 include diagnosis, prevention and treatment of diseases and clinical conditions associated with SSB-3. SSH2 (Accession XM_030846) is another VGAM1959 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31190, to the nucleotide sequence of VGAM1959 RNA, herein designated VGAM RNA, also designated SEQ ID:4670.

Another function of VGAM1959 is therefore inhibition of SSH2 (Accession XM_030846). Accordingly, utilities of VGAM1959 include diagnosis, prevention and treatment of diseases and clinical conditions associated with SSH2. Syntaxin 3A (STX3A, Accession NM_004177) is another VGAM1959 host target gene. STX3A BINDING SITE is HOST TARGET binding site found in the 3' untranslated region of mRNA encoded by STX3A, corresponding to a HOST TARGET binding site such as BINDING SITE I, BINDING SITE II or BINDING SITE III. Table 2 illustrates the complementarity of the nucleotide sequences of STX3A BINDING SITE, designated SEQ ID:10387, to the nucleotide sequence of VGAM1959 RNA, herein designated VGAM RNA, also designated SEQ ID:4670.

Another function of VGAM1959 is therefore inhibition of Syntaxin 3A (STX3A, Accession NM_004177). Accordingly, utilities of VGAM1959 include diagnosis, prevention and treatment of diseases and clinical conditions associated with STX3A. Sulfotransferase Family, Cytosolic, 1C, Member 2 (SULT1C2, Accession NM_006588) is another VGAM1959 host target gene. SULT1C2 BINDING SITE is HOST TARGET binding site found in the 5' untranslated region of mRNA encoded by SULT1C2, corresponding to a HOST TARGET binding site such as BINDING SITE I, BINDING SITE II or BINDING SITE III. Table 2 illustrates the complementarity of the nucleotide sequences of SULT1C2 BINDING SITE, designated SEQ ID:13353, to the nucleotide sequence of VGAM1959 RNA, herein designated VGAM RNA, also designated SEQ ID:4670.

Another function of VGAM1959 is therefore inhibition of Sulfotransferase Family, Cytosolic, 1C, Member 2 (SULT1C2, Accession NM_006588). Accordingly, utilities of VGAM1959 include diagnosis, prevention and treatment of diseases and clinical conditions associated with SULT1C2. T-box 4 (TBX4, Accession NM_018488) is another VGAM1959 host target gene. TBX4 BINDING SITE is HOST TARGET binding site found in the 3' untranslated region of mRNA encoded by TBX4, corresponding to a HOST TARGET binding site such as BINDING SITE I, BINDING SITE II or BINDING SITE III. Table 2 illustrates the complementarity of the nucleotide sequences of TBX4 BINDING SITE, designated SEQ ID:20546, to the nucleotide sequence of VGAM1959 RNA, herein designated VGAM RNA, also designated SEQ ID:4670.

Another function of VGAM1959 is therefore inhibition of T-box 4 (TBX4, Accession NM_018488). Accordingly, utilities of VGAM1959 include diagnosis, prevention and treatment of diseases and clinical conditions associated with TBX4. Testis Expressed Sequence 27 (TEX27, Accession NM_021943) is another VGAM1959 host target gene. TEX27 BINDING SITE is HOST TARGET binding site found in the 3' untranslated region of mRNA encoded by TEX27, corresponding to a HOST TARGET binding site such as BINDING SITE I, BINDING SITE II or BINDING SITE III. Table 2 illustrates the complementarity of the nucleotide sequences of TEX27 BINDING SITE, designated SEQ ID:22459, to the nucleotide sequence of VGAM1959 RNA, herein designated VGAM RNA, also designated SEQ ID:4670.

Another function of VGAM1959 is therefore inhibition of Testis Expressed Sequence 27 (TEX27, Accession NM_021943). Accordingly, utilities of VGAM1959 include diagnosis, prevention and treatment of diseases and clinical conditions associated with TEX27. Tigger Transposable Element Derived 1 (TIGD1, Accession XM_114293) is another VGAM1959 host target gene. TIGD1 BINDING SITE is HOST TARGET binding site found in the 5' untranslated region of mRNA encoded by TIGD1, corresponding to a HOST TARGET binding site such as BINDING SITE I, BINDING SITE II or BINDING SITE III. Table 2 illustrates the complementarity of the nucleotide sequences of TIGD1 BINDING SITE, designated SEQ ID:42848, to the nucleotide sequence of VGAM1959 RNA, herein designated VGAM RNA, also designated SEQ ID:4670.

Another function of VGAM1959 is therefore inhibition of Tigger Transposable Element Derived 1 (TIGD1, Accession XM_114293). Accordingly, utilities of VGAM1959 include diagnosis, prevention and treatment of diseases and clinical conditions associated with TIGD1. Tumor Necrosis Factor, Alpha-induced Protein 3 (TNFAIP3, Accession NM_006290) is another VGAM1959 host target gene. TNFAIP3 BINDING SITE is HOST TARGET binding site found in the 3' untranslated region of mRNA encoded by TNFAIP3, corresponding to a HOST TARGET binding site such as BINDING SITE I, BINDING SITE II or BINDING SITE III. Table 2 illustrates the complementarity of the nucleotide sequences of TNFAIP3 BINDING SITE, designated SEQ ID:12979, to the nucleotide sequence of VGAM1959 RNA, herein designated VGAM RNA, also designated SEQ ID:4670.

Another function of VGAM1959 is therefore inhibition of Tumor Necrosis Factor, Alpha-induced Protein 3 (TNFAIP3, Accession NM_006290). Accordingly, utilities of VGAM1959 include diagnosis, prevention and treatment of diseases and clinical conditions associated with TNFAIP3. Three Prime Repair Exonuclease 1 (TREX1, Accession NM_016381) is another VGAM1959 host target gene. TREX1 BINDING SITE1 through TREX1 BINDING SITE3 are HOST TARGET binding sites found in untranslated regions of mRNA encoded by TREX1, corresponding to HOST TARGET binding sites such as BINDING SITE I, BINDING SITE II or BINDING SITE III. Table 2 illustrates the complementarity of the nucleotide sequences of TREX1 BINDING SITE1 through TREX1 BINDING SITE3, designated SEQ ID:18521, SEQ ID:27341 and SEQ ID:27348 respectively, to the nucleotide sequence of VGAM1959 RNA, herein designated VGAM RNA, also designated SEQ ID:4670.

Another function of VGAM1959 is therefore inhibition of Three Prime Repair Exonuclease 1 (TREX1, Accession NM_016381). Accordingly, utilities of VGAM1959 include diagnosis, prevention and treatment of diseases and clinical conditions associated with TREX1. UBCE7IP5 (Accession NM_014948) is another VGAM1959 host target gene. UBCE7IP5 BINDING SITE is HOST TARGET binding site found in the 3' untranslated region of mRNA encoded by UBCE7IP5, corresponding to a HOST TARGET binding site such as BINDING SITE I, BINDING SITE II or BINDING SITE III. Table 2 illustrates the complementarity of the nucleotide sequences of UBCE7IP5 BINDING SITE, designated SEQ ID:17271, to the nucleotide sequence of VGAM1959 RNA, herein designated VGAM RNA, also designated SEQ ID:4670.

Another function of VGAM1959 is therefore inhibition of UBCE7IP5 (Accession NM_014948). Accordingly, utilities of VGAM1959 include diagnosis, prevention and treatment of diseases and clinical conditions associated with UBCE7IP5. UDP-glucuronate Decarboxylase 1 (UXS1, Accession NM_025076) is another VGAM1959 host target gene. UXS1 BINDING SITE is HOST TARGET binding site found in the 5' untranslated region of mRNA encoded by UXS1, corresponding to a HOST TARGET binding site such as BINDING SITE I, BINDING SITE II or BINDING SITE III. Table 2 illustrates the complementarity of the nucleotide sequences of UXS1 BINDING SITE, designated SEQ ID:24677, to the nucleotide sequence of VGAM1959 RNA, herein designated VGAM RNA, also designated SEQ ID:4670.

Another function of VGAM1959 is therefore inhibition of UDP-glucuronate Decarboxylase 1 (UXS1, Accession NM_025076). Accordingly, utilities of VGAM1959 include diagnosis, prevention and treatment of diseases and clinical conditions associated with UXS1. VI (Accession NM_013443) is another VGAM1959 host target gene. VI BINDING SITE is HOST TARGET binding site found in the 3' untranslated region of mRNA encoded by VI, corresponding to a HOST TARGET binding site such as BINDING SITE I, BINDING SITE II or BINDING SITE III. Table 2 illustrates the complementarity of the nucleotide sequences of VI BINDING SITE, designated SEQ ID:15110, to the nucleotide sequence of VGAM1959 RNA, herein designated VGAM RNA, also designated SEQ ID:4670.

Another function of VGAM1959 is therefore inhibition of VI (Accession NM_013443). Accordingly, utilities of VGAM1959 include diagnosis, prevention and treatment of diseases and clinical conditions associated with VI. VLCS-H1 (Accession NM_014031) is another VGAM1959 host target gene. VLCS-H1 BINDING SITE is HOST TARGET binding site found in the 5" untranslated region of mRNA encoded by VLCS-H1, corresponding to a HOST TARGET binding site such as BINDING SITE I, BINDING SITE II or BINDING SITE III. Table 2 illustrates the complementarity of the nucleotide sequences of VLCS-H1 BINDING SITE, designated SEQ ID:15260, to the nucleotide sequence of VGAM1959 RNA, herein designated VGAM RNA, also designated SEQ ID:4670.

Another function of VGAM1959 is therefore inhibition of VLCS-H1 (Accession NM_014031). Accordingly, utilities of VGAM1959 include diagnosis, prevention and treatment of diseases and clinical conditions associated with VLCS-H1. WD Repeat Domain 7 (WDR7, Accession NM_015285) is another VGAM1959 host target gene. WDR7 BINDING SITE is HOST TARGET binding site found in the 3' untranslated region of mRNA encoded by WDR7, corresponding to a HOST TARGET binding site such as BINDING SITE I, BINDING SITE II or BINDING SITE III. Table 2 illustrates the complementarity of the nucleotide sequences of WDR7 BINDING SITE, designated SEQ ID:17610, to the nucleotide sequence of VGAM1959 RNA, herein designated VGAM RNA, also designated SEQ ID:4670.

Another function of VGAM1959 is therefore inhibition of WD Repeat Domain 7 (WDR7, Accession NM_015285). Accordingly, utilities of VGAM1959 include diagnosis, prevention and treatment of diseases and clinical conditions associated with WDR7. Zinc Finger, DHHC Domain Containing 8 (ZDHHC8, Accession XM_033828) is another VGAM1959 host target gene. ZDHHC8 BINDING SITE is HOST TARGET binding site found in the 3' untranslated region of mRNA encoded by ZDHHC8, corresponding to a HOST TARGET binding site such as BINDING SITE I, BINDING SITE II or BINDING SITE III. Table 2 illustrates the complementarity of the nucleotide sequences of ZDHHC8 BINDING SITE, designated SEQ ID:31962, to the nucleotide sequence of VGAM1959 RNA, herein designated VGAM RNA, also designated SEQ ID:4670.

Another function of VGAM1959 is therefore inhibition of Zinc Finger, DHHC Domain Containing 8 (ZDHHC8, Accession XM_033828). Accordingly, utilities of VGAM1959 include diagnosis, prevention and treatment of diseases and clinical conditions associated with ZDHHC8. Zinc Finger Protein 95 Homolog (mouse) (ZFP95, Accession NM_014569) is another VGAM1959 host target gene. ZFP95 BINDING SITE is HOST TARGET binding site found in the 5' untranslated region of mRNA encoded by ZFP95, corresponding to a HOST TARGET binding site such as BINDING SITE I, BINDING SITE II or BINDING SITE III. Table 2 illustrates the complementarity of the nucleotide sequences of ZFP95 BINDING SITE, designated SEQ ID:15923, to the nucleotide sequence of VGAM1959 RNA, herein designated VGAM RNA, also designated SEQ ID:4670.

Another function of VGAM1959 is therefore inhibition of Zinc Finger Protein 95 Homolog (mouse) (ZFP95, Accession NM_014569). Accordingly, utilities of VGAM1959 include diagnosis, prevention and treatment of diseases and clinical conditions associated with ZFP95. ZID (Accession NM_006626) is another VGAM1959 host target gene. ZID BINDING SITE is HOST TARGET binding site found in the 3' untranslated region of mRNA encoded by ZID, corresponding to a HOST TARGET binding site such as BINDING SITE I, BINDING SITE II or BINDING SITE III. Table 2 illustrates the complementarity of the nucleotide sequences of ZID BINDING SITE, designated SEQ ID:13416, to the nucleotide sequence of VGAM1959 RNA, herein designated VGAM RNA, also designated SEQ ID:4670.

Another function of VGAM1959 is therefore inhibition of ZID (Accession NM_006626). Accordingly, utilities of VGAM1959 include diagnosis, prevention and treatment of diseases and clinical conditions associated with ZID. Zinc Finger Protein 17 (HPF3, KOX 10) (ZNF17, Accession XM_091895) is another VGAM1959 host target gene. ZNF17 BINDING SITE is HOST TARGET binding site found in the 3' untranslated region of mRNA encoded by ZNF17, corresponding to a HOST TARGET binding site such as BINDING SITE I, BINDING SITE II or BINDING SITE III. Table 2 illustrates the complementarity of the nucleotide sequences of ZNF17 BINDING SITE, designated SEQ ID:40070, to the nucleotide sequence of VGAM1959 RNA, herein designated VGAM RNA, also designated SEQ ID:4670.

Another function of VGAM1959 is therefore inhibition of Zinc Finger Protein 17 (HPF3, KOX 10) (ZNF17, Accession XM_091895). Accordingly, utilities of VGAM1959 include diagnosis, prevention and treatment of diseases and clinical conditions associated with ZNF17. Zinc Finger Protein 317 (ZNF317, Accession XM_050435) is another VGAM1959 host target gene. ZNF317 BINDING SITE is HOST TARGET binding site found in the 3' untranslated region of mRNA encoded by ZNF317, corresponding to a HOST TARGET binding site such as BINDING SITE I, BINDING SITE II or BINDING SITE III. Table 2 illustrates the complementarity of the nucleotide sequences of ZNF317 BINDING SITE, designated SEQ ID:35635, to the nucleotide sequence of VGAM1959 RNA, herein designated VGAM RNA, also designated SEQ ID:4670.

Another function of VGAM1959 is therefore inhibition of Zinc Finger Protein 317 (ZNF317, Accession XM_050435). Accordingly, utilities of VGAM1959 include diagnosis, prevention and treatment of diseases and clinical conditions associated with ZNF317. LOC115051 (Accession XM_010647) is another VGAM1959 host target gene. LOC115051 BINDING SITE is HOST TARGET binding site found in the 3' untranslated region of mRNA encoded by LOC115051, corresponding to a HOST TARGET binding site such as BINDING SITE I, BINDING SITE II or BINDING SITE III. Table 2 illustrates the complementarity of the nucleotide sequences of LOC115051 BINDING SITE, designated SEQ ID:30161, to the nucleotide sequence of VGAM1959 RNA, herein designated VGAM RNA, also designated SEQ ID:4670.

Another function of VGAM1959 is therefore inhibition of LOC115051 (Accession XM_010647). Accordingly, utilities of VGAM1959 include diagnosis, prevention and treatment of diseases and clinical conditions associated with LOC115051. LOC115110 (Accession XM_049825) is another VGAM1959 host target gene. LOC115110 BINDING SITE is HOST TARGET binding site found in the 5' untranslated region of mRNA encoded by LOC115110, corresponding to a HOST TARGET binding site such as BINDING SITE I, BINDING SITE II or BINDING SITE III. Table 2 illustrates the complementarity of the nucleotide sequences of LOC115110 BINDING SITE, designated SEQ ID:35509, to the nucleotide sequence of VGAM1959 RNA, herein designated VGAM RNA, also designated SEQ ID:4670.

Another function of VGAM1959 is therefore inhibition of LOC115110 (Accession XM_049825). Accordingly, utilities of VGAM1959 include diagnosis, prevention and treatment of diseases and clinical conditions associated with LOC115110. LOC115343 (Accession XM_050640) is another VGAM1959 host target gene. LOC115343 BINDING SITE is HOST TARGET binding site found in the 5' untranslated region of mRNA encoded by LOC115343, corresponding to a HOST TARGET binding site such as BINDING SITE I, BINDING SITE II or BINDING SITE III. Table 2 illustrates the complementarity of the nucleotide sequences of LOC115343 BINDING SITE, designated SEQ ID:35666, to the nucleotide sequence of VGAM1959 RNA, herein designated VGAM RNA, also designated SEQ ID:4670.

Another function of VGAM1959 is therefore inhibition of LOC115343 (Accession XM_050640). Accordingly, utilities of VGAM1959 include diagnosis, prevention and treatment of diseases and clinical conditions associated with LOC115343. LOC115708 (Accession XM_056552) is another VGAM1959 host target gene. LOC115708 BINDING SITE is HOST TARGET binding site found in the 3' untranslated region of mRNA encoded by LOC115708, corresponding to a HOST TARGET binding site such as BINDING SITE I, BINDING SITE II or BINDING SITE III. Table 2 illustrates the complementarity of the nucleotide sequences of LOC115708 BINDING SITE, designated SEQ ID:36405, to the nucleotide sequence of VGAM1959 RNA, herein designated VGAM RNA, also designated SEQ ID:4670.

Another function of VGAM1959 is therefore inhibition of LOC115708 (Accession XM_056552). Accordingly, utilities of VGAM1959 include diagnosis, prevention and treatment of diseases and clinical conditions associated with LOC115708. LOC120772 (Accession XM_058505) is another VGAM1959 host target gene. LOC120772 BINDING SITE is HOST TARGET binding site found in the 5' untranslated region of mRNA encoded by LOC120772, corresponding to a HOST TARGET binding site such as BINDING SITE I, BINDING SITE II or BINDING SITE III. Table 2 illustrates the complementarity of the nucleotide sequences of LOC120772 BINDING SITE, designated SEQ ID:36628, to the nucleotide sequence of VGAM1959 RNA, herein designated VGAM RNA, also designated SEQ ID:4670.

Another function of VGAM1959 is therefore inhibition of LOC120772 (Accession XM_058505). Accordingly, utilities of VGAM1959 include diagnosis, prevention and treatment of diseases and clinical conditions associated with LOC120772. LOC122792 (Accession NM_145251) is another VGAM1959 host target gene. LOC122792 BINDING SITE is HOST TARGET binding site found in the 3' untranslated region of mRNA encoded by LOC122792, corresponding to a HOST TARGET binding site such as BINDING SITE I, BINDING SITE II or BINDING SITE III. Table 2 illustrates the complementarity of the nucleotide sequences of LOC122792 BINDING SITE, designated SEQ ID:29763, to the nucleotide sequence of VGAM1959 RNA, herein designated VGAM RNA, also designated SEQ ID:4670.

Another function of VGAM1959 is therefore inhibition of LOC122792 (Accession NM_145251). Accordingly, utilities of VGAM1959 include diagnosis, prevention and treatment of diseases and clinical conditions associated with LOC122792. LOC124145 (Accession XM_058775) is another VGAM1959 host target gene. LOC124145 BINDING SITE is HOST TARGET binding site found in the 3' untranslated region of mRNA encoded by LOC124145, corresponding to a HOST TARGET binding site such as BINDING SITE I, BINDING SITE II or BINDING SITE III. Table 2 illustrates the complementarity of the nucleotide sequences of LOC124145 BINDING SITE, designated SEQ ID:36735, to the nucleotide sequence of VGAM1959 RNA, herein designated VGAM RNA, also designated SEQ ID:4670.

Another function of VGAM1959 is therefore inhibition of LOC124145 (Accession XM_058775). Accordingly, utilities of VGAM1959 include diagnosis, prevention and treatment of diseases and clinical conditions associated with LOC124145. LOC124245 (Accession NM_144604) is another VGAM1959 host target gene. LOC124245 BINDING SITE is HOST TARGET binding site found in the 3' untranslated region of mRNA encoded by LOC124245, corresponding to a HOST TARGET binding site such as BINDING SITE I, BINDING SITE II or BINDING SITE III. Table 2 illustrates the complementarity of the nucleotide sequences of LOC124245 BINDING SITE, designated SEQ ID:29418, to the nucleotide sequence of VGAM1959 RNA, herein designated VGAM RNA, also designated SEQ ID:4670.

Another function of VGAM1959 is therefore inhibition of LOC124245 (Accession NM_144604). Accordingly, utilities of VGAM1959 include diagnosis, prevention and treatment of diseases and clinical conditions associated with LOC124245. LOC124538 (Accession XM_064177) is another VGAM1959 host target gene. LOC124538 BINDING SITE is HOST TARGET binding site found in the 3' untranslated region of mRNA encoded by LOC124538, corresponding to a HOST TARGET binding site such as BINDING SITE I, BINDING SITE II or BINDING SITE III. Table 2 illustrates the complementarity of the nucleotide sequences of LOC124538 BINDING SITE, designated SEQ ID:37257, to the nucleotide sequence of VGAM1959 RNA, herein designated VGAM RNA, also designated SEQ ID:4670.

Another function of VGAM1959 is therefore inhibition of LOC124538 (Accession XM_064177). Accordingly, utilities of VGAM1959 include diagnosis, prevention and treatment of diseases and clinical conditions associated with LOC124538. LOC124842 (Accession XM_064333) is another VGAM1959 host target gene. LOC124842 BINDING SITE is HOST TARGET binding site found in the 3' untranslated region of mRNA encoded by LOC124842, corresponding to a HOST TARGET binding site such as BINDING SITE I, BINDING SITE II or BINDING SITE III. Table 2 illustrates the complementarity of the nucleotide sequences of LOC124842 BINDING SITE, designated SEQ ID:37259, to the nucleotide sequence of VGAM1959 RNA, herein designated VGAM RNA, also designated SEQ ID:4670.

Another function of VGAM1959 is therefore inhibition of LOC124842 (Accession XM_064333). Accordingly, utilities of VGAM1959 include diagnosis, prevention and treatment of diseases and clinical conditions associated with LOC124842. LOC126917 (Accession XM_059091) is another VGAM1959 host target gene. LOC126917 BINDING SITE1 and LOC126917 BINDING SITE2 are HOST TARGET binding sites found in untranslated regions of mRNA encoded by LOC126917, corresponding to HOST TARGET binding sites such as BINDING SITE I, BINDING SITE II or BINDING SITE III. Table 2 illustrates the complementarity of the nucleotide sequences of LOC126917 BINDING SITE1 and LOC126917 BINDING SITE2, designated SEQ ID:36874 and SEQ ID:36875 respectively, to the nucleotide sequence of VGAM1959 RNA, herein designated VGAM RNA, also designated SEQ ID:4670.

Another function of VGAM1959 is therefore inhibition of LOC126917 (Accession XM_059091). Accordingly, utilities of VGAM1959 include diagnosis, prevention and treatment of diseases and clinical conditions associated with LOC126917. LOC132671 (Accession NM_145263) is another VGAM1959 host target gene. LOC132671 BINDING SITE is HOST TARGET binding site found in the 3' untranslated region of mRNA encoded by LOC132671, corresponding to a HOST TARGET binding site such as BINDING SITE I, BINDING SITE II or BINDING SITE III. Table 2 illustrates the complementarity of the nucleotide sequences of LOC132671 BINDING SITE, designated SEQ ID:29776, to the nucleotide sequence of VGAM1959 RNA, herein designated VGAM RNA, also designated SEQ ID:4670.

Another function of VGAM1959 is therefore inhibition of LOC132671 (Accession NM_145263). Accordingly, utilities of VGAM1959 include diagnosis, prevention and treatment of diseases and clinical conditions associated with LOC132671. LOC133308 (Accession XM_059638) is another VGAM1959 host target gene. LOC133308 BINDING SITE is HOST TARGET binding site found in the 5' untranslated region of mRNA encoded by LOC133308, corresponding to a HOST TARGET binding site such as BINDING SITE I, BINDING SITE II or BINDING SITE III. Table 2 illustrates the complementarity of the nucleotide sequences of LOC133308 BINDING SITE, designated SEQ ID:37036, to the nucleotide sequence of VGAM1959 RNA, herein designated VGAM RNA, also designated SEQ ID:4670.

Another function of VGAM1959 is therefore inhibition of LOC133308 (Accession XM_059638). Accordingly, utilities of VGAM1959 include diagnosis, prevention and treatment of diseases and clinical conditions associated with LOC133308. LOC133923 (Accession XM_068602) is another VGAM1959 host target gene. LOC133923 BINDING SITE is HOST TARGET binding site found in the 5' untranslated region of mRNA encoded by LOC133923, corresponding to a HOST TARGET binding site such as BINDING SITE I, BINDING SITE II or BINDING SITE III. Table 2 illustrates the complementarity of the nucleotide sequences of LOC133923 BINDING SITE, designated SEQ ID:37382, to the nucleotide sequence of VGAM1959 RNA, herein designated VGAM RNA, also designated SEQ ID:4670.

Another function of VGAM1959 is therefore inhibition of LOC133923 (Accession XM_068602). Accordingly, utilities of VGAM1959 include diagnosis, prevention and treatment of diseases and clinical conditions associated with LOC133923. LOC139296 (Accession XM_066612) is another VGAM1959 host target gene. LOC139296 BINDING SITE is HOST TARGET binding site found in the 5' untranslated region of mRNA encoded by LOC139296, corresponding to a HOST TARGET binding site such as BINDING SITE I, BINDING SITE II or BINDING SITE III. Table 2 illustrates the complementarity of the nucleotide sequences of LOC139296 BINDING SITE, designated SEQ ID:37339, to the nucleotide sequence of VGAM1959 RNA, herein designated VGAM RNA, also designated SEQ ID:4670.

Another function of VGAM1959 is therefore inhibition of LOC139296 (Accession XM_066612). Accordingly, utilities of VGAM1959 include diagnosis, prevention and treatment of diseases and clinical conditions associated with LOC139296. LOC143146 (Accession XM_011844) is another VGAM1959 host target gene. LOC143146 BINDING SITE is HOST TARGET binding site found in the 5' untranslated region of mRNA encoded by LOC143146, corresponding to a HOST TARGET binding site such as BINDING SITE I, BINDING SITE II or BINDING SITE III. Table 2 illustrates the complementarity of the nucleotide sequences of LOC143146 BINDING SITE, designated SEQ ID:30195, to the nucleotide sequence of VGAM1959 RNA, herein designated VGAM RNA, also designated SEQ ID:4670.

Another function of VGAM1959 is therefore inhibition of LOC143146 (Accession XM_011844). Accordingly, utilities of VGAM1959 include diagnosis, prevention and treatment of diseases and clinical conditions associated with LOC143146. LOC143279 (Accession XM_084476) is another VGAM1959 host target gene. LOC143279 BINDING SITE is HOST TARGET binding site found in the 5' untranslated region of mRNA encoded by LOC143279, corresponding to a HOST TARGET binding site such as BINDING SITE I, BINDING SITE II or BINDING SITE III. Table 2 illustrates the complementarity of the nucleotide sequences of LOC143279 BINDING SITE, designated SEQ ID:37600, to the nucleotide sequence of VGAM1959 RNA, herein designated VGAM RNA, also designated SEQ ID:4670.

Another function of VGAM1959 is therefore inhibition of LOC143279 (Accession XM_084476). Accordingly, utilities of VGAM1959 include diagnosis, prevention and treatment of diseases and clinical conditions associated with LOC143279. LOC143425 (Accession XM_113695) is another VGAM1959 host target gene. LOC143425 BINDING SITE is HOST TARGET binding site found in the 5' untranslated region of mRNA encoded by LOC143425, corresponding to a HOST TARGET binding site such as BINDING SITE I, BINDING SITE II or BINDING SITE III. Table 2 illustrates the complementarity of the nucleotide sequences of LOC143425 BINDING SITE, designated SEQ ID:42352, to the nucleotide sequence of VGAM1959 RNA, herein designated VGAM RNA, also designated SEQ ID:4670.

Another function of VGAM1959 is therefore inhibition of LOC143425 (Accession XM_113695). Accordingly, utilities of VGAM1959 include diagnosis, prevention and treatment of diseases and clinical conditions associated with LOC143425. LOC143719 (Accession XM_027090) is another VGAM1959 host target gene. LOC143719 BINDING SITE is HOST TARGET binding site found in the 5' untranslated region of mRNA encoded by LOC143719, corresponding to a HOST TARGET binding site such as BINDING SITE I, BINDING SITE II or BINDING SITE III. Table 2 illustrates the complementarity of the nucleotide sequences of LOC143719 BINDING SITE, designated SEQ ID:30405, to the nucleotide sequence of VGAM1959 RNA, herein designated VGAM RNA, also designated SEQ ID:4670.

Another function of VGAM1959 is therefore inhibition of LOC143719 (Accession XM_027090). Accordingly, utilities of VGAM1959 include diagnosis, prevention and treatment of diseases and clinical conditions associated with LOC143719. LOC144182 (Accession NM_139136) is another VGAM1959 host target gene. LOC144182 BINDING SITE is HOST TARGET binding site found in the 3' untranslated region of mRNA encoded by LOC144182, corresponding to a HOST TARGET binding site such as BINDING SITE I, BINDING SITE II or BINDING SITE III. Table 2 illustrates the complementarity of the nucleotide sequences of LOC144182 BINDING SITE, designated SEQ ID:29167, to the nucleotide sequence of VGAM1959 RNA, herein designated VGAM RNA, also designated SEQ ID:4670.

Another function of VGAM1959 is therefore inhibition of LOC144182 (Accession NM_139136). Accordingly, utilities of VGAM1959 include diagnosis, prevention and treatment of diseases and clinical conditions associated with LOC144182. LOC144266 (Accession XM_084795) is another VGAM1959 host target gene. LOC144266 BINDING SITE is HOST TARGET binding site found in the 5' untranslated region of mRNA encoded by LOC144266, corresponding to a HOST TARGET binding site such as BINDING SITE I, BINDING SITE II or BINDING SITE III. Table 2 illustrates the complementarity of the nucleotide sequences of LOC144266 BINDING SITE, designated SEQ ID:37709, to the nucleotide sequence of VGAM1959 RNA, herein designated VGAM RNA, also designated SEQ ID:4670.

Another function of VGAM1959 is therefore inhibition of LOC144266 (Accession XM_084795). Accordingly, utilities of VGAM1959 include diagnosis, prevention and treatment of diseases and clinical conditions associated with LOC144266. LOC144305 (Accession XM_096572) is another VGAM1959 host target gene. LOC144305 BINDING SITE is HOST TARGET binding site found in the 5' untranslated region of mRNA encoded by LOC144305, corresponding to a HOST TARGET binding site such as BINDING SITE I, BINDING SITE II or BINDING SITE III. Table 2 illustrates the complementarity of the nucleotide sequences of LOC144305 BINDING SITE, designated SEQ ID:40399, to the nucleotide sequence of VGAM1959 RNA, herein designated VGAM RNA, also designated SEQ ID:4670.

Another function of VGAM1959 is therefore inhibition of LOC144305 (Accession XM_096572). Accordingly, utilities of VGAM1959 include diagnosis, prevention and treatment of diseases and clinical conditions associated with LOC144305. LOC144317 (Accession XM_084813) is another VGAM1959 host target gene. LOC144317 BINDING SITE is HOST TARGET binding site found in the 3' untranslated region of mRNA encoded by LOC144317, corresponding to a HOST TARGET binding site such as BINDING SITE I, BINDING SITE II or BINDING SITE III. Table 2 illustrates the complementarity of the nucleotide sequences of LOC144317 BINDING SITE, designated SEQ ID:37717, to the nucleotide sequence of VGAM1959 RNA, herein designated VGAM RNA, also designated SEQ ID:4670.

Another function of VGAM1959 is therefore inhibition of LOC144317 (Accession XM_084813). Accordingly, utilities of VGAM1959 include diagnosis, prevention and treatment of diseases and clinical conditions associated with LOC144317. LOC144501 (Accession XM_096612) is another VGAM1959 host target gene. LOC144501 BINDING SITE is HOST TARGET binding site found in the 3' untranslated region of mRNA encoded by LOC144501, corresponding to a HOST TARGET binding site such as BINDING SITE I, BINDING SITE II or BINDING SITE III. Table 2 illustrates the complementarity of the nucleotide sequences of LOC144501 BINDING SITE, designated SEQ ID:40427, to the nucleotide sequence of VGAM1959 RNA, herein designated VGAM RNA, also designated SEQ ID:4670.

Another function of VGAM1959 is therefore inhibition of LOC144501 (Accession XM_096612). Accordingly, utilities of VGAM1959 include diagnosis, prevention and treatment of diseases and clinical conditions associated with LOC144501. LOC144535 (Accession XM_084892) is another VGAM1959 host target gene. LOC144535 BINDING SITE is HOST TARGET binding site found in the 3' untranslated region of mRNA encoded by LOC144535, corresponding to a HOST TARGET binding site such as BINDING SITE I, BINDING SITE II or BINDING SITE III. Table 2 illustrates the complementarity of the nucleotide sequences of LOC144535 BINDING SITE, designated SEQ ID:37762, to the nucleotide sequence of VGAM1959 RNA, herein designated VGAM RNA, also designated SEQ ID:4670.

Another function of VGAM1959 is therefore inhibition of LOC144535 (Accession XM_084892). Accordingly, utilities of VGAM1959 include diagnosis, prevention and treatment of diseases and clinical conditions associated with LOC144535. LOC144871 (Accession XM_096698) is another VGAM1959 host target gene. LOC144871 BINDING SITE is HOST TARGET binding site found in the 3' untranslated region of mRNA encoded by LOC144871, corresponding to a HOST TARGET binding site such as BINDING SITE I, BINDING SITE II or BINDING SITE III. Table 2 illustrates the complementarity of the nucleotide sequences of LOC144871 BINDING SITE, designated SEQ ID:40468, to the nucleotide sequence of VGAM1959 RNA, herein designated VGAM RNA, also designated SEQ ID:4670.

Another function of VGAM1959 is therefore inhibition of LOC144871 (Accession XM_096698). Accordingly, utilities of VGAM1959 include diagnosis, prevention and treatment of diseases and clinical conditions associated with LOC144871. LOC145317 (Accession XM_096760) is another VGAM1959 host target gene. LOC145317 BINDING SITE is HOST TARGET binding site found in the 5' untranslated region of mRNA encoded by LOC145317, corresponding to a HOST TARGET binding site such as BINDING SITE I, BINDING SITE II or BINDING SITE III. Table 2 illustrates the complementarity of the nucleotide sequences of LOC145317 BINDING SITE, designated SEQ ID:40530, to the nucleotide sequence of VGAM1959 RNA, herein designated VGAM RNA, also designated SEQ ID:4670.

Another function of VGAM1959 is therefore inhibition of LOC145317 (Accession XM_096760). Accordingly, utilities of VGAM1959 include diagnosis, prevention and treatment of diseases and clinical conditions associated with LOC145317. LOC145622 (Accession XM_085186) is another VGAM1959 host target gene. LOC145622 BINDING SITE1 through LOC145622 BINDING SITE3 are HOST TARGET binding sites found in untranslated regions of mRNA encoded by LOC145622, corresponding to HOST TARGET binding sites such as BINDING SITE I, BINDING SITE II or BINDING SITE III. Table 2 illustrates the complementarity of the nucleotide sequences of LOC145622 BINDING SITE1 through LOC145622 BINDING SITE3, designated SEQ ID:37907, SEQ ID:37908 and SEQ ID:37915 respectively, to the nucleotide sequence of VGAM1959 RNA, herein designated VGAM RNA, also designated SEQ ID:4670.

Another function of VGAM1959 is therefore inhibition of LOC145622 (Accession XM_085186). Accordingly, utilities of VGAM1959 include diagnosis, prevention and treatment of diseases and clinical conditions associated with LOC145622. LOC145732 (Accession XM_085218) is another VGAM1959 host target gene. LOC145732 BINDING SITE is HOST TARGET binding site found in the 3' untranslated region of mRNA encoded by LOC145732, corresponding to a HOST TARGET binding site such as BINDING SITE I, BINDING SITE II or BINDING SITE III. Table 2 illustrates the complementarity of the nucleotide sequences of LOC145732 BINDING SITE, designated SEQ ID:37958, to the nucleotide sequence of VGAM1959 RNA, herein designated VGAM RNA, also designated SEQ ID:4670.

Another function of VGAM1959 is therefore inhibition of LOC145732 (Accession XM_085218). Accordingly, utilities of VGAM1959 include diagnosis, prevention and treatment of diseases and clinical conditions associated with LOC145732. LOC145761 (Accession XM_096855) is another VGAM1959 host target gene. LOC145761 BINDING SITE is HOST TARGET binding site found in the 5' untranslated region of mRNA encoded by LOC145761, corresponding to a HOST TARGET binding site such as BINDING SITE I, BINDING SITE II or BINDING SITE III. Table 2 illustrates the complementarity of the nucleotide sequences of LOC145761 BINDING SITE, designated SEQ ID:40583, to the nucleotide sequence of VGAM1959 RNA, herein designated VGAM RNA, also designated SEQ ID:4670.

Another function of VGAM1959 is therefore inhibition of LOC145761 (Accession XM_096855). Accordingly, utilities of VGAM1959 include diagnosis, prevention and treatment of diseases and clinical conditions associated with LOC145761. LOC145815 (Accession XM_096874) is another VGAM1959 host target gene. LOC145815 BINDING SITE is HOST TARGET binding site found in the 5' untranslated region of mRNA encoded by LOC145815, corresponding to a HOST TARGET binding site such as BINDING SITE I, BINDING SITE II or BINDING SITE III. Table 2 illustrates the complementarity of the nucleotide sequences of LOC145815 BINDING SITE, designated SEQ ID:40604, to the nucleotide sequence of VGAM1959 RNA, herein designated VGAM RNA, also designated SEQ ID:4670.

Another function of VGAM1959 is therefore inhibition of LOC145815 (Accession XM_096874). Accordingly, utilities of VGAM1959 include diagnosis, prevention and treatment of diseases and clinical conditions associated with LOC145815. LOC146237 (Accession XM_096954) is another VGAM1959 host target gene. LOC146237 BINDING SITE is HOST TARGET binding site found in the 3' untranslated region of mRNA encoded by LOC146237, corresponding to a HOST TARGET binding site such as BINDING SITE I, BINDING SITE II or BINDING SITE III. Table 2 illustrates the complementarity of the nucleotide sequences of LOC146237 BINDING SITE, designated SEQ ID:40667, to the nucleotide sequence of VGAM1959 RNA, herein designated VGAM RNA, also designated SEQ ID:4670.

Another function of VGAM1959 is therefore inhibition of LOC146237 (Accession XM_096954). Accordingly, utilities of VGAM1959 include diagnosis, prevention and treatment of diseases and clinical conditions associated with LOC146237. LOC146332 (Accession XM_085413) is another VGAM1959 host target gene. LOC146332 BINDING SITE is HOST TARGET binding site found in the 5' untranslated region of mRNA encoded by LOC146332, corresponding to a HOST TARGET binding site such as BINDING SITE I, BINDING SITE II or BINDING SITE III. Table 2 illustrates the complementarity of the nucleotide sequences of LOC146332 BINDING SITE, designated SEQ ID:38130, to the nucleotide sequence of VGAM1959 RNA, herein designated VGAM RNA, also designated SEQ ID:4670.

Another function of VGAM1959 is therefore inhibition of LOC146332 (Accession XM_085413). Accordingly, utilities of VGAM1959 include diagnosis, prevention and treatment of diseases and clinical conditions associated with LOC146332. LOC146452 (Accession XM_085473) is another VGAM1959 host target gene. LOC146452 BINDING SITE is HOST TARGET binding site found in the 3' untranslated region of mRNA encoded by LOC146452, corresponding to a HOST TARGET binding site such as BINDING SITE I, BINDING SITE II or BINDING SITE III. Table 2 illustrates the complementarity of the nucleotide sequences of LOC146452 BINDING SITE, designated SEQ ID:38164, to the nucleotide sequence of VGAM1959 RNA, herein designated VGAM RNA, also designated SEQ ID:4670.

Another function of VGAM1959 is therefore inhibition of LOC146452 (Accession XM_085473). Accordingly, utilities of VGAM1959 include diagnosis, prevention and treatment of diseases and clinical conditions associated with LOC146452. LOC146488 (Accession XM_047748) is another VGAM1959 host target gene. LOC146488 BINDING SITE is HOST TARGET binding site found in the 3' untranslated region of mRNA encoded by LOC146488, corresponding to a HOST TARGET binding site such as BINDING SITE I, BINDING SITE II or BINDING SITE III. Table 2 illustrates the complementarity of the nucleotide sequences of LOC146488 BINDING SITE, designated SEQ ID:35050, to the nucleotide sequence of VGAM1959 RNA, herein designated VGAM RNA, also designated SEQ ID:4670.

Another function of VGAM1959 is therefore inhibition of LOC146488 (Accession XM_047748). Accordingly, utilities of VGAM1959 include diagnosis, prevention and treatment of diseases and clinical conditions associated with LOC146488. LOC146513 (Accession XM_097013) is another VGAM1959 host target gene. LOC146513 BINDING SITE is HOST TARGET binding site found in the 5' untranslated region of mRNA encoded by LOC146513, corresponding to a HOST TARGET binding site such as BINDING SITE I, BINDING SITE II or BINDING SITE III. Table 2 illustrates the complementarity of the nucleotide sequences of LOC146513 BINDING SITE, designated SEQ ID:40709, to the nucleotide sequence of VGAM1959 RNA, herein designated VGAM RNA, also designated SEQ ID:4670.

Another function of VGAM1959 is therefore inhibition of LOC146513 (Accession XM_097013). Accordingly, utilities of VGAM1959 include diagnosis, prevention and treatment of diseases and clinical conditions associated with LOC146513. LOC146714 (Accession XM_097072) is another VGAM1959 host target gene. LOC146714 BINDING SITE is HOST TARGET binding site found in the 5' untranslated region of mRNA encoded by LOC146714, corresponding to a HOST TARGET binding site such as BINDING SITE I, BINDING SITE II or BINDING SITE III. Table 2 illustrates the complementarity of the nucleotide sequences of LOC146714 BINDING SITE, designated SEQ ID:40720, to the nucleotide sequence of VGAM1959 RNA, herein designated VGAM RNA, also designated SEQ ID:4670.

Another function of VGAM1959 is therefore inhibition of LOC146714 (Accession XM_097072). Accordingly, utilities of VGAM1959 include diagnosis, prevention and treatment of diseases and clinical conditions associated with LOC146714. LOC146894 (Accession NM_145273) is another VGAM1959 host target gene. LOC146894 BINDING SITE is HOST TARGET binding site found in the 3' untranslated region of mRNA encoded by LOC146894, corresponding to a HOST TARGET binding site such as BINDING SITE I, BINDING SITE II or BINDING SITE III. Table 2 illustrates the complementarity of the nucleotide sequences of LOC146894 BINDING SITE, designated SEQ ID:29780, to the nucleotide sequence of VGAM1959 RNA, herein designated VGAM RNA, also designated SEQ ID:4670.

Another function of VGAM1959 is therefore inhibition of LOC146894 (Accession NM_145273). Accordingly, utilities of VGAM1959 include diagnosis, prevention and treatment of diseases and clinical conditions associated with LOC146894. LOC146957 (Accession XM_085652) is another VGAM1959 host target gene. LOC146957 BINDING SITE is HOST TARGET binding site found in the 3' untranslated region of mRNA encoded by LOC146957, corresponding to a HOST TARGET binding site such as BINDING SITE I, BINDING SITE II or BINDING SITE III. Table 2 illustrates the complementarity of the nucleotide sequences of LOC146957 BINDING SITE, designated SEQ ID:38277, to the nucleotide sequence of VGAM1959 RNA, herein designated VGAM RNA, also designated SEQ ID:4670.

Another function of VGAM1959 is therefore inhibition of LOC146957 (Accession XM_085652). Accordingly, utilities of VGAM1959 include diagnosis, prevention and treatment of diseases and clinical conditions associated with LOC146957. LOC147054 (Accession XM_097172) is another VGAM1959 host target gene. LOC147054 BINDING SITE is HOST TARGET binding site found in the 5' untranslated region of mRNA encoded by LOC147054, corresponding to a HOST TARGET binding site such as BINDING SITE I, BINDING SITE II or BINDING SITE III. Table 2 illustrates the complementarity of the nucleotide sequences of LOC147054 BINDING SITE, designated SEQ ID:40789, to the nucleotide sequence of VGAM1959 RNA, herein designated VGAM RNA, also designated SEQ ID:4670.

Another function of VGAM1959 is therefore inhibition of LOC147054 (Accession XM_097172). Accordingly, utilities of VGAM1959 include diagnosis, prevention and treatment of diseases and clinical conditions associated with LOC147054. LOC147136 (Accession XM_085716) is another VGAM1959 host target gene. LOC147136 BINDING SITE is HOST TARGET binding site found in the 3' untranslated region of mRNA encoded by LOC147136, corresponding to a HOST TARGET binding site such as BINDING SITE I, BINDING SITE II or BINDING SITE III. Table 2 illustrates the complementarity of the nucleotide sequences of LOC147136 BINDING SITE, designated SEQ ID:38303, to the nucleotide sequence of VGAM1959 RNA, herein designated VGAM RNA, also designated SEQ ID:4670.

Another function of VGAM1959 is therefore inhibition of LOC147136 (Accession XM_085716). Accordingly, utilities of VGAM1959 include diagnosis, prevention and treatment of diseases and clinical conditions associated with LOC147136. LOC147165 (Accession XM_097205) is another VGAM1959 host target gene. LOC147165 BINDING SITE is HOST TARGET binding site found in the 3' untranslated region of mRNA encoded by LOC147165, corresponding to a HOST TARGET binding site such as BINDING SITE I, BINDING SITE II or BINDING SITE III. Table 2 illustrates the complementarity of the nucleotide sequences of LOC147165 BINDING SITE, designated SEQ ID:40815, to the nucleotide sequence of VGAM1959 RNA, herein designated VGAM RNA, also designated SEQ ID:4670.

Another function of VGAM1959 is therefore inhibition of LOC147165 (Accession XM_097205). Accordingly, utilities of VGAM1959 include diagnosis, prevention and treatment of diseases and clinical conditions associated with LOC147165. LOC147178 (Accession XM_028755) is another VGAM1959 host target gene. LOC147178 BINDING SITE is HOST TARGET binding site found in the 3' untranslated region of mRNA encoded by LOC147178, corresponding to a HOST TARGET binding site such as BINDING SITE I, BINDING SITE II or BINDING SITE III. Table 2 illustrates the complementarity of the nucleotide sequences of LOC147178 BINDING SITE, designated SEQ ID:30743, to the nucleotide sequence of VGAM1959 RNA, herein designated VGAM RNA, also designated SEQ ID:4670.

Another function of VGAM1959 is therefore inhibition of LOC147178 (Accession XM_028755). Accordingly, utilities of VGAM1959 include diagnosis, prevention and treatment of diseases and clinical conditions associated with LOC147178. LOC147694 (Accession XM_085843) is another VGAM1959 host target gene. LOC147694 BINDING SITE is HOST TARGET binding site found in the 5' untranslated region of mRNA encoded by LOC147694, corresponding to a HOST TARGET binding site such as BINDING SITE I, BINDING SITE II or BINDING SITE III. Table 2 illustrates the complementarity of the nucleotide sequences of LOC147694 BINDING SITE, designated SEQ ID:38371, to the nucleotide sequence of VGAM1959 RNA, herein designated VGAM RNA, also designated SEQ ID:4670.

Another function of VGAM1959 is therefore inhibition of LOC147694 (Accession XM_085843). Accordingly, utilities of VGAM1959 include diagnosis, prevention and treatment of diseases and clinical conditions associated with LOC147694. LOC147859 (Accession XM_103235) is another VGAM1959 host target gene. LOC147859 BINDING SITE is HOST TARGET binding site found in the 5' untranslated region of mRNA encoded by LOC147859, corresponding to a HOST TARGET binding site such as BINDING SITE I, BINDING SITE II or BINDING SITE III. Table 2 illustrates the complementarity of the nucleotide sequences of LOC147859 BINDING SITE, designated SEQ ID:42151, to the nucleotide sequence of VGAM1959 RNA, herein designated VGAM RNA, also designated SEQ ID:4670.

Another function of VGAM1959 is therefore inhibition of LOC147859 (Accession XM_103235). Accordingly, utilities of VGAM1959 include diagnosis, prevention and treatment of diseases and clinical conditions associated with LOC147859. LOC147993 (Accession XM_103268) is another VGAM1959 host target gene. LOC147993 BINDING SITE is HOST TARGET binding site found in the 5' untranslated region of mRNA encoded by LOC147993, corresponding to a HOST TARGET binding site such as BINDING SITE I, BINDING SITE II or BINDING SITE III. Table 2 illustrates the complementarity of the nucleotide sequences of LOC147993 BINDING SITE, designated SEQ ID:42153, to the nucleotide sequence of VGAM1959 RNA, herein designated VGAM RNA, also designated SEQ ID:4670.

Another function of VGAM1959 is therefore inhibition of LOC147993 (Accession XM_103268). Accordingly, utilities of VGAM1959 include diagnosis, prevention and treatment of diseases and clinical conditions associated with LOC147993. LOC148089 (Accession XM_086040) is another VGAM1959 host target gene. LOC148089 BINDING SITE is HOST TARGET binding site found in the 3' untranslated region of mRNA encoded by LOC148089, corresponding to a HOST TARGET binding site such as BINDING SITE I, BINDING SITE II or BINDING SITE III. Table 2 illustrates the complementarity of the nucleotide sequences of LOC148089 BINDING SITE, designated SEQ ID:38450, to the nucleotide sequence of VGAM1959 RNA, herein designated VGAM RNA, also designated SEQ ID:4670.

Another function of VGAM1959 is therefore inhibition of LOC148089 (Accession XM_086040). Accordingly, utilities of VGAM1959 include diagnosis, prevention and treatment of diseases and clinical conditions associated with LOC148089. LOC148397 (Accession XM_086171) is another VGAM1959 host target gene. LOC148397 BINDING SITE is HOST TARGET binding site found in the 3' untranslated region of mRNA encoded by LOC148397, corresponding to a HOST TARGET binding site such as BINDING SITE I, BINDING SITE II or BINDING SITE III. Table 2 illustrates the complementarity of the nucleotide sequences of LOC148397 BINDING SITE, designated SEQ ID:38528, to the nucleotide sequence of VGAM1959 RNA, herein designated VGAM RNA, also designated SEQ ID:4670.

Another function of VGAM1959 is therefore inhibition of LOC148397 (Accession XM_086171). Accordingly, utilities of VGAM1959 include diagnosis, prevention and treatment of diseases and clinical conditions associated with LOC148397. LOC148710 (Accession XM_097506) is another VGAM1959 host target gene. LOC148710 BINDING SITE is HOST TARGET binding site found in the 3' untranslated region of mRNA encoded by LOC148710, corresponding to a HOST TARGET binding site such as BINDING SITE I, BINDING SITE II or BINDING SITE III. Table 2 illustrates the complementarity of the nucleotide sequences of LOC148710 BINDING SITE, designated SEQ ID:40894, to the nucleotide sequence of VGAM1959 RNA, herein designated VGAM RNA, also designated SEQ ID:4670.

Another function of VGAM1959 is therefore inhibition of LOC148710 (Accession XM_097506). Accordingly, utilities of VGAM1959 include diagnosis, prevention and treatment of diseases and clinical conditions associated with LOC148710. LOC148918 (Accession XM_086361) is another VGAM1959 host target gene. LOC148918 BINDING SITE is HOST TARGET binding site found in the 5' untranslated region of mRNA encoded by LOC148918, corresponding to a HOST TARGET binding site such as BINDING SITE I, BINDING SITE II or BINDING SITE III. Table 2 illustrates the complementarity of the nucleotide sequences of LOC148918 BINDING SITE, designated SEQ ID:38614, to the nucleotide sequence of VGAM1959 RNA, herein designated VGAM RNA, also designated SEQ ID:4670.

Another function of VGAM1959 is therefore inhibition of LOC148918 (Accession XM_086361). Accordingly, utilities of VGAM1959 include diagnosis, prevention and treatment of diseases and clinical conditions associated with LOC148918. LOC148936 (Accession XM_097556) is another VGAM1959 host target gene. LOC148936 BINDING SITE is HOST TARGET binding site found in the 3' untranslated region of mRNA encoded by LOC148936, corresponding to a HOST TARGET binding site such as BINDING SITE I, BINDING SITE II or BINDING SITE III. Table 2 illustrates the complementarity of the nucleotide sequences of LOC148936 BINDING SITE, designated SEQ ID:40932, to the nucleotide sequence of VGAM1959 RNA, herein designated VGAM RNA, also designated SEQ ID:4670.

Another function of VGAM1959 is therefore inhibition of LOC148936 (Accession XM_097556). Accordingly, utilities of VGAM1959 include diagnosis, prevention and treatment of diseases and clinical conditions associated with LOC148936. LOC148938 (Accession XM_097555) is another VGAM1959 host target gene. LOC148938 BINDING SITE is HOST TARGET binding site found in the 3' untranslated region of mRNA encoded by LOC148938, corresponding to a HOST TARGET binding site such as BINDING SITE I, BINDING SITE II or BINDING SITE III. Table 2 illustrates the complementarity of the nucleotide sequences of LOC148938 BINDING SITE, designated SEQ ID:40925, to the nucleotide sequence of VGAM1959 RNA, herein designated VGAM RNA, also designated SEQ ID:4670.

Another function of VGAM1959 is therefore inhibition of LOC148938 (Accession XM_097555). Accordingly, utilities of VGAM1959 include diagnosis, prevention and treatment of diseases and clinical conditions associated with LOC148938. LOC148979 (Accession XM_097568) is another VGAM1959 host target gene. LOC148979 BINDING SITE is HOST TARGET binding site found in the 5' untranslated region of mRNA encoded by LOC148979, corresponding to a HOST TARGET binding site such as BINDING SITE I, BINDING SITE II or BINDING SITE III. Table 2 illustrates the complementarity of the nucleotide sequences of LOC148979 BINDING SITE, designated SEQ ID:40942, to the nucleotide sequence of VGAM1959 RNA, herein designated VGAM RNA, also designated SEQ ID:4670.

Another function of VGAM1959 is therefore inhibition of LOC148979 (Accession XM_097568). Accordingly, utilities of VGAM1959 include diagnosis, prevention and treatment of diseases and clinical conditions associated with LOC148979. LOC149132 (Accession XM_086428) is another VGAM1959 host target gene. LOC149132 BINDING SITE is HOST TARGET binding site found in the 5' untranslated region of mRNA encoded by LOC149132, corresponding to a HOST TARGET binding site such as BINDING SITE I, BINDING SITE II or BINDING SITE III. Table 2 illustrates the complementarity of the nucleotide sequences of LOC149132 BINDING SITE, designated SEQ ID:38645, to the nucleotide sequence of VGAM1959 RNA, herein designated VGAM RNA, also designated SEQ ID:4670.

Another function of VGAM1959 is therefore inhibition of LOC149132 (Accession XM_086428). Accordingly, utilities of VGAM1959 include diagnosis, prevention and treatment of diseases and clinical conditions associated with LOC149132. LOC149171 (Accession XM_086450) is another VGAM1959 host target gene. LOC149171 BINDING SITE is HOST TARGET binding site found in the 5' untranslated region of mRNA encoded by LOC149171, corresponding to a HOST TARGET binding site such as BINDING SITE I, BINDING SITE II or BINDING SITE III. Table 2 illustrates the complementarity of the nucleotide sequences of LOC149171 BINDING SITE, designated SEQ ID:38666, to the nucleotide sequence of VGAM1959 RNA, herein designated VGAM RNA, also designated SEQ ID:4670.

Another function of VGAM1959 is therefore inhibition of LOC149171 (Accession XM_086450). Accordingly, utilities of VGAM1959 include diagnosis, prevention and treatment of diseases and clinical conditions associated with LOC149171. LOC149194 (Accession XM_086458) is another VGAM1959 host target gene. LOC149194 BINDING SITE is HOST TARGET binding site found in the 5' untranslated region of mRNA encoded by LOC149194, corresponding to a HOST TARGET binding site such as BINDING SITE I, BINDING SITE II or BINDING SITE III. Table 2 illustrates the complementarity of the nucleotide sequences of LOC149194 BINDING SITE, designated SEQ ID:38669, to the nucleotide sequence of VGAM1959 RNA, herein designated VGAM RNA, also designated SEQ ID:4670.

Another function of VGAM1959 is therefore inhibition of LOC149194 (Accession XM_086458). Accordingly, utilities of VGAM1959 include diagnosis, prevention and treatment of diseases and clinical conditions associated with LOC149194. LOC149267 (Accession NM_138480) is another VGAM1959 host target gene. LOC149267 BINDING SITE is HOST TARGET binding site found in the 5' untranslated region of mRNA encoded by LOC149267, corresponding to a HOST TARGET binding site such as BINDING SITE I, BINDING SITE II or BINDING SITE III. Table 2 illustrates the complementarity of the nucleotide sequences of LOC149267 BINDING SITE, designated SEQ ID:28831, to the nucleotide sequence of VGAM1959 RNA, herein designated VGAM RNA, also designated SEQ ID:4670.

Another function of VGAM1959 is therefore inhibition of LOC149267 (Accession NM_138480). Accordingly, utilities of VGAM1959 include diagnosis, prevention and treatment of diseases and clinical conditions associated with LOC149267. LOC149276 (Accession XM_097621) is another VGAM1959 host target gene. LOC149276 BINDING SITE is HOST TARGET binding site found in the 5' untranslated region of mRNA encoded by LOC149276, corresponding to a HOST TARGET binding site such as BINDING SITE I, BINDING SITE II or BINDING SITE III. Table 2 illustrates the complementarity of the nucleotide sequences of LOC149276 BINDING SITE, designated SEQ ID:40978, to the nucleotide sequence of VGAM1959 RNA, herein designated VGAM RNA, also designated SEQ ID:4670.

Another function of VGAM1959 is therefore inhibition of LOC149276 (Accession XM_097621). Accordingly, utilities of VGAM1959 include diagnosis, prevention and treatment of diseases and clinical conditions associated with LOC149276. LOC149506 (Accession XM_097661) is another VGAM1959 host target gene. LOC149506 BINDING SITE is HOST TARGET binding site found in the 3' untranslated region of mRNA encoded by LOC149506, corresponding to a HOST TARGET binding site such as BINDING SITE I, BINDING SITE II or BINDING SITE III. Table 2 illustrates the complementarity of the nucleotide sequences of LOC149506 BINDING SITE, designated SEQ ID:41008, to the nucleotide sequence of VGAM1959 RNA, herein designated VGAM RNA, also designated SEQ ID:4670.

Another function of VGAM1959 is therefore inhibition of LOC149506 (Accession XM_097661). Accordingly, utilities of VGAM1959 include diagnosis, prevention and treatment of diseases and clinical conditions associated with LOC149506. LOC149603 (Accession XM_047499) is another VGAM1959 host target gene. LOC149603 BINDING SITE is HOST TARGET binding site found in the 3' untranslated region of mRNA encoded by LOC149603, corresponding to a HOST TARGET binding site such as BINDING SITE I, BINDING SITE II or BINDING SITE III. Table 2 illustrates the complementarity of the nucleotide sequences of LOC149603 BINDING SITE, designated SEQ ID:34971, to the nucleotide sequence of VGAM1959 RNA, herein designated VGAM RNA, also designated SEQ ID:4670.

Another function of VGAM1959 is therefore inhibition of LOC149603 (Accession XM_047499). Accordingly, utilities of VGAM1959 include diagnosis, prevention and treatment of diseases and clinical conditions associated with LOC149603. LOC149620 (Accession XM_086604) is another VGAM1959 host target gene. LOC149620 BINDING SITE is HOST TARGET binding site found in the 5' untranslated region of mRNA encoded by LOC149620, corresponding to a HOST TARGET binding site such as BINDING SITE I, BINDING SITE II or BINDING SITE III. Table 2 illustrates the complementarity of the nucleotide sequences of LOC149620 BINDING SITE, designated SEQ ID:38788, to the nucleotide sequence of VGAM1959 RNA, herein designated VGAM RNA, also designated SEQ ID:4670.

Another function of VGAM1959 is therefore inhibition of LOC149620 (Accession XM_086604). Accordingly, utilities of VGAM1959 include diagnosis, prevention and treatment of diseases and clinical conditions associated with LOC149620. LOC149650 (Accession XM_086623) is another VGAM1959 host target gene. LOC149650 BINDING SITE is HOST TARGET binding site found in the 3' untranslated region of mRNA encoded by LOC149650, corresponding to a HOST TARGET binding site such as BINDING SITE I, BINDING SITE II or BINDING SITE III. Table 2 illustrates the complementarity of the nucleotide sequences of LOC149650 BINDING SITE, designated SEQ ID:38793, to the nucleotide sequence of VGAM1959 RNA, herein designated VGAM RNA, also designated SEQ ID:4670.

Another function of VGAM1959 is therefore inhibition of LOC149650 (Accession XM_086623). Accordingly, utilities of VGAM1959 include diagnosis, prevention and treatment of diseases and clinical conditions associated with LOC149650. LOC149657 (Accession XM_097702) is another VGAM1959 host target gene. LOC149657 BINDING SITE is HOST TARGET binding site found in the 3' untranslated region of mRNA encoded by LOC149657, corresponding to a HOST TARGET binding site such as BINDING SITE I, BINDING SITE II or BINDING SITE III. Table 2 illustrates the complementarity of the nucleotide sequences of LOC149657 BINDING SITE, designated SEQ ID:41037, to the nucleotide sequence of VGAM1959 RNA, herein designated VGAM RNA, also designated SEQ ID:4670.

Another function of VGAM1959 is therefore inhibition of LOC149657 (Accession XM_097702). Accordingly, utilities of VGAM1959 include diagnosis, prevention and treatment of diseases and clinical conditions associated with LOC149657. LOC150142 (Accession XM_086791) is another VGAM1959 host target gene. LOC150142 BINDING SITE is HOST TARGET binding site found in the 5' untranslated region of mRNA encoded by LOC150142, corresponding to a HOST TARGET binding site such as BINDING SITE I, BINDING SITE II or BINDING SITE III. Table 2 illustrates the complementarity of the nucleotide sequences of LOC150142 BINDING SITE, designated SEQ ID:38851, to the nucleotide sequence of VGAM1959 RNA, herein designated VGAM RNA, also designated SEQ ID:4670.

Another function of VGAM1959 is therefore inhibition of LOC150142 (Accession XM_086791). Accordingly, utilities of VGAM1959 include diagnosis, prevention and treatment of diseases and clinical conditions associated with LOC150142. LOC150150 (Accession XM_097820) is another VGAM1959 host target gene. LOC150150 BINDING SITE is HOST TARGET binding site found in the 5' untranslated region of mRNA encoded by LOC150150, corresponding to a HOST TARGET binding site such as BINDING SITE I, BINDING SITE II or BINDING SITE III. Table 2 illustrates the complementarity of the nucleotide sequences of LOC150150 BINDING SITE, designated SEQ ID:41136, to the nucleotide sequence of VGAM1959 RNA, herein designated VGAM RNA, also designated SEQ ID:4670.

Another function of VGAM1959 is therefore inhibition of LOC150150 (Accession XM_097820). Accordingly, utilities of VGAM1959 include diagnosis, prevention and treatment of diseases and clinical conditions associated with LOC150150. LOC150372 (Accession XM_086893) is another VGAM1959 host target gene. LOC150372 BINDING SITE is HOST TARGET binding site found in the 5' untranslated region of mRNA encoded by LOC150372, corresponding to a HOST TARGET binding site such as BINDING SITE I, BINDING SITE II or BINDING SITE III. Table 2 illustrates the complementarity of the nucleotide sequences of LOC150372 BINDING SITE, designated SEQ ID:38938, to the nucleotide sequence of VGAM1959 RNA, herein designated VGAM RNA, also designated SEQ ID:4670.

Another function of VGAM1959 is therefore inhibition of LOC150372 (Accession XM_086893). Accordingly, utilities of VGAM1959 include diagnosis, prevention and treatment of diseases and clinical conditions associated with LOC150372. LOC150421 (Accession XM_097901) is another VGAM1959 host target gene. LOC150421 BINDING SITE is HOST TARGET binding site found in the 3' untranslated region of mRNA encoded by LOC150421, corresponding to a HOST TARGET binding site such as BINDING SITE I, BINDING SITE II or BINDING SITE III. Table 2 illustrates the complementarity of the nucleotide sequences of LOC150421 BINDING SITE, designated SEQ ID:41204, to the nucleotide sequence of VGAM1959 RNA, herein designated VGAM RNA, also designated SEQ ID:4670.

Another function of VGAM1959 is therefore inhibition of LOC150421 (Accession XM_097901). Accordingly, utilities of VGAM1959 include diagnosis, prevention and treatment of diseases and clinical conditions associated with LOC150421. LOC150776 (Accession XM_032542) is another VGAM1959 host target gene. LOC150776 BINDING SITE is HOST TARGET binding site found in the 3' untranslated region of mRNA encoded by LOC150776, corresponding to a HOST TARGET binding site such as BINDING SITE I, BINDING SITE II or BINDING SITE III. Table 2 illustrates the complementarity of the nucleotide sequences of LOC150776 BINDING SITE, designated SEQ ID:31677, to the nucleotide sequence of VGAM1959 RNA, herein designated VGAM RNA, also designated SEQ ID:4670.

Another function of VGAM1959 is therefore inhibition of LOC150776 (Accession XM_032542). Accordingly, utilities of VGAM1959 include diagnosis, prevention and treatment of diseases and clinical conditions associated with LOC150776. LOC150819 (Accession XM_097954) is another VGAM1959 host target gene. LOC150819 BINDING SITE is HOST TARGET binding site found in the 3' untranslated region of mRNA encoded by LOC150819, corresponding to a HOST TARGET binding site such as BINDING SITE I, BINDING SITE II or BINDING SITE III. Table 2 illustrates the complementarity of the nucleotide sequences of LOC150819 BINDING SITE, designated SEQ ID:41249, to the nucleotide sequence of VGAM1959 RNA, herein designated VGAM RNA, also designated SEQ ID:4670.

Another function of VGAM1959 is therefore inhibition of LOC150819 (Accession XM_097954). Accordingly, utilities of VGAM1959 include diagnosis, prevention and treatment of diseases and clinical conditions associated with LOC150819. LOC150935 (Accession XM_087049) is another VGAM1959 host target gene. LOC150935 BINDING SITE is HOST TARGET binding site found in the 3' untranslated region of mRNA encoded by LOC150935, corresponding to a HOST TARGET binding site such as BINDING SITE I, BINDING SITE II or BINDING SITE III. Table 2 illustrates the complementarity of the nucleotide sequences of LOC150935 BINDING SITE, designated SEQ ID:39021, to the nucleotide sequence of VGAM1959 RNA, herein designated VGAM RNA, also designated SEQ ID:4670.

Another function of VGAM1959 is therefore inhibition of LOC150935 (Accession XM_087049). Accordingly, utilities of VGAM1959 include diagnosis, prevention and treatment of diseases and clinical conditions associated with LOC150935. LOC151201 (Accession XM_098021) is another VGAM1959 host target gene. LOC151201 BINDING SITE is HOST TARGET binding site found in the 3' untranslated region of mRNA encoded by LOC151201, corresponding to a HOST TARGET binding site such as BINDING SITE I, BINDING SITE II or BINDING SITE III. Table 2 illustrates the complementarity of the nucleotide sequences of LOC151201 BINDING SITE, designated SEQ ID:41327, to the nucleotide sequence of VGAM1959 RNA, herein designated VGAM RNA, also designated SEQ ID:4670.

Another function of VGAM1959 is therefore inhibition of LOC151201 (Accession XM_098021). Accordingly, utilities of VGAM1959 include diagnosis, prevention and treatment of diseases and clinical conditions associated with LOC151201. LOC151507 (Accession XM_087225) is another VGAM1959 host target gene. LOC151507 BINDING SITE is HOST TARGET binding site found in the 3' untranslated region of mRNA encoded by LOC151507, corresponding to a HOST TARGET binding site such as BINDING SITE I, BINDING SITE II or BINDING SITE III. Table 2 illustrates the complementarity of the nucleotide sequences of LOC151507 BINDING SITE, designated SEQ ID:39127, to the nucleotide sequence of VGAM1959 RNA, herein designated VGAM RNA, also designated SEQ ID:4670.

Another function of VGAM1959 is therefore inhibition of LOC151507 (Accession XM_087225). Accordingly, utilities of VGAM1959 include diagnosis, prevention and treatment of diseases and clinical conditions associated with LOC151507. LOC151877 (Accession XM_098132) is another VGAM1959 host target gene. LOC151877 BINDING SITE is HOST TARGET binding site found in the 3' untranslated region of mRNA encoded by LOC151877, corresponding to a HOST TARGET binding site such as BINDING SITE I, BINDING SITE II or BINDING SITE III. Table 2 illustrates the complementarity of the nucleotide sequences of LOC151877 BINDING SITE, designated SEQ ID:41397, to the nucleotide sequence of VGAM1959 RNA, herein designated VGAM RNA, also designated SEQ ID:4670.

Another function of VGAM1959 is therefore inhibition of LOC151877 (Accession XM_098132). Accordingly, utilities of VGAM1959 include diagnosis, prevention and treatment of diseases and clinical conditions associated with LOC151877. LOC152078 (Accession XM_087376) is another VGAM1959 host target gene. LOC152078 BINDING SITE is HOST TARGET binding site found in the 3' untranslated region of mRNA encoded by LOC152078, corresponding to a HOST TARGET binding site such as BIND- ING SITE I, BINDING SITE II or BINDING SITE III. Table 2 illustrates the complementarity of the nucleotide sequences of LOC152078 BINDING SITE, designated SEQ ID:39211, to the nucleotide sequence of VGAM1959 RNA, herein designated VGAM RNA, also designated SEQ ID:4670.

Another function of VGAM1959 is therefore inhibition of LOC152078 (Accession XM_087376). Accordingly, utilities of VGAM1959 include diagnosis, prevention and treatment of diseases and clinical conditions associated with LOC152078. LOC152441 (Accession XM_098230) is another VGAM1959 host target gene. LOC152441 BINDING SITE is HOST TARGET binding site found in the 5' untranslated region of mRNA encoded by LOC152441, corresponding to a HOST TARGET binding site such as BINDING SITE I, BINDING SITE II or BINDING SITE III. Table 2 illustrates the complementarity of the nucleotide sequences of LOC152441 BINDING SITE, designated SEQ ID:41505, to the nucleotide sequence of VGAM1959 RNA, herein designated VGAM RNA, also designated SEQ ID:4670.

Another function of VGAM1959 is therefore inhibition of LOC152441 (Accession XM_098230). Accordingly, utilities of VGAM1959 include diagnosis, prevention and treatment of diseases and clinical conditions associated with LOC152441. LOC152765 (Accession XM_087519) is another VGAM1959 host target gene. LOC152765 BINDING SITE is HOST TARGET binding site found in the 5' untranslated region of mRNA encoded by LOC152765, corresponding to a HOST TARGET binding site such as BINDING SITE I, BINDING SITE II or BINDING SITE III. Table 2 illustrates the complementarity of the nucleotide sequences of LOC152765 BINDING SITE, designated SEQ ID:39315, to the nucleotide sequence of VGAM1959 RNA, herein designated VGAM RNA, also designated SEQ ID:4670.

Another function of VGAM1959 is therefore inhibition of LOC152765 (Accession XM_087519). Accordingly, utilities of VGAM1959 include diagnosis, prevention and treatment of diseases and clinical conditions associated with LOC152765. LOC153020 (Accession XM_087578) is another VGAM1959 host target gene. LOC153020 BINDING SITE is HOST TARGET binding site found in the 3' untranslated region of mRNA encoded by LOC153020, corresponding to a HOST TARGET binding site such as BINDING SITE I, BINDING SITE II or BINDING SITE III. Table 2 illustrates the complementarity of the nucleotide sequences of LOC153020 BINDING SITE, designated SEQ ID:39354, to the nucleotide sequence of VGAM1959 RNA, herein designated VGAM RNA, also designated SEQ ID:4670.

Another function of VGAM1959 is therefore inhibition of LOC153020 (Accession XM_087578). Accordingly, utilities of VGAM1959 include diagnosis, prevention and treatment of diseases and clinical conditions associated with LOC153020. LOC153339 (Accession XM_098362) is another VGAM1959 host target gene. LOC153339 BINDING SITE is HOST TARGET binding site found in the 5' untranslated region of mRNA encoded by LOC153339, corresponding to a HOST TARGET binding site such as BINDING SITE I, BINDING SITE II or BINDING SITE III. Table 2 illustrates the complementarity of the nucleotide sequences of LOC153339 BINDING SITE, designated SEQ ID:41615, to the nucleotide sequence of VGAM1959 RNA, herein designated VGAM RNA, also designated SEQ ID:4670.

Another function of VGAM1959 is therefore inhibition of LOC153339 (Accession XM_098362). Accordingly, utilities of VGAM1959 include diagnosis, prevention and treatment of diseases and clinical conditions associated with LOC153339. LOC153442 (Accession XM_098373) is another VGAM1959 host target gene. LOC153442 BINDING SITE is HOST TARGET binding site found in the 5' untranslated region of mRNA encoded by LOC153442, corresponding to a HOST TARGET binding site such as BINDING SITE I, BINDING SITE II or BINDING SITE III. Table 2 illustrates the complementarity of the nucleotide sequences of LOC153442 BINDING SITE, designated SEQ ID:41636, to the nucleotide sequence of VGAM1959 RNA, herein designated VGAM RNA, also designated SEQ ID:4670.

Another function of VGAM1959 is therefore inhibition of LOC153442 (Accession XM_098373). Accordingly, utilities of VGAM1959 include diagnosis, prevention and treatment of diseases and clinical conditions associated with LOC153442. LOC153577 (Accession XM_098394) is another VGAM1959 host target gene. LOC153577 BINDING SITE is HOST TARGET binding site found in the 3' untranslated region of mRNA encoded by LOC153577, corresponding to a HOST TARGET binding site such as BINDING SITE I, BINDING SITE II or BINDING SITE III. Table 2 illustrates the complementarity of the nucleotide sequences of LOC153577 BINDING SITE, designated SEQ ID:41643, to the nucleotide sequence of VGAM1959 RNA, herein designated VGAM RNA, also designated SEQ ID:4670.

Another function of VGAM1959 is therefore inhibition of LOC153577 (Accession XM_098394). Accordingly, utilities of VGAM1959 include diagnosis, prevention and treatment of diseases and clinical conditions associated with LOC153577. LOC153688 (Accession XM_098416) is another VGAM1959 host target gene. LOC153688 BINDING SITE is HOST TARGET binding site found in the 3' untranslated region of mRNA encoded by LOC153688, corresponding to a HOST TARGET binding site such as BINDING SITE I, BINDING SITE II or BINDING SITE III. Table 2 illustrates the complementarity of the nucleotide sequences of LOC153688 BINDING SITE, designated SEQ ID:41661, to the nucleotide sequence of VGAM1959 RNA, herein designated VGAM RNA, also designated SEQ ID:4670.

Another function of VGAM1959 is therefore inhibition of LOC153688 (Accession XM_098416). Accordingly, utilities of VGAM1959 include diagnosis, prevention and treatment of diseases and clinical conditions associated with LOC153688. LOC153811 (Accession XM_087779) is another VGAM1959 host target gene. LOC153811 BINDING SITE is HOST TARGET binding site found in the 3' untranslated region of mRNA encoded by LOC153811, corresponding to a HOST TARGET binding site such as BINDING SITE I, BINDING SITE II or BINDING SITE III. Table 2 illustrates the complementarity of the nucleotide sequences of LOC153811 BINDING SITE, designated SEQ ID:39415, to the nucleotide sequence of VGAM1959 RNA, herein designated VGAM RNA, also designated SEQ ID:4670.

Another function of VGAM1959 is therefore inhibition of LOC153811 (Accession XM_087779). Accordingly, utilities of VGAM1959 include diagnosis, prevention and treatment of diseases and clinical conditions associated with LOC153811. LOC154442 (Accession XM_098536) is another VGAM1959 host target gene. LOC154442 BINDING SITE is HOST TARGET binding site found in the 3' untranslated region of mRNA encoded by LOC154442, corresponding to a HOST TARGET binding site such as BINDING SITE I, BINDING SITE II or BINDING SITE III. Table 2 illustrates the complementarity of the nucleotide sequences of LOC154442 BINDING SITE, designated SEQ ID:41705, to the nucleotide sequence of VGAM1959 RNA, herein designated VGAM RNA, also designated SEQ ID:4670.

Another function of VGAM1959 is therefore inhibition of LOC154442 (Accession XM_098536). Accordingly, utilities of VGAM1959 include diagnosis, prevention and treatment of diseases and clinical conditions associated with LOC154442. LOC157556 (Accession XM_098783) is another VGAM1959 host target gene. LOC157556 BINDING SITE is HOST TARGET binding site found in the 3' untranslated region of mRNA encoded by LOC157556, corresponding to a HOST TARGET binding site such as BINDING SITE I, BINDING SITE II or BINDING SITE III. Table 2 illustrates the complementarity of the nucleotide sequences of LOC157556 BINDING SITE, designated SEQ ID:41821, to the nucleotide sequence of VGAM1959 RNA, herein designated VGAM RNA, also designated SEQ ID:4670.

Another function of VGAM1959 is therefore inhibition of LOC157556 (Accession XM_098783). Accordingly, utilities of VGAM1959 include diagnosis, prevention and treatment of diseases and clinical conditions associated with LOC157556. LOC157623 (Accession XM_088346) is another VGAM1959 host target gene. LOC157623 BINDING SITE is HOST TARGET binding site found in the 5' untranslated region of mRNA encoded by LOC157623, corresponding to a HOST TARGET binding site such as BINDING SITE I, BINDING SITE II or BINDING SITE III. Table 2 illustrates the complementarity of the nucleotide sequences of LOC157623 BINDING SITE, designated SEQ ID:39615, to the nucleotide sequence of VGAM1959 RNA, herein designated VGAM RNA, also designated SEQ ID:4670.

Another function of VGAM1959 is therefore inhibition of LOC157623 (Accession XM_088346). Accordingly, utilities of VGAM1959 include diagnosis, prevention and treatment of diseases and clinical conditions associated with LOC157623. LOC157638 (Accession XM_088350) is another VGAM1959 host target gene. LOC157638 BINDING SITE is HOST TARGET binding site found in the 5' untranslated region of mRNA encoded by LOC157638, corresponding to a HOST TARGET binding site such as BINDING SITE I, BINDING SITE II or BINDING SITE III. Table 2 illustrates the complementarity of the nucleotide sequences of LOC157638 BINDING SITE, designated SEQ ID:39623, to the nucleotide sequence of VGAM1959 RNA, herein designated VGAM RNA, also designated SEQ ID:4670.

Another function of VGAM1959 is therefore inhibition of LOC157638 (Accession XM_088350). Accordingly, utilities of VGAM1959 include diagnosis, prevention and treatment of diseases and clinical conditions associated with LOC157638. LOC157657 (Accession XM_088352) is another VGAM1959 host target gene. LOC157657 BINDING SITE is HOST TARGET binding site found in the 3' untranslated region of mRNA encoded by LOC157657, corresponding to a HOST TARGET binding site such as BINDING SITE I, BINDING SITE II or BINDING SITE III. Table 2 illustrates the complementarity of the nucleotide sequences of LOC157657 BINDING SITE, designated SEQ ID:39626, to the nucleotide sequence of VGAM1959 RNA, herein designated VGAM RNA, also designated SEQ ID:4670.

Another function of VGAM1959 is therefore inhibition of LOC157657 (Accession XM_088352). Accordingly, utilities of VGAM1959 include diagnosis, prevention and treatment of diseases and clinical conditions associated with LOC157657. LOC157773 (Accession XM_088387) is another VGAM1959 host target gene. LOC157773 BINDING SITE is HOST TARGET binding site found in the 5' untranslated region of mRNA encoded by LOC157773, corresponding to a HOST TARGET binding site such as BINDING SITE I, BINDING SITE II or BINDING SITE III. Table 2 illustrates the complementarity of the nucleotide sequences of LOC157773 BINDING SITE, designated SEQ ID:39670, to the nucleotide sequence of VGAM1959 RNA, herein designated VGAM RNA, also designated SEQ ID:4670.

Another function of VGAM1959 is therefore inhibition of LOC157773 (Accession XM_088387). Accordingly, utilities of VGAM1959 include diagnosis, prevention and treatment of diseases and clinical conditions associated with LOC157773. LOC157848 (Accession XM_088405) is another VGAM1959 host target gene. LOC157848 BINDING SITE is HOST TARGET binding site found in the 3' untranslated region of mRNA encoded by LOC157848, corresponding to a HOST TARGET binding site such as BINDING SITE I, BINDING SITE II or BINDING SITE III. Table 2 illustrates the complementarity of the nucleotide sequences of LOC157848 BINDING SITE, designated SEQ ID:39672, to the nucleotide sequence of VGAM1959 RNA, herein designated VGAM RNA, also designated SEQ ID:4670.

Another function of VGAM1959 is therefore inhibition of LOC157848 (Accession XM_088405). Accordingly, utilities of VGAM1959 include diagnosis, prevention and treatment of diseases and clinical conditions associated with LOC157848. LOC157860 (Accession XM_098832) is another VGAM1959 host target gene. LOC157860 BINDING SITE is HOST TARGET binding site found in the 3' untranslated region of mRNA encoded by LOC157860, corresponding to a HOST TARGET binding site such as BINDING SITE I, BINDING SITE II or BINDING SITE III. Table 2 illustrates the complementarity of the nucleotide sequences of LOC157860 BINDING SITE, designated SEQ ID:41861, to the nucleotide sequence of VGAM1959 RNA, herein designated VGAM RNA, also designated SEQ ID:4670.

Another function of VGAM1959 is therefore inhibition of LOC157860 (Accession XM_098832). Accordingly, utilities of VGAM1959 include diagnosis, prevention and treatment of diseases and clinical conditions associated with LOC157860. LOC158056 (Accession XM_088463) is another VGAM1959 host target gene. LOC158056 BINDING SITE is HOST TARGET binding site found in the 5' untranslated region of mRNA encoded by LOC158056, corresponding to a HOST TARGET binding site such as BINDING SITE I, BINDING SITE II or BINDING SITE III. Table 2 illustrates the complementarity of the nucleotide sequences of LOC158056 BINDING SITE, designated SEQ ID:39720, to the nucleotide sequence of VGAM1959 RNA, herein designated VGAM RNA, also designated SEQ ID:4670.

Another function of VGAM1959 is therefore inhibition of LOC158056 (Accession XM_088463). Accordingly, utilities of VGAM1959 include diagnosis, prevention and treatment of diseases and clinical conditions associated with LOC158056. LOC158156 (Accession XM_088496) is another VGAM1959 host target gene. LOC158156 BINDING SITE is HOST TARGET binding site found in the 3' untranslated region of mRNA encoded by LOC158156, corresponding to a HOST TARGET binding site such as BINDING SITE I, BINDING SITE II or BINDING SITE III. Table 2 illustrates the complementarity of the nucleotide sequences of LOC158156 BINDING SITE, designated SEQ ID:39739, to the nucleotide sequence of VGAM1959 RNA, herein designated VGAM RNA, also designated SEQ ID:4670.

Another function of VGAM1959 is therefore inhibition of LOC158156 (Accession XM_088496). Accordingly, utilities of VGAM1959 include diagnosis, prevention and treatment of diseases and clinical conditions associated with LOC158156. LOC158332 (Accession XM_088554) is another VGAM1959 host target gene. LOC158332 BINDING SITE is HOST TARGET binding site found in the 3' untranslated region of mRNA encoded by LOC158332, corresponding to a HOST TARGET binding site such as BINDING SITE I, BINDING SITE II or BINDING SITE III. Table 2 illustrates the complementarity of the nucleotide sequences of LOC158332 BINDING SITE, designated SEQ ID:39825, to the nucleotide sequence of VGAM1959 RNA, herein designated VGAM RNA, also designated SEQ ID:4670.

Another function of VGAM1959 is therefore inhibition of LOC158332 (Accession XM_088554). Accordingly, utilities of VGAM1959 include diagnosis, prevention and treatment of diseases and clinical conditions associated with LOC158332. LOC158476 (Accession XM_098955) is another VGAM1959 host target gene. LOC158476 BINDING SITE is HOST TARGET binding site found in the 5' untranslated region of mRNA encoded by LOC158476, corresponding to a HOST TARGET binding site such as BINDING SITE I, BINDING SITE II or BINDING SITE III. Table 2 illustrates the complementarity of the nucleotide sequences of LOC158476 BINDING SITE, designated SEQ ID:41999, to the nucleotide sequence of VGAM1959 RNA, herein designated VGAM RNA, also designated SEQ ID:4670.

Another function of VGAM1959 is therefore inhibition of LOC158476 (Accession XM_098955). Accordingly, utilities of VGAM1959 include diagnosis, prevention and treatment of diseases and clinical conditions associated with LOC158476. LOC158549 (Accession XM_098963) is another VGAM1959 host target gene. LOC158549 BINDING SITE is HOST TARGET binding site found in the 3' untranslated region of mRNA encoded by LOC158549, corresponding to a HOST TARGET binding site such as BINDING SITE I, BINDING SITE II or BINDING SITE III. Table 2 illustrates the complementarity of the nucleotide sequences of LOC158549 BINDING SITE, designated SEQ ID:42012, to the nucleotide sequence of VGAM1959 RNA, herein designated VGAM RNA, also designated SEQ ID:4670.

Another function of VGAM1959 is therefore inhibition of LOC158549 (Accession XM_098963). Accordingly, utilities of VGAM1959 include diagnosis, prevention and treatment of diseases and clinical conditions associated with LOC158549. LOC160336 (Accession XM_090228) is another VGAM1959 host target gene. LOC160336 BINDING SITE is HOST TARGET binding site found in the 5' untranslated region of mRNA encoded by LOC160336, corresponding to a HOST TARGET binding site such as BINDING SITE I, BINDING SITE II or BINDING SITE III. Table 2 illustrates the complementarity of the nucleotide sequences of LOC160336 BINDING SITE, designated SEQ ID:39996, to the nucleotide sequence of VGAM1959 RNA, herein designated VGAM RNA, also designated SEQ ID:4670.

Another function of VGAM1959 is therefore inhibition of LOC160336 (Accession XM_090228). Accordingly, utilities of VGAM1959 include diagnosis, prevention and treatment of diseases and clinical conditions associated with LOC160336. LOC160414 (Accession XM_100898) is another VGAM1959 host target gene. LOC160414 BINDING SITE is HOST TARGET binding site found in the 5' untranslated region of mRNA encoded by LOC160414, corresponding to a HOST TARGET binding site such as BINDING SITE I, BINDING SITE II or BINDING SITE III. Table 2 illustrates the complementarity of the nucleotide sequences of LOC160414 BINDING SITE, designated SEQ ID:42103, to the nucleotide sequence of VGAM1959 RNA, herein designated VGAM RNA, also designated SEQ ID:4670.

Another function of VGAM1959 is therefore inhibition of LOC160414 (Accession XM_100898). Accordingly, utilities of VGAM1959 include diagnosis, prevention and treatment of diseases and clinical conditions associated with LOC160414. LOC160484 (Accession XM_090326) is another VGAM1959 host target gene. LOC160484 BINDING SITE is HOST TARGET binding site found in the 5' untranslated region of mRNA encoded by LOC160484, corresponding to a HOST TARGET binding site such as BINDING SITE I, BINDING SITE II or BINDING SITE III. Table 2 illustrates the complementarity of the nucleotide sequences of LOC160484 BINDING SITE, designated SEQ ID:39998, to the nucleotide sequence of VGAM1959 RNA, herein designated VGAM RNA, also designated SEQ ID:4670.

Another function of VGAM1959 is therefore inhibition of LOC160484 (Accession XM_090326). Accordingly, utilities of VGAM1959 include diagnosis, prevention and treatment of diseases and clinical conditions associated with LOC160484. LOC160717 (Accession XM_090457) is another VGAM1959 host target gene. LOC160717 BINDING SITE is HOST TARGET binding site found in the 5' untranslated region of mRNA encoded by LOC160717, corresponding to a HOST TARGET binding site such as BINDING SITE I, BINDING SITE II or BINDING SITE III. Table 2 illustrates the complementarity of the nucleotide sequences of LOC160717 BINDING SITE, designated SEQ ID:40006, to the nucleotide sequence of VGAM1959 RNA, herein designated VGAM RNA, also designated SEQ ID:4670.

Another function of VGAM1959 is therefore inhibition of LOC160717 (Accession XM_090457). Accordingly, utilities of VGAM1959 include diagnosis, prevention and treatment of diseases and clinical conditions associated with LOC160717. LOC162333 (Accession XM_102591) is another VGAM1959 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42135, to the nucleotide sequence of VGAM1959 RNA, herein designated VGAM RNA, also designated SEQ ID:4670.

Another function of VGAM1959 is therefore inhibition of LOC162333 (Accession XM_102591). Accordingly, utilities of VGAM1959 include diagnosis, prevention and treatment of diseases and clinical conditions associated with LOC162333. LOC163682 (Accession XM_099402) is another VGAM1959 host target gene. LOC163682 BINDING SITE is HOST TARGET binding site found in the 3' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42090, to the nucleotide sequence of VGAM1959 RNA, herein designated VGAM RNA, also designated SEQ ID:4670.

Another function of VGAM1959 is therefore inhibition of LOC163682 (Accession XM_099402). Accordingly, utilities of VGAM1959 include diagnosis, prevention and treatment of diseases and clinical conditions associated with LOC163682. LOC165908 (Accession XM_093523) is another VGAM1959 host target gene. LOC165908 BINDING SITE is HOST TARGET binding site found in the 5' untranslated region of mRNA encoded by LOC165908, corresponding to a HOST TARGET binding site such as BINDING SITE I, BINDING SITE II or BINDING SITE III. Table 2 illustrates the complementarity of the nucleotide sequences of LOC165908 BINDING SITE, designated SEQ ID:40196, to the nucleotide sequence of VGAM1959 RNA, herein designated VGAM RNA, also designated SEQ ID:4670.

Another function of VGAM1959 is therefore inhibition of LOC165908 (Accession XM_093523). Accordingly, utilities of VGAM1959 include diagnosis, prevention and treatment of diseases and clinical conditions associated with LOC165908. LOC166793 (Accession NM_145291) is another VGAM1959 host target gene. LOC166793 BINDING SITE is HOST TARGET binding site found in the 5' untranslated region of mRNA encoded by LOC166793, corresponding to a HOST TARGET binding site such as BINDING SITE I, BINDING SITE II or BINDING SITE III. Table 2 illustrates the complementarity of the nucleotide sequences of LOC166793 BINDING SITE, designated SEQ ID:29806, to the nucleotide sequence of VGAM1959 RNA, herein designated VGAM RNA, also designated SEQ ID:4670.

Another function of VGAM1959 is therefore inhibition of LOC166793 (Accession NM_145291). Accordingly, utilities of VGAM1959 include diagnosis, prevention and treatment of diseases and clinical conditions associated with LOC166793. LOC166983 (Accession XM_106422) is another VGAM1959 host target gene. LOC166983 BINDING SITE is HOST TARGET binding site found in the 5' untranslated region of mRNA encoded by LOC166983, corresponding to a HOST TARGET binding site such as BINDING SITE I, BINDING SITE II or BINDING SITE III. Table 2 illustrates the complementarity of the nucleotide sequences of LOC166983 BINDING SITE, designated SEQ ID:42198, to the nucleotide sequence of VGAM1959 RNA, herein designated VGAM RNA, also designated SEQ ID:4670.

Another function of VGAM1959 is therefore inhibition of LOC166983 (Accession XM_106422). Accordingly, utilities of VGAM1959 include diagnosis, prevention and treatment of diseases and clinical conditions associated with LOC166983. LOC170082 (Accession XM_093092) is another VGAM1959 host target gene. LOC170082 BINDING SITE is HOST TARGET binding site found in the 3' untranslated region of mRNA encoded by LOC170082, corresponding to a HOST TARGET binding site such as BINDING SITE I, BINDING SITE II or BINDING SITE III. Table 2 illustrates the complementarity of the nucleotide sequences of LOC170082 BINDING SITE, designated SEQ ID:40173, to the nucleotide sequence of VGAM1959 RNA, herein designated VGAM RNA, also designated SEQ ID:4670.

Another function of VGAM1959 is therefore inhibition of LOC170082 (Accession XM_093092). Accordingly, utilities of VGAM1959 include diagnosis, prevention and treatment of diseases and clinical conditions associated with LOC170082. LOC170221 (Accession XM_093188) is another VGAM1959 host target gene. LOC170221 BINDING SITE is HOST TARGET binding site found in the 3' untranslated region of mRNA encoded by LOC170221, corresponding to a HOST TARGET binding site such as BINDING SITE I, BINDING SITE II or BINDING SITE III. Table 2 illustrates the complementarity of the nucleotide sequences of LOC170221 BINDING SITE, designated SEQ ID:40182, to the nucleotide sequence of VGAM1959 RNA, herein designated VGAM RNA, also designated SEQ ID:4670.

Another function of VGAM1959 is therefore inhibition of LOC170221 (Accession XM_093188). Accordingly, utilities of VGAM1959 include diagnosis, prevention and treatment of diseases and clinical conditions associated with LOC170221. LOC170394 (Accession XM_096329) is another VGAM1959 host target gene. LOC170394 BINDING SITE is HOST TARGET binding site found in the 5' untranslated region of mRNA encoded by LOC170394, corresponding to a HOST TARGET binding site such as BINDING SITE I, BINDING SITE II or BINDING SITE III. Table 2 illustrates the complementarity of the nucleotide sequences of LOC170394 BINDING SITE, designated SEQ ID:40313, to the nucleotide sequence of VGAM1959 RNA, herein designated VGAM RNA, also designated SEQ ID:4670.

Another function of VGAM1959 is therefore inhibition of LOC170394 (Accession XM_096329). Accordingly, utilities of VGAM1959 include diagnosis, prevention and treatment of diseases and clinical conditions associated with LOC170394. LOC195977 (Accession XM_113625) is another VGAM1959 host target gene. LOC195977 BINDING SITE is HOST TARGET binding site found in the 3' untranslated region of mRNA encoded by LOC195977, corresponding to a HOST TARGET binding site such as BINDING SITE I, BINDING SITE II or BINDING SITE III. Table 2 illustrates the complementarity of the nucleotide sequences of LOC195977 BINDING SITE, designated SEQ ID:42302, to the nucleotide sequence of VGAM1959 RNA, herein designated VGAM RNA, also designated SEQ ID:4670.

Another function of VGAM1959 is therefore inhibition of LOC195977 (Accession XM_113625). Accordingly, utilities of VGAM1959 include diagnosis, prevention and treatment of diseases and clinical conditions associated with LOC195977. LOC196337 (Accession XM_113696) is another VGAM1959 host target gene. LOC196337 BINDING SITE is HOST TARGET binding site found in the 3' untranslated region of mRNA encoded by LOC196337, corresponding to a HOST TARGET binding site such as BINDING SITE I, BINDING SITE II or BINDING SITE III. Table 2 illustrates the complementarity of the nucleotide sequences of LOC196337 BINDING SITE, designated SEQ ID:42361, to the nucleotide sequence of VGAM1959 RNA, herein designated VGAM RNA, also designated SEQ ID:4670.

Another function of VGAM1959 is therefore inhibition of LOC196337 (Accession XM_113696). Accordingly, utilities of VGAM1959 include diagnosis, prevention and treatment of diseases and clinical conditions associated with LOC196337. LOC196478 (Accession XM_113729) is another VGAM1959 host target gene. LOC196478 BINDING SITE is HOST TARGET binding site found in the 5' untranslated region of mRNA encoded by LOC196478, corresponding to a HOST TARGET binding site such as BINDING SITE I, BINDING SITE II or BINDING SITE III. Table 2 illustrates the complementarity of the nucleotide sequences of LOC196478 BINDING SITE, designated SEQ ID:42378, to the nucleotide sequence of VGAM1959 RNA, herein designated VGAM RNA, also designated SEQ ID:4670.

Another function of VGAM1959 is therefore inhibition of LOC196478 (Accession XM_113729). Accordingly, utilities of VGAM1959 include diagnosis, prevention and treatment of diseases and clinical conditions associated with LOC196478. LOC196510 (Accession XM_113738) is another VGAM1959 host target gene. LOC196510 BINDING SITE is HOST TARGET binding site found in the 3' untranslated region of mRNA encoded by LOC196510, corresponding to a HOST TARGET binding site such as BINDING SITE I, BINDING SITE II or BINDING SITE III. Table 2 illustrates the complementarity of the nucleotide sequences of LOC196510 BINDING SITE, designated SEQ ID:42394, to the nucleotide sequence of VGAM1959 RNA, herein designated VGAM RNA, also designated SEQ ID:4670.

Another function of VGAM1959 is therefore inhibition of LOC196510 (Accession XM_113738). Accordingly, utilities of VGAM1959 include diagnosis, prevention and treatment of diseases and clinical conditions associated with LOC196510. LOC196812 (Accession XM_116868) is another VGAM1959 host target gene. LOC196812 BINDING SITE is HOST TARGET binding site found in the 3' untranslated region of mRNA encoded by LOC196812, corresponding to a HOST TARGET binding site such as BINDING SITE I, BINDING SITE II or BINDING SITE III. Table 2 illustrates the complementarity of the nucleotide sequences of LOC196812 BINDING SITE, designated SEQ ID:43133, to the nucleotide sequence of VGAM1959 RNA, herein designated VGAM RNA, also designated SEQ ID:4670.

Another function of VGAM1959 is therefore inhibition of LOC196812 (Accession XM_116868). Accordingly, utilities of VGAM1959 include diagnosis, prevention and treatment of diseases and clinical conditions associated with LOC196812. LOC196860 (Accession XM_116945) is another VGAM1959 host target gene. LOC196860 BINDING SITE is HOST TARGET binding site found in the 5' untranslated region of mRNA encoded by LOC196860, corresponding to a HOST TARGET binding site such as BINDING SITE I, BINDING SITE II or BINDING SITE III. Table 2 illustrates the complementarity of the nucleotide sequences of LOC196860 BINDING SITE, designated SEQ ID:43153, to the nucleotide sequence of VGAM1959 RNA, herein designated VGAM RNA, also designated SEQ ID:4670.

Another function of VGAM1959 is therefore inhibition of LOC196860 (Accession XM_116945). Accordingly, utilities of VGAM1959 include diagnosis, prevention and treatment of diseases and clinical conditions associated with LOC196860. LOC196872 (Accession XM_113760) is another VGAM1959 host target gene. LOC196872 BINDING SITE is HOST TARGET binding site found in the 3' untranslated region of mRNA encoded by LOC196872, corresponding to a HOST TARGET binding site such as BINDING SITE I, BINDING SITE II or BINDING SITE III. Table 2 illustrates the complementarity of the nucleotide sequences of LOC196872 BINDING SITE, designated SEQ ID:42419, to the nucleotide sequence of VGAM1959 RNA, herein designated VGAM RNA, also designated SEQ ID:4670.

Another function of VGAM1959 is therefore inhibition of LOC196872 (Accession XM_113760). Accordingly, utilities of VGAM1959 include diagnosis, prevention and treatment of diseases and clinical conditions associated with LOC196872. LOC196957 (Accession XM_113789) is another VGAM1959 host target gene. LOC196957 BINDING SITE is HOST TARGET binding site found in the 3' untranslated region of mRNA encoded by LOC196957, corresponding to a HOST TARGET binding site such as BINDING SITE I, BINDING SITE II or BINDING SITE III. Table 2 illustrates the complementarity of the nucleotide sequences of LOC196957 BINDING SITE, designated SEQ ID:42430, to the nucleotide sequence of VGAM1959 RNA, herein designated VGAM RNA, also designated SEQ ID:4670.

Another function of VGAM1959 is therefore inhibition of LOC196957 (Accession XM_113789). Accordingly, utilities of VGAM1959 include diagnosis, prevention and treatment of diseases and clinical conditions associated with LOC196957. LOC196961 (Accession XM_113790) is another VGAM1959 host target gene. LOC196961 BINDING SITE is HOST TARGET binding site found in the 3' untranslated region of mRNA encoded by LOC196961, corresponding to a HOST TARGET binding site such as BINDING SITE I, BINDING SITE II or BINDING SITE III. Table 2 illustrates the complementarity of the nucleotide sequences of LOC196961 BINDING SITE, designated SEQ ID:42439, to the nucleotide sequence of VGAM1959 RNA, herein designated VGAM RNA, also designated SEQ ID:4670.

Another function of VGAM1959 is therefore inhibition of LOC196961 (Accession XM_113790). Accordingly, utilities of VGAM1959 include diagnosis, prevention and treatment of diseases and clinical conditions associated with LOC196961. LOC197138 (Accession XM_113829) is another VGAM1959 host target gene. LOC197138 BINDING SITE is HOST TARGET binding site found in the 3' untranslated region of mRNA encoded by LOC197138, corresponding to a HOST TARGET binding site such as BINDING SITE I, BINDING SITE II or BINDING SITE III. Table 2 illustrates the complementarity of the nucleotide sequences of LOC197138 BINDING SITE, designated SEQ ID:42457, to the nucleotide sequence of VGAM1959 RNA, herein designated VGAM RNA, also designated SEQ ID:4670.

Another function of VGAM1959 is therefore inhibition of LOC197138 (Accession XM_113829). Accordingly, utilities of VGAM1959 include diagnosis, prevention and treatment of diseases and clinical conditions associated with LOC197138. LOC197273 (Accession XM_041139) is another VGAM1959 host target gene. LOC197273 BINDING SITE is HOST TARGET binding site found in the 5' untranslated region of mRNA encoded by LOC197273, corresponding to a HOST TARGET binding site such as BINDING SITE I, BINDING SITE II or BINDING SITE III. Table 2 illustrates the complementarity of the nucleotide sequences of LOC197273 BINDING SITE, designated SEQ ID:33472, to the nucleotide sequence of VGAM1959 RNA, herein designated VGAM RNA, also designated SEQ ID:4670.

Another function of VGAM1959 is therefore inhibition of LOC197273 (Accession XM_041139). Accordingly, utilities of VGAM1959 include diagnosis, prevention and treatment of diseases and clinical conditions associated with LOC197273. LOC197342 (Accession XM_113869) is another VGAM1959 host target gene. LOC197342 BINDING SITE is HOST TARGET binding site found in the 3' untranslated region of mRNA encoded by LOC197342, corresponding to a HOST TARGET binding site such as BINDING SITE I, BINDING SITE II or BINDING SITE III. Table 2 illustrates the complementarity of the nucleotide sequences of LOC197342 BINDING SITE, designated SEQ ID:42485, to the nucleotide sequence of VGAM1959 RNA, herein designated VGAM RNA, also designated SEQ ID:4670.

Another function of VGAM1959 is therefore inhibition of LOC197342 (Accession XM_113869). Accordingly, utilities of VGAM1959 include diagnosis, prevention and treatment of diseases and clinical conditions associated with LOC197342. LOC199704 (Accession XM_113994) is another VGAM1959 host target gene. LOC199704 BINDING SITE is HOST TARGET binding site found in the 3' untranslated region of mRNA encoded by LOC199704, corresponding to a HOST TARGET binding site such as BINDING SITE I, BINDING SITE II or BINDING SITE III. Table 2 illustrates the complementarity of the nucleotide sequences of LOC199704 BINDING SITE, designated SEQ ID:42605, to the nucleotide sequence of VGAM1959 RNA, herein designated VGAM RNA, also designated SEQ ID:4670.

Another function of VGAM1959 is therefore inhibition of LOC199704 (Accession XM_113994). Accordingly, utilities of VGAM1959 include diagnosis, prevention and treatment of diseases and clinical conditions associated with LOC199704. LOC199733 (Accession XM_117123) is another VGAM1959 host target gene. LOC199733 BINDING SITE is HOST TARGET binding site found in the 3' untranslated region of mRNA encoded by LOC199733, corresponding to a HOST TARGET binding site such as BINDING SITE I, BINDING SITE II or BINDING SITE III. Table 2 illustrates the complementarity of the nucleotide sequences of LOC199733 BINDING SITE, designated SEQ ID:43245, to the nucleotide sequence of VGAM1959 RNA, herein designated VGAM RNA, also designated SEQ ID:4670.

Another function of VGAM1959 is therefore inhibition of LOC199733 (Accession XM_117123). Accordingly, utilities of VGAM1959 include diagnosis, prevention and treatment of diseases and clinical conditions associated with LOC199733. LOC199858 (Accession XM_114040) is another VGAM1959 host target gene. LOC199858 BIND- ING SITE is HOST TARGET binding site found in the 3' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42635, to the nucleotide sequence of VGAM1959 RNA, herein designated VGAM RNA, also designated SEQ ID:4670.

Another function of VGAM1959 is therefore inhibition of LOC199858 (Accession XM_114040). Accordingly, utilities of VGAM1959 include diagnosis, prevention and treatment of diseases and clinical conditions associated with LOC199858. LOC199920 (Accession XM_114056) is another VGAM1959 host target gene. LOC199920 BINDING SITE is HOST TARGET binding site found in the 3' untranslated region of mRNA encoded by LOC199920, corresponding to a HOST TARGET binding site such as BINDING SITE I, BINDING SITE II or BINDING SITE III. Table 2 illustrates the complementarity of the nucleotide sequences of LOC199920 BINDING SITE, designated SEQ ID:42662, to the nucleotide sequence of VGAM1959 RNA, herein designated VGAM RNA, also designated SEQ ID:4670.

Another function of VGAM1959 is therefore inhibition of LOC199920 (Accession XM_114056). Accordingly, utilities of VGAM1959 include diagnosis, prevention and treatment of diseases and clinical conditions associated with LOC199920. LOC199990 (Accession XM_114083) is another VGAM1959 host target gene. LOC199990 BINDING SITE is HOST TARGET binding site found in the 3' untranslated region of mRNA encoded by LOC199990, corresponding to a HOST TARGET binding site such as BINDING SITE I, BINDING SITE II or BINDING SITE III. Table 2 illustrates the complementarity of the nucleotide sequences of LOC199990 BINDING SITE, designated SEQ ID:42680, to the nucleotide sequence of VGAM1959 RNA, herein designated VGAM RNA, also designated SEQ ID:4670.

Another function of VGAM1959 is therefore inhibition of LOC199990 (Accession XM_114083). Accordingly, utilities of VGAM1959 include diagnosis, prevention and treatment of diseases and clinical conditions associated with LOC199990. LOC200059 (Accession XM_114104) is another VGAM1959 host target gene. LOC200059 BINDING SITE is HOST TARGET binding site found in the 3' untranslated region of mRNA encoded by LOC200059, corresponding to a HOST TARGET binding site such as BINDING SITE I, BINDING SITE II or BINDING SITE III. Table 2 illustrates the complementarity of the nucleotide sequences of LOC200059 BINDING SITE, designated SEQ ID:42702, to the nucleotide sequence of VGAM1959 RNA, herein designated VGAM RNA, also designated SEQ ID:4670.

Another function of VGAM1959 is therefore inhibition of LOC200059 (Accession XM_114104). Accordingly, utilities of VGAM1959 include diagnosis, prevention and treatment of diseases and clinical conditions associated with LOC200059. LOC200093 (Accession XM_032184) is another VGAM1959 host target gene. LOC200093 BINDING SITE1 and LOC200093 BINDING SITE2 are HOST TARGET binding sites found in untranslated regions of mRNA encoded by LOC200093, corresponding to HOST TARGET binding sites such as BINDING SITE I, BINDING SITE II or BINDING SITE III. Table 2 illustrates the complementarity of the nucleotide sequences of LOC200093 BINDING SITE1 and LOC200093 BINDING SITE2, designated SEQ ID:31599 and SEQ ID:31605 respectively, to the nucleotide sequence of VGAM1959 RNA, herein designated VGAM RNA, also designated SEQ ID:4670.

Another function of VGAM1959 is therefore inhibition of LOC200093 (Accession XM_032184). Accordingly, utilities of VGAM1959 include diagnosis, prevention and treatment of diseases and clinical conditions associated with LOC200093. LOC200220 (Accession XM_114157) is another VGAM1959 host target gene. LOC200220 BINDING SITE is HOST TARGET binding site found in the 3' untranslated region of mRNA encoded by LOC200220, corresponding to a HOST TARGET binding site such as BINDING SITE I, BINDING SITE II or BINDING SITE III. Table 2 illustrates the complementarity of the nucleotide sequences of LOC200220 BINDING SITE, designated SEQ ID:42743, to the nucleotide sequence of VGAM1959 RNA, herein designated VGAM RNA, also designated SEQ ID:4670.

Another function of VGAM1959 is therefore inhibition of LOC200220 (Accession XM_114157). Accordingly, utilities of VGAM1959 include diagnosis, prevention and treatment of diseases and clinical conditions associated with LOC200220. LOC200953 (Accession XM_117302) is another VGAM1959 host target gene. LOC200953 BINDING SITE is HOST TARGET binding site found in the 5' untranslated region of mRNA encoded by LOC200953, corresponding to a HOST TARGET binding site such as BINDING SITE I, BINDING SITE II or BINDING SITE III. Table 2 illustrates the complementarity of the nucleotide sequences of LOC200953 BINDING SITE, designated SEQ ID:43366, to the nucleotide sequence of VGAM1959 RNA, herein designated VGAM RNA, also designated SEQ ID:4670.

Another function of VGAM1959 is therefore inhibition of LOC200953 (Accession XM_117302). Accordingly, utilities of VGAM1959 include diagnosis, prevention and treatment of diseases and clinical conditions associated with LOC200953. LOC201382 (Accession XM_113963) is another VGAM1959 host target gene. LOC201382 BINDING SITE is HOST TARGET binding site found in the 5' untranslated region of mRNA encoded by LOC201382, corresponding to a HOST TARGET binding site such as BINDING SITE I, BINDING SITE II or BINDING SITE III. Table 2 illustrates the complementarity of the nucleotide sequences of LOC201382 BINDING SITE, designated SEQ ID:42573, to the nucleotide sequence of VGAM1959 RNA, herein designated VGAM RNA, also designated SEQ ID:4670.

Another function of VGAM1959 is therefore inhibition of LOC201382 (Accession XM_113963). Accordingly, utilities of VGAM1959 include diagnosis, prevention and treatment of diseases and clinical conditions associated with LOC201382. LOC201627 (Accession XM_114353) is another VGAM1959 host target gene. LOC201627 BINDING SITE is HOST TARGET binding site found in the 3' untranslated region of mRNA encoded by LOC201627, corresponding to a HOST TARGET binding site such as BINDING SITE I, BINDING SITE II or BINDING SITE III. Table 2 illustrates the complementarity of the nucleotide sequences of LOC201627 BINDING SITE, designated SEQ ID:42897, to the nucleotide sequence of VGAM1959 RNA, herein designated VGAM RNA, also designated SEQ ID:4670.

Another function of VGAM1959 is therefore inhibition of LOC201627 (Accession XM_114353). Accordingly, utilities of VGAM1959 include diagnosis, prevention and treatment of diseases and clinical conditions associated with LOC201627. LOC201911 (Accession XM_117339) is another VGAM1959 host target gene. LOC201911 BINDING SITE is HOST TARGET binding site found in the 5' untranslated region of mRNA encoded by LOC201911, corresponding to a HOST TARGET binding site such as BINDING SITE I, BINDING SITE II or BINDING SITE III. Table 2 illustrates the complementarity of the nucleotide sequences of LOC201911 BINDING SITE, designated SEQ ID:43392, to the nucleotide sequence of VGAM1959 RNA, herein designated VGAM RNA, also designated SEQ ID:4670.

Another function of VGAM1959 is therefore inhibition of LOC201911 (Accession XM_117339). Accordingly, utilities of VGAM1959 include diagnosis, prevention and treatment of diseases and clinical conditions associated with LOC201911. LOC204804 (Accession XM_115599) is another VGAM1959 host target gene. LOC204804 BINDING SITE is HOST TARGET binding site found in the 3' untranslated region of mRNA encoded by LOC204804, corresponding to a HOST TARGET binding site such as BINDING SITE I, BINDING SITE II or BINDING SITE III. Table 2 illustrates the complementarity of the nucleotide sequences of LOC204804 BINDING SITE, designated SEQ ID:43099, to the nucleotide sequence of VGAM1959 RNA, herein designated VGAM RNA, also designated SEQ ID:4670.

Another function of VGAM1959 is therefore inhibition of LOC204804 (Accession XM_115599). Accordingly, utilities of VGAM1959 include diagnosis, prevention and treatment of diseases and clinical conditions associated with LOC204804. LOC204820 (Accession XM_119323) is another VGAM1959 host target gene. LOC204820 BINDING SITE is HOST TARGET binding site found in the 3' untranslated region of mRNA encoded by LOC204820, corresponding to a HOST TARGET binding site such as BINDING SITE I, BINDING SITE II or BINDING SITE III. Table 2 illustrates the complementarity of the nucleotide sequences of LOC204820 BINDING SITE, designated SEQ ID:43584, to the nucleotide sequence of VGAM1959 RNA, herein designated VGAM RNA, also designated SEQ ID:4670.

Another function of VGAM1959 is therefore inhibition of LOC204820 (Accession XM_119323). Accordingly, utilities of VGAM1959 include diagnosis, prevention and treatment of diseases and clinical conditions associated with LOC204820. LOC206463 (Accession XM_116523) is another VGAM1959 host target gene. LOC206463 BINDING SITE is HOST TARGET binding site found in the 5' untranslated region of mRNA encoded by LOC206463, corresponding to a HOST TARGET binding site such as BINDING SITE I, BINDING SITE II or BINDING SITE III. Table 2 illustrates the complementarity of the nucleotide sequences of LOC206463 BINDING SITE, designated SEQ ID:43123, to the nucleotide sequence of VGAM1959 RNA, herein designated VGAM RNA, also designated SEQ ID:4670.

Another function of VGAM1959 is therefore inhibition of LOC206463 (Accession XM_116523). Accordingly, utilities of VGAM1959 include diagnosis, prevention and treatment of diseases and clinical conditions associated with LOC206463. LOC219793 (Accession XM_166127) is another VGAM1959 host target gene. LOC219793 BINDING SITE is HOST TARGET binding site found in the 5' untranslated region of mRNA encoded by LOC219793, corresponding to a HOST TARGET binding site such as BINDING SITE I, BINDING SITE II or BINDING SITE III. Table 2 illustrates the complementarity of the nucleotide sequences of LOC219793 BINDING SITE, designated SEQ ID:43916, to the nucleotide sequence of VGAM1959 RNA, herein designated VGAM RNA, also designated SEQ ID:4670.

Another function of VGAM1959 is therefore inhibition of LOC219793 (Accession XM_166127). Accordingly, utilities of VGAM1959 include diagnosis, prevention and treatment of diseases and clinical conditions associated with LOC219793. LOC220018 (Accession XM_167816) is another VGAM1959 host target gene. LOC220018 BINDING SITE is HOST TARGET binding site found in the 5' untranslated region of mRNA encoded by LOC220018, corresponding to a HOST TARGET binding site such as BINDING SITE I, BINDING SITE II or BINDING SITE III. Table 2 illustrates the complementarity of the nucleotide sequences of LOC220018 BINDING SITE, designated SEQ ID:44854, to the nucleotide sequence of VGAM1959 RNA, herein designated VGAM RNA, also designated SEQ ID:4670.

Another function of VGAM1959 is therefore inhibition of LOC220018 (Accession XM_167816). Accordingly, utilities of VGAM1959 include diagnosis, prevention and treatment of diseases and clinical conditions associated with LOC220018. LOC220020 (Accession XM_167821) is another VGAM1959 host target gene. LOC220020 BINDING SITE is HOST TARGET binding site found in the 5' untranslated region of mRNA encoded by LOC220020, corresponding to a HOST TARGET binding site such as BINDING SITE I, BINDING SITE II or BINDING SITE III. Table 2 illustrates the complementarity of the nucleotide sequences of LOC220020 BINDING SITE, designated SEQ ID:44864, to the nucleotide sequence of VGAM1959 RNA, herein designated VGAM RNA, also designated SEQ ID:4670.

Another function of VGAM1959 is therefore inhibition of LOC220020 (Accession XM_167821). Accordingly, utilities of VGAM1959 include diagnosis, prevention and treatment of diseases and clinical conditions associated with LOC220020. LOC220705 (Accession XM_166000) is another VGAM1959 host target gene. LOC220705 BINDING SITE is HOST TARGET binding site found in the 3' untranslated region of mRNA encoded by LOC220705, corresponding to a HOST TARGET binding site such as BINDING SITE I, BINDING SITE II or BINDING SITE III. Table 2 illustrates the complementarity of the nucleotide sequences of LOC220705 BINDING SITE, designated SEQ ID:43833, to the nucleotide sequence of VGAM1959 RNA, herein designated VGAM RNA, also designated SEQ ID:4670.

Another function of VGAM1959 is therefore inhibition of LOC220705 (Accession XM_166000). Accordingly, utilities of VGAM1959 include diagnosis, prevention and treatment of diseases and clinical conditions associated with LOC220705. LOC220766 (Accession XM_165471) is another VGAM1959 host target gene. LOC220766 BINDING SITE is HOST TARGET binding site found in the 5' untranslated region of mRNA encoded by LOC220766, corresponding to a HOST TARGET binding site such as BINDING SITE I, BINDING SITE II or BINDING SITE III. Table 2 illustrates the complementarity of the nucleotide sequences of LOC220766 BINDING SITE, designated SEQ ID:43657, to the nucleotide sequence of VGAM1959 RNA, herein designated VGAM RNA, also designated SEQ ID:4670.

Another function of VGAM1959 is therefore inhibition of LOC220766 (Accession XM_165471). Accordingly, utilities of VGAM1959 include diagnosis, prevention and treatment of diseases and clinical conditions associated with LOC220766. LOC221143 (Accession XM_167986) is another VGAM1959 host target gene. LOC221143 BINDING SITE is HOST TARGET binding site found in the 3' untranslated region of mRNA encoded by LOC221143, corresponding to a HOST TARGET binding site such as BINDING SITE I, BINDING SITE II or BINDING SITE III. Table 2 illustrates the complementarity of the nucleotide sequences of LOC221143 BINDING SITE, designated SEQ ID:44943, to the nucleotide sequence of VGAM1959 RNA, herein designated VGAM RNA, also designated SEQ ID:4670.

Another function of VGAM1959 is therefore inhibition of LOC221143 (Accession XM_167986). Accordingly, utilities of VGAM1959 include diagnosis, prevention and treatment of diseases and clinical conditions associated with LOC221143. LOC221178 (Accession XM_167936) is another VGAM1959 host target gene. LOC221178 BINDING SITE is HOST TARGET binding site found in the 5' untranslated region of mRNA encoded by LOC221178, corresponding to a HOST TARGET binding site such as BINDING SITE I, BINDING SITE II or BINDING SITE III. Table 2 illustrates the complementarity of the nucleotide sequences of LOC221178 BINDING SITE, designated SEQ ID:44928, to the nucleotide sequence of VGAM1959 RNA, herein designated VGAM RNA, also designated SEQ ID:4670.

Another function of VGAM1959 is therefore inhibition of LOC221178 (Accession XM_167936). Accordingly, utilities of VGAM1959 include diagnosis, prevention and treatment of diseases and clinical conditions associated with LOC221178. LOC221415 (Accession XM_168137) is another VGAM1959 host target gene. LOC221415 BINDING SITE is HOST TARGET binding site found in the 5' untranslated region of mRNA encoded by LOC221415, corresponding to a HOST TARGET binding site such as BINDING SITE I, BINDING SITE II or BINDING SITE III. Table 2 illustrates the complementarity of the nucleotide sequences of LOC221415 BINDING SITE, designated SEQ ID:45064, to the nucleotide sequence of VGAM1959 RNA, herein designated VGAM RNA, also designated SEQ ID:4670.

Another function of VGAM1959 is therefore inhibition of LOC221415 (Accession XM_168137). Accordingly, utilities of VGAM1959 include diagnosis, prevention and treatment of diseases and clinical conditions associated with LOC221415. LOC221496 (Accession XM_166338) is another VGAM1959 host target gene. LOC221496 BINDING SITE is HOST TARGET binding site found in the 3' untranslated region of mRNA encoded by LOC221496, corresponding to a HOST TARGET binding site such as BINDING SITE I, BINDING SITE II or BINDING SITE III. Table 2 illustrates the complementarity of the nucleotide sequences of LOC221496 BINDING SITE, designated SEQ ID:44177, to the nucleotide sequence of VGAM1959 RNA, herein designated VGAM RNA, also designated SEQ ID:4670.

Another function of VGAM1959 is therefore inhibition of LOC221496 (Accession XM_166338). Accordingly, utilities of VGAM1959 include diagnosis, prevention and treatment of diseases and clinical conditions associated with LOC221496. LOC221692 (Accession XM_166420) is another VGAM1959 host target gene. LOC221692 BINDING SITE is HOST TARGET binding site found in the 3' untranslated region of mRNA encoded by LOC221692, corresponding to a HOST TARGET binding site such as BINDING SITE I, BINDING SITE II or BINDING SITE III. Table 2 illustrates the complementarity of the nucleotide sequences of LOC221692 BINDING SITE, designated SEQ ID:44297, to the nucleotide sequence of VGAM1959 RNA, herein designated VGAM RNA, also designated SEQ ID:4670.

Another function of VGAM1959 is therefore inhibition of LOC221692 (Accession XM_166420). Accordingly, utilities of VGAM1959 include diagnosis, prevention and treatment of diseases and clinical conditions associated with LOC221692. LOC221756 (Accession XM_166394) is another VGAM1959 host target gene. LOC221756 BINDING SITE is HOST TARGET binding site found in the 5' untranslated region of mRNA encoded by LOC221756, corresponding to a HOST TARGET binding site such as BINDING SITE I, BINDING SITE II or BINDING SITE III. Table 2 illustrates the complementarity of the nucleotide sequences of LOC221756 BINDING SITE, designated SEQ ID:44241, to the nucleotide sequence of VGAM1959 RNA, herein designated VGAM RNA, also designated SEQ ID:4670.

Another function of VGAM1959 is therefore inhibition of LOC221756 (Accession XM_166394). Accordingly, utilities of VGAM1959 include diagnosis, prevention and treatment of diseases and clinical conditions associated with LOC221756. LOC221922 (Accession XM_166555) is another VGAM1959 host target gene. LOC221922 BINDING SITE is HOST TARGET binding site found in the 5' untranslated region of mRNA encoded by LOC221922, corresponding to a HOST TARGET binding site such as BINDING SITE I, BINDING SITE II or BINDING SITE III. Table 2 illustrates the complementarity of the nucleotide sequences of LOC221922 BINDING SITE, designated SEQ ID:44533, to the nucleotide sequence of VGAM1959 RNA, herein designated VGAM RNA, also designated SEQ ID:4670.

Another function of VGAM1959 is therefore inhibition of LOC221922 (Accession XM_166555). Accordingly, utilities of VGAM1959 include diagnosis, prevention and treatment of diseases and clinical conditions associated with LOC221922. LOC222060 (Accession XM_168427) is another VGAM1959 host target gene. LOC222060 BINDING SITE is HOST TARGET binding site found in the 5' untranslated region of mRNA encoded by LOC222060, corresponding to a HOST TARGET binding site such as BINDING SITE I, BINDING SITE II or BINDING SITE III. Table 2 illustrates the complementarity of the nucleotide sequences of LOC222060 BINDING SITE, designated SEQ ID:45162, to the nucleotide sequence of VGAM1959 RNA, herein designated VGAM RNA, also designated SEQ ID:4670.

Another function of VGAM1959 is therefore inhibition of LOC222060 (Accession XM_168427). Accordingly, utilities of VGAM1959 include diagnosis, prevention and treatment of diseases and clinical conditions associated with LOC222060. LOC222134 (Accession XM_168432) is another VGAM1959 host target gene. LOC222134 BINDING SITE is HOST TARGET binding site found in the 5' untranslated region of mRNA encoded by LOC222134, corresponding to a HOST TARGET binding site such as BINDING SITE I, BINDING SITE II or BINDING SITE III. Table 2 illustrates the complementarity of the nucleotide sequences of LOC222134 BINDING SITE, designated SEQ ID:45171, to the nucleotide sequence of VGAM1959 RNA, herein designated VGAM RNA, also designated SEQ ID:4670.

Another function of VGAM1959 is therefore inhibition of LOC222134 (Accession XM_168432). Accordingly, utilities of VGAM1959 include diagnosis, prevention and treatment of diseases and clinical conditions associated with LOC222134. LOC222602 (Accession XM_167171) is another VGAM1959 host target gene. LOC222602 BINDING SITE is HOST TARGET binding site found in the 5' untranslated region of mRNA encoded by LOC222602, corresponding to a HOST TARGET binding site such as BINDING SITE I, BINDING SITE II or BINDING SITE III. Table 2 illustrates the complementarity of the nucleotide sequences of LOC222602 BINDING SITE, designated SEQ ID:44618, to the nucleotide sequence of VGAM1959 RNA, herein designated VGAM RNA, also designated SEQ ID:4670.

Another function of VGAM1959 is therefore inhibition of LOC222602 (Accession XM_167171). Accordingly, utilities of VGAM1959 include diagnosis, prevention and treatment of diseases and clinical conditions associated with LOC222602. LOC245727 (Accession XM_165913) is another VGAM1959 host target gene. LOC245727 BINDING SITE is HOST TARGET binding site found in the 3' untranslated region of mRNA encoded by LOC245727, corresponding to a HOST TARGET binding site such as BINDING SITE I, BINDING SITE II or BINDING SITE III. Table 2 illustrates the complementarity of the nucleotide sequences of LOC245727 BINDING SITE, designated SEQ ID:43798, to the nucleotide sequence of VGAM1959 RNA, herein designated VGAM RNA, also designated SEQ ID:4670.

Another function of VGAM1959 is therefore inhibition of LOC245727 (Accession XM_165913). Accordingly, utilities of VGAM1959 include diagnosis, prevention and treatment of diseases and clinical conditions associated with LOC245727. LOC245728 (Accession XM_165922) is another VGAM1959 host target gene. LOC245728 BINDING SITE is HOST TARGET binding site found in the 5' untranslated region of mRNA encoded by LOC245728, corresponding to a HOST TARGET binding site such as BINDING SITE I, BINDING SITE II or BINDING SITE III. Table 2 illustrates the complementarity of the nucleotide sequences of LOC245728 BINDING SITE, designated SEQ ID:43802, to the nucleotide sequence of VGAM1959 RNA, herein designated VGAM RNA, also designated SEQ ID:4670.

Another function of VGAM1959 is therefore inhibition of LOC245728 (Accession XM_165922). Accordingly, utilities of VGAM1959 include diagnosis, prevention and treatment of diseases and clinical conditions associated with LOC245728. LOC245771 (Accession XM_167366) is another VGAM1959 host target gene. LOC245771 BINDING SITE is HOST TARGET binding site found in the 5' untranslated region of mRNA encoded by LOC245771, corresponding to a HOST TARGET binding site such as BINDING SITE I, BINDING SITE II or BINDING SITE III. Table 2 illustrates the complementarity of the nucleotide sequences of LOC245771 BINDING SITE, designated SEQ ID:44636, to the nucleotide sequence of VGAM1959 RNA, herein designated VGAM RNA, also designated SEQ ID:4670.

Another function of VGAM1959 is therefore inhibition of LOC245771 (Accession XM_167366). Accordingly, utilities of VGAM1959 include diagnosis, prevention and treatment of diseases and clinical conditions associated with LOC245771. LOC253001 (Accession XM_171711) is another VGAM1959 host target gene. LOC253001 BINDING SITE is HOST TARGET binding site found in the 3' untranslated region of mRNA encoded by LOC253001, corresponding to a HOST TARGET binding site such as BINDING SITE I, BINDING SITE II or BINDING SITE III. Table 2 illustrates the complementarity of the nucleotide sequences of LOC253001 BINDING SITE, designated SEQ ID:46060, to the nucleotide sequence of VGAM1959 RNA, herein designated VGAM RNA, also designated SEQ ID:4670.

Another function of VGAM1959 is therefore inhibition of LOC253001 (Accession XM_171711). Accordingly, utilities of VGAM1959 include diagnosis, prevention and treatment of diseases and clinical conditions associated with LOC253001. LOC253216 (Accession XM_170765) is another VGAM1959 host target gene. LOC253216 BINDING SITE is HOST TARGET binding site found in the 3' untranslated region of mRNA encoded by LOC253216, corresponding to a HOST TARGET binding site such as BINDING SITE I, BINDING SITE II or BINDING SITE III. Table 2 illustrates the complementarity of the nucleotide sequences of LOC253216 BINDING SITE, designated SEQ ID:45521, to the nucleotide sequence of VGAM1959 RNA, herein designated VGAM RNA, also designated SEQ ID:4670.

Another function of VGAM1959 is therefore inhibition of LOC253216 (Accession XM_170765). Accordingly, utilities of VGAM1959 include diagnosis, prevention and treatment of diseases and clinical conditions associated with LOC253216. LOC253539 (Accession XM_171134) is another VGAM1959 host target gene. LOC253539 BINDING SITE is HOST TARGET binding site found in the 5' untranslated region of mRNA encoded by LOC253539, corresponding to a HOST TARGET binding site such as BINDING SITE I, BINDING SITE II or BINDING SITE III. Table 2 illustrates the complementarity of the nucleotide sequences of LOC253539 BINDING SITE, designated SEQ ID:45939, to the nucleotide sequence of VGAM1959 RNA, herein designated VGAM RNA, also designated SEQ ID:4670.

Another function of VGAM1959 is therefore inhibition of LOC253539 (Accession XM_171134). Accordingly, utilities of VGAM1959 include diagnosis, prevention and treatment of diseases and clinical conditions associated with LOC253539. LOC254228 (Accession XM_171123) is another VGAM1959 host target gene. LOC254228 BINDING SITE is HOST TARGET binding site found in the 3' untranslated region of mRNA encoded by LOC254228, corresponding to a HOST TARGET binding site such as BINDING SITE I, BINDING SITE II or BINDING SITE III. Table 2 illustrates the complementarity of the nucleotide sequences of LOC254228 BINDING SITE, designated SEQ ID:45921, to the nucleotide sequence of VGAM1959 RNA, herein designated VGAM RNA, also designated SEQ ID:4670.

Another function of VGAM1959 is therefore inhibition of LOC254228 (Accession XM_171123). Accordingly, utilities of VGAM1959 include diagnosis, prevention and treatment of diseases and clinical conditions associated with LOC254228. LOC255452 (Accession XM_174088) is another VGAM1959 host target gene. LOC255452 BINDING SITE is HOST TARGET binding site found in the 5' untranslated region of mRNA encoded by LOC255452, corresponding to a HOST TARGET binding site such as BINDING SITE I, BINDING SITE II or BINDING SITE III. Table 2 illustrates the complementarity of the nucleotide sequences of LOC255452 BINDING SITE, designated SEQ ID:46574, to the nucleotide sequence of VGAM1959 RNA, herein designated VGAM RNA, also designated SEQ ID:4670.

Another function of VGAM1959 is therefore inhibition of LOC255452 (Accession XM_174088). Accordingly, utilities of VGAM1959 include diagnosis, prevention and treatment of diseases and clinical conditions associated with LOC255452. LOC255458 (Accession XM_173150) is another VGAM1959 host target gene. LOC255458 BINDING SITE is HOST TARGET binding site found in the 5' untranslated region of mRNA encoded by LOC255458, corresponding to a HOST TARGET binding site such as BINDING SITE I, BINDING SITE II or BINDING SITE III. Table 2 illustrates the complementarity of the nucleotide sequences of LOC255458 BINDING SITE, designated SEQ ID:46407, to the nucleotide sequence of VGAM1959 RNA, herein designated VGAM RNA, also designated SEQ ID:4670.

Another function of VGAM1959 is therefore inhibition of LOC255458 (Accession XM_173150). Accordingly, utilities of VGAM1959 include diagnosis, prevention and treatment of diseases and clinical conditions associated with LOC255458. LOC255535 (Accession XM_171034) is another VGAM1959 host target gene. LOC255535 BINDING SITE is HOST TARGET binding site found in the 5' untranslated region of mRNA encoded by LOC255535, corresponding to a HOST TARGET binding site such as BINDING SITE I, BINDING SITE II or BINDING SITE III. Table 2 illustrates the complementarity of the nucleotide sequences of LOC255535 BINDING SITE, designated SEQ ID:45807, to the nucleotide sequence of VGAM1959 RNA, herein designated VGAM RNA, also designated SEQ ID:4670.

Another function of VGAM1959 is therefore inhibition of LOC255535 (Accession XM_171034). Accordingly, utilities of VGAM1959 include diagnosis, prevention and treatment of diseases and clinical conditions associated with LOC255535. LOC255743 (Accession XM_171089) is another VGAM1959 host target gene. LOC255743 BIND- ING SITE is HOST TARGET binding site found in the 5' untranslated region of mRNA encoded by LOC255743, corresponding to a HOST TARGET binding site such as BINDING SITE I, BINDING SITE II or BINDING SITE III. Table 2 illustrates the complementarity of the nucleotide sequences of LOC255743 BINDING SITE, designated SEQ ID:45902, to the nucleotide sequence of VGAM1959 RNA, herein designated VGAM RNA, also designated SEQ ID:4670.

Another function of VGAM1959 is therefore inhibition of LOC255743 (Accession XM_171089). Accordingly, utilities of VGAM1959 include diagnosis, prevention and treatment of diseases and clinical conditions associated with LOC255743. LOC256158 (Accession XM_175125) is another VGAM1959 host target gene. LOC256158 BINDING SITE1 through LOC256158 BINDING SITE3 are HOST TARGET binding sites found in untranslated regions of mRNA encoded by LOC256158, corresponding to HOST TARGET binding sites such as BINDING SITE I, BINDING SITE II or BINDING SITE III. Table 2 illustrates the complementarity of the nucleotide sequences of LOC256158 BINDING SITE1 through LOC256158 BINDING SITE3, designated SEQ ID:46622, SEQ ID:46623 and SEQ ID:46632 respectively, to the nucleotide sequence of VGAM1959 RNA, herein designated VGAM RNA, also designated SEQ ID:4670.

Another function of VGAM1959 is therefore inhibition of LOC256158 (Accession XM_175125). Accordingly, utilities of VGAM1959 include diagnosis, prevention and treatment of diseases and clinical conditions associated with LOC256158. LOC256307 (Accession XM_173118) is another VGAM1959 host target gene. LOC256307 BINDING SITE is HOST TARGET binding site found in the 5' untranslated region of mRNA encoded by LOC256307, corresponding to a HOST TARGET binding site such as BINDING SITE I, BINDING SITE II or BINDING SITE III. Table 2 illustrates the complementarity of the nucleotide sequences of LOC256307 BINDING SITE, designated SEQ ID:46370, to the nucleotide sequence of VGAM1959 RNA, herein designated VGAM RNA, also designated SEQ ID:4670.

Another function of VGAM1959 is therefore inhibition of LOC256307 (Accession XM_173118). Accordingly, utilities of VGAM1959 include diagnosis, prevention and treatment of diseases and clinical conditions associated with LOC256307. LOC256492 (Accession XM_174467) is another VGAM1959 host target gene. LOC256492 BINDING SITE is HOST TARGET binding site found in the 5' untranslated region of mRNA encoded by LOC256492, corresponding to a HOST TARGET binding site such as BINDING SITE I, BINDING SITE II or BINDING SITE III. Table 2 illustrates the complementarity of the nucleotide sequences of LOC256492 BINDING SITE, designated SEQ ID:46592, to the nucleotide sequence of VGAM1959 RNA, herein designated VGAM RNA, also designated SEQ ID:4670.

Another function of VGAM1959 is therefore inhibition of LOC256492 (Accession XM_174467). Accordingly, utilities of VGAM1959 include diagnosis, prevention and treatment of diseases and clinical conditions associated with LOC256492. LOC256781 (Accession XM_174695) is another VGAM1959 host target gene. LOC256781 BINDING SITE is HOST TARGET binding site found in the 5' untranslated region of mRNA encoded by LOC256781, corresponding to a HOST TARGET binding site such as BINDING SITE I, BINDING SITE II or BINDING SITE III. Table 2 illustrates the complementarity of the nucleotide sequences of LOC256781 BINDING SITE, designated SEQ ID:46602, to the nucleotide sequence of VGAM1959 RNA, herein designated VGAM RNA, also designated SEQ ID:4670.

Another function of VGAM1959 is therefore inhibition of LOC256781 (Accession XM_174695). Accordingly, utilities of VGAM1959 include diagnosis, prevention and treatment of diseases and clinical conditions associated with LOC256781. LOC256867 (Accession XM_170694) is another VGAM1959 host target gene. LOC256867 BINDING SITE1 and LOC256867 BINDING SITE2 are HOST TARGET binding sites found in untranslated regions of mRNA encoded by LOC256867, corresponding to HOST TARGET binding sites such as BINDING SITE I, BINDING SITE II or BINDING SITE III. Table 2 illustrates the complementarity of the nucleotide sequences of LOC256867 BINDING SITE1 and LOC256867 BINDING SITE2, designated SEQ ID:45473 and SEQ ID:45476 respectively, to the nucleotide sequence of VGAM1959 RNA, herein designated VGAM RNA, also designated SEQ ID:4670.

Another function of VGAM1959 is therefore inhibition of LOC256867 (Accession XM_170694). Accordingly, utilities of VGAM1959 include diagnosis, prevention and treatment of diseases and clinical conditions associated with LOC256867. LOC51308 (Accession NM_016606) is another VGAM1959 host target gene. LOC51308 BINDING SITE is HOST TARGET binding site found in the 3' untranslated region of mRNA encoded by LOC51308, corresponding to a HOST TARGET binding site such as BINDING SITE I, BINDING SITE II or BINDING SITE III. Table 2 illustrates the complementarity of the nucleotide sequences of LOC51308 BINDING SITE, designated SEQ ID:18710, to the nucleotide sequence of VGAM1959 RNA, herein designated VGAM RNA, also designated SEQ ID:4670.

Another function of VGAM1959 is therefore inhibition of LOC51308 (Accession NM_016606). Accordingly, utilities of VGAM1959 include diagnosis, prevention and treatment of diseases and clinical conditions associated with LOC51308. LOC51334 (Accession NM_016644) is another VGAM1959 host target gene. LOC51334 BINDING SITE is HOST TARGET binding site found in the 5' untranslated region of mRNA encoded by LOC51334, corresponding to a HOST TARGET binding site such as BINDING SITE I, BINDING SITE II or BINDING SITE III. Table 2 illustrates the complementarity of the nucleotide sequences of LOC51334 BINDING SITE, designated SEQ ID:18751, to the nucleotide sequence of VGAM1959 RNA, herein designated VGAM RNA, also designated SEQ ID:4670.

Another function of VGAM1959 is therefore inhibition of LOC51334 (Accession NM_016644). Accordingly, utilities of VGAM1959 include diagnosis, prevention and treatment of diseases and clinical conditions associated with LOC51334. LOC85028 (Accession NM_053040) is another VGAM1959 host target gene. LOC85028 BINDING SITE is HOST TARGET binding site found in the 5' untranslated region of mRNA encoded by LOC85028, corresponding to a HOST TARGET binding site such as BINDING SITE I, BINDING SITE II or BINDING SITE III. Table 2 illustrates the complementarity of the nucleotide sequences of LOC85028 BINDING SITE, designated SEQ ID:27585, to the nucleotide sequence of VGAM1959 RNA, herein designated VGAM RNA, also designated SEQ ID:4670.

Another function of VGAM1959 is therefore inhibition of LOC85028 (Accession NM_053040). Accordingly, utilities of VGAM1959 include diagnosis, prevention and treatment of diseases and clinical conditions associated with LOC85028. LOC90249 (Accession XM_030300) is another VGAM1959 host target gene. LOC90249 BINDING SITE is HOST TARGET binding site found in the 3' untranslated region of mRNA encoded by LOC90249, corresponding to a HOST TARGET binding site such as BINDING SITE I, BINDING SITE II or BINDING SITE III. Table 2 illustrates the complementarity of the nucleotide sequences of LOC90249 BINDING SITE, designated SEQ ID:31008, to the nucleotide sequence of VGAM1959 RNA, herein designated VGAM RNA, also designated SEQ ID:4670.

Another function of VGAM1959 is therefore inhibition of LOC90249 (Accession XM_030300). Accordingly, utilities of VGAM1959 include diagnosis, prevention and treatment of diseases and clinical conditions associated with LOC90249. LOC90342 (Accession XM_031009) is another VGAM1959 host target gene. LOC90342 BINDING SITE is HOST TARGET binding site found in the 5' untranslated region of mRNA encoded by LOC90342, corresponding to a HOST TARGET binding site such as BINDING SITE I, BINDING SITE II or BINDING SITE III. Table 2 illustrates the complementarity of the nucleotide sequences of LOC90342 BINDING SITE, designated SEQ ID:31257, to the nucleotide sequence of VGAM1959 RNA, herein designated VGAM RNA, also designated SEQ ID:4670.

Another function of VGAM1959 is therefore inhibition of LOC90342 (Accession XM_031009). Accordingly, utilities of VGAM1959 include diagnosis, prevention and treatment of diseases and clinical conditions associated with LOC90342. LOC90826 (Accession XM_034321) is another VGAM1959 host target gene. LOC90826 BINDING SITE is HOST TARGET binding site found in the 5' untranslated region of mRNA encoded by LOC90826, corresponding to a HOST TARGET binding site such as BINDING SITE I, BINDING SITE II or BINDING SITE III. Table 2 illustrates the complementarity of the nucleotide sequences of LOC90826 BINDING SITE, designated SEQ ID:32050, to the nucleotide sequence of VGAM1959 RNA, herein designated VGAM RNA, also designated SEQ ID:4670.

Another function of VGAM1959 is therefore inhibition of LOC90826 (Accession XM_034321). Accordingly, utilities of VGAM1959 include diagnosis, prevention and treatment of diseases and clinical conditions associated with LOC90826. LOC91040 (Accession XM_035641) is another VGAM1959 host target gene. LOC91040 BINDING SITE1 and LOC91040 BINDING SITE2 are HOST TARGET binding sites found in untranslated regions of mRNA encoded by LOC91040, corresponding to HOST TARGET binding sites such as BINDING SITE I, BINDING SITE II or BINDING SITE III. Table 2 illustrates the complementarity of the nucleotide sequences of LOC91040 BINDING SITE1 and LOC91040 BINDING SITE2, designated SEQ ID:32316 and SEQ ID:32322 respectively, to the nucleotide sequence of VGAM1959 RNA, herein designated VGAM RNA, also designated SEQ ID:4670.

Another function of VGAM1959 is therefore inhibition of LOC91040 (Accession XM_035641). Accordingly, utilities of VGAM1959 include diagnosis, prevention and treatment of diseases and clinical conditions associated with LOC91040. LOC91355 (Accession XM_037825) is another VGAM1959 host target gene. LOC91355 BINDING SITE1 and LOC91355 BINDING SITE2 are HOST TARGET binding sites found in untranslated regions of mRNA encoded by LOC91355, corresponding to HOST TARGET binding sites such as BINDING SITE I, BINDING SITE II or BINDING SITE III. Table 2 illustrates the complementarity of the nucleotide sequences of LOC91355 BINDING SITE1 and LOC91355 BINDING SITE2, designated SEQ ID:32705 and SEQ ID:32808 respectively, to the nucleotide sequence of VGAM1959 RNA, herein designated VGAM RNA, also designated SEQ ID:4670.

Another function of VGAM1959 is therefore inhibition of LOC91355 (Accession XM_037825). Accordingly, utilities of VGAM1959 include diagnosis, prevention and treatment of diseases and clinical conditions associated with LOC91355. LOC91464 (Accession XM_038589) is another VGAM1959 host target gene. LOC91464 BINDING SITE is HOST TARGET binding site found in the 5' untranslated region of mRNA encoded by LOC91464, corresponding to a HOST TARGET binding site such as BINDING SITE I, BINDING SITE II or BINDING SITE III. Table 2 illustrates the complementarity of the nucleotide sequences of LOC91464 BINDING SITE, designated SEQ ID:32874, to the nucleotide sequence of VGAM1959 RNA, herein designated VGAM RNA, also designated SEQ ID:4670.

Another function of VGAM1959 is therefore inhibition of LOC91464 (Accession XM_038589). Accordingly, utilities of VGAM1959 include diagnosis, prevention and treatment of diseases and clinical conditions associated with LOC91464. LOC91565 (Accession XM_039231) is another VGAM1959 host target gene. LOC91565 BINDING SITE is HOST TARGET binding site found in the 5' untranslated region of mRNA encoded by LOC91565, corresponding to a HOST TARGET binding site such as BINDING SITE I, BINDING SITE II or BINDING SITE III. Table 2 illustrates the complementarity of the nucleotide sequences of LOC91565 BINDING SITE, designated SEQ ID:33023, to the nucleotide sequence of VGAM1959 RNA, herein designated VGAM RNA, also designated SEQ ID:4670.

Another function of VGAM1959 is therefore inhibition of LOC91565 (Accession XM_039231). Accordingly, utilities of VGAM1959 include diagnosis, prevention and treatment of diseases and clinical conditions associated with LOC91565. LOC91782 (Accession XM_040612) is another VGAM1959 host target gene. LOC91782 BINDING SITE is HOST TARGET binding site found in the 3' untranslated region of mRNA encoded by LOC91782, corresponding to a HOST TARGET binding site such as BINDING SITE I, BINDING SITE II or BINDING SITE III. Table 2 illustrates the complementarity of the nucleotide sequences of LOC91782 BINDING SITE, designated SEQ ID:33336, to the nucleotide sequence of VGAM1959 RNA, herein designated VGAM RNA, also designated SEQ ID:4670.

Another function of VGAM1959 is therefore inhibition of LOC91782 (Accession XM_040612). Accordingly, utilities of VGAM1959 include diagnosis, prevention and treatment of diseases and clinical conditions associated with LOC91782. LOC91828 (Accession XM_040910) is another VGAM1959 host target gene. LOC91828 BINDING SITE1 and LOC91828 BINDING SITE2 are HOST TARGET binding sites found in untranslated regions of mRNA encoded by LOC91828, corresponding to HOST TARGET binding sites such as BINDING SITE I, BINDING SITE II or BINDING SITE III. Table 2 illustrates the complementarity of the nucleotide sequences of LOC91828 BINDING SITE1 and LOC91828 BINDING SITE2, designated SEQ ID:33407 and SEQ ID:33409 respectively, to the nucleotide sequence of VGAM1959 RNA, herein designated VGAM RNA, also designated SEQ ID:4670.

Another function of VGAM1959 is therefore inhibition of LOC91828 (Accession XM_040910). Accordingly, utilities of VGAM1959 include diagnosis, prevention and treatment of diseases and clinical conditions associated with LOC91828. LOC92162 (Accession XM_043273) is another VGAM1959 host target gene. LOC92162 BINDING SITE is HOST TARGET binding site found in the 5' untranslated region of mRNA encoded by LOC92162, corresponding to a HOST TARGET binding site such as BINDING SITE I, BINDING SITE II or BINDING SITE III. Table 2 illustrates the complementarity of the nucleotide sequences of LOC92162 BINDING SITE, designated SEQ ID:33921, to the nucleotide sequence of VGAM1959 RNA, herein designated VGAM RNA, also designated SEQ ID:4670.

Another function of VGAM1959 is therefore inhibition of LOC92162 (Accession XM_043273). Accordingly, utilities of VGAM1959 include diagnosis, prevention and treatment of diseases and clinical conditions associated with LOC92162. LOC92230 (Accession XM_043733) is another VGAM1959 host target gene. LOC92230 BINDING SITE is HOST TARGET binding site found in the 5' untranslated region of mRNA encoded by LOC92230, corresponding to a HOST TARGET binding site such as BINDING SITE I, BINDING SITE II or BINDING SITE III. Table 2 illustrates the complementarity of the nucleotide sequences of LOC92230 BINDING SITE, designated SEQ ID:34007, to the nucleotide sequence of VGAM1959 RNA, herein designated VGAM RNA, also designated SEQ ID:4670.

Another function of VGAM1959 is therefore inhibition of LOC92230 (Accession XM_043733). Accordingly, utilities of VGAM1959 include diagnosis, prevention and treatment of diseases and clinical conditions associated with LOC92230. LOC93109 (Accession XM_049278) is another VGAM1959 host target gene. LOC93109 BINDING SITE is HOST TARGET binding site found in the 3' untranslated region of mRNA encoded by LOC93109, corresponding to a HOST TARGET binding site such as BINDING SITE I, BINDING SITE II or BINDING SITE III. Table 2 illustrates the complementarity of the nucleotide sequences of LOC93109 BINDING SITE, designated SEQ ID:35374, to the nucleotide sequence of VGAM1959 RNA, herein designated VGAM RNA, also designated SEQ ID:4670.

Another function of VGAM1959 is therefore inhibition of LOC93109 (Accession XM_049278). Accordingly, utilities of VGAM1959 include diagnosis, prevention and treatment of diseases and clinical conditions associated with LOC93109. LOC93444 (Accession XM_051455) is another VGAM1959 host target gene. LOC93444 BINDING SITE is HOST TARGET binding site found in the 3' untranslated region of mRNA encoded by LOC93444, corresponding to a HOST TARGET binding site such as BINDING SITE I, BINDING SITE II or BINDING SITE III. Table 2 illustrates the complementarity of the nucleotide sequences of LOC93444 BINDING SITE, designated SEQ ID:35844, to the nucleotide sequence of VGAM1959 RNA, herein designated VGAM RNA, also designated SEQ ID:4670.

Another function of VGAM1959 is therefore inhibition of LOC93444 (Accession XM_051455). Accordingly, utilities of VGAM1959 include diagnosis, prevention and treatment of diseases and clinical conditions associated with LOC93444. LOC95702 (Accession XM_031446) is another VGAM1959 host target gene. LOC95702 BINDING SITE is HOST TARGET binding site found in the 5' untranslated region of mRNA encoded by LOC95702, corresponding to a HOST TARGET binding site such as BINDING SITE I, BINDING SITE II or BINDING SITE III. Table 2 illustrates the complementarity of the nucleotide sequences of LOC95702 BINDING SITE, designated SEQ ID:31384, to the nucleotide sequence of VGAM1959 RNA, herein designated VGAM RNA, also designated SEQ ID:4670.

Another function of VGAM1959 is therefore inhibition of LOC95702 (Accession XM_031446). Accordingly, utilities of VGAM1959 include diagnosis, prevention and treatment of diseases and clinical conditions associated with LOC95702. LOC96597 (Accession XM_039922) is another VGAM1959 host target gene. LOC96597 BINDING SITE is HOST TARGET binding site found in the 5' untranslated region of mRNA encoded by LOC96597, corresponding to a HOST TARGET binding site such as BINDING SITE I, BINDING SITE II or BINDING SITE III. Table 2 illustrates the complementarity of the nucleotide sequences of LOC96597 BINDING SITE, designated SEQ ID:33233, to the nucleotide sequence of VGAM1959 RNA, herein designated VGAM RNA, also designated SEQ ID:4670.

Another function of VGAM1959 is therefore inhibition of LOC96597 (Accession XM_039922). Accordingly, utilities of VGAM1959 include diagnosis, prevention and treatment of diseases and clinical conditions associated with LOC96597. FIG. 1 further provides a conceptual description of a novel bioinformatically detected viral gene of the present invention, referred to here as Viral Genomic Address Messenger 1960 (VGAM1960) viral gene, which modulates expression of respective host target genes thereof, the function and utility of which host target genes is known in the art.

VGAM1960 is a novel bioinformatically detected regulatory, non protein coding, viral micro RNA (miRNA) gene. The method by which VGAM1960 was detected is described hereinabove with reference to FIGS. 1-8.

VGAM1960 gene, herein designated VGAM GENE, is a viral gene contained in the genome of Macaca Mulatta Rhadinovirus. VGAM1960 host target gene, herein designated VGAM HOST TARGET GENE, is a human gene contained in the human genome.

VGAM1960 gene encodes a VGAM1960 precursor RNA, herein designated VGAM PRECURSOR RNA. Similar to other miRNA genes, and unlike most ordinary genes, VGAM1960 precursor RNA does not encode a protein. A nucleotide sequence identical or highly similar to the nucleotide sequence of VGAM1960 precursor RNA is designated SEQ ID:1946, and is provided hereinbelow with reference to the sequence listing part. Nucleotide sequence SEQ ID:1946 is located at position 10523 relative to the genome of Macaca Mulatta Rhadinovirus.

VGAM1960 precursor RNA folds onto itself, forming VGAM1960 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1960 folded precursor RNA into VGAM1960 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1960 RNA is designated SEQ ID:4671, and is provided hereinbelow with reference to the sequence listing part.

VGAM1960 host target gene, herein designated VGAM HOST TARGET GENE, encodes a corresponding messenger RNA, VGAM1960 host target RNA, herein designated VGAM HOST TARGET RNA. VGAM1960 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1960 RNA, herein designated VGAM RNA, binds complementarily to one or more host target binding sites located in untranslated regions of VGAM1960 host target RNA, herein designated VGAM HOST TARGET RNA. This complementary binding is due to the fact that the nucleotide sequence of VGAM1960 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1960 RNA, herein designated VGAM RNA, may have a different number of host target binding sites in untranslated regions of a VGAM1960 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1960 RNA, herein designated VGAM RNA, to host target binding sites on VGAM1960 host target RNA, herein designated VGAM HOST TARGET RNA, such as BINDING SITE I, BINDING SITE II and BINDING SITE III, inhibits translation of VGAM1960 host target RNA into VGAM1960 host target protein, herein designated VGAM HOST TARGET PROTEIN. VGAM host target protein is therefore outlined by a broken line.

It is appreciated that VGAM1960 host target gene, herein designated VGAM HOST TARGET GENE, in fact represents a plurality of VGAM1960 host target genes. The mRNA of each one of this plurality of VGAM1960 host target genes comprises one or more host target binding sites, each having a nucleotide sequence which is at least partly complementary to VGAM1960 RNA, herein designated VGAM RNA, and which when bound by VGAM1960 RNA causes inhibition of translation of respective one or more VGAM1960 host target proteins.

It is further appreciated by one skilled in the art that the mode of translational inhibition illustrated by FIG. 1 with specific reference to translational inhibition exerted by VGAM1960 gene, herein designated VGAM GENE, on one or more VGAM1960 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1960 is inhibition of expression of host target genes, as part of a novel viral mechanism of attacking a host. Accordingly, utilities of VGAM1960 include diagnosis, prevention and treatment of viral infection by Macaca Mulatta Rhadinovirus. Specific functions, and accordingly utilities, of VGAM1960 correlate with, and may be deduced from, the identity of the host target genes which VGAM1960 binds and inhibits, and the function of these host target genes, as elaborated hereinbelow.

Nucleotide sequences of the VGAM1960 precursor RNA, herein designated VGAM PRECURSOR RNA, and of the 'diced' VGAM1960 RNA, herein designated VGAM RNA, and a schematic representation of the secondary folding of VGAM1960 folded precursor RNA, herein designated VGAM FOLDED PRECURSOR RNA, of VGAM1960 are further described hereinbelow with reference to Table 1.

Nucleotide sequences of host target binding sites, such as BINDING SITE-I, BINDING SITE-II and BINDING SITE-III of FIG. 1, found on VGAM1960 host target RNA, and schematic representation of the complementarity of each of these host target binding sites to VGAM1960 RNA, herein designated VGAM RNA, are described hereinbelow with reference to Table 2.

As mentioned hereinabove with reference to FIG. 1, a function of VGAM1960 gene, herein designated VGAM is inhibition of expression of VGAM1960 target genes. It is appreciated that specific functions, and accordingly utilities, of VGAM1960 correlate with, and may be deduced from, the identity of the target genes which VGAM1960 binds and inhibits, and the function of these target genes, as elaborated hereinbelow.

Angiotensin II Receptor, Type 1 (AGTR1, Accession NM_000685) is a VGAM1960 host target gene. AGTR1 BINDING SITE1 through AGTR1 BINDING SITE5 are HOST TARGET binding sites found in untranslated regions of mRNA encoded by AGTR1, corresponding to HOST TARGET binding sites such as BINDING SITE I, BINDING SITE II or BINDING SITE III. Table 2 illustrates the complementarity of the nucleotide sequences of AGTR1 BINDING SITE1 through AGTR1 BINDING SITE5, designated SEQ ID:6342, SEQ ID:11243, SEQ ID:14309, SEQ ID:25594 and SEQ ID:25769 respectively, to the nucleotide sequence of VGAM1960 RNA, herein designated VGAM RNA, also designated SEQ ID:4671.

A function of VGAM1960 is therefore inhibition of Angiotensin II Receptor, Type 1 (AGTR1, Accession NM_000685), a gene which is an important effector controlling blood pressure and volume in the cardiovascular system. Accordingly, utilities of VGAM1960 include diagnosis, prevention and treatment of diseases and clinical conditions associated with AGTR1. The function of AGTR1 and its association with various diseases and clinical conditions, has been established by previous studies, as described hereinabove with reference to VGAM96. Rac/Cdc42 Guanine Nucleotide Exchange Factor (GEF) 6 (ARHGEF6, Accession XM_042963) is another VGAM1960 host target gene. ARHGEF6 BINDING SITE is HOST TARGET binding site found in the 3' untranslated region of mRNA encoded by ARHGEF6, corresponding to a HOST TARGET binding site such as BINDING SITE I, BINDING SITE II or BINDING SITE III. Table 2 illustrates the complementarity of the nucleotide sequences of ARHGEF6 BINDING SITE, designated SEQ ID:33848, to the nucleotide sequence of VGAM1960 RNA, herein designated VGAM RNA, also designated SEQ ID:4671.

Another function of VGAM1960 is therefore inhibition of Rac/Cdc42 Guanine Nucleotide Exchange Factor (GEF) 6 (ARHGEF6, Accession XM_042963). Accordingly, utilities of VGAM1960 include diagnosis, prevention and treatment of diseases and clinical conditions associated with ARHGEF6. Alpha Thalassemia/mental Retardation Syndrome X-linked (RAD54 homolog, S. cerevisiae) (ATRX, Accession NM_138271) is another VGAM1960 host target gene. ATRX BINDING SITE1 and ATRX BINDING SITE2 are HOST TARGET binding sites found in untranslated regions of mRNA encoded by ATRX, corresponding to HOST TARGET binding sites such as BINDING SITE I, BINDING SITE II or BINDING SITE III. Table 2 illustrates the complementarity of the nucleotide sequences of ATRX BINDING SITE1 and ATRX BINDING SITE2, designated SEQ ID:28685 and SEQ ID:6096 respectively, to the nucleotide sequence of VGAM1960 RNA, herein designated VGAM RNA, also designated SEQ ID:4671.

Another function of VGAM1960 is therefore inhibition of Alpha Thalassemia/mental Retardation Syndrome X-linked (RAD54 homolog, S. cerevisiae) (ATRX, Accession NM_138271). Accordingly, utilities of VGAM1960 include diagnosis, prevention and treatment of diseases and clinical conditions associated with ATRX. Caldesmon 1 (CALD1, Accession NM_033138) is another VGAM1960 host target gene. CALD1 BINDING SITE1 and CALD1 BINDING SITE2 are HOST TARGET binding sites found in untranslated regions of mRNA encoded by CALD1, corresponding to HOST TARGET binding sites such as BINDING SITE I, BINDING SITE II or BINDING SITE III. Table 2 illustrates the complementarity of the nucleotide sequences of CALD1 BINDING SITE1 and CALD1 BINDING SITE2, designated SEQ ID:26992 and SEQ ID:27010 respectively, to the nucleotide sequence of VGAM1960 RNA, herein designated VGAM RNA, also designated SEQ ID:4671.

Another function of VGAM1960 is therefore inhibition of Caldesmon 1 (CALD1, Accession NM_033138), a gene which is implicated in the regulation of actomyosin interactions in smooth muscle and nonmuscle cells. Accordingly, utilities of VGAM1960 include diagnosis, prevention and treatment of diseases and clinical conditions associated with CALD1. The function of CALD1 has been established by previous studies. Caldesmon is a potential actomyosin regulatory protein found in smooth muscle and nonmuscle cells. Domain mapping and physical studies suggested that CDM is an elongated molecule with an N-terminal myosin/calmodulin-binding domain and a C-terminal tropomyosin/actin/calmodulin-binding domain separated by a 40-nm-long central helix. Humphrey et al. (1992) used a probe encoding part of avian caldesmon to screen a human aorta library and clone smooth-muscle and nonmuscle CDM-encoding cDNAs. The predicted smooth-muscle polypeptide is 793 amino acids long. As in the case of chicken CDM, nonmuscle CDM was missing the central helical domain of 256 amino acids. The nonmuscle form appeared to be generated by exon skipping. Humphrey et al. (1992) suggested that the CDMs are a small family of highly conserved proteins which are probably derived from a single gene. The high molecular weight caldesmon is predominantly expressed in smooth muscles, whereas the low molecular weight caldesmon is widely distributed in nonmuscle tissues and cells. Hayashi et al. (1992) demonstrated that the human CDM gene is composed of 14 exons. By fluorescence in situ hybridization, they showed that it is encoded by a single gene located at 7q33-q34. The regulation of high molecular weight and low molecular weight caldesmon expression was thought to depend on selection of the 2 5-prime splice sites within exon 3.

Full details of the abovementioned studies are described in the following publications, the disclosure of which are hereby incorporated by reference:

Hayashi, K.; Yano, H.; Hashida, T.; Takeuchi, R.; Takeda, O.; Asada, K.; Takahashi, E.; Kato, I.; Sobue, K.: Genomic structure of the human caldesmon gene. Proc. Nat. Acad. Sci. 89:12122-12126, 1992; and Humphrey, M. B.; Herrera-Sosa, H.; Gonzalez, G.; Lee, R.; Bryan, J.: Cloning of cDNAs encoding human caldesmons. Gene 112:197-204, 1992.

Further studies establishing the function and utilities of CALD1 are found in John Hopkins OMIM database record ID 114213, and in sited publications numbered 4030-4031 listed in the bibliography section hereinbelow, which are also hereby incorporated by reference. Dihydropyrimidinase-like 2 (DPYSL2, Accession NM_001386) is another VGAM1960 host target gene. DPYSL2 BINDING SITE is HOST TARGET binding site found in the 3' untranslated region of mRNA encoded by DPYSL2, corresponding to a HOST TARGET binding site such as BINDING SITE I, BINDING SITE II or BINDING SITE III. Table 2 illustrates the complementarity of the nucleotide sequences of DPYSL2 BINDING SITE, designated SEQ ID:7064, to the nucleotide sequence of VGAM1960 RNA, herein designated VGAM RNA, also designated SEQ ID:4671.

Another function of VGAM1960 is therefore inhibition of Dihydropyrimidinase-like 2 (DPYSL2, Accession NM_001386), a gene which is a member of the dihydropyrimidinase family. Accordingly, utilities of VGAM1960 include diagnosis, prevention and treatment of diseases and clinical conditions associated with DPYSL2. The function of DPYSL2 and its association with various diseases and clinical conditions, has been established by previous studies, as described hereinabove with reference to VGAM217. E2F Transcription Factor 3 (E2F3, Accession NM_001949) is another VGAM1960 host target gene. E2F3 BINDING SITE is HOST TARGET binding site found in the 3' untranslated region of mRNA encoded by E2F3, corresponding to a HOST TARGET binding site such as BINDING SITE I, BINDING SITE II or BINDING SITE III. Table 2 illustrates the complementarity of the nucleotide sequences of E2F3 BINDING SITE, designated SEQ ID:7668, to the nucleotide sequence of VGAM1960 RNA, herein designated VGAM RNA, also designated SEQ ID:4671.

Another function of VGAM1960 is therefore inhibition of E2F Transcription Factor 3 (E2F3, Accession NM_001949), a gene which binds dna and controls cell-cycle progression from g1 to s phase. Accordingly, utilities of VGAM1960 include diagnosis, prevention and treatment of diseases and clinical conditions associated with E2F3. The function of E2F3 and its association with various diseases and clinical conditions, has been established by previous studies, as described hereinabove with reference to VGAM475. Coagulation Factor II (thrombin) Receptor (F2R, Accession NM_001992) is another VGAM1960 host target gene. F2R BINDING SITE is HOST TARGET binding site found in the 3' untranslated region of mRNA encoded by F2R, corresponding to a HOST TARGET binding site such as BINDING SITE I, BINDING SITE II or BINDING SITE III. Table 2 illustrates the complementarity of the nucleotide sequences of F2R BINDING SITE, designated SEQ ID:7723, to the nucleotide sequence of VGAM1960 RNA, herein designated VGAM RNA, also designated SEQ ID:4671.

Another function of VGAM1960 is therefore inhibition of Coagulation Factor II (thrombin) Receptor (F2R, Accession NM_001992), a gene which Thrombin receptor; G protein-coupled receptor involved in platelet activation. Accordingly, utilities of VGAM1960 include diagnosis, prevention and treatment of diseases and clinical conditions associated with F2R. The function of F2R and its association with various diseases and clinical conditions, has been established by previous studies, as described hereinabove with reference to VGAM140. F-box and Leucine-rich Repeat Protein 2 (FBXL2, Accession NM_012157) is another VGAM1960 host target gene. FBXL2 BINDING SITE is HOST TARGET binding site found in the 3' untranslated region of mRNA encoded by FBXL2, corresponding to a HOST TARGET binding site such as BINDING SITE I, BINDING SITE II or BINDING SITE III. Table 2 illustrates the complementarity of the nucleotide sequences of FBXL2 BINDING SITE, designated SEQ ID:14454, to the nucleotide sequence of VGAM1960 RNA, herein designated VGAM RNA, also designated SEQ ID:4671.

Another function of VGAM1960 is therefore inhibition of F-box and Leucine-rich Repeat Protein 2 (FBXL2, Accession NM_012157). Accordingly, utilities of VGAM1960 include diagnosis, prevention and treatment of diseases and clinical conditions associated with FBXL2. Glypican 1 (GPC1, Accession NM_002081) is another VGAM1960 host target gene. GPC1 BINDING SITE is HOST TARGET binding site found in the 3' untranslated region of mRNA encoded by GPC1, corresponding to a HOST TARGET binding site such as BINDING SITE I, BINDING SITE II or BINDING SITE III. Table 2 illustrates the complementarity of the nucleotide sequences of GPC1 BINDING SITE, designated SEQ ID:7875, to the nucleotide sequence of VGAM1960 RNA, herein designated VGAM RNA, also designated SEQ ID:4671.

Another function of VGAM1960 is therefore inhibition of Glypican 1 (GPC1, Accession NM_002081), a gene which may play a role in growth control and differentation. Accordingly, utilities of VGAM1960 include diagnosis, prevention and treatment of diseases and clinical conditions associated with GPC1. The function of GPC1 and its association with various diseases and clinical conditions, has been established by previous studies, as described hereinabove with reference to VGAM125. Hemochromatosis (HFE, Accession NM_000410) is another VGAM1960 host target gene. HFE BINDING SITE1 and HFE BINDING SITE2 are HOST TARGET binding sites found in untranslated regions of mRNA encoded by HFE, corresponding to HOST TARGET binding sites such as BINDING SITE I, BINDING SITE II or BINDING SITE III. Table 2 illustrates the complementarity of the nucleotide sequences of HFE BINDING SITE1 and HFE BINDING SITE2, designated SEQ ID:5985 and SEQ ID:29099 respectively, to the nucleotide sequence of VGAM1960 RNA, herein designated VGAM RNA, also designated SEQ ID:4671.

Another function of VGAM1960 is therefore inhibition of Hemochromatosis (HFE, Accession NM_000410). Accordingly, utilities of VGAM1960 include diagnosis, prevention and treatment of diseases and clinical conditions associated with HFE. Kinesin Family Member 5C (KIF5C, Accession NM_004522) is another VGAM1960 host target gene. KIF5C BINDING SITE is HOST TARGET binding site found in the 3' untranslated region of mRNA encoded by KIF5C, corresponding to a HOST TARGET binding site such as BINDING SITE I, BINDING SITE II or BINDING SITE III. Table 2 illustrates the complementarity of the nucleotide sequences of KIF5C BINDING SITE, designated SEQ ID:10855, to the nucleotide sequence of VGAM1960 RNA, herein designated VGAM RNA, also designated SEQ ID:4671.

Another function of VGAM1960 is therefore inhibition of Kinesin Family Member 5C (KIF5C, Accession NM_004522). Accordingly, utilities of VGAM1960 include diagnosis, prevention and treatment of diseases and clinical conditions associated with KIF5C. Leucine Zipper-EF-hand Containing Transmembrane Protein 1 (LETM1, Accession NM_012318) is another VGAM1960 host target gene. LETM1 BINDING SITE is HOST TARGET binding site found in the 3' untranslated region of mRNA encoded by LETM1, corresponding to a HOST TARGET binding site such as BINDING SITE I, BINDING SITE II or BINDING SITE III. Table 2 illustrates the complementarity of the nucleotide sequences of LETM1 BINDING SITE, designated SEQ ID:14698, to the nucleotide sequence of VGAM1960 RNA, herein designated VGAM RNA, also designated SEQ ID:4671.

Another function of VGAM1960 is therefore inhibition of Leucine Zipper-EF-hand Containing Transmembrane Protein 1 (LETM1, Accession NM_012318). Accordingly, utilities of VGAM1960 include diagnosis, prevention and treatment of diseases and clinical conditions associated with LETM1. Leukocyte Immunoglobulin-like Receptor, Subfamily B (with TM and ITIM domains), Member 4 (LILRB4, Accession NM_006847) is another VGAM1960 host target gene. LILRB4 BINDING SITE is HOST TARGET binding site found in the 3' untranslated region of mRNA encoded by LILRB4, corresponding to a HOST TARGET binding site such as BINDING SITE I, BINDING SITE II or BINDING SITE III. Table 2 illustrates the complementarity of the nucleotide sequences of LILRB4 BINDING SITE, designated SEQ ID:13717, to the nucleotide sequence of VGAM1960 RNA, herein designated VGAM RNA, also designated SEQ ID:4671.

Another function of VGAM1960 is therefore inhibition of Leukocyte Immunoglobulin-like Receptor, Subfamily B (with TM and ITIM domains), Member 4 (LILRB4, Accession NM_006847). Accordingly, utilities of VGAM1960 include diagnosis, prevention and treatment of diseases and clinical conditions associated with LILRB4. MAD, Mothers Against Decapentaplegic Homolog 4 (Drosophila) (MADH4, Accession NM_005359) is another VGAM1960 host target gene. MADH4 BINDING SITE is HOST TARGET binding site found in the 3' untranslated region of mRNA encoded by MADH4, corresponding to a HOST TARGET binding site such as BINDING SITE I, BINDING SITE II or BINDING SITE III. Table 2 illustrates the complementarity of the nucleotide sequences of MADH4 BINDING SITE, designated SEQ ID:11834, to the nucleotide sequence of VGAM1960 RNA, herein designated VGAM RNA, also designated SEQ ID:4671.

Another function of VGAM1960 is therefore inhibition of MAD, Mothers Against Decapentaplegic Homolog 4 (Drosophila) (MADH4, Accession NM_005359), a gene which common mediator of signal transduction by tgf-beta (transforming growth factor) superfamily; smad4 is the common smad (co-smad). promotes binding of the smad2/smad4/fast-1 complex to dna and provides an activation function required for smad1 or smad2 to stimulate transcription. may act as a tumor suppressor. Accordingly, utilities of VGAM1960 include diagnosis, prevention and treatment of diseases and clinical conditions associated with MADH4. The function of MADH4 and its association with various diseases and clinical conditions, has been established by previous studies, as described hereinabove with reference to VGAM217. Maltase-glucoamylase (alpha-glucosidase) (MGAM, Accession XM_051351) is another VGAM1960 host target gene. MGAM BINDING SITE is HOST TARGET binding site found in the 3' untranslated region of mRNA encoded by MGAM, corresponding to a HOST TARGET binding site such as BINDING SITE I, BINDING SITE II or BINDING SITE III. Table 2 illustrates the complementarity of the nucleotide sequences of MGAM BINDING SITE, designated SEQ ID:35827, to the nucleotide sequence of VGAM1960 RNA, herein designated VGAM RNA, also designated SEQ ID:4671.

Another function of VGAM1960 is therefore inhibition of Maltase-glucoamylase (alpha-glucosidase) (MGAM, Accession XM_051351), a gene which plays a role in the final steps of digestion of starch. Accordingly, utilities of VGAM1960 include diagnosis, prevention and treatment of diseases and clinical conditions associated with MGAM. The function of MGAM and its association with various diseases and clinical conditions, has been established by previous studies, as described hereinabove with reference to VGAM791. Neuroepithelial Cell Transforming Gene 1 (NET1, Accession NM_005863) is another VGAM1960 host target gene. NET1 BINDING SITE is HOST TARGET binding site found in the 3' untranslated region of mRNA encoded by NET1, corresponding to a HOST TARGET binding site such as BINDING SITE I, BINDING SITE II or BINDING SITE III. Table 2 illustrates the complementarity of the nucleotide sequences of NET1 BINDING SITE, designated SEQ ID:12474, to the nucleotide sequence of VGAM1960 RNA, herein designated VGAM RNA, also designated SEQ ID:4671.

Another function of VGAM1960 is therefore inhibition of Neuroepithelial Cell Transforming Gene 1 (NET1, Accession NM_005863), a gene which is induced morphologic alterations and conferred a malignant phenotype in vitro and in nude mice. Accordingly, utilities of VGAM1960 include diagnosis, prevention and treatment of diseases and clinical conditions associated with NET1. The function of NET1 and its association with various diseases and clinical conditions, has been established by previous studies, as described hereinabove with reference to VGAM1333. Neurotrophic Tyrosine Kinase, Receptor, Type 2 (NTRK2, Accession NM_006180) is another VGAM1960 host target gene. NTRK2 BINDING SITE is HOST TARGET binding site found in the 3' untranslated region of mRNA encoded by NTRK2, corresponding to a HOST TARGET binding site such as BINDING SITE I, BINDING SITE II or BINDING SITE III. Table 2 illustrates the complementarity of the nucleotide sequences of NTRK2 BINDING SITE, designated SEQ ID:12847, to the nucleotide sequence of VGAM1960 RNA, herein designated VGAM RNA, also designated SEQ ID:4671.

Another function of VGAM1960 is therefore inhibition of Neurotrophic Tyrosine Kinase, Receptor, Type 2 (NTRK2, Accession NM_006180), a gene which is involved in the development and/or maintenance of the nervous system. Accordingly, utilities of VGAM1960 include diagnosis, prevention and treatment of diseases and clinical conditions associated with NTRK2. The function of NTRK2 and its association with various diseases and clinical conditions, has been established by previous studies, as described hereinabove with reference to VGAM341. Procollagen-proline, 2-oxoglutarate 4-dioxygenase (proline 4-hydroxylase), Alpha Polypeptide I (P4HA1, Accession NM_000917) is another VGAM1960 host target gene. P4HA1 BINDING SITE is HOST TARGET binding site found in the 3' untranslated region of mRNA encoded by P4HA1, corresponding to a HOST TARGET binding site such as BINDING SITE I, BINDING SITE II or BINDING SITE III. Table 2 illustrates the complementarity of the nucleotide sequences of P4HA1 BINDING SITE, designated SEQ ID:6625, to the nucleotide sequence of VGAM1960 RNA, herein designated VGAM RNA, also designated SEQ ID:4671.

Another function of VGAM1960 is therefore inhibition of Procollagen-proline, 2-oxoglutarate 4-dioxygenase (proline 4-hydroxylase), Alpha Polypeptide I (P4HA1, Accession NM_000917), a gene which catalyzes the formation of 4-hydroxyproline in collagen. Accordingly, utilities of VGAM1960 include diagnosis, prevention and treatment of diseases and clinical conditions associated with P4HA1. The function of P4HA1 and its association with various diseases and clinical conditions, has been established by previous studies, as described hereinabove with reference to VGAM260. PDL2 (Accession NM_025239) is another VGAM1960 host target gene. PDL2 BINDING SITE is HOST TARGET binding site found in the 5' untranslated region of mRNA encoded by PDL2, corresponding to a HOST TARGET binding site such as BINDING SITE I, BINDING SITE II or BINDING SITE III. Table 2 illustrates the complementarity of the nucleotide sequences of PDL2 BINDING SITE, designated SEQ ID:24923, to the nucleotide sequence of VGAM1960 RNA, herein designated VGAM RNA, also designated SEQ ID:4671.

Another function of VGAM1960 is therefore inhibition of PDL2 (Accession NM_025239), a gene which is a second ligand for PD-1 and inhibits T cell activation. Accordingly, utilities of VGAM1960 include diagnosis, prevention and treatment of diseases and clinical conditions associated with PDL2. The function of PDL2 has been established by previous studies. The costimulatory B7 molecules (e.g., B7-1, or CD80; 112203) signal through CD28 (OMIM Ref. No. 186760) family molecules such as CD28, CTLA4 (OMIM Ref. No. 123890), ICOS (OMIM Ref. No. 604558), and programmed cell death-1 (PDCD1, or PD1; 600244). Ctla4-deficient mice are prone to a fatal lymphoproliferative disorder, suggesting that CTLA4 plays a critical regulatory and immunoinhibitory function, and Pdcd1-deficient mice develop lupus-like autoimmune diseases, including arthritis and cardiomyopathy. By searching EST databases with mouse Pd1 ligand-1 (Pdl1, or B7H1; 605402), Latchman et al. (2001) identified cDNAs encoding mouse Pdl2 and human PDL2, which they cloned from a placenta cDNA library. Sequence analysis predicted that the 273-amino acid PDL2 protein, which is 70% identical to the mouse Pdl2 protein, contains a signal sequence, IgV- and IgC-like domains, a transmembrane region, and a cytoplasmic region. Flow cytometric analysis showed that the IgV region of mouse Pdl2, like Pdl1, binds to human PDCD1 but not to CTLA4, CD28, or ICOS. Northern blot analysis detected wide expression of PDL2, with highest levels in placenta, heart, pancreas, lung, and liver, and lower levels in spleen, lymph nodes, and thymus. Stimulation with gamma-interferon (IFNG; 147570) was required to detect expression in monocytes. Stimulation of mouse T cells with anti-CD3 (see OMIM Ref. No. 186740) and Pdl2 or Pdl1 resulted in inhibition of proliferation and cytokine production, and Pdl2 could inhibit T-cell receptor (see OMIM Ref. No. 186880)-CD28 signals at low antigen concentrations. Latchman et al. (2001) proposed that blocking of the PDL-PDCD1 pathway may enhance antitumor immunity, whereas stimulating this pathway may help downregulate graft rejection and autoimmune and allergic reactions. By screening a subtractive dendritic cell-activated macrophage cDNA library, Tseng et al. (2001) isolated mouse and human cDNAs encoding PDL2, which they termed B7DC. Northern blot analysis detected Pdl2 transcripts in mouse dendritic cells but not in primary macrophages or macrophage cell lines. Expression was also detected in human dendritic cells but not in placenta. Functional analysis showed that in the presence of low concentrations of anti-CD3, mouse Pdl2 preferentially costimulates CD4 (OMIM Ref. No. 186940)-positive (Th1) T-cell proliferation and Ifng production to a greater level than does B7.1.

Full details of the abovementioned studies are described in the following publications, the disclosure of which are hereby incorporated by reference:

Latchman, Y.; Wood, C. R.; Chernova, T.; Chaudhary, D.; Borde, M.; Chernova, I.; Iwai, Y.; Long, A. J.; Brown, J. A.; Nunes, R.; Greenfield, E. A.; Bourque, K.: PD-L2 is a second ligand for PD-1 and inhibits T cell activation. Nature Immun. 2:261-268, 2001; and Tseng, B. S.-Y.; Otsuji, M.; Gorski, K.; Huang, X.; Slansky, J. E.; Pai, S. I.; Shalabi, A.; Shin, T.; Pardoll, D. M.; Tsuchiya, H.: B7-DC, a new dendritic cell molecule with potent c.

Further studies establishing the function and utilities of PDL2 are found in John Hopkins OMIM database record ID 605723, and in sited publications numbered 681 and 6909 listed in the bibliography section hereinbelow, which are also hereby incorporated by reference. Pleckstrin Homology, Sec7 and Coiled/coil Domains, Binding Protein (PSCDBP, Accession NM_004288) is another VGAM1960 host target gene. PSCDBP BINDING SITE is HOST TARGET binding site found in the 3' untranslated region of mRNA encoded by PSCDBP, corresponding to a HOST TARGET binding site such as BINDING SITE I, BINDING SITE II or BINDING SITE III. Table 2 illustrates the complementarity of the nucleotide sequences of PSCDBP BINDING SITE, designated SEQ ID:10500, to the nucleotide sequence of VGAM1960 RNA, herein designated VGAM RNA, also designated SEQ ID:4671.

Another function of VGAM1960 is therefore inhibition of Pleckstrin Homology, Sec7 and Coiled/coil Domains, Binding Protein (PSCDBP, Accession NM_004288), a gene which Protein that contains leucine zipper domains and a nuclear targeting sequence. Accordingly, utilities of VGAM1960 include diagnosis, prevention and treatment of diseases and clinical conditions associated with PSCDBP. The function of PSCDBP and its association with various diseases and clinical conditions, has been established by previous studies, as described hereinabove with reference to VGAM1924. Secreted Frizzled-related Protein 1 (SFRP1, Accession NM_003012) is another VGAM1960 host target gene. SFRP1 BINDING SITE is HOST TARGET binding site found in the 3' untranslated region of mRNA encoded by SFRP1, corresponding to a HOST TARGET binding site such as BINDING SITE I, BINDING SITE II or BINDING SITE III. Table 2 illustrates the complementarity of the nucleotide sequences of SFRP1 BINDING SITE, designated SEQ ID:8935, to the nucleotide sequence of VGAM1960 RNA, herein designated VGAM RNA, also designated SEQ ID:4671.

Another function of VGAM1960 is therefore inhibition of Secreted Frizzled-related Protein 1 (SFRP1, Accession NM_003012), a gene which is a receptor for wnt proteins that may have an anti-apoptotic function. Accordingly, utilities of VGAM1960 include diagnosis, prevention and treatment of diseases and clinical conditions associated with SFRP1. The function of SFRP1 and its association with various diseases and clinical conditions, has been established by previous studies, as described hereinabove with reference to VGAM250. Tissue Inhibitor of Metalloproteinase 3 (Sorsby fundus dystrophy, pseudoinflammatory) (TIMP3, Accession NM_000362) is another VGAM1960 host target gene. TIMP3 BINDING SITE is HOST TARGET binding site found in the 3' untranslated region of mRNA encoded by TIMP3, corresponding to a HOST TARGET binding site such as BINDING SITE I, BINDING SITE II or BINDING SITE III. Table 2 illustrates the complementarity of the nucleotide sequences of TIMP3 BINDING SITE, designated SEQ ID:5930, to the nucleotide sequence of VGAM1960 RNA, herein designated VGAM RNA, also designated SEQ ID:4671.

Another function of VGAM1960 is therefore inhibition of Tissue Inhibitor of Metalloproteinase 3 (Sorsby fundus dystrophy, pseudoinflammatory) (TIMP3, Accession NM_000362). Accordingly, utilities of VGAM1960 include diagnosis, prevention and treatment of diseases and clinical conditions associated with TIMP3. Tropomyosin 4 (TPM4, Accession NM_003290) is another VGAM1960 host target gene. TPM4 BINDING SITE is HOST TARGET binding site found in the 3' untranslated region of mRNA encoded by TPM4, corresponding to a HOST TARGET binding site such as BINDING SITE I, BINDING SITE II or BINDING SITE III. Table 2 illustrates the complementarity of the nucleotide sequences of TPM4 BINDING SITE, designated SEQ ID:9301, to the nucleotide sequence of VGAM1960 RNA, herein designated VGAM RNA, also designated SEQ ID:4671.

Another function of VGAM1960 is therefore inhibition of Tropomyosin 4 (TPM4, Accession NM_003290), a gene which plays a central role, in association with the troponin complex, in the calcium dependent regulation of vertebrate striated muscle contraction. Accordingly, utilities of VGAM1960 include diagnosis, prevention and treatment of diseases and clinical conditions associated with TPM4. The function of TPM4 and its association with various diseases and clinical conditions, has been established by previous studies, as described hereinabove with reference to VGAM744. Zinc Finger Protein 14 (KOX 6) (ZNF14, Accession NM_021030) is another VGAM1960 host target gene. ZNF14 BINDING SITE is HOST TARGET binding site found in the 3' untranslated region of mRNA encoded by ZNF14, corresponding to a HOST TARGET binding site such as BINDING SITE I, BINDING SITE II or BINDING SITE III. Table 2 illustrates the complementarity of the nucleotide sequences of ZNF14 BINDING SITE, designated SEQ ID:22018, to the nucleotide sequence of VGAM1960 RNA, herein designated VGAM RNA, also designated SEQ ID:4671.

Another function of VGAM1960 is therefore inhibition of Zinc Finger Protein 14 (KOX 6) (ZNF14, Accession NM_021030). Accordingly, utilities of VGAM1960 include diagnosis, prevention and treatment of diseases and clinical conditions associated with ZNF14. ADP-ribosylation Factor GTPase Activating Protein 3 (ARFGAP3, Accession NM_014570) is another VGAM1960 host target gene. ARFGAP3 BINDING SITE is HOST TARGET binding site found in the 3' untranslated region of mRNA encoded by ARFGAP3, corresponding to a HOST TARGET binding site such as BINDING SITE I, BINDING SITE II or BINDING SITE III. Table 2 illustrates the complementarity of the nucleotide sequences of ARFGAP3 BINDING SITE, designated SEQ ID:15924, to the nucleotide sequence of VGAM1960 RNA, herein designated VGAM RNA, also designated SEQ ID:4671.

Another function of VGAM1960 is therefore inhibition of ADP-ribosylation Factor GTPase Activating Protein 3 (ARFGAP3, Accession NM_014570). Accordingly, utilities of VGAM1960 include diagnosis, prevention and treatment of diseases and clinical conditions associated with ARFGAP3. B7-H1 (Accession NM_014143) is another VGAM1960 host target gene. B7-H1 BINDING SITE is HOST TARGET binding site found in the 3' untranslated region of mRNA encoded by B7-H1, corresponding to a HOST TARGET binding site such as BINDING SITE I, BINDING SITE II or BINDING SITE III. Table 2 illustrates the complementarity of the nucleotide sequences of B7-H1 BINDING SITE, designated SEQ ID:15424, to the nucleotide sequence of VGAM1960 RNA, herein designated VGAM RNA, also designated SEQ ID:4671.

Another function of VGAM1960 is therefore inhibition of B7-H1 (Accession NM_014143). Accordingly, utilities of VGAM1960 include diagnosis, prevention and treatment of diseases and clinical conditions associated with B7-H1. Chromosome 1 Open Reading Frame 17 (C1orf17, Accession XM_042965) is another VGAM1960 host target gene. C1orf17 BINDING SITE is HOST TARGET binding site found in the 3' untranslated region of mRNA encoded by C1orf17, corresponding to a HOST TARGET binding site such as BINDING SITE I, BINDING SITE II or BINDING SITE III. Table 2 illustrates the complementarity of the nucleotide sequences of C1orf17 BINDING SITE, designated SEQ ID:33855, to the nucleotide sequence of VGAM1960 RNA, herein designated VGAM RNA, also designated SEQ ID:4671.

Another function of VGAM1960 is therefore inhibition of Chromosome 1 Open Reading Frame 17 (C1orf17, Accession XM_042965). Accordingly, utilities of VGAM1960 include diagnosis, prevention and treatment of diseases and clinical conditions associated with C1orf17. Calcium Channel, Voltage-dependent, Gamma Subunit 4 (CACNG4, Accession NM_014405) is another VGAM1960 host target gene. CACNG4 BINDING SITE is HOST TARGET binding site found in the 3' untranslated region of mRNA encoded by CACNG4, corresponding to a HOST TARGET binding site such as BINDING SITE I, BINDING SITE II or BINDING SITE III. Table 2 illustrates the complementarity of the nucleotide sequences of CACNG4 BINDING SITE, designated SEQ ID:15746, to the nucleotide sequence of VGAM1960 RNA, herein designated VGAM RNA, also designated SEQ ID:4671.

Another function of VGAM1960 is therefore inhibition of Calcium Channel, Voltage-dependent, Gamma Subunit 4 (CACNG4, Accession NM_014405). Accordingly, utilities of VGAM1960 include diagnosis, prevention and treatment of diseases and clinical conditions associated with CACNG4. COE2 (Accession XM_034639) is another VGAM1960 host target gene. COE2 BINDING SITE is HOST TARGET binding site found in the 3' untranslated region of mRNA encoded by COE2, corresponding to a HOST TARGET binding site such as BINDING SITE I, BINDING SITE II or BINDING SITE III. Table 2 illustrates the complementarity of the nucleotide sequences of COE2 BINDING SITE, designated SEQ ID:32129, to the nucleotide sequence of VGAM1960 RNA, herein designated VGAM RNA, also designated SEQ ID:4671.

Another function of VGAM1960 is therefore inhibition of COE2 (Accession XM_034639). Accordingly, utilities of VGAM1960 include diagnosis, prevention and treatment of diseases and clinical conditions associated with COE2. Cysteine and Tyrosine-rich 1 (CYYR1, Accession NM_052954) is another VGAM1960 host target gene. CYYR1 BINDING SITE is HOST TARGET binding site found in the 3' untranslated region of mRNA encoded by CYYR1, corresponding to a HOST TARGET binding site such as BINDING SITE I, BINDING SITE II or BINDING SITE III. Table 2 illustrates the complementarity of the nucleotide sequences of CYYR1 BINDING SITE, designated SEQ ID:27513, to the nucleotide sequence of VGAM1960 RNA, herein designated VGAM RNA, also designated SEQ ID:4671.

Another function of VGAM1960 is therefore inhibition of Cysteine and Tyrosine-rich 1 (CYYR1, Accession NM_052954). Accordingly, utilities of VGAM1960 include diagnosis, prevention and treatment of diseases and clinical conditions associated with CYYR1. DKFZp434C0328 (Accession NM_017577) is another VGAM1960 host target gene. DKFZp434C0328 BINDING SITE is HOST TARGET binding site found in the 3' untranslated region of mRNA encoded by DKFZp434C0328, corresponding to a HOST TARGET binding site such as BINDING SITE I, BINDING SITE II or BINDING SITE III. Table 2 illustrates the complementarity of the nucleotide sequences of DKFZp434C0328 BINDING SITE, designated SEQ ID:19017, to the nucleotide sequence of VGAM1960 RNA, herein designated VGAM RNA, also designated SEQ ID:4671.

Another function of VGAM1960 is therefore inhibition of DKFZp434C0328 (Accession NM_017577). Accordingly, utilities of VGAM1960 include diagnosis, prevention and treatment of diseases and clinical conditions associated with DKFZp434C0328. DKFZp434K1210 (Accession NM_017606) is another VGAM1960 host target gene. DKFZp434K1210 BINDING SITE is HOST TARGET binding site found in the 3' untranslated region of mRNA encoded by DKFZp434K1210, corresponding to a HOST TARGET binding site such as BINDING SITE I, BINDING SITE II or BINDING SITE III. Table 2 illustrates the complementarity of the nucleotide sequences of DKFZp434K1210 BINDING SITE, designated SEQ ID:19103, to the nucleotide sequence of VGAM1960 RNA, herein designated VGAM RNA, also designated SEQ ID:4671.

Another function of VGAM1960 is therefore inhibition of DKFZp434K1210 (Accession NM_017606). Accordingly, utilities of VGAM1960 include diagnosis, prevention and treatment of diseases and clinical conditions associated with DKFZp434K1210. Eukaryotic Translation Initiation Factor 4B (EIF4B, Accession XM_071605) is another VGAM1960 host target gene. EIF4B BINDING SITE is HOST TARGET binding site found in the 3' untranslated region of mRNA encoded by EIF4B, corresponding to a HOST TARGET binding site such as BINDING SITE I, BINDING SITE II or BINDING SITE III. Table 2 illustrates the complementarity of the nucleotide sequences of EIF4B BINDING SITE, designated SEQ ID:37400, to the nucleotide sequence of VGAM1960 RNA, herein designated VGAM RNA, also designated SEQ ID:4671.

Another function of VGAM1960 is therefore inhibition of Eukaryotic Translation Initiation Factor 4B (EIF4B, Accession XM_071605). Accordingly, utilities of VGAM1960 include diagnosis, prevention and treatment of diseases and clinical conditions associated with EIF4B. FLJ20094 (Accession NM_017665) is another VGAM1960 host target gene. FLJ20094 BINDING SITE is HOST TARGET binding site found in the 3' untranslated region of mRNA encoded by FLJ20094, corresponding to a HOST TARGET binding site such as BINDING SITE I, BINDING SITE II or BINDING SITE III. Table 2 illustrates the complementarity of the nucleotide sequences of FLJ20094 BINDING SITE, designated SEQ ID:19209, to the nucleotide sequence of VGAM1960 RNA, herein designated VGAM RNA, also designated SEQ ID:4671.

Another function of VGAM1960 is therefore inhibition of FLJ20094 (Accession NM_017665). Accordingly, utilities of VGAM1960 include diagnosis, prevention and treatment of diseases and clinical conditions associated with FLJ20094. FLJ21106 (Accession NM_025097) is another VGAM1960 host target gene. FLJ21106 BINDING SITE is HOST TARGET binding site found in the 3' untranslated region of mRNA encoded by FLJ21106, corresponding to a HOST TARGET binding site such as BINDING SITE I, BINDING SITE II or BINDING SITE III. Table 2 illustrates the complementarity of the nucleotide sequences of FLJ21106 BINDING SITE, designated SEQ ID:24738, to the nucleotide sequence of VGAM1960 RNA, herein designated VGAM RNA, also designated SEQ ID:4671.

Another function of VGAM1960 is therefore inhibition of FLJ21106 (Accession NM_025097). Accordingly, utilities of VGAM1960 include diagnosis, prevention and treatment of diseases and clinical conditions associated with FLJ21106. Fucose-1-phosphate Guanylyltransferase (FPGT, Accession NM_003838) is another VGAM1960 host target gene. FPGT BINDING SITE is HOST TARGET binding site found in the 3' untranslated region of mRNA encoded by FPGT, corresponding to a HOST TARGET binding site such as BINDING SITE I, BINDING SITE II or BINDING SITE III. Table 2 illustrates the complementarity of the nucleotide sequences of FPGT BINDING SITE, designated SEQ ID:9930, to the nucleotide sequence of VGAM1960 RNA, herein designated VGAM RNA, also designated SEQ ID:4671.

Another function of VGAM1960 is therefore inhibition of Fucose-1-phosphate Guanylyltransferase (FPGT, Accession NM_003838). Accordingly, utilities of VGAM1960 include diagnosis, prevention and treatment of diseases and clinical conditions associated with FPGT. KIAA0368 (Accession XM_036708) is another VGAM1960 host target gene. KIAA0368 BINDING SITE is HOST TARGET binding site found in the 3' untranslated region of mRNA encoded by KIAA0368, corresponding to a HOST TARGET binding site such as BINDING SITE I, BINDING SITE II or BINDING SITE III. Table 2 illustrates the complementarity of the nucleotide sequences of KIAA0368 BINDING SITE, designated SEQ ID:32488, to the nucleotide sequence of VGAM1960 RNA, herein designated VGAM RNA, also designated SEQ ID:4671.

Another function of VGAM1960 is therefore inhibition of KIAA0368 (Accession XM_036708). Accordingly, utilities of VGAM1960 include diagnosis, prevention and treatment of diseases and clinical conditions associated with KIAA0368. KIAA0427 (Accession NM_014772) is another VGAM1960 host target gene. KIAA0427 BINDING SITE is HOST TARGET binding site found in the 3' untranslated region of mRNA encoded by KIAA0427, corresponding to a HOST TARGET binding site such as BINDING SITE I, BINDING SITE II or BINDING SITE III. Table 2 illustrates the complementarity of the nucleotide sequences of KIAA0427 BINDING SITE, designated SEQ ID:16579, to the nucleotide sequence of VGAM1960 RNA, herein designated VGAM RNA, also designated SEQ ID:4671.

Another function of VGAM1960 is therefore inhibition of KIAA0427 (Accession NM_014772). Accordingly, utilities of VGAM1960 include diagnosis, prevention and treatment of diseases and clinical conditions associated with KIAA0427. KIAA0534 (Accession XM_049349) is another VGAM1960 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35387, to the nucleotide sequence of VGAM1960 RNA, herein designated VGAM RNA, also designated SEQ ID:4671.

Another function of VGAM1960 is therefore inhibition of KIAA0534 (Accession XM_049349). Accordingly, utilities of VGAM1960 include diagnosis, prevention and treatment of diseases and clinical conditions associated with KIAA0534. KIAA0644 (Accession NM_014817) is another VGAM1960 host target gene. KIAA0644 BINDING SITE is HOST TARGET binding site found in the 3' untranslated region of mRNA encoded by KIAA0644, corresponding to a HOST TARGET binding site such as BINDING SITE I, BINDING SITE II or BINDING SITE III. Table 2 illustrates the complementarity of the nucleotide sequences of KIAA0644 BINDING SITE, designated SEQ ID:16785, to the nucleotide sequence of VGAM1960 RNA, herein designated VGAM RNA, also designated SEQ ID:4671.

Another function of VGAM1960 is therefore inhibition of KIAA0644 (Accession NM_014817). Accordingly, utilities of VGAM1960 include diagnosis, prevention and treatment of diseases and clinical conditions associated with KIAA0644. KIAA0961 (Accession NM_014898) is another VGAM1960 host target gene. KIAA0961 BINDING SITE is HOST TARGET binding site found in the 3' untranslated region of mRNA encoded by KIAA0961, corresponding to a HOST TARGET binding site such as BINDING SITE I, BINDING SITE II or BINDING SITE III. Table 2 illustrates the complementarity of the nucleotide sequences of KIAA0961 BINDING SITE, designated SEQ ID:17075, to the nucleotide sequence of VGAM1960 RNA, herein designated VGAM RNA, also designated SEQ ID:4671.

Another function of VGAM1960 is therefore inhibition of KIAA0961 (Accession NM_014898). Accordingly, utilities of VGAM1960 include diagnosis, prevention and treatment of diseases and clinical conditions associated with KIAA0961. KIAA0984 (Accession XM_037557) is another VGAM1960 host target gene. KIAA0984 BINDING SITE is HOST TARGET binding site found in the 3' untranslated region of mRNA encoded by KIAA0984, corresponding to a HOST TARGET binding site such as BINDING SITE I, BINDING SITE II or BINDING SITE III. Table 2 illustrates the complementarity of the nucleotide sequences of KIAA0984 BINDING SITE, designated SEQ ID:32644, to the nucleotide sequence of VGAM1960 RNA, herein designated VGAM RNA, also designated SEQ ID:4671.

Another function of VGAM1960 is therefore inhibition of KIAA0984 (Accession XM_037557). Accordingly, utilities of VGAM1960 include diagnosis, prevention and treatment of diseases and clinical conditions associated with KIAA0984. KIAA1136 (Accession XM_166110) is another VGAM1960 host target gene. KIAA1136 BINDING SITE is HOST TARGET binding site found in the 3' untranslated region of mRNA encoded by KIAA1136, corresponding to a HOST TARGET binding site such as BINDING SITE I, BINDING SITE II or BINDING SITE III. Table 2 illustrates the complementarity of the nucleotide sequences of KIAA1136 BINDING SITE, designated SEQ ID:43883, to the nucleotide sequence of VGAM1960 RNA, herein designated VGAM RNA, also designated SEQ ID:4671.

Another function of VGAM1960 is therefore inhibition of KIAA1136 (Accession XM_166110). Accordingly, utilities of VGAM1960 include diagnosis, prevention and treatment of diseases and clinical conditions associated with KIAA1136. KIAA1300 (Accession XM_031744) is another VGAM1960 host target gene. KIAA1300 BINDING SITE is HOST TARGET binding site found in the 3' untranslated region of mRNA encoded by KIAA1300, corresponding to a HOST TARGET binding site such as BINDING SITE I, BINDING SITE II or BINDING SITE III. Table 2 illustrates the complementarity of the nucleotide sequences of KIAA1300 BINDING SITE, designated SEQ ID:31481, to the nucleotide sequence of VGAM1960 RNA, herein designated VGAM RNA, also designated SEQ ID:4671.

Another function of VGAM1960 is therefore inhibition of KIAA1300 (Accession XM_031744). Accordingly, utilities of VGAM1960 include diagnosis, prevention and treatment of diseases and clinical conditions associated with KIAA1300. KIAA1598 (Accession NM_018330) is another VGAM1960 host target gene. KIAA1598 BINDING SITE is HOST TARGET binding site found in the 3' untranslated region of mRNA encoded by KIAA1598, corresponding to a HOST TARGET binding site such as BINDING SITE I, BINDING SITE II or BINDING SITE III. Table 2 illustrates the complementarity of the nucleotide sequences of KIAA1598 BINDING SITE, designated SEQ ID:20331, to the nucleotide sequence of VGAM1960 RNA, herein designated VGAM RNA, also designated SEQ ID:4671.

Another function of VGAM1960 is therefore inhibition of KIAA1598 (Accession NM_018330). Accordingly, utilities of VGAM1960 include diagnosis, prevention and treatment of diseases and clinical conditions associated with KIAA1598. KIAA1676 (Accession XM_167612) is another VGAM1960 host target gene. KIAA1676 BINDING SITE is HOST TARGET binding site found in the 3' untranslated region of mRNA encoded by KIAA1676, corresponding to a HOST TARGET binding site such as BINDING SITE I, BINDING SITE II or BINDING SITE III. Table 2 illustrates the complementarity of the nucleotide sequences of KIAA1676 BINDING SITE, designated SEQ ID:44727, to the nucleotide sequence of VGAM1960 RNA, herein designated VGAM RNA, also designated SEQ ID:4671.

Another function of VGAM1960 is therefore inhibition of KIAA1676 (Accession XM_167612). Accordingly, utilities of VGAM1960 include diagnosis, prevention and treatment of diseases and clinical conditions associated with KIAA1676. KIAA1889 (Accession XM_056298) is another VGAM1960 host target gene. KIAA1889 BINDING SITE is HOST TARGET binding site found in the 3' untranslated region of mRNA encoded by KIAA1889, corresponding to a HOST TARGET binding site such as BINDING SITE I, BINDING SITE II or BINDING SITE III. Table 2 illustrates the complementarity of the nucleotide sequences of KIAA1889 BINDING SITE, designated SEQ ID:36389, to the nucleotide sequence of VGAM1960 RNA, herein designated VGAM RNA, also designated SEQ ID:4671.

Another function of VGAM1960 is therefore inhibition of KIAA1889 (Accession XM_056298). Accordingly, utilities of VGAM1960 include diagnosis, prevention and treatment of diseases and clinical conditions associated with KIAA1889. l(3) mbt-like 2 (Drosophila) (L3MBTL2, Accession XM_114201) is another VGAM1960 host target gene. L3MBTL2 BINDING SITE is HOST TARGET binding site found in the 3' untranslated region of mRNA encoded by L3MBTL2, corresponding to a HOST TARGET binding site such as BINDING SITE I, BINDING SITE II or BINDING SITE III. Table 2 illustrates the complementarity of the nucleotide sequences of L3MBTL2 BINDING SITE, designated SEQ ID:42791, to the nucleotide sequence of VGAM1960 RNA, herein designated VGAM RNA, also designated SEQ ID:4671.

Another function of VGAM1960 is therefore inhibition of l (3) mbt-like 2 (Drosophila) (L3MBTL2, Accession XM_114201). Accordingly, utilities of VGAM1960 include diagnosis, prevention and treatment of diseases and clinical conditions associated with L3MBTL2. LIN-7-C (Accession NM_018362) is another VGAM1960 host target gene. LIN-7-C BINDING SITE is HOST TARGET binding site found in the 3' untranslated region of mRNA encoded by LIN-7-C, corresponding to a HOST TARGET binding site such as BINDING SITE I, BINDING SITE II or BINDING SITE III. Table 2 illustrates the complementarity of the nucleotide sequences of LIN-7-C BINDING SITE, designated SEQ ID:20372, to the nucleotide sequence of VGAM1960 RNA, herein designated VGAM RNA, also designated SEQ ID:4671.

Another function of VGAM1960 is therefore inhibition of LIN-7-C (Accession NM_018362). Accordingly, utilities of VGAM1960 include diagnosis, prevention and treatment of diseases and clinical conditions associated with LIN-7-C. Mesoderm Development Candidate 1 (MESDC1, Accession NM_022566) is another VGAM1960 host target gene. MESDC1 BINDING SITE is HOST TARGET binding site found in the 3' untranslated region of mRNA encoded by MESDC1, corresponding to a HOST TARGET binding site such as BINDING SITE I, BINDING SITE II or BINDING SITE III. Table 2 illustrates the complementarity of the nucleotide sequences of MESDC1 BINDING SITE, designated SEQ ID:22885, to the nucleotide sequence of VGAM1960 RNA, herein designated VGAM RNA, also designated SEQ ID:4671.

Another function of VGAM1960 is therefore inhibition of Mesoderm Development Candidate 1 (MESDC1, Accession NM_022566). Accordingly, utilities of VGAM1960 include diagnosis, prevention and treatment of diseases and clinical conditions associated with MESDC1. MGC12335 (Accession NM_032744) is another VGAM1960 host target gene. MGC12335 BINDING SITE is HOST TARGET binding site found in the 3' untranslated region of mRNA encoded by MGC12335, corresponding to a HOST TARGET binding site such as BINDING SITE I, BINDING SITE II or BINDING SITE III. Table 2 illustrates the complementarity of the nucleotide sequences of MGC12335 BINDING SITE, designated SEQ ID:26478, to the nucleotide sequence of VGAM1960 RNA, herein designated VGAM RNA, also designated SEQ ID:4671.

Another function of VGAM1960 is therefore inhibition of MGC12335 (Accession NM_032744). Accordingly, utilities of VGAM1960 include diagnosis, prevention and treatment of diseases and clinical conditions associated with MGC12335. Ring Finger Protein 38 (RNF38, Accession NM_022781) is another VGAM1960 host target gene. RNF38 BINDING SITE is HOST TARGET binding site found in the 3' untranslated region of mRNA encoded by RNF38, corresponding to a HOST TARGET binding site such as BINDING SITE I, BINDING SITE II or BINDING SITE III. Table 2 illustrates the complementarity of the nucleotide sequences of RNF38 BINDING SITE, designated SEQ ID:23064, to the nucleotide sequence of VGAM1960 RNA, herein designated VGAM RNA, also designated SEQ ID:4671.

Another function of VGAM1960 is therefore inhibition of Ring Finger Protein 38 (RNF38, Accession NM_022781). Accordingly, utilities of VGAM1960 include diagnosis, prevention and treatment of diseases and clinical conditions associated with RNF38. Solute Carrier Family 6 (neurotransmitter transporter), Member 14 (SLC6A14, Accession NM_007231) is another VGAM1960 host target gene. SLC6A14 BINDING SITE is HOST TARGET binding site found in the 3' untranslated region of mRNA encoded by SLC6A14, corresponding to a HOST TARGET binding site such as BINDING SITE I, BINDING SITE II or BINDING SITE III. Table 2 illustrates the complementarity of the nucleotide sequences of SLC6A14 BINDING SITE, designated SEQ ID:14101, to the nucleotide sequence of VGAM1960 RNA, herein designated VGAM RNA, also designated SEQ ID:4671.

Another function of VGAM1960 is therefore inhibition of Solute Carrier Family 6 (neurotransmitter transporter), Member 14 (SLC6A14, Accession NM_007231). Accordingly, utilities of VGAM1960 include diagnosis, prevention and treatment of diseases and clinical conditions associated with SLC6A14. Synovial Sarcoma Translocation Gene On Chromosome 18-like 1 (SS18L1, Accession XM_037202) is another VGAM1960 host target gene. SS18L1 BINDING SITE is HOST TARGET binding site found in the 3' untranslated region of mRNA encoded by SS18L1, corresponding to a HOST TARGET binding site such as BINDING SITE I, BINDING SITE II or BINDING SITE III. Table 2 illustrates the complementarity of the nucleotide sequences of SS18L1 BINDING SITE, designated SEQ ID:32567, to the nucleotide sequence of VGAM1960 RNA, herein designated VGAM RNA, also designated SEQ ID:4671.

Another function of VGAM1960 is therefore inhibition of Synovial Sarcoma Translocation Gene On Chromosome 18-like 1 (SS18L1, Accession XM_037202). Accordingly, utilities of VGAM1960 include diagnosis, prevention and treatment of diseases and clinical conditions associated with SS18L1. Signal Transducing Adaptor Molecule (SH3 domain and ITAM motif) 2 (STAM2, Accession NM_005843) is another VGAM1960 host target gene. STAM2 BINDING SITE is HOST TARGET binding site found in the 3' untranslated region of mRNA encoded by STAM2, corresponding to a HOST TARGET binding site such as BINDING SITE I, BINDING SITE II or BINDING SITE III. Table 2 illustrates the complementarity of the nucleotide sequences of STAM2 BINDING SITE, designated SEQ ID:12460, to the nucleotide sequence of VGAM1960 RNA, herein designated VGAM RNA, also designated SEQ ID:4671.

Another function of VGAM1960 is therefore inhibition of Signal Transducing Adaptor Molecule (SH3 domain and ITAM motif) 2 (STAM2, Accession NM_005843). Accordingly, utilities of VGAM1960 include diagnosis, prevention and treatment of diseases and clinical conditions associated with STAM2. TRAP150 (Accession NM_005119) is another VGAM1960 host target gene. TRAP150 BINDING SITE is HOST TARGET binding site found in the 5' untranslated region of mRNA encoded by TRAP150, corresponding to a HOST TARGET binding site such as BINDING SITE I, BINDING SITE II or BINDING SITE III. Table 2 illustrates the complementarity of the nucleotide sequences of TRAP150 BINDING SITE, designated SEQ ID:11603, to the nucleotide sequence of VGAM1960 RNA, herein designated VGAM RNA, also designated SEQ ID:4671.

Another function of VGAM1960 is therefore inhibition of TRAP150 (Accession NM_005119). Accordingly, utilities of VGAM1960 include diagnosis, prevention and treatment of diseases and clinical conditions associated with TRAP150. Ubiquitin Specific Protease 8 (USP8, Accession NM_005154) is another VGAM1960 host target gene. USP8 BINDING SITE is HOST TARGET binding site found in the 3' untranslated region of mRNA encoded by USP8, corresponding to a HOST TARGET binding site such as BINDING SITE I, BINDING SITE II or BINDING SITE III. Table 2 illustrates the complementarity of the nucleotide sequences of USP8 BINDING SITE, designated SEQ ID:11631, to the nucleotide sequence of VGAM1960 RNA, herein designated VGAM RNA, also designated SEQ ID:4671.

Another function of VGAM1960 is therefore inhibition of Ubiquitin Specific Protease 8 (USP8, Accession NM_005154). Accordingly, utilities of VGAM1960 include diagnosis, prevention and treatment of diseases and clinical conditions associated with USP8. Zinc Finger Protein 294 (ZNF294, Accession XM_047829) is another VGAM1960 host target gene. ZNF294 BINDING SITE is HOST TARGET binding site found in the 3' untranslated region of mRNA encoded by ZNF294, corresponding to a HOST TARGET binding site such as BINDING SITE I, BINDING SITE II or BINDING SITE III. Table 2 illustrates the complementarity of the nucleotide sequences of ZNF294 BINDING SITE, designated SEQ ID:35058, to the nucleotide sequence of VGAM1960 RNA, herein designated VGAM RNA, also designated SEQ ID:4671.

Another function of VGAM1960 is therefore inhibition of Zinc Finger Protein 294 (ZNF294, Accession XM_047829). Accordingly, utilities of VGAM1960 include diagnosis, prevention and treatment of diseases and clinical conditions associated with ZNF294. Zinc Finger Protein 33a (KOX 31) (ZNF33A, Accession XM_166119) is another VGAM1960 host target gene. ZNF33A BINDING SITE is HOST TARGET binding site found in the 3" untranslated region of mRNA encoded by ZNF33A, corresponding to a HOST TARGET binding site such as BINDING SITE I, BINDING SITE II or BINDING SITE III. Table 2 illustrates the complementarity of the nucleotide sequences of ZNF33A BINDING SITE, designated SEQ ID:43899, to the nucleotide sequence of VGAM1960 RNA, herein designated VGAM RNA, also designated SEQ ID:4671.

Another function of VGAM1960 is therefore inhibition of Zinc Finger Protein 33a (KOX 31) (ZNF33A, Accession XM_166119). Accordingly, utilities of VGAM1960 include diagnosis, prevention and treatment of diseases and clinical conditions associated with ZNF33A. LOC112616 (Accession NM_138410) is another VGAM1960 host target gene. LOC112616 BINDING SITE is HOST TARGET binding site found in the 3' untranslated region of mRNA encoded by LOC112616, corresponding to a HOST TARGET binding site such as BINDING SITE I, BINDING SITE II or BINDING SITE III. Table 2 illustrates the complementarity of the nucleotide sequences of LOC112616 BINDING SITE, designated SEQ ID:28776, to the nucleotide sequence of VGAM1960 RNA, herein designated VGAM RNA, also designated SEQ ID:4671.

Another function of VGAM1960 is therefore inhibition of LOC112616 (Accession NM_138410). Accordingly, utilities of VGAM1960 include diagnosis, prevention and treatment of diseases and clinical conditions associated with LOC112616. LOC113763 (Accession NM_138434) is another VGAM1960 host target gene. LOC113763 BINDING SITE is HOST TARGET binding site found in the 3' untranslated region of mRNA encoded by LOC113763, corresponding to a HOST TARGET binding site such as BINDING SITE I, BINDING SITE II or BINDING SITE III. Table 2 illustrates the complementarity of the nucleotide sequences of LOC113763 BINDING SITE, designated SEQ ID:28804, to the nucleotide sequence of VGAM1960 RNA, herein designated VGAM RNA, also designated SEQ ID:4671.

Another function of VGAM1960 is therefore inhibition of LOC113763 (Accession NM_138434). Accordingly, utilities of VGAM1960 include diagnosis, prevention and treatment of diseases and clinical conditions associated with LOC113763. LOC134266 (Accession XM_059701) is another VGAM1960 host target gene. LOC134266 BINDING SITE is HOST TARGET binding site found in the 3' untranslated region of mRNA encoded by LOC134266, corresponding to a HOST TARGET binding site such as BINDING SITE I, BINDING SITE II or BINDING SITE III. Table 2 illustrates the complementarity of the nucleotide sequences of LOC134266 BINDING SITE, designated SEQ ID:37070, to the nucleotide sequence of VGAM1960 RNA, herein designated VGAM RNA, also designated SEQ ID:4671.

Another function of VGAM1960 is therefore inhibition of LOC134266 (Accession XM_059701). Accordingly, utilities of VGAM1960 include diagnosis, prevention and treatment of diseases and clinical conditions associated with LOC134266. LOC139673 (Accession XM_071645) is another VGAM1960 host target gene. LOC139673 BINDING SITE is HOST TARGET binding site found in the 3' untranslated region of mRNA encoded by LOC139673, corresponding to a HOST TARGET binding site such as BINDING SITE I, BINDING SITE II or BINDING SITE III. Table 2 illustrates the complementarity of the nucleotide sequences of LOC139673 BINDING SITE, designated SEQ ID:37405, to the nucleotide sequence of VGAM1960 RNA, herein designated VGAM RNA, also designated SEQ ID:4671.

Another function of VGAM1960 is therefore inhibition of LOC139673 (Accession XM_071645). Accordingly, utilities of VGAM1960 include diagnosis, prevention and treatment of diseases and clinical conditions associated with LOC139673. LOC144747 (Accession XM_084954) is another VGAM1960 host target gene. LOC144747 BINDING SITE is HOST TARGET binding site found in the 5' untranslated region of mRNA encoded by LOC144747, corresponding to a HOST TARGET binding site such as BINDING SITE I, BINDING SITE II or BINDING SITE III. Table 2 illustrates the complementarity of the nucleotide sequences of LOC144747 BINDING SITE, designated SEQ ID:37785, to the nucleotide sequence of VGAM1960 RNA, herein designated VGAM RNA, also designated SEQ ID:4671.

Another function of VGAM1960 is therefore inhibition of LOC144747 (Accession XM_084954). Accordingly, utilities of VGAM1960 include diagnosis, prevention and treatment of diseases and clinical conditions associated with LOC144747. LOC146856 (Accession XM_096086) is another VGAM1960 host target gene. LOC146856 BINDING SITE is HOST TARGET binding site found in the 3' untranslated region of mRNA encoded by LOC146856, corresponding to a HOST TARGET binding site such as BINDING SITE I, BINDING SITE II or BINDING SITE III. Table 2 illustrates the complementarity of the nucleotide sequences of LOC146856 BINDING SITE, designated SEQ ID:40299, to the nucleotide sequence of VGAM1960 RNA, herein designated VGAM RNA, also designated SEQ ID:4671.

Another function of VGAM1960 is therefore inhibition of LOC146856 (Accession XM_096086). Accordingly, utilities of VGAM1960 include diagnosis, prevention and treatment of diseases and clinical conditions associated with LOC146856. LOC147990 (Accession XM_097358) is another VGAM1960 host target gene. LOC147990 BINDING SITE is HOST TARGET binding site found in the 3' untranslated region of mRNA encoded by LOC147990, corresponding to a HOST TARGET binding site such as BINDING SITE I, BINDING SITE II or BINDING SITE III. Table 2 illustrates the complementarity of the nucleotide sequences of LOC147990 BINDING SITE, designated SEQ ID:40863, to the nucleotide sequence of VGAM1960 RNA, herein designated VGAM RNA, also designated SEQ ID:4671.

Another function of VGAM1960 is therefore inhibition of LOC147990 (Accession XM_097358). Accordingly, utilities of VGAM1960 include diagnosis, prevention and treatment of diseases and clinical conditions associated with LOC147990. LOC152018 (Accession XM_098156) is another VGAM1960 host target gene. LOC152018 BINDING SITE is HOST TARGET binding site found in the 5' untranslated region of mRNA encoded by LOC152018, corresponding to a HOST TARGET binding site such as BINDING SITE I, BINDING SITE II or BINDING SITE III. Table 2 illustrates the complementarity of the nucleotide sequences of LOC152018 BINDING SITE, designated SEQ ID:41421, to the nucleotide sequence of VGAM1960 RNA, herein designated VGAM RNA, also designated SEQ ID:4671.

Another function of VGAM1960 is therefore inhibition of LOC152018 (Accession XM_098156). Accordingly, utilities of VGAM1960 include diagnosis, prevention and treatment of diseases and clinical conditions associated with LOC152018. LOC157798 (Accession XM_098827) is another VGAM1960 host target gene. LOC157798 BINDING SITE is HOST TARGET binding site found in the 5' untranslated region of mRNA encoded by LOC157798, corresponding to a HOST TARGET binding site such as BINDING SITE I, BINDING SITE II or BINDING SITE III. Table 2 illustrates the complementarity of the nucleotide sequences of LOC157798 BINDING SITE, designated SEQ ID:41850, to the nucleotide sequence of VGAM1960 RNA, herein designated VGAM RNA, also designated SEQ ID:4671.

Another function of VGAM1960 is therefore inhibition of LOC157798 (Accession XM_098827). Accordingly, utilities of VGAM1960 include diagnosis, prevention and treatment of diseases and clinical conditions associated with LOC157798. LOC158709 (Accession XM_088648) is another VGAM1960 host target gene. LOC158709 BINDING SITE is HOST TARGET binding site found in the 3' untranslated region of mRNA encoded by LOC158709, corresponding to a HOST TARGET binding site such as BINDING SITE I, BINDING SITE II or BINDING SITE III. Table 2 illustrates the complementarity of the nucleotide sequences of LOC158709 BINDING SITE, designated SEQ ID:39882, to the nucleotide sequence of VGAM1960 RNA, herein designated VGAM RNA, also designated SEQ ID:4671.

Another function of VGAM1960 is therefore inhibition of LOC158709 (Accession XM_088648). Accordingly, utilities of VGAM1960 include diagnosis, prevention and treatment of diseases and clinical conditions associated with LOC158709. LOC203365 (Accession XM_114690) is another VGAM1960 host target gene. LOC203365 BINDING SITE is HOST TARGET binding site found in the 3' untranslated region of mRNA encoded by LOC203365, corresponding to a HOST TARGET binding site such as BINDING SITE I, BINDING SITE II or BINDING SITE III. Table 2 illustrates the complementarity of the nucleotide sequences of LOC203365 BINDING SITE, designated SEQ ID:43034, to the nucleotide sequence of VGAM1960 RNA, herein designated VGAM RNA, also designated SEQ ID:4671.

Another function of VGAM1960 is therefore inhibition of LOC203365 (Accession XM_114690). Accordingly, utilities of VGAM1960 include diagnosis, prevention and treatment of diseases and clinical conditions associated with LOC203365. FIG. 1 further provides a conceptual description of a novel bioinformatically detected viral gene of the present invention, referred to here as Viral Genomic Address Messenger 1961 (VGAM1961) viral gene, which modulates expression of respective host target genes thereof, the function and utility of which host target genes is known in the art.

VGAM1961 is a novel bioinformatically detected regulatory, non protein coding, viral micro RNA (miRNA) gene. The method by which VGAM1961 was detected is described hereinabove with reference to FIGS. 1-8.

VGAM1961 gene, herein designated VGAM GENE, is a viral gene contained in the genome of Camelpox Virus. VGAM1961 host target gene, herein designated VGAM HOST TARGET GENE, is a human gene contained in the human genome.

VGAM1961 gene encodes a VGAM1961 precursor RNA, herein designated VGAM PRECURSOR RNA. Similar to other miRNA genes, and unlike most ordinary genes, VGAM1961 precursor RNA does not encode a protein. A nucleotide sequence identical or highly similar to the nucleotide sequence of VGAM1961 precursor RNA is designated SEQ ID:1947, and is provided hereinbelow with reference to the sequence listing part. Nucleotide sequence SEQ ID:1947 is located at position 16323 relative to the genome of Camelpox Virus.

VGAM1961 precursor RNA folds onto itself, forming VGAM1961 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1961 folded precursor RNA into VGAM1961 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1961 RNA is designated SEQ ID:4672, and is provided hereinbelow with reference to the sequence listing part.

VGAM1961 host target gene, herein designated VGAM HOST TARGET GENE, encodes a corresponding messenger RNA, VGAM1961 host target RNA, herein designated VGAM HOST TARGET RNA. VGAM1961 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1961 RNA, herein designated VGAM RNA, binds complementarily to one or more host target binding sites located in untranslated regions of VGAM1961 host target RNA, herein designated VGAM HOST TARGET RNA. This complementary binding is due to the fact that the nucleotide sequence of VGAM1961 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1961 RNA, herein designated VGAM RNA, may have a different number of host target binding sites in untranslated regions of a VGAM1961 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1961 RNA, herein designated VGAM RNA, to host target binding sites on VGAM1961 host target RNA, herein designated VGAM HOST TARGET RNA, such as BINDING SITE I, BINDING SITE II and BINDING SITE III, inhibits translation of VGAM1961 host target RNA into VGAM1961 host target protein, herein designated VGAM HOST TARGET PROTEIN. VGAM host target protein is therefore outlined by a broken line.

It is appreciated that VGAM1961 host target gene, herein designated VGAM HOST TARGET GENE, in fact represents a plurality of VGAM1961 host target genes. The mRNA of each one of this plurality of VGAM1961 host target genes comprises one or more host target binding sites, each having a nucleotide sequence which is at least partly complementary to VGAM1961 RNA, herein designated VGAM RNA, and which when bound by VGAM1961 RNA causes inhibition of translation of respective one or more VGAM1961 host target proteins.

It is further appreciated by one skilled in the art that the mode of translational inhibition illustrated by FIG. 1 with specific reference to translational inhibition exerted by VGAM1961 gene, herein designated VGAM GENE, on one or more VGAM1961 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1961 is inhibition of expression of host target genes, as part of a novel viral mechanism of attacking a host. Accordingly, utilities of VGAM1961 include diagnosis, prevention and treatment of viral infection by Camelpox Virus. Specific functions, and accordingly utilities, of VGAM1961 correlate with, and may be deduced from, the identity of the host target genes which VGAM1961 binds and inhibits, and the function of these host target genes, as elaborated hereinbelow.

Nucleotide sequences of the VGAM1961 precursor RNA, herein designated VGAM PRECURSOR RNA, and of the 'diced' VGAM1961 RNA, herein designated VGAM RNA, and a schematic representation of the secondary folding of VGAM1961 folded precursor RNA, herein designated VGAM FOLDED PRECURSOR RNA, of VGAM1961 are further described hereinbelow with reference to Table 1.

Nucleotide sequences of host target binding sites, such as BINDING SITE-I, BINDING SITE-II and BINDING SITE-III of FIG. 1, found on VGAM1961 host target RNA, and schematic representation of the complementarity of each of these host target binding sites to VGAM1961 RNA, herein designated VGAM RNA, are described hereinbelow with reference to Table 2.

As mentioned hereinabove with reference to FIG. 1, a function of VGAM1961 gene, herein designated VGAM is inhibition of expression of VGAM1961 target genes. It is appreciated that specific functions, and accordingly utilities, of VGAM1961 correlate with, and may be deduced from, the identity of the target genes which VGAM1961 binds and inhibits, and the function of these target genes, as elaborated hereinbelow.

Inositol 1,4,5-triphosphate Receptor, Type 1 (ITPR1, Accession NM_002222) is a VGAM1961 host target gene. ITPR1 BINDING SITE is HOST TARGET binding site found in the 3' untranslated region of mRNA encoded by ITPR1, corresponding to a HOST TARGET binding site such as BINDING SITE I, BINDING SITE II or BINDING SITE III. Table 2 illustrates the complementarity of the nucleotide sequences of ITPR1 BINDING SITE, designated SEQ ID:7985, to the nucleotide sequence of VGAM1961 RNA, herein designated VGAM RNA, also designated SEQ ID:4672.

A function of VGAM1961 is therefore inhibition of Inositol 1,4,5-triphosphate Receptor, Type 1 (ITPR1, Accession NM_002222), a gene which couples cell membrane receptors to Ca2+ signal transduction pathways. Accordingly, utilities of VGAM1961 include diagnosis, prevention and treatment of diseases and clinical conditions associated with ITPR1. The function of ITPR1 and its association with various diseases and clinical conditions, has been established by previous studies, as described hereinabove with reference to VGAM106. FIG. 1 further provides a conceptual description of a novel bioinformatically detected viral gene of the present invention, referred to here as Viral Genomic Address Messenger 1962 (VGAM1962) viral gene, which modulates expression of respective host target genes thereof, the function and utility of which host target genes is known in the art.

VGAM1962 is a novel bioinformatically detected regulatory, non protein coding, viral micro RNA (miRNA) gene.

The method by which VGAM1962 was detected is described hereinabove with reference to FIGS. 1-8.

VGAM1962 gene, herein designated VGAM GENE, is a viral gene contained in the genome of Camelpox Virus. VGAM1962 host target gene, herein designated VGAM HOST TARGET GENE, is a human gene contained in the human genome.

VGAM1962 gene encodes a VGAM1962 precursor RNA, herein designated VGAM PRECURSOR RNA. Similar to other miRNA genes, and unlike most ordinary genes, VGAM1962 precursor RNA does not encode a protein. A nucleotide sequence identical or highly similar to the nucleotide sequence of VGAM1962 precursor RNA is designated SEQ ID:1948, and is provided hereinbelow with reference to the sequence listing part. Nucleotide sequence SEQ ID:1948 is located at position 16962 relative to the genome of Camelpox Virus.

VGAM1962 precursor RNA folds onto itself, forming VGAM1962 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1962 folded precursor RNA into VGAM1962 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1962 RNA is designated SEQ ID:4673, and is provided hereinbelow with reference to the sequence listing part.

VGAM1962 host target gene, herein designated VGAM HOST TARGET GENE, encodes a corresponding messenger RNA, VGAM1962 host target RNA, herein designated VGAM HOST TARGET RNA. VGAM1962 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1962 RNA, herein designated VGAM RNA, binds complementarily to one or more host target binding sites located in untranslated regions of VGAM1962 host target RNA, herein designated VGAM HOST TARGET RNA. This complementary binding is due to the fact that the nucleotide sequence of VGAM1962 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1962 RNA, herein designated VGAM RNA, may have a different number of host target binding sites in untranslated regions of a VGAM1962 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1962 RNA, herein designated VGAM RNA, to host target binding sites on VGAM1962 host target RNA, herein designated VGAM HOST TARGET RNA, such as BINDING SITE I, BINDING SITE II and BINDING SITE III, inhibits translation of VGAM1962 host target RNA into VGAM1962 host target protein, herein designated VGAM HOST TARGET PROTEIN. VGAM host target protein is therefore outlined by a broken line.

It is appreciated that VGAM1962 host target gene, herein designated VGAM HOST TARGET GENE, in fact represents a plurality of VGAM1962 host target genes. The mRNA of each one of this plurality of VGAM1962 host target genes comprises one or more host target binding sites, each having a nucleotide sequence which is at least partly complementary to VGAM1962 RNA, herein designated VGAM RNA, and which when bound by VGAM1962 RNA causes inhibition of translation of respective one or more VGAM1962 host target proteins.

It is further appreciated by one skilled in the art that the mode of translational inhibition illustrated by FIG. 1 with specific reference to translational inhibition exerted by VGAM1962 gene, herein designated VGAM GENE, on one or more VGAM1962 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1962 is inhibition of expression of host target genes, as part of a novel viral mechanism of attacking a host. Accordingly, utilities of VGAM1962 include diagnosis, prevention and treatment of viral infection by Camelpox Virus. Specific functions, and accordingly utilities, of VGAM1962 correlate with, and may be deduced from, the identity of the host target genes which VGAM1962 binds and inhibits, and the function of these host target genes, as elaborated hereinbelow.

Nucleotide sequences of the VGAM1962 precursor RNA, herein designated VGAM PRECURSOR RNA, and of the 'diced' VGAM1962 RNA, herein designated VGAM RNA, and a schematic representation of the secondary folding of VGAM1962 folded precursor RNA, herein designated VGAM FOLDED PRECURSOR RNA, of VGAM1962 are further described hereinbelow with reference to Table 1.

Nucleotide sequences of host target binding sites, such as BINDING SITE-I, BINDING SITE-II and BINDING SITE-III of FIG. 1, found on VGAM1962 host target RNA, and schematic representation of the complementarity of each of these host target binding sites to VGAM1962 RNA, herein designated VGAM RNA, are described hereinbelow with reference to Table 2.

As mentioned hereinabove with reference to FIG. 1, a function of VGAM1962 gene, herein designated VGAM is inhibition of expression of VGAM1962 target genes. It is appreciated that specific functions, and accordingly utilities, of VGAM1962 correlate with, and may be deduced from, the identity of the target genes which VGAM1962 binds and inhibits, and the function of these target genes, as elaborated hereinbelow.

A Kinase (PRKA) Anchor Protein 10 (AKAP10, Accession NM_007202) is a VGAM1962 host target gene. AKAP10 BINDING SITE is HOST TARGET binding site found in the 3' untranslated region of mRNA encoded by AKAP10, corresponding to a HOST TARGET binding site such as BINDING SITE I, BINDING SITE II or BINDING SITE III. Table 2 illustrates the complementarity of the nucleotide sequences of AKAP10 BINDING SITE, designated SEQ ID:14056, to the nucleotide sequence of VGAM1962 RNA, herein designated VGAM RNA, also designated SEQ ID:4673.

A function of VGAM1962 is therefore inhibition of A Kinase (PRKA) Anchor Protein 10 (AKAP10, Accession NM_007202). Accordingly, utilities of VGAM1962 include diagnosis, prevention and treatment of diseases and clinical conditions associated with AKAP10. Chromosome 11 Open Reading Frame 23 (C11orf23, Accession NM_018312) is another VGAM1962 host target gene. C11orf23 BINDING SITE is HOST TARGET binding site found in the 3' untranslated region of mRNA encoded by C11orf23, corresponding to a HOST TARGET binding site such as BINDING SITE I, BINDING SITE II or BINDING SITE III. Table 2 illustrates the complementarity of the nucleotide sequences of C11orf23 BINDING SITE, designated SEQ ID:20304, to the nucleotide sequence of VGAM1962 RNA, herein designated VGAM RNA, also designated SEQ ID:4673.

Another function of VGAM1962 is therefore inhibition of Chromosome 11 Open Reading Frame 23 (C11orf23, Accession NM_018312). Accordingly, utilities of VGAM1962 include diagnosis, prevention and treatment of diseases and clinical conditions associated with C11orf23. C20orf180 (Accession NM_018431) is another VGAM1962 host target gene. C20orf180 BINDING SITE is HOST TARGET binding site found in the 3' untranslated region of mRNA encoded by C20orf180, corresponding to a HOST TARGET binding site such as BINDING SITE I, BINDING SITE II or BINDING SITE III. Table 2 illustrates the complementarity of the nucleotide sequences of C20orf180 BINDING SITE, designated SEQ ID:20494, to the nucleotide sequence of VGAM1962 RNA, herein designated VGAM RNA, also designated SEQ ID:4673.

Another function of VGAM1962 is therefore inhibition of C20orf180 (Accession NM_018431). Accordingly, utilities of VGAM1962 include diagnosis, prevention and treatment of diseases and clinical conditions associated with C20orf180. FIG. 1 further provides a conceptual description of a novel bioinformatically detected viral gene of the present invention, referred to here as Viral Genomic Address Messenger 1963 (VGAM1963) viral gene, which modulates expression of respective host target genes thereof, the function and utility of which host target genes is known in the art.

VGAM1963 is a novel bioinformatically detected regulatory, non protein coding, viral micro RNA (miRNA) gene. The method by which VGAM1963 was detected is described hereinabove with reference to FIGS. 1-8.

VGAM1963 gene, herein designated VGAM GENE, is a viral gene contained in the genome of Camelpox Virus. VGAM1963 host target gene, herein designated VGAM HOST TARGET GENE, is a human gene contained in the human genome.

VGAM1963 gene encodes a VGAM1963 precursor RNA, herein designated VGAM PRECURSOR RNA. Similar to other miRNA genes, and unlike most ordinary genes, VGAM1963 precursor RNA does not encode a protein. A nucleotide sequence identical or highly similar to the nucleotide sequence of VGAM1963 precursor RNA is designated SEQ ID:1949, and is provided hereinbelow with reference to the sequence listing part. Nucleotide sequence SEQ ID:1949 is located at position 17595 relative to the genome of Camelpox Virus.

VGAM1963 precursor RNA folds onto itself, forming VGAM1963 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1963 folded precursor RNA into VGAM1963 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1963 RNA is designated SEQ ID:4674, and is provided hereinbelow with reference to the sequence listing part.

VGAM1963 host target gene, herein designated VGAM HOST TARGET GENE, encodes a corresponding messenger RNA, VGAM1963 host target RNA, herein designated VGAM HOST TARGET RNA. VGAM1963 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1963 RNA, herein designated VGAM RNA, binds complementarily to one or more host target binding sites located in untranslated regions of VGAM1963 host target RNA, herein designated VGAM HOST TARGET RNA. This complementary binding is due to the fact that the nucleotide sequence of VGAM1963 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1963 RNA, herein designated VGAM RNA, may have a different number of host target binding sites in untranslated regions of a VGAM1963 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1963 RNA, herein designated VGAM RNA, to host target binding sites on VGAM1963 host target RNA, herein designated VGAM HOST TARGET RNA, such as BINDING SITE I, BINDING SITE II and BINDING SITE III, inhibits translation of VGAM1963 host target RNA into VGAM1963 host target protein, herein designated VGAM HOST TARGET PROTEIN. VGAM host target protein is therefore outlined by a broken line.

It is appreciated that VGAM1963 host target gene, herein designated VGAM HOST TARGET GENE, in fact represents a plurality of VGAM1963 host target genes. The mRNA of each one of this plurality of VGAM1963 host target genes comprises one or more host target binding sites, each having a nucleotide sequence which is at least partly complementary to VGAM1963 RNA, herein designated VGAM RNA, and which when bound by VGAM1963 RNA causes inhibition of translation of respective one or more VGAM1963 host target proteins.

It is further appreciated by one skilled in the art that the mode of translational inhibition illustrated by FIG. 1 with specific reference to translational inhibition exerted by VGAM1963 gene, herein designated VGAM GENE, on one or more VGAM1963 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1963 is inhibition of expression of host target genes, as part of a novel viral mechanism of attacking a host. Accordingly, utilities of VGAM1963 include diagnosis, prevention and treatment of viral infection by Camelpox Virus. Specific functions, and accordingly utilities, of VGAM1963 correlate with, and may be deduced from, the identity of the host target genes which VGAM1963 binds and inhibits, and the function of these host target genes, as elaborated hereinbelow.

Nucleotide sequences of the VGAM1963 precursor RNA, herein designated VGAM PRECURSOR RNA, and of the 'diced' VGAM1963 RNA, herein designated VGAM RNA, and a schematic representation of the secondary folding of VGAM1963 folded precursor RNA, herein designated VGAM FOLDED PRECURSOR RNA, of VGAM1963 are further described hereinbelow with reference to Table 1.

Nucleotide sequences of host target binding sites, such as BINDING SITE-I, BINDING SITE-II and BINDING SITE-III of FIG. 1, found on VGAM1963 host target RNA, and schematic representation of the complementarity of each of these host target binding sites to VGAM1963 RNA, herein designated VGAM RNA, are described hereinbelow with reference to Table 2.

As mentioned hereinabove with reference to FIG. 1, a function of VGAM1963 gene, herein designated VGAM is inhibition of expression of VGAM1963 target genes. It is appreciated that specific functions, and accordingly utilities, of VGAM1963 correlate with, and may be deduced from, the identity of the target genes which VGAM1963 binds and inhibits, and the function of these target genes, as elaborated hereinbelow.

Retinitis Pigmentosa 2 (X-linked recessive) (RP2, Accession NM_006915) is a VGAM1963 host target gene. RP2 BINDING SITE is HOST TARGET binding site found in the 3' untranslated region of mRNA encoded by RP2, corresponding to a HOST TARGET binding site such as BINDING SITE I, BINDING SITE II or BINDING SITE III. Table 2 illustrates the complementarity of the nucleotide sequences of RP2 BINDING SITE, designated SEQ ID:13790, to the nucleotide sequence of VGAM1963 RNA, herein designated VGAM RNA, also designated SEQ ID:4674.

A function of VGAM1963 is therefore inhibition of Retinitis Pigmentosa 2 (X-linked recessive) (RP2, Accession NM_006915). Accordingly, utilities of VGAM1963 include diagnosis, prevention and treatment of diseases and clinical conditions associated with RP2. caspr5 (Accession NM_130773) is another VGAM1963 host target gene. caspr5 BINDING SITE is HOST TARGET binding site found in the 3' untranslated region of mRNA encoded by caspr5, corresponding to a HOST TARGET binding site such as BINDING SITE I, BINDING SITE II or BINDING SITE III. Table 2 illustrates the complementarity of the nucleotide sequences of caspr5 BINDING SITE, designated SEQ ID:28267, to the nucleotide sequence of VGAM1963 RNA, herein designated VGAM RNA, also designated SEQ ID:4674.

Another function of VGAM1963 is therefore inhibition of caspr5 (Accession NM_130773). Accordingly, utilities of VGAM1963 include diagnosis, prevention and treatment of diseases and clinical conditions associated with caspr5. FLJ11252 (Accession XM_041702) is another VGAM1963 host target gene. FLJ11252 BINDING SITE is HOST TARGET binding site found in the 3' untranslated region of mRNA encoded by FLJ11252, corresponding to a HOST TARGET binding site such as BINDING SITE I, BINDING SITE II or BINDING SITE III. Table 2 illustrates the complementarity of the nucleotide sequences of FLJ11252 BINDING SITE, designated SEQ ID:33566, to the nucleotide sequence of VGAM1963 RNA, herein designated VGAM RNA, also designated SEQ ID:4674.

Another function of VGAM1963 is therefore inhibition of FLJ11252 (Accession XM_041702). Accordingly, utilities of VGAM1963 include diagnosis, prevention and treatment of diseases and clinical conditions associated with FLJ11252.

FIG. 1 further provides a conceptual description of a novel bioinformatically detected viral gene of the present invention, referred to here as Viral Genomic Address Messenger 1964 (VGAM1964) viral gene, which modulates expression of respective host target genes thereof, the function and utility of which host target genes is known in the art.

VGAM1964 is a novel bioinformatically detected regulatory, non protein coding, viral micro RNA (miRNA) gene. The method by which VGAM1964 was detected is described hereinabove with reference to FIGS. 1-8.

VGAM1964 gene, herein designated VGAM GENE, is a viral gene contained in the genome of Rana Tigrina Ranavirus. VGAM1964 host target gene, herein designated VGAM HOST TARGET GENE, is a human gene contained in the human genome.

VGAM1964 gene encodes a VGAM1964 precursor RNA, herein designated VGAM PRECURSOR RNA. Similar to other miRNA genes, and unlike most ordinary genes, VGAM1964 precursor RNA does not encode a protein. A nucleotide sequence identical or highly similar to the nucleotide sequence of VGAM1964 precursor RNA is designated SEQ ID:1950, and is provided hereinbelow with reference to the sequence listing part. Nucleotide sequence SEQ ID:1950 is located at position 87983 relative to the genome of Rana Tigrina Ranavirus.

VGAM1964 precursor RNA folds onto itself, forming VGAM1964 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1964 folded precursor RNA into VGAM1964 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1964 RNA is designated SEQ ID:4675, and is provided hereinbelow with reference to the sequence listing part.

VGAM1964 host target gene, herein designated VGAM HOST TARGET GENE, encodes a corresponding messenger RNA, VGAM1964 host target RNA, herein designated VGAM HOST TARGET RNA. VGAM1964 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1964 RNA, herein designated VGAM RNA, binds complementarily to one or more host target binding sites located in untranslated regions of VGAM1964 host target RNA, herein designated VGAM HOST TARGET RNA. This complementary binding is due to the fact that the nucleotide sequence of VGAM1964 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1964 RNA, herein designated VGAM RNA, may have a different number of host target binding sites in untranslated regions of a VGAM1964 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1964 RNA, herein designated VGAM RNA, to host target binding sites on VGAM1964 host target RNA, herein designated VGAM HOST TARGET RNA, such as BINDING SITE I, BINDING SITE II and BINDING SITE III, inhibits translation of VGAM1964 host target RNA into VGAM1964 host target protein, herein designated VGAM HOST TARGET PROTEIN. VGAM host target protein is therefore outlined by a broken line.

It is appreciated that VGAM1964 host target gene, herein designated VGAM HOST TARGET GENE, in fact represents a plurality of VGAM1964 host target genes. The mRNA of each one of this plurality of VGAM1964 host target genes comprises one or more host target binding sites, each having a nucleotide sequence which is at least partly complementary to VGAM1964 RNA, herein designated VGAM RNA, and which when bound by VGAM1964 RNA causes inhibition of translation of respective one or more VGAM1964 host target proteins.

It is further appreciated by one skilled in the art that the mode of translational inhibition illustrated by FIG. 1 with specific reference to translational inhibition exerted by VGAM1964 gene, herein designated VGAM GENE, on one or more VGAM1964 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1964 is inhibition of expression of host target genes, as part of a novel viral mechanism of attacking a host. Accordingly, utilities of VGAM1964 include diagnosis, prevention and treatment of viral infection by Rana Tigrina Ranavirus. Specific functions, and accordingly utilities, of VGAM1964 correlate with, and may be deduced from, the identity of the host target genes which VGAM1964 binds and inhibits, and the function of these host target genes, as elaborated hereinbelow.

Nucleotide sequences of the VGAM1964 precursor RNA, herein designated VGAM PRECURSOR RNA, and of the 'diced' VGAM1964 RNA, herein designated VGAM RNA, and a schematic representation of the secondary folding of VGAM1964 folded precursor RNA, herein designated VGAM FOLDED PRECURSOR RNA, of VGAM1964 are further described hereinbelow with reference to Table 1.

Nucleotide sequences of host target binding sites, such as BINDING SITE-I, BINDING SITE-II and BINDING SITE-III of FIG. 1, found on VGAM1964 host target RNA, and schematic representation of the complementarity of each of these host target binding sites to VGAM1964 RNA, herein designated VGAM RNA, are described hereinbelow with reference to Table 2.

As mentioned hereinabove with reference to FIG. 1, a function of VGAM1964 gene, herein designated VGAM is inhibition of expression of VGAM1964 target genes. It is appreciated that specific functions, and accordingly utilities, of VGAM1964 correlate with, and may be deduced from, the identity of the target genes which VGAM1964 binds and inhibits, and the function of these target genes, as elaborated hereinbelow.

UDP-GlcNAc:betaGal Beta-1,3-N-acetylglucosaminyltransferase 3 (B3GNT3, Accession NM_014256) is a VGAM1964 host target gene. B3GNT3 BINDING SITE is HOST TARGET binding site found in the 3' untranslated region of mRNA encoded by B3GNT3, corresponding to a HOST TARGET binding site such as BINDING SITE I, BINDING SITE II or BINDING SITE III. Table 2 illustrates the complementarity of the nucleotide sequences of B3GNT3 BINDING SITE, designated SEQ ID:15533, to the nucleotide sequence of VGAM1964 RNA, herein designated VGAM RNA, also designated SEQ ID:4675.

A function of VGAM1964 is therefore inhibition of UDP-GlcNAc:betaGal Beta-1,3-N-acetylglucosaminyltransferase 3 (B3GNT3, Accession NM_014256). Accordingly, utilities of VGAM1964 include diagnosis, prevention and treatment of diseases and clinical conditions associated with B3GNT3. Microtubule-associated Protein 7 (MAP7, Accession NM_003980) is another VGAM1964 host target gene. MAP7 BINDING SITE is HOST TARGET binding site found in the 3' untranslated region of mRNA encoded by MAP7, corresponding to a HOST TARGET binding site such as BINDING SITE I, BINDING SITE II or BINDING SITE III. Table 2 illustrates the complementarity of the nucleotide sequences of MAP7 BINDING SITE, designated SEQ ID:10118, to the nucleotide sequence of VGAM1964 RNA, herein designated VGAM RNA, also designated SEQ ID:4675.

Another function of VGAM1964 is therefore inhibition of Microtubule-associated Protein 7 (MAP7, Accession NM_003980), a gene which Microtubule-associated protein 7; stabilizes microtubules, may help establish epithelial cell polarity. Accordingly, utilities of VGAM1964 include diagnosis, prevention and treatment of diseases and clinical conditions associated with MAP7. The function of MAP7 and its association with various diseases and clinical conditions, has been established by previous studies, as described hereinabove with reference to VGAM1373. Retinal Pigment Epithelium-specific Protein 65 kDa (RPE65, Accession NM_000329) is another VGAM1964 host target gene. RPE65 BINDING SITE is HOST TARGET binding site found in the 3' untranslated region of mRNA encoded by RPE65, corresponding to a HOST TARGET binding site such as BINDING SITE I, BINDING SITE II or BINDING SITE III. Table 2 illustrates the complementarity of the nucleotide sequences of RPE65 BINDING SITE, designated SEQ ID:5872, to the nucleotide sequence of VGAM1964 RNA, herein designated VGAM RNA, also designated SEQ ID:4675.

Another function of VGAM1964 is therefore inhibition of Retinal Pigment Epithelium-specific Protein 65 kDa (RPE65, Accession NM_000329), a gene which May play a role in vitamin-A metabolism of the retina. Accordingly, utilities of VGAM1964 include diagnosis, prevention and treatment of diseases and clinical conditions associated with RPE65. The function of RPE65 and its association with various diseases and clinical conditions, has been established by previous studies, as described hereinabove with reference to VGAM66. ERp44 (Accession XM_088476) is another VGAM1964 host target gene. ERp44 BINDING SITE is HOST TARGET binding site found in the 3' untranslated region of mRNA encoded by ERp44, corresponding to a HOST TARGET binding site such as BINDING SITE I, BINDING SITE II or BINDING SITE III. Table 2 illustrates the complementarity of the nucleotide sequences of ERp44 BINDING SITE, designated SEQ ID:39722, to the nucleotide sequence of VGAM1964 RNA, herein designated VGAM RNA, also designated SEQ ID:4675.

Another function of VGAM1964 is therefore inhibition of ERp44 (Accession XM_088476). Accordingly, utilities of VGAM1964 include diagnosis, prevention and treatment of diseases and clinical conditions associated with ERp44. KIAA0266 (Accession NM_021645) is another VGAM1964 host target gene. KIAA0266 BINDING SITE is HOST TARGET binding site found in the 3' untranslated region of mRNA encoded by KIAA0266, corresponding to a HOST TARGET binding site such as BINDING SITE I, BINDING SITE II or BINDING SITE III. Table 2 illustrates the complementarity of the nucleotide sequences of KIAA0266 BINDING SITE, designated SEQ ID:22309, to the nucleotide sequence of VGAM1964 RNA, herein designated VGAM RNA, also designated SEQ ID:4675.

Another function of VGAM1964 is therefore inhibition of KIAA0266 (Accession NM_021645). Accordingly, utilities of VGAM1964 include diagnosis, prevention and treatment of diseases and clinical conditions associated with KIAA0266. LOC113523 (Accession XM_054378) is another VGAM1964 host target gene. LOC113523 BINDING SITE is HOST TARGET binding site found in the 3' untranslated region of mRNA encoded by LOC113523, corresponding to a HOST TARGET binding site such as BINDING SITE I, BINDING SITE II or BINDING SITE III. Table 2 illustrates the complementarity of the nucleotide sequences of LOC113523 BINDING SITE, designated SEQ ID:36152, to the nucleotide sequence of VGAM1964 RNA, herein designated VGAM RNA, also designated SEQ ID:4675.

Another function of VGAM1964 is therefore inhibition of LOC113523 (Accession XM_054378). Accordingly, utilities of VGAM1964 include diagnosis, prevention and treatment of diseases and clinical conditions associated with LOC113523. LOC145786 (Accession XM_096860) is another VGAM1964 host target gene. LOC145786 BINDING SITE is HOST TARGET binding site found in the 5' untranslated region of mRNA encoded by LOC145786, corresponding to a HOST TARGET binding site such as BINDING SITE I, BINDING SITE II or BINDING SITE III. Table 2 illustrates the complementarity of the nucleotide sequences of LOC145786 BINDING SITE, designated SEQ ID:40591, to the nucleotide sequence of VGAM1964 RNA, herein designated VGAM RNA, also designated SEQ ID:4675.

Another function of VGAM1964 is therefore inhibition of LOC145786 (Accession XM_096860). Accordingly, utilities of VGAM1964 include diagnosis, prevention and treatment of diseases and clinical conditions associated with LOC145786. LOC146332 (Accession XM_085413) is another VGAM1964 host target gene. LOC146332 BINDING SITE is HOST TARGET binding site found in the 3' untranslated region of mRNA encoded by LOC146332, corresponding to a HOST TARGET binding site such as BINDING SITE I, BINDING SITE II or BINDING SITE III. Table 2 illustrates the complementarity of the nucleotide sequences of LOC146332 BINDING SITE, designated SEQ ID:38128, to the nucleotide sequence of VGAM1964 RNA, herein designated VGAM RNA, also designated SEQ ID:4675.

Another function of VGAM1964 is therefore inhibition of LOC146332 (Accession XM_085413). Accordingly, utilities of VGAM1964 include diagnosis, prevention and treatment of diseases and clinical conditions associated with LOC146332. LOC158527 (Accession XM_088594) is another VGAM1964 host target gene. LOC158527 BINDING SITE is HOST TARGET binding site found in the 5' untranslated region of mRNA encoded by LOC158527, corresponding to a HOST TARGET binding site such as BINDING SITE I, BINDING SITE II or BINDING SITE III. Table 2 illustrates the complementarity of the nucleotide sequences of LOC158527 BINDING SITE, designated SEQ ID:39865, to the nucleotide sequence of VGAM1964 RNA, herein designated VGAM RNA, also designated SEQ ID:4675.

Another function of VGAM1964 is therefore inhibition of LOC158527 (Accession XM_088594). Accordingly, utilities of VGAM1964 include diagnosis, prevention and treatment of diseases and clinical conditions associated with LOC158527. LOC91408 (Accession XM_038290) is another VGAM1964 host target gene. LOC91408 BINDING SITE is HOST TARGET binding site found in the 3' untranslated region of mRNA encoded by LOC91408, corresponding to a HOST TARGET binding site such as BINDING SITE I, BINDING SITE II or BINDING SITE III. Table 2 illustrates the complementarity of the nucleotide sequences of LOC91408 BINDING SITE, designated SEQ ID:32792, to the nucleotide sequence of VGAM1964 RNA, herein designated VGAM RNA, also designated SEQ ID:4675.

Another function of VGAM1964 is therefore inhibition of LOC91408 (Accession XM_038290). Accordingly, utilities of VGAM1964 include diagnosis, prevention and treatment of diseases and clinical conditions associated with LOC91408. FIG. 1 further provides a conceptual description of a novel bioinformatically detected viral gene of the present invention, referred to here as Viral Genomic Address Messenger 1965 (VGAM1965) viral gene, which modulates expression of respective host target genes thereof, the function and utility of which host target genes is known in the art.

VGAM1965 is a novel bioinformatically detected regulatory, non protein coding, viral micro RNA (miRNA) gene. The method by which VGAM1965 was detected is described hereinabove with reference to FIGS. 1-8.

VGAM1965 gene, herein designated VGAM GENE, is a viral gene contained in the genome of Rana Tigrina Ranavirus. VGAM1965 host target gene, herein designated VGAM HOST TARGET GENE, is a human gene contained in the human genome.

VGAM1965 gene encodes a VGAM1965 precursor RNA, herein designated VGAM PRECURSOR RNA. Similar to other miRNA genes, and unlike most ordinary genes, VGAM1965 precursor RNA does not encode a protein. A nucleotide sequence identical or highly similar to the nucleotide sequence of VGAM1965 precursor RNA is designated SEQ ID:1951, and is provided hereinbelow with reference to the sequence listing part. Nucleotide sequence SEQ ID:1951 is located at position 100137 relative to the genome of Rana Tigrina Ranavirus.

VGAM1965 precursor RNA folds onto itself, forming VGAM1965 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1965 folded precursor RNA into VGAM1965 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1965 RNA is designated SEQ ID:4676, and is provided hereinbelow with reference to the sequence listing part.

VGAM1965 host target gene, herein designated VGAM HOST TARGET GENE, encodes a corresponding messenger RNA, VGAM1965 host target RNA, herein designated VGAM HOST TARGET RNA. VGAM1965 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1965 RNA, herein designated VGAM RNA, binds complementarily to one or more host target binding sites located in untranslated regions of VGAM1965 host target RNA, herein designated VGAM HOST TARGET RNA. This complementary binding is due to the fact that the nucleotide sequence of VGAM1965 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1965 RNA, herein designated VGAM RNA, may have a different number of host target binding sites in untranslated regions of a VGAM1965 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1965 RNA, herein designated VGAM RNA, to host target binding sites on VGAM1965 host target RNA, herein designated VGAM HOST TARGET RNA, such as BINDING SITE I, BINDING SITE II and BINDING SITE III, inhibits translation of VGAM1965 host target RNA into VGAM1965 host target protein, herein designated VGAM HOST TARGET PROTEIN. VGAM host target protein is therefore outlined by a broken line.

It is appreciated that VGAM1965 host target gene, herein designated VGAM HOST TARGET GENE, in fact represents a plurality of VGAM1965 host target genes. The mRNA of each one of this plurality of VGAM1965 host target genes comprises one or more host target binding sites, each having a nucleotide sequence which is at least partly complementary to VGAM1965 RNA, herein designated VGAM RNA, and which when bound by VGAM1965 RNA causes inhibition of translation of respective one or more VGAM1965 host target proteins.

It is further appreciated by one skilled in the art that the mode of translational inhibition illustrated by FIG. 1 with specific reference to translational inhibition exerted by VGAM1965 gene, herein designated VGAM GENE, on one or more VGAM1965 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1965 is inhibition of expression of host target genes, as part of a novel viral mechanism of attacking a host. Accordingly, utilities of VGAM1965 include diagnosis, prevention and treatment of viral infection by Rana Tigrina Ranavirus. Specific functions, and accordingly utilities, of VGAM1965 correlate with, and may be deduced from, the identity of the host target genes which VGAM1965 binds and inhibits, and the function of these host target genes, as elaborated hereinbelow.

Nucleotide sequences of the VGAM1965 precursor RNA, herein designated VGAM PRECURSOR RNA, and of the 'diced' VGAM1965 RNA, herein designated VGAM RNA, and a schematic representation of the secondary folding of VGAM1965 folded precursor RNA, herein designated VGAM FOLDED PRECURSOR RNA, of VGAM1965 are further described hereinbelow with reference to Table 1.

Nucleotide sequences of host target binding sites, such as BINDING SITE-I, BINDING SITE-II and BINDING SITE-III of FIG. 1, found on VGAM1965 host target RNA, and schematic representation of the complementarity of each of these host target binding sites to VGAM1965 RNA, herein designated VGAM RNA, are described hereinbelow with reference to Table 2.

As mentioned hereinabove with reference to FIG. 1, a function of VGAM1965 gene, herein designated VGAM is inhibition of expression of VGAM1965 target genes. It is appreciated that specific functions, and accordingly utilities, of VGAM1965 correlate with, and may be deduced from, the identity of the target genes which VGAM1965 binds and inhibits, and the function of these target genes, as elaborated hereinbelow.

ATP-binding Cassette, Sub-family D (ALD), Member 4 (ABCD4, Accession NM_020323) is a VGAM1965 host target gene. ABCD4 BINDING SITE1 through ABCD4 BINDING SITE4 are HOST TARGET binding sites found in untranslated regions of mRNA encoded by ABCD4, corresponding to HOST TARGET binding sites such as BINDING SITE I, BINDING SITE II or BINDING SITE III. Table 2 illustrates the complementarity of the nucleotide sequences of ABCD4 BINDING SITE1 through ABCD4 BINDING SITE4, designated SEQ ID:21583, SEQ ID:21585, SEQ ID:21588 and SEQ ID:21591 respectively, to the nucleotide sequence of VGAM1965 RNA, herein designated VGAM RNA, also designated SEQ ID:4676.

A function of VGAM1965 is therefore inhibition of ATP-binding Cassette, Sub-family D (ALD), Member 4 (ABCD4, Accession NM_020323), a gene which Putative peroxisomal ATP binding cassette transporter. Accordingly, utilities of VGAM1965 include diagnosis, prevention and treatment of diseases and clinical conditions associated with ABCD4. The function of ABCD4 and its association with various diseases and clinical conditions, has been established by previous studies, as described hereinabove with reference to VGAM1924. Acid Phosphatase, Testicular (ACPT, Accession NM_080790) is another VGAM1965 host target gene. ACPT BINDING SITE1 and ACPT BINDING SITE2 are HOST TARGET binding sites found in untranslated regions of mRNA encoded by ACPT, corresponding to HOST TARGET binding sites such as BINDING SITE I, BINDING SITE II or BINDING SITE III. Table 2 illustrates the complementarity of the nucleotide sequences of ACPT BINDING SITE1 and ACPT BINDING SITE2, designated SEQ ID:28049 and SEQ ID:35054 respectively, to the nucleotide sequence of VGAM1965 RNA, herein designated VGAM RNA, also designated SEQ ID:4676.

Another function of VGAM1965 is therefore inhibition of Acid Phosphatase, Testicular (ACPT, Accession NM_080790). Accordingly, utilities of VGAM1965 include diagnosis, prevention and treatment of diseases and clinical conditions associated with ACPT. Adenylate Cyclase 6 (ADCY6, Accession NM_015270) is another VGAM1965 host target gene. ADCY6 BINDING SITE1 and ADCY6 BINDING SITE2 are HOST TARGET binding sites found in untranslated regions of mRNA encoded by ADCY6, corresponding to HOST TARGET binding sites such as BINDING SITE I, BINDING SITE II or BINDING SITE III. Table 2 illustrates the complementarity of the nucleotide sequences of ADCY6 BINDING SITE1 and ADCY6 BINDING SITE2, designated SEQ ID:17592 and SEQ ID:43182 respectively, to the nucleotide sequence of VGAM1965 RNA, herein designated VGAM RNA, also designated SEQ ID:4676.

Another function of VGAM1965 is therefore inhibition of Adenylate Cyclase 6 (ADCY6, Accession NM_015270), a gene which this a membrane-bound, ca (2+)-inhibitable adenylyl cyclase (by similarity). Accordingly, utilities of VGAM1965 include diagnosis, prevention and treatment of diseases and clinical conditions associated with ADCY6. The function of ADCY6 and its association with various diseases and clinical conditions, has been established by previous studies, as described hereinabove with reference to VGAM22. S-adenosylmethionine Decarboxylase 1 (AMD1, Accession NM_001634) is another VGAM1965 host target gene. AMD1 BINDING SITE is HOST TARGET binding site found in the 3' untranslated region of mRNA encoded by AMD1, corresponding to a HOST TARGET binding site such as BINDING SITE I, BINDING SITE II or BINDING SITE III. Table 2 illustrates the complementarity of the nucleotide sequences of AMD1 BINDING SITE, designated SEQ ID:7346, to the nucleotide sequence of VGAM1965 RNA, herein designated VGAM RNA, also designated SEQ ID:4676.

Another function of VGAM1965 is therefore inhibition of S-adenosylmethionine Decarboxylase 1 (AMD1, Accession NM_001634), a gene which catalyzes the removal of the carboxylate group of S-adenosylmethionine in the polyamine biosynthesis pathway. Accordingly, utilities of VGAM1965 include diagnosis, prevention and treatment of diseases and clinical conditions associated with AMD1. The function of AMD1 and its association with various diseases and clinical conditions, has been established by previous studies, as described hereinabove with reference to VGAM1016. Aminomethyltransferase (glycine cleavage system protein T) (AMT, Accession NM_000481) is another VGAM1965 host target gene. AMT BINDING SITE is HOST TARGET binding site found in the 3' untranslated region of mRNA encoded by AMT, corresponding to a HOST TARGET binding site such as BINDING SITE I, BINDING SITE II or BINDING SITE III. Table 2 illustrates the complementarity of the nucleotide sequences of AMT BINDING SITE, designated SEQ ID:6091, to the nucleotide sequence of VGAM1965 RNA, herein designated VGAM RNA, also designated SEQ ID:4676.

Another function of VGAM1965 is therefore inhibition of Aminomethyltransferase (glycine cleavage system protein T) (AMT, Accession NM_000481). Accordingly, utilities of VGAM1965 include diagnosis, prevention and treatment of diseases and clinical conditions associated with AMT. Ankyrin Repeat Domain 3 (ANKRD3, Accession NM_020639) is another VGAM1965 host target gene. ANKRD3 BINDING SITE is HOST TARGET binding site found in the 3' untranslated region of mRNA encoded by ANKRD3, corresponding to a HOST TARGET binding site such as BINDING SITE I, BINDING SITE II or BINDING SITE III. Table 2 illustrates the complementarity of the nucleotide sequences of ANKRD3 BINDING SITE, designated SEQ ID:21798, to the nucleotide sequence of VGAM1965 RNA, herein designated VGAM RNA, also designated SEQ ID:4676.

Another function of VGAM1965 is therefore inhibition of Ankyrin Repeat Domain 3 (ANKRD3, Accession NM_020639). Accordingly, utilities of VGAM1965 include diagnosis, prevention and treatment of diseases and clinical conditions associated with ANKRD3. Adaptor-related Protein Complex 1, Beta 1 Subunit (AP1B1, Accession NM_001127) is another VGAM1965 host target gene. AP1B1 BINDING SITE is HOST TARGET binding site found in the 3' untranslated region of mRNA encoded by AP1B1, corresponding to a HOST TARGET binding site such as BINDING SITE I, BINDING SITE II or BINDING SITE III. Table 2 illustrates the complementarity of the nucleotide sequences of AP1B1 BINDING SITE, designated SEQ ID:6798, to the nucleotide sequence of VGAM1965 RNA, herein designated VGAM RNA, also designated SEQ ID:4676.

Another function of VGAM1965 is therefore inhibition of Adaptor-related Protein Complex 1, Beta 1 Subunit (AP1B1, Accession NM_001127), a gene which plays a role in protein sorting in the late-golgi/trans-golgi network (tgn) and/or endosomes. Accordingly, utilities of VGAM1965 include diagnosis, prevention and treatment of diseases and clinical conditions associated with AP1B1. The function of AP1B1 and its association with various diseases and clinical conditions, has been established by previous studies, as described hereinabove with reference to VGAM1048. Adenomatosis Polyposis Coli (APC, Accession NM_000038) is another VGAM1965 host target gene. APC BINDING SITE is HOST TARGET binding site found in the 3" untranslated region of mRNA encoded by APC, corresponding to a HOST TARGET binding site such as BINDING SITE I, BINDING SITE II or BINDING SITE III. Table 2 illustrates the complementarity of the nucleotide sequences of APC BINDING SITE, designated SEQ ID:5479, to the nucleotide sequence of VGAM1965 RNA, herein designated VGAM RNA, also designated SEQ ID:4676.

Another function of VGAM1965 is therefore inhibition of Adenomatosis Polyposis Coli (APC, Accession NM_000038). Accordingly, utilities of VGAM1965 include diagnosis, prevention and treatment of diseases and clinical conditions associated with APC. APPL (Accession NM_012096) is another VGAM1965 host target gene. APPL BINDING SITE is HOST TARGET binding site found in the 3' untranslated region of mRNA encoded by APPL, corresponding to a HOST TARGET binding site such as BINDING SITE I, BINDING SITE II or BINDING SITE III. Table 2 illustrates the complementarity of the nucleotide sequences of APPL BINDING SITE, designated SEQ ID:14401, to the nucleotide sequence of VGAM1965 RNA, herein designated VGAM RNA, also designated SEQ ID:4676.

Another function of VGAM1965 is therefore inhibition of APPL (Accession NM_012096). Accordingly, utilities of VGAM1965 include diagnosis, prevention and treatment of diseases and clinical conditions associated with APPL. Archain 1 (ARCN1, Accession NM_001655) is another VGAM1965 host target gene. ARCN1 BINDING SITE is HOST TARGET binding site found in the 3' untranslated region of mRNA encoded by ARCN1, corresponding to a HOST TARGET binding site such as BINDING SITE I, BINDING SITE II or BINDING SITE III. Table 2 illustrates the complementarity of the nucleotide sequences of ARCN1 BINDING SITE, designated SEQ ID:7368, to the nucleotide sequence of VGAM1965 RNA, herein designated VGAM RNA, also designated SEQ ID:4676.

Another function of VGAM1965 is therefore inhibition of Archain 1 (ARCN1, Accession NM_001655), a gene which plays a fundamental role in eukaryotic cell biology. Accordingly, utilities of VGAM1965 include diagnosis, prevention and treatment of diseases and clinical conditions associated with ARCN1. The function of ARCN1 and its association with various diseases and clinical conditions, has been established by previous studies, as described hereinabove with reference to VGAM1226. ADP-ribosylation Factor 3 (ARF3, Accession NM_001659) is another VGAM1965 host target gene. ARF3 BINDING SITE is HOST TARGET binding site found in the 3' untranslated region of mRNA encoded by ARF3, corresponding to a HOST TARGET binding site such as BINDING SITE I, BINDING SITE II or BINDING SITE III. Table 2 illustrates the complementarity of the nucleotide sequences of ARF3 BINDING SITE, designated SEQ ID:7380, to the nucleotide sequence of VGAM1965 RNA, herein designated VGAM RNA, also designated SEQ ID:4676.

Another function of VGAM1965 is therefore inhibition of ADP-ribosylation Factor 3 (ARF3, Accession NM_001659). Accordingly, utilities of VGAM1965 include diagnosis, prevention and treatment of diseases and clinical conditions associated with ARF3. Rho Guanine Nucleotide Exchange Factor (GEF) 7 (ARHGEF7, Accession NM_003899) is another VGAM1965 host target gene. ARHGEF7 BINDING SITE is HOST TARGET binding site found in the 3' untranslated region of mRNA encoded by ARHGEF7, corresponding to a HOST TARGET binding site such as BINDING SITE I, BINDING SITE II or BINDING SITE III. Table 2 illustrates the complementarity of the nucleotide sequences of ARHGEF7 BINDING SITE, designated SEQ ID:9986, to the nucleotide sequence of VGAM1965 RNA, herein designated VGAM RNA, also designated SEQ ID:4676.

Another function of VGAM1965 is therefore inhibition of Rho Guanine Nucleotide Exchange Factor (GEF) 7 (ARHGEF7, Accession NM_003899), a gene which acts as a rac1 guanine nucleotide exchange factor (gef) and can induce membrane ruffling. Accordingly, utilities of VGAM1965 include diagnosis, prevention and treatment of diseases and clinical conditions associated with ARHGEF7. The function of ARHGEF7 and its association with various diseases and clinical conditions, has been established by previous studies, as described hereinabove with reference to VGAM297. ATP10C (Accession NM_024490) is another VGAM1965 host target gene. ATP10C BINDING SITE is HOST TARGET binding site found in the 3' untranslated region of mRNA encoded by ATP10C, corresponding to a HOST TARGET binding site such as BINDING SITE I, BINDING SITE II or BINDING SITE III. Table 2 illustrates the complementarity of the nucleotide sequences of ATP10C BINDING SITE, designated SEQ ID:23688, to the nucleotide sequence of VGAM1965 RNA, herein designated VGAM RNA, also designated SEQ ID:4676.

Another function of VGAM1965 is therefore inhibition of ATP10C (Accession NM_024490), a gene which is phosphorylated in their intermediate state, drives uphill transport of ions across membranes. Accordingly, utilities of VGAM1965 include diagnosis, prevention and treatment of diseases and clinical conditions associated with ATP10C. The function of ATP10C and its association with various diseases and clinical conditions, has been established by previous studies, as described hereinabove with reference to VGAM801. ATPase, Class VI, Type 11A (ATP11A, Accession XM_085028) is another VGAM1965 host target gene. ATP11A BINDING SITE is HOST TARGET binding site found in the 3' untranslated region of mRNA encoded by ATP11A, corresponding to a HOST TARGET binding site such as BINDING SITE I, BINDING SITE II or BINDING SITE III. Table 2 illustrates the complementarity of the nucleotide sequences of ATP11A BINDING SITE, designated SEQ ID:37799, to the nucleotide sequence of VGAM1965 RNA, herein designated VGAM RNA, also designated SEQ ID:4676.

Another function of VGAM1965 is therefore inhibition of ATPase, Class VI, Type 11A (ATP11A, Accession XM_085028). Accordingly, utilities of VGAM1965 include diagnosis, prevention and treatment of diseases and clinical conditions associated with ATP11A. ATPase, Ca++ Transporting, Type 2C, Member 1 (ATP2C1, Accession NM_014382) is another VGAM1965 host target gene. ATP2C1 BINDING SITE is HOST TARGET binding site found in the 3' untranslated region of mRNA encoded by ATP2C1, corresponding to a HOST TARGET binding site such as BINDING SITE I, BINDING SITE II or BINDING SITE III. Table 2 illustrates the complementarity of the nucleotide sequences of ATP2C1 BINDING SITE, designated SEQ ID:15718, to the nucleotide sequence of VGAM1965 RNA, herein designated VGAM RNA, also designated SEQ ID:4676.

Another function of VGAM1965 is therefore inhibition of ATPase, Ca++ Transporting, Type 2C, Member 1 (ATP2C1, Accession NM_014382). Accordingly, utilities of VGAM1965 include diagnosis, prevention and treatment of diseases and clinical conditions associated with ATP2C1. ATPase, Class I, Type 8B, Member 2 (ATP8B2, Accession XM_036933) is another VGAM1965 host target gene. ATP8B2 BINDING SITE is HOST TARGET binding site found in the 3' untranslated region of mRNA encoded by ATP8B2, corresponding to a HOST TARGET binding site such as BINDING SITE I, BINDING SITE II or BINDING SITE III. Table 2 illustrates the complementarity of the nucleotide sequences of ATP8B2 BINDING SITE, designated SEQ ID:32519, to the nucleotide sequence of VGAM1965

RNA, herein designated VGAM RNA, also designated SEQ ID:4676.

Another function of VGAM1965 is therefore inhibition of ATPase, Class I, Type 8B, Member 2 (ATP8B2, Accession XM_036933). Accordingly, utilities of VGAM1965 include diagnosis, prevention and treatment of diseases and clinical conditions associated with ATP8B2. Arginine Vasopressin Receptor 1A (AVPR1A, Accession NM_000706) is another VGAM1965 host target gene. AVPR1A BINDING SITE is HOST TARGET binding site found in the 5' untranslated region of mRNA encoded by AVPR1A, corresponding to a HOST TARGET binding site such as BINDING SITE I, BINDING SITE II or BINDING SITE III. Table 2 illustrates the complementarity of the nucleotide sequences of AVPR1A BINDING SITE, designated SEQ ID:6376, to the nucleotide sequence of VGAM1965 RNA, herein designated VGAM RNA, also designated SEQ ID:4676.

Another function of VGAM1965 is therefore inhibition of Arginine Vasopressin Receptor 1A (AVPR1A, Accession NM_000706), a gene which mediates cell contraction and proliferation, platelet aggregation, release of coagulation factor, and glycogenolysis. Accordingly, utilities of VGAM1965 include diagnosis, prevention and treatment of diseases and clinical conditions associated with AVPR1A. The function of AVPR1A and its association with various diseases and clinical conditions, has been established by previous studies, as described hereinabove with reference to VGAM549. Beta-site APP-cleaving Enzyme (BACE, Accession NM_138971) is another VGAM1965 host target gene. BACE BINDING SITE1 and BACE BINDING SITE2 are HOST TARGET binding sites found in untranslated regions of mRNA encoded by BACE, corresponding to HOST TARGET binding sites such as BINDING SITE I, BINDING SITE II or BINDING SITE III. Table 2 illustrates the complementarity of the nucleotide sequences of BACE BINDING SITE1 and BACE BINDING SITE2, designated SEQ ID:29089 and SEQ ID:14421 respectively, to the nucleotide sequence of VGAM1965 RNA, herein designated VGAM RNA, also designated SEQ ID:4676.

Another function of VGAM1965 is therefore inhibition of Beta-site APP-cleaving Enzyme (BACE, Accession NM_138971), a gene which is responsible for the proteolytic processing of the amyloid precursor protein. Accordingly, utilities of VGAM1965 include diagnosis, prevention and treatment of diseases and clinical conditions associated with BACE. The function of BACE and its association with various diseases and clinical conditions, has been established by previous studies, as described hereinabove with reference to VGAM173. Bromodomain Adjacent to Zinc Finger Domain, 2B (BAZ2B, Accession NM_013450) is another VGAM1965 host target gene. BAZ2B BINDING SITE is HOST TARGET binding site found in the 5' untranslated region of mRNA encoded by BAZ2B, corresponding to a HOST TARGET binding site such as BINDING SITE I, BINDING SITE II or BINDING SITE III. Table 2 illustrates the complementarity of the nucleotide sequences of BAZ2B BINDING SITE, designated SEQ ID:15125, to the nucleotide sequence of VGAM1965 RNA, herein designated VGAM RNA, also designated SEQ ID:4676.

Another function of VGAM1965 is therefore inhibition of Bromodomain Adjacent to Zinc Finger Domain, 2B (BAZ2B, Accession NM_013450). Accordingly, utilities of VGAM1965 include diagnosis, prevention and treatment of diseases and clinical conditions associated with BAZ2B. BCL2-like 2 (BCL2L2, Accession NM_004050) is another VGAM1965 host target gene. BCL2L2 BINDING SITE is HOST TARGET binding site found in the 3' untranslated region of mRNA encoded by BCL2L2, corresponding to a HOST TARGET binding site such as BINDING SITE I, BINDING SITE II or BINDING SITE III. Table 2 illustrates the complementarity of the nucleotide sequences of BCL2L2 BINDING SITE, designated SEQ ID:10264, to the nucleotide sequence of VGAM1965 RNA, herein designated VGAM RNA, also designated SEQ ID:4676.

Another function of VGAM1965 is therefore inhibition of BCL2-like 2 (BCL2L2, Accession NM_004050), a gene which promotes cell survival. Accordingly, utilities of VGAM1965 include diagnosis, prevention and treatment of diseases and clinical conditions associated with BCL2L2. The function of BCL2L2 and its association with various diseases and clinical conditions, has been established by previous studies, as described hereinabove with reference to VGAM431. B-cell CLL/lymphoma 7A (BCL7A, Accession NM_020993) is another VGAM1965 host target gene. BCL7A BINDING SITE is HOST TARGET binding site found in the 3' untranslated region of mRNA encoded by BCL7A, corresponding to a HOST TARGET binding site such as BINDING SITE I, BINDING SITE II or BINDING SITE III. Table 2 illustrates the complementarity of the nucleotide sequences of BCL7A BINDING SITE, designated SEQ ID:21993, to the nucleotide sequence of VGAM1965 RNA, herein designated VGAM RNA, also designated SEQ ID:4676.

Another function of VGAM1965 is therefore inhibition of B-cell CLL/lymphoma 7A (BCL7A, Accession NM_020993). Accordingly, utilities of VGAM1965 include diagnosis, prevention and treatment of diseases and clinical conditions associated with BCL7A. BCRP2 (Accession XM_031102) is another VGAM1965 host target gene. BCRP2 BINDING SITE is HOST TARGET binding site found in the 3' untranslated region of mRNA encoded by BCRP2, corresponding to a HOST TARGET binding site such as BINDING SITE I, BINDING SITE II or BINDING SITE III. Table 2 illustrates the complementarity of the nucleotide sequences of BCRP2 BINDING SITE, designated SEQ ID:31274, to the nucleotide sequence of VGAM1965 RNA, herein designated VGAM RNA, also designated SEQ ID:4676.

Another function of VGAM1965 is therefore inhibition of BCRP2 (Accession XM_031102). Accordingly, utilities of VGAM1965 include diagnosis, prevention and treatment of diseases and clinical conditions associated with BCRP2. Bone Morphogenetic Protein Receptor, Type IA (BMPR1A, Accession NM_004329) is another VGAM1965 host target gene. BMPR1A BINDING SITE is HOST TARGET binding site found in the 3' untranslated region of mRNA encoded by BMPR1A, corresponding to a HOST TARGET binding site such as BINDING SITE I, BINDING SITE II or BINDING SITE III. Table 2 illustrates the complementarity of the nucleotide sequences of BMPR1A BINDING SITE, designated SEQ ID:10529, to the nucleotide sequence of VGAM1965 RNA, herein designated VGAM RNA, also designated SEQ ID:4676.

Another function of VGAM1965 is therefore inhibition of Bone Morphogenetic Protein Receptor, Type IA (BMPR1A, Accession NM_004329). Accordingly, utilities of VGAM1965 include diagnosis, prevention and treatment of diseases and clinical conditions associated with BMPR1A. Bassoon (presynaptic cytomatrix protein) (BSN, Accession NM_003458) is another VGAM1965 host target gene. BSN BINDING SITE is HOST TARGET binding site found in the 3" untranslated region of mRNA encoded by BSN, corresponding to a HOST TARGET binding site such as BINDING SITE I, BINDING SITE II or BINDING SITE III. Table 2 illustrates the complementarity of the nucleotide sequences of BSN BINDING SITE, designated SEQ ID:9522, to the nucleotide sequence of VGAM1965 RNA, herein designated VGAM RNA, also designated SEQ ID:4676.

Another function of VGAM1965 is therefore inhibition of Bassoon (presynaptic cytomatrix protein) (BSN, Accession NM_003458), a gene which may be involved in cytomatrix organization at the site of neurotransmitter release. Accordingly, utilities of VGAM1965 include diagnosis, prevention and treatment of diseases and clinical conditions associated with BSN. The function of BSN and its association with various diseases and clinical conditions, has been established by previous studies, as described hereinabove with reference to VGAM638. B-cell Translocation Gene 1, Anti-proliferative (BTG1, Accession NM_001731) is another VGAM1965 host target gene. BTG1 BINDING SITE is HOST TARGET binding site found in the 3' untranslated region of mRNA encoded by BTG1, corresponding to a HOST TARGET binding site such as BINDING SITE I, BINDING SITE II or BINDING SITE III. Table 2 illustrates the complementarity of the nucleotide sequences of BTG1 BINDING SITE, designated SEQ ID:7466, to the nucleotide sequence of VGAM1965 RNA, herein designated VGAM RNA, also designated SEQ ID:4676.

Another function of VGAM1965 is therefore inhibition of B-cell Translocation Gene 1, Anti-proliferative (BTG1, Accession NM_001731), a gene which is a member of a new family of antiproliferative proteins. Accordingly, utilities of VGAM1965 include diagnosis, prevention and treatment of diseases and clinical conditions associated with BTG1. The function of BTG1 and its association with various diseases and clinical conditions, has been established by previous studies, as described hereinabove with reference to VGAM1296. Chromosome 11 Open Reading Frame 8 (C11orf8, Accession NM_001584) is another VGAM1965 host target gene. C11orf8 BINDING SITE is HOST TARGET binding site found in the 3' untranslated region of mRNA encoded by C11orf8, corresponding to a HOST TARGET binding site such as BINDING SITE I, BINDING SITE II or BINDING SITE III. Table 2 illustrates the complementarity of the nucleotide sequences of C11orf8 BINDING SITE, designated SEQ ID:7303, to the nucleotide sequence of VGAM1965 RNA, herein designated VGAM RNA, also designated SEQ ID:4676.

Another function of VGAM1965 is therefore inhibition of Chromosome 11 Open Reading Frame 8 (C11orf8, Accession NM_001584), a gene which May function in brain development. Accordingly, utilities of VGAM1965 include diagnosis, prevention and treatment of diseases and clinical conditions associated with C11orf8. The function of C11orf8 has been established by previous studies. Schwartz et al. (1994) identified a gene, which they designated 239FB, from the 11p13-p14 region between PAX6 (OMIM Ref. No. 607108) and FSHB (OMIM Ref. No. 136530) known as the WAGR region (Wilms tumor, aniridia, genitourinary abnormalities, and mental retardation). Schwartz et al. (1995) showed that the predicted 294-amino acid protein shares regions of significant identity to a gene identified in an 8.5-day chicken embryo library and 2 C. elegans loci of unknown function. The gene consists of 6 exons spanning about 87 kb. A CpG island occurs at the 5-prime end of the gene. Northern blots detected a 3.1-kb transcript in fetal brain RNA. The extensive conservation of sequence places 239FB among a group of proteins that contains ancient conserved regions (Green et al., 1993) and is, presumably, functionally important. See also 239AB (OMIM Ref. No. 602112), a related human gene identified in adult brain.

Full details of the abovementioned studies are described in the following publications, the disclosure of which are hereby incorporated by reference:

Green, P.; Lipman, D.; Hillier, L.; Waterston, R.; States, D.; Claverie, J.-M.: Ancient conserved regions in new gene sequences and the protein databases. Science 259:1711-1716, 1993; and Schwartz, F.; Eisenman, R.; Knoll, J.; Gessler, M.; Bruns, G.: cDNA sequence, genomic organization, and evolutionary conservation of a novel gene from the WAGR region. Genomics 29:526.

Further studies establishing the function and utilities of C11orf8 are found in John Hopkins OMIM database record ID 600911, and in sited publications numbered 9607-9609 listed in the bibliography section hereinbelow, which are also hereby incorporated by reference. C1D (Accession NM_006333) is another VGAM1965 host target gene. C1D BINDING SITE is HOST TARGET binding site found in the 3' untranslated region of mRNA encoded by C1D, corresponding to a HOST TARGET binding site such as BINDING SITE I, BINDING SITE II or BINDING SITE III. Table 2 illustrates the complementarity of the nucleotide sequences of C1D BINDING SITE, designated SEQ ID:13033, to the nucleotide sequence of VGAM1965 RNA, herein designated VGAM RNA, also designated SEQ ID:4676.

Another function of VGAM1965 is therefore inhibition of C1D (Accession NM_006333), a gene which is similar to murine C1D and may be a component of nuclear hormone receptor complexes. Accordingly, utilities of VGAM1965 include diagnosis, prevention and treatment of diseases and clinical conditions associated with C1D. The function of C1D and its association with various diseases and clinical conditions, has been established by previous studies, as described hereinabove with reference to VGAM78. Complement Component 5 Receptor 1 (C5a ligand) (C5R1, Accession NM_001736) is another VGAM1965 host target gene. C5R1 BINDING SITE is HOST TARGET binding site found in the 3' untranslated region of mRNA encoded by C5R1, corresponding to a HOST TARGET binding site such as BINDING SITE I, BINDING SITE II or BINDING SITE III. Table 2 illustrates the complementarity of the nucleotide sequences of C5R1 BINDING SITE, designated SEQ ID:7475, to the nucleotide sequence of VGAM1965 RNA, herein designated VGAM RNA, also designated SEQ ID:4676.

Another function of VGAM1965 is therefore inhibition of Complement Component 5 Receptor 1 (C5a ligand) (C5R1, Accession NM_001736), a gene which has a nonredundant function and is required for mucosal host cell defense in the lung. Accordingly, utilities of VGAM1965 include diagnosis, prevention and treatment of diseases and clinical conditions associated with C5R1. The function of C5R1 and its association with various diseases and clinical conditions, has been established by previous studies, as described hereinabove with reference to VGAM484. Calumenin (CALU, Accession NM_001219) is another VGAM1965 host target gene. CALU BINDING SITE is HOST TARGET binding site found in the 3' untranslated region of mRNA encoded by CALU, corresponding to a HOST TARGET binding site such as BINDING SITE I, BINDING SITE II or BINDING SITE III. Table 2 illustrates the complementarity of the nucleotide sequences of CALU BINDING SITE, designated SEQ ID:6887, to the nucleotide sequence of VGAM1965 RNA, herein designated VGAM RNA, also designated SEQ ID:4676.

Another function of VGAM1965 is therefore inhibition of Calumenin (CALU, Accession NM_001219), a gene which binds 7 calcium ions with a low affinity with unidtified function. Accordingly, utilities of VGAM1965 include diagnosis, prevention and treatment of diseases and clinical conditions associated with CALU. The function of CALU and its association with various diseases and clinical conditions, has been established by previous studies, as described hereinabove with reference to VGAM253. Caspase 3, Apoptosis-related Cysteine Protease (CASP3, Accession NM_032991) is another VGAM1965 host target gene. CASP3 BINDING SITE1 and CASP3 BINDING SITE2 are HOST TARGET binding sites found in untranslated regions of mRNA encoded by CASP3, corresponding to HOST TARGET binding sites such as BINDING SITE I, BINDING SITE II or BINDING SITE III. Table 2 illustrates the complementarity of the nucleotide sequences of CASP3 BINDING SITE1 and CASP3 BINDING SITE2, designated SEQ ID:26872 and SEQ ID:10541 respectively, to the nucleotide sequence of VGAM1965 RNA, herein designated VGAM RNA, also designated SEQ ID:4676.

Another function of VGAM1965 is therefore inhibition of Caspase 3, Apoptosis-related Cysteine Protease (CASP3, Accession NM_032991), a gene which is one apoptosis-related cysteine protease and is important for the initiation of apoptotic cell death. Accordingly, utilities of VGAM1965 include diagnosis, prevention and treatment of diseases and clinical conditions associated with CASP3. The function of CASP3 has been established by previous studies. Nicholson et al. (1995) developed a potent peptide aldehyde inhibitor and showed that it prevents apoptotic events in vitro, suggesting that apopain/CPP32 is important for the initiation of apoptotic cell death. Apoptosis of human endothelial cells after growth factor deprivation is associated with rapid and dramatic upregulation of cyclin A-associated cyclin-dependent kinase-2 (CDK2; 116953) activity. Levkau et al. (1998) showed that in apoptotic cells the carboxyl termini of the CDK inhibitors CDKN1A (OMIM Ref. No. 116899) and CDKN1B (OMIM Ref. No. 600778) are truncated by specific cleavage. The enzyme involved in this cleavage is CASP3 and/or a CASP3-like caspase. After cleavage, CDKN1A loses its nuclear localization sequence and exits the nucleus. Cleavage of CDKN1A and CDKN1B resulted in a substantial reduction in their association with nuclear cyclin-CDK2 complexes, leading to a dramatic induction of CDK2 activity. Dominant-negative CDK2, as well as a mutant CDKN1A resistant to caspase cleavage, partially suppressed apoptosis. These data suggested that CDK2 activation, through caspase-mediated cleavage of CDK inhibitors, may be instrumental in the execution of apoptosis following caspase activation. Animal model experiments lend further support to the function of CASP3. To analyze the function of CPP32 in vivo, Kuida et al. (1996) generated CPP32-deficient mice by homologous recombination. These mice, born at a frequency lower than expected by mendelian genetics, were smaller than their littermates and died at 1 to 3 weeks of age. Although their thymocytes retained normal susceptibility to various apoptotic stimuli, brain development in CPP32-deficient mice was profoundly affected, and discernible by embryonic day 12, resulting in a variety of hypoplasias and disorganized cell deployment. These supernumerary cells were postmitotic and terminally differentiated by the postnatal stage. Pyknotic clusters at sites of major morphogenetic change during normal brain development were not observed in the mutant embryos, indicating increased apoptosis in the absence of CPP32. Thus, CPP32 was shown by Kuida et al. (1996) to play a critical role during morphogenetic cell death in the mammalian brain.

It is appreciated that the abovementioned animal model for CASP3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kuida, K.; Zheng, T. S.; Na, S.; Kuan, C.; Yang, D.; Karasuyama, H.; Rakio, P.; Flavell, R. A.: Decreased apoptosis in the brain and premature lethality in CPP32-deficient mice. Nature 384:368-372, 1996; and Nicholson, D. W.; Ali, A.; Thornberry, N. A.; Vaillancourt, J. P.; Ding, C. K.; Gallant, M.; Gareau, Y.; Griffin, P. R.; Labelle, M.; Lazebnik, Y. A.; Munday, N. A.; Raju, S. M.; Smulso.

Further studies establishing the function and utilities of CASP3 are found in John Hopkins OMIM database record ID 600636, and in sited publications numbered 7119-7121, 1211, 7122-7124, 462, 712 and 7128-7127 listed in the bibliography section hereinbelow, which are also hereby incorporated by reference. CD28 Antigen (Tp44) (CD28, Accession NM_006139) is another VGAM1965 host target gene. CD28 BINDING SITE is HOST TARGET binding site found in the 3' untranslated region of mRNA encoded by CD28, corresponding to a HOST TARGET binding site such as BINDING SITE I, BINDING SITE II or BINDING SITE III. Table 2 illustrates the complementarity of the nucleotide sequences of CD28 BINDING SITE, designated SEQ ID:12782, to the nucleotide sequence of VGAM1965 RNA, herein designated VGAM RNA, also designated SEQ ID:4676.

Another function of VGAM1965 is therefore inhibition of CD28 Antigen (Tp44) (CD28, Accession NM_006139), a gene which possibly involved in t-cell activation. Accordingly, utilities of VGAM1965 include diagnosis, prevention and treatment of diseases and clinical conditions associated with CD28. The function of CD28 and its association with various diseases and clinical conditions, has been established by previous studies, as described hereinabove with reference to VGAM281. CD69 Antigen (p60, early T-cell activation antigen) (CD69, Accession NM_001781) is another VGAM1965 host target gene. CD69 BINDING SITE is HOST TARGET binding site found in the 3' untranslated region of mRNA encoded by CD69, corresponding to a HOST TARGET binding site such as BINDING SITE I, BINDING SITE II or BINDING SITE III. Table 2 illustrates the complementarity of the nucleotide sequences of CD69 BINDING SITE, designated SEQ ID:7539, to the nucleotide sequence of VGAM1965 RNA, herein designated VGAM RNA, also designated SEQ ID:4676.

Another function of VGAM1965 is therefore inhibition of CD69 Antigen (p60, early T-cell activation antigen) (CD69, Accession NM_001781), a gene which is involved in lymphocyte proliferation and functions as a signal transmitting receptor. Accordingly, utilities of VGAM1965 include diagnosis, prevention and treatment of diseases and clinical conditions associated with CD69. The function of CD69 and its association with various diseases and clinical conditions, has been established by previous studies, as described hereinabove with reference to VGAM1888. Cadherin 2, Type 1, N-cadherin (neuronal) (CDH2, Accession NM_001792) is another VGAM1965 host target gene. CDH2 BINDING SITE is HOST TARGET binding site found in the 3' untranslated region of mRNA encoded by CDH2, corresponding to a HOST TARGET binding site such as BINDING SITE I, BINDING SITE II or BINDING SITE III. Table 2 illustrates the complementarity of the nucleotide sequences of CDH2 BINDING SITE, designated SEQ ID:7543, to the nucleotide sequence of VGAM1965 RNA, herein designated VGAM RNA, also designated SEQ ID:4676.

Another function of VGAM1965 is therefore inhibition of Cadherin 2, Type 1, N-cadherin (neuronal) (CDH2, Accession NM_001792), a gene which may be involved in neuronal recognition mechanism. Accordingly, utilities of VGAM1965 include diagnosis, prevention and treatment of diseases and clinical conditions associated with CDH2. The function of CDH2 has been established by previous studies. may be involved in neuronal recognition mechanism.

Full details of the abovementioned studies are described in the following publications, the disclosure of which are hereby incorporated by reference:

Tanaka, H.; Shan, W.; Phillips, G. R.; Arndt, K.; Bozdagi, O.; Shapiro, L.; Huntley, G. W.; Benson, D. L.; Colman, D. R.: Molecular modification of N-cadherin in response to synaptic activity. Neuron 25:93-107, 2000; and Miyatani, S.; Copeland, N. G.; Gilbert, D. J.; Jenkins, N. A.; Takeichi, M.: Genomic structure and chromosomal mapping of the mouse N-cadherin gene. Proc. Nat. Acad. Sci. 89:8443-844.

Further studies establishing the function and utilities of CDH2 are found in John Hopkins OMIM database record ID 114020, and in sited publications numbered 334 and 11647-11653 listed in the bibliography section hereinbelow, which are also hereby incorporated by reference. Cadherin 6, Type 2, K-cadherin (fetal kidney) (CDH6, Accession NM_004932) is another VGAM1965 host target gene. CDH6 BINDING SITE is HOST TARGET binding site found in the 3' untranslated region of mRNA encoded by CDH6, corresponding to a HOST TARGET binding site such as BINDING SITE I, BINDING SITE II or BINDING SITE III. Table 2 illustrates the complementarity of the nucleotide sequences of CDH6 BINDING SITE, designated SEQ ID:11377, to the nucleotide sequence of VGAM1965 RNA, herein designated VGAM RNA, also designated SEQ ID:4676.

Another function of VGAM1965 is therefore inhibition of Cadherin 6, Type 2, K-cadherin (fetal kidney) (CDH6, Accession NM_004932), a gene which is a calcium dependent cell adhesion protein. Accordingly, utilities of VGAM1965 include diagnosis, prevention and treatment of diseases and clinical conditions associated with CDH6. The function of CDH6 and its association with various diseases and clinical conditions, has been established by previous studies, as described hereinabove with reference to VGAM60. Cyclin-dependent Kinase Inhibitor 1A (p21, Cip1) (CDKN1A, Accession NM_078467) is another VGAM1965 host target gene. CDKN1A BINDING SITE is HOST TARGET binding site found in the 3' untranslated region of mRNA encoded by CDKN1A, corresponding to a HOST TARGET binding site such as BINDING SITE I, BINDING SITE II or BINDING SITE III. Table 2 illustrates the complementarity of the nucleotide sequences of CDKN1A BINDING SITE, designated SEQ ID:27784, to the nucleotide sequence of VGAM1965 RNA, herein designated VGAM RNA, also designated SEQ ID:4676.

Another function of VGAM1965 is therefore inhibition of Cyclin-dependent Kinase Inhibitor 1A (p21, Cip1) (CDKN1A, Accession NM_078467), a gene which inhibits cyclin-kinase activity and probably serves as the effector of p53 cell cycle control. Accordingly, utilities of VGAM1965 include diagnosis, prevention and treatment of diseases and clinical conditions associated with CDKN1A. The function of CDKN1A and its association with various diseases and clinical conditions, has been established by previous studies, as described hereinabove with reference to VGAM1912. Carcinoembryonic Antigen-related Cell Adhesion Molecule 6 (non-specific cross reacting antigen) (CEACAM6, Accession NM_002483) is another VGAM1965 host target gene. CEACAM6 BINDING SITE is HOST TARGET binding site found in the 3' untranslated region of mRNA encoded by CEACAM6, corresponding to a HOST TARGET binding site such as BINDING SITE I, BINDING SITE II or BINDING SITE III. Table 2 illustrates the complementarity of the nucleotide sequences of CEACAM6 BINDING SITE, designated SEQ ID:8311, to the nucleotide sequence of VGAM1965 RNA, herein designated VGAM RNA, also designated SEQ ID:4676.

Another function of VGAM1965 is therefore inhibition of Carcinoembryonic Antigen-related Cell Adhesion Molecule 6 (non-specific cross reacting antigen) (CEACAM6, Accession NM_002483), a gene which Non-specific cross reacting antigen (. Accordingly, utilities of VGAM1965 include diagnosis, prevention and treatment of diseases and clinical conditions associated with CEACAM6. The function of CEACAM6 and its association with various diseases and clinical conditions, has been established by previous studies, as described hereinabove with reference to VGAM286. Centaurin, Delta 1 (CENTD1, Accession NM_139182) is another VGAM1965 host target gene. CENTD1 BINDING SITE is HOST TARGET binding site found in the 5' untranslated region of mRNA encoded by CENTD1, corresponding to a HOST TARGET binding site such as BINDING SITE I, BINDING SITE II or BINDING SITE III. Table 2 illustrates the complementarity of the nucleotide sequences of CENTD1 BINDING SITE, designated SEQ ID:29198, to the nucleotide sequence of VGAM1965 RNA, herein designated VGAM RNA, also designated SEQ ID:4676.

Another function of VGAM1965 is therefore inhibition of Centaurin, Delta 1 (CENTD1, Accession NM_139182), a gene which is nvolved in cell signaling/communication. Accordingly, utilities of VGAM1965 include diagnosis, prevention and treatment of diseases and clinical conditions associated with CENTD1. The function of CENTD1 and its association with various diseases and clinical conditions, has been established by previous studies, as described hereinabove with reference to VGAM445. CERD4 (Accession NM_012074) is another VGAM1965 host target gene. CERD4 BINDING SITE1 and CERD4 BINDING SITE2 are HOST TARGET binding sites found in untranslated regions of mRNA encoded by CERD4, corresponding to HOST TARGET binding sites such as BINDING SITE I, BINDING SITE II or BINDING SITE III. Table 2 illustrates the complementarity of the nucleotide sequences of CERD4 BINDING SITE1 and CERD4 BINDING SITE2, designated SEQ ID:14352 and SEQ ID:14353 respectively, to the nucleotide sequence of VGAM1965 RNA, herein designated VGAM RNA, also designated SEQ ID:4676.

Another function of VGAM1965 is therefore inhibition of CERD4 (Accession NM_012074). Accordingly, utilities of VGAM1965 include diagnosis, prevention and treatment of diseases and clinical conditions associated with CERD4. Cholinergic Receptor, Nicotinic, Alpha Polypeptide 4 (CHRNA4, Accession NM_000744) is another VGAM1965 host target gene. CHRNA4 BINDING SITE is HOST TARGET binding site found in the 3' untranslated region of mRNA encoded by CHRNA4, corresponding to a HOST TARGET binding site such as BINDING SITE I, BINDING SITE II or BINDING SITE III. Table 2 illustrates the complementarity of the nucleotide sequences of CHRNA4 BINDING SITE, designated SEQ ID:6399, to the nucleotide sequence of VGAM1965 RNA, herein designated VGAM RNA, also designated SEQ ID:4676.

Another function of VGAM1965 is therefore inhibition of Cholinergic Receptor, Nicotinic, Alpha Polypeptide 4 (CHRNA4, Accession NM_000744), a gene which binds acetylcholine and opens an ion-conducting channel across the plasma membrane. Accordingly, utilities of VGAM1965 include diagnosis, prevention and treatment of diseases and clinical conditions associated with CHRNA4. The function of CHRNA4 and its association with various diseases and clinical conditions, has been established by previous studies, as described hereinabove with reference to VGAM1649. Cholinergic Receptor, Nicotinic, Alpha Polypeptide 5 (CHRNA5, Accession XM_007577) is another VGAM1965 host target gene. CHRNA5 BINDING SITE is HOST TARGET binding site found in the 5' untranslated region of mRNA encoded by CHRNA5, corresponding to a HOST TARGET binding site such as BINDING SITE I, BINDING SITE II or BINDING SITE III. Table 2 illustrates the complementarity of the nucleotide sequences of CHRNA5 BINDING SITE, designated SEQ ID:30057, to the nucleotide sequence of VGAM1965 RNA, herein designated VGAM RNA, also designated SEQ ID:4676.

Another function of VGAM1965 is therefore inhibition of Cholinergic Receptor, Nicotinic, Alpha Polypeptide 5 (CHRNA5, Accession XM_007577). Accordingly, utilities of VGAM1965 include diagnosis, prevention and treatment of diseases and clinical conditions associated with CHRNA5. Cholinergic Receptor, Nicotinic, Beta Polypeptide 2 (neuronal) (CHRNB2, Accession NM_000748) is another VGAM1965 host target gene. CHRNB2 BINDING SITE is HOST TARGET binding site found in the 3' untranslated region of mRNA encoded by CHRNB2, corresponding to a HOST TARGET binding site such as BINDING SITE I, BINDING SITE II or BINDING SITE III. Table 2 illustrates the complementarity of the nucleotide sequences of CHRNB2 BINDING SITE, designated SEQ ID:6403, to the nucleotide sequence of VGAM1965 RNA, herein designated VGAM RNA, also designated SEQ ID:4676.

Another function of VGAM1965 is therefore inhibition of Cholinergic Receptor, Nicotinic, Beta Polypeptide 2 (neuronal) (CHRNB2, Accession NM_000748), a gene which mediates fast signal transmission at synapses. Accordingly, utilities of VGAM1965 include diagnosis, prevention and treatment of diseases and clinical conditions associated with CHRNB2. The function of CHRNB2 and its association with various diseases and clinical conditions, has been established by previous studies, as described hereinabove with reference to VGAM166. Cytoplasmic Linker Associated Protein 1 (CLASP1, Accession XM_037105) is another VGAM1965 host target gene. CLASP1 BINDING SITE is HOST TARGET binding site found in the 3' untranslated region of mRNA encoded by CLASP1, corresponding to a HOST TARGET binding site such as BINDING SITE I, BINDING SITE II or BINDING SITE III. Table 2 illustrates the complementarity of the nucleotide sequences of CLASP1 BINDING SITE, designated SEQ ID:32542, to the nucleotide sequence of VGAM1965 RNA, herein designated VGAM RNA, also designated SEQ ID:4676.

Another function of VGAM1965 is therefore inhibition of Cytoplasmic Linker Associated Protein 1 (CLASP1, Accession XM_037105), a gene which plays a role in the local regulation of microtubule dynamics. Accordingly, utilities of VGAM1965 include diagnosis, prevention and treatment of diseases and clinical conditions associated with CLASP1. The function of CLASP1 and its association with various diseases and clinical conditions, has been established by previous studies, as described hereinabove with reference to VGAM298. Cytoplasmic Linker Associated Protein 2 (CLASP2, Accession XM_035453) is another VGAM1965 host target gene. CLASP2 BINDING SITE is HOST TARGET binding site found in the 3' untranslated region of mRNA encoded by CLASP2, corresponding to a HOST TARGET binding site such as BINDING SITE I, BINDING SITE II or BINDING SITE III. Table 2 illustrates the complementarity of the nucleotide sequences of CLASP2 BINDING SITE, designated SEQ ID:32271, to the nucleotide sequence of VGAM1965 RNA, herein designated VGAM RNA, also designated SEQ ID:4676.

Another function of VGAM1965 is therefore inhibition of Cytoplasmic Linker Associated Protein 2 (CLASP2, Accession XM_035453), a gene which is involved in the regional regulation of microtubule dynamics in motile fibroblasts. Accordingly, utilities of VGAM1965 include diagnosis, prevention and treatment of diseases and clinical conditions associated with CLASP2. The function of CLASP2 and its association with various diseases and clinical conditions, has been established by previous studies, as described hereinabove with reference to VGAM897. Ceroid-lipofuscinosis, Neuronal 2, Late Infantile (Jansky-Bielschowsky disease) (CLN2, Accession NM_000391) is another VGAM1965 host target gene. CLN2 BINDING SITE is HOST TARGET binding site found in the 3' untranslated region of mRNA encoded by CLN2, corresponding to a HOST TARGET binding site such as BINDING SITE I, BINDING SITE II or BINDING SITE III. Table 2 illustrates the complementarity of the nucleotide sequences of CLN2 BINDING SITE, designated SEQ ID:5963, to the nucleotide sequence of VGAM1965 RNA, herein designated VGAM RNA, also designated SEQ ID:4676.

Another function of VGAM1965 is therefore inhibition of Ceroid-lipofuscinosis, Neuronal 2, Late Infantile (Jansky-Bielschowsky disease) (CLN2, Accession NM_000391). Accordingly, utilities of VGAM1965 include diagnosis, prevention and treatment of diseases and clinical conditions associated with CLN2. 2',3'-cyclic Nucleotide 3' Phosphodiesterase (CNP, Accession NM_033133) is another VGAM1965 host target gene. CNP BINDING SITE is HOST TARGET binding site found in the 3' untranslated region of mRNA encoded by CNP, corresponding to a HOST TARGET binding site such as BINDING SITE I, BINDING SITE II or BINDING SITE III. Table 2 illustrates the complementarity of the nucleotide sequences of CNP BINDING SITE, designated SEQ ID:26978, to the nucleotide sequence of VGAM1965 RNA, herein designated VGAM RNA, also designated SEQ ID:4676.

Another function of VGAM1965 is therefore inhibition of 2',3'-cyclic Nucleotide 3' Phosphodiesterase (CNP, Accession NM_033133), a gene which can link tubulin to membranes and may regulate cytoplasmic microtubule distribution. Accordingly, utilities of VGAM1965 include diagnosis, prevention and treatment of diseases and clinical conditions associated with CNP. The function of CNP and its association with various diseases and clinical conditions, has been established by previous studies, as described hereinabove with reference to VGAM443. Collagen, Type IV, Alpha 1 (COL4A1, Accession NM_001845) is another VGAM1965 host target gene. COL4A1 BINDING SITE is HOST TARGET binding site found in the 3' untranslated region of mRNA encoded by COL4A1, corresponding to a HOST TARGET binding site such as BINDING SITE I, BINDING SITE II or BINDING SITE III. Table 2 illustrates the complementarity of the nucleotide sequences of COL4A1 BINDING SITE, designated SEQ ID:7579, to the nucleotide sequence of VGAM1965 RNA, herein designated VGAM RNA, also designated SEQ ID:4676.

Another function of VGAM1965 is therefore inhibition of Collagen, Type IV, Alpha 1 (COL4A1, Accession NM_001845), a gene which is a member of a subfamily of collagen extracellular matrix proteins. Accordingly, utilities of VGAM1965 include diagnosis, prevention and treatment of diseases and clinical conditions associated with COL4A1. The function of COL4A1 and its association with various diseases and clinical conditions, has been established by previous studies, as described hereinabove with reference to VGAM1645. Carboxypeptidase D (CPD, Accession NM_001304) is another VGAM1965 host target gene. CPD BINDING SITE is HOST TARGET binding site found in the 3" untranslated region of mRNA encoded by CPD, corresponding to a HOST TARGET binding site such as BINDING SITE I, BINDING SITE II or BINDING SITE III. Table 2 illustrates the complementarity of the nucleotide sequences of CPD BINDING SITE, designated SEQ ID:6986, to the nucleotide sequence of VGAM1965 RNA, herein designated VGAM RNA, also designated SEQ ID:4676.

Another function of VGAM1965 is therefore inhibition of Carboxypeptidase D (CPD, Accession NM_001304), a gene which is a membrane-bound metalloprotease. Accordingly, utilities of VGAM1965 include diagnosis, prevention and treatment of diseases and clinical conditions associated with CPD. The function of CPD and its association with various diseases and clinical conditions, has been established by previous studies, as described hereinabove with reference to VGAM596. Carboxypeptidase N, Polypeptide 1, 50kD (CPN1, Accession NM_001308) is another VGAM1965 host target gene. CPN1 BINDING SITE is HOST TARGET binding site found in the 5' untranslated region of mRNA encoded by CPN1, corresponding to a HOST TARGET binding site such as BINDING SITE I, BINDING SITE II or BINDING SITE III. Table 2 illustrates the complementarity of the nucleotide sequences of CPN1 BINDING SITE, designated SEQ ID:6991, to the nucleotide sequence of VGAM1965 RNA, herein designated VGAM RNA, also designated SEQ ID:4676.

Another function of VGAM1965 is therefore inhibition of Carboxypeptidase N, Polypeptide 1, 50kD (CPN1, Accession NM_001308), a gene which cleaves basic amino acid residues from the C terminal of peptides and proteins. Accordingly, utilities of VGAM1965 include diagnosis, prevention and treatment of diseases and clinical conditions associated with CPN1. The function of CPN1 has been established by previous studies. Carboxypeptidase N (arginine carboxypeptidase, EC 3.4.17.3) cleaves basic amino acid residues from the C terminal of peptides and proteins. The enzyme plays a central role in regulating the biologic activity of peptides such as kinins and anaphylatoxins, and therefore is also known as kininase-1 and anaphylatoxin inactivator. Carboxypeptidase N is a 280-kD tetrameric complex consisting of 2 identical 83-kD regulatory subunits (OMIM Ref. No. 603104) and 2 identical 50-kD catalytic subunits Skidgel et al. (1988) and Gebhard et al. (1989) each purified carboxypeptidase N and determined a partial sequence of the catalytic subunit. By screening a liver cDNA library with an oligonucleotide probe based on the protein sequence, Gebhard et al. (1989) isolated a cDNA encoding the catalytic subunit, CPN1. The predicted protein is 458 amino acids long. Riley et al. (1998) stated that carboxypeptidase N is a member of the regulatory B-type carboxypeptidase group (see OMIM Ref. No. CPD, 603102).

Full details of the abovementioned studies are described in the following publications, the disclosure of which are hereby incorporated by reference:

Gebhard, W.; Schube, M.; Eulitz, M.: cDNA cloning and complete primary structure of the small, active subunit of human carboxypeptidase N (kininase 1). Eur. J. Biochem. 178:603-607, 1989; and Skidgel, R. A.; Bennett, C. D.; Schilling, J. W.; Tan, F.; Weerasinghe, D. K.; Erdos, E. G.: Amino acid sequence of the N-terminus and selected tryptic peptides of the active subunit of.

Further studies establishing the function and utilities of CPN1 are found in John Hopkins OMIM database record ID 603103, and in sited publications numbered 849 and 8493 listed in the bibliography section hereinbelow, which are also hereby incorporated by reference. CAMP Responsive Element Binding Protein-like 2 (CREBL2, Accession NM_001310) is another VGAM1965 host target gene. CREBL2 BINDING SITE is HOST TARGET binding site found in the 3' untranslated region of mRNA encoded by CREBL2, corresponding to a HOST TARGET binding site such as BINDING SITE I, BINDING SITE II or BINDING SITE III. Table 2 illustrates the complementarity of the nucleotide sequences of CREBL2 BINDING SITE, designated SEQ ID:6996, to the nucleotide sequence of VGAM1965 RNA, herein designated VGAM RNA, also designated SEQ ID:4676.

Another function of VGAM1965 is therefore inhibition of CAMP Responsive Element Binding Protein-like 2 (CREBL2, Accession NM_001310). Accordingly, utilities of VGAM1965 include diagnosis, prevention and treatment of diseases and clinical conditions associated with CREBL2. Connective Tissue Growth Factor (CTGF, Accession NM_001901) is another VGAM1965 host target gene. CTGF BINDING SITE is HOST TARGET binding site found in the 3' untranslated region of mRNA encoded by CTGF, corresponding to a HOST TARGET binding site such as BINDING SITE I, BINDING SITE II or BINDING SITE III. Table 2 illustrates the complementarity of the nucleotide sequences of CTGF BINDING SITE, designated SEQ ID:7625, to the nucleotide sequence of VGAM1965 RNA, herein designated VGAM RNA, also designated SEQ ID:4676.

Another function of VGAM1965 is therefore inhibition of Connective Tissue Growth Factor (CTGF, Accession NM_001901), a gene which promotes proliferation and differentiation of chondrocytes. Accordingly, utilities of VGAM1965 include diagnosis, prevention and treatment of diseases and clinical conditions associated with CTGF. The function of CTGF has been established by previous studies. Bradham et al. (1991) described a new mitogen produced by human umbilical vein endothelial cells, which they termed connective tissue growth factor. The protein, related to platelet-derived growth factor (see OMIM Ref. No. 190040), was predicted from its cDNA to be a 349-amino acid, 38-kD cysteine-rich secreted protein. Martinerie et al. (1992) identified a locus sharing homology with the nov proto-oncogene overexpressed in avian nephroblastoma and corresponding to the CTGF gene. They assigned the CTGF gene to 6q23.1 by a combination of study of mouse/human somatic cell hybrids and fluorescence in situ hybridization. They showed that CTGF is situated proximal to MYB (OMIM Ref. No. 189990). By analysis of Northern blots, Kim et al. (1997) found that CTGF is expressed as a 2.4-kb mRNA in a broad spectrum of human tissues. Sequence comparison revealed that CTGF belongs to a group known as the immediate-early genes, which are expressed after induction by growth factors or certain oncogenes (see OMIM Ref. No. 164958). The immediate-early genes have significant sequence homology to the insulin-like growth factor-binding proteins (OMIM Ref. No. IGFBPs) and contain the conserved N-terminal IGFBP motif (see OMIM Ref. No. IGFBP7, 602867). CTGF shares 28 to 38% amino acid identity with IGFBPs 1-6. Kim et al. (1997) demonstrated that CTGF specifically bound insulin-like growth factors (IGFs), although with relatively low affinity. They proposed that the immediate-early genes, together with IGFBP7, constitute a subfamily of IGFBP genes whose products bind IGFs with low affinity Animal model experiments lend further support to the function of CTGF. Nakanishi et al. (2001) generated transgenic mice that overexpressed CTGF under the control of the mouse type XI collagen (see OMIM Ref. No. 120280) promoter. Embryonic and neonatal growth occurred normally, but transgenic mice showed dwarfism within a few months after birth. X-ray analysis revealed that their bone density was decreased compared with that of normal mice. Nakanishi et al. (2001) concluded that overexpression of CTGF affects certain steps of endochondral ossification. In addition, the testes were much smaller than normal and fertility was affected in transgenic mice, indicating that CTGF may also regulate the embryonic development of the testis It is appreciated that the abovementioned animal model for CTGF is acknowledged by those skilled in the art as a scientifically valid animal model, as can be further appreciated from the publications sited hereinbelow.

Full details of the abovementioned studies are described in the following publications, the disclosure of which are hereby incorporated by reference:

Martinerie, C.; Viegas-Pequignot, E.; Guenard, I.; Dutrillaux, B.; Nguyen, V. C.; Bernheim, A.; Perbal, B.: Physical mapping of human loci homologous to the chicken nov proto-oncogene. Oncogene 7:2529-2534, 1992; and Nakanishi, T.; Yamaai, T.; Asano, M.; Nawachi, K.; Suzuki, M.; Sugimoto, T.; Takigawa, M.: Overexpression of connective tissue growth factor/hypertrophic chondrocyte-specific gene produc.

Further studies establishing the function and utilities of CTGF are found in John Hopkins OMIM database record ID 121009, and in sited publications numbered 497 and 11958-11960 listed in the bibliography section hereinbelow, which are also hereby incorporated by reference. Chromosome X Open Reading Frame 6 (CXorf6, Accession NM_005491) is another VGAM1965 host target gene. CXorf6 BINDING SITE is HOST TARGET binding site found in the 3' untranslated region of mRNA encoded by CXorf6, corresponding to a HOST TARGET binding site such as BINDING SITE I, BINDING SITE II or BINDING SITE III. Table 2 illustrates the complementarity of the nucleotide sequences of CXorf6 BINDING SITE, designated SEQ ID:11995, to the nucleotide sequence of VGAM1965 RNA, herein designated VGAM RNA, also designated SEQ ID:4676.

Another function of VGAM1965 is therefore inhibition of Chromosome X Open Reading Frame 6 (CXorf6, Accession NM_005491). Accordingly, utilities of VGAM1965 include diagnosis, prevention and treatment of diseases and clinical conditions associated with CXorf6. Deleted In Azoospermia (DAZ, Accession NM_004081) is another VGAM1965 host target gene. DAZ BINDING SITE1 through DAZ BINDING SITE3 are HOST TARGET binding sites found in untranslated regions of mRNA encoded by DAZ, corresponding to HOST TARGET binding sites such as BINDING SITE I, BINDING SITE II or BINDING SITE III. Table 2 illustrates the complementarity of the nucleotide sequences of DAZ BINDING SITE1 through DAZ BINDING SITE3, designated SEQ ID:10283, SEQ ID:39946 and SEQ ID:39945 respectively, to the nucleotide sequence of VGAM1965 RNA, herein designated VGAM RNA, also designated SEQ ID:4676.

Another function of VGAM1965 is therefore inhibition of Deleted In Azoospermia (DAZ, Accession NM_004081), a gene which may play a role in the germ-cell-specific patterns of RNA splicing and storage. Accordingly, utilities of VGAM1965 include diagnosis, prevention and treatment of diseases and clinical conditions associated with DAZ. The function of DAZ and its association with various diseases and clinical conditions, has been established by previous studies, as described hereinabove with reference to VGAM206. Dynactin 1 (p150, glued homolog, Drosophila) (DCTN1, Accession NM_004082) is another VGAM1965 host target gene. DCTN1 BINDING SITE is HOST TARGET binding site found in the 5' untranslated region of mRNA encoded by DCTN1, corresponding to a HOST TARGET binding site such as BINDING SITE I, BINDING SITE II or BINDING SITE III. Table 2 illustrates the complementarity of the nucleotide sequences of DCTN1 BINDING SITE, designated SEQ ID:10286, to the nucleotide sequence of VGAM1965 RNA, herein designated VGAM RNA, also designated SEQ ID:4676.

Another function of VGAM1965 is therefore inhibition of Dynactin 1 (p150, glued homolog, Drosophila) (DCTN1, Accession NM_004082), a gene which is a microtubule-based biologic motor protein. Accordingly, utilities of VGAM1965 include diagnosis, prevention and treatment of diseases and clinical conditions associated with DCTN1. The function of DCTN1 has been established by previous studies. Cytoplasmic dynein is a microtubule-based biologic motor protein. Holzbaur and Tokito (1996) noted that dyneins were initially discovered as enzymes that couple ATP hydrolysis to provide a force for cellular motility in eukaryotic cilia and flagella. A distinct cytoplasmic form of dynein (OMIM Ref. No. 600112) was subsequently characterized and thought to be responsible for the intracellular retrograde motility of vesicles and organelles along microtubules (Holzbaur and Vallee, 1994). A large macromolecular complex, dynactin, is required for the cytoplasmic dynein-driven movement of organelles along microtubules. Dynactin is composed of 10 distinct polypeptides of 150, 135, 62, 50, 45, 42, 37, 32, 27, and 24 kD, with a combined mass of 10 million daltons. The largest polypeptide of the dynactin complex, p150(Glued), binds directly to microtubules and to cytoplasmic dynein. The binding of dynactin to dynein is critical for neuronal function, as antibodies that specifically disrupt this binding block vesicle motility along microtubules in extruded squid axoplasm. Holzbaur and Tokito (1996) stated that the dynein-dynactin interaction is probably a key component of the mechanism of axonal transport of vesicles and organelles. Further evidence for a critical role for dynactin in vivo comes from the analysis of mutations in the homologous gene in Drosophila. Mutant alleles of the 'glued' gene induced disruption of the neurons of the optic lobe and compound eye in heterozygotes; null mutations are lethal.

Full details of the abovementioned studies are described in the following publications, the disclosure of which are hereby incorporated by reference:

Holzbaur, E. L. F.; Tokito, M. K.: Localization of the DCTN1 gene encoding p150(Glued) to human chromosome 2p13 by fluorescence in situ hybridization. Genomics 31:398-399, 1996; and Holzbaur, E. L. F.; Vallee, R. B.: Dyneins: molecular structure and cellular function. Ann. Rev. Cell Biol. 10:339-372, 1994.

Further studies establishing the function and utilities of DCTN1 are found in John Hopkins OMIM database record ID 601143, and in sited publications numbered 2850-2855 listed in the bibliography section hereinbelow, which are also hereby incorporated by reference. DNA Fragmentation Factor, 40 kDa, Beta Polypeptide (caspase-activated DNase)

(DFFB, Accession XM_113366) is another VGAM1965 host target gene. DFFB BINDING SITE is HOST TARGET binding site found in the 3' untranslated region of mRNA encoded by DFFB, corresponding to a HOST TARGET binding site such as BINDING SITE I, BINDING SITE II or BINDING SITE III. Table 2 illustrates the complementarity of the nucleotide sequences of DFFB BINDING SITE, designated SEQ ID:42244, to the nucleotide sequence of VGAM1965 RNA, herein designated VGAM RNA, also designated SEQ ID:4676.

Another function of VGAM1965 is therefore inhibition of DNA Fragmentation Factor, 40 kDa, Beta Polypeptide (caspase-activated DNase) (DFFB, Accession XM_113366), a gene which induces DNA fragmentation and chromatin condensation during apoptosis. Accordingly, utilities of VGAM1965 include diagnosis, prevention and treatment of diseases and clinical conditions associated with DFFB. The function of DFFB and its association with various diseases and clinical conditions, has been established by previous studies, as described hereinabove with reference to VGAM74. Diacylglycerol Kinase, Gamma 90 kDa (DGKG, Accession NM_001346) is another VGAM1965 host target gene. DGKG BINDING SITE is HOST TARGET binding site found in the 3' untranslated region of mRNA encoded by DGKG, corresponding to a HOST TARGET binding site such as BINDING SITE I, BINDING SITE II or BINDING SITE III. Table 2 illustrates the complementarity of the nucleotide sequences of DGKG BINDING SITE, designated SEQ ID:7027, to the nucleotide sequence of VGAM1965 RNA, herein designated VGAM RNA, also designated SEQ ID:4676.

Another function of VGAM1965 is therefore inhibition of Diacylglycerol Kinase, Gamma 90 kDa (DGKG, Accession NM_001346), a gene which may convert diacylglycerol to phosphatidic acid. Accordingly, utilities of VGAM1965 include diagnosis, prevention and treatment of diseases and clinical conditions associated with DGKG. The function of DGKG and its association with various diseases and clinical conditions, has been established by previous studies, as described hereinabove with reference to VGAM451.24-dehydrocholesterol Reductase (DHCR24, Accession NM_014762) is another VGAM1965 host target gene. DHCR24 BINDING SITE is HOST TARGET binding site found in the 3' untranslated region of mRNA encoded by DHCR24, corresponding to a HOST TARGET binding site such as BINDING SITE I, BINDING SITE II or BINDING SITE III. Table 2 illustrates the complementarity of the nucleotide sequences of DHCR24 BINDING SITE, designated SEQ ID:16526, to the nucleotide sequence of VGAM1965 RNA, herein designated VGAM RNA, also designated SEQ ID:4676.

Another function of VGAM1965 is therefore inhibition of 24-dehydrocholesterol Reductase (DHCR24, Accession NM_014762), a gene which catalyzes the reduction of sterol intermediates. Accordingly, utilities of VGAM1965 include diagnosis, prevention and treatment of diseases and clinical conditions associated with DHCR24. The function of DHCR24 and its association with various diseases and clinical conditions, has been established by previous studies, as described hereinabove with reference to VGAM235. Dihydrofolate Reductase (DHFR, Accession NM_000791) is another VGAM1965 host target gene. DHFR BINDING SITE is HOST TARGET binding site found in the 3' untranslated region of mRNA encoded by DHFR, corresponding to a HOST TARGET binding site such as BINDING SITE I, BINDING SITE II or BINDING SITE III. Table 2 illustrates the complementarity of the nucleotide sequences of DHFR BINDING SITE, designated SEQ ID:6446, to the nucleotide sequence of VGAM1965 RNA, herein designated VGAM RNA, also designated SEQ ID:4676.

Another function of VGAM1965 is therefore inhibition of Dihydrofolate Reductase (DHFR, Accession NM_000791), a gene which converts dihydrofolate into tetrahydrofolate. Accordingly, utilities of VGAM1965 include diagnosis, prevention and treatment of diseases and clinical conditions associated with DHFR. The function of DHFR and its association with various diseases and clinical conditions, has been established by previous studies, as described hereinabove with reference to VGAM826. Discs, Large (Drosophila) Homolog 3 (neuroendocrine-dlg) (DLG3, Accession NM_021120) is another VGAM1965 host target gene. DLG3 BINDING SITE is HOST TARGET binding site found in the 5' untranslated region of mRNA encoded by DLG3, corresponding to a HOST TARGET binding site such as BINDING SITE I, BINDING SITE II or BINDING SITE III. Table 2 illustrates the complementarity of the nucleotide sequences of DLG3 BINDING SITE, designated SEQ ID:22095, to the nucleotide sequence of VGAM1965 RNA, herein designated VGAM RNA, also designated SEQ ID:4676.

Another function of VGAM1965 is therefore inhibition of Discs, Large (Drosophila) Homolog 3 (neuroendocrine-dlg) (DLG3, Accession NM_021120), a gene which may interact with the cytoplasmic tail of the nmda receptor subunit nr2b . Accordingly, utilities of VGAM1965 include diagnosis, prevention and treatment of diseases and clinical conditions associated with DLG3. The function of DLG3 and its association with various diseases and clinical conditions, has been established by previous studies, as described hereinabove with reference to VGAM782. Discs, Large (Drosophila) Homolog 5 (DLG5, Accession XM_096398) is another VGAM1965 host target gene. DLG5 BINDING SITE is HOST TARGET binding site found in the 3' untranslated region of mRNA encoded by DLG5, corresponding to a HOST TARGET binding site such as BINDING SITE I, BINDING SITE II or BINDING SITE III. Table 2 illustrates the complementarity of the nucleotide sequences of DLG5 BINDING SITE, designated SEQ ID:40342, to the nucleotide sequence of VGAM1965 RNA, herein designated VGAM RNA, also designated SEQ ID:4676.

Another function of VGAM1965 is therefore inhibition of Discs, Large (Drosophila) Homolog 5 (DLG5, Accession XM_096398), a gene which may transmit extracellular signals to inhibit cell proliferation. Accordingly, utilities of VGAM1965 include diagnosis, prevention and treatment of diseases and clinical conditions associated with DLG5. The function of DLG5 and its association with various diseases and clinical conditions, has been established by previous studies, as described hereinabove with reference to VGAM444. Dihydropyrimidine Dehydrogenase (DPYD, Accession XM_017469) is another VGAM1965 host target gene. DPYD BINDING SITE is HOST TARGET binding site found in the 3' untranslated region of mRNA encoded by DPYD, corresponding to a HOST TARGET binding site such as BINDING SITE I, BINDING SITE II or BINDING SITE III. Table 2 illustrates the complementarity of the nucleotide sequences of DPYD BINDING SITE, designated SEQ ID:30319, to the nucleotide sequence of VGAM1965 RNA, herein designated VGAM RNA, also designated SEQ ID:4676.

Another function of VGAM1965 is therefore inhibition of Dihydropyrimidine Dehydrogenase (DPYD, Accession XM_017469). Accordingly, utilities of VGAM1965 include diagnosis, prevention and treatment of diseases and clinical conditions associated with DPYD. Dopamine Receptor D2

(DRD2, Accession NM_000795) is another VGAM1965 host target gene. DRD2 BINDING SITE is HOST TARGET binding site found in the 3' untranslated region of mRNA encoded by DRD2, corresponding to a HOST TARGET binding site such as BINDING SITE I, BINDING SITE II or BINDING SITE III. Table 2 illustrates the complementarity of the nucleotide sequences of DRD2 BINDING SITE, designated SEQ ID:6467, to the nucleotide sequence of VGAM1965 RNA, herein designated VGAM RNA, also designated SEQ ID:4676.

Another function of VGAM1965 is therefore inhibition of Dopamine Receptor D2 (DRD2, Accession NM_000795), a gene which has a key role in the control of movement. Accordingly, utilities of VGAM1965 include diagnosis, prevention and treatment of diseases and clinical conditions associated with DRD2. The function of DRD2 has been established by previous studies. Bunzow et al. (1988) cloned the rat gene for D2 dopamine receptor. Grandy et al. (1989) cloned the human gene from a pituitary cDNA library. The deduced protein sequence is 96% identical to that of the rat receptor with 1 major difference: the human receptor contains an additional 29 amino acids in its putative third cytoplasmic loop. Southern blot analysis demonstrated the presence of only 1 human DRD2 gene. The coding sequence is interrupted by 6 introns. The additional amino acids present in the human pituitary receptor are encoded by a single exon of 87 basepairs. Eubanks et al. (1992) found that the DRD2 gene extends over 270 kb and includes an intron of approximately 250 kb separating the putative first exon from the exons encoding the receptor protein. They prepared a physical map spanning more than 1.5 Mb of chromosome 11q23, which demonstrated that the neural cell adhesion molecule gene (NCAM; 116930) is located 150 kb 3-prime of the DRD2 gene and is transcribed from the same DNA strand. High resolution fluorescence in situ suppression hybridization using cosmid and YAC clones localized these genes between the APOA1 and STMY genes at the interface of 11q22.3 and 11q23.1. In situ hybridization studies showed, furthermore, that the DRD2/NCAM complex resides telomeric to the STMY1 gene and centromeric of the APOA1 gene. Animal model experiments lend further support to the function of DRD2. Balk et al. (1995) used homologous recombination to generate D2-receptor-deficient mice. Absence of D2 receptors led to animals that were akinetic and bradykinetic in behavioral tests and showed significantly reduced spontaneous movements. The phenotype resembled Parkinson disease. Maldonado et al. (1997) studied the behavior of DRD2 knockout mice and showed that there was a total suppression of rewarding behavior with morphine. In contrast, these animals showed normal responses when food was used as a reward.

It is appreciated that the abovementioned animal model for DRD2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Eubanks, J. H.; Djabali, M.; Selleri, L.; Grandy, D. K.; Civelli, O.; McElligott, D. L.; Evans, G. A.: Structure and linkage of the D2 dopamine receptor and neural cell adhesion molecule genes on human chromosome 11q23. Genomics 14:1010-1018, 1992; and Maldonado, R.; Salardi, A.; Valverde, O.; Samad, T. A.; Roques, B. P.; Borrelli, E.: Absence of opiate rewarding effects in mice lacking dopamine D2 receptors. Nature 388: 586-589, 19.

Further studies establishing the function and utilities of DRD2 are found in John Hopkins OMIM database record ID 126476, and in sited publications numbered 11895-11899, 11886, 1190 and 11786-11804 listed in the bibliography section hereinbelow, which are also hereby incorporated by reference. Desmocollin 3 (DSC3, Accession NM_024423) is another VGAM1965 host target gene. DSC3 BINDING SITE1 and DSC3 BINDING SITE2 are HOST TARGET binding sites found in untranslated regions of mRNA encoded by DSC3, corresponding to HOST TARGET binding sites such as BINDING SITE I, BINDING SITE II or BINDING SITE III. Table 2 illustrates the complementarity of the nucleotide sequences of DSC3 BINDING SITE1 and DSC3 BINDING SITE2, designated SEQ ID:23662 and SEQ ID:7651 respectively, to the nucleotide sequence of VGAM1965 RNA, herein designated VGAM RNA, also designated SEQ ID:4676.

Another function of VGAM1965 is therefore inhibition of Desmocollin 3 (DSC3, Accession NM_024423), a gene which is a component of intercellular desmosome junctions. Accordingly, utilities of VGAM1965 include diagnosis, prevention and treatment of diseases and clinical conditions associated with DSC3. The function of DSC3 and its association with various diseases and clinical conditions, has been established by previous studies, as described hereinabove with reference to VGAM230. Endothelin 3 (EDN3, Accession NM_000114) is another VGAM1965 host target gene. EDN3 BINDING SITE is HOST TARGET binding site found in the 3' untranslated region of mRNA encoded by EDN3, corresponding to a HOST TARGET binding site such as BINDING SITE I, BINDING SITE II or BINDING SITE III. Table 2 illustrates the complementarity of the nucleotide sequences of EDN3 BINDING SITE, designated SEQ ID:5582, to the nucleotide sequence of VGAM1965 RNA, herein designated VGAM RNA, also designated SEQ ID:4676.

Another function of VGAM1965 is therefore inhibition of Endothelin 3 (EDN3, Accession NM_000114). Accordingly, utilities of VGAM1965 include diagnosis, prevention and treatment of diseases and clinical conditions associated with EDN3. Endothelin Receptor Type A (EDNRA, Accession XM_034331) is another VGAM1965 host target gene. EDNRA BINDING SITE is HOST TARGET binding site found in the 3' untranslated region of mRNA encoded by EDNRA, corresponding to a HOST TARGET binding site such as BINDING SITE I, BINDING SITE II or BINDING SITE III. Table 2 illustrates the complementarity of the nucleotide sequences of EDNRA BINDING SITE, designated SEQ ID:32057, to the nucleotide sequence of VGAM1965 RNA, herein designated VGAM RNA, also designated SEQ ID:4676.

Another function of VGAM1965 is therefore inhibition of Endothelin Receptor Type A (EDNRA, Accession XM_034331), a gene which binds endothelins, and induces intracellular calcium flux and arachidonic acid accumulation. Accordingly, utilities of VGAM1965 include diagnosis, prevention and treatment of diseases and clinical conditions associated with EDNRA. The function of EDNRA and its association with various diseases and clinical conditions, has been established by previous studies, as described hereinabove with reference to VGAM441. Eukaryotic Translation Initiation Factor 1A (EIF1A, Accession XM_114147) is another VGAM1965 host target gene. EIF1A BINDING SITE is HOST TARGET binding site found in the 3' untranslated region of mRNA encoded by EIF1A, corresponding to a HOST TARGET binding site such as BINDING SITE I, BINDING SITE II or BINDING SITE III. Table 2 illustrates the complementarity of the nucleotide sequences of EIF1A BINDING SITE, designated SEQ ID:42725, to the nucleotide sequence of VGAM1965 RNA, herein designated VGAM RNA, also designated SEQ ID:4676.

Another function of VGAM1965 is therefore inhibition of Eukaryotic Translation Initiation Factor 1A (EIF1A, Accession XM_114147), a gene which seems to be required for maximal rate of protein biosynthesis. Accordingly, utilities of VGAM1965 include diagnosis, prevention and treatment of diseases and clinical conditions associated with EIF1A. The function of EIF1A and its association with various diseases and clinical conditions, has been established by previous studies, as described hereinabove with reference to VGAM120. Eukaryotic Translation Initiation Factor 2, Subunit 3 Gamma, 52kDa (EIF2S3, Accession NM_001415) is another VGAM1965 host target gene. EIF2S3 BINDING SITE is HOST TARGET binding site found in the 3' untranslated region of mRNA encoded by EIF2S3, corresponding to a HOST TARGET binding site such as BINDING SITE I, BINDING SITE II or BINDING SITE III. Table 2 illustrates the complementarity of the nucleotide sequences of EIF2S3 BINDING SITE, designated SEQ ID:7113, to the nucleotide sequence of VGAM1965 RNA, herein designated VGAM RNA, also designated SEQ ID:4676.

Another function of VGAM1965 is therefore inhibition of Eukaryotic Translation Initiation Factor 2, Subunit 3 Gamma, 52 kDa (EIF2S3, Accession NM_001415), a gene which functions in the early steps of protein synthesis. Accordingly, utilities of VGAM1965 include diagnosis, prevention and treatment of diseases and clinical conditions associated with EIF2S3. The function of EIF2S3 and its association with various diseases and clinical conditions, has been established by previous studies, as described hereinabove with reference to VGAM1254. V-erb-a Erythroblastic Leukemia Viral Oncogene Homolog 4 (avian) (ERBB4, Accession NM_005235) is another VGAM1965 host target gene. ERBB4 BINDING SITE is HOST TARGET binding site found in the 3' untranslated region of mRNA encoded by ERBB4, corresponding to a HOST TARGET binding site such as BINDING SITE I, BINDING SITE II or BINDING SITE III. Table 2 illustrates the complementarity of the nucleotide sequences of ERBB4 BINDING SITE, designated SEQ ID:11747, to the nucleotide sequence of VGAM1965 RNA, herein designated VGAM RNA, also designated SEQ ID:4676.

Another function of VGAM1965 is therefore inhibition of V-erb-a Erythroblastic Leukemia Viral Oncogene Homolog 4 (avian) (ERBB4, Accession NM_005235), a gene which may function in growth/differentiation of normal and transformed cells. Accordingly, utilities of VGAM1965 include diagnosis, prevention and treatment of diseases and clinical conditions associated with ERBB4. The function of ERBB4 and its association with various diseases and clinical conditions, has been established by previous studies, as described hereinabove with reference to VGAM381. Exostoses (multiple) 2 (EXT2, Accession NM_000401) is another VGAM1965 host target gene. EXT2 BINDING SITE is HOST TARGET binding site found in the 3' untranslated region of mRNA encoded by EXT2, corresponding to a HOST TARGET binding site such as BINDING SITE I, BINDING SITE II or BINDING SITE III. Table 2 illustrates the complementarity of the nucleotide sequences of EXT2 BINDING SITE, designated SEQ ID:5976, to the nucleotide sequence of VGAM1965 RNA, herein designated VGAM RNA, also designated SEQ ID:4676.

Another function of VGAM1965 is therefore inhibition of Exostoses (multiple) 2 (EXT2, Accession NM_000401). Accordingly, utilities of VGAM1965 include diagnosis, prevention and treatment of diseases and clinical conditions associated with EXT2. Fatty-acid-Coenzyme A Ligase, Long-chain 3 (FACL3, Accession NM_004457) is another VGAM1965 host target gene. FACL3 BINDING SITE is HOST TARGET binding site found in the 3' untranslated region of mRNA encoded by FACL3, corresponding to a HOST TARGET binding site such as BINDING SITE I, BINDING SITE II or BINDING SITE III. Table 2 illustrates the complementarity of the nucleotide sequences of FACL3 BINDING SITE, designated SEQ ID:10759, to the nucleotide sequence of VGAM1965 RNA, herein designated VGAM RNA, also designated SEQ ID:4676.

Another function of VGAM1965 is therefore inhibition of Fatty-acid-Coenzyme A Ligase, Long-chain 3 (FACL3, Accession NM_004457), a gene which is required for lipid synthesis and fatty acid degradation. Accordingly, utilities of VGAM1965 include diagnosis, prevention and treatment of diseases and clinical conditions associated with FACL3. The function of FACL3 has been established by previous studies. See FACL1 (OMIM Ref. No. 152425) and FACL2 (OMIM Ref. No. 152426). An initial reaction in fatty acid metabolism in eukaryotic cells is activation of fatty acids catalyzed by acyl-CoA synthetase (ACS; EC 6.2.1.3). Fujino et al. (1996) identified a member of the ACS family by PCR of rat brain cDNAs using primers based on the conserved region of the ACS protein, and designated it ACS3. The 720-amino acid, approximately 80-kd rat protein preferentially utilizes myristate, laurate, arachidonate, and eicosapentaenoate, and is expressed primarily in brain. Minekura et al. (1997) used rat ACS3 cDNA as a probe to isolate a human ACS3 clone from a placental cDNA library. The predicted 720-amino acid human protein is 92% identical to that of rat ACS3. Minekura et al. (1997) used PCR of somatic cell hybrids and fluorescence in situ hybridization to map the ACS3 gene to 2q34-q35.

Full details of the abovementioned studies are described in the following publications, the disclosure of which are hereby incorporated by reference:

Fujino, T.; Kang, M.-J.; Suzuki, H.; Iijima, H.; Yamamoto, T.: Molecular characterization and expression of rat acyl-CoA synthetase 3. J. Biol. Chem. 271:16748-16752, 1996; and Minekura, H.; Fujino, T.; Kang, M.-J.; Fujita, T.; Endo, Y.; Yamamoto, T. T.: Human acyl-coenzyme A synthetase 3 cDNA and localization of its gene (ACS3) to chromosome band 2q34-q35. G.

Further studies establishing the function and utilities of FACL3 are found in John Hopkins OMIM database record ID 602371, and in sited publications numbered 8939-8940 listed in the bibliography section hereinbelow, which are also hereby incorporated by reference. Ficolin (collagen/fibrinogen domain containing lectin) 2 (hucolin) (FCN2, Accession NM_015839) is another VGAM1965 host target gene. FCN2 BINDING SITE is HOST TARGET binding site found in the 3' untranslated region of mRNA encoded by FCN2, corresponding to a HOST TARGET binding site such as BINDING SITE I, BINDING SITE II or BINDING SITE III. Table 2 illustrates the complementarity of the nucleotide sequences of FCN2 BINDING SITE, designated SEQ ID:17955, to the nucleotide sequence of VGAM1965 RNA, herein designated VGAM RNA, also designated SEQ ID:4676.

Another function of VGAM1965 is therefore inhibition of Ficolin (collagen/fibrinogen domain containing lectin) 2 (hucolin) (FCN2, Accession NM_015839), a gene which is involved in phagocytosis of pathogens. Accordingly, utilities of VGAM1965 include diagnosis, prevention and treatment of diseases and clinical conditions associated with FCN2. The function of FCN2 and its association with various diseases and clinical conditions, has been established by previous studies, as described hereinabove with reference to VGAM493. Ferredoxin 1 (FDX1, Accession XM_016467) is another VGAM1965 host target gene. FDX1 BINDING SITE is HOST TARGET binding site found in the 3' untranslated region of mRNA encoded by FDX1, corresponding to a HOST TARGET binding site such as BINDING SITE I, BINDING SITE II or BINDING SITE III. Table 2 illustrates the complementarity of the nucleotide sequences of FDX1 BINDING SITE, designated SEQ ID:30260, to the nucleotide sequence of VGAM1965 RNA, herein designated VGAM RNA, also designated SEQ ID:4676.

Another function of VGAM1965 is therefore inhibition of Ferredoxin 1 (FDX1, Accession XM_016467), a gene which tcytochromes P450 involved in steroid, vitamin D, and bile acid metabolism. Accordingly, utilities of VGAM1965 include diagnosis, prevention and treatment of diseases and clinical conditions associated with FDX1. The function of FDX1 and its association with various diseases and clinical conditions, has been established by previous studies, as described hereinabove with reference to VGAM203. Frizzled Homolog 7 (Drosophila) (FZD7, Accession NM_003507) is another VGAM1965 host target gene. FZD7 BINDING SITE is HOST TARGET binding site found in the 3' untranslated region of mRNA encoded by FZD7, corresponding to a HOST TARGET binding site such as BINDING SITE I, BINDING SITE II or BINDING SITE III. Table 2 illustrates the complementarity of the nucleotide sequences of FZD7 BINDING SITE, designated SEQ ID:9599, to the nucleotide sequence of VGAM1965 RNA, herein designated VGAM RNA, also designated SEQ ID:4676.

Another function of VGAM1965 is therefore inhibition of Frizzled Homolog 7 (Drosophila) (FZD7, Accession NM_003507), a gene which enhances beta-catenin mediated signaling. Accordingly, utilities of VGAM1965 include diagnosis, prevention and treatment of diseases and clinical conditions associated with FZD7. The function of FZD7 and its association with various diseases and clinical conditions, has been established by previous studies, as described hereinabove with reference to VGAM1063. G2A (Accession NM_013345) is another VGAM1965 host target gene. G2A BINDING SITE is HOST TARGET binding site found in the 5' untranslated region of mRNA encoded by G2A, corresponding to a HOST TARGET binding site such as BINDING SITE I, BINDING SITE II or BINDING SITE III. Table 2 illustrates the complementarity of the nucleotide sequences of G2A BINDING SITE, designated SEQ ID:14989, to the nucleotide sequence of VGAM1965 RNA, herein designated VGAM RNA, also designated SEQ ID:4676.

Another function of VGAM1965 is therefore inhibition of G2A (Accession NM_013345), a gene which may mediate some of the effects of extracellular atp on insulin secretion. Accordingly, utilities of VGAM1965 include diagnosis, prevention and treatment of diseases and clinical conditions associated with G2A. The function of G2A has been established by previous studies. G2A belongs to a subfamily of GPCRs that bind to various glycolipids. Kabarowski et al. (2001) determined that expression of G2A induces signaling responses after exposure to lysophosphatidylcholine (LPC) and to sphingosylphosphorylcholine (SPC), a high-affinity ligand for OGR1 (GPR68; 601404). Scatchard analysis indicated that G2A binds LPC with high affinity and SPC with low affinity. Western blot analysis showed that both LPC and SPC activated ERK mitogen-activated protein kinase (see OMIM Ref. No. MAP3K4; 602425) in G2A-expressing CHO cells. LPC, but not SPC, stimulated transmigration of G2A-expressing T lymphocytes. The authors proposed that G2A may act as a sensor of LPC levels at sites of inflammation to limit the expansion of tissue-infiltrating cells promoting overt autoimmune disease. Animal model experiments lend further support to the function of G2A. Le et al. (2001) showed that mice with a targeted disruption of G2a, apart from enhanced in vitro T-cell proliferative responses, initially appeared normal. With age, however, they developed a progressive secondary lymphoid organ enlargement associated with an abnormal polyclonal lymphocyte expansion. Older animals succumbed to a late-onset autoimmune wasting syndrome It is appreciated that the abovementioned animal model for G2A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kabarowski, J. H. S.; Zhu, K.; Le, L. Q.; Witte, O. N.; Xu, Y.: Lysophosphatidylcholine as a ligand for the immunoregulatory receptor G2A. Science 293:702-705, 2001; and Le, L. Q.; Kabarowski, J. H. S.; Weng, Z.; Satterthwaite, A. B.; Harvill, E. T.; Jensen, E. R.; Miller, J. F.; Witte, O. N.: Mice lacking the orphan G protein-coupled receptor G2A de.

Further studies establishing the function and utilities of G2A are found in John Hopkins OMIM database record ID 606167, and in sited publications numbered 6994 listed in the bibliography section hereinbelow, which are also hereby incorporated by reference. GRB2-associated Binding Protein 2 (GAB2, Accession NM_012296) is another VGAM1965 host target gene. GAB2 BINDING SITE1 and GAB2 BINDING SITE2 are HOST TARGET binding sites found in untranslated regions of mRNA encoded by GAB2, corresponding to HOST TARGET binding sites such as BINDING SITE I, BINDING SITE II or BINDING SITE III. Table 2 illustrates the complementarity of the nucleotide sequences of GAB2 BINDING SITE1 and GAB2 BINDING SITE2, designated SEQ ID:14655 and SEQ ID:27850 respectively, to the nucleotide sequence of VGAM1965 RNA, herein designated VGAM RNA, also designated SEQ ID:4676.

Another function of VGAM1965 is therefore inhibition of GRB2-associated Binding Protein 2 (GAB2, Accession NM_012296), a gene which act as adapters for transmitting various signals. Accordingly, utilities of VGAM1965 include diagnosis, prevention and treatment of diseases and clinical conditions associated with GAB2. The function of GAB2 and its association with various diseases and clinical conditions, has been established by previous studies, as described hereinabove with reference to VGAM53. GA Binding Protein Transcription Factor, Beta Subunit 1, 53 kDa (GABPB1, Accession NM_005254) is another VGAM1965 host target gene. GABPB1 BINDING SITE is HOST TARGET binding site found in the 3' untranslated region of mRNA encoded by GABPB1, corresponding to a HOST TARGET binding site such as BINDING SITE I, BINDING SITE II or BINDING SITE III. Table 2 illustrates the complementarity of the nucleotide sequences of GABPB1 BINDING SITE, designated SEQ ID:11762, to the nucleotide sequence of VGAM1965 RNA, herein designated VGAM RNA, also designated SEQ ID:4676.

Another function of VGAM1965 is therefore inhibition of GA Binding Protein Transcription Factor, Beta Subunit 1, 53 kDa (GABPB1, Accession NM_005254), a gene which activates adenovirus E4 gene transcription. Accordingly, utilities of VGAM1965 include diagnosis, prevention and treatment of diseases and clinical conditions associated with GABPB1. The function of GABPB1 and its association with various diseases and clinical conditions, has been established by previous studies, as described hereinabove with reference to VGAM191. UDP-N-acetyl-alpha-D-galactosamine: polypeptide N-acetylgalactosaminyltransferase 3 (GalNAc-T3) (GALNT3, Accession NM_004482) is another VGAM1965 host target gene. GALNT3 BINDING SITE is HOST TARGET binding site found in the 3' untranslated region of mRNA encoded by GALNT3, corresponding to a HOST TARGET binding site such as BINDING SITE I, BINDING SITE II or BINDING SITE III. Table 2 illustrates the complementarity of the nucleotide sequences of GALNT3 BINDING SITE, designated SEQ ID:10805, to the nucleotide sequence of VGAM1965 RNA, herein designated VGAM RNA, also designated SEQ ID:4676.

Another function of VGAM1965 is therefore inhibition of UDP-N-acetyl-alpha-D-galactosamine:polypeptide N-acetylgalactosaminyltransferase 3 (GalNAc-T3) (GALNT3, Accession NM_004482), a gene which initiates O-glycosylation of serine and threonine residues. Accordingly, utilities of VGAM1965 include diagnosis, prevention and treatment of diseases and clinical conditions associated with GALNT3. The function of GALNT3 and its association with various diseases and clinical conditions, has been established by previous studies, as described hereinabove with reference to VGAM1565. UDP-N-acetyl-alpha-D-galactosamine:polypeptide N-acetylgalactosaminyltransferase 7 (GalNAc-T7) (GALNT7, Accession NM_054110) is another VGAM1965 host target gene. GALNT7 BINDING SITE is HOST TARGET binding site found in the 5' untranslated region of mRNA encoded by GALNT7, corresponding to a HOST TARGET binding site such as BINDING SITE I, BINDING SITE II or BINDING SITE III. Table 2 illustrates the complementarity of the nucleotide sequences of GALNT7 BINDING SITE, designated SEQ ID:27652, to the nucleotide sequence of VGAM1965 RNA, herein designated VGAM RNA, also designated SEQ ID:4676.

Another function of VGAM1965 is therefore inhibition of UDP-N-acetyl-alpha-D-galactosamine:polypeptide N-acetylgalactosaminyltransferase 7 (GalNAc-T7) (GALNT7, Accession NM_054110). Accordingly, utilities of VGAM1965 include diagnosis, prevention and treatment of diseases and clinical conditions associated with GALNT7. Growth Arrest-specific 7 (GAS7, Accession NM_003644) is another VGAM1965 host target gene. GAS7 BINDING SITE is HOST TARGET binding site found in the 3' untranslated region of mRNA encoded by GAS7, corresponding to a HOST TARGET binding site such as BINDING SITE I, BINDING SITE II or BINDING SITE III. Table 2 illustrates the complementarity of the nucleotide sequences of GAS7 BINDING SITE, designated SEQ ID:9718, to the nucleotide sequence of VGAM1965 RNA, herein designated VGAM RNA, also designated SEQ ID:4676.

Another function of VGAM1965 is therefore inhibition of Growth Arrest-specific 7 (GAS7, Accession NM_003644), a gene which may play a role in promoting maturation and morphological differentiation of cerebellar neurons. Accordingly, utilities of VGAM1965 include diagnosis, prevention and treatment of diseases and clinical conditions associated with GAS7. The function of GAS7 and its association with various diseases and clinical conditions, has been established by previous studies, as described hereinabove with reference to VGAM232. Glioblastoma Amplified Sequence (GBAS, Accession NM_001483) is another VGAM1965 host target gene. GBAS BINDING SITE is HOST TARGET binding site found in the 3' untranslated region of mRNA encoded by GBAS, corresponding to a HOST TARGET binding site such as BINDING SITE I, BINDING SITE II or BINDING SITE III. Table 2 illustrates the complementarity of the nucleotide sequences of GBAS BINDING SITE, designated SEQ ID:7227, to the nucleotide sequence of VGAM1965 RNA, herein designated VGAM RNA, also designated SEQ ID:4676.

Another function of VGAM1965 is therefore inhibition of Glioblastoma Amplified Sequence (GBAS, Accession NM_001483), a gene which might be involved in vesicular transport. Accordingly, utilities of VGAM1965 include diagnosis, prevention and treatment of diseases and clinical conditions associated with GBAS. The function of GBAS and its association with various diseases and clinical conditions, has been established by previous studies, as described hereinabove with reference to VGAM859. GEMIN5 (Accession XM_114471) is another VGAM1965 host target gene. GEMIN5 BINDING SITE is HOST TARGET binding site found in the 5' untranslated region of mRNA encoded by GEMIN5, corresponding to a HOST TARGET binding site such as BINDING SITE I, BINDING SITE II or BINDING SITE III. Table 2 illustrates the complementarity of the nucleotide sequences of GEMIN5 BINDING SITE, designated SEQ ID:42973, to the nucleotide sequence of VGAM1965 RNA, herein designated VGAM RNA, also designated SEQ ID:4676.

Another function of VGAM1965 is therefore inhibition of GEMIN5 (Accession XM_114471). Accordingly, utilities of VGAM1965 include diagnosis, prevention and treatment of diseases and clinical conditions associated with GEMIN5. Gamma-glutamyl Carboxylase (GGCX, Accession NM_000821) is another VGAM1965 host target gene. GGCX BINDING SITE is HOST TARGET binding site found in the 3' untranslated region of mRNA encoded by GGCX, corresponding to a HOST TARGET binding site such as BINDING SITE I, BINDING SITE II or BINDING SITE III. Table 2 illustrates the complementarity of the nucleotide sequences of GGCX BINDING SITE, designated SEQ ID:6482, to the nucleotide sequence of VGAM1965 RNA, herein designated VGAM RNA, also designated SEQ ID:4676.

Another function of VGAM1965 is therefore inhibition of Gamma-glutamyl Carboxylase (GGCX, Accession NM_000821). Accordingly, utilities of VGAM1965 include diagnosis, prevention and treatment of diseases and clinical conditions associated with GGCX. Gap Junction Protein, Beta 3, 31 kDa (connexin 31) (GJB3, Accession NM_024009) is another VGAM1965 host target gene. GJB3 BINDING SITE is HOST TARGET binding site found in the 3' untranslated region of mRNA encoded by GJB3, corresponding to a HOST TARGET binding site such as BINDING SITE I, BINDING SITE II or BINDING SITE III. Table 2 illustrates the complementarity of the nucleotide sequences of GJB3 BINDING SITE, designated SEQ ID:23442, to the nucleotide sequence of VGAM1965 RNA, herein designated VGAM RNA, also designated SEQ ID:4676.

Another function of VGAM1965 is therefore inhibition of Gap Junction Protein, Beta 3, 31 kDa (connexin 31) (GJB3, Accession NM_024009). Accordingly, utilities of VGAM1965 include diagnosis, prevention and treatment of diseases and clinical conditions associated with GJB3. Guanine Nucleotide Binding Protein (G protein), Alpha Inhibiting Activity Polypeptide 1 (GNAI1, Accession NM_002069) is another VGAM1965 host target gene. GNAI1 BINDING SITE is HOST TARGET binding site found in the 3' untranslated region of mRNA encoded by GNAI1, corresponding to a HOST TARGET binding site such as BINDING SITE I, BINDING SITE II or BINDING SITE III. Table 2 illustrates the complementarity of the nucleotide sequences of GNAI1

BINDING SITE, designated SEQ ID:7842, to the nucleotide sequence of VGAM1965 RNA, herein designated VGAM RNA, also designated SEQ ID:4676.

Another function of VGAM1965 is therefore inhibition of Guanine Nucleotide Binding Protein (G protein), Alpha Inhibiting Activity Polypeptide 1 (GNAI1, Accession NM_002069), a gene which is involved as modulators or transducers in various transmembrane signaling systems. Accordingly, utilities of VGAM1965 include diagnosis, prevention and treatment of diseases and clinical conditions associated with GNAI1. The function of GNAI1 and its association with various diseases and clinical conditions, has been established by previous studies, as described hereinabove with reference to VGAM57. Guanine Nucleotide Binding Protein (G protein), Gamma 2 (GNG2, Accession XM_170743) is another VGAM1965 host target gene. GNG2 BINDING SITE is HOST TARGET binding site found in the 5' untranslated region of mRNA encoded by GNG2, corresponding to a HOST TARGET binding site such as BINDING SITE I, BINDING SITE II or BINDING SITE III. Table 2 illustrates the complementarity of the nucleotide sequences of GNG2 BINDING SITE, designated SEQ ID:45502, to the nucleotide sequence of VGAM1965 RNA, herein designated VGAM RNA, also designated SEQ ID:4676.

Another function of VGAM1965 is therefore inhibition of Guanine Nucleotide Binding Protein (G protein), Gamma 2 (GNG2, Accession XM_170743), a gene which is involved as a modulator or transducer in various transmembrane signaling systems. Accordingly, utilities of VGAM1965 include diagnosis, prevention and treatment of diseases and clinical conditions associated with GNG2. The function of GNG2 has been established by previous studies. Modarressi et al. (2000) identified GNG2 by differential display RT-PCR of normal testis RNA and RNA from the testis of infertile and azoospermic patients. The full-length cDNA, obtained by 5-prime RACE, encodes a deduced 71-amino acid protein that is 100% homologous with the bovine, mouse, and rat GNG2 proteins. RT-PCR revealed expression in adult testis, adrenals, brain, white blood cells, and lung, but no or undetectable expression in testis from infertile or azoospermic patients, or in adult liver, muscle, or prostate. PCR of fetal tissues revealed highest expression in sternum and brain, intermediate expression in limbs, stomach, intestine, and kidney, and lowest expression in testis, heart, spleen, and lung. High expression was also found in tumor tissues from thyroid and parotid glands, in a squamous cell carcinoma, and in a lymphoid cell line, with little detected in granulation tissue. Yu et al. (2001) independently cloned human GNG2 from a 22-week fetal liver cDNA library.

Full details of the abovementioned studies are described in the following publications, the disclosure of which are hereby incorporated by reference:

Modarressi, M. H.; Taylor, K. E.; Wolfe, J.: Cloning, characterization, and mapping of the gene encoding the human G protein gamma-2 subunit. Biochem. Biophys. Res. Commun. 272:610-615, 2000; and Yu, Y.; Zhang, C.; Zhou, G.; Wu, S.; Qu, X.; Wei, H.; Xing, G.; Dong, C.; Zhai, Y.; Wan, J.; Ouyang, S.; Li, L., Zhang, S.; Zhou, K.; Zhang, Y.; Wu, C.; He, F.: Gene expression profil.

Further studies establishing the function and utilities of GNG2 are found in John Hopkins OMIM database record ID 606981, and in sited publications numbered 5526-5528 listed in the bibliography section hereinbelow, which are also hereby incorporated by reference. Glypican 1 (GPC1, Accession NM_002081) is another VGAM1965 host target gene. GPC1 BINDING SITE is HOST TARGET binding site found in the 3' untranslated region of mRNA encoded by GPC1, corresponding to a HOST TARGET binding site such as BINDING SITE I, BINDING SITE II or BINDING SITE III. Table 2 illustrates the complementarity of the nucleotide sequences of GPC1 BINDING SITE, designated SEQ ID:7876, to the nucleotide sequence of VGAM1965 RNA, herein designated VGAM RNA, also designated SEQ ID:4676.

Another function of VGAM1965 is therefore inhibition of Glypican 1 (GPC1, Accession NM_002081), a gene which may play a role in growth control and differentation. Accordingly, utilities of VGAM1965 include diagnosis, prevention and treatment of diseases and clinical conditions associated with GPC1. The function of GPC1 and its association with various diseases and clinical conditions, has been established by previous studies, as described hereinabove with reference to VGAM125. G Protein-coupled Receptor 85 (GPR85, Accession NM_018970) is another VGAM1965 host target gene. GPR85 BINDING SITE is HOST TARGET binding site found in the 5' untranslated region of mRNA encoded by GPR85, corresponding to a HOST TARGET binding site such as BINDING SITE I, BINDING SITE II or BINDING SITE III. Table 2 illustrates the complementarity of the nucleotide sequences of GPR85 BINDING SITE, designated SEQ ID:21044, to the nucleotide sequence of VGAM1965 RNA, herein designated VGAM RNA, also designated SEQ ID:4676.

Another function of VGAM1965 is therefore inhibition of G Protein-coupled Receptor 85 (GPR85, Accession NM_018970). Accordingly, utilities of VGAM1965 include diagnosis, prevention and treatment of diseases and clinical conditions associated with GPR85. Glucocorticoid Receptor DNA Binding Factor 1 (GRLF1, Accession XM_085943) is another VGAM1965 host target gene. GRLF1 BINDING SITE is HOST TARGET binding site found in the 3' untranslated region of mRNA encoded by GRLF1, corresponding to a HOST TARGET binding site such as BINDING SITE I, BINDING SITE II or BINDING SITE III. Table 2 illustrates the complementarity of the nucleotide sequences of GRLF1 BINDING SITE, designated SEQ ID:38417, to the nucleotide sequence of VGAM1965 RNA, herein designated VGAM RNA, also designated SEQ ID:4676.

Another function of VGAM1965 is therefore inhibition of Glucocorticoid Receptor DNA Binding Factor 1 (GRLF1, Accession XM_085943), a gene which inhibits transcription of the glucocorticoid receptor gene. Accordingly, utilities of VGAM1965 include diagnosis, prevention and treatment of diseases and clinical conditions associated with GRLF1. The function of GRLF1 and its association with various diseases and clinical conditions, has been established by previous studies, as described hereinabove with reference to VGAM55. Glutamate Receptor, Metabotropic 6 (GRM6, Accession NM_000843) is another VGAM1965 host target gene. GRM6 BINDING SITE is HOST TARGET binding site found in the 3' untranslated region of mRNA encoded by GRM6, corresponding to a HOST TARGET binding site such as BINDING SITE I, BINDING SITE II or BINDING SITE III. Table 2 illustrates the complementarity of the nucleotide sequences of GRM6 BINDING SITE, designated SEQ ID:6511, to the nucleotide sequence of VGAM1965 RNA, herein designated VGAM RNA, also designated SEQ ID:4676.

Another function of VGAM1965 is therefore inhibition of Glutamate Receptor, Metabotropic 6 (GRM6, Accession NM_000843). Accordingly, utilities of VGAM1965 include diagnosis, prevention and treatment of diseases and clinical conditions associated with GRM6. HCS (Accession NM_018947) is another VGAM1965 host target gene. HCS BINDING SITE is HOST TARGET binding site found in the 3' untranslated region of mRNA encoded by HCS, corresponding to a HOST TARGET binding site such as BINDING SITE I, BINDING SITE II or BINDING SITE III. Table 2 illustrates the complementarity of the nucleotide sequences of HCS BINDING SITE, designated SEQ ID:21017, to the nucleotide sequence of VGAM1965 RNA, herein designated VGAM RNA, also designated SEQ ID:4676.

Another function of VGAM1965 is therefore inhibition of HCS (Accession NM_018947). Accordingly, utilities of VGAM1965 include diagnosis, prevention and treatment of diseases and clinical conditions associated with HCS. Huntingtin Interacting Protein 1 (HIP1, Accession NM_005338) is another VGAM1965 host target gene. HIP1 BINDING SITE is HOST TARGET binding site found in the 3' untranslated region of mRNA encoded by HIP1, corresponding to a HOST TARGET binding site such as BINDING SITE I, BINDING SITE II or BINDING SITE III. Table 2 illustrates the complementarity of the nucleotide sequences of HIP1 BINDING SITE, designated SEQ ID:11811, to the nucleotide sequence of VGAM1965 RNA, herein designated VGAM RNA, also designated SEQ ID:4676.

Another function of VGAM1965 is therefore inhibition of Huntingtin Interacting Protein 1 (HIP1, Accession NM_005338), a gene which is a membrane protein and interacts with huntingtin. Accordingly, utilities of VGAM1965 include diagnosis, prevention and treatment of diseases and clinical conditions associated with HIP1. The function of HIP1 and its association with various diseases and clinical conditions, has been established by previous studies, as described hereinabove with reference to VGAM474. Heterogeneous Nuclear Ribonucleoprotein D-like (HNRPDL, Accession NM_005463) is another VGAM1965 host target gene. HNRPDL BINDING SITE is HOST TARGET binding site found in the 3' untranslated region of mRNA encoded by HNRPDL, corresponding to a HOST TARGET binding site such as BINDING SITE I, BINDING SITE II or BINDING SITE III. Table 2 illustrates the complementarity of the nucleotide sequences of HNRPDL BINDING SITE, designated SEQ ID:11955, to the nucleotide sequence of VGAM1965 RNA, herein designated VGAM RNA, also designated SEQ ID:4676.

Another function of VGAM1965 is therefore inhibition of Heterogeneous Nuclear Ribonucleoprotein D-like (HNRPDL, Accession NM_005463), a gene which binds to rna molecules that contain au-rich elements. Accordingly, utilities of VGAM1965 include diagnosis, prevention and treatment of diseases and clinical conditions associated with HNRPDL. The function of HNRPDL and its association with various diseases and clinical conditions, has been established by previous studies, as described hereinabove with reference to VGAM144. Homeo Box B9 (HOXB9, Accession NM_024017) is another VGAM1965 host target gene. HOXB9 BINDING SITE is HOST TARGET binding site found in the 3' untranslated region of mRNA encoded by HOXB9, corresponding to a HOST TARGET binding site such as BINDING SITE I, BINDING SITE II or BINDING SITE III. Table 2 illustrates the complementarity of the nucleotide sequences of HOXB9 BINDING SITE, designated SEQ ID:23448, to the nucleotide sequence of VGAM1965 RNA, herein designated VGAM RNA, also designated SEQ ID:4676.

Another function of VGAM1965 is therefore inhibition of Homeo Box B9 (HOXB9, Accession NM_024017). Accordingly, utilities of VGAM1965 include diagnosis, prevention and treatment of diseases and clinical conditions associated with HOXB9. Histamine Receptor H1 (HRH1, Accession NM_000861) is another VGAM1965 host target gene. HRH1 BINDING SITE is HOST TARGET binding site found in the 3' untranslated region of mRNA encoded by HRH1, corresponding to a HOST TARGET binding site such as BINDING SITE I, BINDING SITE II or BINDING SITE III. Table 2 illustrates the complementarity of the nucleotide sequences of HRH1 BINDING SITE, designated SEQ ID:6527, to the nucleotide sequence of VGAM1965 RNA, herein designated VGAM RNA, also designated SEQ ID:4676.

Another function of VGAM1965 is therefore inhibition of Histamine Receptor H1 (HRH1, Accession NM_000861), a gene which stimulates the synthesis of inositol phosphate. Accordingly, utilities of VGAM1965 include diagnosis, prevention and treatment of diseases and clinical conditions associated with HRH1. The function of HRH1 and its association with various diseases and clinical conditions, has been established by previous studies, as described hereinabove with reference to VGAM766. Heat Shock 70 kDa Protein 5 (glucose-regulated protein, 78 kDa) (HSPA5, Accession NM_005347) is another VGAM1965 host target gene. HSPA5 BINDING SITE is HOST TARGET binding site found in the 3' untranslated region of mRNA encoded by HSPA5, corresponding to a HOST TARGET binding site such as BINDING SITE I, BINDING SITE II or BINDING SITE III. Table 2 illustrates the complementarity of the nucleotide sequences of HSPA5 BINDING SITE, designated SEQ ID:11822, to the nucleotide sequence of VGAM1965 RNA, herein designated VGAM RNA, also designated SEQ ID:4676.

Another function of VGAM1965 is therefore inhibition of Heat Shock 70kDa Protein 5 (glucose-regulated protein, 78 kDa) (HSPA5, Accession NM_005347), a gene which is involved in the folding and assembly of proteins in the endoplasmic reticulum (ER). Accordingly, utilities of VGAM1965 include diagnosis, prevention and treatment of diseases and clinical conditions associated with HSPA5. The function of HSPA5 and its association with various diseases and clinical conditions, has been established by previous studies, as described hereinabove with reference to VGAM1782. Inducible T-cell Co-stimulator (ICOS, Accession NM_012092) is another VGAM1965 host target gene. ICOS BINDING SITE is HOST TARGET binding site found in the 3' untranslated region of mRNA encoded by ICOS, corresponding to a HOST TARGET binding site such as BINDING SITE I, BINDING SITE II or BINDING SITE III. Table 2 illustrates the complementarity of the nucleotide sequences of ICOS BINDING SITE, designated SEQ ID:14392, to the nucleotide sequence of VGAM1965 RNA, herein designated VGAM RNA, also designated SEQ ID:4676.

Another function of VGAM1965 is therefore inhibition of Inducible T-cell Co-stimulator (ICOS, Accession NM_012092), a gene which forms homodimers and functions as an inducible T-cell co-stimulator. Accordingly, utilities of VGAM1965 include diagnosis, prevention and treatment of diseases and clinical conditions associated with ICOS. The function of ICOS and its association with various diseases and clinical conditions, has been established by previous studies, as described hereinabove with reference to VGAM18. Inhibitor of DNA Binding 3, Dominant Negative Helix-loop-helix Protein (ID3, Accession XM_086357) is another VGAM1965 host target gene. ID3 BINDING SITE is HOST TARGET binding site found in the 3' untranslated region of mRNA encoded by ID3, corresponding to a HOST TARGET binding site such as BINDING SITE I, BINDING SITE II or BINDING SITE III. Table 2 illustrates the complementarity of the nucleotide sequences of ID3 BINDING SITE, designated SEQ ID:38612, to the nucleotide sequence of VGAM1965 RNA, herein designated VGAM RNA, also designated SEQ ID:4676.

Another function of VGAM1965 is therefore inhibition of Inhibitor of DNA Binding 3, Dominant Negative Helix-loop-helix Protein (ID3, Accession XM_086357), a gene which inhibits DNA-binding of E2A-containing complexes. Accordingly, utilities of VGAM1965 include diagnosis, prevention and treatment of diseases and clinical conditions associated with ID3. The function of ID3 has been established by previous studies. Members of the ID family of helix-loop-helix (HLH) proteins lack a basic DNA-binding domain and inhibit transcription through formation of nonfunctional dimers that are incapable of binding to DNA. Ellmeier et al. (1992) isolated a novel human gene encoding a helix-loop-helix protein by molecular cloning of chromosome 1p36-specific CpG islands. Initially termed HEIR1, the ID3 gene was localized to the neuroblastoma consensus deletion region, 1p36.2-p36.12. Its predicted protein was 95.8% identical to the mouse HLH462 protein and had clear homology to the mouse Id and Drosophila emc proteins. The gene was expressed at high abundance in adult lung, kidney, and adrenal medulla, but not in adult brain. Despite prominent HEIR1 expression in adrenal medulla, which is a prime target for neuroblastomas, 10 of 12 neuroblastoma-derived cell lines showed very low levels of HEIR1 mRNA. Low HEIR1 expression was generally found in tumor cell lines with NMYC (OMIM Ref. No. 164840) overexpression, whereas the 2 cell lines displaying high HEIR1 levels did not overexpress NMYC. Mutually exclusive expression of the 2 genes was also found by in situ hybridization in developing mouse tissues, particularly in the forebrain neuroectoderm. Ellmeier et al. (1992) concluded that HEIR1 expression is reduced specifically in the majority of neuroblastomas and suggested an inverse correlation between HEIR1 and NMYC expression in these tumors and in embryonic development. ID3 is an inhibitor of E proteins, such as E2A (OMIM Ref. No. 147141). By Northern and Western blot analysis, Kee et al. (2001) showed that transforming growth factor-beta (OMIM Ref. No. 190180) in mouse rapidly induced transient Id3 expression in B-lymphocyte precursors. This induction involved activation of the SMAD (see OMIM Ref. No. 602932) transcription factor pathway. Deed et al. (1994) reported a comparison of the ID3 gene with ID1 (OMIM Ref. No. 600349) and ID2 (OMIM Ref. No. 600386) that showed a highly conserved protein-coding gene organization consistent with evolution from a common ancestral gene. Animal model experiments lend further support to the function of ID3. Id proteins may control cell differentiation by interfering with DNA binding of transcription factors. Lyden et al. (1999) demonstrated that the targeted disruption of Id1 and Id3 in mice results in premature withdrawal of neuroblasts in the cell cycle and expression of neural-specific differentiation markers. Lyden et al. (1999) crossed Id1 +/- and Id3 +/- mice. Offspring lacking 1 to 3 Id alleles in any combination were indistinguishable from wildtype, but no animals lacking all 4 Id alleles were born. The Id1-Id3 double knockout mice displayed vascular malformations in forebrain and absence of branching and sprouting of blood vessels in the neuroectoderm. As angiogenesis both in the brain and in tumors requires invasion of avascular tissue by endothelial cells, Lyden et al. (1999) examined Id knockout mice for their ability to support the growth of tumor xenografts. Three different tumors failed to grow and/or metastasize in Id1+/-Id3-/- mice, and any tumor growth present showed poor vascularization and extensive necrosis. Lyden et al. (1999) concluded that Id genes are required to maintain the timing of neuronal differentiation in the embryo and invasiveness of the vasculature. Because the Id genes are expressed at very low levels in adults, they make attractive targets for antiangiogenic drug design. Lyden et al. (1999) also concluded that the premature neuronal differentiation in Id1-Id3 double knockout mice indicates that ID1 or ID3 is required to block the precisely timed expression and activation of positively acting bHLH proteins during murine development. Pan et al. (1999) found that Id3-deficient mice had no overt abnormalities but had compromised humoral immunity. After immunization with T cell-dependent or T cell-independent antigens, the responses of Id3-deficient mice were attenuated and severely impaired, respectively. T-cell proliferative responses appeared to be intact, but IFNG expression may have been impaired. The defect in B-cell proliferation could be rescued by ectopic expression of Id1.

It is appreciated that the abovementioned animal model for ID3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kee, B. L.; Rivera, R. R.; Murre, C.: Id3 inhibits B lymphocyte progenitor growth and survival in response to TGF-beta. Nature Immun. 2:242-247, 2001; and Lyden, D.; Young, A. Z.; Zagzag, D.; Yan, W.; Gerald, W.; O'Reilly, R.; Bader, B. L.; Hynes, R. O.; Zhuang, Y.; Manova, K.; Benezra, R.: Id1 and Id3 are required for neurogenesis, angi.

Further studies establishing the function and utilities of ID3 are found in John Hopkins OMIM database record ID 600277, and in sited publications numbered 8421-842 and 10357 listed in the bibliography section hereinbelow, which are also hereby incorporated by reference. Inositol Hexaphosphate Kinase 1 (IHPK1, Accession XM_171045) is another VGAM1965 host target gene. IHPK1 BINDING SITE1 and IHPK1 BINDING SITE2 are HOST TARGET binding sites found in untranslated regions of mRNA encoded by IHPK1, corresponding to HOST TARGET binding sites such as BINDING SITE I, BINDING SITE II or BINDING SITE III. Table 2 illustrates the complementarity of the nucleotide sequences of IHPK1 BINDING SITE1 and IHPK1 BINDING SITE2, designated SEQ ID:45824 and SEQ ID:45825 respectively, to the nucleotide sequence of VGAM1965 RNA, herein designated VGAM RNA, also designated SEQ ID:4676.

Another function of VGAM1965 is therefore inhibition of Inositol Hexaphosphate Kinase 1 (IHPK1, Accession XM_171045), a gene which is a messenger molecule that releases calcium from intracellular stores. Accordingly, utilities of VGAM1965 include diagnosis, prevention and treatment of diseases and clinical conditions associated with IHPK1. The function of IHPK1 and its association with various diseases and clinical conditions, has been established by previous studies, as described hereinabove with reference to VGAM1061. Interleukin 18 (interferon-gamma-inducing factor) (IL18, Accession NM_001562) is another VGAM1965 host target gene. IL18 BINDING SITE is HOST TARGET binding site found in the 5' untranslated region of mRNA encoded by IL18, corresponding to a HOST TARGET binding site such as BINDING SITE I, BINDING SITE II or BINDING SITE III. Table 2 illustrates the complementarity of the nucleotide sequences of IL18 BINDING SITE, designated SEQ ID:7292, to the nucleotide sequence of VGAM1965 RNA, herein designated VGAM RNA, also designated SEQ ID:4676.

Another function of VGAM1965 is therefore inhibition of Interleukin 18 (interferon-gamma-inducing factor) (IL18, Accession NM_001562), a gene which augments natural killer cell activity in spleen cells and stimulates interferon gamma production in t helper type i cells. Accordingly, utilities of VGAM1965 include diagnosis, prevention and treatment of diseases and clinical conditions associated with IL18. The function of IL18 has been established by previous studies. Okamura et al. (1995) cloned an interferon-gamma (IFNG; 147570)-inducing factor that augments natural killer (NK) cell activity in spleen cells. The gene encodes a precursor protein of 192 amino acids and a mature protein of 157 amino acids. Messenger RNAs for the gene, designated IGIF by them, and for interleukin-12 (IL12; OMIM Ref. No. 161560) were readily detected in Kupffer cells and activated macrophages. Recombinant IGIF induced IFNG more potently than did IL12, which is also a NK-cell stimulatory factor. Administration of anti-IGIF antibodies prevented liver damage in mice inoculated with Propionibacterium acnes and challenged with lipopolysaccharide that induces toxic shock. Okamura et al. (1995) speculated that IGIF may be involved in the development of Th1 cells and also in mechanisms of tissue injury in inflammatory reactions. The mechanism underlying the differentiation of CD4+ T cells into functionally distinct Th1 and Th2 subsets had been incompletely understood. The interferon-gamma-inducing factor is also known as interleukin-18 (Sarvetnick, 1997). Rothe et al. (1997) concluded that IGIF expression is normally regulated in autoimmune NOD mice and is closely associated with diabetes development. They showed that the Igif gene maps to mouse chromosome 9 within the Idd2 interval and is therefore a candidate for the Idd2 diabetes susceptibility gene, a non-MHC gene associated with the acceleration of diabetes development Animal model experiments lend further support to the function of IL18. In transgenic mice, Konishi et al. (2002) showed that IL18 contributes to the spontaneous development of atopic dermatitis-like inflammatory skin lesions independently of IgE/Stat6 (OMIM Ref. No. 601512) under specific pathogen-free conditions. Overrelease of IL18 initiated atopic dermatitis-like inflammation, which was accelerated by interleukin 1-alpha (IL1A; 147760).

It is appreciated that the abovementioned animal model for IL18 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Okamura, H.; Tsutsui, H.; Komatsu, T.; Yutsudo, M.; Hakura, A.; Tanimoto, T.; Torigoe, K.; Okura, T.; Nukada, Y.; Hattori, K.; Akita, K.; Namba, M.; Tanabe, F.; Konishi, K.; Fukuda, S.; Kurimoto, M.: Cloning of a new cytokine that induces IFN-gamma production by T cells. Nature 378:88-91, 1995; and Konishi, H.; Tsutsui, H.; Murakami, T.; Yumikura-Futatsugi, S.; Yamanaka, K.; Tanaka, M.; Iwakura, Y.; Suzuki, N.; Takeda, K.; Akira, S.; Nakanishi, K.; Mizutani, H.: IL-18 contributes.

Further studies establishing the function and utilities of IL18 are found in John Hopkins OMIM database record ID 600953, and in sited publications numbered 8950-1320, 11688-1324, 1162, 943 and 11190 listed in the bibliography section hereinbelow, which are also hereby incorporated by reference. Interleukin 1 Receptor, Type I (IL1R1, Accession NM_000877) is another VGAM1965 host target gene. IL1R1 BINDING SITE is HOST TARGET binding site found in the 3' untranslated region of mRNA encoded by IL1R1, corresponding to a HOST TARGET binding site such as BINDING SITE I, BINDING SITE II or BINDING SITE III. Table 2 illustrates the complementarity of the nucleotide sequences of IL1R1 BINDING SITE, designated SEQ ID:6567, to the nucleotide sequence of VGAM1965 RNA, herein designated VGAM RNA, also designated SEQ ID:4676.

Another function of VGAM1965 is therefore inhibition of Interleukin 1 Receptor, Type I (IL1R1, Accession NM_000877), a gene which is a receptor for interleukin-1 alpha (il-1a), beta (il-1b), and interleukin-1 receptor antagonist protein (il-1ra). Accordingly, utilities of VGAM1965 include diagnosis, prevention and treatment of diseases and clinical conditions associated with IL1R1. The function of IL1R1 and its association with various diseases and clinical conditions, has been established by previous studies, as described hereinabove with reference to VGAM704. Interleukin 1 Receptor Accessory Protein-like 2 (IL1RAPL2, Accession NM_017416) is another VGAM1965 host target gene. IL1RAPL2 BINDING SITE is HOST TARGET binding site found in the 5" untranslated region of mRNA encoded by IL1RAPL2, corresponding to a HOST TARGET binding site such as BINDING SITE I, BINDING SITE II or BINDING SITE III. Table 2 illustrates the complementarity of the nucleotide sequences of IL1RAPL2 BINDING SITE, designated SEQ ID:18874, to the nucleotide sequence of VGAM1965 RNA, herein designated VGAM RNA, also designated SEQ ID:4676.

Another function of VGAM1965 is therefore inhibition of Interleukin 1 Receptor Accessory Protein-like 2 (IL1RAPL2, Accession NM_017416), a gene which may act in the development or function of the central nervous system. Accordingly, utilities of VGAM1965 include diagnosis, prevention and treatment of diseases and clinical conditions associated with IL1RAPL2. The function of IL1RAPL2 has been established by previous studies. The IL1 receptor family is composed of bona fide receptors (e.g., IL1R (OMIM Ref. No. 147810) and IL18R (OMIM Ref. No. 604494)), decoy receptors (e.g., IL1R2; 147811), signaling accessory receptors (e.g., IL1RAP (OMIM Ref. No. 602626) and IL18RAP (OMIM Ref. No. 604509)), and structurally homologous orphan receptors. During searches of genomic databases with the IL1RAPL1 (OMIM Ref. No. 300206) cDNA sequence, Jin et al. (2000) identified a close homolog, which they designated IL1RAPL2, located on Xq22. They obtained a partial IL1RAPL2 cDNA by screening a human brain cDNA library. The cDNA encodes a deduced 658-amino acid protein that shares 65% identity with the IL1RAPL1 protein. Both proteins have novel C-terminal sequences not present in other members of the IL1 receptor family. The IL1RAPL2 gene is transcribed in a centromere-to-telomere direction. By searching genomic databases for sequences homologous to the Toll homology domain (THD), Sana et al. (2000) identified a cDNA encoding IL1RAPL2, which they termed IL1R9. Sequence analysis predicted that the 307-amino acid cytoplasmic tail of the 686-amino acid IL1RAPL2 protein contains an additional 120 to 130 residues beyond the THD, like IL1R8 (IL1RAPL1) but unlike other IL1Rs. Northern blot analysis revealed expression of a 5.5-kb transcript in fetal brain. Functional analysis determined that neither IL1RAPL1 nor IL1RAPL2 activate nuclear factor kappa-B (NFKB; OMIM Ref. No. 164011) except in the presence of bona fide receptors but not orphan receptors. Evolutionary sequence analysis suggested that these orphan receptors probably form a functionally distinct subset of the IL1R superfamily. Jin et al. (2000) and Sana et al. (2000) suggested that, like IL1RAPL1, IL1RAPL2 may be the site of mutations causing nonspecific mental retardation.

Full details of the abovementioned studies are described in the following publications, the disclosure of which are hereby incorporated by reference:

Jin, H.; Gardner, R. J.; Viswesvaraiah, R.; Muntoni, F.; Roberts, R. G.: Two novel members of the interleukin-1 receptor gene family, one deleted in Xp22.1-Xp21.3 mental retardation. Europ. J. Hum. Genet. 8:87-94, 2000; and Sana, T. R.; Debets, R.; Timans, J. C.; Bazan, J. F.; Kastelein, R. A.: Computational identification, cloning, and characterization of IL1R9, a novel interleukin-1 receptor-like gene e.

Further studies establishing the function and utilities of IL1RAPL2 are found in John Hopkins OMIM database record ID 300277, and in sited publications numbered 899 and 10993 listed in the bibliography section hereinbelow, which are also hereby incorporated by reference. Interleukin 21 Receptor (IL21R, Accession NM_021798) is another VGAM1965 host target gene. IL21R BINDING SITE is HOST TARGET binding site found in the 3' untranslated region of mRNA encoded by IL21R, corresponding to a HOST TARGET binding site such as BINDING SITE I, BINDING SITE II or BINDING SITE III. Table 2 illustrates the complementarity of the nucleotide sequences of IL21R BINDING SITE, designated SEQ ID:22355, to the nucleotide sequence of VGAM1965 RNA, herein designated VGAM RNA, also designated SEQ ID:4676.

Another function of VGAM1965 is therefore inhibition of Interleukin 21 Receptor (IL21R, Accession NM_021798), a gene which is involved in receptor mediated endocytosis and transduces the mitogenic signals of il-2. Accordingly, utilities of VGAM1965 include diagnosis, prevention and treatment of diseases and clinical conditions associated with IL21R. The function of IL21R and its association with various diseases and clinical conditions, has been established by previous studies, as described hereinabove with reference to VGAM1940. Interleukin Enhancer Binding Factor 1 (ILF1, Accession NM_004514) is another VGAM1965 host target gene. ILF1 BINDING SITE is HOST TARGET binding site found in the 3' untranslated region of mRNA encoded by ILF1, corresponding to a HOST TARGET binding site such as BINDING SITE I, BINDING SITE II or BINDING SITE III. Table 2 illustrates the complementarity of the nucleotide sequences of ILF1 BINDING SITE, designated SEQ ID:10844, to the nucleotide sequence of VGAM1965 RNA, herein designated VGAM RNA, also designated SEQ ID:4676.

Another function of VGAM1965 is therefore inhibition of Interleukin Enhancer Binding Factor 1 (ILF1, Accession NM_004514), a gene which binds to nfat-like motifs (purine-rich) in the hiv-1 long terminal repeat and in the il-2 promoter. Accordingly, utilities of VGAM1965 include diagnosis, prevention and treatment of diseases and clinical conditions associated with ILF1. The function of ILF1 and its association with various diseases and clinical conditions, has been established by previous studies, as described hereinabove with reference to VGAM1446. Insulin Receptor Substrate 1 (IRS1, Accession NM_005544) is another VGAM1965 host target gene. IRS1 BINDING SITE is HOST TARGET binding site found in the 5' untranslated region of mRNA encoded by IRS1, corresponding to a HOST TARGET binding site such as BINDING SITE I, BINDING SITE II or BINDING SITE III. Table 2 illustrates the complementarity of the nucleotide sequences of IRS1 BINDING SITE, designated SEQ ID:12070, to the nucleotide sequence of VGAM1965 RNA, herein designated VGAM RNA, also designated SEQ ID:4676.

Another function of VGAM1965 is therefore inhibition of Insulin Receptor Substrate 1 (IRS1, Accession NM_005544), a gene which may mediate the control of various cellular processes by insulin. Accordingly, utilities of VGAM1965 include diagnosis, prevention and treatment of diseases and clinical conditions associated with IRS1. The function of IRS1 and its association with various diseases and clinical conditions, has been established by previous studies, as described hereinabove with reference to VGAM281. Insulin Receptor Substrate 2 (IRS2, Accession XM_007095) is another VGAM1965 host target gene. IRS2 BINDING SITE is HOST TARGET binding site found in the 3' untranslated region of mRNA encoded by IRS2, corresponding to a HOST TARGET binding site such as BINDING SITE I, BINDING SITE II or BINDING SITE III. Table 2 illustrates the complementarity of the nucleotide sequences of IRS2 BINDING SITE, designated SEQ ID:30034, to the nucleotide sequence of VGAM1965 RNA, herein designated VGAM RNA, also designated SEQ ID:4676.

Another function of VGAM1965 is therefore inhibition of Insulin Receptor Substrate 2 (IRS2, Accession XM_007095), a gene which may mediate the control of various cellular processes by insulin. Accordingly, utilities of VGAM1965 include diagnosis, prevention and treatment of diseases and clinical conditions associated with IRS2. The function of IRS2 and its association with various diseases and clinical conditions, has been established by previous studies, as described hereinabove with reference to VGAM1217. ISL1 Transcription Factor, LIM/homeodomain, (islet-1) (ISL1, Accession NM_002202) is another VGAM1965 host target gene. ISL1 BINDING SITE is HOST TARGET binding site found in the 3' untranslated region of mRNA encoded by ISL1, corresponding to a HOST TARGET binding site such as BINDING SITE I, BINDING SITE II or BINDING SITE III. Table 2 illustrates the complementarity of the nucleotide sequences of ISL1 BINDING SITE, designated SEQ ID:7958, to the nucleotide sequence of VGAM1965 RNA, herein designated VGAM RNA, also designated SEQ ID:4676.

Another function of VGAM1965 is therefore inhibition of ISL1 Transcription Factor, LIM/homeodomain, (islet-1) (ISL1, Accession NM_002202), a gene which binds to one of the cis-acting domain of the insulin gene enhancer. Accordingly, utilities of VGAM1965 include diagnosis, prevention and treatment of diseases and clinical conditions associated with ISL1. The function of ISL1 and its association with various diseases and clinical conditions, has been established by previous studies, as described hereinabove with reference to VGAM464. Integrin, Alpha 5 (fibronectin receptor, alpha polypeptide) (ITGA5, Accession XM_028642) is another VGAM1965 host target gene. ITGA5 BINDING SITE is HOST TARGET binding site found in the 3' untranslated region of mRNA encoded by ITGA5, corresponding to a HOST TARGET binding site such as BINDING SITE I, BINDING SITE II or BINDING SITE III. Table 2 illustrates the complementarity of the nucleotide sequences of ITGA5 BINDING SITE, designated SEQ ID:30722, to the nucleotide sequence of VGAM1965 RNA, herein designated VGAM RNA, also designated SEQ ID:4676.

Another function of VGAM1965 is therefore inhibition of Integrin, Alpha 5 (fibronectin receptor, alpha polypeptide) (ITGA5, Accession XM_028642), a gene which is receptor for fibronectin and fibrinogen and recognizes the sequence r-g-d in its ligands. Accordingly, utilities of VGAM1965 include diagnosis, prevention and treatment of diseases and clinical conditions associated with ITGA5. The function of ITGA5 and its association with various diseases and clinical conditions, has been established by previous studies, as described hereinabove with reference to VGAM1220. Inositol 1,4,5-triphosphate Receptor, Type 1 (ITPR1, Accession NM_002222) is another VGAM1965 host target gene. ITPR1 BINDING SITE is HOST TARGET binding site found in the 3' untranslated region of mRNA encoded by ITPR1, corresponding to a HOST TARGET binding site such as BINDING SITE I, BINDING SITE II or BINDING SITE III. Table 2 illustrates the complementarity of the nucleotide sequences of ITPR1 BINDING SITE, designated SEQ ID:7987, to the nucleotide sequence of VGAM1965 RNA, herein designated VGAM RNA, also designated SEQ ID:4676.

Another function of VGAM1965 is therefore inhibition of Inositol 1,4,5-triphosphate Receptor, Type 1 (ITPR1, Accession NM_002222), a gene which couples cell membrane receptors to Ca2+ signal transduction pathways. Accordingly, utilities of VGAM1965 include diagnosis, prevention and treatment of diseases and clinical conditions associated with ITPR1. The function of ITPR1 and its association with various diseases and clinical conditions, has been established by previous studies, as described hereinabove with reference to VGAM106. Jagged 1 (Alagille syndrome) (JAG1, Accession NM_000214) is another VGAM1965 host target gene. JAG1 BINDING SITE is HOST TARGET binding site found in the 3' untranslated region of mRNA encoded by JAG1, corresponding to a HOST TARGET binding site such as BINDING SITE I, BINDING SITE II or BINDING SITE III. Table 2 illustrates the complementarity of the nucleotide sequences of JAG1 BINDING SITE, designated SEQ ID:5711, to the nucleotide sequence of VGAM1965 RNA, herein designated VGAM RNA, also designated SEQ ID:4676.

Another function of VGAM1965 is therefore inhibition of Jagged 1 (Alagille syndrome) (JAG1, Accession NM_000214). Accordingly, utilities of VGAM1965 include diagnosis, prevention and treatment of diseases and clinical conditions associated with JAG1. Janus Kinase 2 (a protein tyrosine kinase) (JAK2, Accession NM_004972) is another VGAM1965 host target gene. JAK2 BINDING SITE is HOST TARGET binding site found in the 3' untranslated region of mRNA encoded by JAK2, corresponding to a HOST TARGET binding site such as BINDING SITE I, BINDING SITE II or BINDING SITE III. Table 2 illustrates the complementarity of the nucleotide sequences of JAK2 BINDING SITE, designated SEQ ID:11417, to the nucleotide sequence of VGAM1965 RNA, herein designated VGAM RNA, also designated SEQ ID:4676.

Another function of VGAM1965 is therefore inhibition of Janus Kinase 2 (a protein tyrosine kinase) (JAK2, Accession NM_004972), a gene which tyrosine kinase of the non-receptor type, involved in interleukin 3 signal transduction. Accordingly, utilities of VGAM1965 include diagnosis, prevention and treatment of diseases and clinical conditions associated with JAK2. The function of JAK2 and its association with various diseases and clinical conditions, has been established by previous studies, as described hereinabove with reference to VGAM445. JJAZ1 (Accession NM_015355) is another VGAM1965 host target gene. JJAZ1 BINDING SITE is HOST TARGET binding site found in the 3' untranslated region of mRNA encoded by JJAZ1, corresponding to a HOST TARGET binding site such as BINDING SITE I, BINDING SITE II or BINDING SITE III. Table 2 illustrates the complementarity of the nucleotide sequences of JJAZ1 BINDING SITE, designated SEQ ID:17652, to the nucleotide sequence of VGAM1965 RNA, herein designated VGAM RNA, also designated SEQ ID:4676.

Another function of VGAM1965 is therefore inhibition of JJAZ1 (Accession NM_015355), a gene which is a zinc finger protein. Accordingly, utilities of VGAM1965 include diagnosis, prevention and treatment of diseases and clinical conditions associated with JJAZ1. The function of JJAZ1 and its association with various diseases and clinical conditions, has been established by previous studies, as described hereinabove with reference to VGAM231. Potassium Voltage-gated Channel, Shaker-related Subfamily, Member 5 (KCNA5, Accession XM_006988) is another VGAM1965 host target gene. KCNA5 BINDING SITE is HOST TARGET binding site found in the 3' untranslated region of mRNA encoded by KCNA5, corresponding to a HOST TARGET binding site such as BINDING SITE I, BINDING SITE II or BINDING SITE III. Table 2 illustrates the complementarity of the nucleotide sequences of KCNA5 BINDING SITE, designated SEQ ID:30027, to the nucleotide sequence of VGAM1965 RNA, herein designated VGAM RNA, also designated SEQ ID:4676.

Another function of VGAM1965 is therefore inhibition of Potassium Voltage-gated Channel, Shaker-related Subfamily, Member 5 (KCNA5, Accession XM_006988), a gene which mediates the voltage-dependent potassium ion permeability of excitable membranes. Accordingly, utilities of VGAM1965 include diagnosis, prevention and treatment of diseases and clinical conditions associated with KCNA5. The function of KCNA5 and its association with various diseases and clinical conditions, has been established by previous studies, as described hereinabove with reference to VGAM413. Potassium Channel, Subfamily K, Member 6 (KCNK6, Accession NM_004823) is another VGAM1965 host target gene. KCNK6 BINDING SITE is HOST TARGET binding site found in the 3' untranslated region of mRNA encoded by KCNK6, corresponding to a HOST TARGET binding site such as BINDING SITE I, BINDING SITE II or BINDING SITE III. Table 2 illustrates the complementarity of the nucleotide sequences of KCNK6 BINDING SITE, designated SEQ ID:11240, to the nucleotide sequence of VGAM1965 RNA, herein designated VGAM RNA, also designated SEQ ID:4676.

Another function of VGAM1965 is therefore inhibition of Potassium Channel, Subfamily K, Member 6 (KCNK6, Accession NM_004823), a gene which is an inward rectifying potassium channel protein. Accordingly, utilities of VGAM1965 include diagnosis, prevention and treatment of diseases and clinical conditions associated with KCNK6. The function of KCNK6 and its association with various diseases and clinical conditions, has been established by previous studies, as described hereinabove with reference to VGAM1190. Potassium Voltage-gated Channel, Delayed-rectifier, Subfamily S, Member 2 (KCNS2, Accession XM_043106) is another VGAM1965 host target gene. KCNS2 BINDING SITE is HOST TARGET binding site found in the 3' untranslated region of mRNA encoded by KCNS2, corresponding to a HOST TARGET binding site such as BINDING SITE I, BINDING SITE II or BINDING SITE III. Table 2 illustrates the complementarity of the nucleotide sequences of KCNS2 BINDING SITE, designated SEQ ID:33895, to the nucleotide sequence of VGAM1965 RNA, herein designated VGAM RNA, also designated SEQ ID:4676.

Another function of VGAM1965 is therefore inhibition of Potassium Voltage-gated Channel, Delayed-rectifier, Subfamily S, Member 2 (KCNS2, Accession XM_043106), a gene which mediates the voltage-dependent potassium ion permeability of excitable membranes. Accordingly, utilities of VGAM1965 include diagnosis, prevention and treatment of diseases and clinical conditions associated with KCNS2. The function of KCNS2 and its association with various diseases and clinical conditions, has been established by previous studies, as described hereinabove with reference to VGAM419. Kinase Insert Domain Receptor (a type III receptor tyrosine kinase) (KDR, Accession NM_002253) is another VGAM1965 host target gene. KDR BINDING SITE is HOST TARGET binding site found in the 3' untranslated region of mRNA encoded by KDR, corresponding to a HOST TARGET binding site such as BINDING SITE I, BINDING SITE II or BINDING SITE III. Table 2 illustrates the complementarity of the nucleotide sequences of KDR BINDING SITE, designated SEQ ID:8051, to the nucleotide sequence of VGAM1965 RNA, herein designated VGAM RNA, also designated SEQ ID:4676.

Another function of VGAM1965 is therefore inhibition of Kinase Insert Domain Receptor (a type III receptor tyrosine kinase) (KDR, Accession NM_002253). Accordingly, utilities of VGAM1965 include diagnosis, prevention and treatment of diseases and clinical conditions associated with KDR. KIAA0857 (Accession XM_039552) is another VGAM1965 host target gene. KIAA0857 BINDING SITE is HOST TARGET binding site found in the 3' untranslated region of mRNA encoded by KIAA0857, corresponding to a HOST TARGET binding site such as BINDING SITE I, BINDING SITE II or BINDING SITE III. Table 2 illustrates the complementarity of the nucleotide sequences of KIAA0857 BINDING SITE, designated SEQ ID:33122, to the nucleotide sequence of VGAM1965 RNA, herein designated VGAM RNA, also designated SEQ ID:4676.

Another function of VGAM1965 is therefore inhibition of KIAA0857 (Accession XM_039552), a gene which is involved in cytoskeletal organization and cellular growth. Accordingly, utilities of VGAM1965 include diagnosis, prevention and treatment of diseases and clinical conditions associated with KIAA0857. The function of KIAA0857 and its association with various diseases and clinical conditions, has been established by previous studies, as described hereinabove with reference to VGAM548. Kinesin Family Member 3B (KIF3B, Accession NM_004798) is another VGAM1965 host target gene. KIF3B BINDING SITE is HOST TARGET binding site found in the 3' untranslated region of mRNA encoded by KIF3B, corresponding to a HOST TARGET binding site such as BINDING SITE I, BINDING SITE II or BINDING SITE III. Table 2 illustrates the complementarity of the nucleotide sequences of KIF3B BINDING SITE, designated SEQ ID:11219, to the nucleotide sequence of VGAM1965 RNA, herein designated VGAM RNA, also designated SEQ ID:4676.

Another function of VGAM1965 is therefore inhibition of Kinesin Family Member 3B (KIF3B, Accession NM_004798), a gene which is a microtubule-based anterograde translocator for membranous organelles. Accordingly, utilities of VGAM1965 include diagnosis, prevention and treatment of diseases and clinical conditions associated with KIF3B. The function of KIF3B and its association with various diseases and clinical conditions, has been established by previous studies, as described hereinabove with reference to VGAM1017. Killer Cell Lectin-like Receptor Subfamily G, Member 1 (KLRG1, Accession NM_005810) is another VGAM1965 host target gene. KLRG1 BINDING SITE is HOST TARGET binding site found in the 3' untranslated region of mRNA encoded by KLRG1, corresponding to a HOST TARGET binding site such as BINDING SITE I, BINDING SITE II or BINDING SITE III. Table 2 illustrates the complementarity of the nucleotide sequences of KLRG1 BINDING SITE, designated SEQ ID:12393, to the nucleotide sequence of VGAM1965 RNA, herein designated VGAM RNA, also designated SEQ ID:4676.

Another function of VGAM1965 is therefore inhibition of Killer Cell Lectin-like Receptor Subfamily G, Member 1 (KLRG1, Accession NM_005810), a gene which plays a role in host defense. Accordingly, utilities of VGAM1965 include diagnosis, prevention and treatment of diseases and clinical conditions associated with KLRG1. The function of KLRG1 and its association with various diseases and clinical conditions, has been established by previous studies, as described hereinabove with reference to VGAM648. Lysosomal-associated Membrane Protein 2 (LAMP2, Accession NM_013995) is another VGAM1965 host target gene. LAMP2 BINDING SITE is HOST TARGET binding site found in the 3' untranslated region of mRNA encoded by LAMP2, corresponding to a HOST TARGET binding site such as BINDING SITE I, BINDING SITE II or BINDING SITE III. Table 2 illustrates the complementarity of the nucleotide sequences of LAMP2 BINDING SITE, designated SEQ ID:15187, to the nucleotide sequence of VGAM1965 RNA, herein designated VGAM RNA, also designated SEQ ID:4676.

Another function of VGAM1965 is therefore inhibition of Lysosomal-associated Membrane Protein 2 (LAMP2, Accession NM_013995). Accordingly, utilities of VGAM1965 include diagnosis, prevention and treatment of diseases and clinical conditions associated with LAMP2. Leptin (obesity homolog, mouse) (LEP, Accession NM_000230) is another VGAM1965 host target gene. LEP BINDING SITE is HOST TARGET binding site found in the 3' untranslated region of mRNA encoded by LEP, corresponding to a HOST TARGET binding site such as BINDING SITE I, BINDING SITE II or BINDING SITE III. Table 2 illustrates the complementarity of the nucleotide sequences of LEP BINDING SITE, designated SEQ ID:5741, to the nucleotide sequence of VGAM1965 RNA, herein designated VGAM RNA, also designated SEQ ID:4676.

Another function of VGAM1965 is therefore inhibition of Leptin (obesity homolog, mouse) (LEP, Accession NM_000230). Accordingly, utilities of VGAM1965 include diagnosis, prevention and treatment of diseases and clinical conditions associated with LEP. LIM Homeobox Protein 5 (LHX5, Accession NM_022363) is another VGAM1965 host target gene. LHX5 BINDING SITE is HOST TARGET binding site found in the 5' untranslated region of mRNA encoded by LHX5, corresponding to a HOST TARGET binding site such as BINDING SITE I, BINDING SITE II or BINDING SITE III. Table 2 illustrates the complementarity of the nucleotide sequences of LHX5 BINDING SITE, designated SEQ ID:22751, to the nucleotide sequence of VGAM1965 RNA, herein designated VGAM RNA, also designated SEQ ID:4676.

Another function of VGAM1965 is therefore inhibition of LIM Homeobox Protein 5 (LHX5, Accession NM_022363). Accordingly, utilities of VGAM1965 include diagnosis, prevention and treatment of diseases and clinical conditions associated with LHX5. Loss of Heterozygosity, 11, Chromosomal Region 2, Gene A (LOH11CR2A, Accession NM_014622) is another VGAM1965 host target gene. LOH11CR2A BINDING SITE1 and LOH11CR2A BINDING SITE2 are HOST TARGET binding sites found in untranslated regions of mRNA encoded by LOH11CR2A, corresponding to HOST TARGET binding sites such as BINDING SITE I, BINDING SITE II or BINDING SITE III. Table 2 illustrates the complementarity of the nucleotide sequences of LOH11CR2A BINDING SITE1 and LOH11CR2A BINDING SITE2, designated SEQ ID:15987 and SEQ ID:15991 respectively, to the nucleotide sequence of VGAM1965 RNA, herein designated VGAM RNA, also designated SEQ ID:4676.

Another function of VGAM1965 is therefore inhibition of Loss of Heterozygosity, 11, Chromosomal Region 2, Gene A (LOH11CR2A, Accession NM_014622). Accordingly, utilities of VGAM1965 include diagnosis, prevention and treatment of diseases and clinical conditions associated with LOH11CR2A. Low Density Lipoprotein-related Protein 1 (alpha-2-macroglobulin receptor) (LRP1, Accession NM_002332) is another VGAM1965 host target gene. LRP1 BINDING SITE is HOST TARGET binding site found in the 5' untranslated region of mRNA encoded by LRP1, corresponding to a HOST TARGET binding site such as BINDING SITE I, BINDING SITE II or BINDING SITE III. Table 2 illustrates the complementarity of the nucleotide sequences of LRP1 BINDING SITE, designated SEQ ID:8139, to the nucleotide sequence of VGAM1965 RNA, herein designated VGAM RNA, also designated SEQ ID:4676.

Another function of VGAM1965 is therefore inhibition of Low Density Lipoprotein-related Protein 1 (alpha-2-macroglobulin receptor) (LRP1, Accession NM_002332), a gene which is a recycling lipoprotein receptor with possible growth-modulating effects. Accordingly, utilities of VGAM1965 include diagnosis, prevention and treatment of diseases and clinical conditions associated with LRP1. The function of LRP1 and its association with various diseases and clinical conditions, has been established by previous studies, as described hereinabove with reference to VGAM885. Low Density Lipoprotein Receptor-related Protein 8, Apolipoprotein E Receptor (LRP8, Accession NM_033300) is another VGAM1965 host target gene. LRP8 BINDING SITE1 and LRP8 BINDING SITE2 are HOST TARGET binding sites found in untranslated regions of mRNA encoded by LRP8, corresponding to HOST TARGET binding sites such as BINDING SITE I, BINDING SITE II or BINDING SITE III. Table 2 illustrates the complementarity of the nucleotide sequences of LRP8 BINDING SITE1 and LRP8 BINDING SITE2, designated SEQ ID:27133 and SEQ ID:11009 respectively, to the nucleotide sequence of VGAM1965 RNA, herein designated VGAM RNA, also designated SEQ ID:4676.

Another function of VGAM1965 is therefore inhibition of Low Density Lipoprotein Receptor-related Protein 8, Apolipoprotein E Receptor (LRP8, Accession NM_033300), a gene which binds vldl and transports it into cells by endocytosis. Accordingly, utilities of VGAM1965 include diagnosis, prevention and treatment of diseases and clinical conditions associated with LRP8. The function of LRP8 and its association with various diseases and clinical conditions, has been established by previous studies, as described hereinabove with reference to VGAM191. Mitogen-activated Protein Kinase Kinase 1 (MAP2K1, Accession NM_002755) is another VGAM1965 host target gene. MAP2K1 BINDING SITE is HOST TARGET binding site found in the 3' untranslated region of mRNA encoded by MAP2K1, corresponding to a HOST TARGET binding site such as BINDING SITE I, BINDING SITE II or BINDING SITE III. Table 2 illustrates the complementarity of the nucleotide sequences of MAP2K1 BINDING SITE, designated SEQ ID:8633, to the nucleotide sequence of VGAM1965 RNA, herein designated VGAM RNA, also designated SEQ ID:4676.

Another function of VGAM1965 is therefore inhibition of Mitogen-activated Protein Kinase Kinase 1 (MAP2K1, Accession NM_002755), a gene which is a signaling intermediate, may take part in cell transformation. Accordingly, utilities of VGAM1965 include diagnosis, prevention and treatment of diseases and clinical conditions associated with MAP2K1. The function of MAP2K1 and its association with various diseases and clinical conditions, has been established by previous studies, as described hereinabove with reference to VGAM528. Mitogen-activated Protein Kinase Kinase Kinase 7 Interacting Protein 2 (MAP3K7IP2, Accession NM_015093) is another VGAM1965 host target gene. MAP3K7IP2 BINDING SITE is HOST TARGET binding site found in the 3' untranslated region of mRNA encoded by MAP3K7IP2, corresponding to a HOST TARGET binding site such as BINDING SITE I, BINDING SITE II or BINDING SITE III. Table 2 illustrates the complementarity of the nucleotide sequences of MAP3K7IP2 BINDING SITE, designated SEQ ID:17488, to the nucleotide sequence of VGAM1965 RNA, herein designated VGAM RNA, also designated SEQ ID:4676.

Another function of VGAM1965 is therefore inhibition of Mitogen-activated Protein Kinase Kinase Kinase 7 Interacting Protein 2 (MAP3K7IP2, Accession NM_015093). Accordingly, utilities of VGAM1965 include diagnosis, prevention and treatment of diseases and clinical conditions associated with MAP3K7IP2. Mannan-binding Lectin Serine Protease 1 (C4/C2 activating component of Ra-reactive factor) (MASP1, Accession NM_139125) is another VGAM1965 host target gene. MASP1 BINDING SITE is HOST TARGET binding site found in the 3' untranslated region of mRNA encoded by MASP1, corresponding to a HOST TARGET binding site such as BINDING SITE I, BINDING SITE II or BINDING SITE III. Table 2 illustrates the complementarity of the nucleotide sequences of MASP1 BINDING SITE, designated SEQ ID:29160, to the nucleotide sequence of VGAM1965 RNA, herein designated VGAM RNA, also designated SEQ ID:4676.

Another function of VGAM1965 is therefore inhibition of Mannan-binding Lectin Serine Protease 1 (C4/C2 activating component of Ra-reactive factor) (MASP1, Accession NM_139125), a gene which a complement-dependent bactericidal factor. Accordingly, utilities of VGAM1965 include diagnosis, prevention and treatment of diseases and clinical conditions associated with MASP1. The function of MASP1 and its association with various diseases and clinical conditions, has been established by previous studies, as described hereinabove with reference to VGAM566. Meis1, Myeloid Ecotropic Viral Integration Site 1 Homolog 2 (mouse) (MEIS2, Accession NM_020149) is another VGAM1965 host target gene. MEIS2 BINDING SITE is HOST TARGET binding site found in the 3' untranslated region of mRNA encoded by MEIS2, corresponding to a HOST TARGET binding site such as BINDING SITE I, BINDING SITE II or BINDING SITE III. Table 2 illustrates the complementarity of the nucleotide sequences of MEIS2 BINDING SITE, designated SEQ ID:21348, to the nucleotide sequence of VGAM1965 RNA, herein designated VGAM RNA, also designated SEQ ID:4676.

Another function of VGAM1965 is therefore inhibition of Meis1, Myeloid Ecotropic Viral Integration Site 1 Homolog 2 (mouse) (MEIS2, Accession NM_020149), a gene which may regulate gene expression and control cell differentiation. Accordingly, utilities of VGAM1965 include diagnosis, prevention and treatment of diseases and clinical conditions associated with MEIS2. The function of MEIS2 and its association with various diseases and clinical conditions, has been established by previous studies, as described hereinabove with reference to VGAM1244. Multiple Endocrine Neoplasia I (MEN1, Accession XM_167804) is another VGAM1965 host target gene. MEN1 BINDING SITE1 and MEN1 BINDING SITE2 are HOST TARGET binding sites found in untranslated regions of mRNA encoded by MEN1, corresponding to HOST TARGET binding sites such as BINDING SITE I, BINDING SITE II or BINDING SITE III. Table 2 illustrates the complementarity of the nucleotide sequences of MEN1 BINDING SITE1 and MEN1 BINDING SITE2, designated SEQ ID:44846 and SEQ ID:44847 respectively, to the nucleotide sequence of VGAM1965 RNA, herein designated VGAM RNA, also designated SEQ ID:4676.

Another function of VGAM1965 is therefore inhibition of Multiple Endocrine Neoplasia I (MEN1, Accession XM_167804). Accordingly, utilities of VGAM1965 include diagnosis, prevention and treatment of diseases and clinical conditions associated with MEN1. Mesenchyme Homeo Box 1 (MEOX1, Accession NM_004527) is another VGAM1965 host target gene. MEOX1 BINDING SITE1 and MEOX1 BINDING SITE2 are HOST TARGET binding sites found in untranslated regions of mRNA encoded by MEOX1, corresponding to HOST TARGET binding sites such as BINDING SITE I, BINDING SITE II or BINDING SITE III. Table 2 illustrates the complementarity of the nucleotide sequences of MEOX1 BINDING SITE1 and MEOX1 BINDING SITE2, designated SEQ ID:10865 and SEQ ID:23309 respectively, to the nucleotide sequence of VGAM1965 RNA, herein designated VGAM RNA, also designated SEQ ID:4676.

Another function of VGAM1965 is therefore inhibition of Mesenchyme Homeo Box 1 (MEOX1, Accession NM_004527), a gene which plays a role in mesoderm induction and isomitogenesis, and sclerotomal differentiation. Accordingly, utilities of VGAM1965 include diagnosis, prevention and treatment of diseases and clinical conditions associated with MEOX1. The function of MEOX1 and its association with various diseases and clinical conditions, has been established by previous studies, as described hereinabove with reference to VGAM1958. Maltase-glucoamylase (alpha-glucosidase) (MGAM, Accession XM_051351) is another VGAM1965 host target gene. MGAM BINDING SITE1 and MGAM BINDING SITE2 are HOST TARGET binding sites found in untranslated regions of mRNA encoded by MGAM, corresponding to HOST TARGET binding sites such as BINDING SITE I, BINDING SITE II or BINDING SITE III. Table 2 illustrates the complementarity of the nucleotide sequences of MGAM BINDING SITE1 and MGAM BINDING SITE2, designated SEQ ID:35825 and SEQ ID:35828 respectively, to the nucleotide sequence of VGAM1965 RNA, herein designated VGAM RNA, also designated SEQ ID:4676.

Another function of VGAM1965 is therefore inhibition of Maltase-glucoamylase (alpha-glucosidase) (MGAM, Accession XM_051351), a gene which plays a role in the final steps of digestion of starch. Accordingly, utilities of VGAM1965 include diagnosis, prevention and treatment of diseases and clinical conditions associated with MGAM. The function of MGAM and its association with various diseases and clinical conditions, has been established by previous studies, as described hereinabove with reference to VGAM791. Matrix Metalloproteinase 11 (stromelysin 3) (MMP11, Accession NM_005940) is another VGAM1965 host target gene. MMP11 BINDING SITE is HOST TARGET binding site found in the 3' untranslated region of mRNA encoded by MMP11, corresponding to a HOST TARGET binding site such as BINDING SITE I, BINDING SITE II or BINDING SITE III. Table 2 illustrates the complementarity of the nucleotide sequences of MMP11 BINDING SITE, designated SEQ ID:12579, to the nucleotide sequence of VGAM1965 RNA, herein designated VGAM RNA, also designated SEQ ID:4676.

Another function of VGAM1965 is therefore inhibition of Matrix Metalloproteinase 11 (stromelysin 3) (MMP11, Accession NM_005940). Accordingly, utilities of VGAM1965 include diagnosis, prevention and treatment of diseases and clinical conditions associated with MMP11. MAX Binding Protein (MNT, Accession NM_020310) is another VGAM1965 host target gene. MNT BINDING SITE is HOST TARGET binding site found in the 3" untranslated region of mRNA encoded by MNT, corresponding to a HOST TARGET binding site such as BINDING SITE I, BINDING SITE II or BINDING SITE III. Table 2 illustrates the complementarity of the nucleotide sequences of MNT BINDING SITE, designated SEQ ID:21568, to the nucleotide sequence of VGAM1965 RNA, herein designated VGAM RNA, also designated SEQ ID:4676.

Another function of VGAM1965 is therefore inhibition of MAX Binding Protein (MNT, Accession NM_020310). Accordingly, utilities of VGAM1965 include diagnosis, prevention and treatment of diseases and clinical conditions associated with MNT. Mucin 4, Tracheobronchial (MUC4, Accession NM_138298) is another VGAM1965 host target gene. MUC4 BINDING SITE is HOST TARGET binding site found in the 3' untranslated region of mRNA encoded by MUC4, corresponding to a HOST TARGET binding site such as BINDING SITE I, BINDING SITE II or BINDING SITE III. Table 2 illustrates the complementarity of the nucleotide sequences of MUC4 BINDING SITE, designated SEQ ID:28712, to the nucleotide sequence of VGAM1965 RNA, herein designated VGAM RNA, also designated SEQ ID:4676.

Another function of VGAM1965 is therefore inhibition of Mucin 4, Tracheobronchial (MUC4, Accession NM_138298), a gene which may act as a ligand for ErbB2 mediated cell signalling. Accordingly, utilities of VGAM1965 include diagnosis, prevention and treatment of diseases and clinical conditions associated with MUC4. The function of MUC4 and its association with various diseases and clinical conditions, has been established by previous studies, as described hereinabove with reference to VGAM1290. C-myc Binding Protein (MYCBP, Accession NM_012333) is another VGAM1965 host target gene. MYCBP BINDING SITE is HOST TARGET binding site found in the 3' untranslated region of mRNA encoded by MYCBP, corresponding to a HOST TARGET binding site such as BINDING SITE I, BINDING SITE II or BINDING SITE III. Table 2 illustrates the complementarity of the nucleotide sequences of MYCBP BINDING SITE, designated SEQ ID:14725, to the nucleotide sequence of VGAM1965 RNA, herein designated VGAM RNA, also designated SEQ ID:4676.

Another function of VGAM1965 is therefore inhibition of C-myc Binding Protein (MYCBP, Accession NM_012333), a gene which binds c-Myc stimulating the activation of E-box-dependent transcription. Accordingly, utilities of VGAM1965 include diagnosis, prevention and treatment of diseases and clinical conditions associated with MYCBP. The function of MYCBP and its association with various diseases and clinical conditions, has been established by previous studies, as described hereinabove with reference to VGAM435. N-ethylmaleimide-sensitive Factor Attachment Protein, Beta (NAPB, Accession XM_046652) is another VGAM1965 host target gene. NAPB BINDING SITE is HOST TARGET binding site found in the 3" untranslated region of mRNA encoded by NAPB, corresponding to a HOST TARGET binding site such as BINDING SITE I, BINDING SITE II or BINDING SITE III. Table 2 illustrates the complementarity of the nucleotide sequences of NAPB BINDING SITE, designated SEQ ID:34768, to the nucleotide sequence of VGAM1965 RNA, herein designated VGAM RNA, also designated SEQ ID:4676.

Another function of VGAM1965 is therefore inhibition of N-ethylmaleimide-sensitive Factor Attachment Protein, Beta (NAPB, Accession XM_046652). Accordingly, utilities of VGAM1965 include diagnosis, prevention and treatment of diseases and clinical conditions associated with NAPB. Neurocalcin Delta (NCALD, Accession NM_032041) is another VGAM1965 host target gene. NCALD BINDING SITE is HOST TARGET binding site found in the 3' untranslated region of mRNA encoded by NCALD, corresponding to a HOST TARGET binding site such as BINDING SITE I, BINDING SITE II or BINDING SITE III. Table 2 illustrates the complementarity of the nucleotide sequences of NCALD BINDING SITE, designated SEQ ID:25743, to the nucleotide sequence of VGAM1965 RNA, herein designated VGAM RNA, also designated SEQ ID:4676.

Another function of VGAM1965 is therefore inhibition of Neurocalcin Delta (NCALD, Accession NM_032041). Accordingly, utilities of VGAM1965 include diagnosis, prevention and treatment of diseases and clinical conditions associated with NCALD. NADH Dehydrogenase (ubiquinone) 1 Alpha Subcomplex, 6, 14 kDa (NDUFA6, Accession NM_002490) is another VGAM1965 host target gene. NDUFA6 BINDING SITE is HOST TARGET binding site found in the 3' untranslated region of mRNA encoded by NDUFA6, corresponding to a HOST TARGET binding site such as BINDING SITE I, BINDING SITE II or BINDING SITE III. Table 2 illustrates the complementarity of the nucleotide sequences of NDUFA6 BINDING SITE, designated SEQ ID:8313, to the nucleotide sequence of VGAM1965 RNA, herein designated VGAM RNA, also designated SEQ ID:4676.

Another function of VGAM1965 is therefore inhibition of NADH Dehydrogenase (ubiquinone) 1 Alpha Subcomplex, 6, 14 kDa (NDUFA6, Accession NM_002490), a gene which transfers electrons from nadh to the respiratory chain. Accordingly, utilities of VGAM1965 include diagnosis, prevention and treatment of diseases and clinical conditions associated with NDUFA6. The function of NDUFA6 has been established by previous studies. See NDUFA2 (OMIM Ref. No. 602137). Dunbar et al. (1997) mapped the NDUFA6 gene to 21q22 by fluorescence in situ hybridization (FISH). However, by intron-based radiation hybrid mapping, Emahazion and Brookes (1998) assigned the NDUFA6 gene to 22q13.1. They stated that subsequent mapping studies with subfragments of the FISH-mapped recombinants of Dunbar et al. (1997) suggested chimerism and confirmed that the earlier FISH data were flawed. Ton et al. (1997) isolated human heart cDNAs encoding CI-B14 (OMIM Ref. No. NDUFA6) and 4 other complex I subunits.

Full details of the abovementioned studies are described in the following publications, the disclosure of which are hereby incorporated by reference:

Dunbar, D. R.; Shibasaki, Y.; Dobbie, L.; Andersson, B.; Brookes, A. J.: In situ hybridisation mapping of genomic clones for five human respiratory chain complex I genes. Cytogenet. Cell Genet. 78:21-24, 1997; and Emahazion, T.; Brookes, A. J.: Mapping of the NDUFA2, NDUFA6, NDUFA7, NDUFB8, and NDUFS8 electron transport chain genes by intron based radiation hybrid mapping. Cytogenet. Cell Genet.

Further studies establishing the function and utilities of NDUFA6 are found in John Hopkins OMIM database record ID 602138, and in sited publications numbered 6283-6285 listed in the bibliography section hereinbelow, which are also hereby incorporated by reference. NEBL (Accession NM_006393) is another VGAM1965 host target gene. NEBL BINDING SITE is HOST TARGET binding site found in the 3' untranslated region of mRNA encoded by NEBL, corresponding to a HOST TARGET binding site such as BINDING SITE I, BINDING SITE II or BINDING SITE III. Table 2 illustrates the complementarity of the nucleotide sequences of NEBL BINDING SITE, designated SEQ ID:13097, to the nucleotide sequence of VGAM1965 RNA, herein designated VGAM RNA, also designated SEQ ID:4676.

Another function of VGAM1965 is therefore inhibition of NEBL (Accession NM_006393). Accordingly, utilities of VGAM1965 include diagnosis, prevention and treatment of diseases and clinical conditions associated with NEBL. Nuclear Factor I/A (NFIA, Accession XM_046827) is another VGAM1965 host target gene. NFIA BINDING SITE is HOST TARGET binding site found in the 3' untranslated region of mRNA encoded by NFIA, corresponding to a HOST TARGET binding site such as BINDING SITE I, BINDING SITE II or BINDING SITE III. Table 2 illustrates the complementarity of the nucleotide sequences of NFIA BINDING SITE, designated SEQ ID:34843, to the nucleotide sequence of VGAM1965 RNA, herein designated VGAM RNA, also designated SEQ ID:4676.

Another function of VGAM1965 is therefore inhibition of Nuclear Factor I/A (NFIA, Accession XM_046827). Accordingly, utilities of VGAM1965 include diagnosis, prevention and treatment of diseases and clinical conditions associated with NFIA. Neuro-oncological Ventral Antigen 1 (NOVA1, Accession NM_006489) is another VGAM1965 host target gene. NOVA1 BINDING SITE1 and NOVA1 BINDING SITE2 are HOST TARGET binding sites found in untranslated regions of mRNA encoded by NOVA1, corresponding to HOST TARGET binding sites such as BINDING SITE I, BINDING SITE II or BINDING SITE III. Table 2 illustrates the complementarity of the nucleotide sequences of NOVA1 BINDING SITE1 and NOVA1 BINDING SITE2, designated SEQ ID:13219 and SEQ ID:8350 respectively, to the nucleotide sequence of VGAM1965 RNA, herein designated VGAM RNA, also designated SEQ ID:4676.

Another function of VGAM1965 is therefore inhibition of Neuro-oncological Ventral Antigen 1 (NOVA1, Accession NM_006489), a gene which may regulate rna splicing or metabolism in a specific subset of developing neurons. Accordingly, utilities of VGAM1965 include diagnosis, prevention and treatment of diseases and clinical conditions associated with NOVA1. The function of NOVA1 and its association with various diseases and clinical conditions, has been established by previous studies, as described hereinabove with reference to VGAM521. Neuropeptide Y Receptor Y1 (NPY1R, Accession NM_000909) is another VGAM1965 host target gene. NPY1R BINDING SITE is HOST TARGET binding site found in the 5' untranslated region of mRNA encoded by NPY1R, corresponding to a HOST TARGET binding site such as BINDING SITE I, BINDING SITE II or BINDING SITE III. Table 2 illustrates the complementarity of the nucleotide sequences of NPY1R BINDING SITE, designated SEQ ID:6608, to the nucleotide sequence of VGAM1965 RNA, herein designated VGAM RNA, also designated SEQ ID:4676.

Another function of VGAM1965 is therefore inhibition of Neuropeptide Y Receptor Y1 (NPY1R, Accession NM_000909), a gene which stimulates intracellular calcium flux and signals through an inhibitory G-protein. Accordingly, utilities of VGAM1965 include diagnosis, prevention and treatment of diseases and clinical conditions associated with NPY1R. The function of NPY1R and its association with various diseases and clinical conditions, has been established by previous studies, as described hereinabove with reference to VGAM1588. Neuronal Cell Adhesion Molecule (NRCAM, Accession NM_005010) is another VGAM1965 host target gene. NRCAM BINDING SITE1 and NRCAM BINDING SITE2 are HOST TARGET binding sites found in untranslated regions of mRNA encoded by NRCAM, corresponding to HOST TARGET binding sites such as BINDING SITE I, BINDING SITE II or BINDING SITE III. Table 2 illustrates the complementarity of the nucleotide sequences of NRCAM BINDING SITE1 and NRCAM BINDING SITE2, designated SEQ ID:11453 and SEQ ID:11454 respectively, to the nucleotide sequence of VGAM1965 RNA, herein designated VGAM RNA, also designated SEQ ID:4676.

Another function of VGAM1965 is therefore inhibition of Neuronal Cell Adhesion Molecule (NRCAM, Accession NM_005010), a gene which functions as a cell surface protein and belongs to the immunoglobulin superfamily. Accordingly, utilities of VGAM1965 include diagnosis, prevention and treatment of diseases and clinical conditions associated with NRCAM. The function of NRCAM and its association with various diseases and clinical conditions, has been established by previous studies, as described hereinabove with reference to VGAM268. Nuclear Respiratory Factor 1 (NRF1, Accession XM_011548) is another VGAM1965 host target gene. NRF1 BINDING SITE1 and NRF1 BINDING SITE2 are HOST TARGET binding sites found in untranslated regions of mRNA encoded by NRF1, corresponding to HOST TARGET binding sites such as BINDING SITE I, BINDING SITE II or BINDING SITE III. Table 2 illustrates the complementarity of the nucleotide sequences of NRF1 BINDING SITE1 and NRF1 BINDING SITE2, designated SEQ ID:30190 and SEQ ID:8378 respectively, to the nucleotide sequence of VGAM1965 RNA, herein designated VGAM RNA, also designated SEQ ID:4676.

Another function of VGAM1965 is therefore inhibition of Nuclear Respiratory Factor 1 (NRF1, Accession XM_011548), a gene which is a basic leucine zipper (bZIP) transcriptional activator and involved in the regulation of genes for EIF2A and respiratory subunits. Accordingly, utilities of VGAM1965 include diagnosis, prevention and treatment of diseases and clinical conditions associated with NRF1. The function of NRF1 and its association with various diseases and clinical conditions, has been established by previous studies, as described hereinabove with reference to VGAM1314. Oxidative-stress Responsive 1 (OSR1, Accession NM_005109) is another VGAM1965 host target gene. OSR1 BINDING SITE is HOST TARGET binding site found in the 5' untranslated region of mRNA encoded by OSR1, corresponding to a HOST TARGET binding site such as BINDING SITE I, BINDING SITE II or BINDING SITE III. Table 2 illustrates the complementarity of the nucleotide sequences of OSR1 BINDING SITE, designated SEQ ID:11592, to the nucleotide sequence of VGAM1965 RNA, herein designated VGAM RNA, also designated SEQ ID:4676.

Another function of VGAM1965 is therefore inhibition of Oxidative-stress Responsive 1 (OSR1, Accession NM_005109), a gene which mediats stress-activated signals. Accordingly, utilities of VGAM1965 include diagnosis, prevention and treatment of diseases and clinical conditions associated with OSR1. The function of OSR1 and its association with various diseases and clinical conditions, has been established by previous studies, as described hereinabove with reference to VGAM538. Platelet-activating Factor Acetylhydrolase, Isoform Ib, Alpha Subunit 45 kDa (PAFAH1B1, Accession NM_000430) is another VGAM1965 host target gene. PAFAH1B1 BINDING SITE is HOST TARGET binding site found in the 3' untranslated region of mRNA encoded by PAFAH1B1, corresponding to a HOST TARGET binding site such as BINDING SITE I, BINDING SITE II or BINDING SITE III. Table 2 illustrates the complementarity of the nucleotide sequences of PAFAH1B1 BINDING SITE, designated SEQ ID:6014, to the nucleotide sequence of VGAM1965 RNA, herein designated VGAM RNA, also designated SEQ ID:4676.

Another function of VGAM1965 is therefore inhibition of Platelet-activating Factor Acetylhydrolase, Isoform Ib, Alpha Subunit 45 kDa (PAFAH1B1, Accession NM_000430). Accordingly, utilities of VGAM1965 include diagnosis, prevention and treatment of diseases and clinical conditions associated with PAFAH1B1. Paired Box Gene 5 (B-cell lineage specific activator protein) (PAX5, Accession NM_016734) is another VGAM1965 host target gene. PAX5 BINDING SITE is HOST TARGET binding site found in the 3' untranslated region of mRNA encoded by PAX5, corresponding to a HOST TARGET binding site such as BINDING SITE I, BINDING SITE II or BINDING SITE III. Table 2 illustrates the complementarity of the nucleotide sequences of PAX5 BINDING SITE, designated SEQ ID:18791, to the nucleotide sequence of VGAM1965 RNA, herein designated VGAM RNA, also designated SEQ ID:4676.

Another function of VGAM1965 is therefore inhibition of Paired Box Gene 5 (B-cell lineage specific activator protein) (PAX5, Accession NM_016734), a gene which plays a role in B-cell differentiation, neural development and spermatogenesis. Accordingly, utilities of VGAM1965 include diagnosis, prevention and treatment of diseases and clinical conditions associated with PAX5. The function of PAX5 and its association with various diseases and clinical conditions, has been established by previous studies, as described hereinabove with reference to VGAM1151. Protocadherin 11 X-linked (PCDH11X, Accession NM_032967) is another VGAM1965 host target gene. PCDH11X BINDING SITE is HOST TARGET binding site found in the 3' untranslated region of mRNA encoded by PCDH11X, corresponding to a HOST TARGET binding site such as BINDING SITE I, BINDING SITE II or BINDING SITE III. Table 2 illustrates the complementarity of the nucleotide sequences of PCDH11X BINDING SITE, designated SEQ ID:26782, to the nucleotide sequence of VGAM1965 RNA, herein designated VGAM RNA, also designated SEQ ID:4676.

Another function of VGAM1965 is therefore inhibition of Protocadherin 11 X-linked (PCDH11X, Accession NM_032967), a gene which is thought to play a fundamental role in cell-cell recognition essential for the segmental development and function of the central nervous system. Accordingly, utilities of VGAM1965 include diagnosis, prevention and treatment of diseases and clinical conditions associated with PCDH11X. The function of PCDH11X and its association with various diseases and clinical conditions, has been established by previous studies, as described hereinabove with reference to VGAM433. Phosphatidylcholine Transfer Protein (PCTP, Accession NM_021213) is another VGAM1965 host target gene. PCTP BINDING SITE is HOST TARGET binding site found in the 3' untranslated region of mRNA encoded by PCTP, corresponding to a HOST TARGET binding site such as BINDING SITE I, BINDING SITE II or BINDING SITE III. Table 2 illustrates the complementarity of the nucleotide sequences of PCTP BINDING SITE, designated SEQ ID:22194, to the nucleotide sequence of VGAM1965 RNA, herein designated VGAM RNA, also designated SEQ ID:4676.

Another function of VGAM1965 is therefore inhibition of Phosphatidylcholine Transfer Protein (PCTP, Accession NM_021213), a gene which catalyzes the transfer of phosphatidylcholine between membranes (by similarity). Accordingly, utilities of VGAM1965 include diagnosis, prevention and treatment of diseases and clinical conditions associated with PCTP. The function of PCTP and its association with various diseases and clinical conditions, has been established by previous studies, as described hereinabove with reference to VGAM1396. Phosphodiesterase 4C, CAMP-specific (phosphodiesterase E1 dunce homolog, Drosophila) (PDE4C, Accession NM_000923) is another VGAM1965 host target gene. PDE4C BINDING SITE is HOST TARGET binding site found in the 3' untranslated region of mRNA encoded by PDE4C, corresponding to a HOST TARGET binding site such as BINDING SITE I, BINDING SITE II or BINDING SITE III. Table 2 illustrates the complementarity of the nucleotide sequences of PDE4C BINDING SITE, designated SEQ ID:6635, to the nucleotide sequence of VGAM1965 RNA, herein designated VGAM RNA, also designated SEQ ID:4676.

Another function of VGAM1965 is therefore inhibition of Phosphodiesterase 4C, CAMP-specific (phosphodiesterase E1 dunce homolog, Drosophila) (PDE4C, Accession NM_000923), a gene which is a cAMP-specific phosphodiesterase and may be a protein involved in learning and memory. Accordingly, utilities of VGAM1965 include diagnosis, prevention and treatment of diseases and clinical conditions associated with PDE4C. The function of PDE4C has been established by previous studies. Milatovich et al. (1994) applied Southern analyses of somatic cell hybrid lines and of recombinant inbred mouse strains, as well as fluorescence chromosomal in situ hybridization (FISH), to map 4 'dunce-like' cAMP-specific nucleotide phosphodiesterase genes in human and mouse. DPDE1 (also symbolized PDE4C) was assigned to human chromosome 19 and mouse chromosome 8. DPDE2 (also symbolized PDE4A; 600126) was also assigned to human chromosome 19 but to mouse chromosome 9. DPDE3 (also symbolized PDE4D; 600129) was assigned to human 5q12 and mouse chromosome 13. DPDE4 (also symbolized PDE4B; 600127) was assigned to human 1p31 and mouse chromosome 4. By fluorescence in situ hybridization, Sullivan et al. (1999) localized the PDE4C gene to 19p13.1. They found that the PDE4C gene spans at least 38 kb, consists of at least 18 exons, and contains the marker D19S212 within an intron. Comparison of the published human PDE4C cDNA sequences with those of the genomic DNA identified 4 alternatively spliced exons and the possibility that the PDE4C locus contains at least 3 alternative promoters. The cosmids containing PDE4C also contained the genes for the growth regulatory transcription factor JUND (OMIM Ref. No. 165162), and the mini guanine nucleotide regulatory protein RAB3A (OMIM Ref. No. 179490). RAB3A was shown to consist of 5 exons spanning 7.9 kb, while the JUND gene was found to contain no introns. Analysis of cosmids containing PDE4C, JUND, and RAB3A showed that 27 kb separate JUND and PDE4C, while only 3.7 kb separate PDE4C and RAB3A. The 3 genes share the same orientation of transcription and are arranged in the 5-prime/3-prime order as follows: JUND--PDE4C--RAB3A--tel.

Full details of the abovementioned studies are described in the following publications, the disclosure of which are hereby incorporated by reference:

Milatovich, A.; Bolger, G.; Michaeli, T.; Francke, U.: Chromosome localizations of genes for five cAMP-specific phosphodiesterases in man and mouse. Somat. Cell Molec. Genet. 20:75-86, 1994; and Sullivan, M.; Olsen, A. S.; Houslay, M. D.: Genomic organisation of the human cyclic AMP-specific phosphodiesterase PDE4C gene and its chromosomal localisation to 19p13.1, between RAB3A.

Further studies establishing the function and utilities of PDE4C are found in John Hopkins OMIM database record ID 600128, and in sited publications numbered 488 and 12445 listed in the bibliography section hereinbelow, which are also hereby incorporated by reference. Platelet-derived Growth Factor Receptor, Beta Polypeptide (PDGFRB, Accession XM_038350) is another VGAM1965 host target gene. PDGFRB BINDING SITE is HOST TARGET binding site found in the 3" untranslated region of mRNA encoded by PDGFRB, corresponding to a HOST TARGET binding site such as BINDING SITE I, BINDING SITE II or BINDING SITE III. Table 2 illustrates the complementarity of the nucleotide sequences of PDGFRB BINDING SITE, designated SEQ ID:32817, to the nucleotide sequence of VGAM1965 RNA, herein designated VGAM RNA, also designated SEQ ID:4676.

Another function of VGAM1965 is therefore inhibition of Platelet-derived Growth Factor Receptor, Beta Polypeptide (PDGFRB, Accession XM_038350), a gene which Platelet-derived growth factor receptor beta chain; tyrosine kinase receptor. Accordingly, utilities of VGAM1965 include diagnosis, prevention and treatment of diseases and clinical conditions associated with PDGFRB. The function of PDGFRB and its association with various diseases and clinical conditions, has been established by previous studies, as described hereinabove with reference to VGAM125. Phospholipase A2, Group IID (PLA2G2D, Accession NM_012400) is another VGAM1965 host target gene. PLA2G2D BINDING SITE is HOST TARGET binding site found in the 3' untranslated region of mRNA encoded by PLA2G2D, corresponding to a HOST TARGET binding site such as BINDING SITE I, BINDING SITE II or BINDING SITE III. Table 2 illustrates the complementarity of the nucleotide sequences of PLA2G2D BINDING SITE, designated SEQ ID:14774, to the nucleotide sequence of VGAM1965 RNA, herein designated VGAM RNA, also designated SEQ ID:4676.

Another function of VGAM1965 is therefore inhibition of Phospholipase A2, Group IID (PLA2G2D, Accession NM_012400), a gene which is involved in phospholipid digestion, remodeling of cell membranes, and host defense, as well as pathophysiologic processes. Accordingly, utilities of VGAM1965 include diagnosis, prevention and treatment of diseases and clinical conditions associated with PLA2G2D. The function of PLA2G2D and its association with various diseases and clinical conditions, has been established by previous studies, as described hereinabove with reference to VGAM74. PPAR Binding Protein (PPARBP, Accession NM_004774) is another VGAM1965 host target gene. PPARBP BINDING SITE is HOST TARGET binding site found in the 3' untranslated region of mRNA encoded by PPARBP, corresponding to a HOST TARGET binding site such as BINDING SITE I, BINDING SITE II or BINDING SITE III. Table 2 illustrates the complementarity of the nucleotide sequences of PPARBP BINDING SITE, designated SEQ ID:11164, to the nucleotide sequence of VGAM1965 RNA, herein designated VGAM RNA, also designated SEQ ID:4676.

Another function of VGAM1965 is therefore inhibition of PPAR Binding Protein (PPARBP, Accession NM_004774), a gene which interacts with thyroid hormone receptors to regulate nuclear receptor-mediated transcription; binds dna and p53 protein. Accordingly, utilities of VGAM1965 include diagnosis, prevention and treatment of diseases and clinical conditions associated with PPARBP. The function of PPARBP has been established by previous studies. By immunoscreening a human B-lymphoma cell cDNA expression library with the anti-p53 (see OMIM Ref. No. TP53; 191170) monoclonal antibody PAb1801, Drane et al. (1997) identified PPARBP, which they called RB18A for 'recognized by PAb1801 monoclonal antibody.' The predicted 1,566-amino acid RB18A protein contains several potential nuclear localization signals, 13 potential N-glycosylation sites, and a high number of potential phosphorylation sites. Despite sharing common antigenic determinants with p53, RB18A does not show significant nucleotide or amino acid sequence similarity with p53. Whereas the calculated molecular mass of RB18A is 166 kD, the apparent mass of recombinant RB18A was 205 kD by SDS-PAGE analysis. Drane et al. (1997) demonstrated that RB18A shares functional properties with p53, including DNA binding, p53 binding, and self-oligomerization. Furthermore, RB18A was able to activate the sequence-specific binding of p53 to DNA, which was induced through an unstable interaction between both proteins. Northern blot analysis of human tissues detected an 8.5-kb RB18A transcript in all tissues examined except kidney, with highest expression in heart. Animal model experiments lend further support to the function of PPARBP. Ito et al. (2000) generated mouse mutants with targeted disruption of the Trap220 gene. The null mutants died during an early gestational stage with heart failure and exhibited impaired neuronal development with extensive apoptosis. Primary embryonic fibroblasts derived from null mutants showed impaired cell cycle regulation and a prominent decrease of thyroid hormone receptor (see OMIM Ref. No. 190160) function that was restored by ectopic Trap220; no defect in activation by Gal4-RARA, Gal4-RXRA, p53, or Gal4-VP16 (see OMIM Ref. No. 300019) was detected. Haploinsufficient mice showed growth retardation, pituitary hypothyroidism, and widely impaired transcription in certain organs. The results indicated that TRAP220 is essential for a wide range of physiologic processes and that it also has gene- and activator-selective functions.

It is appreciated that the abovementioned animal model for PPARBP is acknowledged by those skilled in the art as a scientifically valid animal model, as can be further appreciated from the publications sited hereinbelow.

Full details of the abovementioned studies are described in the following publications, the disclosure of which are hereby incorporated by reference:

Drane, P.; Barel, M.; Balbo, M.; Frade, R.: Identification of RB18A, a 205 kDa new p53 regulatory protein which shares antigenic and functional properties with p53. Oncogene 15:3013-3024, 1997; and Ito, M.; Yuan, C.-X.; Okano, H. J.; Darnell, R. B.; Roeder, R. G.: Involvement of the TRAP220 component of the TRAP/SMCC coactivator complex in embryonic development and thyroid hormone.

Further studies establishing the function and utilities of PPARBP are found in John Hopkins OMIM database record ID 604311, and in sited publications numbered 7006, 635 and 6199-4761 listed in the bibliography section hereinbelow, which are also hereby incorporated by reference. Protein Phosphatase 2A, Regulatory Subunit B' (PR 53) (PPP2R4, Accession XM_026944) is another VGAM1965 host target gene. PPP2R4 BINDING SITE is HOST TARGET binding site found in the 3' untranslated region of mRNA encoded by PPP2R4, corresponding to a HOST TARGET binding site such as BINDING SITE I, BINDING SITE II or BINDING SITE III. Table 2 illustrates the complementarity of the nucleotide sequences of PPP2R4 BINDING SITE, designated SEQ ID:30377, to the nucleotide sequence of VGAM1965 RNA, herein designated VGAM RNA, also designated SEQ ID:4676.

Another function of VGAM1965 is therefore inhibition of Protein Phosphatase 2A, Regulatory Subunit B' (PR 53) (PPP2R4, Accession XM_026944), a gene which is a regulatory subunit of protein phosphatase 2A. Accordingly, utilities of VGAM1965 include diagnosis, prevention and treatment of diseases and clinical conditions associated with PPP2R4. The function of PPP2R4 and its association with various diseases and clinical conditions, has been established by previous studies, as described hereinabove with reference to VGAM435. Protein Phosphatase 2, Regulatory Subunit B (B56), Alpha Isoform (PPP2R5A, Accession NM_006243) is another VGAM1965 host target gene. PPP2R5A BINDING SITE is HOST TARGET binding site found in the 3' untranslated region of mRNA encoded by PPP2R5A, corresponding to a HOST TARGET binding site such as BINDING SITE I, BINDING SITE II or BINDING SITE III. Table 2 illustrates the complementarity of the nucleotide sequences of PPP2R5A BINDING SITE, designated SEQ ID:12912, to the nucleotide sequence of VGAM1965 RNA, herein designated VGAM RNA, also designated SEQ ID:4676.

Another function of VGAM1965 is therefore inhibition of Protein Phosphatase 2, Regulatory Subunit B (B56), Alpha Isoform (PPP2R5A, Accession NM_006243), a gene which is a regulatory subunit of protein phosphatase 2A. Accordingly, utilities of VGAM1965 include diagnosis, prevention and treatment of diseases and clinical conditions associated with PPP2R5A. The function of PPP2R5A and its association with various diseases and clinical conditions, has been established by previous studies, as described hereinabove with reference to VGAM675. Protein Phosphatase 2, Regulatory Subunit B (B56), Epsilon Isoform (PPP2R5E, Accession NM_006246) is another VGAM1965 host target gene. PPP2R5E BINDING SITE is HOST TARGET binding site found in the 3' untranslated region of mRNA encoded by PPP2R5E, corresponding to a HOST TARGET binding site such as BINDING SITE I, BINDING SITE II or BINDING SITE III. Table 2 illustrates the complementarity of the nucleotide sequences of PPP2R5E BINDING SITE, designated SEQ ID:12923, to the nucleotide sequence of VGAM1965 RNA, herein designated VGAM RNA, also designated SEQ ID:4676.

Another function of VGAM1965 is therefore inhibition of Protein Phosphatase 2, Regulatory Subunit B (B56), Epsilon Isoform (PPP2R5E, Accession NM_006246), a gene which is a regulatory subunit of protein phosphatase 2A. Accordingly, utilities of VGAM1965 include diagnosis, prevention and treatment of diseases and clinical conditions associated with PPP2R5E. The function of PPP2R5E and its association with various diseases and clinical conditions, has been established by previous studies, as described hereinabove with reference to VGAM302. PR Domain Containing 2, with ZNF Domain (PRDM2, Accession NM_015866) is another VGAM1965 host target gene. PRDM2 BINDING SITE is HOST TARGET binding site found in the 3' untranslated region of mRNA encoded by PRDM2, corresponding to a HOST TARGET binding site such as BINDING SITE I, BINDING SITE II or BINDING SITE III. Table 2 illustrates the complementarity of the nucleotide sequences of PRDM2 BINDING SITE, designated SEQ ID:18004, to the nucleotide sequence of VGAM1965 RNA, herein designated VGAM RNA, also designated SEQ ID:4676.

Another function of VGAM1965 is therefore inhibition of PR Domain Containing 2, with ZNF Domain (PRDM2, Accession NM_015866), a gene which plays a role in transcriptional regulation during neuronal differentiation and pathogenesis of retinoblastoma. Accordingly, utilities of VGAM1965 include diagnosis, prevention and treatment of diseases and clinical conditions associated with PRDM2. The function of PRDM2 and its association with various diseases and clinical conditions, has been established by previous studies, as described hereinabove with reference to VGAM120. Protein Kinase, AMP-activated, Beta 1 Non-catalytic Subunit (PRKAB1, Accession NM_006253) is another VGAM1965 host target gene. PRKAB1 BINDING SITE is HOST TARGET binding site found in the 3' untranslated region of mRNA encoded by PRKAB1, corresponding to a HOST TARGET binding site such as BINDING SITE I, BINDING SITE II or BINDING SITE III. Table 2 illustrates the complementarity of the nucleotide sequences of PRKAB1 BINDING SITE, designated SEQ ID:12931, to the nucleotide sequence of VGAM1965 RNA, herein designated VGAM RNA, also designated SEQ ID:4676.

Another function of VGAM1965 is therefore inhibition of Protein Kinase, AMP-activated, Beta 1 Non-catalytic Subunit (PRKAB1, Accession NM_006253), a gene which is responsible for the regulation of fatty acid synthesis by phosphorylation of acetyl-coa carboxylase. Accordingly, utilities of VGAM1965 include diagnosis, prevention and treatment of diseases and clinical conditions associated with PRKAB1. The function of PRKAB1 and its association with various diseases and clinical conditions, has been established by previous studies, as described hereinabove with reference to VGAM1384. Protein S (alpha) (PROS1, Accession XM_113400) is another VGAM1965 host target gene. PROS1 BINDING SITE is HOST TARGET binding site found in the 3' untranslated region of mRNA encoded by PROS1, corresponding to a HOST TARGET binding site such as BINDING SITE I, BINDING SITE II or BINDING SITE III. Table 2 illustrates the complementarity of the nucleotide sequences of PROS1 BINDING SITE, designated SEQ ID:42256, to the nucleotide sequence of VGAM1965 RNA, herein designated VGAM RNA, also designated SEQ ID:4676.

Another function of VGAM1965 is therefore inhibition of Protein S (alpha) (PROS1, Accession XM_113400). Accordingly, utilities of VGAM1965 include diagnosis, prevention and treatment of diseases and clinical conditions associated with PROS1. Periaxin (PRX, Accession NM_020956) is another VGAM1965 host target gene. PRX BINDING SITE1 and PRX BINDING SITE2 are HOST TARGET binding sites found in untranslated regions of mRNA encoded by PRX, corresponding to HOST TARGET binding sites such as BINDING SITE I, BINDING SITE II or BINDING SITE III. Table 2 illustrates the complementarity of the nucleotide sequences of PRX BINDING SITE1 and PRX BINDING SITE2, designated SEQ ID:21932 and SEQ ID:21938 respectively, to the nucleotide sequence of VGAM1965 RNA, herein designated VGAM RNA, also designated SEQ ID:4676.

Another function of VGAM1965 is therefore inhibition of Periaxin (PRX, Accession NM_020956), a gene which seems to be required for maintenance of peripheral nerve myelin sheath. may have a role in axon-glial interactions, possibly by interacting with the cytoplasmic domains of integral membrane proteins such as myelin-associated glycoprotein in the periaxonal regions of the schwann cell plasma membrane. may have a role in the early phases of myelin deposition. Accordingly, utilities of VGAM1965 include diagnosis, prevention and treatment of diseases and clinical conditions associated with PRX. The function of PRX and its association with various diseases and clinical conditions, has been established by previous studies, as described hereinabove with reference to VGAM476. Pituitary Tumor-transforming 1 Interacting Protein (PTTG1IP, Accession NM_004339) is another VGAM1965 host target gene. PTTG1IP BINDING SITE is HOST TARGET binding site found in the 3' untranslated region of mRNA encoded by PTTG1IP, corresponding to a HOST TARGET binding site such as BINDING SITE I, BINDING SITE II or BINDING SITE III. Table 2 illustrates the complementarity of the nucleotide sequences of PTTG1IP BINDING SITE, designated SEQ ID:10538, to the nucleotide sequence of VGAM1965 RNA, herein designated VGAM RNA, also designated SEQ ID:4676.

Another function of VGAM1965 is therefore inhibition of Pituitary Tumor-transforming 1 Interacting Protein (PTTG1IP, Accession NM_004339), a gene which facilitates the translocation of PTTG to the nucleus. Accordingly, utilities of VGAM1965 include diagnosis, prevention and treatment of diseases and clinical conditions associated with PTTG1IP. The function of PTTG1IP and its association with various diseases and clinical conditions, has been established by previous studies, as described hereinabove with reference to VGAM131. Pumilio Homolog 2 (Drosophila) (PUM2, Accession NM_015317) is another VGAM1965 host target gene. PUM2 BINDING SITE is HOST TARGET binding site found in the 3' untranslated region of mRNA encoded by PUM2, corresponding to a HOST TARGET binding site such as BINDING SITE I, BINDING SITE II or BINDING SITE III. Table 2 illustrates the complementarity of the nucleotide sequences of PUM2 BINDING SITE, designated SEQ ID:17635, to the nucleotide sequence of VGAM1965 RNA, herein designated VGAM RNA, also designated SEQ ID:4676.

Another function of VGAM1965 is therefore inhibition of Pumilio Homolog 2 (Drosophila) (PUM2, Accession NM_015317). Accordingly, utilities of VGAM1965 include diagnosis, prevention and treatment of diseases and clinical conditions associated with PUM2. RAB5B, Member RAS Oncogene Family (RAB5B, Accession NM_002868) is another VGAM1965 host target gene. RAB5B BINDING SITE is HOST TARGET binding site found in the 3' untranslated region of mRNA encoded by RAB5B, corresponding to a HOST TARGET binding site such as BINDING SITE I, BINDING SITE II or BINDING SITE III. Table 2 illustrates the complementarity of the nucleotide sequences of RAB5B BINDING SITE, designated SEQ ID:8774, to the nucleotide sequence of VGAM1965 RNA, herein designated VGAM RNA, also designated SEQ ID:4676.

Another function of VGAM1965 is therefore inhibition of RAB5B, Member RAS Oncogene Family (RAB5B, Accession NM_002868), a gene which is presumably involved in vesicular trafficking at the plasma membrane. Accordingly, utilities of VGAM1965 include diagnosis, prevention and treatment of diseases and clinical conditions associated with RAB5B. The function of RAB5B and its association with various diseases and clinical conditions, has been established by previous studies, as described hereinabove with reference to VGAM1237. RAD54B (Accession NM_134434) is another VGAM1965 host target gene. RAD54B BINDING SITE is HOST TARGET binding site found in the 3' untranslated region of mRNA encoded by RAD54B, corresponding to a HOST TARGET binding site such as BINDING SITE I, BINDING SITE II or BINDING SITE III. Table 2 illustrates the complementarity of the nucleotide sequences of RAD54B BINDING SITE, designated SEQ ID:28679, to the nucleotide sequence of VGAM1965 RNA, herein designated VGAM RNA, also designated SEQ ID:4676.

Another function of VGAM1965 is therefore inhibition of RAD54B (Accession NM_134434), a gene which is involved in dna repair and mitotic recombination. Accordingly, utilities of VGAM1965 include diagnosis, prevention and treatment of diseases and clinical conditions associated with RAD54B. The function of RAD54B and its association with various diseases and clinical conditions, has been established by previous studies, as described hereinabove with reference to VGAM595. RalA Binding Protein 1 (RALBP1, Accession NM_006788) is another VGAM1965 host target gene. RALBP1 BINDING SITE is HOST TARGET binding site found in the 3' untranslated region of mRNA encoded by RALBP1, corresponding to a HOST TARGET binding site such as BINDING SITE I, BINDING SITE II or BINDING SITE III. Table 2 illustrates the complementarity of the nucleotide sequences of RALBP1 BINDING SITE, designated SEQ ID:13667, to the nucleotide sequence of VGAM1965 RNA, herein designated VGAM RNA, also designated SEQ ID:4676.

Another function of VGAM1965 is therefore inhibition of RalA Binding Protein 1 (RALBP1, Accession NM_006788), a gene which plays a role in signal transduction and catalyzes the transport of glutathione conjugates and xenobiotics. Accordingly, utilities of VGAM1965 include diagnosis, prevention and treatment of diseases and clinical conditions associated with RALBP1. The function of RALBP1 and its association with various diseases and clinical conditions, has been established by previous studies, as described hereinabove with reference to VGAM345. RAN Binding Protein 2-like 1 (RANBP2L1, Accession NM_005054) is another VGAM1965 host target gene. RANBP2L1 BINDING SITE is HOST TARGET binding site found in the 3" untranslated region of mRNA encoded by RANBP2L1, corresponding to a HOST TARGET binding site such as BINDING SITE I, BINDING SITE II or BINDING SITE III. Table 2 illustrates the complementarity of the nucleotide sequences of RANBP2L1 BINDING SITE, designated SEQ ID:11483, to the nucleotide sequence of VGAM1965 RNA, herein designated VGAM RNA, also designated SEQ ID:4676.

Another function of VGAM1965 is therefore inhibition of RAN Binding Protein 2-like 1 (RANBP2L1, Accession NM_005054). Accordingly, utilities of VGAM1965 include diagnosis, prevention and treatment of diseases and clinical conditions associated with RANBP2L1. RGL (Accession NM_015149) is another VGAM1965 host target gene. RGL BINDING SITE is HOST TARGET binding site found in the 3' untranslated region of mRNA encoded by RGL, corresponding to a HOST TARGET binding site such as BINDING SITE I, BINDING SITE II or BINDING SITE III. Table 2 illustrates the complementarity of the nucleotide sequences of RGL BINDING SITE, designated SEQ ID:17509, to the nucleotide sequence of VGAM1965 RNA, herein designated VGAM RNA, also designated SEQ ID:4676.

Another function of VGAM1965 is therefore inhibition of RGL (Accession NM_015149), a gene which is involved in nucleotide exchange factor. Accordingly, utilities of VGAM1965 include diagnosis, prevention and treatment of diseases and clinical conditions associated with RGL. The function of RGL and its association with various diseases and clinical conditions, has been established by previous studies, as described hereinabove with reference to VGAM861. Arginyl Aminopeptidase (aminopeptidase B)-like 1 (RNPEPL1, Accession NM_018226) is another VGAM1965 host target gene. RNPEPL1 BINDING SITE is HOST TARGET binding site found in the 3' untranslated region of mRNA encoded by RNPEPL1, corresponding to a HOST TARGET binding site such as BINDING SITE I, BINDING SITE II or BINDING SITE III. Table 2 illustrates the complementarity of the nucleotide sequences of RNPEPL1 BINDING SITE, designated SEQ ID:20162, to the nucleotide sequence of VGAM1965 RNA, herein designated VGAM RNA, also designated SEQ ID:4676.

Another function of VGAM1965 is therefore inhibition of Arginyl Aminopeptidase (aminopeptidase B)-like 1 (RNPEPL1, Accession NM_018226). Accordingly, utilities of VGAM1965 include diagnosis, prevention and treatment of diseases and clinical conditions associated with RNPEPL1. Ribonucleotide Reductase M2 B (TP53 inducible) (RRM2B, Accession XM_042096) is another VGAM1965 host target gene. RRM2B BINDING SITE is HOST TARGET binding site found in the 3' untranslated region of mRNA encoded by RRM2B, corresponding to a HOST TARGET binding site such as BINDING SITE I, BINDING SITE II or BINDING SITE III. Table 2 illustrates the complementarity of the nucleotide sequences of RRM2B BINDING SITE, designated SEQ ID:33688, to the nucleotide sequence of VGAM1965 RNA, herein designated VGAM RNA, also designated SEQ ID:4676.

Another function of VGAM1965 is therefore inhibition of Ribonucleotide Reductase M2 B (TP53 inducible) (RRM2B, Accession XM_042096). Accordingly, utilities of VGAM1965 include diagnosis, prevention and treatment of diseases and clinical conditions associated with RRM2B. Retinoid X Receptor, Alpha (RXRA, Accession NM_002957) is another VGAM1965 host target gene. RXRA BINDING SITE is HOST TARGET binding site found in the 3' untranslated region of mRNA encoded by RXRA, corresponding to a HOST TARGET binding site such as BINDING SITE I, BINDING SITE II or BINDING SITE III. Table 2 illustrates the complementarity of the nucleotide sequences of RXRA BINDING SITE, designated SEQ ID:8872, to the nucleotide sequence of VGAM1965 RNA, herein designated VGAM RNA, also designated SEQ ID:4676.

Another function of VGAM1965 is therefore inhibition of Retinoid X Receptor, Alpha (RXRA, Accession NM_002957), a gene which activates genes required for vitamin A metabolism, binds 9-cis retinoic acid. Accordingly, utilities of VGAM1965 include diagnosis, prevention and treatment of diseases and clinical conditions associated with RXRA. The function of RXRA and its association with various diseases and clinical conditions, has been established by previous studies, as described hereinabove with reference to VGAM349. Spastic Ataxia of Charlevoix-Saguenay (sacsin) (SACS, Accession XM_170738) is another VGAM1965 host target gene. SACS BINDING SITE is HOST TARGET binding site found in the 3' untranslated region of mRNA encoded by SACS, corresponding to a HOST TARGET binding site such as BINDING SITE I, BINDING SITE II or BINDING SITE III. Table 2 illustrates the complementarity of the nucleotide sequences of SACS BINDING SITE, designated SEQ ID:45496, to the nucleotide sequence of VGAM1965 RNA, herein designated VGAM RNA, also designated SEQ ID:4676.

Another function of VGAM1965 is therefore inhibition of Spastic Ataxia of Charlevoix-Saguenay (sacsin) (SACS, Accession XM_170738). Accordingly, utilities of VGAM1965 include diagnosis, prevention and treatment of diseases and clinical conditions associated with SACS. Src Family Associated Phosphoprotein 2 (SCAP2, Accession NM_003930) is another VGAM1965 host target gene. SCAP2 BINDING SITE is HOST TARGET binding site found in the 3' untranslated region of mRNA encoded by SCAP2, corresponding to a HOST TARGET binding site such as BINDING SITE I, BINDING SITE II or BINDING SITE III. Table 2 illustrates the complementarity of the nucleotide sequences of SCAP2 BINDING SITE, designated SEQ ID:10027, to the nucleotide sequence of VGAM1965 RNA, herein designated VGAM RNA, also designated SEQ ID:4676.

Another function of VGAM1965 is therefore inhibition of Src Family Associated Phosphoprotein 2 (SCAP2, Accession NM_003930), a gene which interacts with Src family protein tyrosine kinases and SLAP/FYB (SLA). Accordingly, utilities of VGAM1965 include diagnosis, prevention and treatment of diseases and clinical conditions associated with SCAP2. The function of SCAP2 and its association with various diseases and clinical conditions, has been established by previous studies, as described hereinabove with reference to VGAM134. Sodium Channel, Voltage-gated, Type I, Alpha Polypeptide (SCN1A, Accession XM_114281) is another VGAM1965 host target gene. SCN1A BINDING SITE is HOST TARGET binding site found in the 3' untranslated region of mRNA encoded by SCN1A, corresponding to a HOST TARGET binding site such as BINDING SITE I, BINDING SITE II or BINDING SITE III. Table 2 illustrates the complementarity of the nucleotide sequences of SCN1A BINDING SITE, designated SEQ ID:42836, to the nucleotide sequence of VGAM1965 RNA, herein designated VGAM RNA, also designated SEQ ID:4676.

Another function of VGAM1965 is therefore inhibition of Sodium Channel, Voltage-gated, Type I, Alpha Polypeptide (SCN1A, Accession XM_114281). Accordingly, utilities of VGAM1965 include diagnosis, prevention and treatment of diseases and clinical conditions associated with SCN1A. Succinate Dehydrogenase Complex, Subunit D, Integral Membrane Protein (SDHD, Accession NM_003002) is another VGAM1965 host target gene. SDHD BINDING SITE is HOST TARGET binding site found in the 3' untranslated region of mRNA encoded by SDHD, corresponding to a HOST TARGET binding site such as BINDING SITE I, BINDING SITE II or BINDING SITE III. Table 2 illustrates the complementarity of the nucleotide sequences of SDHD BINDING SITE, designated SEQ ID:8897, to the nucleotide sequence of VGAM1965 RNA, herein designated VGAM RNA, also designated SEQ ID:4676.

Another function of VGAM1965 is therefore inhibition of Succinate Dehydrogenase Complex, Subunit D, Integral Membrane Protein (SDHD, Accession NM_003002). Accordingly, utilities of VGAM1965 include diagnosis, prevention and treatment of diseases and clinical conditions associated with SDHD. Spondyloepiphyseal Dysplasia, Late (SEDL, Accession NM_014563) is another VGAM1965 host target gene. SEDL BINDING SITE is HOST TARGET binding site found in the 3' untranslated region of mRNA encoded by SEDL, corresponding to a HOST TARGET binding site such as BINDING SITE I, BINDING SITE II or BINDING SITE III. Table 2 illustrates the complementarity of the nucleotide sequences of SEDL BINDING SITE, designated SEQ ID:15917, to the nucleotide sequence of VGAM1965 RNA, herein designated VGAM RNA, also designated SEQ ID:4676.

Another function of VGAM1965 is therefore inhibition of Spondyloepiphyseal Dysplasia, Late (SEDL, Accession NM_014563), a gene which may play role in vesicular transport from endoplasmic reticulum to golgi. Accordingly, utilities of VGAM1965 include diagnosis, prevention and treatment of diseases and clinical conditions associated with SEDL. The function of SEDL and its association with various diseases and clinical conditions, has been established by previous studies, as described hereinabove with reference to VGAM74. Surfactant, Pulmonary-associated Protein A2 (SFTPA2, Accession NM_006926) is another VGAM1965 host target gene. SFTPA2 BINDING SITE is HOST TARGET binding site found in the 3' untranslated region of mRNA encoded by SFTPA2, corresponding to a HOST TARGET binding site such as BINDING SITE I, BINDING SITE II or BINDING SITE III. Table 2 illustrates the complementarity of the nucleotide sequences of SFTPA2 BINDING SITE, designated SEQ ID:13811, to the nucleotide sequence of VGAM1965 RNA, herein designated VGAM RNA, also designated SEQ ID:4676.

Another function of VGAM1965 is therefore inhibition of Surfactant, Pulmonary-associated Protein A2 (SFTPA2, Accession NM_006926), a gene which plays a role in innate host defense in the lung. Accordingly, utilities of VGAM1965 include diagnosis, prevention and treatment of diseases and clinical conditions associated with SFTPA2. The function of SFTPA2 and its association with various diseases and clinical conditions, has been established by previous studies, as described hereinabove with reference to VGAM148. Serine Hydroxymethyltransferase 2 (mitochondrial) (SHMT2, Accession NM_005412) is another VGAM1965 host target gene. SHMT2 BINDING SITE is HOST TARGET binding site found in the 3' untranslated region of mRNA encoded by SHMT2, corresponding to a HOST TARGET binding site such as BINDING SITE I, BINDING SITE II or BINDING SITE III. Table 2 illustrates the complementarity of the nucleotide sequences of SHMT2 BINDING SITE, designated SEQ ID:11881, to the nucleotide sequence of VGAM1965 RNA, herein designated VGAM RNA, also designated SEQ ID:4676.

Another function of VGAM1965 is therefore inhibition of Serine Hydroxymethyltransferase 2 (mitochondrial) (SHMT2, Accession NM_005412), a gene which interconverts serine and glycine. Accordingly, utilities of VGAM1965 include diagnosis, prevention and treatment of diseases and clinical conditions associated with SHMT2. The function of SHMT2 and its association with various diseases and clinical conditions, has been established by previous studies, as described hereinabove with reference to VGAM152. Single-minded Homolog 2 (Drosophila) (SIM2, Accession NM_009586) is another VGAM1965 host target gene. SIM2 BINDING SITE is HOST TARGET binding site found in the 3' untranslated region of mRNA encoded by SIM2, corresponding to a HOST TARGET binding site such as BINDING SITE I, BINDING SITE II or BINDING SITE III. Table 2 illustrates the complementarity of the nucleotide sequences of SIM2 BINDING SITE, designated SEQ ID:14313, to the nucleotide sequence of VGAM1965 RNA, herein designated VGAM RNA, also designated SEQ ID:4676.

Another function of VGAM1965 is therefore inhibition of Single-minded Homolog 2 (Drosophila) (SIM2, Accession NM_009586), a gene which may be a master gene of cns development. Accordingly, utilities of VGAM1965 include diagnosis, prevention and treatment of diseases and clinical conditions associated with SIM2. The function of SIM2 and its association with various diseases and clinical conditions, has been established by previous studies, as described hereinabove with reference to VGAM369. Src-like-adaptor (SLA, Accession NM_006748) is another VGAM1965 host target gene. SLA BINDING SITE1 and SLA BINDING SITE2 are HOST TARGET binding sites found in untranslated regions of mRNA encoded by SLA, corresponding to HOST TARGET binding sites such as BINDING SITE I, BINDING SITE II or BINDING SITE III. Table 2 illustrates the complementarity of the nucleotide sequences of SLA BINDING SITE1 and SLA BINDING SITE2, designated SEQ ID:13598 and SEQ ID:13597 respectively, to the nucleotide sequence of VGAM1965 RNA, herein designated VGAM RNA, also designated SEQ ID:4676.

Another function of VGAM1965 is therefore inhibition of Src-like-adaptor (SLA, Accession NM_006748), a gene which is a negative regulator of T-cell receptor signaling. Accordingly, utilities of VGAM1965 include diagnosis, prevention and treatment of diseases and clinical conditions associated with SLA. The function of SLA and its association with various diseases and clinical conditions, has been established by previous studies, as described hereinabove with reference to VGAM383. Solute Carrier Family 13 (sodium/sulfate symporters), Member 4 (SLC13A4, Accession NM_012450) is another VGAM1965 host target gene. SLC13A4 BINDING SITE is HOST TARGET binding site found in the 5' untranslated region of mRNA encoded by SLC13A4, corresponding to a HOST TARGET binding site such as BINDING SITE I, BINDING SITE II or BINDING SITE III. Table 2 illustrates the complementarity of the nucleotide sequences of SLC13A4 BINDING SITE, designated SEQ ID:14820, to the nucleotide sequence of VGAM1965 RNA, herein designated VGAM RNA, also designated SEQ ID:4676.

Another function of VGAM1965 is therefore inhibition of Solute Carrier Family 13 (sodium/sulfate symporters), Member 4 (SLC13A4, Accession NM_012450). Accordingly, utilities of VGAM1965 include diagnosis, prevention and treatment of diseases and clinical conditions associated with SLC13A4. Solute Carrier Family 14 (urea transporter), Member 1 (Kidd blood group) (SLC14A1, Accession NM_015865) is another VGAM1965 host target gene. SLC14A1 BINDING SITE1 through SLC14A1 BINDING SITE3 are HOST TARGET binding sites found in untranslated regions of mRNA encoded by SLC14A1, corresponding to HOST TARGET binding sites such as BINDING SITE I, BINDING SITE II or BINDING SITE III. Table 2 illustrates the complementarity of the nucleotide sequences of SLC14A1 BINDING SITE1 through SLC14A1 BINDING SITE3, designated SEQ ID:17998, SEQ ID:17999 and SEQ ID:17997 respectively, to the nucleotide sequence of VGAM1965 RNA, herein designated VGAM RNA, also designated SEQ ID:4676.

Another function of VGAM1965 is therefore inhibition of Solute Carrier Family 14 (urea transporter), Member 1 (Kidd blood group) (SLC14A1, Accession NM_015865), a gene which is a urea transporters in spermatogenesis. Accordingly, utilities of VGAM1965 include diagnosis, prevention and treatment of diseases and clinical conditions associated with SLC14A1. The function of SLC14A1 and its association with various diseases and clinical conditions, has been established by previous studies, as described hereinabove with reference to VGAM586. Solute Carrier Family 1 (neuronal/epithelial high affinity glutamate transporter, system Xag), Member 1 (SLC1A1, Accession NM_004170) is another VGAM1965 host target gene. SLC1A1 BINDING SITE is HOST TARGET binding site found in the 3' untranslated region of mRNA encoded by SLC1A1, corresponding to a HOST TARGET binding site such as BINDING SITE I, BINDING SITE II or BINDING SITE III. Table 2 illustrates the complementarity of the nucleotide sequences of SLC1A1 BINDING SITE, designated SEQ ID:10381, to the nucleotide sequence of VGAM1965 RNA, herein designated VGAM RNA, also designated SEQ ID:4676.

Another function of VGAM1965 is therefore inhibition of Solute Carrier Family 1 (neuronal/epithelial high affinity glutamate transporter, system Xag), Member 1 (SLC1A1, Accession NM_004170), a gene which is a glutamate transporter, essential for terminating the postsynaptic action of glutamate by rapidly removing it from the synaptic cleft. Accordingly, utilities of VGAM1965 include diagnosis, prevention and treatment of diseases and clinical conditions associated with SLC1A1. The function of SLC1A1 and its association with various diseases and clinical conditions, has been established by previous studies, as described hereinabove with reference to VGAM206. Solute Carrier Family 21 (organic anion transporter), Member 3 (SLC21A3, Accession NM_134431) is another VGAM1965 host target gene. SLC21A3 BINDING SITE1 and SLC21A3 BINDING SITE2 are HOST TARGET binding sites found in untranslated regions of mRNA encoded by SLC21A3, corresponding to HOST TARGET binding sites such as BINDING SITE I, BINDING SITE II or BINDING SITE III. Table 2 illustrates the complementarity of the nucleotide sequences of SLC21A3 BINDING SITE1 and SLC21A3 BINDING SITE2, designated SEQ ID:28672 and SEQ ID:22075 respectively, to the nucleotide sequence of VGAM1965 RNA, herein designated VGAM RNA, also designated SEQ ID:4676.

Another function of VGAM1965 is therefore inhibition of Solute Carrier Family 21 (organic anion transporter), Member 3 (SLC21A3, Accession NM_134431), a gene which mediates the na (+)-independent transport of organic anions such as bsp and conjugated (taurocholate) and unconjugated (cholate) bile acids. Accordingly, utilities of VGAM1965 include diagnosis, prevention and treatment of diseases and clinical conditions associated with SLC21A3. The function of SLC21A3 has been established by previous studies. The organic anion transporter (OATP) of liver mediates the basolateral hepatocellular uptake of numerous cholephilic anions and steroidal compounds from sinusoidal blood. By screening a human liver cDNA library with a rat Oatp cDNA, Kullak-Ublick et al. (1995) cloned a cDNA encoding OATP. The deduced 670-amino acid OATP protein has 12 putative transmembrane domains and 8 potential N-linked glycosylation sites. The human and rat OATP proteins are 67% identical. In vitro translation produced unglycosylated and glycosylated human OATP proteins that migrated as 59-kD and 71-kD polypeptides, respectively, in SDS-polyacrylamide gels. Functional studies in Xenopus oocytes showed that OATP mediates sodium-independent transport of the xenobiotic bromosulfophthalein and of endogenous conjugated and unconjugated bile acids. Northern blot analysis detected an approximately 2.7-kb OATP transcript in human liver, brain, lung, kidney, and testis; additional transcripts were also observed. The authors stated that the extrahepatic expression of OATP suggests a general role for OATP in transepithelial organic anion transport Full details of the abovementioned studies are described in the following publications, the disclosure of which are hereby incorporated by reference:

Kullak-Ublick, G. A.; Hagenbuch, B.; Stieger, B.; Schteingart, C. D.; Hofmann, A. F.; Wolkoff, A. W.; Meier, P. J.: Molecular and functional characterization of an organic anion transporting polypeptide cloned from human liveR.: Gastroenterology 109:1274-1282, 1995; and By somatic cell hybrid analysis, Kullak-Ublick et al. (1995) mapped the SLC21A3 gene to chromosome 12. Kullak-Ublick et al. (1996) regionally localized the SLC21A3 gene to 12p12 using fluor.

Further studies establishing the function and utilities of SLC21A3 are found in John Hopkins OMIM database record ID 602883, and in sited publications numbered 5325-5326 listed in the bibliography section hereinbelow, which are also hereby incorporated by reference. Solute Carrier Family 4, Sodium Bicarbonate Cotransporter, Member 7 (SLC4A7, Accession NM_003615) is another VGAM1965 host target gene. SLC4A7 BINDING SITE is HOST TARGET binding site found in the 3' untranslated region of mRNA encoded by SLC4A7, corresponding to a HOST TARGET binding site such as BINDING SITE I, BINDING SITE II or BINDING SITE III. Table 2 illustrates the complementarity of the nucleotide sequences of SLC4A7 BINDING SITE, designated SEQ ID:9672, to the nucleotide sequence of VGAM1965 RNA, herein designated VGAM RNA, also designated SEQ ID:4676.

Another function of VGAM1965 is therefore inhibition of Solute Carrier Family 4, Sodium Bicarbonate Cotransporter, Member 7 (SLC4A7, Accession NM_003615), a gene which mediates the coupled movement of sodium and bicarbonate ions across the plasma membrane. Accordingly, utilities of VGAM1965 include diagnosis, prevention and treatment of diseases and clinical conditions associated with SLC4A7. The function of SLC4A7 and its association with various diseases and clinical conditions, has been established by previous studies, as described hereinabove with reference to VGAM66. Solute Carrier Family 8 (sodium-calcium exchanger), Member 2 (SLC8A2, Accession XM_038970) is another VGAM1965 host target gene. SLC8A2 BINDING SITE is HOST TARGET binding site found in the 3' untranslated region of mRNA encoded by SLC8A2, corresponding to a HOST TARGET binding site such as BINDING SITE I, BINDING SITE II or BINDING SITE III. Table 2 illustrates the complementarity of the nucleotide sequences of SLC8A2 BINDING SITE, designated SEQ ID:32969, to the nucleotide sequence of VGAM1965 RNA, herein designated VGAM RNA, also designated SEQ ID:4676.

Another function of VGAM1965 is therefore inhibition of Solute Carrier Family 8 (sodium-calcium exchanger), Member 2 (SLC8A2, Accession XM_038970). Accordingly, utilities of VGAM1965 include diagnosis, prevention and treatment of diseases and clinical conditions associated with SLC8A2. SWI/SNF Related, Matrix Associated, Actin Dependent Regulator of Chromatin, Subfamily A, Member 3 (SMARCA3, Accession NM_139048) is another VGAM1965 host target gene. SMARCA3 BINDING SITE1 and SMARCA3 BINDING SITE2 are HOST TARGET binding sites found in untranslated regions of mRNA encoded by SMARCA3, corresponding to HOST TARGET binding sites such as BINDING SITE I, BINDING SITE II or BINDING SITE III. Table 2 illustrates the complementarity of the nucleotide sequences of SMARCA3 BINDING SITE1 and SMARCA3 BINDING SITE2, designated SEQ ID:29133 and SEQ ID:9038 respectively, to the nucleotide sequence of VGAM1965 RNA, herein designated VGAM RNA, also designated SEQ ID:4676.

Another function of VGAM1965 is therefore inhibition of SWI/SNF Related, Matrix Associated, Actin Dependent Regulator of Chromatin, Subfamily A, Member 3 (SMARCA3, Accession NM_139048), a gene which is involved in chromatin assembly and remodeling. Accordingly, utilities of VGAM1965 include diagnosis, prevention and treatment of diseases and clinical conditions associated with SMARCA3. The function of SMARCA3 and its association with various diseases and clinical conditions, has been established by previous studies, as described hereinabove with reference to VGAM1330. Small Nuclear Ribonucleoprotein Polypeptide N (SNRPN, Accession NM_022807) is another VGAM1965 host target gene. SNRPN BINDING SITE is HOST TARGET binding site found in the 5' untranslated region of mRNA encoded by SNRPN, corresponding to a HOST TARGET binding site such as BINDING SITE I, BINDING SITE II or BINDING SITE III. Table 2 illustrates the complementarity of the nucleotide sequences of SNRPN BINDING SITE, designated SEQ ID:23084, to the nucleotide sequence of VGAM1965 RNA, herein designated VGAM RNA, also designated SEQ ID:4676.

Another function of VGAM1965 is therefore inhibition of Small Nuclear Ribonucleoprotein Polypeptide N (SNRPN, Accession NM_022807), a gene which may be involved in tissue-specific alternative RNA processing events. Accordingly, utilities of VGAM1965 include diagnosis, prevention and treatment of diseases and clinical conditions associated with SNRPN. The function of SNRPN and its association with various diseases and clinical conditions, has been established by previous studies, as described hereinabove with reference to VGAM1924. Sorting Nexin 9 (SNX9, Accession NM_016224) is another VGAM1965 host target gene. SNX9 BINDING SITE is HOST TARGET binding site found in the 3' untranslated region of mRNA encoded by SNX9, corresponding to a HOST TARGET binding site such as BINDING SITE I, BINDING SITE II or BINDING SITE III. Table 2 illustrates the complementarity of the nucleotide sequences of SNX9 BINDING SITE, designated SEQ ID:18332, to the nucleotide sequence of VGAM1965 RNA, herein designated VGAM RNA, also designated SEQ ID:4676.

Another function of VGAM1965 is therefore inhibition of Sorting Nexin 9 (SNX9, Accession NM_016224). Accordingly, utilities of VGAM1965 include diagnosis, prevention and treatment of diseases and clinical conditions associated with SNX9. Sorbitol Dehydrogenase (SORD, Accession NM_003104) is another VGAM1965 host target gene. SORD BINDING SITE is HOST TARGET binding site found in the 3' untranslated region of mRNA encoded by SORD, corresponding to a HOST TARGET binding site such as BINDING SITE I, BINDING SITE II or BINDING SITE III. Table 2 illustrates the complementarity of the nucleotide sequences of SORD BINDING SITE, designated SEQ ID:9070, to the nucleotide sequence of VGAM1965 RNA, herein designated VGAM RNA, also designated SEQ ID:4676.

Another function of VGAM1965 is therefore inhibition of Sorbitol Dehydrogenase (SORD, Accession NM_003104). Accordingly, utilities of VGAM1965 include diagnosis, prevention and treatment of diseases and clinical conditions associated with SORD. SRP46 (Accession NM_032102) is another VGAM1965 host target gene. SRP46 BINDING SITE is HOST TARGET binding site found in the 5' untranslated region of mRNA encoded by SRP46, corresponding to a HOST TARGET binding site such as BINDING SITE I, BINDING SITE II or BINDING SITE III. Table 2 illustrates the complementarity of the nucleotide sequences of SRP46 BINDING SITE, designated SEQ ID:25793, to the nucleotide sequence of VGAM1965 RNA, herein designated VGAM RNA, also designated SEQ ID:4676.

Another function of VGAM1965 is therefore inhibition of SRP46 (Accession NM_032102). Accordingly, utilities of VGAM1965 include diagnosis, prevention and treatment of diseases and clinical conditions associated with SRP46. Suppressor of Fused Homolog (Drosophila) (SUFU, Accession NM_016169) is another VGAM1965 host target gene. SUFU BINDING SITE is HOST TARGET binding site found in the 3' untranslated region of mRNA encoded by SUFU, corresponding to a HOST TARGET binding site such as BINDING SITE I, BINDING SITE II or BINDING SITE III. Table 2 illustrates the complementarity of the nucleotide sequences of SUFU BINDING SITE, designated SEQ ID:18260, to the nucleotide sequence of VGAM1965 RNA, herein designated VGAM RNA, also designated SEQ ID:4676.

Another function of VGAM1965 is therefore inhibition of Suppressor of Fused Homolog (Drosophila) (SUFU, Accession NM_016169). Accordingly, utilities of VGAM1965 include diagnosis, prevention and treatment of diseases and clinical conditions associated with SUFU. Synaptotagmin I (SYT1, Accession NM_005639) is another VGAM1965 host target gene. SYT1 BINDING SITE is HOST TARGET binding site found in the 3' untranslated region of mRNA encoded by SYT1, corresponding to a HOST TARGET binding site such as BINDING SITE I, BINDING SITE II or BINDING SITE III. Table 2 illustrates the complementarity of the nucleotide sequences of SYT1 BINDING SITE, designated SEQ ID:12172, to the nucleotide sequence of VGAM1965 RNA, herein designated VGAM RNA, also designated SEQ ID:4676.

Another function of VGAM1965 is therefore inhibition of Synaptotagmin I (SYT1, Accession NM_005639), a gene which may have a regulatory role in the membrane interactions during trafficking of synaptic vesicles at the active zone of the synapse. Accordingly, utilities of VGAM1965 include diagnosis, prevention and treatment of diseases and clinical conditions associated with SYT1. The function of SYT1 and its association with various diseases and clinical conditions, has been established by previous studies, as described hereinabove with reference to VGAM739. Synaptotagmin V (SYT5, Accession NM_003180) is another VGAM1965 host target gene. SYT5 BINDING SITE is HOST TARGET binding site found in the 5' untranslated region of mRNA encoded by SYT5, corresponding to a HOST TARGET binding site such as BINDING SITE I, BINDING SITE II or BINDING SITE III. Table 2 illustrates the complementarity of the nucleotide sequences of SYT5 BINDING SITE, designated SEQ ID:9152, to the nucleotide sequence of VGAM1965 RNA, herein designated VGAM RNA, also designated SEQ ID:4676.

Another function of VGAM1965 is therefore inhibition of Synaptotagmin V (SYT5, Accession NM_003180), a gene which is a member of a family of calcium sensors regulating neurotransmitter release. Accordingly, utilities of VGAM1965 include diagnosis, prevention and treatment of diseases and clinical conditions associated with SYT5. The function of SYT5 has been established by previous studies. The synaptotagmins are a family of type III membrane proteins characterized by cytoplasmic repeats related to the protein kinase C regulatory (C2) domains which are thought to bind calcium. The synaptotagmins may act both as negative regulators of vesicle fusion, allowing fusion in the presence of calcium, and as calcium receptors or sensor molecules. Hudson and Birnbaum (1995) cloned a synaptotagmin cDNA from a rat adipose tissue cDNA library. The sequence predicts a 386-amino acid protein with 49% identity to synaptotagmins 1 (OMIM Ref. No. 185605) and 2 (OMIM Ref. No. 600104). The 1.7-kb synaptotagmin-5 mRNA is expressed in rat kidney, adipose tissue, lung and heart, and at higher levels in brain. An antibody to the SYT5 gene product detected an approximately 50-kD protein. Kwon et al. (1995) mapped the SYT5 gene to mouse chromosome 7 and predicted that the human gene is located on 11p.

Full details of the abovementioned studies are described in the following publications, the disclosure of which are hereby incorporated by reference:

Hudson, A. W.; Birnbaum, M. J.: Identification of a non-neuronal isoform of synaptotagmin. Proc. Nat. Acad. Sci. 92:5895-5899, 1995; and Kwon, O.-J.; Adamson, M. C.; Chin, H.; Kozak, C. A.: Genetic mapping of five mouse genes encoding synaptotagmins. Mammalian Genome 6:880-881, 1995.

Further studies establishing the function and utilities of SYT5 are found in John Hopkins OMIM database record ID 600782, and in sited publications numbered 9943 listed in the bibliography section hereinbelow, which are also hereby incorporated by reference. Transforming, Acidic Coiled-coil Containing Protein 1 (TACC1, Accession NM_006283) is another VGAM1965 host target gene. TACC1 BINDING SITE1 and TACC1 BINDING SITE2 are HOST TARGET binding sites found in untranslated regions of mRNA encoded by TACC1, corresponding to HOST TARGET binding sites such as BINDING SITE I, BINDING SITE II or BINDING SITE III. Table 2 illustrates the complementarity of the nucleotide sequences of TACC1 BINDING SITE1 and TACC1 BINDING SITE2, designated SEQ ID:12961 and SEQ ID:12968 respectively, to the nucleotide sequence of VGAM1965 RNA, herein designated VGAM RNA, also designated SEQ ID:4676.

Another function of VGAM1965 is therefore inhibition of Transforming, Acidic Coiled-coil Containing Protein 1 (TACC1, Accession NM_006283). Accordingly, utilities of VGAM1965 include diagnosis, prevention and treatment of diseases and clinical conditions associated with TACC1. T-cell Acute Lymphocytic Leukemia 1 (TAL1, Accession NM_003189) is another VGAM1965 host target gene. TAL1 BINDING SITE1 and TAL1 BINDING SITE2 are HOST TARGET binding sites found in untranslated regions of mRNA encoded by TAL1, corresponding to HOST TARGET binding sites such as BINDING SITE I, BINDING SITE II or BINDING SITE III. Table 2 illustrates the complementarity of the nucleotide sequences of TAL1 BINDING SITE1 and TAL1 BINDING SITE2, designated SEQ ID:9172 and SEQ ID:9186 respectively, to the nucleotide sequence of VGAM1965 RNA, herein designated VGAM RNA, also designated SEQ ID:4676.

Another function of VGAM1965 is therefore inhibition of T-cell Acute Lymphocytic Leukemia 1 (TAL1, Accession NM_003189), a gene which may help control cell growth and differentiation. Accordingly, utilities of VGAM1965 include diagnosis, prevention and treatment of diseases and clinical conditions associated with TAL1. The function of TAL1 and its association with various diseases and clinical conditions, has been established by previous studies, as described hereinabove with reference to VGAM172. Transmembrane Protein 1 (TMEM1, Accession NM_003274) is another VGAM1965 host target gene. TMEM1 BINDING SITE is HOST TARGET binding site found in the 3' untranslated region of mRNA encoded by TMEM1, corresponding to a HOST TARGET binding site such as BINDING SITE I, BINDING SITE II or BINDING SITE III. Table 2 illustrates the complementarity of the nucleotide sequences of TMEM1 BINDING SITE, designated SEQ ID:9288, to the nucleotide sequence of VGAM1965 RNA, herein designated VGAM RNA, also designated SEQ ID:4676.

Another function of VGAM1965 is therefore inhibition of Transmembrane Protein 1 (TMEM1, Accession NM_003274). Accordingly, utilities of VGAM1965 include diagnosis, prevention and treatment of diseases and clinical conditions associated with TMEM1. Transmembrane Protease, Serine 2 (TMPRSS2, Accession NM_005656) is another VGAM1965 host target gene. TMPRSS2 BINDING SITE is HOST TARGET binding site found in the 3' untranslated region of mRNA encoded by TMPRSS2, corresponding to a HOST TARGET binding site such as BINDING SITE I, BINDING SITE II or BINDING SITE III. Table 2 illustrates the complementarity of the nucleotide sequences of TMPRSS2 BINDING SITE, designated SEQ ID:12195, to the nucleotide sequence of VGAM1965 RNA, herein designated VGAM RNA, also designated SEQ ID:4676.

Another function of VGAM1965 is therefore inhibition of Transmembrane Protease, Serine 2 (TMPRSS2, Accession NM_005656). Accordingly, utilities of VGAM1965 include diagnosis, prevention and treatment of diseases and clinical conditions associated with TMPRSS2. Tumor Necrosis Factor (TNF superfamily, member 2) (TNF, Accession XM_165823) is another VGAM1965 host target gene. TNF BINDING SITE is HOST TARGET binding site found in the 3' untranslated region of mRNA encoded by TNF, corresponding to a HOST TARGET binding site such as BINDING SITE I, BINDING SITE II or BINDING SITE III. Table 2 illustrates the complementarity of the nucleotide sequences of TNF BINDING SITE, designated SEQ ID:43772, to the nucleotide sequence of VGAM1965 RNA, herein designated VGAM RNA, also designated SEQ ID:4676.

Another function of VGAM1965 is therefore inhibition of Tumor Necrosis Factor (TNF superfamily, member 2) (TNF, Accession XM_165823), a gene which mediates proinflammatory responses and apoptosis. Accordingly, utilities of VGAM1965 include diagnosis, prevention and treatment of diseases and clinical conditions associated with TNF. The function of TNF and its association with various diseases and clinical conditions, has been established by previous studies, as described hereinabove with reference to VGAM175. TOX (Accession NM_014729) is another VGAM1965 host target gene. TOX BINDING SITE is HOST TARGET binding site found in the 3' untranslated region of mRNA encoded by TOX, corresponding to a HOST TARGET binding site such as BINDING SITE I, BINDING SITE II or BINDING SITE III. Table 2 illustrates the complementarity of the nucleotide sequences of TOX BINDING SITE, designated SEQ ID:16329, to the nucleotide sequence of VGAM1965 RNA, herein designated VGAM RNA, also designated SEQ ID:4676.

Another function of VGAM1965 is therefore inhibition of TOX (Accession NM_014729). Accordingly, utilities of VGAM1965 include diagnosis, prevention and treatment of diseases and clinical conditions associated with TOX. Tumor Protein P53 (Li-Fraumeni syndrome) (TP53, Accession NM_000546) is another VGAM1965 host target gene. TP53 BINDING SITE is HOST TARGET binding site found in the 3' untranslated region of mRNA encoded by TP53, corresponding to a HOST TARGET binding site such as BINDING SITE I, BINDING SITE II or BINDING SITE III. Table 2 illustrates the complementarity of the nucleotide sequences of TP53 BINDING SITE, designated SEQ ID:6153, to the nucleotide sequence of VGAM1965 RNA, herein designated VGAM RNA, also designated SEQ ID:4676.

Another function of VGAM1965 is therefore inhibition of Tumor Protein P53 (Li-Fraumeni syndrome) (TP53, Accession NM_000546). Accordingly, utilities of VGAM1965 include diagnosis, prevention and treatment of diseases and clinical conditions associated with TP53. Tripartite Motif-containing 14 (TRIM14, Accession NM_014788) is another VGAM1965 host target gene. TRIM14 BINDING SITE is HOST TARGET binding site found in the 3' untranslated region of mRNA encoded by TRIM14, corresponding to a HOST TARGET binding site such as BINDING SITE I, BINDING SITE II or BINDING SITE III. Table 2 illustrates the complementarity of the nucleotide sequences of TRIM14 BINDING SITE, designated SEQ ID:16671, to the nucleotide sequence of VGAM1965 RNA, herein designated VGAM RNA, also designated SEQ ID:4676.

Another function of VGAM1965 is therefore inhibition of Tripartite Motif-containing 14 (TRIM14, Accession NM_014788), a gene which is composed of 3 zinc-binding domains and is involved in development and cell growth. Accordingly, utilities of VGAM1965 include diagnosis, prevention and treatment of diseases and clinical conditions associated with TRIM14. The function of TRIM14 and its association with various diseases and clinical conditions, has been established by previous studies, as described hereinabove with reference to VGAM180. Transient Receptor Potential Cation Channel, Subfamily C, Member 6 (TRPC6, Accession NM_004621) is another VGAM1965 host target gene. TRPC6 BINDING SITE is HOST TARGET binding site found in the 3' untranslated region of mRNA encoded by TRPC6, corresponding to a HOST TARGET binding site such as BINDING SITE I, BINDING SITE II or BINDING SITE III. Table 2 illustrates the complementarity of the nucleotide sequences of TRPC6 BINDING SITE, designated SEQ ID:10980, to the nucleotide sequence of VGAM1965 RNA, herein designated VGAM RNA, also designated SEQ ID:4676.

Another function of VGAM1965 is therefore inhibition of Transient Receptor Potential Cation Channel, Subfamily C, Member 6 (TRPC6, Accession NM_004621), a gene which has calcium channel activity. Accordingly, utilities of VGAM1965 include diagnosis, prevention and treatment of diseases and clinical conditions associated with TRPC6. The function of TRPC6 and its association with various diseases and clinical conditions, has been established by previous studies, as described hereinabove with reference to VGAM25. TSLP (Accession NM_033035) is another VGAM1965 host target gene. TSLP BINDING SITE is HOST TARGET binding site found in the 5' untranslated region of mRNA encoded by TSLP, corresponding to a HOST TARGET binding site such as BINDING SITE I, BINDING SITE II or BINDING SITE III. Table 2 illustrates the complementarity of the nucleotide sequences of TSLP BINDING SITE, designated SEQ ID:26929, to the nucleotide sequence of VGAM1965 RNA, herein designated VGAM RNA, also designated SEQ ID:4676.

Another function of VGAM1965 is therefore inhibition of TSLP (Accession NM_033035), a gene which may contribute directly to the activation of Langerhans cells and inhibit apoptosis. Accordingly, utilities of VGAM1965 include diagnosis, prevention and treatment of diseases and clinical conditions associated with TSLP. The function of TSLP and its association with various diseases and clinical conditions, has been established by previous studies, as described hereinabove with reference to VGAM558. Translin-associated Factor X (TSNAX, Accession NM_005999) is another VGAM1965 host target gene. TSNAX BINDING SITE is HOST TARGET binding site found in the 3' untranslated region of mRNA encoded by TSNAX, corresponding to a HOST TARGET binding site such as BINDING SITE I, BINDING SITE II or BINDING SITE III. Table 2 illustrates the complementarity of the nucleotide sequences of TSNAX BINDING SITE, designated SEQ ID:12616, to the nucleotide sequence of VGAM1965 RNA, herein designated VGAM RNA, also designated SEQ ID:4676.

Another function of VGAM1965 is therefore inhibition of Translin-associated Factor X (TSNAX, Accession NM_005999), a gene which Interacts with translin (TSN). Accordingly, utilities of VGAM1965 include diagnosis, prevention and treatment of diseases and clinical conditions associated with TSNAX. The function of TSNAX has been established by previous studies. Translin (TSN; 600575) is a DNA-binding protein that specifically binds to consensus sequences at breakpoint junctions of chromosomal translocations in many cases of lymphoid malignancies. Aoki et al. (1997) used a yeast 2-hybrid system to screen a human spleen cDNA library for potential interactions of TSN with other proteins. They isolated a TSNAX cDNA, termed TRAX (translin-associated factor X) by the authors, whose product specifically interacted with TSN in cotransformation and in vitro interaction assays. The cDNA encodes a putative 290-amino acid protein with a predicted molecular mass of 33 kD. The protein contains a heptad repeat of hydrophobic amino acids consistent with the hypothetical leucine zipper structure. The authors found 28% amino acid sequence identity between TSNAX and TSN, with 38% identity in the C-terminal regions. Northern blot analysis revealed a single TSNAX transcript of 2.7 kb, with a tissue distribution similar to that of the TSN transcript. Meng et al. (2000) determined that the genomic structure of TSNAX is similar to that of TSN, consisting of 6 exons encompassing approximately 27 kb of genomic DNA. By fluorescence in situ hybridization, Meng et al. (2000) mapped the TSNAX gene to chromosome 1q41.

Full details of the abovementioned studies are described in the following publications, the disclosure of which are hereby incorporated by reference:

Aoki, K.; Ishida, R.; Kasai, M.: Isolation and characterization of a cDNA encoding a translin-like protein, TRAX. FEBS Lett. 401:109-112, 1997; and Meng, G.; Aoki, K.; Tokura, K.; Nakahara, K.; Inazawa, J.; Kasai, M.: Genomic structure and chromosomal localization of the gene encoding TRAX, a translin-associated factor X. J. Hum. G.

Further studies establishing the function and utilities of TSNAX are found in John Hopkins OMIM database record ID 602964, and in sited publications numbered 8476-8477 listed in the bibliography section hereinbelow, which are also hereby incorporated by reference. Ubiquitin-like 1 (sentrin) (UBL1, Accession NM_003352) is another VGAM1965 host target gene. UBL1 BINDING SITE is HOST TARGET binding site found in the 3' untranslated region of mRNA encoded by UBL1, corresponding to a HOST TARGET binding site such as BINDING SITE I, BINDING SITE II or BINDING SITE III. Table 2 illustrates the complementarity of the nucleotide sequences of UBL1 BINDING SITE, designated SEQ ID:9379, to the nucleotide sequence of VGAM1965 RNA, herein designated VGAM RNA, also designated SEQ ID:4676.

Another function of VGAM1965 is therefore inhibition of Ubiquitin-like 1 (sentrin) (UBL1, Accession NM_003352), a gene which generates proteins resistant to degradation through its modification. Accordingly, utilities of VGAM1965 include diagnosis, prevention and treatment of diseases and clinical conditions associated with UBL1. The function of UBL1 and its association with various diseases and clinical conditions, has been established by previous studies, as described hereinabove with reference to VGAM206. UC28 (Accession NM_021635) is another VGAM1965 host target gene. UC28 BINDING SITE is HOST TARGET binding site found in the 3' untranslated region of mRNA encoded by UC28, corresponding to a HOST TARGET binding site such as BINDING SITE I, BINDING SITE II or BINDING SITE III. Table 2 illustrates the complementarity of the nucleotide sequences of UC28 BINDING SITE, designated SEQ ID:22281, to the nucleotide sequence of VGAM1965 RNA, herein designated VGAM RNA, also designated SEQ ID:4676.

Another function of VGAM1965 is therefore inhibition of UC28 (Accession NM_021635). Accordingly, utilities of VGAM1965 include diagnosis, prevention and treatment of diseases and clinical conditions associated with UC28. Vang-like 2 (van gogh, Drosophila) (VANGL2, Accession XM_049695) is another VGAM1965 host target gene. VANGL2 BINDING SITE1 and VANGL2 BINDING SITE2 are HOST TARGET binding sites found in untranslated regions of mRNA encoded by VANGL2, corresponding to HOST TARGET binding sites such as BINDING SITE I, BINDING SITE II or BINDING SITE III. Table 2 illustrates the complementarity of the nucleotide sequences of VANGL2 BINDING SITE1 and VANGL2 BINDING SITE2, designated SEQ ID:35476 and SEQ ID:35487 respectively, to the nucleotide sequence of VGAM1965 RNA, herein designated VGAM RNA, also designated SEQ ID:4676.

Another function of VGAM1965 is therefore inhibition of Vang-like 2 (van gogh, Drosophila) (VANGL2, Accession XM_049695), a gene which may take part in defining the lateral boundary of floorplate differentiation. Accordingly, utilities of VGAM1965 include diagnosis, prevention and treatment of diseases and clinical conditions associated with VANGL2. The function of VANGL2 and its association with various diseases and clinical conditions, has been established by previous studies, as described hereinabove with reference to VGAM111. WD Repeat Domain 3 (WDR3, Accession NM_006784) is another VGAM1965 host target gene. WDR3 BINDING SITE is HOST TARGET binding site found in the 3' untranslated region of mRNA encoded by WDR3, corresponding to a HOST TARGET binding site such as BINDING SITE I, BINDING SITE II or BINDING SITE III. Table 2 illustrates the complementarity of the nucleotide sequences of WDR3 BINDING SITE, designated SEQ ID:13654, to the nucleotide sequence of VGAM1965 RNA, herein designated VGAM RNA, also designated SEQ ID:4676.

Another function of VGAM1965 is therefore inhibition of WD Repeat Domain 3 (WDR3, Accession NM_006784), a gene which contains a WD repeat domain with unknown function. Accordingly, utilities of VGAM1965 include diagnosis, prevention and treatment of diseases and clinical conditions associated with WDR3. The function of WDR3 has been established by previous studies. A conserved core of 4 or more modular repeat units defines a group of functionally diverse regulatory proteins in eukaryotes known as the WD repeat family. WD repeats are minimally conserved regions of approximately 40 amino acids typically bracketed by gly-his and trp-asp (GH-WD), which may facilitate formation of heterotrimeric or multiprotein complexes. Proteins belonging to the WD repeat family are involved in a variety of cellular processes, including cell cycle progression, signal transduction, apoptosis, and gene regulation. Claudio et al. (1998) identified a human CD34+ hematopoietic progenitor line (KG-1a) EST with significant sequence similarity to a portion of the yeast TUP1 gene, which encodes a WD repeat-containing transcriptional regulator. Using the EST, they isolated the complete coding sequence of the human WDR3 protein. Claudio et al. (1999) found that the predicted 943-amino acid WDR3 protein contains 10 WD repeat modules. The first 4 WD repeats are separated from the remaining 6 WD repeats by a nuclear localization signal (NLS); a second NLS is located near the C-terminal end of the protein. WDR3 also contains a potential tyrosine kinase phosphorylation site and a cAMP- and cGMP-dependent protein kinase phosphorylation site. WDR3 shares 37% amino acid sequence identity with the S. cerevisiae WD repeat-containing protein DIP2. Northern blot analysis detected an approximately 4-kb WDR3 transcript in the majority of tissues examined, including brain, pancreas, skeletal muscle, and placenta. WDR3 expression was also found in all of the cell lines tested. By FISH, Claudio et al. (1999) mapped the WDR3 gene to 1p13-p12.

Full details of the abovementioned studies are described in the following publications, the disclosure of which are hereby incorporated by reference:

Claudio, J. O.; Liew, C.-C.; Dempsey, A. A.; Cukerman, E.; Stewart, A. K.; Na, E.; Atkins, H. L.; Iscove, N. N.; Hawley, R. G.: Identification of sequence-tagged transcripts differentially expressed within the human hematopoietic hierarchy. Genomics 50:44-52, 1998; and Claudio, J. O.; Liew, C.-C.; Ma, J.; Heng, H. H. Q.; Stewart, A. K.; Hawley, R. G. : Cloning and expression analysis of a novel WD repeat gene, WDR3, mapping to 1p12-p13. Genomics 59:8.

Further studies establishing the function and utilities of WDR3 are found in John Hopkins OMIM database record ID 604737, and in sited publications numbered 6742-6743 listed in the bibliography section hereinbelow, which are also hereby incorporated by reference. Wolf-Hirschhorn Syndrome Candidate 1 (WHSC1, Accession NM_007331) is another VGAM1965 host target gene. WHSC1 BINDING SITE is HOST TARGET binding site found in the 3' untranslated region of mRNA encoded by WHSC1, corresponding to a HOST TARGET binding site such as BINDING SITE I, BINDING SITE II or BINDING SITE III. Table 2 illustrates the complementarity of the nucleotide sequences of WHSC1 BINDING SITE, designated SEQ ID:14253, to the nucleotide sequence of VGAM1965 RNA, herein designated VGAM RNA, also designated SEQ ID:4676.

Another function of VGAM1965 is therefore inhibition of Wolf-Hirschhorn Syndrome Candidate 1 (WHSC1, Accession NM_007331), a gene which binds covalently to and repairs g/t mismatches. Accordingly, utilities of VGAM1965 include diagnosis, prevention and treatment of diseases and clinical conditions associated with WHSC1. The function of WHSC1 and its association with various diseases and clinical conditions, has been established by previous studies, as described hereinabove with reference to VGAM200. Wingless-type MMTV Integration Site Family, Member 10B (WNT10B, Accession NM_003394) is another VGAM1965 host target gene. WNT10B BINDING SITE is HOST TARGET binding site found in the 3' untranslated region of mRNA encoded by WNT10B, corresponding to a HOST TARGET binding site such as BINDING SITE I, BINDING SITE II or BINDING SITE III. Table 2 illustrates the complementarity of the nucleotide sequences of WNT10B BINDING SITE, designated SEQ ID:9431, to the nucleotide sequence of VGAM1965 RNA, herein designated VGAM RNA, also designated SEQ ID:4676.

Another function of VGAM1965 is therefore inhibition of Wingless-type MMTV Integration Site Family, Member 10B (WNT10B, Accession NM_003394), a gene which is a ligand for members of the frizzled family of seven transmembrane receptors and may be a signaling molecule. Accordingly, utilities of VGAM1965 include diagnosis, prevention and treatment of diseases and clinical conditions associated with WNT10B. The function of WNT10B and its association with various diseases and clinical conditions, has been established by previous studies, as described hereinabove with reference to VGAM594. Wingless-type MMTV Integration Site Family, Member 5B (WNT5B, Accession NM_030775) is another VGAM1965 host target gene. WNT5B BINDING SITE1 and WNT5B BINDING SITE2 are HOST TARGET binding sites found in untranslated regions of mRNA encoded by WNT5B, corresponding to HOST TARGET binding sites such as BINDING SITE I, BINDING SITE II or BINDING SITE III. Table 2 illustrates the complementarity of the nucleotide sequences of WNT5B BINDING SITE1 and WNT5B BINDING SITE2, designated SEQ ID:25059 and SEQ ID:26361 respectively, to the nucleotide sequence of VGAM1965 RNA, herein designated VGAM RNA, also designated SEQ ID:4676.

Another function of VGAM1965 is therefore inhibition of Wingless-type MMTV Integration Site Family, Member 5B (WNT5B, Accession NM_030775), a gene which is the ligand for members of the frizzled family of seven transmembrane receptors and may be a signaling molecule. Accordingly, utilities of VGAM1965 include diagnosis, prevention and treatment of diseases and clinical conditions associated with WNT5B. The function of WNT5B and its association with various diseases and clinical conditions, has been established by previous studies, as described hereinabove with reference to VGAM1928. X-ray Repair Complementing Defective Repair In Chinese Hamster Cells 3 (XRCC3, Accession NM_005432) is another VGAM1965 host target gene. XRCC3 BINDING SITE is HOST TARGET binding site found in the 3' untranslated region of mRNA encoded by XRCC3, corresponding to a HOST TARGET binding site such as BINDING SITE I, BINDING SITE II or BINDING SITE III. Table 2 illustrates the complementarity of the nucleotide sequences of XRCC3 BINDING SITE, designated SEQ ID:11910, to the nucleotide sequence of VGAM1965 RNA, herein designated VGAM RNA, also designated SEQ ID:4676.

Another function of VGAM1965 is therefore inhibition of X-ray Repair Complementing Defective Repair In Chinese Hamster Cells 3 (XRCC3, Accession NM_005432), a gene which is required for meiotic recombination, synaptonemal complex formation and cell cycle progression. Accordingly, utilities of VGAM1965 include diagnosis, prevention and treatment of diseases and clinical conditions associated with XRCC3. The function of XRCC3 and its association with various diseases and clinical conditions, has been established by previous studies, as described hereinabove with reference to VGAM1290. XT3 (Accession NM_020208) is another VGAM1965 host target gene. XT3 BINDING SITE1 and XT3 BINDING SITE2 are HOST TARGET binding sites found in untranslated regions of mRNA encoded by XT3, corresponding to HOST TARGET binding sites such as BINDING SITE I, BINDING SITE II or BINDING SITE III. Table 2 illustrates the complementarity of the nucleotide sequences of XT3 BINDING SITE1 and XT3 BINDING SITE2, designated SEQ ID:21448 and SEQ ID:21449 respectively, to the nucleotide sequence of VGAM1965 RNA, herein designated VGAM RNA, also designated SEQ ID:4676.

Another function of VGAM1965 is therefore inhibition of XT3 (Accession NM_020208), a gene which is a Kidney-specific orphan transporter. Accordingly, utilities of VGAM1965 include diagnosis, prevention and treatment of diseases and clinical conditions associated with XT3. The function of XT3 and its association with various diseases and clinical conditions, has been established by previous studies, as described hereinabove with reference to VGAM21. Zinc Finger Protein 124 (HZF-16) (ZNF124, Accession NM_003431) is another VGAM1965 host target gene. ZNF124 BINDING SITE is HOST TARGET binding site found in the 5' untranslated region of mRNA encoded by ZNF124, corresponding to a HOST TARGET binding site such as BINDING SITE I, BINDING SITE II or BINDING SITE III. Table 2 illustrates the complementarity of the nucleotide sequences of ZNF124 BINDING SITE, designated SEQ ID:9483, to the nucleotide sequence of VGAM1965 RNA, herein designated VGAM RNA, also designated SEQ ID:4676.

Another function of VGAM1965 is therefore inhibition of Zinc Finger Protein 124 (HZF-16) (ZNF124, Accession NM_003431). Accordingly, utilities of VGAM1965 include diagnosis, prevention and treatment of diseases and clinical conditions associated with ZNF124. Zinc Finger Protein 137 (clone pHZ-30) (ZNF137, Accession NM_003438) is another VGAM1965 host target gene. ZNF137 BINDING SITE is HOST TARGET binding site found in the 3' untranslated region of mRNA encoded by ZNF137, corresponding to a HOST TARGET binding site such as BINDING SITE I, BINDING SITE II or BINDING SITE III. Table 2 illustrates the complementarity of the nucleotide sequences of ZNF137 BINDING SITE, designated SEQ ID:9493, to the nucleotide sequence of VGAM1965 RNA, herein designated VGAM RNA, also designated SEQ ID:4676.

Another function of VGAM1965 is therefore inhibition of Zinc Finger Protein 137 (clone pHZ-30) (ZNF137, Accession NM_003438). Accordingly, utilities of VGAM1965 include diagnosis, prevention and treatment of diseases and clinical conditions associated with ZNF137. Zinc Finger Protein 202 (ZNF202, Accession NM_003455) is another VGAM1965 host target gene. ZNF202 BINDING SITE is HOST TARGET binding site found in the 3' untranslated region of mRNA encoded by ZNF202, corresponding to a HOST TARGET binding site such as BINDING SITE I, BINDING SITE II or BINDING SITE III. Table 2 illustrates the complementarity of the nucleotide sequences of ZNF202 BINDING SITE, designated SEQ ID:9510, to the nucleotide sequence of VGAM1965 RNA, herein designated VGAM RNA, also designated SEQ ID:4676.

Another function of VGAM1965 is therefore inhibition of Zinc Finger Protein 202 (ZNF202, Accession NM_003455). Accordingly, utilities of VGAM1965 include diagnosis, prevention and treatment of diseases and clinical conditions associated with ZNF202. Zinc Finger Protein 74 (Cos52) (ZNF74, Accession NM_003426) is another VGAM1965 host target gene. ZNF74 BINDING SITE1 and ZNF74 BINDING SITE2 are HOST TARGET binding sites found in untranslated regions of mRNA encoded by ZNF74, corresponding to HOST TARGET binding sites such as BINDING SITE I, BINDING SITE II or BINDING SITE III. Table 2 illustrates the complementarity of the nucleotide sequences of ZNF74 BINDING SITE1 and ZNF74 BINDING SITE2, designated SEQ ID:9474 and SEQ ID:9476 respectively, to the nucleotide sequence of VGAM1965 RNA, herein designated VGAM RNA, also designated SEQ ID:4676.

Another function of VGAM1965 is therefore inhibition of Zinc Finger Protein 74 (Cos52) (ZNF74, Accession NM_003426). Accordingly, utilities of VGAM1965 include diagnosis, prevention and treatment of diseases and clinical conditions associated with ZNF74. A Kinase (PRKA) Anchor Protein 8 (AKAP8, Accession NM_005858) is another VGAM1965 host target gene. AKAP8 BINDING SITE is HOST TARGET binding site found in the 3' untranslated region of mRNA encoded by AKAP8, corresponding to a HOST TARGET binding site such as BINDING SITE I, BINDING SITE II or BINDING SITE III. Table 2 illustrates the complementarity of the nucleotide sequences of AKAP8 BINDING SITE, designated SEQ ID:12466, to the nucleotide sequence of VGAM1965 RNA, herein designated VGAM RNA, also designated SEQ ID:4676.

Another function of VGAM1965 is therefore inhibition of A Kinase (PRKA) Anchor Protein 8 (AKAP8, Accession NM_005858). Accordingly, utilities of VGAM1965 include diagnosis, prevention and treatment of diseases and clinical conditions associated with AKAP8. Adaptor-related Protein Complex 4, Epsilon 1 Subunit (AP4E1, Accession NM_007347) is another VGAM1965 host target gene. AP4E1 BINDING SITE is HOST TARGET binding site found in the 3' untranslated region of mRNA encoded by AP4E1, corresponding to a HOST TARGET binding site such as BINDING SITE I, BINDING SITE II or BINDING SITE III. Table 2 illustrates the complementarity of the nucleotide sequences of AP4E1 BINDING SITE, designated SEQ ID:14277, to the nucleotide sequence of VGAM1965 RNA, herein designated VGAM RNA, also designated SEQ ID:4676.

Another function of VGAM1965 is therefore inhibition of Adaptor-related Protein Complex 4, Epsilon 1 Subunit (AP4E1, Accession NM_007347). Accordingly, utilities of VGAM1965 include diagnosis, prevention and treatment of diseases and clinical conditions associated with AP4E1. Apolipoprotein L, 4 (APOL4, Accession NM_030643) is another VGAM1965 host target gene. APOL4 BINDING SITE is HOST TARGET binding site found in the 5' untranslated region of mRNA encoded by APOL4, corresponding to a HOST TARGET binding site such as BINDING SITE I, BINDING SITE II or BINDING SITE III. Table 2 illustrates the complementarity of the nucleotide sequences of APOL4 BINDING SITE, designated SEQ ID:24978, to the nucleotide sequence of VGAM1965 RNA, herein designated VGAM RNA, also designated SEQ ID:4676.

Another function of VGAM1965 is therefore inhibition of Apolipoprotein L, 4 (APOL4, Accession NM_030643). Accordingly, utilities of VGAM1965 include diagnosis, prevention and treatment of diseases and clinical conditions associated with APOL4. Apolipoprotein L, 6 (APOL6, Accession NM_030641) is another VGAM1965 host target gene. APOL6 BINDING SITE is HOST TARGET binding site found in the 3' untranslated region of mRNA encoded by APOL6, corresponding to a HOST TARGET binding site such as BINDING SITE I, BINDING SITE II or BINDING SITE III. Table 2 illustrates the complementarity of the nucleotide sequences of APOL6 BINDING SITE, designated SEQ ID:24972, to the nucleotide sequence of VGAM1965 RNA, herein designated VGAM RNA, also designated SEQ ID:4676.

Another function of VGAM1965 is therefore inhibition of Apolipoprotein L, 6 (APOL6, Accession NM_030641). Accordingly, utilities of VGAM1965 include diagnosis, prevention and treatment of diseases and clinical conditions associated with APOL6. ARHGAP10 (Accession NM_020824) is another VGAM1965 host target gene. ARHGAP10 BINDING SITE is HOST TARGET binding site found in the 3' untranslated region of mRNA encoded by ARHGAP10, corresponding to a HOST TARGET binding site such as BINDING SITE I, BINDING SITE II or BINDING SITE III. Table 2 illustrates the complementarity of the nucleotide sequences of ARHGAP10 BINDING SITE, designated SEQ ID:21886, to the nucleotide sequence of VGAM1965 RNA, herein designated VGAM RNA, also designated SEQ ID:4676.

Another function of VGAM1965 is therefore inhibition of ARHGAP10 (Accession NM_020824). Accordingly, utilities of VGAM1965 include diagnosis, prevention and treatment of diseases and clinical conditions associated with ARHGAP10. ATPase, H+ Transporting, Lysosomal V0 Subunit A Isoform 1 (ATP6V0A1, Accession NM_005177) is another VGAM1965 host target gene. ATP6V0A1 BINDING SITE is HOST TARGET binding site found in the 3' untranslated region of mRNA encoded by ATP6V0A1, corresponding to a HOST TARGET binding site such as BINDING SITE I, BINDING SITE II or BINDING SITE III. Table 2 illustrates the complementarity of the nucleotide sequences of ATP6V0A1 BINDING SITE, designated SEQ ID:11677, to the nucleotide sequence of VGAM1965 RNA, herein designated VGAM RNA, also designated SEQ ID:4676.

Another function of VGAM1965 is therefore inhibition of ATPase, H+ Transporting, Lysosomal V0 Subunit A Isoform 1 (ATP6V0A1, Accession NM_005177). Accordingly, utilities of VGAM1965 include diagnosis, prevention and treatment of diseases and clinical conditions associated with ATP6V0A1. UDP-GlcNAc:betaGal Beta-1,3-N-acetylglucosaminyltransferase 5 (B3GNT5, Accession NM_032047) is another VGAM1965 host target gene. B3GNT5 BINDING SITE is HOST TARGET binding site found in the 3' untranslated region of mRNA encoded by B3GNT5, corresponding to a HOST TARGET binding site such as BINDING SITE I, BINDING SITE II or BINDING SITE III. Table 2 illustrates the complementarity of the nucleotide sequences of B3GNT5 BINDING SITE, designated SEQ ID:25765, to the nucleotide sequence of VGAM1965 RNA, herein designated VGAM RNA, also designated SEQ ID:4676.

Another function of VGAM1965 is therefore inhibition of UDP-GlcNAc:betaGal Beta-1,3-N-acetylglucosaminyltransferase 5 (B3GNT5, Accession NM_032047). Accordingly, utilities of VGAM1965 include diagnosis, prevention and treatment of diseases and clinical conditions associated with B3GNT5. BDG-29 (Accession XM_051343) is another VGAM1965 host target gene. BDG-29 BINDING SITE1 and BDG-29 BINDING SITE2 are HOST TARGET binding sites found in untranslated regions of mRNA encoded by BDG-29, corresponding to HOST TARGET binding sites such as BINDING SITE I, BINDING SITE II or BINDING SITE III. Table 2 illustrates the complementarity of the nucleotide sequences of BDG-29 BINDING SITE1 and BDG-29 BINDING SITE2, designated SEQ ID:35817 and SEQ ID:35812 respectively, to the nucleotide sequence of VGAM1965 RNA, herein designated VGAM RNA, also designated SEQ ID:4676.

Another function of VGAM1965 is therefore inhibition of BDG-29 (Accession XM_051343). Accordingly, utilities of VGAM1965 include diagnosis, prevention and treatment of diseases and clinical conditions associated with BDG-29. Burkitt Lymphoma Receptor 1, GTP Binding Protein (chemokine (C-X-C motif) Receptor 5) (BLR1, Accession NM_032966) is another VGAM1965 host target gene. BLR1 BINDING SITE1 and BLR1 BINDING SITE2 are HOST TARGET binding sites found in untranslated regions of mRNA encoded by BLR1, corresponding to HOST TARGET binding sites such as BINDING SITE I, BINDING SITE II or BINDING SITE III. Table 2 illustrates the complementarity of the nucleotide sequences of BLR1 BINDING SITE1 and BLR1 BINDING SITE2, designated SEQ ID:26779 and SEQ ID:7449 respectively, to the nucleotide sequence of VGAM1965 RNA, herein designated VGAM RNA, also designated SEQ ID:4676.

Another function of VGAM1965 is therefore inhibition of Burkitt Lymphoma Receptor 1, GTP Binding Protein (chemokine (C-X-C motif) Receptor 5) (BLR1, Accession NM_032966). Accordingly, utilities of VGAM1965 include diagnosis, prevention and treatment of diseases and clinical conditions associated with BLR1. BTB (POZ) Domain Containing 1 (BTBD1, Accession NM_025238) is another VGAM1965 host target gene. BTBD1 BINDING SITE is HOST TARGET binding site found in the 3' untranslated region of mRNA encoded by BTBD1, corresponding to a HOST TARGET binding site such as BINDING SITE I, BINDING SITE II or BINDING SITE III. Table 2 illustrates the complementarity of the nucleotide sequences of BTBD1 BINDING SITE, designated SEQ ID:24920, to the nucleotide sequence of VGAM1965 RNA, herein designated VGAM RNA, also designated SEQ ID:4676.

Another function of VGAM1965 is therefore inhibition of BTB (POZ) Domain Containing 1 (BTBD1, Accession NM_025238). Accordingly, utilities of VGAM1965 include diagnosis, prevention and treatment of diseases and clinical conditions associated with BTBD1. Butyrophilin, Subfamily 1, Member A1 (BTN1A1, Accession NM_001732) is another VGAM1965 host target gene. BTN1A1 BINDING SITE is HOST TARGET binding site found in the 3' untranslated region of mRNA encoded by BTN1A1, corresponding to a HOST TARGET binding site such as BINDING SITE I, BINDING SITE II or BINDING SITE III. Table 2 illustrates the complementarity of the nucleotide sequences of BTN1A1 BINDING SITE, designated SEQ ID:7470, to the nucleotide sequence of VGAM1965 RNA, herein designated VGAM RNA, also designated SEQ ID:4676.

Another function of VGAM1965 is therefore inhibition of Butyrophilin, Subfamily 1, Member A1 (BTN1A1, Accession NM_001732). Accordingly, utilities of VGAM1965 include diagnosis, prevention and treatment of diseases and clinical conditions associated with BTN1A1. Chromosome 14 Open Reading Frame 4 (C14orf4, Accession XM_041104) is another VGAM1965 host target gene. C14orf4 BINDING SITE is HOST TARGET binding site found in the 5' untranslated region of mRNA encoded by C14orf4, corresponding to a HOST TARGET binding site such as BINDING SITE I, BINDING SITE II or BINDING SITE III. Table 2 illustrates the complementarity of the nucleotide sequences of C14orf4 BINDING SITE, designated SEQ ID:33446, to the nucleotide sequence of VGAM1965 RNA, herein designated VGAM RNA, also designated SEQ ID:4676.

Another function of VGAM1965 is therefore inhibition of Chromosome 14 Open Reading Frame 4 (C14orf4, Accession XM_041104). Accordingly, utilities of VGAM1965 include diagnosis, prevention and treatment of diseases and clinical conditions associated with C14orf4. Chromosome 16 Open Reading Frame 7 (C16orf7, Accession NM_004913) is another VGAM1965 host target gene. C16orf7 BINDING SITE is HOST TARGET binding site found in the 3' untranslated region of mRNA encoded by C16orf7, corresponding to a HOST TARGET binding site such as BINDING SITE I, BINDING SITE II or BINDING SITE III. Table 2 illustrates the complementarity of the nucleotide sequences of C16orf7 BINDING SITE, designated SEQ ID:11346, to the nucleotide sequence of VGAM1965 RNA, herein designated VGAM RNA, also designated SEQ ID:4676.

Another function of VGAM1965 is therefore inhibition of Chromosome 16 Open Reading Frame 7 (C16orf7, Accession NM_004913). Accordingly, utilities of VGAM1965 include diagnosis, prevention and treatment of diseases and clinical conditions associated with C16orf7. Chromosome 17 Open Reading Frame 26 (C17orf26, Accession NM_139177) is another VGAM1965 host target gene. C17orf26 BINDING SITE is HOST TARGET binding site found in the 3' untranslated region of mRNA encoded by C17orf26, corresponding to a HOST TARGET binding site such as BINDING SITE I, BINDING SITE II or BINDING SITE III. Table 2 illustrates the complementarity of the nucleotide sequences of C17orf26 BINDING SITE, designated SEQ ID:29188, to the nucleotide sequence of VGAM1965 RNA, herein designated VGAM RNA, also designated SEQ ID:4676.

Another function of VGAM1965 is therefore inhibition of Chromosome 17 Open Reading Frame 26 (C17orf26, Accession NM_139177). Accordingly, utilities of VGAM1965 include diagnosis, prevention and treatment of diseases and clinical conditions associated with C17orf26. Chromosome 1 Open Reading Frame 16 (C1orf16, Accession NM_014837) is another VGAM1965 host target gene. C1orf16 BINDING SITE is HOST TARGET binding site found in the 3' untranslated region of mRNA encoded by C1orf16, corresponding to a HOST TARGET binding site such as BINDING SITE I, BINDING SITE II or BINDING SITE III. Table 2 illustrates the complementarity of the nucleotide sequences of C1orf16 BINDING SITE, designated SEQ ID:16860, to the nucleotide sequence of VGAM1965 RNA, herein designated VGAM RNA, also designated SEQ ID:4676.

Another function of VGAM1965 is therefore inhibition of Chromosome 1 Open Reading Frame 16 (C1orf16, Accession NM_014837). Accordingly, utilities of VGAM1965 include diagnosis, prevention and treatment of diseases and clinical conditions associated with C1orf16. Chromosome 1 Open Reading Frame 24 (C1orf24, Accession NM_052966) is another VGAM1965 host target gene. C1orf24 BINDING SITE is HOST TARGET binding site found in the 3' untranslated region of mRNA encoded by C1orf24, corresponding to a HOST TARGET binding site such as BINDING SITE I, BINDING SITE II or BINDING SITE III. Table 2 illustrates the complementarity of the nucleotide sequences of C1orf24 BINDING SITE, designated SEQ ID:27535, to the nucleotide sequence of VGAM1965 RNA, herein designated VGAM RNA, also designated SEQ ID:4676.

Another function of VGAM1965 is therefore inhibition of Chromosome 1 Open Reading Frame 24 (C1orf24, Accession NM_052966). Accordingly, utilities of VGAM1965 include diagnosis, prevention and treatment of diseases and clinical conditions associated with C1orf24. Chromosome 1 Open Reading Frame 25 (C1orf25, Accession XM_051868) is another VGAM1965 host target gene. C1orf25 BINDING SITE is HOST TARGET binding site found in the 3' untranslated region of mRNA encoded by C1orf25, corresponding to a HOST TARGET binding site such as BINDING SITE I, BINDING SITE II or BINDING SITE III. Table 2 illustrates the complementarity of the nucleotide sequences of C1orf25 BINDING SITE, designated SEQ ID:35911, to the nucleotide sequence of VGAM1965 RNA, herein designated VGAM RNA, also designated SEQ ID:4676.

Another function of VGAM1965 is therefore inhibition of Chromosome 1 Open Reading Frame 25 (C1orf25, Accession XM_051868). Accordingly, utilities of VGAM1965 include diagnosis, prevention and treatment of diseases and clinical conditions associated with C1orf25. Chromosome 1 Open Reading Frame 34 (C1orf34, Accession XM_027172) is another VGAM1965 host target gene. C1orf34 BINDING SITE is HOST TARGET binding site found in the 3' untranslated region of mRNA encoded by C1orf34, corresponding to a HOST TARGET binding site such as BINDING SITE I, BINDING SITE II or BINDING SITE III. Table 2 illustrates the complementarity of the nucleotide sequences of C1orf34 BINDING SITE, designated SEQ ID:30440, to the nucleotide sequence of VGAM1965 RNA, herein designated VGAM RNA, also designated SEQ ID:4676.

Another function of VGAM1965 is therefore inhibition of Chromosome 1 Open Reading Frame 34 (C1orf34, Accession XM_027172). Accordingly, utilities of VGAM1965 include diagnosis, prevention and treatment of diseases and clinical conditions associated with C1orf34. Chromosome 20 Open Reading Frame 12 (C20orf12, Accession NM_018152) is another VGAM1965 host target gene. C20orf12 BINDING SITE is HOST TARGET binding site found in the 5' untranslated region of mRNA encoded by C20orf12, corresponding to a HOST TARGET binding site such as BINDING SITE I, BINDING SITE II or BINDING SITE III. Table 2 illustrates the complementarity of the nucleotide sequences of C20orf12 BINDING SITE, designated SEQ ID:19961, to the nucleotide sequence of VGAM1965 RNA, herein designated VGAM RNA, also designated SEQ ID:4676.

Another function of VGAM1965 is therefore inhibition of Chromosome 20 Open Reading Frame 12 (C20orf12, Accession NM_018152). Accordingly, utilities of VGAM1965 include diagnosis, prevention and treatment of diseases and clinical conditions associated with C20orf12. Chromosome 20 Open Reading Frame 121 (C20orf121, Accession NM_024331) is another VGAM1965 host target gene. C20orf121 BINDING SITE is HOST TARGET binding site found in the 3" untranslated region of mRNA encoded by C20orf121, corresponding to a HOST TARGET binding site such as BINDING SITE I, BINDING SITE II or BINDING SITE III. Table 2 illustrates the complementarity of the nucleotide sequences of C20orf121 BINDING SITE, designated SEQ ID:23631, to the nucleotide sequence of VGAM1965 RNA, herein designated VGAM RNA, also designated SEQ ID:4676.

Another function of VGAM1965 is therefore inhibition of Chromosome 20 Open Reading Frame 121 (C20orf121, Accession NM_024331). Accordingly, utilities of VGAM1965 include diagnosis, prevention and treatment of diseases and clinical conditions associated with C20orf121. Chromosome 20 Open Reading Frame 124 (C20orf124, Accession NM_024777) is another VGAM1965 host target gene. C20orf124 BINDING SITE is HOST TARGET binding site found in the 5" untranslated region of mRNA encoded by C20orf124, corresponding to a HOST TARGET binding site such as BINDING SITE I, BINDING SITE II or BINDING SITE III. Table 2 illustrates the complementarity of the nucleotide sequences of C20orf124 BINDING SITE, designated SEQ ID:24145, to the nucleotide sequence of VGAM1965 RNA, herein designated VGAM RNA, also designated SEQ ID:4676.

Another function of VGAM1965 is therefore inhibition of Chromosome 20 Open Reading Frame 124 (C20orf124, Accession NM_024777). Accordingly, utilities of VGAM1965 include diagnosis, prevention and treatment of diseases and clinical conditions associated with C20orf124. Chromosome 20 Open Reading Frame 126 (C20orf126, Accession NM_030815) is another VGAM1965 host target gene. C20orf126 BINDING SITE is HOST TARGET binding site found in the 3" untranslated region of mRNA encoded by C20orf126, corresponding to a HOST TARGET binding site such as BINDING SITE I, BINDING SITE II or BINDING SITE III. Table 2 illustrates the complementarity of the nucleotide sequences of C20orf126 BINDING SITE, designated SEQ ID:25136, to the nucleotide sequence of VGAM1965 RNA, herein designated VGAM RNA, also designated SEQ ID:4676.

Another function of VGAM1965 is therefore inhibition of Chromosome 20 Open Reading Frame 126 (C20orf126, Accession NM_030815). Accordingly, utilities of VGAM1965 include diagnosis, prevention and treatment of diseases and clinical conditions associated with C20orf126 . Chromosome 20 Open Reading Frame 162 (C20orf162, Accession NM_080603) is another VGAM1965 host target gene. C20orf162 BINDING SITE is HOST TARGET binding site found in the 5" untranslated region of mRNA encoded by C20orf162, corresponding to a HOST TARGET binding site such as BINDING SITE I, BINDING SITE II or BINDING SITE III. Table 2 illustrates the complementarity of the nucleotide sequences of C20orf162 BINDING SITE, designated SEQ ID:27920, to the nucleotide sequence of VGAM1965 RNA, herein designated VGAM RNA, also designated SEQ ID:4676.

Another function of VGAM1965 is therefore inhibition of Chromosome 20 Open Reading Frame 162 (C20orf162, Accession NM_080603). Accordingly, utilities of VGAM1965 include diagnosis, prevention and treatment of diseases and clinical conditions associated with C20orf162. Chromosome 20 Open Reading Frame 39 (C20orf39, Accession NM_024893) is another VGAM1965 host target gene. C20orf39 BINDING SITE is HOST TARGET binding site found in the 3' untranslated region of mRNA encoded by C20orf39, corresponding to a HOST TARGET binding site such as BINDING SITE I, BINDING SITE II or BINDING SITE III. Table 2 illustrates the complementarity of the nucleotide sequences of C20orf39 BINDING SITE, designated SEQ ID:24370, to the nucleotide sequence of VGAM1965 RNA, herein designated VGAM RNA, also designated SEQ ID:4676.

Another function of VGAM1965 is therefore inhibition of Chromosome 20 Open Reading Frame 39 (C20orf39, Accession NM_024893). Accordingly, utilities of VGAM1965 include diagnosis, prevention and treatment of diseases and clinical conditions associated with C20orf39. Chromosome 20 Open Reading Frame 43 (C20orf43, Accession XM_009549) is another VGAM1965 host target gene. C20orf43 BINDING SITE is HOST TARGET binding site found in the 3' untranslated region of mRNA encoded by C20orf43, corresponding to a HOST TARGET binding site such as BINDING SITE I, BINDING SITE II or BINDING SITE III. Table 2 illustrates the complementarity of the nucleotide sequences of C20orf43 BINDING SITE, designated SEQ ID:30114, to the nucleotide sequence of VGAM1965 RNA, herein designated VGAM RNA, also designated SEQ ID:4676.

Another function of VGAM1965 is therefore inhibition of Chromosome 20 Open Reading Frame 43 (C20orf43, Accession XM_009549). Accordingly, utilities of VGAM1965 include diagnosis, prevention and treatment of diseases and clinical conditions associated with C20orf43. Chromosome 20 Open Reading Frame 60 (C20orf60, Accession NM_052970) is another VGAM1965 host target gene. C20orf60 BINDING SITE1 and C20orf60 BINDING SITE2 are HOST TARGET binding sites found in untranslated regions of mRNA encoded by C20orf60, corresponding to HOST TARGET binding sites such as BINDING SITE I, BINDING SITE II or BINDING SITE III. Table 2 illustrates the complementarity of the nucleotide sequences of C20orf60 BINDING SITE1 and C20orf60 BINDING SITE2, designated SEQ ID:27541 and SEQ ID:27542 respectively, to the nucleotide sequence of VGAM1965 RNA, herein designated VGAM RNA, also designated SEQ ID:4676.

Another function of VGAM1965 is therefore inhibition of Chromosome 20 Open Reading Frame 60 (C20orf60, Accession NM_052970). Accordingly, utilities of VGAM1965 include diagnosis, prevention and treatment of diseases and clinical conditions associated with C20orf60. Chromosome 21 Open Reading Frame 100 (C21orf100, Accession NM_145033) is another VGAM1965 host target gene. C21orf100 BINDING SITE is HOST TARGET binding site found in the 3" untranslated region of mRNA encoded by C21orf100, corresponding to a HOST TARGET binding site such as BINDING SITE I, BINDING SITE II or BINDING SITE III. Table 2 illustrates the complementarity of the nucleotide sequences of C21orf100 BINDING SITE, designated SEQ ID:29649, to the nucleotide sequence of VGAM1965 RNA, herein designated VGAM RNA, also designated SEQ ID:4676.

Another function of VGAM1965 is therefore inhibition of Chromosome 21 Open Reading Frame 100 (C21orf100, Accession NM_145033). Accordingly, utilities of VGAM1965 include diagnosis, prevention and treatment of diseases and clinical conditions associated with C21orf100. Chromosome 21 Open Reading Frame 41 (C21orf41, Accession NM_138332) is another VGAM1965 host target gene. C21orf41 BINDING SITE is HOST TARGET binding site found in the 3' untranslated region of mRNA encoded by C21orf41, corresponding to a HOST TARGET binding site such as BINDING SITE I, BINDING SITE II or BINDING SITE III. Table 2 illustrates the complementarity of the nucleotide sequences of C21orf41 BINDING SITE, designated SEQ ID:28731, to the nucleotide sequence of VGAM1965 RNA, herein designated VGAM RNA, also designated SEQ ID:4676.

Another function of VGAM1965 is therefore inhibition of Chromosome 21 Open Reading Frame 41 (C21orf41, Accession NM_138332). Accordingly, utilities of VGAM1965 include diagnosis, prevention and treatment of diseases and clinical conditions associated with C21orf41. Chromosome 21 Open Reading Frame 7 (C21orf7, Accession NM_020152) is another VGAM1965 host target gene. C21orf7 BINDING SITE is HOST TARGET binding site found in the 3' untranslated region of mRNA encoded by C21orf7, corresponding to a HOST TARGET binding site such as BINDING SITE I, BINDING SITE II or BINDING SITE III. Table 2 illustrates the complementarity of the nucleotide sequences of C21orf7 BINDING SITE, designated SEQ ID:21363, to the nucleotide sequence of VGAM1965 RNA, herein designated VGAM RNA, also designated SEQ ID:4676.

Another function of VGAM1965 is therefore inhibition of Chromosome 21 Open Reading Frame 7 (C21orf7, Accession NM_020152). Accordingly, utilities of VGAM1965 include diagnosis, prevention and treatment of diseases and clinical conditions associated with C21orf7. Chromosome 5 Open Reading Frame 7 (C5orf7, Accession XM_033576) is another VGAM1965 host target gene. C5orf7 BINDING SITE is HOST TARGET binding site found in the 3' untranslated region of mRNA encoded by C5orf7, corresponding to a HOST TARGET binding site such as BINDING SITE I, BINDING SITE II or BINDING SITE III. Table 2 illustrates the complementarity of the nucleotide sequences of C5orf7 BINDING SITE, designated SEQ ID:31943, to the nucleotide sequence of VGAM1965 RNA, herein designated VGAM RNA, also designated SEQ ID:4676.

Another function of VGAM1965 is therefore inhibition of Chromosome 5 Open Reading Frame 7 (C5orf7, Accession XM_033576). Accordingly, utilities of VGAM1965 include diagnosis, prevention and treatment of diseases and clinical conditions associated with C5orf7. Chromosome 6 Open Reading Frame 9 (C6orf9, Accession NM_022107) is another VGAM1965 host target gene. C6orf9 BINDING SITE is HOST TARGET binding site found in the 3' untranslated region of mRNA encoded by C6orf9, corresponding to a HOST TARGET binding site such as BINDING SITE I, BINDING SITE II or BINDING SITE III. Table 2 illustrates the complementarity of the nucleotide sequences of C6orf9 BINDING SITE, designated SEQ ID:22655, to the nucleotide sequence of VGAM1965 RNA, herein designated VGAM RNA, also designated SEQ ID:4676.

Another function of VGAM1965 is therefore inhibition of Chromosome 6 Open Reading Frame 9 (C6orf9, Accession NM_022107). Accordingly, utilities of VGAM1965 include diagnosis, prevention and treatment of diseases and clinical conditions associated with C6orf9. Chromosome 8 Open Reading Frame 14 (C8orf14, Accession NM_054029) is another VGAM1965 host target gene. C8orf14 BINDING SITE is HOST TARGET binding site found in the 5' untranslated region of mRNA encoded by C8orf14, corresponding to a HOST TARGET binding site such as BINDING SITE I, BINDING SITE II or BINDING SITE III. Table 2 illustrates the complementarity of the nucleotide sequences of C8orf14 BINDING SITE, designated SEQ ID:27641, to the nucleotide sequence of VGAM1965 RNA, herein designated VGAM RNA, also designated SEQ ID:4676.

Another function of VGAM1965 is therefore inhibition of Chromosome 8 Open Reading Frame 14 (C8orf14, Accession NM_054029). Accordingly, utilities of VGAM1965 include diagnosis, prevention and treatment of diseases and clinical conditions associated with C8orf14. Chromosome 8 Open Reading Frame 7 (C8orf7, Accession XM_088376) is another VGAM1965 host target gene. C8orf7 BINDING SITE is HOST TARGET binding site found in the 3' untranslated region of mRNA encoded by C8orf7, corresponding to a HOST TARGET binding site such as BINDING SITE I, BINDING SITE II or BINDING SITE III. Table 2 illustrates the complementarity of the nucleotide sequences of C8orf7 BINDING SITE, designated SEQ ID:39649, to the nucleotide sequence of VGAM1965 RNA, herein designated VGAM RNA, also designated SEQ ID:4676.

Another function of VGAM1965 is therefore inhibition of Chromosome 8 Open Reading Frame 7 (C8orf7, Accession XM_088376). Accordingly, utilities of VGAM1965 include diagnosis, prevention and treatment of diseases and clinical conditions associated with C8orf7. Chromosome 9 Open Reading Frame 7 (C9orf7, Accession NM_017586) is another VGAM1965 host target gene. C9orf7 BINDING SITE is HOST TARGET binding site found in the 3' untranslated region of mRNA encoded by C9orf7, corresponding to a HOST TARGET binding site such as BINDING SITE I, BINDING SITE II or BINDING SITE III. Table 2 illustrates the complementarity of the nucleotide sequences of C9orf7 BINDING SITE, designated SEQ ID:19037, to the nucleotide sequence of VGAM1965 RNA, herein designated VGAM RNA, also designated SEQ ID:4676.

Another function of VGAM1965 is therefore inhibition of Chromosome 9 Open Reading Frame 7 (C9orf7, Accession NM_017586). Accordingly, utilities of VGAM1965 include diagnosis, prevention and treatment of diseases and clinical conditions associated with C9orf7. CAPN13 (Accession NM_144575) is another VGAM1965 host target gene. CAPN13 BINDING SITE is HOST TARGET binding site found in the 3' untranslated region of mRNA encoded by CAPN13, corresponding to a HOST TARGET binding site such as BINDING SITE I, BINDING SITE II or BINDING SITE III. Table 2 illustrates the complementarity of the nucleotide sequences of CAPN13 BINDING SITE, designated SEQ ID:29381, to the nucleotide sequence of VGAM1965 RNA, herein designated VGAM RNA, also designated SEQ ID:4676.

Another function of VGAM1965 is therefore inhibition of CAPN13 (Accession NM_144575). Accordingly, utilities of VGAM1965 include diagnosis, prevention and treatment of diseases and clinical conditions associated with CAPN13. Chromobox Homolog 6 (CBX6, Accession NM_014292) is another VGAM1965 host target gene. CBX6 BINDING SITE is HOST TARGET binding site found in the 3' untranslated region of mRNA encoded by CBX6, corresponding to a HOST TARGET binding site such as BINDING SITE I, BINDING SITE II or BINDING SITE III. Table 2 illustrates the complementarity of the nucleotide sequences of CBX6 BINDING SITE, designated SEQ ID:15578, to the nucleotide sequence of VGAM1965 RNA, herein designated VGAM RNA, also designated SEQ ID:4676.

Another function of VGAM1965 is therefore inhibition of Chromobox Homolog 6 (CBX6, Accession NM_014292). Accordingly, utilities of VGAM1965 include diagnosis, prevention and treatment of diseases and clinical conditions associated with CBX6. Chemokine (C-C motif) Receptor 6 (CCR6, Accession NM_004367) is another VGAM1965 host target gene. CCR6 BINDING SITE1 through CCR6 BINDING SITE4 are HOST TARGET binding sites found in untranslated regions of mRNA encoded by CCR6, corresponding to HOST TARGET binding sites such as BINDING SITE I, BINDING SITE II or BINDING SITE III. Table 2 illustrates the complementarity of the nucleotide sequences of CCR6 BINDING SITE1 through CCR6 BINDING SITE4, designated SEQ ID:10581, SEQ ID:10582, SEQ ID:25376 and SEQ ID:25377 respectively, to the nucleotide sequence of VGAM1965 RNA, herein designated VGAM RNA, also designated SEQ ID:4676.

Another function of VGAM1965 is therefore inhibition of Chemokine (C-C motif) Receptor 6 (CCR6, Accession NM_004367). Accordingly, utilities of VGAM1965 include diagnosis, prevention and treatment of diseases and clinical conditions associated with CCR6. CDV-1 (Accession NM_031473) is another VGAM1965 host target gene. CDV-1 BINDING SITE1 and CDV-1 BINDING SITE2 are HOST TARGET binding sites found in untranslated regions of mRNA encoded by CDV-1, corresponding to HOST TARGET binding sites such as BINDING SITE I, BINDING SITE II or BINDING SITE III. Table 2 illustrates the complementarity of the nucleotide sequences of CDV-1 BINDING SITE1 and CDV-1 BINDING SITE2, designated SEQ ID:25542 and SEQ ID:40487 respectively, to the nucleotide sequence of VGAM1965 RNA, herein designated VGAM RNA, also designated SEQ ID:4676.

Another function of VGAM1965 is therefore inhibition of CDV-1 (Accession NM_031473). Accordingly, utilities of VGAM1965 include diagnosis, prevention and treatment of diseases and clinical conditions associated with CDV-1. CHRNA7 (cholinergic receptor, nicotinic, alpha polypeptide 7, exons 5-10) and FAM7A (family with sequence similarity 7A, exons A-E) Fusion (CHRFAM7A, Accession XM_170784) is another VGAM1965 host target gene. CHRFAM7A BINDING SITE is HOST TARGET binding site found in the 3' untranslated region of mRNA encoded by CHRFAM7A, corresponding to a HOST TARGET binding site such as BINDING SITE I, BINDING SITE II or BINDING SITE III. Table 2 illustrates the complementarity of the nucleotide sequences of CHRFAM7A BINDING SITE, designated SEQ ID:45551, to the nucleotide sequence of VGAM1965 RNA, herein designated VGAM RNA, also designated SEQ ID:4676.

Another function of VGAM1965 is therefore inhibition of CHRNA7 (cholinergic receptor, nicotinic, alpha polypeptide 7, exons 5-10) and FAM7A (family with sequence similarity 7A, exons A-E) Fusion (CHRFAM7A, Accession XM_170784). Accordingly, utilities of VGAM1965 include diagnosis, prevention and treatment of diseases and clinical conditions associated with CHRFAM7A. Carbohydrate (chondroitin 6) Sulfotransferase 3 (CHST3, Accession NM_004273) is another VGAM1965 host target gene. CHST3 BINDING SITE is HOST TARGET binding site found in the 3' untranslated region of mRNA encoded by CHST3, corresponding to a HOST TARGET binding site such as BINDING SITE I, BINDING SITE II or BINDING SITE III. Table 2 illustrates the complementarity of the nucleotide sequences of CHST3 BINDING SITE, designated SEQ ID:10483, to the nucleotide sequence of VGAM1965 RNA, herein designated VGAM RNA, also designated SEQ ID:4676.

Another function of VGAM1965 is therefore inhibition of Carbohydrate (chondroitin 6) Sulfotransferase 3 (CHST3, Accession NM_004273). Accordingly, utilities of VGAM1965 include diagnosis, prevention and treatment of diseases and clinical conditions associated with CHST3. Claudin 15 (CLDN15, Accession NM_138429) is another VGAM1965 host target gene. CLDN15 BINDING SITE is HOST TARGET binding site found in the 3' untranslated region of mRNA encoded by CLDN15, corresponding to a HOST TARGET binding site such as BINDING SITE I, BINDING SITE II or BINDING SITE III. Table 2 illustrates the complementarity of the nucleotide sequences of CLDN15 BINDING SITE, designated SEQ ID:28794, to the nucleotide sequence of VGAM1965 RNA, herein designated VGAM RNA, also designated SEQ ID:4676.

Another function of VGAM1965 is therefore inhibition of Claudin 15 (CLDN15, Accession NM_138429). Accordingly, utilities of VGAM1965 include diagnosis, prevention and treatment of diseases and clinical conditions associated with CLDN15. C-type (calcium dependent, carbohydrate-recognition domain) Lectin, Superfamily Member 9 (CLECSF9, Accession NM_014358) is another VGAM1965 host target gene. CLECSF9 BINDING SITE is HOST TARGET binding site found in the 3' untranslated region of mRNA encoded by CLECSF9, corresponding to a HOST TARGET binding site such as BINDING SITE I, BINDING SITE II or BINDING SITE III. Table 2 illustrates the complementarity of the nucleotide sequences of CLECSF9 BINDING SITE, designated SEQ ID:15689, to the nucleotide sequence of VGAM1965 RNA, herein designated VGAM RNA, also designated SEQ ID:4676.

Another function of VGAM1965 is therefore inhibition of C-type (calcium dependent, carbohydrate-recognition domain) Lectin, Superfamily Member 9 (CLECSF9, Accession NM_014358). Accordingly, utilities of VGAM1965 include diagnosis, prevention and treatment of diseases and clinical conditions associated with CLECSF9. Chloride Intracellular Channel 5 (CLIC5, Accession NM_016929) is another VGAM1965 host target gene. CLIC5 BINDING SITE is HOST TARGET binding site found in the 3' untranslated region of mRNA encoded by CLIC5, corresponding to a HOST TARGET binding site such as BINDING SITE I, BINDING SITE II or BINDING SITE III. Table 2 illustrates the complementarity of the nucleotide sequences of CLIC5 BINDING SITE, designated SEQ ID:18848, to the nucleotide sequence of VGAM1965 RNA, herein designated VGAM RNA, also designated SEQ ID:4676.

Another function of VGAM1965 is therefore inhibition of Chloride Intracellular Channel 5 (CLIC5, Accession NM_016929). Accordingly, utilities of VGAM1965 include diagnosis, prevention and treatment of diseases and clinical conditions associated with CLIC5. Cyclin M4 (CNNM4, Accession NM_020184) is another VGAM1965 host target gene. CNNM4 BINDING SITE is HOST TARGET binding site found in the 3' untranslated region of mRNA encoded by CNNM4, corresponding to a HOST TARGET binding site such as BINDING SITE I, BINDING SITE II or BINDING SITE III. Table 2 illustrates the complementarity of the nucleotide sequences of CNNM4 BINDING SITE, designated SEQ ID:21429, to the nucleotide sequence of VGAM1965 RNA, herein designated VGAM RNA, also designated SEQ ID:4676.

Another function of VGAM1965 is therefore inhibition of Cyclin M4 (CNNM4, Accession NM_020184). Accordingly, utilities of VGAM1965 include diagnosis, prevention and treatment of diseases and clinical conditions associated with CNNM4. CCR4-NOT Transcription Complex, Subunit 3 (CNOT3, Accession NM_014516) is another VGAM1965 host target gene. CNOT3 BINDING SITE is HOST TARGET binding site found in the 5' untranslated region of mRNA encoded by CNOT3, corresponding to a HOST TARGET binding site such as BINDING SITE I, BINDING SITE II or BINDING SITE III. Table 2 illustrates the complementarity of the nucleotide sequences of CNOT3 BINDING SITE, designated SEQ ID:15844, to the nucleotide sequence of VGAM1965 RNA, herein designated VGAM RNA, also designated SEQ ID:4676.

Another function of VGAM1965 is therefore inhibition of CCR4-NOT Transcription Complex, Subunit 3 (CNOT3, Accession NM_014516). Accordingly, utilities of VGAM1965 include diagnosis, prevention and treatment of diseases and clinical conditions associated with CNOT3. CUB and Sushi Multiple Domains 1 (CSMD1, Accession XM_054838) is another VGAM1965 host target gene. CSMD1 BINDING SITE is HOST TARGET binding site found in the 3' untranslated region of mRNA encoded by CSMD1, corresponding to a HOST TARGET binding site such as BINDING SITE I, BINDING SITE II or BINDING SITE III. Table 2 illustrates the complementarity of the nucleotide sequences of CSMD1 BINDING SITE, designated SEQ ID:36195, to the nucleotide sequence of VGAM1965 RNA, herein designated VGAM RNA, also designated SEQ ID:4676.

Another function of VGAM1965 is therefore inhibition of CUB and Sushi Multiple Domains 1 (CSMD1, Accession XM_054838). Accordingly, utilities of VGAM1965 include diagnosis, prevention and treatment of diseases and clinical conditions associated with CSMD1. DAMS (Accession NM_022001) is another VGAM1965 host target gene. DAMS BINDING SITE is HOST TARGET binding site found in the 5' untranslated region of mRNA encoded by DAMS, corresponding to a HOST TARGET binding site such as BINDING SITE I, BINDING SITE II or BINDING SITE III. Table 2 illustrates the complementarity of the nucleotide sequences of DAMS BINDING SITE, designated SEQ ID:22544, to the nucleotide sequence of VGAM1965 RNA, herein designated VGAM RNA, also designated SEQ ID:4676.

Another function of VGAM1965 is therefore inhibition of DAMS (Accession NM_022001). Accordingly, utilities of VGAM1965 include diagnosis, prevention and treatment of diseases and clinical conditions associated with DAMS. Doublecortin and CaM Kinase-like 1 (DCAMKL1, Accession NM_004734) is another VGAM1965 host target gene. DCAMKL1 BINDING SITE is HOST TARGET binding site found in the 3' untranslated region of mRNA encoded by DCAMKL1, corresponding to a HOST TARGET binding site such as BINDING SITE I, BINDING SITE II or BINDING SITE III. Table 2 illustrates the complementarity of the nucleotide sequences of DCAMKL1 BINDING SITE, designated SEQ ID:11118, to the nucleotide sequence of VGAM1965 RNA, herein designated VGAM RNA, also designated SEQ ID:4676.

Another function of VGAM1965 is therefore inhibition of Doublecortin and CaM Kinase-like 1 (DCAMKL1, Accession NM_004734). Accordingly, utilities of VGAM1965 include diagnosis, prevention and treatment of diseases and clinical conditions associated with DCAMKL1. Degenerative Spermatocyte Homolog, Lipid Desaturase (Drosophila) (DEGS, Accession NM_003676) is another VGAM1965 host target gene. DEGS BINDING SITE is HOST TARGET binding site found in the 3' untranslated region of mRNA encoded by DEGS, corresponding to a HOST TARGET binding site such as BINDING SITE I, BINDING SITE II or BINDING SITE III. Table 2 illustrates the complementarity of the nucleotide sequences of DEGS BINDING SITE, designated SEQ ID:9770, to the nucleotide sequence of VGAM1965 RNA, herein designated VGAM RNA, also designated SEQ ID:4676.

Another function of VGAM1965 is therefore inhibition of Degenerative Spermatocyte Homolog, Lipid Desaturase (Drosophila) (DEGS, Accession NM_003676). Accordingly, utilities of VGAM1965 include diagnosis, prevention and treatment of diseases and clinical conditions associated with DEGS. DIM1 (Accession NM_006701) is another VGAM1965 host target gene. DIM1 BINDING SITE is HOST TARGET binding site found in the 3' untranslated region of mRNA encoded by DIM1, corresponding to a HOST TARGET binding site such as BINDING SITE I, BINDING SITE II or BINDING SITE III. Table 2 illustrates the complementarity of the nucleotide sequences of DIM1 BINDING SITE, designated SEQ ID:13527, to the nucleotide sequence of VGAM1965 RNA, herein designated VGAM RNA, also designated SEQ ID:4676.

Another function of VGAM1965 is therefore inhibition of DIM1 (Accession NM_006701). Accordingly, utilities of VGAM1965 include diagnosis, prevention and treatment of diseases and clinical conditions associated with DIM1. DJ122O8.2 (Accession NM_020466) is another VGAM1965 host target gene. DJ122O8.2 BINDING SITE is HOST TARGET binding site found in the 3' untranslated region of mRNA encoded by DJ122O8.2, corresponding to a HOST TARGET binding site such as BINDING SITE I, BINDING SITE II or BINDING SITE III. Table 2 illustrates the complementarity of the nucleotide sequences of DJ122O8.2 BINDING SITE, designated SEQ ID:21703, to the nucleotide sequence of VGAM1965 RNA, herein designated VGAM RNA, also designated SEQ ID:4676.

Another function of VGAM1965 is therefore inhibition of DJ122O8.2 (Accession NM_020466). Accordingly, utilities of VGAM1965 include diagnosis, prevention and treatment of diseases and clinical conditions associated with DJ122O8.2. DKFZP434A043 (Accession NM_015396) is another VGAM1965 host target gene. DKFZP434A043 BINDING SITE1 and DKFZP434A043 BINDING SITE2 are HOST TARGET binding sites found in untranslated regions of mRNA encoded by DKFZP434A043, corresponding to HOST TARGET binding sites such as BINDING SITE I, BINDING SITE II or BINDING SITE III. Table 2 illustrates the complementarity of the nucleotide sequences of DKFZP434A043 BINDING SITE1 and DKFZP434A043 BINDING SITE2, designated SEQ ID:17698 and SEQ ID:17705 respectively, to the nucleotide sequence of VGAM1965 RNA, herein designated VGAM RNA, also designated SEQ ID:4676.

Another function of VGAM1965 is therefore inhibition of DKFZP434A043 (Accession NM_015396). Accordingly, utilities of VGAM1965 include diagnosis, prevention and treatment of diseases and clinical conditions associated with DKFZP434A043. DKFZP434B1727 (Accession NM_032143) is another VGAM1965 host target gene. DKFZP434B1727 BINDING SITE is HOST TARGET binding site found in the 3' untranslated region of mRNA encoded by DKFZP434B1727, corresponding to a HOST TARGET binding site such as BINDING SITE I, BINDING SITE II or BINDING SITE III. Table 2 illustrates the complementarity of the nucleotide sequences of DKFZP434B1727 BINDING SITE, designated SEQ ID:25831, to the nucleotide sequence of VGAM1965 RNA, herein designated VGAM RNA, also designated SEQ ID:4676.

Another function of VGAM1965 is therefore inhibition of DKFZP434B1727 (Accession NM_032143). Accordingly, utilities of VGAM1965 include diagnosis, prevention and treatment of diseases and clinical conditions associated with DKFZP434B1727. DKFZP434D193 (Accession XM_114297) is another VGAM1965 host target gene. DKFZP434D193 BINDING SITE is HOST TARGET binding site found in the 3' untranslated region of mRNA encoded by DKFZP434D193, corresponding to a HOST TARGET binding site such as BINDING SITE I, BINDING SITE II or BINDING SITE III. Table 2 illustrates the complementarity of the nucleotide sequences of DKFZP434D193 BINDING SITE, designated SEQ ID:42853, to the nucleotide sequence of VGAM1965 RNA, herein designated VGAM RNA, also designated SEQ ID:4676.

Another function of VGAM1965 is therefore inhibition of DKFZP434D193 (Accession XM_114297). Accordingly, utilities of VGAM1965 include diagnosis, prevention and treatment of diseases and clinical conditions associated with DKFZP434D193. DKFZp434E0519 (Accession NM_032247) is another VGAM1965 host target gene. DKFZp434E0519 BINDING SITE is HOST TARGET binding site found in the 3' untranslated region of mRNA encoded by DKFZp434E0519, corresponding to a HOST TARGET binding site such as BINDING SITE I, BINDING SITE II or BINDING SITE III. Table 2 illustrates the complementarity of the nucleotide sequences of DKFZp434E0519 BINDING SITE, designated SEQ ID:25984, to the nucleotide sequence of VGAM1965 RNA, herein designated VGAM RNA, also designated SEQ ID:4676.

Another function of VGAM1965 is therefore inhibition of DKFZp434E0519 (Accession NM_032247). Accordingly, utilities of VGAM1965 include diagnosis, prevention and treatment of diseases and clinical conditions associated with DKFZp434E0519. DKFZP434F0318 (Accession NM_030817) is another VGAM1965 host target gene. DKFZP434F0318 BINDING SITE1 and DKFZP434F0318 BINDING SITE2 are HOST TARGET binding sites found in untranslated regions of mRNA encoded by DKFZP434F0318, corresponding to HOST TARGET binding sites such as BINDING SITE I, BINDING SITE II or BINDING SITE III. Table 2 illustrates the complementarity of the nucleotide sequences of DKFZP434F0318 BINDING SITE1 and DKFZP434F0318 BINDING SITE2, designated SEQ ID:25145 and SEQ ID:25138 respectively, to the nucleotide sequence of VGAM1965 RNA, herein designated VGAM RNA, also designated SEQ ID:4676.

Another function of VGAM1965 is therefore inhibition of DKFZP434F0318 (Accession NM_030817). Accordingly, utilities of VGAM1965 include diagnosis, prevention and treatment of diseases and clinical conditions associated with DKFZP434F0318. DKFZp434G171 (Accession XM_086583) is another VGAM1965 host target gene. DKFZp434G171 BINDING SITE is HOST TARGET binding site found in the 3' untranslated region of mRNA encoded by DKFZp434G171, corresponding to a HOST TARGET binding site such as BINDING SITE I, BINDING SITE II or BINDING SITE III. Table 2 illustrates the complementarity of the nucleotide sequences of DKFZp434G171 BINDING SITE, designated SEQ ID:38778, to the nucleotide sequence of VGAM1965 RNA, herein designated VGAM RNA, also designated SEQ ID:4676.

Another function of VGAM1965 is therefore inhibition of DKFZp434G171 (Accession XM_086583). Accordingly, utilities of VGAM1965 include diagnosis, prevention and treatment of diseases and clinical conditions associated with DKFZp434G171. DKFZP434H204 (Accession XM_039153) is another VGAM1965 host target gene. DKFZP434H204 BINDING SITE is HOST TARGET binding site found in the 5' untranslated region of mRNA encoded by DKFZP434H204, corresponding to a HOST TARGET binding site such as BINDING SITE I, BINDING SITE II or BINDING SITE III. Table 2 illustrates the complementarity of the nucleotide sequences of DKFZP434H204 BINDING SITE, designated SEQ ID:33017, to the nucleotide sequence of VGAM1965 RNA, herein designated VGAM RNA, also designated SEQ ID:4676.

Another function of VGAM1965 is therefore inhibition of DKFZP434H204 (Accession XM_039153). Accordingly, utilities of VGAM1965 include diagnosis, prevention and treatment of diseases and clinical conditions associated with DKFZP434H204. DKFZP434I1735 (Accession XM_113763) is another VGAM1965 host target gene. DKFZP434I1735 BINDING SITE is HOST TARGET binding site found in the 3' untranslated region of mRNA encoded by DKFZP434I1735, corresponding to a HOST TARGET binding site such as BINDING SITE I, BINDING SITE II or BINDING SITE III. Table 2 illustrates the complementarity of the nucleotide sequences of DKFZP434I1735 BINDING SITE, designated SEQ ID:42422, to the nucleotide sequence of VGAM1965 RNA, herein designated VGAM RNA, also designated SEQ ID:4676.

Another function of VGAM1965 is therefore inhibition of DKFZP434I1735 (Accession XM_113763). Accordingly, utilities of VGAM1965 include diagnosis, prevention and treatment of diseases and clinical conditions associated with DKFZP434I1735. DKFZp434K1210 (Accession NM_017606) is another VGAM1965 host target gene. DKFZp434K1210 BINDING SITE is HOST TARGET binding site found in the 3' untranslated region of mRNA encoded by DKFZp434K1210, corresponding to a HOST TARGET binding site such as BINDING SITE I, BINDING SITE II or BINDING SITE III. Table 2 illustrates the complementarity of the nucleotide sequences of DKFZp434K1210 BINDING SITE, designated SEQ ID:19102, to the nucleotide sequence of VGAM1965 RNA, herein designated VGAM RNA, also designated SEQ ID:4676.

Another function of VGAM1965 is therefore inhibition of DKFZp434K1210 (Accession NM_017606). Accordingly, utilities of VGAM1965 include diagnosis, prevention and treatment of diseases and clinical conditions associated with DKFZp434K1210. DKFZP434L187 (Accession XM_044070) is another VGAM1965 host target gene. DKFZP434L187 BINDING SITE is HOST TARGET binding site found in the 5' untranslated region of mRNA encoded by DKFZP434L187, corresponding to a HOST TARGET binding site such as BINDING SITE I, BINDING SITE II or BINDING SITE III. Table 2 illustrates the complementarity of the nucleotide sequences of DKFZP434L187 BINDING SITE, designated SEQ ID:34125, to the nucleotide sequence of VGAM1965 RNA, herein designated VGAM RNA, also designated SEQ ID:4676.

Another function of VGAM1965 is therefore inhibition of DKFZP434L187 (Accession XM_044070). Accordingly, utilities of VGAM1965 include diagnosis, prevention and treatment of diseases and clinical conditions associated with DKFZP434L187. DKFZP434O047 (Accession NM_015594) is another VGAM1965 host target gene. DKFZP434O047 BINDING SITE is HOST TARGET binding site found in the 5' untranslated region of mRNA encoded by DKFZP434O047, corresponding to a HOST TARGET binding site such as BINDING SITE I, BINDING SITE II or BINDING SITE III. Table 2 illustrates the complementarity of the nucleotide sequences of DKFZP434O047 BINDING SITE, designated SEQ ID:17870, to the nucleotide sequence of VGAM1965 RNA, herein designated VGAM RNA, also designated SEQ ID:4676.

Another function of VGAM1965 is therefore inhibition of DKFZP434O047 (Accession NM_015594). Accordingly, utilities of VGAM1965 include diagnosis, prevention and treatment of diseases and clinical conditions associated with DKFZP434O047. DKFZP434P0111 (Accession XM_041116) is another VGAM1965 host target gene. DKFZP434P0111 BINDING SITE is HOST TARGET binding site found in the 3' untranslated region of mRNA encoded by DKFZP434P0111, corresponding to a HOST TARGET binding site such as BINDING SITE I, BINDING SITE II or BINDING SITE III. Table 2 illustrates the complementarity of the nucleotide sequences of DKFZP434P0111 BINDING SITE, designated SEQ ID:33451, to the nucleotide sequence of VGAM1965 RNA, herein designated VGAM RNA, also designated SEQ ID:4676.

Another function of VGAM1965 is therefore inhibition of DKFZP434P0111 (Accession XM_041116). Accordingly, utilities of VGAM1965 include diagnosis, prevention and treatment of diseases and clinical conditions associated with DKFZP434P0111. DKFZP547L112 (Accession XM_039353) is another VGAM1965 host target gene. DKFZP547L112 BINDING SITE is HOST TARGET binding site found in the 3' untranslated region of mRNA encoded by DKFZP547L112, corresponding to a HOST TARGET binding site such as BINDING SITE I, BINDING SITE II or BINDING SITE III. Table 2 illustrates the complementarity of the nucleotide sequences of DKFZP547L112 BINDING SITE, designated SEQ ID:33060, to the nucleotide sequence of VGAM1965 RNA, herein designated VGAM RNA, also designated SEQ ID:4676.

Another function of VGAM1965 is therefore inhibition of DKFZP547L112 (Accession XM_039353). Accordingly, utilities of VGAM1965 include diagnosis, prevention and treatment of diseases and clinical conditions associated with DKFZP547L112. DKFZP564B1162 (Accession NM_031305) is another VGAM1965 host target gene. DKFZP564B1162 BINDING SITE is HOST TARGET binding site found in the 3' untranslated region of mRNA encoded by DKFZP564B1162, corresponding to a HOST TARGET binding site such as BINDING SITE I, BINDING SITE II or BINDING SITE III. Table 2 illustrates the complementarity of the nucleotide sequences of DKFZP564B1162 BINDING SITE, designated SEQ ID:25340, to the nucleotide sequence of VGAM1965 RNA, herein designated VGAM RNA, also designated SEQ ID:4676.

Another function of VGAM1965 is therefore inhibition of DKFZP564B1162 (Accession NM_031305). Accordingly, utilities of VGAM1965 include diagnosis, prevention and treatment of diseases and clinical conditions associated with DKFZP564B1162. DKFZP564F013 (Accession XM_168479) is another VGAM1965 host target gene. DKFZP564F013 BINDING SITE is HOST TARGET binding site found in the 3' untranslated region of mRNA encoded by DKFZP564F013, corresponding to a HOST TARGET binding site such as BINDING SITE I, BINDING SITE II or BINDING SITE III. Table 2 illustrates the complementarity of the nucleotide sequences of DKFZP564F013 BINDING SITE, designated SEQ ID:45204, to the nucleotide sequence of VGAM1965 RNA, herein designated VGAM RNA, also designated SEQ ID:4676.

Another function of VGAM1965 is therefore inhibition of DKFZP564F013 (Accession XM_168479). Accordingly, utilities of VGAM1965 include diagnosis, prevention and treatment of diseases and clinical conditions associated with DKFZP564F013. DKFZP564I052 (Accession XM_039660) is another VGAM1965 host target gene. DKFZP564I052 BINDING SITE1 and DKFZP564I052 BINDING SITE2 are HOST TARGET binding sites found in untranslated regions of mRNA encoded by DKFZP564I052, corresponding to HOST TARGET binding sites such as BINDING SITE I, BINDING SITE II or BINDING SITE III. Table 2 illustrates the complementarity of the nucleotide sequences of DKFZP564I052 BINDING SITE1 and DKFZP564I052 BINDING SITE2, designated SEQ ID:33140 and SEQ ID:33141 respectively, to the nucleotide sequence of VGAM1965 RNA, herein designated VGAM RNA, also designated SEQ ID:4676.

Another function of VGAM1965 is therefore inhibition of DKFZP564I052 (Accession XM_039660). Accordingly, utilities of VGAM1965 include diagnosis, prevention and treatment of diseases and clinical conditions associated with DKFZP564I052. DKFZP564M182 (Accession XM_085525) is another VGAM1965 host target gene. DKFZP564M182 BINDING SITE is HOST TARGET binding site found in the 3' untranslated region of mRNA encoded by DKFZP564M182, corresponding to a HOST TARGET binding site such as BINDING SITE I, BINDING SITE II or BINDING SITE III. Table 2 illustrates the complementarity of the nucleotide sequences of DKFZP564M182 BINDING SITE, designated SEQ ID:38221, to the nucleotide sequence of VGAM1965 RNA, herein designated VGAM RNA, also designated SEQ ID:4676.

Another function of VGAM1965 is therefore inhibition of DKFZP564M182 (Accession XM_085525). Accordingly, utilities of VGAM1965 include diagnosis, prevention and treatment of diseases and clinical conditions associated with DKFZP564M182. DKFZP564O1863 (Accession XM_043922) is another VGAM1965 host target gene. DKFZP564O1863 BINDING SITE is HOST TARGET binding site found in the 3' untranslated region of mRNA encoded by DKFZP564O1863, corresponding to a HOST TARGET binding site such as BINDING SITE I, BINDING SITE II or BINDING SITE III. Table 2 illustrates the complementarity of the nucleotide sequences of DKFZP564O1863 BINDING SITE, designated SEQ ID:34043, to the nucleotide sequence of VGAM1965 RNA, herein designated VGAM RNA, also designated SEQ ID:4676.

Another function of VGAM1965 is therefore inhibition of DKFZP564O1863 (Accession XM_043922). Accordingly, utilities of VGAM1965 include diagnosis, prevention and treatment of diseases and clinical conditions associated with DKFZP564O1863. DKFZP566F2124 (Accession NM_015630) is another VGAM1965 host target gene. DKFZP566F2124 BINDING SITE1 and DKFZP566F2124 BINDING SITE2 are HOST TARGET binding sites found in untranslated regions of mRNA encoded by DKFZP566F2124, corresponding to HOST TARGET binding sites such as BINDING SITE I, BINDING SITE II or BINDING SITE III. Table 2 illustrates the complementarity of the nucleotide sequences of DKFZP566F2124 BINDING SITE1 and DKFZP566F2124 BINDING SITE2, designated SEQ ID:17888 and SEQ ID:17890 respectively, to the nucleotide sequence of VGAM1965 RNA, herein designated VGAM RNA, also designated SEQ ID:4676.

Another function of VGAM1965 is therefore inhibition of DKFZP566F2124 (Accession NM_015630). Accordingly, utilities of VGAM1965 include diagnosis, prevention and treatment of diseases and clinical conditions associated with DKFZP566F2124. DKFZp586I021 (Accession NM_032271) is another VGAM1965 host target gene. DKFZp586I021 BINDING SITE is HOST TARGET binding site found in the 3' untranslated region of mRNA encoded by DKFZp586I021, corresponding to a HOST TARGET binding site such as BINDING SITE I, BINDING SITE II or BINDING SITE III. Table 2 illustrates the complementarity of the nucleotide sequences of DKFZp586I021 BINDING SITE, designated SEQ ID:26030, to the nucleotide sequence of VGAM1965 RNA, herein designated VGAM RNA, also designated SEQ ID:4676.

Another function of VGAM1965 is therefore inhibition of DKFZp586I021 (Accession NM_032271). Accordingly, utilities of VGAM1965 include diagnosis, prevention and treatment of diseases and clinical conditions associated with DKFZp586I021. DKFZP727M111 (Accession NM_015540) is another VGAM1965 host target gene. DKFZP727M111 BINDING SITE is HOST TARGET binding site found in the 5' untranslated region of mRNA encoded by DKFZP727M111, corresponding to a HOST TARGET binding site such as BINDING SITE I, BINDING SITE II or BINDING SITE III. Table 2 illustrates the complementarity of the nucleotide sequences of DKFZP727M111 BINDING SITE, designated SEQ ID:17801, to the nucleotide sequence of VGAM1965 RNA, herein designated VGAM RNA, also designated SEQ ID:4676.

Another function of VGAM1965 is therefore inhibition of DKFZP727M111 (Accession NM_015540). Accordingly, utilities of VGAM1965 include diagnosis, prevention and treatment of diseases and clinical conditions associated with DKFZP727M111. DKFZp761F2014 (Accession NM_020215) is another VGAM1965 host target gene. DKFZp761F2014 BINDING SITE is HOST TARGET binding site found in the 3' untranslated region of mRNA encoded by DKFZp761F2014, corresponding to a HOST TARGET binding site such as BINDING SITE I, BINDING SITE II or BINDING SITE III. Table 2 illustrates the complementarity of the nucleotide sequences of DKFZp761F2014 BINDING SITE, designated SEQ ID:21464, to the nucleotide sequence of VGAM1965 RNA, herein designated VGAM RNA, also designated SEQ ID:4676.

Another function of VGAM1965 is therefore inhibition of DKFZp761F2014 (Accession NM_020215). Accordingly, utilities of VGAM1965 include diagnosis, prevention and treatment of diseases and clinical conditions associated with DKFZp761F2014. DKFZP761F241 (Accession NM_031455) is another VGAM1965 host target gene. DKFZP761F241 BINDING SITE is HOST TARGET binding site found in the 3' untranslated region of mRNA encoded by DKFZP761F241, corresponding to a HOST TARGET binding site such as BINDING SITE I, BINDING SITE II or BINDING SITE III. Table 2 illustrates the complementarity of the nucleotide sequences of DKFZP761F241 BINDING SITE, designated SEQ ID:25479, to the nucleotide sequence of VGAM1965 RNA, herein designated VGAM RNA, also designated SEQ ID:4676.

Another function of VGAM1965 is therefore inhibition of DKFZP761F241 (Accession NM_031455). Accordingly, utilities of VGAM1965 include diagnosis, prevention and treatment of diseases and clinical conditions associated with DKFZP761F241. DKFZp761G0313 (Accession XM_038026) is another VGAM1965 host target gene. DKFZp761G0313 BINDING SITE is HOST TARGET binding site found in the 3' untranslated region of mRNA encoded by DKFZp761G0313, corresponding to a HOST TARGET binding site such as BINDING SITE I, BINDING SITE II or BINDING SITE III. Table 2 illustrates the complementarity of the nucleotide sequences of DKFZp761G0313 BINDING SITE, designated SEQ ID:32743, to the nucleotide sequence of VGAM1965 RNA, herein designated VGAM RNA, also designated SEQ ID:4676.

Another function of VGAM1965 is therefore inhibition of DKFZp761G0313 (Accession XM_038026). Accordingly, utilities of VGAM1965 include diagnosis, prevention and treatment of diseases and clinical conditions associated with DKFZp761G0313. DKFZP761G1913 (Accession NM_031474) is another VGAM1965 host target gene. DKFZP761G1913 BINDING SITE is HOST TARGET binding site found in the 3' untranslated region of mRNA encoded by DKFZP761G1913, corresponding to a HOST TARGET binding site such as BINDING SITE I, BINDING SITE II or BINDING SITE III. Table 2 illustrates the complementarity of the nucleotide sequences of DKFZP761G1913 BINDING SITE, designated SEQ ID:25547, to the nucleotide sequence of VGAM1965 RNA, herein designated VGAM RNA, also designated SEQ ID:4676.

Another function of VGAM1965 is therefore inhibition of DKFZP761G1913 (Accession NM_031474). Accordingly, utilities of VGAM1965 include diagnosis, prevention and treatment of diseases and clinical conditions associated with DKFZP761G1913. DKFZp761G2113 (Accession XM_046017) is another VGAM1965 host target gene. DKFZp761G2113 BINDING SITE is HOST TARGET binding site found in the 3' untranslated region of mRNA encoded by DKFZp761G2113, corresponding to a HOST TARGET binding site such as BINDING SITE I, BINDING SITE II or BINDING SITE III. Table 2 illustrates the complementarity of the nucleotide sequences of DKFZp761G2113 BINDING SITE, designated SEQ ID:34645, to the nucleotide sequence of VGAM1965 RNA, herein designated VGAM RNA, also designated SEQ ID:4676.

Another function of VGAM1965 is therefore inhibition of DKFZp761G2113 (Accession XM_046017). Accordingly, utilities of VGAM1965 include diagnosis, prevention and treatment of diseases and clinical conditions associated with DKFZp761G2113. DKFZp761O0113 (Accession NM_018409) is another VGAM1965 host target gene. DKFZp761O0113 BINDING SITE is HOST TARGET binding site found in the 5' untranslated region of mRNA encoded by DKFZp761O0113, corresponding to a HOST TARGET binding site such as BINDING SITE I, BINDING SITE II or BINDING SITE III. Table 2 illustrates the complementarity of the nucleotide sequences of DKFZp761O0113 BINDING SITE, designated SEQ ID:20448, to the nucleotide sequence of VGAM1965 RNA, herein designated VGAM RNA, also designated SEQ ID:4676.

Another function of VGAM1965 is therefore inhibition of DKFZp761O0113 (Accession NM_018409). Accordingly, utilities of VGAM1965 include diagnosis, prevention and treatment of diseases and clinical conditions associated with DKFZp761O0113. DKFZp761P1010 (Accession NM_018423) is another VGAM1965 host target gene. DKFZp761P1010 BINDING SITE is HOST TARGET binding site found in the 3' untranslated region of mRNA encoded by DKFZp761P1010, corresponding to a HOST TARGET binding site such as BINDING SITE I, BINDING SITE II or BINDING SITE III. Table 2 illustrates the complementarity of the nucleotide sequences of DKFZp761P1010 BINDING SITE, designated SEQ ID:20480, to the nucleotide sequence of VGAM1965 RNA, herein designated VGAM RNA, also designated SEQ ID:4676.

Another function of VGAM1965 is therefore inhibition of DKFZp761P1010 (Accession NM_018423). Accordingly, utilities of VGAM1965 include diagnosis, prevention and treatment of diseases and clinical conditions associated with DKFZp761P1010. DKFZp762L0311 (Accession NM_018719) is another VGAM1965 host target gene. DKFZp762L0311 BINDING SITE is HOST TARGET binding site found in the 3' untranslated region of mRNA encoded by DKFZp762L0311, corresponding to a HOST TARGET binding site such as BINDING SITE I, BINDING SITE II or BINDING SITE III. Table 2 illustrates the complementarity of the nucleotide sequences of DKFZp762L0311 BINDING SITE, designated SEQ ID:20801, to the nucleotide sequence of VGAM1965 RNA, herein designated VGAM RNA, also designated SEQ ID:4676.

Another function of VGAM1965 is therefore inhibition of DKFZp762L0311 (Accession NM_018719). Accordingly, utilities of VGAM1965 include diagnosis, prevention and treatment of diseases and clinical conditions associated with DKFZp762L0311. DRF1 (Accession NM_025104) is another VGAM1965 host target gene. DRF1 BINDING SITE is HOST TARGET binding site found in the 3' untranslated region of mRNA encoded by DRF1, corresponding to a HOST TARGET binding site such as BINDING SITE I, BINDING SITE II or BINDING SITE III. Table 2 illustrates the complementarity of the nucleotide sequences of DRF1 BINDING SITE, designated SEQ ID:24750, to the nucleotide sequence of VGAM1965 RNA, herein designated VGAM RNA, also designated SEQ ID:4676.

Another function of VGAM1965 is therefore inhibition of DRF1 (Accession NM_025104). Accordingly, utilities of VGAM1965 include diagnosis, prevention and treatment of diseases and clinical conditions associated with DRF1. Down Syndrome Critical Region Gene 1-like 1 (DSCR1L1, Accession NM_005822) is another VGAM1965 host target gene. DSCR1L1 BINDING SITE is HOST TARGET binding site found in the 3' untranslated region of mRNA encoded by DSCR1L1, corresponding to a HOST TARGET binding site such as BINDING SITE I, BINDING SITE II or BINDING SITE III. Table 2 illustrates the complementarity of the nucleotide sequences of DSCR1L1 BINDING SITE, designated SEQ ID:12429, to the nucleotide sequence of VGAM1965 RNA, herein designated VGAM RNA, also designated SEQ ID:4676.

Another function of VGAM1965 is therefore inhibition of Down Syndrome Critical Region Gene 1-like 1 (DSCR1L1, Accession NM_005822). Accordingly, utilities of VGAM1965 include diagnosis, prevention and treatment of diseases and clinical conditions associated with DSCR1L1. Ephrin-A5 (EFNA5, Accession NM_001962) is another VGAM1965 host target gene. EFNA5 BINDING SITE is HOST TARGET binding site found in the 3' untranslated region of mRNA encoded by EFNA5, corresponding to a HOST TARGET binding site such as BINDING SITE I, BINDING SITE II or BINDING SITE III. Table 2 illustrates the complementarity of the nucleotide sequences of EFNA5 BINDING SITE, designated SEQ ID:7687, to the nucleotide sequence of VGAM1965 RNA, herein designated VGAM RNA, also designated SEQ ID:4676.

Another function of VGAM1965 is therefore inhibition of Ephrin-A5 (EFNA5, Accession NM_001962). Accordingly, utilities of VGAM1965 include diagnosis, prevention and treatment of diseases and clinical conditions associated with EFNA5. Echinoderm Microtubule Associated Protein Like 4 (EML4, Accession NM_019063) is another VGAM1965 host target gene. EML4 BINDING SITE is HOST TARGET binding site found in the 3' untranslated region of mRNA encoded by EML4, corresponding to a HOST TARGET binding site such as BINDING SITE I, BINDING SITE II or BINDING SITE III. Table 2 illustrates the complementarity of the nucleotide sequences of EML4 BINDING SITE, designated SEQ ID:21146, to the nucleotide sequence of VGAM1965 RNA, herein designated VGAM RNA, also designated SEQ ID:4676.

Another function of VGAM1965 is therefore inhibition of Echinoderm Microtubule Associated Protein Like 4 (EML4, Accession NM_019063). Accordingly, utilities of VGAM1965 include diagnosis, prevention and treatment of diseases and clinical conditions associated with EML4. Enabled Homolog (Drosophila) (ENAH, Accession NM_018212) is another VGAM1965 host target gene. ENAH BINDING SITE is HOST TARGET binding site found in the 3' untranslated region of mRNA encoded by ENAH, corresponding to a HOST TARGET binding site such as BINDING SITE I, BINDING SITE II or BINDING SITE III. Table 2 illustrates the complementarity of the nucleotide sequences of ENAH BINDING SITE, designated SEQ ID:20128, to the nucleotide sequence of VGAM1965 RNA, herein designated VGAM RNA, also designated SEQ ID:4676.

Another function of VGAM1965 is therefore inhibition of Enabled Homolog (Drosophila) (ENAH, Accession NM_018212). Accordingly, utilities of VGAM1965 include diagnosis, prevention and treatment of diseases and clinical conditions associated with ENAH. Ectonucleotide Pyrophosphatase/phosphodiesterase 4 (putative function) (ENPP4, Accession NM_014936) is another VGAM1965 host target gene. ENPP4 BINDING SITE is HOST TARGET binding site found in the 3' untranslated region of mRNA encoded by ENPP4, corresponding to a HOST TARGET binding site such as BINDING SITE I, BINDING SITE II or BINDING SITE III. Table 2 illustrates the complementarity of the nucleotide sequences of ENPP4 BINDING SITE, designated SEQ ID:17241, to the nucleotide sequence of VGAM1965 RNA, herein designated VGAM RNA, also designated SEQ ID:4676.

Another function of VGAM1965 is therefore inhibition of Ectonucleotide Pyrophosphatase/phosphodiesterase 4 (putative function) (ENPP4, Accession NM_014936). Accordingly, utilities of VGAM1965 include diagnosis, prevention and treatment of diseases and clinical conditions associated with ENPP4. EPLIN (Accession NM_016357) is another VGAM1965 host target gene. EPLIN BINDING SITE is HOST TARGET binding site found in the 3" untranslated region of mRNA encoded by EPLIN, corresponding to a HOST TARGET binding site such as BINDING SITE I, BINDING SITE II or BINDING SITE III. Table 2 illustrates the complementarity of the nucleotide sequences of EPLIN BINDING SITE, designated SEQ ID:18495, to the nucleotide sequence of VGAM1965 RNA, herein designated VGAM RNA, also designated SEQ ID:4676.

Another function of VGAM1965 is therefore inhibition of EPLIN (Accession NM_016357). Accordingly, utilities of VGAM1965 include diagnosis, prevention and treatment of diseases and clinical conditions associated with EPLIN. Erythroblast Membrane-associated Protein (ERMAP, Accession NM_018538) is another VGAM1965 host target gene. ERMAP BINDING SITE is HOST TARGET binding site found in the 3' untranslated region of mRNA encoded by ERMAP, corresponding to a HOST TARGET binding site such as BINDING SITE I, BINDING SITE II or BINDING SITE III. Table 2 illustrates the complementarity of the nucleotide sequences of ERMAP BINDING SITE, designated SEQ ID:20604, to the nucleotide sequence of VGAM1965 RNA, herein designated VGAM RNA, also designated SEQ ID:4676.

Another function of VGAM1965 is therefore inhibition of Erythroblast Membrane-associated Protein (ERMAP, Accession NM_018538). Accordingly, utilities of VGAM1965 include diagnosis, prevention and treatment of diseases and clinical conditions associated with ERMAP. ET (Accession NM_024311) is another VGAM1965 host target gene. ET BINDING SITE is HOST TARGET binding site found in the 3' untranslated region of mRNA encoded by ET, corresponding to a HOST TARGET binding site such as BINDING SITE I, BINDING SITE II or BINDING SITE III. Table 2 illustrates the complementarity of the nucleotide sequences of ET BINDING SITE, designated SEQ ID:23605, to the nucleotide sequence of VGAM1965 RNA, herein designated VGAM RNA, also designated SEQ ID:4676.

Another function of VGAM1965 is therefore inhibition of ET (Accession NM_024311). Accordingly, utilities of VGAM1965 include diagnosis, prevention and treatment of diseases and clinical conditions associated with ET. Fatty Acid Desaturase 2 (FADS2, Accession NM_004265) is another VGAM1965 host target gene. FADS2 BINDING SITE is HOST TARGET binding site found in the 3' untranslated region of mRNA encoded by FADS2, corresponding to a HOST TARGET binding site such as BINDING SITE I, BINDING SITE II or BINDING SITE III. Table 2 illustrates the complementarity of the nucleotide sequences of FADS2 BINDING SITE, designated SEQ ID:10468, to the nucleotide sequence of VGAM1965 RNA, herein designated VGAM RNA, also designated SEQ ID:4676.

Another function of VGAM1965 is therefore inhibition of Fatty Acid Desaturase 2 (FADS2, Accession NM_004265). Accordingly, utilities of VGAM1965 include diagnosis, prevention and treatment of diseases and clinical conditions associated with FADS2. FBX30 (Accession NM_033182) is another VGAM1965 host target gene. FBX30 BINDING SITE is HOST TARGET binding site found in the 3' untranslated region of mRNA encoded by FBX30, corresponding to a HOST TARGET binding site such as BINDING SITE I, BINDING SITE II or BINDING SITE III. Table 2 illustrates the complementarity of the nucleotide sequences of FBX30 BINDING SITE, designated SEQ ID:27043, to the nucleotide sequence of VGAM1965 RNA, herein designated VGAM RNA, also designated SEQ ID:4676.

Another function of VGAM1965 is therefore inhibition of FBX30 (Accession NM_033182). Accordingly, utilities of VGAM1965 include diagnosis, prevention and treatment of diseases and clinical conditions associated with FBX30. F-box Only Protein 8 (FBXO8, Accession NM_012180) is another VGAM1965 host target gene. FBXO8 BINDING SITE is HOST TARGET binding site found in the 3' untranslated region of mRNA encoded by FBXO8, corresponding to a HOST TARGET binding site such as BINDING SITE I, BINDING SITE II or BINDING SITE III. Table 2 illustrates the complementarity of the nucleotide sequences of FBXO8 BINDING SITE, designated SEQ ID:14467, to the nucleotide sequence of VGAM1965 RNA, herein designated VGAM RNA, also designated SEQ ID:4676.

Another function of VGAM1965 is therefore inhibition of F-box Only Protein 8 (FBXO8, Accession NM_012180). Accordingly, utilities of VGAM1965 include diagnosis, prevention and treatment of diseases and clinical conditions associated with FBXO8. FGD1 Family, Member 3 (FGD3, Accession XM_053487) is another VGAM1965 host target gene. FGD3 BINDING SITE is HOST TARGET binding site found in the 3' untranslated region of mRNA encoded by FGD3, corresponding to a HOST TARGET binding site such as BINDING SITE I, BINDING SITE II or BINDING SITE III. Table 2 illustrates the complementarity of the nucleotide sequences of FGD3 BINDING SITE, designated SEQ ID:36093, to the nucleotide sequence of VGAM1965 RNA, herein designated VGAM RNA, also designated SEQ ID:4676.

Another function of VGAM1965 is therefore inhibition of FGD1 Family, Member 3 (FGD3, Accession XM_053487). Accordingly, utilities of VGAM1965 include diagnosis, prevention and treatment of diseases and clinical conditions associated with FGD3. FLJ00001 (Accession XM_088525) is another VGAM1965 host target gene. FLJ00001 BINDING SITE1 and FLJ00001 BINDING SITE2 are HOST TARGET binding sites found in untranslated regions of mRNA encoded by FLJ00001, corresponding to HOST TARGET binding sites such as BINDING SITE I, BINDING SITE II or BINDING SITE III. Table 2 illustrates the complementarity of the nucleotide sequences of FLJ00001 BINDING SITE1 and FLJ00001 BINDING SITE2, designated SEQ ID:39781 and SEQ ID:39784 respectively, to the nucleotide sequence of VGAM1965 RNA, herein designated VGAM RNA, also designated SEQ ID:4676.

Another function of VGAM1965 is therefore inhibition of FLJ00001 (Accession XM_088525). Accordingly, utilities of VGAM1965 include diagnosis, prevention and treatment of diseases and clinical conditions associated with FLJ00001. FLJ00007 (Accession XM_048928) is another VGAM1965 host target gene. FLJ00007 BINDING SITE1 and FLJ00007 BINDING SITE2 are HOST TARGET binding sites found in untranslated regions of mRNA encoded by FLJ00007, corresponding to HOST TARGET binding sites such as BINDING SITE I, BINDING SITE II or BINDING SITE III. Table 2 illustrates the complementarity of the nucleotide sequences of FLJ00007 BINDING SITE1 and FLJ00007 BINDING SITE2, designated SEQ ID:35314 and SEQ ID:19799 respectively, to the nucleotide sequence of VGAM1965 RNA, herein designated VGAM RNA, also designated SEQ ID:4676.

Another function of VGAM1965 is therefore inhibition of FLJ00007 (Accession XM_048928). Accordingly, utilities of VGAM1965 include diagnosis, prevention and treatment of diseases and clinical conditions associated with FLJ00007. FLJ10460 (Accession NM_018097) is another VGAM1965 host target gene. FLJ10460 BINDING SITE1 and FLJ10460 BINDING SITE2 are HOST TARGET binding sites found in untranslated regions of mRNA encoded by FLJ10460, corresponding to HOST TARGET binding sites such as BINDING SITE I, BINDING SITE II or BINDING SITE III. Table 2 illustrates the complementarity of the nucleotide sequences of FLJ10460 BINDING SITE1 and FLJ10460 BINDING SITE2, designated SEQ ID:19868 and SEQ ID:19870 respectively, to the nucleotide sequence of VGAM1965 RNA, herein designated VGAM RNA, also designated SEQ ID:4676.

Another function of VGAM1965 is therefore inhibition of FLJ10460 (Accession NM_018097). Accordingly, utilities of VGAM1965 include diagnosis, prevention and treatment of diseases and clinical conditions associated with FLJ10460. FLJ10520 (Accession NM_018124) is another VGAM1965 host target gene. FLJ10520 BINDING SITE is HOST TARGET binding site found in the 3' untranslated region of mRNA encoded by FLJ10520, corresponding to a HOST TARGET binding site such as BINDING SITE I, BINDING SITE II or BINDING SITE III. Table 2 illustrates the complementarity of the nucleotide sequences of FLJ10520 BINDING SITE, designated SEQ ID:19907, to the nucleotide sequence of VGAM1965 RNA, herein designated VGAM RNA, also designated SEQ ID:4676.

Another function of VGAM1965 is therefore inhibition of FLJ10520 (Accession NM_018124). Accordingly, utilities of VGAM1965 include diagnosis, prevention and treatment of diseases and clinical conditions associated with FLJ10520. FLJ10535 (Accession NM_018129) is another VGAM1965 host target gene. FLJ10535 BINDING SITE is HOST TARGET binding site found in the 3' untranslated region of mRNA encoded by FLJ10535, corresponding to a HOST TARGET binding site such as BINDING SITE I, BINDING SITE II or BINDING SITE III. Table 2 illustrates the complementarity of the nucleotide sequences of FLJ10535 BINDING SITE, designated SEQ ID:19923, to the nucleotide sequence of VGAM1965 RNA, herein designated VGAM RNA, also designated SEQ ID:4676.

Another function of VGAM1965 is therefore inhibition of FLJ10535 (Accession NM_018129). Accordingly, utilities of VGAM1965 include diagnosis, prevention and treatment of diseases and clinical conditions associated with FLJ10535. FLJ10539 (Accession NM_018130) is another VGAM1965 host target gene. FLJ10539 BINDING SITE is HOST TARGET binding site found in the 3' untranslated region of mRNA encoded by FLJ10539, corresponding to a HOST TARGET binding site such as BINDING SITE I, BINDING SITE II or BINDING SITE III. Table 2 illustrates the complementarity of the nucleotide sequences of FLJ10539 BINDING SITE, designated SEQ ID:19925, to the nucleotide sequence of VGAM1965 RNA, herein designated VGAM RNA, also designated SEQ ID:4676.

Another function of VGAM1965 is therefore inhibition of FLJ10539 (Accession NM_018130). Accordingly, utilities of VGAM1965 include diagnosis, prevention and treatment of diseases and clinical conditions associated with FLJ10539. FLJ10547 (Accession NM_018134) is another VGAM1965 host target gene. FLJ10547 BINDING SITE is HOST TARGET binding site found in the 3' untranslated region of mRNA encoded by FLJ10547, corresponding to a HOST TARGET binding site such as BINDING SITE I, BINDING SITE II or BINDING SITE III. Table 2 illustrates the complementarity of the nucleotide sequences of FLJ10547 BINDING SITE, designated SEQ ID:19932, to the nucleotide sequence of VGAM1965 RNA, herein designated VGAM RNA, also designated SEQ ID:4676.

Another function of VGAM1965 is therefore inhibition of FLJ10547 (Accession NM_018134). Accordingly, utilities of VGAM1965 include diagnosis, prevention and treatment of diseases and clinical conditions associated with FLJ10547. FLJ10579 (Accession NM_018145) is another VGAM1965 host target gene. FLJ10579 BINDING SITE is HOST TARGET binding site found in the 5' untranslated region of mRNA encoded by FLJ10579, corresponding to a HOST TARGET binding site such as BINDING SITE I, BINDING SITE II or BINDING SITE III. Table 2 illustrates the complementarity of the nucleotide sequences of FLJ10579 BINDING SITE, designated SEQ ID:19947, to the nucleotide sequence of VGAM1965 RNA, herein designated VGAM RNA, also designated SEQ ID:4676.

Another function of VGAM1965 is therefore inhibition of FLJ10579 (Accession NM_018145). Accordingly, utilities of VGAM1965 include diagnosis, prevention and treatment of diseases and clinical conditions associated with FLJ10579. FLJ10619 (Accession NM_018156) is another VGAM1965 host target gene. FLJ10619 BINDING SITE is HOST TARGET binding site found in the 3' untranslated region of mRNA encoded by FLJ10619, corresponding to a HOST TARGET binding site such as BINDING SITE I, BINDING SITE II or BINDING SITE III. Table 2 illustrates the complementarity of the nucleotide sequences of FLJ10619 BINDING SITE, designated SEQ ID:19968, to the nucleotide sequence of VGAM1965 RNA, herein designated VGAM RNA, also designated SEQ ID:4676.

Another function of VGAM1965 is therefore inhibition of FLJ10619 (Accession NM_018156). Accordingly, utilities of VGAM1965 include diagnosis, prevention and treatment of diseases and clinical conditions associated with FLJ10619.

FLJ10704 (Accession NM_018185) is another VGAM1965 host target gene. FLJ10704 BINDING SITE is HOST TARGET binding site found in the 3' untranslated region of mRNA encoded by FLJ10704, corresponding to a HOST TARGET binding site such as BINDING SITE I, BINDING SITE II or BINDING SITE III. Table 2 illustrates the complementarity of the nucleotide sequences of FLJ10704 BINDING SITE, designated SEQ ID:20036, to the nucleotide sequence of VGAM1965 RNA, herein designated VGAM RNA, also designated SEQ ID:4676.

Another function of VGAM1965 is therefore inhibition of FLJ10704 (Accession NM_018185). Accordingly, utilities of VGAM1965 include diagnosis, prevention and treatment of diseases and clinical conditions associated with FLJ10704.

FLJ10895 (Accession NM_019084) is another VGAM1965 host target gene. FLJ10895 BINDING SITE is HOST TARGET binding site found in the 3' untranslated region of mRNA encoded by FLJ10895, corresponding to a HOST TARGET binding site such as BINDING SITE I, BINDING SITE II or BINDING SITE III. Table 2 illustrates the complementarity of the nucleotide sequences of FLJ10895 BINDING SITE, designated SEQ ID:21159, to the nucleotide sequence of VGAM1965 RNA, herein designated VGAM RNA, also designated SEQ ID:4676.

Another function of VGAM1965 is therefore inhibition of FLJ10895 (Accession NM_019084). Accordingly, utilities of VGAM1965 include diagnosis, prevention and treatment of diseases and clinical conditions associated with FLJ10895.

FLJ10904 (Accession NM_018268) is another VGAM1965 host target gene. FLJ10904 BINDING SITE is HOST TARGET binding site found in the 5' untranslated region of mRNA encoded by FLJ10904, corresponding to a HOST TARGET binding site such as BINDING SITE I, BINDING SITE II or BINDING SITE III. Table 2 illustrates the complementarity of the nucleotide sequences of FLJ10904 BINDING SITE, designated SEQ ID:20241, to the nucleotide sequence of VGAM1965 RNA, herein designated VGAM RNA, also designated SEQ ID:4676.

Another function of VGAM1965 is therefore inhibition of FLJ10904 (Accession NM_018268). Accordingly, utilities of VGAM1965 include diagnosis, prevention and treatment of diseases and clinical conditions associated with FLJ10904.

FLJ10922 (Accession NM_018273) is another VGAM1965 host target gene. FLJ10922 BINDING SITE is HOST TARGET binding site found in the 3' untranslated region of mRNA encoded by FLJ10922, corresponding to a HOST TARGET binding site such as BINDING SITE I, BINDING SITE II or BINDING SITE III. Table 2 illustrates the complementarity of the nucleotide sequences of FLJ10922 BINDING SITE, designated SEQ ID:20258, to the nucleotide sequence of VGAM1965 RNA, herein designated VGAM RNA, also designated SEQ ID:4676.

Another function of VGAM1965 is therefore inhibition of FLJ10922 (Accession NM_018273). Accordingly, utilities of VGAM1965 include diagnosis, prevention and treatment of diseases and clinical conditions associated with FLJ10922.

FLJ10936 (Accession NM_018279) is another VGAM1965 host target gene. FLJ10936 BINDING SITE is HOST TARGET binding site found in the 5' untranslated region of mRNA encoded by FLJ10936, corresponding to a HOST TARGET binding site such as BINDING SITE I, BINDING SITE II or BINDING SITE III. Table 2 illustrates the complementarity of the nucleotide sequences of FLJ10936 BINDING SITE, designated SEQ ID:20269, to the nucleotide sequence of VGAM1965 RNA, herein designated VGAM RNA, also designated SEQ ID:4676.

Another function of VGAM1965 is therefore inhibition of FLJ10936 (Accession NM_018279). Accordingly, utilities of VGAM1965 include diagnosis, prevention and treatment of diseases and clinical conditions associated with FLJ10936.

FLJ11210 (Accession XM_005298) is another VGAM1965 host target gene. FLJ11210 BINDING SITE is HOST TARGET binding site found in the 3' untranslated region of mRNA encoded by FLJ11210, corresponding to a HOST TARGET binding site such as BINDING SITE I, BINDING SITE II or BINDING SITE III. Table 2 illustrates the complementarity of the nucleotide sequences of FLJ11210 BINDING SITE, designated SEQ ID:29976, to the nucleotide sequence of VGAM1965 RNA, herein designated VGAM RNA, also designated SEQ ID:4676.

Another function of VGAM1965 is therefore inhibition of FLJ11210 (Accession XM_005298). Accordingly, utilities of VGAM1965 include diagnosis, prevention and treatment of diseases and clinical conditions associated with FLJ11210.

FLJ11539 (Accession NM_024748) is another VGAM1965 host target gene. FLJ11539 BINDING SITE is HOST TARGET binding site found in the 3' untranslated region of mRNA encoded by FLJ11539, corresponding to a HOST TARGET binding site such as BINDING SITE I, BINDING SITE II or BINDING SITE III. Table 2 illustrates the complementarity of the nucleotide sequences of FLJ11539 BINDING SITE, designated SEQ ID:24089, to the nucleotide sequence of VGAM1965 RNA, herein designated VGAM RNA, also designated SEQ ID:4676.

Another function of VGAM1965 is therefore inhibition of FLJ11539 (Accession NM_024748). Accordingly, utilities of VGAM1965 include diagnosis, prevention and treatment of diseases and clinical conditions associated with FLJ11539.

FLJ12057 (Accession NM_024768) is another VGAM1965 host target gene. FLJ12057 BINDING SITE is HOST TARGET binding site found in the 3' untranslated region of mRNA encoded by FLJ12057, corresponding to a HOST TARGET binding site such as BINDING SITE I, BINDING SITE II or BINDING SITE III. Table 2 illustrates the complementarity of the nucleotide sequences of FLJ12057 BINDING SITE, designated SEQ ID:24128, to the nucleotide sequence of VGAM1965 RNA, herein designated VGAM RNA, also designated SEQ ID:4676.

Another function of VGAM1965 is therefore inhibition of FLJ12057 (Accession NM_024768). Accordingly, utilities of VGAM1965 include diagnosis, prevention and treatment of diseases and clinical conditions associated with FLJ12057.

FLJ12363 (Accession NM_032167) is another VGAM1965 host target gene. FLJ12363 BINDING SITE1 and FLJ12363 BINDING SITE2 are HOST TARGET binding sites found in untranslated regions of mRNA encoded by FLJ12363, corresponding to HOST TARGET binding sites such as BINDING SITE I, BINDING SITE II or BINDING SITE III. Table 2 illustrates the complementarity of the nucleotide sequences of FLJ12363 BINDING SITE1 and FLJ12363 BINDING SITE2, designated SEQ ID:25869 and SEQ ID:25870 respectively, to the nucleotide sequence of VGAM1965 RNA, herein designated VGAM RNA, also designated SEQ ID:4676.

Another function of VGAM1965 is therefore inhibition of FLJ12363 (Accession NM_032167). Accordingly, utilities of VGAM1965 include diagnosis, prevention and treatment of diseases and clinical conditions associated with FLJ12363.

FLJ12425 (Accession XM_098290) is another VGAM1965 host target gene. FLJ12425 BINDING SITE1 and FLJ12425

BINDING SITE2 are HOST TARGET binding sites found in untranslated regions of mRNA encoded by FLJ12425, corresponding to HOST TARGET binding sites such as BINDING SITE I, BINDING SITE II or BINDING SITE III. Table 2 illustrates the complementarity of the nucleotide sequences of FLJ12425 BINDING SITE1 and FLJ12425 BINDING SITE2, designated SEQ ID:41563 and SEQ ID:24550 respectively, to the nucleotide sequence of VGAM1965 RNA, herein designated VGAM RNA, also designated SEQ ID:4676.

Another function of VGAM1965 is therefore inhibition of FLJ12425 (Accession XM_098290). Accordingly, utilities of VGAM1965 include diagnosis, prevention and treatment of diseases and clinical conditions associated with FLJ12425. FLJ12587 (Accession NM_022480) is another VGAM1965 host target gene. FLJ12587 BINDING SITE is HOST TARGET binding site found in the 3' untranslated region of mRNA encoded by FLJ12587, corresponding to a HOST TARGET binding site such as BINDING SITE I, BINDING SITE II or BINDING SITE III. Table 2 illustrates the complementarity of the nucleotide sequences of FLJ12587 BINDING SITE, designated SEQ ID:22854, to the nucleotide sequence of VGAM1965 RNA, herein designated VGAM RNA, also designated SEQ ID:4676.

Another function of VGAM1965 is therefore inhibition of FLJ12587 (Accession NM_022480). Accordingly, utilities of VGAM1965 include diagnosis, prevention and treatment of diseases and clinical conditions associated with FLJ12587. FLJ12592 (Accession NM_032169) is another VGAM1965 host target gene. FLJ12592 BINDING SITE is HOST TARGET binding site found in the 3' untranslated region of mRNA encoded by FLJ12592, corresponding to a HOST TARGET binding site such as BINDING SITE I, BINDING SITE II or BINDING SITE III. Table 2 illustrates the complementarity of the nucleotide sequences of FLJ12592 BINDING SITE, designated SEQ ID:25876, to the nucleotide sequence of VGAM1965 RNA, herein designated VGAM RNA, also designated SEQ ID:4676.

Another function of VGAM1965 is therefore inhibition of FLJ12592 (Accession NM_032169). Accordingly, utilities of VGAM1965 include diagnosis, prevention and treatment of diseases and clinical conditions associated with FLJ12592. FLJ12687 (Accession NM_024917) is another VGAM1965 host target gene. FLJ12687 BINDING SITE is HOST TARGET binding site found in the 3' untranslated region of mRNA encoded by FLJ12687, corresponding to a HOST TARGET binding site such as BINDING SITE I, BINDING SITE II or BINDING SITE III. Table 2 illustrates the complementarity of the nucleotide sequences of FLJ12687 BINDING SITE, designated SEQ ID:24448, to the nucleotide sequence of VGAM1965 RNA, herein designated VGAM RNA, also designated SEQ ID:4676.

Another function of VGAM1965 is therefore inhibition of FLJ12687 (Accession NM_024917). Accordingly, utilities of VGAM1965 include diagnosis, prevention and treatment of diseases and clinical conditions associated with FLJ12687. FLJ12747 (Accession NM_032173) is another VGAM1965 host target gene. FLJ12747 BINDING SITE is HOST TARGET binding site found in the 3' untranslated region of mRNA encoded by FLJ12747, corresponding to a HOST TARGET binding site such as BINDING SITE I, BINDING SITE II or BINDING SITE III. Table 2 illustrates the complementarity of the nucleotide sequences of FLJ12747 BINDING SITE, designated SEQ ID:25882, to the nucleotide sequence of VGAM1965 RNA, herein designated VGAM RNA, also designated SEQ ID:4676.

Another function of VGAM1965 is therefore inhibition of FLJ12747 (Accession NM_032173). Accordingly, utilities of VGAM1965 include diagnosis, prevention and treatment of diseases and clinical conditions associated with FLJ12747. FLJ12770 (Accession NM_032174) is another VGAM1965 host target gene. FLJ12770 BINDING SITE1 and FLJ12770 BINDING SITE2 are HOST TARGET binding sites found in untranslated regions of mRNA encoded by FLJ12770, corresponding to HOST TARGET binding sites such as BINDING SITE I, BINDING SITE II or BINDING SITE III. Table 2 illustrates the complementarity of the nucleotide sequences of FLJ12770 BINDING SITE1 and FLJ12770 BINDING SITE2, designated SEQ ID:25886 and SEQ ID:25887 respectively, to the nucleotide sequence of VGAM1965 RNA, herein designated VGAM RNA, also designated SEQ ID:4676.

Another function of VGAM1965 is therefore inhibition of FLJ12770 (Accession NM_032174). Accordingly, utilities of VGAM1965 include diagnosis, prevention and treatment of diseases and clinical conditions associated with FLJ12770. FLJ12994 (Accession NM_022841) is another VGAM1965 host target gene. FLJ12994 BINDING SITE1 and FLJ12994 BINDING SITE2 are HOST TARGET binding sites found in untranslated regions of mRNA encoded by FLJ12994, corresponding to HOST TARGET binding sites such as BINDING SITE I, BINDING SITE II or BINDING SITE III. Table 2 illustrates the complementarity of the nucleotide sequences of FLJ12994 BINDING SITE1 and FLJ12994 BINDING SITE2, designated SEQ ID:23133 and SEQ ID:37975 respectively, to the nucleotide sequence of VGAM1965 RNA, herein designated VGAM RNA, also designated SEQ ID:4676.

Another function of VGAM1965 is therefore inhibition of FLJ12994 (Accession NM_022841). Accordingly, utilities of VGAM1965 include diagnosis, prevention and treatment of diseases and clinical conditions associated with FLJ12994. FLJ13612 (Accession NM_025202) is another VGAM1965 host target gene. FLJ13612 BINDING SITE is HOST TARGET binding site found in the 3' untranslated region of mRNA encoded by FLJ13612, corresponding to a HOST TARGET binding site such as BINDING SITE I, BINDING SITE II or BINDING SITE III. Table 2 illustrates the complementarity of the nucleotide sequences of FLJ13612 BINDING SITE, designated SEQ ID:24865, to the nucleotide sequence of VGAM1965 RNA, herein designated VGAM RNA, also designated SEQ ID:4676.

Another function of VGAM1965 is therefore inhibition of FLJ13612 (Accession NM_025202). Accordingly, utilities of VGAM1965 include diagnosis, prevention and treatment of diseases and clinical conditions associated with FLJ13612. FLJ13614 (Accession NM_139076) is another VGAM1965 host target gene. FLJ13614 BINDING SITE is HOST TARGET binding site found in the 3' untranslated region of mRNA encoded by FLJ13614, corresponding to a HOST TARGET binding site such as BINDING SITE I, BINDING SITE II or BINDING SITE III. Table 2 illustrates the complementarity of the nucleotide sequences of FLJ13614 BINDING SITE, designated SEQ ID:29150, to the nucleotide sequence of VGAM1965 RNA, herein designated VGAM RNA, also designated SEQ ID:4676.

Another function of VGAM1965 is therefore inhibition of FLJ13614 (Accession NM_139076). Accordingly, utilities of VGAM1965 include diagnosis, prevention and treatment of diseases and clinical conditions associated with FLJ13614. FLJ13646 (Accession NM_024584) is another VGAM1965 host target gene. FLJ13646 BINDING SITE is HOST TARGET binding site found in the 3' untranslated region of mRNA encoded by FLJ13646, corresponding to a HOST TARGET binding site such as BINDING SITE I, BINDING SITE II or BINDING SITE III. Table 2 illustrates the complementarity of the nucleotide sequences of FLJ13646 BINDING SITE, designated SEQ ID:23816, to the nucleotide sequence of VGAM1965 RNA, herein designated VGAM RNA, also designated SEQ ID:4676.

Another function of VGAM1965 is therefore inhibition of FLJ13646 (Accession NM_024584). Accordingly, utilities of VGAM1965 include diagnosis, prevention and treatment of diseases and clinical conditions associated with FLJ13646. FLJ13693 (Accession NM_024807) is another VGAM1965 host target gene. FLJ13693 BINDING SITE is HOST TARGET binding site found in the 3' untranslated region of mRNA encoded by FLJ13693, corresponding to a HOST TARGET binding site such as BINDING SITE I, BINDING SITE II or BINDING SITE III. Table 2 illustrates the complementarity of the nucleotide sequences of FLJ13693 BINDING SITE, designated SEQ ID:24189, to the nucleotide sequence of VGAM1965 RNA, herein designated VGAM RNA, also designated SEQ ID:4676.

Another function of VGAM1965 is therefore inhibition of FLJ13693 (Accession NM_024807). Accordingly, utilities of VGAM1965 include diagnosis, prevention and treatment of diseases and clinical conditions associated with FLJ13693. FLJ13902 (Accession NM_024653) is another VGAM1965 host target gene. FLJ13902 BINDING SITE is HOST TARGET binding site found in the 3' untranslated region of mRNA encoded by FLJ13902, corresponding to a HOST TARGET binding site such as BINDING SITE I, BINDING SITE II or BINDING SITE III. Table 2 illustrates the complementarity of the nucleotide sequences of FLJ13902 BINDING SITE, designated SEQ ID:23952, to the nucleotide sequence of VGAM1965 RNA, herein designated VGAM RNA, also designated SEQ ID:4676.

Another function of VGAM1965 is therefore inhibition of FLJ13902 (Accession NM_024653). Accordingly, utilities of VGAM1965 include diagnosis, prevention and treatment of diseases and clinical conditions associated with FLJ13902. FLJ13952 (Accession NM_024798) is another VGAM1965 host target gene. FLJ13952 BINDING SITE is HOST TARGET binding site found in the 3' untranslated region of mRNA encoded by FLJ13952, corresponding to a HOST TARGET binding site such as BINDING SITE I, BINDING SITE II or BINDING SITE III. Table 2 illustrates the complementarity of the nucleotide sequences of FLJ13952 BINDING SITE, designated SEQ ID:24176, to the nucleotide sequence of VGAM1965 RNA, herein designated VGAM RNA, also designated SEQ ID:4676.

Another function of VGAM1965 is therefore inhibition of FLJ13952 (Accession NM_024798). Accordingly, utilities of VGAM1965 include diagnosis, prevention and treatment of diseases and clinical conditions associated with FLJ13952. FLJ14054 (Accession NM_024563) is another VGAM1965 host target gene. FLJ14054 BINDING SITE is HOST TARGET binding site found in the 3' untranslated region of mRNA encoded by FLJ14054, corresponding to a HOST TARGET binding site such as BINDING SITE I, BINDING SITE II or BINDING SITE III. Table 2 illustrates the complementarity of the nucleotide sequences of FLJ14054 BINDING SITE, designated SEQ ID:23787, to the nucleotide sequence of VGAM1965 RNA, herein designated VGAM RNA, also designated SEQ ID:4676.

Another function of VGAM1965 is therefore inhibition of FLJ14054 (Accession NM_024563). Accordingly, utilities of VGAM1965 include diagnosis, prevention and treatment of diseases and clinical conditions associated with FLJ14054. FLJ14084 (Accession NM_021637) is another VGAM1965 host target gene. FLJ14084 BINDING SITE is HOST TARGET binding site found in the 3' untranslated region of mRNA encoded by FLJ14084, corresponding to a HOST TARGET binding site such as BINDING SITE I, BINDING SITE II or BINDING SITE III. Table 2 illustrates the complementarity of the nucleotide sequences of FLJ14084 BINDING SITE, designated SEQ ID:22287, to the nucleotide sequence of VGAM1965 RNA, herein designated VGAM RNA, also designated SEQ ID:4676.

Another function of VGAM1965 is therefore inhibition of FLJ14084 (Accession NM_021637). Accordingly, utilities of VGAM1965 include diagnosis, prevention and treatment of diseases and clinical conditions associated with FLJ14084. FLJ14356 (Accession NM_030824) is another VGAM1965 host target gene. FLJ14356 BINDING SITE is HOST TARGET binding site found in the 5' untranslated region of mRNA encoded by FLJ14356, corresponding to a HOST TARGET binding site such as BINDING SITE I, BINDING SITE II or BINDING SITE III. Table 2 illustrates the complementarity of the nucleotide sequences of FLJ14356 BINDING SITE, designated SEQ ID:25154, to the nucleotide sequence of VGAM1965 RNA, herein designated VGAM RNA, also designated SEQ ID:4676.

Another function of VGAM1965 is therefore inhibition of FLJ14356 (Accession NM_030824). Accordingly, utilities of VGAM1965 include diagnosis, prevention and treatment of diseases and clinical conditions associated with FLJ14356. FLJ14431 (Accession NM_032783) is another VGAM1965 host target gene. FLJ14431 BINDING SITE is HOST TARGET binding site found in the 3' untranslated region of mRNA encoded by FLJ14431, corresponding to a HOST TARGET binding site such as BINDING SITE I, BINDING SITE II or BINDING SITE III. Table 2 illustrates the complementarity of the nucleotide sequences of FLJ14431 BINDING SITE, designated SEQ ID:26527, to the nucleotide sequence of VGAM1965 RNA, herein designated VGAM RNA, also designated SEQ ID:4676.

Another function of VGAM1965 is therefore inhibition of FLJ14431 (Accession NM_032783). Accordingly, utilities of VGAM1965 include diagnosis, prevention and treatment of diseases and clinical conditions associated with FLJ14431. FLJ14525 (Accession NM_032800) is another VGAM1965 host target gene. FLJ14525 BINDING SITE is HOST TARGET binding site found in the 3' untranslated region of mRNA encoded by FLJ14525, corresponding to a HOST TARGET binding site such as BINDING SITE I, BINDING SITE II or BINDING SITE III. Table 2 illustrates the complementarity of the nucleotide sequences of FLJ14525 BINDING SITE, designated SEQ ID:26550, to the nucleotide sequence of VGAM1965 RNA, herein designated VGAM RNA, also designated SEQ ID:4676.

Another function of VGAM1965 is therefore inhibition of FLJ14525 (Accession NM_032800). Accordingly, utilities of VGAM1965 include diagnosis, prevention and treatment of diseases and clinical conditions associated with FLJ14525. FLJ14751 (Accession NM_032834) is another VGAM1965 host target gene. FLJ14751 BINDING SITE is HOST TARGET binding site found in the 3' untranslated region of mRNA encoded by FLJ14751, corresponding to a HOST TARGET binding site such as BINDING SITE I, BINDING SITE II or BINDING SITE III. Table 2 illustrates the complementarity of the nucleotide sequences of FLJ14751 BINDING SITE, designated SEQ ID:26611, to the nucleotide sequence of VGAM1965 RNA, herein designated VGAM RNA, also designated SEQ ID:4676.

Another function of VGAM1965 is therefore inhibition of FLJ14751 (Accession NM_032834). Accordingly, utilities of VGAM1965 include diagnosis, prevention and treatment of diseases and clinical conditions associated with FLJ14751.

FLJ14871 (Accession NM_032854) is another VGAM1965 host target gene. FLJ14871 BINDING SITE is HOST TARGET binding site found in the 3' untranslated region of mRNA encoded by FLJ14871, corresponding to a HOST TARGET binding site such as BINDING SITE I, BINDING SITE II or BINDING SITE III. Table 2 illustrates the complementarity of the nucleotide sequences of FLJ14871 BINDING SITE, designated SEQ ID:26653, to the nucleotide sequence of VGAM1965 RNA, herein designated VGAM RNA, also designated SEQ ID:4676.

Another function of VGAM1965 is therefore inhibition of FLJ14871 (Accession NM_032854). Accordingly, utilities of VGAM1965 include diagnosis, prevention and treatment of diseases and clinical conditions associated with FLJ14871.

FLJ14888 (Accession NM_032856) is another VGAM1965 host target gene. FLJ14888 BINDING SITE is HOST TARGET binding site found in the 3' untranslated region of mRNA encoded by FLJ14888, corresponding to a HOST TARGET binding site such as BINDING SITE I, BINDING SITE II or BINDING SITE III. Table 2 illustrates the complementarity of the nucleotide sequences of FLJ14888 BINDING SITE, designated SEQ ID:26656, to the nucleotide sequence of VGAM1965 RNA, herein designated VGAM RNA, also designated SEQ ID:4676.

Another function of VGAM1965 is therefore inhibition of FLJ14888 (Accession NM_032856). Accordingly, utilities of VGAM1965 include diagnosis, prevention and treatment of diseases and clinical conditions associated with FLJ14888.

FLJ20034 (Accession NM_017630) is another VGAM1965 host target gene. FLJ20034 BINDING SITE is HOST TARGET binding site found in the 3' untranslated region of mRNA encoded by FLJ20034, corresponding to a HOST TARGET binding site such as BINDING SITE I, BINDING SITE II or BINDING SITE III. Table 2 illustrates the complementarity of the nucleotide sequences of FLJ20034 BINDING SITE, designated SEQ ID:19138, to the nucleotide sequence of VGAM1965 RNA, herein designated VGAM RNA, also designated SEQ ID:4676.

Another function of VGAM1965 is therefore inhibition of FLJ20034 (Accession NM_017630). Accordingly, utilities of VGAM1965 include diagnosis, prevention and treatment of diseases and clinical conditions associated with FLJ20034.

FLJ20139 (Accession NM_017685) is another VGAM1965 host target gene. FLJ20139 BINDING SITE is HOST TARGET binding site found in the 3' untranslated region of mRNA encoded by FLJ20139, corresponding to a HOST TARGET binding site such as BINDING SITE I, BINDING SITE II or BINDING SITE III. Table 2 illustrates the complementarity of the nucleotide sequences of FLJ20139 BINDING SITE, designated SEQ ID:19235, to the nucleotide sequence of VGAM1965 RNA, herein designated VGAM RNA, also designated SEQ ID:4676.

Another function of VGAM1965 is therefore inhibition of FLJ20139 (Accession NM_017685). Accordingly, utilities of VGAM1965 include diagnosis, prevention and treatment of diseases and clinical conditions associated with FLJ20139.

FLJ20150 (Accession NM_017688) is another VGAM1965 host target gene. FLJ20150 BINDING SITE is HOST TARGET binding site found in the 3' untranslated region of mRNA encoded by FLJ20150, corresponding to a HOST TARGET binding site such as BINDING SITE I, BINDING SITE II or BINDING SITE III. Table 2 illustrates the complementarity of the nucleotide sequences of FLJ20150 BINDING SITE, designated SEQ ID:19244, to the nucleotide sequence of VGAM1965 RNA, herein designated VGAM RNA, also designated SEQ ID:4676.

Another function of VGAM1965 is therefore inhibition of FLJ20150 (Accession NM_017688). Accordingly, utilities of VGAM1965 include diagnosis, prevention and treatment of diseases and clinical conditions associated with FLJ20150.

FLJ20232 (Accession NM_019008) is another VGAM1965 host target gene. FLJ20232 BINDING SITE is HOST TARGET binding site found in the 5' untranslated region of mRNA encoded by FLJ20232, corresponding to a HOST TARGET binding site such as BINDING SITE I, BINDING SITE II or BINDING SITE III. Table 2 illustrates the complementarity of the nucleotide sequences of FLJ20232 BINDING SITE, designated SEQ ID:21089, to the nucleotide sequence of VGAM1965 RNA, herein designated VGAM RNA, also designated SEQ ID:4676.

Another function of VGAM1965 is therefore inhibition of FLJ20232 (Accession NM_019008). Accordingly, utilities of VGAM1965 include diagnosis, prevention and treatment of diseases and clinical conditions associated with FLJ20232.

FLJ20308 (Accession XM_039852) is another VGAM1965 host target gene. FLJ20308 BINDING SITE is HOST TARGET binding site found in the 3' untranslated region of mRNA encoded by FLJ20308, corresponding to a HOST TARGET binding site such as BINDING SITE I, BINDING SITE II or BINDING SITE III. Table 2 illustrates the complementarity of the nucleotide sequences of FLJ20308 BINDING SITE, designated SEQ ID:33198, to the nucleotide sequence of VGAM1965 RNA, herein designated VGAM RNA, also designated SEQ ID:4676.

Another function of VGAM1965 is therefore inhibition of FLJ20308 (Accession XM_039852). Accordingly, utilities of VGAM1965 include diagnosis, prevention and treatment of diseases and clinical conditions associated with FLJ20308.

FLJ20343 (Accession NM_017775) is another VGAM1965 host target gene. FLJ20343 BINDING SITE is HOST TARGET binding site found in the 3' untranslated region of mRNA encoded by FLJ20343, corresponding to a HOST TARGET binding site such as BINDING SITE I, BINDING SITE II or BINDING SITE III. Table 2 illustrates the complementarity of the nucleotide sequences of FLJ20343 BINDING SITE, designated SEQ ID:19400, to the nucleotide sequence of VGAM1965 RNA, herein designated VGAM RNA, also designated SEQ ID:4676.

Another function of VGAM1965 is therefore inhibition of FLJ20343 (Accession NM_017775). Accordingly, utilities of VGAM1965 include diagnosis, prevention and treatment of diseases and clinical conditions associated with FLJ20343.

FLJ20413 (Accession NM_017808) is another VGAM1965 host target gene. FLJ20413 BINDING SITE is HOST TARGET binding site found in the 3' untranslated region of mRNA encoded by FLJ20413, corresponding to a HOST TARGET binding site such as BINDING SITE I, BINDING SITE II or BINDING SITE III. Table 2 illustrates the complementarity of the nucleotide sequences of FLJ20413 BINDING SITE, designated SEQ ID:19454, to the nucleotide sequence of VGAM1965 RNA, herein designated VGAM RNA, also designated SEQ ID:4676.

Another function of VGAM1965 is therefore inhibition of FLJ20413 (Accession NM_017808). Accordingly, utilities of VGAM1965 include diagnosis, prevention and treatment of diseases and clinical conditions associated with FLJ20413.

FLJ20511 (Accession NM_017853) is another VGAM1965 host target gene. FLJ20511 BINDING SITE is HOST TARGET binding site found in the 5' untranslated region of mRNA encoded by FLJ20511, corresponding to a HOST TARGET binding site such as BINDING SITE I, BINDING SITE II or BINDING SITE III. Table 2 illustrates the complementarity of the nucleotide sequences of FLJ20511 BINDING SITE, designated SEQ ID:19530, to the nucleotide sequence of VGAM1965 RNA, herein designated VGAM RNA, also designated SEQ ID:4676.

Another function of VGAM1965 is therefore inhibition of FLJ20511 (Accession NM_017853). Accordingly, utilities of VGAM1965 include diagnosis, prevention and treatment of diseases and clinical conditions associated with FLJ20511. FLJ20666 (Accession NM_017922) is another VGAM1965 host target gene. FLJ20666 BINDING SITE is HOST TARGET binding site found in the 5' untranslated region of mRNA encoded by FLJ20666, corresponding to a HOST TARGET binding site such as BINDING SITE I, BINDING SITE II or BINDING SITE III. Table 2 illustrates the complementarity of the nucleotide sequences of FLJ20666 BINDING SITE, designated SEQ ID:19584, to the nucleotide sequence of VGAM1965 RNA, herein designated VGAM RNA, also designated SEQ ID:4676.

Another function of VGAM1965 is therefore inhibition of FLJ20666 (Accession NM_017922). Accordingly, utilities of VGAM1965 include diagnosis, prevention and treatment of diseases and clinical conditions associated with FLJ20666. FLJ20686 (Accession NM_017925) is another VGAM1965 host target gene. FLJ20686 BINDING SITE is HOST TARGET binding site found in the 3' untranslated region of mRNA encoded by FLJ20686, corresponding to a HOST TARGET binding site such as BINDING SITE I, BINDING SITE II or BINDING SITE III. Table 2 illustrates the complementarity of the nucleotide sequences of FLJ20686 BINDING SITE, designated SEQ ID:19596, to the nucleotide sequence of VGAM1965 RNA, herein designated VGAM RNA, also designated SEQ ID:4676.

Another function of VGAM1965 is therefore inhibition of FLJ20686 (Accession NM_017925). Accordingly, utilities of VGAM1965 include diagnosis, prevention and treatment of diseases and clinical conditions associated with FLJ20686. FLJ20689 (Accession NM_017926) is another VGAM1965 host target gene. FLJ20689 BINDING SITE1 and FLJ20689 BINDING SITE2 are HOST TARGET binding sites found in untranslated regions of mRNA encoded by FLJ20689, corresponding to HOST TARGET binding sites such as BINDING SITE I, BINDING SITE II or BINDING SITE III. Table 2 illustrates the complementarity of the nucleotide sequences of FLJ20689 BINDING SITE1 and FLJ20689 BINDING SITE2, designated SEQ ID:19600 and SEQ ID:19704 respectively, to the nucleotide sequence of VGAM1965 RNA, herein designated VGAM RNA, also designated SEQ ID:4676.

Another function of VGAM1965 is therefore inhibition of FLJ20689 (Accession NM_017926). Accordingly, utilities of VGAM1965 include diagnosis, prevention and treatment of diseases and clinical conditions associated with FLJ20689. FLJ22004 (Accession NM_025181) is another VGAM1965 host target gene. FLJ22004 BINDING SITE is HOST TARGET binding site found in the 3' untranslated region of mRNA encoded by FLJ22004, corresponding to a HOST TARGET binding site such as BINDING SITE I, BINDING SITE II or BINDING SITE III. Table 2 illustrates the complementarity of the nucleotide sequences of FLJ22004 BINDING SITE, designated SEQ ID:24817, to the nucleotide sequence of VGAM1965 RNA, herein designated VGAM RNA, also designated SEQ ID:4676.

Another function of VGAM1965 is therefore inhibition of FLJ22004 (Accession NM_025181). Accordingly, utilities of VGAM1965 include diagnosis, prevention and treatment of diseases and clinical conditions associated with FLJ22004. FLJ22301 (Accession NM_024836) is another VGAM1965 host target gene. FLJ22301 BINDING SITE is HOST TARGET binding site found in the 5' untranslated region of mRNA encoded by FLJ22301, corresponding to a HOST TARGET binding site such as BINDING SITE I, BINDING SITE II or BINDING SITE III. Table 2 illustrates the complementarity of the nucleotide sequences of FLJ22301 BINDING SITE, designated SEQ ID:24242, to the nucleotide sequence of VGAM1965 RNA, herein designated VGAM RNA, also designated SEQ ID:4676.

Another function of VGAM1965 is therefore inhibition of FLJ22301 (Accession NM_024836). Accordingly, utilities of VGAM1965 include diagnosis, prevention and treatment of diseases and clinical conditions associated with FLJ22301. FLJ22761 (Accession NM_025130) is another VGAM1965 host target gene. FLJ22761 BINDING SITE is HOST TARGET binding site found in the 5' untranslated region of mRNA encoded by FLJ22761, corresponding to a HOST TARGET binding site such as BINDING SITE I, BINDING SITE II or BINDING SITE III. Table 2 illustrates the complementarity of the nucleotide sequences of FLJ22761 BINDING SITE, designated SEQ ID:24772, to the nucleotide sequence of VGAM1965 RNA, herein designated VGAM RNA, also designated SEQ ID:4676.

Another function of VGAM1965 is therefore inhibition of FLJ22761 (Accession NM_025130). Accordingly, utilities of VGAM1965 include diagnosis, prevention and treatment of diseases and clinical conditions associated with FLJ22761. FLJ23040 (Accession NM_025174) is another VGAM1965 host target gene. FLJ23040 BINDING SITE is HOST TARGET binding site found in the 3' untranslated region of mRNA encoded by FLJ23040, corresponding to a HOST TARGET binding site such as BINDING SITE I, BINDING SITE II or BINDING SITE III. Table 2 illustrates the complementarity of the nucleotide sequences of FLJ23040 BINDING SITE, designated SEQ ID:24809, to the nucleotide sequence of VGAM1965 RNA, herein designated VGAM RNA, also designated SEQ ID:4676.

Another function of VGAM1965 is therefore inhibition of FLJ23040 (Accession NM_025174). Accordingly, utilities of VGAM1965 include diagnosis, prevention and treatment of diseases and clinical conditions associated with FLJ23040. FLJ23119 (Accession NM_024652) is another VGAM1965 host target gene. FLJ23119 BINDING SITE is HOST TARGET binding site found in the 3' untranslated region of mRNA encoded by FLJ23119, corresponding to a HOST TARGET binding site such as BINDING SITE I, BINDING SITE II or BINDING SITE III. Table 2 illustrates the complementarity of the nucleotide sequences of FLJ23119 BINDING SITE, designated SEQ ID:23949, to the nucleotide sequence of VGAM1965 RNA, herein designated VGAM RNA, also designated SEQ ID:4676.

Another function of VGAM1965 is therefore inhibition of FLJ23119 (Accession NM_024652). Accordingly, utilities of VGAM1965 include diagnosis, prevention and treatment of diseases and clinical conditions associated with FLJ23119. FLJ23311 (Accession NM_024680) is another VGAM1965 host target gene. FLJ23311 BINDING SITE is HOST TARGET binding site found in the 3' untranslated region of mRNA encoded by FLJ23311, corresponding to a HOST TARGET binding site such as BINDING SITE I, BINDING SITE II or BINDING SITE III. Table 2 illustrates the complementarity of the nucleotide sequences of FLJ23311 BINDING SITE, designated SEQ ID:23993, to the nucleotide sequence of VGAM1965 RNA, herein designated VGAM RNA, also designated SEQ ID:4676.

Another function of VGAM1965 is therefore inhibition of FLJ23311 (Accession NM_024680). Accordingly, utilities of VGAM1965 include diagnosis, prevention and treatment of diseases and clinical conditions associated with FLJ23311. FLJ23342 (Accession NM_024631) is another VGAM1965 host target gene. FLJ23342 BINDING SITE is HOST TARGET binding site found in the 3' untranslated region of mRNA encoded by FLJ23342, corresponding to a HOST TARGET binding site such as BINDING SITE I, BINDING SITE II or BINDING SITE III. Table 2 illustrates the complementarity of the nucleotide sequences of FLJ23342 BINDING SITE, designated SEQ ID:23899, to the nucleotide sequence of VGAM1965 RNA, herein designated VGAM RNA, also designated SEQ ID:4676.

Another function of VGAM1965 is therefore inhibition of FLJ23342 (Accession NM_024631). Accordingly, utilities of VGAM1965 include diagnosis, prevention and treatment of diseases and clinical conditions associated with FLJ23342. FLJ23462 (Accession NM_024843) is another VGAM1965 host target gene. FLJ23462 BINDING SITE is HOST TARGET binding site found in the 3' untranslated region of mRNA encoded by FLJ23462, corresponding to a HOST TARGET binding site such as BINDING SITE I, BINDING SITE II or BINDING SITE III. Table 2 illustrates the complementarity of the nucleotide sequences of FLJ23462 BINDING SITE, designated SEQ ID:24268, to the nucleotide sequence of VGAM1965 RNA, herein designated VGAM RNA, also designated SEQ ID:4676.

Another function of VGAM1965 is therefore inhibition of FLJ23462 (Accession NM_024843). Accordingly, utilities of VGAM1965 include diagnosis, prevention and treatment of diseases and clinical conditions associated with FLJ23462. FLJ23499 (Accession NM_022761) is another VGAM1965 host target gene. FLJ23499 BINDING SITE is HOST TARGET binding site found in the 3' untranslated region of mRNA encoded by FLJ23499, corresponding to a HOST TARGET binding site such as BINDING SITE I, BINDING SITE II or BINDING SITE III. Table 2 illustrates the complementarity of the nucleotide sequences of FLJ23499 BINDING SITE, designated SEQ ID:23008, to the nucleotide sequence of VGAM1965 RNA, herein designated VGAM RNA, also designated SEQ ID:4676.

Another function of VGAM1965 is therefore inhibition of FLJ23499 (Accession NM_022761). Accordingly, utilities of VGAM1965 include diagnosis, prevention and treatment of diseases and clinical conditions associated with FLJ23499. FLJ23556 (Accession NM_024880) is another VGAM1965 host target gene. FLJ23556 BINDING SITE is HOST TARGET binding site found in the 3' untranslated region of mRNA encoded by FLJ23556, corresponding to a HOST TARGET binding site such as BINDING SITE I, BINDING SITE II or BINDING SITE III. Table 2 illustrates the complementarity of the nucleotide sequences of FLJ23556 BINDING SITE, designated SEQ ID:24321, to the nucleotide sequence of VGAM1965 RNA, herein designated VGAM RNA, also designated SEQ ID:4676.

Another function of VGAM1965 is therefore inhibition of FLJ23556 (Accession NM_024880). Accordingly, utilities of VGAM1965 include diagnosis, prevention and treatment of diseases and clinical conditions associated with FLJ23556. FLJ23590 (Accession NM_024649) is another VGAM1965 host target gene. FLJ23590 BINDING SITE is HOST TARGET binding site found in the 3' untranslated region of mRNA encoded by FLJ23590, corresponding to a HOST TARGET binding site such as BINDING SITE I, BINDING SITE II or BINDING SITE III. Table 2 illustrates the complementarity of the nucleotide sequences of FLJ23590 BINDING SITE, designated SEQ ID:23942, to the nucleotide sequence of VGAM1965 RNA, herein designated VGAM RNA, also designated SEQ ID:4676.

Another function of VGAM1965 is therefore inhibition of FLJ23590 (Accession NM_024649). Accordingly, utilities of VGAM1965 include diagnosis, prevention and treatment of diseases and clinical conditions associated with FLJ23590. FLJ25415 (Accession NM_144708) is another VGAM1965 host target gene. FLJ25415 BINDING SITE is HOST TARGET binding site found in the 3' untranslated region of mRNA encoded by FLJ25415, corresponding to a HOST TARGET binding site such as BINDING SITE I, BINDING SITE II or BINDING SITE III. Table 2 illustrates the complementarity of the nucleotide sequences of FLJ25415 BINDING SITE, designated SEQ ID:29534, to the nucleotide sequence of VGAM1965 RNA, herein designated VGAM RNA, also designated SEQ ID:4676.

Another function of VGAM1965 is therefore inhibition of FLJ25415 (Accession NM_144708). Accordingly, utilities of VGAM1965 include diagnosis, prevention and treatment of diseases and clinical conditions associated with FLJ25415. FLJ30294 (Accession NM_144632) is another VGAM1965 host target gene. FLJ30294 BINDING SITE is HOST TARGET binding site found in the 3' untranslated region of mRNA encoded by FLJ30294, corresponding to a HOST TARGET binding site such as BINDING SITE I, BINDING SITE II or BINDING SITE III. Table 2 illustrates the complementarity of the nucleotide sequences of FLJ30294 BINDING SITE, designated SEQ ID:29450, to the nucleotide sequence of VGAM1965 RNA, herein designated VGAM RNA, also designated SEQ ID:4676.

Another function of VGAM1965 is therefore inhibition of FLJ30294 (Accession NM_144632). Accordingly, utilities of VGAM1965 include diagnosis, prevention and treatment of diseases and clinical conditions associated with FLJ30294. FLJ30567 (Accession NM_145022) is another VGAM1965 host target gene. FLJ30567 BINDING SITE is HOST TARGET binding site found in the 3' untranslated region of mRNA encoded by FLJ30567, corresponding to a HOST TARGET binding site such as BINDING SITE I, BINDING SITE II or BINDING SITE III. Table 2 illustrates the complementarity of the nucleotide sequences of FLJ30567 BINDING SITE, designated SEQ ID:29634, to the nucleotide sequence of VGAM1965 RNA, herein designated VGAM RNA, also designated SEQ ID:4676.

Another function of VGAM1965 is therefore inhibition of FLJ30567 (Accession NM_145022). Accordingly, utilities of VGAM1965 include diagnosis, prevention and treatment of diseases and clinical conditions associated with FLJ30567. FLJ31890 (Accession XM_166117) is another VGAM1965 host target gene. FLJ31890 BINDING SITE is HOST TARGET binding site found in the 3' untranslated region of mRNA encoded by FLJ31890, corresponding to a HOST TARGET binding site such as BINDING SITE I, BINDING SITE II or BINDING SITE III. Table 2 illustrates the complementarity of the nucleotide sequences of FLJ31890 BINDING SITE, designated SEQ ID:43893, to the nucleotide sequence of VGAM1965 RNA, herein designated VGAM RNA, also designated SEQ ID:4676.

Another function of VGAM1965 is therefore inhibition of FLJ31890 (Accession XM_166117). Accordingly, utilities of VGAM1965 include diagnosis, prevention and treatment of diseases and clinical conditions associated with FLJ31890. FLJ32865 (Accession NM_144613) is another VGAM1965 host target gene. FLJ32865 BINDING SITE is HOST TARGET binding site found in the 3' untranslated region of mRNA encoded by FLJ32865, corresponding to a HOST TARGET binding site such as BINDING SITE I, BINDING SITE II or BINDING SITE III. Table 2 illustrates the complementarity of the nucleotide sequences of FLJ32865 BINDING SITE, designated SEQ ID:29428, to the nucleotide sequence of VGAM1965 RNA, herein designated VGAM RNA, also designated SEQ ID:4676.

Another function of VGAM1965 is therefore inhibition of FLJ32865 (Accession NM_144613). Accordingly, utilities of VGAM1965 include diagnosis, prevention and treatment of diseases and clinical conditions associated with FLJ32865. FLJ32894 (Accession NM_144667) is another VGAM1965 host target gene. FLJ32894 BINDING SITE is HOST TARGET binding site found in the 3' untranslated region of mRNA encoded by FLJ32894, corresponding to a HOST TARGET binding site such as BINDING SITE I, BINDING SITE II or BINDING SITE III. Table 2 illustrates the complementarity of the nucleotide sequences of FLJ32894 BINDING SITE, designated SEQ ID:29486, to the nucleotide sequence of VGAM1965 RNA, herein designated VGAM RNA, also designated SEQ ID:4676.

Another function of VGAM1965 is therefore inhibition of FLJ32894 (Accession NM_144667). Accordingly, utilities of VGAM1965 include diagnosis, prevention and treatment of diseases and clinical conditions associated with FLJ32894. FLJ33069 (Accession NM_144649) is another VGAM1965 host target gene. FLJ33069 BINDING SITE is HOST TARGET binding site found in the 3' untranslated region of mRNA encoded by FLJ33069, corresponding to a HOST TARGET binding site such as BINDING SITE I, BINDING SITE II or BINDING SITE III. Table 2 illustrates the complementarity of the nucleotide sequences of FLJ33069 BINDING SITE, designated SEQ ID:29476, to the nucleotide sequence of VGAM1965 RNA, herein designated VGAM RNA, also designated SEQ ID:4676.

Another function of VGAM1965 is therefore inhibition of FLJ33069 (Accession NM_144649). Accordingly, utilities of VGAM1965 include diagnosis, prevention and treatment of diseases and clinical conditions associated with FLJ33069. Forkhead Box H1 (FOXH1, Accession NM_003923) is another VGAM1965 host target gene. FOXH1 BINDING SITE is HOST TARGET binding site found in the 5' untranslated region of mRNA encoded by FOXH1, corresponding to a HOST TARGET binding site such as BINDING SITE I, BINDING SITE II or BINDING SITE III. Table 2 illustrates the complementarity of the nucleotide sequences of FOXH1 BINDING SITE, designated SEQ ID:10012, to the nucleotide sequence of VGAM1965 RNA, herein designated VGAM RNA, also designated SEQ ID:4676.

Another function of VGAM1965 is therefore inhibition of Forkhead Box H1 (FOXH1, Accession NM_003923). Accordingly, utilities of VGAM1965 include diagnosis, prevention and treatment of diseases and clinical conditions associated with FOXH1. FRSB (Accession NM_005687) is another VGAM1965 host target gene. FRSB BINDING SITE is HOST TARGET binding site found in the 3' untranslated region of mRNA encoded by FRSB, corresponding to a HOST TARGET binding site such as BINDING SITE I, BINDING SITE II or BINDING SITE III. Table 2 illustrates the complementarity of the nucleotide sequences of FRSB BINDING SITE, designated SEQ ID:12247, to the nucleotide sequence of VGAM1965 RNA, herein designated VGAM RNA, also designated SEQ ID:4676.

Another function of VGAM1965 is therefore inhibition of FRSB (Accession NM_005687). Accordingly, utilities of VGAM1965 include diagnosis, prevention and treatment of diseases and clinical conditions associated with FRSB. GRB2-associated Binding Protein 3 (GAB3, Accession NM_080612) is another VGAM1965 host target gene. GAB3 BINDING SITE is HOST TARGET binding site found in the 3' untranslated region of mRNA encoded by GAB3, corresponding to a HOST TARGET binding site such as BINDING SITE I, BINDING SITE II or BINDING SITE III. Table 2 illustrates the complementarity of the nucleotide sequences of GAB3 BINDING SITE, designated SEQ ID:27929, to the nucleotide sequence of VGAM1965 RNA, herein designated VGAM RNA, also designated SEQ ID:4676.

Another function of VGAM1965 is therefore inhibition of GRB2-associated Binding Protein 3 (GAB3, Accession NM_080612). Accordingly, utilities of VGAM1965 include diagnosis, prevention and treatment of diseases and clinical conditions associated with GAB3. GAPCENA (Accession NM_012197) is another VGAM1965 host target gene. GAPCENA BINDING SITE is HOST TARGET binding site found in the 3' untranslated region of mRNA encoded by GAPCENA, corresponding to a HOST TARGET binding site such as BINDING SITE I, BINDING SITE II or BINDING SITE III. Table 2 illustrates the complementarity of the nucleotide sequences of GAPCENA BINDING SITE, designated SEQ ID:14496, to the nucleotide sequence of VGAM1965 RNA, herein designated VGAM RNA, also designated SEQ ID:4676.

Another function of VGAM1965 is therefore inhibition of GAPCENA (Accession NM_012197). Accordingly, utilities of VGAM1965 include diagnosis, prevention and treatment of diseases and clinical conditions associated with GAPCENA. Ganglioside-induced Differentiation-associated Protein 1-like 1 (GDAP1L1, Accession NM_024034) is another VGAM1965 host target gene. GDAP1L1 BINDING SITE is HOST TARGET binding site found in the 3' untranslated region of mRNA encoded by GDAP1L1, corresponding to a HOST TARGET binding site such as BINDING SITE I, BINDING SITE II or BINDING SITE III. Table 2 illustrates the complementarity of the nucleotide sequences of GDAP1L1 BINDING SITE, designated SEQ ID:23466, to the nucleotide sequence of VGAM1965 RNA, herein designated VGAM RNA, also designated SEQ ID:4676.

Another function of VGAM1965 is therefore inhibition of Ganglioside-induced Differentiation-associated Protein 1-like 1 (GDAP1L1, Accession NM_024034). Accordingly, utilities of VGAM1965 include diagnosis, prevention and treatment of diseases and clinical conditions associated with GDAP1L1. GENX-3414 (Accession NM_003943) is another VGAM1965 host target gene. GENX-3414 BINDING SITE is HOST TARGET binding site found in the 3' untranslated region of mRNA encoded by GENX-3414, corresponding to a HOST TARGET binding site such as BINDING SITE I, BINDING SITE II or BINDING SITE III. Table 2 illustrates the complementarity of the nucleotide sequences of GENX-3414 BINDING SITE, designated SEQ ID:10060, to the nucleotide sequence of VGAM1965 RNA, herein designated VGAM RNA, also designated SEQ ID:4676.

Another function of VGAM1965 is therefore inhibition of GENX-3414 (Accession NM_003943). Accordingly, utilities of VGAM1965 include diagnosis, prevention and treatment of diseases and clinical conditions associated with GENX-3414. Golgi Associated, Gamma Adaptin Ear Containing, ARF Binding Protein 2 (GGA2, Accession NM_138640) is another VGAM1965 host target gene. GGA2 BINDING SITE1 and GGA2 BINDING SITE2 are HOST TARGET binding sites found in untranslated regions of mRNA encoded by GGA2, corresponding to HOST TARGET binding sites such as BINDING SITE I, BINDING SITE II or BINDING SITE III. Table 2 illustrates the complementarity of the nucleotide sequences of GGA2 BINDING SITE1 and GGA2

BINDING SITE2, designated SEQ ID:28927 and SEQ ID:17405 respectively, to the nucleotide sequence of VGAM1965 RNA, herein designated VGAM RNA, also designated SEQ ID:4676.

Another function of VGAM1965 is therefore inhibition of Golgi Associated, Gamma Adaptin Ear Containing, ARF Binding Protein 2 (GGA2, Accession NM_138640). Accordingly, utilities of VGAM1965 include diagnosis, prevention and treatment of diseases and clinical conditions associated with GGA2. Golgi Autoantigen, Golgin Subfamily A, 2-like, Y-linked (GOLGA2LY, Accession XM_034789) is another VGAM1965 host target gene. GOLGA2LY BINDING SITE is HOST TARGET binding site found in the 5' untranslated region of mRNA encoded by GOLGA2LY, corresponding to a HOST TARGET binding site such as BINDING SITE I, BINDING SITE II or BINDING SITE III. Table 2 illustrates the complementarity of the nucleotide sequences of GOLGA2LY BINDING SITE, designated SEQ ID:32145, to the nucleotide sequence of VGAM1965 RNA, herein designated VGAM RNA, also designated SEQ ID:4676.

Another function of VGAM1965 is therefore inhibition of Golgi Autoantigen, Golgin Subfamily A, 2-like, Y-linked (GOLGA2LY, Accession XM_034789). Accordingly, utilities of VGAM1965 include diagnosis, prevention and treatment of diseases and clinical conditions associated with GOLGA2LY. Glycoprotein V (platelet) (GP5, Accession NM_004488) is another VGAM1965 host target gene. GP5 BINDING SITE is HOST TARGET binding site found in the 3' untranslated region of mRNA encoded by GP5, corresponding to a HOST TARGET binding site such as BINDING SITE I, BINDING SITE II or BINDING SITE III. Table 2 illustrates the complementarity of the nucleotide sequences of GP5 BINDING SITE, designated SEQ ID:10820, to the nucleotide sequence of VGAM1965 RNA, herein designated VGAM RNA, also designated SEQ ID:4676.

Another function of VGAM1965 is therefore inhibition of Glycoprotein V (platelet) (GP5, Accession NM_004488). Accordingly, utilities of VGAM1965 include diagnosis, prevention and treatment of diseases and clinical conditions associated with GP5. G Protein Pathway Suppressor 2 (GPS2, Accession NM_004489) is another VGAM1965 host target gene. GPS2 BINDING SITE1 through GPS2 BINDING SITE3 are HOST TARGET binding sites found in untranslated regions of mRNA encoded by GPS2, corresponding to HOST TARGET binding sites such as BINDING SITE I, BINDING SITE II or BINDING SITE III. Table 2 illustrates the complementarity of the nucleotide sequences of GPS2 BINDING SITE1 through GPS2 BINDING SITE3, designated SEQ ID:10828, SEQ ID:42149 and SEQ ID:42150 respectively, to the nucleotide sequence of VGAM1965 RNA, herein designated VGAM RNA, also designated SEQ ID:4676.

Another function of VGAM1965 is therefore inhibition of G Protein Pathway Suppressor 2 (GPS2, Accession NM_004489). Accordingly, utilities of VGAM1965 include diagnosis, prevention and treatment of diseases and clinical conditions associated with GPS2. GTP Binding Protein 2 (GTPBP2, Accession NM_019096) is another VGAM1965 host target gene. GTPBP2 BINDING SITE is HOST TARGET binding site found in the 3' untranslated region of mRNA encoded by GTPBP2, corresponding to a HOST TARGET binding site such as BINDING SITE I, BINDING SITE II or BINDING SITE III. Table 2 illustrates the complementarity of the nucleotide sequences of GTPBP2 BINDING SITE, designated SEQ ID:21174, to the nucleotide sequence of VGAM1965 RNA, herein designated VGAM RNA, also designated SEQ ID:4676.

Another function of VGAM1965 is therefore inhibition of GTP Binding Protein 2 (GTPBP2, Accession NM_019096). Accordingly, utilities of VGAM1965 include diagnosis, prevention and treatment of diseases and clinical conditions associated with GTPBP2. G-2 and S-phase Expressed 1 (GTSE1, Accession NM_016426) is another VGAM1965 host target gene. GTSE1 BINDING SITE is HOST TARGET binding site found in the 3' untranslated region of mRNA encoded by GTSE1, corresponding to a HOST TARGET binding site such as BINDING SITE I, BINDING SITE II or BINDING SITE III. Table 2 illustrates the complementarity of the nucleotide sequences of GTSE1 BINDING SITE, designated SEQ ID:18547, to the nucleotide sequence of VGAM1965 RNA, herein designated VGAM RNA, also designated SEQ ID:4676.

Another function of VGAM1965 is therefore inhibition of G-2 and S-phase Expressed 1 (GTSE1, Accession NM_016426). Accordingly, utilities of VGAM1965 include diagnosis, prevention and treatment of diseases and clinical conditions associated with GTSE1. H326 (Accession NM_015726) is another VGAM1965 host target gene. H326 BINDING SITE is HOST TARGET binding site found in the 3' untranslated region of mRNA encoded by H326, corresponding to a HOST TARGET binding site such as BINDING SITE I, BINDING SITE II or BINDING SITE III. Table 2 illustrates the complementarity of the nucleotide sequences of H326 BINDING SITE, designated SEQ ID:17940, to the nucleotide sequence of VGAM1965 RNA, herein designated VGAM RNA, also designated SEQ ID:4676.

Another function of VGAM1965 is therefore inhibition of H326 (Accession NM_015726). Accordingly, utilities of VGAM1965 include diagnosis, prevention and treatment of diseases and clinical conditions associated with H326. HCA127 (Accession NM_018684) is another VGAM1965 host target gene. HCA127 BINDING SITE is HOST TARGET binding site found in the 3' untranslated region of mRNA encoded by HCA127, corresponding to a HOST TARGET binding site such as BINDING SITE I, BINDING SITE II or BINDING SITE III. Table 2 illustrates the complementarity of the nucleotide sequences of HCA127 BINDING SITE, designated SEQ ID:20757, to the nucleotide sequence of VGAM1965 RNA, herein designated VGAM RNA, also designated SEQ ID:4676.

Another function of VGAM1965 is therefore inhibition of HCA127 (Accession NM_018684). Accordingly, utilities of VGAM1965 include diagnosis, prevention and treatment of diseases and clinical conditions associated with HCA127. HIG2 (Accession NM_013332) is another VGAM1965 host target gene. HIG2 BINDING SITE is HOST TARGET binding site found in the 3' untranslated region of mRNA encoded by HIG2, corresponding to a HOST TARGET binding site such as BINDING SITE I, BINDING SITE II or BINDING SITE III. Table 2 illustrates the complementarity of the nucleotide sequences of HIG2 BINDING SITE, designated SEQ ID:14979, to the nucleotide sequence of VGAM1965 RNA, herein designated VGAM RNA, also designated SEQ ID:4676.

Another function of VGAM1965 is therefore inhibition of HIG2 (Accession NM_013332). Accordingly, utilities of VGAM1965 include diagnosis, prevention and treatment of diseases and clinical conditions associated with HIG2. HSPC065 (Accession NM_014157) is another VGAM1965 host target gene. HSPC065 BINDING SITE is HOST TARGET binding site found in the 3' untranslated region of mRNA encoded by HSPC065, corresponding to a HOST TARGET binding site such as BINDING SITE I, BINDING SITE II or BINDING SITE III. Table 2 illustrates the complementarity of the nucleotide sequences of HSPC065 BINDING SITE, designated SEQ ID:15456, to the nucleotide sequence of VGAM1965 RNA, herein designated VGAM RNA, also designated SEQ ID:4676.

Another function of VGAM1965 is therefore inhibition of HSPC065 (Accession NM_014157). Accordingly, utilities of VGAM1965 include diagnosis, prevention and treatment of diseases and clinical conditions associated with HSPC065. HT002 (Accession NM_014066) is another VGAM1965 host target gene. HT002 BINDING SITE is HOST TARGET binding site found in the 3' untranslated region of mRNA encoded by HT002, corresponding to a HOST TARGET binding site such as BINDING SITE I, BINDING SITE II or BINDING SITE III. Table 2 illustrates the complementarity of the nucleotide sequences of HT002 BINDING SITE, designated SEQ ID:15280, to the nucleotide sequence of VGAM1965 RNA, herein designated VGAM RNA, also designated SEQ ID:4676.

Another function of VGAM1965 is therefore inhibition of HT002 (Accession NM_014066). Accordingly, utilities of VGAM1965 include diagnosis, prevention and treatment of diseases and clinical conditions associated with HT002. HT007 (Accession NM_018480) is another VGAM1965 host target gene. HT007 BINDING SITE is HOST TARGET binding site found in the 5' untranslated region of mRNA encoded by HT007, corresponding to a HOST TARGET binding site such as BINDING SITE I, BINDING SITE II or BINDING SITE III. Table 2 illustrates the complementarity of the nucleotide sequences of HT007 BINDING SITE, designated SEQ ID:20543, to the nucleotide sequence of VGAM1965 RNA, herein designated VGAM RNA, also designated SEQ ID:4676.

Another function of VGAM1965 is therefore inhibition of HT007 (Accession NM_018480). Accordingly, utilities of VGAM1965 include diagnosis, prevention and treatment of diseases and clinical conditions associated with HT007. HUMNPIIY20 (Accession XM_096782) is another VGAM1965 host target gene. HUMNPIIY20 BINDING SITE is HOST TARGET binding site found in the 3' untranslated region of mRNA encoded by HUMNPIIY20, corresponding to a HOST TARGET binding site such as BINDING SITE I, BINDING SITE II or BINDING SITE III. Table 2 illustrates the complementarity of the nucleotide sequences of HUMNPIIY20 BINDING SITE, designated SEQ ID:40538, to the nucleotide sequence of VGAM1965 RNA, herein designated VGAM RNA, also designated SEQ ID:4676.

Another function of VGAM1965 is therefore inhibition of HUMNPIIY20 (Accession XM_096782). Accordingly, utilities of VGAM1965 include diagnosis, prevention and treatment of diseases and clinical conditions associated with HUMNPIIY20. HYA22 (Accession NM_005808) is another VGAM1965 host target gene. HYA22 BINDING SITE is HOST TARGET binding site found in the 3' untranslated region of mRNA encoded by HYA22, corresponding to a HOST TARGET binding site such as BINDING SITE I, BINDING SITE II or BINDING SITE III. Table 2 illustrates the complementarity of the nucleotide sequences of HYA22 BINDING SITE, designated SEQ ID:12390, to the nucleotide sequence of VGAM1965 RNA, herein designated VGAM RNA, also designated SEQ ID:4676.

Another function of VGAM1965 is therefore inhibition of HYA22 (Accession NM_005808). Accordingly, utilities of VGAM1965 include diagnosis, prevention and treatment of diseases and clinical conditions associated with HYA22. IDN3 (Accession NM_133433) is another VGAM1965 host target gene. IDN3 BINDING SITE1 and IDN3 BINDING SITE2 are HOST TARGET binding sites found in untranslated regions of mRNA encoded by IDN3, corresponding to HOST TARGET binding sites such as BINDING SITE I, BINDING SITE II or BINDING SITE III. Table 2 illustrates the complementarity of the nucleotide sequences of IDN3 BINDING SITE1 and IDN3 BINDING SITE2, designated SEQ ID:28513 and SEQ ID:17685 respectively, to the nucleotide sequence of VGAM1965 RNA, herein designated VGAM RNA, also designated SEQ ID:4676.

Another function of VGAM1965 is therefore inhibition of IDN3 (Accession NM_133433). Accordingly, utilities of VGAM1965 include diagnosis, prevention and treatment of diseases and clinical conditions associated with IDN3. Interleukin 1 Receptor Accessory Protein-like 1 (IL1RAPL1, Accession NM_014271) is another VGAM1965 host target gene. IL1RAPL1 BINDING SITE is HOST TARGET binding site found in the 5' untranslated region of mRNA encoded by IL1RAPL1, corresponding to a HOST TARGET binding site such as BINDING SITE I, BINDING SITE II or BINDING SITE III. Table 2 illustrates the complementarity of the nucleotide sequences of IL1RAPL1 BINDING SITE, designated SEQ ID:15555, to the nucleotide sequence of VGAM1965 RNA, herein designated VGAM RNA, also designated SEQ ID:4676.

Another function of VGAM1965 is therefore inhibition of Interleukin 1 Receptor Accessory Protein-like 1 (IL1RAPL1, Accession NM_014271). Accordingly, utilities of VGAM1965 include diagnosis, prevention and treatment of diseases and clinical conditions associated with IL1RAPL1. IMAGE:4907098 (Accession XM_166247) is another VGAM1965 host target gene. IMAGE:4907098 BINDING SITE is HOST TARGET binding site found in the 3' untranslated region of mRNA encoded by IMAGE:4907098, corresponding to a HOST TARGET binding site such as BINDING SITE I, BINDING SITE II or BINDING SITE III. Table 2 illustrates the complementarity of the nucleotide sequences of IMAGE:4907098 BINDING SITE, designated SEQ ID:44059, to the nucleotide sequence of VGAM1965 RNA, herein designated VGAM RNA, also designated SEQ ID:4676.

Another function of VGAM1965 is therefore inhibition of IMAGE:4907098 (Accession XM_166247). Accordingly, utilities of VGAM1965 include diagnosis, prevention and treatment of diseases and clinical conditions associated with IMAGE:4907098. IMPACT (Accession NM_018439) is another VGAM1965 host target gene. IMPACT BINDING SITE is HOST TARGET binding site found in the 3' untranslated region of mRNA encoded by IMPACT, corresponding to a HOST TARGET binding site such as BINDING SITE I, BINDING SITE II or BINDING SITE III. Table 2 illustrates the complementarity of the nucleotide sequences of IMPACT BINDING SITE, designated SEQ ID:20504, to the nucleotide sequence of VGAM1965 RNA, herein designated VGAM RNA, also designated SEQ ID:4676.

Another function of VGAM1965 is therefore inhibition of IMPACT (Accession NM_018439). Accordingly, utilities of VGAM1965 include diagnosis, prevention and treatment of diseases and clinical conditions associated with IMPACT. jdp2 (Accession NM_130469) is another VGAM1965 host target gene. jdp2 BINDING SITE is HOST TARGET binding site found in the 3' untranslated region of mRNA encoded by jdp2, corresponding to a HOST TARGET binding site such as BINDING SITE I, BINDING SITE II or BINDING SITE III. Table 2 illustrates the complementarity of the nucleotide sequences of jdp2 BINDING SITE, designated SEQ ID:28231, to the nucleotide sequence of VGAM1965 RNA, herein designated VGAM RNA, also designated SEQ ID:4676.

Another function of VGAM1965 is therefore inhibition of jdp2 (Accession NM_130469). Accordingly, utilities of VGAM1965 include diagnosis, prevention and treatment of diseases and clinical conditions associated with jdp2. Potassium Voltage-gated Channel, Delayed-rectifier, Subfamily S, Member 1 (KCNS1, Accession NM_002251) is another VGAM1965 host target gene. KCNS1 BINDING SITE is HOST TARGET binding site found in the 3' untranslated region of mRNA encoded by KCNS1, corresponding to a HOST TARGET binding site such as BINDING SITE I, BINDING SITE II or BINDING SITE III. Table 2 illustrates the complementarity of the nucleotide sequences of KCNS1 BINDING SITE, designated SEQ ID:8043, to the nucleotide sequence of VGAM1965 RNA, herein designated VGAM RNA, also designated SEQ ID:4676.

Another function of VGAM1965 is therefore inhibition of Potassium Voltage-gated Channel, Delayed-rectifier, Subfamily S, Member 1 (KCNS1, Accession NM_002251). Accordingly, utilities of VGAM1965 include diagnosis, prevention and treatment of diseases and clinical conditions associated with KCNS1. KIAA0040 (Accession NM_014656) is another VGAM1965 host target gene. KIAA0040 BINDING SITE is HOST TARGET binding site found in the 3' untranslated region of mRNA encoded by KIAA0040, corresponding to a HOST TARGET binding site such as BINDING SITE I, BINDING SITE II or BINDING SITE III. Table 2 illustrates the complementarity of the nucleotide sequences of KIAA0040 BINDING SITE, designated SEQ ID:16097, to the nucleotide sequence of VGAM1965 RNA, herein designated VGAM RNA, also designated SEQ ID:4676.

Another function of VGAM1965 is therefore inhibition of KIAA0040 (Accession NM_014656). Accordingly, utilities of VGAM1965 include diagnosis, prevention and treatment of diseases and clinical conditions associated with KIAA0040. KIAA0061 (Accession XM_043094) is another VGAM1965 host target gene. KIAA0061 BINDING SITE is HOST TARGET binding site found in the 3' untranslated region of mRNA encoded by KIAA0061, corresponding to a HOST TARGET binding site such as BINDING SITE I, BINDING SITE II or BINDING SITE III. Table 2 illustrates the complementarity of the nucleotide sequences of KIAA0061 BINDING SITE, designated SEQ ID:33893, to the nucleotide sequence of VGAM1965 RNA, herein designated VGAM RNA, also designated SEQ ID:4676.

Another function of VGAM1965 is therefore inhibition of KIAA0061 (Accession XM_043094). Accordingly, utilities of VGAM1965 include diagnosis, prevention and treatment of diseases and clinical conditions associated with KIAA0061. KIAA0090 (Accession XM_114045) is another VGAM1965 host target gene. KIAA0090 BINDING SITE is HOST TARGET binding site found in the 3' untranslated region of mRNA encoded by KIAA0090, corresponding to a HOST TARGET binding site such as BINDING SITE I, BINDING SITE II or BINDING SITE III. Table 2 illustrates the complementarity of the nucleotide sequences of KIAA0090 BINDING SITE, designated SEQ ID:42654, to the nucleotide sequence of VGAM1965 RNA, herein designated VGAM RNA, also designated SEQ ID:4676.

Another function of VGAM1965 is therefore inhibition of KIAA0090 (Accession XM_114045). Accordingly, utilities of VGAM1965 include diagnosis, prevention and treatment of diseases and clinical conditions associated with KIAA0090. KIAA0092 (Accession NM_014679) is another VGAM1965 host target gene. KIAA0092 BINDING SITE is HOST TARGET binding site found in the 3' untranslated region of mRNA encoded by KIAA0092, corresponding to a HOST TARGET binding site such as BINDING SITE I, BINDING SITE II or BINDING SITE III. Table 2 illustrates the complementarity of the nucleotide sequences of KIAA0092 BINDING SITE, designated SEQ ID:16156, to the nucleotide sequence of VGAM1965 RNA, herein designated VGAM RNA, also designated SEQ ID:4676.

Another function of VGAM1965 is therefore inhibition of KIAA0092 (Accession NM_014679). Accordingly, utilities of VGAM1965 include diagnosis, prevention and treatment of diseases and clinical conditions associated with KIAA0092. KIAA0102 (Accession NM_014752) is another VGAM1965 host target gene. KIAA0102 BINDING SITE is HOST TARGET binding site found in the 5' untranslated region of mRNA encoded by KIAA0102, corresponding to a HOST TARGET binding site such as BINDING SITE I, BINDING SITE II or BINDING SITE III. Table 2 illustrates the complementarity of the nucleotide sequences of KIAA0102 BINDING SITE, designated SEQ ID:16476, to the nucleotide sequence of VGAM1965 RNA, herein designated VGAM RNA, also designated SEQ ID:4676.

Another function of VGAM1965 is therefore inhibition of KIAA0102 (Accession NM_014752). Accordingly, utilities of VGAM1965 include diagnosis, prevention and treatment of diseases and clinical conditions associated with KIAA0102. KIAA0133 (Accession NM_014777) is another VGAM1965 host target gene. KIAA0133 BINDING SITE is HOST TARGET binding site found in the 3' untranslated region of mRNA encoded by KIAA0133, corresponding to a HOST TARGET binding site such as BINDING SITE I, BINDING SITE II or BINDING SITE III. Table 2 illustrates the complementarity of the nucleotide sequences of KIAA0133 BINDING SITE, designated SEQ ID:16608, to the nucleotide sequence of VGAM1965 RNA, herein designated VGAM RNA, also designated SEQ ID:4676.

Another function of VGAM1965 is therefore inhibition of KIAA0133 (Accession NM_014777). Accordingly, utilities of VGAM1965 include diagnosis, prevention and treatment of diseases and clinical conditions associated with KIAA0133. KIAA0161 (Accession NM_014746) is another VGAM1965 host target gene. KIAA0161 BINDING SITE is HOST TARGET binding site found in the 3' untranslated region of mRNA encoded by KIAA0161, corresponding to a HOST TARGET binding site such as BINDING SITE I, BINDING SITE II or BINDING SITE III. Table 2 illustrates the complementarity of the nucleotide sequences of KIAA0161 BINDING SITE, designated SEQ ID:16433, to the nucleotide sequence of VGAM1965 RNA, herein designated VGAM RNA, also designated SEQ ID:4676.

Another function of VGAM1965 is therefore inhibition of KIAA0161 (Accession NM_014746). Accordingly, utilities of VGAM1965 include diagnosis, prevention and treatment of diseases and clinical conditions associated with KIAA0161. KIAA0173 (Accession NM_014640) is another VGAM1965 host target gene. KIAA0173 BINDING SITE is HOST TARGET binding site found in the 3' untranslated region of mRNA encoded by KIAA0173, corresponding to a HOST TARGET binding site such as BINDING SITE I, BINDING SITE II or BINDING SITE III. Table 2 illustrates the complementarity of the nucleotide sequences of KIAA0173 BINDING SITE, designated SEQ ID:16043, to the nucleotide sequence of VGAM1965 RNA, herein designated VGAM RNA, also designated SEQ ID:4676.

Another function of VGAM1965 is therefore inhibition of KIAA0173 (Accession NM_014640). Accordingly, utilities of VGAM1965 include diagnosis, prevention and treatment of diseases and clinical conditions associated with KIAA0173. KIAA0186 (Accession NM_021067) is another VGAM1965 host target gene. KIAA0186 BINDING SITE is HOST TARGET binding site found in the 3' untranslated region of mRNA encoded by KIAA0186, corresponding to a HOST TARGET binding site such as BINDING SITE I, BINDING SITE II or BINDING SITE III. Table 2 illustrates the complementarity of the nucleotide sequences of KIAA0186 BINDING SITE, designated SEQ ID:22039, to the nucleotide sequence of VGAM1965 RNA, herein designated VGAM RNA, also designated SEQ ID:4676.

Another function of VGAM1965 is therefore inhibition of KIAA0186 (Accession NM_021067). Accordingly, utilities of VGAM1965 include diagnosis, prevention and treatment of diseases and clinical conditions associated with KIAA0186. KIAA0227 (Accession XM_027236) is another VGAM1965 host target gene. KIAA0227 BINDING SITE is HOST TARGET binding site found in the 3' untranslated region of mRNA encoded by KIAA0227, corresponding to a HOST TARGET binding site such as BINDING SITE I, BINDING SITE II or BINDING SITE III. Table 2 illustrates the complementarity of the nucleotide sequences of KIAA0227 BINDING SITE, designated SEQ ID:30453, to the nucleotide sequence of VGAM1965 RNA, herein designated VGAM RNA, also designated SEQ ID:4676.

Another function of VGAM1965 is therefore inhibition of KIAA0227 (Accession XM_027236). Accordingly, utilities of VGAM1965 include diagnosis, prevention and treatment of diseases and clinical conditions associated with KIAA0227. KIAA0232 (Accession XM_052627) is another VGAM1965 host target gene. KIAA0232 BINDING SITE is HOST TARGET binding site found in the 5' untranslated region of mRNA encoded by KIAA0232, corresponding to a HOST TARGET binding site such as BINDING SITE I, BINDING SITE II or BINDING SITE III. Table 2 illustrates the complementarity of the nucleotide sequences of KIAA0232 BINDING SITE, designated SEQ ID:36039, to the nucleotide sequence of VGAM1965 RNA, herein designated VGAM RNA, also designated SEQ ID:4676.

Another function of VGAM1965 is therefore inhibition of KIAA0232 (Accession XM_052627). Accordingly, utilities of VGAM1965 include diagnosis, prevention and treatment of diseases and clinical conditions associated with KIAA0232. KIAA0247 (Accession NM_014734) is another VGAM1965 host target gene. KIAA0247 BINDING SITE is HOST TARGET binding site found in the 3' untranslated region of mRNA encoded by KIAA0247, corresponding to a HOST TARGET binding site such as BINDING SITE I, BINDING SITE II or BINDING SITE III. Table 2 illustrates the complementarity of the nucleotide sequences of KIAA0247 BINDING SITE, designated SEQ ID:16378, to the nucleotide sequence of VGAM1965 RNA, herein designated VGAM RNA, also designated SEQ ID:4676.

Another function of VGAM1965 is therefore inhibition of KIAA0247 (Accession NM_014734). Accordingly, utilities of VGAM1965 include diagnosis, prevention and treatment of diseases and clinical conditions associated with KIAA0247. KIAA0258 (Accession NM_014785) is another VGAM1965 host target gene. KIAA0258 BINDING SITE is HOST TARGET binding site found in the 3' untranslated region of mRNA encoded by KIAA0258, corresponding to a HOST TARGET binding site such as BINDING SITE I, BINDING SITE II or BINDING SITE III. Table 2 illustrates the complementarity of the nucleotide sequences of KIAA0258 BINDING SITE, designated SEQ ID:16646, to the nucleotide sequence of VGAM1965 RNA, herein designated VGAM RNA, also designated SEQ ID:4676.

Another function of VGAM1965 is therefore inhibition of KIAA0258 (Accession NM_014785). Accordingly, utilities of VGAM1965 include diagnosis, prevention and treatment of diseases and clinical conditions associated with KIAA0258. KIAA0265 (Accession XM_045954) is another VGAM1965 host target gene. KIAA0265 BINDING SITE is HOST TARGET binding site found in the 3' untranslated region of mRNA encoded by KIAA0265, corresponding to a HOST TARGET binding site such as BINDING SITE I, BINDING SITE II or BINDING SITE III. Table 2 illustrates the complementarity of the nucleotide sequences of KIAA0265 BINDING SITE, designated SEQ ID:34631, to the nucleotide sequence of VGAM1965 RNA, herein designated VGAM RNA, also designated SEQ ID:4676.

Another function of VGAM1965 is therefore inhibition of KIAA0265 (Accession XM_045954). Accordingly, utilities of VGAM1965 include diagnosis, prevention and treatment of diseases and clinical conditions associated with KIAA0265. KIAA0326 (Accession XM_034819) is another VGAM1965 host target gene. KIAA0326 BINDING SITE is HOST TARGET binding site found in the 3' untranslated region of mRNA encoded by KIAA0326, corresponding to a HOST TARGET binding site such as BINDING SITE I, BINDING SITE II or BINDING SITE III. Table 2 illustrates the complementarity of the nucleotide sequences of KIAA0326 BINDING SITE, designated SEQ ID:32161, to the nucleotide sequence of VGAM1965 RNA, herein designated VGAM RNA, also designated SEQ ID:4676.

Another function of VGAM1965 is therefore inhibition of KIAA0326 (Accession XM_034819). Accordingly, utilities of VGAM1965 include diagnosis, prevention and treatment of diseases and clinical conditions associated with KIAA0326. KIAA0336 (Accession NM_014635) is another VGAM1965 host target gene. KIAA0336 BINDING SITE is HOST TARGET binding site found in the 3' untranslated region of mRNA encoded by KIAA0336, corresponding to a HOST TARGET binding site such as BINDING SITE I, BINDING SITE II or BINDING SITE III. Table 2 illustrates the complementarity of the nucleotide sequences of KIAA0336 BINDING SITE, designated SEQ ID:16012, to the nucleotide sequence of VGAM1965 RNA, herein designated VGAM RNA, also designated SEQ ID:4676.

Another function of VGAM1965 is therefore inhibition of KIAA0336 (Accession NM_014635). Accordingly, utilities of VGAM1965 include diagnosis, prevention and treatment of diseases and clinical conditions associated with KIAA0336. KIAA0349 (Accession XM_166449) is another VGAM1965 host target gene. KIAA0349 BINDING SITE is HOST TARGET binding site found in the 3' untranslated region of mRNA encoded by KIAA0349, corresponding to a HOST TARGET binding site such as BINDING SITE I, BINDING SITE II or BINDING SITE III. Table 2 illustrates the complementarity of the nucleotide sequences of KIAA0349 BINDING SITE, designated SEQ ID:44342, to the nucleotide sequence of VGAM1965 RNA, herein designated VGAM RNA, also designated SEQ ID:4676.

Another function of VGAM1965 is therefore inhibition of KIAA0349 (Accession XM_166449). Accordingly, utilities of VGAM1965 include diagnosis, prevention and treatment of diseases and clinical conditions associated with KIAA0349. KIAA0352 (Accession NM_014830) is another VGAM1965 host target gene. KIAA0352 BINDING SITE is HOST TARGET binding site found in the 3' untranslated region of mRNA encoded by KIAA0352, corresponding to a HOST TARGET binding site such as BINDING SITE I, BINDING SITE II or BINDING SITE III. Table 2 illustrates the complementarity of the nucleotide sequences of KIAA0352 BINDING SITE, designated SEQ ID:16825, to the nucleotide sequence of VGAM1965 RNA, herein designated VGAM RNA, also designated SEQ ID:4676.

Another function of VGAM1965 is therefore inhibition of KIAA0352 (Accession NM_014830). Accordingly, utilities of VGAM1965 include diagnosis, prevention and treatment of diseases and clinical conditions associated with KIAA0352. KIAA0354 (Accession NM_014872) is another VGAM1965 host target gene. KIAA0354 BINDING SITE is HOST TARGET binding site found in the 3' untranslated region of mRNA encoded by KIAA0354, corresponding to a HOST TARGET binding site such as BINDING SITE I, BINDING SITE II or BINDING SITE III. Table 2 illustrates the complementarity of the nucleotide sequences of KIAA0354 BINDING SITE, designated SEQ ID:16999, to the nucleotide sequence of VGAM1965 RNA, herein designated VGAM RNA, also designated SEQ ID:4676.

Another function of VGAM1965 is therefore inhibition of KIAA0354 (Accession NM_014872). Accordingly, utilities of VGAM1965 include diagnosis, prevention and treatment of diseases and clinical conditions associated with KIAA0354. KIAA0365 (Accession XM_086055) is another VGAM1965 host target gene. KIAA0365 BINDING SITE is HOST TARGET binding site found in the 5' untranslated region of mRNA encoded by KIAA0365, corresponding to a HOST TARGET binding site such as BINDING SITE I, BINDING SITE II or BINDING SITE III. Table 2 illustrates the complementarity of the nucleotide sequences of KIAA0365 BINDING SITE, designated SEQ ID:38471, to the nucleotide sequence of VGAM1965 RNA, herein designated VGAM RNA, also designated SEQ ID:4676.

Another function of VGAM1965 is therefore inhibition of KIAA0365 (Accession XM_086055). Accordingly, utilities of VGAM1965 include diagnosis, prevention and treatment of diseases and clinical conditions associated with KIAA0365. KIAA0375 (Accession XM_048462) is another VGAM1965 host target gene. KIAA0375 BINDING SITE is HOST TARGET binding site found in the 5' untranslated region of mRNA encoded by KIAA0375, corresponding to a HOST TARGET binding site such as BINDING SITE I, BINDING SITE II or BINDING SITE III. Table 2 illustrates the complementarity of the nucleotide sequences of KIAA0375 BINDING SITE, designated SEQ ID:35177, to the nucleotide sequence of VGAM1965 RNA, herein designated VGAM RNA, also designated SEQ ID:4676.

Another function of VGAM1965 is therefore inhibition of KIAA0375 (Accession XM_048462). Accordingly, utilities of VGAM1965 include diagnosis, prevention and treatment of diseases and clinical conditions associated with KIAA0375. KIAA0410 (Accession NM_014778) is another VGAM1965 host target gene. KIAA0410 BINDING SITE is HOST TARGET binding site found in the 3' untranslated region of mRNA encoded by KIAA0410, corresponding to a HOST TARGET binding site such as BINDING SITE I, BINDING SITE II or BINDING SITE III. Table 2 illustrates the complementarity of the nucleotide sequences of KIAA0410 BINDING SITE, designated SEQ ID:16612, to the nucleotide sequence of VGAM1965 RNA, herein designated VGAM RNA, also designated SEQ ID:4676.

Another function of VGAM1965 is therefore inhibition of KIAA0410 (Accession NM_014778). Accordingly, utilities of VGAM1965 include diagnosis, prevention and treatment of diseases and clinical conditions associated with KIAA0410. KIAA0419 (Accession NM_014711) is another VGAM1965 host target gene. KIAA0419 BINDING SITE is HOST TARGET binding site found in the 3' untranslated region of mRNA encoded by KIAA0419, corresponding to a HOST TARGET binding site such as BINDING SITE I, BINDING SITE II or BINDING SITE III. Table 2 illustrates the complementarity of the nucleotide sequences of KIAA0419 BINDING SITE, designated SEQ ID:16261, to the nucleotide sequence of VGAM1965 RNA, herein designated VGAM RNA, also designated SEQ ID:4676.

Another function of VGAM1965 is therefore inhibition of KIAA0419 (Accession NM_014711). Accordingly, utilities of VGAM1965 include diagnosis, prevention and treatment of diseases and clinical conditions associated with KIAA0419. KIAA0446 (Accession XM_044155) is another VGAM1965 host target gene. KIAA0446 BINDING SITE is HOST TARGET binding site found in the 5' untranslated region of mRNA encoded by KIAA0446, corresponding to a HOST TARGET binding site such as BINDING SITE I, BINDING SITE II or BINDING SITE III. Table 2 illustrates the complementarity of the nucleotide sequences of KIAA0446 BINDING SITE, designated SEQ ID:34153, to the nucleotide sequence of VGAM1965 RNA, herein designated VGAM RNA, also designated SEQ ID:4676.

Another function of VGAM1965 is therefore inhibition of KIAA0446 (Accession XM_044155). Accordingly, utilities of VGAM1965 include diagnosis, prevention and treatment of diseases and clinical conditions associated with KIAA0446. KIAA0449 (Accession NM_017596) is another VGAM1965 host target gene. KIAA0449 BINDING SITE1 and KIAA0449 BINDING SITE2 are HOST TARGET binding sites found in untranslated regions of mRNA encoded by KIAA0449, corresponding to HOST TARGET binding sites such as BINDING SITE I, BINDING SITE II or BINDING SITE III. Table 2 illustrates the complementarity of the nucleotide sequences of KIAA0449 BINDING SITE1 and KIAA0449 BINDING SITE2, designated SEQ ID:19056 and SEQ ID:19057 respectively, to the nucleotide sequence of VGAM1965 RNA, herein designated VGAM RNA, also designated SEQ ID:4676.

Another function of VGAM1965 is therefore inhibition of KIAA0449 (Accession NM_017596). Accordingly, utilities of VGAM1965 include diagnosis, prevention and treatment of diseases and clinical conditions associated with KIAA0449. KIAA0450 (Accession NM_014638) is another VGAM1965 host target gene. KIAA0450 BINDING SITE1 and KIAA0450 BINDING SITE2 are HOST TARGET binding sites found in untranslated regions of mRNA encoded by KIAA0450, corresponding to HOST TARGET binding sites such as BINDING SITE I, BINDING SITE II or BINDING SITE III. Table 2 illustrates the complementarity of the nucleotide sequences of KIAA0450 BINDING SITE1 and KIAA0450 BINDING SITE2, designated SEQ ID:16035 and SEQ ID:16989 respectively, to the nucleotide sequence of VGAM1965 RNA, herein designated VGAM RNA, also designated SEQ ID:4676.

Another function of VGAM1965 is therefore inhibition of KIAA0450 (Accession NM_014638). Accordingly, utilities of VGAM1965 include diagnosis, prevention and treatment of diseases and clinical conditions associated with KIAA0450. KIAA0527 (Accession XM_171054) is another VGAM1965 host target gene. KIAA0527 BINDING SITE1 and KIAA0527 BINDING SITE2 are HOST TARGET binding sites found in untranslated regions of mRNA encoded by KIAA0527, corresponding to HOST TARGET binding sites such as BINDING SITE I, BINDING SITE II or BINDING SITE III. Table 2 illustrates the complementarity of the nucleotide sequences of KIAA0527 BINDING SITE1 and KIAA0527 BINDING SITE2, designated SEQ ID:45842 and SEQ ID:45845 respectively, to the nucleotide sequence of VGAM1965 RNA, herein designated VGAM RNA, also designated SEQ ID:4676.

Another function of VGAM1965 is therefore inhibition of KIAA0527 (Accession XM_171054). Accordingly, utilities of VGAM1965 include diagnosis, prevention and treatment of diseases and clinical conditions associated with KIAA0527. KIAA0563 (Accession NM_014834) is another VGAM1965 host target gene. KIAA0563 BINDING SITE is HOST TARGET binding site found in the 5' untranslated region of mRNA encoded by KIAA0563, corresponding to a HOST TARGET binding site such as BINDING SITE I, BINDING SITE II or BINDING SITE III. Table 2 illustrates the complementarity of the nucleotide sequences of KIAA0563 BINDING SITE, designated SEQ ID:16843, to the nucleotide sequence of VGAM1965 RNA, herein designated VGAM RNA, also designated SEQ ID:4676.

Another function of VGAM1965 is therefore inhibition of KIAA0563 (Accession NM_014834). Accordingly, utilities of VGAM1965 include diagnosis, prevention and treatment of diseases and clinical conditions associated with KIAA0563. KIAA0565 (Accession XM_039912) is another VGAM1965 host target gene. KIAA0565 BINDING SITE1 and KIAA0565 BINDING SITE2 are HOST TARGET binding sites found in untranslated regions of mRNA encoded by KIAA0565, corresponding to HOST TARGET binding sites such as BINDING SITE I, BINDING SITE II or BINDING SITE III. Table 2 illustrates the complementarity of the nucleotide sequences of KIAA0565 BINDING SITE1 and KIAA0565 BINDING SITE2, designated SEQ ID:33219 and SEQ ID:33221 respectively, to the nucleotide sequence of VGAM1965 RNA, herein designated VGAM RNA, also designated SEQ ID:4676.

Another function of VGAM1965 is therefore inhibition of KIAA0565 (Accession XM_039912). Accordingly, utilities of VGAM1965 include diagnosis, prevention and treatment of diseases and clinical conditions associated with KIAA0565. KIAA0574 (Accession XM_045076) is another VGAM1965 host target gene. KIAA0574 BINDING SITE is HOST TARGET binding site found in the 3' untranslated region of mRNA encoded by KIAA0574, corresponding to a HOST TARGET binding site such as BINDING SITE I, BINDING SITE II or BINDING SITE III. Table 2 illustrates the complementarity of the nucleotide sequences of KIAA0574 BINDING SITE, designated SEQ ID:34350, to the nucleotide sequence of VGAM1965 RNA, herein designated VGAM RNA, also designated SEQ ID:4676.

Another function of VGAM1965 is therefore inhibition of KIAA0574 (Accession XM_045076). Accordingly, utilities of VGAM1965 include diagnosis, prevention and treatment of diseases and clinical conditions associated with KIAA0574. KIAA0607 (Accession XM_051931) is another VGAM1965 host target gene. KIAA0607 BINDING SITE is HOST TARGET binding site found in the 3' untranslated region of mRNA encoded by KIAA0607, corresponding to a HOST TARGET binding site such as BINDING SITE I, BINDING SITE II or BINDING SITE III. Table 2 illustrates the complementarity of the nucleotide sequences of KIAA0607 BINDING SITE, designated SEQ ID:35927, to the nucleotide sequence of VGAM1965 RNA, herein designated VGAM RNA, also designated SEQ ID:4676.

Another function of VGAM1965 is therefore inhibition of KIAA0607 (Accession XM_051931). Accordingly, utilities of VGAM1965 include diagnosis, prevention and treatment of diseases and clinical conditions associated with KIAA0607. KIAA0685 (Accession NM_014678) is another VGAM1965 host target gene. KIAA0685 BINDING SITE is HOST TARGET binding site found in the 3' untranslated region of mRNA encoded by KIAA0685, corresponding to a HOST TARGET binding site such as BINDING SITE I, BINDING SITE II or BINDING SITE III. Table 2 illustrates the complementarity of the nucleotide sequences of KIAA0685 BINDING SITE, designated SEQ ID:16150, to the nucleotide sequence of VGAM1965 RNA, herein designated VGAM RNA, also designated SEQ ID:4676.

Another function of VGAM1965 is therefore inhibition of KIAA0685 (Accession NM_014678). Accordingly, utilities of VGAM1965 include diagnosis, prevention and treatment of diseases and clinical conditions associated with KIAA0685. KIAA0703 (Accession NM_014861) is another VGAM1965 host target gene. KIAA0703 BINDING SITE is HOST TARGET binding site found in the 5' untranslated region of mRNA encoded by KIAA0703, corresponding to a HOST TARGET binding site such as BINDING SITE I, BINDING SITE II or BINDING SITE III. Table 2 illustrates the complementarity of the nucleotide sequences of KIAA0703 BINDING SITE, designated SEQ ID:16928, to the nucleotide sequence of VGAM1965 RNA, herein designated VGAM RNA, also designated SEQ ID:4676.

Another function of VGAM1965 is therefore inhibition of KIAA0703 (Accession NM_014861). Accordingly, utilities of VGAM1965 include diagnosis, prevention and treatment of diseases and clinical conditions associated with KIAA0703. KIAA0712 (Accession NM_014715) is another VGAM1965 host target gene. KIAA0712 BINDING SITE is HOST TARGET binding site found in the 5' untranslated region of mRNA encoded by KIAA0712, corresponding to a HOST TARGET binding site such as BINDING SITE I, BINDING SITE II or BINDING SITE III. Table 2 illustrates the complementarity of the nucleotide sequences of KIAA0712 BINDING SITE, designated SEQ ID:16268, to the nucleotide sequence of VGAM1965 RNA, herein designated VGAM RNA, also designated SEQ ID:4676.

Another function of VGAM1965 is therefore inhibition of KIAA0712 (Accession NM_014715). Accordingly, utilities of VGAM1965 include diagnosis, prevention and treatment of diseases and clinical conditions associated with KIAA0712. KIAA0792 (Accession NM_014698) is another VGAM1965 host target gene. KIAA0792 BINDING SITE is HOST TARGET binding site found in the 3' untranslated region of mRNA encoded by KIAA0792, corresponding to a HOST TARGET binding site such as BINDING SITE I, BINDING SITE II or BINDING SITE III. Table 2 illustrates the complementarity of the nucleotide sequences of KIAA0792 BINDING SITE, designated SEQ ID:16216, to the nucleotide sequence of VGAM1965 RNA, herein designated VGAM RNA, also designated SEQ ID:4676.

Another function of VGAM1965 is therefore inhibition of KIAA0792 (Accession NM_014698). Accordingly, utilities of VGAM1965 include diagnosis, prevention and treatment of diseases and clinical conditions associated with KIAA0792. KIAA0794 (Accession XM_087353) is another VGAM1965 host target gene. KIAA0794 BINDING SITE is HOST TARGET binding site found in the 3' untranslated region of mRNA encoded by KIAA0794, corresponding to a HOST TARGET binding site such as BINDING SITE I, BINDING SITE II or BINDING SITE III. Table 2 illustrates the complementarity of the nucleotide sequences of KIAA0794 BINDING SITE, designated SEQ ID:39187, to the nucleotide sequence of VGAM1965 RNA, herein designated VGAM RNA, also designated SEQ ID:4676.

Another function of VGAM1965 is therefore inhibition of KIAA0794 (Accession XM_087353). Accordingly, utilities of VGAM1965 include diagnosis, prevention and treatment of diseases and clinical conditions associated with KIAA0794. KIAA0798 (Accession NM_014650) is another VGAM1965 host target gene. KIAA0798 BINDING SITE is HOST TARGET binding site found in the 3' untranslated region of mRNA encoded by KIAA0798, corresponding to a HOST TARGET binding site such as BINDING SITE I, BINDING SITE II or BINDING SITE III. Table 2 illustrates the complementarity of the nucleotide sequences of KIAA0798 BINDING SITE, designated SEQ ID:16073, to the nucleotide sequence of VGAM1965 RNA, herein designated VGAM RNA, also designated SEQ ID:4676.

Another function of VGAM1965 is therefore inhibition of KIAA0798 (Accession NM_014650). Accordingly, utilities of VGAM1965 include diagnosis, prevention and treatment of diseases and clinical conditions associated with KIAA0798. KIAA0825 (Accession XM_027906) is another VGAM1965 host target gene. KIAA0825 BINDING SITE is HOST TARGET binding site found in the 3' untranslated region of mRNA encoded by KIAA0825, corresponding to a HOST TARGET binding site such as BINDING SITE I, BINDING SITE II or BINDING SITE III. Table 2 illustrates the complementarity of the nucleotide sequences of KIAA0825 BINDING SITE, designated SEQ ID:30593, to the nucleotide sequence of VGAM1965 RNA, herein designated VGAM RNA, also designated SEQ ID:4676.

Another function of VGAM1965 is therefore inhibition of KIAA0825 (Accession XM_027906). Accordingly, utilities of VGAM1965 include diagnosis, prevention and treatment of diseases and clinical conditions associated with KIAA0825. KIAA0847 (Accession XM_085298) is another VGAM1965 host target gene. KIAA0847 BINDING SITE is HOST TARGET binding site found in the 5' untranslated region of mRNA encoded by KIAA0847, corresponding to a HOST TARGET binding site such as BINDING SITE I, BINDING SITE II or BINDING SITE III. Table 2 illustrates the complementarity of the nucleotide sequences of KIAA0847 BINDING SITE, designated SEQ ID:38049, to the nucleotide sequence of VGAM1965 RNA, herein designated VGAM RNA, also designated SEQ ID:4676.

Another function of VGAM1965 is therefore inhibition of KIAA0847 (Accession XM_085298). Accordingly, utilities of VGAM1965 include diagnosis, prevention and treatment of diseases and clinical conditions associated with KIAA0847. KIAA0854 (Accession NM_014943) is another VGAM1965 host target gene. KIAA0854 BINDING SITE is HOST TARGET binding site found in the 3' untranslated region of mRNA encoded by KIAA0854, corresponding to a HOST TARGET binding site such as BINDING SITE I, BINDING SITE II or BINDING SITE III. Table 2 illustrates the complementarity of the nucleotide sequences of KIAA0854 BINDING SITE, designated SEQ ID:17253, to the nucleotide sequence of VGAM1965 RNA, herein designated VGAM RNA, also designated SEQ ID:4676.

Another function of VGAM1965 is therefore inhibition of KIAA0854 (Accession NM_014943). Accordingly, utilities of VGAM1965 include diagnosis, prevention and treatment of diseases and clinical conditions associated with KIAA0854. KIAA0869 (Accession XM_047992) is another VGAM1965 host target gene. KIAA0869 BINDING SITE is HOST TARGET binding site found in the 3' untranslated region of mRNA encoded by KIAA0869, corresponding to a HOST TARGET binding site such as BINDING SITE I, BINDING SITE II or BINDING SITE III. Table 2 illustrates the complementarity of the nucleotide sequences of KIAA0869 BINDING SITE, designated SEQ ID:35094, to the nucleotide sequence of VGAM1965 RNA, herein designated VGAM RNA, also designated SEQ ID:4676.

Another function of VGAM1965 is therefore inhibition of KIAA0869 (Accession XM_047992). Accordingly, utilities of VGAM1965 include diagnosis, prevention and treatment of diseases and clinical conditions associated with KIAA0869. KIAA0870 (Accession XM_088315) is another VGAM1965 host target gene. KIAA0870 BINDING SITE is HOST TARGET binding site found in the 3' untranslated region of mRNA encoded by KIAA0870, corresponding to a HOST TARGET binding site such as BINDING SITE I, BINDING SITE II or BINDING SITE III. Table 2 illustrates the complementarity of the nucleotide sequences of KIAA0870 BINDING SITE, designated SEQ ID:39610, to the nucleotide sequence of VGAM1965 RNA, herein designated VGAM RNA, also designated SEQ ID:4676.

Another function of VGAM1965 is therefore inhibition of KIAA0870 (Accession XM_088315). Accordingly, utilities of VGAM1965 include diagnosis, prevention and treatment of diseases and clinical conditions associated with KIAA0870. KIAA0884 (Accession XM_046660) is another VGAM1965 host target gene. KIAA0884 BINDING SITE is HOST TARGET binding site found in the 3' untranslated region of mRNA encoded by KIAA0884, corresponding to a HOST TARGET binding site such as BINDING SITE I, BINDING SITE II or BINDING SITE III. Table 2 illustrates the complementarity of the nucleotide sequences of KIAA0884 BINDING SITE, designated SEQ ID:34778, to the nucleotide sequence of VGAM1965 RNA, herein designated VGAM RNA, also designated SEQ ID:4676.

Another function of VGAM1965 is therefore inhibition of KIAA0884 (Accession XM_046660). Accordingly, utilities of VGAM1965 include diagnosis, prevention and treatment of diseases and clinical conditions associated with KIAA0884. KIAA0889 (Accession NM_015377) is another VGAM1965 host target gene. KIAA0889 BINDING SITE is HOST TARGET binding site found in the 3' untranslated region of mRNA encoded by KIAA0889, corresponding to a HOST TARGET binding site such as BINDING SITE I, BINDING SITE II or BINDING SITE III. Table 2 illustrates the complementarity of the nucleotide sequences of KIAA0889 BINDING SITE, designated SEQ ID:17681, to the nucleotide sequence of VGAM1965 RNA, herein designated VGAM RNA, also designated SEQ ID:4676.

Another function of VGAM1965 is therefore inhibition of KIAA0889 (Accession NM_015377). Accordingly, utilities of VGAM1965 include diagnosis, prevention and treatment of diseases and clinical conditions associated with KIAA0889. KIAA0930 (Accession XM_047214) is another VGAM1965 host target gene. KIAA0930 BINDING SITE is HOST TARGET binding site found in the 3' untranslated region of mRNA encoded by KIAA0930, corresponding to a HOST TARGET binding site such as BINDING SITE I, BINDING SITE II or BINDING SITE III. Table 2 illustrates the complementarity of the nucleotide sequences of KIAA0930 BINDING SITE, designated SEQ ID:34918, to the nucleotide sequence of VGAM1965 RNA, herein designated VGAM RNA, also designated SEQ ID:4676.

Another function of VGAM1965 is therefore inhibition of KIAA0930 (Accession XM_047214). Accordingly, utilities of VGAM1965 include diagnosis, prevention and treatment of diseases and clinical conditions associated with KIAA0930. KIAA0937 (Accession XM_166213) is another VGAM1965 host target gene. KIAA0937 BINDING SITE is HOST TARGET binding site found in the 3' untranslated region of mRNA encoded by KIAA0937, corresponding to a HOST TARGET binding site such as BINDING SITE I, BINDING SITE II or BINDING SITE III. Table 2 illustrates the complementarity of the nucleotide sequences of KIAA0937 BINDING SITE, designated SEQ ID:44020, to the nucleotide sequence of VGAM1965 RNA, herein designated VGAM RNA, also designated SEQ ID:4676.

Another function of VGAM1965 is therefore inhibition of KIAA0937 (Accession XM_166213). Accordingly, utilities of VGAM1965 include diagnosis, prevention and treatment of diseases and clinical conditions associated with KIAA0937. KIAA0939 (Accession XM_030524) is another VGAM1965 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31069, to the nucleotide sequence of VGAM1965 RNA, herein designated VGAM RNA, also designated SEQ ID:4676.

Another function of VGAM1965 is therefore inhibition of KIAA0939 (Accession XM_030524). Accordingly, utilities of VGAM1965 include diagnosis, prevention and treatment of diseases and clinical conditions associated with KIAA0939. KIAA0953 (Accession XM_039733) is another VGAM1965 host target gene. KIAA0953 BINDING SITE is HOST TARGET binding site found in the 3' untranslated region of mRNA encoded by KIAA0953, corresponding to a HOST TARGET binding site such as BINDING SITE I, BINDING SITE II or BINDING SITE III. Table 2 illustrates the complementarity of the nucleotide sequences of KIAA0953 BINDING SITE, designated SEQ ID:33170, to the nucleotide sequence of VGAM1965 RNA, herein designated VGAM RNA, also designated SEQ ID:4676.

Another function of VGAM1965 is therefore inhibition of KIAA0953 (Accession XM_039733). Accordingly, utilities of VGAM1965 include diagnosis, prevention and treatment of diseases and clinical conditions associated with KIAA0953. KIAA0971 (Accession NM_014929) is another VGAM1965 host target gene. KIAA0971 BINDING SITE is HOST TARGET binding site found in the 3' untranslated region of mRNA encoded by KIAA0971, corresponding to a HOST TARGET binding site such as BINDING SITE I, BINDING SITE II or BINDING SITE III. Table 2 illustrates the complementarity of the nucleotide sequences of KIAA0971 BINDING SITE, designated SEQ ID:17225, to the nucleotide sequence of VGAM1965 RNA, herein designated VGAM RNA, also designated SEQ ID:4676.

Another function of VGAM1965 is therefore inhibition of KIAA0971 (Accession NM_014929). Accordingly, utilities of VGAM1965 include diagnosis, prevention and treatment of diseases and clinical conditions associated with KIAA0971. KIAA1013 (Accession XM_114303) is another VGAM1965 host target gene. KIAA1013 BINDING SITE is HOST TARGET binding site found in the 3' untranslated region of mRNA encoded by KIAA1013, corresponding to a HOST TARGET binding site such as BINDING SITE I, BINDING SITE II or BINDING SITE III. Table 2 illustrates the complementarity of the nucleotide sequences of KIAA1013 BINDING SITE, designated SEQ ID:42861, to the nucleotide sequence of VGAM1965 RNA, herein designated VGAM RNA, also designated SEQ ID:4676.

Another function of VGAM1965 is therefore inhibition of KIAA1013 (Accession XM_114303). Accordingly, utilities of VGAM1965 include diagnosis, prevention and treatment of diseases and clinical conditions associated with KIAA1013. KIAA1023 (Accession NM_017604) is another VGAM1965 host target gene. KIAA1023 BINDING SITE is HOST TARGET binding site found in the 3' untranslated region of mRNA encoded by KIAA1023, corresponding to a HOST TARGET binding site such as BINDING SITE I, BINDING SITE II or BINDING SITE III. Table 2 illustrates the complementarity of the nucleotide sequences of KIAA1023 BINDING SITE, designated SEQ ID:19098, to the nucleotide sequence of VGAM1965 RNA, herein designated VGAM RNA, also designated SEQ ID:4676.

Another function of VGAM1965 is therefore inhibition of KIAA1023 (Accession NM_017604). Accordingly, utilities of VGAM1965 include diagnosis, prevention and treatment of diseases and clinical conditions associated with KIAA1023. KIAA1029 (Accession NM_007286) is another VGAM1965 host target gene. KIAA1029 BINDING SITE is HOST TARGET binding site found in the 3' untranslated region of mRNA encoded by KIAA1029, corresponding to a HOST TARGET binding site such as BINDING SITE I, BINDING SITE II or BINDING SITE III. Table 2 illustrates the complementarity of the nucleotide sequences of KIAA1029 BINDING SITE, designated SEQ ID:14147, to the nucleotide sequence of VGAM1965 RNA, herein designated VGAM RNA, also designated SEQ ID:4676.

Another function of VGAM1965 is therefore inhibition of KIAA1029 (Accession NM_007286). Accordingly, utilities of VGAM1965 include diagnosis, prevention and treatment of diseases and clinical conditions associated with KIAA1029. KIAA1037 (Accession NM_015023) is another VGAM1965 host target gene. KIAA1037 BINDING SITE is HOST TARGET binding site found in the 3' untranslated region of mRNA encoded by KIAA1037, corresponding to a HOST TARGET binding site such as BINDING SITE I, BINDING SITE II or BINDING SITE III. Table 2 illustrates the complementarity of the nucleotide sequences of KIAA1037 BINDING SITE, designated SEQ ID:17385, to the nucleotide sequence of VGAM1965 RNA, herein designated VGAM RNA, also designated SEQ ID:4676.

Another function of VGAM1965 is therefore inhibition of KIAA1037 (Accession NM_015023). Accordingly, utilities of VGAM1965 include diagnosis, prevention and treatment of diseases and clinical conditions associated with KIAA1037. KIAA1040 (Accession XM_051091) is another VGAM1965 host target gene. KIAA1040 BINDING SITE is HOST TARGET binding site found in the 3' untranslated region of mRNA encoded by KIAA1040, corresponding to a HOST TARGET binding site such as BINDING SITE I, BINDING SITE II or BINDING SITE III. Table 2 illustrates the complementarity of the nucleotide sequences of KIAA1040 BINDING SITE, designated SEQ ID:35742, to the nucleotide sequence of VGAM1965 RNA, herein designated VGAM RNA, also designated SEQ ID:4676.

Another function of VGAM1965 is therefore inhibition of KIAA1040 (Accession XM_051091). Accordingly, utilities of VGAM1965 include diagnosis, prevention and treatment of diseases and clinical conditions associated with KIAA1040. KIAA1054 (Accession XM_043493) is another VGAM1965 host target gene. KIAA1054 BINDING SITE is HOST TARGET binding site found in the 3' untranslated region of mRNA encoded by KIAA1054, corresponding to a HOST TARGET binding site such as BINDING SITE I, BINDING SITE II or BINDING SITE III. Table 2 illustrates the complementarity of the nucleotide sequences of KIAA1054 BINDING SITE, designated SEQ ID:33951, to the nucleotide sequence of VGAM1965 RNA, herein designated VGAM RNA, also designated SEQ ID:4676.

Another function of VGAM1965 is therefore inhibition of KIAA1054 (Accession XM_043493). Accordingly, utilities of VGAM1965 include diagnosis, prevention and treatment of diseases and clinical conditions associated with KIAA1054. KIAA1055 (Accession XM_038509) is another VGAM1965 host target gene. KIAA1055 BINDING SITE is HOST TARGET binding site found in the 3' untranslated region of mRNA encoded by KIAA1055, corresponding to a HOST TARGET binding site such as BINDING SITE I, BINDING SITE II or BINDING SITE III. Table 2 illustrates the complementarity of the nucleotide sequences of KIAA1055 BINDING SITE, designated SEQ ID:32853, to the nucleotide sequence of VGAM1965 RNA, herein designated VGAM RNA, also designated SEQ ID:4676.

Another function of VGAM1965 is therefore inhibition of KIAA1055 (Accession XM_038509). Accordingly, utilities of VGAM1965 include diagnosis, prevention and treatment of diseases and clinical conditions associated with KIAA1055. KIAA1110 (Accession XM_029973) is another VGAM1965 host target gene. KIAA1110 BINDING SITE is HOST TARGET binding site found in the 3' untranslated region of mRNA encoded by KIAA1110, corresponding to a HOST TARGET binding site such as BINDING SITE I, BINDING SITE II or BINDING SITE III. Table 2 illustrates the complementarity of the nucleotide sequences of KIAA1110 BINDING SITE, designated SEQ ID:30986, to the nucleotide sequence of VGAM1965 RNA, herein designated VGAM RNA, also designated SEQ ID:4676.

Another function of VGAM1965 is therefore inhibition of KIAA1110 (Accession XM_029973). Accordingly, utilities of VGAM1965 include diagnosis, prevention and treatment of diseases and clinical conditions associated with KIAA1110. KIAA1161 (Accession XM_088501) is another VGAM1965 host target gene. KIAA1161 BINDING SITE1 and KIAA1161 BINDING SITE2 are HOST TARGET binding sites found in untranslated regions of mRNA encoded by KIAA1161, corresponding to HOST TARGET binding sites such as BINDING SITE I, BINDING SITE II or BINDING SITE III. Table 2 illustrates the complementarity of the nucleotide sequences of KIAA1161 BINDING SITE1 and KIAA1161 BINDING SITE2, designated SEQ ID:39748 and SEQ ID:39755 respectively, to the nucleotide sequence of VGAM1965 RNA, herein designated VGAM RNA, also designated SEQ ID:4676.

Another function of VGAM1965 is therefore inhibition of KIAA1161 (Accession XM_088501). Accordingly, utilities of VGAM1965 include diagnosis, prevention and treatment of diseases and clinical conditions associated with KIAA1161. KIAA1189 (Accession XM_050508) is another VGAM1965 host target gene. KIAA1189 BINDING SITE is HOST TARGET binding site found in the 3' untranslated region of mRNA encoded by KIAA1189, corresponding to a HOST TARGET binding site such as BINDING SITE I, BINDING SITE II or BINDING SITE III. Table 2 illustrates the complementarity of the nucleotide sequences of KIAA1189 BINDING SITE, designated SEQ ID:35652, to the nucleotide sequence of VGAM1965 RNA, herein designated VGAM RNA, also designated SEQ ID:4676.

Another function of VGAM1965 is therefore inhibition of KIAA1189 (Accession XM_050508). Accordingly, utilities of VGAM1965 include diagnosis, prevention and treatment of diseases and clinical conditions associated with KIAA1189. KIAA1191 (Accession NM_020444) is another VGAM1965 host target gene. KIAA1191 BINDING SITE is HOST TARGET binding site found in the 3' untranslated region of mRNA encoded by KIAA1191, corresponding to a HOST TARGET binding site such as BINDING SITE I, BINDING SITE II or BINDING SITE III. Table 2 illustrates the complementarity of the nucleotide sequences of KIAA1191 BINDING SITE, designated SEQ ID:21684, to the nucleotide sequence of VGAM1965 RNA, herein designated VGAM RNA, also designated SEQ ID:4676.

Another function of VGAM1965 is therefore inhibition of KIAA1191 (Accession NM_020444). Accordingly, utilities of VGAM1965 include diagnosis, prevention and treatment of diseases and clinical conditions associated with KIAA1191. KIAA1198 (Accession XM_032674) is another VGAM1965 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31712, to the nucleotide sequence of VGAM1965 RNA, herein designated VGAM RNA, also designated SEQ ID:4676.

Another function of VGAM1965 is therefore inhibition of KIAA1198 (Accession XM_032674). Accordingly, utilities of VGAM1965 include diagnosis, prevention and treatment of diseases and clinical conditions associated with KIAA1198. KIAA1254 (Accession XM_046132) is another VGAM1965 host target gene. KIAA1254 BINDING SITE is HOST TARGET binding site found in the 3' untranslated region of mRNA encoded by KIAA1254, corresponding to a HOST TARGET binding site such as BINDING SITE I, BINDING SITE II or BINDING SITE III. Table 2 illustrates the complementarity of the nucleotide sequences of KIAA1254 BINDING SITE, designated SEQ ID:34698, to the nucleotide sequence of VGAM1965 RNA, herein designated VGAM RNA, also designated SEQ ID:4676.

Another function of VGAM1965 is therefore inhibition of KIAA1254 (Accession XM_046132). Accordingly, utilities of VGAM1965 include diagnosis, prevention and treatment of diseases and clinical conditions associated with KIAA1254. KIAA1265 (Accession XM_047707) is another VGAM1965 host target gene. KIAA1265 BINDING SITE is HOST TARGET binding site found in the 3' untranslated region of mRNA encoded by KIAA1265, corresponding to a HOST TARGET binding site such as BINDING SITE I, BINDING SITE II or BINDING SITE III. Table 2 illustrates the complementarity of the nucleotide sequences of KIAA1265 BINDING SITE, designated SEQ ID:35033, to the nucleotide sequence of VGAM1965 RNA, herein designated VGAM RNA, also designated SEQ ID:4676.

Another function of VGAM1965 is therefore inhibition of KIAA1265 (Accession XM_047707). Accordingly, utilities of VGAM1965 include diagnosis, prevention and treatment of diseases and clinical conditions associated with KIAA1265. KIAA1266 (Accession XM_038567) is another VGAM1965 host target gene. KIAA1266 BINDING SITE is HOST TARGET binding site found in the 3' untranslated region of mRNA encoded by KIAA1266, corresponding to a HOST TARGET binding site such as BINDING SITE I, BINDING SITE II or BINDING SITE III. Table 2 illustrates the complementarity of the nucleotide sequences of KIAA1266 BINDING SITE, designated SEQ ID:32868, to the nucleotide sequence of VGAM1965 RNA, herein designated VGAM RNA, also designated SEQ ID:4676.

Another function of VGAM1965 is therefore inhibition of KIAA1266 (Accession XM_038567). Accordingly, utilities of VGAM1965 include diagnosis, prevention and treatment of diseases and clinical conditions associated with KIAA1266. KIAA1280 (Accession XM_045766) is another VGAM1965 host target gene. KIAA1280 BINDING SITE is HOST TARGET binding site found in the 5' untranslated region of mRNA encoded by KIAA1280, corresponding to a HOST TARGET binding site such as BINDING SITE I, BINDING SITE II or BINDING SITE III. Table 2 illustrates the complementarity of the nucleotide sequences of KIAA1280 BINDING SITE, designated SEQ ID:34555, to the nucleotide sequence of VGAM1965 RNA, herein designated VGAM RNA, also designated SEQ ID:4676.

Another function of VGAM1965 is therefore inhibition of KIAA1280 (Accession XM_045766). Accordingly, utilities of VGAM1965 include diagnosis, prevention and treatment of diseases and clinical conditions associated with KIAA1280. KIAA1322 (Accession XM_052626) is another VGAM1965 host target gene. KIAA1322 BINDING SITE is HOST TARGET binding site found in the 3' untranslated region of mRNA encoded by KIAA1322, corresponding to a HOST TARGET binding site such as BINDING SITE I, BINDING SITE II or BINDING SITE III. Table 2 illustrates the complementarity of the nucleotide sequences of KIAA1322 BINDING SITE, designated SEQ ID:36019, to the nucleotide sequence of VGAM1965 RNA, herein designated VGAM RNA, also designated SEQ ID:4676.

Another function of VGAM1965 is therefore inhibition of KIAA1322 (Accession XM_052626). Accordingly, utilities of VGAM1965 include diagnosis, prevention and treatment of diseases and clinical conditions associated with KIAA1322. KIAA1332 (Accession XM_048774) is another VGAM1965 host target gene. KIAA1332 BINDING SITE is HOST TARGET binding site found in the 3' untranslated region of mRNA encoded by KIAA1332, corresponding to a HOST TARGET binding site such as BINDING SITE I, BINDING SITE II or BINDING SITE III. Table 2 illustrates the complementarity of the nucleotide sequences of KIAA1332 BINDING SITE, designated SEQ ID:35262, to the nucleotide sequence of VGAM1965 RNA, herein designated VGAM RNA, also designated SEQ ID:4676.

Another function of VGAM1965 is therefore inhibition of KIAA1332 (Accession XM_048774). Accordingly, utilities of VGAM1965 include diagnosis, prevention and treatment of diseases and clinical conditions associated with KIAA1332. KIAA1337 (Accession XM_052561) is another VGAM1965 host target gene. KIAA1337 BINDING SITE is HOST TARGET binding site found in the 3' untranslated region of mRNA encoded by KIAA1337, corresponding to a HOST TARGET binding site such as BINDING SITE I, BINDING SITE II or BINDING SITE III. Table 2 illustrates the complementarity of the nucleotide sequences of KIAA1337 BINDING SITE, designated SEQ ID:35985, to the nucleotide sequence of VGAM1965 RNA, herein designated VGAM RNA, also designated SEQ ID:4676.

Another function of VGAM1965 is therefore inhibition of KIAA1337 (Accession XM_052561). Accordingly, utilities of VGAM1965 include diagnosis, prevention and treatment of diseases and clinical conditions associated with KIAA1337. KIAA1363 (Accession XM_045056) is another VGAM1965 host target gene. KIAA1363 BINDING SITE is HOST TARGET binding site found in the 3' untranslated region of mRNA encoded by KIAA1363, corresponding to a HOST TARGET binding site such as BINDING SITE I, BINDING SITE II or BINDING SITE III. Table 2 illustrates the complementarity of the nucleotide sequences of KIAA1363 BINDING SITE, designated SEQ ID:34332, to the nucleotide sequence of VGAM1965 RNA, herein designated VGAM RNA, also designated SEQ ID:4676.

Another function of VGAM1965 is therefore inhibition of KIAA1363 (Accession XM_045056). Accordingly, utilities of VGAM1965 include diagnosis, prevention and treatment of diseases and clinical conditions associated with KIAA1363. KIAA1389 (Accession XM_045839) is another VGAM1965 host target gene. KIAA1389 BINDING SITE is HOST TARGET binding site found in the 3' untranslated region of mRNA encoded by KIAA1389, corresponding to a HOST TARGET binding site such as BINDING SITE I, BINDING SITE II or BINDING SITE III. Table 2 illustrates the complementarity of the nucleotide sequences of KIAA1389 BINDING SITE, designated SEQ ID:34571, to the nucleotide sequence of VGAM1965 RNA, herein designated VGAM RNA, also designated SEQ ID:4676.

Another function of VGAM1965 is therefore inhibition of KIAA1389 (Accession XM_045839). Accordingly, utilities of VGAM1965 include diagnosis, prevention and treatment of diseases and clinical conditions associated with KIAA1389. KIAA1404 (Accession XM_030494) is another VGAM1965 host target gene. KIAA1404 BINDING SITE is HOST TARGET binding site found in the 3' untranslated region of mRNA encoded by KIAA1404, corresponding to a HOST TARGET binding site such as BINDING SITE I, BINDING SITE II or BINDING SITE III. Table 2 illustrates the complementarity of the nucleotide sequences of KIAA1404 BINDING SITE, designated SEQ ID:31050, to the nucleotide sequence of VGAM1965 RNA, herein designated VGAM RNA, also designated SEQ ID:4676.

Another function of VGAM1965 is therefore inhibition of KIAA1404 (Accession XM_030494). Accordingly, utilities of VGAM1965 include diagnosis, prevention and treatment of diseases and clinical conditions associated with KIAA1404. KIAA1463 (Accession XM_051160) is another VGAM1965 host target gene. KIAA1463 BINDING SITE is HOST TARGET binding site found in the 3' untranslated region of mRNA encoded by KIAA1463, corresponding to a HOST TARGET binding site such as BINDING SITE I, BINDING SITE II or BINDING SITE III. Table 2 illustrates the complementarity of the nucleotide sequences of KIAA1463 BINDING SITE, designated SEQ ID:35774, to the nucleotide sequence of VGAM1965 RNA, herein designated VGAM RNA, also designated SEQ ID:4676.

Another function of VGAM1965 is therefore inhibition of KIAA1463 (Accession XM_051160). Accordingly, utilities of VGAM1965 include diagnosis, prevention and treatment of diseases and clinical conditions associated with KIAA1463. KIAA1484 (Accession XM_046088) is another VGAM1965 host target gene. KIAA1484 BINDING SITE is HOST TARGET binding site found in the 3' untranslated region of mRNA encoded by KIAA1484, corresponding to a HOST TARGET binding site such as BINDING SITE I, BINDING SITE II or BINDING SITE III. Table 2 illustrates the complementarity of the nucleotide sequences of KIAA1484 BINDING SITE, designated SEQ ID:34679, to the nucleotide sequence of VGAM1965 RNA, herein designated VGAM RNA, also designated SEQ ID:4676.

Another function of VGAM1965 is therefore inhibition of KIAA1484 (Accession XM_046088). Accordingly, utilities of VGAM1965 include diagnosis, prevention and treatment of diseases and clinical conditions associated with KIAA1484. KIAA1559 (Accession XM_054472) is another VGAM1965 host target gene. KIAA1559 BINDING SITE is HOST TARGET binding site found in the 3' untranslated region of mRNA encoded by KIAA1559, corresponding to a HOST TARGET binding site such as BINDING SITE I, BINDING SITE II or BINDING SITE III. Table 2 illustrates the complementarity of the nucleotide sequences of KIAA1559 BINDING SITE, designated SEQ ID:36166, to the nucleotide sequence of VGAM1965 RNA, herein designated VGAM RNA, also designated SEQ ID:4676.

Another function of VGAM1965 is therefore inhibition of KIAA1559 (Accession XM_054472). Accordingly, utilities of VGAM1965 include diagnosis, prevention and treatment of diseases and clinical conditions associated with KIAA1559. KIAA1579 (Accession NM_018211) is another VGAM1965 host target gene. KIAA1579 BINDING SITE is HOST TARGET binding site found in the 3' untranslated region of mRNA encoded by KIAA1579, corresponding to a HOST TARGET binding site such as BINDING SITE I, BINDING SITE II or BINDING SITE III. Table 2 illustrates the complementarity of the nucleotide sequences of KIAA1579 BINDING SITE, designated SEQ ID:20120, to the nucleotide sequence of VGAM1965 RNA, herein designated VGAM RNA, also designated SEQ ID:4676.

Another function of VGAM1965 is therefore inhibition of KIAA1579 (Accession NM_018211). Accordingly, utilities of VGAM1965 include diagnosis, prevention and treatment of diseases and clinical conditions associated with KIAA1579. KIAA1622 (Accession NM_058237) is another VGAM1965 host target gene. KIAA1622 BINDING SITE is HOST TARGET binding site found in the 3' untranslated region of mRNA encoded by KIAA1622, corresponding to a HOST TARGET binding site such as BINDING SITE I, BINDING SITE II or BINDING SITE III. Table 2 illustrates the complementarity of the nucleotide sequences of KIAA1622 BINDING SITE, designated SEQ ID:27763, to the nucleotide sequence of VGAM1965 RNA, herein designated VGAM RNA, also designated SEQ ID:4676.

Another function of VGAM1965 is therefore inhibition of KIAA1622 (Accession NM_058237). Accordingly, utilities of VGAM1965 include diagnosis, prevention and treatment of diseases and clinical conditions associated with KIAA1622. KIAA1649 (Accession NM_032311) is another VGAM1965 host target gene. KIAA1649 BINDING SITE1 and KIAA1649 BINDING SITE2 are HOST TARGET binding sites found in untranslated regions of mRNA encoded by KIAA1649, corresponding to HOST TARGET binding sites such as BINDING SITE I, BINDING SITE II or BINDING SITE III. Table 2 illustrates the complementarity of the nucleotide sequences of KIAA1649 BINDING SITE1 and KIAA1649 BINDING SITE2, designated SEQ ID:26112 and SEQ ID:26113 respectively, to the nucleotide sequence of VGAM1965 RNA, herein designated VGAM RNA, also designated SEQ ID:4676.

Another function of VGAM1965 is therefore inhibition of KIAA1649 (Accession NM_032311). Accordingly, utilities of VGAM1965 include diagnosis, prevention and treatment of diseases and clinical conditions associated with KIAA1649. KIAA1676 (Accession XM_167612) is another VGAM1965 host target gene. KIAA1676 BINDING SITE is HOST TARGET binding site found in the 3' untranslated region of mRNA encoded by KIAA1676, corresponding to a HOST TARGET binding site such as BINDING SITE I, BINDING SITE II or BINDING SITE III. Table 2 illustrates the complementarity of the nucleotide sequences of KIAA1676 BINDING SITE, designated SEQ ID:44729, to the nucleotide sequence of VGAM1965 RNA, herein designated VGAM RNA, also designated SEQ ID:4676.

Another function of VGAM1965 is therefore inhibition of KIAA1676 (Accession XM_167612). Accordingly, utilities of VGAM1965 include diagnosis, prevention and treatment of diseases and clinical conditions associated with KIAA1676. KIAA1679 (Accession XM_046570) is another VGAM1965 host target gene. KIAA1679 BINDING SITE is HOST TARGET binding site found in the 5' untranslated region of mRNA encoded by KIAA1679, corresponding to a HOST TARGET binding site such as BINDING SITE I, BINDING SITE II or BINDING SITE III. Table 2 illustrates the complementarity of the nucleotide sequences of KIAA1679 BINDING SITE, designated SEQ ID:34752, to the nucleotide sequence of VGAM1965 RNA, herein designated VGAM RNA, also designated SEQ ID:4676.

Another function of VGAM1965 is therefore inhibition of KIAA1679 (Accession XM_046570). Accordingly, utilities of VGAM1965 include diagnosis, prevention and treatment of diseases and clinical conditions associated with KIAA1679. KIAA1706 (Accession XM_166595) is another VGAM1965 host target gene. KIAA1706 BINDING SITE1 and KIAA1706 BINDING SITE2 are HOST TARGET binding sites found in untranslated regions of mRNA encoded by KIAA1706, corresponding to HOST TARGET binding sites such as BINDING SITE I, BINDING SITE II or BINDING SITE III. Table 2 illustrates the complementarity of the nucleotide sequences of KIAA1706 BINDING SITE1 and KIAA1706 BINDING SITE2, designated SEQ ID:44578 and SEQ ID:44579 respectively, to the nucleotide sequence of VGAM1965 RNA, herein designated VGAM RNA, also designated SEQ ID:4676.

Another function of VGAM1965 is therefore inhibition of KIAA1706 (Accession XM_166595). Accordingly, utilities of VGAM1965 include diagnosis, prevention and treatment of diseases and clinical conditions associated with KIAA1706. KIAA1727 (Accession XM_034262) is another VGAM1965 host target gene. KIAA1727 BINDING SITE is HOST TARGET binding site found in the 3' untranslated region of mRNA encoded by KIAA1727, corresponding to a HOST TARGET binding site such as BINDING SITE I, BINDING SITE II or BINDING SITE III. Table 2 illustrates the complementarity of the nucleotide sequences of KIAA1727 BINDING SITE, designated SEQ ID:32038, to the nucleotide sequence of VGAM1965 RNA, herein designated VGAM RNA, also designated SEQ ID:4676.

Another function of VGAM1965 is therefore inhibition of KIAA1727 (Accession XM_034262). Accordingly, utilities of VGAM1965 include diagnosis, prevention and treatment of diseases and clinical conditions associated with KIAA1727. KIAA1729 (Accession XM_114418) is another VGAM1965 host target gene. KIAA1729 BINDING SITE is HOST TARGET binding site found in the 3' untranslated region of mRNA encoded by KIAA1729, corresponding to a HOST TARGET binding site such as BINDING SITE I, BINDING SITE II or BINDING SITE III. Table 2 illustrates the complementarity of the nucleotide sequences of KIAA1729 BINDING SITE, designated SEQ ID:42949, to the nucleotide sequence of VGAM1965 RNA, herein designated VGAM RNA, also designated SEQ ID:4676.

Another function of VGAM1965 is therefore inhibition of KIAA1729 (Accession XM_114418). Accordingly, utilities of VGAM1965 include diagnosis, prevention and treatment of diseases and clinical conditions associated with KIAA1729. KIAA1754 (Accession XM_032587) is another VGAM1965 host target gene. KIAA1754 BINDING SITE is HOST TARGET binding site found in the 3' untranslated region of mRNA encoded by KIAA1754, corresponding to a HOST TARGET binding site such as BINDING SITE I, BINDING SITE II or BINDING SITE III. Table 2 illustrates the complementarity of the nucleotide sequences of KIAA1754 BINDING SITE, designated SEQ ID:31681, to the nucleotide sequence of VGAM1965 RNA, herein designated VGAM RNA, also designated SEQ ID:4676.

Another function of VGAM1965 is therefore inhibition of KIAA1754 (Accession XM_032587). Accordingly, utilities of VGAM1965 include diagnosis, prevention and treatment of diseases and clinical conditions associated with KIAA1754. KIAA1765 (Accession XM_047355) is another VGAM1965 host target gene. KIAA1765 BINDING SITE is HOST TARGET binding site found in the 3' untranslated region of mRNA encoded by KIAA1765, corresponding to a HOST TARGET binding site such as BINDING SITE I, BINDING SITE II or BINDING SITE III. Table 2 illustrates the complementarity of the nucleotide sequences of KIAA1765 BINDING SITE, designated SEQ ID:34957, to the nucleotide sequence of VGAM1965 RNA, herein designated VGAM RNA, also designated SEQ ID:4676.

Another function of VGAM1965 is therefore inhibition of KIAA1765 (Accession XM_047355). Accordingly, utilities of VGAM1965 include diagnosis, prevention and treatment of diseases and clinical conditions associated with KIAA1765. KIAA1789 (Accession XM_040486) is another VGAM1965 host target gene. KIAA1789 BINDING SITE is HOST TARGET binding site found in the 5' untranslated region of mRNA encoded by KIAA1789, corresponding to a HOST TARGET binding site such as BINDING SITE I, BINDING SITE II or BINDING SITE III. Table 2 illustrates the complementarity of the nucleotide sequences of KIAA1789 BINDING SITE, designated SEQ ID:33312, to the nucleotide sequence of VGAM1965 RNA, herein designated VGAM RNA, also designated SEQ ID:4676.

Another function of VGAM1965 is therefore inhibition of KIAA1789 (Accession XM_040486). Accordingly, utilities of VGAM1965 include diagnosis, prevention and treatment of diseases and clinical conditions associated with KIAA1789. KIAA1804 (Accession XM_045864) is another VGAM1965 host target gene. KIAA1804 BINDING SITE1 and KIAA1804 BINDING SITE2 are HOST TARGET binding sites found in untranslated regions of mRNA encoded by KIAA1804, corresponding to HOST TARGET binding sites such as BINDING SITE I, BINDING SITE II or BINDING SITE III. Table 2 illustrates the complementarity of the nucleotide sequences of KIAA1804 BINDING SITE1 and KIAA1804 BINDING SITE2, designated SEQ ID:34588 and SEQ ID:34591 respectively, to the nucleotide sequence of VGAM1965 RNA, herein designated VGAM RNA, also designated SEQ ID:4676.

Another function of VGAM1965 is therefore inhibition of KIAA1804 (Accession XM_045864). Accordingly, utilities of VGAM1965 include diagnosis, prevention and treatment of diseases and clinical conditions associated with KIAA1804. KIAA1813 (Accession XM_046743) is another VGAM1965 host target gene. KIAA1813 BINDING SITE1 and KIAA1813 BINDING SITE2 are HOST TARGET binding sites found in untranslated regions of mRNA encoded by KIAA1813, corresponding to HOST TARGET binding sites such as BINDING SITE I, BINDING SITE II or BINDING SITE III. Table 2 illustrates the complementarity of the nucleotide sequences of KIAA1813 BINDING SITE1 and KIAA1813 BINDING SITE2, designated SEQ ID:34809 and SEQ ID:31036 respectively, to the nucleotide sequence of VGAM1965 RNA, herein designated VGAM RNA, also designated SEQ ID:4676.

Another function of VGAM1965 is therefore inhibition of KIAA1813 (Accession XM_046743). Accordingly, utilities of VGAM1965 include diagnosis, prevention and treatment of diseases and clinical conditions associated with KIAA1813. KIAA1872 (Accession XM_031917) is another VGAM1965 host target gene. KIAA1872 BINDING SITE is HOST TARGET binding site found in the 3' untranslated region of mRNA encoded by KIAA1872, corresponding to a HOST TARGET binding site such as BINDING SITE I, BINDING SITE II or BINDING SITE III. Table 2 illustrates the complementarity of the nucleotide sequences of KIAA1872 BINDING SITE, designated SEQ ID:31522, to the nucleotide sequence of VGAM1965 RNA, herein designated VGAM RNA, also designated SEQ ID:4676.

Another function of VGAM1965 is therefore inhibition of KIAA1872 (Accession XM_031917). Accordingly, utilities of VGAM1965 include diagnosis, prevention and treatment of diseases and clinical conditions associated with KIAA1872. KIAA1887 (Accession XM_084801) is another VGAM1965 host target gene. KIAA1887 BINDING SITE is HOST TARGET binding site found in the 5' untranslated region of mRNA encoded by KIAA1887, corresponding to a HOST TARGET binding site such as BINDING SITE I, BINDING SITE II or BINDING SITE III. Table 2 illustrates the complementarity of the nucleotide sequences of KIAA1887 BINDING SITE, designated SEQ ID:37715, to the nucleotide sequence of VGAM1965 RNA, herein designated VGAM RNA, also designated SEQ ID:4676.

Another function of VGAM1965 is therefore inhibition of KIAA1887 (Accession XM_084801). Accordingly, utilities of VGAM1965 include diagnosis, prevention and treatment of diseases and clinical conditions associated with KIAA1887. KIAA1908 (Accession XM_055834) is another VGAM1965 host target gene. KIAA1908 BINDING SITE1 and KIAA1908 BINDING SITE2 are HOST TARGET binding sites found in untranslated regions of mRNA encoded by KIAA1908, corresponding to HOST TARGET binding sites such as BINDING SITE I, BINDING SITE II or BINDING SITE III. Table 2 illustrates the complementarity of the nucleotide sequences of KIAA1908 BINDING SITE1 and KIAA1908 BINDING SITE2, designated SEQ ID:36339 and SEQ ID:36326 respectively, to the nucleotide sequence of VGAM1965 RNA, herein designated VGAM RNA, also designated SEQ ID:4676.

Another function of VGAM1965 is therefore inhibition of KIAA1908 (Accession XM_055834). Accordingly, utilities of VGAM1965 include diagnosis, prevention and treatment of diseases and clinical conditions associated with KIAA1908. KIAA1987 (Accession XM_113870) is another VGAM1965 host target gene. KIAA1987 BINDING SITE is HOST TARGET binding site found in the 3' untranslated region of mRNA encoded by KIAA1987, corresponding to a HOST TARGET binding site such as BINDING SITE I, BINDING SITE II or BINDING SITE III. Table 2 illustrates the complementarity of the nucleotide sequences of KIAA1987 BINDING SITE, designated SEQ ID:42502, to the nucleotide sequence of VGAM1965 RNA, herein designated VGAM RNA, also designated SEQ ID:4676.

Another function of VGAM1965 is therefore inhibition of KIAA1987 (Accession XM_113870). Accordingly, utilities of VGAM1965 include diagnosis, prevention and treatment of diseases and clinical conditions associated with KIAA1987. Kelch-like 6 (Drosophila) (KLHL6, Accession NM_130446) is another VGAM1965 host target gene. KLHL6 BINDING SITE is HOST TARGET binding site found in the 3' untranslated region of mRNA encoded by KLHL6, corresponding to a HOST TARGET binding site such as BINDING SITE I, BINDING SITE II or BINDING SITE III. Table 2 illustrates the complementarity of the nucleotide sequences of KLHL6 BINDING SITE, designated SEQ ID:28212, to the nucleotide sequence of VGAM1965 RNA, herein designated VGAM RNA, also designated SEQ ID:4676.

Another function of VGAM1965 is therefore inhibition of Kelch-like 6 (Drosophila) (KLHL6, Accession NM_130446). Accordingly, utilities of VGAM1965 include diagnosis, prevention and treatment of diseases and clinical conditions associated with KLHL6. Kelch-like 8 (Drosophila) (KLHL8, Accession XM_031735) is another VGAM1965 host target gene. KLHL8 BINDING SITE is HOST TARGET binding site found in the 3' untranslated region of mRNA encoded by KLHL8, corresponding to a HOST TARGET binding site such as BINDING SITE I, BINDING SITE II or BINDING SITE III. Table 2 illustrates the complementarity of the nucleotide sequences of KLHL8 BINDING SITE, designated SEQ ID:31478, to the nucleotide sequence of VGAM1965 RNA, herein designated VGAM RNA, also designated SEQ ID:4676.

Another function of VGAM1965 is therefore inhibition of Kelch-like 8 (Drosophila) (KLHL8, Accession XM_031735). Accordingly, utilities of VGAM1965 include diagnosis, prevention and treatment of diseases and clinical conditions associated with KLHL8. Keratin, Hair, Basic, 2 (KRTHB2, Accession NM_033033) is another VGAM1965 host target gene. KRTHB2 BINDING SITE is HOST TARGET binding site found in the 3' untranslated region of mRNA encoded by KRTHB2, corresponding to a HOST TARGET binding site such as BINDING SITE I, BINDING SITE II or BINDING SITE III. Table 2 illustrates the complementarity of the nucleotide sequences of KRTHB2 BINDING SITE, designated SEQ ID:26924, to the nucleotide sequence of VGAM1965 RNA, herein designated VGAM RNA, also designated SEQ ID:4676.

Another function of VGAM1965 is therefore inhibition of Keratin, Hair, Basic, 2 (KRTHB2, Accession NM_033033). Accordingly, utilities of VGAM1965 include diagnosis, prevention and treatment of diseases and clinical conditions associated with KRTHB2. Kv6.3 (Accession NM_133490) is another VGAM1965 host target gene. Kv6.3 BINDING SITE is HOST TARGET binding site found in the 3' untranslated region of mRNA encoded by Kv6.3, corresponding to a HOST TARGET binding site such as BINDING SITE I, BINDING SITE II or BINDING SITE III. Table 2 illustrates the complementarity of the nucleotide sequences of Kv6.3 BINDING SITE, designated SEQ ID:28567, to the nucleotide sequence of VGAM1965 RNA, herein designated VGAM RNA, also designated SEQ ID:4676.

Another function of VGAM1965 is therefore inhibition of Kv6.3 (Accession NM_133490). Accordingly, utilities of VGAM1965 include diagnosis, prevention and treatment of diseases and clinical conditions associated with Kv6.3. LIM and SH3 Protein 1 (LASP1, Accession NM_006148) is another VGAM1965 host target gene. LASP1 BINDING SITE is HOST TARGET binding site found in the 3' untranslated region of mRNA encoded by LASP1, corresponding to a HOST TARGET binding site such as BINDING SITE I, BINDING SITE II or BINDING SITE III. Table 2 illustrates the complementarity of the nucleotide sequences of LASP1 BINDING SITE, designated SEQ ID:12804, to the nucleotide sequence of VGAM1965 RNA, herein designated VGAM RNA, also designated SEQ ID:4676.

Another function of VGAM1965 is therefore inhibition of LIM and SH3 Protein 1 (LASP1, Accession NM_006148). Accordingly, utilities of VGAM1965 include diagnosis, prevention and treatment of diseases and clinical conditions associated with LASP1. LATS, Large Tumor Suppressor, Homolog 1 (Drosophila) (LATS1, Accession XM_015547) is another VGAM1965 host target gene. LATS1 BINDING SITE is HOST TARGET binding site found in the 3' untranslated region of mRNA encoded by LATS1, corresponding to a HOST TARGET binding site such as BINDING SITE I, BINDING SITE II or BINDING SITE III. Table 2 illustrates the complementarity of the nucleotide sequences of LATS1 BINDING SITE, designated SEQ ID:30236, to the nucleotide sequence of VGAM1965 RNA, herein designated VGAM RNA, also designated SEQ ID:4676.

Another function of VGAM1965 is therefore inhibition of LATS, Large Tumor Suppressor, Homolog 1 (Drosophila) (LATS1, Accession XM_015547). Accordingly, utilities of VGAM1965 include diagnosis, prevention and treatment of diseases and clinical conditions associated with LATS1. LIN-7-C (Accession NM_018362) is another VGAM1965 host target gene. LIN-7-C BINDING SITE is HOST TARGET binding site found in the 3' untranslated region of mRNA encoded by LIN-7-C, corresponding to a HOST TARGET binding site such as BINDING SITE I, BINDING SITE II or BINDING SITE III. Table 2 illustrates the complementarity of the nucleotide sequences of LIN-7-C BINDING SITE, designated SEQ ID:20369, to the nucleotide sequence of VGAM1965 RNA, herein designated VGAM RNA, also designated SEQ ID:4676.

Another function of VGAM1965 is therefore inhibition of LIN-7-C (Accession NM_018362). Accordingly, utilities of VGAM1965 include diagnosis, prevention and treatment of diseases and clinical conditions associated with LIN-7-C. Leucine-rich Repeat Protein, Neuronal 3 (LRRN3, Accession XM_045261) is another VGAM1965 host target gene. LRRN3 BINDING SITE is HOST TARGET binding site found in the 5' untranslated region of mRNA encoded by LRRN3, corresponding to a HOST TARGET binding site such as BINDING SITE I, BINDING SITE II or BINDING SITE III. Table 2 illustrates the complementarity of the nucleotide sequences of LRRN3 BINDING SITE, designated SEQ ID:34403, to the nucleotide sequence of VGAM1965 RNA, herein designated VGAM RNA, also designated SEQ ID:4676.

Another function of VGAM1965 is therefore inhibition of Leucine-rich Repeat Protein, Neuronal 3 (LRRN3, Accession XM_045261). Accordingly, utilities of VGAM1965 include diagnosis, prevention and treatment of diseases and clinical conditions associated with LRRN3. MAD, Mothers Against Decapentaplegic Homolog (Drosophila) Interacting Protein, Receptor Activation Anchor (MADHIP, Accession NM_007324) is another VGAM1965 host target gene. MADHIP BINDING SITE is HOST TARGET binding site found in the 3' untranslated region of mRNA encoded by MADHIP, corresponding to a HOST TARGET binding site such as BINDING SITE I, BINDING SITE II or BINDING SITE III. Table 2 illustrates the complementarity of the nucleotide sequences of MADHIP BINDING SITE, designated SEQ ID:14244, to the nucleotide sequence of VGAM1965 RNA, herein designated VGAM RNA, also designated SEQ ID:4676.

Another function of VGAM1965 is therefore inhibition of MAD, Mothers Against Decapentaplegic Homolog (Drosophila) Interacting Protein, Receptor Activation Anchor (MADHIP, Accession NM_007324). Accordingly, utilities of VGAM1965 include diagnosis, prevention and treatment of diseases and clinical conditions associated with MADHIP. MAN1 (Accession NM_014319) is another VGAM1965 host target gene. MAN1 BINDING SITE is HOST TARGET binding site found in the 3' untranslated region of mRNA encoded by MAN1, corresponding to a HOST TARGET binding site such as BINDING SITE I, BINDING SITE II or BINDING SITE III. Table 2 illustrates the complementarity of the nucleotide sequences of MAN1 BINDING SITE, designated SEQ ID:15619, to the nucleotide sequence of VGAM1965 RNA, herein designated VGAM RNA, also designated SEQ ID:4676.

Another function of VGAM1965 is therefore inhibition of MAN1 (Accession NM_014319). Accordingly, utilities of VGAM1965 include diagnosis, prevention and treatment of diseases and clinical conditions associated with MAN1. Mitogen-activated Protein Kinase Kinase Kinase 3 (MAP3K3, Accession NM_002401) is another VGAM1965 host target gene. MAP3K3 BINDING SITE is HOST TARGET binding site found in the 3' untranslated region of mRNA encoded by MAP3K3, corresponding to a HOST TARGET binding site such as BINDING SITE I, BINDING SITE II or BINDING SITE III. Table 2 illustrates the complementarity of the nucleotide sequences of MAP3K3 BINDING SITE, designated SEQ ID:8223, to the nucleotide sequence of VGAM1965 RNA, herein designated VGAM RNA, also designated SEQ ID:4676.

Another function of VGAM1965 is therefore inhibition of Mitogen-activated Protein Kinase Kinase Kinase 3 (MAP3K3, Accession NM_002401). Accordingly, utilities of VGAM1965 include diagnosis, prevention and treatment of diseases and clinical conditions associated with MAP3K3. MAWBP (Accession NM_022129) is another VGAM1965 host target gene. MAWBP BINDING SITE is HOST TARGET binding site found in the 3' untranslated region of mRNA encoded by MAWBP, corresponding to a HOST TARGET binding site such as BINDING SITE I, BINDING SITE II or BINDING SITE III. Table 2 illustrates the complementarity of the nucleotide sequences of MAWBP BINDING SITE, designated SEQ ID:22682, to the nucleotide sequence of VGAM1965 RNA, herein designated VGAM RNA, also designated SEQ ID:4676.

Another function of VGAM1965 is therefore inhibition of MAWBP (Accession NM_022129). Accordingly, utilities of VGAM1965 include diagnosis, prevention and treatment of diseases and clinical conditions associated with MAWBP. Methyl-CpG Binding Domain Protein 2 (MBD2, Accession NM_015832) is another VGAM1965 host target gene. MBD2 BINDING SITE is HOST TARGET binding site found in the 3' untranslated region of mRNA encoded by MBD2, corresponding to a HOST TARGET binding site such as BINDING SITE I, BINDING SITE II or BINDING SITE III. Table 2 illustrates the complementarity of the nucleotide sequences of MBD2 BINDING SITE, designated SEQ ID:17947, to the nucleotide sequence of VGAM1965 RNA, herein designated VGAM RNA, also designated SEQ ID:4676.

Another function of VGAM1965 is therefore inhibition of Methyl-CpG Binding Domain Protein 2 (MBD2, Accession NM_015832). Accordingly, utilities of VGAM1965 include diagnosis, prevention and treatment of diseases and clinical conditions associated with MBD2. Mesoderm Development Candidate 2 (MESDC2, Accession XM_051854) is another VGAM1965 host target gene. MESDC2 BINDING SITE1 and MESDC2 BINDING SITE2 are HOST TARGET binding sites found in untranslated regions of mRNA encoded by MESDC2, corresponding to HOST TARGET binding sites such as BINDING SITE I, BINDING SITE II or BINDING SITE III. Table 2 illustrates the complementarity of the nucleotide sequences of MESDC2 BINDING SITE1 and MESDC2 BINDING SITE2, designated SEQ ID:35896 and SEQ ID:35895 respectively, to the nucleotide sequence of VGAM1965 RNA, herein designated VGAM RNA, also designated SEQ ID:4676.

Another function of VGAM1965 is therefore inhibition of Mesoderm Development Candidate 2 (MESDC2, Accession XM_051854). Accordingly, utilities of VGAM1965 include diagnosis, prevention and treatment of diseases and clinical conditions associated with MESDC2. MGC10814 (Accession NM_032671) is another VGAM1965 host target gene. MGC10814 BINDING SITE is HOST TARGET binding site found in the 5' untranslated region of mRNA encoded by MGC10814, corresponding to a HOST TARGET binding site such as BINDING SITE I, BINDING SITE II or BINDING SITE III. Table 2 illustrates the complementarity of the nucleotide sequences of MGC10814 BINDING SITE, designated SEQ ID:26396, to the nucleotide sequence of VGAM1965 RNA, herein designated VGAM RNA, also designated SEQ ID:4676.

Another function of VGAM1965 is therefore inhibition of MGC10814 (Accession NM_032671). Accordingly, utilities of VGAM1965 include diagnosis, prevention and treatment of diseases and clinical conditions associated with MGC10814. MGC10960 (Accession NM_032653) is another VGAM1965 host target gene. MGC10960 BINDING SITE is HOST TARGET binding site found in the 3' untranslated region of mRNA encoded by MGC10960, corresponding to a HOST TARGET binding site such as BINDING SITE I, BINDING SITE II or BINDING SITE III. Table 2 illustrates the complementarity of the nucleotide sequences of MGC10960 BINDING SITE, designated SEQ ID:26383, to the nucleotide sequence of VGAM1965 RNA, herein designated VGAM RNA, also designated SEQ ID:4676.

Another function of VGAM1965 is therefore inhibition of MGC10960 (Accession NM_032653). Accordingly, utilities of VGAM1965 include diagnosis, prevention and treatment of diseases and clinical conditions associated with MGC10960. MGC11034 (Accession NM_031453) is another VGAM1965 host target gene. MGC11034 BINDING SITE is HOST TARGET binding site found in the 3' untranslated region of mRNA encoded by MGC11034, corresponding to a HOST TARGET binding site such as BINDING SITE I, BINDING SITE II or BINDING SITE III. Table 2 illustrates the complementarity of the nucleotide sequences of MGC11034 BINDING SITE, designated SEQ ID:25471, to the nucleotide sequence of VGAM1965 RNA, herein designated VGAM RNA, also designated SEQ ID:4676.

Another function of VGAM1965 is therefore inhibition of MGC11034 (Accession NM_031453). Accordingly, utilities of VGAM1965 include diagnosis, prevention and treatment of diseases and clinical conditions associated with MGC11034. MGC11115 (Accession NM_032310) is another VGAM1965 host target gene. MGC11115 BINDING SITE1 and MGC11115 BINDING SITE2 are HOST TARGET binding sites found in untranslated regions of mRNA encoded by MGC11115, corresponding to HOST TARGET binding sites such as BINDING SITE I, BINDING SITE II or BINDING SITE III. Table 2 illustrates the complementarity of the nucleotide sequences of MGC11115 BINDING SITE1 and MGC11115 BINDING SITE2, designated SEQ ID:26097 and SEQ ID:26098 respectively, to the nucleotide sequence of VGAM1965 RNA, herein designated VGAM RNA, also designated SEQ ID:4676.

Another function of VGAM1965 is therefore inhibition of MGC11115 (Accession NM_032310). Accordingly, utilities of VGAM1965 include diagnosis, prevention and treatment of diseases and clinical conditions associated with MGC11115. MGC13114 (Accession NM_032366) is another VGAM1965 host target gene. MGC13114 BINDING SITE is HOST TARGET binding site found in the 3' untranslated region of mRNA encoded by MGC13114, corresponding to a HOST TARGET binding site such as BINDING SITE I, BINDING SITE II or BINDING SITE III. Table 2 illustrates the complementarity of the nucleotide sequences of MGC13114 BINDING SITE, designated SEQ ID:26155, to the nucleotide sequence of VGAM1965 RNA, herein designated VGAM RNA, also designated SEQ ID:4676.

Another function of VGAM1965 is therefore inhibition of MGC13114 (Accession NM_032366). Accordingly, utilities of VGAM1965 include diagnosis, prevention and treatment of diseases and clinical conditions associated with MGC13114. MGC14407 (Accession NM_032908) is another VGAM1965 host target gene. MGC14407 BINDING SITE is HOST TARGET binding site found in the 3' untranslated region of mRNA encoded by MGC14407, corresponding to a HOST TARGET binding site such as BINDING SITE I, BINDING SITE II or BINDING SITE III. Table 2 illustrates the complementarity of the nucleotide sequences of MGC14407 BINDING SITE, designated SEQ ID:26730, to the nucleotide sequence of VGAM1965 RNA, herein designated VGAM RNA, also designated SEQ ID:4676.

Another function of VGAM1965 is therefore inhibition of MGC14407 (Accession NM_032908). Accordingly, utilities of VGAM1965 include diagnosis, prevention and treatment of diseases and clinical conditions associated with MGC14407. MGC15873 (Accession NM_032920) is another VGAM1965 host target gene. MGC15873 BINDING SITE1 and MGC15873 BINDING SITE2 are HOST TARGET binding sites found in untranslated regions of mRNA encoded by MGC15873, corresponding to HOST TARGET binding sites such as BINDING SITE I, BINDING SITE II or BINDING SITE III. Table 2 illustrates the complementarity of the nucleotide sequences of MGC15873 BINDING SITE1 and MGC15873 BINDING SITE2, designated SEQ ID:26744 and SEQ ID:26745 respectively, to the nucleotide sequence of VGAM1965 RNA, herein designated VGAM RNA, also designated SEQ ID:4676.

Another function of VGAM1965 is therefore inhibition of MGC15873 (Accession NM_032920). Accordingly, utilities of VGAM1965 include diagnosis, prevention and treatment of diseases and clinical conditions associated with MGC15873. MGC2603 (Accession NM_024037) is another VGAM1965 host target gene. MGC2603 BINDING SITE is HOST TARGET binding site found in the 3' untranslated region of mRNA encoded by MGC2603, corresponding to a HOST TARGET binding site such as BINDING SITE I, BINDING SITE II or BINDING SITE III. Table 2 illustrates the complementarity of the nucleotide sequences of MGC2603 BINDING SITE, designated SEQ ID:23471, to the nucleotide sequence of VGAM1965 RNA, herein designated VGAM RNA, also designated SEQ ID:4676.

Another function of VGAM1965 is therefore inhibition of MGC2603 (Accession NM_024037). Accordingly, utilities of VGAM1965 include diagnosis, prevention and treatment of diseases and clinical conditions associated with MGC2603. MGC2668 (Accession XM_026968) is another VGAM1965 host target gene. MGC2668 BINDING SITE is HOST TARGET binding site found in the 3' untranslated region of mRNA encoded by MGC2668, corresponding to a HOST TARGET binding site such as BINDING SITE I, BINDING SITE II or BINDING SITE III. Table 2 illustrates the complementarity of the nucleotide sequences of MGC2668 BINDING SITE, designated SEQ ID:30380, to the nucleotide sequence of VGAM1965 RNA, herein designated VGAM RNA, also designated SEQ ID:4676.

Another function of VGAM1965 is therefore inhibition of MGC2668 (Accession XM_026968). Accordingly, utilities of VGAM1965 include diagnosis, prevention and treatment of diseases and clinical conditions associated with MGC2668. MGC2848 (Accession NM_032917) is another VGAM1965 host target gene. MGC2848 BINDING SITE is HOST TARGET binding site found in the 3' untranslated region of mRNA encoded by MGC2848, corresponding to a HOST TARGET binding site such as BINDING SITE I, BINDING SITE II or BINDING SITE III. Table 2 illustrates the complementarity of the nucleotide sequences of MGC2848 BINDING SITE, designated SEQ ID:26735, to the nucleotide sequence of VGAM1965 RNA, herein designated VGAM RNA, also designated SEQ ID:4676.

Another function of VGAM1965 is therefore inhibition of MGC2848 (Accession NM_032917). Accordingly, utilities of VGAM1965 include diagnosis, prevention and treatment of diseases and clinical conditions associated with MGC2848. MGC5576 (Accession NM_024056) is another VGAM1965 host target gene. MGC5576 BINDING SITE is HOST TARGET binding site found in the 3' untranslated region of mRNA encoded by MGC5576, corresponding to a HOST TARGET binding site such as BINDING SITE I, BINDING SITE II or BINDING SITE III. Table 2 illustrates the complementarity of the nucleotide sequences of MGC5576 BINDING SITE, designated SEQ ID:23493, to the nucleotide sequence of VGAM1965 RNA, herein designated VGAM RNA, also designated SEQ ID:4676.

Another function of VGAM1965 is therefore inhibition of MGC5576 (Accession NM_024056). Accordingly, utilities of VGAM1965 include diagnosis, prevention and treatment of diseases and clinical conditions associated with MGC5576. MIDORI (Accession XM_057651) is another VGAM1965 host target gene. MIDORI BINDING SITE is HOST TARGET binding site found in the 3' untranslated region of mRNA encoded by MIDORI, corresponding to a HOST TARGET binding site such as BINDING SITE I, BINDING SITE II or BINDING SITE III. Table 2 illustrates the complementarity of the nucleotide sequences of MIDORI BINDING SITE, designated SEQ ID:36526, to the nucleotide sequence of VGAM1965 RNA, herein designated VGAM RNA, also designated SEQ ID:4676.

Another function of VGAM1965 is therefore inhibition of MIDORI (Accession XM_057651). Accordingly, utilities of VGAM1965 include diagnosis, prevention and treatment of diseases and clinical conditions associated with MIDORI. MKP-7 (Accession XM_039106) is another VGAM1965 host target gene. MKP-7 BINDING SITE1 and MKP-7 BINDING SITE2 are HOST TARGET binding sites found in untranslated regions of mRNA encoded by MKP-7, corresponding to HOST TARGET binding sites such as BINDING SITE I, BINDING SITE II or BINDING SITE III. Table 2 illustrates the complementarity of the nucleotide sequences of MKP-7 BINDING SITE1 and MKP-7 BINDING SITE2, designated SEQ ID:33010 and SEQ ID:33011 respectively, to the nucleotide sequence of VGAM1965 RNA, herein designated VGAM RNA, also designated SEQ ID:4676.

Another function of VGAM1965 is therefore inhibition of MKP-7 (Accession XM_039106). Accordingly, utilities of VGAM1965 include diagnosis, prevention and treatment of diseases and clinical conditions associated with MKP-7. MRPL56 (Accession NM_032857) is another VGAM1965 host target gene. MRPL56 BINDING SITE is HOST TARGET binding site found in the 3' untranslated region of mRNA encoded by MRPL56, corresponding to a HOST TARGET binding site such as BINDING SITE I, BINDING SITE II or BINDING SITE III. Table 2 illustrates the complementarity of the nucleotide sequences of MRPL56 BINDING SITE, designated SEQ ID:26660, to the nucleotide sequence of VGAM1965 RNA, herein designated VGAM RNA, also designated SEQ ID:4676.

Another function of VGAM1965 is therefore inhibition of MRPL56 (Accession NM_032857). Accordingly, utilities of VGAM1965 include diagnosis, prevention and treatment of diseases and clinical conditions associated with MRPL56. MTCH1 (Accession NM_014341) is another VGAM1965 host target gene. MTCH1 BINDING SITE is HOST TARGET binding site found in the 3' untranslated region of mRNA encoded by MTCH1, corresponding to a HOST TARGET binding site such as BINDING SITE I, BINDING SITE II or BINDING SITE III. Table 2 illustrates the complementarity of the nucleotide sequences of MTCH1 BINDING SITE, designated SEQ ID:15662, to the nucleotide sequence of VGAM1965 RNA, herein designated VGAM RNA, also designated SEQ ID:4676.

Another function of VGAM1965 is therefore inhibition of MTCH1 (Accession NM_014341). Accordingly, utilities of VGAM1965 include diagnosis, prevention and treatment of diseases and clinical conditions associated with MTCH1. MY014 (Accession NM_030918) is another VGAM1965 host target gene. MY014 BINDING SITE is HOST TARGET binding site found in the 5' untranslated region of mRNA encoded by MY014, corresponding to a HOST TARGET binding site such as BINDING SITE I, BINDING SITE II or BINDING SITE III. Table 2 illustrates the complementarity of the nucleotide sequences of MY014 BINDING SITE, designated SEQ ID:25192, to the nucleotide sequence of VGAM1965 RNA, herein designated VGAM RNA, also designated SEQ ID:4676.

Another function of VGAM1965 is therefore inhibition of MY014 (Accession NM_030918). Accordingly, utilities of VGAM1965 include diagnosis, prevention and treatment of diseases and clinical conditions associated with MY014. My015 (Accession XM_039512) is another VGAM1965 host target gene. My015 BINDING SITE is HOST TARGET binding site found in the 3' untranslated region of mRNA encoded by My015, corresponding to a HOST TARGET binding site such as BINDING SITE I, BINDING SITE II or BINDING SITE III. Table 2 illustrates the complementarity of the nucleotide sequences of My015 BINDING SITE, designated SEQ ID:33109, to the nucleotide sequence of VGAM1965 RNA, herein designated VGAM RNA, also designated SEQ ID:4676.

Another function of VGAM1965 is therefore inhibition of My015 (Accession XM_039512). Accordingly, utilities of VGAM1965 include diagnosis, prevention and treatment of diseases and clinical conditions associated with My015. N4BP2 (Accession NM_018177) is another VGAM1965 host target gene. N4BP2 BINDING SITE is HOST TARGET binding site found in the 3' untranslated region of mRNA encoded by N4BP2, corresponding to a HOST TARGET binding site such as BINDING SITE I, BINDING SITE II or BINDING SITE III. Table 2 illustrates the complementarity of the nucleotide sequences of N4BP2 BINDING SITE, designated SEQ ID:20005, to the nucleotide sequence of VGAM1965 RNA, herein designated VGAM RNA, also designated SEQ ID:4676.

Another function of VGAM1965 is therefore inhibition of N4BP2 (Accession NM_018177). Accordingly, utilities of VGAM1965 include diagnosis, prevention and treatment of diseases and clinical conditions associated with N4BP2. N4BP3 (Accession XM_038920) is another VGAM1965 host target gene. N4BP3 BINDING SITE is HOST TARGET binding site found in the 3' untranslated region of mRNA encoded by N4BP3, corresponding to a HOST TARGET binding site such as BINDING SITE I, BINDING SITE II or BINDING SITE III. Table 2 illustrates the complementarity of the nucleotide sequences of N4BP3 BINDING SITE, designated SEQ ID:32940, to the nucleotide sequence of VGAM1965 RNA, herein designated VGAM RNA, also designated SEQ ID:4676.

Another function of VGAM1965 is therefore inhibition of N4BP3 (Accession XM_038920). Accordingly, utilities of VGAM1965 include diagnosis, prevention and treatment of diseases and clinical conditions associated with N4BP3. NIBAN (Accession NM_022083) is another VGAM1965 host target gene. NIBAN BINDING SITE is HOST TARGET binding site found in the 3' untranslated region of mRNA encoded by NIBAN, corresponding to a HOST TARGET binding site such as BINDING SITE I, BINDING SITE II or BINDING SITE III. Table 2 illustrates the complementarity of the nucleotide sequences of NIBAN BINDING SITE, designated SEQ ID:22631, to the nucleotide sequence of VGAM1965 RNA, herein designated VGAM RNA, also designated SEQ ID:4676.

Another function of VGAM1965 is therefore inhibition of NIBAN (Accession NM_022083). Accordingly, utilities of VGAM1965 include diagnosis, prevention and treatment of diseases and clinical conditions associated with NIBAN. N-myristoyltransferase 1 (NMT1, Accession NM_021079) is another VGAM1965 host target gene. NMT1 BINDING SITE1 and NMT1 BINDING SITE2 are HOST TARGET binding sites found in untranslated regions of mRNA encoded by NMT1, corresponding to HOST TARGET binding sites such as BINDING SITE I, BINDING SITE II or BINDING SITE III. Table 2 illustrates the complementarity of the nucleotide sequences of NMT1 BINDING SITE1 and NMT1 BINDING SITE2, designated SEQ ID:22050 and SEQ ID:22051 respectively, to the nucleotide sequence of VGAM1965 RNA, herein designated VGAM RNA, also designated SEQ ID:4676.

Another function of VGAM1965 is therefore inhibition of N-myristoyltransferase 1 (NMT1, Accession NM_021079). Accordingly, utilities of VGAM1965 include diagnosis, prevention and treatment of diseases and clinical conditions associated with NMT1. NX-17 (Accession NM_020665) is another VGAM1965 host target gene. NX-17 BINDING SITE is HOST TARGET binding site found in the 3' untranslated region of mRNA encoded by NX-17, corresponding to a HOST TARGET binding site such as BINDING SITE I, BINDING SITE II or BINDING SITE III. Table 2 illustrates the complementarity of the nucleotide sequences of NX-17 BINDING SITE, designated SEQ ID:21835, to the nucleotide sequence of VGAM1965 RNA, herein designated VGAM RNA, also designated SEQ ID:4676.

Another function of VGAM1965 is therefore inhibition of NX-17 (Accession NM_020665). Accordingly, utilities of VGAM1965 include diagnosis, prevention and treatment of diseases and clinical conditions associated with NX-17. NXP-2 (Accession XM_048706) is another VGAM1965 host target gene. NXP-2 BINDING SITE is HOST TARGET binding site found in the 3' untranslated region of mRNA encoded by NXP-2, corresponding to a HOST TARGET binding site such as BINDING SITE I, BINDING SITE II or BINDING SITE III. Table 2 illustrates the complementarity of the nucleotide sequences of NXP-2 BINDING SITE, designated SEQ ID:35230, to the nucleotide sequence of VGAM1965 RNA, herein designated VGAM RNA, also designated SEQ ID:4676.

Another function of VGAM1965 is therefore inhibition of NXP-2 (Accession XM_048706). Accordingly, utilities of VGAM1965 include diagnosis, prevention and treatment of diseases and clinical conditions associated with NXP-2. Neurexophilin 3 (NXPH3, Accession XM_037847) is another VGAM1965 host target gene. NXPH3 BINDING SITE1 and NXPH3 BINDING SITE2 are HOST TARGET binding sites found in untranslated regions of mRNA encoded by NXPH3, corresponding to HOST TARGET binding sites such as BINDING SITE I, BINDING SITE II or BINDING SITE III. Table 2 illustrates the complementarity of the nucleotide sequences of NXPH3 BINDING SITE1 and NXPH3 BINDING SITE2, designated SEQ ID:32721 and SEQ ID:32723 respectively, to the nucleotide sequence of VGAM1965 RNA, herein designated VGAM RNA, also designated SEQ ID:4676.

Another function of VGAM1965 is therefore inhibition of Neurexophilin 3 (NXPH3, Accession XM_037847). Accordingly, utilities of VGAM1965 include diagnosis, prevention and treatment of diseases and clinical conditions associated with NXPH3. Oxysterol Binding Protein-like 10 (OSBPL10, Accession NM_017784) is another VGAM1965 host target gene. OSBPL10 BINDING SITE is HOST TARGET binding site found in the 3' untranslated region of mRNA encoded by OSBPL10, corresponding to a HOST TARGET binding site such as BINDING SITE I, BINDING SITE II or BINDING SITE III. Table 2 illustrates the complementarity of the nucleotide sequences of OSBPL10 BINDING SITE, designated SEQ ID:19417, to the nucleotide sequence of VGAM1965 RNA, herein designated VGAM RNA, also designated SEQ ID:4676.

Another function of VGAM1965 is therefore inhibition of Oxysterol Binding Protein-like 10 (OSBPL10, Accession NM_017784). Accordingly, utilities of VGAM1965 include diagnosis, prevention and treatment of diseases and clinical conditions associated with OSBPL10. P11 (Accession NM_006025) is another VGAM1965 host target gene. P11 BINDING SITE is HOST TARGET binding site found in the 3' untranslated region of mRNA encoded by P11, corresponding to a HOST TARGET binding site such as BINDING SITE I, BINDING SITE II or BINDING SITE III. Table 2 illustrates the complementarity of the nucleotide sequences of P11 BINDING SITE, designated SEQ ID:12643, to the nucleotide sequence of VGAM1965 RNA, herein designated VGAM RNA, also designated SEQ ID:4676.

Another function of VGAM1965 is therefore inhibition of P11 (Accession NM_006025). Accordingly, utilities of VGAM1965 include diagnosis, prevention and treatment of diseases and clinical conditions associated with P11. Purinergic Receptor P2X, Ligand-gated Ion Channel, 1 (P2RX1, Accession XM_040635) is another VGAM1965 host target gene. P2RX1 BINDING SITE is HOST TARGET binding site found in the 3' untranslated region of mRNA encoded by P2RX1, corresponding to a HOST TARGET binding site such as BINDING SITE I, BINDING SITE II or BINDING SITE III. Table 2 illustrates the complementarity of the nucleotide sequences of P2RX1 BINDING SITE, designated SEQ ID:33359, to the nucleotide sequence of VGAM1965 RNA, herein designated VGAM RNA, also designated SEQ ID:4676.

Another function of VGAM1965 is therefore inhibition of Purinergic Receptor P2X, Ligand-gated Ion Channel, 1 (P2RX1, Accession XM_040635). Accordingly, utilities of VGAM1965 include diagnosis, prevention and treatment of diseases and clinical conditions associated with P2RX1. P5-1 (Accession NM_006674) is another VGAM1965 host target gene. P5-1 BINDING SITE is HOST TARGET binding site found in the 3' untranslated region of mRNA encoded by P5-1, corresponding to a HOST TARGET binding site such as BINDING SITE I, BINDING SITE II or BINDING SITE III. Table 2 illustrates the complementarity of the nucleotide sequences of P5-1 BINDING SITE, designated SEQ ID:13500, to the nucleotide sequence of VGAM1965 RNA, herein designated VGAM RNA, also designated SEQ ID:4676.

Another function of VGAM1965 is therefore inhibition of P5-1 (Accession NM_006674). Accordingly, utilities of VGAM1965 include diagnosis, prevention and treatment of diseases and clinical conditions associated with P5-1. Peptidyl Arginine Deiminase, Type III (PADI3, Accession NM_016233) is another VGAM1965 host target gene. PADI3 BINDING SITE is HOST TARGET binding site found in the 3' untranslated region of mRNA encoded by PADI3, corresponding to a HOST TARGET binding site such as BINDING SITE I, BINDING SITE II or BINDING SITE III. Table 2 illustrates the complementarity of the nucleotide sequences of PADI3 BINDING SITE, designated SEQ ID:18347, to the nucleotide sequence of VGAM1965 RNA, herein designated VGAM RNA, also designated SEQ ID:4676.

Another function of VGAM1965 is therefore inhibition of Peptidyl Arginine Deiminase, Type III (PADI3, Accession NM_016233). Accordingly, utilities of VGAM1965 include diagnosis, prevention and treatment of diseases and clinical conditions associated with PADI3. PANK (Accession NM_138316) is another VGAM1965 host target gene. PANK BINDING SITE is HOST TARGET binding site found in the 3' untranslated region of mRNA encoded by PANK, corresponding to a HOST TARGET binding site such as BINDING SITE I, BINDING SITE II or BINDING SITE III. Table 2 illustrates the complementarity of the nucleotide sequences of PANK BINDING SITE, designated SEQ ID:28715, to the nucleotide sequence of VGAM1965 RNA, herein designated VGAM RNA, also designated SEQ ID:4676.

Another function of VGAM1965 is therefore inhibition of PANK (Accession NM_138316). Accordingly, utilities of VGAM1965 include diagnosis, prevention and treatment of diseases and clinical conditions associated with PANK. Phosphodiesterase 2A, CGMP-stimulated (PDE2A, Accession NM_002599) is another VGAM1965 host target gene. PDE2A BINDING SITE is HOST TARGET binding site found in the 3' untranslated region of mRNA encoded by PDE2A, corresponding to a HOST TARGET binding site such as BINDING SITE I, BINDING SITE II or BINDING SITE III. Table 2 illustrates the complementarity of the nucleotide sequences of PDE2A BINDING SITE, designated SEQ ID:8462, to the nucleotide sequence of VGAM1965 RNA, herein designated VGAM RNA, also designated SEQ ID:4676.

Another function of VGAM1965 is therefore inhibition of Phosphodiesterase 2A, CGMP-stimulated (PDE2A, Accession NM_002599). Accordingly, utilities of VGAM1965 include diagnosis, prevention and treatment of diseases and clinical conditions associated with PDE2A. Platelet Derived Growth Factor C (PDGFC, Accession NM_016205) is another VGAM1965 host target gene. PDGFC BINDING SITE is HOST TARGET binding site found in the 5' untranslated region of mRNA encoded by PDGFC, corresponding to a HOST TARGET binding site such as BINDING SITE I, BINDING SITE II or BINDING SITE III. Table 2 illustrates the complementarity of the nucleotide sequences of PDGFC BINDING SITE, designated SEQ ID:18303, to the nucleotide sequence of VGAM1965 RNA, herein designated VGAM RNA, also designated SEQ ID:4676.

Another function of VGAM1965 is therefore inhibition of Platelet Derived Growth Factor C (PDGFC, Accession NM_016205). Accordingly, utilities of VGAM1965 include diagnosis, prevention and treatment of diseases and clinical conditions associated with PDGFC. Pyruvate Dehydrogenase Kinase, Isoenzyme 2 (PDK2, Accession NM_002611) is another VGAM1965 host target gene. PDK2 BINDING SITE is HOST TARGET binding site found in the 3' untranslated region of mRNA encoded by PDK2, corresponding to a HOST TARGET binding site such as BINDING SITE I, BINDING SITE II or BINDING SITE III. Table 2 illustrates the complementarity of the nucleotide sequences of PDK2 BINDING SITE, designated SEQ ID:8474, to the nucleotide sequence of VGAM1965 RNA, herein designated VGAM RNA, also designated SEQ ID:4676.

Another function of VGAM1965 is therefore inhibition of Pyruvate Dehydrogenase Kinase, Isoenzyme 2 (PDK2, Accession NM_002611). Accordingly, utilities of VGAM1965 include diagnosis, prevention and treatment of diseases and clinical conditions associated with PDK2. PDZ Domain Containing 2 (PDZD2, Accession XM_087705) is another VGAM1965 host target gene. PDZD2 BINDING SITE1 and PDZD2 BINDING SITE2 are HOST TARGET binding sites found in untranslated regions of mRNA encoded by PDZD2, corresponding to HOST TARGET binding sites such as BINDING SITE I, BINDING SITE II or BINDING SITE III. Table 2 illustrates the complementarity of the nucleotide sequences of PDZD2 BINDING SITE1 and PDZD2 BINDING SITE2, designated SEQ ID:39398 and SEQ ID:39394 respectively, to the nucleotide sequence of VGAM1965 RNA, herein designated VGAM RNA, also designated SEQ ID:4676.

Another function of VGAM1965 is therefore inhibition of PDZ Domain Containing 2 (PDZD2, Accession XM_087705). Accordingly, utilities of VGAM1965 include diagnosis, prevention and treatment of diseases and clinical conditions associated with PDZD2. PGR1 (Accession NM_033296) is another VGAM1965 host target gene. PGR1 BINDING SITE is HOST TARGET binding site found in the 3' untranslated region of mRNA encoded by PGR1, corresponding to a HOST TARGET binding site such as BINDING SITE I, BINDING SITE II or BINDING SITE III. Table 2 illustrates the complementarity of the nucleotide sequences of PGR1 BINDING SITE, designated SEQ ID:27124, to the nucleotide sequence of VGAM1965 RNA, herein designated VGAM RNA, also designated SEQ ID:4676.

Another function of VGAM1965 is therefore inhibition of PGR1 (Accession NM_033296). Accordingly, utilities of VGAM1965 include diagnosis, prevention and treatment of diseases and clinical conditions associated with PGR1. Phytanoyl-CoA Hydroxylase Interacting Protein (PHYHIP, Accession NM_014759) is another VGAM1965 host target gene. PHYHIP BINDING SITE is HOST TARGET binding site found in the 3' untranslated region of mRNA encoded by PHYHIP, corresponding to a HOST TARGET binding site such as BINDING SITE I, BINDING SITE II or BINDING SITE III. Table 2 illustrates the complementarity of the nucleotide sequences of PHYHIP BINDING SITE, designated SEQ ID:16514, to the nucleotide sequence of VGAM1965 RNA, herein designated VGAM RNA, also designated SEQ ID:4676.

Another function of VGAM1965 is therefore inhibition of Phytanoyl-CoA Hydroxylase Interacting Protein (PHYHIP, Accession NM_014759). Accordingly, utilities of VGAM1965 include diagnosis, prevention and treatment of diseases and clinical conditions associated with PHYHIP. Phosphatidylinositol-4-phosphate 5-kinase, Type II, Beta (PIP5K2B, Accession NM_003559) is another VGAM1965 host target gene. PIP5K2B BINDING SITE is HOST TARGET binding site found in the 3' untranslated region of mRNA encoded by PIP5K2B, corresponding to a HOST TARGET binding site such as BINDING SITE I, BINDING SITE II or BINDING SITE III. Table 2 illustrates the complementarity of the nucleotide sequences of PIP5K2B BINDING SITE, designated SEQ ID:9616, to the nucleotide sequence of VGAM1965 RNA, herein designated VGAM RNA, also designated SEQ ID:4676.

Another function of VGAM1965 is therefore inhibition of Phosphatidylinositol-4-phosphate 5-kinase, Type II, Beta (PIP5K2B, Accession NM_003559). Accordingly, utilities of VGAM1965 include diagnosis, prevention and treatment of diseases and clinical conditions associated with PIP5K2B. POF1B (Accession NM_024921) is another VGAM1965 host target gene. POF1B BINDING SITE is HOST TARGET binding site found in the 3' untranslated region of mRNA encoded by POF1B, corresponding to a HOST TARGET binding site such as BINDING SITE I, BINDING SITE II or BINDING SITE III. Table 2 illustrates the complementarity of the nucleotide sequences of POF1B BINDING SITE, designated SEQ ID:24455, to the nucleotide sequence of VGAM1965 RNA, herein designated VGAM RNA, also designated SEQ ID:4676.

Another function of VGAM1965 is therefore inhibition of POF1B (Accession NM_024921). Accordingly, utilities of VGAM1965 include diagnosis, prevention and treatment of diseases and clinical conditions associated with POF1B. Polymerase (DNA directed), Mu (POLM, Accession XM_165867) is another VGAM1965 host target gene. POLM BINDING SITE is HOST TARGET binding site found in the 3' untranslated region of mRNA encoded by POLM, corresponding to a HOST TARGET binding site such as BINDING SITE I, BINDING SITE II or BINDING SITE III. Table 2 illustrates the complementarity of the nucleotide sequences of POLM BINDING SITE, designated SEQ ID:43785, to the nucleotide sequence of VGAM1965 RNA, herein designated VGAM RNA, also designated SEQ ID:4676.

Another function of VGAM1965 is therefore inhibition of Polymerase (DNA directed), Mu (POLM, Accession XM_165867). Accordingly, utilities of VGAM1965 include diagnosis, prevention and treatment of diseases and clinical conditions associated with POLM. PP1057 (Accession NM_031285) is another VGAM1965 host target gene. PP1057 BINDING SITE is HOST TARGET binding site found in the 3' untranslated region of mRNA encoded by PP1057, corresponding to a HOST TARGET binding site such as BINDING SITE I, BINDING SITE II or BINDING SITE III. Table 2 illustrates the complementarity of the nucleotide sequences of PP1057 BINDING SITE, designated SEQ ID:25312, to the nucleotide sequence of VGAM1965 RNA, herein designated VGAM RNA, also designated SEQ ID:4676.

Another function of VGAM1965 is therefore inhibition of PP1057 (Accession NM_031285). Accordingly, utilities of VGAM1965 include diagnosis, prevention and treatment of diseases and clinical conditions associated with PP1057. Protein Tyrosine Phosphatase, Receptor Type, F Polypeptide (PTPRF), Interacting Protein (liprin), Alpha 4 (PPFIA4, Accession XM_046751) is another VGAM1965 host target gene. PPFIA4 BINDING SITE is HOST TARGET binding site found in the 3' untranslated region of mRNA encoded by PPFIA4, corresponding to a HOST TARGET binding site such as BINDING SITE I, BINDING SITE II or BINDING SITE III. Table 2 illustrates the complementarity of the nucleotide sequences of PPFIA4 BINDING SITE, designated SEQ ID:34820, to the nucleotide sequence of VGAM1965 RNA, herein designated VGAM RNA, also designated SEQ ID:4676.

Another function of VGAM1965 is therefore inhibition of Protein Tyrosine Phosphatase, Receptor Type, F Polypeptide (PTPRF), Interacting Protein (liprin), Alpha 4 (PPFIA4, Accession XM_046751). Accordingly, utilities of VGAM1965 include diagnosis, prevention and treatment of diseases and clinical conditions associated with PPFIA4. PPI5PIV (Accession NM_019892) is another VGAM1965 host target gene. PPI5PIV BINDING SITE is HOST TARGET binding site found in the 3' untranslated region of mRNA encoded by PPI5PIV, corresponding to a HOST TARGET binding site such as BINDING SITE I, BINDING SITE II or BINDING SITE III. Table 2 illustrates the complementarity of the nucleotide sequences of PPI5PIV BINDING SITE, designated SEQ ID:21279, to the nucleotide sequence of VGAM1965 RNA, herein designated VGAM RNA, also designated SEQ ID:4676.

Another function of VGAM1965 is therefore inhibition of PPI5PIV (Accession NM_019892). Accordingly, utilities of VGAM1965 include diagnosis, prevention and treatment of diseases and clinical conditions associated with PPI5PIV. Protein Phosphatase 4, Regulatory Subunit 1-like (PPP4R1L, Accession XM_086650) is another VGAM1965 host target gene. PPP4R1L BINDING SITE is HOST TARGET binding site found in the 5' untranslated region of mRNA encoded by PPP4R1L, corresponding to a HOST TARGET binding site such as BINDING SITE I, BINDING SITE II or BINDING SITE III. Table 2 illustrates the complementarity of the nucleotide sequences of PPP4R1L BINDING SITE, designated SEQ ID:38818, to the nucleotide sequence of VGAM1965 RNA, herein designated VGAM RNA, also designated SEQ ID:4676.

Another function of VGAM1965 is therefore inhibition of Protein Phosphatase 4, Regulatory Subunit 1-like (PPP4R1L, Accession XM_086650). Accordingly, utilities of VGAM1965 include diagnosis, prevention and treatment of diseases and clinical conditions associated with PPP4R1L. PRO0233 (Accession NM_014121) is another VGAM1965 host target gene. PRO0233 BINDING SITE is HOST TARGET binding site found in the 5' untranslated region of mRNA encoded by PRO0233, corresponding to a HOST TARGET binding site such as BINDING SITE I, BINDING SITE II or BINDING SITE III. Table 2 illustrates the complementarity of the nucleotide sequences of PRO0233 BINDING SITE, designated SEQ ID:15375, to the nucleotide sequence of VGAM1965 RNA, herein designated VGAM RNA, also designated SEQ ID:4676.

Another function of VGAM1965 is therefore inhibition of PRO0233 (Accession NM_014121). Accordingly, utilities of VGAM1965 include diagnosis, prevention and treatment of diseases and clinical conditions associated with PRO0233. PRO0245 (Accession NM_014122) is another VGAM1965 host target gene. PRO0245 BINDING SITE is HOST TARGET binding site found in the 5' untranslated region of mRNA encoded by PRO0245, corresponding to a HOST TARGET binding site such as BINDING SITE I, BINDING SITE II or BINDING SITE III. Table 2 illustrates the complementarity of the nucleotide sequences of PRO0245 BINDING SITE, designated SEQ ID:15378, to the nucleotide sequence of VGAM1965 RNA, herein designated VGAM RNA, also designated SEQ ID:4676.

Another function of VGAM1965 is therefore inhibition of PRO0245 (Accession NM_014122). Accordingly, utilities of VGAM1965 include diagnosis, prevention and treatment of diseases and clinical conditions associated with PRO0245. PRO0246 (Accession NM_014123) is another VGAM1965 host target gene. PRO0246 BINDING SITE is HOST TARGET binding site found in the 5' untranslated region of mRNA encoded by PRO0246, corresponding to a HOST TARGET binding site such as BINDING SITE I, BINDING SITE II or BINDING SITE III. Table 2 illustrates the complementarity of the nucleotide sequences of PRO0246 BINDING SITE, designated SEQ ID:15380, to the nucleotide sequence of VGAM1965 RNA, herein designated VGAM RNA, also designated SEQ ID:4676.

Another function of VGAM1965 is therefore inhibition of PRO0246 (Accession NM_014123). Accordingly, utilities of VGAM1965 include diagnosis, prevention and treatment of diseases and clinical conditions associated with PRO0246. PRO0456 (Accession NM_014127) is another VGAM1965 host target gene. PRO0456 BINDING SITE is HOST TARGET binding site found in the 3' untranslated region of mRNA encoded by PRO0456, corresponding to a HOST TARGET binding site such as BINDING SITE I, BINDING SITE II or BINDING SITE III. Table 2 illustrates the complementarity of the nucleotide sequences of PRO0456 BINDING SITE, designated SEQ ID:15395, to the nucleotide sequence of VGAM1965 RNA, herein designated VGAM RNA, also designated SEQ ID:4676.

Another function of VGAM1965 is therefore inhibition of PRO0456 (Accession NM_014127). Accordingly, utilities of VGAM1965 include diagnosis, prevention and treatment of diseases and clinical conditions associated with PRO0456. PRO0899 (Accession NM_018565) is another VGAM1965 host target gene. PRO0899 BINDING SITE is HOST TARGET binding site found in the 5' untranslated region of mRNA encoded by PRO0899, corresponding to a HOST TARGET binding site such as BINDING SITE I, BINDING SITE II or BINDING SITE III. Table 2 illustrates the complementarity of the nucleotide sequences of PRO0899 BINDING SITE, designated SEQ ID:20649, to the nucleotide sequence of VGAM1965 RNA, herein designated VGAM RNA, also designated SEQ ID:4676.

Another function of VGAM1965 is therefore inhibition of PRO0899 (Accession NM_018565). Accordingly, utilities of VGAM1965 include diagnosis, prevention and treatment of diseases and clinical conditions associated with PRO0899. PRO1048 (Accession NM_018497) is another VGAM1965 host target gene. PRO1048 BINDING SITE is HOST TARGET binding site found in the 3' untranslated region of mRNA encoded by PRO1048, corresponding to a HOST TARGET binding site such as BINDING SITE I, BINDING SITE II or BINDING SITE III. Table 2 illustrates the complementarity of the nucleotide sequences of PRO1048 BINDING SITE, designated SEQ ID:20558, to the nucleotide sequence of VGAM1965 RNA, herein designated VGAM RNA, also designated SEQ ID:4676.

Another function of VGAM1965 is therefore inhibition of PRO1048 (Accession NM_018497). Accordingly, utilities of VGAM1965 include diagnosis, prevention and treatment of diseases and clinical conditions associated with PRO1048. PRO1866 (Accession NM_018510) is another VGAM1965 host target gene. PRO1866 BINDING SITE is HOST TARGET binding site found in the 5' untranslated region of mRNA encoded by PRO1866, corresponding to a HOST TARGET binding site such as BINDING SITE I, BINDING SITE II or BINDING SITE III. Table 2 illustrates the complementarity of the nucleotide sequences of PRO1866 BINDING SITE, designated SEQ ID:20581, to the nucleotide sequence of VGAM1965 RNA, herein designated VGAM RNA, also designated SEQ ID:4676.

Another function of VGAM1965 is therefore inhibition of PRO1866 (Accession NM_018510). Accordingly, utilities of VGAM1965 include diagnosis, prevention and treatment of diseases and clinical conditions associated with PRO1866. PRO2198 (Accession NM_018621) is another VGAM1965 host target gene. PRO2198 BINDING SITE1 and PRO2198 BINDING SITE2 are HOST TARGET binding sites found in untranslated regions of mRNA encoded by PRO2198, corresponding to HOST TARGET binding sites such as BINDING SITE I, BINDING SITE II or BINDING SITE III. Table 2 illustrates the complementarity of the nucleotide sequences of PRO2198 BINDING SITE1 and PRO2198 BINDING SITE2, designated SEQ ID:20696 and SEQ ID:20697 respectively, to the nucleotide sequence of VGAM1965 RNA, herein designated VGAM RNA, also designated SEQ ID:4676.

Another function of VGAM1965 is therefore inhibition of PRO2198 (Accession NM_018621). Accordingly, utilities of VGAM1965 include diagnosis, prevention and treatment of diseases and clinical conditions associated with PRO2198. PRO2859 (Accession NM_018543) is another VGAM1965 host target gene. PRO2859 BINDING SITE1 and PRO2859

BINDING SITE2 are HOST TARGET binding sites found in untranslated regions of mRNA encoded by PRO2859, corresponding to HOST TARGET binding sites such as BINDING SITE I, BINDING SITE II or BINDING SITE III. Table 2 illustrates the complementarity of the nucleotide sequences of PRO2859 BINDING SITE1 and PRO2859 BINDING SITE2, designated SEQ ID:20614 and SEQ ID:20632 respectively, to the nucleotide sequence of VGAM1965 RNA, herein designated VGAM RNA, also designated SEQ ID:4676.

Another function of VGAM1965 is therefore inhibition of PRO2859 (Accession NM_018543). Accordingly, utilities of VGAM1965 include diagnosis, prevention and treatment of diseases and clinical conditions associated with PRO2859. Proline-serine-threonine Phosphatase Interacting Protein 2 (PSTPIP2, Accession NM_024430) is another VGAM1965 host target gene. PSTPIP2 BINDING SITE is HOST TARGET binding site found in the 3' untranslated region of mRNA encoded by PSTPIP2, corresponding to a HOST TARGET binding site such as BINDING SITE I, BINDING SITE II or BINDING SITE III. Table 2 illustrates the complementarity of the nucleotide sequences of PSTPIP2 BINDING SITE, designated SEQ ID:23682, to the nucleotide sequence of VGAM1965 RNA, herein designated VGAM RNA, also designated SEQ ID:4676.

Another function of VGAM1965 is therefore inhibition of Proline-serine-threonine Phosphatase Interacting Protein 2 (PSTPIP2, Accession NM_024430). Accordingly, utilities of VGAM1965 include diagnosis, prevention and treatment of diseases and clinical conditions associated with PSTPIP2. Quiescin Q6 (QSCN6, Accession NM_002826) is another VGAM1965 host target gene. QSCN6 BINDING SITE is HOST TARGET binding site found in the 3' untranslated region of mRNA encoded by QSCN6, corresponding to a HOST TARGET binding site such as BINDING SITE I, BINDING SITE II or BINDING SITE III. Table 2 illustrates the complementarity of the nucleotide sequences of QSCN6 BINDING SITE, designated SEQ ID:8700, to the nucleotide sequence of VGAM1965 RNA, herein designated VGAM RNA, also designated SEQ ID:4676.

Another function of VGAM1965 is therefore inhibition of Quiescin Q6 (QSCN6, Accession NM_002826). Accordingly, utilities of VGAM1965 include diagnosis, prevention and treatment of diseases and clinical conditions associated with QSCN6. RA-GEF-2 (Accession NM_016340) is another VGAM1965 host target gene. RA-GEF-2 BINDING SITE is HOST TARGET binding site found in the 3' untranslated region of mRNA encoded by RA-GEF-2, corresponding to a HOST TARGET binding site such as BINDING SITE I, BINDING SITE II or BINDING SITE III. Table 2 illustrates the complementarity of the nucleotide sequences of RA-GEF-2 BINDING SITE, designated SEQ ID:18468, to the nucleotide sequence of VGAM1965 RNA, herein designated VGAM RNA, also designated SEQ ID:4676.

Another function of VGAM1965 is therefore inhibition of RA-GEF-2 (Accession NM_016340). Accordingly, utilities of VGAM1965 include diagnosis, prevention and treatment of diseases and clinical conditions associated with RA-GEF-2. RAB17, Member RAS Oncogene Family (RAB17, Accession NM_022449) is another VGAM1965 host target gene. RAB17 BINDING SITE is HOST TARGET binding site found in the 3' untranslated region of mRNA encoded by RAB17, corresponding to a HOST TARGET binding site such as BINDING SITE I, BINDING SITE II or BINDING SITE III. Table 2 illustrates the complementarity of the nucleotide sequences of RAB17 BINDING SITE, designated SEQ ID:22788, to the nucleotide sequence of VGAM1965 RNA, herein designated VGAM RNA, also designated SEQ ID:4676.

Another function of VGAM1965 is therefore inhibition of RAB17, Member RAS Oncogene Family (RAB17, Accession NM_022449). Accordingly, utilities of VGAM1965 include diagnosis, prevention and treatment of diseases and clinical conditions associated with RAB17. RAB33B, Member RAS Oncogene Family (RAB33B, Accession NM_031296) is another VGAM1965 host target gene. RAB33B BINDING SITE is HOST TARGET binding site found in the 3' untranslated region of mRNA encoded by RAB33B, corresponding to a HOST TARGET binding site such as BINDING SITE I, BINDING SITE II or BINDING SITE III. Table 2 illustrates the complementarity of the nucleotide sequences of RAB33B BINDING SITE, designated SEQ ID:25333, to the nucleotide sequence of VGAM1965 RNA, herein designated VGAM RNA, also designated SEQ ID:4676.

Another function of VGAM1965 is therefore inhibition of RAB33B, Member RAS Oncogene Family (RAB33B, Accession NM_031296). Accordingly, utilities of VGAM1965 include diagnosis, prevention and treatment of diseases and clinical conditions associated with RAB33B. RAB35, Member RAS Oncogene Family (RAB35, Accession NM_006861) is another VGAM1965 host target gene. RAB35 BINDING SITE is HOST TARGET binding site found in the 3' untranslated region of mRNA encoded by RAB35, corresponding to a HOST TARGET binding site such as BINDING SITE I, BINDING SITE II or BINDING SITE III. Table 2 illustrates the complementarity of the nucleotide sequences of RAB35 BINDING SITE, designated SEQ ID:13734, to the nucleotide sequence of VGAM1965 RNA, herein designated VGAM RNA, also designated SEQ ID:4676.

Another function of VGAM1965 is therefore inhibition of RAB35, Member RAS Oncogene Family (RAB35, Accession NM_006861). Accordingly, utilities of VGAM1965 include diagnosis, prevention and treatment of diseases and clinical conditions associated with RAB35. Rabip4R (Accession NM_017987) is another VGAM1965 host target gene. Rabip4R BINDING SITE is HOST TARGET binding site found in the 3' untranslated region of mRNA encoded by Rabip4R, corresponding to a HOST TARGET binding site such as BINDING SITE I, BINDING SITE II or BINDING SITE III. Table 2 illustrates the complementarity of the nucleotide sequences of Rabip4R BINDING SITE, designated SEQ ID:19718, to the nucleotide sequence of VGAM1965 RNA, herein designated VGAM RNA, also designated SEQ ID:4676.

Another function of VGAM1965 is therefore inhibition of Rabip4R (Accession NM_017987). Accordingly, utilities of VGAM1965 include diagnosis, prevention and treatment of diseases and clinical conditions associated with Rabip4R. RAN, Member RAS Oncogene Family (RAN, Accession NM_006325) is another VGAM1965 host target gene. RAN BINDING SITE1 and RAN BINDING SITE2 are HOST TARGET binding sites found in untranslated regions of mRNA encoded by RAN, corresponding to HOST TARGET binding sites such as BINDING SITE I, BINDING SITE II or BINDING SITE III. Table 2 illustrates the complementarity of the nucleotide sequences of RAN BINDING SITE1 and RAN BINDING SITE2, designated SEQ ID:13019 and SEQ ID:13018 respectively, to the nucleotide sequence of VGAM1965 RNA, herein designated VGAM RNA, also designated SEQ ID:4676.

Another function of VGAM1965 is therefore inhibition of RAN, Member RAS Oncogene Family (RAN, Accession NM_006325). Accordingly, utilities of VGAM1965 include diagnosis, prevention and treatment of diseases and clinical conditions associated with RAN. RAN Binding Protein 6 (RANBP6, Accession XM_029423) is another VGAM1965 host target gene. RANBP6 BINDING SITE1 and RANBP6 BINDING SITE2 are HOST TARGET binding sites found in untranslated regions of mRNA encoded by RANBP6, corresponding to HOST TARGET binding sites such as BINDING SITE I, BINDING SITE II or BINDING SITE III. Table 2 illustrates the complementarity of the nucleotide sequences of RANBP6 BINDING SITE1 and RANBP6 BINDING SITE2, designated SEQ ID:30886 and SEQ ID:16396 respectively, to the nucleotide sequence of VGAM1965 RNA, herein designated VGAM RNA, also designated SEQ ID:4676.

Another function of VGAM1965 is therefore inhibition of RAN Binding Protein 6 (RANBP6, Accession XM_029423). Accordingly, utilities of VGAM1965 include diagnosis, prevention and treatment of diseases and clinical conditions associated with RANBP6. Rpo1-2 (Accession NM_032212) is another VGAM1965 host target gene. Rpo1-2 BINDING SITE is HOST TARGET binding site found in the 3' untranslated region of mRNA encoded by Rpo1-2, corresponding to a HOST TARGET binding site such as BINDING SITE I, BINDING SITE II or BINDING SITE III. Table 2 illustrates the complementarity of the nucleotide sequences of Rpo1-2 BINDING SITE, designated SEQ ID:25937, to the nucleotide sequence of VGAM1965 RNA, herein designated VGAM RNA, also designated SEQ ID:4676.

Another function of VGAM1965 is therefore inhibition of Rpo1-2 (Accession NM_032212). Accordingly, utilities of VGAM1965 include diagnosis, prevention and treatment of diseases and clinical conditions associated with Rpo1-2. RYK Receptor-like Tyrosine Kinase (RYK, Accession XM_093692) is another VGAM1965 host target gene. RYK BINDING SITE is HOST TARGET binding site found in the 3' untranslated region of mRNA encoded by RYK, corresponding to a HOST TARGET binding site such as BINDING SITE I, BINDING SITE II or BINDING SITE III. Table 2 illustrates the complementarity of the nucleotide sequences of RYK BINDING SITE, designated SEQ ID:40206, to the nucleotide sequence of VGAM1965 RNA, herein designated VGAM RNA, also designated SEQ ID:4676.

Another function of VGAM1965 is therefore inhibition of RYK Receptor-like Tyrosine Kinase (RYK, Accession XM_093692). Accordingly, utilities of VGAM1965 include diagnosis, prevention and treatment of diseases and clinical conditions associated with RYK. SBB103 (Accession NM_005785) is another VGAM1965 host target gene. SBB103 BINDING SITE is HOST TARGET binding site found in the 3' untranslated region of mRNA encoded by SBB103, corresponding to a HOST TARGET binding site such as BINDING SITE I, BINDING SITE II or BINDING SITE III. Table 2 illustrates the complementarity of the nucleotide sequences of SBB103 BINDING SITE, designated SEQ ID:12367, to the nucleotide sequence of VGAM1965 RNA, herein designated VGAM RNA, also designated SEQ ID:4676.

Another function of VGAM1965 is therefore inhibition of SBB103 (Accession NM_005785). Accordingly, utilities of VGAM1965 include diagnosis, prevention and treatment of diseases and clinical conditions associated with SBB103. SC65 (Accession NM_006455) is another VGAM1965 host target gene. SC65 BINDING SITE is HOST TARGET binding site found in the 3' untranslated region of mRNA encoded by SC65, corresponding to a HOST TARGET binding site such as BINDING SITE I, BINDING SITE II or BINDING SITE III. Table 2 illustrates the complementarity of the nucleotide sequences of SC65 BINDING SITE, designated SEQ ID:13175, to the nucleotide sequence of VGAM1965 RNA, herein designated VGAM RNA, also designated SEQ ID:4676.

Another function of VGAM1965 is therefore inhibition of SC65 (Accession NM_006455). Accordingly, utilities of VGAM1965 include diagnosis, prevention and treatment of diseases and clinical conditions associated with SC65. SCAMP5 (Accession NM_138967) is another VGAM1965 host target gene. SCAMP5 BINDING SITE is HOST TARGET binding site found in the 3' untranslated region of mRNA encoded by SCAMP5, corresponding to a HOST TARGET binding site such as BINDING SITE I, BINDING SITE II or BINDING SITE III. Table 2 illustrates the complementarity of the nucleotide sequences of SCAMP5 BINDING SITE, designated SEQ ID:29078, to the nucleotide sequence of VGAM1965 RNA, herein designated VGAM RNA, also designated SEQ ID:4676.

Another function of VGAM1965 is therefore inhibition of SCAMP5 (Accession NM_138967). Accordingly, utilities of VGAM1965 include diagnosis, prevention and treatment of diseases and clinical conditions associated with SCAMP5. SCYA5 (Accession NM_002985) is another VGAM1965 host target gene. SCYA5 BINDING SITE is HOST TARGET binding site found in the 3' untranslated region of mRNA encoded by SCYA5, corresponding to a HOST TARGET binding site such as BINDING SITE I, BINDING SITE II or BINDING SITE III. Table 2 illustrates the complementarity of the nucleotide sequences of SCYA5 BINDING SITE, designated SEQ ID:8883, to the nucleotide sequence of VGAM1965 RNA, herein designated VGAM RNA, also designated SEQ ID:4676.

Another function of VGAM1965 is therefore inhibition of SCYA5 (Accession NM_002985). Accordingly, utilities of VGAM1965 include diagnosis, prevention and treatment of diseases and clinical conditions associated with SCYA5. Serologically Defined Colon Cancer Antigen 3 (SDCCAG3, Accession NM_006643) is another VGAM1965 host target gene. SDCCAG3 BINDING SITE is HOST TARGET binding site found in the 3' untranslated region of mRNA encoded by SDCCAG3, corresponding to a HOST TARGET binding site such as BINDING SITE I, BINDING SITE II or BINDING SITE III. Table 2 illustrates the complementarity of the nucleotide sequences of SDCCAG3 BINDING SITE, designated SEQ ID:13437, to the nucleotide sequence of VGAM1965 RNA, herein designated VGAM RNA, also designated SEQ ID:4676.

Another function of VGAM1965 is therefore inhibition of Serologically Defined Colon Cancer Antigen 3 (SDCCAG3, Accession NM_006643). Accordingly, utilities of VGAM1965 include diagnosis, prevention and treatment of diseases and clinical conditions associated with SDCCAG3. SE57-1 (Accession NM_025214) is another VGAM1965 host target gene. SE57-1 BINDING SITE is HOST TARGET binding site found in the 3' untranslated region of mRNA encoded by SE57-1, corresponding to a HOST TARGET binding site such as BINDING SITE I, BINDING SITE II or BINDING SITE III. Table 2 illustrates the complementarity of the nucleotide sequences of SE57-1 BINDING SITE, designated SEQ ID:24893, to the nucleotide sequence of VGAM1965 RNA, herein designated VGAM RNA, also designated SEQ ID:4676.

Another function of VGAM1965 is therefore inhibition of SE57-1 (Accession NM_025214). Accordingly, utilities of VGAM1965 include diagnosis, prevention and treatment of diseases and clinical conditions associated with SE57-1.

SEC24 Related Gene Family, Member A (S. cerevisiae) (SEC24A, Accession XM_094581) is another VGAM1965 host target gene. SEC24A BINDING SITE is HOST TARGET binding site found in the 3' untranslated region of mRNA encoded by SEC24A, corresponding to a HOST TARGET binding site such as BINDING SITE I, BINDING SITE II or BINDING SITE III. Table 2 illustrates the complementarity of the nucleotide sequences of SEC24A BINDING SITE, designated SEQ ID:40231, to the nucleotide sequence of VGAM1965 RNA, herein designated VGAM RNA, also designated SEQ ID:4676.

Another function of VGAM1965 is therefore inhibition of SEC24 Related Gene Family, Member A (S. cerevisiae) (SEC24A, Accession XM_094581). Accordingly, utilities of VGAM1965 include diagnosis, prevention and treatment of diseases and clinical conditions associated with SEC24A. Sema Domain, Immunoglobulin Domain (Ig), Short Basic Domain, Secreted, (semaphorin) 3E (SEMA3E, Accession NM_012431) is another VGAM1965 host target gene. SEMA3E BINDING SITE is HOST TARGET binding site found in the 3" untranslated region of mRNA encoded by SEMA3E, corresponding to a HOST TARGET binding site such as BINDING SITE I, BINDING SITE II or BINDING SITE III. Table 2 illustrates the complementarity of the nucleotide sequences of SEMA3E BINDING SITE, designated SEQ ID:14810, to the nucleotide sequence of VGAM1965 RNA, herein designated VGAM RNA, also designated SEQ ID:4676.

Another function of VGAM1965 is therefore inhibition of Sema Domain, Immunoglobulin Domain (Ig), Short Basic Domain, Secreted, (semaphorin) 3E (SEMA3E, Accession NM_012431). Accordingly, utilities of VGAM1965 include diagnosis, prevention and treatment of diseases and clinical conditions associated with SEMA3E. Sema Domain, Immunoglobulin Domain (Ig), Transmembrane Domain (TM) and Short Cytoplasmic Domain, (semaphorin) 4B (SEMA4B, Accession XM_044533) is another VGAM1965 host target gene. SEMA4B BINDING SITE is HOST TARGET binding site found in the 3' untranslated region of mRNA encoded by SEMA4B, corresponding to a HOST TARGET binding site such as BINDING SITE I, BINDING SITE II or BINDING SITE III. Table 2 illustrates the complementarity of the nucleotide sequences of SEMA4B BINDING SITE, designated SEQ ID:34224, to the nucleotide sequence of VGAM1965 RNA, herein designated VGAM RNA, also designated SEQ ID:4676.

Another function of VGAM1965 is therefore inhibition of Sema Domain, Immunoglobulin Domain (Ig), Transmembrane Domain (TM) and Short Cytoplasmic Domain, (semaphorin) 4B (SEMA4B, Accession XM_044533). Accordingly, utilities of VGAM1965 include diagnosis, prevention and treatment of diseases and clinical conditions associated with SEMA4B. Sema Domain, Immunoglobulin Domain (Ig), Transmembrane Domain (TM) and Short Cytoplasmic Domain, (semaphorin) 4G (SEMA4G, Accession XM_170638) is another VGAM1965 host target gene. SEMA4G BINDING SITE is HOST TARGET binding site found in the 5" untranslated region of mRNA encoded by SEMA4G, corresponding to a HOST TARGET binding site such as BINDING SITE I, BINDING SITE II or BINDING SITE III. Table 2 illustrates the complementarity of the nucleotide sequences of SEMA4G BINDING SITE, designated SEQ ID:45415, to the nucleotide sequence of VGAM1965 RNA, herein designated VGAM RNA, also designated SEQ ID:4676.

Another function of VGAM1965 is therefore inhibition of Sema Domain, Immunoglobulin Domain (Ig), Transmembrane Domain (TM) and Short Cytoplasmic Domain, (semaphorin) 4G (SEMA4G, Accession XM_170638). Accordingly, utilities of VGAM1965 include diagnosis, prevention and treatment of diseases and clinical conditions associated with SEMA4G. Serine (or cysteine) Proteinase Inhibitor, Clade B (ovalbumin), Member 7 (SERPINB7, Accession NM_003784) is another VGAM1965 host target gene. SERPINB7 BINDING SITE is HOST TARGET binding site found in the 3' untranslated region of mRNA encoded by SERPINB7, corresponding to a HOST TARGET binding site such as BINDING SITE I, BINDING SITE II or BINDING SITE III. Table 2 illustrates the complementarity of the nucleotide sequences of SERPINB7 BINDING SITE, designated SEQ ID:9874, to the nucleotide sequence of VGAM1965 RNA, herein designated VGAM RNA, also designated SEQ ID:4676.

Another function of VGAM1965 is therefore inhibition of Serine (or cysteine) Proteinase Inhibitor, Clade B (ovalbumin), Member 7 (SERPINB7, Accession NM_003784). Accordingly, utilities of VGAM1965 include diagnosis, prevention and treatment of diseases and clinical conditions associated with SERPINB7. Sideroflexin 5 (SFXN5, Accession NM_144579) is another VGAM1965 host target gene. SFXN5 BINDING SITE is HOST TARGET binding site found in the 3' untranslated region of mRNA encoded by SFXN5, corresponding to a HOST TARGET binding site such as BINDING SITE I, BINDING SITE II or BINDING SITE III. Table 2 illustrates the complementarity of the nucleotide sequences of SFXN5 BINDING SITE, designated SEQ ID:29385, to the nucleotide sequence of VGAM1965 RNA, herein designated VGAM RNA, also designated SEQ ID:4676.

Another function of VGAM1965 is therefore inhibition of Sideroflexin 5 (SFXN5, Accession NM_144579). Accordingly, utilities of VGAM1965 include diagnosis, prevention and treatment of diseases and clinical conditions associated with SFXN5. Sialyltransferase 9 (CMP-NeuAc:lactosylceramide alpha-2,3-sialyl transferase; GM3 synthase) (SIAT9, Accession NM_003896) is another VGAM1965 host target gene. SIAT9 BINDING SITE is HOST TARGET binding site found in the 5' untranslated region of mRNA encoded by SIAT9, corresponding to a HOST TARGET binding site such as BINDING SITE I, BINDING SITE II or BINDING SITE III. Table 2 illustrates the complementarity of the nucleotide sequences of SIAT9 BINDING SITE, designated SEQ ID:9978, to the nucleotide sequence of VGAM1965 RNA, herein designated VGAM RNA, also designated SEQ ID:4676.

Another function of VGAM1965 is therefore inhibition of Sialyltransferase 9 (CMP-NeuAc:lactosylceramide alpha-2,3-sialyl transferase; GM3 synthase) (SIAT9, Accession NM_003896). Accordingly, utilities of VGAM1965 include diagnosis, prevention and treatment of diseases and clinical conditions associated with SIAT9. SIMRP7 (Accession XM_166462) is another VGAM1965 host target gene. SIMRP7 BINDING SITE is HOST TARGET binding site found in the 3' untranslated region of mRNA encoded by SIMRP7, corresponding to a HOST TARGET binding site such as BINDING SITE I, BINDING SITE II or BINDING SITE III. Table 2 illustrates the complementarity of the nucleotide sequences of SIMRP7 BINDING SITE, designated SEQ ID:44374, to the nucleotide sequence of VGAM1965 RNA, herein designated VGAM RNA, also designated SEQ ID:4676.

Another function of VGAM1965 is therefore inhibition of SIMRP7 (Accession XM_166462). Accordingly, utilities of VGAM1965 include diagnosis, prevention and treatment of diseases and clinical conditions associated with SIMRP7. Signal-regulatory Protein Beta 1 (SIRPB1, Accession NM_006065) is another VGAM1965 host target gene. SIRPB1 BINDING SITE is HOST TARGET binding site found in the 3' untranslated region of mRNA encoded by SIRPB1, corresponding to a HOST TARGET binding site such as BINDING SITE I, BINDING SITE II or BINDING SITE III. Table 2 illustrates the complementarity of the nucleotide sequences of SIRPB1 BINDING SITE, designated SEQ ID:12709, to the nucleotide sequence of VGAM1965 RNA, herein designated VGAM RNA, also designated SEQ ID:4676.

Another function of VGAM1965 is therefore inhibition of Signal-regulatory Protein Beta 1 (SIRPB1, Accession NM_006065). Accordingly, utilities of VGAM1965 include diagnosis, prevention and treatment of diseases and clinical conditions associated with SIRPB1. Solute Carrier Family 7, (cationic amino acid transporter, y+ system) Member 11 (SLC7A11, Accession NM_014331) is another VGAM1965 host target gene. SLC7A11 BINDING SITE is HOST TARGET binding site found in the 3" untranslated region of mRNA encoded by SLC7A11, corresponding to a HOST TARGET binding site such as BINDING SITE I, BINDING SITE II or BINDING SITE III. Table 2 illustrates the complementarity of the nucleotide sequences of SLC7A11 BINDING SITE, designated SEQ ID:15644, to the nucleotide sequence of VGAM1965 RNA, herein designated VGAM RNA, also designated SEQ ID:4676.

Another function of VGAM1965 is therefore inhibition of Solute Carrier Family 7, (cationic amino acid transporter, y+ system) Member 11 (SLC7A11, Accession NM_014331). Accordingly, utilities of VGAM1965 include diagnosis, prevention and treatment of diseases and clinical conditions associated with SLC7A11. SNF1 Sucrose Nonfermenting Like Kinase (yeast) (SLK, Accession NM_014720) is another VGAM1965 host target gene. SLK BINDING SITE is HOST TARGET binding site found in the 3" untranslated region of mRNA encoded by SLK, corresponding to a HOST TARGET binding site such as BINDING SITE I, BINDING SITE II or BINDING SITE III. Table 2 illustrates the complementarity of the nucleotide sequences of SLK BINDING SITE, designated SEQ ID:16280, to the nucleotide sequence of VGAM1965 RNA, herein designated VGAM RNA, also designated SEQ ID:4676.

Another function of VGAM1965 is therefore inhibition of SNF1 Sucrose Nonfermenting Like Kinase (yeast) (SLK, Accession NM_014720). Accordingly, utilities of VGAM1965 include diagnosis, prevention and treatment of diseases and clinical conditions associated with SLK. Small Nuclear RNA Activating Complex, Polypeptide 1, 43 kDa (SNAPC1, Accession NM_003082) is another VGAM1965 host target gene. SNAPC1 BINDING SITE is HOST TARGET binding site found in the 3' untranslated region of mRNA encoded by SNAPC1, corresponding to a HOST TARGET binding site such as BINDING SITE I, BINDING SITE II or BINDING SITE III. Table 2 illustrates the complementarity of the nucleotide sequences of SNAPC1 BINDING SITE, designated SEQ ID:9057, to the nucleotide sequence of VGAM1965 RNA, herein designated VGAM RNA, also designated SEQ ID:4676.

Another function of VGAM1965 is therefore inhibition of Small Nuclear RNA Activating Complex, Polypeptide 1, 43 kDa (SNAPC1, Accession NM_003082). Accordingly, utilities of VGAM1965 include diagnosis, prevention and treatment of diseases and clinical conditions associated with SNAPC1. SP192 (Accession NM_021639) is another VGAM1965 host target gene. SP192 BINDING SITE is HOST TARGET binding site found in the 5' untranslated region of mRNA encoded by SP192, corresponding to a HOST TARGET binding site such as BINDING SITE I, BINDING SITE II or BINDING SITE III. Table 2 illustrates the complementarity of the nucleotide sequences of SP192 BINDING SITE, designated SEQ ID:22297, to the nucleotide sequence of VGAM1965 RNA, herein designated VGAM RNA, also designated SEQ ID:4676.

Another function of VGAM1965 is therefore inhibition of SP192 (Accession NM_021639). Accordingly, utilities of VGAM1965 include diagnosis, prevention and treatment of diseases and clinical conditions associated with SP192. SPEC1 (Accession NM_020239) is another VGAM1965 host target gene. SPEC1 BINDING SITE is HOST TARGET binding site found in the 3' untranslated region of mRNA encoded by SPEC1, corresponding to a HOST TARGET binding site such as BINDING SITE I, BINDING SITE II or BINDING SITE III. Table 2 illustrates the complementarity of the nucleotide sequences of SPEC1 BINDING SITE, designated SEQ ID:21515, to the nucleotide sequence of VGAM1965 RNA, herein designated VGAM RNA, also designated SEQ ID:4676.

Another function of VGAM1965 is therefore inhibition of SPEC1 (Accession NM_020239). Accordingly, utilities of VGAM1965 include diagnosis, prevention and treatment of diseases and clinical conditions associated with SPEC1. Serine Protease Inhibitor-like, with Kunitz and WAP Domains 1 (eppin) (SPINLW1, Accession NM_020398) is another VGAM1965 host target gene. SPINLW1 BINDING SITE is HOST TARGET binding site found in the 3' untranslated region of mRNA encoded by SPINLW1, corresponding to a HOST TARGET binding site such as BINDING SITE I, BINDING SITE II or BINDING SITE III. Table 2 illustrates the complementarity of the nucleotide sequences of SPINLW1 BINDING SITE, designated SEQ ID:21667, to the nucleotide sequence of VGAM1965 RNA, herein designated VGAM RNA, also designated SEQ ID:4676.

Another function of VGAM1965 is therefore inhibition of Serine Protease Inhibitor-like, with Kunitz and WAP Domains 1 (eppin) (SPINLW1, Accession NM_020398). Accordingly, utilities of VGAM1965 include diagnosis, prevention and treatment of diseases and clinical conditions associated with SPINLW1. SSH2 (Accession XM_030846) is another VGAM1965 host target gene. SSH2 BINDING SITE1 and SSH2 BINDING SITE2 are HOST TARGET binding sites found in untranslated regions of mRNA encoded by SSH2, corresponding to HOST TARGET binding sites such as BINDING SITE I, BINDING SITE II or BINDING SITE III. Table 2 illustrates the complementarity of the nucleotide sequences of SSH2 BINDING SITE1 and SSH2 BINDING SITE2, designated SEQ ID:31188 and SEQ ID:31186 respectively, to the nucleotide sequence of VGAM1965 RNA, herein designated VGAM RNA, also designated SEQ ID:4676.

Another function of VGAM1965 is therefore inhibition of SSH2 (Accession XM_030846). Accordingly, utilities of VGAM1965 include diagnosis, prevention and treatment of diseases and clinical conditions associated with SSH2. Stathmin-like 3 (STMN3, Accession NM_015894) is another VGAM1965 host target gene. STMN3 BINDING SITE is HOST TARGET binding site found in the 3' untranslated region of mRNA encoded by STMN3, corresponding to a HOST TARGET binding site such as BINDING SITE I, BINDING SITE II or BINDING SITE III. Table 2 illustrates the complementarity of the nucleotide sequences of STMN3 BINDING SITE, designated SEQ ID:18041, to the nucleotide sequence of VGAM1965 RNA, herein designated VGAM RNA, also designated SEQ ID:4676.

Another function of VGAM1965 is therefore inhibition of Stathmin-like 3 (STMN3, Accession NM_015894). Accordingly, utilities of VGAM1965 include diagnosis, prevention and treatment of diseases and clinical conditions associated with STMN3. Stomatin (EPB72)-like 1 (STOML1, Accession NM_004809) is another VGAM1965 host target gene. STOML1 BINDING SITE is HOST TARGET binding site found in the 3' untranslated region of mRNA encoded by STOML1, corresponding to a HOST TARGET binding site such as BINDING SITE I, BINDING SITE II or BINDING SITE III. Table 2 illustrates the complementarity of the nucleotide sequences of STOML1 BINDING SITE, designated SEQ ID:11234, to the nucleotide sequence of VGAM1965 RNA, herein designated VGAM RNA, also designated SEQ ID:4676.

Another function of VGAM1965 is therefore inhibition of Stomatin (EPB72)-like 1 (STOML1, Accession NM_004809). Accordingly, utilities of VGAM1965 include diagnosis, prevention and treatment of diseases and clinical conditions associated with STOML1. Suppressor of Ty 4 Homolog 1 (S. cerevisiae) (SUPT4H1, Accession NM_003168) is another VGAM1965 host target gene. SUPT4H1 BINDING SITE is HOST TARGET binding site found in the 3' untranslated region of mRNA encoded by SUPT4H1, corresponding to a HOST TARGET binding site such as BINDING SITE I, BINDING SITE II or BINDING SITE III. Table 2 illustrates the complementarity of the nucleotide sequences of SUPT4H1 BINDING SITE, designated SEQ ID:9146, to the nucleotide sequence of VGAM1965 RNA, herein designated VGAM RNA, also designated SEQ ID:4676.

Another function of VGAM1965 is therefore inhibition of Suppressor of Ty 4 Homolog 1 (S. cerevisiae) (SUPT4H1, Accession NM_003168). Accordingly, utilities of VGAM1965 include diagnosis, prevention and treatment of diseases and clinical conditions associated with SUPT4H1. SV2 (Accession NM_014849) is another VGAM1965 host target gene. SV2 BINDING SITE is HOST TARGET binding site found in the 3' untranslated region of mRNA encoded by SV2, corresponding to a HOST TARGET binding site such as BINDING SITE I, BINDING SITE II or BINDING SITE III. Table 2 illustrates the complementarity of the nucleotide sequences of SV2 BINDING SITE, designated SEQ ID:16886, to the nucleotide sequence of VGAM1965 RNA, herein designated VGAM RNA, also designated SEQ ID:4676.

Another function of VGAM1965 is therefore inhibition of SV2 (Accession NM_014849). Accordingly, utilities of VGAM1965 include diagnosis, prevention and treatment of diseases and clinical conditions associated with SV2. SYNCOILIN (Accession NM_030786) is another VGAM1965 host target gene. SYNCOILIN BINDING SITE is HOST TARGET binding site found in the 3' untranslated region of mRNA encoded by SYNCOILIN, corresponding to a HOST TARGET binding site such as BINDING SITE I, BINDING SITE II or BINDING SITE III. Table 2 illustrates the complementarity of the nucleotide sequences of SYNCOILIN BINDING SITE, designated SEQ ID:25081, to the nucleotide sequence of VGAM1965 RNA, herein designated VGAM RNA, also designated SEQ ID:4676.

Another function of VGAM1965 is therefore inhibition of SYNCOILIN (Accession NM_030786). Accordingly, utilities of VGAM1965 include diagnosis, prevention and treatment of diseases and clinical conditions associated with SYNCOILIN. TAO1 (Accession NM_004783) is another VGAM1965 host target gene. TAO1 BINDING SITE is HOST TARGET binding site found in the 3' untranslated region of mRNA encoded by TAO1, corresponding to a HOST TARGET binding site such as BINDING SITE I, BINDING SITE II or BINDING SITE III. Table 2 illustrates the complementarity of the nucleotide sequences of TAO1 BINDING SITE, designated SEQ ID:11189, to the nucleotide sequence of VGAM1965 RNA, herein designated VGAM RNA, also designated SEQ ID:4676.

Another function of VGAM1965 is therefore inhibition of TAO1 (Accession NM_004783). Accordingly, utilities of VGAM1965 include diagnosis, prevention and treatment of diseases and clinical conditions associated with TAO1. Transducin (beta)-like 1Y-linked (TBL1Y, Accession NM_033284) is another VGAM1965 host target gene. TBL1Y BINDING SITE1 and TBL1Y BINDING SITE2 are HOST TARGET binding sites found in untranslated regions of mRNA encoded by TBL1Y, corresponding to HOST TARGET binding sites such as BINDING SITE I, BINDING SITE II or BINDING SITE III. Table 2 illustrates the complementarity of the nucleotide sequences of TBL1Y BINDING SITE1 and TBL1Y BINDING SITE2, designated SEQ ID:27100 and SEQ ID:28611 respectively, to the nucleotide sequence of VGAM1965 RNA, herein designated VGAM RNA, also designated SEQ ID:4676.

Another function of VGAM1965 is therefore inhibition of Transducin (beta)-like 1Y-linked (TBL1Y, Accession NM_033284). Accordingly, utilities of VGAM1965 include diagnosis, prevention and treatment of diseases and clinical conditions associated with TBL1Y. TERE1 (Accession NM_013319) is another VGAM1965 host target gene. TERE1 BINDING SITE is HOST TARGET binding site found in the 5' untranslated region of mRNA encoded by TERE1, corresponding to a HOST TARGET binding site such as BINDING SITE I, BINDING SITE II or BINDING SITE III. Table 2 illustrates the complementarity of the nucleotide sequences of TERE1 BINDING SITE, designated SEQ ID:14966, to the nucleotide sequence of VGAM1965 RNA, herein designated VGAM RNA, also designated SEQ ID:4676.

Another function of VGAM1965 is therefore inhibition of TERE1 (Accession NM_013319). Accordingly, utilities of VGAM1965 include diagnosis, prevention and treatment of diseases and clinical conditions associated with TERE1. TIP47 (Accession NM_005817) is another VGAM1965 host target gene. TIP47 BINDING SITE is HOST TARGET binding site found in the 3' untranslated region of mRNA encoded by TIP47, corresponding to a HOST TARGET binding site such as BINDING SITE I, BINDING SITE II or BINDING SITE III. Table 2 illustrates the complementarity of the nucleotide sequences of TIP47 BINDING SITE, designated SEQ ID:12418, to the nucleotide sequence of VGAM1965 RNA, herein designated VGAM RNA, also designated SEQ ID:4676.

Another function of VGAM1965 is therefore inhibition of TIP47 (Accession NM_005817). Accordingly, utilities of VGAM1965 include diagnosis, prevention and treatment of diseases and clinical conditions associated with TIP47. Translocase of Outer Mitochondrial Membrane 34 (TOMM34, Accession NM_006809) is another VGAM1965 host target gene. TOMM34 BINDING SITE is HOST TARGET binding site found in the 3' untranslated region of mRNA encoded by TOMM34, corresponding to a HOST TARGET binding site such as BINDING SITE I, BINDING SITE II or BINDING SITE III. Table 2 illustrates the complementarity of the nucleotide sequences of TOMM34 BINDING SITE, designated SEQ ID:13681, to the nucleotide sequence of VGAM1965 RNA, herein designated VGAM RNA, also designated SEQ ID:4676.

Another function of VGAM1965 is therefore inhibition of Translocase of Outer Mitochondrial Membrane 34 (TOMM34, Accession NM_006809). Accordingly, utilities of VGAM1965 include diagnosis, prevention and treatment of diseases and clinical conditions associated with TOMM34. TOPK (Accession NM_018492) is another VGAM1965 host target gene. TOPK BINDING SITE is HOST TARGET binding site found in the 3' untranslated region of mRNA encoded by TOPK, corresponding to a HOST TARGET binding site such as BINDING SITE I, BINDING SITE II or BINDING SITE III. Table 2 illustrates the complementarity of the nucleotide sequences of TOPK BINDING SITE, designated SEQ ID:20553, to the nucleotide sequence of VGAM1965 RNA, herein designated VGAM RNA, also designated SEQ ID:4676.

Another function of VGAM1965 is therefore inhibition of TOPK (Accession NM_018492). Accordingly, utilities of VGAM1965 include diagnosis, prevention and treatment of diseases and clinical conditions associated with TOPK. Tripartite Motif-containing 2 (TRIM2, Accession NM_015271) is another VGAM1965 host target gene. TRIM2 BINDING SITE is HOST TARGET binding site found in the 3' untranslated region of mRNA encoded by TRIM2, corresponding to a HOST TARGET binding site such as BINDING SITE I, BINDING SITE II or BINDING SITE III. Table 2 illustrates the complementarity of the nucleotide sequences of TRIM2 BINDING SITE, designated SEQ ID:17599, to the nucleotide sequence of VGAM1965 RNA, herein designated VGAM RNA, also designated SEQ ID:4676.

Another function of VGAM1965 is therefore inhibition of Tripartite Motif-containing 2 (TRIM2, Accession NM_015271). Accordingly, utilities of VGAM1965 include diagnosis, prevention and treatment of diseases and clinical conditions associated with TRIM2. UBCE7IP5 (Accession NM_014948) is another VGAM1965 host target gene. UBCE7IP5 BINDING SITE is HOST TARGET binding site found in the 3" untranslated region of mRNA encoded by UBCE7IP5, corresponding to a HOST TARGET binding site such as BINDING SITE I, BINDING SITE II or BINDING SITE III. Table 2 illustrates the complementarity of the nucleotide sequences of UBCE7IP5 BINDING SITE, designated SEQ ID:17274, to the nucleotide sequence of VGAM1965 RNA, herein designated VGAM RNA, also designated SEQ ID:4676.

Another function of VGAM1965 is therefore inhibition of UBCE7IP5 (Accession NM_014948). Accordingly, utilities of VGAM1965 include diagnosis, prevention and treatment of diseases and clinical conditions associated with UBCE7IP5. UQCR (Accession NM_006830) is another VGAM1965 host target gene. UQCR BINDING SITE is HOST TARGET binding site found in the 3' untranslated region of mRNA encoded by UQCR, corresponding to a HOST TARGET binding site such as BINDING SITE I, BINDING SITE II or BINDING SITE III. Table 2 illustrates the complementarity of the nucleotide sequences of UQCR BINDING SITE, designated SEQ ID:13712, to the nucleotide sequence of VGAM1965 RNA, herein designated VGAM RNA, also designated SEQ ID:4676.

Another function of VGAM1965 is therefore inhibition of UQCR (Accession NM_006830). Accordingly, utilities of VGAM1965 include diagnosis, prevention and treatment of diseases and clinical conditions associated with UQCR. VIT1 (Accession NM_018693) is another VGAM1965 host target gene. VIT1 BINDING SITE is HOST TARGET binding site found in the 5' untranslated region of mRNA encoded by VIT1, corresponding to a HOST TARGET binding site such as BINDING SITE I, BINDING SITE II or BINDING SITE III. Table 2 illustrates the complementarity of the nucleotide sequences of VIT1 BINDING SITE, designated SEQ ID:20768, to the nucleotide sequence of VGAM1965 RNA, herein designated VGAM RNA, also designated SEQ ID:4676.

Another function of VGAM1965 is therefore inhibition of VIT1 (Accession NM_018693). Accordingly, utilities of VGAM1965 include diagnosis, prevention and treatment of diseases and clinical conditions associated with VIT1. Vacuolar Protein Sorting 4B (yeast) (VPS4B, Accession NM_004869) is another VGAM1965 host target gene. VPS4B BINDING SITE is HOST TARGET binding site found in the 3' untranslated region of mRNA encoded by VPS4B, corresponding to a HOST TARGET binding site such as BINDING SITE I, BINDING SITE II or BINDING SITE III. Table 2 illustrates the complementarity of the nucleotide sequences of VPS4B BINDING SITE, designated SEQ ID:11295, to the nucleotide sequence of VGAM1965 RNA, herein designated VGAM RNA, also designated SEQ ID:4676.

Another function of VGAM1965 is therefore inhibition of Vacuolar Protein Sorting 4B (yeast) (VPS4B, Accession NM_004869). Accordingly, utilities of VGAM1965 include diagnosis, prevention and treatment of diseases and clinical conditions associated with VPS4B. Williams-Beuren Syndrome Chromosome Region 17 (WBSCR17, Accession XM_088168) is another VGAM1965 host target gene. WBSCR17 BINDING SITE is HOST TARGET binding site found in the 3' untranslated region of mRNA encoded by WBSCR17, corresponding to a HOST TARGET binding site such as BINDING SITE I, BINDING SITE II or BINDING SITE III. Table 2 illustrates the complementarity of the nucleotide sequences of WBSCR17 BINDING SITE, designated SEQ ID:39547, to the nucleotide sequence of VGAM1965 RNA, herein designated VGAM RNA, also designated SEQ ID:4676.

Another function of VGAM1965 is therefore inhibition of Williams-Beuren Syndrome Chromosome Region 17 (WBSCR17, Accession XM_088168). Accordingly, utilities of VGAM1965 include diagnosis, prevention and treatment of diseases and clinical conditions associated with WBSCR17. WIT-1 (Accession NM_015855) is another VGAM1965 host target gene. WIT-1 BINDING SITE is HOST TARGET binding site found in the 3' untranslated region of mRNA encoded by WIT-1, corresponding to a HOST TARGET binding site such as BINDING SITE I, BINDING SITE II or BINDING SITE III. Table 2 illustrates the complementarity of the nucleotide sequences of WIT-1 BINDING SITE, designated SEQ ID:17993, to the nucleotide sequence of VGAM1965 RNA, herein designated VGAM RNA, also designated SEQ ID:4676.

Another function of VGAM1965 is therefore inhibition of WIT-1 (Accession NM_015855). Accordingly, utilities of VGAM1965 include diagnosis, prevention and treatment of diseases and clinical conditions associated with WIT-1. WSB1 (Accession NM_134264) is another VGAM1965 host target gene. WSB1 BINDING SITE is HOST TARGET binding site found in the 3' untranslated region of mRNA encoded by WSB1, corresponding to a HOST TARGET binding site such as BINDING SITE I, BINDING SITE II or BINDING SITE III. Table 2 illustrates the complementarity of the nucleotide sequences of WSB1 BINDING SITE, designated SEQ ID:28618, to the nucleotide sequence of VGAM1965 RNA, herein designated VGAM RNA, also designated SEQ ID:4676.

Another function of VGAM1965 is therefore inhibition of WSB1 (Accession NM_134264). Accordingly, utilities of VGAM1965 include diagnosis, prevention and treatment of diseases and clinical conditions associated with WSB1. ZAK (Accession NM_016653) is another VGAM1965 host target gene. ZAK BINDING SITE is HOST TARGET binding site found in the 3' untranslated region of mRNA encoded by ZAK, corresponding to a HOST TARGET binding site such as BINDING SITE I, BINDING SITE II or BINDING SITE III. Table 2 illustrates the complementarity of the nucleotide sequences of ZAK BINDING SITE, designated SEQ ID:18777, to the nucleotide sequence of VGAM1965 RNA, herein designated VGAM RNA, also designated SEQ ID:4676.

Another function of VGAM1965 is therefore inhibition of ZAK (Accession NM_016653). Accordingly, utilities of VGAM1965 include diagnosis, prevention and treatment of diseases and clinical conditions associated with ZAK. Zinc Finger, DHHC Domain Containing 7 (ZDHHC7, Accession NM_017740) is another VGAM1965 host target gene. ZDHHC7 BINDING SITE is HOST TARGET binding site found in the 3' untranslated region of mRNA encoded by ZDHHC7, corresponding to a HOST TARGET binding site such as BINDING SITE I, BINDING SITE II or BINDING SITE III. Table 2 illustrates the complementarity of the nucleotide sequences of ZDHHC7 BINDING SITE, designated SEQ ID:19331, to the nucleotide sequence of VGAM1965 RNA, herein designated VGAM RNA, also designated SEQ ID:4676.

Another function of VGAM1965 is therefore inhibition of Zinc Finger, DHHC Domain Containing 7 (ZDHHC7, Accession NM_017740). Accordingly, utilities of VGAM1965 include diagnosis, prevention and treatment of diseases and clinical conditions associated with ZDHHC7. ZER6 (Accession XM_032742) is another VGAM1965 host target gene. ZER6 BINDING SITE is HOST TARGET binding site found in the 3' untranslated region of mRNA encoded by ZER6, corresponding to a HOST TARGET binding site such as BINDING SITE I, BINDING SITE II or BINDING SITE III. Table 2 illustrates the complementarity of the nucleotide sequences of ZER6 BINDING SITE, designated SEQ ID:31746, to the nucleotide sequence of VGAM1965 RNA, herein designated VGAM RNA, also designated SEQ ID:4676.

Another function of VGAM1965 is therefore inhibition of ZER6 (Accession XM_032742). Accordingly, utilities of VGAM1965 include diagnosis, prevention and treatment of diseases and clinical conditions associated with ZER6. ZID (Accession NM_006626) is another VGAM1965 host target gene. ZID BINDING SITE is HOST TARGET binding site found in the 3' untranslated region of mRNA encoded by ZID, corresponding to a HOST TARGET binding site such as BINDING SITE I, BINDING SITE II or BINDING SITE III. Table 2 illustrates the complementarity of the nucleotide sequences of ZID BINDING SITE, designated SEQ ID:13413, to the nucleotide sequence of VGAM1965 RNA, herein designated VGAM RNA, also designated SEQ ID:4676.

Another function of VGAM1965 is therefore inhibition of ZID (Accession NM_006626). Accordingly, utilities of VGAM1965 include diagnosis, prevention and treatment of diseases and clinical conditions associated with ZID. Zinc Finger Protein 237 (ZNF237, Accession NM_014242) is another VGAM1965 host target gene. ZNF237 BINDING SITE1 and ZNF237 BINDING SITE2 are HOST TARGET binding sites found in untranslated regions of mRNA encoded by ZNF237, corresponding to HOST TARGET binding sites such as BINDING SITE I, BINDING SITE II or BINDING SITE III. Table 2 illustrates the complementarity of the nucleotide sequences of ZNF237 BINDING SITE1 and ZNF237 BINDING SITE2, designated SEQ ID:15506 and SEQ ID:15507 respectively, to the nucleotide sequence of VGAM1965 RNA, herein designated VGAM RNA, also designated SEQ ID:4676.

Another function of VGAM1965 is therefore inhibition of Zinc Finger Protein 237 (ZNF237, Accession NM_014242). Accordingly, utilities of VGAM1965 include diagnosis, prevention and treatment of diseases and clinical conditions associated with ZNF237. Zinc Finger Protein 297B (ZNF297B, Accession NM_014007) is another VGAM1965 host target gene. ZNF297B BINDING SITE is HOST TARGET binding site found in the 3' untranslated region of mRNA encoded by ZNF297B, corresponding to a HOST TARGET binding site such as BINDING SITE I, BINDING SITE II or BINDING SITE III. Table 2 illustrates the complementarity of the nucleotide sequences of ZNF297B BINDING SITE, designated SEQ ID:15223, to the nucleotide sequence of VGAM1965 RNA, herein designated VGAM RNA, also designated SEQ ID:4676.

Another function of VGAM1965 is therefore inhibition of Zinc Finger Protein 297B (ZNF297B, Accession NM_014007). Accordingly, utilities of VGAM1965 include diagnosis, prevention and treatment of diseases and clinical conditions associated with ZNF297B. Zinc Finger Protein 31 (KOX 29) (ZNF31, Accession XM_036305) is another VGAM1965 host target gene. ZNF31 BINDING SITE is HOST TARGET binding site found in the 5' untranslated region of mRNA encoded by ZNF31, corresponding to a HOST TARGET binding site such as BINDING SITE I, BINDING SITE II or BINDING SITE III. Table 2 illustrates the complementarity of the nucleotide sequences of ZNF31 BINDING SITE, designated SEQ ID:32423, to the nucleotide sequence of VGAM1965 RNA, herein designated VGAM RNA, also designated SEQ ID:4676.

Another function of VGAM1965 is therefore inhibition of Zinc Finger Protein 31 (KOX 29) (ZNF31, Accession XM_036305). Accordingly, utilities of VGAM1965 include diagnosis, prevention and treatment of diseases and clinical conditions associated with ZNF31. Zinc Finger Protein 33a (KOX 31) (ZNF33A, Accession XM_166119) is another VGAM1965 host target gene. ZNF33A BINDING SITE is HOST TARGET binding site found in the 3' untranslated region of mRNA encoded by ZNF33A, corresponding to a HOST TARGET binding site such as BINDING SITE I, BINDING SITE II or BINDING SITE III. Table 2 illustrates the complementarity of the nucleotide sequences of ZNF33A BINDING SITE, designated SEQ ID:43901, to the nucleotide sequence of VGAM1965 RNA, herein designated VGAM RNA, also designated SEQ ID:4676.

Another function of VGAM1965 is therefore inhibition of Zinc Finger Protein 33a (KOX 31) (ZNF33A, Accession XM_166119). Accordingly, utilities of VGAM1965 include diagnosis, prevention and treatment of diseases and clinical conditions associated with ZNF33A. LOC113523 (Accession XM_054378) is another VGAM1965 host target gene. LOC113523 BINDING SITE1 and LOC113523 BINDING SITE2 are HOST TARGET binding sites found in untranslated regions of mRNA encoded by LOC113523, corresponding to HOST TARGET binding sites such as BINDING SITE I, BINDING SITE II or BINDING SITE III. Table 2 illustrates the complementarity of the nucleotide sequences of LOC113523 BINDING SITE1 and LOC113523 BINDING SITE2, designated SEQ ID:36154 and SEQ ID:36155 respectively, to the nucleotide sequence of VGAM1965 RNA, herein designated VGAM RNA, also designated SEQ ID:4676.

Another function of VGAM1965 is therefore inhibition of LOC113523 (Accession XM_054378). Accordingly, utilities of VGAM1965 include diagnosis, prevention and treatment of diseases and clinical conditions associated with LOC113523. LOC115297 (Accession XM_053313) is another VGAM1965 host target gene. LOC115297 BINDING SITE is HOST TARGET binding site found in the 3' untranslated region of mRNA encoded by LOC115297, corresponding to a HOST TARGET binding site such as BINDING SITE I, BINDING SITE II or BINDING SITE III. Table 2 illustrates the complementarity of the nucleotide sequences of LOC115297 BINDING SITE, designated SEQ ID:36071, to the nucleotide sequence of VGAM1965 RNA, herein designated VGAM RNA, also designated SEQ ID:4676.

Another function of VGAM1965 is therefore inhibition of LOC115297 (Accession XM_053313). Accordingly, utilities of VGAM1965 include diagnosis, prevention and treatment of diseases and clinical conditions associated with LOC115297. LOC116166 (Accession XM_007651) is another VGAM1965 host target gene. LOC116166 BINDING SITE is HOST TARGET binding site found in the 3' untranslated region of mRNA encoded by LOC116166, corresponding to a HOST TARGET binding site such as BINDING SITE I, BINDING SITE II or BINDING SITE III. Table 2 illustrates the complementarity of the nucleotide sequences of LOC116166 BINDING SITE, designated SEQ ID:30061, to the nucleotide sequence of VGAM1965 RNA, herein designated VGAM RNA, also designated SEQ ID:4676.

Another function of VGAM1965 is therefore inhibition of LOC116166 (Accession XM_007651). Accordingly, utilities of VGAM1965 include diagnosis, prevention and treatment of diseases and clinical conditions associated with LOC116166. LOC120196 (Accession XM_061916) is another VGAM1965 host target gene. LOC120196 BINDING SITE is HOST TARGET binding site found in the 3' untranslated region of mRNA encoded by LOC120196, corresponding to a HOST TARGET binding site such as BINDING SITE I, BINDING SITE II or BINDING SITE III. Table 2 illustrates the complementarity of the nucleotide sequences of LOC120196 BINDING SITE, designated SEQ ID:37217, to the nucleotide sequence of VGAM1965 RNA, herein designated VGAM RNA, also designated SEQ ID:4676.

Another function of VGAM1965 is therefore inhibition of LOC120196 (Accession XM_061916). Accordingly, utilities of VGAM1965 include diagnosis, prevention and treatment of diseases and clinical conditions associated with LOC120196. LOC120526 (Accession XM_058475) is another VGAM1965 host target gene. LOC120526 BINDING SITE is HOST TARGET binding site found in the 3' untranslated region of mRNA encoded by LOC120526, corresponding to a HOST TARGET binding site such as BINDING SITE I, BINDING SITE II or BINDING SITE III. Table 2 illustrates the complementarity of the nucleotide sequences of LOC120526 BINDING SITE, designated SEQ ID:36624, to the nucleotide sequence of VGAM1965 RNA, herein designated VGAM RNA, also designated SEQ ID:4676.

Another function of VGAM1965 is therefore inhibition of LOC120526 (Accession XM_058475). Accordingly, utilities of VGAM1965 include diagnosis, prevention and treatment of diseases and clinical conditions associated with LOC120526. LOC121219 (Accession XM_058544) is another VGAM1965 host target gene. LOC121219 BINDING SITE is HOST TARGET binding site found in the 5' untranslated region of mRNA encoded by LOC121219, corresponding to a HOST TARGET binding site such as BINDING SITE I, BINDING SITE II or BINDING SITE III. Table 2 illustrates the complementarity of the nucleotide sequences of LOC121219 BINDING SITE, designated SEQ ID:36651, to the nucleotide sequence of VGAM1965 RNA, herein designated VGAM RNA, also designated SEQ ID:4676.

Another function of VGAM1965 is therefore inhibition of LOC121219 (Accession XM_058544). Accordingly, utilities of VGAM1965 include diagnosis, prevention and treatment of diseases and clinical conditions associated with LOC121219. LOC121601 (Accession XM_058577) is another VGAM1965 host target gene. LOC121601 BINDING SITE is HOST TARGET binding site found in the 5' untranslated region of mRNA encoded by LOC121601, corresponding to a HOST TARGET binding site such as BINDING SITE I, BINDING SITE II or BINDING SITE III. Table 2 illustrates the complementarity of the nucleotide sequences of LOC121601 BINDING SITE, designated SEQ ID:36673, to the nucleotide sequence of VGAM1965 RNA, herein designated VGAM RNA, also designated SEQ ID:4676.

Another function of VGAM1965 is therefore inhibition of LOC121601 (Accession XM_058577). Accordingly, utilities of VGAM1965 include diagnosis, prevention and treatment of diseases and clinical conditions associated with LOC121601. LOC122786 (Accession XM_058660) is another VGAM1965 host target gene. LOC122786 BINDING SITE is HOST TARGET binding site found in the 3' untranslated region of mRNA encoded by LOC122786, corresponding to a HOST TARGET binding site such as BINDING SITE I, BINDING SITE II or BINDING SITE III. Table 2 illustrates the complementarity of the nucleotide sequences of LOC122786 BINDING SITE, designated SEQ ID:36700, to the nucleotide sequence of VGAM1965 RNA, herein designated VGAM RNA, also designated SEQ ID:4676.

Another function of VGAM1965 is therefore inhibition of LOC122786 (Accession XM_058660). Accordingly, utilities of VGAM1965 include diagnosis, prevention and treatment of diseases and clinical conditions associated with LOC122786. LOC124145 (Accession XM_058775) is another VGAM1965 host target gene. LOC124145 BINDING SITE is HOST TARGET binding site found in the 3' untranslated region of mRNA encoded by LOC124145, corresponding to a HOST TARGET binding site such as BINDING SITE I, BINDING SITE II or BINDING SITE III. Table 2 illustrates the complementarity of the nucleotide sequences of LOC124145 BINDING SITE, designated SEQ ID:36734, to the nucleotide sequence of VGAM1965 RNA, herein designated VGAM RNA, also designated SEQ ID:4676.

Another function of VGAM1965 is therefore inhibition of LOC124145 (Accession XM_058775). Accordingly, utilities of VGAM1965 include diagnosis, prevention and treatment of diseases and clinical conditions associated with LOC124145. LOC124446 (Accession XM_058805) is another VGAM1965 host target gene. LOC124446 BINDING SITE is HOST TARGET binding site found in the 5' untranslated region of mRNA encoded by LOC124446, corresponding to a HOST TARGET binding site such as BINDING SITE I, BINDING SITE II or BINDING SITE III. Table 2 illustrates the complementarity of the nucleotide sequences of LOC124446 BINDING SITE, designated SEQ ID:36752, to the nucleotide sequence of VGAM1965 RNA, herein designated VGAM RNA, also designated SEQ ID:4676.

Another function of VGAM1965 is therefore inhibition of LOC124446 (Accession XM_058805). Accordingly, utilities of VGAM1965 include diagnosis, prevention and treatment of diseases and clinical conditions associated with LOC124446. LOC124944 (Accession XM_058876) is another VGAM1965 host target gene. LOC124944 BIND- ING SITE is HOST TARGET binding site found in the 5' untranslated region of mRNA encoded by LOC124944, corresponding to a HOST TARGET binding site such as BINDING SITE I, BINDING SITE II or BINDING SITE III. Table 2 illustrates the complementarity of the nucleotide sequences of LOC124944 BINDING SITE, designated SEQ ID:36778, to the nucleotide sequence of VGAM1965 RNA, herein designated VGAM RNA, also designated SEQ ID:4676.

Another function of VGAM1965 is therefore inhibition of LOC124944 (Accession XM_058876). Accordingly, utilities of VGAM1965 include diagnosis, prevention and treatment of diseases and clinical conditions associated with LOC124944. LOC126167 (Accession XM_058997) is another VGAM1965 host target gene. LOC126167 BINDING SITE is HOST TARGET binding site found in the 5' untranslated region of mRNA encoded by LOC126167, corresponding to a HOST TARGET binding site such as BINDING SITE I, BINDING SITE II or BINDING SITE III. Table 2 illustrates the complementarity of the nucleotide sequences of LOC126167 BINDING SITE, designated SEQ ID:36814, to the nucleotide sequence of VGAM1965 RNA, herein designated VGAM RNA, also designated SEQ ID:4676.

Another function of VGAM1965 is therefore inhibition of LOC126167 (Accession XM_058997). Accordingly, utilities of VGAM1965 include diagnosis, prevention and treatment of diseases and clinical conditions associated with LOC126167. LOC126917 (Accession XM_059091) is another VGAM1965 host target gene. LOC126917 BINDING SITE is HOST TARGET binding site found in the 3' untranslated region of mRNA encoded by LOC126917, corresponding to a HOST TARGET binding site such as BINDING SITE I, BINDING SITE II or BINDING SITE III. Table 2 illustrates the complementarity of the nucleotide sequences of LOC126917 BINDING SITE, designated SEQ ID:36876, to the nucleotide sequence of VGAM1965 RNA, herein designated VGAM RNA, also designated SEQ ID:4676.

Another function of VGAM1965 is therefore inhibition of LOC126917 (Accession XM_059091). Accordingly, utilities of VGAM1965 include diagnosis, prevention and treatment of diseases and clinical conditions associated with LOC126917. LOC126964 (Accession XM_059100) is another VGAM1965 host target gene. LOC126964 BINDING SITE is HOST TARGET binding site found in the 3' untranslated region of mRNA encoded by LOC126964, corresponding to a HOST TARGET binding site such as BINDING SITE I, BINDING SITE II or BINDING SITE III. Table 2 illustrates the complementarity of the nucleotide sequences of LOC126964 BINDING SITE, designated SEQ ID:36885, to the nucleotide sequence of VGAM1965 RNA, herein designated VGAM RNA, also designated SEQ ID:4676.

Another function of VGAM1965 is therefore inhibition of LOC126964 (Accession XM_059100). Accordingly, utilities of VGAM1965 include diagnosis, prevention and treatment of diseases and clinical conditions associated with LOC126964. LOC127162 (Accession XM_059117) is another VGAM1965 host target gene. LOC127162 BINDING SITE is HOST TARGET binding site found in the 3' untranslated region of mRNA encoded by LOC127162, corresponding to a HOST TARGET binding site such as BINDING SITE I, BINDING SITE II or BINDING SITE III. Table 2 illustrates the complementarity of the nucleotide sequences of LOC127162 BINDING SITE, designated SEQ ID:36887, to the nucleotide sequence of VGAM1965 RNA, herein designated VGAM RNA, also designated SEQ ID:4676.

Another function of VGAM1965 is therefore inhibition of LOC127162 (Accession XM_059117). Accordingly, utilities of VGAM1965 include diagnosis, prevention and treatment of diseases and clinical conditions associated with LOC127162. LOC127281 (Accession XM_059128) is another VGAM1965 host target gene. LOC127281 BINDING SITE is HOST TARGET binding site found in the 3' untranslated region of mRNA encoded by LOC127281, corresponding to a HOST TARGET binding site such as BINDING SITE I, BINDING SITE II or BINDING SITE III. Table 2 illustrates the complementarity of the nucleotide sequences of LOC127281 BINDING SITE, designated SEQ ID:36889, to the nucleotide sequence of VGAM1965 RNA, herein designated VGAM RNA, also designated SEQ ID:4676.

Another function of VGAM1965 is therefore inhibition of LOC127281 (Accession XM_059128). Accordingly, utilities of VGAM1965 include diagnosis, prevention and treatment of diseases and clinical conditions associated with LOC127281. LOC127534 (Accession XM_060532) is another VGAM1965 host target gene. LOC127534 BINDING SITE is HOST TARGET binding site found in the 3' untranslated region of mRNA encoded by LOC127534, corresponding to a HOST TARGET binding site such as BINDING SITE I, BINDING SITE II or BINDING SITE III. Table 2 illustrates the complementarity of the nucleotide sequences of LOC127534 BINDING SITE, designated SEQ ID:37173, to the nucleotide sequence of VGAM1965 RNA, herein designated VGAM RNA, also designated SEQ ID:4676.

Another function of VGAM1965 is therefore inhibition of LOC127534 (Accession XM_060532). Accordingly, utilities of VGAM1965 include diagnosis, prevention and treatment of diseases and clinical conditions associated with LOC127534. LOC127841 (Accession XM_059184) is another VGAM1965 host target gene. LOC127841 BINDING SITE is HOST TARGET binding site found in the 5' untranslated region of mRNA encoded by LOC127841, corresponding to a HOST TARGET binding site such as BINDING SITE I, BINDING SITE II or BINDING SITE III. Table 2 illustrates the complementarity of the nucleotide sequences of LOC127841 BINDING SITE, designated SEQ ID:36910, to the nucleotide sequence of VGAM1965 RNA, herein designated VGAM RNA, also designated SEQ ID:4676.

Another function of VGAM1965 is therefore inhibition of LOC127841 (Accession XM_059184). Accordingly, utilities of VGAM1965 include diagnosis, prevention and treatment of diseases and clinical conditions associated with LOC127841. LOC128077 (Accession XM_059208) is another VGAM1965 host target gene. LOC128077 BINDING SITE is HOST TARGET binding site found in the 3' untranslated region of mRNA encoded by LOC128077, corresponding to a HOST TARGET binding site such as BINDING SITE I, BINDING SITE II or BINDING SITE III. Table 2 illustrates the complementarity of the nucleotide sequences of LOC128077 BINDING SITE, designated SEQ ID:36919, to the nucleotide sequence of VGAM1965 RNA, herein designated VGAM RNA, also designated SEQ ID:4676.

Another function of VGAM1965 is therefore inhibition of LOC128077 (Accession XM_059208). Accordingly, utilities of VGAM1965 include diagnosis, prevention and treatment of diseases and clinical conditions associated with LOC128077. LOC129198 (Accession XM_072197) is another VGAM1965 host target gene. LOC129198 BINDING SITE is HOST TARGET binding site found in the 5' untranslated region of mRNA encoded by LOC129198, corresponding to a HOST TARGET binding site such as BINDING SITE I, BINDING SITE II or BINDING SITE III. Table 2 illustrates the complementarity of the nucleotide sequences of LOC129198 BINDING SITE, designated SEQ ID:37465, to the nucleotide sequence of VGAM1965 RNA, herein designated VGAM RNA, also designated SEQ ID:4676.

Another function of VGAM1965 is therefore inhibition of LOC129198 (Accession XM_072197). Accordingly, utilities of VGAM1965 include diagnosis, prevention and treatment of diseases and clinical conditions associated with LOC129198. LOC133022 (Accession XM_068144) is another VGAM1965 host target gene. LOC133022 BINDING SITE is HOST TARGET binding site found in the 3' untranslated region of mRNA encoded by LOC133022, corresponding to a HOST TARGET binding site such as BINDING SITE I, BINDING SITE II or BINDING SITE III. Table 2 illustrates the complementarity of the nucleotide sequences of LOC133022 BINDING SITE, designated SEQ ID:37376, to the nucleotide sequence of VGAM1965 RNA, herein designated VGAM RNA, also designated SEQ ID:4676.

Another function of VGAM1965 is therefore inhibition of LOC133022 (Accession XM_068144). Accordingly, utilities of VGAM1965 include diagnosis, prevention and treatment of diseases and clinical conditions associated with LOC133022. LOC133088 (Accession XM_059624) is another VGAM1965 host target gene. LOC133088 BINDING SITE is HOST TARGET binding site found in the 5' untranslated region of mRNA encoded by LOC133088, corresponding to a HOST TARGET binding site such as BINDING SITE I, BINDING SITE II or BINDING SITE III. Table 2 illustrates the complementarity of the nucleotide sequences of LOC133088 BINDING SITE, designated SEQ ID:37032, to the nucleotide sequence of VGAM1965 RNA, herein designated VGAM RNA, also designated SEQ ID:4676.

Another function of VGAM1965 is therefore inhibition of LOC133088 (Accession XM_059624). Accordingly, utilities of VGAM1965 include diagnosis, prevention and treatment of diseases and clinical conditions associated with LOC133088. LOC133584 (Accession XM_059661) is another VGAM1965 host target gene. LOC133584 BINDING SITE is HOST TARGET binding site found in the 3' untranslated region of mRNA encoded by LOC133584, corresponding to a HOST TARGET binding site such as BINDING SITE I, BINDING SITE II or BINDING SITE III. Table 2 illustrates the complementarity of the nucleotide sequences of LOC133584 BINDING SITE, designated SEQ ID:37048, to the nucleotide sequence of VGAM1965 RNA, herein designated VGAM RNA, also designated SEQ ID:4676.

Another function of VGAM1965 is therefore inhibition of LOC133584 (Accession XM_059661). Accordingly, utilities of VGAM1965 include diagnosis, prevention and treatment of diseases and clinical conditions associated with LOC133584. LOC134121 (Accession XM_059692) is another VGAM1965 host target gene. LOC134121 BINDING SITE is HOST TARGET binding site found in the 3' untranslated region of mRNA encoded by LOC134121, corresponding to a HOST TARGET binding site such as BINDING SITE I, BINDING SITE II or BINDING SITE III. Table 2 illustrates the complementarity of the nucleotide sequences of LOC134121 BINDING SITE, designated SEQ ID:37065, to the nucleotide sequence of VGAM1965 RNA, herein designated VGAM RNA, also designated SEQ ID:4676.

Another function of VGAM1965 is therefore inhibition of LOC134121 (Accession XM_059692). Accordingly, utilities of VGAM1965 include diagnosis, prevention and treatment of diseases and clinical conditions associated with LOC134121. LOC134147 (Accession NM_138809) is another VGAM1965 host target gene. LOC134147 BINDING SITE1 and LOC134147 BINDING SITE2 are HOST TARGET binding sites found in untranslated regions of mRNA encoded by LOC134147, corresponding to HOST TARGET binding sites such as BINDING SITE I, BINDING SITE II or BINDING SITE III. Table 2 illustrates the complementarity of the nucleotide sequences of LOC134147 BINDING SITE1 and LOC134147 BINDING SITE2, designated SEQ ID:29033 and SEQ ID:29034 respectively, to the nucleotide sequence of VGAM1965 RNA, herein designated VGAM RNA, also designated SEQ ID:4676.

Another function of VGAM1965 is therefore inhibition of LOC134147 (Accession NM_138809). Accordingly, utilities of VGAM1965 include diagnosis, prevention and treatment of diseases and clinical conditions associated with LOC134147. LOC135818 (Accession XM_059804) is another VGAM1965 host target gene. LOC135818 BINDING SITE is HOST TARGET binding site found in the 3' untranslated region of mRNA encoded by LOC135818, corresponding to a HOST TARGET binding site such as BINDING SITE I, BINDING SITE II or BINDING SITE III. Table 2 illustrates the complementarity of the nucleotide sequences of LOC135818 BINDING SITE, designated SEQ ID:37096, to the nucleotide sequence of VGAM1965 RNA, herein designated VGAM RNA, also designated SEQ ID:4676.

Another function of VGAM1965 is therefore inhibition of LOC135818 (Accession XM_059804). Accordingly, utilities of VGAM1965 include diagnosis, prevention and treatment of diseases and clinical conditions associated with LOC135818. LOC139221 (Accession XM_066558) is another VGAM1965 host target gene. LOC139221 BINDING SITE is HOST TARGET binding site found in the 3' untranslated region of mRNA encoded by LOC139221, corresponding to a HOST TARGET binding site such as BINDING SITE I, BINDING SITE II or BINDING SITE III. Table 2 illustrates the complementarity of the nucleotide sequences of LOC139221 BINDING SITE, designated SEQ ID:37333, to the nucleotide sequence of VGAM1965 RNA, herein designated VGAM RNA, also designated SEQ ID:4676.

Another function of VGAM1965 is therefore inhibition of LOC139221 (Accession XM_066558). Accordingly, utilities of VGAM1965 include diagnosis, prevention and treatment of diseases and clinical conditions associated with LOC139221. LOC139248 (Accession XM_066582) is another VGAM1965 host target gene. LOC139248 BINDING SITE is HOST TARGET binding site found in the 5' untranslated region of mRNA encoded by LOC139248, corresponding to a HOST TARGET binding site such as BINDING SITE I, BINDING SITE II or BINDING SITE III. Table 2 illustrates the complementarity of the nucleotide sequences of LOC139248 BINDING SITE, designated SEQ ID:37338, to the nucleotide sequence of VGAM1965 RNA, herein designated VGAM RNA, also designated SEQ ID:4676.

Another function of VGAM1965 is therefore inhibition of LOC139248 (Accession XM_066582). Accordingly, utilities of VGAM1965 include diagnosis, prevention and treatment of diseases and clinical conditions associated with LOC139248. LOC139770 (Accession XM_060053) is another VGAM1965 host target gene. LOC139770 BINDING SITE1 through LOC139770 BINDING SITE3 are HOST TARGET binding sites found in untranslated regions of mRNA encoded by LOC139770, corresponding to HOST TARGET binding sites such as BINDING SITE I, BINDING SITE II or BINDING SITE III. Table 2 illustrates the complementarity of the nucleotide sequences of LOC139770 BINDING SITE1 through LOC139770 BINDING SITE3, designated SEQ ID:37146, SEQ ID:37148 and SEQ ID:37149 respectively, to the nucleotide sequence of VGAM1965 RNA, herein designated VGAM RNA, also designated SEQ ID:4676.

Another function of VGAM1965 is therefore inhibition of LOC139770 (Accession XM_060053). Accordingly, utilities of VGAM1965 include diagnosis, prevention and treatment of diseases and clinical conditions associated with LOC139770. LOC143188 (Accession XM_096387) is another VGAM1965 host target gene. LOC143188 BINDING SITE is HOST TARGET binding site found in the 5' untranslated region of mRNA encoded by LOC143188, corresponding to a HOST TARGET binding site such as BINDING SITE I, BINDING SITE II or BINDING SITE III. Table 2 illustrates the complementarity of the nucleotide sequences of LOC143188 BINDING SITE, designated SEQ ID:40328, to the nucleotide sequence of VGAM1965 RNA, herein designated VGAM RNA, also designated SEQ ID:4676.

Another function of VGAM1965 is therefore inhibition of LOC143188 (Accession XM_096387). Accordingly, utilities of VGAM1965 include diagnosis, prevention and treatment of diseases and clinical conditions associated with LOC143188. LOC143465 (Accession XM_096430) is another VGAM1965 host target gene. LOC143465 BINDING SITE is HOST TARGET binding site found in the 5' untranslated region of mRNA encoded by LOC143465, corresponding to a HOST TARGET binding site such as BINDING SITE I, BINDING SITE II or BINDING SITE III. Table 2 illustrates the complementarity of the nucleotide sequences of LOC143465 BINDING SITE, designated SEQ ID:40365, to the nucleotide sequence of VGAM1965 RNA, herein designated VGAM RNA, also designated SEQ ID:4676.

Another function of VGAM1965 is therefore inhibition of LOC143465 (Accession XM_096430). Accordingly, utilities of VGAM1965 include diagnosis, prevention and treatment of diseases and clinical conditions associated with LOC143465. LOC144245 (Accession XM_047770) is another VGAM1965 host target gene. LOC144245 BINDING SITE is HOST TARGET binding site found in the 3' untranslated region of mRNA encoded by LOC144245, corresponding to a HOST TARGET binding site such as BINDING SITE I, BINDING SITE II or BINDING SITE III. Table 2 illustrates the complementarity of the nucleotide sequences of LOC144245 BINDING SITE, designated SEQ ID:35051, to the nucleotide sequence of VGAM1965 RNA, herein designated VGAM RNA, also designated SEQ ID:4676.

Another function of VGAM1965 is therefore inhibition of LOC144245 (Accession XM_047770). Accordingly, utilities of VGAM1965 include diagnosis, prevention and treatment of diseases and clinical conditions associated with LOC144245. LOC144266 (Accession XM_084795) is another VGAM1965 host target gene. LOC144266 BINDING SITE is HOST TARGET binding site found in the 5' untranslated region of mRNA encoded by LOC144266, corresponding to a HOST TARGET binding site such as BINDING SITE I, BINDING SITE II or BINDING SITE III. Table 2 illustrates the complementarity of the nucleotide sequences of LOC144266 BINDING SITE, designated SEQ ID:37707, to the nucleotide sequence of VGAM1965 RNA, herein designated VGAM RNA, also designated SEQ ID:4676.

Another function of VGAM1965 is therefore inhibition of LOC144266 (Accession XM_084795). Accordingly, utilities of VGAM1965 include diagnosis, prevention and treatment of diseases and clinical conditions associated with LOC144266. LOC144512 (Accession XM_096623) is another VGAM1965 host target gene. LOC144512 BINDING SITE1 and LOC144512 BINDING SITE2 are HOST TARGET binding sites found in untranslated regions of mRNA encoded by LOC144512, corresponding to HOST TARGET binding sites such as BINDING SITE I, BINDING SITE II or BINDING SITE III. Table 2 illustrates the complementarity of the nucleotide sequences of LOC144512 BINDING SITE1 and LOC144512 BINDING SITE2, designated SEQ ID:40430 and SEQ ID:40431 respectively, to the nucleotide sequence of VGAM1965 RNA, herein designated VGAM RNA, also designated SEQ ID:4676.

Another function of VGAM1965 is therefore inhibition of LOC144512 (Accession XM_096623). Accordingly, utilities of VGAM1965 include diagnosis, prevention and treatment of diseases and clinical conditions associated with LOC144512. LOC144920 (Accession XM_096688) is another VGAM1965 host target gene. LOC144920 BINDING SITE is HOST TARGET binding site found in the 3' untranslated region of mRNA encoded by LOC144920, corresponding to a HOST TARGET binding site such as BINDING SITE I, BINDING SITE II or BINDING SITE III. Table 2 illustrates the complementarity of the nucleotide sequences of LOC144920 BINDING SITE, designated SEQ ID:40464, to the nucleotide sequence of VGAM1965 RNA, herein designated VGAM RNA, also designated SEQ ID:4676.

Another function of VGAM1965 is therefore inhibition of LOC144920 (Accession XM_096688). Accordingly, utilities of VGAM1965 include diagnosis, prevention and treatment of diseases and clinical conditions associated with LOC144920. LOC145082 (Accession XM_096719) is another VGAM1965 host target gene. LOC145082 BINDING SITE is HOST TARGET binding site found in the 5' untranslated region of mRNA encoded by LOC145082, corresponding to a HOST TARGET binding site such as BINDING SITE I, BINDING SITE II or BINDING SITE III. Table 2 illustrates the complementarity of the nucleotide sequences of LOC145082 BINDING SITE, designated SEQ ID:40495, to the nucleotide sequence of VGAM1965 RNA, herein designated VGAM RNA, also designated SEQ ID:4676.

Another function of VGAM1965 is therefore inhibition of LOC145082 (Accession XM_096719). Accordingly, utilities of VGAM1965 include diagnosis, prevention and treatment of diseases and clinical conditions associated with LOC145082. LOC145231 (Accession XM_096740) is another VGAM1965 host target gene. LOC145231 BINDING SITE1 and LOC145231 BINDING SITE2 are HOST TARGET binding sites found in untranslated regions of mRNA encoded by LOC145231, corresponding to HOST TARGET binding sites such as BINDING SITE I, BINDING SITE II or BINDING SITE III. Table 2 illustrates the complementarity of the nucleotide sequences of LOC145231 BINDING SITE1 and LOC145231 BINDING SITE2, designated SEQ ID:40522 and SEQ ID:40523 respectively, to the nucleotide sequence of VGAM1965 RNA, herein designated VGAM RNA, also designated SEQ ID:4676.

Another function of VGAM1965 is therefore inhibition of LOC145231 (Accession XM_096740). Accordingly, utilities of VGAM1965 include diagnosis, prevention and treatment of diseases and clinical conditions associated with LOC145231. LOC145497 (Accession XM_085150) is another VGAM1965 host target gene. LOC145497 BINDING SITE is HOST TARGET binding site found in the 5' untranslated region of mRNA encoded by LOC145497, corresponding to a HOST TARGET binding site such as BINDING SITE I, BINDING SITE II or BINDING SITE III. Table 2 illustrates the complementarity of the nucleotide sequences of LOC145497 BINDING SITE, designated SEQ ID:37874, to the nucleotide sequence of VGAM1965 RNA, herein designated VGAM RNA, also designated SEQ ID:4676.

Another function of VGAM1965 is therefore inhibition of LOC145497 (Accession XM_085150). Accordingly, utilities of VGAM1965 include diagnosis, prevention and treatment of diseases and clinical conditions associated with LOC145497. LOC145547 (Accession XM_085167) is another VGAM1965 host target gene. LOC145547 BINDING SITE is HOST TARGET binding site found in the 3' untranslated region of mRNA encoded by LOC145547, corresponding to a HOST TARGET binding site such as BINDING SITE I, BINDING SITE II or BINDING SITE III. Table 2 illustrates the complementarity of the nucleotide sequences of LOC145547 BINDING SITE, designated SEQ ID:37891, to the nucleotide sequence of VGAM1965 RNA, herein designated VGAM RNA, also designated SEQ ID:4676.

Another function of VGAM1965 is therefore inhibition of LOC145547 (Accession XM_085167). Accordingly, utilities of VGAM1965 include diagnosis, prevention and treatment of diseases and clinical conditions associated with LOC145547. LOC145662 (Accession XM_085194) is another VGAM1965 host target gene. LOC145662 BINDING SITE is HOST TARGET binding site found in the 3' untranslated region of mRNA encoded by LOC145662, corresponding to a HOST TARGET binding site such as BINDING SITE I, BINDING SITE II or BINDING SITE III. Table 2 illustrates the complementarity of the nucleotide sequences of LOC145662 BINDING SITE, designated SEQ ID:37918, to the nucleotide sequence of VGAM1965 RNA, herein designated VGAM RNA, also designated SEQ ID:4676.

Another function of VGAM1965 is therefore inhibition of LOC145662 (Accession XM_085194). Accordingly, utilities of VGAM1965 include diagnosis, prevention and treatment of diseases and clinical conditions associated with LOC145662. LOC145761 (Accession XM_096855) is another VGAM1965 host target gene. LOC145761 BINDING SITE is HOST TARGET binding site found in the 5' untranslated region of mRNA encoded by LOC145761, corresponding to a HOST TARGET binding site such as BINDING SITE I, BINDING SITE II or BINDING SITE III. Table 2 illustrates the complementarity of the nucleotide sequences of LOC145761 BINDING SITE, designated SEQ ID:40585, to the nucleotide sequence of VGAM1965 RNA, herein designated VGAM RNA, also designated SEQ ID:4676.

Another function of VGAM1965 is therefore inhibition of LOC145761 (Accession XM_096855). Accordingly, utilities of VGAM1965 include diagnosis, prevention and treatment of diseases and clinical conditions associated with LOC145761. LOC145955 (Accession XM_096912) is another VGAM1965 host target gene. LOC145955 BINDING SITE is HOST TARGET binding site found in the 5' untranslated region of mRNA encoded by LOC145955, corresponding to a HOST TARGET binding site such as BINDING SITE I, BINDING SITE II or BINDING SITE III. Table 2 illustrates the complementarity of the nucleotide sequences of LOC145955 BINDING SITE, designated SEQ ID:40646, to the nucleotide sequence of VGAM1965 RNA, herein designated VGAM RNA, also designated SEQ ID:4676.

Another function of VGAM1965 is therefore inhibition of LOC145955 (Accession XM_096912). Accordingly, utilities of VGAM1965 include diagnosis, prevention and treatment of diseases and clinical conditions associated with LOC145955. LOC145988 (Accession XM_085290) is another VGAM1965 host target gene. LOC145988 BINDING SITE is HOST TARGET binding site found in the 5' untranslated region of mRNA encoded by LOC145988, corresponding to a HOST TARGET binding site such as BINDING SITE I, BINDING SITE II or BINDING SITE III. Table 2 illustrates the complementarity of the nucleotide sequences of LOC145988 BINDING SITE, designated SEQ ID:38043, to the nucleotide sequence of VGAM1965 RNA, herein designated VGAM RNA, also designated SEQ ID:4676.

Another function of VGAM1965 is therefore inhibition of LOC145988 (Accession XM_085290). Accordingly, utilities of VGAM1965 include diagnosis, prevention and treatment of diseases and clinical conditions associated with LOC145988. LOC146108 (Accession XM_085322) is another VGAM1965 host target gene. LOC146108 BINDING SITE is HOST TARGET binding site found in the 5' untranslated region of mRNA encoded by LOC146108, corresponding to a HOST TARGET binding site such as BINDING SITE I, BINDING SITE II or BINDING SITE III. Table 2 illustrates the complementarity of the nucleotide sequences of LOC146108 BINDING SITE, designated SEQ ID:38063, to the nucleotide sequence of VGAM1965 RNA, herein designated VGAM RNA, also designated SEQ ID:4676.

Another function of VGAM1965 is therefore inhibition of LOC146108 (Accession XM_085322). Accordingly, utilities of VGAM1965 include diagnosis, prevention and treatment of diseases and clinical conditions associated with LOC146108. LOC146315 (Accession XM_027576) is another VGAM1965 host target gene. LOC146315 BINDING SITE is HOST TARGET binding site found in the 5' untranslated region of mRNA encoded by LOC146315, corresponding to a HOST TARGET binding site such as BINDING SITE I, BINDING SITE II or BINDING SITE III. Table 2 illustrates the complementarity of the nucleotide sequences of LOC146315 BINDING SITE, designated SEQ ID:30535, to the nucleotide sequence of VGAM1965 RNA, herein designated VGAM RNA, also designated SEQ ID:4676.

Another function of VGAM1965 is therefore inhibition of LOC146315 (Accession XM_027576). Accordingly, utilities of VGAM1965 include diagnosis, prevention and treatment of diseases and clinical conditions associated with LOC146315. LOC146336 (Accession XM_085421) is another VGAM1965 host target gene. LOC146336 BINDING SITE is HOST TARGET binding site found in the 3' untranslated region of mRNA encoded by LOC146336, corresponding to a HOST TARGET binding site such as BINDING SITE I, BINDING SITE II or BINDING SITE III. Table 2 illustrates the complementarity of the nucleotide sequences of LOC146336 BINDING SITE, designated SEQ ID:38134, to the nucleotide sequence of VGAM1965 RNA, herein designated VGAM RNA, also designated SEQ ID:4676.

Another function of VGAM1965 is therefore inhibition of LOC146336 (Accession XM_085421). Accordingly, utilities of VGAM1965 include diagnosis, prevention and treatment of diseases and clinical conditions associated with LOC146336. LOC146445 (Accession XM_096999) is another VGAM1965 host target gene. LOC146445 BINDING SITE is HOST TARGET binding site found in the 3' untranslated region of mRNA encoded by LOC146445, corresponding to a HOST TARGET binding site such as BINDING SITE I, BINDING SITE II or BINDING SITE III. Table 2 illustrates the complementarity of the nucleotide sequences of LOC146445 BINDING SITE, designated SEQ ID:40699, to the nucleotide sequence of VGAM1965 RNA, herein designated VGAM RNA, also designated SEQ ID:4676.

Another function of VGAM1965 is therefore inhibition of LOC146445 (Accession XM_096999). Accordingly, utilities of VGAM1965 include diagnosis, prevention and treatment of diseases and clinical conditions associated with LOC146445. LOC146745 (Accession XM_085577) is another VGAM1965 host target gene. LOC146745 BINDING SITE is HOST TARGET binding site found in the 5' untranslated region of mRNA encoded by LOC146745, corresponding to a HOST TARGET binding site such as BINDING SITE I, BINDING SITE II or BINDING SITE III. Table 2 illustrates the complementarity of the nucleotide sequences of LOC146745 BINDING SITE, designated SEQ ID:38232, to the nucleotide sequence of VGAM1965 RNA, herein designated VGAM RNA, also designated SEQ ID:4676.

Another function of VGAM1965 is therefore inhibition of LOC146745 (Accession XM_085577). Accordingly, utilities of VGAM1965 include diagnosis, prevention and treatment of diseases and clinical conditions associated with LOC146745. LOC146756 (Accession XM_097085) is another VGAM1965 host target gene. LOC146756 BINDING SITE is HOST TARGET binding site found in the 3' untranslated region of mRNA encoded by LOC146756, corresponding to a HOST TARGET binding site such as BINDING SITE I, BINDING SITE II or BINDING SITE III. Table 2 illustrates the complementarity of the nucleotide sequences of LOC146756 BINDING SITE, designated SEQ ID:40740, to the nucleotide sequence of VGAM1965 RNA, herein designated VGAM RNA, also designated SEQ ID:4676.

Another function of VGAM1965 is therefore inhibition of LOC146756 (Accession XM_097085). Accordingly, utilities of VGAM1965 include diagnosis, prevention and treatment of diseases and clinical conditions associated with LOC146756. LOC146802 (Accession XM_085595) is another VGAM1965 host target gene. LOC146802 BINDING SITE is HOST TARGET binding site found in the 3' untranslated region of mRNA encoded by LOC146802, corresponding to a HOST TARGET binding site such as BINDING SITE I, BINDING SITE II or BINDING SITE III. Table 2 illustrates the complementarity of the nucleotide sequences of LOC146802 BINDING SITE, designated SEQ ID:38248, to the nucleotide sequence of VGAM1965 RNA, herein designated VGAM RNA, also designated SEQ ID:4676.

Another function of VGAM1965 is therefore inhibition of LOC146802 (Accession XM_085595). Accordingly, utilities of VGAM1965 include diagnosis, prevention and treatment of diseases and clinical conditions associated with LOC146802. LOC146839 (Accession XM_097107) is another VGAM1965 host target gene. LOC146839 BINDING SITE is HOST TARGET binding site found in the 5' untranslated region of mRNA encoded by LOC146839, corresponding to a HOST TARGET binding site such as BINDING SITE I, BINDING SITE II or BINDING SITE III. Table 2 illustrates the complementarity of the nucleotide sequences of LOC146839 BINDING SITE, designated SEQ ID:40755, to the nucleotide sequence of VGAM1965 RNA, herein designated VGAM RNA, also designated SEQ ID:4676.

Another function of VGAM1965 is therefore inhibition of LOC146839 (Accession XM_097107). Accordingly, utilities of VGAM1965 include diagnosis, prevention and treatment of diseases and clinical conditions associated with LOC146839. LOC146880 (Accession XM_085627) is another VGAM1965 host target gene. LOC146880 BINDING SITE1 and LOC146880 BINDING SITE2 are HOST TARGET binding sites found in untranslated regions of mRNA encoded by LOC146880, corresponding to HOST TARGET binding sites such as BINDING SITE I, BINDING SITE II or BINDING SITE III. Table 2 illustrates the complementarity of the nucleotide sequences of LOC146880 BINDING SITE1 and LOC146880 BINDING SITE2, designated SEQ ID:38262 and SEQ ID:38263 respectively, to the nucleotide sequence of VGAM1965 RNA, herein designated VGAM RNA, also designated SEQ ID:4676.

Another function of VGAM1965 is therefore inhibition of LOC146880 (Accession XM_085627). Accordingly, utilities of VGAM1965 include diagnosis, prevention and treatment of diseases and clinical conditions associated with LOC146880. LOC147077 (Accession XM_085699) is another VGAM1965 host target gene. LOC147077 BINDING SITE is HOST TARGET binding site found in the 3' untranslated region of mRNA encoded by LOC147077, corresponding to a HOST TARGET binding site such as BINDING SITE I, BINDING SITE II or BINDING SITE III. Table 2 illustrates the complementarity of the nucleotide sequences of LOC147077 BINDING SITE, designated SEQ ID:38292, to the nucleotide sequence of VGAM1965 RNA, herein designated VGAM RNA, also designated SEQ ID:4676.

Another function of VGAM1965 is therefore inhibition of LOC147077 (Accession XM_085699). Accordingly, utilities of VGAM1965 include diagnosis, prevention and treatment of diseases and clinical conditions associated with LOC147077. LOC147160 (Accession XM_097202) is another VGAM1965 host target gene. LOC147160 BINDING SITE is HOST TARGET binding site found in the 5' untranslated region of mRNA encoded by LOC147160, corresponding to a HOST TARGET binding site such as BINDING SITE I, BINDING SITE II or BINDING SITE III. Table 2 illustrates the complementarity of the nucleotide sequences of LOC147160 BINDING SITE, designated SEQ ID:40811, to the nucleotide sequence of VGAM1965 RNA, herein designated VGAM RNA, also designated SEQ ID:4676.

Another function of VGAM1965 is therefore inhibition of LOC147160 (Accession XM_097202). Accordingly, utilities of VGAM1965 include diagnosis, prevention and treatment of diseases and clinical conditions associated with LOC147160. LOC147229 (Accession XM_085742) is another VGAM1965 host target gene. LOC147229 BINDING SITE is HOST TARGET binding site found in the 5' untranslated region of mRNA encoded by LOC147229, corresponding to a HOST TARGET binding site such as BINDING SITE I, BINDING SITE II or BINDING SITE III. Table 2 illustrates the complementarity of the nucleotide sequences of LOC147229 BINDING SITE, designated SEQ ID:38323, to the nucleotide sequence of VGAM1965 RNA, herein designated VGAM RNA, also designated SEQ ID:4676.

Another function of VGAM1965 is therefore inhibition of LOC147229 (Accession XM_085742). Accordingly, utilities of VGAM1965 include diagnosis, prevention and treatment of diseases and clinical conditions associated with LOC147229. LOC148029 (Accession XM_086014) is another VGAM1965 host target gene. LOC148029 BINDING SITE is HOST TARGET binding site found in the 5' untranslated region of mRNA encoded by LOC148029, corresponding to a HOST TARGET binding site such as BINDING SITE I, BINDING SITE II or BINDING SITE III. Table 2 illustrates the complementarity of the nucleotide sequences of LOC148029 BINDING SITE, designated SEQ ID:38446, to the nucleotide sequence of VGAM1965 RNA, herein designated VGAM RNA, also designated SEQ ID:4676.

Another function of VGAM1965 is therefore inhibition of LOC148029 (Accession XM_086014). Accordingly, utilities of VGAM1965 include diagnosis, prevention and treatment of diseases and clinical conditions associated with LOC148029. LOC148223 (Accession XM_086101) is another VGAM1965 host target gene. LOC148223 BINDING SITE is HOST TARGET binding site found in the 3' untranslated region of mRNA encoded by LOC148223, corresponding to a HOST TARGET binding site such as BINDING SITE I, BINDING SITE II or BINDING SITE III. Table 2 illustrates the complementarity of the nucleotide sequences of LOC148223 BINDING SITE, designated SEQ ID:38493, to the nucleotide sequence of VGAM1965 RNA, herein designated VGAM RNA, also designated SEQ ID:4676.

Another function of VGAM1965 is therefore inhibition of LOC148223 (Accession XM_086101). Accordingly, utilities of VGAM1965 include diagnosis, prevention and treatment of diseases and clinical conditions associated with LOC148223. LOC148394 (Accession XM_097460) is another VGAM1965 host target gene. LOC148394 BIND- ING SITE is HOST TARGET binding site found in the 3' untranslated region of mRNA encoded by LOC148394, corresponding to a HOST TARGET binding site such as BINDING SITE I, BINDING SITE II or BINDING SITE III. Table 2 illustrates the complementarity of the nucleotide sequences of LOC148394 BINDING SITE, designated SEQ ID:40882, to the nucleotide sequence of VGAM1965 RNA, herein designated VGAM RNA, also designated SEQ ID:4676.

Another function of VGAM1965 is therefore inhibition of LOC148394 (Accession XM_097460). Accordingly, utilities of VGAM1965 include diagnosis, prevention and treatment of diseases and clinical conditions associated with LOC148394. LOC148479 (Accession XM_086204) is another VGAM1965 host target gene. LOC148479 BINDING SITE is HOST TARGET binding site found in the 3' untranslated region of mRNA encoded by LOC148479, corresponding to a HOST TARGET binding site such as BINDING SITE I, BINDING SITE II or BINDING SITE III. Table 2 illustrates the complementarity of the nucleotide sequences of LOC148479 BINDING SITE, designated SEQ ID:38543, to the nucleotide sequence of VGAM1965 RNA, herein designated VGAM RNA, also designated SEQ ID:4676.

Another function of VGAM1965 is therefore inhibition of LOC148479 (Accession XM_086204). Accordingly, utilities of VGAM1965 include diagnosis, prevention and treatment of diseases and clinical conditions associated with LOC148479. LOC148823 (Accession NM_145278) is another VGAM1965 host target gene. LOC148823 BINDING SITE is HOST TARGET binding site found in the 3' untranslated region of mRNA encoded by LOC148823, corresponding to a HOST TARGET binding site such as BINDING SITE I, BINDING SITE II or BINDING SITE III. Table 2 illustrates the complementarity of the nucleotide sequences of LOC148823 BINDING SITE, designated SEQ ID:29796, to the nucleotide sequence of VGAM1965 RNA, herein designated VGAM RNA, also designated SEQ ID:4676.

Another function of VGAM1965 is therefore inhibition of LOC148823 (Accession NM_145278). Accordingly, utilities of VGAM1965 include diagnosis, prevention and treatment of diseases and clinical conditions associated with LOC148823. LOC148887 (Accession XM_097537) is another VGAM1965 host target gene. LOC148887 BINDING SITE is HOST TARGET binding site found in the 5' untranslated region of mRNA encoded by LOC148887, corresponding to a HOST TARGET binding site such as BINDING SITE I, BINDING SITE II or BINDING SITE III. Table 2 illustrates the complementarity of the nucleotide sequences of LOC148887 BINDING SITE, designated SEQ ID:40912, to the nucleotide sequence of VGAM1965 RNA, herein designated VGAM RNA, also designated SEQ ID:4676.

Another function of VGAM1965 is therefore inhibition of LOC148887 (Accession XM_097537). Accordingly, utilities of VGAM1965 include diagnosis, prevention and treatment of diseases and clinical conditions associated with LOC148887. LOC149010 (Accession XM_086397) is another VGAM1965 host target gene. LOC149010 BINDING SITE is HOST TARGET binding site found in the 5' untranslated region of mRNA encoded by LOC149010, corresponding to a HOST TARGET binding site such as BINDING SITE I, BINDING SITE II or BINDING SITE III. Table 2 illustrates the complementarity of the nucleotide sequences of LOC149010 BINDING SITE, designated SEQ ID:38628, to the nucleotide sequence of VGAM1965 RNA, herein designated VGAM RNA, also designated SEQ ID:4676.

Another function of VGAM1965 is therefore inhibition of LOC149010 (Accession XM_086397). Accordingly, utilities of VGAM1965 include diagnosis, prevention and treatment of diseases and clinical conditions associated with LOC149010. LOC149013 (Accession XM_086398) is another VGAM1965 host target gene. LOC149013 BINDING SITE is HOST TARGET binding site found in the 3' untranslated region of mRNA encoded by LOC149013, corresponding to a HOST TARGET binding site such as BINDING SITE I, BINDING SITE II or BINDING SITE III. Table 2 illustrates the complementarity of the nucleotide sequences of LOC149013 BINDING SITE, designated SEQ ID:38634, to the nucleotide sequence of VGAM1965 RNA, herein designated VGAM RNA, also designated SEQ ID:4676.

Another function of VGAM1965 is therefore inhibition of LOC149013 (Accession XM_086398). Accordingly, utilities of VGAM1965 include diagnosis, prevention and treatment of diseases and clinical conditions associated with LOC149013. LOC149086 (Accession XM_097580) is another VGAM1965 host target gene. LOC149086 BINDING SITE is HOST TARGET binding site found in the 3' untranslated region of mRNA encoded by LOC149086, corresponding to a HOST TARGET binding site such as BINDING SITE I, BINDING SITE II or BINDING SITE III. Table 2 illustrates the complementarity of the nucleotide sequences of LOC149086 BINDING SITE, designated SEQ ID:40947, to the nucleotide sequence of VGAM1965 RNA, herein designated VGAM RNA, also designated SEQ ID:4676.

Another function of VGAM1965 is therefore inhibition of LOC149086 (Accession XM_097580). Accordingly, utilities of VGAM1965 include diagnosis, prevention and treatment of diseases and clinical conditions associated with LOC149086. LOC149127 (Accession XM_097584) is another VGAM1965 host target gene. LOC149127 BINDING SITE is HOST TARGET binding site found in the 3' untranslated region of mRNA encoded by LOC149127, corresponding to a HOST TARGET binding site such as BINDING SITE I, BINDING SITE II or BINDING SITE III. Table 2 illustrates the complementarity of the nucleotide sequences of LOC149127 BINDING SITE, designated SEQ ID:40950, to the nucleotide sequence of VGAM1965 RNA, herein designated VGAM RNA, also designated SEQ ID:4676.

Another function of VGAM1965 is therefore inhibition of LOC149127 (Accession XM_097584). Accordingly, utilities of VGAM1965 include diagnosis, prevention and treatment of diseases and clinical conditions associated with LOC149127. LOC149153 (Accession XM_097599) is another VGAM1965 host target gene. LOC149153 BINDING SITE is HOST TARGET binding site found in the 3' untranslated region of mRNA encoded by LOC149153, corresponding to a HOST TARGET binding site such as BINDING SITE I, BINDING SITE II or BINDING SITE III. Table 2 illustrates the complementarity of the nucleotide sequences of LOC149153 BINDING SITE, designated SEQ ID:40966, to the nucleotide sequence of VGAM1965 RNA, herein designated VGAM RNA, also designated SEQ ID:4676.

Another function of VGAM1965 is therefore inhibition of LOC149153 (Accession XM_097599). Accordingly, utilities of VGAM1965 include diagnosis, prevention and treatment of diseases and clinical conditions associated with LOC149153. LOC149175 (Accession XM_086445) is another VGAM1965 host target gene. LOC149175 BINDING SITE1 and LOC149175 BINDING SITE2 are HOST TARGET binding sites found in untranslated regions of mRNA encoded by LOC149175, corresponding to HOST TARGET binding sites such as BINDING SITE I, BINDING SITE II or BINDING SITE III. Table 2 illustrates the complementarity of the nucleotide sequences of LOC149175 BINDING SITE1 and LOC149175 BINDING SITE2, designated SEQ ID:38664 and SEQ ID:38665 respectively, to the nucleotide sequence of VGAM1965 RNA, herein designated VGAM RNA, also designated SEQ ID:4676.

Another function of VGAM1965 is therefore inhibition of LOC149175 (Accession XM_086445). Accordingly, utilities of VGAM1965 include diagnosis, prevention and treatment of diseases and clinical conditions associated with LOC149175. LOC149271 (Accession XM_086475) is another VGAM1965 host target gene. LOC149271 BINDING SITE1 and LOC149271 BINDING SITE2 are HOST TARGET binding sites found in untranslated regions of mRNA encoded by LOC149271, corresponding to HOST TARGET binding sites such as BINDING SITE I, BINDING SITE II or BINDING SITE III. Table 2 illustrates the complementarity of the nucleotide sequences of LOC149271 BINDING SITE1 and LOC149271 BINDING SITE2, designated SEQ ID:38684 and SEQ ID:38683 respectively, to the nucleotide sequence of VGAM1965 RNA, herein designated VGAM RNA, also designated SEQ ID:4676.

Another function of VGAM1965 is therefore inhibition of LOC149271 (Accession XM_086475). Accordingly, utilities of VGAM1965 include diagnosis, prevention and treatment of diseases and clinical conditions associated with LOC149271. LOC149319 (Accession XM_086495) is another VGAM1965 host target gene. LOC149319 BINDING SITE is HOST TARGET binding site found in the 3' untranslated region of mRNA encoded by LOC149319, corresponding to a HOST TARGET binding site such as BINDING SITE I, BINDING SITE II or BINDING SITE III. Table 2 illustrates the complementarity of the nucleotide sequences of LOC149319 BINDING SITE, designated SEQ ID:38713, to the nucleotide sequence of VGAM1965 RNA, herein designated VGAM RNA, also designated SEQ ID:4676.

Another function of VGAM1965 is therefore inhibition of LOC149319 (Accession XM_086495). Accordingly, utilities of VGAM1965 include diagnosis, prevention and treatment of diseases and clinical conditions associated with LOC149319. LOC149464 (Accession XM_097645) is another VGAM1965 host target gene. LOC149464 BINDING SITE1 and LOC149464 BINDING SITE2 are HOST TARGET binding sites found in untranslated regions of mRNA encoded by LOC149464, corresponding to HOST TARGET binding sites such as BINDING SITE I, BINDING SITE II or BINDING SITE III. Table 2 illustrates the complementarity of the nucleotide sequences of LOC149464 BINDING SITE1 and LOC149464 BINDING SITE2, designated SEQ ID:40995 and SEQ ID:40996 respectively, to the nucleotide sequence of VGAM1965 RNA, herein designated VGAM RNA, also designated SEQ ID:4676.

Another function of VGAM1965 is therefore inhibition of LOC149464 (Accession XM_097645). Accordingly, utilities of VGAM1965 include diagnosis, prevention and treatment of diseases and clinical conditions associated with LOC149464. LOC149606 (Accession XM_086600) is another VGAM1965 host target gene. LOC149606 BINDING SITE is HOST TARGET binding site found in the 3' untranslated region of mRNA encoded by LOC149606, corresponding to a HOST TARGET binding site such as BINDING SITE I, BINDING SITE II or BINDING SITE III. Table 2 illustrates the complementarity of the nucleotide sequences of LOC149606 BINDING SITE, designated SEQ ID:38785, to the nucleotide sequence of VGAM1965 RNA, herein designated VGAM RNA, also designated SEQ ID:4676.

Another function of VGAM1965 is therefore inhibition of LOC149606 (Accession XM_086600). Accordingly, utilities of VGAM1965 include diagnosis, prevention and treatment of diseases and clinical conditions associated with LOC149606. LOC149684 (Accession XM_097710) is another VGAM1965 host target gene. LOC149684 BINDING SITE is HOST TARGET binding site found in the 5' untranslated region of mRNA encoded by LOC149684, corresponding to a HOST TARGET binding site such as BINDING SITE I, BINDING SITE II or BINDING SITE III. Table 2 illustrates the complementarity of the nucleotide sequences of LOC149684 BINDING SITE, designated SEQ ID:41049, to the nucleotide sequence of VGAM1965 RNA, herein designated VGAM RNA, also designated SEQ ID:4676.

Another function of VGAM1965 is therefore inhibition of LOC149684 (Accession XM_097710). Accordingly, utilities of VGAM1965 include diagnosis, prevention and treatment of diseases and clinical conditions associated with LOC149684. LOC149692 (Accession XM_097706) is another VGAM1965 host target gene. LOC149692 BINDING SITE is HOST TARGET binding site found in the 3' untranslated region of mRNA encoded by LOC149692, corresponding to a HOST TARGET binding site such as BINDING SITE I, BINDING SITE II or BINDING SITE III. Table 2 illustrates the complementarity of the nucleotide sequences of LOC149692 BINDING SITE, designated SEQ ID:41041, to the nucleotide sequence of VGAM1965 RNA, herein designated VGAM RNA, also designated SEQ ID:4676.

Another function of VGAM1965 is therefore inhibition of LOC149692 (Accession XM_097706). Accordingly, utilities of VGAM1965 include diagnosis, prevention and treatment of diseases and clinical conditions associated with LOC149692. LOC149711 (Accession XM_097720) is another VGAM1965 host target gene. LOC149711 BINDING SITE is HOST TARGET binding site found in the 5' untranslated region of mRNA encoded by LOC149711, corresponding to a HOST TARGET binding site such as BINDING SITE I, BINDING SITE II or BINDING SITE III. Table 2 illustrates the complementarity of the nucleotide sequences of LOC149711 BINDING SITE, designated SEQ ID:41076, to the nucleotide sequence of VGAM1965 RNA, herein designated VGAM RNA, also designated SEQ ID:4676.

Another function of VGAM1965 is therefore inhibition of LOC149711 (Accession XM_097720). Accordingly, utilities of VGAM1965 include diagnosis, prevention and treatment of diseases and clinical conditions associated with LOC149711. LOC149722 (Accession XM_097709) is another VGAM1965 host target gene. LOC149722 BINDING SITE is HOST TARGET binding site found in the 5' untranslated region of mRNA encoded by LOC149722, corresponding to a HOST TARGET binding site such as BINDING SITE I, BINDING SITE II or BINDING SITE III. Table 2 illustrates the complementarity of the nucleotide sequences of LOC149722 BINDING SITE, designated SEQ ID:41045, to the nucleotide sequence of VGAM1965 RNA, herein designated VGAM RNA, also designated SEQ ID:4676.

Another function of VGAM1965 is therefore inhibition of LOC149722 (Accession XM_097709). Accordingly, utilities of VGAM1965 include diagnosis, prevention and treatment of diseases and clinical conditions associated with LOC149722. LOC149773 (Accession XM_086628) is another VGAM1965 host target gene. LOC149773 BINDING SITE is HOST TARGET binding site found in the 5' untranslated region of mRNA encoded by LOC149773, corresponding to a HOST TARGET binding site such as BINDING SITE I, BINDING SITE II or BINDING SITE III. Table 2 illustrates the complementarity of the nucleotide sequences of LOC149773 BINDING SITE, designated SEQ ID:38801, to the nucleotide sequence of VGAM1965 RNA, herein designated VGAM RNA, also designated SEQ ID:4676.

Another function of VGAM1965 is therefore inhibition of LOC149773 (Accession XM_086628). Accordingly, utilities of VGAM1965 include diagnosis, prevention and treatment of diseases and clinical conditions associated with LOC149773. LOC150150 (Accession XM_097820) is another VGAM1965 host target gene. LOC150150 BINDING SITE is HOST TARGET binding site found in the 5' untranslated region of mRNA encoded by LOC150150, corresponding to a HOST TARGET binding site such as BINDING SITE I, BINDING SITE II or BINDING SITE III. Table 2 illustrates the complementarity of the nucleotide sequences of LOC150150 BINDING SITE, designated SEQ ID:41137, to the nucleotide sequence of VGAM1965 RNA, herein designated VGAM RNA, also designated SEQ ID:4676.

Another function of VGAM1965 is therefore inhibition of LOC150150 (Accession XM_097820). Accordingly, utilities of VGAM1965 include diagnosis, prevention and treatment of diseases and clinical conditions associated with LOC150150. LOC150299 (Accession XM_097869) is another VGAM1965 host target gene. LOC150299 BINDING SITE is HOST TARGET binding site found in the 3' untranslated region of mRNA encoded by LOC150299, corresponding to a HOST TARGET binding site such as BINDING SITE I, BINDING SITE II or BINDING SITE III. Table 2 illustrates the complementarity of the nucleotide sequences of LOC150299 BINDING SITE, designated SEQ ID:41183, to the nucleotide sequence of VGAM1965 RNA, herein designated VGAM RNA, also designated SEQ ID:4676.

Another function of VGAM1965 is therefore inhibition of LOC150299 (Accession XM_097869). Accordingly, utilities of VGAM1965 include diagnosis, prevention and treatment of diseases and clinical conditions associated with LOC150299. LOC150365 (Accession XM_086847) is another VGAM1965 host target gene. LOC150365 BINDING SITE is HOST TARGET binding site found in the 5' untranslated region of mRNA encoded by LOC150365, corresponding to a HOST TARGET binding site such as BINDING SITE I, BINDING SITE II or BINDING SITE III. Table 2 illustrates the complementarity of the nucleotide sequences of LOC150365 BINDING SITE, designated SEQ ID:38913, to the nucleotide sequence of VGAM1965 RNA, herein designated VGAM RNA, also designated SEQ ID:4676.

Another function of VGAM1965 is therefore inhibition of LOC150365 (Accession XM_086847). Accordingly, utilities of VGAM1965 include diagnosis, prevention and treatment of diseases and clinical conditions associated with LOC150365. LOC150423 (Accession XM_086912) is another VGAM1965 host target gene. LOC150423 BINDING SITE is HOST TARGET binding site found in the 5' untranslated region of mRNA encoded by LOC150423, corresponding to a HOST TARGET binding site such as BINDING SITE I, BINDING SITE II or BINDING SITE III. Table 2 illustrates the complementarity of the nucleotide sequences of LOC150423 BINDING SITE, designated SEQ ID:38969, to the nucleotide sequence of VGAM1965 RNA, herein designated VGAM RNA, also designated SEQ ID:4676.

Another function of VGAM1965 is therefore inhibition of LOC150423 (Accession XM_086912). Accordingly, utilities of VGAM1965 include diagnosis, prevention and treatment of diseases and clinical conditions associated with LOC150423. LOC150468 (Accession XM_086926) is another VGAM1965 host target gene. LOC150468 BINDING SITE is HOST TARGET binding site found in the 3' untranslated region of mRNA encoded by LOC150468, corresponding to a HOST TARGET binding site such as BINDING SITE I, BINDING SITE II or BINDING SITE III. Table 2 illustrates the complementarity of the nucleotide sequences of LOC150468 BINDING SITE, designated SEQ ID:38976, to the nucleotide sequence of VGAM1965 RNA, herein designated VGAM RNA, also designated SEQ ID:4676.

Another function of VGAM1965 is therefore inhibition of LOC150468 (Accession XM_086926). Accordingly, utilities of VGAM1965 include diagnosis, prevention and treatment of diseases and clinical conditions associated with LOC150468. LOC150848 (Accession XM_097959) is another VGAM1965 host target gene. LOC150848 BINDING SITE is HOST TARGET binding site found in the 5' untranslated region of mRNA encoded by LOC150848, corresponding to a HOST TARGET binding site such as BINDING SITE I, BINDING SITE II or BINDING SITE III. Table 2 illustrates the complementarity of the nucleotide sequences of LOC150848 BINDING SITE, designated SEQ ID:41259, to the nucleotide sequence of VGAM1965 RNA, herein designated VGAM RNA, also designated SEQ ID:4676.

Another function of VGAM1965 is therefore inhibition of LOC150848 (Accession XM_097959). Accordingly, utilities of VGAM1965 include diagnosis, prevention and treatment of diseases and clinical conditions associated with LOC150848. LOC150933 (Accession XM_097971) is another VGAM1965 host target gene. LOC150933 BINDING SITE is HOST TARGET binding site found in the 3' untranslated region of mRNA encoded by LOC150933, corresponding to a HOST TARGET binding site such as BINDING SITE I, BINDING SITE II or BINDING SITE III. Table 2 illustrates the complementarity of the nucleotide sequences of LOC150933 BINDING SITE, designated SEQ ID:41272, to the nucleotide sequence of VGAM1965 RNA, herein designated VGAM RNA, also designated SEQ ID:4676.

Another function of VGAM1965 is therefore inhibition of LOC150933 (Accession XM_097971). Accordingly, utilities of VGAM1965 include diagnosis, prevention and treatment of diseases and clinical conditions associated with LOC150933. LOC150998 (Accession XM_097990) is another VGAM1965 host target gene. LOC150998 BINDING SITE is HOST TARGET binding site found in the 3' untranslated region of mRNA encoded by LOC150998, corresponding to a HOST TARGET binding site such as BINDING SITE I, BINDING SITE II or BINDING SITE III. Table 2 illustrates the complementarity of the nucleotide sequences of LOC150998 BINDING SITE, designated SEQ ID:41288, to the nucleotide sequence of VGAM1965 RNA, herein designated VGAM RNA, also designated SEQ ID:4676.

Another function of VGAM1965 is therefore inhibition of LOC150998 (Accession XM_097990). Accordingly, utilities of VGAM1965 include diagnosis, prevention and treatment of diseases and clinical conditions associated with LOC150998. LOC151124 (Accession XM_098006) is another VGAM1965 host target gene. LOC151124 BINDING SITE is HOST TARGET binding site found in the 5' untranslated region of mRNA encoded by LOC151124, corresponding to a HOST TARGET binding site such as BINDING SITE I, BINDING SITE II or BINDING SITE III. Table 2 illustrates the complementarity of the nucleotide sequences of LOC151124 BINDING SITE, designated SEQ ID:41303, to the nucleotide sequence of VGAM1965 RNA, herein designated VGAM RNA, also designated SEQ ID:4676.

Another function of VGAM1965 is therefore inhibition of LOC151124 (Accession XM_098006). Accordingly, utilities of VGAM1965 include diagnosis, prevention and treatment of diseases and clinical conditions associated with LOC151124. LOC151126 (Accession XM_087103) is another VGAM1965 host target gene. LOC151126 BINDING SITE is HOST TARGET binding site found in the 3' untranslated region of mRNA encoded by LOC151126, corresponding to a HOST TARGET binding site such as BIND- ING SITE I, BINDING SITE II or BINDING SITE III. Table 2 illustrates the complementarity of the nucleotide sequences of LOC151126 BINDING SITE, designated SEQ ID:39059, to the nucleotide sequence of VGAM1965 RNA, herein designated VGAM RNA, also designated SEQ ID:4676.

Another function of VGAM1965 is therefore inhibition of LOC151126 (Accession XM_087103). Accordingly, utilities of VGAM1965 include diagnosis, prevention and treatment of diseases and clinical conditions associated with LOC151126. LOC151146 (Accession XM_087106) is another VGAM1965 host target gene. LOC151146 BINDING SITE is HOST TARGET binding site found in the 5' untranslated region of mRNA encoded by LOC151146, corresponding to a HOST TARGET binding site such as BINDING SITE I, BINDING SITE II or BINDING SITE III. Table 2 illustrates the complementarity of the nucleotide sequences of LOC151146 BINDING SITE, designated SEQ ID:39062, to the nucleotide sequence of VGAM1965 RNA, herein designated VGAM RNA, also designated SEQ ID:4676.

Another function of VGAM1965 is therefore inhibition of LOC151146 (Accession XM_087106). Accordingly, utilities of VGAM1965 include diagnosis, prevention and treatment of diseases and clinical conditions associated with LOC151146. LOC151201 (Accession XM_098021) is another VGAM1965 host target gene. LOC151201 BINDING SITE is HOST TARGET binding site found in the 3' untranslated region of mRNA encoded by LOC151201, corresponding to a HOST TARGET binding site such as BINDING SITE I, BINDING SITE II or BINDING SITE III. Table 2 illustrates the complementarity of the nucleotide sequences of LOC151201 BINDING SITE, designated SEQ ID:41322, to the nucleotide sequence of VGAM1965 RNA, herein designated VGAM RNA, also designated SEQ ID:4676.

Another function of VGAM1965 is therefore inhibition of LOC151201 (Accession XM_098021). Accordingly, utilities of VGAM1965 include diagnosis, prevention and treatment of diseases and clinical conditions associated with LOC151201. LOC151405 (Accession XM_098058) is another VGAM1965 host target gene. LOC151405 BINDING SITE is HOST TARGET binding site found in the 5' untranslated region of mRNA encoded by LOC151405, corresponding to a HOST TARGET binding site such as BINDING SITE I, BINDING SITE II or BINDING SITE III. Table 2 illustrates the complementarity of the nucleotide sequences of LOC151405 BINDING SITE, designated SEQ ID:41340, to the nucleotide sequence of VGAM1965 RNA, herein designated VGAM RNA, also designated SEQ ID:4676.

Another function of VGAM1965 is therefore inhibition of LOC151405 (Accession XM_098058). Accordingly, utilities of VGAM1965 include diagnosis, prevention and treatment of diseases and clinical conditions associated with LOC151405. LOC151446 (Accession XM_098061) is another VGAM1965 host target gene. LOC151446 BINDING SITE is HOST TARGET binding site found in the 5' untranslated region of mRNA encoded by LOC151446, corresponding to a HOST TARGET binding site such as BINDING SITE I, BINDING SITE II or BINDING SITE III. Table 2 illustrates the complementarity of the nucleotide sequences of LOC151446 BINDING SITE, designated SEQ ID:41352, to the nucleotide sequence of VGAM1965 RNA, herein designated VGAM RNA, also designated SEQ ID:4676.

Another function of VGAM1965 is therefore inhibition of LOC151446 (Accession XM_098061). Accordingly, utilities of VGAM1965 include diagnosis, prevention and treatment of diseases and clinical conditions associated with LOC151446. LOC151568 (Accession NM_138483) is another VGAM1965 host target gene. LOC151568 BINDING SITE is HOST TARGET binding site found in the 5' untranslated region of mRNA encoded by LOC151568, corresponding to a HOST TARGET binding site such as BINDING SITE I, BINDING SITE II or BINDING SITE III. Table 2 illustrates the complementarity of the nucleotide sequences of LOC151568 BINDING SITE, designated SEQ ID:28839, to the nucleotide sequence of VGAM1965 RNA, herein designated VGAM RNA, also designated SEQ ID:4676.

Another function of VGAM1965 is therefore inhibition of LOC151568 (Accession NM_138483). Accordingly, utilities of VGAM1965 include diagnosis, prevention and treatment of diseases and clinical conditions associated with LOC151568. LOC151602 (Accession XM_087247) is another VGAM1965 host target gene. LOC151602 BINDING SITE is HOST TARGET binding site found in the 3' untranslated region of mRNA encoded by LOC151602, corresponding to a HOST TARGET binding site such as BINDING SITE I, BINDING SITE II or BINDING SITE III. Table 2 illustrates the complementarity of the nucleotide sequences of LOC151602 BINDING SITE, designated SEQ ID:39140, to the nucleotide sequence of VGAM1965 RNA, herein designated VGAM RNA, also designated SEQ ID:4676.

Another function of VGAM1965 is therefore inhibition of LOC151602 (Accession XM_087247). Accordingly, utilities of VGAM1965 include diagnosis, prevention and treatment of diseases and clinical conditions associated with LOC151602. LOC151643 (Accession XM_087259) is another VGAM1965 host target gene. LOC151643 BINDING SITE is HOST TARGET binding site found in the 3' untranslated region of mRNA encoded by LOC151643, corresponding to a HOST TARGET binding site such as BINDING SITE I, BINDING SITE II or BINDING SITE III. Table 2 illustrates the complementarity of the nucleotide sequences of LOC151643 BINDING SITE, designated SEQ ID:39152, to the nucleotide sequence of VGAM1965 RNA, herein designated VGAM RNA, also designated SEQ ID:4676.

Another function of VGAM1965 is therefore inhibition of LOC151643 (Accession XM_087259). Accordingly, utilities of VGAM1965 include diagnosis, prevention and treatment of diseases and clinical conditions associated with LOC151643. LOC151904 (Accession XM_087334) is another VGAM1965 host target gene. LOC151904 BINDING SITE is HOST TARGET binding site found in the 5' untranslated region of mRNA encoded by LOC151904, corresponding to a HOST TARGET binding site such as BINDING SITE I, BINDING SITE II or BINDING SITE III. Table 2 illustrates the complementarity of the nucleotide sequences of LOC151904 BINDING SITE, designated SEQ ID:39174, to the nucleotide sequence of VGAM1965 RNA, herein designated VGAM RNA, also designated SEQ ID:4676.

Another function of VGAM1965 is therefore inhibition of LOC151904 (Accession XM_087334). Accordingly, utilities of VGAM1965 include diagnosis, prevention and treatment of diseases and clinical conditions associated with LOC151904. LOC151959 (Accession XM_098144) is another VGAM1965 host target gene. LOC151959 BINDING SITE is HOST TARGET binding site found in the 3' untranslated region of mRNA encoded by LOC151959, corresponding to a HOST TARGET binding site such as BINDING SITE I, BINDING SITE II or BINDING SITE III. Table 2 illustrates the complementarity of the nucleotide sequences of LOC151959 BINDING SITE, designated SEQ ID:41410, to the nucleotide sequence of VGAM1965 RNA, herein designated VGAM RNA, also designated SEQ ID:4676.

Another function of VGAM1965 is therefore inhibition of LOC151959 (Accession XM_098144). Accordingly, utilities of VGAM1965 include diagnosis, prevention and treatment of diseases and clinical conditions associated with LOC151959. LOC152018 (Accession XM_098156) is another VGAM1965 host target gene. LOC152018 BINDING SITE is HOST TARGET binding site found in the 3' untranslated region of mRNA encoded by LOC152018, corresponding to a HOST TARGET binding site such as BINDING SITE I, BINDING SITE II or BINDING SITE III. Table 2 illustrates the complementarity of the nucleotide sequences of LOC152018 BINDING SITE, designated SEQ ID:41423, to the nucleotide sequence of VGAM1965 RNA, herein designated VGAM RNA, also designated SEQ ID:4676.

Another function of VGAM1965 is therefore inhibition of LOC152018 (Accession XM_098156). Accordingly, utilities of VGAM1965 include diagnosis, prevention and treatment of diseases and clinical conditions associated with LOC152018. LOC152137 (Accession XM_087392) is another VGAM1965 host target gene. LOC152137 BINDING SITE is HOST TARGET binding site found in the 3' untranslated region of mRNA encoded by LOC152137, corresponding to a HOST TARGET binding site such as BINDING SITE I, BINDING SITE II or BINDING SITE III. Table 2 illustrates the complementarity of the nucleotide sequences of LOC152137 BINDING SITE, designated SEQ ID:39223, to the nucleotide sequence of VGAM1965 RNA, herein designated VGAM RNA, also designated SEQ ID:4676.

Another function of VGAM1965 is therefore inhibition of LOC152137 (Accession XM_087392). Accordingly, utilities of VGAM1965 include diagnosis, prevention and treatment of diseases and clinical conditions associated with LOC152137. LOC152315 (Accession XM_087440) is another VGAM1965 host target gene. LOC152315 BINDING SITE is HOST TARGET binding site found in the 5' untranslated region of mRNA encoded by LOC152315, corresponding to a HOST TARGET binding site such as BINDING SITE I, BINDING SITE II or BINDING SITE III. Table 2 illustrates the complementarity of the nucleotide sequences of LOC152315 BINDING SITE, designated SEQ ID:39255, to the nucleotide sequence of VGAM1965 RNA, herein designated VGAM RNA, also designated SEQ ID:4676.

Another function of VGAM1965 is therefore inhibition of LOC152315 (Accession XM_087440). Accordingly, utilities of VGAM1965 include diagnosis, prevention and treatment of diseases and clinical conditions associated with LOC152315. LOC152345 (Accession XM_087442) is another VGAM1965 host target gene. LOC152345 BINDING SITE is HOST TARGET binding site found in the 3' untranslated region of mRNA encoded by LOC152345, corresponding to a HOST TARGET binding site such as BINDING SITE I, BINDING SITE II or BINDING SITE III. Table 2 illustrates the complementarity of the nucleotide sequences of LOC152345 BINDING SITE, designated SEQ ID:39268, to the nucleotide sequence of VGAM1965 RNA, herein designated VGAM RNA, also designated SEQ ID:4676.

Another function of VGAM1965 is therefore inhibition of LOC152345 (Accession XM_087442). Accordingly, utilities of VGAM1965 include diagnosis, prevention and treatment of diseases and clinical conditions associated with LOC152345. LOC152627 (Accession XM_087495) is another VGAM1965 host target gene. LOC152627 BINDING SITE is HOST TARGET binding site found in the 5' untranslated region of mRNA encoded by LOC152627, corresponding to a HOST TARGET binding site such as BINDING SITE I, BINDING SITE II or BINDING SITE III. Table 2 illustrates the complementarity of the nucleotide sequences of LOC152627 BINDING SITE, designated SEQ ID:39296, to the nucleotide sequence of VGAM1965 RNA, herein designated VGAM RNA, also designated SEQ ID:4676.

Another function of VGAM1965 is therefore inhibition of LOC152627 (Accession XM_087495). Accordingly, utilities of VGAM1965 include diagnosis, prevention and treatment of diseases and clinical conditions associated with LOC152627. LOC152804 (Accession XM_098266) is another VGAM1965 host target gene. LOC152804 BINDING SITE1 and LOC152804 BINDING SITE2 are HOST TARGET binding sites found in untranslated regions of mRNA encoded by LOC152804, corresponding to HOST TARGET binding sites such as BINDING SITE I, BINDING SITE II or BINDING SITE III. Table 2 illustrates the complementarity of the nucleotide sequences of LOC152804 BINDING SITE1 and LOC152804 BINDING SITE2, designated SEQ ID:41557 and SEQ ID:41558 respectively, to the nucleotide sequence of VGAM1965 RNA, herein designated VGAM RNA, also designated SEQ ID:4676.

Another function of VGAM1965 is therefore inhibition of LOC152804 (Accession XM_098266). Accordingly, utilities of VGAM1965 include diagnosis, prevention and treatment of diseases and clinical conditions associated with LOC152804. LOC152860 (Accession XM_087539) is another VGAM1965 host target gene. LOC152860 BINDING SITE is HOST TARGET binding site found in the 3' untranslated region of mRNA encoded by LOC152860, corresponding to a HOST TARGET binding site such as BINDING SITE I, BINDING SITE II or BINDING SITE III. Table 2 illustrates the complementarity of the nucleotide sequences of LOC152860 BINDING SITE, designated SEQ ID:39326, to the nucleotide sequence of VGAM1965 RNA, herein designated VGAM RNA, also designated SEQ ID:4676.

Another function of VGAM1965 is therefore inhibition of LOC152860 (Accession XM_087539). Accordingly, utilities of VGAM1965 include diagnosis, prevention and treatment of diseases and clinical conditions associated with LOC152860. LOC153516 (Accession NM_138491) is another VGAM1965 host target gene. LOC153516 BINDING SITE is HOST TARGET binding site found in the 5' untranslated region of mRNA encoded by LOC153516, corresponding to a HOST TARGET binding site such as BINDING SITE I, BINDING SITE II or BINDING SITE III. Table 2 illustrates the complementarity of the nucleotide sequences of LOC153516 BINDING SITE, designated SEQ ID:28843, to the nucleotide sequence of VGAM1965 RNA, herein designated VGAM RNA, also designated SEQ ID:4676.

Another function of VGAM1965 is therefore inhibition of LOC153516 (Accession NM_138491). Accordingly, utilities of VGAM1965 include diagnosis, prevention and treatment of diseases and clinical conditions associated with LOC153516. LOC153688 (Accession XM_098416) is another VGAM1965 host target gene. LOC153688 BINDING SITE is HOST TARGET binding site found in the 3' untranslated region of mRNA encoded by LOC153688, corresponding to a HOST TARGET binding site such as BINDING SITE I, BINDING SITE II or BINDING SITE III. Table 2 illustrates the complementarity of the nucleotide sequences of LOC153688 BINDING SITE, designated SEQ ID:41662, to the nucleotide sequence of VGAM1965 RNA, herein designated VGAM RNA, also designated SEQ ID:4676.

Another function of VGAM1965 is therefore inhibition of LOC153688 (Accession XM_098416). Accordingly, utilities of VGAM1965 include diagnosis, prevention and treatment of diseases and clinical conditions associated with LOC153688. LOC153810 (Accession XM_087778) is another VGAM1965 host target gene. LOC153810 BINDING SITE is HOST TARGET binding site found in the 3' untranslated region of mRNA encoded by LOC153810, corresponding to a HOST TARGET binding site such as BIND- ING SITE I, BINDING SITE II or BINDING SITE III. Table 2 illustrates the complementarity of the nucleotide sequences of LOC153810 BINDING SITE, designated SEQ ID:39413, to the nucleotide sequence of VGAM1965 RNA, herein designated VGAM RNA, also designated SEQ ID:4676.

Another function of VGAM1965 is therefore inhibition of LOC153810 (Accession XM_087778). Accordingly, utilities of VGAM1965 include diagnosis, prevention and treatment of diseases and clinical conditions associated with LOC153810. LOC153811 (Accession XM_087779) is another VGAM1965 host target gene. LOC153811 BINDING SITE is HOST TARGET binding site found in the 3' untranslated region of mRNA encoded by LOC153811, corresponding to a HOST TARGET binding site such as BINDING SITE I, BINDING SITE II or BINDING SITE III. Table 2 illustrates the complementarity of the nucleotide sequences of LOC153811 BINDING SITE, designated SEQ ID:39419, to the nucleotide sequence of VGAM1965 RNA, herein designated VGAM RNA, also designated SEQ ID:4676.

Another function of VGAM1965 is therefore inhibition of LOC153811 (Accession XM_087779). Accordingly, utilities of VGAM1965 include diagnosis, prevention and treatment of diseases and clinical conditions associated with LOC153811. LOC153910 (Accession XM_087801) is another VGAM1965 host target gene. LOC153910 BINDING SITE is HOST TARGET binding site found in the 5' untranslated region of mRNA encoded by LOC153910, corresponding to a HOST TARGET binding site such as BINDING SITE I, BINDING SITE II or BINDING SITE III. Table 2 illustrates the complementarity of the nucleotide sequences of LOC153910 BINDING SITE, designated SEQ ID:39440, to the nucleotide sequence of VGAM1965 RNA, herein designated VGAM RNA, also designated SEQ ID:4676.

Another function of VGAM1965 is therefore inhibition of LOC153910 (Accession XM_087801). Accordingly, utilities of VGAM1965 include diagnosis, prevention and treatment of diseases and clinical conditions associated with LOC153910. LOC154222 (Accession XM_098497) is another VGAM1965 host target gene. LOC154222 BINDING SITE is HOST TARGET binding site found in the 3' untranslated region of mRNA encoded by LOC154222, corresponding to a HOST TARGET binding site such as BINDING SITE I, BINDING SITE II or BINDING SITE III. Table 2 illustrates the complementarity of the nucleotide sequences of LOC154222 BINDING SITE, designated SEQ ID:41694, to the nucleotide sequence of VGAM1965 RNA, herein designated VGAM RNA, also designated SEQ ID:4676.

Another function of VGAM1965 is therefore inhibition of LOC154222 (Accession XM_098497). Accordingly, utilities of VGAM1965 include diagnosis, prevention and treatment of diseases and clinical conditions associated with LOC154222. LOC154739 (Accession XM_098602) is another VGAM1965 host target gene. LOC154739 BINDING SITE is HOST TARGET binding site found in the 5' untranslated region of mRNA encoded by LOC154739, corresponding to a HOST TARGET binding site such as BINDING SITE I, BINDING SITE II or BINDING SITE III. Table 2 illustrates the complementarity of the nucleotide sequences of LOC154739 BINDING SITE, designated SEQ ID:41710, to the nucleotide sequence of VGAM1965 RNA, herein designated VGAM RNA, also designated SEQ ID:4676.

Another function of VGAM1965 is therefore inhibition of LOC154739 (Accession XM_098602). Accordingly, utilities of VGAM1965 include diagnosis, prevention and treatment of diseases and clinical conditions associated with LOC154739. LOC155060 (Accession XM_098650) is another VGAM1965 host target gene. LOC155060 BINDING SITE is HOST TARGET binding site found in the 3' untranslated region of mRNA encoded by LOC155060, corresponding to a HOST TARGET binding site such as BINDING SITE I, BINDING SITE II or BINDING SITE III. Table 2 illustrates the complementarity of the nucleotide sequences of LOC155060 BINDING SITE, designated SEQ ID:41751, to the nucleotide sequence of VGAM1965 RNA, herein designated VGAM RNA, also designated SEQ ID:4676.

Another function of VGAM1965 is therefore inhibition of LOC155060 (Accession XM_098650). Accordingly, utilities of VGAM1965 include diagnosis, prevention and treatment of diseases and clinical conditions associated with LOC155060. LOC155179 (Accession XM_088169) is another VGAM1965 host target gene. LOC155179 BINDING SITE is HOST TARGET binding site found in the 3' untranslated region of mRNA encoded by LOC155179, corresponding to a HOST TARGET binding site such as BINDING SITE I, BINDING SITE II or BINDING SITE III. Table 2 illustrates the complementarity of the nucleotide sequences of LOC155179 BINDING SITE, designated SEQ ID:39561, to the nucleotide sequence of VGAM1965 RNA, herein designated VGAM RNA, also designated SEQ ID:4676.

Another function of VGAM1965 is therefore inhibition of LOC155179 (Accession XM_088169). Accordingly, utilities of VGAM1965 include diagnosis, prevention and treatment of diseases and clinical conditions associated with LOC155179. LOC157381 (Accession XM_098754) is another VGAM1965 host target gene. LOC157381 BINDING SITE is HOST TARGET binding site found in the 3' untranslated region of mRNA encoded by LOC157381, corresponding to a HOST TARGET binding site such as BINDING SITE I, BINDING SITE II or BINDING SITE III. Table 2 illustrates the complementarity of the nucleotide sequences of LOC157381 BINDING SITE, designated SEQ ID:41791, to the nucleotide sequence of VGAM1965 RNA, herein designated VGAM RNA, also designated SEQ ID:4676.

Another function of VGAM1965 is therefore inhibition of LOC157381 (Accession XM_098754). Accordingly, utilities of VGAM1965 include diagnosis, prevention and treatment of diseases and clinical conditions associated with LOC157381. LOC157506 (Accession XM_088311) is another VGAM1965 host target gene. LOC157506 BINDING SITE is HOST TARGET binding site found in the 3' untranslated region of mRNA encoded by LOC157506, corresponding to a HOST TARGET binding site such as BINDING SITE I, BINDING SITE II or BINDING SITE III. Table 2 illustrates the complementarity of the nucleotide sequences of LOC157506 BINDING SITE, designated SEQ ID:39602, to the nucleotide sequence of VGAM1965 RNA, herein designated VGAM RNA, also designated SEQ ID:4676.

Another function of VGAM1965 is therefore inhibition of LOC157506 (Accession XM_088311). Accordingly, utilities of VGAM1965 include diagnosis, prevention and treatment of diseases and clinical conditions associated with LOC157506. LOC157621 (Accession XM_098800) is another VGAM1965 host target gene. LOC157621 BINDING SITE is HOST TARGET binding site found in the 3' untranslated region of mRNA encoded by LOC157621, corresponding to a HOST TARGET binding site such as BINDING SITE I, BINDING SITE II or BINDING SITE III. Table 2 illustrates the complementarity of the nucleotide sequences of LOC157621 BINDING SITE, designated SEQ ID:41825, to the nucleotide sequence of VGAM1965 RNA, herein designated VGAM RNA, also designated SEQ ID:4676.

Another function of VGAM1965 is therefore inhibition of LOC157621 (Accession XM_098800). Accordingly, utilities of VGAM1965 include diagnosis, prevention and treatment of diseases and clinical conditions associated with LOC157621. LOC157624 (Accession XM_098801) is another VGAM1965 host target gene. LOC157624 BINDING SITE is HOST TARGET binding site found in the 5' untranslated region of mRNA encoded by LOC157624, corresponding to a HOST TARGET binding site such as BINDING SITE I, BINDING SITE II or BINDING SITE III. Table 2 illustrates the complementarity of the nucleotide sequences of LOC157624 BINDING SITE, designated SEQ ID:41827, to the nucleotide sequence of VGAM1965 RNA, herein designated VGAM RNA, also designated SEQ ID:4676.

Another function of VGAM1965 is therefore inhibition of LOC157624 (Accession XM_098801). Accordingly, utilities of VGAM1965 include diagnosis, prevention and treatment of diseases and clinical conditions associated with LOC157624. LOC158055 (Accession XM_088453) is another VGAM1965 host target gene. LOC158055 BINDING SITE is HOST TARGET binding site found in the 3' untranslated region of mRNA encoded by LOC158055, corresponding to a HOST TARGET binding site such as BINDING SITE I, BINDING SITE II or BINDING SITE III. Table 2 illustrates the complementarity of the nucleotide sequences of LOC158055 BINDING SITE, designated SEQ ID:39707, to the nucleotide sequence of VGAM1965 RNA, herein designated VGAM RNA, also designated SEQ ID:4676.

Another function of VGAM1965 is therefore inhibition of LOC158055 (Accession XM_088453). Accordingly, utilities of VGAM1965 include diagnosis, prevention and treatment of diseases and clinical conditions associated with LOC158055. LOC158056 (Accession XM_088463) is another VGAM1965 host target gene. LOC158056 BINDING SITE is HOST TARGET binding site found in the 5' untranslated region of mRNA encoded by LOC158056, corresponding to a HOST TARGET binding site such as BINDING SITE I, BINDING SITE II or BINDING SITE III. Table 2 illustrates the complementarity of the nucleotide sequences of LOC158056 BINDING SITE, designated SEQ ID:39715, to the nucleotide sequence of VGAM1965 RNA, herein designated VGAM RNA, also designated SEQ ID:4676.

Another function of VGAM1965 is therefore inhibition of LOC158056 (Accession XM_088463). Accordingly, utilities of VGAM1965 include diagnosis, prevention and treatment of diseases and clinical conditions associated with LOC158056. LOC158301 (Accession XM_088543) is another VGAM1965 host target gene. LOC158301 BINDING SITE is HOST TARGET binding site found in the 3' untranslated region of mRNA encoded by LOC158301, corresponding to a HOST TARGET binding site such as BINDING SITE I, BINDING SITE II or BINDING SITE III. Table 2 illustrates the complementarity of the nucleotide sequences of LOC158301 BINDING SITE, designated SEQ ID:39812, to the nucleotide sequence of VGAM1965 RNA, herein designated VGAM RNA, also designated SEQ ID:4676.

Another function of VGAM1965 is therefore inhibition of LOC158301 (Accession XM_088543). Accordingly, utilities of VGAM1965 include diagnosis, prevention and treatment of diseases and clinical conditions associated with LOC158301. LOC158308 (Accession XM_098917) is another VGAM1965 host target gene. LOC158308 BINDING SITE is HOST TARGET binding site found in the 5' untranslated region of mRNA encoded by LOC158308, corresponding to a HOST TARGET binding site such as BINDING SITE I, BINDING SITE II or BINDING SITE III. Table 2 illustrates the complementarity of the nucleotide sequences of LOC158308 BINDING SITE, designated SEQ ID:41942, to the nucleotide sequence of VGAM1965 RNA, herein designated VGAM RNA, also designated SEQ ID:4676.

Another function of VGAM1965 is therefore inhibition of LOC158308 (Accession XM_098917). Accordingly, utilities of VGAM1965 include diagnosis, prevention and treatment of diseases and clinical conditions associated with LOC158308. LOC158332 (Accession XM_088554) is another VGAM1965 host target gene. LOC158332 BINDING SITE is HOST TARGET binding site found in the 3' untranslated region of mRNA encoded by LOC158332, corresponding to a HOST TARGET binding site such as BINDING SITE I, BINDING SITE II or BINDING SITE III. Table 2 illustrates the complementarity of the nucleotide sequences of LOC158332 BINDING SITE, designated SEQ ID:39826, to the nucleotide sequence of VGAM1965 RNA, herein designated VGAM RNA, also designated SEQ ID:4676.

Another function of VGAM1965 is therefore inhibition of LOC158332 (Accession XM_088554). Accordingly, utilities of VGAM1965 include diagnosis, prevention and treatment of diseases and clinical conditions associated with LOC158332. LOC158382 (Accession XM_098931) is another VGAM1965 host target gene. LOC158382 BINDING SITE is HOST TARGET binding site found in the 5' untranslated region of mRNA encoded by LOC158382, corresponding to a HOST TARGET binding site such as BINDING SITE I, BINDING SITE II or BINDING SITE III. Table 2 illustrates the complementarity of the nucleotide sequences of LOC158382 BINDING SITE, designated SEQ ID:41969, to the nucleotide sequence of VGAM1965 RNA, herein designated VGAM RNA, also designated SEQ ID:4676.

Another function of VGAM1965 is therefore inhibition of LOC158382 (Accession XM_098931). Accordingly, utilities of VGAM1965 include diagnosis, prevention and treatment of diseases and clinical conditions associated with LOC158382. LOC158427 (Accession NM_139246) is another VGAM1965 host target gene. LOC158427 BINDING SITE is HOST TARGET binding site found in the 5' untranslated region of mRNA encoded by LOC158427, corresponding to a HOST TARGET binding site such as BINDING SITE I, BINDING SITE II or BINDING SITE III. Table 2 illustrates the complementarity of the nucleotide sequences of LOC158427 BINDING SITE, designated SEQ ID:29248, to the nucleotide sequence of VGAM1965 RNA, herein designated VGAM RNA, also designated SEQ ID:4676.

Another function of VGAM1965 is therefore inhibition of LOC158427 (Accession NM_139246). Accordingly, utilities of VGAM1965 include diagnosis, prevention and treatment of diseases and clinical conditions associated with LOC158427. LOC158490 (Accession XM_088585) is another VGAM1965 host target gene. LOC158490 BINDING SITE is HOST TARGET binding site found in the 3' untranslated region of mRNA encoded by LOC158490, corresponding to a HOST TARGET binding site such as BINDING SITE I, BINDING SITE II or BINDING SITE III. Table 2 illustrates the complementarity of the nucleotide sequences of LOC158490 BINDING SITE, designated SEQ ID:39849, to the nucleotide sequence of VGAM1965 RNA, herein designated VGAM RNA, also designated SEQ ID:4676.

Another function of VGAM1965 is therefore inhibition of LOC158490 (Accession XM_088585). Accordingly, utilities of VGAM1965 include diagnosis, prevention and treatment of diseases and clinical conditions associated with LOC158490. LOC158527 (Accession XM_088594) is another VGAM1965 host target gene. LOC158527 BINDING SITE is HOST TARGET binding site found in the 5' untranslated region of mRNA encoded by LOC158527, corresponding to a HOST TARGET binding site such as BINDING SITE I, BINDING SITE II or BINDING SITE III. Table 2 illustrates the complementarity of the nucleotide sequences of LOC158527 BINDING SITE, designated SEQ ID:39864, to the nucleotide sequence of VGAM1965 RNA, herein designated VGAM RNA, also designated SEQ ID:4676.

Another function of VGAM1965 is therefore inhibition of LOC158527 (Accession XM_088594). Accordingly, utilities of VGAM1965 include diagnosis, prevention and treatment of diseases and clinical conditions associated with LOC158527. LOC158987 (Accession XM_099015) is another VGAM1965 host target gene. LOC158987 BINDING SITE is HOST TARGET binding site found in the 3' untranslated region of mRNA encoded by LOC158987, corresponding to a HOST TARGET binding site such as BINDING SITE I, BINDING SITE II or BINDING SITE III. Table 2 illustrates the complementarity of the nucleotide sequences of LOC158987 BINDING SITE, designated SEQ ID:42051, to the nucleotide sequence of VGAM1965 RNA, herein designated VGAM RNA, also designated SEQ ID:4676.

Another function of VGAM1965 is therefore inhibition of LOC158987 (Accession XM_099015). Accordingly, utilities of VGAM1965 include diagnosis, prevention and treatment of diseases and clinical conditions associated with LOC158987. LOC161527 (Accession XM_090960) is another VGAM1965 host target gene. LOC161527 BINDING SITE is HOST TARGET binding site found in the 5' untranslated region of mRNA encoded by LOC161527, corresponding to a HOST TARGET binding site such as BINDING SITE I, BINDING SITE II or BINDING SITE III. Table 2 illustrates the complementarity of the nucleotide sequences of LOC161527 BINDING SITE, designated SEQ ID:40020, to the nucleotide sequence of VGAM1965 RNA, herein designated VGAM RNA, also designated SEQ ID:4676.

Another function of VGAM1965 is therefore inhibition of LOC161527 (Accession XM_090960). Accordingly, utilities of VGAM1965 include diagnosis, prevention and treatment of diseases and clinical conditions associated with LOC161527. LOC161829 (Accession XM_091161) is another VGAM1965 host target gene. LOC161829 BINDING SITE1 and LOC161829 BINDING SITE2 are HOST TARGET binding sites found in untranslated regions of mRNA encoded by LOC161829, corresponding to HOST TARGET binding sites such as BINDING SITE I, BINDING SITE II or BINDING SITE III. Table 2 illustrates the complementarity of the nucleotide sequences of LOC161829 BINDING SITE1 and LOC161829 BINDING SITE2, designated SEQ ID:40036 and SEQ ID:40041 respectively, to the nucleotide sequence of VGAM1965 RNA, herein designated VGAM RNA, also designated SEQ ID:4676.

Another function of VGAM1965 is therefore inhibition of LOC161829 (Accession XM_091161). Accordingly, utilities of VGAM1965 include diagnosis, prevention and treatment of diseases and clinical conditions associated with LOC161829. LOC162333 (Accession XM_102591) is another VGAM1965 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42139, to the nucleotide sequence of VGAM1965 RNA, herein designated VGAM RNA, also designated SEQ ID:4676.

Another function of VGAM1965 is therefore inhibition of LOC162333 (Accession XM_102591). Accordingly, utilities of VGAM1965 include diagnosis, prevention and treatment of diseases and clinical conditions associated with LOC162333. LOC170106 (Accession XM_093106) is another VGAM1965 host target gene. LOC170106 BINDING SITE is HOST TARGET binding site found in the 5' untranslated region of mRNA encoded by LOC170106, corresponding to a HOST TARGET binding site such as BINDING SITE I, BINDING SITE II or BINDING SITE III. Table 2 illustrates the complementarity of the nucleotide sequences of LOC170106 BINDING SITE, designated SEQ ID:40175, to the nucleotide sequence of VGAM1965 RNA, herein designated VGAM RNA, also designated SEQ ID:4676.

Another function of VGAM1965 is therefore inhibition of LOC170106 (Accession XM_093106). Accordingly, utilities of VGAM1965 include diagnosis, prevention and treatment of diseases and clinical conditions associated with LOC170106. LOC170409 (Accession XM_096330) is another VGAM1965 host target gene. LOC170409 BINDING SITE is HOST TARGET binding site found in the 3' untranslated region of mRNA encoded by LOC170409, corresponding to a HOST TARGET binding site such as BINDING SITE I, BINDING SITE II or BINDING SITE III. Table 2 illustrates the complementarity of the nucleotide sequences of LOC170409 BINDING SITE, designated SEQ ID:40316, to the nucleotide sequence of VGAM1965 RNA, herein designated VGAM RNA, also designated SEQ ID:4676.

Another function of VGAM1965 is therefore inhibition of LOC170409 (Accession XM_096330). Accordingly, utilities of VGAM1965 include diagnosis, prevention and treatment of diseases and clinical conditions associated with LOC170409. LOC196477 (Accession XM_113728) is another VGAM1965 host target gene. LOC196477 BINDING SITE is HOST TARGET binding site found in the 3' untranslated region of mRNA encoded by LOC196477, corresponding to a HOST TARGET binding site such as BINDING SITE I, BINDING SITE II or BINDING SITE III. Table 2 illustrates the complementarity of the nucleotide sequences of LOC196477 BINDING SITE, designated SEQ ID:42377, to the nucleotide sequence of VGAM1965 RNA, herein designated VGAM RNA, also designated SEQ ID:4676.

Another function of VGAM1965 is therefore inhibition of LOC196477 (Accession XM_113728). Accordingly, utilities of VGAM1965 include diagnosis, prevention and treatment of diseases and clinical conditions associated with LOC196477. LOC196484 (Accession XM_031807) is another VGAM1965 host target gene. LOC196484 BINDING SITE is HOST TARGET binding site found in the 5' untranslated region of mRNA encoded by LOC196484, corresponding to a HOST TARGET binding site such as BINDING SITE I, BINDING SITE II or BINDING SITE III. Table 2 illustrates the complementarity of the nucleotide sequences of LOC196484 BINDING SITE, designated SEQ ID:31486, to the nucleotide sequence of VGAM1965 RNA, herein designated VGAM RNA, also designated SEQ ID:4676.

Another function of VGAM1965 is therefore inhibition of LOC196484 (Accession XM_031807). Accordingly, utilities of VGAM1965 include diagnosis, prevention and treatment of diseases and clinical conditions associated with LOC196484. LOC196955 (Accession XM_085210) is another VGAM1965 host target gene. LOC196955 BINDING SITE is HOST TARGET binding site found in the 5' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37939, to the nucleotide sequence of VGAM1965 RNA, herein designated VGAM RNA, also designated SEQ ID:4676.

Another function of VGAM1965 is therefore inhibition of LOC196955 (Accession XM_085210). Accordingly, utilities of VGAM1965 include diagnosis, prevention and treatment of diseases and clinical conditions associated with LOC196955. LOC197196 (Accession XM_117003) is another VGAM1965 host target gene. LOC197196 BINDING SITE is HOST TARGET binding site found in the 5' untranslated region of mRNA encoded by LOC197196, corresponding to a HOST TARGET binding site such as BINDING SITE I, BINDING SITE II or BINDING SITE III. Table 2 illustrates the complementarity of the nucleotide sequences of LOC197196 BINDING SITE, designated SEQ ID:43203, to the nucleotide sequence of VGAM1965 RNA, herein designated VGAM RNA, also designated SEQ ID:4676.

Another function of VGAM1965 is therefore inhibition of LOC197196 (Accession XM_117003). Accordingly, utilities of VGAM1965 include diagnosis, prevention and treatment of diseases and clinical conditions associated with LOC197196. LOC197201 (Accession XM_113839) is another VGAM1965 host target gene. LOC197201 BINDING SITE is HOST TARGET binding site found in the 3' untranslated region of mRNA encoded by LOC197201, corresponding to a HOST TARGET binding site such as BINDING SITE I, BINDING SITE II or BINDING SITE III. Table 2 illustrates the complementarity of the nucleotide sequences of LOC197201 BINDING SITE, designated SEQ ID:42466, to the nucleotide sequence of VGAM1965 RNA, herein designated VGAM RNA, also designated SEQ ID:4676.

Another function of VGAM1965 is therefore inhibition of LOC197201 (Accession XM_113839). Accordingly, utilities of VGAM1965 include diagnosis, prevention and treatment of diseases and clinical conditions associated with LOC197201. LOC197342 (Accession XM_113869) is another VGAM1965 host target gene. LOC197342 BINDING SITE is HOST TARGET binding site found in the 3' untranslated region of mRNA encoded by LOC197342, corresponding to a HOST TARGET binding site such as BINDING SITE I, BINDING SITE II or BINDING SITE III. Table 2 illustrates the complementarity of the nucleotide sequences of LOC197342 BINDING SITE, designated SEQ ID:42490, to the nucleotide sequence of VGAM1965 RNA, herein designated VGAM RNA, also designated SEQ ID:4676.

Another function of VGAM1965 is therefore inhibition of LOC197342 (Accession XM_113869). Accordingly, utilities of VGAM1965 include diagnosis, prevention and treatment of diseases and clinical conditions associated with LOC197342. LOC199858 (Accession XM_114040) is another VGAM1965 host target gene. LOC199858 BINDING SITE1 and LOC199858 BINDING SITE2 are HOST TARGET binding sites found in untranslated regions of mRNA encoded by LOC199858, corresponding to HOST TARGET binding sites such as BINDING SITE I, BINDING SITE II or BINDING SITE III. Table 2 illustrates the complementarity of the nucleotide sequences of LOC199858 BINDING SITE1 and LOC199858 BINDING SITE2, designated SEQ ID:42644 and SEQ ID:42645 respectively, to the nucleotide sequence of VGAM1965 RNA, herein designated VGAM RNA, also designated SEQ ID:4676.

Another function of VGAM1965 is therefore inhibition of LOC199858 (Accession XM_114040). Accordingly, utilities of VGAM1965 include diagnosis, prevention and treatment of diseases and clinical conditions associated with LOC199858. LOC200488 (Accession XM_117240) is another VGAM1965 host target gene. LOC200488 BINDING SITE is HOST TARGET binding site found in the 5' untranslated region of mRNA encoded by LOC200488, corresponding to a HOST TARGET binding site such as BINDING SITE I, BINDING SITE II or BINDING SITE III. Table 2 illustrates the complementarity of the nucleotide sequences of LOC200488 BINDING SITE, designated SEQ ID:43314, to the nucleotide sequence of VGAM1965 RNA, herein designated VGAM RNA, also designated SEQ ID:4676.

Another function of VGAM1965 is therefore inhibition of LOC200488 (Accession XM_117240). Accordingly, utilities of VGAM1965 include diagnosis, prevention and treatment of diseases and clinical conditions associated with LOC200488. LOC200830 (Accession XM_117287) is another VGAM1965 host target gene. LOC200830 BINDING SITE is HOST TARGET binding site found in the 5' untranslated region of mRNA encoded by LOC200830, corresponding to a HOST TARGET binding site such as BINDING SITE I, BINDING SITE II or BINDING SITE III. Table 2 illustrates the complementarity of the nucleotide sequences of LOC200830 BINDING SITE, designated SEQ ID:43349, to the nucleotide sequence of VGAM1965 RNA, herein designated VGAM RNA, also designated SEQ ID:4676.

Another function of VGAM1965 is therefore inhibition of LOC200830 (Accession XM_117287). Accordingly, utilities of VGAM1965 include diagnosis, prevention and treatment of diseases and clinical conditions associated with LOC200830. LOC200953 (Accession XM_117302) is another VGAM1965 host target gene. LOC200953 BINDING SITE is HOST TARGET binding site found in the 5' untranslated region of mRNA encoded by LOC200953, corresponding to a HOST TARGET binding site such as BINDING SITE I, BINDING SITE II or BINDING SITE III. Table 2 illustrates the complementarity of the nucleotide sequences of LOC200953 BINDING SITE, designated SEQ ID:43368, to the nucleotide sequence of VGAM1965 RNA, herein designated VGAM RNA, also designated SEQ ID:4676.

Another function of VGAM1965 is therefore inhibition of LOC200953 (Accession XM_117302). Accordingly, utilities of VGAM1965 include diagnosis, prevention and treatment of diseases and clinical conditions associated with LOC200953. LOC201173 (Accession XM_113312) is another VGAM1965 host target gene. LOC201173 BINDING SITE is HOST TARGET binding site found in the 5' untranslated region of mRNA encoded by LOC201173, corresponding to a HOST TARGET binding site such as BINDING SITE I, BINDING SITE II or BINDING SITE III. Table 2 illustrates the complementarity of the nucleotide sequences of LOC201173 BINDING SITE, designated SEQ ID:42217, to the nucleotide sequence of VGAM1965 RNA, herein designated VGAM RNA, also designated SEQ ID:4676.

Another function of VGAM1965 is therefore inhibition of LOC201173 (Accession XM_113312). Accordingly, utilities of VGAM1965 include diagnosis, prevention and treatment of diseases and clinical conditions associated with LOC201173. LOC201203 (Accession XM_113920) is another VGAM1965 host target gene. LOC201203 BINDING SITE is HOST TARGET binding site found in the 3' untranslated region of mRNA encoded by LOC201203, corresponding to a HOST TARGET binding site such as BINDING SITE I, BINDING SITE II or BINDING SITE III. Table 2 illustrates the complementarity of the nucleotide sequences of LOC201203 BINDING SITE, designated SEQ ID:42537, to the nucleotide sequence of VGAM1965 RNA, herein designated VGAM RNA, also designated SEQ ID:4676.

Another function of VGAM1965 is therefore inhibition of LOC201203 (Accession XM_113920). Accordingly, utilities of VGAM1965 include diagnosis, prevention and treatment of diseases and clinical conditions associated with LOC201203. LOC201220 (Accession XM_113321) is another VGAM1965 host target gene. LOC201220 BINDING SITE is HOST TARGET binding site found in the 5' untranslated region of mRNA encoded by LOC201220, corresponding to a HOST TARGET binding site such as BIND- ING SITE I, BINDING SITE II or BINDING SITE III. Table 2 illustrates the complementarity of the nucleotide sequences of LOC201220 BINDING SITE, designated SEQ ID:42226, to the nucleotide sequence of VGAM1965 RNA, herein designated VGAM RNA, also designated SEQ ID:4676.

Another function of VGAM1965 is therefore inhibition of LOC201220 (Accession XM_113321). Accordingly, utilities of VGAM1965 include diagnosis, prevention and treatment of diseases and clinical conditions associated with LOC201220. LOC201243 (Accession XM_113935) is another VGAM1965 host target gene. LOC201243 BINDING SITE is HOST TARGET binding site found in the 5' untranslated region of mRNA encoded by LOC201243, corresponding to a HOST TARGET binding site such as BINDING SITE I, BINDING SITE II or BINDING SITE III. Table 2 illustrates the complementarity of the nucleotide sequences of LOC201243 BINDING SITE, designated SEQ ID:42554, to the nucleotide sequence of VGAM1965 RNA, herein designated VGAM RNA, also designated SEQ ID:4676.

Another function of VGAM1965 is therefore inhibition of LOC201243 (Accession XM_113935). Accordingly, utilities of VGAM1965 include diagnosis, prevention and treatment of diseases and clinical conditions associated with LOC201243. LOC201626 (Accession XM_114349) is another VGAM1965 host target gene. LOC201626 BINDING SITE is HOST TARGET binding site found in the 3' untranslated region of mRNA encoded by LOC201626, corresponding to a HOST TARGET binding site such as BINDING SITE I, BINDING SITE II or BINDING SITE III. Table 2 illustrates the complementarity of the nucleotide sequences of LOC201626 BINDING SITE, designated SEQ ID:42888, to the nucleotide sequence of VGAM1965 RNA, herein designated VGAM RNA, also designated SEQ ID:4676.

Another function of VGAM1965 is therefore inhibition of LOC201626 (Accession XM_114349). Accordingly, utilities of VGAM1965 include diagnosis, prevention and treatment of diseases and clinical conditions associated with LOC201626. LOC201895 (Accession XM_114396) is another VGAM1965 host target gene. LOC201895 BINDING SITE is HOST TARGET binding site found in the 3' untranslated region of mRNA encoded by LOC201895, corresponding to a HOST TARGET binding site such as BINDING SITE I, BINDING SITE II or BINDING SITE III. Table 2 illustrates the complementarity of the nucleotide sequences of LOC201895 BINDING SITE, designated SEQ ID:42928, to the nucleotide sequence of VGAM1965 RNA, herein designated VGAM RNA, also designated SEQ ID:4676.

Another function of VGAM1965 is therefore inhibition of LOC201895 (Accession XM_114396). Accordingly, utilities of VGAM1965 include diagnosis, prevention and treatment of diseases and clinical conditions associated with LOC201895. LOC202134 (Accession XM_117365) is another VGAM1965 host target gene. LOC202134 BINDING SITE is HOST TARGET binding site found in the 5' untranslated region of mRNA encoded by LOC202134, corresponding to a HOST TARGET binding site such as BINDING SITE I, BINDING SITE II or BINDING SITE III. Table 2 illustrates the complementarity of the nucleotide sequences of LOC202134 BINDING SITE, designated SEQ ID:43415, to the nucleotide sequence of VGAM1965 RNA, herein designated VGAM RNA, also designated SEQ ID:4676.

Another function of VGAM1965 is therefore inhibition of LOC202134 (Accession XM_117365). Accordingly, utilities of VGAM1965 include diagnosis, prevention and treatment of diseases and clinical conditions associated with LOC202134. LOC203235 (Accession XM_117514) is another VGAM1965 host target gene. LOC203235 BINDING SITE is HOST TARGET binding site found in the 5' untranslated region of mRNA encoded by LOC203235, corresponding to a HOST TARGET binding site such as BINDING SITE I, BINDING SITE II or BINDING SITE III. Table 2 illustrates the complementarity of the nucleotide sequences of LOC203235 BINDING SITE, designated SEQ ID:43479, to the nucleotide sequence of VGAM1965 RNA, herein designated VGAM RNA, also designated SEQ ID:4676.

Another function of VGAM1965 is therefore inhibition of LOC203235 (Accession XM_117514). Accordingly, utilities of VGAM1965 include diagnosis, prevention and treatment of diseases and clinical conditions associated with LOC203235. LOC203248 (Accession XM_114659) is another VGAM1965 host target gene. LOC203248 BINDING SITE is HOST TARGET binding site found in the 3' untranslated region of mRNA encoded by LOC203248, corresponding to a HOST TARGET binding site such as BINDING SITE I, BINDING SITE II or BINDING SITE III. Table 2 illustrates the complementarity of the nucleotide sequences of LOC203248 BINDING SITE, designated SEQ ID:43019, to the nucleotide sequence of VGAM1965 RNA, herein designated VGAM RNA, also designated SEQ ID:4676.

Another function of VGAM1965 is therefore inhibition of LOC203248 (Accession XM_114659). Accordingly, utilities of VGAM1965 include diagnosis, prevention and treatment of diseases and clinical conditions associated with LOC203248. LOC203339 (Accession XM_117534) is another VGAM1965 host target gene. LOC203339 BINDING SITE is HOST TARGET binding site found in the 3' untranslated region of mRNA encoded by LOC203339, corresponding to a HOST TARGET binding site such as BINDING SITE I, BINDING SITE II or BINDING SITE III. Table 2 illustrates the complementarity of the nucleotide sequences of LOC203339 BINDING SITE, designated SEQ ID:43526, to the nucleotide sequence of VGAM1965 RNA, herein designated VGAM RNA, also designated SEQ ID:4676.

Another function of VGAM1965 is therefore inhibition of LOC203339 (Accession XM_117534). Accordingly, utilities of VGAM1965 include diagnosis, prevention and treatment of diseases and clinical conditions associated with LOC203339. LOC203378 (Accession XM_117541) is another VGAM1965 host target gene. LOC203378 BINDING SITE is HOST TARGET binding site found in the 3' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43559, to the nucleotide sequence of VGAM1965 RNA, herein designated VGAM RNA, also designated SEQ ID:4676.

Another function of VGAM1965 is therefore inhibition of LOC203378 (Accession XM_117541). Accordingly, utilities of VGAM1965 include diagnosis, prevention and treatment of diseases and clinical conditions associated with LOC203378. LOC203504 (Accession XM_117550) is another VGAM1965 host target gene. LOC203504 BINDING SITE is HOST TARGET binding site found in the 3' untranslated region of mRNA encoded by LOC203504, corresponding to a HOST TARGET binding site such as BINDING SITE I, BINDING SITE II or BINDING SITE III. Table 2 illustrates the complementarity of the nucleotide sequences of LOC203504 BINDING SITE, designated SEQ ID:43567, to the nucleotide sequence of VGAM1965 RNA, herein designated VGAM RNA, also designated SEQ ID:4676.

Another function of VGAM1965 is therefore inhibition of LOC203504 (Accession XM_117550). Accordingly, utilities of VGAM1965 include diagnosis, prevention and treatment of diseases and clinical conditions associated with LOC203504. LOC205251 (Accession XM_119554) is another VGAM1965 host target gene. LOC205251 BINDING SITE is HOST TARGET binding site found in the 5' untranslated region of mRNA encoded by LOC205251, corresponding to a HOST TARGET binding site such as BINDING SITE I, BINDING SITE II or BINDING SITE III. Table 2 illustrates the complementarity of the nucleotide sequences of LOC205251 BINDING SITE, designated SEQ ID:43591, to the nucleotide sequence of VGAM1965 RNA, herein designated VGAM RNA, also designated SEQ ID:4676.

Another function of VGAM1965 is therefore inhibition of LOC205251 (Accession XM_119554). Accordingly, utilities of VGAM1965 include diagnosis, prevention and treatment of diseases and clinical conditions associated with LOC205251. LOC219540 (Accession XM_168047) is another VGAM1965 host target gene. LOC219540 BINDING SITE is HOST TARGET binding site found in the 5' untranslated region of mRNA encoded by LOC219540, corresponding to a HOST TARGET binding site such as BINDING SITE I, BINDING SITE II or BINDING SITE III. Table 2 illustrates the complementarity of the nucleotide sequences of LOC219540 BINDING SITE, designated SEQ ID:44959, to the nucleotide sequence of VGAM1965 RNA, herein designated VGAM RNA, also designated SEQ ID:4676.

Another function of VGAM1965 is therefore inhibition of LOC219540 (Accession XM_168047). Accordingly, utilities of VGAM1965 include diagnosis, prevention and treatment of diseases and clinical conditions associated with LOC219540. LOC219627 (Accession XM_166402) is another VGAM1965 host target gene. LOC219627 BINDING SITE is HOST TARGET binding site found in the 5' untranslated region of mRNA encoded by LOC219627, corresponding to a HOST TARGET binding site such as BINDING SITE I, BINDING SITE II or BINDING SITE III. Table 2 illustrates the complementarity of the nucleotide sequences of LOC219627 BINDING SITE, designated SEQ ID:44275, to the nucleotide sequence of VGAM1965 RNA, herein designated VGAM RNA, also designated SEQ ID:4676.

Another function of VGAM1965 is therefore inhibition of LOC219627 (Accession XM_166402). Accordingly, utilities of VGAM1965 include diagnosis, prevention and treatment of diseases and clinical conditions associated with LOC219627. LOC219690 (Accession XM_167572) is another VGAM1965 host target gene. LOC219690 BINDING SITE is HOST TARGET binding site found in the 3' untranslated region of mRNA encoded by LOC219690, corresponding to a HOST TARGET binding site such as BINDING SITE I, BINDING SITE II or BINDING SITE III. Table 2 illustrates the complementarity of the nucleotide sequences of LOC219690 BINDING SITE, designated SEQ ID:44707, to the nucleotide sequence of VGAM1965 RNA, herein designated VGAM RNA, also designated SEQ ID:4676.

Another function of VGAM1965 is therefore inhibition of LOC219690 (Accession XM_167572). Accordingly, utilities of VGAM1965 include diagnosis, prevention and treatment of diseases and clinical conditions associated with LOC219690. LOC219735 (Accession XM_167601) is another VGAM1965 host target gene. LOC219735 BINDING SITE is HOST TARGET binding site found in the 3' untranslated region of mRNA encoded by LOC219735, corresponding to a HOST TARGET binding site such as BINDING SITE I, BINDING SITE II or BINDING SITE III. Table 2 illustrates the complementarity of the nucleotide sequences of LOC219735 BINDING SITE, designated SEQ ID:44722, to the nucleotide sequence of VGAM1965 RNA, herein designated VGAM RNA, also designated SEQ ID:4676.

Another function of VGAM1965 is therefore inhibition of LOC219735 (Accession XM_167601). Accordingly, utilities of VGAM1965 include diagnosis, prevention and treatment of diseases and clinical conditions associated with LOC219735. LOC219920 (Accession XM_167787) is another VGAM1965 host target gene. LOC219920 BINDING SITE is HOST TARGET binding site found in the 5' untranslated region of mRNA encoded by LOC219920, corresponding to a HOST TARGET binding site such as BINDING SITE I, BINDING SITE II or BINDING SITE III. Table 2 illustrates the complementarity of the nucleotide sequences of LOC219920 BINDING SITE, designated SEQ ID:44813, to the nucleotide sequence of VGAM1965 RNA, herein designated VGAM RNA, also designated SEQ ID:4676.

Another function of VGAM1965 is therefore inhibition of LOC219920 (Accession XM_167787). Accordingly, utilities of VGAM1965 include diagnosis, prevention and treatment of diseases and clinical conditions associated with LOC219920. LOC219942 (Accession XM_167790) is another VGAM1965 host target gene. LOC219942 BINDING SITE is HOST TARGET binding site found in the 3' untranslated region of mRNA encoded by LOC219942, corresponding to a HOST TARGET binding site such as BINDING SITE I, BINDING SITE II or BINDING SITE III. Table 2 illustrates the complementarity of the nucleotide sequences of LOC219942 BINDING SITE, designated SEQ ID:44823, to the nucleotide sequence of VGAM1965 RNA, herein designated VGAM RNA, also designated SEQ ID:4676.

Another function of VGAM1965 is therefore inhibition of LOC219942 (Accession XM_167790). Accordingly, utilities of VGAM1965 include diagnosis, prevention and treatment of diseases and clinical conditions associated with LOC219942. LOC220073 (Accession XM_167847) is another VGAM1965 host target gene. LOC220073 BINDING SITE is HOST TARGET binding site found in the 5' untranslated region of mRNA encoded by LOC220073, corresponding to a HOST TARGET binding site such as BINDING SITE I, BINDING SITE II or BINDING SITE III. Table 2 illustrates the complementarity of the nucleotide sequences of LOC220073 BINDING SITE, designated SEQ ID:44875, to the nucleotide sequence of VGAM1965 RNA, herein designated VGAM RNA, also designated SEQ ID:4676.

Another function of VGAM1965 is therefore inhibition of LOC220073 (Accession XM_167847). Accordingly, utilities of VGAM1965 include diagnosis, prevention and treatment of diseases and clinical conditions associated with LOC220073. LOC220143 (Accession XM_168046) is another VGAM1965 host target gene. LOC220143 BINDING SITE is HOST TARGET binding site found in the 3' untranslated region of mRNA encoded by LOC220143, corresponding to a HOST TARGET binding site such as BINDING SITE I, BINDING SITE II or BINDING SITE III. Table 2 illustrates the complementarity of the nucleotide sequences of LOC220143 BINDING SITE, designated SEQ ID:44955, to the nucleotide sequence of VGAM1965 RNA, herein designated VGAM RNA, also designated SEQ ID:4676.

Another function of VGAM1965 is therefore inhibition of LOC220143 (Accession XM_168046). Accordingly, utilities of VGAM1965 include diagnosis, prevention and treatment of diseases and clinical conditions associated with LOC220143. LOC220692 (Accession XM_165991) is another VGAM1965 host target gene. LOC220692 BINDING SITE is HOST TARGET binding site found in the 3' untranslated region of mRNA encoded by LOC220692, corresponding to a HOST TARGET binding site such as BINDING SITE I, BINDING SITE II or BINDING SITE III. Table 2 illustrates the complementarity of the nucleotide sequences of LOC220692 BINDING SITE, designated SEQ ID:43832, to the nucleotide sequence of VGAM1965 RNA, herein designated VGAM RNA, also designated SEQ ID:4676.

Another function of VGAM1965 is therefore inhibition of LOC220692 (Accession XM_165991). Accordingly, utilities of VGAM1965 include diagnosis, prevention and treatment of diseases and clinical conditions associated with LOC220692. LOC221002 (Accession XM_166156) is another VGAM1965 host target gene. LOC221002 BINDING SITE1 and LOC221002 BINDING SITE2 are HOST TARGET binding sites found in untranslated regions of mRNA encoded by LOC221002, corresponding to HOST TARGET binding sites such as BINDING SITE I, BINDING SITE II or BINDING SITE III. Table 2 illustrates the complementarity of the nucleotide sequences of LOC221002 BINDING SITE1 and LOC221002 BINDING SITE2, designated SEQ ID:43974 and SEQ ID:43978 respectively, to the nucleotide sequence of VGAM1965 RNA, herein designated VGAM RNA, also designated SEQ ID:4676.

Another function of VGAM1965 is therefore inhibition of LOC221002 (Accession XM_166156). Accordingly, utilities of VGAM1965 include diagnosis, prevention and treatment of diseases and clinical conditions associated with LOC221002. LOC221178 (Accession XM_167936) is another VGAM1965 host target gene. LOC221178 BINDING SITE is HOST TARGET binding site found in the 3' untranslated region of mRNA encoded by LOC221178, corresponding to a HOST TARGET binding site such as BINDING SITE I, BINDING SITE II or BINDING SITE III. Table 2 illustrates the complementarity of the nucleotide sequences of LOC221178 BINDING SITE, designated SEQ ID:44930, to the nucleotide sequence of VGAM1965 RNA, herein designated VGAM RNA, also designated SEQ ID:4676.

Another function of VGAM1965 is therefore inhibition of LOC221178 (Accession XM_167936). Accordingly, utilities of VGAM1965 include diagnosis, prevention and treatment of diseases and clinical conditions associated with LOC221178. LOC221288 (Accession XM_168058) is another VGAM1965 host target gene. LOC221288 BINDING SITE is HOST TARGET binding site found in the 3' untranslated region of mRNA encoded by LOC221288, corresponding to a HOST TARGET binding site such as BINDING SITE I, BINDING SITE II or BINDING SITE III. Table 2 illustrates the complementarity of the nucleotide sequences of LOC221288 BINDING SITE, designated SEQ ID:44971, to the nucleotide sequence of VGAM1965 RNA, herein designated VGAM RNA, also designated SEQ ID:4676.

Another function of VGAM1965 is therefore inhibition of LOC221288 (Accession XM_168058). Accordingly, utilities of VGAM1965 include diagnosis, prevention and treatment of diseases and clinical conditions associated with LOC221288. LOC221421 (Accession XM_166428) is another VGAM1965 host target gene. LOC221421 BINDING SITE is HOST TARGET binding site found in the 3' untranslated region of mRNA encoded by LOC221421, corresponding to a HOST TARGET binding site such as BINDING SITE I, BINDING SITE II or BINDING SITE III. Table 2 illustrates the complementarity of the nucleotide sequences of LOC221421 BINDING SITE, designated SEQ ID:44324, to the nucleotide sequence of VGAM1965 RNA, herein designated VGAM RNA, also designated SEQ ID:4676.

Another function of VGAM1965 is therefore inhibition of LOC221421 (Accession XM_166428). Accordingly, utilities of VGAM1965 include diagnosis, prevention and treatment of diseases and clinical conditions associated with LOC221421. LOC221466 (Accession XM_168087) is another VGAM1965 host target gene. LOC221466 BINDING SITE is HOST TARGET binding site found in the 5' untranslated region of mRNA encoded by LOC221466, corresponding to a HOST TARGET binding site such as BINDING SITE I, BINDING SITE II or BINDING SITE III. Table 2 illustrates the complementarity of the nucleotide sequences of LOC221466 BINDING SITE, designated SEQ ID:44995, to the nucleotide sequence of VGAM1965 RNA, herein designated VGAM RNA, also designated SEQ ID:4676.

Another function of VGAM1965 is therefore inhibition of LOC221466 (Accession XM_168087). Accordingly, utilities of VGAM1965 include diagnosis, prevention and treatment of diseases and clinical conditions associated with LOC221466. LOC221495 (Accession XM_168136) is another VGAM1965 host target gene. LOC221495 BINDING SITE1 through LOC221495 BINDING SITE3 are HOST TARGET binding sites found in untranslated regions of mRNA encoded by LOC221495, corresponding to HOST TARGET binding sites such as BINDING SITE I, BINDING SITE II or BINDING SITE III. Table 2 illustrates the complementarity of the nucleotide sequences of LOC221495 BINDING SITE1 through LOC221495 BINDING SITE3, designated SEQ ID:45059, SEQ ID:45060 and SEQ ID:45061 respectively, to the nucleotide sequence of VGAM1965 RNA, herein designated VGAM RNA, also designated SEQ ID:4676.

Another function of VGAM1965 is therefore inhibition of LOC221495 (Accession XM_168136). Accordingly, utilities of VGAM1965 include diagnosis, prevention and treatment of diseases and clinical conditions associated with LOC221495. LOC221641 (Accession XM_168090) is another VGAM1965 host target gene. LOC221641 BINDING SITE is HOST TARGET binding site found in the 5' untranslated region of mRNA encoded by LOC221641, corresponding to a HOST TARGET binding site such as BINDING SITE I, BINDING SITE II or BINDING SITE III. Table 2 illustrates the complementarity of the nucleotide sequences of LOC221641 BINDING SITE, designated SEQ ID:45010, to the nucleotide sequence of VGAM1965 RNA, herein designated VGAM RNA, also designated SEQ ID:4676.

Another function of VGAM1965 is therefore inhibition of LOC221641 (Accession XM_168090). Accordingly, utilities of VGAM1965 include diagnosis, prevention and treatment of diseases and clinical conditions associated with LOC221641. LOC221662 (Accession XM_166466) is another VGAM1965 host target gene. LOC221662 BINDING SITE is HOST TARGET binding site found in the 3' untranslated region of mRNA encoded by LOC221662, corresponding to a HOST TARGET binding site such as BINDING SITE I, BINDING SITE II or BINDING SITE III. Table 2 illustrates the complementarity of the nucleotide sequences of LOC221662 BINDING SITE, designated SEQ ID:44389, to the nucleotide sequence of VGAM1965 RNA, herein designated VGAM RNA, also designated SEQ ID:4676.

Another function of VGAM1965 is therefore inhibition of LOC221662 (Accession XM_166466). Accordingly, utilities of VGAM1965 include diagnosis, prevention and treatment of diseases and clinical conditions associated with LOC221662. LOC221712 (Accession XM_168059) is another VGAM1965 host target gene. LOC221712 BINDING SITE is HOST TARGET binding site found in the 5' untranslated region of mRNA encoded by LOC221712, corresponding to a HOST TARGET binding site such as BINDING SITE I, BINDING SITE II or BINDING SITE III. Table 2 illustrates the complementarity of the nucleotide sequences of LOC221712 BINDING SITE, designated SEQ ID:44974, to the nucleotide sequence of VGAM1965 RNA, herein designated VGAM RNA, also designated SEQ ID:4676.

Another function of VGAM1965 is therefore inhibition of LOC221712 (Accession XM_168059). Accordingly, utilities of VGAM1965 include diagnosis, prevention and treatment of diseases and clinical conditions associated with LOC221712. LOC221760 (Accession XM_168105) is another VGAM1965 host target gene. LOC221760 BINDING SITE is HOST TARGET binding site found in the 5' untranslated region of mRNA encoded by LOC221760, corresponding to a HOST TARGET binding site such as BINDING SITE I, BINDING SITE II or BINDING SITE III. Table 2 illustrates the complementarity of the nucleotide sequences of LOC221760 BINDING SITE, designated SEQ ID:45033, to the nucleotide sequence of VGAM1965 RNA, herein designated VGAM RNA, also designated SEQ ID:4676.

Another function of VGAM1965 is therefore inhibition of LOC221760 (Accession XM_168105). Accordingly, utilities of VGAM1965 include diagnosis, prevention and treatment of diseases and clinical conditions associated with LOC221760. LOC221773 (Accession XM_165802) is another VGAM1965 host target gene. LOC221773 BINDING SITE is HOST TARGET binding site found in the 3' untranslated region of mRNA encoded by LOC221773, corresponding to a HOST TARGET binding site such as BINDING SITE I, BINDING SITE II or BINDING SITE III. Table 2 illustrates the complementarity of the nucleotide sequences of LOC221773 BINDING SITE, designated SEQ ID:43765, to the nucleotide sequence of VGAM1965 RNA, herein designated VGAM RNA, also designated SEQ ID:4676.

Another function of VGAM1965 is therefore inhibition of LOC221773 (Accession XM_165802). Accordingly, utilities of VGAM1965 include diagnosis, prevention and treatment of diseases and clinical conditions associated with LOC221773. LOC221955 (Accession NM_139179) is another VGAM1965 host target gene. LOC221955 BINDING SITE1 and LOC221955 BINDING SITE2 are HOST TARGET binding sites found in untranslated regions of mRNA encoded by LOC221955, corresponding to HOST TARGET binding sites such as BINDING SITE I, BINDING SITE II or BINDING SITE III. Table 2 illustrates the complementarity of the nucleotide sequences of LOC221955 BINDING SITE1 and LOC221955 BINDING SITE2, designated SEQ ID:29193 and SEQ ID:29194 respectively, to the nucleotide sequence of VGAM1965 RNA, herein designated VGAM RNA, also designated SEQ ID:4676.

Another function of VGAM1965 is therefore inhibition of LOC221955 (Accession NM_139179). Accordingly, utilities of VGAM1965 include diagnosis, prevention and treatment of diseases and clinical conditions associated with LOC221955. LOC222128 (Accession XM_166560) is another VGAM1965 host target gene. LOC222128 BINDING SITE is HOST TARGET binding site found in the 5' untranslated region of mRNA encoded by LOC222128, corresponding to a HOST TARGET binding site such as BINDING SITE I, BINDING SITE II or BINDING SITE III. Table 2 illustrates the complementarity of the nucleotide sequences of LOC222128 BINDING SITE, designated SEQ ID:44540, to the nucleotide sequence of VGAM1965 RNA, herein designated VGAM RNA, also designated SEQ ID:4676.

Another function of VGAM1965 is therefore inhibition of LOC222128 (Accession XM_166560). Accordingly, utilities of VGAM1965 include diagnosis, prevention and treatment of diseases and clinical conditions associated with LOC222128. LOC222256 (Accession XM_168571) is another VGAM1965 host target gene. LOC222256 BINDING SITE is HOST TARGET binding site found in the 3' untranslated region of mRNA encoded by LOC222256, corresponding to a HOST TARGET binding site such as BINDING SITE I, BINDING SITE II or BINDING SITE III. Table 2 illustrates the complementarity of the nucleotide sequences of LOC222256 BINDING SITE, designated SEQ ID:45250, to the nucleotide sequence of VGAM1965 RNA, herein designated VGAM RNA, also designated SEQ ID:4676.

Another function of VGAM1965 is therefore inhibition of LOC222256 (Accession XM_168571). Accordingly, utilities of VGAM1965 include diagnosis, prevention and treatment of diseases and clinical conditions associated with LOC222256. LOC222671 (Accession XM_167094) is another VGAM1965 host target gene. LOC222671 BINDING SITE is HOST TARGET binding site found in the 5' untranslated region of mRNA encoded by LOC222671, corresponding to a HOST TARGET binding site such as BINDING SITE I, BINDING SITE II or BINDING SITE III. Table 2 illustrates the complementarity of the nucleotide sequences of LOC222671 BINDING SITE, designated SEQ ID:44604, to the nucleotide sequence of VGAM1965 RNA, herein designated VGAM RNA, also designated SEQ ID:4676.

Another function of VGAM1965 is therefore inhibition of LOC222671 (Accession XM_167094). Accordingly, utilities of VGAM1965 include diagnosis, prevention and treatment of diseases and clinical conditions associated with LOC222671. LOC253216 (Accession XM_170765) is another VGAM1965 host target gene. LOC253216 BINDING SITE is HOST TARGET binding site found in the 5' untranslated region of mRNA encoded by LOC253216, corresponding to a HOST TARGET binding site such as BINDING SITE I, BINDING SITE II or BINDING SITE III. Table 2 illustrates the complementarity of the nucleotide sequences of LOC253216 BINDING SITE, designated SEQ ID:45522, to the nucleotide sequence of VGAM1965 RNA, herein designated VGAM RNA, also designated SEQ ID:4676.

Another function of VGAM1965 is therefore inhibition of LOC253216 (Accession XM_170765). Accordingly, utilities of VGAM1965 include diagnosis, prevention and treatment of diseases and clinical conditions associated with LOC253216. LOC253264 (Accession XM_170639) is another VGAM1965 host target gene. LOC253264 BINDING SITE is HOST TARGET binding site found in the 5' untranslated region of mRNA encoded by LOC253264, corresponding to a HOST TARGET binding site such as BINDING SITE I, BINDING SITE II or BINDING SITE III. Table 2 illustrates the complementarity of the nucleotide sequences of LOC253264 BINDING SITE, designated SEQ ID:45418, to the nucleotide sequence of VGAM1965 RNA, herein designated VGAM RNA, also designated SEQ ID:4676.

Another function of VGAM1965 is therefore inhibition of LOC253264 (Accession XM_170639). Accordingly, utilities of VGAM1965 include diagnosis, prevention and treatment of diseases and clinical conditions associated with LOC253264. LOC253612 (Accession XM_172985) is another VGAM1965 host target gene. LOC253612 BINDING SITE is HOST TARGET binding site found in the 3' untranslated region of mRNA encoded by LOC253612, corresponding to a HOST TARGET binding site such as BINDING SITE I, BINDING SITE II or BINDING SITE III. Table 2 illustrates the complementarity of the nucleotide sequences of LOC253612 BINDING SITE, designated SEQ ID:46257, to the nucleotide sequence of VGAM1965 RNA, herein designated VGAM RNA, also designated SEQ ID:4676.

Another function of VGAM1965 is therefore inhibition of LOC253612 (Accession XM_172985). Accordingly, utilities of VGAM1965 include diagnosis, prevention and treatment of diseases and clinical conditions associated with LOC253612. LOC253758 (Accession XM_173067) is another VGAM1965 host target gene. LOC253758 BIND- ING SITE is HOST TARGET binding site found in the 5' untranslated region of mRNA encoded by LOC253758, corresponding to a HOST TARGET binding site such as BINDING SITE I, BINDING SITE II or BINDING SITE III. Table 2 illustrates the complementarity of the nucleotide sequences of LOC253758 BINDING SITE, designated SEQ ID:46320, to the nucleotide sequence of VGAM1965 RNA, herein designated VGAM RNA, also designated SEQ ID:4676.

Another function of VGAM1965 is therefore inhibition of LOC253758 (Accession XM_173067). Accordingly, utilities of VGAM1965 include diagnosis, prevention and treatment of diseases and clinical conditions associated with LOC253758. LOC253912 (Accession XM_173222) is another VGAM1965 host target gene. LOC253912 BINDING SITE is HOST TARGET binding site found in the 3' untranslated region of mRNA encoded by LOC253912, corresponding to a HOST TARGET binding site such as BINDING SITE I, BINDING SITE II or BINDING SITE III. Table 2 illustrates the complementarity of the nucleotide sequences of LOC253912 BINDING SITE, designated SEQ ID:46485, to the nucleotide sequence of VGAM1965 RNA, herein designated VGAM RNA, also designated SEQ ID:4676.

Another function of VGAM1965 is therefore inhibition of LOC253912 (Accession XM_173222). Accordingly, utilities of VGAM1965 include diagnosis, prevention and treatment of diseases and clinical conditions associated with LOC253912. LOC253926 (Accession XM_170741) is another VGAM1965 host target gene. LOC253926 BINDING SITE is HOST TARGET binding site found in the 5' untranslated region of mRNA encoded by LOC253926, corresponding to a HOST TARGET binding site such as BINDING SITE I, BINDING SITE II or BINDING SITE III. Table 2 illustrates the complementarity of the nucleotide sequences of LOC253926 BINDING SITE, designated SEQ ID:45500, to the nucleotide sequence of VGAM1965 RNA, herein designated VGAM RNA, also designated SEQ ID:4676.

Another function of VGAM1965 is therefore inhibition of LOC253926 (Accession XM_170741). Accordingly, utilities of VGAM1965 include diagnosis, prevention and treatment of diseases and clinical conditions associated with LOC253926. LOC254015 (Accession XM_172977) is another VGAM1965 host target gene. LOC254015 BINDING SITE is HOST TARGET binding site found in the 3' untranslated region of mRNA encoded by LOC254015, corresponding to a HOST TARGET binding site such as BINDING SITE I, BINDING SITE II or BINDING SITE III. Table 2 illustrates the complementarity of the nucleotide sequences of LOC254015 BINDING SITE, designated SEQ ID:46247, to the nucleotide sequence of VGAM1965 RNA, herein designated VGAM RNA, also designated SEQ ID:4676.

Another function of VGAM1965 is therefore inhibition of LOC254015 (Accession XM_172977). Accordingly, utilities of VGAM1965 include diagnosis, prevention and treatment of diseases and clinical conditions associated with LOC254015. LOC254143 (Accession XM_172880) is another VGAM1965 host target gene. LOC254143 BINDING SITE1 and LOC254143 BINDING SITE2 are HOST TARGET binding sites found in untranslated regions of mRNA encoded by LOC254143, corresponding to HOST TARGET binding sites such as BINDING SITE I, BINDING SITE II or BINDING SITE III. Table 2 illustrates the complementarity of the nucleotide sequences of LOC254143 BINDING SITE1 and LOC254143 BINDING SITE2, designated SEQ ID:46159 and SEQ ID:46160 respectively, to the nucleotide sequence of VGAM1965 RNA, herein designated VGAM RNA, also designated SEQ ID:4676.

Another function of VGAM1965 is therefore inhibition of LOC254143 (Accession XM_172880). Accordingly, utilities of VGAM1965 include diagnosis, prevention and treatment of diseases and clinical conditions associated with LOC254143. LOC254266 (Accession XM_173221) is another VGAM1965 host target gene. LOC254266 BINDING SITE is HOST TARGET binding site found in the 5' untranslated region of mRNA encoded by LOC254266, corresponding to a HOST TARGET binding site such as BINDING SITE I, BINDING SITE II or BINDING SITE III. Table 2 illustrates the complementarity of the nucleotide sequences of LOC254266 BINDING SITE, designated SEQ ID:46482, to the nucleotide sequence of VGAM1965 RNA, herein designated VGAM RNA, also designated SEQ ID:4676.

Another function of VGAM1965 is therefore inhibition of LOC254266 (Accession XM_173221). Accordingly, utilities of VGAM1965 include diagnosis, prevention and treatment of diseases and clinical conditions associated with LOC254266. LOC254351 (Accession XM_170774) is another VGAM1965 host target gene. LOC254351 BINDING SITE is HOST TARGET binding site found in the 3' untranslated region of mRNA encoded by LOC254351, corresponding to a HOST TARGET binding site such as BINDING SITE I, BINDING SITE II or BINDING SITE III. Table 2 illustrates the complementarity of the nucleotide sequences of LOC254351 BINDING SITE, designated SEQ ID:45543, to the nucleotide sequence of VGAM1965 RNA, herein designated VGAM RNA, also designated SEQ ID:4676.

Another function of VGAM1965 is therefore inhibition of LOC254351 (Accession XM_170774). Accordingly, utilities of VGAM1965 include diagnosis, prevention and treatment of diseases and clinical conditions associated with LOC254351. LOC254413 (Accession XM_173141) is another VGAM1965 host target gene. LOC254413 BINDING SITE is HOST TARGET binding site found in the 5' untranslated region of mRNA encoded by LOC254413, corresponding to a HOST TARGET binding site such as BINDING SITE I, BINDING SITE II or BINDING SITE III. Table 2 illustrates the complementarity of the nucleotide sequences of LOC254413 BINDING SITE, designated SEQ ID:46405, to the nucleotide sequence of VGAM1965 RNA, herein designated VGAM RNA, also designated SEQ ID:4676.

Another function of VGAM1965 is therefore inhibition of LOC254413 (Accession XM_173141). Accordingly, utilities of VGAM1965 include diagnosis, prevention and treatment of diseases and clinical conditions associated with LOC254413. LOC254719 (Accession XM_171166) is another VGAM1965 host target gene. LOC254719 BINDING SITE is HOST TARGET binding site found in the 5' untranslated region of mRNA encoded by LOC254719, corresponding to a HOST TARGET binding site such as BINDING SITE I, BINDING SITE II or BINDING SITE III. Table 2 illustrates the complementarity of the nucleotide sequences of LOC254719 BINDING SITE, designated SEQ ID:45952, to the nucleotide sequence of VGAM1965 RNA, herein designated VGAM RNA, also designated SEQ ID:4676.

Another function of VGAM1965 is therefore inhibition of LOC254719 (Accession XM_171166). Accordingly, utilities of VGAM1965 include diagnosis, prevention and treatment of diseases and clinical conditions associated with LOC254719. LOC254896 (Accession XM_171201) is another VGAM1965 host target gene. LOC254896 BINDING SITE1 and LOC254896 BINDING SITE2 are HOST TARGET binding sites found in untranslated regions of mRNA encoded by LOC254896, corresponding to HOST TARGET binding sites such as BINDING SITE I, BINDING SITE II or BINDING SITE III. Table 2 illustrates the complementarity of the nucleotide sequences of LOC254896 BINDING SITE1 and LOC254896 BINDING SITE2, designated SEQ ID:45988 and SEQ ID:45990 respectively, to the nucleotide sequence of VGAM1965 RNA, herein designated VGAM RNA, also designated SEQ ID:4676.

Another function of VGAM1965 is therefore inhibition of LOC254896 (Accession XM_171201). Accordingly, utilities of VGAM1965 include diagnosis, prevention and treatment of diseases and clinical conditions associated with LOC254896. LOC255104 (Accession XM_170911) is another VGAM1965 host target gene. LOC255104 BINDING SITE is HOST TARGET binding site found in the 3' untranslated region of mRNA encoded by LOC255104, corresponding to a HOST TARGET binding site such as BINDING SITE I, BINDING SITE II or BINDING SITE III. Table 2 illustrates the complementarity of the nucleotide sequences of LOC255104 BINDING SITE, designated SEQ ID:45685, to the nucleotide sequence of VGAM1965 RNA, herein designated VGAM RNA, also designated SEQ ID:4676.

Another function of VGAM1965 is therefore inhibition of LOC255104 (Accession XM_170911). Accordingly, utilities of VGAM1965 include diagnosis, prevention and treatment of diseases and clinical conditions associated with LOC255104. LOC255177 (Accession XM_172941) is another VGAM1965 host target gene. LOC255177 BINDING SITE is HOST TARGET binding site found in the 3' untranslated region of mRNA encoded by LOC255177, corresponding to a HOST TARGET binding site such as BINDING SITE I, BINDING SITE II or BINDING SITE III. Table 2 illustrates the complementarity of the nucleotide sequences of LOC255177 BINDING SITE, designated SEQ ID:46202, to the nucleotide sequence of VGAM1965 RNA, herein designated VGAM RNA, also designated SEQ ID:4676.

Another function of VGAM1965 is therefore inhibition of LOC255177 (Accession XM_172941). Accordingly, utilities of VGAM1965 include diagnosis, prevention and treatment of diseases and clinical conditions associated with LOC255177. LOC255252 (Accession XM_170779) is another VGAM1965 host target gene. LOC255252 BINDING SITE is HOST TARGET binding site found in the 3' untranslated region of mRNA encoded by LOC255252, corresponding to a HOST TARGET binding site such as BINDING SITE I, BINDING SITE II or BINDING SITE III. Table 2 illustrates the complementarity of the nucleotide sequences of LOC255252 BINDING SITE, designated SEQ ID:45548, to the nucleotide sequence of VGAM1965 RNA, herein designated VGAM RNA, also designated SEQ ID:4676.

Another function of VGAM1965 is therefore inhibition of LOC255252 (Accession XM_170779). Accordingly, utilities of VGAM1965 include diagnosis, prevention and treatment of diseases and clinical conditions associated with LOC255252. LOC255320 (Accession XM_170777) is another VGAM1965 host target gene. LOC255320 BINDING SITE is HOST TARGET binding site found in the 5' untranslated region of mRNA encoded by LOC255320, corresponding to a HOST TARGET binding site such as BINDING SITE I, BINDING SITE II or BINDING SITE III. Table 2 illustrates the complementarity of the nucleotide sequences of LOC255320 BINDING SITE, designated SEQ ID:45544, to the nucleotide sequence of VGAM1965 RNA, herein designated VGAM RNA, also designated SEQ ID:4676.

Another function of VGAM1965 is therefore inhibition of LOC255320 (Accession XM_170777). Accordingly, utilities of VGAM1965 include diagnosis, prevention and treatment of diseases and clinical conditions associated with LOC255320. LOC255327 (Accession XM_171236) is another VGAM1965 host target gene. LOC255327 BINDING SITE is HOST TARGET binding site found in the 5' untranslated region of mRNA encoded by LOC255327, corresponding to a HOST TARGET binding site such as BINDING SITE I, BINDING SITE II or BINDING SITE III. Table 2 illustrates the complementarity of the nucleotide sequences of LOC255327 BINDING SITE, designated SEQ ID:46023, to the nucleotide sequence of VGAM1965 RNA, herein designated VGAM RNA, also designated SEQ ID:4676.

Another function of VGAM1965 is therefore inhibition of LOC255327 (Accession XM_171236). Accordingly, utilities of VGAM1965 include diagnosis, prevention and treatment of diseases and clinical conditions associated with LOC255327. LOC255338 (Accession XM_171105) is another VGAM1965 host target gene. LOC255338 BINDING SITE is HOST TARGET binding site found in the 5' untranslated region of mRNA encoded by LOC255338, corresponding to a HOST TARGET binding site such as BINDING SITE I, BINDING SITE II or BINDING SITE III. Table 2 illustrates the complementarity of the nucleotide sequences of LOC255338 BINDING SITE, designated SEQ ID:45913, to the nucleotide sequence of VGAM1965 RNA, herein designated VGAM RNA, also designated SEQ ID:4676.

Another function of VGAM1965 is therefore inhibition of LOC255338 (Accession XM_171105). Accordingly, utilities of VGAM1965 include diagnosis, prevention and treatment of diseases and clinical conditions associated with LOC255338. LOC255426 (Accession XM_173155) is another VGAM1965 host target gene. LOC255426 BINDING SITE is HOST TARGET binding site found in the 3' untranslated region of mRNA encoded by LOC255426, corresponding to a HOST TARGET binding site such as BINDING SITE I, BINDING SITE II or BINDING SITE III. Table 2 illustrates the complementarity of the nucleotide sequences of LOC255426 BINDING SITE, designated SEQ ID:46410, to the nucleotide sequence of VGAM1965 RNA, herein designated VGAM RNA, also designated SEQ ID:4676.

Another function of VGAM1965 is therefore inhibition of LOC255426 (Accession XM_173155). Accordingly, utilities of VGAM1965 include diagnosis, prevention and treatment of diseases and clinical conditions associated with LOC255426. LOC255533 (Accession XM_173073) is another VGAM1965 host target gene. LOC255533 BINDING SITE is HOST TARGET binding site found in the 5' untranslated region of mRNA encoded by LOC255533, corresponding to a HOST TARGET binding site such as BINDING SITE I, BINDING SITE II or BINDING SITE III. Table 2 illustrates the complementarity of the nucleotide sequences of LOC255533 BINDING SITE, designated SEQ ID:46332, to the nucleotide sequence of VGAM1965 RNA, herein designated VGAM RNA, also designated SEQ ID:4676.

Another function of VGAM1965 is therefore inhibition of LOC255533 (Accession XM_173073). Accordingly, utilities of VGAM1965 include diagnosis, prevention and treatment of diseases and clinical conditions associated with LOC255533. LOC255975 (Accession XM_171083) is another VGAM1965 host target gene. LOC255975 BINDING SITE is HOST TARGET binding site found in the 5' untranslated region of mRNA encoded by LOC255975, corresponding to a HOST TARGET binding site such as BINDING SITE I, BINDING SITE II or BINDING SITE III. Table 2 illustrates the complementarity of the nucleotide sequences of LOC255975 BINDING SITE, designated SEQ ID:45892, to the nucleotide sequence of VGAM1965 RNA, herein designated VGAM RNA, also designated SEQ ID:4676.

Another function of VGAM1965 is therefore inhibition of LOC255975 (Accession XM_171083). Accordingly, utilities of VGAM1965 include diagnosis, prevention and treatment of diseases and clinical conditions associated with LOC255975. LOC256096 (Accession XM_173164) is another VGAM1965 host target gene. LOC256096 BINDING SITE is HOST TARGET binding site found in the 5' untranslated region of mRNA encoded by LOC256096, corresponding to a HOST TARGET binding site such as BINDING SITE I, BINDING SITE II or BINDING SITE III. Table 2 illustrates the complementarity of the nucleotide sequences of LOC256096 BINDING SITE, designated SEQ ID:46420, to the nucleotide sequence of VGAM1965 RNA, herein designated VGAM RNA, also designated SEQ ID:4676.

Another function of VGAM1965 is therefore inhibition of LOC256096 (Accession XM_173164). Accordingly, utilities of VGAM1965 include diagnosis, prevention and treatment of diseases and clinical conditions associated with LOC256096. LOC256207 (Accession XM_170837) is another VGAM1965 host target gene. LOC256207 BINDING SITE is HOST TARGET binding site found in the 3' untranslated region of mRNA encoded by LOC256207, corresponding to a HOST TARGET binding site such as BINDING SITE I, BINDING SITE II or BINDING SITE III. Table 2 illustrates the complementarity of the nucleotide sequences of LOC256207 BINDING SITE, designated SEQ ID:45622, to the nucleotide sequence of VGAM1965 RNA, herein designated VGAM RNA, also designated SEQ ID:4676.

Another function of VGAM1965 is therefore inhibition of LOC256207 (Accession XM_170837). Accordingly, utilities of VGAM1965 include diagnosis, prevention and treatment of diseases and clinical conditions associated with LOC256207. LOC256337 (Accession XM_170643) is another VGAM1965 host target gene. LOC256337 BINDING SITE is HOST TARGET binding site found in the 3' untranslated region of mRNA encoded by LOC256337, corresponding to a HOST TARGET binding site such as BINDING SITE I, BINDING SITE II or BINDING SITE III. Table 2 illustrates the complementarity of the nucleotide sequences of LOC256337 BINDING SITE, designated SEQ ID:45420, to the nucleotide sequence of VGAM1965 RNA, herein designated VGAM RNA, also designated SEQ ID:4676.

Another function of VGAM1965 is therefore inhibition of LOC256337 (Accession XM_170643). Accordingly, utilities of VGAM1965 include diagnosis, prevention and treatment of diseases and clinical conditions associated with LOC256337. LOC256867 (Accession XM_170694) is another VGAM1965 host target gene. LOC256867 BINDING SITE is HOST TARGET binding site found in the 5' untranslated region of mRNA encoded by LOC256867, corresponding to a HOST TARGET binding site such as BINDING SITE I, BINDING SITE II or BINDING SITE III. Table 2 illustrates the complementarity of the nucleotide sequences of LOC256867 BINDING SITE, designated SEQ ID:45477, to the nucleotide sequence of VGAM1965 RNA, herein designated VGAM RNA, also designated SEQ ID:4676.

Another function of VGAM1965 is therefore inhibition of LOC256867 (Accession XM_170694). Accordingly, utilities of VGAM1965 include diagnosis, prevention and treatment of diseases and clinical conditions associated with LOC256867. LOC256905 (Accession XM_173031) is another VGAM1965 host target gene. LOC256905 BINDING SITE is HOST TARGET binding site found in the 3' untranslated region of mRNA encoded by LOC256905, corresponding to a HOST TARGET binding site such as BINDING SITE I, BINDING SITE II or BINDING SITE III. Table 2 illustrates the complementarity of the nucleotide sequences of LOC256905 BINDING SITE, designated SEQ ID:46298, to the nucleotide sequence of VGAM1965 RNA, herein designated VGAM RNA, also designated SEQ ID:4676.

Another function of VGAM1965 is therefore inhibition of LOC256905 (Accession XM_173031). Accordingly, utilities of VGAM1965 include diagnosis, prevention and treatment of diseases and clinical conditions associated with LOC256905. LOC257302 (Accession XM_171750) is another VGAM1965 host target gene. LOC257302 BINDING SITE is HOST TARGET binding site found in the 5' untranslated region of mRNA encoded by LOC257302, corresponding to a HOST TARGET binding site such as BINDING SITE I, BINDING SITE II or BINDING SITE III. Table 2 illustrates the complementarity of the nucleotide sequences of LOC257302 BINDING SITE, designated SEQ ID:46064, to the nucleotide sequence of VGAM1965 RNA, herein designated VGAM RNA, also designated SEQ ID:4676.

Another function of VGAM1965 is therefore inhibition of LOC257302 (Accession XM_171750). Accordingly, utilities of VGAM1965 include diagnosis, prevention and treatment of diseases and clinical conditions associated with LOC257302. LOC257358 (Accession XM_173138) is another VGAM1965 host target gene. LOC257358 BINDING SITE is HOST TARGET binding site found in the 3' untranslated region of mRNA encoded by LOC257358, corresponding to a HOST TARGET binding site such as BINDING SITE I, BINDING SITE II or BINDING SITE III. Table 2 illustrates the complementarity of the nucleotide sequences of LOC257358 BINDING SITE, designated SEQ ID:46389, to the nucleotide sequence of VGAM1965 RNA, herein designated VGAM RNA, also designated SEQ ID:4676.

Another function of VGAM1965 is therefore inhibition of LOC257358 (Accession XM_173138). Accordingly, utilities of VGAM1965 include diagnosis, prevention and treatment of diseases and clinical conditions associated with LOC257358. LOC257431 (Accession XM_088764) is another VGAM1965 host target gene. LOC257431 BINDING SITE is HOST TARGET binding site found in the 5' untranslated region of mRNA encoded by LOC257431, corresponding to a HOST TARGET binding site such as BINDING SITE I, BINDING SITE II or BINDING SITE III. Table 2 illustrates the complementarity of the nucleotide sequences of LOC257431 BINDING SITE, designated SEQ ID:39947, to the nucleotide sequence of VGAM1965 RNA, herein designated VGAM RNA, also designated SEQ ID:4676.

Another function of VGAM1965 is therefore inhibition of LOC257431 (Accession XM_088764). Accordingly, utilities of VGAM1965 include diagnosis, prevention and treatment of diseases and clinical conditions associated with LOC257431. LOC257464 (Accession XM_116972) is another VGAM1965 host target gene. LOC257464 BINDING SITE is HOST TARGET binding site found in the 5' untranslated region of mRNA encoded by LOC257464, corresponding to a HOST TARGET binding site such as BINDING SITE I, BINDING SITE II or BINDING SITE III. Table 2 illustrates the complementarity of the nucleotide sequences of LOC257464 BINDING SITE, designated SEQ ID:43167, to the nucleotide sequence of VGAM1965 RNA, herein designated VGAM RNA, also designated SEQ ID:4676.

Another function of VGAM1965 is therefore inhibition of LOC257464 (Accession XM_116972). Accordingly, utilities of VGAM1965 include diagnosis, prevention and treatment of diseases and clinical conditions associated with LOC257464. LOC257476 (Accession XM_028610) is another VGAM1965 host target gene. LOC257476 BINDING SITE1 and LOC257476 BINDING SITE2 are HOST TARGET binding sites found in untranslated regions of mRNA encoded by LOC257476, corresponding to HOST TARGET binding sites such as BINDING SITE I, BINDING SITE II or BINDING SITE III. Table 2 illustrates the complementarity of the nucleotide sequences of LOC257476 BINDING SITE1 and LOC257476 BINDING SITE2, designated SEQ ID:30716 and SEQ ID:30717 respectively, to the nucleotide sequence of VGAM1965 RNA, herein designated VGAM RNA, also designated SEQ ID:4676.

Another function of VGAM1965 is therefore inhibition of LOC257476 (Accession XM_028610). Accordingly, utilities of VGAM1965 include diagnosis, prevention and treatment of diseases and clinical conditions associated with LOC257476. LOC257596 (Accession XM_175296) is another VGAM1965 host target gene. LOC257596 BINDING SITE is HOST TARGET binding site found in the 3' untranslated region of mRNA encoded by LOC257596, corresponding to a HOST TARGET binding site such as BINDING SITE I, BINDING SITE II or BINDING SITE III. Table 2 illustrates the complementarity of the nucleotide sequences of LOC257596 BINDING SITE, designated SEQ ID:46755, to the nucleotide sequence of VGAM1965 RNA, herein designated VGAM RNA, also designated SEQ ID:4676.

Another function of VGAM1965 is therefore inhibition of LOC257596 (Accession XM_175296). Accordingly, utilities of VGAM1965 include diagnosis, prevention and treatment of diseases and clinical conditions associated with LOC257596. LOC257601 (Accession XM_175231) is another VGAM1965 host target gene. LOC257601 BINDING SITE is HOST TARGET binding site found in the 3' untranslated region of mRNA encoded by LOC257601, corresponding to a HOST TARGET binding site such as BINDING SITE I, BINDING SITE II or BINDING SITE III. Table 2 illustrates the complementarity of the nucleotide sequences of LOC257601 BINDING SITE, designated SEQ ID:46697, to the nucleotide sequence of VGAM1965 RNA, herein designated VGAM RNA, also designated SEQ ID:4676.

Another function of VGAM1965 is therefore inhibition of LOC257601 (Accession XM_175231). Accordingly, utilities of VGAM1965 include diagnosis, prevention and treatment of diseases and clinical conditions associated with LOC257601. LOC257615 (Accession XM_175293) is another VGAM1965 host target gene. LOC257615 BINDING SITE is HOST TARGET binding site found in the 5' untranslated region of mRNA encoded by LOC257615, corresponding to a HOST TARGET binding site such as BINDING SITE I, BINDING SITE II or BINDING SITE III. Table 2 illustrates the complementarity of the nucleotide sequences of LOC257615 BINDING SITE, designated SEQ ID:46744, to the nucleotide sequence of VGAM1965 RNA, herein designated VGAM RNA, also designated SEQ ID:4676.

Another function of VGAM1965 is therefore inhibition of LOC257615 (Accession XM_175293). Accordingly, utilities of VGAM1965 include diagnosis, prevention and treatment of diseases and clinical conditions associated with LOC257615. LOC51134 (Accession NM_016122) is another VGAM1965 host target gene. LOC51134 BINDING SITE1 and LOC51134 BINDING SITE2 are HOST TARGET binding sites found in untranslated regions of mRNA encoded by LOC51134, corresponding to HOST TARGET binding sites such as BINDING SITE I, BINDING SITE II or BINDING SITE III. Table 2 illustrates the complementarity of the nucleotide sequences of LOC51134 BINDING SITE1 and LOC51134 BINDING SITE2, designated SEQ ID:18212 and SEQ ID:18211 respectively, to the nucleotide sequence of VGAM1965 RNA, herein designated VGAM RNA, also designated SEQ ID:4676.

Another function of VGAM1965 is therefore inhibition of LOC51134 (Accession NM_016122). Accordingly, utilities of VGAM1965 include diagnosis, prevention and treatment of diseases and clinical conditions associated with LOC51134. LOC51301 (Accession NM_016591) is another VGAM1965 host target gene. LOC51301 BINDING SITE is HOST TARGET binding site found in the 3' untranslated region of mRNA encoded by LOC51301, corresponding to a HOST TARGET binding site such as BINDING SITE I, BINDING SITE II or BINDING SITE III. Table 2 illustrates the complementarity of the nucleotide sequences of LOC51301 BINDING SITE, designated SEQ ID:18672, to the nucleotide sequence of VGAM1965 RNA, herein designated VGAM RNA, also designated SEQ ID:4676.

Another function of VGAM1965 is therefore inhibition of LOC51301 (Accession NM_016591). Accordingly, utilities of VGAM1965 include diagnosis, prevention and treatment of diseases and clinical conditions associated with LOC51301. LOC51308 (Accession NM_016606) is another VGAM1965 host target gene. LOC51308 BINDING SITE is HOST TARGET binding site found in the 3' untranslated region of mRNA encoded by LOC51308, corresponding to a HOST TARGET binding site such as BINDING SITE I, BINDING SITE II or BINDING SITE III. Table 2 illustrates the complementarity of the nucleotide sequences of LOC51308 BINDING SITE, designated SEQ ID:18709, to the nucleotide sequence of VGAM1965 RNA, herein designated VGAM RNA, also designated SEQ ID:4676.

Another function of VGAM1965 is therefore inhibition of LOC51308 (Accession NM_016606). Accordingly, utilities of VGAM1965 include diagnosis, prevention and treatment of diseases and clinical conditions associated with LOC51308. LOC51580 (Accession NM_015874) is another VGAM1965 host target gene. LOC51580 BINDING SITE is HOST TARGET binding site found in the 5' untranslated region of mRNA encoded by LOC51580, corresponding to a HOST TARGET binding site such as BINDING SITE I, BINDING SITE II or BINDING SITE III. Table 2 illustrates the complementarity of the nucleotide sequences of LOC51580 BINDING SITE, designated SEQ ID:18016, to the nucleotide sequence of VGAM1965 RNA, herein designated VGAM RNA, also designated SEQ ID:4676.

Another function of VGAM1965 is therefore inhibition of LOC51580 (Accession NM_015874). Accordingly, utilities of VGAM1965 include diagnosis, prevention and treatment of diseases and clinical conditions associated with LOC51580. LOC51696 (Accession NM_016217) is another VGAM1965 host target gene. LOC51696 BINDING SITE is HOST TARGET binding site found in the 3' untranslated region of mRNA encoded by LOC51696, corresponding to a HOST TARGET binding site such as BINDING SITE I, BINDING SITE II or BINDING SITE III. Table 2 illustrates the complementarity of the nucleotide sequences of LOC51696 BINDING SITE, designated SEQ ID:18316, to the nucleotide sequence of VGAM1965 RNA, herein designated VGAM RNA, also designated SEQ ID:4676.

Another function of VGAM1965 is therefore inhibition of LOC51696 (Accession NM_016217). Accordingly, utilities of VGAM1965 include diagnosis, prevention and treatment of diseases and clinical conditions associated with LOC51696. LOC56920 (Accession NM_020163) is another VGAM1965 host target gene. LOC56920 BINDING SITE is HOST TARGET binding site found in the 3' untranslated region of mRNA encoded by LOC56920, corresponding to a HOST TARGET binding site such as BINDING SITE I, BINDING SITE II or BINDING SITE III. Table 2 illustrates the complementarity of the nucleotide sequences of LOC56920 BINDING SITE, designated SEQ ID:21383, to the nucleotide sequence of VGAM1965 RNA, herein designated VGAM RNA, also designated SEQ ID:4676.

Another function of VGAM1965 is therefore inhibition of LOC56920 (Accession NM_020163). Accordingly, utilities of VGAM1965 include diagnosis, prevention and treatment of diseases and clinical conditions associated with LOC56920. LOC57805 (Accession NM_021174) is another VGAM1965 host target gene. LOC57805 BINDING SITE is HOST TARGET binding site found in the 3' untranslated region of mRNA encoded by LOC57805, corresponding to a HOST TARGET binding site such as BINDING SITE I, BINDING SITE II or BINDING SITE III. Table 2 illustrates the complementarity of the nucleotide sequences of LOC57805 BINDING SITE, designated SEQ ID:22150, to the nucleotide sequence of VGAM1965 RNA, herein designated VGAM RNA, also designated SEQ ID:4676.

Another function of VGAM1965 is therefore inhibition of LOC57805 (Accession NM_021174). Accordingly, utilities of VGAM1965 include diagnosis, prevention and treatment of diseases and clinical conditions associated with LOC57805. LOC58525 (Accession XM_086045) is another VGAM1965 host target gene. LOC58525 BINDING SITE is HOST TARGET binding site found in the 3' untranslated region of mRNA encoded by LOC58525, corresponding to a HOST TARGET binding site such as BINDING SITE I, BINDING SITE II or BINDING SITE III. Table 2 illustrates the complementarity of the nucleotide sequences of LOC58525 BINDING SITE, designated SEQ ID:38460, to the nucleotide sequence of VGAM1965 RNA, herein designated VGAM RNA, also designated SEQ ID:4676.

Another function of VGAM1965 is therefore inhibition of LOC58525 (Accession XM_086045). Accordingly, utilities of VGAM1965 include diagnosis, prevention and treatment of diseases and clinical conditions associated with LOC58525. LOC90019 (Accession NM_138567) is another VGAM1965 host target gene. LOC90019 BINDING SITE1 through LOC90019 BINDING SITE3 are HOST TARGET binding sites found in untranslated regions of mRNA encoded by LOC90019, corresponding to HOST TARGET binding sites such as BINDING SITE I, BINDING SITE II or BINDING SITE III. Table 2 illustrates the complementarity of the nucleotide sequences of LOC90019 BINDING SITE1 through LOC90019 BINDING SITE3, designated SEQ ID:28874, SEQ ID:28875 and SEQ ID:28876 respectively, to the nucleotide sequence of VGAM1965 RNA, herein designated VGAM RNA, also designated SEQ ID:4676.

Another function of VGAM1965 is therefore inhibition of LOC90019 (Accession NM_138567). Accordingly, utilities of VGAM1965 include diagnosis, prevention and treatment of diseases and clinical conditions associated with LOC90019. LOC90092 (Accession XM_028862) is another VGAM1965 host target gene. LOC90092 BINDING SITE1 and LOC90092 BINDING SITE2 are HOST TARGET binding sites found in untranslated regions of mRNA encoded by LOC90092, corresponding to HOST TARGET binding sites such as BINDING SITE I, BINDING SITE II or BINDING SITE III. Table 2 illustrates the complementarity of the nucleotide sequences of LOC90092 BINDING SITE1 and LOC90092 BINDING SITE2, designated SEQ ID:30782 and SEQ ID:30793 respectively, to the nucleotide sequence of VGAM1965 RNA, herein designated VGAM RNA, also designated SEQ ID:4676.

Another function of VGAM1965 is therefore inhibition of LOC90092 (Accession XM_028862). Accordingly, utilities of VGAM1965 include diagnosis, prevention and treatment of diseases and clinical conditions associated with LOC90092. LOC90246 (Accession XM_030283) is another VGAM1965 host target gene. LOC90246 BINDING SITE is HOST TARGET binding site found in the 3' untranslated region of mRNA encoded by LOC90246, corresponding to a HOST TARGET binding site such as BINDING SITE I, BINDING SITE II or BINDING SITE III. Table 2 illustrates the complementarity of the nucleotide sequences of LOC90246 BINDING SITE, designated SEQ ID:31003, to the nucleotide sequence of VGAM1965 RNA, herein designated VGAM RNA, also designated SEQ ID:4676.

Another function of VGAM1965 is therefore inhibition of LOC90246 (Accession XM_030283). Accordingly, utilities of VGAM1965 include diagnosis, prevention and treatment of diseases and clinical conditions associated with LOC90246. LOC90379 (Accession XM_031308) is another VGAM1965 host target gene. LOC90379 BINDING SITE is HOST TARGET binding site found in the 5' untranslated region of mRNA encoded by LOC90379, corresponding to a HOST TARGET binding site such as BINDING SITE I, BINDING SITE II or BINDING SITE III. Table 2 illustrates the complementarity of the nucleotide sequences of LOC90379 BINDING SITE, designated SEQ ID:31338, to the nucleotide sequence of VGAM1965 RNA, herein designated VGAM RNA, also designated SEQ ID:4676.

Another function of VGAM1965 is therefore inhibition of LOC90379 (Accession XM_031308). Accordingly, utilities of VGAM1965 include diagnosis, prevention and treatment of diseases and clinical conditions associated with LOC90379. LOC90459 (Accession XM_031826) is another VGAM1965 host target gene. LOC90459 BINDING SITE is HOST TARGET binding site found in the 3' untranslated region of mRNA encoded by LOC90459, corresponding to a HOST TARGET binding site such as BINDING SITE I, BINDING SITE II or BINDING SITE III. Table 2 illustrates the complementarity of the nucleotide sequences of LOC90459 BINDING SITE, designated SEQ ID:31493, to the nucleotide sequence of VGAM1965 RNA, herein designated VGAM RNA, also designated SEQ ID:4676.

Another function of VGAM1965 is therefore inhibition of LOC90459 (Accession XM_031826). Accordingly, utilities of VGAM1965 include diagnosis, prevention and treatment of diseases and clinical conditions associated with LOC90459. LOC90509 (Accession XM_032209) is another VGAM1965 host target gene. LOC90509 BINDING SITE is HOST TARGET binding site found in the 5' untranslated region of mRNA encoded by LOC90509, corresponding to a HOST TARGET binding site such as BINDING SITE I, BINDING SITE II or BINDING SITE III. Table 2 illustrates the complementarity of the nucleotide sequences of LOC90509 BINDING SITE, designated SEQ ID:31610, to the nucleotide sequence of VGAM1965 RNA, herein designated VGAM RNA, also designated SEQ ID:4676.

Another function of VGAM1965 is therefore inhibition of LOC90509 (Accession XM_032209). Accordingly, utilities of VGAM1965 include diagnosis, prevention and treatment of diseases and clinical conditions associated with LOC90509. LOC90529 (Accession XM_032350) is another VGAM1965 host target gene. LOC90529 BINDING SITE is HOST TARGET binding site found in the 3' untranslated region of mRNA encoded by LOC90529, corresponding to a HOST TARGET binding site such as BINDING SITE I, BINDING SITE II or BINDING SITE III. Table 2 illustrates the complementarity of the nucleotide sequences of LOC90529 BINDING SITE, designated SEQ ID:31639, to the nucleotide sequence of VGAM1965 RNA, herein designated VGAM RNA, also designated SEQ ID:4676.

Another function of VGAM1965 is therefore inhibition of LOC90529 (Accession XM_032350). Accordingly, utilities of VGAM1965 include diagnosis, prevention and treatment of diseases and clinical conditions associated with LOC90529. LOC90538 (Accession XM_032401) is another VGAM1965 host target gene. LOC90538 BINDING SITE is HOST TARGET binding site found in the 3' untranslated region of mRNA encoded by LOC90538, corresponding to a HOST TARGET binding site such as BINDING SITE I, BINDING SITE II or BINDING SITE III. Table 2 illustrates the complementarity of the nucleotide sequences of LOC90538 BINDING SITE, designated SEQ ID:31660, to the nucleotide sequence of VGAM1965 RNA, herein designated VGAM RNA, also designated SEQ ID:4676.

Another function of VGAM1965 is therefore inhibition of LOC90538 (Accession XM_032401). Accordingly, utilities of VGAM1965 include diagnosis, prevention and treatment of diseases and clinical conditions associated with LOC90538. LOC90670 (Accession XM_033352) is another VGAM1965 host target gene. LOC90670 BINDING SITE is HOST TARGET binding site found in the 3' untranslated region of mRNA encoded by LOC90670, corresponding to a HOST TARGET binding site such as BINDING SITE I, BINDING SITE II or BINDING SITE III. Table 2 illustrates the complementarity of the nucleotide sequences of LOC90670 BINDING SITE, designated SEQ ID:31884, to the nucleotide sequence of VGAM1965 RNA, herein designated VGAM RNA, also designated SEQ ID:4676.

Another function of VGAM1965 is therefore inhibition of LOC90670 (Accession XM_033352). Accordingly, utilities of VGAM1965 include diagnosis, prevention and treatment of diseases and clinical conditions associated with LOC90670. LOC90750 (Accession XM_033868) is another VGAM1965 host target gene. LOC90750 BINDING SITE is HOST TARGET binding site found in the 3' untranslated region of mRNA encoded by LOC90750, corresponding to a HOST TARGET binding site such as BINDING SITE I, BINDING SITE II or BINDING SITE III. Table 2 illustrates the complementarity of the nucleotide sequences of LOC90750 BINDING SITE, designated SEQ ID:31970, to the nucleotide sequence of VGAM1965 RNA, herein designated VGAM RNA, also designated SEQ ID:4676.

Another function of VGAM1965 is therefore inhibition of LOC90750 (Accession XM_033868). Accordingly, utilities of VGAM1965 include diagnosis, prevention and treatment of diseases and clinical conditions associated with LOC90750. LOC90918 (Accession XM_034863) is another VGAM1965 host target gene. LOC90918 BINDING SITE is HOST TARGET binding site found in the 5' untranslated region of mRNA encoded by LOC90918, corresponding to a HOST TARGET binding site such as BINDING SITE I, BINDING SITE II or BINDING SITE III. Table 2 illustrates the complementarity of the nucleotide sequences of LOC90918 BINDING SITE, designated SEQ ID:32177, to the nucleotide sequence of VGAM1965 RNA, herein designated VGAM RNA, also designated SEQ ID:4676.

Another function of VGAM1965 is therefore inhibition of LOC90918 (Accession XM_034863). Accordingly, utilities of VGAM1965 include diagnosis, prevention and treatment of diseases and clinical conditions associated with LOC90918. LOC91040 (Accession XM_035641) is another VGAM1965 host target gene. LOC91040 BINDING SITE is HOST TARGET binding site found in the 3' untranslated region of mRNA encoded by LOC91040, corresponding to a HOST TARGET binding site such as BINDING SITE I, BINDING SITE II or BINDING SITE III. Table 2 illustrates the complementarity of the nucleotide sequences of LOC91040 BINDING SITE, designated SEQ ID:32324, to the nucleotide sequence of VGAM1965 RNA, herein designated VGAM RNA, also designated SEQ ID:4676.

Another function of VGAM1965 is therefore inhibition of LOC91040 (Accession XM_035641). Accordingly, utilities of VGAM1965 include diagnosis, prevention and treatment of diseases and clinical conditions associated with LOC91040. LOC91069 (Accession XM_035824) is another VGAM1965 host target gene. LOC91069 BINDING SITE is HOST TARGET binding site found in the 3' untranslated region of mRNA encoded by LOC91069, corresponding to a HOST TARGET binding site such as BINDING SITE I, BINDING SITE II or BINDING SITE III. Table 2 illustrates the complementarity of the nucleotide sequences of LOC91069 BINDING SITE, designated SEQ ID:32347, to the nucleotide sequence of VGAM1965 RNA, herein designated VGAM RNA, also designated SEQ ID:4676.

Another function of VGAM1965 is therefore inhibition of LOC91069 (Accession XM_035824). Accordingly, utilities of VGAM1965 include diagnosis, prevention and treatment of diseases and clinical conditions associated with LOC91069. LOC91149 (Accession XM_036480) is another VGAM1965 host target gene. LOC91149 BINDING SITE is HOST TARGET binding site found in the 3' untranslated region of mRNA encoded by LOC91149, corresponding to a HOST TARGET binding site such as BINDING SITE I, BINDING SITE II or BINDING SITE III. Table 2 illustrates the complementarity of the nucleotide sequences of LOC91149 BINDING SITE, designated SEQ ID:32459, to the nucleotide sequence of VGAM1965 RNA, herein designated VGAM RNA, also designated SEQ ID:4676.

Another function of VGAM1965 is therefore inhibition of LOC91149 (Accession XM_036480). Accordingly, utilities of VGAM1965 include diagnosis, prevention and treatment of diseases and clinical conditions associated with LOC91149. LOC91408 (Accession XM_038290) is another VGAM1965 host target gene. LOC91408 BINDING SITE is HOST TARGET binding site found in the 3' untranslated region of mRNA encoded by LOC91408, corresponding to a HOST TARGET binding site such as BINDING SITE I, BINDING SITE II or BINDING SITE III. Table 2 illustrates the complementarity of the nucleotide sequences of LOC91408 BINDING SITE, designated SEQ ID:32793, to the nucleotide sequence of VGAM1965 RNA, herein designated VGAM RNA, also designated SEQ ID:4676.

Another function of VGAM1965 is therefore inhibition of LOC91408 (Accession XM_038290). Accordingly, utilities of VGAM1965 include diagnosis, prevention and treatment of diseases and clinical conditions associated with LOC91408. LOC91445 (Accession XM_018516) is another VGAM1965 host target gene. LOC91445 BINDING SITE is HOST TARGET binding site found in the 3' untranslated region of mRNA encoded by LOC91445, corresponding to a HOST TARGET binding site such as BINDING SITE I, BINDING SITE II or BINDING SITE III. Table 2 illustrates the complementarity of the nucleotide sequences of LOC91445 BINDING SITE, designated SEQ ID:30373, to the nucleotide sequence of VGAM1965 RNA, herein designated VGAM RNA, also designated SEQ ID:4676.

Another function of VGAM1965 is therefore inhibition of LOC91445 (Accession XM_018516). Accordingly, utilities of VGAM1965 include diagnosis, prevention and treatment of diseases and clinical conditions associated with LOC91445. LOC91464 (Accession XM_038589) is another VGAM1965 host target gene. LOC91464 BINDING SITE is HOST TARGET binding site found in the 5' untranslated region of mRNA encoded by LOC91464, corresponding to a HOST TARGET binding site such as BINDING SITE I, BINDING SITE II or BINDING SITE III. Table 2 illustrates the complementarity of the nucleotide sequences of LOC91464 BINDING SITE, designated SEQ ID:32875, to the nucleotide sequence of VGAM1965 RNA, herein designated VGAM RNA, also designated SEQ ID:4676.

Another function of VGAM1965 is therefore inhibition of LOC91464 (Accession XM_038589). Accordingly, utilities of VGAM1965 include diagnosis, prevention and treatment of diseases and clinical conditions associated with LOC91464. LOC91948 (Accession XM_041723) is another VGAM1965 host target gene. LOC91948 BINDING SITE is HOST TARGET binding site found in the 3' untranslated region of mRNA encoded by LOC91948, corresponding to a HOST TARGET binding site such as BINDING SITE I, BINDING SITE II or BINDING SITE III. Table 2 illustrates the complementarity of the nucleotide sequences of LOC91948 BINDING SITE, designated SEQ ID:33576, to the nucleotide sequence of VGAM1965 RNA, herein designated VGAM RNA, also designated SEQ ID:4676.

Another function of VGAM1965 is therefore inhibition of LOC91948 (Accession XM_041723). Accordingly, utilities of VGAM1965 include diagnosis, prevention and treatment of diseases and clinical conditions associated with LOC91948. LOC92078 (Accession XM_042684) is another VGAM1965 host target gene. LOC92078 BINDING SITE is HOST TARGET binding site found in the 3' untranslated region of mRNA encoded by LOC92078, corresponding to a HOST TARGET binding site such as BINDING SITE I, BINDING SITE II or BINDING SITE III. Table 2 illustrates the complementarity of the nucleotide sequences of LOC92078 BINDING SITE, designated SEQ ID:33748, to the nucleotide sequence of VGAM1965 RNA, herein designated VGAM RNA, also designated SEQ ID:4676.

Another function of VGAM1965 is therefore inhibition of LOC92078 (Accession XM_042684). Accordingly, utilities of VGAM1965 include diagnosis, prevention and treatment of diseases and clinical conditions associated with LOC92078. LOC92140 (Accession XM_043070) is another VGAM1965 host target gene. LOC92140 BINDING SITE is HOST TARGET binding site found in the 3' untranslated region of mRNA encoded by LOC92140, corresponding to a HOST TARGET binding site such as BINDING SITE I, BINDING SITE II or BINDING SITE III. Table 2 illustrates the complementarity of the nucleotide sequences of LOC92140 BINDING SITE, designated SEQ ID:33888, to the nucleotide sequence of VGAM1965 RNA, herein designated VGAM RNA, also designated SEQ ID:4676.

Another function of VGAM1965 is therefore inhibition of LOC92140 (Accession XM_043070). Accordingly, utilities of VGAM1965 include diagnosis, prevention and treatment of diseases and clinical conditions associated with LOC92140. LOC92181 (Accession XM_043394) is another VGAM1965 host target gene. LOC92181 BINDING SITE is HOST TARGET binding site found in the 3' untranslated region of mRNA encoded by LOC92181, corresponding to a HOST TARGET binding site such as BINDING SITE I, BINDING SITE II or BINDING SITE III. Table 2 illustrates the complementarity of the nucleotide sequences of LOC92181 BINDING SITE, designated SEQ ID:33945, to the nucleotide sequence of VGAM1965 RNA, herein designated VGAM RNA, also designated SEQ ID:4676.

Another function of VGAM1965 is therefore inhibition of LOC92181 (Accession XM_043394). Accordingly, utilities of VGAM1965 include diagnosis, prevention and treatment of diseases and clinical conditions associated with LOC92181. LOC92249 (Accession XM_043814) is another VGAM1965 host target gene. LOC92249 BINDING SITE is HOST TARGET binding site found in the 5' untranslated region of mRNA encoded by LOC92249, corresponding to a HOST TARGET binding site such as BINDING SITE I, BINDING SITE II or BINDING SITE III. Table 2 illustrates the complementarity of the nucleotide sequences of LOC92249 BINDING SITE, designated SEQ ID:34026, to the nucleotide sequence of VGAM1965 RNA, herein designated VGAM RNA, also designated SEQ ID:4676.

Another function of VGAM1965 is therefore inhibition of LOC92249 (Accession XM_043814). Accordingly, utilities of VGAM1965 include diagnosis, prevention and treatment of diseases and clinical conditions associated with LOC92249. LOC92267 (Accession XM_043979) is another VGAM1965 host target gene. LOC92267 BINDING SITE1 and LOC92267 BINDING SITE2 are HOST TARGET binding sites found in untranslated regions of mRNA encoded by LOC92267, corresponding to HOST TARGET binding sites such as BINDING SITE I, BINDING SITE II or BINDING SITE III. Table 2 illustrates the complementarity of the nucleotide sequences of LOC92267 BINDING SITE1 and LOC92267 BINDING SITE2, designated SEQ ID:34056 and SEQ ID:34059 respectively, to the nucleotide sequence of VGAM1965 RNA, herein designated VGAM RNA, also designated SEQ ID:4676.

Another function of VGAM1965 is therefore inhibition of LOC92267 (Accession XM_043979). Accordingly, utilities of VGAM1965 include diagnosis, prevention and treatment of diseases and clinical conditions associated with LOC92267. LOC92379 (Accession XM_044712) is another VGAM1965 host target gene. LOC92379 BINDING SITE is HOST TARGET binding site found in the 3' untranslated region of mRNA encoded by LOC92379, corresponding to a HOST TARGET binding site such as BINDING SITE I, BINDING SITE II or BINDING SITE III. Table 2 illustrates the complementarity of the nucleotide sequences of LOC92379 BINDING SITE, designated SEQ ID:34267, to the nucleotide sequence of VGAM1965 RNA, herein designated VGAM RNA, also designated SEQ ID:4676.

Another function of VGAM1965 is therefore inhibition of LOC92379 (Accession XM_044712). Accordingly, utilities of VGAM1965 include diagnosis, prevention and treatment of diseases and clinical conditions associated with LOC92379. LOC92661 (Accession XM_046465) is another VGAM1965 host target gene. LOC92661 BINDING SITE is HOST TARGET binding site found in the 3' untranslated region of mRNA encoded by LOC92661, corresponding to a HOST TARGET binding site such as BINDING SITE I, BINDING SITE II or BINDING SITE III. Table 2 illustrates the complementarity of the nucleotide sequences of LOC92661 BINDING SITE, designated SEQ ID:34723, to the nucleotide sequence of VGAM1965 RNA, herein designated VGAM RNA, also designated SEQ ID:4676.

Another function of VGAM1965 is therefore inhibition of LOC92661 (Accession XM_046465). Accordingly, utilities of VGAM1965 include diagnosis, prevention and treatment of diseases and clinical conditions associated with LOC92661. LOC92771 (Accession NM_033424) is another VGAM1965 host target gene. LOC92771 BINDING SITE is HOST TARGET binding site found in the 3' untranslated region of mRNA encoded by LOC92771, corresponding to a HOST TARGET binding site such as BINDING SITE I, BINDING SITE II or BINDING SITE III. Table 2 illustrates the complementarity of the nucleotide sequences of LOC92771 BINDING SITE, designated SEQ ID:27248, to the nucleotide sequence of VGAM1965 RNA, herein designated VGAM RNA, also designated SEQ ID:4676.

Another function of VGAM1965 is therefore inhibition of LOC92771 (Accession NM_033424). Accordingly, utilities of VGAM1965 include diagnosis, prevention and treatment of diseases and clinical conditions associated with LOC92771. LOC93052 (Accession XM_048905) is another VGAM1965 host target gene. LOC93052 BINDING SITE is HOST TARGET binding site found in the 5' untranslated region of mRNA encoded by LOC93052, corresponding to a HOST TARGET binding site such as BINDING SITE I, BINDING SITE II or BINDING SITE III. Table 2 illustrates the complementarity of the nucleotide sequences of LOC93052 BINDING SITE, designated SEQ ID:35301, to the nucleotide sequence of VGAM1965 RNA, herein designated VGAM RNA, also designated SEQ ID:4676.

Another function of VGAM1965 is therefore inhibition of LOC93052 (Accession XM_048905). Accordingly, utilities of VGAM1965 include diagnosis, prevention and treatment of diseases and clinical conditions associated with LOC93052. LOC93070 (Accession XM_049046) is another VGAM1965 host target gene. LOC93070 BINDING SITE is HOST TARGET binding site found in the 5' untranslated region of mRNA encoded by LOC93070, corresponding to a HOST TARGET binding site such as BINDING SITE I, BINDING SITE II or BINDING SITE III. Table 2 illustrates the complementarity of the nucleotide sequences of LOC93070 BINDING SITE, designated SEQ ID:35324, to the nucleotide sequence of VGAM1965 RNA, herein designated VGAM RNA, also designated SEQ ID:4676.

Another function of VGAM1965 is therefore inhibition of LOC93070 (Accession XM_049046). Accordingly, utilities of VGAM1965 include diagnosis, prevention and treatment of diseases and clinical conditions associated with LOC93070. LOC93622 (Accession NM_138699) is another VGAM1965 host target gene. LOC93622 BINDING SITE is HOST TARGET binding site found in the 3' untranslated region of mRNA encoded by LOC93622, corresponding to a HOST TARGET binding site such as BINDING SITE I, BINDING SITE II or BINDING SITE III. Table 2 illustrates the complementarity of the nucleotide sequences of LOC93622 BINDING SITE, designated SEQ ID:28949, to the nucleotide sequence of VGAM1965 RNA, herein designated VGAM RNA, also designated SEQ ID:4676.

Another function of VGAM1965 is therefore inhibition of LOC93622 (Accession NM_138699). Accordingly, utilities of VGAM1965 include diagnosis, prevention and treatment of diseases and clinical conditions associated with LOC93622. LOC93624 (Accession XM_052624) is another VGAM1965 host target gene. LOC93624 BINDING SITE is HOST TARGET binding site found in the 5' untranslated region of mRNA encoded by LOC93624, corresponding to a HOST TARGET binding site such as BINDING SITE I, BINDING SITE II or BINDING SITE III. Table 2 illustrates the complementarity of the nucleotide sequences of LOC93624 BINDING SITE, designated SEQ ID:36015, to the nucleotide sequence of VGAM1965 RNA, herein designated VGAM RNA, also designated SEQ ID:4676.

Another function of VGAM1965 is therefore inhibition of LOC93624 (Accession XM_052624). Accordingly, utilities of VGAM1965 include diagnosis, prevention and treatment of diseases and clinical conditions associated with LOC93624. FIG. 1 further provides a conceptual description of a novel bioinformatically detected viral gene of the present invention, referred to here as Viral Genomic Address Messenger 1966 (VGAM1966) viral gene, which modulates expression of respective host target genes thereof, the function and utility of which host target genes is known in the art.

VGAM1966 is a novel bioinformatically detected regulatory, non protein coding, viral micro RNA (miRNA) gene. The method by which VGAM1966 was detected is described hereinabove with reference to FIGS. 1-8.

VGAM1966 gene, herein designated VGAM GENE, is a viral gene contained in the genome of Rana Tigrina Ranavirus. VGAM1966 host target gene, herein designated VGAM HOST TARGET GENE, is a human gene contained in the human genome.

VGAM1966 gene encodes a VGAM1966 precursor RNA, herein designated VGAM PRECURSOR RNA. Similar to other miRNA genes, and unlike most ordinary genes, VGAM1966 precursor RNA does not encode a protein. A nucleotide sequence identical or highly similar to the nucleotide sequence of VGAM1966 precursor RNA is designated SEQ ID:1952, and is provided hereinbelow with reference to the sequence listing part. Nucleotide sequence SEQ ID:1952 is located at position 88719 relative to the genome of Rana Tigrina Ranavirus.

VGAM1966 precursor RNA folds onto itself, forming VGAM1966 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1966 folded precursor RNA into VGAM1966 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM1966 RNA is designated SEQ ID:4677, and is provided hereinbelow with reference to the sequence listing part.

VGAM1966 host target gene, herein designated VGAM HOST TARGET GENE, encodes a corresponding messenger RNA, VGAM1966 host target RNA, herein designated VGAM HOST TARGET RNA. VGAM1966 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1966 RNA, herein designated VGAM RNA, binds complementarily to one or more host target binding sites located in untranslated regions of VGAM1966 host target RNA, herein designated VGAM HOST TARGET RNA. This complementary binding is due to the fact that the nucleotide sequence of VGAM1966 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1966 RNA, herein designated VGAM RNA, may have a different number of host target binding sites in untranslated regions of a VGAM1966 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1966 RNA, herein designated VGAM RNA, to host target binding sites on VGAM1966 host target RNA, herein designated VGAM HOST TARGET RNA, such as BINDING SITE I, BINDING SITE II and BINDING SITE III, inhibits translation of VGAM1966 host target RNA into VGAM1966 host target protein, herein designated VGAM HOST TARGET PROTEIN. VGAM host target protein is therefore outlined by a broken line.

It is appreciated that VGAM1966 host target gene, herein designated VGAM HOST TARGET GENE, in fact represents a plurality of VGAM1966 host target genes. The mRNA of each one of this plurality of VGAM1966 host target genes comprises one or more host target binding sites, each having a nucleotide sequence which is at least partly complementary to VGAM1966 RNA, herein designated VGAM RNA, and which when bound by VGAM1966 RNA causes inhibition of translation of respective one or more VGAM1966 host target proteins.

It is further appreciated by one skilled in the art that the mode of translational inhibition illustrated by FIG. 1 with specific reference to translational inhibition exerted by VGAM1966 gene, herein designated VGAM GENE, on one or more VGAM1966 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1966 is inhibition of expression of host target genes, as part of a novel viral mechanism of attacking a host. Accordingly, utilities of VGAM1966 include diagnosis, prevention and treatment of viral infection by Rana Tigrina Ranavirus. Specific functions, and accordingly utilities, of VGAM1966 correlate with, and may be deduced from, the identity of the host target genes which VGAM1966 binds and inhibits, and the function of these host target genes, as elaborated hereinbelow.

Nucleotide sequences of the VGAM1966 precursor RNA, herein designated VGAM PRECURSOR RNA, and of the 'diced' VGAM1966 RNA, herein designated VGAM RNA, and a schematic representation of the secondary folding of VGAM1966 folded precursor RNA, herein designated VGAM FOLDED PRECURSOR RNA, of VGAM1966 are further described hereinbelow with reference to Table 1.

Nucleotide sequences of host target binding sites, such as BINDING SITE-I, BINDING SITE-II and BINDING SITE-III of FIG. 1, found on VGAM1966 host target RNA, and schematic representation of the complementarity of each of these host target binding sites to VGAM1966 RNA, herein designated VGAM RNA, are described hereinbelow with reference to Table 2.

As mentioned hereinabove with reference to FIG. 1, a function of VGAM1966 gene, herein designated VGAM is inhibition of expression of VGAM1966 target genes. It is appreciated that specific functions, and accordingly utilities, of VGAM1966 correlate with, and may be deduced from, the identity of the target genes which VGAM1966 binds and inhibits, and the function of these target genes, as elaborated hereinbelow.

Surfeit 6 (SURF6, Accession NM_006753) is a VGAM1966 host target gene. SURF6 BINDING SITE is HOST TARGET binding site found in the 3' untranslated region of mRNA encoded by SURF6, corresponding to a HOST TARGET binding site such as BINDING SITE I, BINDING SITE II or BINDING SITE III. Table 2 illustrates the complementarity of the nucleotide sequences of SURF6 BINDING SITE, designated SEQ ID:13608, to the nucleotide sequence of VGAM1966 RNA, herein designated VGAM RNA, also designated SEQ ID:4677.

A function of VGAM1966 is therefore inhibition of Surfeit 6 (SURF6, Accession NM_006753). Accordingly, utilities of VGAM1966 include diagnosis, prevention and treatment of diseases and clinical conditions associated with SURF6. FIG. 1 further provides a conceptual description of a novel bioinformatically detected viral gene of the present invention, referred to here as Viral Genomic Address Messenger 1967 (VGAM1967) viral gene, which modulates expression of respective host target genes thereof, the function and utility of which host target genes is known in the art.

VGAM1967 is a novel bioinformatically detected regulatory, non protein coding, viral micro RNA (miRNA) gene. The method by which VGAM1967 was detected is described hereinabove with reference to FIGS. 1-8.

VGAM1967 gene, herein designated VGAM GENE, is a viral gene contained in the genome of Rana Tigrina Ranavirus. VGAM1967 host target gene, herein designated VGAM HOST TARGET GENE, is a human gene contained in the human genome.

VGAM1967 gene encodes a VGAM1967 precursor RNA, herein designated VGAM PRECURSOR RNA. Similar to other miRNA genes, and unlike most ordinary genes, VGAM1967 precursor RNA does not encode a protein. A nucleotide sequence identical or highly similar to the nucleotide sequence of VGAM1967 precursor RNA is designated SEQ ID:1953, and is provided hereinbelow with reference to the sequence listing part. Nucleotide sequence SEQ ID:1953 is located at position 96311 relative to the genome of Rana Tigrina Ranavirus.

VGAM1967 precursor RNA folds onto itself, forming VGAM1967 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1967 folded precursor RNA into VGAM1967 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM1967 RNA is designated SEQ ID:4678, and is provided hereinbelow with reference to the sequence listing part.

VGAM1967 host target gene, herein designated VGAM HOST TARGET GENE, encodes a corresponding messenger RNA, VGAM1967 host target RNA, herein designated VGAM HOST TARGET RNA. VGAM1967 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1967 RNA, herein designated VGAM RNA, binds complementarily to one or more host target binding sites located in untranslated regions of VGAM1967 host target RNA, herein designated VGAM HOST TARGET RNA. This complementary binding is due to the fact that the nucleotide sequence of VGAM1967 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1967 RNA, herein designated VGAM RNA, may have a different number of host target binding sites in untranslated regions of a VGAM1967 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1967 RNA, herein designated VGAM RNA, to host target binding sites on VGAM1967 host target RNA, herein designated VGAM HOST TARGET RNA, such as BINDING SITE I, BINDING SITE II and BINDING SITE III, inhibits translation of VGAM1967 host target RNA into VGAM1967 host target protein, herein designated VGAM HOST TARGET PROTEIN. VGAM host target protein is therefore outlined by a broken line.

It is appreciated that VGAM1967 host target gene, herein designated VGAM HOST TARGET GENE, in fact represents a plurality of VGAM1967 host target genes. The mRNA of each one of this plurality of VGAM1967 host target genes comprises one or more host target binding sites, each having a nucleotide sequence which is at least partly complementary to VGAM1967 RNA, herein designated VGAM RNA, and which when bound by VGAM1967 RNA causes inhibition of translation of respective one or more VGAM1967 host target proteins.

It is further appreciated by one skilled in the art that the mode of translational inhibition illustrated by FIG. 1 with specific reference to translational inhibition exerted by VGAM1967 gene, herein designated VGAM GENE, on one or more VGAM1967 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1967 is inhibition of expression of host target genes, as part of a novel viral mechanism of attacking a host. Accordingly, utilities of VGAM1967 include diagnosis, prevention and treatment of viral infection by Rana Tigrina Ranavirus. Specific functions, and accordingly utilities, of VGAM1967 correlate with, and may be deduced from, the identity of the host target genes which VGAM1967 binds and inhibits, and the function of these host target genes, as elaborated hereinbelow.

Nucleotide sequences of the VGAM1967 precursor RNA, herein designated VGAM PRECURSOR RNA, and of the 'diced' VGAM1967 RNA, herein designated VGAM RNA, and a schematic representation of the secondary folding of VGAM1967 folded precursor RNA, herein designated VGAM FOLDED PRECURSOR RNA, of VGAM1967 are further described hereinbelow with reference to Table 1.

Nucleotide sequences of host target binding sites, such as BINDING SITE-I, BINDING SITE-II and BINDING SITE-III of FIG. 1, found on VGAM1967 host target RNA, and schematic representation of the complementarity of each of these host target binding sites to VGAM1967 RNA, herein designated VGAM RNA, are described hereinbelow with reference to Table 2.

As mentioned hereinabove with reference to FIG. 1, a function of VGAM1967 gene, herein designated VGAM is inhibition of expression of VGAM1967 target genes. It is appreciated that specific functions, and accordingly utilities, of VGAM1967 correlate with, and may be deduced from, the identity of the target genes which VGAM1967 binds and inhibits, and the function of these target genes, as elaborated hereinbelow.

Dual Oxidase 1 (DUOX1, Accession NM_017434) is a VGAM1967 host target gene. DUOX1 BINDING SITE is HOST TARGET binding site found in the 3' untranslated region of mRNA encoded by DUOX1, corresponding to a HOST TARGET binding site such as BINDING SITE I, BINDING SITE II or BINDING SITE III. Table 2 illustrates the complementarity of the nucleotide sequences of DUOX1 BINDING SITE, designated SEQ ID:18888, to the nucleotide sequence of VGAM1967 RNA, herein designated VGAM RNA, also designated SEQ ID:4678.

A function of VGAM1967 is therefore inhibition of Dual Oxidase 1 (DUOX1, Accession NM_017434), a gene which is a component of the thyroid hydrogen peroxide generating system. Accordingly, utilities of VGAM1967 include diagnosis, prevention and treatment of diseases and clinical conditions associated with DUOX1. The function of DUOX1 and its association with various diseases and clinical conditions, has been established by previous studies, as described hereinabove with reference to VGAM1188. Growth Differentiation Factor 2 (GDF2, Accession NM_016204) is another VGAM1967 host target gene. GDF2 BINDING SITE is HOST TARGET binding site found in the 5' untranslated region of mRNA encoded by GDF2, corresponding to a HOST TARGET binding site such as BINDING SITE I, BINDING SITE II or BINDING SITE III. Table 2 illustrates the complementarity of the nucleotide sequences of GDF2 BINDING SITE, designated SEQ ID:18299, to the nucleotide sequence of VGAM1967 RNA, herein designated VGAM RNA, also designated SEQ ID:4678.

Another function of VGAM1967 is therefore inhibition of Growth Differentiation Factor 2 (GDF2, Accession NM_016204), a gene which could be involved in bone formation. Accordingly, utilities of VGAM1967 include diagnosis, prevention and treatment of diseases and clinical conditions associated with GDF2. The function of GDF2 has been established by previous studies. Bone morphogenetic proteins (BMPs, e.g., BMP2; 112261) are members of the highly conserved transforming growth factor-beta (TGFB; OMIM Ref. No. 190180) superfamily. BMP signaling is important during development and growth, and BMPs and their type I (e.g., BMPR1A; 601299) and type II (e.g., BMPR2; 600799) receptors are expressed in numerous cell types. BMP ligands bring type I and type II receptors together, allowing the ser/thr kinase activity of the type II receptor to phosphorylate and activate the type I ser/thr kinase. The activated receptor then initiates intracellular signaling. By ribonuclease protection analysis, Miller et al. (2000) found that Bmp9, also called Gdf2, is expressed in adult rat predominantly in the Kupffer cells (KC), endothelial cells (EC), and stellate cells, but not the parenchymal cells, of liver, with little expression in other tissues. Western blot analysis showed that a 13-kD Bmp9 protein is expressed in KC and liver EC. KC and liver EC bound Bmp9 but not other BMPs, suggesting that BMP9 acts in an autocrine and/or paracrine manner. Liver EC and KC also internalized labeled Bmp9 under physiologic conditions.

Full details of the abovementioned studies are described in the following publications, the disclosure of which are hereby incorporated by reference:

Lopez-Coviella, I.; Berse, B.; Krauss, R.; Thies, R. S.; Blusztajn, J. K.: Induction and maintenance of the neuronal cholinergic phenotype in the central nervous system by BMP-9. Science 289:313-316, 2000; and Miller, A. F.; Harvey, S. A. K.; Thies, R. S.; Olson, M. S.: Bone morphogenetic protein-9: an autocrine/paracrine cytokine in the liver. J. Biol. Chem. 275:17937-17945, 2000.

Further studies establishing the function and utilities of GDF2 are found in John Hopkins OMIM database record ID 605120, and in sited publications numbered 696 and 7080-7081 listed in the bibliography section hereinbelow, which are also hereby incorporated by reference. Jun B Proto-oncogene (JUNB, Accession NM_002229) is another VGAM1967 host target gene. JUNB BINDING SITE is HOST TARGET binding site found in the 5' untranslated region of mRNA encoded by JUNB, corresponding to a HOST TARGET binding site such as BINDING SITE I, BINDING SITE II or BINDING SITE III. Table 2 illustrates the complementarity of the nucleotide sequences of JUNB BINDING SITE, designated SEQ ID:8011, to the nucleotide sequence of VGAM1967 RNA, herein designated VGAM RNA, also designated SEQ ID:4678.

Another function of VGAM1967 is therefore inhibition of Jun B Proto-oncogene (JUNB, Accession NM_002229), a gene which may be a key transcriptional regulator of myelopoiesis. Accordingly, utilities of VGAM1967 include diagnosis, prevention and treatment of diseases and clinical conditions associated with JUNB. The function of JUNB has been established by previous studies. Jacobs-Helber et al. (2002) studied the role of JUNB in erythroid differentiation in an erythropoietin (EPO; 133170)-dependent cell line and in primary mouse and human erythroid cells. They identified an initial EPO-dependent induction of JUNB expression that was insufficient to induce differentiation. A second EPO-independent peak of JUNB expression was associated with erythroid cell differentiation as measured by increased expression of erythroid-specific proteins. Mathas et al. (2002) found AP1 constitutively activated, with robust JUN (OMIM Ref. No. 165160) and JUNB overexpression, in all cell lines derived from patients with classical Hodgkin lymphoma (OMIM Ref. No. 236000) and anaplastic large cell lymphoma (ALCL), but not in other lymphoma types. AP1 supported proliferation of Hodgkin cells, but suppressed apoptosis of ALCL cells. Mathas et al. (2002) noted that, whereas JUN is upregulated by an autoregulatory process, JUNB is under the control of nuclear factor kappa-B (NFKB; 164011). They found that AP1 and NFKB cooperate and stimulate expression of the cell cycle regulator cyclin D2 (OMIM Ref. No. 123833), the proto-oncogene MET (OMIM Ref. No. 164860), and the lymphocyte homing receptor CCR7 (OMIM Ref. No. 600242), which are all strongly expressed in primary Hodgkin/Reed-Sternberg (HRS) cells Jacobs-Helber et al. (2002) studied the role of JUNB in erythroid differentiation in an erythropoietin (EPO; 133170)-dependent cell line and in primary mouse and human erythroid cells. They identified an initial EPO-dependent induction of JUNB expression that was insufficient to induce differentiation. A second EPO-independent peak of JUNB expression was associated with erythroid cell differentiation as measured by increased expression of erythroid-specific proteins. Mathas et al. (2002) found AP1 constitutively activated, with robust JUN (OMIM Ref. No. 165160) and JUNB overexpression, in all cell lines derived from patients with classical Hodgkin lymphoma (OMIM Ref. No. 236000) and anaplastic large cell lymphoma (ALCL), but not in other lymphoma types. AP1 supported proliferation of Hodgkin cells, but suppressed apoptosis of ALCL cells. Mathas et al. (2002) noted that, whereas JUN is upregulated by an autoregulatory process, JUNB is under the control of nuclear factor kappa-B (NFKB; 164011). They found that AP1 and NFKB cooperate and stimulate expression of the cell cycle regulator cyclin D2 (OMIM Ref. No. 123833), the proto-oncogene MET (OMIM Ref. No. 164860), and the lymphocyte homing receptor CCR7 (OMIM Ref. No. 600242), which are all strongly expressed in primary Hodgkin/Reed-Sternberg (HRS) cells Animal model experiments lend further support to the function of JUNB. The JUN and JUNB components of the AP1 transcription factor are known to have antagonistic functions. Passegue et al. (2002) showed, by a knockin strategy and a transgenic complementation approach, that JunB can substitute for absence of Jun during mouse development. JunB can rescue both liver and cardiac defects in Jun-null mice in a manner dependent on gene dosage. JunB restores the expression of genes regulated by Jun/Fos (OMIM Ref. No. 164810), but not those regulated by Jun/ATF (ATF1; 123803), thereby rescuing Jun-dependent defects in vivo as well as in primary fibroblasts and fetal hepatoblasts in vitro. Thus, the transcriptionally less active JunB has the potential to substitute for Jun, indicating that the spatial and temporal regulation of expression of the transcription factor AP1 may be more important than the coding sequence of its components.

It is appreciated that the abovementioned animal model for JUNB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Passegue, E.; Jochum, W.; Behrens, A.; Ricci, R.; Wagner, E. F.: JunB can substitute for Jun in mouse development and cell proliferation. Nature Genet. 30:158-166, 2002; and Jacobs-Helber, S. M.; Abutin, R. M.; Tian, C.; Bondurant, M.; Wickrema, A.; Sawyer, S. T.: Role of JunB in erythroid differentiation. J. Biol. Chem. 277:4859-4866, 2002.

Further studies establishing the function and utilities of JUNB are found in John Hopkins OMIM database record ID 165161, and in sited publications numbered 5122-512 and 4710 listed in the bibliography section hereinbelow, which are also hereby incorporated by reference. Palmitoyl-protein Thioesterase 2 (PPT2, Accession NM_138934) is another VGAM1967 host target gene. PPT2 BINDING SITE is HOST TARGET binding site found in the 3' untranslated region of mRNA encoded by PPT2, corresponding to a HOST TARGET binding site such as BINDING SITE I, BINDING SITE II or BINDING SITE III. Table 2 illustrates the complementarity of the nucleotide sequences of PPT2 BINDING SITE, designated SEQ ID:29062, to the nucleotide sequence of VGAM1967 RNA, herein designated VGAM RNA, also designated SEQ ID:4678.

Another function of VGAM1967 is therefore inhibition of Palmitoyl-protein Thioesterase 2 (PPT2, Accession NM_138934), a gene which is a palmitoyl-protein thioesterase 2 which possesses a different substrate specificity than PPT1. Accordingly, utilities of VGAM1967 include diagnosis, prevention and treatment of diseases and clinical conditions associated with PPT2. The function of PPT2 and its association with various diseases and clinical conditions, has been established by previous studies, as described hereinabove with reference to VGAM120. Ribonucleotide Reductase M2 Polypeptide (RRM2, Accession NM_001034) is another VGAM1967 host target gene. RRM2 BINDING SITE is HOST TARGET binding site found in the 3' untranslated region of mRNA encoded by RRM2, corresponding to a HOST TARGET binding site such as BINDING SITE I, BINDING SITE II or BINDING SITE III. Table 2 illustrates the complementarity of the nucleotide sequences of RRM2 BINDING SITE, designated SEQ ID:6698, to the nucleotide sequence of VGAM1967 RNA, herein designated VGAM RNA, also designated SEQ ID:4678.

Another function of VGAM1967 is therefore inhibition of Ribonucleotide Reductase M2 Polypeptide (RRM2, Accession NM_001034). Accordingly, utilities of VGAM1967 include diagnosis, prevention and treatment of diseases and clinical conditions associated with RRM2. DKFZP434I2117 (Accession NM_031478) is another VGAM1967 host target gene. DKFZP434I2117 BINDING SITE is HOST TARGET binding site found in the 3' untranslated region of mRNA encoded by DKFZP434I2117, corresponding to a HOST TARGET binding site such as BINDING SITE I, BINDING SITE II or BINDING SITE III. Table 2 illustrates the complementarity of the nucleotide sequences of DKFZP434I2117 BINDING SITE, designated SEQ ID:25556, to the nucleotide sequence of VGAM1967 RNA, herein designated VGAM RNA, also designated SEQ ID:4678.

Another function of VGAM1967 is therefore inhibition of DKFZP434I2117 (Accession NM_031478). Accordingly, utilities of VGAM1967 include diagnosis, prevention and treatment of diseases and clinical conditions associated with DKFZP434I2117. DKFZp564A176 (Accession NM_032242) is another VGAM1967 host target gene. DKFZp564A176 BINDING SITE is HOST TARGET binding site found in the 3' untranslated region of mRNA encoded by DKFZp564A176, corresponding to a HOST TARGET binding site such as BINDING SITE I, BINDING SITE II or BINDING SITE III. Table 2 illustrates the complementarity of the nucleotide sequences of DKFZp564A176 BINDING SITE, designated SEQ ID:25979, to the nucleotide sequence of VGAM1967 RNA, herein designated VGAM RNA, also designated SEQ ID:4678.

Another function of VGAM1967 is therefore inhibition of DKFZp564A176 (Accession NM_032242). Accordingly, utilities of VGAM1967 include diagnosis, prevention and treatment of diseases and clinical conditions associated with DKFZp564A176. GNB4 (Accession NM_021629) is another VGAM1967 host target gene. GNB4 BINDING SITE is HOST TARGET binding site found in the 5' untranslated region of mRNA encoded by GNB4, corresponding to a HOST TARGET binding site such as BINDING SITE I, BINDING SITE II or BINDING SITE III. Table 2 illustrates the complementarity of the nucleotide sequences of GNB4 BINDING SITE, designated SEQ ID:22270, to the nucleotide sequence of VGAM1967 RNA, herein designated VGAM RNA, also designated SEQ ID:4678.

Another function of VGAM1967 is therefore inhibition of GNB4 (Accession NM_021629). Accordingly, utilities of VGAM1967 include diagnosis, prevention and treatment of diseases and clinical conditions associated with GNB4. KIAA0323 (Accession XM_032634) is another VGAM1967 host target gene. KIAA0323 BINDING SITE is HOST TARGET binding site found in the 3' untranslated region of mRNA encoded by KIAA0323, corresponding to a HOST TARGET binding site such as BINDING SITE I, BINDING SITE II or BINDING SITE III. Table 2 illustrates the complementarity of the nucleotide sequences of KIAA0323 BINDING SITE, designated SEQ ID:31692, to the nucleotide sequence of VGAM1967 RNA, herein designated VGAM RNA, also designated SEQ ID:4678.

Another function of VGAM1967 is therefore inhibition of KIAA0323 (Accession XM_032634). Accordingly, utilities of VGAM1967 include diagnosis, prevention and treatment of diseases and clinical conditions associated with KIAA0323. SARM (Accession NM_015077) is another VGAM1967 host target gene. SARM BINDING SITE is HOST TARGET binding site found in the 3' untranslated region of mRNA encoded by SARM, corresponding to a HOST TARGET binding site such as BINDING SITE I, BINDING SITE II or BINDING SITE III. Table 2 illustrates the complementarity of the nucleotide sequences of SARM BINDING SITE, designated SEQ ID:17456, to the nucleotide sequence of VGAM1967 RNA, herein designated VGAM RNA, also designated SEQ ID:4678.

Another function of VGAM1967 is therefore inhibition of SARM (Accession NM_015077). Accordingly, utilities of VGAM1967 include diagnosis, prevention and treatment of diseases and clinical conditions associated with SARM. LOC149345 (Accession XM_086502) is another VGAM1967 host target gene. LOC149345 BINDING SITE is HOST TARGET binding site found in the 5' untranslated region of mRNA encoded by LOC149345, corresponding to a HOST TARGET binding site such as BINDING SITE I, BINDING SITE II or BINDING SITE III. Table 2 illustrates the complementarity of the nucleotide sequences of LOC149345 BINDING SITE, designated SEQ ID:38715, to the nucleotide sequence of VGAM1967 RNA, herein designated VGAM RNA, also designated SEQ ID:4678.

Another function of VGAM1967 is therefore inhibition of LOC149345 (Accession XM_086502). Accordingly, utilities of VGAM1967 include diagnosis, prevention and treatment of diseases and clinical conditions associated with LOC149345. LOC152275 (Accession XM_098186) is another VGAM1967 host target gene. LOC152275 BINDING SITE is HOST TARGET binding site found in the 3' untranslated region of mRNA encoded by LOC152275, corresponding to a HOST TARGET binding site such as BINDING SITE I, BINDING SITE II or BINDING SITE III. Table 2 illustrates the complementarity of the nucleotide sequences of LOC152275 BINDING SITE, designated SEQ ID:41457, to the nucleotide sequence of VGAM1967 RNA, herein designated VGAM RNA, also designated SEQ ID:4678.

Another function of VGAM1967 is therefore inhibition of LOC152275 (Accession XM_098186). Accordingly, utilities of VGAM1967 include diagnosis, prevention and treatment of diseases and clinical conditions associated with LOC152275. LOC152286 (Accession XM_098188) is another VGAM1967 host target gene. LOC152286 BINDING SITE is HOST TARGET binding site found in the 3' untranslated region of mRNA encoded by LOC152286, corresponding to a HOST TARGET binding site such as BINDING SITE I, BINDING SITE II or BINDING SITE III. Table 2 illustrates the complementarity of the nucleotide sequences of LOC152286 BINDING SITE, designated SEQ ID:41463, to the nucleotide sequence of VGAM1967 RNA, herein designated VGAM RNA, also designated SEQ ID:4678.

Another function of VGAM1967 is therefore inhibition of LOC152286 (Accession XM_098188). Accordingly, utilities of VGAM1967 include diagnosis, prevention and treatment of diseases and clinical conditions associated with LOC152286. LOC160646 (Accession XM_090413) is another VGAM1967 host target gene. LOC160646 BINDING SITE is HOST TARGET binding site found in the 5' untranslated region of mRNA encoded by LOC160646, corresponding to a HOST TARGET binding site such as BINDING SITE I, BINDING SITE II or BINDING SITE III. Table 2 illustrates the complementarity of the nucleotide sequences of LOC160646 BINDING SITE, designated SEQ ID:40004, to the nucleotide sequence of VGAM1967 RNA, herein designated VGAM RNA, also designated SEQ ID:4678.

Another function of VGAM1967 is therefore inhibition of LOC160646 (Accession XM_090413). Accordingly, utilities of VGAM1967 include diagnosis, prevention and treatment of diseases and clinical conditions associated with LOC160646. LOC84548 (Accession XM_048904) is another VGAM1967 host target gene. LOC84548 BINDING SITE is HOST TARGET binding site found in the 3' untranslated region of mRNA encoded by LOC84548, corresponding to a HOST TARGET binding site such as BINDING SITE I, BINDING SITE II or BINDING SITE III. Table 2 illustrates the complementarity of the nucleotide sequences of LOC84548 BINDING SITE, designated SEQ ID:35297, to the nucleotide sequence of VGAM1967 RNA, herein designated VGAM RNA, also designated SEQ ID:4678.

Another function of VGAM1967 is therefore inhibition of LOC84548 (Accession XM_048904). Accordingly, utilities of VGAM1967 include diagnosis, prevention and treatment of diseases and clinical conditions associated with LOC84548. FIG. 1 further provides a conceptual description of a novel bioinformatically detected viral gene of the present invention, referred to here as Viral Genomic Address Messenger 1968 (VGAM1968) viral gene, which modulates expression of respective host target genes thereof, the function and utility of which host target genes is known in the art.

VGAM1968 is a novel bioinformatically detected regulatory, non protein coding, viral micro RNA (miRNA) gene. The method by which VGAM1968 was detected is described hereinabove with reference to FIGS. 1-8.

VGAM1968 gene, herein designated VGAM GENE, is a viral gene contained in the genome of Rana Tigrina Ranavirus. VGAM1968 host target gene, herein designated VGAM HOST TARGET GENE, is a human gene contained in the human genome.

VGAM1968 gene encodes a VGAM1968 precursor RNA, herein designated VGAM PRECURSOR RNA. Similar to other miRNA genes, and unlike most ordinary genes, VGAM1968 precursor RNA does not encode a protein. A nucleotide sequence identical or highly similar to the nucleotide sequence of VGAM1968 precursor RNA is designated SEQ ID:1954, and is provided hereinbelow with reference to the sequence listing part. Nucleotide sequence SEQ ID:1954 is located at position 97726 relative to the genome of Rana Tigrina Ranavirus.

VGAM1968 precursor RNA folds onto itself, forming VGAM1968 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1968 folded precursor RNA into VGAM1968 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1968 RNA is designated SEQ ID:4679, and is provided hereinbelow with reference to the sequence listing part.

VGAM1968 host target gene, herein designated VGAM HOST TARGET GENE, encodes a corresponding messenger RNA, VGAM1968 host target RNA, herein designated VGAM HOST TARGET RNA. VGAM1968 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1968 RNA, herein designated VGAM RNA, binds complementarily to one or more host target binding sites located in untranslated regions of VGAM1968 host target RNA, herein designated VGAM HOST TARGET RNA. This complementary binding is due to the fact that the nucleotide sequence of VGAM1968 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1968 RNA, herein designated VGAM RNA, may have a different number of host target binding sites in untranslated regions of a VGAM1968 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1968 RNA, herein designated VGAM RNA, to host target binding sites on VGAM1968 host target RNA, herein designated VGAM HOST TARGET RNA, such as BINDING SITE I, BINDING SITE II and BINDING SITE III, inhibits translation of VGAM1968 host target RNA into VGAM1968 host target protein, herein designated VGAM HOST TARGET PROTEIN. VGAM host target protein is therefore outlined by a broken line.

It is appreciated that VGAM1968 host target gene, herein designated VGAM HOST TARGET GENE, in fact represents a plurality of VGAM1968 host target genes. The mRNA of each one of this plurality of VGAM1968 host target genes comprises one or more host target binding sites, each having a nucleotide sequence which is at least partly complementary to VGAM1968 RNA, herein designated VGAM RNA, and which when bound by VGAM1968 RNA causes inhibition of translation of respective one or more VGAM1968 host target proteins.

It is further appreciated by one skilled in the art that the mode of translational inhibition illustrated by FIG. 1 with specific reference to translational inhibition exerted by VGAM1968 gene, herein designated VGAM GENE, on one or more VGAM1968 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1968 is inhibition of expression of host target genes, as part of a novel viral mechanism of attacking a host. Accordingly, utilities of VGAM1968 include diagnosis, prevention and treatment of viral infection by Rana Tigrina Ranavirus. Specific functions, and accordingly utilities, of VGAM1968 correlate with, and may be deduced from, the identity of the host target genes which VGAM1968 binds and inhibits, and the function of these host target genes, as elaborated hereinbelow.

Nucleotide sequences of the VGAM1968 precursor RNA, herein designated VGAM PRECURSOR RNA, and of the 'diced' VGAM1968 RNA, herein designated VGAM RNA, and a schematic representation of the secondary folding of VGAM1968 folded precursor RNA, herein designated VGAM FOLDED PRECURSOR RNA, of VGAM1968 are further described hereinbelow with reference to Table 1.

Nucleotide sequences of host target binding sites, such as BINDING SITE-I, BINDING SITE-II and BINDING SITE-III of FIG. 1, found on VGAM1968 host target RNA, and schematic representation of the complementarity of each of these host target binding sites to VGAM1968 RNA, herein designated VGAM RNA, are described hereinbelow with reference to Table 2.

As mentioned hereinabove with reference to FIG. 1, a function of VGAM1968 gene, herein designated VGAM is inhibition of expression of VGAM1968 target genes. It is appreciated that specific functions, and accordingly utilities, of VGAM1968 correlate with, and may be deduced from, the identity of the target genes which VGAM1968 binds and inhibits, and the function of these target genes, as elaborated hereinbelow.

Adaptor-related Protein Complex 1, Gamma 1 Subunit (AP1G1, Accession NM_001128) is a VGAM1968 host target gene. AP1G1 BINDING SITE is HOST TARGET binding site found in the 3' untranslated region of mRNA encoded by AP1G1, corresponding to a HOST TARGET binding site such as BINDING SITE I, BINDING SITE II or BINDING SITE III. Table 2 illustrates the complementarity of the nucleotide sequences of AP1G1 BINDING SITE, designated SEQ ID:6801, to the nucleotide sequence of VGAM1968 RNA, herein designated VGAM RNA, also designated SEQ ID:4679.

A function of VGAM1968 is therefore inhibition of Adaptor-related Protein Complex 1, Gamma 1 Subunit (AP1G1, Accession NM_001128), a gene which promotes the formation of clathrin-coated pits and vesicles. Accordingly, utilities of VGAM1968 include diagnosis, prevention and treatment of diseases and clinical conditions associated with AP1G1. The function of AP1G1 and its association with various diseases and clinical conditions, has been established by previous studies, as described hereinabove with reference to VGAM316. ASIC4 (Accession NM_018674) is another VGAM1968 host target gene. ASIC4 BINDING SITE is HOST TARGET binding site found in the 3' untranslated region of mRNA encoded by ASIC4, corresponding to a HOST TARGET binding site such as BINDING SITE I, BINDING SITE II or BINDING SITE III. Table 2 illustrates the complementarity of the nucleotide sequences of ASIC4 BINDING SITE, designated SEQ ID:20748, to the nucleotide sequence of VGAM1968 RNA, herein designated VGAM RNA, also designated SEQ ID:4679.

Another function of VGAM1968 is therefore inhibition of ASIC4 (Accession NM_018674), a gene which is a proton-gated, amiloride-sensitive sodium channel. Accordingly, utilities of VGAM1968 include diagnosis, prevention and treatment of diseases and clinical conditions associated with ASIC4. The function of ASIC4 has been established by previous studies. Grunder et al. (2000) isolated a cDNA corresponding to the human ASIC4 gene from a pituitary gland-specific cDNA library. Human ASIC4 protein shares 97% identity with its rat homolog. Dot-blot analysis and abundance of ASIC4 cDNAs in the pituitary cDNA library indicated strong expression in pituitary gland. By RT-PCR, Grunder et al. (2000) demonstrated expression in vestibular system and very faint expression in organ of Corti. ASIC4 could not be activated by a drop in extracellular pH in Xenopus oocytes, suggesting association with other subunits or activation by a ligand other than protons As the ASIC4 gene mapped in close proximity to the locus for paroxysmal dystonic choreoathetosis (PDC; 118800) on chromosome 2q, Grunder et al. (2001) sequenced the entire coding region and adjacent intronic sequences in an affected member of a large PDC family in which the disorder had been shown to be linked to the PDC locus on chromosome 2. Although 3 amino acid substitution polymorphisms were identified, none was disease-specific.

Full details of the abovementioned studies are described in the following publications, the disclosure of which are hereby incorporated by reference:

Grunder, S.; Geisler, H.-S.; Rainer, S.; Fink, J. K.: Acid-sensing ion channel (ASIC) 4 gene: physical mapping, genomic organisation, and evaluation as a candidate for paroxysmal dystonia. Europ. J. Hum. Genet. 9:672-676, 2001; and Grunder, S.; Geissler, H.-S.; Bassler, E.-L.; Ruppersberg, J. P.: A new member of acid-sensing ion channels from pituitary gland. Neuroreport 11:1607-1611, 2000.

Further studies establishing the function and utilities of ASIC4 are found in John Hopkins OMIM database record ID 606715, and in sited publications numbered 11920 listed in the bibliography section hereinbelow, which are also hereby incorporated by reference. ATPase, Cu++ Transporting, Beta Polypeptide (Wilson disease) (ATP7B, Accession NM_000053) is another VGAM1968 host target gene. ATP7B BINDING SITE is HOST TARGET binding site found in the 3' untranslated region of mRNA encoded by ATP7B, corresponding to a HOST TARGET binding site such as BINDING SITE I, BINDING SITE II or BINDING SITE III. Table 2 illustrates the complementarity of the nucleotide sequences of ATP7B BINDING SITE, designated SEQ ID:5505, to the nucleotide sequence of VGAM1968 RNA, herein designated VGAM RNA, also designated SEQ ID:4679.

Another function of VGAM1968 is therefore inhibition of ATPase, Cu++ Transporting, Beta Polypeptide (Wilson disease) (ATP7B, Accession NM_000053). Accordingly, utilities of VGAM1968 include diagnosis, prevention and treatment of diseases and clinical conditions associated with ATP7B. B-cell CLL/lymphoma 6 (zinc finger protein 51) (BCL6, Accession NM_001706) is another VGAM1968 host target gene. BCL6 BINDING SITE is HOST TARGET binding site found in the 5' untranslated region of mRNA encoded by BCL6, corresponding to a HOST TARGET binding site such as BINDING SITE I, BINDING SITE II or BINDING SITE III. Table 2 illustrates the complementarity of the nucleotide sequences of BCL6 BINDING SITE, designated SEQ ID:7432, to the nucleotide sequence of VGAM1968 RNA, herein designated VGAM RNA, also designated SEQ ID:4679.

Another function of VGAM1968 is therefore inhibition of B-cell CLL/lymphoma 6 (zinc finger protein 51) (BCL6, Accession NM_001706), a gene which is involved in the generation and maintenance of both T and B cells during immune responses. Accordingly, utilities of VGAM1968 include diagnosis, prevention and treatment of diseases and clinical conditions associated with BCL6. The function of BCL6 and its association with various diseases and clinical conditions, has been established by previous studies, as described hereinabove with reference to VGAM481. BLAME (Accession NM_020125) is another VGAM1968 host target gene. BLAME BINDING SITE is HOST TARGET binding site found in the 3' untranslated region of mRNA encoded by BLAME, corresponding to a HOST TARGET binding site such as BINDING SITE I, BINDING SITE II or BINDING SITE III. Table 2 illustrates the complementarity of the nucleotide sequences of BLAME BINDING SITE, designated SEQ ID:21310, to the nucleotide sequence of VGAM1968 RNA, herein designated VGAM RNA, also designated SEQ ID:4679.

Another function of VGAM1968 is therefore inhibition of BLAME (Accession NM_020125). Accordingly, utilities of VGAM1968 include diagnosis, prevention and treatment of diseases and clinical conditions associated with BLAME. Breast Cancer 1, Early Onset (BRCA1, Accession NM_007301) is another VGAM1968 host target gene. BRCA1 BINDING SITE is HOST TARGET binding site found in the 3' untranslated region of mRNA encoded by BRCA1, corresponding to a HOST TARGET binding site such as BINDING SITE I, BINDING SITE II or BINDING SITE III. Table 2 illustrates the complementarity of the nucleotide sequences of BRCA1 BINDING SITE, designated SEQ ID:14203, to the nucleotide sequence of VGAM1968 RNA, herein designated VGAM RNA, also designated SEQ ID:4679.

Another function of VGAM1968 is therefore inhibition of Breast Cancer 1, Early Onset (BRCA1, Accession NM_007301). Accordingly, utilities of VGAM1968 include diagnosis, prevention and treatment of diseases and clinical conditions associated with BRCA1. Bassoon (presynaptic cytomatrix protein) (BSN, Accession NM_003458) is another VGAM1968 host target gene. BSN BINDING SITE is HOST TARGET binding site found in the 3' untranslated region of mRNA encoded by BSN, corresponding to a HOST TARGET binding site such as BINDING SITE I, BINDING SITE II or BINDING SITE III. Table 2 illustrates the complementarity of the nucleotide sequences of BSN BINDING SITE, designated SEQ ID:9518, to the nucleotide sequence of VGAM1968 RNA, herein designated VGAM RNA, also designated SEQ ID:4679.

Another function of VGAM1968 is therefore inhibition of Bassoon (presynaptic cytomatrix protein) (BSN, Accession NM_003458), a gene which may be involved in cytomatrix organization at the site of neurotransmitter release. Accordingly, utilities of VGAM1968 include diagnosis, prevention and treatment of diseases and clinical conditions associated with BSN. The function of BSN and its association with various diseases and clinical conditions, has been established by previous studies, as described hereinabove with reference to VGAM638. BUB3 Budding Uninhibited By Benzimidazoles 3 Homolog (yeast) (BUB3, Accession NM_004725) is another VGAM1968 host target gene. BUB3 BINDING SITE is HOST TARGET binding site found in the 3' untranslated region of mRNA encoded by BUB3, corresponding to a HOST TARGET binding site such as BINDING SITE I, BINDING SITE II or BINDING SITE III. Table 2 illustrates the complementarity of the nucleotide sequences of BUB3 BINDING SITE, designated SEQ ID:11095, to the nucleotide sequence of VGAM1968 RNA, herein designated VGAM RNA, also designated SEQ ID:4679.

Another function of VGAM1968 is therefore inhibition of BUB3 Budding Uninhibited By Benzimidazoles 3 Homolog (yeast) (BUB3, Accession NM_004725), a gene which has a role in the mitotic spindle checkpoint. Accordingly, utilities of VGAM1968 include diagnosis, prevention and treatment of diseases and clinical conditions associated with BUB3. The function of BUB3 and its association with various diseases and clinical conditions, has been established by previous studies, as described hereinabove with reference to VGAM1361. Cyclin D1 (PRAD1: parathyroid adenomatosis 1) (CCND1, Accession NM_053056) is another VGAM1968 host target gene. CCND1 BINDING SITE is HOST TARGET binding site found in the 5' untranslated region of mRNA encoded by CCND1, corresponding to a HOST TARGET binding site such as BINDING SITE I, BINDING SITE II or BINDING SITE III. Table 2 illustrates the complementarity of the nucleotide sequences of CCND1 BINDING SITE, designated SEQ ID:27599, to the nucleotide sequence of VGAM1968 RNA, herein designated VGAM RNA, also designated SEQ ID:4679.

Another function of VGAM1968 is therefore inhibition of Cyclin D1 (PRAD1: parathyroid adenomatosis 1) (CCND1, Accession NM_053056), a gene which is involved in the control of cell cycle and is required for Schwann cell proliferation to proceed normally during Wallerian degeneration. Accordingly, utilities of VGAM1968 include diagnosis, prevention and treatment of diseases and clinical conditions associated with CCND1. The function of CCND1 and its association with various diseases and clinical conditions, has been established by previous studies, as described hereinabove with reference to VGAM220. CIAO1 (Accession NM_004804) is another VGAM1968 host target gene. CIAO1 BINDING SITE is HOST TARGET binding site found in the 5' untranslated region of mRNA encoded by CIAO1, corresponding to a HOST TARGET binding site such as BINDING SITE I, BINDING SITE II or BINDING SITE III. Table 2 illustrates the complementarity of the nucleotide sequences of CIAO1 BINDING SITE, designated SEQ ID:11226, to the nucleotide sequence of VGAM1968 RNA, herein designated VGAM RNA, also designated SEQ ID:4679.

Another function of VGAM1968 is therefore inhibition of CIAO1 (Accession NM_004804), a gene which interacts in regulating cell cycle progression and apoptosis. Accordingly, utilities of VGAM1968 include diagnosis, prevention and treatment of diseases and clinical conditions associated with CIAO1. The function of CIAO1 has been established by previous studies. The Wilms tumor gene (WT1; 607102) on 11p13 is involved in regulating cell cycle progression and apoptosis. In an attempt to dissect the molecular mechanisms of transcriptional activation and repression by WT1, and to identify other proteins that may be involved in kidney and hematopoietic cell tumorigenesis, several groups have studied WT1-interacting proteins. WT1 binds in vivo and in vitro to p53 (OMIM Ref. No. 191170), resulting in WT1 functioning as a transcriptional repressor. Mutations in p53 increase the aggressiveness of Wilms tumors, resulting in poorer patient prognosis, but are not thought to be a primary genetic cause of Wilms tumor formation. WT1 also interacts with and regulates the transcriptional activity of steroidogenic factor-1 (OMIM Ref. No. 184757), a key molecule in gonadal development. Johnstone et al. (1996) identified a protein called PAWR (OMIM Ref. No. 601936), the gene for which maps to 12q21, that is capable of modulating the transcriptional activities of WT1. Johnstone et al. (1998) identified a second protein, which they named CIAO1 after the Chinese word for "bridge," that is also capable of modulating the transcriptional activities of WT1. CIAO1 is a 339-amino acid polypeptide containing 7 WD40 or beta-transducin repeats. It can inhibit the transcriptional activation function of WT1, but does not affect WT1-mediated transcriptional repression. Johnstone et al. (1998) demonstrated that the yeast Ciao1 homolog is an essential protein that appears to be highly evolutionarily conserved. Johnstone et al. (1999) described the structural organization of the CIAO1 gene, with the intron/exon boundaries closely matching the consensus 5-prime donor/3-prime acceptor splice site sequences. By FISH and radiation hybrid analysis, Johnstone et al. (1999) mapped the CIAO1 gene to the pericentric region of chromosome 2. They stated that the probable location is 2q11.2 based on the gene's inclusion within a previously mapped BAC clone (GenBank AC004020).

Full details of the abovementioned studies are described in the following publications, the disclosure of which are hereby incorporated by reference:

Johnstone, R. W.; See, R. H.; Sells, S. F.; Wang, J.; Muthukkumar, S.; Englert, C.; Haber, D. A.; Licht, J. D.; Sugrue, S. P.; Roberts, T.; Rangnekar, V. M.; Shi, Y.: A novel repressor, par-4, modulates transcription and growth suppression functions of the Wilms' tumor suppressor WT1. Molec. Cell. Biol. 16:6945-6956, 1996; and Johnstone, R. W.; Tommerup, N.; Hansen, C.; Vissing, H.; Shi, Y.: Structural organization, tissue expression, and chromosomal localization of Ciao 1, a functional modulator of the Wilm.

Further studies establishing the function and utilities of CIAO1 are found in John Hopkins OMIM database record ID 604333, and in sited publications numbered 93 and 4985-4986 listed in the bibliography section hereinbelow, which are also hereby incorporated by reference. Coronin, Actin Binding Protein, 1C (CORO1C, Accession NM_014325) is another VGAM1968 host target gene. CORO1C BINDING SITE is HOST TARGET binding site found in the 3" untranslated region of mRNA encoded by CORO1C, corresponding to a HOST TARGET binding site such as BINDING SITE I, BINDING SITE II or BINDING SITE III. Table 2 illustrates the complementarity of the nucleotide sequences of CORO1C BINDING SITE, designated SEQ ID:15630, to the nucleotide sequence of VGAM1968 RNA, herein designated VGAM RNA, also designated SEQ ID:4679.

Another function of VGAM1968 is therefore inhibition of Coronin, Actin Binding Protein, 1C (CORO1C, Accession NM_014325). Accordingly, utilities of VGAM1968 include diagnosis, prevention and treatment of diseases and clinical conditions associated with CORO1C. Carboxypeptidase D (CPD, Accession NM_001304) is another VGAM1968 host target gene. CPD BINDING SITE1 and CPD BINDING SITE2 are HOST TARGET binding sites found in untranslated regions of mRNA encoded by CPD, corresponding to HOST TARGET binding sites such as BINDING SITE I, BINDING SITE II or BINDING SITE III. Table 2 illustrates the complementarity of the nucleotide sequences of CPD BINDING SITE1 and CPD BINDING SITE2, designated SEQ ID:6984 and SEQ ID:6985 respectively, to the nucleotide sequence of VGAM1968 RNA, herein designated VGAM RNA, also designated SEQ ID:4679.

Another function of VGAM1968 is therefore inhibition of Carboxypeptidase D (CPD, Accession NM_001304), a gene which is a membrane-bound metalloprotease. Accordingly, utilities of VGAM1968 include diagnosis, prevention and treatment of diseases and clinical conditions associated with CPD. The function of CPD and its association with various diseases and clinical conditions, has been established by previous studies, as described hereinabove with reference to VGAM596. D1S155E (Accession NM_007158) is another VGAM1968 host target gene. D1S155E BINDING SITE is HOST TARGET binding site found in the 3' untranslated region of mRNA encoded by D1S155E, corresponding to a HOST TARGET binding site such as BINDING SITE I, BINDING SITE II or BINDING SITE III. Table 2 illustrates the complementarity of the nucleotide sequences of D1S155E BINDING SITE, designated SEQ ID:14005, to the nucleotide sequence of VGAM1968 RNA, herein designated VGAM RNA, also designated SEQ ID:4679.

Another function of VGAM1968 is therefore inhibition of D1S155E (Accession NM_007158), a gene which regulates development of the testis. Accordingly, utilities of VGAM1968 include diagnosis, prevention and treatment of diseases and clinical conditions associated with D1S155E. The function of D1S155E has been established by previous studies. While investigating NRAS (OMIM Ref. No. 164790), Jeffers et al. (1990) isolated cDNAs that originated from a closely linked upstream gene on chromosome 1. RNase protection assays showed that this gene, termed UNR by them, is transcribed in the same direction as NRAS and that its 3-prime end is located only 130 bp from the transcription initiation site of NRAS. The close spatial relationship was conserved in all species from which the NRAS gene had been isolated. The UNR cDNA contained an open reading frame capable of encoding a protein of 798 amino acids. Neither the primary protein structure nor the nucleic acid sequence of UNR was homologous to any known gene, including NRAS. UNR transcripts were detected in mouse, rat, and human cells. Only a single copy of UNR was detected in the mouse. The gene produced multiple transcripts that differed in their 3-prime ends and apparently resulted from the differential use of multiple polyadenylation sites located in the 3-prime untranslated region of the gene. Both UNR and NRAS were expressed in all tissues examined and the 2 genes may be coordinately regulated. UNR was first isolated by Doniger and DiPaolo (1988) in tumorigenic guinea pig cells. They designated the gene UNR (for 'upstream of NRAS'). (This should not be confused with the gene encoding ubiquitously expressed nuclear receptor (UNR; 600380) on chromosome 19.)

Full details of the abovementioned studies are described in the following publications, the disclosure of which are hereby incorporated by reference:

Doniger, J.; DiPaolo, J. A.: Coordinate N-RAS mRNA up-regulation with mutational activation in tumorigenic guinea pig cells. Nucleic Acids Res. 16:969-980, 1988; and Jeffers, M.; Paciucci, R.; Pellicer, A.: Characterization of UNR: a gene closely linked to N-RAS. Nucleic Acids Res. 18:4891-4899, 1990.

Further studies establishing the function and utilities of D1S155E are found in John Hopkins OMIM database record ID 191510, and in sited publications numbered 12356-12357 listed in the bibliography section hereinbelow, which are also hereby incorporated by reference. Development and Differentiation Enhancing Factor 2 (DDEF2, Accession NM_003887) is another VGAM1968 host target gene. DDEF2 BINDING SITE is HOST TARGET binding site found in the 3' untranslated region of mRNA encoded by DDEF2, corresponding to a HOST TARGET binding site such as BINDING SITE I, BINDING SITE II or BINDING SITE III. Table 2 illustrates the complementarity of the nucleotide sequences of DDEF2 BINDING SITE, designated SEQ ID:9967, to the nucleotide sequence of VGAM1968 RNA, herein designated VGAM RNA, also designated SEQ ID:4679.

Another function of VGAM1968 is therefore inhibition of Development and Differentiation Enhancing Factor 2 (DDEF2, Accession NM_003887), a gene which interacts with members of the Arf and Src family. Accordingly, utilities of VGAM1968 include diagnosis, prevention and treatment of diseases and clinical conditions associated with DDEF2. The function of DDEF2 and its association with various diseases and clinical conditions, has been established by previous studies, as described hereinabove with reference to VGAM464. DEAD/H (Asp-Glu-Ala-Asp/His) Box Polypeptide 3 (DDX3, Accession NM_001356) is another VGAM1968 host target gene. DDX3 BINDING SITE1 through DDX3 BINDING SITE3 are HOST TARGET binding sites found in untranslated regions of mRNA encoded by DDX3, corresponding to HOST TARGET binding sites such as BINDING SITE I, BINDING SITE II or BINDING SITE III. Table 2 illustrates the complementarity of the nucleotide sequences of DDX3 BINDING SITE1 through DDX3 BINDING SITE3, designated SEQ ID:7035, SEQ ID:7036 and SEQ ID:23432 respectively, to the nucleotide sequence of VGAM1968 RNA, herein designated VGAM RNA, also designated SEQ ID:4679.

Another function of VGAM1968 is therefore inhibition of DEAD/H (Asp-Glu-Ala-Asp/His) Box Polypeptide 3 (DDX3, Accession NM_001356), a gene which interacts with hepatitis c virus core protein resulting a change in intracellular location. Accordingly, utilities of VGAM1968 include diagnosis, prevention and treatment of diseases and clinical conditions associated with DDX3. The function of DDX3 and its association with various diseases and clinical conditions, has been established by previous studies, as described hereinabove with reference to VGAM232. DnaJ (Hsp40) Homolog, Subfmaily B, Member 1 (DNAJB1, Accession NM_006145) is another VGAM1968 host target gene. DNAJB1 BINDING SITE is HOST TARGET binding site found in the 3' untranslated region of mRNA encoded by DNAJB1, corresponding to a HOST TARGET binding site such as BINDING SITE I, BINDING SITE II or BINDING SITE III. Table 2 illustrates the complementarity of the nucleotide sequences of DNAJB1 BINDING SITE, designated SEQ ID:12789, to the nucleotide sequence of VGAM1968 RNA, herein designated VGAM RNA, also designated SEQ ID:4679.

Another function of VGAM1968 is therefore inhibition of DnaJ (Hsp40) Homolog, Subfmaily B, Member 1 (DNAJB1, Accession NM_006145), a gene which may prevent aggregation of newly translated proteins. Accordingly, utilities of VGAM1968 include diagnosis, prevention and treatment of diseases and clinical conditions associated with DNAJB1. The function of DNAJB1 and its association with various diseases and clinical conditions, has been established by previous studies, as described hereinabove with reference to VGAM1778. Deoxyribonuclease I (DNASE1, Accession NM_005223) is another VGAM1968 host target gene. DNASE1 BINDING SITE is HOST TARGET binding site found in the 5' untranslated region of mRNA encoded by DNASE1, corresponding to a HOST TARGET binding site such as BINDING SITE I, BINDING SITE II or BINDING SITE III. Table 2 illustrates the complementarity of the nucleotide sequences of DNASE1 BINDING SITE, designated SEQ ID:11715, to the nucleotide sequence of VGAM1968 RNA, herein designated VGAM RNA, also designated SEQ ID:4679.

Another function of VGAM1968 is therefore inhibition of Deoxyribonuclease I (DNASE1, Accession NM_005223), a gene which seems to be involved in cell death. Accordingly, utilities of VGAM1968 include diagnosis, prevention and treatment of diseases and clinical conditions associated with DNASE1. The function of DNASE1 and its association with various diseases and clinical conditions, has been established by previous studies, as described hereinabove with reference to VGAM492. Ephrin-B1 (EFNB1, Accession NM_004429) is another VGAM1968 host target gene. EFNB1 BINDING SITE is HOST TARGET binding site found in the 3' untranslated region of mRNA encoded by EFNB1, corresponding to a HOST TARGET binding site such as BINDING SITE I, BINDING SITE II or BINDING SITE III. Table 2 illustrates the complementarity of the nucleotide sequences of EFNB1 BINDING SITE, designated SEQ ID:10712, to the nucleotide sequence of VGAM1968 RNA, herein designated VGAM RNA, also designated SEQ ID:4679.

Another function of VGAM1968 is therefore inhibition of Ephrin-B1 (EFNB1, Accession NM_004429), a gene which is a transmembrane ligand of Eph-related receptor tyrosine kinases, has a role in cell adhesion. Accordingly, utilities of VGAM1968 include diagnosis, prevention and treatment of diseases and clinical conditions associated with EFNB1. The function of EFNB1 and its association with various diseases and clinical conditions, has been established by previous studies, as described hereinabove with reference to VGAM390. V-erb-b2 Erythroblastic Leukemia Viral Oncogene Homolog 2, Neuro/glioblastoma Derived Oncogene Homolog (avian) (ERBB2, Accession NM_004448) is another VGAM1968 host target gene. ERBB2 BINDING SITE is HOST TARGET binding site found in the 3' untranslated region of mRNA encoded by ERBB2, corresponding to a HOST TARGET binding site such as BINDING SITE I, BINDING SITE II or BINDING SITE III. Table 2 illustrates the complementarity of the nucleotide sequences of ERBB2 BINDING SITE, designated SEQ ID:10746, to the nucleotide sequence of VGAM1968 RNA, herein designated VGAM RNA, also designated SEQ ID:4679.

Another function of VGAM1968 is therefore inhibition of V-erb-b2 Erythroblastic Leukemia Viral Oncogene Homolog 2, Neuro/glioblastoma Derived Oncogene Homolog (avian) (ERBB2, Accession NM_004448), a gene which Tyrosine kinase receptor. Accordingly, utilities of VGAM1968 include diagnosis, prevention and treatment of diseases and clinical conditions associated with ERBB2. The function of ERBB2 and its association with various diseases and clinical conditions, has been established by previous studies, as described hereinabove with reference to VGAM1366. Fucosyltransferase 5 (alpha (1,3) Fucosyltransferase) (FUT5, Accession NM_002034) is another VGAM1968 host target gene. FUT5 BINDING SITE is HOST TARGET binding site found in the 3' untranslated region of mRNA encoded by FUT5, corresponding to a HOST TARGET binding site such as BINDING SITE I, BINDING SITE II or BINDING SITE III. Table 2 illustrates the complementarity of the nucleotide sequences of FUT5 BINDING SITE, designated SEQ ID:7789, to the nucleotide sequence of VGAM1968 RNA, herein designated VGAM RNA, also designated SEQ ID:4679.

Another function of VGAM1968 is therefore inhibition of Fucosyltransferase 5 (alpha (1,3) Fucosyltransferase) (FUT5, Accession NM_002034), a gene which may catalyse alpha-1,3 glycosidic linkages involved in the expression of vim-2, lewis x/ssea-1 and sialyl lewis x antigens. Accordingly, utilities of VGAM1968 include diagnosis, prevention and treatment of diseases and clinical conditions associated with FUT5. The function of FUT5 and its association with various diseases and clinical conditions, has been established by previous studies, as described hereinabove with reference to VGAM1519. Growth Arrest-specific 7 (GAS7, Accession NM_003644) is another VGAM1968 host target gene. GAS7 BINDING SITE is HOST TARGET binding site found in the 3' untranslated region of mRNA encoded by GAS7, corresponding to a HOST TARGET binding site such as BIND- ING SITE I, BINDING SITE II or BINDING SITE III. Table 2 illustrates the complementarity of the nucleotide sequences of GAS7 BINDING SITE, designated SEQ ID:9715, to the nucleotide sequence of VGAM1968 RNA, herein designated VGAM RNA, also designated SEQ ID:4679.

Another function of VGAM1968 is therefore inhibition of Growth Arrest-specific 7 (GAS7, Accession NM_003644), a gene which may play a role in promoting maturation and morphological differentiation of cerebellar neurons. Accordingly, utilities of VGAM1968 include diagnosis, prevention and treatment of diseases and clinical conditions associated with GAS7. The function of GAS7 and its association with various diseases and clinical conditions, has been established by previous studies, as described hereinabove with reference to VGAM232. G1 to S Phase Transition 1 (GSPT1, Accession NM_002094) is another VGAM1968 host target gene. GSPT1 BINDING SITE is HOST TARGET binding site found in the 5' untranslated region of mRNA encoded by GSPT1, corresponding to a HOST TARGET binding site such as BINDING SITE I, BINDING SITE II or BINDING SITE III. Table 2 illustrates the complementarity of the nucleotide sequences of GSPT1 BINDING SITE, designated SEQ ID:7883, to the nucleotide sequence of VGAM1968 RNA, herein designated VGAM RNA, also designated SEQ ID:4679.

Another function of VGAM1968 is therefore inhibition of G1 to S Phase Transition 1 (GSPT1, Accession NM_002094), a gene which involves in regulation of mammalian cell growth. Accordingly, utilities of VGAM1968 include diagnosis, prevention and treatment of diseases and clinical conditions associated with GSPT1. The function of GSPT1 and its association with various diseases and clinical conditions, has been established by previous studies, as described hereinabove with reference to VGAM1707. Glutathione S-transferase M5 (GSTM5, Accession NM_000851) is another VGAM1968 host target gene. GSTM5 BINDING SITE is HOST TARGET binding site found in the 3' untranslated region of mRNA encoded by GSTM5, corresponding to a HOST TARGET binding site such as BINDING SITE I, BINDING SITE II or BINDING SITE III. Table 2 illustrates the complementarity of the nucleotide sequences of GSTM5 BINDING SITE, designated SEQ ID:6520, to the nucleotide sequence of VGAM1968 RNA, herein designated VGAM RNA, also designated SEQ ID:4679.

Another function of VGAM1968 is therefore inhibition of Glutathione S-transferase M5 (GSTM5, Accession NM_000851), a gene which conjugates reduced glutathione to a wide number of exogenous and endogenous hydrophobic electrophiles. Accordingly, utilities of VGAM1968 include diagnosis, prevention and treatment of diseases and clinical conditions associated with GSTM5. The function of GSTM5 and its association with various diseases and clinical conditions, has been established by previous studies, as described hereinabove with reference to VGAM1957. H3 Histone, Family 3B (H3.3B) (H3F3B, Accession NM_005324) is another VGAM1968 host target gene. H3F3B BINDING SITE is HOST TARGET binding site found in the 3" untranslated region of mRNA encoded by H3F3B, corresponding to a HOST TARGET binding site such as BINDING SITE I, BINDING SITE II or BINDING SITE III. Table 2 illustrates the complementarity of the nucleotide sequences of H3F3B BINDING SITE, designated SEQ ID:11795, to the nucleotide sequence of VGAM1968 RNA, herein designated VGAM RNA, also designated SEQ ID:4679.

Another function of VGAM1968 is therefore inhibition of H3 Histone, Family 3B (H3.3B) (H3F3B, Accession NM_005324). Accordingly, utilities of VGAM1968 include diagnosis, prevention and treatment of diseases and clinical conditions associated with H3F3B. High Mobility Group AT-hook 2 (HMGA2, Accession NM_003483) is another VGAM1968 host target gene. HMGA2 BINDING SITE is HOST TARGET binding site found in the 3' untranslated region of mRNA encoded by HMGA2, corresponding to a HOST TARGET binding site such as BINDING SITE I, BINDING SITE II or BINDING SITE III. Table 2 illustrates the complementarity of the nucleotide sequences of HMGA2 BINDING SITE, designated SEQ ID:9568, to the nucleotide sequence of VGAM1968 RNA, herein designated VGAM RNA, also designated SEQ ID:4679.

Another function of VGAM1968 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM1968 include diagnosis, prevention and treatment of diseases and clinical conditions associated with HMGA2. The function of HMGA2 and its association with various diseases and clinical conditions, has been established by previous studies, as described hereinabove with reference to VGAM552. Hairless Homolog (mouse) (HR, Accession NM_005144) is another VGAM1968 host target gene. HR BINDING SITE is HOST TARGET binding site found in the 5' untranslated region of mRNA encoded by HR, corresponding to a HOST TARGET binding site such as BINDING SITE I, BINDING SITE II or BINDING SITE III. Table 2 illustrates the complementarity of the nucleotide sequences of HR BINDING SITE, designated SEQ ID:11616, to the nucleotide sequence of VGAM1968 RNA, herein designated VGAM RNA, also designated SEQ ID:4679.

Another function of VGAM1968 is therefore inhibition of Hairless Homolog (mouse) (HR, Accession NM_005144). Accordingly, utilities of VGAM1968 include diagnosis, prevention and treatment of diseases and clinical conditions associated with HR. Heparan Sulfate 2-O-sulfotransferase 1 (HS2ST1, Accession NM_012262) is another VGAM1968 host target gene. HS2ST1 BINDING SITE is HOST TARGET binding site found in the 3' untranslated region of mRNA encoded by HS2ST1, corresponding to a HOST TARGET binding site such as BINDING SITE I, BINDING SITE II or BINDING SITE III. Table 2 illustrates the complementarity of the nucleotide sequences of HS2ST1 BINDING SITE, designated SEQ ID:14573, to the nucleotide sequence of VGAM1968 RNA, herein designated VGAM RNA, also designated SEQ ID:4679.

Another function of VGAM1968 is therefore inhibition of Heparan Sulfate 2-O-sulfotransferase 1 (HS2ST1, Accession NM_012262). Accordingly, utilities of VGAM1968 include diagnosis, prevention and treatment of diseases and clinical conditions associated with HS2ST1. Potassium Inwardly-rectifying Channel, Subfamily J, Member 15 (KCNJ15, Accession NM_002243) is another VGAM1968 host target gene. KCNJ15 BINDING SITE is HOST TARGET binding site found in the 5' untranslated region of mRNA encoded by KCNJ15, corresponding to a HOST TARGET binding site such as BINDING SITE I, BINDING SITE II or BINDING SITE III. Table 2 illustrates the complementarity of the nucleotide sequences of KCNJ15 BINDING SITE, designated SEQ ID:8029, to the nucleotide sequence of VGAM1968 RNA, herein designated VGAM RNA, also designated SEQ ID:4679.

Another function of VGAM1968 is therefore inhibition of Potassium Inwardly-rectifying Channel, Subfamily J, Member 15 (KCNJ15, Accession NM_002243). Accordingly, utilities of VGAM1968 include diagnosis, prevention and treatment of diseases and clinical conditions associated with KCNJ15. Kinesin Heavy Chain Member 2 (KIF2, Accession NM_004520) is another VGAM1968 host target gene. KIF2 BINDING SITE is HOST TARGET binding site found in the 3' untranslated region of mRNA encoded by KIF2, corresponding to a HOST TARGET binding site such as BINDING SITE I, BINDING SITE II or BINDING SITE III. Table 2 illustrates the complementarity of the nucleotide sequences of KIF2 BINDING SITE, designated SEQ ID:10848, to the nucleotide sequence of VGAM1968 RNA, herein designated VGAM RNA, also designated SEQ ID:4679.

Another function of VGAM1968 is therefore inhibition of Kinesin Heavy Chain Member 2 (KIF2, Accession NM_004520). Accordingly, utilities of VGAM1968 include diagnosis, prevention and treatment of diseases and clinical conditions associated with KIF2. Leukocyte Tyrosine Kinase (LTK, Accession NM_002344) is another VGAM1968 host target gene. LTK BINDING SITE is HOST TARGET binding site found in the 5' untranslated region of mRNA encoded by LTK, corresponding to a HOST TARGET binding site such as BINDING SITE I, BINDING SITE II or BINDING SITE III. Table 2 illustrates the complementarity of the nucleotide sequences of LTK BINDING SITE, designated SEQ ID:8143, to the nucleotide sequence of VGAM1968 RNA, herein designated VGAM RNA, also designated SEQ ID:4679.

Another function of VGAM1968 is therefore inhibition of Leukocyte Tyrosine Kinase (LTK, Accession NM_002344), a gene which is probably a receptor with a tyrosine-protein kinase activity. Accordingly, utilities of VGAM1968 include diagnosis, prevention and treatment of diseases and clinical conditions associated with LTK. The function of LTK has been established by previous studies. Ben-Neriah and Bauskin (1988) isolated and characterized the complementary DNA for the mouse leukocyte tyrosine kinase locus. They used the insulin receptor-related avian sarcoma oncogene v-ros (OMIM Ref. No. 165020) as a probe to isolate the cDNA from a mouse pre-B lymphocyte cDNA library. Northern analysis revealed expression of the gene in thymus, spleen, and kidney. Sequence analysis of the gene revealed similarities with several tyrosine kinase receptor genes of the insulin receptor family. The LTK gene, however, is unique in that it encodes a transmembrane protein that lacks an extracellular domain. The authors suggested that LTK may encode a signal transduction subunit for one or more of the hematopoietic receptors. Krolewski et al. (1990) mapped TYK1 to human chromosome 15 by Southern analysis of somatic cell hybrid DNAs. Richard et al. (1994) mapped many loci on chromosome 15, which they subdivided into 5 regions. By PCR, they concluded that the LTK gene is located in their region III:15q15.1-q21.1. Liao et al. (1996) found that the mouse Ltk gene is closely linked to the Tyro3 gene (OMIM Ref. No. 600341) which maps to mouse chromosome 2. Toyoshima et al. (1993) cloned a set of cDNAs representing differently spliced human LTK mRNAs. These cDNAs predicted a truncated receptor protein that lacks the tyrosine kinase domain and a soluble receptor protein that has neither a transmembrane nor a tyrosine kinase domain. A cDNA clone containing the complete open reading frame demonstrated that the extracellular domain of the receptor protein is larger than previously predicted. Thus, the LTK gene produces not only the putative receptor tyrosine kinase for an unknown ligand but also multiple protein products that may have different functions Full details of the abovementioned studies are described in the following publications, the disclosure of which are hereby incorporated by reference:

Liao, X.; Zhou, R.; Gilbert, D. J.; Copeland, N. G.; Jenkins, N. A.: Receptor tyrosine kinase gene Tyro3 maps to mouse chromosome 2, closely linked to Ltk. Mammalian Genome 7:395-396, 1996; and Richard, I.; Broux, O.; Chiannilkulchai, N.; Fougerousse, F.; Allamand, V.; Bourg, N.; Brenguier, L.; Devaud, C.; Pasturaud, P.; Roudaut, C.; Lorenzo, F.; Sebastiani-Kabatchis, C.; Schul.

Further studies establishing the function and utilities of LTK are found in John Hopkins OMIM database record ID 151520, and in sited publications numbered 5077-5079, 212 and 5080 listed in the bibliography section hereinbelow, which are also hereby incorporated by reference. Mitogen-activated Protein Kinase Kinase Kinase 7 (MAP3K7, Accession NM_003188) is another VGAM1968 host target gene. MAP3K7 BINDING SITE is HOST TARGET binding site found in the 3' untranslated region of mRNA encoded by MAP3K7, corresponding to a HOST TARGET binding site such as BINDING SITE I, BINDING SITE II or BINDING SITE III. Table 2 illustrates the complementarity of the nucleotide sequences of MAP3K7 BINDING SITE, designated SEQ ID:9164, to the nucleotide sequence of VGAM1968 RNA, herein designated VGAM RNA, also designated SEQ ID:4679.

Another function of VGAM1968 is therefore inhibition of Mitogen-activated Protein Kinase Kinase Kinase 7 (MAP3K7, Accession NM_003188), a gene which can phosphorylate and activate yet undefined mapkks. mediator of tgf-beta signal transduction. stimulates nf-kappa b activation. Accordingly, utilities of VGAM1968 include diagnosis, prevention and treatment of diseases and clinical conditions associated with MAP3K7. The function of MAP3K7 has been established by previous studies. The MAP kinase (MAPK) cascades constitute functional units that couple upstream input signals to a variety of outputs through pathways that involve 3 protein kinases. MAPKKK (MAP3K; OMIM Ref. No. 602448) phosphorylates MAPKK (MAP2K; OMIM Ref. No. 176872), which in turn phosphorylates and activates MAPK (see OMIM Ref. No. 176948). One MAPK pathway in S. cerevisiae controls the response to mating pheromone. Yamaguchi et al. (1995) screened a mouse cDNA library for clones that could act as MAPKKKs, suppressing a defect in the mating pheromone response pathway. They identified a cDNA that encodes a predicted 579-amino acid protein, which they named TAK1 (TGF-beta-activated kinase). TAK1 has a putative N-terminal protein kinase domain. In mammalian cells, TAK1 regulates transcription by transforming growth factor-beta (TGFB; 190180). Only TAK1 protein missing the N-terminal 22 amino acids suppressed the yeast defect. This activated form also signaled in the absence of TGFB in mammalian cells Kondo et al. (1998) identified human ESTs that were homologous to mouse TAK1 and used the resulting sequence information to clone human TAK1 from lung cDNA. The predicted 579-amino acid human TAK1 protein is 99% identical to the mouse TAK1 protein. On Northern blots, TAK1 was expressed as a 3-kb mRNA in all tissues tested. Kondo et al. (1998) found 2 isoforms of TAK1 that differed by an insertion of 27 amino acids after amino acid 403

Full details of the abovementioned studies are described in the following publications, the disclosure of which are hereby incorporated by reference:

Yamaguchi, K.; Shirakabe, K.; Shibuya, H.; Irie, K.; Oishi, I.; Ueno, N.; Taniguchi, T.; Nishida, E.; Matsumoto, K.: Identification of a member of the MAPKKK family as a potential mediator of TGF-beta signal transduction. Science 270:2008-2011, 1995; and Kondo, M.; Osada, H.; Uchida, K.; Yanagisawa, K.; Masuda, A.; Takagi, K.; Takahashi, T.; Takahashi, T.: Molecular cloning of human TAK1 and its mutational analysis in human lung cancer.

Further studies establishing the function and utilities of MAP3K7 are found in John Hopkins OMIM database record ID 602614, and in sited publications numbered 9048-9050, 902 and 9051 listed in the bibliography section hereinbelow, which are also hereby incorporated by reference. Matrix Metalloproteinase 14 (membrane-inserted) (MMP14, Accession NM_004995) is another VGAM1968 host target gene. MMP14 BINDING SITE is HOST TARGET binding site found in the 3' untranslated region of mRNA encoded by MMP14, corresponding to a HOST TARGET binding site such as BINDING SITE I, BINDING SITE II or BINDING SITE III. Table 2 illustrates the complementarity of the nucleotide sequences of MMP14 BINDING SITE, designated SEQ ID:11433, to the nucleotide sequence of VGAM1968 RNA, herein designated VGAM RNA, also designated SEQ ID:4679.

Another function of VGAM1968 is therefore inhibition of Matrix Metalloproteinase 14 (membrane-inserted) (MMP14, Accession NM_004995). Accordingly, utilities of VGAM1968 include diagnosis, prevention and treatment of diseases and clinical conditions associated with MMP14. Myosin, Light Polypeptide Kinase (MYLK, Accession XM_173098) is another VGAM1968 host target gene. MYLK BINDING SITE is HOST TARGET binding site found in the 3' untranslated region of mRNA encoded by MYLK, corresponding to a HOST TARGET binding site such as BINDING SITE I, BINDING SITE II or BINDING SITE III. Table 2 illustrates the complementarity of the nucleotide sequences of MYLK BINDING SITE, designated SEQ ID:46358, to the nucleotide sequence of VGAM1968 RNA, herein designated VGAM RNA, also designated SEQ ID:4679.

Another function of VGAM1968 is therefore inhibition of Myosin, Light Polypeptide Kinase (MYLK, Accession XM_173098), a gene which is involved in contraction of smooth muscle. Accordingly, utilities of VGAM1968 include diagnosis, prevention and treatment of diseases and clinical conditions associated with MYLK. The function of MYLK and its association with various diseases and clinical conditions, has been established by previous studies, as described hereinabove with reference to VGAM793. NDRG Family Member 3 (NDRG3, Accession NM_032013) is another VGAM1968 host target gene. NDRG3 BINDING SITE1 and NDRG3 BINDING SITE2 are HOST TARGET binding sites found in untranslated regions of mRNA encoded by NDRG3, corresponding to HOST TARGET binding sites such as BINDING SITE I, BINDING SITE II or BINDING SITE III. Table 2 illustrates the complementarity of the nucleotide sequences of NDRG3 BINDING SITE1 and NDRG3 BINDING SITE2, designated SEQ ID:25723 and SEQ ID:22847 respectively, to the nucleotide sequence of VGAM1968 RNA, herein designated VGAM RNA, also designated SEQ ID:4679.

Another function of VGAM1968 is therefore inhibition of NDRG Family Member 3 (NDRG3, Accession NM_032013). Accordingly, utilities of VGAM1968 include diagnosis, prevention and treatment of diseases and clinical conditions associated with NDRG3. Nuclear Factor of Kappa Light Polypeptide Gene Enhancer In B-cells Inhibitor-like 2 (NFKBIL2, Accession NM_013432) is another VGAM1968 host target gene. NFKBIL2 BINDING SITE is HOST TARGET binding site found in the 5' untranslated region of mRNA encoded by NFKBIL2, corresponding to a HOST TARGET binding site such as BINDING SITE I, BINDING SITE II or BINDING SITE III. Table 2 illustrates the complementarity of the nucleotide sequences of NFKBIL2 BINDING SITE, designated SEQ ID:15086, to the nucleotide sequence of VGAM1968 RNA, herein designated VGAM RNA, also designated SEQ ID:4679.

Another function of VGAM1968 is therefore inhibition of Nuclear Factor of Kappa Light Polypeptide Gene Enhancer In B-cells Inhibitor-like 2 (NFKBIL2, Accession NM_013432), a gene which may have a role in regulating NF-kappa B function in epithelial cells. Accordingly, utilities of VGAM1968 include diagnosis, prevention and treatment of diseases and clinical conditions associated with NFKBIL2. The function of NFKBIL2 has been established by previous studies. By means of subtractive hybridization of lung fibroblast cDNAs from a lung epithelial cell line cDNA, degenerate PCR, and HeLa cell cDNA screening, Ray et al. (1995) identified a novel cDNA, which they called I-kappa-B-related (IKBR). IKBR cDNA encodes a deduced 481-amino acid protein containing 3 ankyrin-repeat motifs. Northern blot analysis revealed an approximately 5.5-kb transcript in lung and trachea epithelial but not fibroblast cells. In whole tissues, the transcript was detected in skeletal muscle and heart but not in lung (where epithelial cells constitute only 10% of adult alveolar epithelium), liver, kidney, pancreas, brain, or placenta. Western blot analysis demonstrated a 52-kD protein in HeLa cell lysates. In electrophoretic mobility shift assays, DNA binding by NFKB/RELA was inhibited in the presence of NFKBIL2. Norman and Barton (2000) showed that the NFKBIL2 gene contains 13 exons, spanning 6,550 bp of genomic sequence. They reported a revised mRNA and protein sequence for IKBR, which predicted that the protein is larger than originally described.

Full details of the abovementioned studies are described in the following publications, the disclosure of which are hereby incorporated by reference:

Norman, D. A. M.; Barton, P. J. R.: Isolation, sequence, and chromosomal localisation of the human I(kappa)BR gene. Ann. Hum. Genet. 64:15-23, 2000; and Ray, P.; Zhang, D.-H.; Elias, J. A.; Ray, A.: Cloning of a differentially expressed I-kappa-B-related protein. J. Biol. Chem. 270:10680-10685, 1995.

Further studies establishing the function and utilities of NFKBIL2 are found in John Hopkins OMIM database record ID 604546, and in sited publications numbered 7464-7465 listed in the bibliography section hereinbelow, which are also hereby incorporated by reference. Nucleoporin 98 kDa (NUP98, Accession NM_016320) is another VGAM1968 host target gene. NUP98 BINDING SITE is HOST TARGET binding site found in the 3' untranslated region of mRNA encoded by NUP98, corresponding to a HOST TARGET binding site such as BINDING SITE I, BINDING SITE II or BINDING SITE III. Table 2 illustrates the complementarity of the nucleotide sequences of NUP98 BINDING SITE, designated SEQ ID:18443, to the nucleotide sequence of VGAM1968 RNA, herein designated VGAM RNA, also designated SEQ ID:4679.

Another function of VGAM1968 is therefore inhibition of Nucleoporin 98kDa (NUP98, Accession NM_016320), a gene which functions in the nuclear transport of protein and RNA. Accordingly, utilities of VGAM1968 include diagnosis, prevention and treatment of diseases and clinical conditions associated with NUP98. The function of NUP98 and its association with various diseases and clinical conditions, has been established by previous studies, as described hereinabove with reference to VGAM55. OIP2 (Accession XM_085017) is another VGAM1968 host target gene. OIP2

BINDING SITE is HOST TARGET binding site found in the 5' untranslated region of mRNA encoded by OIP2, corresponding to a HOST TARGET binding site such as BINDING SITE I, BINDING SITE II or BINDING SITE III. Table 2 illustrates the complementarity of the nucleotide sequences of OIP2 BINDING SITE, designated SEQ ID:37794, to the nucleotide sequence of VGAM1968 RNA, herein designated VGAM RNA, also designated SEQ ID:4679.

Another function of VGAM1968 is therefore inhibition of OIP2 (Accession XM_085017), a gene which belongs to a family of outer membrane proteins involved in gonococcal adhesion to and invasion of human cells. Accordingly, utilities of VGAM1968 include diagnosis, prevention and treatment of diseases and clinical conditions associated with OIP2. The function of OIP2 has been established by previous studies. Neisseria gonorrhoeae opacity-associated (Opa) proteins are a family of outer membrane proteins involved in gonococcal adhesion to and invasion of human cells. Opa expression appears to be necessary for gonococcal disease. Using the yeast 2-hybrid system to screen a HeLa cell cDNA library with an N. gonorrhoeae Opa protein as bait, Williams et al. (1998) identified partial cDNAs encoding Opa-interacting protein-1 (OIP1, or TRIP6; 602933), OIP2, OIP3 (PK3; 179050), OIP4 (PRAME; 606021), and OIP5 (OMIM Ref. No. 606020). Sequence analysis predicted that the partial OIP2 cDNA encodes a 265-amino acid peptide that is likely to be the C terminus of a longer protein. OIP2 contains a cluster of basic residues, but unlike OIP1, OIP4, and OIP5, it has no cysteine motif. Inherently unstable mammalian mRNAs contain AU-rich elements (AREs) within their 3-prime untranslated regions. In yeast, 3-prime-to-5-prime mRNA degradation is mediated by the exosome, a multisubunit particle. Chen et al. (2001) purified and characterized the human exosome by mass spectrometry and found its composition to be similar to its yeast counterpart. They identified the following protein subunits within the human exosome: p7, which is homologous to the yeast Rrp4 protein (OMIM Ref. No. 602238); p8, which is homologous to the yeast Rrp42 protein (OMIM Ref. No. 606488); p9, which is homologous to the yeast Rrp43 protein (OIP2); p10, which is homologous to the yeast Rrp40 protein (OMIM Ref. No. 606489); p11, which is homologous to the yeast Mtr3 protein (OMIM Ref. No. 606490); p12A, which is homologous to the yeast Rrp41 protein (OMIM Ref. No. 606491); p12B, which is homologous to the yeast Rrp46 protein (OMIM Ref. No. 606492); and p13, which is homologous to the yeast Csl4 protein (OMIM Ref. No. 606493). They also identified 2 exosome-associated factors, p1 (OMIM Ref. No. 600478) and p14 (MPP6; 605500), that were not homologous to any yeast exosome components.

Full details of the abovementioned studies are described in the following publications, the disclosure of which are hereby incorporated by reference:

Chen, C.-Y.; Gherzi, R.; Ong, S.-E.; Chan, E. L.; Raijmakers, R.; Pruijn, G. J. M.; Stoecklin, G.; Moroni, C.; Mann, M.; Karin, M.: AU binding proteins recruit the exosome to degrade ARE-containing mRNAs. Cell 107:451-464, 2001; and Williams, J. M.; Chen, G.-C.; Zhu, L.; Rest, R. F.: Using the yeast two-hybrid system to identify human epithelial cell proteins that bind gonococcal Opa proteins: intracellular gonoc.

Further studies establishing the function and utilities of OIP2 are found in John Hopkins OMIM database record ID 606019, and in sited publications numbered 9518 listed in the bibliography section hereinbelow, which are also hereby incorporated by reference.poly (A) Binding Protein, Nuclear 1 (PABPN1, Accession NM_004643) is another VGAM1968 host target gene. PABPN1 BINDING SITE is HOST TARGET binding site found in the 3' untranslated region of mRNA encoded by PABPN1, corresponding to a HOST TARGET binding site such as BINDING SITE I, BINDING SITE II or BINDING SITE III. Table 2 illustrates the complementarity of the nucleotide sequences of PABPN1 BINDING SITE, designated SEQ ID:11018, to the nucleotide sequence of VGAM1968 RNA, herein designated VGAM RNA, also designated SEQ ID:4679.

Another function of VGAM1968 is therefore inhibition of poly (A) Binding Protein, Nuclear 1 (PABPN1, Accession NM_004643), a gene which binds to Poly (A). Accordingly, utilities of VGAM1968 include diagnosis, prevention and treatment of diseases and clinical conditions associated with PABPN1. The function of PABPN1 has been established by previous studies. In a search for a gene mutant in oculopharyngeal muscular dystrophy (OPMD; 164300), which maps to 14q11, Brais et al. (1998) isolated a promising candidate, a gene homologous to the bovine poly (A)-binding protein-2 gene. The authors called the human gene PABP2. PABP2 was considered a good candidate for OPMD because it maps to the genetically defined candidate interval in 14q11, its mRNA is highly expressed in skeletal muscle, and the PABP2 protein is exclusively localized to the nucleus, where it acts as a factor in mRNA polyadenylation. Brais et al. (1998) identified short N-terminal trinucleotide expansions (GCG) in the PABP2 gene of OPMD patients (e.g., 602279.0001) Using both immunoelectron microscopy and fluorescence confocal microscopy, Calado et al. (2000) determined that the OPMD-specific nuclear inclusions were stained anti-PABP2 antibodies. In addition, the inclusions were labeled with antibodies directed against ubiquitin and the subunits of the proteasome, and contained a less soluble form of PABP2 as well as poly (A) RNA. The authors suggested that the polyalanine expansions in PABP2 induce a misfolding and aggregation of the protein into insoluble inclusions, similarly to events in neurodegenerative diseases caused by CAG/polyglutamine expansions, and that in OPMD the polyalanine expansions in the PABP2 protein may interfere with the cellular traffic of poly (A) RNA.

Full details of the abovementioned studies are described in the following publications, the disclosure of which are hereby incorporated by reference:

Brais, B.; Bouchard, J.-P.; Xie, Y.-G.; Rochefort, D. L.; Chretien, N.; Tome, F. M. S.; Lafreniere, R. G.; Rommens, J. M.; Uyama, E.; Nohira, O.; Blumen, S.; Korczyn, A. D.; Heutink, P.; Mathieu, J.; Duranceau, A.; Codere, F.; Fardeau, M.; Rouleau, G. A.: Short GCG expansions in the PABP2 gene cause oculopharyngeal muscular dystrophy. Nature Genet. 18:164-167, 1998. Note: Erratum: Nature Genet. 19:404 only, 1998; and Calado, A.; Tome, F. M. S.; Brais, B.; Rouleau, G. A.; Kuhn, U.; Wahle, E.; Carmo-Fonseca, M.: Nuclear inclusions in oculopharyngeal muscular dystrophy consist of poly (A) binding protei.

Further studies establishing the function and utilities of PABPN1 are found in John Hopkins OMIM database record ID 602279, and in sited publications numbered 8568-8569, 10685, 1114 and 11606 listed in the bibliography section hereinbelow, which are also hereby incorporated by reference. Platelet-derived Growth Factor Beta Polypeptide (simian sarcoma viral (v-sis) Oncogene Homolog) (PDGFB, Accession NM_002608) is another VGAM1968 host target gene. PDGFB BINDING SITE is HOST TARGET binding site found in the 3' untranslated region of mRNA encoded by PDGFB, corresponding to a HOST TARGET binding site such as BINDING SITE I, BINDING SITE II or BINDING SITE III. Table 2 illustrates the complementarity of the nucleotide sequences of PDGFB BINDING SITE, designated SEQ ID:8470, to the nucleotide sequence of VGAM1968 RNA, herein designated VGAM RNA, also designated SEQ ID:4679.

Another function of VGAM1968 is therefore inhibition of Platelet-derived Growth Factor Beta Polypeptide (simian sarcoma viral (v-sis) Oncogene Homolog) (PDGFB, Accession NM_002608), a gene which plays an important role in stimulating adjacent cells to grow and thereby heal the wound. Accordingly, utilities of VGAM1968 include diagnosis, prevention and treatment of diseases and clinical conditions associated with PDGFB. The function of PDGFB and its association with various diseases and clinical conditions, has been established by previous studies, as described hereinabove with reference to VGAM173. Placental Growth Factor, Vascular Endothelial Growth Factor-related Protein (PGF, Accession NM_002632) is another VGAM1968 host target gene. PGF BINDING SITE is HOST TARGET binding site found in the 3' untranslated region of mRNA encoded by PGF, corresponding to a HOST TARGET binding site such as BINDING SITE I, BINDING SITE II or BINDING SITE III. Table 2 illustrates the complementarity of the nucleotide sequences of PGF BINDING SITE, designated SEQ ID:8493, to the nucleotide sequence of VGAM1968 RNA, herein designated VGAM RNA, also designated SEQ ID:4679.

Another function of VGAM1968 is therefore inhibition of Placental Growth Factor, Vascular Endothelial Growth Factor-related Protein (PGF, Accession NM_002632), a gene which is a growth factor active in angiogenesis, and endothelial cell growth, stimulating cell proliferation and migration. it binds to receptor vegfr-1/fl. Accordingly, utilities of VGAM1968 include diagnosis, prevention and treatment of diseases and clinical conditions associated with PGF. The function of PGF and its association with various diseases and clinical conditions, has been established by previous studies, as described hereinabove with reference to VGAM1420. Phosphoinositide-3-kinase, Regulatory Subunit, Polypeptide 3 (p55, gamma) (PIK3R3, Accession XM_027982) is another VGAM1968 host target gene. PIK3R3 BINDING SITE is HOST TARGET binding site found in the 3' untranslated region of mRNA encoded by PIK3R3, corresponding to a HOST TARGET binding site such as BINDING SITE I, BINDING SITE II or BINDING SITE III. Table 2 illustrates the complementarity of the nucleotide sequences of PIK3R3 BINDING SITE, designated SEQ ID:30606, to the nucleotide sequence of VGAM1968 RNA, herein designated VGAM RNA, also designated SEQ ID:4679.

Another function of VGAM1968 is therefore inhibition of Phosphoinositide-3-kinase, Regulatory Subunit, Polypeptide 3 (p55, gamma) (PIK3R3, Accession XM_027982). Accordingly, utilities of VGAM1968 include diagnosis, prevention and treatment of diseases and clinical conditions associated with PIK3R3. Pinin, Desmosome Associated Protein (PNN, Accession XM_048719) is another VGAM1968 host target gene. PNN BINDING SITE is HOST TARGET binding site found in the 3' untranslated region of mRNA encoded by PNN, corresponding to a HOST TARGET binding site such as BINDING SITE I, BINDING SITE II or BINDING SITE III. Table 2 illustrates the complementarity of the nucleotide sequences of PNN BINDING SITE, designated SEQ ID:35233, to the nucleotide sequence of VGAM1968 RNA, herein designated VGAM RNA, also designated SEQ ID:4679.

Another function of VGAM1968 is therefore inhibition of Pinin, Desmosome Associated Protein (PNN, Accession XM_048719), a gene which reinforces the intermediate filament-desmosome complex. Accordingly, utilities of VGAM1968 include diagnosis, prevention and treatment of diseases and clinical conditions associated with PNN. The function of PNN and its association with various diseases and clinical conditions, has been established by previous studies, as described hereinabove with reference to VGAM120. Polymerase (DNA directed), Eta (POLH, Accession NM_006502) is another VGAM1968 host target gene. POLH BINDING SITE is HOST TARGET binding site found in the 5' untranslated region of mRNA encoded by POLH, corresponding to a HOST TARGET binding site such as BINDING SITE I, BINDING SITE II or BINDING SITE III. Table 2 illustrates the complementarity of the nucleotide sequences of POLH BINDING SITE, designated SEQ ID:13251, to the nucleotide sequence of VGAM1968 RNA, herein designated VGAM RNA, also designated SEQ ID:4679.

Another function of VGAM1968 is therefore inhibition of Polymerase (DNA directed), Eta (POLH, Accession NM_006502). Accordingly, utilities of VGAM1968 include diagnosis, prevention and treatment of diseases and clinical conditions associated with POLH. Protein Kinase, Y-linked (PRKY, Accession NM_002760) is another VGAM1968 host target gene. PRKY BINDING SITE is HOST TARGET binding site found in the 5' untranslated region of mRNA encoded by PRKY, corresponding to a HOST TARGET binding site such as BINDING SITE I, BINDING SITE II or BINDING SITE III. Table 2 illustrates the complementarity of the nucleotide sequences of PRKY BINDING SITE, designated SEQ ID:8647, to the nucleotide sequence of VGAM1968 RNA, herein designated VGAM RNA, also designated SEQ ID:4679.

Another function of VGAM1968 is therefore inhibition of Protein Kinase, Y-linked (PRKY, Accession NM_002760), a gene which is a putative protein kinase. Accordingly, utilities of VGAM1968 include diagnosis, prevention and treatment of diseases and clinical conditions associated with PRKY. The function of PRKY has been established by previous studies. PRKX (OMIM Ref. No. 300083) is a novel serine/threonine subtype of protein kinase that appears to encode a protein related to the catalytic subunit of the cAMP-dependent protein kinases, which are key players in the cellular responses to the second messenger cAMP. Klink et al. (1995) found that somatic cell hybrid analysis of PRKX under high stringency conditions revealed at least 3 further loci closely related to this gene in the human, constituting a small subfamily. Schiebel et al. (1997) isolated and characterized the PRKY gene, which is highly homologous to the PRKX gene on Xp22.3 and represents a member of the cAMP-dependent serine/threonine protein kinase gene family. Abnormal interchange can occur anywhere between Xp and Yp proximal to SRY (OMIM Ref. No. 480000). Schiebel et al. (1997) demonstrated that abnormal interchange in XX males (OMIM Ref. No. 278850) and XY females (OMIM Ref. No. 306100) happens particularly frequently between PRKX and PRKY. In a collection of 26 XX males and 4 XY females, between 27 and 35% of the interchanges took place between PRK homologs, but at different sites within the gene. PRKY and PRKX are located far from the pseudoautosomal region, where XY exchange normally takes place. Schiebel et al. (1997) stated that the unprecedented high sequence identity and identical orientation of PRKY to its homologous partner on the X chromosome, PRKX, explains the high frequency of abnormal pairing and the subsequent ectopic recombination, leading to XX males and XY females and to the highest rate of recombination outside the pseudoautosomal region. Schiebel et al. (1997) used FISH analysis to map the PRKY gene to Yp11.2 in close proximity to AMELY (OMIM Ref. No. 410000); the autosomal copy, a pseudogene (OMIM Ref. No. PRKXP1), to 15q26; and a further X-linked pseudogene (OMIM Ref. No. PRKXP2) to Xq12-q13.

Full details of the abovementioned studies are described in the following publications, the disclosure of which are hereby incorporated by reference:

Schiebel, K.; Mertz, A.; Winkelmann, B.; Glaser, B.; Schempp, W.; Rappold, G.: FISH localization of the human Y-homolog of protein kinase PRKX (PRKY) to Yp11.2 and two pseudogenes to 15q26 and Xq12-q13. Cytogenet. Cell Genet. 76:49-52, 1997; and Schiebel, K.; Winkelmann, M.; Mertz, A.; Xu, X.; Page, D. C.; Weil, D.; Petit, C.; Rappold, G. A.: Abnormal XY interchange between a novel isolated protein kinase gene, PRKY, and its h.

Further studies establishing the function and utilities of PRKY are found in John Hopkins OMIM database record ID 400008, and in sited publications numbered 10972-1097 and 8834 listed in the bibliography section hereinbelow, which are also hereby incorporated by reference. RAB5A, Member RAS Oncogene Family (RAB5A, Accession NM_004162) is another VGAM1968 host target gene. RAB5A BINDING SITE is HOST TARGET binding site found in the 3" untranslated region of mRNA encoded by RAB5A, corresponding to a HOST TARGET binding site such as BINDING SITE I, BINDING SITE II or BINDING SITE III. Table 2 illustrates the complementarity of the nucleotide sequences of RAB5A BINDING SITE, designated SEQ ID:10372, to the nucleotide sequence of VGAM1968 RNA, herein designated VGAM RNA, also designated SEQ ID:4679.

Another function of VGAM1968 is therefore inhibition of RAB5A, Member RAS Oncogene Family (RAB5A, Accession NM_004162), a gene which is a rate-limiting component of the machinery regulating the kinetics of membrane traffic. Accordingly, utilities of VGAM1968 include diagnosis, prevention and treatment of diseases and clinical conditions associated with RAB5A. The function of RAB5A and its association with various diseases and clinical conditions, has been established by previous studies, as described hereinabove with reference to VGAM1342. Regulator of Nonsense Transcripts 1 (RENT1, Accession NM_002911) is another VGAM1968 host target gene. RENT1 BINDING SITE is HOST TARGET binding site found in the 3' untranslated region of mRNA encoded by RENT1, corresponding to a HOST TARGET binding site such as BINDING SITE I, BINDING SITE II or BINDING SITE III. Table 2 illustrates the complementarity of the nucleotide sequences of RENT1 BINDING SITE, designated SEQ ID:8815, to the nucleotide sequence of VGAM1968 RNA, herein designated VGAM RNA, also designated SEQ ID:4679.

Another function of VGAM1968 is therefore inhibition of Regulator of Nonsense Transcripts 1 (RENT1, Accession NM_002911), a gene which eliminates the production of nonsense-containing RNAs in mammalian cells. Accordingly, utilities of VGAM1968 include diagnosis, prevention and treatment of diseases and clinical conditions associated with RENT1. The function of RENT1 and its association with various diseases and clinical conditions, has been established by previous studies, as described hereinabove with reference to VGAM1959. SH3-domain Binding Protein 2 (SH3BP2, Accession NM_003023) is another VGAM1968 host target gene. SH3BP2 BINDING SITE is HOST TARGET binding site found in the 3' untranslated region of mRNA encoded by SH3BP2, corresponding to a HOST TARGET binding site such as BINDING SITE I, BINDING SITE II or BINDING SITE III. Table 2 illustrates the complementarity of the nucleotide sequences of SH3BP2 BINDING SITE, designated SEQ ID:8947, to the nucleotide sequence of VGAM1968 RNA, herein designated VGAM RNA, also designated SEQ ID:4679.

Another function of VGAM1968 is therefore inhibition of SH3-domain Binding Protein 2 (SH3BP2, Accession NM_003023). Accordingly, utilities of VGAM1968 include diagnosis, prevention and treatment of diseases and clinical conditions associated with SH3BP2. SUSP1 (Accession NM_015571) is another VGAM1968 host target gene. SUSP1 BINDING SITE is HOST TARGET binding site found in the 3' untranslated region of mRNA encoded by SUSP1, corresponding to a HOST TARGET binding site such as BINDING SITE I, BINDING SITE II or BINDING SITE III. Table 2 illustrates the complementarity of the nucleotide sequences of SUSP1 BINDING SITE, designated SEQ ID:17844, to the nucleotide sequence of VGAM1968 RNA, herein designated VGAM RNA, also designated SEQ ID:4679.

Another function of VGAM1968 is therefore inhibition of SUSP1 (Accession NM_015571), a gene which may play a role in the regulation of SUMO-1-mediated cellular processes particularly related to reproduction. Accordingly, utilities of VGAM1968 include diagnosis, prevention and treatment of diseases and clinical conditions associated with SUSP1. The function of SUSP1 has been established by previous studies. By screening human brain cDNAs for the potential to encode proteins that are at least 50 kD, Nagase et al. (1998) isolated a partial SUSP1 cDNA, which they called KIAA0797, that lacks 5-prime coding sequence. The deduced partial SUSP1 protein has 1,084 amino acids. RT-PCR followed by ELISA detected SUSP1 expression in all 10 human tissues examined, with highest expression in ovary and lowest expression in spleen. By 5-prime-anchored PCR using the KIAA0797 cDNA isolated by Nagase et al. (1998), Kim et al. (2000) determined the complete SUSP1 coding sequence. The deduced 1,112-amino acid SUSP1 protein is a cysteine protease containing the conserved histidine, aspartic acid, and cysteine residues of the catalytic triad and the invariant glutamine residue that helps form the oxyanion hole. The sequence similarity of SUSP1 to other known UBL-specific proteases was largely restricted to the active site domains. Recombinant SUSP1 expressed in bacteria efficiently released SUMO1 from a SUMO1-beta-galactosidase fusion protein but not from a RANGAP1-SUMO1 conjugate, suggesting a role for SUSP1 in the generation of mature SUMO1 specifically from its precursor. SUSP1 showed a tight substrate specificity for SUMO1. Recombinant SUSP1 was exclusively localized to the cytoplasm of mammalian cells. Northern blot analysis detected a 4.4-kb SUSP1 transcript in various human tissues. The highest expression of SUSP1 was in reproductive organs, namely testis, ovary, and prostate. SUSP1 was also expressed in colon and peripheral blood leukocytes. Little or no SUSP1 transcripts were detected in brain, liver, lung, kidney, pancreas, spleen, thymus, heart, and skeletal muscle. Kim et al. (2000) suggested that SUSP1 may play a role in the regulation of SUMO1-mediated cellular processes particularly related to reproduction.

Full details of the abovementioned studies are described in the following publications, the disclosure of which are hereby incorporated by reference:

Kim, K. I.; Baek, S. H.; Jeon, Y.-J.; Nishimori, S.; Suzuki, T.; Uchida, S.; Shimbara, N.; Saitoh, H.; Tanaka, K.; Chung, C. H.: A new SUMO-1-specific protease, SUSP1, that is highly expressed in reproductive organs. J. Biol. Chem. 275: 14102-14106, 2000; and Nagase, T.; Ishikawa, K.; Suyama, M.; Kikuno, R.; Miyajima, N.; Tanaka, A.; Kotani, H.; Nomura, N.; Ohara, O.: Prediction of the coding sequences of unidentified human genes. XI. The.

Further studies establishing the function and utilities of SUSP1 are found in John Hopkins OMIM database record ID 605003, and in sited publications numbered 291 and 7048 listed in the bibliography section hereinbelow, which are also hereby incorporated by reference. Transducin (beta)-like 1X-linked (TBL1X, Accession NM_005647) is another VGAM1968 host target gene. TBL1X BINDING SITE1 and TBL1X BINDING SITE2 are HOST TARGET binding sites found in untranslated regions of mRNA encoded by TBL1X, corresponding to HOST TARGET binding sites such as BINDING SITE I, BINDING SITE II or BINDING SITE III. Table 2 illustrates the complementarity of the nucleotide sequences of TBL1X BINDING SITE1 and TBL1X BINDING SITE2, designated SEQ ID:12185 and SEQ ID:12186 respectively, to the nucleotide sequence of VGAM1968 RNA, herein designated VGAM RNA, also designated SEQ ID:4679.

Another function of VGAM1968 is therefore inhibition of Transducin (beta)-like 1X-linked (TBL1X, Accession NM_005647), a gene which activates latent HDAC3 activity. Accordingly, utilities of VGAM1968 include diagnosis, prevention and treatment of diseases and clinical conditions associated with TBL1X. The function of TBL1X and its association with various diseases and clinical conditions, has been established by previous studies, as described hereinabove with reference to VGAM1151. Transmembrane, Prostate Androgen Induced RNA (TMEPAI, Accession NM_020182) is another VGAM1968 host target gene. TMEPAI BINDING SITE is HOST TARGET binding site found in the 3' untranslated region of mRNA encoded by TMEPAI, corresponding to a HOST TARGET binding site such as BINDING SITE I, BINDING SITE II or BINDING SITE III. Table 2 illustrates the complementarity of the nucleotide sequences of TMEPAI BINDING SITE, designated SEQ ID:21407, to the nucleotide sequence of VGAM1968 RNA, herein designated VGAM RNA, also designated SEQ ID:4679.

Another function of VGAM1968 is therefore inhibition of Transmembrane, Prostate Androgen Induced RNA (TMEPAI, Accession NM_020182). Accordingly, utilities of VGAM1968 include diagnosis, prevention and treatment of diseases and clinical conditions associated with TMEPAI. Transformation/transcription Domain-associated Protein (TRRAP, Accession NM_003496) is another VGAM1968 host target gene. TRRAP BINDING SITE is HOST TARGET binding site found in the 3' untranslated region of mRNA encoded by TRRAP, corresponding to a HOST TARGET binding site such as BINDING SITE I, BINDING SITE II or BINDING SITE III. Table 2 illustrates the complementarity of the nucleotide sequences of TRRAP BINDING SITE, designated SEQ ID:9589, to the nucleotide sequence of VGAM1968 RNA, herein designated VGAM RNA, also designated SEQ ID:4679.

Another function of VGAM1968 is therefore inhibition of Transformation/transcription Domain-associated Protein (TRRAP, Accession NM_003496). Accordingly, utilities of VGAM1968 include diagnosis, prevention and treatment of diseases and clinical conditions associated with TRRAP. Uncoupling Protein 3 (mitochondrial, proton carrier) (UCP3, Accession NM_003356) is another VGAM1968 host target gene. UCP3 BINDING SITE is HOST TARGET binding site found in the 3' untranslated region of mRNA encoded by UCP3, corresponding to a HOST TARGET binding site such as BINDING SITE I, BINDING SITE II or BINDING SITE III. Table 2 illustrates the complementarity of the nucleotide sequences of UCP3 BINDING SITE, designated SEQ ID:9385, to the nucleotide sequence of VGAM1968 RNA, herein designated VGAM RNA, also designated SEQ ID:4679.

Another function of VGAM1968 is therefore inhibition of Uncoupling Protein 3 (mitochondrial, proton carrier) (UCP3, Accession NM_003356), a gene which is a mitochondrial transporter protein that creates proton leaks across the inner mitochondrial membrane, thus uncoupling oxidative phosphorylation. Accordingly, utilities of VGAM1968 include diagnosis, prevention and treatment of diseases and clinical conditions associated with UCP3. The function of UCP3 and its association with various diseases and clinical conditions, has been established by previous studies, as described hereinabove with reference to VGAM1317. WAS Protein Family, Member 3 (WASF3, Accession NM_006646) is another VGAM1968 host target gene. WASF3 BINDING SITE is HOST TARGET binding site found in the 3' untranslated region of mRNA encoded by WASF3, corresponding to a HOST TARGET binding site such as BINDING SITE I, BINDING SITE II or BINDING SITE III. Table 2 illustrates the complementarity of the nucleotide sequences of WASF3 BINDING SITE, designated SEQ ID:13442, to the nucleotide sequence of VGAM1968 RNA, herein designated VGAM RNA, also designated SEQ ID:4679.

Another function of VGAM1968 is therefore inhibition of WAS Protein Family, Member 3 (WASF3, Accession NM_006646), a gene which stimulates actin polymerization. Accordingly, utilities of VGAM1968 include diagnosis, prevention and treatment of diseases and clinical conditions associated with WASF3. The function of WASF3 and its association with various diseases and clinical conditions, has been established by previous studies, as described hereinabove with reference to VGAM1692. Tyrosine 3-monooxygenase/tryptophan 5-monooxygenase Activation Protein, Epsilon Polypeptide (YWHAE, Accession NM_006761) is another VGAM1968 host target gene. YWHAE BINDING SITE is HOST TARGET binding site found in the 3' untranslated region of mRNA encoded by YWHAE, corresponding to a HOST TARGET binding site such as BINDING SITE I, BINDING SITE II or BINDING SITE III. Table 2 illustrates the complementarity of the nucleotide sequences of YWHAE BINDING SITE, designated SEQ ID:13614, to the nucleotide sequence of VGAM1968 RNA, herein designated VGAM RNA, also designated SEQ ID:4679.

Another function of VGAM1968 is therefore inhibition of Tyrosine 3-monooxygenase/tryptophan 5-monooxygenase Activation Protein, Epsilon Polypeptide (YWHAE, Accession NM_006761), a gene which binds to cdc25 and may facilitate cdc25 interaction with Raf-1 in vivo. Accordingly, utilities of VGAM1968 include diagnosis, prevention and treatment of diseases and clinical conditions associated with YWHAE. The function of YWHAE and its association with various diseases and clinical conditions, has been established by previous studies, as described hereinabove with reference to VGAM656. AD-020 (Accession NM_020141) is another VGAM1968 host target gene. AD-020 BINDING SITE1 and AD-020 BINDING SITE2 are HOST TARGET binding sites found in untranslated regions of mRNA encoded by AD-020, corresponding to HOST TARGET binding sites such as BINDING SITE I, BINDING SITE II or BINDING SITE III. Table 2 illustrates the complementarity of the nucleotide sequences of AD-020 BINDING SITE1 and AD-020 BIND- ING SITE2, designated SEQ ID:21340 and SEQ ID:29870 respectively, to the nucleotide sequence of VGAM1968 RNA, herein designated VGAM RNA, also designated SEQ ID:4679.

Another function of VGAM1968 is therefore inhibition of AD-020 (Accession NM_020141). Accordingly, utilities of VGAM1968 include diagnosis, prevention and treatment of diseases and clinical conditions associated with AD-020. Adaptor-related Protein Complex 3, Delta 1 Subunit (AP3D1, Accession NM_003938) is another VGAM1968 host target gene. AP3D1 BINDING SITE1 and AP3D1 BINDING SITE2 are HOST TARGET binding sites found in untranslated regions of mRNA encoded by AP3D1, corresponding to HOST TARGET binding sites such as BINDING SITE I, BINDING SITE II or BINDING SITE III. Table 2 illustrates the complementarity of the nucleotide sequences of AP3D1 BINDING SITE1 and AP3D1 BINDING SITE2, designated SEQ ID:10047 and SEQ ID:18509 respectively, to the nucleotide sequence of VGAM1968 RNA, herein designated VGAM RNA, also designated SEQ ID:4679.

Another function of VGAM1968 is therefore inhibition of Adaptor-related Protein Complex 3, Delta 1 Subunit (AP3D1, Accession NM_003938). Accordingly, utilities of VGAM1968 include diagnosis, prevention and treatment of diseases and clinical conditions associated with AP3D1. Chromosome 17 Open Reading Frame 31 (C17orf31, Accession NM_017575) is another VGAM1968 host target gene. C17orf31 BINDING SITE is HOST TARGET binding site found in the 3" untranslated region of mRNA encoded by C17orf31, corresponding to a HOST TARGET binding site such as BINDING SITE I, BINDING SITE II or BINDING SITE III. Table 2 illustrates the complementarity of the nucleotide sequences of C17orf31 BINDING SITE, designated SEQ ID:19006, to the nucleotide sequence of VGAM1968 RNA, herein designated VGAM RNA, also designated SEQ ID:4679.

Another function of VGAM1968 is therefore inhibition of Chromosome 17 Open Reading Frame 31 (C17orf31, Accession NM_017575). Accordingly, utilities of VGAM1968 include diagnosis, prevention and treatment of diseases and clinical conditions associated with C17orf31. Chromosome 19 Open Reading Frame 7 (C19orf7, Accession XM_028253) is another VGAM1968 host target gene. C19orf7 BINDING SITE is HOST TARGET binding site found in the 3' untranslated region of mRNA encoded by C19orf7, corresponding to a HOST TARGET binding site such as BINDING SITE I, BINDING SITE II or BINDING SITE III. Table 2 illustrates the complementarity of the nucleotide sequences of C19orf7 BINDING SITE, designated SEQ ID:30636, to the nucleotide sequence of VGAM1968 RNA, herein designated VGAM RNA, also designated SEQ ID:4679.

Another function of VGAM1968 is therefore inhibition of Chromosome 19 Open Reading Frame 7 (C19orf7, Accession XM_028253). Accordingly, utilities of VGAM1968 include diagnosis, prevention and treatment of diseases and clinical conditions associated with C19orf7. Chromosome 20 Open Reading Frame 100 (C20orf100, Accession NM_032883) is another VGAM1968 host target gene. C20orf100 BINDING SITE is HOST TARGET binding site found in the 3" untranslated region of mRNA encoded by C20orf100, corresponding to a HOST TARGET binding site such as BINDING SITE I, BINDING SITE II or BINDING SITE III. Table 2 illustrates the complementarity of the nucleotide sequences of C20orf100 BINDING SITE, designated SEQ ID:26704, to the nucleotide sequence of VGAM1968 RNA, herein designated VGAM RNA, also designated SEQ ID:4679.

Another function of VGAM1968 is therefore inhibition of Chromosome 20 Open Reading Frame 100 (C20orf100, Accession NM_032883). Accordingly, utilities of VGAM1968 include diagnosis, prevention and treatment of diseases and clinical conditions associated with C20orf100. Chromosome 21 Open Reading Frame 25 (C21orf25, Accession XM_032945) is another VGAM1968 host target gene. C21orf25 BINDING SITE is HOST TARGET binding site found in the 3' untranslated region of mRNA encoded by C21orf25, corresponding to a HOST TARGET binding site such as BINDING SITE I, BINDING SITE II or BINDING SITE III. Table 2 illustrates the complementarity of the nucleotide sequences of C21orf25 BINDING SITE, designated SEQ ID:31801, to the nucleotide sequence of VGAM1968 RNA, herein designated VGAM RNA, also designated SEQ ID:4679.

Another function of VGAM1968 is therefore inhibition of Chromosome 21 Open Reading Frame 25 (C21orf25, Accession XM_032945). Accordingly, utilities of VGAM1968 include diagnosis, prevention and treatment of diseases and clinical conditions associated with C21orf25. Chromosome 21 Open Reading Frame 59 (C21orf59, Accession NM_017835) is another VGAM1968 host target gene. C21orf59 BINDING SITE is HOST TARGET binding site found in the 5' untranslated region of mRNA encoded by C21orf59, corresponding to a HOST TARGET binding site such as BINDING SITE I, BINDING SITE II or BINDING SITE III. Table 2 illustrates the complementarity of the nucleotide sequences of C21orf59 BINDING SITE, designated SEQ ID:19501, to the nucleotide sequence of VGAM1968 RNA, herein designated VGAM RNA, also designated SEQ ID:4679.

Another function of VGAM1968 is therefore inhibition of Chromosome 21 Open Reading Frame 59 (C21orf59, Accession NM_017835). Accordingly, utilities of VGAM1968 include diagnosis, prevention and treatment of diseases and clinical conditions associated with C21orf59. Chemokine (C-C motif) Receptor 6 (CCR6, Accession NM_031409) is another VGAM1968 host target gene. CCR6 BINDING SITE1 and CCR6 BINDING SITE2 are HOST TARGET binding sites found in untranslated regions of mRNA encoded by CCR6, corresponding to HOST TARGET binding sites such as BINDING SITE I, BINDING SITE II or BINDING SITE III. Table 2 illustrates the complementarity of the nucleotide sequences of CCR6 BINDING SITE1 and CCR6 BINDING SITE2, designated SEQ ID:25370 and SEQ ID:10577 respectively, to the nucleotide sequence of VGAM1968 RNA, herein designated VGAM RNA, also designated SEQ ID:4679.

Another function of VGAM1968 is therefore inhibition of Chemokine (C-C motif) Receptor 6 (CCR6, Accession NM_031409). Accordingly, utilities of VGAM1968 include diagnosis, prevention and treatment of diseases and clinical conditions associated with CCR6. DJ37E16.5 (Accession NM_020315) is another VGAM1968 host target gene. DJ37E16.5 BINDING SITE is HOST TARGET binding site found in the 3' untranslated region of mRNA encoded by DJ37E16.5, corresponding to a HOST TARGET binding site such as BINDING SITE I, BINDING SITE II or BINDING SITE III. Table 2 illustrates the complementarity of the nucleotide sequences of DJ37E16.5 BINDING SITE, designated SEQ ID:21576, to the nucleotide sequence of VGAM1968 RNA, herein designated VGAM RNA, also designated SEQ ID:4679.

Another function of VGAM1968 is therefore inhibition of DJ37E16.5 (Accession NM_020315). Accordingly, utilities of VGAM1968 include diagnosis, prevention and treatment of diseases and clinical conditions associated with DJ37E16.5. DKFZP434E2135 (Accession NM_030804) is another VGAM1968 host target gene. DKFZP434E2135 BINDING SITE is HOST TARGET binding site found in the 3' untranslated region of mRNA encoded by DKFZP434E2135, corresponding to a HOST TARGET binding site such as BINDING SITE I, BINDING SITE II or BINDING SITE III. Table 2 illustrates the complementarity of the nucleotide sequences of DKFZP434E2135 BINDING SITE, designated SEQ ID:25115, to the nucleotide sequence of VGAM1968 RNA, herein designated VGAM RNA, also designated SEQ ID:4679.

Another function of VGAM1968 is therefore inhibition of DKFZP434E2135 (Accession NM_030804). Accordingly, utilities of VGAM1968 include diagnosis, prevention and treatment of diseases and clinical conditions associated with DKFZP434E2135. DKFZP434F091 (Accession NM_015453) is another VGAM1968 host target gene. DKFZP434F091 BINDING SITE is HOST TARGET binding site found in the 3' untranslated region of mRNA encoded by DKFZP434F091, corresponding to a HOST TARGET binding site such as BINDING SITE I, BINDING SITE II or BINDING SITE III. Table 2 illustrates the complementarity of the nucleotide sequences of DKFZP434F091 BINDING SITE, designated SEQ ID:17739, to the nucleotide sequence of VGAM1968 RNA, herein designated VGAM RNA, also designated SEQ ID:4679.

Another function of VGAM1968 is therefore inhibition of DKFZP434F091 (Accession NM_015453). Accordingly, utilities of VGAM1968 include diagnosis, prevention and treatment of diseases and clinical conditions associated with DKFZP434F091. DKFZP564B1162 (Accession NM_031305) is another VGAM1968 host target gene. DKFZP564B1162 BINDING SITE is HOST TARGET binding site found in the 5' untranslated region of mRNA encoded by DKFZP564B1162, corresponding to a HOST TARGET binding site such as BINDING SITE I, BINDING SITE II or BINDING SITE III. Table 2 illustrates the complementarity of the nucleotide sequences of DKFZP564B1162 BINDING SITE, designated SEQ ID:25337, to the nucleotide sequence of VGAM1968 RNA, herein designated VGAM RNA, also designated SEQ ID:4679.

Another function of VGAM1968 is therefore inhibition of DKFZP564B1162 (Accession NM_031305). Accordingly, utilities of VGAM1968 include diagnosis, prevention and treatment of diseases and clinical conditions associated with DKFZP564B1162. DKFZP586A0522 (Accession NM_014033) is another VGAM1968 host target gene. DKFZP586A0522 BINDING SITE is HOST TARGET binding site found in the 3' untranslated region of mRNA encoded by DKFZP586A0522, corresponding to a HOST TARGET binding site such as BINDING SITE I, BINDING SITE II or BINDING SITE III. Table 2 illustrates the complementarity of the nucleotide sequences of DKFZP586A0522 BINDING SITE, designated SEQ ID:15262, to the nucleotide sequence of VGAM1968 RNA, herein designated VGAM RNA, also designated SEQ ID:4679.

Another function of VGAM1968 is therefore inhibition of DKFZP586A0522 (Accession NM_014033). Accordingly, utilities of VGAM1968 include diagnosis, prevention and treatment of diseases and clinical conditions associated with DKFZP586A0522. F-box Only Protein 21 (FBXO21, Accession NM_033624) is another VGAM1968 host target gene. FBXO21 BINDING SITE is HOST TARGET binding site found in the 3' untranslated region of mRNA encoded by FBXO21, corresponding to a HOST TARGET binding site such as BINDING SITE I, BINDING SITE II or BINDING SITE III. Table 2 illustrates the complementarity of the nucleotide sequences of FBXO21 BINDING SITE, designated SEQ ID:27324, to the nucleotide sequence of VGAM1968 RNA, herein designated VGAM RNA, also designated SEQ ID:4679.

Another function of VGAM1968 is therefore inhibition of F-box Only Protein 21 (FBXO21, Accession NM_033624). Accordingly, utilities of VGAM1968 include diagnosis, prevention and treatment of diseases and clinical conditions associated with FBXO21. FLJ10199 (Accession XM_048840) is another VGAM1968 host target gene. FLJ10199 BINDING SITE is HOST TARGET binding site found in the 5' untranslated region of mRNA encoded by FLJ10199, corresponding to a HOST TARGET binding site such as BINDING SITE I, BINDING SITE II or BINDING SITE III. Table 2 illustrates the complementarity of the nucleotide sequences of FLJ10199 BINDING SITE, designated SEQ ID:35285, to the nucleotide sequence of VGAM1968 RNA, herein designated VGAM RNA, also designated SEQ ID:4679.

Another function of VGAM1968 is therefore inhibition of FLJ10199 (Accession XM_048840). Accordingly, utilities of VGAM1968 include diagnosis, prevention and treatment of diseases and clinical conditions associated with FLJ10199. FLJ11269 (Accession XM_052193) is another VGAM1968 host target gene. FLJ11269 BINDING SITE is HOST TARGET binding site found in the 3' untranslated region of mRNA encoded by FLJ11269, corresponding to a HOST TARGET binding site such as BINDING SITE I, BINDING SITE II or BINDING SITE III. Table 2 illustrates the complementarity of the nucleotide sequences of FLJ11269 BINDING SITE, designated SEQ ID:35954, to the nucleotide sequence of VGAM1968 RNA, herein designated VGAM RNA, also designated SEQ ID:4679.

Another function of VGAM1968 is therefore inhibition of FLJ11269 (Accession XM_052193). Accordingly, utilities of VGAM1968 include diagnosis, prevention and treatment of diseases and clinical conditions associated with FLJ11269. FLJ12783 (Accession NM_031426) is another VGAM1968 host target gene. FLJ12783 BINDING SITE is HOST TARGET binding site found in the 3' untranslated region of mRNA encoded by FLJ12783, corresponding to a HOST TARGET binding site such as BINDING SITE I, BINDING SITE II or BINDING SITE III. Table 2 illustrates the complementarity of the nucleotide sequences of FLJ12783 BINDING SITE, designated SEQ ID:25418, to the nucleotide sequence of VGAM1968 RNA, herein designated VGAM RNA, also designated SEQ ID:4679.

Another function of VGAM1968 is therefore inhibition of FLJ12783 (Accession NM_031426). Accordingly, utilities of VGAM1968 include diagnosis, prevention and treatment of diseases and clinical conditions associated with FLJ12783. FLJ13441 (Accession NM_023924) is another VGAM1968 host target gene. FLJ13441 BINDING SITE is HOST TARGET binding site found in the 3' untranslated region of mRNA encoded by FLJ13441, corresponding to a HOST TARGET binding site such as BINDING SITE I, BINDING SITE II or BINDING SITE III. Table 2 illustrates the complementarity of the nucleotide sequences of FLJ13441 BINDING SITE, designated SEQ ID:23393, to the nucleotide sequence of VGAM1968 RNA, herein designated VGAM RNA, also designated SEQ ID:4679.

Another function of VGAM1968 is therefore inhibition of FLJ13441 (Accession NM_023924). Accordingly, utilities of VGAM1968 include diagnosis, prevention and treatment of diseases and clinical conditions associated with FLJ13441. FLJ13646 (Accession NM_024584) is another VGAM1968 host target gene. FLJ13646 BINDING SITE is HOST TARGET binding site found in the 3' untranslated region of mRNA encoded by FLJ13646, corresponding to a HOST TARGET binding site such as BINDING SITE I, BINDING SITE II or BINDING SITE III. Table 2 illustrates the complementarity of the nucleotide sequences of FLJ13646 BINDING SITE, designated SEQ ID:23813, to the nucleotide sequence of VGAM1968 RNA, herein designated VGAM RNA, also designated SEQ ID:4679.

Another function of VGAM1968 is therefore inhibition of FLJ13646 (Accession NM_024584). Accordingly, utilities of VGAM1968 include diagnosis, prevention and treatment of diseases and clinical conditions associated with FLJ13646. FLJ14803 (Accession NM_032842) is another VGAM1968 host target gene. FLJ14803 BINDING SITE is HOST TARGET binding site found in the 3' untranslated region of mRNA encoded by FLJ14803, corresponding to a HOST TARGET binding site such as BINDING SITE I, BINDING SITE II or BINDING SITE III. Table 2 illustrates the complementarity of the nucleotide sequences of FLJ14803 BINDING SITE, designated SEQ ID:26627, to the nucleotide sequence of VGAM1968 RNA, herein designated VGAM RNA, also designated SEQ ID:4679.

Another function of VGAM1968 is therefore inhibition of FLJ14803 (Accession NM_032842). Accordingly, utilities of VGAM1968 include diagnosis, prevention and treatment of diseases and clinical conditions associated with FLJ14803. FLJ20445 (Accession NM_017824) is another VGAM1968 host target gene. FLJ20445 BINDING SITE is HOST TARGET binding site found in the 3' untranslated region of mRNA encoded by FLJ20445, corresponding to a HOST TARGET binding site such as BINDING SITE I, BINDING SITE II or BINDING SITE III. Table 2 illustrates the complementarity of the nucleotide sequences of FLJ20445 BINDING SITE, designated SEQ ID:19481, to the nucleotide sequence of VGAM1968 RNA, herein designated VGAM RNA, also designated SEQ ID:4679.

Another function of VGAM1968 is therefore inhibition of FLJ20445 (Accession NM_017824). Accordingly, utilities of VGAM1968 include diagnosis, prevention and treatment of diseases and clinical conditions associated with FLJ20445. FLJ20548 (Accession NM_017873) is another VGAM1968 host target gene. FLJ20548 BINDING SITE is HOST TARGET binding site found in the 3' untranslated region of mRNA encoded by FLJ20548, corresponding to a HOST TARGET binding site such as BINDING SITE I, BINDING SITE II or BINDING SITE III. Table 2 illustrates the complementarity of the nucleotide sequences of FLJ20548 BINDING SITE, designated SEQ ID:19545, to the nucleotide sequence of VGAM1968 RNA, herein designated VGAM RNA, also designated SEQ ID:4679.

Another function of VGAM1968 is therefore inhibition of FLJ20548 (Accession NM_017873). Accordingly, utilities of VGAM1968 include diagnosis, prevention and treatment of diseases and clinical conditions associated with FLJ20548. FLJ22479 (Accession NM_024900) is another VGAM1968 host target gene. FLJ22479 BINDING SITE is HOST TARGET binding site found in the 3' untranslated region of mRNA encoded by FLJ22479, corresponding to a HOST TARGET binding site such as BINDING SITE I, BINDING SITE II or BINDING SITE III. Table 2 illustrates the complementarity of the nucleotide sequences of FLJ22479 BINDING SITE, designated SEQ ID:24386, to the nucleotide sequence of VGAM1968 RNA, herein designated VGAM RNA, also designated SEQ ID:4679.

Another function of VGAM1968 is therefore inhibition of FLJ22479 (Accession NM_024900). Accordingly, utilities of VGAM1968 include diagnosis, prevention and treatment of diseases and clinical conditions associated with FLJ22479. FLJ22679 (Accession NM_032227) is another VGAM1968 host target gene. FLJ22679 BINDING SITE1 and FLJ22679 BINDING SITE2 are HOST TARGET binding sites found in untranslated regions of mRNA encoded by FLJ22679, corresponding to HOST TARGET binding sites such as BINDING SITE I, BINDING SITE II or BINDING SITE III. Table 2 illustrates the complementarity of the nucleotide sequences of FLJ22679 BINDING SITE1 and FLJ22679 BINDING SITE2, designated SEQ ID:25950 and SEQ ID:19263 respectively, to the nucleotide sequence of VGAM1968 RNA, herein designated VGAM RNA, also designated SEQ ID:4679.

Another function of VGAM1968 is therefore inhibition of FLJ22679 (Accession NM_032227). Accordingly, utilities of VGAM1968 include diagnosis, prevention and treatment of diseases and clinical conditions associated with FLJ22679. GS3955 (Accession NM_021643) is another VGAM1968 host target gene. GS3955 BINDING SITE is HOST TARGET binding site found in the 3' untranslated region of mRNA encoded by GS3955, corresponding to a HOST TARGET binding site such as BINDING SITE I, BINDING SITE II or BINDING SITE III. Table 2 illustrates the complementarity of the nucleotide sequences of GS3955 BINDING SITE, designated SEQ ID:22301, to the nucleotide sequence of VGAM1968 RNA, herein designated VGAM RNA, also designated SEQ ID:4679.

Another function of VGAM1968 is therefore inhibition of GS3955 (Accession NM_021643). Accordingly, utilities of VGAM1968 include diagnosis, prevention and treatment of diseases and clinical conditions associated with GS3955. HCA4 (Accession XM_085287) is another VGAM1968 host target gene. HCA4 BINDING SITE is HOST TARGET binding site found in the 3' untranslated region of mRNA encoded by HCA4, corresponding to a HOST TARGET binding site such as BINDING SITE I, BINDING SITE II or BINDING SITE III. Table 2 illustrates the complementarity of the nucleotide sequences of HCA4 BINDING SITE, designated SEQ ID:38024, to the nucleotide sequence of VGAM1968 RNA, herein designated VGAM RNA, also designated SEQ ID:4679.

Another function of VGAM1968 is therefore inhibition of HCA4 (Accession XM_085287). Accordingly, utilities of VGAM1968 include diagnosis, prevention and treatment of diseases and clinical conditions associated with HCA4. HDAC9-PENDING (Accession NM_058176) is another VGAM1968 host target gene. HDAC9-PENDING BINDING SITE1 through HDAC9-PENDING BINDING SITE3 are HOST TARGET binding sites found in untranslated regions of mRNA encoded by HDAC9-PENDING, corresponding to HOST TARGET binding sites such as BINDING SITE I, BINDING SITE II or BINDING SITE III. Table 2 illustrates the complementarity of the nucleotide sequences of HDAC9-PENDING BINDING SITE1 through HDAC9-PENDING BINDING SITE3, designated SEQ ID:27728, SEQ ID:27729 and SEQ ID:16251 respectively, to the nucleotide sequence of VGAM1968 RNA, herein designated VGAM RNA, also designated SEQ ID:4679.

Another function of VGAM1968 is therefore inhibition of HDAC9-PENDING (Accession NM_058176). Accordingly, utilities of VGAM1968 include diagnosis, prevention and treatment of diseases and clinical conditions associated with HDAC9-PENDING. Potassium Channel, Subfamily T, Member 1 (KCNT1, Accession XM_029962) is another VGAM1968 host target gene. KCNT1 BINDING SITE is HOST TARGET binding site found in the 3' untranslated region of mRNA encoded by KCNT1, corresponding to a HOST TARGET binding site such as BINDING SITE I, BINDING SITE II or BINDING SITE III. Table 2 illustrates the complementarity of the nucleotide sequences of KCNT1 BINDING SITE, designated SEQ ID:30976, to the nucleotide sequence of VGAM1968 RNA, herein designated VGAM RNA, also designated SEQ ID:4679.

Another function of VGAM1968 is therefore inhibition of Potassium Channel, Subfamily T, Member 1 (KCNT1, Accession XM_029962). Accordingly, utilities of VGAM1968 include diagnosis, prevention and treatment of diseases and clinical conditions associated with KCNT1. KIAA0057 (Accession NM_012288) is another VGAM1968 host target gene. KIAA0057 BINDING SITE is HOST TARGET binding site found in the 3' untranslated region of mRNA encoded by KIAA0057, corresponding to a HOST TARGET binding site such as BINDING SITE I, BINDING SITE II or BINDING SITE III. Table 2 illustrates the complementarity of the nucleotide sequences of KIAA0057 BINDING SITE, designated SEQ ID:14622, to the nucleotide sequence of VGAM1968 RNA, herein designated VGAM RNA, also designated SEQ ID:4679.

Another function of VGAM1968 is therefore inhibition of KIAA0057 (Accession NM_012288). Accordingly, utilities of VGAM1968 include diagnosis, prevention and treatment of diseases and clinical conditions associated with KIAA0057. KIAA0335 (Accession NM_014803) is another VGAM1968 host target gene. KIAA0335 BINDING SITE is HOST TARGET binding site found in the 3' untranslated region of mRNA encoded by KIAA0335, corresponding to a HOST TARGET binding site such as BINDING SITE I, BINDING SITE II or BINDING SITE III. Table 2 illustrates the complementarity of the nucleotide sequences of KIAA0335 BINDING SITE, designated SEQ ID:16732, to the nucleotide sequence of VGAM1968 RNA, herein designated VGAM RNA, also designated SEQ ID:4679.

Another function of VGAM1968 is therefore inhibition of KIAA0335 (Accession NM_014803). Accordingly, utilities of VGAM1968 include diagnosis, prevention and treatment of diseases and clinical conditions associated with KIAA0335. KIAA0446 (Accession XM_044155) is another VGAM1968 host target gene. KIAA0446 BINDING SITE is HOST TARGET binding site found in the 3' untranslated region of mRNA encoded by KIAA0446, corresponding to a HOST TARGET binding site such as BINDING SITE I, BINDING SITE II or BINDING SITE III. Table 2 illustrates the complementarity of the nucleotide sequences of KIAA0446 BINDING SITE, designated SEQ ID:34150, to the nucleotide sequence of VGAM1968 RNA, herein designated VGAM RNA, also designated SEQ ID:4679.

Another function of VGAM1968 is therefore inhibition of KIAA0446 (Accession XM_044155). Accordingly, utilities of VGAM1968 include diagnosis, prevention and treatment of diseases and clinical conditions associated with KIAA0446. KIAA0534 (Accession XM_049349) is another VGAM1968 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35385, to the nucleotide sequence of VGAM1968 RNA, herein designated VGAM RNA, also designated SEQ ID:4679.

Another function of VGAM1968 is therefore inhibition of KIAA0534 (Accession XM_049349). Accordingly, utilities of VGAM1968 include diagnosis, prevention and treatment of diseases and clinical conditions associated with KIAA0534. KIAA0843 (Accession NM_014945) is another VGAM1968 host target gene. KIAA0843 BINDING SITE is HOST TARGET binding site found in the 3' untranslated region of mRNA encoded by KIAA0843, corresponding to a HOST TARGET binding site such as BINDING SITE I, BINDING SITE II or BINDING SITE III. Table 2 illustrates the complementarity of the nucleotide sequences of KIAA0843 BINDING SITE, designated SEQ ID:17260, to the nucleotide sequence of VGAM1968 RNA, herein designated VGAM RNA, also designated SEQ ID:4679.

Another function of VGAM1968 is therefore inhibition of KIAA0843 (Accession NM_014945). Accordingly, utilities of VGAM1968 include diagnosis, prevention and treatment of diseases and clinical conditions associated with KIAA0843. KIAA0892 (Accession XM_048457) is another VGAM1968 host target gene. KIAA0892 BINDING SITE is HOST TARGET binding site found in the 3' untranslated region of mRNA encoded by KIAA0892, corresponding to a HOST TARGET binding site such as BINDING SITE I, BINDING SITE II or BINDING SITE III. Table 2 illustrates the complementarity of the nucleotide sequences of KIAA0892 BINDING SITE, designated SEQ ID:35172, to the nucleotide sequence of VGAM1968 RNA, herein designated VGAM RNA, also designated SEQ ID:4679.

Another function of VGAM1968 is therefore inhibition of KIAA0892 (Accession XM_048457). Accordingly, utilities of VGAM1968 include diagnosis, prevention and treatment of diseases and clinical conditions associated with KIAA0892. KIAA0894 (Accession NM_014896) is another VGAM1968 host target gene. KIAA0894 BINDING SITE is HOST TARGET binding site found in the 3' untranslated region of mRNA encoded by KIAA0894, corresponding to a HOST TARGET binding site such as BINDING SITE I, BINDING SITE II or BINDING SITE III. Table 2 illustrates the complementarity of the nucleotide sequences of KIAA0894 BINDING SITE, designated SEQ ID:17056, to the nucleotide sequence of VGAM1968 RNA, herein designated VGAM RNA, also designated SEQ ID:4679.

Another function of VGAM1968 is therefore inhibition of KIAA0894 (Accession NM_014896). Accordingly, utilities of VGAM1968 include diagnosis, prevention and treatment of diseases and clinical conditions associated with KIAA0894. KIAA0981 (Accession XM_028867) is another VGAM1968 host target gene. KIAA0981 BINDING SITE is HOST TARGET binding site found in the 3' untranslated region of mRNA encoded by KIAA0981, corresponding to a HOST TARGET binding site such as BINDING SITE I, BINDING SITE II or BINDING SITE III. Table 2 illustrates the complementarity of the nucleotide sequences of KIAA0981 BINDING SITE, designated SEQ ID:30799, to the nucleotide sequence of VGAM1968 RNA, herein designated VGAM RNA, also designated SEQ ID:4679.

Another function of VGAM1968 is therefore inhibition of KIAA0981 (Accession XM_028867). Accordingly, utilities of VGAM1968 include diagnosis, prevention and treatment of diseases and clinical conditions associated with KIAA0981. KIAA1157 (Accession XM_051093) is another VGAM1968 host target gene. KIAA1157 BINDING SITE is HOST TARGET binding site found in the 3' untranslated region of mRNA encoded by KIAA1157, corresponding to a HOST TARGET binding site such as BINDING SITE I, BINDING SITE II or BINDING SITE III. Table 2 illustrates the complementarity of the nucleotide sequences of KIAA1157 BINDING SITE, designated SEQ ID:35751, to the nucleotide sequence of VGAM1968 RNA, herein designated VGAM RNA, also designated SEQ ID:4679.

Another function of VGAM1968 is therefore inhibition of KIAA1157 (Accession XM_051093). Accordingly, utilities of VGAM1968 include diagnosis, prevention and treatment of diseases and clinical conditions associated with KIAA1157. KIAA1274 (Accession XM_166125) is another VGAM1968 host target gene. KIAA1274 BINDING SITE is HOST TARGET binding site found in the 3' untranslated region of mRNA encoded by KIAA1274, corresponding to a HOST TARGET binding site such as BINDING SITE I, BINDING SITE II or BINDING SITE III. Table 2 illustrates the complementarity of the nucleotide sequences of KIAA1274 BINDING SITE, designated SEQ ID:43911, to the nucleotide sequence of VGAM1968 RNA, herein designated VGAM RNA, also designated SEQ ID:4679.

Another function of VGAM1968 is therefore inhibition of KIAA1274 (Accession XM_166125). Accordingly, utilities of VGAM1968 include diagnosis, prevention and treatment of diseases and clinical conditions associated with KIAA1274. KIAA1529 (Accession XM_047336) is another VGAM1968 host target gene. KIAA1529 BINDING SITE is HOST TARGET binding site found in the 5' untranslated region of mRNA encoded by KIAA1529, corresponding to a HOST TARGET binding site such as BINDING SITE I, BINDING SITE II or BINDING SITE III. Table 2 illustrates the complementarity of the nucleotide sequences of KIAA1529 BINDING SITE, designated SEQ ID:34947, to the nucleotide sequence of VGAM1968 RNA, herein designated VGAM RNA, also designated SEQ ID:4679.

Another function of VGAM1968 is therefore inhibition of KIAA1529 (Accession XM_047336). Accordingly, utilities of VGAM1968 include diagnosis, prevention and treatment of diseases and clinical conditions associated with KIAA1529. KIAA1538 (Accession XM_049474) is another VGAM1968 host target gene. KIAA1538 BINDING SITE is HOST TARGET binding site found in the 5' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35437, to the nucleotide sequence of VGAM1968 RNA, herein designated VGAM RNA, also designated SEQ ID:4679.

Another function of VGAM1968 is therefore inhibition of KIAA1538 (Accession XM_049474). Accordingly, utilities of VGAM1968 include diagnosis, prevention and treatment of diseases and clinical conditions associated with KIAA1538. KIAA1576 (Accession XM_038186) is another VGAM1968 host target gene. KIAA1576 BINDING SITE is HOST TARGET binding site found in the 3' untranslated region of mRNA encoded by KIAA1576, corresponding to a HOST TARGET binding site such as BINDING SITE I, BINDING SITE II or BINDING SITE III. Table 2 illustrates the complementarity of the nucleotide sequences of KIAA1576 BINDING SITE, designated SEQ ID:32775, to the nucleotide sequence of VGAM1968 RNA, herein designated VGAM RNA, also designated SEQ ID:4679.

Another function of VGAM1968 is therefore inhibition of KIAA1576 (Accession XM_038186). Accordingly, utilities of VGAM1968 include diagnosis, prevention and treatment of diseases and clinical conditions associated with KIAA1576. KIAA1821 (Accession XM_050101) is another VGAM1968 host target gene. KIAA1821 BINDING SITE is HOST TARGET binding site found in the 3' untranslated region of mRNA encoded by KIAA1821, corresponding to a HOST TARGET binding site such as BINDING SITE I, BINDING SITE II or BINDING SITE III. Table 2 illustrates the complementarity of the nucleotide sequences of KIAA1821 BINDING SITE, designated SEQ ID:35551, to the nucleotide sequence of VGAM1968 RNA, herein designated VGAM RNA, also designated SEQ ID:4679.

Another function of VGAM1968 is therefore inhibition of KIAA1821 (Accession XM_050101). Accordingly, utilities of VGAM1968 include diagnosis, prevention and treatment of diseases and clinical conditions associated with KIAA1821. KIAA1894 (Accession XM_058025) is another VGAM1968 host target gene. KIAA1894 BINDING SITE is HOST TARGET binding site found in the 3' untranslated region of mRNA encoded by KIAA1894, corresponding to a HOST TARGET binding site such as BINDING SITE I, BINDING SITE II or BINDING SITE III. Table 2 illustrates the complementarity of the nucleotide sequences of KIAA1894 BINDING SITE, designated SEQ ID:36561, to the nucleotide sequence of VGAM1968 RNA, herein designated VGAM RNA, also designated SEQ ID:4679.

Another function of VGAM1968 is therefore inhibition of KIAA1894 (Accession XM_058025). Accordingly, utilities of VGAM1968 include diagnosis, prevention and treatment of diseases and clinical conditions associated with KIAA1894. V-maf Musculoaponeurotic Fibrosarcoma Oncogene Homolog B (avian) (MAFB, Accession NM_005461) is another VGAM1968 host target gene. MAFB BINDING SITE is HOST TARGET binding site found in the 3' untranslated region of mRNA encoded by MAFB, corresponding to a HOST TARGET binding site such as BINDING SITE I, BINDING SITE II or BINDING SITE III. Table 2 illustrates the complementarity of the nucleotide sequences of MAFB BINDING SITE, designated SEQ ID:11943, to the nucleotide sequence of VGAM1968 RNA, herein designated VGAM RNA, also designated SEQ ID:4679.

Another function of VGAM1968 is therefore inhibition of V-maf Musculoaponeurotic Fibrosarcoma Oncogene Homolog B (avian) (MAFB, Accession NM_005461). Accordingly, utilities of VGAM1968 include diagnosis, prevention and treatment of diseases and clinical conditions associated with MAFB. Mitogen-activated Protein Kinase Kinase 6 (MAP2K6, Accession NM_002758) is another VGAM1968 host target gene. MAP2K6 BINDING SITE is HOST TARGET binding site found in the 5' untranslated region of mRNA encoded by MAP2K6, corresponding to a HOST TARGET binding site such as BINDING SITE I, BINDING SITE II or BINDING SITE III. Table 2 illustrates the complementarity of the nucleotide sequences of MAP2K6 BINDING SITE, designated SEQ ID:8641, to the nucleotide sequence of VGAM1968 RNA, herein designated VGAM RNA, also designated SEQ ID:4679.

Another function of VGAM1968 is therefore inhibition of Mitogen-activated Protein Kinase Kinase 6 (MAP2K6, Accession NM_002758). Accordingly, utilities of VGAM1968 include diagnosis, prevention and treatment of diseases and clinical conditions associated with MAP2K6. MGC2628 (Accession NM_024076) is another VGAM1968 host target gene. MGC2628 BINDING SITE is HOST TARGET binding site found in the 3" untranslated region of mRNA encoded by MGC2628, corresponding to a HOST TARGET binding site such as BINDING SITE I, BINDING SITE II or BINDING SITE III. Table 2 illustrates the complementarity of the nucleotide sequences of MGC2628 BINDING SITE, designated SEQ ID:23511, to the nucleotide sequence of VGAM1968 RNA, herein designated VGAM RNA, also designated SEQ ID:4679.

Another function of VGAM1968 is therefore inhibition of MGC2628 (Accession NM_024076). Accordingly, utilities of VGAM1968 include diagnosis, prevention and treatment of diseases and clinical conditions associated with MGC2628. MGC30052 (Accession NM_144721) is another VGAM1968 host target gene. MGC30052 BINDING SITE is HOST TARGET binding site found in the 3' untranslated region of mRNA encoded by MGC30052, corresponding to a HOST TARGET binding site such as BINDING SITE I, BINDING SITE II or BINDING SITE III. Table 2 illustrates the complementarity of the nucleotide sequences of MGC30052 BINDING SITE, designated SEQ ID:29544, to the nucleotide sequence of VGAM1968 RNA, herein designated VGAM RNA, also designated SEQ ID:4679.

Another function of VGAM1968 is therefore inhibition of MGC30052 (Accession NM_144721). Accordingly, utilities of VGAM1968 include diagnosis, prevention and treatment of diseases and clinical conditions associated with MGC30052. MGC4294 (Accession NM_024314) is another VGAM1968 host target gene. MGC4294 BINDING SITE is HOST TARGET binding site found in the 5' untranslated region of mRNA encoded by MGC4294, corresponding to a HOST TARGET binding site such as BINDING SITE I, BINDING SITE II or BINDING SITE III. Table 2 illustrates the complementarity of the nucleotide sequences of MGC4294 BINDING SITE, designated SEQ ID:23608, to the nucleotide sequence of VGAM1968 RNA, herein designated VGAM RNA, also designated SEQ ID:4679.

Another function of VGAM1968 is therefore inhibition of MGC4294 (Accession NM_024314). Accordingly, utilities of VGAM1968 include diagnosis, prevention and treatment of diseases and clinical conditions associated with MGC4294. Oxysterol Binding Protein-like 5 (OSBPL5, Accession XM_052567) is another VGAM1968 host target gene. OSBPL5 BINDING SITE is HOST TARGET binding site found in the 3' untranslated region of mRNA encoded by OSBPL5, corresponding to a HOST TARGET binding site such as BINDING SITE I, BINDING SITE II or BINDING SITE III. Table 2 illustrates the complementarity of the nucleotide sequences of OSBPL5 BINDING SITE, designated SEQ ID:35991, to the nucleotide sequence of VGAM1968 RNA, herein designated VGAM RNA, also designated SEQ ID:4679.

Another function of VGAM1968 is therefore inhibition of Oxysterol Binding Protein-like 5 (OSBPL5, Accession XM_052567). Accordingly, utilities of VGAM1968 include diagnosis, prevention and treatment of diseases and clinical conditions associated with OSBPL5. pcnp (Accession NM_020357) is another VGAM1968 host target gene. pcnp BINDING SITE is HOST TARGET binding site found in the 3' untranslated region of mRNA encoded by pcnp, corresponding to a HOST TARGET binding site such as BINDING SITE I, BINDING SITE II or BINDING SITE III. Table 2 illustrates the complementarity of the nucleotide sequences of pcnp BINDING SITE, designated SEQ ID:21628, to the nucleotide sequence of VGAM1968 RNA, herein designated VGAM RNA, also designated SEQ ID:4679.

Another function of VGAM1968 is therefore inhibition of pcnp (Accession NM_020357). Accordingly, utilities of VGAM1968 include diagnosis, prevention and treatment of diseases and clinical conditions associated with pcnp. PDZ Domain Containing 2 (PDZD2, Accession XM_087705) is another VGAM1968 host target gene. PDZD2 BINDING SITE is HOST TARGET binding site found in the 5' untranslated region of mRNA encoded by PDZD2, corresponding to a HOST TARGET binding site such as BINDING SITE I, BINDING SITE II or BINDING SITE III. Table 2 illustrates the complementarity of the nucleotide sequences of PDZD2 BINDING SITE, designated SEQ ID:39391, to the nucleotide sequence of VGAM1968 RNA, herein designated VGAM RNA, also designated SEQ ID:4679.

Another function of VGAM1968 is therefore inhibition of PDZ Domain Containing 2 (PDZD2, Accession XM_087705). Accordingly, utilities of VGAM1968 include diagnosis, prevention and treatment of diseases and clinical conditions associated with PDZD2. Paraneoplastic Antigen MA3 (PNMA3, Accession NM_013364) is another VGAM1968 host target gene. PNMA3 BINDING SITE is HOST TARGET binding site found in the 3' untranslated region of mRNA encoded by PNMA3, corresponding to a HOST TARGET binding site such as BINDING SITE I, BINDING SITE II or BINDING SITE III. Table 2 illustrates the complementarity of the nucleotide sequences of PNMA3 BINDING SITE, designated SEQ ID:15010, to the nucleotide sequence of VGAM1968 RNA, herein designated VGAM RNA, also designated SEQ ID:4679.

Another function of VGAM1968 is therefore inhibition of Paraneoplastic Antigen MA3 (PNMA3, Accession NM_013364). Accordingly, utilities of VGAM1968 include diagnosis, prevention and treatment of diseases and clinical conditions associated with PNMA3. Polymerase I and Transcript Release Factor (PTRF, Accession XM_032852) is another VGAM1968 host target gene. PTRF BINDING SITE is HOST TARGET binding site found in the 5' untranslated region of mRNA encoded by PTRF, corresponding to a HOST TARGET binding site such as BINDING SITE I, BINDING SITE II or BINDING SITE III. Table 2 illustrates the complementarity of the nucleotide sequences of PTRF BINDING SITE, designated SEQ ID:31784, to the nucleotide sequence of VGAM1968 RNA, herein designated VGAM RNA, also designated SEQ ID:4679.

Another function of VGAM1968 is therefore inhibition of Polymerase I and Transcript Release Factor (PTRF, Accession XM_032852). Accordingly, utilities of VGAM1968 include diagnosis, prevention and treatment of diseases and clinical conditions associated with PTRF. RAB14, Member RAS Oncogene Family (RAB14, Accession NM_016322) is another VGAM1968 host target gene. RAB14 BINDING SITE is HOST TARGET binding site found in the 3' untranslated region of mRNA encoded by RAB14, corresponding to a HOST TARGET binding site such as BINDING SITE I, BINDING SITE II or BINDING SITE III. Table 2 illustrates the complementarity of the nucleotide sequences of RAB14 BINDING SITE, designated SEQ ID:18448, to the nucleotide sequence of VGAM1968 RNA, herein designated VGAM RNA, also designated SEQ ID:4679.

Another function of VGAM1968 is therefore inhibition of RAB14, Member RAS Oncogene Family (RAB14, Accession NM_016322). Accordingly, utilities of VGAM1968 include diagnosis, prevention and treatment of diseases and clinical conditions associated with RAB14. RAS Guanyl Releasing Protein 4 (RASGRP4, Accession NM_052949) is another VGAM1968 host target gene. RASGRP4 BINDING SITE is HOST TARGET binding site found in the 3' untranslated region of mRNA encoded by RASGRP4, corresponding to a HOST TARGET binding site such as BINDING SITE I, BINDING SITE II or BINDING SITE III. Table 2 illustrates the complementarity of the nucleotide sequences of RASGRP4 BINDING SITE, designated SEQ ID:27504, to the nucleotide sequence of VGAM1968 RNA, herein designated VGAM RNA, also designated SEQ ID:4679.

Another function of VGAM1968 is therefore inhibition of RAS Guanyl Releasing Protein 4 (RASGRP4, Accession NM_052949). Accordingly, utilities of VGAM1968 include diagnosis, prevention and treatment of diseases and clinical conditions associated with RASGRP4. Retinoblastoma Binding Protein 1 (RBBP1, Accession NM_023001) is another VGAM1968 host target gene. RBBP1 BINDING SITE1 and RBBP1 BINDING SITE2 are HOST TARGET binding sites found in untranslated regions of mRNA encoded by RBBP1, corresponding to HOST TARGET binding sites such as BINDING SITE I, BINDING SITE II or BINDING SITE III. Table 2 illustrates the complementarity of the nucleotide sequences of RBBP1 BINDING SITE1 and RBBP1 BINDING SITE2, designated SEQ ID:23261 and SEQ ID:8800 respectively, to the nucleotide sequence of VGAM1968 RNA, herein designated VGAM RNA, also designated SEQ ID:4679.

Another function of VGAM1968 is therefore inhibition of Retinoblastoma Binding Protein 1 (RBBP1, Accession NM_023001). Accordingly, utilities of VGAM1968 include diagnosis, prevention and treatment of diseases and clinical conditions associated with RBBP1. RNAH (Accession XM_030392) is another VGAM1968 host target gene. RNAH BINDING SITE is HOST TARGET binding site found in the 3' untranslated region of mRNA encoded by RNAH, corresponding to a HOST TARGET binding site such as BINDING SITE I, BINDING SITE II or BINDING SITE III. Table 2 illustrates the complementarity of the nucleotide sequences of RNAH BINDING SITE, designated SEQ ID:31039, to the nucleotide sequence of VGAM1968 RNA, herein designated VGAM RNA, also designated SEQ ID:4679.

Another function of VGAM1968 is therefore inhibition of RNAH (Accession XM_030392). Accordingly, utilities of VGAM1968 include diagnosis, prevention and treatment of diseases and clinical conditions associated with RNAH. Ring Finger Protein 11 (RNF11, Accession NM_014372) is another VGAM1968 host target gene. RNF11 BINDING SITE1 and RNF11 BINDING SITE2 are HOST TARGET binding sites found in untranslated regions of mRNA encoded by RNF11, corresponding to HOST TARGET binding sites such as BINDING SITE I, BINDING SITE II or BINDING SITE III. Table 2 illustrates the complementarity of the nucleotide sequences of RNF11 BINDING SITE1 and RNF11 BINDING SITE2, designated SEQ ID:15705 and SEQ ID:15706 respectively, to the nucleotide sequence of VGAM1968 RNA, herein designated VGAM RNA, also designated SEQ ID:4679.

Another function of VGAM1968 is therefore inhibition of Ring Finger Protein 11 (RNF11, Accession NM_014372). Accordingly, utilities of VGAM1968 include diagnosis, prevention and treatment of diseases and clinical conditions associated with RNF11. SAST (Accession XM_032034) is another VGAM1968 host target gene. SAST BINDING SITE is HOST TARGET binding site found in the 5' untranslated region of mRNA encoded by SAST, corresponding to a HOST TARGET binding site such as BINDING SITE I, BINDING SITE II or BINDING SITE III. Table 2 illustrates the complementarity of the nucleotide sequences of SAST BINDING SITE, designated SEQ ID:31542, to the nucleotide sequence of VGAM1968 RNA, herein designated VGAM RNA, also designated SEQ ID:4679.

Another function of VGAM1968 is therefore inhibition of SAST (Accession XM_032034). Accordingly, utilities of VGAM1968 include diagnosis, prevention and treatment of diseases and clinical conditions associated with SAST. Sema Domain, Transmembrane Domain (TM), and Cytoplasmic Domain, (semaphorin) 6B (SEMA6B, Accession NM_032108) is another VGAM1968 host target gene. SEMA6B BINDING SITE is HOST TARGET binding site found in the 3' untranslated region of mRNA encoded by SEMA6B, corresponding to a HOST TARGET binding site such as BINDING SITE I, BINDING SITE II or BINDING SITE III. Table 2 illustrates the complementarity of the nucleotide sequences of SEMA6B BINDING SITE, designated SEQ ID:25801, to the nucleotide sequence of VGAM1968 RNA, herein designated VGAM RNA, also designated SEQ ID:4679.

Another function of VGAM1968 is therefore inhibition of Sema Domain, Transmembrane Domain (TM), and Cytoplasmic Domain, (semaphorin) 6B (SEMA6B, Accession NM_032108). Accordingly, utilities of VGAM1968 include diagnosis, prevention and treatment of diseases and clinical conditions associated with SEMA6B. Solute Carrier Family 6 (neurotransmitter transporter), Member 14 (SLC6A14, Accession NM_007231) is another VGAM1968 host target gene. SLC6A14 BINDING SITE is HOST TARGET binding site found in the 3' untranslated region of mRNA encoded by SLC6A14, corresponding to a HOST TARGET binding site such as BINDING SITE I, BINDING SITE II or BINDING SITE III. Table 2 illustrates the complementarity of the nucleotide sequences of SLC6A14 BINDING SITE, designated SEQ ID:14103, to the nucleotide sequence of VGAM1968 RNA, herein designated VGAM RNA, also designated SEQ ID:4679.

Another function of VGAM1968 is therefore inhibition of Solute Carrier Family 6 (neurotransmitter transporter), Member 14 (SLC6A14, Accession NM_007231). Accordingly, utilities of VGAM1968 include diagnosis, prevention and treatment of diseases and clinical conditions associated with SLC6A14. STAT12 (Accession XM_170547) is another VGAM1968 host target gene. STAT12 BINDING SITE1 and STAT12 BINDING SITE2 are HOST TARGET binding sites found in untranslated regions of mRNA encoded by STAT12, corresponding to HOST TARGET binding sites such as BINDING SITE I, BINDING SITE II or BINDING SITE III. Table 2 illustrates the complementarity of the nucleotide sequences of STAT12 BINDING SITE1 and STAT12 BINDING SITE2, designated SEQ ID:45371 and SEQ ID:9960 respectively, to the nucleotide sequence of VGAM1968 RNA, herein designated VGAM RNA, also designated SEQ ID:4679.

Another function of VGAM1968 is therefore inhibition of STAT12 (Accession XM_170547). Accordingly, utilities of VGAM1968 include diagnosis, prevention and treatment of diseases and clinical conditions associated with STAT12. TA-PP2C (Accession NM_139283) is another VGAM1968 host target gene. TA-PP2C BINDING SITE is HOST TARGET binding site found in the 3' untranslated region of mRNA encoded by TA-PP2C, corresponding to a HOST TARGET binding site such as BINDING SITE I, BINDING SITE II or BINDING SITE III. Table 2 illustrates the complementarity of the nucleotide sequences of TA-PP2C BINDING SITE, designated SEQ ID:29283, to the nucleotide sequence of VGAM1968 RNA, herein designated VGAM RNA, also designated SEQ ID:4679.

Another function of VGAM1968 is therefore inhibition of TA-PP2C (Accession NM_139283). Accordingly, utilities of VGAM1968 include diagnosis, prevention and treatment of diseases and clinical conditions associated with TA-PP2C. TBLR1 (Accession NM_024665) is another VGAM1968 host target gene. TBLR1 BINDING SITE is HOST TARGET binding site found in the 3' untranslated region of mRNA encoded by TBLR1, corresponding to a HOST TARGET binding site such as BINDING SITE I, BINDING SITE II or BINDING SITE III. Table 2 illustrates the complementarity of the nucleotide sequences of TBLR1 BINDING SITE, designated SEQ ID:23966, to the nucleotide sequence of VGAM1968 RNA, herein designated VGAM RNA, also designated SEQ ID:4679.

Another function of VGAM1968 is therefore inhibition of TBLR1 (Accession NM_024665). Accordingly, utilities of VGAM1968 include diagnosis, prevention and treatment of diseases and clinical conditions associated with TBLR1. TIP-1 (Accession NM_014604) is another VGAM1968 host target gene. TIP-1 BINDING SITE is HOST TARGET binding site found in the 5' untranslated region of mRNA encoded by TIP-1, corresponding to a HOST TARGET binding site such as BINDING SITE I, BINDING SITE II or BINDING SITE III. Table 2 illustrates the complementarity of the nucleotide sequences of TIP-1 BINDING SITE, designated SEQ ID:15968, to the nucleotide sequence of VGAM1968 RNA, herein designated VGAM RNA, also designated SEQ ID:4679.

Another function of VGAM1968 is therefore inhibition of TIP-1 (Accession NM_014604). Accordingly, utilities of VGAM1968 include diagnosis, prevention and treatment of diseases and clinical conditions associated with TIP-1. TOLLIP (Accession NM_019009) is another VGAM1968 host target gene. TOLLIP BINDING SITE is HOST TARGET binding site found in the 3' untranslated region of mRNA encoded by TOLLIP, corresponding to a HOST TARGET binding site such as BINDING SITE I, BINDING SITE II or BINDING SITE III. Table 2 illustrates the complementarity of the nucleotide sequences of TOLLIP BINDING SITE, designated SEQ ID:21091, to the nucleotide sequence of VGAM1968 RNA, herein designated VGAM RNA, also designated SEQ ID:4679.

Another function of VGAM1968 is therefore inhibition of TOLLIP (Accession NM_019009). Accordingly, utilities of VGAM1968 include diagnosis, prevention and treatment of diseases and clinical conditions associated with TOLLIP. Tripartite Motif-containing 4 (TRIM4, Accession NM_033017) is another VGAM1968 host target gene. TRIM4 BINDING SITE is HOST TARGET binding site found in the 3' untranslated region of mRNA encoded by TRIM4, corresponding to a HOST TARGET binding site such as BINDING SITE I, BINDING SITE II or BINDING SITE III. Table 2 illustrates the complementarity of the nucleotide sequences of TRIM4 BINDING SITE, designated SEQ ID:26904, to the nucleotide sequence of VGAM1968 RNA, herein designated VGAM RNA, also designated SEQ ID:4679.

Another function of VGAM1968 is therefore inhibition of Tripartite Motif-containing 4 (TRIM4, Accession NM_033017). Accordingly, utilities of VGAM1968 include diagnosis, prevention and treatment of diseases and clinical conditions associated with TRIM4. TRIP-Br2 (Accession NM_014755) is another VGAM1968 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16483, to the nucleotide sequence of VGAM1968 RNA, herein designated VGAM RNA, also designated SEQ ID:4679.

Another function of VGAM1968 is therefore inhibition of TRIP-Br2 (Accession NM_014755). Accordingly, utilities of VGAM1968 include diagnosis, prevention and treatment of diseases and clinical conditions associated with TRIP-Br2. TSPAN-5 (Accession NM_005723) is another VGAM1968 host target gene. TSPAN-5 BINDING SITE is HOST TARGET binding site found in the 5' untranslated region of mRNA encoded by TSPAN-5, corresponding to a HOST TARGET binding site such as BINDING SITE I, BINDING SITE II or BINDING SITE III. Table 2 illustrates the complementarity of the nucleotide sequences of TSPAN-5 BINDING SITE, designated SEQ ID:12276, to the nucleotide sequence of VGAM1968 RNA, herein designated VGAM RNA, also designated SEQ ID:4679.

Another function of VGAM1968 is therefore inhibition of TSPAN-5 (Accession NM_005723). Accordingly, utilities of VGAM1968 include diagnosis, prevention and treatment of diseases and clinical conditions associated with TSPAN-5. LOC115073 (Accession XM_055193) is another VGAM1968 host target gene. LOC115073 BINDING SITE is HOST TARGET binding site found in the 3' untranslated region of mRNA encoded by LOC115073, corresponding to a HOST TARGET binding site such as BINDING SITE I, BINDING SITE II or BINDING SITE III. Table 2 illustrates the complementarity of the nucleotide sequences of LOC115073 BINDING SITE, designated SEQ ID:36233, to the nucleotide sequence of VGAM1968 RNA, herein designated VGAM RNA, also designated SEQ ID:4679.

Another function of VGAM1968 is therefore inhibition of LOC115073 (Accession XM_055193). Accordingly, utilities of VGAM1968 include diagnosis, prevention and treatment of diseases and clinical conditions associated with LOC115073. LOC115219 (Accession XM_055499) is another VGAM1968 host target gene. LOC115219 BINDING SITE is HOST TARGET binding site found in the 5' untranslated region of mRNA encoded by LOC115219, corresponding to a HOST TARGET binding site such as BINDING SITE I, BINDING SITE II or BINDING SITE III. Table 2 illustrates the complementarity of the nucleotide sequences of LOC115219 BINDING SITE, designated SEQ ID:36281, to the nucleotide sequence of VGAM1968 RNA, herein designated VGAM RNA, also designated SEQ ID:4679.

Another function of VGAM1968 is therefore inhibition of LOC115219 (Accession XM_055499). Accordingly, utilities of VGAM1968 include diagnosis, prevention and treatment of diseases and clinical conditions associated with LOC115219. LOC118709 (Accession XM_058338) is another VGAM1968 host target gene. LOC118709 BINDING SITE is HOST TARGET binding site found in the 5' untranslated region of mRNA encoded by LOC118709, corresponding to a HOST TARGET binding site such as BINDING SITE I, BINDING SITE II or BINDING SITE III. Table 2 illustrates the complementarity of the nucleotide sequences of LOC118709 BINDING SITE, designated SEQ ID:36600, to the nucleotide sequence of VGAM1968 RNA, herein designated VGAM RNA, also designated SEQ ID:4679.

Another function of VGAM1968 is therefore inhibition of LOC118709 (Accession XM_058338). Accordingly, utilities of VGAM1968 include diagnosis, prevention and treatment of diseases and clinical conditions associated with LOC118709. LOC126353 (Accession XM_059034) is another VGAM1968 host target gene. LOC126353 BINDING SITE is HOST TARGET binding site found in the 3' untranslated region of mRNA encoded by LOC126353, corresponding to a HOST TARGET binding site such as BINDING SITE I, BINDING SITE II or BINDING SITE III. Table 2 illustrates the complementarity of the nucleotide sequences of LOC126353 BINDING SITE, designated SEQ ID:36830, to the nucleotide sequence of VGAM1968 RNA, herein designated VGAM RNA, also designated SEQ ID:4679.

Another function of VGAM1968 is therefore inhibition of LOC126353 (Accession XM_059034). Accordingly, utilities of VGAM1968 include diagnosis, prevention and treatment of diseases and clinical conditions associated with LOC126353. LOC126661 (Accession XM_059061) is another VGAM1968 host target gene. LOC126661 BINDING SITE is HOST TARGET binding site found in the 3' untranslated region of mRNA encoded by LOC126661, corresponding to a HOST TARGET binding site such as BINDING SITE I, BINDING SITE II or BINDING SITE III. Table 2 illustrates the complementarity of the nucleotide sequences of LOC126661 BINDING SITE, designated SEQ ID:36853, to the nucleotide sequence of VGAM1968 RNA, herein designated VGAM RNA, also designated SEQ ID:4679.

Another function of VGAM1968 is therefore inhibition of LOC126661 (Accession XM_059061). Accordingly, utilities of VGAM1968 include diagnosis, prevention and treatment of diseases and clinical conditions associated with LOC126661. LOC132321 (Accession XM_059585) is another VGAM1968 host target gene. LOC132321 BINDING SITE is HOST TARGET binding site found in the 3' untranslated region of mRNA encoded by LOC132321, corresponding to a HOST TARGET binding site such as BINDING SITE I, BINDING SITE II or BINDING SITE III. Table 2 illustrates the complementarity of the nucleotide sequences of LOC132321 BINDING SITE, designated SEQ ID:37027, to the nucleotide sequence of VGAM1968 RNA, herein designated VGAM RNA, also designated SEQ ID:4679.

Another function of VGAM1968 is therefore inhibition of LOC132321 (Accession XM_059585). Accordingly, utilities of VGAM1968 include diagnosis, prevention and treatment of diseases and clinical conditions associated with LOC132321. LOC133686 (Accession XM_059667) is another VGAM1968 host target gene. LOC133686 BINDING SITE is HOST TARGET binding site found in the 3' untranslated region of mRNA encoded by LOC133686, corresponding to a HOST TARGET binding site such as BINDING SITE I, BINDING SITE II or BINDING SITE III. Table 2 illustrates the complementarity of the nucleotide sequences of LOC133686 BINDING SITE, designated SEQ ID:37053, to the nucleotide sequence of VGAM1968 RNA, herein designated VGAM RNA, also designated SEQ ID:4679.

Another function of VGAM1968 is therefore inhibition of LOC133686 (Accession XM_059667). Accordingly, utilities of VGAM1968 include diagnosis, prevention and treatment of diseases and clinical conditions associated with LOC133686. LOC144317 (Accession XM_084813) is another VGAM1968 host target gene. LOC144317 BINDING SITE is HOST TARGET binding site found in the 3' untranslated region of mRNA encoded by LOC144317, corresponding to a HOST TARGET binding site such as BINDING SITE I, BINDING SITE II or BINDING SITE III. Table 2 illustrates the complementarity of the nucleotide sequences of LOC144317 BINDING SITE, designated SEQ ID:37718, to the nucleotide sequence of VGAM1968 RNA, herein designated VGAM RNA, also designated SEQ ID:4679.

Another function of VGAM1968 is therefore inhibition of LOC144317 (Accession XM_084813). Accordingly, utilities of VGAM1968 include diagnosis, prevention and treatment of diseases and clinical conditions associated with LOC144317. LOC144848 (Accession XM_056770) is another VGAM1968 host target gene. LOC144848 BINDING SITE is HOST TARGET binding site found in the 3' untranslated region of mRNA encoded by LOC144848, corresponding to a HOST TARGET binding site such as BINDING SITE I, BINDING SITE II or BINDING SITE III. Table 2 illustrates the complementarity of the nucleotide sequences of LOC144848 BINDING SITE, designated SEQ ID:36421, to the nucleotide sequence of VGAM1968 RNA, herein designated VGAM RNA, also designated SEQ ID:4679.

Another function of VGAM1968 is therefore inhibition of LOC144848 (Accession XM_056770). Accordingly, utilities of VGAM1968 include diagnosis, prevention and treatment of diseases and clinical conditions associated with LOC144848. LOC145317 (Accession XM_096760) is another VGAM1968 host target gene. LOC145317 BINDING SITE is HOST TARGET binding site found in the 5' untranslated region of mRNA encoded by LOC145317, corresponding to a HOST TARGET binding site such as BINDING SITE I, BINDING SITE II or BINDING SITE III. Table 2 illustrates the complementarity of the nucleotide sequences of LOC145317 BINDING SITE, designated SEQ ID:40531, to the nucleotide sequence of VGAM1968 RNA, herein designated VGAM RNA, also designated SEQ ID:4679.

Another function of VGAM1968 is therefore inhibition of LOC145317 (Accession XM_096760). Accordingly, utilities of VGAM1968 include diagnosis, prevention and treatment of diseases and clinical conditions associated with LOC145317. LOC145844 (Accession XM_085255) is another VGAM1968 host target gene. LOC145844 BINDING SITE is HOST TARGET binding site found in the 3' untranslated region of mRNA encoded by LOC145844, corresponding to a HOST TARGET binding site such as BINDING SITE I, BINDING SITE II or BINDING SITE III. Table 2 illustrates the complementarity of the nucleotide sequences of LOC145844 BINDING SITE, designated SEQ ID:38001, to the nucleotide sequence of VGAM1968 RNA, herein designated VGAM RNA, also designated SEQ ID:4679.

Another function of VGAM1968 is therefore inhibition of LOC145844 (Accession XM_085255). Accordingly, utilities of VGAM1968 include diagnosis, prevention and treatment of diseases and clinical conditions associated with LOC145844. LOC150185 (Accession XM_097834) is another VGAM1968 host target gene. LOC150185 BINDING SITE is HOST TARGET binding site found in the 3' untranslated region of mRNA encoded by LOC150185, corresponding to a HOST TARGET binding site such as BINDING SITE I, BINDING SITE II or BINDING SITE III. Table 2 illustrates the complementarity of the nucleotide sequences of LOC150185 BINDING SITE, designated SEQ ID:41152, to the nucleotide sequence of VGAM1968 RNA, herein designated VGAM RNA, also designated SEQ ID:4679.

Another function of VGAM1968 is therefore inhibition of LOC150185 (Accession XM_097834). Accordingly, utilities of VGAM1968 include diagnosis, prevention and treatment of diseases and clinical conditions associated with LOC150185. LOC150407 (Accession XM_086906) is another VGAM1968 host target gene. LOC150407 BINDING SITE is HOST TARGET binding site found in the 3' untranslated region of mRNA encoded by LOC150407, corresponding to a HOST TARGET binding site such as BINDING SITE I, BINDING SITE II or BINDING SITE III. Table 2 illustrates the complementarity of the nucleotide sequences of LOC150407 BINDING SITE, designated SEQ ID:38952, to the nucleotide sequence of VGAM1968 RNA, herein designated VGAM RNA, also designated SEQ ID:4679.

Another function of VGAM1968 is therefore inhibition of LOC150407 (Accession XM_086906). Accordingly, utilities of VGAM1968 include diagnosis, prevention and treatment of diseases and clinical conditions associated with LOC150407. LOC151405 (Accession XM_098058) is another VGAM1968 host target gene. LOC151405 BINDING SITE is HOST TARGET binding site found in the 5' untranslated region of mRNA encoded by LOC151405, corresponding to a HOST TARGET binding site such as BINDING SITE I, BINDING SITE II or BINDING SITE III. Table 2 illustrates the complementarity of the nucleotide sequences of LOC151405 BINDING SITE, designated SEQ ID:41339, to the nucleotide sequence of VGAM1968 RNA, herein designated VGAM RNA, also designated SEQ ID:4679.

Another function of VGAM1968 is therefore inhibition of LOC151405 (Accession XM_098058). Accordingly, utilities of VGAM1968 include diagnosis, prevention and treatment of diseases and clinical conditions associated with LOC151405. LOC157660 (Accession XM_098805) is another VGAM1968 host target gene. LOC157660 BINDING SITE is HOST TARGET binding site found in the 3' untranslated region of mRNA encoded by LOC157660, corresponding to a HOST TARGET binding site such as BINDING SITE I, BINDING SITE II or BINDING SITE III. Table 2 illustrates the complementarity of the nucleotide sequences of LOC157660 BINDING SITE, designated SEQ ID:41830, to the nucleotide sequence of VGAM1968 RNA, herein designated VGAM RNA, also designated SEQ ID:4679.

Another function of VGAM1968 is therefore inhibition of LOC157660 (Accession XM_098805). Accordingly, utilities of VGAM1968 include diagnosis, prevention and treatment of diseases and clinical conditions associated with LOC157660. LOC158434 (Accession XM_098939) is another VGAM1968 host target gene. LOC158434 BINDING SITE is HOST TARGET binding site found in the 5' untranslated region of mRNA encoded by LOC158434, corresponding to a HOST TARGET binding site such as BINDING SITE I, BINDING SITE II or BINDING SITE III. Table 2 illustrates the complementarity of the nucleotide sequences of LOC158434 BINDING SITE, designated SEQ ID:41986, to the nucleotide sequence of VGAM1968 RNA, herein designated VGAM RNA, also designated SEQ ID:4679.

Another function of VGAM1968 is therefore inhibition of LOC158434 (Accession XM_098939). Accordingly, utilities of VGAM1968 include diagnosis, prevention and treatment of diseases and clinical conditions associated with LOC158434. LOC164173 (Accession XM_089424) is another VGAM1968 host target gene. LOC164173 BINDING SITE is HOST TARGET binding site found in the 3' untranslated region of mRNA encoded by LOC164173, corresponding to a HOST TARGET binding site such as BINDING SITE I, BINDING SITE II or BINDING SITE III. Table 2 illustrates the complementarity of the nucleotide sequences of LOC164173 BINDING SITE, designated SEQ ID:39975, to the nucleotide sequence of VGAM1968 RNA, herein designated VGAM RNA, also designated SEQ ID:4679.

Another function of VGAM1968 is therefore inhibition of LOC164173 (Accession XM_089424). Accordingly, utilities of VGAM1968 include diagnosis, prevention and treatment of diseases and clinical conditions associated with LOC164173. LOC165741 (Accession XM_105272) is another VGAM1968 host target gene. LOC165741 BINDING SITE is HOST TARGET binding site found in the 3' untranslated region of mRNA encoded by LOC165741, corresponding to a HOST TARGET binding site such as BINDING SITE I, BINDING SITE II or BINDING SITE III. Table 2 illustrates the complementarity of the nucleotide sequences of LOC165741 BINDING SITE, designated SEQ ID:42192, to the nucleotide sequence of VGAM1968 RNA, herein designated VGAM RNA, also designated SEQ ID:4679.

Another function of VGAM1968 is therefore inhibition of LOC165741 (Accession XM_105272). Accordingly, utilities of VGAM1968 include diagnosis, prevention and treatment of diseases and clinical conditions associated with LOC165741. LOC196047 (Accession XM_116883) is another VGAM1968 host target gene. LOC196047 BINDING SITE is HOST TARGET binding site found in the 5' untranslated region of mRNA encoded by LOC196047, corresponding to a HOST TARGET binding site such as BINDING SITE I, BINDING SITE II or BINDING SITE III. Table 2 illustrates the complementarity of the nucleotide sequences of LOC196047 BINDING SITE, designated SEQ ID:43145, to the nucleotide sequence of VGAM1968 RNA, herein designated VGAM RNA, also designated SEQ ID:4679.

Another function of VGAM1968 is therefore inhibition of LOC196047 (Accession XM_116883). Accordingly, utilities of VGAM1968 include diagnosis, prevention and treatment of diseases and clinical conditions associated with LOC196047. LOC196529 (Accession XM_113746) is another VGAM1968 host target gene. LOC196529 BINDING SITE is HOST TARGET binding site found in the 3' untranslated region of mRNA encoded by LOC196529, corresponding to a HOST TARGET binding site such as BINDING SITE I, BINDING SITE II or BINDING SITE III. Table 2 illustrates the complementarity of the nucleotide sequences of LOC196529 BINDING SITE, designated SEQ ID:42409, to the nucleotide sequence of VGAM1968 RNA, herein designated VGAM RNA, also designated SEQ ID:4679.

Another function of VGAM1968 is therefore inhibition of LOC196529 (Accession XM_113746). Accordingly, utilities of VGAM1968 include diagnosis, prevention and treatment of diseases and clinical conditions associated with LOC196529. LOC200942 (Accession XM_114323) is another VGAM1968 host target gene. LOC200942 BINDING SITE is HOST TARGET binding site found in the 3' untranslated region of mRNA encoded by LOC200942, corresponding to a HOST TARGET binding site such as BINDING SITE I, BINDING SITE II or BINDING SITE III. Table 2 illustrates the complementarity of the nucleotide sequences of LOC200942 BINDING SITE, designated SEQ ID:42873, to the nucleotide sequence of VGAM1968 RNA, herein designated VGAM RNA, also designated SEQ ID:4679.

Another function of VGAM1968 is therefore inhibition of LOC200942 (Accession XM_114323). Accordingly, utilities of VGAM1968 include diagnosis, prevention and treatment of diseases and clinical conditions associated with LOC200942. LOC201685 (Accession XM_117325) is another VGAM1968 host target gene. LOC201685 BINDING SITE is HOST TARGET binding site found in the 5' untranslated region of mRNA encoded by LOC201685, corresponding to a HOST TARGET binding site such as BINDING SITE I, BINDING SITE II or BINDING SITE III. Table 2 illustrates the complementarity of the nucleotide sequences of LOC201685 BINDING SITE, designated SEQ ID:43386, to the nucleotide sequence of VGAM1968 RNA, herein designated VGAM RNA, also designated SEQ ID:4679.

Another function of VGAM1968 is therefore inhibition of LOC201685 (Accession XM_117325). Accordingly, utilities of VGAM1968 include diagnosis, prevention and treatment of diseases and clinical conditions associated with LOC201685. LOC202020 (Accession XM_114419) is another VGAM1968 host target gene. LOC202020 BINDING SITE is HOST TARGET binding site found in the 3' untranslated region of mRNA encoded by LOC202020, corresponding to a HOST TARGET binding site such as BINDING SITE I, BINDING SITE II or BINDING SITE III. Table 2 illustrates the complementarity of the nucleotide sequences of LOC202020 BINDING SITE, designated SEQ ID:42954, to the nucleotide sequence of VGAM1968 RNA, herein designated VGAM RNA, also designated SEQ ID:4679.

Another function of VGAM1968 is therefore inhibition of LOC202020 (Accession XM_114419). Accordingly, utilities of VGAM1968 include diagnosis, prevention and treatment of diseases and clinical conditions associated with LOC202020. LOC202934 (Accession XM_117486) is another VGAM1968 host target gene. LOC202934 BIND- ING SITE is HOST TARGET binding site found in the 5' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43469, to the nucleotide sequence of VGAM1968 RNA, herein designated VGAM RNA, also designated SEQ ID:4679.

Another function of VGAM1968 is therefore inhibition of LOC202934 (Accession XM_117486). Accordingly, utilities of VGAM1968 include diagnosis, prevention and treatment of diseases and clinical conditions associated with LOC202934. LOC220672 (Accession XM_017177) is another VGAM1968 host target gene. LOC220672 BINDING SITE is HOST TARGET binding site found in the 3' untranslated region of mRNA encoded by LOC220672, corresponding to a HOST TARGET binding site such as BINDING SITE I, BINDING SITE II or BINDING SITE III. Table 2 illustrates the complementarity of the nucleotide sequences of LOC220672 BINDING SITE, designated SEQ ID:30309, to the nucleotide sequence of VGAM1968 RNA, herein designated VGAM RNA, also designated SEQ ID:4679.

Another function of VGAM1968 is therefore inhibition of LOC220672 (Accession XM_017177). Accordingly, utilities of VGAM1968 include diagnosis, prevention and treatment of diseases and clinical conditions associated with LOC220672. LOC254158 (Accession XM_172799) is another VGAM1968 host target gene. LOC254158 BINDING SITE is HOST TARGET binding site found in the 5' untranslated region of mRNA encoded by LOC254158, corresponding to a HOST TARGET binding site such as BINDING SITE I, BINDING SITE II or BINDING SITE III. Table 2 illustrates the complementarity of the nucleotide sequences of LOC254158 BINDING SITE, designated SEQ ID:46082, to the nucleotide sequence of VGAM1968 RNA, herein designated VGAM RNA, also designated SEQ ID:4679.

Another function of VGAM1968 is therefore inhibition of LOC254158 (Accession XM_172799). Accordingly, utilities of VGAM1968 include diagnosis, prevention and treatment of diseases and clinical conditions associated with LOC254158. LOC255045 (Accession XM_171243) is another VGAM1968 host target gene. LOC255045 BINDING SITE is HOST TARGET binding site found in the 3' untranslated region of mRNA encoded by LOC255045, corresponding to a HOST TARGET binding site such as BINDING SITE I, BINDING SITE II or BINDING SITE III. Table 2 illustrates the complementarity of the nucleotide sequences of LOC255045 BINDING SITE, designated SEQ ID:46033, to the nucleotide sequence of VGAM1968 RNA, herein designated VGAM RNA, also designated SEQ ID:4679.

Another function of VGAM1968 is therefore inhibition of LOC255045 (Accession XM_171243). Accordingly, utilities of VGAM1968 include diagnosis, prevention and treatment of diseases and clinical conditions associated with LOC255045. LOC256536 (Accession XM_170651) is another VGAM1968 host target gene. LOC256536 BINDING SITE is HOST TARGET binding site found in the 3' untranslated region of mRNA encoded by LOC256536, corresponding to a HOST TARGET binding site such as BINDING SITE I, BINDING SITE II or BINDING SITE III. Table 2 illustrates the complementarity of the nucleotide sequences of LOC256536 BINDING SITE, designated SEQ ID:45428, to the nucleotide sequence of VGAM1968 RNA, herein designated VGAM RNA, also designated SEQ ID:4679.

Another function of VGAM1968 is therefore inhibition of LOC256536 (Accession XM_170651). Accordingly, utilities of VGAM1968 include diagnosis, prevention and treatment of diseases and clinical conditions associated with LOC256536. LOC257017 (Accession XM_173227) is another VGAM1968 host target gene. LOC257017 BINDING SITE is HOST TARGET binding site found in the 5' untranslated region of mRNA encoded by LOC257017, corresponding to a HOST TARGET binding site such as BINDING SITE I, BINDING SITE II or BINDING SITE III. Table 2 illustrates the complementarity of the nucleotide sequences of LOC257017 BINDING SITE, designated SEQ ID:46496, to the nucleotide sequence of VGAM1968 RNA, herein designated VGAM RNA, also designated SEQ ID:4679.

Another function of VGAM1968 is therefore inhibition of LOC257017 (Accession XM_173227). Accordingly, utilities of VGAM1968 include diagnosis, prevention and treatment of diseases and clinical conditions associated with LOC257017. LOC56912 (Accession NM_020153) is another VGAM1968 host target gene. LOC56912 BINDING SITE is HOST TARGET binding site found in the 5' untranslated region of mRNA encoded by LOC56912, corresponding to a HOST TARGET binding site such as BINDING SITE I, BINDING SITE II or BINDING SITE III. Table 2 illustrates the complementarity of the nucleotide sequences of LOC56912 BINDING SITE, designated SEQ ID:21365, to the nucleotide sequence of VGAM1968 RNA, herein designated VGAM RNA, also designated SEQ ID:4679.

Another function of VGAM1968 is therefore inhibition of LOC56912 (Accession NM_020153). Accordingly, utilities of VGAM1968 include diagnosis, prevention and treatment of diseases and clinical conditions associated with LOC56912. LOC85414 (Accession NM_033102) is another VGAM1968 host target gene. LOC85414 BINDING SITE is HOST TARGET binding site found in the 3' untranslated region of mRNA encoded by LOC85414, corresponding to a HOST TARGET binding site such as BINDING SITE I, BINDING SITE II or BINDING SITE III. Table 2 illustrates the complementarity of the nucleotide sequences of LOC85414 BINDING SITE, designated SEQ ID:26952, to the nucleotide sequence of VGAM1968 RNA, herein designated VGAM RNA, also designated SEQ ID:4679.

Another function of VGAM1968 is therefore inhibition of LOC85414 (Accession NM_033102). Accordingly, utilities of VGAM1968 include diagnosis, prevention and treatment of diseases and clinical conditions associated with LOC85414. LOC90183 (Accession XM_029709) is another VGAM1968 host target gene. LOC90183 BINDING SITE is HOST TARGET binding site found in the 3' untranslated region of mRNA encoded by LOC90183, corresponding to a HOST TARGET binding site such as BINDING SITE I, BINDING SITE II or BINDING SITE III. Table 2 illustrates the complementarity of the nucleotide sequences of LOC90183 BINDING SITE, designated SEQ ID:30926, to the nucleotide sequence of VGAM1968 RNA, herein designated VGAM RNA, also designated SEQ ID:4679.

Another function of VGAM1968 is therefore inhibition of LOC90183 (Accession XM_029709). Accordingly, utilities of VGAM1968 include diagnosis, prevention and treatment of diseases and clinical conditions associated with LOC90183. LOC91272 (Accession XM_037317) is another VGAM1968 host target gene. LOC91272 BINDING SITE is HOST TARGET binding site found in the 5' untranslated region of mRNA encoded by LOC91272, corresponding to a HOST TARGET binding site such as BINDING SITE I, BINDING SITE II or BINDING SITE III. Table 2 illustrates the complementarity of the nucleotide sequences of LOC91272 BINDING SITE, designated SEQ ID:32612, to the nucleotide sequence of VGAM1968 RNA, herein designated VGAM RNA, also designated SEQ ID:4679.

Another function of VGAM1968 is therefore inhibition of LOC91272 (Accession XM_037317). Accordingly, utilities of VGAM1968 include diagnosis, prevention and treatment of diseases and clinical conditions associated with LOC91272. LOC91301 (Accession XM_037564) is another VGAM1968 host target gene. LOC91301 BINDING SITE is HOST TARGET binding site found in the 5' untranslated region of mRNA encoded by LOC91301, corresponding to a HOST TARGET binding site such as BINDING SITE I, BINDING SITE II or BINDING SITE III. Table 2 illustrates the complementarity of the nucleotide sequences of LOC91301 BINDING SITE, designated SEQ ID:32651, to the nucleotide sequence of VGAM1968 RNA, herein designated VGAM RNA, also designated SEQ ID:4679.

Another function of VGAM1968 is therefore inhibition of LOC91301 (Accession XM_037564). Accordingly, utilities of VGAM1968 include diagnosis, prevention and treatment of diseases and clinical conditions associated with LOC91301. LOC91516 (Accession XM_038924) is another VGAM1968 host target gene. LOC91516 BINDING SITE is HOST TARGET binding site found in the 5' untranslated region of mRNA encoded by LOC91516, corresponding to a HOST TARGET binding site such as BINDING SITE I, BINDING SITE II or BINDING SITE III. Table 2 illustrates the complementarity of the nucleotide sequences of LOC91516 BINDING SITE, designated SEQ ID:32956, to the nucleotide sequence of VGAM1968 RNA, herein designated VGAM RNA, also designated SEQ ID:4679.

Another function of VGAM1968 is therefore inhibition of LOC91516 (Accession XM_038924). Accordingly, utilities of VGAM1968 include diagnosis, prevention and treatment of diseases and clinical conditions associated with LOC91516. LOC91585 (Accession XM_039395) is another VGAM1968 host target gene. LOC91585 BINDING SITE is HOST TARGET binding site found in the 3' untranslated region of mRNA encoded by LOC91585, corresponding to a HOST TARGET binding site such as BINDING SITE I, BINDING SITE II or BINDING SITE III. Table 2 illustrates the complementarity of the nucleotide sequences of LOC91585 BINDING SITE, designated SEQ ID:33076, to the nucleotide sequence of VGAM1968 RNA, herein designated VGAM RNA, also designated SEQ ID:4679.

Another function of VGAM1968 is therefore inhibition of LOC91585 (Accession XM_039395). Accordingly, utilities of VGAM1968 include diagnosis, prevention and treatment of diseases and clinical conditions associated with LOC91585. LOC93166 (Accession XM_049619) is another VGAM1968 host target gene. LOC93166 BINDING SITE is HOST TARGET binding site found in the 3' untranslated region of mRNA encoded by LOC93166, corresponding to a HOST TARGET binding site such as BINDING SITE I, BINDING SITE II or BINDING SITE III. Table 2 illustrates the complementarity of the nucleotide sequences of LOC93166 BINDING SITE, designated SEQ ID:35462, to the nucleotide sequence of VGAM1968 RNA, herein designated VGAM RNA, also designated SEQ ID:4679.

Another function of VGAM1968 is therefore inhibition of LOC93166 (Accession XM_049619). Accordingly, utilities of VGAM1968 include diagnosis, prevention and treatment of diseases and clinical conditions associated with LOC93166. FIG. 1 further provides a conceptual description of a novel bioinformatically detected viral gene of the present invention, referred to here as Viral Genomic Address Messenger 1969 (VGAM1969) viral gene, which modulates expression of respective host target genes thereof, the function and utility of which host target genes is known in the art.

VGAM1969 is a novel bioinformatically detected regulatory, non protein coding, viral micro RNA (miRNA) gene. The method by which VGAM1969 was detected is described hereinabove with reference to FIGS. 1-8.

VGAM1969 gene, herein designated VGAM GENE, is a viral gene contained in the genome of Rana Tigrina Ranavirus. VGAM1969 host target gene, herein designated VGAM HOST TARGET GENE, is a human gene contained in the human genome.

VGAM1969 gene encodes a VGAM1969 precursor RNA, herein designated VGAM PRECURSOR RNA. Similar to other miRNA genes, and unlike most ordinary genes, VGAM1969 precursor RNA does not encode a protein. A nucleotide sequence identical or highly similar to the nucleotide sequence of VGAM1969 precursor RNA is designated SEQ ID:1955, and is provided hereinbelow with reference to the sequence listing part. Nucleotide sequence SEQ ID:1955 is located at position 88273 relative to the genome of Rana Tigrina Ranavirus.

VGAM1969 precursor RNA folds onto itself, forming VGAM1969 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1969 folded precursor RNA into VGAM1969 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 62%) nucleotide sequence of VGAM1969 RNA is designated SEQ ID:4680, and is provided hereinbelow with reference to the sequence listing part.

VGAM1969 host target gene, herein designated VGAM HOST TARGET GENE, encodes a corresponding messenger RNA, VGAM1969 host target RNA, herein designated VGAM HOST TARGET RNA. VGAM1969 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1969 RNA, herein designated VGAM RNA, binds complementarily to one or more host target binding sites located in untranslated regions of VGAM1969 host target RNA, herein designated VGAM HOST TARGET RNA. This complementary binding is due to the fact that the nucleotide sequence of VGAM1969 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1969 RNA, herein designated VGAM RNA, may have a different number of host target binding sites in untranslated regions of a VGAM1969 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1969 RNA, herein designated VGAM RNA, to host target binding sites on VGAM1969 host target RNA, herein designated VGAM HOST TARGET RNA, such as BINDING SITE I, BINDING SITE II and BINDING SITE III, inhibits translation of VGAM1969 host target RNA into VGAM1969 host target protein, herein designated VGAM HOST TARGET PROTEIN. VGAM host target protein is therefore outlined by a broken line.

It is appreciated that VGAM1969 host target gene, herein designated VGAM HOST TARGET GENE, in fact represents a plurality of VGAM1969 host target genes. The mRNA of each one of this plurality of VGAM1969 host target genes comprises one or more host target binding sites, each having a nucleotide sequence which is at least partly complementary to VGAM1969 RNA, herein designated VGAM RNA, and which when bound by VGAM1969 RNA causes inhibition of translation of respective one or more VGAM1969 host target proteins.

It is further appreciated by one skilled in the art that the mode of translational inhibition illustrated by FIG. 1 with specific reference to translational inhibition exerted by VGAM1969 gene, herein designated VGAM GENE, on one or more VGAM1969 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1969 is inhibition of expression of host target genes, as part of a novel viral mechanism of attacking a host. Accordingly, utilities of VGAM1969 include diagnosis, prevention and treatment of viral infection by Rana Tigrina Ranavirus. Specific functions, and accordingly utilities, of VGAM1969 correlate with, and may be deduced from, the identity of the host target genes which VGAM1969 binds and inhibits, and the function of these host target genes, as elaborated hereinbelow.

Nucleotide sequences of the VGAM1969 precursor RNA, herein designated VGAM PRECURSOR RNA, and of the 'diced' VGAM1969 RNA, herein designated VGAM RNA, and a schematic representation of the secondary folding of VGAM1969 folded precursor RNA, herein designated VGAM FOLDED PRECURSOR RNA, of VGAM1969 are further described hereinbelow with reference to Table 1.

Nucleotide sequences of host target binding sites, such as BINDING SITE-I, BINDING SITE-II and BINDING SITE-III of FIG. 1, found on VGAM1969 host target RNA, and schematic representation of the complementarity of each of these host target binding sites to VGAM1969 RNA, herein designated VGAM RNA, are described hereinbelow with reference to Table 2.

As mentioned hereinabove with reference to FIG. 1, a function of VGAM1969 gene, herein designated VGAM is inhibition of expression of VGAM1969 target genes. It is appreciated that specific functions, and accordingly utilities, of VGAM1969 correlate with, and may be deduced from, the identity of the target genes which VGAM1969 binds and inhibits, and the function of these target genes, as elaborated hereinbelow.

FLJ21432 (Accession NM_024551) is a VGAM1969 host target gene. FLJ21432 BINDING SITE is HOST TARGET binding site found in the 3' untranslated region of mRNA encoded by FLJ21432, corresponding to a HOST TARGET binding site such as BINDING SITE I, BINDING SITE II or BINDING SITE III. Table 2 illustrates the complementarity of the nucleotide sequences of FLJ21432 BINDING SITE, designated SEQ ID:23767, to the nucleotide sequence of VGAM1969 RNA, herein designated VGAM RNA, also designated SEQ ID:4680.

A function of VGAM1969 is therefore inhibition of FLJ21432 (Accession NM_024551). Accordingly, utilities of VGAM1969 include diagnosis, prevention and treatment of diseases and clinical conditions associated with FLJ21432. KIAA1538 (Accession XM_049474) is another VGAM1969 host target gene. KIAA1538 BINDING SITE is HOST TARGET binding site found in the 3' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35432, to the nucleotide sequence of VGAM1969 RNA, herein designated VGAM RNA, also designated SEQ ID:4680.

Another function of VGAM1969 is therefore inhibition of KIAA1538 (Accession XM_049474). Accordingly, utilities of VGAM1969 include diagnosis, prevention and treatment of diseases and clinical conditions associated with KIAA1538. LOC143914 (Accession XM_084654) is another VGAM1969 host target gene. LOC143914 BINDING SITE is HOST TARGET binding site found in the 5' untranslated region of mRNA encoded by LOC143914, corresponding to a HOST TARGET binding site such as BINDING SITE I, BINDING SITE II or BINDING SITE III. Table 2 illustrates the complementarity of the nucleotide sequences of LOC143914 BINDING SITE, designated SEQ ID:37635, to the nucleotide sequence of VGAM1969 RNA, herein designated VGAM RNA, also designated SEQ ID:4680.

Another function of VGAM1969 is therefore inhibition of LOC143914 (Accession XM_084654). Accordingly, utilities of VGAM1969 include diagnosis, prevention and treatment of diseases and clinical conditions associated with LOC143914. LOC146795 (Accession XM_085593) is another VGAM1969 host target gene. LOC146795 BINDING SITE is HOST TARGET binding site found in the 5' untranslated region of mRNA encoded by LOC146795, corresponding to a HOST TARGET binding site such as BINDING SITE I, BINDING SITE II or BINDING SITE III. Table 2 illustrates the complementarity of the nucleotide sequences of LOC146795 BINDING SITE, designated SEQ ID:38243, to the nucleotide sequence of VGAM1969 RNA, herein designated VGAM RNA, also designated SEQ ID:4680.

Another function of VGAM1969 is therefore inhibition of LOC146795 (Accession XM_085593). Accordingly, utilities of VGAM1969 include diagnosis, prevention and treatment of diseases and clinical conditions associated with LOC146795. LOC154860 (Accession XM_098623) is another VGAM1969 host target gene. LOC154860 BINDING SITE is HOST TARGET binding site found in the 3' untranslated region of mRNA encoded by LOC154860, corresponding to a HOST TARGET binding site such as BINDING SITE I, BINDING SITE II or BINDING SITE III. Table 2 illustrates the complementarity of the nucleotide sequences of LOC154860 BINDING SITE, designated SEQ ID:41736, to the nucleotide sequence of VGAM1969 RNA, herein designated VGAM RNA, also designated SEQ ID:4680.

Another function of VGAM1969 is therefore inhibition of LOC154860 (Accession XM_098623). Accordingly, utilities of VGAM1969 include diagnosis, prevention and treatment of diseases and clinical conditions associated with LOC154860. FIG. 1 further provides a conceptual description of a novel bioinformatically detected viral gene of the present invention, referred to here as Viral Genomic Address Messenger 1970 (VGAM1970) viral gene, which modulates expression of respective host target genes thereof, the function and utility of which host target genes is known in the art.

VGAM1970 is a novel bioinformatically detected regulatory, non protein coding, viral micro RNA (miRNA) gene. The method by which VGAM1970 was detected is described hereinabove with reference to FIGS. 1-8.

VGAM1970 gene, herein designated VGAM GENE, is a viral gene contained in the genome of Rana Tigrina Ranavirus. VGAM1970 host target gene, herein designated VGAM HOST TARGET GENE, is a human gene contained in the human genome.

VGAM1970 gene encodes a VGAM1970 precursor RNA, herein designated VGAM PRECURSOR RNA. Similar to other miRNA genes, and unlike most ordinary genes, VGAM1970 precursor RNA does not encode a protein. A nucleotide sequence identical or highly similar to the nucleotide sequence of VGAM1970 precursor RNA is designated SEQ ID:1956, and is provided hereinbelow with reference to the sequence listing part. Nucleotide sequence SEQ ID:1956 is located at position 98318 relative to the genome of Rana Tigrina Ranavirus.

VGAM1970 precursor RNA folds onto itself, forming VGAM1970 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1970 folded precursor RNA into VGAM1970 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM1970 RNA is designated SEQ ID:4681, and is provided hereinbelow with reference to the sequence listing part.

VGAM1970 host target gene, herein designated VGAM HOST TARGET GENE, encodes a corresponding messenger RNA, VGAM1970 host target RNA, herein designated VGAM HOST TARGET RNA. VGAM1970 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1970 RNA, herein designated VGAM RNA, binds complementarily to one or more host target binding sites located in untranslated regions of VGAM1970 host target RNA, herein designated VGAM HOST TARGET RNA. This complementary binding is due to the fact that the nucleotide sequence of VGAM1970 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1970 RNA, herein designated VGAM RNA, may have a different number of host target binding sites in untranslated regions of a VGAM1970 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1970 RNA, herein designated VGAM RNA, to host target binding sites on VGAM1970 host target RNA, herein designated VGAM HOST TARGET RNA, such as BINDING SITE I, BINDING SITE II and BINDING SITE III, inhibits translation of VGAM1970 host target RNA into VGAM1970 host target protein, herein designated VGAM HOST TARGET PROTEIN. VGAM host target protein is therefore outlined by a broken line.

It is appreciated that VGAM1970 host target gene, herein designated VGAM HOST TARGET GENE, in fact represents a plurality of VGAM1970 host target genes. The mRNA of each one of this plurality of VGAM1970 host target genes comprises one or more host target binding sites, each having a nucleotide sequence which is at least partly complementary to VGAM1970 RNA, herein designated VGAM RNA, and which when bound by VGAM1970 RNA causes inhibition of translation of respective one or more VGAM1970 host target proteins.

It is further appreciated by one skilled in the art that the mode of translational inhibition illustrated by FIG. 1 with specific reference to translational inhibition exerted by VGAM1970 gene, herein designated VGAM GENE, on one or more VGAM1970 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1970 is inhibition of expression of host target genes, as part of a novel viral mechanism of attacking a host. Accordingly, utilities of VGAM1970 include diagnosis, prevention and treatment of viral infection by Rana Tigrina Ranavirus. Specific functions, and accordingly utilities, of VGAM1970 correlate with, and may be deduced from, the identity of the host target genes which VGAM1970 binds and inhibits, and the function of these host target genes, as elaborated hereinbelow.

Nucleotide sequences of the VGAM1970 precursor RNA, herein designated VGAM PRECURSOR RNA, and of the 'diced' VGAM1970 RNA, herein designated VGAM RNA, and a schematic representation of the secondary folding of VGAM1970 folded precursor RNA, herein designated VGAM FOLDED PRECURSOR RNA, of VGAM1970 are further described hereinbelow with reference to Table 1.

Nucleotide sequences of host target binding sites, such as BINDING SITE-I, BINDING SITE-II and BINDING SITE-III of FIG. 1, found on VGAM1970 host target RNA, and schematic representation of the complementarity of each of these host target binding sites to VGAM1970 RNA, herein designated VGAM RNA, are described hereinbelow with reference to Table 2.

As mentioned hereinabove with reference to FIG. 1, a function of VGAM1970 gene, herein designated VGAM is inhibition of expression of VGAM1970 target genes. It is appreciated that specific functions, and accordingly utilities, of VGAM1970 correlate with, and may be deduced from, the identity of the target genes which VGAM1970 binds and inhibits, and the function of these target genes, as elaborated hereinbelow.

Casein Kinase 1, Gamma 2 (CSNK1G2, Accession NM_001319) is a VGAM1970 host target gene. CSNK1G2 BINDING SITE is HOST TARGET binding site found in the 3' untranslated region of mRNA encoded by CSNK1G2, corresponding to a HOST TARGET binding site such as BINDING SITE I, BINDING SITE II or BINDING SITE III. Table 2 illustrates the complementarity of the nucleotide sequences of CSNK1G2 BINDING SITE, designated SEQ ID:7006, to the nucleotide sequence of VGAM1970 RNA, herein designated VGAM RNA, also designated SEQ ID:4681.

A function of VGAM1970 is therefore inhibition of Casein Kinase 1, Gamma 2 (CSNK1G2, Accession NM_001319). Accordingly, utilities of VGAM1970 include diagnosis, prevention and treatment of diseases and clinical conditions associated with CSNK1G2. Zinc Finger Protein 200 (ZNF200, Accession NM_003454) is another VGAM1970 host target gene. ZNF200 BINDING SITE is HOST TARGET binding site found in the 3' untranslated region of mRNA encoded by ZNF200, corresponding to a HOST TARGET binding site such as BINDING SITE I, BINDING SITE II or BINDING SITE III. Table 2 illustrates the complementarity of the nucleotide sequences of ZNF200 BINDING SITE, designated SEQ ID:9504, to the nucleotide sequence of VGAM1970 RNA, herein designated VGAM RNA, also designated SEQ ID:4681.

Another function of VGAM1970 is therefore inhibition of Zinc Finger Protein 200 (ZNF200, Accession NM_003454). Accordingly, utilities of VGAM1970 include diagnosis, prevention and treatment of diseases and clinical conditions associated with ZNF200. BLP1 (Accession NM_031940) is another VGAM1970 host target gene. BLP1 BINDING SITE is HOST TARGET binding site found in the 3' untranslated region of mRNA encoded by BLP1, corresponding to a HOST TARGET binding site such as BINDING SITE I, BINDING SITE II or BINDING SITE III. Table 2 illustrates the complementarity of the nucleotide sequences of BLP1 BINDING SITE, designated SEQ ID:25686, to the nucleotide sequence of VGAM1970 RNA, herein designated VGAM RNA, also designated SEQ ID:4681.

Another function of VGAM1970 is therefore inhibition of BLP1 (Accession NM_031940). Accordingly, utilities of VGAM1970 include diagnosis, prevention and treatment of diseases and clinical conditions associated with BLP1. GFR (Accession NM_012294) is another VGAM1970 host target gene. GFR BINDING SITE is HOST TARGET binding site found in the 3' untranslated region of mRNA encoded by GFR, corresponding to a HOST TARGET binding site such as BINDING SITE I, BINDING SITE II or BINDING SITE III. Table 2 illustrates the complementarity of the nucleotide sequences of GFR BINDING SITE, designated SEQ ID:14633, to the nucleotide sequence of VGAM1970 RNA, herein designated VGAM RNA, also designated SEQ ID:4681.

Another function of VGAM1970 is therefore inhibition of GFR (Accession NM_012294). Accordingly, utilities of VGAM1970 include diagnosis, prevention and treatment of diseases and clinical conditions associated with GFR. Interleukin 1 Receptor Accessory Protein-like 1 (IL1RAPL1, Accession NM_014271) is another VGAM1970 host target gene. IL1RAPL1 BINDING SITE is HOST TARGET binding site found in the 3" untranslated region of mRNA encoded by IL1RAPL1, corresponding to a HOST TARGET binding site such as BINDING SITE I, BINDING SITE II or BINDING SITE III. Table 2 illustrates the complementarity of the nucleotide sequences of IL1RAPL1 BINDING SITE, designated SEQ ID:15551, to the nucleotide sequence of VGAM1970 RNA, herein designated VGAM RNA, also designated SEQ ID:4681.

Another function of VGAM1970 is therefore inhibition of Interleukin 1 Receptor Accessory Protein-like 1 (IL1RAPL1, Accession NM_014271). Accordingly, utilities of VGAM1970 include diagnosis, prevention and treatment of diseases and clinical conditions associated with IL1RAPL1. LOC143187 (Accession NM_145206) is another VGAM1970 host target gene. LOC143187 BINDING SITE is HOST TARGET binding site found in the 3' untranslated region of mRNA encoded by LOC143187, corresponding to a HOST TARGET binding site such as BINDING SITE I, BINDING SITE II or BINDING SITE III. Table 2 illustrates the complementarity of the nucleotide sequences of LOC143187 BINDING SITE, designated SEQ ID:29746, to the nucleotide sequence of VGAM1970 RNA, herein designated VGAM RNA, also designated SEQ ID:4681.

Another function of VGAM1970 is therefore inhibition of LOC143187 (Accession NM_145206). Accordingly, utilities of VGAM1970 include diagnosis, prevention and treatment of diseases and clinical conditions associated with LOC143187. LOC149711 (Accession XM_097720) is another VGAM1970 host target gene. LOC149711 BINDING SITE is HOST TARGET binding site found in the 5' untranslated region of mRNA encoded by LOC149711, corresponding to a HOST TARGET binding site such as BINDING SITE I, BINDING SITE II or BINDING SITE III. Table 2 illustrates the complementarity of the nucleotide sequences of LOC149711 BINDING SITE, designated SEQ ID:41070, to the nucleotide sequence of VGAM1970 RNA, herein designated VGAM RNA, also designated SEQ ID:4681.

Another function of VGAM1970 is therefore inhibition of LOC149711 (Accession XM_097720). Accordingly, utilities of VGAM1970 include diagnosis, prevention and treatment of diseases and clinical conditions associated with LOC149711. LOC90906 (Accession XM_034809) is another VGAM1970 host target gene. LOC90906 BINDING SITE is HOST TARGET binding site found in the 3' untranslated region of mRNA encoded by LOC90906, corresponding to a HOST TARGET binding site such as BINDING SITE I, BINDING SITE II or BINDING SITE III. Table 2 illustrates the complementarity of the nucleotide sequences of LOC90906 BINDING SITE, designated SEQ ID:32151, to the nucleotide sequence of VGAM1970 RNA, herein designated VGAM RNA, also designated SEQ ID:4681.

Another function of VGAM1970 is therefore inhibition of LOC90906 (Accession XM_034809). Accordingly, utilities of VGAM1970 include diagnosis, prevention and treatment of diseases and clinical conditions associated with LOC90906. FIG. 1 further provides a conceptual description of a novel bioinformatically detected viral gene of the present invention, referred to here as Viral Genomic Address Messenger 1971 (VGAM1971) viral gene, which modulates expression of respective host target genes thereof, the function and utility of which host target genes is known in the art.

VGAM1971 is a novel bioinformatically detected regulatory, non protein coding, viral micro RNA (miRNA) gene. The method by which VGAM1971 was detected is described hereinabove with reference to FIGS. 1-8.

VGAM1971 gene, herein designated VGAM GENE, is a viral gene contained in the genome of Rana Tigrina Ranavirus. VGAM1971 host target gene, herein designated VGAM HOST TARGET GENE, is a human gene contained in the human genome.

VGAM1971 gene encodes a VGAM1971 precursor RNA, herein designated VGAM PRECURSOR RNA. Similar to other miRNA genes, and unlike most ordinary genes, VGAM1971 precursor RNA does not encode a protein. A nucleotide sequence identical or highly similar to the nucleotide sequence of VGAM1971 precursor RNA is designated SEQ ID:1957, and is provided hereinbelow with reference to the sequence listing part. Nucleotide sequence SEQ ID:1957 is located at position 90823 relative to the genome of Rana Tigrina Ranavirus.

VGAM1971 precursor RNA folds onto itself, forming VGAM1971 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1971 folded precursor RNA into VGAM1971 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1971 RNA is designated SEQ ID:4682, and is provided hereinbelow with reference to the sequence listing part.

VGAM1971 host target gene, herein designated VGAM HOST TARGET GENE, encodes a corresponding messenger RNA, VGAM1971 host target RNA, herein designated VGAM HOST TARGET RNA. VGAM1971 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1971 RNA, herein designated VGAM RNA, binds complementarily to one or more host target binding sites located in untranslated regions of VGAM1971 host target RNA, herein designated VGAM HOST TARGET RNA. This complementary binding is due to the fact that the nucleotide sequence of VGAM1971 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1971 RNA, herein designated VGAM RNA, may have a different number of host target binding sites in untranslated regions of a VGAM1971 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1971 RNA, herein designated VGAM RNA, to host target binding sites on VGAM1971 host target RNA, herein designated VGAM HOST TARGET RNA, such as BINDING SITE I, BINDING SITE II and BINDING SITE III, inhibits translation of VGAM1971 host target RNA into VGAM1971 host target protein, herein designated VGAM HOST TARGET PROTEIN. VGAM host target protein is therefore outlined by a broken line.

It is appreciated that VGAM1971 host target gene, herein designated VGAM HOST TARGET GENE, in fact represents a plurality of VGAM1971 host target genes. The mRNA of each one of this plurality of VGAM1971 host target genes comprises one or more host target binding sites, each having a nucleotide sequence which is at least partly complementary to VGAM1971 RNA, herein designated VGAM RNA, and which when bound by VGAM1971 RNA causes inhibition of translation of respective one or more VGAM1971 host target proteins.

It is further appreciated by one skilled in the art that the mode of translational inhibition illustrated by FIG. 1 with specific reference to translational inhibition exerted by VGAM1971 gene, herein designated VGAM GENE, on one or more VGAM1971 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1971 is inhibition of expression of host target genes, as part of a novel viral mechanism of attacking a host. Accordingly, utilities of VGAM1971 include diagnosis, prevention and treatment of viral infection by Rana Tigrina Ranavirus. Specific functions, and accordingly utilities, of VGAM1971 correlate with, and may be deduced from, the identity of the host target genes which VGAM1971 binds and inhibits, and the function of these host target genes, as elaborated hereinbelow.

Nucleotide sequences of the VGAM1971 precursor RNA, herein designated VGAM PRECURSOR RNA, and of the 'diced' VGAM1971 RNA, herein designated VGAM RNA, and a schematic representation of the secondary folding of VGAM1971 folded precursor RNA, herein designated VGAM FOLDED PRECURSOR RNA, of VGAM1971 are further described hereinbelow with reference to Table 1.

Nucleotide sequences of host target binding sites, such as BINDING SITE-I, BINDING SITE-II and BINDING SITE-III of FIG. 1, found on VGAM1971 host target RNA, and schematic representation of the complementarity of each of these host target binding sites to VGAM1971 RNA, herein designated VGAM RNA, are described hereinbelow with reference to Table 2.

As mentioned hereinabove with reference to FIG. 1, a function of VGAM1971 gene, herein designated VGAM is inhibition of expression of VGAM1971 target genes. It is appreciated that specific functions, and accordingly utilities, of VGAM1971 correlate with, and may be deduced from, the identity of the target genes which VGAM1971 binds and inhibits, and the function of these target genes, as elaborated hereinbelow.

Androgen Receptor (dihydrotestosterone receptor; testicular feminization; spinal and bulbar muscular atrophy; Kennedy disease) (AR, Accession NM_000044) is a VGAM1971 host target gene. AR BINDING SITE is HOST TARGET binding site found in the 5' untranslated region of mRNA encoded by AR, corresponding to a HOST TARGET binding site such as BINDING SITE I, BINDING SITE II or BINDING SITE III. Table 2 illustrates the complementarity of the nucleotide sequences of AR BINDING SITE, designated SEQ ID:5487, to the nucleotide sequence of VGAM1971 RNA, herein designated VGAM RNA, also designated SEQ ID:4682.

A function of VGAM1971 is therefore inhibition of Androgen Receptor (dihydrotestosterone receptor; testicular feminization; spinal and bulbar muscular atrophy; Kennedy disease) (AR, Accession NM_000044), a gene which are involved in the regulation of eukaryotic gene expression and affect cellular proliferation and differentiation in target tissues. Accordingly, utilities of VGAM1971 include diagnosis, prevention and treatment of diseases and clinical conditions associated with AR. The function of AR has been established by previous studies. The length of a polymorphic CAG repeat sequence occurring in the androgen receptor gene is inversely correlated with transcriptional activity by the androgen receptor. Men who possess exceptionally long CAG repeat lengths experience clinical androgen insensitivity, presumably related to reduced transcriptional activity of the receptor. Prostate carcinogenesis is dependent on androgens. Because shorter CAG repeat lengths are associated with high transcriptional activity of AR, Irvine et al. (1995) proposed that men with shorter repeat lengths will be at higher risk for prostate cancer. Some indirect evidence is consistent with this hypothesis. African-Americans, who have generally shorter CAG repeat lengths in the AR gene, have a higher incidence and mortality rate from prostate cancer (Coetzee and Ross, 1994). Moreover, because of X linkage, a history of disease in a brother carries greater risk than paternal history. Against this background, Giovannucci et al. (1997) conducted within the Physician's Health Study a nested case-controlled study of 587 newly diagnosed cases of prostate cancer detected between 1982 and 1995, and 588 controls without prostate cancer. They found an association between fewer androgen receptor gene CAG repeats and higher risk of total prostate cancer. In particular, a shorter CAG repeat sequence was associated with cancers characterized by extraprostatic extension, distant metastases, or high histologic grade. Variability in the CAG repeat length was not associated with low-grade or low-stage disease. Animal model experiments lend further support to the function of AR. Abel et al. (2001) created transgenic mice that developed many of the motor symptoms of SBMA and had a truncated, highly expanded androgen receptor gene driven by the neurofilament light chain (OMIM Ref. No. 162280) promoter. In addition, transgenic mice created with the prion protein (OMIM Ref. No. 176640) promoter developed widespread neurologic disease, reminiscent of juvenile forms of other polyglutamine diseases. The distribution of neurologic symptoms depended on the expression level and pattern of the promoter used, rather than on specific characteristics of androgen receptor metabolism or function. The transgenic mice that were generated developed neuronal intranuclear inclusions (NIIs), a hallmark of SBMA and the other polyglutamine diseases. These inclusions were ubiquitinated and sequestered molecular chaperones, components of the 26S proteasome (OMIM Ref. No. 604449) and the transcriptional activator CREB-binding protein. Apart from the presence of NIIs, evidence of neuropathology or neurogenic muscle atrophy was absent, suggesting to the authors that the neurologic phenotypes observed were the result of neuronal dysfunction rather than neuronal degeneration.

It is appreciated that the abovementioned animal model for AR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Abel, A.; Walcott, J.; Woods, J.; Duda, J.; Merry, D. E.: Expression of expanded repeat androgen receptor produces neurologic disease in transgenic mice. Hum. Molec. Genet. 10:107-116, 2001; and Irvine, R. A.; Yu, M. C.; Ross, R. K.; Coetzee, G. A.: The CAG and GGC microsatellites of the androgen receptor gene are in linkage disequilibrium in men with prostate cancer. Cancer.

Further studies establishing the function and utilities of AR are found in John Hopkins OMIM database record ID 313700, and in sited publications numbered 8395-8396, 9166-8409, 8413, 8431-8439, 1634, 8440-8449, 9181-8455, 9182, 8805, 9183, 9184, 8809, 9185, 9186-9187, 8811, 9188-8818, 1230, 8819, 9189, 9190-8825, 8229, 8838, 8976-8981, 311 and 8982-8995 listed in the bibliography section hereinbelow, which are also hereby incorporated by reference. Insulin Receptor-related Receptor (INSRR, Accession XM_043563) is another VGAM1971 host target gene. INSRR BINDING SITE is HOST TARGET binding site found in the 3' untranslated region of mRNA encoded by INSRR, corresponding to a HOST TARGET binding site such as BINDING SITE I, BINDING SITE II or BINDING SITE III. Table 2 illustrates the complementarity of the nucleotide sequences of INSRR BINDING SITE, designated SEQ ID:33962, to the nucleotide sequence of VGAM1971 RNA, herein designated VGAM RNA, also designated SEQ ID:4682.

Another function of VGAM1971 is therefore inhibition of Insulin Receptor-related Receptor (INSRR, Accession XM_043563), a gene which phosphorylates the insulin receptor substrates irs-1 and irs-2. Accordingly, utilities of VGAM1971 include diagnosis, prevention and treatment of diseases and clinical conditions associated with INSRR. The function of INSRR has been established by previous studies. Shier and Watt (1989) isolated genomic DNA that appeared to encode a novel receptor that was structurally as similar to the insulin receptor (OMIM Ref. No. 147670) and the IGF1 receptor (OMIM Ref. No. 147370) as the last two are to each other. This similarity suggested that the insulin receptor-related receptor (IRR) mediates the action of a ligand that is identical or very similar to insulin, IGF1, or IGF2. Kurachi et al. (1992) isolated IRR cDNA from rat brain and examined the expression of IRR mRNA in a variety of rat tissues. They demonstrated that, in contrast to the wide distribution of the insulin receptor and the IGF1 receptor mRNAs, the IRR mRNA is expressed preferentially in the kidney, which indicates that it has unique functions as a member of the insulin receptor family. Using genomic DNA encoding part of IRR in Southern blot analysis of DNA from human-mouse cell hybrids, Shier et al. (1990) assigned the INSRR gene to human chromosome 1. By radiation hybrid analysis, Whitmore et al. (1999) mapped the gene to chromosome 1q21-q23

Full details of the abovementioned studies are described in the following publications, the disclosure of which are hereby incorporated by reference:

Shier, P.; Willard, H. F.; Watt, V. M.: Localization of the insulin receptor-related receptor gene to human chromosome 1. Cytogenet. Cell Genet. 54:80-81, 1990; and Whitmore, T. E.; Maurer, M. F.; Day, H. L.; Jelmberg, A. C.; Dasovich, M. M.; Sundborg, L. M.; Burkhead, S. K.; Heipel, M. D.; Madden, K. L.; Kramer, J. M.; Kuijper, J. L.; Xu, W. F.; Ja.

Further studies establishing the function and utilities of INSRR are found in John Hopkins OMIM database record ID 147671, and in sited publications numbered 3210-3213 listed in the bibliography section hereinbelow, which are also hereby incorporated by reference.6-phosphofructo-2-kinase/fructose-2,6-biphosphatase 4 (PFKFB4, Accession NM_004567) is another VGAM1971 host target gene. PFKFB4 BINDING SITE is HOST TARGET binding site found in the 3' untranslated region of mRNA encoded by PFKFB4, corresponding to a HOST TARGET binding site such as BINDING SITE I, BINDING SITE II or BINDING SITE III. Table 2 illustrates the complementarity of the nucleotide sequences of PFKFB4 BINDING SITE, designated SEQ ID:10910, to the nucleotide sequence of VGAM1971 RNA, herein designated VGAM RNA, also designated SEQ ID:4682.

Another function of VGAM1971 is therefore inhibition of 6-phosphofructo-2-kinase/fructose-2,6-biphosphatase 4 (PFKFB4, Accession NM_004567), a gene which catalyzes synthesis and degradation of fructose 2,6-bisphosphate. Accordingly, utilities of VGAM1971 include diagnosis, prevention and treatment of diseases and clinical conditions associated with PFKFB4. The function of PFKFB4 and its association with various diseases and clinical conditions, has been established by previous studies, as described hereinabove with reference to VGAM1316. Phosphomannomutase 2 (PMM2, Accession XM_050755) is another VGAM1971 host target gene. PMM2 BINDING SITE is HOST TARGET binding site found in the 3' untranslated region of mRNA encoded by PMM2, corresponding to a HOST TARGET binding site such as BINDING SITE I, BINDING SITE II or BINDING SITE III. Table 2 illustrates the complementarity of the nucleotide sequences of PMM2 BINDING SITE, designated SEQ ID:35682, to the nucleotide sequence of VGAM1971 RNA, herein designated VGAM RNA, also designated SEQ ID:4682.

Another function of VGAM1971 is therefore inhibition of Phosphomannomutase 2 (PMM2, Accession XM_050755). Accordingly, utilities of VGAM1971 include diagnosis, prevention and treatment of diseases and clinical conditions associated with PMM2. Protein Kinase C, Alpha Binding Protein (PRKCABP, Accession NM_012407) is another VGAM1971 host target gene. PRKCABP BINDING SITE is HOST TARGET binding site found in the 5' untranslated region of mRNA encoded by PRKCABP, corresponding to a HOST TARGET binding site such as BINDING SITE I, BINDING SITE II or BINDING SITE III. Table 2 illustrates the complementarity of the nucleotide sequences of PRKCABP BINDING SITE, designated SEQ ID:14788, to the nucleotide sequence of VGAM1971 RNA, herein designated VGAM RNA, also designated SEQ ID:4682.

Another function of VGAM1971 is therefore inhibition of Protein Kinase C, Alpha Binding Protein (PRKCABP, Accession NM_012407), a gene which may interact with the catalytic domain of protein C kinase. Accordingly, utilities of VGAM1971 include diagnosis, prevention and treatment of diseases and clinical conditions associated with PRKCABP. The function of PRKCABP and its association with various diseases and clinical conditions, has been established by previous studies, as described hereinabove with reference to VGAM1958. Parathyroid Hormone-like Hormone (PTHLH, Accession NM_002820) is another VGAM1971 host target gene. PTHLH BINDING SITE is HOST TARGET binding site found in the 3' untranslated region of mRNA encoded by PTHLH, corresponding to a HOST TARGET binding site such as BINDING SITE I, BINDING SITE II or BINDING SITE III. Table 2 illustrates the complementarity of the nucleotide sequences of PTHLH BINDING SITE, designated SEQ ID:8687, to the nucleotide sequence of VGAM1971 RNA, herein designated VGAM RNA, also designated SEQ ID:4682.

Another function of VGAM1971 is therefore inhibition of Parathyroid Hormone-like Hormone (PTHLH, Accession NM_002820), a gene which plays a physiological role in lactation, possibly as a hormone for the mobilization and/or transfer of calcium to the milk. Accordingly, utilities of VGAM1971 include diagnosis, prevention and treatment of diseases and clinical conditions associated with PTHLH. The function of PTHLH and its association with various diseases and clinical conditions, has been established by previous studies, as described hereinabove with reference to VGAM1590. Chromosome 2 Open Reading Frame 6 (C2orf6, Accession NM_018221) is another VGAM1971 host target gene. C2orf6 BINDING SITE is HOST TARGET binding site found in the 5' untranslated region of mRNA encoded by C2orf6, corresponding to a HOST TARGET binding site such as BINDING SITE I, BINDING SITE II or BINDING SITE III. Table 2 illustrates the complementarity of the nucleotide sequences of C2orf6 BINDING SITE, designated SEQ ID:20142, to the nucleotide sequence of VGAM1971 RNA, herein designated VGAM RNA, also designated SEQ ID:4682.

Another function of VGAM1971 is therefore inhibition of Chromosome 2 Open Reading Frame 6 (C2orf6, Accession NM_018221). Accordingly, utilities of VGAM1971 include diagnosis, prevention and treatment of diseases and clinical conditions associated with C2orf6. DKFZp547I014 (Accession NM_020217) is another VGAM1971 host target gene. DKFZp547I014 BINDING SITE is HOST TARGET binding site found in the 5' untranslated region of mRNA encoded by DKFZp547I014, corresponding to a HOST TARGET binding site such as BINDING SITE I, BINDING SITE II or BINDING SITE III. Table 2 illustrates the complementarity of the nucleotide sequences of DKFZp547I014 BINDING SITE, designated SEQ ID:21467, to the nucleotide sequence of VGAM1971 RNA, herein designated VGAM RNA, also designated SEQ ID:4682.

Another function of VGAM1971 is therefore inhibition of DKFZp547I014 (Accession NM_020217). Accordingly, utilities of VGAM1971 include diagnosis, prevention and treatment of diseases and clinical conditions associated with DKFZp547I014. EDR2 (Accession XM_018136) is another VGAM1971 host target gene. EDR2 BINDING SITE is HOST TARGET binding site found in the 5' untranslated region of mRNA encoded by EDR2, corresponding to a HOST TARGET binding site such as BINDING SITE I, BINDING SITE II or BINDING SITE III. Table 2 illustrates the complementarity of the nucleotide sequences of EDR2 BINDING SITE, designated SEQ ID:30339, to the nucleotide sequence of VGAM1971 RNA, herein designated VGAM RNA, also designated SEQ ID:4682.

Another function of VGAM1971 is therefore inhibition of EDR2 (Accession XM_018136). Accordingly, utilities of VGAM1971 include diagnosis, prevention and treatment of diseases and clinical conditions associated with EDR2. FLJ10700 (Accession NM_018182) is another VGAM1971 host target gene. FLJ10700 BINDING SITE is HOST TAR- GET binding site found in the 3' untranslated region of mRNA encoded by FLJ10700, corresponding to a HOST TARGET binding site such as BINDING SITE I, BINDING SITE II or BINDING SITE III. Table 2 illustrates the complementarity of the nucleotide sequences of FLJ10700 BINDING SITE, designated SEQ ID:20020, to the nucleotide sequence of VGAM1971 RNA, herein designated VGAM RNA, also designated SEQ ID:4682.

Another function of VGAM1971 is therefore inhibition of FLJ10700 (Accession NM_018182). Accordingly, utilities of VGAM1971 include diagnosis, prevention and treatment of diseases and clinical conditions associated with FLJ10700. FLJ11160 (Accession NM_018344) is another VGAM1971 host target gene. FLJ11160 BINDING SITE is HOST TARGET binding site found in the 3' untranslated region of mRNA encoded by FLJ11160, corresponding to a HOST TARGET binding site such as BINDING SITE I, BINDING SITE II or BINDING SITE III. Table 2 illustrates the complementarity of the nucleotide sequences of FLJ11160 BINDING SITE, designated SEQ ID:20353, to the nucleotide sequence of VGAM1971 RNA, herein designated VGAM RNA, also designated SEQ ID:4682.

Another function of VGAM1971 is therefore inhibition of FLJ11160 (Accession NM_018344). Accordingly, utilities of VGAM1971 include diagnosis, prevention and treatment of diseases and clinical conditions associated with FLJ11160. FLJ12270 (Accession NM_030581) is another VGAM1971 host target gene. FLJ12270 BINDING SITE is HOST TARGET binding site found in the 5' untranslated region of mRNA encoded by FLJ12270, corresponding to a HOST TARGET binding site such as BINDING SITE I, BINDING SITE II or BINDING SITE III. Table 2 illustrates the complementarity of the nucleotide sequences of FLJ12270 BINDING SITE, designated SEQ ID:24954, to the nucleotide sequence of VGAM1971 RNA, herein designated VGAM RNA, also designated SEQ ID:4682.

Another function of VGAM1971 is therefore inhibition of FLJ12270 (Accession NM_030581). Accordingly, utilities of VGAM1971 include diagnosis, prevention and treatment of diseases and clinical conditions associated with FLJ12270. FLJ12294 (Accession NM_025100) is another VGAM1971 host target gene. FLJ12294 BINDING SITE is HOST TARGET binding site found in the 5' untranslated region of mRNA encoded by FLJ12294, corresponding to a HOST TARGET binding site such as BINDING SITE I, BINDING SITE II or BINDING SITE III. Table 2 illustrates the complementarity of the nucleotide sequences of FLJ12294 BINDING SITE, designated SEQ ID:24746, to the nucleotide sequence of VGAM1971 RNA, herein designated VGAM RNA, also designated SEQ ID:4682.

Another function of VGAM1971 is therefore inhibition of FLJ12294 (Accession NM_025100). Accordingly, utilities of VGAM1971 include diagnosis, prevention and treatment of diseases and clinical conditions associated with FLJ12294. FLJ14297 (Accession NM_024903) is another VGAM1971 host target gene. FLJ14297 BINDING SITE is HOST TARGET binding site found in the 3' untranslated region of mRNA encoded by FLJ14297, corresponding to a HOST TARGET binding site such as BINDING SITE I, BINDING SITE II or BINDING SITE III. Table 2 illustrates the complementarity of the nucleotide sequences of FLJ14297 BINDING SITE, designated SEQ ID:24392, to the nucleotide sequence of VGAM1971 RNA, herein designated VGAM RNA, also designated SEQ ID:4682.

Another function of VGAM1971 is therefore inhibition of FLJ14297 (Accession NM_024903). Accordingly, utilities of VGAM1971 include diagnosis, prevention and treatment of diseases and clinical conditions associated with FLJ14297. FLJ22329 (Accession NM_024656) is another VGAM1971 host target gene. FLJ22329 BINDING SITE is HOST TARGET binding site found in the 3' untranslated region of mRNA encoded by FLJ22329, corresponding to a HOST TARGET binding site such as BINDING SITE I, BINDING SITE II or BINDING SITE III. Table 2 illustrates the complementarity of the nucleotide sequences of FLJ22329 BINDING SITE, designated SEQ ID:23958, to the nucleotide sequence of VGAM1971 RNA, herein designated VGAM RNA, also designated SEQ ID:4682.

Another function of VGAM1971 is therefore inhibition of FLJ22329 (Accession NM_024656). Accordingly, utilities of VGAM1971 include diagnosis, prevention and treatment of diseases and clinical conditions associated with FLJ22329. IKKE (Accession NM_014002) is another VGAM1971 host target gene. IKKE BINDING SITE is HOST TARGET binding site found in the 5' untranslated region of mRNA encoded by IKKE, corresponding to a HOST TARGET binding site such as BINDING SITE I, BINDING SITE II or BINDING SITE III. Table 2 illustrates the complementarity of the nucleotide sequences of IKKE BINDING SITE, designated SEQ ID:15202, to the nucleotide sequence of VGAM1971 RNA, herein designated VGAM RNA, also designated SEQ ID:4682.

Another function of VGAM1971 is therefore inhibition of IKKE (Accession NM_014002). Accordingly, utilities of VGAM1971 include diagnosis, prevention and treatment of diseases and clinical conditions associated with IKKE. KIAA1344 (Accession XM_051699) is another VGAM1971 host target gene. KIAA1344 BINDING SITE is HOST TARGET binding site found in the 3" untranslated region of mRNA encoded by KIAA1344, corresponding to a HOST TARGET binding site such as BINDING SITE I, BINDING SITE II or BINDING SITE III. Table 2 illustrates the complementarity of the nucleotide sequences of KIAA1344 BINDING SITE, designated SEQ ID:35874, to the nucleotide sequence of VGAM1971 RNA, herein designated VGAM RNA, also designated SEQ ID:4682.

Another function of VGAM1971 is therefore inhibition of KIAA1344 (Accession XM_051699). Accordingly, utilities of VGAM1971 include diagnosis, prevention and treatment of diseases and clinical conditions associated with KIAA1344. MAP (Accession NM_022818) is another VGAM1971 host target gene. MAP BINDING SITE is HOST TARGET binding site found in the 3' untranslated region of mRNA encoded by MAP, corresponding to a HOST TARGET binding site such as BINDING SITE I, BINDING SITE II or BINDING SITE III. Table 2 illustrates the complementarity of the nucleotide sequences of MAP BINDING SITE, designated SEQ ID:23097, to the nucleotide sequence of VGAM1971 RNA, herein designated VGAM RNA, also designated SEQ ID:4682.

Another function of VGAM1971 is therefore inhibition of MAP (Accession NM_022818). Accordingly, utilities of VGAM1971 include diagnosis, prevention and treatment of diseases and clinical conditions associated with MAP. MGC13061 (Accession NM_032322) is another VGAM1971 host target gene. MGC13061 BINDING SITE is HOST TARGET binding site found in the 3' untranslated region of mRNA encoded by MGC13061, corresponding to a HOST TARGET binding site such as BINDING SITE I, BINDING SITE II or BINDING SITE III. Table 2 illustrates the complementarity of the nucleotide sequences of MGC13061 BINDING SITE, designated SEQ ID:26130, to the nucleotide sequence of VGAM1971 RNA, herein designated VGAM RNA, also designated SEQ ID:4682.

Another function of VGAM1971 is therefore inhibition of MGC13061 (Accession NM_032322). Accordingly, utilities of VGAM1971 include diagnosis, prevention and treatment of diseases and clinical conditions associated with MGC13061. MGC1842 (Accession XM_037797) is another VGAM1971 host target gene. MGC1842 BINDING SITE is HOST TARGET binding site found in the 3' untranslated region of mRNA encoded by MGC1842, corresponding to a HOST TARGET binding site such as BINDING SITE I, BINDING SITE II or BINDING SITE III. Table 2 illustrates the complementarity of the nucleotide sequences of MGC1842 BINDING SITE, designated SEQ ID:32688, to the nucleotide sequence of VGAM1971 RNA, herein designated VGAM RNA, also designated SEQ ID:4682.

Another function of VGAM1971 is therefore inhibition of MGC1842 (Accession XM_037797). Accordingly, utilities of VGAM1971 include diagnosis, prevention and treatment of diseases and clinical conditions associated with MGC1842. PRO0943 (Accession NM_018568) is another VGAM1971 host target gene. PRO0943 BINDING SITE is HOST TARGET binding site found in the 5' untranslated region of mRNA encoded by PRO0943, corresponding to a HOST TARGET binding site such as BINDING SITE I, BINDING SITE II or BINDING SITE III. Table 2 illustrates the complementarity of the nucleotide sequences of PRO0943 BINDING SITE, designated SEQ ID:20651, to the nucleotide sequence of VGAM1971 RNA, herein designated VGAM RNA, also designated SEQ ID:4682.

Another function of VGAM1971 is therefore inhibition of PRO0943 (Accession NM_018568). Accordingly, utilities of VGAM1971 include diagnosis, prevention and treatment of diseases and clinical conditions associated with PRO0943. SEC14-like 1 (S. cerevisiae) (SEC14L1, Accession NM_003003) is another VGAM1971 host target gene. SEC14L1 BINDING SITE is HOST TARGET binding site found in the 3' untranslated region of mRNA encoded by SEC14L1, corresponding to a HOST TARGET binding site such as BINDING SITE I, BINDING SITE II or BINDING SITE III. Table 2 illustrates the complementarity of the nucleotide sequences of SEC14L1 BINDING SITE, designated SEQ ID:8903, to the nucleotide sequence of VGAM1971 RNA, herein designated VGAM RNA, also designated SEQ ID:4682.

Another function of VGAM1971 is therefore inhibition of SEC14-like 1 (S. cerevisiae) (SEC14L1, Accession NM_003003). Accordingly, utilities of VGAM1971 include diagnosis, prevention and treatment of diseases and clinical conditions associated with SEC14L1. Solute Carrier Family 26, Member 9 (SLC26A9, Accession NM_052934) is another VGAM1971 host target gene. SLC26A9 BINDING SITE1 and SLC26A9 BINDING SITE2 are HOST TARGET binding sites found in untranslated regions of mRNA encoded by SLC26A9, corresponding to HOST TARGET binding sites such as BINDING SITE I, BINDING SITE II or BINDING SITE III. Table 2 illustrates the complementarity of the nucleotide sequences of SLC26A9 BINDING SITE1 and SLC26A9 BINDING SITE2, designated SEQ ID:27494 and SEQ ID:28632 respectively, to the nucleotide sequence of VGAM1971 RNA, herein designated VGAM RNA, also designated SEQ ID:4682.

Another function of VGAM1971 is therefore inhibition of Solute Carrier Family 26, Member 9 (SLC26A9, Accession NM_052934). Accordingly, utilities of VGAM1971 include diagnosis, prevention and treatment of diseases and clinical conditions associated with SLC26A9. Zinc Finger Protein 387 (ZNF387, Accession NM_014682) is another VGAM1971 host target gene. ZNF387 BINDING SITE is HOST TARGET binding site found in the 5' untranslated region of mRNA encoded by ZNF387, corresponding to a HOST TARGET binding site such as BINDING SITE I, BINDING SITE II or BINDING SITE III. Table 2 illustrates the complementarity of the nucleotide sequences of ZNF387 BINDING SITE, designated SEQ ID:16180, to the nucleotide sequence of VGAM1971 RNA, herein designated VGAM RNA, also designated SEQ ID:4682.

Another function of VGAM1971 is therefore inhibition of Zinc Finger Protein 387 (ZNF387, Accession NM_014682). Accordingly, utilities of VGAM1971 include diagnosis, prevention and treatment of diseases and clinical conditions associated with ZNF387. LOC153688 (Accession XM_098416) is another VGAM1971 host target gene. LOC153688 BINDING SITE is HOST TARGET binding site found in the 3' untranslated region of mRNA encoded by LOC153688, corresponding to a HOST TARGET binding site such as BINDING SITE I, BINDING SITE II or BINDING SITE III. Table 2 illustrates the complementarity of the nucleotide sequences of LOC153688 BINDING SITE, designated SEQ ID:41660, to the nucleotide sequence of VGAM1971 RNA, herein designated VGAM RNA, also designated SEQ ID:4682.

Another function of VGAM1971 is therefore inhibition of LOC153688 (Accession XM_098416). Accordingly, utilities of VGAM1971 include diagnosis, prevention and treatment of diseases and clinical conditions associated with LOC153688. LOC154428 (Accession XM_098528) is another VGAM1971 host target gene. LOC154428 BINDING SITE is HOST TARGET binding site found in the 5' untranslated region of mRNA encoded by LOC154428, corresponding to a HOST TARGET binding site such as BINDING SITE I, BINDING SITE II or BINDING SITE III. Table 2 illustrates the complementarity of the nucleotide sequences of LOC154428 BINDING SITE, designated SEQ ID:41703, to the nucleotide sequence of VGAM1971 RNA, herein designated VGAM RNA, also designated SEQ ID:4682.

Another function of VGAM1971 is therefore inhibition of LOC154428 (Accession XM_098528). Accordingly, utilities of VGAM1971 include diagnosis, prevention and treatment of diseases and clinical conditions associated with LOC154428. LOC157273 (Accession XM_098743) is another VGAM1971 host target gene. LOC157273 BINDING SITE is HOST TARGET binding site found in the 3' untranslated region of mRNA encoded by LOC157273, corresponding to a HOST TARGET binding site such as BINDING SITE I, BINDING SITE II or BINDING SITE III. Table 2 illustrates the complementarity of the nucleotide sequences of LOC157273 BINDING SITE, designated SEQ ID:41786, to the nucleotide sequence of VGAM1971 RNA, herein designated VGAM RNA, also designated SEQ ID:4682.

Another function of VGAM1971 is therefore inhibition of LOC157273 (Accession XM_098743). Accordingly, utilities of VGAM1971 include diagnosis, prevention and treatment of diseases and clinical conditions associated with LOC157273. LOC163255 (Accession XM_092121) is another VGAM1971 host target gene. LOC163255 BINDING SITE is HOST TARGET binding site found in the 5' untranslated region of mRNA encoded by LOC163255, corresponding to a HOST TARGET binding site such as BINDING SITE I, BINDING SITE II or BINDING SITE III. Table 2 illustrates the complementarity of the nucleotide sequences of LOC163255 BINDING SITE, designated SEQ ID:40109, to the nucleotide sequence of VGAM1971 RNA, herein designated VGAM RNA, also designated SEQ ID:4682.

Another function of VGAM1971 is therefore inhibition of LOC163255 (Accession XM_092121). Accordingly, utilities of VGAM1971 include diagnosis, prevention and treatment of diseases and clinical conditions associated with LOC163255. LOC220020 (Accession XM_167821) is another VGAM1971 host target gene. LOC220020 BINDING SITE is HOST TARGET binding site found in the 3' untranslated region of mRNA encoded by LOC220020, corresponding to a HOST TARGET binding site such as BINDING SITE I, BINDING SITE II or BINDING SITE III. Table 2 illustrates the complementarity of the nucleotide sequences of LOC220020 BINDING SITE, designated SEQ ID:44867, to the nucleotide sequence of VGAM1971 RNA, herein designated VGAM RNA, also designated SEQ ID:4682.

Another function of VGAM1971 is therefore inhibition of LOC220020 (Accession XM_167821). Accordingly, utilities of VGAM1971 include diagnosis, prevention and treatment of diseases and clinical conditions associated with LOC220020. LOC91266 (Accession XM_037268) is another VGAM1971 host target gene. LOC91266 BINDING SITE is HOST TARGET binding site found in the 5' untranslated region of mRNA encoded by LOC91266, corresponding to a HOST TARGET binding site such as BINDING SITE I, BINDING SITE II or BINDING SITE III. Table 2 illustrates the complementarity of the nucleotide sequences of LOC91266 BINDING SITE, designated SEQ ID:32604, to the nucleotide sequence of VGAM1971 RNA, herein designated VGAM RNA, also designated SEQ ID:4682.

Another function of VGAM1971 is therefore inhibition of LOC91266 (Accession XM_037268). Accordingly, utilities of VGAM1971 include diagnosis, prevention and treatment of diseases and clinical conditions associated with LOC91266. FIG. 1 further provides a conceptual description of a novel bioinformatically detected viral gene of the present invention, referred to here as Viral Genomic Address Messenger 1972 (VGAM1972) viral gene, which modulates expression of respective host target genes thereof, the function and utility of which host target genes is known in the art.

VGAM1972 is a novel bioinformatically detected regulatory, non protein coding, viral micro RNA (miRNA) gene. The method by which VGAM1972 was detected is described hereinabove with reference to FIGS. 1-8.

VGAM1972 gene, herein designated VGAM GENE, is a viral gene contained in the genome of Bovine Herpesvirus 4. VGAM1972 host target gene, herein designated VGAM HOST TARGET GENE, is a human gene contained in the human genome.

VGAM1972 gene encodes a VGAM1972 precursor RNA, herein designated VGAM PRECURSOR RNA. Similar to other miRNA genes, and unlike most ordinary genes, VGAM1972 precursor RNA does not encode a protein. A nucleotide sequence identical or highly similar to the nucleotide sequence of VGAM1972 precursor RNA is designated SEQ ID:1958, and is provided hereinbelow with reference to the sequence listing part. Nucleotide sequence SEQ ID:1958 is located at position 10062 relative to the genome of Bovine Herpesvirus 4.

VGAM1972 precursor RNA folds onto itself, forming VGAM1972 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1972 folded precursor RNA into VGAM1972 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM1972 RNA is designated SEQ ID:4683, and is provided hereinbelow with reference to the sequence listing part.

VGAM1972 host target gene, herein designated VGAM HOST TARGET GENE, encodes a corresponding messenger RNA, VGAM1972 host target RNA, herein designated VGAM HOST TARGET RNA. VGAM1972 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1972 RNA, herein designated VGAM RNA, binds complementarily to one or more host target binding sites located in untranslated regions of VGAM1972 host target RNA, herein designated VGAM HOST TARGET RNA. This complementary binding is due to the fact that the nucleotide sequence of VGAM1972 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1972 RNA, herein designated VGAM RNA, may have a different number of host target binding sites in untranslated regions of a VGAM1972 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1972 RNA, herein designated VGAM RNA, to host target binding sites on VGAM1972 host target RNA, herein designated VGAM HOST TARGET RNA, such as BINDING SITE I, BINDING SITE II and BINDING SITE III, inhibits translation of VGAM1972 host target RNA into VGAM1972 host target protein, herein designated VGAM HOST TARGET PROTEIN. VGAM host target protein is therefore outlined by a broken line.

It is appreciated that VGAM1972 host target gene, herein designated VGAM HOST TARGET GENE, in fact represents a plurality of VGAM1972 host target genes. The mRNA of each one of this plurality of VGAM1972 host target genes comprises one or more host target binding sites, each having a nucleotide sequence which is at least partly complementary to VGAM1972 RNA, herein designated VGAM RNA, and which when bound by VGAM1972 RNA causes inhibition of translation of respective one or more VGAM1972 host target proteins.

It is further appreciated by one skilled in the art that the mode of translational inhibition illustrated by FIG. 1 with specific reference to translational inhibition exerted by VGAM1972 gene, herein designated VGAM GENE, on one or more VGAM1972 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1972 is inhibition of expression of host target genes, as part of a novel viral mechanism of attacking a host. Accordingly, utilities of VGAM1972 include diagnosis, prevention and treatment of viral infection by Bovine Herpesvirus 4. Specific functions, and accordingly utilities, of VGAM1972 correlate with, and may be deduced from, the identity of the host target genes which VGAM1972 binds and inhibits, and the function of these host target genes, as elaborated hereinbelow.

Nucleotide sequences of the VGAM1972 precursor RNA, herein designated VGAM PRECURSOR RNA, and of the 'diced' VGAM1972 RNA, herein designated VGAM RNA, and a schematic representation of the secondary folding of VGAM1972 folded precursor RNA, herein designated VGAM FOLDED PRECURSOR RNA, of VGAM1972 are further described hereinbelow with reference to Table 1.

Nucleotide sequences of host target binding sites, such as BINDING SITE-I, BINDING SITE-II and BINDING SITE-III of FIG. 1, found on VGAM1972 host target RNA, and schematic representation of the complementarity of each of these host target binding sites to VGAM1972 RNA, herein designated VGAM RNA, are described hereinbelow with reference to Table 2.

As mentioned hereinabove with reference to FIG. 1, a function of VGAM1972 gene, herein designated VGAM is inhibition of expression of VGAM1972 target genes. It is appreciated that specific functions, and accordingly utilities, of VGAM1972 correlate with, and may be deduced from, the identity of the target genes which VGAM1972 binds and inhibits, and the function of these target genes, as elaborated hereinbelow.

B-cell CLL/lymphoma 10 (BCL10, Accession NM_003921) is a VGAM1972 host target gene. BCL10 BINDING SITE is HOST TARGET binding site found in the 3' untranslated region of mRNA encoded by BCL10, corresponding to a HOST TARGET binding site such as BINDING SITE I, BINDING SITE II or BINDING SITE III. Table 2 illustrates the complementarity of the nucleotide sequences of BCL10 BINDING SITE, designated SEQ ID:10009, to the nucleotide sequence of VGAM1972 RNA, herein designated VGAM RNA, also designated SEQ ID:4683.

A function of VGAM1972 is therefore inhibition of B-cell CLL/lymphoma 10 (BCL10, Accession NM_003921), a gene which is a positive regulator of lymphocyte proliferation, NF-kappaB activator. Accordingly, utilities of VGAM1972 include diagnosis, prevention and treatment of diseases and clinical conditions associated with BCL10. The function of BCL10 and its association with various diseases and clinical conditions, has been established by previous studies, as described hereinabove with reference to VGAM433. Golgi Complex Associated Protein 1, 60 kDa (GOCAP1, Accession NM_022735) is another VGAM1972 host target gene. GOCAP1 BINDING SITE is HOST TARGET binding site found in the 3' untranslated region of mRNA encoded by GOCAP1, corresponding to a HOST TARGET binding site such as BINDING SITE I, BINDING SITE II or BINDING SITE III. Table 2 illustrates the complementarity of the nucleotide sequences of GOCAP1 BINDING SITE, designated SEQ ID:22939, to the nucleotide sequence of VGAM1972 RNA, herein designated VGAM RNA, also designated SEQ ID:4683.

Another function of VGAM1972 is therefore inhibition of Golgi Complex Associated Protein 1, 60 kDa (GOCAP1, Accession NM_022735). Accordingly, utilities of VGAM1972 include diagnosis, prevention and treatment of diseases and clinical conditions associated with GOCAP1. G Protein-coupled Receptor 86 (GPR86, Accession NM_023914) is another VGAM1972 host target gene. GPR86 BINDING SITE is HOST TARGET binding site found in the 3' untranslated region of mRNA encoded by GPR86, corresponding to a HOST TARGET binding site such as BINDING SITE I, BINDING SITE II or BINDING SITE III. Table 2 illustrates the complementarity of the nucleotide sequences of GPR86 BINDING SITE, designated SEQ ID:23387, to the nucleotide sequence of VGAM1972 RNA, herein designated VGAM RNA, also designated SEQ ID:4683.

Another function of VGAM1972 is therefore inhibition of G Protein-coupled Receptor 86 (GPR86, Accession NM_023914), a gene which plays a role in cell communication. Accordingly, utilities of VGAM1972 include diagnosis, prevention and treatment of diseases and clinical conditions associated with GPR86. The function of GPR86 has been established by previous studies. By batch EST database searching, Wittenberger et al. (2001) identified a cDNA encoding GPR86. The deduced 333-amino acid protein lacks a leader peptide but possesses a DRF motif. Northern blot analysis revealed wide expression of a 2.9-kb GPR86 transcript in spleen, with weaker expression in placenta, leukocytes, and brain. In brain, expression was strongest in substantia nigra, thalamus, and medulla. Communi et al. (2001) determined that GPR86 shows a high affinity for ADP through pharmacologic characterization of GPR86-transfected human astrocytoma cells and CHO cells. Stimulation of GPR86 by ADP in stably expressing CHO cells resulted in inhibition of adenylyl cyclase and the phosphorylation of the MAP kinases Erk1 (OMIM Ref. No. 601795) and Erk2 (OMIM Ref. No. 176948). Communi et al. (2001) noted that inhibition of adenylyl cyclase and phosphorylation of the MAP kinases are transduction mechanisms that involve Gi proteins (see OMIM Ref. No. 139310).

Full details of the abovementioned studies are described in the following publications, the disclosure of which are hereby incorporated by reference:

Communi, D.; Gonzalez, N. S.; Detheux, M.; Brezillon, S.; Lannoy, V.; Parmentier, M.; Boeynaems, J.-M.: Identification of a novel human ADP receptor coupled to G(i). J. Biol. Chem. 276:41479-41485, 2001; and Wittenberger, T.; Schaller, H. C.; Hellebrand, S.: An expressed sequence tag (EST) data mining strategy succeeding in the discovery of new G-protein coupled receptors. J. Molec. Biol.

Further studies establishing the function and utilities of GPR86 are found in John Hopkins OMIM database record ID 606380, and in sited publications numbered 647 and 10637 listed in the bibliography section hereinbelow, which are also hereby incorporated by reference. Nuclear Receptor Subfamily 3, Group C, Member 1 (glucocorticoid receptor) (NR3C1, Accession NM_000176) is another VGAM1972 host target gene. NR3C1 BINDING SITE is HOST TARGET binding site found in the 3' untranslated region of mRNA encoded by NR3C1, corresponding to a HOST TARGET binding site such as BINDING SITE I, BINDING SITE II or BINDING SITE III. Table 2 illustrates the complementarity of the nucleotide sequences of NR3C1 BINDING SITE, designated SEQ ID:5685, to the nucleotide sequence of VGAM1972 RNA, herein designated VGAM RNA, also designated SEQ ID:4683.

Another function of VGAM1972 is therefore inhibition of Nuclear Receptor Subfamily 3, Group C, Member 1 (glucocorticoid receptor) (NR3C1, Accession NM_000176). Accordingly, utilities of VGAM1972 include diagnosis, prevention and treatment of diseases and clinical conditions associated with NR3C1. Calneuron 1 (CALN1, Accession NM_031468) is another VGAM1972 host target gene. CALN1 BINDING SITE is HOST TARGET binding site found in the 3' untranslated region of mRNA encoded by CALN1, corresponding to a HOST TARGET binding site such as BINDING SITE I, BINDING SITE II or BINDING SITE III. Table 2 illustrates the complementarity of the nucleotide sequences of CALN1 BINDING SITE, designated SEQ ID:25515, to the nucleotide sequence of VGAM1972 RNA, herein designated VGAM RNA, also designated SEQ ID:4683.

Another function of VGAM1972 is therefore inhibition of Calneuron 1 (CALN1, Accession NM_031468). Accordingly, utilities of VGAM1972 include diagnosis, prevention and treatment of diseases and clinical conditions associated with CALN1. Isopentenyl-diphosphate Delta Isomerase (IDI1, Accession XM_040272) is another VGAM1972 host target gene. IDI1 BINDING SITE is HOST TARGET binding site found in the 3' untranslated region of mRNA encoded by IDI1, corresponding to a HOST TARGET binding site such as BINDING SITE I, BINDING SITE II or BINDING SITE III. Table 2 illustrates the complementarity of the nucleotide sequences of IDI1 BINDING SITE, designated SEQ ID:33285, to the nucleotide sequence of VGAM1972 RNA, herein designated VGAM RNA, also designated SEQ ID:4683.

Another function of VGAM1972 is therefore inhibition of Isopentenyl-diphosphate Delta Isomerase (IDI1, Accession XM_040272). Accordingly, utilities of VGAM1972 include diagnosis, prevention and treatment of diseases and clinical conditions associated with IDI1. FIG. 1 further provides a conceptual description of a novel bioinformatically detected viral gene of the present invention, referred to here as Viral Genomic Address Messenger 1973 (VGAM1973) viral gene, which modulates expression of respective host target genes thereof, the function and utility of which host target genes is known in the art.

VGAM1973 is a novel bioinformatically detected regulatory, non protein coding, viral micro RNA (miRNA) gene. The method by which VGAM1973 was detected is described hereinabove with reference to FIGS. 1-8.

VGAM1973 gene, herein designated VGAM GENE, is a viral gene contained in the genome of Bovine Herpesvirus 4. VGAM1973 host target gene, herein designated VGAM HOST TARGET GENE, is a human gene contained in the human genome.

VGAM1973 gene encodes a VGAM1973 precursor RNA, herein designated VGAM PRECURSOR RNA. Similar to other miRNA genes, and unlike most ordinary genes, VGAM1973 precursor RNA does not encode a protein. A nucleotide sequence identical or highly similar to the nucleotide sequence of VGAM1973 precursor RNA is designated SEQ ID:1959, and is provided hereinbelow with reference to the sequence listing part. Nucleotide sequence SEQ ID:1959 is located at position 5233 relative to the genome of Bovine Herpesvirus 4.

VGAM1973 precursor RNA folds onto itself, forming VGAM1973 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1973 folded precursor RNA into VGAM1973 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1973 RNA is designated SEQ ID:4684, and is provided hereinbelow with reference to the sequence listing part.

VGAM1973 host target gene, herein designated VGAM HOST TARGET GENE, encodes a corresponding messenger RNA, VGAM1973 host target RNA, herein designated VGAM HOST TARGET RNA. VGAM1973 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1973 RNA, herein designated VGAM RNA, binds complementarily to one or more host target binding sites located in untranslated regions of VGAM1973 host target RNA, herein designated VGAM HOST TARGET RNA. This complementary binding is due to the fact that the nucleotide sequence of VGAM1973 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1973 RNA, herein designated VGAM RNA, may have a different number of host target binding sites in untranslated regions of a VGAM1973 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1973 RNA, herein designated VGAM RNA, to host target binding sites on VGAM1973 host target RNA, herein designated VGAM HOST TARGET RNA, such as BINDING SITE I, BINDING SITE II and BINDING SITE III, inhibits translation of VGAM1973 host target RNA into VGAM1973 host target protein, herein designated VGAM HOST TARGET PROTEIN. VGAM host target protein is therefore outlined by a broken line.

It is appreciated that VGAM1973 host target gene, herein designated VGAM HOST TARGET GENE, in fact represents a plurality of VGAM1973 host target genes. The mRNA of each one of this plurality of VGAM1973 host target genes comprises one or more host target binding sites, each having a nucleotide sequence which is at least partly complementary to VGAM1973 RNA, herein designated VGAM RNA, and which when bound by VGAM1973 RNA causes inhibition of translation of respective one or more VGAM1973 host target proteins.

It is further appreciated by one skilled in the art that the mode of translational inhibition illustrated by FIG. 1 with specific reference to translational inhibition exerted by VGAM1973 gene, herein designated VGAM GENE, on one or more VGAM1973 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1973 is inhibition of expression of host target genes, as part of a novel viral mechanism of attacking a host. Accordingly, utilities of VGAM1973 include diagnosis, prevention and treatment of viral infection by Bovine Herpesvirus 4. Specific functions, and accordingly utilities, of VGAM1973 correlate with, and may be deduced from, the identity of the host target genes which VGAM1973 binds and inhibits, and the function of these host target genes, as elaborated hereinbelow.

Nucleotide sequences of the VGAM1973 precursor RNA, herein designated VGAM PRECURSOR RNA, and of the 'diced' VGAM1973 RNA, herein designated VGAM RNA, and a schematic representation of the secondary folding of VGAM1973 folded precursor RNA, herein designated VGAM FOLDED PRECURSOR RNA, of VGAM1973 are further described hereinbelow with reference to Table 1.

Nucleotide sequences of host target binding sites, such as BINDING SITE-I, BINDING SITE-II and BINDING SITE-III of FIG. 1, found on VGAM1973 host target RNA, and schematic representation of the complementarity of each of these host target binding sites to VGAM1973 RNA, herein designated VGAM RNA, are described hereinbelow with reference to Table 2.

As mentioned hereinabove with reference to FIG. 1, a function of VGAM1973 gene, herein designated VGAM is inhibition of expression of VGAM1973 target genes. It is appreciated that specific functions, and accordingly utilities, of VGAM1973 correlate with, and may be deduced from, the identity of the target genes which VGAM1973 binds and inhibits, and the function of these target genes, as elaborated hereinbelow.

V-abl Abelson Murine Leukemia Viral Oncogene Homolog 1 (ABL1, Accession NM_005157) is a VGAM1973 host target gene. ABL1 BINDING SITE1 and ABL1 BINDING SITE2 are HOST TARGET binding sites found in untranslated regions of mRNA encoded by ABL1, corresponding to HOST TARGET binding sites such as BINDING SITE I, BINDING SITE II or BINDING SITE III. Table 2 illustrates the complementarity of the nucleotide sequences of ABL1 BINDING SITE1 and ABL1 BINDING SITE2, designated SEQ ID:11638 and SEQ ID:14227 respectively, to the nucleotide sequence of VGAM1973 RNA, herein designated VGAM RNA, also designated SEQ ID:4684.

A function of VGAM1973 is therefore inhibition of V-abl Abelson Murine Leukemia Viral Oncogene Homolog 1 (ABL1, Accession NM_005157). Accordingly, utilities of VGAM1973 include diagnosis, prevention and treatment of diseases and clinical conditions associated with ABL1. Kinesin-like 3 (KNSL3, Accession NM_005355) is another VGAM1973 host target gene. KNSL3 BINDING SITE1 and KNSL3 BINDING SITE2 are HOST TARGET binding sites found in untranslated regions of mRNA encoded by KNSL3, corresponding to HOST TARGET binding sites such as BINDING SITE I, BINDING SITE II or BINDING SITE III. Table 2 illustrates the complementarity of the nucleotide sequences of KNSL3 BINDING SITE1 and KNSL3 BINDING SITE2, designated SEQ ID:11823 and SEQ ID:24961 respectively, to the nucleotide sequence of VGAM1973 RNA, herein designated VGAM RNA, also designated SEQ ID:4684.

Another function of VGAM1973 is therefore inhibition of Kinesin-like 3 (KNSL3, Accession NM_005355), a gene which may function in intracellular transport and mitosis. Accordingly, utilities of VGAM1973 include diagnosis, prevention and treatment of diseases and clinical conditions associated with KNSL3. The function of KNSL3 and its association with various diseases and clinical conditions, has been established by previous studies, as described hereinabove with reference to VGAM1958. Cellular Repressor of E1A-stimulated Genes (CREG, Accession NM_003851) is another VGAM1973 host target gene. CREG BINDING SITE is HOST TARGET binding site found in the 3' untranslated region of mRNA encoded by CREG, corresponding to a HOST TARGET binding site such as BINDING SITE I, BINDING SITE II or BINDING SITE III. Table 2 illustrates the complementarity of the nucleotide sequences of CREG BINDING SITE, designated SEQ ID:9947, to the nucleotide sequence of VGAM1973 RNA, herein designated VGAM RNA, also designated SEQ ID:4684.

Another function of VGAM1973 is therefore inhibition of Cellular Repressor of E1A-stimulated Genes (CREG, Accession NM_003851). Accordingly, utilities of VGAM1973 include diagnosis, prevention and treatment of diseases and clinical conditions associated with CREG. FLJ22794 (Accession XM_166220) is another VGAM1973 host target gene. FLJ22794 BINDING SITE is HOST TARGET binding site found in the 5' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44027, to the nucleotide sequence of VGAM1973 RNA, herein designated VGAM RNA, also designated SEQ ID:4684.

Another function of VGAM1973 is therefore inhibition of FLJ22794 (Accession XM_166220). Accordingly, utilities of VGAM1973 include diagnosis, prevention and treatment of diseases and clinical conditions associated with FLJ22794. KIAA0522 (Accession XM_050404) is another VGAM1973 host target gene. KIAA0522 BINDING SITE is HOST TARGET binding site found in the 3' untranslated region of mRNA encoded by KIAA0522, corresponding to a HOST TARGET binding site such as BINDING SITE I, BINDING SITE II or BINDING SITE III. Table 2 illustrates the complementarity of the nucleotide sequences of KIAA0522 BINDING SITE, designated SEQ ID:35622, to the nucleotide sequence of VGAM1973 RNA, herein designated VGAM RNA, also designated SEQ ID:4684.

Another function of VGAM1973 is therefore inhibition of KIAA0522 (Accession XM_050404). Accordingly, utilities of VGAM1973 include diagnosis, prevention and treatment of diseases and clinical conditions associated with KIAA0522. KIAA0532 (Accession XM_047659) is another VGAM1973 host target gene. KIAA0532 BINDING SITE is HOST TARGET binding site found in the 3' untranslated region of mRNA encoded by KIAA0532, corresponding to a HOST TARGET binding site such as BINDING SITE I, BINDING SITE II or BINDING SITE III. Table 2 illustrates the complementarity of the nucleotide sequences of KIAA0532 BINDING SITE, designated SEQ ID:35023, to the nucleotide sequence of VGAM1973 RNA, herein designated VGAM RNA, also designated SEQ ID:4684.

Another function of VGAM1973 is therefore inhibition of KIAA0532 (Accession XM_047659). Accordingly, utilities of VGAM1973 include diagnosis, prevention and treatment of diseases and clinical conditions associated with KIAA0532. MIL1 (Accession NM_015367) is another VGAM1973 host target gene. MIL1 BINDING SITE is HOST TARGET binding site found in the 3' untranslated region of mRNA encoded by MIL1, corresponding to a HOST TARGET binding site such as BINDING SITE I, BINDING SITE II or BINDING SITE III. Table 2 illustrates the complementarity of the nucleotide sequences of MIL1 BINDING SITE, designated SEQ ID:17666, to the nucleotide sequence of VGAM1973 RNA, herein designated VGAM RNA, also designated SEQ ID:4684.

Another function of VGAM1973 is therefore inhibition of MIL1 (Accession NM_015367). Accordingly, utilities of VGAM1973 include diagnosis, prevention and treatment of diseases and clinical conditions associated with MIL1. FIG. 1 further provides a conceptual description of a novel bioinformatically detected viral gene of the present invention, referred to here as Viral Genomic Address Messenger 1974 (VGAM1974) viral gene, which modulates expression of respective host target genes thereof, the function and utility of which host target genes is known in the art.

VGAM1974 is a novel bioinformatically detected regulatory, non protein coding, viral micro RNA (miRNA) gene. The method by which VGAM1974 was detected is described hereinabove with reference to FIGS. 1-8.

VGAM1974 gene, herein designated VGAM GENE, is a viral gene contained in the genome of Bovine Herpesvirus 4. VGAM1974 host target gene, herein designated VGAM HOST TARGET GENE, is a human gene contained in the human genome.

VGAM1974 gene encodes a VGAM1974 precursor RNA, herein designated VGAM PRECURSOR RNA. Similar to other miRNA genes, and unlike most ordinary genes, VGAM1974 precursor RNA does not encode a protein. A nucleotide sequence identical or highly similar to the nucleotide sequence of VGAM1974 precursor RNA is designated SEQ ID:1960, and is provided hereinbelow with reference to the sequence listing part. Nucleotide sequence SEQ ID:1960 is located at position 14078 relative to the genome of Bovine Herpesvirus 4.

VGAM1974 precursor RNA folds onto itself, forming VGAM1974 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1974 folded precursor RNA into VGAM1974 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM1974 RNA is designated SEQ ID:4685, and is provided hereinbelow with reference to the sequence listing part.

VGAM1974 host target gene, herein designated VGAM HOST TARGET GENE, encodes a corresponding messenger RNA, VGAM1974 host target RNA, herein designated VGAM HOST TARGET RNA. VGAM1974 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1974 RNA, herein designated VGAM RNA, binds complementarily to one or more host target binding sites located in untranslated regions of VGAM1974 host target RNA, herein designated VGAM HOST TARGET RNA. This complementary binding is due to the fact that the nucleotide sequence of VGAM1974 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1974 RNA, herein designated VGAM RNA, may have a different number of host target binding sites in untranslated regions of a VGAM1974 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1974 RNA, herein designated VGAM RNA, to host target binding sites on VGAM1974 host target RNA, herein designated VGAM HOST TARGET RNA, such as BINDING SITE I, BINDING SITE II and BINDING SITE III, inhibits translation of VGAM1974 host target RNA into VGAM1974 host target protein, herein designated VGAM HOST TARGET PROTEIN. VGAM host target protein is therefore outlined by a broken line.

It is appreciated that VGAM1974 host target gene, herein designated VGAM HOST TARGET GENE, in fact represents a plurality of VGAM1974 host target genes. The mRNA of each one of this plurality of VGAM1974 host target genes comprises one or more host target binding sites, each having a nucleotide sequence which is at least partly complementary to VGAM1974 RNA, herein designated VGAM RNA, and which when bound by VGAM1974 RNA causes inhibition of translation of respective one or more VGAM1974 host target proteins.

It is further appreciated by one skilled in the art that the mode of translational inhibition illustrated by FIG. 1 with specific reference to translational inhibition exerted by VGAM1974 gene, herein designated VGAM GENE, on one or more VGAM1974 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1974 is inhibition of expression of host target genes, as part of a novel viral mechanism of attacking a host. Accordingly, utilities of VGAM1974 include diagnosis, prevention and treatment of viral infection by Bovine Herpesvirus 4. Specific functions, and accordingly utilities, of VGAM1974 correlate with, and may be deduced from, the identity of the host target genes which VGAM1974 binds and inhibits, and the function of these host target genes, as elaborated hereinbelow.

Nucleotide sequences of the VGAM1974 precursor RNA, herein designated VGAM PRECURSOR RNA, and of the 'diced' VGAM1974 RNA, herein designated VGAM RNA, and a schematic representation of the secondary folding of VGAM1974 folded precursor RNA, herein designated VGAM FOLDED PRECURSOR RNA, of VGAM1974 are further described hereinbelow with reference to Table 1.

Nucleotide sequences of host target binding sites, such as BINDING SITE-I, BINDING SITE-II and BINDING SITE-III of FIG. 1, found on VGAM1974 host target RNA, and schematic representation of the complementarity of each of these host target binding sites to VGAM1974 RNA, herein designated VGAM RNA, are described hereinbelow with reference to Table 2.

As mentioned hereinabove with reference to FIG. 1, a function of VGAM1974 gene, herein designated VGAM is inhibition of expression of VGAM1974 target genes. It is appreciated that specific functions, and accordingly utilities, of VGAM1974 correlate with, and may be deduced from, the identity of the target genes which VGAM1974 binds and inhibits, and the function of these target genes, as elaborated hereinbelow.

Frizzled Homolog 10 (Drosophila) (FZD10, Accession NM_007197) is a VGAM1974 host target gene. FZD10 BINDING SITE is HOST TARGET binding site found in the 3' untranslated region of mRNA encoded by FZD10, corresponding to a HOST TARGET binding site such as BINDING SITE I, BINDING SITE II or BINDING SITE III. Table 2 illustrates the complementarity of the nucleotide sequences of FZD10 BINDING SITE, designated SEQ ID:14050, to the nucleotide sequence of VGAM1974 RNA, herein designated VGAM RNA, also designated SEQ ID:4685.

A function of VGAM1974 is therefore inhibition of Frizzled Homolog 10 (Drosophila) (FZD10, Accession NM_007197). Accordingly, utilities of VGAM1974 include diagnosis, prevention and treatment of diseases and clinical conditions associated with FZD10. FLJ13621 (Accession NM_025009) is another VGAM1974 host target gene. FLJ13621 BINDING SITE is HOST TARGET binding site found in the 5' untranslated region of mRNA encoded by FLJ13621, corresponding to a HOST TARGET binding site such as BINDING SITE I, BINDING SITE II or BINDING SITE III. Table 2 illustrates the complementarity of the nucleotide sequences of FLJ13621 BINDING SITE, designated SEQ ID:24580, to the nucleotide sequence of VGAM1974 RNA, herein designated VGAM RNA, also designated SEQ ID:4685.

Another function of VGAM1974 is therefore inhibition of FLJ13621 (Accession NM_025009). Accordingly, utilities of VGAM1974 include diagnosis, prevention and treatment of diseases and clinical conditions associated with FLJ13621. KIAA0781 (Accession XM_041314) is another VGAM1974 host target gene. KIAA0781 BINDING SITE is HOST TARGET binding site found in the 3' untranslated region of mRNA encoded by KIAA0781, corresponding to a HOST TARGET binding site such as BINDING SITE I, BINDING SITE II or BINDING SITE III. Table 2 illustrates the complementarity of the nucleotide sequences of KIAA0781 BINDING SITE, designated SEQ ID:33497, to the nucleotide sequence of VGAM1974 RNA, herein designated VGAM RNA, also designated SEQ ID:4685.

Another function of VGAM1974 is therefore inhibition of KIAA0781 (Accession XM_041314). Accordingly, utilities of VGAM1974 include diagnosis, prevention and treatment of diseases and clinical conditions associated with KIAA0781. Kruppel-like Factor 5 (intestinal) (KLF5, Accession NM_001730) is another VGAM1974 host target gene. KLF5 BINDING SITE is HOST TARGET binding site found in the 3' untranslated region of mRNA encoded by KLF5, corresponding to a HOST TARGET binding site such as BINDING SITE I, BINDING SITE II or BINDING SITE III. Table 2 illustrates the complementarity of the nucleotide sequences of KLF5 BINDING SITE, designated SEQ ID:7460, to the nucleotide sequence of VGAM1974 RNA, herein designated VGAM RNA, also designated SEQ ID:4685.

Another function of VGAM1974 is therefore inhibition of Kruppel-like Factor 5 (intestinal) (KLF5, Accession NM_001730). Accordingly, utilities of VGAM1974 include diagnosis, prevention and treatment of diseases and clinical conditions associated with KLF5. N-acetylated Alpha-linked Acidic Dipeptidase 2 (NAALAD2, Accession NM_005467) is another VGAM1974 host target gene. NAALAD2 BINDING SITE is HOST TARGET binding site found in the 3' untranslated region of mRNA encoded by NAALAD2, corresponding to a HOST TARGET binding site such as BINDING SITE I, BINDING SITE II or BINDING SITE III. Table 2 illustrates the complementarity of the nucleotide sequences of NAALAD2 BINDING SITE, designated SEQ ID:11962, to the nucleotide sequence of VGAM1974 RNA, herein designated VGAM RNA, also designated SEQ ID:4685.

Another function of VGAM1974 is therefore inhibition of N-acetylated Alpha-linked Acidic Dipeptidase 2 (NAALAD2, Accession NM_005467). Accordingly, utilities of VGAM1974 include diagnosis, prevention and treatment of diseases and clinical conditions associated with NAALAD2. LOC148266 (Accession XM_086128) is another VGAM1974 host target gene. LOC148266 BINDING SITE is HOST TARGET binding site found in the 3' untranslated region of mRNA encoded by LOC148266, corresponding to a HOST TARGET binding site such as BINDING SITE I, BINDING SITE II or BINDING SITE III. Table 2 illustrates the complementarity of the nucleotide sequences of LOC148266 BINDING SITE, designated SEQ ID:38515, to the nucleotide sequence of VGAM1974 RNA, herein designated VGAM RNA, also designated SEQ ID:4685.

Another function of VGAM1974 is therefore inhibition of LOC148266 (Accession XM_086128). Accordingly, utilities of VGAM1974 include diagnosis, prevention and treatment of diseases and clinical conditions associated with LOC148266. FIG. 1 further provides a conceptual description of a novel bioinformatically detected viral gene of the present invention, referred to here as Viral Genomic Address Messenger 1975 (VGAM1975) viral gene, which modulates expression of respective host target genes thereof, the function and utility of which host target genes is known in the art.

VGAM1975 is a novel bioinformatically detected regulatory, non protein coding, viral micro RNA (miRNA) gene. The method by which VGAM1975 was detected is described hereinabove with reference to FIGS. 1-8.

VGAM1975 gene, herein designated VGAM GENE, is a viral gene contained in the genome of Bovine Herpesvirus 4. VGAM1975 host target gene, herein designated VGAM HOST TARGET GENE, is a human gene contained in the human genome.

VGAM1975 gene encodes a VGAM1975 precursor RNA, herein designated VGAM PRECURSOR RNA. Similar to other miRNA genes, and unlike most ordinary genes, VGAM1975 precursor RNA does not encode a protein. A nucleotide sequence identical or highly similar to the nucleotide sequence of VGAM1975 precursor RNA is designated SEQ ID:1961, and is provided hereinbelow with reference to the sequence listing part. Nucleotide sequence SEQ ID:1961 is located at position 9804 relative to the genome of Bovine Herpesvirus 4.

VGAM1975 precursor RNA folds onto itself, forming VGAM1975 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1975 folded precursor RNA into VGAM1975 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1975 RNA is designated SEQ ID:4686, and is provided hereinbelow with reference to the sequence listing part.

VGAM1975 host target gene, herein designated VGAM HOST TARGET GENE, encodes a corresponding messenger RNA, VGAM1975 host target RNA, herein designated VGAM HOST TARGET RNA. VGAM1975 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1975 RNA, herein designated VGAM RNA, binds complementarily to one or more host target binding sites located in untranslated regions of VGAM1975 host target RNA, herein designated VGAM HOST TARGET RNA. This complementary binding is due to the fact that the nucleotide sequence of VGAM1975 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1975 RNA, herein designated VGAM RNA, may have a different number of host target binding sites in untranslated regions of a VGAM1975 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1975 RNA, herein designated VGAM RNA, to host target binding sites on VGAM1975 host target RNA, herein designated VGAM HOST TARGET RNA, such as BINDING SITE I, BINDING SITE II and BINDING SITE III, inhibits translation of VGAM1975 host target RNA into VGAM1975 host target protein, herein designated VGAM HOST TARGET PROTEIN. VGAM host target protein is therefore outlined by a broken line.

It is appreciated that VGAM1975 host target gene, herein designated VGAM HOST TARGET GENE, in fact represents a plurality of VGAM1975 host target genes. The mRNA of each one of this plurality of VGAM1975 host target genes comprises one or more host target binding sites, each having a nucleotide sequence which is at least partly complementary to VGAM1975 RNA, herein designated VGAM RNA, and which when bound by VGAM1975 RNA causes inhibition of translation of respective one or more VGAM1975 host target proteins.

It is further appreciated by one skilled in the art that the mode of translational inhibition illustrated by FIG. 1 with specific reference to translational inhibition exerted by VGAM1975 gene, herein designated VGAM GENE, on one or more VGAM1975 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1975 is inhibition of expression of host target genes, as part of a novel viral mechanism of attacking a host. Accordingly, utilities of VGAM1975 include diagnosis, prevention and treatment of viral infection by Bovine Herpesvirus 4. Specific functions, and accordingly utilities, of VGAM1975 correlate with, and may be deduced from, the identity of the host target genes which VGAM1975 binds and inhibits, and the function of these host target genes, as elaborated hereinbelow.

Nucleotide sequences of the VGAM1975 precursor RNA, herein designated VGAM PRECURSOR RNA, and of the 'diced' VGAM1975 RNA, herein designated VGAM RNA, and a schematic representation of the secondary folding of VGAM1975 folded precursor RNA, herein designated VGAM FOLDED PRECURSOR RNA, of VGAM1975 are further described hereinbelow with reference to Table 1.

Nucleotide sequences of host target binding sites, such as BINDING SITE-I, BINDING SITE-II and BINDING SITE-III of FIG. 1, found on VGAM1975 host target RNA, and schematic representation of the complementarity of each of these host target binding sites to VGAM1975 RNA, herein designated VGAM RNA, are described hereinbelow with reference to Table 2.

As mentioned hereinabove with reference to FIG. 1, a function of VGAM1975 gene, herein designated VGAM is inhibition of expression of VGAM1975 target genes. It is appreciated that specific functions, and accordingly utilities, of VGAM1975 correlate with, and may be deduced from, the identity of the target genes which VGAM1975 binds and inhibits, and the function of these target genes, as elaborated hereinbelow.

Fibroblast Growth Factor 7 (keratinocyte growth factor) (FGF7, Accession NM_002009) is a VGAM1975 host target gene. FGF7 BINDING SITE is HOST TARGET binding site found in the 3' untranslated region of mRNA encoded by FGF7, corresponding to a HOST TARGET binding site such as BINDING SITE I, BINDING SITE II or BINDING SITE III. Table 2 illustrates the complementarity of the nucleotide sequences of FGF7 BINDING SITE, designated SEQ ID:7748, to the nucleotide sequence of VGAM1975 RNA, herein designated VGAM RNA, also designated SEQ ID:4686.

A function of VGAM1975 is therefore inhibition of Fibroblast Growth Factor 7 (keratinocyte growth factor) (FGF7, Accession NM_002009), a gene which growth factor active on keratinocytes. Accordingly, utilities of VGAM1975 include diagnosis, prevention and treatment of diseases and clinical conditions associated with FGF7. The function of FGF7 and its association with various diseases and clinical conditions, has been established by previous studies, as described hereinabove with reference to VGAM678. Mannan-binding Lectin Serine Protease 1 (C4/C2 activating component of Ra-reactive factor) (MASP1, Accession NM_001879) is another VGAM1975 host target gene. MASP1 BINDING SITE is HOST TARGET binding site found in the 3' untranslated region of mRNA encoded by MASP1, corresponding to a HOST TARGET binding site such as BINDING SITE I, BINDING SITE II or BINDING SITE III. Table 2 illustrates the complementarity of the nucleotide sequences of MASP1 BINDING SITE, designated SEQ ID:7604, to the nucleotide sequence of VGAM1975 RNA, herein designated VGAM RNA, also designated SEQ ID:4686.

Another function of VGAM1975 is therefore inhibition of Mannan-binding Lectin Serine Protease 1 (C4/C2 activating component of Ra-reactive factor) (MASP1, Accession NM_001879), a gene which a complement-dependent bactericidal factor. Accordingly, utilities of VGAM1975 include diagnosis, prevention and treatment of diseases and clinical conditions associated with MASP1. The function of MASP1 and its association with various diseases and clinical conditions, has been established by previous studies, as described hereinabove with reference to VGAM566. Methyltransferase-like 1 (METTL1, Accession NM_023032) is another VGAM1975 host target gene. METTL1 BINDING SITE1 and METTL1 BINDING SITE2 are HOST TARGET binding sites found in untranslated regions of mRNA encoded by METTL1, corresponding to HOST TARGET binding sites such as BINDING SITE I, BINDING SITE II or BINDING SITE III. Table 2 illustrates the complementarity of the nucleotide sequences of METTL1 BINDING SITE1 and METTL1 BINDING SITE2, designated SEQ ID:23308 and SEQ ID:23313 respectively, to the nucleotide sequence of VGAM1975 RNA, herein designated VGAM RNA, also designated SEQ ID:4686.

Another function of VGAM1975 is therefore inhibition of Methyltransferase-like 1 (METTL1, Accession NM_023032). Accordingly, utilities of VGAM1975 include diagnosis, prevention and treatment of diseases and clinical conditions associated with METTL1. Myosin, Heavy Polypeptide 11, Smooth Muscle (MYH11, Accession NM_002474) is another VGAM1975 host target gene. MYH11 BINDING SITE1 and MYH11 BINDING SITE2 are HOST TARGET binding sites found in untranslated regions of mRNA encoded by MYH11, corresponding to HOST TARGET binding sites such as BINDING SITE I, BINDING SITE II or BINDING SITE III. Table 2 illustrates the complementarity of the nucleotide sequences of MYH11 BINDING SITE1 and MYH11 BINDING SITE2, designated SEQ ID:8298 and SEQ ID:8334 respectively, to the nucleotide sequence of VGAM1975 RNA, herein designated VGAM RNA, also designated SEQ ID:4686.

Another function of VGAM1975 is therefore inhibition of Myosin, Heavy Polypeptide 11, Smooth Muscle (MYH11, Accession NM_002474), a gene which is involved in muscle contraction. Accordingly, utilities of VGAM1975 include diagnosis, prevention and treatment of diseases and clinical conditions associated with MYH11. The function of MYH11 and its association with various diseases and clinical conditions, has been established by previous studies, as described hereinabove with reference to VGAM178. Paired Mesoderm Homeo Box 1 (PMX1, Accession NM_006902) is another VGAM1975 host target gene. PMX1 BINDING SITE1 and PMX1 BINDING SITE2 are HOST TARGET binding sites found in untranslated regions of mRNA encoded by PMX1, corresponding to HOST TARGET binding sites such as BINDING SITE I, BINDING SITE II or BINDING SITE III. Table 2 illustrates the complementarity of the nucleotide sequences of PMX1 BINDING SITE1 and PMX1 BINDING SITE2, designated SEQ ID:13777 and SEQ ID:22912 respectively, to the nucleotide sequence of VGAM1975 RNA, herein designated VGAM RNA, also designated SEQ ID:4686.

Another function of VGAM1975 is therefore inhibition of Paired Mesoderm Homeo Box 1 (PMX1, Accession NM_006902), a gene which acts as a transcriptional regulator of muscle creatine kinase. Accordingly, utilities of VGAM1975 include diagnosis, prevention and treatment of diseases and clinical conditions associated with PMX1. The function of PMX1 and its association with various diseases and clinical conditions, has been established by previous studies, as described hereinabove with reference to VGAM381. Contactin Associated Protein 1 (CNTNAP1, Accession NM_003632) is another VGAM1975 host target gene. CNTNAP1 BINDING SITE is HOST TARGET binding site found in the 3' untranslated region of mRNA encoded by CNTNAP1, corresponding to a HOST TARGET binding site such as BINDING SITE I, BINDING SITE II or BINDING SITE III. Table 2 illustrates the complementarity of the nucleotide sequences of CNTNAP1 BINDING SITE, designated SEQ ID:9694, to the nucleotide sequence of VGAM1975 RNA, herein designated VGAM RNA, also designated SEQ ID:4686.

Another function of VGAM1975 is therefore inhibition of Contactin Associated Protein 1 (CNTNAP1, Accession NM_003632). Accordingly, utilities of VGAM1975 include diagnosis, prevention and treatment of diseases and clinical conditions associated with CNTNAP1. DKFZP434P1750 (Accession NM_015527) is another VGAM1975 host target gene. DKFZP434P1750 BINDING SITE is HOST TARGET binding site found in the 3' untranslated region of mRNA encoded by DKFZP434P1750, corresponding to a HOST TARGET binding site such as BINDING SITE I, BINDING SITE II or BINDING SITE III. Table 2 illustrates the complementarity of the nucleotide sequences of DKFZP434P1750 BINDING SITE, designated SEQ ID:17792, to the nucleotide sequence of VGAM1975 RNA, herein designated VGAM RNA, also designated SEQ ID:4686.

Another function of VGAM1975 is therefore inhibition of DKFZP434P1750 (Accession NM_015527). Accordingly, utilities of VGAM1975 include diagnosis, prevention and treatment of diseases and clinical conditions associated with DKFZP434P1750. FLJ10687 (Accession NM_018178) is another VGAM1975 host target gene. FLJ10687 BINDING SITE is HOST TARGET binding site found in the 3' untranslated region of mRNA encoded by FLJ10687, corresponding to a HOST TARGET binding site such as BINDING SITE I, BINDING SITE II or BINDING SITE III. Table 2 illustrates the complementarity of the nucleotide sequences of FLJ10687 BINDING SITE, designated SEQ ID:20006, to the nucleotide sequence of VGAM1975 RNA, herein designated VGAM RNA, also designated SEQ ID:4686.

Another function of VGAM1975 is therefore inhibition of FLJ10687 (Accession NM_018178). Accordingly, utilities of VGAM1975 include diagnosis, prevention and treatment of diseases and clinical conditions associated with FLJ10687. FLJ11286 (Accession NM_018381) is another VGAM1975 host target gene. FLJ11286 BINDING SITE is HOST TARGET binding site found in the 3' untranslated region of mRNA encoded by FLJ11286, corresponding to a HOST TARGET binding site such as BINDING SITE I, BINDING SITE II or BINDING SITE III. Table 2 illustrates the complementarity of the nucleotide sequences of FLJ11286 BINDING SITE, designated SEQ ID:20412, to the nucleotide sequence of VGAM1975 RNA, herein designated VGAM RNA, also designated SEQ ID:4686.

Another function of VGAM1975 is therefore inhibition of FLJ11286 (Accession NM_018381). Accordingly, utilities of VGAM1975 include diagnosis, prevention and treatment of diseases and clinical conditions associated with FLJ11286. FLJ14154 (Accession NM_024845) is another VGAM1975 host target gene. FLJ14154 BINDING SITE is HOST TARGET binding site found in the 3' untranslated region of mRNA encoded by FLJ14154, corresponding to a HOST TARGET binding site such as BINDING SITE I, BINDING SITE II or BINDING SITE III. Table 2 illustrates the complementarity of the nucleotide sequences of FLJ14154 BINDING SITE, designated SEQ ID:24272, to the nucleotide sequence of VGAM1975 RNA, herein designated VGAM RNA, also designated SEQ ID:4686.

Another function of VGAM1975 is therefore inhibition of FLJ14154 (Accession NM_024845). Accordingly, utilities of VGAM1975 include diagnosis, prevention and treatment of diseases and clinical conditions associated with FLJ14154. FLJ20619 (Accession NM_017904) is another VGAM1975 host target gene. FLJ20619 BINDING SITE is HOST TARGET binding site found in the 3' untranslated region of mRNA encoded by FLJ20619, corresponding to a HOST TARGET binding site such as BINDING SITE I, BINDING SITE II or BINDING SITE III. Table 2 illustrates the complementarity of the nucleotide sequences of FLJ20619 BINDING SITE, designated SEQ ID:19570, to the nucleotide sequence of VGAM1975 RNA, herein designated VGAM RNA, also designated SEQ ID:4686.

Another function of VGAM1975 is therefore inhibition of FLJ20619 (Accession NM_017904). Accordingly, utilities of VGAM1975 include diagnosis, prevention and treatment of diseases and clinical conditions associated with FLJ20619. HN1L (Accession NM_144570) is another VGAM1975 host target gene. HN1L BINDING SITE is HOST TARGET binding site found in the 3' untranslated region of mRNA encoded by HN1L, corresponding to a HOST TARGET binding site such as BINDING SITE I, BINDING SITE II or BINDING SITE III. Table 2 illustrates the complementarity of the nucleotide sequences of HN1L BINDING SITE, designated SEQ ID:29377, to the nucleotide sequence of VGAM1975 RNA, herein designated VGAM RNA, also designated SEQ ID:4686.

Another function of VGAM1975 is therefore inhibition of HN1L (Accession NM_144570). Accordingly, utilities of VGAM1975 include diagnosis, prevention and treatment of diseases and clinical conditions associated with HN1L. Potassium Voltage-gated Channel, Delayed-rectifier, Subfamily S, Member 1 (KCNS1, Accession NM_002251) is another VGAM1975 host target gene. KCNS1 BINDING SITE is HOST TARGET binding site found in the 3' untranslated region of mRNA encoded by KCNS1, corresponding to a HOST TARGET binding site such as BINDING SITE I, BINDING SITE II or BINDING SITE III. Table 2 illustrates the complementarity of the nucleotide sequences of KCNS1 BINDING SITE, designated SEQ ID:8040, to the nucleotide sequence of VGAM1975 RNA, herein designated VGAM RNA, also designated SEQ ID:4686.

Another function of VGAM1975 is therefore inhibition of Potassium Voltage-gated Channel, Delayed-rectifier, Subfamily S, Member 1 (KCNS1, Accession NM_002251). Accordingly, utilities of VGAM1975 include diagnosis, prevention and treatment of diseases and clinical conditions associated with KCNS1. KIAA0435 (Accession NM_014801) is another VGAM1975 host target gene. KIAA0435 BINDING SITE is HOST TARGET binding site found in the 3' untranslated region of mRNA encoded by KIAA0435, corresponding to a HOST TARGET binding site such as BINDING SITE I, BINDING SITE II or BINDING SITE III. Table 2 illustrates the complementarity of the nucleotide sequences of KIAA0435 BINDING SITE, designated SEQ ID:16720, to the nucleotide sequence of VGAM1975 RNA, herein designated VGAM RNA, also designated SEQ ID:4686.

Another function of VGAM1975 is therefore inhibition of KIAA0435 (Accession NM_014801). Accordingly, utilities of VGAM1975 include diagnosis, prevention and treatment of diseases and clinical conditions associated with KIAA0435. KIAA0544 (Accession XM_048119) is another VGAM1975 host target gene. KIAA0544 BINDING SITE is HOST TARGET binding site found in the 3' untranslated region of mRNA encoded by KIAA0544, corresponding to a HOST TARGET binding site such as BINDING SITE I, BINDING SITE II or BINDING SITE III. Table 2 illustrates the complementarity of the nucleotide sequences of KIAA0544 BINDING SITE, designated SEQ ID:35112, to the nucleotide sequence of VGAM1975 RNA, herein designated VGAM RNA, also designated SEQ ID:4686.

Another function of VGAM1975 is therefore inhibition of KIAA0544 (Accession XM_048119). Accordingly, utilities of VGAM1975 include diagnosis, prevention and treatment of diseases and clinical conditions associated with KIAA0544. KIAA0556 (Accession XM_044632) is another VGAM1975 host target gene. KIAA0556 BINDING SITE is HOST TARGET binding site found in the 3' untranslated region of mRNA encoded by KIAA0556, corresponding to a HOST TARGET binding site such as BINDING SITE I, BINDING SITE II or BINDING SITE III. Table 2 illustrates the complementarity of the nucleotide sequences of KIAA0556 BINDING SITE, designated SEQ ID:34251, to the nucleotide sequence of VGAM1975 RNA, herein designated VGAM RNA, also designated SEQ ID:4686.

Another function of VGAM1975 is therefore inhibition of KIAA0556 (Accession XM_044632). Accordingly, utilities of VGAM1975 include diagnosis, prevention and treatment of diseases and clinical conditions associated with KIAA0556. KIAA0848 (Accession NM_014926) is another VGAM1975 host target gene. KIAA0848 BINDING SITE is HOST TARGET binding site found in the 3' untranslated region of mRNA encoded by KIAA0848, corresponding to a HOST TARGET binding site such as BINDING SITE I, BINDING SITE II or BINDING SITE III. Table 2 illustrates the complementarity of the nucleotide sequences of KIAA0848 BINDING SITE, designated SEQ ID:17212, to the nucleotide sequence of VGAM1975 RNA, herein designated VGAM RNA, also designated SEQ ID:4686.

Another function of VGAM1975 is therefore inhibition of KIAA0848 (Accession NM_014926). Accordingly, utilities of VGAM1975 include diagnosis, prevention and treatment of diseases and clinical conditions associated with KIAA0848. MGC2574 (Accession NM_024098) is another VGAM1975 host target gene. MGC2574 BINDING SITE is HOST TARGET binding site found in the 3' untranslated region of mRNA encoded by MGC2574, corresponding to a HOST TARGET binding site such as BINDING SITE I, BINDING SITE II or BINDING SITE III. Table 2 illustrates the complementarity of the nucleotide sequences of MGC2574 BINDING SITE, designated SEQ ID:23539, to the nucleotide sequence of VGAM1975 RNA, herein designated VGAM RNA, also designated SEQ ID:4686.

Another function of VGAM1975 is therefore inhibition of MGC2574 (Accession NM_024098). Accordingly, utilities of VGAM1975 include diagnosis, prevention and treatment of diseases and clinical conditions associated with MGC2574. N4BP3 (Accession XM_038920) is another VGAM1975 host target gene. N4BP3 BINDING SITE is HOST TARGET binding site found in the 3' untranslated region of mRNA encoded by N4BP3, corresponding to a HOST TARGET binding site such as BINDING SITE I, BINDING SITE II or BINDING SITE III. Table 2 illustrates the complementarity of the nucleotide sequences of N4BP3 BINDING SITE, designated SEQ ID:32936, to the nucleotide sequence of VGAM1975 RNA, herein designated VGAM RNA, also designated SEQ ID:4686.

Another function of VGAM1975 is therefore inhibition of N4BP3 (Accession XM_038920). Accordingly, utilities of VGAM1975 include diagnosis, prevention and treatment of diseases and clinical conditions associated with N4BP3. SARM (Accession NM_015077) is another VGAM1975 host target gene. SARM BINDING SITE is HOST TARGET binding site found in the 3' untranslated region of mRNA encoded by SARM, corresponding to a HOST TARGET binding site such as BINDING SITE I, BINDING SITE II or BINDING SITE III. Table 2 illustrates the complementarity of the nucleotide sequences of SARM BINDING SITE, designated SEQ ID:17450, to the nucleotide sequence of VGAM1975 RNA, herein designated VGAM RNA, also designated SEQ ID:4686.

Another function of VGAM1975 is therefore inhibition of SARM (Accession NM_015077). Accordingly, utilities of VGAM1975 include diagnosis, prevention and treatment of diseases and clinical conditions associated with SARM. SCYA16 (Accession NM_004590) is another VGAM1975 host target gene. SCYA16 BINDING SITE is HOST TARGET binding site found in the 3' untranslated region of mRNA encoded by SCYA16, corresponding to a HOST TARGET binding site such as BINDING SITE I, BINDING SITE II or BINDING SITE III. Table 2 illustrates the complementarity of the nucleotide sequences of SCYA16 BINDING SITE, designated SEQ ID:10933, to the nucleotide sequence of VGAM1975 RNA, herein designated VGAM RNA, also designated SEQ ID:4686.

Another function of VGAM1975 is therefore inhibition of SCYA16 (Accession NM_004590). Accordingly, utilities of VGAM1975 include diagnosis, prevention and treatment of diseases and clinical conditions associated with SCYA16. Synaptotagmin-like 2 (SYTL2, Accession NM_032943) is another VGAM1975 host target gene. SYTL2 BINDING SITE is HOST TARGET binding site found in the 5' untranslated region of mRNA encoded by SYTL2, corresponding to a HOST TARGET binding site such as BINDING SITE I, BINDING SITE II or BINDING SITE III. Table 2 illustrates the complementarity of the nucleotide sequences of SYTL2 BINDING SITE, designated SEQ ID:26757, to the nucleotide sequence of VGAM1975 RNA, herein designated VGAM RNA, also designated SEQ ID:4686.

Another function of VGAM1975 is therefore inhibition of Synaptotagmin-like 2 (SYTL2, Accession NM_032943). Accordingly, utilities of VGAM1975 include diagnosis, prevention and treatment of diseases and clinical conditions associated with SYTL2. XT2 (Accession NM_022167) is another VGAM1975 host target gene. XT2 BINDING SITE is HOST TARGET binding site found in the 3' untranslated region of mRNA encoded by XT2, corresponding to a HOST TARGET binding site such as BINDING SITE I, BINDING SITE II or BINDING SITE III. Table 2 illustrates the complementarity of the nucleotide sequences of XT2 BINDING SITE, designated SEQ ID:22721, to the nucleotide sequence of VGAM1975 RNA, herein designated VGAM RNA, also designated SEQ ID:4686.

Another function of VGAM1975 is therefore inhibition of XT2 (Accession NM_022167). Accordingly, utilities of VGAM1975 include diagnosis, prevention and treatment of diseases and clinical conditions associated with XT2. LOC145195 (Accession XM_096731) is another VGAM1975 host target gene. LOC145195 BINDING SITE is HOST TARGET binding site found in the 5' untranslated region of mRNA encoded by LOC145195, corresponding to a HOST TARGET binding site such as BINDING SITE I, BINDING SITE II or BINDING SITE III. Table 2 illustrates the complementarity of the nucleotide sequences of LOC145195 BINDING SITE, designated SEQ ID:40511, to the nucleotide sequence of VGAM1975 RNA, herein designated VGAM RNA, also designated SEQ ID:4686.

Another function of VGAM1975 is therefore inhibition of LOC145195 (Accession XM_096731). Accordingly, utilities of VGAM1975 include diagnosis, prevention and treatment of diseases and clinical conditions associated with LOC145195. LOC148137 (Accession NM_144692) is another VGAM1975 host target gene. LOC148137 BINDING SITE is HOST TARGET binding site found in the 3' untranslated region of mRNA encoded by LOC148137, corresponding to a HOST TARGET binding site such as BINDING SITE I, BINDING SITE II or BINDING SITE III. Table 2 illustrates the complementarity of the nucleotide sequences of LOC148137 BINDING SITE, designated SEQ ID:29512, to the nucleotide sequence of VGAM1975 RNA, herein designated VGAM RNA, also designated SEQ ID:4686.

Another function of VGAM1975 is therefore inhibition of LOC148137 (Accession NM_144692). Accordingly, utilities of VGAM1975 include diagnosis, prevention and treatment of diseases and clinical conditions associated with LOC148137. LOC158116 (Accession XM_016240) is another VGAM1975 host target gene. LOC158116 BINDING SITE is HOST TARGET binding site found in the 3' untranslated region of mRNA encoded by LOC158116, corresponding to a HOST TARGET binding site such as BINDING SITE I, BINDING SITE II or BINDING SITE III. Table 2 illustrates the complementarity of the nucleotide sequences of LOC158116 BINDING SITE, designated SEQ ID:30251, to the nucleotide sequence of VGAM1975 RNA, herein designated VGAM RNA, also designated SEQ ID:4686.

Another function of VGAM1975 is therefore inhibition of LOC158116 (Accession XM_016240). Accordingly, utilities of VGAM1975 include diagnosis, prevention and treatment of diseases and clinical conditions associated with LOC158116. LOC160646 (Accession XM_090413) is another VGAM1975 host target gene. LOC160646 BINDING SITE is HOST TARGET binding site found in the 3' untranslated region of mRNA encoded by LOC160646, corresponding to a HOST TARGET binding site such as BINDING SITE I, BINDING SITE II or BINDING SITE III. Table 2 illustrates the complementarity of the nucleotide sequences of LOC160646 BINDING SITE, designated SEQ ID:40003, to the nucleotide sequence of VGAM1975 RNA, herein designated VGAM RNA, also designated SEQ ID:4686.

Another function of VGAM1975 is therefore inhibition of LOC160646 (Accession XM_090413). Accordingly, utilities of VGAM1975 include diagnosis, prevention and treatment of diseases and clinical conditions associated with LOC160646. LOC51200 (Accession NM_016352) is another VGAM1975 host target gene. LOC51200 BINDING SITE is HOST TARGET binding site found in the 3' untranslated region of mRNA encoded by LOC51200, corresponding to a HOST TARGET binding site such as BINDING SITE I, BINDING SITE II or BINDING SITE III. Table 2 illustrates the complementarity of the nucleotide sequences of LOC51200 BINDING SITE, designated SEQ ID:18479, to the nucleotide sequence of VGAM1975 RNA, herein designated VGAM RNA, also designated SEQ ID:4686.

Another function of VGAM1975 is therefore inhibition of LOC51200 (Accession NM_016352). Accordingly, utilities of VGAM1975 include diagnosis, prevention and treatment of diseases and clinical conditions associated with LOC51200. LOC51267 (Accession NM_016511) is another VGAM1975 host target gene. LOC51267 BINDING SITE is HOST TARGET binding site found in the 3' untranslated region of mRNA encoded by LOC51267, corresponding to a HOST TARGET binding site such as BINDING SITE I, BINDING SITE II or BINDING SITE III. Table 2 illustrates the complementarity of the nucleotide sequences of LOC51267 BINDING SITE, designated SEQ ID:18590, to the nucleotide sequence of VGAM1975 RNA, herein designated VGAM RNA, also designated SEQ ID:4686.

Another function of VGAM1975 is therefore inhibition of LOC51267 (Accession NM_016511). Accordingly, utilities of VGAM1975 include diagnosis, prevention and treatment of diseases and clinical conditions associated with LOC51267. LOC81558 (Accession NM_030802) is another VGAM1975 host target gene. LOC81558 BINDING SITE is HOST TARGET binding site found in the 3' untranslated region of mRNA encoded by LOC81558, corresponding to a HOST TARGET binding site such as BINDING SITE I, BINDING SITE II or BINDING SITE III. Table 2 illustrates the complementarity of the nucleotide sequences of LOC81558 BINDING SITE, designated SEQ ID:25110, to the nucleotide sequence of VGAM1975 RNA, herein designated VGAM RNA, also designated SEQ ID:4686.

Another function of VGAM1975 is therefore inhibition of LOC81558 (Accession NM_030802). Accordingly, utilities of VGAM1975 include diagnosis, prevention and treatment of diseases and clinical conditions associated with LOC81558. FIG. 1 further provides a conceptual description of a novel bioinformatically detected viral gene of the present invention, referred to here as Viral Genomic Address Messenger 1976 (VGAM1976) viral gene, which modulates expression of respective host target genes thereof, the function and utility of which host target genes is known in the art.

VGAM1976 is a novel bioinformatically detected regulatory, non protein coding, viral micro RNA (miRNA) gene. The method by which VGAM1976 was detected is described hereinabove with reference to FIGS. 1-8.

VGAM1976 gene, herein designated VGAM GENE, is a viral gene contained in the genome of Bovine Herpesvirus 4. VGAM1976 host target gene, herein designated VGAM HOST TARGET GENE, is a human gene contained in the human genome.

VGAM1976 gene encodes a VGAM1976 precursor RNA, herein designated VGAM PRECURSOR RNA. Similar to other miRNA genes, and unlike most ordinary genes, VGAM1976 precursor RNA does not encode a protein. A nucleotide sequence identical or highly similar to the nucleotide sequence of VGAM1976 precursor RNA is designated SEQ ID:1962, and is provided hereinbelow with reference to the sequence listing part. Nucleotide sequence SEQ ID:1962 is located at position 13694 relative to the genome of Bovine Herpesvirus 4.

VGAM1976 precursor RNA folds onto itself, forming VGAM1976 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1976 folded precursor RNA into VGAM1976 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1976 RNA is designated SEQ ID:4687, and is provided hereinbelow with reference to the sequence listing part.

VGAM1976 host target gene, herein designated VGAM HOST TARGET GENE, encodes a corresponding messenger RNA, VGAM1976 host target RNA, herein designated VGAM HOST TARGET RNA. VGAM1976 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1976 RNA, herein designated VGAM RNA, binds complementarily to one or more host target binding sites located in untranslated regions of VGAM1976 host target RNA, herein designated VGAM HOST TARGET RNA. This complementary binding is due to the fact that the nucleotide sequence of VGAM1976 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1976 RNA, herein designated VGAM RNA, may have a different number of host target binding sites in untranslated regions of a VGAM1976 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1976 RNA, herein designated VGAM RNA, to host target binding sites on VGAM1976 host target RNA, herein designated VGAM HOST TARGET RNA, such as BINDING SITE I, BINDING SITE II and BINDING SITE III, inhibits translation of VGAM1976 host target RNA into VGAM1976 host target protein, herein designated VGAM HOST TARGET PROTEIN. VGAM host target protein is therefore outlined by a broken line.

It is appreciated that VGAM1976 host target gene, herein designated VGAM HOST TARGET GENE, in fact represents a plurality of VGAM1976 host target genes. The mRNA of each one of this plurality of VGAM1976 host target genes comprises one or more host target binding sites, each having a nucleotide sequence which is at least partly complementary to VGAM1976 RNA, herein designated VGAM RNA, and which when bound by VGAM1976 RNA causes inhibition of translation of respective one or more VGAM1976 host target proteins.

It is further appreciated by one skilled in the art that the mode of translational inhibition illustrated by FIG. 1 with specific reference to translational inhibition exerted by VGAM1976 gene, herein designated VGAM GENE, on one or more VGAM1976 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1976 is inhibition of expression of host target genes, as part of a novel viral mechanism of attacking a host. Accordingly, utilities of VGAM1976 include diagnosis, prevention and treatment of viral infection by Bovine Herpesvirus 4. Specific functions, and accordingly utilities, of VGAM1976 correlate with, and may be deduced from, the identity of the host target genes which VGAM1976 binds and inhibits, and the function of these host target genes, as elaborated hereinbelow.

Nucleotide sequences of the VGAM1976 precursor RNA, herein designated VGAM PRECURSOR RNA, and of the 'diced' VGAM1976 RNA, herein designated VGAM RNA, and a schematic representation of the secondary folding of VGAM1976 folded precursor RNA, herein designated VGAM FOLDED PRECURSOR RNA, of VGAM1976 are further described hereinbelow with reference to Table 1.

Nucleotide sequences of host target binding sites, such as BINDING SITE-I, BINDING SITE-II and BINDING SITE-III of FIG. 1, found on VGAM1976 host target RNA, and schematic representation of the complementarity of each of these host target binding sites to VGAM1976 RNA, herein designated VGAM RNA, are described hereinbelow with reference to Table 2.

As mentioned hereinabove with reference to FIG. 1, a function of VGAM1976 gene, herein designated VGAM is inhibition of expression of VGAM1976 target genes. It is appreciated that specific functions, and accordingly utilities, of VGAM1976 correlate with, and may be deduced from, the identity of the target genes which VGAM1976 binds and inhibits, and the function of these target genes, as elaborated hereinbelow.

Dystrophin (muscular dystrophy, Duchenne and Becker types) (DMD, Accession NM_000109) is a VGAM1976 host target gene. DMD BINDING SITE1 through DMD BINDING SITE13 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 through DMD BINDING SITE13, designated SEQ ID:5574, SEQ ID:10157, SEQ ID:10164, SEQ ID:10170, SEQ ID:10178, SEQ ID:10183, SEQ ID:10188, SEQ ID:10199, SEQ ID:10205, SEQ ID:10210, SEQ ID:10215, SEQ ID:10226 and SEQ ID:10238 respectively, to the nucleotide sequence of VGAM1976 RNA, herein designated VGAM RNA, also designated SEQ ID:4687.

A function of VGAM1976 is therefore inhibition of Dystrophin (muscular dystrophy, Duchenne and Becker types) (DMD, Accession NM_000109), a gene which muscular dystrophy. Accordingly, utilities of VGAM1976 include diagnosis, prevention and treatment of diseases and clinical conditions associated with DMD. The function of DMD and its association with various diseases and clinical conditions, has been established by previous studies, as described hereinabove with reference to VGAM218. Protocadherin 11 X-linked (PCDH11X, Accession NM_032968) is another VGAM1976 host target gene. PCDH11X BINDING SITE1 and PCDH11X BINDING SITE2 are HOST TARGET binding sites found in untranslated regions of mRNA encoded by PCDH11X, corresponding to HOST TARGET binding sites such as BINDING SITE I, BINDING SITE II or BINDING SITE III. Table 2 illustrates the complementarity of the nucleotide sequences of PCDH11X BINDING SITE1 and PCDH11X BINDING SITE2, designated SEQ ID:26792 and SEQ ID:26807 respectively, to the nucleotide sequence of VGAM1976 RNA, herein designated VGAM RNA, also designated SEQ ID:4687.

Another function of VGAM1976 is therefore inhibition of Protocadherin 11 X-linked (PCDH11X, Accession NM_032968), a gene which is thought to play a fundamental role in cell-cell recognition essential for the segmental development and function of the central nervous system. Accordingly, utilities of VGAM1976 include diagnosis, prevention and treatment of diseases and clinical conditions associated with PCDH11X. The function of PCDH11X and its association with various diseases and clinical conditions, has been established by previous studies, as described hereinabove with reference to VGAM433. PDGFA Associated Protein 1 (PDAP1, Accession XM_166484) is another VGAM1976 host target gene. PDAP1 BINDING SITE is HOST TARGET binding site found in the 3' untranslated region of mRNA encoded by PDAP1, corresponding to a HOST TARGET binding site such as BINDING SITE I, BINDING SITE II or BINDING SITE III. Table 2 illustrates the complementarity of the nucleotide sequences of PDAP1 BINDING SITE, designated SEQ ID:44422, to the nucleotide sequence of VGAM1976 RNA, herein designated VGAM RNA, also designated SEQ ID:4687.

Another function of VGAM1976 is therefore inhibition of PDGFA Associated Protein 1 (PDAP1, Accession XM_166484). Accordingly, utilities of VGAM1976 include diagnosis, prevention and treatment of diseases and clinical conditions associated with PDAP1. Phosphatidylinositol Glycan, Class A (paroxysmal nocturnal hemoglobinuria) (PIGA, Accession NM_020472) is another VGAM1976 host target gene. PIGA BINDING SITE1 through PIGA BINDING SITE3 are HOST TARGET binding sites found in untranslated regions of mRNA encoded by PIGA, corresponding to HOST TARGET binding sites such as BINDING SITE I, BINDING SITE II or BINDING SITE III. Table 2 illustrates the complementarity of the nucleotide sequences of PIGA BINDING SITE1 through PIGA BINDING SITE3, designated SEQ ID:21714, SEQ ID:21721 and SEQ ID:8501 respectively, to the nucleotide sequence of VGAM1976 RNA, herein designated VGAM RNA, also designated SEQ ID:4687.

Another function of VGAM1976 is therefore inhibition of Phosphatidylinositol Glycan, Class A (paroxysmal nocturnal hemoglobinuria) (PIGA, Accession NM_020472). Accordingly, utilities of VGAM1976 include diagnosis, prevention and treatment of diseases and clinical conditions associated with PIGA. SWI/SNF Related, Matrix Associated, Actin Dependent Regulator of Chromatin, Subfamily A, Member 1 (SMARCA1, Accession NM_139035) is another VGAM1976 host target gene. SMARCA1 BINDING SITE1 and SMARCA1 BINDING SITE2 are HOST TARGET binding sites found in untranslated regions of mRNA encoded by SMARCA1, corresponding to HOST TARGET binding sites such as BINDING SITE I, BINDING SITE II or BINDING SITE III. Table 2 illustrates the complementarity of the nucleotide sequences of SMARCA1 BINDING SITE1 and SMARCA1 BINDING SITE2, designated SEQ ID:29132 and SEQ ID:15723 respectively, to the nucleotide sequence of VGAM1976 RNA, herein designated VGAM RNA, also designated SEQ ID:4687.

Another function of VGAM1976 is therefore inhibition of SWI/SNF Related, Matrix Associated, Actin Dependent Regulator of Chromatin, Subfamily A, Member 1 (SMARCA1, Accession NM_139035), a gene which regulates transcription via it effects on chromatin structure. Accordingly, utilities of VGAM1976 include diagnosis, prevention and treatment of diseases and clinical conditions associated with SMARCA1. The function of SMARCA1 has been established by previous studies. In the course of positional cloning of genes carried on YACs that span the breakpoint in a t (X;3) translocation in a female with Lowe syndrome (OMIM Ref. No. 309000), Okabe et al. (1992) isolated by chance a human gene with strong homology to SNF2 in S. cerevisiae. Despite strong homology at the amino acid level, the SNF2L1 gene in the human was not capable of complementing the yeast mutation. Furthermore, in contrast to SNF2 itself, a fusion protein consisting of the DNA binding domain of LexA and the human gene did not transactivate a reporter gene downstream of LexA binding sites in a yeast expression system. The similarity between SNF2L1 and the yeast gene suggested that the mammalian gene is part of an evolutionarily conserved family that has been implicated as a global activator of transcription in yeast, but its function in mammals remains unknown. See also SNF2L2 (OMIM Ref. No. 600014) and ATRX (OMIM Ref. No. 300032). Lazzaro and Picketts (2001) cloned the murine homologs of the Drosophila 'imitation switch' (ISWI) protein, Snf2h (SMARCA5; 603375) and Snf2l. In situ hybridization of mouse adult tissues and embryos showed that Snf2h expression correlated with cell proliferation, while Snf2l expression correlated with differentiation. Snf2l was expressed in terminally differentiated neurons after birth and in adult mice, as well as in adult ovaries and testes Full details of the abovementioned studies are described in the following publications, the disclosure of which are hereby incorporated by reference:

Lazzaro, M. A.; Picketts, D. J.: Cloning and characterization of the murine Imitation Switch (ISWI) genes: differential expression patterns suggest distinct developmental roles for Snf2h and Snf2l. J. Neurochem. 77:1145-1156, 2001; and Okabe, I.; Bailey, L. C.; Attree, O.; Srinivasan, S.; Perkel, J. M.; Laurent, B. C.; Carlson, M.; Nelson, D. L.; Nussbaum, R. L.: Cloning of human and bovine homologs of SNF2/SWI2: a g.

Further studies establishing the function and utilities of SMARCA1 are found in John Hopkins OMIM database record ID 300012, and in sited publications numbered 7226-7227 listed in the bibliography section hereinbelow, which are also hereby incorporated by reference. FLJ14117 (Accession NM_022777) is another VGAM1976 host target gene. FLJ14117 BINDING SITE is HOST TARGET binding site found in the 3' untranslated region of mRNA encoded by FLJ14117, corresponding to a HOST TARGET binding site such as BINDING SITE I, BINDING SITE II or BINDING SITE III. Table 2 illustrates the complementarity of the nucleotide sequences of FLJ14117 BINDING SITE, designated SEQ ID:23050, to the nucleotide sequence of VGAM1976 RNA, herein designated VGAM RNA, also designated SEQ ID:4687.

Another function of VGAM1976 is therefore inhibition of FLJ14117 (Accession NM_022777). Accordingly, utilities of VGAM1976 include diagnosis, prevention and treatment of diseases and clinical conditions associated with FLJ14117. FLJ14751 (Accession NM_032834) is another VGAM1976 host target gene. FLJ14751 BINDING SITE is HOST TARGET binding site found in the 3' untranslated region of mRNA encoded by FLJ14751, corresponding to a HOST TARGET binding site such as BINDING SITE I, BINDING SITE II or BINDING SITE III. Table 2 illustrates the complementarity of the nucleotide sequences of FLJ14751 BINDING SITE, designated SEQ ID:26613, to the nucleotide sequence of VGAM1976 RNA, herein designated VGAM RNA, also designated SEQ ID:4687.

Another function of VGAM1976 is therefore inhibition of FLJ14751 (Accession NM_032834). Accordingly, utilities of VGAM1976 include diagnosis, prevention and treatment of diseases and clinical conditions associated with FLJ14751. FLJ23153 (Accession NM_024636) is another VGAM1976 host target gene. FLJ23153 BINDING SITE is HOST TARGET binding site found in the 3' untranslated region of mRNA encoded by FLJ23153, corresponding to a HOST TARGET binding site such as BINDING SITE I, BINDING SITE II or BINDING SITE III. Table 2 illustrates the complementarity of the nucleotide sequences of FLJ23153 BINDING SITE, designated SEQ ID:23909, to the nucleotide sequence of VGAM1976 RNA, herein designated VGAM RNA, also designated SEQ ID:4687.

Another function of VGAM1976 is therefore inhibition of FLJ23153 (Accession NM_024636). Accordingly, utilities of VGAM1976 include diagnosis, prevention and treatment of diseases and clinical conditions associated with FLJ23153. HSPC195 (Accession XM_087785) is another VGAM1976 host target gene. HSPC195 BINDING SITE is HOST TARGET binding site found in the 5' untranslated region of mRNA encoded by HSPC195, corresponding to a HOST TARGET binding site such as BINDING SITE I, BINDING SITE II or BINDING SITE III. Table 2 illustrates the complementarity of the nucleotide sequences of HSPC195 BINDING SITE, designated SEQ ID:39425, to the nucleotide sequence of VGAM1976 RNA, herein designated VGAM RNA, also designated SEQ ID:4687.

Another function of VGAM1976 is therefore inhibition of HSPC195 (Accession XM_087785). Accordingly, utilities of VGAM1976 include diagnosis, prevention and treatment of diseases and clinical conditions associated with HSPC195. KIAA0562 (Accession NM_014704) is another VGAM1976 host target gene. KIAA0562 BINDING SITE is HOST TARGET binding site found in the 3' untranslated region of mRNA encoded by KIAA0562, corresponding to a HOST TARGET binding site such as BINDING SITE I, BINDING SITE II or BINDING SITE III. Table 2 illustrates the complementarity of the nucleotide sequences of KIAA0562 BINDING SITE, designated SEQ ID:16239, to the nucleotide sequence of VGAM1976 RNA, herein designated VGAM RNA, also designated SEQ ID:4687.

Another function of VGAM1976 is therefore inhibition of KIAA0562 (Accession NM_014704). Accordingly, utilities of VGAM1976 include diagnosis, prevention and treatment of diseases and clinical conditions associated with KIAA0562. KIAA0923 (Accession NM_014021) is another VGAM1976 host target gene. KIAA0923 BINDING SITE is HOST TARGET binding site found in the 3' untranslated region of mRNA encoded by KIAA0923, corresponding to a HOST TARGET binding site such as BINDING SITE I, BINDING SITE II or BINDING SITE III. Table 2 illustrates the complementarity of the nucleotide sequences of KIAA0923 BINDING SITE, designated SEQ ID:15242, to the nucleotide sequence of VGAM1976 RNA, herein designated VGAM RNA, also designated SEQ ID:4687.

Another function of VGAM1976 is therefore inhibition of KIAA0923 (Accession NM_014021). Accordingly, utilities of VGAM1976 include diagnosis, prevention and treatment of diseases and clinical conditions associated with KIAA0923. KIAA1327 (Accession XM_051146) is another VGAM1976 host target gene. KIAA1327 BINDING SITE is HOST TARGET binding site found in the 3' untranslated region of mRNA encoded by KIAA1327, corresponding to a HOST TARGET binding site such as BINDING SITE I, BINDING SITE II or BINDING SITE III. Table 2 illustrates the complementarity of the nucleotide sequences of KIAA1327 BINDING SITE, designated SEQ ID:35763, to the nucleotide sequence of VGAM1976 RNA, herein designated VGAM RNA, also designated SEQ ID:4687.

Another function of VGAM1976 is therefore inhibition of KIAA1327 (Accession XM_051146). Accordingly, utilities of VGAM1976 include diagnosis, prevention and treatment of diseases and clinical conditions associated with KIAA1327. Mitochondrial Ribosomal Protein L20 (MRPL20, Accession NM_017971) is another VGAM1976 host target gene. MRPL20 BINDING SITE is HOST TARGET binding site found in the 3' untranslated region of mRNA encoded by MRPL20, corresponding to a HOST TARGET binding site such as BINDING SITE I, BINDING SITE II or BINDING SITE III. Table 2 illustrates the complementarity of the nucleotide sequences of MRPL20 BINDING SITE, designated SEQ ID:19694, to the nucleotide sequence of VGAM1976 RNA, herein designated VGAM RNA, also designated SEQ ID:4687.

Another function of VGAM1976 is therefore inhibition of Mitochondrial Ribosomal Protein L20 (MRPL20, Accession NM_017971). Accordingly, utilities of VGAM1976 include diagnosis, prevention and treatment of diseases and clinical conditions associated with MRPL20. Prefoldin 4 (PFDN4, Accession NM_002623) is another VGAM1976 host target gene. PFDN4 BINDING SITE is HOST TARGET binding site found in the 3' untranslated region of mRNA encoded by PFDN4, corresponding to a HOST TARGET binding site such as BINDING SITE I, BINDING SITE II or BINDING SITE III. Table 2 illustrates the complementarity of the nucleotide sequences of PFDN4 BINDING SITE, designated SEQ ID:8486, to the nucleotide sequence of VGAM1976 RNA, herein designated VGAM RNA, also designated SEQ ID:4687.

Another function of VGAM1976 is therefore inhibition of Prefoldin 4 (PFDN4, Accession NM_002623). Accordingly, utilities of VGAM1976 include diagnosis, prevention and treatment of diseases and clinical conditions associated with PFDN4. RAB14, Member RAS Oncogene Family (RAB14, Accession NM_016322) is another VGAM1976 host target gene. RAB14 BINDING SITE is HOST TARGET binding site found in the 3' untranslated region of mRNA encoded by RAB14, corresponding to a HOST TARGET binding site such as BINDING SITE I, BINDING SITE II or BINDING SITE III. Table 2 illustrates the complementarity of the nucleotide sequences of RAB14 BINDING SITE, designated SEQ ID:18449, to the nucleotide sequence of VGAM1976 RNA, herein designated VGAM RNA, also designated SEQ ID:4687.

Another function of VGAM1976 is therefore inhibition of RAB14, Member RAS Oncogene Family (RAB14, Accession NM_016322). Accordingly, utilities of VGAM1976 include diagnosis, prevention and treatment of diseases and clinical conditions associated with RAB14. RYK Receptor-like Tyrosine Kinase (RYK, Accession XM_093692) is another VGAM1976 host target gene. RYK BINDING SITE is HOST TARGET binding site found in the 3' untranslated region of mRNA encoded by RYK, corresponding to a HOST TARGET binding site such as BINDING SITE I, BINDING SITE II or BINDING SITE III. Table 2 illustrates the complementarity of the nucleotide sequences of RYK BINDING SITE, designated SEQ ID:40203, to the nucleotide sequence of VGAM1976 RNA, herein designated VGAM RNA, also designated SEQ ID:4687.

Another function of VGAM1976 is therefore inhibition of RYK Receptor-like Tyrosine Kinase (RYK, Accession XM_093692). Accordingly, utilities of VGAM1976 include diagnosis, prevention and treatment of diseases and clinical conditions associated with RYK. Wingless-type MMTV Integration Site Family, Member 16 (WNT16, Accession NM_057168) is another VGAM1976 host target gene. WNT16 BINDING SITE1 and WNT16 BINDING SITE2 are HOST TARGET binding sites found in untranslated regions of mRNA encoded by WNT16, corresponding to HOST TARGET binding sites such as BINDING SITE I, BINDING SITE II or BINDING SITE III. Table 2 illustrates the complementarity of the nucleotide sequences of WNT16 BINDING SITE1 and WNT16 BINDING SITE2, designated SEQ ID:27675 and SEQ ID:18171 respectively, to the nucleotide sequence of VGAM1976 RNA, herein designated VGAM RNA, also designated SEQ ID:4687.

Another function of VGAM1976 is therefore inhibition of Wingless-type MMTV Integration Site Family, Member 16 (WNT16, Accession NM_057168). Accordingly, utilities of VGAM1976 include diagnosis, prevention and treatment of diseases and clinical conditions associated with WNT16. LOC144245 (Accession XM_047770) is another VGAM1976 host target gene. LOC144245 BINDING SITE is HOST TARGET binding site found in the 3' untranslated region of mRNA encoded by LOC144245, corresponding to a HOST TARGET binding site such as BINDING SITE I, BINDING SITE II or BINDING SITE III. Table 2 illustrates the complementarity of the nucleotide sequences of LOC144245 BINDING SITE, designated SEQ ID:35052, to the nucleotide sequence of VGAM1976 RNA, herein designated VGAM RNA, also designated SEQ ID:4687.

Another function of VGAM1976 is therefore inhibition of LOC144245 (Accession XM_047770). Accordingly, utilities of VGAM1976 include diagnosis, prevention and treatment of diseases and clinical conditions associated with LOC144245. LOC148697 (Accession XM_086276) is another VGAM1976 host target gene. LOC148697 BINDING SITE is HOST TARGET binding site found in the 3' untranslated region of mRNA encoded by LOC148697, corresponding to a HOST TARGET binding site such as BINDING SITE I, BINDING SITE II or BINDING SITE III. Table 2 illustrates the complementarity of the nucleotide sequences of LOC148697 BINDING SITE, designated SEQ ID:38576, to the nucleotide sequence of VGAM1976 RNA, herein designated VGAM RNA, also designated SEQ ID:4687.

Another function of VGAM1976 is therefore inhibition of LOC148697 (Accession XM_086276). Accordingly, utilities of VGAM1976 include diagnosis, prevention and treatment of diseases and clinical conditions associated with LOC148697. LOC150933 (Accession XM_097971) is another VGAM1976 host target gene. LOC150933 BINDING SITE is HOST TARGET binding site found in the 3' untranslated region of mRNA encoded by LOC150933, corresponding to a HOST TARGET binding site such as BINDING SITE I, BINDING SITE II or BINDING SITE III. Table 2 illustrates the complementarity of the nucleotide sequences of LOC150933 BINDING SITE, designated SEQ ID:41273, to the nucleotide sequence of VGAM1976 RNA, herein designated VGAM RNA, also designated SEQ ID:4687.

Another function of VGAM1976 is therefore inhibition of LOC150933 (Accession XM_097971). Accordingly, utilities of VGAM1976 include diagnosis, prevention and treatment of diseases and clinical conditions associated with LOC150933. LOC152580 (Accession XM_098240) is another VGAM1976 host target gene. LOC152580 BINDING SITE is HOST TARGET binding site found in the 3' untranslated region of mRNA encoded by LOC152580, corresponding to a HOST TARGET binding site such as BINDING SITE I, BINDING SITE II or BINDING SITE III. Table 2 illustrates the complementarity of the nucleotide sequences of LOC152580 BINDING SITE, designated SEQ ID:41524, to the nucleotide sequence of VGAM1976 RNA, herein designated VGAM RNA, also designated SEQ ID:4687.

Another function of VGAM1976 is therefore inhibition of LOC152580 (Accession XM_098240). Accordingly, utilities of VGAM1976 include diagnosis, prevention and treatment of diseases and clinical conditions associated with LOC152580. LOC152925 (Accession XM_087559) is another VGAM1976 host target gene. LOC152925 BINDING SITE is HOST TARGET binding site found in the 3' untranslated region of mRNA encoded by LOC152925, corresponding to a HOST TARGET binding site such as BINDING SITE I, BINDING SITE II or BINDING SITE III. Table 2 illustrates the complementarity of the nucleotide sequences of LOC152925 BINDING SITE, designated SEQ ID:39334, to the nucleotide sequence of VGAM1976 RNA, herein designated VGAM RNA, also designated SEQ ID:4687.

Another function of VGAM1976 is therefore inhibition of LOC152925 (Accession XM_087559). Accordingly, utilities of VGAM1976 include diagnosis, prevention and treatment of diseases and clinical conditions associated with LOC152925. LOC219404 (Accession XM_167909) is another VGAM1976 host target gene. LOC219404 BINDING SITE is HOST TARGET binding site found in the 3' untranslated region of mRNA encoded by LOC219404, corresponding to a HOST TARGET binding site such as BINDING SITE I, BINDING SITE II or BINDING SITE III. Table 2 illustrates the complementarity of the nucleotide sequences of LOC219404 BINDING SITE, designated SEQ ID:44909, to the nucleotide sequence of VGAM1976 RNA, herein designated VGAM RNA, also designated SEQ ID:4687.

Another function of VGAM1976 is therefore inhibition of LOC219404 (Accession XM_167909). Accordingly, utilities of VGAM1976 include diagnosis, prevention and treatment of diseases and clinical conditions associated with LOC219404. LOC221738 (Accession XM_168097) is another VGAM1976 host target gene. LOC221738 BINDING SITE is HOST TARGET binding site found in the 3' untranslated region of mRNA encoded by LOC221738, corresponding to a HOST TARGET binding site such as BINDING SITE I, BINDING SITE II or BINDING SITE III. Table 2 illustrates the complementarity of the nucleotide sequences of LOC221738 BINDING SITE, designated SEQ ID:45027, to the nucleotide sequence of VGAM1976 RNA, herein designated VGAM RNA, also designated SEQ ID:4687.

Another function of VGAM1976 is therefore inhibition of LOC221738 (Accession XM_168097). Accordingly, utilities of VGAM1976 include diagnosis, prevention and treatment of diseases and clinical conditions associated with LOC221738. LOC51068 (Accession NM_015938) is another VGAM1976 host target gene. LOC51068 BINDING SITE is HOST TARGET binding site found in the 3' untranslated region of mRNA encoded by LOC51068, corresponding to a HOST TARGET binding site such as BINDING SITE I, BINDING SITE II or BINDING SITE III. Table 2 illustrates the complementarity of the nucleotide sequences of LOC51068 BINDING SITE, designated SEQ ID:18060, to the nucleotide sequence of VGAM1976 RNA, herein designated VGAM RNA, also designated SEQ ID:4687.

Another function of VGAM1976 is therefore inhibition of LOC51068 (Accession NM_015938). Accordingly, utilities of VGAM1976 include diagnosis, prevention and treatment of diseases and clinical conditions associated with LOC51068. LOC93380 (Accession XM_051020) is another VGAM1976 host target gene. LOC93380 BINDING SITE is HOST TARGET binding site found in the 3' untranslated region of mRNA encoded by LOC93380, corresponding to a HOST TARGET binding site such as BINDING SITE I, BINDING SITE II or BINDING SITE III. Table 2 illustrates the complementarity of the nucleotide sequences of LOC93380 BINDING SITE, designated SEQ ID:35729, to the nucleotide sequence of VGAM1976 RNA, herein designated VGAM RNA, also designated SEQ ID:4687.

Another function of VGAM1976 is therefore inhibition of LOC93380 (Accession XM_051020). Accordingly, utilities of VGAM1976 include diagnosis, prevention and treatment of diseases and clinical conditions associated with LOC93380. FIG. 1 further provides a conceptual description of a novel bioinformatically detected viral gene of the present invention, referred to here as Viral Genomic Address Messenger 1977 (VGAM1977) viral gene, which modulates expression of respective host target genes thereof, the function and utility of which host target genes is known in the art.

VGAM1977 is a novel bioinformatically detected regulatory, non protein coding, viral micro RNA (miRNA) gene. The method by which VGAM1977 was detected is described hereinabove with reference to FIGS. 1-8.

VGAM1977 gene, herein designated VGAM GENE, is a viral gene contained in the genome of Bovine Herpesvirus 4. VGAM1977 host target gene, herein designated VGAM HOST TARGET GENE, is a human gene contained in the human genome.

VGAM1977 gene encodes a VGAM1977 precursor RNA, herein designated VGAM PRECURSOR RNA. Similar to other miRNA genes, and unlike most ordinary genes, VGAM1977 precursor RNA does not encode a protein. A nucleotide sequence identical or highly similar to the nucleotide sequence of VGAM1977 precursor RNA is designated SEQ ID:1963, and is provided hereinbelow with reference to the sequence listing part. Nucleotide sequence SEQ ID:1963 is located at position 5340 relative to the genome of Bovine Herpesvirus 4.

VGAM1977 precursor RNA folds onto itself, forming VGAM1977 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1977 folded precursor RNA into VGAM1977 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM1977 RNA is designated SEQ ID:4688, and is provided hereinbelow with reference to the sequence listing part.

VGAM1977 host target gene, herein designated VGAM HOST TARGET GENE, encodes a corresponding messenger RNA, VGAM1977 host target RNA, herein designated VGAM HOST TARGET RNA. VGAM1977 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1977 RNA, herein designated VGAM RNA, binds complementarily to one or more host target binding sites located in untranslated regions of VGAM1977 host target RNA, herein designated VGAM HOST TARGET RNA. This complementary binding is due to the fact that the nucleotide sequence of VGAM1977 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1977 RNA, herein designated VGAM RNA, may have a different number of host target binding sites in untranslated regions of a VGAM1977 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1977 RNA, herein designated VGAM RNA, to host target binding sites on VGAM1977 host target RNA, herein designated VGAM HOST TARGET RNA, such as BINDING SITE I, BINDING SITE II and BINDING SITE III, inhibits translation of VGAM1977 host target RNA into VGAM1977 host target protein, herein designated VGAM HOST TARGET PROTEIN. VGAM host target protein is therefore outlined by a broken line.

It is appreciated that VGAM1977 host target gene, herein designated VGAM HOST TARGET GENE, in fact represents a plurality of VGAM1977 host target genes. The mRNA of each one of this plurality of VGAM1977 host target genes comprises one or more host target binding sites, each having a nucleotide sequence which is at least partly complementary to VGAM1977 RNA, herein designated VGAM RNA, and which when bound by VGAM1977 RNA causes inhibition of translation of respective one or more VGAM1977 host target proteins.

It is further appreciated by one skilled in the art that the mode of translational inhibition illustrated by FIG. 1 with specific reference to translational inhibition exerted by VGAM1977 gene, herein designated VGAM GENE, on one or more VGAM1977 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1977 is inhibition of expression of host target genes, as part of a novel viral mechanism of attacking a host. Accordingly, utilities of VGAM1977 include diagnosis, prevention and treatment of viral infection by Bovine Herpesvirus 4. Specific functions, and accordingly utilities, of VGAM1977 correlate with, and may be deduced from, the identity of the host target genes which VGAM1977 binds and inhibits, and the function of these host target genes, as elaborated hereinbelow.

Nucleotide sequences of the VGAM1977 precursor RNA, herein designated VGAM PRECURSOR RNA, and of the 'diced' VGAM1977 RNA, herein designated VGAM RNA, and a schematic representation of the secondary folding of VGAM1977 folded precursor RNA, herein designated VGAM FOLDED PRECURSOR RNA, of VGAM1977 are further described hereinbelow with reference to Table 1.

Nucleotide sequences of host target binding sites, such as BINDING SITE-I, BINDING SITE-II and BINDING SITE-III of FIG. 1, found on VGAM1977 host target RNA, and schematic representation of the complementarity of each of these host target binding sites to VGAM1977 RNA, herein designated VGAM RNA, are described hereinbelow with reference to Table 2.

As mentioned hereinabove with reference to FIG. 1, a function of VGAM1977 gene, herein designated VGAM is inhibition of expression of VGAM1977 target genes. It is appreciated that specific functions, and accordingly utilities, of VGAM1977 correlate with, and may be deduced from, the identity of the target genes which VGAM1977 binds and inhibits, and the function of these target genes, as elaborated hereinbelow.

Archain 1 (ARCN1, Accession NM_001655) is a VGAM1977 host target gene. ARCN1 BINDING SITE is HOST TARGET binding site found in the 3' untranslated region of mRNA encoded by ARCN1, corresponding to a HOST TARGET binding site such as BINDING SITE I, BINDING SITE II or BINDING SITE III. Table 2 illustrates the complementarity of the nucleotide sequences of ARCN1 BINDING SITE, designated SEQ ID:7363, to the nucleotide sequence of VGAM1977 RNA, herein designated VGAM RNA, also designated SEQ ID:4688.

A function of VGAM1977 is therefore inhibition of Archain 1 (ARCN1, Accession NM_001655), a gene which plays a fundamental role in eukaryotic cell biology. Accordingly, utilities of VGAM1977 include diagnosis, prevention and treatment of diseases and clinical conditions associated with ARCN1. The function of ARCN1 and its association with various diseases and clinical conditions, has been established by previous studies, as described hereinabove with reference to VGAM1226. FLJ12888 (Accession NM_024945) is another VGAM1977 host target gene. FLJ12888 BINDING SITE is HOST TARGET binding site found in the 3' untranslated region of mRNA encoded by FLJ12888, corresponding to a HOST TARGET binding site such as BINDING SITE I, BINDING SITE II or BINDING SITE III. Table 2 illustrates the complementarity of the nucleotide sequences of FLJ12888 BINDING SITE, designated SEQ ID:24494, to the nucleotide sequence of VGAM1977 RNA, herein designated VGAM RNA, also designated SEQ ID:4688.

Another function of VGAM1977 is therefore inhibition of FLJ12888 (Accession NM_024945). Accordingly, utilities of VGAM1977 include diagnosis, prevention and treatment of diseases and clinical conditions associated with FLJ12888. FIG. 1 further provides a conceptual description of a novel bioinformatically detected viral gene of the present invention, referred to here as Viral Genomic Address Messenger 1978 (VGAM1978) viral gene, which modulates expression of respective host target genes thereof, the function and utility of which host target genes is known in the art.

VGAM1978 is a novel bioinformatically detected regulatory, non protein coding, viral micro RNA (miRNA) gene. The method by which VGAM1978 was detected is described hereinabove with reference to FIGS. 1-8.

VGAM1978 gene, herein designated VGAM GENE, is a viral gene contained in the genome of Bovine Herpesvirus 4. VGAM1978 host target gene, herein designated VGAM HOST TARGET GENE, is a human gene contained in the human genome.

VGAM1978 gene encodes a VGAM1978 precursor RNA, herein designated VGAM PRECURSOR RNA. Similar to other miRNA genes, and unlike most ordinary genes, VGAM1978 precursor RNA does not encode a protein. A nucleotide sequence identical or highly similar to the nucleotide sequence of VGAM1978 precursor RNA is designated SEQ ID:1964, and is provided hereinbelow with reference to the sequence listing part. Nucleotide sequence SEQ ID:1964 is located at position 2128 relative to the genome of Bovine Herpesvirus 4.

VGAM1978 precursor RNA folds onto itself, forming VGAM1978 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1978 folded precursor RNA into VGAM1978 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM1978 RNA is designated SEQ ID:4689, and is provided hereinbelow with reference to the sequence listing part.

VGAM1978 host target gene, herein designated VGAM HOST TARGET GENE, encodes a corresponding messenger RNA, VGAM1978 host target RNA, herein designated VGAM HOST TARGET RNA. VGAM1978 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1978 RNA, herein designated VGAM RNA, binds complementarily to one or more host target binding sites located in untranslated regions of VGAM1978 host target RNA, herein designated VGAM HOST TARGET RNA. This complementary binding is due to the fact that the nucleotide sequence of VGAM1978 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1978 RNA, herein designated VGAM RNA, may have a different number of host target binding sites in untranslated regions of a VGAM1978 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1978 RNA, herein designated VGAM RNA, to host target binding sites on VGAM1978 host target RNA, herein designated VGAM HOST TARGET RNA, such as BINDING SITE I, BINDING SITE II and BINDING SITE III, inhibits translation of VGAM1978 host target RNA into VGAM1978 host target protein, herein designated VGAM HOST TARGET PROTEIN. VGAM host target protein is therefore outlined by a broken line.

It is appreciated that VGAM1978 host target gene, herein designated VGAM HOST TARGET GENE, in fact represents a plurality of VGAM1978 host target genes. The mRNA of each one of this plurality of VGAM1978 host target genes comprises one or more host target binding sites, each having a nucleotide sequence which is at least partly complementary to VGAM1978 RNA, herein designated VGAM RNA, and which when bound by VGAM1978 RNA causes inhibition of translation of respective one or more VGAM1978 host target proteins.

It is further appreciated by one skilled in the art that the mode of translational inhibition illustrated by FIG. 1 with specific reference to translational inhibition exerted by VGAM1978 gene, herein designated VGAM GENE, on one or more VGAM1978 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1978 is inhibition of expression of host target genes, as part of a novel viral mechanism of attacking a host. Accordingly, utilities of VGAM1978 include diagnosis, prevention and treatment of viral infection by Bovine Herpesvirus 4. Specific functions, and accordingly utilities, of VGAM1978 correlate with, and may be deduced from, the identity of the host target genes which VGAM1978 binds and inhibits, and the function of these host target genes, as elaborated hereinbelow.

Nucleotide sequences of the VGAM1978 precursor RNA, herein designated VGAM PRECURSOR RNA, and of the 'diced' VGAM1978 RNA, herein designated VGAM RNA, and a schematic representation of the secondary folding of VGAM1978 folded precursor RNA, herein designated VGAM FOLDED PRECURSOR RNA, of VGAM1978 are further described hereinbelow with reference to Table 1.

Nucleotide sequences of host target binding sites, such as BINDING SITE-I, BINDING SITE-II and BINDING SITE-III of FIG. 1, found on VGAM1978 host target RNA, and schematic representation of the complementarity of each of these host target binding sites to VGAM1978 RNA, herein designated VGAM RNA, are described hereinbelow with reference to Table 2.

As mentioned hereinabove with reference to FIG. 1, a function of VGAM1978 gene, herein designated VGAM is inhibition of expression of VGAM1978 target genes. It is appreciated that specific functions, and accordingly utilities, of VGAM1978 correlate with, and may be deduced from, the identity of the target genes which VGAM1978 binds and inhibits, and the function of these target genes, as elaborated hereinbelow.

BLTR2 (Accession NM_019839) is a VGAM1978 host target gene. BLTR2 BINDING SITE is HOST TARGET binding site found in the 5' untranslated region of mRNA encoded by BLTR2, corresponding to a HOST TARGET binding site such as BINDING SITE I, BINDING SITE II or BINDING SITE III. Table 2 illustrates the complementarity of the nucleotide sequences of BLTR2 BINDING SITE, designated SEQ ID:21245, to the nucleotide sequence of VGAM1978 RNA, herein designated VGAM RNA, also designated SEQ ID:4689.

A function of VGAM1978 is therefore inhibition of BLTR2 (Accession NM_019839). Accordingly, utilities of VGAM1978 include diagnosis, prevention and treatment of diseases and clinical conditions associated with BLTR2. CERD4 (Accession NM_012074) is another VGAM1978 host target gene. CERD4 BINDING SITE is HOST TARGET binding site found in the 3' untranslated region of mRNA encoded by CERD4, corresponding to a HOST TARGET binding site such as BINDING SITE I, BINDING SITE II or BINDING SITE III. Table 2 illustrates the complementarity of the nucleotide sequences of CERD4 BINDING SITE, designated SEQ ID:14354, to the nucleotide sequence of VGAM1978 RNA, herein designated VGAM RNA, also designated SEQ ID:4689.

Another function of VGAM1978 is therefore inhibition of CERD4 (Accession NM_012074). Accordingly, utilities of VGAM1978 include diagnosis, prevention and treatment of diseases and clinical conditions associated with CERD4. Cytochrome P450, Subfamily I (dioxin-inducible), Polypeptide 1 (glaucoma 3, primary infantile) (CYP1B1, Accession NM_000104) is another VGAM1978 host target gene. CYP1B1 BINDING SITE is HOST TARGET binding site found in the 3' untranslated region of mRNA encoded by CYP1B1, corresponding to a HOST TARGET binding site such as BINDING SITE I, BINDING SITE II or BINDING SITE III. Table 2 illustrates the complementarity of the nucleotide sequences of CYP1B1 BINDING SITE, designated SEQ ID:5567, to the nucleotide sequence of VGAM1978 RNA, herein designated VGAM RNA, also designated SEQ ID:4689.

Another function of VGAM1978 is therefore inhibition of Cytochrome P450, Subfamily I (dioxin-inducible), Polypeptide 1 (glaucoma 3, primary infantile) (CYP1B1, Accession NM_000104), a gene which participates in the metabolism of a molecule that is a participant in eye development. Accordingly, utilities of VGAM1978 include diagnosis, prevention and treatment of diseases and clinical conditions associated with CYP1B1. The function of CYP1B1 and its association with various diseases and clinical conditions, has been established by previous studies, as described hereinabove with reference to VGAM894. Gap Junction Protein, Alpha 1, 43 kDa (connexin 43) (GJA1, Accession NM_000165) is another VGAM1978 host target gene. GJA1 BINDING SITE is HOST TARGET binding site found in the 3' untranslated region of mRNA encoded by GJA1, corresponding to a HOST TARGET binding site such as BINDING SITE I, BINDING SITE II or BINDING SITE III. Table 2 illustrates the complementarity of the nucleotide sequences of GJA1 BINDING SITE, designated SEQ ID:5678, to the nucleotide sequence of VGAM1978 RNA, herein designated VGAM RNA, also designated SEQ ID:4689.

Another function of VGAM1978 is therefore inhibition of Gap Junction Protein, Alpha 1, 43 kDa (connexin 43) (GJA1, Accession NM_000165), a gene which may act in synchronizing heart contraction and embryonic development. Accordingly, utilities of VGAM1978 include diagnosis, prevention and treatment of diseases and clinical conditions associated with GJA1. The function of GJA1 and its association with various diseases and clinical conditions, has been established by previous studies, as described hereinabove with reference to VGAM341.5-hydroxytryptamine (serotonin) Receptor 2C (HTR2C, Accession NM_000868) is another VGAM1978 host target gene. HTR2C BINDING SITE is HOST TARGET binding site found in the 3' untranslated region of mRNA encoded by HTR2C, corresponding to a HOST TARGET binding site such as BINDING SITE I, BINDING SITE II or BINDING SITE III. Table 2 illustrates the complementarity of the nucleotide sequences of HTR2C BINDING SITE, designated SEQ ID:6536, to the nucleotide sequence of VGAM1978 RNA, herein designated VGAM RNA, also designated SEQ ID:4689.

Another function of VGAM1978 is therefore inhibition of 5-hydroxytryptamine (serotonin) Receptor 2C (HTR2C, Accession NM_000868), a gene which activates phospholipase C and regulates intracellular calcium flux. Accordingly, utilities of VGAM1978 include diagnosis, prevention and treatment of diseases and clinical conditions associated with HTR2C. The function of HTR2C and its association with various diseases and clinical conditions, has been established by previous studies, as described hereinabove with reference to VGAM1052. Platelet-activating Factor Acetylhydrolase, Isoform Ib, Gamma Subunit 29kDa (PAFAH1B3, Accession NM_002573) is another VGAM1978 host target gene. PAFAH1B3 BINDING SITE is HOST TARGET binding site found in the 5' untranslated region of mRNA encoded by PAFAH1B3, corresponding to a HOST TARGET binding site such as BINDING SITE I, BINDING SITE II or BINDING SITE III. Table 2 illustrates the complementarity of the nucleotide sequences of PAFAH1B3 BINDING SITE, designated SEQ ID:8433, to the nucleotide sequence of VGAM1978 RNA, herein designated VGAM RNA, also designated SEQ ID:4689.

Another function of VGAM1978 is therefore inhibition of Platelet-activating Factor Acetylhydrolase, Isoform Ib, Gamma Subunit 29 kDa (PAFAH1B3, Accession NM_002573), a gene which plays a role during the development of brain. Accordingly, utilities of VGAM1978 include diagnosis, prevention and treatment of diseases and clinical conditions associated with PAFAH1B3. The function of PAFAH1B3 has been established by previous studies. Platelet-activating factor acetylhydrolase (PAFAH) catalyzes the removal of the acetyl group at the sn-2 position of the glycerol backbone of platelet-activating factor (PAF), producing biologically inactive lyso-PAF. Isoform 1B of PAFAH consists of 3 subunits: alpha (PAFAH1B1; 601545), beta (PAFAH1B2; 602508), and gamma. The catalytic activity of the enzyme resides in the beta and gamma subunits, whereas the alpha subunit has regulatory activity. PAFAH1B1 has been identified as a causative gene of Miller-Dieker lissencephaly (OMIM Ref. No. 247200). By screening a human fetal liver cDNA library with oligonucleotides based on the cDNA sequence of the bovine PAFAH-gamma subunit, Adachi et al. (1995) cloned a cDNA encoding PAFAH1B3. The deduced 231-amino acid human protein has 97.8% identity with the bovine PAFAH-gamma subunit. The authors found that the PAFAH1B3 gene spans approximately 5.6 kb and contains 5 exons. Southern blot analysis showed that PAFAH1B3 is a single-copy gene in the human genome. Northern blot analysis detected a 1.0-kb PAFAH1B3 transcript in several human adult and fetal tissues, with the highest expression in fetal brain. Adachi et al. (1995) expressed the PAFAH1B3 cDNA in E. coli and found that the resulting protein was catalytically active, demonstrating that trimer formation is not essential for PAFAH1B3 activity. Nothwang et al. (2001) reported a translocation t (1;19)(q21.3; q13.2) in a female with mental retardation, ataxia, and atrophy of the brain. Sequence analysis of the breakpoints revealed an Alu repeat-mediated mechanism of recombination that led to truncation of PAFAH1B3 and the kinase CLK2 (OMIM Ref. No. 602989). One expressed fusion gene encoded the first 136 amino acids of PAFAH1B3, followed by the complete CLK2 protein. Truncated PAFAH1B3 protein lost its potential to interact with LIS1 (OMIM Ref. No. 601545), whereas CLK2 activity was conserved within the fusion protein. These data emphasized the importance of PAFAH1B in brain development and function.

Full details of the abovementioned studies are described in the following publications, the disclosure of which are hereby incorporated by reference:

Adachi, H.; Tsujimoto, M.; Hattori, M.; Arai, H.; Inoue, K.: cDNA cloning of human cytosolic platelet-activating factor acetylhydrolase gamma-subunit and its mRNA expression in human tissues. Biochem. Biophys. Res. Commun. 214:180-187, 1995; and Nothwang, H. G.; Kim, H. G.; Aoki, J.; Geisterfer, M.; Kubart, S.; Wegner, R. D.; van Moers, A.; Ashworth, L. K.; Haaf, T.; Bell, J.; Arai, H.; Tommerup, N.; Ropers, H. H.; Wirth, J.: F.

Further studies establishing the function and utilities of PAFAH1B3 are found in John Hopkins OMIM database record ID 603074, and in sited publications numbered 885 and 9036 listed in the bibliography section hereinbelow, which are also hereby incorporated by reference. Platelet-derived Growth Factor Receptor, Alpha Polypeptide (PDGFRA, Accession NM_006206) is another VGAM1978 host target gene. PDGFRA BINDING SITE is HOST TARGET binding site found in the 3' untranslated region of mRNA encoded by PDGFRA, corresponding to a HOST TARGET binding site such as BINDING SITE I, BINDING SITE II or BINDING SITE III. Table 2 illustrates the complementarity of the nucleotide sequences of PDGFRA BINDING SITE, designated SEQ ID:12887, to the nucleotide sequence of VGAM1978 RNA, herein designated VGAM RNA, also designated SEQ ID:4689.

Another function of VGAM1978 is therefore inhibition of Platelet-derived Growth Factor Receptor, Alpha Polypeptide (PDGFRA, Accession NM_006206), a gene which this receptor binds platelet-derived growth factor and has a tyrosine-protein kinase activity. Accordingly, utilities of VGAM1978 include diagnosis, prevention and treatment of diseases and clinical conditions associated with PDGFRA. The function of PDGFRA and its association with various diseases and clinical conditions, has been established by previous studies, as described hereinabove with reference to VGAM117. Protein Phosphatase 1, Catalytic Subunit, Beta Isoform (PPP1CB, Accession NM_002709) is another VGAM1978 host target gene. PPP1CB BINDING SITE is HOST TARGET binding site found in the 3" untranslated region of mRNA encoded by PPP1CB, corresponding to a HOST TARGET binding site such as BINDING SITE I, BINDING SITE II or BINDING SITE III. Table 2 illustrates the complementarity of the nucleotide sequences of PPP1CB BINDING SITE, designated SEQ ID:8561, to the nucleotide sequence of VGAM1978 RNA, herein designated VGAM RNA, also designated SEQ ID:4689.

Another function of VGAM1978 is therefore inhibition of Protein Phosphatase 1, Catalytic Subunit, Beta Isoform (PPP1CB, Accession NM_002709), a gene which is the catalytic subunit of protein phosphatase 1. Accordingly, utilities of VGAM1978 include diagnosis, prevention and treatment of diseases and clinical conditions associated with PPP1CB. The function of PPP1CB and its association with various diseases and clinical conditions, has been established by previous studies, as described hereinabove with reference to VGAM46. TRIP15 (Accession NM_004236) is another VGAM1978 host target gene. TRIP15 BINDING SITE is HOST TARGET binding site found in the 3' untranslated region of mRNA encoded by TRIP15, corresponding to a HOST TARGET binding site such as BINDING SITE I, BINDING SITE II or BINDING SITE III. Table 2 illustrates the complementarity of the nucleotide sequences of TRIP15 BINDING SITE, designated SEQ ID:10431, to the nucleotide sequence of VGAM1978 RNA, herein designated VGAM RNA, also designated SEQ ID:4689.

Another function of VGAM1978 is therefore inhibition of TRIP15 (Accession NM_004236), a gene which is a subunit of the COP9 signalosome complex. Accordingly, utilities of VGAM1978 include diagnosis, prevention and treatment of diseases and clinical conditions associated with TRIP15. The function of TRIP15 and its association with various diseases and clinical conditions, has been established by previous studies, as described hereinabove with reference to VGAM452. HSPC065 (Accession NM_014157) is another VGAM1978 host target gene. HSPC065 BINDING SITE is HOST TARGET binding site found in the 3' untranslated region of mRNA encoded by HSPC065, corresponding to a HOST TARGET binding site such as BINDING SITE I, BINDING SITE II or BINDING SITE III. Table 2 illustrates the complementarity of the nucleotide sequences of HSPC065 BINDING SITE, designated SEQ ID:15457, to the nucleotide sequence of VGAM1978 RNA, herein designated VGAM RNA, also designated SEQ ID:4689.

Another function of VGAM1978 is therefore inhibition of HSPC065 (Accession NM_014157). Accordingly, utilities of VGAM1978 include diagnosis, prevention and treatment of diseases and clinical conditions associated with HSPC065. KIAA0153 (Accession NM_015140) is another VGAM1978 host target gene. KIAA0153 BINDING SITE is HOST TARGET binding site found in the 3' untranslated region of mRNA encoded by KIAA0153, corresponding to a HOST TARGET binding site such as BINDING SITE I, BINDING SITE II or BINDING SITE III. Table 2 illustrates the complementarity of the nucleotide sequences of KIAA0153 BINDING SITE, designated SEQ ID:17500, to the nucleotide sequence of VGAM1978 RNA, herein designated VGAM RNA, also designated SEQ ID:4689.

Another function of VGAM1978 is therefore inhibition of KIAA0153 (Accession NM_015140). Accordingly, utilities of VGAM1978 include diagnosis, prevention and treatment of diseases and clinical conditions associated with KIAA0153. MGC10870 (Accession NM_032301) is another VGAM1978 host target gene. MGC10870 BINDING SITE is HOST TARGET binding site found in the 5' untranslated region of mRNA encoded by MGC10870, corresponding to a HOST TARGET binding site such as BINDING SITE I, BINDING SITE II or BINDING SITE III. Table 2 illustrates the complementarity of the nucleotide sequences of MGC10870 BINDING SITE, designated SEQ ID:26082, to the nucleotide sequence of VGAM1978 RNA, herein designated VGAM RNA, also designated SEQ ID:4689.

Another function of VGAM1978 is therefore inhibition of MGC10870 (Accession NM_032301). Accordingly, utilities of VGAM1978 include diagnosis, prevention and treatment of diseases and clinical conditions associated with MGC10870. LOC144231 (Accession XM_096561) is another VGAM1978 host target gene. LOC144231 BIND- ING SITE is HOST TARGET binding site found in the 5' untranslated region of mRNA encoded by LOC144231, corresponding to a HOST TARGET binding site such as BINDING SITE I, BINDING SITE II or BINDING SITE III. Table 2 illustrates the complementarity of the nucleotide sequences of LOC144231 BINDING SITE, designated SEQ ID:40396, to the nucleotide sequence of VGAM1978 RNA, herein designated VGAM RNA, also designated SEQ ID:4689.

Another function of VGAM1978 is therefore inhibition of LOC144231 (Accession XM_096561). Accordingly, utilities of VGAM1978 include diagnosis, prevention and treatment of diseases and clinical conditions associated with LOC144231. LOC163231 (Accession XM_092094) is another VGAM1978 host target gene. LOC163231 BINDING SITE is HOST TARGET binding site found in the 5' untranslated region of mRNA encoded by LOC163231, corresponding to a HOST TARGET binding site such as BINDING SITE I, BINDING SITE II or BINDING SITE III. Table 2 illustrates the complementarity of the nucleotide sequences of LOC163231 BINDING SITE, designated SEQ ID:40103, to the nucleotide sequence of VGAM1978 RNA, herein designated VGAM RNA, also designated SEQ ID:4689.

Another function of VGAM1978 is therefore inhibition of LOC163231 (Accession XM_092094). Accordingly, utilities of VGAM1978 include diagnosis, prevention and treatment of diseases and clinical conditions associated with LOC163231. LOC205313 (Accession XM_119628) is another VGAM1978 host target gene. LOC205313 BINDING SITE is HOST TARGET binding site found in the 5' untranslated region of mRNA encoded by LOC205313, corresponding to a HOST TARGET binding site such as BINDING SITE I, BINDING SITE II or BINDING SITE III. Table 2 illustrates the complementarity of the nucleotide sequences of LOC205313 BINDING SITE, designated SEQ ID:43595, to the nucleotide sequence of VGAM1978 RNA, herein designated VGAM RNA, also designated SEQ ID:4689.

Another function of VGAM1978 is therefore inhibition of LOC205313 (Accession XM_119628). Accordingly, utilities of VGAM1978 include diagnosis, prevention and treatment of diseases and clinical conditions associated with LOC205313. LOC58525 (Accession XM_086045) is another VGAM1978 host target gene. LOC58525 BINDING SITE is HOST TARGET binding site found in the 3' untranslated region of mRNA encoded by LOC58525, corresponding to a HOST TARGET binding site such as BINDING SITE I, BINDING SITE II or BINDING SITE III. Table 2 illustrates the complementarity of the nucleotide sequences of LOC58525 BINDING SITE, designated SEQ ID:38456, to the nucleotide sequence of VGAM1978 RNA, herein designated VGAM RNA, also designated SEQ ID:4689.

Another function of VGAM1978 is therefore inhibition of LOC58525 (Accession XM_086045). Accordingly, utilities of VGAM1978 include diagnosis, prevention and treatment of diseases and clinical conditions associated with LOC58525. LOC91650 (Accession XM_039853) is another VGAM1978 host target gene. LOC91650 BINDING SITE is HOST TARGET binding site found in the 5' untranslated region of mRNA encoded by LOC91650, corresponding to a HOST TARGET binding site such as BINDING SITE I, BINDING SITE II or BINDING SITE III. Table 2 illustrates the complementarity of the nucleotide sequences of LOC91650 BINDING SITE, designated SEQ ID:33201, to the nucleotide sequence of VGAM1978 RNA, herein designated VGAM RNA, also designated SEQ ID:4689.

Another function of VGAM1978 is therefore inhibition of LOC91650 (Accession XM_039853). Accordingly, utilities of VGAM1978 include diagnosis, prevention and treatment of diseases and clinical conditions associated with LOC91650. FIG. 1 further provides a conceptual description of a novel bioinformatically detected viral gene of the present invention, referred to here as Viral Genomic Address Messenger 1979 (VGAM1979) viral gene, which modulates expression of respective host target genes thereof, the function and utility of which host target genes is known in the art.

VGAM1979 is a novel bioinformatically detected regulatory, non protein coding, viral micro RNA (miRNA) gene. The method by which VGAM1979 was detected is described hereinabove with reference to FIGS. 1-8.

VGAM1979 gene, herein designated VGAM GENE, is a viral gene contained in the genome of Bovine Herpesvirus 4. VGAM1979 host target gene, herein designated VGAM HOST TARGET GENE, is a human gene contained in the human genome.

VGAM1979 gene encodes a VGAM1979 precursor RNA, herein designated VGAM PRECURSOR RNA. Similar to other miRNA genes, and unlike most ordinary genes, VGAM1979 precursor RNA does not encode a protein. A nucleotide sequence identical or highly similar to the nucleotide sequence of VGAM1979 precursor RNA is designated SEQ ID:1965, and is provided hereinbelow with reference to the sequence listing part. Nucleotide sequence SEQ ID:1965 is located at position 11708 relative to the genome of Bovine Herpesvirus 4.

VGAM1979 precursor RNA folds onto itself, forming VGAM1979 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1979 folded precursor RNA into VGAM1979 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM1979 RNA is designated SEQ ID:4690, and is provided hereinbelow with reference to the sequence listing part.

VGAM1979 host target gene, herein designated VGAM HOST TARGET GENE, encodes a corresponding messenger RNA, VGAM1979 host target RNA, herein designated VGAM HOST TARGET RNA. VGAM1979 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1979 RNA, herein designated VGAM RNA, binds complementarily to one or more host target binding sites located in untranslated regions of VGAM1979 host target RNA, herein designated VGAM HOST TARGET RNA. This complementary binding is due to the fact that the nucleotide sequence of VGAM1979 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1979 RNA, herein designated VGAM RNA, may have a different number of host target binding sites in untranslated regions of a VGAM1979 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1979 RNA, herein designated VGAM RNA, to host target binding sites on VGAM1979 host target RNA, herein designated VGAM HOST TARGET RNA, such as BINDING SITE I, BINDING SITE II and BINDING SITE III, inhibits translation of VGAM1979 host target RNA into VGAM1979 host target protein, herein designated VGAM HOST TARGET PROTEIN. VGAM host target protein is therefore outlined by a broken line.

It is appreciated that VGAM1979 host target gene, herein designated VGAM HOST TARGET GENE, in fact represents a plurality of VGAM1979 host target genes. The mRNA of each one of this plurality of VGAM1979 host target genes comprises one or more host target binding sites, each having a nucleotide sequence which is at least partly complementary to VGAM1979 RNA, herein designated VGAM RNA, and which when bound by VGAM1979 RNA causes inhibition of translation of respective one or more VGAM1979 host target proteins.

It is further appreciated by one skilled in the art that the mode of translational inhibition illustrated by FIG. 1 with specific reference to translational inhibition exerted by VGAM1979 gene, herein designated VGAM GENE, on one or more VGAM1979 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1979 is inhibition of expression of host target genes, as part of a novel viral mechanism of attacking a host. Accordingly, utilities of VGAM1979 include diagnosis, prevention and treatment of viral infection by Bovine Herpesvirus 4. Specific functions, and accordingly utilities, of VGAM1979 correlate with, and may be deduced from, the identity of the host target genes which VGAM1979 binds and inhibits, and the function of these host target genes, as elaborated hereinbelow.

Nucleotide sequences of the VGAM1979 precursor RNA, herein designated VGAM PRECURSOR RNA, and of the 'diced' VGAM1979 RNA, herein designated VGAM RNA, and a schematic representation of the secondary folding of VGAM1979 folded precursor RNA, herein designated VGAM FOLDED PRECURSOR RNA, of VGAM1979 are further described hereinbelow with reference to Table 1.

Nucleotide sequences of host target binding sites, such as BINDING SITE-I, BINDING SITE-II and BINDING SITE-III of FIG. 1, found on VGAM1979 host target RNA, and schematic representation of the complementarity of each of these host target binding sites to VGAM1979 RNA, herein designated VGAM RNA, are described hereinbelow with reference to Table 2.

As mentioned hereinabove with reference to FIG. 1, a function of VGAM1979 gene, herein designated VGAM is inhibition of expression of VGAM1979 target genes. It is appreciated that specific functions, and accordingly utilities, of VGAM1979 correlate with, and may be deduced from, the identity of the target genes which VGAM1979 binds and inhibits, and the function of these target genes, as elaborated hereinbelow.

Protein Phosphatase 2, Regulatory Subunit B (B56), Epsilon Isoform (PPP2R5E, Accession NM_006246) is a VGAM1979 host target gene. PPP2R5E BINDING SITE is HOST TARGET binding site found in the 3" untranslated region of mRNA encoded by PPP2R5E, corresponding to a HOST TARGET binding site such as BINDING SITE I, BINDING SITE II or BINDING SITE III. Table 2 illustrates the complementarity of the nucleotide sequences of PPP2R5E BINDING SITE, designated SEQ ID:12921, to the nucleotide sequence of VGAM1979 RNA, herein designated VGAM RNA, also designated SEQ ID:4690.

A function of VGAM1979 is therefore inhibition of Protein Phosphatase 2, Regulatory Subunit B (B56), Epsilon Isoform (PPP2R5E, Accession NM_006246), a gene which is a regulatory subunit of protein phosphatase 2A. Accordingly, utilities of VGAM1979 include diagnosis, prevention and treatment of diseases and clinical conditions associated with PPP2R5E. The function of PPP2R5E and its association with various diseases and clinical conditions, has been established by previous studies, as described hereinabove with reference to VGAM302. Pyrroline-5-carboxylate Reductase 1 (PYCR1, Accession XM_046472) is another VGAM1979 host target gene. PYCR1 BINDING SITE is HOST TARGET binding site found in the 3' untranslated region of mRNA encoded by PYCR1, corresponding to a HOST TARGET binding site such as BINDING SITE I, BINDING SITE II or BINDING SITE III. Table 2 illustrates the complementarity of the nucleotide sequences of PYCR1 BINDING SITE, designated SEQ ID:34730, to the nucleotide sequence of VGAM1979 RNA, herein designated VGAM RNA, also designated SEQ ID:4690.

Another function of VGAM1979 is therefore inhibition of Pyrroline-5-carboxylate Reductase 1 (PYCR1, Accession XM_046472), a gene which catalyzes the NAD(P)H-dependent conversion of pyrroline-5-carboxylate to proline. Accordingly, utilities of VGAM1979 include diagnosis, prevention and treatment of diseases and clinical conditions associated with PYCR1. The function of PYCR1 and its association with various diseases and clinical conditions, has been established by previous studies, as described hereinabove with reference to VGAM178. Tetratricopeptide Repeat Domain 3 (TTC3, Accession NM_003316) is another VGAM1979 host target gene. TTC3 BINDING SITE is HOST TARGET binding site found in the 3' untranslated region of mRNA encoded by TTC3, corresponding to a HOST TARGET binding site such as BINDING SITE I, BINDING SITE II or BINDING SITE III. Table 2 illustrates the complementarity of the nucleotide sequences of TTC3 BINDING SITE, designated SEQ ID:9314, to the nucleotide sequence of VGAM1979 RNA, herein designated VGAM RNA, also designated SEQ ID:4690.

Another function of VGAM1979 is therefore inhibition of Tetratricopeptide Repeat Domain 3 (TTC3, Accession NM_003316), a gene which contains tetratricopeptide repeat (TPR) motifs. Accordingly, utilities of VGAM1979 include diagnosis, prevention and treatment of diseases and clinical conditions associated with TTC3. The function of TTC3 and its association with various diseases and clinical conditions, has been established by previous studies, as described hereinabove with reference to VGAM699. CASPR3 (Accession NM_024879) is another VGAM1979 host target gene. CASPR3 BINDING SITE is HOST TARGET binding site found in the 3' untranslated region of mRNA encoded by CASPR3, corresponding to a HOST TARGET binding site such as BINDING SITE I, BINDING SITE II or BINDING SITE III. Table 2 illustrates the complementarity of the nucleotide sequences of CASPR3 BINDING SITE, designated SEQ ID:24316, to the nucleotide sequence of VGAM1979 RNA, herein designated VGAM RNA, also designated SEQ ID:4690.

Another function of VGAM1979 is therefore inhibition of CASPR3 (Accession NM_024879). Accordingly, utilities of VGAM1979 include diagnosis, prevention and treatment of diseases and clinical conditions associated with CASPR3. Cell Adhesion Molecule with Homology to L1CAM (close homolog of L1) (CHL1, Accession NM_006614) is another VGAM1979 host target gene. CHL1 BINDING SITE is HOST TARGET binding site found in the 3' untranslated region of mRNA encoded by CHL1, corresponding to a HOST TARGET binding site such as BINDING SITE I, BINDING SITE II or BINDING SITE III. Table 2 illustrates the complementarity of the nucleotide sequences of CHL1 BINDING SITE, designated SEQ ID:13397, to the nucleotide sequence of VGAM1979 RNA, herein designated VGAM RNA, also designated SEQ ID:4690.

Another function of VGAM1979 is therefore inhibition of Cell Adhesion Molecule with Homology to L1CAM (close homolog of L1) (CHL1, Accession NM_006614). Accordingly, utilities of VGAM1979 include diagnosis, prevention and treatment of diseases and clinical conditions associated with CHL1. FLJ20060 (Accession NM_017645) is another VGAM1979 host target gene. FLJ20060 BINDING SITE is HOST TARGET binding site found in the 3' untranslated region of mRNA encoded by FLJ20060, corresponding to a HOST TARGET binding site such as BINDING SITE I, BINDING SITE II or BINDING SITE III. Table 2 illustrates the complementarity of the nucleotide sequences of FLJ20060 BINDING SITE, designated SEQ ID:19149, to the nucleotide sequence of VGAM1979 RNA, herein designated VGAM RNA, also designated SEQ ID:4690.

Another function of VGAM1979 is therefore inhibition of FLJ20060 (Accession NM_017645). Accordingly, utilities of VGAM1979 include diagnosis, prevention and treatment of diseases and clinical conditions associated with FLJ20060. FLJ22569 (Accession NM_023925) is another VGAM1979 host target gene. FLJ22569 BINDING SITE is HOST TARGET binding site found in the 5' untranslated region of mRNA encoded by FLJ22569, corresponding to a HOST TARGET binding site such as BINDING SITE I, BINDING SITE II or BINDING SITE III. Table 2 illustrates the complementarity of the nucleotide sequences of FLJ22569 BINDING SITE, designated SEQ ID:23402, to the nucleotide sequence of VGAM1979 RNA, herein designated VGAM RNA, also designated SEQ ID:4690.

Another function of VGAM1979 is therefore inhibition of FLJ22569 (Accession NM_023925). Accordingly, utilities of VGAM1979 include diagnosis, prevention and treatment of diseases and clinical conditions associated with FLJ22569. KIAA0367 (Accession XM_041018) is another VGAM1979 host target gene. KIAA0367 BINDING SITE is HOST TARGET binding site found in the 3' untranslated region of mRNA encoded by KIAA0367, corresponding to a HOST TARGET binding site such as BINDING SITE I, BINDING SITE II or BINDING SITE III. Table 2 illustrates the complementarity of the nucleotide sequences of KIAA0367 BINDING SITE, designated SEQ ID:33426, to the nucleotide sequence of VGAM1979 RNA, herein designated VGAM RNA, also designated SEQ ID:4690.

Another function of VGAM1979 is therefore inhibition of KIAA0367 (Accession XM_041018). Accordingly, utilities of VGAM1979 include diagnosis, prevention and treatment of diseases and clinical conditions associated with KIAA0367. MGC10200 (Accession NM_145060) is another VGAM1979 host target gene. MGC10200 BINDING SITE is HOST TARGET binding site found in the 3' untranslated region of mRNA encoded by MGC10200, corresponding to a HOST TARGET binding site such as BINDING SITE I, BINDING SITE II or BINDING SITE III. Table 2 illustrates the complementarity of the nucleotide sequences of MGC10200 BINDING SITE, designated SEQ ID:29695, to the nucleotide sequence of VGAM1979 RNA, herein designated VGAM RNA, also designated SEQ ID:4690.

Another function of VGAM1979 is therefore inhibition of MGC10200 (Accession NM_145060). Accordingly, utilities of VGAM1979 include diagnosis, prevention and treatment of diseases and clinical conditions associated with MGC10200. TERF1 (TRF1)-interacting Nuclear Factor 2 (TINF2, Accession NM_012461) is another VGAM1979 host target gene. TINF2 BINDING SITE is HOST TARGET binding site found in the 3' untranslated region of mRNA encoded by TINF2, corresponding to a HOST TARGET binding site such as BINDING SITE I, BINDING SITE II or BINDING SITE III. Table 2 illustrates the complementarity of the nucleotide sequences of TINF2 BINDING SITE, designated SEQ ID:14835, to the nucleotide sequence of VGAM1979 RNA, herein designated VGAM RNA, also designated SEQ ID:4690.

Another function of VGAM1979 is therefore inhibition of TERF1 (TRF1)-interacting Nuclear Factor 2 (TINF2, Accession NM_012461). Accordingly, utilities of VGAM1979 include diagnosis, prevention and treatment of diseases and clinical conditions associated with TINF2. LOC162333 (Accession XM_102591) is another VGAM1979 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42125, to the nucleotide sequence of VGAM1979 RNA, herein designated VGAM RNA, also designated SEQ ID:4690.

Another function of VGAM1979 is therefore inhibition of LOC162333 (Accession XM_102591). Accordingly, utilities of VGAM1979 include diagnosis, prevention and treatment of diseases and clinical conditions associated with LOC162333. FIG. 1 further provides a conceptual description of a novel bioinformatically detected viral gene of the present invention, referred to here as Viral Genomic Address Messenger 1980 (VGAM1980) viral gene, which modulates expression of respective host target genes thereof, the function and utility of which host target genes is known in the art.

VGAM1980 is a novel bioinformatically detected regulatory, non protein coding, viral micro RNA (miRNA) gene. The method by which VGAM1980 was detected is described hereinabove with reference to FIGS. 1-8.

VGAM1980 gene, herein designated VGAM GENE, is a viral gene contained in the genome of Bovine Herpesvirus 4. VGAM1980 host target gene, herein designated VGAM HOST TARGET GENE, is a human gene contained in the human genome.

VGAM1980 gene encodes a VGAM1980 precursor RNA, herein designated VGAM PRECURSOR RNA. Similar to other miRNA genes, and unlike most ordinary genes, VGAM1980 precursor RNA does not encode a protein. A nucleotide sequence identical or highly similar to the nucleotide sequence of VGAM1980 precursor RNA is designated SEQ ID:1966, and is provided hereinbelow with reference to the sequence listing part. Nucleotide sequence SEQ ID:1966 is located at position 9455 relative to the genome of Bovine Herpesvirus 4.

VGAM1980 precursor RNA folds onto itself, forming VGAM1980 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1980 folded precursor RNA into VGAM1980 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM1980 RNA is designated SEQ ID:4691, and is provided hereinbelow with reference to the sequence listing part.

VGAM1980 host target gene, herein designated VGAM HOST TARGET GENE, encodes a corresponding messenger RNA, VGAM1980 host target RNA, herein designated VGAM HOST TARGET RNA. VGAM1980 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1980 RNA, herein designated VGAM RNA, binds complementarily to one or more host target binding sites located in untranslated regions of VGAM1980 host target RNA, herein designated VGAM HOST TARGET RNA. This complementary binding is due to the fact that the nucleotide sequence of VGAM1980 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1980 RNA, herein designated VGAM RNA, may have a different number of host target binding sites in untranslated regions of a VGAM1980 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1980 RNA, herein designated VGAM RNA, to host target binding sites on VGAM1980 host target RNA, herein designated VGAM HOST TARGET RNA, such as BINDING SITE I, BINDING SITE II and BINDING SITE III, inhibits translation of VGAM1980 host target RNA into VGAM1980 host target protein, herein designated VGAM HOST TARGET PROTEIN. VGAM host target protein is therefore outlined by a broken line.

It is appreciated that VGAM1980 host target gene, herein designated VGAM HOST TARGET GENE, in fact represents a plurality of VGAM1980 host target genes. The mRNA of each one of this plurality of VGAM1980 host target genes comprises one or more host target binding sites, each having a nucleotide sequence which is at least partly complementary to VGAM1980 RNA, herein designated VGAM RNA, and which when bound by VGAM1980 RNA causes inhibition of translation of respective one or more VGAM1980 host target proteins.

It is further appreciated by one skilled in the art that the mode of translational inhibition illustrated by FIG. 1 with specific reference to translational inhibition exerted by VGAM1980 gene, herein designated VGAM GENE, on one or more VGAM1980 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1980 is inhibition of expression of host target genes, as part of a novel viral mechanism of attacking a host. Accordingly, utilities of VGAM1980 include diagnosis, prevention and treatment of viral infection by Bovine Herpesvirus 4. Specific functions, and accordingly utilities, of VGAM1980 correlate with, and may be deduced from, the identity of the host target genes which VGAM1980 binds and inhibits, and the function of these host target genes, as elaborated hereinbelow.

Nucleotide sequences of the VGAM1980 precursor RNA, herein designated VGAM PRECURSOR RNA, and of the 'diced' VGAM1980 RNA, herein designated VGAM RNA, and a schematic representation of the secondary folding of VGAM1980 folded precursor RNA, herein designated VGAM FOLDED PRECURSOR RNA, of VGAM1980 are further described hereinbelow with reference to Table 1.

Nucleotide sequences of host target binding sites, such as BINDING SITE-I, BINDING SITE-II and BINDING SITE-III of FIG. 1, found on VGAM1980 host target RNA, and schematic representation of the complementarity of each of these host target binding sites to VGAM1980 RNA, herein designated VGAM RNA, are described hereinbelow with reference to Table 2.

As mentioned hereinabove with reference to FIG. 1, a function of VGAM1980 gene, herein designated VGAM is inhibition of expression of VGAM1980 target genes. It is appreciated that specific functions, and accordingly utilities, of VGAM1980 correlate with, and may be deduced from, the identity of the target genes which VGAM1980 binds and inhibits, and the function of these target genes, as elaborated hereinbelow.

Lipin 1 (LPIN1, Accession XM_041136) is a VGAM1980 host target gene. LPIN1 BINDING SITE is HOST TARGET binding site found in the 3' untranslated region of mRNA encoded by LPIN1, corresponding to a HOST TARGET binding site such as BINDING SITE I, BINDING SITE II or BINDING SITE III. Table 2 illustrates the complementarity of the nucleotide sequences of LPIN1 BINDING SITE, designated SEQ ID:33466, to the nucleotide sequence of VGAM1980 RNA, herein designated VGAM RNA, also designated SEQ ID:4691.

A function of VGAM1980 is therefore inhibition of Lipin 1 (LPIN1, Accession XM_041136), a gene which is involved in adipocyte differenciation (by similarity). Accordingly, utilities of VGAM1980 include diagnosis, prevention and treatment of diseases and clinical conditions associated with LPIN1. The function of LPIN1 and its association with various diseases and clinical conditions, has been established by previous studies, as described hereinabove with reference to VGAM35. Presenilin 1 (Alzheimer disease 3) (PSEN1, Accession NM_000021) is another VGAM1980 host target gene. PSEN1 BINDING SITE1 and PSEN1 BINDING SITE2 are HOST TARGET binding sites found in untranslated regions of mRNA encoded by PSEN1, corresponding to HOST TARGET binding sites such as BINDING SITE I, BINDING SITE II or BINDING SITE III. Table 2 illustrates the complementarity of the nucleotide sequences of PSEN1 BINDING SITE1 and PSEN1 BINDING SITE2, designated SEQ ID:5455 and SEQ ID:14233 respectively, to the nucleotide sequence of VGAM1980 RNA, herein designated VGAM RNA, also designated SEQ ID:4691.

Another function of VGAM1980 is therefore inhibition of Presenilin 1 (Alzheimer disease 3) (PSEN1, Accession NM_000021). Accordingly, utilities of VGAM1980 include diagnosis, prevention and treatment of diseases and clinical conditions associated with PSEN1. KIAA1203 (Accession XM_049683) is another VGAM1980 host target gene. KIAA1203 BINDING SITE is HOST TARGET binding site found in the 3' untranslated region of mRNA encoded by KIAA1203, corresponding to a HOST TARGET binding site such as BINDING SITE I, BINDING SITE II or BINDING SITE III. Table 2 illustrates the complementarity of the nucleotide sequences of KIAA1203 BINDING SITE, designated SEQ ID:35465, to the nucleotide sequence of VGAM1980 RNA, herein designated VGAM RNA, also designated SEQ ID:4691.

Another function of VGAM1980 is therefore inhibition of KIAA1203 (Accession XM_049683). Accordingly, utilities of VGAM1980 include diagnosis, prevention and treatment of diseases and clinical conditions associated with KIAA1203. PIPPIN (Accession XM_086825) is another VGAM1980 host target gene. PIPPIN BINDING SITE is HOST TARGET binding site found in the 3' untranslated region of mRNA encoded by PIPPIN, corresponding to a HOST TARGET binding site such as BINDING SITE I, BINDING SITE II or BINDING SITE III. Table 2 illustrates the complementarity of the nucleotide sequences of PIPPIN BINDING SITE, designated SEQ ID:38908, to the nucleotide sequence of VGAM1980 RNA, herein designated VGAM RNA, also designated SEQ ID:4691.

Another function of VGAM1980 is therefore inhibition of PIPPIN (Accession XM_086825). Accordingly, utilities of VGAM1980 include diagnosis, prevention and treatment of diseases and clinical conditions associated with PIPPIN. PRO0529 (Accession NM_014074) is another VGAM1980 host target gene. PRO0529 BINDING SITE is HOST TARGET binding site found in the 5' untranslated region of mRNA encoded by PRO0529, corresponding to a HOST TARGET binding site such as BINDING SITE I, BINDING SITE II or BINDING SITE III. Table 2 illustrates the complementarity of the nucleotide sequences of PRO0529 BINDING SITE, designated SEQ ID:15302, to the nucleotide sequence of VGAM1980 RNA, herein designated VGAM RNA, also designated SEQ ID:4691.

Another function of VGAM1980 is therefore inhibition of PRO0529 (Accession NM_014074). Accordingly, utilities of VGAM1980 include diagnosis, prevention and treatment of diseases and clinical conditions associated with PRO0529.

FIG. 1 further provides a conceptual description of a novel bioinformatically detected viral gene of the present invention, referred to here as Viral Genomic Address Messenger 1981 (VGAM1981) viral gene, which modulates expression of respective host target genes thereof, the function and utility of which host target genes is known in the art.

VGAM1981 is a novel bioinformatically detected regulatory, non protein coding, viral micro RNA (miRNA) gene. The method by which VGAM1981 was detected is described hereinabove with reference to FIGS. 1-8.

VGAM1981 gene, herein designated VGAM GENE, is a viral gene contained in the genome of Hendra Virus. VGAM1981 host target gene, herein designated VGAM HOST TARGET GENE, is a human gene contained in the human genome.

VGAM1981 gene encodes a VGAM1981 precursor RNA, herein designated VGAM PRECURSOR RNA. Similar to other miRNA genes, and unlike most ordinary genes, VGAM1981 precursor RNA does not encode a protein. A nucleotide sequence identical or highly similar to the nucleotide sequence of VGAM1981 precursor RNA is designated SEQ ID:1967, and is provided hereinbelow with reference to the sequence listing part. Nucleotide sequence SEQ ID:1967 is located at position 10871 relative to the genome of Hendra Virus.

VGAM1981 precursor RNA folds onto itself, forming VGAM1981 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM1981 folded precursor RNA into VGAM1981 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 61%) nucleotide sequence of VGAM1981 RNA is designated SEQ ID:4692, and is provided hereinbelow with reference to the sequence listing part.

VGAM1981 host target gene, herein designated VGAM HOST TARGET GENE, encodes a corresponding messenger RNA, VGAM1981 host target RNA, herein designated VGAM HOST TARGET RNA. VGAM1981 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1981 RNA, herein designated VGAM RNA, binds complementarily to one or more host target binding sites located in untranslated regions of VGAM1981 host target RNA, herein designated VGAM HOST TARGET RNA. This complementary binding is due to the fact that the nucleotide sequence of VGAM1981 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1981 RNA, herein designated VGAM RNA, may have a different number of host target binding sites in untranslated regions of a VGAM1981 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1981 RNA, herein designated VGAM RNA, to host target binding sites on VGAM1981 host target RNA, herein designated VGAM HOST TARGET RNA, such as BINDING SITE I, BINDING SITE II and BINDING SITE III, inhibits translation of VGAM1981 host target RNA into VGAM1981 host target protein, herein designated VGAM HOST TARGET PROTEIN. VGAM host target protein is therefore outlined by a broken line.

It is appreciated that VGAM1981 host target gene, herein designated VGAM HOST TARGET GENE, in fact represents a plurality of VGAM1981 host target genes. The mRNA of each one of this plurality of VGAM1981 host target genes comprises one or more host target binding sites, each having a nucleotide sequence which is at least partly complementary to VGAM1981 RNA, herein designated VGAM RNA, and which when bound by VGAM1981 RNA causes inhibition of translation of respective one or more VGAM1981 host target proteins.

It is further appreciated by one skilled in the art that the mode of translational inhibition illustrated by FIG. 1 with specific reference to translational inhibition exerted by VGAM1981 gene, herein designated VGAM GENE, on one or more VGAM1981 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1981 is inhibition of expression of host target genes, as part of a novel viral mechanism of attacking a host. Accordingly, utilities of VGAM1981 include diagnosis, prevention and treatment of viral infection by Hendra Virus. Specific functions, and accordingly utilities, of VGAM1981 correlate with, and may be deduced from, the identity of the host target genes which VGAM1981 binds and inhibits, and the function of these host target genes, as elaborated hereinbelow.

Nucleotide sequences of the VGAM1981 precursor RNA, herein designated VGAM PRECURSOR RNA, and of the 'diced' VGAM1981 RNA, herein designated VGAM RNA, and a schematic representation of the secondary folding of VGAM1981 folded precursor RNA, herein designated VGAM FOLDED PRECURSOR RNA, of VGAM1981 are further described hereinbelow with reference to Table 1.

Nucleotide sequences of host target binding sites, such as BINDING SITE-I, BINDING SITE-II and BINDING SITE-III of FIG. 1, found on VGAM1981 host target RNA, and schematic representation of the complementarity of each of these host target binding sites to VGAM1981 RNA, herein designated VGAM RNA, are described hereinbelow with reference to Table 2.

As mentioned hereinabove with reference to FIG. 1, a function of VGAM1981 gene, herein designated VGAM is inhibition of expression of VGAM1981 target genes. It is appreciated that specific functions, and accordingly utilities, of VGAM1981 correlate with, and may be deduced from, the identity of the target genes which VGAM1981 binds and inhibits, and the function of these target genes, as elaborated hereinbelow.

Holocarboxylase Synthetase (biotin-[proprionyl-Coenzyme A-carboxylase (ATP-hydrolysing)] Ligase) (HLCS, Accession NM_000411) is a VGAM1981 host target gene. HLCS BINDING SITE is HOST TARGET binding site found in the 5' untranslated region of mRNA encoded by HLCS, corresponding to a HOST TARGET binding site such as BINDING SITE I, BINDING SITE II or BINDING SITE III. Table 2 illustrates the complementarity of the nucleotide sequences of HLCS BINDING SITE, designated SEQ ID:5987, to the nucleotide sequence of VGAM1981 RNA, herein designated VGAM RNA, also designated SEQ ID:4692.

A function of VGAM1981 is therefore inhibition of Holocarboxylase Synthetase (biotin-[proprionyl-Coenzyme A-carboxylase (ATP-hydrolysing)] Ligase) (HLCS, Accession NM_000411). Accordingly, utilities of VGAM1981 include diagnosis, prevention and treatment of diseases and clinical conditions associated with HLCS. Ligase IV, DNA, ATP-dependent (LIG4, Accession NM_002312) is another VGAM1981 host target gene. LIG4 BINDING SITE is HOST TARGET binding site found in the 5' untranslated region of mRNA encoded by LIG4, corresponding to a HOST TARGET binding site such as BINDING SITE I, BINDING SITE II or BINDING SITE III. Table 2 illustrates the complementarity of the nucleotide sequences of LIG4 BINDING SITE, designated SEQ ID:8107, to the nucleotide sequence of VGAM1981 RNA, herein designated VGAM RNA, also designated SEQ ID:4692.

Another function of VGAM1981 is therefore inhibition of Ligase IV, DNA, ATP-dependent (LIG4, Accession NM_002312), a gene which functions in DNA nonhomologous end-joining and V(D)J recombination. Accordingly, utilities of VGAM1981 include diagnosis, prevention and treatment of diseases and clinical conditions associated with LIG4. The function of LIG4 and its association with various diseases and clinical conditions, has been established by previous studies, as described hereinabove with reference to VGAM258. Microtubule-associated Protein, RP/EB Family, Member 2 (MAPRE2, Accession NM_014268) is another VGAM1981 host target gene. MAPRE2 BINDING SITE is HOST TARGET binding site found in the 3' untranslated region of mRNA encoded by MAPRE2, corresponding to a HOST TARGET binding site such as BINDING SITE I, BINDING SITE II or BINDING SITE III. Table 2 illustrates the complementarity of the nucleotide sequences of MAPRE2 BINDING SITE, designated SEQ ID:15543, to the nucleotide sequence of VGAM1981 RNA, herein designated VGAM RNA, also designated SEQ ID:4692.

Another function of VGAM1981 is therefore inhibition of Microtubule-associated Protein, RP/EB Family, Member 2 (MAPRE2, Accession NM_014268), a gene which The functional inactivation of the APC gene product is a key event in colorectal tumorigenesis. Accordingly, utilities of VGAM1981 include diagnosis, prevention and treatment of diseases and clinical conditions associated with MAPRE2. The function of MAPRE2 and its association with various diseases and clinical conditions, has been established by previous studies, as described hereinabove with reference to VGAM178. Phospholipase A2, Group X (PLA2G10, Accession NM_003561) is another VGAM1981 host target gene. PLA2G10 BINDING SITE is HOST TARGET binding site found in the 5' untranslated region of mRNA encoded by PLA2G10, corresponding to a HOST TARGET binding site such as BINDING SITE I, BINDING SITE II or BINDING SITE III. Table 2 illustrates the complementarity of the nucleotide sequences of PLA2G10 BINDING SITE, designated SEQ ID:9617, to the nucleotide sequence of VGAM1981 RNA, herein designated VGAM RNA, also designated SEQ ID:4692.

Another function of VGAM1981 is therefore inhibition of Phospholipase A2, Group X (PLA2G10, Accession NM_003561). Accordingly, utilities of VGAM1981 include diagnosis, prevention and treatment of diseases and clinical conditions associated with PLA2G10. Pleiomorphic Adenoma Gene 1 (PLAG1, Accession NM_002655) is another VGAM1981 host target gene. PLAG1 BINDING SITE is HOST TARGET binding site found in the 3' untranslated region of mRNA encoded by PLAG1, corresponding to a HOST TARGET binding site such as BINDING SITE I, BINDING SITE II or BINDING SITE III. Table 2 illustrates the complementarity of the nucleotide sequences of PLAG1 BINDING SITE, designated SEQ ID:8514, to the nucleotide sequence of VGAM1981 RNA, herein designated VGAM RNA, also designated SEQ ID:4692.

Another function of VGAM1981 is therefore inhibition of Pleiomorphic Adenoma Gene 1 (PLAG1, Accession NM_002655), a gene which contains a zinc finger domain. Accordingly, utilities of VGAM1981 include diagnosis, prevention and treatment of diseases and clinical conditions associated with PLAG1. The function of PLAG1 and its association with various diseases and clinical conditions, has been established by previous studies, as described hereinabove with reference to VGAM29. Staufen, RNA Binding Protein (Drosophila) (STAU, Accession NM_004602) is another VGAM1981 host target gene. STAU BINDING SITE1 through STAU BINDING SITE4 are HOST TARGET binding sites found in untranslated regions of mRNA encoded by STAU, corresponding to HOST TARGET binding sites such as BINDING SITE I, BINDING SITE II or BINDING SITE III. Table 2 illustrates the complementarity of the nucleotide sequences of STAU BINDING SITE1 through STAU BINDING SITE4, designated SEQ ID:10939, SEQ ID:18924, SEQ ID:18912 and SEQ ID:18918 respectively, to the nucleotide sequence of VGAM1981 RNA, herein designated VGAM RNA, also designated SEQ ID:4692.

Another function of VGAM1981 is therefore inhibition of Staufen, RNA Binding Protein (Drosophila) (STAU, Accession NM_004602), a gene which may play a role in specific positioning of mrnas at given sites in the cell and in stimulating their translation at the site. Accordingly, utilities of VGAM1981 include diagnosis, prevention and treatment of diseases and clinical conditions associated with STAU. The function of STAU and its association with various diseases and clinical conditions, has been established by previous studies, as described hereinabove with reference to VGAM916. FLJ13910 (Accession NM_022780) is another VGAM1981 host target gene. FLJ13910 BINDING SITE is HOST TARGET binding site found in the 3' untranslated region of mRNA encoded by FLJ13910, corresponding to a HOST TARGET binding site such as BINDING SITE I, BINDING SITE II or BINDING SITE III. Table 2 illustrates the complementarity of the nucleotide sequences of FLJ13910 BINDING SITE, designated SEQ ID:23053, to the nucleotide sequence of VGAM1981 RNA, herein designated VGAM RNA, also designated SEQ ID:4692.

Another function of VGAM1981 is therefore inhibition of FLJ13910 (Accession NM_022780). Accordingly, utilities of VGAM1981 include diagnosis, prevention and treatment of diseases and clinical conditions associated with FLJ13910. FLJ20086 (Accession NM_017661) is another VGAM1981 host target gene. FLJ20086 BINDING SITE is HOST TARGET binding site found in the 3' untranslated region of mRNA encoded by FLJ20086, corresponding to a HOST TARGET binding site such as BINDING SITE I, BINDING SITE II or BINDING SITE III. Table 2 illustrates the complementarity of the nucleotide sequences of FLJ20086 BINDING SITE, designated SEQ ID:19189, to the nucleotide sequence of VGAM1981 RNA, herein designated VGAM RNA, also designated SEQ ID:4692.

Another function of VGAM1981 is therefore inhibition of FLJ20086 (Accession NM_017661). Accordingly, utilities of VGAM1981 include diagnosis, prevention and treatment of diseases and clinical conditions associated with FLJ20086. KIAA0931 (Accession XM_041191) is another VGAM1981 host target gene. KIAA0931 BINDING SITE is HOST TARGET binding site found in the 3' untranslated region of mRNA encoded by KIAA0931, corresponding to a HOST TARGET binding site such as BINDING SITE I, BINDING SITE II or BINDING SITE III. Table 2 illustrates the complementarity of the nucleotide sequences of KIAA0931 BINDING SITE, designated SEQ ID:33480, to the nucleotide sequence of VGAM1981 RNA, herein designated VGAM RNA, also designated SEQ ID:4692.

Another function of VGAM1981 is therefore inhibition of KIAA0931 (Accession XM_041191). Accordingly, utilities of VGAM1981 include diagnosis, prevention and treatment of diseases and clinical conditions associated with KIAA0931. KIAA0953 (Accession XM_039733) is another VGAM1981 host target gene. KIAA0953 BINDING SITE is HOST TARGET binding site found in the 3' untranslated region of mRNA encoded by KIAA0953, corresponding to a HOST TARGET binding site such as BINDING SITE I, BINDING SITE II or BINDING SITE III. Table 2 illustrates the complementarity of the nucleotide sequences of KIAA0953 BINDING SITE, designated SEQ ID:33166, to the nucleotide sequence of VGAM1981 RNA, herein designated VGAM RNA, also designated SEQ ID:4692.

Another function of VGAM1981 is therefore inhibition of KIAA0953 (Accession XM_039733). Accordingly, utilities of VGAM1981 include diagnosis, prevention and treatment of diseases and clinical conditions associated with KIAA0953. KIAA1323 (Accession XM_032146) is another VGAM1981 host target gene. KIAA1323 BINDING SITE is HOST TARGET binding site found in the 5' untranslated region of mRNA encoded by KIAA1323, corresponding to a HOST TARGET binding site such as BINDING SITE I, BINDING SITE II or BINDING SITE III. Table 2 illustrates the complementarity of the nucleotide sequences of KIAA1323 BINDING SITE, designated SEQ ID:31560, to the nucleotide sequence of VGAM1981 RNA, herein designated VGAM RNA, also designated SEQ ID:4692.

Another function of VGAM1981 is therefore inhibition of KIAA1323 (Accession XM_032146). Accordingly, utilities of VGAM1981 include diagnosis, prevention and treatment of diseases and clinical conditions associated with KIAA1323. Retinoic Acid Induced 17 (RAI17, Accession XM_166091) is another VGAM1981 host target gene. RAI17 BINDING SITE is HOST TARGET binding site found in the 3' untranslated region of mRNA encoded by RAI17, corresponding to a HOST TARGET binding site such as BINDING SITE I, BINDING SITE II or BINDING SITE III. Table 2 illustrates the complementarity of the nucleotide sequences of RAI17 BINDING SITE, designated SEQ ID:43855, to the nucleotide sequence of VGAM1981 RNA, herein designated VGAM RNA, also designated SEQ ID:4692.

Another function of VGAM1981 is therefore inhibition of Retinoic Acid Induced 17 (RAI17, Accession XM_166091). Accordingly, utilities of VGAM1981 include diagnosis, prevention and treatment of diseases and clinical conditions associated with RAI17. SEC24 Related Gene Family, Member B (S. cerevisiae) (SEC24B, Accession NM_006323) is another VGAM1981 host target gene. SEC24B BINDING SITE is HOST TARGET binding site found in the 3' untranslated region of mRNA encoded by SEC24B, corresponding to a HOST TARGET binding site such as BINDING SITE I, BINDING SITE II or BINDING SITE III. Table 2 illustrates the complementarity of the nucleotide sequences of SEC24B BINDING SITE, designated SEQ ID:13015, to the nucleotide sequence of VGAM1981 RNA, herein designated VGAM RNA, also designated SEQ ID:4692.

Another function of VGAM1981 is therefore inhibition of SEC24 Related Gene Family, Member B (S. cerevisiae) (SEC24B, Accession NM_006323). Accordingly, utilities of VGAM1981 include diagnosis, prevention and treatment of diseases and clinical conditions associated with SEC24B. Sialyltransferase 4A (beta-galactoside alpha-2,3-sialytransferase) (SIAT4A, Accession NM_003033) is another VGAM1981 host target gene. SIAT4A BINDING SITE is HOST TARGET binding site found in the 5' untranslated region of mRNA encoded by SIAT4A, corresponding to a HOST TARGET binding site such as BINDING SITE I, BINDING SITE II or BINDING SITE III. Table 2 illustrates the complementarity of the nucleotide sequences of SIAT4A BINDING SITE, designated SEQ ID:8977, to the nucleotide sequence of VGAM1981 RNA, herein designated VGAM RNA, also designated SEQ ID:4692.

Another function of VGAM1981 is therefore inhibition of Sialyltransferase 4A (beta-galactoside alpha-2,3-sialytransferase) (SIAT4A, Accession NM_003033). Accordingly, utilities of VGAM1981 include diagnosis, prevention and treatment of diseases and clinical conditions associated with SIAT4A. FIG. 1 further provides a conceptual description of a novel bioinformatically detected viral gene of the present invention, referred to here as Viral Genomic Address Messenger 1982 (VGAM1982) viral gene, which modulates expression of respective host target genes thereof, the function and utility of which host target genes is known in the art.

VGAM1982 is a novel bioinformatically detected regulatory, non protein coding, viral micro RNA (miRNA) gene. The method by which VGAM1982 was detected is described hereinabove with reference to FIGS. 1-8.

VGAM1982 gene, herein designated VGAM GENE, is a viral gene contained in the genome of Hendra Virus. VGAM1982 host target gene, herein designated VGAM HOST TARGET GENE, is a human gene contained in the human genome.

VGAM1982 gene encodes a VGAM1982 precursor RNA, herein designated VGAM PRECURSOR RNA. Similar to other miRNA genes, and unlike most ordinary genes, VGAM1982 precursor RNA does not encode a protein. A nucleotide sequence identical or highly similar to the nucleotide sequence of VGAM1982 precursor RNA is designated SEQ ID:1968, and is provided hereinbelow with reference to the sequence listing part. Nucleotide sequence SEQ ID:1968 is located at position 3780 relative to the genome of Hendra Virus.

VGAM1982 precursor RNA folds onto itself, forming VGAM1982 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1982 folded precursor RNA into VGAM1982 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1982 RNA is designated SEQ ID:4693, and is provided hereinbelow with reference to the sequence listing part.

VGAM1982 host target gene, herein designated VGAM HOST TARGET GENE, encodes a corresponding messenger RNA, VGAM1982 host target RNA, herein designated VGAM HOST TARGET RNA. VGAM1982 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1982 RNA, herein designated VGAM RNA, binds complementarily to one or more host target binding sites located in untranslated regions of VGAM1982 host target RNA, herein designated VGAM HOST TARGET RNA. This complementary binding is due to the fact that the nucleotide sequence of VGAM1982 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1982 RNA, herein designated VGAM RNA, may have a different number of host target binding sites in untranslated regions of a VGAM1982 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1982 RNA, herein designated VGAM RNA, to host target binding sites on VGAM1982 host target RNA, herein designated VGAM HOST TARGET RNA, such as BINDING SITE I, BINDING SITE II and BINDING SITE III, inhibits translation of VGAM1982 host target RNA into VGAM1982 host target protein, herein designated VGAM HOST TARGET PROTEIN. VGAM host target protein is therefore outlined by a broken line.

It is appreciated that VGAM1982 host target gene, herein designated VGAM HOST TARGET GENE, in fact represents a plurality of VGAM1982 host target genes. The mRNA of each one of this plurality of VGAM1982 host target genes comprises one or more host target binding sites, each having a nucleotide sequence which is at least partly complementary to VGAM1982 RNA, herein designated VGAM RNA, and which when bound by VGAM1982 RNA causes inhibition of translation of respective one or more VGAM1982 host target proteins.

It is further appreciated by one skilled in the art that the mode of translational inhibition illustrated by FIG. 1 with specific reference to translational inhibition exerted by VGAM1982 gene, herein designated VGAM GENE, on one or more VGAM1982 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1982 is inhibition of expression of host target genes, as part of a novel viral mechanism of attacking a host. Accordingly, utilities of VGAM1982 include diagnosis, prevention and treatment of viral infection by Hendra Virus. Specific functions, and accordingly utilities, of VGAM1982 correlate with, and may be deduced from, the identity of the host target genes which VGAM1982 binds and inhibits, and the function of these host target genes, as elaborated hereinbelow.

Nucleotide sequences of the VGAM1982 precursor RNA, herein designated VGAM PRECURSOR RNA, and of the 'diced' VGAM1982 RNA, herein designated VGAM RNA, and a schematic representation of the secondary folding of VGAM1982 folded precursor RNA, herein designated VGAM FOLDED PRECURSOR RNA, of VGAM1982 are further described hereinbelow with reference to Table 1.

Nucleotide sequences of host target binding sites, such as BINDING SITE-I, BINDING SITE-II and BINDING SITE-III of FIG. 1, found on VGAM1982 host target RNA, and schematic representation of the complementarity of each of these host target binding sites to VGAM1982 RNA, herein designated VGAM RNA, are described hereinbelow with reference to Table 2.

As mentioned hereinabove with reference to FIG. 1, a function of VGAM1982 gene, herein designated VGAM is inhibition of expression of VGAM1982 target genes. It is appreciated that specific functions, and accordingly utilities, of VGAM1982 correlate with, and may be deduced from, the identity of the target genes which VGAM1982 binds and inhibits, and the function of these target genes, as elaborated hereinbelow.

KIAA0553 (Accession XM_045981) is a VGAM1982 host target gene. KIAA0553 BINDING SITE is HOST TARGET binding site found in the 3' untranslated region of mRNA encoded by KIAA0553, corresponding to a HOST TARGET binding site such as BINDING SITE I, BINDING SITE II or BINDING SITE III. Table 2 illustrates the complementarity of the nucleotide sequences of KIAA0553 BINDING SITE, designated SEQ ID:34636, to the nucleotide sequence of VGAM1982 RNA, herein designated VGAM RNA, also designated SEQ ID:4693.

A function of VGAM1982 is therefore inhibition of KIAA0553 (Accession XM_045981). Accordingly, utilities of VGAM1982 include diagnosis, prevention and treatment of diseases and clinical conditions associated with KIAA0553. MST4 (Accession NM_016542) is another VGAM1982 host target gene. MST4 BINDING SITE is HOST TARGET binding site found in the 3' untranslated region of mRNA encoded by MST4, corresponding to a HOST TARGET binding site such as BINDING SITE I, BINDING SITE II or BINDING SITE III. Table 2 illustrates the complementarity of the nucleotide sequences of MST4 BINDING SITE, designated SEQ ID:18607, to the nucleotide sequence of VGAM1982 RNA, herein designated VGAM RNA, also designated SEQ ID:4693.

Another function of VGAM1982 is therefore inhibition of MST4 (Accession NM_016542). Accordingly, utilities of VGAM1982 include diagnosis, prevention and treatment of diseases and clinical conditions associated with MST4. FIG. 1 further provides a conceptual description of a novel bioinformatically detected viral gene of the present invention, referred to here as Viral Genomic Address Messenger 1983 (VGAM1983) viral gene, which modulates expression of respective host target genes thereof, the function and utility of which host target genes is known in the art.

VGAM1983 is a novel bioinformatically detected regulatory, non protein coding, viral micro RNA (miRNA) gene. The method by which VGAM1983 was detected is described hereinabove with reference to FIGS. 1-8.

VGAM1983 gene, herein designated VGAM GENE, is a viral gene contained in the genome of Hendra Virus. VGAM1983 host target gene, herein designated VGAM HOST TARGET GENE, is a human gene contained in the human genome.

VGAM1983 gene encodes a VGAM1983 precursor RNA, herein designated VGAM PRECURSOR RNA. Similar to other miRNA genes, and unlike most ordinary genes, VGAM1983 precursor RNA does not encode a protein. A nucleotide sequence identical or highly similar to the nucleotide sequence of VGAM1983 precursor RNA is designated SEQ ID:1969, and is provided hereinbelow with reference to the sequence listing part. Nucleotide sequence SEQ ID:1969 is located at position 5639 relative to the genome of Hendra Virus.

VGAM1983 precursor RNA folds onto itself, forming VGAM1983 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1983 folded precursor RNA into VGAM1983 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM1983 RNA is designated SEQ ID:4694, and is provided hereinbelow with reference to the sequence listing part.

VGAM1983 host target gene, herein designated VGAM HOST TARGET GENE, encodes a corresponding messenger RNA, VGAM1983 host target RNA, herein designated VGAM HOST TARGET RNA. VGAM1983 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1983 RNA, herein designated VGAM RNA, binds complementarily to one or more host target binding sites located in untranslated regions of VGAM1983 host target RNA, herein designated VGAM HOST TARGET RNA. This complementary binding is due to the fact that the nucleotide sequence of VGAM1983 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1983 RNA, herein designated VGAM RNA, may have a different number of host target binding sites in untranslated regions of a VGAM1983 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1983 RNA, herein designated VGAM RNA, to host target binding sites on VGAM1983 host target RNA, herein designated VGAM HOST TARGET RNA, such as BINDING SITE I, BINDING SITE II and BINDING SITE III, inhibits translation of VGAM1983 host target RNA into VGAM1983 host target protein, herein designated VGAM HOST TARGET PROTEIN. VGAM host target protein is therefore outlined by a broken line.

It is appreciated that VGAM1983 host target gene, herein designated VGAM HOST TARGET GENE, in fact represents a plurality of VGAM1983 host target genes. The mRNA of each one of this plurality of VGAM1983 host target genes comprises one or more host target binding sites, each having a nucleotide sequence which is at least partly complementary to VGAM1983 RNA, herein designated VGAM RNA, and which when bound by VGAM1983 RNA causes inhibition of translation of respective one or more VGAM1983 host target proteins.

It is further appreciated by one skilled in the art that the mode of translational inhibition illustrated by FIG. 1 with specific reference to translational inhibition exerted by VGAM1983 gene, herein designated VGAM GENE, on one or more VGAM1983 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1983 is inhibition of expression of host target genes, as part of a novel viral mechanism of attacking a host. Accordingly, utilities of VGAM1983 include diagnosis, prevention and treatment of viral infection by Hendra Virus. Specific functions, and accordingly utilities, of VGAM1983 correlate with, and may be deduced from, the identity of the host target genes which VGAM1983 binds and inhibits, and the function of these host target genes, as elaborated hereinbelow.

Nucleotide sequences of the VGAM1983 precursor RNA, herein designated VGAM PRECURSOR RNA, and of the 'diced' VGAM1983 RNA, herein designated VGAM RNA, and a schematic representation of the secondary folding of VGAM1983 folded precursor RNA, herein designated VGAM FOLDED PRECURSOR RNA, of VGAM1983 are further described hereinbelow with reference to Table 1.

Nucleotide sequences of host target binding sites, such as BINDING SITE-I, BINDING SITE-II and BINDING SITE-III of FIG. 1, found on VGAM1983 host target RNA, and schematic representation of the complementarity of each of these host target binding sites to VGAM1983 RNA, herein designated VGAM RNA, are described hereinbelow with reference to Table 2.

As mentioned hereinabove with reference to FIG. 1, a function of VGAM1983 gene, herein designated VGAM is inhibition of expression of VGAM1983 target genes. It is appreciated that specific functions, and accordingly utilities, of VGAM1983 correlate with, and may be deduced from, the identity of the target genes which VGAM1983 binds and inhibits, and the function of these target genes, as elaborated hereinbelow.

Arginine Vasopressin Receptor 2 (nephrogenic diabetes insipidus) (AVPR2, Accession NM_000054) is a VGAM1983 host target gene. AVPR2 BINDING SITE is HOST TARGET binding site found in the 5' untranslated region of mRNA encoded by AVPR2, corresponding to a HOST TARGET binding site such as BINDING SITE I, BINDING SITE II or BINDING SITE III. Table 2 illustrates the complementarity of the nucleotide sequences of AVPR2 BINDING SITE, designated SEQ ID:5511, to the nucleotide sequence of VGAM1983 RNA, herein designated VGAM RNA, also designated SEQ ID:4694.

A function of VGAM1983 is therefore inhibition of Arginine Vasopressin Receptor 2 (nephrogenic diabetes insipidus) (AVPR2, Accession NM_000054). Accordingly, utilities of VGAM1983 include diagnosis, prevention and treatment of diseases and clinical conditions associated with AVPR2. High Mobility Group AT-hook 2 (HMGA2, Accession NM_003483) is another VGAM1983 host target gene. HMGA2 BINDING SITE is HOST TARGET binding site found in the 3' untranslated region of mRNA encoded by HMGA2, corresponding to a HOST TARGET binding site such as BINDING SITE I, BINDING SITE II or BINDING SITE III. Table 2 illustrates the complementarity of the nucleotide sequences of HMGA2 BINDING SITE, designated SEQ ID:9563, to the nucleotide sequence of VGAM1983 RNA, herein designated VGAM RNA, also designated SEQ ID:4694.

Another function of VGAM1983 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM1983 include diagnosis, prevention and treatment of diseases and clinical conditions associated with HMGA2. The function of HMGA2 and its association with various diseases and clinical conditions, has been established by previous studies, as described hereinabove with reference to VGAM552. Myotubularin Related Protein 2 (MTMR2, Accession NM_016156) is another VGAM1983 host target gene. MTMR2 BINDING SITE is HOST TARGET binding site found in the 3' untranslated region of mRNA encoded by MTMR2, corresponding to a HOST TARGET binding site such as BINDING SITE I, BINDING SITE II or BINDING SITE III. Table 2 illustrates the complementarity of the nucleotide sequences of MTMR2 BINDING SITE, designated SEQ ID:18244, to the nucleotide sequence of VGAM1983 RNA, herein designated VGAM RNA, also designated SEQ ID:4694.

Another function of VGAM1983 is therefore inhibition of Myotubularin Related Protein 2 (MTMR2, Accession NM_016156). Accordingly, utilities of VGAM1983 include diagnosis, prevention and treatment of diseases and clinical conditions associated with MTMR2. Vascular Cell Adhesion Molecule 1 (VCAM1, Accession NM_080682) is another VGAM1983 host target gene. VCAM1 BINDING SITE1 and VCAM1 BINDING SITE2 are HOST TARGET binding sites found in untranslated regions of mRNA encoded by VCAM1, corresponding to HOST TARGET binding sites such as BINDING SITE I, BINDING SITE II or BINDING SITE III. Table 2 illustrates the complementarity of the nucleotide sequences of VCAM1 BINDING SITE1 and VCAM1 BINDING SITE2, designated SEQ ID:27984 and SEQ ID:6738 respectively, to the nucleotide sequence of VGAM1983 RNA, herein designated VGAM RNA, also designated SEQ ID:4694.

Another function of VGAM1983 is therefore inhibition of Vascular Cell Adhesion Molecule 1 (VCAM1, Accession NM_080682). Accordingly, utilities of VGAM1983 include diagnosis, prevention and treatment of diseases and clinical conditions associated with VCAM1. SPEC1 (Accession NM_020239) is another VGAM1983 host target gene. SPEC1 BINDING SITE is HOST TARGET binding site found in the 3' untranslated region of mRNA encoded by SPEC1, corresponding to a HOST TARGET binding site such as BINDING SITE I, BINDING SITE II or BINDING SITE III. Table 2 illustrates the complementarity of the nucleotide sequences of SPEC1 BINDING SITE, designated SEQ ID:21514, to the nucleotide sequence of VGAM1983 RNA, herein designated VGAM RNA, also designated SEQ ID:4694.

Another function of VGAM1983 is therefore inhibition of SPEC1 (Accession NM_020239). Accordingly, utilities of VGAM1983 include diagnosis, prevention and treatment of diseases and clinical conditions associated with SPEC1. LOC89932 (Accession XM_027341) is another VGAM1983 host target gene. LOC89932 BINDING SITE is HOST TARGET binding site found in the 5' untranslated region of mRNA encoded by LOC89932, corresponding to a HOST TARGET binding site such as BINDING SITE I, BINDING SITE II or BINDING SITE III. Table 2 illustrates the complementarity of the nucleotide sequences of LOC89932 BINDING SITE, designated SEQ ID:30492, to the nucleotide sequence of VGAM1983 RNA, herein designated VGAM RNA, also designated SEQ ID:4694.

Another function of VGAM1983 is therefore inhibition of LOC89932 (Accession XM_027341). Accordingly, utilities of VGAM1983 include diagnosis, prevention and treatment of diseases and clinical conditions associated with LOC89932. FIG. 1 further provides a conceptual description of a novel bioinformatically detected viral gene of the present invention, referred to here as Viral Genomic Address Messenger 1984 (VGAM1984) viral gene, which modulates expression of respective host target genes thereof, the function and utility of which host target genes is known in the art.

VGAM1984 is a novel bioinformatically detected regulatory, non protein coding, viral micro RNA (miRNA) gene. The method by which VGAM1984 was detected is described hereinabove with reference to FIGS. 1-8.

VGAM1984 gene, herein designated VGAM GENE, is a viral gene contained in the genome of Hendra Virus. VGAM1984 host target gene, herein designated VGAM HOST TARGET GENE, is a human gene contained in the human genome.

VGAM1984 gene encodes a VGAM1984 precursor RNA, herein designated VGAM PRECURSOR RNA. Similar to other miRNA genes, and unlike most ordinary genes, VGAM1984 precursor RNA does not encode a protein. A nucleotide sequence identical or highly similar to the nucleotide sequence of VGAM1984 precursor RNA is designated SEQ ID:1970, and is provided hereinbelow with reference to the sequence listing part. Nucleotide sequence SEQ ID:1970 is located at position 7867 relative to the genome of Hendra Virus.

VGAM1984 precursor RNA folds onto itself, forming VGAM1984 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1984 folded precursor RNA into VGAM1984 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1984 RNA is designated SEQ ID:4695, and is provided hereinbelow with reference to the sequence listing part.

VGAM1984 host target gene, herein designated VGAM HOST TARGET GENE, encodes a corresponding messenger RNA, VGAM1984 host target RNA, herein designated VGAM HOST TARGET RNA. VGAM1984 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1984 RNA, herein designated VGAM RNA, binds complementarily to one or more host target binding sites located in untranslated regions of VGAM1984 host target RNA, herein designated VGAM HOST TARGET RNA. This complementary binding is due to the fact that the nucleotide sequence of VGAM1984 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1984 RNA, herein designated VGAM RNA, may have a different number of host target binding sites in untranslated regions of a VGAM1984 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1984 RNA, herein designated VGAM RNA, to host target binding sites on VGAM1984 host target RNA, herein designated VGAM HOST TARGET RNA, such as BINDING SITE I, BINDING SITE II and BINDING SITE III, inhibits translation of VGAM1984 host target RNA into VGAM1984 host target protein, herein designated VGAM HOST TARGET PROTEIN. VGAM host target protein is therefore outlined by a broken line.

It is appreciated that VGAM1984 host target gene, herein designated VGAM HOST TARGET GENE, in fact represents a plurality of VGAM1984 host target genes. The mRNA of each one of this plurality of VGAM1984 host target genes comprises one or more host target binding sites, each having a nucleotide sequence which is at least partly complementary to VGAM1984 RNA, herein designated VGAM RNA, and which when bound by VGAM1984 RNA causes inhibition of translation of respective one or more VGAM1984 host target proteins.

It is further appreciated by one skilled in the art that the mode of translational inhibition illustrated by FIG. 1 with specific reference to translational inhibition exerted by VGAM1984 gene, herein designated VGAM GENE, on one or more VGAM1984 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1984 is inhibition of expression of host target genes, as part of a novel viral mechanism of attacking a host. Accordingly, utilities of VGAM1984 include diagnosis, prevention and treatment of viral infection by Hendra Virus. Specific functions, and accordingly utilities, of VGAM1984 correlate with, and may be deduced from, the identity of the host target genes which VGAM1984 binds and inhibits, and the function of these host target genes, as elaborated hereinbelow.

Nucleotide sequences of the VGAM1984 precursor RNA, herein designated VGAM PRECURSOR RNA, and of the 'diced' VGAM1984 RNA, herein designated VGAM RNA, and a schematic representation of the secondary folding of VGAM1984 folded precursor RNA, herein designated VGAM FOLDED PRECURSOR RNA, of VGAM1984 are further described hereinbelow with reference to Table 1.

Nucleotide sequences of host target binding sites, such as BINDING SITE-I, BINDING SITE-II and BINDING SITE-III of FIG. 1, found on VGAM1984 host target RNA, and schematic representation of the complementarity of each of these host target binding sites to VGAM1984 RNA, herein designated VGAM RNA, are described hereinbelow with reference to Table 2.

As mentioned hereinabove with reference to FIG. 1, a function of VGAM1984 gene, herein designated VGAM is inhibition of expression of VGAM1984 target genes. It is appreciated that specific functions, and accordingly utilities, of VGAM1984 correlate with, and may be deduced from, the identity of the target genes which VGAM1984 binds and inhibits, and the function of these target genes, as elaborated hereinbelow.

Secretogranin III (SCG3, Accession NM_013243) is a VGAM1984 host target gene. SCG3 BINDING SITE is HOST TARGET binding site found in the 3' untranslated region of mRNA encoded by SCG3, corresponding to a HOST TARGET binding site such as BINDING SITE I, BINDING SITE II or BINDING SITE III. Table 2 illustrates the complementarity of the nucleotide sequences of SCG3 BINDING SITE, designated SEQ ID:14904, to the nucleotide sequence of VGAM1984 RNA, herein designated VGAM RNA, also designated SEQ ID:4695.

A function of VGAM1984 is therefore inhibition of Secretogranin III (SCG3, Accession NM_013243). Accordingly, utilities of VGAM1984 include diagnosis, prevention and treatment of diseases and clinical conditions associated with SCG3. FLJ20086 (Accession NM_017661) is another VGAM1984 host target gene. FLJ20086 BINDING SITE is HOST TARGET binding site found in the 3' untranslated region of mRNA encoded by FLJ20086, corresponding to a HOST TARGET binding site such as BINDING SITE I, BINDING SITE II or BINDING SITE III. Table 2 illustrates the complementarity of the nucleotide sequences of FLJ20086 BINDING SITE, designated SEQ ID:19192, to the nucleotide sequence of VGAM1984 RNA, herein designated VGAM RNA, also designated SEQ ID:4695.

Another function of VGAM1984 is therefore inhibition of FLJ20086 (Accession NM_017661). Accordingly, utilities of VGAM1984 include diagnosis, prevention and treatment of diseases and clinical conditions associated with FLJ20086. Junctional Adhesion Molecule 1 (JAM1, Accession NM_144501) is another VGAM1984 host target gene. JAM1 BINDING SITE1 through JAM1 BINDING SITE5 are HOST TARGET binding sites found in untranslated regions of mRNA encoded by JAM1, corresponding to HOST TARGET binding sites such as BINDING SITE I, BINDING SITE II or BINDING SITE III. Table 2 illustrates the complementarity of the nucleotide sequences of JAM1 BINDING SITE1 through JAM1 BINDING SITE5, designated SEQ ID:29321, SEQ ID:29328, SEQ ID:18861, SEQ ID:29337 and SEQ ID:29348 respectively, to the nucleotide sequence of VGAM1984 RNA, herein designated VGAM RNA, also designated SEQ ID:4695.

Another function of VGAM1984 is therefore inhibition of Junctional Adhesion Molecule 1 (JAM1, Accession NM_144501). Accordingly, utilities of VGAM1984 include diagnosis, prevention and treatment of diseases and clinical conditions associated with JAM1. Yes-associated Protein 1, 65 kDa (YAP1, Accession NM_006106) is another VGAM1984 host target gene. YAP1 BINDING SITE is HOST TARGET binding site found in the 3' untranslated region of mRNA encoded by YAP1, corresponding to a HOST TARGET binding site such as BINDING SITE I, BINDING SITE II or BINDING SITE III. Table 2 illustrates the complementarity of the nucleotide sequences of YAP1 BINDING SITE, designated SEQ ID:12750, to the nucleotide sequence of VGAM1984 RNA, herein designated VGAM RNA, also designated SEQ ID:4695.

Another function of VGAM1984 is therefore inhibition of Yes-associated Protein 1, 65 kDa (YAP1, Accession NM_006106). Accordingly, utilities of VGAM1984 include diagnosis, prevention and treatment of diseases and clinical conditions associated with YAP1. FIG. 1 further provides a conceptual description of a novel bioinformatically detected viral gene of the present invention, referred to here as Viral Genomic Address Messenger 1985 (VGAM1985) viral gene, which modulates expression of respective host target genes thereof, the function and utility of which host target genes is known in the art.

VGAM1985 is a novel bioinformatically detected regulatory, non protein coding, viral micro RNA (miRNA) gene. The method by which VGAM1985 was detected is described hereinabove with reference to FIGS. 1-8.

VGAM1985 gene, herein designated VGAM GENE, is a viral gene contained in the genome of Hendra Virus. VGAM1985 host target gene, herein designated VGAM HOST TARGET GENE, is a human gene contained in the human genome.

VGAM1985 gene encodes a VGAM1985 precursor RNA, herein designated VGAM PRECURSOR RNA. Similar to other miRNA genes, and unlike most ordinary genes, VGAM1985 precursor RNA does not encode a protein. A nucleotide sequence identical or highly similar to the nucleotide sequence of VGAM1985 precursor RNA is designated SEQ ID:1971, and is provided hereinbelow with reference to the sequence listing part. Nucleotide sequence SEQ ID:1971 is located at position 3920 relative to the genome of Hendra Virus.

VGAM1985 precursor RNA folds onto itself, forming VGAM1985 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1985 folded precursor RNA into VGAM1985 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM1985 RNA is designated SEQ ID:4696, and is provided hereinbelow with reference to the sequence listing part.

VGAM1985 host target gene, herein designated VGAM HOST TARGET GENE, encodes a corresponding messenger RNA, VGAM1985 host target RNA, herein designated VGAM HOST TARGET RNA. VGAM1985 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1985 RNA, herein designated VGAM RNA, binds complementarily to one or more host target binding sites located in untranslated regions of VGAM1985 host target RNA, herein designated VGAM HOST TARGET RNA. This complementary binding is due to the fact that the nucleotide sequence of VGAM1985 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1985 RNA, herein designated VGAM RNA, may have a different number of host target binding sites in untranslated regions of a VGAM1985 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1985 RNA, herein designated VGAM RNA, to host target binding sites on VGAM1985 host target RNA, herein designated VGAM HOST TARGET RNA, such as BINDING SITE I, BINDING SITE II and BINDING SITE III, inhibits translation of VGAM1985 host target RNA into VGAM1985 host target protein, herein designated VGAM HOST TARGET PROTEIN. VGAM host target protein is therefore outlined by a broken line.

It is appreciated that VGAM1985 host target gene, herein designated VGAM HOST TARGET GENE, in fact represents a plurality of VGAM1985 host target genes. The mRNA of each one of this plurality of VGAM1985 host target genes comprises one or more host target binding sites, each having a nucleotide sequence which is at least partly complementary to VGAM1985 RNA, herein designated VGAM RNA, and which when bound by VGAM1985 RNA causes inhibition of translation of respective one or more VGAM1985 host target proteins.

It is further appreciated by one skilled in the art that the mode of translational inhibition illustrated by FIG. 1 with specific reference to translational inhibition exerted by VGAM1985 gene, herein designated VGAM GENE, on one or more VGAM1985 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1985 is inhibition of expression of host target genes, as part of a novel viral mechanism of attacking a host. Accordingly, utilities of VGAM1985 include diagnosis, prevention and treatment of viral infection by Hendra Virus. Specific functions, and accordingly utilities, of VGAM1985 correlate with, and may be deduced from, the identity of the host target genes which VGAM1985 binds and inhibits, and the function of these host target genes, as elaborated hereinbelow.

Nucleotide sequences of the VGAM1985 precursor RNA, herein designated VGAM PRECURSOR RNA, and of the 'diced' VGAM1985 RNA, herein designated VGAM RNA, and a schematic representation of the secondary folding of VGAM1985 folded precursor RNA, herein designated VGAM FOLDED PRECURSOR RNA, of VGAM1985 are further described hereinbelow with reference to Table 1.

Nucleotide sequences of host target binding sites, such as BINDING SITE-I, BINDING SITE-II and BINDING SITE-III of FIG. 1, found on VGAM1985 host target RNA, and schematic representation of the complementarity of each of these host target binding sites to VGAM1985 RNA, herein designated VGAM RNA, are described hereinbelow with reference to Table 2.

As mentioned hereinabove with reference to FIG. 1, a function of VGAM1985 gene, herein designated VGAM is inhibition of expression of VGAM1985 target genes. It is appreciated that specific functions, and accordingly utilities, of VGAM1985 correlate with, and may be deduced from, the identity of the target genes which VGAM1985 binds and inhibits, and the function of these target genes, as elaborated hereinbelow.

Cyclin-dependent Kinase Inhibitor 2A (melanoma, p16, inhibits CDK4) (CDKN2A, Accession NM_058197) is a VGAM1985 host target gene. CDKN2A BINDING SITE is HOST TARGET binding site found in the 3' untranslated region of mRNA encoded by CDKN2A, corresponding to a HOST TARGET binding site such as BINDING SITE I, BINDING SITE II or BINDING SITE III. Table 2 illustrates the complementarity of the nucleotide sequences of CDKN2A BINDING SITE, designated SEQ ID:27757, to the nucleotide sequence of VGAM1985 RNA, herein designated VGAM RNA, also designated SEQ ID:4696.

A function of VGAM1985 is therefore inhibition of Cyclin-dependent Kinase Inhibitor 2A (melanoma, p16, inhibits CDK4) (CDKN2A, Accession NM_058197). Accordingly, utilities of VGAM1985 include diagnosis, prevention and treatment of diseases and clinical conditions associated with CDKN2A. Cysteine Knot Superfamily 1, BMP Antagonist 1 (CKTSF1B1, Accession NM_013372) is another VGAM1985 host target gene. CKTSF1B1 BINDING SITE is HOST TARGET binding site found in the 3' untranslated region of mRNA encoded by CKTSF1B1, corresponding to a HOST TARGET binding site such as BINDING SITE I, BINDING SITE II or BINDING SITE III. Table 2 illustrates the complementarity of the nucleotide sequences of CKTSF1B1 BINDING SITE, designated SEQ ID:15023, to the nucleotide sequence of VGAM1985 RNA, herein designated VGAM RNA, also designated SEQ ID:4696.

Another function of VGAM1985 is therefore inhibition of Cysteine Knot Superfamily 1, BMP Antagonist 1 (CKTSF1B1, Accession NM_013372), a gene which blocks signaling of bone morphogenetic protein (BMP). Accordingly, utilities of VGAM1985 include diagnosis, prevention and treatment of diseases and clinical conditions associated with CKTSF1B1. The function of CKTSF1B1 and its association with various diseases and clinical conditions, has been established by previous studies, as described hereinabove with reference to VGAM28. HLA Class II Region Expressed Gene KE4 (HKE4, Accession NM_006979) is another VGAM1985 host target gene. HKE4 BINDING SITE is HOST TARGET binding site found in the 3' untranslated region of mRNA encoded by HKE4, corresponding to a HOST TARGET binding site such as BINDING SITE I, BINDING SITE II or BINDING SITE III. Table 2 illustrates the complementarity of the nucleotide sequences of HKE4 BINDING SITE, designated SEQ ID:13841, to the nucleotide sequence of VGAM1985 RNA, herein designated VGAM RNA, also designated SEQ ID:4696.

Another function of VGAM1985 is therefore inhibition of HLA Class II Region Expressed Gene KE4 (HKE4, Accession NM_006979), a gene which Contains histidine-rich charge clusters. Accordingly, utilities of VGAM1985 include diagnosis, prevention and treatment of diseases and clinical conditions associated with HKE4. The function of HKE4 has been established by previous studies. Among the many non-HLA genes that have been identified in the region of the major histocompatibility complex (OMIM Ref. No. 6p21.3) in mouse and human are the genes symbolized Ke4 and Ke6 in the mouse. Ando et al. (1996) stated that the function of these genes is unknown, although Ke6 may be involved in the manifestation of polycystic kidney disease (PKD; 173900) because of its aberrant expression in 2 different murine models of PKD (Aziz et al., 1993; Aziz et al., 1994). Ando et al. (1996) isolated cDNA clones corresponding to the human Ke4 and Ke6 (OMIM Ref. No. 601417) genes (designated HKE4 and HKE6 by them) and located at the centromeric end of the HLA region on human 6p21.3. The predicted amino acid sequences of HKE4 and HKE6 exhibited 81.5 and 85.6% identity to the mouse homologs, respectively. Ando et al. (1996) speculated that HKE4 may encode a membrane protein with histidine-rich charge clusters. Kikuti et al. (1997) examined YAC clone Y42, which contains the MHC class II region of chromosome 6q21.3. This region has a relatively high gene density. They identified the following human genes (in order from centromere toward telomere): HSET (OMIM Ref. No. 603763)--HKE1.5--HKE2--HKE3--RING1--(OMIM Ref. No. 602045)--HKE6 (OMIM Ref. No. 601417)--HKE4--RXRB (OMIM Ref. No. 180246)--COL11A2 (OMIM Ref. No. 120290)--DPB2.

Full details of the abovementioned studies are described in the following publications, the disclosure of which are hereby incorporated by reference:

Ando, A.; Kikuti, Y. Y.; Shigenari, A.; Kawata, H.; Okamoto, N.; Shiina, T.; Chen, L.; Ikemura, T.; Abe, K.; Kimura, M.; Inoko, H.: cDNA cloning of the human homologues of the mouse Ke4 and Ke6 genes at the centromeric end of the human MHC region. Genomics 35:600-602, 1996; and Kikuti, Y. Y.; Tamiya, G.; Ando, A.; Chen, L.; Kimura, M.; Ferreira, E.; Tsuji, K.; Trowsdale, J.; Inoko, H.: Physical mapping 220 kb centromeric of the human MHC and DNA sequence analy.

Further studies establishing the function and utilities of HKE4 are found in John Hopkins OMIM database record ID 601416, and in sited publications numbered 9390-9393 listed in the bibliography section hereinbelow, which are also hereby incorporated by reference. LFG (Accession XM_084780) is another VGAM1985 host target gene. LFG BINDING SITE is HOST TARGET binding site found in the 3' untranslated region of mRNA encoded by LFG, corresponding to a HOST TARGET binding site such as BINDING SITE I, BINDING SITE II or BINDING SITE III. Table 2 illustrates the complementarity of the nucleotide sequences of LFG BINDING SITE, designated SEQ ID:37695, to the nucleotide sequence of VGAM1985 RNA, herein designated VGAM RNA, also designated SEQ ID:4696.

Another function of VGAM1985 is therefore inhibition of LFG (Accession XM_084780). Accordingly, utilities of VGAM1985 include diagnosis, prevention and treatment of diseases and clinical conditions associated with LFG. Polycystic Kidney Disease 1 (autosomal dominant) (PKD1, Accession NM_000296) is another VGAM1985 host target gene. PKD1 BINDING SITE is HOST TARGET binding site found in the 3' untranslated region of mRNA encoded by PKD1, corresponding to a HOST TARGET binding site such as BINDING SITE I, BINDING SITE II or BINDING SITE III. Table 2 illustrates the complementarity of the nucleotide sequences of PKD1 BINDING SITE, designated SEQ ID:5840, to the nucleotide sequence of VGAM1985 RNA, herein designated VGAM RNA, also designated SEQ ID:4696.

Another function of VGAM1985 is therefore inhibition of Polycystic Kidney Disease 1 (autosomal dominant) (PKD1, Accession NM_000296). Accordingly, utilities of VGAM1985 include diagnosis, prevention and treatment of diseases and clinical conditions associated with PKD1. RAB27A, Member RAS Oncogene Family (RAB27A, Accession NM_004580) is another VGAM1985 host target gene. RAB27A BINDING SITE is HOST TARGET binding site found in the 3' untranslated region of mRNA encoded by RAB27A, corresponding to a HOST TARGET binding site such as BINDING SITE I, BINDING SITE II or BINDING SITE III. Table 2 illustrates the complementarity of the nucleotide sequences of RAB27A BINDING SITE, designated SEQ ID:10927, to the nucleotide sequence of VGAM1985 RNA, herein designated VGAM RNA, also designated SEQ ID:4696.

Another function of VGAM1985 is therefore inhibition of RAB27A, Member RAS Oncogene Family (RAB27A, Accession NM_004580). Accordingly, utilities of VGAM1985 include diagnosis, prevention and treatment of diseases and clinical conditions associated with RAB27A. RB1-inducible Coiled-coil 1 (RB1CC1, Accession NM_014781) is another VGAM1985 host target gene. RB1CC1 BINDING SITE is HOST TARGET binding site found in the 3' untranslated region of mRNA encoded by RB1CC1, corresponding to a HOST TARGET binding site such as BINDING SITE I, BINDING SITE II or BINDING SITE III. Table 2 illustrates the complementarity of the nucleotide sequences of RB1CC1 BINDING SITE, designated SEQ ID:16633, to the nucleotide sequence of VGAM1985 RNA, herein designated VGAM RNA, also designated SEQ ID:4696.

Another function of VGAM1985 is therefore inhibition of RB1-inducible Coiled-coil 1 (RB1CC1, Accession NM_014781), a gene which is likely to participate in nuclear architecture by connecting chromatin with the nuclear matrix or envelope. Accordingly, utilities of VGAM1985 include diagnosis, prevention and treatment of diseases and clinical conditions associated with RB1CC1. The function of RB1CC1 and its association with various diseases and clinical conditions, has been established by previous studies, as described hereinabove with reference to VGAM18. Adaptor-related Protein Complex 3, Mu 2 Subunit (AP3M2, Accession NM_006803) is another VGAM1985 host target gene. AP3M2 BINDING SITE is HOST TARGET binding site found in the 3' untranslated region of mRNA encoded by AP3M2, corresponding to a HOST TARGET binding site such as BINDING SITE I, BINDING SITE II or BINDING SITE III. Table 2 illustrates the complementarity of the nucleotide sequences of AP3M2 BINDING SITE, designated SEQ ID:13676, to the nucleotide sequence of VGAM1985 RNA, herein designated VGAM RNA, also designated SEQ ID:4696.

Another function of VGAM1985 is therefore inhibition of Adaptor-related Protein Complex 3, Mu 2 Subunit (AP3M2, Accession NM_006803). Accordingly, utilities of VGAM1985 include diagnosis, prevention and treatment of diseases and clinical conditions associated with AP3M2. Chromosome 17 Open Reading Frame 26 (C17orf26, Accession NM_139177) is another VGAM1985 host target gene. C17orf26 BINDING SITE is HOST TARGET binding site found in the 3" untranslated region of mRNA encoded by C17orf26, corresponding to a HOST TARGET binding site such as BINDING SITE I, BINDING SITE II or BINDING SITE III. Table 2 illustrates the complementarity of the nucleotide sequences of C17orf26 BINDING SITE, designated SEQ ID:29186, to the nucleotide sequence of VGAM1985 RNA, herein designated VGAM RNA, also designated SEQ ID:4696.

Another function of VGAM1985 is therefore inhibition of Chromosome 17 Open Reading Frame 26 (C17orf26, Accession NM_139177). Accordingly, utilities of VGAM1985 include diagnosis, prevention and treatment of diseases and clinical conditions associated with C17orf26. FLJ20584 (Accession NM_017891) is another VGAM1985 host target gene. FLJ20584 BINDING SITE is HOST TARGET binding site found in the 3' untranslated region of mRNA encoded by FLJ20584, corresponding to a HOST TARGET binding site such as BINDING SITE I, BINDING SITE II or BINDING SITE III. Table 2 illustrates the complementarity of the nucleotide sequences of FLJ20584 BINDING SITE, designated SEQ ID:19563, to the nucleotide sequence of VGAM1985 RNA, herein designated VGAM RNA, also designated SEQ ID:4696.

Another function of VGAM1985 is therefore inhibition of FLJ20584 (Accession NM_017891). Accordingly, utilities of VGAM1985 include diagnosis, prevention and treatment of diseases and clinical conditions associated with FLJ20584. TRIAD3 (Accession XM_170517) is another VGAM1985 host target gene. TRIAD3 BINDING SITE is HOST TARGET binding site found in the 3' untranslated region of mRNA encoded by TRIAD3, corresponding to a HOST TARGET binding site such as BINDING SITE I, BINDING SITE II or BINDING SITE III. Table 2 illustrates the complementarity of the nucleotide sequences of TRIAD3 BINDING SITE, designated SEQ ID:45348, to the nucleotide sequence of VGAM1985 RNA, herein designated VGAM RNA, also designated SEQ ID:4696.

Another function of VGAM1985 is therefore inhibition of TRIAD3 (Accession XM_170517). Accordingly, utilities of VGAM1985 include diagnosis, prevention and treatment of diseases and clinical conditions associated with TRIAD3. LOC126267 (Accession XM_065012) is another VGAM1985 host target gene. LOC126267 BINDING SITE is HOST TARGET binding site found in the 5' untranslated region of mRNA encoded by LOC126267, corresponding to a HOST TARGET binding site such as BINDING SITE I, BINDING SITE II or BINDING SITE III. Table 2 illustrates the complementarity of the nucleotide sequences of LOC126267 BINDING SITE, designated SEQ ID:37271, to the nucleotide sequence of VGAM1985 RNA, herein designated VGAM RNA, also designated SEQ ID:4696.

Another function of VGAM1985 is therefore inhibition of LOC126267 (Accession XM_065012). Accordingly, utilities of VGAM1985 include diagnosis, prevention and treatment of diseases and clinical conditions associated with LOC126267. LOC147229 (Accession XM_085742) is another VGAM1985 host target gene. LOC147229 BINDING SITE is HOST TARGET binding site found in the 5' untranslated region of mRNA encoded by LOC147229, corresponding to a HOST TARGET binding site such as BINDING SITE I, BINDING SITE II or BINDING SITE III. Table 2 illustrates the complementarity of the nucleotide sequences of LOC147229 BINDING SITE, designated SEQ ID:38320, to the nucleotide sequence of VGAM1985 RNA, herein designated VGAM RNA, also designated SEQ ID:4696.

Another function of VGAM1985 is therefore inhibition of LOC147229 (Accession XM_085742). Accordingly, utilities of VGAM1985 include diagnosis, prevention and treatment of diseases and clinical conditions associated with LOC147229. LOC163081 (Accession XM_091987) is another VGAM1985 host target gene. LOC163081 BINDING SITE is HOST TARGET binding site found in the 5' untranslated region of mRNA encoded by LOC163081, corresponding to a HOST TARGET binding site such as BINDING SITE I, BINDING SITE II or BINDING SITE III. Table 2 illustrates the complementarity of the nucleotide sequences of LOC163081 BINDING SITE, designated SEQ ID:40087, to the nucleotide sequence of VGAM1985 RNA, herein designated VGAM RNA, also designated SEQ ID:4696.

Another function of VGAM1985 is therefore inhibition of LOC163081 (Accession XM_091987). Accordingly, utilities of VGAM1985 include diagnosis, prevention and treatment of diseases and clinical conditions associated with LOC163081. LOC166424 (Accession XM_105867) is another VGAM1985 host target gene. LOC166424 BINDING SITE is HOST TARGET binding site found in the 5' untranslated region of mRNA encoded by LOC166424, corresponding to a HOST TARGET binding site such as BINDING SITE I, BINDING SITE II or BINDING SITE III. Table 2 illustrates the complementarity of the nucleotide sequences of LOC166424 BINDING SITE, designated SEQ ID:42194, to the nucleotide sequence of VGAM1985 RNA, herein designated VGAM RNA, also designated SEQ ID:4696.

Another function of VGAM1985 is therefore inhibition of LOC166424 (Accession XM_105867). Accordingly, utilities of VGAM1985 include diagnosis, prevention and treatment of diseases and clinical conditions associated with LOC166424. LOC255242 (Accession XM_171095) is another VGAM1985 host target gene. LOC255242 BINDING SITE is HOST TARGET binding site found in the 5' untranslated region of mRNA encoded by LOC255242, corresponding to a HOST TARGET binding site such as BINDING SITE I, BINDING SITE II or BINDING SITE III. Table 2 illustrates the complementarity of the nucleotide sequences of LOC255242 BINDING SITE, designated SEQ ID:45905, to the nucleotide sequence of VGAM1985 RNA, herein designated VGAM RNA, also designated SEQ ID:4696.

Another function of VGAM1985 is therefore inhibition of LOC255242 (Accession XM_171095). Accordingly, utilities of VGAM1985 include diagnosis, prevention and treatment of diseases and clinical conditions associated with LOC255242. FIG. 1 further provides a conceptual description of a novel bioinformatically detected viral gene of the present invention, referred to here as Viral Genomic Address Messenger 1986 (VGAM1986) viral gene, which modulates expression of respective host target genes thereof, the function and utility of which host target genes is known in the art.

VGAM1986 is a novel bioinformatically detected regulatory, non protein coding, viral micro RNA (miRNA) gene. The method by which VGAM1986 was detected is described hereinabove with reference to FIGS. 1-8.

VGAM1986 gene, herein designated VGAM GENE, is a viral gene contained in the genome of Hendra Virus. VGAM1986 host target gene, herein designated VGAM HOST TARGET GENE, is a human gene contained in the human genome.

VGAM1986 gene encodes a VGAM1986 precursor RNA, herein designated VGAM PRECURSOR RNA. Similar to other miRNA genes, and unlike most ordinary genes, VGAM1986 precursor RNA does not encode a protein. A nucleotide sequence identical or highly similar to the nucleotide sequence of VGAM1986 precursor RNA is designated SEQ ID:1972, and is provided hereinbelow with reference to the sequence listing part. Nucleotide sequence SEQ ID:1972 is located at position 4500 relative to the genome of Hendra Virus.

VGAM1986 precursor RNA folds onto itself, forming VGAM1986 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1986 folded precursor RNA into VGAM1986 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM1986 RNA is designated SEQ ID:4697, and is provided hereinbelow with reference to the sequence listing part.

VGAM1986 host target gene, herein designated VGAM HOST TARGET GENE, encodes a corresponding messenger RNA, VGAM1986 host target RNA, herein designated VGAM HOST TARGET RNA. VGAM1986 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1986 RNA, herein designated VGAM RNA, binds complementarily to one or more host target binding sites located in untranslated regions of VGAM1986 host target RNA, herein designated VGAM HOST TARGET RNA. This complementary binding is due to the fact that the nucleotide sequence of VGAM1986 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1986 RNA, herein designated VGAM RNA, may have a different number of host target binding sites in untranslated regions of a VGAM1986 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1986 RNA, herein designated VGAM RNA, to host target binding sites on VGAM1986 host target RNA, herein designated VGAM HOST TARGET RNA, such as BINDING SITE I, BINDING SITE II and BINDING SITE III, inhibits translation of VGAM1986 host target RNA into VGAM1986 host target protein, herein designated VGAM HOST TARGET PROTEIN. VGAM host target protein is therefore outlined by a broken line.

It is appreciated that VGAM1986 host target gene, herein designated VGAM HOST TARGET GENE, in fact represents a plurality of VGAM1986 host target genes. The mRNA of each one of this plurality of VGAM1986 host target genes comprises one or more host target binding sites, each having a nucleotide sequence which is at least partly complementary to VGAM1986 RNA, herein designated VGAM RNA, and which when bound by VGAM1986 RNA causes inhibition of translation of respective one or more VGAM1986 host target proteins.

It is further appreciated by one skilled in the art that the mode of translational inhibition illustrated by FIG. 1 with specific reference to translational inhibition exerted by VGAM1986 gene, herein designated VGAM GENE, on one or more VGAM1986 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM1986 is inhibition of expression of host target genes, as part of a novel viral mechanism of attacking a host. Accordingly, utilities of VGAM1986 include diagnosis, prevention and treatment of viral infection by Hendra Virus. Specific functions, and accordingly utilities, of VGAM1986 correlate with, and may be deduced from, the identity of the host target genes which VGAM1986 binds and inhibits, and the function of these host target genes, as elaborated hereinbelow.

Nucleotide sequences of the VGAM1986 precursor RNA, herein designated VGAM PRECURSOR RNA, and of the 'diced' VGAM1986 RNA, herein designated VGAM RNA, and a schematic representation of the secondary folding of VGAM1986 folded precursor RNA, herein designated VGAM FOLDED PRECURSOR RNA, of VGAM1986 are further described hereinbelow with reference to Table 1.

Nucleotide sequences of host target binding sites, such as BINDING SITE-I, BINDING SITE-II and BINDING SITE- III of FIG. 1, found on VGAM1986 host target RNA, and schematic representation of the complementarity of each of these host target binding sites to VGAM1986 RNA, herein designated VGAM RNA, are described hereinbelow with reference to Table 2.

As mentioned hereinabove with reference to FIG. 1, a function of VGAM1986 gene, herein designated VGAM is inhibition of expression of VGAM1986 target genes. It is appreciated that specific functions, and accordingly utilities, of VGAM1986 correlate with, and may be deduced from, the identity of the target genes which VGAM1986 binds and inhibits, and the function of these target genes, as elaborated hereinbelow.

X-ray Repair Complementing Defective Repair In Chinese Hamster Cells 3 (XRCC3, Accession NM_005432) is a VGAM1986 host target gene. XRCC3 BINDING SITE is HOST TARGET binding site found in the 3' untranslated region of mRNA encoded by XRCC3, corresponding to a HOST TARGET binding site such as BINDING SITE I, BINDING SITE II or BINDING SITE III. Table 2 illustrates the complementarity of the nucleotide sequences of XRCC3 BINDING SITE, designated SEQ ID:11905, to the nucleotide sequence of VGAM1986 RNA, herein designated VGAM RNA, also designated SEQ ID:4697.

A function of VGAM1986 is therefore inhibition of X-ray Repair Complementing Defective Repair In Chinese Hamster Cells 3 (XRCC3, Accession NM_005432), a gene which is required for meiotic recombination, synaptonemal complex formation and cell cycle progression. Accordingly, utilities of VGAM1986 include diagnosis, prevention and treatment of diseases and clinical conditions associated with XRCC3. The function of XRCC3 and its association with various diseases and clinical conditions, has been established by previous studies, as described hereinabove with reference to VGAM1290. HEMK (Accession NM_016173) is another VGAM1986 host target gene. HEMK BINDING SITE is HOST TARGET binding site found in the 3' untranslated region of mRNA encoded by HEMK, corresponding to a HOST TARGET binding site such as BINDING SITE I, BINDING SITE II or BINDING SITE III. Table 2 illustrates the complementarity of the nucleotide sequences of HEMK BINDING SITE, designated SEQ ID:18264, to the nucleotide sequence of VGAM1986 RNA, herein designated VGAM RNA, also designated SEQ ID:4697.

Another function of VGAM1986 is therefore inhibition of HEMK (Accession NM_016173). Accordingly, utilities of VGAM1986 include diagnosis, prevention and treatment of diseases and clinical conditions associated with HEMK. Lectin, Galactoside-binding, Soluble, 8 (galectin 8) (LGALS8, Accession NM_006499) is another VGAM1986 host target gene. LGALS8 BINDING SITE is HOST TARGET binding site found in the 3' untranslated region of mRNA encoded by LGALS8, corresponding to a HOST TARGET binding site such as BINDING SITE I, BINDING SITE II or BINDING SITE III. Table 2 illustrates the complementarity of the nucleotide sequences of LGALS8 BINDING SITE, designated SEQ ID:13243, to the nucleotide sequence of VGAM1986 RNA, herein designated VGAM RNA, also designated SEQ ID:4697.

Another function of VGAM1986 is therefore inhibition of Lectin, Galactoside-binding, Soluble, 8 (galectin 8) (LGALS8, Accession NM_006499). Accordingly, utilities of VGAM1986 include diagnosis, prevention and treatment of diseases and clinical conditions associated with LGALS8. Protein Phosphatase 1, Regulatory (inhibitor) Subunit 3B (PPP1R3B, Accession NM_024607) is another VGAM1986 host target gene. PPP1R3B BINDING SITE is HOST TARGET binding site found in the 3' untranslated region of mRNA encoded by PPP1R3B, corresponding to a HOST TARGET binding site such as BINDING SITE I, BINDING SITE II or BINDING SITE III. Table 2 illustrates the complementarity of the nucleotide sequences of PPP1R3B BINDING SITE, designated SEQ ID:23857, to the nucleotide sequence of VGAM1986 RNA, herein designated VGAM RNA, also designated SEQ ID:4697.

Another function of VGAM1986 is therefore inhibition of Protein Phosphatase 1, Regulatory (inhibitor) Subunit 3B (PPP1R3B, Accession NM_024607). Accordingly, utilities of VGAM1986 include diagnosis, prevention and treatment of diseases and clinical conditions associated with PPP1R3B. SCAN Domain Containing 2 (SCAND2, Accession NM_033640) is another VGAM1986 host target gene. SCAND2 BINDING SITE is HOST TARGET binding site found in the 3' untranslated region of mRNA encoded by SCAND2, corresponding to a HOST TARGET binding site such as BINDING SITE I, BINDING SITE II or BINDING SITE III. Table 2 illustrates the complementarity of the nucleotide sequences of SCAND2 BINDING SITE, designated SEQ ID:27355, to the nucleotide sequence of VGAM1986 RNA, herein designated VGAM RNA, also designated SEQ ID:4697.

Another function of VGAM1986 is therefore inhibition of SCAN Domain Containing 2 (SCAND2, Accession NM_033640). Accordingly, utilities of VGAM1986 include diagnosis, prevention and treatment of diseases and clinical conditions associated with SCAND2. LOC113763 (Accession NM_138434) is another VGAM1986 host target gene. LOC113763 BINDING SITE is HOST TARGET binding site found in the 3' untranslated region of mRNA encoded by LOC113763, corresponding to a HOST TARGET binding site such as BINDING SITE I, BINDING SITE II or BINDING SITE III. Table 2 illustrates the complementarity of the nucleotide sequences of LOC113763 BINDING SITE, designated SEQ ID:28800, to the nucleotide sequence of VGAM1986 RNA, herein designated VGAM RNA, also designated SEQ ID:4697.

Another function of VGAM1986 is therefore inhibition of LOC113763 (Accession NM_138434). Accordingly, utilities of VGAM1986 include diagnosis, prevention and treatment of diseases and clinical conditions associated with LOC113763. LOC137964 (Accession XM_059933) is another VGAM1986 host target gene. LOC137964 BINDING SITE is HOST TARGET binding site found in the 3' untranslated region of mRNA encoded by LOC137964, corresponding to a HOST TARGET binding site such as BINDING SITE I, BINDING SITE II or BINDING SITE III. Table 2 illustrates the complementarity of the nucleotide sequences of LOC137964 BINDING SITE, designated SEQ ID:37110, to the nucleotide sequence of VGAM1986 RNA, herein designated VGAM RNA, also designated SEQ ID:4697.

Another function of VGAM1986 is therefore inhibition of LOC137964 (Accession XM_059933). Accordingly, utilities of VGAM1986 include diagnosis, prevention and treatment of diseases and clinical conditions associated with LOC137964. LOC150577 (Accession XM_097918) is another VGAM1986 host target gene. LOC150577 BINDING SITE is HOST TARGET binding site found in the 3' untranslated region of mRNA encoded by LOC150577, corresponding to a HOST TARGET binding site such as BINDING SITE I, BINDING SITE II or BINDING SITE III. Table 2 illustrates the complementarity of the nucleotide sequences of LOC150577 BINDING SITE, designated SEQ ID:41216, to the nucleotide sequence of VGAM1986 RNA, herein designated VGAM RNA, also designated SEQ ID:4697.

Another function of VGAM1986 is therefore inhibition of LOC150577 (Accession XM_097918). Accordingly, utilities of VGAM1986 include diagnosis, prevention and treatment of diseases and clinical conditions associated with LOC150577. LOC199863 (Accession XM_117147) is another VGAM1986 host target gene. LOC199863 BINDING SITE is HOST TARGET binding site found in the 3' untranslated region of mRNA encoded by LOC199863, corresponding to a HOST TARGET binding site such as BINDING SITE I, BINDING SITE II or BINDING SITE III. Table 2 illustrates the complementarity of the nucleotide sequences of LOC199863 BINDING SITE, designated SEQ ID:43254, to the nucleotide sequence of VGAM1986 RNA, herein designated VGAM RNA, also designated SEQ ID:4697.

Another function of VGAM1986 is therefore inhibition of LOC199863 (Accession XM_117147). Accordingly, utilities of VGAM1986 include diagnosis, prevention and treatment of diseases and clinical conditions associated with LOC199863. LOC253897 (Accession XM_171187) is another VGAM1986 host target gene. LOC253897 BINDING SITE is HOST TARGET binding site found in the 3' untranslated region of mRNA encoded by LOC253897, corresponding to a HOST TARGET binding site such as BINDING SITE I, BINDING SITE II or BINDING SITE III. Table 2 illustrates the complementarity of the nucleotide sequences of LOC253897 BINDING SITE, designated SEQ ID:45967, to the nucleotide sequence of VGAM1986 RNA, herein designated VGAM RNA, also designated SEQ ID:4697.

Another function of VGAM1986 is therefore inhibition of LOC253897 (Accession XM_171187). Accordingly, utilities of VGAM1986 include diagnosis, prevention and treatment of diseases and clinical conditions associated with LOC253897. FIG. 1 further provides a conceptual description of a novel bioinformatically detected viral gene of the present invention, referred to here as Viral Genomic Address Messenger 1987 (VGAM1987) viral gene, which modulates expression of respective host target genes thereof, the function and utility of which host target genes is known in the art.

VGAM1987 is a novel bioinformatically detected regulatory, non protein coding, viral micro RNA (miRNA) gene. The method by which VGAM1987 was detected is described hereinabove with reference to FIGS. 1-8.

VGAM1987 gene, herein designated VGAM GENE, is a viral gene contained in the genome of Hendra Virus. VGAM1987 host target gene, herein designated VGAM HOST TARGET GENE, is a human gene contained in the human genome.

VGAM1987 gene encodes a VGAM1987 precursor RNA, herein designated VGAM PRECURSOR RNA. Similar to other miRNA genes, and unlike most ordinary genes, VGAM1987 precursor RNA does not encode a protein. A nucleotide sequence identical or highly similar to the nucleotide sequence of VGAM1987 precursor RNA is designated SEQ ID:1973, and is provided hereinbelow with reference to the sequence listing part. Nucleotide sequence SEQ ID:1973 is located at position 11388 relative to the genome of Hendra Virus.

VGAM1987 precursor RNA folds onto itself, forming VGAM1987 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1987 folded precursor RNA into VGAM1987 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM1987 RNA is designated SEQ ID:4698, and is provided hereinbelow with reference to the sequence listing part.

VGAM1987 host target gene, herein designated VGAM HOST TARGET GENE, encodes a corresponding messenger RNA, VGAM1987 host target RNA, herein designated VGAM HOST TARGET RNA. VGAM1987 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1987 RNA, herein designated VGAM RNA, binds complementarily to one or more host target binding sites located in untranslated regions of VGAM1987 host target RNA, herein designated VGAM HOST TARGET RNA. This complementary binding is due to the fact that the nucleotide sequence of VGAM1987 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1987 RNA, herein designated VGAM RNA, may have a different number of host target binding sites in untranslated regions of a VGAM1987 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1987 RNA, herein designated VGAM RNA, to host target binding sites on VGAM1987 host target RNA, herein designated VGAM HOST TARGET RNA, such as BINDING SITE I, BINDING SITE II and BINDING SITE III, inhibits translation of VGAM1987 host target RNA into VGAM1987 host target protein, herein designated VGAM HOST TARGET PROTEIN. VGAM host target protein is therefore outlined by a broken line.

It is appreciated that VGAM1987 host target gene, herein designated VGAM HOST TARGET GENE, in fact represents a plurality of VGAM1987 host target genes. The mRNA of each one of this plurality of VGAM1987 host target genes comprises one or more host target binding sites, each having a nucleotide sequence which is at least partly complementary to VGAM1987 RNA, herein designated VGAM RNA, and which when bound by VGAM1987 RNA causes inhibition of translation of respective one or more VGAM1987 host target proteins.

It is further appreciated by one skilled in the art that the mode of translational inhibition illustrated by FIG. 1 with specific reference to translational inhibition exerted by VGAM1987 gene, herein designated VGAM GENE, on one or more VGAM1987 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1987 is inhibition of expression of host target genes, as part of a novel viral mechanism of attacking a host. Accordingly, utilities of VGAM1987 include diagnosis, prevention and treatment of viral infection by Hendra Virus. Specific functions, and accordingly utilities, of VGAM1987 correlate with, and may be deduced from, the identity of the host target genes which VGAM1987 binds and inhibits, and the function of these host target genes, as elaborated hereinbelow.

Nucleotide sequences of the VGAM1987 precursor RNA, herein designated VGAM PRECURSOR RNA, and of the 'diced' VGAM1987 RNA, herein designated VGAM RNA, and a schematic representation of the secondary folding of VGAM1987 folded precursor RNA, herein designated VGAM FOLDED PRECURSOR RNA, of VGAM1987 are further described hereinbelow with reference to Table 1.

Nucleotide sequences of host target binding sites, such as BINDING SITE-I, BINDING SITE-II and BINDING SITE-III of FIG. 1, found on VGAM1987 host target RNA, and schematic representation of the complementarity of each of these host target binding sites to VGAM1987 RNA, herein designated VGAM RNA, are described hereinbelow with reference to Table 2.

As mentioned hereinabove with reference to FIG. 1, a function of VGAM1987 gene, herein designated VGAM is inhibition of expression of VGAM1987 target genes. It is appreciated that specific functions, and accordingly utilities, of VGAM1987 correlate with, and may be deduced from, the identity of the target genes which VGAM1987 binds and inhibits, and the function of these target genes, as elaborated hereinbelow.

KIAA1467 (Accession XM_049605) is a VGAM1987 host target gene. KIAA1467 BINDING SITE is HOST TARGET binding site found in the 3' untranslated region of mRNA encoded by KIAA1467, corresponding to a HOST TARGET binding site such as BINDING SITE I, BINDING SITE II or BINDING SITE III. Table 2 illustrates the complementarity of the nucleotide sequences of KIAA1467 BINDING SITE, designated SEQ ID:35455, to the nucleotide sequence of VGAM1987 RNA, herein designated VGAM RNA, also designated SEQ ID:4698.

A function of VGAM1987 is therefore inhibition of KIAA1467 (Accession XM_049605). Accordingly, utilities of VGAM1987 include diagnosis, prevention and treatment of diseases and clinical conditions associated with KIAA1467. MGC11061 (Accession NM_032312) is another VGAM1987 host target gene. MGC11061 BINDING SITE is HOST TARGET binding site found in the 3' untranslated region of mRNA encoded by MGC11061, corresponding to a HOST TARGET binding site such as BINDING SITE I, BINDING SITE II or BINDING SITE III. Table 2 illustrates the complementarity of the nucleotide sequences of MGC11061 BINDING SITE, designated SEQ ID:26116, to the nucleotide sequence of VGAM1987 RNA, herein designated VGAM RNA, also designated SEQ ID:4698.

Another function of VGAM1987 is therefore inhibition of MGC11061 (Accession NM_032312). Accordingly, utilities of VGAM1987 include diagnosis, prevention and treatment of diseases and clinical conditions associated with MGC11061. Synaptosomal-associated Protein, 91 kDa Homolog (mouse) (SNAP91, Accession NM_014841) is another VGAM1987 host target gene. SNAP91 BINDING SITE is HOST TARGET binding site found in the 3' untranslated region of mRNA encoded by SNAP91, corresponding to a HOST TARGET binding site such as BINDING SITE I, BINDING SITE II or BINDING SITE III. Table 2 illustrates the complementarity of the nucleotide sequences of SNAP91 BINDING SITE, designated SEQ ID:16869, to the nucleotide sequence of VGAM1987 RNA, herein designated VGAM RNA, also designated SEQ ID:4698.

Another function of VGAM1987 is therefore inhibition of Synaptosomal-associated Protein, 91 kDa Homolog (mouse) (SNAP91, Accession NM_014841). Accordingly, utilities of VGAM1987 include diagnosis, prevention and treatment of diseases and clinical conditions associated with SNAP91. LOC120406 (Accession XM_061976) is another VGAM1987 host target gene. LOC120406 BINDING SITE is HOST TARGET binding site found in the 3' untranslated region of mRNA encoded by LOC120406, corresponding to a HOST TARGET binding site such as BINDING SITE I, BINDING SITE II or BINDING SITE III. Table 2 illustrates the complementarity of the nucleotide sequences of LOC120406 BINDING SITE, designated SEQ ID:37220, to the nucleotide sequence of VGAM1987 RNA, herein designated VGAM RNA, also designated SEQ ID:4698.

Another function of VGAM1987 is therefore inhibition of LOC120406 (Accession XM_061976). Accordingly, utilities of VGAM1987 include diagnosis, prevention and treatment of diseases and clinical conditions associated with LOC120406. LOC93349 (Accession NM_138402) is another VGAM1987 host target gene. LOC93349 BINDING SITE is HOST TARGET binding site found in the 3' untranslated region of mRNA encoded by LOC93349, corresponding to a HOST TARGET binding site such as BINDING SITE I, BINDING SITE II or BINDING SITE III. Table 2 illustrates the complementarity of the nucleotide sequences of LOC93349 BINDING SITE, designated SEQ ID:28769, to the nucleotide sequence of VGAM1987 RNA, herein designated VGAM RNA, also designated SEQ ID:4698.

Another function of VGAM1987 is therefore inhibition of LOC93349 (Accession NM_138402). Accordingly, utilities of VGAM1987 include diagnosis, prevention and treatment of diseases and clinical conditions associated with LOC93349. FIG. 1 further provides a conceptual description of a novel bioinformatically detected viral gene of the present invention, referred to here as Viral Genomic Address Messenger 1988 (VGAM1988) viral gene, which modulates expression of respective host target genes thereof, the function and utility of which host target genes is known in the art.

VGAM1988 is a novel bioinformatically detected regulatory, non protein coding, viral micro RNA (miRNA) gene. The method by which VGAM1988 was detected is described hereinabove with reference to FIGS. 1-8.

VGAM1988 gene, herein designated VGAM GENE, is a viral gene contained in the genome of Hendra Virus. VGAM1988 host target gene, herein designated VGAM HOST TARGET GENE, is a human gene contained in the human genome.

VGAM1988 gene encodes a VGAM1988 precursor RNA, herein designated VGAM PRECURSOR RNA. Similar to other miRNA genes, and unlike most ordinary genes, VGAM1988 precursor RNA does not encode a protein. A nucleotide sequence identical or highly similar to the nucleotide sequence of VGAM1988 precursor RNA is designated SEQ ID:1974, and is provided hereinbelow with reference to the sequence listing part. Nucleotide sequence SEQ ID:1974 is located at position 15383 relative to the genome of Hendra Virus.

VGAM1988 precursor RNA folds onto itself, forming VGAM1988 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1988 folded precursor RNA into VGAM1988 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM1988 RNA is designated SEQ ID:4699, and is provided hereinbelow with reference to the sequence listing part.

VGAM1988 host target gene, herein designated VGAM HOST TARGET GENE, encodes a corresponding messenger RNA, VGAM1988 host target RNA, herein designated VGAM HOST TARGET RNA. VGAM1988 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1988 RNA, herein designated VGAM RNA, binds complementarily to one or more host target binding sites located in untranslated regions of VGAM1988 host target RNA, herein designated VGAM HOST TARGET RNA. This complementary binding is due to the fact that the nucleotide sequence of VGAM1988 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1988 RNA, herein designated VGAM RNA, may have a different number of host target binding sites in untranslated regions of a VGAM1988 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1988 RNA, herein designated VGAM RNA, to host target binding sites on VGAM1988 host target RNA, herein designated VGAM HOST TARGET RNA, such as BINDING SITE I, BINDING SITE II and BINDING SITE III, inhibits translation of VGAM1988 host target RNA into VGAM1988 host target protein, herein designated VGAM HOST TARGET PROTEIN. VGAM host target protein is therefore outlined by a broken line.

It is appreciated that VGAM1988 host target gene, herein designated VGAM HOST TARGET GENE, in fact represents a plurality of VGAM1988 host target genes. The mRNA of each one of this plurality of VGAM1988 host target genes comprises one or more host target binding sites, each having a nucleotide sequence which is at least partly complementary to VGAM1988 RNA, herein designated VGAM RNA, and which when bound by VGAM1988 RNA causes inhibition of translation of respective one or more VGAM1988 host target proteins.

It is further appreciated by one skilled in the art that the mode of translational inhibition illustrated by FIG. 1 with specific reference to translational inhibition exerted by VGAM1988 gene, herein designated VGAM GENE, on one or more VGAM1988 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1988 is inhibition of expression of host target genes, as part of a novel viral mechanism of attacking a host. Accordingly, utilities of VGAM1988 include diagnosis, prevention and treatment of viral infection by Hendra Virus. Specific functions, and accordingly utilities, of VGAM1988 correlate with, and may be deduced from, the identity of the host target genes which VGAM1988 binds and inhibits, and the function of these host target genes, as elaborated hereinbelow.

Nucleotide sequences of the VGAM1988 precursor RNA, herein designated VGAM PRECURSOR RNA, and of the 'diced' VGAM1988 RNA, herein designated VGAM RNA, and a schematic representation of the secondary folding of VGAM1988 folded precursor RNA, herein designated VGAM FOLDED PRECURSOR RNA, of VGAM1988 are further described hereinbelow with reference to Table 1.

Nucleotide sequences of host target binding sites, such as BINDING SITE-I, BINDING SITE-II and BINDING SITE-III of FIG. 1, found on VGAM1988 host target RNA, and schematic representation of the complementarity of each of these host target binding sites to VGAM1988 RNA, herein designated VGAM RNA, are described hereinbelow with reference to Table 2.

As mentioned hereinabove with reference to FIG. 1, a function of VGAM1988 gene, herein designated VGAM is inhibition of expression of VGAM1988 target genes. It is appreciated that specific functions, and accordingly utilities, of VGAM1988 correlate with, and may be deduced from, the identity of the target genes which VGAM1988 binds and inhibits, and the function of these target genes, as elaborated hereinbelow.

Adenomatosis Polyposis Coli (APC, Accession NM_000038) is a VGAM1988 host target gene. APC BINDING SITE is HOST TARGET binding site found in the 3' untranslated region of mRNA encoded by APC, corresponding to a HOST TARGET binding site such as BINDING SITE I, BINDING SITE II or BINDING SITE III. Table 2 illustrates the complementarity of the nucleotide sequences of APC BINDING SITE, designated SEQ ID:5481, to the nucleotide sequence of VGAM1988 RNA, herein designated VGAM RNA, also designated SEQ ID:4699.

A function of VGAM1988 is therefore inhibition of Adenomatosis Polyposis Coli (APC, Accession NM_000038). Accordingly, utilities of VGAM1988 include diagnosis, prevention and treatment of diseases and clinical conditions associated with APC. Protein Kinase (cAMP-dependent, catalytic) Inhibitor Beta (PKIB, Accession NM_032471) is another VGAM1988 host target gene. PKIB BINDING SITE is HOST TARGET binding site found in the 5' untranslated region of mRNA encoded by PKIB, corresponding to a HOST TARGET binding site such as BINDING SITE I, BINDING SITE II or BINDING SITE III. Table 2 illustrates the complementarity of the nucleotide sequences of PKIB BINDING SITE, designated SEQ ID:26229, to the nucleotide sequence of VGAM1988 RNA, herein designated VGAM RNA, also designated SEQ ID:4699.

Another function of VGAM1988 is therefore inhibition of Protein Kinase (cAMP-dependent, catalytic) Inhibitor Beta (PKIB, Accession NM_032471). Accordingly, utilities of VGAM1988 include diagnosis, prevention and treatment of diseases and clinical conditions associated with PKIB. Sodium Channel, Nonvoltage-gated 1, Gamma (SCNN1G, Accession NM_001039) is another VGAM1988 host target gene. SCNN1G BINDING SITE is HOST TARGET binding site found in the 3' untranslated region of mRNA encoded by SCNN1G, corresponding to a HOST TARGET binding site such as BINDING SITE I, BINDING SITE II or BINDING SITE III. Table 2 illustrates the complementarity of the nucleotide sequences of SCNN1G BINDING SITE, designated SEQ ID:6704, to the nucleotide sequence of VGAM1988 RNA, herein designated VGAM RNA, also designated SEQ ID:4699.

Another function of VGAM1988 is therefore inhibition of Sodium Channel, Nonvoltage-gated 1, Gamma (SCNN1G, Accession NM_001039). Accordingly, utilities of VGAM1988 include diagnosis, prevention and treatment of diseases and clinical conditions associated with SCNN1G. Transcription Factor 1, Hepatic; LF-B1, Hepatic Nuclear Factor (HNF1), Albumin Proximal Factor (TCF1, Accession NM_000545) is another VGAM1988 host target gene. TCF1 BINDING SITE is HOST TARGET binding site found in the 3' untranslated region of mRNA encoded by TCF1, corresponding to a HOST TARGET binding site such as BINDING SITE I, BINDING SITE II or BINDING SITE III. Table 2 illustrates the complementarity of the nucleotide sequences of TCF1 BINDING SITE, designated SEQ ID:6147, to the nucleotide sequence of VGAM1988 RNA, herein designated VGAM RNA, also designated SEQ ID:4699.

Another function of VGAM1988 is therefore inhibition of Transcription Factor 1, Hepatic; LF-B1, Hepatic Nuclear Factor (HNF1), Albumin Proximal Factor (TCF1, Accession NM_000545), a gene which is required for the expression of several liver specific genes. binds to the inverted palindrome 5'-gttaatnattaac-3'. Accordingly, utilities of VGAM1988 include diagnosis, prevention and treatment of diseases and clinical conditions associated with TCF1. The function of TCF1 and its association with various diseases and clinical conditions, has been established by previous studies, as described hereinabove with reference to VGAM1189. BLOV1 (Accession XM_083866) is another VGAM1988 host target gene. BLOV1 BINDING SITE is HOST TARGET binding site found in the 3' untranslated region of mRNA encoded by BLOV1, corresponding to a HOST TARGET binding site such as BINDING SITE I, BINDING SITE II or BINDING SITE III. Table 2 illustrates the complementarity of the nucleotide sequences of BLOV1 BINDING SITE, designated SEQ ID:37520, to the nucleotide sequence of VGAM1988 RNA, herein designated VGAM RNA, also designated SEQ ID:4699.

Another function of VGAM1988 is therefore inhibition of BLOV1 (Accession XM_083866). Accordingly, utilities of VGAM1988 include diagnosis, prevention and treatment of diseases and clinical conditions associated with BLOV1. FLJ00058 (Accession XM_086123) is another VGAM1988 host target gene. FLJ00058 BINDING SITE is HOST TARGET binding site found in the 5' untranslated region of mRNA encoded by FLJ00058, corresponding to a HOST TARGET binding site such as BINDING SITE I, BINDING SITE II or BINDING SITE III. Table 2 illustrates the complementarity of the nucleotide sequences of FLJ00058 BINDING SITE, designated SEQ ID:38508, to the nucleotide sequence of VGAM1988 RNA, herein designated VGAM RNA, also designated SEQ ID:4699.

Another function of VGAM1988 is therefore inhibition of FLJ00058 (Accession XM_086123). Accordingly, utilities of VGAM1988 include diagnosis, prevention and treatment of diseases and clinical conditions associated with FLJ00058. FLJ10276 (Accession NM_018045) is another VGAM1988 host target gene. FLJ10276 BINDING SITE is HOST TARGET binding site found in the 3' untranslated region of mRNA encoded by FLJ10276, corresponding to a HOST TARGET binding site such as BINDING SITE I, BINDING SITE II or BINDING SITE III. Table 2 illustrates the complementarity of the nucleotide sequences of FLJ10276 BINDING SITE, designated SEQ ID:19790, to the nucleotide sequence of VGAM1988 RNA, herein designated VGAM RNA, also designated SEQ ID:4699.

Another function of VGAM1988 is therefore inhibition of FLJ10276 (Accession NM_018045). Accordingly, utilities of VGAM1988 include diagnosis, prevention and treatment of diseases and clinical conditions associated with FLJ10276. FLJ10803 (Accession NM_018224) is another VGAM1988 host target gene. FLJ10803 BINDING SITE is HOST TARGET binding site found in the 3' untranslated region of mRNA encoded by FLJ10803, corresponding to a HOST TARGET binding site such as BINDING SITE I, BINDING SITE II or BINDING SITE III. Table 2 illustrates the complementarity of the nucleotide sequences of FLJ10803 BINDING SITE, designated SEQ ID:20153, to the nucleotide sequence of VGAM1988 RNA, herein designated VGAM RNA, also designated SEQ ID:4699.

Another function of VGAM1988 is therefore inhibition of FLJ10803 (Accession NM_018224). Accordingly, utilities of VGAM1988 include diagnosis, prevention and treatment of diseases and clinical conditions associated with FLJ10803. FLJ11142 (Accession NM_018338) is another VGAM1988 host target gene. FLJ11142 BINDING SITE is HOST TARGET binding site found in the 3' untranslated region of mRNA encoded by FLJ11142, corresponding to a HOST TARGET binding site such as BINDING SITE I, BINDING SITE II or BINDING SITE III. Table 2 illustrates the complementarity of the nucleotide sequences of FLJ11142 BINDING SITE, designated SEQ ID:20343, to the nucleotide sequence of VGAM1988 RNA, herein designated VGAM RNA, also designated SEQ ID:4699.

Another function of VGAM1988 is therefore inhibition of FLJ11142 (Accession NM_018338). Accordingly, utilities of VGAM1988 include diagnosis, prevention and treatment of diseases and clinical conditions associated with FLJ11142. KIAA0997 (Accession NM_014950) is another VGAM1988 host target gene. KIAA0997 BINDING SITE is HOST TARGET binding site found in the 3' untranslated region of mRNA encoded by KIAA0997, corresponding to a HOST TARGET binding site such as BINDING SITE I, BINDING SITE II or BINDING SITE III. Table 2 illustrates the complementarity of the nucleotide sequences of KIAA0997 BINDING SITE, designated SEQ ID:17280, to the nucleotide sequence of VGAM1988 RNA, herein designated VGAM RNA, also designated SEQ ID:4699.

Another function of VGAM1988 is therefore inhibition of KIAA0997 (Accession NM_014950). Accordingly, utilities of VGAM1988 include diagnosis, prevention and treatment of diseases and clinical conditions associated with KIAA0997. KIAA1069 (Accession XM_042635) is another VGAM1988 host target gene. KIAA1069 BINDING SITE is HOST TARGET binding site found in the 3' untranslated region of mRNA encoded by KIAA1069, corresponding to a HOST TARGET binding site such as BINDING SITE I, BINDING SITE II or BINDING SITE III. Table 2 illustrates the complementarity of the nucleotide sequences of KIAA1069 BINDING SITE, designated SEQ ID:33723, to the nucleotide sequence of VGAM1988 RNA, herein designated VGAM RNA, also designated SEQ ID:4699.

Another function of VGAM1988 is therefore inhibition of KIAA1069 (Accession XM_042635). Accordingly, utilities of VGAM1988 include diagnosis, prevention and treatment of diseases and clinical conditions associated with KIAA1069. NUDEL (Accession NM_030808) is another VGAM1988 host target gene. NUDEL BINDING SITE is HOST TARGET binding site found in the 3' untranslated region of mRNA encoded by NUDEL, corresponding to a HOST TARGET binding site such as BINDING SITE I, BINDING SITE II or BINDING SITE III. Table 2 illustrates the complementarity of the nucleotide sequences of NUDEL BINDING SITE, designated SEQ ID:25122, to the nucleotide sequence of VGAM1988 RNA, herein designated VGAM RNA, also designated SEQ ID:4699.

Another function of VGAM1988 is therefore inhibition of NUDEL (Accession NM_030808). Accordingly, utilities of VGAM1988 include diagnosis, prevention and treatment of diseases and clinical conditions associated with NUDEL. LOC151178 (Accession XM_087117) is another VGAM1988 host target gene. LOC151178 BINDING SITE is HOST TARGET binding site found in the 5' untranslated region of mRNA encoded by LOC151178, corresponding to a HOST TARGET binding site such as BINDING SITE I, BINDING SITE II or BINDING SITE III. Table 2 illustrates the complementarity of the nucleotide sequences of LOC151178 BINDING SITE, designated SEQ ID:39071, to the nucleotide sequence of VGAM1988 RNA, herein designated VGAM RNA, also designated SEQ ID:4699.

Another function of VGAM1988 is therefore inhibition of LOC151178 (Accession XM_087117). Accordingly, utilities of VGAM1988 include diagnosis, prevention and treatment of diseases and clinical conditions associated with LOC151178. LOC199786 (Accession XM_114021) is another VGAM1988 host target gene. LOC199786 BINDING SITE is HOST TARGET binding site found in the 3' untranslated region of mRNA encoded by LOC199786, corresponding to a HOST TARGET binding site such as BINDING SITE I, BINDING SITE II or BINDING SITE III. Table 2 illustrates the complementarity of the nucleotide sequences of LOC199786 BINDING SITE, designated SEQ ID:42618, to the nucleotide sequence of VGAM1988 RNA, herein designated VGAM RNA, also designated SEQ ID:4699.

Another function of VGAM1988 is therefore inhibition of LOC199786 (Accession XM_114021). Accordingly, utilities of VGAM1988 include diagnosis, prevention and treatment of diseases and clinical conditions associated with LOC199786. LOC255975 (Accession XM_171083) is another VGAM1988 host target gene. LOC255975 BINDING SITE is HOST TARGET binding site found in the 5' untranslated region of mRNA encoded by LOC255975, corresponding to a HOST TARGET binding site such as BINDING SITE I, BINDING SITE II or BINDING SITE III. Table 2 illustrates the complementarity of the nucleotide sequences of LOC255975 BINDING SITE, designated SEQ ID:45890, to the nucleotide sequence of VGAM1988 RNA, herein designated VGAM RNA, also designated SEQ ID:4699.

Another function of VGAM1988 is therefore inhibition of LOC255975 (Accession XM_171083). Accordingly, utilities of VGAM1988 include diagnosis, prevention and treatment of diseases and clinical conditions associated with LOC255975. FIG. 1 further provides a conceptual description of a novel bioinformatically detected viral gene of the present invention, referred to here as Viral Genomic Address Messenger 1989 (VGAM1989) viral gene, which modulates expression of respective host target genes thereof, the function and utility of which host target genes is known in the art.

VGAM1989 is a novel bioinformatically detected regulatory, non protein coding, viral micro RNA (miRNA) gene. The method by which VGAM1989 was detected is described hereinabove with reference to FIGS. 1-8.

VGAM1989 gene, herein designated VGAM GENE, is a viral gene contained in the genome of Hendra Virus. VGAM1989 host target gene, herein designated VGAM HOST TARGET GENE, is a human gene contained in the human genome.

VGAM1989 gene encodes a VGAM1989 precursor RNA, herein designated VGAM PRECURSOR RNA. Similar to other miRNA genes, and unlike most ordinary genes, VGAM1989 precursor RNA does not encode a protein. A nucleotide sequence identical or highly similar to the nucleotide sequence of VGAM1989 precursor RNA is designated SEQ ID:1975, and is provided hereinbelow with reference to the sequence listing part. Nucleotide sequence SEQ ID:1975 is located at position 1467 relative to the genome of Hendra Virus.

VGAM1989 precursor RNA folds onto itself, forming VGAM1989 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1989 folded precursor RNA into VGAM1989 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM1989 RNA is designated SEQ ID:4700, and is provided hereinbelow with reference to the sequence listing part.

VGAM1989 host target gene, herein designated VGAM HOST TARGET GENE, encodes a corresponding messenger RNA, VGAM1989 host target RNA, herein designated VGAM HOST TARGET RNA. VGAM1989 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1989 RNA, herein designated VGAM RNA, binds complementarily to one or more host target binding sites located in untranslated regions of VGAM1989 host target RNA, herein designated VGAM HOST TARGET RNA. This complementary binding is due to the fact that the nucleotide sequence of VGAM1989 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1989 RNA, herein designated VGAM RNA, may have a different number of host target binding sites in untranslated regions of a VGAM1989 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1989 RNA, herein designated VGAM RNA, to host target binding sites on VGAM1989 host target RNA, herein designated VGAM HOST TARGET RNA, such as BINDING SITE I, BINDING SITE II and BINDING SITE III, inhibits translation of VGAM1989 host target RNA into VGAM1989 host target protein, herein designated VGAM HOST TARGET PROTEIN. VGAM host target protein is therefore outlined by a broken line.

It is appreciated that VGAM1989 host target gene, herein designated VGAM HOST TARGET GENE, in fact represents a plurality of VGAM1989 host target genes. The mRNA of each one of this plurality of VGAM1989 host target genes comprises one or more host target binding sites, each having a nucleotide sequence which is at least partly complementary to VGAM1989 RNA, herein designated VGAM RNA, and which when bound by VGAM1989 RNA causes inhibition of translation of respective one or more VGAM1989 host target proteins.

It is further appreciated by one skilled in the art that the mode of translational inhibition illustrated by FIG. 1 with specific reference to translational inhibition exerted by VGAM1989 gene, herein designated VGAM GENE, on one or more VGAM1989 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1989 is inhibition of expression of host target genes, as part of a novel viral mechanism of attacking a host. Accordingly, utilities of VGAM1989 include diagnosis, prevention and treatment of viral infection by Hendra Virus. Specific functions, and accordingly utilities, of VGAM1989 correlate with, and may be deduced from, the identity of the host target genes which VGAM1989 binds and inhibits, and the function of these host target genes, as elaborated hereinbelow.

Nucleotide sequences of the VGAM1989 precursor RNA, herein designated VGAM PRECURSOR RNA, and of the 'diced' VGAM1989 RNA, herein designated VGAM RNA, and a schematic representation of the secondary folding of VGAM1989 folded precursor RNA, herein designated VGAM FOLDED PRECURSOR RNA, of VGAM1989 are further described hereinbelow with reference to Table 1.

Nucleotide sequences of host target binding sites, such as BINDING SITE-I, BINDING SITE-II and BINDING SITE-III of FIG. 1, found on VGAM1989 host target RNA, and schematic representation of the complementarity of each of these host target binding sites to VGAM1989 RNA, herein designated VGAM RNA, are described hereinbelow with reference to Table 2.

As mentioned hereinabove with reference to FIG. 1, a function of VGAM1989 gene, herein designated VGAM is inhibition of expression of VGAM1989 target genes. It is appreciated that specific functions, and accordingly utilities, of VGAM1989 correlate with, and may be deduced from, the identity of the target genes which VGAM1989 binds and inhibits, and the function of these target genes, as elaborated hereinbelow.

Diptheria Toxin Resistance Protein Required For Diphthamide Biosynthesis-like 1 (S. cerevisiae) (DPH2L1, Accession NM_001383) is a VGAM1989 host target gene. DPH2L1 BINDING SITE is HOST TARGET binding site found in the 3' untranslated region of mRNA encoded by DPH2L1, corresponding to a HOST TARGET binding site such as BINDING SITE I, BINDING SITE II or BINDING SITE III. Table 2 illustrates the complementarity of the nucleotide sequences of DPH2L1 BINDING SITE, designated SEQ ID:7053, to the nucleotide sequence of VGAM1989 RNA, herein designated VGAM RNA, also designated SEQ ID:4700.

A function of VGAM1989 is therefore inhibition of Diptheria Toxin Resistance Protein Required For Diphthamide Biosynthesis-like 1 (S. cerevisiae) (DPH2L1, Accession NM_001383), a gene which may be involved in regulating global protein synthesis; has similarity to S. cerevisiae Dph2p. Accordingly, utilities of VGAM1989 include diagnosis, prevention and treatment of diseases and clinical conditions associated with DPH2L1. The function of DPH2L1 and its association with various diseases and clinical conditions, has been established by previous studies, as described hereinabove with reference to VGAM608. RNA (guanine-7-) Methyltransferase (RNMT, Accession NM_003799) is another VGAM1989 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9882, to the nucleotide sequence of VGAM1989 RNA, herein designated VGAM RNA, also designated SEQ ID:4700.

Another function of VGAM1989 is therefore inhibition of RNA (guanine-7-) Methyltransferase (RNMT, Accession NM_003799), a gene which catalyzes the methylation of GpppN- at the guanine N7 position. Accordingly, utilities of VGAM1989 include diagnosis, prevention and treatment of diseases and clinical conditions associated with RNMT. The function of RNMT and its association with various diseases and clinical conditions, has been established by previous studies, as described hereinabove with reference to VGAM178. Transcription Factor 19 (SC1) (TCF19, Accession XM_175167) is another VGAM1989 host target gene. TCF19 BINDING SITE1 and TCF19 BINDING SITE2 are HOST TARGET binding sites found in untranslated regions of mRNA encoded by TCF19, corresponding to HOST TARGET binding sites such as BINDING SITE I, BINDING SITE II or BINDING SITE III. Table 2 illustrates the complementarity of the nucleotide sequences of TCF19 BINDING SITE1 and TCF19 BINDING SITE2, designated SEQ ID:46658 and SEQ ID:46707 respectively, to the nucleotide sequence of VGAM1989 RNA, herein designated VGAM RNA, also designated SEQ ID:4700.

Another function of VGAM1989 is therefore inhibition of Transcription Factor 19 (SC1) (TCF19, Accession XM_175167), a gene which plays an important role in the transcription of genes required for the later stages of cell cycle progression. Accordingly, utilities of VGAM1989 include diagnosis, prevention and treatment of diseases and clinical conditions associated with TCF19. The function of TCF19 and its association with various diseases and clinical conditions, has been established by previous studies, as described hereinabove with reference to VGAM299. FLJ20374 (Accession NM_017793) is another VGAM1989 host target gene. FLJ20374 BINDING SITE is HOST TARGET binding site found in the 5' untranslated region of mRNA encoded by FLJ20374, corresponding to a HOST TARGET binding site such as BINDING SITE I, BINDING SITE II or BINDING SITE III. Table 2 illustrates the complementarity of the nucleotide sequences of FLJ20374 BINDING SITE, designated SEQ ID:19429, to the nucleotide sequence of VGAM1989 RNA, herein designated VGAM RNA, also designated SEQ ID:4700.

Another function of VGAM1989 is therefore inhibition of FLJ20374 (Accession NM_017793). Accordingly, utilities of VGAM1989 include diagnosis, prevention and treatment of diseases and clinical conditions associated with FLJ20374. FLJ25415 (Accession NM_144708) is another VGAM1989 host target gene. FLJ25415 BINDING SITE is HOST TARGET binding site found in the 3' untranslated region of mRNA encoded by FLJ25415, corresponding to a HOST TARGET binding site such as BINDING SITE I, BINDING SITE II or BINDING SITE III. Table 2 illustrates the complementarity of the nucleotide sequences of FLJ25415 BINDING SITE, designated SEQ ID:29533, to the nucleotide sequence of VGAM1989 RNA, herein designated VGAM RNA, also designated SEQ ID:4700.

Another function of VGAM1989 is therefore inhibition of FLJ25415 (Accession NM_144708). Accordingly, utilities of VGAM1989 include diagnosis, prevention and treatment of diseases and clinical conditions associated with FLJ25415. KIAA0798 (Accession NM_014650) is another VGAM1989 host target gene. KIAA0798 BINDING SITE is HOST TARGET binding site found in the 5' untranslated region of mRNA encoded by KIAA0798, corresponding to a HOST TARGET binding site such as BINDING SITE I, BINDING SITE II or BINDING SITE III. Table 2 illustrates the complementarity of the nucleotide sequences of KIAA0798 BINDING SITE, designated SEQ ID:16068, to the nucleotide sequence of VGAM1989 RNA, herein designated VGAM RNA, also designated SEQ ID:4700.

Another function of VGAM1989 is therefore inhibition of KIAA0798 (Accession NM_014650). Accordingly, utilities of VGAM1989 include diagnosis, prevention and treatment of diseases and clinical conditions associated with KIAA0798. KIAA1281 (Accession XM_114432) is another VGAM1989 host target gene. KIAA1281 BINDING SITE is HOST TARGET binding site found in the 3' untranslated region of mRNA encoded by KIAA1281, corresponding to a HOST TARGET binding site such as BINDING SITE I, BINDING SITE II or BINDING SITE III. Table 2 illustrates the complementarity of the nucleotide sequences of KIAA1281 BINDING SITE, designated SEQ ID:42961, to the nucleotide sequence of VGAM1989 RNA, herein designated VGAM RNA, also designated SEQ ID:4700.

Another function of VGAM1989 is therefore inhibition of KIAA1281 (Accession XM_114432). Accordingly, utilities of VGAM1989 include diagnosis, prevention and treatment of diseases and clinical conditions associated with KIAA1281. MACMARCKS (Accession NM_023009) is another VGAM1989 host target gene. MACMARCKS BINDING SITE is HOST TARGET binding site found in the 3' untranslated region of mRNA encoded by MACMARCKS, corresponding to a HOST TARGET binding site such as BINDING SITE I, BINDING SITE II or BINDING SITE III. Table 2 illustrates the complementarity of the nucleotide sequences of MACMARCKS BINDING SITE, designated SEQ ID:23273, to the nucleotide sequence of VGAM1989 RNA, herein designated VGAM RNA, also designated SEQ ID:4700.

Another function of VGAM1989 is therefore inhibition of MACMARCKS (Accession NM_023009). Accordingly, utilities of VGAM1989 include diagnosis, prevention and treatment of diseases and clinical conditions associated with MACMARCKS. MGC10812 (Accession NM_031425) is another VGAM1989 host target gene. MGC10812 BINDING SITE is HOST TARGET binding site found in the 3' untranslated region of mRNA encoded by MGC10812, corresponding to a HOST TARGET binding site such as BINDING SITE I, BINDING SITE II or BINDING SITE III. Table 2 illustrates the complementarity of the nucleotide sequences of MGC10812 BINDING SITE, designated SEQ ID:25412, to the nucleotide sequence of VGAM1989 RNA, herein designated VGAM RNA, also designated SEQ ID:4700.

Another function of VGAM1989 is therefore inhibition of MGC10812 (Accession NM_031425). Accordingly, utilities of VGAM1989 include diagnosis, prevention and treatment of diseases and clinical conditions associated with MGC10812. MGC2628 (Accession NM_024076) is another VGAM1989 host target gene. MGC2628 BINDING SITE is HOST TARGET binding site found in the 3' untranslated region of mRNA encoded by MGC2628, corresponding to a HOST TARGET binding site such as BINDING SITE I, BINDING SITE II or BINDING SITE III. Table 2 illustrates the complementarity of the nucleotide sequences of MGC2628 BINDING SITE, designated SEQ ID:23509, to the nucleotide sequence of VGAM1989 RNA, herein designated VGAM RNA, also designated SEQ ID:4700.

Another function of VGAM1989 is therefore inhibition of MGC2628 (Accession NM_024076). Accordingly, utilities of VGAM1989 include diagnosis, prevention and treatment of diseases and clinical conditions associated with MGC2628. Synaptophysin-like Protein (SYPL, Accession XM_167511) is another VGAM1989 host target gene. SYPL BINDING SITE is HOST TARGET binding site found in the 3' untranslated region of mRNA encoded by SYPL, corresponding to a HOST TARGET binding site such as BINDING SITE I, BINDING SITE II or BINDING SITE III. Table 2 illustrates the complementarity of the nucleotide sequences of SYPL BINDING SITE, designated SEQ ID:44645, to the nucleotide sequence of VGAM1989 RNA, herein designated VGAM RNA, also designated SEQ ID:4700.

Another function of VGAM1989 is therefore inhibition of Synaptophysin-like Protein (SYPL, Accession XM_167511). Accordingly, utilities of VGAM1989 include diagnosis, prevention and treatment of diseases and clinical conditions associated with SYPL. LOC143310 (Accession XM_084485) is another VGAM1989 host target gene. LOC143310 BINDING SITE is HOST TARGET binding site found in the 5' untranslated region of mRNA encoded by LOC143310, corresponding to a HOST TARGET binding site such as BINDING SITE I, BINDING SITE II or BINDING SITE III. Table 2 illustrates the complementarity of the nucleotide sequences of LOC143310 BINDING SITE, designated SEQ ID:37605, to the nucleotide sequence of VGAM1989 RNA, herein designated VGAM RNA, also designated SEQ ID:4700.

Another function of VGAM1989 is therefore inhibition of LOC143310 (Accession XM_084485). Accordingly, utilities of VGAM1989 include diagnosis, prevention and treatment of diseases and clinical conditions associated with LOC143310. LOC169577 (Accession XM_095785) is another VGAM1989 host target gene. LOC169577 BINDING SITE is HOST TARGET binding site found in the 5' untranslated region of mRNA encoded by LOC169577, corresponding to a HOST TARGET binding site such as BINDING SITE I, BINDING SITE II or BINDING SITE III. Table 2 illustrates the complementarity of the nucleotide sequences of LOC169577 BINDING SITE, designated SEQ ID:40283, to the nucleotide sequence of VGAM1989 RNA, herein designated VGAM RNA, also designated SEQ ID:4700.

Another function of VGAM1989 is therefore inhibition of LOC169577 (Accession XM_095785). Accordingly, utilities of VGAM1989 include diagnosis, prevention and treatment of diseases and clinical conditions associated with LOC169577. LOC219920 (Accession XM_167787) is another VGAM1989 host target gene. LOC219920 BINDING SITE is HOST TARGET binding site found in the 5' untranslated region of mRNA encoded by LOC219920, corresponding to a HOST TARGET binding site such as BINDING SITE I, BINDING SITE II or BINDING SITE III. Table 2 illustrates the complementarity of the nucleotide sequences of LOC219920 BINDING SITE, designated SEQ ID:44803, to the nucleotide sequence of VGAM1989 RNA, herein designated VGAM RNA, also designated SEQ ID:4700.

Another function of VGAM1989 is therefore inhibition of LOC219920 (Accession XM_167787). Accordingly, utilities of VGAM1989 include diagnosis, prevention and treatment of diseases and clinical conditions associated with LOC219920. FIG. 1 further provides a conceptual description of a novel bioinformatically detected viral gene of the present invention, referred to here as Viral Genomic Address Messenger 1990 (VGAM1990) viral gene, which modulates expression of respective host target genes thereof, the function and utility of which host target genes is known in the art.

VGAM1990 is a novel bioinformatically detected regulatory, non protein coding, viral micro RNA (miRNA) gene. The method by which VGAM1990 was detected is described hereinabove with reference to FIGS. 1-8.

VGAM1990 gene, herein designated VGAM GENE, is a viral gene contained in the genome of Nipah Virus. VGAM1990 host target gene, herein designated VGAM HOST TARGET GENE, is a human gene contained in the human genome.

VGAM1990 gene encodes a VGAM1990 precursor RNA, herein designated VGAM PRECURSOR RNA. Similar to other miRNA genes, and unlike most ordinary genes, VGAM1990 precursor RNA does not encode a protein. A nucleotide sequence identical or highly similar to the nucleotide sequence of VGAM1990 precursor RNA is designated SEQ ID:1976, and is provided hereinbelow with reference to the sequence listing part. Nucleotide sequence SEQ ID:1976 is located at position 7327 relative to the genome of Nipah Virus.

VGAM1990 precursor RNA folds onto itself, forming VGAM1990 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1990 folded precursor RNA into VGAM1990 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM1990 RNA is designated SEQ ID:4701, and is provided hereinbelow with reference to the sequence listing part.

VGAM1990 host target gene, herein designated VGAM HOST TARGET GENE, encodes a corresponding messenger RNA, VGAM1990 host target RNA, herein designated VGAM HOST TARGET RNA. VGAM1990 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1990 RNA, herein designated VGAM RNA, binds complementarily to one or more host target binding sites located in untranslated regions of VGAM1990 host target RNA, herein designated VGAM HOST TARGET RNA. This complementary binding is due to the fact that the nucleotide sequence of VGAM1990 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1990 RNA, herein designated VGAM RNA, may have a different number of host target binding sites in untranslated regions of a VGAM1990 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1990 RNA, herein designated VGAM RNA, to host target binding sites on VGAM1990 host target RNA, herein designated VGAM HOST TARGET RNA, such as BINDING SITE I, BINDING SITE II and BINDING SITE III, inhibits translation of VGAM1990 host target RNA into VGAM1990 host target protein, herein designated VGAM HOST TARGET PROTEIN. VGAM host target protein is therefore outlined by a broken line.

It is appreciated that VGAM1990 host target gene, herein designated VGAM HOST TARGET GENE, in fact represents a plurality of VGAM1990 host target genes. The mRNA of each one of this plurality of VGAM1990 host target genes comprises one or more host target binding sites, each having a nucleotide sequence which is at least partly complementary to VGAM1990 RNA, herein designated VGAM RNA, and which when bound by VGAM1990 RNA causes inhibition of translation of respective one or more VGAM1990 host target proteins.

It is further appreciated by one skilled in the art that the mode of translational inhibition illustrated by FIG. 1 with specific reference to translational inhibition exerted by VGAM1990 gene, herein designated VGAM GENE, on one or more VGAM1990 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1990 is inhibition of expression of host target genes, as part of a novel viral mechanism of attacking a host. Accordingly, utilities of VGAM1990 include diagnosis, prevention and treatment of viral infection by Nipah Virus. Specific functions, and accordingly utilities, of VGAM1990 correlate with, and may be deduced from, the identity of the host target genes which VGAM1990 binds and inhibits, and the function of these host target genes, as elaborated hereinbelow.

Nucleotide sequences of the VGAM1990 precursor RNA, herein designated VGAM PRECURSOR RNA, and of the 'diced' VGAM1990 RNA, herein designated VGAM RNA, and a schematic representation of the secondary folding of VGAM1990 folded precursor RNA, herein designated VGAM FOLDED PRECURSOR RNA, of VGAM1990 are further described hereinbelow with reference to Table 1.

Nucleotide sequences of host target binding sites, such as BINDING SITE-I, BINDING SITE-II and BINDING SITE-III of FIG. 1, found on VGAM1990 host target RNA, and schematic representation of the complementarity of each of these host target binding sites to VGAM1990 RNA, herein designated VGAM RNA, are described hereinbelow with reference to Table 2.

As mentioned hereinabove with reference to FIG. 1, a function of VGAM1990 gene, herein designated VGAM is inhibition of expression of VGAM1990 target genes. It is appreciated that specific functions, and accordingly utilities, of VGAM1990 correlate with, and may be deduced from, the identity of the target genes which VGAM1990 binds and inhibits, and the function of these target genes, as elaborated hereinbelow.

Tumor Necrosis Factor Receptor Superfamily, Member 6 (TNFRSF6, Accession NM_000043) is a VGAM1990 host target gene. TNFRSF6 BINDING SITE is HOST TARGET binding site found in the 3' untranslated region of mRNA encoded by TNFRSF6, corresponding to a HOST TARGET binding site such as BINDING SITE I, BINDING SITE II or BINDING SITE III. Table 2 illustrates the complementarity of the nucleotide sequences of TNFRSF6 BINDING SITE, designated SEQ ID:5484, to the nucleotide sequence of VGAM1990 RNA, herein designated VGAM RNA, also designated SEQ ID:4701.

A function of VGAM1990 is therefore inhibition of Tumor Necrosis Factor Receptor Superfamily, Member 6 (TNFRSF6, Accession NM_000043). Accordingly, utilities of VGAM1990 include diagnosis, prevention and treatment of diseases and clinical conditions associated with TNFRSF6. Preimplantation Protein 3 (PREI3, Accession XM_038960) is another VGAM1990 host target gene. PREI3 BINDING SITE is HOST TARGET binding site found in the 3' untranslated region of mRNA encoded by PREI3, corresponding to a HOST TARGET binding site such as BINDING SITE I, BINDING SITE II or BINDING SITE III. Table 2 illustrates the complementarity of the nucleotide sequences of PREI3 BINDING SITE, designated SEQ ID:32965, to the nucleotide sequence of VGAM1990 RNA, herein designated VGAM RNA, also designated SEQ ID:4701.

Another function of VGAM1990 is therefore inhibition of Preimplantation Protein 3 (PREI3, Accession XM_038960). Accordingly, utilities of VGAM1990 include diagnosis, prevention and treatment of diseases and clinical conditions associated with PREI3. Ubiquitin Specific Protease 25 (USP25, Accession NM_013396) is another VGAM1990 host target gene. USP25 BINDING SITE is HOST TARGET binding site found in the 3' untranslated region of mRNA encoded by USP25, corresponding to a HOST TARGET binding site such as BINDING SITE I, BINDING SITE II or BINDING SITE III. Table 2 illustrates the complementarity of the nucleotide sequences of USP25 BINDING SITE, designated SEQ ID:15046, to the nucleotide sequence of VGAM1990 RNA, herein designated VGAM RNA, also designated SEQ ID:4701.

Another function of VGAM1990 is therefore inhibition of Ubiquitin Specific Protease 25 (USP25, Accession NM_013396). Accordingly, utilities of VGAM1990 include diagnosis, prevention and treatment of diseases and clinical conditions associated with USP25. LOC146092 (Accession XM_096927) is another VGAM1990 host target gene. LOC146092 BINDING SITE is HOST TARGET binding site found in the 5' untranslated region of mRNA encoded by LOC146092, corresponding to a HOST TARGET binding site such as BINDING SITE I, BINDING SITE II or BINDING SITE III. Table 2 illustrates the complementarity of the nucleotide sequences of LOC146092 BINDING SITE, designated SEQ ID:40652, to the nucleotide sequence of VGAM1990 RNA, herein designated VGAM RNA, also designated SEQ ID:4701.

Another function of VGAM1990 is therefore inhibition of LOC146092 (Accession XM_096927). Accordingly, utilities of VGAM1990 include diagnosis, prevention and treatment of diseases and clinical conditions associated with LOC146092. LOC92181 (Accession XM_043394) is another VGAM1990 host target gene. LOC92181 BINDING SITE is HOST TARGET binding site found in the 3' untranslated region of mRNA encoded by LOC92181, corresponding to a HOST TARGET binding site such as BINDING SITE I, BINDING SITE II or BINDING SITE III. Table 2 illustrates the complementarity of the nucleotide sequences of LOC92181 BINDING SITE, designated SEQ ID:33941, to the nucleotide sequence of VGAM1990 RNA, herein designated VGAM RNA, also designated SEQ ID:4701.

Another function of VGAM1990 is therefore inhibition of LOC92181 (Accession XM_043394). Accordingly, utilities of VGAM1990 include diagnosis, prevention and treatment of diseases and clinical conditions associated with LOC92181. FIG. 1 further provides a conceptual description of a novel bioinformatically detected viral gene of the present invention, referred to here as Viral Genomic Address Messenger 1991 (VGAM1991) viral gene, which modulates expression of respective host target genes thereof, the function and utility of which host target genes is known in the art.

VGAM1991 is a novel bioinformatically detected regulatory, non protein coding, viral micro RNA (miRNA) gene. The method by which VGAM1991 was detected is described hereinabove with reference to FIGS. 1-8.

VGAM1991 gene, herein designated VGAM GENE, is a viral gene contained in the genome of Nipah Virus. VGAM1991 host target gene, herein designated VGAM HOST TARGET GENE, is a human gene contained in the human genome.

VGAM1991 gene encodes a VGAM1991 precursor RNA, herein designated VGAM PRECURSOR RNA. Similar to other miRNA genes, and unlike most ordinary genes, VGAM1991 precursor RNA does not encode a protein. A nucleotide sequence identical or highly similar to the nucleotide sequence of VGAM1991 precursor RNA is designated SEQ ID:1977, and is provided hereinbelow with reference to the sequence listing part. Nucleotide sequence SEQ ID:1977 is located at position 2776 relative to the genome of Nipah Virus.

VGAM1991 precursor RNA folds onto itself, forming VGAM1991 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1991 folded precursor RNA into VGAM1991 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1991 RNA is designated SEQ ID:4702, and is provided hereinbelow with reference to the sequence listing part.

VGAM1991 host target gene, herein designated VGAM HOST TARGET GENE, encodes a corresponding messenger RNA, VGAM1991 host target RNA, herein designated VGAM HOST TARGET RNA. VGAM1991 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1991 RNA, herein designated VGAM RNA, binds complementarily to one or more host target binding sites located in untranslated regions of VGAM1991 host target RNA, herein designated VGAM HOST TARGET RNA. This complementary binding is due to the fact that the nucleotide sequence of VGAM1991 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1991 RNA, herein designated VGAM RNA, may have a different number of host target binding sites in untranslated regions of a VGAM1991 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1991 RNA, herein designated VGAM RNA, to host target binding sites on VGAM1991 host target RNA, herein designated VGAM HOST TARGET RNA, such as BINDING SITE I, BINDING SITE II and BINDING SITE III, inhibits translation of VGAM1991 host target RNA into VGAM1991 host target protein, herein designated VGAM HOST TARGET PROTEIN. VGAM host target protein is therefore outlined by a broken line.

It is appreciated that VGAM1991 host target gene, herein designated VGAM HOST TARGET GENE, in fact represents a plurality of VGAM1991 host target genes. The mRNA of each one of this plurality of VGAM1991 host target genes comprises one or more host target binding sites, each having a nucleotide sequence which is at least partly complementary to VGAM1991 RNA, herein designated VGAM RNA, and which when bound by VGAM1991 RNA causes inhibition of translation of respective one or more VGAM1991 host target proteins.

It is further appreciated by one skilled in the art that the mode of translational inhibition illustrated by FIG. 1 with specific reference to translational inhibition exerted by VGAM1991 gene, herein designated VGAM GENE, on one or more VGAM1991 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1991 is inhibition of expression of host target genes, as part of a novel viral mechanism of attacking a host. Accordingly, utilities of VGAM1991 include diagnosis, prevention and treatment of viral infection by Nipah Virus. Specific functions, and accordingly utilities, of VGAM1991 correlate with, and may be deduced from, the identity of the host target genes which VGAM1991 binds and inhibits, and the function of these host target genes, as elaborated hereinbelow.

Nucleotide sequences of the VGAM1991 precursor RNA, herein designated VGAM PRECURSOR RNA, and of the 'diced' VGAM1991 RNA, herein designated VGAM RNA, and a schematic representation of the secondary folding of VGAM1991 folded precursor RNA, herein designated VGAM FOLDED PRECURSOR RNA, of VGAM1991 are further described hereinbelow with reference to Table 1.

Nucleotide sequences of host target binding sites, such as BINDING SITE-I, BINDING SITE-II and BINDING SITE-III of FIG. 1, found on VGAM1991 host target RNA, and schematic representation of the complementarity of each of these host target binding sites to VGAM1991 RNA, herein designated VGAM RNA, are described hereinbelow with reference to Table 2.

As mentioned hereinabove with reference to FIG. 1, a function of VGAM1991 gene, herein designated VGAM is inhibition of expression of VGAM1991 target genes. It is appreciated that specific functions, and accordingly utilities, of VGAM1991 correlate with, and may be deduced from, the identity of the target genes which VGAM1991 binds and inhibits, and the function of these target genes, as elaborated hereinbelow.

Methyltransferase-like 1 (METTL1, Accession NM_023032) is a VGAM1991 host target gene. METTL1 BINDING SITE1 and METTL1 BINDING SITE2 are HOST TARGET binding sites found in untranslated regions of mRNA encoded by METTL1, corresponding to HOST TARGET binding sites such as BINDING SITE I, BINDING SITE II or BINDING SITE III. Table 2 illustrates the complementarity of the nucleotide sequences of METTL1 BINDING SITE1 and METTL1 BINDING SITE2, designated SEQ ID:23306 and SEQ ID:23311 respectively, to the nucleotide sequence of VGAM1991 RNA, herein designated VGAM RNA, also designated SEQ ID:4702.

A function of VGAM1991 is therefore inhibition of Methyltransferase-like 1 (METTL1, Accession NM_023032). Accordingly, utilities of VGAM1991 include diagnosis, prevention and treatment of diseases and clinical conditions associated with METTL1. Solute Carrier Family 21 (organic anion transporter), Member 3 (SLC21A3, Accession NM_134431) is another VGAM1991 host target gene. SLC21A3 BINDING SITE1 and SLC21A3 BINDING SITE2 are HOST TARGET binding sites found in untranslated regions of mRNA encoded by SLC21A3, corresponding to HOST TARGET binding sites such as BINDING SITE I, BINDING SITE II or BINDING SITE III. Table 2 illustrates the complementarity of the nucleotide sequences of SLC21A3 BINDING SITE1 and SLC21A3 BINDING SITE2, designated SEQ ID:28673 and SEQ ID:18250 respectively, to the nucleotide sequence of VGAM1991 RNA, herein designated VGAM RNA, also designated SEQ ID:4702.

Another function of VGAM1991 is therefore inhibition of Solute Carrier Family 21 (organic anion transporter), Member 3 (SLC21A3, Accession NM_134431), a gene which mediates the na (+)-independent transport of organic anions such as bsp and conjugated (taurocholate) and unconjugated (cholate) bile acids. Accordingly, utilities of VGAM1991 include diagnosis, prevention and treatment of diseases and clinical conditions associated with SLC21A3. The function of SLC21A3 and its association with various diseases and clinical conditions, has been established by previous studies, as described hereinabove with reference to VGAM1965. Chromosome 5 Open Reading Frame 4 (C5orf4, Accession NM_032385) is another VGAM1991 host target gene. C5orf4 BINDING SITE is HOST TARGET binding site found in the 3' untranslated region of mRNA encoded by C5orf4, corresponding to a HOST TARGET binding site such as BINDING SITE I, BINDING SITE II or BINDING SITE III. Table 2 illustrates the complementarity of the nucleotide sequences of C5orf4 BINDING SITE, designated SEQ ID:26181, to the nucleotide sequence of VGAM1991 RNA, herein designated VGAM RNA, also designated SEQ ID:4702.

Another function of VGAM1991 is therefore inhibition of Chromosome 5 Open Reading Frame 4 (C5orf4, Accession NM_032385). Accordingly, utilities of VGAM1991 include diagnosis, prevention and treatment of diseases and clinical conditions associated with C5orf4. DJ122O8.2 (Accession NM_020466) is another VGAM1991 host target gene. DJ122O8.2 BINDING SITE is HOST TARGET binding site found in the 3' untranslated region of mRNA encoded by DJ122O8.2, corresponding to a HOST TARGET binding site such as BINDING SITE I, BINDING SITE II or BINDING SITE III. Table 2 illustrates the complementarity of the nucleotide sequences of DJ122O8.2 BINDING SITE, designated SEQ ID:21702, to the nucleotide sequence of VGAM1991 RNA, herein designated VGAM RNA, also designated SEQ ID:4702.

Another function of VGAM1991 is therefore inhibition of DJ122O8.2 (Accession NM_020466). Accordingly, utilities of VGAM1991 include diagnosis, prevention and treatment of diseases and clinical conditions associated with DJ122O8.2. DKFZp547I224 (Accession NM_020221) is another VGAM1991 host target gene. DKFZp547I224 BINDING SITE is HOST TARGET binding site found in the 5' untranslated region of mRNA encoded by DKFZp547I224, corresponding to a HOST TARGET binding site such as BINDING SITE I, BINDING SITE II or BINDING SITE III. Table 2 illustrates the complementarity of the nucleotide sequences of DKFZp547I224 BINDING SITE, designated SEQ ID:21479, to the nucleotide sequence of VGAM1991 RNA, herein designated VGAM RNA, also designated SEQ ID:4702.

Another function of VGAM1991 is therefore inhibition of DKFZp547I224 (Accession NM_020221). Accordingly, utilities of VGAM1991 include diagnosis, prevention and treatment of diseases and clinical conditions associated with DKFZp547I224. FLJ10759 (Accession NM_018207) is another VGAM1991 host target gene. FLJ10759 BINDING SITE is HOST TARGET binding site found in the 3' untranslated region of mRNA encoded by FLJ10759, corresponding to a HOST TARGET binding site such as BINDING SITE I, BINDING SITE II or BINDING SITE III. Table 2 illustrates the complementarity of the nucleotide sequences of FLJ10759 BINDING SITE, designated SEQ ID:20100, to the nucleotide sequence of VGAM1991 RNA, herein designated VGAM RNA, also designated SEQ ID:4702.

Another function of VGAM1991 is therefore inhibition of FLJ10759 (Accession NM_018207). Accordingly, utilities of VGAM1991 include diagnosis, prevention and treatment of diseases and clinical conditions associated with FLJ10759. FLJ21432 (Accession NM_024551) is another VGAM1991 host target gene. FLJ21432 BINDING SITE is HOST TARGET binding site found in the 3' untranslated region of mRNA encoded by FLJ21432, corresponding to a HOST TARGET binding site such as BINDING SITE I, BINDING SITE II or BINDING SITE III. Table 2 illustrates the complementarity of the nucleotide sequences of FLJ21432 BINDING SITE, designated SEQ ID:23764, to the nucleotide sequence of VGAM1991 RNA, herein designated VGAM RNA, also designated SEQ ID:4702.

Another function of VGAM1991 is therefore inhibition of FLJ21432 (Accession NM_024551). Accordingly, utilities of VGAM1991 include diagnosis, prevention and treatment of diseases and clinical conditions associated with FLJ21432. KIAA1034 (Accession XM_031223) is another VGAM1991 host target gene. KIAA1034 BINDING SITE is HOST TARGET binding site found in the 3' untranslated region of mRNA encoded by KIAA1034, corresponding to a HOST TARGET binding site such as BINDING SITE I, BINDING SITE II or BINDING SITE III. Table 2 illustrates the complementarity of the nucleotide sequences of KIAA1034 BINDING SITE, designated SEQ ID:31311, to the nucleotide sequence of VGAM1991 RNA, herein designated VGAM RNA, also designated SEQ ID:4702.

Another function of VGAM1991 is therefore inhibition of KIAA1034 (Accession XM_031223). Accordingly, utilities of VGAM1991 include diagnosis, prevention and treatment of diseases and clinical conditions associated with KIAA1034. MGC3020 (Accession NM_024048) is another VGAM1991 host target gene. MGC3020 BINDING SITE is HOST TARGET binding site found in the 5' untranslated region of mRNA encoded by MGC3020, corresponding to a HOST TARGET binding site such as BINDING SITE I, BINDING SITE II or BINDING SITE III. Table 2 illustrates the complementarity of the nucleotide sequences of MGC3020 BINDING SITE, designated SEQ ID:23481, to the nucleotide sequence of VGAM1991 RNA, herein designated VGAM RNA, also designated SEQ ID:4702.

Another function of VGAM1991 is therefore inhibition of MGC3020 (Accession NM_024048). Accordingly, utilities of VGAM1991 include diagnosis, prevention and treatment of diseases and clinical conditions associated with MGC3020. PRO2435 (Accession NM_018527) is another VGAM1991 host target gene. PRO2435 BINDING SITE is HOST TARGET binding site found in the 5' untranslated region of mRNA encoded by PRO2435, corresponding to a HOST TARGET binding site such as BINDING SITE I, BINDING SITE II or BINDING SITE III. Table 2 illustrates the complementarity of the nucleotide sequences of PRO2435 BINDING SITE, designated SEQ ID:20599, to the nucleotide sequence of VGAM1991 RNA, herein designated VGAM RNA, also designated SEQ ID:4702.

Another function of VGAM1991 is therefore inhibition of PRO2435 (Accession NM_018527). Accordingly, utilities of VGAM1991 include diagnosis, prevention and treatment of diseases and clinical conditions associated with PRO2435. LOC143310 (Accession XM_084485) is another VGAM1991 host target gene. LOC143310 BINDING SITE is HOST TARGET binding site found in the 5' untranslated region of mRNA encoded by LOC143310, corresponding to a HOST TARGET binding site such as BINDING SITE I, BINDING SITE II or BINDING SITE III. Table 2 illustrates the complementarity of the nucleotide sequences of LOC143310 BINDING SITE, designated SEQ ID:37604, to the nucleotide sequence of VGAM1991 RNA, herein designated VGAM RNA, also designated SEQ ID:4702.

Another function of VGAM1991 is therefore inhibition of LOC143310 (Accession XM_084485). Accordingly, utilities of VGAM1991 include diagnosis, prevention and treatment of diseases and clinical conditions associated with LOC143310. LOC143465 (Accession XM_096430) is another VGAM1991 host target gene. LOC143465 BINDING SITE is HOST TARGET binding site found in the 5' untranslated region of mRNA encoded by LOC143465, corresponding to a HOST TARGET binding site such as BINDING SITE I, BINDING SITE II or BINDING SITE III. Table 2 illustrates the complementarity of the nucleotide sequences of LOC143465 BINDING SITE, designated SEQ ID:40360, to the nucleotide sequence of VGAM1991 RNA, herein designated VGAM RNA, also designated SEQ ID:4702.

Another function of VGAM1991 is therefore inhibition of LOC143465 (Accession XM_096430). Accordingly, utilities of VGAM1991 include diagnosis, prevention and treatment of diseases and clinical conditions associated with LOC143465. LOC154877 (Accession XM_098626) is another VGAM1991 host target gene. LOC154877 BINDING SITE is HOST TARGET binding site found in the 3' untranslated region of mRNA encoded by LOC154877, corresponding to a HOST TARGET binding site such as BINDING SITE I, BINDING SITE II or BINDING SITE III. Table 2 illustrates the complementarity of the nucleotide sequences of LOC154877 BINDING SITE, designated SEQ ID:41738, to the nucleotide sequence of VGAM1991 RNA, herein designated VGAM RNA, also designated SEQ ID:4702.

Another function of VGAM1991 is therefore inhibition of LOC154877 (Accession XM_098626). Accordingly, utilities of VGAM1991 include diagnosis, prevention and treatment of diseases and clinical conditions associated with LOC154877. LOC196527 (Accession XM_113743) is another VGAM1991 host target gene. LOC196527 BINDING SITE is HOST TARGET binding site found in the 3' untranslated region of mRNA encoded by LOC196527, corresponding to a HOST TARGET binding site such as BINDING SITE I, BINDING SITE II or BINDING SITE III. Table 2 illustrates the complementarity of the nucleotide sequences of LOC196527 BINDING SITE, designated SEQ ID:42398, to the nucleotide sequence of VGAM1991 RNA, herein designated VGAM RNA, also designated SEQ ID:4702.

Another function of VGAM1991 is therefore inhibition of LOC196527 (Accession XM_113743). Accordingly, utilities of VGAM1991 include diagnosis, prevention and treatment of diseases and clinical conditions associated with LOC196527. LOC221738 (Accession XM_168097) is another VGAM1991 host target gene. LOC221738 BINDING SITE is HOST TARGET binding site found in the 5' untranslated region of mRNA encoded by LOC221738, corresponding to a HOST TARGET binding site such as BINDING SITE I, BINDING SITE II or BINDING SITE III. Table 2 illustrates the complementarity of the nucleotide sequences of LOC221738 BINDING SITE, designated SEQ ID:45026, to the nucleotide sequence of VGAM1991 RNA, herein designated VGAM RNA, also designated SEQ ID:4702.

Another function of VGAM1991 is therefore inhibition of LOC221738 (Accession XM_168097). Accordingly, utilities of VGAM1991 include diagnosis, prevention and treatment of diseases and clinical conditions associated with LOC221738. FIG. 1 further provides a conceptual description of a novel bioinformatically detected viral gene of the present invention, referred to here as Viral Genomic Address Messenger 1992 (VGAM1992) viral gene, which modulates expression of respective host target genes thereof, the function and utility of which host target genes is known in the art.

VGAM1992 is a novel bioinformatically detected regulatory, non protein coding, viral micro RNA (miRNA) gene. The method by which VGAM1992 was detected is described hereinabove with reference to FIGS. 1-8.

VGAM1992 gene, herein designated VGAM GENE, is a viral gene contained in the genome of Nipah Virus. VGAM1992 host target gene, herein designated VGAM HOST TARGET GENE, is a human gene contained in the human genome.

VGAM1992 gene encodes a VGAM1992 precursor RNA, herein designated VGAM PRECURSOR RNA. Similar to other miRNA genes, and unlike most ordinary genes, VGAM1992 precursor RNA does not encode a protein. A nucleotide sequence identical or highly similar to the nucleotide sequence of VGAM1992 precursor RNA is designated SEQ ID:1978, and is provided hereinbelow with reference to the sequence listing part. Nucleotide sequence SEQ ID:1978 is located at position 12009 relative to the genome of Nipah Virus.

VGAM1992 precursor RNA folds onto itself, forming VGAM1992 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1992 folded precursor RNA into VGAM1992 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM1992 RNA is designated SEQ ID:4703, and is provided hereinbelow with reference to the sequence listing part.

VGAM1992 host target gene, herein designated VGAM HOST TARGET GENE, encodes a corresponding messenger RNA, VGAM1992 host target RNA, herein designated VGAM HOST TARGET RNA. VGAM1992 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1992 RNA, herein designated VGAM RNA, binds complementarily to one or more host target binding sites located in untranslated regions of VGAM1992 host target RNA, herein designated VGAM HOST TARGET RNA. This complementary binding is due to the fact that the nucleotide sequence of VGAM1992 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1992 RNA, herein designated VGAM RNA, may have a different number of host target binding sites in untranslated regions of a VGAM1992 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1992 RNA, herein designated VGAM RNA, to host target binding sites on VGAM1992 host target RNA, herein designated VGAM HOST TARGET RNA, such as BINDING SITE I, BINDING SITE II and BINDING SITE III, inhibits translation of VGAM1992 host target RNA into VGAM1992 host target protein, herein designated VGAM HOST TARGET PROTEIN. VGAM host target protein is therefore outlined by a broken line.

It is appreciated that VGAM1992 host target gene, herein designated VGAM HOST TARGET GENE, in fact represents a plurality of VGAM1992 host target genes. The mRNA of each one of this plurality of VGAM1992 host target genes comprises one or more host target binding sites, each having a nucleotide sequence which is at least partly complementary to VGAM1992 RNA, herein designated VGAM RNA, and which when bound by VGAM1992 RNA causes inhibition of translation of respective one or more VGAM1992 host target proteins.

It is further appreciated by one skilled in the art that the mode of translational inhibition illustrated by FIG. 1 with specific reference to translational inhibition exerted by VGAM1992 gene, herein designated VGAM GENE, on one or more VGAM1992 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1992 is inhibition of expression of host target genes, as part of a novel viral mechanism of attacking a host. Accordingly, utilities of VGAM1992 include diagnosis, prevention and treatment of viral infection by Nipah Virus. Specific functions, and accordingly utilities, of VGAM1992 correlate with, and may be deduced from, the identity of the host target genes which VGAM1992 binds and inhibits, and the function of these host target genes, as elaborated hereinbelow.

Nucleotide sequences of the VGAM1992 precursor RNA, herein designated VGAM PRECURSOR RNA, and of the 'diced' VGAM1992 RNA, herein designated VGAM RNA, and a schematic representation of the secondary folding of VGAM1992 folded precursor RNA, herein designated VGAM FOLDED PRECURSOR RNA, of VGAM1992 are further described hereinbelow with reference to Table 1.

Nucleotide sequences of host target binding sites, such as BINDING SITE-I, BINDING SITE-II and BINDING SITE-III of FIG. 1, found on VGAM1992 host target RNA, and schematic representation of the complementarity of each of these host target binding sites to VGAM1992 RNA, herein designated VGAM RNA, are described hereinbelow with reference to Table 2.

As mentioned hereinabove with reference to FIG. 1, a function of VGAM1992 gene, herein designated VGAM is inhibition of expression of VGAM1992 target genes. It is appreciated that specific functions, and accordingly utilities, of VGAM1992 correlate with, and may be deduced from, the identity of the target genes which VGAM1992 binds and inhibits, and the function of these target genes, as elaborated hereinbelow.

Transcription Elongation Factor A (SII), 1 (TCEA1, Accession XM_087370) is a VGAM1992 host target gene. TCEA1 BINDING SITE is HOST TARGET binding site found in the 3' untranslated region of mRNA encoded by TCEA1, corresponding to a HOST TARGET binding site such as BINDING SITE I, BINDING SITE II or BINDING SITE III. Table 2 illustrates the complementarity of the nucleotide sequences of TCEA1 BINDING SITE, designated SEQ ID:39201, to the nucleotide sequence of VGAM1992 RNA, herein designated VGAM RNA, also designated SEQ ID:4703.

A function of VGAM1992 is therefore inhibition of Transcription Elongation Factor A (SII), 1 (TCEA1, Accession XM_087370), a gene which helps RNA polymerase II to transcribe past blockages. Accordingly, utilities of VGAM1992 include diagnosis, prevention and treatment of diseases and clinical conditions associated with TCEA1. The function of TCEA1 and its association with various diseases and clinical conditions, has been established by previous studies, as described hereinabove with reference to VGAM211. LOC203084 (Accession XM_113540) is another VGAM1992 host target gene. LOC203084 BINDING SITE is HOST TARGET binding site found in the 3' untranslated region of mRNA encoded by LOC203084, corresponding to a HOST TARGET binding site such as BINDING SITE I, BINDING SITE II or BINDING SITE III. Table 2 illustrates the complementarity of the nucleotide sequences of LOC203084 BINDING SITE, designated SEQ ID:42279, to the nucleotide sequence of VGAM1992 RNA, herein designated VGAM RNA, also designated SEQ ID:4703.

Another function of VGAM1992 is therefore inhibition of LOC203084 (Accession XM_113540). Accordingly, utilities of VGAM1992 include diagnosis, prevention and treatment of diseases and clinical conditions associated with LOC203084. FIG. 1 further provides a conceptual description of a novel bioinformatically detected viral gene of the present invention, referred to here as Viral Genomic Address Messenger 1993 (VGAM1993) viral gene, which modulates expression of respective host target genes thereof, the function and utility of which host target genes is known in the art.

VGAM1993 is a novel bioinformatically detected regulatory, non protein coding, viral micro RNA (miRNA) gene. The method by which VGAM1993 was detected is described hereinabove with reference to FIGS. 1-8.

VGAM1993 gene, herein designated VGAM GENE, is a viral gene contained in the genome of Nipah Virus. VGAM1993 host target gene, herein designated VGAM HOST TARGET GENE, is a human gene contained in the human genome.

VGAM1993 gene encodes a VGAM1993 precursor RNA, herein designated VGAM PRECURSOR RNA. Similar to other miRNA genes, and unlike most ordinary genes, VGAM1993 precursor RNA does not encode a protein. A nucleotide sequence identical or highly similar to the nucleotide sequence of VGAM1993 precursor RNA is designated SEQ ID:1979, and is provided hereinbelow with reference to the sequence listing part. Nucleotide sequence SEQ ID:1979 is located at position 17946 relative to the genome of Nipah Virus.

VGAM1993 precursor RNA folds onto itself, forming VGAM1993 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1993 folded precursor RNA into VGAM1993 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM1993 RNA is designated SEQ ID:4704, and is provided hereinbelow with reference to the sequence listing part.

VGAM1993 host target gene, herein designated VGAM HOST TARGET GENE, encodes a corresponding messenger RNA, VGAM1993 host target RNA, herein designated VGAM HOST TARGET RNA. VGAM1993 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1993 RNA, herein designated VGAM RNA, binds complementarily to one or more host target binding sites located in untranslated regions of VGAM1993 host target RNA, herein designated VGAM HOST TARGET RNA. This complementary binding is due to the fact that the nucleotide sequence of VGAM1993 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1993 RNA, herein designated VGAM RNA, may have a different number of host target binding sites in untranslated regions of a VGAM1993 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1993 RNA, herein designated VGAM RNA, to host target binding sites on VGAM1993 host target RNA, herein designated VGAM HOST TARGET RNA, such as BINDING SITE I, BINDING SITE II and BINDING SITE III, inhibits translation of VGAM1993 host target RNA into VGAM1993 host target protein, herein designated VGAM HOST TARGET PROTEIN. VGAM host target protein is therefore outlined by a broken line.

It is appreciated that VGAM1993 host target gene, herein designated VGAM HOST TARGET GENE, in fact represents a plurality of VGAM1993 host target genes. The mRNA of each one of this plurality of VGAM1993 host target genes comprises one or more host target binding sites, each having a nucleotide sequence which is at least partly complementary to VGAM1993 RNA, herein designated VGAM RNA, and which when bound by VGAM1993 RNA causes inhibition of translation of respective one or more VGAM1993 host target proteins.

It is further appreciated by one skilled in the art that the mode of translational inhibition illustrated by FIG. 1 with specific reference to translational inhibition exerted by VGAM1993 gene, herein designated VGAM GENE, on one or more VGAM1993 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1993 is inhibition of expression of host target genes, as part of a novel viral mechanism of attacking a host. Accordingly, utilities of VGAM1993 include diagnosis, prevention and treatment of viral infection by Nipah Virus. Specific functions, and accordingly utilities, of VGAM1993 correlate with, and may be deduced from, the identity of the host target genes which VGAM1993 binds and inhibits, and the function of these host target genes, as elaborated hereinbelow.

Nucleotide sequences of the VGAM1993 precursor RNA, herein designated VGAM PRECURSOR RNA, and of the 'diced' VGAM1993 RNA, herein designated VGAM RNA, and a schematic representation of the secondary folding of VGAM1993 folded precursor RNA, herein designated VGAM FOLDED PRECURSOR RNA, of VGAM1993 are further described hereinbelow with reference to Table 1.

Nucleotide sequences of host target binding sites, such as BINDING SITE-I, BINDING SITE-II and BINDING SITE-III of FIG. 1, found on VGAM1993 host target RNA, and schematic representation of the complementarity of each of these host target binding sites to VGAM1993 RNA, herein designated VGAM RNA, are described hereinbelow with reference to Table 2.

As mentioned hereinabove with reference to FIG. 1, a function of VGAM1993 gene, herein designated VGAM is inhibition of expression of VGAM1993 target genes. It is appreciated that specific functions, and accordingly utilities, of VGAM1993 correlate with, and may be deduced from, the identity of the target genes which VGAM1993 binds and inhibits, and the function of these target genes, as elaborated hereinbelow.

ZNF333 (Accession NM_032433) is a VGAM1993 host target gene. ZNF333 BINDING SITE is HOST TARGET binding site found in the 3' untranslated region of mRNA encoded by ZNF333, corresponding to a HOST TARGET binding site such as BINDING SITE I, BINDING SITE II or BINDING SITE III. Table 2 illustrates the complementarity of the nucleotide sequences of ZNF333 BINDING SITE, designated SEQ ID:26202, to the nucleotide sequence of VGAM1993 RNA, herein designated VGAM RNA, also designated SEQ ID:4704.

A function of VGAM1993 is therefore inhibition of ZNF333 (Accession NM_032433). Accordingly, utilities of VGAM1993 include diagnosis, prevention and treatment of diseases and clinical conditions associated with ZNF333.

FIG. 1 further provides a conceptual description of a novel bioinformatically detected viral gene of the present invention, referred to here as Viral Genomic Address Messenger 1994 (VGAM1994) viral gene, which modulates expression of respective host target genes thereof, the function and utility of which host target genes is known in the art.

VGAM1994 is a novel bioinformatically detected regulatory, non protein coding, viral micro RNA (miRNA) gene. The method by which VGAM1994 was detected is described hereinabove with reference to FIGS. 1-8.

VGAM1994 gene, herein designated VGAM GENE, is a viral gene contained in the genome of Nipah Virus. VGAM1994 host target gene, herein designated VGAM HOST TARGET GENE, is a human gene contained in the human genome.

VGAM1994 gene encodes a VGAM1994 precursor RNA, herein designated VGAM PRECURSOR RNA. Similar to other miRNA genes, and unlike most ordinary genes, VGAM1994 precursor RNA does not encode a protein. A nucleotide sequence identical or highly similar to the nucleotide sequence of VGAM1994 precursor RNA is designated SEQ ID:1980, and is provided hereinbelow with reference to the sequence listing part. Nucleotide sequence SEQ ID:1980 is located at position 17237 relative to the genome of Nipah Virus.

VGAM1994 precursor RNA folds onto itself, forming VGAM1994 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1994 folded precursor RNA into VGAM1994 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM1994 RNA is designated SEQ ID:4705, and is provided hereinbelow with reference to the sequence listing part.

VGAM1994 host target gene, herein designated VGAM HOST TARGET GENE, encodes a corresponding messenger RNA, VGAM1994 host target RNA, herein designated VGAM HOST TARGET RNA. VGAM1994 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1994 RNA, herein designated VGAM RNA, binds complementarily to one or more host target binding sites located in untranslated regions of VGAM1994 host target RNA, herein designated VGAM HOST TARGET RNA. This complementary binding is due to the fact that the nucleotide sequence of VGAM1994 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1994 RNA, herein designated VGAM RNA, may have a different number of host target binding sites in untranslated regions of a VGAM1994 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1994 RNA, herein designated VGAM RNA, to host target binding sites on VGAM1994 host target RNA, herein designated VGAM HOST TARGET RNA, such as BINDING SITE I, BINDING SITE II and BINDING SITE III, inhibits translation of VGAM1994 host target RNA into VGAM1994 host target protein, herein designated VGAM HOST TARGET PROTEIN. VGAM host target protein is therefore outlined by a broken line.

It is appreciated that VGAM1994 host target gene, herein designated VGAM HOST TARGET GENE, in fact represents a plurality of VGAM1994 host target genes. The mRNA of each one of this plurality of VGAM1994 host target genes comprises one or more host target binding sites, each having a nucleotide sequence which is at least partly complementary to VGAM1994 RNA, herein designated VGAM RNA, and which when bound by VGAM1994 RNA causes inhibition of translation of respective one or more VGAM1994 host target proteins.

It is further appreciated by one skilled in the art that the mode of translational inhibition illustrated by FIG. 1 with specific reference to translational inhibition exerted by VGAM1994 gene, herein designated VGAM GENE, on one or more VGAM1994 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1994 is inhibition of expression of host target genes, as part of a novel viral mechanism of attacking a host. Accordingly, utilities of VGAM1994 include diagnosis, prevention and treatment of viral infection by Nipah Virus. Specific functions, and accordingly utilities, of VGAM1994 correlate with, and may be deduced from, the identity of the host target genes which VGAM1994 binds and inhibits, and the function of these host target genes, as elaborated hereinbelow.

Nucleotide sequences of the VGAM1994 precursor RNA, herein designated VGAM PRECURSOR RNA, and of the 'diced' VGAM1994 RNA, herein designated VGAM RNA, and a schematic representation of the secondary folding of VGAM1994 folded precursor RNA, herein designated VGAM FOLDED PRECURSOR RNA, of VGAM1994 are further described hereinbelow with reference to Table 1.

Nucleotide sequences of host target binding sites, such as BINDING SITE-I, BINDING SITE-II and BINDING SITE-III of FIG. 1, found on VGAM1994 host target RNA, and schematic representation of the complementarity of each of these host target binding sites to VGAM1994 RNA, herein designated VGAM RNA, are described hereinbelow with reference to Table 2.

As mentioned hereinabove with reference to FIG. 1, a function of VGAM1994 gene, herein designated VGAM is inhibition of expression of VGAM1994 target genes. It is appreciated that specific functions, and accordingly utilities, of VGAM1994 correlate with, and may be deduced from, the identity of the target genes which VGAM1994 binds and inhibits, and the function of these target genes, as elaborated hereinbelow.

Heat Shock 70 kDa Protein 5 (glucose-regulated protein, 78 kDa) (HSPA5, Accession NM_005347) is a VGAM1994 host target gene. HSPA5 BINDING SITE is HOST TARGET binding site found in the 3' untranslated region of mRNA encoded by HSPA5, corresponding to a HOST TARGET binding site such as BINDING SITE I, BINDING SITE II or BINDING SITE III. Table 2 illustrates the complementarity of the nucleotide sequences of HSPA5 BINDING SITE, designated SEQ ID:11821, to the nucleotide sequence of VGAM1994 RNA, herein designated VGAM RNA, also designated SEQ ID:4705.

A function of VGAM1994 is therefore inhibition of Heat Shock 70 kDa Protein 5 (glucose-regulated protein, 78 kDa) (HSPA5, Accession NM_005347), a gene which is involved in the folding and assembly of proteins in the endoplasmic reticulum (ER). Accordingly, utilities of VGAM1994 include diagnosis, prevention and treatment of diseases and clinical conditions associated with HSPA5. The function of HSPA5 and its association with various diseases and clinical conditions, has been established by previous studies, as described hereinabove with reference to VGAM1782. Calsenilin, Presenilin Binding Protein, EF Hand Transcription Factor (CSEN, Accession NM_013434) is another VGAM1994 host target gene. CSEN BINDING SITE is HOST TARGET binding site found in the 3' untranslated region of mRNA encoded by CSEN, corresponding to a HOST TARGET binding site such as BINDING SITE I, BINDING SITE II or BINDING SITE III. Table 2 illustrates the complementarity of the nucleotide sequences of CSEN BINDING SITE, designated SEQ ID:15092, to the nucleotide sequence of VGAM1994 RNA, herein designated VGAM RNA, also designated SEQ ID:4705.

Another function of VGAM1994 is therefore inhibition of Calsenilin, Presenilin Binding Protein, EF Hand Transcription Factor (CSEN, Accession NM_013434). Accordingly, utilities of VGAM1994 include diagnosis, prevention and treatment of diseases and clinical conditions associated with CSEN. KIAA1509 (Accession XM_029353) is another VGAM1994 host target gene. KIAA1509 BINDING SITE is HOST TARGET binding site found in the 3' untranslated region of mRNA encoded by KIAA1509, corresponding to a HOST TARGET binding site such as BINDING SITE I, BINDING SITE II or BINDING SITE III. Table 2 illustrates the complementarity of the nucleotide sequences of KIAA1509 BINDING SITE, designated SEQ ID:30872, to the nucleotide sequence of VGAM1994 RNA, herein designated VGAM RNA, also designated SEQ ID:4705.

Another function of VGAM1994 is therefore inhibition of KIAA1509 (Accession XM_029353). Accordingly, utilities of VGAM1994 include diagnosis, prevention and treatment of diseases and clinical conditions associated with KIAA1509. LOC148760 (Accession XM_097514) is another VGAM1994 host target gene. LOC148760 BINDING SITE is HOST TARGET binding site found in the 3' untranslated region of mRNA encoded by LOC148760, corresponding to a HOST TARGET binding site such as BINDING SITE I, BINDING SITE II or BINDING SITE III. Table 2 illustrates the complementarity of the nucleotide sequences of LOC148760 BINDING SITE, designated SEQ ID:40897, to the nucleotide sequence of VGAM1994 RNA, herein designated VGAM RNA, also designated SEQ ID:4705.

Another function of VGAM1994 is therefore inhibition of LOC148760 (Accession XM_097514). Accordingly, utilities of VGAM1994 include diagnosis, prevention and treatment of diseases and clinical conditions associated with LOC148760. LOC168667 (Accession XM_166592) is another VGAM1994 host target gene. LOC168667 BINDING SITE is HOST TARGET binding site found in the 3' untranslated region of mRNA encoded by LOC168667, corresponding to a HOST TARGET binding site such as BINDING SITE I, BINDING SITE II or BINDING SITE III. Table 2 illustrates the complementarity of the nucleotide sequences of LOC168667 BINDING SITE, designated SEQ ID:44566, to the nucleotide sequence of VGAM1994 RNA, herein designated VGAM RNA, also designated SEQ ID:4705.

Another function of VGAM1994 is therefore inhibition of LOC168667 (Accession XM_166592). Accordingly, utilities of VGAM1994 include diagnosis, prevention and treatment of diseases and clinical conditions associated with LOC168667. LOC253842 (Accession XM_173230) is another VGAM1994 host target gene. LOC253842 BINDING SITE is HOST TARGET binding site found in the 3' untranslated region of mRNA encoded by LOC253842, corresponding to a HOST TARGET binding site such as BINDING SITE I, BINDING SITE II or BINDING SITE III. Table 2 illustrates the complementarity of the nucleotide sequences of LOC253842 BINDING SITE, designated SEQ ID:46503, to the nucleotide sequence of VGAM1994 RNA, herein designated VGAM RNA, also designated SEQ ID:4705.

Another function of VGAM1994 is therefore inhibition of LOC253842 (Accession XM_173230). Accordingly, utilities of VGAM1994 include diagnosis, prevention and treatment of diseases and clinical conditions associated with LOC253842. FIG. 1 further provides a conceptual description of a novel bioinformatically detected viral gene of the present invention, referred to here as Viral Genomic Address Messenger 1995 (VGAM1995) viral gene, which modulates expression of respective host target genes thereof, the function and utility of which host target genes is known in the art.

VGAM1995 is a novel bioinformatically detected regulatory, non protein coding, viral micro RNA (miRNA) gene. The method by which VGAM1995 was detected is described hereinabove with reference to FIGS. 1-8.

VGAM1995 gene, herein designated VGAM GENE, is a viral gene contained in the genome of Nipah Virus. VGAM1995 host target gene, herein designated VGAM HOST TARGET GENE, is a human gene contained in the human genome.

VGAM1995 gene encodes a VGAM1995 precursor RNA, herein designated VGAM PRECURSOR RNA. Similar to other miRNA genes, and unlike most ordinary genes, VGAM1995 precursor RNA does not encode a protein. A nucleotide sequence identical or highly similar to the nucleotide sequence of VGAM1995 precursor RNA is designated SEQ ID:1981, and is provided hereinbelow with reference to the sequence listing part. Nucleotide sequence SEQ ID:1981 is located at position 9693 relative to the genome of Nipah Virus.

VGAM1995 precursor RNA folds onto itself, forming VGAM1995 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1995 folded precursor RNA into VGAM1995 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1995 RNA is designated SEQ ID:4706, and is provided hereinbelow with reference to the sequence listing part.

VGAM1995 host target gene, herein designated VGAM HOST TARGET GENE, encodes a corresponding messenger RNA, VGAM1995 host target RNA, herein designated VGAM HOST TARGET RNA. VGAM1995 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1995 RNA, herein designated VGAM RNA, binds complementarily to one or more host target binding sites located in untranslated regions of VGAM1995 host target RNA, herein designated VGAM HOST TARGET RNA. This complementary binding is due to the fact that the nucleotide sequence of VGAM1995 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1995 RNA, herein designated VGAM RNA, may have a different number of host target binding sites in untranslated regions of a VGAM1995 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1995 RNA, herein designated VGAM RNA, to host target binding sites on VGAM1995 host target RNA, herein designated VGAM HOST TARGET RNA, such as BINDING SITE I, BINDING SITE II and BINDING SITE III, inhibits translation of VGAM1995 host target RNA into VGAM1995 host target protein, herein designated VGAM HOST TARGET PROTEIN. VGAM host target protein is therefore outlined by a broken line.

It is appreciated that VGAM1995 host target gene, herein designated VGAM HOST TARGET GENE, in fact represents a plurality of VGAM1995 host target genes. The mRNA of each one of this plurality of VGAM1995 host target genes comprises one or more host target binding sites, each having a nucleotide sequence which is at least partly complementary to VGAM1995 RNA, herein designated VGAM RNA, and which when bound by VGAM1995 RNA causes inhibition of translation of respective one or more VGAM1995 host target proteins.

It is further appreciated by one skilled in the art that the mode of translational inhibition illustrated by FIG. 1 with specific reference to translational inhibition exerted by VGAM1995 gene, herein designated VGAM GENE, on one or more VGAM1995 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1995 is inhibition of expression of host target genes, as part of a novel viral mechanism of attacking a host. Accordingly, utilities of VGAM1995 include diagnosis, prevention and treatment of viral infection by Nipah Virus. Specific functions, and accordingly utilities, of VGAM1995 correlate with, and may be deduced from, the identity of the host target genes which VGAM1995 binds and inhibits, and the function of these host target genes, as elaborated hereinbelow.

Nucleotide sequences of the VGAM1995 precursor RNA, herein designated VGAM PRECURSOR RNA, and of the 'diced' VGAM1995 RNA, herein designated VGAM RNA, and a schematic representation of the secondary folding of VGAM1995 folded precursor RNA, herein designated VGAM FOLDED PRECURSOR RNA, of VGAM1995 are further described hereinbelow with reference to Table 1.

Nucleotide sequences of host target binding sites, such as BINDING SITE-I, BINDING SITE-II and BINDING SITE-III of FIG. 1, found on VGAM1995 host target RNA, and schematic representation of the complementarity of each of these host target binding sites to VGAM1995 RNA, herein designated VGAM RNA, are described hereinbelow with reference to Table 2.

As mentioned hereinabove with reference to FIG. 1, a function of VGAM1995 gene, herein designated VGAM is inhibition of expression of VGAM1995 target genes. It is appreciated that specific functions, and accordingly utilities, of VGAM1995 correlate with, and may be deduced from, the identity of the target genes which VGAM1995 binds and inhibits, and the function of these target genes, as elaborated hereinbelow.

Ankyrin 1, Erythrocytic (ANK1, Accession XM_016774) is a VGAM1995 host target gene. ANK1 BINDING SITE is HOST TARGET binding site found in the 3' untranslated region of mRNA encoded by ANK1, corresponding to a HOST TARGET binding site such as BINDING SITE I, BINDING SITE II or BINDING SITE III. Table 2 illustrates the complementarity of the nucleotide sequences of ANK1 BINDING SITE, designated SEQ ID:30279, to the nucleotide sequence of VGAM1995 RNA, herein designated VGAM RNA, also designated SEQ ID:4706.

A function of VGAM1995 is therefore inhibition of Ankyrin 1, Erythrocytic (ANK1, Accession XM_016774). Accordingly, utilities of VGAM1995 include diagnosis, prevention and treatment of diseases and clinical conditions associated with ANK1. APM1 (Accession NM_004797) is another VGAM1995 host target gene. APM1 BINDING SITE is HOST TARGET binding site found in the 3' untranslated region of mRNA encoded by APM1, corresponding to a HOST TARGET binding site such as BINDING SITE I, BINDING SITE II or BINDING SITE III. Table 2 illustrates the complementarity of the nucleotide sequences of APM1 BINDING SITE, designated SEQ ID:11211, to the nucleotide sequence of VGAM1995 RNA, herein designated VGAM RNA, also designated SEQ ID:4706.

Another function of VGAM1995 is therefore inhibition of APM1 (Accession NM_004797). Accordingly, utilities of VGAM1995 include diagnosis, prevention and treatment of diseases and clinical conditions associated with APM1. Collagen, Type I, Alpha 2 (COL1A2, Accession NM_000089) is another VGAM1995 host target gene. COL1A2 BINDING SITE is HOST TARGET binding site found in the 3' untranslated region of mRNA encoded by COL1A2, corresponding to a HOST TARGET binding site such as BINDING SITE I, BINDING SITE II or BINDING SITE III. Table 2 illustrates the complementarity of the nucleotide sequences of COL1A2 BINDING SITE, designated SEQ ID:5541, to the nucleotide sequence of VGAM1995 RNA, herein designated VGAM RNA, also designated SEQ ID:4706.

Another function of VGAM1995 is therefore inhibition of Collagen, Type I, Alpha 2 (COL1A2, Accession NM_000089). Accordingly, utilities of VGAM1995 include diagnosis, prevention and treatment of diseases and clinical conditions associated with COL1A2. Coagulation Factor VII (serum prothrombin conversion accelerator) (F7, Accession NM_000131) is another VGAM1995 host target gene. F7 BINDING SITE1 and F7 BINDING SITE2 are HOST TARGET binding sites found in untranslated regions of mRNA encoded by F7, corresponding to HOST TARGET binding sites such as BINDING SITE I, BINDING SITE II or BINDING SITE III. Table 2 illustrates the complementarity of the nucleotide sequences of F7 BINDING SITE1 and F7 BINDING SITE2, designated SEQ ID:5607 and SEQ ID:21236 respectively, to the nucleotide sequence of VGAM1995 RNA, herein designated VGAM RNA, also designated SEQ ID:4706.

Another function of VGAM1995 is therefore inhibition of Coagulation Factor VII (serum prothrombin conversion accelerator) (F7, Accession NM_000131). Accordingly, utilities of VGAM1995 include diagnosis, prevention and treatment of diseases and clinical conditions associated with F7. Potassium Inwardly-rectifying Channel, Subfamily J, Member 8 (KCNJ8, Accession NM_004982) is another VGAM1995 host target gene. KCNJ8 BINDING SITE is HOST TARGET binding site found in the 5' untranslated region of mRNA encoded by KCNJ8, corresponding to a HOST TARGET binding site such as BINDING SITE I, BINDING SITE II or BINDING SITE III. Table 2 illustrates the complementarity of the nucleotide sequences of KCNJ8 BINDING SITE, designated SEQ ID:11429, to the nucleotide sequence of VGAM1995 RNA, herein designated VGAM RNA, also designated SEQ ID:4706.

Another function of VGAM1995 is therefore inhibition of Potassium Inwardly-rectifying Channel, Subfamily J, Member 8 (KCNJ8, Accession NM_004982), a gene which is a potassium inwardly-rectifying channel. Accordingly, utilities of VGAM1995 include diagnosis, prevention and treatment of diseases and clinical conditions associated with KCNJ8. The function of KCNJ8 has been established by previous studies. Inagaki et al. (1995) isolated a cDNA from a rat pancreatic islet cell library that encodes a member of the inward rectifier potassium channel family. The predicted 424-amino acid protein, which they designated uKATP-1, has 2 transmembrane domains and shares 43 to 46% identity with other inward rectifier potassium channels, including ROMK1 (OMIM Ref. No. 600359), IRK1 (OMIM Ref. No. 600681), GIRK1 (OMIM Ref. No. 601534), and cKATP-1 (OMIM Ref. No. 600734). When the protein was expressed in Xenopus oocytes, a weak rectifier activity was demonstrated that was blocked with Ba (+2) and activated by diazoxide. Northern blots showed that the mRNA is widely expressed in various tissues of the rat. Inagaki et al. (1995) cloned the human gene, designated KCNJ8. The predicted human protein is 98% identical to that of the rat. Animal model experiments lend further support to the function of KCNJ8. ANIMAL MODEL Miki et al. (2002) found that mice lacking the Kir6.1 gene had a high rate of sudden death associated with spontaneous ST elevation followed by atrioventricular block, as seen on the electrocardiogram. The potassium channel opener pinacidil did not induce potassium channels in vascular smooth muscle cells of Kir6.1 null mice, and there was no vasodilation response to pinacidil. Administration of methylergometrine, a vasoconstrictive agent, elicited ST elevation followed by cardiac death in Kir6.1 null mice but not in wildtype mice, indicating a phenotype characterized by hypercontractility of coronary arteries and resembling Prinzmetal (or variant) angina in human S (Prinzmetal et al., 1959). Prinzmetal angina occurs exclusively at rest and is associated with elevation of ST segments on EKG during the attack. Although the attack disappears spontaneously in most cases, it can lead to myocardial infarction, severe AV block, life-threatening ventricular tachycardia, and sudden death if the coronary vasospasm is prolonged (MacAlpin, 1993). The elevated ST segments on EKG during the attack are diagnostic, as is induction of coronary spasm by ergot alkaloids or acetylcholine. Vasospastic angina is more common in Japanese than in Caucasians (Beltrame et al., 1999; Pristipino et al., 2000). Miki et al. (2002) concluded that the Kir6.1-containing potassium channel is critical in the regulation of vascular tone, especially in the coronary arteries, and its disruption may cause Prinzmetal angina. They suggested that it will be important to learn whether genetic differences in the KIR6.1 gene are associated with Prinzmetal angina in various populations It is appreciated that the abovementioned animal model for KCNJ8 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Miki, T.; Suzuki, M.; Shibasaki, T.; Uemura, H.; Sato, T.; Yamaguchi, K.; Koseki, H.; Iwanaga, T.; Nakaya, H.; Seino, S.: Mouse model of Prinzmetal angina by disruption of the inward rectifier Kir6.1. Nature Med. 8:466-472, 2002; and Inagaki, N.; Inazawa, J.; Seino, S.: cDNA sequence, gene structure, and chromosomal localization of the human ATP-sensitive potassium channel, uK(ATP)-1, gene (KCNJ8). Genomics 30:102.

Further studies establishing the function and utilities of KCNJ8 are found in John Hopkins OMIM database record ID 600935, and in sited publications numbered 6865-686 and 7024-7026 listed in the bibliography section hereinbelow, which are also hereby incorporated by reference.5'-nucleotidase, Cytosolic II (NT5C2, Accession NM_012229) is another VGAM1995 host target gene. NT5C2 BINDING SITE is HOST TARGET binding site found in the 3' untranslated region of mRNA encoded by NT5C2, corresponding to a HOST TARGET binding site such as BINDING SITE I, BINDING SITE II or BINDING SITE III. Table 2 illustrates the complementarity of the nucleotide sequences of NT5C2 BINDING SITE, designated SEQ ID:14525, to the nucleotide sequence of VGAM1995 RNA, herein designated VGAM RNA, also designated SEQ ID:4706.

Another function of VGAM1995 is therefore inhibition of 5'-nucleotidase, Cytosolic II (NT5C2, Accession NM_012229). Accordingly, utilities of VGAM1995 include diagnosis, prevention and treatment of diseases and clinical conditions associated with NT5C2. p21(CDKN1A)-activated Kinase 4 (PAK4, Accession NM_005884) is another VGAM1995 host target gene. PAK4 BINDING SITE is HOST TARGET binding site found in the 3' untranslated region of mRNA encoded by PAK4, corresponding to a HOST TARGET binding site such as BINDING SITE I, BINDING SITE II or BINDING SITE III. Table 2 illustrates the complementarity of the nucleotide sequences of PAK4 BINDING SITE, designated SEQ ID:12507, to the nucleotide sequence of VGAM1995 RNA, herein designated VGAM RNA, also designated SEQ ID:4706.

Another function of VGAM1995 is therefore inhibition of p21(CDKN1A)-activated Kinase 4 (PAK4, Accession NM_005884). Accordingly, utilities of VGAM1995 include diagnosis, prevention and treatment of diseases and clinical conditions associated with PAK4. Pumilio Homolog 2 (Drosophila) (PUM2, Accession NM_015317) is another VGAM1995 host target gene. PUM2 BINDING SITE is HOST TARGET binding site found in the 3' untranslated region of mRNA encoded by PUM2, corresponding to a HOST TARGET binding site such as BINDING SITE I, BINDING SITE II or BINDING SITE III. Table 2 illustrates the complementarity of the nucleotide sequences of PUM2 BINDING SITE, designated SEQ ID:17633, to the nucleotide sequence of VGAM1995 RNA, herein designated VGAM RNA, also designated SEQ ID:4706.

Another function of VGAM1995 is therefore inhibition of Pumilio Homolog 2 (Drosophila) (PUM2, Accession NM_015317). Accordingly, utilities of VGAM1995 include diagnosis, prevention and treatment of diseases and clinical conditions associated with PUM2. Retinaldehyde Binding Protein 1 (RLBP1, Accession NM_000326) is another VGAM1995 host target gene. RLBP1 BINDING SITE is HOST TARGET binding site found in the 5' untranslated region of mRNA encoded by RLBP1, corresponding to a HOST TARGET binding site such as BINDING SITE I, BINDING SITE II or BINDING SITE III. Table 2 illustrates the complementarity of the nucleotide sequences of RLBP1 BINDING SITE, designated SEQ ID:5869, to the nucleotide sequence of VGAM1995 RNA, herein designated VGAM RNA, also designated SEQ ID:4706.

Another function of VGAM1995 is therefore inhibition of Retinaldehyde Binding Protein 1 (RLBP1, Accession NM_000326). Accordingly, utilities of VGAM1995 include diagnosis, prevention and treatment of diseases and clinical conditions associated with RLBP1. TIC (Accession NM_012455) is another VGAM1995 host target gene. TIC BINDING SITE is HOST TARGET binding site found in the 3' untranslated region of mRNA encoded by TIC, corresponding to a HOST TARGET binding site such as BINDING SITE I, BINDING SITE II or BINDING SITE III. Table 2 illustrates the complementarity of the nucleotide sequences of TIC BINDING SITE, designated SEQ ID:14828, to the nucleotide sequence of VGAM1995 RNA, herein designated VGAM RNA, also designated SEQ ID:4706.

Another function of VGAM1995 is therefore inhibition of TIC (Accession NM_012455). Accordingly, utilities of VGAM1995 include diagnosis, prevention and treatment of diseases and clinical conditions associated with TIC. Ubiquitin Specific Protease 9, Y Chromosome (fat facets-like Drosophila) (USP9Y, Accession XM_034147) is another VGAM1995 host target gene. USP9Y BINDING SITE is HOST TARGET binding site found in the 5' untranslated region of mRNA encoded by USP9Y, corresponding to a HOST TARGET binding site such as BINDING SITE I, BINDING SITE II or BINDING SITE III. Table 2 illustrates the complementarity of the nucleotide sequences of USP9Y BINDING SITE, designated SEQ ID:32017, to the nucleotide sequence of VGAM1995 RNA, herein designated VGAM RNA, also designated SEQ ID:4706.

Another function of VGAM1995 is therefore inhibition of Ubiquitin Specific Protease 9, Y Chromosome (fat facets-like Drosophila) (USP9Y, Accession XM_034147), a gene which removes ubiquitin from ubiquitin-conjugated proteins and has a role in spermatogenesis. Accordingly, utilities of VGAM1995 include diagnosis, prevention and treatment of diseases and clinical conditions associated with USP9Y. The function of USP9Y and its association with various diseases and clinical conditions, has been established by previous studies, as described hereinabove with reference to VGAM894. Chromosome 20 Open Reading Frame 54 (C20orf54, Accession NM_033409) is another VGAM1995 host target gene. C20orf54 BINDING SITE is HOST TARGET binding site found in the 3' untranslated region of mRNA encoded by C20orf54, corresponding to a HOST TARGET binding site such as BINDING SITE I, BINDING SITE II or BINDING SITE III. Table 2 illustrates the complementarity of the nucleotide sequences of C20orf54 BINDING SITE, designated SEQ ID:27229, to the nucleotide sequence of VGAM1995 RNA, herein designated VGAM RNA, also designated SEQ ID:4706.

Another function of VGAM1995 is therefore inhibition of Chromosome 20 Open Reading Frame 54 (C20orf54, Accession NM_033409). Accordingly, utilities of VGAM1995 include diagnosis, prevention and treatment of diseases and clinical conditions associated with C20orf54. CDT1 (Accession XM_085327) is another VGAM1995 host target gene. CDT1 BINDING SITE is HOST TARGET binding site found in the 3' untranslated region of mRNA encoded by CDT1, corresponding to a HOST TARGET binding site such as BINDING SITE I, BINDING SITE II or BINDING SITE III. Table 2 illustrates the complementarity of the nucleotide sequences of CDT1 BINDING SITE, designated SEQ ID:38069, to the nucleotide sequence of VGAM1995 RNA, herein designated VGAM RNA, also designated SEQ ID:4706.

Another function of VGAM1995 is therefore inhibition of CDT1 (Accession XM_085327). Accordingly, utilities of VGAM1995 include diagnosis, prevention and treatment of diseases and clinical conditions associated with CDT1. Cytosolic Ovarian Carcinoma Antigen 1 (COVA1, Accession XM_055323) is another VGAM1995 host target gene. COVA1 BINDING SITE is HOST TARGET binding site found in the 3' untranslated region of mRNA encoded by COVA1, corresponding to a HOST TARGET binding site such as BINDING SITE I, BINDING SITE II or BINDING SITE III. Table 2 illustrates the complementarity of the nucleotide sequences of COVA1 BINDING SITE, designated SEQ ID:36266, to the nucleotide sequence of VGAM1995 RNA, herein designated VGAM RNA, also designated SEQ ID:4706.

Another function of VGAM1995 is therefore inhibition of Cytosolic Ovarian Carcinoma Antigen 1 (COVA1, Accession XM_055323). Accordingly, utilities of VGAM1995 include diagnosis, prevention and treatment of diseases and clinical conditions associated with COVA1. CSR1 (Accession NM_016240) is another VGAM1995 host target gene. CSR1 BINDING SITE is HOST TARGET binding site found in the 3' untranslated region of mRNA encoded by CSR1, corresponding to a HOST TARGET binding site such as BINDING SITE I, BINDING SITE II or BINDING SITE III. Table 2 illustrates the complementarity of the nucleotide sequences of CSR1 BINDING SITE, designated SEQ ID:18361, to the nucleotide sequence of VGAM1995 RNA, herein designated VGAM RNA, also designated SEQ ID:4706.

Another function of VGAM1995 is therefore inhibition of CSR1 (Accession NM_016240). Accordingly, utilities of VGAM1995 include diagnosis, prevention and treatment of diseases and clinical conditions associated with CSR1. Deiodinase, Iodothyronine, Type II (DIO2, Accession NM_013989) is another VGAM1995 host target gene. DIO2 BINDING SITE1 and DIO2 BINDING SITE2 are HOST TARGET binding sites found in untranslated regions of mRNA encoded by DIO2, corresponding to HOST TARGET binding sites such as BINDING SITE I, BINDING SITE II or BINDING SITE III. Table 2 illustrates the complementarity of the nucleotide sequences of DIO2 BINDING SITE1 and DIO2 BINDING SITE2, designated SEQ ID:15164 and SEQ ID:6454 respectively, to the nucleotide sequence of VGAM1995 RNA, herein designated VGAM RNA, also designated SEQ ID:4706.

Another function of VGAM1995 is therefore inhibition of Deiodinase, Iodothyronine, Type II (DIO2, Accession NM_013989). Accordingly, utilities of VGAM1995 include diagnosis, prevention and treatment of diseases and clinical conditions associated with DIO2. Docking Protein 4 (DOK4, Accession NM_018110) is another VGAM1995 host target gene. DOK4 BINDING SITE is HOST TARGET binding site found in the 3' untranslated region of mRNA encoded by DOK4, corresponding to a HOST TARGET binding site such as BINDING SITE I, BINDING SITE II or BINDING SITE III. Table 2 illustrates the complementarity of the nucleotide sequences of DOK4 BINDING SITE, designated SEQ ID:19883, to the nucleotide sequence of VGAM1995 RNA, herein designated VGAM RNA, also designated SEQ ID:4706.

Another function of VGAM1995 is therefore inhibition of Docking Protein 4 (DOK4, Accession NM_018110). Accordingly, utilities of VGAM1995 include diagnosis, prevention and treatment of diseases and clinical conditions associated with DOK4. FLJ10079 (Accession XM_012540) is another VGAM1995 host target gene. FLJ10079 BINDING SITE is HOST TARGET binding site found in the 3' untranslated region of mRNA encoded by FLJ10079, corresponding to a HOST TARGET binding site such as BINDING SITE I, BINDING SITE II or BINDING SITE III. Table 2 illustrates the complementarity of the nucleotide sequences of FLJ10079 BINDING SITE, designated SEQ ID:30215, to the nucleotide sequence of VGAM1995 RNA, herein designated VGAM RNA, also designated SEQ ID:4706.

Another function of VGAM1995 is therefore inhibition of FLJ10079 (Accession XM_012540). Accordingly, utilities of VGAM1995 include diagnosis, prevention and treatment of diseases and clinical conditions associated with FLJ10079. FLJ10300 (Accession NM_018051) is another VGAM1995 host target gene. FLJ10300 BINDING SITE is HOST TARGET binding site found in the 5' untranslated region of mRNA encoded by FLJ10300, corresponding to a HOST TARGET binding site such as BINDING SITE I, BINDING SITE II or BINDING SITE III. Table 2 illustrates the complementarity of the nucleotide sequences of FLJ10300 BINDING SITE, designated SEQ ID:19810, to the nucleotide sequence of VGAM1995 RNA, herein designated VGAM RNA, also designated SEQ ID:4706.

Another function of VGAM1995 is therefore inhibition of FLJ10300 (Accession NM_018051). Accordingly, utilities of VGAM1995 include diagnosis, prevention and treatment of diseases and clinical conditions associated with FLJ10300. FLJ10904 (Accession NM_018268) is another VGAM1995 host target gene. FLJ10904 BINDING SITE is HOST TARGET binding site found in the 3' untranslated region of mRNA encoded by FLJ10904, corresponding to a HOST TARGET binding site such as BINDING SITE I, BINDING SITE II or BINDING SITE III. Table 2 illustrates the complementarity of the nucleotide sequences of FLJ10904 BINDING SITE, designated SEQ ID:20240, to the nucleotide sequence of VGAM1995 RNA, herein designated VGAM RNA, also designated SEQ ID:4706.

Another function of VGAM1995 is therefore inhibition of FLJ10904 (Accession NM_018268). Accordingly, utilities of VGAM1995 include diagnosis, prevention and treatment of diseases and clinical conditions associated with FLJ10904. FLJ10986 (Accession NM_018291) is another VGAM1995 host target gene. FLJ10986 BINDING SITE is HOST TARGET binding site found in the 5' untranslated region of mRNA encoded by FLJ10986, corresponding to a HOST TARGET binding site such as BINDING SITE I, BINDING SITE II or BINDING SITE III. Table 2 illustrates the complementarity of the nucleotide sequences of FLJ10986 BINDING SITE, designated SEQ ID:20281, to the nucleotide sequence of VGAM1995 RNA, herein designated VGAM RNA, also designated SEQ ID:4706.

Another function of VGAM1995 is therefore inhibition of FLJ10986 (Accession NM_018291). Accordingly, utilities of VGAM1995 include diagnosis, prevention and treatment of diseases and clinical conditions associated with FLJ10986. FLJ12969 (Accession NM_022838) is another VGAM1995 host target gene. FLJ12969 BINDING SITE is HOST TARGET binding site found in the 5' untranslated region of mRNA encoded by FLJ12969, corresponding to a HOST TARGET binding site such as BINDING SITE I, BINDING SITE II or BINDING SITE III. Table 2 illustrates the complementarity of the nucleotide sequences of FLJ12969 BINDING SITE, designated SEQ ID:23125, to the nucleotide sequence of VGAM1995 RNA, herein designated VGAM RNA, also designated SEQ ID:4706.

Another function of VGAM1995 is therefore inhibition of FLJ12969 (Accession NM_022838). Accordingly, utilities of VGAM1995 include diagnosis, prevention and treatment of diseases and clinical conditions associated with FLJ12969. FLJ32356 (Accession NM_144671) is another VGAM1995 host target gene. FLJ32356 BINDING SITE is HOST TARGET binding site found in the 3' untranslated region of mRNA encoded by FLJ32356, corresponding to a HOST TARGET binding site such as BINDING SITE I, BINDING SITE II or BINDING SITE III. Table 2 illustrates the complementarity of the nucleotide sequences of FLJ32356 BINDING SITE, designated SEQ ID:29493, to the nucleotide sequence of VGAM1995 RNA, herein designated VGAM RNA, also designated SEQ ID:4706.

Another function of VGAM1995 is therefore inhibition of FLJ32356 (Accession NM_144671). Accordingly, utilities of VGAM1995 include diagnosis, prevention and treatment of diseases and clinical conditions associated with FLJ32356. Integrin, Alpha 10 (ITGA10, Accession XM_002097) is another VGAM1995 host target gene. ITGA10 BINDING SITE is HOST TARGET binding site found in the 5' untranslated region of mRNA encoded by ITGA10, corresponding to a HOST TARGET binding site such as BINDING SITE I, BINDING SITE II or BINDING SITE III. Table 2 illustrates the complementarity of the nucleotide sequences of ITGA10 BINDING SITE, designated SEQ ID:29864, to the nucleotide sequence of VGAM1995 RNA, herein designated VGAM RNA, also designated SEQ ID:4706.

Another function of VGAM1995 is therefore inhibition of Integrin, Alpha 10 (ITGA10, Accession XM_002097). Accordingly, utilities of VGAM1995 include diagnosis, prevention and treatment of diseases and clinical conditions associated with ITGA10. KIAA0318 (Accession XM_044334) is another VGAM1995 host target gene. KIAA0318 BINDING SITE is HOST TARGET binding site found in the 3' untranslated region of mRNA encoded by KIAA0318, corresponding to a HOST TARGET binding site such as BINDING SITE I, BINDING SITE II or BINDING SITE III. Table 2 illustrates the complementarity of the nucleotide sequences of KIAA0318 BINDING SITE, designated SEQ ID:34189, to the nucleotide sequence of VGAM1995 RNA, herein designated VGAM RNA, also designated SEQ ID:4706.

Another function of VGAM1995 is therefore inhibition of KIAA0318 (Accession XM_044334). Accordingly, utilities of VGAM1995 include diagnosis, prevention and treatment of diseases and clinical conditions associated with KIAA0318. KIAA0416 (Accession NM_015564) is another VGAM1995 host target gene. KIAA0416 BINDING SITE is HOST TARGET binding site found in the 3' untranslated region of mRNA encoded by KIAA0416, corresponding to a HOST TARGET binding site such as BINDING SITE I, BINDING SITE II or BINDING SITE III. Table 2 illustrates the complementarity of the nucleotide sequences of KIAA0416 BINDING SITE, designated SEQ ID:17830, to the nucleotide sequence of VGAM1995 RNA, herein designated VGAM RNA, also designated SEQ ID:4706.

Another function of VGAM1995 is therefore inhibition of KIAA0416 (Accession NM_015564). Accordingly, utilities of VGAM1995 include diagnosis, prevention and treatment of diseases and clinical conditions associated with KIAA0416. KIAA0426 (Accession NM_014724) is another VGAM1995 host target gene. KIAA0426 BINDING SITE is HOST TARGET binding site found in the 3' untranslated region of mRNA encoded by KIAA0426, corresponding to a HOST TARGET binding site such as BINDING SITE I, BINDING SITE II or BINDING SITE III. Table 2 illustrates the complementarity of the nucleotide sequences of KIAA0426 BINDING SITE, designated SEQ ID:16314, to the nucleotide sequence of VGAM1995 RNA, herein designated VGAM RNA, also designated SEQ ID:4706.

Another function of VGAM1995 is therefore inhibition of KIAA0426 (Accession NM_014724). Accordingly, utilities of VGAM1995 include diagnosis, prevention and treatment of diseases and clinical conditions associated with KIAA0426. KIAA0459 (Accession XM_027862) is another VGAM1995 host target gene. KIAA0459 BINDING SITE is HOST TARGET binding site found in the 3' untranslated region of mRNA encoded by KIAA0459, corresponding to a HOST TARGET binding site such as BINDING SITE I, BINDING SITE II or BINDING SITE III. Table 2 illustrates the complementarity of the nucleotide sequences of KIAA0459 BINDING SITE, designated SEQ ID:30581, to the nucleotide sequence of VGAM1995 RNA, herein designated VGAM RNA, also designated SEQ ID:4706.

Another function of VGAM1995 is therefore inhibition of KIAA0459 (Accession XM_027862). Accordingly, utilities of VGAM1995 include diagnosis, prevention and treatment of diseases and clinical conditions associated with KIAA0459. KIAA0711 (Accession NM_014867) is another VGAM1995 host target gene. KIAA0711 BINDING SITE is HOST TARGET binding site found in the 5' untranslated region of mRNA encoded by KIAA0711, corresponding to a HOST TARGET binding site such as BINDING SITE I, BINDING SITE II or BINDING SITE III. Table 2 illustrates the complementarity of the nucleotide sequences of KIAA0711 BINDING SITE, designated SEQ ID:16960, to the nucleotide sequence of VGAM1995 RNA, herein designated VGAM RNA, also designated SEQ ID:4706.

Another function of VGAM1995 is therefore inhibition of KIAA0711 (Accession NM_014867). Accordingly, utilities of VGAM1995 include diagnosis, prevention and treatment of diseases and clinical conditions associated with KIAA0711. KIAA1199 (Accession XM_051860) is another VGAM1995 host target gene. KIAA1199 BINDING SITE is HOST TARGET binding site found in the 3' untranslated region of mRNA encoded by KIAA1199, corresponding to a HOST TARGET binding site such as BINDING SITE I, BINDING SITE II or BINDING SITE III. Table 2 illustrates the complementarity of the nucleotide sequences of KIAA1199 BINDING SITE, designated SEQ ID:35901, to the nucleotide sequence of VGAM1995 RNA, herein designated VGAM RNA, also designated SEQ ID:4706.

Another function of VGAM1995 is therefore inhibition of KIAA1199 (Accession XM_051860). Accordingly, utilities of VGAM1995 include diagnosis, prevention and treatment of diseases and clinical conditions associated with KIAA1199. KIAA1950 (Accession XM_166532) is another VGAM1995 host target gene. KIAA1950 BINDING SITE is HOST TARGET binding site found in the 3' untranslated region of mRNA encoded by KIAA1950, corresponding to a HOST TARGET binding site such as BINDING SITE I, BINDING SITE II or BINDING SITE III. Table 2 illustrates the complementarity of the nucleotide sequences of KIAA1950 BINDING SITE, designated SEQ ID:44489, to the nucleotide sequence of VGAM1995 RNA, herein designated VGAM RNA, also designated SEQ ID:4706.

Another function of VGAM1995 is therefore inhibition of KIAA1950 (Accession XM_166532). Accordingly, utilities of VGAM1995 include diagnosis, prevention and treatment of diseases and clinical conditions associated with KIAA1950. LSR7 (Accession NM_018559) is another VGAM1995 host target gene. LSR7 BINDING SITE is HOST TARGET binding site found in the 5' untranslated region of mRNA encoded by LSR7, corresponding to a HOST TARGET binding site such as BINDING SITE I, BINDING SITE II or BINDING SITE III. Table 2 illustrates the complementarity of the nucleotide sequences of LSR7 BINDING SITE, designated SEQ ID:20642, to the nucleotide sequence of VGAM1995 RNA, herein designated VGAM RNA, also designated SEQ ID:4706.

Another function of VGAM1995 is therefore inhibition of LSR7 (Accession NM_018559). Accordingly, utilities of VGAM1995 include diagnosis, prevention and treatment of diseases and clinical conditions associated with LSR7. Mitogen-activated Protein Kinase 8 Interacting Protein 3 (MAPK8IP3, Accession NM_033392) is another VGAM1995 host target gene. MAPK8IP3 BINDING SITE is HOST TARGET binding site found in the 3' untranslated region of mRNA encoded by MAPK8IP3, corresponding to a HOST TARGET binding site such as BINDING SITE I, BINDING SITE II or BINDING SITE III. Table 2 illustrates the complementarity of the nucleotide sequences of MAPK8IP3 BINDING SITE, designated SEQ ID:27221, to the nucleotide sequence of VGAM1995 RNA, herein designated VGAM RNA, also designated SEQ ID:4706.

Another function of VGAM1995 is therefore inhibition of Mitogen-activated Protein Kinase 8 Interacting Protein 3 (MAPK8IP3, Accession NM_033392). Accordingly, utilities of VGAM1995 include diagnosis, prevention and treatment of diseases and clinical conditions associated with MAPK8IP3. Phosphodiesterase 8A (PDE8A, Accession XM_031443) is another VGAM1995 host target gene. PDE8A BINDING SITE is HOST TARGET binding site found in the 3' untranslated region of mRNA encoded by PDE8A, corresponding to a HOST TARGET binding site such as BINDING SITE I, BINDING SITE II or BINDING SITE III. Table 2 illustrates the complementarity of the nucleotide sequences of PDE8A BINDING SITE, designated SEQ ID:31380, to the nucleotide sequence of VGAM1995 RNA, herein designated VGAM RNA, also designated SEQ ID:4706.

Another function of VGAM1995 is therefore inhibition of Phosphodiesterase 8A (PDE8A, Accession XM_031443). Accordingly, utilities of VGAM1995 include diagnosis, prevention and treatment of diseases and clinical conditions associated with PDE8A. PDZ Domain Containing 2 (PDZD2, Accession XM_087705) is another VGAM1995 host target gene. PDZD2 BINDING SITE is HOST TARGET binding site found in the 5' untranslated region of mRNA encoded by PDZD2, corresponding to a HOST TARGET binding site such as BINDING SITE I, BINDING SITE II or BINDING SITE III. Table 2 illustrates the complementarity of the nucleotide sequences of PDZD2 BINDING SITE, designated SEQ ID:39393, to the nucleotide sequence of VGAM1995 RNA, herein designated VGAM RNA, also designated SEQ ID:4706.

Another function of VGAM1995 is therefore inhibition of PDZ Domain Containing 2 (PDZD2, Accession XM_087705). Accordingly, utilities of VGAM1995 include diagnosis, prevention and treatment of diseases and clinical conditions associated with PDZD2. Paternally Expressed 10 (PEG10, Accession NM_015068) is another VGAM1995 host target gene. PEG10 BINDING SITE is HOST TARGET binding site found in the 3' untranslated region of mRNA encoded by PEG10, corresponding to a HOST TARGET binding site such as BINDING SITE I, BINDING SITE II or BINDING SITE III. Table 2 illustrates the complementarity of the nucleotide sequences of PEG10 BINDING SITE, designated SEQ ID:17433, to the nucleotide sequence of VGAM1995 RNA, herein designated VGAM RNA, also designated SEQ ID:4706.

Another function of VGAM1995 is therefore inhibition of Paternally Expressed 10 (PEG10, Accession NM_015068). Accordingly, utilities of VGAM1995 include diagnosis, prevention and treatment of diseases and clinical conditions associated with PEG10. PRO0233 (Accession NM_014121) is another VGAM1995 host target gene. PRO0233 BINDING SITE is HOST TARGET binding site found in the 3' untranslated region of mRNA encoded by PRO0233, corresponding to a HOST TARGET binding site such as BINDING SITE I, BINDING SITE II or BINDING SITE III. Table 2 illustrates the complementarity of the nucleotide sequences of PRO0233 BINDING SITE, designated SEQ ID:15374, to the nucleotide sequence of VGAM1995 RNA, herein designated VGAM RNA, also designated SEQ ID:4706.

Another function of VGAM1995 is therefore inhibition of PRO0233 (Accession NM_014121). Accordingly, utilities of VGAM1995 include diagnosis, prevention and treatment of diseases and clinical conditions associated with PRO0233. SEC24 Related Gene Family, Member C (S. cerevisiae) (SEC24C, Accession NM_004922) is another VGAM1995 host target gene. SEC24C BINDING SITE is HOST TARGET binding site found in the 3' untranslated region of mRNA encoded by SEC24C, corresponding to a HOST TARGET binding site such as BINDING SITE I, BINDING SITE II or BINDING SITE III. Table 2 illustrates the complementarity of the nucleotide sequences of SEC24C BINDING SITE, designated SEQ ID:11357, to the nucleotide sequence of VGAM1995 RNA, herein designated VGAM RNA, also designated SEQ ID:4706.

Another function of VGAM1995 is therefore inhibition of SEC24 Related Gene Family, Member C (S. cerevisiae) (SEC24C, Accession NM_004922). Accordingly, utilities of VGAM1995 include diagnosis, prevention and treatment of diseases and clinical conditions associated with SEC24C. SMC1 Structural Maintenance of Chromosomes 1-like 1 (yeast) (SMC1L1, Accession XM_050403) is another VGAM1995 host target gene. SMC1L1 BINDING SITE is HOST TARGET binding site found in the 3' untranslated region of mRNA encoded by SMC1L1, corresponding to a HOST TARGET binding site such as BINDING SITE I, BINDING SITE II or BINDING SITE III. Table 2 illustrates the complementarity of the nucleotide sequences of SMC1L1 BINDING SITE, designated SEQ ID:35620, to the nucleotide sequence of VGAM1995 RNA, herein designated VGAM RNA, also designated SEQ ID:4706.

Another function of VGAM1995 is therefore inhibition of SMC1 Structural Maintenance of Chromosomes 1-like 1 (yeast) (SMC1L1, Accession XM_050403). Accordingly, utilities of VGAM1995 include diagnosis, prevention and treatment of diseases and clinical conditions associated with SMC1L1. Ubiquitin Specific Protease 24 (USP24, Accession XM_165973) is another VGAM1995 host target gene. USP24 BINDING SITE is HOST TARGET binding site found in the 3' untranslated region of mRNA encoded by USP24, corresponding to a HOST TARGET binding site such as BINDING SITE I, BINDING SITE II or BINDING SITE III. Table 2 illustrates the complementarity of the nucleotide sequences of USP24 BINDING SITE, designated SEQ ID:43813, to the nucleotide sequence of VGAM1995 RNA, herein designated VGAM RNA, also designated SEQ ID:4706.

Another function of VGAM1995 is therefore inhibition of Ubiquitin Specific Protease 24 (USP24, Accession XM_165973). Accordingly, utilities of VGAM1995 include diagnosis, prevention and treatment of diseases and clinical conditions associated with USP24. WD Repeat Domain 9 (WDR9, Accession NM_018963) is another VGAM1995 host target gene. WDR9 BINDING SITE is HOST TARGET binding site found in the 3' untranslated region of mRNA encoded by WDR9, corresponding to a HOST TARGET binding site such as BINDING SITE I, BINDING SITE II or BINDING SITE III. Table 2 illustrates the complementarity of the nucleotide sequences of WDR9 BINDING SITE, designated SEQ ID:21033, to the nucleotide sequence of VGAM1995 RNA, herein designated VGAM RNA, also designated SEQ ID:4706.

Another function of VGAM1995 is therefore inhibition of WD Repeat Domain 9 (WDR9, Accession NM_018963). Accordingly, utilities of VGAM1995 include diagnosis, prevention and treatment of diseases and clinical conditions associated with WDR9. LOC124470 (Accession XM_064152) is another VGAM1995 host target gene. LOC124470 BINDING SITE is HOST TARGET binding site found in the 3' untranslated region of mRNA encoded by LOC124470, corresponding to a HOST TARGET binding site such as BINDING SITE I, BINDING SITE II or BINDING SITE III. Table 2 illustrates the complementarity of the nucleotide sequences of LOC124470 BINDING SITE, designated SEQ ID:37256, to the nucleotide sequence of VGAM1995 RNA, herein designated VGAM RNA, also designated SEQ ID:4706.

Another function of VGAM1995 is therefore inhibition of LOC124470 (Accession XM_064152). Accordingly, utilities of VGAM1995 include diagnosis, prevention and treatment of diseases and clinical conditions associated with LOC124470. LOC146489 (Accession XM_047734) is another VGAM1995 host target gene. LOC146489 BINDING SITE is HOST TARGET binding site found in the 5' untranslated region of mRNA encoded by LOC146489, corresponding to a HOST TARGET binding site such as BINDING SITE I, BINDING SITE II or BINDING SITE III. Table 2 illustrates the complementarity of the nucleotide sequences of LOC146489 BINDING SITE, designated SEQ ID:35038, to the nucleotide sequence of VGAM1995 RNA, herein designated VGAM RNA, also designated SEQ ID:4706.

Another function of VGAM1995 is therefore inhibition of LOC146489 (Accession XM_047734). Accordingly, utilities of VGAM1995 include diagnosis, prevention and treatment of diseases and clinical conditions associated with LOC146489. LOC147650 (Accession XM_085824) is another VGAM1995 host target gene. LOC147650 BINDING SITE is HOST TARGET binding site found in the 5' untranslated region of mRNA encoded by LOC147650, corresponding to a HOST TARGET binding site such as BINDING SITE I, BINDING SITE II or BINDING SITE III. Table 2 illustrates the complementarity of the nucleotide sequences of LOC147650 BINDING SITE, designated SEQ ID:38348, to the nucleotide sequence of VGAM1995 RNA, herein designated VGAM RNA, also designated SEQ ID:4706.

Another function of VGAM1995 is therefore inhibition of LOC147650 (Accession XM_085824). Accordingly, utilities of VGAM1995 include diagnosis, prevention and treatment of diseases and clinical conditions associated with LOC147650. LOC162333 (Accession XM_102591) is another VGAM1995 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42123, to the nucleotide sequence of VGAM1995 RNA, herein designated VGAM RNA, also designated SEQ ID:4706.

Another function of VGAM1995 is therefore inhibition of LOC162333 (Accession XM_102591). Accordingly, utilities of VGAM1995 include diagnosis, prevention and treatment of diseases and clinical conditions associated with LOC162333. LOC167040 (Accession XM_106497) is another VGAM1995 host target gene. LOC167040 BINDING SITE is HOST TARGET binding site found in the 5' untranslated region of mRNA encoded by LOC167040, corresponding to a HOST TARGET binding site such as BINDING SITE I, BINDING SITE II or BINDING SITE III. Table 2 illustrates the complementarity of the nucleotide sequences of LOC167040 BINDING SITE, designated SEQ ID:42201, to the nucleotide sequence of VGAM1995 RNA, herein designated VGAM RNA, also designated SEQ ID:4706.

Another function of VGAM1995 is therefore inhibition of LOC167040 (Accession XM_106497). Accordingly, utilities of VGAM1995 include diagnosis, prevention and treatment of diseases and clinical conditions associated with LOC167040. LOC201283 (Accession XM_017132) is another VGAM1995 host target gene. LOC201283 BINDING SITE is HOST TARGET binding site found in the 3' untranslated region of mRNA encoded by LOC201283, corresponding to a HOST TARGET binding site such as BINDING SITE I, BINDING SITE II or BINDING SITE III. Table 2 illustrates the complementarity of the nucleotide sequences of LOC201283 BINDING SITE, designated SEQ ID:30302, to the nucleotide sequence of VGAM1995 RNA, herein designated VGAM RNA, also designated SEQ ID:4706.

Another function of VGAM1995 is therefore inhibition of LOC201283 (Accession XM_017132). Accordingly, utilities of VGAM1995 include diagnosis, prevention and treatment of diseases and clinical conditions associated with LOC201283. LOC202460 (Accession XM_114493) is another VGAM1995 host target gene. LOC202460 BINDING SITE is HOST TARGET binding site found in the 5' untranslated region of mRNA encoded by LOC202460, corresponding to a HOST TARGET binding site such as BINDING SITE I, BINDING SITE II or BINDING SITE III. Table 2 illustrates the complementarity of the nucleotide sequences of LOC202460 BINDING SITE, designated SEQ ID:42983, to the nucleotide sequence of VGAM1995 RNA, herein designated VGAM RNA, also designated SEQ ID:4706.

Another function of VGAM1995 is therefore inhibition of LOC202460 (Accession XM_114493). Accordingly, utilities of VGAM1995 include diagnosis, prevention and treatment of diseases and clinical conditions associated with LOC202460. LOC206327 (Accession XM_121168) is another VGAM1995 host target gene. LOC206327 BINDING SITE is HOST TARGET binding site found in the 5' untranslated region of mRNA encoded by LOC206327, corresponding to a HOST TARGET binding site such as BINDING SITE I, BINDING SITE II or BINDING SITE III. Table 2 illustrates the complementarity of the nucleotide sequences of LOC206327 BINDING SITE, designated SEQ ID:43613, to the nucleotide sequence of VGAM1995 RNA, herein designated VGAM RNA, also designated SEQ ID:4706.

Another function of VGAM1995 is therefore inhibition of LOC206327 (Accession XM_121168). Accordingly, utilities of VGAM1995 include diagnosis, prevention and treatment of diseases and clinical conditions associated with LOC206327. LOC221474 (Accession XM_166464) is another VGAM1995 host target gene. LOC221474 BINDING SITE is HOST TARGET binding site found in the 5' untranslated region of mRNA encoded by LOC221474, corresponding to a HOST TARGET binding site such as BINDING SITE I, BINDING SITE II or BINDING SITE III. Table 2 illustrates the complementarity of the nucleotide sequences of LOC221474 BINDING SITE, designated SEQ ID:44383, to the nucleotide sequence of VGAM1995 RNA, herein designated VGAM RNA, also designated SEQ ID:4706.

Another function of VGAM1995 is therefore inhibition of LOC221474 (Accession XM_166464). Accordingly, utilities of VGAM1995 include diagnosis, prevention and treatment of diseases and clinical conditions associated with LOC221474. LOC51170 (Accession NM_016245) is another VGAM1995 host target gene. LOC51170 BINDING SITE is HOST TARGET binding site found in the 3' untranslated region of mRNA encoded by LOC51170, corresponding to a HOST TARGET binding site such as BINDING SITE I, BINDING SITE II or BINDING SITE III. Table 2 illustrates the complementarity of the nucleotide sequences of LOC51170 BINDING SITE, designated SEQ ID:18363, to the nucleotide sequence of VGAM1995 RNA, herein designated VGAM RNA, also designated SEQ ID:4706.

Another function of VGAM1995 is therefore inhibition of LOC51170 (Accession NM_016245). Accordingly, utilities of VGAM1995 include diagnosis, prevention and treatment of diseases and clinical conditions associated with LOC51170. LOC90333 (Accession XM_030958) is another VGAM1995 host target gene. LOC90333 BINDING SITE is HOST TARGET binding site found in the 3' untranslated region of mRNA encoded by LOC90333, corresponding to a HOST TARGET binding site such as BINDING SITE I, BINDING SITE II or BINDING SITE III. Table 2 illustrates the complementarity of the nucleotide sequences of LOC90333 BINDING SITE, designated SEQ ID:31227, to the nucleotide sequence of VGAM1995 RNA, herein designated VGAM RNA, also designated SEQ ID:4706.

Another function of VGAM1995 is therefore inhibition of LOC90333 (Accession XM_030958). Accordingly, utilities of VGAM1995 include diagnosis, prevention and treatment of diseases and clinical conditions associated with LOC90333. LOC92568 (Accession XM_045852) is another VGAM1995 host target gene. LOC92568 BINDING SITE is HOST TARGET binding site found in the 5' untranslated region of mRNA encoded by LOC92568, corresponding to a HOST TARGET binding site such as BINDING SITE I, BINDING SITE II or BINDING SITE III. Table 2 illustrates the complementarity of the nucleotide sequences of LOC92568 BINDING SITE, designated SEQ ID:34574, to the nucleotide sequence of VGAM1995 RNA, herein designated VGAM RNA, also designated SEQ ID:4706.

Another function of VGAM1995 is therefore inhibition of LOC92568 (Accession XM_045852). Accordingly, utilities of VGAM1995 include diagnosis, prevention and treatment of diseases and clinical conditions associated with LOC92568. FIG. 1 further provides a conceptual description of a novel bioinformatically detected viral gene of the present invention, referred to here as Viral Genomic Address Messenger 1996 (VGAM1996) viral gene, which modulates expression of respective host target genes thereof, the function and utility of which host target genes is known in the art.

VGAM1996 is a novel bioinformatically detected regulatory, non protein coding, viral micro RNA (miRNA) gene. The method by which VGAM1996 was detected is described hereinabove with reference to FIGS. 1-8.

VGAM1996 gene, herein designated VGAM GENE, is a viral gene contained in the genome of Nipah Virus. VGAM1996 host target gene, herein designated VGAM HOST TARGET GENE, is a human gene contained in the human genome.

VGAM1996 gene encodes a VGAM1996 precursor RNA, herein designated VGAM PRECURSOR RNA. Similar to other miRNA genes, and unlike most ordinary genes, VGAM1996 precursor RNA does not encode a protein. A nucleotide sequence identical or highly similar to the nucleotide sequence of VGAM1996 precursor RNA is designated SEQ ID:1982, and is provided hereinbelow with reference to the sequence listing part. Nucleotide sequence SEQ ID:1982 is located at position 8558 relative to the genome of Nipah Virus.

VGAM1996 precursor RNA folds onto itself, forming VGAM1996 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1996 folded precursor RNA into VGAM1996 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM1996 RNA is designated SEQ ID:4707, and is provided hereinbelow with reference to the sequence listing part.

VGAM1996 host target gene, herein designated VGAM HOST TARGET GENE, encodes a corresponding messenger RNA, VGAM1996 host target RNA, herein designated VGAM HOST TARGET RNA. VGAM1996 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1996 RNA, herein designated VGAM RNA, binds complementarily to one or more host target binding sites located in untranslated regions of VGAM1996 host target RNA, herein designated VGAM HOST TARGET RNA. This complementary binding is due to the fact that the nucleotide sequence of VGAM1996 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1996 RNA, herein designated VGAM RNA, may have a different number of host target binding sites in untranslated regions of a VGAM1996 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1996 RNA, herein designated VGAM RNA, to host target binding sites on VGAM1996 host target RNA, herein designated VGAM HOST TARGET RNA, such as BINDING SITE I, BINDING SITE II and BINDING SITE III, inhibits translation of VGAM1996 host target RNA into VGAM1996 host target protein, herein designated VGAM HOST TARGET PROTEIN. VGAM host target protein is therefore outlined by a broken line.

It is appreciated that VGAM1996 host target gene, herein designated VGAM HOST TARGET GENE, in fact represents a plurality of VGAM1996 host target genes. The mRNA of each one of this plurality of VGAM1996 host target genes comprises one or more host target binding sites, each having a nucleotide sequence which is at least partly complementary to VGAM1996 RNA, herein designated VGAM RNA, and which when bound by VGAM1996 RNA causes inhibition of translation of respective one or more VGAM1996 host target proteins.

It is further appreciated by one skilled in the art that the mode of translational inhibition illustrated by FIG. 1 with specific reference to translational inhibition exerted by VGAM1996 gene, herein designated VGAM GENE, on one or more VGAM1996 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1996 is inhibition of expression of host target genes, as part of a novel viral mechanism of attacking a host. Accordingly, utilities of VGAM1996 include diagnosis, prevention and treatment of viral infection by Nipah Virus. Specific functions, and accordingly utilities, of VGAM1996 correlate with, and may be deduced from, the identity of the host target genes which VGAM1996 binds and inhibits, and the function of these host target genes, as elaborated hereinbelow.

Nucleotide sequences of the VGAM1996 precursor RNA, herein designated VGAM PRECURSOR RNA, and of the 'diced' VGAM1996 RNA, herein designated VGAM RNA, and a schematic representation of the secondary folding of VGAM1996 folded precursor RNA, herein designated VGAM FOLDED PRECURSOR RNA, of VGAM1996 are further described hereinbelow with reference to Table 1.

Nucleotide sequences of host target binding sites, such as BINDING SITE-I, BINDING SITE-II and BINDING SITE-III of FIG. 1, found on VGAM1996 host target RNA, and schematic representation of the complementarity of each of these host target binding sites to VGAM1996 RNA, herein designated VGAM RNA, are described hereinbelow with reference to Table 2.

As mentioned hereinabove with reference to FIG. 1, a function of VGAM1996 gene, herein designated VGAM is inhibition of expression of VGAM1996 target genes. It is appreciated that specific functions, and accordingly utilities, of VGAM1996 correlate with, and may be deduced from, the identity of the target genes which VGAM1996 binds and inhibits, and the function of these target genes, as elaborated hereinbelow.

AXL Receptor Tyrosine Kinase (AXL, Accession NM_001699) is a VGAM1996 host target gene. AXL BINDING SITE1 and AXL BINDING SITE2 are HOST TARGET binding sites found in untranslated regions of mRNA encoded by AXL, corresponding to HOST TARGET binding sites such as BINDING SITE I, BINDING SITE II or BINDING SITE III. Table 2 illustrates the complementarity of the nucleotide sequences of AXL BINDING SITE1 and AXL BINDING SITE2, designated SEQ ID:7417 and SEQ ID:22438 respectively, to the nucleotide sequence of VGAM1996 RNA, herein designated VGAM RNA, also designated SEQ ID:4707.

A function of VGAM1996 is therefore inhibition of AXL Receptor Tyrosine Kinase (AXL, Accession NM_001699). Accordingly, utilities of VGAM1996 include diagnosis, prevention and treatment of diseases and clinical conditions associated with AXL. Kynurenine 3-monooxygenase (kynurenine 3-hydroxylase) (KMO, Accession NM_003679) is another VGAM1996 host target gene. KMO BINDING SITE is HOST TARGET binding site found in the 3" untranslated region of mRNA encoded by KMO, corresponding to a HOST TARGET binding site such as BINDING SITE I, BINDING SITE II or BINDING SITE III. Table 2 illustrates the complementarity of the nucleotide sequences of KMO BINDING SITE, designated SEQ ID:9778, to the nucleotide sequence of VGAM1996 RNA, herein designated VGAM RNA, also designated SEQ ID:4707.

Another function of VGAM1996 is therefore inhibition of Kynurenine 3-monooxygenase (kynurenine 3-hydroxylase) (KMO, Accession NM_003679), a gene which may play a role in encephalic photoreception. Accordingly, utilities of VGAM1996 include diagnosis, prevention and treatment of diseases and clinical conditions associated with KMO. The function of KMO and its association with various diseases and clinical conditions, has been established by previous studies, as described hereinabove with reference to VGAM162. G-rich RNA Sequence Binding Factor 1 (GRSF1, Accession NM_002092) is another VGAM1996 host target gene. GRSF1 BINDING SITE is HOST TARGET binding site found in the 3' untranslated region of mRNA encoded by GRSF1, corresponding to a HOST TARGET binding site such as BINDING SITE I, BINDING SITE II or BINDING SITE III. Table 2 illustrates the complementarity of the nucleotide sequences of GRSF1 BINDING SITE, designated SEQ ID:7880, to the nucleotide sequence of VGAM1996 RNA, herein designated VGAM RNA, also designated SEQ ID:4707.

Another function of VGAM1996 is therefore inhibition of G-rich RNA Sequence Binding Factor 1 (GRSF1, Accession NM_002092). Accordingly, utilities of VGAM1996 include diagnosis, prevention and treatment of diseases and clinical conditions associated with GRSF1. KIAA1467 (Accession XM_049605) is another VGAM1996 host target gene. KIAA1467 BINDING SITE is HOST TARGET binding site found in the 3' untranslated region of mRNA encoded by KIAA1467, corresponding to a HOST TARGET binding site such as BINDING SITE I, BINDING SITE II or BINDING SITE III. Table 2 illustrates the complementarity of the nucleotide sequences of KIAA1467 BINDING SITE, designated SEQ ID:35450, to the nucleotide sequence of VGAM1996 RNA, herein designated VGAM RNA, also designated SEQ ID:4707.

Another function of VGAM1996 is therefore inhibition of KIAA1467 (Accession XM_049605). Accordingly, utilities of VGAM1996 include diagnosis, prevention and treatment of diseases and clinical conditions associated with KIAA1467. RYK Receptor-like Tyrosine Kinase (RYK, Accession XM_093692) is another VGAM1996 host target gene. RYK BINDING SITE is HOST TARGET binding site found in the 3' untranslated region of mRNA encoded by RYK, corresponding to a HOST TARGET binding site such as BINDING SITE I, BINDING SITE II or BINDING SITE III. Table 2 illustrates the complementarity of the nucleotide sequences of RYK BINDING SITE, designated SEQ ID:40202, to the nucleotide sequence of VGAM1996 RNA, herein designated VGAM RNA, also designated SEQ ID:4707.

Another function of VGAM1996 is therefore inhibition of RYK Receptor-like Tyrosine Kinase (RYK, Accession XM_093692). Accordingly, utilities of VGAM1996 include diagnosis, prevention and treatment of diseases and clinical conditions associated with RYK. Solute Carrier Family 19, Member 3 (SLC19A3, Accession NM_025243) is another VGAM1996 host target gene. SLC19A3 BINDING SITE is HOST TARGET binding site found in the 3' untranslated region of mRNA encoded by SLC19A3, corresponding to a HOST TARGET binding site such as BINDING SITE I, BINDING SITE II or BINDING SITE III. Table 2 illustrates the complementarity of the nucleotide sequences of SLC19A3 BINDING SITE, designated SEQ ID:24925, to the nucleotide sequence of VGAM1996 RNA, herein designated VGAM RNA, also designated SEQ ID:4707.

Another function of VGAM1996 is therefore inhibition of Solute Carrier Family 19, Member 3 (SLC19A3, Accession NM_025243). Accordingly, utilities of VGAM1996 include diagnosis, prevention and treatment of diseases and clinical conditions associated with SLC19A3. LOC256277 (Accession XM_170644) is another VGAM1996 host target gene. LOC256277 BINDING SITE is HOST TARGET binding site found in the 5' untranslated region of mRNA encoded by LOC256277, corresponding to a HOST TARGET binding site such as BINDING SITE I, BINDING SITE II or BINDING SITE III. Table 2 illustrates the complementarity of the nucleotide sequences of LOC256277 BINDING SITE, designated SEQ ID:45423, to the nucleotide sequence of VGAM1996 RNA, herein designated VGAM RNA, also designated SEQ ID:4707.

Another function of VGAM1996 is therefore inhibition of LOC256277 (Accession XM_170644). Accordingly, utilities of VGAM1996 include diagnosis, prevention and treatment of diseases and clinical conditions associated with LOC256277. FIG. 1 further provides a conceptual description of a novel bioinformatically detected viral gene of the present invention, referred to here as Viral Genomic Address Messenger 1997 (VGAM1997) viral gene, which modulates expression of respective host target genes thereof, the function and utility of which host target genes is known in the art.

VGAM1997 is a novel bioinformatically detected regulatory, non protein coding, viral micro RNA (miRNA) gene. The method by which VGAM1997 was detected is described hereinabove with reference to FIGS. 1-8.

VGAM1997 gene, herein designated VGAM GENE, is a viral gene contained in the genome of Nipah Virus. VGAM1997 host target gene, herein designated VGAM HOST TARGET GENE, is a human gene contained in the human genome.

VGAM1997 gene encodes a VGAM1997 precursor RNA, herein designated VGAM PRECURSOR RNA. Similar to other miRNA genes, and unlike most ordinary genes, VGAM1997 precursor RNA does not encode a protein. A nucleotide sequence identical or highly similar to the nucleotide sequence of VGAM1997 precursor RNA is designated SEQ ID:1983, and is provided hereinbelow with reference to the sequence listing part. Nucleotide sequence SEQ ID:1983 is located at position 1708 relative to the genome of Nipah Virus.

VGAM1997 precursor RNA folds onto itself, forming VGAM1997 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1997 folded precursor RNA into VGAM1997 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM1997 RNA is designated SEQ ID:4708, and is provided hereinbelow with reference to the sequence listing part.

VGAM1997 host target gene, herein designated VGAM HOST TARGET GENE, encodes a corresponding messenger RNA, VGAM1997 host target RNA, herein designated VGAM HOST TARGET RNA. VGAM1997 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1997 RNA, herein designated VGAM RNA, binds complementarily to one or more host target binding sites located in untranslated regions of VGAM1997 host target RNA, herein designated VGAM HOST TARGET RNA. This complementary binding is due to the fact that the nucleotide sequence of VGAM1997 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1997 RNA, herein designated VGAM RNA, may have a different number of host target binding sites in untranslated regions of a VGAM1997 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1997 RNA, herein designated VGAM RNA, to host target binding sites on VGAM1997 host target RNA, herein designated VGAM HOST TARGET RNA, such as BINDING SITE I, BINDING SITE II and BINDING SITE III, inhibits translation of VGAM1997 host target RNA into VGAM1997 host target protein, herein designated VGAM HOST TARGET PROTEIN. VGAM host target protein is therefore outlined by a broken line.

It is appreciated that VGAM1997 host target gene, herein designated VGAM HOST TARGET GENE, in fact represents a plurality of VGAM1997 host target genes. The mRNA of each one of this plurality of VGAM1997 host target genes comprises one or more host target binding sites, each having a nucleotide sequence which is at least partly complementary to VGAM1997 RNA, herein designated VGAM RNA, and which when bound by VGAM1997 RNA causes inhibition of translation of respective one or more VGAM1997 host target proteins.

It is further appreciated by one skilled in the art that the mode of translational inhibition illustrated by FIG. 1 with specific reference to translational inhibition exerted by VGAM1997 gene, herein designated VGAM GENE, on one or more VGAM1997 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1997 is inhibition of expression of host target genes, as part of a novel viral mechanism of attacking a host. Accordingly, utilities of VGAM1997 include diagnosis, prevention and treatment of viral infection by Nipah Virus. Specific functions, and accordingly utilities, of VGAM1997 correlate with, and may be deduced from, the identity of the host target genes which VGAM1997 binds and inhibits, and the function of these host target genes, as elaborated hereinbelow.

Nucleotide sequences of the VGAM1997 precursor RNA, herein designated VGAM PRECURSOR RNA, and of the 'diced' VGAM1997 RNA, herein designated VGAM RNA, and a schematic representation of the secondary folding of VGAM1997 folded precursor RNA, herein designated VGAM FOLDED PRECURSOR RNA, of VGAM1997 are further described hereinbelow with reference to Table 1.

Nucleotide sequences of host target binding sites, such as BINDING SITE-I, BINDING SITE-II and BINDING SITE-III of FIG. 1, found on VGAM1997 host target RNA, and schematic representation of the complementarity of each of these host target binding sites to VGAM1997 RNA, herein designated VGAM RNA, are described hereinbelow with reference to Table 2.

As mentioned hereinabove with reference to FIG. 1, a function of VGAM1997 gene, herein designated VGAM is inhibition of expression of VGAM1997 target genes. It is appreciated that specific functions, and accordingly utilities, of VGAM1997 correlate with, and may be deduced from, the identity of the target genes which VGAM1997 binds and inhibits, and the function of these target genes, as elaborated hereinbelow.

FLJ14547 (Accession NM_032804) is a VGAM1997 host target gene. FLJ14547 BINDING SITE is HOST TARGET binding site found in the 3' untranslated region of mRNA encoded by FLJ14547, corresponding to a HOST TARGET binding site such as BINDING SITE I, BINDING SITE II or BINDING SITE III. Table 2 illustrates the complementarity of the nucleotide sequences of FLJ14547 BINDING SITE, designated SEQ ID:26562, to the nucleotide sequence of VGAM1997 RNA, herein designated VGAM RNA, also designated SEQ ID:4708.

A function of VGAM1997 is therefore inhibition of FLJ14547 (Accession NM_032804). Accordingly, utilities of VGAM1997 include diagnosis, prevention and treatment of diseases and clinical conditions associated with FLJ14547. SMBP (Accession XM_050993) is another VGAM1997 host target gene. SMBP BINDING SITE is HOST TARGET binding site found in the 3' untranslated region of mRNA encoded by SMBP, corresponding to a HOST TARGET binding site such as BINDING SITE I, BINDING SITE II or BINDING SITE III. Table 2 illustrates the complementarity of the nucleotide sequences of SMBP BINDING SITE, designated SEQ ID:35705, to the nucleotide sequence of VGAM1997 RNA, herein designated VGAM RNA, also designated SEQ ID:4708.

Another function of VGAM1997 is therefore inhibition of SMBP (Accession XM_050993). Accordingly, utilities of VGAM1997 include diagnosis, prevention and treatment of diseases and clinical conditions associated with SMBP. FIG. 1 further provides a conceptual description of a novel bioinformatically detected viral gene of the present invention, referred to here as Viral Genomic Address Messenger 1998 (VGAM1998) viral gene, which modulates expression of respective host target genes thereof, the function and utility of which host target genes is known in the art.

VGAM1998 is a novel bioinformatically detected regulatory, non protein coding, viral micro RNA (miRNA) gene. The method by which VGAM1998 was detected is described hereinabove with reference to FIGS. 1-8.

VGAM1998 gene, herein designated VGAM GENE, is a viral gene contained in the genome of Nipah Virus. VGAM1998 host target gene, herein designated VGAM HOST TARGET GENE, is a human gene contained in the human genome.

VGAM1998 gene encodes a VGAM1998 precursor RNA, herein designated VGAM PRECURSOR RNA. Similar to other miRNA genes, and unlike most ordinary genes, VGAM1998 precursor RNA does not encode a protein. A nucleotide sequence identical or highly similar to the nucleotide sequence of VGAM1998 precursor RNA is designated SEQ ID:1984, and is provided hereinbelow with reference to the sequence listing part. Nucleotide sequence SEQ ID:1984 is located at position 15895 relative to the genome of Nipah Virus.

VGAM1998 precursor RNA folds onto itself, forming VGAM1998 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1998 folded precursor RNA into VGAM1998 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM1998 RNA is designated SEQ ID:4709, and is provided hereinbelow with reference to the sequence listing part.

VGAM1998 host target gene, herein designated VGAM HOST TARGET GENE, encodes a corresponding messenger RNA, VGAM1998 host target RNA, herein designated VGAM HOST TARGET RNA. VGAM1998 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1998 RNA, herein designated VGAM RNA, binds complementarily to one or more host target binding sites located in untranslated regions of VGAM1998 host target RNA, herein designated VGAM HOST TARGET RNA. This complementary binding is due to the fact that the nucleotide sequence of VGAM1998 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1998 RNA, herein designated VGAM RNA, may have a different number of host target binding sites in untranslated regions of a VGAM1998 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1998 RNA, herein designated VGAM RNA, to host target binding sites on VGAM1998 host target RNA, herein designated VGAM HOST TARGET RNA, such as BINDING SITE I, BINDING SITE II and BINDING SITE III, inhibits translation of VGAM1998 host target RNA into VGAM1998 host target protein, herein designated VGAM HOST TARGET PROTEIN. VGAM host target protein is therefore outlined by a broken line.

It is appreciated that VGAM1998 host target gene, herein designated VGAM HOST TARGET GENE, in fact represents a plurality of VGAM1998 host target genes. The mRNA of each one of this plurality of VGAM1998 host target genes comprises one or more host target binding sites, each having a nucleotide sequence which is at least partly complementary to VGAM1998 RNA, herein designated VGAM RNA, and which when bound by VGAM1998 RNA causes inhibition of translation of respective one or more VGAM1998 host target proteins.

It is further appreciated by one skilled in the art that the mode of translational inhibition illustrated by FIG. 1 with specific reference to translational inhibition exerted by VGAM1998 gene, herein designated VGAM GENE, on one or more VGAM1998 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let- 7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1998 is inhibition of expression of host target genes, as part of a novel viral mechanism of attacking a host. Accordingly, utilities of VGAM1998 include diagnosis, prevention and treatment of viral infection by Nipah Virus. Specific functions, and accordingly utilities, of VGAM1998 correlate with, and may be deduced from, the identity of the host target genes which VGAM1998 binds and inhibits, and the function of these host target genes, as elaborated hereinbelow.

Nucleotide sequences of the VGAM1998 precursor RNA, herein designated VGAM PRECURSOR RNA, and of the 'diced' VGAM1998 RNA, herein designated VGAM RNA, and a schematic representation of the secondary folding of VGAM1998 folded precursor RNA, herein designated VGAM FOLDED PRECURSOR RNA, of VGAM1998 are further described hereinbelow with reference to Table 1.

Nucleotide sequences of host target binding sites, such as BINDING SITE-I, BINDING SITE-II and BINDING SITE-III of FIG. 1, found on VGAM1998 host target RNA, and schematic representation of the complementarity of each of these host target binding sites to VGAM1998 RNA, herein designated VGAM RNA, are described hereinbelow with reference to Table 2.

As mentioned hereinabove with reference to FIG. 1, a function of VGAM1998 gene, herein designated VGAM is inhibition of expression of VGAM1998 target genes. It is appreciated that specific functions, and accordingly utilities, of VGAM1998 correlate with, and may be deduced from, the identity of the target genes which VGAM1998 binds and inhibits, and the function of these target genes, as elaborated hereinbelow.

Angiopoietin 1 (ANGPT1, Accession NM_139290) is a VGAM1998 host target gene. ANGPT1 BINDING SITE is HOST TARGET binding site found in the 3' untranslated region of mRNA encoded by ANGPT1, corresponding to a HOST TARGET binding site such as BINDING SITE I, BINDING SITE II or BINDING SITE III. Table 2 illustrates the complementarity of the nucleotide sequences of ANGPT1 BINDING SITE, designated SEQ ID:29291, to the nucleotide sequence of VGAM1998 RNA, herein designated VGAM RNA, also designated SEQ ID:4709.

A function of VGAM1998 is therefore inhibition of Angiopoietin 1 (ANGPT1, Accession NM_139290), a gene which binds and activates tie2 receptor by inducing its tyrosine phosphorylation. Accordingly, utilities of VGAM1998 include diagnosis, prevention and treatment of diseases and clinical conditions associated with ANGPT1. The function of ANGPT1 and its association with various diseases and clinical conditions, has been established by previous studies, as described hereinabove with reference to VGAM291. B-cell Linker (BLNK, Accession NM_013314) is another VGAM1998 host target gene. BLNK BINDING SITE is HOST TARGET binding site found in the 5' untranslated region of mRNA encoded by BLNK, corresponding to a HOST TARGET binding site such as BINDING SITE I, BINDING SITE II or BINDING SITE III. Table 2 illustrates the complementarity of the nucleotide sequences of BLNK BINDING SITE, designated SEQ ID:14963, to the nucleotide sequence of VGAM1998 RNA, herein designated VGAM RNA, also designated SEQ ID:4709.

Another function of VGAM1998 is therefore inhibition of B-cell Linker (BLNK, Accession NM_013314), a gene which is a component of the BCR transducer complex, promotes B-cell development. Accordingly, utilities of VGAM1998 include diagnosis, prevention and treatment of diseases and clinical conditions associated with BLNK. The function of BLNK has been established by previous studies. In evaluating patients with absent B cells, Minegishi et al. (1999) identified a male with a homozygous splice defect in the gene encoding the cytoplasmic adaptor protein BLNK (604515.0001). Although this patient had normal numbers of pro-B cells, he had no pre-B cells or mature B cells, indicating that BLNK plays a critical role in orchestrating the pro-B cell to pre-B cell transition. The immune system and overall growth and development were otherwise normal in this patient, suggesting that BLNK function is highly specific. The patient had developed recurrent otitis at 8 months of age; after 2 episodes of pneumonia, he was evaluated for immunodeficiency at 16 months of age. At that time, he had no detectable serum IgG, IgM, or IgA, and he had less than 1% B cells in the peripheral circulation. He was started on gammaglobulin replacement, and between 2 and 20 years of age he did well except for chronic otitis and sinusitis, hepatitis C acquired from intravenous gammaglobulin, and an episode of protein-losing enteropathy in adolescence. Animal model experiments lend further support to the function of BLNK. Pappu et al. (1999) generated mice deficient in BLNK by targeted disruption. B-cell development in BLNK -/- mice was blocked at the transition from B220+CD43+ progenitor B to B220+CD43- precursor B cells. Only a small percentage of IgM M++, but not mature IgM(lo)IgD(hi), B cells were detected in the periphery. Pappu et al. (1999) concluded that BLNK is an essential component of the B-cell receptor signaling pathways and is required to promote B-cell development.

It is appreciated that the abovementioned animal model for BLNK is acknowledged by those skilled in the art as a scientifically valid animal model, as can be further appreciated from the publications sited hereinbelow.

Full details of the abovementioned studies are described in the following publications, the disclosure of which are hereby incorporated by reference:

Minegishi, Y.; Rohrer, J.; Coustan-Smith, E.; Lederman, H. M.; Pappu, R.; Campana, D.; Chan, A. C.; Conley, M. E.: An essential role for BLNK in human B cell development. Science 286:1954-1957, 1999; and Pappu, R.; Cheng, A. M.; Li, B.; Gong, Q.; Chiu, C.; Griffin, N.; White, M.; Sleckman, B. P.; Chan, A. C.: Requirement for B cell linker protein (BLNK) in B cell development. Science.

Further studies establishing the function and utilities of BLNK are found in John Hopkins OMIM database record ID 604515, and in sited publications numbered 5446-544 and 4787-4788 listed in the bibliography section hereinbelow, which are also hereby incorporated by reference. Coagulation Factor VIII, Procoagulant Component (hemophilia A) (F8, Accession NM_000132) is another VGAM1998 host target gene. F8 BINDING SITE is HOST TARGET binding site found in the 3' untranslated region of mRNA encoded by F8, corresponding to a HOST TARGET binding site such as BINDING SITE I, BINDING SITE II or BINDING SITE III. Table 2 illustrates the complementarity of the nucleotide sequences of F8 BINDING SITE, designated SEQ ID:5619, to the nucleotide sequence of VGAM1998 RNA, herein designated VGAM RNA, also designated SEQ ID:4709.

Another function of VGAM1998 is therefore inhibition of Coagulation Factor VIII, Procoagulant Component (hemophilia A) (F8, Accession NM_000132). Accordingly, utilities of VGAM1998 include diagnosis, prevention and treatment of diseases and clinical conditions associated with F8. F-box and Leucine-rich Repeat Protein 7 (FBXL7, Accession NM_012304) is another VGAM1998 host target gene. FBXL7 BINDING SITE is HOST TARGET binding site found in the 3' untranslated region of mRNA encoded by FBXL7, corresponding to a HOST TARGET binding site such as BINDING SITE I, BINDING SITE II or BINDING SITE III. Table 2 illustrates the complementarity of the nucleotide sequences of FBXL7 BINDING SITE, designated SEQ ID:14673, to the nucleotide sequence of VGAM1998 RNA, herein designated VGAM RNA, also designated SEQ ID:4709.

Another function of VGAM1998 is therefore inhibition of F-box and Leucine-rich Repeat Protein 7 (FBXL7, Accession NM_012304), a gene which may be involved in in phosphorylation-dependent ubiquitination. Accordingly, utilities of VGAM1998 include diagnosis, prevention and treatment of diseases and clinical conditions associated with FBXL7. The function of FBXL7 and its association with various diseases and clinical conditions, has been established by previous studies, as described hereinabove with reference to VGAM1924. Leucine-rich Repeat-containing 2 (LRRC2, Accession NM_024512) is another VGAM1998 host target gene. LRRC2 BINDING SITE is HOST TARGET binding site found in the 3' untranslated region of mRNA encoded by LRRC2, corresponding to a HOST TARGET binding site such as BINDING SITE I, BINDING SITE II or BINDING SITE III. Table 2 illustrates the complementarity of the nucleotide sequences of LRRC2 BINDING SITE, designated SEQ ID:23705, to the nucleotide sequence of VGAM1998 RNA, herein designated VGAM RNA, also designated SEQ ID:4709.

Another function of VGAM1998 is therefore inhibition of Leucine-rich Repeat-containing 2 (LRRC2, Accession NM_024512). Accordingly, utilities of VGAM1998 include diagnosis, prevention and treatment of diseases and clinical conditions associated with LRRC2. Nucleolar Protein 3 (apoptosis repressor with CARD domain) (NOL3, Accession NM_003946) is another VGAM1998 host target gene. NOL3 BINDING SITE is HOST TARGET binding site found in the 3' untranslated region of mRNA encoded by NOL3, corresponding to a HOST TARGET binding site such as BINDING SITE I, BINDING SITE II or BINDING SITE III. Table 2 illustrates the complementarity of the nucleotide sequences of NOL3 BINDING SITE, designated SEQ ID:10063, to the nucleotide sequence of VGAM1998 RNA, herein designated VGAM RNA, also designated SEQ ID:4709.

Another function of VGAM1998 is therefore inhibition of Nucleolar Protein 3 (apoptosis repressor with CARD domain) (NOL3, Accession NM_003946), a gene which inhibits CASP2 and CASP8 and interacts with splicing factors. Accordingly, utilities of VGAM1998 include diagnosis, prevention and treatment of diseases and clinical conditions associated with NOL3. The function of NOL3 and its association with various diseases and clinical conditions, has been established by previous studies, as described hereinabove with reference to VGAM554. Serine (or cysteine) Proteinase Inhibitor, Clade A (alpha-1 antiproteinase, antitrypsin), Member 5 (SERPINA5, Accession NM_000624) is another VGAM1998 host target gene. SERPINA5 BINDING SITE is HOST TARGET binding site found in the 3' untranslated region of mRNA encoded by SERPINA5, corresponding to a HOST TARGET binding site such as BINDING SITE I, BINDING SITE II or BINDING SITE III. Table 2 illustrates the complementarity of the nucleotide sequences of SERPINA5 BINDING SITE, designated SEQ ID:6240, to the nucleotide sequence of VGAM1998 RNA, herein designated VGAM RNA, also designated SEQ ID:4709.

Another function of VGAM1998 is therefore inhibition of Serine (or cysteine) Proteinase Inhibitor, Clade A (alpha-1 antiproteinase, antitrypsin), Member 5 (SERPINA5, Accession NM_000624), a gene which inhibits activated protein c as well as plasminogen activators. Accordingly, utilities of VGAM1998 include diagnosis, prevention and treatment of diseases and clinical conditions associated with SERPINA5. The function of SERPINA5 and its association with various diseases and clinical conditions, has been established by previous studies, as described hereinabove with reference to VGAM1233. DKFZP434N178 (Accession XM_050278) is another VGAM1998 host target gene. DKFZP434N178 BINDING SITE is HOST TARGET binding site found in the 3' untranslated region of mRNA encoded by DKFZP434N178, corresponding to a HOST TARGET binding site such as BINDING SITE I, BINDING SITE II or BINDING SITE III. Table 2 illustrates the complementarity of the nucleotide sequences of DKFZP434N178 BINDING SITE, designated SEQ ID:35597, to the nucleotide sequence of VGAM1998 RNA, herein designated VGAM RNA, also designated SEQ ID:4709.

Another function of VGAM1998 is therefore inhibition of DKFZP434N178 (Accession XM_050278). Accordingly, utilities of VGAM1998 include diagnosis, prevention and treatment of diseases and clinical conditions associated with DKFZP434N178. FLJ10458 (Accession NM_018096) is another VGAM1998 host target gene. FLJ10458 BINDING SITE is HOST TARGET binding site found in the 3' untranslated region of mRNA encoded by FLJ10458, corresponding to a HOST TARGET binding site such as BINDING SITE I, BINDING SITE II or BINDING SITE III. Table 2 illustrates the complementarity of the nucleotide sequences of FLJ10458 BINDING SITE, designated SEQ ID:19866, to the nucleotide sequence of VGAM1998 RNA, herein designated VGAM RNA, also designated SEQ ID:4709.

Another function of VGAM1998 is therefore inhibition of FLJ10458 (Accession NM_018096). Accordingly, utilities of VGAM1998 include diagnosis, prevention and treatment of diseases and clinical conditions associated with FLJ10458. KIAA0326 (Accession XM_034819) is another VGAM1998 host target gene. KIAA0326 BINDING SITE is HOST TARGET binding site found in the 3' untranslated region of mRNA encoded by KIAA0326, corresponding to a HOST TARGET binding site such as BINDING SITE I, BINDING SITE II or BINDING SITE III. Table 2 illustrates the complementarity of the nucleotide sequences of KIAA0326 BINDING SITE, designated SEQ ID:32157, to the nucleotide sequence of VGAM1998 RNA, herein designated VGAM RNA, also designated SEQ ID:4709.

Another function of VGAM1998 is therefore inhibition of KIAA0326 (Accession XM_034819). Accordingly, utilities of VGAM1998 include diagnosis, prevention and treatment of diseases and clinical conditions associated with KIAA0326. KIAA0420 (Accession XM_032693) is another VGAM1998 host target gene. KIAA0420 BINDING SITE is HOST TARGET binding site found in the 3' untranslated region of mRNA encoded by KIAA0420, corresponding to a HOST TARGET binding site such as BINDING SITE I, BINDING SITE II or BINDING SITE III. Table 2 illustrates the complementarity of the nucleotide sequences of KIAA0420 BINDING SITE, designated SEQ ID:31730, to the nucleotide sequence of VGAM1998 RNA, herein designated VGAM RNA, also designated SEQ ID:4709.

Another function of VGAM1998 is therefore inhibition of KIAA0420 (Accession XM_032693). Accordingly, utilities of VGAM1998 include diagnosis, prevention and treatment of diseases and clinical conditions associated with KIAA0420. KIAA0494 (Accession NM_014774) is another VGAM1998 host target gene. KIAA0494 BINDING SITE is HOST TARGET binding site found in the 3' untranslated region of mRNA encoded by KIAA0494, corresponding to a HOST TARGET binding site such as BINDING SITE I, BINDING SITE II or BINDING SITE III. Table 2 illustrates the complementarity of the nucleotide sequences of KIAA0494 BINDING SITE, designated SEQ ID:16589, to the nucleotide sequence of VGAM1998 RNA, herein designated VGAM RNA, also designated SEQ ID:4709.

Another function of VGAM1998 is therefore inhibition of KIAA0494 (Accession NM_014774). Accordingly, utilities of VGAM1998 include diagnosis, prevention and treatment of diseases and clinical conditions associated with KIAA0494. KIAA0552 (Accession NM_014731) is another VGAM1998 host target gene. KIAA0552 BINDING SITE is HOST TARGET binding site found in the 3' untranslated region of mRNA encoded by KIAA0552, corresponding to a HOST TARGET binding site such as BINDING SITE I, BINDING SITE II or BINDING SITE III. Table 2 illustrates the complementarity of the nucleotide sequences of KIAA0552 BINDING SITE, designated SEQ ID:16346, to the nucleotide sequence of VGAM1998 RNA, herein designated VGAM RNA, also designated SEQ ID:4709.

Another function of VGAM1998 is therefore inhibition of KIAA0552 (Accession NM_014731). Accordingly, utilities of VGAM1998 include diagnosis, prevention and treatment of diseases and clinical conditions associated with KIAA0552. KIAA0970 (Accession NM_014923) is another VGAM1998 host target gene. KIAA0970 BINDING SITE is HOST TARGET binding site found in the 3' untranslated region of mRNA encoded by KIAA0970, corresponding to a HOST TARGET binding site such as BINDING SITE I, BINDING SITE II or BINDING SITE III. Table 2 illustrates the complementarity of the nucleotide sequences of KIAA0970 BINDING SITE, designated SEQ ID:17204, to the nucleotide sequence of VGAM1998 RNA, herein designated VGAM RNA, also designated SEQ ID:4709.

Another function of VGAM1998 is therefore inhibition of KIAA0970 (Accession NM_014923). Accordingly, utilities of VGAM1998 include diagnosis, prevention and treatment of diseases and clinical conditions associated with KIAA0970. LOC145453 (Accession XM_085120) is another VGAM1998 host target gene. LOC145453 BINDING SITE is HOST TARGET binding site found in the 3' untranslated region of mRNA encoded by LOC145453, corresponding to a HOST TARGET binding site such as BINDING SITE I, BINDING SITE II or BINDING SITE III. Table 2 illustrates the complementarity of the nucleotide sequences of LOC145453 BINDING SITE, designated SEQ ID:37838, to the nucleotide sequence of VGAM1998 RNA, herein designated VGAM RNA, also designated SEQ ID:4709.

Another function of VGAM1998 is therefore inhibition of LOC145453 (Accession XM_085120). Accordingly, utilities of VGAM1998 include diagnosis, prevention and treatment of diseases and clinical conditions associated with LOC145453. LOC155064 (Accession XM_088128) is another VGAM1998 host target gene. LOC155064 BINDING SITE is HOST TARGET binding site found in the 3' untranslated region of mRNA encoded by LOC155064, corresponding to a HOST TARGET binding site such as BINDING SITE I, BINDING SITE II or BINDING SITE III. Table 2 illustrates the complementarity of the nucleotide sequences of LOC155064 BINDING SITE, designated SEQ ID:39532, to the nucleotide sequence of VGAM1998 RNA, herein designated VGAM RNA, also designated SEQ ID:4709.

Another function of VGAM1998 is therefore inhibition of LOC155064 (Accession XM_088128). Accordingly, utilities of VGAM1998 include diagnosis, prevention and treatment of diseases and clinical conditions associated with LOC155064. LOC221738 (Accession XM_168097) is another VGAM1998 host target gene. LOC221738 BINDING SITE is HOST TARGET binding site found in the 3' untranslated region of mRNA encoded by LOC221738, corresponding to a HOST TARGET binding site such as BINDING SITE I, BINDING SITE II or BINDING SITE III. Table 2 illustrates the complementarity of the nucleotide sequences of LOC221738 BINDING SITE, designated SEQ ID:45030, to the nucleotide sequence of VGAM1998 RNA, herein designated VGAM RNA, also designated SEQ ID:4709.

Another function of VGAM1998 is therefore inhibition of LOC221738 (Accession XM_168097). Accordingly, utilities of VGAM1998 include diagnosis, prevention and treatment of diseases and clinical conditions associated with LOC221738. LOC257354 (Accession XM_170810) is another VGAM1998 host target gene. LOC257354 BINDING SITE is HOST TARGET binding site found in the 3' untranslated region of mRNA encoded by LOC257354, corresponding to a HOST TARGET binding site such as BINDING SITE I, BINDING SITE II or BINDING SITE III. Table 2 illustrates the complementarity of the nucleotide sequences of LOC257354 BINDING SITE, designated SEQ ID:45583, to the nucleotide sequence of VGAM1998 RNA, herein designated VGAM RNA, also designated SEQ ID:4709.

Another function of VGAM1998 is therefore inhibition of LOC257354 (Accession XM_170810). Accordingly, utilities of VGAM1998 include diagnosis, prevention and treatment of diseases and clinical conditions associated with LOC257354. LOC51236 (Accession NM_016458) is another VGAM1998 host target gene. LOC51236 BINDING SITE is HOST TARGET binding site found in the 3' untranslated region of mRNA encoded by LOC51236, corresponding to a HOST TARGET binding site such as BINDING SITE I, BINDING SITE II or BINDING SITE III. Table 2 illustrates the complementarity of the nucleotide sequences of LOC51236 BINDING SITE, designated SEQ ID:18574, to the nucleotide sequence of VGAM1998 RNA, herein designated VGAM RNA, also designated SEQ ID:4709.

Another function of VGAM1998 is therefore inhibition of LOC51236 (Accession NM_016458). Accordingly, utilities of VGAM1998 include diagnosis, prevention and treatment of diseases and clinical conditions associated with LOC51236. LOC90268 (Accession XM_030424) is another VGAM1998 host target gene. LOC90268 BINDING SITE is HOST TARGET binding site found in the 3' untranslated region of mRNA encoded by LOC90268, corresponding to a HOST TARGET binding site such as BINDING SITE I, BINDING SITE II or BINDING SITE III. Table 2 illustrates the complementarity of the nucleotide sequences of LOC90268 BINDING SITE, designated SEQ ID:31042, to the nucleotide sequence of VGAM1998 RNA, herein designated VGAM RNA, also designated SEQ ID:4709.

Another function of VGAM1998 is therefore inhibition of LOC90268 (Accession XM_030424). Accordingly, utilities of VGAM1998 include diagnosis, prevention and treatment of diseases and clinical conditions associated with LOC90268. FIG. 1 further provides a conceptual description of a novel bioinformatically detected viral gene of the present invention, referred to here as Viral Genomic Address Messenger 1999 (VGAM1999) viral gene, which modulates expression of respective host target genes thereof, the function and utility of which host target genes is known in the art.

VGAM1999 is a novel bioinformatically detected regulatory, non protein coding, viral micro RNA (miRNA) gene. The method by which VGAM1999 was detected is described hereinabove with reference to FIGS. 1-8.

VGAM1999 gene, herein designated VGAM GENE, is a viral gene contained in the genome of Nipah Virus. VGAM1999 host target gene, herein designated VGAM HOST TARGET GENE, is a human gene contained in the human genome.

VGAM1999 gene encodes a VGAM1999 precursor RNA, herein designated VGAM PRECURSOR RNA. Similar to other miRNA genes, and unlike most ordinary genes, VGAM1999 precursor RNA does not encode a protein. A nucleotide sequence identical or highly similar to the nucleotide sequence of VGAM1999 precursor RNA is designated SEQ ID:1985, and is provided hereinbelow with reference to the sequence listing part. Nucleotide sequence SEQ ID:1985 is located at position 11709 relative to the genome of Nipah Virus.

VGAM1999 precursor RNA folds onto itself, forming VGAM1999 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM1999 folded precursor RNA into VGAM1999 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM1999 RNA is designated SEQ ID:4710, and is provided hereinbelow with reference to the sequence listing part.

VGAM1999 host target gene, herein designated VGAM HOST TARGET GENE, encodes a corresponding messenger RNA, VGAM1999 host target RNA, herein designated VGAM HOST TARGET RNA. VGAM1999 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM1999 RNA, herein designated VGAM RNA, binds complementarily to one or more host target binding sites located in untranslated regions of VGAM1999 host target RNA, herein designated VGAM HOST TARGET RNA. This complementary binding is due to the fact that the nucleotide sequence of VGAM1999 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM1999 RNA, herein designated VGAM RNA, may have a different number of host target binding sites in untranslated regions of a VGAM1999 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM1999 RNA, herein designated VGAM RNA, to host target binding sites on VGAM1999 host target RNA, herein designated VGAM HOST TARGET RNA, such as BINDING SITE I, BINDING SITE II and BINDING SITE III, inhibits translation of VGAM1999 host target RNA into VGAM1999 host target protein, herein designated VGAM HOST TARGET PROTEIN. VGAM host target protein is therefore outlined by a broken line.

It is appreciated that VGAM1999 host target gene, herein designated VGAM HOST TARGET GENE, in fact represents a plurality of VGAM1999 host target genes. The mRNA of each one of this plurality of VGAM1999 host target genes comprises one or more host target binding sites, each having a nucleotide sequence which is at least partly complementary to VGAM1999 RNA, herein designated VGAM RNA, and which when bound by VGAM1999 RNA causes inhibition of translation of respective one or more VGAM1999 host target proteins.

It is further appreciated by one skilled in the art that the mode of translational inhibition illustrated by FIG. 1 with specific reference to translational inhibition exerted by VGAM1999 gene, herein designated VGAM GENE, on one or more VGAM1999 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM1999 is inhibition of expression of host target genes, as part of a novel viral mechanism of attacking a host. Accordingly, utilities of VGAM1999 include diagnosis, prevention and treatment of viral infection by Nipah Virus. Specific functions, and accordingly utilities, of VGAM1999 correlate with, and may be deduced from, the identity of the host target genes which VGAM1999 binds and inhibits, and the function of these host target genes, as elaborated hereinbelow.

Nucleotide sequences of the VGAM1999 precursor RNA, herein designated VGAM PRECURSOR RNA, and of the 'diced' VGAM1999 RNA, herein designated VGAM RNA, and a schematic representation of the secondary folding of VGAM1999 folded precursor RNA, herein designated VGAM FOLDED PRECURSOR RNA, of VGAM1999 are further described hereinbelow with reference to Table 1.

Nucleotide sequences of host target binding sites, such as BINDING SITE-I, BINDING SITE-II and BINDING SITE-III of FIG. 1, found on VGAM1999 host target RNA, and schematic representation of the complementarity of each of these host target binding sites to VGAM1999 RNA, herein designated VGAM RNA, are described hereinbelow with reference to Table 2.

As mentioned hereinabove with reference to FIG. 1, a function of VGAM1999 gene, herein designated VGAM is inhibition of expression of VGAM1999 target genes. It is appreciated that specific functions, and accordingly utilities, of VGAM1999 correlate with, and may be deduced from, the identity of the target genes which VGAM1999 binds and inhibits, and the function of these target genes, as elaborated hereinbelow.

Fer (fps/fes related) Tyrosine Kinase (phosphoprotein NCP94) (FER, Accession NM_005246) is a VGAM1999 host target gene. FER BINDING SITE is HOST TARGET binding site found in the 5' untranslated region of mRNA encoded by FER, corresponding to a HOST TARGET binding site such as BINDING SITE I, BINDING SITE II or BINDING SITE III. Table 2 illustrates the complementarity of the nucleotide sequences of FER BINDING SITE, designated SEQ ID:11754, to the nucleotide sequence of VGAM1999 RNA, herein designated VGAM RNA, also designated SEQ ID:4710.

A function of VGAM1999 is therefore inhibition of Fer (fps/fes related) Tyrosine Kinase (phosphoprotein NCP94) (FER, Accession NM_005246), a gene which Non-receptor protein tyrosine kinase; member of the Src family. Accordingly, utilities of VGAM1999 include diagnosis, prevention and treatment of diseases and clinical conditions associated with FER. The function of FER and its association with various diseases and clinical conditions, has been established by previous studies, as described hereinabove with reference to VGAM224. FLJ13385 (Accession NM_024853) is another VGAM1999 host target gene. FLJ13385 BINDING SITE is HOST TARGET binding site found in the 3' untranslated region of mRNA encoded by FLJ13385, corresponding to a HOST TARGET binding site such as BINDING SITE I, BINDING SITE II or BINDING SITE III. Table 2 illustrates the complementarity of the nucleotide sequences of FLJ13385 BINDING SITE, designated SEQ ID:24283, to the nucleotide sequence of VGAM1999 RNA, herein designated VGAM RNA, also designated SEQ ID:4710.

Another function of VGAM1999 is therefore inhibition of FLJ13385 (Accession NM_024853). Accordingly, utilities of VGAM1999 include diagnosis, prevention and treatment of diseases and clinical conditions associated with FLJ13385. KIAA0555 (Accession NM_014790) is another VGAM1999 host target gene. KIAA0555 BINDING SITE is HOST TARGET binding site found in the 3' untranslated region of mRNA encoded by KIAA0555, corresponding to a HOST TARGET binding site such as BINDING SITE I, BINDING SITE II or BINDING SITE III. Table 2 illustrates the complementarity of the nucleotide sequences of KIAA0555 BINDING SITE, designated SEQ ID:16677, to the nucleotide sequence of VGAM1999 RNA, herein designated VGAM RNA, also designated SEQ ID:4710.

Another function of VGAM1999 is therefore inhibition of KIAA0555 (Accession NM_014790). Accordingly, utilities of VGAM1999 include diagnosis, prevention and treatment of diseases and clinical conditions associated with KIAA0555. PDZ Domain Containing 2 (PDZD2, Accession XM_087705) is another VGAM1999 host target gene. PDZD2 BINDING SITE is HOST TARGET binding site found in the 3' untranslated region of mRNA encoded by PDZD2, corresponding to a HOST TARGET binding site such as BINDING SITE I, BINDING SITE II or BINDING SITE III. Table 2 illustrates the complementarity of the nucleotide sequences of PDZD2 BINDING SITE, designated SEQ ID:39385, to the nucleotide sequence of VGAM1999 RNA, herein designated VGAM RNA, also designated SEQ ID:4710.

Another function of VGAM1999 is therefore inhibition of PDZ Domain Containing 2 (PDZD2, Accession XM_087705). Accordingly, utilities of VGAM1999 include diagnosis, prevention and treatment of diseases and clinical conditions associated with PDZD2. LOC203411 (Accession XM_117547) is another VGAM1999 host target gene. LOC203411 BINDING SITE is HOST TARGET binding site found in the 3' untranslated region of mRNA encoded by LOC203411, corresponding to a HOST TARGET binding site such as BINDING SITE I, BINDING SITE II or BINDING SITE III. Table 2 illustrates the complementarity of the nucleotide sequences of LOC203411 BINDING SITE, designated SEQ ID:43563, to the nucleotide sequence of VGAM1999 RNA, herein designated VGAM RNA, also designated SEQ ID:4710.

Another function of VGAM1999 is therefore inhibition of LOC203411 (Accession XM_117547). Accordingly, utilities of VGAM1999 include diagnosis, prevention and treatment of diseases and clinical conditions associated with LOC203411. LOC54499 (Accession XM_047479) is another VGAM1999 host target gene. LOC54499 BINDING SITE is HOST TARGET binding site found in the 3' untranslated region of mRNA encoded by LOC54499, corresponding to a HOST TARGET binding site such as BINDING SITE I, BINDING SITE II or BINDING SITE III. Table 2 illustrates the complementarity of the nucleotide sequences of LOC54499 BINDING SITE, designated SEQ ID:34966, to the nucleotide sequence of VGAM1999 RNA, herein designated VGAM RNA, also designated SEQ ID:4710.

Another function of VGAM1999 is therefore inhibition of LOC54499 (Accession XM_047479). Accordingly, utilities of VGAM1999 include diagnosis, prevention and treatment of diseases and clinical conditions associated with LOC54499. FIG. 1 further provides a conceptual description of a novel bioinformatically detected viral gene of the present invention, referred to here as Viral Genomic Address Messenger 2000 (VGAM2000) viral gene, which modulates expression of respective host target genes thereof, the function and utility of which host target genes is known in the art.

VGAM2000 is a novel bioinformatically detected regulatory, non protein coding, viral micro RNA (miRNA) gene. The method by which VGAM2000 was detected is described hereinabove with reference to FIGS. 1-8.

VGAM2000 gene, herein designated VGAM GENE, is a viral gene contained in the genome of Nipah Virus. VGAM2000 host target gene, herein designated VGAM HOST TARGET GENE, is a human gene contained in the human genome.

VGAM2000 gene encodes a VGAM2000 precursor RNA, herein designated VGAM PRECURSOR RNA. Similar to other miRNA genes, and unlike most ordinary genes, VGAM2000 precursor RNA does not encode a protein. A nucleotide sequence identical or highly similar to the nucleotide sequence of VGAM2000 precursor RNA is designated SEQ ID:1986, and is provided hereinbelow with reference to the sequence listing part. Nucleotide sequence SEQ ID:1986 is located at position 10918 relative to the genome of Nipah Virus.

VGAM2000 precursor RNA folds onto itself, forming VGAM2000 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2000 folded precursor RNA into VGAM2000 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2000 RNA is designated SEQ ID:4711, and is provided hereinbelow with reference to the sequence listing part.

VGAM2000 host target gene, herein designated VGAM HOST TARGET GENE, encodes a corresponding messenger RNA, VGAM2000 host target RNA, herein designated VGAM HOST TARGET RNA. VGAM2000 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2000 RNA, herein designated VGAM RNA, binds complementarily to one or more host target binding sites located in untranslated regions of VGAM2000 host target RNA, herein designated VGAM HOST TARGET RNA. This complementary binding is due to the fact that the nucleotide sequence of VGAM2000 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2000 RNA, herein designated VGAM RNA, may have a different number of host target binding sites in untranslated regions of a VGAM2000 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2000 RNA, herein designated VGAM RNA, to host target binding sites on VGAM2000 host target RNA, herein designated VGAM HOST TARGET RNA, such as BINDING SITE I, BINDING SITE II and BINDING SITE III, inhibits translation of VGAM2000 host target RNA into VGAM2000 host target protein, herein designated VGAM HOST TARGET PROTEIN. VGAM host target protein is therefore outlined by a broken line.

It is appreciated that VGAM2000 host target gene, herein designated VGAM HOST TARGET GENE, in fact represents a plurality of VGAM2000 host target genes. The mRNA of each one of this plurality of VGAM2000 host target genes comprises one or more host target binding sites, each having a nucleotide sequence which is at least partly complementary to VGAM2000 RNA, herein designated VGAM RNA, and which when bound by VGAM2000 RNA causes inhibition of translation of respective one or more VGAM2000 host target proteins.

It is further appreciated by one skilled in the art that the mode of translational inhibition illustrated by FIG. 1 with specific reference to translational inhibition exerted by VGAM2000 gene, herein designated VGAM GENE, on one or more VGAM2000 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2000 is inhibition of expression of host target genes, as part of a novel viral mechanism of attacking a host. Accordingly, utilities of VGAM2000 include diagnosis, prevention and treatment of viral infection by Nipah Virus. Specific functions, and accordingly utilities, of VGAM2000 correlate with, and may be deduced from, the identity of the host target genes which VGAM2000 binds and inhibits, and the function of these host target genes, as elaborated hereinbelow.

Nucleotide sequences of the VGAM2000 precursor RNA, herein designated VGAM PRECURSOR RNA, and of the 'diced' VGAM2000 RNA, herein designated VGAM RNA, and a schematic representation of the secondary folding of VGAM2000 folded precursor RNA, herein designated VGAM FOLDED PRECURSOR RNA, of VGAM2000 are further described hereinbelow with reference to Table 1.

Nucleotide sequences of host target binding sites, such as BINDING SITE-I, BINDING SITE-II and BINDING SITE-III of FIG. 1, found on VGAM2000 host target RNA, and schematic representation of the complementarity of each of these host target binding sites to VGAM2000 RNA, herein designated VGAM RNA, are described hereinbelow with reference to Table 2.

As mentioned hereinabove with reference to FIG. 1, a function of VGAM2000 gene, herein designated VGAM is inhibition of expression of VGAM2000 target genes. It is appreciated that specific functions, and accordingly utilities, of VGAM2000 correlate with, and may be deduced from, the identity of the target genes which VGAM2000 binds and inhibits, and the function of these target genes, as elaborated hereinbelow.

Cytochrome P450, Subfamily IVF, Polypeptide 3 (leukotriene B4 omega hydroxylase) (CYP4F3, Accession NM_000896) is a VGAM2000 host target gene. CYP4F3 BINDING SITE is HOST TARGET binding site found in the 3' untranslated region of mRNA encoded by CYP4F3, corresponding to a HOST TARGET binding site such as BINDING SITE I, BINDING SITE II or BINDING SITE III. Table 2 illustrates the complementarity of the nucleotide sequences of CYP4F3 BINDING SITE, designated SEQ ID:6590, to the nucleotide sequence of VGAM2000 RNA, herein designated VGAM RNA, also designated SEQ ID:4711.

A function of VGAM2000 is therefore inhibition of Cytochrome P450, Subfamily IVF, Polypeptide 3 (leukotriene B4 omega hydroxylase) (CYP4F3, Accession NM_000896), a gene which converts leukotriene B4 into the less active 20-hydroxy-leukotriene B4. Accordingly, utilities of VGAM2000 include diagnosis, prevention and treatment of diseases and clinical conditions associated with CYP4F3. The function of CYP4F3 and its association with various diseases and clinical conditions, has been established by previous studies, as described hereinabove with reference to VGAM186. MHC Class II Transactivator (MHC2TA, Accession NM_000246) is another VGAM2000 host target gene. MHC2TA BINDING SITE is HOST TARGET binding site found in the 3' untranslated region of mRNA encoded by MHC2TA, corresponding to a HOST TARGET binding site such as BINDING SITE I, BINDING SITE II or BINDING SITE III. Table 2 illustrates the complementarity of the nucleotide sequences of MHC2TA BINDING SITE, designated SEQ ID:5782, to the nucleotide sequence of VGAM2000 RNA, herein designated VGAM RNA, also designated SEQ ID:4711.

Another function of VGAM2000 is therefore inhibition of MHC Class II Transactivator (MHC2TA, Accession NM_000246). Accordingly, utilities of VGAM2000 include diagnosis, prevention and treatment of diseases and clinical conditions associated with MHC2TA. Kruppel-like Factor 3 (basic) (KLF3, Accession NM_016531) is another VGAM2000 host target gene. KLF3 BINDING SITE is HOST TARGET binding site found in the 3' untranslated region of mRNA encoded by KLF3, corresponding to a HOST TARGET binding site such as BINDING SITE I, BINDING SITE II or BINDING SITE III. Table 2 illustrates the complementarity of the nucleotide sequences of KLF3 BINDING SITE, designated SEQ ID:18595, to the nucleotide sequence of VGAM2000 RNA, herein designated VGAM RNA, also designated SEQ ID:4711.

Another function of VGAM2000 is therefore inhibition of Kruppel-like Factor 3 (basic) (KLF3, Accession NM_016531). Accordingly, utilities of VGAM2000 include diagnosis, prevention and treatment of diseases and clinical conditions associated with KLF3. LOC201626 (Accession XM_114349) is another VGAM2000 host target gene. LOC201626 BINDING SITE is HOST TARGET binding site found in the 3' untranslated region of mRNA encoded by LOC201626, corresponding to a HOST TARGET binding site such as BINDING SITE I, BINDING SITE II or BINDING SITE III. Table 2 illustrates the complementarity of the nucleotide sequences of LOC201626 BINDING SITE, designated SEQ ID:42890, to the nucleotide sequence of VGAM2000 RNA, herein designated VGAM RNA, also designated SEQ ID:4711.

Another function of VGAM2000 is therefore inhibition of LOC201626 (Accession XM_114349). Accordingly, utilities of VGAM2000 include diagnosis, prevention and treatment of diseases and clinical conditions associated with LOC201626. FIG. 1 further provides a conceptual description of a novel bioinformatically detected viral gene of the present invention, referred to here as Viral Genomic Address Messenger 2001 (VGAM2001) viral gene, which modulates expression of respective host target genes thereof, the function and utility of which host target genes is known in the art.

VGAM2001 is a novel bioinformatically detected regulatory, non protein coding, viral micro RNA (miRNA) gene. The method by which VGAM2001 was detected is described hereinabove with reference to FIGS. 1-8.

VGAM2001 gene, herein designated VGAM GENE, is a viral gene contained in the genome of Nipah Virus. VGAM2001 host target gene, herein designated VGAM HOST TARGET GENE, is a human gene contained in the human genome.

VGAM2001 gene encodes a VGAM2001 precursor RNA, herein designated VGAM PRECURSOR RNA. Similar to other miRNA genes, and unlike most ordinary genes, VGAM2001 precursor RNA does not encode a protein. A nucleotide sequence identical or highly similar to the nucleotide sequence of VGAM2001 precursor RNA is designated SEQ ID:1987, and is provided hereinbelow with reference to the sequence listing part. Nucleotide sequence SEQ ID:1987 is located at position 2273 relative to the genome of Nipah Virus.

VGAM2001 precursor RNA folds onto itself, forming VGAM2001 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2001 folded precursor RNA into VGAM2001 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 76%) nucleotide sequence of VGAM2001 RNA is designated SEQ ID:4712, and is provided hereinbelow with reference to the sequence listing part.

VGAM2001 host target gene, herein designated VGAM HOST TARGET GENE, encodes a corresponding messenger RNA, VGAM2001 host target RNA, herein designated VGAM HOST TARGET RNA. VGAM2001 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2001 RNA, herein designated VGAM RNA, binds complementarily to one or more host target binding sites located in untranslated regions of VGAM2001 host target RNA, herein designated VGAM HOST TARGET RNA. This complementary binding is due to the fact that the nucleotide sequence of VGAM2001 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2001 RNA, herein designated VGAM RNA, may have a different number of host target binding sites in untranslated regions of a VGAM2001 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2001 RNA, herein designated VGAM RNA, to host target binding sites on VGAM2001 host target RNA, herein designated VGAM HOST TARGET RNA, such as BINDING SITE I, BINDING SITE II and BINDING SITE III, inhibits translation of VGAM2001 host target RNA into VGAM2001 host target protein, herein designated VGAM HOST TARGET PROTEIN. VGAM host target protein is therefore outlined by a broken line.

It is appreciated that VGAM2001 host target gene, herein designated VGAM HOST TARGET GENE, in fact represents a plurality of VGAM2001 host target genes. The mRNA of each one of this plurality of VGAM2001 host target genes comprises one or more host target binding sites, each having a nucleotide sequence which is at least partly complementary to VGAM2001 RNA, herein designated VGAM RNA, and which when bound by VGAM2001 RNA causes inhibition of translation of respective one or more VGAM2001 host target proteins.

It is further appreciated by one skilled in the art that the mode of translational inhibition illustrated by FIG. 1 with specific reference to translational inhibition exerted by VGAM2001 gene, herein designated VGAM GENE, on one or more VGAM2001 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let- 7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2001 is inhibition of expression of host target genes, as part of a novel viral mechanism of attacking a host. Accordingly, utilities of VGAM2001 include diagnosis, prevention and treatment of viral infection by Nipah Virus. Specific functions, and accordingly utilities, of VGAM2001 correlate with, and may be deduced from, the identity of the host target genes which VGAM2001 binds and inhibits, and the function of these host target genes, as elaborated hereinbelow.

Nucleotide sequences of the VGAM2001 precursor RNA, herein designated VGAM PRECURSOR RNA, and of the 'diced' VGAM2001 RNA, herein designated VGAM RNA, and a schematic representation of the secondary folding of VGAM2001 folded precursor RNA, herein designated VGAM FOLDED PRECURSOR RNA, of VGAM2001 are further described hereinbelow with reference to Table 1.

Nucleotide sequences of host target binding sites, such as BINDING SITE-I, BINDING SITE-II and BINDING SITE-III of FIG. 1, found on VGAM2001 host target RNA, and schematic representation of the complementarity of each of these host target binding sites to VGAM2001 RNA, herein designated VGAM RNA, are described hereinbelow with reference to Table 2.

As mentioned hereinabove with reference to FIG. 1, a function of VGAM2001 gene, herein designated VGAM is inhibition of expression of VGAM2001 target genes. It is appreciated that specific functions, and accordingly utilities, of VGAM2001 correlate with, and may be deduced from, the identity of the target genes which VGAM2001 binds and inhibits, and the function of these target genes, as elaborated hereinbelow.

Ring Finger Protein 12 (RNF12, Accession NM_016120) is a VGAM2001 host target gene. RNF12 BINDING SITE is HOST TARGET binding site found in the 5' untranslated region of mRNA encoded by RNF12, corresponding to a HOST TARGET binding site such as BINDING SITE I, BINDING SITE II or BINDING SITE III. Table 2 illustrates the complementarity of the nucleotide sequences of RNF12 BINDING SITE, designated SEQ ID:18202, to the nucleotide sequence of VGAM2001 RNA, herein designated VGAM RNA, also designated SEQ ID:4712.

A function of VGAM2001 is therefore inhibition of Ring Finger Protein 12 (RNF12, Accession NM_016120), a gene which acts as a negative coregulator for LIM homeodomain transcription factors. Accordingly, utilities of VGAM2001 include diagnosis, prevention and treatment of diseases and clinical conditions associated with RNF12. The function of RNF12 has been established by previous studies. RNF12 encodes a RING H2 zinc finger protein, RLIM, that acts as a negative coregulator for LIM homeodomain transcription factors. Scanlan et al. (1999) isolated a human RNF12 cDNA by screening antigens recognized by autologous antibodies in patients with renal cell carcinoma. Using PCR, Ostendorff et al. (2000) amplified an RNF12 cDNA encoding a deduced 624-amino acid protein that shares 89% and 85% sequence identity with the mouse and chick Rlim proteins, respectively. Northern blot analysis detected wide expression of mouse Rnf12. Ostendorff et al. (2002) examined RLIM as a mediator of cofactor exchange on DNA-bound transcription factors. SDS-PAGE and mutation analysis showed the RLIM, dependent on the RING finger, is ubiquitinated in the presence of UBCH5 (OMIM Ref. No. 602961). RLIM, however, is unable to ubiquitinate LHX1 (OMIM Ref. No. 601999), LXH3 (OMIM Ref. No. 600577), or ISL1 (OMIM Ref. No. 600366) transcription factors. RLIM efficiently ubiquitinates LMO2 (OMIM Ref. No. 180385) and LMO4 (OMIM Ref. No. 603129), but only in the absence of LIM interaction domain of CLIM1 (OMIM Ref. No. 603450) or CLIM2 (OMIM Ref. No. 603451). The CLIM proteins themselves are specifically polyubiquitinated in the presence of RLIM in the presence or absence of LMO2 or LHX3. Western blot analysis and fluorescence microscopy showed that proteosomal degradation of CLIM depends on the presence of the RLIM RING finger and that RLIM and CLIM levels are reciprocally correlated. Analysis of mutated or truncated forms of RLIM demonstrated that the interaction domain is restricted to a basic evolutionarily conserved and centrally located region of approximately 100 amino acids. A combined EMSA and in vitro ubiquitination analysis, as well as chromatin immunoprecipitation analysis, indicated that RLIM, dependent on the presence of the RING finger, is able to ubiquitinate CLIM cofactors associated with DNA-bound LHX3. Ostendorff et al. (2002) proposed a model of cofactor exchange which depends on the nuclear concentrations of these components and the availability of other LIM-domain interaction partners Full details of the abovementioned studies are described in the following publications, the disclosure of which are hereby incorporated by reference:

Ostendorff, H. P.; Peirano, R. I.; Peters, M. A.; Schluter, A.; Bossenz, M.; Scheffner, M.; Bach, I.: Ubiquitination-dependent cofactor exchange on LIM homeodomain transcription factors. Nature 416:99-103, 2002; and Scanlan, M. J.; Gordan, J. D.; Williamson, B.; Stockert, E.; Bander, N. H.; Jongeneel, V.; Gure, A. O.; Jager, D.; Jager, E.; Knuth, A.; Chen, Y.-T.; Old, L. J.: Antigens recognized by.

Further studies establishing the function and utilities of RNF12 are found in John Hopkins OMIM database record ID 300379, and in sited publications numbered 986-98 and 9448 listed in the bibliography section hereinbelow, which are also hereby incorporated by reference. KIAA0680 (Accession NM_014721) is another VGAM2001 host target gene. KIAA0680 BINDING SITE is HOST TARGET binding site found in the 3' untranslated region of mRNA encoded by KIAA0680, corresponding to a HOST TARGET binding site such as BINDING SITE I, BINDING SITE II or BINDING SITE III. Table 2 illustrates the complementarity of the nucleotide sequences of KIAA0680 BINDING SITE, designated SEQ ID:16286, to the nucleotide sequence of VGAM2001 RNA, herein designated VGAM RNA, also designated SEQ ID:4712.

Another function of VGAM2001 is therefore inhibition of KIAA0680 (Accession NM_014721). Accordingly, utilities of VGAM2001 include diagnosis, prevention and treatment of diseases and clinical conditions associated with KIAA0680. FIG. 1 further provides a conceptual description of a novel bioinformatically detected viral gene of the present invention, referred to here as Viral Genomic Address Messenger 2002 (VGAM2002) viral gene, which modulates expression of respective host target genes thereof, the function and utility of which host target genes is known in the art.

VGAM2002 is a novel bioinformatically detected regulatory, non protein coding, viral micro RNA (miRNA) gene. The method by which VGAM2002 was detected is described hereinabove with reference to FIGS. 1-8.

VGAM2002 gene, herein designated VGAM GENE, is a viral gene contained in the genome of Nipah Virus. VGAM2002 host target gene, herein designated VGAM HOST TARGET GENE, is a human gene contained in the human genome.

VGAM2002 gene encodes a VGAM2002 precursor RNA, herein designated VGAM PRECURSOR RNA. Similar to other miRNA genes, and unlike most ordinary genes, VGAM2002 precursor RNA does not encode a protein. A nucleotide sequence identical or highly similar to the nucleotide sequence of VGAM2002 precursor RNA is designated SEQ ID:1988, and is provided hereinbelow with reference to the sequence listing part. Nucleotide sequence SEQ ID:1988 is located at position 1516 relative to the genome of Nipah Virus.

VGAM2002 precursor RNA folds onto itself, forming VGAM2002 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2002 folded precursor RNA into VGAM2002 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM2002 RNA is designated SEQ ID:4713, and is provided hereinbelow with reference to the sequence listing part.

VGAM2002 host target gene, herein designated VGAM HOST TARGET GENE, encodes a corresponding messenger RNA, VGAM2002 host target RNA, herein designated VGAM HOST TARGET RNA. VGAM2002 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2002 RNA, herein designated VGAM RNA, binds complementarily to one or more host target binding sites located in untranslated regions of VGAM2002 host target RNA, herein designated VGAM HOST TARGET RNA. This complementary binding is due to the fact that the nucleotide sequence of VGAM2002 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2002 RNA, herein designated VGAM RNA, may have a different number of host target binding sites in untranslated regions of a VGAM2002 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2002 RNA, herein designated VGAM RNA, to host target binding sites on VGAM2002 host target RNA, herein designated VGAM HOST TARGET RNA, such as BINDING SITE I, BINDING SITE II and BINDING SITE III, inhibits translation of VGAM2002 host target RNA into VGAM2002 host target protein, herein designated VGAM HOST TARGET PROTEIN. VGAM host target protein is therefore outlined by a broken line.

It is appreciated that VGAM2002 host target gene, herein designated VGAM HOST TARGET GENE, in fact represents a plurality of VGAM2002 host target genes. The mRNA of each one of this plurality of VGAM2002 host target genes comprises one or more host target binding sites, each having a nucleotide sequence which is at least partly complementary to VGAM2002 RNA, herein designated VGAM RNA, and which when bound by VGAM2002 RNA causes inhibition of translation of respective one or more VGAM2002 host target proteins.

It is further appreciated by one skilled in the art that the mode of translational inhibition illustrated by FIG. 1 with specific reference to translational inhibition exerted by VGAM2002 gene, herein designated VGAM GENE, on one or more VGAM2002 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2002 is inhibition of expression of host target genes, as part of a novel viral mechanism of attacking a host. Accordingly, utilities of VGAM2002 include diagnosis, prevention and treatment of viral infection by Nipah Virus. Specific functions, and accordingly utilities, of VGAM2002 correlate with, and may be deduced from, the identity of the host target genes which VGAM2002 binds and inhibits, and the function of these host target genes, as elaborated hereinbelow.

Nucleotide sequences of the VGAM2002 precursor RNA, herein designated VGAM PRECURSOR RNA, and of the 'diced' VGAM2002 RNA, herein designated VGAM RNA, and a schematic representation of the secondary folding of VGAM2002 folded precursor RNA, herein designated VGAM FOLDED PRECURSOR RNA, of VGAM2002 are further described hereinbelow with reference to Table 1.

Nucleotide sequences of host target binding sites, such as BINDING SITE-I, BINDING SITE-II and BINDING SITE-III of FIG. 1, found on VGAM2002 host target RNA, and schematic representation of the complementarity of each of these host target binding sites to VGAM2002 RNA, herein designated VGAM RNA, are described hereinbelow with reference to Table 2.

As mentioned hereinabove with reference to FIG. 1, a function of VGAM2002 gene, herein designated VGAM is inhibition of expression of VGAM2002 target genes. It is appreciated that specific functions, and accordingly utilities, of VGAM2002 correlate with, and may be deduced from, the identity of the target genes which VGAM2002 binds and inhibits, and the function of these target genes, as elaborated hereinbelow.

Fibroblast Growth Factor 2 (basic) (FGF2, Accession NM_002006) is a VGAM2002 host target gene. FGF2 BINDING SITE is HOST TARGET binding site found in the 3' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7731, to the nucleotide sequence of VGAM2002 RNA, herein designated VGAM RNA, also designated SEQ ID:4713.

A function of VGAM2002 is therefore inhibition of Fibroblast Growth Factor 2 (basic) (FGF2, Accession NM_002006), a gene which probably involved in nervous system development and function. Accordingly, utilities of VGAM2002 include diagnosis, prevention and treatment of diseases and clinical conditions associated with FGF2. The function of FGF2 and its association with various diseases and clinical conditions, has been established by previous studies, as described hereinabove with reference to VGAM51. Follistatin-like 3 (secreted glycoprotein) (FSTL3, Accession NM_005860) is another VGAM2002 host target gene. FSTL3 BINDING SITE is HOST TARGET binding site found in the 3' untranslated region of mRNA encoded by FSTL3, corresponding to a HOST TARGET binding site such as BINDING SITE I, BINDING SITE II or BINDING SITE III. Table 2 illustrates the complementarity of the nucleotide sequences of FSTL3 BINDING SITE, designated SEQ ID:12471, to the nucleotide sequence of VGAM2002 RNA, herein designated VGAM RNA, also designated SEQ ID:4713.

Another function of VGAM2002 is therefore inhibition of Follistatin-like 3 (secreted glycoprotein) (FSTL3, Accession NM_005860), a gene which is a member of the follistatin-module-protein family. Accordingly, utilities of VGAM2002 include diagnosis, prevention and treatment of diseases and clinical conditions associated with FSTL3. The function of FSTL3 and its association with various diseases and clinical conditions, has been established by previous studies, as described hereinabove with reference to VGAM200. Prostaglandin-endoperoxide Synthase 2 (prostaglandin G/H synthase and cyclooxygenase) (PTGS2, Accession NM_000963) is another VGAM2002 host target gene. PTGS2 BINDING SITE is HOST TARGET binding site found in the 3' untranslated region of mRNA encoded by PTGS2, corresponding to a HOST TARGET binding site such as BINDING SITE I, BINDING SITE II or BINDING SITE III. Table 2 illustrates the complementarity of the nucleotide sequences of PTGS2 BINDING SITE, designated SEQ ID:6685, to the nucleotide sequence of VGAM2002 RNA, herein designated VGAM RNA, also designated SEQ ID:4713.

Another function of VGAM2002 is therefore inhibition of Prostaglandin-endoperoxide Synthase 2 (prostaglandin G/H synthase and cyclooxygenase) (PTGS2, Accession NM_000963), a gene which may have a role as a major mediator of inflammation and/or a role for prostanoid signaling in activity-dependent plasticity. Accordingly, utilities of VGAM2002 include diagnosis, prevention and treatment of diseases and clinical conditions associated with PTGS2. The function of PTGS2 and its association with various diseases and clinical conditions, has been established by previous studies, as described hereinabove with reference to VGAM292. X-ray Repair Complementing Defective Repair In Chinese Hamster Cells 2 (XRCC2, Accession NM_005431) is another VGAM2002 host target gene. XRCC2 BINDING SITE is HOST TARGET binding site found in the 3' untranslated region of mRNA encoded by XRCC2, corresponding to a HOST TARGET binding site such as BINDING SITE I, BINDING SITE II or BINDING SITE III. Table 2 illustrates the complementarity of the nucleotide sequences of XRCC2 BINDING SITE, designated SEQ ID:11904, to the nucleotide sequence of VGAM2002 RNA, herein designated VGAM RNA, also designated SEQ ID:4713.

Another function of VGAM2002 is therefore inhibition of X-ray Repair Complementing Defective Repair In Chinese Hamster Cells 2 (XRCC2, Accession NM_005431), a gene which involves in the homologous recombination repair (hrr) pathway of double-stranded dna. Accordingly, utilities of VGAM2002 include diagnosis, prevention and treatment of diseases and clinical conditions associated with XRCC2. The function of XRCC2 and its association with various diseases and clinical conditions, has been established by previous studies, as described hereinabove with reference to VGAM241. FLJ20445 (Accession NM_017824) is another VGAM2002 host target gene. FLJ20445 BINDING SITE is HOST TARGET binding site found in the 3' untranslated region of mRNA encoded by FLJ20445, corresponding to a HOST TARGET binding site such as BINDING SITE I, BINDING SITE II or BINDING SITE III. Table 2 illustrates the complementarity of the nucleotide sequences of FLJ20445 BINDING SITE, designated SEQ ID:19475, to the nucleotide sequence of VGAM2002 RNA, herein designated VGAM RNA, also designated SEQ ID:4713.

Another function of VGAM2002 is therefore inhibition of FLJ20445 (Accession NM_017824). Accordingly, utilities of VGAM2002 include diagnosis, prevention and treatment of diseases and clinical conditions associated with FLJ20445. KIAA1328 (Accession XM_029429) is another VGAM2002 host target gene. KIAA1328 BINDING SITE is HOST TARGET binding site found in the 3' untranslated region of mRNA encoded by KIAA1328, corresponding to a HOST TARGET binding site such as BINDING SITE I, BINDING SITE II or BINDING SITE III. Table 2 illustrates the complementarity of the nucleotide sequences of KIAA1328 BINDING SITE, designated SEQ ID:30888, to the nucleotide sequence of VGAM2002 RNA, herein designated VGAM RNA, also designated SEQ ID:4713.

Another function of VGAM2002 is therefore inhibition of KIAA1328 (Accession XM_029429). Accordingly, utilities of VGAM2002 include diagnosis, prevention and treatment of diseases and clinical conditions associated with KIAA1328. KIAA1361 (Accession XM_030845) is another VGAM2002 host target gene. KIAA1361 BINDING SITE is HOST TARGET binding site found in the 5' untranslated region of mRNA encoded by KIAA1361, corresponding to a HOST TARGET binding site such as BINDING SITE I, BINDING SITE II or BINDING SITE III. Table 2 illustrates the complementarity of the nucleotide sequences of KIAA1361 BINDING SITE, designated SEQ ID:31170, to the nucleotide sequence of VGAM2002 RNA, herein designated VGAM RNA, also designated SEQ ID:4713.

Another function of VGAM2002 is therefore inhibition of KIAA1361 (Accession XM_030845). Accordingly, utilities of VGAM2002 include diagnosis, prevention and treatment of diseases and clinical conditions associated with KIAA1361. Rab11-FIP2 (Accession NM_014904) is another VGAM2002 host target gene. Rab11-FIP2 BINDING SITE is HOST TARGET binding site found in the 3' untranslated region of mRNA encoded by Rab11-FIP2, corresponding to a HOST TARGET binding site such as BINDING SITE I, BINDING SITE II or BINDING SITE III. Table 2 illustrates the complementarity of the nucleotide sequences of Rab11-FIP2 BINDING SITE, designated SEQ ID:17094, to the nucleotide sequence of VGAM2002 RNA, herein designated VGAM RNA, also designated SEQ ID:4713.

Another function of VGAM2002 is therefore inhibition of Rab11-FIP2 (Accession NM_014904). Accordingly, utilities of VGAM2002 include diagnosis, prevention and treatment of diseases and clinical conditions associated with Rab11-FIP2. LOC146136 (Accession XM_053737) is another VGAM2002 host target gene. LOC146136 BINDING SITE is HOST TARGET binding site found in the 5' untranslated region of mRNA encoded by LOC146136, corresponding to a HOST TARGET binding site such as BINDING SITE I, BINDING SITE II or BINDING SITE III. Table 2 illustrates the complementarity of the nucleotide sequences of LOC146136 BINDING SITE, designated SEQ ID:36110, to the nucleotide sequence of VGAM2002 RNA, herein designated VGAM RNA, also designated SEQ ID:4713.

Another function of VGAM2002 is therefore inhibition of LOC146136 (Accession XM_053737). Accordingly, utilities of VGAM2002 include diagnosis, prevention and treatment of diseases and clinical conditions associated with LOC146136. LOC150577 (Accession XM_097918) is another VGAM2002 host target gene. LOC150577 BINDING SITE is HOST TARGET binding site found in the 5' untranslated region of mRNA encoded by LOC150577, corresponding to a HOST TARGET binding site such as BINDING SITE I, BINDING SITE II or BINDING SITE III. Table 2 illustrates the complementarity of the nucleotide sequences of LOC150577 BINDING SITE, designated SEQ ID:41223, to the nucleotide sequence of VGAM2002 RNA, herein designated VGAM RNA, also designated SEQ ID:4713.

Another function of VGAM2002 is therefore inhibition of LOC150577 (Accession XM_097918). Accordingly, utilities of VGAM2002 include diagnosis, prevention and treatment of diseases and clinical conditions associated with LOC150577. LOC220565 (Accession XM_165417) is another VGAM2002 host target gene. LOC220565 BINDING SITE is HOST TARGET binding site found in the 3' untranslated region of mRNA encoded by LOC220565, corresponding to a HOST TARGET binding site such as BINDING SITE I, BINDING SITE II or BINDING SITE III. Table 2 illustrates the complementarity of the nucleotide sequences of LOC220565 BINDING SITE, designated SEQ ID:43629, to the nucleotide sequence of VGAM2002 RNA, herein designated VGAM RNA, also designated SEQ ID:4713.

Another function of VGAM2002 is therefore inhibition of LOC220565 (Accession XM_165417). Accordingly, utilities of VGAM2002 include diagnosis, prevention and treatment of diseases and clinical conditions associated with LOC220565. FIG. 1 further provides a conceptual description of a novel bioinformatically detected viral gene of the present invention, referred to here as Viral Genomic Address Messenger 2003 (VGAM2003) viral gene, which modulates expression of respective host target genes thereof, the function and utility of which host target genes is known in the art.

VGAM2003 is a novel bioinformatically detected regulatory, non protein coding, viral micro RNA (miRNA) gene. The method by which VGAM2003 was detected is described hereinabove with reference to FIGS. 1-8.

VGAM2003 gene, herein designated VGAM GENE, is a viral gene contained in the genome of Nipah Virus. VGAM2003 host target gene, herein designated VGAM HOST TARGET GENE, is a human gene contained in the human genome.

VGAM2003 gene encodes a VGAM2003 precursor RNA, herein designated VGAM PRECURSOR RNA. Similar to other miRNA genes, and unlike most ordinary genes, VGAM2003 precursor RNA does not encode a protein. A nucleotide sequence identical or highly similar to the nucleotide sequence of VGAM2003 precursor RNA is designated SEQ ID:1989, and is provided hereinbelow with reference to the sequence listing part. Nucleotide sequence SEQ ID:1989 is located at position 5319 relative to the genome of Nipah Virus.

VGAM2003 precursor RNA folds onto itself, forming VGAM2003 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2003 folded precursor RNA into VGAM2003 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2003 RNA is designated SEQ ID:4714, and is provided hereinbelow with reference to the sequence listing part.

VGAM2003 host target gene, herein designated VGAM HOST TARGET GENE, encodes a corresponding messenger RNA, VGAM2003 host target RNA, herein designated VGAM HOST TARGET RNA. VGAM2003 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2003 RNA, herein designated VGAM RNA, binds complementarily to one or more host target binding sites located in untranslated regions of VGAM2003 host target RNA, herein designated VGAM HOST TARGET RNA. This complementary binding is due to the fact that the nucleotide sequence of VGAM2003 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2003 RNA, herein designated VGAM RNA, may have a different number of host target binding sites in untranslated regions of a VGAM2003 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2003 RNA, herein designated VGAM RNA, to host target binding sites on VGAM2003 host target RNA, herein designated VGAM HOST TARGET RNA, such as BINDING SITE I, BINDING SITE II and BINDING SITE III, inhibits translation of VGAM2003 host target RNA into VGAM2003 host target protein, herein designated VGAM HOST TARGET PROTEIN. VGAM host target protein is therefore outlined by a broken line.

It is appreciated that VGAM2003 host target gene, herein designated VGAM HOST TARGET GENE, in fact represents a plurality of VGAM2003 host target genes. The mRNA of each one of this plurality of VGAM2003 host target genes comprises one or more host target binding sites, each having a nucleotide sequence which is at least partly complementary to VGAM2003 RNA, herein designated VGAM RNA, and which when bound by VGAM2003 RNA causes inhibition of translation of respective one or more VGAM2003 host target proteins.

It is further appreciated by one skilled in the art that the mode of translational inhibition illustrated by FIG. 1 with specific reference to translational inhibition exerted by VGAM2003 gene, herein designated VGAM GENE, on one or more VGAM2003 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2003 is inhibition of expression of host target genes, as part of a novel viral mechanism of attacking a host. Accordingly, utilities of VGAM2003 include diagnosis, prevention and treatment of viral infection by Nipah Virus. Specific functions, and accordingly utilities, of VGAM2003 correlate with, and may be deduced from, the identity of the host target genes which VGAM2003 binds and inhibits, and the function of these host target genes, as elaborated hereinbelow.

Nucleotide sequences of the VGAM2003 precursor RNA, herein designated VGAM PRECURSOR RNA, and of the 'diced' VGAM2003 RNA, herein designated VGAM RNA, and a schematic representation of the secondary folding of VGAM2003 folded precursor RNA, herein designated VGAM FOLDED PRECURSOR RNA, of VGAM2003 are further described hereinbelow with reference to Table 1.

Nucleotide sequences of host target binding sites, such as BINDING SITE-I, BINDING SITE-II and BINDING SITE-III of FIG. 1, found on VGAM2003 host target RNA, and schematic representation of the complementarity of each of these host target binding sites to VGAM2003 RNA, herein designated VGAM RNA, are described hereinbelow with reference to Table 2.

As mentioned hereinabove with reference to FIG. 1, a function of VGAM2003 gene, herein designated VGAM is inhibition of expression of VGAM2003 target genes. It is appreciated that specific functions, and accordingly utilities, of VGAM2003 correlate with, and may be deduced from, the identity of the target genes which VGAM2003 binds and inhibits, and the function of these target genes, as elaborated hereinbelow.

Ankyrin 3, Node of Ranvier (ankyrin G) (ANK3, Accession NM_020987) is a VGAM2003 host target gene. ANK3 BINDING SITE is HOST TARGET binding site found in the 3' untranslated region of mRNA encoded by ANK3, corresponding to a HOST TARGET binding site such as BINDING SITE I, BINDING SITE II or BINDING SITE III. Table 2 illustrates the complementarity of the nucleotide sequences of ANK3 BINDING SITE, designated SEQ ID:21983, to the nucleotide sequence of VGAM2003 RNA, herein designated VGAM RNA, also designated SEQ ID:4714.

A function of VGAM2003 is therefore inhibition of Ankyrin 3, Node of Ranvier (ankyrin G) (ANK3, Accession NM_020987), a gene which plays key roles in activities such as cell motility, activation, proliferation. Accordingly, utilities of VGAM2003 include diagnosis, prevention and treatment of diseases and clinical conditions associated with ANK3. The function of ANK3 and its association with various diseases and clinical conditions, has been established by previous studies, as described hereinabove with reference to VGAM1527. Adaptor-related Protein Complex 2, Beta 1 Subunit (AP2B1, Accession NM_001282) is another VGAM2003 host target gene. AP2B1 BINDING SITE is HOST TARGET binding site found in the 3' untranslated region of mRNA encoded by AP2B1, corresponding to a HOST TARGET binding site such as BINDING SITE I, BINDING SITE II or BINDING SITE III. Table 2 illustrates the complementarity of the nucleotide sequences of AP2B1 BINDING SITE, designated SEQ ID:6956, to the nucleotide sequence of VGAM2003 RNA, herein designated VGAM RNA, also designated SEQ ID:4714.

Another function of VGAM2003 is therefore inhibition of Adaptor-related Protein Complex 2, Beta 1 Subunit (AP2B1, Accession NM_001282), a gene which links clathrin to receptors in coated vesicles. Accordingly, utilities of VGAM2003 include diagnosis, prevention and treatment of diseases and clinical conditions associated with AP2B1. The function of AP2B1 and its association with various diseases and clinical conditions, has been established by previous studies, as described hereinabove with reference to VGAM1126. Beta-1,3-glucuronyltransferase 1 (glucuronosyltransferase P) (B3GAT1, Accession NM_054025) is another VGAM2003 host target gene. B3GAT1 BINDING SITE is HOST TARGET binding site found in the 5' untranslated region of mRNA encoded by B3GAT1, corresponding to a HOST TARGET binding site such as BINDING SITE I, BINDING SITE II or BINDING SITE III. Table 2 illustrates the complementarity of the nucleotide sequences of B3GAT1 BINDING SITE, designated SEQ ID:27632, to the nucleotide sequence of VGAM2003 RNA, herein designated VGAM RNA, also designated SEQ ID:4714.

Another function of VGAM2003 is therefore inhibition of Beta-1,3-glucuronyltransferase 1 (glucuronosyltransferase P) (B3GAT1, Accession NM_054025). Accordingly, utilities of VGAM2003 include diagnosis, prevention and treatment of diseases and clinical conditions associated with B3GAT1. Developmentally Regulated GTP Binding Protein 2 (DRG2, Accession NM_001388) is another VGAM2003 host target gene. DRG2 BINDING SITE is HOST TARGET binding site found in the 3' untranslated region of mRNA encoded by DRG2, corresponding to a HOST TARGET binding site such as BINDING SITE I, BINDING SITE II or BINDING SITE III. Table 2 illustrates the complementarity of the nucleotide sequences of DRG2 BINDING SITE, designated SEQ ID:7076, to the nucleotide sequence of VGAM2003 RNA, herein designated VGAM RNA, also designated SEQ ID:4714.

Another function of VGAM2003 is therefore inhibition of Developmentally Regulated GTP Binding Protein 2 (DRG2, Accession NM_001388), a gene which may play a role in cell proliferation, differentiation and death. Accordingly, utilities of VGAM2003 include diagnosis, prevention and treatment of diseases and clinical conditions associated with DRG2. The function of DRG2 has been established by previous studies. Using a subtractive hybridization strategy, Schenker et al. (1994) identified embryonic lung fibroblast cDNAs whose expression was selectively repressed in SV40-transformed cells. One cDNA encoded a predicted 364-amino acid protein that was designated DRG2. DRG2 contains the 5 sequence motifs that are conserved in all GTP-binding proteins. Northern blot analysis detected DRG2 expression as a major 2-kb and a minor 1.5-kb transcript in various tissues. The shorter mRNA appeared to result from use of an alternative polyadenylation site. By fluorescence in situ hybridization, Schenker and Trueb (1997) mapped the DRG2 gene to 17p13-p12. Vlangos et al. (2000) mapped the DRG2 gene to 17p11.2 within the Smith-Magenis syndrome critical region by somatic cell hybrid analysis.

Full details of the abovementioned studies are described in the following publications, the disclosure of which are hereby incorporated by reference:

Schenker, T.; Lach, C.; Kessler, B.; Calderara, S.; Trueb, B.: A novel GTP-binding protein which is selectively repressed in SV40 transformed fibroblasts. J. Biol. Chem. 269:25447-25453, 1994; and Vlangos, C. N.; Das, P.; Patel, P. I.; Elsea, S. H.: Assignment of developmentally regulated GTP-binding protein (DRG2) to human chromosome band 17p11.2 with somatic cell hybrids and 1.

Further studies establishing the function and utilities of DRG2 are found in John Hopkins OMIM database record ID 602986, and in sited publications numbered 122 and 8846 listed in the bibliography section hereinbelow, which are also hereby incorporated by reference. GM2 Ganglioside Activator Protein (GM2A, Accession XM_041978) is another VGAM2003 host target gene. GM2A BINDING SITE is HOST TARGET binding site found in the 3" untranslated region of mRNA encoded by GM2A, corresponding to a HOST TARGET binding site such as BINDING SITE I, BINDING SITE II or BINDING SITE III. Table 2 illustrates the complementarity of the nucleotide sequences of GM2A BINDING SITE, designated SEQ ID:33661, to the nucleotide sequence of VGAM2003 RNA, herein designated VGAM RNA, also designated SEQ ID:4714.

Another function of VGAM2003 is therefore inhibition of GM2 Ganglioside Activator Protein (GM2A, Accession XM_041978). Accordingly, utilities of VGAM2003 include diagnosis, prevention and treatment of diseases and clinical conditions associated with GM2A. GRAF (Accession NM_015071) is another VGAM2003 host target gene. GRAF BINDING SITE is HOST TARGET binding site found in the 3' untranslated region of mRNA encoded by GRAF, corresponding to a HOST TARGET binding site such as BINDING SITE I, BINDING SITE II or BINDING SITE III. Table 2 illustrates the complementarity of the nucleotide sequences of GRAF BINDING SITE, designated SEQ ID:17443, to the nucleotide sequence of VGAM2003 RNA, herein designated VGAM RNA, also designated SEQ ID:4714.

Another function of VGAM2003 is therefore inhibition of GRAF (Accession NM_015071), a gene which ia a GTPase activating protein for p21-rac. Accordingly, utilities of VGAM2003 include diagnosis, prevention and treatment of diseases and clinical conditions associated with GRAF. The function of GRAF and its association with various diseases and clinical conditions, has been established by previous studies, as described hereinabove with reference to VGAM430. MAX Gene Associated (MGA, Accession XM_031689) is another VGAM2003 host target gene. MGA BINDING SITE is HOST TARGET binding site found in the 3' untranslated region of mRNA encoded by MGA, corresponding to a HOST TARGET binding site such as BINDING SITE I, BINDING SITE II or BINDING SITE III. Table 2 illustrates the complementarity of the nucleotide sequences of MGA BINDING SITE, designated SEQ ID:31454, to the nucleotide sequence of VGAM2003 RNA, herein designated VGAM RNA, also designated SEQ ID:4714.

Another function of VGAM2003 is therefore inhibition of MAX Gene Associated (MGA, Accession XM_031689), a gene which plays a role in the final steps of digestion of starch. Accordingly, utilities of VGAM2003 include diagnosis, prevention and treatment of diseases and clinical conditions associated with MGA. The function of MGA has been established by previous studies. Maltase-glucoamylase (MGA; EC 3.2.1.20) is a brush border membrane enzyme that plays a role in the final steps of digestion of starch. Naim et al. (1988) showed that it is synthesized as a single-chain polypeptide precursor, acquires N- and O-linked carbohydrates, and does not undergo intracellular or extracellular proteolytic cleavage. Nichols et al. (1998) purified and partially sequenced the human maltase-glucoamylase protein. By RT-PCR using degenerate oligonucleotides based on the MGA protein sequence, they isolated human small intestine MGA cDNAs. The deduced 1,857-amino acid MGA protein has a putative type II membrane anchor, 2 WIDMNE catalytic sites, which are characteristic of carbohydrate hydrolases such as sucrase-isomaltase (SI; 222900), and 2 glycosyl hydrolase family 31 signature 2 sequences. MGA also has 19 potential N-glycosylation sites and 253 potential O-glycosylation sites. The MGA protein shares 59% sequence identity with SI. RT-PCR detected MGA expression in human small intestine, granulocyte, and kidney but not in salivary gland or pancreas.

Full details of the abovementioned studies are described in the following publications, the disclosure of which are hereby incorporated by reference:

Naim, H. Y.; Sterchi, E. E.; Lentze, M. J.: Structure, biosynthesis, and glycosylation of human small intestinal maltase-glucoamylase. J. Biol. Chem. 263:19709-19717, 1988; and Nichols, B. L.; Eldering, J.; Avery, S.; Hahn, D.; Quaroni, A.; Sterchi, E.: Human small intestinal maltase-glucoamylase cDNA cloning: homology to sucrase-isomaltase. J. Biol. Chem. 273:3.

Further studies establishing the function and utilities of MGA are found in John Hopkins OMIM database record ID 154360, and in sited publications numbered 12706-12708 listed in the bibliography section hereinbelow, which are also hereby incorporated by reference. Neuroligin 2 (NLGN2, Accession XM_113932) is another VGAM2003 host target gene. NLGN2 BINDING SITE is HOST TARGET binding site found in the 3' untranslated region of mRNA encoded by NLGN2, corresponding to a HOST TARGET binding site such as BINDING SITE I, BINDING SITE II or BINDING SITE III. Table 2 illustrates the complementarity of the nucleotide sequences of NLGN2 BINDING SITE, designated SEQ ID:42550, to the nucleotide sequence of VGAM2003 RNA, herein designated VGAM RNA, also designated SEQ ID:4714.

Another function of VGAM2003 is therefore inhibition of Neuroligin 2 (NLGN2, Accession XM_113932), a gene which rapidly hydrolyzes choline released into the synapse. Accordingly, utilities of VGAM2003 include diagnosis, prevention and treatment of diseases and clinical conditions associated with NLGN2. The function of NLGN2 and its association with various diseases and clinical conditions, has been established by previous studies, as described hereinabove with reference to VGAM178. Nebulin-related Anchoring Protein (NRAP, Accession NM_006175) is another VGAM2003 host target gene. NRAP BINDING SITE is HOST TARGET binding site found in the 3' untranslated region of mRNA encoded by NRAP, corresponding to a HOST TARGET binding site such as BINDING SITE I, BINDING SITE II or BINDING SITE III. Table 2 illustrates the complementarity of the nucleotide sequences of NRAP BINDING SITE, designated SEQ ID:12834, to the nucleotide sequence of VGAM2003 RNA, herein designated VGAM RNA, also designated SEQ ID:4714.

Another function of VGAM2003 is therefore inhibition of Nebulin-related Anchoring Protein (NRAP, Accession NM_006175), a gene which performs an anchoring function to link the terminal actin filaments of myofibrils to protein complexes located beneath the sarcolemma. Accordingly, utilities of VGAM2003 include diagnosis, prevention and treatment of diseases and clinical conditions associated with NRAP. The function of NRAP and its association with various diseases and clinical conditions, has been established by previous studies, as described hereinabove with reference to VGAM649. Ret Proto-oncogene (multiple endocrine neoplasia and medullary thyroid carcinoma 1, Hirschsprung disease) (RET, Accession NM_020630) is another VGAM2003 host target gene. RET BINDING SITE is HOST TARGET binding site found in the 3' untranslated region of mRNA encoded by RET, corresponding to a HOST TARGET binding site such as BINDING SITE I, BINDING SITE II or BINDING SITE III. Table 2 illustrates the complementarity of the nucleotide sequences of RET BINDING SITE, designated SEQ ID:21785, to the nucleotide sequence of VGAM2003 RNA, herein designated VGAM RNA, also designated SEQ ID:4714.

Another function of VGAM2003 is therefore inhibition of Ret Proto-oncogene (multiple endocrine neoplasia and medullary thyroid carcinoma 1, Hirschsprung disease) (RET, Accession NM_020630), a gene which transduces signals for cell growth and differentiation. Accordingly, utilities of VGAM2003 include diagnosis, prevention and treatment of diseases and clinical conditions associated with RET. The function of RET and its association with various diseases and clinical conditions, has been established by previous studies, as described hereinabove with reference to VGAM381. Tumor Necrosis Factor (ligand) Superfamily, Member 11 (TNFSF11, Accession NM_033012) is another VGAM2003 host target gene. TNFSF11 BINDING SITE1 and TNFSF11 BINDING SITE2 are HOST TARGET binding sites found in untranslated regions of mRNA encoded by TNFSF11, corresponding to HOST TARGET binding sites such as BINDING SITE I, BINDING SITE II or BINDING SITE III. Table 2 illustrates the complementarity of the nucleotide sequences of TNFSF11 BINDING SITE1 and TNFSF11 BINDING SITE2, designated SEQ ID:26898 and SEQ ID:9801 respectively, to the nucleotide sequence of VGAM2003 RNA, herein designated VGAM RNA, also designated SEQ ID:4714.

Another function of VGAM2003 is therefore inhibition of Tumor Necrosis Factor (ligand) Superfamily, Member 11 (TNFSF11, Accession NM_033012), a gene which may be an important regulator of interactions between t cells and dendritic cells and may play a may play a role in the regulation of the t cell-dependent immune response. may also play an important role in enhanced bone-resorption in humoral hypercalcemia of malignancy. Accordingly, utilities of VGAM2003 include diagnosis, prevention and treatment of diseases and clinical conditions associated with TNFSF11. The function of TNFSF11 has been established by previous studies. Croucher et al. (2001) demonstrated that myeloma cells express the critical osteoclastogenic factor RANKL. Injection of myeloma cells into a C57BL strain of mice resulted in development of bone disease characterized by a significant decrease in cancellous bone volume in the tibial and femoral metaphyses, an increase in osteoclast formation, and radiologic evidence of osteolytic bone lesions. Treatment of mice with established myeloma with recombinant OPG protein, the soluble decoy receptor for RANKL, prevented the development of lytic bone lesions. OPG treatment was associated with preservation of cancellous bone volume and inhibition of osteoclast formation. OPG also promoted an increase in femoral, tibial, and vertebral BMD. The data suggested that the RANKL/RANK/OPG system may play a critical role in the development of osteolytic bone disease in multiple myeloma and that targeting this system may have therapeutic potential. Takayanagi et al. (2002) demonstrated that RANKL induces the IFN-beta (OMIM Ref. No. 147640) gene in osteoclast precursor cells, and that IFN-beta inhibits the differentiation of osteoclasts by interfering with the RANKL-induced expression of c-Fos (OMIM Ref. No. 164810), an essential transcription factor for the formation of osteoclasts. This IFN-beta gene induction mechanism is distinct from that induced by virus, and is dependent on c-Fos itself. Thus an autoregulatory mechanism operates--the RANKL-induced c-Fos induces its own inhibitor. The importance of this regulatory mechanism for bone homeostasis is emphasized by the observation that mice deficient in IFN-beta signaling exhibit severe osteopenia accompanied by enhanced osteoclastogenesis.

Full details of the abovementioned studies are described in the following publications, the disclosure of which are hereby incorporated by reference:

Croucher, P. I.; Shipman, C. M.; Lippitt, J.; Perry, M.; Asosingh, K.; Hijzen, A.; Brabbs, A. C.; van Beek, E. J. R.; Holen, I.; Skerry, T. M.; Dunstan, C. R.; Russell, G. R.; Van Camp, B.; Vanderkerken, K.: Osteoprotegerin inhibits the development of osteolytic bone disease in multiple myeloma. Blood 98:3534-3540, 2001; and Fata, J. E.; Kong, Y.-Y.; Li, J.; Sasaki, T.; Irie-Sasaki, J.; Moorehead, R. A.; Elliott, R.; Scully, S.; Voura, E. B.; Lacey, D. L.; Boyle, W. J.; Khokha, R.; Penninger, J. M.: The o.

Further studies establishing the function and utilities of TNFSF11 are found in John Hopkins OMIM database record ID 602642, and in sited publications numbered 2390-2396, 1147 and 8538 listed in the bibliography section hereinbelow, which are also hereby incorporated by reference. Chromosome 20 Open Reading Frame 142 (C20orf142, Accession XM_059257) is another VGAM2003 host target gene. C20orf142 BINDING SITE is HOST TARGET binding site found in the 3' untranslated region of mRNA encoded by C20orf142, corresponding to a HOST TARGET binding site such as BINDING SITE I, BINDING SITE II or BINDING SITE III. Table 2 illustrates the complementarity of the nucleotide sequences of C20orf142 BINDING SITE, designated SEQ ID:36931, to the nucleotide sequence of VGAM2003 RNA, herein designated VGAM RNA, also designated SEQ ID:4714.

Another function of VGAM2003 is therefore inhibition of Chromosome 20 Open Reading Frame 142 (C20orf142, Accession XM_059257). Accordingly, utilities of VGAM2003 include diagnosis, prevention and treatment of diseases and clinical conditions associated with C20orf142. DKFZP564O0423 (Accession XM_166254) is another VGAM2003 host target gene. DKFZP564O0423 BINDING SITE is HOST TARGET binding site found in the 3' untranslated region of mRNA encoded by DKFZP564O0423, corresponding to a HOST TARGET binding site such as BINDING SITE I, BINDING SITE II or BINDING SITE III. Table 2 illustrates the complementarity of the nucleotide sequences of DKFZP564O0423 BINDING SITE, designated SEQ ID:44068, to the nucleotide sequence of VGAM2003 RNA, herein designated VGAM RNA, also designated SEQ ID:4714.

Another function of VGAM2003 is therefore inhibition of DKFZP564O0423 (Accession XM_166254). Accordingly, utilities of VGAM2003 include diagnosis, prevention and treatment of diseases and clinical conditions associated with DKFZP564O0423. FLJ20232 (Accession NM_019008) is another VGAM2003 host target gene. FLJ20232 BINDING SITE is HOST TARGET binding site found in the 3' untranslated region of mRNA encoded by FLJ20232, corresponding to a HOST TARGET binding site such as BINDING SITE I, BINDING SITE II or BINDING SITE III. Table 2 illustrates the complementarity of the nucleotide sequences of FLJ20232 BINDING SITE, designated SEQ ID:21088, to the nucleotide sequence of VGAM2003 RNA, herein designated VGAM RNA, also designated SEQ ID:4714.

Another function of VGAM2003 is therefore inhibition of FLJ20232 (Accession NM_019008). Accordingly, utilities of VGAM2003 include diagnosis, prevention and treatment of diseases and clinical conditions associated with FLJ20232. FLJ20686 (Accession NM_017925) is another VGAM2003 host target gene. FLJ20686 BINDING SITE is HOST TARGET binding site found in the 3' untranslated region of mRNA encoded by FLJ20686, corresponding to a HOST TARGET binding site such as BINDING SITE I, BINDING SITE II or BINDING SITE III. Table 2 illustrates the complementarity of the nucleotide sequences of FLJ20686 BINDING SITE, designated SEQ ID:19594, to the nucleotide sequence of VGAM2003 RNA, herein designated VGAM RNA, also designated SEQ ID:4714.

Another function of VGAM2003 is therefore inhibition of FLJ20686 (Accession NM_017925). Accordingly, utilities of VGAM2003 include diagnosis, prevention and treatment of diseases and clinical conditions associated with FLJ20686. FLJ22501 (Accession NM_024747) is another VGAM2003 host target gene. FLJ22501 BINDING SITE is HOST TARGET binding site found in the 5' untranslated region of mRNA encoded by FLJ22501, corresponding to a HOST TARGET binding site such as BINDING SITE I, BINDING SITE II or BINDING SITE III. Table 2 illustrates the complementarity of the nucleotide sequences of FLJ22501 BINDING SITE, designated SEQ ID:24082, to the nucleotide sequence of VGAM2003 RNA, herein designated VGAM RNA, also designated SEQ ID:4714.

Another function of VGAM2003 is therefore inhibition of FLJ22501 (Accession NM_024747). Accordingly, utilities of VGAM2003 include diagnosis, prevention and treatment of diseases and clinical conditions associated with FLJ22501. FLJ23120 (Accession XM_097961) is another VGAM2003 host target gene. FLJ23120 BINDING SITE is HOST TARGET binding site found in the 3' untranslated region of mRNA encoded by FLJ23120, corresponding to a HOST TARGET binding site such as BINDING SITE I, BINDING SITE II or BINDING SITE III. Table 2 illustrates the complementarity of the nucleotide sequences of FLJ23120 BINDING SITE, designated SEQ ID:41265, to the nucleotide sequence of VGAM2003 RNA, herein designated VGAM RNA, also designated SEQ ID:4714.

Another function of VGAM2003 is therefore inhibition of FLJ23120 (Accession XM_097961). Accordingly, utilities of VGAM2003 include diagnosis, prevention and treatment of diseases and clinical conditions associated with FLJ23120. FLJ23309 (Accession NM_024896) is another VGAM2003 host target gene. FLJ23309 BINDING SITE is HOST TARGET binding site found in the 3' untranslated region of mRNA encoded by FLJ23309, corresponding to a HOST TARGET binding site such as BINDING SITE I, BINDING SITE II or BINDING SITE III. Table 2 illustrates the complementarity of the nucleotide sequences of FLJ23309 BINDING SITE, designated SEQ ID:24379, to the nucleotide sequence of VGAM2003 RNA, herein designated VGAM RNA, also designated SEQ ID:4714.

Another function of VGAM2003 is therefore inhibition of FLJ23309 (Accession NM_024896). Accordingly, utilities of VGAM2003 include diagnosis, prevention and treatment of diseases and clinical conditions associated with FLJ23309. FLJ25438 (Accession NM_144696) is another VGAM2003 host target gene. FLJ25438 BINDING SITE is HOST TARGET binding site found in the 3' untranslated region of mRNA encoded by FLJ25438, corresponding to a HOST TARGET binding site such as BINDING SITE I, BINDING SITE II or BINDING SITE III. Table 2 illustrates the complementarity of the nucleotide sequences of FLJ25438 BINDING SITE, designated SEQ ID:29521, to the nucleotide sequence of VGAM2003 RNA, herein designated VGAM RNA, also designated SEQ ID:4714.

Another function of VGAM2003 is therefore inhibition of FLJ25438 (Accession NM_144696). Accordingly, utilities of VGAM2003 include diagnosis, prevention and treatment of diseases and clinical conditions associated with FLJ25438. Kruppel-like Factor 5 (intestinal) (KLF5, Accession NM_001730) is another VGAM2003 host target gene. KLF5 BINDING SITE is HOST TARGET binding site found in the 3' untranslated region of mRNA encoded by KLF5, corresponding to a HOST TARGET binding site such as BINDING SITE I, BINDING SITE II or BINDING SITE III. Table 2 illustrates the complementarity of the nucleotide sequences of KLF5 BINDING SITE, designated SEQ ID:7464, to the nucleotide sequence of VGAM2003 RNA, herein designated VGAM RNA, also designated SEQ ID:4714.

Another function of VGAM2003 is therefore inhibition of Kruppel-like Factor 5 (intestinal) (KLF5, Accession NM_001730). Accordingly, utilities of VGAM2003 include diagnosis, prevention and treatment of diseases and clinical conditions associated with KLF5. PRO0659 (Accession NM_014138) is another VGAM2003 host target gene. PRO0659 BINDING SITE is HOST TARGET binding site found in the 3' untranslated region of mRNA encoded by PRO0659, corresponding to a HOST TARGET binding site such as BINDING SITE I, BINDING SITE II or BINDING SITE III. Table 2 illustrates the complementarity of the nucleotide sequences of PRO0659 BINDING SITE, designated SEQ ID:15407, to the nucleotide sequence of VGAM2003 RNA, herein designated VGAM RNA, also designated SEQ ID:4714.

Another function of VGAM2003 is therefore inhibition of PRO0659 (Accession NM_014138). Accordingly, utilities of VGAM2003 include diagnosis, prevention and treatment of diseases and clinical conditions associated with PRO0659. LOC144453 (Accession XM_084869) is another VGAM2003 host target gene. LOC144453 BINDING SITE is HOST TARGET binding site found in the 3' untranslated region of mRNA encoded by LOC144453, corresponding to a HOST TARGET binding site such as BINDING SITE I, BINDING SITE II or BINDING SITE III. Table 2 illustrates the complementarity of the nucleotide sequences of LOC144453 BINDING SITE, designated SEQ ID:37748, to the nucleotide sequence of VGAM2003 RNA, herein designated VGAM RNA, also designated SEQ ID:4714.

Another function of VGAM2003 is therefore inhibition of LOC144453 (Accession XM_084869). Accordingly, utilities of VGAM2003 include diagnosis, prevention and treatment of diseases and clinical conditions associated with LOC144453. LOC148223 (Accession XM_086101) is another VGAM2003 host target gene. LOC148223 BINDING SITE is HOST TARGET binding site found in the 3' untranslated region of mRNA encoded by LOC148223, corresponding to a HOST TARGET binding site such as BINDING SITE I, BINDING SITE II or BINDING SITE III. Table 2 illustrates the complementarity of the nucleotide sequences of LOC148223 BINDING SITE, designated SEQ ID:38495, to the nucleotide sequence of VGAM2003 RNA, herein designated VGAM RNA, also designated SEQ ID:4714.

Another function of VGAM2003 is therefore inhibition of LOC148223 (Accession XM_086101). Accordingly, utilities of VGAM2003 include diagnosis, prevention and treatment of diseases and clinical conditions associated with LOC148223. LOC158819 (Accession XM_098995) is another VGAM2003 host target gene. LOC158819 BINDING SITE is HOST TARGET binding site found in the 5' untranslated region of mRNA encoded by LOC158819, corresponding to a HOST TARGET binding site such as BINDING SITE I, BINDING SITE II or BINDING SITE III. Table 2 illustrates the complementarity of the nucleotide sequences of LOC158819 BINDING SITE, designated SEQ ID:42027, to the nucleotide sequence of VGAM2003 RNA, herein designated VGAM RNA, also designated SEQ ID:4714.

Another function of VGAM2003 is therefore inhibition of LOC158819 (Accession XM_098995). Accordingly, utilities of VGAM2003 include diagnosis, prevention and treatment of diseases and clinical conditions associated with LOC158819. LOC202934 (Accession XM_117486) is another VGAM2003 host target gene. LOC202934 BINDING SITE is HOST TARGET binding site found in the 3' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43462, to the nucleotide sequence of VGAM2003 RNA, herein designated VGAM RNA, also designated SEQ ID:4714.

Another function of VGAM2003 is therefore inhibition of LOC202934 (Accession XM_117486). Accordingly, utilities of VGAM2003 include diagnosis, prevention and treatment of diseases and clinical conditions associated with LOC202934. LOC206426 (Accession XM_116505) is another VGAM2003 host target gene. LOC206426 BINDING SITE is HOST TARGET binding site found in the 3' untranslated region of mRNA encoded by LOC206426, corresponding to a HOST TARGET binding site such as BINDING SITE I, BINDING SITE II or BINDING SITE III. Table 2 illustrates the complementarity of the nucleotide sequences of LOC206426 BINDING SITE, designated SEQ ID:43118, to the nucleotide sequence of VGAM2003 RNA, herein designated VGAM RNA, also designated SEQ ID:4714.

Another function of VGAM2003 is therefore inhibition of LOC206426 (Accession XM_116505). Accordingly, utilities of VGAM2003 include diagnosis, prevention and treatment of diseases and clinical conditions associated with LOC206426. LOC255465 (Accession XM_173206) is another VGAM2003 host target gene. LOC255465 BINDING SITE is HOST TARGET binding site found in the 3' untranslated region of mRNA encoded by LOC255465, corresponding to a HOST TARGET binding site such as BINDING SITE I, BINDING SITE II or BINDING SITE III. Table 2 illustrates the complementarity of the nucleotide sequences of LOC255465 BINDING SITE, designated SEQ ID:46454, to the nucleotide sequence of VGAM2003 RNA, herein designated VGAM RNA, also designated SEQ ID:4714.

Another function of VGAM2003 is therefore inhibition of LOC255465 (Accession XM_173206). Accordingly, utilities of VGAM2003 include diagnosis, prevention and treatment of diseases and clinical conditions associated with LOC255465. FIG. 1 further provides a conceptual description of a novel bioinformatically detected viral gene of the present invention, referred to here as Viral Genomic Address Messenger 2004 (VGAM2004) viral gene, which modulates expression of respective host target genes thereof, the function and utility of which host target genes is known in the art.

VGAM2004 is a novel bioinformatically detected regulatory, non protein coding, viral micro RNA (miRNA) gene. The method by which VGAM2004 was detected is described hereinabove with reference to FIGS. 1-8.

VGAM2004 gene, herein designated VGAM GENE, is a viral gene contained in the genome of Chimpanzee Cytomegalovirus. VGAM2004 host target gene, herein designated VGAM HOST TARGET GENE, is a human gene contained in the human genome.

VGAM2004 gene encodes a VGAM2004 precursor RNA, herein designated VGAM PRECURSOR RNA. Similar to other miRNA genes, and unlike most ordinary genes, VGAM2004 precursor RNA does not encode a protein. A nucleotide sequence identical or highly similar to the nucleotide sequence of VGAM2004 precursor RNA is designated SEQ ID:1990, and is provided hereinbelow with reference to the sequence listing part. Nucleotide sequence SEQ ID:1990 is located at position 177784 relative to the genome of Chimpanzee Cytomegalovirus.

VGAM2004 precursor RNA folds onto itself, forming VGAM2004 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2004 folded precursor RNA into VGAM2004 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2004 RNA is designated SEQ ID:4715, and is provided hereinbelow with reference to the sequence listing part.

VGAM2004 host target gene, herein designated VGAM HOST TARGET GENE, encodes a corresponding messenger RNA, VGAM2004 host target RNA, herein designated VGAM HOST TARGET RNA. VGAM2004 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2004 RNA, herein designated VGAM RNA, binds complementarily to one or more host target binding sites located in untranslated regions of VGAM2004 host target RNA, herein designated VGAM HOST TARGET RNA. This complementary binding is due to the fact that the nucleotide sequence of VGAM2004 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2004 RNA, herein designated VGAM RNA, may have a different number of host target binding sites in untranslated regions of a VGAM2004 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2004 RNA, herein designated VGAM RNA, to host target binding sites on VGAM2004 host target RNA, herein designated VGAM HOST TARGET RNA, such as BINDING SITE I, BINDING SITE II and BINDING SITE III, inhibits translation of VGAM2004 host target RNA into VGAM2004 host target protein, herein designated VGAM HOST TARGET PROTEIN. VGAM host target protein is therefore outlined by a broken line.

It is appreciated that VGAM2004 host target gene, herein designated VGAM HOST TARGET GENE, in fact represents a plurality of VGAM2004 host target genes. The mRNA of each one of this plurality of VGAM2004 host target genes comprises one or more host target binding sites, each having a nucleotide sequence which is at least partly complementary to VGAM2004 RNA, herein designated VGAM RNA, and which when bound by VGAM2004 RNA causes inhibition of translation of respective one or more VGAM2004 host target proteins.

It is further appreciated by one skilled in the art that the mode of translational inhibition illustrated by FIG. 1 with specific reference to translational inhibition exerted by VGAM2004 gene, herein designated VGAM GENE, on one or more VGAM2004 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM2004 is inhibition of expression of host target genes, as part of a novel viral mechanism of attacking a host. Accordingly, utilities of VGAM2004 include diagnosis, prevention and treatment of viral infection by Chimpanzee Cytomegalovirus. Specific functions, and accordingly utilities, of VGAM2004 correlate with, and may be deduced from, the identity of the host target genes which VGAM2004 binds and inhibits, and the function of these host target genes, as elaborated hereinbelow.

Nucleotide sequences of the VGAM2004 precursor RNA, herein designated VGAM PRECURSOR RNA, and of the ‘diced’ VGAM2004 RNA, herein designated VGAM RNA, and a schematic representation of the secondary folding of VGAM2004 folded precursor RNA, herein designated VGAM FOLDED PRECURSOR RNA, of VGAM2004 are further described hereinbelow with reference to Table 1.

Nucleotide sequences of host target binding sites, such as BINDING SITE-I, BINDING SITE-II and BINDING SITE-III of FIG. 1, found on VGAM2004 host target RNA, and schematic representation of the complementarity of each of these host target binding sites to VGAM2004 RNA, herein designated VGAM RNA, are described hereinbelow with reference to Table 2.

As mentioned hereinabove with reference to FIG. 1, a function of VGAM2004 gene, herein designated VGAM is inhibition of expression of VGAM2004 target genes. It is appreciated that specific functions, and accordingly utilities, of VGAM2004 correlate with, and may be deduced from, the identity of the target genes which VGAM2004 binds and inhibits, and the function of these target genes, as elaborated hereinbelow.

G Protein-coupled Receptor 61 (GPR61, Accession XM_086232) is a VGAM2004 host target gene. GPR61 BINDING SITE is HOST TARGET binding site found in the 3' untranslated region of mRNA encoded by GPR61, corresponding to a HOST TARGET binding site such as BINDING SITE I, BINDING SITE II or BINDING SITE III. Table 2 illustrates the complementarity of the nucleotide sequences of GPR61 BINDING SITE, designated SEQ ID:38564, to the nucleotide sequence of VGAM2004 RNA, herein designated VGAM RNA, also designated SEQ ID:4715.

A function of VGAM2004 is therefore inhibition of G Protein-coupled Receptor 61 (GPR61, Accession XM_086232), a gene which transduces extracellular signals through heterotrimeric G proteins. Accordingly, utilities of VGAM2004 include diagnosis, prevention and treatment of diseases and clinical conditions associated with GPR61. The function of GPR61 and its association with various diseases and clinical conditions, has been established by previous studies, as described hereinabove with reference to VGAM1958. FIG. 1 further provides a conceptual description of a novel bioinformatically detected viral gene of the present invention, referred to here as Viral Genomic Address Messenger 2005 (VGAM2005) viral gene, which modulates expression of respective host target genes thereof, the function and utility of which host target genes is known in the art.

VGAM2005 is a novel bioinformatically detected regulatory, non protein coding, viral micro RNA (miRNA) gene. The method by which VGAM2005 was detected is described hereinabove with reference to FIGS. 1-8.

VGAM2005 gene, herein designated VGAM GENE, is a viral gene contained in the genome of Chimpanzee Cytomegalovirus. VGAM2005 host target gene, herein designated VGAM HOST TARGET GENE, is a human gene contained in the human genome.

VGAM2005 gene encodes a VGAM2005 precursor RNA, herein designated VGAM PRECURSOR RNA. Similar to other miRNA genes, and unlike most ordinary genes, VGAM2005 precursor RNA does not encode a protein. A nucleotide sequence identical or highly similar to the nucleotide sequence of VGAM2005 precursor RNA is designated SEQ ID:1991, and is provided hereinbelow with reference to the sequence listing part. Nucleotide sequence SEQ ID:1991 is located at position 177914 relative to the genome of Chimpanzee Cytomegalovirus.

VGAM2005 precursor RNA folds onto itself, forming VGAM2005 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2005 folded precursor RNA into VGAM2005 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 80%) nucleotide sequence of VGAM2005 RNA is designated SEQ ID:4716, and is provided hereinbelow with reference to the sequence listing part.

VGAM2005 host target gene, herein designated VGAM HOST TARGET GENE, encodes a corresponding messenger RNA, VGAM2005 host target RNA, herein designated VGAM HOST TARGET RNA. VGAM2005 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2005 RNA, herein designated VGAM RNA, binds complementarily to one or more host target binding sites located in untranslated regions of VGAM2005 host target RNA, herein designated VGAM HOST TARGET RNA. This complementary binding is due to the fact that the nucleotide sequence of VGAM2005 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2005 RNA, herein designated VGAM RNA, may have a different number of host target binding sites in untranslated regions of a VGAM2005 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2005 RNA, herein designated VGAM RNA, to host target binding sites on VGAM2005 host target RNA, herein designated VGAM HOST TARGET RNA, such as BINDING SITE I, BINDING SITE II and BINDING SITE III, inhibits translation of VGAM2005 host target RNA into VGAM2005 host target protein, herein designated VGAM HOST TARGET PROTEIN. VGAM host target protein is therefore outlined by a broken line.

It is appreciated that VGAM2005 host target gene, herein designated VGAM HOST TARGET GENE, in fact represents a plurality of VGAM2005 host target genes. The mRNA of each one of this plurality of VGAM2005 host target genes comprises one or more host target binding sites, each having a nucleotide sequence which is at least partly complementary to VGAM2005 RNA, herein designated VGAM RNA, and which when bound by VGAM2005 RNA causes inhibition of translation of respective one or more VGAM2005 host target proteins.

It is further appreciated by one skilled in the art that the mode of translational inhibition illustrated by FIG. 1 with specific reference to translational inhibition exerted by VGAM2005 gene, herein designated VGAM GENE, on one or more VGAM2005 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2005 is inhibition of expression of host target genes, as part of a novel viral mechanism of attacking a host. Accordingly, utilities of VGAM2005 include diagnosis, prevention and treatment of viral infection by Chimpanzee Cytomegalovirus. Specific functions, and accordingly utilities, of VGAM2005 correlate with, and may be deduced from, the identity of the host target genes which VGAM2005 binds and inhibits, and the function of these host target genes, as elaborated hereinbelow.

Nucleotide sequences of the VGAM2005 precursor RNA, herein designated VGAM PRECURSOR RNA, and of the 'diced' VGAM2005 RNA, herein designated VGAM RNA, and a schematic representation of the secondary folding of VGAM2005 folded precursor RNA, herein designated VGAM FOLDED PRECURSOR RNA, of VGAM2005 are further described hereinbelow with reference to Table 1.

Nucleotide sequences of host target binding sites, such as BINDING SITE-I, BINDING SITE-II and BINDING SITE-III of FIG. 1, found on VGAM2005 host target RNA, and schematic representation of the complementarity of each of these host target binding sites to VGAM2005 RNA, herein designated VGAM RNA, are described hereinbelow with reference to Table 2.

As mentioned hereinabove with reference to FIG. 1, a function of VGAM2005 gene, herein designated VGAM is inhibition of expression of VGAM2005 target genes. It is appreciated that specific functions, and accordingly utilities, of VGAM2005 correlate with, and may be deduced from, the identity of the target genes which VGAM2005 binds and inhibits, and the function of these target genes, as elaborated hereinbelow.

V-akt Murine Thymoma Viral Oncogene Homolog 2 (AKT2, Accession NM_001626) is a VGAM2005 host target gene. AKT2 BINDING SITE is HOST TARGET binding site found in the 5' untranslated region of mRNA encoded by AKT2, corresponding to a HOST TARGET binding site such as BINDING SITE I, BINDING SITE II or BINDING SITE III. Table 2 illustrates the complementarity of the nucleotide sequences of AKT2 BINDING SITE, designated SEQ ID:7338, to the nucleotide sequence of VGAM2005 RNA, herein designated VGAM RNA, also designated SEQ ID:4716.

A function of VGAM2005 is therefore inhibition of V-akt Murine Thymoma Viral Oncogene Homolog 2 (AKT2, Accession NM_001626). Accordingly, utilities of VGAM2005 include diagnosis, prevention and treatment of diseases and clinical conditions associated with AKT2. Tec Protein Tyrosine Kinase (TEC, Accession NM_003215) is another VGAM2005 host target gene. TEC BINDING SITE is HOST TARGET binding site found in the 3' untranslated region of mRNA encoded by TEC, corresponding to a HOST TARGET binding site such as BINDING SITE I, BINDING SITE II or BINDING SITE III. Table 2 illustrates the complementarity of the nucleotide sequences of TEC BINDING SITE, designated SEQ ID:9218, to the nucleotide sequence of VGAM2005 RNA, herein designated VGAM RNA, also designated SEQ ID:4716.

Another function of VGAM2005 is therefore inhibition of Tec Protein Tyrosine Kinase (TEC, Accession NM_003215). Accordingly, utilities of VGAM2005 include diagnosis, prevention and treatment of diseases and clinical conditions associated with TEC. KIAA0429 (Accession NM_014751) is another VGAM2005 host target gene. KIAA0429 BINDING SITE is HOST TARGET binding site found in the 3' untranslated region of mRNA encoded by KIAA0429, corresponding to a HOST TARGET binding site such as BINDING SITE I, BINDING SITE II or BINDING SITE III. Table 2 illustrates the complementarity of the nucleotide sequences of KIAA0429 BINDING SITE, designated SEQ ID:16473, to the nucleotide sequence of VGAM2005 RNA, herein designated VGAM RNA, also designated SEQ ID:4716.

Another function of VGAM2005 is therefore inhibition of KIAA0429 (Accession NM_014751). Accordingly, utilities of VGAM2005 include diagnosis, prevention and treatment of diseases and clinical conditions associated with KIAA0429. LOC147841 (Accession XM_085924) is another VGAM2005 host target gene. LOC147841 BINDING SITE is HOST TARGET binding site found in the 5' untranslated region of mRNA encoded by LOC147841, corresponding to a HOST TARGET binding site such as BINDING SITE I, BINDING SITE II or BINDING SITE III. Table 2 illustrates the complementarity of the nucleotide sequences of LOC147841 BINDING SITE, designated SEQ ID:38399, to the nucleotide sequence of VGAM2005 RNA, herein designated VGAM RNA, also designated SEQ ID:4716.

Another function of VGAM2005 is therefore inhibition of LOC147841 (Accession XM_085924). Accordingly, utilities of VGAM2005 include diagnosis, prevention and treatment of diseases and clinical conditions associated with LOC147841. LOC152048 (Accession XM_098158) is another VGAM2005 host target gene. LOC152048 BINDING SITE is HOST TARGET binding site found in the 3' untranslated region of mRNA encoded by LOC152048, corresponding to a HOST TARGET binding site such as BINDING SITE I, BINDING SITE II or BINDING SITE III. Table 2 illustrates the complementarity of the nucleotide sequences of LOC152048 BINDING SITE, designated SEQ ID:41425, to the nucleotide sequence of VGAM2005 RNA, herein designated VGAM RNA, also designated SEQ ID:4716.

Another function of VGAM2005 is therefore inhibition of LOC152048 (Accession XM_098158). Accordingly, utilities of VGAM2005 include diagnosis, prevention and treatment of diseases and clinical conditions associated with LOC152048. LOC152271 (Accession XM_087419) is another VGAM2005 host target gene. LOC152271 BINDING SITE is HOST TARGET binding site found in the 3' untranslated region of mRNA encoded by LOC152271, corresponding to a HOST TARGET binding site such as BINDING SITE I, BINDING SITE II or BINDING SITE III. Table 2 illustrates the complementarity of the nucleotide sequences of LOC152271 BINDING SITE, designated SEQ ID:39240, to the nucleotide sequence of VGAM2005 RNA, herein designated VGAM RNA, also designated SEQ ID:4716.

Another function of VGAM2005 is therefore inhibition of LOC152271 (Accession XM_087419). Accordingly, utilities of VGAM2005 include diagnosis, prevention and treatment of diseases and clinical conditions associated with LOC152271. LOC199796 (Accession XM_058994) is another VGAM2005 host target gene. LOC199796 BINDING SITE is HOST TARGET binding site found in the 5' untranslated region of mRNA encoded by LOC199796, corresponding to a HOST TARGET binding site such as BINDING SITE I, BINDING SITE II or BINDING SITE III. Table 2 illustrates the complementarity of the nucleotide sequences of LOC199796 BINDING SITE, designated SEQ ID:36811, to the nucleotide sequence of VGAM2005 RNA, herein designated VGAM RNA, also designated SEQ ID:4716.

Another function of VGAM2005 is therefore inhibition of LOC199796 (Accession XM_058994). Accordingly, utilities of VGAM2005 include diagnosis, prevention and treatment of diseases and clinical conditions associated with LOC199796. LOC56270 (Accession NM_019613) is another VGAM2005 host target gene. LOC56270 BINDING SITE is HOST TARGET binding site found in the 3' untranslated region of mRNA encoded by LOC56270, corresponding to a HOST TARGET binding site such as BINDING SITE I, BINDING SITE II or BINDING SITE III. Table 2 illustrates the complementarity of the nucleotide sequences of LOC56270 BINDING SITE, designated SEQ ID:21232, to the nucleotide sequence of VGAM2005 RNA, herein designated VGAM RNA, also designated SEQ ID:4716.

Another function of VGAM2005 is therefore inhibition of LOC56270 (Accession NM_019613). Accordingly, utilities of VGAM2005 include diagnosis, prevention and treatment of diseases and clinical conditions associated with LOC56270. FIG. 1 further provides a conceptual description of a novel bioinformatically detected viral gene of the present invention, referred to here as Viral Genomic Address Messenger 2006 (VGAM2006) viral gene, which modulates expression of respective host target genes thereof, the function and utility of which host target genes is known in the art.

VGAM2006 is a novel bioinformatically detected regulatory, non protein coding, viral micro RNA (miRNA) gene. The method by which VGAM2006 was detected is described hereinabove with reference to FIGS. 1-8.

VGAM2006 gene, herein designated VGAM GENE, is a viral gene contained in the genome of Chimpanzee Cytomegalovirus. VGAM2006 host target gene, herein designated VGAM HOST TARGET GENE, is a human gene contained in the human genome.

VGAM2006 gene encodes a VGAM2006 precursor RNA, herein designated VGAM PRECURSOR RNA. Similar to other miRNA genes, and unlike most ordinary genes, VGAM2006 precursor RNA does not encode a protein. A nucleotide sequence identical or highly similar to the nucleotide sequence of VGAM2006 precursor RNA is designated SEQ ID:1992, and is provided hereinbelow with reference to the sequence listing part. Nucleotide sequence SEQ ID:1992 is located at position 191561 relative to the genome of Chimpanzee Cytomegalovirus.

VGAM2006 precursor RNA folds onto itself, forming VGAM2006 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2006 folded precursor RNA into VGAM2006 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM2006 RNA is designated SEQ ID:4717, and is provided hereinbelow with reference to the sequence listing part.

VGAM2006 host target gene, herein designated VGAM HOST TARGET GENE, encodes a corresponding messenger RNA, VGAM2006 host target RNA, herein designated VGAM HOST TARGET RNA. VGAM2006 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2006 RNA, herein designated VGAM RNA, binds complementarily to one or more host target binding sites located in untranslated regions of VGAM2006 host target RNA, herein designated VGAM HOST TARGET RNA. This complementary binding is due to the fact that the nucleotide sequence of VGAM2006 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2006 RNA, herein designated VGAM RNA, may have a different number of host target binding sites in untranslated regions of a VGAM2006 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2006 RNA, herein designated VGAM RNA, to host target binding sites on VGAM2006 host target RNA, herein designated VGAM HOST TARGET RNA, such as BINDING SITE I, BINDING SITE II and BINDING SITE III, inhibits translation of VGAM2006 host target RNA into VGAM2006 host target protein, herein designated VGAM HOST TARGET PROTEIN. VGAM host target protein is therefore outlined by a broken line.

It is appreciated that VGAM2006 host target gene, herein designated VGAM HOST TARGET GENE, in fact represents a plurality of VGAM2006 host target genes. The mRNA of each one of this plurality of VGAM2006 host target genes comprises one or more host target binding sites, each having a nucleotide sequence which is at least partly complementary to VGAM2006 RNA, herein designated VGAM RNA, and which when bound by VGAM2006 RNA causes inhibition of translation of respective one or more VGAM2006 host target proteins.

It is further appreciated by one skilled in the art that the mode of translational inhibition illustrated by FIG. 1 with specific reference to translational inhibition exerted by VGAM2006 gene, herein designated VGAM GENE, on one or more VGAM2006 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2006 is inhibition of expression of host target genes, as part of a novel viral mechanism of attacking a host. Accordingly, utilities of VGAM2006 include diagnosis, prevention and treatment of viral infection by Chimpanzee Cytomegalovirus. Specific functions, and accordingly utilities, of VGAM2006 correlate with, and may be deduced from, the identity of the host target genes which VGAM2006 binds and inhibits, and the function of these host target genes, as elaborated hereinbelow.

Nucleotide sequences of the VGAM2006 precursor RNA, herein designated VGAM PRECURSOR RNA, and of the 'diced' VGAM2006 RNA, herein designated VGAM RNA, and a schematic representation of the secondary folding of VGAM2006 folded precursor RNA, herein designated VGAM FOLDED PRECURSOR RNA, of VGAM2006 are further described hereinbelow with reference to Table 1.

Nucleotide sequences of host target binding sites, such as BINDING SITE-I, BINDING SITE-II and BINDING SITE-III of FIG. 1, found on VGAM2006 host target RNA, and schematic representation of the complementarity of each of these host target binding sites to VGAM2006 RNA, herein designated VGAM RNA, are described hereinbelow with reference to Table 2.

As mentioned hereinabove with reference to FIG. 1, a function of VGAM2006 gene, herein designated VGAM is inhibition of expression of VGAM2006 target genes. It is appreciated that specific functions, and accordingly utilities, of VGAM2006 correlate with, and may be deduced from, the identity of the target genes which VGAM2006 binds and inhibits, and the function of these target genes, as elaborated hereinbelow.

Formin 2 (FMN2, Accession XM_086525) is a VGAM2006 host target gene. FMN2 BINDING SITE is HOST TARGET binding site found in the 3' untranslated region of mRNA encoded by FMN2, corresponding to a HOST TARGET binding site such as BINDING SITE I, BINDING SITE II or BINDING SITE III. Table 2 illustrates the complementarity of the nucleotide sequences of FMN2 BINDING SITE, designated SEQ ID:38741, to the nucleotide sequence of VGAM2006 RNA, herein designated VGAM RNA, also designated SEQ ID:4717.

A function of VGAM2006 is therefore inhibition of Formin 2 (FMN2, Accession XM_086525). Accordingly, utilities of VGAM2006 include diagnosis, prevention and treatment of diseases and clinical conditions associated with FMN2. Homeo Box C13 (HOXC13, Accession XM_006804) is another VGAM2006 host target gene. HOXC13 BINDING SITE is HOST TARGET binding site found in the 3' untranslated region of mRNA encoded by HOXC13, corresponding to a HOST TARGET binding site such as BINDING SITE I, BINDING SITE II or BINDING SITE III. Table 2 illustrates the complementarity of the nucleotide sequences of HOXC13 BINDING SITE, designated SEQ ID:30015, to the nucleotide sequence of VGAM2006 RNA, herein designated VGAM RNA, also designated SEQ ID:4717.

Another function of VGAM2006 is therefore inhibition of Homeo Box C13 (HOXC13, Accession XM_006804). Accordingly, utilities of VGAM2006 include diagnosis, prevention and treatment of diseases and clinical conditions associated with HOXC13. Hypoxia Up-regulated 1 (HYOU1, Accession XM_006464) is another VGAM2006 host target gene. HYOU1 BINDING SITE is HOST TARGET binding site found in the 3' untranslated region of mRNA encoded by HYOU1, corresponding to a HOST TARGET binding site such as BINDING SITE I, BINDING SITE II or BINDING SITE III. Table 2 illustrates the complementarity of the nucleotide sequences of HYOU1 BINDING SITE, designated SEQ ID:30003, to the nucleotide sequence of VGAM2006 RNA, herein designated VGAM RNA, also designated SEQ ID:4717.

Another function of VGAM2006 is therefore inhibition of Hypoxia Up-regulated 1 (HYOU1, Accession XM_006464). Accordingly, utilities of VGAM2006 include diagnosis, prevention and treatment of diseases and clinical conditions associated with HYOU1. RAP1, GTPase Activating Protein 1 (RAP1GA1, Accession NM_002885) is another VGAM2006 host target gene. RAP1GA1 BINDING SITE is HOST TARGET binding site found in the 3' untranslated region of mRNA encoded by RAP1GA1, corresponding to a HOST TARGET binding site such as BINDING SITE I, BINDING SITE II or BINDING SITE III. Table 2 illustrates the complementarity of the nucleotide sequences of RAP1GA1 BINDING SITE, designated SEQ ID:8796, to the nucleotide sequence of VGAM2006 RNA, herein designated VGAM RNA, also designated SEQ ID:4717.

Another function of VGAM2006 is therefore inhibition of RAP1, GTPase Activating Protein 1 (RAP1GA1, Accession NM_002885). Accordingly, utilities of VGAM2006 include diagnosis, prevention and treatment of diseases and clinical conditions associated with RAP1GA1. DKFZP434E2318 (Accession NM_032138) is another VGAM2006 host target gene. DKFZP434E2318 BINDING SITE is HOST TARGET binding site found in the 5' untranslated region of mRNA encoded by DKFZP434E2318, corresponding to a HOST TARGET binding site such as BINDING SITE I, BINDING SITE II or BINDING SITE III. Table 2 illustrates the complementarity of the nucleotide sequences of DKFZP434E2318 BINDING SITE, designated SEQ ID:25816, to the nucleotide sequence of VGAM2006 RNA, herein designated VGAM RNA, also designated SEQ ID:4717.

Another function of VGAM2006 is therefore inhibition of DKFZP434E2318 (Accession NM_032138). Accordingly, utilities of VGAM2006 include diagnosis, prevention and treatment of diseases and clinical conditions associated with DKFZP434E2318. Family with Sequence Similarity 3, Member A (FAM3A, Accession NM_021806) is another VGAM2006 host target gene. FAM3A BINDING SITE is HOST TARGET binding site found in the 3' untranslated region of mRNA encoded by FAM3A, corresponding to a HOST TARGET binding site such as BINDING SITE I, BINDING SITE II or BINDING SITE III. Table 2 illustrates the complementarity of the nucleotide sequences of FAM3A BINDING SITE, designated SEQ ID:22357, to the nucleotide sequence of VGAM2006 RNA, herein designated VGAM RNA, also designated SEQ ID:4717.

Another function of VGAM2006 is therefore inhibition of Family with Sequence Similarity 3, Member A (FAM3A, Accession NM_021806). Accordingly, utilities of VGAM2006 include diagnosis, prevention and treatment of diseases and clinical conditions associated with FAM3A. FGD1 Family, Member 3 (FGD3, Accession XM_053487) is another VGAM2006 host target gene. FGD3 BINDING SITE is HOST TARGET binding site found in the 3' untranslated region of mRNA encoded by FGD3, corresponding to a HOST TARGET binding site such as BINDING SITE I, BINDING SITE II or BINDING SITE III. Table 2 illustrates the complementarity of the nucleotide sequences of FGD3 BINDING SITE, designated SEQ ID:36090, to the nucleotide sequence of VGAM2006 RNA, herein designated VGAM RNA, also designated SEQ ID:4717.

Another function of VGAM2006 is therefore inhibition of FGD1 Family, Member 3 (FGD3, Accession XM_053487). Accordingly, utilities of VGAM2006 include diagnosis, prevention and treatment of diseases and clinical conditions associated with FGD3. KIAA0014 (Accession NM_014665) is another VGAM2006 host target gene. KIAA0014 BINDING SITE is HOST TARGET binding site found in the 3' untranslated region of mRNA encoded by KIAA0014, corresponding to a HOST TARGET binding site such as BINDING SITE I, BINDING SITE II or BINDING SITE III. Table 2 illustrates the complementarity of the nucleotide sequences of KIAA0014 BINDING SITE, designated SEQ ID:16114, to the nucleotide sequence of VGAM2006 RNA, herein designated VGAM RNA, also designated SEQ ID:4717.

Another function of VGAM2006 is therefore inhibition of KIAA0014 (Accession NM_014665). Accordingly, utilities of VGAM2006 include diagnosis, prevention and treatment of diseases and clinical conditions associated with KIAA0014. KIAA0152 (Accession NM_014730) is another VGAM2006 host target gene. KIAA0152 BINDING SITE is HOST TARGET binding site found in the 3' untranslated region of mRNA encoded by KIAA0152, corresponding to a HOST TARGET binding site such as BINDING SITE I, BINDING SITE II or BINDING SITE III. Table 2 illustrates the complementarity of the nucleotide sequences of KIAA0152 BINDING SITE, designated SEQ ID:16335, to the nucleotide sequence of VGAM2006 RNA, herein designated VGAM RNA, also designated SEQ ID:4717.

Another function of VGAM2006 is therefore inhibition of KIAA0152 (Accession NM_014730). Accordingly, utilities of VGAM2006 include diagnosis, prevention and treatment of diseases and clinical conditions associated with KIAA0152. KIAA0753 (Accession NM_014804) is another VGAM2006 host target gene. KIAA0753 BINDING SITE is HOST TARGET binding site found in the 3' untranslated region of mRNA encoded by KIAA0753, corresponding to a HOST TARGET binding site such as BINDING SITE I, BINDING SITE II or BINDING SITE III. Table 2 illustrates the complementarity of the nucleotide sequences of KIAA0753 BINDING SITE, designated SEQ ID:16735, to the nucleotide sequence of VGAM2006 RNA, herein designated VGAM RNA, also designated SEQ ID:4717.

Another function of VGAM2006 is therefore inhibition of KIAA0753 (Accession NM_014804). Accordingly, utilities of VGAM2006 include diagnosis, prevention and treatment of diseases and clinical conditions associated with KIAA0753. KIAA1404 (Accession XM_030494) is another VGAM2006 host target gene. KIAA1404 BINDING SITE is HOST TARGET binding site found in the 3' untranslated region of mRNA encoded by KIAA1404, corresponding to a HOST TARGET binding site such as BINDING SITE I, BINDING SITE II or BINDING SITE III. Table 2 illustrates the complementarity of the nucleotide sequences of KIAA1404 BINDING SITE, designated SEQ ID:31051, to the nucleotide sequence of VGAM2006 RNA, herein designated VGAM RNA, also designated SEQ ID:4717.

Another function of VGAM2006 is therefore inhibition of KIAA1404 (Accession XM_030494). Accordingly, utilities of VGAM2006 include diagnosis, prevention and treatment of diseases and clinical conditions associated with KIAA1404. KIAA1987 (Accession XM_113870) is another VGAM2006 host target gene. KIAA1987 BINDING SITE is HOST TARGET binding site found in the 5' untranslated region of mRNA encoded by KIAA1987, corresponding to a HOST TARGET binding site such as BINDING SITE I, BINDING SITE II or BINDING SITE III. Table 2 illustrates the complementarity of the nucleotide sequences of KIAA1987 BINDING SITE, designated SEQ ID:42495, to the nucleotide sequence of VGAM2006 RNA, herein designated VGAM RNA, also designated SEQ ID:4717.

Another function of VGAM2006 is therefore inhibition of KIAA1987 (Accession XM_113870). Accordingly, utilities of VGAM2006 include diagnosis, prevention and treatment of diseases and clinical conditions associated with KIAA1987. Neuron Navigator 3 (NAV3, Accession NM_014903) is another VGAM2006 host target gene. NAV3 BINDING SITE is HOST TARGET binding site found in the 3' untranslated region of mRNA encoded by NAV3, corresponding to a HOST TARGET binding site such as BINDING SITE I, BINDING SITE II or BINDING SITE III. Table 2 illustrates the complementarity of the nucleotide sequences of NAV3 BINDING SITE, designated SEQ ID:17090, to the nucleotide sequence of VGAM2006 RNA, herein designated VGAM RNA, also designated SEQ ID:4717.

Another function of VGAM2006 is therefore inhibition of Neuron Navigator 3 (NAV3, Accession NM_014903). Accordingly, utilities of VGAM2006 include diagnosis, prevention and treatment of diseases and clinical conditions associated with NAV3. PDEF (Accession NM_012391) is another VGAM2006 host target gene. PDEF BINDING SITE is HOST TARGET binding site found in the 5' untranslated region of mRNA encoded by PDEF, corresponding to a HOST TARGET binding site such as BINDING SITE I, BINDING SITE II or BINDING SITE III. Table 2 illustrates the complementarity of the nucleotide sequences of PDEF BINDING SITE, designated SEQ ID:14746, to the nucleotide sequence of VGAM2006 RNA, herein designated VGAM RNA, also designated SEQ ID:4717.

Another function of VGAM2006 is therefore inhibition of PDEF (Accession NM_012391). Accordingly, utilities of VGAM2006 include diagnosis, prevention and treatment of diseases and clinical conditions associated with PDEF. RoXaN (Accession NM_025013) is another VGAM2006 host target gene. RoXaN BINDING SITE is HOST TARGET binding site found in the 3' untranslated region of mRNA encoded by RoXaN, corresponding to a HOST TARGET binding site such as BINDING SITE I, BINDING SITE II or BINDING SITE III. Table 2 illustrates the complementarity of the nucleotide sequences of RoXaN BINDING SITE, designated SEQ ID:24603, to the nucleotide sequence of VGAM2006 RNA, herein designated VGAM RNA, also designated SEQ ID:4717.

Another function of VGAM2006 is therefore inhibition of RoXaN (Accession NM_025013). Accordingly, utilities of VGAM2006 include diagnosis, prevention and treatment of diseases and clinical conditions associated with RoXaN. LOC145813 (Accession XM_096873) is another VGAM2006 host target gene. LOC145813 BINDING SITE is HOST TARGET binding site found in the 5' untranslated region of mRNA encoded by LOC145813, corresponding to a HOST TARGET binding site such as BINDING SITE I, BINDING SITE II or BINDING SITE III. Table 2 illustrates the complementarity of the nucleotide sequences of LOC145813 BINDING SITE, designated SEQ ID:40598, to the nucleotide sequence of VGAM2006 RNA, herein designated VGAM RNA, also designated SEQ ID:4717.

Another function of VGAM2006 is therefore inhibition of LOC145813 (Accession XM_096873). Accordingly, utilities of VGAM2006 include diagnosis, prevention and treatment of diseases and clinical conditions associated with LOC145813. LOC152426 (Accession XM_098225) is another VGAM2006 host target gene. LOC152426 BINDING SITE is HOST TARGET binding site found in the 5' untranslated region of mRNA encoded by LOC152426, corresponding to a HOST TARGET binding site such as BINDING SITE I, BINDING SITE II or BINDING SITE III. Table 2 illustrates the complementarity of the nucleotide sequences of LOC152426 BINDING SITE, designated SEQ ID:41498, to the nucleotide sequence of VGAM2006 RNA, herein designated VGAM RNA, also designated SEQ ID:4717.

Another function of VGAM2006 is therefore inhibition of LOC152426 (Accession XM_098225). Accordingly, utilities of VGAM2006 include diagnosis, prevention and treatment of diseases and clinical conditions associated with LOC152426. LOC157254 (Accession XM_088279) is another VGAM2006 host target gene. LOC157254 BINDING SITE is HOST TARGET binding site found in the 5' untranslated region of mRNA encoded by LOC157254, corresponding to a HOST TARGET binding site such as BINDING SITE I, BINDING SITE II or BINDING SITE III. Table 2 illustrates the complementarity of the nucleotide sequences of LOC157254 BINDING SITE, designated SEQ ID:39579, to the nucleotide sequence of VGAM2006 RNA, herein designated VGAM RNA, also designated SEQ ID:4717.

Another function of VGAM2006 is therefore inhibition of LOC157254 (Accession XM_088279). Accordingly, utilities of VGAM2006 include diagnosis, prevention and treatment of diseases and clinical conditions associated with LOC157254. LOC158382 (Accession XM_098931) is another VGAM2006 host target gene. LOC158382 BINDING SITE is HOST TARGET binding site found in the 3' untranslated region of mRNA encoded by LOC158382, corresponding to a HOST TARGET binding site such as BINDING SITE I, BINDING SITE II or BINDING SITE III. Table 2 illustrates the complementarity of the nucleotide sequences of LOC158382 BINDING SITE, designated SEQ ID:41964, to the nucleotide sequence of VGAM2006 RNA, herein designated VGAM RNA, also designated SEQ ID:4717.

Another function of VGAM2006 is therefore inhibition of LOC158382 (Accession XM_098931). Accordingly, utilities of VGAM2006 include diagnosis, prevention and treatment of diseases and clinical conditions associated with LOC158382. LOC221393 (Accession XM_166435) is another VGAM2006 host target gene. LOC221393 BINDING SITE is HOST TARGET binding site found in the 3' untranslated region of mRNA encoded by LOC221393, corresponding to a HOST TARGET binding site such as BINDING SITE I, BINDING SITE II or BINDING SITE III. Table 2 illustrates the complementarity of the nucleotide sequences of LOC221393 BINDING SITE, designated SEQ ID:44337, to the nucleotide sequence of VGAM2006 RNA, herein designated VGAM RNA, also designated SEQ ID:4717.

Another function of VGAM2006 is therefore inhibition of LOC221393 (Accession XM_166435). Accordingly, utilities of VGAM2006 include diagnosis, prevention and treatment of diseases and clinical conditions associated with LOC221393. LOC51285 (Accession NM_016563) is another VGAM2006 host target gene. LOC51285 BINDING SITE is HOST TARGET binding site found in the 3' untranslated region of mRNA encoded by LOC51285, corresponding to a HOST TARGET binding site such as BINDING SITE I, BINDING SITE II or BINDING SITE III. Table 2 illustrates the complementarity of the nucleotide sequences of LOC51285 BINDING SITE, designated SEQ ID:18638, to the nucleotide sequence of VGAM2006 RNA, herein designated VGAM RNA, also designated SEQ ID:4717.

Another function of VGAM2006 is therefore inhibition of LOC51285 (Accession NM_016563). Accordingly, utilities of VGAM2006 include diagnosis, prevention and treatment of diseases and clinical conditions associated with LOC51285. LOC90342 (Accession XM_031009) is another VGAM2006 host target gene. LOC90342 BINDING SITE is HOST TARGET binding site found in the 5' untranslated region of mRNA encoded by LOC90342, corresponding to a HOST TARGET binding site such as BINDING SITE I, BINDING SITE II or BINDING SITE III. Table 2 illustrates the complementarity of the nucleotide sequences of LOC90342 BINDING SITE, designated SEQ ID:31253, to the nucleotide sequence of VGAM2006 RNA, herein designated VGAM RNA, also designated SEQ ID:4717.

Another function of VGAM2006 is therefore inhibition of LOC90342 (Accession XM_031009). Accordingly, utilities of VGAM2006 include diagnosis, prevention and treatment of diseases and clinical conditions associated with LOC90342. FIG. 1 further provides a conceptual description of a novel bioinformatically detected viral gene of the present invention, referred to here as Viral Genomic Address Messenger 2007 (VGAM2007) viral gene, which modulates expression of respective host target genes thereof, the function and utility of which host target genes is known in the art.

VGAM2007 is a novel bioinformatically detected regulatory, non protein coding, viral micro RNA (miRNA) gene. The method by which VGAM2007 was detected is described hereinabove with reference to FIGS. 1-8.

VGAM2007 gene, herein designated VGAM GENE, is a viral gene contained in the genome of Reston Ebola Virus (REBOV). VGAM2007 host target gene, herein designated VGAM HOST TARGET GENE, is a human gene contained in the human genome.

VGAM2007 gene encodes a VGAM2007 precursor RNA, herein designated VGAM PRECURSOR RNA. Similar to other miRNA genes, and unlike most ordinary genes, VGAM2007 precursor RNA does not encode a protein. A nucleotide sequence identical or highly similar to the nucleotide sequence of VGAM2007 precursor RNA is designated SEQ ID:1993, and is provided hereinbelow with reference to the sequence listing part. Nucleotide sequence SEQ ID:1993 is located at position 5965 relative to the genome of Reston Ebola Virus (REBOV).

VGAM2007 precursor RNA folds onto itself, forming VGAM2007 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2007 folded precursor RNA into VGAM2007 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2007 RNA is designated SEQ ID:4718, and is provided hereinbelow with reference to the sequence listing part.

VGAM2007 host target gene, herein designated VGAM HOST TARGET GENE, encodes a corresponding messenger RNA, VGAM2007 host target RNA, herein designated VGAM HOST TARGET RNA. VGAM2007 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2007 RNA, herein designated VGAM RNA, binds complementarily to one or more host target binding sites located in untranslated regions of VGAM2007 host target RNA, herein designated VGAM HOST TARGET RNA. This complementary binding is due to the fact that the nucleotide sequence of VGAM2007 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2007 RNA, herein designated VGAM RNA, may have a different number of host target binding sites in untranslated regions of a VGAM2007 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2007 RNA, herein designated VGAM RNA, to host target binding sites on VGAM2007 host target RNA, herein designated VGAM HOST TARGET RNA, such as BINDING SITE I, BINDING SITE II and BINDING SITE III, inhibits translation of VGAM2007 host target RNA into VGAM2007 host target protein, herein designated VGAM HOST TARGET PROTEIN. VGAM host target protein is therefore outlined by a broken line.

It is appreciated that VGAM2007 host target gene, herein designated VGAM HOST TARGET GENE, in fact represents a plurality of VGAM2007 host target genes. The mRNA of each one of this plurality of VGAM2007 host target genes comprises one or more host target binding sites, each having a nucleotide sequence which is at least partly complementary to VGAM2007 RNA, herein designated VGAM RNA, and which when bound by VGAM2007 RNA causes inhibition of translation of respective one or more VGAM2007 host target proteins.

It is further appreciated by one skilled in the art that the mode of translational inhibition illustrated by FIG. 1 with specific reference to translational inhibition exerted by VGAM2007 gene, herein designated VGAM GENE, on one or more VGAM2007 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2007 is inhibition of expression of host target genes, as part of a novel viral mechanism of attacking a host. Accordingly, utilities of VGAM2007 include diagnosis, prevention and treatment of viral infection by Reston Ebola Virus (REBOV). Specific functions, and accordingly utilities, of VGAM2007 correlate with, and may be deduced from, the identity of the host target genes which VGAM2007 binds and inhibits, and the function of these host target genes, as elaborated hereinbelow.

Nucleotide sequences of the VGAM2007 precursor RNA, herein designated VGAM PRECURSOR RNA, and of the 'diced' VGAM2007 RNA, herein designated VGAM RNA, and a schematic representation of the secondary folding of VGAM2007 folded precursor RNA, herein designated VGAM FOLDED PRECURSOR RNA, of VGAM2007 are further described hereinbelow with reference to Table 1.

Nucleotide sequences of host target binding sites, such as BINDING SITE-I, BINDING SITE-II and BINDING SITE-III of FIG. 1, found on VGAM2007 host target RNA, and schematic representation of the complementarity of each of these host target binding sites to VGAM2007 RNA, herein designated VGAM RNA, are described hereinbelow with reference to Table 2.

As mentioned hereinabove with reference to FIG. 1, a function of VGAM2007 gene, herein designated VGAM is inhibition of expression of VGAM2007 target genes. It is appreciated that specific functions, and accordingly utilities, of VGAM2007 correlate with, and may be deduced from, the identity of the target genes which VGAM2007 binds and inhibits, and the function of these target genes, as elaborated hereinbelow.

Adenylate Cyclase 8 (brain) (ADCY8, Accession NM_001115) is a VGAM2007 host target gene. ADCY8 BINDING SITE is HOST TARGET binding site found in the 5' untranslated region of mRNA encoded by ADCY8, corresponding to a HOST TARGET binding site such as BINDING SITE I, BINDING SITE II or BINDING SITE III. Table 2 illustrates the complementarity of the nucleotide sequences of ADCY8 BINDING SITE, designated SEQ ID:6787, to the nucleotide sequence of VGAM2007 RNA, herein designated VGAM RNA, also designated SEQ ID:4718.

A function of VGAM2007 is therefore inhibition of Adenylate Cyclase 8 (brain) (ADCY8, Accession NM_001115), a gene which this a membrane-bound, ca (2+)-inhibitable adenylyl cyclase. Accordingly, utilities of VGAM2007 include diagnosis, prevention and treatment of diseases and clinical conditions associated with ADCY8. The function of ADCY8 and its association with various diseases and clinical conditions, has been established by previous studies, as described hereinabove with reference to VGAM1169. Aldehyde Dehydrogenase 3 Family, Member B1 (ALDH3B1, Accession XM_166190) is another VGAM2007 host target gene. ALDH3B1 BINDING SITE is HOST TARGET binding site found in the 3' untranslated region of mRNA encoded by ALDH3B1, corresponding to a HOST TARGET binding site such as BINDING SITE I, BINDING SITE II or BINDING SITE III. Table 2 illustrates the complementarity of the nucleotide sequences of ALDH3B1 BINDING SITE, designated SEQ ID:44002, to the nucleotide sequence of VGAM2007 RNA, herein designated VGAM RNA, also designated SEQ ID:4718.

Another function of VGAM2007 is therefore inhibition of Aldehyde Dehydrogenase 3 Family, Member B1 (ALDH3B1, Accession XM_166190), a gene which may play a major role in the detoxification of aldehydes generated by alcohol metabolism and lipid peroxidation. Accordingly, utilities of VGAM2007 include diagnosis, prevention and treatment of diseases and clinical conditions associated with ALDH3B1. The function of ALDH3B1 has been established by previous studies. The aldehyde dehydrogenases are a family of isozymes that may play a major role in the detoxification of aldehydes generated by alcohol metabolism and lipid peroxidation. Hsu et al. (1994) reported the cloning and sequencing of a cDNA encoding a new human ALDH, designated ALDH7. Degenerate oligodeoxyribonucleotides derived from conserved regions of known ALDH cDNAs amplified a 408-bp product from human kidney total RNA by the reverse transcription-PCR procedure. This PCR product was subcloned, selected, and used as a probe to screen a human kidney cDNA library. The full-length human kidney cDNA of ALDH7 is 2,791 bp long and contains an open reading frame encoding 468 amino acids. The deduced sequence of ALDH7 was longer than that of human stomach ALDH3 (OMIM Ref. No. 100660) by 15 amino acids at the C terminus. The degree of identity between the 2 isozymes was 52% with a positional alignment of 453 amino acids. Northern blot analysis demonstrated that lung is another major tissue expressing ALDH7. Hsu et al. (1997) determined the structure of the ALDH7 and ALDH8 (OMIM Ref. No. 601917) genes. The ALDH7 gene spans about 20 kb of genomic DNA and is composed of 9 coding exons. The ALDH8 gene is over 10 kb in length and consists of at least 10 exons. The ALDH8 gene contains an in-frame stop codon at the seventeenth codon position from the first initiator Met. The coding region of the ALDH7 gene shows about 86% nucleotide identity with the corresponding region of the ALDH8 gene. The numbers and positions of the introns of the 2 genes are conserved, suggesting that gene duplication is involved in the expansion of the ALDH gene family. The human ALDH7 and ALDH8 genes have a close evolutionary relationship with human ALDH3. The International Radiation Hybrid Mapping Consortium mapped the ALDH7 gene to chromosome 11 (RH69713).

Full details of the abovementioned studies are described in the following publications, the disclosure of which are hereby incorporated by reference:

Hsu, L. C.; Chang, W.-C.; Yoshida, A.: Human aldehyde dehydrogenase genes, ALDH7 and ALDH8: genomic organization and gene structure comparison. Gene 189:89-94, 1997; and Hsu, L. C.; Chang, W.-C.; Yoshida, A.: Cloning of a cDNA encoding human ALDH7, a new member of the aldehyde dehydrogenase family. Gene 151:285-289, 1994.

Further studies establishing the function and utilities of ALDH3B1 are found in John Hopkins OMIM database record ID 600466, and in sited publications numbered 7732-7733 listed in the bibliography section hereinbelow, which are also hereby incorporated by reference. Aprataxin (APTX, Accession NM_017692) is another VGAM2007 host target gene. APTX BINDING SITE is HOST TARGET binding site found in the 3' untranslated region of mRNA encoded by APTX, corresponding to a HOST TARGET binding site such as BINDING SITE I, BINDING SITE II or BINDING SITE III. Table 2 illustrates the complementarity of the nucleotide sequences of APTX BINDING SITE, designated SEQ ID:19249, to the nucleotide sequence of VGAM2007 RNA, herein designated VGAM RNA, also designated SEQ ID:4718.

Another function of VGAM2007 is therefore inhibition of Aprataxin (APTX, Accession NM_017692). Accordingly, utilities of VGAM2007 include diagnosis, prevention and treatment of diseases and clinical conditions associated with APTX. UDP-Gal:betaGlcNAc Beta 1,4-Galactosyltransferase, Polypeptide 6 (B4GALT6, Accession XM_008799) is another VGAM2007 host target gene. B4GALT6 BINDING SITE is HOST TARGET binding site found in the 3' untranslated region of mRNA encoded by B4GALT6, corresponding to a HOST TARGET binding site such as BINDING SITE I, BINDING SITE II or BINDING SITE III. Table 2 illustrates the complementarity of the nucleotide sequences of B4GALT6 BINDING SITE, designated SEQ ID:30093, to the nucleotide sequence of VGAM2007 RNA, herein designated VGAM RNA, also designated SEQ ID:4718.

Another function of VGAM2007 is therefore inhibition of UDP-Gal:betaGlcNAc Beta 1,4-Galactosyltransferase, Polypeptide 6 (B4GALT6, Accession XM_008799). Accordingly, utilities of VGAM2007 include diagnosis, prevention and treatment of diseases and clinical conditions associated with B4GALT6. Collagen, Type V, Alpha 3 (COL5A3, Accession NM_015719) is another VGAM2007 host target gene. COL5A3 BINDING SITE is HOST TARGET binding site found in the 3' untranslated region of mRNA encoded by COL5A3, corresponding to a HOST TARGET binding site such as BINDING SITE I, BINDING SITE II or BINDING SITE III. Table 2 illustrates the complementarity of the nucleotide sequences of COL5A3 BINDING SITE, designated SEQ ID:17932, to the nucleotide sequence of VGAM2007 RNA, herein designated VGAM RNA, also designated SEQ ID:4718.

Another function of VGAM2007 is therefore inhibition of Collagen, Type V, Alpha 3 (COL5A3, Accession NM_015719). Accordingly, utilities of VGAM2007 include diagnosis, prevention and treatment of diseases and clinical conditions associated with COL5A3. Enamelin (ENAM, Accession NM_031889) is another VGAM2007 host target gene. ENAM BINDING SITE is HOST TARGET binding site found in the 3' untranslated region of mRNA encoded by ENAM, corresponding to a HOST TARGET binding site such as BINDING SITE I, BINDING SITE II or BINDING SITE III. Table 2 illustrates the complementarity of the nucleotide sequences of ENAM BINDING SITE, designated SEQ ID:25634, to the nucleotide sequence of VGAM2007 RNA, herein designated VGAM RNA, also designated SEQ ID:4718.

Another function of VGAM2007 is therefore inhibition of Enamelin (ENAM, Accession NM_031889). Accordingly, utilities of VGAM2007 include diagnosis, prevention and treatment of diseases and clinical conditions associated with ENAM. FBJ Murine Osteosarcoma Viral Oncogene Homolog B (FOSB, Accession NM_006732) is another VGAM2007 host target gene. FOSB BINDING SITE is HOST TARGET binding site found in the 3' untranslated region of mRNA encoded by FOSB, corresponding to a HOST TARGET binding site such as BINDING SITE I, BINDING SITE II or BINDING SITE III. Table 2 illustrates the complementarity of the nucleotide sequences of FOSB BINDING SITE, designated SEQ ID:13584, to the nucleotide sequence of VGAM2007 RNA, herein designated VGAM RNA, also designated SEQ ID:4718.

Another function of VGAM2007 is therefore inhibition of FBJ Murine Osteosarcoma Viral Oncogene Homolog B (FOSB, Accession NM_006732), a gene which interacts with jun proteins enhancing their dna binding activity. Accordingly, utilities of VGAM2007 include diagnosis, prevention and treatment of diseases and clinical conditions associated with FOSB. The function of FOSB and its association with various diseases and clinical conditions, has been established by previous studies, as described hereinabove with reference to VGAM747. Interleukin 1, Beta (IL1B, Accession NM_000576) is another VGAM2007 host target gene. IL1B BINDING SITE is HOST TARGET binding site found in the 3' untranslated region of mRNA encoded by IL1B, corresponding to a HOST TARGET binding site such as BINDING SITE I, BINDING SITE II or BINDING SITE III. Table 2 illustrates the complementarity of the nucleotide sequences of IL1B BINDING SITE, designated SEQ ID:6176, to the nucleotide sequence of VGAM2007 RNA, herein designated VGAM RNA, also designated SEQ ID:4718.

Another function of VGAM2007 is therefore inhibition of Interleukin 1, Beta (IL1B, Accession NM_000576), a gene which stimulates thymocyte proliferation. Accordingly, utilities of VGAM2007 include diagnosis, prevention and treatment of diseases and clinical conditions associated with IL1B. The function of IL1B has been established by previous studies. Interleukin-1, produced mainly by blood monocytes, mediates the panoply of host reactions collectively known as acute phase response. It is identical to endogenous pyrogen. The multiple biologic activities that define IL1 are properties of a 15- to 18-kD protein that is derived from a 30- to 35-kD precursor. El-Omar et al. (2000) reported that interleukin-1 gene cluster polymorphisms suspected of enhancing production of interleukin-1-beta are associated with an increased risk of both hypochlorhydria induced by Helicobacter pylori and gastric cancer. Two of these polymorphisms are in near-complete linkage disequilibrium, and 1 is a TATA-box polymorphism that markedly affects DNA-protein interactions in vitro. The association with disease may be explained by the biologic properties of interleukin-1-beta, which is an important proinflammatory cytokine and a powerful inhibitor of gastric acid secretion. Host genetic factors that affect interleukin-1-beta may determine why some individuals infected with H. pylori develop gastric cancer while others do not. IL1-beta is upregulated in the presence of H. pylori and is important in initiating and amplifying the inflammatory response to this infection. Three diallelic polymorphisms in IL1B have been reported, all representing C-to-T base transitions, at positions -511, -31, and +3954 basepairs from the transcriptional start site. To determine whether these polymorphisms are important with respect to different outcomes of H. pylori infections, El-Omar et al. (2000) studied their effects on gastric physiology in healthy subjects. Carriers of the ILB -31T allele (147720.0001) had an age-adjusted odds ratio of 9.1 (95% confidence interval, 2.2-37) for low acid secretion, and there was little difference between homozygous and heterozygous carriers. The IL1B +3954 genotype was not associated with the risk of hypochlorhydria. Carriers of IL1B -31T had an increased gastric cancer risk at an odds ratio of 1.9 (95% confidence interval, 1.5-2.6), with no significant difference between homozygotes and heterozygotes Hamajima et al. (2001) determined that the C-to-T transition at position -31, creating a TATA box, is associated with vulnerability to persistent H. pylori infection, and that the susceptibility is modified by smoking Animal model experiments lend further support to the function of IL1B. Mature IL1-beta levels are a sensitive and specific indicator of caspase-1 (OMIM Ref. No. 147678) activation. Ona et al. (1999) studied the effect of inhibition of caspase-1 on the progression of Huntington disease (OMIM Ref. No. 143100) in the mouse model developed by Mangiarini et al. (1996), which they called R6/2 mice. Ona et al. (1999) crossed R6/2 mice with a well-characterized transgenic mouse strain expressing a dominant-negative mutant of caspase-1 in the brain (NSE M17Z). Double mutant mice showed extended survival and delayed appearance of neuronal inclusions, neurotransmitter receptor alterations, and onset of symptoms, indicating that caspase-1 is important in the pathogenesis of Huntington disease. Mature IL1-beta levels in R6/2 mice were elevated to 268% of those in wildtype controls. This increase was significantly inhibited in the R6/2-NSE M17Z mice. IL1-beta levels in the brains of human patients also exhibited significant increases, to 213% of those in normal controls It is appreciated that the abovementioned animal model for IL1B is acknowledged by those skilled in the art as a scientifically valid animal model, as can be further appreciated from the publications sited hereinbelow.

Full details of the abovementioned studies are described in the following publications, the disclosure of which are hereby incorporated by reference:

El-Omar, E. M.; Carrington, M.; Chow, W.-H.; McColl, K. E. L.; Bream, J. H.; Young, H. A.; Herrera, J.; Lissowska, J.; Yuan, C.-C.; Rothman, N.; Lanyon, G.; Martin, M.; Fraumeni, J. F., Jr.; Rabkin, C. S.: Interleukin-1 polymorphisms associated with increased risk of gastric cancer. Nature 404: 398-402, 2000. Note: Erratum: Nature 412:99 only, 2001; and Ona, V. O.; Li, M.; Vonsattel, J. P. G.; Andrews, L. J.; Khan, S. Q.; Chung, W. M.; Frey, A. S.; Menon, A. S.; Li, X.-J.; Stieg, P. E.; Yuan, J.; Penney, J. B.; Young, A. B.; Cha, J.-H.

Further studies establishing the function and utilities of IL1B are found in John Hopkins OMIM database record ID 147720, and in sited publications numbered 5261, 11182-11184, 11189-11186, 472, 11187, 11188, 4805, 11170, 1119 and 11191-11192 listed in the bibliography section hereinbelow, which are also hereby incorporated by reference. Membrane Protein, Palmitoylated 2 (MAGUK p55 subfamily member 2) (MPP2, Accession XM_008355) is another VGAM2007 host target gene. MPP2 BINDING SITE is HOST TARGET binding site found in the 3' untranslated region of mRNA encoded by MPP2, corresponding to a HOST TARGET binding site such as BINDING SITE I, BINDING SITE II or BINDING SITE III. Table 2 illustrates the complementarity of the nucleotide sequences of MPP2 BINDING SITE, designated SEQ ID:30085, to the nucleotide sequence of VGAM2007 RNA, herein designated VGAM RNA, also designated SEQ ID:4718.

Another function of VGAM2007 is therefore inhibition of Membrane Protein, Palmitoylated 2 (MAGUK p55 subfamily member 2) (MPP2, Accession XM_008355). Accordingly, utilities of VGAM2007 include diagnosis, prevention and treatment of diseases and clinical conditions associated with MPP2. Male-specific Lethal 3-like 1 (Drosophila) (MSL3L1, Accession NM_078628) is another VGAM2007 host target gene. MSL3L1 BINDING SITE is HOST TARGET binding site found in the 3' untranslated region of mRNA encoded by MSL3L1, corresponding to a HOST TARGET binding site such as BINDING SITE I, BINDING SITE II or BINDING SITE III. Table 2 illustrates the complementarity of the nucleotide sequences of MSL3L1 BINDING SITE, designated SEQ ID:27812, to the nucleotide sequence of VGAM2007 RNA, herein designated VGAM RNA, also designated SEQ ID:4718.

Another function of VGAM2007 is therefore inhibition of Male-specific Lethal 3-like 1 (Drosophila) (MSL3L1, Accession NM_078628). Accordingly, utilities of VGAM2007 include diagnosis, prevention and treatment of diseases and clinical conditions associated with MSL3L1. Mature T-cell Proliferation 1 (MTCP1, Accession NM_014221) is another VGAM2007 host target gene. MTCP1 BINDING SITE is HOST TARGET binding site found in the 5' untranslated region of mRNA encoded by MTCP1, corresponding to a HOST TARGET binding site such as BINDING SITE I, BINDING SITE II or BINDING SITE III. Table 2 illustrates the complementarity of the nucleotide sequences of MTCP1 BINDING SITE, designated SEQ ID:15491, to the nucleotide sequence of VGAM2007 RNA, herein designated VGAM RNA, also designated SEQ ID:4718.

Another function of VGAM2007 is therefore inhibition of Mature T-cell Proliferation 1 (MTCP1, Accession NM_014221). Accordingly, utilities of VGAM2007 include diagnosis, prevention and treatment of diseases and clinical conditions associated with MTCP1. SRGAP1 (Accession XM_051143) is another VGAM2007 host target gene. SRGAP1 BINDING SITE is HOST TARGET binding site found in the 3' untranslated region of mRNA encoded by SRGAP1, corresponding to a HOST TARGET binding site such as BINDING SITE I, BINDING SITE II or BINDING SITE III. Table 2 illustrates the complementarity of the nucleotide sequences of SRGAP1 BINDING SITE, designated SEQ ID:35760, to the nucleotide sequence of VGAM2007 RNA, herein designated VGAM RNA, also designated SEQ ID:4718.

Another function of VGAM2007 is therefore inhibition of SRGAP1 (Accession XM_051143). Accordingly, utilities of VGAM2007 include diagnosis, prevention and treatment of diseases and clinical conditions associated with SRGAP1. C(27)-3BETA-HSD (Accession NM_025193) is another VGAM2007 host target gene. C(27)-3BETA-HSD BINDING SITE is HOST TARGET binding site found in the 3' untranslated region of mRNA encoded by C(27)-3BETA-HSD, corresponding to a HOST TARGET binding site such as BINDING SITE I, BINDING SITE II or BINDING SITE III. Table 2 illustrates the complementarity of the nucleotide sequences of C(27)-3BETA-HSD BINDING SITE, designated SEQ ID:24850, to the nucleotide sequence of VGAM2007 RNA, herein designated VGAM RNA, also designated SEQ ID:4718.

Another function of VGAM2007 is therefore inhibition of C(27)-3BETA-HSD (Accession NM_025193). Accordingly, utilities of VGAM2007 include diagnosis, prevention and treatment of diseases and clinical conditions associated with C(27)-3BETA-HSD. DKFZp547M072 (Accession XM_028067) is another VGAM2007 host target gene. DKFZp547M072 BINDING SITE is HOST TARGET binding site found in the 3' untranslated region of mRNA encoded by DKFZp547M072, corresponding to a HOST TARGET binding site such as BINDING SITE I, BINDING SITE II or BINDING SITE III. Table 2 illustrates the complementarity of the nucleotide sequences of DKFZp547M072 BINDING SITE, designated SEQ ID:30619, to the nucleotide sequence of VGAM2007 RNA, herein designated VGAM RNA, also designated SEQ ID:4718.

Another function of VGAM2007 is therefore inhibition of DKFZp547M072 (Accession XM_028067). Accordingly, utilities of VGAM2007 include diagnosis, prevention and treatment of diseases and clinical conditions associated with DKFZp547M072. FLJ14594 (Accession NM_032808) is another VGAM2007 host target gene. FLJ14594 BINDING SITE is HOST TARGET binding site found in the 3' untranslated region of mRNA encoded by FLJ14594, corresponding to a HOST TARGET binding site such as BINDING SITE I, BINDING SITE II or BINDING SITE III. Table 2 illustrates the complementarity of the nucleotide sequences of FLJ14594 BINDING SITE, designated SEQ ID:26568, to the nucleotide sequence of VGAM2007 RNA, herein designated VGAM RNA, also designated SEQ ID:4718.

Another function of VGAM2007 is therefore inhibition of FLJ14594 (Accession NM_032808). Accordingly, utilities of VGAM2007 include diagnosis, prevention and treatment of diseases and clinical conditions associated with FLJ14594. FUS Interacting Protein (serine-arginine rich) 1 (FUSIP1, Accession NM_006625) is another VGAM2007 host target gene. FUSIP1 BINDING SITE is HOST TARGET binding site found in the 3' untranslated region of mRNA encoded by FUSIP1, corresponding to a HOST TARGET binding site such as BINDING SITE I, BINDING SITE II or BINDING SITE III. Table 2 illustrates the complementarity of the nucleotide sequences of FUSIP1 BINDING SITE, designated SEQ ID:13411, to the nucleotide sequence of VGAM2007 RNA, herein designated VGAM RNA, also designated SEQ ID:4718.

Another function of VGAM2007 is therefore inhibition of FUS Interacting Protein (serine-arginine rich) 1 (FUSIP1, Accession NM_006625). Accordingly, utilities of VGAM2007 include diagnosis, prevention and treatment of diseases and clinical conditions associated with FUSIP1. KIAA0193 (Accession NM_014766) is another VGAM2007 host target gene. KIAA0193 BINDING SITE is HOST TARGET binding site found in the 3" untranslated region of mRNA encoded by KIAA0193, corresponding to a HOST TARGET binding site such as BINDING SITE I, BINDING SITE II or BINDING SITE III. Table 2 illustrates the complementarity of the nucleotide sequences of KIAA0193 BINDING SITE, designated SEQ ID:16548, to the nucleotide sequence of VGAM2007 RNA, herein designated VGAM RNA, also designated SEQ ID:4718.

Another function of VGAM2007 is therefore inhibition of KIAA0193 (Accession NM_014766). Accordingly, utilities of VGAM2007 include diagnosis, prevention and treatment of diseases and clinical conditions associated with KIAA0193. KIAA0435 (Accession NM_014801) is another VGAM2007 host target gene. KIAA0435 BINDING SITE is HOST TARGET binding site found in the 3' untranslated region of mRNA encoded by KIAA0435, corresponding to a HOST TARGET binding site such as BINDING SITE I, BINDING SITE II or BINDING SITE III. Table 2 illustrates the complementarity of the nucleotide sequences of KIAA0435 BINDING SITE, designated SEQ ID:16724, to the nucleotide sequence of VGAM2007 RNA, herein designated VGAM RNA, also designated SEQ ID:4718.

Another function of VGAM2007 is therefore inhibition of KIAA0435 (Accession NM_014801). Accordingly, utilities of VGAM2007 include diagnosis, prevention and treatment of diseases and clinical conditions associated with KIAA0435. KIAA1755 (Accession XM_028810) is another VGAM2007 host target gene. KIAA1755 BINDING SITE is HOST TARGET binding site found in the 3' untranslated region of mRNA encoded by KIAA1755, corresponding to a HOST TARGET binding site such as BINDING SITE I, BINDING SITE II or BINDING SITE III. Table 2 illustrates the complementarity of the nucleotide sequences of KIAA1755 BINDING SITE, designated SEQ ID:30753, to the nucleotide sequence of VGAM2007 RNA, herein designated VGAM RNA, also designated SEQ ID:4718.

Another function of VGAM2007 is therefore inhibition of KIAA1755 (Accession XM_028810). Accordingly, utilities of VGAM2007 include diagnosis, prevention and treatment of diseases and clinical conditions associated with KIAA1755. Lysosomal-associated Membrane Protein 3 (LAMP3, Accession XM_003022) is another VGAM2007 host target gene. LAMP3 BINDING SITE is HOST TARGET binding site found in the 3' untranslated region of mRNA encoded by LAMP3, corresponding to a HOST TARGET binding site such as BINDING SITE I, BINDING SITE II or BINDING SITE III. Table 2 illustrates the complementarity of the nucleotide sequences of LAMP3 BINDING SITE, designated SEQ ID:29917, to the nucleotide sequence of VGAM2007 RNA, herein designated VGAM RNA, also designated SEQ ID:4718.

Another function of VGAM2007 is therefore inhibition of Lysosomal-associated Membrane Protein 3 (LAMP3, Accession XM_003022). Accordingly, utilities of VGAM2007 include diagnosis, prevention and treatment of diseases and clinical conditions associated with LAMP3. MacGAP (Accession NM_033515) is another VGAM2007 host target gene. MacGAP BINDING SITE is HOST TARGET binding site found in the 3' untranslated region of mRNA encoded by MacGAP, corresponding to a HOST TARGET binding site such as BINDING SITE I, BINDING SITE II or BINDING SITE III. Table 2 illustrates the complementarity of the nucleotide sequences of MacGAP BINDING SITE, designated SEQ ID:27290, to the nucleotide sequence of VGAM2007 RNA, herein designated VGAM RNA, also designated SEQ ID:4718.

Another function of VGAM2007 is therefore inhibition of MacGAP (Accession NM_033515). Accordingly, utilities of VGAM2007 include diagnosis, prevention and treatment of diseases and clinical conditions associated with MacGAP. MGC12217 (Accession NM_032771) is another VGAM2007 host target gene. MGC12217 BINDING SITE is HOST TARGET binding site found in the 3' untranslated region of mRNA encoded by MGC12217, corresponding to a HOST TARGET binding site such as BINDING SITE I, BINDING SITE II or BINDING SITE III. Table 2 illustrates the complementarity of the nucleotide sequences of MGC12217 BINDING SITE, designated SEQ ID:26518, to the nucleotide sequence of VGAM2007 RNA, herein designated VGAM RNA, also designated SEQ ID:4718.

Another function of VGAM2007 is therefore inhibition of MGC12217 (Accession NM_032771). Accordingly, utilities of VGAM2007 include diagnosis, prevention and treatment of diseases and clinical conditions associated with MGC12217. Protein Tyrosine Phosphatase, Receptor Type, F Polypeptide (PTPRF), Interacting Protein (liprin), Alpha 4 (PPFIA4, Accession XM_046751) is another VGAM2007 host target gene. PPFIA4 BINDING SITE is HOST TARGET binding site found in the 3' untranslated region of mRNA encoded by PPFIA4, corresponding to a HOST TARGET binding site such as BINDING SITE I, BINDING SITE II or BINDING SITE III. Table 2 illustrates the complementarity of the nucleotide sequences of PPFIA4 BINDING SITE, designated SEQ ID:34822, to the nucleotide sequence of VGAM2007 RNA, herein designated VGAM RNA, also designated SEQ ID:4718.

Another function of VGAM2007 is therefore inhibition of Protein Tyrosine Phosphatase, Receptor Type, F Polypeptide (PTPRF), Interacting Protein (liprin), Alpha 4 (PPFIA4, Accession XM_046751). Accordingly, utilities of VGAM2007 include diagnosis, prevention and treatment of diseases and clinical conditions associated with PPFIA4. RAB6C, Member RAS Oncogene Family (RAB6C, Accession NM_032144) is another VGAM2007 host target gene. RAB6C BINDING SITE is HOST TARGET binding site found in the 3' untranslated region of mRNA encoded by RAB6C, corresponding to a HOST TARGET binding site such as BINDING SITE I, BINDING SITE II or BINDING SITE III. Table 2 illustrates the complementarity of the nucleotide sequences of RAB6C BINDING SITE, designated SEQ ID:25837, to the nucleotide sequence of VGAM2007 RNA, herein designated VGAM RNA, also designated SEQ ID:4718.

Another function of VGAM2007 is therefore inhibition of RAB6C, Member RAS Oncogene Family (RAB6C, Accession NM_032144). Accordingly, utilities of VGAM2007 include diagnosis, prevention and treatment of diseases and clinical conditions associated with RAB6C. SARM (Accession NM_015077) is another VGAM2007 host target gene. SARM BINDING SITE is HOST TARGET binding site found in the 3' untranslated region of mRNA encoded by SARM, corresponding to a HOST TARGET binding site such as BINDING SITE I, BINDING SITE II or BINDING SITE III. Table 2 illustrates the complementarity of the nucleotide sequences of SARM BINDING SITE, designated SEQ ID:17463, to the nucleotide sequence of VGAM2007 RNA, herein designated VGAM RNA, also designated SEQ ID:4718.

Another function of VGAM2007 is therefore inhibition of SARM (Accession NM_015077). Accordingly, utilities of VGAM2007 include diagnosis, prevention and treatment of diseases and clinical conditions associated with SARM. LOC148823 (Accession NM_145278) is another VGAM2007 host target gene. LOC148823 BINDING SITE is HOST TARGET binding site found in the 3' untranslated region of mRNA encoded by LOC148823, corresponding to a HOST TARGET binding site such as BINDING SITE I, BINDING SITE II or BINDING SITE III. Table 2 illustrates the complementarity of the nucleotide sequences of LOC148823 BINDING SITE, designated SEQ ID:29791, to the nucleotide sequence of VGAM2007 RNA, herein designated VGAM RNA, also designated SEQ ID:4718.

Another function of VGAM2007 is therefore inhibition of LOC148823 (Accession NM_145278). Accordingly, utilities of VGAM2007 include diagnosis, prevention and treatment of diseases and clinical conditions associated with LOC148823. LOC159121 (Accession XM_099028) is another VGAM2007 host target gene. LOC159121 BINDING SITE is HOST TARGET binding site found in the 5' untranslated region of mRNA encoded by LOC159121, corresponding to a HOST TARGET binding site such as BINDING SITE I, BINDING SITE II or BINDING SITE III. Table 2 illustrates the complementarity of the nucleotide sequences of LOC159121 BINDING SITE, designated SEQ ID:42065, to the nucleotide sequence of VGAM2007 RNA, herein designated VGAM RNA, also designated SEQ ID:4718.

Another function of VGAM2007 is therefore inhibition of LOC159121 (Accession XM_099028). Accordingly, utilities of VGAM2007 include diagnosis, prevention and treatment of diseases and clinical conditions associated with LOC159121. LOC164955 (Accession XM_092265) is another VGAM2007 host target gene. LOC164955 BINDING SITE is HOST TARGET binding site found in the 3' untranslated region of mRNA encoded by LOC164955, corresponding to a HOST TARGET binding site such as BINDING SITE I, BINDING SITE II or BINDING SITE III. Table 2 illustrates the complementarity of the nucleotide sequences of LOC164955 BINDING SITE, designated SEQ ID:40114, to the nucleotide sequence of VGAM2007 RNA, herein designated VGAM RNA, also designated SEQ ID:4718.

Another function of VGAM2007 is therefore inhibition of LOC164955 (Accession XM_092265). Accordingly, utilities of VGAM2007 include diagnosis, prevention and treatment of diseases and clinical conditions associated with LOC164955. LOC200269 (Accession XM_114175) is another VGAM2007 host target gene. LOC200269 BINDING SITE is HOST TARGET binding site found in the 5' untranslated region of mRNA encoded by LOC200269, corresponding to a HOST TARGET binding site such as BINDING SITE I, BINDING SITE II or BINDING SITE III. Table 2 illustrates the complementarity of the nucleotide sequences of LOC200269 BINDING SITE, designated SEQ ID:42758, to the nucleotide sequence of VGAM2007 RNA, herein designated VGAM RNA, also designated SEQ ID:4718.

Another function of VGAM2007 is therefore inhibition of LOC200269 (Accession XM_114175). Accordingly, utilities of VGAM2007 include diagnosis, prevention and treatment of diseases and clinical conditions associated with LOC200269. LOC200830 (Accession XM_117287) is another VGAM2007 host target gene. LOC200830 BINDING SITE is HOST TARGET binding site found in the 3' untranslated region of mRNA encoded by LOC200830, corresponding to a HOST TARGET binding site such as BINDING SITE I, BINDING SITE II or BINDING SITE III. Table 2 illustrates the complementarity of the nucleotide sequences of LOC200830 BINDING SITE, designated SEQ ID:43348, to the nucleotide sequence of VGAM2007 RNA, herein designated VGAM RNA, also designated SEQ ID:4718.

Another function of VGAM2007 is therefore inhibition of LOC200830 (Accession XM_117287). Accordingly, utilities of VGAM2007 include diagnosis, prevention and treatment of diseases and clinical conditions associated with LOC200830. LOC256946 (Accession XM_170543) is another VGAM2007 host target gene. LOC256946 BINDING SITE is HOST TARGET binding site found in the 3' untranslated region of mRNA encoded by LOC256946, corresponding to a HOST TARGET binding site such as BINDING SITE I, BINDING SITE II or BINDING SITE III. Table 2 illustrates the complementarity of the nucleotide sequences of LOC256946 BINDING SITE, designated SEQ ID:45361, to the nucleotide sequence of VGAM2007 RNA, herein designated VGAM RNA, also designated SEQ ID:4718.

Another function of VGAM2007 is therefore inhibition of LOC256946 (Accession XM_170543). Accordingly, utilities of VGAM2007 include diagnosis, prevention and treatment of diseases and clinical conditions associated with LOC256946. LOC85414 (Accession NM_033102) is another VGAM2007 host target gene. LOC85414 BINDING SITE is HOST TARGET binding site found in the 3' untranslated region of mRNA encoded by LOC85414, corresponding to a HOST TARGET binding site such as BINDING SITE I, BINDING SITE II or BINDING SITE III. Table 2 illustrates the complementarity of the nucleotide sequences of LOC85414 BINDING SITE, designated SEQ ID:26949, to the nucleotide sequence of VGAM2007 RNA, herein designated VGAM RNA, also designated SEQ ID:4718.

Another function of VGAM2007 is therefore inhibition of LOC85414 (Accession NM_033102). Accordingly, utilities of VGAM2007 include diagnosis, prevention and treatment of diseases and clinical conditions associated with LOC85414. LOC90110 (Accession XM_029046) is another VGAM2007 host target gene. LOC90110 BINDING SITE is HOST TARGET binding site found in the 5' untranslated region of mRNA encoded by LOC90110, corresponding to a HOST TARGET binding site such as BINDING SITE I, BINDING SITE II or BINDING SITE III. Table 2 illustrates the complementarity of the nucleotide sequences of LOC90110 BINDING SITE, designated SEQ ID:30841, to the nucleotide sequence of VGAM2007 RNA, herein designated VGAM RNA, also designated SEQ ID:4718.

Another function of VGAM2007 is therefore inhibition of LOC90110 (Accession XM_029046). Accordingly, utilities of VGAM2007 include diagnosis, prevention and treatment of diseases and clinical conditions associated with LOC90110. LOC92659 (Accession XM_046434) is another VGAM2007 host target gene. LOC92659 BINDING SITE is HOST TARGET binding site found in the 5' untranslated region of mRNA encoded by LOC92659, corresponding to a HOST TARGET binding site such as BINDING SITE I, BINDING SITE II or BINDING SITE III. Table 2 illustrates the complementarity of the nucleotide sequences of LOC92659 BINDING SITE, designated SEQ ID:34716, to the nucleotide sequence of VGAM2007 RNA, herein designated VGAM RNA, also designated SEQ ID:4718.

Another function of VGAM2007 is therefore inhibition of LOC92659 (Accession XM_046434). Accordingly, utilities of VGAM2007 include diagnosis, prevention and treatment of diseases and clinical conditions associated with LOC92659. FIG. 1 further provides a conceptual description of a novel bioinformatically detected viral gene of the present invention, referred to here as Viral Genomic Address Messenger 2008 (VGAM2008) viral gene, which modulates expression of respective host target genes thereof, the function and utility of which host target genes is known in the art.

VGAM2008 is a novel bioinformatically detected regulatory, non protein coding, viral micro RNA (miRNA) gene. The method by which VGAM2008 was detected is described hereinabove with reference to FIGS. 1-8.

VGAM2008 gene, herein designated VGAM GENE, is a viral gene contained in the genome of Reston Ebola Virus (REBOV). VGAM2008 host target gene, herein designated VGAM HOST TARGET GENE, is a human gene contained in the human genome.

VGAM2008 gene encodes a VGAM2008 precursor RNA, herein designated VGAM PRECURSOR RNA. Similar to other miRNA genes, and unlike most ordinary genes, VGAM2008 precursor RNA does not encode a protein. A nucleotide sequence identical or highly similar to the nucleotide sequence of VGAM2008 precursor RNA is designated SEQ ID:1994, and is provided hereinbelow with reference to the sequence listing part. Nucleotide sequence SEQ ID:1994 is located at position 11658 relative to the genome of Reston Ebola Virus (REBOV).

VGAM2008 precursor RNA folds onto itself, forming VGAM2008 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2008 folded precursor RNA into VGAM2008 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2008 RNA is designated SEQ ID:4719, and is provided hereinbelow with reference to the sequence listing part.

VGAM2008 host target gene, herein designated VGAM HOST TARGET GENE, encodes a corresponding messenger RNA, VGAM2008 host target RNA, herein designated VGAM HOST TARGET RNA. VGAM2008 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2008 RNA, herein designated VGAM RNA, binds complementarily to one or more host target binding sites located in untranslated regions of VGAM2008 host target RNA, herein designated VGAM HOST TARGET RNA. This complementary binding is due to the fact that the nucleotide sequence of VGAM2008 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2008 RNA, herein designated VGAM RNA, may have a different number of host target binding sites in untranslated regions of a VGAM2008 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2008 RNA, herein designated VGAM RNA, to host target binding sites on VGAM2008 host target RNA, herein designated VGAM HOST TARGET RNA, such as BINDING SITE I, BINDING SITE II and BINDING SITE III, inhibits translation of VGAM2008 host target RNA into VGAM2008 host target protein, herein designated VGAM HOST TARGET PROTEIN. VGAM host target protein is therefore outlined by a broken line.

It is appreciated that VGAM2008 host target gene, herein designated VGAM HOST TARGET GENE, in fact represents a plurality of VGAM2008 host target genes. The mRNA of each one of this plurality of VGAM2008 host target genes comprises one or more host target binding sites, each having a nucleotide sequence which is at least partly complementary to VGAM2008 RNA, herein designated VGAM RNA, and which when bound by VGAM2008 RNA causes inhibition of translation of respective one or more VGAM2008 host target proteins.

It is further appreciated by one skilled in the art that the mode of translational inhibition illustrated by FIG. 1 with specific reference to translational inhibition exerted by VGAM2008 gene, herein designated VGAM GENE, on one or more VGAM2008 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2008 is inhibition of expression of host target genes, as part of a novel viral mechanism of attacking a host. Accordingly, utilities of VGAM2008 include diagnosis, prevention and treatment of viral infection by Reston Ebola Virus (REBOV). Specific functions, and accordingly utilities, of VGAM2008 correlate with, and may be deduced from, the identity of the host target genes which VGAM2008 binds and inhibits, and the function of these host target genes, as elaborated hereinbelow.

Nucleotide sequences of the VGAM2008 precursor RNA, herein designated VGAM PRECURSOR RNA, and of the 'diced' VGAM2008 RNA, herein designated VGAM RNA, and a schematic representation of the secondary folding of VGAM2008 folded precursor RNA, herein designated VGAM FOLDED PRECURSOR RNA, of VGAM2008 are further described hereinbelow with reference to Table 1.

Nucleotide sequences of host target binding sites, such as BINDING SITE-I, BINDING SITE-II and BINDING SITE-III of FIG. 1, found on VGAM2008 host target RNA, and schematic representation of the complementarity of each of these host target binding sites to VGAM2008 RNA, herein designated VGAM RNA, are described hereinbelow with reference to Table 2.

As mentioned hereinabove with reference to FIG. 1, a function of VGAM2008 gene, herein designated VGAM is inhibition of expression of VGAM2008 target genes. It is appreciated that specific functions, and accordingly utilities, of VGAM2008 correlate with, and may be deduced from, the identity of the target genes which VGAM2008 binds and inhibits, and the function of these target genes, as elaborated hereinbelow.

Chromosome 8 Open Reading Frame 1 (C8orf1, Accession NM_004337) is a VGAM2008 host target gene. C8orf1 BINDING SITE is HOST TARGET binding site found in the 3' untranslated region of mRNA encoded by C8orf1, corresponding to a HOST TARGET binding site such as BINDING SITE I, BINDING SITE II or BINDING SITE III. Table 2 illustrates the complementarity of the nucleotide sequences of C8orf1 BINDING SITE, designated SEQ ID:10530, to the nucleotide sequence of VGAM2008 RNA, herein designated VGAM RNA, also designated SEQ ID:4719.

A function of VGAM2008 is therefore inhibition of Chromosome 8 Open Reading Frame 1 (C8orf1, Accession NM_004337). Accordingly, utilities of VGAM2008 include diagnosis, prevention and treatment of diseases and clinical conditions associated with C8orf1. Synaptotagmin I (SYT1, Accession NM_005639) is another VGAM2008 host target gene. SYT1 BINDING SITE is HOST TARGET binding site found in the 3' untranslated region of mRNA encoded by SYT1, corresponding to a HOST TARGET binding site such as BINDING SITE I, BINDING SITE II or BINDING SITE III. Table 2 illustrates the complementarity of the nucleotide sequences of SYT1 BINDING SITE, designated SEQ ID:12169, to the nucleotide sequence of VGAM2008 RNA, herein designated VGAM RNA, also designated SEQ ID:4719.

Another function of VGAM2008 is therefore inhibition of Synaptotagmin I (SYT1, Accession NM_005639), a gene which may have a regulatory role in the membrane interactions during trafficking of synaptic vesicles at the active zone of the synapse. Accordingly, utilities of VGAM2008 include diagnosis, prevention and treatment of diseases and clinical conditions associated with SYT1. The function of SYT1 and its association with various diseases and clinical conditions, has been established by previous studies, as described hereinabove with reference to VGAM739. Carbohydrate (chondroitin 6) Sulfotransferase 3 (CHST3, Accession NM_004273) is another VGAM2008 host target gene. CHST3 BINDING SITE is HOST TARGET binding site found in the 3' untranslated region of mRNA encoded by CHST3, corresponding to a HOST TARGET binding site such as BINDING SITE I, BINDING SITE II or BINDING SITE III. Table 2 illustrates the complementarity of the nucleotide sequences of CHST3 BINDING SITE, designated SEQ ID:10474, to the nucleotide sequence of VGAM2008 RNA, herein designated VGAM RNA, also designated SEQ ID:4719.

Another function of VGAM2008 is therefore inhibition of Carbohydrate (chondroitin 6) Sulfotransferase 3 (CHST3, Accession NM_004273). Accordingly, utilities of VGAM2008 include diagnosis, prevention and treatment of diseases and clinical conditions associated with CHST3. KIAA1055 (Accession XM_038509) is another VGAM2008 host target gene. KIAA1055 BINDING SITE is HOST TARGET binding site found in the 3" untranslated region of mRNA encoded by KIAA1055, corresponding to a HOST TARGET binding site such as BINDING SITE I, BINDING SITE II or BINDING SITE III. Table 2 illustrates the complementarity of the nucleotide sequences of KIAA1055 BINDING SITE, designated SEQ ID:32849, to the nucleotide sequence of VGAM2008 RNA, herein designated VGAM RNA, also designated SEQ ID:4719.

Another function of VGAM2008 is therefore inhibition of KIAA1055 (Accession XM_038509). Accordingly, utilities of VGAM2008 include diagnosis, prevention and treatment of diseases and clinical conditions associated with KIAA1055. Syndecan 3 (N-syndecan) (SDC3, Accession NM_014654) is another VGAM2008 host target gene. SDC3 BINDING SITE is HOST TARGET binding site found in the 3' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16077, to the nucleotide sequence of VGAM2008 RNA, herein designated VGAM RNA, also designated SEQ ID:4719.

Another function of VGAM2008 is therefore inhibition of Syndecan 3 (N-syndecan) (SDC3, Accession NM_014654). Accordingly, utilities of VGAM2008 include diagnosis, prevention and treatment of diseases and clinical conditions associated with SDC3. Zinc Finger Protein 387 (ZNF387, Accession NM_014682) is another VGAM2008 host target gene. ZNF387 BINDING SITE is HOST TARGET binding site found in the 5' untranslated region of mRNA encoded by ZNF387, corresponding to a HOST TARGET binding site such as BINDING SITE I, BINDING SITE II or BINDING SITE III. Table 2 illustrates the complementarity of the nucleotide sequences of ZNF387 BINDING SITE, designated SEQ ID:16171, to the nucleotide sequence of VGAM2008 RNA, herein designated VGAM RNA, also designated SEQ ID:4719.

Another function of VGAM2008 is therefore inhibition of Zinc Finger Protein 387 (ZNF387, Accession NM_014682). Accordingly, utilities of VGAM2008 include diagnosis, prevention and treatment of diseases and clinical conditions associated with ZNF387. LOC151234 (Accession XM_087136) is another VGAM2008 host target gene. LOC151234 BINDING SITE is HOST TARGET binding site found in the 3' untranslated region of mRNA encoded by LOC151234, corresponding to a HOST TARGET binding site such as BINDING SITE I, BINDING SITE II or BINDING SITE III. Table 2 illustrates the complementarity of the nucleotide sequences of LOC151234 BINDING SITE, designated SEQ ID:39078, to the nucleotide sequence of VGAM2008 RNA, herein designated VGAM RNA, also designated SEQ ID:4719.

Another function of VGAM2008 is therefore inhibition of LOC151234 (Accession XM_087136). Accordingly, utilities of VGAM2008 include diagnosis, prevention and treatment of diseases and clinical conditions associated with LOC151234. LOC96597 (Accession XM_039922) is another VGAM2008 host target gene. LOC96597 BINDING SITE is HOST TARGET binding site found in the 5' untranslated region of mRNA encoded by LOC96597, corresponding to a HOST TARGET binding site such as BINDING SITE I, BINDING SITE II or BINDING SITE III. Table 2 illustrates the complementarity of the nucleotide sequences of LOC96597 BINDING SITE, designated SEQ ID:33225, to the nucleotide sequence of VGAM2008 RNA, herein designated VGAM RNA, also designated SEQ ID:4719.

Another function of VGAM2008 is therefore inhibition of LOC96597 (Accession XM_039922). Accordingly, utilities of VGAM2008 include diagnosis, prevention and treatment of diseases and clinical conditions associated with LOC96597. FIG. 1 further provides a conceptual description of a novel bioinformatically detected viral gene of the present invention, referred to here as Viral Genomic Address Messenger 2009 (VGAM2009) viral gene, which modulates expression of respective host target genes thereof, the function and utility of which host target genes is known in the art.

VGAM2009 is a novel bioinformatically detected regulatory, non protein coding, viral micro RNA (miRNA) gene. The method by which VGAM2009 was detected is described hereinabove with reference to FIGS. 1-8.

VGAM2009 gene, herein designated VGAM GENE, is a viral gene contained in the genome of Reston Ebola Virus (REBOV). VGAM2009 host target gene, herein designated VGAM HOST TARGET GENE, is a human gene contained in the human genome.

VGAM2009 gene encodes a VGAM2009 precursor RNA, herein designated VGAM PRECURSOR RNA. Similar to other miRNA genes, and unlike most ordinary genes, VGAM2009 precursor RNA does not encode a protein. A nucleotide sequence identical or highly similar to the nucleotide sequence of VGAM2009 precursor RNA is designated SEQ ID:1995, and is provided hereinbelow with reference to the sequence listing part. Nucleotide sequence SEQ ID:1995 is located at position 12590 relative to the genome of Reston Ebola Virus (REBOV).

VGAM2009 precursor RNA folds onto itself, forming VGAM2009 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2009 folded precursor RNA into VGAM2009 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2009 RNA is designated SEQ ID:4720, and is provided hereinbelow with reference to the sequence listing part.

VGAM2009 host target gene, herein designated VGAM HOST TARGET GENE, encodes a corresponding messenger RNA, VGAM2009 host target RNA, herein designated VGAM HOST TARGET RNA. VGAM2009 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2009 RNA, herein designated VGAM RNA, binds complementarily to one or more host target binding sites located in untranslated regions of VGAM2009 host target RNA, herein designated VGAM HOST TARGET RNA. This complementary binding is due to the fact that the nucleotide sequence of VGAM2009 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2009 RNA, herein designated VGAM RNA, may have a different number of host target binding sites in untranslated regions of a VGAM2009 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2009 RNA, herein designated VGAM RNA, to host target binding sites on VGAM2009 host target RNA, herein designated VGAM HOST TARGET RNA, such as BINDING SITE I, BINDING SITE II and BINDING SITE III, inhibits translation of VGAM2009 host target RNA into VGAM2009 host target protein, herein designated VGAM HOST TARGET PROTEIN. VGAM host target protein is therefore outlined by a broken line.

It is appreciated that VGAM2009 host target gene, herein designated VGAM HOST TARGET GENE, in fact represents a plurality of VGAM2009 host target genes. The mRNA of each one of this plurality of VGAM2009 host target genes comprises one or more host target binding sites, each having a nucleotide sequence which is at least partly complementary to VGAM2009 RNA, herein designated VGAM RNA, and which when bound by VGAM2009 RNA causes inhibition of translation of respective one or more VGAM2009 host target proteins.

It is further appreciated by one skilled in the art that the mode of translational inhibition illustrated by FIG. 1 with specific reference to translational inhibition exerted by VGAM2009 gene, herein designated VGAM GENE, on one or more VGAM2009 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2009 is inhibition of expression of host target genes, as part of a novel viral mechanism of attacking a host. Accordingly, utilities of VGAM2009 include diagnosis, prevention and treatment of viral infection by Reston Ebola Virus (REBOV). Specific functions, and accordingly utilities, of VGAM2009 correlate with, and may be deduced from, the identity of the host target genes which VGAM2009 binds and inhibits, and the function of these host target genes, as elaborated hereinbelow.

Nucleotide sequences of the VGAM2009 precursor RNA, herein designated VGAM PRECURSOR RNA, and of the 'diced' VGAM2009 RNA, herein designated VGAM RNA, and a schematic representation of the secondary folding of VGAM2009 folded precursor RNA, herein designated VGAM FOLDED PRECURSOR RNA, of VGAM2009 are further described hereinbelow with reference to Table 1.

Nucleotide sequences of host target binding sites, such as BINDING SITE-I, BINDING SITE-II and BINDING SITE-III of FIG. 1, found on VGAM2009 host target RNA, and schematic representation of the complementarity of each of these host target binding sites to VGAM2009 RNA, herein designated VGAM RNA, are described hereinbelow with reference to Table 2.

As mentioned hereinabove with reference to FIG. 1, a function of VGAM2009 gene, herein designated VGAM is inhibition of expression of VGAM2009 target genes. It is appreciated that specific functions, and accordingly utilities, of VGAM2009 correlate with, and may be deduced from, the identity of the target genes which VGAM2009 binds and inhibits, and the function of these target genes, as elaborated hereinbelow.

Phosphoinositide-3-kinase, Regulatory Subunit, Polypeptide 1 (p85 alpha) (PIK3R1, Accession XM_043865) is a VGAM2009 host target gene. PIK3R1 BINDING SITE is HOST TARGET binding site found in the 3' untranslated region of mRNA encoded by PIK3R1, corresponding to a HOST TARGET binding site such as BINDING SITE I, BINDING SITE II or BINDING SITE III. Table 2 illustrates the complementarity of the nucleotide sequences of PIK3R1 BINDING SITE, designated SEQ ID:34039, to the nucleotide sequence of VGAM2009 RNA, herein designated VGAM RNA, also designated SEQ ID:4720.

A function of VGAM2009 is therefore inhibition of Phosphoinositide-3-kinase, Regulatory Subunit, Polypeptide 1 (p85 alpha) (PIK3R1, Accession XM_043865), a gene which acts as an adapter, for the insulin-stimulated increase in glucose uptake and glycogen synthesis. Accordingly, utilities of VGAM2009 include diagnosis, prevention and treatment of diseases and clinical conditions associated with PIK3R1. The function of PIK3R1 and its association with various diseases and clinical conditions, has been established by previous studies, as described hereinabove with reference to VGAM826. Suppression of Tumorigenicity 7 (ST7, Accession NM_013437) is another VGAM2009 host target gene. ST7 BINDING SITE is HOST TARGET binding site found in the 3' untranslated region of mRNA encoded by ST7, corresponding to a HOST TARGET binding site such as BINDING SITE I, BINDING SITE II or BINDING SITE III. Table 2 illustrates the complementarity of the nucleotide sequences of ST7 BINDING SITE, designated SEQ ID:15099, to the nucleotide sequence of VGAM2009 RNA, herein designated VGAM RNA, also designated SEQ ID:4720.

Another function of VGAM2009 is therefore inhibition of Suppression of Tumorigenicity 7 (ST7, Accession NM_013437), a gene which has a role in regulating cell-environment or cell-cell interactions. Accordingly, utilities of VGAM2009 include diagnosis, prevention and treatment of diseases and clinical conditions associated with ST7. The function of ST7 and its association with various diseases and clinical conditions, has been established by previous studies, as described hereinabove with reference to VGAM107. Supervillin (SVIL, Accession NM_003174) is another VGAM2009 host target gene. SVIL BINDING SITE1 and SVIL BINDING SITE2 are HOST TARGET binding sites found in untranslated regions of mRNA encoded by SVIL, corresponding to HOST TARGET binding sites such as BINDING SITE I, BINDING SITE II or BINDING SITE III. Table 2 illustrates the complementarity of the nucleotide sequences of SVIL BINDING SITE1 and SVIL BINDING SITE2, designated SEQ ID:9151 and SEQ ID:22348 respectively, to the nucleotide sequence of VGAM2009 RNA, herein designated VGAM RNA, also designated SEQ ID:4720.

Another function of VGAM2009 is therefore inhibition of Supervillin (SVIL, Accession NM_003174), a gene which binds actin, links filamentous actin with the plasma membrane; and contains putative nuclear localization signals. Accordingly, utilities of VGAM2009 include diagnosis, prevention and treatment of diseases and clinical conditions associated with SVIL. The function of SVIL and its association with various diseases and clinical conditions, has been established by previous studies, as described hereinabove with reference to VGAM1459. GNB4 (Accession NM_021629) is another VGAM2009 host target gene. GNB4 BINDING SITE is HOST TARGET binding site found in the 3' untranslated region of mRNA encoded by GNB4, corresponding to a HOST TARGET binding site such as BINDING SITE I, BINDING SITE II or BINDING SITE III. Table 2 illustrates the complementarity of the nucleotide sequences of GNB4 BINDING SITE, designated SEQ ID:22269, to the nucleotide sequence of VGAM2009 RNA, herein designated VGAM RNA, also designated SEQ ID:4720.

Another function of VGAM2009 is therefore inhibition of GNB4 (Accession NM_021629). Accordingly, utilities of VGAM2009 include diagnosis, prevention and treatment of diseases and clinical conditions associated with GNB4. KIAA0530 (Accession XM_048070) is another VGAM2009 host target gene. KIAA0530 BINDING SITE is HOST TARGET binding site found in the 3' untranslated region of mRNA encoded by KIAA0530, corresponding to a HOST TARGET binding site such as BINDING SITE I, BINDING SITE II or BINDING SITE III. Table 2 illustrates the complementarity of the nucleotide sequences of KIAA0530 BINDING SITE, designated SEQ ID:35099, to the nucleotide sequence of VGAM2009 RNA, herein designated VGAM RNA, also designated SEQ ID:4720.

Another function of VGAM2009 is therefore inhibition of KIAA0530 (Accession XM_048070). Accordingly, utilities of VGAM2009 include diagnosis, prevention and treatment of diseases and clinical conditions associated with KIAA0530. KIAA1265 (Accession XM_047707) is another VGAM2009 host target gene. KIAA1265 BINDING SITE is HOST TARGET binding site found in the 3' untranslated region of mRNA encoded by KIAA1265, corresponding to a HOST TARGET binding site such as BINDING SITE I, BINDING SITE II or BINDING SITE III. Table 2 illustrates the complementarity of the nucleotide sequences of KIAA1265 BINDING SITE, designated SEQ ID:35032, to the nucleotide sequence of VGAM2009 RNA, herein designated VGAM RNA, also designated SEQ ID:4720.

Another function of VGAM2009 is therefore inhibition of KIAA1265 (Accession XM_047707). Accordingly, utilities of VGAM2009 include diagnosis, prevention and treatment of diseases and clinical conditions associated with KIAA1265. Testis-specific Transcript, Y-linked 9 (TTTY9, Accession NM_031927) is another VGAM2009 host target gene. TTTY9 BINDING SITE is HOST TARGET binding site found in the 3' untranslated region of mRNA encoded by TTTY9, corresponding to a HOST TARGET binding site such as BINDING SITE I, BINDING SITE II or BINDING SITE III. Table 2 illustrates the complementarity of the nucleotide sequences of TTTY9 BINDING SITE, designated SEQ ID:25677, to the nucleotide sequence of VGAM2009 RNA, herein designated VGAM RNA, also designated SEQ ID:4720.

Another function of VGAM2009 is therefore inhibition of Testis-specific Transcript, Y-linked 9 (TTTY9, Accession NM_031927). Accordingly, utilities of VGAM2009 include diagnosis, prevention and treatment of diseases and clinical conditions associated with TTTY9. LOC120856 (Accession XM_058509) is another VGAM2009 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36634, to the nucleotide sequence of VGAM2009 RNA, herein designated VGAM RNA, also designated SEQ ID:4720.

Another function of VGAM2009 is therefore inhibition of LOC120856 (Accession XM_058509). Accordingly, utilities of VGAM2009 include diagnosis, prevention and treatment of diseases and clinical conditions associated with LOC120856. LOC157278 (Accession XM_098741) is another VGAM2009 host target gene. LOC157278 BINDING SITE is HOST TARGET binding site found in the 3' untranslated region of mRNA encoded by LOC157278, corresponding to a HOST TARGET binding site such as BINDING SITE I, BINDING SITE II or BINDING SITE III. Table 2 illustrates the complementarity of the nucleotide sequences of LOC157278 BINDING SITE, designated SEQ ID:41777, to the nucleotide sequence of VGAM2009 RNA, herein designated VGAM RNA, also designated SEQ ID:4720.

Another function of VGAM2009 is therefore inhibition of LOC157278 (Accession XM_098741). Accordingly, utilities of VGAM2009 include diagnosis, prevention and treatment of diseases and clinical conditions associated with LOC157278. LOC221962 (Accession XM_166554) is another VGAM2009 host target gene. LOC221962 BINDING SITE is HOST TARGET binding site found in the 3' untranslated region of mRNA encoded by LOC221962, corresponding to a HOST TARGET binding site such as BIND- ING SITE I, BINDING SITE II or BINDING SITE III. Table 2 illustrates the complementarity of the nucleotide sequences of LOC221962 BINDING SITE, designated SEQ ID:44528, to the nucleotide sequence of VGAM2009 RNA, herein designated VGAM RNA, also designated SEQ ID:4720.

Another function of VGAM2009 is therefore inhibition of LOC221962 (Accession XM_166554). Accordingly, utilities of VGAM2009 include diagnosis, prevention and treatment of diseases and clinical conditions associated with LOC221962. LOC255461 (Accession XM_173207) is another VGAM2009 host target gene. LOC255461 BINDING SITE is HOST TARGET binding site found in the 3' untranslated region of mRNA encoded by LOC255461, corresponding to a HOST TARGET binding site such as BINDING SITE I, BINDING SITE II or BINDING SITE III. Table 2 illustrates the complementarity of the nucleotide sequences of LOC255461 BINDING SITE, designated SEQ ID:46463, to the nucleotide sequence of VGAM2009 RNA, herein designated VGAM RNA, also designated SEQ ID:4720.

Another function of VGAM2009 is therefore inhibition of LOC255461 (Accession XM_173207). Accordingly, utilities of VGAM2009 include diagnosis, prevention and treatment of diseases and clinical conditions associated with LOC255461. LOC255516 (Accession XM_173212) is another VGAM2009 host target gene. LOC255516 BINDING SITE is HOST TARGET binding site found in the 3' untranslated region of mRNA encoded by LOC255516, corresponding to a HOST TARGET binding site such as BINDING SITE I, BINDING SITE II or BINDING SITE III. Table 2 illustrates the complementarity of the nucleotide sequences of LOC255516 BINDING SITE, designated SEQ ID:46469, to the nucleotide sequence of VGAM2009 RNA, herein designated VGAM RNA, also designated SEQ ID:4720.

Another function of VGAM2009 is therefore inhibition of LOC255516 (Accession XM_173212). Accordingly, utilities of VGAM2009 include diagnosis, prevention and treatment of diseases and clinical conditions associated with LOC255516. FIG. 1 further provides a conceptual description of a novel bioinformatically detected viral gene of the present invention, referred to here as Viral Genomic Address Messenger 2010 (VGAM2010) viral gene, which modulates expression of respective host target genes thereof, the function and utility of which host target genes is known in the art.

VGAM2010 is a novel bioinformatically detected regulatory, non protein coding, viral micro RNA (miRNA) gene. The method by which VGAM2010 was detected is described hereinabove with reference to FIGS. 1-8.

VGAM2010 gene, herein designated VGAM GENE, is a viral gene contained in the genome of Reston Ebola Virus (REBOV). VGAM2010 host target gene, herein designated VGAM HOST TARGET GENE, is a human gene contained in the human genome.

VGAM2010 gene encodes a VGAM2010 precursor RNA, herein designated VGAM PRECURSOR RNA. Similar to other miRNA genes, and unlike most ordinary genes, VGAM2010 precursor RNA does not encode a protein. A nucleotide sequence identical or highly similar to the nucleotide sequence of VGAM2010 precursor RNA is designated SEQ ID:1996, and is provided hereinbelow with reference to the sequence listing part. Nucleotide sequence SEQ ID:1996 is located at position 17622 relative to the genome of Reston Ebola Virus (REBOV).

VGAM2010 precursor RNA folds onto itself, forming VGAM2010 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2010 folded precursor RNA into VGAM2010 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM2010 RNA is designated SEQ ID:4721, and is provided hereinbelow with reference to the sequence listing part.

VGAM2010 host target gene, herein designated VGAM HOST TARGET GENE, encodes a corresponding messenger RNA, VGAM2010 host target RNA, herein designated VGAM HOST TARGET RNA. VGAM2010 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2010 RNA, herein designated VGAM RNA, binds complementarily to one or more host target binding sites located in untranslated regions of VGAM2010 host target RNA, herein designated VGAM HOST TARGET RNA. This complementary binding is due to the fact that the nucleotide sequence of VGAM2010 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2010 RNA, herein designated VGAM RNA, may have a different number of host target binding sites in untranslated regions of a VGAM2010 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2010 RNA, herein designated VGAM RNA, to host target binding sites on VGAM2010 host target RNA, herein designated VGAM HOST TARGET RNA, such as BINDING SITE I, BINDING SITE II and BINDING SITE III, inhibits translation of VGAM2010 host target RNA into VGAM2010 host target protein, herein designated VGAM HOST TARGET PROTEIN. VGAM host target protein is therefore outlined by a broken line.

It is appreciated that VGAM2010 host target gene, herein designated VGAM HOST TARGET GENE, in fact represents a plurality of VGAM2010 host target genes. The mRNA of each one of this plurality of VGAM2010 host target genes comprises one or more host target binding sites, each having a nucleotide sequence which is at least partly complementary to VGAM2010 RNA, herein designated VGAM RNA, and which when bound by VGAM2010 RNA causes inhibition of translation of respective one or more VGAM2010 host target proteins.

It is further appreciated by one skilled in the art that the mode of translational inhibition illustrated by FIG. 1 with specific reference to translational inhibition exerted by VGAM2010 gene, herein designated VGAM GENE, on one or more VGAM2010 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2010 is inhibition of expression of host target genes, as part of a novel viral mechanism of attacking a host. Accordingly, utilities of VGAM2010 include diagnosis, prevention and treatment of viral infection by Reston Ebola Virus (REBOV). Specific functions, and accordingly utilities, of VGAM2010 correlate with, and may be deduced from, the identity of the host target genes which VGAM2010 binds and inhibits, and the function of these host target genes, as elaborated hereinbelow.

Nucleotide sequences of the VGAM2010 precursor RNA, herein designated VGAM PRECURSOR RNA, and of the 'diced' VGAM2010 RNA, herein designated VGAM RNA, and a schematic representation of the secondary folding of VGAM2010 folded precursor RNA, herein designated VGAM FOLDED PRECURSOR RNA, of VGAM2010 are further described hereinbelow with reference to Table 1.

Nucleotide sequences of host target binding sites, such as BINDING SITE-I, BINDING SITE-II and BINDING SITE-III of FIG. 1, found on VGAM2010 host target RNA, and schematic representation of the complementarity of each of these host target binding sites to VGAM2010 RNA, herein designated VGAM RNA, are described hereinbelow with reference to Table 2.

As mentioned hereinabove with reference to FIG. 1, a function of VGAM2010 gene, herein designated VGAM is inhibition of expression of VGAM2010 target genes. It is appreciated that specific functions, and accordingly utilities, of VGAM2010 correlate with, and may be deduced from, the identity of the target genes which VGAM2010 binds and inhibits, and the function of these target genes, as elaborated hereinbelow.

Complement Component (3b/4b) Receptor 1, Including Knops Blood Group System (CR1, Accession NM_000573) is a VGAM2010 host target gene. CR1 BINDING SITE is HOST TARGET binding site found in the 3" untranslated region of mRNA encoded by CR1, corresponding to a HOST TARGET binding site such as BINDING SITE I, BINDING SITE II or BINDING SITE III. Table 2 illustrates the complementarity of the nucleotide sequences of CR1 BINDING SITE, designated SEQ ID:6173, to the nucleotide sequence of VGAM2010 RNA, herein designated VGAM RNA, also designated SEQ ID:4721.

A function of VGAM2010 is therefore inhibition of Complement Component (3b/4b) Receptor 1, Including Knops Blood Group System (CR1, Accession NM_000573). Accordingly, utilities of VGAM2010 include diagnosis, prevention and treatment of diseases and clinical conditions associated with CR1. Interleukin-1 Receptor-associated Kinase 1 (IRAK1, Accession NM_001569) is another VGAM2010 host target gene. IRAK1 BINDING SITE is HOST TARGET binding site found in the 3' untranslated region of mRNA encoded by IRAK1, corresponding to a HOST TARGET binding site such as BINDING SITE I, BINDING SITE II or BINDING SITE III. Table 2 illustrates the complementarity of the nucleotide sequences of IRAK1 BINDING SITE, designated SEQ ID:7299, to the nucleotide sequence of VGAM2010 RNA, herein designated VGAM RNA, also designated SEQ ID:4721.

Another function of VGAM2010 is therefore inhibition of Interleukin-1 Receptor-associated Kinase 1 (IRAK1, Accession NM_001569). Accordingly, utilities of VGAM2010 include diagnosis, prevention and treatment of diseases and clinical conditions associated with IRAK1. DKFZp547I014 (Accession NM_020217) is another VGAM2010 host target gene. DKFZp547I014 BINDING SITE is HOST TARGET binding site found in the 5' untranslated region of mRNA encoded by DKFZp547I014, corresponding to a HOST TARGET binding site such as BINDING SITE I, BINDING SITE II or BINDING SITE III. Table 2 illustrates the complementarity of the nucleotide sequences of DKFZp547I014 BINDING SITE, designated SEQ ID:21470, to the nucleotide sequence of VGAM2010 RNA, herein designated VGAM RNA, also designated SEQ ID:4721.

Another function of VGAM2010 is therefore inhibition of DKFZp547I014 (Accession NM_020217). Accordingly, utilities of VGAM2010 include diagnosis, prevention and treatment of diseases and clinical conditions associated with DKFZp547I014. Erythroblast Membrane-associated Protein (ERMAP, Accession NM_018538) is another VGAM2010 host target gene. ERMAP BINDING SITE is HOST TARGET binding site found in the 3' untranslated region of mRNA encoded by ERMAP, corresponding to a HOST TARGET binding site such as BINDING SITE I, BINDING SITE II or BINDING SITE III. Table 2 illustrates the complementarity of the nucleotide sequences of ERMAP BINDING SITE, designated SEQ ID:20605, to the nucleotide sequence of VGAM2010 RNA, herein designated VGAM RNA, also designated SEQ ID:4721.

Another function of VGAM2010 is therefore inhibition of Erythroblast Membrane-associated Protein (ERMAP, Accession NM_018538). Accordingly, utilities of VGAM2010 include diagnosis, prevention and treatment of diseases and clinical conditions associated with ERMAP. KIAA0527 (Accession XM_171054) is another VGAM2010 host target gene. KIAA0527 BINDING SITE is HOST TARGET binding site found in the 3' untranslated region of mRNA encoded by KIAA0527, corresponding to a HOST TARGET binding site such as BINDING SITE I, BINDING SITE II or BINDING SITE III. Table 2 illustrates the complementarity of the nucleotide sequences of KIAA0527 BINDING SITE, designated SEQ ID:45849, to the nucleotide sequence of VGAM2010 RNA, herein designated VGAM RNA, also designated SEQ ID:4721.

Another function of VGAM2010 is therefore inhibition of KIAA0527 (Accession XM_171054). Accordingly, utilities of VGAM2010 include diagnosis, prevention and treatment of diseases and clinical conditions associated with KIAA0527. Rab11-FIP2 (Accession NM_014904) is another VGAM2010 host target gene. Rab11-FIP2 BINDING SITE is HOST TARGET binding site found in the 3' untranslated region of mRNA encoded by Rab11-FIP2, corresponding to a HOST TARGET binding site such as BINDING SITE I, BINDING SITE II or BINDING SITE III. Table 2 illustrates the complementarity of the nucleotide sequences of Rab11-FIP2 BINDING SITE, designated SEQ ID:17096, to the nucleotide sequence of VGAM2010 RNA, herein designated VGAM RNA, also designated SEQ ID:4721.

Another function of VGAM2010 is therefore inhibition of Rab11-FIP2 (Accession NM_014904). Accordingly, utilities of VGAM2010 include diagnosis, prevention and treatment of diseases and clinical conditions associated with Rab11-

FIP2. RING1 and YY1 Binding Protein (RYBP, Accession XM_002853) is another VGAM2010 host target gene. RYBP BINDING SITE is HOST TARGET binding site found in the 5' untranslated region of mRNA encoded by RYBP, corresponding to a HOST TARGET binding site such as BINDING SITE I, BINDING SITE II or BINDING SITE III. Table 2 illustrates the complementarity of the nucleotide sequences of RYBP BINDING SITE, designated SEQ ID:29908, to the nucleotide sequence of VGAM2010 RNA, herein designated VGAM RNA, also designated SEQ ID:4721.

Another function of VGAM2010 is therefore inhibition of RING1 and YY1 Binding Protein (RYBP, Accession XM_002853). Accordingly, utilities of VGAM2010 include diagnosis, prevention and treatment of diseases and clinical conditions associated with RYBP. LOC221035 (Accession XM_167640) is another VGAM2010 host target gene. LOC221035 BINDING SITE is HOST TARGET binding site found in the 3' untranslated region of mRNA encoded by LOC221035, corresponding to a HOST TARGET binding site such as BINDING SITE I, BINDING SITE II or BINDING SITE III. Table 2 illustrates the complementarity of the nucleotide sequences of LOC221035 BINDING SITE, designated SEQ ID:44744, to the nucleotide sequence of VGAM2010 RNA, herein designated VGAM RNA, also designated SEQ ID:4721.

Another function of VGAM2010 is therefore inhibition of LOC221035 (Accession XM_167640). Accordingly, utilities of VGAM2010 include diagnosis, prevention and treatment of diseases and clinical conditions associated with LOC221035. FIG. 1 further provides a conceptual description of a novel bioinformatically detected viral gene of the present invention, referred to here as Viral Genomic Address Messenger 2011 (VGAM2011) viral gene, which modulates expression of respective host target genes thereof, the function and utility of which host target genes is known in the art.

VGAM2011 is a novel bioinformatically detected regulatory, non protein coding, viral micro RNA (miRNA) gene. The method by which VGAM2011 was detected is described hereinabove with reference to FIGS. 1-8.

VGAM2011 gene, herein designated VGAM GENE, is a viral gene contained in the genome of Reston Ebola Virus (REBOV). VGAM2011 host target gene, herein designated VGAM HOST TARGET GENE, is a human gene contained in the human genome.

VGAM2011 gene encodes a VGAM2011 precursor RNA, herein designated VGAM PRECURSOR RNA. Similar to other miRNA genes, and unlike most ordinary genes, VGAM2011 precursor RNA does not encode a protein. A nucleotide sequence identical or highly similar to the nucleotide sequence of VGAM2011 precursor RNA is designated SEQ ID:1997, and is provided hereinbelow with reference to the sequence listing part. Nucleotide sequence SEQ ID:1997 is located at position 4098 relative to the genome of Reston Ebola Virus (REBOV).

VGAM2011 precursor RNA folds onto itself, forming VGAM2011 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2011 folded precursor RNA into VGAM2011 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2011 RNA is designated SEQ ID:4722, and is provided hereinbelow with reference to the sequence listing part.

VGAM2011 host target gene, herein designated VGAM HOST TARGET GENE, encodes a corresponding messenger RNA, VGAM2011 host target RNA, herein designated VGAM HOST TARGET RNA. VGAM2011 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2011 RNA, herein designated VGAM RNA, binds complementarily to one or more host target binding sites located in untranslated regions of VGAM2011 host target RNA, herein designated VGAM HOST TARGET RNA. This complementary binding is due to the fact that the nucleotide sequence of VGAM2011 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2011 RNA, herein designated VGAM RNA, may have a different number of host target binding sites in untranslated regions of a VGAM2011 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2011 RNA, herein designated VGAM RNA, to host target binding sites on VGAM2011 host target RNA, herein designated VGAM HOST TARGET RNA, such as BINDING SITE I, BINDING SITE II and BINDING SITE III, inhibits translation of VGAM2011 host target RNA into VGAM2011 host target protein, herein designated VGAM HOST TARGET PROTEIN. VGAM host target protein is therefore outlined by a broken line.

It is appreciated that VGAM2011 host target gene, herein designated VGAM HOST TARGET GENE, in fact represents a plurality of VGAM2011 host target genes. The mRNA of each one of this plurality of VGAM2011 host target genes comprises one or more host target binding sites, each having a nucleotide sequence which is at least partly complementary to VGAM2011 RNA, herein designated VGAM RNA, and which when bound by VGAM2011 RNA causes inhibition of translation of respective one or more VGAM2011 host target proteins.

It is further appreciated by one skilled in the art that the mode of translational inhibition illustrated by FIG. 1 with specific reference to translational inhibition exerted by VGAM2011 gene, herein designated VGAM GENE, on one or more VGAM2011 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2011 is inhibition of expression of host target genes, as part of a novel viral mechanism of attacking a host. Accordingly, utilities of VGAM2011 include diagnosis, prevention and treatment of viral infection by Reston Ebola Virus (REBOV). Specific functions, and accordingly utilities, of VGAM2011 correlate with, and may be deduced from, the identity of the host target genes which VGAM2011 binds and inhibits, and the function of these host target genes, as elaborated hereinbelow.

Nucleotide sequences of the VGAM2011 precursor RNA, herein designated VGAM PRECURSOR RNA, and of the 'diced' VGAM2011 RNA, herein designated VGAM RNA, and a schematic representation of the secondary folding of VGAM2011 folded precursor RNA, herein designated VGAM FOLDED PRECURSOR RNA, of VGAM2011 are further described hereinbelow with reference to Table 1.

Nucleotide sequences of host target binding sites, such as BINDING SITE-I, BINDING SITE-II and BINDING SITE-III of FIG. 1, found on VGAM2011 host target RNA, and schematic representation of the complementarity of each of these host target binding sites to VGAM2011 RNA, herein designated VGAM RNA, are described hereinbelow with reference to Table 2.

As mentioned hereinabove with reference to FIG. 1, a function of VGAM2011 gene, herein designated VGAM is inhibition of expression of VGAM2011 target genes. It is appreciated that specific functions, and accordingly utilities, of VGAM2011 correlate with, and may be deduced from, the identity of the target genes which VGAM2011 binds and inhibits, and the function of these target genes, as elaborated hereinbelow.

Cold Shock Domain Protein A (CSDA, Accession NM_003651) is a VGAM2011 host target gene. CSDA BINDING SITE is HOST TARGET binding site found in the 3' untranslated region of mRNA encoded by CSDA, corresponding to a HOST TARGET binding site such as BINDING SITE I, BINDING SITE II or BINDING SITE III. Table 2 illustrates the complementarity of the nucleotide sequences of CSDA BINDING SITE, designated SEQ ID:9728, to the nucleotide sequence of VGAM2011 RNA, herein designated VGAM RNA, also designated SEQ ID:4722.

A function of VGAM2011 is therefore inhibition of Cold Shock Domain Protein A (CSDA, Accession NM_003651), a gene which binds to the gm-csf promoter and seems to act as a repressor. Accordingly, utilities of VGAM2011 include diagnosis, prevention and treatment of diseases and clinical conditions associated with CSDA. The function of CSDA and its association with various diseases and clinical conditions, has been established by previous studies, as described hereinabove with reference to VGAM1615. Leucine-zipper-like Transcriptional Regulator, 1 (LZTR1, Accession NM_006767) is another VGAM2011 host target gene. LZTR1 BINDING SITE is HOST TARGET binding site found in the 3' untranslated region of mRNA encoded by LZTR1, corresponding to a HOST TARGET binding site such as BINDING SITE I, BINDING SITE II or BINDING SITE III. Table 2 illustrates the complementarity of the nucleotide sequences of LZTR1 BINDING SITE, designated SEQ ID:13636, to the nucleotide sequence of VGAM2011 RNA, herein designated VGAM RNA, also designated SEQ ID:4722.

Another function of VGAM2011 is therefore inhibition of Leucine-zipper-like Transcriptional Regulator, 1 (LZTR1, Accession NM_006767). Accordingly, utilities of VGAM2011 include diagnosis, prevention and treatment of diseases and clinical conditions associated with LZTR1. SORCS2 (Accession NM_020777) is another VGAM2011 host target gene. SORCS2 BINDING SITE is HOST TARGET binding site found in the 3' untranslated region of mRNA encoded by SORCS2, corresponding to a HOST TARGET binding site such as BINDING SITE I, BINDING SITE II or BINDING SITE III. Table 2 illustrates the complementarity of the nucleotide sequences of SORCS2 BINDING SITE, designated SEQ ID:21872, to the nucleotide sequence of VGAM2011 RNA, herein designated VGAM RNA, also designated SEQ ID:4722.

Another function of VGAM2011 is therefore inhibition of SORCS2 (Accession NM_020777). Accordingly, utilities of VGAM2011 include diagnosis, prevention and treatment of diseases and clinical conditions associated with SORCS2. KIAA1922 (Accession XM_057040) is another VGAM2011 host target gene. KIAA1922 BINDING SITE is HOST TARGET binding site found in the 5' untranslated region of mRNA encoded by KIAA1922, corresponding to a HOST TARGET binding site such as BINDING SITE I, BINDING SITE II or BINDING SITE III. Table 2 illustrates the complementarity of the nucleotide sequences of KIAA1922 BINDING SITE, designated SEQ ID:36456, to the nucleotide sequence of VGAM2011 RNA, herein designated VGAM RNA, also designated SEQ ID:4722.

Another function of VGAM2011 is therefore inhibition of KIAA1922 (Accession XM_057040). Accordingly, utilities of VGAM2011 include diagnosis, prevention and treatment of diseases and clinical conditions associated with KIAA1922. MGC19556 (Accession NM_033551) is another VGAM2011 host target gene. MGC19556 BINDING SITE is HOST TARGET binding site found in the 3' untranslated region of mRNA encoded by MGC19556, corresponding to a HOST TARGET binding site such as BINDING SITE I, BINDING SITE II or BINDING SITE III. Table 2 illustrates the complementarity of the nucleotide sequences of MGC19556 BINDING SITE, designated SEQ ID:27315, to the nucleotide sequence of VGAM2011 RNA, herein designated VGAM RNA, also designated SEQ ID:4722.

Another function of VGAM2011 is therefore inhibition of MGC19556 (Accession NM_033551). Accordingly, utilities of VGAM2011 include diagnosis, prevention and treatment of diseases and clinical conditions associated with MGC19556. NY-REN-25 (Accession XM_027116) is another VGAM2011 host target gene. NY-REN-25 BINDING SITE is HOST TARGET binding site found in the 3' untranslated region of mRNA encoded by NY-REN-25, corresponding to a HOST TARGET binding site such as BINDING SITE I, BINDING SITE II or BINDING SITE III. Table 2 illustrates the complementarity of the nucleotide sequences of NY-REN-25 BINDING SITE, designated SEQ ID:30415, to the nucleotide sequence of VGAM2011 RNA, herein designated VGAM RNA, also designated SEQ ID:4722.

Another function of VGAM2011 is therefore inhibition of NY-REN-25 (Accession XM_027116). Accordingly, utilities of VGAM2011 include diagnosis, prevention and treatment of diseases and clinical conditions associated with NY-REN-25. PF1 (Accession XM_170828) is another VGAM2011 host target gene. PF1 BINDING SITE is HOST TARGET binding site found in the 5' untranslated region of mRNA encoded by PF1, corresponding to a HOST TARGET binding site such as BINDING SITE I, BINDING SITE II or BINDING SITE III. Table 2 illustrates the complementarity of the nucleotide sequences of PF1 BINDING SITE, designated SEQ ID:45603, to the nucleotide sequence of VGAM2011 RNA, herein designated VGAM RNA, also designated SEQ ID:4722.

Another function of VGAM2011 is therefore inhibition of PF1 (Accession XM_170828). Accordingly, utilities of VGAM2011 include diagnosis, prevention and treatment of diseases and clinical conditions associated with PF1. SARM (Accession NM_015077) is another VGAM2011 host target gene. SARM BINDING SITE is HOST TARGET binding site found in the 3' untranslated region of mRNA encoded by SARM, corresponding to a HOST TARGET binding site such as BINDING SITE I, BINDING SITE II or BINDING SITE III. Table 2 illustrates the complementarity of the nucleotide sequences of SARM BINDING SITE, designated SEQ ID:17459, to the nucleotide sequence of VGAM2011 RNA, herein designated VGAM RNA, also designated SEQ ID:4722.

Another function of VGAM2011 is therefore inhibition of SARM (Accession NM_015077). Accordingly, utilities of VGAM2011 include diagnosis, prevention and treatment of diseases and clinical conditions associated with SARM. SCAMP-4 (Accession NM_079834) is another VGAM2011 host target gene. SCAMP-4 BINDING SITE is HOST TARGET binding site found in the 3' untranslated region of mRNA encoded by SCAMP-4, corresponding to a HOST TARGET binding site such as BINDING SITE I, BINDING SITE II or BINDING SITE III. Table 2 illustrates the complementarity of the nucleotide sequences of SCAMP-4 BINDING SITE, designated SEQ ID:27820, to the nucleotide sequence of VGAM2011 RNA, herein designated VGAM RNA, also designated SEQ ID:4722.

Another function of VGAM2011 is therefore inhibition of SCAMP-4 (Accession NM_079834). Accordingly, utilities of VGAM2011 include diagnosis, prevention and treatment of diseases and clinical conditions associated with SCAMP-4. WIT-1 (Accession NM_015855) is another VGAM2011 host target gene. WIT-1 BINDING SITE is HOST TARGET binding site found in the 5' untranslated region of mRNA encoded by WIT-1, corresponding to a HOST TARGET binding site such as BINDING SITE I, BINDING SITE II or BINDING SITE III. Table 2 illustrates the complementarity of the nucleotide sequences of WIT-1 BINDING SITE, designated SEQ ID:17989, to the nucleotide sequence of VGAM2011 RNA, herein designated VGAM RNA, also designated SEQ ID:4722.

Another function of VGAM2011 is therefore inhibition of WIT-1 (Accession NM_015855). Accordingly, utilities of VGAM2011 include diagnosis, prevention and treatment of diseases and clinical conditions associated with WIT-1. LOC149271 (Accession XM_086475) is another VGAM2011 host target gene. LOC149271 BINDING SITE is HOST TARGET binding site found in the 5' untranslated region of mRNA encoded by LOC149271, corresponding to a HOST TARGET binding site such as BINDING SITE I, BINDING SITE II or BINDING SITE III. Table 2 illustrates the complementarity of the nucleotide sequences of LOC149271 BINDING SITE, designated SEQ ID:38673, to the nucleotide sequence of VGAM2011 RNA, herein designated VGAM RNA, also designated SEQ ID:4722.

Another function of VGAM2011 is therefore inhibition of LOC149271 (Accession XM_086475). Accordingly, utilities of VGAM2011 include diagnosis, prevention and treatment of diseases and clinical conditions associated with LOC149271. LOC221288 (Accession XM_168058) is another VGAM2011 host target gene. LOC221288 BINDING SITE is HOST TARGET binding site found in the 3' untranslated region of mRNA encoded by LOC221288, corresponding to a HOST TARGET binding site such as BINDING SITE I, BINDING SITE II or BINDING SITE III. Table 2 illustrates the complementarity of the nucleotide sequences of LOC221288 BINDING SITE, designated SEQ ID:44967, to the nucleotide sequence of VGAM2011 RNA, herein designated VGAM RNA, also designated SEQ ID:4722.

Another function of VGAM2011 is therefore inhibition of LOC221288 (Accession XM_168058). Accordingly, utilities of VGAM2011 include diagnosis, prevention and treatment of diseases and clinical conditions associated with LOC221288. LOC255299 (Accession XM_173564) is another VGAM2011 host target gene. LOC255299 BINDING SITE is HOST TARGET binding site found in the 5' untranslated region of mRNA encoded by LOC255299, corresponding to a HOST TARGET binding site such as BINDING SITE I, BINDING SITE II or BINDING SITE III. Table 2 illustrates the complementarity of the nucleotide sequences of LOC255299 BINDING SITE, designated SEQ ID:46548, to the nucleotide sequence of VGAM2011 RNA, herein designated VGAM RNA, also designated SEQ ID:4722.

Another function of VGAM2011 is therefore inhibition of LOC255299 (Accession XM_173564). Accordingly, utilities of VGAM2011 include diagnosis, prevention and treatment of diseases and clinical conditions associated with LOC255299. LOC90092 (Accession XM_028862) is another VGAM2011 host target gene. LOC90092 BINDING SITE is HOST TARGET binding site found in the 5' untranslated region of mRNA encoded by LOC90092, corresponding to a HOST TARGET binding site such as BINDING SITE I, BINDING SITE II or BINDING SITE III. Table 2 illustrates the complementarity of the nucleotide sequences of LOC90092 BINDING SITE, designated SEQ ID:30788, to the nucleotide sequence of VGAM2011 RNA, herein designated VGAM RNA, also designated SEQ ID:4722.

Another function of VGAM2011 is therefore inhibition of LOC90092 (Accession XM_028862). Accordingly, utilities of VGAM2011 include diagnosis, prevention and treatment of diseases and clinical conditions associated with LOC90092. FIG. 1 further provides a conceptual description of a novel bioinformatically detected viral gene of the present invention, referred to here as Viral Genomic Address Messenger 2012 (VGAM2012) viral gene, which modulates expression of respective host target genes thereof, the function and utility of which host target genes is known in the art.

VGAM2012 is a novel bioinformatically detected regulatory, non protein coding, viral micro RNA (miRNA) gene. The method by which VGAM2012 was detected is described hereinabove with reference to FIGS. 1-8.

VGAM2012 gene, herein designated VGAM GENE, is a viral gene contained in the genome of Reston Ebola Virus (REBOV). VGAM2012 host target gene, herein designated VGAM HOST TARGET GENE, is a human gene contained in the human genome.

VGAM2012 gene encodes a VGAM2012 precursor RNA, herein designated VGAM PRECURSOR RNA. Similar to other miRNA genes, and unlike most ordinary genes, VGAM2012 precursor RNA does not encode a protein. A nucleotide sequence identical or highly similar to the nucleotide sequence of VGAM2012 precursor RNA is designated SEQ ID:1998, and is provided hereinbelow with reference to the sequence listing part. Nucleotide sequence SEQ ID:1998 is located at position 16890 relative to the genome of Reston Ebola Virus (REBOV).

VGAM2012 precursor RNA folds onto itself, forming VGAM2012 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2012 folded precursor RNA into VGAM2012 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2012 RNA is designated SEQ ID:4723, and is provided hereinbelow with reference to the sequence listing part.

VGAM2012 host target gene, herein designated VGAM HOST TARGET GENE, encodes a corresponding messenger RNA, VGAM2012 host target RNA, herein designated VGAM HOST TARGET RNA. VGAM2012 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2012 RNA, herein designated VGAM RNA, binds complementarily to one or more host target binding sites located in untranslated regions of VGAM2012 host target RNA, herein designated VGAM HOST TARGET RNA. This complementary binding is due to the fact that the nucleotide sequence of VGAM2012 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2012 RNA, herein designated VGAM RNA, may have a different number of host target binding sites in untranslated regions of a VGAM2012 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2012 RNA, herein designated VGAM RNA, to host target binding sites on VGAM2012 host target RNA, herein designated VGAM HOST TARGET RNA, such as BINDING SITE I, BINDING SITE II and BINDING SITE III, inhibits translation of VGAM2012 host target RNA into VGAM2012 host target protein, herein designated VGAM HOST TARGET PROTEIN. VGAM host target protein is therefore outlined by a broken line.

It is appreciated that VGAM2012 host target gene, herein designated VGAM HOST TARGET GENE, in fact represents a plurality of VGAM2012 host target genes. The mRNA of each one of this plurality of VGAM2012 host target genes comprises one or more host target binding sites, each having a nucleotide sequence which is at least partly complementary to VGAM2012 RNA, herein designated VGAM RNA, and which when bound by VGAM2012 RNA causes inhibition of translation of respective one or more VGAM2012 host target proteins.

It is further appreciated by one skilled in the art that the mode of translational inhibition illustrated by FIG. 1 with specific reference to translational inhibition exerted by VGAM2012 gene, herein designated VGAM GENE, on one or more VGAM2012 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2012 is inhibition of expression of host target genes, as part of a novel viral mechanism of attacking a host. Accordingly, utilities of VGAM2012 include diagnosis, prevention and treatment of viral infection by Reston Ebola Virus (REBOV). Specific functions, and accordingly utilities, of VGAM2012 correlate with, and may be deduced from, the identity of the host target genes which VGAM2012 binds and inhibits, and the function of these host target genes, as elaborated hereinbelow.

Nucleotide sequences of the VGAM2012 precursor RNA, herein designated VGAM PRECURSOR RNA, and of the 'diced' VGAM2012 RNA, herein designated VGAM RNA, and a schematic representation of the secondary folding of VGAM2012 folded precursor RNA, herein designated VGAM FOLDED PRECURSOR RNA, of VGAM2012 are further described hereinbelow with reference to Table 1.

Nucleotide sequences of host target binding sites, such as BINDING SITE-I, BINDING SITE-II and BINDING SITE-III of FIG. 1, found on VGAM2012 host target RNA, and schematic representation of the complementarity of each of these host target binding sites to VGAM2012 RNA, herein designated VGAM RNA, are described hereinbelow with reference to Table 2.

As mentioned hereinabove with reference to FIG. 1, a function of VGAM2012 gene, herein designated VGAM is inhibition of expression of VGAM2012 target genes. It is appreciated that specific functions, and accordingly utilities, of VGAM2012 correlate with, and may be deduced from, the identity of the target genes which VGAM2012 binds and inhibits, and the function of these target genes, as elaborated hereinbelow.

Beclin 1 (coiled-coil, myosin-like BCL2 interacting protein) (BECN1, Accession NM_003766) is a VGAM2012 host target gene. BECN1 BINDING SITE is HOST TARGET binding site found in the 3' untranslated region of mRNA encoded by BECN1, corresponding to a HOST TARGET binding site such as BINDING SITE I, BINDING SITE II or BINDING SITE III. Table 2 illustrates the complementarity of the nucleotide sequences of BECN1 BINDING SITE, designated SEQ ID:9844, to the nucleotide sequence of VGAM2012 RNA, herein designated VGAM RNA, also designated SEQ ID:4723.

A function of VGAM2012 is therefore inhibition of Beclin 1 (coiled-coil, myosin-like BCL2 interacting protein) (BECN1, Accession NM_003766), a gene which protects cell from viral-induced apoptosis. Accordingly, utilities of VGAM2012 include diagnosis, prevention and treatment of diseases and clinical conditions associated with BECN1. The function of BECN1 and its association with various diseases and clinical conditions, has been established by previous studies, as described hereinabove with reference to VGAM1246. Dmx-like 1 (DMXL1, Accession NM_005509)

is another VGAM2012 host target gene. DMXL1 BINDING SITE is HOST TARGET binding site found in the 3' untranslated region of mRNA encoded by DMXL1, corresponding to a HOST TARGET binding site such as BINDING SITE I, BINDING SITE II or BINDING SITE III. Table 2 illustrates the complementarity of the nucleotide sequences of DMXL1 BINDING SITE, designated SEQ ID:12023, to the nucleotide sequence of VGAM2012 RNA, herein designated VGAM RNA, also designated SEQ ID:4723.

Another function of VGAM2012 is therefore inhibition of Dmx-like 1 (DMXL1, Accession NM_005509). Accordingly, utilities of VGAM2012 include diagnosis, prevention and treatment of diseases and clinical conditions associated with DMXL1. Nuclear Transcription Factor Y, Gamma (NFYC, Accession NM_014223) is another VGAM2012 host target gene. NFYC BINDING SITE is HOST TARGET binding site found in the 3' untranslated region of mRNA encoded by NFYC, corresponding to a HOST TARGET binding site such as BINDING SITE I, BINDING SITE II or BINDING SITE III. Table 2 illustrates the complementarity of the nucleotide sequences of NFYC BINDING SITE, designated SEQ ID:15493, to the nucleotide sequence of VGAM2012 RNA, herein designated VGAM RNA, also designated SEQ ID:4723.

Another function of VGAM2012 is therefore inhibition of Nuclear Transcription Factor Y, Gamma (NFYC, Accession NM_014223). Accordingly, utilities of VGAM2012 include diagnosis, prevention and treatment of diseases and clinical conditions associated with NFYC. Plastin 3 (T isoform) (PLS3, Accession NM_005032) is another VGAM2012 host target gene. PLS3 BINDING SITE is HOST TARGET binding site found in the 3' untranslated region of mRNA encoded by PLS3, corresponding to a HOST TARGET binding site such as BINDING SITE I, BINDING SITE II or BINDING SITE III. Table 2 illustrates the complementarity of the nucleotide sequences of PLS3 BINDING SITE, designated SEQ ID:11471, to the nucleotide sequence of VGAM2012 RNA, herein designated VGAM RNA, also designated SEQ ID:4723.

Another function of VGAM2012 is therefore inhibition of Plastin 3 (T isoform) (PLS3, Accession NM_005032), a gene which binds actin. Accordingly, utilities of VGAM2012 include diagnosis, prevention and treatment of diseases and clinical conditions associated with PLS3. The function of PLS3 and its association with various diseases and clinical conditions, has been established by previous studies, as described hereinabove with reference to VGAM1754. Protein Tyrosine Phosphatase, Receptor Type, J (PTPRJ, Accession NM_002843) is another VGAM2012 host target gene. PTPRJ BINDING SITE is HOST TARGET binding site found in the 3' untranslated region of mRNA encoded by PTPRJ, corresponding to a HOST TARGET binding site such as BINDING SITE I, BINDING SITE II or BINDING SITE III. Table 2 illustrates the complementarity of the nucleotide sequences of PTPRJ BINDING SITE, designated SEQ ID:8730, to the nucleotide sequence of VGAM2012 RNA, herein designated VGAM RNA, also designated SEQ ID:4723.

Another function of VGAM2012 is therefore inhibition of Protein Tyrosine Phosphatase, Receptor Type, J (PTPRJ, Accession NM_002843), a gene which Receptor-type protein tyrosine phosphatase J. Accordingly, utilities of VGAM2012 include diagnosis, prevention and treatment of diseases and clinical conditions associated with PTPRJ. The function of PTPRJ and its association with various diseases and clinical conditions, has been established by previous studies, as described hereinabove with reference to VGAM552. JDD1 (Accession XM_032515) is another VGAM2012 host target gene. JDD1 BINDING SITE is HOST TARGET binding site found in the 3' untranslated region of mRNA encoded by JDD1, corresponding to a HOST TARGET binding site such as BINDING SITE I, BINDING SITE II or BINDING SITE III. Table 2 illustrates the complementarity of the nucleotide sequences of JDD1 BINDING SITE, designated SEQ ID:31666, to the nucleotide sequence of VGAM2012 RNA, herein designated VGAM RNA, also designated SEQ ID:4723.

Another function of VGAM2012 is therefore inhibition of JDD1 (Accession XM_032515). Accordingly, utilities of VGAM2012 include diagnosis, prevention and treatment of diseases and clinical conditions associated with JDD1. KIAA1878 (Accession XM_166256) is another VGAM2012 host target gene. KIAA1878 BINDING SITE is HOST TARGET binding site found in the 3' untranslated region of mRNA encoded by KIAA1878, corresponding to a HOST TARGET binding site such as BINDING SITE I, BINDING SITE II or BINDING SITE III. Table 2 illustrates the complementarity of the nucleotide sequences of KIAA1878 BINDING SITE, designated SEQ ID:44077, to the nucleotide sequence of VGAM2012 RNA, herein designated VGAM RNA, also designated SEQ ID:4723.

Another function of VGAM2012 is therefore inhibition of KIAA1878 (Accession XM_166256). Accordingly, utilities of VGAM2012 include diagnosis, prevention and treatment of diseases and clinical conditions associated with KIAA1878. LOC157867 (Accession XM_098831) is another VGAM2012 host target gene. LOC157867 BINDING SITE is HOST TARGET binding site found in the 5' untranslated region of mRNA encoded by LOC157867, corresponding to a HOST TARGET binding site such as BINDING SITE I, BINDING SITE II or BINDING SITE III. Table 2 illustrates the complementarity of the nucleotide sequences of LOC157867 BINDING SITE, designated SEQ ID:41854, to the nucleotide sequence of VGAM2012 RNA, herein designated VGAM RNA, also designated SEQ ID:4723.

Another function of VGAM2012 is therefore inhibition of LOC157867 (Accession XM_098831). Accordingly, utilities of VGAM2012 include diagnosis, prevention and treatment of diseases and clinical conditions associated with LOC157867. FIG. 1 further provides a conceptual description of a novel bioinformatically detected viral gene of the present invention, referred to here as Viral Genomic Address Messenger 2013 (VGAM2013) viral gene, which modulates expression of respective host target genes thereof, the function and utility of which host target genes is known in the art.

VGAM2013 is a novel bioinformatically detected regulatory, non protein coding, viral micro RNA (miRNA) gene. The method by which VGAM2013 was detected is described hereinabove with reference to FIGS. 1-8.

VGAM2013 gene, herein designated VGAM GENE, is a viral gene contained in the genome of Reston Ebola Virus (REBOV). VGAM2013 host target gene, herein designated VGAM HOST TARGET GENE, is a human gene contained in the human genome.

VGAM2013 gene encodes a VGAM2013 precursor RNA, herein designated VGAM PRECURSOR RNA. Similar to other miRNA genes, and unlike most ordinary genes, VGAM2013 precursor RNA does not encode a protein. A nucleotide sequence identical or highly similar to the nucleotide sequence of VGAM2013 precursor RNA is designated SEQ ID:1999, and is provided hereinbelow with reference to the sequence listing part. Nucleotide sequence SEQ ID:1999 is located at position 12733 relative to the genome of Reston Ebola Virus (REBOV).

VGAM2013 precursor RNA folds onto itself, forming VGAM2013 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2013 folded precursor RNA into VGAM2013 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2013 RNA is designated SEQ ID:4724, and is provided hereinbelow with reference to the sequence listing part.

VGAM2013 host target gene, herein designated VGAM HOST TARGET GENE, encodes a corresponding messenger RNA, VGAM2013 host target RNA, herein designated VGAM HOST TARGET RNA. VGAM2013 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2013 RNA, herein designated VGAM RNA, binds complementarily to one or more host target binding sites located in untranslated regions of VGAM2013 host target RNA, herein designated VGAM HOST TARGET RNA. This complementary binding is due to the fact that the nucleotide sequence of VGAM2013 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2013 RNA, herein designated VGAM RNA, may have a different number of host target binding sites in untranslated regions of a VGAM2013 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2013 RNA, herein designated VGAM RNA, to host target binding sites on VGAM2013 host target RNA, herein designated VGAM HOST TARGET RNA, such as BINDING SITE I, BINDING SITE II and BINDING SITE III, inhibits translation of VGAM2013 host target RNA into VGAM2013 host target protein, herein designated VGAM HOST TARGET PROTEIN. VGAM host target protein is therefore outlined by a broken line.

It is appreciated that VGAM2013 host target gene, herein designated VGAM HOST TARGET GENE, in fact represents a plurality of VGAM2013 host target genes. The mRNA of each one of this plurality of VGAM2013 host target genes comprises one or more host target binding sites, each having a nucleotide sequence which is at least partly complementary to VGAM2013 RNA, herein designated VGAM RNA, and which when bound by VGAM2013 RNA causes inhibition of translation of respective one or more VGAM2013 host target proteins.

It is further appreciated by one skilled in the art that the mode of translational inhibition illustrated by FIG. 1 with specific reference to translational inhibition exerted by VGAM2013 gene, herein designated VGAM GENE, on one or more VGAM2013 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2013 is inhibition of expression of host target genes, as part of a novel viral mechanism of attacking a host. Accordingly, utilities of VGAM2013 include diagnosis, prevention and treatment of viral infection by Reston Ebola Virus (REBOV). Specific functions, and accordingly utilities, of VGAM2013 correlate with, and may be deduced from, the identity of the host target genes which VGAM2013 binds and inhibits, and the function of these host target genes, as elaborated hereinbelow.

Nucleotide sequences of the VGAM2013 precursor RNA, herein designated VGAM PRECURSOR RNA, and of the 'diced' VGAM2013 RNA, herein designated VGAM RNA, and a schematic representation of the secondary folding of VGAM2013 folded precursor RNA, herein designated VGAM FOLDED PRECURSOR RNA, of VGAM2013 are further described hereinbelow with reference to Table 1.

Nucleotide sequences of host target binding sites, such as BINDING SITE-I, BINDING SITE-II and BINDING SITE-III of FIG. 1, found on VGAM2013 host target RNA, and schematic representation of the complementarity of each of these host target binding sites to VGAM2013 RNA, herein designated VGAM RNA, are described hereinbelow with reference to Table 2.

As mentioned hereinabove with reference to FIG. 1, a function of VGAM2013 gene, herein designated VGAM is inhibition of expression of VGAM2013 target genes. It is appreciated that specific functions, and accordingly utilities, of VGAM2013 correlate with, and may be deduced from, the identity of the target genes which VGAM2013 binds and inhibits, and the function of these target genes, as elaborated hereinbelow.

Collagen, Type XIX, Alpha 1 (COL19A1, Accession NM_001858) is a VGAM2013 host target gene. COL19A1 BINDING SITE is HOST TARGET binding site found in the 3' untranslated region of mRNA encoded by COL19A1, corresponding to a HOST TARGET binding site such as BINDING SITE I, BINDING SITE II or BINDING SITE III. Table 2 illustrates the complementarity of the nucleotide sequences of COL19A1 BINDING SITE, designated SEQ ID:7593, to the nucleotide sequence of VGAM2013 RNA, herein designated VGAM RNA, also designated SEQ ID:4724.

A function of VGAM2013 is therefore inhibition of Collagen, Type XIX, Alpha 1 (COL19A1, Accession NM_001858), a gene which may act as a cross-bridge between fibrils and other extracellular matrix molecules. Accordingly, utilities of VGAM2013 include diagnosis, prevention and treatment of diseases and clinical conditions associated with COL19A1. The function of COL19A1 and its association with various diseases and clinical conditions, has been established by previous studies, as described hereinabove with reference to VGAM19. Filamin B, Beta (actin binding protein 278) (FLNB, Accession XM_030806) is another VGAM2013 host target gene. FLNB BINDING SITE is HOST TARGET binding site found in the 3' untranslated region of mRNA encoded by FLNB, corresponding to a HOST TARGET binding site such as BINDING SITE I, BINDING SITE II or BINDING SITE III. Table 2 illustrates the complementarity of the nucleotide sequences of FLNB BINDING SITE, designated SEQ ID:31145, to the nucleotide sequence of VGAM2013 RNA, herein designated VGAM RNA, also designated SEQ ID:4724.

Another function of VGAM2013 is therefore inhibition of Filamin B, Beta (actin binding protein 278) (FLNB, Accession XM_030806), a gene which Filamin B, beta; binds actin, interacts with cytoplasmic domain of Ibalpha. Accordingly, utilities of VGAM2013 include diagnosis, prevention and treatment of diseases and clinical conditions associated with FLNB. The function of FLNB and its association with various diseases and clinical conditions, has been established by previous studies, as described hereinabove with reference to VGAM416. FLJ23322 (Accession XM_114207) is another VGAM2013 host target gene. FLJ23322 BINDING SITE is HOST TARGET binding site found in the 3' untranslated region of mRNA encoded by FLJ23322, corresponding to a HOST TARGET binding site such as BINDING SITE I, BINDING SITE II or BINDING SITE III. Table 2 illustrates the complementarity of the nucleotide sequences of FLJ23322 BINDING SITE, designated SEQ ID:42799, to the nucleotide sequence of VGAM2013 RNA, herein designated VGAM RNA, also designated SEQ ID:4724.

Another function of VGAM2013 is therefore inhibition of FLJ23322 (Accession XM_114207). Accordingly, utilities of VGAM2013 include diagnosis, prevention and treatment of diseases and clinical conditions associated with FLJ23322. KIAA1317 (Accession XM_098368) is another VGAM2013 host target gene. KIAA1317 BINDING SITE is HOST TARGET binding site found in the 3' untranslated region of mRNA encoded by KIAA1317, corresponding to a HOST TARGET binding site such as BINDING SITE I, BINDING SITE II or BINDING SITE III. Table 2 illustrates the complementarity of the nucleotide sequences of KIAA1317 BINDING SITE, designated SEQ ID:41622, to the nucleotide sequence of VGAM2013 RNA, herein designated VGAM RNA, also designated SEQ ID:4724.

Another function of VGAM2013 is therefore inhibition of KIAA1317 (Accession XM_098368). Accordingly, utilities of VGAM2013 include diagnosis, prevention and treatment of diseases and clinical conditions associated with KIAA1317. Testis-specific Transcript, Y-linked 9 (TTTY9, Accession NM_031927) is another VGAM2013 host target gene. TTTY9 BINDING SITE is HOST TARGET binding site found in the 3' untranslated region of mRNA encoded by TTTY9, corresponding to a HOST TARGET binding site such as BINDING SITE I, BINDING SITE II or BINDING SITE III. Table 2 illustrates the complementarity of the nucleotide sequences of TTTY9 BINDING SITE, designated SEQ ID:25676, to the nucleotide sequence of VGAM2013 RNA, herein designated VGAM RNA, also designated SEQ ID:4724.

Another function of VGAM2013 is therefore inhibition of Testis-specific Transcript, Y-linked 9 (TTTY9, Accession NM_031927). Accordingly, utilities of VGAM2013 include diagnosis, prevention and treatment of diseases and clinical conditions associated with TTTY9. LOC146287 (Accession XM_096967) is another VGAM2013 host target gene. LOC146287 BINDING SITE is HOST TARGET binding site found in the 5' untranslated region of mRNA encoded by LOC146287, corresponding to a HOST TARGET binding site such as BINDING SITE I, BINDING SITE II or BINDING SITE III. Table 2 illustrates the complementarity of the nucleotide sequences of LOC146287 BINDING SITE, designated SEQ ID:40688, to the nucleotide sequence of VGAM2013 RNA, herein designated VGAM RNA, also designated SEQ ID:4724.

Another function of VGAM2013 is therefore inhibition of LOC146287 (Accession XM_096967). Accordingly, utilities of VGAM2013 include diagnosis, prevention and treatment of diseases and clinical conditions associated with LOC146287. LOC253039 (Accession XM_171203) is another VGAM2013 host target gene. LOC253039 BINDING SITE is HOST TARGET binding site found in the 3' untranslated region of mRNA encoded by LOC253039, corresponding to a HOST TARGET binding site such as BINDING SITE I, BINDING SITE II or BINDING SITE III. Table 2 illustrates the complementarity of the nucleotide sequences of LOC253039 BINDING SITE, designated SEQ ID:45992, to the nucleotide sequence of VGAM2013 RNA, herein designated VGAM RNA, also designated SEQ ID:4724.

Another function of VGAM2013 is therefore inhibition of LOC253039 (Accession XM_171203). Accordingly, utilities of VGAM2013 include diagnosis, prevention and treatment of diseases and clinical conditions associated with LOC253039. LOC257235 (Accession XM_173124) is another VGAM2013 host target gene. LOC257235 BINDING SITE is HOST TARGET binding site found in the 5' untranslated region of mRNA encoded by LOC257235, corresponding to a HOST TARGET binding site such as BINDING SITE I, BINDING SITE II or BINDING SITE III. Table 2 illustrates the complementarity of the nucleotide sequences of LOC257235 BINDING SITE, designated SEQ ID:46371, to the nucleotide sequence of VGAM2013 RNA, herein designated VGAM RNA, also designated SEQ ID:4724.

Another function of VGAM2013 is therefore inhibition of LOC257235 (Accession XM_173124). Accordingly, utilities of VGAM2013 include diagnosis, prevention and treatment of diseases and clinical conditions associated with LOC257235. FIG. 1 further provides a conceptual description of a novel bioinformatically detected viral gene of the present invention, referred to here as Viral Genomic Address Messenger 2014 (VGAM2014) viral gene, which modulates expression of respective host target genes thereof, the function and utility of which host target genes is known in the art.

VGAM2014 is a novel bioinformatically detected regulatory, non protein coding, viral micro RNA (miRNA) gene. The method by which VGAM2014 was detected is described hereinabove with reference to FIGS. 1-8.

VGAM2014 gene, herein designated VGAM GENE, is a viral gene contained in the genome of Reston Ebola Virus (REBOV). VGAM2014 host target gene, herein designated VGAM HOST TARGET GENE, is a human gene contained in the human genome.

VGAM2014 gene encodes a VGAM2014 precursor RNA, herein designated VGAM PRECURSOR RNA. Similar to other miRNA genes, and unlike most ordinary genes, VGAM2014 precursor RNA does not encode a protein. A nucleotide sequence identical or highly similar to the nucleotide sequence of VGAM2014 precursor RNA is designated SEQ ID:2000, and is provided hereinbelow with reference to the sequence listing part. Nucleotide sequence SEQ ID:2000 is located at position 13026 relative to the genome of Reston Ebola Virus (REBOV).

VGAM2014 precursor RNA folds onto itself, forming VGAM2014 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2014 folded precursor RNA into VGAM2014 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2014 RNA is designated SEQ ID:4725, and is provided hereinbelow with reference to the sequence listing part.

VGAM2014 host target gene, herein designated VGAM HOST TARGET GENE, encodes a corresponding messenger RNA, VGAM2014 host target RNA, herein designated VGAM HOST TARGET RNA. VGAM2014 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2014 RNA, herein designated VGAM RNA, binds complementarily to one or more host target binding sites located in untranslated regions of VGAM2014 host target RNA, herein designated VGAM HOST TARGET RNA. This complementary binding is due to the fact that the nucleotide sequence of VGAM2014 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2014 RNA, herein designated VGAM RNA, may have a different number of host target binding sites in untranslated regions of a VGAM2014 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2014 RNA, herein designated VGAM RNA, to host target binding sites on VGAM2014 host target RNA, herein designated VGAM HOST TARGET RNA, such as BINDING SITE I, BINDING SITE II and BINDING SITE III, inhibits translation of VGAM2014 host target RNA into VGAM2014 host target protein, herein designated VGAM HOST TARGET PROTEIN. VGAM host target protein is therefore outlined by a broken line.

It is appreciated that VGAM2014 host target gene, herein designated VGAM HOST TARGET GENE, in fact represents a plurality of VGAM2014 host target genes. The mRNA of each one of this plurality of VGAM2014 host target genes comprises one or more host target binding sites, each having a nucleotide sequence which is at least partly complementary to VGAM2014 RNA, herein designated VGAM RNA, and which when bound by VGAM2014 RNA causes inhibition of translation of respective one or more VGAM2014 host target proteins.

It is further appreciated by one skilled in the art that the mode of translational inhibition illustrated by FIG. 1 with specific reference to translational inhibition exerted by VGAM2014 gene, herein designated VGAM GENE, on one or more VGAM2014 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2014 is inhibition of expression of host target genes, as part of a novel viral mechanism of attacking a host. Accordingly, utilities of VGAM2014 include diagnosis, prevention and treatment of viral infection by Reston Ebola Virus (REBOV). Specific functions, and accordingly utilities, of VGAM2014 correlate with, and may be deduced from, the identity of the host target genes which VGAM2014 binds and inhibits, and the function of these host target genes, as elaborated hereinbelow.

Nucleotide sequences of the VGAM2014 precursor RNA, herein designated VGAM PRECURSOR RNA, and of the 'diced' VGAM2014 RNA, herein designated VGAM RNA, and a schematic representation of the secondary folding of VGAM2014 folded precursor RNA, herein designated VGAM FOLDED PRECURSOR RNA, of VGAM2014 are further described hereinbelow with reference to Table 1.

Nucleotide sequences of host target binding sites, such as BINDING SITE-I, BINDING SITE-II and BINDING SITE-III of FIG. 1, found on VGAM2014 host target RNA, and schematic representation of the complementarity of each of these host target binding sites to VGAM2014 RNA, herein designated VGAM RNA, are described hereinbelow with reference to Table 2.

As mentioned hereinabove with reference to FIG. 1, a function of VGAM2014 gene, herein designated VGAM is inhibition of expression of VGAM2014 target genes. It is appreciated that specific functions, and accordingly utilities, of VGAM2014 correlate with, and may be deduced from, the identity of the target genes which VGAM2014 binds and inhibits, and the function of these target genes, as elaborated hereinbelow.

ATPase, Ca++ Transporting, Plasma Membrane 2 (ATP2B2, Accession NM_001683) is a VGAM2014 host target gene. ATP2B2 BINDING SITE is HOST TARGET binding site found in the 3' untranslated region of mRNA encoded by ATP2B2, corresponding to a HOST TARGET binding site such as BINDING SITE I, BINDING SITE II or BINDING SITE III. Table 2 illustrates the complementarity of the nucleotide sequences of ATP2B2 BINDING SITE, designated SEQ ID:7405, to the nucleotide sequence of VGAM2014 RNA, herein designated VGAM RNA, also designated SEQ ID:4725.

A function of VGAM2014 is therefore inhibition of ATPase, Ca++ Transporting, Plasma Membrane 2 (ATP2B2, Accession NM_001683), a gene which catalyzes the hydrolysis of ATP coupled with the transport of the calcium out of the cell. Accordingly, utilities of VGAM2014 include diagnosis, prevention and treatment of diseases and clinical conditions associated with ATP2B2. The function of ATP2B2 and its association with various diseases and clinical conditions, has been established by previous studies, as described hereinabove with reference to VGAM711. Ceroid-lipofuscinosis, Neuronal 5 (CLN5, Accession NM_006493) is another VGAM2014 host target gene. CLN5 BINDING SITE is HOST TARGET binding site found in the 5' untranslated region of mRNA encoded by CLN5, corresponding to a HOST TARGET binding site such as BINDING SITE I, BINDING SITE II or BINDING SITE III. Table 2 illustrates the complementarity of the nucleotide sequences of CLN5 BINDING SITE, designated SEQ ID:13232, to the nucleotide sequence of VGAM2014 RNA, herein designated VGAM RNA, also designated SEQ ID:4725.

Another function of VGAM2014 is therefore inhibition of Ceroid-lipofuscinosis, Neuronal 5 (CLN5, Accession NM_006493). Accordingly, utilities of VGAM2014 include diagnosis, prevention and treatment of diseases and clinical conditions associated with CLN5. Cathepsin B (CTSB, Accession XM_035662) is another VGAM2014 host target gene. CTSB BINDING SITE is HOST TARGET binding site found in the 3' untranslated region of mRNA encoded by CTSB, corresponding to a HOST TARGET binding site such as BINDING SITE I, BINDING SITE II or BINDING SITE III. Table 2 illustrates the complementarity of the nucleotide sequences of CTSB BINDING SITE, designated SEQ ID:32329, to the nucleotide sequence of VGAM2014 RNA, herein designated VGAM RNA, also designated SEQ ID:4725.

Another function of VGAM2014 is therefore inhibition of Cathepsin B (CTSB, Accession XM_035662). Accordingly, utilities of VGAM2014 include diagnosis, prevention and treatment of diseases and clinical conditions associated with CTSB. Engrailed Homolog 1 (EN1, Accession NM_001426) is another VGAM2014 host target gene. EN1 BINDING SITE is HOST TARGET binding site found in the 3' untranslated region of mRNA encoded by EN1, corresponding to a HOST TARGET binding site such as BINDING SITE I, BINDING SITE II or BINDING SITE III. Table 2 illustrates the complementarity of the nucleotide sequences of EN1 BINDING SITE, designated SEQ ID:7142, to the nucleotide sequence of VGAM2014 RNA, herein designated VGAM RNA, also designated SEQ ID:4725.

Another function of VGAM2014 is therefore inhibition of Engrailed Homolog 1 (EN1, Accession NM_001426), a gene which is a member of the homeodomain family of DNA binding proteins; may regulate gene expression, morphogenesis, and differentiation. Accordingly, utilities of VGAM2014 include diagnosis, prevention and treatment of diseases and clinical conditions associated with EN1. The function of EN1 and its association with various diseases and clinical conditions, has been established by previous studies, as described hereinabove with reference to VGAM1615. Potassium Voltage-gated Channel, Shaker-related Subfamily, Member 6 (KCNA6, Accession NM_002235) is another VGAM2014 host target gene. KCNA6 BINDING SITE is HOST TARGET binding site found in the 3' untranslated region of mRNA encoded by KCNA6, corresponding to a HOST TARGET binding site such as BINDING SITE I, BINDING SITE II or BINDING SITE III. Table 2 illustrates the complementarity of the nucleotide sequences of KCNA6 BINDING SITE, designated SEQ ID:8019, to the nucleotide sequence of VGAM2014 RNA, herein designated VGAM RNA, also designated SEQ ID:4725.

Another function of VGAM2014 is therefore inhibition of Potassium Voltage-gated Channel, Shaker-related Subfamily, Member 6 (KCNA6, Accession NM_002235), a gene which mediates the voltage-dependent potassium ion permeability of excitable membranes. Accordingly, utilities of VGAM2014 include diagnosis, prevention and treatment of diseases and clinical conditions associated with KCNA6. The function of KCNA6 and its association with various diseases and clinical conditions, has been established by previous studies, as described hereinabove with reference to VGAM893. Ryanodine Receptor 3 (RYR3, Accession NM_001036) is another VGAM2014 host target gene. RYR3 BINDING SITE is HOST TARGET binding site found in the 3' untranslated region of mRNA encoded by RYR3, corresponding to a HOST TARGET binding site such as BINDING SITE I, BINDING SITE II or BINDING SITE III. Table 2 illustrates the complementarity of the nucleotide sequences of RYR3 BINDING SITE, designated SEQ ID:6701, to the nucleotide sequence of VGAM2014 RNA, herein designated VGAM RNA, also designated SEQ ID:4725.

Another function of VGAM2014 is therefore inhibition of Ryanodine Receptor 3 (RYR3, Accession NM_001036), a gene which is involved in communication between transverse-tubules and sarcoplasmic reticulum. Accordingly, utilities of VGAM2014 include diagnosis, prevention and treatment of diseases and clinical conditions associated with RYR3. The function of RYR3 has been established by previous studies. Ryanodine receptors are intracellular calcium ion release channels responsible for the release of Ca (2+) from intracellular stores following transduction of many different extracellular stimuli. Hakamata et al. (1992) deduced the complete amino acid sequence of a novel ryanodine receptor/calcium release channel from rabbit brain by cloning and sequence analysis of the cDNA. The protein was composed of 4,872 amino acids and shared characteristic structural features with the skeletal muscle (RYR1; 180901) and cardiac (RYR2; 180902) ryanodine receptors. RNA blot hybridization analysis showed that the brain ryanodine receptor is abundantly expressed in corpus striatum, thalamus, and hippocampus, whereas the cardiac ryanodine receptor is more uniformly expressed in the brain. The brain ryanodine receptor gene was also transcribed in smooth muscle. Leeb and Brenig (1998) isolated overlapping human RYR3 clones from a random primed fetal brain cDNA library. The gene encodes a 4,870-amino acid polypeptide that contains 4 RYR repeats, 3 SPRY domains, an ATP/GTP binding site consensus sequence, and 3 potential calmodulin-binding sites. They identified an alternatively spliced transcript that encodes a truncated protein. By isotopic in situ hybridization, Sorrentino et al. (1993) mapped the RYR3 gene to 15q14-q15; 15q15 is a probable location. By in situ hybridization, Mattei et al. (1994) mapped the type 3 ryanodine receptor to mouse chromosome 2E5-2F3. Richard et al. (1994) presented an integrated physical, expression, and genetic map of chromosome 15. They found that the RYR3 gene fell in their region I:15pter-q14 Animal model experiments lend further support to the function of RYR3. Takeshima et al. (1996), Bertocchini et al. (1997), and Futatsugi et al. (1999) independently generated Ryr3-deficient mice. In all cases, the homozygous mutant mice were fertile and displayed no gross abnormalities. Takeshima et al. (1996) detected increased locomotor activity in Ryr3 knockout mice compared to that of the control mice and concluded that the lack of Ryr3-mediated Ca (2+) signaling results in abnormalities of certain neurons in the central nervous system. Bertocchini et al. (1997) detected normal Ryr3 expression in murine skeletal muscles during the postnatal phase of muscle development, but not in muscles of adult mice, with the exception of the diaphragm and soleus muscles. The authors demonstrated that skeletal muscle contraction in Ryr3 knockout mice was impaired during the first weeks after birth. They concluded that Ryr3 has a physiologic role in excitation-contraction coupling of neonatal skeletal muscles. Futatsugi et al. (1999) measured the electrophysiologic and pharmacologic properties of synaptic plasticity in the CA1 area of Ryr3-deficient mice. The results suggested that Ryr3-mediated intracellular calcium release from endoplasmic reticulum may inhibit hippocampal LTP and spatial learning. Barone et al. (1998) generated double mutant mice carrying a targeted disruption of both the Ryr1 and Ryr3 genes. Skeletal muscles from mice homozygous for both mutations did not contract in response to caffeine or ryanodine. In addition, these muscles showed very low tension when directly activated with micromolar ionized calcium after membrane permeabilization, indicating either poor development or degeneration of the myofibrils. This was confirmed by biochemical analysis of contractile proteins. Electron microscopy confirmed small size of myofibrils and showed complete absence of feet (RyRs) in the junctional sarcoplasmic reticulum.

It is appreciated that the abovementioned animal model for RYR3 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bertocchini, F.; Ovitt, C. E.; Conti, A.; Barone, V.; Scholer, H. R.; Bottinelli, R.; Reggiani, C.; Sorrentino, V.: Requirement for the ryanodine receptor type 3 for efficient contraction in neonatal skeletal muscles. EMBO J. 16:6956-6963, 1997; and Futatsugi, A.; Kato, K.; Ogura, H.; Li, S.-T.; Nagata, E.; Kuwajima, G.; Tanaka, K.; Itohara, S.; Mikoshiba, K.: Facilitation of NMDAR-independent LTP and spatial learning in mutant mic.

Further studies establishing the function and utilities of RYR3 are found in John Hopkins OMIM database record ID 180903, and in sited publications numbered 10477-10276, 1027 and 10277-10278 listed in the bibliography section hereinbelow, which are also hereby incorporated by reference. Transmembrane Protein 2 (TMEM2, Accession NM_013390) is another VGAM2014 host target gene. TMEM2 BINDING SITE is HOST TARGET binding site found in the 3' untranslated region of mRNA encoded by TMEM2, corresponding to a HOST TARGET binding site such as BINDING SITE I, BINDING SITE II or BINDING SITE III. Table 2 illustrates the complementarity of the nucleotide sequences of TMEM2 BINDING SITE, designated SEQ ID:15043, to the nucleotide sequence of VGAM2014 RNA, herein designated VGAM RNA, also designated SEQ ID:4725.

Another function of VGAM2014 is therefore inhibition of Transmembrane Protein 2 (TMEM2, Accession NM_013390). Accordingly, utilities of VGAM2014 include diagnosis, prevention and treatment of diseases and clinical conditions associated with TMEM2. Tumor Necrosis Factor Receptor Superfamily, Member 9 (TNFRSF9, Accession NM_001561) is another VGAM2014 host target gene. TNFRSF9 BINDING SITE is HOST TARGET binding site found in the 3' untranslated region of mRNA encoded by TNFRSF9, corresponding to a HOST TARGET binding site such as BINDING SITE I, BINDING SITE II or BINDING SITE III. Table 2 illustrates the complementarity of the nucleotide sequences of TNFRSF9 BINDING SITE, designated SEQ ID:7290, to the nucleotide sequence of VGAM2014 RNA, herein designated VGAM RNA, also designated SEQ ID:4725.

Another function of VGAM2014 is therefore inhibition of Tumor Necrosis Factor Receptor Superfamily, Member 9 (TNFRSF9, Accession NM_001561), a gene which inhibits proliferation of activated T lymphocytes. Accordingly, utilities of VGAM2014 include diagnosis, prevention and treatment of diseases and clinical conditions associated with TNFRSF9. The function of TNFRSF9 and its association with various diseases and clinical conditions, has been established by previous studies, as described hereinabove with reference to VGAM1954. Chromosome 20 Open Reading Frame 29 (C20orf29, Accession NM_018347) is another VGAM2014 host target gene. C20orf29 BINDING SITE is HOST TARGET binding site found in the 3' untranslated region of mRNA encoded by C20orf29, corresponding to a HOST TARGET binding site such as BINDING SITE I, BINDING SITE II or BINDING SITE III. Table 2 illustrates the complementarity of the nucleotide sequences of C20orf29 BINDING SITE, designated SEQ ID:20359, to the nucleotide sequence of VGAM2014 RNA, herein designated VGAM RNA, also designated SEQ ID:4725.

Another function of VGAM2014 is therefore inhibition of Chromosome 20 Open Reading Frame 29 (C20orf29, Accession NM_018347). Accordingly, utilities of VGAM2014 include diagnosis, prevention and treatment of diseases and clinical conditions associated with C20orf29. DJ971N18.2 (Accession NM_021156) is another VGAM2014 host target gene. DJ971N18.2 BINDING SITE is HOST TARGET binding site found in the 3' untranslated region of mRNA encoded by DJ971N18.2, corresponding to a HOST TARGET binding site such as BINDING SITE I, BINDING SITE II or BINDING SITE III. Table 2 illustrates the complementarity of the nucleotide sequences of DJ971N18.2 BINDING SITE, designated SEQ ID:22137, to the nucleotide sequence of VGAM2014 RNA, herein designated VGAM RNA, also designated SEQ ID:4725.

Another function of VGAM2014 is therefore inhibition of DJ971N18.2 (Accession NM_021156). Accordingly, utilities of VGAM2014 include diagnosis, prevention and treatment of diseases and clinical conditions associated with DJ971N18.2. DKFZP434A0131 (Accession NM_018991) is another VGAM2014 host target gene. DKFZP434A0131 BINDING SITE is HOST TARGET binding site found in the 3' untranslated region of mRNA encoded by DKFZP434A0131, corresponding to a HOST TARGET binding site such as BINDING SITE I, BINDING SITE II or BINDING SITE III. Table 2 illustrates the complementarity of the nucleotide sequences of DKFZP434A0131 BINDING SITE, designated SEQ ID:21064, to the nucleotide sequence of VGAM2014 RNA, herein designated VGAM RNA, also designated SEQ ID:4725.

Another function of VGAM2014 is therefore inhibition of DKFZP434A0131 (Accession NM_018991). Accordingly, utilities of VGAM2014 include diagnosis, prevention and treatment of diseases and clinical conditions associated with DKFZP434A0131. Endothelial Cell-specific Molecule 1 (ESM1, Accession NM_007036) is another VGAM2014 host target gene. ESM1 BINDING SITE is HOST TARGET binding site found in the 3' untranslated region of mRNA encoded by ESM1, corresponding to a HOST TARGET binding site such as BINDING SITE I, BINDING SITE II or BINDING SITE III. Table 2 illustrates the complementarity of the nucleotide sequences of ESM1 BINDING SITE, designated SEQ ID:13915, to the nucleotide sequence of VGAM2014 RNA, herein designated VGAM RNA, also designated SEQ ID:4725.

Another function of VGAM2014 is therefore inhibition of Endothelial Cell-specific Molecule 1 (ESM1, Accession NM_007036). Accordingly, utilities of VGAM2014 include diagnosis, prevention and treatment of diseases and clinical conditions associated with ESM1. FLJ13910 (Accession NM_022780) is another VGAM2014 host target gene. FLJ13910 BINDING SITE is HOST TARGET binding site found in the 3' untranslated region of mRNA encoded by FLJ13910, corresponding to a HOST TARGET binding site such as BINDING SITE I, BINDING SITE II or BINDING SITE III. Table 2 illustrates the complementarity of the nucleotide sequences of FLJ13910 BINDING SITE, designated SEQ ID:23058, to the nucleotide sequence of VGAM2014 RNA, herein designated VGAM RNA, also designated SEQ ID:4725.

Another function of VGAM2014 is therefore inhibition of FLJ13910 (Accession NM_022780). Accordingly, utilities of VGAM2014 include diagnosis, prevention and treatment of diseases and clinical conditions associated with FLJ13910. Golgi Associated, Gamma Adaptin Ear Containing, ARF Binding Protein 2 (GGA2, Accession NM_015044) is another VGAM2014 host target gene. GGA2 BINDING SITE1 and GGA2 BINDING SITE2 are HOST TARGET binding sites found in untranslated regions of mRNA encoded by GGA2, corresponding to HOST TARGET binding sites such as BINDING SITE I, BINDING SITE II or BINDING SITE III. Table 2 illustrates the complementarity of the nucleotide sequences of GGA2 BINDING SITE1 and GGA2 BINDING SITE2, designated SEQ ID:17403 and SEQ ID:28925 respectively, to the nucleotide sequence of VGAM2014 RNA, herein designated VGAM RNA, also designated SEQ ID:4725.

Another function of VGAM2014 is therefore inhibition of Golgi Associated, Gamma Adaptin Ear Containing, ARF Binding Protein 2 (GGA2, Accession NM_015044). Accordingly, utilities of VGAM2014 include diagnosis, prevention and treatment of diseases and clinical conditions associated with GGA2. HSU24186 (Accession NM_013347) is another VGAM2014 host target gene. HSU24186 BINDING SITE is HOST TARGET binding site found in the 5' untranslated region of mRNA encoded by HSU24186, corresponding to a HOST TARGET binding site such as BINDING SITE I, BINDING SITE II or BINDING SITE III. Table 2 illustrates the complementarity of the nucleotide sequences of HSU24186 BINDING SITE, designated SEQ ID:14992, to the nucleotide sequence of VGAM2014 RNA, herein designated VGAM RNA, also designated SEQ ID:4725.

Another function of VGAM2014 is therefore inhibition of HSU24186 (Accession NM_013347). Accordingly, utilities of VGAM2014 include diagnosis, prevention and treatment of diseases and clinical conditions associated with HSU24186. KIAA0057 (Accession NM_012288) is another VGAM2014 host target gene. KIAA0057 BINDING SITE is HOST TARGET binding site found in the 3' untranslated region of mRNA encoded by KIAA0057, corresponding to a HOST TARGET binding site such as BINDING SITE I, BINDING SITE II or BINDING SITE III. Table 2 illustrates the complementarity of the nucleotide sequences of KIAA0057 BINDING SITE, designated SEQ ID:14629, to the nucleotide sequence of VGAM2014 RNA, herein designated VGAM RNA, also designated SEQ ID:4725.

Another function of VGAM2014 is therefore inhibition of KIAA0057 (Accession NM_012288). Accordingly, utilities of VGAM2014 include diagnosis, prevention and treatment of diseases and clinical conditions associated with KIAA0057. KIAA0483 (Accession NM_015176) is another VGAM2014 host target gene. KIAA0483 BINDING SITE is HOST TARGET binding site found in the 3' untranslated region of mRNA encoded by KIAA0483, corresponding to a HOST TARGET binding site such as BINDING SITE I, BINDING SITE II or BINDING SITE III. Table 2 illustrates the complementarity of the nucleotide sequences of KIAA0483 BINDING SITE, designated SEQ ID:17531, to the nucleotide sequence of VGAM2014 RNA, herein designated VGAM RNA, also designated SEQ ID:4725.

Another function of VGAM2014 is therefore inhibition of KIAA0483 (Accession NM_015176). Accordingly, utilities of VGAM2014 include diagnosis, prevention and treatment of diseases and clinical conditions associated with KIAA0483. MGC10960 (Accession NM_032653) is another VGAM2014 host target gene. MGC10960 BINDING SITE is HOST TARGET binding site found in the 3' untranslated region of mRNA encoded by MGC10960, corresponding to a HOST TARGET binding site such as BINDING SITE I, BINDING SITE II or BINDING SITE III. Table 2 illustrates the complementarity of the nucleotide sequences of MGC10960 BINDING SITE, designated SEQ ID:26385, to the nucleotide sequence of VGAM2014 RNA, herein designated VGAM RNA, also designated SEQ ID:4725.

Another function of VGAM2014 is therefore inhibition of MGC10960 (Accession NM_032653). Accordingly, utilities of VGAM2014 include diagnosis, prevention and treatment of diseases and clinical conditions associated with MGC10960. MGC13159 (Accession NM_032927) is another VGAM2014 host target gene. MGC13159 BINDING SITE is HOST TARGET binding site found in the 3' untranslated region of mRNA encoded by MGC13159, corresponding to a HOST TARGET binding site such as BINDING SITE I, BINDING SITE II or BINDING SITE III. Table 2 illustrates the complementarity of the nucleotide sequences of MGC13159 BINDING SITE, designated SEQ ID:26753, to the nucleotide sequence of VGAM2014 RNA, herein designated VGAM RNA, also designated SEQ ID:4725.

Another function of VGAM2014 is therefore inhibition of MGC13159 (Accession NM_032927). Accordingly, utilities of VGAM2014 include diagnosis, prevention and treatment of diseases and clinical conditions associated with MGC13159. MGC2721 (Accession NM_032737) is another VGAM2014 host target gene. MGC2721 BINDING SITE is HOST TARGET binding site found in the 3' untranslated region of mRNA encoded by MGC2721, corresponding to a HOST TARGET binding site such as BINDING SITE I, BINDING SITE II or BINDING SITE III. Table 2 illustrates the complementarity of the nucleotide sequences of MGC2721 BINDING SITE, designated SEQ ID:26464, to the nucleotide sequence of VGAM2014 RNA, herein designated VGAM RNA, also designated SEQ ID:4725.

Another function of VGAM2014 is therefore inhibition of MGC2721 (Accession NM_032737). Accordingly, utilities of VGAM2014 include diagnosis, prevention and treatment of diseases and clinical conditions associated with MGC2721. MGC29937 (Accession NM_144597) is another VGAM2014 host target gene. MGC29937 BINDING SITE is HOST TARGET binding site found in the 3' untranslated region of mRNA encoded by MGC29937, corresponding to a HOST TARGET binding site such as BINDING SITE I, BINDING SITE II or BINDING SITE III. Table 2 illustrates the complementarity of the nucleotide sequences of MGC29937 BINDING SITE, designated SEQ ID:29411, to the nucleotide sequence of VGAM2014 RNA, herein designated VGAM RNA, also designated SEQ ID:4725.

Another function of VGAM2014 is therefore inhibition of MGC29937 (Accession NM_144597). Accordingly, utilities of VGAM2014 include diagnosis, prevention and treatment of diseases and clinical conditions associated with MGC29937. Phosphodiesterase 8A (PDE8A, Accession XM_031443) is another VGAM2014 host target gene. PDE8A BINDING SITE is HOST TARGET binding site found in the 3' untranslated region of mRNA encoded by PDE8A, corresponding to a HOST TARGET binding site such as BINDING SITE I, BINDING SITE II or BINDING SITE III. Table 2 illustrates the complementarity of the nucleotide sequences of PDE8A BINDING SITE, designated SEQ ID:31381, to the nucleotide sequence of VGAM2014 RNA, herein designated VGAM RNA, also designated SEQ ID:4725.

Another function of VGAM2014 is therefore inhibition of Phosphodiesterase 8A (PDE8A, Accession XM_031443). Accordingly, utilities of VGAM2014 include diagnosis, prevention and treatment of diseases and clinical conditions associated with PDE8A. Ras Association (RalGDS/AF-6) Domain Family 2 (RASSF2, Accession NM_014737) is another VGAM2014 host target gene. RASSF2 BINDING SITE is HOST TARGET binding site found in the 3' untranslated region of mRNA encoded by RASSF2, corresponding to a HOST TARGET binding site such as BINDING SITE I, BINDING SITE II or BINDING SITE III. Table 2 illustrates the complementarity of the nucleotide sequences of RASSF2 BINDING SITE, designated SEQ ID:16399, to the nucleotide sequence of VGAM2014 RNA, herein designated VGAM RNA, also designated SEQ ID:4725.

Another function of VGAM2014 is therefore inhibition of Ras Association (RalGDS/AF-6) Domain Family 2 (RASSF2, Accession NM_014737). Accordingly, utilities of VGAM2014 include diagnosis, prevention and treatment of diseases and clinical conditions associated with RASSF2. RYK Receptor-like Tyrosine Kinase (RYK, Accession XM_093692) is another VGAM2014 host target gene. RYK BINDING SITE is HOST TARGET binding site found in the 3' untranslated region of mRNA encoded by RYK, corresponding to a HOST TARGET binding site such as BINDING SITE I, BINDING SITE II or BINDING SITE III. Table 2 illustrates the complementarity of the nucleotide sequences of RYK BINDING SITE, designated SEQ ID:40207, to the nucleotide sequence of VGAM2014 RNA, herein designated VGAM RNA, also designated SEQ ID:4725.

Another function of VGAM2014 is therefore inhibition of RYK Receptor-like Tyrosine Kinase (RYK, Accession XM_093692). Accordingly, utilities of VGAM2014 include diagnosis, prevention and treatment of diseases and clinical conditions associated with RYK. VMP1 (Accession NM_030938) is another VGAM2014 host target gene. VMP1 BINDING SITE is HOST TARGET binding site found in the 3' untranslated region of mRNA encoded by VMP1, corresponding to a HOST TARGET binding site such as BINDING SITE I, BINDING SITE II or BINDING SITE III. Table 2 illustrates the complementarity of the nucleotide sequences of VMP1 BINDING SITE, designated SEQ ID:25207, to the nucleotide sequence of VGAM2014 RNA, herein designated VGAM RNA, also designated SEQ ID:4725.

Another function of VGAM2014 is therefore inhibition of VMP1 (Accession NM_030938). Accordingly, utilities of VGAM2014 include diagnosis, prevention and treatment of diseases and clinical conditions associated with VMP1. LOC151647 (Accession XM_087261) is another VGAM2014 host target gene. LOC151647 BINDING SITE is HOST TARGET binding site found in the 3' untranslated region of mRNA encoded by LOC151647, corresponding to a HOST TARGET binding site such as BINDING SITE I, BINDING SITE II or BINDING SITE III. Table 2 illustrates the complementarity of the nucleotide sequences of LOC151647 BINDING SITE, designated SEQ ID:39159, to the nucleotide sequence of VGAM2014 RNA, herein designated VGAM RNA, also designated SEQ ID:4725.

Another function of VGAM2014 is therefore inhibition of LOC151647 (Accession XM_087261). Accordingly, utilities of VGAM2014 include diagnosis, prevention and treatment of diseases and clinical conditions associated with LOC151647. LOC158263 (Accession XM_088530) is another VGAM2014 host target gene. LOC158263 BINDING SITE is HOST TARGET binding site found in the 3' untranslated region of mRNA encoded by LOC158263, corresponding to a HOST TARGET binding site such as BINDING SITE I, BINDING SITE II or BINDING SITE III. Table 2 illustrates the complementarity of the nucleotide sequences of LOC158263 BINDING SITE, designated SEQ ID:39800, to the nucleotide sequence of VGAM2014 RNA, herein designated VGAM RNA, also designated SEQ ID:4725.

Another function of VGAM2014 is therefore inhibition of LOC158263 (Accession XM_088530). Accordingly, utilities of VGAM2014 include diagnosis, prevention and treatment of diseases and clinical conditions associated with LOC158263. LOC158714 (Accession XM_088650) is another VGAM2014 host target gene. LOC158714 BINDING SITE is HOST TARGET binding site found in the 5' untranslated region of mRNA encoded by LOC158714, corresponding to a HOST TARGET binding site such as BINDING SITE I, BINDING SITE II or BINDING SITE III. Table 2 illustrates the complementarity of the nucleotide sequences of LOC158714 BINDING SITE, designated SEQ ID:39887, to the nucleotide sequence of VGAM2014 RNA, herein designated VGAM RNA, also designated SEQ ID:4725.

Another function of VGAM2014 is therefore inhibition of LOC158714 (Accession XM_088650). Accordingly, utilities of VGAM2014 include diagnosis, prevention and treatment of diseases and clinical conditions associated with LOC158714. LOC168667 (Accession XM_166592) is another VGAM2014 host target gene. LOC168667 BINDING SITE is HOST TARGET binding site found in the 3' untranslated region of mRNA encoded by LOC168667, corresponding to a HOST TARGET binding site such as BINDING SITE I, BINDING SITE II or BINDING SITE III. Table 2 illustrates the complementarity of the nucleotide sequences of LOC168667 BINDING SITE, designated SEQ ID:44570, to the nucleotide sequence of VGAM2014 RNA, herein designated VGAM RNA, also designated SEQ ID:4725.

Another function of VGAM2014 is therefore inhibition of LOC168667 (Accession XM_166592). Accordingly, utilities of VGAM2014 include diagnosis, prevention and treatment of diseases and clinical conditions associated with LOC168667. LOC201229 (Accession XM_113925) is another VGAM2014 host target gene. LOC201229 BINDING SITE is HOST TARGET binding site found in the 5' untranslated region of mRNA encoded by LOC201229, corresponding to a HOST TARGET binding site such as BINDING SITE I, BINDING SITE II or BINDING SITE III. Table 2 illustrates the complementarity of the nucleotide sequences of LOC201229 BINDING SITE, designated SEQ ID:42545, to the nucleotide sequence of VGAM2014 RNA, herein designated VGAM RNA, also designated SEQ ID:4725.

Another function of VGAM2014 is therefore inhibition of LOC201229 (Accession XM_113925). Accordingly, utilities of VGAM2014 include diagnosis, prevention and treatment of diseases and clinical conditions associated with LOC201229. LOC256821 (Accession XM_175144) is another VGAM2014 host target gene. LOC256821 BINDING SITE is HOST TARGET binding site found in the 5' untranslated region of mRNA encoded by LOC256821, corresponding to a HOST TARGET binding site such as BIND- ING SITE I, BINDING SITE II or BINDING SITE III. Table 2 illustrates the complementarity of the nucleotide sequences of LOC256821 BINDING SITE, designated SEQ ID:46639, to the nucleotide sequence of VGAM2014 RNA, herein designated VGAM RNA, also designated SEQ ID:4725.

Another function of VGAM2014 is therefore inhibition of LOC256821 (Accession XM_175144). Accordingly, utilities of VGAM2014 include diagnosis, prevention and treatment of diseases and clinical conditions associated with LOC256821. LOC51141 (Accession XM_043953) is another VGAM2014 host target gene. LOC51141 BINDING SITE is HOST TARGET binding site found in the 5' untranslated region of mRNA encoded by LOC51141, corresponding to a HOST TARGET binding site such as BINDING SITE I, BINDING SITE II or BINDING SITE III. Table 2 illustrates the complementarity of the nucleotide sequences of LOC51141 BINDING SITE, designated SEQ ID:34049, to the nucleotide sequence of VGAM2014 RNA, herein designated VGAM RNA, also designated SEQ ID:4725.

Another function of VGAM2014 is therefore inhibition of LOC51141 (Accession XM_043953). Accordingly, utilities of VGAM2014 include diagnosis, prevention and treatment of diseases and clinical conditions associated with LOC51141. FIG. 1 further provides a conceptual description of a novel bioinformatically detected viral gene of the present invention, referred to here as Viral Genomic Address Messenger 2015 (VGAM2015) viral gene, which modulates expression of respective host target genes thereof, the function and utility of which host target genes is known in the art.

VGAM2015 is a novel bioinformatically detected regulatory, non protein coding, viral micro RNA (miRNA) gene. The method by which VGAM2015 was detected is described hereinabove with reference to FIGS. 1-8.

VGAM2015 gene, herein designated VGAM GENE, is a viral gene contained in the genome of Kyuri Green Mottle Mosaic Virus. VGAM2015 host target gene, herein designated VGAM HOST TARGET GENE, is a human gene contained in the human genome.

VGAM2015 gene encodes a VGAM2015 precursor RNA, herein designated VGAM PRECURSOR RNA. Similar to other miRNA genes, and unlike most ordinary genes, VGAM2015 precursor RNA does not encode a protein. A nucleotide sequence identical or highly similar to the nucleotide sequence of VGAM2015 precursor RNA is designated SEQ ID:2001, and is provided hereinbelow with reference to the sequence listing part. Nucleotide sequence SEQ ID:2001 is located at position 4081 relative to the genome of Kyuri Green Mottle Mosaic Virus.

VGAM2015 precursor RNA folds onto itself, forming VGAM2015 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2015 folded precursor RNA into VGAM2015 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM2015 RNA is designated SEQ ID:4726, and is provided hereinbelow with reference to the sequence listing part.

VGAM2015 host target gene, herein designated VGAM HOST TARGET GENE, encodes a corresponding messenger RNA, VGAM2015 host target RNA, herein designated VGAM HOST TARGET RNA. VGAM2015 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2015 RNA, herein designated VGAM RNA, binds complementarily to one or more host target binding sites located in untranslated regions of VGAM2015 host target RNA, herein designated VGAM HOST TARGET RNA. This complementary binding is due to the fact that the nucleotide sequence of VGAM2015 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2015 RNA, herein designated VGAM RNA, may have a different number of host target binding sites in untranslated regions of a VGAM2015 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2015 RNA, herein designated VGAM RNA, to host target binding sites on VGAM2015 host target RNA, herein designated VGAM HOST TARGET RNA, such as BINDING SITE I, BINDING SITE II and BINDING SITE III, inhibits translation of VGAM2015 host target RNA into VGAM2015 host target protein, herein designated VGAM HOST TARGET PROTEIN. VGAM host target protein is therefore outlined by a broken line.

It is appreciated that VGAM2015 host target gene, herein designated VGAM HOST TARGET GENE, in fact represents a plurality of VGAM2015 host target genes. The mRNA of each one of this plurality of VGAM2015 host target genes comprises one or more host target binding sites, each having a nucleotide sequence which is at least partly complementary to VGAM2015 RNA, herein designated VGAM RNA, and which when bound by VGAM2015 RNA causes inhibition of translation of respective one or more VGAM2015 host target proteins.

It is further appreciated by one skilled in the art that the mode of translational inhibition illustrated by FIG. 1 with specific reference to translational inhibition exerted by VGAM2015 gene, herein designated VGAM GENE, on one or more VGAM2015 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2015 is inhibition of expression of host target genes, as part of a novel viral mechanism of attacking a host. Accordingly, utilities of VGAM2015 include diagnosis, prevention and treatment of viral infection by Kyuri Green Mottle Mosaic Virus. Specific functions, and accordingly utilities, of VGAM2015 correlate with, and may be deduced from, the identity of the host target genes which VGAM2015 binds and inhibits, and the function of these host target genes, as elaborated hereinbelow.

Nucleotide sequences of the VGAM2015 precursor RNA, herein designated VGAM PRECURSOR RNA, and of the 'diced' VGAM2015 RNA, herein designated VGAM RNA, and a schematic representation of the secondary folding of VGAM2015 folded precursor RNA, herein designated VGAM FOLDED PRECURSOR RNA, of VGAM2015 are further described hereinbelow with reference to Table 1.

Nucleotide sequences of host target binding sites, such as BINDING SITE-I, BINDING SITE-II and BINDING SITE-III of FIG. 1, found on VGAM2015 host target RNA, and schematic representation of the complementarity of each of these host target binding sites to VGAM2015 RNA, herein designated VGAM RNA, are described hereinbelow with reference to Table 2.

As mentioned hereinabove with reference to FIG. 1, a function of VGAM2015 gene, herein designated VGAM is inhibition of expression of VGAM2015 target genes. It is appreciated that specific functions, and accordingly utilities, of VGAM2015 correlate with, and may be deduced from, the identity of the target genes which VGAM2015 binds and inhibits, and the function of these target genes, as elaborated hereinbelow.

Vacuolar Protein Sorting 26 (yeast) (VPS26, Accession NM_004896) is a VGAM2015 host target gene. VPS26 BINDING SITE is HOST TARGET binding site found in the 3' untranslated region of mRNA encoded by VPS26, corresponding to a HOST TARGET binding site such as BINDING SITE I, BINDING SITE II or BINDING SITE III. Table 2 illustrates the complementarity of the nucleotide sequences of VPS26 BINDING SITE, designated SEQ ID:11325, to the nucleotide sequence of VGAM2015 RNA, herein designated VGAM RNA, also designated SEQ ID:4726.

A function of VGAM2015 is therefore inhibition of Vacuolar Protein Sorting 26 (yeast) (VPS26, Accession NM_004896), a gene which is a sorting protein- ensures the proper delivery of organelle-specific proteins. Accordingly, utilities of VGAM2015 include diagnosis, prevention and treatment of diseases and clinical conditions associated with VPS26. The function of VPS26 and its association with various diseases and clinical conditions, has been established by previous studies, as described hereinabove with reference to VGAM315. Chromosome 20 Open Reading Frame 42 (C20orf42, Accession NM_017671) is another VGAM2015 host target gene. C20orf42 BINDING SITE is HOST TARGET binding site found in the 3' untranslated region of mRNA encoded by C20orf42, corresponding to a HOST TARGET binding site such as BINDING SITE I, BINDING SITE II or BINDING SITE III. Table 2 illustrates the complementarity of the nucleotide sequences of C20orf42 BINDING SITE, designated SEQ ID:19214, to the nucleotide sequence of VGAM2015 RNA, herein designated VGAM RNA, also designated SEQ ID:4726.

Another function of VGAM2015 is therefore inhibition of Chromosome 20 Open Reading Frame 42 (C20orf42, Accession NM_017671). Accordingly, utilities of VGAM2015 include diagnosis, prevention and treatment of diseases and clinical conditions associated with C20orf42. HCGIV.9 (Accession NM_018985) is another VGAM2015 host target gene. HCGIV.9 BINDING SITE is HOST TARGET binding site found in the 3' untranslated region of mRNA encoded by HCGIV.9, corresponding to a HOST TARGET binding site such as BINDING SITE I, BINDING SITE II or BINDING SITE III. Table 2 illustrates the complementarity of the nucleotide sequences of HCGIV.9 BINDING SITE, designated SEQ ID:21055, to the nucleotide sequence of VGAM2015 RNA, herein designated VGAM RNA, also designated SEQ ID:4726.

Another function of VGAM2015 is therefore inhibition of HCGIV.9 (Accession NM_018985). Accordingly, utilities of VGAM2015 include diagnosis, prevention and treatment of diseases and clinical conditions associated with HCGIV.9. V-maf Musculoaponeurotic Fibrosarcoma Oncogene Homolog B (avian) (MAFB, Accession NM_005461) is another VGAM2015 host target gene. MAFB BINDING SITE is HOST TARGET binding site found in the 3' untranslated region of mRNA encoded by MAFB, corresponding to a HOST TARGET binding site such as BINDING SITE I, BINDING SITE II or BINDING SITE III. Table 2 illustrates the complementarity of the nucleotide sequences of MAFB BINDING SITE, designated SEQ ID:11942, to the nucleotide sequence of VGAM2015 RNA, herein designated VGAM RNA, also designated SEQ ID:4726.

Another function of VGAM2015 is therefore inhibition of V-maf Musculoaponeurotic Fibrosarcoma Oncogene Homolog B (avian) (MAFB, Accession NM_005461). Accordingly, utilities of VGAM2015 include diagnosis, prevention and treatment of diseases and clinical conditions associated with MAFB. Proline-serine-threonine Phosphatase Interacting Protein 2 (PSTPIP2, Accession NM_024430) is another VGAM2015 host target gene. PSTPIP2 BINDING SITE is HOST TARGET binding site found in the 3' untranslated region of mRNA encoded by PSTPIP2, corresponding to a HOST TARGET binding site such as BINDING SITE I, BINDING SITE II or BINDING SITE III. Table 2 illustrates the complementarity of the nucleotide sequences of PSTPIP2 BINDING SITE, designated SEQ ID:23681, to the nucleotide sequence of VGAM2015 RNA, herein designated VGAM RNA, also designated SEQ ID:4726.

Another function of VGAM2015 is therefore inhibition of Proline-serine-threonine Phosphatase Interacting Protein 2 (PSTPIP2, Accession NM_024430). Accordingly, utilities of VGAM2015 include diagnosis, prevention and treatment of diseases and clinical conditions associated with PSTPIP2. LOC148195 (Accession XM_097419) is another VGAM2015 host target gene. LOC148195 BINDING SITE is HOST TARGET binding site found in the 5' untranslated region of mRNA encoded by LOC148195, corresponding to a HOST TARGET binding site such as BINDING SITE I, BINDING SITE II or BINDING SITE III. Table 2 illustrates the complementarity of the nucleotide sequences of LOC148195 BINDING SITE, designated SEQ ID:40876, to the nucleotide sequence of VGAM2015 RNA, herein designated VGAM RNA, also designated SEQ ID:4726.

Another function of VGAM2015 is therefore inhibition of LOC148195 (Accession XM_097419). Accordingly, utilities of VGAM2015 include diagnosis, prevention and treatment of diseases and clinical conditions associated with LOC148195. LOC253981 (Accession XM_171064) is another VGAM2015 host target gene. LOC253981 BINDING SITE is HOST TARGET binding site found in the 3' untranslated region of mRNA encoded by LOC253981, corresponding to a HOST TARGET binding site such as BINDING SITE I, BINDING SITE II or BINDING SITE III. Table 2 illustrates the complementarity of the nucleotide sequences of LOC253981 BINDING SITE, designated SEQ ID:45864, to the nucleotide sequence of VGAM2015 RNA, herein designated VGAM RNA, also designated SEQ ID:4726.

Another function of VGAM2015 is therefore inhibition of LOC253981 (Accession XM_171064). Accordingly, utilities of VGAM2015 include diagnosis, prevention and treatment of diseases and clinical conditions associated with LOC253981. LOC90183 (Accession XM_029709) is another VGAM2015 host target gene. LOC90183 BINDING SITE is HOST TARGET binding site found in the 3' untranslated region of mRNA encoded by LOC90183, corresponding to a HOST TARGET binding site such as BINDING SITE I, BINDING SITE II or BINDING SITE III. Table 2 illustrates the complementarity of the nucleotide sequences of LOC90183 BINDING SITE, designated SEQ ID:30925, to the nucleotide sequence of VGAM2015 RNA, herein designated VGAM RNA, also designated SEQ ID:4726.

Another function of VGAM2015 is therefore inhibition of LOC90183 (Accession XM_029709). Accordingly, utilities of VGAM2015 include diagnosis, prevention and treatment of diseases and clinical conditions associated with LOC90183. FIG. 1 further provides a conceptual description of a novel bioinformatically detected viral gene of the present invention, referred to here as Viral Genomic Address Messenger 2016 (VGAM2016) viral gene, which modulates expression of respective host target genes thereof, the function and utility of which host target genes is known in the art.

VGAM2016 is a novel bioinformatically detected regulatory, non protein coding, viral micro RNA (miRNA) gene. The method by which VGAM2016 was detected is described hereinabove with reference to FIGS. 1-8.

VGAM2016 gene, herein designated VGAM GENE, is a viral gene contained in the genome of Kyuri Green Mottle Mosaic Virus. VGAM2016 host target gene, herein designated VGAM HOST TARGET GENE, is a human gene contained in the human genome.

VGAM2016 gene encodes a VGAM2016 precursor RNA, herein designated VGAM PRECURSOR RNA. Similar to other miRNA genes, and unlike most ordinary genes, VGAM2016 precursor RNA does not encode a protein. A nucleotide sequence identical or highly similar to the nucleotide sequence of VGAM2016 precursor RNA is designated SEQ ID:2002, and is provided hereinbelow with reference to the sequence listing part. Nucleotide sequence SEQ ID:2002 is located at position 1496 relative to the genome of Kyuri Green Mottle Mosaic Virus.

VGAM2016 precursor RNA folds onto itself, forming VGAM2016 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2016 folded precursor RNA into VGAM2016 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2016 RNA is designated SEQ ID:4727, and is provided hereinbelow with reference to the sequence listing part.

VGAM2016 host target gene, herein designated VGAM HOST TARGET GENE, encodes a corresponding messenger RNA, VGAM2016 host target RNA, herein designated VGAM HOST TARGET RNA. VGAM2016 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2016 RNA, herein designated VGAM RNA, binds complementarily to one or more host target binding sites located in untranslated regions of VGAM2016 host target RNA, herein designated VGAM HOST TARGET RNA. This complementary binding is due to the fact that the nucleotide sequence of VGAM2016 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2016 RNA, herein designated VGAM RNA, may have a different number of host target binding sites in untranslated regions of a VGAM2016 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2016 RNA, herein designated VGAM RNA, to host target binding sites on VGAM2016 host target RNA, herein designated VGAM HOST TARGET RNA, such as BINDING SITE I, BINDING SITE II and BINDING SITE III, inhibits translation of VGAM2016 host target RNA into VGAM2016 host target protein, herein designated VGAM HOST TARGET PROTEIN. VGAM host target protein is therefore outlined by a broken line.

It is appreciated that VGAM2016 host target gene, herein designated VGAM HOST TARGET GENE, in fact represents a plurality of VGAM2016 host target genes. The mRNA of each one of this plurality of VGAM2016 host target genes comprises one or more host target binding sites, each having a nucleotide sequence which is at least partly complementary to VGAM2016 RNA, herein designated VGAM RNA, and which when bound by VGAM2016 RNA causes inhibition of translation of respective one or more VGAM2016 host target proteins.

It is further appreciated by one skilled in the art that the mode of translational inhibition illustrated by FIG. 1 with specific reference to translational inhibition exerted by VGAM2016 gene, herein designated VGAM GENE, on one or more VGAM2016 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2016 is inhibition of expression of host target genes, as part of a novel viral mechanism of attacking a host. Accordingly, utilities of VGAM2016 include diagnosis, prevention and treatment of viral infection by Kyuri Green Mottle Mosaic Virus. Specific functions, and accordingly utilities, of VGAM2016 correlate with, and may be deduced from, the identity of the host target genes which VGAM2016 binds and inhibits, and the function of these host target genes, as elaborated hereinbelow.

Nucleotide sequences of the VGAM2016 precursor RNA, herein designated VGAM PRECURSOR RNA, and of the 'diced' VGAM2016 RNA, herein designated VGAM RNA, and a schematic representation of the secondary folding of VGAM2016 folded precursor RNA, herein designated VGAM FOLDED PRECURSOR RNA, of VGAM2016 are further described hereinbelow with reference to Table 1.

Nucleotide sequences of host target binding sites, such as BINDING SITE-I, BINDING SITE-II and BINDING SITE-III of FIG. 1, found on VGAM2016 host target RNA, and schematic representation of the complementarity of each of these host target binding sites to VGAM2016 RNA, herein designated VGAM RNA, are described hereinbelow with reference to Table 2.

As mentioned hereinabove with reference to FIG. 1, a function of VGAM2016 gene, herein designated VGAM is inhibition of expression of VGAM2016 target genes. It is appreciated that specific functions, and accordingly utilities, of VGAM2016 correlate with, and may be deduced from, the identity of the target genes which VGAM2016 binds and inhibits, and the function of these target genes, as elaborated hereinbelow.

Fibroblast Growth Factor Receptor 1 (fms-related tyrosine kinase 2, Pfeiffer syndrome) (FGFR1, Accession NM_023107) is a VGAM2016 host target gene. FGFR1 BINDING SITE1 and FGFR1 BINDING SITE2 are HOST TARGET binding sites found in untranslated regions of mRNA encoded by FGFR1, corresponding to HOST TARGET binding sites such as BINDING SITE I, BINDING SITE II or BINDING SITE III. Table 2 illustrates the complementarity of the nucleotide sequences of FGFR1 BINDING SITE1 and FGFR1 BINDING SITE2, designated SEQ ID:23360 and SEQ ID:23365 respectively, to the nucleotide sequence of VGAM2016 RNA, herein designated VGAM RNA, also designated SEQ ID:4727.

A function of VGAM2016 is therefore inhibition of Fibroblast Growth Factor Receptor 1 (fms-related tyrosine kinase 2, Pfeiffer syndrome) (FGFR1, Accession NM_023107). Accordingly, utilities of VGAM2016 include diagnosis, prevention and treatment of diseases and clinical conditions associated with FGFR1. Protease, Serine, 8 (prostasin) (PRSS8, Accession NM_002773) is another VGAM2016 host target gene. PRSS8 BINDING SITE is HOST TARGET binding site found in the 5' untranslated region of mRNA encoded by PRSS8, corresponding to a HOST TARGET binding site such as BINDING SITE I, BINDING SITE II or BINDING SITE III. Table 2 illustrates the complementarity of the nucleotide sequences of PRSS8 BINDING SITE, designated SEQ ID:8663, to the nucleotide sequence of VGAM2016 RNA, herein designated VGAM RNA, also designated SEQ ID:4727.

Another function of VGAM2016 is therefore inhibition of Protease, Serine, 8 (prostasin) (PRSS8, Accession NM_002773), a gene which is a transmembrane serine protease. Accordingly, utilities of VGAM2016 include diagnosis, prevention and treatment of diseases and clinical conditions associated with PRSS8. The function of PRSS8 has been established by previous studies. Human seminal fluid contains a variety of proteolytic enzymes, including prostate-specific antigen (OMIM Ref. No. 176820) and acrosin (OMIM Ref. No. 102480). These enzymes are involved in the postejaculatory hydrolysis of proteins and in semen coagulation and liquefaction. Yu et al. (1995) obtained partial amino acid sequence of a 40-kD protein isolated from seminal fluid originally by Yu et al. (1994). Yu et al. (1995) designed degenerate primers based on the amino acid sequence and used to screen a human prostate cDNA library by PCR. The 3-prime end of the cDNA was obtained by the RACE (rapid amplification of cDNA ends) method. A 1.8-kb cDNA sequence was assembled encoding a predicted protein of 343 amino acids which contains a 32-amino acid signal peptide. The protein, designated serine protease-8 (PRSS8), was called prostasin by the authors. The precursor, proprostasin, is cleaved between residues 12 and 13 to produce a 12-amino acid light chain and a 299-amino acid heavy chain which are associated through a disulfide bond. The predicted amino acid sequence is between 34 and 42% identical to human acrosin, plasma kallikrein (OMIM Ref. No. 229000), and hepsin (OMIM Ref. No. 142440). The deduced protein has a hydrophobic domain at the C terminus, indicating to the authors that it may be membrane anchored. The authors showed that the hydrophobic region is cleaved between residues 290 and 291 during secretion. Expression levels of the prostasin mRNA were assayed by Southern blots of RT-PCR products. Expression was noted in a wide variety of tissues. In the prostate gland, expression was localized to the epithelial cells. Donaldson et al. (2002) found evidence for the regulation of the epithelial sodium channel (ENaC; OMIM Ref. No. 600228) by prostasin. They cloned prostasin in their search for a human homolog of a channel-activating protease (xCAP1) of Xenopus kidney epithelial cells. They determined that prostasin shares 41% sequence identity with the Xenopus protease and 76% identity with the mouse homolog. --FUNCTION Donaldson et al. (2002) found that coexpression of prostasin with either Xenopus or rat ENaC in Xenopus oocytes resulted in a 60 to 80% increase in amiloride-sensitive sodium currents, and that the addition of aprotinin, a serine protease inhibitor, completely prevented this activation. By in situ hybridization, they determined that both prostasin and TMPRSS2 (OMIM Ref. No. 602060) show a tissue distribution in human airway epithelia consistent with a role in ENaC regulation. Both had strong expression in superficial epithelial cells lining the nose, trachea, and distal airways, and both were expressed at the alveolar level, most notably at alveolar junctions in a distribution characteristic of type II pneumocytes. Expression was also pronounced in submucosal glands associated with nasal, tracheal, and bronchial tissues. Donaldson et al. (2002) suggested that prostasin is likely to be the more physiologically relevant protease.

Full details of the abovementioned studies are described in the following publications, the disclosure of which are hereby incorporated by reference:

Donaldson, S. H.; Hirsh, A.; Li, D. C.; Holloway, G.; Chao, J.; Boucher, R. C.; Gabriel, S. E.: Regulation of the epithelial sodium channel by serine proteases in human airways. J. Biol. Chem. 277:8338-8345, 2002; and Yu, J. X.; Chao, L.; Ward, D. C.; Chao, J.: Structure and chromosomal localization of the human prostasin (PRSS8) gene. Genomics 32:334-340, 1996.

Further studies establishing the function and utilities of PRSS8 are found in John Hopkins OMIM database record ID 600823, and in sited publications numbered 755 and 7772-7774 listed in the bibliography section hereinbelow, which are also hereby incorporated by reference. DKFZP564K0322 (Accession NM_032040) is another VGAM2016 host target gene. DKFZP564K0322 BINDING SITE is HOST TARGET binding site found in the 5' untranslated region of mRNA encoded by DKFZP564K0322, corresponding to a HOST TARGET binding site such as BINDING SITE I, BINDING SITE II or BINDING SITE III. Table 2 illustrates the complementarity of the nucleotide sequences of DKFZP564K0322 BINDING SITE, designated SEQ ID:25740, to the nucleotide sequence of VGAM2016 RNA, herein designated VGAM RNA, also designated SEQ ID:4727.

Another function of VGAM2016 is therefore inhibition of DKFZP564K0322 (Accession NM_032040). Accordingly, utilities of VGAM2016 include diagnosis, prevention and treatment of diseases and clinical conditions associated with DKFZP564K0322. FLJ23511 (Accession NM_032239) is another VGAM2016 host target gene. FLJ23511 BINDING SITE is HOST TARGET binding site found in the 5' untranslated region of mRNA encoded by FLJ23511, corresponding to a HOST TARGET binding site such as BINDING SITE I, BINDING SITE II or BINDING SITE III. Table 2 illustrates the complementarity of the nucleotide sequences of FLJ23511 BINDING SITE, designated SEQ ID:25966, to the nucleotide sequence of VGAM2016 RNA, herein designated VGAM RNA, also designated SEQ ID:4727.

Another function of VGAM2016 is therefore inhibition of FLJ23511 (Accession NM_032239). Accordingly, utilities of VGAM2016 include diagnosis, prevention and treatment of diseases and clinical conditions associated with FLJ23511. MGC12904 (Accession NM_031219) is another VGAM2016 host target gene. MGC12904 BINDING SITE is HOST TARGET binding site found in the 5' untranslated region of mRNA encoded by MGC12904, corresponding to a HOST TARGET binding site such as BINDING SITE I, BINDING SITE II or BINDING SITE III. Table 2 illustrates the complementarity of the nucleotide sequences of MGC12904 BINDING SITE, designated SEQ ID:25267, to the nucleotide sequence of VGAM2016 RNA, herein designated VGAM RNA, also designated SEQ ID:4727.

Another function of VGAM2016 is therefore inhibition of MGC12904 (Accession NM_031219). Accordingly, utilities of VGAM2016 include diagnosis, prevention and treatment of diseases and clinical conditions associated with MGC12904. Solute Carrier Family 5 (choline transporter), Member 7 (SLC5A7, Accession NM_021815) is another VGAM2016 host target gene. SLC5A7 BINDING SITE is HOST TARGET binding site found in the 3' untranslated region of mRNA encoded by SLC5A7, corresponding to a HOST TARGET binding site such as BINDING SITE I, BINDING SITE II or BINDING SITE III. Table 2 illustrates the complementarity of the nucleotide sequences of SLC5A7 BINDING SITE, designated SEQ ID:22391, to the nucleotide sequence of VGAM2016 RNA, herein designated VGAM RNA, also designated SEQ ID:4727.

Another function of VGAM2016 is therefore inhibition of Solute Carrier Family 5 (choline transporter), Member 7 (SLC5A7, Accession NM_021815). Accordingly, utilities of VGAM2016 include diagnosis, prevention and treatment of diseases and clinical conditions associated with SLC5A7. Spir-1 (Accession XM_035640) is another VGAM2016 host target gene. Spir-1 BINDING SITE is HOST TARGET binding site found in the 3' untranslated region of mRNA encoded by Spir-1, corresponding to a HOST TARGET binding site such as BINDING SITE I, BINDING SITE II or BINDING SITE III. Table 2 illustrates the complementarity of the nucleotide sequences of Spir-1 BINDING SITE, designated SEQ ID:32307, to the nucleotide sequence of VGAM2016 RNA, herein designated VGAM RNA, also designated SEQ ID:4727.

Another function of VGAM2016 is therefore inhibition of Spir-1 (Accession XM_035640). Accordingly, utilities of VGAM2016 include diagnosis, prevention and treatment of diseases and clinical conditions associated with Spir-1. LOC163682 (Accession XM_099402) is another VGAM2016 host target gene. LOC163682 BINDING SITE is HOST TARGET binding site found in the 3' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42092, to the nucleotide sequence of VGAM2016 RNA, herein designated VGAM RNA, also designated SEQ ID:4727.

Another function of VGAM2016 is therefore inhibition of LOC163682 (Accession XM_099402). Accordingly, utilities of VGAM2016 include diagnosis, prevention and treatment of diseases and clinical conditions associated with LOC163682. LOC93589 (Accession XM_052387) is another VGAM2016 host target gene. LOC93589 BINDING SITE is HOST TARGET binding site found in the 3' untranslated region of mRNA encoded by LOC93589, corresponding to a HOST TARGET binding site such as BINDING SITE I, BINDING SITE II or BINDING SITE III. Table 2 illustrates the complementarity of the nucleotide sequences of LOC93589 BINDING SITE, designated SEQ ID:35979, to the nucleotide sequence of VGAM2016 RNA, herein designated VGAM RNA, also designated SEQ ID:4727.

Another function of VGAM2016 is therefore inhibition of LOC93589 (Accession XM_052387). Accordingly, utilities of VGAM2016 include diagnosis, prevention and treatment of diseases and clinical conditions associated with LOC93589. FIG. 1 further provides a conceptual description of a novel bioinformatically detected viral gene of the present invention, referred to here as Viral Genomic Address Messenger 2017 (VGAM2017) viral gene, which modulates expression of respective host target genes thereof, the function and utility of which host target genes is known in the art.

VGAM2017 is a novel bioinformatically detected regulatory, non protein coding, viral micro RNA (miRNA) gene. The method by which VGAM2017 was detected is described hereinabove with reference to FIGS. 1-8.

VGAM2017 gene, herein designated VGAM GENE, is a viral gene contained in the genome of Zaire Ebola Virus (ZEBOV). VGAM2017 host target gene, herein designated VGAM HOST TARGET GENE, is a human gene contained in the human genome.

VGAM2017 gene encodes a VGAM2017 precursor RNA, herein designated VGAM PRECURSOR RNA. Similar to other miRNA genes, and unlike most ordinary genes, VGAM2017 precursor RNA does not encode a protein. A nucleotide sequence identical or highly similar to the nucleotide sequence of VGAM2017 precursor RNA is designated SEQ ID:2003, and is provided hereinbelow with reference to the sequence listing part. Nucleotide sequence SEQ ID:2003 is located at position 15595 relative to the genome of Zaire Ebola Virus (ZEBOV).

VGAM2017 precursor RNA folds onto itself, forming VGAM2017 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2017 folded precursor RNA into VGAM2017 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM2017 RNA is designated SEQ ID:4728, and is provided hereinbelow with reference to the sequence listing part.

VGAM2017 host target gene, herein designated VGAM HOST TARGET GENE, encodes a corresponding messenger RNA, VGAM2017 host target RNA, herein designated VGAM HOST TARGET RNA. VGAM2017 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2017 RNA, herein designated VGAM RNA, binds complementarily to one or more host target binding sites located in untranslated regions of VGAM2017 host target RNA, herein designated VGAM HOST TARGET RNA. This complementary binding is due to the fact that the nucleotide sequence of VGAM2017 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2017 RNA, herein designated VGAM RNA, may have a different number of host target binding sites in untranslated regions of a VGAM2017 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2017 RNA, herein designated VGAM RNA, to host target binding sites on VGAM2017 host target RNA, herein designated VGAM HOST TARGET RNA, such as BINDING SITE I, BINDING SITE II and BINDING SITE III, inhibits translation of VGAM2017 host target RNA into VGAM2017 host target protein, herein designated VGAM HOST TARGET PROTEIN. VGAM host target protein is therefore outlined by a broken line.

It is appreciated that VGAM2017 host target gene, herein designated VGAM HOST TARGET GENE, in fact represents a plurality of VGAM2017 host target genes. The mRNA of each one of this plurality of VGAM2017 host target genes comprises one or more host target binding sites, each having a nucleotide sequence which is at least partly complementary to VGAM2017 RNA, herein designated VGAM RNA, and which when bound by VGAM2017 RNA causes inhibition of translation of respective one or more VGAM2017 host target proteins.

It is further appreciated by one skilled in the art that the mode of translational inhibition illustrated by FIG. 1 with specific reference to translational inhibition exerted by VGAM2017 gene, herein designated VGAM GENE, on one or more VGAM2017 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2017 is inhibition of expression of host target genes, as part of a novel viral mechanism of attacking a host. Accordingly, utilities of VGAM2017 include diagnosis, prevention and treatment of viral infection by Zaire Ebola Virus (ZEBOV). Specific functions, and accordingly utilities, of VGAM2017 correlate with, and may be deduced from, the identity of the host target genes which VGAM2017 binds and inhibits, and the function of these host target genes, as elaborated hereinbelow.

Nucleotide sequences of the VGAM2017 precursor RNA, herein designated VGAM PRECURSOR RNA, and of the 'diced' VGAM2017 RNA, herein designated VGAM RNA, and a schematic representation of the secondary folding of VGAM2017 folded precursor RNA, herein designated VGAM FOLDED PRECURSOR RNA, of VGAM2017 are further described hereinbelow with reference to Table 1.

Nucleotide sequences of host target binding sites, such as BINDING SITE-I, BINDING SITE-II and BINDING SITE-III of FIG. 1, found on VGAM2017 host target RNA, and schematic representation of the complementarity of each of these host target binding sites to VGAM2017 RNA, herein designated VGAM RNA, are described hereinbelow with reference to Table 2.

As mentioned hereinabove with reference to FIG. 1, a function of VGAM2017 gene, herein designated VGAM is inhibition of expression of VGAM2017 target genes. It is appreciated that specific functions, and accordingly utilities, of VGAM2017 correlate with, and may be deduced from, the identity of the target genes which VGAM2017 binds and inhibits, and the function of these target genes, as elaborated hereinbelow.

Fibroblast Growth Factor 2 (basic) (FGF2, Accession NM_002006) is a VGAM2017 host target gene. FGF2 BINDING SITE is HOST TARGET binding site found in the 3' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7734, to the nucleotide sequence of VGAM2017 RNA, herein designated VGAM RNA, also designated SEQ ID:4728.

A function of VGAM2017 is therefore inhibition of Fibroblast Growth Factor 2 (basic) (FGF2, Accession NM_002006), a gene which probably involved in nervous system development and function. Accordingly, utilities of VGAM2017 include diagnosis, prevention and treatment of diseases and clinical conditions associated with FGF2. The function of FGF2 and its association with various diseases and clinical conditions, has been established by previous studies, as described hereinabove with reference to VGAM51. Protein Phosphatase 1, Regulatory (inhibitor) Subunit 3A (glycogen and sarcoplasmic reticulum binding subunit, skeletal muscle) (PPP1R3A, Accession NM_002711) is another VGAM2017 host target gene. PPP1R3A BINDING SITE is HOST TARGET binding site found in the 3' untranslated region of mRNA encoded by PPP1R3A, corresponding to a HOST TARGET binding site such as BINDING SITE I, BINDING SITE II or BINDING SITE III. Table 2 illustrates the complementarity of the nucleotide sequences of PPP1R3A BINDING SITE, designated SEQ ID:8565, to the nucleotide sequence of VGAM2017

RNA, herein designated VGAM RNA, also designated SEQ ID:4728.

Another function of VGAM2017 is therefore inhibition of Protein Phosphatase 1, Regulatory (inhibitor) Subunit 3A (glycogen and sarcoplasmic reticulum binding subunit, skeletal muscle) (PPP1R3A, Accession NM_002711), a gene which regulates phosphatase activity towards glycogen synthase, active in skeletal muscle. Accordingly, utilities of VGAM2017 include diagnosis, prevention and treatment of diseases and clinical conditions associated with PPP1R3A. The function of PPP1R3A and its association with various diseases and clinical conditions, has been established by previous studies, as described hereinabove with reference to VGAM1872. Ubiquitin-like 3 (UBL3, Accession NM_007106) is another VGAM2017 host target gene. UBL3 BINDING SITE is HOST TARGET binding site found in the 3' untranslated region of mRNA encoded by UBL3, corresponding to a HOST TARGET binding site such as BINDING SITE I, BINDING SITE II or BINDING SITE III. Table 2 illustrates the complementarity of the nucleotide sequences of UBL3 BINDING SITE, designated SEQ ID:13964, to the nucleotide sequence of VGAM2017 RNA, herein designated VGAM RNA, also designated SEQ ID:4728.

Another function of VGAM2017 is therefore inhibition of Ubiquitin-like 3 (UBL3, Accession NM_007106), a gene which appears to have a diverse range of cellular functions. Accordingly, utilities of VGAM2017 include diagnosis, prevention and treatment of diseases and clinical conditions associated with UBL3. The function of UBL3 and its association with various diseases and clinical conditions, has been established by previous studies, as described hereinabove with reference to VGAM459. Nup43 (Accession NM_024647) is another VGAM2017 host target gene. Nup43 BINDING SITE is HOST TARGET binding site found in the 3' untranslated region of mRNA encoded by Nup43, corresponding to a HOST TARGET binding site such as BINDING SITE I, BINDING SITE II or BINDING SITE III. Table 2 illustrates the complementarity of the nucleotide sequences of Nup43 BINDING SITE, designated SEQ ID:23933, to the nucleotide sequence of VGAM2017 RNA, herein designated VGAM RNA, also designated SEQ ID:4728.

Another function of VGAM2017 is therefore inhibition of Nup43 (Accession NM_024647). Accordingly, utilities of VGAM2017 include diagnosis, prevention and treatment of diseases and clinical conditions associated with Nup43. Protein Phosphatase 1, Regulatory (inhibitor) Subunit 13B (PPP1R13B, Accession NM_015316) is another VGAM2017 host target gene. PPP1R13B BINDING SITE is HOST TARGET binding site found in the 3' untranslated region of mRNA encoded by PPP1R13B, corresponding to a HOST TARGET binding site such as BINDING SITE I, BINDING SITE II or BINDING SITE III. Table 2 illustrates the complementarity of the nucleotide sequences of PPP1R13B BINDING SITE, designated SEQ ID:17632, to the nucleotide sequence of VGAM2017 RNA, herein designated VGAM RNA, also designated SEQ ID:4728.

Another function of VGAM2017 is therefore inhibition of Protein Phosphatase 1, Regulatory (inhibitor) Subunit 13B (PPP1R13B, Accession NM_015316). Accordingly, utilities of VGAM2017 include diagnosis, prevention and treatment of diseases and clinical conditions associated with PPP1R13B. LOC148932 (Accession XM_086372) is another VGAM2017 host target gene. LOC148932 BINDING SITE is HOST TARGET binding site found in the 3' untranslated region of mRNA encoded by LOC148932, corresponding to a HOST TARGET binding site such as BINDING SITE I, BINDING SITE II or BINDING SITE III. Table 2 illustrates the complementarity of the nucleotide sequences of LOC148932 BINDING SITE, designated SEQ ID:38623, to the nucleotide sequence of VGAM2017 RNA, herein designated VGAM RNA, also designated SEQ ID:4728.

Another function of VGAM2017 is therefore inhibition of LOC148932 (Accession XM_086372). Accordingly, utilities of VGAM2017 include diagnosis, prevention and treatment of diseases and clinical conditions associated with LOC148932. LOC158376 (Accession XM_098934) is another VGAM2017 host target gene. LOC158376 BINDING SITE is HOST TARGET binding site found in the 5' untranslated region of mRNA encoded by LOC158376, corresponding to a HOST TARGET binding site such as BINDING SITE I, BINDING SITE II or BINDING SITE III. Table 2 illustrates the complementarity of the nucleotide sequences of LOC158376 BINDING SITE, designated SEQ ID:41972, to the nucleotide sequence of VGAM2017 RNA, herein designated VGAM RNA, also designated SEQ ID:4728.

Another function of VGAM2017 is therefore inhibition of LOC158376 (Accession XM_098934). Accordingly, utilities of VGAM2017 include diagnosis, prevention and treatment of diseases and clinical conditions associated with LOC158376. LOC221042 (Accession XM_167669) is another VGAM2017 host target gene. LOC221042 BINDING SITE is HOST TARGET binding site found in the 5' untranslated region of mRNA encoded by LOC221042, corresponding to a HOST TARGET binding site such as BINDING SITE I, BINDING SITE II or BINDING SITE III. Table 2 illustrates the complementarity of the nucleotide sequences of LOC221042 BINDING SITE, designated SEQ ID:44751, to the nucleotide sequence of VGAM2017 RNA, herein designated VGAM RNA, also designated SEQ ID:4728.

Another function of VGAM2017 is therefore inhibition of LOC221042 (Accession XM_167669). Accordingly, utilities of VGAM2017 include diagnosis, prevention and treatment of diseases and clinical conditions associated with LOC221042. FIG. 1 further provides a conceptual description of a novel bioinformatically detected viral gene of the present invention, referred to here as Viral Genomic Address Messenger 2018 (VGAM2018) viral gene, which modulates expression of respective host target genes thereof, the function and utility of which host target genes is known in the art.

VGAM2018 is a novel bioinformatically detected regulatory, non protein coding, viral micro RNA (miRNA) gene. The method by which VGAM2018 was detected is described hereinabove with reference to FIGS. 1-8.

VGAM2018 gene, herein designated VGAM GENE, is a viral gene contained in the genome of Zaire Ebola Virus (ZEBOV). VGAM2018 host target gene, herein designated VGAM HOST TARGET GENE, is a human gene contained in the human genome.

VGAM2018 gene encodes a VGAM2018 precursor RNA, herein designated VGAM PRECURSOR RNA. Similar to other miRNA genes, and unlike most ordinary genes, VGAM2018 precursor RNA does not encode a protein. A nucleotide sequence identical or highly similar to the nucleotide sequence of VGAM2018 precursor RNA is designated SEQ ID:2004, and is provided hereinbelow with reference to the sequence listing part. Nucleotide sequence SEQ ID:2004 is located at position 13583 relative to the genome of Zaire Ebola Virus (ZEBOV).

VGAM2018 precursor RNA folds onto itself, forming VGAM2018 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2018 folded precursor RNA into VGAM2018 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM2018 RNA is designated SEQ ID:4729, and is provided hereinbelow with reference to the sequence listing part.

VGAM2018 host target gene, herein designated VGAM HOST TARGET GENE, encodes a corresponding messenger RNA, VGAM2018 host target RNA, herein designated VGAM HOST TARGET RNA. VGAM2018 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2018 RNA, herein designated VGAM RNA, binds complementarily to one or more host target binding sites located in untranslated regions of VGAM2018 host target RNA, herein designated VGAM HOST TARGET RNA. This complementary binding is due to the fact that the nucleotide sequence of VGAM2018 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2018 RNA, herein designated VGAM RNA, may have a different number of host target binding sites in untranslated regions of a VGAM2018 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2018 RNA, herein designated VGAM RNA, to host target binding sites on VGAM2018 host target RNA, herein designated VGAM HOST TARGET RNA, such as BINDING SITE I, BINDING SITE II and BINDING SITE III, inhibits translation of VGAM2018 host target RNA into VGAM2018 host target protein, herein designated VGAM HOST TARGET PROTEIN. VGAM host target protein is therefore outlined by a broken line.

It is appreciated that VGAM2018 host target gene, herein designated VGAM HOST TARGET GENE, in fact represents a plurality of VGAM2018 host target genes. The mRNA of each one of this plurality of VGAM2018 host target genes comprises one or more host target binding sites, each having a nucleotide sequence which is at least partly complementary to VGAM2018 RNA, herein designated VGAM RNA, and which when bound by VGAM2018 RNA causes inhibition of translation of respective one or more VGAM2018 host target proteins.

It is further appreciated by one skilled in the art that the mode of translational inhibition illustrated by FIG. 1 with specific reference to translational inhibition exerted by VGAM2018 gene, herein designated VGAM GENE, on one or more VGAM2018 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2018 is inhibition of expression of host target genes, as part of a novel viral mechanism of attacking a host. Accordingly, utilities of VGAM2018 include diagnosis, prevention and treatment of viral infection by Zaire Ebola Virus (ZEBOV). Specific functions, and accordingly utilities, of VGAM2018 correlate with, and may be deduced from, the identity of the host target genes which VGAM2018 binds and inhibits, and the function of these host target genes, as elaborated hereinbelow.

Nucleotide sequences of the VGAM2018 precursor RNA, herein designated VGAM PRECURSOR RNA, and of the 'diced' VGAM2018 RNA, herein designated VGAM RNA, and a schematic representation of the secondary folding of VGAM2018 folded precursor RNA, herein designated VGAM FOLDED PRECURSOR RNA, of VGAM2018 are further described hereinbelow with reference to Table 1.

Nucleotide sequences of host target binding sites, such as BINDING SITE-I, BINDING SITE-II and BINDING SITE-III of FIG. 1, found on VGAM2018 host target RNA, and schematic representation of the complementarity of each of these host target binding sites to VGAM2018 RNA, herein designated VGAM RNA, are described hereinbelow with reference to Table 2.

As mentioned hereinabove with reference to FIG. 1, a function of VGAM2018 gene, herein designated VGAM is inhibition of expression of VGAM2018 target genes. It is appreciated that specific functions, and accordingly utilities, of VGAM2018 correlate with, and may be deduced from, the identity of the target genes which VGAM2018 binds and inhibits, and the function of these target genes, as elaborated hereinbelow.

Early Growth Response 3 (EGR3, Accession XM_005040) is a VGAM2018 host target gene. EGR3 BINDING SITE is HOST TARGET binding site found in the 3' untranslated region of mRNA encoded by EGR3, corresponding to a HOST TARGET binding site such as BINDING SITE I, BINDING SITE II or BINDING SITE III. Table 2 illustrates the complementarity of the nucleotide sequences of EGR3 BINDING SITE, designated SEQ ID:29957, to the nucleotide sequence of VGAM2018 RNA, herein designated VGAM RNA, also designated SEQ ID:4729.

A function of VGAM2018 is therefore inhibition of Early Growth Response 3 (EGR3, Accession XM_005040), a gene which is a putative transcription factor. Accordingly, utilities of VGAM2018 include diagnosis, prevention and treatment of diseases and clinical conditions associated with EGR3. The function of EGR3 and its association with various diseases and clinical conditions, has been established by previous studies, as described hereinabove with reference to VGAM189. Inositol Hexaphosphate Kinase 3 (IHPK3, Accession NM_054111) is another VGAM2018 host target gene. IHPK3 BINDING SITE is HOST TARGET binding site found in the 5' untranslated region of mRNA encoded by IHPK3, corresponding to a HOST TARGET binding site such as BINDING SITE I, BINDING SITE II or BINDING SITE III. Table 2 illustrates the complementarity of the nucleotide sequences of IHPK3 BINDING SITE, designated SEQ ID:27657, to the nucleotide sequence of VGAM2018 RNA, herein designated VGAM RNA, also designated SEQ ID:4729.

Another function of VGAM2018 is therefore inhibition of Inositol Hexaphosphate Kinase 3 (IHPK3, Accession NM_054111). Accordingly, utilities of VGAM2018 include diagnosis, prevention and treatment of diseases and clinical conditions associated with IHPK3. Meis1, Myeloid Ecotropic Viral Integration Site 1 Homolog 2 (mouse) (MEIS2, Accession NM_020149) is another VGAM2018 host target gene. MEIS2 BINDING SITE is HOST TARGET binding site found in the 3' untranslated region of mRNA encoded by MEIS2, corresponding to a HOST TARGET binding site such as BINDING SITE I, BINDING SITE II or BINDING SITE III. Table 2 illustrates the complementarity of the nucleotide sequences of MEIS2 BINDING SITE, designated SEQ ID:21347, to the nucleotide sequence of VGAM2018 RNA, herein designated VGAM RNA, also designated SEQ ID:4729.

Another function of VGAM2018 is therefore inhibition of Meis1, Myeloid Ecotropic Viral Integration Site 1 Homolog 2 (mouse) (MEIS2, Accession NM_020149), a gene which may regulate gene expression and control cell differentiation. Accordingly, utilities of VGAM2018 include diagnosis, prevention and treatment of diseases and clinical conditions associated with MEIS2. The function of MEIS2 and its association with various diseases and clinical conditions, has been established by previous studies, as described hereinabove with reference to VGAM1244. Proprotein Convertase Subtilisin/kexin Type 2 (PCSK2, Accession NM_002594) is another VGAM2018 host target gene. PCSK2 BINDING SITE is HOST TARGET binding site found in the 3' untranslated region of mRNA encoded by PCSK2, corresponding to a HOST TARGET binding site such as BINDING SITE I, BINDING SITE II or BINDING SITE III. Table 2 illustrates the complementarity of the nucleotide sequences of PCSK2 BINDING SITE, designated SEQ ID:8456, to the nucleotide sequence of VGAM2018 RNA, herein designated VGAM RNA, also designated SEQ ID:4729.

Another function of VGAM2018 is therefore inhibition of Proprotein Convertase Subtilisin/kexin Type 2 (PCSK2, Accession NM_002594), a gene which is involved in the processing of hormone and other protein precursors at sites comprised of pairs of basic amino acid residues. Accordingly, utilities of VGAM2018 include diagnosis, prevention and treatment of diseases and clinical conditions associated with PCSK2. The function of PCSK2 and its association with various diseases and clinical conditions, has been established by previous studies, as described hereinabove with reference to VGAM1120. TAP Binding Protein (tapasin) (TAPBP, Accession NM_003190) is another VGAM2018 host target gene. TAPBP BINDING SITE is HOST TARGET binding site found in the 3' untranslated region of mRNA encoded by TAPBP, corresponding to a HOST TARGET binding site such as BINDING SITE I, BINDING SITE II or BINDING SITE III. Table 2 illustrates the complementarity of the nucleotide sequences of TAPBP BINDING SITE, designated SEQ ID:9178, to the nucleotide sequence of VGAM2018 RNA, herein designated VGAM RNA, also designated SEQ ID:4729.

Another function of VGAM2018 is therefore inhibition of TAP Binding Protein (tapasin) (TAPBP, Accession NM_003190), a gene which is involved in MHC class I-restricted antigen processing. Accordingly, utilities of VGAM2018 include diagnosis, prevention and treatment of diseases and clinical conditions associated with TAPBP. The function of TAPBP and its association with various diseases and clinical conditions, has been established by previous studies, as described hereinabove with reference to VGAM122. KIAA0934 (Accession XM_034536) is another VGAM2018 host target gene. KIAA0934 BINDING SITE is HOST TARGET binding site found in the 3' untranslated region of mRNA encoded by KIAA0934, corresponding to a HOST TARGET binding site such as BINDING SITE I, BINDING SITE II or BINDING SITE III. Table 2 illustrates the complementarity of the nucleotide sequences of KIAA0934 BINDING SITE, designated SEQ ID:32119, to the nucleotide sequence of VGAM2018 RNA, herein designated VGAM RNA, also designated SEQ ID:4729.

Another function of VGAM2018 is therefore inhibition of KIAA0934 (Accession XM_034536). Accordingly, utilities of VGAM2018 include diagnosis, prevention and treatment of diseases and clinical conditions associated with KIAA0934. KIAA1184 (Accession NM_022572) is another VGAM2018 host target gene. KIAA1184 BINDING SITE is HOST TARGET binding site found in the 3' untranslated region of mRNA encoded by KIAA1184, corresponding to a HOST TARGET binding site such as BINDING SITE I, BINDING SITE II or BINDING SITE III. Table 2 illustrates the complementarity of the nucleotide sequences of KIAA1184 BINDING SITE, designated SEQ ID:22895, to the nucleotide sequence of VGAM2018 RNA, herein designated VGAM RNA, also designated SEQ ID:4729.

Another function of VGAM2018 is therefore inhibition of KIAA1184 (Accession NM_022572). Accordingly, utilities of VGAM2018 include diagnosis, prevention and treatment of diseases and clinical conditions associated with KIAA1184. Protein Phosphatase 1, Regulatory (inhibitor) Subunit 16B (PPP1R16B, Accession XM_028840) is another VGAM2018 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30777, to the nucleotide sequence of VGAM2018 RNA, herein designated VGAM RNA, also designated SEQ ID:4729.

Another function of VGAM2018 is therefore inhibition of Protein Phosphatase 1, Regulatory (inhibitor) Subunit 16B (PPP1R16B, Accession XM_028840). Accordingly, utilities of VGAM2018 include diagnosis, prevention and treatment of diseases and clinical conditions associated with PPP1R16B. Ribosomal Protein S6 Kinase, 52 kDa, Polypeptide 1 (RPS6KC1, Accession NM_012424) is another VGAM2018 host target gene. RPS6KC1 BINDING SITE is HOST TARGET binding site found in the 3' untranslated region of mRNA encoded by RPS6KC1, corresponding to a HOST TARGET binding site such as BINDING SITE I, BINDING SITE II or BINDING SITE III. Table 2 illustrates the complementarity of the nucleotide sequences of RPS6KC1 BINDING SITE, designated SEQ ID:14799, to the nucleotide sequence of VGAM2018 RNA, herein designated VGAM RNA, also designated SEQ ID:4729.

Another function of VGAM2018 is therefore inhibition of Ribosomal Protein S6 Kinase, 52 kDa, Polypeptide 1 (RPS6KC1, Accession NM_012424). Accordingly, utilities of VGAM2018 include diagnosis, prevention and treatment of diseases and clinical conditions associated with RPS6KC1. LOC157421 (Accession XM_098756) is another VGAM2018 host target gene. LOC157421 BINDING SITE is HOST TARGET binding site found in the 5' untranslated region of mRNA encoded by LOC157421, corresponding to a HOST TARGET binding site such as BINDING SITE I, BINDING SITE II or BINDING SITE III. Table 2 illustrates the complementarity of the nucleotide sequences of LOC157421 BINDING SITE, designated SEQ ID:41794, to the nucleotide sequence of VGAM2018 RNA, herein designated VGAM RNA, also designated SEQ ID:4729.

Another function of VGAM2018 is therefore inhibition of LOC157421 (Accession XM_098756). Accordingly, utilities of VGAM2018 include diagnosis, prevention and treatment of diseases and clinical conditions associated with LOC157421. LOC158267 (Accession XM_088528) is another VGAM2018 host target gene. LOC158267 BINDING SITE is HOST TARGET binding site found in the 3' untranslated region of mRNA encoded by LOC158267, corresponding to a HOST TARGET binding site such as BINDING SITE I, BINDING SITE II or BINDING SITE III. Table 2 illustrates the complementarity of the nucleotide sequences of LOC158267 BINDING SITE, designated SEQ ID:39795, to the nucleotide sequence of VGAM2018 RNA, herein designated VGAM RNA, also designated SEQ ID:4729.

Another function of VGAM2018 is therefore inhibition of LOC158267 (Accession XM_088528). Accordingly, utilities of VGAM2018 include diagnosis, prevention and treatment of diseases and clinical conditions associated with LOC158267. FIG. 1 further provides a conceptual description of a novel bioinformatically detected viral gene of the present invention, referred to here as Viral Genomic Address Messenger 2019 (VGAM2019) viral gene, which modulates expression of respective host target genes thereof, the function and utility of which host target genes is known in the art.

VGAM2019 is a novel bioinformatically detected regulatory, non protein coding, viral micro RNA (miRNA) gene. The method by which VGAM2019 was detected is described hereinabove with reference to FIGS. 1-8.

VGAM2019 gene, herein designated VGAM GENE, is a viral gene contained in the genome of Kyuri Green Mottle Mosaic Virus. VGAM2019 host target gene, herein designated VGAM HOST TARGET GENE, is a human gene contained in the human genome.

VGAM2019 gene encodes a VGAM2019 precursor RNA, herein designated VGAM PRECURSOR RNA. Similar to other miRNA genes, and unlike most ordinary genes, VGAM2019 precursor RNA does not encode a protein. A nucleotide sequence identical or highly similar to the nucleotide sequence of VGAM2019 precursor RNA is designated SEQ ID:2005, and is provided hereinbelow with reference to the sequence listing part. Nucleotide sequence SEQ ID:2005 is located at position 3691 relative to the genome of Kyuri Green Mottle Mosaic Virus.

VGAM2019 precursor RNA folds onto itself, forming VGAM2019 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2019 folded precursor RNA into VGAM2019 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM2019 RNA is designated SEQ ID:4730, and is provided hereinbelow with reference to the sequence listing part.

VGAM2019 host target gene, herein designated VGAM HOST TARGET GENE, encodes a corresponding messenger RNA, VGAM2019 host target RNA, herein designated VGAM HOST TARGET RNA. VGAM2019 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2019 RNA, herein designated VGAM RNA, binds complementarily to one or more host target binding sites located in untranslated regions of VGAM2019 host target RNA, herein designated VGAM HOST TARGET RNA. This complementary binding is due to the fact that the nucleotide sequence of VGAM2019 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2019 RNA, herein designated VGAM RNA, may have a different number of host target binding sites in untranslated regions of a VGAM2019 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2019 RNA, herein designated VGAM RNA, to host target binding sites on VGAM2019 host target RNA, herein designated VGAM HOST TARGET RNA, such as BINDING SITE I, BINDING SITE II and BINDING SITE III, inhibits translation of VGAM2019 host target RNA into VGAM2019 host target protein, herein designated VGAM HOST TARGET PROTEIN. VGAM host target protein is therefore outlined by a broken line.

It is appreciated that VGAM2019 host target gene, herein designated VGAM HOST TARGET GENE, in fact represents a plurality of VGAM2019 host target genes. The mRNA of each one of this plurality of VGAM2019 host target genes comprises one or more host target binding sites, each having a nucleotide sequence which is at least partly complementary to VGAM2019 RNA, herein designated VGAM RNA, and which when bound by VGAM2019 RNA causes inhibition of translation of respective one or more VGAM2019 host target proteins.

It is further appreciated by one skilled in the art that the mode of translational inhibition illustrated by FIG. 1 with specific reference to translational inhibition exerted by VGAM2019 gene, herein designated VGAM GENE, on one or more VGAM2019 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2019 is inhibition of expression of host target genes, as part of a novel viral mechanism of attacking a host. Accordingly, utilities of VGAM2019 include diagnosis, prevention and treatment of viral infection by Kyuri Green Mottle Mosaic Virus. Specific functions, and accordingly utilities, of VGAM2019 correlate with, and may be deduced from, the identity of the host target genes which VGAM2019 binds and inhibits, and the function of these host target genes, as elaborated hereinbelow.

Nucleotide sequences of the VGAM2019 precursor RNA, herein designated VGAM PRECURSOR RNA, and of the 'diced' VGAM2019 RNA, herein designated VGAM RNA, and a schematic representation of the secondary folding of VGAM2019 folded precursor RNA, herein designated VGAM FOLDED PRECURSOR RNA, of VGAM2019 are further described hereinbelow with reference to Table 1.

Nucleotide sequences of host target binding sites, such as BINDING SITE-I, BINDING SITE-II and BINDING SITE-III of FIG. 1, found on VGAM2019 host target RNA, and schematic representation of the complementarity of each of these host target binding sites to VGAM2019 RNA, herein designated VGAM RNA, are described hereinbelow with reference to Table 2.

As mentioned hereinabove with reference to FIG. 1, a function of VGAM2019 gene, herein designated VGAM is inhibition of expression of VGAM2019 target genes. It is appreciated that specific functions, and accordingly utilities, of VGAM2019 correlate with, and may be deduced from, the identity of the target genes which VGAM2019 binds and inhibits, and the function of these target genes, as elaborated hereinbelow.

Selenoprotein X, 1 (SEPX1, Accession NM_016332) is a VGAM2019 host target gene. SEPX1 BINDING SITE is HOST TARGET binding site found in the 3' untranslated region of mRNA encoded by SEPX1, corresponding to a HOST TARGET binding site such as BINDING SITE I, BINDING SITE II or BINDING SITE III. Table 2 illustrates the complementarity of the nucleotide sequences of SEPX1 BINDING SITE, designated SEQ ID:18457, to the nucleotide sequence of VGAM2019 RNA, herein designated VGAM RNA, also designated SEQ ID:4730.

A function of VGAM2019 is therefore inhibition of Selenoprotein X, 1 (SEPX1, Accession NM_016332). Accordingly, utilities of VGAM2019 include diagnosis, prevention and treatment of diseases and clinical conditions associated with SEPX1. Solute Carrier Family 1 (glial high affinity glutamate transporter), Member 3 (SLC1A3, Accession NM_004172) is another VGAM2019 host target gene. SLC1A3 BINDING SITE is HOST TARGET binding site found in the 3' untranslated region of mRNA encoded by SLC1A3, corresponding to a HOST TARGET binding site such as BINDING SITE I, BINDING SITE II or BINDING SITE III. Table 2 illustrates the complementarity of the nucleotide sequences of SLC1A3 BINDING SITE, designated SEQ ID:10383, to the nucleotide sequence of VGAM2019 RNA, herein designated VGAM RNA, also designated SEQ ID:4730.

Another function of VGAM2019 is therefore inhibition of Solute Carrier Family 1 (glial high affinity glutamate transporter), Member 3 (SLC1A3, Accession NM_004172), a gene which is a transporter molecule that regulates neurotransmitter concentrations at excitatory synapses of the mammalian cns. Accordingly, utilities of VGAM2019 include diagnosis, prevention and treatment of diseases and clinical conditions associated with SLC1A3. The function of SLC1A3 and its association with various diseases and clinical conditions, has been established by previous studies, as described hereinabove with reference to VGAM294. TAR (HIV) RNA Binding Protein 2 (TARBP2, Accession NM_134324) is another VGAM2019 host target gene. TARBP2 BINDING SITE is HOST TARGET binding site found in the 3' untranslated region of mRNA encoded by TARBP2, corresponding to a HOST TARGET binding site such as BINDING SITE I, BINDING SITE II or BINDING SITE III. Table 2 illustrates the complementarity of the nucleotide sequences of TARBP2 BINDING SITE, designated SEQ ID:28628, to the nucleotide sequence of VGAM2019 RNA, herein designated VGAM RNA, also designated SEQ ID:4730.

Another function of VGAM2019 is therefore inhibition of TAR (HIV) RNA Binding Protein 2 (TARBP2, Accession NM_134324), a gene which is involved in the regulation of HIV replication. Accordingly, utilities of VGAM2019 include diagnosis, prevention and treatment of diseases and clinical conditions associated with TARBP2. The function of TARBP2 and its association with various diseases and clinical conditions, has been established by previous studies, as described hereinabove with reference to VGAM95. CEP3 (Accession NM_006449) is another VGAM2019 host target gene. CEP3 BINDING SITE is HOST TARGET binding site found in the 3' untranslated region of mRNA encoded by CEP3, corresponding to a HOST TARGET binding site such as BINDING SITE I, BINDING SITE II or BINDING SITE III. Table 2 illustrates the complementarity of the nucleotide sequences of CEP3 BINDING SITE, designated SEQ ID:13155, to the nucleotide sequence of VGAM2019 RNA, herein designated VGAM RNA, also designated SEQ ID:4730.

Another function of VGAM2019 is therefore inhibition of CEP3 (Accession NM_006449). Accordingly, utilities of VGAM2019 include diagnosis, prevention and treatment of diseases and clinical conditions associated with CEP3. FLJ20300 (Accession NM_017753) is another VGAM2019 host target gene. FLJ20300 BINDING SITE is HOST TARGET binding site found in the 3' untranslated region of mRNA encoded by FLJ20300, corresponding to a HOST TARGET binding site such as BINDING SITE I, BINDING SITE II or BINDING SITE III. Table 2 illustrates the complementarity of the nucleotide sequences of FLJ20300 BINDING SITE, designated SEQ ID:19365, to the nucleotide sequence of VGAM2019 RNA, herein designated VGAM RNA, also designated SEQ ID:4730.

Another function of VGAM2019 is therefore inhibition of FLJ20300 (Accession NM_017753). Accordingly, utilities of VGAM2019 include diagnosis, prevention and treatment of diseases and clinical conditions associated with FLJ20300. KIAA0433 (Accession NM_015216) is another VGAM2019 host target gene. KIAA0433 BINDING SITE is HOST TARGET binding site found in the 5' untranslated region of mRNA encoded by KIAA0433, corresponding to a HOST TARGET binding site such as BINDING SITE I, BINDING SITE II or BINDING SITE III. Table 2 illustrates the complementarity of the nucleotide sequences of KIAA0433 BINDING SITE, designated SEQ ID:17546, to the nucleotide sequence of VGAM2019 RNA, herein designated VGAM RNA, also designated SEQ ID:4730.

Another function of VGAM2019 is therefore inhibition of KIAA0433 (Accession NM_015216). Accordingly, utilities of VGAM2019 include diagnosis, prevention and treatment of diseases and clinical conditions associated with KIAA0433. Syntrophin, Gamma 1 (SNTG1, Accession NM_018967) is another VGAM2019 host target gene. SNTG1 BINDING SITE is HOST TARGET binding site found in the 5' untranslated region of mRNA encoded by SNTG1, corresponding to a HOST TARGET binding site such as BINDING SITE I, BINDING SITE II or BINDING SITE III. Table 2 illustrates the complementarity of the nucleotide sequences of SNTG1 BINDING SITE, designated SEQ ID:21038, to the nucleotide sequence of VGAM2019 RNA, herein designated VGAM RNA, also designated SEQ ID:4730.

Another function of VGAM2019 is therefore inhibition of Syntrophin, Gamma 1 (SNTG1, Accession NM_018967). Accordingly, utilities of VGAM2019 include diagnosis, prevention and treatment of diseases and clinical conditions associated with SNTG1. LOC150225 (Accession XM_097870) is another VGAM2019 host target gene. LOC150225 BINDING SITE is HOST TARGET binding site found in the 3' untranslated region of mRNA encoded by LOC150225, corresponding to a HOST TARGET binding site such as BINDING SITE I, BINDING SITE II or BINDING SITE III. Table 2 illustrates the complementarity of the nucleotide sequences of LOC150225 BINDING SITE, designated SEQ ID:41187, to the nucleotide sequence of VGAM2019 RNA, herein designated VGAM RNA, also designated SEQ ID:4730.

Another function of VGAM2019 is therefore inhibition of LOC150225 (Accession XM_097870). Accordingly, utilities of VGAM2019 include diagnosis, prevention and treatment of diseases and clinical conditions associated with LOC150225. LOC91526 (Accession XM_038985) is another VGAM2019 host target gene. LOC91526 BINDING SITE is HOST TARGET binding site found in the 5' untranslated region of mRNA encoded by LOC91526, corresponding to a HOST TARGET binding site such as BINDING SITE I, BINDING SITE II or BINDING SITE III. Table 2 illustrates the complementarity of the nucleotide sequences of LOC91526 BINDING SITE, designated SEQ ID:32971, to the nucleotide sequence of VGAM2019 RNA, herein designated VGAM RNA, also designated SEQ ID:4730.

Another function of VGAM2019 is therefore inhibition of LOC91526 (Accession XM_038985). Accordingly, utilities of VGAM2019 include diagnosis, prevention and treatment of diseases and clinical conditions associated with LOC91526. FIG. 1 further provides a conceptual description of a novel bioinformatically detected viral gene of the present invention, referred to here as Viral Genomic Address Messenger 2020 (VGAM2020) viral gene, which modulates expression of respective host target genes thereof, the function and utility of which host target genes is known in the art.

VGAM2020 is a novel bioinformatically detected regulatory, non protein coding, viral micro RNA (miRNA) gene. The method by which VGAM2020 was detected is described hereinabove with reference to FIGS. 1-8.

VGAM2020 gene, herein designated VGAM GENE, is a viral gene contained in the genome of Zaire Ebola Virus (ZEBOV). VGAM2020 host target gene, herein designated VGAM HOST TARGET GENE, is a human gene contained in the human genome.

VGAM2020 gene encodes a VGAM2020 precursor RNA, herein designated VGAM PRECURSOR RNA. Similar to other miRNA genes, and unlike most ordinary genes, VGAM2020 precursor RNA does not encode a protein. A nucleotide sequence identical or highly similar to the nucleotide sequence of VGAM2020 precursor RNA is designated SEQ ID:2006, and is provided hereinbelow with reference to the sequence listing part. Nucleotide sequence SEQ ID:2006 is located at position 8150 relative to the genome of Zaire Ebola Virus (ZEBOV).

VGAM2020 precursor RNA folds onto itself, forming VGAM2020 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2020 folded precursor RNA into VGAM2020 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM2020 RNA is designated SEQ ID:4731, and is provided hereinbelow with reference to the sequence listing part.

VGAM2020 host target gene, herein designated VGAM HOST TARGET GENE, encodes a corresponding messenger RNA, VGAM2020 host target RNA, herein designated VGAM HOST TARGET RNA. VGAM2020 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2020 RNA, herein designated VGAM RNA, binds complementarily to one or more host target binding sites located in untranslated regions of VGAM2020 host target RNA, herein designated VGAM HOST TARGET RNA. This complementary binding is due to the fact that the nucleotide sequence of VGAM2020 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2020 RNA, herein designated VGAM RNA, may have a different number of host target binding sites in untranslated regions of a VGAM2020 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2020 RNA, herein designated VGAM RNA, to host target binding sites on VGAM2020 host target RNA, herein designated VGAM HOST TARGET RNA, such as BINDING SITE I, BINDING SITE II and BINDING SITE III, inhibits translation of VGAM2020 host target RNA into VGAM2020 host target protein, herein designated VGAM HOST TARGET PROTEIN. VGAM host target protein is therefore outlined by a broken line.

It is appreciated that VGAM2020 host target gene, herein designated VGAM HOST TARGET GENE, in fact represents a plurality of VGAM2020 host target genes. The mRNA of each one of this plurality of VGAM2020 host target genes comprises one or more host target binding sites, each having a nucleotide sequence which is at least partly complementary to VGAM2020 RNA, herein designated VGAM RNA, and which when bound by VGAM2020 RNA causes inhibition of translation of respective one or more VGAM2020 host target proteins.

It is further appreciated by one skilled in the art that the mode of translational inhibition illustrated by FIG. 1 with specific reference to translational inhibition exerted by VGAM2020 gene, herein designated VGAM GENE, on one or more VGAM2020 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2020 is inhibition of expression of host target genes, as part of a novel viral mechanism of attacking a host. Accordingly, utilities of VGAM2020 include diagnosis, prevention and treatment of viral infection by Zaire Ebola Virus (ZEBOV). Specific functions, and accordingly utilities, of VGAM2020 correlate with, and may be deduced from, the identity of the host target genes which VGAM2020 binds and inhibits, and the function of these host target genes, as elaborated hereinbelow.

Nucleotide sequences of the VGAM2020 precursor RNA, herein designated VGAM PRECURSOR RNA, and of the 'diced' VGAM2020 RNA, herein designated VGAM RNA, and a schematic representation of the secondary folding of VGAM2020 folded precursor RNA, herein designated VGAM FOLDED PRECURSOR RNA, of VGAM2020 are further described hereinbelow with reference to Table 1.

Nucleotide sequences of host target binding sites, such as BINDING SITE-I, BINDING SITE-II and BINDING SITE-III of FIG. 1, found on VGAM2020 host target RNA, and schematic representation of the complementarity of each of these host target binding sites to VGAM2020 RNA, herein designated VGAM RNA, are described hereinbelow with reference to Table 2.

As mentioned hereinabove with reference to FIG. 1, a function of VGAM2020 gene, herein designated VGAM is inhibition of expression of VGAM2020 target genes. It is appreciated that specific functions, and accordingly utilities, of VGAM2020 correlate with, and may be deduced from, the identity of the target genes which VGAM2020 binds and inhibits, and the function of these target genes, as elaborated hereinbelow.

Protein S (alpha) (PROS1, Accession XM_113400) is a VGAM2020 host target gene. PROS1 BINDING SITE is HOST TARGET binding site found in the 3' untranslated region of mRNA encoded by PROS1, corresponding to a HOST TARGET binding site such as BINDING SITE I, BINDING SITE II or BINDING SITE III. Table 2 illustrates the complementarity of the nucleotide sequences of PROS1 BINDING SITE, designated SEQ ID:42254, to the nucleotide sequence of VGAM2020 RNA, herein designated VGAM RNA, also designated SEQ ID:4731.

A function of VGAM2020 is therefore inhibition of Protein S (alpha) (PROS1, Accession XM_113400). Accordingly, utilities of VGAM2020 include diagnosis, prevention and treatment of diseases and clinical conditions associated with PROS1. Serine/threonine Kinase 24 (STE20 homolog, yeast) (STK24, Accession NM_003576) is another VGAM2020 host target gene. STK24 BINDING SITE is HOST TARGET binding site found in the 3' untranslated region of mRNA encoded by STK24, corresponding to a HOST TARGET binding site such as BINDING SITE I, BINDING SITE II or BINDING SITE III. Table 2 illustrates the complementarity of the nucleotide sequences of STK24 BINDING SITE, designated SEQ ID:9628, to the nucleotide sequence of VGAM2020 RNA, herein designated VGAM RNA, also designated SEQ ID:4731.

Another function of VGAM2020 is therefore inhibition of Serine/threonine Kinase 24 (STE20 homolog, yeast) (STK24, Accession NM_003576), a gene which acts on both serine and threonine residues. Accordingly, utilities of VGAM2020 include diagnosis, prevention and treatment of diseases and clinical conditions associated with STK24. The function of STK24 and its association with various diseases and clinical conditions, has been established by previous studies, as described hereinabove with reference to VGAM1958. SWAP70 (Accession XM_049197) is another VGAM2020 host target gene. SWAP70 BINDING SITE is HOST TARGET binding site found in the 3' untranslated region of mRNA encoded by SWAP70, corresponding to a HOST TARGET binding site such as BINDING SITE I, BINDING SITE II or BINDING SITE III. Table 2 illustrates the complementarity of the nucleotide sequences of SWAP70 BINDING SITE, designated SEQ ID:35351, to the nucleotide sequence of VGAM2020 RNA, herein designated VGAM RNA, also designated SEQ ID:4731.

Another function of VGAM2020 is therefore inhibition of SWAP70 (Accession XM_049197), a gene which is involved not only in nuclear events but also in signaling in B-cell activation. Accordingly, utilities of VGAM2020 include diagnosis, prevention and treatment of diseases and clinical conditions associated with SWAP70. The function of SWAP70 and its association with various diseases and clinical conditions, has been established by previous studies, as described hereinabove with reference to VGAM1090. DKFZP564I122 (Accession XM_032397) is another VGAM2020 host target gene. DKFZP564I122 BINDING SITE is HOST TARGET binding site found in the 3' untranslated region of mRNA encoded by DKFZP564I122, corresponding to a HOST TARGET binding site such as BINDING SITE I, BINDING SITE II or BINDING SITE III. Table 2 illustrates the complementarity of the nucleotide sequences of DKFZP564I122 BINDING SITE, designated SEQ ID:31646, to the nucleotide sequence of VGAM2020 RNA, herein designated VGAM RNA, also designated SEQ ID:4731.

Another function of VGAM2020 is therefore inhibition of DKFZP564I122 (Accession XM_032397). Accordingly, utilities of VGAM2020 include diagnosis, prevention and treatment of diseases and clinical conditions associated with DKFZP564I122. FLJ22724 (Accession NM_024532) is another VGAM2020 host target gene. FLJ22724 BINDING SITE is HOST TARGET binding site found in the 3' untranslated region of mRNA encoded by FLJ22724, corresponding to a HOST TARGET binding site such as BINDING SITE I, BINDING SITE II or BINDING SITE III. Table 2 illustrates the complementarity of the nucleotide sequences of FLJ22724 BINDING SITE, designated SEQ ID:23737, to the nucleotide sequence of VGAM2020 RNA, herein designated VGAM RNA, also designated SEQ ID:4731.

Another function of VGAM2020 is therefore inhibition of FLJ22724 (Accession NM_024532). Accordingly, utilities of VGAM2020 include diagnosis, prevention and treatment of diseases and clinical conditions associated with FLJ22724. HERV-H LTR-associating 2 (HHLA2, Accession NM_007072) is another VGAM2020 host target gene. HHLA2 BINDING SITE is HOST TARGET binding site found in the 5' untranslated region of mRNA encoded by HHLA2, corresponding to a HOST TARGET binding site such as BINDING SITE I, BINDING SITE II or BINDING SITE III. Table 2 illustrates the complementarity of the nucleotide sequences of HHLA2 BINDING SITE, designated SEQ ID:13938, to the nucleotide sequence of VGAM2020 RNA, herein designated VGAM RNA, also designated SEQ ID:4731.

Another function of VGAM2020 is therefore inhibition of HERV-H LTR-associating 2 (HHLA2, Accession NM_007072). Accordingly, utilities of VGAM2020 include diagnosis, prevention and treatment of diseases and clinical conditions associated with HHLA2. KIAA0871 (Accession NM_014961) is another VGAM2020 host target gene. KIAA0871 BINDING SITE is HOST TARGET binding site found in the 3' untranslated region of mRNA encoded by KIAA0871, corresponding to a HOST TARGET binding site such as BINDING SITE I, BINDING SITE II or BINDING SITE III. Table 2 illustrates the complementarity of the nucleotide sequences of KIAA0871 BINDING SITE, designated SEQ ID:17335, to the nucleotide sequence of VGAM2020 RNA, herein designated VGAM RNA, also designated SEQ ID:4731.

Another function of VGAM2020 is therefore inhibition of KIAA0871 (Accession NM_014961). Accordingly, utilities of VGAM2020 include diagnosis, prevention and treatment of diseases and clinical conditions associated with KIAA0871. KIAA0931 (Accession XM_041191) is another VGAM2020 host target gene. KIAA0931 BINDING SITE is HOST TARGET binding site found in the 3' untranslated region of mRNA encoded by KIAA0931, corresponding to a HOST TARGET binding site such as BINDING SITE I, BINDING SITE II or BINDING SITE III. Table 2 illustrates the complementarity of the nucleotide sequences of KIAA0931 BINDING SITE, designated SEQ ID:33482, to the nucleotide sequence of VGAM2020 RNA, herein designated VGAM RNA, also designated SEQ ID:4731.

Another function of VGAM2020 is therefore inhibition of KIAA0931 (Accession XM_041191). Accordingly, utilities of VGAM2020 include diagnosis, prevention and treatment of diseases and clinical conditions associated with KIAA0931. PTD012 (Accession NM_014039) is another VGAM2020 host target gene. PTD012 BINDING SITE is HOST TARGET binding site found in the 3' untranslated region of mRNA encoded by PTD012, corresponding to a HOST TARGET binding site such as BINDING SITE I, BINDING SITE II or BINDING SITE III. Table 2 illustrates the complementarity of the nucleotide sequences of PTD012 BINDING SITE, designated SEQ ID:15270, to the nucleotide sequence of VGAM2020 RNA, herein designated VGAM RNA, also designated SEQ ID:4731.

Another function of VGAM2020 is therefore inhibition of PTD012 (Accession NM_014039). Accordingly, utilities of VGAM2020 include diagnosis, prevention and treatment of diseases and clinical conditions associated with PTD012. TAF9-like RNA Polymerase II, TATA Box Binding Protein (TBP)-associated Factor, 31 kDa (TAF9L, Accession NM_015975) is another VGAM2020 host target gene. TAF9L BINDING SITE is HOST TARGET binding site found in the 3' untranslated region of mRNA encoded by TAF9L, corresponding to a HOST TARGET binding site such as BINDING SITE I, BINDING SITE II or BINDING SITE III. Table 2 illustrates the complementarity of the nucleotide sequences of TAF9L BINDING SITE, designated SEQ ID:18074, to the nucleotide sequence of VGAM2020 RNA, herein designated VGAM RNA, also designated SEQ ID:4731.

Another function of VGAM2020 is therefore inhibition of TAF9-like RNA Polymerase II, TATA Box Binding Protein (TBP)-associated Factor, 31 kDa (TAF9L, Accession NM_015975). Accordingly, utilities of VGAM2020 include diagnosis, prevention and treatment of diseases and clinical conditions associated with TAF9L. LOC152765 (Accession XM_087519) is another VGAM2020 host target gene. LOC152765 BINDING SITE is HOST TARGET binding site found in the 3' untranslated region of mRNA encoded by LOC152765, corresponding to a HOST TARGET binding site such as BINDING SITE I, BINDING SITE II or BINDING SITE III. Table 2 illustrates the complementarity of the nucleotide sequences of LOC152765 BINDING SITE, designated SEQ ID:39311, to the nucleotide sequence of VGAM2020 RNA, herein designated VGAM RNA, also designated SEQ ID:4731.

Another function of VGAM2020 is therefore inhibition of LOC152765 (Accession XM_087519). Accordingly, utilities of VGAM2020 include diagnosis, prevention and treatment of diseases and clinical conditions associated with LOC152765. LOC203286 (Accession XM_117526) is another VGAM2020 host target gene. LOC203286 BINDING SITE is HOST TARGET binding site found in the 5' untranslated region of mRNA encoded by LOC203286, corresponding to a HOST TARGET binding site such as BINDING SITE I, BINDING SITE II or BINDING SITE III. Table 2 illustrates the complementarity of the nucleotide sequences of LOC203286 BINDING SITE, designated SEQ ID:43493, to the nucleotide sequence of VGAM2020 RNA, herein designated VGAM RNA, also designated SEQ ID:4731.

Another function of VGAM2020 is therefore inhibition of LOC203286 (Accession XM_117526). Accordingly, utilities of VGAM2020 include diagnosis, prevention and treatment of diseases and clinical conditions associated with LOC203286. FIG. 1 further provides a conceptual description of a novel bioinformatically detected viral gene of the present invention, referred to here as Viral Genomic Address Messenger 2021 (VGAM2021) viral gene, which modulates expression of respective host target genes thereof, the function and utility of which host target genes is known in the art.

VGAM2021 is a novel bioinformatically detected regulatory, non protein coding, viral micro RNA (miRNA) gene. The method by which VGAM2021 was detected is described hereinabove with reference to FIGS. 1-8.

VGAM2021 gene, herein designated VGAM GENE, is a viral gene contained in the genome of Zaire Ebola Virus (ZEBOV). VGAM2021 host target gene, herein designated VGAM HOST TARGET GENE, is a human gene contained in the human genome.

VGAM2021 gene encodes a VGAM2021 precursor RNA, herein designated VGAM PRECURSOR RNA. Similar to other miRNA genes, and unlike most ordinary genes, VGAM2021 precursor RNA does not encode a protein. A nucleotide sequence identical or highly similar to the nucleotide sequence of VGAM2021 precursor RNA is designated SEQ ID:2007, and is provided hereinbelow with reference to the sequence listing part. Nucleotide sequence SEQ ID:2007 is located at position 11857 relative to the genome of Zaire Ebola Virus (ZEBOV).

VGAM2021 precursor RNA folds onto itself, forming VGAM2021 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2021 folded precursor RNA into VGAM2021 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2021 RNA is designated SEQ ID:4732, and is provided hereinbelow with reference to the sequence listing part.

VGAM2021 host target gene, herein designated VGAM HOST TARGET GENE, encodes a corresponding messenger RNA, VGAM2021 host target RNA, herein designated VGAM HOST TARGET RNA. VGAM2021 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2021 RNA, herein designated VGAM RNA, binds complementarily to one or more host target binding sites located in untranslated regions of VGAM2021 host target RNA, herein designated VGAM HOST TARGET RNA. This complementary binding is due to the fact that the nucleotide sequence of VGAM2021 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2021 RNA, herein designated VGAM RNA, may have a different number of host target binding sites in untranslated regions of a VGAM2021 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2021 RNA, herein designated VGAM RNA, to host target binding sites on VGAM2021 host target RNA, herein designated VGAM HOST TARGET RNA, such as BINDING SITE I, BINDING SITE II and BINDING SITE III, inhibits translation of VGAM2021 host target RNA into VGAM2021 host target protein, herein designated VGAM HOST TARGET PROTEIN. VGAM host target protein is therefore outlined by a broken line.

It is appreciated that VGAM2021 host target gene, herein designated VGAM HOST TARGET GENE, in fact represents a plurality of VGAM2021 host target genes. The mRNA of each one of this plurality of VGAM2021 host target genes comprises one or more host target binding sites, each having a nucleotide sequence which is at least partly complementary to VGAM2021 RNA, herein designated VGAM RNA, and which when bound by VGAM2021 RNA causes inhibition of translation of respective one or more VGAM2021 host target proteins.

It is further appreciated by one skilled in the art that the mode of translational inhibition illustrated by FIG. 1 with specific reference to translational inhibition exerted by VGAM2021 gene, herein designated VGAM GENE, on one or more VGAM2021 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2021 is inhibition of expression of host target genes, as part of a novel viral mechanism of attacking a host. Accordingly, utilities of VGAM2021 include diagnosis, prevention and treatment of viral infection by Zaire Ebola Virus (ZEBOV). Specific functions, and accordingly utilities, of VGAM2021 correlate with, and may be deduced from, the identity of the host target genes which VGAM2021 binds and inhibits, and the function of these host target genes, as elaborated hereinbelow.

Nucleotide sequences of the VGAM2021 precursor RNA, herein designated VGAM PRECURSOR RNA, and of the 'diced' VGAM2021 RNA, herein designated VGAM RNA, and a schematic representation of the secondary folding of VGAM2021 folded precursor RNA, herein designated VGAM FOLDED PRECURSOR RNA, of VGAM2021 are further described hereinbelow with reference to Table 1.

Nucleotide sequences of host target binding sites, such as BINDING SITE-I, BINDING SITE-II and BINDING SITE-III of FIG. 1, found on VGAM2021 host target RNA, and schematic representation of the complementarity of each of these host target binding sites to VGAM2021 RNA, herein designated VGAM RNA, are described hereinbelow with reference to Table 2.

As mentioned hereinabove with reference to FIG. 1, a function of VGAM2021 gene, herein designated VGAM is inhibition of expression of VGAM2021 target genes. It is appreciated that specific functions, and accordingly utilities, of VGAM2021 correlate with, and may be deduced from, the identity of the target genes which VGAM2021 binds and inhibits, and the function of these target genes, as elaborated hereinbelow.

DNA (cytosine-5-)-methyltransferase 3 Beta (DNMT3B, Accession NM_006892) is a VGAM2021 host target gene. DNMT3B BINDING SITE is HOST TARGET binding site found in the 3' untranslated region of mRNA encoded by DNMT3B, corresponding to a HOST TARGET binding site such as BINDING SITE I, BINDING SITE II or BINDING SITE III. Table 2 illustrates the complementarity of the nucleotide sequences of DNMT3B BINDING SITE, designated SEQ ID:13763, to the nucleotide sequence of VGAM2021 RNA, herein designated VGAM RNA, also designated SEQ ID:4732.

A function of VGAM2021 is therefore inhibition of DNA (cytosine-5-)-methyltransferase 3 Beta (DNMT3B, Accession NM_006892), a gene which is required for genome wide de novo methylation. Accordingly, utilities of VGAM2021 include diagnosis, prevention and treatment of diseases and clinical conditions associated with DNMT3B. The function of DNMT3B and its association with various diseases and clinical conditions, has been established by previous studies, as described hereinabove with reference to VGAM280. Phosphodiesterase 4D, CAMP-specific (phosphodiesterase E3 dunce homolog, Drosophila) (PDE4D, Accession XM_056815) is another VGAM2021 host target gene. PDE4D BINDING SITE is HOST TARGET binding site found in the 5' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36432, to the nucleotide sequence of VGAM2021 RNA, herein designated VGAM RNA, also designated SEQ ID:4732.

Another function of VGAM2021 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM2021 include diagnosis, prevention and treatment of diseases and clinical conditions associated with PDE4D. The function of PDE4D and its association with various diseases and clinical conditions, has been established by previous studies, as described hereinabove with reference to VGAM180. Interferon Regulatory Factor 7 (IRF7, Accession NM_004030) is another VGAM2021 host target gene. IRF7 BINDING SITE is HOST TARGET binding site found in the 3' untranslated region of mRNA encoded by IRF7, corresponding to a HOST TARGET binding site such as BINDING SITE I, BINDING SITE II or BINDING SITE III. Table 2 illustrates the complementarity of the nucleotide sequences of IRF7 BINDING SITE, designated SEQ ID:10251, to the nucleotide sequence of VGAM2021 RNA, herein designated VGAM RNA, also designated SEQ ID:4732.

Another function of VGAM2021 is therefore inhibition of Interferon Regulatory Factor 7 (IRF7, Accession NM_004030). Accordingly, utilities of VGAM2021 include diagnosis, prevention and treatment of diseases and clinical conditions associated with IRF7. KIAA0226 (Accession XM_032901) is another VGAM2021 host target gene. KIAA0226 BINDING SITE is HOST TARGET binding site found in the 3' untranslated region of mRNA encoded by KIAA0226, corresponding to a HOST TARGET binding site such as BINDING SITE I, BINDING SITE II or BINDING SITE III. Table 2 illustrates the complementarity of the nucleotide sequences of KIAA0226 BINDING SITE, designated SEQ ID:31786, to the nucleotide sequence of VGAM2021 RNA, herein designated VGAM RNA, also designated SEQ ID:4732.

Another function of VGAM2021 is therefore inhibition of KIAA0226 (Accession XM_032901). Accordingly, utilities of VGAM2021 include diagnosis, prevention and treatment of diseases and clinical conditions associated with KIAA0226. KIAA0433 (Accession NM_015216) is another VGAM2021 host target gene. KIAA0433 BINDING SITE is HOST TARGET binding site found in the 5' untranslated region of mRNA encoded by KIAA0433, corresponding to a HOST TARGET binding site such as BINDING SITE I, BINDING SITE II or BINDING SITE III. Table 2 illustrates the complementarity of the nucleotide sequences of KIAA0433 BINDING SITE, designated SEQ ID:17548, to the nucleotide sequence of VGAM2021 RNA, herein designated VGAM RNA, also designated SEQ ID:4732.

Another function of VGAM2021 is therefore inhibition of KIAA0433 (Accession NM_015216). Accordingly, utilities of VGAM2021 include diagnosis, prevention and treatment of diseases and clinical conditions associated with KIAA0433. VPS39 (Accession XM_031720) is another VGAM2021 host target gene. VPS39 BINDING SITE is HOST TARGET binding site found in the 3' untranslated region of mRNA encoded by VPS39, corresponding to a HOST TARGET binding site such as BINDING SITE I, BINDING SITE II or BINDING SITE III. Table 2 illustrates the complementarity of the nucleotide sequences of VPS39 BINDING SITE, designated SEQ ID:31470, to the nucleotide sequence of VGAM2021 RNA, herein designated VGAM RNA, also designated SEQ ID:4732.

Another function of VGAM2021 is therefore inhibition of VPS39 (Accession XM_031720). Accordingly, utilities of VGAM2021 include diagnosis, prevention and treatment of diseases and clinical conditions associated with VPS39. Zinc Finger, DHHC Domain Containing 3 (ZDHHC3, Accession NM_016598) is another VGAM2021 host target gene. ZDHHC3 BINDING SITE is HOST TARGET binding site found in the 5' untranslated region of mRNA encoded by ZDHHC3, corresponding to a HOST TARGET binding site such as BINDING SITE I, BINDING SITE II or BINDING SITE III. Table 2 illustrates the complementarity of the nucleotide sequences of ZDHHC3 BINDING SITE, designated SEQ ID:18688, to the nucleotide sequence of VGAM2021 RNA, herein designated VGAM RNA, also designated SEQ ID:4732.

Another function of VGAM2021 is therefore inhibition of Zinc Finger, DHHC Domain Containing 3 (ZDHHC3, Accession NM_016598). Accordingly, utilities of VGAM2021 include diagnosis, prevention and treatment of diseases and clinical conditions associated with ZDHHC3. LOC200213 (Accession XM_114156) is another VGAM2021 host target gene. LOC200213 BINDING SITE is HOST TARGET binding site found in the 5' untranslated region of mRNA encoded by LOC200213, corresponding to a HOST TARGET binding site such as BINDING SITE I, BINDING SITE II or BINDING SITE III. Table 2 illustrates the complementarity of the nucleotide sequences of LOC200213 BINDING SITE, designated SEQ ID:42740, to the nucleotide sequence of VGAM2021 RNA, herein designated VGAM RNA, also designated SEQ ID:4732.

Another function of VGAM2021 is therefore inhibition of LOC200213 (Accession XM_114156). Accordingly, utilities of VGAM2021 include diagnosis, prevention and treatment of diseases and clinical conditions associated with LOC200213. LOC222161 (Accession XM_166596) is another VGAM2021 host target gene. LOC222161 BINDING SITE is HOST TARGET binding site found in the 5' untranslated region of mRNA encoded by LOC222161, corresponding to a HOST TARGET binding site such as BINDING SITE I, BINDING SITE II or BINDING SITE III. Table 2 illustrates the complementarity of the nucleotide sequences of LOC222161 BINDING SITE, designated SEQ ID:44580, to the nucleotide sequence of VGAM2021 RNA, herein designated VGAM RNA, also designated SEQ ID:4732.

Another function of VGAM2021 is therefore inhibition of LOC222161 (Accession XM_166596). Accordingly, utilities of VGAM2021 include diagnosis, prevention and treatment of diseases and clinical conditions associated with LOC222161. FIG. 1 further provides a conceptual description of a novel bioinformatically detected viral gene of the present invention, referred to here as Viral Genomic Address Messenger 2022 (VGAM2022) viral gene, which modulates expression of respective host target genes thereof, the function and utility of which host target genes is known in the art.

VGAM2022 is a novel bioinformatically detected regulatory, non protein coding, viral micro RNA (miRNA) gene. The method by which VGAM2022 was detected is described hereinabove with reference to FIGS. 1-8.

VGAM2022 gene, herein designated VGAM GENE, is a viral gene contained in the genome of Zaire Ebola Virus (ZEBOV). VGAM2022 host target gene, herein designated VGAM HOST TARGET GENE, is a human gene contained in the human genome.

VGAM2022 gene encodes a VGAM2022 precursor RNA, herein designated VGAM PRECURSOR RNA. Similar to other miRNA genes, and unlike most ordinary genes, VGAM2022 precursor RNA does not encode a protein. A nucleotide sequence identical or highly similar to the nucleotide sequence of VGAM2022 precursor RNA is designated SEQ ID:2008, and is provided hereinbelow with reference to the sequence listing part. Nucleotide sequence SEQ ID:2008 is located at position 4390 relative to the genome of Zaire Ebola Virus (ZEBOV).

VGAM2022 precursor RNA folds onto itself, forming VGAM2022 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2022 folded precursor RNA into VGAM2022 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2022 RNA is designated SEQ ID:4733, and is provided hereinbelow with reference to the sequence listing part.

VGAM2022 host target gene, herein designated VGAM HOST TARGET GENE, encodes a corresponding messenger RNA, VGAM2022 host target RNA, herein designated VGAM HOST TARGET RNA. VGAM2022 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2022 RNA, herein designated VGAM RNA, binds complementarily to one or more host target binding sites located in untranslated regions of VGAM2022 host target RNA, herein designated VGAM HOST TARGET RNA. This complementary binding is due to the fact that the nucleotide sequence of VGAM2022 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2022 RNA, herein designated VGAM RNA, may have a different number of host target binding sites in untranslated regions of a VGAM2022 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2022 RNA, herein designated VGAM RNA, to host target binding sites on VGAM2022 host target RNA, herein designated VGAM HOST TARGET RNA, such as BINDING SITE I, BINDING SITE II and BINDING SITE III, inhibits translation of VGAM2022 host target RNA into VGAM2022 host target protein, herein designated VGAM HOST TARGET PROTEIN. VGAM host target protein is therefore outlined by a broken line.

It is appreciated that VGAM2022 host target gene, herein designated VGAM HOST TARGET GENE, in fact represents a plurality of VGAM2022 host target genes. The mRNA of each one of this plurality of VGAM2022 host target genes comprises one or more host target binding sites, each having a nucleotide sequence which is at least partly complementary to VGAM2022 RNA, herein designated VGAM RNA, and which when bound by VGAM2022 RNA causes inhibition of translation of respective one or more VGAM2022 host target proteins.

It is further appreciated by one skilled in the art that the mode of translational inhibition illustrated by FIG. 1 with specific reference to translational inhibition exerted by VGAM2022 gene, herein designated VGAM GENE, on one or more VGAM2022 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2022 is inhibition of expression of host target genes, as part of a novel viral mechanism of attacking a host. Accordingly, utilities of VGAM2022 include diagnosis, prevention and treatment of viral infection by Zaire Ebola Virus (ZEBOV). Specific functions, and accordingly utilities, of VGAM2022 correlate with, and may be deduced from, the identity of the host target genes which VGAM2022 binds and inhibits, and the function of these host target genes, as elaborated hereinbelow.

Nucleotide sequences of the VGAM2022 precursor RNA, herein designated VGAM PRECURSOR RNA, and of the 'diced' VGAM2022 RNA, herein designated VGAM RNA, and a schematic representation of the secondary folding of VGAM2022 folded precursor RNA, herein designated VGAM FOLDED PRECURSOR RNA, of VGAM2022 are further described hereinbelow with reference to Table 1.

Nucleotide sequences of host target binding sites, such as BINDING SITE-I, BINDING SITE-II and BINDING SITE-III of FIG. 1, found on VGAM2022 host target RNA, and schematic representation of the complementarity of each of these host target binding sites to VGAM2022 RNA, herein designated VGAM RNA, are described hereinbelow with reference to Table 2.

As mentioned hereinabove with reference to FIG. 1, a function of VGAM2022 gene, herein designated VGAM is inhibition of expression of VGAM2022 target genes. It is appreciated that specific functions, and accordingly utilities, of VGAM2022 correlate with, and may be deduced from, the identity of the target genes which VGAM2022 binds and inhibits, and the function of these target genes, as elaborated hereinbelow.

NEL-like 2 (chicken) (NELL2, Accession NM_006159) is a VGAM2022 host target gene. NELL2 BINDING SITE is HOST TARGET binding site found in the 3' untranslated region of mRNA encoded by NELL2, corresponding to a HOST TARGET binding site such as BINDING SITE I, BINDING SITE II or BINDING SITE III. Table 2 illustrates the complementarity of the nucleotide sequences of NELL2

BINDING SITE, designated SEQ ID:12812, to the nucleotide sequence of VGAM2022 RNA, herein designated VGAM RNA, also designated SEQ ID:4733.

A function of VGAM2022 is therefore inhibition of NEL-like 2 (chicken) (NELL2, Accession NM_006159). Accordingly, utilities of VGAM2022 include diagnosis, prevention and treatment of diseases and clinical conditions associated with NELL2. AWP1 (Accession NM_019006) is another VGAM2022 host target gene. AWP1 BINDING SITE is HOST TARGET binding site found in the 3' untranslated region of mRNA encoded by AWP1, corresponding to a HOST TARGET binding site such as BINDING SITE I, BINDING SITE II or BINDING SITE III. Table 2 illustrates the complementarity of the nucleotide sequences of AWP1 BINDING SITE, designated SEQ ID:21080, to the nucleotide sequence of VGAM2022 RNA, herein designated VGAM RNA, also designated SEQ ID:4733.

Another function of VGAM2022 is therefore inhibition of AWP1 (Accession NM_019006). Accordingly, utilities of VGAM2022 include diagnosis, prevention and treatment of diseases and clinical conditions associated with AWP1. FLJ10520 (Accession NM_018124) is another VGAM2022 host target gene. FLJ10520 BINDING SITE is HOST TARGET binding site found in the 3' untranslated region of mRNA encoded by FLJ10520, corresponding to a HOST TARGET binding site such as BINDING SITE I, BINDING SITE II or BINDING SITE III. Table 2 illustrates the complementarity of the nucleotide sequences of FLJ10520 BINDING SITE, designated SEQ ID:19904, to the nucleotide sequence of VGAM2022 RNA, herein designated VGAM RNA, also designated SEQ ID:4733.

Another function of VGAM2022 is therefore inhibition of FLJ10520 (Accession NM_018124). Accordingly, utilities of VGAM2022 include diagnosis, prevention and treatment of diseases and clinical conditions associated with FLJ10520. FLJ13657 (Accession NM_024828) is another VGAM2022 host target gene. FLJ13657 BINDING SITE is HOST TARGET binding site found in the 3' untranslated region of mRNA encoded by FLJ13657, corresponding to a HOST TARGET binding site such as BINDING SITE I, BINDING SITE II or BINDING SITE III. Table 2 illustrates the complementarity of the nucleotide sequences of FLJ13657 BINDING SITE, designated SEQ ID:24219, to the nucleotide sequence of VGAM2022 RNA, herein designated VGAM RNA, also designated SEQ ID:4733.

Another function of VGAM2022 is therefore inhibition of FLJ13657 (Accession NM_024828). Accordingly, utilities of VGAM2022 include diagnosis, prevention and treatment of diseases and clinical conditions associated with FLJ13657. Oxysterol Binding Protein-like 8 (OSBPL8, Accession NM_020841) is another VGAM2022 host target gene. OSBPL8 BINDING SITE is HOST TARGET binding site found in the 3' untranslated region of mRNA encoded by OSBPL8, corresponding to a HOST TARGET binding site such as BINDING SITE I, BINDING SITE II or BINDING SITE III. Table 2 illustrates the complementarity of the nucleotide sequences of OSBPL8 BINDING SITE, designated SEQ ID:21908, to the nucleotide sequence of VGAM2022 RNA, herein designated VGAM RNA, also designated SEQ ID:4733.

Another function of VGAM2022 is therefore inhibition of Oxysterol Binding Protein-like 8 (OSBPL8, Accession NM_020841). Accordingly, utilities of VGAM2022 include diagnosis, prevention and treatment of diseases and clinical conditions associated with OSBPL8. PRO2964 (Accession NM_018547) is another VGAM2022 host target gene. PRO2964 BINDING SITE is HOST TARGET binding site found in the 3' untranslated region of mRNA encoded by PRO2964, corresponding to a HOST TARGET binding site such as BINDING SITE I, BINDING SITE II or BINDING SITE III. Table 2 illustrates the complementarity of the nucleotide sequences of PRO2964 BINDING SITE, designated SEQ ID:20631, to the nucleotide sequence of VGAM2022 RNA, herein designated VGAM RNA, also designated SEQ ID:4733.

Another function of VGAM2022 is therefore inhibition of PRO2964 (Accession NM_018547). Accordingly, utilities of VGAM2022 include diagnosis, prevention and treatment of diseases and clinical conditions associated with PRO2964. LOC146237 (Accession XM_096954) is another VGAM2022 host target gene. LOC146237 BINDING SITE is HOST TARGET binding site found in the 3' untranslated region of mRNA encoded by LOC146237, corresponding to a HOST TARGET binding site such as BINDING SITE I, BINDING SITE II or BINDING SITE III. Table 2 illustrates the complementarity of the nucleotide sequences of LOC146237 BINDING SITE, designated SEQ ID:40668, to the nucleotide sequence of VGAM2022 RNA, herein designated VGAM RNA, also designated SEQ ID:4733.

Another function of VGAM2022 is therefore inhibition of LOC146237 (Accession XM_096954). Accordingly, utilities of VGAM2022 include diagnosis, prevention and treatment of diseases and clinical conditions associated with LOC146237. LOC158381 (Accession XM_048461) is another VGAM2022 host target gene. LOC158381 BINDING SITE is HOST TARGET binding site found in the 3' untranslated region of mRNA encoded by LOC158381, corresponding to a HOST TARGET binding site such as BINDING SITE I, BINDING SITE II or BINDING SITE III. Table 2 illustrates the complementarity of the nucleotide sequences of LOC158381 BINDING SITE, designated SEQ ID:35176, to the nucleotide sequence of VGAM2022 RNA, herein designated VGAM RNA, also designated SEQ ID:4733.

Another function of VGAM2022 is therefore inhibition of LOC158381 (Accession XM_048461). Accordingly, utilities of VGAM2022 include diagnosis, prevention and treatment of diseases and clinical conditions associated with LOC158381. LOC89231 (Accession XM_166577) is another VGAM2022 host target gene. LOC89231 BINDING SITE is HOST TARGET binding site found in the 3' untranslated region of mRNA encoded by LOC89231, corresponding to a HOST TARGET binding site such as BINDING SITE I, BINDING SITE II or BINDING SITE III. Table 2 illustrates the complementarity of the nucleotide sequences of LOC89231 BINDING SITE, designated SEQ ID:44551, to the nucleotide sequence of VGAM2022 RNA, herein designated VGAM RNA, also designated SEQ ID:4733.

Another function of VGAM2022 is therefore inhibition of LOC89231 (Accession XM_166577). Accordingly, utilities of VGAM2022 include diagnosis, prevention and treatment of diseases and clinical conditions associated with LOC89231. FIG. 1 further provides a conceptual description of a novel bioinformatically detected viral gene of the present invention, referred to here as Viral Genomic Address Messenger 2023 (VGAM2023) viral gene, which modulates expression of respective host target genes thereof, the function and utility of which host target genes is known in the art.

VGAM2023 is a novel bioinformatically detected regulatory, non protein coding, viral micro RNA (miRNA) gene. The method by which VGAM2023 was detected is described hereinabove with reference to FIGS. 1-8.

VGAM2023 gene, herein designated VGAM GENE, is a viral gene contained in the genome of Zaire Ebola Virus (ZEBOV). VGAM2023 host target gene, herein designated VGAM HOST TARGET GENE, is a human gene contained in the human genome.

VGAM2023 gene encodes a VGAM2023 precursor RNA, herein designated VGAM PRECURSOR RNA. Similar to other miRNA genes, and unlike most ordinary genes, VGAM2023 precursor RNA does not encode a protein. A nucleotide sequence identical or highly similar to the nucleotide sequence of VGAM2023 precursor RNA is designated SEQ ID:2009, and is provided hereinbelow with reference to the sequence listing part. Nucleotide sequence SEQ ID:2009 is located at position 11139 relative to the genome of Zaire Ebola Virus (ZEBOV).

VGAM2023 precursor RNA folds onto itself, forming VGAM2023 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2023 folded precursor RNA into VGAM2023 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM2023 RNA is designated SEQ ID:4734, and is provided hereinbelow with reference to the sequence listing part.

VGAM2023 host target gene, herein designated VGAM HOST TARGET GENE, encodes a corresponding messenger RNA, VGAM2023 host target RNA, herein designated VGAM HOST TARGET RNA. VGAM2023 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2023 RNA, herein designated VGAM RNA, binds complementarily to one or more host target binding sites located in untranslated regions of VGAM2023 host target RNA, herein designated VGAM HOST TARGET RNA. This complementary binding is due to the fact that the nucleotide sequence of VGAM2023 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2023 RNA, herein designated VGAM RNA, may have a different number of host target binding sites in untranslated regions of a VGAM2023 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2023 RNA, herein designated VGAM RNA, to host target binding sites on VGAM2023 host target RNA, herein designated VGAM HOST TARGET RNA, such as BINDING SITE I, BINDING SITE II and BINDING SITE III, inhibits translation of VGAM2023 host target RNA into VGAM2023 host target protein, herein designated VGAM HOST TARGET PROTEIN. VGAM host target protein is therefore outlined by a broken line.

It is appreciated that VGAM2023 host target gene, herein designated VGAM HOST TARGET GENE, in fact represents a plurality of VGAM2023 host target genes. The mRNA of each one of this plurality of VGAM2023 host target genes comprises one or more host target binding sites, each having a nucleotide sequence which is at least partly complementary to VGAM2023 RNA, herein designated VGAM RNA, and which when bound by VGAM2023 RNA causes inhibition of translation of respective one or more VGAM2023 host target proteins.

It is further appreciated by one skilled in the art that the mode of translational inhibition illustrated by FIG. 1 with specific reference to translational inhibition exerted by VGAM2023 gene, herein designated VGAM GENE, on one or more VGAM2023 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2023 is inhibition of expression of host target genes, as part of a novel viral mechanism of attacking a host. Accordingly, utilities of VGAM2023 include diagnosis, prevention and treatment of viral infection by Zaire Ebola Virus (ZEBOV). Specific functions, and accordingly utilities, of VGAM2023 correlate with, and may be deduced from, the identity of the host target genes which VGAM2023 binds and inhibits, and the function of these host target genes, as elaborated hereinbelow.

Nucleotide sequences of the VGAM2023 precursor RNA, herein designated VGAM PRECURSOR RNA, and of the 'diced' VGAM2023 RNA, herein designated VGAM RNA, and a schematic representation of the secondary folding of VGAM2023 folded precursor RNA, herein designated VGAM FOLDED PRECURSOR RNA, of VGAM2023 are further described hereinbelow with reference to Table 1.

Nucleotide sequences of host target binding sites, such as BINDING SITE-I, BINDING SITE-II and BINDING SITE-III of FIG. 1, found on VGAM2023 host target RNA, and schematic representation of the complementarity of each of these host target binding sites to VGAM2023 RNA, herein designated VGAM RNA, are described hereinbelow with reference to Table 2.

As mentioned hereinabove with reference to FIG. 1, a function of VGAM2023 gene, herein designated VGAM is inhibition of expression of VGAM2023 target genes. It is appreciated that specific functions, and accordingly utilities, of VGAM2023 correlate with, and may be deduced from, the identity of the target genes which VGAM2023 binds and inhibits, and the function of these target genes, as elaborated hereinbelow.

Chemokine (C-C motif) Receptor 5 (CCR5, Accession NM_000579) is a VGAM2023 host target gene. CCR5 BINDING SITE is HOST TARGET binding site found in the 3' untranslated region of mRNA encoded by CCR5, corresponding to a HOST TARGET binding site such as BINDING SITE I, BINDING SITE II or BINDING SITE III. Table 2 illustrates the complementarity of the nucleotide sequences of CCR5 BINDING SITE, designated SEQ ID:6182, to the nucleotide sequence of VGAM2023 RNA, herein designated VGAM RNA, also designated SEQ ID:4734.

A function of VGAM2023 is therefore inhibition of Chemokine (C-C motif) Receptor 5 (CCR5, Accession NM_000579). Accordingly, utilities of VGAM2023 include diagnosis, prevention and treatment of diseases and clinical conditions associated with CCR5. KIAA0310 (Accession XM_088459) is another VGAM2023 host target gene. KIAA0310 BINDING SITE is HOST TARGET binding site found in the 5' untranslated region of mRNA encoded by KIAA0310, corresponding to a HOST TARGET binding site such as BINDING SITE I, BINDING SITE II or BINDING SITE III. Table 2 illustrates the complementarity of the nucleotide sequences of KIAA0310 BINDING SITE, designated SEQ ID:39708, to the nucleotide sequence of VGAM2023 RNA, herein designated VGAM RNA, also designated SEQ ID:4734.

Another function of VGAM2023 is therefore inhibition of KIAA0310 (Accession XM_088459). Accordingly, utilities of VGAM2023 include diagnosis, prevention and treatment of diseases and clinical conditions associated with KIAA0310. POLD3 (Accession XM_166243) is another VGAM2023 host target gene. POLD3 BINDING SITE is HOST TARGET binding site found in the 3' untranslated region of mRNA encoded by POLD3, corresponding to a HOST TARGET binding site such as BINDING SITE I, BINDING SITE II or BINDING SITE III. Table 2 illustrates the complementarity of the nucleotide sequences of POLD3 BINDING SITE, designated SEQ ID:44053, to the nucleotide sequence of VGAM2023 RNA, herein designated VGAM RNA, also designated SEQ ID:4734.

Another function of VGAM2023 is therefore inhibition of POLD3 (Accession XM_166243). Accordingly, utilities of VGAM2023 include diagnosis, prevention and treatment of diseases and clinical conditions associated with POLD3. LOC161357 (Accession XM_090827) is another VGAM2023 host target gene. LOC161357 BINDING SITE is HOST TARGET binding site found in the 3' untranslated region of mRNA encoded by LOC161357, corresponding to a HOST TARGET binding site such as BINDING SITE I, BINDING SITE II or BINDING SITE III. Table 2 illustrates the complementarity of the nucleotide sequences of LOC161357 BINDING SITE, designated SEQ ID:40016, to the nucleotide sequence of VGAM2023 RNA, herein designated VGAM RNA, also designated SEQ ID:4734.

Another function of VGAM2023 is therefore inhibition of LOC161357 (Accession XM_090827). Accordingly, utilities of VGAM2023 include diagnosis, prevention and treatment of diseases and clinical conditions associated with LOC161357. FIG. 1 further provides a conceptual description of a novel bioinformatically detected viral gene of the present invention, referred to here as Viral Genomic Address Messenger 2024 (VGAM2024) viral gene, which modulates expression of respective host target genes thereof, the function and utility of which host target genes is known in the art.

VGAM2024 is a novel bioinformatically detected regulatory, non protein coding, viral micro RNA (miRNA) gene. The method by which VGAM2024 was detected is described hereinabove with reference to FIGS. 1-8.

VGAM2024 gene, herein designated VGAM GENE, is a viral gene contained in the genome of Kyuri Green Mottle Mosaic Virus. VGAM2024 host target gene, herein designated VGAM HOST TARGET GENE, is a human gene contained in the human genome.

VGAM2024 gene encodes a VGAM2024 precursor RNA, herein designated VGAM PRECURSOR RNA. Similar to other miRNA genes, and unlike most ordinary genes, VGAM2024 precursor RNA does not encode a protein. A nucleotide sequence identical or highly similar to the nucleotide sequence of VGAM2024 precursor RNA is designated SEQ ID:2010, and is provided hereinbelow with reference to the sequence listing part. Nucleotide sequence SEQ ID:2010 is located at position 332 relative to the genome of Kyuri Green Mottle Mosaic Virus.

VGAM2024 precursor RNA folds onto itself, forming VGAM2024 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2024 folded precursor RNA into VGAM2024 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM2024 RNA is designated SEQ ID:4735, and is provided hereinbelow with reference to the sequence listing part.

VGAM2024 host target gene, herein designated VGAM HOST TARGET GENE, encodes a corresponding messenger RNA, VGAM2024 host target RNA, herein designated VGAM HOST TARGET RNA. VGAM2024 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2024 RNA, herein designated VGAM RNA, binds complementarily to one or more host target binding sites located in untranslated regions of VGAM2024 host target RNA, herein designated VGAM HOST TARGET RNA. This complementary binding is due to the fact that the nucleotide sequence of VGAM2024 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2024 RNA, herein designated VGAM RNA, may have a different number of host target binding sites in untranslated regions of a VGAM2024 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2024 RNA, herein designated VGAM RNA, to host target binding sites on VGAM2024 host target RNA, herein designated VGAM HOST TARGET RNA, such as BINDING SITE I, BINDING SITE II and BINDING SITE III, inhibits translation of VGAM2024 host target RNA into VGAM2024 host target protein, herein designated VGAM HOST TARGET PRO- TEIN. VGAM host target protein is therefore outlined by a broken line.

It is appreciated that VGAM2024 host target gene, herein designated VGAM HOST TARGET GENE, in fact represents a plurality of VGAM2024 host target genes. The mRNA of each one of this plurality of VGAM2024 host target genes comprises one or more host target binding sites, each having a nucleotide sequence which is at least partly complementary to VGAM2024 RNA, herein designated VGAM RNA, and which when bound by VGAM2024 RNA causes inhibition of translation of respective one or more VGAM2024 host target proteins.

It is further appreciated by one skilled in the art that the mode of translational inhibition illustrated by FIG. 1 with specific reference to translational inhibition exerted by VGAM2024 gene, herein designated VGAM GENE, on one or more VGAM2024 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2024 is inhibition of expression of host target genes, as part of a novel viral mechanism of attacking a host. Accordingly, utilities of VGAM2024 include diagnosis, prevention and treatment of viral infection by Kyuri Green Mottle Mosaic Virus. Specific functions, and accordingly utilities, of VGAM2024 correlate with, and may be deduced from, the identity of the host target genes which VGAM2024 binds and inhibits, and the function of these host target genes, as elaborated hereinbelow.

Nucleotide sequences of the VGAM2024 precursor RNA, herein designated VGAM PRECURSOR RNA, and of the 'diced' VGAM2024 RNA, herein designated VGAM RNA, and a schematic representation of the secondary folding of VGAM2024 folded precursor RNA, herein designated VGAM FOLDED PRECURSOR RNA, of VGAM2024 are further described hereinbelow with reference to Table 1.

Nucleotide sequences of host target binding sites, such as BINDING SITE-I, BINDING SITE-II and BINDING SITE-III of FIG. 1, found on VGAM2024 host target RNA, and schematic representation of the complementarity of each of these host target binding sites to VGAM2024 RNA, herein designated VGAM RNA, are described hereinbelow with reference to Table 2.

As mentioned hereinabove with reference to FIG. 1, a function of VGAM2024 gene, herein designated VGAM is inhibition of expression of VGAM2024 target genes. It is appreciated that specific functions, and accordingly utilities, of VGAM2024 correlate with, and may be deduced from, the identity of the target genes which VGAM2024 binds and inhibits, and the function of these target genes, as elaborated hereinbelow.

APM1 (Accession NM_004797) is a VGAM2024 host target gene. APM1 BINDING SITE is HOST TARGET binding site found in the 3' untranslated region of mRNA encoded by APM1, corresponding to a HOST TARGET binding site such as BINDING SITE I, BINDING SITE II or BINDING SITE III. Table 2 illustrates the complementarity of the nucleotide sequences of APM1 BINDING SITE, designated SEQ ID:11213, to the nucleotide sequence of VGAM2024 RNA, herein designated VGAM RNA, also designated SEQ ID:4735.

A function of VGAM2024 is therefore inhibition of APM1 (Accession NM_004797). Accordingly, utilities of VGAM2024 include diagnosis, prevention and treatment of diseases and clinical conditions associated with APM1. Rho GTPase Activating Protein 6 (ARHGAP6, Accession NM_013423) is another VGAM2024 host target gene. ARHGAP6 BINDING SITE1 and ARHGAP6 BINDING SITE2 are HOST TARGET binding sites found in untranslated regions of mRNA encoded by ARHGAP6, corresponding to HOST TARGET binding sites such as BINDING SITE I, BINDING SITE II or BINDING SITE III. Table 2 illustrates the complementarity of the nucleotide sequences of ARHGAP6 BINDING SITE1 and ARHGAP6 BINDING SITE2, designated SEQ ID:15085 and SEQ ID:6847 respectively, to the nucleotide sequence of VGAM2024 RNA, herein designated VGAM RNA, also designated SEQ ID:4735.

Another function of VGAM2024 is therefore inhibition of Rho GTPase Activating Protein 6 (ARHGAP6, Accession NM_013423), a gene which activates the rho-type GTPases by converting them to an inactive GTP-bound state. Accordingly, utilities of VGAM2024 include diagnosis, prevention and treatment of diseases and clinical conditions associated with ARHGAP6. The function of ARHGAP6 and its association with various diseases and clinical conditions, has been established by previous studies, as described hereinabove with reference to VGAM55. Vinculin (VCL, Accession NM_014000) is another VGAM2024 host target gene. VCL BINDING SITE1 and VCL BINDING SITE2 are HOST TARGET binding sites found in untranslated regions of mRNA encoded by VCL, corresponding to HOST TARGET binding sites such as BINDING SITE I, BINDING SITE II or BINDING SITE III. Table 2 illustrates the complementarity of the nucleotide sequences of VCL BINDING SITE1 and VCL BINDING SITE2, designated SEQ ID:15193 and SEQ ID:9404 respectively, to the nucleotide sequence of VGAM2024 RNA, herein designated VGAM RNA, also designated SEQ ID:4735.

Another function of VGAM2024 is therefore inhibition of Vinculin (VCL, Accession NM_014000). Accordingly, utilities of VGAM2024 include diagnosis, prevention and treatment of diseases and clinical conditions associated with VCL. BPES (Accession NM_023067) is another VGAM2024 host target gene. BPES BINDING SITE is HOST TARGET binding site found in the 3' untranslated region of mRNA encoded by BPES, corresponding to a HOST TARGET binding site such as BINDING SITE I, BINDING SITE II or BINDING SITE III. Table 2 illustrates the complementarity of the nucleotide sequences of BPES BINDING SITE, designated SEQ ID:23325, to the nucleotide sequence of VGAM2024 RNA, herein designated VGAM RNA, also designated SEQ ID:4735.

Another function of VGAM2024 is therefore inhibition of BPES (Accession NM_023067). Accordingly, utilities of VGAM2024 include diagnosis, prevention and treatment of diseases and clinical conditions associated with BPES. FLJ11722 (Accession NM_024970) is another VGAM2024 host target gene. FLJ11722 BINDING SITE is HOST TARGET binding site found in the 3' untranslated region of mRNA encoded by FLJ11722, corresponding to a HOST TARGET binding site such as BINDING SITE I, BINDING SITE II or BINDING SITE III. Table 2 illustrates the complementarity of the nucleotide sequences of FLJ11722 BINDING SITE, designated SEQ ID:24518, to the nucleotide sequence of VGAM2024 RNA, herein designated VGAM RNA, also designated SEQ ID:4735.

Another function of VGAM2024 is therefore inhibition of FLJ11722 (Accession NM_024970). Accordingly, utilities of VGAM2024 include diagnosis, prevention and treatment of diseases and clinical conditions associated with FLJ11722. pcnp (Accession NM_020357) is another VGAM2024 host target gene. pcnp BINDING SITE is HOST TARGET binding site found in the 3' untranslated region of mRNA encoded by pcnp, corresponding to a HOST TARGET binding site such as BINDING SITE I, BINDING SITE II or BINDING SITE III. Table 2 illustrates the complementarity of the nucleotide sequences of pcnp BINDING SITE, designated SEQ ID:21629, to the nucleotide sequence of VGAM2024 RNA, herein designated VGAM RNA, also designated SEQ ID:4735.

Another function of VGAM2024 is therefore inhibition of pcnp (Accession NM_020357). Accordingly, utilities of VGAM2024 include diagnosis, prevention and treatment of diseases and clinical conditions associated with pcnp. Zinc Finger Protein 297B (ZNF297B, Accession NM_014007) is another VGAM2024 host target gene. ZNF297B BINDING SITE is HOST TARGET binding site found in the 3' untranslated region of mRNA encoded by ZNF297B, corresponding to a HOST TARGET binding site such as BINDING SITE I, BINDING SITE II or BINDING SITE III. Table 2 illustrates the complementarity of the nucleotide sequences of ZNF297B BINDING SITE, designated SEQ ID:15221, to the nucleotide sequence of VGAM2024 RNA, herein designated VGAM RNA, also designated SEQ ID:4735.

Another function of VGAM2024 is therefore inhibition of Zinc Finger Protein 297B (ZNF297B, Accession NM_014007). Accordingly, utilities of VGAM2024 include diagnosis, prevention and treatment of diseases and clinical conditions associated with ZNF297B. LOC150139 (Accession XM_086794) is another VGAM2024 host target gene. LOC150139 BINDING SITE is HOST TARGET binding site found in the 5' untranslated region of mRNA encoded by LOC150139, corresponding to a HOST TARGET binding site such as BINDING SITE I, BINDING SITE II or BINDING SITE III. Table 2 illustrates the complementarity of the nucleotide sequences of LOC150139 BINDING SITE, designated SEQ ID:38859, to the nucleotide sequence of VGAM2024 RNA, herein designated VGAM RNA, also designated SEQ ID:4735.

Another function of VGAM2024 is therefore inhibition of LOC150139 (Accession XM_086794). Accordingly, utilities of VGAM2024 include diagnosis, prevention and treatment of diseases and clinical conditions associated with LOC150139. LOC92597 (Accession XM_046066) is another VGAM2024 host target gene. LOC92597 BINDING SITE is HOST TARGET binding site found in the 3' untranslated region of mRNA encoded by LOC92597, corresponding to a HOST TARGET binding site such as BINDING SITE I, BINDING SITE II or BINDING SITE III. Table 2 illustrates the complementarity of the nucleotide sequences of LOC92597 BINDING SITE, designated SEQ ID:34675, to the nucleotide sequence of VGAM2024 RNA, herein designated VGAM RNA, also designated SEQ ID:4735.

Another function of VGAM2024 is therefore inhibition of LOC92597 (Accession XM_046066). Accordingly, utilities of VGAM2024 include diagnosis, prevention and treatment of diseases and clinical conditions associated with LOC92597. FIG. 1 further provides a conceptual description of a novel bioinformatically detected viral gene of the present invention, referred to here as Viral Genomic Address Messenger 2025 (VGAM2025) viral gene, which modulates expression of respective host target genes thereof, the function and utility of which host target genes is known in the art.

VGAM2025 is a novel bioinformatically detected regulatory, non protein coding, viral micro RNA (miRNA) gene. The method by which VGAM2025 was detected is described hereinabove with reference to FIGS. 1-8.

VGAM2025 gene, herein designated VGAM GENE, is a viral gene contained in the genome of Kyuri Green Mottle Mosaic Virus. VGAM2025 host target gene, herein designated VGAM HOST TARGET GENE, is a human gene contained in the human genome.

VGAM2025 gene encodes a VGAM2025 precursor RNA, herein designated VGAM PRECURSOR RNA. Similar to other miRNA genes, and unlike most ordinary genes, VGAM2025 precursor RNA does not encode a protein. A nucleotide sequence identical or highly similar to the nucleotide sequence of VGAM2025 precursor RNA is designated SEQ ID:2011, and is provided hereinbelow with reference to the sequence listing part. Nucleotide sequence SEQ ID:2011 is located at position 4374 relative to the genome of Kyuri Green Mottle Mosaic Virus.

VGAM2025 precursor RNA folds onto itself, forming VGAM2025 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2025 folded precursor RNA into VGAM2025 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2025 RNA is designated SEQ ID:4736, and is provided hereinbelow with reference to the sequence listing part.

VGAM2025 host target gene, herein designated VGAM HOST TARGET GENE, encodes a corresponding messenger RNA, VGAM2025 host target RNA, herein designated VGAM HOST TARGET RNA. VGAM2025 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2025 RNA, herein designated VGAM RNA, binds complementarily to one or more host target binding sites located in untranslated regions of VGAM2025 host target RNA, herein designated VGAM HOST TARGET RNA. This complementary binding is due to the fact that the nucleotide sequence of VGAM2025 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2025 RNA, herein designated VGAM RNA, may have a different number of host target binding sites in untranslated regions of a VGAM2025 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2025 RNA, herein designated VGAM RNA, to host target binding sites on VGAM2025 host target RNA, herein designated VGAM HOST TARGET RNA, such as BINDING SITE I, BINDING SITE II and BINDING SITE III, inhibits translation of VGAM2025 host target RNA into VGAM2025 host target protein, herein designated VGAM HOST TARGET PROTEIN. VGAM host target protein is therefore outlined by a broken line.

It is appreciated that VGAM2025 host target gene, herein designated VGAM HOST TARGET GENE, in fact represents a plurality of VGAM2025 host target genes. The mRNA of each one of this plurality of VGAM2025 host target genes comprises one or more host target binding sites, each having a nucleotide sequence which is at least partly complementary to VGAM2025 RNA, herein designated VGAM RNA, and which when bound by VGAM2025 RNA causes inhibition of translation of respective one or more VGAM2025 host target proteins.

It is further appreciated by one skilled in the art that the mode of translational inhibition illustrated by FIG. 1 with specific reference to translational inhibition exerted by VGAM2025 gene, herein designated VGAM GENE, on one or more VGAM2025 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2025 is inhibition of expression of host target genes, as part of a novel viral mechanism of attacking a host. Accordingly, utilities of VGAM2025 include diagnosis, prevention and treatment of viral infection by Kyuri Green Mottle Mosaic Virus. Specific functions, and accordingly utilities, of VGAM2025 correlate with, and may be deduced from, the identity of the host target genes which VGAM2025 binds and inhibits, and the function of these host target genes, as elaborated hereinbelow.

Nucleotide sequences of the VGAM2025 precursor RNA, herein designated VGAM PRECURSOR RNA, and of the 'diced' VGAM2025 RNA, herein designated VGAM RNA, and a schematic representation of the secondary folding of VGAM2025 folded precursor RNA, herein designated VGAM FOLDED PRECURSOR RNA, of VGAM2025 are further described hereinbelow with reference to Table 1.

Nucleotide sequences of host target binding sites, such as BINDING SITE-I, BINDING SITE-II and BINDING SITE-III of FIG. 1, found on VGAM2025 host target RNA, and schematic representation of the complementarity of each of these host target binding sites to VGAM2025 RNA, herein designated VGAM RNA, are described hereinbelow with reference to Table 2.

As mentioned hereinabove with reference to FIG. 1, a function of VGAM2025 gene, herein designated VGAM is inhibition of expression of VGAM2025 target genes. It is appreciated that specific functions, and accordingly utilities, of VGAM2025 correlate with, and may be deduced from, the identity of the target genes which VGAM2025 binds and inhibits, and the function of these target genes, as elaborated hereinbelow.

UMP-CMPK (Accession NM_016308) is a VGAM2025 host target gene. UMP-CMPK BINDING SITE is HOST TARGET binding site found in the 3' untranslated region of mRNA encoded by UMP-CMPK, corresponding to a HOST TARGET binding site such as BINDING SITE I, BINDING SITE II or BINDING SITE III. Table 2 illustrates the complementarity of the nucleotide sequences of UMP-CMPK BINDING SITE, designated SEQ ID:18426, to the nucleotide sequence of VGAM2025 RNA, herein designated VGAM RNA, also designated SEQ ID:4736.

A function of VGAM2025 is therefore inhibition of UMP-CMPK (Accession NM_016308). Accordingly, utilities of VGAM2025 include diagnosis, prevention and treatment of diseases and clinical conditions associated with UMP-CMPK. LOC151959 (Accession XM_098144) is another VGAM2025 host target gene. LOC151959 BINDING SITE is HOST TARGET binding site found in the 5' untranslated region of mRNA encoded by LOC151959, corresponding to a HOST TARGET binding site such as BINDING SITE I, BINDING SITE II or BINDING SITE III. Table 2 illustrates the complementarity of the nucleotide sequences of LOC151959 BINDING SITE, designated SEQ ID:41409, to the nucleotide sequence of VGAM2025 RNA, herein designated VGAM RNA, also designated SEQ ID:4736.

Another function of VGAM2025 is therefore inhibition of LOC151959 (Accession XM_098144). Accordingly, utilities of VGAM2025 include diagnosis, prevention and treatment of diseases and clinical conditions associated with LOC151959. LOC203197 (Accession XM_114645) is another VGAM2025 host target gene. LOC203197 BINDING SITE is HOST TARGET binding site found in the 3' untranslated region of mRNA encoded by LOC203197, corresponding to a HOST TARGET binding site such as BINDING SITE I, BINDING SITE II or BINDING SITE III. Table 2 illustrates the complementarity of the nucleotide sequences of LOC203197 BINDING SITE, designated SEQ ID:43011, to the nucleotide sequence of VGAM2025 RNA, herein designated VGAM RNA, also designated SEQ ID:4736.

Another function of VGAM2025 is therefore inhibition of LOC203197 (Accession XM_114645). Accordingly, utilities of VGAM2025 include diagnosis, prevention and treatment of diseases and clinical conditions associated with LOC203197. LOC221431 (Accession XM_166380) is another VGAM2025 host target gene. LOC221431 BINDING SITE is HOST TARGET binding site found in the 3' untranslated region of mRNA encoded by LOC221431, corresponding to a HOST TARGET binding site such as BINDING SITE I, BINDING SITE II or BINDING SITE III. Table 2 illustrates the complementarity of the nucleotide sequences of LOC221431 BINDING SITE, designated SEQ ID:44220, to the nucleotide sequence of VGAM2025 RNA, herein designated VGAM RNA, also designated SEQ ID:4736.

Another function of VGAM2025 is therefore inhibition of LOC221431 (Accession XM_166380). Accordingly, utilities of VGAM2025 include diagnosis, prevention and treatment of diseases and clinical conditions associated with LOC221431. LOC93589 (Accession XM_052387) is another VGAM2025 host target gene. LOC93589 BINDING SITE is HOST TARGET binding site found in the 3' untranslated region of mRNA encoded by LOC93589, corresponding to a HOST TARGET binding site such as BINDING SITE I, BINDING SITE II or BINDING SITE III. Table 2 illustrates the complementarity of the nucleotide sequences of LOC93589 BINDING SITE, designated SEQ ID:35975, to the nucleotide sequence of VGAM2025 RNA, herein designated VGAM RNA, also designated SEQ ID:4736.

Another function of VGAM2025 is therefore inhibition of LOC93589 (Accession XM_052387). Accordingly, utilities of VGAM2025 include diagnosis, prevention and treatment of diseases and clinical conditions associated with LOC93589. FIG. 1 further provides a conceptual description of a novel bioinformatically detected viral gene of the present invention, referred to here as Viral Genomic Address Messenger 2026 (VGAM2026) viral gene, which modulates expression of respective host target genes thereof, the function and utility of which host target genes is known in the art.

VGAM2026 is a novel bioinformatically detected regulatory, non protein coding, viral micro RNA (miRNA) gene. The method by which VGAM2026 was detected is described hereinabove with reference to FIGS. 1-8.

VGAM2026 gene, herein designated VGAM GENE, is a viral gene contained in the genome of Zaire Ebola Virus (ZEBOV). VGAM2026 host target gene, herein designated VGAM HOST TARGET GENE, is a human gene contained in the human genome.

VGAM2026 gene encodes a VGAM2026 precursor RNA, herein designated VGAM PRECURSOR RNA. Similar to other miRNA genes, and unlike most ordinary genes, VGAM2026 precursor RNA does not encode a protein. A nucleotide sequence identical or highly similar to the nucleotide sequence of VGAM2026 precursor RNA is designated SEQ ID:2012, and is provided hereinbelow with reference to the sequence listing part. Nucleotide sequence SEQ ID:2012 is located at position 18253 relative to the genome of Zaire Ebola Virus (ZEBOV).

VGAM2026 precursor RNA folds onto itself, forming VGAM2026 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2026 folded precursor RNA into VGAM2026 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2026 RNA is designated SEQ ID:4737, and is provided hereinbelow with reference to the sequence listing part.

VGAM2026 host target gene, herein designated VGAM HOST TARGET GENE, encodes a corresponding messenger RNA, VGAM2026 host target RNA, herein designated VGAM HOST TARGET RNA. VGAM2026 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2026 RNA, herein designated VGAM RNA, binds complementarily to one or more host target binding sites located in untranslated regions of VGAM2026 host target RNA, herein designated VGAM HOST TARGET RNA. This complementary binding is due to the fact that the nucleotide sequence of VGAM2026 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2026 RNA, herein designated VGAM RNA, may have a different number of host target binding sites in untranslated regions of a VGAM2026 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2026 RNA, herein designated VGAM RNA, to host target binding sites on VGAM2026 host target RNA, herein designated VGAM HOST TARGET RNA, such as BINDING SITE I, BINDING SITE II and BINDING SITE III, inhibits translation of VGAM2026 host target RNA into VGAM2026 host target protein, herein designated VGAM HOST TARGET PROTEIN. VGAM host target protein is therefore outlined by a broken line.

It is appreciated that VGAM2026 host target gene, herein designated VGAM HOST TARGET GENE, in fact represents a plurality of VGAM2026 host target genes. The mRNA of each one of this plurality of VGAM2026 host target genes comprises one or more host target binding sites, each having a nucleotide sequence which is at least partly complementary to VGAM2026 RNA, herein designated VGAM RNA, and which when bound by VGAM2026 RNA causes inhibition of translation of respective one or more VGAM2026 host target proteins.

It is further appreciated by one skilled in the art that the mode of translational inhibition illustrated by FIG. 1 with specific reference to translational inhibition exerted by VGAM2026 gene, herein designated VGAM GENE, on one or more VGAM2026 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2026 is inhibition of expression of host target genes, as part of a novel viral mechanism of attacking a host. Accordingly, utilities of VGAM2026 include diagnosis, prevention and treatment of viral infection by Zaire Ebola Virus (ZEBOV). Specific functions, and accordingly utilities, of VGAM2026 correlate with, and may be deduced from, the identity of the host target genes which VGAM2026 binds and inhibits, and the function of these host target genes, as elaborated hereinbelow.

Nucleotide sequences of the VGAM2026 precursor RNA, herein designated VGAM PRECURSOR RNA, and of the 'diced' VGAM2026 RNA, herein designated VGAM RNA, and a schematic representation of the secondary folding of VGAM2026 folded precursor RNA, herein designated VGAM FOLDED PRECURSOR RNA, of VGAM2026 are further described hereinbelow with reference to Table 1.

Nucleotide sequences of host target binding sites, such as BINDING SITE-I, BINDING SITE-II and BINDING SITE- III of FIG. 1, found on VGAM2026 host target RNA, and schematic representation of the complementarity of each of these host target binding sites to VGAM2026 RNA, herein designated VGAM RNA, are described hereinbelow with reference to Table 2.

As mentioned hereinabove with reference to FIG. 1, a function of VGAM2026 gene, herein designated VGAM is inhibition of expression of VGAM2026 target genes. It is appreciated that specific functions, and accordingly utilities, of VGAM2026 correlate with, and may be deduced from, the identity of the target genes which VGAM2026 binds and inhibits, and the function of these target genes, as elaborated hereinbelow.

Lysophospholipase I (LYPLA1, Accession NM_006330) is a VGAM2026 host target gene. LYPLA1 BINDING SITE is HOST TARGET binding site found in the 3' untranslated region of mRNA encoded by LYPLA1, corresponding to a HOST TARGET binding site such as BINDING SITE I, BINDING SITE II or BINDING SITE III. Table 2 illustrates the complementarity of the nucleotide sequences of LYPLA1 BINDING SITE, designated SEQ ID:13029, to the nucleotide sequence of VGAM2026 RNA, herein designated VGAM RNA, also designated SEQ ID:4737.

A function of VGAM2026 is therefore inhibition of Lysophospholipase I (LYPLA1, Accession NM_006330). Accordingly, utilities of VGAM2026 include diagnosis, prevention and treatment of diseases and clinical conditions associated with LYPLA1. BM-002 (Accession NM_016617) is another VGAM2026 host target gene. BM-002 BINDING SITE is HOST TARGET binding site found in the 3' untranslated region of mRNA encoded by BM-002, corresponding to a HOST TARGET binding site such as BINDING SITE I, BINDING SITE II or BINDING SITE III. Table 2 illustrates the complementarity of the nucleotide sequences of BM-002 BINDING SITE, designated SEQ ID:18727, to the nucleotide sequence of VGAM2026 RNA, herein designated VGAM RNA, also designated SEQ ID:4737.

Another function of VGAM2026 is therefore inhibition of BM-002 (Accession NM_016617). Accordingly, utilities of VGAM2026 include diagnosis, prevention and treatment of diseases and clinical conditions associated with BM-002. DKFZP564I052 (Accession XM_039660) is another VGAM2026 host target gene. DKFZP564I052 BINDING SITE is HOST TARGET binding site found in the 3' untranslated region of mRNA encoded by DKFZP564I052, corresponding to a HOST TARGET binding site such as BINDING SITE I, BINDING SITE II or BINDING SITE III. Table 2 illustrates the complementarity of the nucleotide sequences of DKFZP564I052 BINDING SITE, designated SEQ ID:33139, to the nucleotide sequence of VGAM2026 RNA, herein designated VGAM RNA, also designated SEQ ID:4737.

Another function of VGAM2026 is therefore inhibition of DKFZP564I052 (Accession XM_039660). Accordingly, utilities of VGAM2026 include diagnosis, prevention and treatment of diseases and clinical conditions associated with DKFZP564I052. Erythroblast Membrane-associated Protein (ERMAP, Accession NM_018538) is another VGAM2026 host target gene. ERMAP BINDING SITE is HOST TARGET binding site found in the 3' untranslated region of mRNA encoded by ERMAP, corresponding to a HOST TARGET binding site such as BINDING SITE I, BINDING SITE II or BINDING SITE III. Table 2 illustrates the complementarity of the nucleotide sequences of ERMAP BINDING SITE, designated SEQ ID:20610, to the nucleotide sequence of VGAM2026 RNA, herein designated VGAM RNA, also designated SEQ ID:4737.

Another function of VGAM2026 is therefore inhibition of Erythroblast Membrane-associated Protein (ERMAP, Accession NM_018538). Accordingly, utilities of VGAM2026 include diagnosis, prevention and treatment of diseases and clinical conditions associated with ERMAP. FLJ13441 (Accession NM_023924) is another VGAM2026 host target gene. FLJ13441 BINDING SITE is HOST TARGET binding site found in the 5' untranslated region of mRNA encoded by FLJ13441, corresponding to a HOST TARGET binding site such as BINDING SITE I, BINDING SITE II or BINDING SITE III. Table 2 illustrates the complementarity of the nucleotide sequences of FLJ13441 BINDING SITE, designated SEQ ID:23400, to the nucleotide sequence of VGAM2026 RNA, herein designated VGAM RNA, also designated SEQ ID:4737.

Another function of VGAM2026 is therefore inhibition of FLJ13441 (Accession NM_023924). Accordingly, utilities of VGAM2026 include diagnosis, prevention and treatment of diseases and clinical conditions associated with FLJ13441. FLJ14751 (Accession NM_032834) is another VGAM2026 host target gene. FLJ14751 BINDING SITE is HOST TARGET binding site found in the 3' untranslated region of mRNA encoded by FLJ14751, corresponding to a HOST TARGET binding site such as BINDING SITE I, BINDING SITE II or BINDING SITE III. Table 2 illustrates the complementarity of the nucleotide sequences of FLJ14751 BINDING SITE, designated SEQ ID:26610, to the nucleotide sequence of VGAM2026 RNA, herein designated VGAM RNA, also designated SEQ ID:4737.

Another function of VGAM2026 is therefore inhibition of FLJ14751 (Accession NM_032834). Accordingly, utilities of VGAM2026 include diagnosis, prevention and treatment of diseases and clinical conditions associated with FLJ14751. NAG14 (Accession NM_022143) is another VGAM2026 host target gene. NAG14 BINDING SITE is HOST TARGET binding site found in the 3' untranslated region of mRNA encoded by NAG14, corresponding to a HOST TARGET binding site such as BINDING SITE I, BINDING SITE II or BINDING SITE III. Table 2 illustrates the complementarity of the nucleotide sequences of NAG14 BINDING SITE, designated SEQ ID:22707, to the nucleotide sequence of VGAM2026 RNA, herein designated VGAM RNA, also designated SEQ ID:4737.

Another function of VGAM2026 is therefore inhibition of NAG14 (Accession NM_022143). Accordingly, utilities of VGAM2026 include diagnosis, prevention and treatment of diseases and clinical conditions associated with NAG14. N-ethylmaleimide-sensitive Factor Attachment Protein, Gamma (NAPG, Accession XM_172983) is another VGAM2026 host target gene. NAPG BINDING SITE is HOST TARGET binding site found in the 3' untranslated region of mRNA encoded by NAPG, corresponding to a HOST TARGET binding site such as BINDING SITE I, BINDING SITE II or BINDING SITE III. Table 2 illustrates the complementarity of the nucleotide sequences of NAPG BINDING SITE, designated SEQ ID:46252, to the nucleotide sequence of VGAM2026 RNA, herein designated VGAM RNA, also designated SEQ ID:4737.

Another function of VGAM2026 is therefore inhibition of N-ethylmaleimide-sensitive Factor Attachment Protein, Gamma (NAPG, Accession XM_172983). Accordingly, utilities of VGAM2026 include diagnosis, prevention and treatment of diseases and clinical conditions associated with NAPG. LOC91115 (Accession XM_036218) is another VGAM2026 host target gene. LOC91115 BINDING SITE is HOST TARGET binding site found in the 3' untranslated region of mRNA encoded by LOC91115, corresponding to a HOST TARGET binding site such as BINDING SITE I, BINDING SITE II or BINDING SITE III. Table 2 illustrates the complementarity of the nucleotide sequences of LOC91115 BINDING SITE, designated SEQ ID:32398, to the nucleotide sequence of VGAM2026 RNA, herein designated VGAM RNA, also designated SEQ ID:4737.

Another function of VGAM2026 is therefore inhibition of LOC91115 (Accession XM_036218). Accordingly, utilities of VGAM2026 include diagnosis, prevention and treatment of diseases and clinical conditions associated with LOC91115. FIG. 1 further provides a conceptual description of a novel bioinformatically detected viral gene of the present invention, referred to here as Viral Genomic Address Messenger 2027 (VGAM2027) viral gene, which modulates expression of respective host target genes thereof, the function and utility of which host target genes is known in the art.

VGAM2027 is a novel bioinformatically detected regulatory, non protein coding, viral micro RNA (miRNA) gene. The method by which VGAM2027 was detected is described hereinabove with reference to FIGS. 1-8.

VGAM2027 gene, herein designated VGAM GENE, is a viral gene contained in the genome of Kyuri Green Mottle Mosaic Virus. VGAM2027 host target gene, herein designated VGAM HOST TARGET GENE, is a human gene contained in the human genome.

VGAM2027 gene encodes a VGAM2027 precursor RNA, herein designated VGAM PRECURSOR RNA. Similar to other miRNA genes, and unlike most ordinary genes, VGAM2027 precursor RNA does not encode a protein. A nucleotide sequence identical or highly similar to the nucleotide sequence of VGAM2027 precursor RNA is designated SEQ ID:2013, and is provided hereinbelow with reference to the sequence listing part. Nucleotide sequence SEQ ID:2013 is located at position 4198 relative to the genome of Kyuri Green Mottle Mosaic Virus.

VGAM2027 precursor RNA folds onto itself, forming VGAM2027 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2027 folded precursor RNA into VGAM2027 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2027 RNA is designated SEQ ID:4738, and is provided hereinbelow with reference to the sequence listing part.

VGAM2027 host target gene, herein designated VGAM HOST TARGET GENE, encodes a corresponding messenger RNA, VGAM2027 host target RNA, herein designated VGAM HOST TARGET RNA. VGAM2027 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2027 RNA, herein designated VGAM RNA, binds complementarily to one or more host target binding sites located in untranslated regions of VGAM2027 host target RNA, herein designated VGAM HOST TARGET RNA. This complementary binding is due to the fact that the nucleotide sequence of VGAM2027 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2027 RNA, herein designated VGAM RNA, may have a different number of host target binding sites in untranslated regions of a VGAM2027 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2027 RNA, herein designated VGAM RNA, to host target binding sites on VGAM2027 host target RNA, herein designated VGAM HOST TARGET RNA, such as BINDING SITE I, BINDING SITE II and BINDING SITE III, inhibits translation of VGAM2027 host target RNA into VGAM2027 host target protein, herein designated VGAM HOST TARGET PROTEIN. VGAM host target protein is therefore outlined by a broken line.

It is appreciated that VGAM2027 host target gene, herein designated VGAM HOST TARGET GENE, in fact represents a plurality of VGAM2027 host target genes. The mRNA of each one of this plurality of VGAM2027 host target genes comprises one or more host target binding sites, each having a nucleotide sequence which is at least partly complementary to VGAM2027 RNA, herein designated VGAM RNA, and which when bound by VGAM2027 RNA causes inhibition of translation of respective one or more VGAM2027 host target proteins.

It is further appreciated by one skilled in the art that the mode of translational inhibition illustrated by FIG. 1 with specific reference to translational inhibition exerted by VGAM2027 gene, herein designated VGAM GENE, on one or more VGAM2027 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2027 is inhibition of expression of host target genes, as part of a novel viral mechanism of attacking a host. Accordingly, utilities of VGAM2027 include diagnosis, prevention and treatment of viral infection by Kyuri Green Mottle Mosaic Virus. Specific functions, and accordingly utilities, of VGAM2027 correlate with, and may be deduced from, the identity of the host target genes which VGAM2027 binds and inhibits, and the function of these host target genes, as elaborated hereinbelow.

Nucleotide sequences of the VGAM2027 precursor RNA, herein designated VGAM PRECURSOR RNA, and of the 'diced' VGAM2027 RNA, herein designated VGAM RNA, and a schematic representation of the secondary folding of VGAM2027 folded precursor RNA, herein designated VGAM FOLDED PRECURSOR RNA, of VGAM2027 are further described hereinbelow with reference to Table 1.

Nucleotide sequences of host target binding sites, such as BINDING SITE-I, BINDING SITE-II and BINDING SITE-III of FIG. 1, found on VGAM2027 host target RNA, and schematic representation of the complementarity of each of these host target binding sites to VGAM2027 RNA, herein designated VGAM RNA, are described hereinbelow with reference to Table 2.

As mentioned hereinabove with reference to FIG. 1, a function of VGAM2027 gene, herein designated VGAM is inhibition of expression of VGAM2027 target genes. It is appreciated that specific functions, and accordingly utilities, of VGAM2027 correlate with, and may be deduced from, the identity of the target genes which VGAM2027 binds and inhibits, and the function of these target genes, as elaborated hereinbelow.

FLJ13769 (Accession NM_025012) is a VGAM2027 host target gene. FLJ13769 BINDING SITE is HOST TARGET binding site found in the 3' untranslated region of mRNA encoded by FLJ13769, corresponding to a HOST TARGET binding site such as BINDING SITE I, BINDING SITE II or BINDING SITE III. Table 2 illustrates the complementarity of the nucleotide sequences of FLJ13769 BINDING SITE, designated SEQ ID:24589, to the nucleotide sequence of VGAM2027 RNA, herein designated VGAM RNA, also designated SEQ ID:4738.

A function of VGAM2027 is therefore inhibition of FLJ13769 (Accession NM_025012). Accordingly, utilities of VGAM2027 include diagnosis, prevention and treatment of diseases and clinical conditions associated with FLJ13769. FIG. 1 further provides a conceptual description of a novel bioinformatically detected viral gene of the present invention, referred to here as Viral Genomic Address Messenger 2028 (VGAM2028) viral gene, which modulates expression of respective host target genes thereof, the function and utility of which host target genes is known in the art.

VGAM2028 is a novel bioinformatically detected regulatory, non protein coding, viral micro RNA (miRNA) gene. The method by which VGAM2028 was detected is described hereinabove with reference to FIGS. 1-8.

VGAM2028 gene, herein designated VGAM GENE, is a viral gene contained in the genome of Zaire Ebola Virus (ZEBOV). VGAM2028 host target gene, herein designated VGAM HOST TARGET GENE, is a human gene contained in the human genome.

VGAM2028 gene encodes a VGAM2028 precursor RNA, herein designated VGAM PRECURSOR RNA. Similar to other miRNA genes, and unlike most ordinary genes, VGAM2028 precursor RNA does not encode a protein. A nucleotide sequence identical or highly similar to the nucleotide sequence of VGAM2028 precursor RNA is designated SEQ ID:2014, and is provided hereinbelow with reference to the sequence listing part. Nucleotide sequence SEQ ID:2014 is located at position 16037 relative to the genome of Zaire Ebola Virus (ZEBOV).

VGAM2028 precursor RNA folds onto itself, forming VGAM2028 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2028 folded precursor RNA into VGAM2028 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM2028 RNA is designated SEQ ID:4739, and is provided hereinbelow with reference to the sequence listing part.

VGAM2028 host target gene, herein designated VGAM HOST TARGET GENE, encodes a corresponding messenger RNA, VGAM2028 host target RNA, herein designated VGAM HOST TARGET RNA. VGAM2028 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2028 RNA, herein designated VGAM RNA, binds complementarily to one or more host target binding sites located in untranslated regions of VGAM2028 host target RNA, herein designated VGAM HOST TARGET RNA. This complementary binding is due to the fact that the nucleotide sequence of VGAM2028 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2028 RNA, herein designated VGAM RNA, may have a different number of host target binding sites in untranslated regions of a VGAM2028 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2028 RNA, herein designated VGAM RNA, to host target binding sites on VGAM2028 host target RNA, herein designated VGAM HOST TARGET RNA, such as BINDING SITE I, BINDING SITE II and BINDING SITE III, inhibits translation of VGAM2028 host target RNA into VGAM2028 host target protein, herein designated VGAM HOST TARGET PROTEIN. VGAM host target protein is therefore outlined by a broken line.

It is appreciated that VGAM2028 host target gene, herein designated VGAM HOST TARGET GENE, in fact represents a plurality of VGAM2028 host target genes. The mRNA of each one of this plurality of VGAM2028 host target genes comprises one or more host target binding sites, each having a nucleotide sequence which is at least partly complementary to VGAM2028 RNA, herein designated VGAM RNA, and which when bound by VGAM2028 RNA causes inhibition of translation of respective one or more VGAM2028 host target proteins.

It is further appreciated by one skilled in the art that the mode of translational inhibition illustrated by FIG. 1 with specific reference to translational inhibition exerted by VGAM2028 gene, herein designated VGAM GENE, on one or more VGAM2028 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let- 7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2028 is inhibition of expression of host target genes, as part of a novel viral mechanism of attacking a host. Accordingly, utilities of VGAM2028 include diagnosis, prevention and treatment of viral infection by Zaire Ebola Virus (ZEBOV). Specific functions, and accordingly utilities, of VGAM2028 correlate with, and may be deduced from, the identity of the host target genes which VGAM2028 binds and inhibits, and the function of these host target genes, as elaborated hereinbelow.

Nucleotide sequences of the VGAM2028 precursor RNA, herein designated VGAM PRECURSOR RNA, and of the 'diced' VGAM2028 RNA, herein designated VGAM RNA, and a schematic representation of the secondary folding of VGAM2028 folded precursor RNA, herein designated VGAM FOLDED PRECURSOR RNA, of VGAM2028 are further described hereinbelow with reference to Table 1.

Nucleotide sequences of host target binding sites, such as BINDING SITE-I, BINDING SITE-II and BINDING SITE-III of FIG. 1, found on VGAM2028 host target RNA, and schematic representation of the complementarity of each of these host target binding sites to VGAM2028 RNA, herein designated VGAM RNA, are described hereinbelow with reference to Table 2.

As mentioned hereinabove with reference to FIG. 1, a function of VGAM2028 gene, herein designated VGAM is inhibition of expression of VGAM2028 target genes. It is appreciated that specific functions, and accordingly utilities, of VGAM2028 correlate with, and may be deduced from, the identity of the target genes which VGAM2028 binds and inhibits, and the function of these target genes, as elaborated hereinbelow.

Hypermethylated In Cancer 2 (HIC2, Accession XM_036937) is a VGAM2028 host target gene. HIC2 BINDING SITE is HOST TARGET binding site found in the 3' untranslated region of mRNA encoded by HIC2, corresponding to a HOST TARGET binding site such as BINDING SITE I, BINDING SITE II or BINDING SITE III. Table 2 illustrates the complementarity of the nucleotide sequences of HIC2 BINDING SITE, designated SEQ ID:32527, to the nucleotide sequence of VGAM2028 RNA, herein designated VGAM RNA, also designated SEQ ID:4739.

A function of VGAM2028 is therefore inhibition of Hypermethylated In Cancer 2 (HIC2, Accession XM_036937). Accordingly, utilities of VGAM2028 include diagnosis, prevention and treatment of diseases and clinical conditions associated with HIC2. FIG. 1 further provides a conceptual description of a novel bioinformatically detected viral gene of the present invention, referred to here as Viral Genomic Address Messenger 2029 (VGAM2029) viral gene, which modulates expression of respective host target genes thereof, the function and utility of which host target genes is known in the art.

VGAM2029 is a novel bioinformatically detected regulatory, non protein coding, viral micro RNA (miRNA) gene. The method by which VGAM2029 was detected is described hereinabove with reference to FIGS. 1-8.

VGAM2029 gene, herein designated VGAM GENE, is a viral gene contained in the genome of Zaire Ebola Virus (ZEBOV). VGAM2029 host target gene, herein designated VGAM HOST TARGET GENE, is a human gene contained in the human genome.

VGAM2029 gene encodes a VGAM2029 precursor RNA, herein designated VGAM PRECURSOR RNA. Similar to other miRNA genes, and unlike most ordinary genes, VGAM2029 precursor RNA does not encode a protein. A nucleotide sequence identical or highly similar to the nucleotide sequence of VGAM2029 precursor RNA is designated SEQ ID:2015, and is provided hereinbelow with reference to the sequence listing part. Nucleotide sequence SEQ ID:2015 is located at position 17355 relative to the genome of Zaire Ebola Virus (ZEBOV).

VGAM2029 precursor RNA folds onto itself, forming VGAM2029 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2029 folded precursor RNA into VGAM2029 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2029 RNA is designated SEQ ID:4740, and is provided hereinbelow with reference to the sequence listing part.

VGAM2029 host target gene, herein designated VGAM HOST TARGET GENE, encodes a corresponding messenger RNA, VGAM2029 host target RNA, herein designated VGAM HOST TARGET RNA. VGAM2029 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2029 RNA, herein designated VGAM RNA, binds complementarily to one or more host target binding sites located in untranslated regions of VGAM2029 host target RNA, herein designated VGAM HOST TARGET RNA. This complementary binding is due to the fact that the nucleotide sequence of VGAM2029 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2029 RNA, herein designated VGAM RNA, may have a different number of host target binding sites in untranslated regions of a VGAM2029 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2029 RNA, herein designated VGAM RNA, to host target binding sites on VGAM2029 host target RNA, herein designated VGAM HOST TARGET RNA, such as BINDING SITE I, BINDING SITE II and BINDING SITE III, inhibits translation of VGAM2029 host target RNA into VGAM2029 host target protein, herein designated VGAM HOST TARGET PROTEIN. VGAM host target protein is therefore outlined by a broken line.

It is appreciated that VGAM2029 host target gene, herein designated VGAM HOST TARGET GENE, in fact represents a plurality of VGAM2029 host target genes. The mRNA of each one of this plurality of VGAM2029 host target genes comprises one or more host target binding sites, each having a nucleotide sequence which is at least partly complementary to VGAM2029 RNA, herein designated VGAM RNA, and which when bound by VGAM2029 RNA causes inhibition of translation of respective one or more VGAM2029 host target proteins.

It is further appreciated by one skilled in the art that the mode of translational inhibition illustrated by FIG. 1 with specific reference to translational inhibition exerted by VGAM2029 gene, herein designated VGAM GENE, on one or more VGAM2029 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2029 is inhibition of expression of host target genes, as part of a novel viral mechanism of attacking a host. Accordingly, utilities of VGAM2029 include diagnosis, prevention and treatment of viral infection by Zaire Ebola Virus (ZEBOV). Specific functions, and accordingly utilities, of VGAM2029 correlate with, and may be deduced from, the identity of the host target genes which VGAM2029 binds and inhibits, and the function of these host target genes, as elaborated hereinbelow.

Nucleotide sequences of the VGAM2029 precursor RNA, herein designated VGAM PRECURSOR RNA, and of the 'diced' VGAM2029 RNA, herein designated VGAM RNA, and a schematic representation of the secondary folding of VGAM2029 folded precursor RNA, herein designated VGAM FOLDED PRECURSOR RNA, of VGAM2029 are further described hereinbelow with reference to Table 1.

Nucleotide sequences of host target binding sites, such as BINDING SITE-I, BINDING SITE-II and BINDING SITE-III of FIG. 1, found on VGAM2029 host target RNA, and schematic representation of the complementarity of each of these host target binding sites to VGAM2029 RNA, herein designated VGAM RNA, are described hereinbelow with reference to Table 2.

As mentioned hereinabove with reference to FIG. 1, a function of VGAM2029 gene, herein designated VGAM is inhibition of expression of VGAM2029 target genes. It is appreciated that specific functions, and accordingly utilities, of VGAM2029 correlate with, and may be deduced from, the identity of the target genes which VGAM2029 binds and inhibits, and the function of these target genes, as elaborated hereinbelow.

Heparanase (HPSE, Accession NM_006665) is a VGAM2029 host target gene. HPSE BINDING SITE is HOST TARGET binding site found in the 3' untranslated region of mRNA encoded by HPSE, corresponding to a HOST TARGET binding site such as BINDING SITE I, BINDING SITE II or BINDING SITE III. Table 2 illustrates the complementarity of the nucleotide sequences of HPSE BINDING SITE, designated SEQ ID:13479, to the nucleotide sequence of VGAM2029 RNA, herein designated VGAM RNA, also designated SEQ ID:4740.

A function of VGAM2029 is therefore inhibition of Heparanase (HPSE, Accession NM_006665), a gene which is an endoglycosidase that cleaves heparan sulfate. Accordingly, utilities of VGAM2029 include diagnosis, prevention and treatment of diseases and clinical conditions associated with HPSE. The function of HPSE and its association with various diseases and clinical conditions, has been established by previous studies, as described hereinabove with reference to VGAM374. DAMS (Accession NM_022001) is another VGAM2029 host target gene. DAMS BINDING SITE is HOST TARGET binding site found in the 5' untranslated region of mRNA encoded by DAMS, corresponding to a HOST TARGET binding site such as BINDING SITE I, BINDING SITE II or BINDING SITE III. Table 2 illustrates the complementarity of the nucleotide sequences of DAMS BINDING SITE, designated SEQ ID:22542, to the nucleotide sequence of VGAM2029 RNA, herein designated VGAM RNA, also designated SEQ ID:4740.

Another function of VGAM2029 is therefore inhibition of DAMS (Accession NM_022001). Accordingly, utilities of VGAM2029 include diagnosis, prevention and treatment of diseases and clinical conditions associated with DAMS. FLJ13262 (Accession NM_024914) is another VGAM2029 host target gene. FLJ13262 BINDING SITE is HOST TARGET binding site found in the 3' untranslated region of mRNA encoded by FLJ13262, corresponding to a HOST TARGET binding site such as BINDING SITE I, BINDING SITE II or BINDING SITE III. Table 2 illustrates the complementarity of the nucleotide sequences of FLJ13262 BINDING SITE, designated SEQ ID:24434, to the nucleotide sequence of VGAM2029 RNA, herein designated VGAM RNA, also designated SEQ ID:4740.

Another function of VGAM2029 is therefore inhibition of FLJ13262 (Accession NM_024914). Accordingly, utilities of VGAM2029 include diagnosis, prevention and treatment of diseases and clinical conditions associated with FLJ13262. SFRS Protein Kinase 1 (SRPK1, Accession NM_003137) is another VGAM2029 host target gene. SRPK1 BINDING SITE is HOST TARGET binding site found in the 3' untranslated region of mRNA encoded by SRPK1, corresponding to a HOST TARGET binding site such as BINDING SITE I, BINDING SITE II or BINDING SITE III. Table 2 illustrates the complementarity of the nucleotide sequences of SRPK1 BINDING SITE, designated SEQ ID:9108, to the nucleotide sequence of VGAM2029 RNA, herein designated VGAM RNA, also designated SEQ ID:4740.

Another function of VGAM2029 is therefore inhibition of SFRS Protein Kinase 1 (SRPK1, Accession NM_003137). Accordingly, utilities of VGAM2029 include diagnosis, prevention and treatment of diseases and clinical conditions associated with SRPK1. FIG. 1 further provides a conceptual description of a novel bioinformatically detected viral gene of the present invention, referred to here as Viral Genomic Address Messenger 2030 (VGAM2030) viral gene, which modulates expression of respective host target genes thereof, the function and utility of which host target genes is known in the art.

VGAM2030 is a novel bioinformatically detected regulatory, non protein coding, viral micro RNA (miRNA) gene. The method by which VGAM2030 was detected is described hereinabove with reference to FIGS. 1-8.

VGAM2030 gene, herein designated VGAM GENE, is a viral gene contained in the genome of Zaire Ebola Virus (ZEBOV). VGAM2030 host target gene, herein designated VGAM HOST TARGET GENE, is a human gene contained in the human genome.

VGAM2030 gene encodes a VGAM2030 precursor RNA, herein designated VGAM PRECURSOR RNA. Similar to other miRNA genes, and unlike most ordinary genes, VGAM2030 precursor RNA does not encode a protein. A nucleotide sequence identical or highly similar to the nucleotide sequence of VGAM2030 precursor RNA is designated SEQ ID:2016, and is provided hereinbelow with reference to the sequence listing part. Nucleotide sequence SEQ ID:2016 is located at position 12693 relative to the genome of Zaire Ebola Virus (ZEBOV).

VGAM2030 precursor RNA folds onto itself, forming VGAM2030 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2030 folded precursor RNA into VGAM2030 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2030 RNA is designated SEQ ID:4741, and is provided hereinbelow with reference to the sequence listing part.

VGAM2030 host target gene, herein designated VGAM HOST TARGET GENE, encodes a corresponding messenger RNA, VGAM2030 host target RNA, herein designated VGAM HOST TARGET RNA. VGAM2030 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2030 RNA, herein designated VGAM RNA, binds complementarily to one or more host target binding sites located in untranslated regions of VGAM2030 host target RNA, herein designated VGAM HOST TARGET RNA. This complementary binding is due to the fact that the nucleotide sequence of VGAM2030 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2030 RNA, herein designated VGAM RNA, may have a different number of host target binding sites in untranslated regions of a VGAM2030 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2030 RNA, herein designated VGAM RNA, to host target binding sites on VGAM2030 host target RNA, herein designated VGAM HOST TARGET RNA, such as BINDING SITE I, BINDING SITE II and BINDING SITE III, inhibits translation of VGAM2030 host target RNA into VGAM2030 host target protein, herein designated VGAM HOST TARGET PROTEIN. VGAM host target protein is therefore outlined by a broken line.

It is appreciated that VGAM2030 host target gene, herein designated VGAM HOST TARGET GENE, in fact represents a plurality of VGAM2030 host target genes. The mRNA of each one of this plurality of VGAM2030 host target genes comprises one or more host target binding sites, each having a nucleotide sequence which is at least partly complementary to VGAM2030 RNA, herein designated VGAM RNA, and which when bound by VGAM2030 RNA causes inhibition of translation of respective one or more VGAM2030 host target proteins.

It is further appreciated by one skilled in the art that the mode of translational inhibition illustrated by FIG. 1 with specific reference to translational inhibition exerted by VGAM2030 gene, herein designated VGAM GENE, on one or more VGAM2030 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2030 is inhibition of expression of host target genes, as part of a novel viral mechanism of attacking a host. Accordingly, utilities of VGAM2030 include diagnosis, prevention and treatment of viral infection by Zaire Ebola Virus (ZEBOV). Specific functions, and accordingly utilities, of VGAM2030 correlate with, and may be deduced from, the identity of the host target genes which VGAM2030 binds and inhibits, and the function of these host target genes, as elaborated hereinbelow.

Nucleotide sequences of the VGAM2030 precursor RNA, herein designated VGAM PRECURSOR RNA, and of the 'diced' VGAM2030 RNA, herein designated VGAM RNA, and a schematic representation of the secondary folding of VGAM2030 folded precursor RNA, herein designated VGAM FOLDED PRECURSOR RNA, of VGAM2030 are further described hereinbelow with reference to Table 1.

Nucleotide sequences of host target binding sites, such as BINDING SITE-I, BINDING SITE-II and BINDING SITE-III of FIG. 1, found on VGAM2030 host target RNA, and schematic representation of the complementarity of each of these host target binding sites to VGAM2030 RNA, herein designated VGAM RNA, are described hereinbelow with reference to Table 2.

As mentioned hereinabove with reference to FIG. 1, a function of VGAM2030 gene, herein designated VGAM is inhibition of expression of VGAM2030 target genes. It is appreciated that specific functions, and accordingly utilities, of VGAM2030 correlate with, and may be deduced from, the identity of the target genes which VGAM2030 binds and inhibits, and the function of these target genes, as elaborated hereinbelow.

Pleiomorphic Adenoma Gene 1 (PLAG1, Accession NM_002655) is a VGAM2030 host target gene. PLAG1 BINDING SITE is HOST TARGET binding site found in the 3' untranslated region of mRNA encoded by PLAG1, corresponding to a HOST TARGET binding site such as BIND- ING SITE I, BINDING SITE II or BINDING SITE III. Table 2 illustrates the complementarity of the nucleotide sequences of PLAG1 BINDING SITE, designated SEQ ID:8524, to the nucleotide sequence of VGAM2030 RNA, herein designated VGAM RNA, also designated SEQ ID:4741.

A function of VGAM2030 is therefore inhibition of Pleiomorphic Adenoma Gene 1 (PLAG1, Accession NM_002655), a gene which contains a zinc finger domain. Accordingly, utilities of VGAM2030 include diagnosis, prevention and treatment of diseases and clinical conditions associated with PLAG1. The function of PLAG1 and its association with various diseases and clinical conditions, has been established by previous studies, as described hereinabove with reference to VGAM29. Oxysterol Binding Protein-like 8 (OSBPL8, Accession NM_020841) is another VGAM2030 host target gene. OSBPL8 BINDING SITE is HOST TARGET binding site found in the 3' untranslated region of mRNA encoded by OSBPL8, corresponding to a HOST TARGET binding site such as BINDING SITE I, BINDING SITE II or BINDING SITE III. Table 2 illustrates the complementarity of the nucleotide sequences of OSBPL8 BINDING SITE, designated SEQ ID:21907, to the nucleotide sequence of VGAM2030 RNA, herein designated VGAM RNA, also designated SEQ ID:4741.

Another function of VGAM2030 is therefore inhibition of Oxysterol Binding Protein-like 8 (OSBPL8, Accession NM_020841). Accordingly, utilities of VGAM2030 include diagnosis, prevention and treatment of diseases and clinical conditions associated with OSBPL8. FIG. 1 further provides a conceptual description of a novel bioinformatically detected viral gene of the present invention, referred to here as Viral Genomic Address Messenger 2031 (VGAM2031) viral gene, which modulates expression of respective host target genes thereof, the function and utility of which host target genes is known in the art.

VGAM2031 is a novel bioinformatically detected regulatory, non protein coding, viral micro RNA (miRNA) gene. The method by which VGAM2031 was detected is described hereinabove with reference to FIGS. 1-8.

VGAM2031 gene, herein designated VGAM GENE, is a viral gene contained in the genome of Zaire Ebola Virus (ZEBOV). VGAM2031 host target gene, herein designated VGAM HOST TARGET GENE, is a human gene contained in the human genome.

VGAM2031 gene encodes a VGAM2031 precursor RNA, herein designated VGAM PRECURSOR RNA. Similar to other miRNA genes, and unlike most ordinary genes, VGAM2031 precursor RNA does not encode a protein. A nucleotide sequence identical or highly similar to the nucleotide sequence of VGAM2031 precursor RNA is designated SEQ ID:2017, and is provided hereinbelow with reference to the sequence listing part. Nucleotide sequence SEQ ID:2017 is located at position 9873 relative to the genome of Zaire Ebola Virus (ZEBOV).

VGAM2031 precursor RNA folds onto itself, forming VGAM2031 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2031 folded precursor RNA into VGAM2031 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM2031 RNA is designated SEQ ID:4742, and is provided hereinbelow with reference to the sequence listing part.

VGAM2031 host target gene, herein designated VGAM HOST TARGET GENE, encodes a corresponding messenger RNA, VGAM2031 host target RNA, herein designated VGAM HOST TARGET RNA. VGAM2031 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2031 RNA, herein designated VGAM RNA, binds complementarily to one or more host target binding sites located in untranslated regions of VGAM2031 host target RNA, herein designated VGAM HOST TARGET RNA. This complementary binding is due to the fact that the nucleotide sequence of VGAM2031 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2031 RNA, herein designated VGAM RNA, may have a different number of host target binding sites in untranslated regions of a VGAM2031 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2031 RNA, herein designated VGAM RNA, to host target binding sites on VGAM2031 host target RNA, herein designated VGAM HOST TARGET RNA, such as BINDING SITE I, BINDING SITE II and BINDING SITE III, inhibits translation of VGAM2031 host target RNA into VGAM2031 host target protein, herein designated VGAM HOST TARGET PROTEIN. VGAM host target protein is therefore outlined by a broken line.

It is appreciated that VGAM2031 host target gene, herein designated VGAM HOST TARGET GENE, in fact represents a plurality of VGAM2031 host target genes. The mRNA of each one of this plurality of VGAM2031 host target genes comprises one or more host target binding sites, each having a nucleotide sequence which is at least partly complementary to VGAM2031 RNA, herein designated VGAM RNA, and which when bound by VGAM2031 RNA causes inhibition of translation of respective one or more VGAM2031 host target proteins.

It is further appreciated by one skilled in the art that the mode of translational inhibition illustrated by FIG. 1 with specific reference to translational inhibition exerted by VGAM2031 gene, herein designated VGAM GENE, on one or more VGAM2031 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2031 is inhibition of expression of host target genes, as part of a novel viral mechanism of attacking a host. Accordingly, utilities of VGAM2031 include diagnosis, prevention and treatment of viral infection by Zaire Ebola Virus (ZEBOV). Specific functions, and accordingly utilities, of VGAM2031 correlate with, and may be deduced from, the identity of the host target genes which VGAM2031 binds and inhibits, and the function of these host target genes, as elaborated hereinbelow.

Nucleotide sequences of the VGAM2031 precursor RNA, herein designated VGAM PRECURSOR RNA, and of the 'diced' VGAM2031 RNA, herein designated VGAM RNA, and a schematic representation of the secondary folding of VGAM2031 folded precursor RNA, herein designated VGAM FOLDED PRECURSOR RNA, of VGAM2031 are further described hereinbelow with reference to Table 1.

Nucleotide sequences of host target binding sites, such as BINDING SITE-I, BINDING SITE-II and BINDING SITE-III of FIG. 1, found on VGAM2031 host target RNA, and schematic representation of the complementarity of each of these host target binding sites to VGAM2031 RNA, herein designated VGAM RNA, are described hereinbelow with reference to Table 2.

As mentioned hereinabove with reference to FIG. 1, a function of VGAM2031 gene, herein designated VGAM is inhibition of expression of VGAM2031 target genes. It is appreciated that specific functions, and accordingly utilities, of VGAM2031 correlate with, and may be deduced from, the identity of the target genes which VGAM2031 binds and inhibits, and the function of these target genes, as elaborated hereinbelow.

Carcinoembryonic Antigen-related Cell Adhesion Molecule 1 (biliary glycoprotein) (CEACAM1, Accession NM_001712) is a VGAM2031 host target gene. CEACAM1 BINDING SITE is HOST TARGET binding site found in the 3' untranslated region of mRNA encoded by CEACAM1, corresponding to a HOST TARGET binding site such as BINDING SITE I, BINDING SITE II or BINDING SITE III. Table 2 illustrates the complementarity of the nucleotide sequences of CEACAM1 BINDING SITE, designated SEQ ID:7442, to the nucleotide sequence of VGAM2031 RNA, herein designated VGAM RNA, also designated SEQ ID:4742.

A function of VGAM2031 is therefore inhibition of Carcinoembryonic Antigen-related Cell Adhesion Molecule 1 (biliary glycoprotein) (CEACAM1, Accession NM_001712), a gene which is a major effector of VEGF and may be a target for the inhibition of tumor angiogenesis. Accordingly, utilities of VGAM2031 include diagnosis, prevention and treatment of diseases and clinical conditions associated with CEACAM1. The function of CEACAM1 and its association with various diseases and clinical conditions, has been established by previous studies, as described hereinabove with reference to VGAM93. EphB2 (EPHB2, Accession NM_004442) is another VGAM2031 host target gene. EPHB2 BINDING SITE is HOST TARGET binding site found in the 3' untranslated region of mRNA encoded by EPHB2, corresponding to a HOST TARGET binding site such as BINDING SITE I, BINDING SITE II or BINDING SITE III. Table 2 illustrates the complementarity of the nucleotide sequences of EPHB2 BINDING SITE, designated SEQ ID:10734, to the nucleotide sequence of VGAM2031 RNA, herein designated VGAM RNA, also designated SEQ ID:4742.

Another function of VGAM2031 is therefore inhibition of EphB2 (EPHB2, Accession NM_004442), a gene which Eph-related receptor tyrosine kinase B2; may have a role in neurogenesis. Accordingly, utilities of VGAM2031 include diagnosis, prevention and treatment of diseases and clinical conditions associated with EPHB2. The function of EPHB2 and its association with various diseases and clinical conditions, has been established by previous studies, as described hereinabove with reference to VGAM533. Leucine Zipper-EF-hand Containing Transmembrane Protein 1 (LETM1, Accession NM_012318) is another VGAM2031 host target gene. LETM1 BINDING SITE is HOST TARGET binding site found in the 3' untranslated region of mRNA encoded by LETM1, corresponding to a HOST TARGET binding site such as BINDING SITE I, BINDING SITE II or BINDING SITE III. Table 2 illustrates the complementarity of the nucleotide sequences of LETM1 BINDING SITE, designated SEQ ID:14695, to the nucleotide sequence of VGAM2031 RNA, herein designated VGAM RNA, also designated SEQ ID:4742.

Another function of VGAM2031 is therefore inhibition of Leucine Zipper-EF-hand Containing Transmembrane Protein 1 (LETM1, Accession NM_012318). Accordingly, utilities of VGAM2031 include diagnosis, prevention and treatment of diseases and clinical conditions associated with LETM1. Lysozyme (renal amyloidosis) (LYZ, Accession NM_000239) is another VGAM2031 host target gene. LYZ BINDING SITE is HOST TARGET binding site found in the 3' untranslated region of mRNA encoded by LYZ, corresponding to a HOST TARGET binding site such as BINDING SITE I, BINDING SITE II or BINDING SITE III. Table 2 illustrates the complementarity of the nucleotide sequences of LYZ BINDING SITE, designated SEQ ID:5759, to the nucleotide sequence of VGAM2031 RNA, herein designated VGAM RNA, also designated SEQ ID:4742.

Another function of VGAM2031 is therefore inhibition of Lysozyme (renal amyloidosis) (LYZ, Accession NM_000239), a gene which a bacteriolytic enzyme. Accordingly, utilities of VGAM2031 include diagnosis, prevention and treatment of diseases and clinical conditions associated with LYZ. The function of LYZ and its association with various diseases and clinical conditions, has been established by previous studies, as described hereinabove with reference to VGAM929. Microtubule-associated Protein 1B (MAP1B, Accession NM_005909) is another VGAM2031 host target gene. MAP1B BINDING SITE1 and MAP1B BINDING SITE2 are HOST TARGET binding sites found in untranslated regions of mRNA encoded by MAP1B, corresponding to HOST TARGET binding sites such as BINDING SITE I, BINDING SITE II or BINDING SITE III. Table 2 illustrates the complementarity of the nucleotide sequences of MAP1B BINDING SITE1 and MAP1B BINDING SITE2, designated SEQ ID:12533 and SEQ ID:25711 respectively, to the nucleotide sequence of VGAM2031 RNA, herein designated VGAM RNA, also designated SEQ ID:4742.

Another function of VGAM2031 is therefore inhibition of Microtubule-associated Protein 1B (MAP1B, Accession NM_005909), a gene which may have a role in neuronal plasticity and brain development. Accordingly, utilities of VGAM2031 include diagnosis, prevention and treatment of diseases and clinical conditions associated with MAP1B. The function of MAP1B and its association with various diseases and clinical conditions, has been established by previous studies, as described hereinabove with reference to VGAM316. Phosphatidylinositol-4-phosphate 5-kinase, Type I, Alpha (PIP5K1A, Accession NM_003557) is another VGAM2031 host target gene. PIP5K1A BINDING SITE is HOST TARGET binding site found in the 3" untranslated region of mRNA encoded by PIP5K1A, corresponding to a HOST TARGET binding site such as BINDING SITE I, BINDING SITE II or BINDING SITE III. Table 2 illustrates the complementarity of the nucleotide sequences of PIP5K1A BINDING SITE, designated SEQ ID:9602, to the nucleotide sequence of VGAM2031 RNA, herein designated VGAM RNA, also designated SEQ ID:4742.

Another function of VGAM2031 is therefore inhibition of Phosphatidylinositol-4-phosphate 5-kinase, Type I, Alpha (PIP5K1A, Accession NM_003557), a gene which is responsible for the synthesis of PtdIns (4,5)P2. Accordingly, utilities of VGAM2031 include diagnosis, prevention and treatment of diseases and clinical conditions associated with PIP5K1A. The function of PIP5K1A and its association with various diseases and clinical conditions, has been established by previous studies, as described hereinabove with reference to VGAM427. Transforming Growth Factor, Beta Receptor II (70/80 kDa) (TGFBR2, Accession NM_003242) is another VGAM2031 host target gene. TGFBR2 BINDING SITE is HOST TARGET binding site found in the 3' untranslated region of mRNA encoded by TGFBR2, corresponding to a HOST TARGET binding site such as BINDING SITE I, BINDING SITE II or BINDING SITE III. Table 2 illustrates the complementarity of the nucleotide sequences of TGFBR2 BINDING SITE, designated SEQ ID:9245, to the nucleotide sequence of VGAM2031 RNA, herein designated VGAM RNA, also designated SEQ ID:4742.

Another function of VGAM2031 is therefore inhibition of Transforming Growth Factor, Beta Receptor II (70/80 kDa) (TGFBR2, Accession NM_003242). Accordingly, utilities of VGAM2031 include diagnosis, prevention and treatment of diseases and clinical conditions associated with TGFBR2. Ubiquitin Specific Protease 6 (Tre-2 oncogene) (USP6, Accession XM_165948) is another VGAM2031 host target gene. USP6 BINDING SITE is HOST TARGET binding site found in the 5' untranslated region of mRNA encoded by USP6, corresponding to a HOST TARGET binding site such as BINDING SITE I, BINDING SITE II or BINDING SITE III. Table 2 illustrates the complementarity of the nucleotide sequences of USP6 BINDING SITE, designated SEQ ID:43808, to the nucleotide sequence of VGAM2031 RNA, herein designated VGAM RNA, also designated SEQ ID:4742.

Another function of VGAM2031 is therefore inhibition of Ubiquitin Specific Protease 6 (Tre-2 oncogene) (USP6, Accession XM_165948), a gene which has an atp-independent isopeptidase activity, cleaving at the carboxyl terminus of the ubiquitin moiety. Accordingly, utilities of VGAM2031 include diagnosis, prevention and treatment of diseases and clinical conditions associated with USP6. The function of USP6 and its association with various diseases and clinical conditions, has been established by previous studies, as described hereinabove with reference to VGAM296. BTB (POZ) Domain Containing 2 (BTBD2, Accession NM_017797) is another VGAM2031 host target gene. BTBD2 BINDING SITE is HOST TARGET binding site found in the 3' untranslated region of mRNA encoded by BTBD2, corresponding to a HOST TARGET binding site such as BINDING SITE I, BINDING SITE II or BINDING SITE III. Table 2 illustrates the complementarity of the nucleotide sequences of BTBD2 BINDING SITE, designated SEQ ID:19439, to the nucleotide sequence of VGAM2031 RNA, herein designated VGAM RNA, also designated SEQ ID:4742.

Another function of VGAM2031 is therefore inhibition of BTB (POZ) Domain Containing 2 (BTBD2, Accession NM_017797). Accordingly, utilities of VGAM2031 include diagnosis, prevention and treatment of diseases and clinical conditions associated with BTBD2. Chromosome 20 Open Reading Frame 140 (C20orf140, Accession NM_144628) is another VGAM2031 host target gene. C20orf140 BINDING SITE is HOST TARGET binding site found in the 3' untranslated region of mRNA encoded by C20orf140, corresponding to a HOST TARGET binding site such as BINDING SITE I, BINDING SITE II or BINDING SITE III. Table 2 illustrates the complementarity of the nucleotide sequences of C20orf140 BINDING SITE, designated SEQ ID:29445, to the nucleotide sequence of VGAM2031 RNA, herein designated VGAM RNA, also designated SEQ ID:4742.

Another function of VGAM2031 is therefore inhibition of Chromosome 20 Open Reading Frame 140 (C20orf140, Accession NM_144628). Accordingly, utilities of VGAM2031 include diagnosis, prevention and treatment of diseases and clinical conditions associated with C20orf140. C20orf183 (Accession NM_030776) is another VGAM2031 host target gene. C20orf183 BINDING SITE is HOST TARGET binding site found in the 3' untranslated region of mRNA encoded by C20orf183, corresponding to a HOST TARGET binding site such as BINDING SITE I, BINDING SITE II or BINDING SITE III. Table 2 illustrates the complementarity of the nucleotide sequences of C20orf183 BINDING SITE, designated SEQ ID:25061, to the nucleotide sequence of VGAM2031 RNA, herein designated VGAM RNA, also designated SEQ ID:4742.

Another function of VGAM2031 is therefore inhibition of C20orf183 (Accession NM_030776). Accordingly, utilities of VGAM2031 include diagnosis, prevention and treatment of diseases and clinical conditions associated with C20orf183. DKFZp434F142 (Accession NM_032254) is another VGAM2031 host target gene. DKFZp434F142 BINDING SITE is HOST TARGET binding site found in the 3' untranslated region of mRNA encoded by DKFZp434F142, corresponding to a HOST TARGET binding site such as BINDING SITE I, BINDING SITE II or BINDING SITE III. Table 2 illustrates the complementarity of the nucleotide sequences of DKFZp434F142 BINDING SITE, designated SEQ ID:25997, to the nucleotide sequence of VGAM2031 RNA, herein designated VGAM RNA, also designated SEQ ID:4742.

Another function of VGAM2031 is therefore inhibition of DKFZp434F142 (Accession NM_032254). Accordingly, utilities of VGAM2031 include diagnosis, prevention and treatment of diseases and clinical conditions associated with DKFZp434F142. DKFZP434J193 (Accession XM_048452) is another VGAM2031 host target gene. DKFZP434J193 BINDING SITE is HOST TARGET binding site found in the 5' untranslated region of mRNA encoded by DKFZP434J193, corresponding to a HOST TARGET binding site such as BINDING SITE I, BINDING SITE II or BINDING SITE III. Table 2 illustrates the complementarity of the nucleotide sequences of DKFZP434J193 BINDING SITE, designated SEQ ID:35163, to the nucleotide sequence of VGAM2031 RNA, herein designated VGAM RNA, also designated SEQ ID:4742.

Another function of VGAM2031 is therefore inhibition of DKFZP434J193 (Accession XM_048452). Accordingly, utilities of VGAM2031 include diagnosis, prevention and treatment of diseases and clinical conditions associated with DKFZP434J193. DKFZP434L187 (Accession XM_044070) is another VGAM2031 host target gene. DKFZP434L187 BINDING SITE is HOST TARGET binding site found in the 5' untranslated region of mRNA encoded by DKFZP434L187, corresponding to a HOST TARGET binding site such as BINDING SITE I, BINDING SITE II or BINDING SITE III. Table 2 illustrates the complementarity of the nucleotide sequences of DKFZP434L187 BINDING SITE, designated SEQ ID:34119, to the nucleotide sequence of VGAM2031 RNA, herein designated VGAM RNA, also designated SEQ ID:4742.

Another function of VGAM2031 is therefore inhibition of DKFZP434L187 (Accession XM_044070). Accordingly, utilities of VGAM2031 include diagnosis, prevention and treatment of diseases and clinical conditions associated with DKFZP434L187. DKFZP564C196 (Accession XM_046405) is another VGAM2031 host target gene. DKFZP564C196 BINDING SITE is HOST TARGET binding site found in the 3' untranslated region of mRNA encoded by DKFZP564C196, corresponding to a HOST TARGET binding site such as BINDING SITE I, BINDING SITE II or BINDING SITE III. Table 2 illustrates the complementarity of the nucleotide sequences of DKFZP564C196 BINDING SITE, designated SEQ ID:34709, to the nucleotide sequence of VGAM2031 RNA, herein designated VGAM RNA, also designated SEQ ID:4742.

Another function of VGAM2031 is therefore inhibition of DKFZP564C196 (Accession XM_046405). Accordingly, utilities of VGAM2031 include diagnosis, prevention and treatment of diseases and clinical conditions associated with DKFZP564C196. Potassium Voltage-gated Channel, Shal-related Subfamily, Member 1 (KCND1, Accession NM_004979) is another VGAM2031 host target gene. KCND1 BINDING SITE is HOST TARGET binding site found in the 5' untranslated region of mRNA encoded by KCND1, corresponding to a HOST TARGET binding site such as BINDING SITE I, BINDING SITE II or BINDING SITE III. Table 2 illustrates the complementarity of the nucleotide sequences of KCND1 BINDING SITE, designated SEQ ID:11426, to the nucleotide sequence of VGAM2031 RNA, herein designated VGAM RNA, also designated SEQ ID:4742.

Another function of VGAM2031 is therefore inhibition of Potassium Voltage-gated Channel, Shal-related Subfamily, Member 1 (KCND1, Accession NM_004979). Accordingly, utilities of VGAM2031 include diagnosis, prevention and treatment of diseases and clinical conditions associated with KCND1. KIAA0155 (Accession NM_014633) is another VGAM2031 host target gene. KIAA0155 BINDING SITE is HOST TARGET binding site found in the 3' untranslated region of mRNA encoded by KIAA0155, corresponding to a HOST TARGET binding site such as BINDING SITE I, BINDING SITE II or BINDING SITE III. Table 2 illustrates the complementarity of the nucleotide sequences of KIAA0155 BINDING SITE, designated SEQ ID:16003, to the nucleotide sequence of VGAM2031 RNA, herein designated VGAM RNA, also designated SEQ ID:4742.

Another function of VGAM2031 is therefore inhibition of KIAA0155 (Accession NM_014633). Accordingly, utilities of VGAM2031 include diagnosis, prevention and treatment of diseases and clinical conditions associated with KIAA0155. KIAA0169 (Accession XM_052725) is another VGAM2031 host target gene. KIAA0169 BINDING SITE is HOST TARGET binding site found in the 5' untranslated region of mRNA encoded by KIAA0169, corresponding to a HOST TARGET binding site such as BINDING SITE I, BINDING SITE II or BINDING SITE III. Table 2 illustrates the complementarity of the nucleotide sequences of KIAA0169 BINDING SITE, designated SEQ ID:36052, to the nucleotide sequence of VGAM2031 RNA, herein designated VGAM RNA, also designated SEQ ID:4742.

Another function of VGAM2031 is therefore inhibition of KIAA0169 (Accession XM_052725). Accordingly, utilities of VGAM2031 include diagnosis, prevention and treatment of diseases and clinical conditions associated with KIAA0169. KIAA0441 (Accession NM_014797) is another VGAM2031 host target gene. KIAA0441 BINDING SITE is HOST TARGET binding site found in the 3' untranslated region of mRNA encoded by KIAA0441, corresponding to a HOST TARGET binding site such as BINDING SITE I, BINDING SITE II or BINDING SITE III. Table 2 illustrates the complementarity of the nucleotide sequences of KIAA0441 BINDING SITE, designated SEQ ID:16715, to the nucleotide sequence of VGAM2031 RNA, herein designated VGAM RNA, also designated SEQ ID:4742.

Another function of VGAM2031 is therefore inhibition of KIAA0441 (Accession NM_014797). Accordingly, utilities of VGAM2031 include diagnosis, prevention and treatment of diseases and clinical conditions associated with KIAA0441. KIAA0553 (Accession XM_045981) is another VGAM2031 host target gene. KIAA0553 BINDING SITE is HOST TARGET binding site found in the 3' untranslated region of mRNA encoded by KIAA0553, corresponding to a HOST TARGET binding site such as BINDING SITE I, BINDING SITE II or BINDING SITE III. Table 2 illustrates the complementarity of the nucleotide sequences of KIAA0553 BINDING SITE, designated SEQ ID:34635, to the nucleotide sequence of VGAM2031 RNA, herein designated VGAM RNA, also designated SEQ ID:4742.

Another function of VGAM2031 is therefore inhibition of KIAA0553 (Accession XM_045981). Accordingly, utilities of VGAM2031 include diagnosis, prevention and treatment of diseases and clinical conditions associated with KIAA0553. KIAA1075 (Accession XM_029631) is another VGAM2031 host target gene. KIAA1075 BINDING SITE is HOST TARGET binding site found in the 5' untranslated region of mRNA encoded by KIAA1075, corresponding to a HOST TARGET binding site such as BINDING SITE I, BINDING SITE II or BINDING SITE III. Table 2 illustrates the complementarity of the nucleotide sequences of KIAA1075 BINDING SITE, designated SEQ ID:30917, to the nucleotide sequence of VGAM2031 RNA, herein designated VGAM RNA, also designated SEQ ID:4742.

Another function of VGAM2031 is therefore inhibition of KIAA1075 (Accession XM_029631). Accordingly, utilities of VGAM2031 include diagnosis, prevention and treatment of diseases and clinical conditions associated with KIAA1075. KIAA1143 (Accession XM_044014) is another VGAM2031 host target gene. KIAA1143 BINDING SITE is HOST TARGET binding site found in the 3' untranslated region of mRNA encoded by KIAA1143, corresponding to a HOST TARGET binding site such as BINDING SITE I, BINDING SITE II or BINDING SITE III. Table 2 illustrates the complementarity of the nucleotide sequences of KIAA1143 BINDING SITE, designated SEQ ID:34073, to the nucleotide sequence of VGAM2031 RNA, herein designated VGAM RNA, also designated SEQ ID:4742.

Another function of VGAM2031 is therefore inhibition of KIAA1143 (Accession XM_044014). Accordingly, utilities of VGAM2031 include diagnosis, prevention and treatment of diseases and clinical conditions associated with KIAA1143. KIAA1280 (Accession XM_045766) is another VGAM2031 host target gene. KIAA1280 BINDING SITE is HOST TARGET binding site found in the 5' untranslated region of mRNA encoded by KIAA1280, corresponding to a HOST TARGET binding site such as BINDING SITE I, BINDING SITE II or BINDING SITE III. Table 2 illustrates the complementarity of the nucleotide sequences of KIAA1280 BINDING SITE, designated SEQ ID:34557, to the nucleotide sequence of VGAM2031 RNA, herein designated VGAM RNA, also designated SEQ ID:4742.

Another function of VGAM2031 is therefore inhibition of KIAA1280 (Accession XM_045766). Accordingly, utilities of VGAM2031 include diagnosis, prevention and treatment of diseases and clinical conditions associated with KIAA1280. KIAA1432 (Accession XM_039698) is another VGAM2031 host target gene. KIAA1432 BINDING SITE is HOST TARGET binding site found in the 3' untranslated region of mRNA encoded by KIAA1432, corresponding to a HOST TARGET binding site such as BINDING SITE I, BINDING SITE II or BINDING SITE III. Table 2 illustrates the complementarity of the nucleotide sequences of KIAA1432 BINDING SITE, designated SEQ ID:33159, to the nucleotide sequence of VGAM2031 RNA, herein designated VGAM RNA, also designated SEQ ID:4742.

Another function of VGAM2031 is therefore inhibition of KIAA1432 (Accession XM_039698). Accordingly, utilities of VGAM2031 include diagnosis, prevention and treatment of diseases and clinical conditions associated with KIAA1432. KIAA1856 (Accession XM_166549) is another VGAM2031 host target gene. KIAA1856 BINDING SITE is HOST TARGET binding site found in the 3' untranslated region of mRNA encoded by KIAA1856, corresponding to a HOST TARGET binding site such as BINDING SITE I, BINDING SITE II or BINDING SITE III. Table 2 illustrates the complementarity of the nucleotide sequences of KIAA1856 BINDING SITE, designated SEQ ID:44523, to the nucleotide sequence of VGAM2031 RNA, herein designated VGAM RNA, also designated SEQ ID:4742.

Another function of VGAM2031 is therefore inhibition of KIAA1856 (Accession XM_166549). Accordingly, utilities of VGAM2031 include diagnosis, prevention and treatment of diseases and clinical conditions associated with KIAA1856. MGC15631 (Accession NM_032753) is another VGAM2031 host target gene. MGC15631 BINDING SITE is HOST TARGET binding site found in the 3' untranslated region of mRNA encoded by MGC15631, corresponding to a HOST TARGET binding site such as BINDING SITE I, BINDING SITE II or BINDING SITE III. Table 2 illustrates the complementarity of the nucleotide sequences of MGC15631 BINDING SITE, designated SEQ ID:26490, to the nucleotide sequence of VGAM2031 RNA, herein designated VGAM RNA, also designated SEQ ID:4742.

Another function of VGAM2031 is therefore inhibition of MGC15631 (Accession NM_032753). Accordingly, utilities of VGAM2031 include diagnosis, prevention and treatment of diseases and clinical conditions associated with MGC15631. NLI-IF (Accession NM_021198) is another VGAM2031 host target gene. NLI-IF BINDING SITE is HOST TARGET binding site found in the 3' untranslated region of mRNA encoded by NLI-IF, corresponding to a HOST TARGET binding site such as BINDING SITE I, BINDING SITE II or BINDING SITE III. Table 2 illustrates the complementarity of the nucleotide sequences of NLI-IF BINDING SITE, designated SEQ ID:22172, to the nucleotide sequence of VGAM2031 RNA, herein designated VGAM RNA, also designated SEQ ID:4742.

Another function of VGAM2031 is therefore inhibition of NLI-IF (Accession NM_021198). Accordingly, utilities of VGAM2031 include diagnosis, prevention and treatment of diseases and clinical conditions associated with NLI-IF. Ornithine Decarboxylase Antizyme 2 (OAZ2, Accession NM_002537) is another VGAM2031 host target gene. OAZ2 BINDING SITE is HOST TARGET binding site found in the 3' untranslated region of mRNA encoded by OAZ2, corresponding to a HOST TARGET binding site such as BINDING SITE I, BINDING SITE II or BINDING SITE III. Table 2 illustrates the complementarity of the nucleotide sequences of OAZ2 BINDING SITE, designated SEQ ID:8375, to the nucleotide sequence of VGAM2031 RNA, herein designated VGAM RNA, also designated SEQ ID:4742.

Another function of VGAM2031 is therefore inhibition of Ornithine Decarboxylase Antizyme 2 (OAZ2, Accession NM_002537). Accordingly, utilities of VGAM2031 include diagnosis, prevention and treatment of diseases and clinical conditions associated with OAZ2. PGR1 (Accession NM_033296) is another VGAM2031 host target gene. PGR1 BINDING SITE is HOST TARGET binding site found in the 3' untranslated region of mRNA encoded by PGR1, corresponding to a HOST TARGET binding site such as BINDING SITE I, BINDING SITE II or BINDING SITE III. Table 2 illustrates the complementarity of the nucleotide sequences of PGR1 BINDING SITE, designated SEQ ID:27123, to the nucleotide sequence of VGAM2031 RNA, herein designated VGAM RNA, also designated SEQ ID:4742.

Another function of VGAM2031 is therefore inhibition of PGR1 (Accession NM_033296). Accordingly, utilities of VGAM2031 include diagnosis, prevention and treatment of diseases and clinical conditions associated with PGR1. PRAX-1 (Accession NM_004758) is another VGAM2031 host target gene. PRAX-1 BINDING SITE is HOST TARGET binding site found in the 3' untranslated region of mRNA encoded by PRAX-1, corresponding to a HOST TARGET binding site such as BINDING SITE I, BINDING SITE II or BINDING SITE III. Table 2 illustrates the complementarity of the nucleotide sequences of PRAX-1 BINDING SITE, designated SEQ ID:11146, to the nucleotide sequence of VGAM2031 RNA, herein designated VGAM RNA, also designated SEQ ID:4742.

Another function of VGAM2031 is therefore inhibition of PRAX-1 (Accession NM_004758). Accordingly, utilities of VGAM2031 include diagnosis, prevention and treatment of diseases and clinical conditions associated with PRAX-1. Polymerase I and Transcript Release Factor (PTRF, Accession XM_032852) is another VGAM2031 host target gene. PTRF BINDING SITE is HOST TARGET binding site found in the 5' untranslated region of mRNA encoded by PTRF, corresponding to a HOST TARGET binding site such as BINDING SITE I, BINDING SITE II or BINDING SITE III. Table 2 illustrates the complementarity of the nucleotide sequences of PTRF BINDING SITE, designated SEQ ID:31785, to the nucleotide sequence of VGAM2031 RNA, herein designated VGAM RNA, also designated SEQ ID:4742.

Another function of VGAM2031 is therefore inhibition of Polymerase I and Transcript Release Factor (PTRF, Accession XM_032852). Accordingly, utilities of VGAM2031 include diagnosis, prevention and treatment of diseases and clinical conditions associated with PTRF. SCYD1 (Accession XM_165650) is another VGAM2031 host target gene. SCYD1 BINDING SITE is HOST TARGET binding site found in the 3' untranslated region of mRNA encoded by SCYD1, corresponding to a HOST TARGET binding site such as BINDING SITE I, BINDING SITE II or BINDING SITE III. Table 2 illustrates the complementarity of the nucleotide sequences of SCYD1 BINDING SITE, designated SEQ ID:43712, to the nucleotide sequence of VGAM2031 RNA, herein designated VGAM RNA, also designated SEQ ID:4742.

Another function of VGAM2031 is therefore inhibition of SCYD1 (Accession XM_165650). Accordingly, utilities of VGAM2031 include diagnosis, prevention and treatment of diseases and clinical conditions associated with SCYD1. LOC147093 (Accession XM_097184) is another VGAM2031 host target gene. LOC147093 BINDING SITE is HOST TARGET binding site found in the 5' untranslated region of mRNA encoded by LOC147093, corresponding to a HOST TARGET binding site such as BINDING SITE I, BINDING SITE II or BINDING SITE III. Table 2 illustrates the complementarity of the nucleotide sequences of LOC147093 BINDING SITE, designated SEQ ID:40798, to the nucleotide sequence of VGAM2031 RNA, herein designated VGAM RNA, also designated SEQ ID:4742.

Another function of VGAM2031 is therefore inhibition of LOC147093 (Accession XM_097184). Accordingly, utilities of VGAM2031 include diagnosis, prevention and treatment of diseases and clinical conditions associated with LOC147093. LOC149132 (Accession XM_086428) is another VGAM2031 host target gene. LOC149132 BINDING SITE is HOST TARGET binding site found in the 5' untranslated region of mRNA encoded by LOC149132, corresponding to a HOST TARGET binding site such as BINDING SITE I, BINDING SITE II or BINDING SITE III. Table 2 illustrates the complementarity of the nucleotide sequences of LOC149132 BINDING SITE, designated SEQ ID:38644, to the nucleotide sequence of VGAM2031 RNA, herein designated VGAM RNA, also designated SEQ ID:4742.

Another function of VGAM2031 is therefore inhibition of LOC149132 (Accession XM_086428). Accordingly, utilities of VGAM2031 include diagnosis, prevention and treatment of diseases and clinical conditions associated with LOC149132. LOC201229 (Accession XM_113925) is another VGAM2031 host target gene. LOC201229 BINDING SITE is HOST TARGET binding site found in the 5' untranslated region of mRNA encoded by LOC201229, corresponding to a HOST TARGET binding site such as BINDING SITE I, BINDING SITE II or BINDING SITE III. Table 2 illustrates the complementarity of the nucleotide sequences of LOC201229 BINDING SITE, designated SEQ ID:42539, to the nucleotide sequence of VGAM2031 RNA, herein designated VGAM RNA, also designated SEQ ID:4742.

Another function of VGAM2031 is therefore inhibition of LOC201229 (Accession XM_113925). Accordingly, utilities of VGAM2031 include diagnosis, prevention and treatment of diseases and clinical conditions associated with LOC201229. LOC203257 (Accession XM_113561) is another VGAM2031 host target gene. LOC203257 BINDING SITE is HOST TARGET binding site found in the 5' untranslated region of mRNA encoded by LOC203257, corresponding to a HOST TARGET binding site such as BINDING SITE I, BINDING SITE II or BINDING SITE III. Table 2 illustrates the complementarity of the nucleotide sequences of LOC203257 BINDING SITE, designated SEQ ID:42286, to the nucleotide sequence of VGAM2031 RNA, herein designated VGAM RNA, also designated SEQ ID:4742.

Another function of VGAM2031 is therefore inhibition of LOC203257 (Accession XM_113561). Accordingly, utilities of VGAM2031 include diagnosis, prevention and treatment of diseases and clinical conditions associated with LOC203257. LOC206426 (Accession XM_116505) is another VGAM2031 host target gene. LOC206426 BINDING SITE is HOST TARGET binding site found in the 3' untranslated region of mRNA encoded by LOC206426, corresponding to a HOST TARGET binding site such as BINDING SITE I, BINDING SITE II or BINDING SITE III. Table 2 illustrates the complementarity of the nucleotide sequences of LOC206426 BINDING SITE, designated SEQ ID:43115, to the nucleotide sequence of VGAM2031 RNA, herein designated VGAM RNA, also designated SEQ ID:4742.

Another function of VGAM2031 is therefore inhibition of LOC206426 (Accession XM_116505). Accordingly, utilities of VGAM2031 include diagnosis, prevention and treatment of diseases and clinical conditions associated with LOC206426. LOC91040 (Accession XM_035641) is another VGAM2031 host target gene. LOC91040 BINDING SITE is HOST TARGET binding site found in the 3' untranslated region of mRNA encoded by LOC91040, corresponding to a HOST TARGET binding site such as BINDING SITE I, BINDING SITE II or BINDING SITE III. Table 2 illustrates the complementarity of the nucleotide sequences of LOC91040 BINDING SITE, designated SEQ ID:32311, to the nucleotide sequence of VGAM2031 RNA, herein designated VGAM RNA, also designated SEQ ID:4742.

Another function of VGAM2031 is therefore inhibition of LOC91040 (Accession XM_035641). Accordingly, utilities of VGAM2031 include diagnosis, prevention and treatment of diseases and clinical conditions associated with LOC91040. LOC91409 (Accession XM_038298) is another VGAM2031 host target gene. LOC91409 BINDING SITE is HOST TARGET binding site found in the 3' untranslated region of mRNA encoded by LOC91409, corresponding to a HOST TARGET binding site such as BINDING SITE I, BINDING SITE II or BINDING SITE III. Table 2 illustrates the complementarity of the nucleotide sequences of LOC91409 BINDING SITE, designated SEQ ID:32803, to the nucleotide sequence of VGAM2031 RNA, herein designated VGAM RNA, also designated SEQ ID:4742.

Another function of VGAM2031 is therefore inhibition of LOC91409 (Accession XM_038298). Accordingly, utilities of VGAM2031 include diagnosis, prevention and treatment of diseases and clinical conditions associated with LOC91409. FIG. 1 further provides a conceptual description of a novel bioinformatically detected viral gene of the present invention, referred to here as Viral Genomic Address Messenger 2032 (VGAM2032) viral gene, which modulates expression of respective host target genes thereof, the function and utility of which host target genes is known in the art.

VGAM2032 is a novel bioinformatically detected regulatory, non protein coding, viral micro RNA (miRNA) gene. The method by which VGAM2032 was detected is described hereinabove with reference to FIGS. 1-8.

VGAM2032 gene, herein designated VGAM GENE, is a viral gene contained in the genome of Kyuri Green Mottle Mosaic Virus. VGAM2032 host target gene, herein designated VGAM HOST TARGET GENE, is a human gene contained in the human genome.

VGAM2032 gene encodes a VGAM2032 precursor RNA, herein designated VGAM PRECURSOR RNA. Similar to other miRNA genes, and unlike most ordinary genes, VGAM2032 precursor RNA does not encode a protein. A nucleotide sequence identical or highly similar to the nucleotide sequence of VGAM2032 precursor RNA is designated SEQ ID:2018, and is provided hereinbelow with reference to the sequence listing part. Nucleotide sequence SEQ ID:2018 is located at position 2336 relative to the genome of Kyuri Green Mottle Mosaic Virus.

VGAM2032 precursor RNA folds onto itself, forming VGAM2032 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2032 folded precursor RNA into VGAM2032 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2032 RNA is designated SEQ ID:4743, and is provided hereinbelow with reference to the sequence listing part.

VGAM2032 host target gene, herein designated VGAM HOST TARGET GENE, encodes a corresponding messenger RNA, VGAM2032 host target RNA, herein designated VGAM HOST TARGET RNA. VGAM2032 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2032 RNA, herein designated VGAM RNA, binds complementarily to one or more host target binding sites located in untranslated regions of VGAM2032 host target RNA, herein designated VGAM HOST TARGET RNA. This complementary binding is due to the fact that the nucleotide sequence of VGAM2032 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2032 RNA, herein designated VGAM RNA, may have a different number of host target binding sites in untranslated regions of a VGAM2032 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2032 RNA, herein designated VGAM RNA, to host target binding sites on VGAM2032 host target RNA, herein designated VGAM HOST TARGET RNA, such as BINDING SITE I, BINDING SITE II and BINDING SITE III, inhibits translation of VGAM2032 host target RNA into VGAM2032 host target protein, herein designated VGAM HOST TARGET PROTEIN. VGAM host target protein is therefore outlined by a broken line.

It is appreciated that VGAM2032 host target gene, herein designated VGAM HOST TARGET GENE, in fact represents a plurality of VGAM2032 host target genes. The mRNA of each one of this plurality of VGAM2032 host target genes comprises one or more host target binding sites, each having a nucleotide sequence which is at least partly complementary to VGAM2032 RNA, herein designated VGAM RNA, and which when bound by VGAM2032 RNA causes inhibition of translation of respective one or more VGAM2032 host target proteins.

It is further appreciated by one skilled in the art that the mode of translational inhibition illustrated by FIG. 1 with specific reference to translational inhibition exerted by VGAM2032 gene, herein designated VGAM GENE, on one or more VGAM2032 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2032 is inhibition of expression of host target genes, as part of a novel viral mechanism of attacking a host. Accordingly, utilities of VGAM2032 include diagnosis, prevention and treatment of viral infection by Kyuri Green Mottle Mosaic Virus. Specific functions, and accordingly utilities, of VGAM2032 correlate with, and may be deduced from, the identity of the host target genes which VGAM2032 binds and inhibits, and the function of these host target genes, as elaborated hereinbelow.

Nucleotide sequences of the VGAM2032 precursor RNA, herein designated VGAM PRECURSOR RNA, and of the 'diced' VGAM2032 RNA, herein designated VGAM RNA, and a schematic representation of the secondary folding of VGAM2032 folded precursor RNA, herein designated VGAM FOLDED PRECURSOR RNA, of VGAM2032 are further described hereinbelow with reference to Table 1.

Nucleotide sequences of host target binding sites, such as BINDING SITE-I, BINDING SITE-II and BINDING SITE-III of FIG. 1, found on VGAM2032 host target RNA, and schematic representation of the complementarity of each of these host target binding sites to VGAM2032 RNA, herein designated VGAM RNA, are described hereinbelow with reference to Table 2.

As mentioned hereinabove with reference to FIG. 1, a function of VGAM2032 gene, herein designated VGAM is inhibition of expression of VGAM2032 target genes. It is appreciated that specific functions, and accordingly utilities, of VGAM2032 correlate with, and may be deduced from, the identity of the target genes which VGAM2032 binds and inhibits, and the function of these target genes, as elaborated hereinbelow.

FLJ20298 (Accession NM_017752) is a VGAM2032 host target gene. FLJ20298 BINDING SITE is HOST TARGET binding site found in the 3' untranslated region of mRNA encoded by FLJ20298, corresponding to a HOST TARGET binding site such as BINDING SITE I, BINDING SITE II or BINDING SITE III. Table 2 illustrates the complementarity of the nucleotide sequences of FLJ20298 BINDING SITE, designated SEQ ID:19362, to the nucleotide sequence of VGAM2032 RNA, herein designated VGAM RNA, also designated SEQ ID:4743.

A function of VGAM2032 is therefore inhibition of FLJ20298 (Accession NM_017752). Accordingly, utilities of VGAM2032 include diagnosis, prevention and treatment of diseases and clinical conditions associated with FLJ20298. LOC201695 (Accession XM_120432) is another VGAM2032 host target gene. LOC201695 BINDING SITE is HOST TARGET binding site found in the 5' untranslated region of mRNA encoded by LOC201695, corresponding to a HOST TARGET binding site such as BINDING SITE I, BINDING SITE II or BINDING SITE III. Table 2 illustrates the complementarity of the nucleotide sequences of LOC201695 BINDING SITE, designated SEQ ID:43609, to the nucleotide sequence of VGAM2032 RNA, herein designated VGAM RNA, also designated SEQ ID:4743.

Another function of VGAM2032 is therefore inhibition of LOC201695 (Accession XM_120432). Accordingly, utilities of VGAM2032 include diagnosis, prevention and treatment of diseases and clinical conditions associated with LOC201695. FIG. 1 further provides a conceptual description of a novel bioinformatically detected viral gene of the present invention, referred to here as Viral Genomic Address Messenger 2033 (VGAM2033) viral gene, which modulates expression of respective host target genes thereof, the function and utility of which host target genes is known in the art.

VGAM2033 is a novel bioinformatically detected regulatory, non protein coding, viral micro RNA (miRNA) gene. The method by which VGAM2033 was detected is described hereinabove with reference to FIGS. 1-8.

VGAM2033 gene, herein designated VGAM GENE, is a viral gene contained in the genome of Zaire Ebola Virus (ZEBOV). VGAM2033 host target gene, herein designated VGAM HOST TARGET GENE, is a human gene contained in the human genome.

VGAM2033 gene encodes a VGAM2033 precursor RNA, herein designated VGAM PRECURSOR RNA. Similar to other miRNA genes, and unlike most ordinary genes, VGAM2033 precursor RNA does not encode a protein. A nucleotide sequence identical or highly similar to the nucleotide sequence of VGAM2033 precursor RNA is designated SEQ ID:2019, and is provided hereinbelow with reference to the sequence listing part. Nucleotide sequence SEQ ID:2019 is located at position 4726 relative to the genome of Zaire Ebola Virus (ZEBOV).

VGAM2033 precursor RNA folds onto itself, forming VGAM2033 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2033 folded precursor RNA into VGAM2033 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2033 RNA is designated SEQ ID:4744, and is provided hereinbelow with reference to the sequence listing part.

VGAM2033 host target gene, herein designated VGAM HOST TARGET GENE, encodes a corresponding messenger RNA, VGAM2033 host target RNA, herein designated VGAM HOST TARGET RNA. VGAM2033 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2033 RNA, herein designated VGAM RNA, binds complementarily to one or more host target binding sites located in untranslated regions of VGAM2033 host target RNA, herein designated VGAM HOST TARGET RNA. This complementary binding is due to the fact that the nucleotide sequence of VGAM2033 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2033 RNA, herein designated VGAM RNA, may have a different number of host target binding sites in untranslated regions of a VGAM2033 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2033 RNA, herein designated VGAM RNA, to host target binding sites on VGAM2033 host target RNA, herein designated VGAM HOST TARGET RNA, such as BINDING SITE I, BINDING SITE II and BINDING SITE III, inhibits translation of VGAM2033 host target RNA into VGAM2033 host target protein, herein designated VGAM HOST TARGET PROTEIN. VGAM host target protein is therefore outlined by a broken line.

It is appreciated that VGAM2033 host target gene, herein designated VGAM HOST TARGET GENE, in fact represents a plurality of VGAM2033 host target genes. The mRNA of each one of this plurality of VGAM2033 host target genes comprises one or more host target binding sites, each having a nucleotide sequence which is at least partly complementary to VGAM2033 RNA, herein designated VGAM RNA, and which when bound by VGAM2033 RNA causes inhibition of translation of respective one or more VGAM2033 host target proteins.

It is further appreciated by one skilled in the art that the mode of translational inhibition illustrated by FIG. 1 with specific reference to translational inhibition exerted by VGAM2033 gene, herein designated VGAM GENE, on one or more VGAM2033 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2033 is inhibition of expression of host target genes, as part of a novel viral mechanism of attacking a host. Accordingly, utilities of VGAM2033 include diagnosis, prevention and treatment of viral infection by Zaire Ebola Virus (ZEBOV). Specific functions, and accordingly utilities, of VGAM2033 correlate with, and may be deduced from, the identity of the host target genes which VGAM2033 binds and inhibits, and the function of these host target genes, as elaborated hereinbelow.

Nucleotide sequences of the VGAM2033 precursor RNA, herein designated VGAM PRECURSOR RNA, and of the 'diced' VGAM2033 RNA, herein designated VGAM RNA, and a schematic representation of the secondary folding of VGAM2033 folded precursor RNA, herein designated VGAM FOLDED PRECURSOR RNA, of VGAM2033 are further described hereinbelow with reference to Table 1.

Nucleotide sequences of host target binding sites, such as BINDING SITE-I, BINDING SITE-II and BINDING SITE-III of FIG. 1, found on VGAM2033 host target RNA, and schematic representation of the complementarity of each of these host target binding sites to VGAM2033 RNA, herein designated VGAM RNA, are described hereinbelow with reference to Table 2.

As mentioned hereinabove with reference to FIG. 1, a function of VGAM2033 gene, herein designated VGAM is inhibition of expression of VGAM2033 target genes. It is appreciated that specific functions, and accordingly utilities, of VGAM2033 correlate with, and may be deduced from, the identity of the target genes which VGAM2033 binds and inhibits, and the function of these target genes, as elaborated hereinbelow.

KIAA1219 (Accession XM_028835) is a VGAM2033 host target gene. KIAA1219 BINDING SITE is HOST TARGET binding site found in the 3' untranslated region of mRNA encoded by KIAA1219, corresponding to a HOST TARGET binding site such as BINDING SITE I, BINDING SITE II or BINDING SITE III. Table 2 illustrates the complementarity of the nucleotide sequences of KIAA1219 BINDING SITE, designated SEQ ID:30759, to the nucleotide sequence of VGAM2033 RNA, herein designated VGAM RNA, also designated SEQ ID:4744.

A function of VGAM2033 is therefore inhibition of KIAA1219 (Accession XM_028835). Accordingly, utilities of VGAM2033 include diagnosis, prevention and treatment of diseases and clinical conditions associated with KIAA1219. KIAA1822 (Accession XM_041566) is another VGAM2033 host target gene. KIAA1822 BINDING SITE is HOST TARGET binding site found in the 3' untranslated region of mRNA encoded by KIAA1822, corresponding to a HOST TARGET binding site such as BINDING SITE I, BINDING SITE II or BINDING SITE III. Table 2 illustrates the complementarity of the nucleotide sequences of KIAA1822 BINDING SITE, designated SEQ ID:33549, to the nucleotide sequence of VGAM2033 RNA, herein designated VGAM RNA, also designated SEQ ID:4744.

Another function of VGAM2033 is therefore inhibition of KIAA1822 (Accession XM_041566). Accordingly, utilities of VGAM2033 include diagnosis, prevention and treatment of diseases and clinical conditions associated with KIAA1822. MKP-7 (Accession XM_039106) is another VGAM2033 host target gene. MKP-7 BINDING SITE is HOST TARGET binding site found in the 5' untranslated region of mRNA encoded by MKP-7, corresponding to a HOST TARGET binding site such as BINDING SITE I, BINDING SITE II or BINDING SITE III. Table 2 illustrates the complementarity of the nucleotide sequences of MKP-7 BINDING SITE, designated SEQ ID:33004, to the nucleotide sequence of VGAM2033 RNA, herein designated VGAM RNA, also designated SEQ ID:4744.

Another function of VGAM2033 is therefore inhibition of MKP-7 (Accession XM_039106). Accordingly, utilities of VGAM2033 include diagnosis, prevention and treatment of diseases and clinical conditions associated with MKP-7. LOC199858 (Accession XM_114040) is another VGAM2033 host target gene. LOC199858 BINDING SITE is HOST TARGET binding site found in the 5' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42634, to the nucleotide sequence of VGAM2033 RNA, herein designated VGAM RNA, also designated SEQ ID:4744.

Another function of VGAM2033 is therefore inhibition of LOC199858 (Accession XM_114040). Accordingly, utilities of VGAM2033 include diagnosis, prevention and treatment of diseases and clinical conditions associated with LOC199858. FIG. 1 further provides a conceptual description of a novel bioinformatically detected viral gene of the present invention, referred to here as Viral Genomic Address Messenger 2034 (VGAM2034) viral gene, which modulates expression of respective host target genes thereof, the function and utility of which host target genes is known in the art.

VGAM2034 is a novel bioinformatically detected regulatory, non protein coding, viral micro RNA (miRNA) gene. The method by which VGAM2034 was detected is described hereinabove with reference to FIGS. 1-8.

VGAM2034 gene, herein designated VGAM GENE, is a viral gene contained in the genome of Kyuri Green Mottle Mosaic Virus. VGAM2034 host target gene, herein designated VGAM HOST TARGET GENE, is a human gene contained in the human genome.

VGAM2034 gene encodes a VGAM2034 precursor RNA, herein designated VGAM PRECURSOR RNA. Similar to other miRNA genes, and unlike most ordinary genes, VGAM2034 precursor RNA does not encode a protein. A nucleotide sequence identical or highly similar to the nucleotide sequence of VGAM2034 precursor RNA is designated SEQ ID:2020, and is provided hereinbelow with reference to the sequence listing part. Nucleotide sequence SEQ ID:2020 is located at position 3084 relative to the genome of Kyuri Green Mottle Mosaic Virus.

VGAM2034 precursor RNA folds onto itself, forming VGAM2034 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2034 folded precursor RNA into VGAM2034 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2034 RNA is designated SEQ ID:4745, and is provided hereinbelow with reference to the sequence listing part.

VGAM2034 host target gene, herein designated VGAM HOST TARGET GENE, encodes a corresponding messenger RNA, VGAM2034 host target RNA, herein designated VGAM HOST TARGET RNA. VGAM2034 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2034 RNA, herein designated VGAM RNA, binds complementarily to one or more host target binding sites located in untranslated regions of VGAM2034 host target RNA, herein designated VGAM HOST TARGET RNA. This complementary binding is due to the fact that the nucleotide sequence of VGAM2034 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2034 RNA, herein designated VGAM RNA, may have a different number of host target binding sites in untranslated regions of a VGAM2034 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2034 RNA, herein designated VGAM RNA, to host target binding sites on VGAM2034 host target RNA, herein designated VGAM HOST TARGET RNA, such as BINDING SITE I, BINDING SITE II and BINDING SITE III, inhibits translation of VGAM2034 host target RNA into VGAM2034 host target protein, herein designated VGAM HOST TARGET PROTEIN. VGAM host target protein is therefore outlined by a broken line.

It is appreciated that VGAM2034 host target gene, herein designated VGAM HOST TARGET GENE, in fact represents a plurality of VGAM2034 host target genes. The mRNA of each one of this plurality of VGAM2034 host target genes comprises one or more host target binding sites, each having a nucleotide sequence which is at least partly complementary to VGAM2034 RNA, herein designated VGAM RNA, and which when bound by VGAM2034 RNA causes inhibition of translation of respective one or more VGAM2034 host target proteins.

It is further appreciated by one skilled in the art that the mode of translational inhibition illustrated by FIG. 1 with specific reference to translational inhibition exerted by VGAM2034 gene, herein designated VGAM GENE, on one or more VGAM2034 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2034 is inhibition of expression of host target genes, as part of a novel viral mechanism of attacking a host. Accordingly, utilities of VGAM2034 include diagnosis, prevention and treatment of viral infection by Kyuri Green Mottle Mosaic Virus. Specific functions, and accordingly utilities, of VGAM2034 correlate with, and may be deduced from, the identity of the host target genes which VGAM2034 binds and inhibits, and the function of these host target genes, as elaborated hereinbelow.

Nucleotide sequences of the VGAM2034 precursor RNA, herein designated VGAM PRECURSOR RNA, and of the 'diced' VGAM2034 RNA, herein designated VGAM RNA, and a schematic representation of the secondary folding of VGAM2034 folded precursor RNA, herein designated VGAM FOLDED PRECURSOR RNA, of VGAM2034 are further described hereinbelow with reference to Table 1.

Nucleotide sequences of host target binding sites, such as BINDING SITE-I, BINDING SITE-II and BINDING SITE-III of FIG. 1, found on VGAM2034 host target RNA, and schematic representation of the complementarity of each of these host target binding sites to VGAM2034 RNA, herein designated VGAM RNA, are described hereinbelow with reference to Table 2.

As mentioned hereinabove with reference to FIG. 1, a function of VGAM2034 gene, herein designated VGAM is inhibition of expression of VGAM2034 target genes. It is appreciated that specific functions, and accordingly utilities, of VGAM2034 correlate with, and may be deduced from, the identity of the target genes which VGAM2034 binds and inhibits, and the function of these target genes, as elaborated hereinbelow.

C-reactive Protein, Pentraxin-related (CRP, Accession XM_049673) is a VGAM2034 host target gene. CRP BINDING SITE is HOST TARGET binding site found in the 3' untranslated region of mRNA encoded by CRP, corresponding to a HOST TARGET binding site such as BINDING SITE I, BINDING SITE II or BINDING SITE III. Table 2 illustrates the complementarity of the nucleotide sequences of CRP BINDING SITE, designated SEQ ID:35464, to the nucleotide sequence of VGAM2034 RNA, herein designated VGAM RNA, also designated SEQ ID:4745.

A function of VGAM2034 is therefore inhibition of C-reactive Protein, Pentraxin-related (CRP, Accession XM_049673). Accordingly, utilities of VGAM2034 include diagnosis, prevention and treatment of diseases and clinical conditions associated with CRP. Huntingtin (Huntington disease) (HD, Accession NM_002111) is another VGAM2034 host target gene. HD BINDING SITE is HOST TARGET binding site found in the 3' untranslated region of mRNA encoded by HD, corresponding to a HOST TARGET binding site such as BINDING SITE I, BINDING SITE II or BINDING SITE III. Table 2 illustrates the complementarity of the nucleotide sequences of HD BINDING SITE, designated SEQ ID:7898, to the nucleotide sequence of VGAM2034 RNA, herein designated VGAM RNA, also designated SEQ ID:4745.

Another function of VGAM2034 is therefore inhibition of Huntingtin (Huntington disease) (HD, Accession NM_002111). Accordingly, utilities of VGAM2034 include diagnosis, prevention and treatment of diseases and clinical conditions associated with HD. LAPTM5 (Accession NM_006762) is another VGAM2034 host target gene. LAPTM5 BINDING SITE is HOST TARGET binding site found in the 3' untranslated region of mRNA encoded by LAPTM5, corresponding to a HOST TARGET binding site such as BINDING SITE I, BINDING SITE II or BINDING SITE III. Table 2 illustrates the complementarity of the nucleotide sequences of LAPTM5 BINDING SITE, designated SEQ ID:13618, to the nucleotide sequence of VGAM2034 RNA, herein designated VGAM RNA, also designated SEQ ID:4745.

Another function of VGAM2034 is therefore inhibition of LAPTM5 (Accession NM_006762). Accordingly, utilities of VGAM2034 include diagnosis, prevention and treatment of diseases and clinical conditions associated with LAPTM5. Non-POU Domain Containing, Octamer-binding (NONO, Accession XM_088688) is another VGAM2034 host target gene. NONO BINDING SITE is HOST TARGET binding site found in the 3' untranslated region of mRNA encoded by NONO, corresponding to a HOST TARGET binding site such as BINDING SITE I, BINDING SITE II or BINDING SITE III. Table 2 illustrates the complementarity of the nucleotide sequences of NONO BINDING SITE, designated SEQ ID:39901, to the nucleotide sequence of VGAM2034 RNA, herein designated VGAM RNA, also designated SEQ ID:4745.

Another function of VGAM2034 is therefore inhibition of Non-POU Domain Containing, Octamer-binding (NONO, Accession XM_088688), a gene which is a nuclear protein which contains RNA recognition motifs. Accordingly, utilities of VGAM2034 include diagnosis, prevention and treatment of diseases and clinical conditions associated with NONO. The function of NONO and its association with various diseases and clinical conditions, has been established by previous studies, as described hereinabove with reference to VGAM95. Proprotein Convertase Subtilisin/kexin Type 1 (PCSK1, Accession NM_000439) is another VGAM2034 host target gene. PCSK1 BINDING SITE is HOST TARGET binding site found in the 3' untranslated region of mRNA encoded by PCSK1, corresponding to a HOST TARGET binding site such as BINDING SITE I, BINDING SITE II or BINDING SITE III. Table 2 illustrates the complementarity of the nucleotide sequences of PCSK1 BINDING SITE, designated SEQ ID:6024, to the nucleotide sequence of VGAM2034 RNA, herein designated VGAM RNA, also designated SEQ ID:4745.

Another function of VGAM2034 is therefore inhibition of Proprotein Convertase Subtilisin/kexin Type 1 (PCSK1, Accession NM_000439), a gene which processes hormone precursors by cleaving paired basic amino acids; serine protease of the subtilase family. Accordingly, utilities of VGAM2034 include diagnosis, prevention and treatment of diseases and clinical conditions associated with PCSK1. The function of PCSK1 and its association with various diseases and clinical conditions, has been established by previous studies, as described hereinabove with reference to VGAM1398. APELIN (Accession NM_017413) is another VGAM2034 host target gene. APELIN BINDING SITE is HOST TARGET binding site found in the 5' untranslated region of mRNA encoded by APELIN, corresponding to a HOST TARGET binding site such as BINDING SITE I, BINDING SITE II or BINDING SITE III. Table 2 illustrates the complementarity of the nucleotide sequences of APELIN BINDING SITE, designated SEQ ID:18872, to the nucleotide sequence of VGAM2034 RNA, herein designated VGAM RNA, also designated SEQ ID:4745.

Another function of VGAM2034 is therefore inhibition of APELIN (Accession NM_017413). Accordingly, utilities of VGAM2034 include diagnosis, prevention and treatment of diseases and clinical conditions associated with APELIN. Apoptosis Inhibitor 5 (API5, Accession NM_006595) is another VGAM2034 host target gene. API5 BINDING SITE is HOST TARGET binding site found in the 3' untranslated region of mRNA encoded by API5, corresponding to a HOST TARGET binding site such as BINDING SITE I, BINDING SITE II or BINDING SITE III. Table 2 illustrates the complementarity of the nucleotide sequences of API5 BINDING SITE, designated SEQ ID:13363, to the nucleotide sequence of VGAM2034 RNA, herein designated VGAM RNA, also designated SEQ ID:4745.

Another function of VGAM2034 is therefore inhibition of Apoptosis Inhibitor 5 (API5, Accession NM_006595). Accordingly, utilities of VGAM2034 include diagnosis, prevention and treatment of diseases and clinical conditions associated with API5. FLJ20979 (Accession NM_024121) is another VGAM2034 host target gene. FLJ20979 BINDING SITE is HOST TARGET binding site found in the 5' untranslated region of mRNA encoded by FLJ20979, corresponding to a HOST TARGET binding site such as BINDING SITE I, BINDING SITE II or BINDING SITE III. Table 2 illustrates the complementarity of the nucleotide sequences of FLJ20979 BINDING SITE, designated SEQ ID:23575, to the nucleotide sequence of VGAM2034 RNA, herein designated VGAM RNA, also designated SEQ ID:4745.

Another function of VGAM2034 is therefore inhibition of FLJ20979 (Accession NM_024121). Accordingly, utilities of VGAM2034 include diagnosis, prevention and treatment of diseases and clinical conditions associated with FLJ20979. KIAA0441 (Accession NM_014797) is another VGAM2034 host target gene. KIAA0441 BINDING SITE is HOST TARGET binding site found in the 3' untranslated region of mRNA encoded by KIAA0441, corresponding to a HOST TARGET binding site such as BINDING SITE I, BINDING SITE II or BINDING SITE III. Table 2 illustrates the complementarity of the nucleotide sequences of KIAA0441 BINDING SITE, designated SEQ ID:16711, to the nucleotide sequence of VGAM2034 RNA, herein designated VGAM RNA, also designated SEQ ID:4745.

Another function of VGAM2034 is therefore inhibition of KIAA0441 (Accession NM_014797). Accordingly, utilities of VGAM2034 include diagnosis, prevention and treatment of diseases and clinical conditions associated with KIAA0441. MGC15437 (Accession NM_032873) is another VGAM2034 host target gene. MGC15437 BINDING SITE is HOST TARGET binding site found in the 3' untranslated region of mRNA encoded by MGC15437, corresponding to a HOST TARGET binding site such as BINDING SITE I, BINDING SITE II or BINDING SITE III. Table 2 illustrates the complementarity of the nucleotide sequences of MGC15437 BINDING SITE, designated SEQ ID:26691, to the nucleotide sequence of VGAM2034 RNA, herein designated VGAM RNA, also designated SEQ ID:4745.

Another function of VGAM2034 is therefore inhibition of MGC15437 (Accession NM_032873). Accordingly, utilities of VGAM2034 include diagnosis, prevention and treatment of diseases and clinical conditions associated with MGC15437. LOC144079 (Accession XM_084711) is another VGAM2034 host target gene. LOC144079 BINDING SITE is HOST TARGET binding site found in the 5' untranslated region of mRNA encoded by LOC144079, corresponding to a HOST TARGET binding site such as BINDING SITE I, BINDING SITE II or BINDING SITE III. Table 2 illustrates the complementarity of the nucleotide sequences of LOC144079 BINDING SITE, designated SEQ ID:37673, to the nucleotide sequence of VGAM2034 RNA, herein designated VGAM RNA, also designated SEQ ID:4745.

Another function of VGAM2034 is therefore inhibition of LOC144079 (Accession XM_084711). Accordingly, utilities of VGAM2034 include diagnosis, prevention and treatment of diseases and clinical conditions associated with LOC144079. LOC146455 (Accession XM_085471) is another VGAM2034 host target gene. LOC146455 BINDING SITE is HOST TARGET binding site found in the 3' untranslated region of mRNA encoded by LOC146455, corresponding to a HOST TARGET binding site such as BINDING SITE I, BINDING SITE II or BINDING SITE III. Table 2 illustrates the complementarity of the nucleotide sequences of LOC146455 BINDING SITE, designated SEQ ID:38160, to the nucleotide sequence of VGAM2034 RNA, herein designated VGAM RNA, also designated SEQ ID:4745.

Another function of VGAM2034 is therefore inhibition of LOC146455 (Accession XM_085471). Accordingly, utilities of VGAM2034 include diagnosis, prevention and treatment of diseases and clinical conditions associated with LOC146455. LOC152762 (Accession XM_087518) is another VGAM2034 host target gene. LOC152762 BINDING SITE is HOST TARGET binding site found in the 3' untranslated region of mRNA encoded by LOC152762, corresponding to a HOST TARGET binding site such as BINDING SITE I, BINDING SITE II or BINDING SITE III. Table 2 illustrates the complementarity of the nucleotide sequences of LOC152762 BINDING SITE, designated SEQ ID:39307, to the nucleotide sequence of VGAM2034 RNA, herein designated VGAM RNA, also designated SEQ ID:4745.

Another function of VGAM2034 is therefore inhibition of LOC152762 (Accession XM_087518). Accordingly, utilities of VGAM2034 include diagnosis, prevention and treatment of diseases and clinical conditions associated with LOC152762. LOC153196 (Accession XM_098323) is another VGAM2034 host target gene. LOC153196 BINDING SITE is HOST TARGET binding site found in the 3' untranslated region of mRNA encoded by LOC153196, corresponding to a HOST TARGET binding site such as BINDING SITE I, BINDING SITE II or BINDING SITE III. Table 2 illustrates the complementarity of the nucleotide sequences of LOC153196 BINDING SITE, designated SEQ ID:41591, to the nucleotide sequence of VGAM2034 RNA, herein designated VGAM RNA, also designated SEQ ID:4745.

Another function of VGAM2034 is therefore inhibition of LOC153196 (Accession XM_098323). Accordingly, utilities of VGAM2034 include diagnosis, prevention and treatment of diseases and clinical conditions associated with LOC153196. LOC153505 (Accession XM_087693) is another VGAM2034 host target gene. LOC153505 BINDING SITE is HOST TARGET binding site found in the 3' untranslated region of mRNA encoded by LOC153505, corresponding to a HOST TARGET binding site such as BINDING SITE I, BINDING SITE II or BINDING SITE III. Table 2 illustrates the complementarity of the nucleotide sequences of LOC153505 BINDING SITE, designated SEQ ID:39384, to the nucleotide sequence of VGAM2034 RNA, herein designated VGAM RNA, also designated SEQ ID:4745.

Another function of VGAM2034 is therefore inhibition of LOC153505 (Accession XM_087693). Accordingly, utilities of VGAM2034 include diagnosis, prevention and treatment of diseases and clinical conditions associated with LOC153505. FIG. 1 further provides a conceptual description of a novel bioinformatically detected viral gene of the present invention, referred to here as Viral Genomic Address Messenger 2035 (VGAM2035) viral gene, which modulates expression of respective host target genes thereof, the function and utility of which host target genes is known in the art.

VGAM2035 is a novel bioinformatically detected regulatory, non protein coding, viral micro RNA (miRNA) gene. The method by which VGAM2035 was detected is described hereinabove with reference to FIGS. 1-8.

VGAM2035 gene, herein designated VGAM GENE, is a viral gene contained in the genome of Zaire Ebola Virus (ZEBOV). VGAM2035 host target gene, herein designated VGAM HOST TARGET GENE, is a human gene contained in the human genome.

VGAM2035 gene encodes a VGAM2035 precursor RNA, herein designated VGAM PRECURSOR RNA. Similar to other miRNA genes, and unlike most ordinary genes, VGAM2035 precursor RNA does not encode a protein. A nucleotide sequence identical or highly similar to the nucleotide sequence of VGAM2035 precursor RNA is designated SEQ ID:2021, and is provided hereinbelow with reference to the sequence listing part. Nucleotide sequence SEQ ID:2021 is located at position 12837 relative to the genome of Zaire Ebola Virus (ZEBOV).

VGAM2035 precursor RNA folds onto itself, forming VGAM2035 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2035 folded precursor RNA into VGAM2035 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM2035 RNA is designated SEQ ID:4746, and is provided hereinbelow with reference to the sequence listing part.

VGAM2035 host target gene, herein designated VGAM HOST TARGET GENE, encodes a corresponding messenger RNA, VGAM2035 host target RNA, herein designated VGAM HOST TARGET RNA. VGAM2035 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2035 RNA, herein designated VGAM RNA, binds complementarily to one or more host target binding sites located in untranslated regions of VGAM2035 host target RNA, herein designated VGAM HOST TARGET RNA. This complementary binding is due to the fact that the nucleotide sequence of VGAM2035 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2035 RNA, herein designated VGAM RNA, may have a different number of host target binding sites in untranslated regions of a VGAM2035 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2035 RNA, herein designated VGAM RNA, to host target binding sites on VGAM2035 host target RNA, herein designated VGAM HOST TARGET RNA, such as BINDING SITE I, BINDING SITE II and BINDING SITE III, inhibits translation of VGAM2035 host target RNA into VGAM2035 host target protein, herein designated VGAM HOST TARGET PROTEIN. VGAM host target protein is therefore outlined by a broken line.

It is appreciated that VGAM2035 host target gene, herein designated VGAM HOST TARGET GENE, in fact represents a plurality of VGAM2035 host target genes. The mRNA of each one of this plurality of VGAM2035 host target genes comprises one or more host target binding sites, each having a nucleotide sequence which is at least partly complementary to VGAM2035 RNA, herein designated VGAM RNA, and which when bound by VGAM2035 RNA causes inhibition of translation of respective one or more VGAM2035 host target proteins.

It is further appreciated by one skilled in the art that the mode of translational inhibition illustrated by FIG. 1 with specific reference to translational inhibition exerted by VGAM2035 gene, herein designated VGAM GENE, on one or more VGAM2035 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2035 is inhibition of expression of host target genes, as part of a novel viral mechanism of attacking a host. Accordingly, utilities of VGAM2035 include diagnosis, prevention and treatment of viral infection by Zaire Ebola Virus (ZEBOV). Specific functions, and accordingly utilities, of VGAM2035 correlate with, and may be deduced from, the identity of the host target genes which VGAM2035 binds and inhibits, and the function of these host target genes, as elaborated hereinbelow.

Nucleotide sequences of the VGAM2035 precursor RNA, herein designated VGAM PRECURSOR RNA, and of the 'diced' VGAM2035 RNA, herein designated VGAM RNA, and a schematic representation of the secondary folding of VGAM2035 folded precursor RNA, herein designated VGAM FOLDED PRECURSOR RNA, of VGAM2035 are further described hereinbelow with reference to Table 1.

Nucleotide sequences of host target binding sites, such as BINDING SITE-I, BINDING SITE-II and BINDING SITE-III of FIG. 1, found on VGAM2035 host target RNA, and schematic representation of the complementarity of each of these host target binding sites to VGAM2035 RNA, herein designated VGAM RNA, are described hereinbelow with reference to Table 2.

As mentioned hereinabove with reference to FIG. 1, a function of VGAM2035 gene, herein designated VGAM is inhibition of expression of VGAM2035 target genes. It is appreciated that specific functions, and accordingly utilities, of VGAM2035 correlate with, and may be deduced from, the identity of the target genes which VGAM2035 binds and inhibits, and the function of these target genes, as elaborated hereinbelow.

Activating Transcription Factor 5 (ATF5, Accession NM_012068) is a VGAM2035 host target gene. ATF5 BINDING SITE is HOST TARGET binding site found in the 5' untranslated region of mRNA encoded by ATF5, corresponding to a HOST TARGET binding site such as BINDING SITE I, BINDING SITE II or BINDING SITE III. Table 2 illustrates the complementarity of the nucleotide sequences of ATF5 BINDING SITE, designated SEQ ID:14319, to the nucleotide sequence of VGAM2035 RNA, herein designated VGAM RNA, also designated SEQ ID:4746.

A function of VGAM2035 is therefore inhibition of Activating Transcription Factor 5 (ATF5, Accession NM_012068), a gene which binds to cAMP-inducible promoters and is involved in gene transcription. Accordingly, utilities of VGAM2035 include diagnosis, prevention and treatment of diseases and clinical conditions associated with ATF5. The function of ATF5 and its association with various diseases and clinical conditions, has been established by previous studies, as described hereinabove with reference to VGAM588. Interleukin 8 Receptor, Alpha (IL8RA, Accession NM_000634) is another VGAM2035 host target gene. IL8RA BINDING SITE is HOST TARGET binding site found in the 3' untranslated region of mRNA encoded by IL8RA, corresponding to a HOST TARGET binding site such as BINDING SITE I, BINDING SITE II or BINDING SITE III. Table 2 illustrates the complementarity of the nucleotide sequences of IL8RA BINDING SITE, designated SEQ ID:6265, to the nucleotide sequence of VGAM2035 RNA, herein designated VGAM RNA, also designated SEQ ID:4746.

Another function of VGAM2035 is therefore inhibition of Interleukin 8 Receptor, Alpha (IL8RA, Accession NM_000634), a gene which is the receptor to interleukin-8, which is a powerful neutrophils chemotactic factor. Accordingly, utilities of VGAM2035 include diagnosis, prevention and treatment of diseases and clinical conditions associated with IL8RA. The function of IL8RA and its association with various diseases and clinical conditions, has been established by previous studies, as described hereinabove with reference to VGAM300. Paraoxonase 1 (PON1, Accession NM_000446) is another VGAM2035 host target gene. PON1 BINDING SITE is HOST TARGET binding site found in the 3' untranslated region of mRNA encoded by PON1, corresponding to a HOST TARGET binding site such as BINDING SITE I, BINDING SITE II or BINDING SITE III. Table 2 illustrates the complementarity of the nucleotide sequences of PON1 BINDING SITE, designated SEQ ID:6032, to the nucleotide sequence of VGAM2035 RNA, herein designated VGAM RNA, also designated SEQ ID:4746.

Another function of VGAM2035 is therefore inhibition of Paraoxonase 1 (PON1, Accession NM_000446), a gene which hydrolyzes the toxic metabolites of a variety of organophosphorus insecticides. Accordingly, utilities of VGAM2035 include diagnosis, prevention and treatment of diseases and clinical conditions associated with PON1. The function of PON1 and its association with various diseases and clinical conditions, has been established by previous studies, as described hereinabove with reference to VGAM1956. SH3-domain Binding Protein 4 (SH3BP4, Accession NM_014521) is another VGAM2035 host target gene. SH3BP4 BINDING SITE is HOST TARGET binding site found in the 3' untranslated region of mRNA encoded by SH3BP4, corresponding to a HOST TARGET binding site such as BINDING SITE I, BINDING SITE II or BINDING SITE III. Table 2 illustrates the complementarity of the nucleotide sequences of SH3BP4 BINDING SITE, designated SEQ ID:15853, to the nucleotide sequence of VGAM2035 RNA, herein designated VGAM RNA, also designated SEQ ID:4746.

Another function of VGAM2035 is therefore inhibition of SH3-domain Binding Protein 4 (SH3BP4, Accession NM_014521), a gene which is of unknown function, contains SH3-domain binding protein 4; similar to the EH-binding protein. Accordingly, utilities of VGAM2035 include diagnosis, prevention and treatment of diseases and clinical conditions associated with SH3BP4. The function of SH3BP4 and its association with various diseases and clinical conditions, has been established by previous studies, as described hereinabove with reference to VGAM179. FLJ10540 (Accession NM_018131) is another VGAM2035 host target gene. FLJ10540 BINDING SITE is HOST TARGET binding site found in the 3' untranslated region of mRNA encoded by FLJ10540, corresponding to a HOST TARGET binding site such as BINDING SITE I, BINDING SITE II or BINDING SITE III. Table 2 illustrates the complementarity of the nucleotide sequences of FLJ10540 BINDING SITE, designated SEQ ID:19926, to the nucleotide sequence of VGAM2035 RNA, herein designated VGAM RNA, also designated SEQ ID:4746.

Another function of VGAM2035 is therefore inhibition of FLJ10540 (Accession NM_018131). Accordingly, utilities of VGAM2035 include diagnosis, prevention and treatment of diseases and clinical conditions associated with FLJ10540. FLJ11370 (Accession NM_024961) is another VGAM2035 host target gene. FLJ11370 BINDING SITE is HOST TARGET binding site found in the 3' untranslated region of mRNA encoded by FLJ11370, corresponding to a HOST TARGET binding site such as BINDING SITE I, BINDING SITE II or BINDING SITE III. Table 2 illustrates the complementarity of the nucleotide sequences of FLJ11370 BINDING SITE, designated SEQ ID:24516, to the nucleotide sequence of VGAM2035 RNA, herein designated VGAM RNA, also designated SEQ ID:4746.

Another function of VGAM2035 is therefore inhibition of FLJ11370 (Accession NM_024961). Accordingly, utilities of VGAM2035 include diagnosis, prevention and treatment of diseases and clinical conditions associated with FLJ11370. FLJ21272 (Accession NM_025032) is another VGAM2035 host target gene. FLJ21272 BINDING SITE is HOST TARGET binding site found in the 3' untranslated region of mRNA encoded by FLJ21272, corresponding to a HOST TARGET binding site such as BINDING SITE I, BINDING SITE II or BINDING SITE III. Table 2 illustrates the complementarity of the nucleotide sequences of FLJ21272 BINDING SITE, designated SEQ ID:24630, to the nucleotide sequence of VGAM2035 RNA, herein designated VGAM RNA, also designated SEQ ID:4746.

Another function of VGAM2035 is therefore inhibition of FLJ21272 (Accession NM_025032). Accordingly, utilities of VGAM2035 include diagnosis, prevention and treatment of diseases and clinical conditions associated with FLJ21272. HSMPP8 (Accession XM_167894) is another VGAM2035 host target gene. HSMPP8 BINDING SITE is HOST TARGET binding site found in the 3' untranslated region of mRNA encoded by HSMPP8, corresponding to a HOST TARGET binding site such as BINDING SITE I, BINDING SITE II or BINDING SITE III. Table 2 illustrates the complementarity of the nucleotide sequences of HSMPP8 BINDING SITE, designated SEQ ID:44903, to the nucleotide sequence of VGAM2035 RNA, herein designated VGAM RNA, also designated SEQ ID:4746.

Another function of VGAM2035 is therefore inhibition of HSMPP8 (Accession XM_167894). Accordingly, utilities of VGAM2035 include diagnosis, prevention and treatment of diseases and clinical conditions associated with HSMPP8. KIAA0431 (Accession NM_015251) is another VGAM2035 host target gene. KIAA0431 BINDING SITE is HOST TARGET binding site found in the 3' untranslated region of mRNA encoded by KIAA0431, corresponding to a HOST TARGET binding site such as BINDING SITE I, BINDING SITE II or BINDING SITE III. Table 2 illustrates the complementarity of the nucleotide sequences of KIAA0431 BINDING SITE, designated SEQ ID:17578, to the nucleotide sequence of VGAM2035 RNA, herein designated VGAM RNA, also designated SEQ ID:4746.

Another function of VGAM2035 is therefore inhibition of KIAA0431 (Accession NM_015251). Accordingly, utilities of VGAM2035 include diagnosis, prevention and treatment of diseases and clinical conditions associated with KIAA0431. KIAA0562 (Accession NM_014704) is another VGAM2035 host target gene. KIAA0562 BINDING SITE is HOST TARGET binding site found in the 3' untranslated region of mRNA encoded by KIAA0562, corresponding to a HOST TARGET binding site such as BINDING SITE I, BINDING SITE II or BINDING SITE III. Table 2 illustrates the complementarity of the nucleotide sequences of KIAA0562 BINDING SITE, designated SEQ ID:16241, to the nucleotide sequence of VGAM2035 RNA, herein designated VGAM RNA, also designated SEQ ID:4746.

Another function of VGAM2035 is therefore inhibition of KIAA0562 (Accession NM_014704). Accordingly, utilities of VGAM2035 include diagnosis, prevention and treatment of diseases and clinical conditions associated with KIAA0562. KIAA1789 (Accession XM_040486) is another VGAM2035 host target gene. KIAA1789 BINDING SITE is HOST TARGET binding site found in the 5' untranslated region of mRNA encoded by KIAA1789, corresponding to a HOST TARGET binding site such as BINDING SITE I, BINDING SITE II or BINDING SITE III. Table 2 illustrates the complementarity of the nucleotide sequences of KIAA1789 BINDING SITE, designated SEQ ID:33308, to the nucleotide sequence of VGAM2035 RNA, herein designated VGAM RNA, also designated SEQ ID:4746.

Another function of VGAM2035 is therefore inhibition of KIAA1789 (Accession XM_040486). Accordingly, utilities of VGAM2035 include diagnosis, prevention and treatment of diseases and clinical conditions associated with KIAA1789. LIN-7-C (Accession NM_018362) is another VGAM2035 host target gene. LIN-7-C BINDING SITE is HOST TARGET binding site found in the 3' untranslated region of mRNA encoded by LIN-7-C, corresponding to a HOST TARGET binding site such as BINDING SITE I, BINDING SITE II or BINDING SITE III. Table 2 illustrates the complementarity of the nucleotide sequences of LIN-7-C BINDING SITE, designated SEQ ID:20371, to the nucleotide sequence of VGAM2035 RNA, herein designated VGAM RNA, also designated SEQ ID:4746.

Another function of VGAM2035 is therefore inhibition of LIN-7-C (Accession NM_018362). Accordingly, utilities of VGAM2035 include diagnosis, prevention and treatment of diseases and clinical conditions associated with LIN-7-C. LOC119504 (Accession XM_058400) is another VGAM2035 host target gene. LOC119504 BINDING SITE is HOST TARGET binding site found in the 3' untranslated region of mRNA encoded by LOC119504, corresponding to a HOST TARGET binding site such as BINDING SITE I, BINDING SITE II or BINDING SITE III. Table 2 illustrates the complementarity of the nucleotide sequences of LOC119504 BINDING SITE, designated SEQ ID:36615, to the nucleotide sequence of VGAM2035 RNA, herein designated VGAM RNA, also designated SEQ ID:4746.

Another function of VGAM2035 is therefore inhibition of LOC119504 (Accession XM_058400). Accordingly, utilities of VGAM2035 include diagnosis, prevention and treatment of diseases and clinical conditions associated with LOC119504. LOC145547 (Accession XM_085167) is another VGAM2035 host target gene. LOC145547 BINDING SITE is HOST TARGET binding site found in the 3' untranslated region of mRNA encoded by LOC145547, corresponding to a HOST TARGET binding site such as BINDING SITE I, BINDING SITE II or BINDING SITE III. Table 2 illustrates the complementarity of the nucleotide sequences of LOC145547 BINDING SITE, designated SEQ ID:37895, to the nucleotide sequence of VGAM2035 RNA, herein designated VGAM RNA, also designated SEQ ID:4746.

Another function of VGAM2035 is therefore inhibition of LOC145547 (Accession XM_085167). Accordingly, utilities of VGAM2035 include diagnosis, prevention and treatment of diseases and clinical conditions associated with LOC145547. LOC203339 (Accession XM_117534) is another VGAM2035 host target gene. LOC203339 BINDING SITE is HOST TARGET binding site found in the 3' untranslated region of mRNA encoded by LOC203339, corresponding to a HOST TARGET binding site such as BINDING SITE I, BINDING SITE II or BINDING SITE III. Table 2 illustrates the complementarity of the nucleotide sequences of LOC203339 BINDING SITE, designated SEQ ID:43525, to the nucleotide sequence of VGAM2035 RNA, herein designated VGAM RNA, also designated SEQ ID:4746.

Another function of VGAM2035 is therefore inhibition of LOC203339 (Accession XM_117534). Accordingly, utilities of VGAM2035 include diagnosis, prevention and treatment of diseases and clinical conditions associated with LOC203339. LOC253128 (Accession XM_170726) is another VGAM2035 host target gene. LOC253128 BINDING SITE is HOST TARGET binding site found in the 3' untranslated region of mRNA encoded by LOC253128, corresponding to a HOST TARGET binding site such as BINDING SITE I, BINDING SITE II or BINDING SITE III. Table 2 illustrates the complementarity of the nucleotide sequences of LOC253128 BINDING SITE, designated SEQ ID:45487, to the nucleotide sequence of VGAM2035 RNA, herein designated VGAM RNA, also designated SEQ ID:4746.

Another function of VGAM2035 is therefore inhibition of LOC253128 (Accession XM_170726). Accordingly, utilities of VGAM2035 include diagnosis, prevention and treatment of diseases and clinical conditions associated with LOC253128. LOC254065 (Accession XM_173239) is another VGAM2035 host target gene. LOC254065 BINDING SITE is HOST TARGET binding site found in the 5' untranslated region of mRNA encoded by LOC254065, corresponding to a HOST TARGET binding site such as BINDING SITE I, BINDING SITE II or BINDING SITE III. Table 2 illustrates the complementarity of the nucleotide sequences of LOC254065 BINDING SITE, designated SEQ ID:46523, to the nucleotide sequence of VGAM2035 RNA, herein designated VGAM RNA, also designated SEQ ID:4746.

Another function of VGAM2035 is therefore inhibition of LOC254065 (Accession XM_173239). Accordingly, utilities of VGAM2035 include diagnosis, prevention and treatment of diseases and clinical conditions associated with LOC254065. FIG. 1 further provides a conceptual description of a novel bioinformatically detected viral gene of the present invention, referred to here as Viral Genomic Address Messenger 2036 (VGAM2036) viral gene, which modulates expression of respective host target genes thereof, the function and utility of which host target genes is known in the art.

VGAM2036 is a novel bioinformatically detected regulatory, non protein coding, viral micro RNA (miRNA) gene. The method by which VGAM2036 was detected is described hereinabove with reference to FIGS. 1-8.

VGAM2036 gene, herein designated VGAM GENE, is a viral gene contained in the genome of Marburg Virus. VGAM2036 host target gene, herein designated VGAM HOST TARGET GENE, is a human gene contained in the human genome.

VGAM2036 gene encodes a VGAM2036 precursor RNA, herein designated VGAM PRECURSOR RNA. Similar to other miRNA genes, and unlike most ordinary genes, VGAM2036 precursor RNA does not encode a protein. A nucleotide sequence identical or highly similar to the nucleotide sequence of VGAM2036 precursor RNA is designated SEQ ID:2022, and is provided hereinbelow with reference to the sequence listing part. Nucleotide sequence SEQ ID:2022 is located at position 4709 relative to the genome of Marburg Virus.

VGAM2036 precursor RNA folds onto itself, forming VGAM2036 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2036 folded precursor RNA into VGAM2036 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2036 RNA is designated SEQ ID:4747, and is provided hereinbelow with reference to the sequence listing part.

VGAM2036 host target gene, herein designated VGAM HOST TARGET GENE, encodes a corresponding messenger RNA, VGAM2036 host target RNA, herein designated VGAM HOST TARGET RNA. VGAM2036 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2036 RNA, herein designated VGAM RNA, binds complementarily to one or more host target binding sites located in untranslated regions of VGAM2036 host target RNA, herein designated VGAM HOST TARGET RNA. This complementary binding is due to the fact that the nucleotide sequence of VGAM2036 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2036 RNA, herein designated VGAM RNA, may have a different number of host target binding sites in untranslated regions of a VGAM2036 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2036 RNA, herein designated VGAM RNA, to host target binding sites on VGAM2036 host target RNA, herein designated VGAM HOST TARGET RNA, such as BINDING SITE I, BINDING SITE II and BINDING SITE III, inhibits translation of VGAM2036 host target RNA into VGAM2036 host target protein, herein designated VGAM HOST TARGET PROTEIN. VGAM host target protein is therefore outlined by a broken line.

It is appreciated that VGAM2036 host target gene, herein designated VGAM HOST TARGET GENE, in fact represents a plurality of VGAM2036 host target genes. The mRNA of each one of this plurality of VGAM2036 host target genes comprises one or more host target binding sites, each having a nucleotide sequence which is at least partly complementary to VGAM2036 RNA, herein designated VGAM RNA, and which when bound by VGAM2036 RNA causes inhibition of translation of respective one or more VGAM2036 host target proteins.

It is further appreciated by one skilled in the art that the mode of translational inhibition illustrated by FIG. 1 with specific reference to translational inhibition exerted by VGAM2036 gene, herein designated VGAM GENE, on one or more VGAM2036 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2036 is inhibition of expression of host target genes, as part of a novel viral mechanism of attacking a host. Accordingly, utilities of VGAM2036 include diagnosis, prevention and treatment of viral infection by Marburg Virus. Specific functions, and accordingly utilities, of VGAM2036 correlate with, and may be deduced from, the identity of the host target genes which VGAM2036 binds and inhibits, and the function of these host target genes, as elaborated hereinbelow.

Nucleotide sequences of the VGAM2036 precursor RNA, herein designated VGAM PRECURSOR RNA, and of the 'diced' VGAM2036 RNA, herein designated VGAM RNA, and a schematic representation of the secondary folding of VGAM2036 folded precursor RNA, herein designated VGAM FOLDED PRECURSOR RNA, of VGAM2036 are further described hereinbelow with reference to Table 1.

Nucleotide sequences of host target binding sites, such as BINDING SITE-I, BINDING SITE-II and BINDING SITE-III of FIG. 1, found on VGAM2036 host target RNA, and schematic representation of the complementarity of each of these host target binding sites to VGAM2036 RNA, herein designated VGAM RNA, are described hereinbelow with reference to Table 2.

As mentioned hereinabove with reference to FIG. 1, a function of VGAM2036 gene, herein designated VGAM is inhibition of expression of VGAM2036 target genes. It is appreciated that specific functions, and accordingly utilities, of VGAM2036 correlate with, and may be deduced from, the identity of the target genes which VGAM2036 binds and inhibits, and the function of these target genes, as elaborated hereinbelow.

Death-associated Protein (DAP, Accession XM_051902) is a VGAM2036 host target gene. DAP BINDING SITE is HOST TARGET binding site found in the 3" untranslated region of mRNA encoded by DAP, corresponding to a HOST TARGET binding site such as BINDING SITE I, BINDING SITE II or BINDING SITE III. Table 2 illustrates the complementarity of the nucleotide sequences of DAP BINDING SITE, designated SEQ ID:35915, to the nucleotide sequence of VGAM2036 RNA, herein designated VGAM RNA, also designated SEQ ID:4747.

A function of VGAM2036 is therefore inhibition of Death-associated Protein (DAP, Accession XM_051902), a gene which mediates in programmed cell death . Accordingly, utilities of VGAM2036 include diagnosis, prevention and treatment of diseases and clinical conditions associated with DAP. The function of DAP has been established by previous studies. Deiss et al. (1995) reported that gamma-interferon (OMIM Ref. No. 147570) induced in HeLa cells a type of death that had cytologic characteristics of programmed cell death. In this system, they identified 2 novel genes whose expression was indispensable for the execution of this type of cell death. The rescue was based on positive growth selection of cells after transfection with antisense cDNA expression libraries. The antisense RNA-mediated inactivation of the 2 novel genes protected the cells from the IFNG-induced cell death, but not from the cytostatic effects of the cytokine or from a necrotic type of cell death. One of these genes was death-associated protein kinase-1 (OMIM Ref. No. 600831). The other, designated death-associated protein (DAP), was expressed as a single 2.4-kb mRNA that encodes a basic, proline-rich, 15-kD protein. The expression levels of the 2 proteins were selectively reduced by the corresponding antisense RNAs. The authors suggested that these 2 novel genes are candidates for positive mediators of programmed cell death that is induced by interferon-gamma. By analysis of rodent-human somatic cell hybrids, Feinstein et al. (1995) found that DAP is located on chromosome 5p15.2 in a region just centromeric to that to which the cri-du-chat syndrome (OMIM Ref. No. 123450) has been mapped Full details of the abovementioned studies are described in the following publications, the disclosure of which are hereby incorporated by reference:

Deiss, L. P.; Feinstein, E.; Berissi, H.; Cohen, O.; Kimchi, A.: Identification of a novel serine/threonine kinase and a novel 15-kD protein as potential mediators of the gamma interferon-induced cell death. Genes Dev. 9:15-30, 1995; and Feinstein, E.; Druck, T.; Kastury, K.; Berissi, H.; Goodart, S. A.; Overhauser, J.; Kimchi, A.; Huebner, K.: Assignment of DAP1 and DAPK: genes that positively mediate programmed cell.

Further studies establishing the function and utilities of DAP are found in John Hopkins OMIM database record ID 600954, and in sited publications numbered 8217-8218 listed in the bibliography section hereinbelow, which are also hereby incorporated by reference. Zinc Finger Protein 256 (ZNF256, Accession NM_005773) is another VGAM2036 host target gene. ZNF256 BINDING SITE is HOST TARGET binding site found in the 5' untranslated region of mRNA encoded by ZNF256, corresponding to a HOST TARGET binding site such as BINDING SITE I, BINDING SITE II or BINDING SITE III. Table 2 illustrates the complementarity of the nucleotide sequences of ZNF256 BINDING SITE, designated SEQ ID:12346, to the nucleotide sequence of VGAM2036 RNA, herein designated VGAM RNA, also designated SEQ ID:4747.

Another function of VGAM2036 is therefore inhibition of Zinc Finger Protein 256 (ZNF256, Accession NM_005773). Accordingly, utilities of VGAM2036 include diagnosis, prevention and treatment of diseases and clinical conditions associated with ZNF256. KIAA1843 (Accession XM_030838) is another VGAM2036 host target gene. KIAA1843 BINDING SITE is HOST TARGET binding site found in the 3' untranslated region of mRNA encoded by KIAA1843, corresponding to a HOST TARGET binding site such as BINDING SITE I, BINDING SITE II or BINDING SITE III. Table 2 illustrates the complementarity of the nucleotide sequences of KIAA1843 BINDING SITE, designated SEQ ID:31161, to the nucleotide sequence of VGAM2036 RNA, herein designated VGAM RNA, also designated SEQ ID:4747.

Another function of VGAM2036 is therefore inhibition of KIAA1843 (Accession XM_030838). Accordingly, utilities of VGAM2036 include diagnosis, prevention and treatment of diseases and clinical conditions associated with KIAA1843. PRO0456 (Accession NM_014127) is another VGAM2036 host target gene. PRO0456 BINDING SITE is HOST TARGET binding site found in the 3' untranslated region of mRNA encoded by PRO0456, corresponding to a HOST TARGET binding site such as BINDING SITE I, BINDING SITE II or BINDING SITE III. Table 2 illustrates the complementarity of the nucleotide sequences of PRO0456 BINDING SITE, designated SEQ ID:15393, to the nucleotide sequence of VGAM2036 RNA, herein designated VGAM RNA, also designated SEQ ID:4747.

Another function of VGAM2036 is therefore inhibition of PRO0456 (Accession NM_014127). Accordingly, utilities of VGAM2036 include diagnosis, prevention and treatment of diseases and clinical conditions associated with PRO0456. FIG. 1 further provides a conceptual description of a novel bioinformatically detected viral gene of the present invention, referred to here as Viral Genomic Address Messenger 2037 (VGAM2037) viral gene, which modulates expression of respective host target genes thereof, the function and utility of which host target genes is known in the art.

VGAM2037 is a novel bioinformatically detected regulatory, non protein coding, viral micro RNA (miRNA) gene. The method by which VGAM2037 was detected is described hereinabove with reference to FIGS. 1-8.

VGAM2037 gene, herein designated VGAM GENE, is a viral gene contained in the genome of Marburg Virus. VGAM2037 host target gene, herein designated VGAM HOST TARGET GENE, is a human gene contained in the human genome.

VGAM2037 gene encodes a VGAM2037 precursor RNA, herein designated VGAM PRECURSOR RNA. Similar to other miRNA genes, and unlike most ordinary genes, VGAM2037 precursor RNA does not encode a protein. A nucleotide sequence identical or highly similar to the nucleotide sequence of VGAM2037 precursor RNA is designated SEQ ID:2023, and is provided hereinbelow with reference to the sequence listing part. Nucleotide sequence SEQ ID:2023 is located at position 17431 relative to the genome of Marburg Virus.

VGAM2037 precursor RNA folds onto itself, forming VGAM2037 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2037 folded precursor RNA into VGAM2037 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2037 RNA is designated SEQ ID:4748, and is provided hereinbelow with reference to the sequence listing part.

VGAM2037 host target gene, herein designated VGAM HOST TARGET GENE, encodes a corresponding messenger RNA, VGAM2037 host target RNA, herein designated VGAM HOST TARGET RNA. VGAM2037 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2037 RNA, herein designated VGAM RNA, binds complementarily to one or more host target binding sites located in untranslated regions of VGAM2037 host target RNA, herein designated VGAM HOST TARGET RNA. This complementary binding is due to the fact that the nucleotide sequence of VGAM2037 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2037 RNA, herein designated VGAM RNA, may have a different number of host target binding sites in untranslated regions of a VGAM2037 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2037 RNA, herein designated VGAM RNA, to host target binding sites on VGAM2037 host target RNA, herein designated VGAM HOST TARGET RNA, such as BINDING SITE I, BINDING SITE II and BINDING SITE III, inhibits translation of VGAM2037 host target RNA into VGAM2037 host target protein, herein designated VGAM HOST TARGET PROTEIN. VGAM host target protein is therefore outlined by a broken line.

It is appreciated that VGAM2037 host target gene, herein designated VGAM HOST TARGET GENE, in fact represents a plurality of VGAM2037 host target genes. The mRNA of each one of this plurality of VGAM2037 host target genes comprises one or more host target binding sites, each having a nucleotide sequence which is at least partly complementary to VGAM2037 RNA, herein designated VGAM RNA, and which when bound by VGAM2037 RNA causes inhibition of translation of respective one or more VGAM2037 host target proteins.

It is further appreciated by one skilled in the art that the mode of translational inhibition illustrated by FIG. 1 with specific reference to translational inhibition exerted by VGAM2037 gene, herein designated VGAM GENE, on one or more VGAM2037 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2037 is inhibition of expression of host target genes, as part of a novel viral mechanism of attacking a host. Accordingly, utilities of VGAM2037 include diagnosis, prevention and treatment of viral infection by Marburg Virus. Specific functions, and accordingly utilities, of VGAM2037 correlate with, and may be deduced from, the identity of the host target genes which VGAM2037 binds and inhibits, and the function of these host target genes, as elaborated hereinbelow.

Nucleotide sequences of the VGAM2037 precursor RNA, herein designated VGAM PRECURSOR RNA, and of the 'diced' VGAM2037 RNA, herein designated VGAM RNA, and a schematic representation of the secondary folding of VGAM2037 folded precursor RNA, herein designated VGAM FOLDED PRECURSOR RNA, of VGAM2037 are further described hereinbelow with reference to Table 1.

Nucleotide sequences of host target binding sites, such as BINDING SITE-I, BINDING SITE-II and BINDING SITE-III of FIG. 1, found on VGAM2037 host target RNA, and schematic representation of the complementarity of each of these host target binding sites to VGAM2037 RNA, herein designated VGAM RNA, are described hereinbelow with reference to Table 2.

As mentioned hereinabove with reference to FIG. 1, a function of VGAM2037 gene, herein designated VGAM is inhibition of expression of VGAM2037 target genes. It is appreciated that specific functions, and accordingly utilities, of VGAM2037 correlate with, and may be deduced from, the identity of the target genes which VGAM2037 binds and inhibits, and the function of these target genes, as elaborated hereinbelow.

FLJ20449 (Accession NM_017826) is a VGAM2037 host target gene. FLJ20449 BINDING SITE is HOST TARGET binding site found in the 3' untranslated region of mRNA encoded by FLJ20449, corresponding to a HOST TARGET binding site such as BINDING SITE I, BINDING SITE II or BINDING SITE III. Table 2 illustrates the complementarity of the nucleotide sequences of FLJ20449 BINDING SITE, designated SEQ ID:19486, to the nucleotide sequence of VGAM2037 RNA, herein designated VGAM RNA, also designated SEQ ID:4748.

A function of VGAM2037 is therefore inhibition of FLJ20449 (Accession NM_017826). Accordingly, utilities of VGAM2037 include diagnosis, prevention and treatment of diseases and clinical conditions associated with FLJ20449. FLJ21044 (Accession NM_022370) is another VGAM2037 host target gene. FLJ21044 BINDING SITE is HOST TARGET binding site found in the 5' untranslated region of mRNA encoded by FLJ21044, corresponding to a HOST TARGET binding site such as BINDING SITE I, BINDING SITE II or BINDING SITE III. Table 2 illustrates the complementarity of the nucleotide sequences of FLJ21044 BINDING SITE, designated SEQ ID:22759, to the nucleotide sequence of VGAM2037 RNA, herein designated VGAM RNA, also designated SEQ ID:4748.

Another function of VGAM2037 is therefore inhibition of FLJ21044 (Accession NM_022370). Accordingly, utilities of VGAM2037 include diagnosis, prevention and treatment of diseases and clinical conditions associated with FLJ21044. KIAA0354 (Accession NM_014872) is another VGAM2037 host target gene. KIAA0354 BINDING SITE is HOST TARGET binding site found in the 3' untranslated region of mRNA encoded by KIAA0354, corresponding to a HOST TARGET binding site such as BINDING SITE I, BINDING SITE II or BINDING SITE III. Table 2 illustrates the complementarity of the nucleotide sequences of KIAA0354 BINDING SITE, designated SEQ ID:16996, to the nucleotide sequence of VGAM2037 RNA, herein designated VGAM RNA, also designated SEQ ID:4748.

Another function of VGAM2037 is therefore inhibition of KIAA0354 (Accession NM_014872). Accordingly, utilities of VGAM2037 include diagnosis, prevention and treatment of diseases and clinical conditions associated with KIAA0354. KIAA0534 (Accession XM_049349) is another VGAM2037 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35378, to the nucleotide sequence of VGAM2037 RNA, herein designated VGAM RNA, also designated SEQ ID:4748.

Another function of VGAM2037 is therefore inhibition of KIAA0534 (Accession XM_049349). Accordingly, utilities of VGAM2037 include diagnosis, prevention and treatment of diseases and clinical conditions associated with KIAA0534. KIAA0825 (Accession XM_027906) is another VGAM2037 host target gene. KIAA0825 BINDING SITE is HOST TARGET binding site found in the 3' untranslated region of mRNA encoded by KIAA0825, corresponding to a HOST TARGET binding site such as BINDING SITE I, BINDING SITE II or BINDING SITE III. Table 2 illustrates the complementarity of the nucleotide sequences of KIAA0825 BINDING SITE, designated SEQ ID:30591, to the nucleotide sequence of VGAM2037 RNA, herein designated VGAM RNA, also designated SEQ ID:4748.

Another function of VGAM2037 is therefore inhibition of KIAA0825 (Accession XM_027906). Accordingly, utilities of VGAM2037 include diagnosis, prevention and treatment of diseases and clinical conditions associated with KIAA0825. LOC115207 (Accession NM_138444) is another VGAM2037 host target gene. LOC115207 BINDING SITE is HOST TARGET binding site found in the 3' untranslated region of mRNA encoded by LOC115207, corresponding to a HOST TARGET binding site such as BINDING SITE I, BINDING SITE II or BINDING SITE III. Table 2 illustrates the complementarity of the nucleotide sequences of LOC115207 BINDING SITE, designated SEQ ID:28808, to the nucleotide sequence of VGAM2037 RNA, herein designated VGAM RNA, also designated SEQ ID:4748.

Another function of VGAM2037 is therefore inhibition of LOC115207 (Accession NM_138444). Accordingly, utilities of VGAM2037 include diagnosis, prevention and treatment of diseases and clinical conditions associated with LOC115207. FIG. 1 further provides a conceptual description of a novel bioinformatically detected viral gene of the present invention, referred to here as Viral Genomic Address Messenger 2038 (VGAM2038) viral gene, which modulates expression of respective host target genes thereof, the function and utility of which host target genes is known in the art.

VGAM2038 is a novel bioinformatically detected regulatory, non protein coding, viral micro RNA (miRNA) gene. The method by which VGAM2038 was detected is described hereinabove with reference to FIGS. 1-8.

VGAM2038 gene, herein designated VGAM GENE, is a viral gene contained in the genome of Kyuri Green Mottle Mosaic Virus. VGAM2038 host target gene, herein designated VGAM HOST TARGET GENE, is a human gene contained in the human genome.

VGAM2038 gene encodes a VGAM2038 precursor RNA, herein designated VGAM PRECURSOR RNA. Similar to other miRNA genes, and unlike most ordinary genes, VGAM2038 precursor RNA does not encode a protein. A nucleotide sequence identical or highly similar to the nucleotide sequence of VGAM2038 precursor RNA is designated SEQ ID:2024, and is provided hereinbelow with reference to the sequence listing part. Nucleotide sequence SEQ ID:2024 is located at position 2310 relative to the genome of Kyuri Green Mottle Mosaic Virus.

VGAM2038 precursor RNA folds onto itself, forming VGAM2038 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2038 folded precursor RNA into VGAM2038 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2038 RNA is designated SEQ ID:4749, and is provided hereinbelow with reference to the sequence listing part.

VGAM2038 host target gene, herein designated VGAM HOST TARGET GENE, encodes a corresponding messenger RNA, VGAM2038 host target RNA, herein designated VGAM HOST TARGET RNA. VGAM2038 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2038 RNA, herein designated VGAM RNA, binds complementarily to one or more host target binding sites located in untranslated regions of VGAM2038 host target RNA, herein designated VGAM HOST TARGET RNA. This complementary binding is due to the fact that the nucleotide sequence of VGAM2038 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2038 RNA, herein designated VGAM RNA, may have a different number of host target binding sites in untranslated regions of a VGAM2038 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2038 RNA, herein designated VGAM RNA, to host target binding sites on VGAM2038 host target RNA, herein designated VGAM HOST TARGET RNA, such as BINDING SITE I, BINDING SITE II and BINDING SITE III, inhibits translation of VGAM2038 host target RNA into VGAM2038 host target protein, herein designated VGAM HOST TARGET PROTEIN. VGAM host target protein is therefore outlined by a broken line.

It is appreciated that VGAM2038 host target gene, herein designated VGAM HOST TARGET GENE, in fact represents a plurality of VGAM2038 host target genes. The mRNA of each one of this plurality of VGAM2038 host target genes comprises one or more host target binding sites, each having a nucleotide sequence which is at least partly complementary to VGAM2038 RNA, herein designated VGAM RNA, and which when bound by VGAM2038 RNA causes inhibition of translation of respective one or more VGAM2038 host target proteins.

It is further appreciated by one skilled in the art that the mode of translational inhibition illustrated by FIG. 1 with specific reference to translational inhibition exerted by VGAM2038 gene, herein designated VGAM GENE, on one or more VGAM2038 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2038 is inhibition of expression of host target genes, as part of a novel viral mechanism of attacking a host. Accordingly, utilities of VGAM2038 include diagnosis, prevention and treatment of viral infection by Kyuri Green Mottle Mosaic Virus. Specific functions, and accordingly utilities, of VGAM2038 correlate with, and may be deduced from, the identity of the host target genes which VGAM2038 binds and inhibits, and the function of these host target genes, as elaborated hereinbelow.

Nucleotide sequences of the VGAM2038 precursor RNA, herein designated VGAM PRECURSOR RNA, and of the 'diced' VGAM2038 RNA, herein designated VGAM RNA, and a schematic representation of the secondary folding of VGAM2038 folded precursor RNA, herein designated VGAM FOLDED PRECURSOR RNA, of VGAM2038 are further described hereinbelow with reference to Table 1.

Nucleotide sequences of host target binding sites, such as BINDING SITE-I, BINDING SITE-II and BINDING SITE-III of FIG. 1, found on VGAM2038 host target RNA, and schematic representation of the complementarity of each of these host target binding sites to VGAM2038 RNA, herein designated VGAM RNA, are described hereinbelow with reference to Table 2.

As mentioned hereinabove with reference to FIG. 1, a function of VGAM2038 gene, herein designated VGAM is inhibition of expression of VGAM2038 target genes. It is appreciated that specific functions, and accordingly utilities, of VGAM2038 correlate with, and may be deduced from, the identity of the target genes which VGAM2038 binds and inhibits, and the function of these target genes, as elaborated hereinbelow.

FLJ20298 (Accession NM_017752) is a VGAM2038 host target gene. FLJ20298 BINDING SITE is HOST TARGET binding site found in the 3' untranslated region of mRNA encoded by FLJ20298, corresponding to a HOST TARGET binding site such as BINDING SITE I, BINDING SITE II or BINDING SITE III. Table 2 illustrates the complementarity of the nucleotide sequences of FLJ20298 BINDING SITE, designated SEQ ID:19362, to the nucleotide sequence of VGAM2038 RNA, herein designated VGAM RNA, also designated SEQ ID:4749.

A function of VGAM2038 is therefore inhibition of FLJ20298 (Accession NM_017752). Accordingly, utilities of VGAM2038 include diagnosis, prevention and treatment of diseases and clinical conditions associated with FLJ20298. LOC201695 (Accession XM_120432) is another VGAM2038 host target gene. LOC201695 BINDING SITE is HOST TARGET binding site found in the 5' untranslated region of mRNA encoded by LOC201695, corresponding to a HOST TARGET binding site such as BINDING SITE I, BINDING SITE II or BINDING SITE III. Table 2 illustrates the complementarity of the nucleotide sequences of LOC201695 BINDING SITE, designated SEQ ID:43609, to the nucleotide sequence of VGAM2038 RNA, herein designated VGAM RNA, also designated SEQ ID:4749.

Another function of VGAM2038 is therefore inhibition of LOC201695 (Accession XM_120432). Accordingly, utilities of VGAM2038 include diagnosis, prevention and treatment of diseases and clinical conditions associated with LOC201695. FIG. 1 further provides a conceptual description of a novel bioinformatically detected viral gene of the present invention, referred to here as Viral Genomic Address Messenger 2039 (VGAM2039) viral gene, which modulates expression of respective host target genes thereof, the function and utility of which host target genes is known in the art.

VGAM2039 is a novel bioinformatically detected regulatory, non protein coding, viral micro RNA (miRNA) gene. The method by which VGAM2039 was detected is described hereinabove with reference to FIGS. 1-8.

VGAM2039 gene, herein designated VGAM GENE, is a viral gene contained in the genome of Marburg Virus. VGAM2039 host target gene, herein designated VGAM HOST TARGET GENE, is a human gene contained in the human genome.

VGAM2039 gene encodes a VGAM2039 precursor RNA, herein designated VGAM PRECURSOR RNA. Similar to other miRNA genes, and unlike most ordinary genes, VGAM2039 precursor RNA does not encode a protein. A nucleotide sequence identical or highly similar to the nucleotide sequence of VGAM2039 precursor RNA is designated SEQ ID:2025, and is provided hereinbelow with reference to the sequence listing part. Nucleotide sequence SEQ ID:2025 is located at position 2481 relative to the genome of Marburg Virus.

VGAM2039 precursor RNA folds onto itself, forming VGAM2039 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2039 folded precursor RNA into VGAM2039 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2039 RNA is designated SEQ ID:4750, and is provided hereinbelow with reference to the sequence listing part.

VGAM2039 host target gene, herein designated VGAM HOST TARGET GENE, encodes a corresponding messenger RNA, VGAM2039 host target RNA, herein designated VGAM HOST TARGET RNA. VGAM2039 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2039 RNA, herein designated VGAM RNA, binds complementarily to one or more host target binding sites located in untranslated regions of VGAM2039 host target RNA, herein designated VGAM HOST TARGET RNA. This complementary binding is due to the fact that the nucleotide sequence of VGAM2039 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2039 RNA, herein designated VGAM RNA, may have a different number of host target binding sites in untranslated regions of a VGAM2039 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2039 RNA, herein designated VGAM RNA, to host target binding sites on VGAM2039 host target RNA, herein designated VGAM HOST TARGET RNA, such as BINDING SITE I, BINDING SITE II and BINDING SITE III, inhibits translation of VGAM2039 host target RNA into VGAM2039 host target protein, herein designated VGAM HOST TARGET PROTEIN. VGAM host target protein is therefore outlined by a broken line.

It is appreciated that VGAM2039 host target gene, herein designated VGAM HOST TARGET GENE, in fact represents a plurality of VGAM2039 host target genes. The mRNA of each one of this plurality of VGAM2039 host target genes comprises one or more host target binding sites, each having a nucleotide sequence which is at least partly complementary to VGAM2039 RNA, herein designated VGAM RNA, and which when bound by VGAM2039 RNA causes inhibition of translation of respective one or more VGAM2039 host target proteins.

It is further appreciated by one skilled in the art that the mode of translational inhibition illustrated by FIG. 1 with specific reference to translational inhibition exerted by VGAM2039 gene, herein designated VGAM GENE, on one or more VGAM2039 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2039 is inhibition of expression of host target genes, as part of a novel viral mechanism of attacking a host. Accordingly, utilities of VGAM2039 include diagnosis, prevention and treatment of viral infection by Marburg Virus. Specific functions, and accordingly utilities, of VGAM2039 correlate with, and may be deduced from, the identity of the host target genes which VGAM2039 binds and inhibits, and the function of these host target genes, as elaborated hereinbelow.

Nucleotide sequences of the VGAM2039 precursor RNA, herein designated VGAM PRECURSOR RNA, and of the 'diced' VGAM2039 RNA, herein designated VGAM RNA, and a schematic representation of the secondary folding of VGAM2039 folded precursor RNA, herein designated VGAM FOLDED PRECURSOR RNA, of VGAM2039 are further described hereinbelow with reference to Table 1.

Nucleotide sequences of host target binding sites, such as BINDING SITE-I, BINDING SITE-II and BINDING SITE-III of FIG. 1, found on VGAM2039 host target RNA, and schematic representation of the complementarity of each of these host target binding sites to VGAM2039 RNA, herein designated VGAM RNA, are described hereinbelow with reference to Table 2.

As mentioned hereinabove with reference to FIG. 1, a function of VGAM2039 gene, herein designated VGAM is inhibition of expression of VGAM2039 target genes. It is appreciated that specific functions, and accordingly utilities, of VGAM2039 correlate with, and may be deduced from, the identity of the target genes which VGAM2039 binds and inhibits, and the function of these target genes, as elaborated hereinbelow.

ABH (Accession XM_007409) is a VGAM2039 host target gene. ABH BINDING SITE is HOST TARGET binding site found in the 3' untranslated region of mRNA encoded by ABH, corresponding to a HOST TARGET binding site such as BINDING SITE I, BINDING SITE II or BINDING SITE III. Table 2 illustrates the complementarity of the nucleotide sequences of ABH BINDING SITE, designated SEQ ID:30055, to the nucleotide sequence of VGAM2039 RNA, herein designated VGAM RNA, also designated SEQ ID:4750.

A function of VGAM2039 is therefore inhibition of ABH (Accession XM_007409). Accordingly, utilities of VGAM2039 include diagnosis, prevention and treatment of diseases and clinical conditions associated with ABH. Attractin (ATRN, Accession NM_139321) is another VGAM2039 host target gene. ATRN BINDING SITE is HOST TARGET binding site found in the 3' untranslated region of mRNA encoded by ATRN, corresponding to a HOST TARGET binding site such as BINDING SITE I, BINDING SITE II or BINDING SITE III. Table 2 illustrates the complementarity of the nucleotide sequences of ATRN BINDING SITE, designated SEQ ID:29299, to the nucleotide sequence of VGAM2039 RNA, herein designated VGAM RNA, also designated SEQ ID:4750.

Another function of VGAM2039 is therefore inhibition of Attractin (ATRN, Accession NM_139321), a gene which is involved in the initial immune cell clustering during inflammatory response. Accordingly, utilities of VGAM2039 include diagnosis, prevention and treatment of diseases and clinical conditions associated with ATRN. The function of ATRN and its association with various diseases and clinical conditions, has been established by previous studies, as described hereinabove with reference to VGAM53. Cardiotrophin 1 (CTF1, Accession NM_001330) is another VGAM2039 host target gene. CTF1 BINDING SITE is HOST TARGET binding site found in the 3' untranslated region of mRNA encoded by CTF1, corresponding to a HOST TARGET binding site such as BINDING SITE I, BINDING SITE II or BINDING SITE III. Table 2 illustrates the complementarity of the nucleotide sequences of CTF1 BINDING SITE, designated SEQ ID:7011, to the nucleotide sequence of VGAM2039 RNA, herein designated VGAM RNA, also designated SEQ ID:4750.

Another function of VGAM2039 is therefore inhibition of Cardiotrophin 1 (CTF1, Accession NM_001330), a gene which may play a role in cardiac hypertrophy. Accordingly, utilities of VGAM2039 include diagnosis, prevention and treatment of diseases and clinical conditions associated with CTF1. The function of CTF1 and its association with various diseases and clinical conditions, has been established by previous studies, as described hereinabove with reference to VGAM71. Dystrobrevin, Alpha (DTNA, Accession NM_001390) is another VGAM2039 host target gene. DTNA BINDING SITE1 and DTNA BINDING SITE2 are HOST TARGET binding sites found in untranslated regions of mRNA encoded by DTNA, corresponding to HOST TARGET binding sites such as BINDING SITE I, BINDING SITE II or BINDING SITE III. Table 2 illustrates the complementarity of the nucleotide sequences of DTNA BINDING SITE1 and DTNA BINDING SITE2, designated SEQ ID:7078 and SEQ ID:7081 respectively, to the nucleotide sequence of VGAM2039 RNA, herein designated VGAM RNA, also designated SEQ ID:4750.

Another function of VGAM2039 is therefore inhibition of Dystrobrevin, Alpha (DTNA, Accession NM_001390), a gene which may be involved in the formation and stability of synapses. Accordingly, utilities of VGAM2039 include diagnosis, prevention and treatment of diseases and clinical conditions associated with DTNA. The function of DTNA and its association with various diseases and clinical conditions, has been established by previous studies, as described hereinabove with reference to VGAM1021. Glucosamine-6-phosphate Isomerase (GNPI, Accession NM_005471) is another VGAM2039 host target gene. GNPI BINDING SITE is HOST TARGET binding site found in the 3' untranslated region of mRNA encoded by GNPI, corresponding to a HOST TARGET binding site such as BINDING SITE I, BINDING SITE II or BINDING SITE III. Table 2 illustrates the complementarity of the nucleotide sequences of GNPI BINDING SITE, designated SEQ ID:11966, to the nucleotide sequence of VGAM2039 RNA, herein designated VGAM RNA, also designated SEQ ID:4750.

Another function of VGAM2039 is therefore inhibition of Glucosamine-6-phosphate Isomerase (GNPI, Accession NM_005471), a gene which converts glucosamine-6-phosphate to fructose-6-phosphate. Accordingly, utilities of VGAM2039 include diagnosis, prevention and treatment of diseases and clinical conditions associated with GNPI. The function of GNPI and its association with various diseases and clinical conditions, has been established by previous studies, as described hereinabove with reference to VGAM124. Inducible T-cell Co-stimulator (ICOS, Accession NM_012092) is another VGAM2039 host target gene. ICOS BINDING SITE is HOST TARGET binding site found in the 3' untranslated region of mRNA encoded by ICOS, corresponding to a HOST TARGET binding site such as BINDING SITE I, BINDING SITE II or BINDING SITE III. Table 2 illustrates the complementarity of the nucleotide sequences of ICOS BINDING SITE, designated SEQ ID:14388, to the nucleotide sequence of VGAM2039 RNA, herein designated VGAM RNA, also designated SEQ ID:4750.

Another function of VGAM2039 is therefore inhibition of Inducible T-cell Co-stimulator (ICOS, Accession NM_012092), a gene which forms homodimers and functions as an inducible T-cell co-stimulator. Accordingly, utilities of VGAM2039 include diagnosis, prevention and treatment of diseases and clinical conditions associated with ICOS. The function of ICOS and its association with various diseases and clinical conditions, has been established by previous studies, as described hereinabove with reference to VGAM18. Insulin Receptor (INSR, Accession XM_048346) is another VGAM2039 host target gene. INSR BINDING SITE is HOST TARGET binding site found in the 3' untranslated region of mRNA encoded by INSR, corresponding to a HOST TARGET binding site such as BINDING SITE I, BINDING SITE II or BINDING SITE III. Table 2 illustrates the complementarity of the nucleotide sequences of INSR BINDING SITE, designated SEQ ID:35155, to the nucleotide sequence of VGAM2039 RNA, herein designated VGAM RNA, also designated SEQ ID:4750.

Another function of VGAM2039 is therefore inhibition of Insulin Receptor (INSR, Accession XM_048346), a gene which binds insulin and has a tyrosine-protein kinase activity. Accordingly, utilities of VGAM2039 include diagnosis, prevention and treatment of diseases and clinical conditions associated with INSR. The function of INSR and its association with various diseases and clinical conditions, has been established by previous studies, as described hereinabove with reference to VGAM200. Integrin, Alpha 4 (antigen CD49D, alpha 4 subunit of VLA-4 receptor) (ITGA4, Accession NM_000885) is another VGAM2039 host target gene. ITGA4 BINDING SITE is HOST TARGET binding site found in the 5' untranslated region of mRNA encoded by ITGA4, corresponding to a HOST TARGET binding site such as BINDING SITE I, BINDING SITE II or BINDING SITE III. Table 2 illustrates the complementarity of the nucleotide sequences of ITGA4 BINDING SITE, designated SEQ ID:6582, to the nucleotide sequence of VGAM2039 RNA, herein designated VGAM RNA, also designated SEQ ID:4750.

Another function of VGAM2039 is therefore inhibition of Integrin, Alpha 4 (antigen CD49D, alpha 4 subunit of VLA-4 receptor) (ITGA4, Accession NM_000885), a gene which recognizes one or more domains within the alternatively spliced cs-1 and cs-5 regions of fibronectin. Accordingly, utilities of VGAM2039 include diagnosis, prevention and treatment of diseases and clinical conditions associated with ITGA4. The function of ITGA4 and its association with various diseases and clinical conditions, has been established by previous studies, as described hereinabove with reference to VGAM1096. LNK (Accession NM_005475) is another VGAM2039 host target gene. LNK BINDING SITE is HOST TARGET binding site found in the 3' untranslated region of mRNA encoded by LNK, corresponding to a HOST TARGET binding site such as BINDING SITE I, BINDING SITE II or BINDING SITE III. Table 2 illustrates the complementarity of the nucleotide sequences of LNK BINDING SITE, designated SEQ ID:11973, to the nucleotide sequence of VGAM2039 RNA, herein designated VGAM RNA, also designated SEQ ID:4750.

Another function of VGAM2039 is therefore inhibition of LNK (Accession NM_005475), a gene which links T-cell receptor activation signal to phospholipase c-gamma-1, grb-2 and phosphatidylinositol 3-kinase (by similarity). Accordingly, utilities of VGAM2039 include diagnosis, prevention and treatment of diseases and clinical conditions associated with LNK. The function of LNK and its association with various diseases and clinical conditions, has been established by previous studies, as described hereinabove with reference to VGAM115. V-maf Musculoaponeurotic Fibrosarcoma Oncogene Homolog (avian) (MAF, Accession NM_005360) is another VGAM2039 host target gene. MAF BINDING SITE is HOST TARGET binding site found in the 5' untranslated region of mRNA encoded by MAF, corresponding to a HOST TARGET binding site such as BINDING SITE I, BINDING SITE II or BINDING SITE III. Table 2 illustrates the complementarity of the nucleotide sequences of MAF BINDING SITE, designated SEQ ID:11835, to the nucleotide sequence of VGAM2039 RNA, herein designated VGAM RNA, also designated SEQ ID:4750.

Another function of VGAM2039 is therefore inhibition of V-maf Musculoaponeurotic Fibrosarcoma Oncogene Homolog (avian) (MAF, Accession NM_005360), a gene which is a transcription factor; contains a leucine zipper motif. Accordingly, utilities of VGAM2039 include diagnosis, prevention and treatment of diseases and clinical conditions associated with MAF. The function of MAF and its association with various diseases and clinical conditions, has been established by previous studies, as described hereinabove with reference to VGAM822. Mastermind-like 1 (Drosophila) (MAML1, Accession NM_014757) is another VGAM2039 host target gene. MAML1 BINDING SITE is HOST TARGET binding site found in the 3' untranslated region of mRNA encoded by MAML1, corresponding to a HOST TARGET binding site such as BINDING SITE I, BINDING SITE II or BINDING SITE III. Table 2 illustrates the complementarity of the nucleotide sequences of MAML1 BINDING SITE, designated SEQ ID:16498, to the nucleotide sequence of VGAM2039 RNA, herein designated VGAM RNA, also designated SEQ ID:4750.

Another function of VGAM2039 is therefore inhibition of Mastermind-like 1 (Drosophila) (MAML1, Accession NM_014757), a gene which MAML1 functions as a transcriptional coactivator for Notch signaling. Accordingly, utilities of VGAM2039 include diagnosis, prevention and treatment of diseases and clinical conditions associated with MAML1. The function of MAML1 and its association with various diseases and clinical conditions, has been established by previous studies, as described hereinabove with reference to VGAM556. Matrix Metalloproteinase 13 (collagenase 3) (MMP13, Accession NM_002427) is another VGAM2039 host target gene. MMP13 BINDING SITE is HOST TARGET binding site found in the 3' untranslated region of mRNA encoded by MMP13, corresponding to a HOST TARGET binding site such as BINDING SITE I, BINDING SITE II or BINDING SITE III. Table 2 illustrates the complementarity of the nucleotide sequences of MMP13 BINDING SITE, designated SEQ ID:8260, to the nucleotide sequence of VGAM2039 RNA, herein designated VGAM RNA, also designated SEQ ID:4750.

Another function of VGAM2039 is therefore inhibition of Matrix Metalloproteinase 13 (collagenase 3) (MMP13, Accession NM_002427). Accordingly, utilities of VGAM2039 include diagnosis, prevention and treatment of diseases and clinical conditions associated with MMP13. Neurotrophic Tyrosine Kinase, Receptor, Type 2 (NTRK2, Accession NM_006180) is another VGAM2039 host target gene. NTRK2 BINDING SITE is HOST TARGET binding site found in the 3' untranslated region of mRNA encoded by NTRK2, corresponding to a HOST TARGET binding site such as BINDING SITE I, BINDING SITE II or BINDING SITE III. Table 2 illustrates the complementarity of the nucleotide sequences of NTRK2 BINDING SITE, designated SEQ ID:12842, to the nucleotide sequence of VGAM2039 RNA, herein designated VGAM RNA, also designated SEQ ID:4750.

Another function of VGAM2039 is therefore inhibition of Neurotrophic Tyrosine Kinase, Receptor, Type 2 (NTRK2, Accession NM_006180), a gene which is involved in the development and/or maintenance of the nervous system. Accordingly, utilities of VGAM2039 include diagnosis, prevention and treatment of diseases and clinical conditions associated with NTRK2. The function of NTRK2 and its association with various diseases and clinical conditions, has been established by previous studies, as described hereinabove with reference to VGAM341.2'-5'-oligoadenylate Synthetase 3, 100 kDa (OAS3, Accession NM_006187) is another VGAM2039 host target gene. OAS3 BINDING SITE is HOST TARGET binding site found in the 3' untranslated region of mRNA encoded by OAS3, corresponding to a HOST TARGET binding site such as BINDING SITE I, BINDING SITE II or BINDING SITE III. Table 2 illustrates the complementarity of the nucleotide sequences of OAS3 BINDING SITE, designated SEQ ID:12861, to the nucleotide sequence of VGAM2039 RNA, herein designated VGAM RNA, also designated SEQ ID:4750.

Another function of VGAM2039 is therefore inhibition of 2'-5'-oligoadenylate Synthetase 3, 100 kDa (OAS3, Accession NM_006187), a gene which may play a role in mediating resistance to virus infection, control of cell growth, differentiation, and apoptosis. Accordingly, utilities of VGAM2039 include diagnosis, prevention and treatment of diseases and clinical conditions associated with OAS3. The function of OAS3 and its association with various diseases and clinical conditions, has been established by previous studies, as described hereinabove with reference to VGAM309. Prostaglandin F2 Receptor Negative Regulator (PTGFRN, Accession XM_040709) is another VGAM2039 host target gene. PTGFRN BINDING SITE is HOST TARGET binding site found in the 3' untranslated region of mRNA encoded by PTGFRN, corresponding to a HOST TARGET binding site such as BINDING SITE I, BINDING SITE II or BINDING SITE III. Table 2 illustrates the complementarity of the nucleotide sequences of PTGFRN BINDING SITE, designated SEQ ID:33364, to the nucleotide sequence of VGAM2039 RNA, herein designated VGAM RNA, also designated SEQ ID:4750.

Another function of VGAM2039 is therefore inhibition of Prostaglandin F2 Receptor Negative Regulator (PTGFRN, Accession XM_040709), a gene which inhibits the binding of prostaglandin f2-alpha (pgf2- alpha) to its specific fp receptor. Accordingly, utilities of VGAM2039 include diagnosis, prevention and treatment of diseases and clinical conditions associated with PTGFRN. The function of PTGFRN and its association with various diseases and clinical conditions, has been established by previous studies, as described hereinabove with reference to VGAM125. Regulator of G-protein Signalling 16 (RGS16, Accession NM_002928) is another VGAM2039 host target gene. RGS16 BINDING SITE is HOST TARGET binding site found in the 3' untranslated region of mRNA encoded by RGS16, corresponding to a HOST TARGET binding site such as BINDING SITE I, BINDING SITE II or BINDING SITE III. Table 2 illustrates the complementarity of the nucleotide sequences of RGS16 BINDING SITE, designated SEQ ID:8832, to the nucleotide sequence of VGAM2039 RNA, herein designated VGAM RNA, also designated SEQ ID:4750.

Another function of VGAM2039 is therefore inhibition of Regulator of G-protein Signalling 16 (RGS16, Accession NM_002928), a gene which inhibits signal transduction. Accordingly, utilities of VGAM2039 include diagnosis, prevention and treatment of diseases and clinical conditions associated with RGS16. The function of RGS16 and its association with various diseases and clinical conditions, has been established by previous studies, as described hereinabove with reference to VGAM1843. Regulator of G-protein Signalling 19 Interacting Protein 1 (RGS19IP1, Accession XM_031263) is another VGAM2039 host target gene. RGS19IP1 BINDING SITE is HOST TARGET binding site found in the 3' untranslated region of mRNA encoded by RGS19IP1, corresponding to a HOST TARGET binding site such as BINDING SITE I, BINDING SITE II or BINDING SITE III. Table 2 illustrates the complementarity of the nucleotide sequences of RGS19IP1 BINDING SITE, designated SEQ ID:31325, to the nucleotide sequence of VGAM2039 RNA, herein designated VGAM RNA, also designated SEQ ID:4750.

Another function of VGAM2039 is therefore inhibition of Regulator of G-protein Signalling 19 Interacting Protein 1 (RGS19IP1, Accession XM_031263), a gene which is involved in g protein-linked signaling. Accordingly, utilities of VGAM2039 include diagnosis, prevention and treatment of diseases and clinical conditions associated with RGS19IP1. The function of RGS19IP1 has been established by previous studies. Northern blot analysis detected a 1.8-kb C19ORF3 transcript in all tissues tested, with strongest expression in pancreas, followed by skeletal muscle, brain, kidney, placenta, lung, liver, and lowest expression in heart. Expression levels did not correlate with those of GAIP. Immunoblot analysis demonstrated the presence of C19ORF3 primarily in cytosolic fractions but also in membrane fractions. Immunofluorescence analysis showed expression of endogenous C19ORF3 in both a diffuse and a punctate staining pattern throughout the cytoplasm. Using a yeast 2-hybrid system, Bunn et al. (1999) isolated a cDNA encoding C19ORF3, which they called GLUT1CBP (GLUT1 (SLC2A1; 138140) C-terminus-binding protein). SDS-PAGE and Western blot analyses determined that C19ORF3 is expressed as a 39-kD protein in all tissues tested except small intestine. Yeast 2-hybrid analysis showed that C19ORF3 binds SLC2A1 through its PDZ domain. Northern blot analysis revealed similar expression patterns for C19ORF3 and SLC2A1, with both being expressed most strongly in brain. Using a yeast 2-hybrid screen for brain-interacting proteins, the authors determined that only SLC2A1, KIF1B, and alpha actinin-1 (ACTN1; 102575) bind C19ORF3 through its PDZ domain; myosin VI (MYO6; 600970) was shown to interact with C19ORF3 but not via the PDZ domain.

Full details of the abovementioned studies are described in the following publications, the disclosure of which are hereby incorporated by reference:

Bunn, R. C.; Jensen, M. A.; Reed, B. C.: Protein interactions with the glucose transporter binding protein GLUT1CBP that provide a link between GLUT1 and the cytoskeleton. Molec. Biol. Cell 10:819-832, 1999; and Von Kap-Herr, C.; Kandala, G.; Mann, S. S.; Hart, T. C.; Pettenati, M. J.; Setaluri, V.: Assignment of PDZ domain-containing protein GIPC gene (C19orf3) to human chromosome band 19p13.1 b.

Further studies establishing the function and utilities of RGS19IP1 are found in John Hopkins OMIM database record ID 605072, and in sited publications numbered 6953-6955 listed in the bibliography section hereinbelow, which are also hereby incorporated by reference. SRY (sex determining region Y)-box 12 (SOX12, Accession NM_006943) is another VGAM2039 host target gene. SOX12 BINDING SITE is HOST TARGET binding site found in the 3' untranslated region of mRNA encoded by SOX12, corresponding to a HOST TARGET binding site such as BINDING SITE I, BINDING SITE II or BINDING SITE III. Table 2 illustrates the complementarity of the nucleotide sequences of SOX12 BINDING SITE, designated SEQ ID:13830, to the nucleotide sequence of VGAM2039 RNA, herein designated VGAM RNA, also designated SEQ ID:4750.

Another function of VGAM2039 is therefore inhibition of SRY (sex determining region Y)-box 12 (SOX12, Accession NM_006943). Accordingly, utilities of VGAM2039 include diagnosis, prevention and treatment of diseases and clinical conditions associated with SOX12. Transglutaminase 2 (C polypeptide, protein-glutamine-gamma-glutamyltransferase) (TGM2, Accession NM_004613) is another VGAM2039 host target gene. TGM2 BINDING SITE is HOST TARGET binding site found in the 3' untranslated region of mRNA encoded by TGM2, corresponding to a HOST TARGET binding site such as BINDING SITE I, BINDING SITE II or BINDING SITE III. Table 2 illustrates the complementarity of the nucleotide sequences of TGM2 BINDING SITE, designated SEQ ID:10954, to the nucleotide sequence of VGAM2039 RNA, herein designated VGAM RNA, also designated SEQ ID:4750.

Another function of VGAM2039 is therefore inhibition of Transglutaminase 2 (C polypeptide, protein-glutamine-gamma-glutamyltransferase) (TGM2, Accession NM_004613), a gene which catalyzes the cross-linking of proteins and the conjugation of polyamines to proteins. Accordingly, utilities of VGAM2039 include diagnosis, prevention and treatment of diseases and clinical conditions associated with TGM2. The function of TGM2 and its association with various diseases and clinical conditions, has been established by previous studies, as described hereinabove with reference to VGAM899. Tumor Protein P63 (TP63, Accession NM_003722) is another VGAM2039 host target gene. TP63 BINDING SITE is HOST TARGET binding site found in the 3' untranslated region of mRNA encoded by TP63, corresponding to a HOST TARGET binding site such as BINDING SITE I, BINDING SITE II or BINDING SITE III. Table 2 illustrates the complementarity of the nucleotide sequences of TP63 BINDING SITE, designated SEQ ID:9815, to the nucleotide sequence of VGAM2039 RNA, herein designated VGAM RNA, also designated SEQ ID:4750.

Another function of VGAM2039 is therefore inhibition of Tumor Protein P63 (TP63, Accession NM_003722). Accordingly, utilities of VGAM2039 include diagnosis, prevention and treatment of diseases and clinical conditions associated with TP63. Vitamin D (1,25- dihydroxyvitamin D3) Receptor (VDR, Accession NM_000376) is another VGAM2039 host target gene. VDR BINDING SITE is HOST TARGET binding site found in the 3' untranslated region of mRNA encoded by VDR, corresponding to a HOST TARGET binding site such as BINDING SITE I, BINDING SITE II or BINDING SITE III. Table 2 illustrates the complementarity of the nucleotide sequences of VDR BINDING SITE, designated SEQ ID:5947, to the nucleotide sequence of VGAM2039 RNA, herein designated VGAM RNA, also designated SEQ ID:4750.

Another function of VGAM2039 is therefore inhibition of Vitamin D (1,25- dihydroxyvitamin D3) Receptor (VDR, Accession NM_000376). Accordingly, utilities of VGAM2039 include diagnosis, prevention and treatment of diseases and clinical conditions associated with VDR. Williams-Beuren Syndrome Chromosome Region 1 (WBSCR1, Accession NM_022170) is another VGAM2039 host target gene. WBSCR1 BINDING SITE1 and WBSCR1 BINDING SITE2 are HOST TARGET binding sites found in untranslated regions of mRNA encoded by WBSCR1, corresponding to HOST TARGET binding sites such as BINDING SITE I, BINDING SITE II or BINDING SITE III. Table 2 illustrates the complementarity of the nucleotide sequences of WBSCR1 BINDING SITE1 and WBSCR1 BINDING SITE2, designated SEQ ID:22722 and SEQ ID:25705 respectively, to the nucleotide sequence of VGAM2039 RNA, herein designated VGAM RNA, also designated SEQ ID:4750.

Another function of VGAM2039 is therefore inhibition of Williams-Beuren Syndrome Chromosome Region 1 (WBSCR1, Accession NM_022170), a gene which stimulates protein translation. Accordingly, utilities of VGAM2039 include diagnosis, prevention and treatment of diseases and clinical conditions associated with WBSCR1. The function of WBSCR1 and its association with various diseases and clinical conditions, has been established by previous studies, as described hereinabove with reference to VGAM110. Basic, Immunoglobulin-like Variable Motif Containing (BIVM, Accession NM_017693) is another VGAM2039 host target gene. BIVM BINDING SITE is HOST TARGET binding site found in the 5' untranslated region of mRNA encoded by BIVM, corresponding to a HOST TARGET binding site such as BINDING SITE I, BINDING SITE II or BINDING SITE III. Table 2 illustrates the complementarity of the nucleotide sequences of BIVM BINDING SITE, designated SEQ ID:19252, to the nucleotide sequence of VGAM2039 RNA, herein designated VGAM RNA, also designated SEQ ID:4750.

Another function of VGAM2039 is therefore inhibition of Basic, Immunoglobulin-like Variable Motif Containing (BIVM, Accession NM_017693). Accordingly, utilities of VGAM2039 include diagnosis, prevention and treatment of diseases and clinical conditions associated with BIVM. Carbohydrate (chondroitin 6) Sulfotransferase 3 (CHST3, Accession NM_004273) is another VGAM2039 host target gene. CHST3 BINDING SITE is HOST TARGET binding site found in the 3' untranslated region of mRNA encoded by CHST3, corresponding to a HOST TARGET binding site such as BINDING SITE I, BINDING SITE II or BINDING SITE III. Table 2 illustrates the complementarity of the nucleotide sequences of CHST3 BINDING SITE, designated SEQ ID:10480, to the nucleotide sequence of VGAM2039 RNA, herein designated VGAM RNA, also designated SEQ ID:4750.

Another function of VGAM2039 is therefore inhibition of Carbohydrate (chondroitin 6) Sulfotransferase 3 (CHST3, Accession NM_004273). Accordingly, utilities of VGAM2039 include diagnosis, prevention and treatment of diseases and clinical conditions associated with CHST3. CPR2 (Accession NM_030900) is another VGAM2039 host target gene. CPR2 BINDING SITE is HOST TARGET binding site found in the 3' untranslated region of mRNA encoded by CPR2, corresponding to a HOST TARGET binding site such as BINDING SITE I, BINDING SITE II or BINDING SITE III. Table 2 illustrates the complementarity of the nucleotide sequences of CPR2 BINDING SITE, designated SEQ ID:25175, to the nucleotide sequence of VGAM2039 RNA, herein designated VGAM RNA, also designated SEQ ID:4750.

Another function of VGAM2039 is therefore inhibition of CPR2 (Accession NM_030900). Accordingly, utilities of VGAM2039 include diagnosis, prevention and treatment of diseases and clinical conditions associated with CPR2. DCOHM (Accession NM_032151) is another VGAM2039 host target gene. DCOHM BINDING SITE is HOST TARGET binding site found in the 3' untranslated region of mRNA encoded by DCOHM, corresponding to a HOST TARGET binding site such as BINDING SITE I, BINDING SITE II or BINDING SITE III. Table 2 illustrates the complementarity of the nucleotide sequences of DCOHM BINDING SITE, designated SEQ ID:25845, to the nucleotide sequence of VGAM2039 RNA, herein designated VGAM RNA, also designated SEQ ID:4750.

Another function of VGAM2039 is therefore inhibition of DCOHM (Accession NM_032151). Accordingly, utilities of VGAM2039 include diagnosis, prevention and treatment of diseases and clinical conditions associated with DCOHM. FKSG44 (Accession NM_031904) is another VGAM2039 host target gene. FKSG44 BINDING SITE is HOST TARGET binding site found in the 3' untranslated region of mRNA encoded by FKSG44, corresponding to a HOST TARGET binding site such as BINDING SITE I, BINDING SITE II or BINDING SITE III. Table 2 illustrates the complementarity of the nucleotide sequences of FKSG44 BINDING SITE, designated SEQ ID:25648, to the nucleotide sequence of VGAM2039 RNA, herein designated VGAM RNA, also designated SEQ ID:4750.

Another function of VGAM2039 is therefore inhibition of FKSG44 (Accession NM_031904). Accordingly, utilities of VGAM2039 include diagnosis, prevention and treatment of diseases and clinical conditions associated with FKSG44. FLJ10932 (Accession NM_018277) is another VGAM2039 host target gene. FLJ10932 BINDING SITE is HOST TAR- GET binding site found in the 3' untranslated region of mRNA encoded by FLJ10932, corresponding to a HOST TARGET binding site such as BINDING SITE I, BINDING SITE II or BINDING SITE III. Table 2 illustrates the complementarity of the nucleotide sequences of FLJ10932 BINDING SITE, designated SEQ ID:20263, to the nucleotide sequence of VGAM2039 RNA, herein designated VGAM RNA, also designated SEQ ID:4750.

Another function of VGAM2039 is therefore inhibition of FLJ10932 (Accession NM_018277). Accordingly, utilities of VGAM2039 include diagnosis, prevention and treatment of diseases and clinical conditions associated with FLJ10932. FLJ20729 (Accession NM_017953) is another VGAM2039 host target gene. FLJ20729 BINDING SITE is HOST TARGET binding site found in the 3' untranslated region of mRNA encoded by FLJ20729, corresponding to a HOST TARGET binding site such as BINDING SITE I, BINDING SITE II or BINDING SITE III. Table 2 illustrates the complementarity of the nucleotide sequences of FLJ20729 BINDING SITE, designated SEQ ID:19656, to the nucleotide sequence of VGAM2039 RNA, herein designated VGAM RNA, also designated SEQ ID:4750.

Another function of VGAM2039 is therefore inhibition of FLJ20729 (Accession NM_017953). Accordingly, utilities of VGAM2039 include diagnosis, prevention and treatment of diseases and clinical conditions associated with FLJ20729. FLJ21916 (Accession NM_023112) is another VGAM2039 host target gene. FLJ21916 BINDING SITE is HOST TARGET binding site found in the 3' untranslated region of mRNA encoded by FLJ21916, corresponding to a HOST TARGET binding site such as BINDING SITE I, BINDING SITE II or BINDING SITE III. Table 2 illustrates the complementarity of the nucleotide sequences of FLJ21916 BINDING SITE, designated SEQ ID:23380, to the nucleotide sequence of VGAM2039 RNA, herein designated VGAM RNA, also designated SEQ ID:4750.

Another function of VGAM2039 is therefore inhibition of FLJ21916 (Accession NM_023112). Accordingly, utilities of VGAM2039 include diagnosis, prevention and treatment of diseases and clinical conditions associated with FLJ21916. FLJ22202 (Accession NM_024883) is another VGAM2039 host target gene. FLJ22202 BINDING SITE is HOST TARGET binding site found in the 3' untranslated region of mRNA encoded by FLJ22202, corresponding to a HOST TARGET binding site such as BINDING SITE I, BINDING SITE II or BINDING SITE III. Table 2 illustrates the complementarity of the nucleotide sequences of FLJ22202 BINDING SITE, designated SEQ ID:24337, to the nucleotide sequence of VGAM2039 RNA, herein designated VGAM RNA, also designated SEQ ID:4750.

Another function of VGAM2039 is therefore inhibition of FLJ22202 (Accession NM_024883). Accordingly, utilities of VGAM2039 include diagnosis, prevention and treatment of diseases and clinical conditions associated with FLJ22202. FLJ23462 (Accession NM_024843) is another VGAM2039 host target gene. FLJ23462 BINDING SITE is HOST TARGET binding site found in the 3' untranslated region of mRNA encoded by FLJ23462, corresponding to a HOST TARGET binding site such as BINDING SITE I, BINDING SITE II or BINDING SITE III. Table 2 illustrates the complementarity of the nucleotide sequences of FLJ23462 BINDING SITE, designated SEQ ID:24266, to the nucleotide sequence of VGAM2039 RNA, herein designated VGAM RNA, also designated SEQ ID:4750.

Another function of VGAM2039 is therefore inhibition of FLJ23462 (Accession NM_024843). Accordingly, utilities of VGAM2039 include diagnosis, prevention and treatment of diseases and clinical conditions associated with FLJ23462. Glutamate Receptor, Ionotropic, Delta 1 (GRID1, Accession XM_043613) is another VGAM2039 host target gene. GRID1 BINDING SITE is HOST TARGET binding site found in the 3' untranslated region of mRNA encoded by GRID1, corresponding to a HOST TARGET binding site such as BINDING SITE I, BINDING SITE II or BINDING SITE III. Table 2 illustrates the complementarity of the nucleotide sequences of GRID1 BINDING SITE, designated SEQ ID:33980, to the nucleotide sequence of VGAM2039 RNA, herein designated VGAM RNA, also designated SEQ ID:4750.

Another function of VGAM2039 is therefore inhibition of Glutamate Receptor, Ionotropic, Delta 1 (GRID1, Accession XM_043613). Accordingly, utilities of VGAM2039 include diagnosis, prevention and treatment of diseases and clinical conditions associated with GRID1. Hyaluronan Binding Protein 2 (HABP2, Accession NM_004132) is another VGAM2039 host target gene. HABP2 BINDING SITE is HOST TARGET binding site found in the 3' untranslated region of mRNA encoded by HABP2, corresponding to a HOST TARGET binding site such as BINDING SITE I, BINDING SITE II or BINDING SITE III. Table 2 illustrates the complementarity of the nucleotide sequences of HABP2 BINDING SITE, designated SEQ ID:10344, to the nucleotide sequence of VGAM2039 RNA, herein designated VGAM RNA, also designated SEQ ID:4750.

Another function of VGAM2039 is therefore inhibition of Hyaluronan Binding Protein 2 (HABP2, Accession NM_004132). Accordingly, utilities of VGAM2039 include diagnosis, prevention and treatment of diseases and clinical conditions associated with HABP2. HEMK (Accession NM_016173) is another VGAM2039 host target gene. HEMK BINDING SITE is HOST TARGET binding site found in the 3' untranslated region of mRNA encoded by HEMK, corresponding to a HOST TARGET binding site such as BINDING SITE I, BINDING SITE II or BINDING SITE III. Table 2 illustrates the complementarity of the nucleotide sequences of HEMK BINDING SITE, designated SEQ ID:18265, to the nucleotide sequence of VGAM2039 RNA, herein designated VGAM RNA, also designated SEQ ID:4750.

Another function of VGAM2039 is therefore inhibition of HEMK (Accession NM_016173). Accordingly, utilities of VGAM2039 include diagnosis, prevention and treatment of diseases and clinical conditions associated with HEMK. Interleukin 1 Receptor Accessory Protein-like 1 (IL1RAPL1, Accession NM_014271) is another VGAM2039 host target gene. IL1RAPL1 BINDING SITE is HOST TARGET binding site found in the 5" untranslated region of mRNA encoded by IL1RAPL1, corresponding to a HOST TARGET binding site such as BINDING SITE I, BINDING SITE II or BINDING SITE III. Table 2 illustrates the complementarity of the nucleotide sequences of IL1RAPL1 BINDING SITE, designated SEQ ID:15552, to the nucleotide sequence of VGAM2039 RNA, herein designated VGAM RNA, also designated SEQ ID:4750.

Another function of VGAM2039 is therefore inhibition of Interleukin 1 Receptor Accessory Protein-like 1 (IL1RAPL1, Accession NM_014271). Accordingly, utilities of VGAM2039 include diagnosis, prevention and treatment of diseases and clinical conditions associated with IL1RAPL1. KIAA0459 (Accession XM_027862) is another VGAM2039 host target gene. KIAA0459 BINDING SITE is HOST TARGET binding site found in the 3' untranslated region of mRNA encoded by KIAA0459, corresponding to a HOST TARGET binding site such as BINDING SITE I, BINDING SITE II or BINDING SITE III. Table 2 illustrates the complementarity of the nucleotide sequences of KIAA0459 BINDING SITE, designated SEQ ID:30575, to the nucleotide sequence of VGAM2039 RNA, herein designated VGAM RNA, also designated SEQ ID:4750.

Another function of VGAM2039 is therefore inhibition of KIAA0459 (Accession XM_027862). Accordingly, utilities of VGAM2039 include diagnosis, prevention and treatment of diseases and clinical conditions associated with KIAA0459. KIAA0731 (Accession XM_039975) is another VGAM2039 host target gene. KIAA0731 BINDING SITE is HOST TARGET binding site found in the 3' untranslated region of mRNA encoded by KIAA0731, corresponding to a HOST TARGET binding site such as BINDING SITE I, BINDING SITE II or BINDING SITE III. Table 2 illustrates the complementarity of the nucleotide sequences of KIAA0731 BINDING SITE, designated SEQ ID:33241, to the nucleotide sequence of VGAM2039 RNA, herein designated VGAM RNA, also designated SEQ ID:4750.

Another function of VGAM2039 is therefore inhibition of KIAA0731 (Accession XM_039975). Accordingly, utilities of VGAM2039 include diagnosis, prevention and treatment of diseases and clinical conditions associated with KIAA0731. KIAA0960 (Accession XM_166543) is another VGAM2039 host target gene. KIAA0960 BINDING SITE is HOST TARGET binding site found in the 5' untranslated region of mRNA encoded by KIAA0960, corresponding to a HOST TARGET binding site such as BINDING SITE I, BINDING SITE II or BINDING SITE III. Table 2 illustrates the complementarity of the nucleotide sequences of KIAA0960 BINDING SITE, designated SEQ ID:44517, to the nucleotide sequence of VGAM2039 RNA, herein designated VGAM RNA, also designated SEQ ID:4750.

Another function of VGAM2039 is therefore inhibition of KIAA0960 (Accession XM_166543). Accordingly, utilities of VGAM2039 include diagnosis, prevention and treatment of diseases and clinical conditions associated with KIAA0960. KIAA1045 (Accession XM_048592) is another VGAM2039 host target gene. KIAA1045 BINDING SITE is HOST TARGET binding site found in the 3' untranslated region of mRNA encoded by KIAA1045, corresponding to a HOST TARGET binding site such as BINDING SITE I, BINDING SITE II or BINDING SITE III. Table 2 illustrates the complementarity of the nucleotide sequences of KIAA1045 BINDING SITE, designated SEQ ID:35196, to the nucleotide sequence of VGAM2039 RNA, herein designated VGAM RNA, also designated SEQ ID:4750.

Another function of VGAM2039 is therefore inhibition of KIAA1045 (Accession XM_048592). Accordingly, utilities of VGAM2039 include diagnosis, prevention and treatment of diseases and clinical conditions associated with KIAA1045. KIAA1184 (Accession NM_022572) is another VGAM2039 host target gene. KIAA1184 BINDING SITE is HOST TARGET binding site found in the 3' untranslated region of mRNA encoded by KIAA1184, corresponding to a HOST TARGET binding site such as BINDING SITE I, BINDING SITE II or BINDING SITE III. Table 2 illustrates the complementarity of the nucleotide sequences of KIAA1184 BINDING SITE, designated SEQ ID:22897, to the nucleotide sequence of VGAM2039 RNA, herein designated VGAM RNA, also designated SEQ ID:4750.

Another function of VGAM2039 is therefore inhibition of KIAA1184 (Accession NM_022572). Accordingly, utilities of VGAM2039 include diagnosis, prevention and treatment of diseases and clinical conditions associated with KIAA1184. KIAA1323 (Accession XM_032146) is another VGAM2039 host target gene. KIAA1323 BINDING SITE is HOST TARGET binding site found in the 3' untranslated region of mRNA encoded by KIAA1323, corresponding to a HOST TARGET binding site such as BINDING SITE I, BINDING SITE II or BINDING SITE III. Table 2 illustrates the complementarity of the nucleotide sequences of KIAA1323 BINDING SITE, designated SEQ ID:31561, to the nucleotide sequence of VGAM2039 RNA, herein designated VGAM RNA, also designated SEQ ID:4750.

Another function of VGAM2039 is therefore inhibition of KIAA1323 (Accession XM_032146). Accordingly, utilities of VGAM2039 include diagnosis, prevention and treatment of diseases and clinical conditions associated with KIAA1323. KIAA1908 (Accession XM_055834) is another VGAM2039 host target gene. KIAA1908 BINDING SITE is HOST TARGET binding site found in the 3' untranslated region of mRNA encoded by KIAA1908, corresponding to a HOST TARGET binding site such as BINDING SITE I, BINDING SITE II or BINDING SITE III. Table 2 illustrates the complementarity of the nucleotide sequences of KIAA1908 BINDING SITE, designated SEQ ID:36334, to the nucleotide sequence of VGAM2039 RNA, herein designated VGAM RNA, also designated SEQ ID:4750.

Another function of VGAM2039 is therefore inhibition of KIAA1908 (Accession XM_055834). Accordingly, utilities of VGAM2039 include diagnosis, prevention and treatment of diseases and clinical conditions associated with KIAA1908. MACMARCKS (Accession NM_023009) is another VGAM2039 host target gene. MACMARCKS BINDING SITE is HOST TARGET binding site found in the 3' untranslated region of mRNA encoded by MACMARCKS, corresponding to a HOST TARGET binding site such as BINDING SITE I, BINDING SITE II or BINDING SITE III. Table 2 illustrates the complementarity of the nucleotide sequences of MACMARCKS BINDING SITE, designated SEQ ID:23272, to the nucleotide sequence of VGAM2039 RNA, herein designated VGAM RNA, also designated SEQ ID:4750.

Another function of VGAM2039 is therefore inhibition of MACMARCKS (Accession NM_023009). Accordingly, utilities of VGAM2039 include diagnosis, prevention and treatment of diseases and clinical conditions associated with MACMARCKS. MOST2 (Accession NM_020250) is another VGAM2039 host target gene. MOST2 BINDING SITE is HOST TARGET binding site found in the 5' untranslated region of mRNA encoded by MOST2, corresponding to a HOST TARGET binding site such as BINDING SITE I, BINDING SITE II or BINDING SITE III. Table 2 illustrates the complementarity of the nucleotide sequences of MOST2 BINDING SITE, designated SEQ ID:21551, to the nucleotide sequence of VGAM2039 RNA, herein designated VGAM RNA, also designated SEQ ID:4750.

Another function of VGAM2039 is therefore inhibition of MOST2 (Accession NM_020250). Accordingly, utilities of VGAM2039 include diagnosis, prevention and treatment of diseases and clinical conditions associated with MOST2. MSTP028 (Accession NM_031954) is another VGAM2039 host target gene. MSTP028 BINDING SITE is HOST TARGET binding site found in the 3' untranslated region of mRNA encoded by MSTP028, corresponding to a HOST TARGET binding site such as BINDING SITE I, BINDING SITE II or BINDING SITE III. Table 2 illustrates the complementarity of the nucleotide sequences of MSTP028 BINDING SITE, designated SEQ ID:25694, to the nucleotide sequence of VGAM2039 RNA, herein designated VGAM RNA, also designated SEQ ID:4750.

Another function of VGAM2039 is therefore inhibition of MSTP028 (Accession NM_031954). Accordingly, utilities of VGAM2039 include diagnosis, prevention and treatment of diseases and clinical conditions associated with MSTP028. Nudix (nucleoside diphosphate linked moiety X)-type Motif 4 (NUDT4, Accession NM_019094) is another VGAM2039 host target gene. NUDT4 BINDING SITE is HOST TARGET binding site found in the 3' untranslated region of mRNA encoded by NUDT4, corresponding to a HOST TARGET binding site such as BINDING SITE I, BINDING SITE II or BINDING SITE III. Table 2 illustrates the complementarity of the nucleotide sequences of NUDT4 BINDING SITE, designated SEQ ID:21169, to the nucleotide sequence of VGAM2039 RNA, herein designated VGAM RNA, also designated SEQ ID:4750.

Another function of VGAM2039 is therefore inhibition of Nudix (nucleoside diphosphate linked moiety X)-type Motif 4 (NUDT4, Accession NM_019094). Accordingly, utilities of VGAM2039 include diagnosis, prevention and treatment of diseases and clinical conditions associated with NUDT4. TACTILE (Accession NM_005816) is another VGAM2039 host target gene. TACTILE BINDING SITE is HOST TARGET binding site found in the 3' untranslated region of mRNA encoded by TACTILE, corresponding to a HOST TARGET binding site such as BINDING SITE I, BINDING SITE II or BINDING SITE III. Table 2 illustrates the complementarity of the nucleotide sequences of TACTILE BINDING SITE, designated SEQ ID:12411, to the nucleotide sequence of VGAM2039 RNA, herein designated VGAM RNA, also designated SEQ ID:4750.

Another function of VGAM2039 is therefore inhibition of TACTILE (Accession NM_005816). Accordingly, utilities of VGAM2039 include diagnosis, prevention and treatment of diseases and clinical conditions associated with TACTILE. U5-116KD (Accession NM_004247) is another VGAM2039 host target gene. U5-116KD BINDING SITE is HOST TARGET binding site found in the 3' untranslated region of mRNA encoded by U5-116KD, corresponding to a HOST TARGET binding site such as BINDING SITE I, BINDING SITE II or BINDING SITE III. Table 2 illustrates the complementarity of the nucleotide sequences of U5-116KD BINDING SITE, designated SEQ ID:10438, to the nucleotide sequence of VGAM2039 RNA, herein designated VGAM RNA, also designated SEQ ID:4750.

Another function of VGAM2039 is therefore inhibition of U5-116KD (Accession NM_004247). Accordingly, utilities of VGAM2039 include diagnosis, prevention and treatment of diseases and clinical conditions associated with U5-116KD. UBE3B (Accession XM_084941) is another VGAM2039 host target gene. UBE3B BINDING SITE is HOST TARGET binding site found in the 3' untranslated region of mRNA encoded by UBE3B, corresponding to a HOST TARGET binding site such as BINDING SITE I, BINDING SITE II or BINDING SITE III. Table 2 illustrates the complementarity of the nucleotide sequences of UBE3B BINDING SITE, designated SEQ ID:37773, to the nucleotide sequence of VGAM2039 RNA, herein designated VGAM RNA, also designated SEQ ID:4750.

Another function of VGAM2039 is therefore inhibition of UBE3B (Accession XM_084941). Accordingly, utilities of VGAM2039 include diagnosis, prevention and treatment of diseases and clinical conditions associated with UBE3B. Ubiquitin Specific Protease 10 (USP10, Accession XM_033922) is another VGAM2039 host target gene. USP10 BINDING SITE is HOST TARGET binding site found in the 3' untranslated region of mRNA encoded by USP10, corresponding to a HOST TARGET binding site such as BINDING SITE I, BINDING SITE II or BINDING SITE III. Table 2 illustrates the complementarity of the nucleotide sequences of USP10 BINDING SITE, designated SEQ ID:31984, to the nucleotide sequence of VGAM2039 RNA, herein designated VGAM RNA, also designated SEQ ID:4750.

Another function of VGAM2039 is therefore inhibition of Ubiquitin Specific Protease 10 (USP10, Accession XM_033922). Accordingly, utilities of VGAM2039 include diagnosis, prevention and treatment of diseases and clinical conditions associated with USP10. Zinc Finger, DHHC Domain Containing 2 (ZDHHC2, Accession NM_016353) is another VGAM2039 host target gene. ZDHHC2 BINDING SITE is HOST TARGET binding site found in the 3' untranslated region of mRNA encoded by ZDHHC2, corresponding to a HOST TARGET binding site such as BINDING SITE I, BINDING SITE II or BINDING SITE III. Table 2 illustrates the complementarity of the nucleotide sequences of ZDHHC2 BINDING SITE, designated SEQ ID:18488, to the nucleotide sequence of VGAM2039 RNA, herein designated VGAM RNA, also designated SEQ ID:4750.

Another function of VGAM2039 is therefore inhibition of Zinc Finger, DHHC Domain Containing 2 (ZDHHC2, Accession NM_016353). Accordingly, utilities of VGAM2039 include diagnosis, prevention and treatment of diseases and clinical conditions associated with ZDHHC2. LOC138389 (Accession XM_072534) is another VGAM2039 host target gene. LOC138389 BINDING SITE is HOST TARGET binding site found in the 5' untranslated region of mRNA encoded by LOC138389, corresponding to a HOST TARGET binding site such as BINDING SITE I, BINDING SITE II or BINDING SITE III. Table 2 illustrates the complementarity of the nucleotide sequences of LOC138389 BINDING SITE, designated SEQ ID:37506, to the nucleotide sequence of VGAM2039 RNA, herein designated VGAM RNA, also designated SEQ ID:4750.

Another function of VGAM2039 is therefore inhibition of LOC138389 (Accession XM_072534). Accordingly, utilities of VGAM2039 include diagnosis, prevention and treatment of diseases and clinical conditions associated with LOC138389. LOC144110 (Accession XM_084735) is another VGAM2039 host target gene. LOC144110 BINDING SITE is HOST TARGET binding site found in the 3' untranslated region of mRNA encoded by LOC144110, corresponding to a HOST TARGET binding site such as BINDING SITE I, BINDING SITE II or BINDING SITE III. Table 2 illustrates the complementarity of the nucleotide sequences of LOC144110 BINDING SITE, designated SEQ ID:37679, to the nucleotide sequence of VGAM2039 RNA, herein designated VGAM RNA, also designated SEQ ID:4750.

Another function of VGAM2039 is therefore inhibition of LOC144110 (Accession XM_084735). Accordingly, utilities of VGAM2039 include diagnosis, prevention and treatment of diseases and clinical conditions associated with LOC144110. LOC144558 (Accession XM_096629) is another VGAM2039 host target gene. LOC144558 BINDING SITE is HOST TARGET binding site found in the 5' untranslated region of mRNA encoded by LOC144558, corresponding to a HOST TARGET binding site such as BINDING SITE I, BINDING SITE II or BINDING SITE III. Table 2 illustrates the complementarity of the nucleotide sequences of LOC144558 BINDING SITE, designated SEQ ID:40438, to the nucleotide sequence of VGAM2039 RNA, herein designated VGAM RNA, also designated SEQ ID:4750.

Another function of VGAM2039 is therefore inhibition of LOC144558 (Accession XM_096629). Accordingly, utilities of VGAM2039 include diagnosis, prevention and treatment of diseases and clinical conditions associated with LOC144558. LOC144893 (Accession XM_096687) is another VGAM2039 host target gene. LOC144893 BINDING SITE is HOST TARGET binding site found in the 5' untranslated region of mRNA encoded by LOC144893, corresponding to a HOST TARGET binding site such as BINDING SITE I, BINDING SITE II or BINDING SITE III. Table 2 illustrates the complementarity of the nucleotide sequences of LOC144893 BINDING SITE, designated SEQ ID:40459, to the nucleotide sequence of VGAM2039 RNA, herein designated VGAM RNA, also designated SEQ ID:4750.

Another function of VGAM2039 is therefore inhibition of LOC144893 (Accession XM_096687). Accordingly, utilities of VGAM2039 include diagnosis, prevention and treatment of diseases and clinical conditions associated with LOC144893. LOC145368 (Accession XM_085112) is another VGAM2039 host target gene. LOC145368 BINDING SITE is HOST TARGET binding site found in the 3' untranslated region of mRNA encoded by LOC145368, corresponding to a HOST TARGET binding site such as BINDING SITE I, BINDING SITE II or BINDING SITE III. Table 2 illustrates the complementarity of the nucleotide sequences of LOC145368 BINDING SITE, designated SEQ ID:37828, to the nucleotide sequence of VGAM2039 RNA, herein designated VGAM RNA, also designated SEQ ID:4750.

Another function of VGAM2039 is therefore inhibition of LOC145368 (Accession XM_085112). Accordingly, utilities of VGAM2039 include diagnosis, prevention and treatment of diseases and clinical conditions associated with LOC145368. LOC145719 (Accession XM_096848) is another VGAM2039 host target gene. LOC145719 BINDING SITE is HOST TARGET binding site found in the 5' untranslated region of mRNA encoded by LOC145719, corresponding to a HOST TARGET binding site such as BINDING SITE I, BINDING SITE II or BINDING SITE III. Table 2 illustrates the complementarity of the nucleotide sequences of LOC145719 BINDING SITE, designated SEQ ID:40576, to the nucleotide sequence of VGAM2039 RNA, herein designated VGAM RNA, also designated SEQ ID:4750.

Another function of VGAM2039 is therefore inhibition of LOC145719 (Accession XM_096848). Accordingly, utilities of VGAM2039 include diagnosis, prevention and treatment of diseases and clinical conditions associated with LOC145719. LOC145720 (Accession XM_096846) is another VGAM2039 host target gene. LOC145720 BINDING SITE is HOST TARGET binding site found in the 5' untranslated region of mRNA encoded by LOC145720, corresponding to a HOST TARGET binding site such as BINDING SITE I, BINDING SITE II or BINDING SITE III. Table 2 illustrates the complementarity of the nucleotide sequences of LOC145720 BINDING SITE, designated SEQ ID:40565, to the nucleotide sequence of VGAM2039 RNA, herein designated VGAM RNA, also designated SEQ ID:4750.

Another function of VGAM2039 is therefore inhibition of LOC145720 (Accession XM_096846). Accordingly, utilities of VGAM2039 include diagnosis, prevention and treatment of diseases and clinical conditions associated with LOC145720. LOC146346 (Accession XM_085430) is another VGAM2039 host target gene. LOC146346 BINDING SITE is HOST TARGET binding site found in the 5' untranslated region of mRNA encoded by LOC146346, corresponding to a HOST TARGET binding site such as BINDING SITE I, BINDING SITE II or BINDING SITE III. Table 2 illustrates the complementarity of the nucleotide sequences of LOC146346 BINDING SITE, designated SEQ ID:38135, to the nucleotide sequence of VGAM2039 RNA, herein designated VGAM RNA, also designated SEQ ID:4750.

Another function of VGAM2039 is therefore inhibition of LOC146346 (Accession XM_085430). Accordingly, utilities of VGAM2039 include diagnosis, prevention and treatment of diseases and clinical conditions associated with LOC146346. LOC148029 (Accession XM_086014) is another VGAM2039 host target gene. LOC148029 BINDING SITE is HOST TARGET binding site found in the 5' untranslated region of mRNA encoded by LOC148029, corresponding to a HOST TARGET binding site such as BINDING SITE I, BINDING SITE II or BINDING SITE III. Table 2 illustrates the complementarity of the nucleotide sequences of LOC148029 BINDING SITE, designated SEQ ID:38445, to the nucleotide sequence of VGAM2039 RNA, herein designated VGAM RNA, also designated SEQ ID:4750.

Another function of VGAM2039 is therefore inhibition of LOC148029 (Accession XM_086014). Accordingly, utilities of VGAM2039 include diagnosis, prevention and treatment of diseases and clinical conditions associated with LOC148029. LOC150423 (Accession XM_086912) is another VGAM2039 host target gene. LOC150423 BINDING SITE is HOST TARGET binding site found in the 3' untranslated region of mRNA encoded by LOC150423, corresponding to a HOST TARGET binding site such as BINDING SITE I, BINDING SITE II or BINDING SITE III. Table 2 illustrates the complementarity of the nucleotide sequences of LOC150423 BINDING SITE, designated SEQ ID:38968, to the nucleotide sequence of VGAM2039 RNA, herein designated VGAM RNA, also designated SEQ ID:4750.

Another function of VGAM2039 is therefore inhibition of LOC150423 (Accession XM_086912). Accordingly, utilities of VGAM2039 include diagnosis, prevention and treatment of diseases and clinical conditions associated with LOC150423. LOC155072 (Accession XM_098661) is another VGAM2039 host target gene. LOC155072 BINDING SITE is HOST TARGET binding site found in the 3' untranslated region of mRNA encoded by LOC155072, corresponding to a HOST TARGET binding site such as BINDING SITE I, BINDING SITE II or BINDING SITE III. Table 2 illustrates the complementarity of the nucleotide sequences of LOC155072 BINDING SITE, designated SEQ ID:41760, to the nucleotide sequence of VGAM2039 RNA, herein designated VGAM RNA, also designated SEQ ID:4750.

Another function of VGAM2039 is therefore inhibition of LOC155072 (Accession XM_098661). Accordingly, utilities of VGAM2039 include diagnosis, prevention and treatment of diseases and clinical conditions associated with LOC155072. LOC158156 (Accession XM_088496) is another VGAM2039 host target gene. LOC158156 BINDING SITE is HOST TARGET binding site found in the 3' untranslated region of mRNA encoded by LOC158156, corresponding to a HOST TARGET binding site such as BINDING SITE I, BINDING SITE II or BINDING SITE III. Table 2 illustrates the complementarity of the nucleotide sequences of LOC158156 BINDING SITE, designated SEQ ID:39741, to the nucleotide sequence of VGAM2039 RNA, herein designated VGAM RNA, also designated SEQ ID:4750.

Another function of VGAM2039 is therefore inhibition of LOC158156 (Accession XM_088496). Accordingly, utilities of VGAM2039 include diagnosis, prevention and treatment of diseases and clinical conditions associated with LOC158156. LOC169270 (Accession XM_095607) is another VGAM2039 host target gene. LOC169270 BINDING SITE is HOST TARGET binding site found in the 3' untranslated region of mRNA encoded by LOC169270, corresponding to a HOST TARGET binding site such as BINDING SITE I, BINDING SITE II or BINDING SITE III. Table 2 illustrates the complementarity of the nucleotide sequences of LOC169270 BINDING SITE, designated SEQ ID:40274, to the nucleotide sequence of VGAM2039 RNA, herein designated VGAM RNA, also designated SEQ ID:4750.

Another function of VGAM2039 is therefore inhibition of LOC169270 (Accession XM_095607). Accordingly, utilities of VGAM2039 include diagnosis, prevention and treatment of diseases and clinical conditions associated with LOC169270. LOC197114 (Accession XM_116987) is another VGAM2039 host target gene. LOC197114 BINDING SITE is HOST TARGET binding site found in the 5' untranslated region of mRNA encoded by LOC197114, corresponding to a HOST TARGET binding site such as BINDING SITE I, BINDING SITE II or BINDING SITE III. Table 2 illustrates the complementarity of the nucleotide sequences of LOC197114 BINDING SITE, designated SEQ ID:43188, to the nucleotide sequence of VGAM2039 RNA, herein designated VGAM RNA, also designated SEQ ID:4750.

Another function of VGAM2039 is therefore inhibition of LOC197114 (Accession XM_116987). Accordingly, utilities of VGAM2039 include diagnosis, prevention and treatment of diseases and clinical conditions associated with LOC197114. LOC201799 (Accession XM_114380) is another VGAM2039 host target gene. LOC201799 BINDING SITE is HOST TARGET binding site found in the 3' untranslated region of mRNA encoded by LOC201799, corresponding to a HOST TARGET binding site such as BINDING SITE I, BINDING SITE II or BINDING SITE III. Table 2 illustrates the complementarity of the nucleotide sequences of LOC201799 BINDING SITE, designated SEQ ID:42916, to the nucleotide sequence of VGAM2039 RNA, herein designated VGAM RNA, also designated SEQ ID:4750.

Another function of VGAM2039 is therefore inhibition of LOC201799 (Accession XM_114380). Accordingly, utilities of VGAM2039 include diagnosis, prevention and treatment of diseases and clinical conditions associated with LOC201799. LOC202868 (Accession XM_117477) is another VGAM2039 host target gene. LOC202868 BINDING SITE is HOST TARGET binding site found in the 3' untranslated region of mRNA encoded by LOC202868, corresponding to a HOST TARGET binding site such as BINDING SITE I, BINDING SITE II or BINDING SITE III. Table 2 illustrates the complementarity of the nucleotide sequences of LOC202868 BINDING SITE, designated SEQ ID:43447, to the nucleotide sequence of VGAM2039 RNA, herein designated VGAM RNA, also designated SEQ ID:4750.

Another function of VGAM2039 is therefore inhibition of LOC202868 (Accession XM_117477). Accordingly, utilities of VGAM2039 include diagnosis, prevention and treatment of diseases and clinical conditions associated with LOC202868. LOC220758 (Accession XM_165466) is another VGAM2039 host target gene. LOC220758 BINDING SITE is HOST TARGET binding site found in the 3' untranslated region of mRNA encoded by LOC220758, corresponding to a HOST TARGET binding site such as BINDING SITE I, BINDING SITE II or BINDING SITE III. Table 2 illustrates the complementarity of the nucleotide sequences of LOC220758 BINDING SITE, designated SEQ ID:43642, to the nucleotide sequence of VGAM2039 RNA, herein designated VGAM RNA, also designated SEQ ID:4750.

Another function of VGAM2039 is therefore inhibition of LOC220758 (Accession XM_165466). Accordingly, utilities of VGAM2039 include diagnosis, prevention and treatment of diseases and clinical conditions associated with LOC220758. LOC221528 (Accession XM_166377) is another VGAM2039 host target gene. LOC221528 BINDING SITE is HOST TARGET binding site found in the 5' untranslated region of mRNA encoded by LOC221528, corresponding to a HOST TARGET binding site such as BINDING SITE I, BINDING SITE II or BINDING SITE III. Table 2 illustrates the complementarity of the nucleotide sequences of LOC221528 BINDING SITE, designated SEQ ID:44211, to the nucleotide sequence of VGAM2039 RNA, herein designated VGAM RNA, also designated SEQ ID:4750.

Another function of VGAM2039 is therefore inhibition of LOC221528 (Accession XM_166377). Accordingly, utilities of VGAM2039 include diagnosis, prevention and treatment of diseases and clinical conditions associated with LOC221528. LOC221687 (Accession XM_166423) is another VGAM2039 host target gene. LOC221687 BINDING SITE is HOST TARGET binding site found in the 3' untranslated region of mRNA encoded by LOC221687, corresponding to a HOST TARGET binding site such as BINDING SITE I, BINDING SITE II or BINDING SITE III. Table 2 illustrates the complementarity of the nucleotide sequences of LOC221687 BINDING SITE, designated SEQ ID:44307, to the nucleotide sequence of VGAM2039 RNA, herein designated VGAM RNA, also designated SEQ ID:4750.

Another function of VGAM2039 is therefore inhibition of LOC221687 (Accession XM_166423). Accordingly, utilities of VGAM2039 include diagnosis, prevention and treatment of diseases and clinical conditions associated with LOC221687. LOC221882 (Accession XM_166507) is another VGAM2039 host target gene. LOC221882 BINDING SITE is HOST TARGET binding site found in the 5' untranslated region of mRNA encoded by LOC221882, corresponding to a HOST TARGET binding site such as BINDING SITE I, BINDING SITE II or BINDING SITE III. Table 2 illustrates the complementarity of the nucleotide sequences of LOC221882 BINDING SITE, designated SEQ ID:44433, to the nucleotide sequence of VGAM2039 RNA, herein designated VGAM RNA, also designated SEQ ID:4750.

Another function of VGAM2039 is therefore inhibition of LOC221882 (Accession XM_166507). Accordingly, utilities of VGAM2039 include diagnosis, prevention and treatment of diseases and clinical conditions associated with LOC221882. LOC255461 (Accession XM_173207) is another VGAM2039 host target gene. LOC255461 BINDING SITE is HOST TARGET binding site found in the 5' untranslated region of mRNA encoded by LOC255461, corresponding to a HOST TARGET binding site such as BINDING SITE I, BINDING SITE II or BINDING SITE III. Table 2 illustrates the complementarity of the nucleotide sequences of LOC255461 BINDING SITE, designated SEQ ID:46465, to the nucleotide sequence of VGAM2039 RNA, herein designated VGAM RNA, also designated SEQ ID:4750.

Another function of VGAM2039 is therefore inhibition of LOC255461 (Accession XM_173207). Accordingly, utilities of VGAM2039 include diagnosis, prevention and treatment of diseases and clinical conditions associated with LOC255461. LOC255516 (Accession XM_173212) is another VGAM2039 host target gene. LOC255516 BINDING SITE is HOST TARGET binding site found in the 5' untranslated region of mRNA encoded by LOC255516, corresponding to a HOST TARGET binding site such as BINDING SITE I, BINDING SITE II or BINDING SITE III. Table 2 illustrates the complementarity of the nucleotide sequences of LOC255516 BINDING SITE, designated SEQ ID:46471, to the nucleotide sequence of VGAM2039 RNA, herein designated VGAM RNA, also designated SEQ ID:4750.

Another function of VGAM2039 is therefore inhibition of LOC255516 (Accession XM_173212). Accordingly, utilities of VGAM2039 include diagnosis, prevention and treatment of diseases and clinical conditions associated with LOC255516. LOC256789 (Accession XM_173369) is another VGAM2039 host target gene. LOC256789 BIND- ING SITE is HOST TARGET binding site found in the 5' untranslated region of mRNA encoded by LOC256789, corresponding to a HOST TARGET binding site such as BINDING SITE I, BINDING SITE II or BINDING SITE III. Table 2 illustrates the complementarity of the nucleotide sequences of LOC256789 BINDING SITE, designated SEQ ID:46536, to the nucleotide sequence of VGAM2039 RNA, herein designated VGAM RNA, also designated SEQ ID:4750.

Another function of VGAM2039 is therefore inhibition of LOC256789 (Accession XM_173369). Accordingly, utilities of VGAM2039 include diagnosis, prevention and treatment of diseases and clinical conditions associated with LOC256789. LOC257552 (Accession XM_175174) is another VGAM2039 host target gene. LOC257552 BINDING SITE is HOST TARGET binding site found in the 5' untranslated region of mRNA encoded by LOC257552, corresponding to a HOST TARGET binding site such as BINDING SITE I, BINDING SITE II or BINDING SITE III. Table 2 illustrates the complementarity of the nucleotide sequences of LOC257552 BINDING SITE, designated SEQ ID:46670, to the nucleotide sequence of VGAM2039 RNA, herein designated VGAM RNA, also designated SEQ ID:4750.

Another function of VGAM2039 is therefore inhibition of LOC257552 (Accession XM_175174). Accordingly, utilities of VGAM2039 include diagnosis, prevention and treatment of diseases and clinical conditions associated with LOC257552. LOC257602 (Accession XM_175246) is another VGAM2039 host target gene. LOC257602 BINDING SITE is HOST TARGET binding site found in the 5' untranslated region of mRNA encoded by LOC257602, corresponding to a HOST TARGET binding site such as BINDING SITE I, BINDING SITE II or BINDING SITE III. Table 2 illustrates the complementarity of the nucleotide sequences of LOC257602 BINDING SITE, designated SEQ ID:46700, to the nucleotide sequence of VGAM2039 RNA, herein designated VGAM RNA, also designated SEQ ID:4750.

Another function of VGAM2039 is therefore inhibition of LOC257602 (Accession XM_175246). Accordingly, utilities of VGAM2039 include diagnosis, prevention and treatment of diseases and clinical conditions associated with LOC257602. LOC90342 (Accession XM_031009) is another VGAM2039 host target gene. LOC90342 BINDING SITE is HOST TARGET binding site found in the 5' untranslated region of mRNA encoded by LOC90342, corresponding to a HOST TARGET binding site such as BINDING SITE I, BINDING SITE II or BINDING SITE III. Table 2 illustrates the complementarity of the nucleotide sequences of LOC90342 BINDING SITE, designated SEQ ID:31251, to the nucleotide sequence of VGAM2039 RNA, herein designated VGAM RNA, also designated SEQ ID:4750.

Another function of VGAM2039 is therefore inhibition of LOC90342 (Accession XM_031009). Accordingly, utilities of VGAM2039 include diagnosis, prevention and treatment of diseases and clinical conditions associated with LOC90342. FIG. 1 further provides a conceptual description of a novel bioinformatically detected viral gene of the present invention, referred to here as Viral Genomic Address Messenger 2040 (VGAM2040) viral gene, which modulates expression of respective host target genes thereof, the function and utility of which host target genes is known in the art.

VGAM2040 is a novel bioinformatically detected regulatory, non protein coding, viral micro RNA (miRNA) gene. The method by which VGAM2040 was detected is described hereinabove with reference to FIGS. 1-8.

VGAM2040 gene, herein designated VGAM GENE, is a viral gene contained in the genome of Marburg Virus. VGAM2040 host target gene, herein designated VGAM HOST TARGET GENE, is a human gene contained in the human genome.

VGAM2040 gene encodes a VGAM2040 precursor RNA, herein designated VGAM PRECURSOR RNA. Similar to other miRNA genes, and unlike most ordinary genes, VGAM2040 precursor RNA does not encode a protein. A nucleotide sequence identical or highly similar to the nucleotide sequence of VGAM2040 precursor RNA is designated SEQ ID:2026, and is provided hereinbelow with reference to the sequence listing part. Nucleotide sequence SEQ ID:2026 is located at position 5679 relative to the genome of Marburg Virus.

VGAM2040 precursor RNA folds onto itself, forming VGAM2040 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2040 folded precursor RNA into VGAM2040 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2040 RNA is designated SEQ ID:4751, and is provided hereinbelow with reference to the sequence listing part.

VGAM2040 host target gene, herein designated VGAM HOST TARGET GENE, encodes a corresponding messenger RNA, VGAM2040 host target RNA, herein designated VGAM HOST TARGET RNA. VGAM2040 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2040 RNA, herein designated VGAM RNA, binds complementarily to one or more host target binding sites located in untranslated regions of VGAM2040 host target RNA, herein designated VGAM HOST TARGET RNA. This complementary binding is due to the fact that the nucleotide sequence of VGAM2040 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2040 RNA, herein designated VGAM RNA, may have a different number of host target binding sites in untranslated regions of a VGAM2040 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2040 RNA, herein designated VGAM RNA, to host target binding sites on VGAM2040 host target RNA, herein designated VGAM HOST TARGET RNA, such as BINDING SITE I, BINDING SITE II and BINDING SITE III, inhibits translation of VGAM2040 host target RNA into VGAM2040 host target protein, herein designated VGAM HOST TARGET PROTEIN. VGAM host target protein is therefore outlined by a broken line.

It is appreciated that VGAM2040 host target gene, herein designated VGAM HOST TARGET GENE, in fact represents a plurality of VGAM2040 host target genes. The mRNA of each one of this plurality of VGAM2040 host target genes comprises one or more host target binding sites, each having a nucleotide sequence which is at least partly complementary to VGAM2040 RNA, herein designated VGAM RNA, and which when bound by VGAM2040 RNA causes inhibition of translation of respective one or more VGAM2040 host target proteins.

It is further appreciated by one skilled in the art that the mode of translational inhibition illustrated by FIG. 1 with specific reference to translational inhibition exerted by VGAM2040 gene, herein designated VGAM GENE, on one or more VGAM2040 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2040 is inhibition of expression of host target genes, as part of a novel viral mechanism of attacking a host. Accordingly, utilities of VGAM2040 include diagnosis, prevention and treatment of viral infection by Marburg Virus. Specific functions, and accordingly utilities, of VGAM2040 correlate with, and may be deduced from, the identity of the host target genes which VGAM2040 binds and inhibits, and the function of these host target genes, as elaborated hereinbelow.

Nucleotide sequences of the VGAM2040 precursor RNA, herein designated VGAM PRECURSOR RNA, and of the 'diced' VGAM2040 RNA, herein designated VGAM RNA, and a schematic representation of the secondary folding of VGAM2040 folded precursor RNA, herein designated VGAM FOLDED PRECURSOR RNA, of VGAM2040 are further described hereinbelow with reference to Table 1.

Nucleotide sequences of host target binding sites, such as BINDING SITE-I, BINDING SITE-II and BINDING SITE-III of FIG. 1, found on VGAM2040 host target RNA, and schematic representation of the complementarity of each of these host target binding sites to VGAM2040 RNA, herein designated VGAM RNA, are described hereinbelow with reference to Table 2.

As mentioned hereinabove with reference to FIG. 1, a function of VGAM2040 gene, herein designated VGAM is inhibition of expression of VGAM2040 target genes. It is appreciated that specific functions, and accordingly utilities, of VGAM2040 correlate with, and may be deduced from, the identity of the target genes which VGAM2040 binds and inhibits, and the function of these target genes, as elaborated hereinbelow.

A Disintegrin-like and Metalloprotease (reprolysin type) with Thrombospondin Type 1 Motif, 1 (ADAMTS1, Accession NM_006988) is a VGAM2040 host target gene. ADAMTS1 BINDING SITE is HOST TARGET binding site found in the 3' untranslated region of mRNA encoded by ADAMTS1, corresponding to a HOST TARGET binding site such as BINDING SITE I, BINDING SITE II or BINDING SITE III. Table 2 illustrates the complementarity of the nucleotide sequences of ADAMTS1 BINDING SITE, designated SEQ ID:13852, to the nucleotide sequence of VGAM2040 RNA, herein designated VGAM RNA, also designated SEQ ID:4751.

A function of VGAM2040 is therefore inhibition of A Disintegrin-like and Metalloprotease (reprolysin type) with Thrombospondin Type 1 Motif, 1 (ADAMTS1, Accession NM_006988). Accordingly, utilities of VGAM2040 include diagnosis, prevention and treatment of diseases and clinical conditions associated with ADAMTS1. EGF-containing Fibulin-like Extracellular Matrix Protein 1 (EFEMP1, Accession NM_004105) is another VGAM2040 host target gene. EFEMP1 BINDING SITE1 and EFEMP1 BINDING SITE2 are HOST TARGET binding sites found in untranslated regions of mRNA encoded by EFEMP1, corresponding to HOST TARGET binding sites such as BINDING SITE I, BINDING SITE II or BINDING SITE III. Table 2 illustrates the complementarity of the nucleotide sequences of EFEMP1 BINDING SITE1 and EFEMP1 BINDING SITE2, designated SEQ ID:10319 and SEQ ID:20839 respectively, to the nucleotide sequence of VGAM2040 RNA, herein designated VGAM RNA, also designated SEQ ID:4751.

Another function of VGAM2040 is therefore inhibition of EGF-containing Fibulin-like Extracellular Matrix Protein 1 (EFEMP1, Accession NM_004105). Accordingly, utilities of VGAM2040 include diagnosis, prevention and treatment of diseases and clinical conditions associated with EFEMP1. Phosphoribosyl Pyrophosphate Amidotransferase (PPAT, Accession NM_002703) is another VGAM2040 host target gene. PPAT BINDING SITE is HOST TARGET binding site found in the 3' untranslated region of mRNA encoded by PPAT, corresponding to a HOST TARGET binding site such as BINDING SITE I, BINDING SITE II or BINDING SITE III. Table 2 illustrates the complementarity of the nucleotide sequences of PPAT BINDING SITE, designated SEQ ID:8552, to the nucleotide sequence of VGAM2040 RNA, herein designated VGAM RNA, also designated SEQ ID:4751.

Another function of VGAM2040 is therefore inhibition of Phosphoribosyl Pyrophosphate Amidotransferase (PPAT, Accession NM_002703). Accordingly, utilities of VGAM2040 include diagnosis, prevention and treatment of diseases and clinical conditions associated with PPAT. Secretogranin III (SCG3, Accession NM_013243) is another VGAM2040 host target gene. SCG3 BINDING SITE is HOST TARGET binding site found in the 3' untranslated region of mRNA encoded by SCG3, corresponding to a HOST TARGET binding site such as BINDING SITE I, BINDING SITE II or BINDING SITE III. Table 2 illustrates the complementarity of the nucleotide sequences of SCG3 BINDING SITE, designated SEQ ID:14905, to the nucleotide sequence of VGAM2040 RNA, herein designated VGAM RNA, also designated SEQ ID:4751.

Another function of VGAM2040 is therefore inhibition of Secretogranin III (SCG3, Accession NM_013243). Accordingly, utilities of VGAM2040 include diagnosis, prevention and treatment of diseases and clinical conditions associated with SCG3. SH3-domain Binding Protein 2 (SH3BP2, Accession NM_003023) is another VGAM2040 host target gene. SH3BP2 BINDING SITE is HOST TARGET binding site found in the 3' untranslated region of mRNA encoded by SH3BP2, corresponding to a HOST TARGET binding site such as BINDING SITE I, BINDING SITE II or BINDING SITE III. Table 2 illustrates the complementarity of the nucleotide sequences of SH3BP2 BINDING SITE, designated SEQ ID:8950, to the nucleotide sequence of VGAM2040

RNA, herein designated VGAM RNA, also designated SEQ ID:4751.

Another function of VGAM2040 is therefore inhibition of SH3-domain Binding Protein 2 (SH3BP2, Accession NM_003023). Accordingly, utilities of VGAM2040 include diagnosis, prevention and treatment of diseases and clinical conditions associated with SH3BP2. KIAA1795 (Accession XM_050988) is another VGAM2040 host target gene. KIAA1795 BINDING SITE is HOST TARGET binding site found in the 3' untranslated region of mRNA encoded by KIAA1795, corresponding to a HOST TARGET binding site such as BINDING SITE I, BINDING SITE II or BINDING SITE III. Table 2 illustrates the complementarity of the nucleotide sequences of KIAA1795 BINDING SITE, designated SEQ ID:35703, to the nucleotide sequence of VGAM2040 RNA, herein designated VGAM RNA, also designated SEQ ID:4751.

Another function of VGAM2040 is therefore inhibition of KIAA1795 (Accession XM_050988). Accordingly, utilities of VGAM2040 include diagnosis, prevention and treatment of diseases and clinical conditions associated with KIAA1795. UBE3B (Accession XM_084941) is another VGAM2040 host target gene. UBE3B BINDING SITE is HOST TARGET binding site found in the 3' untranslated region of mRNA encoded by UBE3B, corresponding to a HOST TARGET binding site such as BINDING SITE I, BINDING SITE II or BINDING SITE III. Table 2 illustrates the complementarity of the nucleotide sequences of UBE3B BINDING SITE, designated SEQ ID:37776, to the nucleotide sequence of VGAM2040 RNA, herein designated VGAM RNA, also designated SEQ ID:4751.

Another function of VGAM2040 is therefore inhibition of UBE3B (Accession XM_084941). Accordingly, utilities of VGAM2040 include diagnosis, prevention and treatment of diseases and clinical conditions associated with UBE3B. LOC129446 (Accession XM_072203) is another VGAM2040 host target gene. LOC129446 BINDING SITE is HOST TARGET binding site found in the 3' untranslated region of mRNA encoded by LOC129446, corresponding to a HOST TARGET binding site such as BINDING SITE I, BINDING SITE II or BINDING SITE III. Table 2 illustrates the complementarity of the nucleotide sequences of LOC129446 BINDING SITE, designated SEQ ID:37467, to the nucleotide sequence of VGAM2040 RNA, herein designated VGAM RNA, also designated SEQ ID:4751.

Another function of VGAM2040 is therefore inhibition of LOC129446 (Accession XM_072203). Accordingly, utilities of VGAM2040 include diagnosis, prevention and treatment of diseases and clinical conditions associated with LOC129446. LOC158549 (Accession XM_098963) is another VGAM2040 host target gene. LOC158549 BINDING SITE is HOST TARGET binding site found in the 3' untranslated region of mRNA encoded by LOC158549, corresponding to a HOST TARGET binding site such as BINDING SITE I, BINDING SITE II or BINDING SITE III. Table 2 illustrates the complementarity of the nucleotide sequences of LOC158549 BINDING SITE, designated SEQ ID:42010, to the nucleotide sequence of VGAM2040 RNA, herein designated VGAM RNA, also designated SEQ ID:4751.

Another function of VGAM2040 is therefore inhibition of LOC158549 (Accession XM_098963). Accordingly, utilities of VGAM2040 include diagnosis, prevention and treatment of diseases and clinical conditions associated with LOC158549. FIG. 1 further provides a conceptual description of a novel bioinformatically detected viral gene of the present invention, referred to here as Viral Genomic Address Messenger 2041 (VGAM2041) viral gene, which modulates expression of respective host target genes thereof, the function and utility of which host target genes is known in the art.

VGAM2041 is a novel bioinformatically detected regulatory, non protein coding, viral micro RNA (miRNA) gene. The method by which VGAM2041 was detected is described hereinabove with reference to FIGS. 1-8.

VGAM2041 gene, herein designated VGAM GENE, is a viral gene contained in the genome of Marburg Virus. VGAM2041 host target gene, herein designated VGAM HOST TARGET GENE, is a human gene contained in the human genome.

VGAM2041 gene encodes a VGAM2041 precursor RNA, herein designated VGAM PRECURSOR RNA. Similar to other miRNA genes, and unlike most ordinary genes, VGAM2041 precursor RNA does not encode a protein. A nucleotide sequence identical or highly similar to the nucleotide sequence of VGAM2041 precursor RNA is designated SEQ ID:2027, and is provided hereinbelow with reference to the sequence listing part. Nucleotide sequence SEQ ID:2027 is located at position 9817 relative to the genome of Marburg Virus.

VGAM2041 precursor RNA folds onto itself, forming VGAM2041 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2041 folded precursor RNA into VGAM2041 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2041 RNA is designated SEQ ID:4752, and is provided hereinbelow with reference to the sequence listing part.

VGAM2041 host target gene, herein designated VGAM HOST TARGET GENE, encodes a corresponding messenger RNA, VGAM2041 host target RNA, herein designated VGAM HOST TARGET RNA. VGAM2041 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2041 RNA, herein designated VGAM RNA, binds complementarily to one or more host target binding sites located in untranslated regions of VGAM2041 host target RNA, herein designated VGAM HOST TARGET RNA. This complementary binding is due to the fact that the nucleotide sequence of VGAM2041 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2041 RNA, herein designated VGAM RNA, may have a different number of host target binding sites in untranslated regions of a VGAM2041 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2041 RNA, herein designated VGAM RNA, to host target binding sites on VGAM2041 host target RNA, herein designated VGAM HOST TARGET RNA, such as BINDING SITE I, BINDING SITE II and BINDING SITE III, inhibits translation of VGAM2041 host target RNA into VGAM2041 host target protein, herein designated VGAM HOST TARGET PROTEIN. VGAM host target protein is therefore outlined by a broken line.

It is appreciated that VGAM2041 host target gene, herein designated VGAM HOST TARGET GENE, in fact represents a plurality of VGAM2041 host target genes. The mRNA of each one of this plurality of VGAM2041 host target genes comprises one or more host target binding sites, each having a nucleotide sequence which is at least partly complementary to VGAM2041 RNA, herein designated VGAM RNA, and which when bound by VGAM2041 RNA causes inhibition of translation of respective one or more VGAM2041 host target proteins.

It is further appreciated by one skilled in the art that the mode of translational inhibition illustrated by FIG. 1 with specific reference to translational inhibition exerted by VGAM2041 gene, herein designated VGAM GENE, on one or more VGAM2041 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2041 is inhibition of expression of host target genes, as part of a novel viral mechanism of attacking a host. Accordingly, utilities of VGAM2041 include diagnosis, prevention and treatment of viral infection by Marburg Virus. Specific functions, and accordingly utilities, of VGAM2041 correlate with, and may be deduced from, the identity of the host target genes which VGAM2041 binds and inhibits, and the function of these host target genes, as elaborated hereinbelow.

Nucleotide sequences of the VGAM2041 precursor RNA, herein designated VGAM PRECURSOR RNA, and of the 'diced' VGAM2041 RNA, herein designated VGAM RNA, and a schematic representation of the secondary folding of VGAM2041 folded precursor RNA, herein designated VGAM FOLDED PRECURSOR RNA, of VGAM2041 are further described hereinbelow with reference to Table 1.

Nucleotide sequences of host target binding sites, such as BINDING SITE-I, BINDING SITE-II and BINDING SITE-III of FIG. 1, found on VGAM2041 host target RNA, and schematic representation of the complementarity of each of these host target binding sites to VGAM2041 RNA, herein designated VGAM RNA, are described hereinbelow with reference to Table 2.

As mentioned hereinabove with reference to FIG. 1, a function of VGAM2041 gene, herein designated VGAM is inhibition of expression of VGAM2041 target genes. It is appreciated that specific functions, and accordingly utilities, of VGAM2041 correlate with, and may be deduced from, the identity of the target genes which VGAM2041 binds and inhibits, and the function of these target genes, as elaborated hereinbelow.

Cytoplasmic Linker Associated Protein 1 (CLASP1, Accession XM_037105) is a VGAM2041 host target gene. CLASP1 BINDING SITE is HOST TARGET binding site found in the 3' untranslated region of mRNA encoded by CLASP1, corresponding to a HOST TARGET binding site such as BINDING SITE I, BINDING SITE II or BINDING SITE III. Table 2 illustrates the complementarity of the nucleotide sequences of CLASP1 BINDING SITE, designated SEQ ID:32541, to the nucleotide sequence of VGAM2041 RNA, herein designated VGAM RNA, also designated SEQ ID:4752.

A function of VGAM2041 is therefore inhibition of Cytoplasmic Linker Associated Protein 1 (CLASP1, Accession XM_037105), a gene which plays a role in the local regulation of microtubule dynamics. Accordingly, utilities of VGAM2041 include diagnosis, prevention and treatment of diseases and clinical conditions associated with CLASP1. The function of CLASP1 and its association with various diseases and clinical conditions, has been established by previous studies, as described hereinabove with reference to VGAM298. Histamine Receptor H1 (HRH1, Accession NM_000861) is another VGAM2041 host target gene. HRH1 BINDING SITE is HOST TARGET binding site found in the 5' untranslated region of mRNA encoded by HRH1, corresponding to a HOST TARGET binding site such as BINDING SITE I, BINDING SITE II or BINDING SITE III. Table 2 illustrates the complementarity of the nucleotide sequences of HRH1 BINDING SITE, designated SEQ ID:6523, to the nucleotide sequence of VGAM2041 RNA, herein designated VGAM RNA, also designated SEQ ID:4752.

Another function of VGAM2041 is therefore inhibition of Histamine Receptor H1 (HRH1, Accession NM_000861), a gene which stimulates the synthesis of inositol phosphate. Accordingly, utilities of VGAM2041 include diagnosis, prevention and treatment of diseases and clinical conditions associated with HRH1. The function of HRH1 and its association with various diseases and clinical conditions, has been established by previous studies, as described hereinabove with reference to VGAM766. Protein Kinase, AMP-activated, Beta 1 Non-catalytic Subunit (PRKAB1, Accession NM_006253) is another VGAM2041 host target gene. PRKAB1 BINDING SITE is HOST TARGET binding site found in the 3' untranslated region of mRNA encoded by PRKAB1, corresponding to a HOST TARGET binding site such as BINDING SITE I, BINDING SITE II or BINDING SITE III. Table 2 illustrates the complementarity of the nucleotide sequences of PRKAB1 BINDING SITE, designated SEQ ID:12933, to the nucleotide sequence of VGAM2041 RNA, herein designated VGAM RNA, also designated SEQ ID:4752.

Another function of VGAM2041 is therefore inhibition of Protein Kinase, AMP-activated, Beta 1 Non-catalytic Subunit (PRKAB1, Accession NM_006253), a gene which is responsible for the regulation of fatty acid synthesis by phosphorylation of acetyl-coa carboxylase. Accordingly, utilities of VGAM2041 include diagnosis, prevention and treatment of diseases and clinical conditions associated with PRKAB1. The function of PRKAB1 and its association with various diseases and clinical conditions, has been established by previous studies, as described hereinabove with reference to VGAM1384. TERA (Accession NM_021238) is another VGAM2041 host target gene. TERA BINDING SITE is HOST TARGET binding site found in the 3' untranslated region of mRNA encoded by TERA, corresponding to a HOST TARGET binding site such as BINDING SITE I, BINDING SITE II or BINDING SITE III. Table 2 illustrates the complementarity of the nucleotide sequences of TERA BINDING SITE, designated SEQ ID:22204, to the nucleotide sequence of VGAM2041 RNA, herein designated VGAM RNA, also designated SEQ ID:4752.

Another function of VGAM2041 is therefore inhibition of TERA (Accession NM_021238). Accordingly, utilities of VGAM2041 include diagnosis, prevention and treatment of diseases and clinical conditions associated with TERA. FIG. 1 further provides a conceptual description of a novel bioinformatically detected viral gene of the present invention, referred to here as Viral Genomic Address Messenger 2042 (VGAM2042) viral gene, which modulates expression of respective host target genes thereof, the function and utility of which host target genes is known in the art.

VGAM2042 is a novel bioinformatically detected regulatory, non protein coding, viral micro RNA (miRNA) gene. The method by which VGAM2042 was detected is described hereinabove with reference to FIGS. 1-8.

VGAM2042 gene, herein designated VGAM GENE, is a viral gene contained in the genome of Human Herpesvirus 5. VGAM2042 host target gene, herein designated VGAM HOST TARGET GENE, is a human gene contained in the human genome.

VGAM2042 gene encodes a VGAM2042 precursor RNA, herein designated VGAM PRECURSOR RNA. Similar to other miRNA genes, and unlike most ordinary genes, VGAM2042 precursor RNA does not encode a protein. A nucleotide sequence identical or highly similar to the nucleotide sequence of VGAM2042 precursor RNA is designated SEQ ID:2028, and is provided hereinbelow with reference to the sequence listing part. Nucleotide sequence SEQ ID:2028 is located at position 207065 relative to the genome of Human Herpesvirus 5.

VGAM2042 precursor RNA folds onto itself, forming VGAM2042 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2042 folded precursor RNA into VGAM2042 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM2042 RNA is designated SEQ ID:4753, and is provided hereinbelow with reference to the sequence listing part.

VGAM2042 host target gene, herein designated VGAM HOST TARGET GENE, encodes a corresponding messenger RNA, VGAM2042 host target RNA, herein designated VGAM HOST TARGET RNA. VGAM2042 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2042 RNA, herein designated VGAM RNA, binds complementarily to one or more host target binding sites located in untranslated regions of VGAM2042 host target RNA, herein designated VGAM HOST TARGET RNA. This complementary binding is due to the fact that the nucleotide sequence of VGAM2042 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2042 RNA, herein designated VGAM RNA, may have a different number of host target binding sites in untranslated regions of a VGAM2042 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2042 RNA, herein designated VGAM RNA, to host target binding sites on VGAM2042 host target RNA, herein designated VGAM HOST TARGET RNA, such as BINDING SITE I, BINDING SITE II and BINDING SITE III, inhibits translation of VGAM2042 host target RNA into VGAM2042 host target protein, herein designated VGAM HOST TARGET PROTEIN. VGAM host target protein is therefore outlined by a broken line.

It is appreciated that VGAM2042 host target gene, herein designated VGAM HOST TARGET GENE, in fact represents a plurality of VGAM2042 host target genes. The mRNA of each one of this plurality of VGAM2042 host target genes comprises one or more host target binding sites, each having a nucleotide sequence which is at least partly complementary to VGAM2042 RNA, herein designated VGAM RNA, and which when bound by VGAM2042 RNA causes inhibition of translation of respective one or more VGAM2042 host target proteins.

It is further appreciated by one skilled in the art that the mode of translational inhibition illustrated by FIG. 1 with specific reference to translational inhibition exerted by VGAM2042 gene, herein designated VGAM GENE, on one or more VGAM2042 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2042 is inhibition of expression of host target genes, as part of a novel viral mechanism of attacking a host. Accordingly, utilities of VGAM2042 include diagnosis, prevention and treatment of viral infection by Human Herpesvirus 5. Specific functions, and accordingly utilities, of VGAM2042 correlate with, and may be deduced from, the identity of the host target genes which VGAM2042 binds and inhibits, and the function of these host target genes, as elaborated hereinbelow.

Nucleotide sequences of the VGAM2042 precursor RNA, herein designated VGAM PRECURSOR RNA, and of the 'diced' VGAM2042 RNA, herein designated VGAM RNA, and a schematic representation of the secondary folding of VGAM2042 folded precursor RNA, herein designated VGAM FOLDED PRECURSOR RNA, of VGAM2042 are further described hereinbelow with reference to Table 1.

Nucleotide sequences of host target binding sites, such as BINDING SITE-I, BINDING SITE-II and BINDING SITE-III of FIG. 1, found on VGAM2042 host target RNA, and schematic representation of the complementarity of each of these host target binding sites to VGAM2042 RNA, herein designated VGAM RNA, are described hereinbelow with reference to Table 2.

As mentioned hereinabove with reference to FIG. 1, a function of VGAM2042 gene, herein designated VGAM is inhibition of expression of VGAM2042 target genes. It is appreciated that specific functions, and accordingly utilities, of VGAM2042 correlate with, and may be deduced from, the identity of the target genes which VGAM2042 binds and inhibits, and the function of these target genes, as elaborated hereinbelow.

Filamin B, Beta (actin binding protein 278) (FLNB, Accession XM_030806) is a VGAM2042 host target gene. FLNB BINDING SITE is HOST TARGET binding site found in the 3' untranslated region of mRNA encoded by FLNB, corresponding to a HOST TARGET binding site such as BINDING SITE I, BINDING SITE II or BINDING SITE III. Table 2 illustrates the complementarity of the nucleotide sequences of FLNB BINDING SITE, designated SEQ ID:31148, to the nucleotide sequence of VGAM2042 RNA, herein designated VGAM RNA, also designated SEQ ID:4753.

A function of VGAM2042 is therefore inhibition of Filamin B, Beta (actin binding protein 278) (FLNB, Accession XM_030806), a gene which Filamin B, beta; binds actin, interacts with cytoplasmic domain of Ibalpha. Accordingly, utilities of VGAM2042 include diagnosis, prevention and treatment of diseases and clinical conditions associated with FLNB. The function of FLNB and its association with various diseases and clinical conditions, has been established by previous studies, as described hereinabove with reference to VGAM416. Junctophilin 3 (JPH3, Accession NM_020655) is another VGAM2042 host target gene. JPH3 BINDING SITE is HOST TARGET binding site found in the 3' untranslated region of mRNA encoded by JPH3, corresponding to a HOST TARGET binding site such as BINDING SITE I, BINDING SITE II or BINDING SITE III. Table 2 illustrates the complementarity of the nucleotide sequences of JPH3 BINDING SITE, designated SEQ ID:21826, to the nucleotide sequence of VGAM2042 RNA, herein designated VGAM RNA, also designated SEQ ID:4753.

Another function of VGAM2042 is therefore inhibition of Junctophilin 3 (JPH3, Accession NM_020655), a gene which is involved in cytoskeletal organization and cellular growth. Accordingly, utilities of VGAM2042 include diagnosis, prevention and treatment of diseases and clinical conditions associated with JPH3. The function of JPH3 and its association with various diseases and clinical conditions, has been established by previous studies, as described hereinabove with reference to VGAM254. FLJ23598 (Accession NM_024783) is another VGAM2042 host target gene. FLJ23598 BINDING SITE is HOST TARGET binding site found in the 5' untranslated region of mRNA encoded by FLJ23598, corresponding to a HOST TARGET binding site such as BINDING SITE I, BINDING SITE II or BINDING SITE III. Table 2 illustrates the complementarity of the nucleotide sequences of FLJ23598 BINDING SITE, designated SEQ ID:24157, to the nucleotide sequence of VGAM2042 RNA, herein designated VGAM RNA, also designated SEQ ID:4753.

Another function of VGAM2042 is therefore inhibition of FLJ23598 (Accession NM_024783). Accordingly, utilities of VGAM2042 include diagnosis, prevention and treatment of diseases and clinical conditions associated with FLJ23598. KIAA0295 (Accession XM_042833) is another VGAM2042 host target gene. KIAA0295 BINDING SITE is HOST TARGET binding site found in the 3' untranslated region of mRNA encoded by KIAA0295, corresponding to a HOST TARGET binding site such as BINDING SITE I, BINDING SITE II or BINDING SITE III. Table 2 illustrates the complementarity of the nucleotide sequences of KIAA0295 BINDING SITE, designated SEQ ID:33785, to the nucleotide sequence of VGAM2042 RNA, herein designated VGAM RNA, also designated SEQ ID:4753.

Another function of VGAM2042 is therefore inhibition of KIAA0295 (Accession XM_042833). Accordingly, utilities of VGAM2042 include diagnosis, prevention and treatment of diseases and clinical conditions associated with KIAA0295. LOC149372 (Accession XM_086509) is another VGAM2042 host target gene. LOC149372 BINDING SITE is HOST TARGET binding site found in the 5' untranslated region of mRNA encoded by LOC149372, corresponding to a HOST TARGET binding site such as BINDING SITE I, BINDING SITE II or BINDING SITE III. Table 2 illustrates the complementarity of the nucleotide sequences of LOC149372 BINDING SITE, designated SEQ ID:38725, to the nucleotide sequence of VGAM2042 RNA, herein designated VGAM RNA, also designated SEQ ID:4753.

Another function of VGAM2042 is therefore inhibition of LOC149372 (Accession XM_086509). Accordingly, utilities of VGAM2042 include diagnosis, prevention and treatment of diseases and clinical conditions associated with LOC149372. LOC150577 (Accession XM_097918) is another VGAM2042 host target gene. LOC150577 BINDING SITE is HOST TARGET binding site found in the 3' untranslated region of mRNA encoded by LOC150577, corresponding to a HOST TARGET binding site such as BINDING SITE I, BINDING SITE II or BINDING SITE III. Table 2 illustrates the complementarity of the nucleotide sequences of LOC150577 BINDING SITE, designated SEQ ID:41217, to the nucleotide sequence of VGAM2042 RNA, herein designated VGAM RNA, also designated SEQ ID:4753.

Another function of VGAM2042 is therefore inhibition of LOC150577 (Accession XM_097918). Accordingly, utilities of VGAM2042 include diagnosis, prevention and treatment of diseases and clinical conditions associated with LOC150577. LOC157627 (Accession XM_088347) is another VGAM2042 host target gene. LOC157627 BINDING SITE is HOST TARGET binding site found in the 3' untranslated region of mRNA encoded by LOC157627, corresponding to a HOST TARGET binding site such as BINDING SITE I, BINDING SITE II or BINDING SITE III. Table 2 illustrates the complementarity of the nucleotide sequences of LOC157627 BINDING SITE, designated SEQ ID:39619, to the nucleotide sequence of VGAM2042 RNA, herein designated VGAM RNA, also designated SEQ ID:4753.

Another function of VGAM2042 is therefore inhibition of LOC157627 (Accession XM_088347). Accordingly, utilities of VGAM2042 include diagnosis, prevention and treatment of diseases and clinical conditions associated with LOC157627. FIG. 1 further provides a conceptual description of a novel bioinformatically detected viral gene of the present invention, referred to here as Viral Genomic Address Messenger 2043 (VGAM2043) viral gene, which modulates expression of respective host target genes thereof, the function and utility of which host target genes is known in the art.

VGAM2043 is a novel bioinformatically detected regulatory, non protein coding, viral micro RNA (miRNA) gene. The method by which VGAM2043 was detected is described hereinabove with reference to FIGS. 1-8.

VGAM2043 gene, herein designated VGAM GENE, is a viral gene contained in the genome of Human Herpesvirus 5. VGAM2043 host target gene, herein designated VGAM HOST TARGET GENE, is a human gene contained in the human genome.

VGAM2043 gene encodes a VGAM2043 precursor RNA, herein designated VGAM PRECURSOR RNA. Similar to other miRNA genes, and unlike most ordinary genes, VGAM2043 precursor RNA does not encode a protein. A nucleotide sequence identical or highly similar to the nucleotide sequence of VGAM2043 precursor RNA is designated SEQ ID:2029, and is provided hereinbelow with reference to the sequence listing part. Nucleotide sequence SEQ ID:2029 is located at position 200386 relative to the genome of Human Herpesvirus 5.

VGAM2043 precursor RNA folds onto itself, forming VGAM2043 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2043 folded precursor RNA into VGAM2043 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2043 RNA is designated SEQ ID:4754, and is provided hereinbelow with reference to the sequence listing part.

VGAM2043 host target gene, herein designated VGAM HOST TARGET GENE, encodes a corresponding messenger RNA, VGAM2043 host target RNA, herein designated VGAM HOST TARGET RNA. VGAM2043 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2043 RNA, herein designated VGAM RNA, binds complementarily to one or more host target binding sites located in untranslated regions of VGAM2043 host target RNA, herein designated VGAM HOST TARGET RNA. This complementary binding is due to the fact that the nucleotide sequence of VGAM2043 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2043 RNA, herein designated VGAM RNA, may have a different number of host target binding sites in untranslated regions of a VGAM2043 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2043 RNA, herein designated VGAM RNA, to host target binding sites on VGAM2043 host target RNA, herein designated VGAM HOST TARGET RNA, such as BINDING SITE I, BINDING SITE II and BINDING SITE III, inhibits translation of VGAM2043 host target RNA into VGAM2043 host target protein, herein designated VGAM HOST TARGET PROTEIN. VGAM host target protein is therefore outlined by a broken line.

It is appreciated that VGAM2043 host target gene, herein designated VGAM HOST TARGET GENE, in fact represents a plurality of VGAM2043 host target genes. The mRNA of each one of this plurality of VGAM2043 host target genes comprises one or more host target binding sites, each having a nucleotide sequence which is at least partly complementary to VGAM2043 RNA, herein designated VGAM RNA, and which when bound by VGAM2043 RNA causes inhibition of translation of respective one or more VGAM2043 host target proteins.

It is further appreciated by one skilled in the art that the mode of translational inhibition illustrated by FIG. 1 with specific reference to translational inhibition exerted by VGAM2043 gene, herein designated VGAM GENE, on one or more VGAM2043 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2043 is inhibition of expression of host target genes, as part of a novel viral mechanism of attacking a host. Accordingly, utilities of VGAM2043 include diagnosis, prevention and treatment of viral infection by Human Herpesvirus 5. Specific functions, and accordingly utilities, of VGAM2043 correlate with, and may be deduced from, the identity of the host target genes which VGAM2043 binds and inhibits, and the function of these host target genes, as elaborated hereinbelow.

Nucleotide sequences of the VGAM2043 precursor RNA, herein designated VGAM PRECURSOR RNA, and of the 'diced' VGAM2043 RNA, herein designated VGAM RNA, and a schematic representation of the secondary folding of VGAM2043 folded precursor RNA, herein designated VGAM FOLDED PRECURSOR RNA, of VGAM2043 are further described hereinbelow with reference to Table 1.

Nucleotide sequences of host target binding sites, such as BINDING SITE-I, BINDING SITE-II and BINDING SITE-III of FIG. 1, found on VGAM2043 host target RNA, and schematic representation of the complementarity of each of these host target binding sites to VGAM2043 RNA, herein designated VGAM RNA, are described hereinbelow with reference to Table 2.

As mentioned hereinabove with reference to FIG. 1, a function of VGAM2043 gene, herein designated VGAM is inhibition of expression of VGAM2043 target genes. It is appreciated that specific functions, and accordingly utilities, of VGAM2043 correlate with, and may be deduced from, the identity of the target genes which VGAM2043 binds and inhibits, and the function of these target genes, as elaborated hereinbelow.

Actinin, Alpha 2 (ACTN2, Accession NM_001103) is a VGAM2043 host target gene. ACTN2 BINDING SITE is HOST TARGET binding site found in the 3' untranslated region of mRNA encoded by ACTN2, corresponding to a HOST TARGET binding site such as BINDING SITE I, BINDING SITE II or BINDING SITE III. Table 2 illustrates the complementarity of the nucleotide sequences of ACTN2 BINDING SITE, designated SEQ ID:6760, to the nucleotide sequence of VGAM2043 RNA, herein designated VGAM RNA, also designated SEQ ID:4754.

A function of VGAM2043 is therefore inhibition of Actinin, Alpha 2 (ACTN2, Accession NM_001103), a gene which an actin-binding protein with multiple roles in different cell types. Accordingly, utilities of VGAM2043 include diagnosis, prevention and treatment of diseases and clinical conditions associated with ACTN2. The function of ACTN2 and its association with various diseases and clinical conditions, has been established by previous studies, as described hereinabove with reference to VGAM88. Protein Tyrosine Phosphatase, Receptor Type, G (PTPRG, Accession NM_002841) is another VGAM2043 host target gene. PTPRG BINDING SITE is HOST TARGET binding site found in the 3' untranslated region of mRNA encoded by PTPRG, corresponding to a HOST TARGET binding site such as BINDING SITE I, BINDING SITE II or BINDING SITE III. Table 2 illustrates the complementarity of the nucleotide sequences of PTPRG BINDING SITE, designated SEQ ID:8728, to the nucleotide sequence of VGAM2043 RNA, herein designated VGAM RNA, also designated SEQ ID:4754.

Another function of VGAM2043 is therefore inhibition of Protein Tyrosine Phosphatase, Receptor Type, G (PTPRG, Accession NM_002841), a gene which is a candidate tumor suppressor and represents a subfamily of receptor tyrosine phosphatases. Accordingly, utilities of VGAM2043 include diagnosis, prevention and treatment of diseases and clinical conditions associated with PTPRG. The function of PTPRG and its association with various diseases and clinical conditions, has been established by previous studies, as described hereinabove with reference to VGAM1924. MIC2 Like 1 (MIC2L1, Accession NM_031462) is another VGAM2043 host target gene. MIC2L1 BINDING SITE is HOST TARGET binding site found in the 3' untranslated region of mRNA encoded by MIC2L1, corresponding to a HOST TARGET binding site such as BINDING SITE I, BINDING SITE II or BINDING SITE III. Table 2 illustrates the complementarity of the nucleotide sequences of MIC2L1 BINDING SITE, designated SEQ ID:25489, to the nucleotide sequence of VGAM2043 RNA, herein designated VGAM RNA, also designated SEQ ID:4754.

Another function of VGAM2043 is therefore inhibition of MIC2 Like 1 (MIC2L1, Accession NM_031462). Accordingly, utilities of VGAM2043 include diagnosis, prevention and treatment of diseases and clinical conditions associated with MIC2L1. FIG. 1 further provides a conceptual description of a novel bioinformatically detected viral gene of the present invention, referred to here as Viral Genomic Address Messenger 2044 (VGAM2044) viral gene, which modulates expression of respective host target genes thereof, the function and utility of which host target genes is known in the art.

VGAM2044 is a novel bioinformatically detected regulatory, non protein coding, viral micro RNA (miRNA) gene. The method by which VGAM2044 was detected is described hereinabove with reference to FIGS. 1-8.

VGAM2044 gene, herein designated VGAM GENE, is a viral gene contained in the genome of Human Herpesvirus 5. VGAM2044 host target gene, herein designated VGAM HOST TARGET GENE, is a human gene contained in the human genome.

VGAM2044 gene encodes a VGAM2044 precursor RNA, herein designated VGAM PRECURSOR RNA. Similar to other miRNA genes, and unlike most ordinary genes, VGAM2044 precursor RNA does not encode a protein. A nucleotide sequence identical or highly similar to the nucleotide sequence of VGAM2044 precursor RNA is designated SEQ ID:2030, and is provided hereinbelow with reference to the sequence listing part. Nucleotide sequence SEQ ID:2030 is located at position 212421 relative to the genome of Human Herpesvirus 5.

VGAM2044 precursor RNA folds onto itself, forming VGAM2044 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2044 folded precursor RNA into VGAM2044 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM2044 RNA is designated SEQ ID:4755, and is provided hereinbelow with reference to the sequence listing part.

VGAM2044 host target gene, herein designated VGAM HOST TARGET GENE, encodes a corresponding messenger RNA, VGAM2044 host target RNA, herein designated VGAM HOST TARGET RNA. VGAM2044 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2044 RNA, herein designated VGAM RNA, binds complementarily to one or more host target binding sites located in untranslated regions of VGAM2044 host target RNA, herein designated VGAM HOST TARGET RNA. This complementary binding is due to the fact that the nucleotide sequence of VGAM2044 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2044 RNA, herein designated VGAM RNA, may have a different number of host target binding sites in untranslated regions of a VGAM2044 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2044 RNA, herein designated VGAM RNA, to host target binding sites on VGAM2044 host target RNA, herein designated VGAM HOST TARGET RNA, such as BINDING SITE I, BINDING SITE II and BINDING SITE III, inhibits translation of VGAM2044 host target RNA into VGAM2044 host target protein, herein designated VGAM HOST TARGET PROTEIN. VGAM host target protein is therefore outlined by a broken line.

It is appreciated that VGAM2044 host target gene, herein designated VGAM HOST TARGET GENE, in fact represents a plurality of VGAM2044 host target genes. The mRNA of each one of this plurality of VGAM2044 host target genes comprises one or more host target binding sites, each having a nucleotide sequence which is at least partly complementary to VGAM2044 RNA, herein designated VGAM RNA, and which when bound by VGAM2044 RNA causes inhibition of translation of respective one or more VGAM2044 host target proteins.

It is further appreciated by one skilled in the art that the mode of translational inhibition illustrated by FIG. 1 with specific reference to translational inhibition exerted by VGAM2044 gene, herein designated VGAM GENE, on one or more VGAM2044 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2044 is inhibition of expression of host target genes, as part of a novel viral mechanism of attacking a host. Accordingly, utilities of VGAM2044 include diagnosis, prevention and treatment of viral infection by Human Herpesvirus 5. Specific functions, and accordingly utilities, of VGAM2044 correlate with, and may be deduced from, the identity of the host target genes which VGAM2044 binds and inhibits, and the function of these host target genes, as elaborated hereinbelow.

Nucleotide sequences of the VGAM2044 precursor RNA, herein designated VGAM PRECURSOR RNA, and of the 'diced' VGAM2044 RNA, herein designated VGAM RNA, and a schematic representation of the secondary folding of VGAM2044 folded precursor RNA, herein designated VGAM FOLDED PRECURSOR RNA, of VGAM2044 are further described hereinbelow with reference to Table 1.

Nucleotide sequences of host target binding sites, such as BINDING SITE-I, BINDING SITE-II and BINDING SITE-III of FIG. 1, found on VGAM2044 host target RNA, and schematic representation of the complementarity of each of these host target binding sites to VGAM2044 RNA, herein designated VGAM RNA, are described hereinbelow with reference to Table 2.

As mentioned hereinabove with reference to FIG. 1, a function of VGAM2044 gene, herein designated VGAM is inhibition of expression of VGAM2044 target genes. It is appreciated that specific functions, and accordingly utilities, of VGAM2044 correlate with, and may be deduced from, the identity of the target genes which VGAM2044 binds and inhibits, and the function of these target genes, as elaborated hereinbelow.

Chromosome 8 Open Reading Frame 1 (C8orf1, Accession NM_004337) is a VGAM2044 host target gene. C8orf1 BINDING SITE is HOST TARGET binding site found in the 5' untranslated region of mRNA encoded by C8orf1, corresponding to a HOST TARGET binding site such as BINDING SITE I, BINDING SITE II or BINDING SITE III. Table 2 illustrates the complementarity of the nucleotide sequences of C8orf1 BINDING SITE, designated SEQ ID:10531, to the nucleotide sequence of VGAM2044 RNA, herein designated VGAM RNA, also designated SEQ ID:4755.

A function of VGAM2044 is therefore inhibition of Chromosome 8 Open Reading Frame 1 (C8orf1, Accession NM_004337). Accordingly, utilities of VGAM2044 include diagnosis, prevention and treatment of diseases and clinical conditions associated with C8orf1. Cullin 3 (CUL3, Accession NM_003590) is another VGAM2044 host target gene. CUL3 BINDING SITE is HOST TARGET binding site found in the 3' untranslated region of mRNA encoded by CUL3, corresponding to a HOST TARGET binding site such as BINDING SITE I, BINDING SITE II or BINDING SITE III. Table 2 illustrates the complementarity of the nucleotide sequences of CUL3 BINDING SITE, designated SEQ ID:9644, to the nucleotide sequence of VGAM2044 RNA, herein designated VGAM RNA, also designated SEQ ID:4755.

Another function of VGAM2044 is therefore inhibition of Cullin 3 (CUL3, Accession NM_003590), a gene which may target other proteins for ubiquitin-dependent proteolysis. Accordingly, utilities of VGAM2044 include diagnosis, prevention and treatment of diseases and clinical conditions associated with CUL3. The function of CUL3 and its association with various diseases and clinical conditions, has been established by previous studies, as described hereinabove with reference to VGAM143.5-hydroxytryptamine (serotonin) Receptor 4 (HTR4, Accession NM_000870) is another VGAM2044 host target gene. HTR4 BINDING SITE is HOST TARGET binding site found in the 3' untranslated region of mRNA encoded by HTR4, corresponding to a HOST TARGET binding site such as BINDING SITE I, BINDING SITE II or BINDING SITE III. Table 2 illustrates the complementarity of the nucleotide sequences of HTR4 BINDING SITE, designated SEQ ID:6542, to the nucleotide sequence of VGAM2044 RNA, herein designated VGAM RNA, also designated SEQ ID:4755.

Another function of VGAM2044 is therefore inhibition of 5-hydroxytryptamine (serotonin) Receptor 4 (HTR4, Accession NM_000870), a gene which mediates calcium channel currents. Accordingly, utilities of VGAM2044 include diagnosis, prevention and treatment of diseases and clinical conditions associated with HTR4. The function of HTR4 and its association with various diseases and clinical conditions, has been established by previous studies, as described hereinabove with reference to VGAM65. RAB Interacting Factor (RABIF, Accession NM_002871) is another VGAM2044 host target gene. RABIF BINDING SITE is HOST TARGET binding site found in the 3' untranslated region of mRNA encoded by RABIF, corresponding to a HOST TARGET binding site such as BINDING SITE I, BINDING SITE II or BINDING SITE III. Table 2 illustrates the complementarity of the nucleotide sequences of RABIF BINDING SITE, designated SEQ ID:8781, to the nucleotide sequence of VGAM2044 RNA, herein designated VGAM RNA, also designated SEQ ID:4755.

Another function of VGAM2044 is therefore inhibition of RAB Interacting Factor (RABIF, Accession NM_002871), a gene which is involved in the regulation of intracellular vesicular transport. Accordingly, utilities of VGAM2044 include diagnosis, prevention and treatment of diseases and clinical conditions associated with RABIF. The function of RABIF and its association with various diseases and clinical conditions, has been established by previous studies, as described hereinabove with reference to VGAM1633. Transient Receptor Potential Cation Channel, Subfamily C, Member 6 (TRPC6, Accession NM_004621) is another VGAM2044 host target gene. TRPC6 BINDING SITE is HOST TARGET binding site found in the 5' untranslated region of mRNA encoded by TRPC6, corresponding to a HOST TARGET binding site such as BINDING SITE I, BINDING SITE II or BINDING SITE III. Table 2 illustrates the complementarity of the nucleotide sequences of TRPC6 BINDING SITE, designated SEQ ID:10976, to the nucleotide sequence of VGAM2044 RNA, herein designated VGAM RNA, also designated SEQ ID:4755.

Another function of VGAM2044 is therefore inhibition of Transient Receptor Potential Cation Channel, Subfamily C, Member 6 (TRPC6, Accession NM_004621), a gene which has calcium channel activity. Accordingly, utilities of VGAM2044 include diagnosis, prevention and treatment of diseases and clinical conditions associated with TRPC6. The function of TRPC6 and its association with various diseases and clinical conditions, has been established by previous studies, as described hereinabove with reference to VGAM25. Wolf-Hirschhorn Syndrome Candidate 1 (WHSC1, Accession NM_014919) is another VGAM2044 host target gene. WHSC1 BINDING SITE1 through WHSC1 BINDING SITE4 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE4, designated SEQ ID:17183, SEQ ID:28447, SEQ ID:28464 and SEQ ID:28475 respectively, to the nucleotide sequence of VGAM2044 RNA, herein designated VGAM RNA, also designated SEQ ID:4755.

Another function of VGAM2044 is therefore inhibition of Wolf-Hirschhorn Syndrome Candidate 1 (WHSC1, Accession NM_014919), a gene which binds covalently to and repairs g/t mismatches. Accordingly, utilities of VGAM2044 include diagnosis, prevention and treatment of diseases and clinical conditions associated with WHSC1. The function of WHSC1 and its association with various diseases and clinical conditions, has been established by previous studies, as described hereinabove with reference to VGAM200. DKFZp434J1015 (Accession XM_166538) is another VGAM2044 host target gene. DKFZp434J1015 BINDING SITE is HOST TARGET binding site found in the 3' untranslated region of mRNA encoded by DKFZp434J1015, corresponding to a HOST TARGET binding site such as BINDING SITE I, BINDING SITE II or BINDING SITE III. Table 2 illustrates the complementarity of the nucleotide sequences of DKFZp434J1015 BINDING SITE, designated SEQ ID:44506, to the nucleotide sequence of VGAM2044 RNA, herein designated VGAM RNA, also designated SEQ ID:4755.

Another function of VGAM2044 is therefore inhibition of DKFZp434J1015 (Accession XM_166538). Accordingly, utilities of VGAM2044 include diagnosis, prevention and treatment of diseases and clinical conditions associated with DKFZp434J1015. IMAGE:4907098 (Accession XM_166247) is another VGAM2044 host target gene. IMAGE:4907098 BINDING SITE is HOST TARGET binding site found in the 5' untranslated region of mRNA encoded by IMAGE:4907098, corresponding to a HOST TARGET binding site such as BINDING SITE I, BINDING SITE II or BINDING SITE III. Table 2 illustrates the complementarity of the nucleotide sequences of IMAGE:4907098 BINDING SITE, designated SEQ ID:44060, to the nucleotide sequence of VGAM2044 RNA, herein designated VGAM RNA, also designated SEQ ID:4755.

Another function of VGAM2044 is therefore inhibition of IMAGE:4907098 (Accession XM_166247). Accordingly, utilities of VGAM2044 include diagnosis, prevention and treatment of diseases and clinical conditions associated with IMAGE:4907098. LOC123876 (Accession XM_058743) is another VGAM2044 host target gene. LOC123876 BINDING SITE is HOST TARGET binding site found in the 3' untranslated region of mRNA encoded by LOC123876, corresponding to a HOST TARGET binding site such as BINDING SITE I, BINDING SITE II or BINDING SITE III. Table 2 illustrates the complementarity of the nucleotide sequences of LOC123876 BINDING SITE, designated SEQ ID:36733, to the nucleotide sequence of VGAM2044 RNA, herein designated VGAM RNA, also designated SEQ ID:4755.

Another function of VGAM2044 is therefore inhibition of LOC123876 (Accession XM_058743). Accordingly, utilities of VGAM2044 include diagnosis, prevention and treatment of diseases and clinical conditions associated with LOC123876. LOC146316 (Accession XM_027568) is another VGAM2044 host target gene. LOC146316 BINDING SITE is HOST TARGET binding site found in the 5' untranslated region of mRNA encoded by LOC146316, corresponding to a HOST TARGET binding site such as BINDING SITE I, BINDING SITE II or BINDING SITE III. Table 2 illustrates the complementarity of the nucleotide sequences of LOC146316 BINDING SITE, designated SEQ ID:30526, to the nucleotide sequence of VGAM2044 RNA, herein designated VGAM RNA, also designated SEQ ID:4755.

Another function of VGAM2044 is therefore inhibition of LOC146316 (Accession XM_027568). Accordingly, utilities of VGAM2044 include diagnosis, prevention and treatment of diseases and clinical conditions associated with LOC146316. LOC200470 (Accession XM_117235) is another VGAM2044 host target gene. LOC200470 BINDING SITE is HOST TARGET binding site found in the 5' untranslated region of mRNA encoded by LOC200470, corresponding to a HOST TARGET binding site such as BINDING SITE I, BINDING SITE II or BINDING SITE III. Table 2 illustrates the complementarity of the nucleotide sequences of LOC200470 BINDING SITE, designated SEQ ID:43309, to the nucleotide sequence of VGAM2044 RNA, herein designated VGAM RNA, also designated SEQ ID:4755.

Another function of VGAM2044 is therefore inhibition of LOC200470 (Accession XM_117235). Accordingly, utilities of VGAM2044 include diagnosis, prevention and treatment of diseases and clinical conditions associated with LOC200470. FIG. 1 further provides a conceptual description of a novel bioinformatically detected viral gene of the present invention, referred to here as Viral Genomic Address Messenger 2045 (VGAM2045) viral gene, which modulates expression of respective host target genes thereof, the function and utility of which host target genes is known in the art.

VGAM2045 is a novel bioinformatically detected regulatory, non protein coding, viral micro RNA (miRNA) gene. The method by which VGAM2045 was detected is described hereinabove with reference to FIGS. 1-8.

VGAM2045 gene, herein designated VGAM GENE, is a viral gene contained in the genome of Human Herpesvirus 5. VGAM2045 host target gene, herein designated VGAM HOST TARGET GENE, is a human gene contained in the human genome.

VGAM2045 gene encodes a VGAM2045 precursor RNA, herein designated VGAM PRECURSOR RNA. Similar to other miRNA genes, and unlike most ordinary genes, VGAM2045 precursor RNA does not encode a protein. A nucleotide sequence identical or highly similar to the nucleotide sequence of VGAM2045 precursor RNA is designated SEQ ID:2031, and is provided hereinbelow with reference to the sequence listing part. Nucleotide sequence SEQ ID:2031 is located at position 196544 relative to the genome of Human Herpesvirus 5.

VGAM2045 precursor RNA folds onto itself, forming VGAM2045 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2045 folded precursor RNA into VGAM2045 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2045 RNA is designated SEQ ID:4756, and is provided hereinbelow with reference to the sequence listing part.

VGAM2045 host target gene, herein designated VGAM HOST TARGET GENE, encodes a corresponding messenger RNA, VGAM2045 host target RNA, herein designated VGAM HOST TARGET RNA. VGAM2045 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2045 RNA, herein designated VGAM RNA, binds complementarily to one or more host target binding sites located in untranslated regions of VGAM2045 host target RNA, herein designated VGAM HOST TARGET RNA. This complementary binding is due to the fact that the nucleotide sequence of VGAM2045 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2045 RNA, herein designated VGAM RNA, may have a different number of host target binding sites in untranslated regions of a VGAM2045 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2045 RNA, herein designated VGAM RNA, to host target binding sites on VGAM2045 host target RNA, herein designated VGAM HOST TARGET RNA, such as BINDING SITE I, BINDING SITE II and BINDING SITE III, inhibits translation of VGAM2045 host target RNA into VGAM2045 host target protein, herein designated VGAM HOST TARGET PROTEIN. VGAM host target protein is therefore outlined by a broken line.

It is appreciated that VGAM2045 host target gene, herein designated VGAM HOST TARGET GENE, in fact represents a plurality of VGAM2045 host target genes. The mRNA of each one of this plurality of VGAM2045 host target genes comprises one or more host target binding sites, each having a nucleotide sequence which is at least partly complementary to VGAM2045 RNA, herein designated VGAM RNA, and which when bound by VGAM2045 RNA causes inhibition of translation of respective one or more VGAM2045 host target proteins.

It is further appreciated by one skilled in the art that the mode of translational inhibition illustrated by FIG. 1 with specific reference to translational inhibition exerted by VGAM2045 gene, herein designated VGAM GENE, on one or more VGAM2045 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2045 is inhibition of expression of host target genes, as part of a novel viral mechanism of attacking a host. Accordingly, utilities of VGAM2045 include diagnosis, prevention and treatment of viral infection by Human Herpesvirus 5. Specific functions, and accordingly utilities, of VGAM2045 correlate with, and may be deduced from, the identity of the host target genes which VGAM2045 binds and inhibits, and the function of these host target genes, as elaborated hereinbelow.

Nucleotide sequences of the VGAM2045 precursor RNA, herein designated VGAM PRECURSOR RNA, and of the 'diced' VGAM2045 RNA, herein designated VGAM RNA, and a schematic representation of the secondary folding of VGAM2045 folded precursor RNA, herein designated VGAM FOLDED PRECURSOR RNA, of VGAM2045 are further described hereinbelow with reference to Table 1.

Nucleotide sequences of host target binding sites, such as BINDING SITE-I, BINDING SITE-II and BINDING SITE-III of FIG. 1, found on VGAM2045 host target RNA, and schematic representation of the complementarity of each of these host target binding sites to VGAM2045 RNA, herein designated VGAM RNA, are described hereinbelow with reference to Table 2.

As mentioned hereinabove with reference to FIG. 1, a function of VGAM2045 gene, herein designated VGAM is inhibition of expression of VGAM2045 target genes. It is appreciated that specific functions, and accordingly utilities, of VGAM2045 correlate with, and may be deduced from, the identity of the target genes which VGAM2045 binds and inhibits, and the function of these target genes, as elaborated hereinbelow.

Interleukin 1 Receptor, Type I (IL1R1, Accession NM_000877) is a VGAM2045 host target gene. IL1R1 BINDING SITE is HOST TARGET binding site found in the 3' untranslated region of mRNA encoded by IL1R1, corresponding to a HOST TARGET binding site such as BINDING SITE I, BINDING SITE II or BINDING SITE III. Table 2 illustrates the complementarity of the nucleotide sequences of IL1R1 BINDING SITE, designated SEQ ID:6564, to the nucleotide sequence of VGAM2045 RNA, herein designated VGAM RNA, also designated SEQ ID:4756.

A function of VGAM2045 is therefore inhibition of Interleukin 1 Receptor, Type I (IL1R1, Accession NM_000877), a gene which is a receptor for interleukin-1 alpha (il-1a), beta (il-1b), and interleukin-1 receptor antagonist protein (il-1ra). Accordingly, utilities of VGAM2045 include diagnosis, prevention and treatment of diseases and clinical conditions associated with IL1R1. The function of IL1R1 and its association with various diseases and clinical conditions, has been established by previous studies, as described hereinabove with reference to VGAM704. Tryptophan Rich Basic Protein (WRB, Accession NM_004627) is another VGAM2045 host target gene. WRB BINDING SITE is HOST TARGET binding site found in the 3" untranslated region of mRNA encoded by WRB, corresponding to a HOST TARGET binding site such as BINDING SITE I, BINDING SITE II or BINDING SITE III. Table 2 illustrates the complementarity of the nucleotide sequences of WRB BINDING SITE, designated SEQ ID:10997, to the nucleotide sequence of VGAM2045 RNA, herein designated VGAM RNA, also designated SEQ ID:4756.

Another function of VGAM2045 is therefore inhibition of Tryptophan Rich Basic Protein (WRB, Accession NM_004627). Accordingly, utilities of VGAM2045 include diagnosis, prevention and treatment of diseases and clinical conditions associated with WRB. C6orf5 (Accession NM_015524) is another VGAM2045 host target gene. C6orf5 BINDING SITE is HOST TARGET binding site found in the 3' untranslated region of mRNA encoded by C6orf5, corresponding to a HOST TARGET binding site such as BINDING SITE I, BINDING SITE II or BINDING SITE III. Table 2 illustrates the complementarity of the nucleotide sequences of C6orf5 BINDING SITE, designated SEQ ID:17777, to the nucleotide sequence of VGAM2045 RNA, herein designated VGAM RNA, also designated SEQ ID:4756.

Another function of VGAM2045 is therefore inhibition of C6orf5 (Accession NM_015524). Accordingly, utilities of VGAM2045 include diagnosis, prevention and treatment of diseases and clinical conditions associated with C6orf5. LOC203595 (Accession XM_119962) is another VGAM2045 host target gene. LOC203595 BINDING SITE is HOST TARGET binding site found in the 5' untranslated region of mRNA encoded by LOC203595, corresponding to a HOST TARGET binding site such as BINDING SITE I, BINDING SITE II or BINDING SITE III. Table 2 illustrates the complementarity of the nucleotide sequences of LOC203595 BINDING SITE, designated SEQ ID:43606, to the nucleotide sequence of VGAM2045 RNA, herein designated VGAM RNA, also designated SEQ ID:4756.

Another function of VGAM2045 is therefore inhibition of LOC203595 (Accession XM_119962). Accordingly, utilities of VGAM2045 include diagnosis, prevention and treatment of diseases and clinical conditions associated with LOC203595. LOC51667 (Accession NM_016118) is another VGAM2045 host target gene. LOC51667 BINDING SITE is HOST TARGET binding site found in the 3' untranslated region of mRNA encoded by LOC51667, corresponding to a HOST TARGET binding site such as BINDING SITE I, BINDING SITE II or BINDING SITE III. Table 2 illustrates the complementarity of the nucleotide sequences of LOC51667 BINDING SITE, designated SEQ ID:18196, to the nucleotide sequence of VGAM2045 RNA, herein designated VGAM RNA, also designated SEQ ID:4756.

Another function of VGAM2045 is therefore inhibition of LOC51667 (Accession NM_016118). Accordingly, utilities of VGAM2045 include diagnosis, prevention and treatment of diseases and clinical conditions associated with LOC51667. FIG. 1 further provides a conceptual description of a novel bioinformatically detected viral gene of the present invention, referred to here as Viral Genomic Address Messenger 2046 (VGAM2046) viral gene, which modulates expression of respective host target genes thereof, the function and utility of which host target genes is known in the art.

VGAM2046 is a novel bioinformatically detected regulatory, non protein coding, viral micro RNA (miRNA) gene. The method by which VGAM2046 was detected is described hereinabove with reference to FIGS. 1-8.

VGAM2046 gene, herein designated VGAM GENE, is a viral gene contained in the genome of Human Herpesvirus 5. VGAM2046 host target gene, herein designated VGAM HOST TARGET GENE, is a human gene contained in the human genome.

VGAM2046 gene encodes a VGAM2046 precursor RNA, herein designated VGAM PRECURSOR RNA. Similar to other miRNA genes, and unlike most ordinary genes, VGAM2046 precursor RNA does not encode a protein. A nucleotide sequence identical or highly similar to the nucleotide sequence of VGAM2046 precursor RNA is designated SEQ ID:2032, and is provided hereinbelow with reference to the sequence listing part. Nucleotide sequence SEQ ID:2032 is located at position 209917 relative to the genome of Human Herpesvirus 5.

VGAM2046 precursor RNA folds onto itself, forming VGAM2046 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2046 folded precursor RNA into VGAM2046 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM2046 RNA is designated SEQ ID:4757, and is provided hereinbelow with reference to the sequence listing part.

VGAM2046 host target gene, herein designated VGAM HOST TARGET GENE, encodes a corresponding messenger RNA, VGAM2046 host target RNA, herein designated VGAM HOST TARGET RNA. VGAM2046 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2046 RNA, herein designated VGAM RNA, binds complementarily to one or more host target binding sites located in untranslated regions of VGAM2046 host target RNA, herein designated VGAM HOST TARGET RNA. This complementary binding is due to the fact that the nucleotide sequence of VGAM2046 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2046 RNA, herein designated VGAM RNA, may have a different number of host target binding sites in untranslated regions of a VGAM2046 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2046 RNA, herein designated VGAM RNA, to host target binding sites on VGAM2046 host target RNA, herein designated VGAM HOST TARGET RNA, such as BINDING SITE I, BINDING SITE II and BINDING SITE III, inhibits translation of VGAM2046 host target RNA into VGAM2046 host target protein, herein designated VGAM HOST TARGET PROTEIN. VGAM host target protein is therefore outlined by a broken line.

It is appreciated that VGAM2046 host target gene, herein designated VGAM HOST TARGET GENE, in fact represents a plurality of VGAM2046 host target genes. The mRNA of each one of this plurality of VGAM2046 host target genes comprises one or more host target binding sites, each having a nucleotide sequence which is at least partly complementary to VGAM2046 RNA, herein designated VGAM RNA, and which when bound by VGAM2046 RNA causes inhibition of translation of respective one or more VGAM2046 host target proteins.

It is further appreciated by one skilled in the art that the mode of translational inhibition illustrated by FIG. 1 with specific reference to translational inhibition exerted by VGAM2046 gene, herein designated VGAM GENE, on one or more VGAM2046 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2046 is inhibition of expression of host target genes, as part of a novel viral mechanism of attacking a host. Accordingly, utilities of VGAM2046 include diagnosis, prevention and treatment of viral infection by Human Herpesvirus 5. Specific functions, and accordingly utilities, of VGAM2046 correlate with, and may be deduced from, the identity of the host target genes which VGAM2046 binds and inhibits, and the function of these host target genes, as elaborated hereinbelow.

Nucleotide sequences of the VGAM2046 precursor RNA, herein designated VGAM PRECURSOR RNA, and of the 'diced' VGAM2046 RNA, herein designated VGAM RNA, and a schematic representation of the secondary folding of VGAM2046 folded precursor RNA, herein designated VGAM FOLDED PRECURSOR RNA, of VGAM2046 are further described hereinbelow with reference to Table 1.

Nucleotide sequences of host target binding sites, such as BINDING SITE-I, BINDING SITE-II and BINDING SITE-III of FIG. 1, found on VGAM2046 host target RNA, and schematic representation of the complementarity of each of these host target binding sites to VGAM2046 RNA, herein designated VGAM RNA, are described hereinbelow with reference to Table 2.

As mentioned hereinabove with reference to FIG. 1, a function of VGAM2046 gene, herein designated VGAM is inhibition of expression of VGAM2046 target genes. It is appreciated that specific functions, and accordingly utilities, of VGAM2046 correlate with, and may be deduced from, the identity of the target genes which VGAM2046 binds and inhibits, and the function of these target genes, as elaborated hereinbelow.

G2A (Accession NM_013345) is a VGAM2046 host target gene. G2A BINDING SITE is HOST TARGET binding site found in the 5' untranslated region of mRNA encoded by G2A, corresponding to a HOST TARGET binding site such as BINDING SITE I, BINDING SITE II or BINDING SITE III. Table 2 illustrates the complementarity of the nucleotide sequences of G2A BINDING SITE, designated SEQ ID:14988, to the nucleotide sequence of VGAM2046 RNA, herein designated VGAM RNA, also designated SEQ ID:4757.

A function of VGAM2046 is therefore inhibition of G2A (Accession NM_013345), a gene which may mediate some of the effects of extracellular atp on insulin secretion. Accordingly, utilities of VGAM2046 include diagnosis, prevention and treatment of diseases and clinical conditions associated with G2A. The function of G2A and its association with various diseases and clinical conditions, has been established by previous studies, as described hereinabove with reference to VGAM1965. FIG. 1 further provides a conceptual description of a novel bioinformatically detected viral gene of the present invention, referred to here as Viral Genomic Address Messenger 2047 (VGAM2047) viral gene, which modulates expression of respective host target genes thereof, the function and utility of which host target genes is known in the art.

VGAM2047 is a novel bioinformatically detected regulatory, non protein coding, viral micro RNA (miRNA) gene. The method by which VGAM2047 was detected is described hereinabove with reference to FIGS. 1-8.

VGAM2047 gene, herein designated VGAM GENE, is a viral gene contained in the genome of Human Herpesvirus 5. VGAM2047 host target gene, herein designated VGAM HOST TARGET GENE, is a human gene contained in the human genome.

VGAM2047 gene encodes a VGAM2047 precursor RNA, herein designated VGAM PRECURSOR RNA. Similar to other miRNA genes, and unlike most ordinary genes, VGAM2047 precursor RNA does not encode a protein. A nucleotide sequence identical or highly similar to the nucleotide sequence of VGAM2047 precursor RNA is designated SEQ ID:2033, and is provided hereinbelow with reference to the sequence listing part. Nucleotide sequence SEQ ID:2033 is located at position 202249 relative to the genome of Human Herpesvirus 5.

VGAM2047 precursor RNA folds onto itself, forming VGAM2047 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2047 folded precursor RNA into VGAM2047 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2047 RNA is designated SEQ ID:4758, and is provided hereinbelow with reference to the sequence listing part.

VGAM2047 host target gene, herein designated VGAM HOST TARGET GENE, encodes a corresponding messenger RNA, VGAM2047 host target RNA, herein designated VGAM HOST TARGET RNA. VGAM2047 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2047 RNA, herein designated VGAM RNA, binds complementarily to one or more host target binding sites located in untranslated regions of VGAM2047 host target RNA, herein designated VGAM HOST TARGET RNA. This complementary binding is due to the fact that the nucleotide sequence of VGAM2047 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2047 RNA, herein designated VGAM RNA, may have a different number of host target binding sites in untranslated regions of a VGAM2047 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2047 RNA, herein designated VGAM RNA, to host target binding sites on VGAM2047 host target RNA, herein designated VGAM HOST TARGET RNA, such as BINDING SITE I, BINDING SITE II and BINDING SITE III, inhibits translation of VGAM2047 host target RNA into VGAM2047 host target protein, herein designated VGAM HOST TARGET PROTEIN. VGAM host target protein is therefore outlined by a broken line.

It is appreciated that VGAM2047 host target gene, herein designated VGAM HOST TARGET GENE, in fact represents a plurality of VGAM2047 host target genes. The mRNA of each one of this plurality of VGAM2047 host target genes comprises one or more host target binding sites, each having a nucleotide sequence which is at least partly complementary to VGAM2047 RNA, herein designated VGAM RNA, and which when bound by VGAM2047 RNA causes inhibition of translation of respective one or more VGAM2047 host target proteins.

It is further appreciated by one skilled in the art that the mode of translational inhibition illustrated by FIG. 1 with specific reference to translational inhibition exerted by VGAM2047 gene, herein designated VGAM GENE, on one or more VGAM2047 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2047 is inhibition of expression of host target genes, as part of a novel viral mechanism of attacking a host. Accordingly, utilities of VGAM2047 include diagnosis, prevention and treatment of viral infection by Human Herpesvirus 5. Specific functions, and accordingly utilities, of VGAM2047 correlate with, and may be deduced from, the identity of the host target genes which VGAM2047 binds and inhibits, and the function of these host target genes, as elaborated hereinbelow.

Nucleotide sequences of the VGAM2047 precursor RNA, herein designated VGAM PRECURSOR RNA, and of the 'diced' VGAM2047 RNA, herein designated VGAM RNA, and a schematic representation of the secondary folding of VGAM2047 folded precursor RNA, herein designated VGAM FOLDED PRECURSOR RNA, of VGAM2047 are further described hereinbelow with reference to Table 1.

Nucleotide sequences of host target binding sites, such as BINDING SITE-I, BINDING SITE-II and BINDING SITE-III of FIG. 1, found on VGAM2047 host target RNA, and schematic representation of the complementarity of each of these host target binding sites to VGAM2047 RNA, herein designated VGAM RNA, are described hereinbelow with reference to Table 2.

As mentioned hereinabove with reference to FIG. 1, a function of VGAM2047 gene, herein designated VGAM is inhibition of expression of VGAM2047 target genes. It is appreciated that specific functions, and accordingly utilities, of VGAM2047 correlate with, and may be deduced from, the identity of the target genes which VGAM2047 binds and inhibits, and the function of these target genes, as elaborated hereinbelow.

CAAX Box 1 (CXX1, Accession NM_003928) is a VGAM2047 host target gene. CXX1 BINDING SITE is HOST TARGET binding site found in the 5' untranslated region of mRNA encoded by CXX1, corresponding to a HOST TARGET binding site such as BINDING SITE I, BINDING SITE II or BINDING SITE III. Table 2 illustrates the complementarity of the nucleotide sequences of CXX1 BINDING SITE, designated SEQ ID:10023, to the nucleotide sequence of VGAM2047 RNA, herein designated VGAM RNA, also designated SEQ ID:4758.

A function of VGAM2047 is therefore inhibition of CAAX Box 1 (CXX1, Accession NM_003928). Accordingly, utilities of VGAM2047 include diagnosis, prevention and treatment of diseases and clinical conditions associated with CXX1. Death Effector Domain Containing (DEDD, Accession NM_032998) is another VGAM2047 host target gene. DEDD BINDING SITE is HOST TARGET binding site found in the 3' untranslated region of mRNA encoded by DEDD, corresponding to a HOST TARGET binding site such as BINDING SITE I, BINDING SITE II or BINDING SITE III. Table 2 illustrates the complementarity of the nucleotide sequences of DEDD BINDING SITE, designated SEQ ID:26878, to the nucleotide sequence of VGAM2047 RNA, herein designated VGAM RNA, also designated SEQ ID:4758.

Another function of VGAM2047 is therefore inhibition of Death Effector Domain Containing (DEDD, Accession NM_032998), a gene which intervenes in apoptosis. Accordingly, utilities of VGAM2047 include diagnosis, prevention and treatment of diseases and clinical conditions associated with DEDD. The function of DEDD and its association with various diseases and clinical conditions, has been established by previous studies, as described hereinabove with reference to VGAM1189. GDP Dissociation Inhibitor 1 (GDI1, Accession XM_010152) is another VGAM2047 host target gene. GDI1 BINDING SITE is HOST TARGET binding site found in the 3' untranslated region of mRNA encoded by GDI1, corresponding to a HOST TARGET binding site such as BINDING SITE I, BINDING SITE II or BINDING SITE III. Table 2 illustrates the complementarity of the nucleotide sequences of GDI1 BINDING SITE, designated SEQ ID:30131, to the nucleotide sequence of VGAM2047 RNA, herein designated VGAM RNA, also designated SEQ ID:4758.

Another function of VGAM2047 is therefore inhibition of GDP Dissociation Inhibitor 1 (GDI1, Accession XM_010152). Accordingly, utilities of VGAM2047 include diagnosis, prevention and treatment of diseases and clinical conditions associated with GDI1. Homeo Box C11 (HOXC11, Accession XM_012215) is another VGAM2047 host target gene. HOXC11 BINDING SITE is HOST TARGET binding site found in the 3' untranslated region of mRNA encoded by HOXC11, corresponding to a HOST TARGET binding site such as BINDING SITE I, BINDING SITE II or BINDING SITE III. Table 2 illustrates the complementarity of the nucleotide sequences of HOXC11 BINDING SITE, designated SEQ ID:30210, to the nucleotide sequence of VGAM2047 RNA, herein designated VGAM RNA, also designated SEQ ID:4758.

Another function of VGAM2047 is therefore inhibition of Homeo Box C11 (HOXC11, Accession XM_012215), a gene which interacts with the lactase-phlorizin hydrolase promoter. Accordingly, utilities of VGAM2047 include diagnosis, prevention and treatment of diseases and clinical conditions associated with HOXC11. The function of HOXC11 has been established by previous studies. See 142950 for general information on homeo box genes. HOXC11 is a member of the Hox C cluster on human chromosome 12 (Scott, 1992) and is homologous to the mouse Hoxc11 gene (previously called Hox3.7) which is located on chromosome 15. Using a yeast 1-hybrid screen designed to identify factors that bind to a portion of the lactase (LCT; 603202) gene promoter, Mitchelmore et al. (1998) identified a partial clone of HOXC11. They assembled the full-length HOXC11 cDNA using database searches and 5-prime RACE. The HOXC11 cDNA encodes a 304-amino acid protein with a homeodomain and a C-terminal extension identical to those of mouse Hoxc11. The homeodomain of HOXC11 is most similar to the homeodomains of mouse Hoxa11, mouse Hoxd11, and Drosophila Abdominal-B genes. Using Northern blot analysis, Mitchelmore et al. (1998) detected a 2.1-kb HOXC11 transcript in HeLa cells. This expression was confirmed by ribonuclease protection assay. A second, 1.7-kb transcript, hypothesized to encode a protein lacking 114 amino acids at the HOXC11 N-terminal end, was detected in HeLa cells and Caco-2 intestinal cells. This smaller transcript becomes more abundant in Caco-2 cells after differentiation. Using RT-PCR, Mitchelmore et al. (1998) showed that HOXC11 is expressed in fetal tissues, including kidney, skeletal muscle, and small intestine. The expression in fetal small intestine was higher than that in small intestine from a 15-year old. Transfection studies using the C-terminal 190 amino acids of HOXC11 in HeLa cells demonstrated binding with similar affinity to the LCT promoter and an optimized Abdominal-B binding site. Both the long and short transcript forms of HOXC11 stimulated HNF1-alpha (OMIM Ref. No. 142410)-dependent transcription of LCT in cotransfection experiments.

Full details of the abovementioned studies are described in the following publications, the disclosure of which are hereby incorporated by reference:

Mitchelmore, C.; Troelsen, J. T.; Sjostrom, H.; Noren, O.: The HOXC11 homeodomain protein interacts with the lactose-phlorizin hydrolase promoter and stimulates HNF1-alpha-dependent transcription. J. Biol. Chem. 273:13297-13306, 1998; and Scott, M. P.: Vertebrate homeobox gene nomenclature. Cell 71:551-553, 1992.

Further studies establishing the function and utilities of HOXC11 are found in John Hopkins OMIM database record ID 605559, and in sited publications numbered 97 and 4377 listed in the bibliography section hereinbelow, which are also hereby incorporated by reference. PCTAIRE Protein Kinase 3 (PCTK3, Accession XM_053746) is another VGAM2047 host target gene. PCTK3 BINDING SITE is HOST TARGET binding site found in the 5' untranslated region of mRNA encoded by PCTK3, corresponding to a HOST TARGET binding site such as BINDING SITE I, BINDING SITE II or BINDING SITE III. Table 2 illustrates the complementarity of the nucleotide sequences of PCTK3 BINDING SITE, designated SEQ ID:36124, to the nucleotide sequence of VGAM2047 RNA, herein designated VGAM RNA, also designated SEQ ID:4758.

Another function of VGAM2047 is therefore inhibition of PCTAIRE Protein Kinase 3 (PCTK3, Accession XM_053746), a gene which may play a role in signal transduction cascades in terminally differentiated cells. Accordingly, utilities of VGAM2047 include diagnosis, prevention and treatment of diseases and clinical conditions associated with PCTK3. The function of PCTK3 and its association with various diseases and clinical conditions, has been established by previous studies, as described hereinabove with reference to VGAM132. Transcription Factor 19 (SC1) (TCF19, Accession XM_175167) is another VGAM2047 host target gene. TCF19 BINDING SITE1 and TCF19 BINDING SITE2 are HOST TARGET binding sites found in untranslated regions of mRNA encoded by TCF19, corresponding to HOST TARGET binding sites such as BINDING SITE I, BINDING SITE II or BINDING SITE III. Table 2 illustrates the complementarity of the nucleotide sequences of TCF19 BINDING SITE1 and TCF19 BINDING SITE2, designated SEQ ID:46659 and SEQ ID:46708 respectively, to the nucleotide sequence of VGAM2047 RNA, herein designated VGAM RNA, also designated SEQ ID:4758.

Another function of VGAM2047 is therefore inhibition of Transcription Factor 19 (SC1) (TCF19, Accession XM_175167), a gene which plays an important role in the transcription of genes required for the later stages of cell cycle progression. Accordingly, utilities of VGAM2047 include diagnosis, prevention and treatment of diseases and clinical conditions associated with TCF19. The function of TCF19 and its association with various diseases and clinical conditions, has been established by previous studies, as described hereinabove with reference to VGAM299. Ubiquitin-conjugating Enzyme E2L 6 (UBE2L6, Accession NM_004223) is another VGAM2047 host target gene. UBE2L6 BINDING SITE is HOST TARGET binding site found in the 3' untranslated region of mRNA encoded by UBE2L6, corresponding to a HOST TARGET binding site such as BINDING SITE I, BINDING SITE II or BINDING SITE III. Table 2 illustrates the complementarity of the nucleotide sequences of UBE2L6 BINDING SITE, designated SEQ ID:10419, to the nucleotide sequence of VGAM2047 RNA, herein designated VGAM RNA, also designated SEQ ID:4758.

Another function of VGAM2047 is therefore inhibition of Ubiquitin-conjugating Enzyme E2L 6 (UBE2L6, Accession NM_004223), a gene which catalyzes the covalent attachment of ubiquitin to other proteins. Accordingly, utilities of VGAM2047 include diagnosis, prevention and treatment of diseases and clinical conditions associated with UBE2L6. The function of UBE2L6 and its association with various diseases and clinical conditions, has been established by previous studies, as described hereinabove with reference to VGAM1059. Zinc Finger Protein 236 (ZNF236, Accession NM_007345) is another VGAM2047 host target gene. ZNF236 BINDING SITE is HOST TARGET binding site found in the 3' untranslated region of mRNA encoded by ZNF236, corresponding to a HOST TARGET binding site such as BINDING SITE I, BINDING SITE II or BINDING SITE III. Table 2 illustrates the complementarity of the nucleotide sequences of ZNF236 BINDING SITE, designated SEQ ID:14274, to the nucleotide sequence of VGAM2047

RNA, herein designated VGAM RNA, also designated SEQ ID:4758.

Another function of VGAM2047 is therefore inhibition of Zinc Finger Protein 236 (ZNF236, Accession NM_007345). Accordingly, utilities of VGAM2047 include diagnosis, prevention and treatment of diseases and clinical conditions associated with ZNF236. DKFZP564B147 (Accession XM_088745) is another VGAM2047 host target gene. DKFZP564B147 BINDING SITE is HOST TARGET binding site found in the 5' untranslated region of mRNA encoded by DKFZP564B147, corresponding to a HOST TARGET binding site such as BINDING SITE I, BINDING SITE II or BINDING SITE III. Table 2 illustrates the complementarity of the nucleotide sequences of DKFZP564B147 BINDING SITE, designated SEQ ID:39934, to the nucleotide sequence of VGAM2047 RNA, herein designated VGAM RNA, also designated SEQ ID:4758.

Another function of VGAM2047 is therefore inhibition of DKFZP564B147 (Accession XM_088745). Accordingly, utilities of VGAM2047 include diagnosis, prevention and treatment of diseases and clinical conditions associated with DKFZP564B147. FLJ10352 (Accession NM_032142) is another VGAM2047 host target gene. FLJ10352 BINDING SITE is HOST TARGET binding site found in the 3' untranslated region of mRNA encoded by FLJ10352, corresponding to a HOST TARGET binding site such as BINDING SITE I, BINDING SITE II or BINDING SITE III. Table 2 illustrates the complementarity of the nucleotide sequences of FLJ10352 BINDING SITE, designated SEQ ID:25827, to the nucleotide sequence of VGAM2047 RNA, herein designated VGAM RNA, also designated SEQ ID:4758.

Another function of VGAM2047 is therefore inhibition of FLJ10352 (Accession NM_032142). Accordingly, utilities of VGAM2047 include diagnosis, prevention and treatment of diseases and clinical conditions associated with FLJ10352. KIAA0140 (Accession NM_014661) is another VGAM2047 host target gene. KIAA0140 BINDING SITE is HOST TARGET binding site found in the 3' untranslated region of mRNA encoded by KIAA0140, corresponding to a HOST TARGET binding site such as BINDING SITE I, BINDING SITE II or BINDING SITE III. Table 2 illustrates the complementarity of the nucleotide sequences of KIAA0140 BINDING SITE, designated SEQ ID:16109, to the nucleotide sequence of VGAM2047 RNA, herein designated VGAM RNA, also designated SEQ ID:4758.

Another function of VGAM2047 is therefore inhibition of KIAA0140 (Accession NM_014661). Accordingly, utilities of VGAM2047 include diagnosis, prevention and treatment of diseases and clinical conditions associated with KIAA0140. KIAA0329 (Accession NM_014844) is another VGAM2047 host target gene. KIAA0329 BINDING SITE is HOST TARGET binding site found in the 3' untranslated region of mRNA encoded by KIAA0329, corresponding to a HOST TARGET binding site such as BINDING SITE I, BINDING SITE II or BINDING SITE III. Table 2 illustrates the complementarity of the nucleotide sequences of KIAA0329 BINDING SITE, designated SEQ ID:16879, to the nucleotide sequence of VGAM2047 RNA, herein designated VGAM RNA, also designated SEQ ID:4758.

Another function of VGAM2047 is therefore inhibition of KIAA0329 (Accession NM_014844). Accordingly, utilities of VGAM2047 include diagnosis, prevention and treatment of diseases and clinical conditions associated with KIAA0329. KIAA0863 (Accession NM_014913) is another VGAM2047 host target gene. KIAA0863 BINDING SITE is HOST TARGET binding site found in the 5' untranslated region of mRNA encoded by KIAA0863, corresponding to a HOST TARGET binding site such as BINDING SITE I, BINDING SITE II or BINDING SITE III. Table 2 illustrates the complementarity of the nucleotide sequences of KIAA0863 BINDING SITE, designated SEQ ID:17154, to the nucleotide sequence of VGAM2047 RNA, herein designated VGAM RNA, also designated SEQ ID:4758.

Another function of VGAM2047 is therefore inhibition of KIAA0863 (Accession NM_014913). Accordingly, utilities of VGAM2047 include diagnosis, prevention and treatment of diseases and clinical conditions associated with KIAA0863. Ras and Rab Interactor 3 (RIN3, Accession NM_024832) is another VGAM2047 host target gene. RIN3 BINDING SITE is HOST TARGET binding site found in the 3' untranslated region of mRNA encoded by RIN3, corresponding to a HOST TARGET binding site such as BINDING SITE I, BINDING SITE II or BINDING SITE III. Table 2 illustrates the complementarity of the nucleotide sequences of RIN3 BINDING SITE, designated SEQ ID:24233, to the nucleotide sequence of VGAM2047 RNA, herein designated VGAM RNA, also designated SEQ ID:4758.

Another function of VGAM2047 is therefore inhibition of Ras and Rab Interactor 3 (RIN3, Accession NM_024832). Accordingly, utilities of VGAM2047 include diagnosis, prevention and treatment of diseases and clinical conditions associated with RIN3. LOC144305 (Accession XM_096572) is another VGAM2047 host target gene. LOC144305 BINDING SITE is HOST TARGET binding site found in the 3' untranslated region of mRNA encoded by LOC144305, corresponding to a HOST TARGET binding site such as BINDING SITE I, BINDING SITE II or BINDING SITE III. Table 2 illustrates the complementarity of the nucleotide sequences of LOC144305 BINDING SITE, designated SEQ ID:40401, to the nucleotide sequence of VGAM2047 RNA, herein designated VGAM RNA, also designated SEQ ID:4758.

Another function of VGAM2047 is therefore inhibition of LOC144305 (Accession XM_096572). Accordingly, utilities of VGAM2047 include diagnosis, prevention and treatment of diseases and clinical conditions associated with LOC144305. LOC154877 (Accession XM_098626) is another VGAM2047 host target gene. LOC154877 BINDING SITE is HOST TARGET binding site found in the 3' untranslated region of mRNA encoded by LOC154877, corresponding to a HOST TARGET binding site such as BINDING SITE I, BINDING SITE II or BINDING SITE III. Table 2 illustrates the complementarity of the nucleotide sequences of LOC154877 BINDING SITE, designated SEQ ID:41740, to the nucleotide sequence of VGAM2047 RNA, herein designated VGAM RNA, also designated SEQ ID:4758.

Another function of VGAM2047 is therefore inhibition of LOC154877 (Accession XM_098626). Accordingly, utilities of VGAM2047 include diagnosis, prevention and treatment of diseases and clinical conditions associated with LOC154877. LOC157983 (Accession XM_088433) is another VGAM2047 host target gene. LOC157983 BINDING SITE is HOST TARGET binding site found in the 3' untranslated region of mRNA encoded by LOC157983, corresponding to a HOST TARGET binding site such as BINDING SITE I, BINDING SITE II or BINDING SITE III. Table 2 illustrates the complementarity of the nucleotide sequences of LOC157983 BINDING SITE, designated SEQ ID:39686, to the nucleotide sequence of VGAM2047 RNA, herein designated VGAM RNA, also designated SEQ ID:4758.

Another function of VGAM2047 is therefore inhibition of LOC157983 (Accession XM_088433). Accordingly, utilities of VGAM2047 include diagnosis, prevention and treatment of diseases and clinical conditions associated with LOC157983. LOC203289 (Accession XM_114672) is another VGAM2047 host target gene. LOC203289 BINDING SITE is HOST TARGET binding site found in the 3' untranslated region of mRNA encoded by LOC203289, corresponding to a HOST TARGET binding site such as BINDING SITE I, BINDING SITE II or BINDING SITE III. Table 2 illustrates the complementarity of the nucleotide sequences of LOC203289 BINDING SITE, designated SEQ ID:43028, to the nucleotide sequence of VGAM2047 RNA, herein designated VGAM RNA, also designated SEQ ID:4758.

Another function of VGAM2047 is therefore inhibition of LOC203289 (Accession XM_114672). Accordingly, utilities of VGAM2047 include diagnosis, prevention and treatment of diseases and clinical conditions associated with LOC203289. LOC256544 (Accession XM_171228) is another VGAM2047 host target gene. LOC256544 BINDING SITE is HOST TARGET binding site found in the 3' untranslated region of mRNA encoded by LOC256544, corresponding to a HOST TARGET binding site such as BINDING SITE I, BINDING SITE II or BINDING SITE III. Table 2 illustrates the complementarity of the nucleotide sequences of LOC256544 BINDING SITE, designated SEQ ID:46015, to the nucleotide sequence of VGAM2047 RNA, herein designated VGAM RNA, also designated SEQ ID:4758.

Another function of VGAM2047 is therefore inhibition of LOC256544 (Accession XM_171228). Accordingly, utilities of VGAM2047 include diagnosis, prevention and treatment of diseases and clinical conditions associated with LOC256544. FIG. 1 further provides a conceptual description of a novel bioinformatically detected viral gene of the present invention, referred to here as Viral Genomic Address Messenger 2048 (VGAM2048) viral gene, which modulates expression of respective host target genes thereof, the function and utility of which host target genes is known in the art.

VGAM2048 is a novel bioinformatically detected regulatory, non protein coding, viral micro RNA (miRNA) gene. The method by which VGAM2048 was detected is described hereinabove with reference to FIGS. 1-8.

VGAM2048 gene, herein designated VGAM GENE, is a viral gene contained in the genome of Human Herpesvirus 5. VGAM2048 host target gene, herein designated VGAM HOST TARGET GENE, is a human gene contained in the human genome.

VGAM2048 gene encodes a VGAM2048 precursor RNA, herein designated VGAM PRECURSOR RNA. Similar to other miRNA genes, and unlike most ordinary genes, VGAM2048 precursor RNA does not encode a protein. A nucleotide sequence identical or highly similar to the nucleotide sequence of VGAM2048 precursor RNA is designated SEQ ID:2034, and is provided hereinbelow with reference to the sequence listing part. Nucleotide sequence SEQ ID:2034 is located at position 207766 relative to the genome of Human Herpesvirus 5.

VGAM2048 precursor RNA folds onto itself, forming VGAM2048 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2048 folded precursor RNA into VGAM2048 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2048 RNA is designated SEQ ID:4759, and is provided hereinbelow with reference to the sequence listing part.

VGAM2048 host target gene, herein designated VGAM HOST TARGET GENE, encodes a corresponding messenger RNA, VGAM2048 host target RNA, herein designated VGAM HOST TARGET RNA. VGAM2048 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2048 RNA, herein designated VGAM RNA, binds complementarily to one or more host target binding sites located in untranslated regions of VGAM2048 host target RNA, herein designated VGAM HOST TARGET RNA. This complementary binding is due to the fact that the nucleotide sequence of VGAM2048 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2048 RNA, herein designated VGAM RNA, may have a different number of host target binding sites in untranslated regions of a VGAM2048 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2048 RNA, herein designated VGAM RNA, to host target binding sites on VGAM2048 host target RNA, herein designated VGAM HOST TARGET RNA, such as BINDING SITE I, BINDING SITE II and BINDING SITE III, inhibits translation of VGAM2048 host target RNA into VGAM2048 host target protein, herein designated VGAM HOST TARGET PROTEIN. VGAM host target protein is therefore outlined by a broken line.

It is appreciated that VGAM2048 host target gene, herein designated VGAM HOST TARGET GENE, in fact represents a plurality of VGAM2048 host target genes. The mRNA of each one of this plurality of VGAM2048 host target genes comprises one or more host target binding sites, each having a nucleotide sequence which is at least partly complementary to VGAM2048 RNA, herein designated VGAM RNA, and which when bound by VGAM2048 RNA causes inhibition of translation of respective one or more VGAM2048 host target proteins.

It is further appreciated by one skilled in the art that the mode of translational inhibition illustrated by FIG. 1 with specific reference to translational inhibition exerted by VGAM2048 gene, herein designated VGAM GENE, on one or more VGAM2048 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2048 is inhibition of expression of host target genes, as part of a novel viral mechanism of attacking a host. Accordingly, utilities of VGAM2048 include diagnosis, prevention and treatment of viral infection by Human Herpesvirus 5. Specific functions, and accordingly utilities, of VGAM2048 correlate with, and may be deduced from, the identity of the host target genes which VGAM2048 binds and inhibits, and the function of these host target genes, as elaborated hereinbelow.

Nucleotide sequences of the VGAM2048 precursor RNA, herein designated VGAM PRECURSOR RNA, and of the 'diced' VGAM2048 RNA, herein designated VGAM RNA, and a schematic representation of the secondary folding of VGAM2048 folded precursor RNA, herein designated VGAM FOLDED PRECURSOR RNA, of VGAM2048 are further described hereinbelow with reference to Table 1.

Nucleotide sequences of host target binding sites, such as BINDING SITE-I, BINDING SITE-II and BINDING SITE-III of FIG. 1, found on VGAM2048 host target RNA, and schematic representation of the complementarity of each of these host target binding sites to VGAM2048 RNA, herein designated VGAM RNA, are described hereinbelow with reference to Table 2.

As mentioned hereinabove with reference to FIG. 1, a function of VGAM2048 gene, herein designated VGAM is inhibition of expression of VGAM2048 target genes. It is appreciated that specific functions, and accordingly utilities, of VGAM2048 correlate with, and may be deduced from, the identity of the target genes which VGAM2048 binds and inhibits, and the function of these target genes, as elaborated hereinbelow.

Coagulation Factor II (thrombin) Receptor-like 3 (F2RL3, Accession NM_003950) is a VGAM2048 host target gene. F2RL3 BINDING SITE is HOST TARGET binding site found in the 3' untranslated region of mRNA encoded by F2RL3, corresponding to a HOST TARGET binding site such as BINDING SITE I, BINDING SITE II or BINDING SITE III. Table 2 illustrates the complementarity of the nucleotide sequences of F2RL3 BINDING SITE, designated SEQ ID:10079, to the nucleotide sequence of VGAM2048 RNA, herein designated VGAM RNA, also designated SEQ ID:4759.

A function of VGAM2048 is therefore inhibition of Coagulation Factor II (thrombin) Receptor-like 3 (F2RL3, Accession NM_003950), a gene which Protease-activated receptor 4; G protein-coupled receptor that increases phosphoinositide hydrolysis. Accordingly, utilities of VGAM2048 include diagnosis, prevention and treatment of diseases and clinical conditions associated with F2RL3. The function of F2RL3 and its association with various diseases and clinical conditions, has been established by previous studies, as described hereinabove with reference to VGAM193. Mannose-6-phosphate Receptor (cation dependent) (M6PR, Accession NM_002355) is another VGAM2048 host target gene. M6PR BINDING SITE is HOST TARGET binding site found in the 3' untranslated region of mRNA encoded by M6PR, corresponding to a HOST TARGET binding site such as BINDING SITE I, BINDING SITE II or BINDING SITE III. Table 2 illustrates the complementarity of the nucleotide sequences of M6PR BINDING SITE, designated SEQ ID:8163, to the nucleotide sequence of VGAM2048 RNA, herein designated VGAM RNA, also designated SEQ ID:4759.

Another function of VGAM2048 is therefore inhibition of Mannose-6-phosphate Receptor (cation dependent) (M6PR, Accession NM_002355), a gene which is nvolved in intracellular sorting and transport of acid hydrolases. Accordingly, utilities of VGAM2048 include diagnosis, prevention and treatment of diseases and clinical conditions associated with M6PR. The function of M6PR and its association with various diseases and clinical conditions, has been established by previous studies, as described hereinabove with reference to VGAM1924. Nescient Helix Loop Helix 1 (NHLH1, Accession NM_005598) is another VGAM2048 host target gene. NHLH1 BINDING SITE is HOST TARGET binding site found in the 3' untranslated region of mRNA encoded by NHLH1, corresponding to a HOST TARGET binding site such as BINDING SITE I, BINDING SITE II or BINDING SITE III. Table 2 illustrates the complementarity of the nucleotide sequences of NHLH1 BINDING SITE, designated SEQ ID:12123, to the nucleotide sequence of VGAM2048 RNA, herein designated VGAM RNA, also designated SEQ ID:4759.

Another function of VGAM2048 is therefore inhibition of Nescient Helix Loop Helix 1 (NHLH1, Accession NM_005598), a gene which may have a role in development of the nervous system. Accordingly, utilities of VGAM2048 include diagnosis, prevention and treatment of diseases and clinical conditions associated with NHLH1. The function of NHLH1 and its association with various diseases and clinical conditions, has been established by previous studies, as described hereinabove with reference to VGAM1923. CCR4-NOT Transcription Complex, Subunit 4 (CNOT4, Accession NM_013316) is another VGAM2048 host target gene. CNOT4 BINDING SITE is HOST TARGET binding site found in the 3' untranslated region of mRNA encoded by CNOT4, corresponding to a HOST TARGET binding site such as BINDING SITE I, BINDING SITE II or BINDING SITE III. Table 2 illustrates the complementarity of the nucleotide sequences of CNOT4 BINDING SITE, designated SEQ ID:14964, to the nucleotide sequence of VGAM2048 RNA, herein designated VGAM RNA, also designated SEQ ID:4759.

Another function of VGAM2048 is therefore inhibition of CCR4-NOT Transcription Complex, Subunit 4 (CNOT4, Accession NM_013316). Accordingly, utilities of VGAM2048 include diagnosis, prevention and treatment of diseases and clinical conditions associated with CNOT4. EFA6R (Accession NM_015310) is another VGAM2048 host target gene. EFA6R BINDING SITE is HOST TARGET binding site found in the 3' untranslated region of mRNA encoded by EFA6R, corresponding to a HOST TARGET binding site such as BINDING SITE I, BINDING SITE II or BINDING SITE III. Table 2 illustrates the complementarity of the nucleotide sequences of EFA6R BINDING SITE, designated SEQ ID:17621, to the nucleotide sequence of VGAM2048 RNA, herein designated VGAM RNA, also designated SEQ ID:4759.

Another function of VGAM2048 is therefore inhibition of EFA6R (Accession NM_015310). Accordingly, utilities of VGAM2048 include diagnosis, prevention and treatment of diseases and clinical conditions associated with EFA6R. FLJ20220 (Accession NM_017718) is another VGAM2048 host target gene. FLJ20220 BINDING SITE is HOST TARGET binding site found in the 3' untranslated region of mRNA encoded by FLJ20220, corresponding to a HOST TARGET binding site such as BINDING SITE I, BINDING SITE II or BINDING SITE III. Table 2 illustrates the complementarity of the nucleotide sequences of FLJ20220 BINDING SITE, designated SEQ ID:19303, to the nucleotide sequence of VGAM2048 RNA, herein designated VGAM RNA, also designated SEQ ID:4759.

Another function of VGAM2048 is therefore inhibition of FLJ20220 (Accession NM_017718). Accordingly, utilities of VGAM2048 include diagnosis, prevention and treatment of diseases and clinical conditions associated with FLJ20220. FLJ20392 (Accession NM_017799) is another VGAM2048 host target gene. FLJ20392 BINDING SITE is HOST TARGET binding site found in the 5' untranslated region of mRNA encoded by FLJ20392, corresponding to a HOST TARGET binding site such as BINDING SITE I, BINDING SITE II or BINDING SITE III. Table 2 illustrates the complementarity of the nucleotide sequences of FLJ20392 BINDING SITE, designated SEQ ID:19444, to the nucleotide sequence of VGAM2048 RNA, herein designated VGAM RNA, also designated SEQ ID:4759.

Another function of VGAM2048 is therefore inhibition of FLJ20392 (Accession NM_017799). Accordingly, utilities of VGAM2048 include diagnosis, prevention and treatment of diseases and clinical conditions associated with FLJ20392. FLJ20445 (Accession NM_017824) is another VGAM2048 host target gene. FLJ20445 BINDING SITE is HOST TARGET binding site found in the 5' untranslated region of mRNA encoded by FLJ20445, corresponding to a HOST TARGET binding site such as BINDING SITE I, BINDING SITE II or BINDING SITE III. Table 2 illustrates the complementarity of the nucleotide sequences of FLJ20445 BINDING SITE, designated SEQ ID:19477, to the nucleotide sequence of VGAM2048 RNA, herein designated VGAM RNA, also designated SEQ ID:4759.

Another function of VGAM2048 is therefore inhibition of FLJ20445 (Accession NM_017824). Accordingly, utilities of VGAM2048 include diagnosis, prevention and treatment of diseases and clinical conditions associated with FLJ20445. FLJ22596 (Accession NM_025086) is another VGAM2048 host target gene. FLJ22596 BINDING SITE is HOST TARGET binding site found in the 5' untranslated region of mRNA encoded by FLJ22596, corresponding to a HOST TARGET binding site such as BINDING SITE I, BINDING SITE II or BINDING SITE III. Table 2 illustrates the complementarity of the nucleotide sequences of FLJ22596 BINDING SITE, designated SEQ ID:24701, to the nucleotide sequence of VGAM2048 RNA, herein designated VGAM RNA, also designated SEQ ID:4759.

Another function of VGAM2048 is therefore inhibition of FLJ22596 (Accession NM_025086). Accordingly, utilities of VGAM2048 include diagnosis, prevention and treatment of diseases and clinical conditions associated with FLJ22596. KIAA1046 (Accession NM_014928) is another VGAM2048 host target gene. KIAA1046 BINDING SITE is HOST TARGET binding site found in the 3' untranslated region of mRNA encoded by KIAA1046, corresponding to a HOST TARGET binding site such as BINDING SITE I, BINDING SITE II or BINDING SITE III. Table 2 illustrates the complementarity of the nucleotide sequences of KIAA1046 BINDING SITE, designated SEQ ID:17216, to the nucleotide sequence of VGAM2048 RNA, herein designated VGAM RNA, also designated SEQ ID:4759.

Another function of VGAM2048 is therefore inhibition of KIAA1046 (Accession NM_014928). Accordingly, utilities of VGAM2048 include diagnosis, prevention and treatment of diseases and clinical conditions associated with KIAA1046. Musculin (activated B-cell factor-1) (MSC, Accession XM_084266) is another VGAM2048 host target gene. MSC BINDING SITE is HOST TARGET binding site found in the 5' untranslated region of mRNA encoded by MSC, corresponding to a HOST TARGET binding site such as BINDING SITE I, BINDING SITE II or BINDING SITE III. Table 2 illustrates the complementarity of the nucleotide sequences of MSC BINDING SITE, designated SEQ ID:37532, to the nucleotide sequence of VGAM2048 RNA, herein designated VGAM RNA, also designated SEQ ID:4759.

Another function of VGAM2048 is therefore inhibition of Musculin (activated B-cell factor-1) (MSC, Accession XM_084266). Accordingly, utilities of VGAM2048 include diagnosis, prevention and treatment of diseases and clinical conditions associated with MSC. PRP8 Pre-mRNA Processing Factor 8 Homolog (yeast) (PRPF8, Accession XM_028335) is another VGAM2048 host target gene. PRPF8 BINDING SITE is HOST TARGET binding site found in the 3' untranslated region of mRNA encoded by PRPF8, corresponding to a HOST TARGET binding site such as BINDING SITE I, BINDING SITE II or BINDING SITE III. Table 2 illustrates the complementarity of the nucleotide sequences of PRPF8 BINDING SITE, designated SEQ ID:30678, to the nucleotide sequence of VGAM2048 RNA, herein designated VGAM RNA, also designated SEQ ID:4759.

Another function of VGAM2048 is therefore inhibition of PRP8 Pre-mRNA Processing Factor 8 Homolog (yeast) (PRPF8, Accession XM_028335). Accordingly, utilities of VGAM2048 include diagnosis, prevention and treatment of diseases and clinical conditions associated with PRPF8. TBP-like 1 (TBPL1, Accession NM_004865) is another VGAM2048 host target gene. TBPL1 BINDING SITE is HOST TARGET binding site found in the 5' untranslated region of mRNA encoded by TBPL1, corresponding to a HOST TARGET binding site such as BINDING SITE I, BINDING SITE II or BINDING SITE III. Table 2 illustrates the complementarity of the nucleotide sequences of TBPL1 BINDING SITE, designated SEQ ID:11289, to the nucleotide sequence of VGAM2048 RNA, herein designated VGAM RNA, also designated SEQ ID:4759.

Another function of VGAM2048 is therefore inhibition of TBP-like 1 (TBPL1, Accession NM_004865). Accordingly, utilities of VGAM2048 include diagnosis, prevention and treatment of diseases and clinical conditions associated with TBPL1. VPS39 (Accession XM_031720) is another VGAM2048 host target gene. VPS39 BINDING SITE is HOST TARGET binding site found in the 3' untranslated region of mRNA encoded by VPS39, corresponding to a HOST TARGET binding site such as BINDING SITE I, BINDING SITE II or BINDING SITE III. Table 2 illustrates the complementarity of the nucleotide sequences of VPS39 BINDING SITE, designated SEQ ID:31468, to the nucleotide sequence of VGAM2048 RNA, herein designated VGAM RNA, also designated SEQ ID:4759.

Another function of VGAM2048 is therefore inhibition of VPS39 (Accession XM_031720). Accordingly, utilities of VGAM2048 include diagnosis, prevention and treatment of diseases and clinical conditions associated with VPS39. ZTL1 (Accession NM_024055) is another VGAM2048 host target gene. ZTL1 BINDING SITE is HOST TARGET binding site found in the 3' untranslated region of mRNA encoded by ZTL1, corresponding to a HOST TARGET binding site such as BINDING SITE I, BINDING SITE II or BINDING SITE III. Table 2 illustrates the complementarity of the nucleotide sequences of ZTL1 BINDING SITE, designated SEQ ID:23490, to the nucleotide sequence of VGAM2048 RNA, herein designated VGAM RNA, also designated SEQ ID:4759.

Another function of VGAM2048 is therefore inhibition of ZTL1 (Accession NM_024055). Accordingly, utilities of VGAM2048 include diagnosis, prevention and treatment of diseases and clinical conditions associated with ZTL1.

LOC150067 (Accession XM_016411) is another VGAM2048 host target gene. LOC150067 BINDING SITE is HOST TARGET binding site found in the 5' untranslated region of mRNA encoded by LOC150067, corresponding to a HOST TARGET binding site such as BINDING SITE I, BINDING SITE II or BINDING SITE III. Table 2 illustrates the complementarity of the nucleotide sequences of LOC150067 BINDING SITE, designated SEQ ID:30258, to the nucleotide sequence of VGAM2048 RNA, herein designated VGAM RNA, also designated SEQ ID:4759.

Another function of VGAM2048 is therefore inhibition of LOC150067 (Accession XM_016411). Accordingly, utilities of VGAM2048 include diagnosis, prevention and treatment of diseases and clinical conditions associated with LOC150067. LOC151057 (Accession XM_097998) is another VGAM2048 host target gene. LOC151057 BINDING SITE is HOST TARGET binding site found in the 3' untranslated region of mRNA encoded by LOC151057, corresponding to a HOST TARGET binding site such as BINDING SITE I, BINDING SITE II or BINDING SITE III. Table 2 illustrates the complementarity of the nucleotide sequences of LOC151057 BINDING SITE, designated SEQ ID:41292, to the nucleotide sequence of VGAM2048 RNA, herein designated VGAM RNA, also designated SEQ ID:4759.

Another function of VGAM2048 is therefore inhibition of LOC151057 (Accession XM_097998). Accordingly, utilities of VGAM2048 include diagnosis, prevention and treatment of diseases and clinical conditions associated with LOC151057. LOC153443 (Accession XM_087669) is another VGAM2048 host target gene. LOC153443 BINDING SITE is HOST TARGET binding site found in the 3' untranslated region of mRNA encoded by LOC153443, corresponding to a HOST TARGET binding site such as BINDING SITE I, BINDING SITE II or BINDING SITE III. Table 2 illustrates the complementarity of the nucleotide sequences of LOC153443 BINDING SITE, designated SEQ ID:39373, to the nucleotide sequence of VGAM2048 RNA, herein designated VGAM RNA, also designated SEQ ID:4759.

Another function of VGAM2048 is therefore inhibition of LOC153443 (Accession XM_087669). Accordingly, utilities of VGAM2048 include diagnosis, prevention and treatment of diseases and clinical conditions associated with LOC153443. LOC197003 (Accession XM_113798) is another VGAM2048 host target gene. LOC197003 BINDING SITE is HOST TARGET binding site found in the 3' untranslated region of mRNA encoded by LOC197003, corresponding to a HOST TARGET binding site such as BINDING SITE I, BINDING SITE II or BINDING SITE III. Table 2 illustrates the complementarity of the nucleotide sequences of LOC197003 BINDING SITE, designated SEQ ID:42442, to the nucleotide sequence of VGAM2048 RNA, herein designated VGAM RNA, also designated SEQ ID:4759.

Another function of VGAM2048 is therefore inhibition of LOC197003 (Accession XM_113798). Accordingly, utilities of VGAM2048 include diagnosis, prevention and treatment of diseases and clinical conditions associated with LOC197003. LOC200205 (Accession XM_114152) is another VGAM2048 host target gene. LOC200205 BINDING SITE is HOST TARGET binding site found in the 3' untranslated region of mRNA encoded by LOC200205, corresponding to a HOST TARGET binding site such as BINDING SITE I, BINDING SITE II or BINDING SITE III. Table 2 illustrates the complementarity of the nucleotide sequences of LOC200205 BINDING SITE, designated SEQ ID:42734, to the nucleotide sequence of VGAM2048 RNA, herein designated VGAM RNA, also designated SEQ ID:4759.

Another function of VGAM2048 is therefore inhibition of LOC200205 (Accession XM_114152). Accordingly, utilities of VGAM2048 include diagnosis, prevention and treatment of diseases and clinical conditions associated with LOC200205. LOC219401 (Accession XM_166706) is another VGAM2048 host target gene. LOC219401 BINDING SITE is HOST TARGET binding site found in the 3' untranslated region of mRNA encoded by LOC219401, corresponding to a HOST TARGET binding site such as BINDING SITE I, BINDING SITE II or BINDING SITE III. Table 2 illustrates the complementarity of the nucleotide sequences of LOC219401 BINDING SITE, designated SEQ ID:44592, to the nucleotide sequence of VGAM2048 RNA, herein designated VGAM RNA, also designated SEQ ID:4759.

Another function of VGAM2048 is therefore inhibition of LOC219401 (Accession XM_166706). Accordingly, utilities of VGAM2048 include diagnosis, prevention and treatment of diseases and clinical conditions associated with LOC219401. LOC255126 (Accession XM_173585) is another VGAM2048 host target gene. LOC255126 BINDING SITE is HOST TARGET binding site found in the 5' untranslated region of mRNA encoded by LOC255126, corresponding to a HOST TARGET binding site such as BINDING SITE I, BINDING SITE II or BINDING SITE III. Table 2 illustrates the complementarity of the nucleotide sequences of LOC255126 BINDING SITE, designated SEQ ID:46550, to the nucleotide sequence of VGAM2048 RNA, herein designated VGAM RNA, also designated SEQ ID:4759.

Another function of VGAM2048 is therefore inhibition of LOC255126 (Accession XM_173585). Accordingly, utilities of VGAM2048 include diagnosis, prevention and treatment of diseases and clinical conditions associated with LOC255126. LOC51072 (Accession NM_015955) is another VGAM2048 host target gene. LOC51072 BINDING SITE is HOST TARGET binding site found in the 5' untranslated region of mRNA encoded by LOC51072, corresponding to a HOST TARGET binding site such as BINDING SITE I, BINDING SITE II or BINDING SITE III. Table 2 illustrates the complementarity of the nucleotide sequences of LOC51072 BINDING SITE, designated SEQ ID:18067, to the nucleotide sequence of VGAM2048 RNA, herein designated VGAM RNA, also designated SEQ ID:4759.

Another function of VGAM2048 is therefore inhibition of LOC51072 (Accession NM_015955). Accordingly, utilities of VGAM2048 include diagnosis, prevention and treatment of diseases and clinical conditions associated with LOC51072. LOC90139 (Accession NM_130783) is another VGAM2048 host target gene. LOC90139 BINDING SITE is HOST TARGET binding site found in the 3' untranslated region of mRNA encoded by LOC90139, corresponding to a HOST TARGET binding site such as BINDING SITE I, BINDING SITE II or BINDING SITE III. Table 2 illustrates the complementarity of the nucleotide sequences of LOC90139 BINDING SITE, designated SEQ ID:28273, to the nucleotide sequence of VGAM2048 RNA, herein designated VGAM RNA, also designated SEQ ID:4759.

Another function of VGAM2048 is therefore inhibition of LOC90139 (Accession NM_130783). Accordingly, utilities of VGAM2048 include diagnosis, prevention and treatment of diseases and clinical conditions associated with LOC90139. LOC91373 (Accession XM_038063) is another VGAM2048 host target gene. LOC91373 BINDING SITE is HOST TARGET binding site found in the 3' untranslated region of mRNA encoded by LOC91373, corresponding to a HOST TARGET binding site such as BINDING SITE I, BINDING SITE II or BINDING SITE III. Table 2 illustrates the complementarity of the nucleotide sequences of LOC91373 BINDING SITE, designated SEQ ID:32750, to the nucleotide sequence of VGAM2048 RNA, herein designated VGAM RNA, also designated SEQ ID:4759.

Another function of VGAM2048 is therefore inhibition of LOC91373 (Accession XM_038063). Accordingly, utilities of VGAM2048 include diagnosis, prevention and treatment of diseases and clinical conditions associated with LOC91373. FIG. 1 further provides a conceptual description of a novel bioinformatically detected viral gene of the present invention, referred to here as Viral Genomic Address Messenger 2049 (VGAM2049) viral gene, which modulates expression of respective host target genes thereof, the function and utility of which host target genes is known in the art.

VGAM2049 is a novel bioinformatically detected regulatory, non protein coding, viral micro RNA (miRNA) gene. The method by which VGAM2049 was detected is described hereinabove with reference to FIGS. 1-8.

VGAM2049 gene, herein designated VGAM GENE, is a viral gene contained in the genome of Human Herpesvirus 5. VGAM2049 host target gene, herein designated VGAM HOST TARGET GENE, is a human gene contained in the human genome.

VGAM2049 gene encodes a VGAM2049 precursor RNA, herein designated VGAM PRECURSOR RNA. Similar to other miRNA genes, and unlike most ordinary genes, VGAM2049 precursor RNA does not encode a protein. A nucleotide sequence identical or highly similar to the nucleotide sequence of VGAM2049 precursor RNA is designated SEQ ID:2035, and is provided hereinbelow with reference to the sequence listing part. Nucleotide sequence SEQ ID:2035 is located at position 196060 relative to the genome of Human Herpesvirus 5.

VGAM2049 precursor RNA folds onto itself, forming VGAM2049 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2049 folded precursor RNA into VGAM2049 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM2049 RNA is designated SEQ ID:4760, and is provided hereinbelow with reference to the sequence listing part.

VGAM2049 host target gene, herein designated VGAM HOST TARGET GENE, encodes a corresponding messenger RNA, VGAM2049 host target RNA, herein designated VGAM HOST TARGET RNA. VGAM2049 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2049 RNA, herein designated VGAM RNA, binds complementarily to one or more host target binding sites located in untranslated regions of VGAM2049 host target RNA, herein designated VGAM HOST TARGET RNA. This complementary binding is due to the fact that the nucleotide sequence of VGAM2049 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2049 RNA, herein designated VGAM RNA, may have a different number of host target binding sites in untranslated regions of a VGAM2049 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2049 RNA, herein designated VGAM RNA, to host target binding sites on VGAM2049 host target RNA, herein designated VGAM HOST TARGET RNA, such as BINDING SITE I, BINDING SITE II and BINDING SITE III, inhibits translation of VGAM2049 host target RNA into VGAM2049 host target protein, herein designated VGAM HOST TARGET PROTEIN. VGAM host target protein is therefore outlined by a broken line.

It is appreciated that VGAM2049 host target gene, herein designated VGAM HOST TARGET GENE, in fact represents a plurality of VGAM2049 host target genes. The mRNA of each one of this plurality of VGAM2049 host target genes comprises one or more host target binding sites, each having a nucleotide sequence which is at least partly complementary to VGAM2049 RNA, herein designated VGAM RNA, and which when bound by VGAM2049 RNA causes inhibition of translation of respective one or more VGAM2049 host target proteins.

It is further appreciated by one skilled in the art that the mode of translational inhibition illustrated by FIG. 1 with specific reference to translational inhibition exerted by VGAM2049 gene, herein designated VGAM GENE, on one or more VGAM2049 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2049 is inhibition of expression of host target genes, as part of a novel viral mechanism of attacking a host. Accordingly, utilities of VGAM2049 include diagnosis, prevention and treatment of viral infection by Human Herpesvirus 5. Specific functions, and accordingly utilities, of VGAM2049 correlate with, and may be deduced from, the identity of the host target genes which VGAM2049 binds and inhibits, and the function of these host target genes, as elaborated hereinbelow.

Nucleotide sequences of the VGAM2049 precursor RNA, herein designated VGAM PRECURSOR RNA, and of the 'diced' VGAM2049 RNA, herein designated VGAM RNA, and a schematic representation of the secondary folding of VGAM2049 folded precursor RNA, herein designated VGAM FOLDED PRECURSOR RNA, of VGAM2049 are further described hereinbelow with reference to Table 1.

Nucleotide sequences of host target binding sites, such as BINDING SITE-I, BINDING SITE-II and BINDING SITE- III of FIG. 1, found on VGAM2049 host target RNA, and schematic representation of the complementarity of each of these host target binding sites to VGAM2049 RNA, herein designated VGAM RNA, are described hereinbelow with reference to Table 2.

As mentioned hereinabove with reference to FIG. 1, a function of VGAM2049 gene, herein designated VGAM is inhibition of expression of VGAM2049 target genes. It is appreciated that specific functions, and accordingly utilities, of VGAM2049 correlate with, and may be deduced from, the identity of the target genes which VGAM2049 binds and inhibits, and the function of these target genes, as elaborated hereinbelow.

Complement Component 7 (C7, Accession NM_000587) is a VGAM2049 host target gene. C7 BINDING SITE is HOST TARGET binding site found in the 3' untranslated region of mRNA encoded by C7, corresponding to a HOST TARGET binding site such as BINDING SITE I, BINDING SITE II or BINDING SITE III. Table 2 illustrates the complementarity of the nucleotide sequences of C7 BINDING SITE, designated SEQ ID:6192, to the nucleotide sequence of VGAM2049 RNA, herein designated VGAM RNA, also designated SEQ ID:4760.

A function of VGAM2049 is therefore inhibition of Complement Component 7 (C7, Accession NM_000587). Accordingly, utilities of VGAM2049 include diagnosis, prevention and treatment of diseases and clinical conditions associated with C7. Dual Specificity Phosphatase 5 (DUSP5, Accession NM_004419) is another VGAM2049 host target gene. DUSP5 BINDING SITE is HOST TARGET binding site found in the 3' untranslated region of mRNA encoded by DUSP5, corresponding to a HOST TARGET binding site such as BINDING SITE I, BINDING SITE II or BINDING SITE III. Table 2 illustrates the complementarity of the nucleotide sequences of DUSP5 BINDING SITE, designated SEQ ID:10686, to the nucleotide sequence of VGAM2049 RNA, herein designated VGAM RNA, also designated SEQ ID:4760.

Another function of VGAM2049 is therefore inhibition of Dual Specificity Phosphatase 5 (DUSP5, Accession NM_004419), a gene which displays phosphatase activity toward several substrates. Accordingly, utilities of VGAM2049 include diagnosis, prevention and treatment of diseases and clinical conditions associated with DUSP5. The function of DUSP5 and its association with various diseases and clinical conditions, has been established by previous studies, as described hereinabove with reference to VGAM538. DKFZP564C103 (Accession NM_015654) is another VGAM2049 host target gene. DKFZP564C103 BINDING SITE is HOST TARGET binding site found in the 3' untranslated region of mRNA encoded by DKFZP564C103, corresponding to a HOST TARGET binding site such as BINDING SITE I, BINDING SITE II or BINDING SITE III. Table 2 illustrates the complementarity of the nucleotide sequences of DKFZP564C103 BINDING SITE, designated SEQ ID:17901, to the nucleotide sequence of VGAM2049 RNA, herein designated VGAM RNA, also designated SEQ ID:4760.

Another function of VGAM2049 is therefore inhibition of DKFZP564C103 (Accession NM_015654). Accordingly, utilities of VGAM2049 include diagnosis, prevention and treatment of diseases and clinical conditions associated with DKFZP564C103. KIAA0561 (Accession XM_038150) is another VGAM2049 host target gene. KIAA0561 BINDING SITE is HOST TARGET binding site found in the 5' untranslated region of mRNA encoded by KIAA0561, corresponding to a HOST TARGET binding site such as BINDING SITE I, BINDING SITE II or BINDING SITE III. Table 2 illustrates the complementarity of the nucleotide sequences of KIAA0561 BINDING SITE, designated SEQ ID:32762, to the nucleotide sequence of VGAM2049 RNA, herein designated VGAM RNA, also designated SEQ ID:4760.

Another function of VGAM2049 is therefore inhibition of KIAA0561 (Accession XM_038150). Accordingly, utilities of VGAM2049 include diagnosis, prevention and treatment of diseases and clinical conditions associated with KIAA0561. KIAA0935 (Accession XM_052620) is another VGAM2049 host target gene. KIAA0935 BINDING SITE is HOST TARGET binding site found in the 3' untranslated region of mRNA encoded by KIAA0935, corresponding to a HOST TARGET binding site such as BINDING SITE I, BINDING SITE II or BINDING SITE III. Table 2 illustrates the complementarity of the nucleotide sequences of KIAA0935 BINDING SITE, designated SEQ ID:36012, to the nucleotide sequence of VGAM2049 RNA, herein designated VGAM RNA, also designated SEQ ID:4760.

Another function of VGAM2049 is therefore inhibition of KIAA0935 (Accession XM_052620). Accordingly, utilities of VGAM2049 include diagnosis, prevention and treatment of diseases and clinical conditions associated with KIAA0935. Protein Phosphatase 4, Regulatory Subunit 1-like (PPP4R1L, Accession XM_086650) is another VGAM2049 host target gene. PPP4R1L BINDING SITE is HOST TARGET binding site found in the 5' untranslated region of mRNA encoded by PPP4R1L, corresponding to a HOST TARGET binding site such as BINDING SITE I, BINDING SITE II or BINDING SITE III. Table 2 illustrates the complementarity of the nucleotide sequences of PPP4R1L BINDING SITE, designated SEQ ID:38816, to the nucleotide sequence of VGAM2049 RNA, herein designated VGAM RNA, also designated SEQ ID:4760.

Another function of VGAM2049 is therefore inhibition of Protein Phosphatase 4, Regulatory Subunit 1-like (PPP4R1L, Accession XM_086650). Accordingly, utilities of VGAM2049 include diagnosis, prevention and treatment of diseases and clinical conditions associated with PPP4R1L. ZAK (Accession NM_016653) is another VGAM2049 host target gene. ZAK BINDING SITE is HOST TARGET binding site found in the 3' untranslated region of mRNA encoded by ZAK, corresponding to a HOST TARGET binding site such as BINDING SITE I, BINDING SITE II or BINDING SITE III. Table 2 illustrates the complementarity of the nucleotide sequences of ZAK BINDING SITE, designated SEQ ID:18778, to the nucleotide sequence of VGAM2049 RNA, herein designated VGAM RNA, also designated SEQ ID:4760.

Another function of VGAM2049 is therefore inhibition of ZAK (Accession NM_016653). Accordingly, utilities of VGAM2049 include diagnosis, prevention and treatment of diseases and clinical conditions associated with ZAK. LOC149566 (Accession XM_097670) is another VGAM2049 host target gene. LOC149566 BINDING SITE is HOST TARGET binding site found in the 3' untranslated region of mRNA encoded by LOC149566, corresponding to a HOST TARGET binding site such as BINDING SITE I, BINDING SITE II or BINDING SITE III. Table 2 illustrates the complementarity of the nucleotide sequences of LOC149566 BINDING SITE, designated SEQ ID:41012, to the nucleotide sequence of VGAM2049 RNA, herein designated VGAM RNA, also designated SEQ ID:4760.

Another function of VGAM2049 is therefore inhibition of LOC149566 (Accession XM_097670). Accordingly, utilities of VGAM2049 include diagnosis, prevention and treatment of diseases and clinical conditions associated with LOC149566. LOC150368 (Accession XM_086826) is another VGAM2049 host target gene. LOC150368 BINDING SITE is HOST TARGET binding site found in the 3' untranslated region of mRNA encoded by LOC150368, corresponding to a HOST TARGET binding site such as BINDING SITE I, BINDING SITE II or BINDING SITE III. Table 2 illustrates the complementarity of the nucleotide sequences of LOC150368 BINDING SITE, designated SEQ ID:38911, to the nucleotide sequence of VGAM2049 RNA, herein designated VGAM RNA, also designated SEQ ID:4760.

Another function of VGAM2049 is therefore inhibition of LOC150368 (Accession XM_086826). Accordingly, utilities of VGAM2049 include diagnosis, prevention and treatment of diseases and clinical conditions associated with LOC150368. LOC255718 (Accession XM_174148) is another VGAM2049 host target gene. LOC255718 BINDING SITE is HOST TARGET binding site found in the 5' untranslated region of mRNA encoded by LOC255718, corresponding to a HOST TARGET binding site such as BINDING SITE I, BINDING SITE II or BINDING SITE III. Table 2 illustrates the complementarity of the nucleotide sequences of LOC255718 BINDING SITE, designated SEQ ID:46582, to the nucleotide sequence of VGAM2049 RNA, herein designated VGAM RNA, also designated SEQ ID:4760.

Another function of VGAM2049 is therefore inhibition of LOC255718 (Accession XM_174148). Accordingly, utilities of VGAM2049 include diagnosis, prevention and treatment of diseases and clinical conditions associated with LOC255718. FIG. 1 further provides a conceptual description of a novel bioinformatically detected viral gene of the present invention, referred to here as Viral Genomic Address Messenger 2050 (VGAM2050) viral gene, which modulates expression of respective host target genes thereof, the function and utility of which host target genes is known in the art.

VGAM2050 is a novel bioinformatically detected regulatory, non protein coding, viral micro RNA (miRNA) gene. The method by which VGAM2050 was detected is described hereinabove with reference to FIGS. 1-8.

VGAM2050 gene, herein designated VGAM GENE, is a viral gene contained in the genome of Ovine Adenovirus A. VGAM2050 host target gene, herein designated VGAM HOST TARGET GENE, is a human gene contained in the human genome.

VGAM2050 gene encodes a VGAM2050 precursor RNA, herein designated VGAM PRECURSOR RNA. Similar to other miRNA genes, and unlike most ordinary genes, VGAM2050 precursor RNA does not encode a protein. A nucleotide sequence identical or highly similar to the nucleotide sequence of VGAM2050 precursor RNA is designated SEQ ID:2036, and is provided hereinbelow with reference to the sequence listing part. Nucleotide sequence SEQ ID:2036 is located at position 13096 relative to the genome of Ovine Adenovirus A.

VGAM2050 precursor RNA folds onto itself, forming VGAM2050 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2050 folded precursor RNA into VGAM2050 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM2050 RNA is designated SEQ ID:4761, and is provided hereinbelow with reference to the sequence listing part.

VGAM2050 host target gene, herein designated VGAM HOST TARGET GENE, encodes a corresponding messenger RNA, VGAM2050 host target RNA, herein designated VGAM HOST TARGET RNA. VGAM2050 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2050 RNA, herein designated VGAM RNA, binds complementarily to one or more host target binding sites located in untranslated regions of VGAM2050 host target RNA, herein designated VGAM HOST TARGET RNA. This complementary binding is due to the fact that the nucleotide sequence of VGAM2050 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2050 RNA, herein designated VGAM RNA, may have a different number of host target binding sites in untranslated regions of a VGAM2050 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2050 RNA, herein designated VGAM RNA, to host target binding sites on VGAM2050 host target RNA, herein designated VGAM HOST TARGET RNA, such as BINDING SITE I, BINDING SITE II and BINDING SITE III, inhibits translation of VGAM2050 host target RNA into VGAM2050 host target protein, herein designated VGAM HOST TARGET PROTEIN. VGAM host target protein is therefore outlined by a broken line.

It is appreciated that VGAM2050 host target gene, herein designated VGAM HOST TARGET GENE, in fact represents a plurality of VGAM2050 host target genes. The mRNA of each one of this plurality of VGAM2050 host target genes comprises one or more host target binding sites, each having a nucleotide sequence which is at least partly complementary to VGAM2050 RNA, herein designated VGAM RNA, and which when bound by VGAM2050 RNA causes inhibition of translation of respective one or more VGAM2050 host target proteins.

It is further appreciated by one skilled in the art that the mode of translational inhibition illustrated by FIG. 1 with specific reference to translational inhibition exerted by VGAM2050 gene, herein designated VGAM GENE, on one or more VGAM2050 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2050 is inhibition of expression of host target genes, as part of a novel viral mechanism of attacking a host. Accordingly, utilities of VGAM2050 include diagnosis, prevention and treatment of viral infection by Ovine Adenovirus A. Specific functions, and accordingly utilities, of VGAM2050 correlate with, and may be deduced from, the identity of the host target genes which VGAM2050 binds and inhibits, and the function of these host target genes, as elaborated hereinbelow.

Nucleotide sequences of the VGAM2050 precursor RNA, herein designated VGAM PRECURSOR RNA, and of the 'diced' VGAM2050 RNA, herein designated VGAM RNA, and a schematic representation of the secondary folding of VGAM2050 folded precursor RNA, herein designated VGAM FOLDED PRECURSOR RNA, of VGAM2050 are further described hereinbelow with reference to Table 1.

Nucleotide sequences of host target binding sites, such as BINDING SITE-I, BINDING SITE-II and BINDING SITE-III of FIG. 1, found on VGAM2050 host target RNA, and schematic representation of the complementarity of each of these host target binding sites to VGAM2050 RNA, herein designated VGAM RNA, are described hereinbelow with reference to Table 2.

As mentioned hereinabove with reference to FIG. 1, a function of VGAM2050 gene, herein designated VGAM is inhibition of expression of VGAM2050 target genes. It is appreciated that specific functions, and accordingly utilities, of VGAM2050 correlate with, and may be deduced from, the identity of the target genes which VGAM2050 binds and inhibits, and the function of these target genes, as elaborated hereinbelow.

KIAA0820 (Accession XM_044463) is a VGAM2050 host target gene. KIAA0820 BINDING SITE is HOST TARGET binding site found in the 3' untranslated region of mRNA encoded by KIAA0820, corresponding to a HOST TARGET binding site such as BINDING SITE I, BINDING SITE II or BINDING SITE III. Table 2 illustrates the complementarity of the nucleotide sequences of KIAA0820 BINDING SITE, designated SEQ ID:34215, to the nucleotide sequence of VGAM2050 RNA, herein designated VGAM RNA, also designated SEQ ID:4761.

A function of VGAM2050 is therefore inhibition of KIAA0820 (Accession XM_044463). Accordingly, utilities of VGAM2050 include diagnosis, prevention and treatment of diseases and clinical conditions associated with KIAA0820. LOC205327 (Accession XM_115788) is another VGAM2050 host target gene. LOC205327 BINDING SITE is HOST TARGET binding site found in the 3' untranslated region of mRNA encoded by LOC205327, corresponding to a HOST TARGET binding site such as BINDING SITE I, BINDING SITE II or BINDING SITE III. Table 2 illustrates the complementarity of the nucleotide sequences of LOC205327 BINDING SITE, designated SEQ ID:43103, to the nucleotide sequence of VGAM2050 RNA, herein designated VGAM RNA, also designated SEQ ID:4761.

Another function of VGAM2050 is therefore inhibition of LOC205327 (Accession XM_115788). Accordingly, utilities of VGAM2050 include diagnosis, prevention and treatment of diseases and clinical conditions associated with LOC205327. LOC222681 (Accession XM_167116) is another VGAM2050 host target gene. LOC222681 BINDING SITE is HOST TARGET binding site found in the 3' untranslated region of mRNA encoded by LOC222681, corresponding to a HOST TARGET binding site such as BINDING SITE I, BINDING SITE II or BINDING SITE III. Table 2 illustrates the complementarity of the nucleotide sequences of LOC222681 BINDING SITE, designated SEQ ID:44607, to the nucleotide sequence of VGAM2050 RNA, herein designated VGAM RNA, also designated SEQ ID:4761.

Another function of VGAM2050 is therefore inhibition of LOC222681 (Accession XM_167116). Accordingly, utilities of VGAM2050 include diagnosis, prevention and treatment of diseases and clinical conditions associated with LOC222681. LOC257507 (Accession XM_175204) is another VGAM2050 host target gene. LOC257507 BINDING SITE is HOST TARGET binding site found in the 3' untranslated region of mRNA encoded by LOC257507, corresponding to a HOST TARGET binding site such as BINDING SITE I, BINDING SITE II or BINDING SITE III. Table 2 illustrates the complementarity of the nucleotide sequences of LOC257507 BINDING SITE, designated SEQ ID:46673, to the nucleotide sequence of VGAM2050 RNA, herein designated VGAM RNA, also designated SEQ ID:4761.

Another function of VGAM2050 is therefore inhibition of LOC257507 (Accession XM_175204). Accordingly, utilities of VGAM2050 include diagnosis, prevention and treatment of diseases and clinical conditions associated with LOC257507. LOC257625 (Accession XM_175267) is another VGAM2050 host target gene. LOC257625 BINDING SITE is HOST TARGET binding site found in the 3' untranslated region of mRNA encoded by LOC257625, corresponding to a HOST TARGET binding site such as BINDING SITE I, BINDING SITE II or BINDING SITE III. Table 2 illustrates the complementarity of the nucleotide sequences of LOC257625 BINDING SITE, designated SEQ ID:46729, to the nucleotide sequence of VGAM2050 RNA, herein designated VGAM RNA, also designated SEQ ID:4761.

Another function of VGAM2050 is therefore inhibition of LOC257625 (Accession XM_175267). Accordingly, utilities of VGAM2050 include diagnosis, prevention and treatment of diseases and clinical conditions associated with LOC257625. FIG. 1 further provides a conceptual description of a novel bioinformatically detected viral gene of the present invention, referred to here as Viral Genomic Address Messenger 2051 (VGAM2051) viral gene, which modulates expression of respective host target genes thereof, the function and utility of which host target genes is known in the art.

VGAM2051 is a novel bioinformatically detected regulatory, non protein coding, viral micro RNA (miRNA) gene. The method by which VGAM2051 was detected is described hereinabove with reference to FIGS. 1-8.

VGAM2051 gene, herein designated VGAM GENE, is a viral gene contained in the genome of Ovine Adenovirus A. VGAM2051 host target gene, herein designated VGAM HOST TARGET GENE, is a human gene contained in the human genome.

VGAM2051 gene encodes a VGAM2051 precursor RNA, herein designated VGAM PRECURSOR RNA. Similar to other miRNA genes, and unlike most ordinary genes, VGAM2051 precursor RNA does not encode a protein. A nucleotide sequence identical or highly similar to the nucleotide sequence of VGAM2051 precursor RNA is designated SEQ ID:2037, and is provided hereinbelow with reference to the sequence listing part. Nucleotide sequence SEQ ID:2037 is located at position 24505 relative to the genome of Ovine Adenovirus A.

VGAM2051 precursor RNA folds onto itself, forming VGAM2051 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2051 folded precursor RNA into VGAM2051 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM2051 RNA is designated SEQ ID:4762, and is provided hereinbelow with reference to the sequence listing part.

VGAM2051 host target gene, herein designated VGAM HOST TARGET GENE, encodes a corresponding messenger RNA, VGAM2051 host target RNA, herein designated VGAM HOST TARGET RNA. VGAM2051 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2051 RNA, herein designated VGAM RNA, binds complementarily to one or more host target binding sites located in untranslated regions of VGAM2051 host target RNA, herein designated VGAM HOST TARGET RNA. This complementary binding is due to the fact that the nucleotide sequence of VGAM2051 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2051 RNA, herein designated VGAM RNA, may have a different number of host target binding sites in untranslated regions of a VGAM2051 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2051 RNA, herein designated VGAM RNA, to host target binding sites on VGAM2051 host target RNA, herein designated VGAM HOST TARGET RNA, such as BINDING SITE I, BINDING SITE II and BINDING SITE III, inhibits translation of VGAM2051 host target RNA into VGAM2051 host target protein, herein designated VGAM HOST TARGET PROTEIN. VGAM host target protein is therefore outlined by a broken line.

It is appreciated that VGAM2051 host target gene, herein designated VGAM HOST TARGET GENE, in fact represents a plurality of VGAM2051 host target genes. The mRNA of each one of this plurality of VGAM2051 host target genes comprises one or more host target binding sites, each having a nucleotide sequence which is at least partly complementary to VGAM2051 RNA, herein designated VGAM RNA, and which when bound by VGAM2051 RNA causes inhibition of translation of respective one or more VGAM2051 host target proteins.

It is further appreciated by one skilled in the art that the mode of translational inhibition illustrated by FIG. 1 with specific reference to translational inhibition exerted by VGAM2051 gene, herein designated VGAM GENE, on one or more VGAM2051 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2051 is inhibition of expression of host target genes, as part of a novel viral mechanism of attacking a host. Accordingly, utilities of VGAM2051 include diagnosis, prevention and treatment of viral infection by Ovine Adenovirus A. Specific functions, and accordingly utilities, of VGAM2051 correlate with, and may be deduced from, the identity of the host target genes which VGAM2051 binds and inhibits, and the function of these host target genes, as elaborated hereinbelow.

Nucleotide sequences of the VGAM2051 precursor RNA, herein designated VGAM PRECURSOR RNA, and of the 'diced' VGAM2051 RNA, herein designated VGAM RNA, and a schematic representation of the secondary folding of VGAM2051 folded precursor RNA, herein designated VGAM FOLDED PRECURSOR RNA, of VGAM2051 are further described hereinbelow with reference to Table 1.

Nucleotide sequences of host target binding sites, such as BINDING SITE-I, BINDING SITE-II and BINDING SITE-III of FIG. 1, found on VGAM2051 host target RNA, and schematic representation of the complementarity of each of these host target binding sites to VGAM2051 RNA, herein designated VGAM RNA, are described hereinbelow with reference to Table 2.

As mentioned hereinabove with reference to FIG. 1, a function of VGAM2051 gene, herein designated VGAM is inhibition of expression of VGAM2051 target genes. It is appreciated that specific functions, and accordingly utilities, of VGAM2051 correlate with, and may be deduced from, the identity of the target genes which VGAM2051 binds and inhibits, and the function of these target genes, as elaborated hereinbelow.

Mitogen-activated Protein Kinase Kinase Kinase 14 (MAP3K14, Accession NM_003954) is a VGAM2051 host target gene. MAP3K14 BINDING SITE is HOST TARGET binding site found in the 3' untranslated region of mRNA encoded by MAP3K14, corresponding to a HOST TARGET binding site such as BINDING SITE I, BINDING SITE II or BINDING SITE III. Table 2 illustrates the complementarity of the nucleotide sequences of MAP3K14 BINDING SITE, designated SEQ ID:10089, to the nucleotide sequence of VGAM2051 RNA, herein designated VGAM RNA, also designated SEQ ID:4762.

A function of VGAM2051 is therefore inhibition of Mitogen-activated Protein Kinase Kinase Kinase 14 (MAP3K14, Accession NM_003954), a gene which is involved in the activation of nf-kappa-b and its transcriptional activity. induces the processing of nf-kappa-b 2/p100. could act in a receptor-selective manner (by similarity). Accordingly, utilities of VGAM2051 include diagnosis, prevention and treatment of diseases and clinical conditions associated with MAP3K14. The function of MAP3K14 and its association with various diseases and clinical conditions, has been established by previous studies, as described hereinabove with reference to VGAM55. Methionine Adenosyltransferase II, Alpha (MAT2A, Accession NM_005911) is another VGAM2051 host target gene. MAT2A BINDING SITE is HOST TARGET binding site found in the 3' untranslated region of mRNA encoded by MAT2A, corresponding to a HOST TARGET binding site such as BINDING SITE I, BINDING SITE II or BINDING SITE III. Table 2 illustrates the complementarity of the nucleotide sequences of MAT2A BINDING SITE, designated SEQ ID:12543, to the nucleotide sequence of VGAM2051 RNA, herein designated VGAM RNA, also designated SEQ ID:4762.

Another function of VGAM2051 is therefore inhibition of Methionine Adenosyltransferase II, Alpha (MAT2A, Accession NM_005911), a gene which catalyzes the biosynthesis of S-adenosylmethionine (AdoMet) from methionine and ATP. Accordingly, utilities of VGAM2051 include diagnosis, prevention and treatment of diseases and clinical conditions associated with MAT2A. The function of MAT2A has been established by previous studies. Methionine adenosyltransferase (EC 2.5.1.6) catalyzes the biosynthesis of S-adenosylmethionine (OMIM Ref. No. AdoMet) from methionine and ATP. AdoMet is the major methyl donor for many of the transmethylation reactions in the body. Chamberlin et al. (1996) noted that AdoMet also participates in the transsulfuration pathway and, after decarboxylation, serves as a propylamine group donor in the biosynthesis of polyamines. Three forms of MAT have been identified in mammalian tissues. MAT I and MAT III, which are encoded by the single-copy MAT1A gene (OMIM Ref. No. 250850), represent tetramers and dimers, respectively, formed from identical alpha-1 subunits and are synthesized primarily in the liver. MAT II, encoded by a separate gene, which was cloned by Horikawa and Tsukada (1992), is found in fetal liver (and to a lesser extent in adult liver) as well as in kidney, brain, testis, and lymphocytes. Horikawa and Tsukada (1992) showed that the 395-amino acid MAT II shares 84% amino acid similarity with the human liver MAT I/III protein. Mao et al. (1998) cloned the 5-prime flanking region of the MAT2A gene. They identified 2 major transcriptional start sites, one located within 10 nucleotides downstream and the other 158 nucleotides upstream from the TATA box. The MAT2A promoter is highly GC rich, especially in the first 300 bp. The promoter contains several potential SP1-, v-myb-, and GATA-binding sites, as well as potential binding sites for C/EBP, HSF2, c-myb, and STATx. Mao et al. (1998) showed that the MAT2A promoter can efficiently drive expression from a reporter gene in both Jurkat and 293 cells. The authors identified regions of the promoter that are important for cell-specific MAT2A expression. By in situ hybridization, De La Rosa et al. (1995) mapped the MATA2 gene to 2p11.2.

Full details of the abovementioned studies are described in the following publications, the disclosure of which are hereby incorporated by reference:

Chamberlin, M. E.; Ubagai, T.; Mudd, S. H.; Wilson, W. G.; Leonard, J. V.; Chou, J. Y.: Demyelination of the brain is associated with methionine adenosyltransferase I/III deficiency. J. Clin. Invest. 98:1021-1027, 1996; and De La Rosa, J.; Ostrowski, J.; Hryniewicz, M. M.; Kredich, N. M.; Kotb, M.; LeGros, H. L., Jr.; Valentine, M.; Geller, A. M.: Chromosomal localization and catalytic properties of the r.

Further studies establishing the function and utilities of MAT2A are found in John Hopkins OMIM database record ID 601468, and in sited publications numbered 907 and 6689-6690 listed in the bibliography section hereinbelow, which are also hereby incorporated by reference. N-ethylmaleimide-sensitive Factor (NSF, Accession XM_032173) is another VGAM2051 host target gene. NSF BINDING SITE is HOST TARGET binding site found in the 3' untranslated region of mRNA encoded by NSF, corresponding to a HOST TARGET binding site such as BINDING SITE I, BINDING SITE II or BINDING SITE III. Table 2 illustrates the complementarity of the nucleotide sequences of NSF BINDING SITE, designated SEQ ID:31587, to the nucleotide sequence of VGAM2051 RNA, herein designated VGAM RNA, also designated SEQ ID:4762.

Another function of VGAM2051 is therefore inhibition of N-ethylmaleimide-sensitive Factor (NSF, Accession XM_032173), a gene which catalyzes the fusion of transport vesicles within the golgi cisternae. Accordingly, utilities of VGAM2051 include diagnosis, prevention and treatment of diseases and clinical conditions associated with NSF. The function of NSF and its association with various diseases and clinical conditions, has been established by previous studies, as described hereinabove with reference to VGAM370. Pyrimidinergic Receptor P2Y, G-protein Coupled, 6 (P2RY6, Accession NM_004154) is another VGAM2051 host target gene. P2RY6 BINDING SITE is HOST TARGET binding site found in the 5' untranslated region of mRNA encoded by P2RY6, corresponding to a HOST TARGET binding site such as BINDING SITE I, BINDING SITE II or BINDING SITE III. Table 2 illustrates the complementarity of the nucleotide sequences of P2RY6 BINDING SITE, designated SEQ ID:10353, to the nucleotide sequence of VGAM2051 RNA, herein designated VGAM RNA, also designated SEQ ID:4762.

Another function of VGAM2051 is therefore inhibition of Pyrimidinergic Receptor P2Y, G-protein Coupled, 6 (P2RY6, Accession NM_004154), a gene which mediates cellular responses to nucleotides. Accordingly, utilities of VGAM2051 include diagnosis, prevention and treatment of diseases and clinical conditions associated with P2RY6. The function of P2RY6 and its association with various diseases and clinical conditions, has been established by previous studies, as described hereinabove with reference to VGAM445. Ring Finger Protein 26 (RNF26, Accession NM_032015) is another VGAM2051 host target gene. RNF26 BINDING SITE is HOST TARGET binding site found in the 3' untranslated region of mRNA encoded by RNF26, corresponding to a HOST TARGET binding site such as BINDING SITE I, BINDING SITE II or BINDING SITE III. Table 2 illustrates the complementarity of the nucleotide sequences of RNF26 BINDING SITE, designated SEQ ID:25727, to the nucleotide sequence of VGAM2051 RNA, herein designated VGAM RNA, also designated SEQ ID:4762.

Another function of VGAM2051 is therefore inhibition of Ring Finger Protein 26 (RNF26, Accession NM_032015). Accordingly, utilities of VGAM2051 include diagnosis, prevention and treatment of diseases and clinical conditions associated with RNF26. Carboxylesterase 2 (intestine, liver) (CES2, Accession NM_003869) is another VGAM2051 host target gene. CES2 BINDING SITE is HOST TARGET binding site found in the 5' untranslated region of mRNA encoded by CES2, corresponding to a HOST TARGET binding site such as BINDING SITE I, BINDING SITE II or BINDING SITE III. Table 2 illustrates the complementarity of the nucleotide sequences of CES2 BINDING SITE, designated SEQ ID:9956, to the nucleotide sequence of VGAM2051 RNA, herein designated VGAM RNA, also designated SEQ ID:4762.

Another function of VGAM2051 is therefore inhibition of Carboxylesterase 2 (intestine, liver) (CES2, Accession NM_003869). Accordingly, utilities of VGAM2051 include diagnosis, prevention and treatment of diseases and clinical conditions associated with CES2. FLJ14642 (Accession NM_032818) is another VGAM2051 host target gene. FLJ14642 BINDING SITE is HOST TARGET binding site found in the 3' untranslated region of mRNA encoded by FLJ14642, corresponding to a HOST TARGET binding site such as BINDING SITE I, BINDING SITE II or BINDING SITE III. Table 2 illustrates the complementarity of the nucleotide sequences of FLJ14642 BINDING SITE, designated SEQ ID:26594, to the nucleotide sequence of VGAM2051 RNA, herein designated VGAM RNA, also designated SEQ ID:4762.

Another function of VGAM2051 is therefore inhibition of FLJ14642 (Accession NM_032818). Accordingly, utilities of VGAM2051 include diagnosis, prevention and treatment of diseases and clinical conditions associated with FLJ14642. HSNOV1 (Accession NM_017515) is another VGAM2051 host target gene. HSNOV1 BINDING SITE is HOST TARGET binding site found in the 3' untranslated region of mRNA encoded by HSNOV1, corresponding to a HOST TARGET binding site such as BINDING SITE I, BINDING SITE II or BINDING SITE III. Table 2 illustrates the complementarity of the nucleotide sequences of HSNOV1 BINDING SITE, designated SEQ ID:18964, to the nucleotide sequence of VGAM2051 RNA, herein designated VGAM RNA, also designated SEQ ID:4762.

Another function of VGAM2051 is therefore inhibition of HSNOV1 (Accession NM_017515). Accordingly, utilities of VGAM2051 include diagnosis, prevention and treatment of diseases and clinical conditions associated with HSNOV1. KIAA0757 (Accession NM_006038) is another VGAM2051 host target gene. KIAA0757 BINDING SITE is HOST TARGET binding site found in the 3' untranslated region of mRNA encoded by KIAA0757, corresponding to a HOST TARGET binding site such as BINDING SITE I, BINDING SITE II or BINDING SITE III. Table 2 illustrates the complementarity of the nucleotide sequences of KIAA0757 BINDING SITE, designated SEQ ID:12670, to the nucleotide sequence of VGAM2051 RNA, herein designated VGAM RNA, also designated SEQ ID:4762.

Another function of VGAM2051 is therefore inhibition of KIAA0757 (Accession NM_006038). Accordingly, utilities of VGAM2051 include diagnosis, prevention and treatment of diseases and clinical conditions associated with KIAA0757. NDRG Family Member 4 (NDRG4, Accession NM_020465) is another VGAM2051 host target gene. NDRG4 BINDING SITE1 and NDRG4 BINDING SITE2 are HOST TARGET binding sites found in untranslated regions of mRNA encoded by NDRG4, corresponding to HOST TARGET binding sites such as BINDING SITE I, BINDING SITE II or BINDING SITE III. Table 2 illustrates the complementarity of the nucleotide sequences of NDRG4 BINDING SITE1 and NDRG4 BINDING SITE2, designated SEQ ID:21696 and SEQ ID:23211 respectively, to the nucleotide sequence of VGAM2051 RNA, herein designated VGAM RNA, also designated SEQ ID:4762.

Another function of VGAM2051 is therefore inhibition of NDRG Family Member 4 (NDRG4, Accession NM_020465). Accordingly, utilities of VGAM2051 include diagnosis, prevention and treatment of diseases and clinical conditions associated with NDRG4. LOC145497 (Accession XM_085150) is another VGAM2051 host target gene. LOC145497 BINDING SITE is HOST TARGET binding site found in the 5' untranslated region of mRNA encoded by LOC145497, corresponding to a HOST TARGET binding site such as BINDING SITE I, BINDING SITE II or BINDING SITE III. Table 2 illustrates the complementarity of the nucleotide sequences of LOC145497 BINDING SITE, designated SEQ ID:37872, to the nucleotide sequence of VGAM2051 RNA, herein designated VGAM RNA, also designated SEQ ID:4762.

Another function of VGAM2051 is therefore inhibition of LOC145497 (Accession XM_085150). Accordingly, utilities of VGAM2051 include diagnosis, prevention and treatment of diseases and clinical conditions associated with LOC145497. FIG. 1 further provides a conceptual description of a novel bioinformatically detected viral gene of the present invention, referred to here as Viral Genomic Address Messenger 2052 (VGAM2052) viral gene, which modulates expression of respective host target genes thereof, the function and utility of which host target genes is known in the art.

VGAM2052 is a novel bioinformatically detected regulatory, non protein coding, viral micro RNA (miRNA) gene. The method by which VGAM2052 was detected is described hereinabove with reference to FIGS. 1-8.

VGAM2052 gene, herein designated VGAM GENE, is a viral gene contained in the genome of Ovine Adenovirus A. VGAM2052 host target gene, herein designated VGAM HOST TARGET GENE, is a human gene contained in the human genome.

VGAM2052 gene encodes a VGAM2052 precursor RNA, herein designated VGAM PRECURSOR RNA. Similar to other miRNA genes, and unlike most ordinary genes, VGAM2052 precursor RNA does not encode a protein. A nucleotide sequence identical or highly similar to the nucleotide sequence of VGAM2052 precursor RNA is designated SEQ ID:2038, and is provided hereinbelow with reference to the sequence listing part. Nucleotide sequence SEQ ID:2038 is located at position 28963 relative to the genome of Ovine Adenovirus A.

VGAM2052 precursor RNA folds onto itself, forming VGAM2052 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2052 folded precursor RNA into VGAM2052 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM2052 RNA is designated SEQ ID:4763, and is provided hereinbelow with reference to the sequence listing part.

VGAM2052 host target gene, herein designated VGAM HOST TARGET GENE, encodes a corresponding messenger RNA, VGAM2052 host target RNA, herein designated VGAM HOST TARGET RNA. VGAM2052 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2052 RNA, herein designated VGAM RNA, binds complementarily to one or more host target binding sites located in untranslated regions of VGAM2052 host target RNA, herein designated VGAM HOST TARGET RNA. This complementary binding is due to the fact that the nucleotide sequence of VGAM2052 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2052 RNA, herein designated VGAM RNA, may have a different number of host target binding sites in untranslated regions of a VGAM2052 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2052 RNA, herein designated VGAM RNA, to host target binding sites on VGAM2052 host target RNA, herein designated VGAM HOST TARGET RNA, such as BINDING SITE I, BINDING SITE II and BINDING SITE III, inhibits translation of VGAM2052 host target RNA into VGAM2052 host target protein, herein designated VGAM HOST TARGET PROTEIN. VGAM host target protein is therefore outlined by a broken line.

It is appreciated that VGAM2052 host target gene, herein designated VGAM HOST TARGET GENE, in fact represents a plurality of VGAM2052 host target genes. The mRNA of each one of this plurality of VGAM2052 host target genes comprises one or more host target binding sites, each having a nucleotide sequence which is at least partly complementary to VGAM2052 RNA, herein designated VGAM RNA, and which when bound by VGAM2052 RNA causes inhibition of translation of respective one or more VGAM2052 host target proteins.

It is further appreciated by one skilled in the art that the mode of translational inhibition illustrated by FIG. 1 with specific reference to translational inhibition exerted by VGAM2052 gene, herein designated VGAM GENE, on one or more VGAM2052 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2052 is inhibition of expression of host target genes, as part of a novel viral mechanism of attacking a host. Accordingly, utilities of VGAM2052 include diagnosis, prevention and treatment of viral infection by Ovine Adenovirus A. Specific functions, and accordingly utilities, of VGAM2052 correlate with, and may be deduced from, the identity of the host target genes which VGAM2052 binds and inhibits, and the function of these host target genes, as elaborated hereinbelow.

Nucleotide sequences of the VGAM2052 precursor RNA, herein designated VGAM PRECURSOR RNA, and of the 'diced' VGAM2052 RNA, herein designated VGAM RNA, and a schematic representation of the secondary folding of VGAM2052 folded precursor RNA, herein designated VGAM FOLDED PRECURSOR RNA, of VGAM2052 are further described hereinbelow with reference to Table 1.

Nucleotide sequences of host target binding sites, such as BINDING SITE-I, BINDING SITE-II and BINDING SITE-III of FIG. 1, found on VGAM2052 host target RNA, and schematic representation of the complementarity of each of these host target binding sites to VGAM2052 RNA, herein designated VGAM RNA, are described hereinbelow with reference to Table 2.

As mentioned hereinabove with reference to FIG. 1, a function of VGAM2052 gene, herein designated VGAM is inhibition of expression of VGAM2052 target genes. It is appreciated that specific functions, and accordingly utilities, of VGAM2052 correlate with, and may be deduced from, the identity of the target genes which VGAM2052 binds and inhibits, and the function of these target genes, as elaborated hereinbelow.

Adaptor-related Protein Complex 2, Beta 1 Subunit (AP2B1, Accession NM_001282) is a VGAM2052 host target gene. AP2B1 BINDING SITE is HOST TARGET binding site found in the 5' untranslated region of mRNA encoded by AP2B1, corresponding to a HOST TARGET binding site such as BINDING SITE I, BINDING SITE II or BINDING SITE III. Table 2 illustrates the complementarity of the nucleotide sequences of AP2B1 BINDING SITE, designated SEQ ID:6951, to the nucleotide sequence of VGAM2052 RNA, herein designated VGAM RNA, also designated SEQ ID:4763.

A function of VGAM2052 is therefore inhibition of Adaptor-related Protein Complex 2, Beta 1 Subunit (AP2B1, Accession NM_001282), a gene which links clathrin to receptors in coated vesicles. Accordingly, utilities of VGAM2052 include diagnosis, prevention and treatment of diseases and clinical conditions associated with AP2B1. The function of AP2B1 and its association with various diseases and clinical conditions, has been established by previous studies, as described hereinabove with reference to VGAM1126. Cadherin 1, Type 1, E-cadherin (epithelial) (CDH1, Accession NM_004360) is another VGAM2052 host target gene. CDH1 BINDING SITE is HOST TARGET binding site found in the 3' untranslated region of mRNA encoded by CDH1, corresponding to a HOST TARGET binding site such as BINDING SITE I, BINDING SITE II or BINDING SITE III. Table 2 illustrates the complementarity of the nucleotide sequences of CDH1 BINDING SITE, designated SEQ ID:10565, to the nucleotide sequence of VGAM2052 RNA, herein designated VGAM RNA, also designated SEQ ID:4763.

Another function of VGAM2052 is therefore inhibition of Cadherin 1, Type 1, E-cadherin (epithelial) (CDH1, Accession NM_004360). Accordingly, utilities of VGAM2052 include diagnosis, prevention and treatment of diseases and clinical conditions associated with CDH1. Decorin (DCN, Accession NM_001920) is another VGAM2052 host target gene. DCN BINDING SITE is HOST TARGET binding site found in the 5' untranslated region of mRNA encoded by DCN, corresponding to a HOST TARGET binding site such as BINDING SITE I, BINDING SITE II or BINDING SITE III. Table 2 illustrates the complementarity of the nucleotide sequences of DCN BINDING SITE, designated SEQ ID:7635, to the nucleotide sequence of VGAM2052 RNA, herein designated VGAM RNA, also designated SEQ ID:4763.

Another function of VGAM2052 is therefore inhibition of Decorin (DCN, Accession NM_001920), a gene which may mediate in epithelial/mesenchymal interactions. Accordingly, utilities of VGAM2052 include diagnosis, prevention and treatment of diseases and clinical conditions associated with DCN. The function of DCN and its association with various diseases and clinical conditions, has been established by previous studies, as described hereinabove with reference to VGAM1326. High Mobility Group AT-hook 2 (HMGA2, Accession NM_003483) is another VGAM2052 host target gene. HMGA2 BINDING SITE is HOST TARGET binding site found in the 3' untranslated region of mRNA encoded by HMGA2, corresponding to a HOST TARGET binding site such as BINDING SITE I, BINDING SITE II or BINDING SITE III. Table 2 illustrates the complementarity of the nucleotide sequences of HMGA2 BINDING SITE, designated SEQ ID:9571, to the nucleotide sequence of VGAM2052 RNA, herein designated VGAM RNA, also designated SEQ ID:4763.

Another function of VGAM2052 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM2052 include diagnosis, prevention and treatment of diseases and clinical conditions associated with HMGA2. The function of HMGA2 and its association with various diseases and clinical conditions, has been established by previous studies, as described hereinabove with reference to VGAM552. Interferon (alpha, beta and omega) Receptor 2 (IFNAR2, Accession NM_000874) is another VGAM2052 host target gene. IFNAR2 BINDING SITE is HOST TARGET binding site found in the 3' untranslated region of mRNA encoded by IFNAR2, corresponding to a HOST TARGET binding site such as BINDING SITE I, BINDING SITE II or BINDING SITE III. Table 2 illustrates the complementarity of the nucleotide sequences of IFNAR2 BINDING SITE, designated SEQ ID:6553, to the nucleotide sequence of VGAM2052 RNA, herein designated VGAM RNA, also designated SEQ ID:4763.

Another function of VGAM2052 is therefore inhibition of Interferon (alpha, beta and omega) Receptor 2 (IFNAR2, Accession NM_000874), a gene which is a receptor for interferons alpha and beta. Accordingly, utilities of VGAM2052 include diagnosis, prevention and treatment of diseases and clinical conditions associated with IFNAR2. The function of IFNAR2 and its association with various diseases and clinical conditions, has been established by previous studies, as described hereinabove with reference to VGAM487. Integrin, Beta-like 1 (with EGF-like repeat domains) (ITGBL1, Accession NM_004791) is another VGAM2052 host target gene. ITGBL1 BINDING SITE is HOST TARGET binding site found in the 5' untranslated region of mRNA encoded by ITGBL1, corresponding to a HOST TARGET binding site such as BINDING SITE I, BINDING SITE II or BINDING SITE III. Table 2 illustrates the complementarity of the nucleotide sequences of ITGBL1 BINDING SITE, designated SEQ ID:11200, to the nucleotide sequence of VGAM2052 RNA, herein designated VGAM RNA, also designated SEQ ID:4763.

Another function of VGAM2052 is therefore inhibition of Integrin, Beta-like 1 (with EGF-like repeat domains) (ITGBL1, Accession NM_004791). Accordingly, utilities of VGAM2052 include diagnosis, prevention and treatment of diseases and clinical conditions associated with ITGBL1. MLL Sep.in-like Fusion (MSF, Accession XM_113892) is another VGAM2052 host target gene. MSF BINDING SITE is HOST TARGET binding site found in the 3" untranslated region of mRNA encoded by MSF, corresponding to a HOST TARGET binding site such as BINDING SITE I, BINDING SITE II or BINDING SITE III. Table 2 illustrates the complementarity of the nucleotide sequences of MSF BINDING SITE, designated SEQ ID:42524, to the nucleotide sequence of VGAM2052 RNA, herein designated VGAM RNA, also designated SEQ ID:4763.

Another function of VGAM2052 is therefore inhibition of MLL Sep.in-like Fusion (MSF, Accession XM_113892), a gene which plays a role in the cell cycle. Accordingly, utilities of VGAM2052 include diagnosis, prevention and treatment of diseases and clinical conditions associated with MSF. The function of MSF and its association with various diseases and clinical conditions, has been established by previous studies, as described hereinabove with reference to VGAM514. Protocadherin Alpha 9 (PCDHA9, Accession NM_014005) is another VGAM2052 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:15212, to the nucleotide sequence of VGAM2052 RNA, herein designated VGAM RNA, also designated SEQ ID:4763.

Another function of VGAM2052 is therefore inhibition of Protocadherin Alpha 9 (PCDHA9, Accession NM_014005), a gene which is a calcium-dependent cell-adhesion protein. Accordingly, utilities of VGAM2052 include diagnosis, prevention and treatment of diseases and clinical conditions associated with PCDHA9. The function of PCDHA9 and its association with various diseases and clinical conditions, has been established by previous studies, as described hereinabove with reference to VGAM71. Protease, Serine, 16 (thymus) (PRSS16, Accession NM_005865) is another VGAM2052 host target gene. PRSS16 BINDING SITE is HOST TARGET binding site found in the 3' untranslated region of mRNA encoded by PRSS16, corresponding to a HOST TARGET binding site such as BINDING SITE I, BINDING SITE II or BINDING SITE III. Table 2 illustrates the complementarity of the nucleotide sequences of PRSS16 BINDING SITE, designated SEQ ID:12481, to the nucleotide sequence of VGAM2052 RNA, herein designated VGAM RNA, also designated SEQ ID:4763.

Another function of VGAM2052 is therefore inhibition of Protease, Serine, 16 (thymus) (PRSS16, Accession NM_005865). Accordingly, utilities of VGAM2052 include diagnosis, prevention and treatment of diseases and clinical conditions associated with PRSS16. Protein Tyrosine Phosphatase, Receptor Type, F (PTPRF, Accession NM_130440) is another VGAM2052 host target gene. PTPRF BINDING SITE1 and PTPRF BINDING SITE2 are HOST TARGET binding sites found in untranslated regions of mRNA encoded by PTPRF, corresponding to HOST TARGET binding sites such as BINDING SITE I, BINDING SITE II or BINDING SITE III. Table 2 illustrates the complementarity of the nucleotide sequences of PTPRF BINDING SITE1 and PTPRF BINDING SITE2, designated SEQ ID:28197 and SEQ ID:8723 respectively, to the nucleotide sequence of VGAM2052 RNA, herein designated VGAM RNA, also designated SEQ ID:4763.

Another function of VGAM2052 is therefore inhibition of Protein Tyrosine Phosphatase, Receptor Type, F (PTPRF, Accession NM_130440), a gene which negatively regulates the insulin signaling pathway. Accordingly, utilities of VGAM2052 include diagnosis, prevention and treatment of diseases and clinical conditions associated with PTPRF. The function of PTPRF and its association with various diseases and clinical conditions, has been established by previous studies, as described hereinabove with reference to VGAM1105. SON DNA Binding Protein (SON, Accession NM_138926) is another VGAM2052 host target gene. SON BINDING SITE1 through SON BINDING SITE3 are HOST TARGET binding sites found in untranslated regions of mRNA encoded by SON, corresponding to HOST TARGET binding sites such as BINDING SITE I, BINDING SITE II or BINDING SITE III. Table 2 illustrates the complementarity of the nucleotide sequences of SON BINDING SITE1 through SON BINDING SITE3, designated SEQ ID:29042, SEQ ID:29046 and SEQ ID:27746 respectively, to the nucleotide sequence of VGAM2052 RNA, herein designated VGAM RNA, also designated SEQ ID:4763.

Another function of VGAM2052 is therefore inhibition of SON DNA Binding Protein (SON, Accession NM_138926). Accordingly, utilities of VGAM2052 include diagnosis, prevention and treatment of diseases and clinical conditions associated with SON. TAF7-like RNA Polymerase II, TATA Box Binding Protein (TBP)-associated Factor, 50 kDa (TAF7L, Accession NM_024885) is another VGAM2052 host target gene. TAF7L BINDING SITE is HOST TARGET binding site found in the 3' untranslated region of mRNA encoded by TAF7L, corresponding to a HOST TARGET binding site such as BINDING SITE I, BINDING SITE II or BINDING SITE III. Table 2 illustrates the complementarity of the nucleotide sequences of TAF7L BINDING SITE, designated SEQ ID:24338, to the nucleotide sequence of VGAM2052 RNA, herein designated VGAM RNA, also designated SEQ ID:4763.

Another function of VGAM2052 is therefore inhibition of TAF7-like RNA Polymerase II, TATA Box Binding Protein (TBP)-associated Factor, 50 kDa (TAF7L, Accession NM_024885). Accordingly, utilities of VGAM2052 include diagnosis, prevention and treatment of diseases and clinical conditions associated with TAF7L. Transcription Factor AP-4 (activating enhancer binding protein 4) (TFAP4, Accession NM_003223) is another VGAM2052 host target gene. TFAP4 BINDING SITE is HOST TARGET binding site found in the 3' untranslated region of mRNA encoded by TFAP4, corresponding to a HOST TARGET binding site such as BINDING SITE I, BINDING SITE II or BINDING SITE III. Table 2 illustrates the complementarity of the nucleotide sequences of TFAP4 BINDING SITE, designated SEQ ID:9226, to the nucleotide sequence of VGAM2052 RNA, herein designated VGAM RNA, also designated SEQ ID:4763.

Another function of VGAM2052 is therefore inhibition of Transcription Factor AP-4 (activating enhancer binding protein 4) (TFAP4, Accession NM_003223), a gene which activates both viral and cellular genes by binding to the symmetrical dna sequence 5'-cagctg-3'. Accordingly, utilities of VGAM2052 include diagnosis, prevention and treatment of diseases and clinical conditions associated with TFAP4. The function of TFAP4 and its association with various diseases and clinical conditions, has been established by previous studies, as described hereinabove with reference to VGAM175. WWP2 (Accession XM_028151) is another VGAM2052 host target gene. WWP2 BINDING SITE is HOST TARGET binding site found in the 3' untranslated region of mRNA encoded by WWP2, corresponding to a HOST TARGET binding site such as BINDING SITE I, BINDING SITE II or BINDING SITE III. Table 2 illustrates the complementarity of the nucleotide sequences of WWP2 BINDING SITE, designated SEQ ID:30624, to the nucleotide sequence of VGAM2052 RNA, herein designated VGAM RNA, also designated SEQ ID:4763.

Another function of VGAM2052 is therefore inhibition of WWP2 (Accession XM_028151), a gene which exhibits ubiquitin-protein ligase activity and contains WW and HECT domains. Accordingly, utilities of VGAM2052 include diagnosis, prevention and treatment of diseases and clinical conditions associated with WWP2. The function of WWP2 and its association with various diseases and clinical conditions, has been established by previous studies, as described hereinabove with reference to VGAM1959. Apolipoprotein A-V (APOA5, Accession NM_052968) is another VGAM2052 host target gene. APOA5 BINDING SITE is HOST TARGET binding site found in the 3' untranslated region of mRNA encoded by APOA5, corresponding to a HOST TARGET binding site such as BINDING SITE I, BINDING SITE II or BINDING SITE III. Table 2 illustrates the complementarity of the nucleotide sequences of APOA5 BINDING SITE, designated SEQ ID:27538, to the nucleotide sequence of VGAM2052 RNA, herein designated VGAM RNA, also designated SEQ ID:4763.

Another function of VGAM2052 is therefore inhibition of Apolipoprotein A-V (APOA5, Accession NM_052968). Accordingly, utilities of VGAM2052 include diagnosis, prevention and treatment of diseases and clinical conditions associated with APOA5. Destrin (actin depolymerizing factor) (DSTN, Accession NM_006870) is another VGAM2052 host target gene. DSTN BINDING SITE is HOST TARGET binding site found in the 3' untranslated region of mRNA encoded by DSTN, corresponding to a HOST TARGET binding site such as BINDING SITE I, BINDING SITE II or BINDING SITE III. Table 2 illustrates the complementarity of the nucleotide sequences of DSTN BINDING SITE, designated SEQ ID:13741, to the nucleotide sequence of VGAM2052 RNA, herein designated VGAM RNA, also designated SEQ ID:4763.

Another function of VGAM2052 is therefore inhibition of Destrin (actin depolymerizing factor) (DSTN, Accession NM_006870). Accordingly, utilities of VGAM2052 include diagnosis, prevention and treatment of diseases and clinical conditions associated with DSTN. FLJ10081 (Accession NM_017991) is another VGAM2052 host target gene. FLJ10081 BINDING SITE is HOST TARGET binding site found in the 3' untranslated region of mRNA encoded by FLJ10081, corresponding to a HOST TARGET binding site such as BINDING SITE I, BINDING SITE II or BINDING SITE III. Table 2 illustrates the complementarity of the nucleotide sequences of FLJ10081 BINDING SITE, designated SEQ ID:19722, to the nucleotide sequence of VGAM2052 RNA, herein designated VGAM RNA, also designated SEQ ID:4763.

Another function of VGAM2052 is therefore inhibition of FLJ10081 (Accession NM_017991). Accordingly, utilities of VGAM2052 include diagnosis, prevention and treatment of diseases and clinical conditions associated with FLJ10081. FLJ11726 (Accession NM_024971) is another VGAM2052 host target gene. FLJ11726 BINDING SITE is HOST TARGET binding site found in the 3' untranslated region of mRNA encoded by FLJ11726, corresponding to a HOST TARGET binding site such as BINDING SITE I, BINDING SITE II or BINDING SITE III. Table 2 illustrates the complementarity of the nucleotide sequences of FLJ11726 BINDING SITE, designated SEQ ID:24525, to the nucleotide sequence of VGAM2052 RNA, herein designated VGAM RNA, also designated SEQ ID:4763.

Another function of VGAM2052 is therefore inhibition of FLJ11726 (Accession NM_024971). Accordingly, utilities of VGAM2052 include diagnosis, prevention and treatment of diseases and clinical conditions associated with FLJ11726. FLJ14327 (Accession NM_024912) is another VGAM2052 host target gene. FLJ14327 BINDING SITE is HOST TARGET binding site found in the 3' untranslated region of mRNA encoded by FLJ14327, corresponding to a HOST TARGET binding site such as BINDING SITE I, BINDING SITE II or BINDING SITE III. Table 2 illustrates the complementarity of the nucleotide sequences of FLJ14327 BINDING SITE, designated SEQ ID:24423, to the nucleotide sequence of VGAM2052 RNA, herein designated VGAM RNA, also designated SEQ ID:4763.

Another function of VGAM2052 is therefore inhibition of FLJ14327 (Accession NM_024912). Accordingly, utilities of VGAM2052 include diagnosis, prevention and treatment of diseases and clinical conditions associated with FLJ14327. ICK (Accession NM_014920) is another VGAM2052 host target gene. ICK BINDING SITE is HOST TARGET binding site found in the 3' untranslated region of mRNA encoded by ICK, corresponding to a HOST TARGET binding site such as BINDING SITE I, BINDING SITE II or BINDING SITE III. Table 2 illustrates the complementarity of the nucleotide sequences of ICK BINDING SITE, designated SEQ ID:17194, to the nucleotide sequence of VGAM2052 RNA, herein designated VGAM RNA, also designated SEQ ID:4763.

Another function of VGAM2052 is therefore inhibition of ICK (Accession NM_014920). Accordingly, utilities of VGAM2052 include diagnosis, prevention and treatment of diseases and clinical conditions associated with ICK. KIAA0532 (Accession XM_047659) is another VGAM2052 host target gene. KIAA0532 BINDING SITE is HOST TARGET binding site found in the 3" untranslated region of mRNA encoded by KIAA0532, corresponding to a HOST TARGET binding site such as BINDING SITE I, BINDING SITE II or BINDING SITE III. Table 2 illustrates the complementarity of the nucleotide sequences of KIAA0532 BINDING SITE, designated SEQ ID:35022, to the nucleotide sequence of VGAM2052 RNA, herein designated VGAM RNA, also designated SEQ ID:4763.

Another function of VGAM2052 is therefore inhibition of KIAA0532 (Accession XM_047659). Accordingly, utilities of VGAM2052 include diagnosis, prevention and treatment of diseases and clinical conditions associated with KIAA0532. KIAA0682 (Accession NM_014852) is another VGAM2052 host target gene. KIAA0682 BINDING SITE is HOST TARGET binding site found in the 3' untranslated region of mRNA encoded by KIAA0682, corresponding to a HOST TARGET binding site such as BINDING SITE I, BINDING SITE II or BINDING SITE III. Table 2 illustrates the complementarity of the nucleotide sequences of KIAA0682 BINDING SITE, designated SEQ ID:16901, to the nucleotide sequence of VGAM2052 RNA, herein designated VGAM RNA, also designated SEQ ID:4763.

Another function of VGAM2052 is therefore inhibition of KIAA0682 (Accession NM_014852). Accordingly, utilities of VGAM2052 include diagnosis, prevention and treatment of diseases and clinical conditions associated with KIAA0682. KIAA0766 (Accession NM_014805) is another VGAM2052 host target gene. KIAA0766 BINDING SITE is HOST TARGET binding site found in the 3' untranslated region of mRNA encoded by KIAA0766, corresponding to a HOST TARGET binding site such as BINDING SITE I, BINDING SITE II or BINDING SITE III. Table 2 illustrates the complementarity of the nucleotide sequences of KIAA0766 BINDING SITE, designated SEQ ID:16744, to the nucleotide sequence of VGAM2052 RNA, herein designated VGAM RNA, also designated SEQ ID:4763.

Another function of VGAM2052 is therefore inhibition of KIAA0766 (Accession NM_014805). Accordingly, utilities of VGAM2052 include diagnosis, prevention and treatment of diseases and clinical conditions associated with KIAA0766. KIAA1045 (Accession XM_048592) is another VGAM2052 host target gene. KIAA1045 BINDING SITE is HOST TARGET binding site found in the 3' untranslated region of mRNA encoded by KIAA1045, corresponding to a HOST TARGET binding site such as BINDING SITE I, BINDING SITE II or BINDING SITE III. Table 2 illustrates the complementarity of the nucleotide sequences of KIAA1045 BINDING SITE, designated SEQ ID:35199, to the nucleotide sequence of VGAM2052 RNA, herein designated VGAM RNA, also designated SEQ ID:4763.

Another function of VGAM2052 is therefore inhibition of KIAA1045 (Accession XM_048592). Accordingly, utilities of VGAM2052 include diagnosis, prevention and treatment of diseases and clinical conditions associated with KIAA1045. KIAA1184 (Accession NM_022572) is another VGAM2052 host target gene. KIAA1184 BINDING SITE is HOST TARGET binding site found in the 3' untranslated region of mRNA encoded by KIAA1184, corresponding to a HOST TARGET binding site such as BINDING SITE I, BINDING SITE II or BINDING SITE III. Table 2 illustrates the complementarity of the nucleotide sequences of KIAA1184 BINDING SITE, designated SEQ ID:22894, to the nucleotide sequence of VGAM2052 RNA, herein designated VGAM RNA, also designated SEQ ID:4763.

Another function of VGAM2052 is therefore inhibition of KIAA1184 (Accession NM_022572). Accordingly, utilities of VGAM2052 include diagnosis, prevention and treatment of diseases and clinical conditions associated with KIAA1184. KIAA1579 (Accession NM_018211) is another VGAM2052 host target gene. KIAA1579 BINDING SITE is HOST TARGET binding site found in the 3' untranslated region of mRNA encoded by KIAA1579, corresponding to a HOST TARGET binding site such as BINDING SITE I, BINDING SITE II or BINDING SITE III. Table 2 illustrates the complementarity of the nucleotide sequences of KIAA1579 BINDING SITE, designated SEQ ID:20119, to the nucleotide sequence of VGAM2052 RNA, herein designated VGAM RNA, also designated SEQ ID:4763.

Another function of VGAM2052 is therefore inhibition of KIAA1579 (Accession NM_018211). Accordingly, utilities of VGAM2052 include diagnosis, prevention and treatment of diseases and clinical conditions associated with KIAA1579. KIAA1908 (Accession XM_055834) is another VGAM2052 host target gene. KIAA1908 BINDING SITE1 and KIAA1908 BINDING SITE2 are HOST TARGET binding sites found in untranslated regions of mRNA encoded by KIAA1908, corresponding to HOST TARGET binding sites such as BINDING SITE I, BINDING SITE II or BINDING SITE III. Table 2 illustrates the complementarity of the nucleotide sequences of KIAA1908 BINDING SITE1 and KIAA1908 BINDING SITE2, designated SEQ ID:36328 and SEQ ID:36338 respectively, to the nucleotide sequence of VGAM2052 RNA, herein designated VGAM RNA, also designated SEQ ID:4763.

Another function of VGAM2052 is therefore inhibition of KIAA1908 (Accession XM_055834). Accordingly, utilities of VGAM2052 include diagnosis, prevention and treatment of diseases and clinical conditions associated with KIAA1908. Protein Phosphatase 1, Regulatory (inhibitor) Subunit 16B (PPP1R16B, Accession XM_028840) is another VGAM2052 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30776, to the nucleotide sequence of VGAM2052 RNA, herein designated VGAM RNA, also designated SEQ ID:4763.

Another function of VGAM2052 is therefore inhibition of Protein Phosphatase 1, Regulatory (inhibitor) Subunit 16B (PPP1R16B, Accession XM_028840). Accordingly, utilities of VGAM2052 include diagnosis, prevention and treatment of diseases and clinical conditions associated with PPP1R16B. Syndecan Binding Protein (syntenin) (SDCBP, Accession NM_005625) is another VGAM2052 host target gene. SDCBP BINDING SITE is HOST TARGET binding site found in the 3' untranslated region of mRNA encoded by SDCBP, corresponding to a HOST TARGET binding site such as BINDING SITE I, BINDING SITE II or BINDING SITE III. Table 2 illustrates the complementarity of the nucleotide sequences of SDCBP BINDING SITE, designated SEQ ID:12135, to the nucleotide sequence of VGAM2052 RNA, herein designated VGAM RNA, also designated SEQ ID:4763.

Another function of VGAM2052 is therefore inhibition of Syndecan Binding Protein (syntenin) (SDCBP, Accession NM_005625). Accordingly, utilities of VGAM2052 include diagnosis, prevention and treatment of diseases and clinical conditions associated with SDCBP. SE70-2 (Accession NM_022118) is another VGAM2052 host target gene. SE70-2 BINDING SITE is HOST TARGET binding site found in the 5' untranslated region of mRNA encoded by SE70-2, corresponding to a HOST TARGET binding site such as BINDING SITE I, BINDING SITE II or BINDING SITE III. Table 2 illustrates the complementarity of the nucleotide sequences of SE70-2 BINDING SITE, designated SEQ ID:22663, to the nucleotide sequence of VGAM2052 RNA, herein designated VGAM RNA, also designated SEQ ID:4763.

Another function of VGAM2052 is therefore inhibition of SE70-2 (Accession NM_022118). Accordingly, utilities of VGAM2052 include diagnosis, prevention and treatment of diseases and clinical conditions associated with SE70-2. LOC112476 (Accession NM_145239) is another VGAM2052 host target gene. LOC112476 BINDING SITE is HOST TARGET binding site found in the 3' untranslated region of mRNA encoded by LOC112476, corresponding to a HOST TARGET binding site such as BINDING SITE I, BINDING SITE II or BINDING SITE III. Table 2 illustrates the complementarity of the nucleotide sequences of LOC112476 BINDING SITE, designated SEQ ID:29752, to the nucleotide sequence of VGAM2052 RNA, herein designated VGAM RNA, also designated SEQ ID:4763.

Another function of VGAM2052 is therefore inhibition of LOC112476 (Accession NM_145239). Accordingly, utilities of VGAM2052 include diagnosis, prevention and treatment of diseases and clinical conditions associated with LOC112476. LOC115399 (Accession XM_055874) is another VGAM2052 host target gene. LOC115399 BINDING SITE is HOST TARGET binding site found in the 5' untranslated region of mRNA encoded by LOC115399, corresponding to a HOST TARGET binding site such as BINDING SITE I, BINDING SITE II or BINDING SITE III. Table 2 illustrates the complementarity of the nucleotide sequences of LOC115399 BINDING SITE, designated SEQ ID:36345, to the nucleotide sequence of VGAM2052 RNA, herein designated VGAM RNA, also designated SEQ ID:4763.

Another function of VGAM2052 is therefore inhibition of LOC115399 (Accession XM_055874). Accordingly, utilities of VGAM2052 include diagnosis, prevention and treatment of diseases and clinical conditions associated with LOC115399. LOC130595 (Accession XM_065793) is another VGAM2052 host target gene. LOC130595 BINDING SITE is HOST TARGET binding site found in the 5' untranslated region of mRNA encoded by LOC130595, corresponding to a HOST TARGET binding site such as BINDING SITE I, BINDING SITE II or BINDING SITE III. Table 2 illustrates the complementarity of the nucleotide sequences of LOC130595 BINDING SITE, designated SEQ ID:37299, to the nucleotide sequence of VGAM2052 RNA, herein designated VGAM RNA, also designated SEQ ID:4763.

Another function of VGAM2052 is therefore inhibition of LOC130595 (Accession XM_065793). Accordingly, utilities of VGAM2052 include diagnosis, prevention and treatment of diseases and clinical conditions associated with LOC130595. LOC134266 (Accession XM_059701) is another VGAM2052 host target gene. LOC134266 BINDING SITE is HOST TARGET binding site found in the 3' untranslated region of mRNA encoded by LOC134266, corresponding to a HOST TARGET binding site such as BINDING SITE I, BINDING SITE II or BINDING SITE III. Table 2 illustrates the complementarity of the nucleotide sequences of LOC134266 BINDING SITE, designated SEQ ID:37071, to the nucleotide sequence of VGAM2052 RNA, herein designated VGAM RNA, also designated SEQ ID:4763.

Another function of VGAM2052 is therefore inhibition of LOC134266 (Accession XM_059701). Accordingly, utilities of VGAM2052 include diagnosis, prevention and treatment of diseases and clinical conditions associated with LOC134266. LOC149103 (Accession XM_086434) is another VGAM2052 host target gene. LOC149103 BINDING SITE is HOST TARGET binding site found in the 3' untranslated region of mRNA encoded by LOC149103, corresponding to a HOST TARGET binding site such as BINDING SITE I, BINDING SITE II or BINDING SITE III. Table 2 illustrates the complementarity of the nucleotide sequences of LOC149103 BINDING SITE, designated SEQ ID:38653, to the nucleotide sequence of VGAM2052 RNA, herein designated VGAM RNA, also designated SEQ ID:4763.

Another function of VGAM2052 is therefore inhibition of LOC149103 (Accession XM_086434). Accordingly, utilities of VGAM2052 include diagnosis, prevention and treatment of diseases and clinical conditions associated with LOC149103. LOC150577 (Accession XM_097918) is another VGAM2052 host target gene. LOC150577 BINDING SITE is HOST TARGET binding site found in the 3' untranslated region of mRNA encoded by LOC150577, corresponding to a HOST TARGET binding site such as BINDING SITE I, BINDING SITE II or BINDING SITE III. Table 2 illustrates the complementarity of the nucleotide sequences of LOC150577 BINDING SITE, designated SEQ ID:41226, to the nucleotide sequence of VGAM2052 RNA, herein designated VGAM RNA, also designated SEQ ID:4763.

Another function of VGAM2052 is therefore inhibition of LOC150577 (Accession XM_097918). Accordingly, utilities of VGAM2052 include diagnosis, prevention and treatment of diseases and clinical conditions associated with LOC150577. LOC158572 (Accession XM_088608) is another VGAM2052 host target gene. LOC158572 BINDING SITE is HOST TARGET binding site found in the 3' untranslated region of mRNA encoded by LOC158572, corresponding to a HOST TARGET binding site such as BINDING SITE I, BINDING SITE II or BINDING SITE III. Table 2 illustrates the complementarity of the nucleotide sequences of LOC158572 BINDING SITE, designated SEQ ID:39872, to the nucleotide sequence of VGAM2052 RNA, herein designated VGAM RNA, also designated SEQ ID:4763.

Another function of VGAM2052 is therefore inhibition of LOC158572 (Accession XM_088608). Accordingly, utilities of VGAM2052 include diagnosis, prevention and treatment of diseases and clinical conditions associated with LOC158572. LOC199704 (Accession XM_113994) is another VGAM2052 host target gene. LOC199704 BINDING SITE is HOST TARGET binding site found in the 3' untranslated region of mRNA encoded by LOC199704, corresponding to a HOST TARGET binding site such as BINDING SITE I, BINDING SITE II or BINDING SITE III. Table 2 illustrates the complementarity of the nucleotide sequences of LOC199704 BINDING SITE, designated SEQ ID:42603, to the nucleotide sequence of VGAM2052 RNA, herein designated VGAM RNA, also designated SEQ ID:4763.

Another function of VGAM2052 is therefore inhibition of LOC199704 (Accession XM_113994). Accordingly, utilities of VGAM2052 include diagnosis, prevention and treatment of diseases and clinical conditions associated with LOC199704. LOC220573 (Accession XM_045569) is another VGAM2052 host target gene. LOC220573 BINDING SITE is HOST TARGET binding site found in the 3' untranslated region of mRNA encoded by LOC220573, corresponding to a HOST TARGET binding site such as BINDING SITE I, BINDING SITE II or BINDING SITE III. Table 2 illustrates the complementarity of the nucleotide sequences of LOC220573 BINDING SITE, designated SEQ ID:34483, to the nucleotide sequence of VGAM2052 RNA, herein designated VGAM RNA, also designated SEQ ID:4763.

Another function of VGAM2052 is therefore inhibition of LOC220573 (Accession XM_045569). Accordingly, utilities of VGAM2052 include diagnosis, prevention and treatment of diseases and clinical conditions associated with LOC220573. LOC255098 (Accession XM_170912) is another VGAM2052 host target gene. LOC255098 BINDING SITE is HOST TARGET binding site found in the 5' untranslated region of mRNA encoded by LOC255098, corresponding to a HOST TARGET binding site such as BINDING SITE I, BINDING SITE II or BINDING SITE III. Table 2 illustrates the complementarity of the nucleotide sequences of LOC255098 BINDING SITE, designated SEQ ID:45690, to the nucleotide sequence of VGAM2052 RNA, herein designated VGAM RNA, also designated SEQ ID:4763.

Another function of VGAM2052 is therefore inhibition of LOC255098 (Accession XM_170912). Accordingly, utilities of VGAM2052 include diagnosis, prevention and treatment of diseases and clinical conditions associated with LOC255098. LOC257000 (Accession XM_172999) is another VGAM2052 host target gene. LOC257000 BINDING SITE is HOST TARGET binding site found in the 3' untranslated region of mRNA encoded by LOC257000, corresponding to a HOST TARGET binding site such as BINDING SITE I, BINDING SITE II or BINDING SITE III. Table 2 illustrates the complementarity of the nucleotide sequences of LOC257000 BINDING SITE, designated SEQ ID:46272, to the nucleotide sequence of VGAM2052 RNA, herein designated VGAM RNA, also designated SEQ ID:4763.

Another function of VGAM2052 is therefore inhibition of LOC257000 (Accession XM_172999). Accordingly, utilities of VGAM2052 include diagnosis, prevention and treatment of diseases and clinical conditions associated with LOC257000. LOC257465 (Accession XM_088384) is another VGAM2052 host target gene. LOC257465 BINDING SITE is HOST TARGET binding site found in the 3' untranslated region of mRNA encoded by LOC257465, corresponding to a HOST TARGET binding site such as BINDING SITE I, BINDING SITE II or BINDING SITE III. Table 2 illustrates the complementarity of the nucleotide sequences of LOC257465 BINDING SITE, designated SEQ ID:39665, to the nucleotide sequence of VGAM2052 RNA, herein designated VGAM RNA, also designated SEQ ID:4763.

Another function of VGAM2052 is therefore inhibition of LOC257465 (Accession XM_088384). Accordingly, utilities of VGAM2052 include diagnosis, prevention and treatment of diseases and clinical conditions associated with LOC257465. LOC57105 (Accession NM_020377) is another VGAM2052 host target gene. LOC57105 BINDING SITE is HOST TARGET binding site found in the 3' untranslated region of mRNA encoded by LOC57105, corresponding to a HOST TARGET binding site such as BINDING SITE I, BINDING SITE II or BINDING SITE III. Table 2 illustrates the complementarity of the nucleotide sequences of LOC57105 BINDING SITE, designated SEQ ID:21636, to the nucleotide sequence of VGAM2052 RNA, herein designated VGAM RNA, also designated SEQ ID:4763.

Another function of VGAM2052 is therefore inhibition of LOC57105 (Accession NM_020377). Accordingly, utilities of VGAM2052 include diagnosis, prevention and treatment of diseases and clinical conditions associated with LOC57105. LOC90333 (Accession XM_030958) is another VGAM2052 host target gene. LOC90333 BINDING SITE is HOST TARGET binding site found in the 3' untranslated region of mRNA encoded by LOC90333, corresponding to a HOST TARGET binding site such as BINDING SITE I, BINDING SITE II or BINDING SITE III. Table 2 illustrates the complementarity of the nucleotide sequences of LOC90333 BINDING SITE, designated SEQ ID:31222, to the nucleotide sequence of VGAM2052 RNA, herein designated VGAM RNA, also designated SEQ ID:4763.

Another function of VGAM2052 is therefore inhibition of LOC90333 (Accession XM_030958). Accordingly, utilities of VGAM2052 include diagnosis, prevention and treatment of diseases and clinical conditions associated with LOC90333. LOC90494 (Accession XM_032161) is another VGAM2052 host target gene. LOC90494 BINDING SITE is HOST TARGET binding site found in the 5' untranslated region of mRNA encoded by LOC90494, corresponding to a HOST TARGET binding site such as BINDING SITE I, BINDING SITE II or BINDING SITE III. Table 2 illustrates the complementarity of the nucleotide sequences of LOC90494 BINDING SITE, designated SEQ ID:31576, to the nucleotide sequence of VGAM2052 RNA, herein designated VGAM RNA, also designated SEQ ID:4763.

Another function of VGAM2052 is therefore inhibition of LOC90494 (Accession XM_032161). Accordingly, utilities of VGAM2052 include diagnosis, prevention and treatment of diseases and clinical conditions associated with LOC90494. LOC92299 (Accession XM_044075) is another VGAM2052 host target gene. LOC92299 BINDING SITE is HOST TARGET binding site found in the 5' untranslated region of mRNA encoded by LOC92299, corresponding to a HOST TARGET binding site such as BINDING SITE I, BINDING SITE II or BINDING SITE III. Table 2 illustrates the complementarity of the nucleotide sequences of LOC92299 BINDING SITE, designated SEQ ID:34132, to the nucleotide sequence of VGAM2052 RNA, herein designated VGAM RNA, also designated SEQ ID:4763.

Another function of VGAM2052 is therefore inhibition of LOC92299 (Accession XM_044075). Accordingly, utilities of VGAM2052 include diagnosis, prevention and treatment of diseases and clinical conditions associated with LOC92299. FIG. 1 further provides a conceptual description of a novel bioinformatically detected viral gene of the present invention, referred to here as Viral Genomic Address Messenger 2053 (VGAM2053) viral gene, which modulates expression of respective host target genes thereof, the function and utility of which host target genes is known in the art.

VGAM2053 is a novel bioinformatically detected regulatory, non protein coding, viral micro RNA (miRNA) gene.

The method by which VGAM2053 was detected is described hereinabove with reference to FIGS. 1-8.

VGAM2053 gene, herein designated VGAM GENE, is a viral gene contained in the genome of Ovine Adenovirus A. VGAM2053 host target gene, herein designated VGAM HOST TARGET GENE, is a human gene contained in the human genome.

VGAM2053 gene encodes a VGAM2053 precursor RNA, herein designated VGAM PRECURSOR RNA. Similar to other miRNA genes, and unlike most ordinary genes, VGAM2053 precursor RNA does not encode a protein. A nucleotide sequence identical or highly similar to the nucleotide sequence of VGAM2053 precursor RNA is designated SEQ ID:2039, and is provided hereinbelow with reference to the sequence listing part. Nucleotide sequence SEQ ID:2039 is located at position 25948 relative to the genome of Ovine Adenovirus A.

VGAM2053 precursor RNA folds onto itself, forming VGAM2053 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2053 folded precursor RNA into VGAM2053 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM2053 RNA is designated SEQ ID:4764, and is provided hereinbelow with reference to the sequence listing part.

VGAM2053 host target gene, herein designated VGAM HOST TARGET GENE, encodes a corresponding messenger RNA, VGAM2053 host target RNA, herein designated VGAM HOST TARGET RNA. VGAM2053 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2053 RNA, herein designated VGAM RNA, binds complementarily to one or more host target binding sites located in untranslated regions of VGAM2053 host target RNA, herein designated VGAM HOST TARGET RNA. This complementary binding is due to the fact that the nucleotide sequence of VGAM2053 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2053 RNA, herein designated VGAM RNA, may have a different number of host target binding sites in untranslated regions of a VGAM2053 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2053 RNA, herein designated VGAM RNA, to host target binding sites on VGAM2053 host target RNA, herein designated VGAM HOST TARGET RNA, such as BINDING SITE I, BINDING SITE II and BINDING SITE III, inhibits translation of VGAM2053 host target RNA into VGAM2053 host target protein, herein designated VGAM HOST TARGET PROTEIN. VGAM host target protein is therefore outlined by a broken line.

It is appreciated that VGAM2053 host target gene, herein designated VGAM HOST TARGET GENE, in fact represents a plurality of VGAM2053 host target genes. The mRNA of each one of this plurality of VGAM2053 host target genes comprises one or more host target binding sites, each having a nucleotide sequence which is at least partly complementary to VGAM2053 RNA, herein designated VGAM RNA, and which when bound by VGAM2053 RNA causes inhibition of translation of respective one or more VGAM2053 host target proteins.

It is further appreciated by one skilled in the art that the mode of translational inhibition illustrated by FIG. 1 with specific reference to translational inhibition exerted by VGAM2053 gene, herein designated VGAM GENE, on one or more VGAM2053 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2053 is inhibition of expression of host target genes, as part of a novel viral mechanism of attacking a host. Accordingly, utilities of VGAM2053 include diagnosis, prevention and treatment of viral infection by Ovine Adenovirus A. Specific functions, and accordingly utilities, of VGAM2053 correlate with, and may be deduced from, the identity of the host target genes which VGAM2053 binds and inhibits, and the function of these host target genes, as elaborated hereinbelow.

Nucleotide sequences of the VGAM2053 precursor RNA, herein designated VGAM PRECURSOR RNA, and of the 'diced' VGAM2053 RNA, herein designated VGAM RNA, and a schematic representation of the secondary folding of VGAM2053 folded precursor RNA, herein designated VGAM FOLDED PRECURSOR RNA, of VGAM2053 are further described hereinbelow with reference to Table 1.

Nucleotide sequences of host target binding sites, such as BINDING SITE-I, BINDING SITE-II and BINDING SITE-III of FIG. 1, found on VGAM2053 host target RNA, and schematic representation of the complementarity of each of these host target binding sites to VGAM2053 RNA, herein designated VGAM RNA, are described hereinbelow with reference to Table 2.

As mentioned hereinabove with reference to FIG. 1, a function of VGAM2053 gene, herein designated VGAM is inhibition of expression of VGAM2053 target genes. It is appreciated that specific functions, and accordingly utilities, of VGAM2053 correlate with, and may be deduced from, the identity of the target genes which VGAM2053 binds and inhibits, and the function of these target genes, as elaborated hereinbelow.

Fatty Acid Binding Protein 2, Intestinal (FABP2, Accession NM_000134) is a VGAM2053 host target gene. FABP2 BINDING SITE is HOST TARGET binding site found in the 3' untranslated region of mRNA encoded by FABP2, corresponding to a HOST TARGET binding site such as BINDING SITE I, BINDING SITE II or BINDING SITE III. Table 2 illustrates the complementarity of the nucleotide sequences of FABP2 BINDING SITE, designated SEQ ID:5620, to the nucleotide sequence of VGAM2053 RNA, herein designated VGAM RNA, also designated SEQ ID:4764.

A function of VGAM2053 is therefore inhibition of Fatty Acid Binding Protein 2, Intestinal (FABP2, Accession NM_000134), a gene which may have a role in dietary fat uptake or processing. Accordingly, utilities of VGAM2053 include diagnosis, prevention and treatment of diseases and clinical conditions associated with FABP2. The function of FABP2 and its association with various diseases and clinical conditions, has been established by previous studies, as described hereinabove with reference to VGAM951. High-mobility Group Box 3 (HMGB3, Accession NM_005342) is another VGAM2053 host target gene. HMGB3 BINDING SITE is HOST TARGET binding site found in the 3' untranslated region of mRNA encoded by HMGB3, corresponding to a HOST TARGET binding site such as BINDING SITE I, BINDING SITE II or BINDING SITE III. Table 2 illustrates the complementarity of the nucleotide sequences of HMGB3 BINDING SITE, designated SEQ ID:11818, to the nucleotide sequence of VGAM2053 RNA, herein designated VGAM RNA, also designated SEQ ID:4764.

Another function of VGAM2053 is therefore inhibition of High-mobility Group Box 3 (HMGB3, Accession NM_005342), a gene which plays a fundamental role in DNA replication, nucleosome assembly, and transcription. Accordingly, utilities of VGAM2053 include diagnosis, prevention and treatment of diseases and clinical conditions associated with HMGB3. The function of HMGB3 and its association with various diseases and clinical conditions, has been established by previous studies, as described hereinabove with reference to VGAM1272. HN1L (Accession NM_144570) is another VGAM2053 host target gene. HN1L BINDING SITE is HOST TARGET binding site found in the 3" untranslated region of mRNA encoded by HN1L, corresponding to a HOST TARGET binding site such as BINDING SITE I, BINDING SITE II or BINDING SITE III. Table 2 illustrates the complementarity of the nucleotide sequences of HN1L BINDING SITE, designated SEQ ID:29378, to the nucleotide sequence of VGAM2053 RNA, herein designated VGAM RNA, also designated SEQ ID:4764.

Another function of VGAM2053 is therefore inhibition of HN1L (Accession NM_144570). Accordingly, utilities of VGAM2053 include diagnosis, prevention and treatment of diseases and clinical conditions associated with HN1L. poly (A) Polymerase Gamma (PAPOLG, Accession NM_022894) is another VGAM2053 host target gene. PAPOLG BINDING SITE is HOST TARGET binding site found in the 3' untranslated region of mRNA encoded by PAPOLG, corresponding to a HOST TARGET binding site such as BINDING SITE I, BINDING SITE II or BINDING SITE III. Table 2 illustrates the complementarity of the nucleotide sequences of PAPOLG BINDING SITE, designated SEQ ID:23153, to the nucleotide sequence of VGAM2053 RNA, herein designated VGAM RNA, also designated SEQ ID:4764.

Another function of VGAM2053 is therefore inhibition of poly (A) Polymerase Gamma (PAPOLG, Accession NM_022894). Accordingly, utilities of VGAM2053 include diagnosis, prevention and treatment of diseases and clinical conditions associated with PAPOLG. LOC145790 (Accession XM_085234) is another VGAM2053 host target gene. LOC145790 BINDING SITE is HOST TARGET binding site found in the 3' untranslated region of mRNA encoded by LOC145790, corresponding to a HOST TARGET binding site such as BINDING SITE I, BINDING SITE II or BINDING SITE III. Table 2 illustrates the complementarity of the nucleotide sequences of LOC145790 BINDING SITE, designated SEQ ID:37977, to the nucleotide sequence of VGAM2053 RNA, herein designated VGAM RNA, also designated SEQ ID:4764.

Another function of VGAM2053 is therefore inhibition of LOC145790 (Accession XM_085234). Accordingly, utilities of VGAM2053 include diagnosis, prevention and treatment of diseases and clinical conditions associated with LOC145790. LOC219654 (Accession XM_166095) is another VGAM2053 host target gene. LOC219654 BINDING SITE is HOST TARGET binding site found in the 3' untranslated region of mRNA encoded by LOC219654, corresponding to a HOST TARGET binding site such as BINDING SITE I, BINDING SITE II or BINDING SITE III. Table 2 illustrates the complementarity of the nucleotide sequences of LOC219654 BINDING SITE, designated SEQ ID:43876, to the nucleotide sequence of VGAM2053 RNA, herein designated VGAM RNA, also designated SEQ ID:4764.

Another function of VGAM2053 is therefore inhibition of LOC219654 (Accession XM_166095). Accordingly, utilities of VGAM2053 include diagnosis, prevention and treatment of diseases and clinical conditions associated with LOC219654. FIG. 1 further provides a conceptual description of a novel bioinformatically detected viral gene of the present invention, referred to here as Viral Genomic Address Messenger 2054 (VGAM2054) viral gene, which modulates expression of respective host target genes thereof, the function and utility of which host target genes is known in the art.

VGAM2054 is a novel bioinformatically detected regulatory, non protein coding, viral micro RNA (miRNA) gene. The method by which VGAM2054 was detected is described hereinabove with reference to FIGS. 1-8.

VGAM2054 gene, herein designated VGAM GENE, is a viral gene contained in the genome of Ectromelia Virus. VGAM2054 host target gene, herein designated VGAM HOST TARGET GENE, is a human gene contained in the human genome.

VGAM2054 gene encodes a VGAM2054 precursor RNA, herein designated VGAM PRECURSOR RNA. Similar to other miRNA genes, and unlike most ordinary genes, VGAM2054 precursor RNA does not encode a protein. A nucleotide sequence identical or highly similar to the nucleotide sequence of VGAM2054 precursor RNA is designated SEQ ID:2040, and is provided hereinbelow with reference to the sequence listing part. Nucleotide sequence SEQ ID:2040 is located at position 2713 relative to the genome of Ectromelia Virus.

VGAM2054 precursor RNA folds onto itself, forming VGAM2054 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2054 folded precursor RNA into VGAM2054 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM2054 RNA is designated SEQ ID:4765, and is provided hereinbelow with reference to the sequence listing part.

VGAM2054 host target gene, herein designated VGAM HOST TARGET GENE, encodes a corresponding messenger RNA, VGAM2054 host target RNA, herein designated VGAM HOST TARGET RNA. VGAM2054 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2054 RNA, herein designated VGAM RNA, binds complementarily to one or more host target binding sites located in untranslated regions of VGAM2054 host target RNA, herein designated VGAM HOST TARGET RNA. This complementary binding is due to the fact that the nucleotide sequence of VGAM2054 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2054 RNA, herein designated VGAM RNA, may have a different number of host target binding sites in untranslated regions of a VGAM2054 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2054 RNA, herein designated VGAM RNA, to host target binding sites on VGAM2054 host target RNA, herein designated VGAM HOST TARGET RNA, such as BINDING SITE I, BINDING SITE II and BINDING SITE III, inhibits translation of VGAM2054 host target RNA into VGAM2054 host target protein, herein designated VGAM HOST TARGET PROTEIN. VGAM host target protein is therefore outlined by a broken line.

It is appreciated that VGAM2054 host target gene, herein designated VGAM HOST TARGET GENE, in fact represents a plurality of VGAM2054 host target genes. The mRNA of each one of this plurality of VGAM2054 host target genes comprises one or more host target binding sites, each having a nucleotide sequence which is at least partly complementary to VGAM2054 RNA, herein designated VGAM RNA, and which when bound by VGAM2054 RNA causes inhibition of translation of respective one or more VGAM2054 host target proteins.

It is further appreciated by one skilled in the art that the mode of translational inhibition illustrated by FIG. 1 with specific reference to translational inhibition exerted by VGAM2054 gene, herein designated VGAM GENE, on one or more VGAM2054 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2054 is inhibition of expression of host target genes, as part of a novel viral mechanism of attacking a host. Accordingly, utilities of VGAM2054 include diagnosis, prevention and treatment of viral infection by Ectromelia Virus. Specific functions, and accordingly utilities, of VGAM2054 correlate with, and may be deduced from, the identity of the host target genes which VGAM2054 binds and inhibits, and the function of these host target genes, as elaborated hereinbelow.

Nucleotide sequences of the VGAM2054 precursor RNA, herein designated VGAM PRECURSOR RNA, and of the 'diced' VGAM2054 RNA, herein designated VGAM RNA, and a schematic representation of the secondary folding of VGAM2054 folded precursor RNA, herein designated VGAM FOLDED PRECURSOR RNA, of VGAM2054 are further described hereinbelow with reference to Table 1.

Nucleotide sequences of host target binding sites, such as BINDING SITE-I, BINDING SITE-II and BINDING SITE-III of FIG. 1, found on VGAM2054 host target RNA, and schematic representation of the complementarity of each of these host target binding sites to VGAM2054 RNA, herein designated VGAM RNA, are described hereinbelow with reference to Table 2.

As mentioned hereinabove with reference to FIG. 1, a function of VGAM2054 gene, herein designated VGAM is inhibition of expression of VGAM2054 target genes. It is appreciated that specific functions, and accordingly utilities, of VGAM2054 correlate with, and may be deduced from, the identity of the target genes which VGAM2054 binds and inhibits, and the function of these target genes, as elaborated hereinbelow.

Cyclin-dependent Kinase Inhibitor 2C (p18, inhibits CDK4) (CDKN2C, Accession NM_001262) is a VGAM2054 host target gene. CDKN2C BINDING SITE is HOST TARGET binding site found in the 5' untranslated region of mRNA encoded by CDKN2C, corresponding to a HOST TARGET binding site such as BINDING SITE I, BINDING SITE II or BINDING SITE III. Table 2 illustrates the complementarity of the nucleotide sequences of CDKN2C BINDING SITE, designated SEQ ID:6927, to the nucleotide sequence of VGAM2054 RNA, herein designated VGAM RNA, also designated SEQ ID:4765.

A function of VGAM2054 is therefore inhibition of Cyclin-dependent Kinase Inhibitor 2C (p18, inhibits CDK4) (CDKN2C, Accession NM_001262), a gene which associate with cyclin-CDK complexes or CDKs alone and inhibit their activity. Accordingly, utilities of VGAM2054 include diagnosis, prevention and treatment of diseases and clinical conditions associated with CDKN2C. The function of CDKN2C has been established by previous studies. Cyclin-dependent kinase inhibitors (CKIs) are a group of low molecular weight proteins that associate with cyclin-CDK complexes or CDKs alone and inhibit their activity. Members of the INK4 family of CKIs specifically bind and inhibit CDK4 (OMIM Ref. No. 123829) and CDK6 (OMIM Ref. No. 603368), thereby preventing cyclin D-dependent phosphorylation of RB1 (OMIM Ref. No. 180200). See INK4D (OMIM Ref. No. 600927). By using a yeast 2-hybrid screen to search for CDK6-interacting proteins, Guan et al. (1994) isolated a partial cDNA encoding a protein that they designated p18 based on its molecular mass of 18 kD. They used the partial cDNA to screen a HeLa cell library and recovered additional cDNAs corresponding to the entire p18 coding region. Sequence analysis revealed that the predicted 168-amino acid p18 protein shares 38% and 42% sequence identity with p16/INK4A (OMIM Ref. No. 600160) and p14/INK4B (OMIM Ref. No. 600431), respectively. Like p14 and p16, p18 contains an ankyrin repeat domain. Both in vivo and in vitro, p18 interacted strongly with CDK6 and weakly with CDK4, but not with the other CDKs tested. Recombinant p18 inhibited the kinase activity of cyclin D-CDK6 in vitro. Ectopic expression of either p16 or p18 suppressed the growth of human cells in a manner that appears to correlate with the presence of a wildtype RB1 function. Using Northern blot analysis, Guan et al. (1994) found that p18 is expressed as multiple transcripts in various human tissues, with the strongest expression in skeletal muscle. Blais et al. (1998) determined that the p18, or INK4C, gene contains 3 exons and spans more than 7.5 kb. Lapointe et al. (1996) identified a single amino acid substitution (ala72 to pro; A72P) in BT-20 human breast cancer cells that abrogated the ability of p18 to interact with CDK6 and to suppress cell growth. These authors suggested that p18 inactivation by point mutations may contribute to deregulated growth control in certain cell lines and/or tumors. Blais et al. (1998) found this p18 variant in 3 of 35 breast tumors examined, and suggested that it may be a polymorphism.

Full details of the abovementioned studies are described in the following publications, the disclosure of which are hereby incorporated by reference:

Blais, A.; Labrie, Y.; Pouliot, F.; Lachance, Y.; Labrie, C.: Structure of the gene encoding the human cyclin-dependent kinase inhibitor p18 and mutational analysis in breast cancer. Biochem. Biophys. Res. Commun. 247:146-153, 1998; and Lapointe, J.; Lachance, Y.; Labrie, Y.; Labrie, C.: A p18 mutant defective in CDK6 binding in human breast cancer cells. Cancer Res. 56:4586-4589, 1996.

Further studies establishing the function and utilities of CDKN2C are found in John Hopkins OMIM database record ID 603369, and in sited publications numbered 851 and 8511 listed in the bibliography section hereinbelow, which are also hereby incorporated by reference. DKFZp761N0624 (Accession NM_032295) is another VGAM2054 host target gene. DKFZp761N0624 BINDING SITE is HOST TARGET binding site found in the 3' untranslated region of mRNA encoded by DKFZp761N0624, corresponding to a HOST TARGET binding site such as BINDING SITE I, BINDING SITE II or BINDING SITE III. Table 2 illustrates the complementarity of the nucleotide sequences of DKFZp761N0624 BINDING SITE, designated SEQ ID:26071, to the nucleotide sequence of VGAM2054 RNA, herein designated VGAM RNA, also designated SEQ ID:4765.

Another function of VGAM2054 is therefore inhibition of DKFZp761N0624 (Accession NM_032295). Accordingly, utilities of VGAM2054 include diagnosis, prevention and treatment of diseases and clinical conditions associated with DKFZp761N0624. Nuclear Receptor Subfamily 4, Group A, Member 3 (NR4A3, Accession NM_006981) is another VGAM2054 host target gene. NR4A3 BINDING SITE is HOST TARGET binding site found in the 5' untranslated region of mRNA encoded by NR4A3, corresponding to a HOST TARGET binding site such as BINDING SITE I, BINDING SITE II or BINDING SITE III. Table 2 illustrates the complementarity of the nucleotide sequences of NR4A3 BINDING SITE, designated SEQ ID:13843, to the nucleotide sequence of VGAM2054 RNA, herein designated VGAM RNA, also designated SEQ ID:4765.

Another function of VGAM2054 is therefore inhibition of Nuclear Receptor Subfamily 4, Group A, Member 3 (NR4A3, Accession NM_006981). Accordingly, utilities of VGAM2054 include diagnosis, prevention and treatment of diseases and clinical conditions associated with NR4A3.

LOC149073 (Accession XM_097577) is another VGAM2054 host target gene. LOC149073 BINDING SITE is HOST TARGET binding site found in the 5' untranslated region of mRNA encoded by LOC149073, corresponding to a HOST TARGET binding site such as BINDING SITE I, BINDING SITE II or BINDING SITE III. Table 2 illustrates the complementarity of the nucleotide sequences of LOC149073 BINDING SITE, designated SEQ ID:40943, to the nucleotide sequence of VGAM2054 RNA, herein designated VGAM RNA, also designated SEQ ID:4765.

Another function of VGAM2054 is therefore inhibition of LOC149073 (Accession XM_097577). Accordingly, utilities of VGAM2054 include diagnosis, prevention and treatment of diseases and clinical conditions associated with LOC149073. FIG. 1 further provides a conceptual description of a novel bioinformatically detected viral gene of the present invention, referred to here as Viral Genomic Address Messenger 2055 (VGAM2055) viral gene, which modulates expression of respective host target genes thereof, the function and utility of which host target genes is known in the art.

VGAM2055 is a novel bioinformatically detected regulatory, non protein coding, viral micro RNA (miRNA) gene. The method by which VGAM2055 was detected is described hereinabove with reference to FIGS. 1-8.

VGAM2055 gene, herein designated VGAM GENE, is a viral gene contained in the genome of Peanut Bud Necrosis Virus. VGAM2055 host target gene, herein designated VGAM HOST TARGET GENE, is a human gene contained in the human genome.

VGAM2055 gene encodes a VGAM2055 precursor RNA, herein designated VGAM PRECURSOR RNA. Similar to other miRNA genes, and unlike most ordinary genes, VGAM2055 precursor RNA does not encode a protein. A nucleotide sequence identical or highly similar to the nucleotide sequence of VGAM2055 precursor RNA is designated SEQ ID:2041, and is provided hereinbelow with reference to the sequence listing part. Nucleotide sequence SEQ ID:2041 is located at position 6690 relative to the genome of Peanut Bud Necrosis Virus.

VGAM2055 precursor RNA folds onto itself, forming VGAM2055 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2055 folded precursor RNA into VGAM2055 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2055 RNA is designated SEQ ID:4766, and is provided hereinbelow with reference to the sequence listing part.

VGAM2055 host target gene, herein designated VGAM HOST TARGET GENE, encodes a corresponding messenger RNA, VGAM2055 host target RNA, herein designated VGAM HOST TARGET RNA. VGAM2055 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2055 RNA, herein designated VGAM RNA, binds complementarily to one or more host target binding sites located in untranslated regions of VGAM2055 host target RNA, herein designated VGAM HOST TARGET RNA. This complementary binding is due to the fact that the nucleotide sequence of VGAM2055 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2055 RNA, herein designated VGAM RNA, may have a different number of host target binding sites in untranslated regions of a VGAM2055 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2055 RNA, herein designated VGAM RNA, to host target binding sites on VGAM2055 host target RNA, herein designated VGAM HOST TARGET RNA, such as BINDING SITE I, BINDING SITE II and BINDING SITE III, inhibits translation of VGAM2055 host target RNA into VGAM2055 host target protein, herein designated VGAM HOST TARGET PROTEIN. VGAM host target protein is therefore outlined by a broken line.

It is appreciated that VGAM2055 host target gene, herein designated VGAM HOST TARGET GENE, in fact represents a plurality of VGAM2055 host target genes. The mRNA of each one of this plurality of VGAM2055 host target genes comprises one or more host target binding sites, each having a nucleotide sequence which is at least partly complementary to VGAM2055 RNA, herein designated VGAM RNA, and which when bound by VGAM2055 RNA causes inhibition of translation of respective one or more VGAM2055 host target proteins.

It is further appreciated by one skilled in the art that the mode of translational inhibition illustrated by FIG. 1 with specific reference to translational inhibition exerted by VGAM2055 gene, herein designated VGAM GENE, on one or more VGAM2055 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2055 is inhibition of expression of host target genes, as part of a novel viral mechanism of attacking a host. Accordingly, utilities of VGAM2055 include diagnosis, prevention and treatment of viral infection by Peanut Bud Necrosis Virus. Specific functions, and accordingly utilities, of VGAM2055 correlate with, and may be deduced from, the identity of the host target genes which VGAM2055 binds and inhibits, and the function of these host target genes, as elaborated hereinbelow.

Nucleotide sequences of the VGAM2055 precursor RNA, herein designated VGAM PRECURSOR RNA, and of the 'diced' VGAM2055 RNA, herein designated VGAM RNA, and a schematic representation of the secondary folding of VGAM2055 folded precursor RNA, herein designated VGAM FOLDED PRECURSOR RNA, of VGAM2055 are further described hereinbelow with reference to Table 1.

Nucleotide sequences of host target binding sites, such as BINDING SITE-I, BINDING SITE-II and BINDING SITE-III of FIG. 1, found on VGAM2055 host target RNA, and schematic representation of the complementarity of each of these host target binding sites to VGAM2055 RNA, herein designated VGAM RNA, are described hereinbelow with reference to Table 2.

As mentioned hereinabove with reference to FIG. 1, a function of VGAM2055 gene, herein designated VGAM is inhibition of expression of VGAM2055 target genes. It is appreciated that specific functions, and accordingly utilities, of VGAM2055 correlate with, and may be deduced from, the identity of the target genes which VGAM2055 binds and inhibits, and the function of these target genes, as elaborated hereinbelow.

BIG1 (Accession NM_006421) is a VGAM2055 host target gene. BIG1 BINDING SITE is HOST TARGET binding site found in the 3' untranslated region of mRNA encoded by BIG1, corresponding to a HOST TARGET binding site such as BINDING SITE I, BINDING SITE II or BINDING SITE III. Table 2 illustrates the complementarity of the nucleotide sequences of BIG1 BINDING SITE, designated SEQ ID:13140, to the nucleotide sequence of VGAM2055 RNA, herein designated VGAM RNA, also designated SEQ ID:4766.

A function of VGAM2055 is therefore inhibition of BIG1 (Accession NM_006421), a gene which is a guanine nucleotide-exchange protein, has a role in vesicular transport. Accordingly, utilities of VGAM2055 include diagnosis, prevention and treatment of diseases and clinical conditions associated with BIG1. The function of BIG1 and its association with various diseases and clinical conditions, has been established by previous studies, as described hereinabove with reference to VGAM1190. Fukuyama Type Congenital Muscular Dystrophy (fukutin) (FCMD, Accession NM_006731) is another VGAM2055 host target gene. FCMD BINDING SITE is HOST TARGET binding site found in the 3' untranslated region of mRNA encoded by FCMD, corresponding to a HOST TARGET binding site such as BINDING SITE I, BINDING SITE II or BINDING SITE III. Table 2 illustrates the complementarity of the nucleotide sequences of FCMD BINDING SITE, designated SEQ ID:13578, to the nucleotide sequence of VGAM2055 RNA, herein designated VGAM RNA, also designated SEQ ID:4766.

Another function of VGAM2055 is therefore inhibition of Fukuyama Type Congenital Muscular Dystrophy (fukutin) (FCMD, Accession NM_006731). Accordingly, utilities of VGAM2055 include diagnosis, prevention and treatment of diseases and clinical conditions associated with FCMD. FtsJ Homolog 2 (E. coli) (FTSJ2, Accession NM_013393) is another VGAM2055 host target gene. FTSJ2 BINDING SITE is HOST TARGET binding site found in the 3' untranslated region of mRNA encoded by FTSJ2, corresponding to a HOST TARGET binding site such as BINDING SITE I, BINDING SITE II or BINDING SITE III. Table 2 illustrates the complementarity of the nucleotide sequences of FTSJ2 BINDING SITE, designated SEQ ID:15045, to the nucleotide sequence of VGAM2055 RNA, herein designated VGAM RNA, also designated SEQ ID:4766.

Another function of VGAM2055 is therefore inhibition of FtsJ Homolog 2 (E. coli) (FTSJ2, Accession NM_013393). Accordingly, utilities of VGAM2055 include diagnosis, prevention and treatment of diseases and clinical conditions associated with FTSJ2. Prostatic Binding Protein (PBP, Accession NM_002567) is another VGAM2055 host target gene. PBP BINDING SITE is HOST TARGET binding site found in the 3' untranslated region of mRNA encoded by PBP, corresponding to a HOST TARGET binding site such as BINDING SITE I, BINDING SITE II or BINDING SITE III. Table 2 illustrates the complementarity of the nucleotide sequences of PBP BINDING SITE, designated SEQ ID:8417, to the nucleotide sequence of VGAM2055 RNA, herein designated VGAM RNA, also designated SEQ ID:4766.

Another function of VGAM2055 is therefore inhibition of Prostatic Binding Protein (PBP, Accession NM_002567), a gene which regulates the activity of the Raf/MEK/ERK module. Accordingly, utilities of VGAM2055 include diagnosis, prevention and treatment of diseases and clinical conditions associated with PBP. The function of PBP and its association with various diseases and clinical conditions, has been established by previous studies, as described hereinabove with reference to VGAM1332. Serine/threonine Kinase 10 (STK10, Accession NM_005990) is another VGAM2055 host target gene. STK10 BINDING SITE is HOST TARGET binding site found in the 3' untranslated region of mRNA encoded by STK10, corresponding to a HOST TARGET binding site such as BINDING SITE I, BINDING SITE II or BINDING SITE III. Table 2 illustrates the complementarity of the nucleotide sequences of STK10 BINDING SITE, designated SEQ ID:12615, to the nucleotide sequence of VGAM2055 RNA, herein designated VGAM RNA, also designated SEQ ID:4766.

Another function of VGAM2055 is therefore inhibition of Serine/threonine Kinase 10 (STK10, Accession NM_005990), a gene which can act on substrates such as myelin basic protein and histone iia on serine and threonine residues. Accordingly, utilities of VGAM2055 include diagnosis, prevention and treatment of diseases and clinical conditions associated with STK10. The function of STK10 and its association with various diseases and clinical conditions, has been established by previous studies, as described hereinabove with reference to VGAM1958. Rho GTPase Activating Protein 5 (ARHGAP5, Accession XM_085082) is another VGAM2055 host target gene. ARHGAP5 BINDING SITE is HOST TARGET binding site found in the 5' untranslated region of mRNA encoded by ARHGAP5, corresponding to a HOST TARGET binding site such as BINDING SITE I, BINDING SITE II or BINDING SITE III. Table 2 illustrates the complementarity of the nucleotide sequences of ARHGAP5 BINDING SITE, designated SEQ ID:37824, to the nucleotide sequence of VGAM2055 RNA, herein designated VGAM RNA, also designated SEQ ID:4766.

Another function of VGAM2055 is therefore inhibition of Rho GTPase Activating Protein 5 (ARHGAP5, Accession XM_085082). Accordingly, utilities of VGAM2055 include diagnosis, prevention and treatment of diseases and clinical conditions associated with ARHGAP5. Chromosome 1 Open Reading Frame 22 (C1orf22, Accession NM_025191) is another VGAM2055 host target gene. C1orf22 BINDING SITE is HOST TARGET binding site found in the 3' untranslated region of mRNA encoded by C1orf22, corresponding to a HOST TARGET binding site such as BINDING SITE I, BINDING SITE II or BINDING SITE III. Table 2 illustrates the complementarity of the nucleotide sequences of C1orf22 BINDING SITE, designated SEQ ID:24842, to the nucleotide sequence of VGAM2055 RNA, herein designated VGAM RNA, also designated SEQ ID:4766.

Another function of VGAM2055 is therefore inhibition of Chromosome 1 Open Reading Frame 22 (C1orf22, Accession NM_025191). Accordingly, utilities of VGAM2055 include diagnosis, prevention and treatment of diseases and clinical conditions associated with C1orf22. Chromobox Homolog 6 (CBX6, Accession NM_014292) is another VGAM2055 host target gene. CBX6 BINDING SITE is HOST TARGET binding site found in the 3' untranslated region of mRNA encoded by CBX6, corresponding to a HOST TARGET binding site such as BINDING SITE I, BINDING SITE II or BINDING SITE III. Table 2 illustrates the complementarity of the nucleotide sequences of CBX6 BINDING SITE, designated SEQ ID:15580, to the nucleotide sequence of VGAM2055 RNA, herein designated VGAM RNA, also designated SEQ ID:4766.

Another function of VGAM2055 is therefore inhibition of Chromobox Homolog 6 (CBX6, Accession NM_014292). Accordingly, utilities of VGAM2055 include diagnosis, prevention and treatment of diseases and clinical conditions associated with CBX6. DKFZP434A043 (Accession NM_015396) is another VGAM2055 host target gene. DKFZP434A043 BINDING SITE is HOST TARGET binding site found in the 5' untranslated region of mRNA encoded by DKFZP434A043, corresponding to a HOST TARGET binding site such as BINDING SITE I, BINDING SITE II or BINDING SITE III. Table 2 illustrates the complementarity of the nucleotide sequences of DKFZP434A043 BINDING SITE, designated SEQ ID:17704, to the nucleotide sequence of VGAM2055 RNA, herein designated VGAM RNA, also designated SEQ ID:4766.

Another function of VGAM2055 is therefore inhibition of DKFZP434A043 (Accession NM_015396). Accordingly, utilities of VGAM2055 include diagnosis, prevention and treatment of diseases and clinical conditions associated with DKFZP434A043. DKFZP434C212 (Accession XM_044196) is another VGAM2055 host target gene. DKFZP434C212 BINDING SITE is HOST TARGET binding site found in the 3' untranslated region of mRNA encoded by DKFZP434C212, corresponding to a HOST TARGET binding site such as BINDING SITE I, BINDING SITE II or BINDING SITE III. Table 2 illustrates the complementarity of the nucleotide sequences of DKFZP434C212 BINDING SITE, designated SEQ ID:34172, to the nucleotide sequence of VGAM2055 RNA, herein designated VGAM RNA, also designated SEQ ID:4766.

Another function of VGAM2055 is therefore inhibition of DKFZP434C212 (Accession XM_044196). Accordingly, utilities of VGAM2055 include diagnosis, prevention and treatment of diseases and clinical conditions associated with DKFZP434C212. DKFZP434J037 (Accession NM_030952) is another VGAM2055 host target gene. DKFZP434J037 BINDING SITE is HOST TARGET binding site found in the 3' untranslated region of mRNA encoded by DKFZP434J037, corresponding to a HOST TARGET binding site such as BINDING SITE I, BINDING SITE II or BINDING SITE III. Table 2 illustrates the complementarity of the nucleotide sequences of DKFZP434J037 BINDING SITE, designated SEQ ID:25221, to the nucleotide sequence of VGAM2055 RNA, herein designated VGAM RNA, also designated SEQ ID:4766.

Another function of VGAM2055 is therefore inhibition of DKFZP434J037 (Accession NM_030952). Accordingly, utilities of VGAM2055 include diagnosis, prevention and treatment of diseases and clinical conditions associated with DKFZP434J037. FLJ23129 (Accession NM_024763) is another VGAM2055 host target gene. FLJ23129 BINDING SITE is HOST TARGET binding site found in the 3' untranslated region of mRNA encoded by FLJ23129, corresponding to a HOST TARGET binding site such as BINDING SITE I, BINDING SITE II or BINDING SITE III. Table 2 illustrates the complementarity of the nucleotide sequences of FLJ23129 BINDING SITE, designated SEQ ID:24122, to the nucleotide sequence of VGAM2055 RNA, herein designated VGAM RNA, also designated SEQ ID:4766.

Another function of VGAM2055 is therefore inhibition of FLJ23129 (Accession NM_024763). Accordingly, utilities of VGAM2055 include diagnosis, prevention and treatment of diseases and clinical conditions associated with FLJ23129. HEMK (Accession NM_016173) is another VGAM2055 host target gene. HEMK BINDING SITE is HOST TARGET binding site found in the 3' untranslated region of mRNA encoded by HEMK, corresponding to a HOST TARGET binding site such as BINDING SITE I, BINDING SITE II or BINDING SITE III. Table 2 illustrates the complementarity of the nucleotide sequences of HEMK BINDING SITE, designated SEQ ID:18275, to the nucleotide sequence of VGAM2055 RNA, herein designated VGAM RNA, also designated SEQ ID:4766.

Another function of VGAM2055 is therefore inhibition of HEMK (Accession NM_016173). Accordingly, utilities of VGAM2055 include diagnosis, prevention and treatment of diseases and clinical conditions associated with HEMK. KIAA0781 (Accession XM_041314) is another VGAM2055 host target gene. KIAA0781 BINDING SITE is HOST TARGET binding site found in the 3" untranslated region of mRNA encoded by KIAA0781, corresponding to a HOST TARGET binding site such as BINDING SITE I, BINDING SITE II or BINDING SITE III. Table 2 illustrates the complementarity of the nucleotide sequences of KIAA0781 BINDING SITE, designated SEQ ID:33500, to the nucleotide sequence of VGAM2055 RNA, herein designated VGAM RNA, also designated SEQ ID:4766.

Another function of VGAM2055 is therefore inhibition of KIAA0781 (Accession XM_041314). Accordingly, utilities of VGAM2055 include diagnosis, prevention and treatment of diseases and clinical conditions associated with KIAA0781. KIAA1034 (Accession XM_031223) is another VGAM2055 host target gene. KIAA1034 BINDING SITE is HOST TARGET binding site found in the 3' untranslated region of mRNA encoded by KIAA1034, corresponding to a HOST TARGET binding site such as BINDING SITE I, BINDING SITE II or BINDING SITE III. Table 2 illustrates the complementarity of the nucleotide sequences of KIAA1034 BINDING SITE, designated SEQ ID:31313, to the nucleotide sequence of VGAM2055 RNA, herein designated VGAM RNA, also designated SEQ ID:4766.

Another function of VGAM2055 is therefore inhibition of KIAA1034 (Accession XM_031223). Accordingly, utilities of VGAM2055 include diagnosis, prevention and treatment of diseases and clinical conditions associated with KIAA1034. KIAA1508 (Accession XM_030209) is another VGAM2055 host target gene. KIAA1508 BINDING SITE is HOST TARGET binding site found in the 5' untranslated region of mRNA encoded by KIAA1508, corresponding to a HOST TARGET binding site such as BINDING SITE I, BINDING SITE II or BINDING SITE III. Table 2 illustrates the complementarity of the nucleotide sequences of KIAA1508 BINDING SITE, designated SEQ ID:30997, to the nucleotide sequence of VGAM2055 RNA, herein designated VGAM RNA, also designated SEQ ID:4766.

Another function of VGAM2055 is therefore inhibition of KIAA1508 (Accession XM_030209). Accordingly, utilities of VGAM2055 include diagnosis, prevention and treatment of diseases and clinical conditions associated with KIAA1508. KIAA1804 (Accession XM_045864) is another VGAM2055 host target gene. KIAA1804 BINDING SITE is HOST TARGET binding site found in the 3' untranslated region of mRNA encoded by KIAA1804, corresponding to a HOST TARGET binding site such as BINDING SITE I, BINDING SITE II or BINDING SITE III. Table 2 illustrates the complementarity of the nucleotide sequences of KIAA1804 BINDING SITE, designated SEQ ID:34589, to the nucleotide sequence of VGAM2055 RNA, herein designated VGAM RNA, also designated SEQ ID:4766.

Another function of VGAM2055 is therefore inhibition of KIAA1804 (Accession XM_045864). Accordingly, utilities of VGAM2055 include diagnosis, prevention and treatment of diseases and clinical conditions associated with KIAA1804. Ornithine Decarboxylase Antizyme 3 (OAZ3, Accession NM_016178) is another VGAM2055 host target gene. OAZ3 BINDING SITE is HOST TARGET binding site found in the 5' untranslated region of mRNA encoded by OAZ3, corresponding to a HOST TARGET binding site such as BINDING SITE I, BINDING SITE II or BINDING SITE III. Table 2 illustrates the complementarity of the nucleotide sequences of OAZ3 BINDING SITE, designated SEQ ID:18281, to the nucleotide sequence of VGAM2055 RNA, herein designated VGAM RNA, also designated SEQ ID:4766.

Another function of VGAM2055 is therefore inhibition of Ornithine Decarboxylase Antizyme 3 (OAZ3, Accession NM_016178). Accordingly, utilities of VGAM2055 include diagnosis, prevention and treatment of diseases and clinical conditions associated with OAZ3. PI4KII (Accession NM_018425) is another VGAM2055 host target gene. PI4KII BINDING SITE is HOST TARGET binding site found in the 3' untranslated region of mRNA encoded by PI4KII, corresponding to a HOST TARGET binding site such as BINDING SITE I, BINDING SITE II or BINDING SITE III. Table 2 illustrates the complementarity of the nucleotide sequences of PI4KII BINDING SITE, designated SEQ ID:20485, to the nucleotide sequence of VGAM2055 RNA, herein designated VGAM RNA, also designated SEQ ID:4766.

Another function of VGAM2055 is therefore inhibition of PI4KII (Accession NM_018425). Accordingly, utilities of VGAM2055 include diagnosis, prevention and treatment of diseases and clinical conditions associated with PI4KII. Rho-related BTB Domain Containing 1 (RHOBTB1, Accession XM_166144) is another VGAM2055 host target gene. RHOBTB1 BINDING SITE is HOST TARGET binding site found in the 3' untranslated region of mRNA encoded by RHOBTB1, corresponding to a HOST TARGET binding site such as BINDING SITE I, BINDING SITE II or BINDING SITE III. Table 2 illustrates the complementarity of the nucleotide sequences of RHOBTB1 BINDING SITE, designated SEQ ID:43953, to the nucleotide sequence of VGAM2055 RNA, herein designated VGAM RNA, also designated SEQ ID:4766.

Another function of VGAM2055 is therefore inhibition of Rho-related BTB Domain Containing 1 (RHOBTB1, Accession XM_166144). Accordingly, utilities of VGAM2055 include diagnosis, prevention and treatment of diseases and clinical conditions associated with RHOBTB1. VEZATIN (Accession NM_017599) is another VGAM2055 host target gene. VEZATIN BINDING SITE is HOST TARGET binding site found in the 3' untranslated region of mRNA encoded by VEZATIN, corresponding to a HOST TARGET binding site such as BINDING SITE I, BINDING SITE II or BINDING SITE III. Table 2 illustrates the complementarity of the nucleotide sequences of VEZATIN BINDING SITE, designated SEQ ID:19071, to the nucleotide sequence of VGAM2055 RNA, herein designated VGAM RNA, also designated SEQ ID:4766.

Another function of VGAM2055 is therefore inhibition of VEZATIN (Accession NM_017599). Accordingly, utilities of VGAM2055 include diagnosis, prevention and treatment of diseases and clinical conditions associated with VEZATIN. ZFP106 (Accession NM_022473) is another VGAM2055 host target gene. ZFP106 BINDING SITE is HOST TARGET binding site found in the 3' untranslated region of mRNA encoded by ZFP106, corresponding to a HOST TARGET binding site such as BINDING SITE I, BINDING SITE II or BINDING SITE III. Table 2 illustrates the complementarity of the nucleotide sequences of ZFP106 BINDING SITE, designated SEQ ID:22836, to the nucleotide sequence of VGAM2055 RNA, herein designated VGAM RNA, also designated SEQ ID:4766.

Another function of VGAM2055 is therefore inhibition of ZFP106 (Accession NM_022473). Accordingly, utilities of VGAM2055 include diagnosis, prevention and treatment of diseases and clinical conditions associated with ZFP106. Zinc Finger Protein 363 (ZNF363, Accession XM_055989) is another VGAM2055 host target gene. ZNF363 BINDING SITE is HOST TARGET binding site found in the 3' untranslated region of mRNA encoded by ZNF363, corresponding to a HOST TARGET binding site such as BINDING SITE I, BINDING SITE II or BINDING SITE III. Table 2 illustrates the complementarity of the nucleotide sequences of ZNF363 BINDING SITE, designated SEQ ID:36357, to the nucleotide sequence of VGAM2055 RNA, herein designated VGAM RNA, also designated SEQ ID:4766.

Another function of VGAM2055 is therefore inhibition of Zinc Finger Protein 363 (ZNF363, Accession XM_055989). Accordingly, utilities of VGAM2055 include diagnosis, prevention and treatment of diseases and clinical conditions associated with ZNF363. LOC149821 (Accession XM_097751) is another VGAM2055 host target gene. LOC149821 BINDING SITE is HOST TARGET binding site found in the 5' untranslated region of mRNA encoded by LOC149821, corresponding to a HOST TARGET binding site such as BINDING SITE I, BINDING SITE II or BINDING SITE III. Table 2 illustrates the complementarity of the nucleotide sequences of LOC149821 BINDING SITE, designated SEQ ID:41110, to the nucleotide sequence of VGAM2055 RNA, herein designated VGAM RNA, also designated SEQ ID:4766.

Another function of VGAM2055 is therefore inhibition of LOC149821 (Accession XM_097751). Accordingly, utilities of VGAM2055 include diagnosis, prevention and treatment of diseases and clinical conditions associated with LOC149821. LOC150271 (Accession XM_097859) is another VGAM2055 host target gene. LOC150271 BINDING SITE is HOST TARGET binding site found in the 3' untranslated region of mRNA encoded by LOC150271, corresponding to a HOST TARGET binding site such as BINDING SITE I, BINDING SITE II or BINDING SITE III. Table 2 illustrates the complementarity of the nucleotide sequences of LOC150271 BINDING SITE, designated SEQ ID:41176, to the nucleotide sequence of VGAM2055 RNA, herein designated VGAM RNA, also designated SEQ ID:4766.

Another function of VGAM2055 is therefore inhibition of LOC150271 (Accession XM_097859). Accordingly, utilities of VGAM2055 include diagnosis, prevention and treatment of diseases and clinical conditions associated with LOC150271. LOC150445 (Accession XM_086916) is another VGAM2055 host target gene. LOC150445 BINDING SITE is HOST TARGET binding site found in the 3' untranslated region of mRNA encoded by LOC150445, corresponding to a HOST TARGET binding site such as BINDING SITE I, BINDING SITE II or BINDING SITE III. Table 2 illustrates the complementarity of the nucleotide sequences of LOC150445 BINDING SITE, designated SEQ ID:38972, to the nucleotide sequence of VGAM2055 RNA, herein designated VGAM RNA, also designated SEQ ID:4766.

Another function of VGAM2055 is therefore inhibition of LOC150445 (Accession XM_086916). Accordingly, utilities of VGAM2055 include diagnosis, prevention and treatment of diseases and clinical conditions associated with LOC150445. LOC90736 (Accession XM_033811) is another VGAM2055 host target gene. LOC90736 BINDING SITE is HOST TARGET binding site found in the 3' untranslated region of mRNA encoded by LOC90736, corresponding to a HOST TARGET binding site such as BINDING SITE I, BINDING SITE II or BINDING SITE III. Table 2 illustrates the complementarity of the nucleotide sequences of LOC90736 BINDING SITE, designated SEQ ID:31958, to the nucleotide sequence of VGAM2055 RNA, herein designated VGAM RNA, also designated SEQ ID:4766.

Another function of VGAM2055 is therefore inhibition of LOC90736 (Accession XM_033811). Accordingly, utilities of VGAM2055 include diagnosis, prevention and treatment of diseases and clinical conditions associated with LOC90736. FIG. 1 further provides a conceptual description of a novel bioinformatically detected viral gene of the present invention, referred to here as Viral Genomic Address Messenger 2056 (VGAM2056) viral gene, which modulates expression of respective host target genes thereof, the function and utility of which host target genes is known in the art.

VGAM2056 is a novel bioinformatically detected regulatory, non protein coding, viral micro RNA (miRNA) gene. The method by which VGAM2056 was detected is described hereinabove with reference to FIGS. 1-8.

VGAM2056 gene, herein designated VGAM GENE, is a viral gene contained in the genome of Peanut Bud Necrosis Virus. VGAM2056 host target gene, herein designated VGAM HOST TARGET GENE, is a human gene contained in the human genome.

VGAM2056 gene encodes a VGAM2056 precursor RNA, herein designated VGAM PRECURSOR RNA. Similar to other miRNA genes, and unlike most ordinary genes, VGAM2056 precursor RNA does not encode a protein. A nucleotide sequence identical or highly similar to the nucleotide sequence of VGAM2056 precursor RNA is designated SEQ ID:2042, and is provided hereinbelow with reference to the sequence listing part. Nucleotide sequence SEQ ID:2042 is located at position 5281 relative to the genome of Peanut Bud Necrosis Virus.

VGAM2056 precursor RNA folds onto itself, forming VGAM2056 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2056 folded precursor RNA into VGAM2056 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2056 RNA is designated SEQ ID:4767, and is provided hereinbelow with reference to the sequence listing part.

VGAM2056 host target gene, herein designated VGAM HOST TARGET GENE, encodes a corresponding messenger RNA, VGAM2056 host target RNA, herein designated VGAM HOST TARGET RNA. VGAM2056 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2056 RNA, herein designated VGAM RNA, binds complementarily to one or more host target binding sites located in untranslated regions of VGAM2056 host target RNA, herein designated VGAM HOST TARGET RNA. This complementary binding is due to the fact that the nucleotide sequence of VGAM2056 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2056 RNA, herein designated VGAM RNA, may have a different number of host target binding sites in untranslated regions of a VGAM2056 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2056 RNA, herein designated VGAM RNA, to host target binding sites on VGAM2056 host target RNA, herein designated VGAM HOST TARGET RNA, such as BINDING SITE I, BINDING SITE II and BINDING SITE III, inhibits translation of VGAM2056 host target RNA into VGAM2056 host target protein, herein designated VGAM HOST TARGET PROTEIN. VGAM host target protein is therefore outlined by a broken line.

It is appreciated that VGAM2056 host target gene, herein designated VGAM HOST TARGET GENE, in fact represents a plurality of VGAM2056 host target genes. The mRNA of each one of this plurality of VGAM2056 host target genes comprises one or more host target binding sites, each having a nucleotide sequence which is at least partly complementary to VGAM2056 RNA, herein designated VGAM RNA, and which when bound by VGAM2056 RNA causes inhibition of translation of respective one or more VGAM2056 host target proteins.

It is further appreciated by one skilled in the art that the mode of translational inhibition illustrated by FIG. 1 with specific reference to translational inhibition exerted by VGAM2056 gene, herein designated VGAM GENE, on one or more VGAM2056 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2056 is inhibition of expression of host target genes, as part of a novel viral mechanism of attacking a host. Accordingly, utilities of VGAM2056 include diagnosis, prevention and treatment of viral infection by Peanut Bud Necrosis Virus. Specific functions, and accordingly utilities, of VGAM2056 correlate with, and may be deduced from, the identity of the host target genes which VGAM2056 binds and inhibits, and the function of these host target genes, as elaborated hereinbelow.

Nucleotide sequences of the VGAM2056 precursor RNA, herein designated VGAM PRECURSOR RNA, and of the 'diced' VGAM2056 RNA, herein designated VGAM RNA, and a schematic representation of the secondary folding of VGAM2056 folded precursor RNA, herein designated VGAM FOLDED PRECURSOR RNA, of VGAM2056 are further described hereinbelow with reference to Table 1.

Nucleotide sequences of host target binding sites, such as BINDING SITE-I, BINDING SITE-II and BINDING SITE-III of FIG. 1, found on VGAM2056 host target RNA, and schematic representation of the complementarity of each of these host target binding sites to VGAM2056 RNA, herein designated VGAM RNA, are described hereinbelow with reference to Table 2.

As mentioned hereinabove with reference to FIG. 1, a function of VGAM2056 gene, herein designated VGAM is inhibition of expression of VGAM2056 target genes. It is appreciated that specific functions, and accordingly utilities, of VGAM2056 correlate with, and may be deduced from, the identity of the target genes which VGAM2056 binds and inhibits, and the function of these target genes, as elaborated hereinbelow.

Amyotrophic Lateral Sclerosis 2 (juvenile) (ALS2, Accession NM_020919) is a VGAM2056 host target gene. ALS2 BINDING SITE is HOST TARGET binding site found in the 3' untranslated region of mRNA encoded by ALS2, corresponding to a HOST TARGET binding site such as BINDING SITE I, BINDING SITE II or BINDING SITE III. Table 2 illustrates the complementarity of the nucleotide sequences of ALS2 BINDING SITE, designated SEQ ID:21930, to the nucleotide sequence of VGAM2056 RNA, herein designated VGAM RNA, also designated SEQ ID:4767.

A function of VGAM2056 is therefore inhibition of Amyotrophic Lateral Sclerosis 2 (juvenile) (ALS2, Accession NM_020919). Accordingly, utilities of VGAM2056 include diagnosis, prevention and treatment of diseases and clinical conditions associated with ALS2. UDP-Gal:betaGlcNAc Beta 1,3-galactosyltransferase, Polypeptide 2 (B3GALT2, Accession NM_003783) is another VGAM2056 host target gene. B3GALT2 BINDING SITE is HOST TARGET binding site found in the 5' untranslated region of mRNA encoded by B3GALT2, corresponding to a HOST TARGET binding site such as BINDING SITE I, BINDING SITE II or BINDING SITE III. Table 2 illustrates the complementarity of the nucleotide sequences of B3GALT2 BINDING SITE, designated SEQ ID:9873, to the nucleotide sequence of VGAM2056 RNA, herein designated VGAM RNA, also designated SEQ ID:4767.

Another function of VGAM2056 is therefore inhibition of UDP-Gal:betaGlcNAc Beta 1,3-galactosyltransferase, Polypeptide 2 (B3GALT2, Accession NM_003783). Accordingly, utilities of VGAM2056 include diagnosis, prevention and treatment of diseases and clinical conditions associated with B3GALT2. Nuclear RNA Export Factor 2 (NXF2, Accession NM_017809) is another VGAM2056 host target gene. NXF2 BINDING SITE is HOST TARGET binding site found in the 5' untranslated region of mRNA encoded by NXF2, corresponding to a HOST TARGET binding site such as BINDING SITE I, BINDING SITE II or BINDING SITE III. Table 2 illustrates the complementarity of the nucleotide sequences of NXF2 BINDING SITE, designated SEQ ID:19456, to the nucleotide sequence of VGAM2056 RNA, herein designated VGAM RNA, also designated SEQ ID:4767.

Another function of VGAM2056 is therefore inhibition of Nuclear RNA Export Factor 2 (NXF2, Accession NM_017809), a gene which is involved in the export of mrna from the nucleus to the cytoplasm. Accordingly, utilities of VGAM2056 include diagnosis, prevention and treatment of diseases and clinical conditions associated with NXF2. The function of NXF2 and its association with various diseases and clinical conditions, has been established by previous studies, as described hereinabove with reference to VGAM595. DKFZP434C1715 (Accession XM_098421) is another VGAM2056 host target gene. DKFZP434C1715 BINDING SITE is HOST TARGET binding site found in the 3' untranslated region of mRNA encoded by DKFZP434C1715, corresponding to a HOST TARGET binding site such as BINDING SITE I, BINDING SITE II or BINDING SITE III. Table 2 illustrates the complementarity of the nucleotide sequences of DKFZP434C1715 BINDING SITE, designated SEQ ID:41678, to the nucleotide sequence of VGAM2056 RNA, herein designated VGAM RNA, also designated SEQ ID:4767.

Another function of VGAM2056 is therefore inhibition of DKFZP434C1715 (Accession XM_098421). Accordingly, utilities of VGAM2056 include diagnosis, prevention and treatment of diseases and clinical conditions associated with DKFZP434C1715. KIAA1831 (Accession XM_033366) is another VGAM2056 host target gene. KIAA1831 BINDING SITE is HOST TARGET binding site found in the 5' untranslated region of mRNA encoded by KIAA1831, corresponding to a HOST TARGET binding site such as BINDING SITE I, BINDING SITE II or BINDING SITE III. Table 2 illustrates the complementarity of the nucleotide sequences of KIAA1831 BINDING SITE, designated SEQ ID:31900, to the nucleotide sequence of VGAM2056 RNA, herein designated VGAM RNA, also designated SEQ ID:4767.

Another function of VGAM2056 is therefore inhibition of KIAA1831 (Accession XM_033366). Accordingly, utilities of VGAM2056 include diagnosis, prevention and treatment of diseases and clinical conditions associated with KIAA1831. MGC16824 (Accession NM_020314) is another VGAM2056 host target gene. MGC16824 BINDING SITE is HOST TARGET binding site found in the 5' untranslated region of mRNA encoded by MGC16824, corresponding to a HOST TARGET binding site such as BINDING SITE I, BINDING SITE II or BINDING SITE III. Table 2 illustrates the complementarity of the nucleotide sequences of MGC16824 BINDING SITE, designated SEQ ID:21571, to the nucleotide sequence of VGAM2056 RNA, herein designated VGAM RNA, also designated SEQ ID:4767.

Another function of VGAM2056 is therefore inhibition of MGC16824 (Accession NM_020314). Accordingly, utilities of VGAM2056 include diagnosis, prevention and treatment of diseases and clinical conditions associated with MGC16824. MGC4562 (Accession NM_133375) is another VGAM2056 host target gene. MGC4562 BINDING SITE is HOST TARGET binding site found in the 5' untranslated region of mRNA encoded by MGC4562, corresponding to a HOST TARGET binding site such as BINDING SITE I, BINDING SITE II or BINDING SITE III. Table 2 illustrates the complementarity of the nucleotide sequences of MGC4562 BINDING SITE, designated SEQ ID:28498, to the nucleotide sequence of VGAM2056 RNA, herein designated VGAM RNA, also designated SEQ ID:4767.

Another function of VGAM2056 is therefore inhibition of MGC4562 (Accession NM_133375). Accordingly, utilities of VGAM2056 include diagnosis, prevention and treatment of diseases and clinical conditions associated with MGC4562. RAB10, Member RAS Oncogene Family (RAB10, Accession XM_097979) is another VGAM2056 host target gene. RAB10 BINDING SITE is HOST TARGET binding site found in the 3' untranslated region of mRNA encoded by RAB10, corresponding to a HOST TARGET binding site such as BINDING SITE I, BINDING SITE II or BINDING SITE III. Table 2 illustrates the complementarity of the nucleotide sequences of RAB10 BINDING SITE, designated SEQ ID:41284, to the nucleotide sequence of VGAM2056 RNA, herein designated VGAM RNA, also designated SEQ ID:4767.

Another function of VGAM2056 is therefore inhibition of RAB10, Member RAS Oncogene Family (RAB10, Accession XM_097979). Accordingly, utilities of VGAM2056 include diagnosis, prevention and treatment of diseases and clinical conditions associated with RAB10. LOC221362 (Accession XM_168093) is another VGAM2056 host target gene. LOC221362 BINDING SITE is HOST TARGET binding site found in the 3' untranslated region of mRNA encoded by LOC221362, corresponding to a HOST TARGET binding site such as BINDING SITE I, BINDING SITE II or BINDING SITE III. Table 2 illustrates the complementarity of the nucleotide sequences of LOC221362 BINDING SITE, designated SEQ ID:45024, to the nucleotide sequence of VGAM2056 RNA, herein designated VGAM RNA, also designated SEQ ID:4767.

Another function of VGAM2056 is therefore inhibition of LOC221362 (Accession XM_168093). Accordingly, utilities of VGAM2056 include diagnosis, prevention and treatment of diseases and clinical conditions associated with LOC221362. FIG. 1 further provides a conceptual description of a novel bioinformatically detected viral gene of the present invention, referred to here as Viral Genomic Address Messenger 2057 (VGAM2057) viral gene, which modulates expression of respective host target genes thereof, the function and utility of which host target genes is known in the art.

VGAM2057 is a novel bioinformatically detected regulatory, non protein coding, viral micro RNA (miRNA) gene. The method by which VGAM2057 was detected is described hereinabove with reference to FIGS. 1-8.

VGAM2057 gene, herein designated VGAM GENE, is a viral gene contained in the genome of Ectromelia Virus. VGAM2057 host target gene, herein designated VGAM HOST TARGET GENE, is a human gene contained in the human genome.

VGAM2057 gene encodes a VGAM2057 precursor RNA, herein designated VGAM PRECURSOR RNA. Similar to other miRNA genes, and unlike most ordinary genes, VGAM2057 precursor RNA does not encode a protein. A nucleotide sequence identical or highly similar to the nucleotide sequence of VGAM2057 precursor RNA is designated SEQ ID:2043, and is provided hereinbelow with reference to the sequence listing part. Nucleotide sequence SEQ ID:2043 is located at position 3968 relative to the genome of Ectromelia Virus.

VGAM2057 precursor RNA folds onto itself, forming VGAM2057 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2057 folded precursor RNA into VGAM2057 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 69%) nucleotide sequence of VGAM2057 RNA is designated SEQ ID:4768, and is provided hereinbelow with reference to the sequence listing part.

VGAM2057 host target gene, herein designated VGAM HOST TARGET GENE, encodes a corresponding messenger RNA, VGAM2057 host target RNA, herein designated VGAM HOST TARGET RNA. VGAM2057 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2057 RNA, herein designated VGAM RNA, binds complementarily to one or more host target binding sites located in untranslated regions of VGAM2057 host target RNA, herein designated VGAM HOST TARGET RNA. This complementary binding is due to the fact that the nucleotide sequence of VGAM2057 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2057 RNA, herein designated VGAM RNA, may have a different number of host target binding sites in untranslated regions of a VGAM2057 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2057 RNA, herein designated VGAM RNA, to host target binding sites on VGAM2057 host target RNA, herein designated VGAM HOST TARGET RNA, such as BINDING SITE I, BINDING SITE II and BINDING SITE III, inhibits translation of VGAM2057 host target RNA into VGAM2057 host target protein, herein designated VGAM HOST TARGET PROTEIN. VGAM host target protein is therefore outlined by a broken line.

It is appreciated that VGAM2057 host target gene, herein designated VGAM HOST TARGET GENE, in fact represents a plurality of VGAM2057 host target genes. The mRNA of each one of this plurality of VGAM2057 host target genes comprises one or more host target binding sites, each having a nucleotide sequence which is at least partly complementary to VGAM2057 RNA, herein designated VGAM RNA, and which when bound by VGAM2057 RNA causes inhibition of translation of respective one or more VGAM2057 host target proteins.

It is further appreciated by one skilled in the art that the mode of translational inhibition illustrated by FIG. 1 with specific reference to translational inhibition exerted by VGAM2057 gene, herein designated VGAM GENE, on one or more VGAM2057 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2057 is inhibition of expression of host target genes, as part of a novel viral mechanism of attacking a host. Accordingly, utilities of VGAM2057 include diagnosis, prevention and treatment of viral infection by Ectromelia Virus. Specific functions, and accordingly utilities, of VGAM2057 correlate with, and may be deduced from, the identity of the host target genes which VGAM2057 binds and inhibits, and the function of these host target genes, as elaborated hereinbelow.

Nucleotide sequences of the VGAM2057 precursor RNA, herein designated VGAM PRECURSOR RNA, and of the 'diced' VGAM2057 RNA, herein designated VGAM RNA, and a schematic representation of the secondary folding of VGAM2057 folded precursor RNA, herein designated VGAM FOLDED PRECURSOR RNA, of VGAM2057 are further described hereinbelow with reference to Table 1.

Nucleotide sequences of host target binding sites, such as BINDING SITE-I, BINDING SITE-II and BINDING SITE-III of FIG. 1, found on VGAM2057 host target RNA, and schematic representation of the complementarity of each of these host target binding sites to VGAM2057 RNA, herein designated VGAM RNA, are described hereinbelow with reference to Table 2.

As mentioned hereinabove with reference to FIG. 1, a function of VGAM2057 gene, herein designated VGAM is inhibition of expression of VGAM2057 target genes. It is appreciated that specific functions, and accordingly utilities, of VGAM2057 correlate with, and may be deduced from, the identity of the target genes which VGAM2057 binds and inhibits, and the function of these target genes, as elaborated hereinbelow.

FYVE and Coiled-coil Domain Containing 1 (FYCO1, Accession NM_024513) is a VGAM2057 host target gene. FYCO1 BINDING SITE is HOST TARGET binding site found in the 3' untranslated region of mRNA encoded by FYCO1, corresponding to a HOST TARGET binding site such as BINDING SITE I, BINDING SITE II or BINDING SITE III. Table 2 illustrates the complementarity of the nucleotide sequences of FYCO1 BINDING SITE, designated SEQ ID:23712, to the nucleotide sequence of VGAM2057 RNA, herein designated VGAM RNA, also designated SEQ ID:4768.

A function of VGAM2057 is therefore inhibition of FYVE and Coiled-coil Domain Containing 1 (FYCO1, Accession NM_024513). Accordingly, utilities of VGAM2057 include diagnosis, prevention and treatment of diseases and clinical conditions associated with FYCO1. FIG. 1 further provides a conceptual description of a novel bioinformatically detected viral gene of the present invention, referred to here as Viral Genomic Address Messenger 2058 (VGAM2058) viral gene, which modulates expression of respective host target genes thereof, the function and utility of which host target genes is known in the art.

VGAM2058 is a novel bioinformatically detected regulatory, non protein coding, viral micro RNA (miRNA) gene. The method by which VGAM2058 was detected is described hereinabove with reference to FIGS. 1-8.

VGAM2058 gene, herein designated VGAM GENE, is a viral gene contained in the genome of Peanut Bud Necrosis Virus. VGAM2058 host target gene, herein designated VGAM HOST TARGET GENE, is a human gene contained in the human genome.

VGAM2058 gene encodes a VGAM2058 precursor RNA, herein designated VGAM PRECURSOR RNA. Similar to other miRNA genes, and unlike most ordinary genes, VGAM2058 precursor RNA does not encode a protein. A nucleotide sequence identical or highly similar to the nucleotide sequence of VGAM2058 precursor RNA is designated SEQ ID:2044, and is provided hereinbelow with reference to the sequence listing part. Nucleotide sequence SEQ ID:2044 is located at position 4967 relative to the genome of Peanut Bud Necrosis Virus.

VGAM2058 precursor RNA folds onto itself, forming VGAM2058 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2058 folded precursor RNA into VGAM2058 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM2058 RNA is designated SEQ ID:4769, and is provided hereinbelow with reference to the sequence listing part.

VGAM2058 host target gene, herein designated VGAM HOST TARGET GENE, encodes a corresponding messenger RNA, VGAM2058 host target RNA, herein designated VGAM HOST TARGET RNA. VGAM2058 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2058 RNA, herein designated VGAM RNA, binds complementarily to one or more host target binding sites located in untranslated regions of VGAM2058 host target RNA, herein designated VGAM HOST TARGET RNA. This complementary binding is due to the fact that the nucleotide sequence of VGAM2058 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2058 RNA, herein designated VGAM RNA, may have a different number of host target binding sites in untranslated regions of a VGAM2058 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2058 RNA, herein designated VGAM RNA, to host target binding sites on VGAM2058 host target RNA, herein designated VGAM HOST TARGET RNA, such as BINDING SITE I, BINDING SITE II and BINDING SITE III, inhibits translation of VGAM2058 host target RNA into VGAM2058 host target protein, herein designated VGAM HOST TARGET PROTEIN. VGAM host target protein is therefore outlined by a broken line.

It is appreciated that VGAM2058 host target gene, herein designated VGAM HOST TARGET GENE, in fact represents a plurality of VGAM2058 host target genes. The mRNA of each one of this plurality of VGAM2058 host target genes comprises one or more host target binding sites, each having a nucleotide sequence which is at least partly complementary to VGAM2058 RNA, herein designated VGAM RNA, and which when bound by VGAM2058 RNA causes inhibition of translation of respective one or more VGAM2058 host target proteins.

It is further appreciated by one skilled in the art that the mode of translational inhibition illustrated by FIG. 1 with specific reference to translational inhibition exerted by VGAM2058 gene, herein designated VGAM GENE, on one or more VGAM2058 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2058 is inhibition of expression of host target genes, as part of a novel viral mechanism of attacking a host. Accordingly, utilities of VGAM2058 include diagnosis, prevention and treatment of viral infection by Peanut Bud Necrosis Virus. Specific functions, and accordingly utilities, of VGAM2058 correlate with, and may be deduced from, the identity of the host target genes which VGAM2058 binds and inhibits, and the function of these host target genes, as elaborated hereinbelow.

Nucleotide sequences of the VGAM2058 precursor RNA, herein designated VGAM PRECURSOR RNA, and of the 'diced' VGAM2058 RNA, herein designated VGAM RNA, and a schematic representation of the secondary folding of VGAM2058 folded precursor RNA, herein designated VGAM FOLDED PRECURSOR RNA, of VGAM2058 are further described hereinbelow with reference to Table 1.

Nucleotide sequences of host target binding sites, such as BINDING SITE-I, BINDING SITE-II and BINDING SITE-III of FIG. 1, found on VGAM2058 host target RNA, and schematic representation of the complementarity of each of these host target binding sites to VGAM2058 RNA, herein designated VGAM RNA, are described hereinbelow with reference to Table 2.

As mentioned hereinabove with reference to FIG. 1, a function of VGAM2058 gene, herein designated VGAM is inhibition of expression of VGAM2058 target genes. It is appreciated that specific functions, and accordingly utilities, of VGAM2058 correlate with, and may be deduced from, the identity of the target genes which VGAM2058 binds and inhibits, and the function of these target genes, as elaborated hereinbelow.

Adenosine Deaminase, RNA-specific (ADAR, Accession NM_001111) is a VGAM2058 host target gene. ADAR BINDING SITE1 through ADAR BINDING SITE3 are HOST TARGET binding sites found in untranslated regions of mRNA encoded by ADAR, corresponding to HOST TARGET binding sites such as BINDING SITE I, BINDING SITE II or BINDING SITE III. Table 2 illustrates the complementarity of the nucleotide sequences of ADAR BINDING SITE1 through ADAR BINDING SITE3, designated SEQ ID:6770, SEQ ID:17956 and SEQ ID:17963 respectively, to the nucleotide sequence of VGAM2058 RNA, herein designated VGAM RNA, also designated SEQ ID:4769.

A function of VGAM2058 is therefore inhibition of Adenosine Deaminase, RNA-specific (ADAR, Accession NM_001111), a gene which converts adenosine to inosine in double-stranded RNA. Accordingly, utilities of VGAM2058 include diagnosis, prevention and treatment of diseases and clinical conditions associated with ADAR. The function of ADAR and its association with various diseases and clinical conditions, has been established by previous studies, as described hereinabove with reference to VGAM323. Collagen, Type IV, Alpha 3 (Goodpasture antigen) (COL4A3, Accession NM_031363) is another VGAM2058 host target gene. COL4A3 BINDING SITE1 through COL4A3 BINDING SITE3 are HOST TARGET binding sites found in untranslated regions of mRNA encoded by COL4A3, corresponding to HOST TARGET binding sites such as BINDING SITE I, BINDING SITE II or BINDING SITE III. Table 2 illustrates the complementarity of the nucleotide sequences of COL4A3 BINDING SITE1 through COL4A3 BINDING SITE3, designated SEQ ID:25353, SEQ ID:5546 and SEQ ID:35916 respectively, to the nucleotide sequence of VGAM2058 RNA, herein designated VGAM RNA, also designated SEQ ID:4769.

Another function of VGAM2058 is therefore inhibition of Collagen, Type IV, Alpha 3 (Goodpasture antigen) (COL4A3, Accession NM_031363). Accordingly, utilities of VGAM2058 include diagnosis, prevention and treatment of diseases and clinical conditions associated with COL4A3. Nuclear Receptor Subfamily 1, Group I, Member 2 (NR1I2, Accession NM_022002) is another VGAM2058 host target gene. NR1I2 BINDING SITE1 and NR1I2 BINDING SITE2 are HOST TARGET binding sites found in untranslated regions of mRNA encoded by NR1I2, corresponding to HOST TARGET binding sites such as BINDING SITE I, BINDING SITE II or BINDING SITE III. Table 2 illustrates the complementarity of the nucleotide sequences of NR1I2 BINDING SITE1 and NR1I2 BINDING SITE2, designated SEQ ID:22545 and SEQ ID:9972 respectively, to the nucleotide sequence of VGAM2058 RNA, herein designated VGAM RNA, also designated SEQ ID:4769.

Another function of VGAM2058 is therefore inhibition of Nuclear Receptor Subfamily 1, Group I, Member 2 (NR1I2, Accession NM_022002), a gene which binds to a response element in the cyp3a4 gene promoter and activates its expression in response to a wide variety of endobiotics and xenobiotics. Accordingly, utilities of VGAM2058 include diagnosis, prevention and treatment of diseases and clinical conditions associated with NR1I2. The function of NR1I2 and its association with various diseases and clinical conditions, has been established by previous studies, as described hereinabove with reference to VGAM336. Solute Carrier Family 9 (sodium/hydrogen exchanger), Isoform 6 (SLC9A6, Accession NM_006359) is another VGAM2058 host target gene. SLC9A6 BINDING SITE is HOST TARGET binding site found in the 3' untranslated region of mRNA encoded by SLC9A6, corresponding to a HOST TARGET binding site such as BINDING SITE I, BINDING SITE II or BINDING SITE III. Table 2 illustrates the complementarity of the nucleotide sequences of SLC9A6 BINDING SITE, designated SEQ ID:13053, to the nucleotide sequence of VGAM2058 RNA, herein designated VGAM RNA, also designated SEQ ID:4769.

Another function of VGAM2058 is therefore inhibition of Solute Carrier Family 9 (sodium/hydrogen exchanger), Isoform 6 (SLC9A6, Accession NM_006359), a gene which is involved electroneutral exchange of protons for na+ and k+ across the mitochondrial inner membrane. Accordingly, utilities of VGAM2058 include diagnosis, prevention and treatment of diseases and clinical conditions associated with SLC9A6. The function of SLC9A6 and its association with various diseases and clinical conditions, has been established by previous studies, as described hereinabove with reference to VGAM493. Tumor Necrosis Factor (ligand) Superfamily, Member 4 (tax-transcriptionally activated glycoprotein 1, 34 kDa) (TNFSF4, Accession NM_003326) is another VGAM2058 host target gene. TNFSF4 BINDING SITE is HOST TARGET binding site found in the 3' untranslated region of mRNA encoded by TNFSF4, corresponding to a HOST TARGET binding site such as BINDING SITE I, BINDING SITE II or BINDING SITE III. Table 2 illustrates the complementarity of the nucleotide sequences of TNFSF4 BINDING SITE, designated SEQ ID:9334, to the nucleotide sequence of VGAM2058 RNA, herein designated VGAM RNA, also designated SEQ ID:4769.

Another function of VGAM2058 is therefore inhibition of Tumor Necrosis Factor (ligand) Superfamily, Member 4 (tax-transcriptionally activated glycoprotein 1, 34 kDa) (TNFSF4, Accession NM_003326), a gene which co-stimulates t cell proliferation and cytokine production. Accordingly, utilities of VGAM2058 include diagnosis, prevention and treatment of diseases and clinical conditions associated with TNFSF4. The function of TNFSF4 and its association with various diseases and clinical conditions, has been established by previous studies, as described hereinabove with reference to VGAM463. Agmatine Ureohydrolase (agmatinase) (AGMAT, Accession NM_024758) is another VGAM2058 host target gene. AGMAT BINDING SITE is HOST TARGET binding site found in the 3' untranslated region of mRNA encoded by AGMAT, corresponding to a HOST TARGET binding site such as BINDING SITE I, BINDING SITE II or BINDING SITE III. Table 2 illustrates the complementarity of the nucleotide sequences of AGMAT BINDING SITE, designated SEQ ID:24105, to the nucleotide sequence of VGAM2058 RNA, herein designated VGAM RNA, also designated SEQ ID:4769.

Another function of VGAM2058 is therefore inhibition of Agmatine Ureohydrolase (agmatinase) (AGMAT, Accession NM_024758). Accordingly, utilities of VGAM2058 include diagnosis, prevention and treatment of diseases and clinical conditions associated with AGMAT. ATPase, H+ Transporting, Lysosomal V0 Subunit A Isoform 1 (ATP6V0A1, Accession NM_005177) is another VGAM2058 host target gene. ATP6V0A1 BINDING SITE is HOST TARGET binding site found in the 3' untranslated region of mRNA encoded by ATP6V0A1, corresponding to a HOST TARGET binding site such as BINDING SITE I, BINDING SITE II or BINDING SITE III. Table 2 illustrates the complementarity of the nucleotide sequences of ATP6V0A1 BINDING SITE, designated SEQ ID:11675, to the nucleotide sequence of VGAM2058 RNA, herein designated VGAM RNA, also designated SEQ ID:4769.

Another function of VGAM2058 is therefore inhibition of ATPase, H+ Transporting, Lysosomal V0 Subunit A Isoform 1 (ATP6V0A1, Accession NM_005177). Accordingly, utilities of VGAM2058 include diagnosis, prevention and treatment of diseases and clinical conditions associated with ATP6V0A1. Cat Eye Syndrome Chromosome Region, Candidate 6 (CECR6, Accession NM_031890) is another VGAM2058 host target gene. CECR6 BINDING SITE is HOST TARGET binding site found in the 3' untranslated region of mRNA encoded by CECR6, corresponding to a HOST TARGET binding site such as BINDING SITE I, BINDING SITE II or BINDING SITE III. Table 2 illustrates the complementarity of the nucleotide sequences of CECR6 BINDING SITE, designated SEQ ID:25638, to the nucleotide sequence of VGAM2058 RNA, herein designated VGAM RNA, also designated SEQ ID:4769.

Another function of VGAM2058 is therefore inhibition of Cat Eye Syndrome Chromosome Region, Candidate 6 (CECR6, Accession NM_031890). Accordingly, utilities of VGAM2058 include diagnosis, prevention and treatment of diseases and clinical conditions associated with CECR6. Deiodinase, Iodothyronine, Type II (DIO2, Accession NM_013989) is another VGAM2058 host target gene. DIO2 BINDING SITE1 and DIO2 BINDING SITE2 are HOST TARGET binding sites found in untranslated regions of mRNA encoded by DIO2, corresponding to HOST TARGET binding sites such as BINDING SITE I, BINDING SITE II or BINDING SITE III. Table 2 illustrates the complementarity of the nucleotide sequences of DIO2 BINDING SITE1 and DIO2 BINDING SITE2, designated SEQ ID:15166 and SEQ ID:6456 respectively, to the nucleotide sequence of VGAM2058 RNA, herein designated VGAM RNA, also designated SEQ ID:4769.

Another function of VGAM2058 is therefore inhibition of Deiodinase, Iodothyronine, Type II (DIO2, Accession NM_013989). Accordingly, utilities of VGAM2058 include diagnosis, prevention and treatment of diseases and clinical conditions associated with DIO2. ERG-1 (Accession NM_022034) is another VGAM2058 host target gene. ERG-1 BINDING SITE is HOST TARGET binding site found in the 5' untranslated region of mRNA encoded by ERG-1, corresponding to a HOST TARGET binding site such as BINDING SITE I, BINDING SITE II or BINDING SITE III. Table 2 illustrates the complementarity of the nucleotide sequences of ERG-1 BINDING SITE, designated SEQ ID:22556, to the nucleotide sequence of VGAM2058 RNA, herein designated VGAM RNA, also designated SEQ ID:4769.

Another function of VGAM2058 is therefore inhibition of ERG-1 (Accession NM_022034). Accordingly, utilities of VGAM2058 include diagnosis, prevention and treatment of diseases and clinical conditions associated with ERG-1. FLJ14437 (Accession NM_032578) is another VGAM2058 host target gene. FLJ14437 BINDING SITE is HOST TARGET binding site found in the 5' untranslated region of mRNA encoded by FLJ14437, corresponding to a HOST TARGET binding site such as BINDING SITE I, BINDING SITE II or BINDING SITE III. Table 2 illustrates the complementarity of the nucleotide sequences of FLJ14437 BINDING SITE, designated SEQ ID:26307, to the nucleotide sequence of VGAM2058 RNA, herein designated VGAM RNA, also designated SEQ ID:4769.

Another function of VGAM2058 is therefore inhibition of FLJ14437 (Accession NM_032578). Accordingly, utilities of VGAM2058 include diagnosis, prevention and treatment of diseases and clinical conditions associated with FLJ14437. HCAP-G (Accession NM_022346) is another VGAM2058 host target gene. HCAP-G BINDING SITE is HOST TARGET binding site found in the 5' untranslated region of mRNA encoded by HCAP-G, corresponding to a HOST TARGET binding site such as BINDING SITE I, BINDING SITE II or BINDING SITE III. Table 2 illustrates the complementarity of the nucleotide sequences of HCAP-G BINDING SITE, designated SEQ ID:22746, to the nucleotide sequence of VGAM2058 RNA, herein designated VGAM RNA, also designated SEQ ID:4769.

Another function of VGAM2058 is therefore inhibition of HCAP-G (Accession NM_022346). Accordingly, utilities of VGAM2058 include diagnosis, prevention and treatment of diseases and clinical conditions associated with HCAP-G. KIAA0205 (Accession NM_014873) is another VGAM2058 host target gene. KIAA0205 BINDING SITE is HOST TARGET binding site found in the 3' untranslated region of mRNA encoded by KIAA0205, corresponding to a HOST TARGET binding site such as BINDING SITE I, BINDING SITE II or BINDING SITE III. Table 2 illustrates the complementarity of the nucleotide sequences of KIAA0205 BINDING SITE, designated SEQ ID:17003, to the nucleotide sequence of VGAM2058 RNA, herein designated VGAM RNA, also designated SEQ ID:4769.

Another function of VGAM2058 is therefore inhibition of KIAA0205 (Accession NM_014873). Accordingly, utilities of VGAM2058 include diagnosis, prevention and treatment of diseases and clinical conditions associated with KIAA0205. MGC4737 (Accession NM_031466) is another VGAM2058 host target gene. MGC4737 BINDING SITE is HOST TARGET binding site found in the 3' untranslated region of mRNA encoded by MGC4737, corresponding to a HOST TARGET binding site such as BINDING SITE I, BINDING SITE II or BINDING SITE III. Table 2 illustrates the complementarity of the nucleotide sequences of MGC4737 BINDING SITE, designated SEQ ID:25504, to the nucleotide sequence of VGAM2058 RNA, herein designated VGAM RNA, also designated SEQ ID:4769.

Another function of VGAM2058 is therefore inhibition of MGC4737 (Accession NM_031466). Accordingly, utilities of VGAM2058 include diagnosis, prevention and treatment of diseases and clinical conditions associated with MGC4737. START Domain Containing 7 (STARD7, Accession NM_139267) is another VGAM2058 host target gene. STARD7 BINDING SITE1 and STARD7 BINDING SITE2 are HOST TARGET binding sites found in untranslated regions of mRNA encoded by STARD7, corresponding to HOST TARGET binding sites such as BINDING SITE I, BINDING SITE II or BINDING SITE III. Table 2 illustrates the complementarity of the nucleotide sequences of STARD7 BINDING SITE1 and STARD7 BINDING SITE2, designated SEQ ID:29263 and SEQ ID:21361 respectively, to the nucleotide sequence of VGAM2058 RNA, herein designated VGAM RNA, also designated SEQ ID:4769.

Another function of VGAM2058 is therefore inhibition of START Domain Containing 7 (STARD7, Accession NM_139267). Accordingly, utilities of VGAM2058 include diagnosis, prevention and treatment of diseases and clinical conditions associated with STARD7. LOC131368 (Accession XM_067347) is another VGAM2058 host target gene. LOC131368 BINDING SITE is HOST TARGET binding site found in the 3' untranslated region of mRNA encoded by LOC131368, corresponding to a HOST TARGET binding site such as BINDING SITE I, BINDING SITE II or BINDING SITE III. Table 2 illustrates the complementarity of the nucleotide sequences of LOC131368 BINDING SITE, designated SEQ ID:37354, to the nucleotide sequence of VGAM2058 RNA, herein designated VGAM RNA, also designated SEQ ID:4769.

Another function of VGAM2058 is therefore inhibition of LOC131368 (Accession XM_067347). Accordingly, utilities of VGAM2058 include diagnosis, prevention and treatment of diseases and clinical conditions associated with LOC131368. LOC148930 (Accession XM_086369) is another VGAM2058 host target gene. LOC148930 BINDING SITE is HOST TARGET binding site found in the 3' untranslated region of mRNA encoded by LOC148930, corresponding to a HOST TARGET binding site such as BINDING SITE I, BINDING SITE II or BINDING SITE III. Table 2 illustrates the complementarity of the nucleotide sequences of LOC148930 BINDING SITE, designated SEQ ID:38617, to the nucleotide sequence of VGAM2058 RNA, herein designated VGAM RNA, also designated SEQ ID:4769.

Another function of VGAM2058 is therefore inhibition of LOC148930 (Accession XM_086369). Accordingly, utilities of VGAM2058 include diagnosis, prevention and treatment of diseases and clinical conditions associated with LOC148930. LOC149506 (Accession XM_097661) is another VGAM2058 host target gene. LOC149506 BINDING SITE is HOST TARGET binding site found in the 5' untranslated region of mRNA encoded by LOC149506, corresponding to a HOST TARGET binding site such as BINDING SITE I, BINDING SITE II or BINDING SITE III. Table 2 illustrates the complementarity of the nucleotide sequences of LOC149506 BINDING SITE, designated SEQ ID:41001, to the nucleotide sequence of VGAM2058 RNA, herein designated VGAM RNA, also designated SEQ ID:4769.

Another function of VGAM2058 is therefore inhibition of LOC149506 (Accession XM_097661). Accordingly, utilities of VGAM2058 include diagnosis, prevention and treatment of diseases and clinical conditions associated with LOC149506. LOC158434 (Accession XM_098939) is another VGAM2058 host target gene. LOC158434 BINDING SITE is HOST TARGET binding site found in the 5' untranslated region of mRNA encoded by LOC158434, corresponding to a HOST TARGET binding site such as BINDING SITE I, BINDING SITE II or BINDING SITE III. Table 2 illustrates the complementarity of the nucleotide sequences of LOC158434 BINDING SITE, designated SEQ ID:41983, to the nucleotide sequence of VGAM2058 RNA, herein designated VGAM RNA, also designated SEQ ID:4769.

Another function of VGAM2058 is therefore inhibition of LOC158434 (Accession XM_098939). Accordingly, utilities of VGAM2058 include diagnosis, prevention and treatment of diseases and clinical conditions associated with LOC158434. LOC196955 (Accession XM_085210) is another VGAM2058 host target gene. LOC196955 BINDING SITE is HOST TARGET binding site found in the 3' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37930, to the nucleotide sequence of VGAM2058 RNA, herein designated VGAM RNA, also designated SEQ ID:4769.

Another function of VGAM2058 is therefore inhibition of LOC196955 (Accession XM_085210). Accordingly, utilities of VGAM2058 include diagnosis, prevention and treatment of diseases and clinical conditions associated with LOC196955. LOC256789 (Accession XM_173369) is another VGAM2058 host target gene. LOC256789 BINDING SITE is HOST TARGET binding site found in the 3' untranslated region of mRNA encoded by LOC256789, corresponding to a HOST TARGET binding site such as BINDING SITE I, BINDING SITE II or BINDING SITE III. Table 2 illustrates the complementarity of the nucleotide sequences of LOC256789 BINDING SITE, designated SEQ ID:46538, to the nucleotide sequence of VGAM2058 RNA, herein designated VGAM RNA, also designated SEQ ID:4769.

Another function of VGAM2058 is therefore inhibition of LOC256789 (Accession XM_173369). Accordingly, utilities of VGAM2058 include diagnosis, prevention and treatment of diseases and clinical conditions associated with LOC256789. FIG. 1 further provides a conceptual description of a novel bioinformatically detected viral gene of the present invention, referred to here as Viral Genomic Address Messenger 2059 (VGAM2059) viral gene, which modulates expression of respective host target genes thereof, the function and utility of which host target genes is known in the art.

VGAM2059 is a novel bioinformatically detected regulatory, non protein coding, viral micro RNA (miRNA) gene. The method by which VGAM2059 was detected is described hereinabove with reference to FIGS. 1-8.

VGAM2059 gene, herein designated VGAM GENE, is a viral gene contained in the genome of Ectromelia Virus. VGAM2059 host target gene, herein designated VGAM HOST TARGET GENE, is a human gene contained in the human genome.

VGAM2059 gene encodes a VGAM2059 precursor RNA, herein designated VGAM PRECURSOR RNA. Similar to other miRNA genes, and unlike most ordinary genes, VGAM2059 precursor RNA does not encode a protein. A nucleotide sequence identical or highly similar to the nucleotide sequence of VGAM2059 precursor RNA is designated SEQ ID:2045, and is provided hereinbelow with reference to the sequence listing part. Nucleotide sequence SEQ ID:2045 is located at position 15250 relative to the genome of Ectromelia Virus.

VGAM2059 precursor RNA folds onto itself, forming VGAM2059 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2059 folded precursor RNA into VGAM2059 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2059 RNA is designated SEQ ID:4770, and is provided hereinbelow with reference to the sequence listing part.

VGAM2059 host target gene, herein designated VGAM HOST TARGET GENE, encodes a corresponding messenger RNA, VGAM2059 host target RNA, herein designated VGAM HOST TARGET RNA. VGAM2059 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2059 RNA, herein designated VGAM RNA, binds complementarily to one or more host target binding sites located in untranslated regions of VGAM2059 host target RNA, herein designated VGAM HOST TARGET RNA. This complementary binding is due to the fact that the nucleotide sequence of VGAM2059 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2059 RNA, herein designated VGAM RNA, may have a different number of host target binding sites in untranslated regions of a VGAM2059 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2059 RNA, herein designated VGAM RNA, to host target binding sites on VGAM2059 host target RNA, herein designated VGAM HOST TARGET RNA, such as BINDING SITE I, BINDING SITE II and BINDING SITE III, inhibits translation of VGAM2059 host target RNA into VGAM2059 host target protein, herein designated VGAM HOST TARGET PROTEIN. VGAM host target protein is therefore outlined by a broken line.

It is appreciated that VGAM2059 host target gene, herein designated VGAM HOST TARGET GENE, in fact represents a plurality of VGAM2059 host target genes. The mRNA of each one of this plurality of VGAM2059 host target genes comprises one or more host target binding sites, each having a nucleotide sequence which is at least partly complementary to VGAM2059 RNA, herein designated VGAM RNA, and which when bound by VGAM2059 RNA causes inhibition of translation of respective one or more VGAM2059 host target proteins.

It is further appreciated by one skilled in the art that the mode of translational inhibition illustrated by FIG. 1 with specific reference to translational inhibition exerted by VGAM2059 gene, herein designated VGAM GENE, on one or more VGAM2059 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2059 is inhibition of expression of host target genes, as part of a novel viral mechanism of attacking a host. Accordingly, utilities of VGAM2059 include diagnosis, prevention and treatment of viral infection by Ectromelia Virus. Specific functions, and accordingly utilities, of VGAM2059 correlate with, and may be deduced from, the identity of the host target genes which VGAM2059 binds and inhibits, and the function of these host target genes, as elaborated hereinbelow.

Nucleotide sequences of the VGAM2059 precursor RNA, herein designated VGAM PRECURSOR RNA, and of the 'diced' VGAM2059 RNA, herein designated VGAM RNA, and a schematic representation of the secondary folding of VGAM2059 folded precursor RNA, herein designated VGAM FOLDED PRECURSOR RNA, of VGAM2059 are further described hereinbelow with reference to Table 1.

Nucleotide sequences of host target binding sites, such as BINDING SITE-I, BINDING SITE-II and BINDING SITE-III of FIG. 1, found on VGAM2059 host target RNA, and schematic representation of the complementarity of each of these host target binding sites to VGAM2059 RNA, herein designated VGAM RNA, are described hereinbelow with reference to Table 2.

As mentioned hereinabove with reference to FIG. 1, a function of VGAM2059 gene, herein designated VGAM is inhibition of expression of VGAM2059 target genes. It is appreciated that specific functions, and accordingly utilities, of VGAM2059 correlate with, and may be deduced from, the identity of the target genes which VGAM2059 binds and inhibits, and the function of these target genes, as elaborated hereinbelow.

Deleted In Azoospermia (DAZ, Accession NM_004081) is a VGAM2059 host target gene. DAZ BINDING SITE is HOST TARGET binding site found in the 3" untranslated region of mRNA encoded by DAZ, corresponding to a HOST TARGET binding site such as BINDING SITE I, BINDING SITE II or BINDING SITE III. Table 2 illustrates the complementarity of the nucleotide sequences of DAZ BINDING SITE, designated SEQ ID:10282, to the nucleotide sequence of VGAM2059 RNA, herein designated VGAM RNA, also designated SEQ ID:4770.

A function of VGAM2059 is therefore inhibition of Deleted In Azoospermia (DAZ, Accession NM_004081), a gene which may play a role in the germ-cell-specific patterns of RNA splicing and storage. Accordingly, utilities of VGAM2059 include diagnosis, prevention and treatment of diseases and clinical conditions associated with DAZ. The function of DAZ and its association with various diseases and clinical conditions, has been established by previous studies, as described hereinabove with reference to VGAM206. Deleted In Azoospermia-like (DAZL, Accession XM_042839) is another VGAM2059 host target gene. DAZL BINDING SITE is HOST TARGET binding site found in the 3' untranslated region of mRNA encoded by DAZL, corresponding to a HOST TARGET binding site such as BINDING SITE I, BINDING SITE II or BINDING SITE III. Table 2 illustrates the complementarity of the nucleotide sequences of DAZL BINDING SITE, designated SEQ ID:33801, to the nucleotide sequence of VGAM2059 RNA, herein designated VGAM RNA, also designated SEQ ID:4770.

Another function of VGAM2059 is therefore inhibition of Deleted In Azoospermia-like (DAZL, Accession XM_042839), a gene which may be essential for gametogenesis. Accordingly, utilities of VGAM2059 include diagnosis, prevention and treatment of diseases and clinical conditions associated with DAZL. The function of DAZL and its association with various diseases and clinical conditions, has been established by previous studies, as described hereinabove with reference to VGAM206. FLJ20330 (Accession NM_018988) is another VGAM2059 host target gene. FLJ20330 BINDING SITE is HOST TARGET binding site found in the 5' untranslated region of mRNA encoded by FLJ20330, corresponding to a HOST TARGET binding site such as BINDING SITE I, BINDING SITE II or BINDING SITE III. Table 2 illustrates the complementarity of the nucleotide sequences of FLJ20330 BINDING SITE, designated SEQ ID:21060, to the nucleotide sequence of VGAM2059 RNA, herein designated VGAM RNA, also designated SEQ ID:4770.

Another function of VGAM2059 is therefore inhibition of FLJ20330 (Accession NM_018988). Accordingly, utilities of VGAM2059 include diagnosis, prevention and treatment of diseases and clinical conditions associated with FLJ20330.

KIAA1908 (Accession XM_055834) is another VGAM2059 host target gene. KIAA1908 BINDING SITE is HOST TARGET binding site found in the 3' untranslated region of mRNA encoded by KIAA1908, corresponding to a HOST TARGET binding site such as BINDING SITE I, BINDING SITE II or BINDING SITE III. Table 2 illustrates the complementarity of the nucleotide sequences of KIAA1908 BINDING SITE, designated SEQ ID:36336, to the nucleotide sequence of VGAM2059 RNA, herein designated VGAM RNA, also designated SEQ ID:4770.

Another function of VGAM2059 is therefore inhibition of KIAA1908 (Accession XM_055834). Accordingly, utilities of VGAM2059 include diagnosis, prevention and treatment of diseases and clinical conditions associated with KIAA1908. FIG. 1 further provides a conceptual description of a novel bioinformatically detected viral gene of the present invention, referred to here as Viral Genomic Address Messenger 2060 (VGAM2060) viral gene, which modulates expression of respective host target genes thereof, the function and utility of which host target genes is known in the art.

VGAM2060 is a novel bioinformatically detected regulatory, non protein coding, viral micro RNA (miRNA) gene. The method by which VGAM2060 was detected is described hereinabove with reference to FIGS. 1-8.

VGAM2060 gene, herein designated VGAM GENE, is a viral gene contained in the genome of Ectromelia Virus. VGAM2060 host target gene, herein designated VGAM HOST TARGET GENE, is a human gene contained in the human genome.

VGAM2060 gene encodes a VGAM2060 precursor RNA, herein designated VGAM PRECURSOR RNA. Similar to other miRNA genes, and unlike most ordinary genes, VGAM2060 precursor RNA does not encode a protein. A nucleotide sequence identical or highly similar to the nucleotide sequence of VGAM2060 precursor RNA is designated SEQ ID:2046, and is provided hereinbelow with reference to the sequence listing part. Nucleotide sequence SEQ ID:2046 is located at position 3202 relative to the genome of Ectromelia Virus.

VGAM2060 precursor RNA folds onto itself, forming VGAM2060 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2060 folded precursor RNA into VGAM2060 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM2060 RNA is designated SEQ ID:4771, and is provided hereinbelow with reference to the sequence listing part.

VGAM2060 host target gene, herein designated VGAM HOST TARGET GENE, encodes a corresponding messenger RNA, VGAM2060 host target RNA, herein designated VGAM HOST TARGET RNA. VGAM2060 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2060 RNA, herein designated VGAM RNA, binds complementarily to one or more host target binding sites located in untranslated regions of VGAM2060 host target RNA, herein designated VGAM HOST TARGET RNA. This complementary binding is due to the fact that the nucleotide sequence of VGAM2060 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2060 RNA, herein designated VGAM RNA, may have a different number of host target binding sites in untranslated regions of a VGAM2060 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2060 RNA, herein designated VGAM RNA, to host target binding sites on VGAM2060 host target RNA, herein designated VGAM HOST TARGET RNA, such as BINDING SITE I, BINDING SITE II and BINDING SITE III, inhibits translation of VGAM2060 host target RNA into VGAM2060 host target protein, herein designated VGAM HOST TARGET PROTEIN. VGAM host target protein is therefore outlined by a broken line.

It is appreciated that VGAM2060 host target gene, herein designated VGAM HOST TARGET GENE, in fact represents a plurality of VGAM2060 host target genes. The mRNA of each one of this plurality of VGAM2060 host target genes comprises one or more host target binding sites, each having a nucleotide sequence which is at least partly complementary to VGAM2060 RNA, herein designated VGAM RNA, and which when bound by VGAM2060 RNA causes inhibition of translation of respective one or more VGAM2060 host target proteins.

It is further appreciated by one skilled in the art that the mode of translational inhibition illustrated by FIG. 1 with specific reference to translational inhibition exerted by VGAM2060 gene, herein designated VGAM GENE, on one or more VGAM2060 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2060 is inhibition of expression of host target genes, as part of a novel viral mechanism of attacking a host. Accordingly, utilities of VGAM2060 include diagnosis, prevention and treatment of viral infection by Ectromelia Virus. Specific functions, and accordingly utilities, of VGAM2060 correlate with, and may be deduced from, the identity of the host target genes which VGAM2060 binds and inhibits, and the function of these host target genes, as elaborated hereinbelow.

Nucleotide sequences of the VGAM2060 precursor RNA, herein designated VGAM PRECURSOR RNA, and of the 'diced' VGAM2060 RNA, herein designated VGAM RNA, and a schematic representation of the secondary folding of VGAM2060 folded precursor RNA, herein designated VGAM FOLDED PRECURSOR RNA, of VGAM2060 are further described hereinbelow with reference to Table 1.

Nucleotide sequences of host target binding sites, such as BINDING SITE-I, BINDING SITE-II and BINDING SITE-III of FIG. 1, found on VGAM2060 host target RNA, and schematic representation of the complementarity of each of these host target binding sites to VGAM2060 RNA, herein designated VGAM RNA, are described hereinbelow with reference to Table 2.

As mentioned hereinabove with reference to FIG. 1, a function of VGAM2060 gene, herein designated VGAM is inhibition of expression of VGAM2060 target genes. It is appreciated that specific functions, and accordingly utilities, of VGAM2060 correlate with, and may be deduced from, the identity of the target genes which VGAM2060 binds and inhibits, and the function of these target genes, as elaborated hereinbelow.

Chromosome 1 Open Reading Frame 24 (C1orf24, Accession NM_052966) is a VGAM2060 host target gene. C1orf24 BINDING SITE is HOST TARGET binding site found in the 3' untranslated region of mRNA encoded by C1orf24, corresponding to a HOST TARGET binding site such as BINDING SITE I, BINDING SITE II or BINDING SITE III. Table 2 illustrates the complementarity of the nucleotide sequences of C1orf24 BINDING SITE, designated SEQ ID:27531, to the nucleotide sequence of VGAM2060 RNA, herein designated VGAM RNA, also designated SEQ ID:4771.

A function of VGAM2060 is therefore inhibition of Chromosome 1 Open Reading Frame 24 (C1orf24, Accession NM_052966). Accordingly, utilities of VGAM2060 include diagnosis, prevention and treatment of diseases and clinical conditions associated with C1orf24. FLJ12761 (Accession NM_024545) is another VGAM2060 host target gene. FLJ12761 BINDING SITE is HOST TARGET binding site found in the 3' untranslated region of mRNA encoded by FLJ12761, corresponding to a HOST TARGET binding site such as BINDING SITE I, BINDING SITE II or BINDING SITE III. Table 2 illustrates the complementarity of the nucleotide sequences of FLJ12761 BINDING SITE, designated SEQ ID:23757, to the nucleotide sequence of VGAM2060 RNA, herein designated VGAM RNA, also designated SEQ ID:4771.

Another function of VGAM2060 is therefore inhibition of FLJ12761 (Accession NM_024545). Accordingly, utilities of VGAM2060 include diagnosis, prevention and treatment of diseases and clinical conditions associated with FLJ12761. KIAA0574 (Accession XM_045076) is another VGAM2060 host target gene. KIAA0574 BINDING SITE is HOST TARGET binding site found in the 3' untranslated region of mRNA encoded by KIAA0574, corresponding to a HOST TARGET binding site such as BINDING SITE I, BINDING SITE II or BINDING SITE III. Table 2 illustrates the complementarity of the nucleotide sequences of KIAA0574 BINDING SITE, designated SEQ ID:34343, to the nucleotide sequence of VGAM2060 RNA, herein designated VGAM RNA, also designated SEQ ID:4771.

Another function of VGAM2060 is therefore inhibition of KIAA0574 (Accession XM_045076). Accordingly, utilities of VGAM2060 include diagnosis, prevention and treatment of diseases and clinical conditions associated with KIAA0574. KIAA1766 (Accession XM_049218) is another VGAM2060 host target gene. KIAA1766 BINDING SITE is HOST TARGET binding site found in the 3' untranslated region of mRNA encoded by KIAA1766, corresponding to a HOST TARGET binding site such as BINDING SITE I, BINDING SITE II or BINDING SITE III. Table 2 illustrates the complementarity of the nucleotide sequences of KIAA1766 BINDING SITE, designated SEQ ID:35352, to the nucleotide sequence of VGAM2060 RNA, herein designated VGAM RNA, also designated SEQ ID:4771.

Another function of VGAM2060 is therefore inhibition of KIAA1766 (Accession XM_049218). Accordingly, utilities of VGAM2060 include diagnosis, prevention and treatment of diseases and clinical conditions associated with KIAA1766. NIBAN (Accession NM_022083) is another VGAM2060 host target gene. NIBAN BINDING SITE is HOST TARGET binding site found in the 3' untranslated region of mRNA encoded by NIBAN, corresponding to a HOST TARGET binding site such as BINDING SITE I, BINDING SITE II or BINDING SITE III. Table 2 illustrates the complementarity of the nucleotide sequences of NIBAN BINDING SITE, designated SEQ ID:22628, to the nucleotide sequence of VGAM2060 RNA, herein designated VGAM RNA, also designated SEQ ID:4771.

Another function of VGAM2060 is therefore inhibition of NIBAN (Accession NM_022083). Accordingly, utilities of VGAM2060 include diagnosis, prevention and treatment of diseases and clinical conditions associated with NIBAN. LOC90381 (Accession XM_031334) is another VGAM2060 host target gene. LOC90381 BINDING SITE is HOST TARGET binding site found in the 3' untranslated region of mRNA encoded by LOC90381, corresponding to a HOST TARGET binding site such as BINDING SITE I, BINDING SITE II or BINDING SITE III. Table 2 illustrates the complementarity of the nucleotide sequences of LOC90381 BINDING SITE, designated SEQ ID:31344, to the nucleotide sequence of VGAM2060 RNA, herein designated VGAM RNA, also designated SEQ ID:4771.

Another function of VGAM2060 is therefore inhibition of LOC90381 (Accession XM_031334). Accordingly, utilities of VGAM2060 include diagnosis, prevention and treatment of diseases and clinical conditions associated with LOC90381. LOC91960 (Accession XM_041872) is another VGAM2060 host target gene. LOC91960 BINDING SITE is HOST TARGET binding site found in the 3' untranslated region of mRNA encoded by LOC91960, corresponding to a HOST TARGET binding site such as BINDING SITE I, BINDING SITE II or BINDING SITE III. Table 2 illustrates the complementarity of the nucleotide sequences of LOC91960 BINDING SITE, designated SEQ ID:33609, to the nucleotide sequence of VGAM2060 RNA, herein designated VGAM RNA, also designated SEQ ID:4771.

Another function of VGAM2060 is therefore inhibition of LOC91960 (Accession XM_041872). Accordingly, utilities of VGAM2060 include diagnosis, prevention and treatment of diseases and clinical conditions associated with LOC91960. FIG. 1 further provides a conceptual description of a novel bioinformatically detected viral gene of the present invention, referred to here as Viral Genomic Address Messenger 2061 (VGAM2061) viral gene, which modulates expression of respective host target genes thereof, the function and utility of which host target genes is known in the art.

VGAM2061 is a novel bioinformatically detected regulatory, non protein coding, viral micro RNA (miRNA) gene. The method by which VGAM2061 was detected is described hereinabove with reference to FIGS. 1-8.

VGAM2061 gene, herein designated VGAM GENE, is a viral gene contained in the genome of Ectromelia Virus. VGAM2061 host target gene, herein designated VGAM HOST TARGET GENE, is a human gene contained in the human genome.

VGAM2061 gene encodes a VGAM2061 precursor RNA, herein designated VGAM PRECURSOR RNA. Similar to other miRNA genes, and unlike most ordinary genes, VGAM2061 precursor RNA does not encode a protein. A nucleotide sequence identical or highly similar to the nucleotide sequence of VGAM2061 precursor RNA is designated SEQ ID:2047, and is provided hereinbelow with reference to the sequence listing part. Nucleotide sequence SEQ ID:2047 is located at position 132 relative to the genome of Ectromelia Virus.

VGAM2061 precursor RNA folds onto itself, forming VGAM2061 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2061 folded precursor RNA into VGAM2061 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2061 RNA is designated SEQ ID:4772, and is provided hereinbelow with reference to the sequence listing part.

VGAM2061 host target gene, herein designated VGAM HOST TARGET GENE, encodes a corresponding messenger RNA, VGAM2061 host target RNA, herein designated VGAM HOST TARGET RNA. VGAM2061 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2061 RNA, herein designated VGAM RNA, binds complementarily to one or more host target binding sites located in untranslated regions of VGAM2061 host target RNA, herein designated VGAM HOST TARGET RNA. This complementary binding is due to the fact that the nucleotide sequence of VGAM2061 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2061 RNA, herein designated VGAM RNA, may have a different number of host target binding sites in untranslated regions of a VGAM2061 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2061 RNA, herein designated VGAM RNA, to host target binding sites on VGAM2061 host target RNA, herein designated VGAM HOST TARGET RNA, such as BINDING SITE I, BINDING SITE II and BINDING SITE III, inhibits translation of VGAM2061 host target RNA into VGAM2061 host target protein, herein designated VGAM HOST TARGET PROTEIN. VGAM host target protein is therefore outlined by a broken line.

It is appreciated that VGAM2061 host target gene, herein designated VGAM HOST TARGET GENE, in fact represents a plurality of VGAM2061 host target genes. The mRNA of each one of this plurality of VGAM2061 host target genes comprises one or more host target binding sites, each having a nucleotide sequence which is at least partly complementary to VGAM2061 RNA, herein designated VGAM RNA, and which when bound by VGAM2061 RNA causes inhibition of translation of respective one or more VGAM2061 host target proteins.

It is further appreciated by one skilled in the art that the mode of translational inhibition illustrated by FIG. 1 with specific reference to translational inhibition exerted by VGAM2061 gene, herein designated VGAM GENE, on one or more VGAM2061 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2061 is inhibition of expression of host target genes, as part of a novel viral mechanism of attacking a host. Accordingly, utilities of VGAM2061 include diagnosis, prevention and treatment of viral infection by Ectromelia Virus. Specific functions, and accordingly utilities, of VGAM2061 correlate with, and may be deduced from, the identity of the host target genes which VGAM2061 binds and inhibits, and the function of these host target genes, as elaborated hereinbelow.

Nucleotide sequences of the VGAM2061 precursor RNA, herein designated VGAM PRECURSOR RNA, and of the 'diced' VGAM2061 RNA, herein designated VGAM RNA, and a schematic representation of the secondary folding of VGAM2061 folded precursor RNA, herein designated VGAM FOLDED PRECURSOR RNA, of VGAM2061 are further described hereinbelow with reference to Table 1.

Nucleotide sequences of host target binding sites, such as BINDING SITE-I, BINDING SITE-II and BINDING SITE-III of FIG. 1, found on VGAM2061 host target RNA, and schematic representation of the complementarity of each of these host target binding sites to VGAM2061 RNA, herein designated VGAM RNA, are described hereinbelow with reference to Table 2.

As mentioned hereinabove with reference to FIG. 1, a function of VGAM2061 gene, herein designated VGAM is inhibition of expression of VGAM2061 target genes. It is appreciated that specific functions, and accordingly utilities, of VGAM2061 correlate with, and may be deduced from, the identity of the target genes which VGAM2061 binds and inhibits, and the function of these target genes, as elaborated hereinbelow.

ATP-binding Cassette, Sub-family D (ALD), Member 2 (ABCD2, Accession NM_005164) is a VGAM2061 host target gene. ABCD2 BINDING SITE is HOST TARGET binding site found in the 3' untranslated region of mRNA encoded by ABCD2, corresponding to a HOST TARGET binding site such as BINDING SITE I, BINDING SITE II or BINDING SITE III. Table 2 illustrates the complementarity of the nucleotide sequences of ABCD2 BINDING SITE, designated SEQ ID:11660, to the nucleotide sequence of VGAM2061 RNA, herein designated VGAM RNA, also designated SEQ ID:4772.

A function of VGAM2061 is therefore inhibition of ATP-binding Cassette, Sub-family D (ALD), Member 2 (ABCD2, Accession NM_005164), a gene which probable transporter. Accordingly, utilities of VGAM2061 include diagnosis, prevention and treatment of diseases and clinical conditions associated with ABCD2. The function of ABCD2 and its association with various diseases and clinical conditions, has been established by previous studies, as described hereinabove with reference to VGAM229. DNA2 DNA Replication Helicase 2-like (yeast) (DNA2L, Accession XM_166103) is another VGAM2061 host target gene. DNA2L BINDING SITE is HOST TARGET binding site found in the 3' untranslated region of mRNA encoded by DNA2L, corresponding to a HOST TARGET binding site such as BINDING SITE I, BINDING SITE II or BINDING SITE III. Table 2 illustrates the complementarity of the nucleotide sequences of DNA2L BINDING SITE, designated SEQ ID:43881, to the nucleotide sequence of VGAM2061 RNA, herein designated VGAM RNA, also designated SEQ ID:4772.

Another function of VGAM2061 is therefore inhibition of DNA2 DNA Replication Helicase 2-like (yeast) (DNA2L, Accession XM_166103), a gene which acts as a template for DNA polymerization during the process of DNA replication. Accordingly, utilities of VGAM2061 include diagnosis, prevention and treatment of diseases and clinical conditions associated with DNA2L. The function of DNA2L has been established by previous studies. While sequencing random cDNAs from the myeloid cell line KG-1, Nagase et al. (1995) found a partial sequence, KIAA0083, whose predicted polypeptide sequence had 41% identity to yeast Dna2 helicase. In yeast, Dna2 helicase is a DNA-dependent ATPase which unwinds duplex DNA to generate single-stranded DNA which then acts as a template for DNA polymerization during the process of DNA replication. Eki et al. (1996) used human-rodent PCR panels and fluorescence in situ hybridization to map the human DNA2L gene to human chromosome 10q21.3-q22.1.

Full details of the abovementioned studies are described in the following publications, the disclosure of which are hereby incorporated by reference:

Eki, T; Okumura, K.; Shiratori, A.; Abe, M.; Nogami, M.; Taguchi, H.; Shibata, T.; Murakami, Y.; Hanaoka, F.: Assignment of the closest human homologue (DNA2L; KIAA0083) of the yeast Dna2 helicase gene to chromosome band 10q21.3-q22.1 Genomics 37:408-410, 1996; and Nagase, T; Miyajima, N; Tanaka, A.; Sazuka, T.; Seki, N.; Sato, S.; Tabata, S.; Ishikawa, K.; Kawarabayashi, Y.; Kotani, H.; Nomura, N.: Prediction of the coding sequences of unidentif.

Further studies establishing the function and utilities of DNA2L are found in John Hopkins OMIM database record ID 601810, and in sited publications numbered 6725-6726 listed in the bibliography section hereinbelow, which are also hereby incorporated by reference. Ribosomal Protein L10 (RPL10, Accession NM_006013) is another VGAM2061 host target gene. RPL10 BINDING SITE is HOST TARGET binding site found in the 3' untranslated region of mRNA encoded by RPL10, corresponding to a HOST TARGET binding site such as BINDING SITE I, BINDING SITE II or BINDING SITE III. Table 2 illustrates the complementarity of the nucleotide sequences of RPL10 BINDING SITE, designated SEQ ID:12622, to the nucleotide sequence of VGAM2061 RNA, herein designated VGAM RNA, also designated SEQ ID:4772.

Another function of VGAM2061 is therefore inhibition of Ribosomal Protein L10 (RPL10, Accession NM_006013), a gene which may be a component of the 60S ribosomal subunit. Accordingly, utilities of VGAM2061 include diagnosis, prevention and treatment of diseases and clinical conditions associated with RPL10. The function of RPL10 and its association with various diseases and clinical conditions, has been established by previous studies, as described hereinabove with reference to VGAM476. DKFZP566M114 (Accession NM_032128) is another VGAM2061 host target gene. DKFZP566M114 BINDING SITE is HOST TARGET binding site found in the 3' untranslated region of mRNA encoded by DKFZP566M114, corresponding to a HOST TARGET binding site such as BINDING SITE I, BINDING SITE II or BINDING SITE III. Table 2 illustrates the complementarity of the nucleotide sequences of DKFZP566M114 BINDING SITE, designated SEQ ID:25813, to the nucleotide sequence of VGAM2061 RNA, herein designated VGAM RNA, also designated SEQ ID:4772.

Another function of VGAM2061 is therefore inhibition of DKFZP566M114 (Accession NM_032128). Accordingly, utilities of VGAM2061 include diagnosis, prevention and treatment of diseases and clinical conditions associated with DKFZP566M114.FLJ20519 (Accession NM_017860) is another VGAM2061 host target gene. FLJ20519 BINDING SITE is HOST TARGET binding site found in the 3' untranslated region of mRNA encoded by FLJ20519, corresponding to a HOST TARGET binding site such as BINDING SITE I, BINDING SITE II or BINDING SITE III. Table 2 illustrates the complementarity of the nucleotide sequences of FLJ20519 BINDING SITE, designated SEQ ID:19539, to the nucleotide sequence of VGAM2061 RNA, herein designated VGAM RNA, also designated SEQ ID:4772.

Another function of VGAM2061 is therefore inhibition of FLJ20519 (Accession NM_017860). Accordingly, utilities of VGAM2061 include diagnosis, prevention and treatment of diseases and clinical conditions associated with FLJ20519. FLJ21369 (Accession NM_024802) is another VGAM2061 host target gene. FLJ21369 BINDING SITE is HOST TARGET binding site found in the 3' untranslated region of mRNA encoded by FLJ21369, corresponding to a HOST TARGET binding site such as BINDING SITE I, BINDING SITE II or BINDING SITE III. Table 2 illustrates the complementarity of the nucleotide sequences of FLJ21369 BINDING SITE, designated SEQ ID:24182, to the nucleotide sequence of VGAM2061 RNA, herein designated VGAM RNA, also designated SEQ ID:4772.

Another function of VGAM2061 is therefore inhibition of FLJ21369 (Accession NM_024802). Accordingly, utilities of VGAM2061 include diagnosis, prevention and treatment of diseases and clinical conditions associated with FLJ21369. FLJ23462 (Accession NM_024843) is another VGAM2061 host target gene. FLJ23462 BINDING SITE is HOST TARGET binding site found in the 3' untranslated region of mRNA encoded by FLJ23462, corresponding to a HOST TARGET binding site such as BINDING SITE I, BINDING SITE II or BINDING SITE III. Table 2 illustrates the complementarity of the nucleotide sequences of FLJ23462 BINDING SITE, designated SEQ ID:24259, to the nucleotide sequence of VGAM2061 RNA, herein designated VGAM RNA, also designated SEQ ID:4772.

Another function of VGAM2061 is therefore inhibition of FLJ23462 (Accession NM_024843). Accordingly, utilities of VGAM2061 include diagnosis, prevention and treatment of diseases and clinical conditions associated with FLJ23462. KIAA1237 (Accession XM_087386) is another VGAM2061 host target gene. KIAA1237 BINDING SITE is HOST TAR- GET binding site found in the 3' untranslated region of mRNA encoded by KIAA1237, corresponding to a HOST TARGET binding site such as BINDING SITE I, BINDING SITE II or BINDING SITE III. Table 2 illustrates the complementarity of the nucleotide sequences of KIAA1237 BINDING SITE, designated SEQ ID:39214, to the nucleotide sequence of VGAM2061 RNA, herein designated VGAM RNA, also designated SEQ ID:4772.

Another function of VGAM2061 is therefore inhibition of KIAA1237 (Accession XM_087386). Accordingly, utilities of VGAM2061 include diagnosis, prevention and treatment of diseases and clinical conditions associated with KIAA1237. KIAA1554 (Accession XM_170834) is another VGAM2061 host target gene. KIAA1554 BINDING SITE is HOST TARGET binding site found in the 3' untranslated region of mRNA encoded by KIAA1554, corresponding to a HOST TARGET binding site such as BINDING SITE I, BINDING SITE II or BINDING SITE III. Table 2 illustrates the complementarity of the nucleotide sequences of KIAA1554 BINDING SITE, designated SEQ ID:45613, to the nucleotide sequence of VGAM2061 RNA, herein designated VGAM RNA, also designated SEQ ID:4772.

Another function of VGAM2061 is therefore inhibition of KIAA1554 (Accession XM_170834). Accordingly, utilities of VGAM2061 include diagnosis, prevention and treatment of diseases and clinical conditions associated with KIAA1554. Ornithine Decarboxylase Antizyme Inhibitor (OAZIN, Accession NM_015878) is another VGAM2061 host target gene. OAZIN BINDING SITE is HOST TARGET binding site found in the 3' untranslated region of mRNA encoded by OAZIN, corresponding to a HOST TARGET binding site such as BINDING SITE I, BINDING SITE II or BINDING SITE III. Table 2 illustrates the complementarity of the nucleotide sequences of OAZIN BINDING SITE, designated SEQ ID:18022, to the nucleotide sequence of VGAM2061 RNA, herein designated VGAM RNA, also designated SEQ ID:4772.

Another function of VGAM2061 is therefore inhibition of Ornithine Decarboxylase Antizyme Inhibitor (OAZIN, Accession NM_015878). Accordingly, utilities of VGAM2061 include diagnosis, prevention and treatment of diseases and clinical conditions associated with OAZIN. LOC147072 (Accession XM_017121) is another VGAM2061 host target gene. LOC147072 BINDING SITE is HOST TARGET binding site found in the 3' untranslated region of mRNA encoded by LOC147072, corresponding to a HOST TARGET binding site such as BINDING SITE I, BINDING SITE II or BINDING SITE III. Table 2 illustrates the complementarity of the nucleotide sequences of LOC147072 BINDING SITE, designated SEQ ID:30300, to the nucleotide sequence of VGAM2061 RNA, herein designated VGAM RNA, also designated SEQ ID:4772.

Another function of VGAM2061 is therefore inhibition of LOC147072 (Accession XM_017121). Accordingly, utilities of VGAM2061 include diagnosis, prevention and treatment of diseases and clinical conditions associated with LOC147072. LOC147093 (Accession XM_097184) is another VGAM2061 host target gene. LOC147093 BINDING SITE is HOST TARGET binding site found in the 3' untranslated region of mRNA encoded by LOC147093, corresponding to a HOST TARGET binding site such as BINDING SITE I, BINDING SITE II or BINDING SITE III. Table 2 illustrates the complementarity of the nucleotide sequences of LOC147093 BINDING SITE, designated SEQ ID:40803, to the nucleotide sequence of VGAM2061 RNA, herein designated VGAM RNA, also designated SEQ ID:4772.

Another function of VGAM2061 is therefore inhibition of LOC147093 (Accession XM_097184). Accordingly, utilities of VGAM2061 include diagnosis, prevention and treatment of diseases and clinical conditions associated with LOC147093. LOC201626 (Accession XM_114349) is another VGAM2061 host target gene. LOC201626 BINDING SITE is HOST TARGET binding site found in the 3' untranslated region of mRNA encoded by LOC201626, corresponding to a HOST TARGET binding site such as BINDING SITE I, BINDING SITE II or BINDING SITE III. Table 2 illustrates the complementarity of the nucleotide sequences of LOC201626 BINDING SITE, designated SEQ ID:42889, to the nucleotide sequence of VGAM2061 RNA, herein designated VGAM RNA, also designated SEQ ID:4772.

Another function of VGAM2061 is therefore inhibition of LOC201626 (Accession XM_114349). Accordingly, utilities of VGAM2061 include diagnosis, prevention and treatment of diseases and clinical conditions associated with LOC201626. LOC93097 (Accession XM_049221) is another VGAM2061 host target gene. LOC93097 BINDING SITE is HOST TARGET binding site found in the 5' untranslated region of mRNA encoded by LOC93097, corresponding to a HOST TARGET binding site such as BINDING SITE I, BINDING SITE II or BINDING SITE III. Table 2 illustrates the complementarity of the nucleotide sequences of LOC93097 BINDING SITE, designated SEQ ID:35356, to the nucleotide sequence of VGAM2061 RNA, herein designated VGAM RNA, also designated SEQ ID:4772.

Another function of VGAM2061 is therefore inhibition of LOC93097 (Accession XM_049221). Accordingly, utilities of VGAM2061 include diagnosis, prevention and treatment of diseases and clinical conditions associated with LOC93097. FIG. 1 further provides a conceptual description of a novel bioinformatically detected viral gene of the present invention, referred to here as Viral Genomic Address Messenger 2062 (VGAM2062) viral gene, which modulates expression of respective host target genes thereof, the function and utility of which host target genes is known in the art.

VGAM2062 is a novel bioinformatically detected regulatory, non protein coding, viral micro RNA (miRNA) gene. The method by which VGAM2062 was detected is described hereinabove with reference to FIGS. 1-8.

VGAM2062 gene, herein designated VGAM GENE, is a viral gene contained in the genome of Peanut Bud Necrosis Virus. VGAM2062 host target gene, herein designated VGAM HOST TARGET GENE, is a human gene contained in the human genome.

VGAM2062 gene encodes a VGAM2062 precursor RNA, herein designated VGAM PRECURSOR RNA. Similar to other miRNA genes, and unlike most ordinary genes, VGAM2062 precursor RNA does not encode a protein. A nucleotide sequence identical or highly similar to the nucleotide sequence of VGAM2062 precursor RNA is designated SEQ ID:2048, and is provided hereinbelow with reference to the sequence listing part. Nucleotide sequence SEQ ID:2048 is located at position 345 relative to the genome of Peanut Bud Necrosis Virus.

VGAM2062 precursor RNA folds onto itself, forming VGAM2062 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2062 folded precursor RNA into VGAM2062 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2062 RNA is designated SEQ ID:4773, and is provided hereinbelow with reference to the sequence listing part.

VGAM2062 host target gene, herein designated VGAM HOST TARGET GENE, encodes a corresponding messenger RNA, VGAM2062 host target RNA, herein designated VGAM HOST TARGET RNA. VGAM2062 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2062 RNA, herein designated VGAM RNA, binds complementarily to one or more host target binding sites located in untranslated regions of VGAM2062 host target RNA, herein designated VGAM HOST TARGET RNA. This complementary binding is due to the fact that the nucleotide sequence of VGAM2062 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2062 RNA, herein designated VGAM RNA, may have a different number of host target binding sites in untranslated regions of a VGAM2062 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2062 RNA, herein designated VGAM RNA, to host target binding sites on VGAM2062 host target RNA, herein designated VGAM HOST TARGET RNA, such as BINDING SITE I, BINDING SITE II and BINDING SITE III, inhibits translation of VGAM2062 host target RNA into VGAM2062 host target protein, herein designated VGAM HOST TARGET PROTEIN. VGAM host target protein is therefore outlined by a broken line.

It is appreciated that VGAM2062 host target gene, herein designated VGAM HOST TARGET GENE, in fact represents a plurality of VGAM2062 host target genes. The mRNA of each one of this plurality of VGAM2062 host target genes comprises one or more host target binding sites, each having a nucleotide sequence which is at least partly complementary to VGAM2062 RNA, herein designated VGAM RNA, and which when bound by VGAM2062 RNA causes inhibition of translation of respective one or more VGAM2062 host target proteins.

It is further appreciated by one skilled in the art that the mode of translational inhibition illustrated by FIG. 1 with specific reference to translational inhibition exerted by VGAM2062 gene, herein designated VGAM GENE, on one or more VGAM2062 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2062 is inhibition of expression of host target genes, as part of a novel viral mechanism of attacking a host. Accordingly, utilities of VGAM2062 include diagnosis, prevention and treatment of viral infection by Peanut Bud Necrosis Virus. Specific functions, and accordingly utilities, of VGAM2062 correlate with, and may be deduced from, the identity of the host target genes which VGAM2062 binds and inhibits, and the function of these host target genes, as elaborated hereinbelow.

Nucleotide sequences of the VGAM2062 precursor RNA, herein designated VGAM PRECURSOR RNA, and of the 'diced' VGAM2062 RNA, herein designated VGAM RNA, and a schematic representation of the secondary folding of VGAM2062 folded precursor RNA, herein designated VGAM FOLDED PRECURSOR RNA, of VGAM2062 are further described hereinbelow with reference to Table 1.

Nucleotide sequences of host target binding sites, such as BINDING SITE-I, BINDING SITE-II and BINDING SITE-III of FIG. 1, found on VGAM2062 host target RNA, and schematic representation of the complementarity of each of these host target binding sites to VGAM2062 RNA, herein designated VGAM RNA, are described hereinbelow with reference to Table 2.

As mentioned hereinabove with reference to FIG. 1, a function of VGAM2062 gene, herein designated VGAM is inhibition of expression of VGAM2062 target genes. It is appreciated that specific functions, and accordingly utilities, of VGAM2062 correlate with, and may be deduced from, the identity of the target genes which VGAM2062 binds and inhibits, and the function of these target genes, as elaborated hereinbelow.

Bassoon (presynaptic cytomatrix protein) (BSN, Accession NM_003458) is a VGAM2062 host target gene. BSN BINDING SITE is HOST TARGET binding site found in the 3' untranslated region of mRNA encoded by BSN, corresponding to a HOST TARGET binding site such as BINDING SITE I, BINDING SITE II or BINDING SITE III. Table 2 illustrates the complementarity of the nucleotide sequences of BSN BINDING SITE, designated SEQ ID:9516, to the nucleotide sequence of VGAM2062 RNA, herein designated VGAM RNA, also designated SEQ ID:4773.

A function of VGAM2062 is therefore inhibition of Bassoon (presynaptic cytomatrix protein) (BSN, Accession NM_003458), a gene which may be involved in cytomatrix organization at the site of neurotransmitter release. Accordingly, utilities of VGAM2062 include diagnosis, prevention and treatment of diseases and clinical conditions associated with BSN. The function of BSN and its association with various diseases and clinical conditions, has been established by previous studies, as described hereinabove with reference to VGAM638. DXS1283E (Accession XM_047871) is another VGAM2062 host target gene. DXS1283E BINDING SITE is HOST TARGET binding site found in the 3' untranslated region of mRNA encoded by DXS1283E, corresponding to a HOST TARGET binding site such as BINDING SITE I, BINDING SITE II or BINDING SITE III. Table 2 illustrates the complementarity of the nucleotide sequences of DXS1283E BINDING SITE, designated SEQ ID:35067, to the nucleotide sequence of VGAM2062 RNA, herein designated VGAM RNA, also designated SEQ ID:4773.

Another function of VGAM2062 is therefore inhibition of DXS1283E (Accession XM_047871). Accordingly, utilities of VGAM2062 include diagnosis, prevention and treatment of diseases and clinical conditions associated with DXS1283E. IL2-inducible T-cell Kinase (ITK, Accession NM_005546) is another VGAM2062 host target gene. ITK BINDING SITE is HOST TARGET binding site found in the 3' untranslated region of mRNA encoded by ITK, corresponding to a HOST TARGET binding site such as BINDING SITE I, BINDING SITE II or BINDING SITE III. Table 2 illustrates the complementarity of the nucleotide sequences of ITK BINDING SITE, designated SEQ ID:12078, to the nucleotide sequence of VGAM2062 RNA, herein designated VGAM RNA, also designated SEQ ID:4773.

Another function of VGAM2062 is therefore inhibition of IL2-inducible T-cell Kinase (ITK, Accession NM_005546), a gene which plays a role in t cell proliferation and differentiation. Accordingly, utilities of VGAM2062 include diagnosis, prevention and treatment of diseases and clinical conditions associated with ITK. The function of ITK and its association with various diseases and clinical conditions, has been established by previous studies, as described hereinabove with reference to VGAM288. Protocadherin 11 X-linked (PCDH11X, Accession NM_032969) is another VGAM2062 host target gene. PCDH11X BINDING SITE1 and PCDH11X BINDING SITE2 are HOST TARGET binding sites found in untranslated regions of mRNA encoded by PCDH11X, corresponding to HOST TARGET binding sites such as BINDING SITE I, BINDING SITE II or BINDING SITE III. Table 2 illustrates the complementarity of the nucleotide sequences of PCDH11X BINDING SITE1 and PCDH11X BINDING SITE2, designated SEQ ID:26805 and SEQ ID:26790 respectively, to the nucleotide sequence of VGAM2062 RNA, herein designated VGAM RNA, also designated SEQ ID:4773.

Another function of VGAM2062 is therefore inhibition of Protocadherin 11 X-linked (PCDH11X, Accession NM_032969), a gene which is thought to play a fundamental role in cell-cell recognition essential for the segmental development and function of the central nervous system. Accordingly, utilities of VGAM2062 include diagnosis, prevention and treatment of diseases and clinical conditions associated with PCDH11X. The function of PCDH11X and its association with various diseases and clinical conditions, has been established by previous studies, as described hereinabove with reference to VGAM433. Replication Protein A1, 70 kDa (RPA1, Accession NM_002945) is another VGAM2062 host target gene. RPA1 BINDING SITE is HOST TARGET binding site found in the 3' untranslated region of mRNA encoded by RPA1, corresponding to a HOST TARGET binding site such as BINDING SITE I, BINDING SITE II or BINDING SITE III. Table 2 illustrates the complementarity of the nucleotide sequences of RPA1 BINDING SITE, designated SEQ ID:8855, to the nucleotide sequence of VGAM2062 RNA, herein designated VGAM RNA, also designated SEQ ID:4773.

Another function of VGAM2062 is therefore inhibition of Replication Protein A1, 70 kDa (RPA1, Accession NM_002945), a gene which is required for simian virus 40 dna replication in vitro. it participates in a very early step in initiation. rp-a is a single-stranded dna-binding protein. Accordingly, utilities of VGAM2062 include diagnosis, prevention and treatment of diseases and clinical conditions associated with RPA1. The function of RPA1 and its association with various diseases and clinical conditions, has been established by previous studies, as described hereinabove with reference to VGAM180. Serine (or cysteine) Proteinase Inhibitor, Clade A (alpha-1 antiproteinase, antitrypsin), Member 5 (SERPINA5, Accession NM_000624) is another VGAM2062 host target gene. SERPINA5 BINDING SITE is HOST TARGET binding site found in the 3' untranslated region of mRNA encoded by SERPINA5, corresponding to a HOST TARGET binding site such as BINDING SITE I, BINDING SITE II or BINDING SITE III. Table 2 illustrates the complementarity of the nucleotide sequences of SERPINA5 BINDING SITE, designated SEQ ID:6241, to the nucleotide sequence of VGAM2062 RNA, herein designated VGAM RNA, also designated SEQ ID:4773.

Another function of VGAM2062 is therefore inhibition of Serine (or cysteine) Proteinase Inhibitor, Clade A (alpha-1 antiproteinase, antitrypsin), Member 5 (SERPINA5, Accession NM_000624), a gene which inhibits activated protein c as well as plasminogen activators. Accordingly, utilities of VGAM2062 include diagnosis, prevention and treatment of diseases and clinical conditions associated with SERPINA5. The function of SERPINA5 and its association with various diseases and clinical conditions, has been established by previous studies, as described hereinabove with reference to VGAM1233. ARL8 (Accession XM_167671) is another VGAM2062 host target gene. ARL8 BINDING SITE is HOST TARGET binding site found in the 3' untranslated region of mRNA encoded by ARL8, corresponding to a HOST TARGET binding site such as BINDING SITE I, BINDING SITE II or BINDING SITE III. Table 2 illustrates the complementarity of the nucleotide sequences of ARL8 BINDING SITE, designated SEQ ID:44766, to the nucleotide sequence of VGAM2062 RNA, herein designated VGAM RNA, also designated SEQ ID:4773.

Another function of VGAM2062 is therefore inhibition of ARL8 (Accession XM_167671). Accordingly, utilities of VGAM2062 include diagnosis, prevention and treatment of diseases and clinical conditions associated with ARL8. Chromosome 1 Open Reading Frame 22 (C1orf22, Accession NM_025191) is another VGAM2062 host target gene. C1orf22 BINDING SITE is HOST TARGET binding site found in the 3' untranslated region of mRNA encoded by C1orf22, corresponding to a HOST TARGET binding site such as BINDING SITE I, BINDING SITE II or BINDING SITE III. Table 2 illustrates the complementarity of the nucleotide sequences of C1orf22 BINDING SITE, designated SEQ ID:24841, to the nucleotide sequence of VGAM2062 RNA, herein designated VGAM RNA, also designated SEQ ID:4773.

Another function of VGAM2062 is therefore inhibition of Chromosome 1 Open Reading Frame 22 (C1orf22, Accession NM_025191). Accordingly, utilities of VGAM2062 include diagnosis, prevention and treatment of diseases and clinical conditions associated with C1orf22. Chromosome 20 Open Reading Frame 20 (C20orf20, Accession NM_018270) is another VGAM2062 host target gene. C20orf20 BINDING SITE is HOST TARGET binding site found in the 3' untranslated region of mRNA encoded by C20orf20, corresponding to a HOST TARGET binding site such as BINDING SITE I, BINDING SITE II or BINDING SITE III. Table 2 illustrates the complementarity of the nucleotide sequences of C20orf20 BINDING SITE, designated SEQ ID:20244, to the nucleotide sequence of VGAM2062 RNA, herein designated VGAM RNA, also designated SEQ ID:4773.

Another function of VGAM2062 is therefore inhibition of Chromosome 20 Open Reading Frame 20 (C20orf20, Accession NM_018270). Accordingly, utilities of VGAM2062 include diagnosis, prevention and treatment of diseases and clinical conditions associated with C20orf20. Chromosome 9 Open Reading Frame 12 (C9orf12, Accession NM_022755) is another VGAM2062 host target gene. C9orf12 BINDING SITE is HOST TARGET binding site found in the 3' untranslated region of mRNA encoded by C9orf12, corresponding to a HOST TARGET binding site such as BINDING SITE I, BINDING SITE II or BINDING SITE III. Table 2 illustrates the complementarity of the nucleotide sequences of C9orf12 BINDING SITE, designated SEQ ID:22992, to the nucleotide sequence of VGAM2062 RNA, herein designated VGAM RNA, also designated SEQ ID:4773.

Another function of VGAM2062 is therefore inhibition of Chromosome 9 Open Reading Frame 12 (C9orf12, Accession NM_022755). Accordingly, utilities of VGAM2062 include diagnosis, prevention and treatment of diseases and clinical conditions associated with C9orf12. CDC14 Cell Division Cycle 14 Homolog B (S. cerevisiae) (CDC14B, Accession NM_003671) is another VGAM2062 host target gene. CDC14B BINDING SITE1 and CDC14B BINDING SITE2 are HOST TARGET binding sites found in untranslated regions of mRNA encoded by CDC14B, corresponding to HOST TARGET binding sites such as BINDING SITE I, BINDING SITE II or BINDING SITE III. Table 2 illustrates the complementarity of the nucleotide sequences of CDC14B BINDING SITE1 and CDC14B BINDING SITE2, designated SEQ ID:9762 and SEQ ID:27165 respectively, to the nucleotide sequence of VGAM2062 RNA, herein designated VGAM RNA, also designated SEQ ID:4773.

Another function of VGAM2062 is therefore inhibition of CDC14 Cell Division Cycle 14 Homolog B (S. cerevisiae) (CDC14B, Accession NM_003671). Accordingly, utilities of VGAM2062 include diagnosis, prevention and treatment of diseases and clinical conditions associated with CDC14B. Ephrin-A5 (EFNA5, Accession NM_001962) is another VGAM2062 host target gene. EFNA5 BINDING SITE is HOST TARGET binding site found in the 3' untranslated region of mRNA encoded by EFNA5, corresponding to a HOST TARGET binding site such as BINDING SITE I, BINDING SITE II or BINDING SITE III. Table 2 illustrates the complementarity of the nucleotide sequences of EFNA5 BINDING SITE, designated SEQ ID:7686, to the nucleotide sequence of VGAM2062 RNA, herein designated VGAM RNA, also designated SEQ ID:4773.

Another function of VGAM2062 is therefore inhibition of Ephrin-A5 (EFNA5, Accession NM_001962). Accordingly, utilities of VGAM2062 include diagnosis, prevention and treatment of diseases and clinical conditions associated with EFNA5. FLJ12409 (Accession NM_025105) is another VGAM2062 host target gene. FLJ12409 BINDING SITE is HOST TARGET binding site found in the 3' untranslated region of mRNA encoded by FLJ12409, corresponding to a HOST TARGET binding site such as BINDING SITE I, BINDING SITE II or BINDING SITE III. Table 2 illustrates the complementarity of the nucleotide sequences of FLJ12409 BINDING SITE, designated SEQ ID:24753, to the nucleotide sequence of VGAM2062 RNA, herein designated VGAM RNA, also designated SEQ ID:4773.

Another function of VGAM2062 is therefore inhibition of FLJ12409 (Accession NM_025105). Accordingly, utilities of VGAM2062 include diagnosis, prevention and treatment of diseases and clinical conditions associated with FLJ12409. FLJ12604 (Accession XM_035022) is another VGAM2062 host target gene. FLJ12604 BINDING SITE is HOST TARGET binding site found in the 3' untranslated region of mRNA encoded by FLJ12604, corresponding to a HOST TARGET binding site such as BINDING SITE I, BINDING SITE II or BINDING SITE III. Table 2 illustrates the complementarity of the nucleotide sequences of FLJ12604 BINDING SITE, designated SEQ ID:32191, to the nucleotide sequence of VGAM2062 RNA, herein designated VGAM RNA, also designated SEQ ID:4773.

Another function of VGAM2062 is therefore inhibition of FLJ12604 (Accession XM_035022). Accordingly, utilities of VGAM2062 include diagnosis, prevention and treatment of diseases and clinical conditions associated with FLJ12604. FLJ14640 (Accession NM_032816) is another VGAM2062 host target gene. FLJ14640 BINDING SITE is HOST TARGET binding site found in the 5' untranslated region of mRNA encoded by FLJ14640, corresponding to a HOST TARGET binding site such as BINDING SITE I, BINDING SITE II or BINDING SITE III. Table 2 illustrates the complementarity of the nucleotide sequences of FLJ14640 BINDING SITE, designated SEQ ID:26586, to the nucleotide sequence of VGAM2062 RNA, herein designated VGAM RNA, also designated SEQ ID:4773.

Another function of VGAM2062 is therefore inhibition of FLJ14640 (Accession NM_032816). Accordingly, utilities of VGAM2062 include diagnosis, prevention and treatment of diseases and clinical conditions associated with FLJ14640. FLJ20413 (Accession NM_017808) is another VGAM2062 host target gene. FLJ20413 BINDING SITE is HOST TARGET binding site found in the 3' untranslated region of mRNA encoded by FLJ20413, corresponding to a HOST TARGET binding site such as BINDING SITE I, BINDING SITE II or BINDING SITE III. Table 2 illustrates the complementarity of the nucleotide sequences of FLJ20413 BINDING SITE, designated SEQ ID:19453, to the nucleotide sequence of VGAM2062 RNA, herein designated VGAM RNA, also designated SEQ ID:4773.

Another function of VGAM2062 is therefore inhibition of FLJ20413 (Accession NM_017808). Accordingly, utilities of VGAM2062 include diagnosis, prevention and treatment of diseases and clinical conditions associated with FLJ20413. H_GS165L15.1 (Accession NM_004904) is another VGAM2062 host target gene. H_GS165L15.1 BINDING SITE is HOST TARGET binding site found in the 3' untranslated region of mRNA encoded by H_GS165L15.1, corresponding to a HOST TARGET binding site such as BINDING SITE I, BINDING SITE II or BINDING SITE III. Table 2 illustrates the complementarity of the nucleotide sequences of H_GS165L15.1 BINDING SITE, designated SEQ ID:11339, to the nucleotide sequence of VGAM2062 RNA, herein designated VGAM RNA, also designated SEQ ID:4773.

Another function of VGAM2062 is therefore inhibition of H_GS165L15.1 (Accession NM_004904). Accordingly, utilities of VGAM2062 include diagnosis, prevention and treatment of diseases and clinical conditions associated with H_GS165L15.1. HN1L (Accession NM_144570) is another VGAM2062 host target gene. HN1L BINDING SITE is HOST TARGET binding site found in the 3' untranslated region of mRNA encoded by HN1L, corresponding to a HOST TARGET binding site such as BINDING SITE I, BINDING SITE II or BINDING SITE III. Table 2 illustrates the complementarity of the nucleotide sequences of HN1L BINDING SITE, designated SEQ ID:29375, to the nucleotide sequence of VGAM2062 RNA, herein designated VGAM RNA, also designated SEQ ID:4773.

Another function of VGAM2062 is therefore inhibition of HN1L (Accession NM_144570). Accordingly, utilities of VGAM2062 include diagnosis, prevention and treatment of diseases and clinical conditions associated with HN1L. KIAA0379 (Accession XM_042860) is another VGAM2062 host target gene. KIAA0379 BINDING SITE is HOST TAR- GET binding site found in the 3' untranslated region of mRNA encoded by KIAA0379, corresponding to a HOST TARGET binding site such as BINDING SITE I, BINDING SITE II or BINDING SITE III. Table 2 illustrates the complementarity of the nucleotide sequences of KIAA0379 BINDING SITE, designated SEQ ID:33813, to the nucleotide sequence of VGAM2062 RNA, herein designated VGAM RNA, also designated SEQ ID:4773.

Another function of VGAM2062 is therefore inhibition of KIAA0379 (Accession XM_042860). Accordingly, utilities of VGAM2062 include diagnosis, prevention and treatment of diseases and clinical conditions associated with KIAA0379. KIAA0560 (Accession XM_029045) is another VGAM2062 host target gene. KIAA0560 BINDING SITE is HOST TARGET binding site found in the 5' untranslated region of mRNA encoded by KIAA0560, corresponding to a HOST TARGET binding site such as BINDING SITE I, BINDING SITE II or BINDING SITE III. Table 2 illustrates the complementarity of the nucleotide sequences of KIAA0560 BINDING SITE, designated SEQ ID:30838, to the nucleotide sequence of VGAM2062 RNA, herein designated VGAM RNA, also designated SEQ ID:4773.

Another function of VGAM2062 is therefore inhibition of KIAA0560 (Accession XM_029045). Accordingly, utilities of VGAM2062 include diagnosis, prevention and treatment of diseases and clinical conditions associated with KIAA0560. KIAA0916 (Accession NM_015057) is another VGAM2062 host target gene. KIAA0916 BINDING SITE is HOST TARGET binding site found in the 3' untranslated region of mRNA encoded by KIAA0916, corresponding to a HOST TARGET binding site such as BINDING SITE I, BINDING SITE II or BINDING SITE III. Table 2 illustrates the complementarity of the nucleotide sequences of KIAA0916 BINDING SITE, designated SEQ ID:17417, to the nucleotide sequence of VGAM2062 RNA, herein designated VGAM RNA, also designated SEQ ID:4773.

Another function of VGAM2062 is therefore inhibition of KIAA0916 (Accession NM_015057). Accordingly, utilities of VGAM2062 include diagnosis, prevention and treatment of diseases and clinical conditions associated with KIAA0916. KIAA1211 (Accession XM_044178) is another VGAM2062 host target gene. KIAA1211 BINDING SITE is HOST TARGET binding site found in the 3' untranslated region of mRNA encoded by KIAA1211, corresponding to a HOST TARGET binding site such as BINDING SITE I, BINDING SITE II or BINDING SITE III. Table 2 illustrates the complementarity of the nucleotide sequences of KIAA1211 BINDING SITE, designated SEQ ID:34163, to the nucleotide sequence of VGAM2062 RNA, herein designated VGAM RNA, also designated SEQ ID:4773.

Another function of VGAM2062 is therefore inhibition of KIAA1211 (Accession XM_044178). Accordingly, utilities of VGAM2062 include diagnosis, prevention and treatment of diseases and clinical conditions associated with KIAA1211. KIAA1376 (Accession XM_033042) is another VGAM2062 host target gene. KIAA1376 BINDING SITE is HOST TARGET binding site found in the 3' untranslated region of mRNA encoded by KIAA1376, corresponding to a HOST TARGET binding site such as BINDING SITE I, BINDING SITE II or BINDING SITE III. Table 2 illustrates the complementarity of the nucleotide sequences of KIAA1376 BINDING SITE, designated SEQ ID:31823, to the nucleotide sequence of VGAM2062 RNA, herein designated VGAM RNA, also designated SEQ ID:4773.

Another function of VGAM2062 is therefore inhibition of KIAA1376 (Accession XM_033042). Accordingly, utilities of VGAM2062 include diagnosis, prevention and treatment of diseases and clinical conditions associated with KIAA1376. MBLL39 (Accession NM_144778) is another VGAM2062 host target gene. MBLL39 BINDING SITE is HOST TARGET binding site found in the 3' untranslated region of mRNA encoded by MBLL39, corresponding to a HOST TARGET binding site such as BINDING SITE I, BINDING SITE II or BINDING SITE III. Table 2 illustrates the complementarity of the nucleotide sequences of MBLL39 BINDING SITE, designated SEQ ID:29570, to the nucleotide sequence of VGAM2062 RNA, herein designated VGAM RNA, also designated SEQ ID:4773.

Another function of VGAM2062 is therefore inhibition of MBLL39 (Accession NM_144778). Accordingly, utilities of VGAM2062 include diagnosis, prevention and treatment of diseases and clinical conditions associated with MBLL39. N-ethylmaleimide-sensitive Factor Attachment Protein, Gamma (NAPG, Accession XM_172983) is another VGAM2062 host target gene. NAPG BINDING SITE is HOST TARGET binding site found in the 3' untranslated region of mRNA encoded by NAPG, corresponding to a HOST TARGET binding site such as BINDING SITE I, BINDING SITE II or BINDING SITE III. Table 2 illustrates the complementarity of the nucleotide sequences of NAPG BINDING SITE, designated SEQ ID:46254, to the nucleotide sequence of VGAM2062 RNA, herein designated VGAM RNA, also designated SEQ ID:4773.

Another function of VGAM2062 is therefore inhibition of N-ethylmaleimide-sensitive Factor Attachment Protein, Gamma (NAPG, Accession XM_172983). Accordingly, utilities of VGAM2062 include diagnosis, prevention and treatment of diseases and clinical conditions associated with NAPG. Pellino Homolog 2 (Drosophila) (PELI2, Accession NM_021255) is another VGAM2062 host target gene. PELI2 BINDING SITE is HOST TARGET binding site found in the 3' untranslated region of mRNA encoded by PELI2, corresponding to a HOST TARGET binding site such as BINDING SITE I, BINDING SITE II or BINDING SITE III. Table 2 illustrates the complementarity of the nucleotide sequences of PELI2 BINDING SITE, designated SEQ ID:22231, to the nucleotide sequence of VGAM2062 RNA, herein designated VGAM RNA, also designated SEQ ID:4773.

Another function of VGAM2062 is therefore inhibition of Pellino Homolog 2 (Drosophila) (PELI2, Accession NM_021255). Accordingly, utilities of VGAM2062 include diagnosis, prevention and treatment of diseases and clinical conditions associated with PELI2. Protein Serine Kinase H1 (PSKH1, Accession XM_043047) is another VGAM2062 host target gene. PSKH1 BINDING SITE is HOST TARGET binding site found in the 3' untranslated region of mRNA encoded by PSKH1, corresponding to a HOST TARGET binding site such as BINDING SITE I, BINDING SITE II or BINDING SITE III. Table 2 illustrates the complementarity of the nucleotide sequences of PSKH1 BINDING SITE, designated SEQ ID:33868, to the nucleotide sequence of VGAM2062 RNA, herein designated VGAM RNA, also designated SEQ ID:4773.

Another function of VGAM2062 is therefore inhibition of Protein Serine Kinase H1 (PSKH1, Accession XM_043047). Accordingly, utilities of VGAM2062 include diagnosis, prevention and treatment of diseases and clinical conditions associated with PSKH1. SEC14-like 2 (S. cerevisiae) (SEC14L2, Accession NM_012429) is another VGAM2062 host target gene. SEC14L2 BINDING SITE is HOST TARGET binding site found in the 5' untranslated region of mRNA encoded by SEC14L2, corresponding to a HOST TARGET binding site such as BINDING SITE I, BINDING SITE II or BINDING SITE III. Table 2 illustrates the complementarity of the nucleotide sequences of SEC14L2 BINDING SITE, designated SEQ ID:14806, to the nucleotide sequence of VGAM2062 RNA, herein designated VGAM RNA, also designated SEQ ID:4773.

Another function of VGAM2062 is therefore inhibition of SEC14-like 2 (S. cerevisiae) (SEC14L2, Accession NM_012429). Accordingly, utilities of VGAM2062 include diagnosis, prevention and treatment of diseases and clinical conditions associated with SEC14L2. Zinc Finger Protein 339 (ZNF339, Accession NM_021220) is another VGAM2062 host target gene. ZNF339 BINDING SITE is HOST TARGET binding site found in the 3' untranslated region of mRNA encoded by ZNF339, corresponding to a HOST TARGET binding site such as BINDING SITE I, BINDING SITE II or BINDING SITE III. Table 2 illustrates the complementarity of the nucleotide sequences of ZNF339 BINDING SITE, designated SEQ ID:22200, to the nucleotide sequence of VGAM2062 RNA, herein designated VGAM RNA, also designated SEQ ID:4773.

Another function of VGAM2062 is therefore inhibition of Zinc Finger Protein 339 (ZNF339, Accession NM_021220). Accordingly, utilities of VGAM2062 include diagnosis, prevention and treatment of diseases and clinical conditions associated with ZNF339. LOC138654 (Accession XM_071015) is another VGAM2062 host target gene. LOC138654 BINDING SITE is HOST TARGET binding site found in the 5' untranslated region of mRNA encoded by LOC138654, corresponding to a HOST TARGET binding site such as BINDING SITE I, BINDING SITE II or BINDING SITE III. Table 2 illustrates the complementarity of the nucleotide sequences of LOC138654 BINDING SITE, designated SEQ ID:37397, to the nucleotide sequence of VGAM2062 RNA, herein designated VGAM RNA, also designated SEQ ID:4773.

Another function of VGAM2062 is therefore inhibition of LOC138654 (Accession XM_071015). Accordingly, utilities of VGAM2062 include diagnosis, prevention and treatment of diseases and clinical conditions associated with LOC138654. LOC142948 (Accession XM_096364) is another VGAM2062 host target gene. LOC142948 BINDING SITE is HOST TARGET binding site found in the 3' untranslated region of mRNA encoded by LOC142948, corresponding to a HOST TARGET binding site such as BINDING SITE I, BINDING SITE II or BINDING SITE III. Table 2 illustrates the complementarity of the nucleotide sequences of LOC142948 BINDING SITE, designated SEQ ID:40326, to the nucleotide sequence of VGAM2062 RNA, herein designated VGAM RNA, also designated SEQ ID:4773.

Another function of VGAM2062 is therefore inhibition of LOC142948 (Accession XM_096364). Accordingly, utilities of VGAM2062 include diagnosis, prevention and treatment of diseases and clinical conditions associated with LOC142948. LOC143916 (Accession XM_084664) is another VGAM2062 host target gene. LOC143916 BINDING SITE is HOST TARGET binding site found in the 3' untranslated region of mRNA encoded by LOC143916, corresponding to a HOST TARGET binding site such as BINDING SITE I, BINDING SITE II or BINDING SITE III. Table 2 illustrates the complementarity of the nucleotide sequences of LOC143916 BINDING SITE, designated SEQ ID:37654, to the nucleotide sequence of VGAM2062 RNA, herein designated VGAM RNA, also designated SEQ ID:4773.

Another function of VGAM2062 is therefore inhibition of LOC143916 (Accession XM_084664). Accordingly, utilities of VGAM2062 include diagnosis, prevention and treatment of diseases and clinical conditions associated with LOC143916. LOC145439 (Accession XM_085144) is another VGAM2062 host target gene. LOC145439 BINDING SITE is HOST TARGET binding site found in the 5' untranslated region of mRNA encoded by LOC145439, corresponding to a HOST TARGET binding site such as BINDING SITE I, BINDING SITE II or BINDING SITE III. Table 2 illustrates the complementarity of the nucleotide sequences of LOC145439 BINDING SITE, designated SEQ ID:37866, to the nucleotide sequence of VGAM2062 RNA, herein designated VGAM RNA, also designated SEQ ID:4773.

Another function of VGAM2062 is therefore inhibition of LOC145439 (Accession XM_085144). Accordingly, utilities of VGAM2062 include diagnosis, prevention and treatment of diseases and clinical conditions associated with LOC145439. LOC147178 (Accession XM_028755) is another VGAM2062 host target gene. LOC147178 BINDING SITE is HOST TARGET binding site found in the 3' untranslated region of mRNA encoded by LOC147178, corresponding to a HOST TARGET binding site such as BINDING SITE I, BINDING SITE II or BINDING SITE III. Table 2 illustrates the complementarity of the nucleotide sequences of LOC147178 BINDING SITE, designated SEQ ID:30744, to the nucleotide sequence of VGAM2062 RNA, herein designated VGAM RNA, also designated SEQ ID:4773.

Another function of VGAM2062 is therefore inhibition of LOC147178 (Accession XM_028755). Accordingly, utilities of VGAM2062 include diagnosis, prevention and treatment of diseases and clinical conditions associated with LOC147178. LOC151194 (Accession NM_145280) is another VGAM2062 host target gene. LOC151194 BINDING SITE is HOST TARGET binding site found in the 3' untranslated region of mRNA encoded by LOC151194, corresponding to a HOST TARGET binding site such as BINDING SITE I, BINDING SITE II or BINDING SITE III. Table 2 illustrates the complementarity of the nucleotide sequences of LOC151194 BINDING SITE, designated SEQ ID:29798, to the nucleotide sequence of VGAM2062 RNA, herein designated VGAM RNA, also designated SEQ ID:4773.

Another function of VGAM2062 is therefore inhibition of LOC151194 (Accession NM_145280). Accordingly, utilities of VGAM2062 include diagnosis, prevention and treatment of diseases and clinical conditions associated with LOC151194. LOC153416 (Accession XM_018473) is another VGAM2062 host target gene. LOC153416 BINDING SITE is HOST TARGET binding site found in the 3' untranslated region of mRNA encoded by LOC153416, corresponding to a HOST TARGET binding site such as BINDING SITE I, BINDING SITE II or BINDING SITE III. Table 2 illustrates the complementarity of the nucleotide sequences of LOC153416 BINDING SITE, designated SEQ ID:30361, to the nucleotide sequence of VGAM2062 RNA, herein designated VGAM RNA, also designated SEQ ID:4773.

Another function of VGAM2062 is therefore inhibition of LOC153416 (Accession XM_018473). Accordingly, utilities of VGAM2062 include diagnosis, prevention and treatment of diseases and clinical conditions associated with LOC153416. LOC157450 (Accession XM_048209) is another VGAM2062 host target gene. LOC157450 BINDING SITE is HOST TARGET binding site found in the 3' untranslated region of mRNA encoded by LOC157450, corresponding to a HOST TARGET binding site such as BINDING SITE I, BINDING SITE II or BINDING SITE III. Table 2 illustrates the complementarity of the nucleotide sequences of LOC157450 BINDING SITE, designated SEQ ID:35146, to the nucleotide sequence of VGAM2062 RNA, herein designated VGAM RNA, also designated SEQ ID:4773.

Another function of VGAM2062 is therefore inhibition of LOC157450 (Accession XM_048209). Accordingly, utilities of VGAM2062 include diagnosis, prevention and treatment of diseases and clinical conditions associated with LOC157450. LOC157556 (Accession XM_098783) is another VGAM2062 host target gene. LOC157556 BINDING SITE is HOST TARGET binding site found in the 5' untranslated region of mRNA encoded by LOC157556, corresponding to a HOST TARGET binding site such as BINDING SITE I, BINDING SITE II or BINDING SITE III. Table 2 illustrates the complementarity of the nucleotide sequences of LOC157556 BINDING SITE, designated SEQ ID:41823, to the nucleotide sequence of VGAM2062 RNA, herein designated VGAM RNA, also designated SEQ ID:4773.

Another function of VGAM2062 is therefore inhibition of LOC157556 (Accession XM_098783). Accordingly, utilities of VGAM2062 include diagnosis, prevention and treatment of diseases and clinical conditions associated with LOC157556. LOC158629 (Accession XM_098972) is another VGAM2062 host target gene. LOC158629 BINDING SITE is HOST TARGET binding site found in the 5' untranslated region of mRNA encoded by LOC158629, corresponding to a HOST TARGET binding site such as BINDING SITE I, BINDING SITE II or BINDING SITE III. Table 2 illustrates the complementarity of the nucleotide sequences of LOC158629 BINDING SITE, designated SEQ ID:42020, to the nucleotide sequence of VGAM2062 RNA, herein designated VGAM RNA, also designated SEQ ID:4773.

Another function of VGAM2062 is therefore inhibition of LOC158629 (Accession XM_098972). Accordingly, utilities of VGAM2062 include diagnosis, prevention and treatment of diseases and clinical conditions associated with LOC158629. LOC200301 (Accession XM_114197) is another VGAM2062 host target gene. LOC200301 BINDING SITE is HOST TARGET binding site found in the 3' untranslated region of mRNA encoded by LOC200301, corresponding to a HOST TARGET binding site such as BINDING SITE I, BINDING SITE II or BINDING SITE III. Table 2 illustrates the complementarity of the nucleotide sequences of LOC200301 BINDING SITE, designated SEQ ID:42784, to the nucleotide sequence of VGAM2062 RNA, herein designated VGAM RNA, also designated SEQ ID:4773.

Another function of VGAM2062 is therefore inhibition of LOC200301 (Accession XM_114197). Accordingly, utilities of VGAM2062 include diagnosis, prevention and treatment of diseases and clinical conditions associated with LOC200301. LOC220790 (Accession XM_166037) is another VGAM2062 host target gene. LOC220790 BINDING SITE is HOST TARGET binding site found in the 3' untranslated region of mRNA encoded by LOC220790, corresponding to a HOST TARGET binding site such as BINDING SITE I, BINDING SITE II or BINDING SITE III. Table 2 illustrates the complementarity of the nucleotide sequences of LOC220790 BINDING SITE, designated SEQ ID:43838, to the nucleotide sequence of VGAM2062 RNA, herein designated VGAM RNA, also designated SEQ ID:4773.

Another function of VGAM2062 is therefore inhibition of LOC220790 (Accession XM_166037). Accordingly, utilities of VGAM2062 include diagnosis, prevention and treatment of diseases and clinical conditions associated with LOC220790. LOC221795 (Accession XM_166491) is another VGAM2062 host target gene. LOC221795 BINDING SITE is HOST TARGET binding site found in the 5' untranslated region of mRNA encoded by LOC221795, corresponding to a HOST TARGET binding site such as BINDING SITE I, BINDING SITE II or BINDING SITE III. Table 2 illustrates the complementarity of the nucleotide sequences of LOC221795 BINDING SITE, designated SEQ ID:44424, to the nucleotide sequence of VGAM2062 RNA, herein designated VGAM RNA, also designated SEQ ID:4773.

Another function of VGAM2062 is therefore inhibition of LOC221795 (Accession XM_166491). Accordingly, utilities of VGAM2062 include diagnosis, prevention and treatment of diseases and clinical conditions associated with LOC221795. LOC257019 (Accession XM_171208) is another VGAM2062 host target gene. LOC257019 BINDING SITE is HOST TARGET binding site found in the 5' untranslated region of mRNA encoded by LOC257019, corresponding to a HOST TARGET binding site such as BINDING SITE I, BINDING SITE II or BINDING SITE III. Table 2 illustrates the complementarity of the nucleotide sequences of LOC257019 BINDING SITE, designated SEQ ID:45995, to the nucleotide sequence of VGAM2062 RNA, herein designated VGAM RNA, also designated SEQ ID:4773.

Another function of VGAM2062 is therefore inhibition of LOC257019 (Accession XM_171208). Accordingly, utilities of VGAM2062 include diagnosis, prevention and treatment of diseases and clinical conditions associated with LOC257019. LOC91664 (Accession XM_039908) is another VGAM2062 host target gene. LOC91664 BINDING SITE is HOST TARGET binding site found in the 3' untranslated region of mRNA encoded by LOC91664, corresponding to a HOST TARGET binding site such as BINDING SITE I, BINDING SITE II or BINDING SITE III. Table 2 illustrates the complementarity of the nucleotide sequences of LOC91664 BINDING SITE, designated SEQ ID:33213, to the nucleotide sequence of VGAM2062 RNA, herein designated VGAM RNA, also designated SEQ ID:4773.

Another function of VGAM2062 is therefore inhibition of LOC91664 (Accession XM_039908). Accordingly, utilities of VGAM2062 include diagnosis, prevention and treatment of diseases and clinical conditions associated with LOC91664. LOC93320 (Accession XM_050534) is another VGAM2062 host target gene. LOC93320 BINDING SITE is HOST TARGET binding site found in the 3' untranslated region of mRNA encoded by LOC93320, corresponding to a HOST TARGET binding site such as BINDING SITE I, BINDING SITE II or BINDING SITE III. Table 2 illustrates the complementarity of the nucleotide sequences of LOC93320 BINDING SITE, designated SEQ ID:35655, to the nucleotide sequence of VGAM2062 RNA, herein designated VGAM RNA, also designated SEQ ID:4773.

Another function of VGAM2062 is therefore inhibition of LOC93320 (Accession XM_050534). Accordingly, utilities of VGAM2062 include diagnosis, prevention and treatment of diseases and clinical conditions associated with LOC93320. FIG. 1 further provides a conceptual description of a novel bioinformatically detected viral gene of the present invention, referred to here as Viral Genomic Address Messenger 2063 (VGAM2063) viral gene, which modulates expression of respective host target genes thereof, the function and utility of which host target genes is known in the art.

VGAM2063 is a novel bioinformatically detected regulatory, non protein coding, viral micro RNA (miRNA) gene. The method by which VGAM2063 was detected is described hereinabove with reference to FIGS. 1-8.

VGAM2063 gene, herein designated VGAM GENE, is a viral gene contained in the genome of Ectromelia Virus. VGAM2063 host target gene, herein designated VGAM HOST TARGET GENE, is a human gene contained in the human genome.

VGAM2063 gene encodes a VGAM2063 precursor RNA, herein designated VGAM PRECURSOR RNA. Similar to other miRNA genes, and unlike most ordinary genes, VGAM2063 precursor RNA does not encode a protein. A nucleotide sequence identical or highly similar to the nucleotide sequence of VGAM2063 precursor RNA is designated SEQ ID:2049, and is provided hereinbelow with reference to the sequence listing part. Nucleotide sequence SEQ ID:2049 is located at position 7074 relative to the genome of Ectromelia Virus.

VGAM2063 precursor RNA folds onto itself, forming VGAM2063 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2063 folded precursor RNA into VGAM2063 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2063 RNA is designated SEQ ID:4774, and is provided hereinbelow with reference to the sequence listing part.

VGAM2063 host target gene, herein designated VGAM HOST TARGET GENE, encodes a corresponding messenger RNA, VGAM2063 host target RNA, herein designated VGAM HOST TARGET RNA. VGAM2063 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2063 RNA, herein designated VGAM RNA, binds complementarily to one or more host target binding sites located in untranslated regions of VGAM2063 host target RNA, herein designated VGAM HOST TARGET RNA. This complementary binding is due to the fact that the nucleotide sequence of VGAM2063 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2063 RNA, herein designated VGAM RNA, may have a different number of host target binding sites in untranslated regions of a VGAM2063 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2063 RNA, herein designated VGAM RNA, to host target binding sites on VGAM2063 host target RNA, herein designated VGAM HOST TARGET RNA, such as BINDING SITE I, BINDING SITE II and BINDING SITE III, inhibits translation of VGAM2063 host target RNA into VGAM2063 host target protein, herein designated VGAM HOST TARGET PROTEIN. VGAM host target protein is therefore outlined by a broken line.

It is appreciated that VGAM2063 host target gene, herein designated VGAM HOST TARGET GENE, in fact represents a plurality of VGAM2063 host target genes. The mRNA of each one of this plurality of VGAM2063 host target genes comprises one or more host target binding sites, each having a nucleotide sequence which is at least partly complementary to VGAM2063 RNA, herein designated VGAM RNA, and which when bound by VGAM2063 RNA causes inhibition of translation of respective one or more VGAM2063 host target proteins.

It is further appreciated by one skilled in the art that the mode of translational inhibition illustrated by FIG. 1 with specific reference to translational inhibition exerted by VGAM2063 gene, herein designated VGAM GENE, on one or more VGAM2063 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2063 is inhibition of expression of host target genes, as part of a novel viral mechanism of attacking a host. Accordingly, utilities of VGAM2063 include diagnosis, prevention and treatment of viral infection by Ectromelia Virus. Specific functions, and accordingly utilities, of VGAM2063 correlate with, and may be deduced from, the identity of the host target genes which VGAM2063 binds and inhibits, and the function of these host target genes, as elaborated hereinbelow.

Nucleotide sequences of the VGAM2063 precursor RNA, herein designated VGAM PRECURSOR RNA, and of the 'diced' VGAM2063 RNA, herein designated VGAM RNA, and a schematic representation of the secondary folding of VGAM2063 folded precursor RNA, herein designated VGAM FOLDED PRECURSOR RNA, of VGAM2063 are further described hereinbelow with reference to Table 1.

Nucleotide sequences of host target binding sites, such as BINDING SITE-I, BINDING SITE-II and BINDING SITE-III of FIG. 1, found on VGAM2063 host target RNA, and schematic representation of the complementarity of each of these host target binding sites to VGAM2063 RNA, herein designated VGAM RNA, are described hereinbelow with reference to Table 2.

As mentioned hereinabove with reference to FIG. 1, a function of VGAM2063 gene, herein designated VGAM is inhibition of expression of VGAM2063 target genes. It is appreciated that specific functions, and accordingly utilities, of VGAM2063 correlate with, and may be deduced from, the identity of the target genes which VGAM2063 binds and inhibits, and the function of these target genes, as elaborated hereinbelow.

Diacylglycerol Kinase, Beta 90 kDa (DGKB, Accession XM_166516) is a VGAM2063 host target gene. DGKB BINDING SITE is HOST TARGET binding site found in the 3' untranslated region of mRNA encoded by DGKB, corresponding to a HOST TARGET binding site such as BINDING SITE I, BINDING SITE II or BINDING SITE III. Table 2 illustrates the complementarity of the nucleotide sequences of DGKB BINDING SITE, designated SEQ ID:44447, to the nucleotide sequence of VGAM2063 RNA, herein designated VGAM RNA, also designated SEQ ID:4774.

A function of VGAM2063 is therefore inhibition of Diacylglycerol Kinase, Beta 90 kDa (DGKB, Accession XM_166516), a gene which regulates the intracellular concentration of the second messenger diacylglycerol (DAG). Accordingly, utilities of VGAM2063 include diagnosis, prevention and treatment of diseases and clinical conditions associated with DGKB. The function of DGKB and its association with various diseases and clinical conditions, has been established by previous studies, as described hereinabove with reference to VGAM497. Myelin Oligodendrocyte Glycoprotein (MOG, Accession NM_002433) is another VGAM2063 host target gene. MOG BINDING SITE is HOST TARGET binding site found in the 3' untranslated region of mRNA encoded by MOG, corresponding to a HOST TARGET binding site such as BINDING SITE I, BINDING SITE II or BINDING SITE III. Table 2 illustrates the complementarity of the nucleotide sequences of MOG BINDING SITE, designated SEQ ID:8278, to the nucleotide sequence of VGAM2063 RNA, herein designated VGAM RNA, also designated SEQ ID:4774.

Another function of VGAM2063 is therefore inhibition of Myelin Oligodendrocyte Glycoprotein (MOG, Accession NM_002433). Accordingly, utilities of VGAM2063 include diagnosis, prevention and treatment of diseases and clinical conditions associated with MOG. SAC1 Suppressor of Actin Mutations 1-like (yeast) (SACM1L, Accession NM_014016) is another VGAM2063 host target gene. SACM1L BINDING SITE is HOST TARGET binding site found in the 3' untranslated region of mRNA encoded by SACM1L, corresponding to a HOST TARGET binding site such as BINDING SITE I, BINDING SITE II or BINDING SITE III. Table 2 illustrates the complementarity of the nucleotide sequences of SACM1L BINDING SITE, designated SEQ ID:15236, to the nucleotide sequence of VGAM2063 RNA, herein designated VGAM RNA, also designated SEQ ID:4774.

Another function of VGAM2063 is therefore inhibition of SAC1 Suppressor of Actin Mutations 1-like (yeast) (SACM1L, Accession NM_014016), a gene which suggests the presence of a tumor suppressor gene. Accordingly, utilities of VGAM2063 include diagnosis, prevention and treatment of diseases and clinical conditions associated with SACM1L. The function of SACM1L has been established by previous studies. 2. Chen, Y.; Cann, M. J.; Litvin, T. N.; Iourgenko, V.; Sinclair, M. L.; Levin, L. R.; Buck, J.: Soluble adenylyl cyclase as an evolutionarily conserved bicarbonate sensor. Science 289:625-628, 2000. PubMed ID:10915626 3. Reed, B. Y.; Gitomer, W. L.; Heller, H. J.; Hsu, M. C.; Lemke, M.; Padalino, P.; Pak, C. Y. C.: Identification and characterization of a gene with base substitutions associated with the absorptive hypercalciuria phenotype and low spinal bone density. J. Clin. Endocr. Metab. 87:1476-1485, 2002. PubMed ID:11932268

Full details of the abovementioned studies are described in the following publications, the disclosure of which are hereby incorporated by reference:

Kiss, H.; Kedra, D.; Kiss, C.; Kost-Alimova, M.; Yang, Y.; Klein, G.; Imreh, S.; Dumanski, J. P.: The LZTFL1 gene is a part of a transcriptional map covering 250 kb within the common eliminated region 1 (C3CER1) in 3p21.3. Genomics 73:10-19, 2001; and Nagase, T.; Kikuno, R.; Hattori, A.; Kondo, Y.; Okumura, K.; Ohara, O.: Prediction of the coding sequences of unidentified human genes. XIX. The complete sequences of 100 new cDNA clon.

Further studies establishing the function and utilities of SACM1L are found in John Hopkins OMIM database record ID 606569, and in sited publications numbered 555 and 6104 listed in the bibliography section hereinbelow, which are also hereby incorporated by reference. Vascular Cell Adhesion Molecule 1 (VCAM1, Accession NM_080682) is another VGAM2063 host target gene. VCAM1 BINDING SITE1 and VCAM1 BINDING SITE2 are HOST TARGET binding sites found in untranslated regions of mRNA encoded by VCAM1, corresponding to HOST TARGET binding sites such as BINDING SITE I, BINDING SITE II or BINDING SITE III. Table 2 illustrates the complementarity of the nucleotide sequences of VCAM1 BINDING SITE1 and VCAM1 BINDING SITE2, designated SEQ ID:27985 and SEQ ID:6739 respectively, to the nucleotide sequence of VGAM2063 RNA, herein designated VGAM RNA, also designated SEQ ID:4774.

Another function of VGAM2063 is therefore inhibition of Vascular Cell Adhesion Molecule 1 (VCAM1, Accession NM_080682). Accordingly, utilities of VGAM2063 include diagnosis, prevention and treatment of diseases and clinical conditions associated with VCAM1. FLJ00060 (Accession XM_028154) is another VGAM2063 host target gene. FLJ00060 BINDING SITE is HOST TARGET binding site found in the 3' untranslated region of mRNA encoded by FLJ00060, corresponding to a HOST TARGET binding site such as BINDING SITE I, BINDING SITE II or BINDING SITE III. Table 2 illustrates the complementarity of the nucleotide sequences of FLJ00060 BINDING SITE, designated SEQ ID:30626, to the nucleotide sequence of VGAM2063 RNA, herein designated VGAM RNA, also designated SEQ ID:4774.

Another function of VGAM2063 is therefore inhibition of FLJ00060 (Accession XM_028154). Accordingly, utilities of VGAM2063 include diagnosis, prevention and treatment of diseases and clinical conditions associated with FLJ00060. KIAA0419 (Accession NM_014711) is another VGAM2063 host target gene. KIAA0419 BINDING SITE is HOST TARGET binding site found in the 3' untranslated region of mRNA encoded by KIAA0419, corresponding to a HOST TARGET binding site such as BINDING SITE I, BINDING SITE II or BINDING SITE III. Table 2 illustrates the complementarity of the nucleotide sequences of KIAA0419 BINDING SITE, designated SEQ ID:16259, to the nucleotide sequence of VGAM2063 RNA, herein designated VGAM RNA, also designated SEQ ID:4774.

Another function of VGAM2063 is therefore inhibition of KIAA0419 (Accession NM_014711). Accordingly, utilities of VGAM2063 include diagnosis, prevention and treatment of diseases and clinical conditions associated with KIAA0419. Lipoma HMGIC Fusion Partner-like 2 (LHFPL2, Accession XM_046054) is another VGAM2063 host target gene. LHFPL2 BINDING SITE is HOST TARGET binding site found in the 3' untranslated region of mRNA encoded by LHFPL2, corresponding to a HOST TARGET binding site such as BINDING SITE I, BINDING SITE II or BINDING SITE III. Table 2 illustrates the complementarity of the nucleotide sequences of LHFPL2 BINDING SITE, designated SEQ ID:34659, to the nucleotide sequence of VGAM2063 RNA, herein designated VGAM RNA, also designated SEQ ID:4774.

Another function of VGAM2063 is therefore inhibition of Lipoma HMGIC Fusion Partner-like 2 (LHFPL2, Accession XM_046054). Accordingly, utilities of VGAM2063 include diagnosis, prevention and treatment of diseases and clinical conditions associated with LHFPL2. LOC256683 (Accession XM_172321) is another VGAM2063 host target gene. LOC256683 BINDING SITE is HOST TARGET binding site found in the 5' untranslated region of mRNA encoded by LOC256683, corresponding to a HOST TARGET binding site such as BINDING SITE I, BINDING SITE II or BINDING SITE III. Table 2 illustrates the complementarity of the nucleotide sequences of LOC256683 BINDING SITE, designated SEQ ID:46069, to the nucleotide sequence of VGAM2063 RNA, herein designated VGAM RNA, also designated SEQ ID:4774.

Another function of VGAM2063 is therefore inhibition of LOC256683 (Accession XM_172321). Accordingly, utilities of VGAM2063 include diagnosis, prevention and treatment of diseases and clinical conditions associated with LOC256683. FIG. 1 further provides a conceptual description of a novel bioinformatically detected viral gene of the present invention, referred to here as Viral Genomic Address Messenger 2064 (VGAM2064) viral gene, which modulates expression of respective host target genes thereof, the function and utility of which host target genes is known in the art.

VGAM2064 is a novel bioinformatically detected regulatory, non protein coding, viral micro RNA (miRNA) gene. The method by which VGAM2064 was detected is described hereinabove with reference to FIGS. 1-8.

VGAM2064 gene, herein designated VGAM GENE, is a viral gene contained in the genome of Peanut Bud Necrosis Virus. VGAM2064 host target gene, herein designated VGAM HOST TARGET GENE, is a human gene contained in the human genome.

VGAM2064 gene encodes a VGAM2064 precursor RNA, herein designated VGAM PRECURSOR RNA. Similar to other miRNA genes, and unlike most ordinary genes, VGAM2064 precursor RNA does not encode a protein. A nucleotide sequence identical or highly similar to the nucleotide sequence of VGAM2064 precursor RNA is designated SEQ ID:2050, and is provided hereinbelow with reference to the sequence listing part. Nucleotide sequence SEQ ID:2050 is located at position 3726 relative to the genome of Peanut Bud Necrosis Virus.

VGAM2064 precursor RNA folds onto itself, forming VGAM2064 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2064 folded precursor RNA into VGAM2064 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2064 RNA is designated SEQ ID:4775, and is provided hereinbelow with reference to the sequence listing part.

VGAM2064 host target gene, herein designated VGAM HOST TARGET GENE, encodes a corresponding messenger RNA, VGAM2064 host target RNA, herein designated VGAM HOST TARGET RNA. VGAM2064 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2064 RNA, herein designated VGAM RNA, binds complementarily to one or more host target binding sites located in untranslated regions of VGAM2064 host target RNA, herein designated VGAM HOST TARGET RNA. This complementary binding is due to the fact that the nucleotide sequence of VGAM2064 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2064 RNA, herein designated VGAM RNA, may have a different number of host target binding sites in untranslated regions of a VGAM2064 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2064 RNA, herein designated VGAM RNA, to host target binding sites on VGAM2064 host target RNA, herein designated VGAM HOST TARGET RNA, such as BINDING SITE I, BINDING SITE II and BINDING SITE III, inhibits translation of VGAM2064 host target RNA into VGAM2064 host target protein, herein designated VGAM HOST TARGET PROTEIN. VGAM host target protein is therefore outlined by a broken line.

It is appreciated that VGAM2064 host target gene, herein designated VGAM HOST TARGET GENE, in fact represents a plurality of VGAM2064 host target genes. The mRNA of each one of this plurality of VGAM2064 host target genes comprises one or more host target binding sites, each having a nucleotide sequence which is at least partly complementary to VGAM2064 RNA, herein designated VGAM RNA, and which when bound by VGAM2064 RNA causes inhibition of translation of respective one or more VGAM2064 host target proteins.

It is further appreciated by one skilled in the art that the mode of translational inhibition illustrated by FIG. 1 with specific reference to translational inhibition exerted by VGAM2064 gene, herein designated VGAM GENE, on one or more VGAM2064 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2064 is inhibition of expression of host target genes, as part of a novel viral mechanism of attacking a host. Accordingly, utilities of VGAM2064 include diagnosis, prevention and treatment of viral infection by Peanut Bud Necrosis Virus. Specific functions, and accordingly utilities, of VGAM2064 correlate with, and may be deduced from, the identity of the host target genes which VGAM2064 binds and inhibits, and the function of these host target genes, as elaborated hereinbelow.

Nucleotide sequences of the VGAM2064 precursor RNA, herein designated VGAM PRECURSOR RNA, and of the 'diced' VGAM2064 RNA, herein designated VGAM RNA, and a schematic representation of the secondary folding of VGAM2064 folded precursor RNA, herein designated VGAM FOLDED PRECURSOR RNA, of VGAM2064 are further described hereinbelow with reference to Table 1.

Nucleotide sequences of host target binding sites, such as BINDING SITE-I, BINDING SITE-II and BINDING SITE-III of FIG. 1, found on VGAM2064 host target RNA, and schematic representation of the complementarity of each of these host target binding sites to VGAM2064 RNA, herein designated VGAM RNA, are described hereinbelow with reference to Table 2.

As mentioned hereinabove with reference to FIG. 1, a function of VGAM2064 gene, herein designated VGAM is inhibition of expression of VGAM2064 target genes. It is appreciated that specific functions, and accordingly utilities, of VGAM2064 correlate with, and may be deduced from, the identity of the target genes which VGAM2064 binds and inhibits, and the function of these target genes, as elaborated hereinbelow.

CD44 Antigen (homing function and Indian blood group system) (CD44, Accession NM_000610) is a VGAM2064 host target gene. CD44 BINDING SITE is HOST TARGET binding site found in the 5' untranslated region of mRNA encoded by CD44, corresponding to a HOST TARGET binding site such as BINDING SITE I, BINDING SITE II or BINDING SITE III. Table 2 illustrates the complementarity of the nucleotide sequences of CD44 BINDING SITE, designated SEQ ID:6212, to the nucleotide sequence of VGAM2064 RNA, herein designated VGAM RNA, also designated SEQ ID:4775.

A function of VGAM2064 is therefore inhibition of CD44 Antigen (homing function and Indian blood group system) (CD44, Accession NM_000610), a gene which is main cell surface receptor for hyaluronate, and involves in matrix adhesion, lymphocyte activation and lymph node homing. Accordingly, utilities of VGAM2064 include diagnosis, prevention and treatment of diseases and clinical conditions associated with CD44. The function of CD44 and its association with various diseases and clinical conditions, has been established by previous studies, as described hereinabove with reference to VGAM1928. Mitochondrial Ribosomal Protein L49 (MRPL49, Accession XM_045499) is another VGAM2064 host target gene. MRPL49 BINDING SITE is HOST TARGET binding site found in the 3' untranslated region of mRNA encoded by MRPL49, corresponding to a HOST TARGET binding site such as BINDING SITE I, BINDING SITE II or BINDING SITE III. Table 2 illustrates the complementarity of the nucleotide sequences of MRPL49 BINDING SITE, designated SEQ ID:34476, to the nucleotide sequence of VGAM2064 RNA, herein designated VGAM RNA, also designated SEQ ID:4775.

Another function of VGAM2064 is therefore inhibition of Mitochondrial Ribosomal Protein L49 (MRPL49, Accession XM_045499). Accordingly, utilities of VGAM2064 include diagnosis, prevention and treatment of diseases and clinical conditions associated with MRPL49. Neuronal Pentraxin I (NPTX1, Accession NM_002522) is another VGAM2064 host target gene. NPTX1 BINDING SITE is HOST TARGET binding site found in the 3' untranslated region of mRNA encoded by NPTX1, corresponding to a HOST TARGET binding site such as BINDING SITE I, BINDING SITE II or BINDING SITE III. Table 2 illustrates the complementarity of the nucleotide sequences of NPTX1 BINDING SITE, designated SEQ ID:8354, to the nucleotide sequence of VGAM2064 RNA, herein designated VGAM RNA, also designated SEQ ID:4775.

Another function of VGAM2064 is therefore inhibition of Neuronal Pentraxin I (NPTX1, Accession NM_002522), a gene which may be involved in synaptic uptake of extracellular material and is very strongly similar to rat NP1. Accordingly, utilities of VGAM2064 include diagnosis, prevention and treatment of diseases and clinical conditions associated with NPTX1. The function of NPTX1 and its association with various diseases and clinical conditions, has been established by previous studies, as described hereinabove with reference to VGAM111. Staufen, RNA Binding Protein (Drosophila) (STAU, Accession NM_004602) is another VGAM2064 host target gene. STAU BINDING SITE1 through STAU BINDING SITE4 are HOST TARGET binding sites found in untranslated regions of mRNA encoded by STAU, corresponding to HOST TARGET binding sites such as BINDING SITE I, BINDING SITE II or BINDING SITE III. Table 2 illustrates the complementarity of the nucleotide sequences of STAU BINDING SITE1 through STAU BINDING SITE4, designated SEQ ID:10943, SEQ ID:18915, SEQ ID:18921 and SEQ ID:18927 respectively, to the nucleotide sequence of VGAM2064 RNA, herein designated VGAM RNA, also designated SEQ ID:4775.

Another function of VGAM2064 is therefore inhibition of Staufen, RNA Binding Protein (Drosophila) (STAU, Accession NM_004602), a gene which may play a role in specific positioning of mrnas at given sites in the cell and in stimulating their translation at the site. Accordingly, utilities of VGAM2064 include diagnosis, prevention and treatment of diseases and clinical conditions associated with STAU. The function of STAU and its association with various diseases and clinical conditions, has been established by previous studies, as described hereinabove with reference to VGAM916. Hairy/enhancer-of-split Related with YRPW Motif 1 (HEY1, Accession XM_166062) is another VGAM2064 host target gene. HEY1 BINDING SITE is HOST TARGET binding site found in the 3' untranslated region of mRNA encoded by HEY1, corresponding to a HOST TARGET binding site such as BINDING SITE I, BINDING SITE II or BINDING SITE III. Table 2 illustrates the complementarity of the nucleotide sequences of HEY1 BINDING SITE, designated SEQ ID:43847, to the nucleotide sequence of VGAM2064 RNA, herein designated VGAM RNA, also designated SEQ ID:4775.

Another function of VGAM2064 is therefore inhibition of Hairy/enhancer-of-split Related with YRPW Motif 1 (HEY1, Accession XM_166062). Accordingly, utilities of VGAM2064 include diagnosis, prevention and treatment of diseases and clinical conditions associated with HEY1. KIAA0335 (Accession NM_014803) is another VGAM2064 host target gene. KIAA0335 BINDING SITE is HOST TARGET binding site found in the 3' untranslated region of mRNA encoded by KIAA0335, corresponding to a HOST TARGET binding site such as BINDING SITE I, BINDING SITE II or BINDING SITE III. Table 2 illustrates the complementarity of the nucleotide sequences of KIAA0335 BINDING SITE, designated SEQ ID:16731, to the nucleotide sequence of VGAM2064 RNA, herein designated VGAM RNA, also designated SEQ ID:4775.

Another function of VGAM2064 is therefore inhibition of KIAA0335 (Accession NM_014803). Accordingly, utilities of VGAM2064 include diagnosis, prevention and treatment of diseases and clinical conditions associated with KIAA0335. KIAA0763 (Accession NM_014869) is another VGAM2064 host target gene. KIAA0763 BINDING SITE is HOST TARGET binding site found in the 3' untranslated region of mRNA encoded by KIAA0763, corresponding to a HOST TARGET binding site such as BINDING SITE I, BINDING SITE II or BINDING SITE III. Table 2 illustrates the complementarity of the nucleotide sequences of KIAA0763 BINDING SITE, designated SEQ ID:16967, to the nucleotide sequence of VGAM2064 RNA, herein designated VGAM RNA, also designated SEQ ID:4775.

Another function of VGAM2064 is therefore inhibition of KIAA0763 (Accession NM_014869). Accordingly, utilities of VGAM2064 include diagnosis, prevention and treatment of diseases and clinical conditions associated with KIAA0763. LOC221683 (Accession XM_168089) is another VGAM2064 host target gene. LOC221683 BINDING SITE is HOST TARGET binding site found in the 5' untranslated region of mRNA encoded by LOC221683, corresponding to a HOST TARGET binding site such as BINDING SITE I, BINDING SITE II or BINDING SITE III. Table 2 illustrates the complementarity of the nucleotide sequences of LOC221683 BINDING SITE, designated SEQ ID:45002, to the nucleotide sequence of VGAM2064 RNA, herein designated VGAM RNA, also designated SEQ ID:4775.

Another function of VGAM2064 is therefore inhibition of LOC221683 (Accession XM_168089). Accordingly, utilities of VGAM2064 include diagnosis, prevention and treatment of diseases and clinical conditions associated with LOC221683. LOC91445 (Accession XM_018516) is another VGAM2064 host target gene. LOC91445 BINDING SITE is HOST TARGET binding site found in the 3' untranslated region of mRNA encoded by LOC91445, corresponding to a HOST TARGET binding site such as BINDING SITE I, BINDING SITE II or BINDING SITE III. Table 2 illustrates the complementarity of the nucleotide sequences of LOC91445 BINDING SITE, designated SEQ ID:30370, to the nucleotide sequence of VGAM2064 RNA, herein designated VGAM RNA, also designated SEQ ID:4775.

Another function of VGAM2064 is therefore inhibition of LOC91445 (Accession XM_018516). Accordingly, utilities of VGAM2064 include diagnosis, prevention and treatment of diseases and clinical conditions associated with LOC91445. FIG. 1 further provides a conceptual description of a novel bioinformatically detected viral gene of the present invention, referred to here as Viral Genomic Address Messenger 2065 (VGAM2065) viral gene, which modulates expression of respective host target genes thereof, the function and utility of which host target genes is known in the art.

VGAM2065 is a novel bioinformatically detected regulatory, non protein coding, viral micro RNA (miRNA) gene. The method by which VGAM2065 was detected is described hereinabove with reference to FIGS. 1-8.

VGAM2065 gene, herein designated VGAM GENE, is a viral gene contained in the genome of Ectromelia Virus. VGAM2065 host target gene, herein designated VGAM HOST TARGET GENE, is a human gene contained in the human genome.

VGAM2065 gene encodes a VGAM2065 precursor RNA, herein designated VGAM PRECURSOR RNA. Similar to other miRNA genes, and unlike most ordinary genes, VGAM2065 precursor RNA does not encode a protein. A nucleotide sequence identical or highly similar to the nucleotide sequence of VGAM2065 precursor RNA is designated SEQ ID:2051, and is provided hereinbelow with reference to the sequence listing part. Nucleotide sequence SEQ ID:2051 is located at position 18973 relative to the genome of Ectromelia Virus.

VGAM2065 precursor RNA folds onto itself, forming VGAM2065 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2065 folded precursor RNA into VGAM2065 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM2065 RNA is designated SEQ ID:4776, and is provided hereinbelow with reference to the sequence listing part.

VGAM2065 host target gene, herein designated VGAM HOST TARGET GENE, encodes a corresponding messenger RNA, VGAM2065 host target RNA, herein designated VGAM HOST TARGET RNA. VGAM2065 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2065 RNA, herein designated VGAM RNA, binds complementarily to one or more host target binding sites located in untranslated regions of VGAM2065 host target RNA, herein designated VGAM HOST TARGET RNA. This complementary binding is due to the fact that the nucleotide sequence of VGAM2065 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2065 RNA, herein designated VGAM RNA, may have a different number of host target binding sites in untranslated regions of a VGAM2065 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2065 RNA, herein designated VGAM RNA, to host target binding sites on VGAM2065 host target RNA, herein designated VGAM HOST TARGET RNA, such as BINDING SITE I, BINDING SITE II and BINDING SITE III, inhibits translation of VGAM2065 host target RNA into VGAM2065 host target protein, herein designated VGAM HOST TARGET PROTEIN. VGAM host target protein is therefore outlined by a broken line.

It is appreciated that VGAM2065 host target gene, herein designated VGAM HOST TARGET GENE, in fact represents a plurality of VGAM2065 host target genes. The mRNA of each one of this plurality of VGAM2065 host target genes comprises one or more host target binding sites, each having a nucleotide sequence which is at least partly complementary to VGAM2065 RNA, herein designated VGAM RNA, and which when bound by VGAM2065 RNA causes inhibition of translation of respective one or more VGAM2065 host target proteins.

It is further appreciated by one skilled in the art that the mode of translational inhibition illustrated by FIG. 1 with specific reference to translational inhibition exerted by VGAM2065 gene, herein designated VGAM GENE, on one or more VGAM2065 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2065 is inhibition of expression of host target genes, as part of a novel viral mechanism of attacking a host. Accordingly, utilities of VGAM2065 include diagnosis, prevention and treatment of viral infection by Ectromelia Virus. Specific functions, and accordingly utilities, of VGAM2065 correlate with, and may be deduced from, the identity of the host target genes which VGAM2065 binds and inhibits, and the function of these host target genes, as elaborated hereinbelow.

Nucleotide sequences of the VGAM2065 precursor RNA, herein designated VGAM PRECURSOR RNA, and of the 'diced' VGAM2065 RNA, herein designated VGAM RNA, and a schematic representation of the secondary folding of VGAM2065 folded precursor RNA, herein designated VGAM FOLDED PRECURSOR RNA, of VGAM2065 are further described hereinbelow with reference to Table 1.

Nucleotide sequences of host target binding sites, such as BINDING SITE-I, BINDING SITE-II and BINDING SITE-III of FIG. 1, found on VGAM2065 host target RNA, and schematic representation of the complementarity of each of these host target binding sites to VGAM2065 RNA, herein designated VGAM RNA, are described hereinbelow with reference to Table 2.

As mentioned hereinabove with reference to FIG. 1, a function of VGAM2065 gene, herein designated VGAM is inhibition of expression of VGAM2065 target genes. It is appreciated that specific functions, and accordingly utilities, of VGAM2065 correlate with, and may be deduced from, the identity of the target genes which VGAM2065 binds and inhibits, and the function of these target genes, as elaborated hereinbelow.

APM1 (Accession NM_004797) is a VGAM2065 host target gene. APM1 BINDING SITE is HOST TARGET binding site found in the 3' untranslated region of mRNA encoded by APM1, corresponding to a HOST TARGET binding site such as BINDING SITE I, BINDING SITE II or BINDING SITE III. Table 2 illustrates the complementarity of the nucleotide sequences of APM1 BINDING SITE, designated SEQ ID:11208, to the nucleotide sequence of VGAM2065 RNA, herein designated VGAM RNA, also designated SEQ ID:4776.

A function of VGAM2065 is therefore inhibition of APM1 (Accession NM_004797). Accordingly, utilities of VGAM2065 include diagnosis, prevention and treatment of diseases and clinical conditions associated with APM1. Protein Kinase C, Beta 1 (PRKCB1, Accession XM_047187) is another VGAM2065 host target gene. PRKCB1 BINDING SITE is HOST TARGET binding site found in the 3' untranslated region of mRNA encoded by PRKCB1, corresponding to a HOST TARGET binding site such as BINDING SITE I, BINDING SITE II or BINDING SITE III. Table 2 illustrates the complementarity of the nucleotide sequences of PRKCB1 BINDING SITE, designated SEQ ID:34903, to the nucleotide sequence of VGAM2065 RNA, herein designated VGAM RNA, also designated SEQ ID:4776.

Another function of VGAM2065 is therefore inhibition of Protein Kinase C, Beta 1 (PRKCB1, Accession XM_047187), a gene which is a calcium-activated, phospholipid-dependent, serine- and threonine-specific enzyme. Accordingly, utilities of VGAM2065 include diagnosis, prevention and treatment of diseases and clinical conditions associated with PRKCB1. The function of PRKCB1 has been established by previous studies. Greenham et al. (1998) determined the genomic structure of the PRKCB gene. The PRKCB gene consists of 18 exons spanning 375 kb, with a particularly large intron of over 150 kb between exons 2 and 3. Exons range from 32 to 174 bp in length. Francke et al. (1989) stated that the most likely location of PKCB is 16p11.2. Animal model experiments lend further support to the function of PRKCB1. Leitges et al. (1996) found that mice homozygous for a targeted disruption of the Prkcb1 gene develop an immunodeficiency characterized by impaired humoral immune responses and reduced cellular responses of B cells similar to X-linked immunodeficiency (Xid) in mice (see OMIM Ref. No. 300300). Thus, they concluded that the 2 isoforms, PKC-beta-I (OMIM Ref. No. PRKCB1) and PKC-beta-II (OMIM Ref. No. PRKCB2), play an important role in B-cell activation and may be functionally linked to Bruton tyrosine kinase (OMIM Ref. No. 300300) in antigen receptor-mediated signal transduction. Su et al. (2002) showed that mice lacking Prkcb are unable to activate Nfkb (OMIM Ref. No. 164011) and promote cell survival in B cells upon BCR signaling, or even in mast cells which, unlike B cells, also express Prkcq (OMIM Ref. No. 600448). The failure to activate Nfkb is associated with a lack of Ikba (OMIM Ref. No. 164008) degradation as well as an absence of Ikka (OMIM Ref. No. 600664) phosphorylation activity. Prkcb -/- mice, lacking the Prkcb enzyme in lipid rafts after BCR stimulation, are also unable to recruit Ikka and Ikkb (OMIM Ref. No. 603258) to the rafts in B cells and have a reduced capacity to recruit other members of the BCR signalosome. However, Prkcb-deficient mice, unlike Xid mice, do have mature B cells expressing IgM and IgD, suggesting that the cells are maintained by an alternative Nfkb-activating pathway, e.g., through CD40 (OMIM Ref. No. 109535). Su et al. (2002) observed that specific Prkcb small molecule inhibitors block the survival of non-Hodgkin diffuse large B cell lymphoma (DLBCL) cell lines, with the effective dose depending on the level of cellular Prkcb. DLBCL lines not expressing Prkcb were not susceptible to the inhibitors. Su et al. (2002) proposed that PRKCB inhibitors and inhibitors of other PRKC isoforms may be effective in treating disorders characterized by dysregulated NFKB survival signaling.

It is appreciated that the abovementioned animal model for PRKCB1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Leitges, M.; Schmedt, C.; Guinamard, R.; Davoust, J.; Schaal, S.; Stabel, S.; Tarakhovsky, A.: Immunodeficiency in protein kinase C-beta-deficient mice. Science 273:788-791, 1996; and Su, T. T.; Guo, B.; Kawakami, Y.; Sommer, K.; Chae, K.; Humphries, L. A.; Kato, R. M.; Kang, S.; Patrone, L.; Wall, R.; Teitell, M.; Leitges, M.; Kawakami, T.; Rawlings, D. J.: PKC-beta.

Further studies establishing the function and utilities of PRKCB1 are found in John Hopkins OMIM database record ID 176970, and in sited publications numbered 154 and 1544-1546 listed in the bibliography section hereinbelow, which are also hereby incorporated by reference. Calcium/calmodulin-dependent Protein Kinase (CaM kinase) II Gamma (CAMK2G, Accession XM_044349) is another VGAM2065 host target gene. CAMK2G BINDING SITE is HOST TAR- GET binding site found in the 5' untranslated region of mRNA encoded by CAMK2G, corresponding to a HOST TARGET binding site such as BINDING SITE I, BINDING SITE II or BINDING SITE III. Table 2 illustrates the complementarity of the nucleotide sequences of CAMK2G BINDING SITE, designated SEQ ID:34191, to the nucleotide sequence of VGAM2065 RNA, herein designated VGAM RNA, also designated SEQ ID:4776.

Another function of VGAM2065 is therefore inhibition of Calcium/calmodulin-dependent Protein Kinase (CaM kinase) II Gamma (CAMK2G, Accession XM_044349). Accordingly, utilities of VGAM2065 include diagnosis, prevention and treatment of diseases and clinical conditions associated with CAMK2G. FLJ13769 (Accession NM_025012) is another VGAM2065 host target gene. FLJ13769 BINDING SITE is HOST TARGET binding site found in the 3' untranslated region of mRNA encoded by FLJ13769, corresponding to a HOST TARGET binding site such as BINDING SITE I, BINDING SITE II or BINDING SITE III. Table 2 illustrates the complementarity of the nucleotide sequences of FLJ13769 BINDING SITE, designated SEQ ID:24591, to the nucleotide sequence of VGAM2065 RNA, herein designated VGAM RNA, also designated SEQ ID:4776.

Another function of VGAM2065 is therefore inhibition of FLJ13769 (Accession NM_025012). Accordingly, utilities of VGAM2065 include diagnosis, prevention and treatment of diseases and clinical conditions associated with FLJ13769. FLJ13955 (Accession NM_024759) is another VGAM2065 host target gene. FLJ13955 BINDING SITE is HOST TARGET binding site found in the 3' untranslated region of mRNA encoded by FLJ13955, corresponding to a HOST TARGET binding site such as BINDING SITE I, BINDING SITE II or BINDING SITE III. Table 2 illustrates the complementarity of the nucleotide sequences of FLJ13955 BINDING SITE, designated SEQ ID:24109, to the nucleotide sequence of VGAM2065 RNA, herein designated VGAM RNA, also designated SEQ ID:4776.

Another function of VGAM2065 is therefore inhibition of FLJ13955 (Accession NM_024759). Accordingly, utilities of VGAM2065 include diagnosis, prevention and treatment of diseases and clinical conditions associated with FLJ13955. FLJ13964 (Accession NM_032186) is another VGAM2065 host target gene. FLJ13964 BINDING SITE is HOST TARGET binding site found in the 3' untranslated region of mRNA encoded by FLJ13964, corresponding to a HOST TARGET binding site such as BINDING SITE I, BINDING SITE II or BINDING SITE III. Table 2 illustrates the complementarity of the nucleotide sequences of FLJ13964 BINDING SITE, designated SEQ ID:25902, to the nucleotide sequence of VGAM2065 RNA, herein designated VGAM RNA, also designated SEQ ID:4776.

Another function of VGAM2065 is therefore inhibition of FLJ13964 (Accession NM_032186). Accordingly, utilities of VGAM2065 include diagnosis, prevention and treatment of diseases and clinical conditions associated with FLJ13964. HEMK (Accession NM_016173) is another VGAM2065 host target gene. HEMK BINDING SITE is HOST TARGET binding site found in the 3' untranslated region of mRNA encoded by HEMK, corresponding to a HOST TARGET binding site such as BINDING SITE I, BINDING SITE II or BINDING SITE III. Table 2 illustrates the complementarity of the nucleotide sequences of HEMK BINDING SITE, designated SEQ ID:18266, to the nucleotide sequence of VGAM2065 RNA, herein designated VGAM RNA, also designated SEQ ID:4776.

Another function of VGAM2065 is therefore inhibition of HEMK (Accession NM_016173). Accordingly, utilities of VGAM2065 include diagnosis, prevention and treatment of diseases and clinical conditions associated with HEMK. Heat Shock 90 kDa Protein 1, Alpha-like 3 (HSPCAL3, Accession XM_084514) is another VGAM2065 host target gene. HSPCAL3 BINDING SITE is HOST TARGET binding site found in the 3' untranslated region of mRNA encoded by HSPCAL3, corresponding to a HOST TARGET binding site such as BINDING SITE I, BINDING SITE II or BINDING SITE III. Table 2 illustrates the complementarity of the nucleotide sequences of HSPCAL3 BINDING SITE, designated SEQ ID:37618, to the nucleotide sequence of VGAM2065 RNA, herein designated VGAM RNA, also designated SEQ ID:4776.

Another function of VGAM2065 is therefore inhibition of Heat Shock 90kDa Protein 1, Alpha-like 3 (HSPCAL3, Accession XM_084514). Accordingly, utilities of VGAM2065 include diagnosis, prevention and treatment of diseases and clinical conditions associated with HSPCAL3. KIAA0217 (Accession XM_040265) is another VGAM2065 host target gene. KIAA0217 BINDING SITE is HOST TARGET binding site found in the 3" untranslated region of mRNA encoded by KIAA0217, corresponding to a HOST TARGET binding site such as BINDING SITE I, BINDING SITE II or BINDING SITE III. Table 2 illustrates the complementarity of the nucleotide sequences of KIAA0217 BINDING SITE, designated SEQ ID:33279, to the nucleotide sequence of VGAM2065 RNA, herein designated VGAM RNA, also designated SEQ ID:4776.

Another function of VGAM2065 is therefore inhibition of KIAA0217 (Accession XM_040265). Accordingly, utilities of VGAM2065 include diagnosis, prevention and treatment of diseases and clinical conditions associated with KIAA0217. Rpo1-2 (Accession NM_019014) is another VGAM2065 host target gene. Rpo1-2 BINDING SITE is HOST TARGET binding site found in the 3' untranslated region of mRNA encoded by Rpo1-2, corresponding to a HOST TARGET binding site such as BINDING SITE I, BINDING SITE II or BINDING SITE III. Table 2 illustrates the complementarity of the nucleotide sequences of Rpo1-2 BINDING SITE, designated SEQ ID:21097, to the nucleotide sequence of VGAM2065 RNA, herein designated VGAM RNA, also designated SEQ ID:4776.

Another function of VGAM2065 is therefore inhibition of Rpo1-2 (Accession NM_019014). Accordingly, utilities of VGAM2065 include diagnosis, prevention and treatment of diseases and clinical conditions associated with Rpo1-2. Trans-golgi Network Protein 2 (TGOLN2, Accession XM_034215) is another VGAM2065 host target gene. TGOLN2 BINDING SITE is HOST TARGET binding site found in the 3' untranslated region of mRNA encoded by TGOLN2, corresponding to a HOST TARGET binding site such as BINDING SITE I, BINDING SITE II or BINDING SITE III. Table 2 illustrates the complementarity of the nucleotide sequences of TGOLN2 BINDING SITE, designated SEQ ID:32023, to the nucleotide sequence of VGAM2065 RNA, herein designated VGAM RNA, also designated SEQ ID:4776.

Another function of VGAM2065 is therefore inhibition of Trans-golgi Network Protein 2 (TGOLN2, Accession XM_034215). Accordingly, utilities of VGAM2065 include diagnosis, prevention and treatment of diseases and clinical conditions associated with TGOLN2. LOC149844 (Accession XM_086675) is another VGAM2065 host target gene. LOC149844 BINDING SITE is HOST TARGET binding site found in the 3' untranslated region of mRNA encoded by LOC149844, corresponding to a HOST TARGET binding site such as BINDING SITE I, BINDING SITE II or BINDING SITE III. Table 2 illustrates the complementarity of the nucleotide sequences of LOC149844 BINDING SITE, designated SEQ ID:38821, to the nucleotide sequence of VGAM2065 RNA, herein designated VGAM RNA, also designated SEQ ID:4776.

Another function of VGAM2065 is therefore inhibition of LOC149844 (Accession XM_086675). Accordingly, utilities of VGAM2065 include diagnosis, prevention and treatment of diseases and clinical conditions associated with LOC149844. LOC157567 (Accession XM_088328) is another VGAM2065 host target gene. LOC157567 BINDING SITE is HOST TARGET binding site found in the 3' untranslated region of mRNA encoded by LOC157567, corresponding to a HOST TARGET binding site such as BINDING SITE I, BINDING SITE II or BINDING SITE III. Table 2 illustrates the complementarity of the nucleotide sequences of LOC157567 BINDING SITE, designated SEQ ID:39612, to the nucleotide sequence of VGAM2065 RNA, herein designated VGAM RNA, also designated SEQ ID:4776.

Another function of VGAM2065 is therefore inhibition of LOC157567 (Accession XM_088328). Accordingly, utilities of VGAM2065 include diagnosis, prevention and treatment of diseases and clinical conditions associated with LOC157567. LOC158219 (Accession XM_088514) is another VGAM2065 host target gene. LOC158219 BINDING SITE is HOST TARGET binding site found in the 3' untranslated region of mRNA encoded by LOC158219, corresponding to a HOST TARGET binding site such as BINDING SITE I, BINDING SITE II or BINDING SITE III. Table 2 illustrates the complementarity of the nucleotide sequences of LOC158219 BINDING SITE, designated SEQ ID:39762, to the nucleotide sequence of VGAM2065 RNA, herein designated VGAM RNA, also designated SEQ ID:4776.

Another function of VGAM2065 is therefore inhibition of LOC158219 (Accession XM_088514). Accordingly, utilities of VGAM2065 include diagnosis, prevention and treatment of diseases and clinical conditions associated with LOC158219. LOC170132 (Accession XM_093119) is another VGAM2065 host target gene. LOC170132 BINDING SITE is HOST TARGET binding site found in the 5' untranslated region of mRNA encoded by LOC170132, corresponding to a HOST TARGET binding site such as BINDING SITE I, BINDING SITE II or BINDING SITE III. Table 2 illustrates the complementarity of the nucleotide sequences of LOC170132 BINDING SITE, designated SEQ ID:40177, to the nucleotide sequence of VGAM2065 RNA, herein designated VGAM RNA, also designated SEQ ID:4776.

Another function of VGAM2065 is therefore inhibition of LOC170132 (Accession XM_093119). Accordingly, utilities of VGAM2065 include diagnosis, prevention and treatment of diseases and clinical conditions associated with LOC170132. LOC203350 (Accession XM_117536) is another VGAM2065 host target gene. LOC203350 BINDING SITE is HOST TARGET binding site found in the 3' untranslated region of mRNA encoded by LOC203350, corresponding to a HOST TARGET binding site such as BINDING SITE I, BINDING SITE II or BINDING SITE III. Table 2 illustrates the complementarity of the nucleotide sequences of LOC203350 BINDING SITE, designated SEQ ID:43533, to the nucleotide sequence of VGAM2065 RNA, herein designated VGAM RNA, also designated SEQ ID:4776.

Another function of VGAM2065 is therefore inhibition of LOC203350 (Accession XM_117536). Accordingly, utilities of VGAM2065 include diagnosis, prevention and treatment of diseases and clinical conditions associated with LOC203350. LOC51313 (Accession NM_016613) is another VGAM2065 host target gene. LOC51313 BINDING SITE is HOST TARGET binding site found in the 3' untranslated region of mRNA encoded by LOC51313, corresponding to a HOST TARGET binding site such as BINDING SITE I, BINDING SITE II or BINDING SITE III. Table 2 illustrates the complementarity of the nucleotide sequences of LOC51313 BINDING SITE, designated SEQ ID:18719, to the nucleotide sequence of VGAM2065 RNA, herein designated VGAM RNA, also designated SEQ ID:4776.

Another function of VGAM2065 is therefore inhibition of LOC51313 (Accession NM_016613). Accordingly, utilities of VGAM2065 include diagnosis, prevention and treatment of diseases and clinical conditions associated with LOC51313. FIG. 1 further provides a conceptual description of a novel bioinformatically detected viral gene of the present invention, referred to here as Viral Genomic Address Messenger 2066 (VGAM2066) viral gene, which modulates expression of respective host target genes thereof, the function and utility of which host target genes is known in the art.

VGAM2066 is a novel bioinformatically detected regulatory, non protein coding, viral micro RNA (miRNA) gene. The method by which VGAM2066 was detected is described hereinabove with reference to FIGS. 1-8.

VGAM2066 gene, herein designated VGAM GENE, is a viral gene contained in the genome of Ectromelia Virus. VGAM2066 host target gene, herein designated VGAM HOST TARGET GENE, is a human gene contained in the human genome.

VGAM2066 gene encodes a VGAM2066 precursor RNA, herein designated VGAM PRECURSOR RNA. Similar to other miRNA genes, and unlike most ordinary genes, VGAM2066 precursor RNA does not encode a protein. A nucleotide sequence identical or highly similar to the nucleotide sequence of VGAM2066 precursor RNA is designated SEQ ID:2052, and is provided hereinbelow with reference to the sequence listing part. Nucleotide sequence SEQ ID:2052 is located at position 9912 relative to the genome of Ectromelia Virus.

VGAM2066 precursor RNA folds onto itself, forming VGAM2066 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2066 folded precursor RNA into VGAM2066 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2066 RNA is designated SEQ ID:4777, and is provided hereinbelow with reference to the sequence listing part.

VGAM2066 host target gene, herein designated VGAM HOST TARGET GENE, encodes a corresponding messenger RNA, VGAM2066 host target RNA, herein designated VGAM HOST TARGET RNA. VGAM2066 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2066 RNA, herein designated VGAM RNA, binds complementarily to one or more host target binding sites located in untranslated regions of VGAM2066 host target RNA, herein designated VGAM HOST TARGET RNA. This complementary binding is due to the fact that the nucleotide sequence of VGAM2066 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2066 RNA, herein designated VGAM RNA, may have a different number of host target binding sites in untranslated regions of a VGAM2066 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2066 RNA, herein designated VGAM RNA, to host target binding sites on VGAM2066 host target RNA, herein designated VGAM HOST TARGET RNA, such as BINDING SITE I, BINDING SITE II and BINDING SITE III, inhibits translation of VGAM2066 host target RNA into VGAM2066 host target protein, herein designated VGAM HOST TARGET PROTEIN. VGAM host target protein is therefore outlined by a broken line.

It is appreciated that VGAM2066 host target gene, herein designated VGAM HOST TARGET GENE, in fact represents a plurality of VGAM2066 host target genes. The mRNA of each one of this plurality of VGAM2066 host target genes comprises one or more host target binding sites, each having a nucleotide sequence which is at least partly complementary to VGAM2066 RNA, herein designated VGAM RNA, and which when bound by VGAM2066 RNA causes inhibition of translation of respective one or more VGAM2066 host target proteins.

It is further appreciated by one skilled in the art that the mode of translational inhibition illustrated by FIG. 1 with specific reference to translational inhibition exerted by VGAM2066 gene, herein designated VGAM GENE, on one or more VGAM2066 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2066 is inhibition of expression of host target genes, as part of a novel viral mechanism of attacking a host. Accordingly, utilities of VGAM2066 include diagnosis, prevention and treatment of viral infection by Ectromelia Virus. Specific functions, and accordingly utilities, of VGAM2066 correlate with, and may be deduced from, the identity of the host target genes which VGAM2066 binds and inhibits, and the function of these host target genes, as elaborated hereinbelow.

Nucleotide sequences of the VGAM2066 precursor RNA, herein designated VGAM PRECURSOR RNA, and of the 'diced' VGAM2066 RNA, herein designated VGAM RNA, and a schematic representation of the secondary folding of VGAM2066 folded precursor RNA, herein designated VGAM FOLDED PRECURSOR RNA, of VGAM2066 are further described hereinbelow with reference to Table 1.

Nucleotide sequences of host target binding sites, such as BINDING SITE-I, BINDING SITE-II and BINDING SITE-III of FIG. 1, found on VGAM2066 host target RNA, and schematic representation of the complementarity of each of these host target binding sites to VGAM2066 RNA, herein designated VGAM RNA, are described hereinbelow with reference to Table 2.

As mentioned hereinabove with reference to FIG. 1, a function of VGAM2066 gene, herein designated VGAM is inhibition of expression of VGAM2066 target genes. It is appreciated that specific functions, and accordingly utilities, of VGAM2066 correlate with, and may be deduced from, the identity of the target genes which VGAM2066 binds and inhibits, and the function of these target genes, as elaborated hereinbelow.

Brain and Acute Leukemia, Cytoplasmic (BAALC, Accession NM_024812) is a VGAM2066 host target gene. BAALC BINDING SITE is HOST TARGET binding site found in the 3' untranslated region of mRNA encoded by BAALC, corresponding to a HOST TARGET binding site such as BINDING SITE I, BINDING SITE II or BINDING SITE III. Table 2 illustrates the complementarity of the nucleotide sequences of BAALC BINDING SITE, designated SEQ ID:24198, to the nucleotide sequence of VGAM2066 RNA, herein designated VGAM RNA, also designated SEQ ID:4777.

A function of VGAM2066 is therefore inhibition of Brain and Acute Leukemia, Cytoplasmic (BAALC, Accession NM_024812). Accordingly, utilities of VGAM2066 include diagnosis, prevention and treatment of diseases and clinical conditions associated with BAALC. Ceramide Kinase (cerk, Accession NM_022766) is another VGAM2066 host target gene. cerk BINDING SITE is HOST TARGET binding site found in the 3' untranslated region of mRNA encoded by cerk, corresponding to a HOST TARGET binding site such as BINDING SITE I, BINDING SITE II or BINDING SITE III. Table 2 illustrates the complementarity of the nucleotide sequences of cerk BINDING SITE, designated SEQ ID:23014, to the nucleotide sequence of VGAM2066 RNA, herein designated VGAM RNA, also designated SEQ ID:4777.

Another function of VGAM2066 is therefore inhibition of Ceramide Kinase (cerk, Accession NM_022766). Accordingly, utilities of VGAM2066 include diagnosis, prevention and treatment of diseases and clinical conditions associated with cerk. Dynein, Cytoplasmic, Light Intermediate Polypeptide 1 (DNCLI1, Accession XM_003119) is another VGAM2066 host target gene. DNCLI1 BINDING SITE is HOST TARGET binding site found in the 3' untranslated region of mRNA encoded by DNCLI1, corresponding to a HOST TARGET binding site such as BINDING SITE I, BINDING SITE II or BINDING SITE III. Table 2 illustrates the complementarity of the nucleotide sequences of DNCLI1 BINDING SITE, designated SEQ ID:29929, to the nucleotide sequence of VGAM2066 RNA, herein designated VGAM RNA, also designated SEQ ID:4777.

Another function of VGAM2066 is therefore inhibition of Dynein, Cytoplasmic, Light Intermediate Polypeptide 1 (DNCLI1, Accession XM_003119). Accordingly, utilities of VGAM2066 include diagnosis, prevention and treatment of diseases and clinical conditions associated with DNCLI1. Histamine Receptor H4 (HRH4, Accession NM_021624) is another VGAM2066 host target gene. HRH4 BINDING SITE is HOST TARGET binding site found in the 3' untranslated region of mRNA encoded by HRH4, corresponding to a HOST TARGET binding site such as BINDING SITE I, BINDING SITE II or BINDING SITE III. Table 2 illustrates the complementarity of the nucleotide sequences of HRH4 BINDING SITE, designated SEQ ID:22265, to the nucleotide sequence of VGAM2066 RNA, herein designated VGAM RNA, also designated SEQ ID:4777.

Another function of VGAM2066 is therefore inhibition of Histamine Receptor H4 (HRH4, Accession NM_021624). Accordingly, utilities of VGAM2066 include diagnosis, prevention and treatment of diseases and clinical conditions associated with HRH4. KIAA0368 (Accession XM_036708) is another VGAM2066 host target gene. KIAA0368 BINDING SITE is HOST TARGET binding site found in the 3' untranslated region of mRNA encoded by KIAA0368, corresponding to a HOST TARGET binding site such as BINDING SITE I, BINDING SITE II or BINDING SITE III. Table 2 illustrates the complementarity of the nucleotide sequences of KIAA0368 BINDING SITE, designated SEQ ID:32491, to the nucleotide sequence of VGAM2066 RNA, herein designated VGAM RNA, also designated SEQ ID:4777.

Another function of VGAM2066 is therefore inhibition of KIAA0368 (Accession XM_036708). Accordingly, utilities of VGAM2066 include diagnosis, prevention and treatment of diseases and clinical conditions associated with KIAA0368. Sema Domain, Immunoglobulin Domain (Ig), Short Basic Domain, Secreted, (semaphorin) 3E (SEMA3E, Accession NM_012431) is another VGAM2066 host target gene. SEMA3E BINDING SITE is HOST TARGET binding site found in the 3' untranslated region of mRNA encoded by SEMA3E, corresponding to a HOST TARGET binding site such as BINDING SITE I, BINDING SITE II or BINDING SITE III. Table 2 illustrates the complementarity of the nucleotide sequences of SEMA3E BINDING SITE, designated SEQ ID:14811, to the nucleotide sequence of VGAM2066 RNA, herein designated VGAM RNA, also designated SEQ ID:4777.

Another function of VGAM2066 is therefore inhibition of Sema Domain, Immunoglobulin Domain (Ig), Short Basic Domain, Secreted, (semaphorin) 3E (SEMA3E, Accession NM_012431). Accordingly, utilities of VGAM2066 include diagnosis, prevention and treatment of diseases and clinical conditions associated with SEMA3E. LOC153139 (Accession XM_098318) is another VGAM2066 host target gene. LOC153139 BINDING SITE is HOST TARGET binding site found in the 5' untranslated region of mRNA encoded by LOC153139, corresponding to a HOST TARGET binding site such as BINDING SITE I, BINDING SITE II or BINDING SITE III. Table 2 illustrates the complementarity of the nucleotide sequences of LOC153139 BINDING SITE, designated SEQ ID:41575, to the nucleotide sequence of VGAM2066 RNA, herein designated VGAM RNA, also designated SEQ ID:4777.

Another function of VGAM2066 is therefore inhibition of LOC153139 (Accession XM_098318). Accordingly, utilities of VGAM2066 include diagnosis, prevention and treatment of diseases and clinical conditions associated with LOC153139. LOC154184 (Accession XM_098488) is another VGAM2066 host target gene. LOC154184 BINDING SITE is HOST TARGET binding site found in the 5' untranslated region of mRNA encoded by LOC154184, corresponding to a HOST TARGET binding site such as BINDING SITE I, BINDING SITE II or BINDING SITE III. Table 2 illustrates the complementarity of the nucleotide sequences of LOC154184 BINDING SITE, designated SEQ ID:41687, to the nucleotide sequence of VGAM2066 RNA, herein designated VGAM RNA, also designated SEQ ID:4777.

Another function of VGAM2066 is therefore inhibition of LOC154184 (Accession XM_098488). Accordingly, utilities of VGAM2066 include diagnosis, prevention and treatment of diseases and clinical conditions associated with LOC154184. LOC221601 (Accession XM_168071) is another VGAM2066 host target gene. LOC221601 BINDING SITE is HOST TARGET binding site found in the 5' untranslated region of mRNA encoded by LOC221601, corresponding to a HOST TARGET binding site such as BINDING SITE I, BINDING SITE II or BINDING SITE III. Table 2 illustrates the complementarity of the nucleotide sequences of LOC221601 BINDING SITE, designated SEQ ID:44984, to the nucleotide sequence of VGAM2066 RNA, herein designated VGAM RNA, also designated SEQ ID:4777.

Another function of VGAM2066 is therefore inhibition of LOC221601 (Accession XM_168071). Accordingly, utilities of VGAM2066 include diagnosis, prevention and treatment of diseases and clinical conditions associated with LOC221601. FIG. 1 further provides a conceptual description of a novel bioinformatically detected viral gene of the present invention, referred to here as Viral Genomic Address Messenger 2067 (VGAM2067) viral gene, which modulates expression of respective host target genes thereof, the function and utility of which host target genes is known in the art.

VGAM2067 is a novel bioinformatically detected regulatory, non protein coding, viral micro RNA (miRNA) gene. The method by which VGAM2067 was detected is described hereinabove with reference to FIGS. 1-8.

VGAM2067 gene, herein designated VGAM GENE, is a viral gene contained in the genome of Ectromelia Virus. VGAM2067 host target gene, herein designated VGAM HOST TARGET GENE, is a human gene contained in the human genome.

VGAM2067 gene encodes a VGAM2067 precursor RNA, herein designated VGAM PRECURSOR RNA. Similar to other miRNA genes, and unlike most ordinary genes, VGAM2067 precursor RNA does not encode a protein. A nucleotide sequence identical or highly similar to the nucleotide sequence of VGAM2067 precursor RNA is designated SEQ ID:2053, and is provided hereinbelow with reference to the sequence listing part. Nucleotide sequence SEQ ID:2053 is located at position 7556 relative to the genome of Ectromelia Virus.

VGAM2067 precursor RNA folds onto itself, forming VGAM2067 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2067 folded precursor RNA into VGAM2067 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2067 RNA is designated SEQ ID:4778, and is provided hereinbelow with reference to the sequence listing part.

VGAM2067 host target gene, herein designated VGAM HOST TARGET GENE, encodes a corresponding messenger RNA, VGAM2067 host target RNA, herein designated VGAM HOST TARGET RNA. VGAM2067 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2067 RNA, herein designated VGAM RNA, binds complementarily to one or more host target binding sites located in untranslated regions of VGAM2067 host target RNA, herein designated VGAM HOST TARGET RNA. This complementary binding is due to the fact that the nucleotide sequence of VGAM2067 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2067 RNA, herein designated VGAM RNA, may have a different number of host target binding sites in untranslated regions of a VGAM2067 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2067 RNA, herein designated VGAM RNA, to host target binding sites on VGAM2067 host target RNA, herein designated VGAM HOST TARGET RNA, such as BINDING SITE I, BINDING SITE II and BINDING SITE III, inhibits translation of VGAM2067 host target RNA into VGAM2067 host target protein, herein designated VGAM HOST TARGET PROTEIN. VGAM host target protein is therefore outlined by a broken line.

It is appreciated that VGAM2067 host target gene, herein designated VGAM HOST TARGET GENE, in fact represents a plurality of VGAM2067 host target genes. The mRNA of each one of this plurality of VGAM2067 host target genes comprises one or more host target binding sites, each having a nucleotide sequence which is at least partly complementary to VGAM2067 RNA, herein designated VGAM RNA, and which when bound by VGAM2067 RNA causes inhibition of translation of respective one or more VGAM2067 host target proteins.

It is further appreciated by one skilled in the art that the mode of translational inhibition illustrated by FIG. 1 with specific reference to translational inhibition exerted by VGAM2067 gene, herein designated VGAM GENE, on one or more VGAM2067 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2067 is inhibition of expression of host target genes, as part of a novel viral mechanism of attacking a host. Accordingly, utilities of VGAM2067 include diagnosis, prevention and treatment of viral infection by Ectromelia Virus. Specific functions, and accordingly utilities, of VGAM2067 correlate with, and may be deduced from, the identity of the host target genes which VGAM2067 binds and inhibits, and the function of these host target genes, as elaborated hereinbelow.

Nucleotide sequences of the VGAM2067 precursor RNA, herein designated VGAM PRECURSOR RNA, and of the 'diced' VGAM2067 RNA, herein designated VGAM RNA, and a schematic representation of the secondary folding of VGAM2067 folded precursor RNA, herein designated VGAM FOLDED PRECURSOR RNA, of VGAM2067 are further described hereinbelow with reference to Table 1.

Nucleotide sequences of host target binding sites, such as BINDING SITE-I, BINDING SITE-II and BINDING SITE-III of FIG. 1, found on VGAM2067 host target RNA, and schematic representation of the complementarity of each of these host target binding sites to VGAM2067 RNA, herein designated VGAM RNA, are described hereinbelow with reference to Table 2.

As mentioned hereinabove with reference to FIG. 1, a function of VGAM2067 gene, herein designated VGAM is inhibition of expression of VGAM2067 target genes. It is appreciated that specific functions, and accordingly utilities, of VGAM2067 correlate with, and may be deduced from, the identity of the target genes which VGAM2067 binds and inhibits, and the function of these target genes, as elaborated hereinbelow.

KIAA1323 (Accession XM_032146) is a VGAM2067 host target gene. KIAA1323 BINDING SITE is HOST TARGET binding site found in the 3' untranslated region of mRNA encoded by KIAA1323, corresponding to a HOST TARGET binding site such as BINDING SITE I, BINDING SITE II or BINDING SITE III. Table 2 illustrates the complementarity of the nucleotide sequences of KIAA1323 BINDING SITE, designated SEQ ID:31571, to the nucleotide sequence of VGAM2067 RNA, herein designated VGAM RNA, also designated SEQ ID:4778.

A function of VGAM2067 is therefore inhibition of KIAA1323 (Accession XM_032146). Accordingly, utilities of VGAM2067 include diagnosis, prevention and treatment of diseases and clinical conditions associated with KIAA1323. MAP (Accession NM_022818) is another VGAM2067 host target gene. MAP BINDING SITE is HOST TARGET binding site found in the 3' untranslated region of mRNA encoded by MAP, corresponding to a HOST TARGET binding site such as BINDING SITE I, BINDING SITE II or BINDING SITE III. Table 2 illustrates the complementarity of the nucleotide sequences of MAP BINDING SITE, designated SEQ ID:23098, to the nucleotide sequence of VGAM2067 RNA, herein designated VGAM RNA, also designated SEQ ID:4778.

Another function of VGAM2067 is therefore inhibition of MAP (Accession NM_022818). Accordingly, utilities of VGAM2067 include diagnosis, prevention and treatment of diseases and clinical conditions associated with MAP. PP1044 (Accession NM_021730) is another VGAM2067 host target gene. PP1044 BINDING SITE is HOST TARGET binding site found in the 5' untranslated region of mRNA encoded by PP1044, corresponding to a HOST TARGET binding site such as BINDING SITE I, BINDING SITE II or BINDING SITE III. Table 2 illustrates the complementarity of the nucleotide sequences of PP1044 BINDING SITE, designated SEQ ID:22327, to the nucleotide sequence of VGAM2067 RNA, herein designated VGAM RNA, also designated SEQ ID:4778.

Another function of VGAM2067 is therefore inhibition of PP1044 (Accession NM_021730). Accordingly, utilities of VGAM2067 include diagnosis, prevention and treatment of diseases and clinical conditions associated with PP1044. Signal-regulatory Protein Beta 1 (SIRPB1, Accession NM_006065) is another VGAM2067 host target gene. SIRPB1 BINDING SITE is HOST TARGET binding site found in the 3' untranslated region of mRNA encoded by SIRPB1, corresponding to a HOST TARGET binding site such as BINDING SITE I, BINDING SITE II or BINDING SITE III. Table 2 illustrates the complementarity of the nucleotide sequences of SIRPB1 BINDING SITE, designated SEQ ID:12712, to the nucleotide sequence of VGAM2067 RNA, herein designated VGAM RNA, also designated SEQ ID:4778.

Another function of VGAM2067 is therefore inhibition of Signal-regulatory Protein Beta 1 (SIRPB1, Accession NM_006065). Accordingly, utilities of VGAM2067 include diagnosis, prevention and treatment of diseases and clinical conditions associated with SIRPB1. LOC93496 (Accession XM_051698) is another VGAM2067 host target gene. LOC93496 BINDING SITE is HOST TARGET binding site found in the 3' untranslated region of mRNA encoded by LOC93496, corresponding to a HOST TARGET binding site such as BINDING SITE I, BINDING SITE II or BINDING SITE III. Table 2 illustrates the complementarity of the nucleotide sequences of LOC93496 BINDING SITE, designated SEQ ID:35867, to the nucleotide sequence of VGAM2067 RNA, herein designated VGAM RNA, also designated SEQ ID:4778.

Another function of VGAM2067 is therefore inhibition of LOC93496 (Accession XM_051698). Accordingly, utilities of VGAM2067 include diagnosis, prevention and treatment of diseases and clinical conditions associated with LOC93496. FIG. 1 further provides a conceptual description of a novel bioinformatically detected viral gene of the present invention, referred to here as Viral Genomic Address Messenger 2068 (VGAM2068) viral gene, which modulates expression of respective host target genes thereof, the function and utility of which host target genes is known in the art.

VGAM2068 is a novel bioinformatically detected regulatory, non protein coding, viral micro RNA (miRNA) gene. The method by which VGAM2068 was detected is described hereinabove with reference to FIGS. 1-8.

VGAM2068 gene, herein designated VGAM GENE, is a viral gene contained in the genome of Monkeypox Virus. VGAM2068 host target gene, herein designated VGAM HOST TARGET GENE, is a human gene contained in the human genome.

VGAM2068 gene encodes a VGAM2068 precursor RNA, herein designated VGAM PRECURSOR RNA. Similar to other miRNA genes, and unlike most ordinary genes, VGAM2068 precursor RNA does not encode a protein. A nucleotide sequence identical or highly similar to the nucleotide sequence of VGAM2068 precursor RNA is designated SEQ ID:2054, and is provided hereinbelow with reference to the sequence listing part. Nucleotide sequence SEQ ID:2054 is located at position 18952 relative to the genome of Monkeypox Virus.

VGAM2068 precursor RNA folds onto itself, forming VGAM2068 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2068 folded precursor RNA into VGAM2068 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2068 RNA is designated SEQ ID:4779, and is provided hereinbelow with reference to the sequence listing part.

VGAM2068 host target gene, herein designated VGAM HOST TARGET GENE, encodes a corresponding messenger RNA, VGAM2068 host target RNA, herein designated VGAM HOST TARGET RNA. VGAM2068 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2068 RNA, herein designated VGAM RNA, binds complementarily to one or more host target binding sites located in untranslated regions of VGAM2068 host target RNA, herein designated VGAM HOST TARGET RNA. This complementary binding is due to the fact that the nucleotide sequence of VGAM2068 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2068 RNA, herein designated VGAM RNA, may have a different number of host target binding sites in untranslated regions of a VGAM2068 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2068 RNA, herein designated VGAM RNA, to host target binding sites on VGAM2068 host target RNA, herein designated VGAM HOST TARGET RNA, such as BINDING SITE I, BINDING SITE II and BINDING SITE III, inhibits translation of VGAM2068 host target RNA into VGAM2068 host target protein, herein designated VGAM HOST TARGET PROTEIN. VGAM host target protein is therefore outlined by a broken line.

It is appreciated that VGAM2068 host target gene, herein designated VGAM HOST TARGET GENE, in fact represents a plurality of VGAM2068 host target genes. The mRNA of each one of this plurality of VGAM2068 host target genes comprises one or more host target binding sites, each having a nucleotide sequence which is at least partly complementary to VGAM2068 RNA, herein designated VGAM RNA, and which when bound by VGAM2068 RNA causes inhibition of translation of respective one or more VGAM2068 host target proteins.

It is further appreciated by one skilled in the art that the mode of translational inhibition illustrated by FIG. 1 with specific reference to translational inhibition exerted by VGAM2068 gene, herein designated VGAM GENE, on one or more VGAM2068 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let- 7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2068 is inhibition of expression of host target genes, as part of a novel viral mechanism of attacking a host. Accordingly, utilities of VGAM2068 include diagnosis, prevention and treatment of viral infection by Monkeypox Virus. Specific functions, and accordingly utilities, of VGAM2068 correlate with, and may be deduced from, the identity of the host target genes which VGAM2068 binds and inhibits, and the function of these host target genes, as elaborated hereinbelow.

Nucleotide sequences of the VGAM2068 precursor RNA, herein designated VGAM PRECURSOR RNA, and of the 'diced' VGAM2068 RNA, herein designated VGAM RNA, and a schematic representation of the secondary folding of VGAM2068 folded precursor RNA, herein designated VGAM FOLDED PRECURSOR RNA, of VGAM2068 are further described hereinbelow with reference to Table 1.

Nucleotide sequences of host target binding sites, such as BINDING SITE-I, BINDING SITE-II and BINDING SITE-III of FIG. 1, found on VGAM2068 host target RNA, and schematic representation of the complementarity of each of these host target binding sites to VGAM2068 RNA, herein designated VGAM RNA, are described hereinbelow with reference to Table 2.

As mentioned hereinabove with reference to FIG. 1, a function of VGAM2068 gene, herein designated VGAM is inhibition of expression of VGAM2068 target genes. It is appreciated that specific functions, and accordingly utilities, of VGAM2068 correlate with, and may be deduced from, the identity of the target genes which VGAM2068 binds and inhibits, and the function of these target genes, as elaborated hereinbelow.

ATP-binding Cassette, Sub-family B (MDR/TAP), Member 10 (ABCB10, Accession NM_012089) is a VGAM2068 host target gene. ABCB10 BINDING SITE is HOST TARGET binding site found in the 3' untranslated region of mRNA encoded by ABCB10, corresponding to a HOST TARGET binding site such as BINDING SITE I, BINDING SITE II or BINDING SITE III. Table 2 illustrates the complementarity of the nucleotide sequences of ABCB10 BINDING SITE, designated SEQ ID:14373, to the nucleotide sequence of VGAM2068 RNA, herein designated VGAM RNA, also designated SEQ ID:4779.

A function of VGAM2068 is therefore inhibition of ATP-binding Cassette, Sub-family B (MDR/TAP), Member 10 (ABCB10, Accession NM_012089), a gene which a member of the superfamily of ATP-binding cassette (ABC) transporters. Accordingly, utilities of VGAM2068 include diagnosis, prevention and treatment of diseases and clinical conditions associated with ABCB10. The function of ABCB10 and its association with various diseases and clinical conditions, has been established by previous studies, as described hereinabove with reference to VGAM1523. Protocadherin Alpha 9 (PCDHA9, Accession NM_014005) is another VGAM2068 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:15207, to the nucleotide sequence of VGAM2068 RNA, herein designated VGAM RNA, also designated SEQ ID:4779.

Another function of VGAM2068 is therefore inhibition of Protocadherin Alpha 9 (PCDHA9, Accession NM_014005), a gene which is a calcium-dependent cell-adhesion protein. Accordingly, utilities of VGAM2068 include diagnosis, prevention and treatment of diseases and clinical conditions associated with PCDHA9. The function of PCDHA9 and its association with various diseases and clinical conditions, has been established by previous studies, as described hereinabove with reference to VGAM71. Prostaglandin-endoperoxide Synthase 1 (prostaglandin G/H synthase and cyclooxygenase) (PTGS1, Accession NM_080591) is another VGAM2068 host target gene. PTGS1 BINDING SITE1 and PTGS1 BINDING SITE2 are HOST TARGET binding sites found in untranslated regions of mRNA encoded by PTGS1, corresponding to HOST TARGET binding sites such as BINDING SITE I, BINDING SITE II or BINDING SITE III. Table 2 illustrates the complementarity of the nucleotide sequences of PTGS1 BINDING SITE1 and PTGS1 BINDING SITE2, designated SEQ ID:27898 and SEQ ID:6677 respectively, to the nucleotide sequence of VGAM2068 RNA, herein designated VGAM RNA, also designated SEQ ID:4779.

Another function of VGAM2068 is therefore inhibition of Prostaglandin-endoperoxide Synthase 1 (prostaglandin G/H synthase and cyclooxygenase) (PTGS1, Accession NM_080591), a gene which may play an important role in regulating or promoting cell proliferation in some normal and neoplastically transformed cells. Accordingly, utilities of VGAM2068 include diagnosis, prevention and treatment of diseases and clinical conditions associated with PTGS1. The function of PTGS1 and its association with various diseases and clinical conditions, has been established by previous studies, as described hereinabove with reference to VGAM1224. FIG. 1 further provides a conceptual description of a novel bioinformatically detected viral gene of the present invention, referred to here as Viral Genomic Address Messenger 2069 (VGAM2069) viral gene, which modulates expression of respective host target genes thereof, the function and utility of which host target genes is known in the art.

VGAM2069 is a novel bioinformatically detected regulatory, non protein coding, viral micro RNA (miRNA) gene. The method by which VGAM2069 was detected is described hereinabove with reference to FIGS. 1-8.

VGAM2069 gene, herein designated VGAM GENE, is a viral gene contained in the genome of Monkeypox Virus. VGAM2069 host target gene, herein designated VGAM HOST TARGET GENE, is a human gene contained in the human genome.

VGAM2069 gene encodes a VGAM2069 precursor RNA, herein designated VGAM PRECURSOR RNA. Similar to other miRNA genes, and unlike most ordinary genes, VGAM2069 precursor RNA does not encode a protein. A nucleotide sequence identical or highly similar to the nucleotide sequence of VGAM2069 precursor RNA is designated SEQ ID:2055, and is provided hereinbelow with reference to the sequence listing part. Nucleotide sequence SEQ ID:2055 is located at position 20862 relative to the genome of Monkeypox Virus.

VGAM2069 precursor RNA folds onto itself, forming VGAM2069 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2069 folded precursor RNA into VGAM2069 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2069 RNA is designated SEQ ID:4780, and is provided hereinbelow with reference to the sequence listing part.

VGAM2069 host target gene, herein designated VGAM HOST TARGET GENE, encodes a corresponding messenger RNA, VGAM2069 host target RNA, herein designated VGAM HOST TARGET RNA. VGAM2069 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2069 RNA, herein designated VGAM RNA, binds complementarily to one or more host target binding sites located in untranslated regions of VGAM2069 host target RNA, herein designated VGAM HOST TARGET RNA. This complementary binding is due to the fact that the nucleotide sequence of VGAM2069 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2069 RNA, herein designated VGAM RNA, may have a different number of host target binding sites in untranslated regions of a VGAM2069 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2069 RNA, herein designated VGAM RNA, to host target binding sites on VGAM2069 host target RNA, herein designated VGAM HOST TARGET RNA, such as BINDING SITE I, BINDING SITE II and BINDING SITE III, inhibits translation of VGAM2069 host target RNA into VGAM2069 host target protein, herein designated VGAM HOST TARGET PROTEIN. VGAM host target protein is therefore outlined by a broken line.

It is appreciated that VGAM2069 host target gene, herein designated VGAM HOST TARGET GENE, in fact represents a plurality of VGAM2069 host target genes. The mRNA of each one of this plurality of VGAM2069 host target genes comprises one or more host target binding sites, each having a nucleotide sequence which is at least partly complementary to VGAM2069 RNA, herein designated VGAM RNA, and which when bound by VGAM2069 RNA causes inhibition of translation of respective one or more VGAM2069 host target proteins.

It is further appreciated by one skilled in the art that the mode of translational inhibition illustrated by FIG. 1 with specific reference to translational inhibition exerted by VGAM2069 gene, herein designated VGAM GENE, on one or more VGAM2069 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2069 is inhibition of expression of host target genes, as part of a novel viral mechanism of attacking a host. Accordingly, utilities of VGAM2069 include diagnosis, prevention and treatment of viral infection by Monkeypox Virus. Specific functions, and accordingly utilities, of VGAM2069 correlate with, and may be deduced from, the identity of the host target genes which VGAM2069 binds and inhibits, and the function of these host target genes, as elaborated hereinbelow.

Nucleotide sequences of the VGAM2069 precursor RNA, herein designated VGAM PRECURSOR RNA, and of the 'diced' VGAM2069 RNA, herein designated VGAM RNA, and a schematic representation of the secondary folding of VGAM2069 folded precursor RNA, herein designated VGAM FOLDED PRECURSOR RNA, of VGAM2069 are further described hereinbelow with reference to Table 1.

Nucleotide sequences of host target binding sites, such as BINDING SITE-I, BINDING SITE-II and BINDING SITE-III of FIG. 1, found on VGAM2069 host target RNA, and schematic representation of the complementarity of each of these host target binding sites to VGAM2069 RNA, herein designated VGAM RNA, are described hereinbelow with reference to Table 2.

As mentioned hereinabove with reference to FIG. 1, a function of VGAM2069 gene, herein designated VGAM is inhibition of expression of VGAM2069 target genes. It is appreciated that specific functions, and accordingly utilities, of VGAM2069 correlate with, and may be deduced from, the identity of the target genes which VGAM2069 binds and inhibits, and the function of these target genes, as elaborated hereinbelow.

ATP-binding Cassette, Sub-family B (MDR/TAP), Member 10 (ABCB10, Accession NM_012089) is a VGAM2069 host target gene. ABCB10 BINDING SITE is HOST TARGET binding site found in the 3' untranslated region of mRNA encoded by ABCB10, corresponding to a HOST TARGET binding site such as BINDING SITE I, BINDING SITE II or BINDING SITE III. Table 2 illustrates the complementarity of the nucleotide sequences of ABCB10 BINDING SITE, designated SEQ ID:14375, to the nucleotide sequence of VGAM2069 RNA, herein designated VGAM RNA, also designated SEQ ID:4780.

A function of VGAM2069 is therefore inhibition of ATP-binding Cassette, Sub-family B (MDR/TAP), Member 10 (ABCB10, Accession NM_012089), a gene which a member of the superfamily of ATP-binding cassette (ABC) transporters. Accordingly, utilities of VGAM2069 include diagnosis, prevention and treatment of diseases and clinical conditions associated with ABCB10. The function of ABCB10 and its association with various diseases and clinical conditions, has been established by previous studies, as described hereinabove with reference to VGAM1523. Component of Oligomeric Golgi Complex 3 (COG3, Accession NM_031431) is another VGAM2069 host target gene. COG3 BINDING SITE is HOST TARGET binding site found in the 3' untranslated region of mRNA encoded by COG3, corresponding to a HOST TARGET binding site such as BINDING SITE I, BINDING SITE II or BINDING SITE III. Table 2 illustrates the complementarity of the nucleotide sequences of COG3 BINDING SITE, designated SEQ ID:25425, to the nucleotide sequence of VGAM2069 RNA, herein designated VGAM RNA, also designated SEQ ID:4780.

Another function of VGAM2069 is therefore inhibition of Component of Oligomeric Golgi Complex 3 (COG3, Accession NM_031431), a gene which is critical for the structure and function of the Golgi apparatus. Accordingly, utilities of VGAM2069 include diagnosis, prevention and treatment of diseases and clinical conditions associated with COG3. The function of COG3 has been established by previous studies. Multiprotein complexes are key determinants of Golgi apparatus structure and its capacity for intracellular transport and glycoprotein modification. Several complexes have been identified, including the Golgi transport complex (GTC), the LDLC complex, which is involved in glycosylation reactions, and the SEC34 complex, which is involved in vesicular transport. These 3 complexes are identical and have been termed the conserved oligomeric Golgi (COG) complex, which includes COG3 (Ungar et al., 2002). By SDS-PAGE analysis of bovine brain cytosol, Ungar et al. (2002) identified the 8 subunits of the COG complex. Immunofluorescence microscopy demonstrated that COG1 (LDLB; 606973) colocalizes with COG7 (OMIM Ref. No. 606978), as well as with COG3 and COG5 (OMIM Ref. No. 606821), with a Golgi marker in a perinuclear distribution. Immunoprecipitation analysis showed that all COG subunits interact with COG2 (LDLC; 606974). Ungar et al. (2002) concluded that the COG complex is critical for the structure and function of the Golgi apparatus and can influence intracellular membrane trafficking Full details of the abovementioned studies are described in the following publications, the disclosure of which are hereby incorporated by reference:

Suvorova, E. S.; Kurten, R. C.; Lupashin, V. V.: Identification of a human orthologue of Sec34p as a component of the cis-Golgi vesicle tethering machinery. J. Biol. Chem. 276: 22810-22818, 2001; and Ungar, D.; Oka, T.; Brittle, E. E.; Vasile, E.; Lupashin, V. V.; Chatterton, J. E.; Heuser, J. E.; Krieger, M.; Waters, M. G.: Characterization of a mammalian Golgi-localized protein c.

Further studies establishing the function and utilities of COG3 are found in John Hopkins OMIM database record ID 606975, and in sited publications numbered 515 and 6340 listed in the bibliography section hereinbelow, which are also hereby incorporated by reference. Dmx-like 1 (DMXL1, Accession NM_005509) is another VGAM2069 host target gene. DMXL1 BINDING SITE is HOST TARGET binding site found in the 3' untranslated region of mRNA encoded by DMXL1, corresponding to a HOST TARGET binding site such as BINDING SITE I, BINDING SITE II or BINDING SITE III. Table 2 illustrates the complementarity of the nucleotide sequences of DMXL1 BINDING SITE, designated SEQ ID:12022, to the nucleotide sequence of VGAM2069 RNA, herein designated VGAM RNA, also designated SEQ ID:4780.

Another function of VGAM2069 is therefore inhibition of Dmx-like 1 (DMXL1, Accession NM_005509). Accordingly, utilities of VGAM2069 include diagnosis, prevention and treatment of diseases and clinical conditions associated with DMXL1. Growth Differentiation Factor 8 (GDF8, Accession NM_005259) is another VGAM2069 host target gene. GDF8 BINDING SITE is HOST TARGET binding site found in the 3' untranslated region of mRNA encoded by GDF8, corresponding to a HOST TARGET binding site such as BINDING SITE I, BINDING SITE II or BINDING SITE III. Table 2 illustrates the complementarity of the nucleotide sequences of GDF8 BINDING SITE, designated SEQ ID:11763, to the nucleotide sequence of VGAM2069 RNA, herein designated VGAM RNA, also designated SEQ ID:4780.

Another function of VGAM2069 is therefore inhibition of Growth Differentiation Factor 8 (GDF8, Accession NM_005259), a gene which acts specifically as a negative regulator of skeletal muscle growth. Accordingly, utilities of VGAM2069 include diagnosis, prevention and treatment of diseases and clinical conditions associated with GDF8. The function of GDF8 and its association with various diseases and clinical conditions, has been established by previous studies, as described hereinabove with reference to VGAM386. Alpha 1,4-galactosyltransferase (A4GALT, Accession NM_017436) is another VGAM2069 host target gene. A4GALT BINDING SITE is HOST TARGET binding site found in the 3' untranslated region of mRNA encoded by A4GALT, corresponding to a HOST TARGET binding site such as BINDING SITE I, BINDING SITE II or BINDING SITE III. Table 2 illustrates the complementarity of the nucleotide sequences of A4GALT BINDING SITE, designated SEQ ID:18893, to the nucleotide sequence of VGAM2069 RNA, herein designated VGAM RNA, also designated SEQ ID:4780.

Another function of VGAM2069 is therefore inhibition of Alpha 1,4-galactosyltransferase (A4GALT, Accession NM_017436). Accordingly, utilities of VGAM2069 include diagnosis, prevention and treatment of diseases and clinical conditions associated with A4GALT. KIAA1317 (Accession XM_098368) is another VGAM2069 host target gene. KIAA1317 BINDING SITE is HOST TARGET binding site found in the 3' untranslated region of mRNA encoded by KIAA1317, corresponding to a HOST TARGET binding site such as BINDING SITE I, BINDING SITE II or BINDING SITE III. Table 2 illustrates the complementarity of the nucleotide sequences of KIAA1317 BINDING SITE, designated SEQ ID:41623, to the nucleotide sequence of VGAM2069 RNA, herein designated VGAM RNA, also designated SEQ ID:4780.

Another function of VGAM2069 is therefore inhibition of KIAA1317 (Accession XM_098368). Accordingly, utilities of VGAM2069 include diagnosis, prevention and treatment of diseases and clinical conditions associated with KIAA1317. LOC114932 (Accession XM_052614) is another VGAM2069 host target gene. LOC114932 BINDING SITE is HOST TARGET binding site found in the 3' untranslated region of mRNA encoded by LOC114932, corresponding to a HOST TARGET binding site such as BINDING SITE I, BINDING SITE II or BINDING SITE III. Table 2 illustrates the complementarity of the nucleotide sequences of LOC114932 BINDING SITE, designated SEQ ID:36003, to the nucleotide sequence of VGAM2069 RNA, herein designated VGAM RNA, also designated SEQ ID:4780.

Another function of VGAM2069 is therefore inhibition of LOC114932 (Accession XM_052614). Accordingly, utilities of VGAM2069 include diagnosis, prevention and treatment of diseases and clinical conditions associated with LOC114932. FIG. 1 further provides a conceptual description of a novel bioinformatically detected viral gene of the present invention, referred to here as Viral Genomic Address Messenger 2070 (VGAM2070) viral gene, which modulates expression of respective host target genes thereof, the function and utility of which host target genes is known in the art.

VGAM2070 is a novel bioinformatically detected regulatory, non protein coding, viral micro RNA (miRNA) gene. The method by which VGAM2070 was detected is described hereinabove with reference to FIGS. 1-8.

VGAM2070 gene, herein designated VGAM GENE, is a viral gene contained in the genome of Monkeypox Virus. VGAM2070 host target gene, herein designated VGAM HOST TARGET GENE, is a human gene contained in the human genome.

VGAM2070 gene encodes a VGAM2070 precursor RNA, herein designated VGAM PRECURSOR RNA. Similar to other miRNA genes, and unlike most ordinary genes, VGAM2070 precursor RNA does not encode a protein. A nucleotide sequence identical or highly similar to the nucleotide sequence of VGAM2070 precursor RNA is designated SEQ ID:2056, and is provided hereinbelow with reference to the sequence listing part. Nucleotide sequence SEQ ID:2056 is located at position 20302 relative to the genome of Monkeypox Virus.

VGAM2070 precursor RNA folds onto itself, forming VGAM2070 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2070 folded precursor RNA into VGAM2070 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2070 RNA is designated SEQ ID:4781, and is provided hereinbelow with reference to the sequence listing part.

VGAM2070 host target gene, herein designated VGAM HOST TARGET GENE, encodes a corresponding messenger RNA, VGAM2070 host target RNA, herein designated VGAM HOST TARGET RNA. VGAM2070 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2070 RNA, herein designated VGAM RNA, binds complementarily to one or more host target binding sites located in untranslated regions of VGAM2070 host target RNA, herein designated VGAM HOST TARGET RNA. This complementary binding is due to the fact that the nucleotide sequence of VGAM2070 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2070 RNA, herein designated VGAM RNA, may have a different number of host target binding sites in untranslated regions of a VGAM2070 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2070 RNA, herein designated VGAM RNA, to host target binding sites on VGAM2070 host target RNA, herein designated VGAM HOST TARGET RNA, such as BINDING SITE I, BINDING SITE II and BINDING SITE III, inhibits translation of VGAM2070 host target RNA into VGAM2070 host target protein, herein designated VGAM HOST TARGET PROTEIN. VGAM host target protein is therefore outlined by a broken line.

It is appreciated that VGAM2070 host target gene, herein designated VGAM HOST TARGET GENE, in fact represents a plurality of VGAM2070 host target genes. The mRNA of each one of this plurality of VGAM2070 host target genes comprises one or more host target binding sites, each having a nucleotide sequence which is at least partly complementary to VGAM2070 RNA, herein designated VGAM RNA, and which when bound by VGAM2070 RNA causes inhibition of translation of respective one or more VGAM2070 host target proteins.

It is further appreciated by one skilled in the art that the mode of translational inhibition illustrated by FIG. 1 with specific reference to translational inhibition exerted by VGAM2070 gene, herein designated VGAM GENE, on one or more VGAM2070 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2070 is inhibition of expression of host target genes, as part of a novel viral mechanism of attacking a host. Accordingly, utilities of VGAM2070 include diagnosis, prevention and treatment of viral infection by Monkeypox Virus. Specific functions, and accordingly utilities, of VGAM2070 correlate with, and may be deduced from, the identity of the host target genes which VGAM2070 binds and inhibits, and the function of these host target genes, as elaborated hereinbelow.

Nucleotide sequences of the VGAM2070 precursor RNA, herein designated VGAM PRECURSOR RNA, and of the 'diced' VGAM2070 RNA, herein designated VGAM RNA, and a schematic representation of the secondary folding of VGAM2070 folded precursor RNA, herein designated VGAM FOLDED PRECURSOR RNA, of VGAM2070 are further described hereinbelow with reference to Table 1.

Nucleotide sequences of host target binding sites, such as BINDING SITE-I, BINDING SITE-II and BINDING SITE-III of FIG. 1, found on VGAM2070 host target RNA, and schematic representation of the complementarity of each of these host target binding sites to VGAM2070 RNA, herein designated VGAM RNA, are described hereinbelow with reference to Table 2.

As mentioned hereinabove with reference to FIG. 1, a function of VGAM2070 gene, herein designated VGAM is inhibition of expression of VGAM2070 target genes. It is appreciated that specific functions, and accordingly utilities, of VGAM2070 correlate with, and may be deduced from, the identity of the target genes which VGAM2070 binds and inhibits, and the function of these target genes, as elaborated hereinbelow.

Lipoprotein Lipase (LPL, Accession NM_000237) is a VGAM2070 host target gene. LPL BINDING SITE is HOST TARGET binding site found in the 3" untranslated region of mRNA encoded by LPL, corresponding to a HOST TARGET binding site such as BINDING SITE I, BINDING SITE II or BINDING SITE III. Table 2 illustrates the complementarity of the nucleotide sequences of LPL BINDING SITE, designated SEQ ID:5751, to the nucleotide sequence of VGAM2070 RNA, herein designated VGAM RNA, also designated SEQ ID:4781.

A function of VGAM2070 is therefore inhibition of Lipoprotein Lipase (LPL, Accession NM_000237), a gene which is the hydrolysis of triglycerides of circulating chylomicrons and very low density lipoproteins (vldl). the enzyme functions in the presence of apolipoprotein c-2 on the luminal surface of vascular. Accordingly, utilities of VGAM2070 include diagnosis, prevention and treatment of diseases and clinical conditions associated with LPL. The function of LPL and its association with various diseases and clinical conditions, has been established by previous studies, as described hereinabove with reference to VGAM55. FLJ14624 (Accession XM_049060) is another VGAM2070 host target gene. FLJ14624 BINDING SITE is HOST TARGET binding site found in the 3' untranslated region of mRNA encoded by FLJ14624, corresponding to a HOST TARGET binding site such as BINDING SITE I, BINDING SITE II or BINDING SITE III. Table 2 illustrates the complementarity of the nucleotide sequences of FLJ14624 BINDING SITE, designated SEQ ID:35336, to the nucleotide sequence of VGAM2070 RNA, herein designated VGAM RNA, also designated SEQ ID:4781.

Another function of VGAM2070 is therefore inhibition of FLJ14624 (Accession XM_049060). Accordingly, utilities of VGAM2070 include diagnosis, prevention and treatment of diseases and clinical conditions associated with FLJ14624. Glutamate Receptor, Ionotropic, Delta 1 (GRID1, Accession XM_043613) is another VGAM2070 host target gene. GRID1 BINDING SITE is HOST TARGET binding site found in the 3' untranslated region of mRNA encoded by GRID1, corresponding to a HOST TARGET binding site such as BINDING SITE I, BINDING SITE II or BINDING SITE III. Table 2 illustrates the complementarity of the nucleotide sequences of GRID1 BINDING SITE, designated SEQ ID:33981, to the nucleotide sequence of VGAM2070 RNA, herein designated VGAM RNA, also designated SEQ ID:4781.

Another function of VGAM2070 is therefore inhibition of Glutamate Receptor, Ionotropic, Delta 1 (GRID1, Accession XM_043613). Accordingly, utilities of VGAM2070 include diagnosis, prevention and treatment of diseases and clinical conditions associated with GRID1. KIAA1336 (Accession XM_051306) is another VGAM2070 host target gene. KIAA1336 BINDING SITE is HOST TARGET binding site found in the 3' untranslated region of mRNA encoded by KIAA1336, corresponding to a HOST TARGET binding site such as BINDING SITE I, BINDING SITE II or BINDING SITE III. Table 2 illustrates the complementarity of the nucleotide sequences of KIAA1336 BINDING SITE, designated SEQ ID:35803, to the nucleotide sequence of VGAM2070 RNA, herein designated VGAM RNA, also designated SEQ ID:4781.

Another function of VGAM2070 is therefore inhibition of KIAA1336 (Accession XM_051306). Accordingly, utilities of VGAM2070 include diagnosis, prevention and treatment of diseases and clinical conditions associated with KIAA1336. STRIN (Accession NM_016271) is another VGAM2070 host target gene. STRIN BINDING SITE is HOST TARGET binding site found in the 3' untranslated region of mRNA encoded by STRIN, corresponding to a HOST TARGET binding site such as BINDING SITE I, BINDING SITE II or BINDING SITE III. Table 2 illustrates the complementarity of the nucleotide sequences of STRIN BINDING SITE, designated SEQ ID:18397, to the nucleotide sequence of VGAM2070 RNA, herein designated VGAM RNA, also designated SEQ ID:4781.

Another function of VGAM2070 is therefore inhibition of STRIN (Accession NM_016271). Accordingly, utilities of VGAM2070 include diagnosis, prevention and treatment of diseases and clinical conditions associated with STRIN. LOC158314 (Accession XM_098920) is another VGAM2070 host target gene. LOC158314 BINDING SITE is HOST TARGET binding site found in the 3' untranslated region of mRNA encoded by LOC158314, corresponding to a HOST TARGET binding site such as BINDING SITE I, BINDING SITE II or BINDING SITE III. Table 2 illustrates the complementarity of the nucleotide sequences of LOC158314 BINDING SITE, designated SEQ ID:41953, to the nucleotide sequence of VGAM2070 RNA, herein designated VGAM RNA, also designated SEQ ID:4781.

Another function of VGAM2070 is therefore inhibition of LOC158314 (Accession XM_098920). Accordingly, utilities of VGAM2070 include diagnosis, prevention and treatment of diseases and clinical conditions associated with LOC158314. FIG. 1 further provides a conceptual description of a novel bioinformatically detected viral gene of the present invention, referred to here as Viral Genomic Address Messenger 2071 (VGAM2071) viral gene, which modulates expression of respective host target genes thereof, the function and utility of which host target genes is known in the art.

VGAM2071 is a novel bioinformatically detected regulatory, non protein coding, viral micro RNA (miRNA) gene. The method by which VGAM2071 was detected is described hereinabove with reference to FIGS. 1-8.

VGAM2071 gene, herein designated VGAM GENE, is a viral gene contained in the genome of Monkeypox Virus. VGAM2071 host target gene, herein designated VGAM HOST TARGET GENE, is a human gene contained in the human genome.

VGAM2071 gene encodes a VGAM2071 precursor RNA, herein designated VGAM PRECURSOR RNA. Similar to other miRNA genes, and unlike most ordinary genes, VGAM2071 precursor RNA does not encode a protein. A nucleotide sequence identical or highly similar to the nucleotide sequence of VGAM2071 precursor RNA is designated SEQ ID:2057, and is provided hereinbelow with reference to the sequence listing part. Nucleotide sequence SEQ ID:2057 is located at position 28091 relative to the genome of Monkeypox Virus.

VGAM2071 precursor RNA folds onto itself, forming VGAM2071 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2071 folded precursor RNA into VGAM2071 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM2071 RNA is designated SEQ ID:4782, and is provided hereinbelow with reference to the sequence listing part.

VGAM2071 host target gene, herein designated VGAM HOST TARGET GENE, encodes a corresponding messenger RNA, VGAM2071 host target RNA, herein designated VGAM HOST TARGET RNA. VGAM2071 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2071 RNA, herein designated VGAM RNA, binds complementarily to one or more host target binding sites located in untranslated regions of VGAM2071 host target RNA, herein designated VGAM HOST TARGET RNA. This complementary binding is due to the fact that the nucleotide sequence of VGAM2071 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2071 RNA, herein designated VGAM RNA, may have a different number of host target binding sites in untranslated regions of a VGAM2071 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2071 RNA, herein designated VGAM RNA, to host target binding sites on VGAM2071 host target RNA, herein designated VGAM HOST TARGET RNA, such as BINDING SITE I, BINDING SITE II and BINDING SITE III, inhibits translation of VGAM2071 host target RNA into VGAM2071 host target protein, herein designated VGAM HOST TARGET PROTEIN. VGAM host target protein is therefore outlined by a broken line.

It is appreciated that VGAM2071 host target gene, herein designated VGAM HOST TARGET GENE, in fact represents a plurality of VGAM2071 host target genes. The mRNA of each one of this plurality of VGAM2071 host target genes comprises one or more host target binding sites, each having a nucleotide sequence which is at least partly complementary to VGAM2071 RNA, herein designated VGAM RNA, and which when bound by VGAM2071 RNA causes inhibition of translation of respective one or more VGAM2071 host target proteins.

It is further appreciated by one skilled in the art that the mode of translational inhibition illustrated by FIG. 1 with specific reference to translational inhibition exerted by VGAM2071 gene, herein designated VGAM GENE, on one or more VGAM2071 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2071 is inhibition of expression of host target genes, as part of a novel viral mechanism of attacking a host. Accordingly, utilities of VGAM2071 include diagnosis, prevention and treatment of viral infection by Monkeypox Virus. Specific functions, and accordingly utilities, of VGAM2071 correlate with, and may be deduced from, the identity of the host target genes which VGAM2071 binds and inhibits, and the function of these host target genes, as elaborated hereinbelow.

Nucleotide sequences of the VGAM2071 precursor RNA, herein designated VGAM PRECURSOR RNA, and of the 'diced' VGAM2071 RNA, herein designated VGAM RNA, and a schematic representation of the secondary folding of VGAM2071 folded precursor RNA, herein designated VGAM FOLDED PRECURSOR RNA, of VGAM2071 are further described hereinbelow with reference to Table 1.

Nucleotide sequences of host target binding sites, such as BINDING SITE-I, BINDING SITE-II and BINDING SITE-III of FIG. 1, found on VGAM2071 host target RNA, and schematic representation of the complementarity of each of these host target binding sites to VGAM2071 RNA, herein designated VGAM RNA, are described hereinbelow with reference to Table 2.

As mentioned hereinabove with reference to FIG. 1, a function of VGAM2071 gene, herein designated VGAM is inhibition of expression of VGAM2071 target genes. It is appreciated that specific functions, and accordingly utilities, of VGAM2071 correlate with, and may be deduced from, the identity of the target genes which VGAM2071 binds and inhibits, and the function of these target genes, as elaborated hereinbelow.

Adenosine Deaminase, RNA-specific (ADAR, Accession NM_001111) is a VGAM2071 host target gene. ADAR BINDING SITE1 through ADAR BINDING SITE3 are HOST TARGET binding sites found in untranslated regions of mRNA encoded by ADAR, corresponding to HOST TARGET binding sites such as BINDING SITE I, BINDING SITE II or BINDING SITE III. Table 2 illustrates the complementarity of the nucleotide sequences of ADAR BINDING SITE1 through ADAR BINDING SITE3, designated SEQ ID:6771, SEQ ID:17957 and SEQ ID:17964 respectively, to the nucleotide sequence of VGAM2071 RNA, herein designated VGAM RNA, also designated SEQ ID:4782.

A function of VGAM2071 is therefore inhibition of Adenosine Deaminase, RNA-specific (ADAR, Accession NM_001111), a gene which converts adenosine to inosine in double-stranded RNA. Accordingly, utilities of VGAM2071 include diagnosis, prevention and treatment of diseases and clinical conditions associated with ADAR. The function of ADAR and its association with various diseases and clinical conditions, has been established by previous studies, as described hereinabove with reference to VGAM323. Endometrial Bleeding Associated Factor (left-right determination, factor A; transforming growth factor beta superfamily) (EBAF, Accession XM_037302) is another VGAM2071 host target gene. EBAF BINDING SITE is HOST TARGET binding site found in the 3' untranslated region of mRNA encoded by EBAF, corresponding to a HOST TARGET binding site such as BINDING SITE I, BINDING SITE II or BINDING SITE III. Table 2 illustrates the complementarity of the nucleotide sequences of EBAF BINDING SITE, designated SEQ ID:32606, to the nucleotide sequence of VGAM2071 RNA, herein designated VGAM RNA, also designated SEQ ID:4782.

Another function of VGAM2071 is therefore inhibition of Endometrial Bleeding Associated Factor (left-right determination, factor A; transforming growth factor beta superfamily) (EBAF, Accession XM_037302), a gene which LEFT-RIGHT AXIS MALFORMATIONS. Accordingly, utilities of VGAM2071 include diagnosis, prevention and treatment of diseases and clinical conditions associated with EBAF. The function of EBAF and its association with various diseases and clinical conditions, has been established by previous studies, as described hereinabove with reference to VGAM93. Gap Junction Protein, Beta 1, 32 kDa (connexin 32, Charcot-Marie-Tooth neuropathy, X-linked) (GJB1, Accession XM_010141) is another VGAM2071 host target gene. GJB1 BINDING SITE is HOST TARGET binding site found in the 3' untranslated region of mRNA encoded by GJB1, corresponding to a HOST TARGET binding site such as BINDING SITE I, BINDING SITE II or BINDING SITE III. Table 2 illustrates the complementarity of the nucleotide sequences of GJB1 BINDING SITE, designated SEQ ID:30129, to the nucleotide sequence of VGAM2071 RNA, herein designated VGAM RNA, also designated SEQ ID:4782.

Another function of VGAM2071 is therefore inhibition of Gap Junction Protein, Beta 1, 32 kDa (connexin 32, Charcot-Marie-Tooth neuropathy, X-linked) (GJB1, Accession XM_010141). Accordingly, utilities of VGAM2071 include diagnosis, prevention and treatment of diseases and clinical conditions associated with GJB1. Hippocalcin-like 1 (HPCAL1, Accession NM_134421) is another VGAM2071 host target gene. HPCAL1 BINDING SITE1 and HPCAL1 BINDING SITE2 are HOST TARGET binding sites found in untranslated regions of mRNA encoded by HPCAL1, corresponding to HOST TARGET binding sites such as BINDING SITE I, BINDING SITE II or BINDING SITE III. Table 2 illustrates the complementarity of the nucleotide sequences of HPCAL1 BINDING SITE1 and HPCAL1 BINDING SITE2, designated SEQ ID:28637 and SEQ ID:7930 respectively, to the nucleotide sequence of VGAM2071 RNA, herein designated VGAM RNA, also designated SEQ ID:4782.

Another function of VGAM2071 is therefore inhibition of Hippocalcin-like 1 (HPCAL1, Accession NM_134421). Accordingly, utilities of VGAM2071 include diagnosis, prevention and treatment of diseases and clinical conditions associated with HPCAL1. Interleukin 2 Receptor, Alpha (IL2RA, Accession NM_000417) is another VGAM2071 host target gene. IL2RA BINDING SITE is HOST TARGET binding site found in the 5' untranslated region of mRNA encoded by IL2RA, corresponding to a HOST TARGET binding site such as BINDING SITE I, BINDING SITE II or BINDING SITE III. Table 2 illustrates the complementarity of the nucleotide sequences of IL2RA BINDING SITE, designated SEQ ID:5999, to the nucleotide sequence of VGAM2071 RNA, herein designated VGAM RNA, also designated SEQ ID:4782.

Another function of VGAM2071 is therefore inhibition of Interleukin 2 Receptor, Alpha (IL2RA, Accession NM_000417), a gene which plays a role in T cell mediated immune response. Accordingly, utilities of VGAM2071 include diagnosis, prevention and treatment of diseases and clinical conditions associated with IL2RA. The function of IL2RA and its association with various diseases and clinical conditions, has been established by previous studies, as described hereinabove with reference to VGAM1168. Meis1, Myeloid Ecotropic Viral Integration Site 1 Homolog (mouse) (MEIS1, Accession NM_002398) is another VGAM2071 host target gene. MEIS1 BINDING SITE is HOST TARGET binding site found in the 3' untranslated region of mRNA encoded by MEIS1, corresponding to a HOST TARGET binding site such as BINDING SITE I, BINDING SITE II or BINDING SITE III. Table 2 illustrates the complementarity of the nucleotide sequences of MEIS1 BINDING SITE, designated SEQ ID:8217, to the nucleotide sequence of VGAM2071 RNA, herein designated VGAM RNA, also designated SEQ ID:4782.

Another function of VGAM2071 is therefore inhibition of Meis1, Myeloid Ecotropic Viral Integration Site 1 Homolog (mouse) (MEIS1, Accession NM_002398), a gene which may regulate gene expression and control cell differentiation. Accordingly, utilities of VGAM2071 include diagnosis, prevention and treatment of diseases and clinical conditions associated with MEIS1. The function of MEIS1 and its association with various diseases and clinical conditions, has been established by previous studies, as described hereinabove with reference to VGAM894. NPR2L (Accession NM_006545) is another VGAM2071 host target gene. NPR2L BINDING SITE is HOST TARGET binding site found in the 3' untranslated region of mRNA encoded by NPR2L, corresponding to a HOST TARGET binding site such as BINDING SITE I, BINDING SITE II or BINDING SITE III. Table 2 illustrates the complementarity of the nucleotide sequences of NPR2L BINDING SITE, designated SEQ ID:13299, to the nucleotide sequence of VGAM2071 RNA, herein designated VGAM RNA, also designated SEQ ID:4782.

Another function of VGAM2071 is therefore inhibition of NPR2L (Accession NM_006545). Accordingly, utilities of VGAM2071 include diagnosis, prevention and treatment of diseases and clinical conditions associated with NPR2L. Poliovirus Receptor (PVR, Accession NM_006505) is another VGAM2071 host target gene. PVR BINDING SITE is HOST TARGET binding site found in the 3' untranslated region of mRNA encoded by PVR, corresponding to a HOST TARGET binding site such as BINDING SITE I, BINDING SITE II or BINDING SITE III. Table 2 illustrates the complementarity of the nucleotide sequences of PVR BINDING SITE, designated SEQ ID:13254, to the nucleotide sequence of VGAM2071 RNA, herein designated VGAM RNA, also designated SEQ ID:4782.

Another function of VGAM2071 is therefore inhibition of Poliovirus Receptor (PVR, Accession NM_006505), a gene which is a poliovirus receptor. Accordingly, utilities of VGAM2071 include diagnosis, prevention and treatment of diseases and clinical conditions associated with PVR. The function of PVR and its association with various diseases and clinical conditions, has been established by previous studies, as described hereinabove with reference to VGAM1411. Tight Junction Protein 1 (zona occludens 1) (TJP1, Accession NM_003257) is another VGAM2071 host target gene. TJP1 BINDING SITE is HOST TARGET binding site found in the 5' untranslated region of mRNA encoded by TJP1, corresponding to a HOST TARGET binding site such as BINDING SITE I, BINDING SITE II or BINDING SITE III. Table 2 illustrates the complementarity of the nucleotide sequences of TJP1 BINDING SITE, designated SEQ ID:9262, to the nucleotide sequence of VGAM2071 RNA, herein designated VGAM RNA, also designated SEQ ID:4782.

Another function of VGAM2071 is therefore inhibition of Tight Junction Protein 1 (zona occludens 1) (TJP1, Accession NM_003257), a gene which colocalizes and interacts with cadherins in cells lacking tight junctions. Accordingly, utilities of VGAM2071 include diagnosis, prevention and treatment of diseases and clinical conditions associated with TJP1. The function of TJP1 and its association with various diseases and clinical conditions, has been established by previous studies, as described hereinabove with reference to VGAM95. Chromosome X Open Reading Frame 1 (CXorf1, Accession NM_004709) is another VGAM2071 host target gene. CXorf1 BINDING SITE is HOST TARGET binding site found in the 3' untranslated region of mRNA encoded by CXorf1, corresponding to a HOST TARGET binding site such as BINDING SITE I, BINDING SITE II or BINDING SITE III. Table 2 illustrates the complementarity of the nucleotide sequences of CXorf1 BINDING SITE, designated SEQ ID:11054, to the nucleotide sequence of VGAM2071 RNA, herein designated VGAM RNA, also designated SEQ ID:4782.

Another function of VGAM2071 is therefore inhibition of Chromosome X Open Reading Frame 1 (CXorf1, Accession NM_004709). Accordingly, utilities of VGAM2071 include diagnosis, prevention and treatment of diseases and clinical conditions associated with CXorf1. DKFZP434K1772 (Accession XM_041936) is another VGAM2071 host target gene. DKFZP434K1772 BINDING SITE is HOST TARGET binding site found in the 5' untranslated region of mRNA encoded by DKFZP434K1772, corresponding to a HOST TARGET binding site such as BINDING SITE I, BINDING SITE II or BINDING SITE III. Table 2 illustrates the complementarity of the nucleotide sequences of DKFZP434K1772 BINDING SITE, designated SEQ ID:33629, to the nucleotide sequence of VGAM2071 RNA, herein designated VGAM RNA, also designated SEQ ID:4782.

Another function of VGAM2071 is therefore inhibition of DKFZP434K1772 (Accession XM_041936). Accordingly, utilities of VGAM2071 include diagnosis, prevention and treatment of diseases and clinical conditions associated with DKFZP434K1772. DKFZp547D155 (Accession XM_046977) is another VGAM2071 host target gene. DKFZp547D155 BINDING SITE is HOST TARGET binding site found in the 3' untranslated region of mRNA encoded by DKFZp547D155, corresponding to a HOST TARGET binding site such as BINDING SITE I, BINDING SITE II or BINDING SITE III. Table 2 illustrates the complementarity of the nucleotide sequences of DKFZp547D155 BINDING SITE, designated SEQ ID:34867, to the nucleotide sequence of VGAM2071 RNA, herein designated VGAM RNA, also designated SEQ ID:4782.

Another function of VGAM2071 is therefore inhibition of DKFZp547D155 (Accession XM_046977). Accordingly, utilities of VGAM2071 include diagnosis, prevention and treatment of diseases and clinical conditions associated with DKFZp547D155. FLJ12242 (Accession NM_024681) is another VGAM2071 host target gene. FLJ12242 BINDING SITE is HOST TARGET binding site found in the 3' untranslated region of mRNA encoded by FLJ12242, corresponding to a HOST TARGET binding site such as BINDING SITE I, BINDING SITE II or BINDING SITE III. Table 2 illustrates the complementarity of the nucleotide sequences of FLJ12242 BINDING SITE, designated SEQ ID:23994, to the nucleotide sequence of VGAM2071 RNA, herein designated VGAM RNA, also designated SEQ ID:4782.

Another function of VGAM2071 is therefore inhibition of FLJ12242 (Accession NM_024681). Accordingly, utilities of VGAM2071 include diagnosis, prevention and treatment of diseases and clinical conditions associated with FLJ12242. FLJ12387 (Accession NM_022822) is another VGAM2071 host target gene. FLJ12387 BINDING SITE is HOST TARGET binding site found in the 3' untranslated region of mRNA encoded by FLJ12387, corresponding to a HOST TARGET binding site such as BINDING SITE I, BINDING SITE II or BINDING SITE III. Table 2 illustrates the complementarity of the nucleotide sequences of FLJ12387 BINDING SITE, designated SEQ ID:23100, to the nucleotide sequence of VGAM2071 RNA, herein designated VGAM RNA, also designated SEQ ID:4782.

Another function of VGAM2071 is therefore inhibition of FLJ12387 (Accession NM_022822). Accordingly, utilities of VGAM2071 include diagnosis, prevention and treatment of diseases and clinical conditions associated with FLJ12387. FLJ12975 (Accession XM_045522) is another VGAM2071 host target gene. FLJ12975 BINDING SITE is HOST TARGET binding site found in the 3' untranslated region of mRNA encoded by FLJ12975, corresponding to a HOST TARGET binding site such as BINDING SITE I, BINDING SITE II or BINDING SITE III. Table 2 illustrates the complementarity of the nucleotide sequences of FLJ12975 BINDING SITE, designated SEQ ID:34479, to the nucleotide sequence of VGAM2071 RNA, herein designated VGAM RNA, also designated SEQ ID:4782.

Another function of VGAM2071 is therefore inhibition of FLJ12975 (Accession XM_045522). Accordingly, utilities of VGAM2071 include diagnosis, prevention and treatment of diseases and clinical conditions associated with FLJ12975. KIAA0155 (Accession NM_014633) is another VGAM2071 host target gene. KIAA0155 BINDING SITE is HOST TARGET binding site found in the 3' untranslated region of mRNA encoded by KIAA0155, corresponding to a HOST TARGET binding site such as BINDING SITE I, BINDING SITE II or BINDING SITE III. Table 2 illustrates the complementarity of the nucleotide sequences of KIAA0155 BINDING SITE, designated SEQ ID:16002, to the nucleotide sequence of VGAM2071 RNA, herein designated VGAM RNA, also designated SEQ ID:4782.

Another function of VGAM2071 is therefore inhibition of KIAA0155 (Accession NM_014633). Accordingly, utilities of VGAM2071 include diagnosis, prevention and treatment of diseases and clinical conditions associated with KIAA0155. KIAA1649 (Accession NM_032311) is another VGAM2071 host target gene. KIAA1649 BINDING SITE is HOST TARGET binding site found in the 3' untranslated region of mRNA encoded by KIAA1649, corresponding to a HOST TARGET binding site such as BINDING SITE I, BINDING SITE II or BINDING SITE III. Table 2 illustrates the complementarity of the nucleotide sequences of KIAA1649 BINDING SITE, designated SEQ ID:26104, to the nucleotide sequence of VGAM2071 RNA, herein designated VGAM RNA, also designated SEQ ID:4782.

Another function of VGAM2071 is therefore inhibition of KIAA1649 (Accession NM_032311). Accordingly, utilities of VGAM2071 include diagnosis, prevention and treatment of diseases and clinical conditions associated with KIAA1649. PRO0899 (Accession NM_018565) is another VGAM2071 host target gene. PRO0899 BINDING SITE is HOST TARGET binding site found in the 5' untranslated region of mRNA encoded by PRO0899, corresponding to a HOST TARGET binding site such as BINDING SITE I, BINDING SITE II or BINDING SITE III. Table 2 illustrates the complementarity of the nucleotide sequences of PRO0899 BINDING SITE, designated SEQ ID:20648, to the nucleotide sequence of VGAM2071 RNA, herein designated VGAM RNA, also designated SEQ ID:4782.

Another function of VGAM2071 is therefore inhibition of PRO0899 (Accession NM_018565). Accordingly, utilities of VGAM2071 include diagnosis, prevention and treatment of diseases and clinical conditions associated with PRO0899. Translocation Protein 1 (TLOC1, Accession NM_003262) is another VGAM2071 host target gene. TLOC1 BINDING SITE is HOST TARGET binding site found in the 5' untranslated region of mRNA encoded by TLOC1, corresponding to a HOST TARGET binding site such as BINDING SITE I, BINDING SITE II or BINDING SITE III. Table 2 illustrates the complementarity of the nucleotide sequences of TLOC1 BINDING SITE, designated SEQ ID:9272, to the nucleotide sequence of VGAM2071 RNA, herein designated VGAM RNA, also designated SEQ ID:4782.

Another function of VGAM2071 is therefore inhibition of Translocation Protein 1 (TLOC1, Accession NM_003262). Accordingly, utilities of VGAM2071 include diagnosis, prevention and treatment of diseases and clinical conditions associated with TLOC1. LOC151877 (Accession XM_098132) is another VGAM2071 host target gene. LOC151877 BINDING SITE is HOST TARGET binding site found in the 3' untranslated region of mRNA encoded by LOC151877, corresponding to a HOST TARGET binding site such as BINDING SITE I, BINDING SITE II or BINDING SITE III. Table 2 illustrates the complementarity of the nucleotide sequences of LOC151877 BINDING SITE, designated SEQ ID:41394, to the nucleotide sequence of VGAM2071 RNA, herein designated VGAM RNA, also designated SEQ ID:4782.

Another function of VGAM2071 is therefore inhibition of LOC151877 (Accession XM_098132). Accordingly, utilities of VGAM2071 include diagnosis, prevention and treatment of diseases and clinical conditions associated with LOC151877. LOC152179 (Accession XM_098170) is another VGAM2071 host target gene. LOC152179 BINDING SITE is HOST TARGET binding site found in the 5' untranslated region of mRNA encoded by LOC152179, corresponding to a HOST TARGET binding site such as BINDING SITE I, BINDING SITE II or BINDING SITE III. Table 2 illustrates the complementarity of the nucleotide sequences of LOC152179 BINDING SITE, designated SEQ ID:41432, to the nucleotide sequence of VGAM2071 RNA, herein designated VGAM RNA, also designated SEQ ID:4782.

Another function of VGAM2071 is therefore inhibition of LOC152179 (Accession XM_098170). Accordingly, utilities of VGAM2071 include diagnosis, prevention and treatment of diseases and clinical conditions associated with LOC152179. LOC164714 (Accession XM_104657) is another VGAM2071 host target gene. LOC164714 BINDING SITE is HOST TARGET binding site found in the 5' untranslated region of mRNA encoded by LOC164714, corresponding to a HOST TARGET binding site such as BINDING SITE I, BINDING SITE II or BINDING SITE III. Table 2 illustrates the complementarity of the nucleotide sequences of LOC164714 BINDING SITE, designated SEQ ID:42176, to the nucleotide sequence of VGAM2071 RNA, herein designated VGAM RNA, also designated SEQ ID:4782.

Another function of VGAM2071 is therefore inhibition of LOC164714 (Accession XM_104657). Accordingly, utilities of VGAM2071 include diagnosis, prevention and treatment of diseases and clinical conditions associated with LOC164714. LOC253783 (Accession XM_170873) is another VGAM2071 host target gene. LOC253783 BINDING SITE is HOST TARGET binding site found in the 5' untranslated region of mRNA encoded by LOC253783, corresponding to a HOST TARGET binding site such as BINDING SITE I, BINDING SITE II or BINDING SITE III. Table 2 illustrates the complementarity of the nucleotide sequences of LOC253783 BINDING SITE, designated SEQ ID:45641, to the nucleotide sequence of VGAM2071 RNA, herein designated VGAM RNA, also designated SEQ ID:4782.

Another function of VGAM2071 is therefore inhibition of LOC253783 (Accession XM_170873). Accordingly, utilities of VGAM2071 include diagnosis, prevention and treatment of diseases and clinical conditions associated with LOC253783. LOC93166 (Accession XM_049619) is another VGAM2071 host target gene. LOC93166 BINDING SITE is HOST TARGET binding site found in the 3' untranslated region of mRNA encoded by LOC93166, corresponding to a HOST TARGET binding site such as BINDING SITE I, BINDING SITE II or BINDING SITE III. Table 2 illustrates the complementarity of the nucleotide sequences of LOC93166 BINDING SITE, designated SEQ ID:35460, to the nucleotide sequence of VGAM2071 RNA, herein designated VGAM RNA, also designated SEQ ID:4782.

Another function of VGAM2071 is therefore inhibition of LOC93166 (Accession XM_049619). Accordingly, utilities of VGAM2071 include diagnosis, prevention and treatment of diseases and clinical conditions associated with LOC93166. FIG. 1 further provides a conceptual description of a novel bioinformatically detected viral gene of the present invention, referred to here as Viral Genomic Address Messenger 2072 (VGAM2072) viral gene, which modulates expression of respective host target genes thereof, the function and utility of which host target genes is known in the art.

VGAM2072 is a novel bioinformatically detected regulatory, non protein coding, viral micro RNA (miRNA) gene. The method by which VGAM2072 was detected is described hereinabove with reference to FIGS. 1-8.

VGAM2072 gene, herein designated VGAM GENE, is a viral gene contained in the genome of Ectromelia Virus. VGAM2072 host target gene, herein designated VGAM HOST TARGET GENE, is a human gene contained in the human genome.

VGAM2072 gene encodes a VGAM2072 precursor RNA, herein designated VGAM PRECURSOR RNA. Similar to other miRNA genes, and unlike most ordinary genes, VGAM2072 precursor RNA does not encode a protein. A nucleotide sequence identical or highly similar to the nucleotide sequence of VGAM2072 precursor RNA is designated SEQ ID:2058, and is provided hereinbelow with reference to the sequence listing part. Nucleotide sequence SEQ ID:2058 is located at position 23821 relative to the genome of Ectromelia Virus.

VGAM2072 precursor RNA folds onto itself, forming VGAM2072 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2072 folded precursor RNA into VGAM2072 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM2072 RNA is designated SEQ ID:4783, and is provided hereinbelow with reference to the sequence listing part.

VGAM2072 host target gene, herein designated VGAM HOST TARGET GENE, encodes a corresponding messenger RNA, VGAM2072 host target RNA, herein designated VGAM HOST TARGET RNA. VGAM2072 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2072 RNA, herein designated VGAM RNA, binds complementarily to one or more host target binding sites located in untranslated regions of VGAM2072 host target RNA, herein designated VGAM HOST TARGET RNA. This complementary binding is due to the fact that the nucleotide sequence of VGAM2072 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2072 RNA, herein designated VGAM RNA, may have a different number of host target binding sites in untranslated regions of a VGAM2072 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2072 RNA, herein designated VGAM RNA, to host target binding sites on VGAM2072 host target RNA, herein designated VGAM HOST TARGET RNA, such as BINDING SITE I, BINDING SITE II and BINDING SITE III, inhibits translation of VGAM2072 host target RNA into VGAM2072 host target protein, herein designated VGAM HOST TARGET PROTEIN. VGAM host target protein is therefore outlined by a broken line.

It is appreciated that VGAM2072 host target gene, herein designated VGAM HOST TARGET GENE, in fact represents a plurality of VGAM2072 host target genes. The mRNA of each one of this plurality of VGAM2072 host target genes comprises one or more host target binding sites, each having a nucleotide sequence which is at least partly complementary to VGAM2072 RNA, herein designated VGAM RNA, and which when bound by VGAM2072 RNA causes inhibition of translation of respective one or more VGAM2072 host target proteins.

It is further appreciated by one skilled in the art that the mode of translational inhibition illustrated by FIG. 1 with specific reference to translational inhibition exerted by VGAM2072 gene, herein designated VGAM GENE, on one or more VGAM2072 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2072 is inhibition of expression of host target genes, as part of a novel viral mechanism of attacking a host. Accordingly, utilities of VGAM2072 include diagnosis, prevention and treatment of viral infection by Ectromelia Virus. Specific functions, and accordingly utilities, of VGAM2072 correlate with, and may be deduced from, the identity of the host target genes which VGAM2072 binds and inhibits, and the function of these host target genes, as elaborated hereinbelow.

Nucleotide sequences of the VGAM2072 precursor RNA, herein designated VGAM PRECURSOR RNA, and of the 'diced' VGAM2072 RNA, herein designated VGAM RNA, and a schematic representation of the secondary folding of VGAM2072 folded precursor RNA, herein designated VGAM FOLDED PRECURSOR RNA, of VGAM2072 are further described hereinbelow with reference to Table 1.

Nucleotide sequences of host target binding sites, such as BINDING SITE-I, BINDING SITE-II and BINDING SITE-III of FIG. 1, found on VGAM2072 host target RNA, and schematic representation of the complementarity of each of these host target binding sites to VGAM2072 RNA, herein designated VGAM RNA, are described hereinbelow with reference to Table 2.

As mentioned hereinabove with reference to FIG. 1, a function of VGAM2072 gene, herein designated VGAM is inhibition of expression of VGAM2072 target genes. It is appreciated that specific functions, and accordingly utilities, of VGAM2072 correlate with, and may be deduced from, the identity of the target genes which VGAM2072 binds and inhibits, and the function of these target genes, as elaborated hereinbelow.

Collagen, Type XVII, Alpha 1 (COL17A1, Accession NM_000494) is a VGAM2072 host target gene. COL17A1 BINDING SITE is HOST TARGET binding site found in the 3' untranslated region of mRNA encoded by COL17A1, corresponding to a HOST TARGET binding site such as BINDING SITE I, BINDING SITE II or BINDING SITE III. Table 2 illustrates the complementarity of the nucleotide sequences of COL17A1 BINDING SITE, designated SEQ ID:6106, to the nucleotide sequence of VGAM2072 RNA, herein designated VGAM RNA, also designated SEQ ID:4783.

A function of VGAM2072 is therefore inhibition of Collagen, Type XVII, Alpha 1 (COL17A1, Accession NM_000494). Accordingly, utilities of VGAM2072 include diagnosis, prevention and treatment of diseases and clinical conditions associated with COL17A1. FIG. 1 further provides a conceptual description of a novel bioinformatically detected viral gene of the present invention, referred to here as Viral Genomic Address Messenger 2073 (VGAM2073) viral gene, which modulates expression of respective host target genes thereof, the function and utility of which host target genes is known in the art.

VGAM2073 is a novel bioinformatically detected regulatory, non protein coding, viral micro RNA (miRNA) gene. The method by which VGAM2073 was detected is described hereinabove with reference to FIGS. 1-8.

VGAM2073 gene, herein designated VGAM GENE, is a viral gene contained in the genome of Monkeypox Virus. VGAM2073 host target gene, herein designated VGAM HOST TARGET GENE, is a human gene contained in the human genome.

VGAM2073 gene encodes a VGAM2073 precursor RNA, herein designated VGAM PRECURSOR RNA. Similar to other miRNA genes, and unlike most ordinary genes, VGAM2073 precursor RNA does not encode a protein. A nucleotide sequence identical or highly similar to the nucleotide sequence of VGAM2073 precursor RNA is designated SEQ ID:2059, and is provided hereinbelow with reference to the sequence listing part. Nucleotide sequence SEQ ID:2059 is located at position 16020 relative to the genome of Monkeypox Virus.

VGAM2073 precursor RNA folds onto itself, forming VGAM2073 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2073 folded precursor RNA into VGAM2073 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2073 RNA is designated SEQ ID:4784, and is provided hereinbelow with reference to the sequence listing part.

VGAM2073 host target gene, herein designated VGAM HOST TARGET GENE, encodes a corresponding messenger RNA, VGAM2073 host target RNA, herein designated VGAM HOST TARGET RNA. VGAM2073 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2073 RNA, herein designated VGAM RNA, binds complementarily to one or more host target binding sites located in untranslated regions of VGAM2073 host target RNA, herein designated VGAM HOST TARGET RNA. This complementary binding is due to the fact that the nucleotide sequence of VGAM2073 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2073 RNA, herein designated VGAM RNA, may have a different number of host target binding sites in untranslated regions of a VGAM2073 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2073 RNA, herein designated VGAM RNA, to host target binding sites on VGAM2073 host target RNA, herein designated VGAM HOST TARGET RNA, such as BINDING SITE I, BINDING SITE II and BINDING SITE III, inhibits translation of VGAM2073 host target RNA into VGAM2073 host target protein, herein designated VGAM HOST TARGET PROTEIN. VGAM host target protein is therefore outlined by a broken line.

It is appreciated that VGAM2073 host target gene, herein designated VGAM HOST TARGET GENE, in fact represents a plurality of VGAM2073 host target genes. The mRNA of each one of this plurality of VGAM2073 host target genes comprises one or more host target binding sites, each having a nucleotide sequence which is at least partly complementary to VGAM2073 RNA, herein designated VGAM RNA, and which when bound by VGAM2073 RNA causes inhibition of translation of respective one or more VGAM2073 host target proteins.

It is further appreciated by one skilled in the art that the mode of translational inhibition illustrated by FIG. 1 with specific reference to translational inhibition exerted by VGAM2073 gene, herein designated VGAM GENE, on one or more VGAM2073 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2073 is inhibition of expression of host target genes, as part of a novel viral mechanism of attacking a host. Accordingly, utilities of VGAM2073 include diagnosis, prevention and treatment of viral infection by Monkeypox Virus. Specific functions, and accordingly utilities, of VGAM2073 correlate with, and may be deduced from, the identity of the host target genes which VGAM2073 binds and inhibits, and the function of these host target genes, as elaborated hereinbelow.

Nucleotide sequences of the VGAM2073 precursor RNA, herein designated VGAM PRECURSOR RNA, and of the 'diced' VGAM2073 RNA, herein designated VGAM RNA, and a schematic representation of the secondary folding of VGAM2073 folded precursor RNA, herein designated VGAM FOLDED PRECURSOR RNA, of VGAM2073 are further described hereinbelow with reference to Table 1.

Nucleotide sequences of host target binding sites, such as BINDING SITE-I, BINDING SITE-II and BINDING SITE-III of FIG. 1, found on VGAM2073 host target RNA, and schematic representation of the complementarity of each of these host target binding sites to VGAM2073 RNA, herein designated VGAM RNA, are described hereinbelow with reference to Table 2.

As mentioned hereinabove with reference to FIG. 1, a function of VGAM2073 gene, herein designated VGAM is inhibition of expression of VGAM2073 target genes. It is appreciated that specific functions, and accordingly utilities, of VGAM2073 correlate with, and may be deduced from, the identity of the target genes which VGAM2073 binds and inhibits, and the function of these target genes, as elaborated hereinbelow.

Chromosome 20 Open Reading Frame 98 (C20orf98, Accession XM_049398) is a VGAM2073 host target gene. C20orf98 BINDING SITE is HOST TARGET binding site found in the 3' untranslated region of mRNA encoded by C20orf98, corresponding to a HOST TARGET binding site such as BINDING SITE I, BINDING SITE II or BINDING SITE III. Table 2 illustrates the complementarity of the nucleotide sequences of C20orf98 BINDING SITE, designated SEQ ID:35415, to the nucleotide sequence of VGAM2073 RNA, herein designated VGAM RNA, also designated SEQ ID:4784.

A function of VGAM2073 is therefore inhibition of Chromosome 20 Open Reading Frame 98 (C20orf98, Accession XM_049398). Accordingly, utilities of VGAM2073 include diagnosis, prevention and treatment of diseases and clinical conditions associated with C20orf98. Potassium Channel, Subfamily V, Member 1 (KCNV1, Accession NM_014379) is another VGAM2073 host target gene. KCNV1 BINDING SITE is HOST TARGET binding site found in the 3' untranslated region of mRNA encoded by KCNV1, corresponding to a HOST TARGET binding site such as BINDING SITE I, BINDING SITE II or BINDING SITE III. Table 2 illustrates the complementarity of the nucleotide sequences of KCNV1 BINDING SITE, designated SEQ ID:15710, to the nucleotide sequence of VGAM2073 RNA, herein designated VGAM RNA, also designated SEQ ID:4784.

Another function of VGAM2073 is therefore inhibition of Potassium Channel, Subfamily V, Member 1 (KCNV1, Accession NM_014379). Accordingly, utilities of VGAM2073 include diagnosis, prevention and treatment of diseases and clinical conditions associated with KCNV1. KIAA0087 (Accession NM_014769) is another VGAM2073 host target gene. KIAA0087 BINDING SITE is HOST TARGET binding site found in the 3' untranslated region of mRNA encoded by KIAA0087, corresponding to a HOST TARGET binding site such as BINDING SITE I, BINDING SITE II or BINDING SITE III. Table 2 illustrates the complementarity of the nucleotide sequences of KIAA0087 BINDING SITE, designated SEQ ID:16562, to the nucleotide sequence of VGAM2073 RNA, herein designated VGAM RNA, also designated SEQ ID:4784.

Another function of VGAM2073 is therefore inhibition of KIAA0087 (Accession NM_014769). Accordingly, utilities of VGAM2073 include diagnosis, prevention and treatment of diseases and clinical conditions associated with KIAA0087. KIAA1877 (Accession XM_038616) is another VGAM2073 host target gene. KIAA1877 BINDING SITE is HOST TARGET binding site found in the 3' untranslated region of mRNA encoded by KIAA1877, corresponding to a HOST TARGET binding site such as BINDING SITE I, BINDING SITE II or BINDING SITE III. Table 2 illustrates the complementarity of the nucleotide sequences of KIAA1877 BINDING SITE, designated SEQ ID:32879, to the nucleotide sequence of VGAM2073 RNA, herein designated VGAM RNA, also designated SEQ ID:4784.

Another function of VGAM2073 is therefore inhibition of KIAA1877 (Accession XM_038616). Accordingly, utilities of VGAM2073 include diagnosis, prevention and treatment of diseases and clinical conditions associated with KIAA1877. MGC4643 (Accession NM_032715) is another VGAM2073 host target gene. MGC4643 BINDING SITE is HOST TARGET binding site found in the 3' untranslated region of mRNA encoded by MGC4643, corresponding to a HOST TARGET binding site such as BINDING SITE I, BINDING SITE II or BINDING SITE III. Table 2 illustrates the complementarity of the nucleotide sequences of MGC4643 BINDING SITE, designated SEQ ID:26441, to the nucleotide sequence of VGAM2073 RNA, herein designated VGAM RNA, also designated SEQ ID:4784.

Another function of VGAM2073 is therefore inhibition of MGC4643 (Accession NM_032715). Accordingly, utilities of VGAM2073 include diagnosis, prevention and treatment of diseases and clinical conditions associated with MGC4643. LOC219818 (Accession XM_165589) is another VGAM2073 host target gene. LOC219818 BINDING SITE is HOST TARGET binding site found in the 3' untranslated region of mRNA encoded by LOC219818, corresponding to a HOST TARGET binding site such as BINDING SITE I, BINDING SITE II or BINDING SITE III. Table 2 illustrates the complementarity of the nucleotide sequences of LOC219818 BINDING SITE, designated SEQ ID:43698, to the nucleotide sequence of VGAM2073 RNA, herein designated VGAM RNA, also designated SEQ ID:4784.

Another function of VGAM2073 is therefore inhibition of LOC219818 (Accession XM_165589). Accordingly, utilities of VGAM2073 include diagnosis, prevention and treatment of diseases and clinical conditions associated with LOC219818. LOC254219 (Accession XM_172913) is another VGAM2073 host target gene. LOC254219 BINDING SITE is HOST TARGET binding site found in the 3' untranslated region of mRNA encoded by LOC254219, corresponding to a HOST TARGET binding site such as BINDING SITE I, BINDING SITE II or BINDING SITE III. Table 2 illustrates the complementarity of the nucleotide sequences of LOC254219 BINDING SITE, designated SEQ ID:46173, to the nucleotide sequence of VGAM2073 RNA, herein designated VGAM RNA, also designated SEQ ID:4784.

Another function of VGAM2073 is therefore inhibition of LOC254219 (Accession XM_172913). Accordingly, utilities of VGAM2073 include diagnosis, prevention and treatment of diseases and clinical conditions associated with LOC254219. FIG. 1 further provides a conceptual description of a novel bioinformatically detected viral gene of the present invention, referred to here as Viral Genomic Address Messenger 2074 (VGAM2074) viral gene, which modulates expression of respective host target genes thereof, the function and utility of which host target genes is known in the art.

VGAM2074 is a novel bioinformatically detected regulatory, non protein coding, viral micro RNA (miRNA) gene. The method by which VGAM2074 was detected is described hereinabove with reference to FIGS. 1-8.

VGAM2074 gene, herein designated VGAM GENE, is a viral gene contained in the genome of Monkeypox Virus. VGAM2074 host target gene, herein designated VGAM HOST TARGET GENE, is a human gene contained in the human genome.

VGAM2074 gene encodes a VGAM2074 precursor RNA, herein designated VGAM PRECURSOR RNA. Similar to other miRNA genes, and unlike most ordinary genes, VGAM2074 precursor RNA does not encode a protein. A nucleotide sequence identical or highly similar to the nucleotide sequence of VGAM2074 precursor RNA is designated SEQ ID:2060, and is provided hereinbelow with reference to the sequence listing part. Nucleotide sequence SEQ ID:2060 is located at position 25479 relative to the genome of Monkeypox Virus.

VGAM2074 precursor RNA folds onto itself, forming VGAM2074 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2074 folded precursor RNA into VGAM2074 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2074 RNA is designated SEQ ID:4785, and is provided hereinbelow with reference to the sequence listing part.

VGAM2074 host target gene, herein designated VGAM HOST TARGET GENE, encodes a corresponding messenger RNA, VGAM2074 host target RNA, herein designated VGAM HOST TARGET RNA. VGAM2074 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2074 RNA, herein designated VGAM RNA, binds complementarily to one or more host target binding sites located in untranslated regions of VGAM2074 host target RNA, herein designated VGAM HOST TARGET RNA. This complementary binding is due to the fact that the nucleotide sequence of VGAM2074 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2074 RNA, herein designated VGAM RNA, may have a different number of host target binding sites in untranslated regions of a VGAM2074 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2074 RNA, herein designated VGAM RNA, to host target binding sites on VGAM2074 host target RNA, herein designated VGAM HOST TARGET RNA, such as BINDING SITE I, BINDING SITE II and BINDING SITE III, inhibits translation of VGAM2074 host target RNA into VGAM2074 host target protein, herein designated VGAM HOST TARGET PROTEIN. VGAM host target protein is therefore outlined by a broken line.

It is appreciated that VGAM2074 host target gene, herein designated VGAM HOST TARGET GENE, in fact represents a plurality of VGAM2074 host target genes. The mRNA of each one of this plurality of VGAM2074 host target genes comprises one or more host target binding sites, each having a nucleotide sequence which is at least partly complementary to VGAM2074 RNA, herein designated VGAM RNA, and which when bound by VGAM2074 RNA causes inhibition of translation of respective one or more VGAM2074 host target proteins.

It is further appreciated by one skilled in the art that the mode of translational inhibition illustrated by FIG. 1 with specific reference to translational inhibition exerted by VGAM2074 gene, herein designated VGAM GENE, on one or more VGAM2074 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2074 is inhibition of expression of host target genes, as part of a novel viral mechanism of attacking a host. Accordingly, utilities of VGAM2074 include diagnosis, prevention and treatment of viral infection by Monkeypox Virus. Specific functions, and accordingly utilities, of VGAM2074 correlate with, and may be deduced from, the identity of the host target genes which VGAM2074 binds and inhibits, and the function of these host target genes, as elaborated hereinbelow.

Nucleotide sequences of the VGAM2074 precursor RNA, herein designated VGAM PRECURSOR RNA, and of the 'diced' VGAM2074 RNA, herein designated VGAM RNA, and a schematic representation of the secondary folding of VGAM2074 folded precursor RNA, herein designated VGAM FOLDED PRECURSOR RNA, of VGAM2074 are further described hereinbelow with reference to Table 1.

Nucleotide sequences of host target binding sites, such as BINDING SITE-I, BINDING SITE-II and BINDING SITE-III of FIG. 1, found on VGAM2074 host target RNA, and schematic representation of the complementarity of each of these host target binding sites to VGAM2074 RNA, herein designated VGAM RNA, are described hereinbelow with reference to Table 2.

As mentioned hereinabove with reference to FIG. 1, a function of VGAM2074 gene, herein designated VGAM is inhibition of expression of VGAM2074 target genes. It is appreciated that specific functions, and accordingly utilities, of VGAM2074 correlate with, and may be deduced from, the identity of the target genes which VGAM2074 binds and inhibits, and the function of these target genes, as elaborated hereinbelow.

FLJ22405 (Accession NM_022485) is a VGAM2074 host target gene. FLJ22405 BINDING SITE is HOST TARGET binding site found in the 5' untranslated region of mRNA encoded by FLJ22405, corresponding to a HOST TARGET binding site such as BINDING SITE I, BINDING SITE II or BINDING SITE III. Table 2 illustrates the complementarity of the nucleotide sequences of FLJ22405 BINDING SITE, designated SEQ ID:22864, to the nucleotide sequence of VGAM2074 RNA, herein designated VGAM RNA, also designated SEQ ID:4785.

A function of VGAM2074 is therefore inhibition of FLJ22405 (Accession NM_022485). Accordingly, utilities of VGAM2074 include diagnosis, prevention and treatment of diseases and clinical conditions associated with FLJ22405. KIAA1143 (Accession XM_044014) is another VGAM2074 host target gene. KIAA1143 BINDING SITE is HOST TARGET binding site found in the 3' untranslated region of mRNA encoded by KIAA1143, corresponding to a HOST TARGET binding site such as BINDING SITE I, BINDING SITE II or BINDING SITE III. Table 2 illustrates the complementarity of the nucleotide sequences of KIAA1143 BINDING SITE, designated SEQ ID:34078, to the nucleotide sequence of VGAM2074 RNA, herein designated VGAM RNA, also designated SEQ ID:4785.

Another function of VGAM2074 is therefore inhibition of KIAA1143 (Accession XM_044014). Accordingly, utilities of VGAM2074 include diagnosis, prevention and treatment of diseases and clinical conditions associated with KIAA1143. FIG. 1 further provides a conceptual description of a novel bioinformatically detected viral gene of the present invention, referred to here as Viral Genomic Address Messenger 2075 (VGAM2075) viral gene, which modulates expression of respective host target genes thereof, the function and utility of which host target genes is known in the art.

VGAM2075 is a novel bioinformatically detected regulatory, non protein coding, viral micro RNA (miRNA) gene. The method by which VGAM2075 was detected is described hereinabove with reference to FIGS. 1-8.

VGAM2075 gene, herein designated VGAM GENE, is a viral gene contained in the genome of Variola Virus. VGAM2075 host target gene, herein designated VGAM HOST TARGET GENE, is a human gene contained in the human genome.

VGAM2075 gene encodes a VGAM2075 precursor RNA, herein designated VGAM PRECURSOR RNA. Similar to other miRNA genes, and unlike most ordinary genes, VGAM2075 precursor RNA does not encode a protein. A nucleotide sequence identical or highly similar to the nucleotide sequence of VGAM2075 precursor RNA is designated SEQ ID:2061, and is provided hereinbelow with reference to the sequence listing part. Nucleotide sequence SEQ ID:2061 is located at position 177494 relative to the genome of Variola Virus.

VGAM2075 precursor RNA folds onto itself, forming VGAM2075 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2075 folded precursor RNA into VGAM2075 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM2075 RNA is designated SEQ ID:4786, and is provided hereinbelow with reference to the sequence listing part.

VGAM2075 host target gene, herein designated VGAM HOST TARGET GENE, encodes a corresponding messenger RNA, VGAM2075 host target RNA, herein designated VGAM HOST TARGET RNA. VGAM2075 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2075 RNA, herein designated VGAM RNA, binds complementarily to one or more host target binding sites located in untranslated regions of VGAM2075 host target RNA, herein designated VGAM HOST TARGET RNA. This complementary binding is due to the fact that the nucleotide sequence of VGAM2075 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2075 RNA, herein designated VGAM RNA, may have a different number of host target binding sites in untranslated regions of a VGAM2075 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2075 RNA, herein designated VGAM RNA, to host target binding sites on VGAM2075 host target RNA, herein designated VGAM HOST TARGET RNA, such as BINDING SITE I, BINDING SITE II and BINDING SITE III, inhibits translation of VGAM2075 host target RNA into VGAM2075 host target protein, herein designated VGAM HOST TARGET PROTEIN. VGAM host target protein is therefore outlined by a broken line.

It is appreciated that VGAM2075 host target gene, herein designated VGAM HOST TARGET GENE, in fact represents a plurality of VGAM2075 host target genes. The mRNA of each one of this plurality of VGAM2075 host target genes comprises one or more host target binding sites, each having a nucleotide sequence which is at least partly complementary to VGAM2075 RNA, herein designated VGAM RNA, and which when bound by VGAM2075 RNA causes inhibition of translation of respective one or more VGAM2075 host target proteins.

It is further appreciated by one skilled in the art that the mode of translational inhibition illustrated by FIG. 1 with specific reference to translational inhibition exerted by VGAM2075 gene, herein designated VGAM GENE, on one or more VGAM2075 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2075 is inhibition of expression of host target genes, as part of a novel viral mechanism of attacking a host. Accordingly, utilities of VGAM2075 include diagnosis, prevention and treatment of viral infection by Variola Virus. Specific functions, and accordingly utilities, of VGAM2075 correlate with, and may be deduced from, the identity of the host target genes which VGAM2075 binds and inhibits, and the function of these host target genes, as elaborated hereinbelow.

Nucleotide sequences of the VGAM2075 precursor RNA, herein designated VGAM PRECURSOR RNA, and of the 'diced' VGAM2075 RNA, herein designated VGAM RNA, and a schematic representation of the secondary folding of VGAM2075 folded precursor RNA, herein designated VGAM FOLDED PRECURSOR RNA, of VGAM2075 are further described hereinbelow with reference to Table 1.

Nucleotide sequences of host target binding sites, such as BINDING SITE-I, BINDING SITE-II and BINDING SITE-III of FIG. 1, found on VGAM2075 host target RNA, and schematic representation of the complementarity of each of these host target binding sites to VGAM2075 RNA, herein designated VGAM RNA, are described hereinbelow with reference to Table 2.

As mentioned hereinabove with reference to FIG. 1, a function of VGAM2075 gene, herein designated VGAM is inhibition of expression of VGAM2075 target genes. It is appreciated that specific functions, and accordingly utilities, of VGAM2075 correlate with, and may be deduced from, the identity of the target genes which VGAM2075 binds and inhibits, and the function of these target genes, as elaborated hereinbelow.

Estrogen-related Receptor Gamma (ESRRG, Accession XM_039053) is a VGAM2075 host target gene. ESRRG BINDING SITE is HOST TARGET binding site found in the 3' untranslated region of mRNA encoded by ESRRG, corresponding to a HOST TARGET binding site such as BINDING SITE I, BINDING SITE II or BINDING SITE III. Table 2 illustrates the complementarity of the nucleotide sequences of ESRRG BINDING SITE, designated SEQ ID:32999, to the nucleotide sequence of VGAM2075 RNA, herein designated VGAM RNA, also designated SEQ ID:4786.

A function of VGAM2075 is therefore inhibition of Estrogen-related Receptor Gamma (ESRRG, Accession XM_039053), a gene which Estrogen-related receptor gamma. Accordingly, utilities of VGAM2075 include diagnosis, prevention and treatment of diseases and clinical conditions associated with ESRRG. The function of ESRRG and its association with various diseases and clinical conditions, has been established by previous studies, as described hereinabove with reference to VGAM359. Integrin, Alpha L (antigen CD11A (p180), Lymphocyte Function-associated Antigen 1; Alpha Polypeptide) (ITGAL, Accession NM_002209) is another VGAM2075 host target gene. ITGAL BINDING SITE is HOST TARGET binding site found in the 3' untranslated region of mRNA encoded by ITGAL, corresponding to a HOST TARGET binding site such as BINDING SITE I, BINDING SITE II or BINDING SITE III. Table 2 illustrates the complementarity of the nucleotide sequences of ITGAL BINDING SITE, designated SEQ ID:7972, to the nucleotide sequence of VGAM2075 RNA, herein designated VGAM RNA, also designated SEQ ID:4786.

Another function of VGAM2075 is therefore inhibition of Integrin, Alpha L (antigen CD11A (p180), Lymphocyte Function-associated Antigen 1; Alpha Polypeptide) (ITGAL, Accession NM_002209), a gene which s a receptor for icam1, icam2, icam3 and icam4. it is involved in a variety of immune phenomena including leukocyte-endothelial cell interaction, cytotoxic t-cell mediated killing, and antibody dependent killing by granulocytes and monocytes. Accordingly, utilities of VGAM2075 include diagnosis, prevention and treatment of diseases and clinical conditions associated with ITGAL. The function of ITGAL and its association with various diseases and clinical conditions, has been established by previous studies, as described hereinabove with reference to VGAM200. Nuclear Fragile X Mental Retardation Protein Interacting Protein 1 (NUFIP1, Accession NM_012345) is another VGAM2075 host target gene. NUFIP1 BINDING SITE is HOST TARGET binding site found in the 3' untranslated region of mRNA encoded by NUFIP1, corresponding to a HOST TARGET binding site such as BINDING SITE I, BINDING SITE II or BINDING SITE III. Table 2 illustrates the complementarity of the nucleotide sequences of NUFIP1 BINDING SITE, designated SEQ ID:14737, to the nucleotide sequence of VGAM2075 RNA, herein designated VGAM RNA, also designated SEQ ID:4786.

Another function of VGAM2075 is therefore inhibition of Nuclear Fragile X Mental Retardation Protein Interacting Protein 1 (NUFIP1, Accession NM_012345), a gene which binds and colocalizes with nuclear fragile X mental retardation protein. Accordingly, utilities of VGAM2075 include diagnosis, prevention and treatment of diseases and clinical conditions associated with NUFIP1. The function of NUFIP1 and its association with various diseases and clinical conditions, has been established by previous studies, as described hereinabove with reference to VGAM733. POU Domain, Class 2, Associating Factor 1 (POU2AF1, Accession NM_006235) is another VGAM2075 host target gene. POU2AF1 BINDING SITE is HOST TARGET binding site found in the 3' untranslated region of mRNA encoded by POU2AF1, corresponding to a HOST TARGET binding site such as BINDING SITE I, BINDING SITE II or BINDING SITE III. Table 2 illustrates the complementarity of the nucleotide sequences of POU2AF1 BINDING SITE, designated SEQ ID:12892, to the nucleotide sequence of VGAM2075 RNA, herein designated VGAM RNA, also designated SEQ ID:4786.

Another function of VGAM2075 is therefore inhibition of POU Domain, Class 2, Associating Factor 1 (POU2AF1, Accession NM_006235), a gene which is a transcriptional coactivator that specifically associates with either oct1 or oct2. Accordingly, utilities of VGAM2075 include diagnosis, prevention and treatment of diseases and clinical conditions associated with POU2AF1. The function of POU2AF1 and its association with various diseases and clinical conditions, has been established by previous studies, as described hereinabove with reference to VGAM171. Recombination Activating Gene 2 (RAG2, Accession XM_089839) is another VGAM2075 host target gene. RAG2 BINDING SITE is HOST TARGET binding site found in the 5' untranslated region of mRNA encoded by RAG2, corresponding to a HOST TARGET binding site such as BINDING SITE I, BINDING SITE II or BINDING SITE III. Table 2 illustrates the complementarity of the nucleotide sequences of RAG2 BINDING SITE, designated SEQ ID:39985, to the nucleotide sequence of VGAM2075 RNA, herein designated VGAM RNA, also designated SEQ ID:4786.

Another function of VGAM2075 is therefore inhibition of Recombination Activating Gene 2 (RAG2, Accession XM_089839). Accordingly, utilities of VGAM2075 include diagnosis, prevention and treatment of diseases and clinical conditions associated with RAG2. Tensin (TNS, Accession NM_022648) is another VGAM2075 host target gene. TNS BINDING SITE is HOST TARGET binding site found in the 3' untranslated region of mRNA encoded by TNS, corresponding to a HOST TARGET binding site such as BINDING SITE I, BINDING SITE II or BINDING SITE III. Table 2 illustrates the complementarity of the nucleotide sequences of TNS BINDING SITE, designated SEQ ID:22903, to the nucleotide sequence of VGAM2075 RNA, herein designated VGAM RNA, also designated SEQ ID:4786.

Another function of VGAM2075 is therefore inhibition of Tensin (TNS, Accession NM_022648). Accordingly, utilities of VGAM2075 include diagnosis, prevention and treatment of diseases and clinical conditions associated with TNS. DKFZP434I092 (Accession XM_042042) is another VGAM2075 host target gene. DKFZP434I092 BINDING SITE is HOST TARGET binding site found in the 3' untranslated region of mRNA encoded by DKFZP434I092, corresponding to a HOST TARGET binding site such as BINDING SITE I, BINDING SITE II or BINDING SITE III. Table 2 illustrates the complementarity of the nucleotide sequences of DKFZP434I092 BINDING SITE, designated SEQ ID:33673, to the nucleotide sequence of VGAM2075 RNA, herein designated VGAM RNA, also designated SEQ ID:4786.

Another function of VGAM2075 is therefore inhibition of DKFZP434I092 (Accession XM_042042). Accordingly, utilities of VGAM2075 include diagnosis, prevention and treatment of diseases and clinical conditions associated with DKFZP434I092. FLJ10656 (Accession NM_018170) is another VGAM2075 host target gene. FLJ10656 BINDING SITE is HOST TARGET binding site found in the 3' untranslated region of mRNA encoded by FLJ10656, corresponding to a HOST TARGET binding site such as BINDING SITE I, BINDING SITE II or BINDING SITE III. Table 2 illustrates the complementarity of the nucleotide sequences of FLJ10656 BINDING SITE, designated SEQ ID:19988, to the nucleotide sequence of VGAM2075 RNA, herein designated VGAM RNA, also designated SEQ ID:4786.

Another function of VGAM2075 is therefore inhibition of FLJ10656 (Accession NM_018170). Accordingly, utilities of VGAM2075 include diagnosis, prevention and treatment of diseases and clinical conditions associated with FLJ10656. GABA(A) Receptor-associated Protein Like 1 (GABARAPL1, Accession NM_031412) is another VGAM2075 host target gene. GABARAPL1 BINDING SITE is HOST TARGET binding site found in the 3' untranslated region of mRNA encoded by GABARAPL1, corresponding to a HOST TARGET binding site such as BINDING SITE I, BINDING SITE II or BINDING SITE III. Table 2 illustrates the complementarity of the nucleotide sequences of GABARAPL1 BINDING SITE, designated SEQ ID:25392, to the nucleotide sequence of VGAM2075 RNA, herein designated VGAM RNA, also designated SEQ ID:4786.

Another function of VGAM2075 is therefore inhibition of GABA(A) Receptor-associated Protein Like 1 (GABARAPL1, Accession NM_031412). Accordingly, utilities of VGAM2075 include diagnosis, prevention and treatment of diseases and clinical conditions associated with GABARAPL1. GABA(A) Receptors Associated Protein Like 3 (GABARAPL3, Accession NM_032568) is another VGAM2075 host target gene. GABARAPL3 BINDING SITE is HOST TARGET binding site found in the 3' untranslated region of mRNA encoded by GABARAPL3, corresponding to a HOST TARGET binding site such as BINDING SITE I, BINDING SITE II or BINDING SITE III. Table 2 illustrates the complementarity of the nucleotide sequences of GABARAPL3 BINDING SITE, designated SEQ ID:26300, to the nucleotide sequence of VGAM2075 RNA, herein designated VGAM RNA, also designated SEQ ID:4786.

Another function of VGAM2075 is therefore inhibition of GABA(A) Receptors Associated Protein Like 3 (GABARAPL3, Accession NM_032568). Accordingly, utilities of VGAM2075 include diagnosis, prevention and treatment of diseases and clinical conditions associated with GABARAPL3. HT002 (Accession NM_014066) is another VGAM2075 host target gene. HT002 BINDING SITE is HOST TARGET binding site found in the 3' untranslated region of mRNA encoded by HT002, corresponding to a HOST TARGET binding site such as BINDING SITE I, BINDING SITE II or BINDING SITE III. Table 2 illustrates the complementarity of the nucleotide sequences of HT002 BINDING SITE, designated SEQ ID:15281, to the nucleotide sequence of VGAM2075 RNA, herein designated VGAM RNA, also designated SEQ ID:4786.

Another function of VGAM2075 is therefore inhibition of HT002 (Accession NM_014066). Accordingly, utilities of VGAM2075 include diagnosis, prevention and treatment of diseases and clinical conditions associated with HT002. KIAA0475 (Accession NM_014864) is another VGAM2075 host target gene. KIAA0475 BINDING SITE is HOST TARGET binding site found in the 3' untranslated region of mRNA encoded by KIAA0475, corresponding to a HOST TARGET binding site such as BINDING SITE I, BINDING SITE II or BINDING SITE III. Table 2 illustrates the complementarity of the nucleotide sequences of KIAA0475 BINDING SITE, designated SEQ ID:16949, to the nucleotide sequence of VGAM2075 RNA, herein designated VGAM RNA, also designated SEQ ID:4786.

Another function of VGAM2075 is therefore inhibition of KIAA0475 (Accession NM_014864). Accordingly, utilities of VGAM2075 include diagnosis, prevention and treatment of diseases and clinical conditions associated with KIAA0475. KIAA0712 (Accession NM_014715) is another VGAM2075 host target gene. KIAA0712 BINDING SITE is HOST TARGET binding site found in the 5' untranslated region of mRNA encoded by KIAA0712, corresponding to a HOST TARGET binding site such as BINDING SITE I, BINDING SITE II or BINDING SITE III. Table 2 illustrates the complementarity of the nucleotide sequences of KIAA0712 BINDING SITE, designated SEQ ID:16262, to the nucleotide sequence of VGAM2075 RNA, herein designated VGAM RNA, also designated SEQ ID:4786.

Another function of VGAM2075 is therefore inhibition of KIAA0712 (Accession NM_014715). Accordingly, utilities of VGAM2075 include diagnosis, prevention and treatment of diseases and clinical conditions associated with KIAA0712. KIAA1301 (Accession XM_038999) is another VGAM2075 host target gene. KIAA1301 BINDING SITE is HOST TARGET binding site found in the 3' untranslated region of mRNA encoded by KIAA1301, corresponding to a HOST TARGET binding site such as BINDING SITE I, BINDING SITE II or BINDING SITE III. Table 2 illustrates the complementarity of the nucleotide sequences of KIAA1301 BINDING SITE, designated SEQ ID:32978, to the nucleotide sequence of VGAM2075 RNA, herein designated VGAM RNA, also designated SEQ ID:4786.

Another function of VGAM2075 is therefore inhibition of KIAA1301 (Accession XM_038999). Accordingly, utilities of VGAM2075 include diagnosis, prevention and treatment of diseases and clinical conditions associated with KIAA1301. Seizure Related 6 Homolog (mouse) (SEZ6, Accession XM_058869) is another VGAM2075 host target gene. SEZ6 BINDING SITE is HOST TARGET binding site found in the 3' untranslated region of mRNA encoded by SEZ6, corresponding to a HOST TARGET binding site such as BINDING SITE I, BINDING SITE II or BINDING SITE III. Table 2 illustrates the complementarity of the nucleotide sequences of SEZ6 BINDING SITE, designated SEQ ID:36774, to the nucleotide sequence of VGAM2075 RNA, herein designated VGAM RNA, also designated SEQ ID:4786.

Another function of VGAM2075 is therefore inhibition of Seizure Related 6 Homolog (mouse) (SEZ6, Accession XM_058869). Accordingly, utilities of VGAM2075 include diagnosis, prevention and treatment of diseases and clinical conditions associated with SEZ6. VMP1 (Accession NM_030938) is another VGAM2075 host target gene. VMP1 BINDING SITE is HOST TARGET binding site found in the 3' untranslated region of mRNA encoded by VMP1, corresponding to a HOST TARGET binding site such as BINDING SITE I, BINDING SITE II or BINDING SITE III. Table 2 illustrates the complementarity of the nucleotide sequences of VMP1 BINDING SITE, designated SEQ ID:25204, to the nucleotide sequence of VGAM2075 RNA, herein designated VGAM RNA, also designated SEQ ID:4786.

Another function of VGAM2075 is therefore inhibition of VMP1 (Accession NM_030938). Accordingly, utilities of VGAM2075 include diagnosis, prevention and treatment of diseases and clinical conditions associated with VMP1. LOC115110 (Accession XM_049825) is another VGAM2075 host target gene. LOC115110 BINDING SITE is HOST TARGET binding site found in the 3' untranslated region of mRNA encoded by LOC115110, corresponding to a HOST TARGET binding site such as BINDING SITE I, BINDING SITE II or BINDING SITE III. Table 2 illustrates the complementarity of the nucleotide sequences of LOC115110 BINDING SITE, designated SEQ ID:35503, to the nucleotide sequence of VGAM2075 RNA, herein designated VGAM RNA, also designated SEQ ID:4786.

Another function of VGAM2075 is therefore inhibition of LOC115110 (Accession XM_049825). Accordingly, utilities of VGAM2075 include diagnosis, prevention and treatment of diseases and clinical conditions associated with LOC115110. LOC132235 (Accession XM_072302) is another VGAM2075 host target gene. LOC132235 BINDING SITE is HOST TARGET binding site found in the 5' untranslated region of mRNA encoded by LOC132235, corresponding to a HOST TARGET binding site such as BINDING SITE I, BINDING SITE II or BINDING SITE III. Table 2 illustrates the complementarity of the nucleotide sequences of LOC132235 BINDING SITE, designated SEQ ID:37483, to the nucleotide sequence of VGAM2075 RNA, herein designated VGAM RNA, also designated SEQ ID:4786.

Another function of VGAM2075 is therefore inhibition of LOC132235 (Accession XM_072302). Accordingly, utilities of VGAM2075 include diagnosis, prevention and treatment of diseases and clinical conditions associated with LOC132235. LOC142941 (Accession XM_096363) is another VGAM2075 host target gene. LOC142941 BINDING SITE is HOST TARGET binding site found in the 3' untranslated region of mRNA encoded by LOC142941, corresponding to a HOST TARGET binding site such as BINDING SITE I, BINDING SITE II or BINDING SITE III. Table 2 illustrates the complementarity of the nucleotide sequences of LOC142941 BINDING SITE, designated SEQ ID:40322, to the nucleotide sequence of VGAM2075 RNA, herein designated VGAM RNA, also designated SEQ ID:4786.

Another function of VGAM2075 is therefore inhibition of LOC142941 (Accession XM_096363). Accordingly, utilities of VGAM2075 include diagnosis, prevention and treatment of diseases and clinical conditions associated with LOC142941. LOC158549 (Accession XM_098963) is another VGAM2075 host target gene. LOC158549 BINDING SITE is HOST TARGET binding site found in the 5' untranslated region of mRNA encoded by LOC158549, corresponding to a HOST TARGET binding site such as BINDING SITE I, BINDING SITE II or BINDING SITE III. Table 2 illustrates the complementarity of the nucleotide sequences of LOC158549 BINDING SITE, designated SEQ ID:42007, to the nucleotide sequence of VGAM2075 RNA, herein designated VGAM RNA, also designated SEQ ID:4786.

Another function of VGAM2075 is therefore inhibition of LOC158549 (Accession XM_098963). Accordingly, utilities of VGAM2075 include diagnosis, prevention and treatment of diseases and clinical conditions associated with LOC158549. LOC221882 (Accession XM_166507) is another VGAM2075 host target gene. LOC221882 BINDING SITE is HOST TARGET binding site found in the 5' untranslated region of mRNA encoded by LOC221882, corresponding to a HOST TARGET binding site such as BINDING SITE I, BINDING SITE II or BINDING SITE III. Table 2 illustrates the complementarity of the nucleotide sequences of LOC221882 BINDING SITE, designated SEQ ID:44434, to the nucleotide sequence of VGAM2075 RNA, herein designated VGAM RNA, also designated SEQ ID:4786.

Another function of VGAM2075 is therefore inhibition of LOC221882 (Accession XM_166507). Accordingly, utilities of VGAM2075 include diagnosis, prevention and treatment of diseases and clinical conditions associated with LOC221882. FIG. 1 further provides a conceptual description of a novel bioinformatically detected viral gene of the present invention, referred to here as Viral Genomic Address Messenger 2076 (VGAM2076) viral gene, which modulates expression of respective host target genes thereof, the function and utility of which host target genes is known in the art.

VGAM2076 is a novel bioinformatically detected regulatory, non protein coding, viral micro RNA (miRNA) gene. The method by which VGAM2076 was detected is described hereinabove with reference to FIGS. 1-8.

VGAM2076 gene, herein designated VGAM GENE, is a viral gene contained in the genome of Variola Virus. VGAM2076 host target gene, herein designated VGAM HOST TARGET GENE, is a human gene contained in the human genome.

VGAM2076 gene encodes a VGAM2076 precursor RNA, herein designated VGAM PRECURSOR RNA. Similar to other miRNA genes, and unlike most ordinary genes, VGAM2076 precursor RNA does not encode a protein. A nucleotide sequence identical or highly similar to the nucleotide sequence of VGAM2076 precursor RNA is designated SEQ ID:2062, and is provided hereinbelow with reference to the sequence listing part. Nucleotide sequence SEQ ID:2062 is located at position 175023 relative to the genome of Variola Virus.

VGAM2076 precursor RNA folds onto itself, forming VGAM2076 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2076 folded precursor RNA into VGAM2076 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2076 RNA is designated SEQ ID:4787, and is provided hereinbelow with reference to the sequence listing part.

VGAM2076 host target gene, herein designated VGAM HOST TARGET GENE, encodes a corresponding messenger RNA, VGAM2076 host target RNA, herein designated VGAM HOST TARGET RNA. VGAM2076 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2076 RNA, herein designated VGAM RNA, binds complementarily to one or more host target binding sites located in untranslated regions of VGAM2076 host target RNA, herein designated VGAM HOST TARGET RNA. This complementary binding is due to the fact that the nucleotide sequence of VGAM2076 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2076 RNA, herein designated VGAM RNA, may have a different number of host target binding sites in untranslated regions of a VGAM2076 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2076 RNA, herein designated VGAM RNA, to host target binding sites on VGAM2076 host target RNA, herein designated VGAM HOST TARGET RNA, such as BINDING SITE I, BINDING SITE II and BINDING SITE III, inhibits translation of VGAM2076 host target RNA into VGAM2076 host target protein, herein designated VGAM HOST TARGET PROTEIN. VGAM host target protein is therefore outlined by a broken line.

It is appreciated that VGAM2076 host target gene, herein designated VGAM HOST TARGET GENE, in fact represents a plurality of VGAM2076 host target genes. The mRNA of each one of this plurality of VGAM2076 host target genes comprises one or more host target binding sites, each having a nucleotide sequence which is at least partly complementary to VGAM2076 RNA, herein designated VGAM RNA, and which when bound by VGAM2076 RNA causes inhibition of translation of respective one or more VGAM2076 host target proteins.

It is further appreciated by one skilled in the art that the mode of translational inhibition illustrated by FIG. 1 with specific reference to translational inhibition exerted by VGAM2076 gene, herein designated VGAM GENE, on one or more VGAM2076 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2076 is inhibition of expression of host target genes, as part of a novel viral mechanism of attacking a host. Accordingly, utilities of VGAM2076 include diagnosis, prevention and treatment of viral infection by Variola Virus. Specific functions, and accordingly utilities, of VGAM2076 correlate with, and may be deduced from, the identity of the host target genes which VGAM2076 binds and inhibits, and the function of these host target genes, as elaborated hereinbelow.

Nucleotide sequences of the VGAM2076 precursor RNA, herein designated VGAM PRECURSOR RNA, and of the 'diced' VGAM2076 RNA, herein designated VGAM RNA, and a schematic representation of the secondary folding of VGAM2076 folded precursor RNA, herein designated VGAM FOLDED PRECURSOR RNA, of VGAM2076 are further described hereinbelow with reference to Table 1.

Nucleotide sequences of host target binding sites, such as BINDING SITE-I, BINDING SITE-II and BINDING SITE-III of FIG. 1, found on VGAM2076 host target RNA, and schematic representation of the complementarity of each of these host target binding sites to VGAM2076 RNA, herein designated VGAM RNA, are described hereinbelow with reference to Table 2.

As mentioned hereinabove with reference to FIG. 1, a function of VGAM2076 gene, herein designated VGAM is inhibition of expression of VGAM2076 target genes. It is appreciated that specific functions, and accordingly utilities, of VGAM2076 correlate with, and may be deduced from, the identity of the target genes which VGAM2076 binds and inhibits, and the function of these target genes, as elaborated hereinbelow.

DKFZP434F2021 (Accession XM_039951) is a VGAM2076 host target gene. DKFZP434F2021 BINDING SITE is HOST TARGET binding site found in the 3' untranslated region of mRNA encoded by DKFZP434F2021, corresponding to a HOST TARGET binding site such as BINDING SITE I, BINDING SITE II or BINDING SITE III. Table 2 illustrates the complementarity of the nucleotide sequences of DKFZP434F2021 BINDING SITE, designated SEQ ID:33235, to the nucleotide sequence of VGAM2076 RNA, herein designated VGAM RNA, also designated SEQ ID:4787.

A function of VGAM2076 is therefore inhibition of DKFZP434F2021 (Accession XM_039951). Accordingly, utilities of VGAM2076 include diagnosis, prevention and treatment of diseases and clinical conditions associated with DKFZP434F2021. PRO2435 (Accession NM_018527) is another VGAM2076 host target gene. PRO2435 BINDING SITE is HOST TARGET binding site found in the 5' untranslated region of mRNA encoded by PRO2435, corresponding to a HOST TARGET binding site such as BINDING SITE I, BINDING SITE II or BINDING SITE III. Table 2 illustrates the complementarity of the nucleotide sequences of PRO2435 BINDING SITE, designated SEQ ID:20601, to the nucleotide sequence of VGAM2076 RNA, herein designated VGAM RNA, also designated SEQ ID:4787.

Another function of VGAM2076 is therefore inhibition of PRO2435 (Accession NM_018527). Accordingly, utilities of VGAM2076 include diagnosis, prevention and treatment of diseases and clinical conditions associated with PRO2435. LOC220980 (Accession XM_167629) is another VGAM2076 host target gene. LOC220980 BINDING SITE is HOST TARGET binding site found in the 5' untranslated region of mRNA encoded by LOC220980, corresponding to a HOST TARGET binding site such as BINDING SITE I, BINDING SITE II or BINDING SITE III. Table 2 illustrates the complementarity of the nucleotide sequences of LOC220980 BINDING SITE, designated SEQ ID:44740, to the nucleotide sequence of VGAM2076 RNA, herein designated VGAM RNA, also designated SEQ ID:4787.

Another function of VGAM2076 is therefore inhibition of LOC220980 (Accession XM_167629). Accordingly, utilities of VGAM2076 include diagnosis, prevention and treatment of diseases and clinical conditions associated with LOC220980. FIG. 1 further provides a conceptual description of a novel bioinformatically detected viral gene of the present invention, referred to here as Viral Genomic Address Messenger 2077 (VGAM2077) viral gene, which modulates expression of respective host target genes thereof, the function and utility of which host target genes is known in the art.

VGAM2077 is a novel bioinformatically detected regulatory, non protein coding, viral micro RNA (miRNA) gene. The method by which VGAM2077 was detected is described hereinabove with reference to FIGS. 1-8.

VGAM2077 gene, herein designated VGAM GENE, is a viral gene contained in the genome of Variola Virus. VGAM2077 host target gene, herein designated VGAM HOST TARGET GENE, is a human gene contained in the human genome.

VGAM2077 gene encodes a VGAM2077 precursor RNA, herein designated VGAM PRECURSOR RNA. Similar to other miRNA genes, and unlike most ordinary genes, VGAM2077 precursor RNA does not encode a protein. A nucleotide sequence identical or highly similar to the nucleotide sequence of VGAM2077 precursor RNA is designated SEQ ID:2063, and is provided hereinbelow with reference to the sequence listing part. Nucleotide sequence SEQ ID:2063 is located at position 178760 relative to the genome of Variola Virus.

VGAM2077 precursor RNA folds onto itself, forming VGAM2077 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2077 folded precursor RNA into VGAM2077 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2077 RNA is designated SEQ ID:4788, and is provided hereinbelow with reference to the sequence listing part.

VGAM2077 host target gene, herein designated VGAM HOST TARGET GENE, encodes a corresponding messenger RNA, VGAM2077 host target RNA, herein designated VGAM HOST TARGET RNA. VGAM2077 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2077 RNA, herein designated VGAM RNA, binds complementarily to one or more host target binding sites located in untranslated regions of VGAM2077 host target RNA, herein designated VGAM HOST TARGET RNA. This complementary binding is due to the fact that the nucleotide sequence of VGAM2077 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2077 RNA, herein designated VGAM RNA, may have a different number of host target binding sites in untranslated regions of a VGAM2077 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2077 RNA, herein designated VGAM RNA, to host target binding sites on VGAM2077 host target RNA, herein designated VGAM HOST TARGET RNA, such as BINDING SITE I, BINDING SITE II and BINDING SITE III, inhibits translation of VGAM2077 host target RNA into VGAM2077 host target protein, herein designated VGAM HOST TARGET PROTEIN. VGAM host target protein is therefore outlined by a broken line.

It is appreciated that VGAM2077 host target gene, herein designated VGAM HOST TARGET GENE, in fact represents a plurality of VGAM2077 host target genes. The mRNA of each one of this plurality of VGAM2077 host target genes comprises one or more host target binding sites, each having a nucleotide sequence which is at least partly complementary to VGAM2077 RNA, herein designated VGAM RNA, and which when bound by VGAM2077 RNA causes inhibition of translation of respective one or more VGAM2077 host target proteins.

It is further appreciated by one skilled in the art that the mode of translational inhibition illustrated by FIG. 1 with specific reference to translational inhibition exerted by VGAM2077 gene, herein designated VGAM GENE, on one or more VGAM2077 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2077 is inhibition of expression of host target genes, as part of a novel viral mechanism of attacking a host. Accordingly, utilities of VGAM2077 include diagnosis, prevention and treatment of viral infection by Variola Virus. Specific functions, and accordingly utilities, of VGAM2077 correlate with, and may be deduced from, the identity of the host target genes which VGAM2077 binds and inhibits, and the function of these host target genes, as elaborated hereinbelow.

Nucleotide sequences of the VGAM2077 precursor RNA, herein designated VGAM PRECURSOR RNA, and of the 'diced' VGAM2077 RNA, herein designated VGAM RNA, and a schematic representation of the secondary folding of VGAM2077 folded precursor RNA, herein designated VGAM FOLDED PRECURSOR RNA, of VGAM2077 are further described hereinbelow with reference to Table 1.

Nucleotide sequences of host target binding sites, such as BINDING SITE-I, BINDING SITE-II and BINDING SITE-III of FIG. 1, found on VGAM2077 host target RNA, and schematic representation of the complementarity of each of these host target binding sites to VGAM2077 RNA, herein designated VGAM RNA, are described hereinbelow with reference to Table 2.

As mentioned hereinabove with reference to FIG. 1, a function of VGAM2077 gene, herein designated VGAM is inhibition of expression of VGAM2077 target genes. It is appreciated that specific functions, and accordingly utilities, of VGAM2077 correlate with, and may be deduced from, the identity of the target genes which VGAM2077 binds and inhibits, and the function of these target genes, as elaborated hereinbelow.

KIAA1582 (Accession XM_037262) is a VGAM2077 host target gene. KIAA1582 BINDING SITE is HOST TARGET binding site found in the 5' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32583, to the nucleotide sequence of VGAM2077 RNA, herein designated VGAM RNA, also designated SEQ ID:4788.

A function of VGAM2077 is therefore inhibition of KIAA1582 (Accession XM_037262). Accordingly, utilities of VGAM2077 include diagnosis, prevention and treatment of diseases and clinical conditions associated with KIAA1582. LOC148709 (Accession XM_086281) is another VGAM2077 host target gene. LOC148709 BINDING SITE is HOST TARGET binding site found in the 3' untranslated region of mRNA encoded by LOC148709, corresponding to a HOST TARGET binding site such as BINDING SITE I, BINDING SITE II or BINDING SITE III. Table 2 illustrates the complementarity of the nucleotide sequences of LOC148709 BINDING SITE, designated SEQ ID:38584, to the nucleotide sequence of VGAM2077 RNA, herein designated VGAM RNA, also designated SEQ ID:4788.

Another function of VGAM2077 is therefore inhibition of LOC148709 (Accession XM_086281). Accordingly, utilities of VGAM2077 include diagnosis, prevention and treatment of diseases and clinical conditions associated with LOC148709. LOC57795 (Accession XM_045110) is another VGAM2077 host target gene. LOC57795 BINDING SITE is HOST TARGET binding site found in the 3' untranslated region of mRNA encoded by LOC57795, corresponding to a HOST TARGET binding site such as BINDING SITE I, BINDING SITE II or BINDING SITE III. Table 2 illustrates the complementarity of the nucleotide sequences of LOC57795 BINDING SITE, designated SEQ ID:34359, to the nucleotide sequence of VGAM2077 RNA, herein designated VGAM RNA, also designated SEQ ID:4788.

Another function of VGAM2077 is therefore inhibition of LOC57795 (Accession XM_045110). Accordingly, utilities of VGAM2077 include diagnosis, prevention and treatment of diseases and clinical conditions associated with LOC57795. FIG. 1 further provides a conceptual description of a novel bioinformatically detected viral gene of the present invention, referred to here as Viral Genomic Address Messenger 2078 (VGAM2078) viral gene, which modulates expression of respective host target genes thereof, the function and utility of which host target genes is known in the art.

VGAM2078 is a novel bioinformatically detected regulatory, non protein coding, viral micro RNA (miRNA) gene. The method by which VGAM2078 was detected is described hereinabove with reference to FIGS. 1-8.

VGAM2078 gene, herein designated VGAM GENE, is a viral gene contained in the genome of Variola Virus. VGAM2078 host target gene, herein designated VGAM HOST TARGET GENE, is a human gene contained in the human genome.

VGAM2078 gene encodes a VGAM2078 precursor RNA, herein designated VGAM PRECURSOR RNA. Similar to other miRNA genes, and unlike most ordinary genes, VGAM2078 precursor RNA does not encode a protein. A nucleotide sequence identical or highly similar to the nucleotide sequence of VGAM2078 precursor RNA is designated SEQ ID:2064, and is provided hereinbelow with reference to the sequence listing part. Nucleotide sequence SEQ ID:2064 is located at position 168720 relative to the genome of Variola Virus.

VGAM2078 precursor RNA folds onto itself, forming VGAM2078 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2078 folded precursor RNA into VGAM2078 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM2078 RNA is designated SEQ ID:4789, and is provided hereinbelow with reference to the sequence listing part.

VGAM2078 host target gene, herein designated VGAM HOST TARGET GENE, encodes a corresponding messenger RNA, VGAM2078 host target RNA, herein designated VGAM HOST TARGET RNA. VGAM2078 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2078 RNA, herein designated VGAM RNA, binds complementarily to one or more host target binding sites located in untranslated regions of VGAM2078 host target RNA, herein designated VGAM HOST TARGET RNA. This complementary binding is due to the fact that the nucleotide sequence of VGAM2078 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2078 RNA, herein designated VGAM RNA, may have a different number of host target binding sites in untranslated regions of a VGAM2078 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2078 RNA, herein designated VGAM RNA, to host target binding sites on VGAM2078 host target RNA, herein designated VGAM HOST TARGET RNA, such as BINDING SITE I, BINDING SITE II and BINDING SITE III, inhibits translation of VGAM2078 host target RNA into VGAM2078 host target protein, herein designated VGAM HOST TARGET PROTEIN. VGAM host target protein is therefore outlined by a broken line.

It is appreciated that VGAM2078 host target gene, herein designated VGAM HOST TARGET GENE, in fact represents a plurality of VGAM2078 host target genes. The mRNA of each one of this plurality of VGAM2078 host target genes comprises one or more host target binding sites, each having a nucleotide sequence which is at least partly complementary to VGAM2078 RNA, herein designated VGAM RNA, and which when bound by VGAM2078 RNA causes inhibition of translation of respective one or more VGAM2078 host target proteins.

It is further appreciated by one skilled in the art that the mode of translational inhibition illustrated by FIG. 1 with specific reference to translational inhibition exerted by VGAM2078 gene, herein designated VGAM GENE, on one or more VGAM2078 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2078 is inhibition of expression of host target genes, as part of a novel viral mechanism of attacking a host. Accordingly, utilities of VGAM2078 include diagnosis, prevention and treatment of viral infection by Variola Virus. Specific functions, and accordingly utilities, of VGAM2078 correlate with, and may be deduced from, the identity of the host target genes which VGAM2078 binds and inhibits, and the function of these host target genes, as elaborated hereinbelow.

Nucleotide sequences of the VGAM2078 precursor RNA, herein designated VGAM PRECURSOR RNA, and of the 'diced' VGAM2078 RNA, herein designated VGAM RNA, and a schematic representation of the secondary folding of VGAM2078 folded precursor RNA, herein designated VGAM FOLDED PRECURSOR RNA, of VGAM2078 are further described hereinbelow with reference to Table 1.

Nucleotide sequences of host target binding sites, such as BINDING SITE-I, BINDING SITE-II and BINDING SITE-III of FIG. 1, found on VGAM2078 host target RNA, and schematic representation of the complementarity of each of these host target binding sites to VGAM2078 RNA, herein designated VGAM RNA, are described hereinbelow with reference to Table 2.

As mentioned hereinabove with reference to FIG. 1, a function of VGAM2078 gene, herein designated VGAM is inhibition of expression of VGAM2078 target genes. It is appreciated that specific functions, and accordingly utilities, of VGAM2078 correlate with, and may be deduced from, the identity of the target genes which VGAM2078 binds and inhibits, and the function of these target genes, as elaborated hereinbelow.

Capping Protein (actin filament) Muscle Z-line, Alpha 1 (CAPZA1, Accession XM_052116) is a VGAM2078 host target gene. CAPZA1 BINDING SITE is HOST TARGET binding site found in the 3' untranslated region of mRNA encoded by CAPZA1, corresponding to a HOST TARGET binding site such as BINDING SITE I, BINDING SITE II or BINDING SITE III. Table 2 illustrates the complementarity of the nucleotide sequences of CAPZA1 BINDING SITE, designated SEQ ID:35947, to the nucleotide sequence of VGAM2078 RNA, herein designated VGAM RNA, also designated SEQ ID:4789.

A function of VGAM2078 is therefore inhibition of Capping Protein (actin filament) Muscle Z-line, Alpha 1 (CAPZA1, Accession XM_052116), a gene which is alpha 1 subunit of actin filament capping protein; binds actin, has roles in cell motility and actin assembly. Accordingly, utilities of VGAM2078 include diagnosis, prevention and treatment of diseases and clinical conditions associated with CAPZA1. The function of CAPZA1 and its association with various diseases and clinical conditions, has been established by previous studies, as described hereinabove with reference to VGAM547. DKFZP586M1120 (Accession NM_031294) is another VGAM2078 host target gene. DKFZP586M1120 BINDING SITE is HOST TARGET binding site found in the 5' untranslated region of mRNA encoded by DKFZP586M1120, corresponding to a HOST TARGET binding site such as BINDING SITE I, BINDING SITE II or BINDING SITE III. Table 2 illustrates the complementarity of the nucleotide sequences of DKFZP586M1120 BINDING SITE, designated SEQ ID:25325, to the nucleotide sequence of VGAM2078 RNA, herein designated VGAM RNA, also designated SEQ ID:4789.

Another function of VGAM2078 is therefore inhibition of DKFZP586M1120 (Accession NM_031294). Accordingly, utilities of VGAM2078 include diagnosis, prevention and treatment of diseases and clinical conditions associated with DKFZP586M1120. KIAA0555 (Accession XM_011347) is another VGAM2078 host target gene. KIAA0555 BINDING SITE is HOST TARGET binding site found in the 3' untranslated region of mRNA encoded by KIAA0555, corresponding to a HOST TARGET binding site such as BINDING SITE I, BINDING SITE II or BINDING SITE III. Table 2 illustrates the complementarity of the nucleotide sequences of KIAA0555 BINDING SITE, designated SEQ ID:30188, to the nucleotide sequence of VGAM2078 RNA, herein designated VGAM RNA, also designated SEQ ID:4789.

Another function of VGAM2078 is therefore inhibition of KIAA0555 (Accession XM_011347). Accordingly, utilities of VGAM2078 include diagnosis, prevention and treatment of diseases and clinical conditions associated with KIAA0555. Pellino Homolog 1 (Drosophila) (PELI1, Accession NM_020651) is another VGAM2078 host target gene. PELI1 BINDING SITE is HOST TARGET binding site found in the 5' untranslated region of mRNA encoded by PELI1, corresponding to a HOST TARGET binding site such as BINDING SITE I, BINDING SITE II or BINDING SITE III. Table 2 illustrates the complementarity of the nucleotide sequences of PELI1 BINDING SITE, designated SEQ ID:21819, to the nucleotide sequence of VGAM2078 RNA, herein designated VGAM RNA, also designated SEQ ID:4789.

Another function of VGAM2078 is therefore inhibition of Pellino Homolog 1 (Drosophila) (PELI1, Accession NM_020651). Accordingly, utilities of VGAM2078 include diagnosis, prevention and treatment of diseases and clinical conditions associated with PELI1. Ras and Rab Interactor 3 (RIN3, Accession NM_024832) is another VGAM2078 host target gene. RIN3 BINDING SITE is HOST TARGET binding site found in the 3' untranslated region of mRNA encoded by RIN3, corresponding to a HOST TARGET binding site such as BINDING SITE I, BINDING SITE II or BINDING SITE III. Table 2 illustrates the complementarity of the nucleotide sequences of RIN3 BINDING SITE, designated SEQ ID:24234, to the nucleotide sequence of VGAM2078 RNA, herein designated VGAM RNA, also designated SEQ ID:4789.

Another function of VGAM2078 is therefore inhibition of Ras and Rab Interactor 3 (RIN3, Accession NM_024832). Accordingly, utilities of VGAM2078 include diagnosis, prevention and treatment of diseases and clinical conditions associated with RIN3. LOC133686 (Accession XM_059667) is another VGAM2078 host target gene. LOC133686 BINDING SITE is HOST TARGET binding site found in the 3' untranslated region of mRNA encoded by LOC133686, corresponding to a HOST TARGET binding site such as BINDING SITE I, BINDING SITE II or BINDING SITE III. Table 2 illustrates the complementarity of the nucleotide sequences of LOC133686 BINDING SITE, designated SEQ ID:37055, to the nucleotide sequence of VGAM2078 RNA, herein designated VGAM RNA, also designated SEQ ID:4789.

Another function of VGAM2078 is therefore inhibition of LOC133686 (Accession XM_059667). Accordingly, utilities of VGAM2078 include diagnosis, prevention and treatment of diseases and clinical conditions associated with LOC133686. LOC153205 (Accession XM_098322) is another VGAM2078 host target gene. LOC153205 BINDING SITE is HOST TARGET binding site found in the 3' untranslated region of mRNA encoded by LOC153205, corresponding to a HOST TARGET binding site such as BINDING SITE I, BINDING SITE II or BINDING SITE III. Table 2 illustrates the complementarity of the nucleotide sequences of LOC153205 BINDING SITE, designated SEQ ID:41582, to the nucleotide sequence of VGAM2078 RNA, herein designated VGAM RNA, also designated SEQ ID:4789.

Another function of VGAM2078 is therefore inhibition of LOC153205 (Accession XM_098322). Accordingly, utilities of VGAM2078 include diagnosis, prevention and treatment of diseases and clinical conditions associated with LOC153205. LOC221810 (Accession XM_168222) is another VGAM2078 host target gene. LOC221810 BINDING SITE is HOST TARGET binding site found in the 3' untranslated region of mRNA encoded by LOC221810, corresponding to a HOST TARGET binding site such as BINDING SITE I, BINDING SITE II or BINDING SITE III. Table 2 illustrates the complementarity of the nucleotide sequences of LOC221810 BINDING SITE, designated SEQ ID:45084, to the nucleotide sequence of VGAM2078 RNA, herein designated VGAM RNA, also designated SEQ ID:4789.

Another function of VGAM2078 is therefore inhibition of LOC221810 (Accession XM_168222). Accordingly, utilities of VGAM2078 include diagnosis, prevention and treatment of diseases and clinical conditions associated with LOC221810. FIG. 1 further provides a conceptual description of a novel bioinformatically detected viral gene of the present invention, referred to here as Viral Genomic Address Messenger 2079 (VGAM2079) viral gene, which modulates expression of respective host target genes thereof, the function and utility of which host target genes is known in the art.

VGAM2079 is a novel bioinformatically detected regulatory, non protein coding, viral micro RNA (miRNA) gene. The method by which VGAM2079 was detected is described hereinabove with reference to FIGS. 1-8.

VGAM2079 gene, herein designated VGAM GENE, is a viral gene contained in the genome of Variola Virus. VGAM2079 host target gene, herein designated VGAM HOST TARGET GENE, is a human gene contained in the human genome.

VGAM2079 gene encodes a VGAM2079 precursor RNA, herein designated VGAM PRECURSOR RNA. Similar to other miRNA genes, and unlike most ordinary genes, VGAM2079 precursor RNA does not encode a protein. A nucleotide sequence identical or highly similar to the nucleotide sequence of VGAM2079 precursor RNA is designated SEQ ID:2065, and is provided hereinbelow with reference to the sequence listing part. Nucleotide sequence SEQ ID:2065 is located at position 171525 relative to the genome of Variola Virus.

VGAM2079 precursor RNA folds onto itself, forming VGAM2079 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2079 folded precursor RNA into VGAM2079 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM2079 RNA is designated SEQ ID:4790, and is provided hereinbelow with reference to the sequence listing part.

VGAM2079 host target gene, herein designated VGAM HOST TARGET GENE, encodes a corresponding messenger RNA, VGAM2079 host target RNA, herein designated VGAM HOST TARGET RNA. VGAM2079 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2079 RNA, herein designated VGAM RNA, binds complementarily to one or more host target binding sites located in untranslated regions of VGAM2079 host target RNA, herein designated VGAM HOST TARGET RNA. This complementary binding is due to the fact that the nucleotide sequence of VGAM2079 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2079 RNA, herein designated VGAM RNA, may have a different number of host target binding sites in untranslated regions of a VGAM2079 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2079 RNA, herein designated VGAM RNA, to host target binding sites on VGAM2079 host target RNA, herein designated VGAM HOST TARGET RNA, such as BINDING SITE I, BINDING SITE II and BINDING SITE III, inhibits translation of VGAM2079 host target RNA into VGAM2079 host target protein, herein designated VGAM HOST TARGET PROTEIN. VGAM host target protein is therefore outlined by a broken line.

It is appreciated that VGAM2079 host target gene, herein designated VGAM HOST TARGET GENE, in fact represents a plurality of VGAM2079 host target genes. The mRNA of each one of this plurality of VGAM2079 host target genes comprises one or more host target binding sites, each having a nucleotide sequence which is at least partly complementary to VGAM2079 RNA, herein designated VGAM RNA, and which when bound by VGAM2079 RNA causes inhibition of translation of respective one or more VGAM2079 host target proteins.

It is further appreciated by one skilled in the art that the mode of translational inhibition illustrated by FIG. 1 with specific reference to translational inhibition exerted by VGAM2079 gene, herein designated VGAM GENE, on one or more VGAM2079 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2079 is inhibition of expression of host target genes, as part of a novel viral mechanism of attacking a host. Accordingly, utilities of VGAM2079 include diagnosis, prevention and treatment of viral infection by Variola Virus. Specific functions, and accordingly utilities, of VGAM2079 correlate with, and may be deduced from, the identity of the host target genes which VGAM2079 binds and inhibits, and the function of these host target genes, as elaborated hereinbelow.

Nucleotide sequences of the VGAM2079 precursor RNA, herein designated VGAM PRECURSOR RNA, and of the 'diced' VGAM2079 RNA, herein designated VGAM RNA, and a schematic representation of the secondary folding of VGAM2079 folded precursor RNA, herein designated VGAM FOLDED PRECURSOR RNA, of VGAM2079 are further described hereinbelow with reference to Table 1.

Nucleotide sequences of host target binding sites, such as BINDING SITE-I, BINDING SITE-II and BINDING SITE-III of FIG. 1, found on VGAM2079 host target RNA, and schematic representation of the complementarity of each of these host target binding sites to VGAM2079 RNA, herein designated VGAM RNA, are described hereinbelow with reference to Table 2.

As mentioned hereinabove with reference to FIG. 1, a function of VGAM2079 gene, herein designated VGAM is inhibition of expression of VGAM2079 target genes. It is appreciated that specific functions, and accordingly utilities, of VGAM2079 correlate with, and may be deduced from, the identity of the target genes which VGAM2079 binds and inhibits, and the function of these target genes, as elaborated hereinbelow.

DXF68S1E (Accession XM_010289) is a VGAM2079 host target gene. DXF68S1E BINDING SITE is HOST TARGET binding site found in the 3' untranslated region of mRNA encoded by DXF68S1E, corresponding to a HOST TARGET binding site such as BINDING SITE I, BINDING SITE II or BINDING SITE III. Table 2 illustrates the complementarity of the nucleotide sequences of DXF68S1E BINDING SITE, designated SEQ ID:30151, to the nucleotide sequence of VGAM2079 RNA, herein designated VGAM RNA, also designated SEQ ID:4790.

A function of VGAM2079 is therefore inhibition of DXF68S1E (Accession XM_010289). Accordingly, utilities of VGAM2079 include diagnosis, prevention and treatment of diseases and clinical conditions associated with DXF68S1E. Pleiomorphic Adenoma Gene 1 (PLAG1, Accession NM_002655) is another VGAM2079 host target gene. PLAG1 BINDING SITE is HOST TARGET binding site found in the 3' untranslated region of mRNA encoded by PLAG1, corresponding to a HOST TARGET binding site such as BINDING SITE I, BINDING SITE II or BINDING SITE III. Table 2 illustrates the complementarity of the nucleotide sequences of PLAG1 BINDING SITE, designated SEQ ID:8517, to the nucleotide sequence of VGAM2079 RNA, herein designated VGAM RNA, also designated SEQ ID:4790.

Another function of VGAM2079 is therefore inhibition of Pleiomorphic Adenoma Gene 1 (PLAG1, Accession NM_002655), a gene which contains a zinc finger domain. Accordingly, utilities of VGAM2079 include diagnosis, prevention and treatment of diseases and clinical conditions associated with PLAG1. The function of PLAG1 and its association with various diseases and clinical conditions, has been established by previous studies, as described hereinabove with reference to VGAM29. ELL2 (Accession NM_012081) is another VGAM2079 host target gene. ELL2 BINDING SITE is HOST TARGET binding site found in the 3' untranslated region of mRNA encoded by ELL2, corresponding to a HOST TARGET binding site such as BINDING SITE I, BINDING SITE II or BINDING SITE III. Table 2 illustrates the complementarity of the nucleotide sequences of ELL2 BINDING SITE, designated SEQ ID:14366, to the nucleotide sequence of VGAM2079 RNA, herein designated VGAM RNA, also designated SEQ ID:4790.

Another function of VGAM2079 is therefore inhibition of ELL2 (Accession NM_012081). Accordingly, utilities of VGAM2079 include diagnosis, prevention and treatment of diseases and clinical conditions associated with ELL2. KIAA0090 (Accession XM_114045) is another VGAM2079 host target gene. KIAA0090 BINDING SITE is HOST TARGET binding site found in the 3' untranslated region of mRNA encoded by KIAA0090, corresponding to a HOST TARGET binding site such as BINDING SITE I, BINDING SITE II or BINDING SITE III. Table 2 illustrates the complementarity of the nucleotide sequences of KIAA0090 BINDING SITE, designated SEQ ID:42652, to the nucleotide sequence of VGAM2079 RNA, herein designated VGAM RNA, also designated SEQ ID:4790.

Another function of VGAM2079 is therefore inhibition of KIAA0090 (Accession XM_114045). Accordingly, utilities of VGAM2079 include diagnosis, prevention and treatment of diseases and clinical conditions associated with KIAA0090. KIAA1622 (Accession NM_058237) is another VGAM2079 host target gene. KIAA1622 BINDING SITE is HOST TARGET binding site found in the 3' untranslated region of mRNA encoded by KIAA1622, corresponding to a HOST TARGET binding site such as BINDING SITE I, BINDING SITE II or BINDING SITE III. Table 2 illustrates the complementarity of the nucleotide sequences of KIAA1622 BINDING SITE, designated SEQ ID:27764, to the nucleotide sequence of VGAM2079 RNA, herein designated VGAM RNA, also designated SEQ ID:4790.

Another function of VGAM2079 is therefore inhibition of KIAA1622 (Accession NM_058237). Accordingly, utilities of VGAM2079 include diagnosis, prevention and treatment of diseases and clinical conditions associated with KIAA1622. RAS-like, Estrogen-regulated, Growth-inhibitor (RERG, Accession NM_032918) is another VGAM2079 host target gene. RERG BINDING SITE is HOST TARGET binding site found in the 3' untranslated region of mRNA encoded by RERG, corresponding to a HOST TARGET binding site such as BINDING SITE I, BINDING SITE II or BINDING SITE III. Table 2 illustrates the complementarity of the nucleotide sequences of RERG BINDING SITE, designated SEQ ID:26738, to the nucleotide sequence of VGAM2079 RNA, herein designated VGAM RNA, also designated SEQ ID:4790.

Another function of VGAM2079 is therefore inhibition of RAS-like, Estrogen-regulated, Growth-inhibitor (RERG, Accession NM_032918). Accordingly, utilities of VGAM2079 include diagnosis, prevention and treatment of diseases and clinical conditions associated with RERG. LOC221288 (Accession XM_168058) is another VGAM2079 host target gene. LOC221288 BINDING SITE is HOST TARGET binding site found in the 3' untranslated region of mRNA encoded by LOC221288, corresponding to a HOST TARGET binding site such as BINDING SITE I, BINDING SITE II or BINDING SITE III. Table 2 illustrates the complementarity of the nucleotide sequences of LOC221288 BINDING SITE, designated SEQ ID:44970, to the nucleotide sequence of VGAM2079 RNA, herein designated VGAM RNA, also designated SEQ ID:4790.

Another function of VGAM2079 is therefore inhibition of LOC221288 (Accession XM_168058). Accordingly, utilities of VGAM2079 include diagnosis, prevention and treatment of diseases and clinical conditions associated with LOC221288. LOC90488 (Accession XM_032129) is another VGAM2079 host target gene. LOC90488 BINDING SITE is HOST TARGET binding site found in the 3' untranslated region of mRNA encoded by LOC90488, corresponding to a HOST TARGET binding site such as BINDING SITE I, BINDING SITE II or BINDING SITE III. Table 2 illustrates the complementarity of the nucleotide sequences of LOC90488 BINDING SITE, designated SEQ ID:31557, to the nucleotide sequence of VGAM2079 RNA, herein designated VGAM RNA, also designated SEQ ID:4790.

Another function of VGAM2079 is therefore inhibition of LOC90488 (Accession XM_032129). Accordingly, utilities of VGAM2079 include diagnosis, prevention and treatment of diseases and clinical conditions associated with LOC90488. FIG. 1 further provides a conceptual description of a novel bioinformatically detected viral gene of the present invention, referred to here as Viral Genomic Address Messenger 2080 (VGAM2080) viral gene, which modulates expression of respective host target genes thereof, the function and utility of which host target genes is known in the art.

VGAM2080 is a novel bioinformatically detected regulatory, non protein coding, viral micro RNA (miRNA) gene. The method by which VGAM2080 was detected is described hereinabove with reference to FIGS. 1-8.

VGAM2080 gene, herein designated VGAM GENE, is a viral gene contained in the genome of Variola Virus. VGAM2080 host target gene, herein designated VGAM HOST TARGET GENE, is a human gene contained in the human genome.

VGAM2080 gene encodes a VGAM2080 precursor RNA, herein designated VGAM PRECURSOR RNA. Similar to other miRNA genes, and unlike most ordinary genes, VGAM2080 precursor RNA does not encode a protein. A nucleotide sequence identical or highly similar to the nucleotide sequence of VGAM2080 precursor RNA is designated SEQ ID:2066, and is provided hereinbelow with reference to the sequence listing part. Nucleotide sequence SEQ ID:2066 is located at position 176691 relative to the genome of Variola Virus.

VGAM2080 precursor RNA folds onto itself, forming VGAM2080 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2080 folded precursor RNA into VGAM2080 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM2080 RNA is designated SEQ ID:4791, and is provided hereinbelow with reference to the sequence listing part.

VGAM2080 host target gene, herein designated VGAM HOST TARGET GENE, encodes a corresponding messenger RNA, VGAM2080 host target RNA, herein designated VGAM HOST TARGET RNA. VGAM2080 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2080 RNA, herein designated VGAM RNA, binds complementarily to one or more host target binding sites located in untranslated regions of VGAM2080 host target RNA, herein designated VGAM HOST TARGET RNA. This complementary binding is due to the fact that the nucleotide sequence of VGAM2080 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2080 RNA, herein designated VGAM RNA, may have a different number of host target binding sites in untranslated regions of a VGAM2080 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2080 RNA, herein designated VGAM RNA, to host target binding sites on VGAM2080 host target RNA, herein designated VGAM HOST TARGET RNA, such as BINDING SITE I, BINDING SITE II and BINDING SITE III, inhibits translation of VGAM2080 host target RNA into VGAM2080 host target protein, herein designated VGAM HOST TARGET PROTEIN. VGAM host target protein is therefore outlined by a broken line.

It is appreciated that VGAM2080 host target gene, herein designated VGAM HOST TARGET GENE, in fact represents a plurality of VGAM2080 host target genes. The mRNA of each one of this plurality of VGAM2080 host target genes comprises one or more host target binding sites, each having a nucleotide sequence which is at least partly complementary to VGAM2080 RNA, herein designated VGAM RNA, and which when bound by VGAM2080 RNA causes inhibition of translation of respective one or more VGAM2080 host target proteins.

It is further appreciated by one skilled in the art that the mode of translational inhibition illustrated by FIG. 1 with specific reference to translational inhibition exerted by VGAM2080 gene, herein designated VGAM GENE, on one or more VGAM2080 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2080 is inhibition of expression of host target genes, as part of a novel viral mechanism of attacking a host. Accordingly, utilities of VGAM2080 include diagnosis, prevention and treatment of viral infection by Variola Virus. Specific functions, and accordingly utilities, of VGAM2080 correlate with, and may be deduced from, the identity of the host target genes which VGAM2080 binds and inhibits, and the function of these host target genes, as elaborated hereinbelow.

Nucleotide sequences of the VGAM2080 precursor RNA, herein designated VGAM PRECURSOR RNA, and of the 'diced' VGAM2080 RNA, herein designated VGAM RNA, and a schematic representation of the secondary folding of VGAM2080 folded precursor RNA, herein designated VGAM FOLDED PRECURSOR RNA, of VGAM2080 are further described hereinbelow with reference to Table 1.

Nucleotide sequences of host target binding sites, such as BINDING SITE-I, BINDING SITE-II and BINDING SITE-III of FIG. 1, found on VGAM2080 host target RNA, and schematic representation of the complementarity of each of these host target binding sites to VGAM2080 RNA, herein designated VGAM RNA, are described hereinbelow with reference to Table 2.

As mentioned hereinabove with reference to FIG. 1, a function of VGAM2080 gene, herein designated VGAM is inhibition of expression of VGAM2080 target genes. It is appreciated that specific functions, and accordingly utilities, of VGAM2080 correlate with, and may be deduced from, the identity of the target genes which VGAM2080 binds and inhibits, and the function of these target genes, as elaborated hereinbelow.

Chemokine (C-X3-C motif) Receptor 1 (CX3CR1, Accession XM_047502) is a VGAM2080 host target gene. CX3CR1 BINDING SITE is HOST TARGET binding site found in the 3' untranslated region of mRNA encoded by CX3CR1, corresponding to a HOST TARGET binding site such as BINDING SITE I, BINDING SITE II or BINDING SITE III. Table 2 illustrates the complementarity of the nucleotide sequences of CX3CR1 BINDING SITE, designated SEQ ID:34983, to the nucleotide sequence of VGAM2080 RNA, herein designated VGAM RNA, also designated SEQ ID:4791.

A function of VGAM2080 is therefore inhibition of Chemokine (C-X3-C motif) Receptor 1 (CX3CR1, Accession XM_047502), a gene which mediates both the adhesive and migratory functions of fractalkine. Accordingly, utilities of VGAM2080 include diagnosis, prevention and treatment of diseases and clinical conditions associated with CX3CR1. The function of CX3CR1 and its association with various diseases and clinical conditions, has been established by previous studies, as described hereinabove with reference to VGAM25. KIAA0720 (Accession XM_030970) is another VGAM2080 host target gene. KIAA0720 BINDING SITE is HOST TARGET binding site found in the 5' untranslated region of mRNA encoded by KIAA0720, corresponding to a HOST TARGET binding site such as BINDING SITE I, BINDING SITE II or BINDING SITE III. Table 2 illustrates the complementarity of the nucleotide sequences of KIAA0720 BINDING SITE, designated SEQ ID:31231, to the nucleotide sequence of VGAM2080 RNA, herein designated VGAM RNA, also designated SEQ ID:4791.

Another function of VGAM2080 is therefore inhibition of KIAA0720 (Accession XM_030970). Accordingly, utilities of VGAM2080 include diagnosis, prevention and treatment of diseases and clinical conditions associated with KIAA0720. KIAA1102 (Accession XM_044461) is another VGAM2080 host target gene. KIAA1102 BINDING SITE is HOST TARGET binding site found in the 3' untranslated region of mRNA encoded by KIAA1102, corresponding to a HOST TARGET binding site such as BINDING SITE I, BINDING SITE II or BINDING SITE III. Table 2 illustrates the complementarity of the nucleotide sequences of KIAA1102 BINDING SITE, designated SEQ ID:34213, to the nucleotide sequence of VGAM2080 RNA, herein designated VGAM RNA, also designated SEQ ID:4791.

Another function of VGAM2080 is therefore inhibition of KIAA1102 (Accession XM_044461). Accordingly, utilities of VGAM2080 include diagnosis, prevention and treatment of diseases and clinical conditions associated with KIAA1102. KIAA1257 (Accession XM_031577) is another VGAM2080 host target gene. KIAA1257 BINDING SITE is HOST TARGET binding site found in the 3' untranslated region of mRNA encoded by KIAA1257, corresponding to a HOST TARGET binding site such as BINDING SITE I, BINDING SITE II or BINDING SITE III. Table 2 illustrates the complementarity of the nucleotide sequences of KIAA1257 BINDING SITE, designated SEQ ID:31430, to the nucleotide sequence of VGAM2080 RNA, herein designated VGAM RNA, also designated SEQ ID:4791.

Another function of VGAM2080 is therefore inhibition of KIAA1257 (Accession XM_031577). Accordingly, utilities of VGAM2080 include diagnosis, prevention and treatment of diseases and clinical conditions associated with KIAA1257. PFTAIRE Protein Kinase 1 (PFTK1, Accession NM_012395) is another VGAM2080 host target gene. PFTK1 BINDING SITE is HOST TARGET binding site found in the 3' untranslated region of mRNA encoded by PFTK1, corresponding to a HOST TARGET binding site such as BINDING SITE I, BINDING SITE II or BINDING SITE III. Table 2 illustrates the complementarity of the nucleotide sequences of PFTK1 BINDING SITE, designated SEQ ID:14751, to the nucleotide sequence of VGAM2080 RNA, herein designated VGAM RNA, also designated SEQ ID:4791.

Another function of VGAM2080 is therefore inhibition of PFTAIRE Protein Kinase 1 (PFTK1, Accession NM_012395). Accordingly, utilities of VGAM2080 include diagnosis, prevention and treatment of diseases and clinical conditions associated with PFTK1. FIG. 1 further provides a conceptual description of a novel bioinformatically detected viral gene of the present invention, referred to here as Viral Genomic Address Messenger 2081 (VGAM2081) viral gene, which modulates expression of respective host target genes thereof, the function and utility of which host target genes is known in the art.

VGAM2081 is a novel bioinformatically detected regulatory, non protein coding, viral micro RNA (miRNA) gene. The method by which VGAM2081 was detected is described hereinabove with reference to FIGS. 1-8.

VGAM2081 gene, herein designated VGAM GENE, is a viral gene contained in the genome of Variola Virus. VGAM2081 host target gene, herein designated VGAM HOST TARGET GENE, is a human gene contained in the human genome.

VGAM2081 gene encodes a VGAM2081 precursor RNA, herein designated VGAM PRECURSOR RNA. Similar to other miRNA genes, and unlike most ordinary genes, VGAM2081 precursor RNA does not encode a protein. A nucleotide sequence identical or highly similar to the nucleotide sequence of VGAM2081 precursor RNA is designated SEQ ID:2067, and is provided hereinbelow with reference to the sequence listing part. Nucleotide sequence SEQ ID:2067 is located at position 180298 relative to the genome of Variola Virus.

VGAM2081 precursor RNA folds onto itself, forming VGAM2081 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2081 folded precursor RNA into VGAM2081 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2081 RNA is designated SEQ ID:4792, and is provided hereinbelow with reference to the sequence listing part.

VGAM2081 host target gene, herein designated VGAM HOST TARGET GENE, encodes a corresponding messenger RNA, VGAM2081 host target RNA, herein designated VGAM HOST TARGET RNA. VGAM2081 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2081 RNA, herein designated VGAM RNA, binds complementarily to one or more host target binding sites located in untranslated regions of VGAM2081 host target RNA, herein designated VGAM HOST TARGET RNA. This complementary binding is due to the fact that the nucleotide sequence of VGAM2081 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2081 RNA, herein designated VGAM RNA, may have a different number of host target binding sites in untranslated regions of a VGAM2081 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2081 RNA, herein designated VGAM RNA, to host target binding sites on VGAM2081 host target RNA, herein designated VGAM HOST TARGET RNA, such as BINDING SITE I, BINDING SITE II and BINDING SITE III, inhibits translation of VGAM2081 host target RNA into VGAM2081 host target protein, herein designated VGAM HOST TARGET PROTEIN. VGAM host target protein is therefore outlined by a broken line.

It is appreciated that VGAM2081 host target gene, herein designated VGAM HOST TARGET GENE, in fact represents a plurality of VGAM2081 host target genes. The mRNA of each one of this plurality of VGAM2081 host target genes comprises one or more host target binding sites, each having a nucleotide sequence which is at least partly complementary to VGAM2081 RNA, herein designated VGAM RNA, and which when bound by VGAM2081 RNA causes inhibition of translation of respective one or more VGAM2081 host target proteins.

It is further appreciated by one skilled in the art that the mode of translational inhibition illustrated by FIG. 1 with specific reference to translational inhibition exerted by VGAM2081 gene, herein designated VGAM GENE, on one or more VGAM2081 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2081 is inhibition of expression of host target genes, as part of a novel viral mechanism of attacking a host. Accordingly, utilities of VGAM2081 include diagnosis, prevention and treatment of viral infection by Variola Virus. Specific functions, and accordingly utilities, of VGAM2081 correlate with, and may be deduced from, the identity of the host target genes which VGAM2081 binds and inhibits, and the function of these host target genes, as elaborated hereinbelow.

Nucleotide sequences of the VGAM2081 precursor RNA, herein designated VGAM PRECURSOR RNA, and of the 'diced' VGAM2081 RNA, herein designated VGAM RNA, and a schematic representation of the secondary folding of VGAM2081 folded precursor RNA, herein designated VGAM FOLDED PRECURSOR RNA, of VGAM2081 are further described hereinbelow with reference to Table 1.

Nucleotide sequences of host target binding sites, such as BINDING SITE-I, BINDING SITE-II and BINDING SITE-III of FIG. 1, found on VGAM2081 host target RNA, and schematic representation of the complementarity of each of these host target binding sites to VGAM2081 RNA, herein designated VGAM RNA, are described hereinbelow with reference to Table 2.

As mentioned hereinabove with reference to FIG. 1, a function of VGAM2081 gene, herein designated VGAM is inhibition of expression of VGAM2081 target genes. It is appreciated that specific functions, and accordingly utilities, of VGAM2081 correlate with, and may be deduced from, the identity of the target genes which VGAM2081 binds and inhibits, and the function of these target genes, as elaborated hereinbelow.

Ceroid-lipofuscinosis, Neuronal 5 (CLN5, Accession NM_006493) is a VGAM2081 host target gene. CLN5 BINDING SITE is HOST TARGET binding site found in the 5' untranslated region of mRNA encoded by CLN5, corresponding to a HOST TARGET binding site such as BINDING SITE I, BINDING SITE II or BINDING SITE III. Table 2 illustrates the complementarity of the nucleotide sequences of CLN5 BINDING SITE, designated SEQ ID:13226, to the nucleotide sequence of VGAM2081 RNA, herein designated VGAM RNA, also designated SEQ ID:4792.

A function of VGAM2081 is therefore inhibition of Ceroid-lipofuscinosis, Neuronal 5 (CLN5, Accession NM_006493). Accordingly, utilities of VGAM2081 include diagnosis, prevention and treatment of diseases and clinical conditions associated with CLN5. ADP-ribosylation Factor GTPase Activating Protein 3 (ARFGAP3, Accession NM_014570) is another VGAM2081 host target gene. ARFGAP3 BINDING SITE is HOST TARGET binding site found in the 3' untranslated region of mRNA encoded by ARFGAP3, corresponding to a HOST TARGET binding site such as BINDING SITE I, BINDING SITE II or BINDING SITE III. Table 2 illustrates the complementarity of the nucleotide sequences of ARFGAP3 BINDING SITE, designated SEQ ID:15925, to the nucleotide sequence of VGAM2081 RNA, herein designated VGAM RNA, also designated SEQ ID:4792.

Another function of VGAM2081 is therefore inhibition of ADP-ribosylation Factor GTPase Activating Protein 3 (ARFGAP3, Accession NM_014570). Accordingly, utilities of VGAM2081 include diagnosis, prevention and treatment of diseases and clinical conditions associated with ARFGAP3. FLJ30532 (Accession NM_144724) is another VGAM2081 host target gene. FLJ30532 BINDING SITE is HOST TARGET binding site found in the 3' untranslated region of mRNA encoded by FLJ30532, corresponding to a HOST TARGET binding site such as BINDING SITE I, BINDING SITE II or BINDING SITE III. Table 2 illustrates the complementarity of the nucleotide sequences of FLJ30532 BINDING SITE, designated SEQ ID:29546, to the nucleotide sequence of VGAM2081 RNA, herein designated VGAM RNA, also designated SEQ ID:4792.

Another function of VGAM2081 is therefore inhibition of FLJ30532 (Accession NM_144724). Accordingly, utilities of VGAM2081 include diagnosis, prevention and treatment of diseases and clinical conditions associated with FLJ30532. KIAA0319 (Accession NM_014809) is another VGAM2081 host target gene. KIAA0319 BINDING SITE is HOST TAR- GET binding site found in the 3' untranslated region of mRNA encoded by KIAA0319, corresponding to a HOST TARGET binding site such as BINDING SITE I, BINDING SITE II or BINDING SITE III. Table 2 illustrates the complementarity of the nucleotide sequences of KIAA0319 BINDING SITE, designated SEQ ID:16764, to the nucleotide sequence of VGAM2081 RNA, herein designated VGAM RNA, also designated SEQ ID:4792.

Another function of VGAM2081 is therefore inhibition of KIAA0319 (Accession NM_014809). Accordingly, utilities of VGAM2081 include diagnosis, prevention and treatment of diseases and clinical conditions associated with KIAA0319. KIAA0416 (Accession NM_015564) is another VGAM2081 host target gene. KIAA0416 BINDING SITE is HOST TARGET binding site found in the 3' untranslated region of mRNA encoded by KIAA0416, corresponding to a HOST TARGET binding site such as BINDING SITE I, BINDING SITE II or BINDING SITE III. Table 2 illustrates the complementarity of the nucleotide sequences of KIAA0416 BINDING SITE, designated SEQ ID:17834, to the nucleotide sequence of VGAM2081 RNA, herein designated VGAM RNA, also designated SEQ ID:4792.

Another function of VGAM2081 is therefore inhibition of KIAA0416 (Accession NM_015564). Accordingly, utilities of VGAM2081 include diagnosis, prevention and treatment of diseases and clinical conditions associated with KIAA0416. KIAA0555 (Accession XM_011347) is another VGAM2081 host target gene. KIAA0555 BINDING SITE is HOST TARGET binding site found in the 3' untranslated region of mRNA encoded by KIAA0555, corresponding to a HOST TARGET binding site such as BINDING SITE I, BINDING SITE II or BINDING SITE III. Table 2 illustrates the complementarity of the nucleotide sequences of KIAA0555 BINDING SITE, designated SEQ ID:30186, to the nucleotide sequence of VGAM2081 RNA, herein designated VGAM RNA, also designated SEQ ID:4792.

Another function of VGAM2081 is therefore inhibition of KIAA0555 (Accession XM_011347). Accordingly, utilities of VGAM2081 include diagnosis, prevention and treatment of diseases and clinical conditions associated with KIAA0555. MGC30052 (Accession NM_144721) is another VGAM2081 host target gene. MGC30052 BINDING SITE is HOST TARGET binding site found in the 3' untranslated region of mRNA encoded by MGC30052, corresponding to a HOST TARGET binding site such as BINDING SITE I, BINDING SITE II or BINDING SITE III. Table 2 illustrates the complementarity of the nucleotide sequences of MGC30052 BINDING SITE, designated SEQ ID:29542, to the nucleotide sequence of VGAM2081 RNA, herein designated VGAM RNA, also designated SEQ ID:4792.

Another function of VGAM2081 is therefore inhibition of MGC30052 (Accession NM_144721). Accordingly, utilities of VGAM2081 include diagnosis, prevention and treatment of diseases and clinical conditions associated with MGC30052. MGC5139 (Accession XM_058587) is another VGAM2081 host target gene. MGC5139 BINDING SITE is HOST TARGET binding site found in the 5' untranslated region of mRNA encoded by MGC5139, corresponding to a HOST TARGET binding site such as BINDING SITE I, BINDING SITE II or BINDING SITE III. Table 2 illustrates the complementarity of the nucleotide sequences of MGC5139 BINDING SITE, designated SEQ ID:36677, to the nucleotide sequence of VGAM2081 RNA, herein designated VGAM RNA, also designated SEQ ID:4792.

Another function of VGAM2081 is therefore inhibition of MGC5139 (Accession XM_058587). Accordingly, utilities of VGAM2081 include diagnosis, prevention and treatment of diseases and clinical conditions associated with MGC5139. NSG-X (Accession NM_014411) is another VGAM2081 host target gene. NSG-X BINDING SITE is HOST TARGET binding site found in the 3' untranslated region of mRNA encoded by NSG-X, corresponding to a HOST TARGET binding site such as BINDING SITE I, BINDING SITE II or BINDING SITE III. Table 2 illustrates the complementarity of the nucleotide sequences of NSG-X BINDING SITE, designated SEQ ID:15754, to the nucleotide sequence of VGAM2081 RNA, herein designated VGAM RNA, also designated SEQ ID:4792.

Another function of VGAM2081 is therefore inhibition of NSG-X (Accession NM_014411). Accordingly, utilities of VGAM2081 include diagnosis, prevention and treatment of diseases and clinical conditions associated with NSG-X. Solute Carrier Family 12, (potassium-chloride transporter) Member 5 (SLC12A5, Accession NM_020708) is another VGAM2081 host target gene. SLC12A5 BINDING SITE is HOST TARGET binding site found in the 3' untranslated region of mRNA encoded by SLC12A5, corresponding to a HOST TARGET binding site such as BINDING SITE I, BINDING SITE II or BINDING SITE III. Table 2 illustrates the complementarity of the nucleotide sequences of SLC12A5 BINDING SITE, designated SEQ ID:21856, to the nucleotide sequence of VGAM2081 RNA, herein designated VGAM RNA, also designated SEQ ID:4792.

Another function of VGAM2081 is therefore inhibition of Solute Carrier Family 12, (potassium-chloride transporter) Member 5 (SLC12A5, Accession NM_020708). Accordingly, utilities of VGAM2081 include diagnosis, prevention and treatment of diseases and clinical conditions associated with SLC12A5. TRIP-Br2 (Accession NM_014755) is another VGAM2081 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16489, to the nucleotide sequence of VGAM2081 RNA, herein designated VGAM RNA, also designated SEQ ID:4792.

Another function of VGAM2081 is therefore inhibition of TRIP-Br2 (Accession NM_014755). Accordingly, utilities of VGAM2081 include diagnosis, prevention and treatment of diseases and clinical conditions associated with TRIP-Br2. LOC128954 (Accession XM_066252) is another VGAM2081 host target gene. LOC128954 BINDING SITE is HOST TARGET binding site found in the 5' untranslated region of mRNA encoded by LOC128954, corresponding to a HOST TARGET binding site such as BINDING SITE I, BINDING SITE II or BINDING SITE III. Table 2 illustrates the complementarity of the nucleotide sequences of LOC128954 BINDING SITE, designated SEQ ID:37320, to the nucleotide sequence of VGAM2081 RNA, herein designated VGAM RNA, also designated SEQ ID:4792.

Another function of VGAM2081 is therefore inhibition of LOC128954 (Accession XM_066252). Accordingly, utilities of VGAM2081 include diagnosis, prevention and treatment of diseases and clinical conditions associated with LOC128954. LOC91948 (Accession XM_041723) is another VGAM2081 host target gene. LOC91948 BINDING SITE is HOST TARGET binding site found in the 3' untranslated region of mRNA encoded by LOC91948, corresponding to a HOST TARGET binding site such as BINDING SITE I, BINDING SITE II or BINDING SITE III. Table 2 illustrates the complementarity of the nucleotide sequences of LOC91948 BINDING SITE, designated SEQ ID:33574, to the nucleotide sequence of VGAM2081 RNA, herein designated VGAM RNA, also designated SEQ ID:4792.

Another function of VGAM2081 is therefore inhibition of LOC91948 (Accession XM_041723). Accordingly, utilities of VGAM2081 include diagnosis, prevention and treatment of diseases and clinical conditions associated with LOC91948. FIG. 1 further provides a conceptual description of a novel bioinformatically detected viral gene of the present invention, referred to here as Viral Genomic Address Messenger 2082 (VGAM2082) viral gene, which modulates expression of respective host target genes thereof, the function and utility of which host target genes is known in the art.

VGAM2082 is a novel bioinformatically detected regulatory, non protein coding, viral micro RNA (miRNA) gene. The method by which VGAM2082 was detected is described hereinabove with reference to FIGS. 1-8.

VGAM2082 gene, herein designated VGAM GENE, is a viral gene contained in the genome of Variola Virus. VGAM2082 host target gene, herein designated VGAM HOST TARGET GENE, is a human gene contained in the human genome.

VGAM2082 gene encodes a VGAM2082 precursor RNA, herein designated VGAM PRECURSOR RNA. Similar to other miRNA genes, and unlike most ordinary genes, VGAM2082 precursor RNA does not encode a protein. A nucleotide sequence identical or highly similar to the nucleotide sequence of VGAM2082 precursor RNA is designated SEQ ID:2068, and is provided hereinbelow with reference to the sequence listing part. Nucleotide sequence SEQ ID:2068 is located at position 174739 relative to the genome of Variola Virus.

VGAM2082 precursor RNA folds onto itself, forming VGAM2082 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2082 folded precursor RNA into VGAM2082 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2082 RNA is designated SEQ ID:4793, and is provided hereinbelow with reference to the sequence listing part.

VGAM2082 host target gene, herein designated VGAM HOST TARGET GENE, encodes a corresponding messenger RNA, VGAM2082 host target RNA, herein designated VGAM HOST TARGET RNA. VGAM2082 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2082 RNA, herein designated VGAM RNA, binds complementarily to one or more host target binding sites located in untranslated regions of VGAM2082 host target RNA, herein designated VGAM HOST TARGET RNA. This complementary binding is due to the fact that the nucleotide sequence of VGAM2082 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2082 RNA, herein designated VGAM RNA, may have a different number of host target binding sites in untranslated regions of a VGAM2082 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2082 RNA, herein designated VGAM RNA, to host target binding sites on VGAM2082 host target RNA, herein designated VGAM HOST TARGET RNA, such as BINDING SITE I, BINDING SITE II and BINDING SITE III, inhibits translation of VGAM2082 host target RNA into VGAM2082 host target protein, herein designated VGAM HOST TARGET PROTEIN. VGAM host target protein is therefore outlined by a broken line.

It is appreciated that VGAM2082 host target gene, herein designated VGAM HOST TARGET GENE, in fact represents a plurality of VGAM2082 host target genes. The mRNA of each one of this plurality of VGAM2082 host target genes comprises one or more host target binding sites, each having a nucleotide sequence which is at least partly complementary to VGAM2082 RNA, herein designated VGAM RNA, and which when bound by VGAM2082 RNA causes inhibition of translation of respective one or more VGAM2082 host target proteins.

It is further appreciated by one skilled in the art that the mode of translational inhibition illustrated by FIG. 1 with specific reference to translational inhibition exerted by VGAM2082 gene, herein designated VGAM GENE, on one or more VGAM2082 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2082 is inhibition of expression of host target genes, as part of a novel viral mechanism of attacking a host. Accordingly, utilities of VGAM2082 include diagnosis, prevention and treatment of viral infection by Variola Virus. Specific functions, and accordingly utilities, of VGAM2082 correlate with, and may be deduced from, the identity of the host target genes which VGAM2082 binds and inhibits, and the function of these host target genes, as elaborated hereinbelow.

Nucleotide sequences of the VGAM2082 precursor RNA, herein designated VGAM PRECURSOR RNA, and of the 'diced' VGAM2082 RNA, herein designated VGAM RNA, and a schematic representation of the secondary folding of VGAM2082 folded precursor RNA, herein designated VGAM FOLDED PRECURSOR RNA, of VGAM2082 are further described hereinbelow with reference to Table 1.

Nucleotide sequences of host target binding sites, such as BINDING SITE-I, BINDING SITE-II and BINDING SITE-III of FIG. 1, found on VGAM2082 host target RNA, and schematic representation of the complementarity of each of these host target binding sites to VGAM2082 RNA, herein designated VGAM RNA, are described hereinbelow with reference to Table 2.

As mentioned hereinabove with reference to FIG. 1, a function of VGAM2082 gene, herein designated VGAM is inhibition of expression of VGAM2082 target genes. It is appreciated that specific functions, and accordingly utilities, of VGAM2082 correlate with, and may be deduced from, the identity of the target genes which VGAM2082 binds and inhibits, and the function of these target genes, as elaborated hereinbelow.

Capping Protein (actin filament) Muscle Z-line, Alpha 1 (CAPZA1, Accession XM_052116) is a VGAM2082 host target gene. CAPZA1 BINDING SITE is HOST TARGET binding site found in the 3' untranslated region of mRNA encoded by CAPZA1, corresponding to a HOST TARGET binding site such as BINDING SITE I, BINDING SITE II or BINDING SITE III. Table 2 illustrates the complementarity of the nucleotide sequences of CAPZA1 BINDING SITE, designated SEQ ID:35952, to the nucleotide sequence of VGAM2082 RNA, herein designated VGAM RNA, also designated SEQ ID:4793.

A function of VGAM2082 is therefore inhibition of Capping Protein (actin filament) Muscle Z-line, Alpha 1 (CAPZA1, Accession XM_052116), a gene which is alpha 1 subunit of actin filament capping protein; binds actin, has roles in cell motility and actin assembly. Accordingly, utilities of VGAM2082 include diagnosis, prevention and treatment of diseases and clinical conditions associated with CAPZA1. The function of CAPZA1 and its association with various diseases and clinical conditions, has been established by previous studies, as described hereinabove with reference to VGAM547. Frizzled Homolog 4 (Drosophila) (FZD4, Accession NM_012193) is another VGAM2082 host target gene. FZD4 BINDING SITE is HOST TARGET binding site found in the 3' untranslated region of mRNA encoded by FZD4, corresponding to a HOST TARGET binding site such as BINDING SITE I, BINDING SITE II or BINDING SITE III. Table 2 illustrates the complementarity of the nucleotide sequences of FZD4 BINDING SITE, designated SEQ ID:14485, to the nucleotide sequence of VGAM2082 RNA, herein designated VGAM RNA, also designated SEQ ID:4793.

Another function of VGAM2082 is therefore inhibition of Frizzled Homolog 4 (Drosophila) (FZD4, Accession NM_012193), a gene which may function in cell polarity, cell fate specification and cancer; similar to frizzled receptor family, has seven transmembrane domains. Accordingly, utilities of VGAM2082 include diagnosis, prevention and treatment of diseases and clinical conditions associated with FZD4. The function of FZD4 and its association with various diseases and clinical conditions, has been established by previous studies, as described hereinabove with reference to VGAM309. Solute Carrier Family 17 (sodium phosphate), Member 4 (SLC17A4, Accession NM_005495) is another VGAM2082 host target gene. SLC17A4 BINDING SITE is HOST TARGET binding site found in the 3' untranslated region of mRNA encoded by SLC17A4, corresponding to a HOST TARGET binding site such as BINDING SITE I, BINDING SITE II or BINDING SITE III. Table 2 illustrates the complementarity of the nucleotide sequences of SLC17A4 BINDING SITE, designated SEQ ID:11997, to the nucleotide sequence of VGAM2082 RNA, herein designated VGAM RNA, also designated SEQ ID:4793.

Another function of VGAM2082 is therefore inhibition of Solute Carrier Family 17 (sodium phosphate), Member 4 (SLC17A4, Accession NM_005495). Accordingly, utilities of VGAM2082 include diagnosis, prevention and treatment of diseases and clinical conditions associated with SLC17A4. C6orf5 (Accession NM_015524) is another VGAM2082 host target gene. C6orf5 BINDING SITE is HOST TARGET binding site found in the 5' untranslated region of mRNA encoded by C6orf5, corresponding to a HOST TARGET binding site such as BINDING SITE I, BINDING SITE II or BINDING SITE III. Table 2 illustrates the complementarity of the nucleotide sequences of C6orf5 BINDING SITE, designated SEQ ID:17781, to the nucleotide sequence of VGAM2082 RNA, herein designated VGAM RNA, also designated SEQ ID:4793.

Another function of VGAM2082 is therefore inhibition of C6orf5 (Accession NM_015524). Accordingly, utilities of VGAM2082 include diagnosis, prevention and treatment of diseases and clinical conditions associated with C6orf5. DKFZp434G179 (Accession XM_087065) is another VGAM2082 host target gene. DKFZp434G179 BINDING SITE is HOST TARGET binding site found in the 3' untranslated region of mRNA encoded by DKFZp434G179, corresponding to a HOST TARGET binding site such as BINDING SITE I, BINDING SITE II or BINDING SITE III. Table 2 illustrates the complementarity of the nucleotide sequences of DKFZp434G179 BINDING SITE, designated SEQ ID:39041, to the nucleotide sequence of VGAM2082 RNA, herein designated VGAM RNA, also designated SEQ ID:4793.

Another function of VGAM2082 is therefore inhibition of DKFZp434G179 (Accession XM_087065). Accordingly, utilities of VGAM2082 include diagnosis, prevention and treatment of diseases and clinical conditions associated with DKFZp434G179. FLJ20712 (Accession NM_017937) is another VGAM2082 host target gene. FLJ20712 BINDING SITE is HOST TARGET binding site found in the 5' untranslated region of mRNA encoded by FLJ20712, corresponding to a HOST TARGET binding site such as BINDING SITE I, BINDING SITE II or BINDING SITE III. Table 2 illustrates the complementarity of the nucleotide sequences of FLJ20712 BINDING SITE, designated SEQ ID:19629, to the nucleotide sequence of VGAM2082 RNA, herein designated VGAM RNA, also designated SEQ ID:4793.

Another function of VGAM2082 is therefore inhibition of FLJ20712 (Accession NM_017937). Accordingly, utilities of VGAM2082 include diagnosis, prevention and treatment of diseases and clinical conditions associated with FLJ20712. KIAA1301 (Accession XM_038999) is another VGAM2082 host target gene. KIAA1301 BINDING SITE is HOST TARGET binding site found in the 3' untranslated region of mRNA encoded by KIAA1301, corresponding to a HOST TARGET binding site such as BINDING SITE I, BINDING SITE II or BINDING SITE III. Table 2 illustrates the complementarity of the nucleotide sequences of KIAA1301 BINDING SITE, designated SEQ ID:32977, to the nucleotide sequence of VGAM2082 RNA, herein designated VGAM RNA, also designated SEQ ID:4793.

Another function of VGAM2082 is therefore inhibition of KIAA1301 (Accession XM_038999). Accordingly, utilities of VGAM2082 include diagnosis, prevention and treatment of diseases and clinical conditions associated with KIAA1301. Retinoic Acid Induced 17 (RAI17, Accession XM_166091) is another VGAM2082 host target gene. RAI17 BINDING SITE is HOST TARGET binding site found in the 3' untranslated region of mRNA encoded by RAI17, corresponding to a HOST TARGET binding site such as BINDING SITE I, BINDING SITE II or BINDING SITE III. Table 2 illustrates the complementarity of the nucleotide sequences of RAI17 BINDING SITE, designated SEQ ID:43857, to the nucleotide sequence of VGAM2082 RNA, herein designated VGAM RNA, also designated SEQ ID:4793.

Another function of VGAM2082 is therefore inhibition of Retinoic Acid Induced 17 (RAI17, Accession XM_166091). Accordingly, utilities of VGAM2082 include diagnosis, prevention and treatment of diseases and clinical conditions associated with RAI17. LOC150630 (Accession XM_097931) is another VGAM2082 host target gene. LOC150630 BINDING SITE is HOST TARGET binding site found in the 5' untranslated region of mRNA encoded by LOC150630, corresponding to a HOST TARGET binding site such as BINDING SITE I, BINDING SITE II or BINDING SITE III. Table 2 illustrates the complementarity of the nucleotide sequences of LOC150630 BINDING SITE, designated SEQ ID:41236, to the nucleotide sequence of VGAM2082 RNA, herein designated VGAM RNA, also designated SEQ ID:4793.

Another function of VGAM2082 is therefore inhibition of LOC150630 (Accession XM_097931). Accordingly, utilities of VGAM2082 include diagnosis, prevention and treatment of diseases and clinical conditions associated with LOC150630. LOC153259 (Accession XM_098342) is another VGAM2082 host target gene. LOC153259 BINDING SITE is HOST TARGET binding site found in the 5' untranslated region of mRNA encoded by LOC153259, corresponding to a HOST TARGET binding site such as BINDING SITE I, BINDING SITE II or BINDING SITE III. Table 2 illustrates the complementarity of the nucleotide sequences of LOC153259 BINDING SITE, designated SEQ ID:41601, to the nucleotide sequence of VGAM2082 RNA, herein designated VGAM RNA, also designated SEQ ID:4793.

Another function of VGAM2082 is therefore inhibition of LOC153259 (Accession XM_098342). Accordingly, utilities of VGAM2082 include diagnosis, prevention and treatment of diseases and clinical conditions associated with LOC153259. LOC201799 (Accession XM_114380) is another VGAM2082 host target gene. LOC201799 BINDING SITE is HOST TARGET binding site found in the 3' untranslated region of mRNA encoded by LOC201799, corresponding to a HOST TARGET binding site such as BINDING SITE I, BINDING SITE II or BINDING SITE III. Table 2 illustrates the complementarity of the nucleotide sequences of LOC201799 BINDING SITE, designated SEQ ID:42911, to the nucleotide sequence of VGAM2082 RNA, herein designated VGAM RNA, also designated SEQ ID:4793.

Another function of VGAM2082 is therefore inhibition of LOC201799 (Accession XM_114380). Accordingly, utilities of VGAM2082 include diagnosis, prevention and treatment of diseases and clinical conditions associated with LOC201799. LOC219578 (Accession XM_170012) is another VGAM2082 host target gene. LOC219578 BINDING SITE is HOST TARGET binding site found in the 5' untranslated region of mRNA encoded by LOC219578, corresponding to a HOST TARGET binding site such as BINDING SITE I, BINDING SITE II or BINDING SITE III. Table 2 illustrates the complementarity of the nucleotide sequences of LOC219578 BINDING SITE, designated SEQ ID:45308, to the nucleotide sequence of VGAM2082 RNA, herein designated VGAM RNA, also designated SEQ ID:4793.

Another function of VGAM2082 is therefore inhibition of LOC219578 (Accession XM_170012). Accordingly, utilities of VGAM2082 include diagnosis, prevention and treatment of diseases and clinical conditions associated with LOC219578. FIG. 1 further provides a conceptual description of a novel bioinformatically detected viral gene of the present invention, referred to here as Viral Genomic Address Messenger 2083 (VGAM2083) viral gene, which modulates expression of respective host target genes thereof, the function and utility of which host target genes is known in the art.

VGAM2083 is a novel bioinformatically detected regulatory, non protein coding, viral micro RNA (miRNA) gene. The method by which VGAM2083 was detected is described hereinabove with reference to FIGS. 1-8.

VGAM2083 gene, herein designated VGAM GENE, is a viral gene contained in the genome of Camelpox Virus. VGAM2083 host target gene, herein designated VGAM HOST TARGET GENE, is a human gene contained in the human genome.

VGAM2083 gene encodes a VGAM2083 precursor RNA, herein designated VGAM PRECURSOR RNA. Similar to other miRNA genes, and unlike most ordinary genes, VGAM2083 precursor RNA does not encode a protein. A nucleotide sequence identical or highly similar to the nucleotide sequence of VGAM2083 precursor RNA is designated SEQ ID:2069, and is provided hereinbelow with reference to the sequence listing part. Nucleotide sequence SEQ ID:2069 is located at position 190806 relative to the genome of Camelpox Virus.

VGAM2083 precursor RNA folds onto itself, forming VGAM2083 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2083 folded precursor RNA into VGAM2083 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2083 RNA is designated SEQ ID:4794, and is provided hereinbelow with reference to the sequence listing part.

VGAM2083 host target gene, herein designated VGAM HOST TARGET GENE, encodes a corresponding messenger RNA, VGAM2083 host target RNA, herein designated VGAM HOST TARGET RNA. VGAM2083 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2083 RNA, herein designated VGAM RNA, binds complementarily to one or more host target binding sites located in untranslated regions of VGAM2083 host target RNA, herein designated VGAM HOST TARGET RNA. This complementary binding is due to the fact that the nucleotide sequence of VGAM2083 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2083 RNA, herein designated VGAM RNA, may have a different number of host target binding sites in untranslated regions of a VGAM2083 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2083 RNA, herein designated VGAM RNA, to host target binding sites on VGAM2083 host target RNA, herein designated VGAM HOST TARGET RNA, such as BINDING SITE I, BINDING SITE II and BINDING SITE III, inhibits translation of VGAM2083 host target RNA into VGAM2083 host target protein, herein designated VGAM HOST TARGET PROTEIN. VGAM host target protein is therefore outlined by a broken line.

It is appreciated that VGAM2083 host target gene, herein designated VGAM HOST TARGET GENE, in fact represents a plurality of VGAM2083 host target genes. The mRNA of each one of this plurality of VGAM2083 host target genes comprises one or more host target binding sites, each having a nucleotide sequence which is at least partly complementary to VGAM2083 RNA, herein designated VGAM RNA, and which when bound by VGAM2083 RNA causes inhibition of translation of respective one or more VGAM2083 host target proteins.

It is further appreciated by one skilled in the art that the mode of translational inhibition illustrated by FIG. 1 with specific reference to translational inhibition exerted by VGAM2083 gene, herein designated VGAM GENE, on one or more VGAM2083 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2083 is inhibition of expression of host target genes, as part of a novel viral mechanism of attacking a host. Accordingly, utilities of VGAM2083 include diagnosis, prevention and treatment of viral infection by Camelpox Virus. Specific functions, and accordingly utilities, of VGAM2083 correlate with, and may be deduced from, the identity of the host target genes which VGAM2083 binds and inhibits, and the function of these host target genes, as elaborated hereinbelow.

Nucleotide sequences of the VGAM2083 precursor RNA, herein designated VGAM PRECURSOR RNA, and of the 'diced' VGAM2083 RNA, herein designated VGAM RNA, and a schematic representation of the secondary folding of VGAM2083 folded precursor RNA, herein designated VGAM FOLDED PRECURSOR RNA, of VGAM2083 are further described hereinbelow with reference to Table 1.

Nucleotide sequences of host target binding sites, such as BINDING SITE-I, BINDING SITE-II and BINDING SITE-III of FIG. 1, found on VGAM2083 host target RNA, and schematic representation of the complementarity of each of these host target binding sites to VGAM2083 RNA, herein designated VGAM RNA, are described hereinbelow with reference to Table 2.

As mentioned hereinabove with reference to FIG. 1, a function of VGAM2083 gene, herein designated VGAM is inhibition of expression of VGAM2083 target genes. It is appreciated that specific functions, and accordingly utilities, of VGAM2083 correlate with, and may be deduced from, the identity of the target genes which VGAM2083 binds and inhibits, and the function of these target genes, as elaborated hereinbelow.

CDK2-associated Protein 1 (CDK2AP1, Accession NM_004642) is a VGAM2083 host target gene. CDK2AP1 BINDING SITE is HOST TARGET binding site found in the 3' untranslated region of mRNA encoded by CDK2AP1, corresponding to a HOST TARGET binding site such as BINDING SITE I, BINDING SITE II or BINDING SITE III. Table 2 illustrates the complementarity of the nucleotide sequences of CDK2AP1 BINDING SITE, designated SEQ ID:11017, to the nucleotide sequence of VGAM2083 RNA, herein designated VGAM RNA, also designated SEQ ID:4794.

A function of VGAM2083 is therefore inhibition of CDK2-associated Protein 1 (CDK2AP1, Accession NM_004642), a gene which negatively regulates CDK2 activity. Accordingly, utilities of VGAM2083 include diagnosis, prevention and treatment of diseases and clinical conditions associated with CDK2AP1. The function of CDK2AP1 and its association with various diseases and clinical conditions, has been established by previous studies, as described hereinabove with reference to VGAM1923. UDP-N-acetyl-alpha-D-galactosamine:polypeptide N-acetylgalactosaminyltransferase 7 (GalNAc-T7) (GALNT7, Accession NM_017423) is another VGAM2083 host target gene. GALNT7 BINDING SITE is HOST TARGET binding site found in the 3' untranslated region of mRNA encoded by GALNT7, corresponding to a HOST TARGET binding site such as BINDING SITE I, BINDING SITE II or BINDING SITE III. Table 2 illustrates the complementarity of the nucleotide sequences of GALNT7 BINDING SITE, designated SEQ ID:18876, to the nucleotide sequence of VGAM2083 RNA, herein designated VGAM RNA, also designated SEQ ID:4794.

Another function of VGAM2083 is therefore inhibition of UDP-N-acetyl-alpha-D-galactosamine:polypeptide N-acetylgalactosaminyltransferase 7 (GalNAc-T7) (GALNT7, Accession NM_017423). Accordingly, utilities of VGAM2083 include diagnosis, prevention and treatment of diseases and clinical conditions associated with GALNT7. RAP1 (Accession NM_018975) is another VGAM2083 host target gene. RAP1 BINDING SITE is HOST TARGET binding site found in the 3' untranslated region of mRNA encoded by RAP1, corresponding to a HOST TARGET binding site such as BINDING SITE I, BINDING SITE II or BINDING SITE III. Table 2 illustrates the complementarity of the nucleotide sequences of RAP1 BINDING SITE, designated SEQ ID:21046, to the nucleotide sequence of VGAM2083 RNA, herein designated VGAM RNA, also designated SEQ ID:4794.

Another function of VGAM2083 is therefore inhibition of RAP1 (Accession NM_018975), a gene which is an ortholog of the yeast telomeric protein Rap1 and may be a general characteristic of sequence-specific transcriptional factors. Accordingly, utilities of VGAM2083 include diagnosis, prevention and treatment of diseases and clinical conditions associated with RAP1. The function of RAP1 has been established by previous studies. By performing a yeast 2-hybrid screen on a HeLa cell cDNA library using telomeric repeat-binding factor-2, or TRF2 (TERF2; 602027), as bait, followed by screening a breast cancer cDNA library, Li et al. (2000) isolated a full-length cDNA encoding RAP1, an ortholog of the yeast telomeric protein Rap1. The RAP1 cDNA is identical to the KAIA804 cDNA (GenBank AK000669) reported by the NEDO Japanese sequencing project. The predicted 47-kD RAP1 protein contains 399 amino acids. A motif search revealed that RAP1 has an N-terminal BRCT domain and a central Myb-type helix-turn-helix motif. RAP1 also has an acidic C terminus (amino acids 214 to 382; pI around 3.8) featuring a predicted 33-amino acid coiled-coil region and a bipartite nuclear localization signal. Sequence alignments showed an additional region of sequence similarity in the C termini of yeast and human RAP1 that coincides with the main protein-protein interaction domain of S. cerevisiae Rap1. Thus, human RAP1 has 3 conserved sequence motifs in common with yeast Rap1. Northern blot analysis detected ubiquitous expression of a 2.5-kb RAP1 transcript. The authors found that RAP1 is located at telomeres and affects telomere length. However, while yeast Rap1 binds telomeric DNA directly, human RAP1 is recruited to telomeres by TRF2. Extending the comparison of telomeric proteins to fission yeast, Li et al. (2000) identified the S. pombe Taz1 protein as a TRF ortholog, indicating that TRFs are conserved at eukaryotic telomeres. The data suggested that ancestral telomeres, like those of vertebrates, contained a TRF-like protein as well as RAP1. The authors proposed that budding yeast preserved Rap1 at telomeres but lost the TRF component, possibly concomitant with a change in the telomeric repeat sequence. Lieb et al. (2001) determined the distribution of RAP1 in vivo on the entire yeast genome, at a resolution of 2 kb. RAP1 is central to the cellular economy during rapid growth, targeting 294 loci, about 5% of yeast genes, and participating in the activation of 37% of all RNA polymerase II (see OMIM Ref. No. 180660) initiation events in exponentially growing cells. Although the DNA sequence recognized by RAP1 is found in both coding and intergenic sequences, the binding of RAP1 to the genome was highly specific to intergenic regions with the potential to act as promoters. Lieb et al. (2001) concluded that this global phenomenon, which may be a general characteristic of sequence-specific transcriptional factors, indicates the existence of a genomewide molecular mechanism for marking promoter regions.

Full details of the abovementioned studies are described in the following publications, the disclosure of which are hereby incorporated by reference:

Li, B.; Oestreich, S.; de Lange, T.: Identification of human Rap1: implications for telomere evolution. Cell 101:471-483, 2000; and Lieb, J. D.; Liu, X.; Botstein, D.; Brown, P. O.: Promoter-specific binding of Rap1 revealed by genome-wide maps of protein-DNA association. Nature Genet. 28:327-334, 2001.

Further studies establishing the function and utilities of RAP1 are found in John Hopkins OMIM database record ID 605061, and in sited publications numbered 6797-6798 listed in the bibliography section hereinbelow, which are also hereby incorporated by reference. KIAA1096 (Accession XM_043678) is another VGAM2083 host target gene. KIAA1096 BINDING SITE is HOST TARGET binding site found in the 3' untranslated region of mRNA encoded by KIAA1096, corresponding to a HOST TARGET binding site such as BINDING SITE I, BINDING SITE II or BINDING SITE III. Table 2 illustrates the complementarity of the nucleotide sequences of KIAA1096 BINDING SITE, designated SEQ ID:33998, to the nucleotide sequence of VGAM2083 RNA, herein designated VGAM RNA, also designated SEQ ID:4794.

Another function of VGAM2083 is therefore inhibition of KIAA1096 (Accession XM_043678). Accordingly, utilities of VGAM2083 include diagnosis, prevention and treatment of diseases and clinical conditions associated with KIAA1096. PRO0097 (Accession NM_014114) is another VGAM2083 host target gene. PRO0097 BINDING SITE is HOST TARGET binding site found in the 5' untranslated region of mRNA encoded by PRO0097, corresponding to a HOST TARGET binding site such as BINDING SITE I, BINDING SITE II or BINDING SITE III. Table 2 illustrates the complementarity of the nucleotide sequences of PRO0097 BINDING SITE, designated SEQ ID:15367, to the nucleotide sequence of VGAM2083 RNA, herein designated VGAM RNA, also designated SEQ ID:4794.

Another function of VGAM2083 is therefore inhibition of PRO0097 (Accession NM_014114). Accordingly, utilities of VGAM2083 include diagnosis, prevention and treatment of diseases and clinical conditions associated with PRO0097. LOC255196 (Accession XM_173157) is another VGAM2083 host target gene. LOC255196 BINDING SITE is HOST TARGET binding site found in the 5' untranslated region of mRNA encoded by LOC255196, corresponding to a HOST TARGET binding site such as BINDING SITE I, BINDING SITE II or BINDING SITE III. Table 2 illustrates the complementarity of the nucleotide sequences of LOC255196 BINDING SITE, designated SEQ ID:46416, to the nucleotide sequence of VGAM2083 RNA, herein designated VGAM RNA, also designated SEQ ID:4794.

Another function of VGAM2083 is therefore inhibition of LOC255196 (Accession XM_173157). Accordingly, utilities of VGAM2083 include diagnosis, prevention and treatment of diseases and clinical conditions associated with LOC255196. FIG. 1 further provides a conceptual description of a novel bioinformatically detected viral gene of the present invention, referred to here as Viral Genomic Address Messenger 2084 (VGAM2084) viral gene, which modulates expression of respective host target genes thereof, the function and utility of which host target genes is known in the art.

VGAM2084 is a novel bioinformatically detected regulatory, non protein coding, viral micro RNA (miRNA) gene. The method by which VGAM2084 was detected is described hereinabove with reference to FIGS. 1-8.

VGAM2084 gene, herein designated VGAM GENE, is a viral gene contained in the genome of Variola Virus. VGAM2084 host target gene, herein designated VGAM HOST TARGET GENE, is a human gene contained in the human genome.

VGAM2084 gene encodes a VGAM2084 precursor RNA, herein designated VGAM PRECURSOR RNA. Similar to other miRNA genes, and unlike most ordinary genes, VGAM2084 precursor RNA does not encode a protein. A nucleotide sequence identical or highly similar to the nucleotide sequence of VGAM2084 precursor RNA is designated SEQ ID:2070, and is provided hereinbelow with reference to the sequence listing part. Nucleotide sequence SEQ ID:2070 is located at position 170712 relative to the genome of Variola Virus.

VGAM2084 precursor RNA folds onto itself, forming VGAM2084 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2084 folded precursor RNA into VGAM2084 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM2084 RNA is designated SEQ ID:4795, and is provided hereinbelow with reference to the sequence listing part.

VGAM2084 host target gene, herein designated VGAM HOST TARGET GENE, encodes a corresponding messenger RNA, VGAM2084 host target RNA, herein designated VGAM HOST TARGET RNA. VGAM2084 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2084 RNA, herein designated VGAM RNA, binds complementarily to one or more host target binding sites located in untranslated regions of VGAM2084 host target RNA, herein designated VGAM HOST TARGET RNA. This complementary binding is due to the fact that the nucleotide sequence of VGAM2084 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2084 RNA, herein designated VGAM RNA, may have a different number of host target binding sites in untranslated regions of a VGAM2084 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2084 RNA, herein designated VGAM RNA, to host target binding sites on VGAM2084 host target RNA, herein designated VGAM HOST TARGET RNA, such as BINDING SITE I, BINDING SITE II and BINDING SITE III, inhibits translation of VGAM2084 host target RNA into VGAM2084 host target protein, herein designated VGAM HOST TARGET PROTEIN. VGAM host target protein is therefore outlined by a broken line.

It is appreciated that VGAM2084 host target gene, herein designated VGAM HOST TARGET GENE, in fact represents a plurality of VGAM2084 host target genes. The mRNA of each one of this plurality of VGAM2084 host target genes comprises one or more host target binding sites, each having a nucleotide sequence which is at least partly complementary to VGAM2084 RNA, herein designated VGAM RNA, and which when bound by VGAM2084 RNA causes inhibition of translation of respective one or more VGAM2084 host target proteins.

It is further appreciated by one skilled in the art that the mode of translational inhibition illustrated by FIG. 1 with specific reference to translational inhibition exerted by VGAM2084 gene, herein designated VGAM GENE, on one or more VGAM2084 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2084 is inhibition of expression of host target genes, as part of a novel viral mechanism of attacking a host. Accordingly, utilities of VGAM2084 include diagnosis, prevention and treatment of viral infection by Variola Virus. Specific functions, and accordingly utilities, of VGAM2084 correlate with, and may be deduced from, the identity of the host target genes which VGAM2084 binds and inhibits, and the function of these host target genes, as elaborated hereinbelow.

Nucleotide sequences of the VGAM2084 precursor RNA, herein designated VGAM PRECURSOR RNA, and of the 'diced' VGAM2084 RNA, herein designated VGAM RNA, and a schematic representation of the secondary folding of VGAM2084 folded precursor RNA, herein designated VGAM FOLDED PRECURSOR RNA, of VGAM2084 are further described hereinbelow with reference to Table 1.

Nucleotide sequences of host target binding sites, such as BINDING SITE-I, BINDING SITE-II and BINDING SITE-III of FIG. 1, found on VGAM2084 host target RNA, and schematic representation of the complementarity of each of these host target binding sites to VGAM2084 RNA, herein designated VGAM RNA, are described hereinbelow with reference to Table 2.

As mentioned hereinabove with reference to FIG. 1, a function of VGAM2084 gene, herein designated VGAM is inhibition of expression of VGAM2084 target genes. It is appreciated that specific functions, and accordingly utilities, of VGAM2084 correlate with, and may be deduced from, the identity of the target genes which VGAM2084 binds and inhibits, and the function of these target genes, as elaborated hereinbelow.

Cytochrome P450, Subfamily I (dioxin-inducible), Polypeptide 1 (glaucoma 3, primary infantile) (CYP1B1, Accession NM_000104) is a VGAM2084 host target gene. CYP1B1 BINDING SITE is HOST TARGET binding site found in the 3' untranslated region of mRNA encoded by CYP1B1, corresponding to a HOST TARGET binding site such as BINDING SITE I, BINDING SITE II or BINDING SITE III. Table 2 illustrates the complementarity of the nucleotide sequences of CYP1B1 BINDING SITE, designated SEQ ID:5566, to the nucleotide sequence of VGAM2084 RNA, herein designated VGAM RNA, also designated SEQ ID:4795.

A function of VGAM2084 is therefore inhibition of Cytochrome P450, Subfamily I (dioxin-inducible), Polypeptide 1 (glaucoma 3, primary infantile) (CYP1B1, Accession NM_000104), a gene which participates in the metabolism of a molecule that is a participant in eye development. Accordingly, utilities of VGAM2084 include diagnosis, prevention and treatment of diseases and clinical conditions associated with CYP1B1. The function of CYP1B1 and its association with various diseases and clinical conditions, has been established by previous studies, as described hereinabove with reference to VGAM894. FLJ14803 (Accession NM_032842) is another VGAM2084 host target gene. FLJ14803 BINDING SITE is HOST TARGET binding site found in the 3' untranslated region of mRNA encoded by FLJ14803, corresponding to a HOST TARGET binding site such as BINDING SITE I, BINDING SITE II or BINDING SITE III. Table 2 illustrates the complementarity of the nucleotide sequences of FLJ14803 BINDING SITE, designated SEQ ID:26628, to the nucleotide sequence of VGAM2084 RNA, herein designated VGAM RNA, also designated SEQ ID:4795.

Another function of VGAM2084 is therefore inhibition of FLJ14803 (Accession NM_032842). Accordingly, utilities of VGAM2084 include diagnosis, prevention and treatment of diseases and clinical conditions associated with FLJ14803.

Protein Tyrosine Kinase 9 (PTK9, Accession NM_002822) is another VGAM2084 host target gene. PTK9 BINDING SITE is HOST TARGET binding site found in the 3' untranslated region of mRNA encoded by PTK9, corresponding to a HOST TARGET binding site such as BINDING SITE I, BINDING SITE II or BINDING SITE III. Table 2 illustrates the complementarity of the nucleotide sequences of PTK9 BINDING SITE, designated SEQ ID:8690, to the nucleotide sequence of VGAM2084 RNA, herein designated VGAM RNA, also designated SEQ ID:4795.

Another function of VGAM2084 is therefore inhibition of Protein Tyrosine Kinase 9 (PTK9, Accession NM_002822). Accordingly, utilities of VGAM2084 include diagnosis, prevention and treatment of diseases and clinical conditions associated with PTK9. LOC122773 (Accession XM_058665) is another VGAM2084 host target gene. LOC122773 BINDING SITE is HOST TARGET binding site found in the 3' untranslated region of mRNA encoded by LOC122773, corresponding to a HOST TARGET binding site such as BINDING SITE I, BINDING SITE II or BINDING SITE III. Table 2 illustrates the complementarity of the nucleotide sequences of LOC122773 BINDING SITE, designated SEQ ID:36711, to the nucleotide sequence of VGAM2084 RNA, herein designated VGAM RNA, also designated SEQ ID:4795.

Another function of VGAM2084 is therefore inhibition of LOC122773 (Accession XM_058665). Accordingly, utilities of VGAM2084 include diagnosis, prevention and treatment of diseases and clinical conditions associated with LOC122773. FIG. 1 further provides a conceptual description of a novel bioinformatically detected viral gene of the present invention, referred to here as Viral Genomic Address Messenger 2085 (VGAM2085) viral gene, which modulates expression of respective host target genes thereof, the function and utility of which host target genes is known in the art.

VGAM2085 is a novel bioinformatically detected regulatory, non protein coding, viral micro RNA (miRNA) gene. The method by which VGAM2085 was detected is described hereinabove with reference to FIGS. 1-8.

VGAM2085 gene, herein designated VGAM GENE, is a viral gene contained in the genome of Fowlpox Virus. VGAM2085 host target gene, herein designated VGAM HOST TARGET GENE, is a human gene contained in the human genome.

VGAM2085 gene encodes a VGAM2085 precursor RNA, herein designated VGAM PRECURSOR RNA. Similar to other miRNA genes, and unlike most ordinary genes, VGAM2085 precursor RNA does not encode a protein. A nucleotide sequence identical or highly similar to the nucleotide sequence of VGAM2085 precursor RNA is designated SEQ ID:2071, and is provided hereinbelow with reference to the sequence listing part. Nucleotide sequence SEQ ID:2071 is located at position 96465 relative to the genome of Fowlpox Virus.

VGAM2085 precursor RNA folds onto itself, forming VGAM2085 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2085 folded precursor RNA into VGAM2085 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM2085 RNA is designated SEQ ID:4796, and is provided hereinbelow with reference to the sequence listing part.

VGAM2085 host target gene, herein designated VGAM HOST TARGET GENE, encodes a corresponding messenger RNA, VGAM2085 host target RNA, herein designated VGAM HOST TARGET RNA. VGAM2085 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2085 RNA, herein designated VGAM RNA, binds complementarily to one or more host target binding sites located in untranslated regions of VGAM2085 host target RNA, herein designated VGAM HOST TARGET RNA. This complementary binding is due to the fact that the nucleotide sequence of VGAM2085 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2085 RNA, herein designated VGAM RNA, may have a different number of host target binding sites in untranslated regions of a VGAM2085 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2085 RNA, herein designated VGAM RNA, to host target binding sites on VGAM2085 host target RNA, herein designated VGAM HOST TARGET RNA, such as BINDING SITE I, BINDING SITE II and BINDING SITE III, inhibits translation of VGAM2085 host target RNA into VGAM2085 host target protein, herein designated VGAM HOST TARGET PROTEIN. VGAM host target protein is therefore outlined by a broken line.

It is appreciated that VGAM2085 host target gene, herein designated VGAM HOST TARGET GENE, in fact represents a plurality of VGAM2085 host target genes. The mRNA of each one of this plurality of VGAM2085 host target genes comprises one or more host target binding sites, each having a nucleotide sequence which is at least partly complementary to VGAM2085 RNA, herein designated VGAM RNA, and which when bound by VGAM2085 RNA causes inhibition of translation of respective one or more VGAM2085 host target proteins.

It is further appreciated by one skilled in the art that the mode of translational inhibition illustrated by FIG. 1 with specific reference to translational inhibition exerted by VGAM2085 gene, herein designated VGAM GENE, on one or more VGAM2085 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2085 is inhibition of expression of host target genes, as part of a novel viral mechanism of attacking a host. Accordingly, utilities of VGAM2085 include diagnosis, prevention and treatment of viral infection by Fowlpox Virus. Specific functions, and accordingly utilities, of VGAM2085 correlate with, and may be deduced from, the identity of the host target genes which VGAM2085 binds and inhibits, and the function of these host target genes, as elaborated hereinbelow.

Nucleotide sequences of the VGAM2085 precursor RNA, herein designated VGAM PRECURSOR RNA, and of the 'diced' VGAM2085 RNA, herein designated VGAM RNA, and a schematic representation of the secondary folding of VGAM2085 folded precursor RNA, herein designated VGAM FOLDED PRECURSOR RNA, of VGAM2085 are further described hereinbelow with reference to Table 1.

Nucleotide sequences of host target binding sites, such as BINDING SITE-I, BINDING SITE-II and BINDING SITE-III of FIG. 1, found on VGAM2085 host target RNA, and schematic representation of the complementarity of each of these host target binding sites to VGAM2085 RNA, herein designated VGAM RNA, are described hereinbelow with reference to Table 2.

As mentioned hereinabove with reference to FIG. 1, a function of VGAM2085 gene, herein designated VGAM is inhibition of expression of VGAM2085 target genes. It is appreciated that specific functions, and accordingly utilities, of VGAM2085 correlate with, and may be deduced from, the identity of the target genes which VGAM2085 binds and inhibits, and the function of these target genes, as elaborated hereinbelow.

Testis Specific Protein, Y-linked (TSPY, Accession XM_088755) is a VGAM2085 host target gene. TSPY BINDING SITE is HOST TARGET binding site found in the 3' untranslated region of mRNA encoded by TSPY, corresponding to a HOST TARGET binding site such as BINDING SITE I, BINDING SITE II or BINDING SITE III. Table 2 illustrates the complementarity of the nucleotide sequences of TSPY BINDING SITE, designated SEQ ID:39944, to the nucleotide sequence of VGAM2085 RNA, herein designated VGAM RNA, also designated SEQ ID:4796.

A function of VGAM2085 is therefore inhibition of Testis Specific Protein, Y-linked (TSPY, Accession XM_088755), a gene which may be involved in sperm differentiation. Accordingly, utilities of VGAM2085 include diagnosis, prevention and treatment of diseases and clinical conditions associated with TSPY. The function of TSPY has been established by previous studies. Schnieders et al. (1996) reported that TSPY gives rise to a pool of heterogeneously composed transcripts, at least 1 of which yields a protein that is a member of a superfamily including the proto-oncogene SET (OMIM Ref. No. 600960) and NAP1 (OMIM Ref. No. 164060), a nucleosome assembly factor. Immunohistological studies reported by Schnieders et al. (1996) revealed that TSPY is concentrated in the cytoplasm of spermatogonia in normal as well as in pathological tissue. They further reported that TSPY was found in the early forms of seminomatous testicular tumors. The authors suggested that TSPY function is related to spermatogonial proliferation in a phosphorylation-dependent manner Lau (1999) discussed the possible role of the TSPY gene in gonadoblastoma (GBY; 424500) and in testicular and prostate cancers. His FIG. 1 presented an updated map of genes assigned to the Y chromosome.

Full details of the abovementioned studies are described in the following publications, the disclosure of which are hereby incorporated by reference:

Schnieders, F.; Dork, T.; Arnemann, J.; Vogel, T.; Werner, M.; Schmidtke, J.: Testis-specific protein, Y-encoded (TSPY) expression in testicular tissues. Hum. Molec. Genet. 5:1801-1807, 1996; and Lau, Y.-F. C.: Sex chromosome genetics '99: gonadoblastoma, testicular and prostate cancers, and the TSPY gene. Am. J. Hum. Genet. 64:921-927, 1999.

Further studies establishing the function and utilities of TSPY are found in John Hopkins OMIM database record ID 480100, and in sited publications numbered 8307-8316 listed in the bibliography section hereinbelow, which are also hereby incorporated by reference. Death-associated Protein Kinase 2 (DAPK2, Accession NM_014326) is another VGAM2085 host target gene. DAPK2 BINDING SITE is HOST TARGET binding site found in the 3' untranslated region of mRNA encoded by DAPK2, corresponding to a HOST TARGET binding site such as BINDING SITE I, BINDING SITE II or BINDING SITE III. Table 2 illustrates the complementarity of the nucleotide sequences of DAPK2 BINDING SITE, designated SEQ ID:15631, to the nucleotide sequence of VGAM2085 RNA, herein designated VGAM RNA, also designated SEQ ID:4796.

Another function of VGAM2085 is therefore inhibition of Death-associated Protein Kinase 2 (DAPK2, Accession NM_014326). Accordingly, utilities of VGAM2085 include diagnosis, prevention and treatment of diseases and clinical conditions associated with DAPK2. LOC120856 (Accession XM_058509) is another VGAM2085 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36630, to the nucleotide sequence of VGAM2085 RNA, herein designated VGAM RNA, also designated SEQ ID:4796.

Another function of VGAM2085 is therefore inhibition of LOC120856 (Accession XM_058509). Accordingly, utilities of VGAM2085 include diagnosis, prevention and treatment of diseases and clinical conditions associated with LOC120856. FIG. 1 further provides a conceptual description of a novel bioinformatically detected viral gene of the present invention, referred to here as Viral Genomic Address Messenger 2086 (VGAM2086) viral gene, which modulates expression of respective host target genes thereof, the function and utility of which host target genes is known in the art.

VGAM2086 is a novel bioinformatically detected regulatory, non protein coding, viral micro RNA (miRNA) gene. The method by which VGAM2086 was detected is described hereinabove with reference to FIGS. 1-8.

VGAM2086 gene, herein designated VGAM GENE, is a viral gene contained in the genome of Fowlpox Virus. VGAM2086 host target gene, herein designated VGAM HOST TARGET GENE, is a human gene contained in the human genome.

VGAM2086 gene encodes a VGAM2086 precursor RNA, herein designated VGAM PRECURSOR RNA. Similar to other miRNA genes, and unlike most ordinary genes, VGAM2086 precursor RNA does not encode a protein. A nucleotide sequence identical or highly similar to the nucleotide sequence of VGAM2086 precursor RNA is designated SEQ ID:2072, and is provided hereinbelow with reference to the sequence listing part. Nucleotide sequence SEQ ID:2072 is located at position 106213 relative to the genome of Fowlpox Virus.

VGAM2086 precursor RNA folds onto itself, forming VGAM2086 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2086 folded precursor RNA into VGAM2086 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2086 RNA is designated SEQ ID:4797, and is provided hereinbelow with reference to the sequence listing part.

VGAM2086 host target gene, herein designated VGAM HOST TARGET GENE, encodes a corresponding messenger RNA, VGAM2086 host target RNA, herein designated VGAM HOST TARGET RNA. VGAM2086 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2086 RNA, herein designated VGAM RNA, binds complementarily to one or more host target binding sites located in untranslated regions of VGAM2086 host target RNA, herein designated VGAM HOST TARGET RNA. This complementary binding is due to the fact that the nucleotide sequence of VGAM2086 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2086 RNA, herein designated VGAM RNA, may have a different number of host target binding sites in untranslated regions of a VGAM2086 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2086 RNA, herein designated VGAM RNA, to host target binding sites on VGAM2086 host target RNA, herein designated VGAM HOST TARGET RNA, such as BINDING SITE I, BINDING SITE II and BINDING SITE III, inhibits translation of VGAM2086 host target RNA into VGAM2086 host target protein, herein designated VGAM HOST TARGET PROTEIN. VGAM host target protein is therefore outlined by a broken line.

It is appreciated that VGAM2086 host target gene, herein designated VGAM HOST TARGET GENE, in fact represents a plurality of VGAM2086 host target genes. The mRNA of each one of this plurality of VGAM2086 host target genes comprises one or more host target binding sites, each having a nucleotide sequence which is at least partly complementary to VGAM2086 RNA, herein designated VGAM RNA, and which when bound by VGAM2086 RNA causes inhibition of translation of respective one or more VGAM2086 host target proteins.

It is further appreciated by one skilled in the art that the mode of translational inhibition illustrated by FIG. 1 with specific reference to translational inhibition exerted by VGAM2086 gene, herein designated VGAM GENE, on one or more VGAM2086 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2086 is inhibition of expression of host target genes, as part of a novel viral mechanism of attacking a host. Accordingly, utilities of VGAM2086 include diagnosis, prevention and treatment of viral infection by Fowlpox Virus. Specific functions, and accordingly utilities, of VGAM2086 correlate with, and may be deduced from, the identity of the host target genes which VGAM2086 binds and inhibits, and the function of these host target genes, as elaborated hereinbelow.

Nucleotide sequences of the VGAM2086 precursor RNA, herein designated VGAM PRECURSOR RNA, and of the 'diced' VGAM2086 RNA, herein designated VGAM RNA, and a schematic representation of the secondary folding of VGAM2086 folded precursor RNA, herein designated VGAM FOLDED PRECURSOR RNA, of VGAM2086 are further described hereinbelow with reference to Table 1.

Nucleotide sequences of host target binding sites, such as BINDING SITE-I, BINDING SITE-II and BINDING SITE-III of FIG. 1, found on VGAM2086 host target RNA, and schematic representation of the complementarity of each of these host target binding sites to VGAM2086 RNA, herein designated VGAM RNA, are described hereinbelow with reference to Table 2.

As mentioned hereinabove with reference to FIG. 1, a function of VGAM2086 gene, herein designated VGAM is inhibition of expression of VGAM2086 target genes. It is appreciated that specific functions, and accordingly utilities, of VGAM2086 correlate with, and may be deduced from, the identity of the target genes which VGAM2086 binds and inhibits, and the function of these target genes, as elaborated hereinbelow.

Brain and Acute Leukemia, Cytoplasmic (BAALC, Accession NM_024812) is a VGAM2086 host target gene. BAALC BINDING SITE is HOST TARGET binding site found in the 3' untranslated region of mRNA encoded by BAALC, corresponding to a HOST TARGET binding site such as BINDING SITE I, BINDING SITE II or BINDING SITE III. Table 2 illustrates the complementarity of the nucleotide sequences of BAALC BINDING SITE, designated SEQ ID:24194, to the nucleotide sequence of VGAM2086 RNA, herein designated VGAM RNA, also designated SEQ ID:4797.

A function of VGAM2086 is therefore inhibition of Brain and Acute Leukemia, Cytoplasmic (BAALC, Accession NM_024812). Accordingly, utilities of VGAM2086 include diagnosis, prevention and treatment of diseases and clinical conditions associated with BAALC. Neuronal Pentraxin I (NPTX1, Accession NM_002522) is another VGAM2086 host target gene. NPTX1 BINDING SITE is HOST TARGET binding site found in the 3' untranslated region of mRNA encoded by NPTX1, corresponding to a HOST TARGET binding site such as BINDING SITE I, BINDING SITE II or BINDING SITE III. Table 2 illustrates the complementarity of the nucleotide sequences of NPTX1 BINDING SITE, designated SEQ ID:8358, to the nucleotide sequence of VGAM2086 RNA, herein designated VGAM RNA, also designated SEQ ID:4797.

Another function of VGAM2086 is therefore inhibition of Neuronal Pentraxin I (NPTX1, Accession NM_002522), a gene which may be involved in synaptic uptake of extracellular material and is very strongly similar to rat NP1. Accordingly, utilities of VGAM2086 include diagnosis, prevention and treatment of diseases and clinical conditions associated with NPTX1. The function of NPTX1 and its association with various diseases and clinical conditions, has been established by previous studies, as described hereinabove with reference to VGAM111. BART1 (Accession NM_012106) is another VGAM2086 host target gene. BART1 BINDING SITE is HOST TARGET binding site found in the 3' untranslated region of mRNA encoded by BART1, corresponding to a HOST TARGET binding site such as BINDING SITE I, BINDING SITE II or BINDING SITE III. Table 2 illustrates the complementarity of the nucleotide sequences of BART1 BINDING SITE, designated SEQ ID:14425, to the nucleotide sequence of VGAM2086 RNA, herein designated VGAM RNA, also designated SEQ ID:4797.

Another function of VGAM2086 is therefore inhibition of BART1 (Accession NM_012106). Accordingly, utilities of VGAM2086 include diagnosis, prevention and treatment of diseases and clinical conditions associated with BART1. KIAA0871 (Accession NM_014961) is another VGAM2086 host target gene. KIAA0871 BINDING SITE is HOST TARGET binding site found in the 3' untranslated region of mRNA encoded by KIAA0871, corresponding to a HOST TARGET binding site such as BINDING SITE I, BINDING SITE II or BINDING SITE III. Table 2 illustrates the complementarity of the nucleotide sequences of KIAA0871 BINDING SITE, designated SEQ ID:17334, to the nucleotide sequence of VGAM2086 RNA, herein designated VGAM RNA, also designated SEQ ID:4797.

Another function of VGAM2086 is therefore inhibition of KIAA0871 (Accession NM_014961). Accordingly, utilities of VGAM2086 include diagnosis, prevention and treatment of diseases and clinical conditions associated with KIAA0871. KIAA0984 (Accession XM_037557) is another VGAM2086 host target gene. KIAA0984 BINDING SITE is HOST TARGET binding site found in the 3' untranslated region of mRNA encoded by KIAA0984, corresponding to a HOST TARGET binding site such as BINDING SITE I, BINDING SITE II or BINDING SITE III. Table 2 illustrates the complementarity of the nucleotide sequences of KIAA0984 BINDING SITE, designated SEQ ID:32645, to the nucleotide sequence of VGAM2086 RNA, herein designated VGAM RNA, also designated SEQ ID:4797.

Another function of VGAM2086 is therefore inhibition of KIAA0984 (Accession XM_037557). Accordingly, utilities of VGAM2086 include diagnosis, prevention and treatment of diseases and clinical conditions associated with KIAA0984. MGC11242 (Accession NM_024320) is another VGAM2086 host target gene. MGC11242 BINDING SITE is HOST TARGET binding site found in the 3' untranslated region of mRNA encoded by MGC11242, corresponding to a HOST TARGET binding site such as BINDING SITE I, BINDING SITE II or BINDING SITE III. Table 2 illustrates the complementarity of the nucleotide sequences of MGC11242 BINDING SITE, designated SEQ ID:23609, to the nucleotide sequence of VGAM2086 RNA, herein designated VGAM RNA, also designated SEQ ID:4797.

Another function of VGAM2086 is therefore inhibition of MGC11242 (Accession NM_024320). Accordingly, utilities of VGAM2086 include diagnosis, prevention and treatment of diseases and clinical conditions associated with MGC11242. Synovial Sarcoma Translocation Gene On Chromosome 18-like 1 (SS18L1, Accession XM_037202) is another VGAM2086 host target gene. SS18L1 BINDING SITE is HOST TARGET binding site found in the 3' untranslated region of mRNA encoded by SS18L1, corresponding to a HOST TARGET binding site such as BINDING SITE I, BINDING SITE II or BINDING SITE III. Table 2 illustrates the complementarity of the nucleotide sequences of SS18L1 BINDING SITE, designated SEQ ID:32564, to the nucleotide sequence of VGAM2086 RNA, herein designated VGAM RNA, also designated SEQ ID:4797.

Another function of VGAM2086 is therefore inhibition of Synovial Sarcoma Translocation Gene On Chromosome 18-like 1 (SS18L1, Accession XM_037202). Accordingly, utilities of VGAM2086 include diagnosis, prevention and treatment of diseases and clinical conditions associated with SS18L1. LOC134553 (Accession XM_059723) is another VGAM2086 host target gene. LOC134553 BINDING SITE is HOST TARGET binding site found in the 3' untranslated region of mRNA encoded by LOC134553, corresponding to a HOST TARGET binding site such as BINDING SITE I, BINDING SITE II or BINDING SITE III. Table 2 illustrates the complementarity of the nucleotide sequences of LOC134553 BINDING SITE, designated SEQ ID:37076, to the nucleotide sequence of VGAM2086 RNA, herein designated VGAM RNA, also designated SEQ ID:4797.

Another function of VGAM2086 is therefore inhibition of LOC134553 (Accession XM_059723). Accordingly, utilities of VGAM2086 include diagnosis, prevention and treatment of diseases and clinical conditions associated with LOC134553. LOC165552 (Accession XM_092666) is another VGAM2086 host target gene. LOC165552 BINDING SITE is HOST TARGET binding site found in the 3' untranslated region of mRNA encoded by LOC165552, corresponding to a HOST TARGET binding site such as BINDING SITE I, BINDING SITE II or BINDING SITE III. Table 2 illustrates the complementarity of the nucleotide sequences of LOC165552 BINDING SITE, designated SEQ ID:40133, to the nucleotide sequence of VGAM2086 RNA, herein designated VGAM RNA, also designated SEQ ID:4797.

Another function of VGAM2086 is therefore inhibition of LOC165552 (Accession XM_092666). Accordingly, utilities of VGAM2086 include diagnosis, prevention and treatment of diseases and clinical conditions associated with LOC165552. FIG. 1 further provides a conceptual description of a novel bioinformatically detected viral gene of the present invention, referred to here as Viral Genomic Address Messenger 2087 (VGAM2087) viral gene, which modulates expression of respective host target genes thereof, the function and utility of which host target genes is known in the art.

VGAM2087 is a novel bioinformatically detected regulatory, non protein coding, viral micro RNA (miRNA) gene. The method by which VGAM2087 was detected is described hereinabove with reference to FIGS. 1-8.

VGAM2087 gene, herein designated VGAM GENE, is a viral gene contained in the genome of Fowlpox Virus. VGAM2087 host target gene, herein designated VGAM HOST TARGET GENE, is a human gene contained in the human genome.

VGAM2087 gene encodes a VGAM2087 precursor RNA, herein designated VGAM PRECURSOR RNA. Similar to other miRNA genes, and unlike most ordinary genes, VGAM2087 precursor RNA does not encode a protein. A nucleotide sequence identical or highly similar to the nucleotide sequence of VGAM2087 precursor RNA is designated SEQ ID:2073, and is provided hereinbelow with reference to the sequence listing part. Nucleotide sequence SEQ ID:2073 is located at position 115039 relative to the genome of Fowlpox Virus.

VGAM2087 precursor RNA folds onto itself, forming VGAM2087 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2087 folded precursor RNA into VGAM2087 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM2087 RNA is designated SEQ ID:4798, and is provided hereinbelow with reference to the sequence listing part.

VGAM2087 host target gene, herein designated VGAM HOST TARGET GENE, encodes a corresponding messenger RNA, VGAM2087 host target RNA, herein designated VGAM HOST TARGET RNA. VGAM2087 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2087 RNA, herein designated VGAM RNA, binds complementarily to one or more host target binding sites located in untranslated regions of VGAM2087 host target RNA, herein designated VGAM HOST TARGET RNA. This complementary binding is due to the fact that the nucleotide sequence of VGAM2087 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2087 RNA, herein designated VGAM RNA, may have a different number of host target binding sites in untranslated regions of a VGAM2087 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2087 RNA, herein designated VGAM RNA, to host target binding sites on VGAM2087 host target RNA, herein designated VGAM HOST TARGET RNA, such as BINDING SITE I, BINDING SITE II and BINDING SITE III, inhibits translation of VGAM2087 host target RNA into VGAM2087 host target protein, herein designated VGAM HOST TARGET PROTEIN. VGAM host target protein is therefore outlined by a broken line.

It is appreciated that VGAM2087 host target gene, herein designated VGAM HOST TARGET GENE, in fact represents a plurality of VGAM2087 host target genes. The mRNA of each one of this plurality of VGAM2087 host target genes comprises one or more host target binding sites, each having a nucleotide sequence which is at least partly complementary to VGAM2087 RNA, herein designated VGAM RNA, and which when bound by VGAM2087 RNA causes inhibition of translation of respective one or more VGAM2087 host target proteins.

It is further appreciated by one skilled in the art that the mode of translational inhibition illustrated by FIG. 1 with specific reference to translational inhibition exerted by VGAM2087 gene, herein designated VGAM GENE, on one or more VGAM2087 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2087 is inhibition of expression of host target genes, as part of a novel viral mechanism of attacking a host. Accordingly, utilities of VGAM2087 include diagnosis, prevention and treatment of viral infection by Fowlpox Virus. Specific functions, and accordingly utilities, of VGAM2087 correlate with, and may be deduced from, the identity of the host target genes which VGAM2087 binds and inhibits, and the function of these host target genes, as elaborated hereinbelow.

Nucleotide sequences of the VGAM2087 precursor RNA, herein designated VGAM PRECURSOR RNA, and of the 'diced' VGAM2087 RNA, herein designated VGAM RNA, and a schematic representation of the secondary folding of VGAM2087 folded precursor RNA, herein designated VGAM FOLDED PRECURSOR RNA, of VGAM2087 are further described hereinbelow with reference to Table 1.

Nucleotide sequences of host target binding sites, such as BINDING SITE-I, BINDING SITE-II and BINDING SITE-III of FIG. 1, found on VGAM2087 host target RNA, and schematic representation of the complementarity of each of these host target binding sites to VGAM2087 RNA, herein designated VGAM RNA, are described hereinbelow with reference to Table 2.

As mentioned hereinabove with reference to FIG. 1, a function of VGAM2087 gene, herein designated VGAM is inhibition of expression of VGAM2087 target genes. It is appreciated that specific functions, and accordingly utilities, of VGAM2087 correlate with, and may be deduced from, the identity of the target genes which VGAM2087 binds and inhibits, and the function of these target genes, as elaborated hereinbelow.

AF3P21 (Accession NM_016453) is a VGAM2087 host target gene. AF3P21 BINDING SITE is HOST TARGET binding site found in the 3' untranslated region of mRNA encoded by AF3P21, corresponding to a HOST TARGET binding site such as BINDING SITE I, BINDING SITE II or BINDING SITE III. Table 2 illustrates the complementarity of the nucleotide sequences of AF3P21 BINDING SITE, designated SEQ ID:18567, to the nucleotide sequence of VGAM2087 RNA, herein designated VGAM RNA, also designated SEQ ID:4798.

A function of VGAM2087 is therefore inhibition of AF3P21 (Accession NM_016453), a gene which has an important role in stress fiber formation induced by active diaphanous protein homolog 1 (drf1). Accordingly, utilities of VGAM2087 include diagnosis, prevention and treatment of diseases and clinical conditions associated with AF3P21. The function of AF3P21 and its association with various diseases and clinical conditions, has been established by previous studies, as described hereinabove with reference to VGAM1280. Glucagon-like Peptide 1 Receptor (GLP1R, Accession NM_002062) is another VGAM2087 host target gene. GLP1R BINDING SITE is HOST TARGET binding site found in the 3' untranslated region of mRNA encoded by GLP1R, corresponding to a HOST TARGET binding site such as BINDING SITE I, BINDING SITE II or BINDING SITE III. Table 2 illustrates the complementarity of the nucleotide sequences of GLP1R BINDING SITE, designated SEQ ID:7827, to the nucleotide sequence of VGAM2087 RNA, herein designated VGAM RNA, also designated SEQ ID:4798.

Another function of VGAM2087 is therefore inhibition of Glucagon-like Peptide 1 Receptor (GLP1R, Accession NM_002062), a gene which is mediated by g proteins which activate adenylyl cyclase. Accordingly, utilities of VGAM2087 include diagnosis, prevention and treatment of diseases and clinical conditions associated with GLP1R. The function of GLP1R and its association with various diseases and clinical conditions, has been established by previous studies, as described hereinabove with reference to VGAM1652. G Protein-coupled Receptor 4 (GPR4, Accession XM_009140) is another VGAM2087 host target gene. GPR4 BINDING SITE is HOST TARGET binding site found in the 5' untranslated region of mRNA encoded by GPR4, corresponding to a HOST TARGET binding site such as BINDING SITE I, BINDING SITE II or BINDING SITE III. Table 2 illustrates the complementarity of the nucleotide sequences of GPR4 BINDING SITE, designated SEQ ID:30100, to the nucleotide sequence of VGAM2087 RNA, herein designated VGAM RNA, also designated SEQ ID:4798.

Another function of VGAM2087 is therefore inhibition of G Protein-coupled Receptor 4 (GPR4, Accession XM_009140), a gene which stimulates to produce increased calcium by both SPC and LPC. Accordingly, utilities of VGAM2087 include diagnosis, prevention and treatment of diseases and clinical conditions associated with GPR4. The function of GPR4 has been established by previous studies. Many cell membrane receptors are members of the G protein-coupled receptor (GPR) family. GPRs are characterized by the presence of 7 transmembrane domains and numerous conserved amino acids. Using degenerate PCR, Heiber et al. (1995) identified additional members of this family. Among these was GPR4, which encodes a putative 355-amino acid protein and was selected from a genomic DNA library using the PCR-derived product as a probe. GPR4 shares the greatest sequence similarity with the human platelet-activating factor receptor (Ye et al., 1991). GPR4 is more than 50% identical to OGR1 (GPR68; 601404), a high-affinity receptor for the sphingosylphosphorylcholine (SPC) signaling molecule. Zhu et al. (2001) showed that cells expressing GPR4 are stimulated to produce increased calcium by both SPC and LPC (lysophosphatidylcholine), a ligand for G2A (OMIM Ref. No. 606167). RNA dot blot analysis revealed highest expression of GPR4 in ovary, liver, lung, kidney, lymph node, and subthalamic nucleus; in contrast, OGR1 is most highly expressed in lung, placenta, spleen, testis, small intestine, and peripheral blood leukocytes. Binding analysis determined that GPR4 interacts with SPC with high affinity and with LPC with lower affinity. Both ligands enhanced proliferation and ERK mitogen-activated protein kinase (see OMIM Ref. No. MAP3K4; 602425) activation in a GPR4-dependent and pertussis toxin (PTX)-sensitive manner, whereas ERK activation is PTX-insensitive in OGR1-mediated signaling. Cell migration analysis suggested that both LPC and SPC enhance chemotaxis, but not chemokinesis, through GPR4.

Full details of the abovementioned studies are described in the following publications, the disclosure of which are hereby incorporated by reference:

Heiber, M.; Docherty, J. M.; Shah, G.; Nguyen, T.; Cheng, R.; Heng, H. H. Q.; Marchese, A.; Tsui, L.-C.; Shi, X.; George, S. R.; O'Dowd, B. F.: Isolation of three novel human genes encoding G protein-coupled receptors. DNA Cell Biol. 14:25-35, 1995; and Zhu, K.; Baudhuin, L. M.; Hong, G.; Williams, F. S.; Cristina, K. L.; Kabarowski, J. H. S.; Witte, O. N.; Xu, Y.: Sphingosylphosphorylcholine and lysophosphatidylcholine are ligands f.

Further studies establishing the function and utilities of GPR4 are found in John Hopkins OMIM database record ID 600551, and in sited publications numbered 7874-787 and 7883 listed in the bibliography section hereinbelow, which are also hereby incorporated by reference. Homeo Box D4 (HOXD4, Accession NM_014621) is another VGAM2087 host target gene. HOXD4 BINDING SITE is HOST TARGET binding site found in the 3' untranslated region of mRNA encoded by HOXD4, corresponding to a HOST TARGET binding site such as BINDING SITE I, BINDING SITE II or BINDING SITE III. Table 2 illustrates the complementarity of the nucleotide sequences of HOXD4 BINDING SITE, designated SEQ ID:15979, to the nucleotide sequence of VGAM2087 RNA, herein designated VGAM RNA, also designated SEQ ID:4798.

Another function of VGAM2087 is therefore inhibition of Homeo Box D4 (HOXD4, Accession NM_014621), a gene which is part of a developmental regulatory system. Accordingly, utilities of VGAM2087 include diagnosis, prevention and treatment of diseases and clinical conditions associated with HOXD4. The function of HOXD4 and its association with various diseases and clinical conditions, has been established by previous studies, as described hereinabove with reference to VGAM330. Baculoviral IAP Repeat-containing 3 (BIRC3, Accession XM_040715) is another VGAM2087 host target gene. BIRC3 BINDING SITE is HOST TARGET binding site found in the 5' untranslated region of mRNA encoded by BIRC3, corresponding to a HOST TARGET binding site such as BINDING SITE I, BINDING SITE II or BINDING SITE III. Table 2 illustrates the complementarity of the nucleotide sequences of BIRC3 BINDING SITE, designated SEQ ID:33369, to the nucleotide sequence of VGAM2087 RNA, herein designated VGAM RNA, also designated SEQ ID:4798.

Another function of VGAM2087 is therefore inhibition of Baculoviral IAP Repeat-containing 3 (BIRC3, Accession XM_040715). Accordingly, utilities of VGAM2087 include diagnosis, prevention and treatment of diseases and clinical conditions associated with BIRC3. Doublecortin and CaM Kinase-like 1 (DCAMKL1, Accession NM_004734) is another VGAM2087 host target gene. DCAMKL1 BINDING SITE is HOST TARGET binding site found in the 3' untranslated region of mRNA encoded by DCAMKL1, corresponding to a HOST TARGET binding site such as BINDING SITE I, BINDING SITE II or BINDING SITE III. Table 2 illustrates the complementarity of the nucleotide sequences of DCAMKL1 BINDING SITE, designated SEQ ID:11111, to the nucleotide sequence of VGAM2087 RNA, herein designated VGAM RNA, also designated SEQ ID:4798.

Another function of VGAM2087 is therefore inhibition of Doublecortin and CaM Kinase-like 1 (DCAMKL1, Accession NM_004734). Accordingly, utilities of VGAM2087 include diagnosis, prevention and treatment of diseases and clinical conditions associated with DCAMKL1. DKFZP434C212 (Accession XM_044196) is another VGAM2087 host target gene. DKFZP434C212 BINDING SITE is HOST TARGET binding site found in the 3' untranslated region of mRNA encoded by DKFZP434C212, corresponding to a HOST TARGET binding site such as BINDING SITE I, BINDING SITE II or BINDING SITE III. Table 2 illustrates the complementarity of the nucleotide sequences of DKFZP434C212 BINDING SITE, designated SEQ ID:34171, to the nucleotide sequence of VGAM2087 RNA, herein designated VGAM RNA, also designated SEQ ID:4798.

Another function of VGAM2087 is therefore inhibition of DKFZP434C212 (Accession XM_044196). Accordingly, utilities of VGAM2087 include diagnosis, prevention and treatment of diseases and clinical conditions associated with DKFZP434C212. FLJ14641 (Accession NM_032817) is another VGAM2087 host target gene. FLJ14641 BINDING SITE is HOST TARGET binding site found in the 5' untranslated region of mRNA encoded by FLJ14641, corresponding to a HOST TARGET binding site such as BINDING SITE I, BINDING SITE II or BINDING SITE III. Table 2 illustrates the complementarity of the nucleotide sequences of FLJ14641 BINDING SITE, designated SEQ ID:26592, to the nucleotide sequence of VGAM2087 RNA, herein designated VGAM RNA, also designated SEQ ID:4798.

Another function of VGAM2087 is therefore inhibition of FLJ14641 (Accession NM_032817). Accordingly, utilities of VGAM2087 include diagnosis, prevention and treatment of diseases and clinical conditions associated with FLJ14641. GDNF Family Receptor Alpha 4 (GFRA4, Accession NM_022139) is another VGAM2087 host target gene. GFRA4 BINDING SITE is HOST TARGET binding site found in the 3' untranslated region of mRNA encoded by GFRA4, corresponding to a HOST TARGET binding site such as BINDING SITE I, BINDING SITE II or BINDING SITE III. Table 2 illustrates the complementarity of the nucleotide sequences of GFRA4 BINDING SITE, designated SEQ ID:22702, to the nucleotide sequence of VGAM2087 RNA, herein designated VGAM RNA, also designated SEQ ID:4798.

Another function of VGAM2087 is therefore inhibition of GDNF Family Receptor Alpha 4 (GFRA4, Accession NM_022139). Accordingly, utilities of VGAM2087 include diagnosis, prevention and treatment of diseases and clinical conditions associated with GFRA4. KIAA0939 (Accession XM_030524) is another VGAM2087 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31057, to the nucleotide sequence of VGAM2087 RNA, herein designated VGAM RNA, also designated SEQ ID:4798.

Another function of VGAM2087 is therefore inhibition of KIAA0939 (Accession XM_030524). Accordingly, utilities of VGAM2087 include diagnosis, prevention and treatment of diseases and clinical conditions associated with KIAA0939. KIAA0961 (Accession NM_014898) is another VGAM2087 host target gene. KIAA0961 BINDING SITE is HOST TARGET binding site found in the 3' untranslated region of mRNA encoded by KIAA0961, corresponding to a HOST TARGET binding site such as BINDING SITE I, BINDING SITE II or BINDING SITE III. Table 2 illustrates the complementarity of the nucleotide sequences of KIAA0961 BINDING SITE, designated SEQ ID:17076, to the nucleotide sequence of VGAM2087 RNA, herein designated VGAM RNA, also designated SEQ ID:4798.

Another function of VGAM2087 is therefore inhibition of KIAA0961 (Accession NM_014898). Accordingly, utilities of VGAM2087 include diagnosis, prevention and treatment of diseases and clinical conditions associated with KIAA0961. KIAA1054 (Accession XM_043493) is another VGAM2087 host target gene. KIAA1054 BINDING SITE is HOST TARGET binding site found in the 3' untranslated region of mRNA encoded by KIAA1054, corresponding to a HOST TARGET binding site such as BINDING SITE I, BINDING SITE II or BINDING SITE III. Table 2 illustrates the complementarity of the nucleotide sequences of KIAA1054 BINDING SITE, designated SEQ ID:33956, to the nucleotide sequence of VGAM2087 RNA, herein designated VGAM RNA, also designated SEQ ID:4798.

Another function of VGAM2087 is therefore inhibition of KIAA1054 (Accession XM_043493). Accordingly, utilities of VGAM2087 include diagnosis, prevention and treatment of diseases and clinical conditions associated with KIAA1054. KIAA1297 (Accession XM_051005) is another VGAM2087 host target gene. KIAA1297 BINDING SITE is HOST TARGET binding site found in the 5' untranslated region of mRNA encoded by KIAA1297, corresponding to a HOST TARGET binding site such as BINDING SITE I, BINDING SITE II or BINDING SITE III. Table 2 illustrates the complementarity of the nucleotide sequences of KIAA1297 BINDING SITE, designated SEQ ID:35706, to the nucleotide sequence of VGAM2087 RNA, herein designated VGAM RNA, also designated SEQ ID:4798.

Another function of VGAM2087 is therefore inhibition of KIAA1297 (Accession XM_051005). Accordingly, utilities of VGAM2087 include diagnosis, prevention and treatment of diseases and clinical conditions associated with KIAA1297. KIAA1854 (Accession XM_049884) is another VGAM2087 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35522, to the nucleotide sequence of VGAM2087 RNA, herein designated VGAM RNA, also designated SEQ ID:4798.

Another function of VGAM2087 is therefore inhibition of KIAA1854 (Accession XM_049884). Accordingly, utilities of VGAM2087 include diagnosis, prevention and treatment of diseases and clinical conditions associated with KIAA1854. MGC10715 (Accession NM_024325) is another VGAM2087 host target gene. MGC10715 BINDING SITE is HOST TARGET binding site found in the 3' untranslated region of mRNA encoded by MGC10715, corresponding to a HOST TARGET binding site such as BINDING SITE I, BINDING SITE II or BINDING SITE III. Table 2 illustrates the complementarity of the nucleotide sequences of MGC10715 BINDING SITE, designated SEQ ID:23612, to the nucleotide sequence of VGAM2087 RNA, herein designated VGAM RNA, also designated SEQ ID:4798.

Another function of VGAM2087 is therefore inhibition of MGC10715 (Accession NM_024325). Accordingly, utilities of VGAM2087 include diagnosis, prevention and treatment of diseases and clinical conditions associated with MGC10715. My015 (Accession XM_039512) is another VGAM2087 host target gene. My015 BINDING SITE is HOST TARGET binding site found in the 3' untranslated region of mRNA encoded by My015, corresponding to a HOST TARGET binding site such as BINDING SITE I, BINDING SITE II or BINDING SITE III. Table 2 illustrates the complementarity of the nucleotide sequences of My015 BINDING SITE, designated SEQ ID:33104, to the nucleotide sequence of VGAM2087 RNA, herein designated VGAM RNA, also designated SEQ ID:4798.

Another function of VGAM2087 is therefore inhibition of My015 (Accession XM_039512). Accordingly, utilities of VGAM2087 include diagnosis, prevention and treatment of diseases and clinical conditions associated with My015. PRO2893 (Accession NM_018634) is another VGAM2087 host target gene. PRO2893 BINDING SITE is HOST TARGET binding site found in the 3' untranslated region of mRNA encoded by PRO2893, corresponding to a HOST TARGET binding site such as BINDING SITE I, BINDING SITE II or BINDING SITE III. Table 2 illustrates the complementarity of the nucleotide sequences of PRO2893 BINDING SITE, designated SEQ ID:20706, to the nucleotide sequence of VGAM2087 RNA, herein designated VGAM RNA, also designated SEQ ID:4798.

Another function of VGAM2087 is therefore inhibition of PRO2893 (Accession NM_018634). Accordingly, utilities of VGAM2087 include diagnosis, prevention and treatment of diseases and clinical conditions associated with PRO2893. RNP24 (Accession NM_006815) is another VGAM2087 host target gene. RNP24 BINDING SITE is HOST TARGET binding site found in the 3' untranslated region of mRNA encoded by RNP24, corresponding to a HOST TARGET binding site such as BINDING SITE I, BINDING SITE II or BINDING SITE III. Table 2 illustrates the complementarity of the nucleotide sequences of RNP24 BINDING SITE, designated SEQ ID:13693, to the nucleotide sequence of VGAM2087 RNA, herein designated VGAM RNA, also designated SEQ ID:4798.

Another function of VGAM2087 is therefore inhibition of RNP24 (Accession NM_006815). Accordingly, utilities of VGAM2087 include diagnosis, prevention and treatment of diseases and clinical conditions associated with RNP24. Trinucleotide Repeat Containing 9 (TNRC9, Accession XM_049037) is another VGAM2087 host target gene. TNRC9 BINDING SITE is HOST TARGET binding site found in the 3' untranslated region of mRNA encoded by TNRC9, corresponding to a HOST TARGET binding site such as BINDING SITE I, BINDING SITE II or BINDING SITE III. Table 2 illustrates the complementarity of the nucleotide sequences of TNRC9 BINDING SITE, designated SEQ ID:35319, to the nucleotide sequence of VGAM2087 RNA, herein designated VGAM RNA, also designated SEQ ID:4798.

Another function of VGAM2087 is therefore inhibition of Trinucleotide Repeat Containing 9 (TNRC9, Accession XM_049037). Accordingly, utilities of VGAM2087 include diagnosis, prevention and treatment of diseases and clinical conditions associated with TNRC9. LOC121838 (Accession XM_071772) is another VGAM2087 host target gene. LOC121838 BINDING SITE is HOST TARGET binding site found in the 5' untranslated region of mRNA encoded by LOC121838, corresponding to a HOST TARGET binding site such as BINDING SITE I, BINDING SITE II or BINDING SITE III. Table 2 illustrates the complementarity of the nucleotide sequences of LOC121838 BINDING SITE, designated SEQ ID:37419, to the nucleotide sequence of VGAM2087 RNA, herein designated VGAM RNA, also designated SEQ ID:4798.

Another function of VGAM2087 is therefore inhibition of LOC121838 (Accession XM_071772). Accordingly, utilities of VGAM2087 include diagnosis, prevention and treatment of diseases and clinical conditions associated with LOC121838. LOC130814 (Accession XM_059471) is another VGAM2087 host target gene. LOC130814 BINDING SITE is HOST TARGET binding site found in the 3' untranslated region of mRNA encoded by LOC130814, corresponding to a HOST TARGET binding site such as BINDING SITE I, BINDING SITE II or BINDING SITE III. Table 2 illustrates the complementarity of the nucleotide sequences of LOC130814 BINDING SITE, designated SEQ ID:37008, to the nucleotide sequence of VGAM2087 RNA, herein designated VGAM RNA, also designated SEQ ID:4798.

Another function of VGAM2087 is therefore inhibition of LOC130814 (Accession XM_059471). Accordingly, utilities of VGAM2087 include diagnosis, prevention and treatment of diseases and clinical conditions associated with LOC130814. LOC144845 (Accession NM_138474) is another VGAM2087 host target gene. LOC144845 BINDING SITE is HOST TARGET binding site found in the 3' untranslated region of mRNA encoded by LOC144845, corresponding to a HOST TARGET binding site such as BINDING SITE I, BINDING SITE II or BINDING SITE III. Table 2 illustrates the complementarity of the nucleotide sequences of LOC144845 BINDING SITE, designated SEQ ID:28824, to the nucleotide sequence of VGAM2087 RNA, herein designated VGAM RNA, also designated SEQ ID:4798.

Another function of VGAM2087 is therefore inhibition of LOC144845 (Accession NM_138474). Accordingly, utilities of VGAM2087 include diagnosis, prevention and treatment of diseases and clinical conditions associated with LOC144845. LOC93550 (Accession XM_051999) is another VGAM2087 host target gene. LOC93550 BINDING SITE is HOST TARGET binding site found in the 3' untranslated region of mRNA encoded by LOC93550, corresponding to a HOST TARGET binding site such as BINDING SITE I, BINDING SITE II or BINDING SITE III. Table 2 illustrates the complementarity of the nucleotide sequences of LOC93550 BINDING SITE, designated SEQ ID:35934, to the nucleotide sequence of VGAM2087 RNA, herein designated VGAM RNA, also designated SEQ ID:4798.

Another function of VGAM2087 is therefore inhibition of LOC93550 (Accession XM_051999). Accordingly, utilities of VGAM2087 include diagnosis, prevention and treatment of diseases and clinical conditions associated with LOC93550. FIG. 1 further provides a conceptual description of a novel bioinformatically detected viral gene of the present invention, referred to here as Viral Genomic Address Messenger 2088 (VGAM2088) viral gene, which modulates expression of respective host target genes thereof, the function and utility of which host target genes is known in the art.

VGAM2088 is a novel bioinformatically detected regulatory, non protein coding, viral micro RNA (miRNA) gene. The method by which VGAM2088 was detected is described hereinabove with reference to FIGS. 1-8.

VGAM2088 gene, herein designated VGAM GENE, is a viral gene contained in the genome of Fowlpox Virus. VGAM2088 host target gene, herein designated VGAM HOST TARGET GENE, is a human gene contained in the human genome.

VGAM2088 gene encodes a VGAM2088 precursor RNA, herein designated VGAM PRECURSOR RNA. Similar to other miRNA genes, and unlike most ordinary genes, VGAM2088 precursor RNA does not encode a protein. A nucleotide sequence identical or highly similar to the nucleotide sequence of VGAM2088 precursor RNA is designated SEQ ID:2074, and is provided hereinbelow with reference to the sequence listing part. Nucleotide sequence SEQ ID:2074 is located at position 97767 relative to the genome of Fowlpox Virus.

VGAM2088 precursor RNA folds onto itself, forming VGAM2088 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2088 folded precursor RNA into VGAM2088 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2088 RNA is designated SEQ ID:4799, and is provided hereinbelow with reference to the sequence listing part.

VGAM2088 host target gene, herein designated VGAM HOST TARGET GENE, encodes a corresponding messenger RNA, VGAM2088 host target RNA, herein designated VGAM HOST TARGET RNA. VGAM2088 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2088 RNA, herein designated VGAM RNA, binds complementarily to one or more host target binding sites located in untranslated regions of VGAM2088 host target RNA, herein designated VGAM HOST TARGET RNA. This complementary binding is due to the fact that the nucleotide sequence of VGAM2088 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2088 RNA, herein designated VGAM RNA, may have a different number of host target binding sites in untranslated regions of a VGAM2088 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2088 RNA, herein designated VGAM RNA, to host target binding sites on VGAM2088 host target RNA, herein designated VGAM HOST TARGET RNA, such as BINDING SITE I, BINDING SITE II and BINDING SITE III, inhibits translation of VGAM2088 host target RNA into VGAM2088 host target protein, herein designated VGAM HOST TARGET PROTEIN. VGAM host target protein is therefore outlined by a broken line.

It is appreciated that VGAM2088 host target gene, herein designated VGAM HOST TARGET GENE, in fact represents a plurality of VGAM2088 host target genes. The mRNA of each one of this plurality of VGAM2088 host target genes comprises one or more host target binding sites, each having a nucleotide sequence which is at least partly complementary to VGAM2088 RNA, herein designated VGAM RNA, and which when bound by VGAM2088 RNA causes inhibition of translation of respective one or more VGAM2088 host target proteins.

It is further appreciated by one skilled in the art that the mode of translational inhibition illustrated by FIG. 1 with specific reference to translational inhibition exerted by VGAM2088 gene, herein designated VGAM GENE, on one or more VGAM2088 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2088 is inhibition of expression of host target genes, as part of a novel viral mechanism of attacking a host. Accordingly, utilities of VGAM2088 include diagnosis, prevention and treatment of viral infection by Fowlpox Virus. Specific functions, and accordingly utilities, of VGAM2088 correlate with, and may be deduced from, the identity of the host target genes which VGAM2088 binds and inhibits, and the function of these host target genes, as elaborated hereinbelow.

Nucleotide sequences of the VGAM2088 precursor RNA, herein designated VGAM PRECURSOR RNA, and of the 'diced' VGAM2088 RNA, herein designated VGAM RNA, and a schematic representation of the secondary folding of VGAM2088 folded precursor RNA, herein designated VGAM FOLDED PRECURSOR RNA, of VGAM2088 are further described hereinbelow with reference to Table 1.

Nucleotide sequences of host target binding sites, such as BINDING SITE-I, BINDING SITE-II and BINDING SITE-III of FIG. 1, found on VGAM2088 host target RNA, and schematic representation of the complementarity of each of these host target binding sites to VGAM2088 RNA, herein designated VGAM RNA, are described hereinbelow with reference to Table 2.

As mentioned hereinabove with reference to FIG. 1, a function of VGAM2088 gene, herein designated VGAM is inhibition of expression of VGAM2088 target genes. It is appreciated that specific functions, and accordingly utilities, of VGAM2088 correlate with, and may be deduced from, the identity of the target genes which VGAM2088 binds and inhibits, and the function of these target genes, as elaborated hereinbelow.

IQ Motif Containing GTPase Activating Protein 2 (IQGAP2, Accession NM_006633) is a VGAM2088 host target gene. IQGAP2 BINDING SITE is HOST TARGET binding site found in the 3' untranslated region of mRNA encoded by IQGAP2, corresponding to a HOST TARGET binding site such as BINDING SITE I, BINDING SITE II or BINDING SITE III. Table 2 illustrates the complementarity of the nucleotide sequences of IQGAP2 BINDING SITE, designated SEQ ID:13428, to the nucleotide sequence of VGAM2088 RNA, herein designated VGAM RNA, also designated SEQ ID:4799.

A function of VGAM2088 is therefore inhibition of IQ Motif Containing GTPase Activating Protein 2 (IQGAP2, Accession NM_006633), a gene which Inhibits GTPase activity of Cdc42 and Rac1. Accordingly, utilities of VGAM2088 include diagnosis, prevention and treatment of diseases and clinical conditions associated with IQGAP2. The function of IQGAP2 and its association with various diseases and clinical conditions, has been established by previous studies, as described hereinabove with reference to VGAM110. NCSTN (Accession XM_057331) is another VGAM2088 host target gene. NCSTN BINDING SITE is HOST TARGET binding site found in the 3' untranslated region of mRNA encoded by NCSTN, corresponding to a HOST TARGET binding site such as BINDING SITE I, BINDING SITE II or BINDING SITE III. Table 2 illustrates the complementarity of the nucleotide sequences of NCSTN BINDING SITE, designated SEQ ID:36509, to the nucleotide sequence of VGAM2088 RNA, herein designated VGAM RNA, also designated SEQ ID:4799.

Another function of VGAM2088 is therefore inhibition of NCSTN (Accession XM_057331), a gene which has a central role in presenilin-mediated processing of beta-amyloid precursor protein (beta-APP, MIM 104760) and some aspects of notch (MIM 190198)/glp-1 signaling in vivo. Accordingly, utilities of VGAM2088 include diagnosis, prevention and treatment of diseases and clinical conditions associated with NCSTN. The function of NCSTN and its association with various diseases and clinical conditions, has been established by previous studies, as described hereinabove with reference to VGAM152. Carbohydrate (chondroitin 6) Sulfotransferase 3 (CHST3, Accession NM_004273) is another VGAM2088 host target gene. CHST3 BINDING SITE is HOST TARGET binding site found in the 3' untranslated region of mRNA encoded by CHST3, corresponding to a HOST TARGET binding site such as BINDING SITE I, BINDING SITE II or BINDING SITE III. Table 2 illustrates the complementarity of the nucleotide sequences of CHST3 BINDING SITE, designated SEQ ID:10487, to the nucleotide sequence of VGAM2088 RNA, herein designated VGAM RNA, also designated SEQ ID:4799.

Another function of VGAM2088 is therefore inhibition of Carbohydrate (chondroitin 6) Sulfotransferase 3 (CHST3, Accession NM_004273). Accordingly, utilities of VGAM2088 include diagnosis, prevention and treatment of diseases and clinical conditions associated with CHST3. FLJ11577 (Accession NM_025159) is another VGAM2088 host target gene. FLJ11577 BINDING SITE is HOST TARGET binding site found in the 3' untranslated region of mRNA encoded by FLJ11577, corresponding to a HOST TARGET binding site such as BINDING SITE I, BINDING SITE II or BINDING SITE III. Table 2 illustrates the complementarity of the nucleotide sequences of FLJ11577 BINDING SITE, designated SEQ ID:24799, to the nucleotide sequence of VGAM2088 RNA, herein designated VGAM RNA, also designated SEQ ID:4799.

Another function of VGAM2088 is therefore inhibition of FLJ11577 (Accession NM_025159). Accordingly, utilities of VGAM2088 include diagnosis, prevention and treatment of diseases and clinical conditions associated with FLJ11577. Fused Toes Homolog (mouse) (FTS, Accession NM_022476) is another VGAM2088 host target gene. FTS BINDING SITE is HOST TARGET binding site found in the 3' untranslated region of mRNA encoded by FTS, corresponding to a HOST TARGET binding site such as BINDING SITE I, BINDING SITE II or BINDING SITE III. Table 2 illustrates the complementarity of the nucleotide sequences of FTS BINDING SITE, designated SEQ ID:22844, to the nucleotide sequence of VGAM2088 RNA, herein designated VGAM RNA, also designated SEQ ID:4799.

Another function of VGAM2088 is therefore inhibition of Fused Toes Homolog (mouse) (FTS, Accession NM_022476). Accordingly, utilities of VGAM2088 include diagnosis, prevention and treatment of diseases and clinical conditions associated with FTS. G Protein-coupled Receptor Kinase-interactor 2 (GIT2, Accession NM_014776) is another VGAM2088 host target gene. GIT2 BINDING SITE1 through GIT2 BINDING SITE3 are HOST TARGET binding sites found in untranslated regions of mRNA encoded by GIT2, corresponding to HOST TARGET binding sites such as BINDING SITE I, BINDING SITE II or BINDING SITE III. Table 2 illustrates the complementarity of the nucleotide sequences of GIT2 BINDING SITE1 through GIT2 BINDING SITE3, designated SEQ ID:16607, SEQ ID:27689 and SEQ ID:27702 respectively, to the nucleotide sequence of VGAM2088 RNA, herein designated VGAM RNA, also designated SEQ ID:4799.

Another function of VGAM2088 is therefore inhibition of G Protein-coupled Receptor Kinase-interactor 2 (GIT2, Accession NM_014776). Accordingly, utilities of VGAM2088 include diagnosis, prevention and treatment of diseases and clinical conditions associated with GIT2. KIAA0478 (Accession NM_014870) is another VGAM2088 host target gene. KIAA0478 BINDING SITE is HOST TARGET binding site found in the 3' untranslated region of mRNA encoded by KIAA0478, corresponding to a HOST TARGET binding site such as BINDING SITE I, BINDING SITE II or BINDING SITE III. Table 2 illustrates the complementarity of the nucleotide sequences of KIAA0478 BINDING SITE, designated SEQ ID:16985, to the nucleotide sequence of VGAM2088 RNA, herein designated VGAM RNA, also designated SEQ ID:4799.

Another function of VGAM2088 is therefore inhibition of KIAA0478 (Accession NM_014870). Accordingly, utilities of VGAM2088 include diagnosis, prevention and treatment of diseases and clinical conditions associated with KIAA0478. KIAA1681 (Accession XM_028059) is another VGAM2088 host target gene. KIAA1681 BINDING SITE is HOST TARGET binding site found in the 3' untranslated region of mRNA encoded by KIAA1681, corresponding to a HOST TARGET binding site such as BINDING SITE I, BINDING SITE II or BINDING SITE III. Table 2 illustrates the complementarity of the nucleotide sequences of KIAA1681 BINDING SITE, designated SEQ ID:30612, to the nucleotide sequence of VGAM2088 RNA, herein designated VGAM RNA, also designated SEQ ID:4799.

Another function of VGAM2088 is therefore inhibition of KIAA1681 (Accession XM_028059). Accordingly, utilities of VGAM2088 include diagnosis, prevention and treatment of diseases and clinical conditions associated with KIAA1681. LOC153688 (Accession XM_098416) is another VGAM2088 host target gene. LOC153688 BINDING SITE is HOST TARGET binding site found in the 3' untranslated region of mRNA encoded by LOC153688, corresponding to a HOST TARGET binding site such as BINDING SITE I, BINDING SITE II or BINDING SITE III. Table 2 illustrates the complementarity of the nucleotide sequences of LOC153688 BINDING SITE, designated SEQ ID:41664, to the nucleotide sequence of VGAM2088 RNA, herein designated VGAM RNA, also designated SEQ ID:4799.

Another function of VGAM2088 is therefore inhibition of LOC153688 (Accession XM_098416). Accordingly, utilities of VGAM2088 include diagnosis, prevention and treatment of diseases and clinical conditions associated with LOC153688. LOC200301 (Accession XM_114197) is another VGAM2088 host target gene. LOC200301 BINDING SITE is HOST TARGET binding site found in the 3' untranslated region of mRNA encoded by LOC200301, corresponding to a HOST TARGET binding site such as BINDING SITE I, BINDING SITE II or BINDING SITE III. Table 2 illustrates the complementarity of the nucleotide sequences of LOC200301 BINDING SITE, designated SEQ ID:42780, to the nucleotide sequence of VGAM2088 RNA, herein designated VGAM RNA, also designated SEQ ID:4799.

Another function of VGAM2088 is therefore inhibition of LOC200301 (Accession XM_114197). Accordingly, utilities of VGAM2088 include diagnosis, prevention and treatment of diseases and clinical conditions associated with LOC200301. LOC255458 (Accession XM_173150) is another VGAM2088 host target gene. LOC255458 BINDING SITE is HOST TARGET binding site found in the 5' untranslated region of mRNA encoded by LOC255458, corresponding to a HOST TARGET binding site such as BINDING SITE I, BINDING SITE II or BINDING SITE III. Table 2 illustrates the complementarity of the nucleotide sequences of LOC255458 BINDING SITE, designated SEQ ID:46408, to the nucleotide sequence of VGAM2088 RNA, herein designated VGAM RNA, also designated SEQ ID:4799.

Another function of VGAM2088 is therefore inhibition of LOC255458 (Accession XM_173150). Accordingly, utilities of VGAM2088 include diagnosis, prevention and treatment of diseases and clinical conditions associated with LOC255458. FIG. 1 further provides a conceptual description of a novel bioinformatically detected viral gene of the present invention, referred to here as Viral Genomic Address Messenger 2089 (VGAM2089) viral gene, which modulates expression of respective host target genes thereof, the function and utility of which host target genes is known in the art.

VGAM2089 is a novel bioinformatically detected regulatory, non protein coding, viral micro RNA (miRNA) gene. The method by which VGAM2089 was detected is described hereinabove with reference to FIGS. 1-8.

VGAM2089 gene, herein designated VGAM GENE, is a viral gene contained in the genome of Fowlpox Virus. VGAM2089 host target gene, herein designated VGAM HOST TARGET GENE, is a human gene contained in the human genome.

VGAM2089 gene encodes a VGAM2089 precursor RNA, herein designated VGAM PRECURSOR RNA. Similar to other miRNA genes, and unlike most ordinary genes, VGAM2089 precursor RNA does not encode a protein. A nucleotide sequence identical or highly similar to the nucleotide sequence of VGAM2089 precursor RNA is designated SEQ ID:2075, and is provided hereinbelow with reference to the sequence listing part. Nucleotide sequence SEQ ID:2075 is located at position 103219 relative to the genome of Fowlpox Virus.

VGAM2089 precursor RNA folds onto itself, forming VGAM2089 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2089 folded precursor RNA into VGAM2089 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2089 RNA is designated SEQ ID:4800, and is provided hereinbelow with reference to the sequence listing part.

VGAM2089 host target gene, herein designated VGAM HOST TARGET GENE, encodes a corresponding messenger RNA, VGAM2089 host target RNA, herein designated VGAM HOST TARGET RNA. VGAM2089 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2089 RNA, herein designated VGAM RNA, binds complementarily to one or more host target binding sites located in untranslated regions of VGAM2089 host target RNA, herein designated VGAM HOST TARGET RNA. This complementary binding is due to the fact that the nucleotide sequence of VGAM2089 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2089 RNA, herein designated VGAM RNA, may have a different number of host target binding sites in untranslated regions of a VGAM2089 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2089 RNA, herein designated VGAM RNA, to host target binding sites on VGAM2089 host target RNA, herein designated VGAM HOST TARGET RNA, such as BINDING SITE I, BINDING SITE II and BINDING SITE III, inhibits translation of VGAM2089 host target RNA into VGAM2089 host target protein, herein designated VGAM HOST TARGET PROTEIN. VGAM host target protein is therefore outlined by a broken line.

It is appreciated that VGAM2089 host target gene, herein designated VGAM HOST TARGET GENE, in fact represents a plurality of VGAM2089 host target genes. The mRNA of each one of this plurality of VGAM2089 host target genes comprises one or more host target binding sites, each having a nucleotide sequence which is at least partly complementary to VGAM2089 RNA, herein designated VGAM RNA, and which when bound by VGAM2089 RNA causes inhibition of translation of respective one or more VGAM2089 host target proteins.

It is further appreciated by one skilled in the art that the mode of translational inhibition illustrated by FIG. 1 with specific reference to translational inhibition exerted by VGAM2089 gene, herein designated VGAM GENE, on one or more VGAM2089 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2089 is inhibition of expression of host target genes, as part of a novel viral mechanism of attacking a host. Accordingly, utilities of VGAM2089 include diagnosis, prevention and treatment of viral infection by Fowlpox Virus. Specific functions, and accordingly utilities, of VGAM2089 correlate with, and may be deduced from, the identity of the host target genes which VGAM2089 binds and inhibits, and the function of these host target genes, as elaborated hereinbelow.

Nucleotide sequences of the VGAM2089 precursor RNA, herein designated VGAM PRECURSOR RNA, and of the 'diced' VGAM2089 RNA, herein designated VGAM RNA, and a schematic representation of the secondary folding of VGAM2089 folded precursor RNA, herein designated VGAM FOLDED PRECURSOR RNA, of VGAM2089 are further described hereinbelow with reference to Table 1.

Nucleotide sequences of host target binding sites, such as BINDING SITE-I, BINDING SITE-II and BINDING SITE-III of FIG. 1, found on VGAM2089 host target RNA, and schematic representation of the complementarity of each of these host target binding sites to VGAM2089 RNA, herein designated VGAM RNA, are described hereinbelow with reference to Table 2.

As mentioned hereinabove with reference to FIG. 1, a function of VGAM2089 gene, herein designated VGAM is inhibition of expression of VGAM2089 target genes. It is appreciated that specific functions, and accordingly utilities, of VGAM2089 correlate with, and may be deduced from, the identity of the target genes which VGAM2089 binds and inhibits, and the function of these target genes, as elaborated hereinbelow.

Protein Kinase, CGMP-dependent, Type I (PRKG1, Accession NM_006258) is a VGAM2089 host target gene. PRKG1 BINDING SITE is HOST TARGET binding site found in the 3' untranslated region of mRNA encoded by PRKG1, corresponding to a HOST TARGET binding site such as BINDING SITE I, BINDING SITE II or BINDING SITE III. Table 2 illustrates the complementarity of the nucleotide sequences of PRKG1 BINDING SITE, designated SEQ ID:12936, to the nucleotide sequence of VGAM2089 RNA, herein designated VGAM RNA, also designated SEQ ID:4800.

A function of VGAM2089 is therefore inhibition of Protein Kinase, CGMP-dependent, Type I (PRKG1, Accession NM_006258), a gene which relaxes vascular smooth muscle and inhibits platelet aggregation. Accordingly, utilities of VGAM2089 include diagnosis, prevention and treatment of diseases and clinical conditions associated with PRKG1. The function of PRKG1 and its association with various diseases and clinical conditions, has been established by previous studies, as described hereinabove with reference to VGAM1571. Asporin (LRR class 1) (ASPN, Accession NM_017680) is another VGAM2089 host target gene. ASPN BINDING SITE is HOST TARGET binding site found in the 3'' untranslated region of mRNA encoded by ASPN, corresponding to a HOST TARGET binding site such as BINDING SITE I, BINDING SITE II or BINDING SITE III. Table 2 illustrates the complementarity of the nucleotide sequences of ASPN BINDING SITE, designated SEQ ID:19225, to the nucleotide sequence of VGAM2089 RNA, herein designated VGAM RNA, also designated SEQ ID:4800.

Another function of VGAM2089 is therefore inhibition of Asporin (LRR class 1) (ASPN, Accession NM_017680). Accordingly, utilities of VGAM2089 include diagnosis, prevention and treatment of diseases and clinical conditions associated with ASPN. DKFZp434A2417 (Accession XM_038526) is another VGAM2089 host target gene. DKFZp434A2417 BINDING SITE is HOST TARGET binding site found in the 3' untranslated region of mRNA encoded by DKFZp434A2417, corresponding to a HOST TARGET binding site such as BINDING SITE I, BINDING SITE II or BINDING SITE III. Table 2 illustrates the complementarity of the nucleotide sequences of DKFZp434A2417 BINDING SITE, designated SEQ ID:32863, to the nucleotide sequence of VGAM2089 RNA, herein designated VGAM RNA, also designated SEQ ID:4800.

Another function of VGAM2089 is therefore inhibition of DKFZp434A2417 (Accession XM_038526). Accordingly, utilities of VGAM2089 include diagnosis, prevention and treatment of diseases and clinical conditions associated with DKFZp434A2417. LOC257017 (Accession XM_173227) is another VGAM2089 host target gene. LOC257017 BINDING SITE is HOST TARGET binding site found in the 5' untranslated region of mRNA encoded by LOC257017, corresponding to a HOST TARGET binding site such as BINDING SITE I, BINDING SITE II or BINDING SITE III. Table 2 illustrates the complementarity of the nucleotide sequences of LOC257017 BINDING SITE, designated SEQ ID:46495, to the nucleotide sequence of VGAM2089 RNA, herein designated VGAM RNA, also designated SEQ ID:4800.

Another function of VGAM2089 is therefore inhibition of LOC257017 (Accession XM_173227). Accordingly, utilities of VGAM2089 include diagnosis, prevention and treatment of diseases and clinical conditions associated with LOC257017. FIG. 1 further provides a conceptual description of a novel bioinformatically detected viral gene of the present invention, referred to here as Viral Genomic Address Messenger 2090 (VGAM2090) viral gene, which modulates expression of respective host target genes thereof, the function and utility of which host target genes is known in the art.

VGAM2090 is a novel bioinformatically detected regulatory, non protein coding, viral micro RNA (miRNA) gene. The method by which VGAM2090 was detected is described hereinabove with reference to FIGS. 1-8.

VGAM2090 gene, herein designated VGAM GENE, is a viral gene contained in the genome of Fowlpox Virus. VGAM2090 host target gene, herein designated VGAM HOST TARGET GENE, is a human gene contained in the human genome.

VGAM2090 gene encodes a VGAM2090 precursor RNA, herein designated VGAM PRECURSOR RNA. Similar to other miRNA genes, and unlike most ordinary genes, VGAM2090 precursor RNA does not encode a protein. A nucleotide sequence identical or highly similar to the nucleotide sequence of VGAM2090 precursor RNA is designated SEQ ID:2076, and is provided hereinbelow with reference to the sequence listing part. Nucleotide sequence SEQ ID:2076 is located at position 110457 relative to the genome of Fowlpox Virus.

VGAM2090 precursor RNA folds onto itself, forming VGAM2090 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2090 folded precursor RNA into VGAM2090 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM2090 RNA is designated SEQ ID:4801, and is provided hereinbelow with reference to the sequence listing part.

VGAM2090 host target gene, herein designated VGAM HOST TARGET GENE, encodes a corresponding messenger RNA, VGAM2090 host target RNA, herein designated VGAM HOST TARGET RNA. VGAM2090 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2090 RNA, herein designated VGAM RNA, binds complementarily to one or more host target binding sites located in untranslated regions of VGAM2090 host target RNA, herein designated VGAM HOST TARGET RNA. This complementary binding is due to the fact that the nucleotide sequence of VGAM2090 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2090 RNA, herein designated VGAM RNA, may have a different number of host target binding sites in untranslated regions of a VGAM2090 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2090 RNA, herein designated VGAM RNA, to host target binding sites on VGAM2090 host target RNA, herein designated VGAM HOST TARGET RNA, such as BINDING SITE I, BINDING SITE II and BINDING SITE III, inhibits translation of VGAM2090 host target RNA into VGAM2090 host target protein, herein designated VGAM HOST TARGET PROTEIN. VGAM host target protein is therefore outlined by a broken line.

It is appreciated that VGAM2090 host target gene, herein designated VGAM HOST TARGET GENE, in fact represents a plurality of VGAM2090 host target genes. The mRNA of each one of this plurality of VGAM2090 host target genes comprises one or more host target binding sites, each having a nucleotide sequence which is at least partly complementary to VGAM2090 RNA, herein designated VGAM RNA, and which when bound by VGAM2090 RNA causes inhibition of translation of respective one or more VGAM2090 host target proteins.

It is further appreciated by one skilled in the art that the mode of translational inhibition illustrated by FIG. 1 with specific reference to translational inhibition exerted by VGAM2090 gene, herein designated VGAM GENE, on one or more VGAM2090 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2090 is inhibition of expression of host target genes, as part of a novel viral mechanism of attacking a host. Accordingly, utilities of VGAM2090 include diagnosis, prevention and treatment of viral infection by Fowlpox Virus. Specific functions, and accordingly utilities, of VGAM2090 correlate with, and may be deduced from, the identity of the host target genes which VGAM2090 binds and inhibits, and the function of these host target genes, as elaborated hereinbelow.

Nucleotide sequences of the VGAM2090 precursor RNA, herein designated VGAM PRECURSOR RNA, and of the 'diced' VGAM2090 RNA, herein designated VGAM RNA, and a schematic representation of the secondary folding of VGAM2090 folded precursor RNA, herein designated VGAM FOLDED PRECURSOR RNA, of VGAM2090 are further described hereinbelow with reference to Table 1.

Nucleotide sequences of host target binding sites, such as BINDING SITE-I, BINDING SITE-II and BINDING SITE-III of FIG. 1, found on VGAM2090 host target RNA, and schematic representation of the complementarity of each of these host target binding sites to VGAM2090 RNA, herein designated VGAM RNA, are described hereinbelow with reference to Table 2.

As mentioned hereinabove with reference to FIG. 1, a function of VGAM2090 gene, herein designated VGAM is inhibition of expression of VGAM2090 target genes. It is appreciated that specific functions, and accordingly utilities, of VGAM2090 correlate with, and may be deduced from, the identity of the target genes which VGAM2090 binds and inhibits, and the function of these target genes, as elaborated hereinbelow.

Membrane Component, Chromosome 11, Surface Marker 1 (M11S1, Accession NM_005898) is a VGAM2090 host target gene. M11S1 BINDING SITE is HOST TARGET binding site found in the 3' untranslated region of mRNA encoded by M11S1, corresponding to a HOST TARGET binding site such as BINDING SITE I, BINDING SITE II or BINDING SITE III. Table 2 illustrates the complementarity of the nucleotide sequences of M11S1 BINDING SITE, designated SEQ ID:12515, to the nucleotide sequence of VGAM2090 RNA, herein designated VGAM RNA, also designated SEQ ID:4801.

A function of VGAM2090 is therefore inhibition of Membrane Component, Chromosome 11, Surface Marker 1 (M11S1, Accession NM_005898), a gene which may play a role in transporting nutrients from the gut lumen across the gutlining epithelial cell layer. Accordingly, utilities of VGAM2090 include diagnosis, prevention and treatment of diseases and clinical conditions associated with M11S1. The function of M11S1 and its association with various diseases and clinical conditions, has been established by previous studies, as described hereinabove with reference to VGAM131. Meis1, Myeloid Ecotropic Viral Integration Site 1 Homolog 2 (mouse) (MEIS2, Accession NM_020149) is another VGAM2090 host target gene. MEIS2 BINDING SITE is HOST TARGET binding site found in the 3' untranslated region of mRNA encoded by MEIS2, corresponding to a HOST TARGET binding site such as BINDING SITE I, BINDING SITE II or BINDING SITE III. Table 2 illustrates the complementarity of the nucleotide sequences of MEIS2 BINDING SITE, designated SEQ ID:21346, to the nucleotide sequence of VGAM2090 RNA, herein designated VGAM RNA, also designated SEQ ID:4801.

Another function of VGAM2090 is therefore inhibition of Meis1, Myeloid Ecotropic Viral Integration Site 1 Homolog 2 (mouse) (MEIS2, Accession NM_020149), a gene which may regulate gene expression and control cell differentiation. Accordingly, utilities of VGAM2090 include diagnosis, prevention and treatment of diseases and clinical conditions associated with MEIS2. The function of MEIS2 and its association with various diseases and clinical conditions, has been established by previous studies, as described hereinabove with reference to VGAM1244. Ribonucleotide Reductase M2 Polypeptide (RRM2, Accession NM_001034) is another VGAM2090 host target gene. RRM2 BINDING SITE is HOST TARGET binding site found in the 3' untranslated region of mRNA encoded by RRM2, corresponding to a HOST TARGET binding site such as BINDING SITE I, BINDING SITE II or BINDING SITE III. Table 2 illustrates the complementarity of the nucleotide sequences of RRM2 BINDING SITE, designated SEQ ID:6697, to the nucleotide sequence of VGAM2090 RNA, herein designated VGAM RNA, also designated SEQ ID:4801.

Another function of VGAM2090 is therefore inhibition of Ribonucleotide Reductase M2 Polypeptide (RRM2, Accession NM_001034). Accordingly, utilities of VGAM2090 include diagnosis, prevention and treatment of diseases and clinical conditions associated with RRM2. Solute Carrier Family 4, Sodium Bicarbonate Cotransporter, Member 4 (SLC4A4, Accession NM_003759) is another VGAM2090 host target gene. SLC4A4 BINDING SITE is HOST TARGET binding site found in the 3' untranslated region of mRNA encoded by SLC4A4, corresponding to a HOST TARGET binding site such as BINDING SITE I, BINDING SITE II or BINDING SITE III. Table 2 illustrates the complementarity of the nucleotide sequences of SLC4A4 BINDING SITE, designated SEQ ID:9836, to the nucleotide sequence of VGAM2090 RNA, herein designated VGAM RNA, also designated SEQ ID:4801.

Another function of VGAM2090 is therefore inhibition of Solute Carrier Family 4, Sodium Bicarbonate Cotransporter, Member 4 (SLC4A4, Accession NM_003759), a gene which is a sodium bicarbonate cotransporter. Accordingly, utilities of VGAM2090 include diagnosis, prevention and treatment of diseases and clinical conditions associated with SLC4A4. The function of SLC4A4 and its association with various diseases and clinical conditions, has been established by previous studies, as described hereinabove with reference to VGAM222. Chromosome 1 Open Reading Frame 22 (C1orf22, Accession NM_025191) is another VGAM2090 host target gene. C1orf22 BINDING SITE is HOST TARGET binding site found in the 3' untranslated region of mRNA encoded by C1orf22, corresponding to a HOST TARGET binding site such as BINDING SITE I, BINDING SITE II or BINDING SITE III. Table 2 illustrates the complementarity of the nucleotide sequences of C1orf22 BINDING SITE, designated SEQ ID:24835, to the nucleotide sequence of VGAM2090 RNA, herein designated VGAM RNA, also designated SEQ ID:4801.

Another function of VGAM2090 is therefore inhibition of Chromosome 1 Open Reading Frame 22 (C1orf22, Accession NM_025191). Accordingly, utilities of VGAM2090 include diagnosis, prevention and treatment of diseases and clinical conditions associated with C1orf22. INSM2 (Accession NM_032594) is another VGAM2090 host target gene. INSM2 BINDING SITE is HOST TARGET binding site found in the 5' untranslated region of mRNA encoded by INSM2, corresponding to a HOST TARGET binding site such as BINDING SITE I, BINDING SITE II or BINDING SITE III. Table 2 illustrates the complementarity of the nucleotide sequences of INSM2 BINDING SITE, designated SEQ ID:26325, to the nucleotide sequence of VGAM2090 RNA, herein designated VGAM RNA, also designated SEQ ID:4801.

Another function of VGAM2090 is therefore inhibition of INSM2 (Accession NM_032594). Accordingly, utilities of VGAM2090 include diagnosis, prevention and treatment of diseases and clinical conditions associated with INSM2. KIAA0352 (Accession NM_014830) is another VGAM2090 host target gene. KIAA0352 BINDING SITE is HOST TARGET binding site found in the 3' untranslated region of mRNA encoded by KIAA0352, corresponding to a HOST TARGET binding site such as BINDING SITE I, BINDING SITE II or BINDING SITE III. Table 2 illustrates the complementarity of the nucleotide sequences of KIAA0352 BINDING SITE, designated SEQ ID:16821, to the nucleotide sequence of VGAM2090 RNA, herein designated VGAM RNA, also designated SEQ ID:4801.

Another function of VGAM2090 is therefore inhibition of KIAA0352 (Accession NM_014830). Accordingly, utilities of VGAM2090 include diagnosis, prevention and treatment of diseases and clinical conditions associated with KIAA0352. PRO2730 (Accession NM_025222) is another VGAM2090 host target gene. PRO2730 BINDING SITE is HOST TARGET binding site found in the 5' untranslated region of mRNA encoded by PRO2730, corresponding to a HOST TARGET binding site such as BINDING SITE I, BINDING SITE II or BINDING SITE III. Table 2 illustrates the complementarity of the nucleotide sequences of PRO2730 BINDING SITE, designated SEQ ID:24897, to the nucleotide sequence of VGAM2090 RNA, herein designated VGAM RNA, also designated SEQ ID:4801.

Another function of VGAM2090 is therefore inhibition of PRO2730 (Accession NM_025222). Accordingly, utilities of VGAM2090 include diagnosis, prevention and treatment of diseases and clinical conditions associated with PRO2730. Spir-1 (Accession XM_035640) is another VGAM2090 host target gene. Spir-1 BINDING SITE is HOST TARGET binding site found in the 3' untranslated region of mRNA encoded by Spir-1, corresponding to a HOST TARGET binding site such as BINDING SITE I, BINDING SITE II or BINDING SITE III. Table 2 illustrates the complementarity of the nucleotide sequences of Spir-1 BINDING SITE, designated SEQ ID:32310, to the nucleotide sequence of VGAM2090 RNA, herein designated VGAM RNA, also designated SEQ ID:4801.

Another function of VGAM2090 is therefore inhibition of Spir-1 (Accession XM_035640). Accordingly, utilities of VGAM2090 include diagnosis, prevention and treatment of diseases and clinical conditions associated with Spir-1. LOC253649 (Accession XM_171211) is another VGAM2090 host target gene. LOC253649 BINDING SITE is HOST TARGET binding site found in the 5' untranslated region of mRNA encoded by LOC253649, corresponding to a HOST TARGET binding site such as BINDING SITE I, BINDING SITE II or BINDING SITE III. Table 2 illustrates the complementarity of the nucleotide sequences of LOC253649 BINDING SITE, designated SEQ ID:45998, to the nucleotide sequence of VGAM2090 RNA, herein designated VGAM RNA, also designated SEQ ID:4801.

Another function of VGAM2090 is therefore inhibition of LOC253649 (Accession XM_171211). Accordingly, utilities of VGAM2090 include diagnosis, prevention and treatment of diseases and clinical conditions associated with LOC253649. LOC253650 (Accession XM_171210) is another VGAM2090 host target gene. LOC253650 BINDING SITE is HOST TARGET binding site found in the 5' untranslated region of mRNA encoded by LOC253650, corresponding to a HOST TARGET binding site such as BINDING SITE I, BINDING SITE II or BINDING SITE III. Table 2 illustrates the complementarity of the nucleotide sequences of LOC253650 BINDING SITE, designated SEQ ID:45996, to the nucleotide sequence of VGAM2090 RNA, herein designated VGAM RNA, also designated SEQ ID:4801.

Another function of VGAM2090 is therefore inhibition of LOC253650 (Accession XM_171210). Accordingly, utilities of VGAM2090 include diagnosis, prevention and treatment of diseases and clinical conditions associated with LOC253650. FIG. 1 further provides a conceptual description of a novel bioinformatically detected viral gene of the present invention, referred to here as Viral Genomic Address Messenger 2091 (VGAM2091) viral gene, which modulates expression of respective host target genes thereof, the function and utility of which host target genes is known in the art.

VGAM2091 is a novel bioinformatically detected regulatory, non protein coding, viral micro RNA (miRNA) gene. The method by which VGAM2091 was detected is described hereinabove with reference to FIGS. 1-8.

VGAM2091 gene, herein designated VGAM GENE, is a viral gene contained in the genome of Fowlpox Virus. VGAM2091 host target gene, herein designated VGAM HOST TARGET GENE, is a human gene contained in the human genome.

VGAM2091 gene encodes a VGAM2091 precursor RNA, herein designated VGAM PRECURSOR RNA. Similar to other miRNA genes, and unlike most ordinary genes, VGAM2091 precursor RNA does not encode a protein. A nucleotide sequence identical or highly similar to the nucleotide sequence of VGAM2091 precursor RNA is designated SEQ ID:2077, and is provided hereinbelow with reference to the sequence listing part. Nucleotide sequence SEQ ID:2077 is located at position 108768 relative to the genome of Fowlpox Virus.

VGAM2091 precursor RNA folds onto itself, forming VGAM2091 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2091 folded precursor RNA into VGAM2091 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2091 RNA is designated SEQ ID:4802, and is provided hereinbelow with reference to the sequence listing part.

VGAM2091 host target gene, herein designated VGAM HOST TARGET GENE, encodes a corresponding messenger RNA, VGAM2091 host target RNA, herein designated VGAM HOST TARGET RNA. VGAM2091 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2091 RNA, herein designated VGAM RNA, binds complementarily to one or more host target binding sites located in untranslated regions of VGAM2091 host target RNA, herein designated VGAM HOST TARGET RNA. This complementary binding is due to the fact that the nucleotide sequence of VGAM2091 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2091 RNA, herein designated VGAM RNA, may have a different number of host target binding sites in untranslated regions of a VGAM2091 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2091 RNA, herein designated VGAM RNA, to host target binding sites on VGAM2091 host target RNA, herein designated VGAM HOST TARGET RNA, such as BINDING SITE I, BINDING SITE II and BINDING SITE III, inhibits translation of VGAM2091 host target RNA into VGAM2091 host target protein, herein designated VGAM HOST TARGET PROTEIN. VGAM host target protein is therefore outlined by a broken line.

It is appreciated that VGAM2091 host target gene, herein designated VGAM HOST TARGET GENE, in fact represents a plurality of VGAM2091 host target genes. The mRNA of each one of this plurality of VGAM2091 host target genes comprises one or more host target binding sites, each having a nucleotide sequence which is at least partly complementary to VGAM2091 RNA, herein designated VGAM RNA, and which when bound by VGAM2091 RNA causes inhibition of translation of respective one or more VGAM2091 host target proteins.

It is further appreciated by one skilled in the art that the mode of translational inhibition illustrated by FIG. 1 with specific reference to translational inhibition exerted by VGAM2091 gene, herein designated VGAM GENE, on one or more VGAM2091 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2091 is inhibition of expression of host target genes, as part of a novel viral mechanism of attacking a host. Accordingly, utilities of VGAM2091 include diagnosis, prevention and treatment of viral infection by Fowlpox Virus. Specific functions, and accordingly utilities, of VGAM2091 correlate with, and may be deduced from, the identity of the host target genes which VGAM2091 binds and inhibits, and the function of these host target genes, as elaborated hereinbelow.

Nucleotide sequences of the VGAM2091 precursor RNA, herein designated VGAM PRECURSOR RNA, and of the 'diced' VGAM2091 RNA, herein designated VGAM RNA, and a schematic representation of the secondary folding of VGAM2091 folded precursor RNA, herein designated VGAM FOLDED PRECURSOR RNA, of VGAM2091 are further described hereinbelow with reference to Table 1.

Nucleotide sequences of host target binding sites, such as BINDING SITE-I, BINDING SITE-II and BINDING SITE-III of FIG. 1, found on VGAM2091 host target RNA, and schematic representation of the complementarity of each of these host target binding sites to VGAM2091 RNA, herein designated VGAM RNA, are described hereinbelow with reference to Table 2.

As mentioned hereinabove with reference to FIG. 1, a function of VGAM2091 gene, herein designated VGAM is inhibition of expression of VGAM2091 target genes. It is appreciated that specific functions, and accordingly utilities, of VGAM2091 correlate with, and may be deduced from, the identity of the target genes which VGAM2091 binds and inhibits, and the function of these target genes, as elaborated hereinbelow.

Fibroblast Growth Factor 7 (keratinocyte growth factor) (FGF7, Accession NM_002009) is a VGAM2091 host target gene. FGF7 BINDING SITE is HOST TARGET binding site found in the 5' untranslated region of mRNA encoded by FGF7, corresponding to a HOST TARGET binding site such as BINDING SITE I, BINDING SITE II or BINDING SITE III. Table 2 illustrates the complementarity of the nucleotide sequences of FGF7 BINDING SITE, designated SEQ ID:7746, to the nucleotide sequence of VGAM2091 RNA, herein designated VGAM RNA, also designated SEQ ID:4802.

A function of VGAM2091 is therefore inhibition of Fibroblast Growth Factor 7 (keratinocyte growth factor) (FGF7, Accession NM_002009), a gene which growth factor active on keratinocytes. Accordingly, utilities of VGAM2091 include diagnosis, prevention and treatment of diseases and clinical conditions associated with FGF7. The function of FGF7 and its association with various diseases and clinical conditions, has been established by previous studies, as described hereinabove with reference to VGAM678. Glutamate Decarboxylase 1 (brain, 67 kDa) (GAD1, Accession NM_000817) is another VGAM2091 host target gene. GAD1 BINDING SITE is HOST TARGET binding site found in the 3' untranslated region of mRNA encoded by GAD1, corresponding to a HOST TARGET binding site such as BINDING SITE I, BINDING SITE II or BINDING SITE III. Table 2 illustrates the complementarity of the nucleotide sequences of GAD1 BINDING SITE, designated SEQ ID:6477, to the nucleotide sequence of VGAM2091 RNA, herein designated VGAM RNA, also designated SEQ ID:4802.

Another function of VGAM2091 is therefore inhibition of Glutamate Decarboxylase 1 (brain, 67 kDa) (GAD1, Accession NM_000817), a gene which catalyzes the conversion of glutamic acid to gamma-aminobutyric acid. Accordingly, utilities of VGAM2091 include diagnosis, prevention and treatment of diseases and clinical conditions associated with GAD1. The function of GAD1 and its association with various diseases and clinical conditions, has been established by previous studies, as described hereinabove with reference to VGAM691. Surfeit 4 (SURF4, Accession NM_033161) is another VGAM2091 host target gene. SURF4 BINDING SITE is HOST TARGET binding site found in the 3' untranslated region of mRNA encoded by SURF4, corresponding to a HOST TARGET binding site such as BINDING SITE I, BINDING SITE II or BINDING SITE III. Table 2 illustrates the complementarity of the nucleotide sequences of SURF4 BINDING SITE, designated SEQ ID:27013, to the nucleotide sequence of VGAM2091 RNA, herein designated VGAM RNA, also designated SEQ ID:4802.

Another function of VGAM2091 is therefore inhibition of Surfeit 4 (SURF4, Accession NM_033161), a gene which is a conserved integral membrane protein containing multiple putative transmembrane regions. Accordingly, utilities of VGAM2091 include diagnosis, prevention and treatment of diseases and clinical conditions associated with SURF4. The function of SURF4 and its association with various diseases and clinical conditions, has been established by previous studies, as described hereinabove with reference to VGAM496. KIAA1866 (Accession XM_027658) is another VGAM2091 host target gene. KIAA1866 BINDING SITE is HOST TARGET binding site found in the 3' untranslated region of mRNA encoded by KIAA1866, corresponding to a HOST TARGET binding site such as BINDING SITE I, BINDING SITE II or BINDING SITE III. Table 2 illustrates the complementarity of the nucleotide sequences of KIAA1866 BINDING SITE, designated SEQ ID:30551, to the nucleotide sequence of VGAM2091 RNA, herein designated VGAM RNA, also designated SEQ ID:4802.

Another function of VGAM2091 is therefore inhibition of KIAA1866 (Accession XM_027658). Accordingly, utilities of VGAM2091 include diagnosis, prevention and treatment of diseases and clinical conditions associated with KIAA1866. Regulator of G-protein Signalling 18 (RGS18, Accession NM_130782) is another VGAM2091 host target gene. RGS18 BINDING SITE is HOST TARGET binding site found in the 3' untranslated region of mRNA encoded by RGS18, corresponding to a HOST TARGET binding site such as BINDING SITE I, BINDING SITE II or BINDING SITE III. Table 2 illustrates the complementarity of the nucleotide sequences of RGS18 BINDING SITE, designated SEQ ID:28271, to the nucleotide sequence of VGAM2091 RNA, herein designated VGAM RNA, also designated SEQ ID:4802.

Another function of VGAM2091 is therefore inhibition of Regulator of G-protein Signalling 18 (RGS18, Accession NM_130782). Accordingly, utilities of VGAM2091 include diagnosis, prevention and treatment of diseases and clinical conditions associated with RGS18. Zinc Finger Protein 237 (ZNF237, Accession NM_014242) is another VGAM2091 host target gene. ZNF237 BINDING SITE is HOST TARGET binding site found in the 3' untranslated region of mRNA encoded by ZNF237, corresponding to a HOST TARGET binding site such as BINDING SITE I, BINDING SITE II or BINDING SITE III. Table 2 illustrates the complementarity of the nucleotide sequences of ZNF237 BINDING SITE, designated SEQ ID:15503, to the nucleotide sequence of VGAM2091 RNA, herein designated VGAM RNA, also designated SEQ ID:4802.

Another function of VGAM2091 is therefore inhibition of Zinc Finger Protein 237 (ZNF237, Accession NM_014242). Accordingly, utilities of VGAM2091 include diagnosis, prevention and treatment of diseases and clinical conditions associated with ZNF237. LOC144874 (Accession XM_096696) is another VGAM2091 host target gene. LOC144874 BINDING SITE is HOST TARGET binding site found in the 5' untranslated region of mRNA encoded by LOC144874, corresponding to a HOST TARGET binding site such as BINDING SITE I, BINDING SITE II or BINDING SITE III. Table 2 illustrates the complementarity of the nucleotide sequences of LOC144874 BINDING SITE, designated SEQ ID:40467, to the nucleotide sequence of VGAM2091 RNA, herein designated VGAM RNA, also designated SEQ ID:4802.

Another function of VGAM2091 is therefore inhibition of LOC144874 (Accession XM_096696). Accordingly, utilities of VGAM2091 include diagnosis, prevention and treatment of diseases and clinical conditions associated with LOC144874. FIG. 1 further provides a conceptual description of a novel bioinformatically detected viral gene of the present invention, referred to here as Viral Genomic Address Messenger 2092 (VGAM2092) viral gene, which modulates expression of respective host target genes thereof, the function and utility of which host target genes is known in the art.

VGAM2092 is a novel bioinformatically detected regulatory, non protein coding, viral micro RNA (miRNA) gene. The method by which VGAM2092 was detected is described hereinabove with reference to FIGS. 1-8.

VGAM2092 gene, herein designated VGAM GENE, is a viral gene contained in the genome of Fowlpox Virus. VGAM2092 host target gene, herein designated VGAM HOST TARGET GENE, is a human gene contained in the human genome.

VGAM2092 gene encodes a VGAM2092 precursor RNA, herein designated VGAM PRECURSOR RNA. Similar to other miRNA genes, and unlike most ordinary genes, VGAM2092 precursor RNA does not encode a protein. A nucleotide sequence identical or highly similar to the nucleotide sequence of VGAM2092 precursor RNA is designated SEQ ID:2078, and is provided hereinbelow with reference to the sequence listing part. Nucleotide sequence SEQ ID:2078 is located at position 102276 relative to the genome of Fowlpox Virus.

VGAM2092 precursor RNA folds onto itself, forming VGAM2092 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2092 folded precursor RNA into VGAM2092 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM2092 RNA is designated SEQ ID:4803, and is provided hereinbelow with reference to the sequence listing part.

VGAM2092 host target gene, herein designated VGAM HOST TARGET GENE, encodes a corresponding messenger RNA, VGAM2092 host target RNA, herein designated VGAM HOST TARGET RNA. VGAM2092 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2092 RNA, herein designated VGAM RNA, binds complementarily to one or more host target binding sites located in untranslated regions of VGAM2092 host target RNA, herein designated VGAM HOST TARGET RNA. This complementary binding is due to the fact that the nucleotide sequence of VGAM2092 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2092 RNA, herein designated VGAM RNA, may have a different number of host target binding sites in untranslated regions of a VGAM2092 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2092 RNA, herein designated VGAM RNA, to host target binding sites on VGAM2092 host target RNA, herein designated VGAM HOST TARGET RNA, such as BINDING SITE I, BINDING SITE II and BINDING SITE III, inhibits translation of VGAM2092 host target RNA into VGAM2092 host target protein, herein designated VGAM HOST TARGET PROTEIN. VGAM host target protein is therefore outlined by a broken line.

It is appreciated that VGAM2092 host target gene, herein designated VGAM HOST TARGET GENE, in fact represents a plurality of VGAM2092 host target genes. The mRNA of each one of this plurality of VGAM2092 host target genes comprises one or more host target binding sites, each having a nucleotide sequence which is at least partly complementary to VGAM2092 RNA, herein designated VGAM RNA, and which when bound by VGAM2092 RNA causes inhibition of translation of respective one or more VGAM2092 host target proteins.

It is further appreciated by one skilled in the art that the mode of translational inhibition illustrated by FIG. 1 with specific reference to translational inhibition exerted by VGAM2092 gene, herein designated VGAM GENE, on one or more VGAM2092 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2092 is inhibition of expression of host target genes, as part of a novel viral mechanism of attacking a host. Accordingly, utilities of VGAM2092 include diagnosis, prevention and treatment of viral infection by Fowlpox Virus. Specific functions, and accordingly utilities, of VGAM2092 correlate with, and may be deduced from, the identity of the host target genes which VGAM2092 binds and inhibits, and the function of these host target genes, as elaborated hereinbelow.

Nucleotide sequences of the VGAM2092 precursor RNA, herein designated VGAM PRECURSOR RNA, and of the 'diced' VGAM2092 RNA, herein designated VGAM RNA, and a schematic representation of the secondary folding of VGAM2092 folded precursor RNA, herein designated VGAM FOLDED PRECURSOR RNA, of VGAM2092 are further described hereinbelow with reference to Table 1.

Nucleotide sequences of host target binding sites, such as BINDING SITE-I, BINDING SITE-II and BINDING SITE-III of FIG. 1, found on VGAM2092 host target RNA, and schematic representation of the complementarity of each of these host target binding sites to VGAM2092 RNA, herein designated VGAM RNA, are described hereinbelow with reference to Table 2.

As mentioned hereinabove with reference to FIG. 1, a function of VGAM2092 gene, herein designated VGAM is inhibition of expression of VGAM2092 target genes. It is appreciated that specific functions, and accordingly utilities, of VGAM2092 correlate with, and may be deduced from, the identity of the target genes which VGAM2092 binds and inhibits, and the function of these target genes, as elaborated hereinbelow.

TEM8 (Accession NM_032208) is a VGAM2092 host target gene. TEM8 BINDING SITE is HOST TARGET binding site found in the 3' untranslated region of mRNA encoded by TEM8, corresponding to a HOST TARGET binding site such as BINDING SITE I, BINDING SITE II or BINDING SITE III. Table 2 illustrates the complementarity of the nucleotide sequences of TEM8 BINDING SITE, designated SEQ ID:25920, to the nucleotide sequence of VGAM2092 RNA, herein designated VGAM RNA, also designated SEQ ID:4803.

A function of VGAM2092 is therefore inhibition of TEM8 (Accession NM_032208), a gene which is a tumor-specific endothelial marker. Accordingly, utilities of VGAM2092 include diagnosis, prevention and treatment of diseases and clinical conditions associated with TEM8. The function of TEM8 and its association with various diseases and clinical conditions, has been established by previous studies, as described hereinabove with reference to VGAM1489. FLJ10458 (Accession NM_018096) is another VGAM2092 host target gene. FLJ10458 BINDING SITE is HOST TARGET binding site found in the 3' untranslated region of mRNA encoded by FLJ10458, corresponding to a HOST TARGET binding site such as BINDING SITE I, BINDING SITE II or BINDING SITE III. Table 2 illustrates the complementarity of the nucleotide sequences of FLJ10458 BINDING SITE, designated SEQ ID:19867, to the nucleotide sequence of VGAM2092 RNA, herein designated VGAM RNA, also designated SEQ ID:4803.

Another function of VGAM2092 is therefore inhibition of FLJ10458 (Accession NM_018096). Accordingly, utilities of VGAM2092 include diagnosis, prevention and treatment of diseases and clinical conditions associated with FLJ10458. KIAA0478 (Accession NM_014870) is another VGAM2092 host target gene. KIAA0478 BINDING SITE is HOST TARGET binding site found in the 5' untranslated region of mRNA encoded by KIAA0478, corresponding to a HOST TARGET binding site such as BINDING SITE I, BINDING SITE II or BINDING SITE III. Table 2 illustrates the complementarity of the nucleotide sequences of KIAA0478 BINDING SITE, designated SEQ ID:16987, to the nucleotide sequence of VGAM2092 RNA, herein designated VGAM RNA, also designated SEQ ID:4803.

Another function of VGAM2092 is therefore inhibition of KIAA0478 (Accession NM_014870). Accordingly, utilities of VGAM2092 include diagnosis, prevention and treatment of diseases and clinical conditions associated with KIAA0478. ZW10 Interactor (ZWINT, Accession NM_032997) is another VGAM2092 host target gene. ZWINT BINDING SITE is HOST TARGET binding site found in the 3' untranslated region of mRNA encoded by ZWINT, corresponding to a HOST TARGET binding site such as BINDING SITE I, BINDING SITE II or BINDING SITE III. Table 2 illustrates the complementarity of the nucleotide sequences of ZWINT BINDING SITE, designated SEQ ID:26877, to the nucleotide sequence of VGAM2092 RNA, herein designated VGAM RNA, also designated SEQ ID:4803.

Another function of VGAM2092 is therefore inhibition of ZW10 Interactor (ZWINT, Accession NM_032997). Accordingly, utilities of VGAM2092 include diagnosis, prevention and treatment of diseases and clinical conditions associated with ZWINT. LOC144231 (Accession XM_096561) is another VGAM2092 host target gene. LOC144231 BINDING SITE is HOST TARGET binding site found in the 5' untranslated region of mRNA encoded by LOC144231, corresponding to a HOST TARGET binding site such as BINDING SITE I, BINDING SITE II or BINDING SITE III. Table 2 illustrates the complementarity of the nucleotide sequences of LOC144231 BINDING SITE, designated SEQ ID:40395, to the nucleotide sequence of VGAM2092 RNA, herein designated VGAM RNA, also designated SEQ ID:4803.

Another function of VGAM2092 is therefore inhibition of LOC144231 (Accession XM_096561). Accordingly, utilities of VGAM2092 include diagnosis, prevention and treatment of diseases and clinical conditions associated with LOC144231. FIG. 1 further provides a conceptual description of a novel bioinformatically detected viral gene of the present invention, referred to here as Viral Genomic Address Messenger 2093 (VGAM2093) viral gene, which modulates expression of respective host target genes thereof, the function and utility of which host target genes is known in the art.

VGAM2093 is a novel bioinformatically detected regulatory, non protein coding, viral micro RNA (miRNA) gene. The method by which VGAM2093 was detected is described hereinabove with reference to FIGS. 1-8.

VGAM2093 gene, herein designated VGAM GENE, is a viral gene contained in the genome of Camelpox Virus. VGAM2093 host target gene, herein designated VGAM HOST TARGET GENE, is a human gene contained in the human genome.

VGAM2093 gene encodes a VGAM2093 precursor RNA, herein designated VGAM PRECURSOR RNA. Similar to other miRNA genes, and unlike most ordinary genes, VGAM2093 precursor RNA does not encode a protein. A nucleotide sequence identical or highly similar to the nucleotide sequence of VGAM2093 precursor RNA is designated SEQ ID:2079, and is provided hereinbelow with reference to the sequence listing part. Nucleotide sequence SEQ ID:2079 is located at position 164255 relative to the genome of Camelpox Virus.

VGAM2093 precursor RNA folds onto itself, forming VGAM2093 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2093 folded precursor RNA into VGAM2093 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2093 RNA is designated SEQ ID:4804, and is provided hereinbelow with reference to the sequence listing part.

VGAM2093 host target gene, herein designated VGAM HOST TARGET GENE, encodes a corresponding messenger RNA, VGAM2093 host target RNA, herein designated VGAM HOST TARGET RNA. VGAM2093 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2093 RNA, herein designated VGAM RNA, binds complementarily to one or more host target binding sites located in untranslated regions of VGAM2093 host target RNA, herein designated VGAM HOST TARGET RNA. This complementary binding is due to the fact that the nucleotide sequence of VGAM2093 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2093 RNA, herein designated VGAM RNA, may have a different number of host target binding sites in untranslated regions of a VGAM2093 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2093 RNA, herein designated VGAM RNA, to host target binding sites on VGAM2093 host target RNA, herein designated VGAM HOST TARGET RNA, such as BINDING SITE I, BINDING SITE II and BINDING SITE III, inhibits translation of VGAM2093 host target RNA into VGAM2093 host target protein, herein designated VGAM HOST TARGET PROTEIN. VGAM host target protein is therefore outlined by a broken line.

It is appreciated that VGAM2093 host target gene, herein designated VGAM HOST TARGET GENE, in fact represents a plurality of VGAM2093 host target genes. The mRNA of each one of this plurality of VGAM2093 host target genes comprises one or more host target binding sites, each having a nucleotide sequence which is at least partly complementary to VGAM2093 RNA, herein designated VGAM RNA, and which when bound by VGAM2093 RNA causes inhibition of translation of respective one or more VGAM2093 host target proteins.

It is further appreciated by one skilled in the art that the mode of translational inhibition illustrated by FIG. 1 with specific reference to translational inhibition exerted by VGAM2093 gene, herein designated VGAM GENE, on one or more VGAM2093 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2093 is inhibition of expression of host target genes, as part of a novel viral mechanism of attacking a host. Accordingly, utilities of VGAM2093 include diagnosis, prevention and treatment of viral infection by Camelpox Virus. Specific functions, and accordingly utilities, of VGAM2093 correlate with, and may be deduced from, the identity of the host target genes which VGAM2093 binds and inhibits, and the function of these host target genes, as elaborated hereinbelow.

Nucleotide sequences of the VGAM2093 precursor RNA, herein designated VGAM PRECURSOR RNA, and of the 'diced' VGAM2093 RNA, herein designated VGAM RNA, and a schematic representation of the secondary folding of VGAM2093 folded precursor RNA, herein designated VGAM FOLDED PRECURSOR RNA, of VGAM2093 are further described hereinbelow with reference to Table 1.

Nucleotide sequences of host target binding sites, such as BINDING SITE-I, BINDING SITE-II and BINDING SITE-III of FIG. 1, found on VGAM2093 host target RNA, and schematic representation of the complementarity of each of these host target binding sites to VGAM2093 RNA, herein designated VGAM RNA, are described hereinbelow with reference to Table 2.

As mentioned hereinabove with reference to FIG. 1, a function of VGAM2093 gene, herein designated VGAM is inhibition of expression of VGAM2093 target genes. It is appreciated that specific functions, and accordingly utilities, of VGAM2093 correlate with, and may be deduced from, the identity of the target genes which VGAM2093 binds and inhibits, and the function of these target genes, as elaborated hereinbelow.

Adaptor-related Protein Complex 1, Sigma 2 Subunit (AP1S2, Accession NM_003916) is a VGAM2093 host target gene. AP1S2 BINDING SITE is HOST TARGET binding site found in the 3' untranslated region of mRNA encoded by AP1S2, corresponding to a HOST TARGET binding site such as BINDING SITE I, BINDING SITE II or BINDING SITE III. Table 2 illustrates the complementarity of the nucleotide sequences of AP1S2 BINDING SITE, designated SEQ ID:9999, to the nucleotide sequence of VGAM2093 RNA, herein designated VGAM RNA, also designated SEQ ID:4804.

A function of VGAM2093 is therefore inhibition of Adaptor-related Protein Complex 1, Sigma 2 Subunit (AP1S2, Accession NM_003916). Accordingly, utilities of VGAM2093 include diagnosis, prevention and treatment of diseases and clinical conditions associated with AP1S2. FIG. 1 further provides a conceptual description of a novel bioinformatically detected viral gene of the present invention, referred to here as Viral Genomic Address Messenger 2094 (VGAM2094) viral gene, which modulates expression of respective host target genes thereof, the function and utility of which host target genes is known in the art.

VGAM2094 is a novel bioinformatically detected regulatory, non protein coding, viral micro RNA (miRNA) gene. The method by which VGAM2094 was detected is described hereinabove with reference to FIGS. 1-8.

VGAM2094 gene, herein designated VGAM GENE, is a viral gene contained in the genome of Camelpox Virus. VGAM2094 host target gene, herein designated VGAM HOST TARGET GENE, is a human gene contained in the human genome.

VGAM2094 gene encodes a VGAM2094 precursor RNA, herein designated VGAM PRECURSOR RNA. Similar to other miRNA genes, and unlike most ordinary genes, VGAM2094 precursor RNA does not encode a protein. A nucleotide sequence identical or highly similar to the nucleotide sequence of VGAM2094 precursor RNA is designated SEQ ID:2080, and is provided hereinbelow with reference to the sequence listing part. Nucleotide sequence SEQ ID:2080 is located at position 169679 relative to the genome of Camelpox Virus.

VGAM2094 precursor RNA folds onto itself, forming VGAM2094 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2094 folded precursor RNA into VGAM2094 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2094 RNA is designated SEQ ID:4805, and is provided hereinbelow with reference to the sequence listing part.

VGAM2094 host target gene, herein designated VGAM HOST TARGET GENE, encodes a corresponding messenger RNA, VGAM2094 host target RNA, herein designated VGAM HOST TARGET RNA. VGAM2094 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2094 RNA, herein designated VGAM RNA, binds complementarily to one or more host target binding sites located in untranslated regions of VGAM2094 host target RNA, herein designated VGAM HOST TARGET RNA. This complementary binding is due to the fact that the nucleotide sequence of VGAM2094 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2094 RNA, herein designated VGAM RNA, may have a different number of host target binding sites in untranslated regions of a VGAM2094 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2094 RNA, herein designated VGAM RNA, to host target binding sites on VGAM2094 host target RNA, herein designated VGAM HOST TARGET RNA, such as BINDING SITE I, BINDING SITE II and BINDING SITE III, inhibits translation of VGAM2094 host target RNA into VGAM2094 host target protein, herein designated VGAM HOST TARGET PROTEIN. VGAM host target protein is therefore outlined by a broken line.

It is appreciated that VGAM2094 host target gene, herein designated VGAM HOST TARGET GENE, in fact represents a plurality of VGAM2094 host target genes. The mRNA of each one of this plurality of VGAM2094 host target genes comprises one or more host target binding sites, each having a nucleotide sequence which is at least partly complementary to VGAM2094 RNA, herein designated VGAM RNA, and which when bound by VGAM2094 RNA causes inhibition of translation of respective one or more VGAM2094 host target proteins.

It is further appreciated by one skilled in the art that the mode of translational inhibition illustrated by FIG. 1 with specific reference to translational inhibition exerted by VGAM2094 gene, herein designated VGAM GENE, on one or more VGAM2094 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2094 is inhibition of expression of host target genes, as part of a novel viral mechanism of attacking a host. Accordingly, utilities of VGAM2094 include diagnosis, prevention and treatment of viral infection by Camelpox Virus. Specific functions, and accordingly utilities, of VGAM2094 correlate with, and may be deduced from, the identity of the host target genes which VGAM2094 binds and inhibits, and the function of these host target genes, as elaborated hereinbelow.

Nucleotide sequences of the VGAM2094 precursor RNA, herein designated VGAM PRECURSOR RNA, and of the 'diced' VGAM2094 RNA, herein designated VGAM RNA, and a schematic representation of the secondary folding of VGAM2094 folded precursor RNA, herein designated VGAM FOLDED PRECURSOR RNA, of VGAM2094 are further described hereinbelow with reference to Table 1.

Nucleotide sequences of host target binding sites, such as BINDING SITE-I, BINDING SITE-II and BINDING SITE-III of FIG. 1, found on VGAM2094 host target RNA, and schematic representation of the complementarity of each of these host target binding sites to VGAM2094 RNA, herein designated VGAM RNA, are described hereinbelow with reference to Table 2.

As mentioned hereinabove with reference to FIG. 1, a function of VGAM2094 gene, herein designated VGAM is inhibition of expression of VGAM2094 target genes. It is appreciated that specific functions, and accordingly utilities, of VGAM2094 correlate with, and may be deduced from, the identity of the target genes which VGAM2094 binds and inhibits, and the function of these target genes, as elaborated hereinbelow.

GM2 Ganglioside Activator Protein (GM2A, Accession XM_041978) is a VGAM2094 host target gene. GM2A BINDING SITE is HOST TARGET binding site found in the 3' untranslated region of mRNA encoded by GM2A, corresponding to a HOST TARGET binding site such as BINDING SITE I, BINDING SITE II or BINDING SITE III. Table 2 illustrates the complementarity of the nucleotide sequences of GM2A BINDING SITE, designated SEQ ID:33658, to the nucleotide sequence of VGAM2094 RNA, herein designated VGAM RNA, also designated SEQ ID:4805.

A function of VGAM2094 is therefore inhibition of GM2 Ganglioside Activator Protein (GM2A, Accession XM_041978). Accordingly, utilities of VGAM2094 include diagnosis, prevention and treatment of diseases and clinical conditions associated with GM2A. Lymphocyte Cytosolic Protein 1 (L-plastin) (LCP1, Accession NM_002298) is another VGAM2094 host target gene. LCP1 BINDING SITE is HOST TARGET binding site found in the 3' untranslated region of mRNA encoded by LCP1, corresponding to a HOST TARGET binding site such as BINDING SITE I, BINDING SITE II or BINDING SITE III. Table 2 illustrates the complementarity of the nucleotide sequences of LCP1 BINDING SITE, designated SEQ ID:8081, to the nucleotide sequence of VGAM2094 RNA, herein designated VGAM RNA, also designated SEQ ID:4805.

Another function of VGAM2094 is therefore inhibition of Lymphocyte Cytosolic Protein 1 (L-plastin) (LCP1, Accession NM_002298), a gene which is involved in t cell antigen receptor mediated signaling. Accordingly, utilities of VGAM2094 include diagnosis, prevention and treatment of diseases and clinical conditions associated with LCP1. The function of LCP1 and its association with various diseases and clinical conditions, has been established by previous studies, as described hereinabove with reference to VGAM418. Ribosomal Protein S6 Kinase, 90 kDa, Polypeptide 5 (RPS6KA5, Accession NM_004755) is another VGAM2094 host target gene. RPS6KA5 BINDING SITE is HOST TARGET binding site found in the 3' untranslated region of mRNA encoded by RPS6KA5, corresponding to a HOST TARGET binding site such as BINDING SITE I, BINDING SITE II or BINDING SITE III. Table 2 illustrates the complementarity of the nucleotide sequences of RPS6KA5 BINDING SITE, designated SEQ ID:11142, to the nucleotide sequence of VGAM2094 RNA, herein designated VGAM RNA, also designated SEQ ID:4805.

Another function of VGAM2094 is therefore inhibition of Ribosomal Protein S6 Kinase, 90 kDa, Polypeptide 5 (RPS6KA5, Accession NM_004755), a gene which plays an essential role in the proliferation of yeast cells. Accordingly, utilities of VGAM2094 include diagnosis, prevention and treatment of diseases and clinical conditions associated with RPS6KA5. The function of RPS6KA5 and its association with various diseases and clinical conditions, has been established by previous studies, as described hereinabove with reference to VGAM191. Tumor Protein P63 (TP63, Accession NM_003722) is another VGAM2094 host target gene. TP63 BINDING SITE is HOST TARGET binding site found in the 3' untranslated region of mRNA encoded by TP63, corresponding to a HOST TARGET binding site such as BINDING SITE I, BINDING SITE II or BINDING SITE III. Table 2 illustrates the complementarity of the nucleotide sequences of TP63 BINDING SITE, designated SEQ ID:9814, to the nucleotide sequence of VGAM2094 RNA, herein designated VGAM RNA, also designated SEQ ID:4805.

Another function of VGAM2094 is therefore inhibition of Tumor Protein P63 (TP63, Accession NM_003722). Accordingly, utilities of VGAM2094 include diagnosis, prevention and treatment of diseases and clinical conditions associated with TP63. Vacuolar Protein Sorting 41 (yeast) (VPS41, Accession NM_014396) is another VGAM2094 host target gene. VPS41 BINDING SITE is HOST TARGET binding site found in the 3' untranslated region of mRNA encoded by VPS41, corresponding to a HOST TARGET binding site such as BINDING SITE I, BINDING SITE II or BINDING SITE III. Table 2 illustrates the complementarity of the nucleotide sequences of VPS41 BINDING SITE, designated SEQ ID:15737, to the nucleotide sequence of VGAM2094 RNA, herein designated VGAM RNA, also designated SEQ ID:4805.

Another function of VGAM2094 is therefore inhibition of Vacuolar Protein Sorting 41 (yeast) (VPS41, Accession NM_014396). Accordingly, utilities of VGAM2094 include diagnosis, prevention and treatment of diseases and clinical conditions associated with VPS41. KIAA0766 (Accession NM_014805) is another VGAM2094 host target gene. KIAA0766 BINDING SITE is HOST TARGET binding site found in the 3' untranslated region of mRNA encoded by KIAA0766, corresponding to a HOST TARGET binding site such as BINDING SITE I, BINDING SITE II or BINDING SITE III. Table 2 illustrates the complementarity of the nucleotide sequences of KIAA0766 BINDING SITE, designated SEQ ID:16740, to the nucleotide sequence of VGAM2094 RNA, herein designated VGAM RNA, also designated SEQ ID:4805.

Another function of VGAM2094 is therefore inhibition of KIAA0766 (Accession NM_014805). Accordingly, utilities of VGAM2094 include diagnosis, prevention and treatment of diseases and clinical conditions associated with KIAA0766. Paternally Expressed 10 (PEG10, Accession NM_015068) is another VGAM2094 host target gene. PEG10 BINDING SITE is HOST TARGET binding site found in the 3' untranslated region of mRNA encoded by PEG10, corresponding to a HOST TARGET binding site such as BINDING SITE I, BINDING SITE II or BINDING SITE III. Table 2 illustrates the complementarity of the nucleotide sequences of PEG10 BINDING SITE, designated SEQ ID:17422, to the nucleotide sequence of VGAM2094 RNA, herein designated VGAM RNA, also designated SEQ ID:4805.

Another function of VGAM2094 is therefore inhibition of Paternally Expressed 10 (PEG10, Accession NM_015068). Accordingly, utilities of VGAM2094 include diagnosis, prevention and treatment of diseases and clinical conditions associated with PEG10. LOC146506 (Accession XM_085489) is another VGAM2094 host target gene. LOC146506 BINDING SITE is HOST TARGET binding site found in the 3' untranslated region of mRNA encoded by LOC146506, corresponding to a HOST TARGET binding site such as BINDING SITE I, BINDING SITE II or BINDING SITE III. Table 2 illustrates the complementarity of the nucleotide sequences of LOC146506 BINDING SITE, designated SEQ ID:38177, to the nucleotide sequence of VGAM2094 RNA, herein designated VGAM RNA, also designated SEQ ID:4805.

Another function of VGAM2094 is therefore inhibition of LOC146506 (Accession XM_085489). Accordingly, utilities of VGAM2094 include diagnosis, prevention and treatment of diseases and clinical conditions associated with LOC146506. LOC149301 (Accession XM_086480) is another VGAM2094 host target gene. LOC149301 BINDING SITE is HOST TARGET binding site found in the 3' untranslated region of mRNA encoded by LOC149301, corresponding to a HOST TARGET binding site such as BINDING SITE I, BINDING SITE II or BINDING SITE III. Table 2 illustrates the complementarity of the nucleotide sequences of LOC149301 BINDING SITE, designated SEQ ID:38689, to the nucleotide sequence of VGAM2094 RNA, herein designated VGAM RNA, also designated SEQ ID:4805.

Another function of VGAM2094 is therefore inhibition of LOC149301 (Accession XM_086480). Accordingly, utilities of VGAM2094 include diagnosis, prevention and treatment of diseases and clinical conditions associated with LOC149301. LOC153525 (Accession XM_098383) is another VGAM2094 host target gene. LOC153525 BINDING SITE is HOST TARGET binding site found in the 3' untranslated region of mRNA encoded by LOC153525, corresponding to a HOST TARGET binding site such as BINDING SITE I, BINDING SITE II or BINDING SITE III. Table 2 illustrates the complementarity of the nucleotide sequences of LOC153525 BINDING SITE, designated SEQ ID:41637, to the nucleotide sequence of VGAM2094 RNA, herein designated VGAM RNA, also designated SEQ ID:4805.

Another function of VGAM2094 is therefore inhibition of LOC153525 (Accession XM_098383). Accordingly, utilities of VGAM2094 include diagnosis, prevention and treatment of diseases and clinical conditions associated with LOC153525. LOC255520 (Accession XM_171073) is another VGAM2094 host target gene. LOC255520 BINDING SITE is HOST TARGET binding site found in the 3' untranslated region of mRNA encoded by LOC255520, corresponding to a HOST TARGET binding site such as BINDING SITE I, BINDING SITE II or BINDING SITE III. Table 2 illustrates the complementarity of the nucleotide sequences of LOC255520 BINDING SITE, designated SEQ ID:45878, to the nucleotide sequence of VGAM2094 RNA, herein designated VGAM RNA, also designated SEQ ID:4805.

Another function of VGAM2094 is therefore inhibition of LOC255520 (Accession XM_171073). Accordingly, utilities of VGAM2094 include diagnosis, prevention and treatment of diseases and clinical conditions associated with LOC255520. FIG. 1 further provides a conceptual description of a novel bioinformatically detected viral gene of the present invention, referred to here as Viral Genomic Address Messenger 2095 (VGAM2095) viral gene, which modulates expression of respective host target genes thereof, the function and utility of which host target genes is known in the art.

VGAM2095 is a novel bioinformatically detected regulatory, non protein coding, viral micro RNA (miRNA) gene. The method by which VGAM2095 was detected is described hereinabove with reference to FIGS. 1-8.

VGAM2095 gene, herein designated VGAM GENE, is a viral gene contained in the genome of Camelpox Virus. VGAM2095 host target gene, herein designated VGAM HOST TARGET GENE, is a human gene contained in the human genome.

VGAM2095 gene encodes a VGAM2095 precursor RNA, herein designated VGAM PRECURSOR RNA. Similar to other miRNA genes, and unlike most ordinary genes, VGAM2095 precursor RNA does not encode a protein. A nucleotide sequence identical or highly similar to the nucleotide sequence of VGAM2095 precursor RNA is designated SEQ ID:2081, and is provided hereinbelow with reference to the sequence listing part. Nucleotide sequence SEQ ID:2081 is located at position 174432 relative to the genome of Camelpox Virus.

VGAM2095 precursor RNA folds onto itself, forming VGAM2095 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2095 folded precursor RNA into VGAM2095 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2095 RNA is designated SEQ ID:4806, and is provided hereinbelow with reference to the sequence listing part.

VGAM2095 host target gene, herein designated VGAM HOST TARGET GENE, encodes a corresponding messenger RNA, VGAM2095 host target RNA, herein designated VGAM HOST TARGET RNA. VGAM2095 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2095 RNA, herein designated VGAM RNA, binds complementarily to one or more host target binding sites located in untranslated regions of VGAM2095 host target RNA, herein designated VGAM HOST TARGET RNA. This complementary binding is due to the fact that the nucleotide sequence of VGAM2095 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2095 RNA, herein designated VGAM RNA, may have a different number of host target binding sites in untranslated regions of a VGAM2095 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2095 RNA, herein designated VGAM RNA, to host target binding sites on VGAM2095 host target RNA, herein designated VGAM HOST TARGET RNA, such as BINDING SITE I, BINDING SITE II and BINDING SITE III, inhibits translation of VGAM2095 host target RNA into VGAM2095 host target protein, herein designated VGAM HOST TARGET PROTEIN. VGAM host target protein is therefore outlined by a broken line.

It is appreciated that VGAM2095 host target gene, herein designated VGAM HOST TARGET GENE, in fact represents a plurality of VGAM2095 host target genes. The mRNA of each one of this plurality of VGAM2095 host target genes comprises one or more host target binding sites, each having a nucleotide sequence which is at least partly complementary to VGAM2095 RNA, herein designated VGAM RNA, and which when bound by VGAM2095 RNA causes inhibition of translation of respective one or more VGAM2095 host target proteins.

It is further appreciated by one skilled in the art that the mode of translational inhibition illustrated by FIG. 1 with specific reference to translational inhibition exerted by VGAM2095 gene, herein designated VGAM GENE, on one or more VGAM2095 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2095 is inhibition of expression of host target genes, as part of a novel viral mechanism of attacking a host. Accordingly, utilities of VGAM2095 include diagnosis, prevention and treatment of viral infection by Camelpox Virus. Specific functions, and accordingly utilities, of VGAM2095 correlate with, and may be deduced from, the identity of the host target genes which VGAM2095 binds and inhibits, and the function of these host target genes, as elaborated hereinbelow.

Nucleotide sequences of the VGAM2095 precursor RNA, herein designated VGAM PRECURSOR RNA, and of the 'diced' VGAM2095 RNA, herein designated VGAM RNA, and a schematic representation of the secondary folding of VGAM2095 folded precursor RNA, herein designated VGAM FOLDED PRECURSOR RNA, of VGAM2095 are further described hereinbelow with reference to Table 1.

Nucleotide sequences of host target binding sites, such as BINDING SITE-I, BINDING SITE-II and BINDING SITE-III of FIG. 1, found on VGAM2095 host target RNA, and schematic representation of the complementarity of each of these host target binding sites to VGAM2095 RNA, herein designated VGAM RNA, are described hereinbelow with reference to Table 2.

As mentioned hereinabove with reference to FIG. 1, a function of VGAM2095 gene, herein designated VGAM is inhibition of expression of VGAM2095 target genes. It is appreciated that specific functions, and accordingly utilities, of VGAM2095 correlate with, and may be deduced from, the identity of the target genes which VGAM2095 binds and inhibits, and the function of these target genes, as elaborated hereinbelow.

V-kit Hardy-Zuckerman 4 Feline Sarcoma Viral Oncogene Homolog (KIT, Accession NM_000222) is a VGAM2095 host target gene. KIT BINDING SITE is HOST TARGET binding site found in the 3' untranslated region of mRNA encoded by KIT, corresponding to a HOST TARGET binding site such as BINDING SITE I, BINDING SITE II or BINDING SITE III. Table 2 illustrates the complementarity of the nucleotide sequences of KIT BINDING SITE, designated SEQ ID:5732, to the nucleotide sequence of VGAM2095 RNA, herein designated VGAM RNA, also designated SEQ ID:4806.

A function of VGAM2095 is therefore inhibition of V-kit Hardy-Zuckerman 4 Feline Sarcoma Viral Oncogene Homolog (KIT, Accession NM_000222), a gene which is the receptor for stem cell factor (mast cell growth factor) and has a tyrosine-protein kinase activity. Accordingly, utilities of VGAM2095 include diagnosis, prevention and treatment of diseases and clinical conditions associated with KIT. The function of KIT and its association with various diseases and clinical conditions, has been established by previous studies, as described hereinabove with reference to VGAM173. Pumilio Homolog 2 (Drosophila) (PUM2, Accession NM_015317) is another VGAM2095 host target gene. PUM2 BINDING SITE is HOST TARGET binding site found in the 3' untranslated region of mRNA encoded by PUM2, corresponding to a HOST TARGET binding site such as BINDING SITE I, BINDING SITE II or BINDING SITE III. Table 2 illustrates the complementarity of the nucleotide sequences of PUM2 BINDING SITE, designated SEQ ID:17634, to the nucleotide sequence of VGAM2095 RNA, herein designated VGAM RNA, also designated SEQ ID:4806.

Another function of VGAM2095 is therefore inhibition of Pumilio Homolog 2 (Drosophila) (PUM2, Accession NM_015317). Accordingly, utilities of VGAM2095 include diagnosis, prevention and treatment of diseases and clinical conditions associated with PUM2. Solute Carrier Family 25, Member 13 (citrin) (SLC25A13, Accession NM_014251) is another VGAM2095 host target gene. SLC25A13 BINDING SITE is HOST TARGET binding site found in the 3' untranslated region of mRNA encoded by SLC25A13, corresponding to a HOST TARGET binding site such as BINDING SITE I, BINDING SITE II or BINDING SITE III. Table 2 illustrates the complementarity of the nucleotide sequences of SLC25A13 BINDING SITE, designated SEQ ID:15523, to the nucleotide sequence of VGAM2095 RNA, herein designated VGAM RNA, also designated SEQ ID:4806.

Another function of VGAM2095 is therefore inhibition of Solute Carrier Family 25, Member 13 (citrin) (SLC25A13, Accession NM_014251). Accordingly, utilities of VGAM2095 include diagnosis, prevention and treatment of diseases and clinical conditions associated with SLC25A13. START Domain Containing 5 (STARD5, Accession NM_030574) is another VGAM2095 host target gene. STARD5 BINDING SITE is HOST TARGET binding site found in the 5' untranslated region of mRNA encoded by STARD5, corresponding to a HOST TARGET binding site such as BINDING SITE I, BINDING SITE II or BINDING SITE III. Table 2 illustrates the complementarity of the nucleotide sequences of STARD5 BINDING SITE, designated SEQ ID:24947, to the nucleotide sequence of VGAM2095 RNA, herein designated VGAM RNA, also designated SEQ ID:4806.

Another function of VGAM2095 is therefore inhibition of START Domain Containing 5 (STARD5, Accession NM_030574). Accordingly, utilities of VGAM2095 include diagnosis, prevention and treatment of diseases and clinical conditions associated with STARD5. Transmembrane Protein 1 (TMEM1, Accession NM_003274) is another VGAM2095 host target gene. TMEM1 BINDING SITE is HOST TARGET binding site found in the 3' untranslated region of mRNA encoded by TMEM1, corresponding to a HOST TARGET binding site such as BINDING SITE I, BINDING SITE II or BINDING SITE III. Table 2 illustrates the complementarity of the nucleotide sequences of TMEM1 BINDING SITE, designated SEQ ID:9287, to the nucleotide sequence of VGAM2095 RNA, herein designated VGAM RNA, also designated SEQ ID:4806.

Another function of VGAM2095 is therefore inhibition of Transmembrane Protein 1 (TMEM1, Accession NM_003274). Accordingly, utilities of VGAM2095 include diagnosis, prevention and treatment of diseases and clinical conditions associated with TMEM1. BC022889 (Accession XM_096964) is another VGAM2095 host target gene. BC022889 BINDING SITE is HOST TARGET binding site found in the 3' untranslated region of mRNA encoded by BC022889, corresponding to a HOST TARGET binding site such as BINDING SITE I, BINDING SITE II or BINDING SITE III. Table 2 illustrates the complementarity of the nucleotide sequences of BC022889 BINDING SITE, designated SEQ ID:40682, to the nucleotide sequence of VGAM2095 RNA, herein designated VGAM RNA, also designated SEQ ID:4806.

Another function of VGAM2095 is therefore inhibition of BC022889 (Accession XM_096964). Accordingly, utilities of VGAM2095 include diagnosis, prevention and treatment of diseases and clinical conditions associated with BC022889. Chromosome 22 Open Reading Frame 19 (C22orf19, Accession NM_003678) is another VGAM2095 host target gene. C22orf19 BINDING SITE is HOST TARGET binding site found in the 3' untranslated region of mRNA encoded by C22orf19, corresponding to a HOST TARGET binding site such as BINDING SITE I, BINDING SITE II or BINDING SITE III. Table 2 illustrates the complementarity of the nucleotide sequences of C22orf19 BINDING SITE, designated SEQ ID:9771, to the nucleotide sequence of VGAM2095 RNA, herein designated VGAM RNA, also designated SEQ ID:4806.

Another function of VGAM2095 is therefore inhibition of Chromosome 22 Open Reading Frame 19 (C22orf19, Accession NM_003678). Accordingly, utilities of VGAM2095 include diagnosis, prevention and treatment of diseases and clinical conditions associated with C22orf19. DKFZp761D221 (Accession NM_032291) is another VGAM2095 host target gene. DKFZp761D221 BINDING SITE is HOST TARGET binding site found in the 3' untranslated region of mRNA encoded by DKFZp761D221, corresponding to a HOST TARGET binding site such as BINDING SITE I, BINDING SITE II or BINDING SITE III. Table 2 illustrates the complementarity of the nucleotide sequences of DKFZp761D221 BINDING SITE, designated SEQ ID:26055, to the nucleotide sequence of VGAM2095 RNA, herein designated VGAM RNA, also designated SEQ ID:4806.

Another function of VGAM2095 is therefore inhibition of DKFZp761D221 (Accession NM_032291). Accordingly, utilities of VGAM2095 include diagnosis, prevention and treatment of diseases and clinical conditions associated with DKFZp761D221. DKFZP761G1913 (Accession NM_031474) is another VGAM2095 host target gene. DKFZP761G1913 BINDING SITE is HOST TARGET binding site found in the 3' untranslated region of mRNA encoded by DKFZP761G1913, corresponding to a HOST TARGET binding site such as BINDING SITE I, BINDING SITE II or BINDING SITE III. Table 2 illustrates the complementarity of the nucleotide sequences of DKFZP761G1913 BINDING SITE, designated SEQ ID:25544, to the nucleotide sequence of VGAM2095 RNA, herein designated VGAM RNA, also designated SEQ ID:4806.

Another function of VGAM2095 is therefore inhibition of DKFZP761G1913 (Accession NM_031474). Accordingly, utilities of VGAM2095 include diagnosis, prevention and treatment of diseases and clinical conditions associated with DKFZP761G1913. FLJ10706 (Accession NM_018186) is another VGAM2095 host target gene. FLJ10706 BINDING SITE is HOST TARGET binding site found in the 5' untranslated region of mRNA encoded by FLJ10706, corresponding to a HOST TARGET binding site such as BINDING SITE I, BINDING SITE II or BINDING SITE III. Table 2 illustrates the complementarity of the nucleotide sequences of FLJ10706 BINDING SITE, designated SEQ ID:20037, to the nucleotide sequence of VGAM2095 RNA, herein designated VGAM RNA, also designated SEQ ID:4806.

Another function of VGAM2095 is therefore inhibition of FLJ10706 (Accession NM_018186). Accordingly, utilities of VGAM2095 include diagnosis, prevention and treatment of diseases and clinical conditions associated with FLJ10706. Hydroxysteroid (17-beta) Dehydrogenase 12 (HSD17B12, Accession NM_016142) is another VGAM2095 host target gene. HSD17B12 BINDING SITE is HOST TARGET binding site found in the 3' untranslated region of mRNA encoded by HSD17B12, corresponding to a HOST TARGET binding site such as BINDING SITE I, BINDING SITE II or BINDING SITE III. Table 2 illustrates the complementarity of the nucleotide sequences of HSD17B12 BINDING SITE, designated SEQ ID:18226, to the nucleotide sequence of VGAM2095 RNA, herein designated VGAM RNA, also designated SEQ ID:4806.

Another function of VGAM2095 is therefore inhibition of Hydroxysteroid (17-beta) Dehydrogenase 12 (HSD17B12, Accession NM_016142). Accordingly, utilities of VGAM2095 include diagnosis, prevention and treatment of diseases and clinical conditions associated with HSD17B12. KIAA1078 (Accession XM_036589) is another VGAM2095 host target gene. KIAA1078 BINDING SITE is HOST TARGET binding site found in the 3' untranslated region of mRNA encoded by KIAA1078, corresponding to a HOST TARGET binding site such as BINDING SITE I, BINDING SITE II or BINDING SITE III. Table 2 illustrates the complementarity of the nucleotide sequences of KIAA1078 BINDING SITE, designated SEQ ID:32470, to the nucleotide sequence of VGAM2095 RNA, herein designated VGAM RNA, also designated SEQ ID:4806.

Another function of VGAM2095 is therefore inhibition of KIAA1078 (Accession XM_036589). Accordingly, utilities of VGAM2095 include diagnosis, prevention and treatment of diseases and clinical conditions associated with KIAA1078. SEC24 Related Gene Family, Member D (S. cerevisiae) (SEC24D, Accession NM_014822) is another VGAM2095 host target gene. SEC24D BINDING SITE is HOST TARGET binding site found in the 5' untranslated region of mRNA encoded by SEC24D, corresponding to a HOST TARGET binding site such as BINDING SITE I, BINDING SITE II or BINDING SITE III. Table 2 illustrates the complementarity of the nucleotide sequences of SEC24D BINDING SITE, designated SEQ ID:16800, to the nucleotide sequence of VGAM2095 RNA, herein designated VGAM RNA, also designated SEQ ID:4806.

Another function of VGAM2095 is therefore inhibition of SEC24 Related Gene Family, Member D (S. cerevisiae) (SEC24D, Accession NM_014822). Accordingly, utilities of VGAM2095 include diagnosis, prevention and treatment of diseases and clinical conditions associated with SEC24D. LOC158428 (Accession XM_047249) is another VGAM2095 host target gene. LOC158428 BINDING SITE is HOST TARGET binding site found in the 5' untranslated region of mRNA encoded by LOC158428, corresponding to a HOST TARGET binding site such as BINDING SITE I, BINDING SITE II or BINDING SITE III. Table 2 illustrates the complementarity of the nucleotide sequences of LOC158428 BINDING SITE, designated SEQ ID:34921, to the nucleotide sequence of VGAM2095 RNA, herein designated VGAM RNA, also designated SEQ ID:4806.

Another function of VGAM2095 is therefore inhibition of LOC158428 (Accession XM_047249). Accordingly, utilities of VGAM2095 include diagnosis, prevention and treatment of diseases and clinical conditions associated with LOC158428. LOC257428 (Accession XM_168584) is another VGAM2095 host target gene. LOC257428 BINDING SITE is HOST TARGET binding site found in the 5' untranslated region of mRNA encoded by LOC257428, corresponding to a HOST TARGET binding site such as BINDING SITE I, BINDING SITE II or BINDING SITE III. Table 2 illustrates the complementarity of the nucleotide sequences of LOC257428 BINDING SITE, designated SEQ ID:45262, to the nucleotide sequence of VGAM2095 RNA, herein designated VGAM RNA, also designated SEQ ID:4806.

Another function of VGAM2095 is therefore inhibition of LOC257428 (Accession XM_168584). Accordingly, utilities of VGAM2095 include diagnosis, prevention and treatment of diseases and clinical conditions associated with LOC257428. LOC91549 (Accession XM_039115) is another VGAM2095 host target gene. LOC91549 BINDING SITE is HOST TARGET binding site found in the 3' untranslated region of mRNA encoded by LOC91549, corresponding to a HOST TARGET binding site such as BINDING SITE I, BINDING SITE II or BINDING SITE III. Table 2 illustrates the complementarity of the nucleotide sequences of LOC91549 BINDING SITE, designated SEQ ID:33014, to the nucleotide sequence of VGAM2095 RNA, herein designated VGAM RNA, also designated SEQ ID:4806.

Another function of VGAM2095 is therefore inhibition of LOC91549 (Accession XM_039115). Accordingly, utilities of VGAM2095 include diagnosis, prevention and treatment of diseases and clinical conditions associated with LOC91549. FIG. 1 further provides a conceptual description of a novel bioinformatically detected viral gene of the present invention, referred to here as Viral Genomic Address Messenger 2096 (VGAM2096) viral gene, which modulates expression of respective host target genes thereof, the function and utility of which host target genes is known in the art.

VGAM2096 is a novel bioinformatically detected regulatory, non protein coding, viral micro RNA (miRNA) gene. The method by which VGAM2096 was detected is described hereinabove with reference to FIGS. 1-8.

VGAM2096 gene, herein designated VGAM GENE, is a viral gene contained in the genome of Camelpox Virus. VGAM2096 host target gene, herein designated VGAM HOST TARGET GENE, is a human gene contained in the human genome.

VGAM2096 gene encodes a VGAM2096 precursor RNA, herein designated VGAM PRECURSOR RNA. Similar to other miRNA genes, and unlike most ordinary genes, VGAM2096 precursor RNA does not encode a protein. A nucleotide sequence identical or highly similar to the nucleotide sequence of VGAM2096 precursor RNA is designated SEQ ID:2082, and is provided hereinbelow with reference to the sequence listing part. Nucleotide sequence SEQ ID:2082 is located at position 170764 relative to the genome of Camelpox Virus.

VGAM2096 precursor RNA folds onto itself, forming VGAM2096 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2096 folded precursor RNA into VGAM2096 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM2096 RNA is designated SEQ ID:4807, and is provided hereinbelow with reference to the sequence listing part.

VGAM2096 host target gene, herein designated VGAM HOST TARGET GENE, encodes a corresponding messenger RNA, VGAM2096 host target RNA, herein designated VGAM HOST TARGET RNA. VGAM2096 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2096 RNA, herein designated VGAM RNA, binds complementarily to one or more host target binding sites located in untranslated regions of VGAM2096 host target RNA, herein designated VGAM HOST TARGET RNA. This complementary binding is due to the fact that the nucleotide sequence of VGAM2096 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2096 RNA, herein designated VGAM RNA, may have a different number of host target binding sites in untranslated regions of a VGAM2096 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2096 RNA, herein designated VGAM RNA, to host target binding sites on VGAM2096 host target RNA, herein designated VGAM HOST TARGET RNA, such as BINDING SITE I, BINDING SITE II and BINDING SITE III, inhibits translation of VGAM2096 host target RNA into VGAM2096 host target protein, herein designated VGAM HOST TARGET PROTEIN. VGAM host target protein is therefore outlined by a broken line.

It is appreciated that VGAM2096 host target gene, herein designated VGAM HOST TARGET GENE, in fact represents a plurality of VGAM2096 host target genes. The mRNA of each one of this plurality of VGAM2096 host target genes comprises one or more host target binding sites, each having a nucleotide sequence which is at least partly complementary to VGAM2096 RNA, herein designated VGAM RNA, and which when bound by VGAM2096 RNA causes inhibition of translation of respective one or more VGAM2096 host target proteins.

It is further appreciated by one skilled in the art that the mode of translational inhibition illustrated by FIG. 1 with specific reference to translational inhibition exerted by VGAM2096 gene, herein designated VGAM GENE, on one or more VGAM2096 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2096 is inhibition of expression of host target genes, as part of a novel viral mechanism of attacking a host. Accordingly, utilities of VGAM2096 include diagnosis, prevention and treatment of viral infection by Camelpox Virus. Specific functions, and accordingly utilities, of VGAM2096 correlate with, and may be deduced from, the identity of the host target genes which VGAM2096 binds and inhibits, and the function of these host target genes, as elaborated hereinbelow.

Nucleotide sequences of the VGAM2096 precursor RNA, herein designated VGAM PRECURSOR RNA, and of the 'diced' VGAM2096 RNA, herein designated VGAM RNA, and a schematic representation of the secondary folding of VGAM2096 folded precursor RNA, herein designated VGAM FOLDED PRECURSOR RNA, of VGAM2096 are further described hereinbelow with reference to Table 1.

Nucleotide sequences of host target binding sites, such as BINDING SITE-I, BINDING SITE-II and BINDING SITE-III of FIG. 1, found on VGAM2096 host target RNA, and schematic representation of the complementarity of each of these host target binding sites to VGAM2096 RNA, herein designated VGAM RNA, are described hereinbelow with reference to Table 2.

As mentioned hereinabove with reference to FIG. 1, a function of VGAM2096 gene, herein designated VGAM is inhibition of expression of VGAM2096 target genes. It is appreciated that specific functions, and accordingly utilities, of VGAM2096 correlate with, and may be deduced from, the identity of the target genes which VGAM2096 binds and inhibits, and the function of these target genes, as elaborated hereinbelow.

LEC3 (Accession NM_015236) is a VGAM2096 host target gene. LEC3 BINDING SITE is HOST TARGET binding site found in the 3' untranslated region of mRNA encoded by LEC3, corresponding to a HOST TARGET binding site such as BINDING SITE I, BINDING SITE II or BINDING SITE III. Table 2 illustrates the complementarity of the nucleotide sequences of LEC3 BINDING SITE, designated SEQ ID:17574, to the nucleotide sequence of VGAM2096 RNA, herein designated VGAM RNA, also designated SEQ ID:4807.

A function of VGAM2096 is therefore inhibition of LEC3 (Accession NM_015236). Accordingly, utilities of VGAM2096 include diagnosis, prevention and treatment of diseases and clinical conditions associated with LEC3. FIG. 1 further provides a conceptual description of a novel bioinformatically detected viral gene of the present invention, referred to here as Viral Genomic Address Messenger 2097 (VGAM2097) viral gene, which modulates expression of respective host target genes thereof, the function and utility of which host target genes is known in the art.

VGAM2097 is a novel bioinformatically detected regulatory, non protein coding, viral micro RNA (miRNA) gene. The method by which VGAM2097 was detected is described hereinabove with reference to FIGS. 1-8.

VGAM2097 gene, herein designated VGAM GENE, is a viral gene contained in the genome of Camelpox Virus. VGAM2097 host target gene, herein designated VGAM HOST TARGET GENE, is a human gene contained in the human genome.

VGAM2097 gene encodes a VGAM2097 precursor RNA, herein designated VGAM PRECURSOR RNA. Similar to other miRNA genes, and unlike most ordinary genes, VGAM2097 precursor RNA does not encode a protein. A nucleotide sequence identical or highly similar to the nucleotide sequence of VGAM2097 precursor RNA is designated SEQ ID:2083, and is provided hereinbelow with reference to the sequence listing part. Nucleotide sequence SEQ ID:2083 is located at position 176879 relative to the genome of Camelpox Virus.

VGAM2097 precursor RNA folds onto itself, forming VGAM2097 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2097 folded precursor RNA into VGAM2097 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 68%) nucleotide sequence of VGAM2097 RNA is designated SEQ ID:4808, and is provided hereinbelow with reference to the sequence listing part.

VGAM2097 host target gene, herein designated VGAM HOST TARGET GENE, encodes a corresponding messenger RNA, VGAM2097 host target RNA, herein designated VGAM HOST TARGET RNA. VGAM2097 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2097 RNA, herein designated VGAM RNA, binds complementarily to one or more host target binding sites located in untranslated regions of VGAM2097 host target RNA, herein designated VGAM HOST TARGET RNA. This complementary binding is due to the fact that the nucleotide sequence of VGAM2097 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2097 RNA, herein designated VGAM RNA, may have a different number of host target binding sites in untranslated regions of a VGAM2097 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2097 RNA, herein designated VGAM RNA, to host target binding sites on VGAM2097 host target RNA, herein designated VGAM HOST TARGET RNA, such as BINDING SITE I, BINDING SITE II and BINDING SITE III, inhibits translation of VGAM2097 host target RNA into VGAM2097 host target protein, herein designated VGAM HOST TARGET PROTEIN. VGAM host target protein is therefore outlined by a broken line.

It is appreciated that VGAM2097 host target gene, herein designated VGAM HOST TARGET GENE, in fact represents a plurality of VGAM2097 host target genes. The mRNA of each one of this plurality of VGAM2097 host target genes comprises one or more host target binding sites, each having a nucleotide sequence which is at least partly complementary to VGAM2097 RNA, herein designated VGAM RNA, and which when bound by VGAM2097 RNA causes inhibition of translation of respective one or more VGAM2097 host target proteins.

It is further appreciated by one skilled in the art that the mode of translational inhibition illustrated by FIG. 1 with specific reference to translational inhibition exerted by VGAM2097 gene, herein designated VGAM GENE, on one or more VGAM2097 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2097 is inhibition of expression of host target genes, as part of a novel viral mechanism of attacking a host. Accordingly, utilities of VGAM2097 include diagnosis, prevention and treatment of viral infection by Camelpox Virus. Specific functions, and accordingly utilities, of VGAM2097 correlate with, and may be deduced from, the identity of the host target genes which VGAM2097 binds and inhibits, and the function of these host target genes, as elaborated hereinbelow.

Nucleotide sequences of the VGAM2097 precursor RNA, herein designated VGAM PRECURSOR RNA, and of the 'diced' VGAM2097 RNA, herein designated VGAM RNA, and a schematic representation of the secondary folding of VGAM2097 folded precursor RNA, herein designated VGAM FOLDED PRECURSOR RNA, of VGAM2097 are further described hereinbelow with reference to Table 1.

Nucleotide sequences of host target binding sites, such as BINDING SITE-I, BINDING SITE-II and BINDING SITE-III of FIG. 1, found on VGAM2097 host target RNA, and schematic representation of the complementarity of each of these host target binding sites to VGAM2097 RNA, herein designated VGAM RNA, are described hereinbelow with reference to Table 2.

As mentioned hereinabove with reference to FIG. 1, a function of VGAM2097 gene, herein designated VGAM is inhibition of expression of VGAM2097 target genes. It is appreciated that specific functions, and accordingly utilities, of VGAM2097 correlate with, and may be deduced from, the identity of the target genes which VGAM2097 binds and inhibits, and the function of these target genes, as elaborated hereinbelow.

Phosphodiesterase 4D, CAMP-specific (phosphodiesterase E3 dunce homolog, Drosophila) (PDE4D, Accession XM_056815) is a VGAM2097 host target gene. PDE4D BINDING SITE is HOST TARGET binding site found in the 3' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36438, to the nucleotide sequence of VGAM2097 RNA, herein designated VGAM RNA, also designated SEQ ID:4808.

A function of VGAM2097 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM2097 include diagnosis, prevention and treatment of diseases and clinical conditions associated with PDE4D. The function of PDE4D and its association with various diseases and clinical conditions, has been established by previous studies, as described hereinabove with reference to VGAM180. Trophinin (TRO, Accession NM_016157) is another VGAM2097 host target gene. TRO BINDING SITE is HOST TARGET binding site found in the 5' untranslated region of mRNA encoded by TRO, corresponding to a HOST TARGET binding site such as BINDING SITE I, BINDING SITE II or BINDING SITE III. Table 2 illustrates the complementarity of the nucleotide sequences of TRO BINDING SITE, designated SEQ ID:18247, to the nucleotide sequence of VGAM2097 RNA, herein designated VGAM RNA, also designated SEQ ID:4808.

Another function of VGAM2097 is therefore inhibition of Trophinin (TRO, Accession NM_016157), a gene which functions as an adhesion molecule. Accordingly, utilities of VGAM2097 include diagnosis, prevention and treatment of diseases and clinical conditions associated with TRO. The function of TRO has been established by previous studies. The initial attachment of the trophoblast to the endometrial epithelium during implantation occurs via the apical cell membranes of the embryonic and maternal cells. Fukuda et al. (1995) found that cells from HT-H, a trophoblastic teratocarcinoma cell line, adhered efficiently to cells from SNG-M, an endometrial adenocarcinoma cell line. The adhesion was homophilic and cell type-specific, and occurred at the respective upper cell surfaces. To identify the adhesion molecules, the authors screened an HT-H expression library in COS-1 cells. They found that expression of 2 distinct cDNAs, encoding trophinin (cloned from trophoblastic cells) and tastin (OMIM Ref. No. 603872), was necessary for adhesion. The deduced 749-amino acid trophinin protein contains 69 tandem repeats of decapeptide sequences. In vitro translated trophinin has a molecular mass of 61 kD. Sequence and structural analyses revealed that trophinin is an intrinsic plasma membrane protein with 8 predicted transmembrane domains, an intracellular N-terminal region, and 3 hydrophilic regions exposed on the cell surface. COS-1 cells expressing trophinin and tastin aggregated in suspension, and soluble peptides of the cell surface domain of trophinin bound to the cell surface of trophinin-expressing cells. Northern blot analysis detected trophinin expression as 3.5-, 7.5-, and 10-kb mRNAs in both HT-H and SNG-M cells. However, neither trophinin nor tastin was expressed in various other human cell types tested, with the exception of macrophages. Using immunofluorescence, Fukuda et al. (1995) detected strong expression of both genes in the trophectoderm surface of monkey blastocysts, as well as in human endometrial surface epithelium at a time consistent with that expected for the 'implantation window.' These authors suggested that trophinin and tastin might mediate the adhesion of the blastocyst to the endometrial epithelium at the time of implantation. Using immunohistochemistry, Suzuki et al. (1999) determined that trophinin and bystin (OMIM Ref. No. 603871), a trophinin- and tastin-binding protein, were found in the placenta from the sixth week of pregnancy. Trophinin and bystin were localized in the cytoplasm of the syncytiotrophoblast in the chorionic villi and in endometrial decidual cells at the uteroplacental interface. After week 10, the levels of trophinin, tastin, and bystin decreased and then disappeared from placental villi.

Full details of the abovementioned studies are described in the following publications, the disclosure of which are hereby incorporated by reference:

Fukuda, M. N.; Sato, T.; Nakayama, J.; Klier, G.; Mikami, M.; Aoki, D.; Nozawa, S. : Trophinin and tastin, a novel cell adhesion molecule complex with potential involvement in embryo implantation. Genes Dev. 9:1199-1210, 1995; and Suzuki, N.; Nakayama, J.; Shih, I. M.; Aoki, D.; Nozawa, S.; Fukuda, M. N.: Expression of trophinin, tastin, and bystin by trophoblast and endometrial cells in human placenta. Biol. Reprod.

Further studies establishing the function and utilities of TRO are found in John Hopkins OMIM database record ID 300132, and in sited publications numbered 10990-10992 listed in the bibliography section hereinbelow, which are also hereby incorporated by reference. Splicing Factor, Arginine/serine-rich 12 (SFRS12, Accession NM_139168) is another VGAM2097 host target gene. SFRS12 BINDING SITE is HOST TARGET binding site found in the 5' untranslated region of mRNA encoded by SFRS12, corresponding to a HOST TARGET binding site such as BINDING SITE I, BINDING SITE II or BINDING SITE III. Table 2 illustrates the complementarity of the nucleotide sequences of SFRS12 BINDING SITE, designated SEQ ID:29175, to the nucleotide sequence of VGAM2097 RNA, herein designated VGAM RNA, also designated SEQ ID:4808.

Another function of VGAM2097 is therefore inhibition of Splicing Factor, Arginine/serine-rich 12 (SFRS12, Accession NM_139168). Accordingly, utilities of VGAM2097 include diagnosis, prevention and treatment of diseases and clinical conditions associated with SFRS12. Transmembrane 4 Superfamily Member 11 (plasmolipin) (TM4SF11, Accession NM_015993) is another VGAM2097 host target gene. TM4SF11 BINDING SITE is HOST TARGET binding site found in the 3' untranslated region of mRNA encoded by TM4SF11, corresponding to a HOST TARGET binding site such as BINDING SITE I, BINDING SITE II or BINDING SITE III. Table 2 illustrates the complementarity of the nucleotide sequences of TM4SF11 BINDING SITE, designated SEQ ID:18083, to the nucleotide sequence of VGAM2097 RNA, herein designated VGAM RNA, also designated SEQ ID:4808.

Another function of VGAM2097 is therefore inhibition of Transmembrane 4 Superfamily Member 11 (plasmolipin) (TM4SF11, Accession NM_015993). Accordingly, utilities of VGAM2097 include diagnosis, prevention and treatment of diseases and clinical conditions associated with TM4SF11. Zinc Finger Protein 11b (KOX 2) (ZNF11B, Accession XM_058399) is another VGAM2097 host target gene. ZNF11B BINDING SITE is HOST TARGET binding site found in the 5' untranslated region of mRNA encoded by ZNF11B, corresponding to a HOST TARGET binding site such as BINDING SITE I, BINDING SITE II or BINDING SITE III. Table 2 illustrates the complementarity of the nucleotide sequences of ZNF11B BINDING SITE, designated SEQ ID:36614, to the nucleotide sequence of VGAM2097 RNA, herein designated VGAM RNA, also designated SEQ ID:4808.

Another function of VGAM2097 is therefore inhibition of Zinc Finger Protein 11b (KOX 2) (ZNF11B, Accession XM_058399). Accordingly, utilities of VGAM2097 include diagnosis, prevention and treatment of diseases and clinical conditions associated with ZNF11B. LOC158476 (Accession XM_098955) is another VGAM2097 host target gene. LOC158476 BINDING SITE is HOST TARGET binding site found in the 3' untranslated region of mRNA encoded by LOC158476, corresponding to a HOST TARGET binding site such as BINDING SITE I, BINDING SITE II or BINDING SITE III. Table 2 illustrates the complementarity of the nucleotide sequences of LOC158476 BINDING SITE, designated SEQ ID:41997, to the nucleotide sequence of VGAM2097 RNA, herein designated VGAM RNA, also designated SEQ ID:4808.

Another function of VGAM2097 is therefore inhibition of LOC158476 (Accession XM_098955). Accordingly, utilities of VGAM2097 include diagnosis, prevention and treatment of diseases and clinical conditions associated with LOC158476. FIG. 1 further provides a conceptual description of a novel bioinformatically detected viral gene of the present invention, referred to here as Viral Genomic Address Messenger 2098 (VGAM2098) viral gene, which modulates expression of respective host target genes thereof, the function and utility of which host target genes is known in the art.

VGAM2098 is a novel bioinformatically detected regulatory, non protein coding, viral micro RNA (miRNA) gene. The method by which VGAM2098 was detected is described hereinabove with reference to FIGS. 1-8.

VGAM2098 gene, herein designated VGAM GENE, is a viral gene contained in the genome of Camelpox Virus. VGAM2098 host target gene, herein designated VGAM HOST TARGET GENE, is a human gene contained in the human genome.

VGAM2098 gene encodes a VGAM2098 precursor RNA, herein designated VGAM PRECURSOR RNA. Similar to other miRNA genes, and unlike most ordinary genes, VGAM2098 precursor RNA does not encode a protein. A nucleotide sequence identical or highly similar to the nucleotide sequence of VGAM2098 precursor RNA is designated SEQ ID:2084, and is provided hereinbelow with reference to the sequence listing part. Nucleotide sequence SEQ ID:2084 is located at position 174573 relative to the genome of Camelpox Virus.

VGAM2098 precursor RNA folds onto itself, forming VGAM2098 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2098 folded precursor RNA into VGAM2098 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2098 RNA is designated SEQ ID:4809, and is provided hereinbelow with reference to the sequence listing part.

VGAM2098 host target gene, herein designated VGAM HOST TARGET GENE, encodes a corresponding messenger RNA, VGAM2098 host target RNA, herein designated VGAM HOST TARGET RNA. VGAM2098 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2098 RNA, herein designated VGAM RNA, binds complementarily to one or more host target binding sites located in untranslated regions of VGAM2098 host target RNA, herein designated VGAM HOST TARGET RNA. This complementary binding is due to the fact that the nucleotide sequence of VGAM2098 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2098 RNA, herein designated VGAM RNA, may have a different number of host target binding sites in untranslated regions of a VGAM2098 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2098 RNA, herein designated VGAM RNA, to host target binding sites on VGAM2098 host target RNA, herein designated VGAM HOST TARGET RNA, such as BINDING SITE I, BINDING SITE II and BINDING SITE III, inhibits translation of VGAM2098 host target RNA into VGAM2098 host target protein, herein designated VGAM HOST TARGET PROTEIN. VGAM host target protein is therefore outlined by a broken line.

It is appreciated that VGAM2098 host target gene, herein designated VGAM HOST TARGET GENE, in fact represents a plurality of VGAM2098 host target genes. The mRNA of each one of this plurality of VGAM2098 host target genes comprises one or more host target binding sites, each having a nucleotide sequence which is at least partly complementary to VGAM2098 RNA, herein designated VGAM RNA, and which when bound by VGAM2098 RNA causes inhibition of translation of respective one or more VGAM2098 host target proteins.

It is further appreciated by one skilled in the art that the mode of translational inhibition illustrated by FIG. 1 with specific reference to translational inhibition exerted by VGAM2098 gene, herein designated VGAM GENE, on one or more VGAM2098 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2098 is inhibition of expression of host target genes, as part of a novel viral mechanism of attacking a host. Accordingly, utilities of VGAM2098 include diagnosis, prevention and treatment of viral infection by Camelpox Virus. Specific functions, and accordingly utilities, of VGAM2098 correlate with, and may be deduced from, the identity of the host target genes which VGAM2098 binds and inhibits, and the function of these host target genes, as elaborated hereinbelow.

Nucleotide sequences of the VGAM2098 precursor RNA, herein designated VGAM PRECURSOR RNA, and of the 'diced' VGAM2098 RNA, herein designated VGAM RNA, and a schematic representation of the secondary folding of VGAM2098 folded precursor RNA, herein designated VGAM FOLDED PRECURSOR RNA, of VGAM2098 are further described hereinbelow with reference to Table 1.

Nucleotide sequences of host target binding sites, such as BINDING SITE-I, BINDING SITE-II and BINDING SITE-III of FIG. 1, found on VGAM2098 host target RNA, and schematic representation of the complementarity of each of these host target binding sites to VGAM2098 RNA, herein designated VGAM RNA, are described hereinbelow with reference to Table 2.

As mentioned hereinabove with reference to FIG. 1, a function of VGAM2098 gene, herein designated VGAM is inhibition of expression of VGAM2098 target genes. It is appreciated that specific functions, and accordingly utilities, of VGAM2098 correlate with, and may be deduced from, the identity of the target genes which VGAM2098 binds and inhibits, and the function of these target genes, as elaborated hereinbelow.

ATP-binding Cassette, Sub-family B (MDR/TAP), Member 4 (ABCB4, Accession NM_000443) is a VGAM2098 host target gene. ABCB4 BINDING SITE1 and ABCB4 BINDING SITE2 are HOST TARGET binding sites found in untranslated regions of mRNA encoded by ABCB4, corresponding to HOST TARGET binding sites such as BINDING SITE I, BINDING SITE II or BINDING SITE III. Table 2 illustrates the complementarity of the nucleotide sequences of ABCB4 BINDING SITE1 and ABCB4 BINDING SITE2, designated SEQ ID:6030 and SEQ ID:20835 respectively, to the nucleotide sequence of VGAM2098 RNA, herein designated VGAM RNA, also designated SEQ ID:4809.

A function of VGAM2098 is therefore inhibition of ATP-binding Cassette, Sub-family B (MDR/TAP), Member 4 (ABCB4, Accession NM_000443). Accordingly, utilities of VGAM2098 include diagnosis, prevention and treatment of diseases and clinical conditions associated with ABCB4. FLJ20152 (Accession NM_019000) is another VGAM2098 host target gene. FLJ20152 BINDING SITE is HOST TARGET binding site found in the 3' untranslated region of mRNA encoded by FLJ20152, corresponding to a HOST TARGET binding site such as BINDING SITE I, BINDING SITE II or BINDING SITE III. Table 2 illustrates the complementarity of the nucleotide sequences of FLJ20152 BINDING SITE, designated SEQ ID:21071, to the nucleotide sequence of VGAM2098 RNA, herein designated VGAM RNA, also designated SEQ ID:4809.

Another function of VGAM2098 is therefore inhibition of FLJ20152 (Accession NM_019000). Accordingly, utilities of VGAM2098 include diagnosis, prevention and treatment of diseases and clinical conditions associated with FLJ20152. KIAA0923 (Accession NM_014021) is another VGAM2098 host target gene. KIAA0923 BINDING SITE is HOST TARGET binding site found in the 3' untranslated region of mRNA encoded by KIAA0923, corresponding to a HOST TARGET binding site such as BINDING SITE I, BINDING SITE II or BINDING SITE III. Table 2 illustrates the complementarity of the nucleotide sequences of KIAA0923 BINDING SITE, designated SEQ ID:15244, to the nucleotide sequence of VGAM2098 RNA, herein designated VGAM RNA, also designated SEQ ID:4809.

Another function of VGAM2098 is therefore inhibition of KIAA0923 (Accession NM_014021). Accordingly, utilities of VGAM2098 include diagnosis, prevention and treatment of diseases and clinical conditions associated with KIAA0923. LOC144920 (Accession XM_096688) is another VGAM2098 host target gene. LOC144920 BINDING SITE is HOST TARGET binding site found in the 3' untranslated region of mRNA encoded by LOC144920, corresponding to a HOST TARGET binding site such as BINDING SITE I, BINDING SITE II or BINDING SITE III. Table 2 illustrates the complementarity of the nucleotide sequences of LOC144920 BINDING SITE, designated SEQ ID:40465, to the nucleotide sequence of VGAM2098 RNA, herein designated VGAM RNA, also designated SEQ ID:4809.

Another function of VGAM2098 is therefore inhibition of LOC144920 (Accession XM_096688). Accordingly, utilities of VGAM2098 include diagnosis, prevention and treatment of diseases and clinical conditions associated with LOC144920. FIG. 1 further provides a conceptual description of a novel bioinformatically detected viral gene of the present invention, referred to here as Viral Genomic Address Messenger 2099 (VGAM2099) viral gene, which modulates expression of respective host target genes thereof, the function and utility of which host target genes is known in the art.

VGAM2099 is a novel bioinformatically detected regulatory, non protein coding, viral micro RNA (miRNA) gene. The method by which VGAM2099 was detected is described hereinabove with reference to FIGS. 1-8.

VGAM2099 gene, herein designated VGAM GENE, is a viral gene contained in the genome of Camelpox Virus. VGAM2099 host target gene, herein designated VGAM HOST TARGET GENE, is a human gene contained in the human genome.

VGAM2099 gene encodes a VGAM2099 precursor RNA, herein designated VGAM PRECURSOR RNA. Similar to other miRNA genes, and unlike most ordinary genes, VGAM2099 precursor RNA does not encode a protein. A nucleotide sequence identical or highly similar to the nucleotide sequence of VGAM2099 precursor RNA is designated SEQ ID:2085, and is provided hereinbelow with reference to the sequence listing part. Nucleotide sequence SEQ ID:2085 is located at position 174840 relative to the genome of Camelpox Virus.

VGAM2099 precursor RNA folds onto itself, forming VGAM2099 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2099 folded precursor RNA into VGAM2099 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2099 RNA is designated SEQ ID:4810, and is provided hereinbelow with reference to the sequence listing part.

VGAM2099 host target gene, herein designated VGAM HOST TARGET GENE, encodes a corresponding messenger RNA, VGAM2099 host target RNA, herein designated VGAM HOST TARGET RNA. VGAM2099 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2099 RNA, herein designated VGAM RNA, binds complementarily to one or more host target binding sites located in untranslated regions of VGAM2099 host target RNA, herein designated VGAM HOST TARGET RNA. This complementary binding is due to the fact that the nucleotide sequence of VGAM2099 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2099 RNA, herein designated VGAM RNA, may have a different number of host target binding sites in untranslated regions of a VGAM2099 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2099 RNA, herein designated VGAM RNA, to host target binding sites on VGAM2099 host target RNA, herein designated VGAM HOST TARGET RNA, such as BINDING SITE I, BINDING SITE II and BINDING SITE III, inhibits translation of VGAM2099 host target RNA into VGAM2099 host target protein, herein designated VGAM HOST TARGET PROTEIN. VGAM host target protein is therefore outlined by a broken line.

It is appreciated that VGAM2099 host target gene, herein designated VGAM HOST TARGET GENE, in fact represents a plurality of VGAM2099 host target genes. The mRNA of each one of this plurality of VGAM2099 host target genes comprises one or more host target binding sites, each having a nucleotide sequence which is at least partly complementary to VGAM2099 RNA, herein designated VGAM RNA, and which when bound by VGAM2099 RNA causes inhibition of translation of respective one or more VGAM2099 host target proteins.

It is further appreciated by one skilled in the art that the mode of translational inhibition illustrated by FIG. 1 with specific reference to translational inhibition exerted by VGAM2099 gene, herein designated VGAM GENE, on one or more VGAM2099 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2099 is inhibition of expression of host target genes, as part of a novel viral mechanism of attacking a host. Accordingly, utilities of VGAM2099 include diagnosis, prevention and treatment of viral infection by Camelpox Virus. Specific functions, and accordingly utilities, of VGAM2099 correlate with, and may be deduced from, the identity of the host target genes which VGAM2099 binds and inhibits, and the function of these host target genes, as elaborated hereinbelow.

Nucleotide sequences of the VGAM2099 precursor RNA, herein designated VGAM PRECURSOR RNA, and of the 'diced' VGAM2099 RNA, herein designated VGAM RNA, and a schematic representation of the secondary folding of VGAM2099 folded precursor RNA, herein designated VGAM FOLDED PRECURSOR RNA, of VGAM2099 are further described hereinbelow with reference to Table 1.

Nucleotide sequences of host target binding sites, such as BINDING SITE-I, BINDING SITE-II and BINDING SITE-III of FIG. 1, found on VGAM2099 host target RNA, and schematic representation of the complementarity of each of these host target binding sites to VGAM2099 RNA, herein designated VGAM RNA, are described hereinbelow with reference to Table 2.

As mentioned hereinabove with reference to FIG. 1, a function of VGAM2099 gene, herein designated VGAM is inhibition of expression of VGAM2099 target genes. It is appreciated that specific functions, and accordingly utilities, of VGAM2099 correlate with, and may be deduced from, the identity of the target genes which VGAM2099 binds and inhibits, and the function of these target genes, as elaborated hereinbelow.

NEBL (Accession NM_006393) is a VGAM2099 host target gene. NEBL BINDING SITE is HOST TARGET binding site found in the 3' untranslated region of mRNA encoded by NEBL, corresponding to a HOST TARGET binding site such as BINDING SITE I, BINDING SITE II or BINDING SITE III. Table 2 illustrates the complementarity of the nucleotide sequences of NEBL BINDING SITE, designated SEQ ID:13095, to the nucleotide sequence of VGAM2099 RNA, herein designated VGAM RNA, also designated SEQ ID:4810.

A function of VGAM2099 is therefore inhibition of NEBL (Accession NM_006393). Accordingly, utilities of VGAM2099 include diagnosis, prevention and treatment of diseases and clinical conditions associated with NEBL. DKFZp761K1423 (Accession NM_018422) is another VGAM2099 host target gene. DKFZp761K1423 BINDING SITE is HOST TARGET binding site found in the 3' untranslated region of mRNA encoded by DKFZp761K1423, corresponding to a HOST TARGET binding site such as BINDING SITE I, BINDING SITE II or BINDING SITE III. Table 2 illustrates the complementarity of the nucleotide sequences of DKFZp761K1423 BINDING SITE, designated SEQ ID:20473, to the nucleotide sequence of VGAM2099 RNA, herein designated VGAM RNA, also designated SEQ ID:4810.

Another function of VGAM2099 is therefore inhibition of DKFZp761K1423 (Accession NM_018422). Accordingly, utilities of VGAM2099 include diagnosis, prevention and treatment of diseases and clinical conditions associated with DKFZp761K1423. NESHBP (Accession NM_015429) is another VGAM2099 host target gene. NESHBP BINDING SITE is HOST TARGET binding site found in the 3' untranslated region of mRNA encoded by NESHBP, corresponding to a HOST TARGET binding site such as BINDING SITE I, BINDING SITE II or BINDING SITE III. Table 2 illustrates the complementarity of the nucleotide sequences of NESHBP BINDING SITE, designated SEQ ID:17726, to the nucleotide sequence of VGAM2099 RNA, herein designated VGAM RNA, also designated SEQ ID:4810.

Another function of VGAM2099 is therefore inhibition of NESHBP (Accession NM_015429). Accordingly, utilities of VGAM2099 include diagnosis, prevention and treatment of diseases and clinical conditions associated with NESHBP. LOC145786 (Accession XM_096860) is another VGAM2099 host target gene. LOC145786 BINDING SITE is HOST TARGET binding site found in the 5' untranslated region of mRNA encoded by LOC145786, corresponding to a HOST TARGET binding site such as BINDING SITE I, BINDING SITE II or BINDING SITE III. Table 2 illustrates the complementarity of the nucleotide sequences of LOC145786 BINDING SITE, designated SEQ ID:40589, to the nucleotide sequence of VGAM2099 RNA, herein designated VGAM RNA, also designated SEQ ID:4810.

Another function of VGAM2099 is therefore inhibition of LOC145786 (Accession XM_096860). Accordingly, utilities of VGAM2099 include diagnosis, prevention and treatment of diseases and clinical conditions associated with LOC145786. LOC157292 (Accession XM_098740) is another VGAM2099 host target gene. LOC157292 BINDING SITE is HOST TARGET binding site found in the 3' untranslated region of mRNA encoded by LOC157292, corresponding to a HOST TARGET binding site such as BINDING SITE I, BINDING SITE II or BINDING SITE III. Table 2 illustrates the complementarity of the nucleotide sequences of LOC157292 BINDING SITE, designated SEQ ID:41773, to the nucleotide sequence of VGAM2099 RNA, herein designated VGAM RNA, also designated SEQ ID:4810.

Another function of VGAM2099 is therefore inhibition of LOC157292 (Accession XM_098740). Accordingly, utilities of VGAM2099 include diagnosis, prevention and treatment of diseases and clinical conditions associated with LOC157292. FIG. 1 further provides a conceptual description of a novel bioinformatically detected viral gene of the present invention, referred to here as Viral Genomic Address Messenger 2100 (VGAM2100) viral gene, which modulates expression of respective host target genes thereof, the function and utility of which host target genes is known in the art.

VGAM2100 is a novel bioinformatically detected regulatory, non protein coding, viral micro RNA (miRNA) gene. The method by which VGAM2100 was detected is described hereinabove with reference to FIGS. 1-8.

VGAM2100 gene, herein designated VGAM GENE, is a viral gene contained in the genome of Camelpox Virus. VGAM2100 host target gene, herein designated VGAM HOST TARGET GENE, is a human gene contained in the human genome.

VGAM2100 gene encodes a VGAM2100 precursor RNA, herein designated VGAM PRECURSOR RNA. Similar to other miRNA genes, and unlike most ordinary genes, VGAM2100 precursor RNA does not encode a protein. A nucleotide sequence identical or highly similar to the nucleotide sequence of VGAM2100 precursor RNA is designated SEQ ID:2086, and is provided hereinbelow with reference to the sequence listing part. Nucleotide sequence SEQ ID:2086 is located at position 176689 relative to the genome of Camelpox Virus.

VGAM2100 precursor RNA folds onto itself, forming VGAM2100 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2100 folded precursor RNA into VGAM2100 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2100 RNA is designated SEQ ID:4811, and is provided hereinbelow with reference to the sequence listing part.

VGAM2100 host target gene, herein designated VGAM HOST TARGET GENE, encodes a corresponding messenger RNA, VGAM2100 host target RNA, herein designated VGAM HOST TARGET RNA. VGAM2100 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2100 RNA, herein designated VGAM RNA, binds complementarily to one or more host target binding sites located in untranslated regions of VGAM2100 host target RNA, herein designated VGAM HOST TARGET RNA. This complementary binding is due to the fact that the nucleotide sequence of VGAM2100 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2100 RNA, herein designated VGAM RNA, may have a different number of host target binding sites in untranslated regions of a VGAM2100 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2100 RNA, herein designated VGAM RNA, to host target binding sites on VGAM2100 host target RNA, herein designated VGAM HOST TARGET RNA, such as BINDING SITE I, BINDING SITE II and BINDING SITE III, inhibits translation of VGAM2100 host target RNA into VGAM2100 host target protein, herein designated VGAM HOST TARGET PROTEIN. VGAM host target protein is therefore outlined by a broken line.

It is appreciated that VGAM2100 host target gene, herein designated VGAM HOST TARGET GENE, in fact represents a plurality of VGAM2100 host target genes. The mRNA of each one of this plurality of VGAM2100 host target genes comprises one or more host target binding sites, each having a nucleotide sequence which is at least partly complementary to VGAM2100 RNA, herein designated VGAM RNA, and which when bound by VGAM2100 RNA causes inhibition of translation of respective one or more VGAM2100 host target proteins.

It is further appreciated by one skilled in the art that the mode of translational inhibition illustrated by FIG. 1 with specific reference to translational inhibition exerted by VGAM2100 gene, herein designated VGAM GENE, on one or more VGAM2100 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2100 is inhibition of expression of host target genes, as part of a novel viral mechanism of attacking a host. Accordingly, utilities of VGAM2100 include diagnosis, prevention and treatment of viral infection by Camelpox Virus. Specific functions, and accordingly utilities, of VGAM2100 correlate with, and may be deduced from, the identity of the host target genes which VGAM2100 binds and inhibits, and the function of these host target genes, as elaborated hereinbelow.

Nucleotide sequences of the VGAM2100 precursor RNA, herein designated VGAM PRECURSOR RNA, and of the 'diced' VGAM2100 RNA, herein designated VGAM RNA, and a schematic representation of the secondary folding of VGAM2100 folded precursor RNA, herein designated VGAM FOLDED PRECURSOR RNA, of VGAM2100 are further described hereinbelow with reference to Table 1.

Nucleotide sequences of host target binding sites, such as BINDING SITE-I, BINDING SITE-II and BINDING SITE-III of FIG. 1, found on VGAM2100 host target RNA, and schematic representation of the complementarity of each of these host target binding sites to VGAM2100 RNA, herein designated VGAM RNA, are described hereinbelow with reference to Table 2.

As mentioned hereinabove with reference to FIG. 1, a function of VGAM2100 gene, herein designated VGAM is inhibition of expression of VGAM2100 target genes. It is appreciated that specific functions, and accordingly utilities, of VGAM2100 correlate with, and may be deduced from, the identity of the target genes which VGAM2100 binds and inhibits, and the function of these target genes, as elaborated hereinbelow.

Rho Guanine Nucleotide Exchange Factor (GEF) 12 (ARHGEF12, Accession NM_015313) is a VGAM2100 host target gene. ARHGEF12 BINDING SITE is HOST TARGET binding site found in the 3' untranslated region of mRNA encoded by ARHGEF12, corresponding to a HOST TARGET binding site such as BINDING SITE I, BINDING SITE II or BINDING SITE III. Table 2 illustrates the complementarity of the nucleotide sequences of ARHGEF12 BINDING SITE, designated SEQ ID:17630, to the nucleotide sequence of VGAM2100 RNA, herein designated VGAM RNA, also designated SEQ ID:4811.

A function of VGAM2100 is therefore inhibition of Rho Guanine Nucleotide Exchange Factor (GEF) 12 (ARHGEF12, Accession NM_015313). Accordingly, utilities of VGAM2100 include diagnosis, prevention and treatment of diseases and clinical conditions associated with ARHGEF12. Prostaglandin-endoperoxide Synthase 1 (prostaglandin G/H synthase and cyclooxygenase) (PTGS1, Accession NM_080591) is another VGAM2100 host target gene. PTGS1 BINDING SITE1 and PTGS1 BINDING SITE2 are HOST TARGET binding sites found in untranslated regions of mRNA encoded by PTGS1, corresponding to HOST TARGET binding sites such as BINDING SITE I, BINDING SITE II or BINDING SITE III. Table 2 illustrates the complementarity of the nucleotide sequences of PTGS1 BINDING SITE1 and PTGS1 BINDING SITE2, designated SEQ ID:27893 and SEQ ID:6672 respectively, to the nucleotide sequence of VGAM2100 RNA, herein designated VGAM RNA, also designated SEQ ID:4811.

Another function of VGAM2100 is therefore inhibition of Prostaglandin-endoperoxide Synthase 1 (prostaglandin G/H synthase and cyclooxygenase) (PTGS1, Accession NM_080591), a gene which may play an important role in regulating or promoting cell proliferation in some normal and neoplastically transformed cells. Accordingly, utilities of VGAM2100 include diagnosis, prevention and treatment of diseases and clinical conditions associated with PTGS1. The function of PTGS1 and its association with various diseases and clinical conditions, has been established by previous studies, as described hereinabove with reference to VGAM1224. BCMP1 (Accession NM_031442) is another VGAM2100 host target gene. BCMP1 BINDING SITE is HOST TARGET binding site found in the 3' untranslated region of mRNA encoded by BCMP1, corresponding to a HOST TARGET binding site such as BINDING SITE I, BINDING SITE II or BINDING SITE III. Table 2 illustrates the complementarity of the nucleotide sequences of BCMP1 BINDING SITE, designated SEQ ID:25455, to the nucleotide sequence of VGAM2100 RNA, herein designated VGAM RNA, also designated SEQ ID:4811.

Another function of VGAM2100 is therefore inhibition of BCMP1 (Accession NM_031442). Accordingly, utilities of VGAM2100 include diagnosis, prevention and treatment of diseases and clinical conditions associated with BCMP1. Chromosome 20 Open Reading Frame 45 (C20orf45, Accession NM_016045) is another VGAM2100 host target gene. C20orf45 BINDING SITE is HOST TARGET binding site found in the 3' untranslated region of mRNA encoded by C20orf45, corresponding to a HOST TARGET binding site such as BINDING SITE I, BINDING SITE II or BINDING SITE III. Table 2 illustrates the complementarity of the nucleotide sequences of C20orf45 BINDING SITE, designated SEQ ID:18121, to the nucleotide sequence of VGAM2100 RNA, herein designated VGAM RNA, also designated SEQ ID:4811.

Another function of VGAM2100 is therefore inhibition of Chromosome 20 Open Reading Frame 45 (C20orf45, Accession NM_016045). Accordingly, utilities of VGAM2100 include diagnosis, prevention and treatment of diseases and clinical conditions associated with C20orf45. FLJ10726 (Accession NM_018195) is another VGAM2100 host target gene. FLJ10726 BINDING SITE is HOST TARGET binding site found in the 3' untranslated region of mRNA encoded by FLJ10726, corresponding to a HOST TARGET binding site such as BINDING SITE I, BINDING SITE II or BINDING SITE III. Table 2 illustrates the complementarity of the nucleotide sequences of FLJ10726 BINDING SITE, designated SEQ ID:20059, to the nucleotide sequence of VGAM2100 RNA, herein designated VGAM RNA, also designated SEQ ID:4811.

Another function of VGAM2100 is therefore inhibition of FLJ10726 (Accession NM_018195). Accordingly, utilities of VGAM2100 include diagnosis, prevention and treatment of diseases and clinical conditions associated with FLJ10726. FLJ20079 (Accession NM_017656) is another VGAM2100 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19171, to the nucleotide sequence of VGAM2100 RNA, herein designated VGAM RNA, also designated SEQ ID:4811.

Another function of VGAM2100 is therefore inhibition of FLJ20079 (Accession NM_017656). Accordingly, utilities of VGAM2100 include diagnosis, prevention and treatment of diseases and clinical conditions associated with FLJ20079. FLJ20508 (Accession NM_017850) is another VGAM2100 host target gene. FLJ20508 BINDING SITE is HOST TARGET binding site found in the 3' untranslated region of mRNA encoded by FLJ20508, corresponding to a HOST TARGET binding site such as BINDING SITE I, BINDING SITE II or BINDING SITE III. Table 2 illustrates the complementarity of the nucleotide sequences of FLJ20508 BINDING SITE, designated SEQ ID:19516, to the nucleotide sequence of VGAM2100 RNA, herein designated VGAM RNA, also designated SEQ ID:4811.

Another function of VGAM2100 is therefore inhibition of FLJ20508 (Accession NM_017850). Accordingly, utilities of VGAM2100 include diagnosis, prevention and treatment of diseases and clinical conditions associated with FLJ20508. FLJ22794 (Accession XM_166220) is another VGAM2100 host target gene. FLJ22794 BINDING SITE is HOST TARGET binding site found in the 3' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44039, to the nucleotide sequence of VGAM2100 RNA, herein designated VGAM RNA, also designated SEQ ID:4811.

Another function of VGAM2100 is therefore inhibition of FLJ22794 (Accession XM_166220). Accordingly, utilities of VGAM2100 include diagnosis, prevention and treatment of diseases and clinical conditions associated with FLJ22794. Histamine Receptor H4 (HRH4, Accession NM_021624) is another VGAM2100 host target gene. HRH4 BINDING SITE is HOST TARGET binding site found in the 3' untranslated region of mRNA encoded by HRH4, corresponding to a HOST TARGET binding site such as BINDING SITE I, BINDING SITE II or BINDING SITE III. Table 2 illustrates the complementarity of the nucleotide sequences of HRH4 BINDING SITE, designated SEQ ID:22263, to the nucleotide sequence of VGAM2100 RNA, herein designated VGAM RNA, also designated SEQ ID:4811.

Another function of VGAM2100 is therefore inhibition of Histamine Receptor H4 (HRH4, Accession NM_021624). Accordingly, utilities of VGAM2100 include diagnosis, prevention and treatment of diseases and clinical conditions associated with HRH4. KIAA0565 (Accession XM_039912) is another VGAM2100 host target gene. KIAA0565 BINDING SITE is HOST TARGET binding site found in the 3' untranslated region of mRNA encoded by KIAA0565, corresponding to a HOST TARGET binding site such as BINDING SITE I, BINDING SITE II or BINDING SITE III. Table 2 illustrates the complementarity of the nucleotide sequences of KIAA0565 BINDING SITE, designated SEQ ID:33218, to the nucleotide sequence of VGAM2100 RNA, herein designated VGAM RNA, also designated SEQ ID:4811.

Another function of VGAM2100 is therefore inhibition of KIAA0565 (Accession XM_039912). Accordingly, utilities of VGAM2100 include diagnosis, prevention and treatment of diseases and clinical conditions associated with KIAA0565. Phosphodiesterase 3A, CGMP-inhibited (PDE3A, Accession NM_000921) is another VGAM2100 host target gene. PDE3A BINDING SITE is HOST TARGET binding site found in the 3' untranslated region of mRNA encoded by PDE3A, corresponding to a HOST TARGET binding site such as BINDING SITE I, BINDING SITE II or BINDING SITE III. Table 2 illustrates the complementarity of the nucleotide sequences of PDE3A BINDING SITE, designated SEQ ID:6631, to the nucleotide sequence of VGAM2100 RNA, herein designated VGAM RNA, also designated SEQ ID:4811.

Another function of VGAM2100 is therefore inhibition of Phosphodiesterase 3A, CGMP-inhibited (PDE3A, Accession NM_000921). Accordingly, utilities of VGAM2100 include diagnosis, prevention and treatment of diseases and clinical conditions associated with PDE3A. LOC148254 (Accession XM_086121) is another VGAM2100 host target gene. LOC148254 BINDING SITE is HOST TARGET binding site found in the 3' untranslated region of mRNA encoded by LOC148254, corresponding to a HOST TARGET binding site such as BINDING SITE I, BINDING SITE II or BINDING SITE III. Table 2 illustrates the complementarity of the nucleotide sequences of LOC148254 BINDING SITE, designated SEQ ID:38505, to the nucleotide sequence of VGAM2100 RNA, herein designated VGAM RNA, also designated SEQ ID:4811.

Another function of VGAM2100 is therefore inhibition of LOC148254 (Accession XM_086121). Accordingly, utilities of VGAM2100 include diagnosis, prevention and treatment of diseases and clinical conditions associated with LOC148254. LOC256207 (Accession XM_170837) is another VGAM2100 host target gene. LOC256207 BINDING SITE is HOST TARGET binding site found in the 3' untranslated region of mRNA encoded by LOC256207, corresponding to a HOST TARGET binding site such as BINDING SITE I, BINDING SITE II or BINDING SITE III. Table 2 illustrates the complementarity of the nucleotide sequences of LOC256207 BINDING SITE, designated SEQ ID:45619, to the nucleotide sequence of VGAM2100 RNA, herein designated VGAM RNA, also designated SEQ ID:4811.

Another function of VGAM2100 is therefore inhibition of LOC256207 (Accession XM_170837). Accordingly, utilities of VGAM2100 include diagnosis, prevention and treatment of diseases and clinical conditions associated with LOC256207. FIG. 1 further provides a conceptual description of a novel bioinformatically detected viral gene of the present invention, referred to here as Viral Genomic Address Messenger 2101 (VGAM2101) viral gene, which modulates expression of respective host target genes thereof, the function and utility of which host target genes is known in the art.

VGAM2101 is a novel bioinformatically detected regulatory, non protein coding, viral micro RNA (miRNA) gene.

The method by which VGAM2101 was detected is described hereinabove with reference to FIGS. 1-8.

VGAM2101 gene, herein designated VGAM GENE, is a viral gene contained in the genome of Camelpox Virus. VGAM2101 host target gene, herein designated VGAM HOST TARGET GENE, is a human gene contained in the human genome.

VGAM2101 gene encodes a VGAM2101 precursor RNA, herein designated VGAM PRECURSOR RNA. Similar to other miRNA genes, and unlike most ordinary genes, VGAM2101 precursor RNA does not encode a protein. A nucleotide sequence identical or highly similar to the nucleotide sequence of VGAM2101 precursor RNA is designated SEQ ID:2087, and is provided hereinbelow with reference to the sequence listing part. Nucleotide sequence SEQ ID:2087 is located at position 171927 relative to the genome of Camelpox Virus.

VGAM2101 precursor RNA folds onto itself, forming VGAM2101 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2101 folded precursor RNA into VGAM2101 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2101 RNA is designated SEQ ID:4812, and is provided hereinbelow with reference to the sequence listing part.

VGAM2101 host target gene, herein designated VGAM HOST TARGET GENE, encodes a corresponding messenger RNA, VGAM2101 host target RNA, herein designated VGAM HOST TARGET RNA. VGAM2101 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2101 RNA, herein designated VGAM RNA, binds complementarily to one or more host target binding sites located in untranslated regions of VGAM2101 host target RNA, herein designated VGAM HOST TARGET RNA. This complementary binding is due to the fact that the nucleotide sequence of VGAM2101 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2101 RNA, herein designated VGAM RNA, may have a different number of host target binding sites in untranslated regions of a VGAM2101 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2101 RNA, herein designated VGAM RNA, to host target binding sites on VGAM2101 host target RNA, herein designated VGAM HOST TARGET RNA, such as BINDING SITE I, BINDING SITE II and BINDING SITE III, inhibits translation of VGAM2101 host target RNA into VGAM2101 host target protein, herein designated VGAM HOST TARGET PROTEIN. VGAM host target protein is therefore outlined by a broken line.

It is appreciated that VGAM2101 host target gene, herein designated VGAM HOST TARGET GENE, in fact represents a plurality of VGAM2101 host target genes. The mRNA of each one of this plurality of VGAM2101 host target genes comprises one or more host target binding sites, each having a nucleotide sequence which is at least partly complementary to VGAM2101 RNA, herein designated VGAM RNA, and which when bound by VGAM2101 RNA causes inhibition of translation of respective one or more VGAM2101 host target proteins.

It is further appreciated by one skilled in the art that the mode of translational inhibition illustrated by FIG. 1 with specific reference to translational inhibition exerted by VGAM2101 gene, herein designated VGAM GENE, on one or more VGAM2101 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2101 is inhibition of expression of host target genes, as part of a novel viral mechanism of attacking a host. Accordingly, utilities of VGAM2101 include diagnosis, prevention and treatment of viral infection by Camelpox Virus. Specific functions, and accordingly utilities, of VGAM2101 correlate with, and may be deduced from, the identity of the host target genes which VGAM2101 binds and inhibits, and the function of these host target genes, as elaborated hereinbelow.

Nucleotide sequences of the VGAM2101 precursor RNA, herein designated VGAM PRECURSOR RNA, and of the 'diced' VGAM2101 RNA, herein designated VGAM RNA, and a schematic representation of the secondary folding of VGAM2101 folded precursor RNA, herein designated VGAM FOLDED PRECURSOR RNA, of VGAM2101 are further described hereinbelow with reference to Table 1.

Nucleotide sequences of host target binding sites, such as BINDING SITE-I, BINDING SITE-II and BINDING SITE-III of FIG. 1, found on VGAM2101 host target RNA, and schematic representation of the complementarity of each of these host target binding sites to VGAM2101 RNA, herein designated VGAM RNA, are described hereinbelow with reference to Table 2.

As mentioned hereinabove with reference to FIG. 1, a function of VGAM2101 gene, herein designated VGAM is inhibition of expression of VGAM2101 target genes. It is appreciated that specific functions, and accordingly utilities, of VGAM2101 correlate with, and may be deduced from, the identity of the target genes which VGAM2101 binds and inhibits, and the function of these target genes, as elaborated hereinbelow.

BarH-like 1 (Drosophila) (BARHL1, Accession NM_020064) is a VGAM2101 host target gene. BARHL1 BINDING SITE is HOST TARGET binding site found in the 3' untranslated region of mRNA encoded by BARHL1, corresponding to a HOST TARGET binding site such as BINDING SITE I, BINDING SITE II or BINDING SITE III. Table 2 illustrates the complementarity of the nucleotide sequences of BARHL1 BINDING SITE, designated SEQ ID:21299, to the nucleotide sequence of VGAM2101 RNA, herein designated VGAM RNA, also designated SEQ ID:4812.

A function of VGAM2101 is therefore inhibition of BarH-like 1 (Drosophila) (BARHL1, Accession NM_020064), a gene which controls the expression of neural adhesion molecules. Accordingly, utilities of VGAM2101 include diagnosis, prevention and treatment of diseases and clinical conditions associated with BARHL1. The function of BARHL1 and its association with various diseases and clinical conditions, has been established by previous studies, as described hereinabove with reference to VGAM1006. Collagen, Type I, Alpha 1 (COL1A1, Accession NM_000088) is another VGAM2101 host target gene. COL1A1 BINDING SITE is HOST TARGET binding site found in the 3' untranslated region of mRNA encoded by COL1A1, corresponding to a HOST TARGET binding site such as BINDING SITE I, BINDING SITE II or BINDING SITE III. Table 2 illustrates the complementarity of the nucleotide sequences of COL1A1 BINDING SITE, designated SEQ ID:5537, to the nucleotide sequence of VGAM2101 RNA, herein designated VGAM RNA, also designated SEQ ID:4812.

Another function of VGAM2101 is therefore inhibition of Collagen, Type I, Alpha 1 (COL1A1, Accession NM_000088). Accordingly, utilities of VGAM2101 include diagnosis, prevention and treatment of diseases and clinical conditions associated with COL1A1. SWI/SNF Related, Matrix Associated, Actin Dependent Regulator of Chromatin, Subfamily A, Member 3 (SMARCA3, Accession NM_003071) is another VGAM2101 host target gene. SMARCA3 BINDING SITE is HOST TARGET binding site found in the 3' untranslated region of mRNA encoded by SMARCA3, corresponding to a HOST TARGET binding site such as BINDING SITE I, BINDING SITE II or BINDING SITE III. Table 2 illustrates the complementarity of the nucleotide sequences of SMARCA3 BINDING SITE, designated SEQ ID:9036, to the nucleotide sequence of VGAM2101 RNA, herein designated VGAM RNA, also designated SEQ ID:4812.

Another function of VGAM2101 is therefore inhibition of SWI/SNF Related, Matrix Associated, Actin Dependent Regulator of Chromatin, Subfamily A, Member 3 (SMARCA3, Accession NM_003071), a gene which is involved in chromatin assembly and remodeling. Accordingly, utilities of VGAM2101 include diagnosis, prevention and treatment of diseases and clinical conditions associated with SMARCA3. The function of SMARCA3 and its association with various diseases and clinical conditions, has been established by previous studies, as described hereinabove with reference to VGAM1330. ABLIM (Accession NM_002313) is another VGAM2101 host target gene. ABLIM BINDING SITE1 and ABLIM BINDING SITE2 are HOST TARGET binding sites found in untranslated regions of mRNA encoded by ABLIM, corresponding to HOST TARGET binding sites such as BINDING SITE I, BINDING SITE II or BINDING SITE III. Table 2 illustrates the complementarity of the nucleotide sequences of ABLIM BINDING SITE1 and ABLIM BINDING SITE2, designated SEQ ID:8109 and SEQ ID:13542 respectively, to the nucleotide sequence of VGAM2101 RNA, herein designated VGAM RNA, also designated SEQ ID:4812.

Another function of VGAM2101 is therefore inhibition of ABLIM (Accession NM_002313). Accordingly, utilities of VGAM2101 include diagnosis, prevention and treatment of diseases and clinical conditions associated with ABLIM. FIG. 1 further provides a conceptual description of a novel bioinformatically detected viral gene of the present invention, referred to here as Viral Genomic Address Messenger 2102 (VGAM2102) viral gene, which modulates expression of respective host target genes thereof, the function and utility of which host target genes is known in the art.

VGAM2102 is a novel bioinformatically detected regulatory, non protein coding, viral micro RNA (miRNA) gene. The method by which VGAM2102 was detected is described hereinabove with reference to FIGS. 1-8.

VGAM2102 gene, herein designated VGAM GENE, is a viral gene contained in the genome of Camelpox Virus. VGAM2102 host target gene, herein designated VGAM HOST TARGET GENE, is a human gene contained in the human genome.

VGAM2102 gene encodes a VGAM2102 precursor RNA, herein designated VGAM PRECURSOR RNA. Similar to other miRNA genes, and unlike most ordinary genes, VGAM2102 precursor RNA does not encode a protein. A nucleotide sequence identical or highly similar to the nucleotide sequence of VGAM2102 precursor RNA is designated SEQ ID:2088, and is provided hereinbelow with reference to the sequence listing part. Nucleotide sequence SEQ ID:2088 is located at position 168981 relative to the genome of Camelpox Virus.

VGAM2102 precursor RNA folds onto itself, forming VGAM2102 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2102 folded precursor RNA into VGAM2102 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM2102 RNA is designated SEQ ID:4813, and is provided hereinbelow with reference to the sequence listing part.

VGAM2102 host target gene, herein designated VGAM HOST TARGET GENE, encodes a corresponding messenger RNA, VGAM2102 host target RNA, herein designated VGAM HOST TARGET RNA. VGAM2102 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2102 RNA, herein designated VGAM RNA, binds complementarily to one or more host target binding sites located in untranslated regions of VGAM2102 host target RNA, herein designated VGAM HOST TARGET RNA. This complementary binding is due to the fact that the nucleotide sequence of VGAM2102 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2102 RNA, herein designated VGAM RNA, may have a different number of host target binding sites in untranslated regions of a VGAM2102 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2102 RNA, herein designated VGAM RNA, to host target binding sites on VGAM2102 host target RNA, herein designated VGAM HOST TARGET RNA, such as BINDING SITE I, BINDING SITE II and BINDING SITE III, inhibits translation of VGAM2102 host target RNA into VGAM2102 host target protein, herein designated VGAM HOST TARGET PROTEIN. VGAM host target protein is therefore outlined by a broken line.

It is appreciated that VGAM2102 host target gene, herein designated VGAM HOST TARGET GENE, in fact represents a plurality of VGAM2102 host target genes. The mRNA of each one of this plurality of VGAM2102 host target genes comprises one or more host target binding sites, each having a nucleotide sequence which is at least partly complementary to VGAM2102 RNA, herein designated VGAM RNA, and which when bound by VGAM2102 RNA causes inhibition of translation of respective one or more VGAM2102 host target proteins.

It is further appreciated by one skilled in the art that the mode of translational inhibition illustrated by FIG. 1 with specific reference to translational inhibition exerted by VGAM2102 gene, herein designated VGAM GENE, on one or more VGAM2102 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2102 is inhibition of expression of host target genes, as part of a novel viral mechanism of attacking a host. Accordingly, utilities of VGAM2102 include diagnosis, prevention and treatment of viral infection by Camelpox Virus. Specific functions, and accordingly utilities, of VGAM2102 correlate with, and may be deduced from, the identity of the host target genes which VGAM2102 binds and inhibits, and the function of these host target genes, as elaborated hereinbelow.

Nucleotide sequences of the VGAM2102 precursor RNA, herein designated VGAM PRECURSOR RNA, and of the 'diced' VGAM2102 RNA, herein designated VGAM RNA, and a schematic representation of the secondary folding of VGAM2102 folded precursor RNA, herein designated VGAM FOLDED PRECURSOR RNA, of VGAM2102 are further described hereinbelow with reference to Table 1.

Nucleotide sequences of host target binding sites, such as BINDING SITE-I, BINDING SITE-II and BINDING SITE-III of FIG. 1, found on VGAM2102 host target RNA, and schematic representation of the complementarity of each of these host target binding sites to VGAM2102 RNA, herein designated VGAM RNA, are described hereinbelow with reference to Table 2.

As mentioned hereinabove with reference to FIG. 1, a function of VGAM2102 gene, herein designated VGAM is inhibition of expression of VGAM2102 target genes. It is appreciated that specific functions, and accordingly utilities, of VGAM2102 correlate with, and may be deduced from, the identity of the target genes which VGAM2102 binds and inhibits, and the function of these target genes, as elaborated hereinbelow.

Heparan Sulfate 2-O-sulfotransferase 1 (HS2ST1, Accession NM_012262) is a VGAM2102 host target gene. HS2ST1 BINDING SITE is HOST TARGET binding site found in the 3' untranslated region of mRNA encoded by HS2ST1, corresponding to a HOST TARGET binding site such as BINDING SITE I, BINDING SITE II or BINDING SITE III. Table 2 illustrates the complementarity of the nucleotide sequences of HS2ST1 BINDING SITE, designated SEQ ID:14578, to the nucleotide sequence of VGAM2102 RNA, herein designated VGAM RNA, also designated SEQ ID:4813.

A function of VGAM2102 is therefore inhibition of Heparan Sulfate 2-O-sulfotransferase 1 (HS2ST1, Accession NM_012262). Accordingly, utilities of VGAM2102 include diagnosis, prevention and treatment of diseases and clinical conditions associated with HS2ST1. Pleiomorphic Adenoma Gene-like 1 (PLAGL1, Accession NM_002656) is another VGAM2102 host target gene. PLAGL1 BINDING SITE is HOST TARGET binding site found in the 3' untranslated region of mRNA encoded by PLAGL1, corresponding to a HOST TARGET binding site such as BINDING SITE I, BINDING SITE II or BINDING SITE III. Table 2 illustrates the complementarity of the nucleotide sequences of PLAGL1 BINDING SITE, designated SEQ ID:8529, to the nucleotide sequence of VGAM2102 RNA, herein designated VGAM RNA, also designated SEQ ID:4813.

Another function of VGAM2102 is therefore inhibition of Pleiomorphic Adenoma Gene-like 1 (PLAGL1, Accession NM_002656), a gene which regulates apoptosis and cell cycle arrest. Accordingly, utilities of VGAM2102 include diagnosis, prevention and treatment of diseases and clinical conditions associated with PLAGL1. The function of PLAGL1 and its association with various diseases and clinical conditions, has been established by previous studies, as described hereinabove with reference to VGAM89. Protein Phosphatase 1, Catalytic Subunit, Beta Isoform (PPP1CB, Accession NM_002709) is another VGAM2102 host target gene. PPP1CB BINDING SITE is HOST TARGET binding site found in the 3' untranslated region of mRNA encoded by PPP1CB, corresponding to a HOST TARGET binding site such as BINDING SITE I, BINDING SITE II or BINDING SITE III. Table 2 illustrates the complementarity of the nucleotide sequences of PPP1CB BINDING SITE, designated SEQ ID:8555, to the nucleotide sequence of VGAM2102 RNA, herein designated VGAM RNA, also designated SEQ ID:4813.

Another function of VGAM2102 is therefore inhibition of Protein Phosphatase 1, Catalytic Subunit, Beta Isoform (PPP1CB, Accession NM_002709), a gene which is the catalytic subunit of protein phosphatase 1. Accordingly, utilities of VGAM2102 include diagnosis, prevention and treatment of diseases and clinical conditions associated with PPP1CB. The function of PPP1CB and its association with various diseases and clinical conditions, has been established by previous studies, as described hereinabove with reference to VGAM46. Protein Tyrosine Phosphatase, Receptor Type, J (PTPRJ, Accession NM_002843) is another VGAM2102 host target gene. PTPRJ BINDING SITE is HOST TARGET binding site found in the 3' untranslated region of mRNA encoded by PTPRJ, corresponding to a HOST TARGET binding site such as BINDING SITE I, BINDING SITE II or BINDING SITE III. Table 2 illustrates the complementarity of the nucleotide sequences of PTPRJ BINDING SITE, designated SEQ ID:8729, to the nucleotide sequence of VGAM2102 RNA, herein designated VGAM RNA, also designated SEQ ID:4813.

Another function of VGAM2102 is therefore inhibition of Protein Tyrosine Phosphatase, Receptor Type, J (PTPRJ, Accession NM_002843), a gene which Receptor-type protein tyrosine phosphatase J. Accordingly, utilities of VGAM2102 include diagnosis, prevention and treatment of diseases and clinical conditions associated with PTPRJ. The function of PTPRJ and its association with various diseases and clinical conditions, has been established by previous studies, as described hereinabove with reference to VGAM552. Tumor-associated Calcium Signal Transducer 2 (TACSTD2, Accession NM_002353) is another VGAM2102 host target gene. TACSTD2 BINDING SITE is HOST TARGET binding site found in the 3' untranslated region of mRNA encoded by TACSTD2, corresponding to a HOST TARGET binding site such as BINDING SITE I, BINDING SITE II or BINDING SITE III. Table 2 illustrates the complementarity of the nucleotide sequences of TACSTD2 BINDING SITE, designated SEQ ID:8159, to the nucleotide sequence of VGAM2102 RNA, herein designated VGAM RNA, also designated SEQ ID:4813.

Another function of VGAM2102 is therefore inhibition of Tumor-associated Calcium Signal Transducer 2 (TACSTD2, Accession NM_002353), a gene which belongs to ga733 tumor-associated antigen gene family and may function as growth factor receptors. Accordingly, utilities of VGAM2102 include diagnosis, prevention and treatment of diseases and clinical conditions associated with TACSTD2. The function of TACSTD2 and its association with various diseases and clinical conditions, has been established by previous studies, as described hereinabove with reference to VGAM210. CAT56 (Accession NM_025263) is another VGAM2102 host target gene. CAT56 BINDING SITE is HOST TARGET binding site found in the 3' untranslated region of mRNA encoded by CAT56, corresponding to a HOST TARGET binding site such as BINDING SITE I, BINDING SITE II or BINDING SITE III. Table 2 illustrates the complementarity of the nucleotide sequences of CAT56 BINDING SITE, designated SEQ ID:24933, to the nucleotide sequence of VGAM2102 RNA, herein designated VGAM RNA, also designated SEQ ID:4813.

Another function of VGAM2102 is therefore inhibition of CAT56 (Accession NM_025263). Accordingly, utilities of VGAM2102 include diagnosis, prevention and treatment of diseases and clinical conditions associated with CAT56. DKFZp761K1423 (Accession NM_018422) is another VGAM2102 host target gene. DKFZp761K1423 BINDING SITE is HOST TARGET binding site found in the 3' untranslated region of mRNA encoded by DKFZp761K1423, corresponding to a HOST TARGET binding site such as BINDING SITE I, BINDING SITE II or BINDING SITE III. Table 2 illustrates the complementarity of the nucleotide sequences of DKFZp761K1423 BINDING SITE, designated SEQ ID:20474, to the nucleotide sequence of VGAM2102 RNA, herein designated VGAM RNA, also designated SEQ ID:4813.

Another function of VGAM2102 is therefore inhibition of DKFZp761K1423 (Accession NM_018422). Accordingly, utilities of VGAM2102 include diagnosis, prevention and treatment of diseases and clinical conditions associated with DKFZp761K1423. KIAA0155 (Accession NM_014633) is another VGAM2102 host target gene. KIAA0155 BINDING SITE is HOST TARGET binding site found in the 3' untranslated region of mRNA encoded by KIAA0155, corresponding to a HOST TARGET binding site such as BINDING SITE I, BINDING SITE II or BINDING SITE III. Table 2 illustrates the complementarity of the nucleotide sequences of KIAA0155 BINDING SITE, designated SEQ ID:16004, to the nucleotide sequence of VGAM2102 RNA, herein designated VGAM RNA, also designated SEQ ID:4813.

Another function of VGAM2102 is therefore inhibition of KIAA0155 (Accession NM_014633). Accordingly, utilities of VGAM2102 include diagnosis, prevention and treatment of diseases and clinical conditions associated with KIAA0155. KIAA1198 (Accession XM_032674) is another VGAM2102 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31714, to the nucleotide sequence of VGAM2102 RNA, herein designated VGAM RNA, also designated SEQ ID:4813.

Another function of VGAM2102 is therefore inhibition of KIAA1198 (Accession XM_032674). Accordingly, utilities of VGAM2102 include diagnosis, prevention and treatment of diseases and clinical conditions associated with KIAA1198. KIAA1915 (Accession XM_055481) is another VGAM2102 host target gene. KIAA1915 BINDING SITE is HOST TARGET binding site found in the 3' untranslated region of mRNA encoded by KIAA1915, corresponding to a HOST TARGET binding site such as BINDING SITE I, BINDING SITE II or BINDING SITE III. Table 2 illustrates the complementarity of the nucleotide sequences of KIAA1915 BINDING SITE, designated SEQ ID:36267, to the nucleotide sequence of VGAM2102 RNA, herein designated VGAM RNA, also designated SEQ ID:4813.

Another function of VGAM2102 is therefore inhibition of KIAA1915 (Accession XM_055481). Accordingly, utilities of VGAM2102 include diagnosis, prevention and treatment of diseases and clinical conditions associated with KIAA1915. Zinc Finger Protein 387 (ZNF387, Accession NM_014682) is another VGAM2102 host target gene. ZNF387 BINDING SITE is HOST TARGET binding site found in the 3' untranslated region of mRNA encoded by ZNF387, corresponding to a HOST TARGET binding site such as BINDING SITE I, BINDING SITE II or BINDING SITE III. Table 2 illustrates the complementarity of the nucleotide sequences of ZNF387 BINDING SITE, designated SEQ ID:16173, to the nucleotide sequence of VGAM2102 RNA, herein designated VGAM RNA, also designated SEQ ID:4813.

Another function of VGAM2102 is therefore inhibition of Zinc Finger Protein 387 (ZNF387, Accession NM_014682). Accordingly, utilities of VGAM2102 include diagnosis, prevention and treatment of diseases and clinical conditions associated with ZNF387. LOC147343 (Accession XM_097225) is another VGAM2102 host target gene. LOC147343 BINDING SITE is HOST TARGET binding site found in the 5' untranslated region of mRNA encoded by LOC147343, corresponding to a HOST TARGET binding site such as BINDING SITE I, BINDING SITE II or BINDING SITE III. Table 2 illustrates the complementarity of the nucleotide sequences of LOC147343 BINDING SITE, designated SEQ ID:40832, to the nucleotide sequence of VGAM2102 RNA, herein designated VGAM RNA, also designated SEQ ID:4813.

Another function of VGAM2102 is therefore inhibition of LOC147343 (Accession XM_097225). Accordingly, utilities of VGAM2102 include diagnosis, prevention and treatment of diseases and clinical conditions associated with LOC147343. LOC164684 (Accession XM_092926) is another VGAM2102 host target gene. LOC164684 BINDING SITE is HOST TARGET binding site found in the 3' untranslated region of mRNA encoded by LOC164684, corresponding to a HOST TARGET binding site such as BINDING SITE I, BINDING SITE II or BINDING SITE III. Table 2 illustrates the complementarity of the nucleotide sequences of LOC164684 BINDING SITE, designated SEQ ID:40161, to the nucleotide sequence of VGAM2102 RNA, herein designated VGAM RNA, also designated SEQ ID:4813.

Another function of VGAM2102 is therefore inhibition of LOC164684 (Accession XM_092926). Accordingly, utilities of VGAM2102 include diagnosis, prevention and treatment of diseases and clinical conditions associated with LOC164684. FIG. 1 further provides a conceptual description of a novel bioinformatically detected viral gene of the present invention, referred to here as Viral Genomic Address Messenger 2103 (VGAM2103) viral gene, which modulates expression of respective host target genes thereof, the function and utility of which host target genes is known in the art.

VGAM2103 is a novel bioinformatically detected regulatory, non protein coding, viral micro RNA (miRNA) gene. The method by which VGAM2103 was detected is described hereinabove with reference to FIGS. 1-8.

VGAM2103 gene, herein designated VGAM GENE, is a viral gene contained in the genome of Camelpox Virus. VGAM2103 host target gene, herein designated VGAM HOST TARGET GENE, is a human gene contained in the human genome.

VGAM2103 gene encodes a VGAM2103 precursor RNA, herein designated VGAM PRECURSOR RNA. Similar to other miRNA genes, and unlike most ordinary genes, VGAM2103 precursor RNA does not encode a protein. A nucleotide sequence identical or highly similar to the nucleotide sequence of VGAM2103 precursor RNA is designated SEQ ID:2089, and is provided hereinbelow with reference to the sequence listing part. Nucleotide sequence SEQ ID:2089 is located at position 177859 relative to the genome of Camelpox Virus.

VGAM2103 precursor RNA folds onto itself, forming VGAM2103 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2103 folded precursor RNA into VGAM2103 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2103 RNA is designated SEQ ID:4814, and is provided hereinbelow with reference to the sequence listing part.

VGAM2103 host target gene, herein designated VGAM HOST TARGET GENE, encodes a corresponding messenger RNA, VGAM2103 host target RNA, herein designated VGAM HOST TARGET RNA. VGAM2103 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2103 RNA, herein designated VGAM RNA, binds complementarily to one or more host target binding sites located in untranslated regions of VGAM2103 host target RNA, herein designated VGAM HOST TARGET RNA. This complementary binding is due to the fact that the nucleotide sequence of VGAM2103 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2103 RNA, herein designated VGAM RNA, may have a different number of host target binding sites in untranslated regions of a VGAM2103 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2103 RNA, herein designated VGAM RNA, to host target binding sites on VGAM2103 host target RNA, herein designated VGAM HOST TARGET RNA, such as BINDING SITE I, BINDING SITE II and BINDING SITE III, inhibits translation of VGAM2103 host target RNA into VGAM2103 host target protein, herein designated VGAM HOST TARGET PROTEIN. VGAM host target protein is therefore outlined by a broken line.

It is appreciated that VGAM2103 host target gene, herein designated VGAM HOST TARGET GENE, in fact represents a plurality of VGAM2103 host target genes. The mRNA of each one of this plurality of VGAM2103 host target genes comprises one or more host target binding sites, each having a nucleotide sequence which is at least partly complementary to VGAM2103 RNA, herein designated VGAM RNA, and which when bound by VGAM2103 RNA causes inhibition of translation of respective one or more VGAM2103 host target proteins.

It is further appreciated by one skilled in the art that the mode of translational inhibition illustrated by FIG. 1 with specific reference to translational inhibition exerted by VGAM2103 gene, herein designated VGAM GENE, on one or more VGAM2103 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2103 is inhibition of expression of host target genes, as part of a novel viral mechanism of attacking a host. Accordingly, utilities of VGAM2103 include diagnosis, prevention and treatment of viral infection by Camelpox Virus. Specific functions, and accordingly utilities, of VGAM2103 correlate with, and may be deduced from, the identity of the host target genes which VGAM2103 binds and inhibits, and the function of these host target genes, as elaborated hereinbelow.

Nucleotide sequences of the VGAM2103 precursor RNA, herein designated VGAM PRECURSOR RNA, and of the 'diced' VGAM2103 RNA, herein designated VGAM RNA, and a schematic representation of the secondary folding of VGAM2103 folded precursor RNA, herein designated VGAM FOLDED PRECURSOR RNA, of VGAM2103 are further described hereinbelow with reference to Table 1.

Nucleotide sequences of host target binding sites, such as BINDING SITE-I, BINDING SITE-II and BINDING SITE-III of FIG. 1, found on VGAM2103 host target RNA, and schematic representation of the complementarity of each of these host target binding sites to VGAM2103 RNA, herein designated VGAM RNA, are described hereinbelow with reference to Table 2.

As mentioned hereinabove with reference to FIG. 1, a function of VGAM2103 gene, herein designated VGAM is inhibition of expression of VGAM2103 target genes. It is appreciated that specific functions, and accordingly utilities, of VGAM2103 correlate with, and may be deduced from, the identity of the target genes which VGAM2103 binds and inhibits, and the function of these target genes, as elaborated hereinbelow.

Protocadherin 10 (PCDH10, Accession NM_032961) is a VGAM2103 host target gene. PCDH10 BINDING SITE is HOST TARGET binding site found in the 3' untranslated region of mRNA encoded by PCDH10, corresponding to a HOST TARGET binding site such as BINDING SITE I, BINDING SITE II or BINDING SITE III. Table 2 illustrates the complementarity of the nucleotide sequences of PCDH10 BINDING SITE, designated SEQ ID:26771, to the nucleotide sequence of VGAM2103 RNA, herein designated VGAM RNA, also designated SEQ ID:4814.

A function of VGAM2103 is therefore inhibition of Protocadherin 10 (PCDH10, Accession NM_032961). Accordingly, utilities of VGAM2103 include diagnosis, prevention and treatment of diseases and clinical conditions associated with PCDH10. LOC150848 (Accession XM_097959) is another VGAM2103 host target gene. LOC150848 BINDING SITE is HOST TARGET binding site found in the 5' untranslated region of mRNA encoded by LOC150848, corresponding to a HOST TARGET binding site such as BINDING SITE I, BINDING SITE II or BINDING SITE III. Table 2 illustrates the complementarity of the nucleotide sequences of LOC150848 BINDING SITE, designated SEQ ID:41257, to the nucleotide sequence of VGAM2103 RNA, herein designated VGAM RNA, also designated SEQ ID:4814.

Another function of VGAM2103 is therefore inhibition of LOC150848 (Accession XM_097959). Accordingly, utilities of VGAM2103 include diagnosis, prevention and treatment of diseases and clinical conditions associated with LOC150848. LOC160414 (Accession XM_100898) is another VGAM2103 host target gene. LOC160414 BINDING SITE is HOST TARGET binding site found in the 3' untranslated region of mRNA encoded by LOC160414, corresponding to a HOST TARGET binding site such as BINDING SITE I, BINDING SITE II or BINDING SITE III. Table 2 illustrates the complementarity of the nucleotide sequences of LOC160414 BINDING SITE, designated SEQ ID:42105, to the nucleotide sequence of VGAM2103 RNA, herein designated VGAM RNA, also designated SEQ ID:4814.

Another function of VGAM2103 is therefore inhibition of LOC160414 (Accession XM_100898). Accordingly, utilities of VGAM2103 include diagnosis, prevention and treatment of diseases and clinical conditions associated with LOC160414. FIG. 1 further provides a conceptual description of a novel bioinformatically detected viral gene of the present invention, referred to here as Viral Genomic Address Messenger 2104 (VGAM2104) viral gene, which modulates expression of respective host target genes thereof, the function and utility of which host target genes is known in the art.

VGAM2104 is a novel bioinformatically detected regulatory, non protein coding, viral micro RNA (miRNA) gene. The method by which VGAM2104 was detected is described hereinabove with reference to FIGS. 1-8.

VGAM2104 gene, herein designated VGAM GENE, is a viral gene contained in the genome of Camelpox Virus. VGAM2104 host target gene, herein designated VGAM HOST TARGET GENE, is a human gene contained in the human genome.

VGAM2104 gene encodes a VGAM2104 precursor RNA, herein designated VGAM PRECURSOR RNA. Similar to other miRNA genes, and unlike most ordinary genes, VGAM2104 precursor RNA does not encode a protein. A nucleotide sequence identical or highly similar to the nucleotide sequence of VGAM2104 precursor RNA is designated SEQ ID:2090, and is provided hereinbelow with reference to the sequence listing part. Nucleotide sequence SEQ ID:2090 is located at position 161818 relative to the genome of Camelpox Virus.

VGAM2104 precursor RNA folds onto itself, forming VGAM2104 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2104 folded precursor RNA into VGAM2104 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2104 RNA is designated SEQ ID:4815, and is provided hereinbelow with reference to the sequence listing part.

VGAM2104 host target gene, herein designated VGAM HOST TARGET GENE, encodes a corresponding messenger RNA, VGAM2104 host target RNA, herein designated VGAM HOST TARGET RNA. VGAM2104 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2104 RNA, herein designated VGAM RNA, binds complementarily to one or more host target binding sites located in untranslated regions of VGAM2104 host target RNA, herein designated VGAM HOST TARGET RNA. This complementary binding is due to the fact that the nucleotide sequence of VGAM2104 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2104 RNA, herein designated VGAM RNA, may have a different number of host target binding sites in untranslated regions of a VGAM2104 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2104 RNA, herein designated VGAM RNA, to host target binding sites on VGAM2104 host target RNA, herein designated VGAM HOST TARGET RNA, such as BINDING SITE I, BINDING SITE II and BINDING SITE III, inhibits translation of VGAM2104 host target RNA into VGAM2104 host target protein, herein designated VGAM HOST TARGET PROTEIN. VGAM host target protein is therefore outlined by a broken line.

It is appreciated that VGAM2104 host target gene, herein designated VGAM HOST TARGET GENE, in fact represents a plurality of VGAM2104 host target genes. The mRNA of each one of this plurality of VGAM2104 host target genes comprises one or more host target binding sites, each having a nucleotide sequence which is at least partly complementary to VGAM2104 RNA, herein designated VGAM RNA, and which when bound by VGAM2104 RNA causes inhibition of translation of respective one or more VGAM2104 host target proteins.

It is further appreciated by one skilled in the art that the mode of translational inhibition illustrated by FIG. 1 with specific reference to translational inhibition exerted by VGAM2104 gene, herein designated VGAM GENE, on one or more VGAM2104 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2104 is inhibition of expression of host target genes, as part of a novel viral mechanism of attacking a host. Accordingly, utilities of VGAM2104 include diagnosis, prevention and treatment of viral infection by Camelpox Virus. Specific functions, and accordingly utilities, of VGAM2104 correlate with, and may be deduced from, the identity of the host target genes which VGAM2104 binds and inhibits, and the function of these host target genes, as elaborated hereinbelow.

Nucleotide sequences of the VGAM2104 precursor RNA, herein designated VGAM PRECURSOR RNA, and of the 'diced' VGAM2104 RNA, herein designated VGAM RNA, and a schematic representation of the secondary folding of VGAM2104 folded precursor RNA, herein designated VGAM FOLDED PRECURSOR RNA, of VGAM2104 are further described hereinbelow with reference to Table 1.

Nucleotide sequences of host target binding sites, such as BINDING SITE-I, BINDING SITE-II and BINDING SITE-III of FIG. 1, found on VGAM2104 host target RNA, and schematic representation of the complementarity of each of these host target binding sites to VGAM2104 RNA, herein designated VGAM RNA, are described hereinbelow with reference to Table 2.

As mentioned hereinabove with reference to FIG. 1, a function of VGAM2104 gene, herein designated VGAM is inhibition of expression of VGAM2104 target genes. It is appreciated that specific functions, and accordingly utilities, of VGAM2104 correlate with, and may be deduced from, the identity of the target genes which VGAM2104 binds and inhibits, and the function of these target genes, as elaborated hereinbelow.

Catenin, Beta Interacting Protein 1 (CTNNBIP1, Accession NM_020248) is a VGAM2104 host target gene. CTNNBIP1 BINDING SITE is HOST TARGET binding site found in the 3' untranslated region of mRNA encoded by CTNNBIP1, corresponding to a HOST TARGET binding site such as BINDING SITE I, BINDING SITE II or BINDING SITE III. Table 2 illustrates the complementarity of the nucleotide sequences of CTNNBIP1 BINDING SITE, designated SEQ ID:21542, to the nucleotide sequence of VGAM2104 RNA, herein designated VGAM RNA, also designated SEQ ID:4815.

A function of VGAM2104 is therefore inhibition of Catenin, Beta Interacting Protein 1 (CTNNBIP1, Accession NM_020248). Accordingly, utilities of VGAM2104 include diagnosis, prevention and treatment of diseases and clinical conditions associated with CTNNBIP1. FIG. 1 further provides a conceptual description of a novel bioinformatically detected viral gene of the present invention, referred to here as Viral Genomic Address Messenger 2105 (VGAM2105) viral gene, which modulates expression of respective host target genes thereof, the function and utility of which host target genes is known in the art.

VGAM2105 is a novel bioinformatically detected regulatory, non protein coding, viral micro RNA (miRNA) gene. The method by which VGAM2105 was detected is described hereinabove with reference to FIGS. 1-8.

VGAM2105 gene, herein designated VGAM GENE, is a viral gene contained in the genome of Grapevine Chrome Mosaic Virus. VGAM2105 host target gene, herein designated VGAM HOST TARGET GENE, is a human gene contained in the human genome.

VGAM2105 gene encodes a VGAM2105 precursor RNA, herein designated VGAM PRECURSOR RNA. Similar to other miRNA genes, and unlike most ordinary genes, VGAM2105 precursor RNA does not encode a protein. A nucleotide sequence identical or highly similar to the nucleotide sequence of VGAM2105 precursor RNA is designated SEQ ID:2091, and is provided hereinbelow with reference to the sequence listing part. Nucleotide sequence SEQ ID:2091 is located at position 3783 relative to the genome of Grapevine Chrome Mosaic Virus.

VGAM2105 precursor RNA folds onto itself, forming VGAM2105 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2105 folded precursor RNA into VGAM2105 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 81%) nucleotide sequence of VGAM2105 RNA is designated SEQ ID:4816, and is provided hereinbelow with reference to the sequence listing part.

VGAM2105 host target gene, herein designated VGAM HOST TARGET GENE, encodes a corresponding messenger RNA, VGAM2105 host target RNA, herein designated VGAM HOST TARGET RNA. VGAM2105 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2105 RNA, herein designated VGAM RNA, binds complementarily to one or more host target binding sites located in untranslated regions of VGAM2105 host target RNA, herein designated VGAM HOST TARGET RNA. This complementary binding is due to the fact that the nucleotide sequence of VGAM2105 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2105 RNA, herein designated VGAM RNA, may have a different number of host target binding sites in untranslated regions of a VGAM2105 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2105 RNA, herein designated VGAM RNA, to host target binding sites on VGAM2105 host target RNA, herein designated VGAM HOST TARGET RNA, such as BINDING SITE I, BINDING SITE II and BINDING SITE III, inhibits translation of VGAM2105 host target RNA into VGAM2105 host target protein, herein designated VGAM HOST TARGET PROTEIN. VGAM host target protein is therefore outlined by a broken line.

It is appreciated that VGAM2105 host target gene, herein designated VGAM HOST TARGET GENE, in fact represents a plurality of VGAM2105 host target genes. The mRNA of each one of this plurality of VGAM2105 host target genes comprises one or more host target binding sites, each having a nucleotide sequence which is at least partly complementary to VGAM2105 RNA, herein designated VGAM RNA, and which when bound by VGAM2105 RNA causes inhibition of translation of respective one or more VGAM2105 host target proteins.

It is further appreciated by one skilled in the art that the mode of translational inhibition illustrated by FIG. 1 with specific reference to translational inhibition exerted by VGAM2105 gene, herein designated VGAM GENE, on one or more VGAM2105 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2105 is inhibition of expression of host target genes, as part of a novel viral mechanism of attacking a host. Accordingly, utilities of VGAM2105 include diagnosis, prevention and treatment of viral infection by Grapevine Chrome Mosaic Virus. Specific functions, and accordingly utilities, of VGAM2105 correlate with, and may be deduced from, the identity of the host target genes which VGAM2105 binds and inhibits, and the function of these host target genes, as elaborated hereinbelow.

Nucleotide sequences of the VGAM2105 precursor RNA, herein designated VGAM PRECURSOR RNA, and of the 'diced' VGAM2105 RNA, herein designated VGAM RNA, and a schematic representation of the secondary folding of VGAM2105 folded precursor RNA, herein designated VGAM FOLDED PRECURSOR RNA, of VGAM2105 are further described hereinbelow with reference to Table 1.

Nucleotide sequences of host target binding sites, such as BINDING SITE-I, BINDING SITE-II and BINDING SITE-III of FIG. 1, found on VGAM2105 host target RNA, and schematic representation of the complementarity of each of these host target binding sites to VGAM2105 RNA, herein designated VGAM RNA, are described hereinbelow with reference to Table 2.

As mentioned hereinabove with reference to FIG. 1, a function of VGAM2105 gene, herein designated VGAM is inhibition of expression of VGAM2105 target genes. It is appreciated that specific functions, and accordingly utilities, of VGAM2105 correlate with, and may be deduced from, the identity of the target genes which VGAM2105 binds and inhibits, and the function of these target genes, as elaborated hereinbelow.

KIAA0459 (Accession XM_027862) is a VGAM2105 host target gene. KIAA0459 BINDING SITE is HOST TARGET binding site found in the 3' untranslated region of mRNA encoded by KIAA0459, corresponding to a HOST TARGET binding site such as BINDING SITE I, BINDING SITE II or BINDING SITE III. Table 2 illustrates the complementarity of the nucleotide sequences of KIAA0459 BINDING SITE, designated SEQ ID:30571, to the nucleotide sequence of VGAM2105 RNA, herein designated VGAM RNA, also designated SEQ ID:4816.

A function of VGAM2105 is therefore inhibition of KIAA0459 (Accession XM_027862). Accordingly, utilities of VGAM2105 include diagnosis, prevention and treatment of diseases and clinical conditions associated with KIAA0459. FIG. 1 further provides a conceptual description of a novel bioinformatically detected viral gene of the present invention, referred to here as Viral Genomic Address Messenger 2106 (VGAM2106) viral gene, which modulates expression of respective host target genes thereof, the function and utility of which host target genes is known in the art.

VGAM2106 is a novel bioinformatically detected regulatory, non protein coding, viral micro RNA (miRNA) gene. The method by which VGAM2106 was detected is described hereinabove with reference to FIGS. 1-8.

VGAM2106 gene, herein designated VGAM GENE, is a viral gene contained in the genome of Grapevine Chrome Mosaic Virus. VGAM2106 host target gene, herein designated VGAM HOST TARGET GENE, is a human gene contained in the human genome.

VGAM2106 gene encodes a VGAM2106 precursor RNA, herein designated VGAM PRECURSOR RNA. Similar to other miRNA genes, and unlike most ordinary genes, VGAM2106 precursor RNA does not encode a protein. A nucleotide sequence identical or highly similar to the nucleotide sequence of VGAM2106 precursor RNA is designated SEQ ID:2092, and is provided hereinbelow with reference to the sequence listing part. Nucleotide sequence SEQ ID:2092 is located at position 4094 relative to the genome of Grapevine Chrome Mosaic Virus.

VGAM2106 precursor RNA folds onto itself, forming VGAM2106 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2106 folded precursor RNA into VGAM2106 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM2106 RNA is designated SEQ ID:4817, and is provided hereinbelow with reference to the sequence listing part.

VGAM2106 host target gene, herein designated VGAM HOST TARGET GENE, encodes a corresponding messenger RNA, VGAM2106 host target RNA, herein designated VGAM HOST TARGET RNA. VGAM2106 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2106 RNA, herein designated VGAM RNA, binds complementarily to one or more host target binding sites located in untranslated regions of VGAM2106 host target RNA, herein designated VGAM HOST TARGET RNA. This complementary binding is due to the fact that the nucleotide sequence of VGAM2106 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2106 RNA, herein designated VGAM RNA, may have a different number of host target binding sites in untranslated regions of a VGAM2106 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2106 RNA, herein designated VGAM RNA, to host target binding sites on VGAM2106 host target RNA, herein designated VGAM HOST TARGET RNA, such as BINDING SITE I, BINDING SITE II and BINDING SITE III, inhibits translation of VGAM2106 host target RNA into VGAM2106 host target protein, herein designated VGAM HOST TARGET PROTEIN. VGAM host target protein is therefore outlined by a broken line.

It is appreciated that VGAM2106 host target gene, herein designated VGAM HOST TARGET GENE, in fact represents a plurality of VGAM2106 host target genes. The mRNA of each one of this plurality of VGAM2106 host target genes comprises one or more host target binding sites, each having a nucleotide sequence which is at least partly complementary to VGAM2106 RNA, herein designated VGAM RNA, and which when bound by VGAM2106 RNA causes inhibition of translation of respective one or more VGAM2106 host target proteins.

It is further appreciated by one skilled in the art that the mode of translational inhibition illustrated by FIG. 1 with specific reference to translational inhibition exerted by VGAM2106 gene, herein designated VGAM GENE, on one or more VGAM2106 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2106 is inhibition of expression of host target genes, as part of a novel viral mechanism of attacking a host. Accordingly, utilities of VGAM2106 include diagnosis, prevention and treatment of viral infection by Grapevine Chrome Mosaic Virus. Specific functions, and accordingly utilities, of VGAM2106 correlate with, and may be deduced from, the identity of the host target genes which VGAM2106 binds and inhibits, and the function of these host target genes, as elaborated hereinbelow.

Nucleotide sequences of the VGAM2106 precursor RNA, herein designated VGAM PRECURSOR RNA, and of the 'diced' VGAM2106 RNA, herein designated VGAM RNA, and a schematic representation of the secondary folding of VGAM2106 folded precursor RNA, herein designated VGAM FOLDED PRECURSOR RNA, of VGAM2106 are further described hereinbelow with reference to Table 1.

Nucleotide sequences of host target binding sites, such as BINDING SITE-I, BINDING SITE-II and BINDING SITE-III of FIG. 1, found on VGAM2106 host target RNA, and schematic representation of the complementarity of each of these host target binding sites to VGAM2106 RNA, herein designated VGAM RNA, are described hereinbelow with reference to Table 2.

As mentioned hereinabove with reference to FIG. 1, a function of VGAM2106 gene, herein designated VGAM is inhibition of expression of VGAM2106 target genes. It is appreciated that specific functions, and accordingly utilities, of VGAM2106 correlate with, and may be deduced from, the identity of the target genes which VGAM2106 binds and inhibits, and the function of these target genes, as elaborated hereinbelow.

Cystathionine-beta-synthase (CBS, Accession NM_000071) is a VGAM2106 host target gene. CBS BINDING SITE is HOST TARGET binding site found in the 5' untranslated region of mRNA encoded by CBS, corresponding to a HOST TARGET binding site such as BINDING SITE I, BINDING SITE II or BINDING SITE III. Table 2 illustrates the complementarity of the nucleotide sequences of CBS BINDING SITE, designated SEQ ID:5517, to the nucleotide sequence of VGAM2106 RNA, herein designated VGAM RNA, also designated SEQ ID:4817.

A function of VGAM2106 is therefore inhibition of Cystathionine-beta-synthase (CBS, Accession NM_000071).

Accordingly, utilities of VGAM2106 include diagnosis, prevention and treatment of diseases and clinical conditions associated with CBS. RAB6A, Member RAS Oncogene Family (RAB6A, Accession NM_002869) is another VGAM2106 host target gene. RAB6A BINDING SITE is HOST TARGET binding site found in the 3' untranslated region of mRNA encoded by RAB6A, corresponding to a HOST TARGET binding site such as BINDING SITE I, BINDING SITE II or BINDING SITE III. Table 2 illustrates the complementarity of the nucleotide sequences of RAB6A BINDING SITE, designated SEQ ID:8776, to the nucleotide sequence of VGAM2106 RNA, herein designated VGAM RNA, also designated SEQ ID:4817.

Another function of VGAM2106 is therefore inhibition of RAB6A, Member RAS Oncogene Family (RAB6A, Accession NM_002869), a gene which is involved in protein trafficking. Accordingly, utilities of VGAM2106 include diagnosis, prevention and treatment of diseases and clinical conditions associated with RAB6A. The function of RAB6A and its association with various diseases and clinical conditions, has been established by previous studies, as described hereinabove with reference to VGAM217. Sodium Channel, Voltage-gated, Type I, Alpha Polypeptide (SCN1A, Accession XM_114281) is another VGAM2106 host target gene. SCN1A BINDING SITE is HOST TARGET binding site found in the 3" untranslated region of mRNA encoded by SCN1A, corresponding to a HOST TARGET binding site such as BINDING SITE I, BINDING SITE II or BINDING SITE III. Table 2 illustrates the complementarity of the nucleotide sequences of SCN1A BINDING SITE, designated SEQ ID:42835, to the nucleotide sequence of VGAM2106 RNA, herein designated VGAM RNA, also designated SEQ ID:4817.

Another function of VGAM2106 is therefore inhibition of Sodium Channel, Voltage-gated, Type I, Alpha Polypeptide (SCN1A, Accession XM_114281). Accordingly, utilities of VGAM2106 include diagnosis, prevention and treatment of diseases and clinical conditions associated with SCN1A. SEC14-like 2 (S. cerevisiae) (SEC14L2, Accession NM_012429) is another VGAM2106 host target gene. SEC14L2 BINDING SITE is HOST TARGET binding site found in the 3' untranslated region of mRNA encoded by SEC14L2, corresponding to a HOST TARGET binding site such as BINDING SITE I, BINDING SITE II or BINDING SITE III. Table 2 illustrates the complementarity of the nucleotide sequences of SEC14L2 BINDING SITE, designated SEQ ID:14807, to the nucleotide sequence of VGAM2106 RNA, herein designated VGAM RNA, also designated SEQ ID:4817.

Another function of VGAM2106 is therefore inhibition of SEC14-like 2 (S. cerevisiae) (SEC14L2, Accession NM_012429). Accordingly, utilities of VGAM2106 include diagnosis, prevention and treatment of diseases and clinical conditions associated with SEC14L2. SEP15 (Accession NM_004261) is another VGAM2106 host target gene. SEP15 BINDING SITE is HOST TARGET binding site found in the 3' untranslated region of mRNA encoded by SEP15, corresponding to a HOST TARGET binding site such as BINDING SITE I, BINDING SITE II or BINDING SITE III. Table 2 illustrates the complementarity of the nucleotide sequences of SEP15 BINDING SITE, designated SEQ ID:10454, to the nucleotide sequence of VGAM2106 RNA, herein designated VGAM RNA, also designated SEQ ID:4817.

Another function of VGAM2106 is therefore inhibition of SEP15 (Accession NM_004261). Accordingly, utilities of VGAM2106 include diagnosis, prevention and treatment of diseases and clinical conditions associated with SEP15. LOC147514 (Accession XM_041564) is another VGAM2106 host target gene. LOC147514 BINDING SITE is HOST TARGET binding site found in the 3' untranslated region of mRNA encoded by LOC147514, corresponding to a HOST TARGET binding site such as BINDING SITE I, BINDING SITE II or BINDING SITE III. Table 2 illustrates the complementarity of the nucleotide sequences of LOC147514 BINDING SITE, designated SEQ ID:33547, to the nucleotide sequence of VGAM2106 RNA, herein designated VGAM RNA, also designated SEQ ID:4817.

Another function of VGAM2106 is therefore inhibition of LOC147514 (Accession XM_041564). Accordingly, utilities of VGAM2106 include diagnosis, prevention and treatment of diseases and clinical conditions associated with LOC147514. LOC90625 (Accession XM_033004) is another VGAM2106 host target gene. LOC90625 BINDING SITE is HOST TARGET binding site found in the 5' untranslated region of mRNA encoded by LOC90625, corresponding to a HOST TARGET binding site such as BINDING SITE I, BINDING SITE II or BINDING SITE III. Table 2 illustrates the complementarity of the nucleotide sequences of LOC90625 BINDING SITE, designated SEQ ID:31818, to the nucleotide sequence of VGAM2106 RNA, herein designated VGAM RNA, also designated SEQ ID:4817.

Another function of VGAM2106 is therefore inhibition of LOC90625 (Accession XM_033004). Accordingly, utilities of VGAM2106 include diagnosis, prevention and treatment of diseases and clinical conditions associated with LOC90625. FIG. 1 further provides a conceptual description of a novel bioinformatically detected viral gene of the present invention, referred to here as Viral Genomic Address Messenger 2107 (VGAM2107) viral gene, which modulates expression of respective host target genes thereof, the function and utility of which host target genes is known in the art.

VGAM2107 is a novel bioinformatically detected regulatory, non protein coding, viral micro RNA (miRNA) gene. The method by which VGAM2107 was detected is described hereinabove with reference to FIGS. 1-8.

VGAM2107 gene, herein designated VGAM GENE, is a viral gene contained in the genome of Grapevine Chrome Mosaic Virus. VGAM2107 host target gene, herein designated VGAM HOST TARGET GENE, is a human gene contained in the human genome.

VGAM2107 gene encodes a VGAM2107 precursor RNA, herein designated VGAM PRECURSOR RNA. Similar to other miRNA genes, and unlike most ordinary genes, VGAM2107 precursor RNA does not encode a protein. A nucleotide sequence identical or highly similar to the nucleotide sequence of VGAM2107 precursor RNA is designated SEQ ID:2093, and is provided hereinbelow with reference to the sequence listing part. Nucleotide sequence SEQ ID:2093 is located at position 2929 relative to the genome of Grapevine Chrome Mosaic Virus.

VGAM2107 precursor RNA folds onto itself, forming VGAM2107 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2107 folded precursor RNA into VGAM2107 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2107 RNA is designated SEQ ID:4818, and is provided hereinbelow with reference to the sequence listing part.

VGAM2107 host target gene, herein designated VGAM HOST TARGET GENE, encodes a corresponding messenger RNA, VGAM2107 host target RNA, herein designated VGAM HOST TARGET RNA. VGAM2107 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2107 RNA, herein designated VGAM RNA, binds complementarily to one or more host target binding sites located in untranslated regions of VGAM2107 host target RNA, herein designated VGAM HOST TARGET RNA. This complementary binding is due to the fact that the nucleotide sequence of VGAM2107 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2107 RNA, herein designated VGAM RNA, may have a different number of host target binding sites in untranslated regions of a VGAM2107 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2107 RNA, herein designated VGAM RNA, to host target binding sites on VGAM2107 host target RNA, herein designated VGAM HOST TARGET RNA, such as BINDING SITE I, BINDING SITE II and BINDING SITE III, inhibits translation of VGAM2107 host target RNA into VGAM2107 host target protein, herein designated VGAM HOST TARGET PROTEIN. VGAM host target protein is therefore outlined by a broken line.

It is appreciated that VGAM2107 host target gene, herein designated VGAM HOST TARGET GENE, in fact represents a plurality of VGAM2107 host target genes. The mRNA of each one of this plurality of VGAM2107 host target genes comprises one or more host target binding sites, each having a nucleotide sequence which is at least partly complementary to VGAM2107 RNA, herein designated VGAM RNA, and which when bound by VGAM2107 RNA causes inhibition of translation of respective one or more VGAM2107 host target proteins.

It is further appreciated by one skilled in the art that the mode of translational inhibition illustrated by FIG. 1 with specific reference to translational inhibition exerted by VGAM2107 gene, herein designated VGAM GENE, on one or more VGAM2107 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2107 is inhibition of expression of host target genes, as part of a novel viral mechanism of attacking a host. Accordingly, utilities of VGAM2107 include diagnosis, prevention and treatment of viral infection by Grapevine Chrome Mosaic Virus. Specific functions, and accordingly utilities, of VGAM2107 correlate with, and may be deduced from, the identity of the host target genes which VGAM2107 binds and inhibits, and the function of these host target genes, as elaborated hereinbelow.

Nucleotide sequences of the VGAM2107 precursor RNA, herein designated VGAM PRECURSOR RNA, and of the 'diced' VGAM2107 RNA, herein designated VGAM RNA, and a schematic representation of the secondary folding of VGAM2107 folded precursor RNA, herein designated VGAM FOLDED PRECURSOR RNA, of VGAM2107 are further described hereinbelow with reference to Table 1.

Nucleotide sequences of host target binding sites, such as BINDING SITE-I, BINDING SITE-II and BINDING SITE-III of FIG. 1, found on VGAM2107 host target RNA, and schematic representation of the complementarity of each of these host target binding sites to VGAM2107 RNA, herein designated VGAM RNA, are described hereinbelow with reference to Table 2.

As mentioned hereinabove with reference to FIG. 1, a function of VGAM2107 gene, herein designated VGAM is inhibition of expression of VGAM2107 target genes. It is appreciated that specific functions, and accordingly utilities, of VGAM2107 correlate with, and may be deduced from, the identity of the target genes which VGAM2107 binds and inhibits, and the function of these target genes, as elaborated hereinbelow.

ATPase, Class VI, Type 11B (ATP11B, Accession XM_087254) is a VGAM2107 host target gene. ATP11B BINDING SITE is HOST TARGET binding site found in the 3' untranslated region of mRNA encoded by ATP11B, corresponding to a HOST TARGET binding site such as BINDING SITE I, BINDING SITE II or BINDING SITE III. Table 2 illustrates the complementarity of the nucleotide sequences of ATP11B BINDING SITE, designated SEQ ID:39146, to the nucleotide sequence of VGAM2107 RNA, herein designated VGAM RNA, also designated SEQ ID:4818.

A function of VGAM2107 is therefore inhibition of ATPase, Class VI, Type 11B (ATP11B, Accession XM_087254), a gene which is phosphorylated in their intermediate state, drives uphill transport of ions across membranes. Accordingly, utilities of VGAM2107 include diagnosis, prevention and treatment of diseases and clinical conditions associated with ATP11B. The function of ATP11B and its association with various diseases and clinical conditions, has been established by previous studies, as described hereinabove with reference to VGAM665. Zinc Finger Protein 76 (expressed in testis) (ZNF76, Accession NM_003427) is another VGAM2107 host target gene. ZNF76 BINDING SITE is HOST TARGET binding site found in the 5' untranslated region of mRNA encoded by ZNF76, corresponding to a HOST TARGET binding site such as BINDING SITE I, BINDING SITE II or BINDING SITE III. Table 2 illustrates the complementarity of the nucleotide sequences of ZNF76 BINDING SITE, designated SEQ ID:9477, to the nucleotide sequence of VGAM2107 RNA, herein designated VGAM RNA, also designated SEQ ID:4818.

Another function of VGAM2107 is therefore inhibition of Zinc Finger Protein 76 (expressed in testis) (ZNF76, Accession NM_003427). Accordingly, utilities of VGAM2107 include diagnosis, prevention and treatment of diseases and clinical conditions associated with ZNF76. Zinc Finger Protein 83 (HPF1) (ZNF83, Accession NM_018300) is another VGAM2107 host target gene. ZNF83 BINDING SITE is HOST TARGET binding site found in the 5' untranslated region of mRNA encoded by ZNF83, corresponding to a HOST TARGET binding site such as BINDING SITE I, BINDING SITE II or BINDING SITE III. Table 2 illustrates the complementarity of the nucleotide sequences of ZNF83 BINDING SITE, designated SEQ ID:20292, to the nucleotide sequence of VGAM2107 RNA, herein designated VGAM RNA, also designated SEQ ID:4818.

Another function of VGAM2107 is therefore inhibition of Zinc Finger Protein 83 (HPF1) (ZNF83, Accession NM_018300). Accordingly, utilities of VGAM2107 include diagnosis, prevention and treatment of diseases and clinical conditions associated with ZNF83. FLJ11608 (Accession NM_024557) is another VGAM2107 host target gene. FLJ11608 BINDING SITE is HOST TARGET binding site found in the 3' untranslated region of mRNA encoded by FLJ11608, corresponding to a HOST TARGET binding site such as BINDING SITE I, BINDING SITE II or BINDING SITE III. Table 2 illustrates the complementarity of the nucleotide sequences of FLJ11608 BINDING SITE, designated SEQ ID:23778, to the nucleotide sequence of VGAM2107 RNA, herein designated VGAM RNA, also designated SEQ ID:4818.

Another function of VGAM2107 is therefore inhibition of FLJ11608 (Accession NM_024557). Accordingly, utilities of VGAM2107 include diagnosis, prevention and treatment of diseases and clinical conditions associated with FLJ11608. HEMK (Accession NM_016173) is another VGAM2107 host target gene. HEMK BINDING SITE is HOST TARGET binding site found in the 3' untranslated region of mRNA encoded by HEMK, corresponding to a HOST TARGET binding site such as BINDING SITE I, BINDING SITE II or BINDING SITE III. Table 2 illustrates the complementarity of the nucleotide sequences of HEMK BINDING SITE, designated SEQ ID:18270, to the nucleotide sequence of VGAM2107 RNA, herein designated VGAM RNA, also designated SEQ ID:4818.

Another function of VGAM2107 is therefore inhibition of HEMK (Accession NM_016173). Accordingly, utilities of VGAM2107 include diagnosis, prevention and treatment of diseases and clinical conditions associated with HEMK. KIAA0798 (Accession NM_014650) is another VGAM2107 host target gene. KIAA0798 BINDING SITE is HOST TARGET binding site found in the 3" untranslated region of mRNA encoded by KIAA0798, corresponding to a HOST TARGET binding site such as BINDING SITE I, BINDING SITE II or BINDING SITE III. Table 2 illustrates the complementarity of the nucleotide sequences of KIAA0798 BINDING SITE, designated SEQ ID:16069, to the nucleotide sequence of VGAM2107 RNA, herein designated VGAM RNA, also designated SEQ ID:4818.

Another function of VGAM2107 is therefore inhibition of KIAA0798 (Accession NM_014650). Accordingly, utilities of VGAM2107 include diagnosis, prevention and treatment of diseases and clinical conditions associated with KIAA0798. KIAA1373 (Accession XM_048195) is another VGAM2107 host target gene. KIAA1373 BINDING SITE is HOST TARGET binding site found in the 3' untranslated region of mRNA encoded by KIAA1373, corresponding to a HOST TARGET binding site such as BINDING SITE I, BINDING SITE II or BINDING SITE III. Table 2 illustrates the complementarity of the nucleotide sequences of KIAA1373 BINDING SITE, designated SEQ ID:35125, to the nucleotide sequence of VGAM2107 RNA, herein designated VGAM RNA, also designated SEQ ID:4818.

Another function of VGAM2107 is therefore inhibition of KIAA1373 (Accession XM_048195). Accordingly, utilities of VGAM2107 include diagnosis, prevention and treatment of diseases and clinical conditions associated with KIAA1373. MDS024 (Accession NM_021820) is another VGAM2107 host target gene. MDS024 BINDING SITE is HOST TARGET binding site found in the 3' untranslated region of mRNA encoded by MDS024, corresponding to a HOST TARGET binding site such as BINDING SITE I, BINDING SITE II or BINDING SITE III. Table 2 illustrates the complementarity of the nucleotide sequences of MDS024 BINDING SITE, designated SEQ ID:22398, to the nucleotide sequence of VGAM2107 RNA, herein designated VGAM RNA, also designated SEQ ID:4818.

Another function of VGAM2107 is therefore inhibition of MDS024 (Accession NM_021820). Accordingly, utilities of VGAM2107 include diagnosis, prevention and treatment of diseases and clinical conditions associated with MDS024. LOC147976 (Accession XM_085980) is another VGAM2107 host target gene. LOC147976 BINDING SITE is HOST TARGET binding site found in the 3' untranslated region of mRNA encoded by LOC147976, corresponding to a HOST TARGET binding site such as BINDING SITE I, BINDING SITE II or BINDING SITE III. Table 2 illustrates the complementarity of the nucleotide sequences of LOC147976 BINDING SITE, designated SEQ ID:38425, to the nucleotide sequence of VGAM2107 RNA, herein designated VGAM RNA, also designated SEQ ID:4818.

Another function of VGAM2107 is therefore inhibition of LOC147976 (Accession XM_085980). Accordingly, utilities of VGAM2107 include diagnosis, prevention and treatment of diseases and clinical conditions associated with LOC147976. LOC254170 (Accession XM_170746) is another VGAM2107 host target gene. LOC254170 BINDING SITE is HOST TARGET binding site found in the 3' untranslated region of mRNA encoded by LOC254170, corresponding to a HOST TARGET binding site such as BINDING SITE I, BINDING SITE II or BINDING SITE III. Table 2 illustrates the complementarity of the nucleotide sequences of LOC254170 BINDING SITE, designated SEQ ID:45503, to the nucleotide sequence of VGAM2107 RNA, herein designated VGAM RNA, also designated SEQ ID:4818.

Another function of VGAM2107 is therefore inhibition of LOC254170 (Accession XM_170746). Accordingly, utilities of VGAM2107 include diagnosis, prevention and treatment of diseases and clinical conditions associated with LOC254170. FIG. 1 further provides a conceptual description of a novel bioinformatically detected viral gene of the present invention, referred to here as Viral Genomic Address Messenger 2108 (VGAM2108) viral gene, which modulates expression of respective host target genes thereof, the function and utility of which host target genes is known in the art.

VGAM2108 is a novel bioinformatically detected regulatory, non protein coding, viral micro RNA (miRNA) gene. The method by which VGAM2108 was detected is described hereinabove with reference to FIGS. 1-8.

VGAM2108 gene, herein designated VGAM GENE, is a viral gene contained in the genome of Grapevine Chrome Mosaic Virus. VGAM2108 host target gene, herein designated VGAM HOST TARGET GENE, is a human gene contained in the human genome.

VGAM2108 gene encodes a VGAM2108 precursor RNA, herein designated VGAM PRECURSOR RNA. Similar to other miRNA genes, and unlike most ordinary genes, VGAM2108 precursor RNA does not encode a protein. A nucleotide sequence identical or highly similar to the nucleotide sequence of VGAM2108 precursor RNA is designated SEQ ID:2094, and is provided hereinbelow with reference to the sequence listing part. Nucleotide sequence SEQ ID:2094 is located at position 3193 relative to the genome of Grapevine Chrome Mosaic Virus.

VGAM2108 precursor RNA folds onto itself, forming VGAM2108 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2108 folded precursor RNA into VGAM2108 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM2108 RNA is designated SEQ ID:4819, and is provided hereinbelow with reference to the sequence listing part.

VGAM2108 host target gene, herein designated VGAM HOST TARGET GENE, encodes a corresponding messenger RNA, VGAM2108 host target RNA, herein designated VGAM HOST TARGET RNA. VGAM2108 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2108 RNA, herein designated VGAM RNA, binds complementarily to one or more host target binding sites located in untranslated regions of VGAM2108 host target RNA, herein designated VGAM HOST TARGET RNA. This complementary binding is due to the fact that the nucleotide sequence of VGAM2108 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2108 RNA, herein designated VGAM RNA, may have a different number of host target binding sites in untranslated regions of a VGAM2108 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2108 RNA, herein designated VGAM RNA, to host target binding sites on VGAM2108 host target RNA, herein designated VGAM HOST TARGET RNA, such as BINDING SITE I, BINDING SITE II and BINDING SITE III, inhibits translation of VGAM2108 host target RNA into VGAM2108 host target protein, herein designated VGAM HOST TARGET PROTEIN. VGAM host target protein is therefore outlined by a broken line.

It is appreciated that VGAM2108 host target gene, herein designated VGAM HOST TARGET GENE, in fact represents a plurality of VGAM2108 host target genes. The mRNA of each one of this plurality of VGAM2108 host target genes comprises one or more host target binding sites, each having a nucleotide sequence which is at least partly complementary to VGAM2108 RNA, herein designated VGAM RNA, and which when bound by VGAM2108 RNA causes inhibition of translation of respective one or more VGAM2108 host target proteins.

It is further appreciated by one skilled in the art that the mode of translational inhibition illustrated by FIG. 1 with specific reference to translational inhibition exerted by VGAM2108 gene, herein designated VGAM GENE, on one or more VGAM2108 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2108 is inhibition of expression of host target genes, as part of a novel viral mechanism of attacking a host. Accordingly, utilities of VGAM2108 include diagnosis, prevention and treatment of viral infection by Grapevine Chrome Mosaic Virus. Specific functions, and accordingly utilities, of VGAM2108 correlate with, and may be deduced from, the identity of the host target genes which VGAM2108 binds and inhibits, and the function of these host target genes, as elaborated hereinbelow.

Nucleotide sequences of the VGAM2108 precursor RNA, herein designated VGAM PRECURSOR RNA, and of the 'diced' VGAM2108 RNA, herein designated VGAM RNA, and a schematic representation of the secondary folding of VGAM2108 folded precursor RNA, herein designated VGAM FOLDED PRECURSOR RNA, of VGAM2108 are further described hereinbelow with reference to Table 1.

Nucleotide sequences of host target binding sites, such as BINDING SITE-I, BINDING SITE-II and BINDING SITE-III of FIG. 1, found on VGAM2108 host target RNA, and schematic representation of the complementarity of each of these host target binding sites to VGAM2108 RNA, herein designated VGAM RNA, are described hereinbelow with reference to Table 2.

As mentioned hereinabove with reference to FIG. 1, a function of VGAM2108 gene, herein designated VGAM is inhibition of expression of VGAM2108 target genes. It is appreciated that specific functions, and accordingly utilities, of VGAM2108 correlate with, and may be deduced from, the identity of the target genes which VGAM2108 binds and inhibits, and the function of these target genes, as elaborated hereinbelow.

X-prolyl Aminopeptidase (aminopeptidase P) 2, Membrane-bound (XPNPEP2, Accession NM_003399) is a VGAM2108 host target gene. XPNPEP2 BINDING SITE is HOST TARGET binding site found in the 3' untranslated region of mRNA encoded by XPNPEP2, corresponding to a HOST TARGET binding site such as BINDING SITE I, BINDING SITE II or BINDING SITE III. Table 2 illustrates the complementarity of the nucleotide sequences of XPNPEP2 BINDING SITE, designated SEQ ID:9434, to the nucleotide sequence of VGAM2108 RNA, herein designated VGAM RNA, also designated SEQ ID:4819.

A function of VGAM2108 is therefore inhibition of X-prolyl Aminopeptidase (aminopeptidase P) 2, Membrane-bound (XPNPEP2, Accession NM_003399), a gene which is a membrane-associated X-prolyl metallopeptidase. Accordingly, utilities of VGAM2108 include diagnosis, prevention and treatment of diseases and clinical conditions associated with XPNPEP2. The function of XPNPEP2 has been established by previous studies. Aminopeptidase P is a widely distributed hydrolase that is specific for N-terminal imido bonds, which are common to several collagen degradation products, neuropeptides, vasoactive peptides, and cytokines. Structurally, the enzyme is a member of the 'pita bread fold' family and occurs in mammalian tissues in both soluble and GPI-anchored membrane-bound forms. By RT-PCR using degenerate oligonucleotides based on the pig aminopeptidase P amino acid sequence, and by 5-prime and 3-prime RACE, Venema et al. (1997) isolated human kidney and lung cDNAs encoding XPNPEP2. The deduced XPNPEP2 protein has 673 amino acids and an estimated molecular mass of 75,490 Da. The authors stated that the human and pig XPNPEP2 amino acid sequences show significant evolutionary divergence, with 83% identity; 5 of 6 potential N-glycosylation sites, and 5 of 6 cysteine residues that are potentially involved in disulfide bond formation, are conserved. Northern blot analysis detected a 3.5-kb XPNPEP2 transcript in human kidney, lung, heart, placenta, liver, small intestine, and colon, but not in brain, skeletal muscle, pancreas, spleen, thymus, prostate, testis, ovary, or leukocytes. Based on these results and on RT-PCR studies, Venema et al. (1997) suggested that the membrane-bound form and the soluble form, which is found in brain and leukocytes, are the products of 2 different genes or of alternative splicing of a single primary transcript. Women with balanced translocations between the long arm of the X chromosome and an autosome frequently suffer premature ovarian failure (POF; 311360). Two critical regions for POF which extend from Xq13 to Xq22 and from Xq22 to Xq26 have been identified by cytogenetic studies. To gain insight into the mechanism (s) responsible for ovarian failure in women with X/autosome translocations, Prueitt et al. (2000) molecularly characterized the translocation breakpoints of 9 X chromosomes. They mapped the breakpoints using somatic cell hybrids retaining the derivative autosome and densely spaced markers from the X-chromosome physical map. One of the POF-associated breakpoints in a critical region (Xq25) mapped to a sequenced PAC clone. The translocation disrupts XPNPEP2. XPNPEP2 mRNA was detected in fibroblasts that carried the translocation, suggesting that this gene at least partially escapes X inactivation. Although the physiologic substrates for the enzyme were not known, Prueitt et al. (2000) suggested that XPNPEP2 is a candidate gene for POF.

Full details of the abovementioned studies are described in the following publications, the disclosure of which are hereby incorporated by reference:

Venema, R. C.; Ju, H.; Zou, R.; Venema, V. J.; Ryan, J. W.: Cloning and tissue distribution of human membrane-bound aminopeptidase P. Biochim. Biophys. Acta 1354:45-48, 1997; and Prueitt, R. L.; Ross, J. L.; Zinn, A. R.: Physical mapping of nine Xq translocation breakpoints and identification of XPNPEP2 as a premature ovarian failure candidate gene. Cytogenet.

Further studies establishing the function and utilities of XPNPEP2 are found in John Hopkins OMIM database record ID 300145, and in sited publications numbered 958-960 listed in the bibliography section hereinbelow, which are also hereby incorporated by reference. KIAA0429 (Accession NM_014751) is another VGAM2108 host target gene. KIAA0429 BINDING SITE is HOST TARGET binding site found in the 5' untranslated region of mRNA encoded by KIAA0429, corresponding to a HOST TARGET binding site such as BINDING SITE I, BINDING SITE II or BINDING SITE III. Table 2 illustrates the complementarity of the nucleotide sequences of KIAA0429 BINDING SITE, designated SEQ ID:16463, to the nucleotide sequence of VGAM2108 RNA, herein designated VGAM RNA, also designated SEQ ID:4819.

Another function of VGAM2108 is therefore inhibition of KIAA0429 (Accession NM_014751). Accordingly, utilities of VGAM2108 include diagnosis, prevention and treatment of diseases and clinical conditions associated with KIAA0429. KIAA1553 (Accession XM_166320) is another VGAM2108 host target gene. KIAA1553 BINDING SITE is HOST TARGET binding site found in the 3' untranslated region of mRNA encoded by KIAA1553, corresponding to a HOST TARGET binding site such as BINDING SITE I, BINDING SITE II or BINDING SITE III. Table 2 illustrates the complementarity of the nucleotide sequences of KIAA1553 BINDING SITE, designated SEQ ID:44145, to the nucleotide sequence of VGAM2108 RNA, herein designated VGAM RNA, also designated SEQ ID:4819.

Another function of VGAM2108 is therefore inhibition of KIAA1553 (Accession XM_166320). Accordingly, utilities of VGAM2108 include diagnosis, prevention and treatment of diseases and clinical conditions associated with KIAA1553. Syndecan 3 (N-syndecan) (SDC3, Accession NM_014654) is another VGAM2108 host target gene. SDC3 BINDING SITE is HOST TARGET binding site found in the 3' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16085, to the nucleotide sequence of VGAM2108 RNA, herein designated VGAM RNA, also designated SEQ ID:4819.

Another function of VGAM2108 is therefore inhibition of Syndecan 3 (N-syndecan) (SDC3, Accession NM_014654). Accordingly, utilities of VGAM2108 include diagnosis, prevention and treatment of diseases and clinical conditions associated with SDC3. Zinc Finger Protein 33a (KOX 31) (ZNF33A, Accession XM_166119) is another VGAM2108 host target gene. ZNF33A BINDING SITE is HOST TARGET binding site found in the 3" untranslated region of mRNA encoded by ZNF33A, corresponding to a HOST TARGET binding site such as BINDING SITE I, BINDING SITE II or BINDING SITE III. Table 2 illustrates the complementarity of the nucleotide sequences of ZNF33A BINDING SITE, designated SEQ ID:43898, to the nucleotide sequence of VGAM2108 RNA, herein designated VGAM RNA, also designated SEQ ID:4819.

Another function of VGAM2108 is therefore inhibition of Zinc Finger Protein 33a (KOX 31) (ZNF33A, Accession XM_166119). Accordingly, utilities of VGAM2108 include diagnosis, prevention and treatment of diseases and clinical conditions associated with ZNF33A. LOC149401 (Accession XM_086511) is another VGAM2108 host target gene. LOC149401 BINDING SITE is HOST TARGET binding site found in the 5' untranslated region of mRNA encoded by LOC149401, corresponding to a HOST TARGET binding site such as BINDING SITE I, BINDING SITE II or BINDING SITE III. Table 2 illustrates the complementarity of the nucleotide sequences of LOC149401 BINDING SITE, designated SEQ ID:38734, to the nucleotide sequence of VGAM2108 RNA, herein designated VGAM RNA, also designated SEQ ID:4819.

Another function of VGAM2108 is therefore inhibition of LOC149401 (Accession XM_086511). Accordingly, utilities of VGAM2108 include diagnosis, prevention and treatment of diseases and clinical conditions associated with LOC149401. LOC150622 (Accession XM_086960) is another VGAM2108 host target gene. LOC150622 BINDING SITE is HOST TARGET binding site found in the 5' untranslated region of mRNA encoded by LOC150622, corresponding to a HOST TARGET binding site such as BINDING SITE I, BINDING SITE II or BINDING SITE III. Table 2 illustrates the complementarity of the nucleotide sequences of LOC150622 BINDING SITE, designated SEQ ID:38995, to the nucleotide sequence of VGAM2108 RNA, herein designated VGAM RNA, also designated SEQ ID:4819.

Another function of VGAM2108 is therefore inhibition of LOC150622 (Accession XM_086960). Accordingly, utilities of VGAM2108 include diagnosis, prevention and treatment of diseases and clinical conditions associated with LOC150622. LOC219621 (Accession XM_166148) is another VGAM2108 host target gene. LOC219621 BINDING SITE is HOST TARGET binding site found in the 3' untranslated region of mRNA encoded by LOC219621, corresponding to a HOST TARGET binding site such as BINDING SITE I, BINDING SITE II or BINDING SITE III. Table 2 illustrates the complementarity of the nucleotide sequences of LOC219621 BINDING SITE, designated SEQ ID:43968, to the nucleotide sequence of VGAM2108 RNA, herein designated VGAM RNA, also designated SEQ ID:4819.

Another function of VGAM2108 is therefore inhibition of LOC219621 (Accession XM_166148). Accordingly, utilities of VGAM2108 include diagnosis, prevention and treatment of diseases and clinical conditions associated with LOC219621. LOC221477 (Accession XM_166397) is another VGAM2108 host target gene. LOC221477 BINDING SITE is HOST TARGET binding site found in the 3' untranslated region of mRNA encoded by LOC221477, corresponding to a HOST TARGET binding site such as BINDING SITE I, BINDING SITE II or BINDING SITE III. Table 2 illustrates the complementarity of the nucleotide sequences of LOC221477 BINDING SITE, designated SEQ ID:44255, to the nucleotide sequence of VGAM2108 RNA, herein designated VGAM RNA, also designated SEQ ID:4819.

Another function of VGAM2108 is therefore inhibition of LOC221477 (Accession XM_166397). Accordingly, utilities of VGAM2108 include diagnosis, prevention and treatment of diseases and clinical conditions associated with LOC221477. LOC255995 (Accession XM_173071) is another VGAM2108 host target gene. LOC255995 BINDING SITE is HOST TARGET binding site found in the 5' untranslated region of mRNA encoded by LOC255995, corresponding to a HOST TARGET binding site such as BINDING SITE I, BINDING SITE II or BINDING SITE III. Table 2 illustrates the complementarity of the nucleotide sequences of LOC255995 BINDING SITE, designated SEQ ID:46325, to the nucleotide sequence of VGAM2108 RNA, herein designated VGAM RNA, also designated SEQ ID:4819.

Another function of VGAM2108 is therefore inhibition of LOC255995 (Accession XM_173071). Accordingly, utilities of VGAM2108 include diagnosis, prevention and treatment of diseases and clinical conditions associated with LOC255995. FIG. 1 further provides a conceptual description of a novel bioinformatically detected viral gene of the present invention, referred to here as Viral Genomic Address Messenger 2109 (VGAM2109) viral gene, which modulates expression of respective host target genes thereof, the function and utility of which host target genes is known in the art.

VGAM2109 is a novel bioinformatically detected regulatory, non protein coding, viral micro RNA (miRNA) gene. The method by which VGAM2109 was detected is described hereinabove with reference to FIGS. 1-8.

VGAM2109 gene, herein designated VGAM GENE, is a viral gene contained in the genome of Goatpox Virus. VGAM2109 host target gene, herein designated VGAM HOST TARGET GENE, is a human gene contained in the human genome.

VGAM2109 gene encodes a VGAM2109 precursor RNA, herein designated VGAM PRECURSOR RNA. Similar to other miRNA genes, and unlike most ordinary genes, VGAM2109 precursor RNA does not encode a protein. A nucleotide sequence identical or highly similar to the nucleotide sequence of VGAM2109 precursor RNA is designated SEQ ID:2095, and is provided hereinbelow with reference to the sequence listing part. Nucleotide sequence SEQ ID:2095 is located at position 22662 relative to the genome of Goatpox Virus.

VGAM2109 precursor RNA folds onto itself, forming VGAM2109 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2109 folded precursor RNA into VGAM2109 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM2109 RNA is designated SEQ ID:4820, and is provided hereinbelow with reference to the sequence listing part.

VGAM2109 host target gene, herein designated VGAM HOST TARGET GENE, encodes a corresponding messenger RNA, VGAM2109 host target RNA, herein designated VGAM HOST TARGET RNA. VGAM2109 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2109 RNA, herein designated VGAM RNA, binds complementarily to one or more host target binding sites located in untranslated regions of VGAM2109 host target RNA, herein designated VGAM HOST TARGET RNA. This complementary binding is due to the fact that the nucleotide sequence of VGAM2109 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2109 RNA, herein designated VGAM RNA, may have a different number of host target binding sites in untranslated regions of a VGAM2109 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2109 RNA, herein designated VGAM RNA, to host target binding sites on VGAM2109 host target RNA, herein designated VGAM HOST TARGET RNA, such as BINDING SITE I, BINDING SITE II and BINDING SITE III, inhibits translation of VGAM2109 host target RNA into VGAM2109 host target protein, herein designated VGAM HOST TARGET PROTEIN. VGAM host target protein is therefore outlined by a broken line.

It is appreciated that VGAM2109 host target gene, herein designated VGAM HOST TARGET GENE, in fact represents a plurality of VGAM2109 host target genes. The mRNA of each one of this plurality of VGAM2109 host target genes comprises one or more host target binding sites, each having a nucleotide sequence which is at least partly complementary to VGAM2109 RNA, herein designated VGAM RNA, and which when bound by VGAM2109 RNA causes inhibition of translation of respective one or more VGAM2109 host target proteins.

It is further appreciated by one skilled in the art that the mode of translational inhibition illustrated by FIG. 1 with specific reference to translational inhibition exerted by VGAM2109 gene, herein designated VGAM GENE, on one or more VGAM2109 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2109 is inhibition of expression of host target genes, as part of a novel viral mechanism of attacking a host. Accordingly, utilities of VGAM2109 include diagnosis, prevention and treatment of viral infection by Goatpox Virus. Specific functions, and accordingly utilities, of VGAM2109 correlate with, and may be deduced from, the identity of the host target genes which VGAM2109 binds and inhibits, and the function of these host target genes, as elaborated hereinbelow.

Nucleotide sequences of the VGAM2109 precursor RNA, herein designated VGAM PRECURSOR RNA, and of the 'diced' VGAM2109 RNA, herein designated VGAM RNA, and a schematic representation of the secondary folding of VGAM2109 folded precursor RNA, herein designated VGAM FOLDED PRECURSOR RNA, of VGAM2109 are further described hereinbelow with reference to Table 1.

Nucleotide sequences of host target binding sites, such as BINDING SITE-I, BINDING SITE-II and BINDING SITE-III of FIG. 1, found on VGAM2109 host target RNA, and schematic representation of the complementarity of each of these host target binding sites to VGAM2109 RNA, herein designated VGAM RNA, are described hereinbelow with reference to Table 2.

As mentioned hereinabove with reference to FIG. 1, a function of VGAM2109 gene, herein designated VGAM is inhibition of expression of VGAM2109 target genes. It is appreciated that specific functions, and accordingly utilities, of VGAM2109 correlate with, and may be deduced from, the identity of the target genes which VGAM2109 binds and inhibits, and the function of these target genes, as elaborated hereinbelow.

LOC91408 (Accession XM_038290) is a VGAM2109 host target gene. LOC91408 BINDING SITE is HOST TARGET binding site found in the 3' untranslated region of mRNA encoded by LOC91408, corresponding to a HOST TARGET binding site such as BINDING SITE I, BINDING SITE II or BINDING SITE III. Table 2 illustrates the complementarity of the nucleotide sequences of LOC91408 BINDING SITE, designated SEQ ID:32790, to the nucleotide sequence of VGAM2109 RNA, herein designated VGAM RNA, also designated SEQ ID:4820.

A function of VGAM2109 is therefore inhibition of LOC91408 (Accession XM_038290). Accordingly, utilities of VGAM2109 include diagnosis, prevention and treatment of diseases and clinical conditions associated with LOC91408. FIG. 1 further provides a conceptual description of a novel bioinformatically detected viral gene of the present invention, referred to here as Viral Genomic Address Messenger 2110 (VGAM2110) viral gene, which modulates expression of respective host target genes thereof, the function and utility of which host target genes is known in the art.

VGAM2110 is a novel bioinformatically detected regulatory, non protein coding, viral micro RNA (miRNA) gene. The method by which VGAM2110 was detected is described hereinabove with reference to FIGS. 1-8.

VGAM2110 gene, herein designated VGAM GENE, is a viral gene contained in the genome of Grapevine Chrome Mosaic Virus. VGAM2110 host target gene, herein designated VGAM HOST TARGET GENE, is a human gene contained in the human genome.

VGAM2110 gene encodes a VGAM2110 precursor RNA, herein designated VGAM PRECURSOR RNA. Similar to other miRNA genes, and unlike most ordinary genes, VGAM2110 precursor RNA does not encode a protein. A nucleotide sequence identical or highly similar to the nucleotide sequence of VGAM2110 precursor RNA is designated SEQ ID:2096, and is provided hereinbelow with reference to the sequence listing part. Nucleotide sequence SEQ ID:2096 is located at position 1090 relative to the genome of Grapevine Chrome Mosaic Virus.

VGAM2110 precursor RNA folds onto itself, forming VGAM2110 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2110 folded precursor RNA into VGAM2110 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2110 RNA is designated SEQ ID:4821, and is provided hereinbelow with reference to the sequence listing part.

VGAM2110 host target gene, herein designated VGAM HOST TARGET GENE, encodes a corresponding messenger RNA, VGAM2110 host target RNA, herein designated VGAM HOST TARGET RNA. VGAM2110 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2110 RNA, herein designated VGAM RNA, binds complementarily to one or more host target binding sites located in untranslated regions of VGAM2110 host target RNA, herein designated VGAM HOST TARGET RNA. This complementary binding is due to the fact that the nucleotide sequence of VGAM2110 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2110 RNA, herein designated VGAM RNA, may have a different number of host target binding sites in untranslated regions of a VGAM2110 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2110 RNA, herein designated VGAM RNA, to host target binding sites on VGAM2110 host target RNA, herein designated VGAM HOST TARGET RNA, such as BINDING SITE I, BINDING SITE II and BINDING SITE III, inhibits translation of VGAM2110 host target RNA into VGAM2110 host target protein, herein designated VGAM HOST TARGET PROTEIN. VGAM host target protein is therefore outlined by a broken line.

It is appreciated that VGAM2110 host target gene, herein designated VGAM HOST TARGET GENE, in fact represents a plurality of VGAM2110 host target genes. The mRNA of each one of this plurality of VGAM2110 host target genes comprises one or more host target binding sites, each having a nucleotide sequence which is at least partly complementary to VGAM2110 RNA, herein designated VGAM RNA, and which when bound by VGAM2110 RNA causes inhibition of translation of respective one or more VGAM2110 host target proteins.

It is further appreciated by one skilled in the art that the mode of translational inhibition illustrated by FIG. 1 with specific reference to translational inhibition exerted by VGAM2110 gene, herein designated VGAM GENE, on one or more VGAM2110 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2110 is inhibition of expression of host target genes, as part of a novel viral mechanism of attacking a host. Accordingly, utilities of VGAM2110 include diagnosis, prevention and treatment of viral infection by Grapevine Chrome Mosaic Virus. Specific functions, and accordingly utilities, of VGAM2110 correlate with, and may be deduced from, the identity of the host target genes which VGAM2110 binds and inhibits, and the function of these host target genes, as elaborated hereinbelow.

Nucleotide sequences of the VGAM2110 precursor RNA, herein designated VGAM PRECURSOR RNA, and of the 'diced' VGAM2110 RNA, herein designated VGAM RNA, and a schematic representation of the secondary folding of VGAM2110 folded precursor RNA, herein designated VGAM FOLDED PRECURSOR RNA, of VGAM2110 are further described hereinbelow with reference to Table 1.

Nucleotide sequences of host target binding sites, such as BINDING SITE-I, BINDING SITE-II and BINDING SITE-III of FIG. 1, found on VGAM2110 host target RNA, and schematic representation of the complementarity of each of these host target binding sites to VGAM2110 RNA, herein designated VGAM RNA, are described hereinbelow with reference to Table 2.

As mentioned hereinabove with reference to FIG. 1, a function of VGAM2110 gene, herein designated VGAM is inhibition of expression of VGAM2110 target genes. It is appreciated that specific functions, and accordingly utilities, of VGAM2110 correlate with, and may be deduced from, the identity of the target genes which VGAM2110 binds and inhibits, and the function of these target genes, as elaborated hereinbelow.

Glypican 1 (GPC1, Accession NM_002081) is a VGAM2110 host target gene. GPC1 BINDING SITE is HOST TARGET binding site found in the 3' untranslated region of mRNA encoded by GPC1, corresponding to a HOST TARGET binding site such as BINDING SITE I, BINDING SITE II or BINDING SITE III. Table 2 illustrates the complementarity of the nucleotide sequences of GPC1 BINDING SITE, designated SEQ ID:7869, to the nucleotide sequence of VGAM2110 RNA, herein designated VGAM RNA, also designated SEQ ID:4821.

A function of VGAM2110 is therefore inhibition of Glypican 1 (GPC1, Accession NM_002081), a gene which may play a role in growth control and differentiation. Accordingly, utilities of VGAM2110 include diagnosis, prevention and treatment of diseases and clinical conditions associated with GPC1. The function of GPC1 and its association with various diseases and clinical conditions, has been established by previous studies, as described hereinabove with reference to VGAM125. G Protein-coupled Receptor 44 (GPR44, Accession NM_004778) is another VGAM2110 host target gene. GPR44 BINDING SITE is HOST TARGET binding site found in the 3' untranslated region of mRNA encoded by GPR44, corresponding to a HOST TARGET binding site such as BINDING SITE I, BINDING SITE II or BINDING SITE III. Table 2 illustrates the complementarity of the nucleotide sequences of GPR44 BINDING SITE, designated SEQ ID:11174, to the nucleotide sequence of VGAM2110 RNA, herein designated VGAM RNA, also designated SEQ ID:4821.

Another function of VGAM2110 is therefore inhibition of G Protein-coupled Receptor 44 (GPR44, Accession NM_004778), a gene which mediates signals to the interior of the cell via activation of heterotrimeric G proteins . Accordingly, utilities of VGAM2110 include diagnosis, prevention and treatment of diseases and clinical conditions associated with GPR44. The function of GPR44 and its association with various diseases and clinical conditions, has been established by previous studies, as described hereinabove with reference to VGAM1669. Islet Cell Autoantigen 1, 69 kDa (ICA1, Accession NM_022308) is another VGAM2110 host target gene. ICA1 BINDING SITE is HOST TARGET binding site found in the 3' untranslated region of mRNA encoded by ICA1, corresponding to a HOST TARGET binding site such as BINDING SITE I, BINDING SITE II or BINDING SITE III. Table 2 illustrates the complementarity of the nucleotide sequences of ICA1 BINDING SITE, designated SEQ ID:22737, to the nucleotide sequence of VGAM2110 RNA, herein designated VGAM RNA, also designated SEQ ID:4821.

Another function of VGAM2110 is therefore inhibition of Islet Cell Autoantigen 1, 69 kDa (ICA1, Accession NM_022308), a gene which Islet cell autoantigen 1. Accordingly, utilities of VGAM2110 include diagnosis, prevention and treatment of diseases and clinical conditions associated with ICA1. The function of ICA1 and its association with various diseases and clinical conditions, has been established by previous studies, as described hereinabove with reference to VGAM1958. LENG4 (Accession NM_024298) is another VGAM2110 host target gene. LENG4 BINDING SITE is HOST TARGET binding site found in the 3' untranslated region of mRNA encoded by LENG4, corresponding to a HOST TARGET binding site such as BINDING SITE I, BINDING SITE II or BINDING SITE III. Table 2 illustrates the complementarity of the nucleotide sequences of LENG4 BINDING SITE, designated SEQ ID:23583, to the nucleotide sequence of VGAM2110 RNA, herein designated VGAM RNA, also designated SEQ ID:4821.

Another function of VGAM2110 is therefore inhibition of LENG4 (Accession NM_024298), a gene which may be a transmembrane protein. Accordingly, utilities of VGAM2110 include diagnosis, prevention and treatment of diseases and clinical conditions associated with LENG4. The function of LENG4 and its association with various diseases and clinical conditions, has been established by previous studies, as described hereinabove with reference to VGAM259. PAIP2 (Accession NM_016480) is another VGAM2110 host target gene. PAIP2 BINDING SITE is HOST TARGET binding site found in the 3' untranslated region of mRNA encoded by PAIP2, corresponding to a HOST TARGET binding site such as BINDING SITE I, BINDING SITE II or BINDING SITE III. Table 2 illustrates the complementarity of the nucleotide sequences of PAIP2 BINDING SITE, designated SEQ ID:18579, to the nucleotide sequence of VGAM2110 RNA, herein designated VGAM RNA, also designated SEQ ID:4821.

Another function of VGAM2110 is therefore inhibition of PAIP2 (Accession NM_016480). Accordingly, utilities of VGAM2110 include diagnosis, prevention and treatment of diseases and clinical conditions associated with PAIP2. Secreted and Transmembrane 1 (SECTM1, Accession NM_003004) is another VGAM2110 host target gene. SECTM1 BINDING SITE is HOST TARGET binding site found in the 3' untranslated region of mRNA encoded by SECTM1, corresponding to a HOST TARGET binding site such as BINDING SITE I, BINDING SITE II or BINDING SITE III. Table 2 illustrates the complementarity of the nucleotide sequences of SECTM1 BINDING SITE, designated SEQ ID:8910, to the nucleotide sequence of VGAM2110 RNA, herein designated VGAM RNA, also designated SEQ ID:4821.

Another function of VGAM2110 is therefore inhibition of Secreted and Transmembrane 1 (SECTM1, Accession NM_003004). Accordingly, utilities of VGAM2110 include diagnosis, prevention and treatment of diseases and clinical conditions associated with SECTM1. Solute Carrier Family 30 (zinc transporter), Member 3 (SLC30A3, Accession NM_003459) is another VGAM2110 host target gene. SLC30A3 BINDING SITE is HOST TARGET binding site found in the 3' untranslated region of mRNA encoded by SLC30A3, corresponding to a HOST TARGET binding site such as BINDING SITE I, BINDING SITE II or BINDING SITE III. Table 2 illustrates the complementarity of the nucleotide sequences of SLC30A3 BINDING SITE, designated SEQ ID:9523, to the nucleotide sequence of VGAM2110 RNA, herein designated VGAM RNA, also designated SEQ ID:4821.

Another function of VGAM2110 is therefore inhibition of Solute Carrier Family 30 (zinc transporter), Member 3 (SLC30A3, Accession NM_003459). Accordingly, utilities of VGAM2110 include diagnosis, prevention and treatment of diseases and clinical conditions associated with SLC30A3. Solute Carrier Family 7 (cationic amino acid transporter, y+ system), Member 5 (SLC7A5, Accession NM_003486) is another VGAM2110 host target gene. SLC7A5 BINDING SITE is HOST TARGET binding site found in the 3' untranslated region of mRNA encoded by SLC7A5, corresponding to a HOST TARGET binding site such as BINDING SITE I, BINDING SITE II or BINDING SITE III. Table 2 illustrates the complementarity of the nucleotide sequences of SLC7A5 BINDING SITE, designated SEQ ID:9575, to the nucleotide sequence of VGAM2110 RNA, herein designated VGAM RNA, also designated SEQ ID:4821.

Another function of VGAM2110 is therefore inhibition of Solute Carrier Family 7 (cationic amino acid transporter, y+ system), Member 5 (SLC7A5, Accession NM_003486), a gene which mediates transport of large and small neutral amino acids. Accordingly, utilities of VGAM2110 include diagnosis, prevention and treatment of diseases and clinical conditions associated with SLC7A5. The function of SLC7A5 and its association with various diseases and clinical conditions, has been established by previous studies, as described hereinabove with reference to VGAM430. START Domain Containing 4, Sterol Regulated (STARD4, Accession NM_139164) is another VGAM2110 host target gene. STARD4 BINDING SITE is HOST TARGET binding site found in the 3' untranslated region of mRNA encoded by STARD4, corresponding to a HOST TARGET binding site such as BINDING SITE I, BINDING SITE II or BINDING SITE III. Table 2 illustrates the complementarity of the nucleotide sequences of STARD4 BINDING SITE, designated SEQ ID:29171, to the nucleotide sequence of VGAM2110 RNA, herein designated VGAM RNA, also designated SEQ ID:4821.

Another function of VGAM2110 is therefore inhibition of START Domain Containing 4, Sterol Regulated (STARD4, Accession NM_139164). Accordingly, utilities of VGAM2110 include diagnosis, prevention and treatment of diseases and clinical conditions associated with STARD4. Choline Kinase (CHK, Accession NM_001277) is another VGAM2110 host target gene. CHK BINDING SITE is HOST TARGET binding site found in the 3' untranslated region of mRNA encoded by CHK, corresponding to a HOST TARGET binding site such as BINDING SITE I, BINDING SITE II or BINDING SITE III. Table 2 illustrates the complementarity of the nucleotide sequences of CHK BINDING SITE, designated SEQ ID:6943, to the nucleotide sequence of VGAM2110 RNA, herein designated VGAM RNA, also designated SEQ ID:4821.

Another function of VGAM2110 is therefore inhibition of Choline Kinase (CHK, Accession NM_001277). Accordingly, utilities of VGAM2110 include diagnosis, prevention and treatment of diseases and clinical conditions associated with CHK. DKFZP434N1817 (Accession XM_042930) is another VGAM2110 host target gene. DKFZP434N1817 BINDING SITE is HOST TARGET binding site found in the 5' untranslated region of mRNA encoded by DKFZP434N1817, corresponding to a HOST TARGET binding site such as BINDING SITE I, BINDING SITE II or BINDING SITE III. Table 2 illustrates the complementarity of the nucleotide sequences of DKFZP434N1817 BINDING SITE, designated SEQ ID:33814, to the nucleotide sequence of VGAM2110 RNA, herein designated VGAM RNA, also designated SEQ ID:4821.

Another function of VGAM2110 is therefore inhibition of DKFZP434N1817 (Accession XM_042930). Accordingly, utilities of VGAM2110 include diagnosis, prevention and treatment of diseases and clinical conditions associated with DKFZP434N1817. H11 (Accession NM_014365) is another VGAM2110 host target gene. H11 BINDING SITE is HOST TARGET binding site found in the 3' untranslated region of mRNA encoded by H11, corresponding to a HOST TARGET binding site such as BINDING SITE I, BINDING SITE II or BINDING SITE III. Table 2 illustrates the complementarity of the nucleotide sequences of H11 BINDING SITE, designated SEQ ID:15692, to the nucleotide sequence of VGAM2110 RNA, herein designated VGAM RNA, also designated SEQ ID:4821.

Another function of VGAM2110 is therefore inhibition of H11 (Accession NM_014365). Accordingly, utilities of VGAM2110 include diagnosis, prevention and treatment of diseases and clinical conditions associated with H11. KIAA0329 (Accession NM_014844) is another VGAM2110 host target gene. KIAA0329 BINDING SITE is HOST TARGET binding site found in the 3' untranslated region of mRNA encoded by KIAA0329, corresponding to a HOST TARGET binding site such as BINDING SITE I, BINDING SITE II or BINDING SITE III. Table 2 illustrates the complementarity of the nucleotide sequences of KIAA0329 BINDING SITE, designated SEQ ID:16877, to the nucleotide sequence of VGAM2110 RNA, herein designated VGAM RNA, also designated SEQ ID:4821.

Another function of VGAM2110 is therefore inhibition of KIAA0329 (Accession NM_014844). Accordingly, utilities of VGAM2110 include diagnosis, prevention and treatment of diseases and clinical conditions associated with KIAA0329. KIAA0557 (Accession XM_085507) is another VGAM2110 host target gene. KIAA0557 BINDING SITE is HOST TARGET binding site found in the 3' untranslated region of mRNA encoded by KIAA0557, corresponding to a HOST TARGET binding site such as BINDING SITE I, BINDING SITE II or BINDING SITE III. Table 2 illustrates the complementarity of the nucleotide sequences of KIAA0557 BINDING SITE, designated SEQ ID:38204, to the nucleotide sequence of VGAM2110 RNA, herein designated VGAM RNA, also designated SEQ ID:4821.

Another function of VGAM2110 is therefore inhibition of KIAA0557 (Accession XM_085507). Accordingly, utilities of VGAM2110 include diagnosis, prevention and treatment of diseases and clinical conditions associated with KIAA0557. MGC4415 (Accession NM_031484) is another VGAM2110 host target gene. MGC4415 BINDING SITE is HOST TARGET binding site found in the 3' untranslated region of mRNA encoded by MGC4415, corresponding to a HOST TARGET binding site such as BINDING SITE I, BINDING SITE II or BINDING SITE III. Table 2 illustrates the complementarity of the nucleotide sequences of MGC4415 BINDING SITE, designated SEQ ID:25571, to the nucleotide sequence of VGAM2110 RNA, herein designated VGAM RNA, also designated SEQ ID:4821.

Another function of VGAM2110 is therefore inhibition of MGC4415 (Accession NM_031484). Accordingly, utilities of VGAM2110 include diagnosis, prevention and treatment of diseases and clinical conditions associated with MGC4415. Syntaphilin (SNPH, Accession NM_014723) is another VGAM2110 host target gene. SNPH BINDING SITE is HOST TARGET binding site found in the 3' untranslated region of mRNA encoded by SNPH, corresponding to a HOST TARGET binding site such as BINDING SITE I, BINDING SITE II or BINDING SITE III. Table 2 illustrates the complementarity of the nucleotide sequences of SNPH BINDING SITE, designated SEQ ID:16291, to the nucleotide sequence of VGAM2110 RNA, herein designated VGAM RNA, also designated SEQ ID:4821.

Another function of VGAM2110 is therefore inhibition of Syntaphilin (SNPH, Accession NM_014723). Accordingly, utilities of VGAM2110 include diagnosis, prevention and treatment of diseases and clinical conditions associated with SNPH. LOC150504 (Accession XM_001732) is another VGAM2110 host target gene. LOC150504 BINDING SITE is HOST TARGET binding site found in the 5' untranslated region of mRNA encoded by LOC150504, corresponding to a HOST TARGET binding site such as BINDING SITE I, BINDING SITE II or BINDING SITE III. Table 2 illustrates the complementarity of the nucleotide sequences of LOC150504 BINDING SITE, designated SEQ ID:29849, to the nucleotide sequence of VGAM2110 RNA, herein designated VGAM RNA, also designated SEQ ID:4821.

Another function of VGAM2110 is therefore inhibition of LOC150504 (Accession XM_001732). Accordingly, utilities of VGAM2110 include diagnosis, prevention and treatment of diseases and clinical conditions associated with LOC150504. LOC151443 (Accession XM_087200) is another VGAM2110 host target gene. LOC151443 BINDING SITE is HOST TARGET binding site found in the 5' untranslated region of mRNA encoded by LOC151443, corresponding to a HOST TARGET binding site such as BINDING SITE I, BINDING SITE II or BINDING SITE III. Table 2 illustrates the complementarity of the nucleotide sequences of LOC151443 BINDING SITE, designated SEQ ID:39114, to the nucleotide sequence of VGAM2110 RNA, herein designated VGAM RNA, also designated SEQ ID:4821.

Another function of VGAM2110 is therefore inhibition of LOC151443 (Accession XM_087200). Accordingly, utilities of VGAM2110 include diagnosis, prevention and treatment of diseases and clinical conditions associated with LOC151443. LOC158236 (Accession XM_098898) is another VGAM2110 host target gene. LOC158236 BINDING SITE is HOST TARGET binding site found in the 5' untranslated region of mRNA encoded by LOC158236, corresponding to a HOST TARGET binding site such as BINDING SITE I, BINDING SITE II or BINDING SITE III. Table 2 illustrates the complementarity of the nucleotide sequences of LOC158236 BINDING SITE, designated SEQ ID:41926, to the nucleotide sequence of VGAM2110 RNA, herein designated VGAM RNA, also designated SEQ ID:4821.

Another function of VGAM2110 is therefore inhibition of LOC158236 (Accession XM_098898). Accordingly, utilities of VGAM2110 include diagnosis, prevention and treatment of diseases and clinical conditions associated with LOC158236. LOC158376 (Accession XM_098934) is another VGAM2110 host target gene. LOC158376 BINDING SITE is HOST TARGET binding site found in the 3' untranslated region of mRNA encoded by LOC158376, corresponding to a HOST TARGET binding site such as BINDING SITE I, BINDING SITE II or BINDING SITE III. Table 2 illustrates the complementarity of the nucleotide sequences of LOC158376 BINDING SITE, designated SEQ ID:41973, to the nucleotide sequence of VGAM2110 RNA, herein designated VGAM RNA, also designated SEQ ID:4821.

Another function of VGAM2110 is therefore inhibition of LOC158376 (Accession XM_098934). Accordingly, utilities of VGAM2110 include diagnosis, prevention and treatment of diseases and clinical conditions associated with LOC158376. LOC158402 (Accession XM_098936) is another VGAM2110 host target gene. LOC158402 BINDING SITE is HOST TARGET binding site found in the 5' untranslated region of mRNA encoded by LOC158402, corresponding to a HOST TARGET binding site such as BINDING SITE I, BINDING SITE II or BINDING SITE III. Table 2 illustrates the complementarity of the nucleotide sequences of LOC158402 BINDING SITE, designated SEQ ID:41974, to the nucleotide sequence of VGAM2110 RNA, herein designated VGAM RNA, also designated SEQ ID:4821.

Another function of VGAM2110 is therefore inhibition of LOC158402 (Accession XM_098936). Accordingly, utilities of VGAM2110 include diagnosis, prevention and treatment of diseases and clinical conditions associated with LOC158402. LOC199676 (Accession XM_117107) is another VGAM2110 host target gene. LOC199676 BINDING SITE is HOST TARGET binding site found in the 3' untranslated region of mRNA encoded by LOC199676, corresponding to a HOST TARGET binding site such as BINDING SITE I, BINDING SITE II or BINDING SITE III. Table 2 illustrates the complementarity of the nucleotide sequences of LOC199676 BINDING SITE, designated SEQ ID:43224, to the nucleotide sequence of VGAM2110 RNA, herein designated VGAM RNA, also designated SEQ ID:4821.

Another function of VGAM2110 is therefore inhibition of LOC199676 (Accession XM_117107). Accordingly, utilities of VGAM2110 include diagnosis, prevention and treatment of diseases and clinical conditions associated with LOC199676. LOC254065 (Accession XM_173239) is another VGAM2110 host target gene. LOC254065 BINDING SITE is HOST TARGET binding site found in the 5' untranslated region of mRNA encoded by LOC254065, corresponding to a HOST TARGET binding site such as BINDING SITE I, BINDING SITE II or BINDING SITE III. Table 2 illustrates the complementarity of the nucleotide sequences of LOC254065 BINDING SITE, designated SEQ ID:46522, to the nucleotide sequence of VGAM2110 RNA, herein designated VGAM RNA, also designated SEQ ID:4821.

Another function of VGAM2110 is therefore inhibition of LOC254065 (Accession XM_173239). Accordingly, utilities of VGAM2110 include diagnosis, prevention and treatment of diseases and clinical conditions associated with LOC254065. FIG. 1 further provides a conceptual description of a novel bioinformatically detected viral gene of the present invention, referred to here as Viral Genomic Address Messenger 2111 (VGAM2111) viral gene, which modulates expression of respective host target genes thereof, the function and utility of which host target genes is known in the art.

VGAM2111 is a novel bioinformatically detected regulatory, non protein coding, viral micro RNA (miRNA) gene. The method by which VGAM2111 was detected is described hereinabove with reference to FIGS. 1-8.

VGAM2111 gene, herein designated VGAM GENE, is a viral gene contained in the genome of Sheeppox Virus. VGAM2111 host target gene, herein designated VGAM HOST TARGET GENE, is a human gene contained in the human genome.

VGAM2111 gene encodes a VGAM2111 precursor RNA, herein designated VGAM PRECURSOR RNA. Similar to other miRNA genes, and unlike most ordinary genes, VGAM2111 precursor RNA does not encode a protein. A nucleotide sequence identical or highly similar to the nucleotide sequence of VGAM2111 precursor RNA is designated SEQ ID:2097, and is provided hereinbelow with reference to the sequence listing part. Nucleotide sequence SEQ ID:2097 is located at position 6922 relative to the genome of Sheeppox Virus.

VGAM2111 precursor RNA folds onto itself, forming VGAM2111 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2111 folded precursor RNA into VGAM2111 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2111 RNA is designated SEQ ID:4822, and is provided hereinbelow with reference to the sequence listing part.

VGAM2111 host target gene, herein designated VGAM HOST TARGET GENE, encodes a corresponding messenger RNA, VGAM2111 host target RNA, herein designated VGAM HOST TARGET RNA. VGAM2111 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2111 RNA, herein designated VGAM RNA, binds complementarily to one or more host target binding sites located in untranslated regions of VGAM2111 host target RNA, herein designated VGAM HOST TARGET RNA. This complementary binding is due to the fact that the nucleotide sequence of VGAM2111 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2111 RNA, herein designated VGAM RNA, may have a different number of host target binding sites in untranslated regions of a VGAM2111 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2111 RNA, herein designated VGAM RNA, to host target binding sites on VGAM2111 host target RNA, herein designated VGAM HOST TARGET RNA, such as BINDING SITE I, BINDING SITE II and BINDING SITE III, inhibits translation of VGAM2111 host target RNA into VGAM2111 host target protein, herein designated VGAM HOST TARGET PROTEIN. VGAM host target protein is therefore outlined by a broken line.

It is appreciated that VGAM2111 host target gene, herein designated VGAM HOST TARGET GENE, in fact represents a plurality of VGAM2111 host target genes. The mRNA of each one of this plurality of VGAM2111 host target genes comprises one or more host target binding sites, each having a nucleotide sequence which is at least partly complementary to VGAM2111 RNA, herein designated VGAM RNA, and which when bound by VGAM2111 RNA causes inhibition of translation of respective one or more VGAM2111 host target proteins.

It is further appreciated by one skilled in the art that the mode of translational inhibition illustrated by FIG. 1 with specific reference to translational inhibition exerted by VGAM2111 gene, herein designated VGAM GENE, on one or more VGAM2111 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2111 is inhibition of expression of host target genes, as part of a novel viral mechanism of attacking a host. Accordingly, utilities of VGAM2111 include diagnosis, prevention and treatment of viral infection by Sheeppox Virus. Specific functions, and accordingly utilities, of VGAM2111 correlate with, and may be deduced from, the identity of the host target genes which VGAM2111 binds and inhibits, and the function of these host target genes, as elaborated hereinbelow.

Nucleotide sequences of the VGAM2111 precursor RNA, herein designated VGAM PRECURSOR RNA, and of the 'diced' VGAM2111 RNA, herein designated VGAM RNA, and a schematic representation of the secondary folding of VGAM2111 folded precursor RNA, herein designated VGAM FOLDED PRECURSOR RNA, of VGAM2111 are further described hereinbelow with reference to Table 1.

Nucleotide sequences of host target binding sites, such as BINDING SITE-I, BINDING SITE-II and BINDING SITE-III of FIG. 1, found on VGAM2111 host target RNA, and schematic representation of the complementarity of each of these host target binding sites to VGAM2111 RNA, herein designated VGAM RNA, are described hereinbelow with reference to Table 2.

As mentioned hereinabove with reference to FIG. 1, a function of VGAM2111 gene, herein designated VGAM is inhibition of expression of VGAM2111 target genes. It is appreciated that specific functions, and accordingly utilities, of VGAM2111 correlate with, and may be deduced from, the identity of the target genes which VGAM2111 binds and inhibits, and the function of these target genes, as elaborated hereinbelow.

Androgen Receptor (dihydrotestosterone receptor; testicular feminization; spinal and bulbar muscular atrophy; Kennedy disease) (AR, Accession NM_000044) is a VGAM2111 host target gene. AR BINDING SITE is HOST TARGET binding site found in the 5' untranslated region of mRNA encoded by AR, corresponding to a HOST TARGET binding site such as BINDING SITE I, BINDING SITE II or BINDING SITE III. Table 2 illustrates the complementarity of the nucleotide sequences of AR BINDING SITE, designated SEQ ID:5485, to the nucleotide sequence of VGAM2111 RNA, herein designated VGAM RNA, also designated SEQ ID:4822.

A function of VGAM2111 is therefore inhibition of Androgen Receptor (dihydrotestosterone receptor; testicular feminization; spinal and bulbar muscular atrophy; Kennedy disease) (AR, Accession NM_000044), a gene which are involved in the regulation of eukaryotic gene expression and affect cellular proliferation and differentiation in target tissues. Accordingly, utilities of VGAM2111 include diagnosis, prevention and treatment of diseases and clinical conditions associated with AR. The function of AR and its association with various diseases and clinical conditions, has been established by previous studies, as described hereinabove with reference to VGAM1971. Cyclin D1 (PRAD1: parathyroid adenomatosis 1) (CCND1, Accession NM_053056) is another VGAM2111 host target gene. CCND1 BINDING SITE is HOST TARGET binding site found in the 3' untranslated region of mRNA encoded by CCND1, corresponding to a HOST TARGET binding site such as BINDING SITE I, BINDING SITE II or BINDING SITE III. Table 2 illustrates the complementarity of the nucleotide sequences of CCND1 BINDING SITE, designated SEQ ID:27602, to the nucleotide sequence of VGAM2111 RNA, herein designated VGAM RNA, also designated SEQ ID:4822.

Another function of VGAM2111 is therefore inhibition of Cyclin D1 (PRAD1: parathyroid adenomatosis 1) (CCND1, Accession NM_053056), a gene which is involved in the control of cell cycle and is required for Schwann cell proliferation to proceed normally during Wallerian degeneration. Accordingly, utilities of VGAM2111 include diagnosis, prevention and treatment of diseases and clinical conditions associated with CCND1. The function of CCND1 and its association with various diseases and clinical conditions, has been established by previous studies, as described hereinabove with reference to VGAM220. CD83 Antigen (activated B lymphocytes, immunoglobulin superfamily) (CD83, Accession NM_004233) is another VGAM2111 host target gene. CD83 BINDING SITE is HOST TARGET binding site found in the 3' untranslated region of mRNA encoded by CD83, corresponding to a HOST TARGET binding site such as BINDING SITE I, BINDING SITE II or BINDING SITE III. Table 2 illustrates the complementarity of the nucleotide sequences of CD83 BINDING SITE, designated SEQ ID:10425, to the nucleotide sequence of VGAM2111 RNA, herein designated VGAM RNA, also designated SEQ ID:4822.

Another function of VGAM2111 is therefore inhibition of CD83 Antigen (activated B lymphocytes, immunoglobulin superfamily) (CD83, Accession NM_004233), a gene which may play a significant role in antigen presentation or the cellular interactions that follow lymphocyte activation. Accordingly, utilities of VGAM2111 include diagnosis, prevention and treatment of diseases and clinical conditions associated with CD83. The function of CD83 and its association with various diseases and clinical conditions, has been established by previous studies, as described hereinabove with reference to VGAM1929. Chorea Acanthocytosis (CHAC, Accession NM_033305) is another VGAM2111 host target gene. CHAC BINDING SITE is HOST TARGET binding site found in the 3' untranslated region of mRNA encoded by CHAC, corresponding to a HOST TARGET binding site such as BINDING SITE I, BINDING SITE II or BINDING SITE III. Table 2 illustrates the complementarity of the nucleotide sequences of CHAC BINDING SITE, designated SEQ ID:27137, to the nucleotide sequence of VGAM2111 RNA, herein designated VGAM RNA, also designated SEQ ID:4822.

Another function of VGAM2111 is therefore inhibition of Chorea Acanthocytosis (CHAC, Accession NM_033305), a gene which may regulate the cycling of proteins. Accordingly, utilities of VGAM2111 include diagnosis, prevention and treatment of diseases and clinical conditions associated with CHAC. The function of CHAC and its association with various diseases and clinical conditions, has been established by previous studies, as described hereinabove with reference to VGAM650. Cytochrome P450, Subfamily I (aromatic compound-inducible), Polypeptide 2 (CYP1A2, Accession NM_000761) is another VGAM2111 host target gene. CYP1A2 BINDING SITE1 and CYP1A2 BINDING SITE2 are HOST TARGET binding sites found in untranslated regions of mRNA encoded by CYP1A2, corresponding to HOST TARGET binding sites such as BINDING SITE I, BINDING SITE II or BINDING SITE III. Table 2 illustrates the complementarity of the nucleotide sequences of CYP1A2 BINDING SITE1 and CYP1A2 BINDING SITE2, designated SEQ ID:6410 and SEQ ID:34253 respectively, to the nucleotide sequence of VGAM2111 RNA, herein designated VGAM RNA, also designated SEQ ID:4822.

Another function of VGAM2111 is therefore inhibition of Cytochrome P450, Subfamily I (aromatic compound-inducible), Polypeptide 2 (CYP1A2, Accession NM_000761), a gene which intervenes in an NADPH-dependent electron transport pathway. Accordingly, utilities of VGAM2111 include diagnosis, prevention and treatment of diseases and clinical conditions associated with CYP1A2. The function of CYP1A2 and its association with various diseases and clinical conditions, has been established by previous studies, as described hereinabove with reference to VGAM74. Desmocollin 2 (DSC2, Accession NM_004949) is another VGAM2111 host target gene. DSC2 BINDING SITE is HOST TARGET binding site found in the 3' untranslated region of mRNA encoded by DSC2, corresponding to a HOST TARGET binding site such as BINDING SITE I, BINDING SITE II or BINDING SITE III. Table 2 illustrates the complementarity of the nucleotide sequences of DSC2 BINDING SITE, designated SEQ ID:11391, to the nucleotide sequence of VGAM2111 RNA, herein designated VGAM RNA, also designated SEQ ID:4822.

Another function of VGAM2111 is therefore inhibition of Desmocollin 2 (DSC2, Accession NM_004949), a gene which is a component of intercellular desmosome junctions. Accordingly, utilities of VGAM2111 include diagnosis, prevention and treatment of diseases and clinical conditions associated with DSC2. The function of DSC2 and its association with various diseases and clinical conditions, has been established by previous studies, as described hereinabove with reference to VGAM909. Dystrobrevin, Beta (DTNB, Accession NM_033147) is another VGAM2111 host target gene. DTNB BINDING SITE is HOST TARGET binding site found in the 3' untranslated region of mRNA encoded by DTNB, corresponding to a HOST TARGET binding site such as BINDING SITE I, BINDING SITE II or BINDING SITE III. Table 2 illustrates the complementarity of the nucleotide sequences of DTNB BINDING SITE, designated SEQ ID:27005, to the nucleotide sequence of VGAM2111 RNA, herein designated VGAM RNA, also designated SEQ ID:4822.

Another function of VGAM2111 is therefore inhibition of Dystrobrevin, Beta (DTNB, Accession NM_033147), a gene which is a part of a dystrophin-associated protein complex. Accordingly, utilities of VGAM2111 include diagnosis, prevention and treatment of diseases and clinical conditions associated with DTNB. The function of DTNB has been established by previous studies. Dystrophin, a component of muscle that is defective in Duchenne muscular dystrophy (DMD; 310200), binds to a complex of proteins and glycoproteins, the dystrophin-associated protein complex (DPC), which effectively forms a transmembrane link between the extracellular matrix, and the cytoskeleton of the muscle fiber. The DPC can be divided into 3 subcomplexes: the dystroglycan complex, the sarcoglycan complex, and the cytoplasmic complex. The dystroglycan complex consists of 2 proteins, alpha- and beta-dystroglycan (DAG1, 128239; DAG2, 600119), that bind to laminin and dystrophin, respectively. The sarcoglycan complex is composed of 4 transmembrane glycoproteins: alpha-, beta-, gamma-, and delta-sarcoglycan, and a 25-kD protein 25DAP. Mutations in all 4 sarcoglycan genes have been found in patients with different forms of limb-girdle muscular dystrophy. The cytoplasmic component of the DPC is composed of the syntrophin family of related proteins and the dystrophin-related protein, dystrobrevin. Peters et al. (1997) described beta-dystrobrevin. They cloned cDNAs from human liver libraries that encode a 627-amino acid polypeptide with a predicted molecular weight of 71 kD. The protein copurified with the dystrobrevin short form, Dp71. The mammalian dystrobrevin genes encode several protein isoforms that are expressed in different tissues, including brain and muscle. Blake et al. (1998) designated the isoform expressed in muscle as alpha-dystrobrevin and used the designation beta-dystrobrevin for the dystrophin-related protein they found to be abundantly expressed in brain and other tissues but not in muscle. Beta-dystrobrevin is encoded by a 2.5-kb alternatively spliced transcript that is found throughout the brain. In common with dystrophin, beta-dystrobrevin is found in neurons of the cortex and hippocampal formation, but it is not found in the brain microvasculature. In the brain, beta-dystrobrevin coprecipitates with the dystrophin isoforms Dp71 and Dp140. The findings of Blake et al. (1998) indicated that the composition of the dystrophin-associated protein complex in the brain differs from that in muscle. Because beta-dystrobrevin and dystrophin are expressed in similar populations of neurons in the hippocampus and cortex, it is possible that beta-dystrobrevin interacts directly with dystrophin. If this is the case, then beta-dystrobrevin levels may be reduced in DMD patients similar to the reduction in sarcolemmal staining seen with other components of the DPC in dystrophic muscle. The findings may be relevant to the cognitive dysfunction affecting many patients with Duchenne muscular dystrophy.

Full details of the abovementioned studies are described in the following publications, the disclosure of which are hereby incorporated by reference:

Blake, D. J.; Nawrotzki, R.; Loh, N. Y.; Gorecki, D. C.; Davies, K. E.: Beta-dystrobrevin, a member of the dystrophin-related protein family. Proc. Nat. Acad. Sci. 95:241-246, 1998; and Peters, M. F.; O'Brien, K. F.; Sadoulet-Puccio, H. M.; Kunkel, L. M.; Adams, M. E.; Froehner, S. C.: Beta-dystrobrevin, a new member of the dystrophin family: identification, cloning.

Further studies establishing the function and utilities of DTNB are found in John Hopkins OMIM database record ID 602415, and in sited publications numbered 284 and 1028 listed in the bibliography section hereinbelow, which are also hereby incorporated by reference. Dishevelled, Dsh Homolog 3 (Drosophila) (DVL3, Accession NM_004423) is another VGAM2111 host target gene. DVL3 BINDING SITE is HOST TARGET binding site found in the 3' untranslated region of mRNA encoded by DVL3, corresponding to a HOST TARGET binding site such as BINDING SITE I, BINDING SITE II or BINDING SITE III. Table 2 illustrates the complementarity of the nucleotide sequences of DVL3 BINDING SITE, designated SEQ ID:10687, to the nucleotide sequence of VGAM2111 RNA, herein designated VGAM RNA, also designated SEQ ID:4822.

Another function of VGAM2111 is therefore inhibition of Dishevelled, Dsh Homolog 3 (Drosophila) (DVL3, Accession NM_004423), a gene which regulates cell proliferation.

Accordingly, utilities of VGAM2111 include diagnosis, prevention and treatment of diseases and clinical conditions associated with DVL3. The function of DVL3 and its association with various diseases and clinical conditions, has been established by previous studies, as described hereinabove with reference to VGAM57. Exostoses (multiple)-like 2 (EXTL2, Accession NM_001439) is another VGAM2111 host target gene. EXTL2 BINDING SITE is HOST TARGET binding site found in the 3' untranslated region of mRNA encoded by EXTL2, corresponding to a HOST TARGET binding site such as BINDING SITE I, BINDING SITE II or BINDING SITE III. Table 2 illustrates the complementarity of the nucleotide sequences of EXTL2 BINDING SITE, designated SEQ ID:7159, to the nucleotide sequence of VGAM2111 RNA, herein designated VGAM RNA, also designated SEQ ID:4822.

Another function of VGAM2111 is therefore inhibition of Exostoses (multiple)-like 2 (EXTL2, Accession NM_001439), a gene which is homologous to the EXT and EXTL genes. Accordingly, utilities of VGAM2111 include diagnosis, prevention and treatment of diseases and clinical conditions associated with EXTL2. The function of EXTL2 and its association with various diseases and clinical conditions, has been established by previous studies, as described hereinabove with reference to VGAM743. Holocarboxylase Synthetase (biotin-[proprionyl-Coenzyme A-carboxylase (ATP-hydrolysing)] Ligase) (HLCS, Accession NM_000411) is another VGAM2111 host target gene. HLCS BINDING SITE is HOST TARGET binding site found in the 3' untranslated region of mRNA encoded by HLCS, corresponding to a HOST TARGET binding site such as BINDING SITE I, BINDING SITE II or BINDING SITE III. Table 2 illustrates the complementarity of the nucleotide sequences of HLCS BINDING SITE, designated SEQ ID:5986, to the nucleotide sequence of VGAM2111 RNA, herein designated VGAM RNA, also designated SEQ ID:4822.

Another function of VGAM2111 is therefore inhibition of Holocarboxylase Synthetase (biotin-[proprionyl-Coenzyme A-carboxylase (ATP-hydrolysing)] Ligase) (HLCS, Accession NM_000411). Accordingly, utilities of VGAM2111 include diagnosis, prevention and treatment of diseases and clinical conditions associated with HLCS. Hairy Homolog (Drosophila) (HRY, Accession NM_005524) is another VGAM2111 host target gene. HRY BINDING SITE is HOST TARGET binding site found in the 5' untranslated region of mRNA encoded by HRY, corresponding to a HOST TARGET binding site such as BINDING SITE I, BINDING SITE II or BINDING SITE III. Table 2 illustrates the complementarity of the nucleotide sequences of HRY BINDING SITE, designated SEQ ID:12048, to the nucleotide sequence of VGAM2111 RNA, herein designated VGAM RNA, also designated SEQ ID:4822.

Another function of VGAM2111 is therefore inhibition of Hairy Homolog (Drosophila) (HRY, Accession NM_005524), a gene which may act as a negative regulator of myogenesis. Accordingly, utilities of VGAM2111 include diagnosis, prevention and treatment of diseases and clinical conditions associated with HRY. The function of HRY has been established by previous studies. By site-directed mutagenesis and overexpression of HRY in human fibroblasts, Yan et al. (2002) showed that HRY, as well as YY1 (OMIM Ref. No. 600013), functions as a transcriptional activator of acid alpha-glucosidase (GAA; 606800). Using gel shift assays, they found that HRY binds to a 25-bp enhancer element within the first intron of the GAA gene. In previous studies, Yan et al. (2001) had found that HRY, binding to the same element of the GAA gene in hepatoma cells, acts as a GAA transcription silencer. Yan et al. (2002) noted that the dual function of HRY is likely to contribute to the subtle tissue-specific control of housekeeping genes such as GAA. Votruba et al. (1998) identified no mutations in the HRY gene in 36 patients from 18 pedigrees with OPA1. Using a polymorphism in the untranslated region of exon 2 of HRY, Votruba et al. (1998) found recombination between HRY and OPA1 in 1 pedigree.

Full details of the abovementioned studies are described in the following publications, the disclosure of which are hereby incorporated by reference:

Yan, B.; Heus, J.; Lu, N.; Nichols, R. C.; Raben, N.; Plotz, P. H.: Transcriptional regulation of the human acid alpha-glucosidase gene: identification of a repressor element and its transcription factors Hes-1 and YY1. J. Biol. Chem. 276: 1789-1793, 2001; and Yan, B.; Raben, N.; Plotz, P. H.: Hes-1, a known transcriptional repressor, acts as a transcriptional activator for the human acid alpha-glucosidase gene in human fibroblast cells. Bi.

Further studies establishing the function and utilities of HRY are found in John Hopkins OMIM database record ID 139605, and in sited publications numbered 3572-3575 listed in the bibliography section hereinbelow, which are also hereby incorporated by reference. Nuclear Receptor Subfamily 1, Group I, Member 2 (NR1I2, Accession NM_003889) is another VGAM2111 host target gene. NR1I2 BINDING SITE is HOST TARGET binding site found in the 5' untranslated region of mRNA encoded by NR1I2, corresponding to a HOST TARGET binding site such as BINDING SITE I, BINDING SITE II or BINDING SITE III. Table 2 illustrates the complementarity of the nucleotide sequences of NR1I2 BINDING SITE, designated SEQ ID:9973, to the nucleotide sequence of VGAM2111 RNA, herein designated VGAM RNA, also designated SEQ ID:4822.

Another function of VGAM2111 is therefore inhibition of Nuclear Receptor Subfamily 1, Group I, Member 2 (NR1I2, Accession NM_003889), a gene which binds to a response element in the cyp3a4 gene promoter and activates its expression in response to a wide variety of endobiotics and xenobiotics. Accordingly, utilities of VGAM2111 include diagnosis, prevention and treatment of diseases and clinical conditions associated with NR1I2. The function of NR1I2 and its association with various diseases and clinical conditions, has been established by previous studies, as described hereinabove with reference to VGAM336. Nuclear Receptor Subfamily 4, Group A, Member 2 (NR4A2, Accession NM_006186) is another VGAM2111 host target gene. NR4A2 BINDING SITE is HOST TARGET binding site found in the 3' untranslated region of mRNA encoded by NR4A2, corresponding to a HOST TARGET binding site such as BINDING SITE I, BINDING SITE II or BINDING SITE III. Table 2 illustrates the complementarity of the nucleotide sequences of NR4A2 BINDING SITE, designated SEQ ID:12856, to the nucleotide sequence of VGAM2111 RNA, herein designated VGAM RNA, also designated SEQ ID:4822.

Another function of VGAM2111 is therefore inhibition of Nuclear Receptor Subfamily 4, Group A, Member 2 (NR4A2, Accession NM_006186), a gene which may be a general coactivator of transcription. Accordingly, utilities of VGAM2111 include diagnosis, prevention and treatment of diseases and clinical conditions associated with NR4A2. The function of NR4A2 and its association with various diseases and clinical conditions, has been established by previous studies, as described hereinabove with reference to VGAM127. P53AIP1 (Accession NM_022112) is another VGAM2111 host target gene. P53AIP1 BINDING SITE is HOST TARGET binding site found in the 3' untranslated region of mRNA encoded by P53AIP1, corresponding to a HOST TARGET binding site such as BINDING SITE I, BINDING SITE II or BINDING SITE III. Table 2 illustrates the complementarity of the nucleotide sequences of P53AIP1 BINDING SITE, designated SEQ ID:22657, to the nucleotide sequence of VGAM2111 RNA, herein designated VGAM RNA, also designated SEQ ID:4822.

Another function of VGAM2111 is therefore inhibition of P53AIP1 (Accession NM_022112). Accordingly, utilities of VGAM2111 include diagnosis, prevention and treatment of diseases and clinical conditions associated with P53AIP1. Protein Kinase, CGMP-dependent, Type I (PRKG1, Accession NM_006258) is another VGAM2111 host target gene. PRKG1 BINDING SITE is HOST TARGET binding site found in the 3' untranslated region of mRNA encoded by PRKG1, corresponding to a HOST TARGET binding site such as BINDING SITE I, BINDING SITE II or BINDING SITE III. Table 2 illustrates the complementarity of the nucleotide sequences of PRKG1 BINDING SITE, designated SEQ ID:12935, to the nucleotide sequence of VGAM2111 RNA, herein designated VGAM RNA, also designated SEQ ID:4822.

Another function of VGAM2111 is therefore inhibition of Protein Kinase, CGMP-dependent, Type I (PRKG1, Accession NM_006258), a gene which relaxes vascular smooth muscle and inhibits platelet aggregation. Accordingly, utilities of VGAM2111 include diagnosis, prevention and treatment of diseases and clinical conditions associated with PRKG1. The function of PRKG1 and its association with various diseases and clinical conditions, has been established by previous studies, as described hereinabove with reference to VGAM1571. Protein Tyrosine Phosphatase, Non-receptor Type 2 (PTPN2, Accession NM_002828) is another VGAM2111 host target gene. PTPN2 BINDING SITE is HOST TARGET binding site found in the 3' untranslated region of mRNA encoded by PTPN2, corresponding to a HOST TARGET binding site such as BINDING SITE I, BINDING SITE II or BINDING SITE III. Table 2 illustrates the complementarity of the nucleotide sequences of PTPN2 BINDING SITE, designated SEQ ID:8704, to the nucleotide sequence of VGAM2111 RNA, herein designated VGAM RNA, also designated SEQ ID:4822.

Another function of VGAM2111 is therefore inhibition of Protein Tyrosine Phosphatase, Non-receptor Type 2 (PTPN2, Accession NM_002828). Accordingly, utilities of VGAM2111 include diagnosis, prevention and treatment of diseases and clinical conditions associated with PTPN2. Synaptotagmin IV (SYT4, Accession XM_031162) is another VGAM2111 host target gene. SYT4 BINDING SITE is HOST TARGET binding site found in the 3' untranslated region of mRNA encoded by SYT4, corresponding to a HOST TARGET binding site such as BINDING SITE I, BINDING SITE II or BINDING SITE III. Table 2 illustrates the complementarity of the nucleotide sequences of SYT4 BINDING SITE, designated SEQ ID:31291, to the nucleotide sequence of VGAM2111 RNA, herein designated VGAM RNA, also designated SEQ ID:4822.

Another function of VGAM2111 is therefore inhibition of Synaptotagmin IV (SYT4, Accession XM_031162), a gene which may be involved in ca2+-dependent exocytosis of secretory vesicles or may serve as ca2+ sensors in the process of vesicular trafficking and exocytosis. Accordingly, utilities of VGAM2111 include diagnosis, prevention and treatment of diseases and clinical conditions associated with SYT4. The function of SYT4 and its association with various diseases and clinical conditions, has been established by previous studies, as described hereinabove with reference to VGAM200. X Kell Blood Group Precursor-related, Y-linked (XKRY, Accession NM_004677) is another VGAM2111 host target gene. XKRY BINDING SITE1 and XKRY BINDING SITE2 are HOST TARGET binding sites found in untranslated regions of mRNA encoded by XKRY, corresponding to HOST TARGET binding sites such as BINDING SITE I, BINDING SITE II or BINDING SITE III. Table 2 illustrates the complementarity of the nucleotide sequences of XKRY BINDING SITE1 and XKRY BINDING SITE2, designated SEQ ID:11044 and SEQ ID:30153 respectively, to the nucleotide sequence of VGAM2111 RNA, herein designated VGAM RNA, also designated SEQ ID:4822.

Another function of VGAM2111 is therefore inhibition of X Kell Blood Group Precursor-related, Y-linked (XKRY, Accession NM_004677). Accordingly, utilities of VGAM2111 include diagnosis, prevention and treatment of diseases and clinical conditions associated with XKRY. Chromosome 6 Open Reading Frame 37 (C6orf37, Accession XM_041375) is another VGAM2111 host target gene. C6orf37 BINDING SITE is HOST TARGET binding site found in the 3' untranslated region of mRNA encoded by C6orf37, corresponding to a HOST TARGET binding site such as BINDING SITE I, BINDING SITE II or BINDING SITE III. Table 2 illustrates the complementarity of the nucleotide sequences of C6orf37 BINDING SITE, designated SEQ ID:33506, to the nucleotide sequence of VGAM2111 RNA, herein designated VGAM RNA, also designated SEQ ID:4822.

Another function of VGAM2111 is therefore inhibition of Chromosome 6 Open Reading Frame 37 (C6orf37, Accession XM_041375). Accordingly, utilities of VGAM2111 include diagnosis, prevention and treatment of diseases and clinical conditions associated with C6orf37. C6orf5 (Accession NM_015524) is another VGAM2111 host target gene. C6orf5 BINDING SITE is HOST TARGET binding site found in the 3' untranslated region of mRNA encoded by C6orf5, corresponding to a HOST TARGET binding site such as BINDING SITE I, BINDING SITE II or BINDING SITE III. Table 2 illustrates the complementarity of the nucleotide sequences of C6orf5 BINDING SITE, designated SEQ ID:17776, to the nucleotide sequence of VGAM2111 RNA, herein designated VGAM RNA, also designated SEQ ID:4822.

Another function of VGAM2111 is therefore inhibition of C6orf5 (Accession NM_015524). Accordingly, utilities of VGAM2111 include diagnosis, prevention and treatment of diseases and clinical conditions associated with C6orf5. Calcium/calmodulin-dependent Protein Kinase Kinase 2, Beta (CAMKK2, Accession NM_006549) is another VGAM2111 host target gene. CAMKK2 BINDING SITE is HOST TARGET binding site found in the 5' untranslated region of mRNA encoded by CAMKK2, corresponding to a HOST TARGET binding site such as BINDING SITE I, BINDING SITE II or BINDING SITE III. Table 2 illustrates the complementarity of the nucleotide sequences of CAMKK2 BINDING SITE, designated SEQ ID:13307, to the nucleotide sequence of VGAM2111 RNA, herein designated VGAM RNA, also designated SEQ ID:4822.

Another function of VGAM2111 is therefore inhibition of Calcium/calmodulin-dependent Protein Kinase Kinase 2, Beta (CAMKK2, Accession NM_006549). Accordingly, utilities of VGAM2111 include diagnosis, prevention and treatment of diseases and clinical conditions associated with CAMKK2. Collagen, Type XXI, Alpha 1 (COL21A1, Accession NM_030820) is another VGAM2111 host target gene. COL21A1 BINDING SITE is HOST TARGET binding site found in the 3' untranslated region of mRNA encoded by COL21A1, corresponding to a HOST TARGET binding site such as BINDING SITE I, BINDING SITE II or BINDING SITE III. Table 2 illustrates the complementarity of the nucleotide sequences of COL21A1 BINDING SITE, designated SEQ ID:25149, to the nucleotide sequence of VGAM2111 RNA, herein designated VGAM RNA, also designated SEQ ID:4822.

Another function of VGAM2111 is therefore inhibition of Collagen, Type XXI, Alpha 1 (COL21A1, Accession NM_030820). Accordingly, utilities of VGAM2111 include diagnosis, prevention and treatment of diseases and clinical conditions associated with COL21A1. Cysteine Sulfinic Acid Decarboxylase (CSAD, Accession NM_015989) is another VGAM2111 host target gene. CSAD BINDING SITE is HOST TARGET binding site found in the 3" untranslated region of mRNA encoded by CSAD, corresponding to a HOST TARGET binding site such as BINDING SITE I, BINDING SITE II or BINDING SITE III. Table 2 illustrates the complementarity of the nucleotide sequences of CSAD BINDING SITE, designated SEQ ID:18081, to the nucleotide sequence of VGAM2111 RNA, herein designated VGAM RNA, also designated SEQ ID:4822.

Another function of VGAM2111 is therefore inhibition of Cysteine Sulfinic Acid Decarboxylase (CSAD, Accession NM_015989). Accordingly, utilities of VGAM2111 include diagnosis, prevention and treatment of diseases and clinical conditions associated with CSAD. DKFZP547L112 (Accession XM_039353) is another VGAM2111 host target gene. DKFZP547L112 BINDING SITE is HOST TARGET binding site found in the 3' untranslated region of mRNA encoded by DKFZP547L112, corresponding to a HOST TARGET binding site such as BINDING SITE I, BINDING SITE II or BINDING SITE III. Table 2 illustrates the complementarity of the nucleotide sequences of DKFZP547L112 BINDING SITE, designated SEQ ID:33057, to the nucleotide sequence of VGAM2111 RNA, herein designated VGAM RNA, also designated SEQ ID:4822.

Another function of VGAM2111 is therefore inhibition of DKFZP547L112 (Accession XM_039353). Accordingly, utilities of VGAM2111 include diagnosis, prevention and treatment of diseases and clinical conditions associated with DKFZP547L112. FLJ12568 (Accession NM_024993) is another VGAM2111 host target gene. FLJ12568 BINDING SITE is HOST TARGET binding site found in the 3' untranslated region of mRNA encoded by FLJ12568, corresponding to a HOST TARGET binding site such as BINDING SITE I, BINDING SITE II or BINDING SITE III. Table 2 illustrates the complementarity of the nucleotide sequences of FLJ12568 BINDING SITE, designated SEQ ID:24554, to the nucleotide sequence of VGAM2111 RNA, herein designated VGAM RNA, also designated SEQ ID:4822.

Another function of VGAM2111 is therefore inhibition of FLJ12568 (Accession NM_024993). Accordingly, utilities of VGAM2111 include diagnosis, prevention and treatment of diseases and clinical conditions associated with FLJ12568. FLJ13409 (Accession NM_024617) is another VGAM2111 host target gene. FLJ13409 BINDING SITE is HOST TARGET binding site found in the 3' untranslated region of mRNA encoded by FLJ13409, corresponding to a HOST TARGET binding site such as BINDING SITE I, BINDING SITE II or BINDING SITE III. Table 2 illustrates the complementarity of the nucleotide sequences of FLJ13409 BINDING SITE, designated SEQ ID:23879, to the nucleotide sequence of VGAM2111 RNA, herein designated VGAM RNA, also designated SEQ ID:4822.

Another function of VGAM2111 is therefore inhibition of FLJ13409 (Accession NM_024617). Accordingly, utilities of VGAM2111 include diagnosis, prevention and treatment of diseases and clinical conditions associated with FLJ13409. FLJ13841 (Accession NM_024702) is another VGAM2111 host target gene. FLJ13841 BINDING SITE is HOST TARGET binding site found in the 3' untranslated region of mRNA encoded by FLJ13841, corresponding to a HOST TARGET binding site such as BINDING SITE I, BINDING SITE II or BINDING SITE III. Table 2 illustrates the complementarity of the nucleotide sequences of FLJ13841 BINDING SITE, designated SEQ ID:24015, to the nucleotide sequence of VGAM2111 RNA, herein designated VGAM RNA, also designated SEQ ID:4822.

Another function of VGAM2111 is therefore inhibition of FLJ13841 (Accession NM_024702). Accordingly, utilities of VGAM2111 include diagnosis, prevention and treatment of diseases and clinical conditions associated with FLJ13841. FLJ20340 (Accession NM_017773) is another VGAM2111 host target gene. FLJ20340 BINDING SITE is HOST TARGET binding site found in the 3' untranslated region of mRNA encoded by FLJ20340, corresponding to a HOST TARGET binding site such as BINDING SITE I, BINDING SITE II or BINDING SITE III. Table 2 illustrates the complementarity of the nucleotide sequences of FLJ20340 BINDING SITE, designated SEQ ID:19395, to the nucleotide sequence of VGAM2111 RNA, herein designated VGAM RNA, also designated SEQ ID:4822.

Another function of VGAM2111 is therefore inhibition of FLJ20340 (Accession NM_017773). Accordingly, utilities of VGAM2111 include diagnosis, prevention and treatment of diseases and clinical conditions associated with FLJ20340. FLJ23058 (Accession NM_024696) is another VGAM2111 host target gene. FLJ23058 BINDING SITE is HOST TARGET binding site found in the 3' untranslated region of mRNA encoded by FLJ23058, corresponding to a HOST TARGET binding site such as BINDING SITE I, BINDING SITE II or BINDING SITE III. Table 2 illustrates the complementarity of the nucleotide sequences of FLJ23058 BINDING SITE, designated SEQ ID:24005, to the nucleotide sequence of VGAM2111 RNA, herein designated VGAM RNA, also designated SEQ ID:4822.

Another function of VGAM2111 is therefore inhibition of FLJ23058 (Accession NM_024696). Accordingly, utilities of VGAM2111 include diagnosis, prevention and treatment of diseases and clinical conditions associated with FLJ23058. FLJ23548 (Accession NM_024590) is another VGAM2111 host target gene. FLJ23548 BINDING SITE is HOST TARGET binding site found in the 3' untranslated region of mRNA encoded by FLJ23548, corresponding to a HOST TARGET binding site such as BINDING SITE I, BINDING SITE II or BINDING SITE III. Table 2 illustrates the complementarity of the nucleotide sequences of FLJ23548 BINDING SITE, designated SEQ ID:23826, to the nucleotide sequence of VGAM2111 RNA, herein designated VGAM RNA, also designated SEQ ID:4822.

Another function of VGAM2111 is therefore inhibition of FLJ23548 (Accession NM_024590). Accordingly, utilities of VGAM2111 include diagnosis, prevention and treatment of diseases and clinical conditions associated with FLJ23548. GTP Binding Protein 5 (putative) (GTPBP5, Accession XM_037206) is another VGAM2111 host target gene. GTPBP5 BINDING SITE is HOST TARGET binding site found in the 3' untranslated region of mRNA encoded by GTPBP5, corresponding to a HOST TARGET binding site such as BINDING SITE I, BINDING SITE II or BINDING SITE III. Table 2 illustrates the complementarity of the nucleotide sequences of GTPBP5 BINDING SITE, designated SEQ ID:32573, to the nucleotide sequence of VGAM2111 RNA, herein designated VGAM RNA, also designated SEQ ID:4822.

Another function of VGAM2111 is therefore inhibition of GTP Binding Protein 5 (putative) (GTPBP5, Accession XM_037206). Accordingly, utilities of VGAM2111 include diagnosis, prevention and treatment of diseases and clinical conditions associated with GTPBP5. ICAP-1A (Accession NM_004763) is another VGAM2111 host target gene. ICAP-1A BINDING SITE is HOST TARGET binding site found in the 3' untranslated region of mRNA encoded by ICAP-1A, corresponding to a HOST TARGET binding site such as BINDING SITE I, BINDING SITE II or BINDING SITE III. Table 2 illustrates the complementarity of the nucleotide sequences of ICAP-1A BINDING SITE, designated SEQ ID:11156, to the nucleotide sequence of VGAM2111 RNA, herein designated VGAM RNA, also designated SEQ ID:4822.

Another function of VGAM2111 is therefore inhibition of ICAP-1A (Accession NM_004763). Accordingly, utilities of VGAM2111 include diagnosis, prevention and treatment of diseases and clinical conditions associated with ICAP-1A. KIAA0455 (Accession XM_051785) is another VGAM2111 host target gene. KIAA0455 BINDING SITE is HOST TARGET binding site found in the 3' untranslated region of mRNA encoded by KIAA0455, corresponding to a HOST TARGET binding site such as BINDING SITE I, BINDING SITE II or BINDING SITE III. Table 2 illustrates the complementarity of the nucleotide sequences of KIAA0455 BINDING SITE, designated SEQ ID:35880, to the nucleotide sequence of VGAM2111 RNA, herein designated VGAM RNA, also designated SEQ ID:4822.

Another function of VGAM2111 is therefore inhibition of KIAA0455 (Accession XM_051785). Accordingly, utilities of VGAM2111 include diagnosis, prevention and treatment of diseases and clinical conditions associated with KIAA0455. KIAA0471 (Accession NM_014857) is another VGAM2111 host target gene. KIAA0471 BINDING SITE is HOST TARGET binding site found in the 3' untranslated region of mRNA encoded by KIAA0471, corresponding to a HOST TARGET binding site such as BINDING SITE I, BINDING SITE II or BINDING SITE III. Table 2 illustrates the complementarity of the nucleotide sequences of KIAA0471 BINDING SITE, designated SEQ ID:16913, to the nucleotide sequence of VGAM2111 RNA, herein designated VGAM RNA, also designated SEQ ID:4822.

Another function of VGAM2111 is therefore inhibition of KIAA0471 (Accession NM_014857). Accordingly, utilities of VGAM2111 include diagnosis, prevention and treatment of diseases and clinical conditions associated with KIAA0471. KIAA1086 (Accession XM_047610) is another VGAM2111 host target gene. KIAA1086 BINDING SITE is HOST TARGET binding site found in the 3' untranslated region of mRNA encoded by KIAA1086, corresponding to a HOST TARGET binding site such as BINDING SITE I, BINDING SITE II or BINDING SITE III. Table 2 illustrates the complementarity of the nucleotide sequences of KIAA1086 BINDING SITE, designated SEQ ID:35011, to the nucleotide sequence of VGAM2111 RNA, herein designated VGAM RNA, also designated SEQ ID:4822.

Another function of VGAM2111 is therefore inhibition of KIAA1086 (Accession XM_047610). Accordingly, utilities of VGAM2111 include diagnosis, prevention and treatment of diseases and clinical conditions associated with KIAA1086. KIAA1260 (Accession XM_010461) is another VGAM2111 host target gene. KIAA1260 BINDING SITE is HOST TARGET binding site found in the 3' untranslated region of mRNA encoded by KIAA1260, corresponding to a HOST TARGET binding site such as BINDING SITE I, BINDING SITE II or BINDING SITE III. Table 2 illustrates the complementarity of the nucleotide sequences of KIAA1260 BINDING SITE, designated SEQ ID:30154, to the nucleotide sequence of VGAM2111 RNA, herein designated VGAM RNA, also designated SEQ ID:4822.

Another function of VGAM2111 is therefore inhibition of KIAA1260 (Accession XM_010461). Accordingly, utilities of VGAM2111 include diagnosis, prevention and treatment of diseases and clinical conditions associated with KIAA1260. KIAA1677 (Accession XM_040383) is another VGAM2111 host target gene. KIAA1677 BINDING SITE is HOST TARGET binding site found in the 3' untranslated region of mRNA encoded by KIAA1677, corresponding to a HOST TARGET binding site such as BINDING SITE I, BINDING SITE II or BINDING SITE III. Table 2 illustrates the complementarity of the nucleotide sequences of KIAA1677 BINDING SITE, designated SEQ ID:33289, to the nucleotide sequence of VGAM2111 RNA, herein designated VGAM RNA, also designated SEQ ID:4822.

Another function of VGAM2111 is therefore inhibition of KIAA1677 (Accession XM_040383). Accordingly, utilities of VGAM2111 include diagnosis, prevention and treatment of diseases and clinical conditions associated with KIAA1677. KIAA1829 (Accession XM_030378) is another VGAM2111 host target gene. KIAA1829 BINDING SITE is HOST TARGET binding site found in the 3' untranslated region of mRNA encoded by KIAA1829, corresponding to a HOST TARGET binding site such as BINDING SITE I, BINDING SITE II or BINDING SITE III. Table 2 illustrates the complementarity of the nucleotide sequences of KIAA1829 BINDING SITE, designated SEQ ID:31033, to the nucleotide sequence of VGAM2111 RNA, herein designated VGAM RNA, also designated SEQ ID:4822.

Another function of VGAM2111 is therefore inhibition of KIAA1829 (Accession XM_030378). Accordingly, utilities of VGAM2111 include diagnosis, prevention and treatment of diseases and clinical conditions associated with KIAA1829. KIAA1866 (Accession XM_027658) is another VGAM2111 host target gene. KIAA1866 BINDING SITE is HOST TARGET binding site found in the 3' untranslated region of mRNA encoded by KIAA1866, corresponding to a HOST TARGET binding site such as BINDING SITE I, BINDING SITE II or BINDING SITE III. Table 2 illustrates the complementarity of the nucleotide sequences of KIAA1866 BINDING SITE, designated SEQ ID:30556, to the nucleotide sequence of VGAM2111 RNA, herein designated VGAM RNA, also designated SEQ ID:4822.

Another function of VGAM2111 is therefore inhibition of KIAA1866 (Accession XM_027658). Accordingly, utilities of VGAM2111 include diagnosis, prevention and treatment of diseases and clinical conditions associated with KIAA1866. MBLL39 (Accession NM_144778) is another VGAM2111 host target gene. MBLL39 BINDING SITE is HOST TARGET binding site found in the 3' untranslated region of mRNA encoded by MBLL39, corresponding to a HOST TARGET binding site such as BINDING SITE I, BINDING SITE II or BINDING SITE III. Table 2 illustrates the complementarity of the nucleotide sequences of MBLL39 BINDING SITE, designated SEQ ID:29574, to the nucleotide sequence of VGAM2111 RNA, herein designated VGAM RNA, also designated SEQ ID:4822.

Another function of VGAM2111 is therefore inhibition of MBLL39 (Accession NM_144778). Accordingly, utilities of VGAM2111 include diagnosis, prevention and treatment of diseases and clinical conditions associated with MBLL39. MGC29891 (Accession NM_144618) is another VGAM2111 host target gene. MGC29891 BINDING SITE is HOST TARGET binding site found in the 3' untranslated region of mRNA encoded by MGC29891, corresponding to a HOST TARGET binding site such as BINDING SITE I, BINDING SITE II or BINDING SITE III. Table 2 illustrates the complementarity of the nucleotide sequences of MGC29891 BINDING SITE, designated SEQ ID:29436, to the nucleotide sequence of VGAM2111 RNA, herein designated VGAM RNA, also designated SEQ ID:4822.

Another function of VGAM2111 is therefore inhibition of MGC29891 (Accession NM_144618). Accordingly, utilities of VGAM2111 include diagnosis, prevention and treatment of diseases and clinical conditions associated with MGC29891. MOT8 (Accession NM_018836) is another VGAM2111 host target gene. MOT8 BINDING SITE is HOST TARGET binding site found in the 3' untranslated region of mRNA encoded by MOT8, corresponding to a HOST TARGET binding site such as BINDING SITE I, BINDING SITE II or BINDING SITE III. Table 2 illustrates the complementarity of the nucleotide sequences of MOT8 BINDING SITE, designated SEQ ID:20826, to the nucleotide sequence of VGAM2111 RNA, herein designated VGAM RNA, also designated SEQ ID:4822.

Another function of VGAM2111 is therefore inhibition of MOT8 (Accession NM_018836). Accordingly, utilities of VGAM2111 include diagnosis, prevention and treatment of diseases and clinical conditions associated with MOT8. ODZ2 (Accession XM_047995) is another VGAM2111 host target gene. ODZ2 BINDING SITE is HOST TARGET binding site found in the 3' untranslated region of mRNA encoded by ODZ2, corresponding to a HOST TARGET binding site such as BINDING SITE I, BINDING SITE II or BINDING SITE III. Table 2 illustrates the complementarity of the nucleotide sequences of ODZ2 BINDING SITE, designated SEQ ID:35095, to the nucleotide sequence of VGAM2111 RNA, herein designated VGAM RNA, also designated SEQ ID:4822.

Another function of VGAM2111 is therefore inhibition of ODZ2 (Accession XM_047995). Accordingly, utilities of VGAM2111 include diagnosis, prevention and treatment of diseases and clinical conditions associated with ODZ2. Proprotein Convertase Subtilisin/kexin Type 7 (PCSK7, Accession NM_004716) is another VGAM2111 host target gene. PCSK7 BINDING SITE is HOST TARGET binding site found in the 3' untranslated region of mRNA encoded by PCSK7, corresponding to a HOST TARGET binding site such as BINDING SITE I, BINDING SITE II or BINDING SITE III. Table 2 illustrates the complementarity of the nucleotide sequences of PCSK7 BINDING SITE, designated SEQ ID:11077, to the nucleotide sequence of VGAM2111 RNA, herein designated VGAM RNA, also designated SEQ ID:4822.

Another function of VGAM2111 is therefore inhibition of Proprotein Convertase Subtilisin/kexin Type 7 (PCSK7, Accession NM_004716). Accordingly, utilities of VGAM2111 include diagnosis, prevention and treatment of diseases and clinical conditions associated with PCSK7. Pleckstrin Homology Domain Containing, Family A (phosphoinositide binding specific) Member 3 (PLEKHA3, Accession NM_019091) is another VGAM2111 host target gene. PLEKHA3 BINDING SITE is HOST TARGET binding site found in the 3' untranslated region of mRNA encoded by PLEKHA3, corresponding to a HOST TARGET binding site such as BINDING SITE I, BINDING SITE II or BINDING SITE III. Table 2 illustrates the complementarity of the nucleotide sequences of PLEKHA3 BINDING SITE, designated SEQ ID:21166, to the nucleotide sequence of VGAM2111 RNA, herein designated VGAM RNA, also designated SEQ ID:4822.

Another function of VGAM2111 is therefore inhibition of Pleckstrin Homology Domain Containing, Family A (phosphoinositide binding specific) Member 3 (PLEKHA3, Accession NM_019091). Accordingly, utilities of VGAM2111 include diagnosis, prevention and treatment of diseases and clinical conditions associated with PLEKHA3. PRO0478 (Accession NM_014129) is another VGAM2111 host target gene. PRO0478 BINDING SITE is HOST TARGET binding site found in the 3' untranslated region of mRNA encoded by PRO0478, corresponding to a HOST TARGET binding site such as BINDING SITE I, BINDING SITE II or BINDING SITE III. Table 2 illustrates the complementarity of the nucleotide sequences of PRO0478 BINDING SITE, designated SEQ ID:15396, to the nucleotide sequence of VGAM2111 RNA, herein designated VGAM RNA, also designated SEQ ID:4822.

Another function of VGAM2111 is therefore inhibition of PRO0478 (Accession NM_014129). Accordingly, utilities of VGAM2111 include diagnosis, prevention and treatment of diseases and clinical conditions associated with PRO0478. RAB14, Member RAS Oncogene Family (RAB14, Accession NM_016322) is another VGAM2111 host target gene. RAB14 BINDING SITE is HOST TARGET binding site found in the 3' untranslated region of mRNA encoded by RAB14, corresponding to a HOST TARGET binding site such as BINDING SITE I, BINDING SITE II or BINDING SITE III. Table 2 illustrates the complementarity of the nucleotide sequences of RAB14 BINDING SITE, designated SEQ ID:18445, to the nucleotide sequence of VGAM2111 RNA, herein designated VGAM RNA, also designated SEQ ID:4822.

Another function of VGAM2111 is therefore inhibition of RAB14, Member RAS Oncogene Family (RAB14, Accession NM_016322). Accordingly, utilities of VGAM2111 include diagnosis, prevention and treatment of diseases and clinical conditions associated with RAB14. RICH1 (Accession NM_018054) is another VGAM2111 host target gene. RICH1 BINDING SITE is HOST TARGET binding site found in the 3' untranslated region of mRNA encoded by RICH1, corresponding to a HOST TARGET binding site such as BINDING SITE I, BINDING SITE II or BINDING SITE III. Table 2 illustrates the complementarity of the nucleotide sequences of RICH1 BINDING SITE, designated SEQ ID:19814, to the nucleotide sequence of VGAM2111 RNA, herein designated VGAM RNA, also designated SEQ ID:4822.

Another function of VGAM2111 is therefore inhibition of RICH1 (Accession NM_018054). Accordingly, utilities of VGAM2111 include diagnosis, prevention and treatment of diseases and clinical conditions associated with RICH1. Solute Carrier Family 11 (proton-coupled divalent metal ion transporters), Member 1 (SLC11A1, Accession XM_002585) is another VGAM2111 host target gene. SLC11A1 BINDING SITE is HOST TARGET binding site found in the 3' untranslated region of mRNA encoded by SLC11A1, corresponding to a HOST TARGET binding site such as BINDING SITE I, BINDING SITE II or BINDING SITE III. Table 2 illustrates the complementarity of the nucleotide sequences of SLC11A1 BINDING SITE, designated SEQ ID:29901, to the nucleotide sequence of VGAM2111 RNA, herein designated VGAM RNA, also designated SEQ ID:4822.

Another function of VGAM2111 is therefore inhibition of Solute Carrier Family 11 (proton-coupled divalent metal ion transporters), Member 1 (SLC11A1, Accession XM_002585). Accordingly, utilities of VGAM2111 include diagnosis, prevention and treatment of diseases and clinical conditions associated with SLC11A1. LOC125434 (Accession XM_058921) is another VGAM2111 host target gene. LOC125434 BINDING SITE is HOST TARGET binding site found in the 3' untranslated region of mRNA encoded by LOC125434, corresponding to a HOST TARGET binding site such as BINDING SITE I, BINDING SITE II or BINDING SITE III. Table 2 illustrates the complementarity of the nucleotide sequences of LOC125434 BINDING SITE, designated SEQ ID:36795, to the nucleotide sequence of VGAM2111 RNA, herein designated VGAM RNA, also designated SEQ ID:4822.

Another function of VGAM2111 is therefore inhibition of LOC125434 (Accession XM_058921). Accordingly, utilities of VGAM2111 include diagnosis, prevention and treatment of diseases and clinical conditions associated with LOC125434. LOC145945 (Accession XM_096908) is another VGAM2111 host target gene. LOC145945 BINDING SITE is HOST TARGET binding site found in the 5' untranslated region of mRNA encoded by LOC145945, corresponding to a HOST TARGET binding site such as BINDING SITE I, BINDING SITE II or BINDING SITE III. Table 2 illustrates the complementarity of the nucleotide sequences of LOC145945 BINDING SITE, designated SEQ ID:40627, to the nucleotide sequence of VGAM2111 RNA, herein designated VGAM RNA, also designated SEQ ID:4822.

Another function of VGAM2111 is therefore inhibition of LOC145945 (Accession XM_096908). Accordingly, utilities of VGAM2111 include diagnosis, prevention and treatment of diseases and clinical conditions associated with LOC145945. LOC146520 (Accession XM_085492) is another VGAM2111 host target gene. LOC146520 BINDING SITE is HOST TARGET binding site found in the 5' untranslated region of mRNA encoded by LOC146520, corresponding to a HOST TARGET binding site such as BINDING SITE I, BINDING SITE II or BINDING SITE III. Table 2 illustrates the complementarity of the nucleotide sequences of LOC146520 BINDING SITE, designated SEQ ID:38183, to the nucleotide sequence of VGAM2111 RNA, herein designated VGAM RNA, also designated SEQ ID:4822.

Another function of VGAM2111 is therefore inhibition of LOC146520 (Accession XM_085492). Accordingly, utilities of VGAM2111 include diagnosis, prevention and treatment of diseases and clinical conditions associated with LOC146520. LOC149127 (Accession XM_097584) is another VGAM2111 host target gene. LOC149127 BINDING SITE is HOST TARGET binding site found in the 5' untranslated region of mRNA encoded by LOC149127, corresponding to a HOST TARGET binding site such as BINDING SITE I, BINDING SITE II or BINDING SITE III. Table 2 illustrates the complementarity of the nucleotide sequences of LOC149127 BINDING SITE, designated SEQ ID:40951, to the nucleotide sequence of VGAM2111 RNA, herein designated VGAM RNA, also designated SEQ ID:4822.

Another function of VGAM2111 is therefore inhibition of LOC149127 (Accession XM_097584). Accordingly, utilities of VGAM2111 include diagnosis, prevention and treatment of diseases and clinical conditions associated with LOC149127. LOC158427 (Accession NM_139246) is another VGAM2111 host target gene. LOC158427 BINDING SITE is HOST TARGET binding site found in the 3' untranslated region of mRNA encoded by LOC158427, corresponding to a HOST TARGET binding site such as BINDING SITE I, BINDING SITE II or BINDING SITE III. Table 2 illustrates the complementarity of the nucleotide sequences of LOC158427 BINDING SITE, designated SEQ ID:29244, to the nucleotide sequence of VGAM2111 RNA, herein designated VGAM RNA, also designated SEQ ID:4822.

Another function of VGAM2111 is therefore inhibition of LOC158427 (Accession NM_139246). Accordingly, utilities of VGAM2111 include diagnosis, prevention and treatment of diseases and clinical conditions associated with LOC158427. LOC199858 (Accession XM_114040) is another VGAM2111 host target gene. LOC199858 BINDING SITE is HOST TARGET binding site found in the 3' untranslated region of mRNA encoded by LOC199858, corresponding to a HOST TARGET binding site such as BINDING SITE I, BINDING SITE II or BINDING SITE III. Table 2 illustrates the complementarity of the nucleotide sequences of LOC199858 BINDING SITE, designated SEQ ID:42628, to the nucleotide sequence of VGAM2111 RNA, herein designated VGAM RNA, also designated SEQ ID:4822.

Another function of VGAM2111 is therefore inhibition of LOC199858 (Accession XM_114040). Accordingly, utilities of VGAM2111 include diagnosis, prevention and treatment of diseases and clinical conditions associated with LOC199858. LOC199923 (Accession XM_114057) is another VGAM2111 host target gene. LOC199923 BINDING SITE1 and LOC199923 BINDING SITE2 are HOST TARGET binding sites found in untranslated regions of mRNA encoded by LOC199923, corresponding to HOST TARGET binding sites such as BINDING SITE I, BINDING SITE II or BINDING SITE III. Table 2 illustrates the complementarity of the nucleotide sequences of LOC199923 BINDING SITE1 and LOC199923 BINDING SITE2, designated SEQ ID:42663 and SEQ ID:42664 respectively, to the nucleotide sequence of VGAM2111 RNA, herein designated VGAM RNA, also designated SEQ ID:4822.

Another function of VGAM2111 is therefore inhibition of LOC199923 (Accession XM_114057). Accordingly, utilities of VGAM2111 include diagnosis, prevention and treatment of diseases and clinical conditions associated with LOC199923. LOC219672 (Accession XM_166111) is another VGAM2111 host target gene. LOC219672 BINDING SITE is HOST TARGET binding site found in the 5' untranslated region of mRNA encoded by LOC219672, corresponding to a HOST TARGET binding site such as BINDING SITE I, BINDING SITE II or BINDING SITE III. Table 2 illustrates the complementarity of the nucleotide sequences of LOC219672 BINDING SITE, designated SEQ ID:43887, to the nucleotide sequence of VGAM2111 RNA, herein designated VGAM RNA, also designated SEQ ID:4822.

Another function of VGAM2111 is therefore inhibition of LOC219672 (Accession XM_166111). Accordingly, utilities of VGAM2111 include diagnosis, prevention and treatment of diseases and clinical conditions associated with LOC219672. LOC221814 (Accession XM_168226) is another VGAM2111 host target gene. LOC221814 BINDING SITE is HOST TARGET binding site found in the 3' untranslated region of mRNA encoded by LOC221814, corresponding to a HOST TARGET binding site such as BINDING SITE I, BINDING SITE II or BINDING SITE III. Table 2 illustrates the complementarity of the nucleotide sequences of LOC221814 BINDING SITE, designated SEQ ID:45095, to the nucleotide sequence of VGAM2111 RNA, herein designated VGAM RNA, also designated SEQ ID:4822.

Another function of VGAM2111 is therefore inhibition of LOC221814 (Accession XM_168226). Accordingly, utilities of VGAM2111 include diagnosis, prevention and treatment of diseases and clinical conditions associated with LOC221814. LOC221943 (Accession XM_168343) is another VGAM2111 host target gene. LOC221943 BINDING SITE is HOST TARGET binding site found in the 5' untranslated region of mRNA encoded by LOC221943, corresponding to a HOST TARGET binding site such as BINDING SITE I, BINDING SITE II or BINDING SITE III. Table 2 illustrates the complementarity of the nucleotide sequences of LOC221943 BINDING SITE, designated SEQ ID:45115, to the nucleotide sequence of VGAM2111 RNA, herein designated VGAM RNA, also designated SEQ ID:4822.

Another function of VGAM2111 is therefore inhibition of LOC221943 (Accession XM_168343). Accordingly, utilities of VGAM2111 include diagnosis, prevention and treatment of diseases and clinical conditions associated with LOC221943. LOC253639 (Accession XM_171060) is another VGAM2111 host target gene. LOC253639 BINDING SITE is HOST TARGET binding site found in the 3' untranslated region of mRNA encoded by LOC253639, corresponding to a HOST TARGET binding site such as BINDING SITE I, BINDING SITE II or BINDING SITE III. Table 2 illustrates the complementarity of the nucleotide sequences of LOC253639 BINDING SITE, designated SEQ ID:45853, to the nucleotide sequence of VGAM2111 RNA, herein designated VGAM RNA, also designated SEQ ID:4822.

Another function of VGAM2111 is therefore inhibition of LOC253639 (Accession XM_171060). Accordingly, utilities of VGAM2111 include diagnosis, prevention and treatment of diseases and clinical conditions associated with LOC253639. LOC254659 (Accession XM_170822) is another VGAM2111 host target gene. LOC254659 BINDING SITE is HOST TARGET binding site found in the 5' untranslated region of mRNA encoded by LOC254659, corresponding to a HOST TARGET binding site such as BINDING SITE I, BINDING SITE II or BINDING SITE III. Table 2 illustrates the complementarity of the nucleotide sequences of LOC254659 BINDING SITE, designated SEQ ID:45598, to the nucleotide sequence of VGAM2111 RNA, herein designated VGAM RNA, also designated SEQ ID:4822.

Another function of VGAM2111 is therefore inhibition of LOC254659 (Accession XM_170822). Accordingly, utilities of VGAM2111 include diagnosis, prevention and treatment of diseases and clinical conditions associated with LOC254659. LOC51141 (Accession XM_043953) is another VGAM2111 host target gene. LOC51141 BINDING SITE is HOST TARGET binding site found in the 3' untranslated region of mRNA encoded by LOC51141, corresponding to a HOST TARGET binding site such as BINDING SITE I, BINDING SITE II or BINDING SITE III. Table 2 illustrates the complementarity of the nucleotide sequences of LOC51141 BINDING SITE, designated SEQ ID:34045, to the nucleotide sequence of VGAM2111 RNA, herein designated VGAM RNA, also designated SEQ ID:4822.

Another function of VGAM2111 is therefore inhibition of LOC51141 (Accession XM_043953). Accordingly, utilities of VGAM2111 include diagnosis, prevention and treatment of diseases and clinical conditions associated with LOC51141. LOC56920 (Accession NM_020163) is another VGAM2111 host target gene. LOC56920 BINDING SITE is HOST TARGET binding site found in the 3' untranslated region of mRNA encoded by LOC56920, corresponding to a HOST TARGET binding site such as BINDING SITE I, BINDING SITE II or BINDING SITE III. Table 2 illustrates the complementarity of the nucleotide sequences of LOC56920 BINDING SITE, designated SEQ ID:21379, to the nucleotide sequence of VGAM2111 RNA, herein designated VGAM RNA, also designated SEQ ID:4822.

Another function of VGAM2111 is therefore inhibition of LOC56920 (Accession NM_020163). Accordingly, utilities of VGAM2111 include diagnosis, prevention and treatment of diseases and clinical conditions associated with LOC56920. LOC90155 (Accession XM_029487) is another VGAM2111 host target gene. LOC90155 BINDING SITE is HOST TARGET binding site found in the 5' untranslated region of mRNA encoded by LOC90155, corresponding to a HOST TARGET binding site such as BINDING SITE I, BINDING SITE II or BINDING SITE III. Table 2 illustrates the complementarity of the nucleotide sequences of LOC90155 BINDING SITE, designated SEQ ID:30898, to the nucleotide sequence of VGAM2111 RNA, herein designated VGAM RNA, also designated SEQ ID:4822.

Another function of VGAM2111 is therefore inhibition of LOC90155 (Accession XM_029487). Accordingly, utilities of VGAM2111 include diagnosis, prevention and treatment of diseases and clinical conditions associated with LOC90155. LOC91496 (Accession XM_038788) is another VGAM2111 host target gene. LOC91496 BINDING SITE is HOST TARGET binding site found in the 5' untranslated region of mRNA encoded by LOC91496, corresponding to a HOST TARGET binding site such as BINDING SITE I, BINDING SITE II or BINDING SITE III. Table 2 illustrates the complementarity of the nucleotide sequences of LOC91496 BINDING SITE, designated SEQ ID:32919, to the nucleotide sequence of VGAM2111 RNA, herein designated VGAM RNA, also designated SEQ ID:4822.

Another function of VGAM2111 is therefore inhibition of LOC91496 (Accession XM_038788). Accordingly, utilities of VGAM2111 include diagnosis, prevention and treatment of diseases and clinical conditions associated with LOC91496. LOC92973 (Accession XM_048529) is another VGAM2111 host target gene. LOC92973 BINDING SITE is HOST TARGET binding site found in the 5' untranslated region of mRNA encoded by LOC92973, corresponding to a HOST TARGET binding site such as BINDING SITE I, BINDING SITE II or BINDING SITE III. Table 2 illustrates the complementarity of the nucleotide sequences of LOC92973 BINDING SITE, designated SEQ ID:35180, to the nucleotide sequence of VGAM2111 RNA, herein designated VGAM RNA, also designated SEQ ID:4822.

Another function of VGAM2111 is therefore inhibition of LOC92973 (Accession XM_048529). Accordingly, utilities of VGAM2111 include diagnosis, prevention and treatment of diseases and clinical conditions associated with LOC92973. FIG. 1 further provides a conceptual description of a novel bioinformatically detected viral gene of the present invention, referred to here as Viral Genomic Address Messenger 2112 (VGAM2112) viral gene, which modulates expression of respective host target genes thereof, the function and utility of which host target genes is known in the art.

VGAM2112 is a novel bioinformatically detected regulatory, non protein coding, viral micro RNA (miRNA) gene. The method by which VGAM2112 was detected is described hereinabove with reference to FIGS. 1-8.

VGAM2112 gene, herein designated VGAM GENE, is a viral gene contained in the genome of Grapevine Chrome Mosaic Virus. VGAM2112 host target gene, herein designated VGAM HOST TARGET GENE, is a human gene contained in the human genome.

VGAM2112 gene encodes a VGAM2112 precursor RNA, herein designated VGAM PRECURSOR RNA. Similar to other miRNA genes, and unlike most ordinary genes, VGAM2112 precursor RNA does not encode a protein. A nucleotide sequence identical or highly similar to the nucleotide sequence of VGAM2112 precursor RNA is designated SEQ ID:2098, and is provided hereinbelow with reference to the sequence listing part. Nucleotide sequence SEQ ID:2098 is located at position 1230 relative to the genome of Grapevine Chrome Mosaic Virus.

VGAM2112 precursor RNA folds onto itself, forming VGAM2112 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2112 folded precursor RNA into VGAM2112 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM2112 RNA is designated SEQ ID:4823, and is provided hereinbelow with reference to the sequence listing part.

VGAM2112 host target gene, herein designated VGAM HOST TARGET GENE, encodes a corresponding messenger RNA, VGAM2112 host target RNA, herein designated VGAM HOST TARGET RNA. VGAM2112 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2112 RNA, herein designated VGAM RNA, binds complementarily to one or more host target binding sites located in untranslated regions of VGAM2112 host target RNA, herein designated VGAM HOST TARGET RNA. This complementary binding is due to the fact that the nucleotide sequence of VGAM2112 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2112 RNA, herein designated VGAM RNA, may have a different number of host target binding sites in untranslated regions of a VGAM2112 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2112 RNA, herein designated VGAM RNA, to host target binding sites on VGAM2112 host target RNA, herein designated VGAM HOST TARGET RNA, such as BINDING SITE I, BINDING SITE II and BINDING SITE III, inhibits translation of VGAM2112 host target RNA into VGAM2112 host target protein, herein designated VGAM HOST TARGET PROTEIN. VGAM host target protein is therefore outlined by a broken line.

It is appreciated that VGAM2112 host target gene, herein designated VGAM HOST TARGET GENE, in fact represents a plurality of VGAM2112 host target genes. The mRNA of each one of this plurality of VGAM2112 host target genes comprises one or more host target binding sites, each having a nucleotide sequence which is at least partly complementary to VGAM2112 RNA, herein designated VGAM RNA, and which when bound by VGAM2112 RNA causes inhibition of translation of respective one or more VGAM2112 host target proteins.

It is further appreciated by one skilled in the art that the mode of translational inhibition illustrated by FIG. 1 with specific reference to translational inhibition exerted by VGAM2112 gene, herein designated VGAM GENE, on one or more VGAM2112 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2112 is inhibition of expression of host target genes, as part of a novel viral mechanism of attacking a host. Accordingly, utilities of VGAM2112 include diagnosis, prevention and treatment of viral infection by Grapevine Chrome Mosaic Virus. Specific functions, and accordingly utilities, of VGAM2112 correlate with, and may be deduced from, the identity of the host target genes which VGAM2112 binds and inhibits, and the function of these host target genes, as elaborated hereinbelow.

Nucleotide sequences of the VGAM2112 precursor RNA, herein designated VGAM PRECURSOR RNA, and of the 'diced' VGAM2112 RNA, herein designated VGAM RNA, and a schematic representation of the secondary folding of VGAM2112 folded precursor RNA, herein designated VGAM FOLDED PRECURSOR RNA, of VGAM2112 are further described hereinbelow with reference to Table 1.

Nucleotide sequences of host target binding sites, such as BINDING SITE-I, BINDING SITE-II and BINDING SITE-III of FIG. 1, found on VGAM2112 host target RNA, and schematic representation of the complementarity of each of these host target binding sites to VGAM2112 RNA, herein designated VGAM RNA, are described hereinbelow with reference to Table 2.

As mentioned hereinabove with reference to FIG. 1, a function of VGAM2112 gene, herein designated VGAM is inhibition of expression of VGAM2112 target genes. It is appreciated that specific functions, and accordingly utilities, of VGAM2112 correlate with, and may be deduced from, the identity of the target genes which VGAM2112 binds and inhibits, and the function of these target genes, as elaborated hereinbelow.

Estrogen Receptor 1 (ESR1, Accession NM_000125) is a VGAM2112 host target gene. ESR1 BINDING SITE is HOST TARGET binding site found in the 3' untranslated region of mRNA encoded by ESR1, corresponding to a HOST TARGET binding site such as BINDING SITE I, BINDING SITE II or BINDING SITE III. Table 2 illustrates the complementarity of the nucleotide sequences of ESR1 BINDING SITE, designated SEQ ID:5600, to the nucleotide sequence of VGAM2112 RNA, herein designated VGAM RNA, also designated SEQ ID:4823.

A function of VGAM2112 is therefore inhibition of Estrogen Receptor 1 (ESR1, Accession NM_000125), a gene which involved in hormone-mediated inhibition of gene expression. Accordingly, utilities of VGAM2112 include diagnosis, prevention and treatment of diseases and clinical conditions associated with ESR1. The function of ESR1 and its association with various diseases and clinical conditions, has been established by previous studies, as described hereinabove with reference to VGAM695. Polycystic Kidney Disease 2-like 1 (PKD2L1, Accession NM_016112) is another VGAM2112 host target gene. PKD2L1 BINDING SITE is HOST TARGET binding site found in the 5' untranslated region of mRNA encoded by PKD2L1, corresponding to a HOST TARGET binding site such as BINDING SITE I, BINDING SITE II or BINDING SITE III. Table 2 illustrates the complementarity of the nucleotide sequences of PKD2L1 BINDING SITE, designated SEQ ID:18194, to the nucleotide sequence of VGAM2112 RNA, herein designated VGAM RNA, also designated SEQ ID:4823.

Another function of VGAM2112 is therefore inhibition of Polycystic Kidney Disease 2-like 1 (PKD2L1, Accession NM_016112). Accordingly, utilities of VGAM2112 include diagnosis, prevention and treatment of diseases and clinical conditions associated with PKD2L1. CGG Triplet Repeat Binding Protein 1 (CGGBP1, Accession NM_003663) is another VGAM2112 host target gene. CGGBP1 BINDING SITE is HOST TARGET binding site found in the 3' untranslated region of mRNA encoded by CGGBP1, corresponding to a HOST TARGET binding site such as BINDING SITE I, BINDING SITE II or BINDING SITE III. Table 2 illustrates the complementarity of the nucleotide sequences of CGGBP1 BINDING SITE, designated SEQ ID:9739, to the nucleotide sequence of VGAM2112 RNA, herein designated VGAM RNA, also designated SEQ ID:4823.

Another function of VGAM2112 is therefore inhibition of CGG Triplet Repeat Binding Protein 1 (CGGBP1, Accession NM_003663). Accordingly, utilities of VGAM2112 include diagnosis, prevention and treatment of diseases and clinical conditions associated with CGGBP1. VRP (Accession NM_007063) is another VGAM2112 host target gene. VRP BINDING SITE is HOST TARGET binding site found in the 5' untranslated region of mRNA encoded by VRP, corresponding to a HOST TARGET binding site such as BINDING SITE I, BINDING SITE II or BINDING SITE III. Table 2 illustrates the complementarity of the nucleotide sequences of VRP BINDING SITE, designated SEQ ID:13927, to the nucleotide sequence of VGAM2112 RNA, herein designated VGAM RNA, also designated SEQ ID:4823.

Another function of VGAM2112 is therefore inhibition of VRP (Accession NM_007063). Accordingly, utilities of VGAM2112 include diagnosis, prevention and treatment of diseases and clinical conditions associated with VRP. LOC155382 (Accession XM_098713) is another VGAM2112 host target gene. LOC155382 BINDING SITE is HOST TARGET binding site found in the 3' untranslated region of mRNA encoded by LOC155382, corresponding to a HOST TARGET binding site such as BINDING SITE I, BINDING SITE II or BINDING SITE III. Table 2 illustrates the complementarity of the nucleotide sequences of LOC155382 BINDING SITE, designated SEQ ID:41763, to the nucleotide sequence of VGAM2112 RNA, herein designated VGAM RNA, also designated SEQ ID:4823.

Another function of VGAM2112 is therefore inhibition of LOC155382 (Accession XM_098713). Accordingly, utilities of VGAM2112 include diagnosis, prevention and treatment of diseases and clinical conditions associated with LOC155382. FIG. 1 further provides a conceptual description of a novel bioinformatically detected viral gene of the present invention, referred to here as Viral Genomic Address Messenger 2113 (VGAM2113) viral gene, which modulates expression of respective host target genes thereof, the function and utility of which host target genes is known in the art.

VGAM2113 is a novel bioinformatically detected regulatory, non protein coding, viral micro RNA (miRNA) gene. The method by which VGAM2113 was detected is described hereinabove with reference to FIGS. 1-8.

VGAM2113 gene, herein designated VGAM GENE, is a viral gene contained in the genome of Sheeppox Virus. VGAM2113 host target gene, herein designated VGAM HOST TARGET GENE, is a human gene contained in the human genome.

VGAM2113 gene encodes a VGAM2113 precursor RNA, herein designated VGAM PRECURSOR RNA. Similar to other miRNA genes, and unlike most ordinary genes, VGAM2113 precursor RNA does not encode a protein. A nucleotide sequence identical or highly similar to the nucleotide sequence of VGAM2113 precursor RNA is designated SEQ ID:2099, and is provided hereinbelow with reference to the sequence listing part. Nucleotide sequence SEQ ID:2099 is located at position 7750 relative to the genome of Sheeppox Virus.

VGAM2113 precursor RNA folds onto itself, forming VGAM2113 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2113 folded precursor RNA into VGAM2113 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2113 RNA is designated SEQ ID:4824, and is provided hereinbelow with reference to the sequence listing part.

VGAM2113 host target gene, herein designated VGAM HOST TARGET GENE, encodes a corresponding messenger RNA, VGAM2113 host target RNA, herein designated VGAM HOST TARGET RNA. VGAM2113 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2113 RNA, herein designated VGAM RNA, binds complementarily to one or more host target binding sites located in untranslated regions of VGAM2113 host target RNA, herein designated VGAM HOST TARGET RNA. This complementary binding is due to the fact that the nucleotide sequence of VGAM2113 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2113 RNA, herein designated VGAM RNA, may have a different number of host target binding sites in untranslated regions of a VGAM2113 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2113 RNA, herein designated VGAM RNA, to host target binding sites on VGAM2113 host target RNA, herein designated VGAM HOST TARGET RNA, such as BINDING SITE I, BINDING SITE II and BINDING SITE III, inhibits translation of VGAM2113 host target RNA into VGAM2113 host target protein, herein designated VGAM HOST TARGET PROTEIN. VGAM host target protein is therefore outlined by a broken line.

It is appreciated that VGAM2113 host target gene, herein designated VGAM HOST TARGET GENE, in fact represents a plurality of VGAM2113 host target genes. The mRNA of each one of this plurality of VGAM2113 host target genes comprises one or more host target binding sites, each having a nucleotide sequence which is at least partly complementary to VGAM2113 RNA, herein designated VGAM RNA, and which when bound by VGAM2113 RNA causes inhibition of translation of respective one or more VGAM2113 host target proteins.

It is further appreciated by one skilled in the art that the mode of translational inhibition illustrated by FIG. 1 with specific reference to translational inhibition exerted by VGAM2113 gene, herein designated VGAM GENE, on one or more VGAM2113 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2113 is inhibition of expression of host target genes, as part of a novel viral mechanism of attacking a host. Accordingly, utilities of VGAM2113 include diagnosis, prevention and treatment of viral infection by Sheeppox Virus. Specific functions, and accordingly utilities, of VGAM2113 correlate with, and may be deduced from, the identity of the host target genes which VGAM2113 binds and inhibits, and the function of these host target genes, as elaborated hereinbelow.

Nucleotide sequences of the VGAM2113 precursor RNA, herein designated VGAM PRECURSOR RNA, and of the 'diced' VGAM2113 RNA, herein designated VGAM RNA, and a schematic representation of the secondary folding of VGAM2113 folded precursor RNA, herein designated VGAM FOLDED PRECURSOR RNA, of VGAM2113 are further described hereinbelow with reference to Table 1.

Nucleotide sequences of host target binding sites, such as BINDING SITE-I, BINDING SITE-II and BINDING SITE-III of FIG. 1, found on VGAM2113 host target RNA, and schematic representation of the complementarity of each of these host target binding sites to VGAM2113 RNA, herein designated VGAM RNA, are described hereinbelow with reference to Table 2.

As mentioned hereinabove with reference to FIG. 1, a function of VGAM2113 gene, herein designated VGAM is inhibition of expression of VGAM2113 target genes. It is appreciated that specific functions, and accordingly utilities, of VGAM2113 correlate with, and may be deduced from, the identity of the target genes which VGAM2113 binds and inhibits, and the function of these target genes, as elaborated hereinbelow.

ATP-binding Cassette, Sub-family D (ALD), Member 4 (ABCD4, Accession NM_020325) is a VGAM2113 host target gene. ABCD4 BINDING SITE is HOST TARGET binding site found in the 3' untranslated region of mRNA encoded by ABCD4, corresponding to a HOST TARGET binding site such as BINDING SITE I, BINDING SITE II or BINDING SITE III. Table 2 illustrates the complementarity of the nucleotide sequences of ABCD4 BINDING SITE, designated SEQ ID:21586, to the nucleotide sequence of VGAM2113 RNA, herein designated VGAM RNA, also designated SEQ ID:4824.

A function of VGAM2113 is therefore inhibition of ATP-binding Cassette, Sub-family D (ALD), Member 4 (ABCD4, Accession NM_020325), a gene which Putative peroxisomal ATP binding cassette transporter. Accordingly, utilities of VGAM2113 include diagnosis, prevention and treatment of diseases and clinical conditions associated with ABCD4. The function of ABCD4 and its association with various diseases and clinical conditions, has been established by previous studies, as described hereinabove with reference to VGAM1924. Eukaryotic Translation Initiation Factor 2C, 1 (EIF2C1, Accession NM_012199) is another VGAM2113 host target gene. EIF2C1 BINDING SITE is HOST TARGET binding site found in the 3' untranslated region of mRNA encoded by EIF2C1, corresponding to a HOST TARGET binding site such as BINDING SITE I, BINDING SITE II or BINDING SITE III. Table 2 illustrates the complementarity of the nucleotide sequences of EIF2C1 BINDING SITE, designated SEQ ID:14503, to the nucleotide sequence of VGAM2113 RNA, herein designated VGAM RNA, also designated SEQ ID:4824.

Another function of VGAM2113 is therefore inhibition of Eukaryotic Translation Initiation Factor 2C, 1 (EIF2C1, Accession NM_012199), a gene which plays an important role in the eukaryotic peptide chain initiation process. Accordingly, utilities of VGAM2113 include diagnosis, prevention and treatment of diseases and clinical conditions associated with EIF2C1. The function of EIF2C1 and its association with various diseases and clinical conditions, has been established by previous studies, as described hereinabove with reference to VGAM118. Oculocerebrorenal Syndrome of Lowe (OCRL, Accession NM_001587) is another VGAM2113 host target gene. OCRL BINDING SITE1 and OCRL BINDING SITE2 are HOST TARGET binding sites found in untranslated regions of mRNA encoded by OCRL, corresponding to HOST TARGET binding sites such as BINDING SITE I, BINDING SITE II or BINDING SITE III. Table 2 illustrates the complementarity of the nucleotide sequences of OCRL BINDING SITE1 and OCRL BINDING SITE2, designated SEQ ID:7308 and SEQ ID:5821 respectively, to the nucleotide sequence of VGAM2113 RNA, herein designated VGAM RNA, also designated SEQ ID:4824.

Another function of VGAM2113 is therefore inhibition of Oculocerebrorenal Syndrome of Lowe (OCRL, Accession NM_001587). Accordingly, utilities of VGAM2113 include diagnosis, prevention and treatment of diseases and clinical conditions associated with OCRL. SRY (sex determining region Y)-box 9 (campomelic dysplasia, autosomal sex-reversal) (SOX9, Accession NM_000346) is another VGAM2113 host target gene. SOX9 BINDING SITE is HOST TARGET binding site found in the 3' untranslated region of mRNA encoded by SOX9, corresponding to a HOST TARGET binding site such as BINDING SITE I, BINDING SITE II or BINDING SITE III. Table 2 illustrates the complementarity of the nucleotide sequences of SOX9 BINDING SITE, designated SEQ ID:5902, to the nucleotide sequence of VGAM2113 RNA, herein designated VGAM RNA, also designated SEQ ID:4824.

Another function of VGAM2113 is therefore inhibition of SRY (sex determining region Y)-box 9 (campomelic dysplasia, autosomal sex-reversal) (SOX9, Accession NM_000346), a gene which regulates the expression of other genes involved in chondrogenesis. Accordingly, utilities of VGAM2113 include diagnosis, prevention and treatment of diseases and clinical conditions associated with SOX9. The function of SOX9 and its association with various diseases and clinical conditions, has been established by previous studies, as described hereinabove with reference to VGAM329. FLJ20211 (Accession NM_017713) is another VGAM2113 host target gene. FLJ20211 BINDING SITE is HOST TARGET binding site found in the 3' untranslated region of mRNA encoded by FLJ20211, corresponding to a HOST TARGET binding site such as BINDING SITE I, BINDING SITE II or BINDING SITE III. Table 2 illustrates the complementarity of the nucleotide sequences of FLJ20211 BINDING SITE, designated SEQ ID:19295, to the nucleotide sequence of VGAM2113 RNA, herein designated VGAM RNA, also designated SEQ ID:4824.

Another function of VGAM2113 is therefore inhibition of FLJ20211 (Accession NM_017713). Accordingly, utilities of VGAM2113 include diagnosis, prevention and treatment of diseases and clinical conditions associated with FLJ20211. FLJ20574 (Accession NM_017886) is another VGAM2113 host target gene. FLJ20574 BINDING SITE is HOST TARGET binding site found in the 3' untranslated region of mRNA encoded by FLJ20574, corresponding to a HOST TARGET binding site such as BINDING SITE I, BINDING SITE II or BINDING SITE III. Table 2 illustrates the complementarity of the nucleotide sequences of FLJ20574 BINDING SITE, designated SEQ ID:19554, to the nucleotide sequence of VGAM2113 RNA, herein designated VGAM RNA, also designated SEQ ID:4824.

Another function of VGAM2113 is therefore inhibition of FLJ20574 (Accession NM_017886). Accordingly, utilities of VGAM2113 include diagnosis, prevention and treatment of diseases and clinical conditions associated with FLJ20574. JM11 (Accession NM_033626) is another VGAM2113 host target gene. JM11 BINDING SITE is HOST TARGET binding site found in the 3' untranslated region of mRNA encoded by JM11, corresponding to a HOST TARGET binding site such as BINDING SITE I, BINDING SITE II or BINDING SITE III. Table 2 illustrates the complementarity of the nucleotide sequences of JM11 BINDING SITE, designated SEQ ID:27332, to the nucleotide sequence of VGAM2113 RNA, herein designated VGAM RNA, also designated SEQ ID:4824.

Another function of VGAM2113 is therefore inhibition of JM11 (Accession NM_033626). Accordingly, utilities of VGAM2113 include diagnosis, prevention and treatment of diseases and clinical conditions associated with JM11. KIAA0247 (Accession NM_014734) is another VGAM2113 host target gene. KIAA0247 BINDING SITE is HOST TARGET binding site found in the 3' untranslated region of mRNA encoded by KIAA0247, corresponding to a HOST TARGET binding site such as BINDING SITE I, BINDING SITE II or BINDING SITE III. Table 2 illustrates the complementarity of the nucleotide sequences of KIAA0247 BINDING SITE, designated SEQ ID:16380, to the nucleotide sequence of VGAM2113 RNA, herein designated VGAM RNA, also designated SEQ ID:4824.

Another function of VGAM2113 is therefore inhibition of KIAA0247 (Accession NM_014734). Accordingly, utilities of VGAM2113 include diagnosis, prevention and treatment of diseases and clinical conditions associated with KIAA0247. KIAA1024 (Accession XM_044580) is another VGAM2113 host target gene. KIAA1024 BINDING SITE is HOST TARGET binding site found in the 3' untranslated region of mRNA encoded by KIAA1024, corresponding to a HOST TARGET binding site such as BINDING SITE I, BINDING SITE II or BINDING SITE III. Table 2 illustrates the complementarity of the nucleotide sequences of KIAA1024 BINDING SITE, designated SEQ ID:34237, to the nucleotide sequence of VGAM2113 RNA, herein designated VGAM RNA, also designated SEQ ID:4824.

Another function of VGAM2113 is therefore inhibition of KIAA1024 (Accession XM_044580). Accordingly, utilities of VGAM2113 include diagnosis, prevention and treatment of diseases and clinical conditions associated with KIAA1024. KIAA1819 (Accession XM_045716) is another VGAM2113 host target gene. KIAA1819 BINDING SITE is HOST TARGET binding site found in the 5' untranslated region of mRNA encoded by KIAA1819, corresponding to a HOST TARGET binding site such as BINDING SITE I, BINDING SITE II or BINDING SITE III. Table 2 illustrates the complementarity of the nucleotide sequences of KIAA1819 BINDING SITE, designated SEQ ID:34534, to the nucleotide sequence of VGAM2113 RNA, herein designated VGAM RNA, also designated SEQ ID:4824.

Another function of VGAM2113 is therefore inhibition of KIAA1819 (Accession XM_045716). Accordingly, utilities of VGAM2113 include diagnosis, prevention and treatment of diseases and clinical conditions associated with KIAA1819. MEGF10 (Accession NM_032446) is another VGAM2113 host target gene. MEGF10 BINDING SITE is HOST TARGET binding site found in the 3' untranslated region of mRNA encoded by MEGF10, corresponding to a HOST TARGET binding site such as BINDING SITE I, BINDING SITE II or BINDING SITE III. Table 2 illustrates the complementarity of the nucleotide sequences of MEGF10 BINDING SITE, designated SEQ ID:26211, to the nucleotide sequence of VGAM2113 RNA, herein designated VGAM RNA, also designated SEQ ID:4824.

Another function of VGAM2113 is therefore inhibition of MEGF10 (Accession NM_032446). Accordingly, utilities of VGAM2113 include diagnosis, prevention and treatment of diseases and clinical conditions associated with MEGF10. FIG. 1 further provides a conceptual description of a novel bioinformatically detected viral gene of the present invention, referred to here as Viral Genomic Address Messenger 2114 (VGAM2114) viral gene, which modulates expression of respective host target genes thereof, the function and utility of which host target genes is known in the art.

VGAM2114 is a novel bioinformatically detected regulatory, non protein coding, viral micro RNA (miRNA) gene. The method by which VGAM2114 was detected is described hereinabove with reference to FIGS. 1-8.

VGAM2114 gene, herein designated VGAM GENE, is a viral gene contained in the genome of Cowpox Virus. VGAM2114 host target gene, herein designated VGAM HOST TARGET GENE, is a human gene contained in the human genome.

VGAM2114 gene encodes a VGAM2114 precursor RNA, herein designated VGAM PRECURSOR RNA. Similar to other miRNA genes, and unlike most ordinary genes, VGAM2114 precursor RNA does not encode a protein. A nucleotide sequence identical or highly similar to the nucleotide sequence of VGAM2114 precursor RNA is designated SEQ ID:2100, and is provided hereinbelow with reference to the sequence listing part. Nucleotide sequence SEQ ID:2100 is located at position 9163 relative to the genome of Cowpox Virus.

VGAM2114 precursor RNA folds onto itself, forming VGAM2114 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2114 folded precursor RNA into VGAM2114 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM2114 RNA is designated SEQ ID:4825, and is provided hereinbelow with reference to the sequence listing part.

VGAM2114 host target gene, herein designated VGAM HOST TARGET GENE, encodes a corresponding messenger RNA, VGAM2114 host target RNA, herein designated VGAM HOST TARGET RNA. VGAM2114 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2114 RNA, herein designated VGAM RNA, binds complementarily to one or more host target binding sites located in untranslated regions of VGAM2114 host target RNA, herein designated VGAM HOST TARGET RNA. This complementary binding is due to the fact that the nucleotide sequence of VGAM2114 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2114 RNA, herein designated VGAM RNA, may have a different number of host target binding sites in untranslated regions of a VGAM2114 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2114 RNA, herein designated VGAM RNA, to host target binding sites on VGAM2114 host target RNA, herein designated VGAM HOST TARGET RNA, such as BINDING SITE I, BINDING SITE II and BINDING SITE III, inhibits translation of VGAM2114 host target RNA into VGAM2114 host target protein, herein designated VGAM HOST TARGET PROTEIN. VGAM host target protein is therefore outlined by a broken line.

It is appreciated that VGAM2114 host target gene, herein designated VGAM HOST TARGET GENE, in fact represents a plurality of VGAM2114 host target genes. The mRNA of each one of this plurality of VGAM2114 host target genes comprises one or more host target binding sites, each having a nucleotide sequence which is at least partly complementary to VGAM2114 RNA, herein designated VGAM RNA, and which when bound by VGAM2114 RNA causes inhibition of translation of respective one or more VGAM2114 host target proteins.

It is further appreciated by one skilled in the art that the mode of translational inhibition illustrated by FIG. 1 with specific reference to translational inhibition exerted by VGAM2114 gene, herein designated VGAM GENE, on one or more VGAM2114 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2114 is inhibition of expression of host target genes, as part of a novel viral mechanism of attacking a host. Accordingly, utilities of VGAM2114 include diagnosis, prevention and treatment of viral infection by Cowpox Virus. Specific functions, and accordingly utilities, of VGAM2114 correlate with, and may be deduced from, the identity of the host target genes which VGAM2114 binds and inhibits, and the function of these host target genes, as elaborated hereinbelow.

Nucleotide sequences of the VGAM2114 precursor RNA, herein designated VGAM PRECURSOR RNA, and of the 'diced' VGAM2114 RNA, herein designated VGAM RNA, and a schematic representation of the secondary folding of VGAM2114 folded precursor RNA, herein designated VGAM FOLDED PRECURSOR RNA, of VGAM2114 are further described hereinbelow with reference to Table 1.

Nucleotide sequences of host target binding sites, such as BINDING SITE-I, BINDING SITE-II and BINDING SITE-III of FIG. 1, found on VGAM2114 host target RNA, and schematic representation of the complementarity of each of these host target binding sites to VGAM2114 RNA, herein designated VGAM RNA, are described hereinbelow with reference to Table 2.

As mentioned hereinabove with reference to FIG. 1, a function of VGAM2114 gene, herein designated VGAM is inhibition of expression of VGAM2114 target genes. It is appreciated that specific functions, and accordingly utilities, of VGAM2114 correlate with, and may be deduced from, the identity of the target genes which VGAM2114 binds and inhibits, and the function of these target genes, as elaborated hereinbelow.

Mitogen-activated Protein Kinase 9 (MAPK9, Accession NM_002752) is a VGAM2114 host target gene. MAPK9 BINDING SITE1 through MAPK9 BINDING SITE4 are HOST TARGET binding sites found in untranslated regions of mRNA encoded by MAPK9, corresponding to HOST TARGET binding sites such as BINDING SITE I, BINDING SITE II or BINDING SITE III. Table 2 illustrates the complementarity of the nucleotide sequences of MAPK9 BINDING SITE1 through MAPK9 BINDING SITE4, designated SEQ ID:8631, SEQ ID:29136, SEQ ID:29138 and SEQ ID:29140 respectively, to the nucleotide sequence of VGAM2114 RNA, herein designated VGAM RNA, also designated SEQ ID:4825.

A function of VGAM2114 is therefore inhibition of Mitogen-activated Protein Kinase 9 (MAPK9, Accession NM_002752), a gene which Member of the MAP kinase family, regulates c-Jun in response to proinflammatory cytokines and UV irradiation. Accordingly, utilities of VGAM2114 include diagnosis, prevention and treatment of diseases and clinical conditions associated with MAPK9. The function of MAPK9 and its association with various diseases and clinical conditions, has been established by previous studies, as described hereinabove with reference to VGAM1958. Parkinson Disease (autosomal recessive, juvenile) 2, Parkin (PARK2, Accession NM_013987) is another VGAM2114 host target gene. PARK2 BINDING SITE1 through PARK2 BINDING SITE3 are HOST TARGET binding sites found in untranslated regions of mRNA encoded by PARK2, corresponding to HOST TARGET binding sites such as BINDING SITE I, BINDING SITE II or BINDING SITE III. Table 2 illustrates the complementarity of the nucleotide sequences of PARK2 BINDING SITE1 through PARK2 BINDING SITE3, designated SEQ ID:15153, SEQ ID:15160 and SEQ ID:8543 respectively, to the nucleotide sequence of VGAM2114 RNA, herein designated VGAM RNA, also designated SEQ ID:4825.

Another function of VGAM2114 is therefore inhibition of Parkinson Disease (autosomal recessive, juvenile) 2, Parkin (PARK2, Accession NM_013987). Accordingly, utilities of VGAM2114 include diagnosis, prevention and treatment of diseases and clinical conditions associated with PARK2. RAD52 Homolog (S. cerevisiae) (RAD52, Accession NM_134422) is another VGAM2114 host target gene. RAD52 BINDING SITE is HOST TARGET binding site found in the 3' untranslated region of mRNA encoded by RAD52, corresponding to a HOST TARGET binding site such as BINDING SITE I, BINDING SITE II or BINDING SITE III. Table 2 illustrates the complementarity of the nucleotide sequences of RAD52 BINDING SITE, designated SEQ ID:28643, to the nucleotide sequence of VGAM2114 RNA, herein designated VGAM RNA, also designated SEQ ID:4825.

Another function of VGAM2114 is therefore inhibition of RAD52 Homolog (S. cerevisiae) (RAD52, Accession NM_134422). Accordingly, utilities of VGAM2114 include diagnosis, prevention and treatment of diseases and clinical conditions associated with RAD52. Supervillin (SVIL, Accession NM_021738) is another VGAM2114 host target gene. SVIL BINDING SITE1 and SVIL BINDING SITE2 are HOST TARGET binding sites found in untranslated regions of mRNA encoded by SVIL, corresponding to HOST TARGET binding sites such as BINDING SITE I, BINDING SITE II or BINDING SITE III. Table 2 illustrates the complementarity of the nucleotide sequences of SVIL BINDING SITE1 and SVIL BINDING SITE2, designated SEQ ID:22345 and SEQ ID:9148 respectively, to the nucleotide sequence of VGAM2114 RNA, herein designated VGAM RNA, also designated SEQ ID:4825.

Another function of VGAM2114 is therefore inhibition of Supervillin (SVIL, Accession NM_021738), a gene which binds actin, links filamentous actin with the plasma membrane; and contains putative nuclear localization signals. Accordingly, utilities of VGAM2114 include diagnosis, prevention and treatment of diseases and clinical conditions associated with SVIL. The function of SVIL and its association with various diseases and clinical conditions, has been established by previous studies, as described hereinabove with reference to VGAM1459. C16orf5 (Accession NM_013399) is another VGAM2114 host target gene. C16orf5 BINDING SITE is HOST TARGET binding site found in the 5' untranslated region of mRNA encoded by C16orf5, corresponding to a HOST TARGET binding site such as BINDING SITE I, BINDING SITE II or BINDING SITE III. Table 2 illustrates the complementarity of the nucleotide sequences of C16orf5 BINDING SITE, designated SEQ ID:15051, to the nucleotide sequence of VGAM2114 RNA, herein designated VGAM RNA, also designated SEQ ID:4825.

Another function of VGAM2114 is therefore inhibition of C16orf5 (Accession NM_013399). Accordingly, utilities of VGAM2114 include diagnosis, prevention and treatment of diseases and clinical conditions associated with C16orf5. DKFZp547M236 (Accession NM_018713) is another VGAM2114 host target gene. DKFZp547M236 BINDING SITE is HOST TARGET binding site found in the 3' untranslated region of mRNA encoded by DKFZp547M236, corresponding to a HOST TARGET binding site such as BINDING SITE I, BINDING SITE II or BINDING SITE III. Table 2 illustrates the complementarity of the nucleotide sequences of DKFZp547M236 BINDING SITE, designated SEQ ID:20791, to the nucleotide sequence of VGAM2114 RNA, herein designated VGAM RNA, also designated SEQ ID:4825.

Another function of VGAM2114 is therefore inhibition of DKFZp547M236 (Accession NM_018713). Accordingly, utilities of VGAM2114 include diagnosis, prevention and treatment of diseases and clinical conditions associated with DKFZp547M236. E74-like Factor 4 (ets domain transcription factor) (ELF4, Accession NM_001421) is another VGAM2114 host target gene. ELF4 BINDING SITE is HOST TARGET binding site found in the 3' untranslated region of mRNA encoded by ELF4, corresponding to a HOST TARGET binding site such as BINDING SITE I, BINDING SITE II or BINDING SITE III. Table 2 illustrates the complementarity of the nucleotide sequences of ELF4 BINDING SITE, designated SEQ ID:7124, to the nucleotide sequence of VGAM2114 RNA, herein designated VGAM RNA, also designated SEQ ID:4825.

Another function of VGAM2114 is therefore inhibition of E74-like Factor 4 (ets domain transcription factor) (ELF4, Accession NM_001421). Accordingly, utilities of VGAM2114 include diagnosis, prevention and treatment of diseases and clinical conditions associated with ELF4. Neuronal PAS Domain Protein 3 (NPAS3, Accession NM_022123) is another VGAM2114 host target gene. NPAS3 BINDING SITE is HOST TARGET binding site found in the 3' untranslated region of mRNA encoded by NPAS3, corresponding to a HOST TARGET binding site such as BINDING SITE I, BINDING SITE II or BINDING SITE III. Table 2 illustrates the complementarity of the nucleotide sequences of NPAS3 BINDING SITE, designated SEQ ID:22667, to the nucleotide sequence of VGAM2114 RNA, herein designated VGAM RNA, also designated SEQ ID:4825.

Another function of VGAM2114 is therefore inhibition of Neuronal PAS Domain Protein 3 (NPAS3, Accession NM_022123). Accordingly, utilities of VGAM2114 include diagnosis, prevention and treatment of diseases and clinical conditions associated with NPAS3. Solute Carrier Family 11 (proton-coupled divalent metal ion transporters), Member 2 (SLC11A2, Accession NM_000617) is another VGAM2114 host target gene. SLC11A2 BINDING SITE is HOST TARGET binding site found in the 3" untranslated region of mRNA encoded by SLC11A2, corresponding to a HOST TARGET binding site such as BINDING SITE I, BINDING SITE II or BINDING SITE III. Table 2 illustrates the complementarity of the nucleotide sequences of SLC11A2 BINDING SITE, designated SEQ ID:6226, to the nucleotide sequence of VGAM2114 RNA, herein designated VGAM RNA, also designated SEQ ID:4825.

Another function of VGAM2114 is therefore inhibition of Solute Carrier Family 11 (proton-coupled divalent metal ion transporters), Member 2 (SLC11A2, Accession NM_000617). Accordingly, utilities of VGAM2114 include diagnosis, prevention and treatment of diseases and clinical conditions associated with SLC11A2. Triple Homeobox 1 (TIX1, Accession XM_029734) is another VGAM2114 host target gene. TIX1 BINDING SITE is HOST TARGET binding site found in the 3' untranslated region of mRNA encoded by TIX1, corresponding to a HOST TARGET binding site such as BINDING SITE I, BINDING SITE II or BINDING SITE III. Table 2 illustrates the complementarity of the nucleotide sequences of TIX1 BINDING SITE, designated SEQ ID:30927, to the nucleotide sequence of VGAM2114 RNA, herein designated VGAM RNA, also designated SEQ ID:4825.

Another function of VGAM2114 is therefore inhibition of Triple Homeobox 1 (TIX1, Accession XM_029734). Accordingly, utilities of VGAM2114 include diagnosis, prevention and treatment of diseases and clinical conditions associated with TIX1. LOC143173 (Accession XM_016685) is another VGAM2114 host target gene. LOC143173 BINDING SITE is HOST TARGET binding site found in the 5' untranslated region of mRNA encoded by LOC143173, corresponding to a HOST TARGET binding site such as BINDING SITE I, BINDING SITE II or BINDING SITE III. Table 2 illustrates the complementarity of the nucleotide sequences of LOC143173 BINDING SITE, designated SEQ ID:30271, to the nucleotide sequence of VGAM2114 RNA, herein designated VGAM RNA, also designated SEQ ID:4825.

Another function of VGAM2114 is therefore inhibition of LOC143173 (Accession XM_016685). Accordingly, utilities of VGAM2114 include diagnosis, prevention and treatment of diseases and clinical conditions associated with LOC143173. LOC143915 (Accession XM_096502) is another VGAM2114 host target gene. LOC143915 BINDING SITE is HOST TARGET binding site found in the 3' untranslated region of mRNA encoded by LOC143915, corresponding to a HOST TARGET binding site such as BINDING SITE I, BINDING SITE II or BINDING SITE III. Table 2 illustrates the complementarity of the nucleotide sequences of LOC143915 BINDING SITE, designated SEQ ID:40379, to the nucleotide sequence of VGAM2114 RNA, herein designated VGAM RNA, also designated SEQ ID:4825.

Another function of VGAM2114 is therefore inhibition of LOC143915 (Accession XM_096502). Accordingly, utilities of VGAM2114 include diagnosis, prevention and treatment of diseases and clinical conditions associated with LOC143915. LOC149302 (Accession XM_086489) is another VGAM2114 host target gene. LOC149302 BINDING SITE is HOST TARGET binding site found in the 5' untranslated region of mRNA encoded by LOC149302, corresponding to a HOST TARGET binding site such as BINDING SITE I, BINDING SITE II or BINDING SITE III. Table 2 illustrates the complementarity of the nucleotide sequences of LOC149302 BINDING SITE, designated SEQ ID:38702, to the nucleotide sequence of VGAM2114 RNA, herein designated VGAM RNA, also designated SEQ ID:4825.

Another function of VGAM2114 is therefore inhibition of LOC149302 (Accession XM_086489). Accordingly, utilities of VGAM2114 include diagnosis, prevention and treatment of diseases and clinical conditions associated with LOC149302. LOC170082 (Accession XM_093092) is another VGAM2114 host target gene. LOC170082 BINDING SITE is HOST TARGET binding site found in the 3' untranslated region of mRNA encoded by LOC170082, corresponding to a HOST TARGET binding site such as BINDING SITE I, BINDING SITE II or BINDING SITE III. Table 2 illustrates the complementarity of the nucleotide sequences of LOC170082 BINDING SITE, designated SEQ ID:40170, to the nucleotide sequence of VGAM2114 RNA, herein designated VGAM RNA, also designated SEQ ID:4825.

Another function of VGAM2114 is therefore inhibition of LOC170082 (Accession XM_093092). Accordingly, utilities of VGAM2114 include diagnosis, prevention and treatment of diseases and clinical conditions associated with LOC170082. LOC221477 (Accession XM_166397) is another VGAM2114 host target gene. LOC221477 BINDING SITE is HOST TARGET binding site found in the 3' untranslated region of mRNA encoded by LOC221477, corresponding to a HOST TARGET binding site such as BINDING SITE I, BINDING SITE II or BINDING SITE III. Table 2 illustrates the complementarity of the nucleotide sequences of LOC221477 BINDING SITE, designated SEQ ID:44257, to the nucleotide sequence of VGAM2114 RNA, herein designated VGAM RNA, also designated SEQ ID:4825.

Another function of VGAM2114 is therefore inhibition of LOC221477 (Accession XM_166397). Accordingly, utilities of VGAM2114 include diagnosis, prevention and treatment of diseases and clinical conditions associated with LOC221477. LOC221760 (Accession XM_168105) is another VGAM2114 host target gene. LOC221760 BINDING SITE is HOST TARGET binding site found in the 5' untranslated region of mRNA encoded by LOC221760, corresponding to a HOST TARGET binding site such as BINDING SITE I, BINDING SITE II or BINDING SITE III. Table 2 illustrates the complementarity of the nucleotide sequences of LOC221760 BINDING SITE, designated SEQ ID:45031, to the nucleotide sequence of VGAM2114 RNA, herein designated VGAM RNA, also designated SEQ ID:4825.

Another function of VGAM2114 is therefore inhibition of LOC221760 (Accession XM_168105). Accordingly, utilities of VGAM2114 include diagnosis, prevention and treatment of diseases and clinical conditions associated with LOC221760. LOC245806 (Accession XM_166309) is another VGAM2114 host target gene. LOC245806 BINDING SITE is HOST TARGET binding site found in the 5' untranslated region of mRNA encoded by LOC245806, corresponding to a HOST TARGET binding site such as BINDING SITE I, BINDING SITE II or BINDING SITE III. Table 2 illustrates the complementarity of the nucleotide sequences of LOC245806 BINDING SITE, designated SEQ ID:44131, to the nucleotide sequence of VGAM2114 RNA, herein designated VGAM RNA, also designated SEQ ID:4825.

Another function of VGAM2114 is therefore inhibition of LOC245806 (Accession XM_166309). Accordingly, utilities of VGAM2114 include diagnosis, prevention and treatment of diseases and clinical conditions associated with LOC245806. FIG. 1 further provides a conceptual description of a novel bioinformatically detected viral gene of the present invention, referred to here as Viral Genomic Address Messenger 2115 (VGAM2115) viral gene, which modulates expression of respective host target genes thereof, the function and utility of which host target genes is known in the art.

VGAM2115 is a novel bioinformatically detected regulatory, non protein coding, viral micro RNA (miRNA) gene. The method by which VGAM2115 was detected is described hereinabove with reference to FIGS. 1-8.

VGAM2115 gene, herein designated VGAM GENE, is a viral gene contained in the genome of Cowpox Virus. VGAM2115 host target gene, herein designated VGAM HOST TARGET GENE, is a human gene contained in the human genome.

VGAM2115 gene encodes a VGAM2115 precursor RNA, herein designated VGAM PRECURSOR RNA. Similar to other miRNA genes, and unlike most ordinary genes, VGAM2115 precursor RNA does not encode a protein. A nucleotide sequence identical or highly similar to the nucleotide sequence of VGAM2115 precursor RNA is designated SEQ ID:2101, and is provided hereinbelow with reference to the sequence listing part. Nucleotide sequence SEQ ID:2101 is located at position 211598 relative to the genome of Cowpox Virus.

VGAM2115 precursor RNA folds onto itself, forming VGAM2115 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2115 folded precursor RNA into VGAM2115 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2115 RNA is designated SEQ ID:4826, and is provided hereinbelow with reference to the sequence listing part.

VGAM2115 host target gene, herein designated VGAM HOST TARGET GENE, encodes a corresponding messenger RNA, VGAM2115 host target RNA, herein designated VGAM HOST TARGET RNA. VGAM2115 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2115 RNA, herein designated VGAM RNA, binds complementarily to one or more host target binding sites located in untranslated regions of VGAM2115 host target RNA, herein designated VGAM HOST TARGET RNA. This complementary binding is due to the fact that the nucleotide sequence of VGAM2115 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2115 RNA, herein designated VGAM RNA, may have a different number of host target binding sites in untranslated regions of a VGAM2115 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2115 RNA, herein designated VGAM RNA, to host target binding sites on VGAM2115 host target RNA, herein designated VGAM HOST TARGET RNA, such as BINDING SITE I, BINDING SITE II and BINDING SITE III, inhibits translation of VGAM2115 host target RNA into VGAM2115 host target protein, herein designated VGAM HOST TARGET PROTEIN. VGAM host target protein is therefore outlined by a broken line.

It is appreciated that VGAM2115 host target gene, herein designated VGAM HOST TARGET GENE, in fact represents a plurality of VGAM2115 host target genes. The mRNA of each one of this plurality of VGAM2115 host target genes comprises one or more host target binding sites, each having a nucleotide sequence which is at least partly complementary to VGAM2115 RNA, herein designated VGAM RNA, and which when bound by VGAM2115 RNA causes inhibition of translation of respective one or more VGAM2115 host target proteins.

It is further appreciated by one skilled in the art that the mode of translational inhibition illustrated by FIG. 1 with specific reference to translational inhibition exerted by VGAM2115 gene, herein designated VGAM GENE, on one or more VGAM2115 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2115 is inhibition of expression of host target genes, as part of a novel viral mechanism of attacking a host. Accordingly, utilities of VGAM2115 include diagnosis, prevention and treatment of viral infection by Cowpox Virus. Specific functions, and accordingly utilities, of VGAM2115 correlate with, and may be deduced from, the identity of the host target genes which VGAM2115 binds and inhibits, and the function of these host target genes, as elaborated hereinbelow.

Nucleotide sequences of the VGAM2115 precursor RNA, herein designated VGAM PRECURSOR RNA, and of the 'diced' VGAM2115 RNA, herein designated VGAM RNA, and a schematic representation of the secondary folding of VGAM2115 folded precursor RNA, herein designated VGAM FOLDED PRECURSOR RNA, of VGAM2115 are further described hereinbelow with reference to Table 1.

Nucleotide sequences of host target binding sites, such as BINDING SITE-I, BINDING SITE-II and BINDING SITE-III of FIG. 1, found on VGAM2115 host target RNA, and schematic representation of the complementarity of each of these host target binding sites to VGAM2115 RNA, herein designated VGAM RNA, are described hereinbelow with reference to Table 2.

As mentioned hereinabove with reference to FIG. 1, a function of VGAM2115 gene, herein designated VGAM is inhibition of expression of VGAM2115 target genes. It is appreciated that specific functions, and accordingly utilities, of VGAM2115 correlate with, and may be deduced from, the identity of the target genes which VGAM2115 binds and inhibits, and the function of these target genes, as elaborated hereinbelow.

Tyrosine 3-monooxygenase/tryptophan 5-monooxygenase Activation Protein, Zeta Polypeptide (YWHAZ, Accession NM_003406) is a VGAM2115 host target gene. YWHAZ BINDING SITE is HOST TARGET binding site found in the 3" untranslated region of mRNA encoded by YWHAZ, corresponding to a HOST TARGET binding site such as BINDING SITE I, BINDING SITE II or BINDING SITE III. Table 2 illustrates the complementarity of the nucleotide sequences of YWHAZ BINDING SITE, designated SEQ ID:9445, to the nucleotide sequence of VGAM2115 RNA, herein designated VGAM RNA, also designated SEQ ID:4826.

A function of VGAM2115 is therefore inhibition of Tyrosine 3-monooxygenase/tryptophan 5-monooxygenase Activation Protein, Zeta Polypeptide (YWHAZ, Accession NM_003406), a gene which mediates signal transduction by binding to phosphorylated serine residues on a variety of signaling molecules. Accordingly, utilities of VGAM2115 include diagnosis, prevention and treatment of diseases and clinical conditions associated with YWHAZ. The function of YWHAZ and its association with various diseases and clinical conditions, has been established by previous studies, as described hereinabove with reference to VGAM43. Parvin, Alpha (PARVA, Accession NM_018222) is another VGAM2115 host target gene. PARVA BINDING SITE is HOST TARGET binding site found in the 3' untranslated region of mRNA encoded by PARVA, corresponding to a HOST TARGET binding site such as BINDING SITE I, BINDING SITE II or BINDING SITE III. Table 2 illustrates the complementarity of the nucleotide sequences of PARVA BINDING SITE, designated SEQ ID:20145, to the nucleotide sequence of VGAM2115 RNA, herein designated VGAM RNA, also designated SEQ ID:4826.

Another function of VGAM2115 is therefore inhibition of Parvin, Alpha (PARVA, Accession NM_018222). Accordingly, utilities of VGAM2115 include diagnosis, prevention and treatment of diseases and clinical conditions associated with PARVA. LOC254251 (Accession XM_171088) is another VGAM2115 host target gene. LOC254251 BINDING SITE is HOST TARGET binding site found in the 3' untranslated region of mRNA encoded by LOC254251, corresponding to a HOST TARGET binding site such as BINDING SITE I, BINDING SITE II or BINDING SITE III. Table 2 illustrates the complementarity of the nucleotide sequences of LOC254251 BINDING SITE, designated SEQ ID:45894, to the nucleotide sequence of VGAM2115 RNA, herein designated VGAM RNA, also designated SEQ ID:4826.

Another function of VGAM2115 is therefore inhibition of LOC254251 (Accession XM_171088). Accordingly, utilities of VGAM2115 include diagnosis, prevention and treatment of diseases and clinical conditions associated with LOC254251. FIG. 1 further provides a conceptual description of a novel bioinformatically detected viral gene of the present invention, referred to here as Viral Genomic Address Messenger 2116 (VGAM2116) viral gene, which modulates expression of respective host target genes thereof, the function and utility of which host target genes is known in the art.

VGAM2116 is a novel bioinformatically detected regulatory, non protein coding, viral micro RNA (miRNA) gene. The method by which VGAM2116 was detected is described hereinabove with reference to FIGS. 1-8.

VGAM2116 gene, herein designated VGAM GENE, is a viral gene contained in the genome of Cowpox Virus. VGAM2116 host target gene, herein designated VGAM HOST TARGET GENE, is a human gene contained in the human genome.

VGAM2116 gene encodes a VGAM2116 precursor RNA, herein designated VGAM PRECURSOR RNA. Similar to other miRNA genes, and unlike most ordinary genes, VGAM2116 precursor RNA does not encode a protein. A nucleotide sequence identical or highly similar to the nucleotide sequence of VGAM2116 precursor RNA is designated SEQ ID:2102, and is provided hereinbelow with reference to the sequence listing part. Nucleotide sequence SEQ ID:2102 is located at position 208834 relative to the genome of Cowpox Virus.

VGAM2116 precursor RNA folds onto itself, forming VGAM2116 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2116 folded precursor RNA into VGAM2116 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2116 RNA is designated SEQ ID:4827, and is provided hereinbelow with reference to the sequence listing part.

VGAM2116 host target gene, herein designated VGAM HOST TARGET GENE, encodes a corresponding messenger RNA, VGAM2116 host target RNA, herein designated VGAM HOST TARGET RNA. VGAM2116 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2116 RNA, herein designated VGAM RNA, binds complementarily to one or more host target binding sites located in untranslated regions of VGAM2116 host target RNA, herein designated VGAM HOST TARGET RNA. This complementary binding is due to the fact that the nucleotide sequence of VGAM2116 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2116 RNA, herein designated VGAM RNA, may have a different number of host target binding sites in untranslated regions of a VGAM2116 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2116 RNA, herein designated VGAM RNA, to host target binding sites on VGAM2116 host target RNA, herein designated VGAM HOST TARGET RNA, such as BINDING SITE I, BINDING SITE II and BINDING SITE III, inhibits translation of VGAM2116 host target RNA into VGAM2116 host target protein, herein designated VGAM HOST TARGET PROTEIN. VGAM host target protein is therefore outlined by a broken line.

It is appreciated that VGAM2116 host target gene, herein designated VGAM HOST TARGET GENE, in fact represents a plurality of VGAM2116 host target genes. The mRNA of each one of this plurality of VGAM2116 host target genes comprises one or more host target binding sites, each having a nucleotide sequence which is at least partly complementary to VGAM2116 RNA, herein designated VGAM RNA, and which when bound by VGAM2116 RNA causes inhibition of translation of respective one or more VGAM2116 host target proteins.

It is further appreciated by one skilled in the art that the mode of translational inhibition illustrated by FIG. 1 with specific reference to translational inhibition exerted by VGAM2116 gene, herein designated VGAM GENE, on one or more VGAM2116 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2116 is inhibition of expression of host target genes, as part of a novel viral mechanism of attacking a host. Accordingly, utilities of VGAM2116 include diagnosis, prevention and treatment of viral infection by Cowpox Virus. Specific functions, and accordingly utilities, of VGAM2116 correlate with, and may be deduced from, the identity of the host target genes which VGAM2116 binds and inhibits, and the function of these host target genes, as elaborated hereinbelow.

Nucleotide sequences of the VGAM2116 precursor RNA, herein designated VGAM PRECURSOR RNA, and of the 'diced' VGAM2116 RNA, herein designated VGAM RNA, and a schematic representation of the secondary folding of VGAM2116 folded precursor RNA, herein designated VGAM FOLDED PRECURSOR RNA, of VGAM2116 are further described hereinbelow with reference to Table 1.

Nucleotide sequences of host target binding sites, such as BINDING SITE-I, BINDING SITE-II and BINDING SITE-III of FIG. 1, found on VGAM2116 host target RNA, and schematic representation of the complementarity of each of these host target binding sites to VGAM2116 RNA, herein designated VGAM RNA, are described hereinbelow with reference to Table 2.

As mentioned hereinabove with reference to FIG. 1, a function of VGAM2116 gene, herein designated VGAM is inhibition of expression of VGAM2116 target genes. It is appreciated that specific functions, and accordingly utilities, of VGAM2116 correlate with, and may be deduced from, the identity of the target genes which VGAM2116 binds and inhibits, and the function of these target genes, as elaborated hereinbelow.

Aspartate Beta-hydroxylase (ASPH, Accession NM_032466) is a VGAM2116 host target gene. ASPH BINDING SITE1 and ASPH BINDING SITE2 are HOST TARGET binding sites found in untranslated regions of mRNA encoded by ASPH, corresponding to HOST TARGET binding sites such as BINDING SITE I, BINDING SITE II or BINDING SITE III. Table 2 illustrates the complementarity of the nucleotide sequences of ASPH BINDING SITE1 and ASPH BINDING SITE2, designated SEQ ID:26222 and SEQ ID:26227 respectively, to the nucleotide sequence of VGAM2116 RNA, herein designated VGAM RNA, also designated SEQ ID:4827.

A function of VGAM2116 is therefore inhibition of Aspartate Beta-hydroxylase (ASPH, Accession NM_032466), a gene which specifically hydroxylates the beta carbon of aspartic acid or asparagine residues in certain epidermal growth factor (EGF)-like domains of a number of proteins. Accordingly, utilities of VGAM2116 include diagnosis, prevention and treatment of diseases and clinical conditions associated with ASPH. The function of ASPH and its association with various diseases and clinical conditions, has been established by previous studies, as described hereinabove with reference to VGAM47. Tensin (TNS, Accession NM_022648) is another VGAM2116 host target gene. TNS BINDING SITE is HOST TARGET binding site found in the 3' untranslated region of mRNA encoded by TNS, corresponding to a HOST TARGET binding site such as BINDING SITE I, BINDING SITE II or BINDING SITE III. Table 2 illustrates the complementarity of the nucleotide sequences of TNS BINDING SITE, designated SEQ ID:22903, to the nucleotide sequence of VGAM2116 RNA, herein designated VGAM RNA, also designated SEQ ID:4827.

Another function of VGAM2116 is therefore inhibition of Tensin (TNS, Accession NM_022648). Accordingly, utilities of VGAM2116 include diagnosis, prevention and treatment of diseases and clinical conditions associated with TNS. FLJ10656 (Accession NM_018170) is another VGAM2116 host target gene. FLJ10656 BINDING SITE is HOST TARGET binding site found in the 3' untranslated region of mRNA encoded by FLJ10656, corresponding to a HOST TARGET binding site such as BINDING SITE I, BINDING SITE II or BINDING SITE III. Table 2 illustrates the complementarity of the nucleotide sequences of FLJ10656 BINDING SITE, designated SEQ ID:19988, to the nucleotide sequence of VGAM2116 RNA, herein designated VGAM RNA, also designated SEQ ID:4827.

Another function of VGAM2116 is therefore inhibition of FLJ10656 (Accession NM_018170). Accordingly, utilities of VGAM2116 include diagnosis, prevention and treatment of diseases and clinical conditions associated with FLJ10656. GABA(A) Receptor-associated Protein Like 1 (GABARAPL1, Accession NM_031412) is another VGAM2116 host target gene. GABARAPL1 BINDING SITE is HOST TARGET binding site found in the 3' untranslated region of mRNA encoded by GABARAPL1, corresponding to a HOST TARGET binding site such as BINDING SITE I, BINDING SITE II or BINDING SITE III. Table 2 illustrates the complementarity of the nucleotide sequences of GABARAPL1 BINDING SITE, designated SEQ ID:25392, to the nucleotide sequence of VGAM2116 RNA, herein designated VGAM RNA, also designated SEQ ID:4827.

Another function of VGAM2116 is therefore inhibition of GABA(A) Receptor-associated Protein Like 1 (GABARAPL1, Accession NM_031412). Accordingly, utilities of VGAM2116 include diagnosis, prevention and treatment of diseases and clinical conditions associated with GABARAPL1. GABA(A) Receptors Associated Protein Like 3 (GABARAPL3, Accession NM_032568) is another VGAM2116 host target gene. GABARAPL3 BINDING SITE is HOST TARGET binding site found in the 3' untranslated region of mRNA encoded by GABARAPL3, corresponding to a HOST TARGET binding site such as BINDING SITE I, BINDING SITE II or BINDING SITE III. Table 2 illustrates the complementarity of the nucleotide sequences of GABARAPL3 BINDING SITE, designated SEQ ID:26300, to the nucleotide sequence of VGAM2116 RNA, herein designated VGAM RNA, also designated SEQ ID:4827.

Another function of VGAM2116 is therefore inhibition of GABA(A) Receptors Associated Protein Like 3 (GABARAPL3, Accession NM_032568). Accordingly, utilities of VGAM2116 include diagnosis, prevention and treatment of diseases and clinical conditions associated with GABARAPL3. HT002 (Accession NM_014066) is another VGAM2116 host target gene. HT002 BINDING SITE is HOST TARGET binding site found in the 3' untranslated region of mRNA encoded by HT002, corresponding to a HOST TARGET binding site such as BINDING SITE I, BINDING SITE II or BINDING SITE III. Table 2 illustrates the complementarity of the nucleotide sequences of HT002 BINDING SITE, designated SEQ ID:15281, to the nucleotide sequence of VGAM2116 RNA, herein designated VGAM RNA, also designated SEQ ID:4827.

Another function of VGAM2116 is therefore inhibition of HT002 (Accession NM_014066). Accordingly, utilities of VGAM2116 include diagnosis, prevention and treatment of diseases and clinical conditions associated with HT002. KIAA0194 (Accession XM_038362) is another VGAM2116 host target gene. KIAA0194 BINDING SITE is HOST TARGET binding site found in the 3' untranslated region of mRNA encoded by KIAA0194, corresponding to a HOST TARGET binding site such as BINDING SITE I, BINDING SITE II or BINDING SITE III. Table 2 illustrates the complementarity of the nucleotide sequences of KIAA0194 BINDING SITE, designated SEQ ID:32825, to the nucleotide sequence of VGAM2116 RNA, herein designated VGAM RNA, also designated SEQ ID:4827.

Another function of VGAM2116 is therefore inhibition of KIAA0194 (Accession XM_038362). Accordingly, utilities of VGAM2116 include diagnosis, prevention and treatment of diseases and clinical conditions associated with KIAA0194. KIAA0435 (Accession NM_014801) is another VGAM2116 host target gene. KIAA0435 BINDING SITE is HOST TARGET binding site found in the 3' untranslated region of mRNA encoded by KIAA0435, corresponding to a HOST TARGET binding site such as BINDING SITE I, BINDING SITE II or BINDING SITE III. Table 2 illustrates the complementarity of the nucleotide sequences of KIAA0435 BINDING SITE, designated SEQ ID:16721, to the nucleotide sequence of VGAM2116 RNA, herein designated VGAM RNA, also designated SEQ ID:4827.

Another function of VGAM2116 is therefore inhibition of KIAA0435 (Accession NM_014801). Accordingly, utilities of VGAM2116 include diagnosis, prevention and treatment of diseases and clinical conditions associated with KIAA0435. KIAA0475 (Accession NM_014864) is another VGAM2116 host target gene. KIAA0475 BINDING SITE is HOST TARGET binding site found in the 3' untranslated region of mRNA encoded by KIAA0475, corresponding to a HOST TARGET binding site such as BINDING SITE I, BINDING SITE II or BINDING SITE III. Table 2 illustrates the complementarity of the nucleotide sequences of KIAA0475 BINDING SITE, designated SEQ ID:16949, to the nucleotide sequence of VGAM2116 RNA, herein designated VGAM RNA, also designated SEQ ID:4827.

Another function of VGAM2116 is therefore inhibition of KIAA0475 (Accession NM_014864). Accordingly, utilities of VGAM2116 include diagnosis, prevention and treatment of diseases and clinical conditions associated with KIAA0475. KIAA0542 (Accession XM_038520) is another VGAM2116 host target gene. KIAA0542 BINDING SITE is HOST TARGET binding site found in the 3' untranslated region of mRNA encoded by KIAA0542, corresponding to a HOST TARGET binding site such as BINDING SITE I, BINDING SITE II or BINDING SITE III. Table 2 illustrates the complementarity of the nucleotide sequences of KIAA0542 BINDING SITE, designated SEQ ID:32856, to the nucleotide sequence of VGAM2116 RNA, herein designated VGAM RNA, also designated SEQ ID:4827.

Another function of VGAM2116 is therefore inhibition of KIAA0542 (Accession XM_038520). Accordingly, utilities of VGAM2116 include diagnosis, prevention and treatment of diseases and clinical conditions associated with KIAA0542. KIAA1301 (Accession XM_038999) is another VGAM2116 host target gene. KIAA1301 BINDING SITE is HOST TARGET binding site found in the 3' untranslated region of mRNA encoded by KIAA1301, corresponding to a HOST TARGET binding site such as BINDING SITE I, BINDING SITE II or BINDING SITE III. Table 2 illustrates the complementarity of the nucleotide sequences of KIAA1301 BINDING SITE, designated SEQ ID:32974, to the nucleotide sequence of VGAM2116 RNA, herein designated VGAM RNA, also designated SEQ ID:4827.

Another function of VGAM2116 is therefore inhibition of KIAA1301 (Accession XM_038999). Accordingly, utilities of VGAM2116 include diagnosis, prevention and treatment of diseases and clinical conditions associated with KIAA1301. KIAA1323 (Accession XM_032146) is another VGAM2116 host target gene. KIAA1323 BINDING SITE is HOST TARGET binding site found in the 5' untranslated region of mRNA encoded by KIAA1323, corresponding to a HOST TARGET binding site such as BINDING SITE I, BINDING SITE II or BINDING SITE III. Table 2 illustrates the complementarity of the nucleotide sequences of KIAA1323 BINDING SITE, designated SEQ ID:31563, to the nucleotide sequence of VGAM2116 RNA, herein designated VGAM RNA, also designated SEQ ID:4827.

Another function of VGAM2116 is therefore inhibition of KIAA1323 (Accession XM_032146). Accordingly, utilities of VGAM2116 include diagnosis, prevention and treatment of diseases and clinical conditions associated with KIAA1323. Seizure Related 6 Homolog (mouse) (SEZ6, Accession XM_058869) is another VGAM2116 host target gene. SEZ6 BINDING SITE is HOST TARGET binding site found in the 3' untranslated region of mRNA encoded by SEZ6, corresponding to a HOST TARGET binding site such as BINDING SITE I, BINDING SITE II or BINDING SITE III. Table 2 illustrates the complementarity of the nucleotide sequences of SEZ6 BINDING SITE, designated SEQ ID:36774, to the nucleotide sequence of VGAM2116 RNA, herein designated VGAM RNA, also designated SEQ ID:4827.

Another function of VGAM2116 is therefore inhibition of Seizure Related 6 Homolog (mouse) (SEZ6, Accession XM_058869). Accordingly, utilities of VGAM2116 include diagnosis, prevention and treatment of diseases and clinical conditions associated with SEZ6. LOC132235 (Accession XM_072302) is another VGAM2116 host target gene. LOC132235 BINDING SITE is HOST TARGET binding site found in the 5' untranslated region of mRNA encoded by LOC132235, corresponding to a HOST TARGET binding site such as BINDING SITE I, BINDING SITE II or BINDING SITE III. Table 2 illustrates the complementarity of the nucleotide sequences of LOC132235 BINDING SITE, designated SEQ ID:37483, to the nucleotide sequence of VGAM2116 RNA, herein designated VGAM RNA, also designated SEQ ID:4827.

Another function of VGAM2116 is therefore inhibition of LOC132235 (Accession XM_072302). Accordingly, utilities of VGAM2116 include diagnosis, prevention and treatment of diseases and clinical conditions associated with LOC132235. LOC146895 (Accession XM_097120) is another VGAM2116 host target gene. LOC146895 BINDING SITE is HOST TARGET binding site found in the 5' untranslated region of mRNA encoded by LOC146895, corresponding to a HOST TARGET binding site such as BIND- ING SITE I, BINDING SITE II or BINDING SITE III. Table 2 illustrates the complementarity of the nucleotide sequences of LOC146895 BINDING SITE, designated SEQ ID:40761, to the nucleotide sequence of VGAM2116 RNA, herein designated VGAM RNA, also designated SEQ ID:4827.

Another function of VGAM2116 is therefore inhibition of LOC146895 (Accession XM_097120). Accordingly, utilities of VGAM2116 include diagnosis, prevention and treatment of diseases and clinical conditions associated with LOC146895. LOC152024 (Accession XM_087365) is another VGAM2116 host target gene. LOC152024 BINDING SITE is HOST TARGET binding site found in the 5' untranslated region of mRNA encoded by LOC152024, corresponding to a HOST TARGET binding site such as BINDING SITE I, BINDING SITE II or BINDING SITE III. Table 2 illustrates the complementarity of the nucleotide sequences of LOC152024 BINDING SITE, designated SEQ ID:39198, to the nucleotide sequence of VGAM2116 RNA, herein designated VGAM RNA, also designated SEQ ID:4827.

Another function of VGAM2116 is therefore inhibition of LOC152024 (Accession XM_087365). Accordingly, utilities of VGAM2116 include diagnosis, prevention and treatment of diseases and clinical conditions associated with LOC152024. FIG. 1 further provides a conceptual description of a novel bioinformatically detected viral gene of the present invention, referred to here as Viral Genomic Address Messenger 2117 (VGAM2117) viral gene, which modulates expression of respective host target genes thereof, the function and utility of which host target genes is known in the art.

VGAM2117 is a novel bioinformatically detected regulatory, non protein coding, viral micro RNA (miRNA) gene. The method by which VGAM2117 was detected is described hereinabove with reference to FIGS. 1-8.

VGAM2117 gene, herein designated VGAM GENE, is a viral gene contained in the genome of Cowpox Virus. VGAM2117 host target gene, herein designated VGAM HOST TARGET GENE, is a human gene contained in the human genome.

VGAM2117 gene encodes a VGAM2117 precursor RNA, herein designated VGAM PRECURSOR RNA. Similar to other miRNA genes, and unlike most ordinary genes, VGAM2117 precursor RNA does not encode a protein. A nucleotide sequence identical or highly similar to the nucleotide sequence of VGAM2117 precursor RNA is designated SEQ ID:2103, and is provided hereinbelow with reference to the sequence listing part. Nucleotide sequence SEQ ID:2103 is located at position 206477 relative to the genome of Cowpox Virus.

VGAM2117 precursor RNA folds onto itself, forming VGAM2117 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2117 folded precursor RNA into VGAM2117 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2117 RNA is designated SEQ ID:4828, and is provided hereinbelow with reference to the sequence listing part.

VGAM2117 host target gene, herein designated VGAM HOST TARGET GENE, encodes a corresponding messenger RNA, VGAM2117 host target RNA, herein designated VGAM HOST TARGET RNA. VGAM2117 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2117 RNA, herein designated VGAM RNA, binds complementarily to one or more host target binding sites located in untranslated regions of VGAM2117 host target RNA, herein designated VGAM HOST TARGET RNA. This complementary binding is due to the fact that the nucleotide sequence of VGAM2117 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2117 RNA, herein designated VGAM RNA, may have a different number of host target binding sites in untranslated regions of a VGAM2117 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2117 RNA, herein designated VGAM RNA, to host target binding sites on VGAM2117 host target RNA, herein designated VGAM HOST TARGET RNA, such as BINDING SITE I, BINDING SITE II and BINDING SITE III, inhibits translation of VGAM2117 host target RNA into VGAM2117 host target protein, herein designated VGAM HOST TARGET PROTEIN. VGAM host target protein is therefore outlined by a broken line.

It is appreciated that VGAM2117 host target gene, herein designated VGAM HOST TARGET GENE, in fact represents a plurality of VGAM2117 host target genes. The mRNA of each one of this plurality of VGAM2117 host target genes comprises one or more host target binding sites, each having a nucleotide sequence which is at least partly complementary to VGAM2117 RNA, herein designated VGAM RNA, and which when bound by VGAM2117 RNA causes inhibition of translation of respective one or more VGAM2117 host target proteins.

It is further appreciated by one skilled in the art that the mode of translational inhibition illustrated by FIG. 1 with specific reference to translational inhibition exerted by VGAM2117 gene, herein designated VGAM GENE, on one or more VGAM2117 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2117 is inhibition of expression of host target genes, as part of a novel viral mechanism of attacking a host. Accordingly, utilities of VGAM2117 include diagnosis, prevention and treatment of viral infection by Cowpox Virus. Specific functions, and accordingly utilities, of VGAM2117 correlate with, and may be deduced from, the identity of the host target genes which VGAM2117 binds and inhibits, and the function of these host target genes, as elaborated hereinbelow.

Nucleotide sequences of the VGAM2117 precursor RNA, herein designated VGAM PRECURSOR RNA, and of the 'diced' VGAM2117 RNA, herein designated VGAM RNA, and a schematic representation of the secondary folding of VGAM2117 folded precursor RNA, herein designated VGAM FOLDED PRECURSOR RNA, of VGAM2117 are further described hereinbelow with reference to Table 1.

Nucleotide sequences of host target binding sites, such as BINDING SITE-I, BINDING SITE-II and BINDING SITE-III of FIG. 1, found on VGAM2117 host target RNA, and schematic representation of the complementarity of each of these host target binding sites to VGAM2117 RNA, herein designated VGAM RNA, are described hereinbelow with reference to Table 2.

As mentioned hereinabove with reference to FIG. 1, a function of VGAM2117 gene, herein designated VGAM is inhibition of expression of VGAM2117 target genes. It is appreciated that specific functions, and accordingly utilities, of VGAM2117 correlate with, and may be deduced from, the identity of the target genes which VGAM2117 binds and inhibits, and the function of these target genes, as elaborated hereinbelow.

Coagulation Factor VIII, Procoagulant Component (hemophilia A) (F8, Accession NM_000132) is a VGAM2117 host target gene. F8 BINDING SITE is HOST TARGET binding site found in the 3' untranslated region of mRNA encoded by F8, corresponding to a HOST TARGET binding site such as BINDING SITE I, BINDING SITE II or BINDING SITE III. Table 2 illustrates the complementarity of the nucleotide sequences of F8 BINDING SITE, designated SEQ ID:5613, to the nucleotide sequence of VGAM2117 RNA, herein designated VGAM RNA, also designated SEQ ID:4828.

A function of VGAM2117 is therefore inhibition of Coagulation Factor VIII, Procoagulant Component (hemophilia A) (F8, Accession NM_000132). Accordingly, utilities of VGAM2117 include diagnosis, prevention and treatment of diseases and clinical conditions associated with F8. Microtubule-associated Protein, RP/EB Family, Member 1 (MAPRE1, Accession NM_012325) is another VGAM2117 host target gene. MAPRE1 BINDING SITE is HOST TARGET binding site found in the 3' untranslated region of mRNA encoded by MAPRE1, corresponding to a HOST TARGET binding site such as BINDING SITE I, BINDING SITE II or BINDING SITE III. Table 2 illustrates the complementarity of the nucleotide sequences of MAPRE1 BINDING SITE, designated SEQ ID:14706, to the nucleotide sequence of VGAM2117 RNA, herein designated VGAM RNA, also designated SEQ ID:4828.

Another function of VGAM2117 is therefore inhibition of Microtubule-associated Protein, RP/EB Family, Member 1 (MAPRE1, Accession NM_012325). Accordingly, utilities of VGAM2117 include diagnosis, prevention and treatment of diseases and clinical conditions associated with MAPRE1. E2F Transcription Factor 5, P130-binding (E2F5, Accession NM_001951) is another VGAM2117 host target gene. E2F5 BINDING SITE is HOST TARGET binding site found in the 3' untranslated region of mRNA encoded by E2F5, corresponding to a HOST TARGET binding site such as BINDING SITE I, BINDING SITE II or BINDING SITE III. Table 2 illustrates the complementarity of the nucleotide sequences of E2F5 BINDING SITE, designated SEQ ID:7673, to the nucleotide sequence of VGAM2117 RNA, herein designated VGAM RNA, also designated SEQ ID:4828.

Another function of VGAM2117 is therefore inhibition of E2F Transcription Factor 5, P130-binding (E2F5, Accession NM_001951). Accordingly, utilities of VGAM2117 include diagnosis, prevention and treatment of diseases and clinical conditions associated with E2F5. E74-like Factor 2 (ets domain transcription factor) (ELF2, Accession NM_006874) is another VGAM2117 host target gene. ELF2 BINDING SITE is HOST TARGET binding site found in the 3' untranslated region of mRNA encoded by ELF2, corresponding to a HOST TARGET binding site such as BINDING SITE I, BINDING SITE II or BINDING SITE III. Table 2 illustrates the complementarity of the nucleotide sequences of ELF2 BINDING SITE, designated SEQ ID:13743, to the nucleotide sequence of VGAM2117 RNA, herein designated VGAM RNA, also designated SEQ ID:4828.

Another function of VGAM2117 is therefore inhibition of E74-like Factor 2 (ets domain transcription factor) (ELF2, Accession NM_006874). Accordingly, utilities of VGAM2117 include diagnosis, prevention and treatment of diseases and clinical conditions associated with ELF2. KIAA0252 (Accession XM_031646) is another VGAM2117 host target gene. KIAA0252 BINDING SITE is HOST TARGET binding site found in the 3" untranslated region of mRNA encoded by KIAA0252, corresponding to a HOST TARGET binding site such as BINDING SITE I, BINDING SITE II or BINDING SITE III. Table 2 illustrates the complementarity of the nucleotide sequences of KIAA0252 BINDING SITE, designated SEQ ID:31451, to the nucleotide sequence of VGAM2117 RNA, herein designated VGAM RNA, also designated SEQ ID:4828.

Another function of VGAM2117 is therefore inhibition of KIAA0252 (Accession XM_031646). Accordingly, utilities of VGAM2117 include diagnosis, prevention and treatment of diseases and clinical conditions associated with KIAA0252. KIAA1855 (Accession XM_166453) is another VGAM2117 host target gene. KIAA1855 BINDING SITE is HOST TARGET binding site found in the 3' untranslated region of mRNA encoded by KIAA1855, corresponding to a HOST TARGET binding site such as BINDING SITE I, BINDING SITE II or BINDING SITE III. Table 2 illustrates the complementarity of the nucleotide sequences of KIAA1855 BINDING SITE, designated SEQ ID:44359, to the nucleotide sequence of VGAM2117 RNA, herein designated VGAM RNA, also designated SEQ ID:4828.

Another function of VGAM2117 is therefore inhibition of KIAA1855 (Accession XM_166453). Accordingly, utilities of VGAM2117 include diagnosis, prevention and treatment of diseases and clinical conditions associated with KIAA1855. LOC152578 (Accession XM_098241) is another VGAM2117 host target gene. LOC152578 BINDING SITE is HOST TARGET binding site found in the 5' untranslated region of mRNA encoded by LOC152578, corresponding to a HOST TARGET binding site such as BINDING SITE I, BINDING SITE II or BINDING SITE III. Table 2 illustrates the complementarity of the nucleotide sequences of LOC152578 BINDING SITE, designated SEQ ID:41526, to the nucleotide sequence of VGAM2117 RNA, herein designated VGAM RNA, also designated SEQ ID:4828.

Another function of VGAM2117 is therefore inhibition of LOC152578 (Accession XM_098241). Accordingly, utilities of VGAM2117 include diagnosis, prevention and treatment of diseases and clinical conditions associated with LOC152578. FIG. 1 further provides a conceptual description of a novel bioinformatically detected viral gene of the present invention, referred to here as Viral Genomic Address Messenger 2118 (VGAM2118) viral gene, which modulates expression of respective host target genes thereof, the function and utility of which host target genes is known in the art.

VGAM2118 is a novel bioinformatically detected regulatory, non protein coding, viral micro RNA (miRNA) gene. The method by which VGAM2118 was detected is described hereinabove with reference to FIGS. 1-8.

VGAM2118 gene, herein designated VGAM GENE, is a viral gene contained in the genome of Cowpox Virus. VGAM2118 host target gene, herein designated VGAM HOST TARGET GENE, is a human gene contained in the human genome.

VGAM2118 gene encodes a VGAM2118 precursor RNA, herein designated VGAM PRECURSOR RNA. Similar to other miRNA genes, and unlike most ordinary genes, VGAM2118 precursor RNA does not encode a protein. A nucleotide sequence identical or highly similar to the nucleotide sequence of VGAM2118 precursor RNA is designated SEQ ID:2104, and is provided hereinbelow with reference to the sequence listing part. Nucleotide sequence SEQ ID:2104 is located at position 6717 relative to the genome of Cowpox Virus.

VGAM2118 precursor RNA folds onto itself, forming VGAM2118 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2118 folded precursor RNA into VGAM2118 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2118 RNA is designated SEQ ID:4829, and is provided hereinbelow with reference to the sequence listing part.

VGAM2118 host target gene, herein designated VGAM HOST TARGET GENE, encodes a corresponding messenger RNA, VGAM2118 host target RNA, herein designated VGAM HOST TARGET RNA. VGAM2118 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2118 RNA, herein designated VGAM RNA, binds complementarily to one or more host target binding sites located in untranslated regions of VGAM2118 host target RNA, herein designated VGAM HOST TARGET RNA. This complementary binding is due to the fact that the nucleotide sequence of VGAM2118 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2118 RNA, herein designated VGAM RNA, may have a different number of host target binding sites in untranslated regions of a VGAM2118 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2118 RNA, herein designated VGAM RNA, to host target binding sites on VGAM2118 host target RNA, herein designated VGAM HOST TARGET RNA, such as BINDING SITE I, BINDING SITE II and BINDING SITE III, inhibits translation of VGAM2118 host target RNA into VGAM2118 host target protein, herein designated VGAM HOST TARGET PROTEIN. VGAM host target protein is therefore outlined by a broken line.

It is appreciated that VGAM2118 host target gene, herein designated VGAM HOST TARGET GENE, in fact represents a plurality of VGAM2118 host target genes. The mRNA of each one of this plurality of VGAM2118 host target genes comprises one or more host target binding sites, each having a nucleotide sequence which is at least partly complementary to VGAM2118 RNA, herein designated VGAM RNA, and which when bound by VGAM2118 RNA causes inhibition of translation of respective one or more VGAM2118 host target proteins.

It is further appreciated by one skilled in the art that the mode of translational inhibition illustrated by FIG. 1 with specific reference to translational inhibition exerted by VGAM2118 gene, herein designated VGAM GENE, on one or more VGAM2118 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2118 is inhibition of expression of host target genes, as part of a novel viral mechanism of attacking a host. Accordingly, utilities of VGAM2118 include diagnosis, prevention and treatment of viral infection by Cowpox Virus. Specific functions, and accordingly utilities, of VGAM2118 correlate with, and may be deduced from, the identity of the host target genes which VGAM2118 binds and inhibits, and the function of these host target genes, as elaborated hereinbelow.

Nucleotide sequences of the VGAM2118 precursor RNA, herein designated VGAM PRECURSOR RNA, and of the 'diced' VGAM2118 RNA, herein designated VGAM RNA, and a schematic representation of the secondary folding of VGAM2118 folded precursor RNA, herein designated VGAM FOLDED PRECURSOR RNA, of VGAM2118 are further described hereinbelow with reference to Table 1.

Nucleotide sequences of host target binding sites, such as BINDING SITE-I, BINDING SITE-II and BINDING SITE-III of FIG. 1, found on VGAM2118 host target RNA, and schematic representation of the complementarity of each of these host target binding sites to VGAM2118 RNA, herein designated VGAM RNA, are described hereinbelow with reference to Table 2.

As mentioned hereinabove with reference to FIG. 1, a function of VGAM2118 gene, herein designated VGAM is inhibition of expression of VGAM2118 target genes. It is appreciated that specific functions, and accordingly utilities, of VGAM2118 correlate with, and may be deduced from, the identity of the target genes which VGAM2118 binds and inhibits, and the function of these target genes, as elaborated hereinbelow.

Kruppel-like Factor 8 (KLF8, Accession NM_007250) is a VGAM2118 host target gene. KLF8 BINDING SITE is HOST TARGET binding site found in the 5' untranslated region of mRNA encoded by KLF8, corresponding to a HOST TARGET binding site such as BINDING SITE I, BINDING SITE II or BINDING SITE III. Table 2 illustrates the complementarity of the nucleotide sequences of KLF8 BINDING SITE, designated SEQ ID:14122, to the nucleotide sequence of VGAM2118 RNA, herein designated VGAM RNA, also designated SEQ ID:4829.

A function of VGAM2118 is therefore inhibition of Kruppel-like Factor 8 (KLF8, Accession NM_007250). Accordingly, utilities of VGAM2118 include diagnosis, prevention and treatment of diseases and clinical conditions associated with KLF8. Tripartite Motif-containing 9 (TRIM9, Accession NM_052978) is another VGAM2118 host target gene. TRIM9 BINDING SITE is HOST TARGET binding site found in the 3' untranslated region of mRNA encoded by TRIM9, corresponding to a HOST TARGET binding site such as BINDING SITE I, BINDING SITE II or BINDING SITE III. Table 2 illustrates the complementarity of the nucleotide sequences of TRIM9 BINDING SITE, designated SEQ ID:27548, to the nucleotide sequence of VGAM2118 RNA, herein designated VGAM RNA, also designated SEQ ID:4829.

Another function of VGAM2118 is therefore inhibition of Tripartite Motif-containing 9 (TRIM9, Accession NM_052978), a gene which may function as a positive regulator for mannosylphosphate transferase and is required to mediate mannosylphosphate transfer in both the core and outer chain portions of n-linked. oligosaccharides. Accordingly, utilities of VGAM2118 include diagnosis, prevention and treatment of diseases and clinical conditions associated with TRIM9. The function of TRIM9 and its association with various diseases and clinical conditions, has been established by previous studies, as described hereinabove with reference to VGAM74. Transient Receptor Potential Cation Channel, Subfamily C, Member 1 (TRPC1, Accession NM_003304) is another VGAM2118 host target gene. TRPC1 BINDING SITE is HOST TARGET binding site found in the 3' untranslated region of mRNA encoded by TRPC1, corresponding to a HOST TARGET binding site such as BINDING SITE I, BINDING SITE II or BINDING SITE III. Table 2 illustrates the complementarity of the nucleotide sequences of TRPC1 BINDING SITE, designated SEQ ID:9304, to the nucleotide sequence of VGAM2118 RNA, herein designated VGAM RNA, also designated SEQ ID:4829.

Another function of VGAM2118 is therefore inhibition of Transient Receptor Potential Cation Channel, Subfamily C, Member 1 (TRPC1, Accession NM_003304), a gene which acts as a non-voltage-sensitive store-operated Ca2+ channel. Accordingly, utilities of VGAM2118 include diagnosis, prevention and treatment of diseases and clinical conditions associated with TRPC1. The function of TRPC1 and its association with various diseases and clinical conditions, has been established by previous studies, as described hereinabove with reference to VGAM200. Butyrophilin, Subfamily 3, Member A1 (BTN3A1, Accession NM_007048) is another VGAM2118 host target gene. BTN3A1 BINDING SITE is HOST TARGET binding site found in the 3' untranslated region of mRNA encoded by BTN3A1, corresponding to a HOST TARGET binding site such as BINDING SITE I, BINDING SITE II or BINDING SITE III. Table 2 illustrates the complementarity of the nucleotide sequences of BTN3A1 BINDING SITE, designated SEQ ID:13920, to the nucleotide sequence of VGAM2118 RNA, herein designated VGAM RNA, also designated SEQ ID:4829.

Another function of VGAM2118 is therefore inhibition of Butyrophilin, Subfamily 3, Member A1 (BTN3A1, Accession NM_007048). Accordingly, utilities of VGAM2118 include diagnosis, prevention and treatment of diseases and clinical conditions associated with BTN3A1. DKFZp761J139 (Accession NM_032280) is another VGAM2118 host target gene. DKFZp761J139 BINDING SITE is HOST TARGET binding site found in the 5' untranslated region of mRNA encoded by DKFZp761J139, corresponding to a HOST TARGET binding site such as BINDING SITE I, BINDING SITE II or BINDING SITE III. Table 2 illustrates the complementarity of the nucleotide sequences of DKFZp761J139 BINDING SITE, designated SEQ ID:26034, to the nucleotide sequence of VGAM2118 RNA, herein designated VGAM RNA, also designated SEQ ID:4829.

Another function of VGAM2118 is therefore inhibition of DKFZp761J139 (Accession NM_032280). Accordingly, utilities of VGAM2118 include diagnosis, prevention and treatment of diseases and clinical conditions associated with DKFZp761J139. FLJ20147 (Accession NM_017687) is another VGAM2118 host target gene. FLJ20147 BINDING SITE is HOST TARGET binding site found in the 3' untranslated region of mRNA encoded by FLJ20147, corresponding to a HOST TARGET binding site such as BINDING SITE I, BINDING SITE II or BINDING SITE III. Table 2 illustrates the complementarity of the nucleotide sequences of FLJ20147 BINDING SITE, designated SEQ ID:19241, to the nucleotide sequence of VGAM2118 RNA, herein designated VGAM RNA, also designated SEQ ID:4829.

Another function of VGAM2118 is therefore inhibition of FLJ20147 (Accession NM_017687). Accordingly, utilities of VGAM2118 include diagnosis, prevention and treatment of diseases and clinical conditions associated with FLJ20147. MGC12466 (Accession XM_086336) is another VGAM2118 host target gene. MGC12466 BINDING SITE1 and MGC12466 BINDING SITE2 are HOST TARGET binding sites found in untranslated regions of mRNA encoded by MGC12466, corresponding to HOST TARGET binding sites such as BINDING SITE I, BINDING SITE II or BINDING SITE III. Table 2 illustrates the complementarity of the nucleotide sequences of MGC12466 BINDING SITE1 and MGC12466 BINDING SITE2, designated SEQ ID:38608 and SEQ ID:27066 respectively, to the nucleotide sequence of VGAM2118 RNA, herein designated VGAM RNA, also designated SEQ ID:4829.

Another function of VGAM2118 is therefore inhibition of MGC12466 (Accession XM_086336). Accordingly, utilities of VGAM2118 include diagnosis, prevention and treatment of diseases and clinical conditions associated with MGC12466. LOC202934 (Accession XM_117486) is another VGAM2118 host target gene. LOC202934 BINDING SITE is HOST TARGET binding site found in the 5' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43453, to the nucleotide sequence of VGAM2118 RNA, herein designated VGAM RNA, also designated SEQ ID:4829.

Another function of VGAM2118 is therefore inhibition of LOC202934 (Accession XM_117486). Accordingly, utilities of VGAM2118 include diagnosis, prevention and treatment of diseases and clinical conditions associated with LOC202934. LOC255465 (Accession XM_173206) is another VGAM2118 host target gene. LOC255465 BINDING SITE is HOST TARGET binding site found in the 5' untranslated region of mRNA encoded by LOC255465, corresponding to a HOST TARGET binding site such as BINDING SITE I, BINDING SITE II or BINDING SITE III. Table 2 illustrates the complementarity of the nucleotide sequences of LOC255465 BINDING SITE, designated SEQ ID:46447, to the nucleotide sequence of VGAM2118 RNA, herein designated VGAM RNA, also designated SEQ ID:4829.

Another function of VGAM2118 is therefore inhibition of LOC255465 (Accession XM_173206). Accordingly, utilities of VGAM2118 include diagnosis, prevention and treatment of diseases and clinical conditions associated with LOC255465. FIG. 1 further provides a conceptual description of a novel bioinformatically detected viral gene of the present invention, referred to here as Viral Genomic Address Messenger 2119 (VGAM2119) viral gene, which modulates expression of respective host target genes thereof, the function and utility of which host target genes is known in the art.

VGAM2119 is a novel bioinformatically detected regulatory, non protein coding, viral micro RNA (miRNA) gene. The method by which VGAM2119 was detected is described hereinabove with reference to FIGS. 1-8.

VGAM2119 gene, herein designated VGAM GENE, is a viral gene contained in the genome of Cowpox Virus. VGAM2119 host target gene, herein designated VGAM HOST TARGET GENE, is a human gene contained in the human genome.

VGAM2119 gene encodes a VGAM2119 precursor RNA, herein designated VGAM PRECURSOR RNA. Similar to other miRNA genes, and unlike most ordinary genes, VGAM2119 precursor RNA does not encode a protein. A nucleotide sequence identical or highly similar to the nucleotide sequence of VGAM2119 precursor RNA is designated SEQ ID:2105, and is provided hereinbelow with reference to the sequence listing part. Nucleotide sequence SEQ ID:2105 is located at position 206331 relative to the genome of Cowpox Virus.

VGAM2119 precursor RNA folds onto itself, forming VGAM2119 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2119 folded precursor RNA into VGAM2119 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2119 RNA is designated SEQ ID:4830, and is provided hereinbelow with reference to the sequence listing part.

VGAM2119 host target gene, herein designated VGAM HOST TARGET GENE, encodes a corresponding messenger RNA, VGAM2119 host target RNA, herein designated VGAM HOST TARGET RNA. VGAM2119 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2119 RNA, herein designated VGAM RNA, binds complementarily to one or more host target binding sites located in untranslated regions of VGAM2119 host target RNA, herein designated VGAM HOST TARGET RNA. This complementary binding is due to the fact that the nucleotide sequence of VGAM2119 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2119 RNA, herein designated VGAM RNA, may have a different number of host target binding sites in untranslated regions of a VGAM2119 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2119 RNA, herein designated VGAM RNA, to host target binding sites on VGAM2119 host target RNA, herein designated VGAM HOST TARGET RNA, such as BINDING SITE I, BINDING SITE II and BINDING SITE III, inhibits translation of VGAM2119 host target RNA into VGAM2119 host target protein, herein designated VGAM HOST TARGET PROTEIN. VGAM host target protein is therefore outlined by a broken line.

It is appreciated that VGAM2119 host target gene, herein designated VGAM HOST TARGET GENE, in fact represents a plurality of VGAM2119 host target genes. The mRNA of each one of this plurality of VGAM2119 host target genes comprises one or more host target binding sites, each having a nucleotide sequence which is at least partly complementary to VGAM2119 RNA, herein designated VGAM RNA, and which when bound by VGAM2119 RNA causes inhibition of translation of respective one or more VGAM2119 host target proteins.

It is further appreciated by one skilled in the art that the mode of translational inhibition illustrated by FIG. 1 with specific reference to translational inhibition exerted by VGAM2119 gene, herein designated VGAM GENE, on one or more VGAM2119 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2119 is inhibition of expression of host target genes, as part of a novel viral mechanism of attacking a host. Accordingly, utilities of VGAM2119 include diagnosis, prevention and treatment of viral infection by Cowpox Virus. Specific functions, and accordingly utilities, of VGAM2119 correlate with, and may be deduced from, the identity of the host target genes which VGAM2119 binds and inhibits, and the function of these host target genes, as elaborated hereinbelow.

Nucleotide sequences of the VGAM2119 precursor RNA, herein designated VGAM PRECURSOR RNA, and of the 'diced' VGAM2119 RNA, herein designated VGAM RNA, and a schematic representation of the secondary folding of VGAM2119 folded precursor RNA, herein designated VGAM FOLDED PRECURSOR RNA, of VGAM2119 are further described hereinbelow with reference to Table 1.

Nucleotide sequences of host target binding sites, such as BINDING SITE-I, BINDING SITE-II and BINDING SITE-III of FIG. 1, found on VGAM2119 host target RNA, and schematic representation of the complementarity of each of these host target binding sites to VGAM2119 RNA, herein designated VGAM RNA, are described hereinbelow with reference to Table 2.

As mentioned hereinabove with reference to FIG. 1, a function of VGAM2119 gene, herein designated VGAM is inhibition of expression of VGAM2119 target genes. It is appreciated that specific functions, and accordingly utilities, of VGAM2119 correlate with, and may be deduced from, the identity of the target genes which VGAM2119 binds and inhibits, and the function of these target genes, as elaborated hereinbelow.

PRO2435 (Accession NM_018527) is a VGAM2119 host target gene. PRO2435 BINDING SITE is HOST TARGET binding site found in the 5' untranslated region of mRNA encoded by PRO2435, corresponding to a HOST TARGET binding site such as BINDING SITE I, BINDING SITE II or BINDING SITE III. Table 2 illustrates the complementarity of the nucleotide sequences of PRO2435 BINDING SITE, designated SEQ ID:20598, to the nucleotide sequence of VGAM2119 RNA, herein designated VGAM RNA, also designated SEQ ID:4830.

A function of VGAM2119 is therefore inhibition of PRO2435 (Accession NM_018527). Accordingly, utilities of VGAM2119 include diagnosis, prevention and treatment of diseases and clinical conditions associated with PRO2435. LOC143425 (Accession XM_113695) is another VGAM2119 host target gene. LOC143425 BINDING SITE is HOST TARGET binding site found in the 3' untranslated region of mRNA encoded by LOC143425, corresponding to a HOST TARGET binding site such as BINDING SITE I, BINDING SITE II or BINDING SITE III. Table 2 illustrates the complementarity of the nucleotide sequences of LOC143425 BINDING SITE, designated SEQ ID:42354, to the nucleotide sequence of VGAM2119 RNA, herein designated VGAM RNA, also designated SEQ ID:4830.

Another function of VGAM2119 is therefore inhibition of LOC143425 (Accession XM_113695). Accordingly, utilities of VGAM2119 include diagnosis, prevention and treatment of diseases and clinical conditions associated with LOC143425. FIG. 1 further provides a conceptual description of a novel bioinformatically detected viral gene of the present invention, referred to here as Viral Genomic Address Messenger 2120 (VGAM2120) viral gene, which modulates expression of respective host target genes thereof, the function and utility of which host target genes is known in the art.

VGAM2120 is a novel bioinformatically detected regulatory, non protein coding, viral micro RNA (miRNA) gene. The method by which VGAM2120 was detected is described hereinabove with reference to FIGS. 1-8.

VGAM2120 gene, herein designated VGAM GENE, is a viral gene contained in the genome of Cowpox Virus. VGAM2120 host target gene, herein designated VGAM HOST TARGET GENE, is a human gene contained in the human genome.

VGAM2120 gene encodes a VGAM2120 precursor RNA, herein designated VGAM PRECURSOR RNA. Similar to other miRNA genes, and unlike most ordinary genes, VGAM2120 precursor RNA does not encode a protein. A nucleotide sequence identical or highly similar to the nucleotide sequence of VGAM2120 precursor RNA is designated SEQ ID:2106, and is provided hereinbelow with reference to the sequence listing part. Nucleotide sequence SEQ ID:2106 is located at position 214751 relative to the genome of Cowpox Virus.

VGAM2120 precursor RNA folds onto itself, forming VGAM2120 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2120 folded precursor RNA into VGAM2120 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2120 RNA is designated SEQ ID:4831, and is provided hereinbelow with reference to the sequence listing part.

VGAM2120 host target gene, herein designated VGAM HOST TARGET GENE, encodes a corresponding messenger RNA, VGAM2120 host target RNA, herein designated VGAM HOST TARGET RNA. VGAM2120 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2120 RNA, herein designated VGAM RNA, binds complementarily to one or more host target binding sites located in untranslated regions of VGAM2120 host target RNA, herein designated VGAM HOST TARGET RNA. This complementary binding is due to the fact that the nucleotide sequence of VGAM2120 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2120 RNA, herein designated VGAM RNA, may have a different number of host target binding sites in untranslated regions of a VGAM2120 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2120 RNA, herein designated VGAM RNA, to host target binding sites on VGAM2120 host target RNA, herein designated VGAM HOST TARGET RNA, such as BINDING SITE I, BINDING SITE II and BINDING SITE III, inhibits translation of VGAM2120 host target RNA into VGAM2120 host target protein, herein designated VGAM HOST TARGET PRO- TEIN. VGAM host target protein is therefore outlined by a broken line.

It is appreciated that VGAM2120 host target gene, herein designated VGAM HOST TARGET GENE, in fact represents a plurality of VGAM2120 host target genes. The mRNA of each one of this plurality of VGAM2120 host target genes comprises one or more host target binding sites, each having a nucleotide sequence which is at least partly complementary to VGAM2120 RNA, herein designated VGAM RNA, and which when bound by VGAM2120 RNA causes inhibition of translation of respective one or more VGAM2120 host target proteins.

It is further appreciated by one skilled in the art that the mode of translational inhibition illustrated by FIG. 1 with specific reference to translational inhibition exerted by VGAM2120 gene, herein designated VGAM GENE, on one or more VGAM2120 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2120 is inhibition of expression of host target genes, as part of a novel viral mechanism of attacking a host. Accordingly, utilities of VGAM2120 include diagnosis, prevention and treatment of viral infection by Cowpox Virus. Specific functions, and accordingly utilities, of VGAM2120 correlate with, and may be deduced from, the identity of the host target genes which VGAM2120 binds and inhibits, and the function of these host target genes, as elaborated hereinbelow.

Nucleotide sequences of the VGAM2120 precursor RNA, herein designated VGAM PRECURSOR RNA, and of the 'diced' VGAM2120 RNA, herein designated VGAM RNA, and a schematic representation of the secondary folding of VGAM2120 folded precursor RNA, herein designated VGAM FOLDED PRECURSOR RNA, of VGAM2120 are further described hereinbelow with reference to Table 1.

Nucleotide sequences of host target binding sites, such as BINDING SITE-I, BINDING SITE-II and BINDING SITE-III of FIG. 1, found on VGAM2120 host target RNA, and schematic representation of the complementarity of each of these host target binding sites to VGAM2120 RNA, herein designated VGAM RNA, are described hereinbelow with reference to Table 2.

As mentioned hereinabove with reference to FIG. 1, a function of VGAM2120 gene, herein designated VGAM is inhibition of expression of VGAM2120 target genes. It is appreciated that specific functions, and accordingly utilities, of VGAM2120 correlate with, and may be deduced from, the identity of the target genes which VGAM2120 binds and inhibits, and the function of these target genes, as elaborated hereinbelow.

ATP-binding Cassette, Sub-family A (ABC1), Member 1 (ABCA1, Accession NM_005502) is a VGAM2120 host target gene. ABCA1 BINDING SITE is HOST TARGET binding site found in the 3' untranslated region of mRNA encoded by ABCA1, corresponding to a HOST TARGET binding site such as BINDING SITE I, BINDING SITE II or BINDING SITE III. Table 2 illustrates the complementarity of the nucleotide sequences of ABCA1 BINDING SITE, designated SEQ ID:12012, to the nucleotide sequence of VGAM2120 RNA, herein designated VGAM RNA, also designated SEQ ID:4831.

A function of VGAM2120 is therefore inhibition of ATP-binding Cassette, Sub-family A (ABC1), Member 1 (ABCA1, Accession NM_005502), a gene which camp-dependent and sulfonylurea-sensitive anion transporter. Accordingly, utilities of VGAM2120 include diagnosis, prevention and treatment of diseases and clinical conditions associated with ABCA1. The function of ABCA1 and its association with various diseases and clinical conditions, has been established by previous studies, as described hereinabove with reference to VGAM1956. Ret Proto-oncogene (multiple endocrine neoplasia and medullary thyroid carcinoma 1, Hirschsprung disease) (RET, Accession NM_000323) is another VGAM2120 host target gene. RET BINDING SITE1 through RET BINDING SITE4 are HOST TARGET binding sites found in untranslated regions of mRNA encoded by RET, corresponding to HOST TARGET binding sites such as BINDING SITE I, BINDING SITE II or BINDING SITE III. Table 2 illustrates the complementarity of the nucleotide sequences of RET BINDING SITE1 through RET BINDING SITE4, designated SEQ ID:5866, SEQ ID:21780, SEQ ID:21782 and SEQ ID:21959 respectively, to the nucleotide sequence of VGAM2120 RNA, herein designated VGAM RNA, also designated SEQ ID:4831.

Another function of VGAM2120 is therefore inhibition of Ret Proto-oncogene (multiple endocrine neoplasia and medullary thyroid carcinoma 1, Hirschsprung disease) (RET, Accession NM_000323), a gene which transduces signals for cell growth and differentiation. Accordingly, utilities of VGAM2120 include diagnosis, prevention and treatment of diseases and clinical conditions associated with RET. The function of RET and its association with various diseases and clinical conditions, has been established by previous studies, as described hereinabove with reference to VGAM381. KIAA1023 (Accession NM_017604) is another VGAM2120 host target gene. KIAA1023 BINDING SITE is HOST TARGET binding site found in the 3' untranslated region of mRNA encoded by KIAA1023, corresponding to a HOST TARGET binding site such as BINDING SITE I, BINDING SITE II or BINDING SITE III. Table 2 illustrates the complementarity of the nucleotide sequences of KIAA1023 BINDING SITE, designated SEQ ID:19086, to the nucleotide sequence of VGAM2120 RNA, herein designated VGAM RNA, also designated SEQ ID:4831.

Another function of VGAM2120 is therefore inhibition of KIAA1023 (Accession NM_017604). Accordingly, utilities of VGAM2120 include diagnosis, prevention and treatment of diseases and clinical conditions associated with KIAA1023. Uronyl-2-sulfotransferase (UST, Accession NM_005715) is another VGAM2120 host target gene. UST BINDING SITE is HOST TARGET binding site found in the 3' untranslated region of mRNA encoded by UST, corresponding to a HOST TARGET binding site such as BINDING SITE I, BINDING SITE II or BINDING SITE III. Table 2 illustrates the complementarity of the nucleotide sequences of UST BINDING SITE, designated SEQ ID:12269, to the nucleotide sequence of VGAM2120 RNA, herein designated VGAM RNA, also designated SEQ ID:4831.

Another function of VGAM2120 is therefore inhibition of Uronyl-2-sulfotransferase (UST, Accession NM_005715). Accordingly, utilities of VGAM2120 include diagnosis, prevention and treatment of diseases and clinical conditions associated with UST. FIG. 1 further provides a conceptual description of a novel bioinformatically detected viral gene of the present invention, referred to here as Viral Genomic Address Messenger 2121 (VGAM2121) viral gene, which modulates expression of respective host target genes thereof, the function and utility of which host target genes is known in the art.

VGAM2121 is a novel bioinformatically detected regulatory, non protein coding, viral micro RNA (miRNA) gene. The method by which VGAM2121 was detected is described hereinabove with reference to FIGS. 1-8.

VGAM2121 gene, herein designated VGAM GENE, is a viral gene contained in the genome of Cowpox Virus. VGAM2121 host target gene, herein designated VGAM HOST TARGET GENE, is a human gene contained in the human genome.

VGAM2121 gene encodes a VGAM2121 precursor RNA, herein designated VGAM PRECURSOR RNA. Similar to other miRNA genes, and unlike most ordinary genes, VGAM2121 precursor RNA does not encode a protein. A nucleotide sequence identical or highly similar to the nucleotide sequence of VGAM2121 precursor RNA is designated SEQ ID:2107, and is provided hereinbelow with reference to the sequence listing part. Nucleotide sequence SEQ ID:2107 is located at position 6122 relative to the genome of Cowpox Virus.

VGAM2121 precursor RNA folds onto itself, forming VGAM2121 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2121 folded precursor RNA into VGAM2121 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2121 RNA is designated SEQ ID:4832, and is provided hereinbelow with reference to the sequence listing part.

VGAM2121 host target gene, herein designated VGAM HOST TARGET GENE, encodes a corresponding messenger RNA, VGAM2121 host target RNA, herein designated VGAM HOST TARGET RNA. VGAM2121 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2121 RNA, herein designated VGAM RNA, binds complementarily to one or more host target binding sites located in untranslated regions of VGAM2121 host target RNA, herein designated VGAM HOST TARGET RNA. This complementary binding is due to the fact that the nucleotide sequence of VGAM2121 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2121 RNA, herein designated VGAM RNA, may have a different number of host target binding sites in untranslated regions of a VGAM2121 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2121 RNA, herein designated VGAM RNA, to host target binding sites on VGAM2121 host target RNA, herein designated VGAM HOST TARGET RNA, such as BINDING SITE I, BINDING SITE II and BINDING SITE III, inhibits translation of VGAM2121 host target RNA into VGAM2121 host target protein, herein designated VGAM HOST TARGET PROTEIN. VGAM host target protein is therefore outlined by a broken line.

It is appreciated that VGAM2121 host target gene, herein designated VGAM HOST TARGET GENE, in fact represents a plurality of VGAM2121 host target genes. The mRNA of each one of this plurality of VGAM2121 host target genes comprises one or more host target binding sites, each having a nucleotide sequence which is at least partly complementary to VGAM2121 RNA, herein designated VGAM RNA, and which when bound by VGAM2121 RNA causes inhibition of translation of respective one or more VGAM2121 host target proteins.

It is further appreciated by one skilled in the art that the mode of translational inhibition illustrated by FIG. 1 with specific reference to translational inhibition exerted by VGAM2121 gene, herein designated VGAM GENE, on one or more VGAM2121 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2121 is inhibition of expression of host target genes, as part of a novel viral mechanism of attacking a host. Accordingly, utilities of VGAM2121 include diagnosis, prevention and treatment of viral infection by Cowpox Virus. Specific functions, and accordingly utilities, of VGAM2121 correlate with, and may be deduced from, the identity of the host target genes which VGAM2121 binds and inhibits, and the function of these host target genes, as elaborated hereinbelow.

Nucleotide sequences of the VGAM2121 precursor RNA, herein designated VGAM PRECURSOR RNA, and of the 'diced' VGAM2121 RNA, herein designated VGAM RNA, and a schematic representation of the secondary folding of VGAM2121 folded precursor RNA, herein designated VGAM FOLDED PRECURSOR RNA, of VGAM2121 are further described hereinbelow with reference to Table 1.

Nucleotide sequences of host target binding sites, such as BINDING SITE-I, BINDING SITE-II and BINDING SITE-III of FIG. 1, found on VGAM2121 host target RNA, and schematic representation of the complementarity of each of these host target binding sites to VGAM2121 RNA, herein designated VGAM RNA, are described hereinbelow with reference to Table 2.

As mentioned hereinabove with reference to FIG. 1, a function of VGAM2121 gene, herein designated VGAM is inhibition of expression of VGAM2121 target genes. It is appreciated that specific functions, and accordingly utilities, of VGAM2121 correlate with, and may be deduced from, the identity of the target genes which VGAM2121 binds and inhibits, and the function of these target genes, as elaborated hereinbelow.

FYVE and Coiled-coil Domain Containing 1 (FYCO1, Accession NM_024513) is a VGAM2121 host target gene. FYCO1 BINDING SITE is HOST TARGET binding site found in the 3' untranslated region of mRNA encoded by FYCO1, corresponding to a HOST TARGET binding site such as BINDING SITE I, BINDING SITE II or BINDING SITE III. Table 2 illustrates the complementarity of the nucleotide sequences of FYCO1 BINDING SITE, designated SEQ ID:23712, to the nucleotide sequence of VGAM2121 RNA, herein designated VGAM RNA, also designated SEQ ID:4832.

A function of VGAM2121 is therefore inhibition of FYVE and Coiled-coil Domain Containing 1 (FYCO1, Accession NM_024513). Accordingly, utilities of VGAM2121 include diagnosis, prevention and treatment of diseases and clinical conditions associated with FYCO1. FIG. 1 further provides a conceptual description of a novel bioinformatically detected viral gene of the present invention, referred to here as Viral Genomic Address Messenger 2122 (VGAM2122) viral gene, which modulates expression of respective host target genes thereof, the function and utility of which host target genes is known in the art.

VGAM2122 is a novel bioinformatically detected regulatory, non protein coding, viral micro RNA (miRNA) gene. The method by which VGAM2122 was detected is described hereinabove with reference to FIGS. 1-8.

VGAM2122 gene, herein designated VGAM GENE, is a viral gene contained in the genome of Cowpox Virus. VGAM2122 host target gene, herein designated VGAM HOST TARGET GENE, is a human gene contained in the human genome.

VGAM2122 gene encodes a VGAM2122 precursor RNA, herein designated VGAM PRECURSOR RNA. Similar to other miRNA genes, and unlike most ordinary genes, VGAM2122 precursor RNA does not encode a protein. A nucleotide sequence identical or highly similar to the nucleotide sequence of VGAM2122 precursor RNA is designated SEQ ID:2108, and is provided hereinbelow with reference to the sequence listing part. Nucleotide sequence SEQ ID:2108 is located at position 5631 relative to the genome of Cowpox Virus.

VGAM2122 precursor RNA folds onto itself, forming VGAM2122 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2122 folded precursor RNA into VGAM2122 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM2122 RNA is designated SEQ ID:4833, and is provided hereinbelow with reference to the sequence listing part.

VGAM2122 host target gene, herein designated VGAM HOST TARGET GENE, encodes a corresponding messenger RNA, VGAM2122 host target RNA, herein designated VGAM HOST TARGET RNA. VGAM2122 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2122 RNA, herein designated VGAM RNA, binds complementarily to one or more host target binding sites located in untranslated regions of VGAM2122 host target RNA, herein designated VGAM HOST TARGET RNA. This complementary binding is due to the fact that the nucleotide sequence of VGAM2122 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2122 RNA, herein designated VGAM RNA, may have a different number of host target binding sites in untranslated regions of a VGAM2122 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2122 RNA, herein designated VGAM RNA, to host target binding sites on VGAM2122 host target RNA, herein designated VGAM HOST TARGET RNA, such as BINDING SITE I, BINDING SITE II and BINDING SITE III, inhibits translation of VGAM2122 host target RNA into VGAM2122 host target protein, herein designated VGAM HOST TARGET PROTEIN. VGAM host target protein is therefore outlined by a broken line.

It is appreciated that VGAM2122 host target gene, herein designated VGAM HOST TARGET GENE, in fact represents a plurality of VGAM2122 host target genes. The mRNA of each one of this plurality of VGAM2122 host target genes comprises one or more host target binding sites, each having a nucleotide sequence which is at least partly complementary to VGAM2122 RNA, herein designated VGAM RNA, and which when bound by VGAM2122 RNA causes inhibition of translation of respective one or more VGAM2122 host target proteins.

It is further appreciated by one skilled in the art that the mode of translational inhibition illustrated by FIG. 1 with specific reference to translational inhibition exerted by VGAM2122 gene, herein designated VGAM GENE, on one or more VGAM2122 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2122 is inhibition of expression of host target genes, as part of a novel viral mechanism of attacking a host. Accordingly, utilities of VGAM2122 include diagnosis, prevention and treatment of viral infection by Cowpox Virus. Specific functions, and accordingly utilities, of VGAM2122 correlate with, and may be deduced from, the identity of the host target genes which VGAM2122 binds and inhibits, and the function of these host target genes, as elaborated hereinbelow.

Nucleotide sequences of the VGAM2122 precursor RNA, herein designated VGAM PRECURSOR RNA, and of the 'diced' VGAM2122 RNA, herein designated VGAM RNA, and a schematic representation of the secondary folding of VGAM2122 folded precursor RNA, herein designated VGAM FOLDED PRECURSOR RNA, of VGAM2122 are further described hereinbelow with reference to Table 1.

Nucleotide sequences of host target binding sites, such as BINDING SITE-I, BINDING SITE-II and BINDING SITE-III of FIG. 1, found on VGAM2122 host target RNA, and schematic representation of the complementarity of each of these host target binding sites to VGAM2122 RNA, herein designated VGAM RNA, are described hereinbelow with reference to Table 2.

As mentioned hereinabove with reference to FIG. 1, a function of VGAM2122 gene, herein designated VGAM is inhibition of expression of VGAM2122 target genes. It is appreciated that specific functions, and accordingly utilities, of VGAM2122 correlate with, and may be deduced from, the identity of the target genes which VGAM2122 binds and inhibits, and the function of these target genes, as elaborated hereinbelow.

Enoyl Coenzyme A Hydratase 1, Peroxisomal (ECH1, Accession XM_008904) is a VGAM2122 host target gene. ECH1 BINDING SITE is HOST TARGET binding site found in the 5' untranslated region of mRNA encoded by ECH1, corresponding to a HOST TARGET binding site such as BINDING SITE I, BINDING SITE II or BINDING SITE III. Table 2 illustrates the complementarity of the nucleotide sequences of ECH1 BINDING SITE, designated SEQ ID:30097, to the nucleotide sequence of VGAM2122 RNA, herein designated VGAM RNA, also designated SEQ ID:4833.

A function of VGAM2122 is therefore inhibition of Enoyl Coenzyme A Hydratase 1, Peroxisomal (ECH1, Accession XM_008904). Accordingly, utilities of VGAM2122 include diagnosis, prevention and treatment of diseases and clinical conditions associated with ECH1. LOC203317 (Accession XM_114683) is another VGAM2122 host target gene. LOC203317 BINDING SITE is HOST TARGET binding site found in the 5' untranslated region of mRNA encoded by LOC203317, corresponding to a HOST TARGET binding site such as BINDING SITE I, BINDING SITE II or BINDING SITE III. Table 2 illustrates the complementarity of the nucleotide sequences of LOC203317 BINDING SITE, designated SEQ ID:43030, to the nucleotide sequence of VGAM2122 RNA, herein designated VGAM RNA, also designated SEQ ID:4833.

Another function of VGAM2122 is therefore inhibition of LOC203317 (Accession XM_114683). Accordingly, utilities of VGAM2122 include diagnosis, prevention and treatment of diseases and clinical conditions associated with LOC203317. FIG. 1 further provides a conceptual description of a novel bioinformatically detected viral gene of the present invention, referred to here as Viral Genomic Address Messenger 2123 (VGAM2123) viral gene, which modulates expression of respective host target genes thereof, the function and utility of which host target genes is known in the art.

VGAM2123 is a novel bioinformatically detected regulatory, non protein coding, viral micro RNA (miRNA) gene. The method by which VGAM2123 was detected is described hereinabove with reference to FIGS. 1-8.

VGAM2123 gene, herein designated VGAM GENE, is a viral gene contained in the genome of Cowpox Virus. VGAM2123 host target gene, herein designated VGAM HOST TARGET GENE, is a human gene contained in the human genome.

VGAM2123 gene encodes a VGAM2123 precursor RNA, herein designated VGAM PRECURSOR RNA. Similar to other miRNA genes, and unlike most ordinary genes, VGAM2123 precursor RNA does not encode a protein. A nucleotide sequence identical or highly similar to the nucleotide sequence of VGAM2123 precursor RNA is designated SEQ ID:2109, and is provided hereinbelow with reference to the sequence listing part. Nucleotide sequence SEQ ID:2109 is located at position 208014 relative to the genome of Cowpox Virus.

VGAM2123 precursor RNA folds onto itself, forming VGAM2123 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2123 folded precursor RNA into VGAM2123 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2123 RNA is designated SEQ ID:4834, and is provided hereinbelow with reference to the sequence listing part.

VGAM2123 host target gene, herein designated VGAM HOST TARGET GENE, encodes a corresponding messenger RNA, VGAM2123 host target RNA, herein designated VGAM HOST TARGET RNA. VGAM2123 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2123 RNA, herein designated VGAM RNA, binds complementarily to one or more host target binding sites located in untranslated regions of VGAM2123 host target RNA, herein designated VGAM HOST TARGET RNA. This complementary binding is due to the fact that the nucleotide sequence of VGAM2123 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2123 RNA, herein designated VGAM RNA, may have a different number of host target binding sites in untranslated regions of a VGAM2123 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2123 RNA, herein designated VGAM RNA, to host target binding sites on VGAM2123 host target RNA, herein designated VGAM HOST TARGET RNA, such as BINDING SITE I, BINDING SITE II and BINDING SITE III, inhibits translation of VGAM2123 host target RNA into VGAM2123 host target protein, herein designated VGAM HOST TARGET PROTEIN. VGAM host target protein is therefore outlined by a broken line.

It is appreciated that VGAM2123 host target gene, herein designated VGAM HOST TARGET GENE, in fact represents a plurality of VGAM2123 host target genes. The mRNA of each one of this plurality of VGAM2123 host target genes comprises one or more host target binding sites, each having a nucleotide sequence which is at least partly complementary to VGAM2123 RNA, herein designated VGAM RNA, and which when bound by VGAM2123 RNA causes inhibition of translation of respective one or more VGAM2123 host target proteins.

It is further appreciated by one skilled in the art that the mode of translational inhibition illustrated by FIG. 1 with specific reference to translational inhibition exerted by VGAM2123 gene, herein designated VGAM GENE, on one or more VGAM2123 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2123 is inhibition of expression of host target genes, as part of a novel viral mechanism of attacking a host. Accordingly, utilities of VGAM2123 include diagnosis, prevention and treatment of viral infection by Cowpox Virus. Specific functions, and accordingly utilities, of VGAM2123 correlate with, and may be deduced from, the identity of the host target genes which VGAM2123 binds and inhibits, and the function of these host target genes, as elaborated hereinbelow.

Nucleotide sequences of the VGAM2123 precursor RNA, herein designated VGAM PRECURSOR RNA, and of the 'diced' VGAM2123 RNA, herein designated VGAM RNA, and a schematic representation of the secondary folding of VGAM2123 folded precursor RNA, herein designated VGAM FOLDED PRECURSOR RNA, of VGAM2123 are further described hereinbelow with reference to Table 1.

Nucleotide sequences of host target binding sites, such as BINDING SITE-I, BINDING SITE-II and BINDING SITE-III of FIG. 1, found on VGAM2123 host target RNA, and schematic representation of the complementarity of each of these host target binding sites to VGAM2123 RNA, herein designated VGAM RNA, are described hereinbelow with reference to Table 2.

As mentioned hereinabove with reference to FIG. 1, a function of VGAM2123 gene, herein designated VGAM is inhibition of expression of VGAM2123 target genes. It is appreciated that specific functions, and accordingly utilities, of VGAM2123 correlate with, and may be deduced from, the identity of the target genes which VGAM2123 binds and inhibits, and the function of these target genes, as elaborated hereinbelow.

Dachshund Homolog (Drosophila) (DACH, Accession NM_080759) is a VGAM2123 host target gene. DACH BINDING SITE is HOST TARGET binding site found in the 3' untranslated region of mRNA encoded by DACH, corresponding to a HOST TARGET binding site such as BINDING SITE I, BINDING SITE II or BINDING SITE III. Table 2 illustrates the complementarity of the nucleotide sequences of DACH BINDING SITE, designated SEQ ID:28042, to the nucleotide sequence of VGAM2123 RNA, herein designated VGAM RNA, also designated SEQ ID:4834.

A function of VGAM2123 is therefore inhibition of Dachshund Homolog (Drosophila) (DACH, Accession NM_080759), a gene which regulates early progenitor cell proliferation during retinogenesis and pituitary development. Accordingly, utilities of VGAM2123 include diagnosis, prevention and treatment of diseases and clinical conditions associated with DACH. The function of DACH and its association with various diseases and clinical conditions, has been established by previous studies, as described hereinabove with reference to VGAM260. Fragile X Mental Retardation 1 (FMR1, Accession NM_002024) is another VGAM2123 host target gene. FMR1 BINDING SITE is HOST TARGET binding site found in the 3' untranslated region of mRNA encoded by FMR1, corresponding to a HOST TARGET binding site such as BINDING SITE I, BINDING SITE II or BINDING SITE III. Table 2 illustrates the complementarity of the nucleotide sequences of FMR1 BINDING SITE, designated SEQ ID:7776, to the nucleotide sequence of VGAM2123 RNA, herein designated VGAM RNA, also designated SEQ ID:4834.

Another function of VGAM2123 is therefore inhibition of Fragile X Mental Retardation 1 (FMR1, Accession NM_002024). Accordingly, utilities of VGAM2123 include diagnosis, prevention and treatment of diseases and clinical conditions associated with FMR1. Maltase-glucoamylase (alpha-glucosidase) (MGAM, Accession XM_051351) is another VGAM2123 host target gene. MGAM BINDING SITE is HOST TARGET binding site found in the 3' untranslated region of mRNA encoded by MGAM, corresponding to a HOST TARGET binding site such as BINDING SITE I, BINDING SITE II or BINDING SITE III. Table 2 illustrates the complementarity of the nucleotide sequences of MGAM BINDING SITE, designated SEQ ID:35822, to the nucleotide sequence of VGAM2123 RNA, herein designated VGAM RNA, also designated SEQ ID:4834.

Another function of VGAM2123 is therefore inhibition of Maltase-glucoamylase (alpha-glucosidase) (MGAM, Accession XM_051351), a gene which plays a role in the final steps of digestion of starch. Accordingly, utilities of VGAM2123 include diagnosis, prevention and treatment of diseases and clinical conditions associated with MGAM. The function of MGAM and its association with various diseases and clinical conditions, has been established by previous studies, as described hereinabove with reference to VGAM791. MHC Class II Transactivator (MHC2TA, Accession NM_000246) is another VGAM2123 host target gene. MHC2TA BINDING SITE is HOST TARGET binding site found in the 3' untranslated region of mRNA encoded by MHC2TA, corresponding to a HOST TARGET binding site such as BINDING SITE I, BINDING SITE II or BINDING SITE III. Table 2 illustrates the complementarity of the nucleotide sequences of MHC2TA BINDING SITE, designated SEQ ID:5784, to the nucleotide sequence of VGAM2123 RNA, herein designated VGAM RNA, also designated SEQ ID:4834.

Another function of VGAM2123 is therefore inhibition of MHC Class II Transactivator (MHC2TA, Accession NM_000246). Accordingly, utilities of VGAM2123 include diagnosis, prevention and treatment of diseases and clinical conditions associated with MHC2TA. Reserved (C8orf13, Accession XM_088377) is another VGAM2123 host target gene. C8orf13 BINDING SITE is HOST TARGET binding site found in the 3' untranslated region of mRNA encoded by C8orf13, corresponding to a HOST TARGET binding site such as BINDING SITE I, BINDING SITE II or BINDING SITE III. Table 2 illustrates the complementarity of the nucleotide sequences of C8orf13 BINDING SITE, designated SEQ ID:39657, to the nucleotide sequence of VGAM2123 RNA, herein designated VGAM RNA, also designated SEQ ID:4834.

Another function of VGAM2123 is therefore inhibition of Reserved (C8orf13, Accession XM_088377). Accordingly, utilities of VGAM2123 include diagnosis, prevention and treatment of diseases and clinical conditions associated with C8orf13. FLJ11827 (Accession NM_025093) is another VGAM2123 host target gene. FLJ11827 BINDING SITE is HOST TARGET binding site found in the 3' untranslated region of mRNA encoded by FLJ11827, corresponding to a HOST TARGET binding site such as BINDING SITE I, BINDING SITE II or BINDING SITE III. Table 2 illustrates the complementarity of the nucleotide sequences of FLJ11827 BINDING SITE, designated SEQ ID:24723, to the nucleotide sequence of VGAM2123 RNA, herein designated VGAM RNA, also designated SEQ ID:4834.

Another function of VGAM2123 is therefore inhibition of FLJ11827 (Accession NM_025093). Accordingly, utilities of VGAM2123 include diagnosis, prevention and treatment of diseases and clinical conditions associated with FLJ11827. KIAA0472 (Accession XM_050147) is another VGAM2123 host target gene. KIAA0472 BINDING SITE is HOST TARGET binding site found in the 5' untranslated region of mRNA encoded by KIAA0472, corresponding to a HOST TARGET binding site such as BINDING SITE I, BINDING SITE II or BINDING SITE III. Table 2 illustrates the complementarity of the nucleotide sequences of KIAA0472 BINDING SITE, designated SEQ ID:35583, to the nucleotide sequence of VGAM2123 RNA, herein designated VGAM RNA, also designated SEQ ID:4834.

Another function of VGAM2123 is therefore inhibition of KIAA0472 (Accession XM_050147). Accordingly, utilities of VGAM2123 include diagnosis, prevention and treatment of diseases and clinical conditions associated with KIAA0472. SRY (sex determining region Y)-box 6 (SOX6, Accession NM_033326) is another VGAM2123 host target gene. SOX6 BINDING SITE is HOST TARGET binding site found in the 3' untranslated region of mRNA encoded by SOX6, corresponding to a HOST TARGET binding site such as BINDING SITE I, BINDING SITE II or BINDING SITE III. Table 2 illustrates the complementarity of the nucleotide sequences of SOX6 BINDING SITE, designated SEQ ID:27159, to the nucleotide sequence of VGAM2123 RNA, herein designated VGAM RNA, also designated SEQ ID:4834.

Another function of VGAM2123 is therefore inhibition of SRY (sex determining region Y)-box 6 (SOX6, Accession NM_033326). Accordingly, utilities of VGAM2123 include diagnosis, prevention and treatment of diseases and clinical conditions associated with SOX6. LOC149276 (Accession XM_097621) is another VGAM2123 host target gene. LOC149276 BINDING SITE is HOST TARGET binding site found in the 3' untranslated region of mRNA encoded by LOC149276, corresponding to a HOST TARGET binding site such as BINDING SITE I, BINDING SITE II or BINDING SITE III. Table 2 illustrates the complementarity of the nucleotide sequences of LOC149276 BINDING SITE, designated SEQ ID:40977, to the nucleotide sequence of VGAM2123 RNA, herein designated VGAM RNA, also designated SEQ ID:4834.

Another function of VGAM2123 is therefore inhibition of LOC149276 (Accession XM_097621). Accordingly, utilities of VGAM2123 include diagnosis, prevention and treatment of diseases and clinical conditions associated with LOC149276. LOC153910 (Accession XM_087801) is another VGAM2123 host target gene. LOC153910 BINDING SITE is HOST TARGET binding site found in the 5' untranslated region of mRNA encoded by LOC153910, corresponding to a HOST TARGET binding site such as BINDING SITE I, BINDING SITE II or BINDING SITE III. Table 2 illustrates the complementarity of the nucleotide sequences of LOC153910 BINDING SITE, designated SEQ ID:39441, to the nucleotide sequence of VGAM2123 RNA, herein designated VGAM RNA, also designated SEQ ID:4834.

Another function of VGAM2123 is therefore inhibition of LOC153910 (Accession XM_087801). Accordingly, utilities of VGAM2123 include diagnosis, prevention and treatment of diseases and clinical conditions associated with LOC153910. FIG. 1 further provides a conceptual description of a novel bioinformatically detected viral gene of the present invention, referred to here as Viral Genomic Address Messenger 2124 (VGAM2124) viral gene, which modulates expression of respective host target genes thereof, the function and utility of which host target genes is known in the art.

VGAM2124 is a novel bioinformatically detected regulatory, non protein coding, viral micro RNA (miRNA) gene. The method by which VGAM2124 was detected is described hereinabove with reference to FIGS. 1-8.

VGAM2124 gene, herein designated VGAM GENE, is a viral gene contained in the genome of Cowpox Virus. VGAM2124 host target gene, herein designated VGAM HOST TARGET GENE, is a human gene contained in the human genome.

VGAM2124 gene encodes a VGAM2124 precursor RNA, herein designated VGAM PRECURSOR RNA. Similar to other miRNA genes, and unlike most ordinary genes, VGAM2124 precursor RNA does not encode a protein. A nucleotide sequence identical or highly similar to the nucleotide sequence of VGAM2124 precursor RNA is designated SEQ ID:2110, and is provided hereinbelow with reference to the sequence listing part. Nucleotide sequence SEQ ID:2110 is located at position 205910 relative to the genome of Cowpox Virus.

VGAM2124 precursor RNA folds onto itself, forming VGAM2124 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2124 folded precursor RNA into VGAM2124 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM2124 RNA is designated SEQ ID:4835, and is provided hereinbelow with reference to the sequence listing part.

VGAM2124 host target gene, herein designated VGAM HOST TARGET GENE, encodes a corresponding messenger RNA, VGAM2124 host target RNA, herein designated VGAM HOST TARGET RNA. VGAM2124 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2124 RNA, herein designated VGAM RNA, binds complementarily to one or more host target binding sites located in untranslated regions of VGAM2124 host target RNA, herein designated VGAM HOST TARGET RNA. This complementary binding is due to the fact that the nucleotide sequence of VGAM2124 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2124 RNA, herein designated VGAM RNA, may have a different number of host target binding sites in untranslated regions of a VGAM2124 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2124 RNA, herein designated VGAM RNA, to host target binding sites on VGAM2124 host target RNA, herein designated VGAM HOST TARGET RNA, such as BINDING SITE I, BINDING SITE II and BINDING SITE III, inhibits translation of VGAM2124 host target RNA into VGAM2124 host target protein, herein designated VGAM HOST TARGET PROTEIN. VGAM host target protein is therefore outlined by a broken line.

It is appreciated that VGAM2124 host target gene, herein designated VGAM HOST TARGET GENE, in fact represents a plurality of VGAM2124 host target genes. The mRNA of each one of this plurality of VGAM2124 host target genes comprises one or more host target binding sites, each having a nucleotide sequence which is at least partly complementary to VGAM2124 RNA, herein designated VGAM RNA, and which when bound by VGAM2124 RNA causes inhibition of translation of respective one or more VGAM2124 host target proteins.

It is further appreciated by one skilled in the art that the mode of translational inhibition illustrated by FIG. 1 with specific reference to translational inhibition exerted by VGAM2124 gene, herein designated VGAM GENE, on one or more VGAM2124 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2124 is inhibition of expression of host target genes, as part of a novel viral mechanism of attacking a host. Accordingly, utilities of VGAM2124 include diagnosis, prevention and treatment of viral infection by Cowpox Virus. Specific functions, and accordingly utilities, of VGAM2124 correlate with, and may be deduced from, the identity of the host target genes which VGAM2124 binds and inhibits, and the function of these host target genes, as elaborated hereinbelow.

Nucleotide sequences of the VGAM2124 precursor RNA, herein designated VGAM PRECURSOR RNA, and of the 'diced' VGAM2124 RNA, herein designated VGAM RNA, and a schematic representation of the secondary folding of VGAM2124 folded precursor RNA, herein designated VGAM FOLDED PRECURSOR RNA, of VGAM2124 are further described hereinbelow with reference to Table 1.

Nucleotide sequences of host target binding sites, such as BINDING SITE-I, BINDING SITE-II and BINDING SITE-III of FIG. 1, found on VGAM2124 host target RNA, and schematic representation of the complementarity of each of these host target binding sites to VGAM2124 RNA, herein designated VGAM RNA, are described hereinbelow with reference to Table 2.

As mentioned hereinabove with reference to FIG. 1, a function of VGAM2124 gene, herein designated VGAM is inhibition of expression of VGAM2124 target genes. It is appreciated that specific functions, and accordingly utilities, of VGAM2124 correlate with, and may be deduced from, the identity of the target genes which VGAM2124 binds and inhibits, and the function of these target genes, as elaborated hereinbelow.

Elongation of Very Long Chain Fatty Acids (FEN1/Elo2, SUR4/Elo3, yeast)-like 4 (ELOVL4, Accession NM_022726) is a VGAM2124 host target gene. ELOVL4 BINDING SITE is HOST TARGET binding site found in the 3' untranslated region of mRNA encoded by ELOVL4, corresponding to a HOST TARGET binding site such as BINDING SITE I, BINDING SITE II or BINDING SITE III. Table 2 illustrates the complementarity of the nucleotide sequences of ELOVL4 BINDING SITE, designated SEQ ID:22928, to the nucleotide sequence of VGAM2124 RNA, herein designated VGAM RNA, also designated SEQ ID:4835.

A function of VGAM2124 is therefore inhibition of Elongation of Very Long Chain Fatty Acids (FEN1/Elo2, SUR4/Elo3, yeast)-like 4 (ELOVL4, Accession NM_022726). Accordingly, utilities of VGAM2124 include diagnosis, prevention and treatment of diseases and clinical conditions associated with ELOVL4. Glutaminase (GLS, Accession NM_014905) is another VGAM2124 host target gene. GLS BINDING SITE is HOST TARGET binding site found in the 3' untranslated region of mRNA encoded by GLS, corresponding to a HOST TARGET binding site such as BINDING SITE I, BINDING SITE II or BINDING SITE III. Table 2 illustrates the complementarity of the nucleotide sequences of GLS BINDING SITE, designated SEQ ID:17110, to the nucleotide sequence of VGAM2124 RNA, herein designated VGAM RNA, also designated SEQ ID:4835.

Another function of VGAM2124 is therefore inhibition of Glutaminase (GLS, Accession NM_014905). Accordingly, utilities of VGAM2124 include diagnosis, prevention and treatment of diseases and clinical conditions associated with GLS. Homeo Box C5 (HOXC5, Accession NM_018953) is another VGAM2124 host target gene. HOXC5 BINDING SITE is HOST TARGET binding site found in the 3' untranslated region of mRNA encoded by HOXC5, corresponding to a HOST TARGET binding site such as BINDING SITE I, BINDING SITE II or BINDING SITE III. Table 2 illustrates the complementarity of the nucleotide sequences of HOXC5 BINDING SITE, designated SEQ ID:21022, to the nucleotide sequence of VGAM2124 RNA, herein designated VGAM RNA, also designated SEQ ID:4835.

Another function of VGAM2124 is therefore inhibition of Homeo Box C5 (HOXC5, Accession NM_018953). Accordingly, utilities of VGAM2124 include diagnosis, prevention and treatment of diseases and clinical conditions associated with HOXC5. Insulin-like Growth Factor Binding Protein 3 (IGFBP3, Accession NM_000598) is another VGAM2124 host target gene. IGFBP3 BINDING SITE is HOST TARGET binding site found in the 3' untranslated region of mRNA encoded by IGFBP3, corresponding to a HOST TARGET binding site such as BINDING SITE I, BINDING SITE II or BINDING SITE III. Table 2 illustrates the complementarity of the nucleotide sequences of IGFBP3 BINDING SITE, designated SEQ ID:6199, to the nucleotide sequence of VGAM2124 RNA, herein designated VGAM RNA, also designated SEQ ID:4835.

Another function of VGAM2124 is therefore inhibition of Insulin-like Growth Factor Binding Protein 3 (IGFBP3, Accession NM_000598). Accordingly, utilities of VGAM2124 include diagnosis, prevention and treatment of diseases and clinical conditions associated with IGFBP3. Lamin B Receptor (LBR, Accession XM_001795) is another VGAM2124 host target gene. LBR BINDING SITE is HOST TARGET binding site found in the 3' untranslated region of mRNA encoded by LBR, corresponding to a HOST TARGET binding site such as BINDING SITE I, BINDING SITE II or BINDING SITE III. Table 2 illustrates the complementarity of the nucleotide sequences of LBR BINDING SITE, designated SEQ ID:29851, to the nucleotide sequence of VGAM2124 RNA, herein designated VGAM RNA, also designated SEQ ID:4835.

Another function of VGAM2124 is therefore inhibition of Lamin B Receptor (LBR, Accession XM_001795). Accordingly, utilities of VGAM2124 include diagnosis, prevention and treatment of diseases and clinical conditions associated with LBR. PR Domain Containing 2, with ZNF Domain (PRDM2, Accession NM_015866) is another VGAM2124 host target gene. PRDM2 BINDING SITE is HOST TARGET binding site found in the 3' untranslated region of mRNA encoded by PRDM2, corresponding to a HOST TARGET binding site such as BINDING SITE I, BINDING SITE II or BINDING SITE III. Table 2 illustrates the complementarity of the nucleotide sequences of PRDM2 BINDING SITE, designated SEQ ID:18007, to the nucleotide sequence of VGAM2124 RNA, herein designated VGAM RNA, also designated SEQ ID:4835.

Another function of VGAM2124 is therefore inhibition of PR Domain Containing 2, with ZNF Domain (PRDM2, Accession NM_015866), a gene which plays a role in transcriptional regulation during neuronal differentiation and pathogenesis of retinoblastoma. Accordingly, utilities of VGAM2124 include diagnosis, prevention and treatment of diseases and clinical conditions associated with PRDM2. The function of PRDM2 and its association with various diseases and clinical conditions, has been established by previous studies, as described hereinabove with reference to VGAM120. Solute Carrier Family 4, Sodium Bicarbonate Cotransporter, Member 7 (SLC4A7, Accession NM_003615) is another VGAM2124 host target gene. SLC4A7 BINDING SITE is HOST TARGET binding site found in the 3' untranslated region of mRNA encoded by SLC4A7, corresponding to a HOST TARGET binding site such as BINDING SITE I, BINDING SITE II or BINDING SITE III. Table 2 illustrates the complementarity of the nucleotide sequences of SLC4A7 BINDING SITE, designated SEQ ID:9673, to the nucleotide sequence of VGAM2124 RNA, herein designated VGAM RNA, also designated SEQ ID:4835.

Another function of VGAM2124 is therefore inhibition of Solute Carrier Family 4, Sodium Bicarbonate Cotransporter, Member 7 (SLC4A7, Accession NM_003615), a gene which mediates the coupled movement of sodium and bicarbonate ions across the plasma membrane. Accordingly, utilities of VGAM2124 include diagnosis, prevention and treatment of diseases and clinical conditions associated with SLC4A7. The function of SLC4A7 and its association with various diseases and clinical conditions, has been established by previous studies, as described hereinabove with reference to VGAM66. Sorting Nexin 6 (SNX6, Accession NM_021249) is another VGAM2124 host target gene. SNX6 BINDING SITE is HOST TARGET binding site found in the 3' untranslated region of mRNA encoded by SNX6, corresponding to a HOST TARGET binding site such as BINDING SITE I, BINDING SITE II or BINDING SITE III. Table 2 illustrates the complementarity of the nucleotide sequences of SNX6 BINDING SITE, designated SEQ ID:22219, to the nucleotide sequence of VGAM2124 RNA, herein designated VGAM RNA, also designated SEQ ID:4835.

Another function of VGAM2124 is therefore inhibition of Sorting Nexin 6 (SNX6, Accession NM_021249). Accordingly, utilities of VGAM2124 include diagnosis, prevention and treatment of diseases and clinical conditions associated with SNX6. Thymidine Kinase 2, Mitochondrial (TK2, Accession NM_004614) is another VGAM2124 host target gene. TK2 BINDING SITE is HOST TARGET binding site found in the 3' untranslated region of mRNA encoded by TK2, corresponding to a HOST TARGET binding site such as BINDING SITE I, BINDING SITE II or BINDING SITE III. Table 2 illustrates the complementarity of the nucleotide sequences of TK2 BINDING SITE, designated SEQ ID:10960, to the nucleotide sequence of VGAM2124 RNA, herein designated VGAM RNA, also designated SEQ ID:4835.

Another function of VGAM2124 is therefore inhibition of Thymidine Kinase 2, Mitochondrial (TK2, Accession NM_004614), a gene which phosphorylates thymidine, deoxycytidine, deoxyuridine, and also anti-viral and anti-cancer nucleoside analogs. Accordingly, utilities of VGAM2124 include diagnosis, prevention and treatment of diseases and clinical conditions associated with TK2. The function of TK2 and its association with various diseases and clinical conditions, has been established by previous studies, as described hereinabove with reference to VGAM210. Tropomodulin 2 (neuronal) (TMOD2, Accession NM_014548) is another VGAM2124 host target gene. TMOD2 BINDING SITE is HOST TARGET binding site found in the 3' untranslated region of mRNA encoded by TMOD2, corresponding to a HOST TARGET binding site such as BINDING SITE I, BINDING SITE II or BINDING SITE III. Table 2 illustrates the complementarity of the nucleotide sequences of TMOD2 BINDING SITE, designated SEQ ID:15860, to the nucleotide sequence of VGAM2124 RNA, herein designated VGAM RNA, also designated SEQ ID:4835.

Another function of VGAM2124 is therefore inhibition of Tropomodulin 2 (neuronal) (TMOD2, Accession NM_014548), a gene which is an actin-capping protein for the slow-growing end of filamentous actin. Accordingly, utilities of VGAM2124 include diagnosis, prevention and treatment of diseases and clinical conditions associated with TMOD2. The function of TMOD2 and its association with various diseases and clinical conditions, has been established by previous studies, as described hereinabove with reference to VGAM791. WAS Protein Family, Member 3 (WASF3, Accession NM_006646) is another VGAM2124 host target gene. WASF3 BINDING SITE is HOST TARGET binding site found in the 5' untranslated region of mRNA encoded by WASF3, corresponding to a HOST TARGET binding site such as BINDING SITE I, BINDING SITE II or BINDING SITE III. Table 2 illustrates the complementarity of the nucleotide sequences of WASF3 BINDING SITE, designated SEQ ID:13445, to the nucleotide sequence of VGAM2124 RNA, herein designated VGAM RNA, also designated SEQ ID:4835.

Another function of VGAM2124 is therefore inhibition of WAS Protein Family, Member 3 (WASF3, Accession NM_006646), a gene which stimulates actin polymerization. Accordingly, utilities of VGAM2124 include diagnosis, prevention and treatment of diseases and clinical conditions associated with WASF3. The function of WASF3 and its association with various diseases and clinical conditions, has been established by previous studies, as described hereinabove with reference to VGAM1692. Chromosome 11 Open Reading Frame 21 (C11orf21, Accession NM_014144) is another VGAM2124 host target gene. C11orf21 BINDING SITE is HOST TARGET binding site found in the 3' untranslated region of mRNA encoded by C11orf21, corresponding to a HOST TARGET binding site such as BINDING SITE I, BINDING SITE II or BINDING SITE III. Table 2 illustrates the complementarity of the nucleotide sequences of C11orf21 BINDING SITE, designated SEQ ID:15428, to the nucleotide sequence of VGAM2124 RNA, herein designated VGAM RNA, also designated SEQ ID:4835.

Another function of VGAM2124 is therefore inhibition of Chromosome 11 Open Reading Frame 21 (C11orf21, Accession NM_014144). Accordingly, utilities of VGAM2124 include diagnosis, prevention and treatment of diseases and clinical conditions associated with C11orf21. DnaJ (Hsp40) Homolog, Subfamily A, Member 3 (DNAJA3, Accession XM_017984) is another VGAM2124 host target gene. DNAJA3 BINDING SITE is HOST TARGET binding site found in the 3' untranslated region of mRNA encoded by DNAJA3, corresponding to a HOST TARGET binding site such as BINDING SITE I, BINDING SITE II or BINDING SITE III. Table 2 illustrates the complementarity of the nucleotide sequences of DNAJA3 BINDING SITE, designated SEQ ID:30335, to the nucleotide sequence of VGAM2124 RNA, herein designated VGAM RNA, also designated SEQ ID:4835.

Another function of VGAM2124 is therefore inhibition of DnaJ (Hsp40) Homolog, Subfamily A, Member 3 (DNAJA3, Accession XM_017984). Accordingly, utilities of VGAM2124 include diagnosis, prevention and treatment of diseases and clinical conditions associated with DNAJA3. FLJ12761 (Accession NM_024545) is another VGAM2124 host target gene. FLJ12761 BINDING SITE is HOST TARGET binding site found in the 3' untranslated region of mRNA encoded by FLJ12761, corresponding to a HOST TARGET binding site such as BINDING SITE I, BINDING SITE II or BINDING SITE III. Table 2 illustrates the complementarity of the nucleotide sequences of FLJ12761 BINDING SITE, designated SEQ ID:23758, to the nucleotide sequence of VGAM2124 RNA, herein designated VGAM RNA, also designated SEQ ID:4835.

Another function of VGAM2124 is therefore inhibition of FLJ12761 (Accession NM_024545). Accordingly, utilities of VGAM2124 include diagnosis, prevention and treatment of diseases and clinical conditions associated with FLJ12761. FLJ12788 (Accession NM_022492) is another VGAM2124 host target gene. FLJ12788 BINDING SITE is HOST TARGET binding site found in the 3' untranslated region of mRNA encoded by FLJ12788, corresponding to a HOST TARGET binding site such as BINDING SITE I, BINDING SITE II or BINDING SITE III. Table 2 illustrates the complementarity of the nucleotide sequences of FLJ12788 BINDING SITE, designated SEQ ID:22874, to the nucleotide sequence of VGAM2124 RNA, herein designated VGAM RNA, also designated SEQ ID:4835.

Another function of VGAM2124 is therefore inhibition of FLJ12788 (Accession NM_022492). Accordingly, utilities of VGAM2124 include diagnosis, prevention and treatment of diseases and clinical conditions associated with FLJ12788. FLJ20783 (Accession NM_017958) is another VGAM2124 host target gene. FLJ20783 BINDING SITE is HOST TARGET binding site found in the 3' untranslated region of mRNA encoded by FLJ20783, corresponding to a HOST TARGET binding site such as BINDING SITE I, BINDING SITE II or BINDING SITE III. Table 2 illustrates the complementarity of the nucleotide sequences of FLJ20783 BINDING SITE, designated SEQ ID:19672, to the nucleotide sequence of VGAM2124 RNA, herein designated VGAM RNA, also designated SEQ ID:4835.

Another function of VGAM2124 is therefore inhibition of FLJ20783 (Accession NM_017958). Accordingly, utilities of VGAM2124 include diagnosis, prevention and treatment of diseases and clinical conditions associated with FLJ20783. KIAA0179 (Accession XM_035973) is another VGAM2124 host target gene. KIAA0179 BINDING SITE is HOST TARGET binding site found in the 3' untranslated region of mRNA encoded by KIAA0179, corresponding to a HOST TARGET binding site such as BINDING SITE I, BINDING SITE II or BINDING SITE III. Table 2 illustrates the complementarity of the nucleotide sequences of KIAA0179 BINDING SITE, designated SEQ ID:32368, to the nucleotide sequence of VGAM2124 RNA, herein designated VGAM RNA, also designated SEQ ID:4835.

Another function of VGAM2124 is therefore inhibition of KIAA0179 (Accession XM_035973). Accordingly, utilities of VGAM2124 include diagnosis, prevention and treatment of diseases and clinical conditions associated with KIAA0179. KIAA1209 (Accession XM_027307) is another VGAM2124 host target gene. KIAA1209 BINDING SITE is HOST TARGET binding site found in the 3' untranslated region of mRNA encoded by KIAA1209, corresponding to a HOST TARGET binding site such as BINDING SITE I, BINDING SITE II or BINDING SITE III. Table 2 illustrates the complementarity of the nucleotide sequences of KIAA1209 BINDING SITE, designated SEQ ID:30474, to the nucleotide sequence of VGAM2124 RNA, herein designated VGAM RNA, also designated SEQ ID:4835.

Another function of VGAM2124 is therefore inhibition of KIAA1209 (Accession XM_027307). Accordingly, utilities of VGAM2124 include diagnosis, prevention and treatment of diseases and clinical conditions associated with KIAA1209. KIAA1432 (Accession XM_039698) is another VGAM2124 host target gene. KIAA1432 BINDING SITE is HOST TARGET binding site found in the 3' untranslated region of mRNA encoded by KIAA1432, corresponding to a HOST TARGET binding site such as BINDING SITE I, BINDING SITE II or BINDING SITE III. Table 2 illustrates the complementarity of the nucleotide sequences of KIAA1432 BINDING SITE, designated SEQ ID:33156, to the nucleotide sequence of VGAM2124 RNA, herein designated VGAM RNA, also designated SEQ ID:4835.

Another function of VGAM2124 is therefore inhibition of KIAA1432 (Accession XM_039698). Accordingly, utilities of VGAM2124 include diagnosis, prevention and treatment of diseases and clinical conditions associated with KIAA1432. KIAA1582 (Accession XM_037262) is another VGAM2124 host target gene. KIAA1582 BINDING SITE is HOST TARGET binding site found in the 5' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32592, to the nucleotide sequence of VGAM2124 RNA, herein designated VGAM RNA, also designated SEQ ID:4835.

Another function of VGAM2124 is therefore inhibition of KIAA1582 (Accession XM_037262). Accordingly, utilities of VGAM2124 include diagnosis, prevention and treatment of diseases and clinical conditions associated with KIAA1582. KIAA1804 (Accession XM_045864) is another VGAM2124 host target gene. KIAA1804 BINDING SITE is HOST TARGET binding site found in the 3' untranslated region of mRNA encoded by KIAA1804, corresponding to a HOST TARGET binding site such as BINDING SITE I, BINDING SITE II or BINDING SITE III. Table 2 illustrates the complementarity of the nucleotide sequences of KIAA1804 BINDING SITE, designated SEQ ID:34590, to the nucleotide sequence of VGAM2124 RNA, herein designated VGAM RNA, also designated SEQ ID:4835.

Another function of VGAM2124 is therefore inhibition of KIAA1804 (Accession XM_045864). Accordingly, utilities of VGAM2124 include diagnosis, prevention and treatment of diseases and clinical conditions associated with KIAA1804. MGC21636 (Accession NM_145032) is another VGAM2124 host target gene. MGC21636 BINDING SITE is HOST TARGET binding site found in the 5' untranslated region of mRNA encoded by MGC21636, corresponding to a HOST TARGET binding site such as BINDING SITE I, BINDING SITE II or BINDING SITE III. Table 2 illustrates the complementarity of the nucleotide sequences of MGC21636 BINDING SITE, designated SEQ ID:29648, to the nucleotide sequence of VGAM2124 RNA, herein designated VGAM RNA, also designated SEQ ID:4835.

Another function of VGAM2124 is therefore inhibition of MGC21636 (Accession NM_145032). Accordingly, utilities of VGAM2124 include diagnosis, prevention and treatment of diseases and clinical conditions associated with MGC21636. MGC5149 (Accession XM_051200) is another VGAM2124 host target gene. MGC5149 BINDING SITE is HOST TARGET binding site found in the 3' untranslated region of mRNA encoded by MGC5149, corresponding to a HOST TARGET binding site such as BINDING SITE I, BINDING SITE II or BINDING SITE III. Table 2 illustrates the complementarity of the nucleotide sequences of MGC5149 BINDING SITE, designated SEQ ID:35785, to the nucleotide sequence of VGAM2124 RNA, herein designated VGAM RNA, also designated SEQ ID:4835.

Another function of VGAM2124 is therefore inhibition of MGC5149 (Accession XM_051200). Accordingly, utilities of VGAM2124 include diagnosis, prevention and treatment of diseases and clinical conditions associated with MGC5149. Ring Finger Protein (C3HC4 type) 8 (RNF8, Accession NM_003958) is another VGAM2124 host target gene. RNF8 BINDING SITE is HOST TARGET binding site found in the 3' untranslated region of mRNA encoded by RNF8, corresponding to a HOST TARGET binding site such as BINDING SITE I, BINDING SITE II or BINDING SITE III. Table 2 illustrates the complementarity of the nucleotide sequences of RNF8 BINDING SITE, designated SEQ ID:10098, to the nucleotide sequence of VGAM2124 RNA, herein designated VGAM RNA, also designated SEQ ID:4835.

Another function of VGAM2124 is therefore inhibition of Ring Finger Protein (C3HC4 type) 8 (RNF8, Accession NM_003958). Accordingly, utilities of VGAM2124 include diagnosis, prevention and treatment of diseases and clinical conditions associated with RNF8. Sema Domain, Immunoglobulin Domain (Ig), Short Basic Domain, Secreted, (semaphorin) 3C (SEMA3C, Accession NM_006379) is another VGAM2124 host target gene. SEMA3C BINDING SITE is HOST TARGET binding site found in the 3' untranslated region of mRNA encoded by SEMA3C, corresponding to a HOST TARGET binding site such as BINDING SITE I, BINDING SITE II or BINDING SITE III. Table 2 illustrates the complementarity of the nucleotide sequences of SEMA3C BINDING SITE, designated SEQ ID:13075, to the nucleotide sequence of VGAM2124 RNA, herein designated VGAM RNA, also designated SEQ ID:4835.

Another function of VGAM2124 is therefore inhibition of Sema Domain, Immunoglobulin Domain (Ig), Short Basic Domain, Secreted, (semaphorin) 3C (SEMA3C, Accession NM_006379). Accordingly, utilities of VGAM2124 include diagnosis, prevention and treatment of diseases and clinical conditions associated with SEMA3C. SHAPY (Accession NM_138793) is another VGAM2124 host target gene. SHAPY BINDING SITE is HOST TARGET binding site found in the 3' untranslated region of mRNA encoded by SHAPY, corresponding to a HOST TARGET binding site such as BINDING SITE I, BINDING SITE II or BINDING SITE III. Table 2 illustrates the complementarity of the nucleotide sequences of SHAPY BINDING SITE, designated SEQ ID:29017, to the nucleotide sequence of VGAM2124 RNA, herein designated VGAM RNA, also designated SEQ ID:4835.

Another function of VGAM2124 is therefore inhibition of SHAPY (Accession NM_138793). Accordingly, utilities of VGAM2124 include diagnosis, prevention and treatment of diseases and clinical conditions associated with SHAPY. Stromal Antigen 2 (STAG2, Accession XM_047285) is another VGAM2124 host target gene. STAG2 BINDING SITE is HOST TARGET binding site found in the 3' untranslated region of mRNA encoded by STAG2, corresponding to a HOST TARGET binding site such as BINDING SITE I, BINDING SITE II or BINDING SITE III. Table 2 illustrates the complementarity of the nucleotide sequences of STAG2 BINDING SITE, designated SEQ ID:34930, to the nucleotide sequence of VGAM2124 RNA, herein designated VGAM RNA, also designated SEQ ID:4835.

Another function of VGAM2124 is therefore inhibition of Stromal Antigen 2 (STAG2, Accession XM_047285). Accordingly, utilities of VGAM2124 include diagnosis, prevention and treatment of diseases and clinical conditions associated with STAG2. Yes-associated Protein 1, 65 kDa (YAP1, Accession NM_006106) is another VGAM2124 host target gene. YAP1 BINDING SITE is HOST TARGET binding site found in the 3' untranslated region of mRNA encoded by YAP1, corresponding to a HOST TARGET binding site such as BINDING SITE I, BINDING SITE II or BINDING SITE III. Table 2 illustrates the complementarity of the nucleotide sequences of YAP1 BINDING SITE, designated SEQ ID:12755, to the nucleotide sequence of VGAM2124 RNA, herein designated VGAM RNA, also designated SEQ ID:4835.

Another function of VGAM2124 is therefore inhibition of Yes-associated Protein 1, 65 kDa (YAP1, Accession NM_006106). Accordingly, utilities of VGAM2124 include diagnosis, prevention and treatment of diseases and clinical conditions associated with YAP1. Zinc Finger RNA Binding Protein (ZFR, Accession NM_016107) is another VGAM2124 host target gene. ZFR BINDING SITE is HOST TARGET binding site found in the 3' untranslated region of mRNA encoded by ZFR, corresponding to a HOST TARGET binding site such as BINDING SITE I, BINDING SITE II or BINDING SITE III. Table 2 illustrates the complementarity of the nucleotide sequences of ZFR BINDING SITE, designated SEQ ID:18189, to the nucleotide sequence of VGAM2124 RNA, herein designated VGAM RNA, also designated SEQ ID:4835.

Another function of VGAM2124 is therefore inhibition of Zinc Finger RNA Binding Protein (ZFR, Accession NM_016107). Accordingly, utilities of VGAM2124 include diagnosis, prevention and treatment of diseases and clinical conditions associated with ZFR. Zinc Finger Protein 294 (ZNF294, Accession XM_047829) is another VGAM2124 host target gene. ZNF294 BINDING SITE is HOST TARGET binding site found in the 3' untranslated region of mRNA encoded by ZNF294, corresponding to a HOST TARGET binding site such as BINDING SITE I, BINDING SITE II or BINDING SITE III. Table 2 illustrates the complementarity of the nucleotide sequences of ZNF294 BINDING SITE, designated SEQ ID:35057, to the nucleotide sequence of VGAM2124 RNA, herein designated VGAM RNA, also designated SEQ ID:4835.

Another function of VGAM2124 is therefore inhibition of Zinc Finger Protein 294 (ZNF294, Accession XM_047829). Accordingly, utilities of VGAM2124 include diagnosis, prevention and treatment of diseases and clinical conditions associated with ZNF294. LOC118706 (Accession XM_058336) is another VGAM2124 host target gene. LOC118706 BINDING SITE is HOST TARGET binding site found in the 5' untranslated region of mRNA encoded by LOC118706, corresponding to a HOST TARGET binding site such as BINDING SITE I, BINDING SITE II or BINDING SITE III. Table 2 illustrates the complementarity of the nucleotide sequences of LOC118706 BINDING SITE, designated SEQ ID:36597, to the nucleotide sequence of VGAM2124 RNA, herein designated VGAM RNA, also designated SEQ ID:4835.

Another function of VGAM2124 is therefore inhibition of LOC118706 (Accession XM_058336). Accordingly, utilities of VGAM2124 include diagnosis, prevention and treatment of diseases and clinical conditions associated with LOC118706. LOC127428 (Accession XM_059144) is another VGAM2124 host target gene. LOC127428 BINDING SITE is HOST TARGET binding site found in the 3' untranslated region of mRNA encoded by LOC127428, corresponding to a HOST TARGET binding site such as BINDING SITE I, BINDING SITE II or BINDING SITE III. Table 2 illustrates the complementarity of the nucleotide sequences of LOC127428 BINDING SITE, designated SEQ ID:36898, to the nucleotide sequence of VGAM2124 RNA, herein designated VGAM RNA, also designated SEQ ID:4835.

Another function of VGAM2124 is therefore inhibition of LOC127428 (Accession XM_059144). Accordingly, utilities of VGAM2124 include diagnosis, prevention and treatment of diseases and clinical conditions associated with LOC127428. LOC133686 (Accession XM_059667) is another VGAM2124 host target gene. LOC133686 BINDING SITE is HOST TARGET binding site found in the 3' untranslated region of mRNA encoded by LOC133686, corresponding to a HOST TARGET binding site such as BINDING SITE I, BINDING SITE II or BINDING SITE III. Table 2 illustrates the complementarity of the nucleotide sequences of LOC133686 BINDING SITE, designated SEQ ID:37057, to the nucleotide sequence of VGAM2124 RNA, herein designated VGAM RNA, also designated SEQ ID:4835.

Another function of VGAM2124 is therefore inhibition of LOC133686 (Accession XM_059667). Accordingly, utilities of VGAM2124 include diagnosis, prevention and treatment of diseases and clinical conditions associated with LOC133686. LOC143158 (Accession XM_084445) is another VGAM2124 host target gene. LOC143158 BINDING SITE is HOST TARGET binding site found in the 5' untranslated region of mRNA encoded by LOC143158, corresponding to a HOST TARGET binding site such as BINDING SITE I, BINDING SITE II or BINDING SITE III. Table 2 illustrates the complementarity of the nucleotide sequences of LOC143158 BINDING SITE, designated SEQ ID:37592, to the nucleotide sequence of VGAM2124 RNA, herein designated VGAM RNA, also designated SEQ ID:4835.

Another function of VGAM2124 is therefore inhibition of LOC143158 (Accession XM_084445). Accordingly, utilities of VGAM2124 include diagnosis, prevention and treatment of diseases and clinical conditions associated with LOC143158. LOC144438 (Accession XM_084860) is another VGAM2124 host target gene. LOC144438 BINDING SITE is HOST TARGET binding site found in the 3' untranslated region of mRNA encoded by LOC144438, corresponding to a HOST TARGET binding site such as BINDING SITE I, BINDING SITE II or BINDING SITE III. Table 2 illustrates the complementarity of the nucleotide sequences of LOC144438 BINDING SITE, designated SEQ ID:37739, to the nucleotide sequence of VGAM2124 RNA, herein designated VGAM RNA, also designated SEQ ID:4835.

Another function of VGAM2124 is therefore inhibition of LOC144438 (Accession XM_084860). Accordingly, utilities of VGAM2124 include diagnosis, prevention and treatment of diseases and clinical conditions associated with LOC144438. LOC145820 (Accession XM_085246) is another VGAM2124 host target gene. LOC145820 BINDING SITE is HOST TARGET binding site found in the 3' untranslated region of mRNA encoded by LOC145820, corresponding to a HOST TARGET binding site such as BINDING SITE I, BINDING SITE II or BINDING SITE III. Table 2 illustrates the complementarity of the nucleotide sequences of LOC145820 BINDING SITE, designated SEQ ID:37993, to the nucleotide sequence of VGAM2124 RNA, herein designated VGAM RNA, also designated SEQ ID:4835.

Another function of VGAM2124 is therefore inhibition of LOC145820 (Accession XM_085246). Accordingly, utilities of VGAM2124 include diagnosis, prevention and treatment of diseases and clinical conditions associated with LOC145820. LOC147160 (Accession XM_097202) is another VGAM2124 host target gene. LOC147160 BINDING SITE is HOST TARGET binding site found in the 5' untranslated region of mRNA encoded by LOC147160, corresponding to a HOST TARGET binding site such as BINDING SITE I, BINDING SITE II or BINDING SITE III. Table 2 illustrates the complementarity of the nucleotide sequences of LOC147160 BINDING SITE, designated SEQ ID:40809, to the nucleotide sequence of VGAM2124 RNA, herein designated VGAM RNA, also designated SEQ ID:4835.

Another function of VGAM2124 is therefore inhibition of LOC147160 (Accession XM_097202). Accordingly, utilities of VGAM2124 include diagnosis, prevention and treatment of diseases and clinical conditions associated with LOC147160. LOC147463 (Accession XM_085799) is another VGAM2124 host target gene. LOC147463 BINDING SITE is HOST TARGET binding site found in the 3' untranslated region of mRNA encoded by LOC147463, corresponding to a HOST TARGET binding site such as BINDING SITE I, BINDING SITE II or BINDING SITE III. Table 2 illustrates the complementarity of the nucleotide sequences of LOC147463 BINDING SITE, designated SEQ ID:38342, to the nucleotide sequence of VGAM2124 RNA, herein designated VGAM RNA, also designated SEQ ID:4835.

Another function of VGAM2124 is therefore inhibition of LOC147463 (Accession XM_085799). Accordingly, utilities of VGAM2124 include diagnosis, prevention and treatment of diseases and clinical conditions associated with LOC147463. LOC159053 (Accession XM_099021) is another VGAM2124 host target gene. LOC159053 BINDING SITE is HOST TARGET binding site found in the 3' untranslated region of mRNA encoded by LOC159053, corresponding to a HOST TARGET binding site such as BINDING SITE I, BINDING SITE II or BINDING SITE III. Table 2 illustrates the complementarity of the nucleotide sequences of LOC159053 BINDING SITE, designated SEQ ID:42060, to the nucleotide sequence of VGAM2124 RNA, herein designated VGAM RNA, also designated SEQ ID:4835.

Another function of VGAM2124 is therefore inhibition of LOC159053 (Accession XM_099021). Accordingly, utilities of VGAM2124 include diagnosis, prevention and treatment of diseases and clinical conditions associated with LOC159053. LOC201931 (Accession XM_114407) is another VGAM2124 host target gene. LOC201931 BINDING SITE is HOST TARGET binding site found in the 3' untranslated region of mRNA encoded by LOC201931, corresponding to a HOST TARGET binding site such as BINDING SITE I, BINDING SITE II or BINDING SITE III. Table 2 illustrates the complementarity of the nucleotide sequences of LOC201931 BINDING SITE, designated SEQ ID:42930, to the nucleotide sequence of VGAM2124 RNA, herein designated VGAM RNA, also designated SEQ ID:4835.

Another function of VGAM2124 is therefore inhibition of LOC201931 (Accession XM_114407). Accordingly, utilities of VGAM2124 include diagnosis, prevention and treatment of diseases and clinical conditions associated with LOC201931. LOC220466 (Accession XM_058363) is another VGAM2124 host target gene. LOC220466 BINDING SITE is HOST TARGET binding site found in the 5' untranslated region of mRNA encoded by LOC220466, corresponding to a HOST TARGET binding site such as BINDING SITE I, BINDING SITE II or BINDING SITE III. Table 2 illustrates the complementarity of the nucleotide sequences of LOC220466 BINDING SITE, designated SEQ ID:36611, to the nucleotide sequence of VGAM2124 RNA, herein designated VGAM RNA, also designated SEQ ID:4835.

Another function of VGAM2124 is therefore inhibition of LOC220466 (Accession XM_058363). Accordingly, utilities of VGAM2124 include diagnosis, prevention and treatment of diseases and clinical conditions associated with LOC220466. FIG. 1 further provides a conceptual description of a novel bioinformatically detected viral gene of the present invention, referred to here as Viral Genomic Address Messenger 2125 (VGAM2125) viral gene, which modulates expression of respective host target genes thereof, the function and utility of which host target genes is known in the art.

VGAM2125 is a novel bioinformatically detected regulatory, non protein coding, viral micro RNA (miRNA) gene. The method by which VGAM2125 was detected is described hereinabove with reference to FIGS. 1-8.

VGAM2125 gene, herein designated VGAM GENE, is a viral gene contained in the genome of Ateline Herpesvirus 3. VGAM2125 host target gene, herein designated VGAM HOST TARGET GENE, is a human gene contained in the human genome.

VGAM2125 gene encodes a VGAM2125 precursor RNA, herein designated VGAM PRECURSOR RNA. Similar to other miRNA genes, and unlike most ordinary genes, VGAM2125 precursor RNA does not encode a protein. A nucleotide sequence identical or highly similar to the nucleotide sequence of VGAM2125 precursor RNA is designated SEQ ID:2111, and is provided hereinbelow with reference to the sequence listing part. Nucleotide sequence SEQ ID:2111 is located at position 18618 relative to the genome of Ateline Herpesvirus 3.

VGAM2125 precursor RNA folds onto itself, forming VGAM2125 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2125 folded precursor RNA into VGAM2125 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2125 RNA is designated SEQ ID:4836, and is provided hereinbelow with reference to the sequence listing part.

VGAM2125 host target gene, herein designated VGAM HOST TARGET GENE, encodes a corresponding messenger RNA, VGAM2125 host target RNA, herein designated VGAM HOST TARGET RNA. VGAM2125 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2125 RNA, herein designated VGAM RNA, binds complementarily to one or more host target binding sites located in untranslated regions of VGAM2125 host target RNA, herein designated VGAM HOST TARGET RNA. This complementary binding is due to the fact that the nucleotide sequence of VGAM2125 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2125 RNA, herein designated VGAM RNA, may have a different number of host target binding sites in untranslated regions of a VGAM2125 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2125 RNA, herein designated VGAM RNA, to host target binding sites on VGAM2125 host target RNA, herein designated VGAM HOST TARGET RNA, such as BINDING SITE I, BINDING SITE II and BINDING SITE III, inhibits translation of VGAM2125 host target RNA into VGAM2125 host target protein, herein designated VGAM HOST TARGET PROTEIN. VGAM host target protein is therefore outlined by a broken line.

It is appreciated that VGAM2125 host target gene, herein designated VGAM HOST TARGET GENE, in fact represents a plurality of VGAM2125 host target genes. The mRNA of each one of this plurality of VGAM2125 host target genes comprises one or more host target binding sites, each having a nucleotide sequence which is at least partly complementary to VGAM2125 RNA, herein designated VGAM RNA, and which when bound by VGAM2125 RNA causes inhibition of translation of respective one or more VGAM2125 host target proteins.

It is further appreciated by one skilled in the art that the mode of translational inhibition illustrated by FIG. 1 with specific reference to translational inhibition exerted by VGAM2125 gene, herein designated VGAM GENE, on one or more VGAM2125 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2125 is inhibition of expression of host target genes, as part of a novel viral mechanism of attacking a host. Accordingly, utilities of VGAM2125 include diagnosis, prevention and treatment of viral infection by Ateline Herpesvirus 3. Specific functions, and accordingly utilities, of VGAM2125 correlate with, and may be deduced from, the identity of the host target genes which VGAM2125 binds and inhibits, and the function of these host target genes, as elaborated hereinbelow.

Nucleotide sequences of the VGAM2125 precursor RNA, herein designated VGAM PRECURSOR RNA, and of the 'diced' VGAM2125 RNA, herein designated VGAM RNA, and a schematic representation of the secondary folding of VGAM2125 folded precursor RNA, herein designated VGAM FOLDED PRECURSOR RNA, of VGAM2125 are further described hereinbelow with reference to Table 1.

Nucleotide sequences of host target binding sites, such as BINDING SITE-I, BINDING SITE-II and BINDING SITE-III of FIG. 1, found on VGAM2125 host target RNA, and schematic representation of the complementarity of each of these host target binding sites to VGAM2125 RNA, herein designated VGAM RNA, are described hereinbelow with reference to Table 2.

As mentioned hereinabove with reference to FIG. 1, a function of VGAM2125 gene, herein designated VGAM is inhibition of expression of VGAM2125 target genes. It is appreciated that specific functions, and accordingly utilities, of VGAM2125 correlate with, and may be deduced from, the identity of the target genes which VGAM2125 binds and inhibits, and the function of these target genes, as elaborated hereinbelow.

Angiotensin I Converting Enzyme (peptidyl-dipeptidase A) 2 (ACE2, Accession NM_021804) is a VGAM2125 host target gene. ACE2 BINDING SITE is HOST TARGET binding site found in the 3' untranslated region of mRNA encoded by ACE2, corresponding to a HOST TARGET binding site such as BINDING SITE I, BINDING SITE II or BINDING SITE III. Table 2 illustrates the complementarity of the nucleotide sequences of ACE2 BINDING SITE, designated SEQ ID:22356, to the nucleotide sequence of VGAM2125 RNA, herein designated VGAM RNA, also designated SEQ ID:4836.

A function of VGAM2125 is therefore inhibition of Angiotensin I Converting Enzyme (peptidyl-dipeptidase A) 2 (ACE2, Accession NM_021804), a gene which converts angiotensin i to angiotensin ii by release of the terminal his-leu. Accordingly, utilities of VGAM2125 include diagnosis, prevention and treatment of diseases and clinical conditions associated with ACE2. The function of ACE2 has been established by previous studies. By EST database searching for sequences showing homology to the zinc metalloprotease angiotensin I converting enzyme (ACE; 106180) and by screening a human lymphoma cDNA library, Tipnis et al. (2000) cloned a full-length ACE2 cDNA, which they called ACEH, encoding a deduced 805-amino acid protein that shares approximately 40% identity with the N- and C-terminal domains of ACE. ACE2 contains a potential 17-amino acid N-terminal signal peptide and a putative 22-amino acid C-terminal membrane anchor. It has a conserved zinc metalloprotease consensus sequence (HEXXH) and a conserved glutamine residue that is predicted to serve as a third zinc ligand. Northern blot analysis detected high expression of ACE2 in kidney, testis, and heart, and moderate expression in colon, small intestine, and ovary. Expression in CHO cells of a soluble, truncated form of ACE2, lacking transmembrane and cytosolic domains, produced a glycosylated protein that is able to cleave angiotensin I and angiotensin II but not bradykinin. In the hydrolysis of the angiotensins, ACE2 functions exclusively as a carboxypeptidase. Tipnis et al. (2000) showed that ACE2 is not inhibited by benzylsuccinate, a carboxypeptidase A inhibitor, or by other ACE inhibitors such as lisinopril. Tipnis et al. (2000) mapped the ACE2 gene by sequence similarity to a sequence in GenBank (AC003669) mapping to Xp22. Animal model experiments lend further support to the function of ACE2. Crackower et al. (2002) demonstrated that Ace2 maps to a defined quantitative trait locus (QTL) on the X chromosome in 3 different rat models of hypertension. In all hypertensive rat strains, Ace2 mRNA and protein expression were markedly reduced, suggesting that Ace2 is a candidate gene for this QTL.

It is appreciated that the abovementioned animal model for ACE2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Tipnis, S. R.; Hooper, N. M.; Hyde, R.; Karran, E.; Christie, G.; Turner, A. J.: A human homolog of angiotensin-converting enzyme: cloning and functional expression as a captopril-insensitive carboxypeptidase. J. Biol. Chem. 275: 33238-33243, 2000; and Crackower, M. A.; Sarao, R.; Oudit, G. Y.; Yagil, C.; Kozieradzki, I.; Scanga, S. E.; Oliveira-dos-Santos, A. J.; da Costa, J.; Zhang, L.; Pei, Y.; Scholey, J.; Ferrario, C. M.; Manouki.

Further studies establishing the function and utilities of ACE2 are found in John Hopkins OMIM database record ID 300335, and in sited publications numbered 9447 listed in the bibliography section hereinbelow, which are also hereby incorporated by reference. Mitogen-activated Protein Kinase Kinase Kinase 5 (MAP3K5, Accession NM_005923) is another VGAM2125 host target gene. MAP3K5 BINDING SITE is HOST TARGET binding site found in the 3' untranslated region of mRNA encoded by MAP3K5, corresponding to a HOST TARGET binding site such as BINDING SITE I, BINDING SITE II or BINDING SITE III. Table 2 illustrates the complementarity of the nucleotide sequences of MAP3K5 BINDING SITE, designated SEQ ID:12546, to the nucleotide sequence of VGAM2125 RNA, herein designated VGAM RNA, also designated SEQ ID:4836.

Another function of VGAM2125 is therefore inhibition of Mitogen-activated Protein Kinase Kinase Kinase 5 (MAP3K5, Accession NM_005923), a gene which phosphorylates and activates two different subgroups of map kinase kinases, mkk4/sek1 and mkk3/mapkk6 (or mkk6).overexpression induces apoptotic cell death. Accordingly, utilities of VGAM2125 include diagnosis, prevention and treatment of diseases and clinical conditions associated with MAP3K5. The function of MAP3K5 and its association with various diseases and clinical conditions, has been established by previous studies, as described hereinabove with reference to VGAM1622. Aminopeptidase Puromycin Sensitive (NPEPPS, Accession NM_006310) is another VGAM2125 host target gene. NPEPPS BINDING SITE is HOST TARGET binding site found in the 3' untranslated region of mRNA encoded by NPEPPS, corresponding to a HOST TARGET binding site such as BINDING SITE I, BINDING SITE II or BINDING SITE III. Table 2 illustrates the complementarity of the nucleotide sequences of NPEPPS BINDING SITE, designated SEQ ID:12996, to the nucleotide sequence of VGAM2125 RNA, herein designated VGAM RNA, also designated SEQ ID:4836.

Another function of VGAM2125 is therefore inhibition of Aminopeptidase Puromycin Sensitive (NPEPPS, Accession NM_006310), a gene which is puromycin-sensitive aminopeptidase and has metallopeptidase activity. Accordingly, utilities of VGAM2125 include diagnosis, prevention and treatment of diseases and clinical conditions associated with NPEPPS. The function of NPEPPS and its association with various diseases and clinical conditions, has been established by previous studies, as described hereinabove with reference to VGAM83. Protein Kinase, AMP-activated, Alpha 2 Catalytic Subunit (PRKAA2, Accession NM_006252) is another VGAM2125 host target gene. PRKAA2 BINDING SITE is HOST TARGET binding site found in the 3' untranslated region of mRNA encoded by PRKAA2, corresponding to a HOST TARGET binding site such as BINDING SITE I, BINDING SITE II or BINDING SITE III. Table 2 illustrates the complementarity of the nucleotide sequences of PRKAA2 BINDING SITE, designated SEQ ID:12927, to the nucleotide sequence of VGAM2125 RNA, herein designated VGAM RNA, also designated SEQ ID:4836.

Another function of VGAM2125 is therefore inhibition of Protein Kinase, AMP-activated, Alpha 2 Catalytic Subunit (PRKAA2, Accession NM_006252), a gene which are responsible for the regulation of fatty acid synthesis by phosphorylation of acetyl-coa carboxylase. Accordingly, utilities of VGAM2125 include diagnosis, prevention and treatment of diseases and clinical conditions associated with PRKAA2. The function of PRKAA2 and its association with various diseases and clinical conditions, has been established by previous studies, as described hereinabove with reference to VGAM1544. Prostaglandin-endoperoxide Synthase 2 (prostaglandin G/H synthase and cyclooxygenase) (PTGS2, Accession NM_000963) is another VGAM2125 host target gene. PTGS2 BINDING SITE is HOST TARGET binding site found in the 3' untranslated region of mRNA encoded by PTGS2, corresponding to a HOST TARGET binding site such as BINDING SITE I, BINDING SITE II or BINDING SITE III. Table 2 illustrates the complementarity of the nucleotide sequences of PTGS2 BINDING SITE, designated SEQ ID:6681, to the nucleotide sequence of VGAM2125 RNA, herein designated VGAM RNA, also designated SEQ ID:4836.

Another function of VGAM2125 is therefore inhibition of Prostaglandin-endoperoxide Synthase 2 (prostaglandin G/H synthase and cyclooxygenase) (PTGS2, Accession NM_000963), a gene which may have a role as a major mediator of inflammation and/or a role for prostanoid signaling in activity-dependent plasticity. Accordingly, utilities of VGAM2125 include diagnosis, prevention and treatment of diseases and clinical conditions associated with PTGS2. The function of PTGS2 and its association with various diseases and clinical conditions, has been established by previous studies, as described hereinabove with reference to VGAM292. Chromosome 6 Open Reading Frame 35 (C6orf35, Accession NM_018452) is another VGAM2125 host target gene. C6orf35 BINDING SITE is HOST TARGET binding site found in the 3' untranslated region of mRNA encoded by C6orf35, corresponding to a HOST TARGET binding site such as BINDING SITE I, BINDING SITE II or BINDING SITE III. Table 2 illustrates the complementarity of the nucleotide sequences of C6orf35 BINDING SITE, designated SEQ ID:20526, to the nucleotide sequence of VGAM2125 RNA, herein designated VGAM RNA, also designated SEQ ID:4836.

Another function of VGAM2125 is therefore inhibition of Chromosome 6 Open Reading Frame 35 (C6orf35, Accession NM_018452). Accordingly, utilities of VGAM2125 include diagnosis, prevention and treatment of diseases and clinical conditions associated with C6orf35. FLJ20730 (Accession NM_017945) is another VGAM2125 host target gene. FLJ20730 BINDING SITE is HOST TARGET binding site found in the 3' untranslated region of mRNA encoded by FLJ20730, corresponding to a HOST TARGET binding site such as BINDING SITE I, BINDING SITE II or BINDING SITE III. Table 2 illustrates the complementarity of the nucleotide sequences of FLJ20730 BINDING SITE, designated SEQ ID:19639, to the nucleotide sequence of VGAM2125 RNA, herein designated VGAM RNA, also designated SEQ ID:4836.

Another function of VGAM2125 is therefore inhibition of FLJ20730 (Accession NM_017945). Accordingly, utilities of VGAM2125 include diagnosis, prevention and treatment of diseases and clinical conditions associated with FLJ20730. FLJ22833 (Accession NM_022837) is another VGAM2125 host target gene. FLJ22833 BINDING SITE is HOST TARGET binding site found in the 3' untranslated region of mRNA encoded by FLJ22833, corresponding to a HOST TARGET binding site such as BINDING SITE I, BINDING SITE II or BINDING SITE III. Table 2 illustrates the complementarity of the nucleotide sequences of FLJ22833 BINDING SITE, designated SEQ ID:23119, to the nucleotide sequence of VGAM2125 RNA, herein designated VGAM RNA, also designated SEQ ID:4836.

Another function of VGAM2125 is therefore inhibition of FLJ22833 (Accession NM_022837). Accordingly, utilities of VGAM2125 include diagnosis, prevention and treatment of diseases and clinical conditions associated with FLJ22833. FLJ23462 (Accession NM_024843) is another VGAM2125 host target gene. FLJ23462 BINDING SITE is HOST TARGET binding site found in the 3' untranslated region of mRNA encoded by FLJ23462, corresponding to a HOST TARGET binding site such as BINDING SITE I, BINDING SITE II or BINDING SITE III. Table 2 illustrates the complementarity of the nucleotide sequences of FLJ23462 BINDING SITE, designated SEQ ID:24258, to the nucleotide sequence of VGAM2125 RNA, herein designated VGAM RNA, also designated SEQ ID:4836.

Another function of VGAM2125 is therefore inhibition of FLJ23462 (Accession NM_024843). Accordingly, utilities of VGAM2125 include diagnosis, prevention and treatment of diseases and clinical conditions associated with FLJ23462. MADP-1 (Accession NM_033114) is another VGAM2125 host target gene. MADP-1 BINDING SITE is HOST TARGET binding site found in the 3' untranslated region of mRNA encoded by MADP-1, corresponding to a HOST TARGET binding site such as BINDING SITE I, BINDING SITE II or BINDING SITE III. Table 2 illustrates the complementarity of the nucleotide sequences of MADP-1 BINDING SITE, designated SEQ ID:26961, to the nucleotide sequence of VGAM2125 RNA, herein designated VGAM RNA, also designated SEQ ID:4836.

Another function of VGAM2125 is therefore inhibition of MADP-1 (Accession NM_033114). Accordingly, utilities of VGAM2125 include diagnosis, prevention and treatment of diseases and clinical conditions associated with MADP-1. MCM10 Minichromosome Maintenance Deficient 10 (S. cerevisiae) (MCM10, Accession NM_018518) is another VGAM2125 host target gene. MCM10 BINDING SITE is HOST TARGET binding site found in the 3' untranslated region of mRNA encoded by MCM10, corresponding to a HOST TARGET binding site such as BINDING SITE I, BINDING SITE II or BINDING SITE III. Table 2 illustrates the complementarity of the nucleotide sequences of MCM10 BINDING SITE, designated SEQ ID:20591, to the nucleotide sequence of VGAM2125 RNA, herein designated VGAM RNA, also designated SEQ ID:4836.

Another function of VGAM2125 is therefore inhibition of MCM10 Minichromosome Maintenance Deficient 10 (S. cerevisiae) (MCM10, Accession NM_018518). Accordingly, utilities of VGAM2125 include diagnosis, prevention and treatment of diseases and clinical conditions associated with MCM10. Phospholipase C-like 1 (PLCL1, Accession NM_006226) is another VGAM2125 host target gene. PLCL1 BINDING SITE is HOST TARGET binding site found in the 3' untranslated region of mRNA encoded by PLCL1, corresponding to a HOST TARGET binding site such as BINDING SITE I, BINDING SITE II or BINDING SITE III. Table 2 illustrates the complementarity of the nucleotide sequences of PLCL1 BINDING SITE, designated SEQ ID:12888, to the nucleotide sequence of VGAM2125 RNA, herein designated VGAM RNA, also designated SEQ ID:4836.

Another function of VGAM2125 is therefore inhibition of Phospholipase C-like 1 (PLCL1, Accession NM_006226). Accordingly, utilities of VGAM2125 include diagnosis, prevention and treatment of diseases and clinical conditions associated with PLCL1. LOC151473 (Accession XM_087215) is another VGAM2125 host target gene. LOC151473 BINDING SITE is HOST TARGET binding site found in the 3' untranslated region of mRNA encoded by LOC151473, corresponding to a HOST TARGET binding site such as BINDING SITE I, BINDING SITE II or BINDING SITE III. Table 2 illustrates the complementarity of the nucleotide sequences of LOC151473 BINDING SITE, designated SEQ ID:39117, to the nucleotide sequence of VGAM2125 RNA, herein designated VGAM RNA, also designated SEQ ID:4836.

Another function of VGAM2125 is therefore inhibition of LOC151473 (Accession XM_087215). Accordingly, utilities of VGAM2125 include diagnosis, prevention and treatment of diseases and clinical conditions associated with LOC151473. LOC162461 (Accession XM_091568) is another VGAM2125 host target gene. LOC162461 BINDING SITE is HOST TARGET binding site found in the 3' untranslated region of mRNA encoded by LOC162461, corresponding to a HOST TARGET binding site such as BINDING SITE I, BINDING SITE II or BINDING SITE III. Table 2 illustrates the complementarity of the nucleotide sequences of LOC162461 BINDING SITE, designated SEQ ID:40056, to the nucleotide sequence of VGAM2125 RNA, herein designated VGAM RNA, also designated SEQ ID:4836.

Another function of VGAM2125 is therefore inhibition of LOC162461 (Accession XM_091568). Accordingly, utilities of VGAM2125 include diagnosis, prevention and treatment of diseases and clinical conditions associated with LOC162461. LOC220776 (Accession XM_043388) is another VGAM2125 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33926, to the nucleotide sequence of VGAM2125 RNA, herein designated VGAM RNA, also designated SEQ ID:4836.

Another function of VGAM2125 is therefore inhibition of LOC220776 (Accession XM_043388). Accordingly, utilities of VGAM2125 include diagnosis, prevention and treatment of diseases and clinical conditions associated with LOC220776. LOC253019 (Accession XM_170907) is another VGAM2125 host target gene. LOC253019 BINDING SITE is HOST TARGET binding site found in the 5' untranslated region of mRNA encoded by LOC253019, corresponding to a HOST TARGET binding site such as BINDING SITE I, BINDING SITE II or BINDING SITE III. Table 2 illustrates the complementarity of the nucleotide sequences of LOC253019 BINDING SITE, designated SEQ ID:45665, to the nucleotide sequence of VGAM2125 RNA, herein designated VGAM RNA, also designated SEQ ID:4836.

Another function of VGAM2125 is therefore inhibition of LOC253019 (Accession XM_170907). Accordingly, utilities of VGAM2125 include diagnosis, prevention and treatment of diseases and clinical conditions associated with LOC253019. LOC253975 (Accession XM_171130) is another VGAM2125 host target gene. LOC253975 BINDING SITE is HOST TARGET binding site found in the 5' untranslated region of mRNA encoded by LOC253975, corresponding to a HOST TARGET binding site such as BINDING SITE I, BINDING SITE II or BINDING SITE III. Table 2 illustrates the complementarity of the nucleotide sequences of LOC253975 BINDING SITE, designated SEQ ID:45932, to the nucleotide sequence of VGAM2125 RNA, herein designated VGAM RNA, also designated SEQ ID:4836.

Another function of VGAM2125 is therefore inhibition of LOC253975 (Accession XM_171130). Accordingly, utilities of VGAM2125 include diagnosis, prevention and treatment of diseases and clinical conditions associated with LOC253975. LOC85479 (Accession NM_033105) is another VGAM2125 host target gene. LOC85479 BINDING SITE is HOST TARGET binding site found in the 5' untranslated region of mRNA encoded by LOC85479, corresponding to a HOST TARGET binding site such as BINDING SITE I, BINDING SITE II or BINDING SITE III. Table 2 illustrates the complementarity of the nucleotide sequences of LOC85479 BINDING SITE, designated SEQ ID:26955, to the nucleotide sequence of VGAM2125 RNA, herein designated VGAM RNA, also designated SEQ ID:4836.

Another function of VGAM2125 is therefore inhibition of LOC85479 (Accession NM_033105). Accordingly, utilities of VGAM2125 include diagnosis, prevention and treatment of diseases and clinical conditions associated with LOC85479. FIG. 1 further provides a conceptual description of a novel bioinformatically detected viral gene of the present invention, referred to here as Viral Genomic Address Messenger 2126 (VGAM2126) viral gene, which modulates expression of respective host target genes thereof, the function and utility of which host target genes is known in the art.

VGAM2126 is a novel bioinformatically detected regulatory, non protein coding, viral micro RNA (miRNA) gene. The method by which VGAM2126 was detected is described hereinabove with reference to FIGS. 1-8.

VGAM2126 gene, herein designated VGAM GENE, is a viral gene contained in the genome of Ateline Herpesvirus 3. VGAM2126 host target gene, herein designated VGAM HOST TARGET GENE, is a human gene contained in the human genome.

VGAM2126 gene encodes a VGAM2126 precursor RNA, herein designated VGAM PRECURSOR RNA. Similar to other miRNA genes, and unlike most ordinary genes, VGAM2126 precursor RNA does not encode a protein. A nucleotide sequence identical or highly similar to the nucleotide sequence of VGAM2126 precursor RNA is designated SEQ ID:2112, and is provided hereinbelow with reference to the sequence listing part. Nucleotide sequence SEQ ID:2112 is located at position 6412 relative to the genome of Ateline Herpesvirus 3.

VGAM2126 precursor RNA folds onto itself, forming VGAM2126 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2126 folded precursor RNA into VGAM2126 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2126 RNA is designated SEQ ID:4837, and is provided hereinbelow with reference to the sequence listing part.

VGAM2126 host target gene, herein designated VGAM HOST TARGET GENE, encodes a corresponding messenger RNA, VGAM2126 host target RNA, herein designated VGAM HOST TARGET RNA. VGAM2126 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2126 RNA, herein designated VGAM RNA, binds complementarily to one or more host target binding sites located in untranslated regions of VGAM2126 host target RNA, herein designated VGAM HOST TARGET RNA. This complementary binding is due to the fact that the nucleotide sequence of VGAM2126 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2126 RNA, herein designated VGAM RNA, may have a different number of host target binding sites in untranslated regions of a VGAM2126 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2126 RNA, herein designated VGAM RNA, to host target binding sites on VGAM2126 host target RNA, herein designated VGAM HOST TARGET RNA, such as BINDING SITE I, BINDING SITE II and BINDING SITE III, inhibits translation of VGAM2126 host target RNA into VGAM2126 host target protein, herein designated VGAM HOST TARGET PROTEIN. VGAM host target protein is therefore outlined by a broken line.

It is appreciated that VGAM2126 host target gene, herein designated VGAM HOST TARGET GENE, in fact represents a plurality of VGAM2126 host target genes. The mRNA of each one of this plurality of VGAM2126 host target genes comprises one or more host target binding sites, each having a nucleotide sequence which is at least partly complementary to VGAM2126 RNA, herein designated VGAM RNA, and which when bound by VGAM2126 RNA causes inhibition of translation of respective one or more VGAM2126 host target proteins.

It is further appreciated by one skilled in the art that the mode of translational inhibition illustrated by FIG. 1 with specific reference to translational inhibition exerted by VGAM2126 gene, herein designated VGAM GENE, on one or more VGAM2126 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2126 is inhibition of expression of host target genes, as part of a novel viral mechanism of attacking a host. Accordingly, utilities of VGAM2126 include diagnosis, prevention and treatment of viral infection by Ateline Herpesvirus 3. Specific functions, and accordingly utilities, of VGAM2126 correlate with, and may be deduced from, the identity of the host target genes which VGAM2126 binds and inhibits, and the function of these host target genes, as elaborated hereinbelow.

Nucleotide sequences of the VGAM2126 precursor RNA, herein designated VGAM PRECURSOR RNA, and of the 'diced' VGAM2126 RNA, herein designated VGAM RNA, and a schematic representation of the secondary folding of VGAM2126 folded precursor RNA, herein designated VGAM FOLDED PRECURSOR RNA, of VGAM2126 are further described hereinbelow with reference to Table 1.

Nucleotide sequences of host target binding sites, such as BINDING SITE-I, BINDING SITE-II and BINDING SITE-III of FIG. 1, found on VGAM2126 host target RNA, and schematic representation of the complementarity of each of these host target binding sites to VGAM2126 RNA, herein designated VGAM RNA, are described hereinbelow with reference to Table 2.

As mentioned hereinabove with reference to FIG. 1, a function of VGAM2126 gene, herein designated VGAM is inhibition of expression of VGAM2126 target genes. It is appreciated that specific functions, and accordingly utilities, of VGAM2126 correlate with, and may be deduced from, the identity of the target genes which VGAM2126 binds and inhibits, and the function of these target genes, as elaborated hereinbelow.

Amyloid Beta Precursor Protein (cytoplasmic tail) Binding Protein 2 (APPBP2, Accession NM_006380) is a VGAM2126 host target gene. APPBP2 BINDING SITE is HOST TARGET binding site found in the 3' untranslated region of mRNA encoded by APPBP2, corresponding to a HOST TARGET binding site such as BINDING SITE I, BINDING SITE II or BINDING SITE III. Table 2 illustrates the complementarity of the nucleotide sequences of APPBP2 BINDING SITE, designated SEQ ID:13083, to the nucleotide sequence of VGAM2126 RNA, herein designated VGAM RNA, also designated SEQ ID:4837.

A function of VGAM2126 is therefore inhibition of Amyloid Beta Precursor Protein (cytoplasmic tail) Binding Protein 2 (APPBP2, Accession NM_006380), a gene which interacts with the basolateral sorting signal of amyloid precursor protein. Accordingly, utilities of VGAM2126 include diagnosis, prevention and treatment of diseases and clinical conditions associated with APPBP2. The function of APPBP2 and its association with various diseases and clinical conditions, has been established by previous studies, as described hereinabove with reference to VGAM525. Aquaporin 6, Kidney Specific (AQP6, Accession NM_001652) is another VGAM2126 host target gene. AQP6 BINDING SITE1 and AQP6 BINDING SITE2 are HOST TARGET binding sites found in untranslated regions of mRNA encoded by AQP6, corresponding to HOST TARGET binding sites such as BINDING SITE I, BINDING SITE II or BINDING SITE III. Table 2 illustrates the complementarity of the nucleotide sequences of AQP6 BINDING SITE1 and AQP6 BINDING SITE2, designated SEQ ID:7360 and SEQ ID:27617 respectively, to the nucleotide sequence of VGAM2126 RNA, herein designated VGAM RNA, also designated SEQ ID:4837.

Another function of VGAM2126 is therefore inhibition of Aquaporin 6, Kidney Specific (AQP6, Accession NM_001652), a gene which participates in distinct physiologic function such as glomerular filtration, tubular endocytosis, and acid-base metabolism. Accordingly, utilities of VGAM2126 include diagnosis, prevention and treatment of diseases and clinical conditions associated with AQP6. The function of AQP6 and its association with various diseases and clinical conditions, has been established by previous studies, as described hereinabove with reference to VGAM340. RPP30 (Accession NM_006413) is another VGAM2126 host target gene. RPP30 BINDING SITE is HOST TARGET binding site found in the 3' untranslated region of mRNA encoded by RPP30, corresponding to a HOST TARGET binding site such as BINDING SITE I, BINDING SITE II or BINDING SITE III. Table 2 illustrates the complementarity of the nucleotide sequences of RPP30 BINDING SITE, designated SEQ ID:13122, to the nucleotide sequence of VGAM2126 RNA, herein designated VGAM RNA, also designated SEQ ID:4837.

Another function of VGAM2126 is therefore inhibition of RPP30 (Accession NM_006413), a gene which is a component of ribonuclease p that processes 5' ends of precursor tRNAs. Accordingly, utilities of VGAM2126 include diagnosis, prevention and treatment of diseases and clinical conditions associated with RPP30. The function of RPP30 and its association with various diseases and clinical conditions, has been established by previous studies, as described hereinabove with reference to VGAM230. Kell Blood Group Precursor (McLeod phenotype) (XK, Accession NM_021083) is another VGAM2126 host target gene. XK BINDING SITE is HOST TARGET binding site found in the 3' untranslated region of mRNA encoded by XK, corresponding to a HOST TARGET binding site such as BINDING SITE I, BINDING SITE II or BINDING SITE III. Table 2 illustrates the complementarity of the nucleotide sequences of XK BINDING SITE, designated SEQ ID:22064, to the nucleotide sequence of VGAM2126 RNA, herein designated VGAM RNA, also designated SEQ ID:4837.

Another function of VGAM2126 is therefore inhibition of Kell Blood Group Precursor (McLeod phenotype) (XK, Accession NM_021083). Accordingly, utilities of VGAM2126 include diagnosis, prevention and treatment of diseases and clinical conditions associated with XK. HCA4 (Accession XM_085287) is another VGAM2126 host target gene. HCA4 BINDING SITE is HOST TARGET binding site found in the 3' untranslated region of mRNA encoded by HCA4, corresponding to a HOST TARGET binding site such as BINDING SITE I, BINDING SITE II or BINDING SITE III. Table 2 illustrates the complementarity of the nucleotide sequences of HCA4 BINDING SITE, designated SEQ ID:38029, to the nucleotide sequence of VGAM2126 RNA, herein designated VGAM RNA, also designated SEQ ID:4837.

Another function of VGAM2126 is therefore inhibition of HCA4 (Accession XM_085287). Accordingly, utilities of VGAM2126 include diagnosis, prevention and treatment of diseases and clinical conditions associated with HCA4. KIAA0635 (Accession NM_014645) is another VGAM2126 host target gene. KIAA0635 BINDING SITE is HOST TARGET binding site found in the 3' untranslated region of mRNA encoded by KIAA0635, corresponding to a HOST TARGET binding site such as BINDING SITE I, BINDING SITE II or BINDING SITE III. Table 2 illustrates the complementarity of the nucleotide sequences of KIAA0635 BINDING SITE, designated SEQ ID:16058, to the nucleotide sequence of VGAM2126 RNA, herein designated VGAM RNA, also designated SEQ ID:4837.

Another function of VGAM2126 is therefore inhibition of KIAA0635 (Accession NM_014645). Accordingly, utilities of VGAM2126 include diagnosis, prevention and treatment of diseases and clinical conditions associated with KIAA0635. LOC158219 (Accession XM_088514) is another VGAM2126 host target gene. LOC158219 BINDING SITE is HOST TARGET binding site found in the 5' untranslated region of mRNA encoded by LOC158219, corresponding to a HOST TARGET binding site such as BINDING SITE I, BINDING SITE II or BINDING SITE III. Table 2 illustrates the complementarity of the nucleotide sequences of LOC158219 BINDING SITE, designated SEQ ID:39763, to the nucleotide sequence of VGAM2126 RNA, herein designated VGAM RNA, also designated SEQ ID:4837.

Another function of VGAM2126 is therefore inhibition of LOC158219 (Accession XM_088514). Accordingly, utilities of VGAM2126 include diagnosis, prevention and treatment of diseases and clinical conditions associated with LOC158219. LOC158434 (Accession XM_098939) is another VGAM2126 host target gene. LOC158434 BINDING SITE is HOST TARGET binding site found in the 3' untranslated region of mRNA encoded by LOC158434, corresponding to a HOST TARGET binding site such as BINDING SITE I, BINDING SITE II or BINDING SITE III. Table 2 illustrates the complementarity of the nucleotide sequences of LOC158434 BINDING SITE, designated SEQ ID:41989, to the nucleotide sequence of VGAM2126 RNA, herein designated VGAM RNA, also designated SEQ ID:4837.

Another function of VGAM2126 is therefore inhibition of LOC158434 (Accession XM_098939). Accordingly, utilities of VGAM2126 include diagnosis, prevention and treatment of diseases and clinical conditions associated with LOC158434. LOC221337 (Accession XM_166387) is another VGAM2126 host target gene. LOC221337 BINDING SITE is HOST TARGET binding site found in the 5' untranslated region of mRNA encoded by LOC221337, corresponding to a HOST TARGET binding site such as BINDING SITE I, BINDING SITE II or BINDING SITE III. Table 2 illustrates the complementarity of the nucleotide sequences of LOC221337 BINDING SITE, designated SEQ ID:44237, to the nucleotide sequence of VGAM2126 RNA, herein designated VGAM RNA, also designated SEQ ID:4837.

Another function of VGAM2126 is therefore inhibition of LOC221337 (Accession XM_166387). Accordingly, utilities of VGAM2126 include diagnosis, prevention and treatment of diseases and clinical conditions associated with LOC221337. LOC256021 (Accession XM_172884) is another VGAM2126 host target gene. LOC256021 BINDING SITE is HOST TARGET binding site found in the 3' untranslated region of mRNA encoded by LOC256021, corresponding to a HOST TARGET binding site such as BINDING SITE I, BINDING SITE II or BINDING SITE III. Table 2 illustrates the complementarity of the nucleotide sequences of LOC256021 BINDING SITE, designated SEQ ID:46165, to the nucleotide sequence of VGAM2126 RNA, herein designated VGAM RNA, also designated SEQ ID:4837.

Another function of VGAM2126 is therefore inhibition of LOC256021 (Accession XM_172884). Accordingly, utilities of VGAM2126 include diagnosis, prevention and treatment of diseases and clinical conditions associated with LOC256021. FIG. 1 further provides a conceptual description of a novel bioinformatically detected viral gene of the present invention, referred to here as Viral Genomic Address Messenger 2127 (VGAM2127) viral gene, which modulates expression of respective host target genes thereof, the function and utility of which host target genes is known in the art.

VGAM2127 is a novel bioinformatically detected regulatory, non protein coding, viral micro RNA (miRNA) gene. The method by which VGAM2127 was detected is described hereinabove with reference to FIGS. 1-8.

VGAM2127 gene, herein designated VGAM GENE, is a viral gene contained in the genome of Ateline Herpesvirus 3. VGAM2127 host target gene, herein designated VGAM HOST TARGET GENE, is a human gene contained in the human genome.

VGAM2127 gene encodes a VGAM2127 precursor RNA, herein designated VGAM PRECURSOR RNA. Similar to other miRNA genes, and unlike most ordinary genes, VGAM2127 precursor RNA does not encode a protein. A nucleotide sequence identical or highly similar to the nucleotide sequence of VGAM2127 precursor RNA is designated SEQ ID:2113, and is provided hereinbelow with reference to the sequence listing part. Nucleotide sequence SEQ ID:2113 is located at position 22317 relative to the genome of Ateline Herpesvirus 3.

VGAM2127 precursor RNA folds onto itself, forming VGAM2127 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2127 folded precursor RNA into VGAM2127 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 86%) nucleotide sequence of VGAM2127 RNA is designated SEQ ID:4838, and is provided hereinbelow with reference to the sequence listing part.

VGAM2127 host target gene, herein designated VGAM HOST TARGET GENE, encodes a corresponding messenger RNA, VGAM2127 host target RNA, herein designated VGAM HOST TARGET RNA. VGAM2127 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2127 RNA, herein designated VGAM RNA, binds complementarily to one or more host target binding sites located in untranslated regions of VGAM2127 host target RNA, herein designated VGAM HOST TARGET RNA. This complementary binding is due to the fact that the nucleotide sequence of VGAM2127 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2127 RNA, herein designated VGAM RNA, may have a different number of host target binding sites in untranslated regions of a VGAM2127 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2127 RNA, herein designated VGAM RNA, to host target binding sites on VGAM2127 host target RNA, herein designated VGAM HOST TARGET RNA, such as BINDING SITE I, BINDING SITE II and BINDING SITE III, inhibits translation of VGAM2127 host target RNA into VGAM2127 host target protein, herein designated VGAM HOST TARGET PROTEIN. VGAM host target protein is therefore outlined by a broken line.

It is appreciated that VGAM2127 host target gene, herein designated VGAM HOST TARGET GENE, in fact represents a plurality of VGAM2127 host target genes. The mRNA of each one of this plurality of VGAM2127 host target genes comprises one or more host target binding sites, each having a nucleotide sequence which is at least partly complementary to VGAM2127 RNA, herein designated VGAM RNA, and which when bound by VGAM2127 RNA causes inhibition of translation of respective one or more VGAM2127 host target proteins.

It is further appreciated by one skilled in the art that the mode of translational inhibition illustrated by FIG. 1 with specific reference to translational inhibition exerted by VGAM2127 gene, herein designated VGAM GENE, on one or more VGAM2127 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2127 is inhibition of expression of host target genes, as part of a novel viral mechanism of attacking a host. Accordingly, utilities of VGAM2127 include diagnosis, prevention and treatment of viral infection by Ateline Herpesvirus 3. Specific functions, and accordingly utilities, of VGAM2127 correlate with, and may be deduced from, the identity of the host target genes which VGAM2127 binds and inhibits, and the function of these host target genes, as elaborated hereinbelow.

Nucleotide sequences of the VGAM2127 precursor RNA, herein designated VGAM PRECURSOR RNA, and of the 'diced' VGAM2127 RNA, herein designated VGAM RNA, and a schematic representation of the secondary folding of VGAM2127 folded precursor RNA, herein designated VGAM FOLDED PRECURSOR RNA, of VGAM2127 are further described hereinbelow with reference to Table 1.

Nucleotide sequences of host target binding sites, such as BINDING SITE-I, BINDING SITE-II and BINDING SITE-III of FIG. 1, found on VGAM2127 host target RNA, and schematic representation of the complementarity of each of these host target binding sites to VGAM2127 RNA, herein designated VGAM RNA, are described hereinbelow with reference to Table 2.

As mentioned hereinabove with reference to FIG. 1, a function of VGAM2127 gene, herein designated VGAM is inhibition of expression of VGAM2127 target genes. It is appreciated that specific functions, and accordingly utilities, of VGAM2127 correlate with, and may be deduced from, the identity of the target genes which VGAM2127 binds and inhibits, and the function of these target genes, as elaborated hereinbelow.

FLJ21615 (Accession NM_032205) is a VGAM2127 host target gene. FLJ21615 BINDING SITE is HOST TARGET binding site found in the 3' untranslated region of mRNA encoded by FLJ21615, corresponding to a HOST TARGET binding site such as BINDING SITE I, BINDING SITE II or BINDING SITE III. Table 2 illustrates the complementarity of the nucleotide sequences of FLJ21615 BINDING SITE, designated SEQ ID:25909, to the nucleotide sequence of VGAM2127 RNA, herein designated VGAM RNA, also designated SEQ ID:4838.

A function of VGAM2127 is therefore inhibition of FLJ21615 (Accession NM_032205). Accordingly, utilities of VGAM2127 include diagnosis, prevention and treatment of diseases and clinical conditions associated with FLJ21615. GABA(A) Receptors Associated Protein Like 3 (GABARAPL3, Accession NM_032568) is another VGAM2127 host target gene. GABARAPL3 BINDING SITE is HOST TARGET binding site found in the 3' untranslated region of mRNA encoded by GABARAPL3, corresponding to a HOST TARGET binding site such as BINDING SITE I, BINDING SITE II or BINDING SITE III. Table 2 illustrates the complementarity of the nucleotide sequences of GABARAPL3 BINDING SITE, designated SEQ ID:26296, to the nucleotide sequence of VGAM2127 RNA, herein designated VGAM RNA, also designated SEQ ID:4838.

Another function of VGAM2127 is therefore inhibition of GABA(A) Receptors Associated Protein Like 3 (GABARAPL3, Accession NM_032568). Accordingly, utilities of VGAM2127 include diagnosis, prevention and treatment of diseases and clinical conditions associated with GABARAPL3. KIAA0077 (Accession XM_040158) is another VGAM2127 host target gene. KIAA0077 BINDING SITE is HOST TARGET binding site found in the 3" untranslated region of mRNA encoded by KIAA0077, corresponding to a HOST TARGET binding site such as BINDING SITE I, BINDING SITE II or BINDING SITE III. Table 2 illustrates the complementarity of the nucleotide sequences of KIAA0077 BINDING SITE, designated SEQ ID:33267, to the nucleotide sequence of VGAM2127 RNA, herein designated VGAM RNA, also designated SEQ ID:4838.

Another function of VGAM2127 is therefore inhibition of KIAA0077 (Accession XM_040158). Accordingly, utilities of VGAM2127 include diagnosis, prevention and treatment of diseases and clinical conditions associated with KIAA0077. KIAA0923 (Accession NM_014021) is another VGAM2127 host target gene. KIAA0923 BINDING SITE is HOST TARGET binding site found in the 3' untranslated region of mRNA encoded by KIAA0923, corresponding to a HOST TARGET binding site such as BINDING SITE I, BINDING SITE II or BINDING SITE III. Table 2 illustrates the complementarity of the nucleotide sequences of KIAA0923 BINDING SITE, designated SEQ ID:15240, to the nucleotide sequence of VGAM2127 RNA, herein designated VGAM RNA, also designated SEQ ID:4838.

Another function of VGAM2127 is therefore inhibition of KIAA0923 (Accession NM_014021). Accordingly, utilities of VGAM2127 include diagnosis, prevention and treatment of diseases and clinical conditions associated with KIAA0923. LAT1-3TM (Accession XM_043976) is another VGAM2127 host target gene. LAT1-3TM BINDING SITE is HOST TARGET binding site found in the 5' untranslated region of mRNA encoded by LAT1-3TM, corresponding to a HOST TARGET binding site such as BINDING SITE I, BINDING SITE II or BINDING SITE III. Table 2 illustrates the complementarity of the nucleotide sequences of LAT1-3TM BINDING SITE, designated SEQ ID:34053, to the nucleotide sequence of VGAM2127 RNA, herein designated VGAM RNA, also designated SEQ ID:4838.

Another function of VGAM2127 is therefore inhibition of LAT1-3TM (Accession XM_043976). Accordingly, utilities of VGAM2127 include diagnosis, prevention and treatment of diseases and clinical conditions associated with LAT1-3TM. MGC13071 (Accession NM_032689) is another VGAM2127 host target gene. MGC13071 BINDING SITE is HOST TARGET binding site found in the 3' untranslated region of mRNA encoded by MGC13071, corresponding to a HOST TARGET binding site such as BINDING SITE I, BINDING SITE II or BINDING SITE III. Table 2 illustrates the complementarity of the nucleotide sequences of MGC13071 BINDING SITE, designated SEQ ID:26407, to the nucleotide sequence of VGAM2127 RNA, herein designated VGAM RNA, also designated SEQ ID:4838.

Another function of VGAM2127 is therefore inhibition of MGC13071 (Accession NM_032689). Accordingly, utilities of VGAM2127 include diagnosis, prevention and treatment of diseases and clinical conditions associated with MGC13071. VEZATIN (Accession NM_017599) is another VGAM2127 host target gene. VEZATIN BINDING SITE is HOST TARGET binding site found in the 3' untranslated region of mRNA encoded by VEZATIN, corresponding to a HOST TARGET binding site such as BINDING SITE I, BINDING SITE II or BINDING SITE III. Table 2 illustrates the complementarity of the nucleotide sequences of VEZATIN BINDING SITE, designated SEQ ID:19070, to the nucleotide sequence of VGAM2127 RNA, herein designated VGAM RNA, also designated SEQ ID:4838.

Another function of VGAM2127 is therefore inhibition of VEZATIN (Accession NM_017599). Accordingly, utilities of VGAM2127 include diagnosis, prevention and treatment of diseases and clinical conditions associated with VEZATIN. LOC116236 (Accession XM_057674) is another VGAM2127 host target gene. LOC116236 BINDING SITE is HOST TARGET binding site found in the 3' untranslated region of mRNA encoded by LOC116236, corresponding to a HOST TARGET binding site such as BINDING SITE I, BINDING SITE II or BINDING SITE III. Table 2 illustrates the complementarity of the nucleotide sequences of LOC116236 BINDING SITE, designated SEQ ID:36541, to the nucleotide sequence of VGAM2127 RNA, herein designated VGAM RNA, also designated SEQ ID:4838.

Another function of VGAM2127 is therefore inhibition of LOC116236 (Accession XM_057674). Accordingly, utilities of VGAM2127 include diagnosis, prevention and treatment of diseases and clinical conditions associated with LOC116236. LOC122786 (Accession XM_058660) is another VGAM2127 host target gene. LOC122786 BINDING SITE is HOST TARGET binding site found in the 3' untranslated region of mRNA encoded by LOC122786, corresponding to a HOST TARGET binding site such as BINDING SITE I, BINDING SITE II or BINDING SITE III. Table 2 illustrates the complementarity of the nucleotide sequences of LOC122786 BINDING SITE, designated SEQ ID:36696, to the nucleotide sequence of VGAM2127 RNA, herein designated VGAM RNA, also designated SEQ ID:4838.

Another function of VGAM2127 is therefore inhibition of LOC122786 (Accession XM_058660). Accordingly, utilities of VGAM2127 include diagnosis, prevention and treatment of diseases and clinical conditions associated with LOC122786. LOC145371 (Accession XM_085123) is another VGAM2127 host target gene. LOC145371 BINDING SITE is HOST TARGET binding site found in the 3' untranslated region of mRNA encoded by LOC145371, corresponding to a HOST TARGET binding site such as BINDING SITE I, BINDING SITE II or BINDING SITE III. Table 2 illustrates the complementarity of the nucleotide sequences of LOC145371 BINDING SITE, designated SEQ ID:37842, to the nucleotide sequence of VGAM2127 RNA, herein designated VGAM RNA, also designated SEQ ID:4838.

Another function of VGAM2127 is therefore inhibition of LOC145371 (Accession XM_085123). Accordingly, utilities of VGAM2127 include diagnosis, prevention and treatment of diseases and clinical conditions associated with LOC145371. LOC162239 (Accession XM_091439) is another VGAM2127 host target gene. LOC162239 BINDING SITE is HOST TARGET binding site found in the 3' untranslated region of mRNA encoded by LOC162239, corresponding to a HOST TARGET binding site such as BINDING SITE I, BINDING SITE II or BINDING SITE III. Table 2 illustrates the complementarity of the nucleotide sequences of LOC162239 BINDING SITE, designated SEQ ID:40055, to the nucleotide sequence of VGAM2127 RNA, herein designated VGAM RNA, also designated SEQ ID:4838.

Another function of VGAM2127 is therefore inhibition of LOC162239 (Accession XM_091439). Accordingly, utilities of VGAM2127 include diagnosis, prevention and treatment of diseases and clinical conditions associated with LOC162239. LOC169026 (Accession XM_095471) is another VGAM2127 host target gene. LOC169026 BINDING SITE is HOST TARGET binding site found in the 3' untranslated region of mRNA encoded by LOC169026, corresponding to a HOST TARGET binding site such as BINDING SITE I, BINDING SITE II or BINDING SITE III. Table 2 illustrates the complementarity of the nucleotide sequences of LOC169026 BINDING SITE, designated SEQ ID:40268, to the nucleotide sequence of VGAM2127 RNA, herein designated VGAM RNA, also designated SEQ ID:4838.

Another function of VGAM2127 is therefore inhibition of LOC169026 (Accession XM_095471). Accordingly, utilities of VGAM2127 include diagnosis, prevention and treatment of diseases and clinical conditions associated with LOC169026. LOC222070 (Accession XM_168433) is another VGAM2127 host target gene. LOC222070 BINDING SITE is HOST TARGET binding site found in the 5' untranslated region of mRNA encoded by LOC222070, corresponding to a HOST TARGET binding site such as BINDING SITE I, BINDING SITE II or BINDING SITE III. Table 2 illustrates the complementarity of the nucleotide sequences of LOC222070 BINDING SITE, designated SEQ ID:45176, to the nucleotide sequence of VGAM2127 RNA, herein designated VGAM RNA, also designated SEQ ID:4838.

Another function of VGAM2127 is therefore inhibition of LOC222070 (Accession XM_168433). Accordingly, utilities of VGAM2127 include diagnosis, prevention and treatment of diseases and clinical conditions associated with LOC222070. LOC93333 (Accession XM_050624) is another VGAM2127 host target gene. LOC93333 BINDING SITE is HOST TARGET binding site found in the 5' untranslated region of mRNA encoded by LOC93333, corresponding to a HOST TARGET binding site such as BINDING SITE I, BINDING SITE II or BINDING SITE III. Table 2 illustrates the complementarity of the nucleotide sequences of LOC93333 BINDING SITE, designated SEQ ID:35664, to the nucleotide sequence of VGAM2127 RNA, herein designated VGAM RNA, also designated SEQ ID:4838.

Another function of VGAM2127 is therefore inhibition of LOC93333 (Accession XM_050624). Accordingly, utilities of VGAM2127 include diagnosis, prevention and treatment of diseases and clinical conditions associated with LOC93333. FIG. 1 further provides a conceptual description of a novel bioinformatically detected viral gene of the present invention, referred to here as Viral Genomic Address Messenger 2128 (VGAM2128) viral gene, which modulates expression of respective host target genes thereof, the function and utility of which host target genes is known in the art.

VGAM2128 is a novel bioinformatically detected regulatory, non protein coding, viral micro RNA (miRNA) gene. The method by which VGAM2128 was detected is described hereinabove with reference to FIGS. 1-8.

VGAM2128 gene, herein designated VGAM GENE, is a viral gene contained in the genome of Ateline Herpesvirus 3. VGAM2128 host target gene, herein designated VGAM HOST TARGET GENE, is a human gene contained in the human genome.

VGAM2128 gene encodes a VGAM2128 precursor RNA, herein designated VGAM PRECURSOR RNA. Similar to other miRNA genes, and unlike most ordinary genes, VGAM2128 precursor RNA does not encode a protein. A nucleotide sequence identical or highly similar to the nucleotide sequence of VGAM2128 precursor RNA is designated SEQ ID:2114, and is provided hereinbelow with reference to the sequence listing part. Nucleotide sequence SEQ ID:2114 is located at position 22124 relative to the genome of Ateline Herpesvirus 3.

VGAM2128 precursor RNA folds onto itself, forming VGAM2128 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2128 folded precursor RNA into VGAM2128 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2128 RNA is designated SEQ ID:4839, and is provided hereinbelow with reference to the sequence listing part.

VGAM2128 host target gene, herein designated VGAM HOST TARGET GENE, encodes a corresponding messenger RNA, VGAM2128 host target RNA, herein designated VGAM HOST TARGET RNA. VGAM2128 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2128 RNA, herein designated VGAM RNA, binds complementarily to one or more host target binding sites located in untranslated regions of VGAM2128 host target RNA, herein designated VGAM HOST TARGET RNA. This complementary binding is due to the fact that the nucleotide sequence of VGAM2128 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2128 RNA, herein designated VGAM RNA, may have a different number of host target binding sites in untranslated regions of a VGAM2128 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2128 RNA, herein designated VGAM RNA, to host target binding sites on VGAM2128 host target RNA, herein designated VGAM HOST TARGET RNA, such as BINDING SITE I, BINDING SITE II and BINDING SITE III, inhibits translation of VGAM2128 host target RNA into VGAM2128 host target protein, herein designated VGAM HOST TARGET PROTEIN. VGAM host target protein is therefore outlined by a broken line.

It is appreciated that VGAM2128 host target gene, herein designated VGAM HOST TARGET GENE, in fact represents a plurality of VGAM2128 host target genes. The mRNA of each one of this plurality of VGAM2128 host target genes comprises one or more host target binding sites, each having a nucleotide sequence which is at least partly complementary to VGAM2128 RNA, herein designated VGAM RNA, and which when bound by VGAM2128 RNA causes inhibition of translation of respective one or more VGAM2128 host target proteins.

It is further appreciated by one skilled in the art that the mode of translational inhibition illustrated by FIG. 1 with specific reference to translational inhibition exerted by VGAM2128 gene, herein designated VGAM GENE, on one or more VGAM2128 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2128 is inhibition of expression of host target genes, as part of a novel viral mechanism of attacking a host. Accordingly, utilities of VGAM2128 include diagnosis, prevention and treatment of viral infection by Ateline Herpesvirus 3. Specific functions, and accordingly utilities, of VGAM2128 correlate with, and may be deduced from, the identity of the host target genes which VGAM2128 binds and inhibits, and the function of these host target genes, as elaborated hereinbelow.

Nucleotide sequences of the VGAM2128 precursor RNA, herein designated VGAM PRECURSOR RNA, and of the 'diced' VGAM2128 RNA, herein designated VGAM RNA, and a schematic representation of the secondary folding of VGAM2128 folded precursor RNA, herein designated VGAM FOLDED PRECURSOR RNA, of VGAM2128 are further described hereinbelow with reference to Table 1.

Nucleotide sequences of host target binding sites, such as BINDING SITE-I, BINDING SITE-II and BINDING SITE-III of FIG. 1, found on VGAM2128 host target RNA, and schematic representation of the complementarity of each of these host target binding sites to VGAM2128 RNA, herein designated VGAM RNA, are described hereinbelow with reference to Table 2.

As mentioned hereinabove with reference to FIG. 1, a function of VGAM2128 gene, herein designated VGAM is inhibition of expression of VGAM2128 target genes. It is appreciated that specific functions, and accordingly utilities, of VGAM2128 correlate with, and may be deduced from, the identity of the target genes which VGAM2128 binds and inhibits, and the function of these target genes, as elaborated hereinbelow.

Discs, Large (Drosophila) Homolog 5 (DLG5, Accession XM_096398) is a VGAM2128 host target gene. DLG5 BINDING SITE is HOST TARGET binding site found in the 3' untranslated region of mRNA encoded by DLG5, corresponding to a HOST TARGET binding site such as BINDING SITE I, BINDING SITE II or BINDING SITE III. Table 2 illustrates the complementarity of the nucleotide sequences of DLG5 BINDING SITE, designated SEQ ID:40339, to the nucleotide sequence of VGAM2128 RNA, herein designated VGAM RNA, also designated SEQ ID:4839.

A function of VGAM2128 is therefore inhibition of Discs, Large (Drosophila) Homolog 5 (DLG5, Accession XM_096398), a gene which may transmit extracellular signals to inhibit cell proliferation. Accordingly, utilities of VGAM2128 include diagnosis, prevention and treatment of diseases and clinical conditions associated with DLG5. The function of DLG5 and its association with various diseases and clinical conditions, has been established by previous studies, as described hereinabove with reference to VGAM444. MGC23937 (Accession NM_145052) is another VGAM2128 host target gene. MGC23937 BINDING SITE is HOST TARGET binding site found in the 3' untranslated region of mRNA encoded by MGC23937, corresponding to a HOST TARGET binding site such as BINDING SITE I, BINDING SITE II or BINDING SITE III. Table 2 illustrates the complementarity of the nucleotide sequences of MGC23937 BINDING SITE, designated SEQ ID:29682, to the nucleotide sequence of VGAM2128 RNA, herein designated VGAM RNA, also designated SEQ ID:4839.

Another function of VGAM2128 is therefore inhibition of MGC23937 (Accession NM_145052). Accordingly, utilities of VGAM2128 include diagnosis, prevention and treatment of diseases and clinical conditions associated with MGC23937. LOC158969 (Accession XM_088728) is another VGAM2128 host target gene. LOC158969 BINDING SITE is HOST TARGET binding site found in the 3' untranslated region of mRNA encoded by LOC158969, corresponding to a HOST TARGET binding site such as BINDING SITE I, BINDING SITE II or BINDING SITE III. Table 2 illustrates the complementarity of the nucleotide sequences of LOC158969 BINDING SITE, designated SEQ ID:39922, to the nucleotide sequence of VGAM2128 RNA, herein designated VGAM RNA, also designated SEQ ID:4839.

Another function of VGAM2128 is therefore inhibition of LOC158969 (Accession XM_088728). Accordingly, utilities of VGAM2128 include diagnosis, prevention and treatment of diseases and clinical conditions associated with LOC158969. FIG. 1 further provides a conceptual description of a novel bioinformatically detected viral gene of the present invention, referred to here as Viral Genomic Address Messenger 2129 (VGAM2129) viral gene, which modulates expression of respective host target genes thereof, the function and utility of which host target genes is known in the art.

VGAM2129 is a novel bioinformatically detected regulatory, non protein coding, viral micro RNA (miRNA) gene. The method by which VGAM2129 was detected is described hereinabove with reference to FIGS. 1-8.

VGAM2129 gene, herein designated VGAM GENE, is a viral gene contained in the genome of Ateline Herpesvirus 3. VGAM2129 host target gene, herein designated VGAM HOST TARGET GENE, is a human gene contained in the human genome.

VGAM2129 gene encodes a VGAM2129 precursor RNA, herein designated VGAM PRECURSOR RNA. Similar to other miRNA genes, and unlike most ordinary genes, VGAM2129 precursor RNA does not encode a protein. A nucleotide sequence identical or highly similar to the nucleotide sequence of VGAM2129 precursor RNA is designated SEQ ID:2115, and is provided hereinbelow with reference to the sequence listing part. Nucleotide sequence SEQ ID:2115 is located at position 9401 relative to the genome of Ateline Herpesvirus 3.

VGAM2129 precursor RNA folds onto itself, forming VGAM2129 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2129 folded precursor RNA into VGAM2129 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM2129 RNA is designated SEQ ID:4840, and is provided hereinbelow with reference to the sequence listing part.

VGAM2129 host target gene, herein designated VGAM HOST TARGET GENE, encodes a corresponding messenger RNA, VGAM2129 host target RNA, herein designated VGAM HOST TARGET RNA. VGAM2129 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2129 RNA, herein designated VGAM RNA, binds complementarily to one or more host target binding sites located in untranslated regions of VGAM2129 host target RNA, herein designated VGAM HOST TARGET RNA. This complementary binding is due to the fact that the nucleotide sequence of VGAM2129 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2129 RNA, herein designated VGAM RNA, may have a different number of host target binding sites in untranslated regions of a VGAM2129 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2129 RNA, herein designated VGAM RNA, to host target binding sites on VGAM2129 host target RNA, herein designated VGAM HOST TARGET RNA, such as BINDING SITE I, BINDING SITE II and BINDING SITE III, inhibits translation of VGAM2129 host target RNA into VGAM2129 host target protein, herein designated VGAM HOST TARGET PROTEIN. VGAM host target protein is therefore outlined by a broken line.

It is appreciated that VGAM2129 host target gene, herein designated VGAM HOST TARGET GENE, in fact represents a plurality of VGAM2129 host target genes. The mRNA of each one of this plurality of VGAM2129 host target genes comprises one or more host target binding sites, each having a nucleotide sequence which is at least partly complementary to VGAM2129 RNA, herein designated VGAM RNA, and which when bound by VGAM2129 RNA causes inhibition of translation of respective one or more VGAM2129 host target proteins.

It is further appreciated by one skilled in the art that the mode of translational inhibition illustrated by FIG. 1 with specific reference to translational inhibition exerted by VGAM2129 gene, herein designated VGAM GENE, on one or more VGAM2129 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2129 is inhibition of expression of host target genes, as part of a novel viral mechanism of attacking a host. Accordingly, utilities of VGAM2129 include diagnosis, prevention and treatment of viral infection by Ateline Herpesvirus 3. Specific functions, and accordingly utilities, of VGAM2129 correlate with, and may be deduced from, the identity of the host target genes which VGAM2129 binds and inhibits, and the function of these host target genes, as elaborated hereinbelow.

Nucleotide sequences of the VGAM2129 precursor RNA, herein designated VGAM PRECURSOR RNA, and of the 'diced' VGAM2129 RNA, herein designated VGAM RNA, and a schematic representation of the secondary folding of VGAM2129 folded precursor RNA, herein designated VGAM FOLDED PRECURSOR RNA, of VGAM2129 are further described hereinbelow with reference to Table 1.

Nucleotide sequences of host target binding sites, such as BINDING SITE-I, BINDING SITE-II and BINDING SITE-III of FIG. 1, found on VGAM2129 host target RNA, and schematic representation of the complementarity of each of these host target binding sites to VGAM2129 RNA, herein designated VGAM RNA, are described hereinbelow with reference to Table 2.

As mentioned hereinabove with reference to FIG. 1, a function of VGAM2129 gene, herein designated VGAM is inhibition of expression of VGAM2129 target genes. It is appreciated that specific functions, and accordingly utilities, of VGAM2129 correlate with, and may be deduced from, the identity of the target genes which VGAM2129 binds and inhibits, and the function of these target genes, as elaborated hereinbelow.

Cysteine-rich Motor Neuron 1 (CRIM1, Accession NM_016441) is a VGAM2129 host target gene. CRIM1 BINDING SITE is HOST TARGET binding site found in the 3' untranslated region of mRNA encoded by CRIM1, corresponding to a HOST TARGET binding site such as BINDING SITE I, BINDING SITE II or BINDING SITE III. Table 2 illustrates the complementarity of the nucleotide sequences of CRIM1 BINDING SITE, designated SEQ ID:18558, to the nucleotide sequence of VGAM2129 RNA, herein designated VGAM RNA, also designated SEQ ID:4840.

A function of VGAM2129 is therefore inhibition of Cysteine-rich Motor Neuron 1 (CRIM1, Accession NM_016441). Accordingly, utilities of VGAM2129 include diagnosis, prevention and treatment of diseases and clinical conditions associated with CRIM1. Mannan-binding Lectin Serine Protease 1 (C4/C2 activating component of Ra-reactive factor) (MASP1, Accession NM_001879) is another VGAM2129 host target gene. MASP1 BINDING SITE is HOST TARGET binding site found in the 3' untranslated region of mRNA encoded by MASP1, corresponding to a HOST TARGET binding site such as BINDING SITE I, BINDING SITE II or BINDING SITE III. Table 2 illustrates the complementarity of the nucleotide sequences of MASP1 BINDING SITE, designated SEQ ID:7605, to the nucleotide sequence of VGAM2129 RNA, herein designated VGAM RNA, also designated SEQ ID:4840.

Another function of VGAM2129 is therefore inhibition of Mannan-binding Lectin Serine Protease 1 (C4/C2 activating component of Ra-reactive factor) (MASP1, Accession NM_001879), a gene which a complement-dependent bactericidal factor. Accordingly, utilities of VGAM2129 include diagnosis, prevention and treatment of diseases and clinical conditions associated with MASP1. The function of MASP1 and its association with various diseases and clinical conditions, has been established by previous studies, as described hereinabove with reference to VGAM566. Rho-associated, Coiled-coil Containing Protein Kinase 2 (ROCK2, Accession XM_038377) is another VGAM2129 host target gene. ROCK2 BINDING SITE is HOST TARGET binding site found in the 3' untranslated region of mRNA encoded by ROCK2, corresponding to a HOST TARGET binding site such as BINDING SITE I, BINDING SITE II or BINDING SITE III. Table 2 illustrates the complementarity of the nucleotide sequences of ROCK2 BINDING SITE, designated SEQ ID:32839, to the nucleotide sequence of VGAM2129 RNA, herein designated VGAM RNA, also designated SEQ ID:4840.

Another function of VGAM2129 is therefore inhibition of Rho-associated, Coiled-coil Containing Protein Kinase 2 (ROCK2, Accession XM_038377), a gene which regulates cytokinesis, smooth muscle contraction, the formation of actin stress fibers and focal adhesions. Accordingly, utilities of VGAM2129 include diagnosis, prevention and treatment of diseases and clinical conditions associated with ROCK2. The function of ROCK2 and its association with various diseases and clinical conditions, has been established by previous studies, as described hereinabove with reference to VGAM273. CASPR3 (Accession NM_033655) is another VGAM2129 host target gene. CASPR3 BINDING SITE is HOST TARGET binding site found in the 3' untranslated region of mRNA encoded by CASPR3, corresponding to a HOST TARGET binding site such as BINDING SITE I, BINDING SITE II or BINDING SITE III. Table 2 illustrates the complementarity of the nucleotide sequences of CASPR3 BINDING SITE, designated SEQ ID:27386, to the nucleotide sequence of VGAM2129 RNA, herein designated VGAM RNA, also designated SEQ ID:4840.

Another function of VGAM2129 is therefore inhibition of CASPR3 (Accession NM_033655). Accordingly, utilities of VGAM2129 include diagnosis, prevention and treatment of diseases and clinical conditions associated with CASPR3. FHR5 (Accession NM_030787) is another VGAM2129 host target gene. FHR5 BINDING SITE is HOST TARGET binding site found in the 3' untranslated region of mRNA encoded by FHR5, corresponding to a HOST TARGET binding site such as BINDING SITE I, BINDING SITE II or BINDING SITE III. Table 2 illustrates the complementarity of the nucleotide sequences of FHR5 BINDING SITE, designated SEQ ID:25083, to the nucleotide sequence of VGAM2129 RNA, herein designated VGAM RNA, also designated SEQ ID:4840.

Another function of VGAM2129 is therefore inhibition of FHR5 (Accession NM_030787). Accordingly, utilities of VGAM2129 include diagnosis, prevention and treatment of diseases and clinical conditions associated with FHR5. FLJ11726 (Accession NM_024971) is another VGAM2129 host target gene. FLJ11726 BINDING SITE is HOST TARGET binding site found in the 3' untranslated region of mRNA encoded by FLJ11726, corresponding to a HOST TARGET binding site such as BINDING SITE I, BINDING SITE II or BINDING SITE III. Table 2 illustrates the complementarity of the nucleotide sequences of FLJ11726 BINDING SITE, designated SEQ ID:24526, to the nucleotide sequence of VGAM2129 RNA, herein designated VGAM RNA, also designated SEQ ID:4840.

Another function of VGAM2129 is therefore inhibition of FLJ11726 (Accession NM_024971). Accordingly, utilities of VGAM2129 include diagnosis, prevention and treatment of diseases and clinical conditions associated with FLJ11726. FLJ20085 (Accession NM_017660) is another VGAM2129 host target gene. FLJ20085 BINDING SITE is HOST TARGET binding site found in the 5' untranslated region of mRNA encoded by FLJ20085, corresponding to a HOST TARGET binding site such as BINDING SITE I, BINDING SITE II or BINDING SITE III. Table 2 illustrates the complementarity of the nucleotide sequences of FLJ20085 BINDING SITE, designated SEQ ID:19185, to the nucleotide sequence of VGAM2129 RNA, herein designated VGAM RNA, also designated SEQ ID:4840.

Another function of VGAM2129 is therefore inhibition of FLJ20085 (Accession NM_017660). Accordingly, utilities of VGAM2129 include diagnosis, prevention and treatment of diseases and clinical conditions associated with FLJ20085. KIAA0475 (Accession NM_014864) is another VGAM2129 host target gene. KIAA0475 BINDING SITE is HOST TARGET binding site found in the 3' untranslated region of mRNA encoded by KIAA0475, corresponding to a HOST TARGET binding site such as BINDING SITE I, BINDING SITE II or BINDING SITE III. Table 2 illustrates the complementarity of the nucleotide sequences of KIAA0475 BINDING SITE, designated SEQ ID:16948, to the nucleotide sequence of VGAM2129 RNA, herein designated VGAM RNA, also designated SEQ ID:4840.

Another function of VGAM2129 is therefore inhibition of KIAA0475 (Accession NM_014864). Accordingly, utilities of VGAM2129 include diagnosis, prevention and treatment of diseases and clinical conditions associated with KIAA0475. RAB40A, Member RAS Oncogene Family (RAB40A, Accession XM_088733) is another VGAM2129 host target gene. RAB40A BINDING SITE is HOST TARGET binding site found in the 5' untranslated region of mRNA encoded by RAB40A, corresponding to a HOST TARGET binding site such as BINDING SITE I, BINDING SITE II or BINDING SITE III. Table 2 illustrates the complementarity of the nucleotide sequences of RAB40A BINDING SITE, designated SEQ ID:39929, to the nucleotide sequence of VGAM2129 RNA, herein designated VGAM RNA, also designated SEQ ID:4840.

Another function of VGAM2129 is therefore inhibition of RAB40A, Member RAS Oncogene Family (RAB40A, Accession XM_088733). Accordingly, utilities of VGAM2129 include diagnosis, prevention and treatment of diseases and clinical conditions associated with RAB40A. TUSP (Accession NM_020245) is another VGAM2129 host target gene. TUSP BINDING SITE is HOST TARGET binding site found in the 3' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21523, to the nucleotide sequence of VGAM2129 RNA, herein designated VGAM RNA, also designated SEQ ID:4840.

Another function of VGAM2129 is therefore inhibition of TUSP (Accession NM_020245). Accordingly, utilities of VGAM2129 include diagnosis, prevention and treatment of diseases and clinical conditions associated with TUSP. Ubiquitin Specific Protease 2 (USP2, Accession NM_004205) is another VGAM2129 host target gene. USP2 BINDING SITE is HOST TARGET binding site found in the 5' untranslated region of mRNA encoded by USP2, corresponding to a HOST TARGET binding site such as BINDING SITE I, BINDING SITE II or BINDING SITE III. Table 2 illustrates the complementarity of the nucleotide sequences of USP2 BINDING SITE, designated SEQ ID:10400, to the nucleotide sequence of VGAM2129 RNA, herein designated VGAM RNA, also designated SEQ ID:4840.

Another function of VGAM2129 is therefore inhibition of Ubiquitin Specific Protease 2 (USP2, Accession NM_004205). Accordingly, utilities of VGAM2129 include diagnosis, prevention and treatment of diseases and clinical conditions associated with USP2. LOC219920 (Accession XM_167787) is another VGAM2129 host target gene. LOC219920 BINDING SITE is HOST TARGET binding site found in the 5' untranslated region of mRNA encoded by LOC219920, corresponding to a HOST TARGET binding site such as BINDING SITE I, BINDING SITE II or BINDING SITE III. Table 2 illustrates the complementarity of the nucleotide sequences of LOC219920 BINDING SITE, designated SEQ ID:44806, to the nucleotide sequence of VGAM2129 RNA, herein designated VGAM RNA, also designated SEQ ID:4840.

Another function of VGAM2129 is therefore inhibition of LOC219920 (Accession XM_167787). Accordingly, utilities of VGAM2129 include diagnosis, prevention and treatment of diseases and clinical conditions associated with LOC219920. LOC255589 (Accession XM_173060) is another VGAM2129 host target gene. LOC255589 BINDING SITE is HOST TARGET binding site found in the 5' untranslated region of mRNA encoded by LOC255589, corresponding to a HOST TARGET binding site such as BINDING SITE I, BINDING SITE II or BINDING SITE III. Table 2 illustrates the complementarity of the nucleotide sequences of LOC255589 BINDING SITE, designated SEQ ID:46314, to the nucleotide sequence of VGAM2129 RNA, herein designated VGAM RNA, also designated SEQ ID:4840.

Another function of VGAM2129 is therefore inhibition of LOC255589 (Accession XM_173060). Accordingly, utilities of VGAM2129 include diagnosis, prevention and treatment of diseases and clinical conditions associated with LOC255589. FIG. 1 further provides a conceptual description of a novel bioinformatically detected viral gene of the present invention, referred to here as Viral Genomic Address Messenger 2130 (VGAM2130) viral gene, which modulates expression of respective host target genes thereof, the function and utility of which host target genes is known in the art.

VGAM2130 is a novel bioinformatically detected regulatory, non protein coding, viral micro RNA (miRNA) gene. The method by which VGAM2130 was detected is described hereinabove with reference to FIGS. 1-8.

VGAM2130 gene, herein designated VGAM GENE, is a viral gene contained in the genome of Ateline Herpesvirus 3. VGAM2130 host target gene, herein designated VGAM HOST TARGET GENE, is a human gene contained in the human genome.

VGAM2130 gene encodes a VGAM2130 precursor RNA, herein designated VGAM PRECURSOR RNA. Similar to other miRNA genes, and unlike most ordinary genes, VGAM2130 precursor RNA does not encode a protein. A nucleotide sequence identical or highly similar to the nucleotide sequence of VGAM2130 precursor RNA is designated SEQ ID:2116, and is provided hereinbelow with reference to the sequence listing part. Nucleotide sequence SEQ ID:2116 is located at position 23005 relative to the genome of Ateline Herpesvirus 3.

VGAM2130 precursor RNA folds onto itself, forming VGAM2130 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2130 folded precursor RNA into VGAM2130 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2130 RNA is designated SEQ ID:4841, and is provided hereinbelow with reference to the sequence listing part.

VGAM2130 host target gene, herein designated VGAM HOST TARGET GENE, encodes a corresponding messenger RNA, VGAM2130 host target RNA, herein designated VGAM HOST TARGET RNA. VGAM2130 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2130 RNA, herein designated VGAM RNA, binds complementarily to one or more host target binding sites located in untranslated regions of VGAM2130 host target RNA, herein designated VGAM HOST TARGET RNA. This complementary binding is due to the fact that the nucleotide sequence of VGAM2130 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2130 RNA, herein designated VGAM RNA, may have a different number of host target binding sites in untranslated regions of a VGAM2130 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2130 RNA, herein designated VGAM RNA, to host target binding sites on VGAM2130 host target RNA, herein designated VGAM HOST TARGET RNA, such as BINDING SITE I, BINDING SITE II and BINDING SITE III, inhibits translation of VGAM2130 host target RNA into VGAM2130 host target protein, herein designated VGAM HOST TARGET PROTEIN. VGAM host target protein is therefore outlined by a broken line.

It is appreciated that VGAM2130 host target gene, herein designated VGAM HOST TARGET GENE, in fact represents a plurality of VGAM2130 host target genes. The mRNA of each one of this plurality of VGAM2130 host target genes comprises one or more host target binding sites, each having a nucleotide sequence which is at least partly complementary to VGAM2130 RNA, herein designated VGAM RNA, and which when bound by VGAM2130 RNA causes inhibition of translation of respective one or more VGAM2130 host target proteins.

It is further appreciated by one skilled in the art that the mode of translational inhibition illustrated by FIG. 1 with specific reference to translational inhibition exerted by VGAM2130 gene, herein designated VGAM GENE, on one or more VGAM2130 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2130 is inhibition of expression of host target genes, as part of a novel viral mechanism of attacking a host. Accordingly, utilities of VGAM2130 include diagnosis, prevention and treatment of viral infection by Ateline Herpesvirus 3. Specific functions, and accordingly utilities, of VGAM2130 correlate with, and may be deduced from, the identity of the host target genes which VGAM2130 binds and inhibits, and the function of these host target genes, as elaborated hereinbelow.

Nucleotide sequences of the VGAM2130 precursor RNA, herein designated VGAM PRECURSOR RNA, and of the 'diced' VGAM2130 RNA, herein designated VGAM RNA, and a schematic representation of the secondary folding of VGAM2130 folded precursor RNA, herein designated VGAM FOLDED PRECURSOR RNA, of VGAM2130 are further described hereinbelow with reference to Table 1.

Nucleotide sequences of host target binding sites, such as BINDING SITE-I, BINDING SITE-II and BINDING SITE-III of FIG. 1, found on VGAM2130 host target RNA, and schematic representation of the complementarity of each of these host target binding sites to VGAM2130 RNA, herein designated VGAM RNA, are described hereinbelow with reference to Table 2.

As mentioned hereinabove with reference to FIG. 1, a function of VGAM2130 gene, herein designated VGAM is inhibition of expression of VGAM2130 target genes. It is appreciated that specific functions, and accordingly utilities, of VGAM2130 correlate with, and may be deduced from, the identity of the target genes which VGAM2130 binds and inhibits, and the function of these target genes, as elaborated hereinbelow.

Actinin, Alpha 2 (ACTN2, Accession NM_001103) is a VGAM2130 host target gene. ACTN2 BINDING SITE is HOST TARGET binding site found in the 3' untranslated region of mRNA encoded by ACTN2, corresponding to a HOST TARGET binding site such as BINDING SITE I, BINDING SITE II or BINDING SITE III. Table 2 illustrates the complementarity of the nucleotide sequences of ACTN2 BINDING SITE, designated SEQ ID:6755, to the nucleotide sequence of VGAM2130 RNA, herein designated VGAM RNA, also designated SEQ ID:4841.

A function of VGAM2130 is therefore inhibition of Actinin, Alpha 2 (ACTN2, Accession NM_001103), a gene which an actin-binding protein with multiple roles in different cell types. Accordingly, utilities of VGAM2130 include diagnosis, prevention and treatment of diseases and clinical conditions associated with ACTN2. The function of ACTN2 and its association with various diseases and clinical conditions, has been established by previous studies, as described hereinabove with reference to VGAM88. Eukaryotic Translation Initiation Factor 2C, 1 (EIF2C1, Accession NM_012199) is another VGAM2130 host target gene. EIF2C1 BINDING SITE is HOST TARGET binding site found in the 3' untranslated region of mRNA encoded by EIF2C1, corresponding to a HOST TARGET binding site such as BINDING SITE I, BINDING SITE II or BINDING SITE III. Table 2 illustrates the complementarity of the nucleotide sequences of EIF2C1 BINDING SITE, designated SEQ ID:14500, to the nucleotide sequence of VGAM2130 RNA, herein designated VGAM RNA, also designated SEQ ID:4841.

Another function of VGAM2130 is therefore inhibition of Eukaryotic Translation Initiation Factor 2C, 1 (EIF2C1, Accession NM_012199), a gene which plays an important role in the eukaryotic peptide chain initiation process. Accordingly, utilities of VGAM2130 include diagnosis, prevention and treatment of diseases and clinical conditions associated with EIF2C1. The function of EIF2C1 and its association with various diseases and clinical conditions, has been established by previous studies, as described hereinabove with reference to VGAM118. PRO2000 (Accession NM_014109) is another VGAM2130 host target gene. PRO2000 BINDING SITE is HOST TARGET binding site found in the 5' untranslated region of mRNA encoded by PRO2000, corresponding to a HOST TARGET binding site such as BINDING SITE I, BINDING SITE II or BINDING SITE III. Table 2 illustrates the complementarity of the nucleotide sequences of PRO2000 BINDING SITE, designated SEQ ID:15337, to the nucleotide sequence of VGAM2130 RNA, herein designated VGAM RNA, also designated SEQ ID:4841.

Another function of VGAM2130 is therefore inhibition of PRO2000 (Accession NM_014109). Accordingly, utilities of VGAM2130 include diagnosis, prevention and treatment of diseases and clinical conditions associated with PRO2000. LOC150383 (Accession XM_086905) is another VGAM2130 host target gene. LOC150383 BINDING SITE is HOST TARGET binding site found in the 3' untranslated region of mRNA encoded by LOC150383, corresponding to a HOST TARGET binding site such as BINDING SITE I, BINDING SITE II or BINDING SITE III. Table 2 illustrates the complementarity of the nucleotide sequences of LOC150383 BINDING SITE, designated SEQ ID:38945, to the nucleotide sequence of VGAM2130 RNA, herein designated VGAM RNA, also designated SEQ ID:4841.

Another function of VGAM2130 is therefore inhibition of LOC150383 (Accession XM_086905). Accordingly, utilities of VGAM2130 include diagnosis, prevention and treatment of diseases and clinical conditions associated with LOC150383. FIG. 1 further provides a conceptual description of a novel bioinformatically detected viral gene of the present invention, referred to here as Viral Genomic Address Messenger 2131 (VGAM2131) viral gene, which modulates expression of respective host target genes thereof, the function and utility of which host target genes is known in the art.

VGAM2131 is a novel bioinformatically detected regulatory, non protein coding, viral micro RNA (miRNA) gene. The method by which VGAM2131 was detected is described hereinabove with reference to FIGS. 1-8.

VGAM2131 gene, herein designated VGAM GENE, is a viral gene contained in the genome of Ateline Herpesvirus 3. VGAM2131 host target gene, herein designated VGAM HOST TARGET GENE, is a human gene contained in the human genome.

VGAM2131 gene encodes a VGAM2131 precursor RNA, herein designated VGAM PRECURSOR RNA. Similar to other miRNA genes, and unlike most ordinary genes, VGAM2131 precursor RNA does not encode a protein. A nucleotide sequence identical or highly similar to the nucleotide sequence of VGAM2131 precursor RNA is designated SEQ ID:2117, and is provided hereinbelow with reference to the sequence listing part. Nucleotide sequence SEQ ID:2117 is located at position 9609 relative to the genome of Ateline Herpesvirus 3.

VGAM2131 precursor RNA folds onto itself, forming VGAM2131 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2131 folded precursor RNA into VGAM2131 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2131 RNA is designated SEQ ID:4842, and is provided hereinbelow with reference to the sequence listing part.

VGAM2131 host target gene, herein designated VGAM HOST TARGET GENE, encodes a corresponding messenger RNA, VGAM2131 host target RNA, herein designated VGAM HOST TARGET RNA. VGAM2131 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2131 RNA, herein designated VGAM RNA, binds complementarily to one or more host target binding sites located in untranslated regions of VGAM2131 host target RNA, herein designated VGAM HOST TARGET RNA. This complementary binding is due to the fact that the nucleotide sequence of VGAM2131 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2131 RNA, herein designated VGAM RNA, may have a different number of host target binding sites in untranslated regions of a VGAM2131 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2131 RNA, herein designated VGAM RNA, to host target binding sites on VGAM2131 host target RNA, herein designated VGAM HOST TARGET RNA, such as BINDING SITE I, BINDING SITE II and BINDING SITE III, inhibits translation of VGAM2131 host target RNA into VGAM2131 host target protein, herein designated VGAM HOST TARGET PROTEIN. VGAM host target protein is therefore outlined by a broken line.

It is appreciated that VGAM2131 host target gene, herein designated VGAM HOST TARGET GENE, in fact represents a plurality of VGAM2131 host target genes. The mRNA of each one of this plurality of VGAM2131 host target genes comprises one or more host target binding sites, each having a nucleotide sequence which is at least partly complementary to VGAM2131 RNA, herein designated VGAM RNA, and which when bound by VGAM2131 RNA causes inhibition of translation of respective one or more VGAM2131 host target proteins.

It is further appreciated by one skilled in the art that the mode of translational inhibition illustrated by FIG. 1 with specific reference to translational inhibition exerted by VGAM2131 gene, herein designated VGAM GENE, on one or more VGAM2131 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2131 is inhibition of expression of host target genes, as part of a novel viral mechanism of attacking a host. Accordingly, utilities of VGAM2131 include diagnosis, prevention and treatment of viral infection by Ateline Herpesvirus 3. Specific functions, and accordingly utilities, of VGAM2131 correlate with, and may be deduced from, the identity of the host target genes which VGAM2131 binds and inhibits, and the function of these host target genes, as elaborated hereinbelow.

Nucleotide sequences of the VGAM2131 precursor RNA, herein designated VGAM PRECURSOR RNA, and of the 'diced' VGAM2131 RNA, herein designated VGAM RNA, and a schematic representation of the secondary folding of VGAM2131 folded precursor RNA, herein designated VGAM FOLDED PRECURSOR RNA, of VGAM2131 are further described hereinbelow with reference to Table 1.

Nucleotide sequences of host target binding sites, such as BINDING SITE-I, BINDING SITE-II and BINDING SITE-III of FIG. 1, found on VGAM2131 host target RNA, and schematic representation of the complementarity of each of these host target binding sites to VGAM2131 RNA, herein designated VGAM RNA, are described hereinbelow with reference to Table 2.

As mentioned hereinabove with reference to FIG. 1, a function of VGAM2131 gene, herein designated VGAM is inhibition of expression of VGAM2131 target genes. It is appreciated that specific functions, and accordingly utilities, of VGAM2131 correlate with, and may be deduced from, the identity of the target genes which VGAM2131 binds and inhibits, and the function of these target genes, as elaborated hereinbelow.

Adrenergic, Beta, Receptor Kinase 2 (ADRBK2, Accession NM_005160) is a VGAM2131 host target gene. ADRBK2 BINDING SITE is HOST TARGET binding site found in the 3' untranslated region of mRNA encoded by ADRBK2, corresponding to a HOST TARGET binding site such as BINDING SITE I, BINDING SITE II or BINDING SITE III. Table 2 illustrates the complementarity of the nucleotide sequences of ADRBK2 BINDING SITE, designated SEQ ID:11642, to the nucleotide sequence of VGAM2131 RNA, herein designated VGAM RNA, also designated SEQ ID:4842.

A function of VGAM2131 is therefore inhibition of Adrenergic, Beta, Receptor Kinase 2 (ADRBK2, Accession NM_005160), a gene which regulates desensitization of G protein-coupled receptors. Accordingly, utilities of VGAM2131 include diagnosis, prevention and treatment of diseases and clinical conditions associated with ADRBK2. The function of ADRBK2 and its association with various diseases and clinical conditions, has been established by previous studies, as described hereinabove with reference to VGAM806. TRAM (Accession NM_014294) is another VGAM2131 host target gene. TRAM BINDING SITE is HOST TARGET binding site found in the 3' untranslated region of mRNA encoded by TRAM, corresponding to a HOST TARGET binding site such as BINDING SITE I, BINDING SITE II or BINDING SITE III. Table 2 illustrates the complementarity of the nucleotide sequences of TRAM BINDING SITE, designated SEQ ID:15589, to the nucleotide sequence of VGAM2131 RNA, herein designated VGAM RNA, also designated SEQ ID:4842.

Another function of VGAM2131 is therefore inhibition of TRAM (Accession NM_014294). Accordingly, utilities of VGAM2131 include diagnosis, prevention and treatment of diseases and clinical conditions associated with TRAM. Coenzyme Q7 Homolog, Ubiquinone (yeast) (COQ7, Accession NM_016138) is another VGAM2131 host target gene. COQ7 BINDING SITE is HOST TARGET binding site found in the 3' untranslated region of mRNA encoded by COQ7, corresponding to a HOST TARGET binding site such as BINDING SITE I, BINDING SITE II or BINDING SITE III. Table 2 illustrates the complementarity of the nucleotide sequences of COQ7 BINDING SITE, designated SEQ ID:18221, to the nucleotide sequence of VGAM2131 RNA, herein designated VGAM RNA, also designated SEQ ID:4842.

Another function of VGAM2131 is therefore inhibition of Coenzyme Q7 Homolog, Ubiquinone (yeast) (COQ7, Accession NM_016138). Accordingly, utilities of VGAM2131 include diagnosis, prevention and treatment of diseases and clinical conditions associated with COQ7. FLJ22965 (Accession NM_022101) is another VGAM2131 host target gene. FLJ22965 BINDING SITE is HOST TARGET binding site found in the 3' untranslated region of mRNA encoded by FLJ22965, corresponding to a HOST TARGET binding site such as BINDING SITE I, BINDING SITE II or BINDING SITE III. Table 2 illustrates the complementarity of the nucleotide sequences of FLJ22965 BINDING SITE, designated SEQ ID:22642, to the nucleotide sequence of VGAM2131 RNA, herein designated VGAM RNA, also designated SEQ ID:4842.

Another function of VGAM2131 is therefore inhibition of FLJ22965 (Accession NM_022101). Accordingly, utilities of VGAM2131 include diagnosis, prevention and treatment of diseases and clinical conditions associated with FLJ22965. SMOC1 (Accession NM_022137) is another VGAM2131 host target gene. SMOC1 BINDING SITE is HOST TARGET binding site found in the 3' untranslated region of mRNA encoded by SMOC1, corresponding to a HOST TARGET binding site such as BINDING SITE I, BINDING SITE II or BINDING SITE III. Table 2 illustrates the complementarity of the nucleotide sequences of SMOC1 BINDING SITE, designated SEQ ID:22697, to the nucleotide sequence of VGAM2131 RNA, herein designated VGAM RNA, also designated SEQ ID:4842.

Another function of VGAM2131 is therefore inhibition of SMOC1 (Accession NM_022137). Accordingly, utilities of VGAM2131 include diagnosis, prevention and treatment of diseases and clinical conditions associated with SMOC1. LOC155072 (Accession XM_098661) is another VGAM2131 host target gene. LOC155072 BINDING SITE is HOST TARGET binding site found in the 3' untranslated region of mRNA encoded by LOC155072, corresponding to a HOST TARGET binding site such as BINDING SITE I, BINDING SITE II or BINDING SITE III. Table 2 illustrates the complementarity of the nucleotide sequences of LOC155072 BINDING SITE, designated SEQ ID:41758, to the nucleotide sequence of VGAM2131 RNA, herein designated VGAM RNA, also designated SEQ ID:4842.

Another function of VGAM2131 is therefore inhibition of LOC155072 (Accession XM_098661). Accordingly, utilities of VGAM2131 include diagnosis, prevention and treatment of diseases and clinical conditions associated with LOC155072. LOC202868 (Accession XM_117477) is another VGAM2131 host target gene. LOC202868 BINDING SITE is HOST TARGET binding site found in the 3' untranslated region of mRNA encoded by LOC202868, corresponding to a HOST TARGET binding site such as BINDING SITE I, BINDING SITE II or BINDING SITE III. Table 2 illustrates the complementarity of the nucleotide sequences of LOC202868 BINDING SITE, designated SEQ ID:43445, to the nucleotide sequence of VGAM2131 RNA, herein designated VGAM RNA, also designated SEQ ID:4842.

Another function of VGAM2131 is therefore inhibition of LOC202868 (Accession XM_117477). Accordingly, utilities of VGAM2131 include diagnosis, prevention and treatment of diseases and clinical conditions associated with LOC202868. FIG. 1 further provides a conceptual description of a novel bioinformatically detected viral gene of the present invention, referred to here as Viral Genomic Address Messenger 2132 (VGAM2132) viral gene, which modulates expression of respective host target genes thereof, the function and utility of which host target genes is known in the art.

VGAM2132 is a novel bioinformatically detected regulatory, non protein coding, viral micro RNA (miRNA) gene. The method by which VGAM2132 was detected is described hereinabove with reference to FIGS. 1-8.

VGAM2132 gene, herein designated VGAM GENE, is a viral gene contained in the genome of Ateline Herpesvirus 3. VGAM2132 host target gene, herein designated VGAM HOST TARGET GENE, is a human gene contained in the human genome.

VGAM2132 gene encodes a VGAM2132 precursor RNA, herein designated VGAM PRECURSOR RNA. Similar to other miRNA genes, and unlike most ordinary genes, VGAM2132 precursor RNA does not encode a protein. A nucleotide sequence identical or highly similar to the nucleotide sequence of VGAM2132 precursor RNA is designated SEQ ID:2118, and is provided hereinbelow with reference to the sequence listing part. Nucleotide sequence SEQ ID:2118 is located at position 17602 relative to the genome of Ateline Herpesvirus 3.

VGAM2132 precursor RNA folds onto itself, forming VGAM2132 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2132 folded precursor RNA into VGAM2132 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM2132 RNA is designated SEQ ID:4843, and is provided hereinbelow with reference to the sequence listing part.

VGAM2132 host target gene, herein designated VGAM HOST TARGET GENE, encodes a corresponding messenger RNA, VGAM2132 host target RNA, herein designated VGAM HOST TARGET RNA. VGAM2132 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2132 RNA, herein designated VGAM RNA, binds complementarily to one or more host target binding sites located in untranslated regions of VGAM2132 host target RNA, herein designated VGAM HOST TARGET RNA. This complementary binding is due to the fact that the nucleotide sequence of VGAM2132 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2132 RNA, herein designated VGAM RNA, may have a different number of host target binding sites in untranslated regions of a VGAM2132 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2132 RNA, herein designated VGAM RNA, to host target binding sites on VGAM2132 host target RNA, herein designated VGAM HOST TARGET RNA, such as BINDING SITE I, BINDING SITE II and BINDING SITE III, inhibits translation of VGAM2132 host target RNA into VGAM2132 host target protein, herein designated VGAM HOST TARGET PROTEIN. VGAM host target protein is therefore outlined by a broken line.

It is appreciated that VGAM2132 host target gene, herein designated VGAM HOST TARGET GENE, in fact represents a plurality of VGAM2132 host target genes. The mRNA of each one of this plurality of VGAM2132 host target genes comprises one or more host target binding sites, each having a nucleotide sequence which is at least partly complementary to VGAM2132 RNA, herein designated VGAM RNA, and which when bound by VGAM2132 RNA causes inhibition of translation of respective one or more VGAM2132 host target proteins.

It is further appreciated by one skilled in the art that the mode of translational inhibition illustrated by FIG. 1 with specific reference to translational inhibition exerted by VGAM2132 gene, herein designated VGAM GENE, on one or more VGAM2132 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2132 is inhibition of expression of host target genes, as part of a novel viral mechanism of attacking a host. Accordingly, utilities of VGAM2132 include diagnosis, prevention and treatment of viral infection by Ateline Herpesvirus 3. Specific functions, and accordingly utilities, of VGAM2132 correlate with, and may be deduced from, the identity of the host target genes which VGAM2132 binds and inhibits, and the function of these host target genes, as elaborated hereinbelow.

Nucleotide sequences of the VGAM2132 precursor RNA, herein designated VGAM PRECURSOR RNA, and of the 'diced' VGAM2132 RNA, herein designated VGAM RNA, and a schematic representation of the secondary folding of VGAM2132 folded precursor RNA, herein designated VGAM FOLDED PRECURSOR RNA, of VGAM2132 are further described hereinbelow with reference to Table 1.

Nucleotide sequences of host target binding sites, such as BINDING SITE-I, BINDING SITE-II and BINDING SITE-III of FIG. 1, found on VGAM2132 host target RNA, and schematic representation of the complementarity of each of these host target binding sites to VGAM2132 RNA, herein designated VGAM RNA, are described hereinbelow with reference to Table 2.

As mentioned hereinabove with reference to FIG. 1, a function of VGAM2132 gene, herein designated VGAM is inhibition of expression of VGAM2132 target genes. It is appreciated that specific functions, and accordingly utilities, of VGAM2132 correlate with, and may be deduced from, the identity of the target genes which VGAM2132 binds and inhibits, and the function of these target genes, as elaborated hereinbelow.

Mel Transforming Oncogene (derived from cell line NK14)- RAB8 Homolog (MEL, Accession NM_005370) is a VGAM2132 host target gene. MEL BINDING SITE is HOST TARGET binding site found in the 3' untranslated region of mRNA encoded by MEL, corresponding to a HOST TARGET binding site such as BINDING SITE I, BINDING SITE II or BINDING SITE III. Table 2 illustrates the complementarity of the nucleotide sequences of MEL BINDING SITE, designated SEQ ID:11846, to the nucleotide sequence of VGAM2132 RNA, herein designated VGAM RNA, also designated SEQ ID:4843.

A function of VGAM2132 is therefore inhibition of Mel Transforming Oncogene (derived from cell line NK14)- RAB8 Homolog (MEL, Accession NM_005370), a gene which may be involved in vesicular trafficking and neurotransmitter release. Accordingly, utilities of VGAM2132 include diagnosis, prevention and treatment of diseases and clinical conditions associated with MEL. The function of MEL and its association with various diseases and clinical conditions, has been established by previous studies, as described hereinabove with reference to VGAM40. Multiple Endocrine Neoplasia I (MEN1, Accession NM_130799) is another VGAM2132 host target gene. MEN1 BINDING SITE1 through MEN1 BINDING SITE7 are HOST TARGET binding sites found in untranslated regions of mRNA encoded by MEN1, corresponding to HOST TARGET binding sites such as BINDING SITE I, BINDING SITE II or BINDING SITE III. Table 2 illustrates the complementarity of the nucleotide sequences of MEN1 BINDING SITE1 through MEN1 BINDING SITE7, designated SEQ ID:28288, SEQ ID:28290, SEQ ID:28292, SEQ ID:28294, SEQ ID:28297, SEQ ID:28301 and SEQ ID:5774 respectively, to the nucleotide sequence of VGAM2132 RNA, herein designated VGAM RNA, also designated SEQ ID:4843.

Another function of VGAM2132 is therefore inhibition of Multiple Endocrine Neoplasia I (MEN1, Accession NM_130799). Accordingly, utilities of VGAM2132 include diagnosis, prevention and treatment of diseases and clinical conditions associated with MEN1. LOC115795 (Accession XM_056738) is another VGAM2132 host target gene. LOC115795 BINDING SITE is HOST TARGET binding site found in the 5' untranslated region of mRNA encoded by LOC115795, corresponding to a HOST TARGET binding site such as BINDING SITE I, BINDING SITE II or BINDING SITE III. Table 2 illustrates the complementarity of the nucleotide sequences of LOC115795 BINDING SITE, designated SEQ ID:36418, to the nucleotide sequence of VGAM2132 RNA, herein designated VGAM RNA, also designated SEQ ID:4843.

Another function of VGAM2132 is therefore inhibition of LOC115795 (Accession XM_056738). Accordingly, utilities of VGAM2132 include diagnosis, prevention and treatment of diseases and clinical conditions associated with LOC115795. LOC130813 (Accession XM_065904) is another VGAM2132 host target gene. LOC130813 BINDING SITE is HOST TARGET binding site found in the 5' untranslated region of mRNA encoded by LOC130813, corresponding to a HOST TARGET binding site such as BINDING SITE I, BINDING SITE II or BINDING SITE III. Table 2 illustrates the complementarity of the nucleotide sequences of LOC130813 BINDING SITE, designated SEQ ID:37315, to the nucleotide sequence of VGAM2132 RNA, herein designated VGAM RNA, also designated SEQ ID:4843.

Another function of VGAM2132 is therefore inhibition of LOC130813 (Accession XM_065904). Accordingly, utilities of VGAM2132 include diagnosis, prevention and treatment of diseases and clinical conditions associated with LOC130813. FIG. 1 further provides a conceptual description of a novel bioinformatically detected viral gene of the present invention, referred to here as Viral Genomic Address Messenger 2133 (VGAM2133) viral gene, which modulates expression of respective host target genes thereof, the function and utility of which host target genes is known in the art.

VGAM2133 is a novel bioinformatically detected regulatory, non protein coding, viral micro RNA (miRNA) gene. The method by which VGAM2133 was detected is described hereinabove with reference to FIGS. 1-8.

VGAM2133 gene, herein designated VGAM GENE, is a viral gene contained in the genome of Ateline Herpesvirus 3. VGAM2133 host target gene, herein designated VGAM HOST TARGET GENE, is a human gene contained in the human genome.

VGAM2133 gene encodes a VGAM2133 precursor RNA, herein designated VGAM PRECURSOR RNA. Similar to other miRNA genes, and unlike most ordinary genes, VGAM2133 precursor RNA does not encode a protein. A nucleotide sequence identical or highly similar to the nucleotide sequence of VGAM2133 precursor RNA is designated SEQ ID:2119, and is provided hereinbelow with reference to the sequence listing part. Nucleotide sequence SEQ ID:2119 is located at position 4296 relative to the genome of Ateline Herpesvirus 3.

VGAM2133 precursor RNA folds onto itself, forming VGAM2133 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2133 folded precursor RNA into VGAM2133 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2133 RNA is designated SEQ ID:4844, and is provided hereinbelow with reference to the sequence listing part.

VGAM2133 host target gene, herein designated VGAM HOST TARGET GENE, encodes a corresponding messenger RNA, VGAM2133 host target RNA, herein designated VGAM HOST TARGET RNA. VGAM2133 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2133 RNA, herein designated VGAM RNA, binds complementarily to one or more host target binding sites located in untranslated regions of VGAM2133 host target RNA, herein designated VGAM HOST TARGET RNA. This complementary binding is due to the fact that the nucleotide sequence of VGAM2133 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2133 RNA, herein designated VGAM RNA, may have a different number of host target binding sites in untranslated regions of a VGAM2133 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2133 RNA, herein designated VGAM RNA, to host target binding sites on VGAM2133 host target RNA, herein designated VGAM HOST TARGET RNA, such as BINDING SITE I, BINDING SITE II and BINDING SITE III, inhibits translation of VGAM2133 host target RNA into VGAM2133 host target protein, herein designated VGAM HOST TARGET PROTEIN. VGAM host target protein is therefore outlined by a broken line.

It is appreciated that VGAM2133 host target gene, herein designated VGAM HOST TARGET GENE, in fact represents a plurality of VGAM2133 host target genes. The mRNA of each one of this plurality of VGAM2133 host target genes comprises one or more host target binding sites, each having a nucleotide sequence which is at least partly complementary to VGAM2133 RNA, herein designated VGAM RNA, and which when bound by VGAM2133 RNA causes inhibition of translation of respective one or more VGAM2133 host target proteins.

It is further appreciated by one skilled in the art that the mode of translational inhibition illustrated by FIG. 1 with specific reference to translational inhibition exerted by VGAM2133 gene, herein designated VGAM GENE, on one or more VGAM2133 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2133 is inhibition of expression of host target genes, as part of a novel viral mechanism of attacking a host. Accordingly, utilities of VGAM2133 include diagnosis, prevention and treatment of viral infection by Ateline Herpesvirus 3. Specific functions, and accordingly utilities, of VGAM2133 correlate with, and may be deduced from, the identity of the host target genes which VGAM2133 binds and inhibits, and the function of these host target genes, as elaborated hereinbelow.

Nucleotide sequences of the VGAM2133 precursor RNA, herein designated VGAM PRECURSOR RNA, and of the 'diced' VGAM2133 RNA, herein designated VGAM RNA, and a schematic representation of the secondary folding of VGAM2133 folded precursor RNA, herein designated VGAM FOLDED PRECURSOR RNA, of VGAM2133 are further described hereinbelow with reference to Table 1.

Nucleotide sequences of host target binding sites, such as BINDING SITE-I, BINDING SITE-II and BINDING SITE-III of FIG. 1, found on VGAM2133 host target RNA, and schematic representation of the complementarity of each of these host target binding sites to VGAM2133 RNA, herein designated VGAM RNA, are described hereinbelow with reference to Table 2.

As mentioned hereinabove with reference to FIG. 1, a function of VGAM2133 gene, herein designated VGAM is inhibition of expression of VGAM2133 target genes. It is appreciated that specific functions, and accordingly utilities, of VGAM2133 correlate with, and may be deduced from, the identity of the target genes which VGAM2133 binds and inhibits, and the function of these target genes, as elaborated hereinbelow.

Adaptor-related Protein Complex 2, Beta 1 Subunit (AP2B1, Accession NM_001282) is a VGAM2133 host target gene. AP2B1 BINDING SITE is HOST TARGET binding site found in the 3' untranslated region of mRNA encoded by AP2B1, corresponding to a HOST TARGET binding site such as BINDING SITE I, BINDING SITE II or BINDING SITE III. Table 2 illustrates the complementarity of the nucleotide sequences of AP2B1 BINDING SITE, designated SEQ ID:6949, to the nucleotide sequence of VGAM2133 RNA, herein designated VGAM RNA, also designated SEQ ID:4844.

A function of VGAM2133 is therefore inhibition of Adaptor-related Protein Complex 2, Beta 1 Subunit (AP2B1, Accession NM_001282), a gene which links clathrin to receptors in coated vesicles. Accordingly, utilities of VGAM2133 include diagnosis, prevention and treatment of diseases and clinical conditions associated with AP2B1. The function of AP2B1 and its association with various diseases and clinical conditions, has been established by previous studies, as described hereinabove with reference to VGAM1126. B-cell CLL/lymphoma 11B (zinc finger protein) (BCL11B, Accession NM_022898) is another VGAM2133 host target gene. BCL11B BINDING SITE is HOST TARGET binding site found in the 3' untranslated region of mRNA encoded by BCL11B, corresponding to a HOST TARGET binding site such as BINDING SITE I, BINDING SITE II or BINDING SITE III. Table 2 illustrates the complementarity of the nucleotide sequences of BCL11B BINDING SITE, designated SEQ ID:23161, to the nucleotide sequence of VGAM2133 RNA, herein designated VGAM RNA, also designated SEQ ID:4844.

Another function of VGAM2133 is therefore inhibition of B-cell CLL/lymphoma 11B (zinc finger protein) (BCL11B, Accession NM_022898). Accordingly, utilities of VGAM2133 include diagnosis, prevention and treatment of diseases and clinical conditions associated with BCL11B. Cytochrome P450, Subfamily XIX (aromatization of androgens) (CYP19, Accession NM_031226) is another VGAM2133 host target gene. CYP19 BINDING SITE1 and CYP19 BINDING SITE2 are HOST TARGET binding sites found in untranslated regions of mRNA encoded by CYP19, corresponding to HOST TARGET binding sites such as BINDING SITE I, BINDING SITE II or BINDING SITE III. Table 2 illustrates the complementarity of the nucleotide sequences of CYP19 BINDING SITE1 and CYP19 BINDING SITE2, designated SEQ ID:25270 and SEQ ID:5560 respectively, to the nucleotide sequence of VGAM2133 RNA, herein designated VGAM RNA, also designated SEQ ID:4844.

Another function of VGAM2133 is therefore inhibition of Cytochrome P450, Subfamily XIX (aromatization of androgens) (CYP19, Accession NM_031226), a gene which catalyzes the last steps of estrogen biosynthesis. Accordingly, utilities of VGAM2133 include diagnosis, prevention and treatment of diseases and clinical conditions associated with CYP19. The function of CYP19 and its association with various diseases and clinical conditions, has been established by previous studies, as described hereinabove with reference to VGAM508. VAMP (vesicle-associated membrane protein)-associated Protein B and C (VAPB, Accession NM_004738) is another VGAM2133 host target gene. VAPB BINDING SITE is HOST TARGET binding site found in the 3' untranslated region of mRNA encoded by VAPB, corresponding to a HOST TARGET binding site such as BINDING SITE I, BINDING SITE II or BINDING SITE III. Table 2 illustrates the complementarity of the nucleotide sequences of VAPB BINDING SITE, designated SEQ ID:11131, to the nucleotide sequence of VGAM2133 RNA, herein designated VGAM RNA, also designated SEQ ID:4844.

Another function of VGAM2133 is therefore inhibition of VAMP (vesicle-associated membrane protein)-associated Protein B and C (VAPB, Accession NM_004738). Accordingly, utilities of VGAM2133 include diagnosis, prevention and treatment of diseases and clinical conditions associated with VAPB. Chromosome 21 Open Reading Frame 25 (C21orf25, Accession XM_032945) is another VGAM2133 host target gene. C21orf25 BINDING SITE is HOST TARGET binding site found in the 3' untranslated region of mRNA encoded by C21orf25, corresponding to a HOST TARGET binding site such as BINDING SITE I, BINDING SITE II or BINDING SITE III. Table 2 illustrates the complementarity of the nucleotide sequences of C21orf25 BINDING SITE, designated SEQ ID:31799, to the nucleotide sequence of VGAM2133 RNA, herein designated VGAM RNA, also designated SEQ ID:4844.

Another function of VGAM2133 is therefore inhibition of Chromosome 21 Open Reading Frame 25 (C21orf25, Accession XM_032945). Accordingly, utilities of VGAM2133 include diagnosis, prevention and treatment of diseases and clinical conditions associated with C21orf25. FLJ14735 (Accession NM_032832) is another VGAM2133 host target gene. FLJ14735 BINDING SITE is HOST TARGET binding site found in the 3' untranslated region of mRNA encoded by FLJ14735, corresponding to a HOST TARGET binding site such as BINDING SITE I, BINDING SITE II or BINDING SITE III. Table 2 illustrates the complementarity of the nucleotide sequences of FLJ14735 BINDING SITE, designated SEQ ID:26608, to the nucleotide sequence of VGAM2133 RNA, herein designated VGAM RNA, also designated SEQ ID:4844.

Another function of VGAM2133 is therefore inhibition of FLJ14735 (Accession NM_032832). Accordingly, utilities of VGAM2133 include diagnosis, prevention and treatment of diseases and clinical conditions associated with FLJ14735. Methyl-CpG Binding Domain Protein 2 (MBD2, Accession NM_015832) is another VGAM2133 host target gene. MBD2 BINDING SITE is HOST TARGET binding site found in the 3' untranslated region of mRNA encoded by MBD2, corresponding to a HOST TARGET binding site such as BINDING SITE I, BINDING SITE II or BINDING SITE III. Table 2 illustrates the complementarity of the nucleotide sequences of MBD2 BINDING SITE, designated SEQ ID:17944, to the nucleotide sequence of VGAM2133 RNA, herein designated VGAM RNA, also designated SEQ ID:4844.

Another function of VGAM2133 is therefore inhibition of Methyl-CpG Binding Domain Protein 2 (MBD2, Accession NM_015832). Accordingly, utilities of VGAM2133 include diagnosis, prevention and treatment of diseases and clinical conditions associated with MBD2. MGC21738 (Accession NM_145044) is another VGAM2133 host target gene. MGC21738 BINDING SITE is HOST TARGET binding site found in the 5' untranslated region of mRNA encoded by MGC21738, corresponding to a HOST TARGET binding site such as BINDING SITE I, BINDING SITE II or BINDING SITE III. Table 2 illustrates the complementarity of the nucleotide sequences of MGC21738 BINDING SITE, designated SEQ ID:29676, to the nucleotide sequence of VGAM2133 RNA, herein designated VGAM RNA, also designated SEQ ID:4844.

Another function of VGAM2133 is therefore inhibition of MGC21738 (Accession NM_145044). Accordingly, utilities of VGAM2133 include diagnosis, prevention and treatment of diseases and clinical conditions associated with MGC21738. Protein Phosphatase 1, Regulatory (inhibitor) Subunit 1A (PPP1R1A, Accession NM_006741) is another VGAM2133 host target gene. PPP1R1A BINDING SITE is HOST TARGET binding site found in the 3' untranslated region of mRNA encoded by PPP1R1A, corresponding to a HOST TARGET binding site such as BINDING SITE I, BINDING SITE II or BINDING SITE III. Table 2 illustrates the complementarity of the nucleotide sequences of PPP1R1A BINDING SITE, designated SEQ ID:13590, to the nucleotide sequence of VGAM2133 RNA, herein designated VGAM RNA, also designated SEQ ID:4844.

Another function of VGAM2133 is therefore inhibition of Protein Phosphatase 1, Regulatory (inhibitor) Subunit 1A (PPP1R1A, Accession NM_006741). Accordingly, utilities of VGAM2133 include diagnosis, prevention and treatment of diseases and clinical conditions associated with PPP1R1A. LOC203248 (Accession XM_114659) is another VGAM2133 host target gene. LOC203248 BINDING SITE is HOST TARGET binding site found in the 3' untranslated region of mRNA encoded by LOC203248, corresponding to a HOST TARGET binding site such as BINDING SITE I, BINDING SITE II or BINDING SITE III. Table 2 illustrates the complementarity of the nucleotide sequences of LOC203248 BINDING SITE, designated SEQ ID:43016, to the nucleotide sequence of VGAM2133 RNA, herein designated VGAM RNA, also designated SEQ ID:4844.

Another function of VGAM2133 is therefore inhibition of LOC203248 (Accession XM_114659). Accordingly, utilities of VGAM2133 include diagnosis, prevention and treatment of diseases and clinical conditions associated with LOC203248. FIG. 1 further provides a conceptual description of a novel bioinformatically detected viral gene of the present invention, referred to here as Viral Genomic Address Messenger 2134 (VGAM2134) viral gene, which modulates expression of respective host target genes thereof, the function and utility of which host target genes is known in the art.

VGAM2134 is a novel bioinformatically detected regulatory, non protein coding, viral micro RNA (miRNA) gene. The method by which VGAM2134 was detected is described hereinabove with reference to FIGS. 1-8.

VGAM2134 gene, herein designated VGAM GENE, is a viral gene contained in the genome of Ateline Herpesvirus 3.

VGAM2134 host target gene, herein designated VGAM HOST TARGET GENE, is a human gene contained in the human genome.

VGAM2134 gene encodes a VGAM2134 precursor RNA, herein designated VGAM PRECURSOR RNA. Similar to other miRNA genes, and unlike most ordinary genes, VGAM2134 precursor RNA does not encode a protein. A nucleotide sequence identical or highly similar to the nucleotide sequence of VGAM2134 precursor RNA is designated SEQ ID:2120, and is provided hereinbelow with reference to the sequence listing part. Nucleotide sequence SEQ ID:2120 is located at position 20245 relative to the genome of Ateline Herpesvirus 3.

VGAM2134 precursor RNA folds onto itself, forming VGAM2134 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2134 folded precursor RNA into VGAM2134 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM2134 RNA is designated SEQ ID:4845, and is provided hereinbelow with reference to the sequence listing part.

VGAM2134 host target gene, herein designated VGAM HOST TARGET GENE, encodes a corresponding messenger RNA, VGAM2134 host target RNA, herein designated VGAM HOST TARGET RNA. VGAM2134 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2134 RNA, herein designated VGAM RNA, binds complementarily to one or more host target binding sites located in untranslated regions of VGAM2134 host target RNA, herein designated VGAM HOST TARGET RNA. This complementary binding is due to the fact that the nucleotide sequence of VGAM2134 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2134 RNA, herein designated VGAM RNA, may have a different number of host target binding sites in untranslated regions of a VGAM2134 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2134 RNA, herein designated VGAM RNA, to host target binding sites on VGAM2134 host target RNA, herein designated VGAM HOST TARGET RNA, such as BINDING SITE I, BINDING SITE II and BINDING SITE III, inhibits translation of VGAM2134 host target RNA into VGAM2134 host target protein, herein designated VGAM HOST TARGET PROTEIN. VGAM host target protein is therefore outlined by a broken line.

It is appreciated that VGAM2134 host target gene, herein designated VGAM HOST TARGET GENE, in fact represents a plurality of VGAM2134 host target genes. The mRNA of each one of this plurality of VGAM2134 host target genes comprises one or more host target binding sites, each having a nucleotide sequence which is at least partly complementary to VGAM2134 RNA, herein designated VGAM RNA, and which when bound by VGAM2134 RNA causes inhibition of translation of respective one or more VGAM2134 host target proteins.

It is further appreciated by one skilled in the art that the mode of translational inhibition illustrated by FIG. 1 with specific reference to translational inhibition exerted by VGAM2134 gene, herein designated VGAM GENE, on one or more VGAM2134 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2134 is inhibition of expression of host target genes, as part of a novel viral mechanism of attacking a host. Accordingly, utilities of VGAM2134 include diagnosis, prevention and treatment of viral infection by Ateline Herpesvirus 3. Specific functions, and accordingly utilities, of VGAM2134 correlate with, and may be deduced from, the identity of the host target genes which VGAM2134 binds and inhibits, and the function of these host target genes, as elaborated hereinbelow.

Nucleotide sequences of the VGAM2134 precursor RNA, herein designated VGAM PRECURSOR RNA, and of the 'diced' VGAM2134 RNA, herein designated VGAM RNA, and a schematic representation of the secondary folding of VGAM2134 folded precursor RNA, herein designated VGAM FOLDED PRECURSOR RNA, of VGAM2134 are further described hereinbelow with reference to Table 1.

Nucleotide sequences of host target binding sites, such as BINDING SITE-I, BINDING SITE-II and BINDING SITE-III of FIG. 1, found on VGAM2134 host target RNA, and schematic representation of the complementarity of each of these host target binding sites to VGAM2134 RNA, herein designated VGAM RNA, are described hereinbelow with reference to Table 2.

As mentioned hereinabove with reference to FIG. 1, a function of VGAM2134 gene, herein designated VGAM is inhibition of expression of VGAM2134 target genes. It is appreciated that specific functions, and accordingly utilities, of VGAM2134 correlate with, and may be deduced from, the identity of the target genes which VGAM2134 binds and inhibits, and the function of these target genes, as elaborated hereinbelow.

Catenin (cadherin-associated protein), Alpha 1, 102 kDa (CTNNA1, Accession XM_038221) is a VGAM2134 host target gene. CTNNA1 BINDING SITE is HOST TARGET binding site found in the 3' untranslated region of mRNA encoded by CTNNA1, corresponding to a HOST TARGET binding site such as BINDING SITE I, BINDING SITE II or BINDING SITE III. Table 2 illustrates the complementarity of the nucleotide sequences of CTNNA1 BINDING SITE, designated SEQ ID:32785, to the nucleotide sequence of VGAM2134 RNA, herein designated VGAM RNA, also designated SEQ ID:4845.

A function of VGAM2134 is therefore inhibition of Catenin (cadherin-associated protein), Alpha 1, 102 kDa (CTNNA1, Accession XM_038221), a gene which is a transmembrane glycoprotein responsible for physical connection of epithelial cells. Accordingly, utilities of VGAM2134 include diagnosis, prevention and treatment of diseases and clinical conditions associated with CTNNA1. The function of CTNNA1 has been established by previous studies. E-cadherin is a transmembrane glycoprotein responsible for physical connection of epithelial cells through Ca (2+)-binding regions in its extracellular domain. E-cadherin-mediated cell-cell adhesion is effected by 3 cytoplasmic proteins known as catenins alpha, beta (see OMIM Ref. No. 116806), and gamma. These catenins are thought to work as connectors that anchor the E-cadherin to the cytoskeletal actin bundle through the cadherin cytoplasmic domain. Dysfunction of this adhesion complex causes dissociation of cancer cells from primary tumor nodules, thus possibly contributing to cancer invasion and metastasis. Herrenknecht et al. (1991) and Nagafuchi et al. (1991) isolated a murine cDNA encoding the 102-kD alpha-catenin (OMIM Ref. No. CAP102). Oda et al. (1993) cloned and sequenced human alpha-catenin. They found that it shows extensive homology with that of the mouse. Hirano et al. (1992) and Shimoyama et al. (1992) showed that a human lung cancer cell line, PC9, which expresses E-cadherin but only a small quantity of abnormal-sized alpha-catenin, grew initially as isolated cells and then regained its cell-cell adhesion potential when transfected with alpha-catenin. Oda et al. (1993) found 2 abnormal mRNA sequences of alpha-catenin in PC9; one was a 957-bp deletion resulting in a 319-amino acid deletion and another was a 761-bp deletion resulting in a frameshift. The deletions were thought to be responsible for the loss of alpha-catenin expression. Vasioukhin et al. (2001) examined the consequences of alpha-catenin protein ablation in otherwise normal newborn mice. When surface epithelium alpha-catenin was ablated, hair follicle development was blocked and epidermal morphogenesis was dramatically affected, with defects in adherens junction formation, intercellular adhesion, and epithelial polarity. Differentiation occurred, but epidermis displayed hyperproliferation, suprabasal mitoses, and multinucleated cells. In vitro, alpha-catenin null keratinocytes were poorly contact inhibited and grew rapidly. These differences were not dependent upon intercellular adhesion and were in marked contrast to keratinocytes conditionally null for another essential intercellular adhesion protein, desmoplakin (DSP; 125647). Knockout keratinocytes exhibited sustained activation of the Ras-MAPK cascade due to aberrations in growth factor responses. The authors concluded that features of precancerous lesions often attributed to defects in cell cycle regulatory genes can be generated by compromising the function of alpha-catenin Full details of the abovementioned studies are described in the following publications, the disclosure of which are hereby incorporated by reference:

Oda, T.; Kanai, Y.; Shimoyama, Y.; Nagafuchi, A.; Tsukita, S.; Hirohashi, S.: Cloning of the human alpha-catenin cDNA and its aberrant mRNA in a human cancer cell line. Biochem. Biophys. Res. Commun. 193:897-904, 1993; and Vasioukhin, V.; Bauer, C.; Degenstein, L.; Wise, B.; Fuchs, E.: Hyperproliferation and defects in epithelial polarity upon conditional ablation of alpha-catenin in skin. Cell 104:605.

Further studies establishing the function and utilities of CTNNA1 are found in John Hopkins OMIM database record ID 116805, and in sited publications numbered 2025, 1072 and 11656-2033 listed in the bibliography section hereinbelow, which are also hereby incorporated by reference. Leucine-rich, Glioma Inactivated 1 (LGI1, Accession NM_005097) is another VGAM2134 host target gene. LGI1 BINDING SITE is HOST TARGET binding site found in the 5' untranslated region of mRNA encoded by LGI1, corresponding to a HOST TARGET binding site such as BINDING SITE I, BINDING SITE II or BINDING SITE III. Table 2 illustrates the complementarity of the nucleotide sequences of LGI1 BINDING SITE, designated SEQ ID:11564, to the nucleotide sequence of VGAM2134 RNA, herein designated VGAM RNA, also designated SEQ ID:4845.

Another function of VGAM2134 is therefore inhibition of Leucine-rich, Glioma Inactivated 1 (LGI1, Accession NM_005097). Accordingly, utilities of VGAM2134 include diagnosis, prevention and treatment of diseases and clinical conditions associated with LGI1. Regulator of G-protein Signalling 16 (RGS16, Accession NM_002928) is another VGAM2134 host target gene. RGS16 BINDING SITE is HOST TARGET binding site found in the 3' untranslated region of mRNA encoded by RGS16, corresponding to a HOST TARGET binding site such as BINDING SITE I, BINDING SITE II or BINDING SITE III. Table 2 illustrates the complementarity of the nucleotide sequences of RGS16 BINDING SITE, designated SEQ ID:8834, to the nucleotide sequence of VGAM2134 RNA, herein designated VGAM RNA, also designated SEQ ID:4845.

Another function of VGAM2134 is therefore inhibition of Regulator of G-protein Signalling 16 (RGS16, Accession NM_002928), a gene which inhibits signal transduction. Accordingly, utilities of VGAM2134 include diagnosis, prevention and treatment of diseases and clinical conditions associated with RGS16. The function of RGS16 and its association with various diseases and clinical conditions, has been established by previous studies, as described hereinabove with reference to VGAM1843. Formin Homology 2 Domain Containing 2 (FHOD2, Accession XM_057927) is another VGAM2134 host target gene. FHOD2 BINDING SITE is HOST TARGET binding site found in the 5' untranslated region of mRNA encoded by FHOD2, corresponding to a HOST TARGET binding site such as BINDING SITE I, BINDING SITE II or BINDING SITE III. Table 2 illustrates the complementarity of the nucleotide sequences of FHOD2 BINDING SITE, designated SEQ ID:36553, to the nucleotide sequence of VGAM2134 RNA, herein designated VGAM RNA, also designated SEQ ID:4845.

Another function of VGAM2134 is therefore inhibition of Formin Homology 2 Domain Containing 2 (FHOD2, Accession XM_057927). Accordingly, utilities of VGAM2134 include diagnosis, prevention and treatment of diseases and clinical conditions associated with FHOD2. FLJ12409 (Accession NM_025105) is another VGAM2134 host target gene. FLJ12409 BINDING SITE is HOST TARGET binding site found in the 3' untranslated region of mRNA encoded by FLJ12409, corresponding to a HOST TARGET binding site such as BINDING SITE I, BINDING SITE II or BINDING SITE III. Table 2 illustrates the complementarity of the nucleotide sequences of FLJ12409 BINDING SITE, designated SEQ ID:24754, to the nucleotide sequence of VGAM2134 RNA, herein designated VGAM RNA, also designated SEQ ID:4845.

Another function of VGAM2134 is therefore inhibition of FLJ12409 (Accession NM_025105). Accordingly, utilities of VGAM2134 include diagnosis, prevention and treatment of diseases and clinical conditions associated with FLJ12409. FLJ20445 (Accession NM_017824) is another VGAM2134 host target gene. FLJ20445 BINDING SITE is HOST TARGET binding site found in the 3' untranslated region of mRNA encoded by FLJ20445, corresponding to a HOST TARGET binding site such as BINDING SITE I, BINDING SITE II or BINDING SITE III. Table 2 illustrates the complementarity of the nucleotide sequences of FLJ20445 BINDING SITE, designated SEQ ID:19482, to the nucleotide sequence of VGAM2134 RNA, herein designated VGAM RNA, also designated SEQ ID:4845.

Another function of VGAM2134 is therefore inhibition of FLJ20445 (Accession NM_017824). Accordingly, utilities of VGAM2134 include diagnosis, prevention and treatment of diseases and clinical conditions associated with FLJ20445. FLJ20739 (Accession XM_042197) is another VGAM2134 host target gene. FLJ20739 BINDING SITE is HOST TARGET binding site found in the 5' untranslated region of mRNA encoded by FLJ20739, corresponding to a HOST TARGET binding site such as BINDING SITE I, BINDING SITE II or BINDING SITE III. Table 2 illustrates the complementarity of the nucleotide sequences of FLJ20739 BINDING SITE, designated SEQ ID:33705, to the nucleotide sequence of VGAM2134 RNA, herein designated VGAM RNA, also designated SEQ ID:4845.

Another function of VGAM2134 is therefore inhibition of FLJ20739 (Accession XM_042197). Accordingly, utilities of VGAM2134 include diagnosis, prevention and treatment of diseases and clinical conditions associated with FLJ20739. FLJ30567 (Accession NM_145022) is another VGAM2134 host target gene. FLJ30567 BINDING SITE is HOST TARGET binding site found in the 3' untranslated region of mRNA encoded by FLJ30567, corresponding to a HOST TARGET binding site such as BINDING SITE I, BINDING SITE II or BINDING SITE III. Table 2 illustrates the complementarity of the nucleotide sequences of FLJ30567 BINDING SITE, designated SEQ ID:29630, to the nucleotide sequence of VGAM2134 RNA, herein designated VGAM RNA, also designated SEQ ID:4845.

Another function of VGAM2134 is therefore inhibition of FLJ30567 (Accession NM_145022). Accordingly, utilities of VGAM2134 include diagnosis, prevention and treatment of diseases and clinical conditions associated with FLJ30567. KIAA0266 (Accession NM_021645) is another VGAM2134 host target gene. KIAA0266 BINDING SITE is HOST TARGET binding site found in the 3' untranslated region of mRNA encoded by KIAA0266, corresponding to a HOST TARGET binding site such as BINDING SITE I, BINDING SITE II or BINDING SITE III. Table 2 illustrates the complementarity of the nucleotide sequences of KIAA0266 BINDING SITE, designated SEQ ID:22311, to the nucleotide sequence of VGAM2134 RNA, herein designated VGAM RNA, also designated SEQ ID:4845.

Another function of VGAM2134 is therefore inhibition of KIAA0266 (Accession NM_021645). Accordingly, utilities of VGAM2134 include diagnosis, prevention and treatment of diseases and clinical conditions associated with KIAA0266. KIAA1336 (Accession XM_051306) is another VGAM2134 host target gene. KIAA1336 BINDING SITE is HOST TARGET binding site found in the 3' untranslated region of mRNA encoded by KIAA1336, corresponding to a HOST TARGET binding site such as BINDING SITE I, BINDING SITE II or BINDING SITE III. Table 2 illustrates the complementarity of the nucleotide sequences of KIAA1336 BINDING SITE, designated SEQ ID:35804, to the nucleotide sequence of VGAM2134 RNA, herein designated VGAM RNA, also designated SEQ ID:4845.

Another function of VGAM2134 is therefore inhibition of KIAA1336 (Accession XM_051306). Accordingly, utilities of VGAM2134 include diagnosis, prevention and treatment of diseases and clinical conditions associated with KIAA1336. SKIP (Accession NM_130766) is another VGAM2134 host target gene. SKIP BINDING SITE1 and SKIP BINDING SITE2 are HOST TARGET binding sites found in untranslated regions of mRNA encoded by SKIP, corresponding to HOST TARGET binding sites such as BINDING SITE I, BINDING SITE II or BINDING SITE III. Table 2 illustrates the complementarity of the nucleotide sequences of SKIP BINDING SITE1 and SKIP BINDING SITE2, designated SEQ ID:28265 and SEQ ID:18601 respectively, to the nucleotide sequence of VGAM2134 RNA, herein designated VGAM RNA, also designated SEQ ID:4845.

Another function of VGAM2134 is therefore inhibition of SKIP (Accession NM_130766). Accordingly, utilities of VGAM2134 include diagnosis, prevention and treatment of diseases and clinical conditions associated with SKIP. LOC144231 (Accession XM_096561) is another VGAM2134 host target gene. LOC144231 BINDING SITE is HOST TARGET binding site found in the 5' untranslated region of mRNA encoded by LOC144231, corresponding to a HOST TARGET binding site such as BINDING SITE I, BINDING SITE II or BINDING SITE III. Table 2 illustrates the complementarity of the nucleotide sequences of LOC144231 BINDING SITE, designated SEQ ID:40394, to the nucleotide sequence of VGAM2134 RNA, herein designated VGAM RNA, also designated SEQ ID:4845.

Another function of VGAM2134 is therefore inhibition of LOC144231 (Accession XM_096561). Accordingly, utilities of VGAM2134 include diagnosis, prevention and treatment of diseases and clinical conditions associated with LOC144231. LOC154215 (Accession XM_087875) is another VGAM2134 host target gene. LOC154215 BINDING SITE is HOST TARGET binding site found in the 3' untranslated region of mRNA encoded by LOC154215, corresponding to a HOST TARGET binding site such as BINDING SITE I, BINDING SITE II or BINDING SITE III. Table 2 illustrates the complementarity of the nucleotide sequences of LOC154215 BINDING SITE, designated SEQ ID:39464, to the nucleotide sequence of VGAM2134 RNA, herein designated VGAM RNA, also designated SEQ ID:4845.

Another function of VGAM2134 is therefore inhibition of LOC154215 (Accession XM_087875). Accordingly, utilities of VGAM2134 include diagnosis, prevention and treatment of diseases and clinical conditions associated with LOC154215. FIG. 1 further provides a conceptual description of a novel bioinformatically detected viral gene of the present invention, referred to here as Viral Genomic Address Messenger 2135 (VGAM2135) viral gene, which modulates expression of respective host target genes thereof, the function and utility of which host target genes is known in the art.

VGAM2135 is a novel bioinformatically detected regulatory, non protein coding, viral micro RNA (miRNA) gene. The method by which VGAM2135 was detected is described hereinabove with reference to FIGS. 1-8.

VGAM2135 gene, herein designated VGAM GENE, is a viral gene contained in the genome of Ateline Herpesvirus 3. VGAM2135 host target gene, herein designated VGAM HOST TARGET GENE, is a human gene contained in the human genome.

VGAM2135 gene encodes a VGAM2135 precursor RNA, herein designated VGAM PRECURSOR RNA. Similar to other miRNA genes, and unlike most ordinary genes, VGAM2135 precursor RNA does not encode a protein. A nucleotide sequence identical or highly similar to the nucleotide sequence of VGAM2135 precursor RNA is designated SEQ ID:2121, and is provided hereinbelow with reference to the sequence listing part. Nucleotide sequence SEQ ID:2121 is located at position 17990 relative to the genome of Ateline Herpesvirus 3.

VGAM2135 precursor RNA folds onto itself, forming VGAM2135 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2135 folded precursor RNA into VGAM2135 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2135 RNA is designated SEQ ID:4846, and is provided hereinbelow with reference to the sequence listing part.

VGAM2135 host target gene, herein designated VGAM HOST TARGET GENE, encodes a corresponding messenger RNA, VGAM2135 host target RNA, herein designated VGAM HOST TARGET RNA. VGAM2135 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2135 RNA, herein designated VGAM RNA, binds complementarily to one or more host target binding sites located in untranslated regions of VGAM2135 host target RNA, herein designated VGAM HOST TARGET RNA. This complementary binding is due to the fact that the nucleotide sequence of VGAM2135 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2135 RNA, herein designated VGAM RNA, may have a different number of host target binding sites in untranslated regions of a VGAM2135 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2135 RNA, herein designated VGAM RNA, to host target binding sites on VGAM2135 host target RNA, herein designated VGAM HOST TARGET RNA, such as BINDING SITE I, BINDING SITE II and BINDING SITE III, inhibits translation of VGAM2135 host target RNA into VGAM2135 host target protein, herein designated VGAM HOST TARGET PROTEIN. VGAM host target protein is therefore outlined by a broken line.

It is appreciated that VGAM2135 host target gene, herein designated VGAM HOST TARGET GENE, in fact represents a plurality of VGAM2135 host target genes. The mRNA of each one of this plurality of VGAM2135 host target genes comprises one or more host target binding sites, each having a nucleotide sequence which is at least partly complementary to VGAM2135 RNA, herein designated VGAM RNA, and which when bound by VGAM2135 RNA causes inhibition of translation of respective one or more VGAM2135 host target proteins.

It is further appreciated by one skilled in the art that the mode of translational inhibition illustrated by FIG. 1 with specific reference to translational inhibition exerted by VGAM2135 gene, herein designated VGAM GENE, on one or more VGAM2135 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2135 is inhibition of expression of host target genes, as part of a novel viral mechanism of attacking a host. Accordingly, utilities of VGAM2135 include diagnosis, prevention and treatment of viral infection by Ateline Herpesvirus 3. Specific functions, and accordingly utilities, of VGAM2135 correlate with, and may be deduced from, the identity of the host target genes which VGAM2135 binds and inhibits, and the function of these host target genes, as elaborated hereinbelow.

Nucleotide sequences of the VGAM2135 precursor RNA, herein designated VGAM PRECURSOR RNA, and of the 'diced' VGAM2135 RNA, herein designated VGAM RNA, and a schematic representation of the secondary folding of VGAM2135 folded precursor RNA, herein designated VGAM FOLDED PRECURSOR RNA, of VGAM2135 are further described hereinbelow with reference to Table 1.

Nucleotide sequences of host target binding sites, such as BINDING SITE-I, BINDING SITE-II and BINDING SITE-III of FIG. 1, found on VGAM2135 host target RNA, and schematic representation of the complementarity of each of these host target binding sites to VGAM2135 RNA, herein designated VGAM RNA, are described hereinbelow with reference to Table 2.

As mentioned hereinabove with reference to FIG. 1, a function of VGAM2135 gene, herein designated VGAM is inhibition of expression of VGAM2135 target genes. It is appreciated that specific functions, and accordingly utilities, of VGAM2135 correlate with, and may be deduced from, the identity of the target genes which VGAM2135 binds and inhibits, and the function of these target genes, as elaborated hereinbelow.

Brain-specific Angiogenesis Inhibitor 3 (BAI3, Accession NM_001704) is a VGAM2135 host target gene. BAI3 BINDING SITE is HOST TARGET binding site found in the 3' untranslated region of mRNA encoded by BAI3, corresponding to a HOST TARGET binding site such as BINDING SITE I, BINDING SITE II or BINDING SITE III. Table 2 illustrates the complementarity of the nucleotide sequences of BAI3 BINDING SITE, designated SEQ ID:7427, to the nucleotide sequence of VGAM2135 RNA, herein designated VGAM RNA, also designated SEQ ID:4846.

A function of VGAM2135 is therefore inhibition of Brain-specific Angiogenesis Inhibitor 3 (BAI3, Accession NM_001704). Accordingly, utilities of VGAM2135 include diagnosis, prevention and treatment of diseases and clinical conditions associated with BAI3. KIAA0210 (Accession NM_014744) is another VGAM2135 host target gene. KIAA0210 BINDING SITE is HOST TARGET binding site found in the 3' untranslated region of mRNA encoded by KIAA0210, corresponding to a HOST TARGET binding site such as BINDING SITE I, BINDING SITE II or BINDING SITE III. Table 2 illustrates the complementarity of the nucleotide sequences of KIAA0210 BINDING SITE, designated SEQ ID:16424, to the nucleotide sequence of VGAM2135 RNA, herein designated VGAM RNA, also designated SEQ ID:4846.

Another function of VGAM2135 is therefore inhibition of KIAA0210 (Accession NM_014744). Accordingly, utilities of VGAM2135 include diagnosis, prevention and treatment of diseases and clinical conditions associated with KIAA0210. KIAA1204 (Accession XM_045011) is another VGAM2135 host target gene. KIAA1204 BINDING SITE is HOST TARGET binding site found in the 3' untranslated region of mRNA encoded by KIAA1204, corresponding to a HOST TARGET binding site such as BINDING SITE I, BINDING SITE II or BINDING SITE III. Table 2 illustrates the complementarity of the nucleotide sequences of KIAA1204 BINDING SITE, designated SEQ ID:34311, to the nucleotide sequence of VGAM2135 RNA, herein designated VGAM RNA, also designated SEQ ID:4846.

Another function of VGAM2135 is therefore inhibition of KIAA1204 (Accession XM_045011). Accordingly, utilities of VGAM2135 include diagnosis, prevention and treatment of diseases and clinical conditions associated with KIAA1204. LOC219988 (Accession XM_166223) is another VGAM2135 host target gene. LOC219988 BINDING SITE is HOST TARGET binding site found in the 5' untranslated region of mRNA encoded by LOC219988, corresponding to a HOST TARGET binding site such as BINDING SITE I, BINDING SITE II or BINDING SITE III. Table 2 illustrates the complementarity of the nucleotide sequences of LOC219988 BINDING SITE, designated SEQ ID:44045, to the nucleotide sequence of VGAM2135 RNA, herein designated VGAM RNA, also designated SEQ ID:4846.

Another function of VGAM2135 is therefore inhibition of LOC219988 (Accession XM_166223). Accordingly, utilities of VGAM2135 include diagnosis, prevention and treatment of diseases and clinical conditions associated with LOC219988. FIG. 1 further provides a conceptual description of a novel bioinformatically detected viral gene of the present invention, referred to here as Viral Genomic Address Messenger 2136 (VGAM2136) viral gene, which modulates expression of respective host target genes thereof, the function and utility of which host target genes is known in the art.

VGAM2136 is a novel bioinformatically detected regulatory, non protein coding, viral micro RNA (miRNA) gene. The method by which VGAM2136 was detected is described hereinabove with reference to FIGS. 1-8.

VGAM2136 gene, herein designated VGAM GENE, is a viral gene contained in the genome of Ectromelia Virus. VGAM2136 host target gene, herein designated VGAM HOST TARGET GENE, is a human gene contained in the human genome.

VGAM2136 gene encodes a VGAM2136 precursor RNA, herein designated VGAM PRECURSOR RNA. Similar to other miRNA genes, and unlike most ordinary genes, VGAM2136 precursor RNA does not encode a protein. A nucleotide sequence identical or highly similar to the nucleotide sequence of VGAM2136 precursor RNA is designated SEQ ID:2122, and is provided hereinbelow with reference to the sequence listing part. Nucleotide sequence SEQ ID:2122 is located at position 176642 relative to the genome of Ectromelia Virus.

VGAM2136 precursor RNA folds onto itself, forming VGAM2136 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2136 folded precursor RNA into VGAM2136 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 92%) nucleotide sequence of VGAM2136 RNA is designated SEQ ID:4847, and is provided hereinbelow with reference to the sequence listing part.

VGAM2136 host target gene, herein designated VGAM HOST TARGET GENE, encodes a corresponding messenger RNA, VGAM2136 host target RNA, herein designated VGAM HOST TARGET RNA. VGAM2136 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2136 RNA, herein designated VGAM RNA, binds complementarily to one or more host target binding sites located in untranslated regions of VGAM2136 host target RNA, herein designated VGAM HOST TARGET RNA. This complementary binding is due to the fact that the nucleotide sequence of VGAM2136 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2136 RNA, herein designated VGAM RNA, may have a different number of host target binding sites in untranslated regions of a VGAM2136 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2136 RNA, herein designated VGAM RNA, to host target binding sites on VGAM2136 host target RNA, herein designated VGAM HOST TARGET RNA, such as BINDING SITE I, BINDING SITE II and BINDING SITE III, inhibits translation of VGAM2136 host target RNA into VGAM2136 host target protein, herein designated VGAM HOST TARGET PROTEIN. VGAM host target protein is therefore outlined by a broken line.

It is appreciated that VGAM2136 host target gene, herein designated VGAM HOST TARGET GENE, in fact represents a plurality of VGAM2136 host target genes. The mRNA of each one of this plurality of VGAM2136 host target genes comprises one or more host target binding sites, each having a nucleotide sequence which is at least partly complementary to VGAM2136 RNA, herein designated VGAM RNA, and which when bound by VGAM2136 RNA causes inhibition of translation of respective one or more VGAM2136 host target proteins.

It is further appreciated by one skilled in the art that the mode of translational inhibition illustrated by FIG. 1 with specific reference to translational inhibition exerted by VGAM2136 gene, herein designated VGAM GENE, on one or more VGAM2136 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2136 is inhibition of expression of host target genes, as part of a novel viral mechanism of attacking a host. Accordingly, utilities of VGAM2136 include diagnosis, prevention and treatment of viral infection by Ectromelia Virus. Specific functions, and accordingly utilities, of VGAM2136 correlate with, and may be deduced from, the identity of the host target genes which VGAM2136 binds and inhibits, and the function of these host target genes, as elaborated hereinbelow.

Nucleotide sequences of the VGAM2136 precursor RNA, herein designated VGAM PRECURSOR RNA, and of the 'diced' VGAM2136 RNA, herein designated VGAM RNA, and a schematic representation of the secondary folding of VGAM2136 folded precursor RNA, herein designated VGAM FOLDED PRECURSOR RNA, of VGAM2136 are further described hereinbelow with reference to Table 1.

Nucleotide sequences of host target binding sites, such as BINDING SITE-I, BINDING SITE-II and BINDING SITE-III of FIG. 1, found on VGAM2136 host target RNA, and schematic representation of the complementarity of each of these host target binding sites to VGAM2136 RNA, herein designated VGAM RNA, are described hereinbelow with reference to Table 2.

As mentioned hereinabove with reference to FIG. 1, a function of VGAM2136 gene, herein designated VGAM is inhibition of expression of VGAM2136 target genes. It is appreciated that specific functions, and accordingly utilities, of VGAM2136 correlate with, and may be deduced from, the identity of the target genes which VGAM2136 binds and inhibits, and the function of these target genes, as elaborated hereinbelow.

ADP-ribosyltransferase (NAD+; poly (ADP-ribose) Polymerase) (ADPRT, Accession NM_001618) is a VGAM2136 host target gene. ADPRT BINDING SITE is HOST TARGET binding site found in the 3' untranslated region of mRNA encoded by ADPRT, corresponding to a HOST TARGET binding site such as BINDING SITE I, BINDING SITE II or BINDING SITE III. Table 2 illustrates the complementarity of the nucleotide sequences of ADPRT BINDING SITE, designated SEQ ID:7327, to the nucleotide sequence of VGAM2136 RNA, herein designated VGAM RNA, also designated SEQ ID:4847.

A function of VGAM2136 is therefore inhibition of ADP-ribosyltransferase (NAD+; poly (ADP-ribose) Polymerase) (ADPRT, Accession NM_001618), a gene which catalyzes addition of mono-ADP-ribose to arginine residues of proteins, inhibits Pol II transcription. Accordingly, utilities of VGAM2136 include diagnosis, prevention and treatment of diseases and clinical conditions associated with ADPRT. The function of ADPRT and its association with various diseases and clinical conditions, has been established by previous studies, as described hereinabove with reference to VGAM506. Cadherin 19, Type 2 (CDH19, Accession NM_021153) is another VGAM2136 host target gene. CDH19 BINDING SITE is HOST TARGET binding site found in the 3' untranslated region of mRNA encoded by CDH19, corresponding to a HOST TARGET binding site such as BINDING SITE I, BINDING SITE II or BINDING SITE III. Table 2 illustrates the complementarity of the nucleotide sequences of CDH19 BINDING SITE, designated SEQ ID:22127, to the nucleotide sequence of VGAM2136 RNA, herein designated VGAM RNA, also designated SEQ ID:4847.

Another function of VGAM2136 is therefore inhibition of Cadherin 19, Type 2 (CDH19, Accession NM_021153), a gene which is a calcium dependent cell adhesion protein. Accordingly, utilities of VGAM2136 include diagnosis, prevention and treatment of diseases and clinical conditions associated with CDH19. The function of CDH19 has been established by previous studies. In EST database searches for cadherin sequences, Kools et al. (2000) identified a partial CDH19 cDNA, which they called CDH7L2. CDH19 encodes a 772-amino acid protein predicted to contain 5 EC (extracellular calcium-binding) repeats, a transmembrane domain, and a cytoplasmic tail. Kools et al. (2000) classified CDH19 as an atypical (type II) cadherin due to the lack of the HAV cell adhesion recognition sequence specific for classic cadherins. CDH19 was previously identified and named CDH7 by Kremmidiotis et al. (1998); however, phylogenetic analysis carried out by Kools et al. (2000) led to nomenclature corrections within the cadherin gene family. CDH19 shares significant homology with chicken Cdh7, but Kools et al. (2000) identified the newly designated CDH7 gene (OMIM Ref. No. 605806) as the likely human ortholog of chicken Cdh7. Using RT-PCR analysis, Kools et al. (2000) detected CDH19 expression in all tissues tested, with the exception of uterus. By somatic cell hybrid analysis and fluorescence in situ hybridization, Kremmidiotis et al. (1998) mapped the human CDH19 gene to chromosome 18q22-q23. Using the same methods, Kools et al. (2000) mapped the CDH19 gene to the same location in a cluster with CDH7 (OMIM Ref. No. 605806) and CDH20 (OMIM Ref. No. 605807).

Full details of the abovementioned studies are described in the following publications, the disclosure of which are hereby incorporated by reference:

Kools, P.; Van Imschoot, G.; van Roy, F.: Characterization of three novel human cadherin genes (CDH7, CDH19, and CDH20) clustered on chromosome 18q22-q23 and with high homology to chicken cadherin-7. Genomics 68:283-295, 2000; and Kremmidiotis, G.; Baker, E.; Crawford, J.; Eyre, H. J.; Nahmias, J.; Callen, D. F.: Localization of human cadherin genes to chromosome regions exhibiting cancer-related loss of hetero.

Further studies establishing the function and utilities of CDH19 are found in John Hopkins OMIM database record ID 603016, and in sited publications numbered 801 and 11646 listed in the bibliography section hereinbelow, which are also hereby incorporated by reference. Cytochrome B-245, Beta Polypeptide (chronic granulomatous disease) (CYBB, Accession XM_084288) is another VGAM2136 host target gene. CYBB BINDING SITE is HOST TARGET binding site found in the 3' untranslated region of mRNA encoded by CYBB, corresponding to a HOST TARGET binding site such as BINDING SITE I, BINDING SITE II or BINDING SITE III. Table 2 illustrates the complementarity of the nucleotide sequences of CYBB BINDING SITE, designated SEQ ID:37537, to the nucleotide sequence of VGAM2136 RNA, herein designated VGAM RNA, also designated SEQ ID:4847.

Another function of VGAM2136 is therefore inhibition of Cytochrome B-245, Beta Polypeptide (chronic granulomatous disease) (CYBB, Accession XM_084288). Accordingly, utilities of VGAM2136 include diagnosis, prevention and treatment of diseases and clinical conditions associated with CYBB. Damage-specific DNA Binding Protein 1, 127 kDa (DDB1, Accession NM_001923) is another VGAM2136 host target gene. DDB1 BINDING SITE is HOST TARGET binding site found in the 3' untranslated region of mRNA encoded by DDB1, corresponding to a HOST TARGET binding site such as BINDING SITE I, BINDING SITE II or BINDING SITE III. Table 2 illustrates the complementarity of the nucleotide sequences of DDB1 BINDING SITE, designated SEQ ID:7640, to the nucleotide sequence of VGAM2136 RNA, herein designated VGAM RNA, also designated SEQ ID:4847.

Another function of VGAM2136 is therefore inhibition of Damage-specific DNA Binding Protein 1, 127 kDa (DDB1, Accession NM_001923). Accordingly, utilities of VGAM2136 include diagnosis, prevention and treatment of diseases and clinical conditions associated with DDB1. Glucose-6-phosphatase, Catalytic (glycogen storage disease type I, von Gierke disease) (G6PC, Accession NM_000151) is another VGAM2136 host target gene. G6PC BINDING SITE is HOST TARGET binding site found in the 3' untranslated region of mRNA encoded by G6PC, corresponding to a HOST TARGET binding site such as BINDING SITE I, BINDING SITE II or BINDING SITE III. Table 2 illustrates the complementarity of the nucleotide sequences of G6PC BINDING SITE, designated SEQ ID:5657, to the nucleotide sequence of VGAM2136 RNA, herein designated VGAM RNA, also designated SEQ ID:4847.

Another function of VGAM2136 is therefore inhibition of Glucose-6-phosphatase, Catalytic (glycogen storage disease type I, von Gierke disease) (G6PC, Accession NM_000151). Accordingly, utilities of VGAM2136 include diagnosis, prevention and treatment of diseases and clinical conditions associated with G6PC. Lysozyme (renal amyloidosis) (LYZ, Accession NM_000239) is another VGAM2136 host target gene. LYZ BINDING SITE is HOST TARGET binding site found in the 3' untranslated region of mRNA encoded by LYZ, corresponding to a HOST TARGET binding site such as BINDING SITE I, BINDING SITE II or BINDING SITE III. Table 2 illustrates the complementarity of the nucleotide sequences of LYZ BINDING SITE, designated SEQ ID:5758, to the nucleotide sequence of VGAM2136 RNA, herein designated VGAM RNA, also designated SEQ ID:4847.

Another function of VGAM2136 is therefore inhibition of Lysozyme (renal amyloidosis) (LYZ, Accession NM_000239), a gene which a bacteriolytic enzyme. Accordingly, utilities of VGAM2136 include diagnosis, prevention and treatment of diseases and clinical conditions associated with LYZ. The function of LYZ and its association with various diseases and clinical conditions, has been established by previous studies, as described hereinabove with reference to VGAM929. Mannosidase, Alpha, Class 2A, Member 1 (MAN2A1, Accession NM_002372) is another VGAM2136 host target gene. MAN2A1 BINDING SITE is HOST TARGET binding site found in the 5' untranslated region of mRNA encoded by MAN2A1, corresponding to a HOST TARGET binding site such as BINDING SITE I, BINDING SITE II or BINDING SITE III. Table 2 illustrates the complementarity of the nucleotide sequences of MAN2A1 BINDING SITE, designated SEQ ID:8177, to the nucleotide sequence of VGAM2136 RNA, herein designated VGAM RNA, also designated SEQ ID:4847.

Another function of VGAM2136 is therefore inhibition of Mannosidase, Alpha, Class 2A, Member 1 (MAN2A1, Accession NM_002372), a gene which catalyzes the final hydrolytic step in the asparagine-linked oligosaccharide (N-glycan) maturation pathway. Accordingly, utilities of VGAM2136 include diagnosis, prevention and treatment of diseases and clinical conditions associated with MAN2A1. The function of MAN2A1 and its association with various diseases and clinical conditions, has been established by previous studies, as described hereinabove with reference to VGAM1410. Mel Transforming Oncogene (derived from cell line NK14)- RAB8 Homolog (MEL, Accession NM_005370) is another VGAM2136 host target gene. MEL BINDING SITE is HOST TARGET binding site found in the 3' untranslated region of mRNA encoded by MEL, corresponding to a HOST TARGET binding site such as BINDING SITE I, BINDING SITE II or BINDING SITE III. Table 2 illustrates the complementarity of the nucleotide sequences of MEL BINDING SITE, designated SEQ ID:11843, to the nucleotide sequence of VGAM2136 RNA, herein designated VGAM RNA, also designated SEQ ID:4847.

Another function of VGAM2136 is therefore inhibition of Mel Transforming Oncogene (derived from cell line NK14)- RAB8 Homolog (MEL, Accession NM_005370), a gene which may be involved in vesicular trafficking and neurotransmitter release. Accordingly, utilities of VGAM2136 include diagnosis, prevention and treatment of diseases and clinical conditions associated with MEL. The function of MEL and its association with various diseases and clinical conditions, has been established by previous studies, as described hereinabove with reference to VGAM40. Oxidation Resistance 1 (OXR1, Accession NM_018002) is another VGAM2136 host target gene. OXR1 BINDING SITE is HOST TARGET binding site found in the 3' untranslated region of mRNA encoded by OXR1, corresponding to a HOST TARGET binding site such as BINDING SITE I, BINDING SITE II or BINDING SITE III. Table 2 illustrates the complementarity of the nucleotide sequences of OXR1 BINDING SITE, designated SEQ ID:19733, to the nucleotide sequence of VGAM2136 RNA, herein designated VGAM RNA, also designated SEQ ID:4847.

Another function of VGAM2136 is therefore inhibition of Oxidation Resistance 1 (OXR1, Accession NM_018002). Accordingly, utilities of VGAM2136 include diagnosis, prevention and treatment of diseases and clinical conditions associated with OXR1. Phosphoinositide-3-kinase, Regulatory Subunit, Polypeptide 3 (p55, gamma) (PIK3R3, Accession XM_027982) is another VGAM2136 host target gene. PIK3R3 BINDING SITE is HOST TARGET binding site found in the 3' untranslated region of mRNA encoded by PIK3R3, corresponding to a HOST TARGET binding site such as BINDING SITE I, BINDING SITE II or BINDING SITE III. Table 2 illustrates the complementarity of the nucleotide sequences of PIK3R3 BINDING SITE, designated SEQ ID:30608, to the nucleotide sequence of VGAM2136 RNA, herein designated VGAM RNA, also designated SEQ ID:4847.

Another function of VGAM2136 is therefore inhibition of Phosphoinositide-3-kinase, Regulatory Subunit, Polypeptide 3 (p55, gamma) (PIK3R3, Accession XM_027982). Accordingly, utilities of VGAM2136 include diagnosis, prevention and treatment of diseases and clinical conditions associated with PIK3R3. Proteasome (prosome, macropain) Activator Subunit 3 (PA28 gamma; Ki) (PSME3, Accession NM_005789) is another VGAM2136 host target gene. PSME3 BINDING SITE is HOST TARGET binding site found in the 3' untranslated region of mRNA encoded by PSME3, corresponding to a HOST TARGET binding site such as BINDING SITE I, BINDING SITE II or BINDING SITE III. Table 2 illustrates the complementarity of the nucleotide sequences of PSME3 BINDING SITE, designated SEQ ID:12372, to the nucleotide sequence of VGAM2136 RNA, herein designated VGAM RNA, also designated SEQ ID:4847.

Another function of VGAM2136 is therefore inhibition of Proteasome (prosome, macropain) Activator Subunit 3 (PA28 gamma; Ki) (PSME3, Accession NM_005789), a gene which is the activator subunit of the proteasome (prosome macropain). Accordingly, utilities of VGAM2136 include diagnosis, prevention and treatment of diseases and clinical conditions associated with PSME3. The function of PSME3 and its association with various diseases and clinical conditions, has been established by previous studies, as described hereinabove with reference to VGAM1498. RNA Binding Motif Protein 8A (RBM8A, Accession NM_005105) is another VGAM2136 host target gene. RBM8A BINDING SITE is HOST TARGET binding site found in the 3' untranslated region of mRNA encoded by RBM8A, corresponding to a HOST TARGET binding site such as BINDING SITE I, BINDING SITE II or BINDING SITE III. Table 2 illustrates the complementarity of the nucleotide sequences of RBM8A BINDING SITE, designated SEQ ID:11579, to the nucleotide sequence of VGAM2136 RNA, herein designated VGAM RNA, also designated SEQ ID:4847.

Another function of VGAM2136 is therefore inhibition of RNA Binding Motif Protein 8A (RBM8A, Accession NM_005105), a gene which involves in the pathway of gene expression postsplicing nuclear preexport mRNPs, and newly exported cytoplasmic mRNPs. Accordingly, utilities of VGAM2136 include diagnosis, prevention and treatment of diseases and clinical conditions associated with RBM8A. The function of RBM8A and its association with various diseases and clinical conditions, has been established by previous studies, as described hereinabove with reference to VGAM1864. SET Binding Factor 1 (SBF1, Accession XM_037447) is another VGAM2136 host target gene. SBF1 BINDING SITE is HOST TARGET binding site found in the 5' untranslated region of mRNA encoded by SBF1, corresponding to a HOST TARGET binding site such as BINDING SITE I, BINDING SITE II or BINDING SITE III. Table 2 illustrates the complementarity of the nucleotide sequences of SBF1 BINDING SITE, designated SEQ ID:32626, to the nucleotide sequence of VGAM2136 RNA, herein designated VGAM RNA, also designated SEQ ID:4847.

Another function of VGAM2136 is therefore inhibition of SET Binding Factor 1 (SBF1, Accession XM_037447), a gene which is of unknown function, could be a tyrosine-phosphatase. Accordingly, utilities of VGAM2136 include diagnosis, prevention and treatment of diseases and clinical conditions associated with SBF1. The function of SBF1 and its association with various diseases and clinical conditions, has been established by previous studies, as described hereinabove with reference to VGAM1452. Serine (or cysteine) Proteinase Inhibitor, Clade B (ovalbumin), Member 9 (SERPINB9, Accession NM_004155) is another VGAM2136 host target gene. SERPINB9 BINDING SITE is HOST TARGET binding site found in the 3' untranslated region of mRNA encoded by SERPINB9, corresponding to a HOST TARGET binding site such as BINDING SITE I, BINDING SITE II or BINDING SITE III. Table 2 illustrates the complementarity of the nucleotide sequences of SERPINB9 BINDING SITE, designated SEQ ID:10359, to the nucleotide sequence of VGAM2136 RNA, herein designated VGAM RNA, also designated SEQ ID:4847.

Another function of VGAM2136 is therefore inhibition of Serine (or cysteine) Proteinase Inhibitor, Clade B (ovalbumin), Member 9 (SERPINB9, Accession NM_004155), a gene which may be a serpin serine protease inhibitor that interacts with granzyme B (GZMB). Accordingly, utilities of VGAM2136 include diagnosis, prevention and treatment of diseases and clinical conditions associated with SERPINB9. The function of SERPINB9 and its association with various diseases and clinical conditions, has been established by previous studies, as described hereinabove with reference to VGAM60. TIRAP (Accession NM_052887) is another VGAM2136 host target gene. TIRAP BINDING SITE is HOST TARGET binding site found in the 3' untranslated region of mRNA encoded by TIRAP, corresponding to a HOST TARGET binding site such as BINDING SITE I, BINDING SITE II or BINDING SITE III. Table 2 illustrates the complementarity of the nucleotide sequences of TIRAP BINDING SITE, designated SEQ ID:27478, to the nucleotide sequence of VGAM2136 RNA, herein designated VGAM RNA, also designated SEQ ID:4847.

Another function of VGAM2136 is therefore inhibition of TIRAP (Accession NM_052887), a gene which is a adapter involved in theTLR4 signaling pathway in the innate immune response. Accordingly, utilities of VGAM2136 include diagnosis, prevention and treatment of diseases and clinical conditions associated with TIRAP. The function of TIRAP and its association with various diseases and clinical conditions, has been established by previous studies, as described hereinabove with reference to VGAM189. Thymidine Kinase 1, Soluble (TK1, Accession NM_003258) is another VGAM2136 host target gene. TK1 BINDING SITE is HOST TARGET binding site found in the 3' untranslated region of mRNA encoded by TK1, corresponding to a HOST TARGET binding site such as BINDING SITE I, BINDING SITE II or BINDING SITE III. Table 2 illustrates the complementarity of the nucleotide sequences of TK1 BINDING SITE, designated SEQ ID:9271, to the nucleotide sequence of VGAM2136 RNA, herein designated VGAM RNA, also designated SEQ ID:4847.

Another function of VGAM2136 is therefore inhibition of Thymidine Kinase 1, Soluble (TK1, Accession NM_003258). Accordingly, utilities of VGAM2136 include diagnosis, prevention and treatment of diseases and clinical conditions associated with TK1. Transient Receptor Potential Cation Channel, Subfamily V, Member 1 (TRPV1, Accession NM_080704) is another VGAM2136 host target gene. TRPV1 BINDING SITE1 through TRPV1 BINDING SITE4 are HOST TARGET binding sites found in untranslated regions of mRNA encoded by TRPV1, corresponding to HOST TARGET binding sites such as BINDING SITE I, BINDING SITE II or BINDING SITE III. Table 2 illustrates the complementarity of the nucleotide sequences of TRPV1 BINDING SITE1 through TRPV1 BINDING SITE4, designated SEQ ID:27992, SEQ ID:28000, SEQ ID:28008 and SEQ ID:20812 respectively, to the nucleotide sequence of VGAM2136 RNA, herein designated VGAM RNA, also designated SEQ ID:4847.

Another function of VGAM2136 is therefore inhibition of Transient Receptor Potential Cation Channel, Subfamily V, Member 1 (TRPV1, Accession NM_080704), a gene which functions as a receptor for capsaicin. Accordingly, utilities of VGAM2136 include diagnosis, prevention and treatment of diseases and clinical conditions associated with TRPV1. The function of TRPV1 and its association with various diseases and clinical conditions, has been established by previous studies, as described hereinabove with reference to VGAM146. Chromosome 1 Open Reading Frame 19 (C1orf19, Accession XM_042962) is another VGAM2136 host target gene. C1orf19 BINDING SITE is HOST TARGET binding site found in the 3' untranslated region of mRNA encoded by C1orf19, corresponding to a HOST TARGET binding site such as BINDING SITE I, BINDING SITE II or BINDING SITE III. Table 2 illustrates the complementarity of the nucleotide sequences of C1orf19 BINDING SITE, designated SEQ ID:33839, to the nucleotide sequence of VGAM2136 RNA, herein designated VGAM RNA, also designated SEQ ID:4847.

Another function of VGAM2136 is therefore inhibition of Chromosome 1 Open Reading Frame 19 (C1orf19, Accession XM_042962). Accordingly, utilities of VGAM2136 include diagnosis, prevention and treatment of diseases and clinical conditions associated with C1orf19. CCR4-NOT Transcription Complex, Subunit 7 (CNOT7, Accession NM_013354) is another VGAM2136 host target gene. CNOT7 BINDING SITE is HOST TARGET binding site found in the 3' untranslated region of mRNA encoded by CNOT7, corresponding to a HOST TARGET binding site such as BINDING SITE I, BINDING SITE II or BINDING SITE III. Table 2 illustrates the complementarity of the nucleotide sequences of CNOT7 BINDING SITE, designated SEQ ID:15003, to the nucleotide sequence of VGAM2136 RNA, herein designated VGAM RNA, also designated SEQ ID:4847.

Another function of VGAM2136 is therefore inhibition of CCR4-NOT Transcription Complex, Subunit 7 (CNOT7, Accession NM_013354). Accordingly, utilities of VGAM2136 include diagnosis, prevention and treatment of diseases and clinical conditions associated with CNOT7. COP9 Constitutive Photomorphogenic Homolog Subunit 7A (Arabidopsis) (COPS7A, Accession NM_016319) is another VGAM2136 host target gene. COPS7A BINDING SITE is HOST TARGET binding site found in the 3' untranslated region of mRNA encoded by COPS7A, corresponding to a HOST TARGET binding site such as BINDING SITE I, BINDING SITE II or BINDING SITE III. Table 2 illustrates the complementarity of the nucleotide sequences of COPS7A BINDING SITE, designated SEQ ID:18436, to the nucleotide sequence of VGAM2136 RNA, herein designated VGAM RNA, also designated SEQ ID:4847.

Another function of VGAM2136 is therefore inhibition of COP9 Constitutive Photomorphogenic Homolog Subunit 7A (Arabidopsis) (COPS7A, Accession NM_016319). Accordingly, utilities of VGAM2136 include diagnosis, prevention and treatment of diseases and clinical conditions associated with COPS7A. DKFZp547I014 (Accession NM_020217) is another VGAM2136 host target gene. DKFZp547I014 BINDING SITE is HOST TARGET binding site found in the 5' untranslated region of mRNA encoded by DKFZp547I014, corresponding to a HOST TARGET binding site such as BINDING SITE I, BINDING SITE II or BINDING SITE III. Table 2 illustrates the complementarity of the nucleotide sequences of DKFZp547I014 BINDING SITE, designated SEQ ID:21466, to the nucleotide sequence of VGAM2136 RNA, herein designated VGAM RNA, also designated SEQ ID:4847.

Another function of VGAM2136 is therefore inhibition of DKFZp547I014 (Accession NM_020217). Accordingly, utilities of VGAM2136 include diagnosis, prevention and treatment of diseases and clinical conditions associated with DKFZp547I014. DKFZP586D2223 (Accession NM_018561) is another VGAM2136 host target gene. DKFZP586D2223 BINDING SITE is HOST TARGET binding site found in the 3' untranslated region of mRNA encoded by DKFZP586D2223, corresponding to a HOST TARGET binding site such as BINDING SITE I, BINDING SITE II or BINDING SITE III. Table 2 illustrates the complementarity of the nucleotide sequences of DKFZP586D2223 BINDING SITE, designated SEQ ID:20644, to the nucleotide sequence of VGAM2136 RNA, herein designated VGAM RNA, also designated SEQ ID:4847.

Another function of VGAM2136 is therefore inhibition of DKFZP586D2223 (Accession NM_018561). Accordingly, utilities of VGAM2136 include diagnosis, prevention and treatment of diseases and clinical conditions associated with DKFZP586D2223. DKFZP727C091 (Accession XM_038689) is another VGAM2136 host target gene. DKFZP727C091 BINDING SITE is HOST TARGET binding site found in the 3' untranslated region of mRNA encoded by DKFZP727C091, corresponding to a HOST TARGET binding site such as BINDING SITE I, BINDING SITE II or BINDING SITE III. Table 2 illustrates the complementarity of the nucleotide sequences of DKFZP727C091 BINDING SITE, designated SEQ ID:32907, to the nucleotide sequence of VGAM2136 RNA, herein designated VGAM RNA, also designated SEQ ID:4847.

Another function of VGAM2136 is therefore inhibition of DKFZP727C091 (Accession XM_038689). Accordingly, utilities of VGAM2136 include diagnosis, prevention and treatment of diseases and clinical conditions associated with DKFZP727C091. FLJ10618 (Accession NM_018155) is another VGAM2136 host target gene. FLJ10618 BINDING SITE is HOST TARGET binding site found in the 3' untranslated region of mRNA encoded by FLJ10618, corresponding to a HOST TARGET binding site such as BINDING SITE I, BINDING SITE II or BINDING SITE III. Table 2 illustrates the complementarity of the nucleotide sequences of FLJ10618 BINDING SITE, designated SEQ ID:19966, to the nucleotide sequence of VGAM2136 RNA, herein designated VGAM RNA, also designated SEQ ID:4847.

Another function of VGAM2136 is therefore inhibition of FLJ10618 (Accession NM_018155). Accordingly, utilities of VGAM2136 include diagnosis, prevention and treatment of diseases and clinical conditions associated with FLJ10618. FLJ10687 (Accession NM_018178) is another VGAM2136 host target gene. FLJ10687 BINDING SITE is HOST TARGET binding site found in the 3' untranslated region of mRNA encoded by FLJ10687, corresponding to a HOST TARGET binding site such as BINDING SITE I, BINDING SITE II or BINDING SITE III. Table 2 illustrates the complementarity of the nucleotide sequences of FLJ10687 BINDING SITE, designated SEQ ID:20008, to the nucleotide sequence of VGAM2136 RNA, herein designated VGAM RNA, also designated SEQ ID:4847.

Another function of VGAM2136 is therefore inhibition of FLJ10687 (Accession NM_018178). Accordingly, utilities of VGAM2136 include diagnosis, prevention and treatment of diseases and clinical conditions associated with FLJ10687. FLJ11184 (Accession NM_018352) is another VGAM2136 host target gene. FLJ11184 BINDING SITE is HOST TARGET binding site found in the 3' untranslated region of mRNA encoded by FLJ11184, corresponding to a HOST TARGET binding site such as BINDING SITE I, BINDING SITE II or BINDING SITE III. Table 2 illustrates the complementarity of the nucleotide sequences of FLJ11184 BINDING SITE, designated SEQ ID:20364, to the nucleotide sequence of VGAM2136 RNA, herein designated VGAM RNA, also designated SEQ ID:4847.

Another function of VGAM2136 is therefore inhibition of FLJ11184 (Accession NM_018352). Accordingly, utilities of VGAM2136 include diagnosis, prevention and treatment of diseases and clinical conditions associated with FLJ11184. FLJ12644 (Accession NM_023074) is another VGAM2136 host target gene. FLJ12644 BINDING SITE is HOST TARGET binding site found in the 3' untranslated region of mRNA encoded by FLJ12644, corresponding to a HOST TARGET binding site such as BINDING SITE I, BINDING SITE II or BINDING SITE III. Table 2 illustrates the complementarity of the nucleotide sequences of FLJ12644 BINDING SITE, designated SEQ ID:23331, to the nucleotide sequence of VGAM2136 RNA, herein designated VGAM RNA, also designated SEQ ID:4847.

Another function of VGAM2136 is therefore inhibition of FLJ12644 (Accession NM_023074). Accordingly, utilities of VGAM2136 include diagnosis, prevention and treatment of diseases and clinical conditions associated with FLJ12644. FLJ12987 (Accession NM_025170) is another VGAM2136 host target gene. FLJ12987 BINDING SITE is HOST TARGET binding site found in the 3' untranslated region of mRNA encoded by FLJ12987, corresponding to a HOST TARGET binding site such as BINDING SITE I, BINDING SITE II or BINDING SITE III. Table 2 illustrates the complementarity of the nucleotide sequences of FLJ12987 BINDING SITE, designated SEQ ID:24806, to the nucleotide sequence of VGAM2136 RNA, herein designated VGAM RNA, also designated SEQ ID:4847.

Another function of VGAM2136 is therefore inhibition of FLJ12987 (Accession NM_025170). Accordingly, utilities of VGAM2136 include diagnosis, prevention and treatment of diseases and clinical conditions associated with FLJ12987. FLJ20666 (Accession NM_018333) is another VGAM2136 host target gene. FLJ20666 BINDING SITE1 and FLJ20666 BINDING SITE2 are HOST TARGET binding sites found in untranslated regions of mRNA encoded by FLJ20666, corresponding to HOST TARGET binding sites such as BINDING SITE I, BINDING SITE II or BINDING SITE III. Table 2 illustrates the complementarity of the nucleotide sequences of FLJ20666 BINDING SITE1 and FLJ20666 BINDING SITE2, designated SEQ ID:20335 and SEQ ID:19581 respectively, to the nucleotide sequence of VGAM2136 RNA, herein designated VGAM RNA, also designated SEQ ID:4847.

Another function of VGAM2136 is therefore inhibition of FLJ20666 (Accession NM_018333). Accordingly, utilities of VGAM2136 include diagnosis, prevention and treatment of diseases and clinical conditions associated with FLJ20666. GFR (Accession NM_012294) is another VGAM2136 host target gene. GFR BINDING SITE is HOST TARGET binding site found in the 3' untranslated region of mRNA encoded by GFR, corresponding to a HOST TARGET binding site such as BINDING SITE I, BINDING SITE II or BINDING SITE III. Table 2 illustrates the complementarity of the nucleotide sequences of GFR BINDING SITE, designated SEQ ID:14635, to the nucleotide sequence of VGAM2136 RNA, herein designated VGAM RNA, also designated SEQ ID:4847.

Another function of VGAM2136 is therefore inhibition of GFR (Accession NM_012294). Accordingly, utilities of VGAM2136 include diagnosis, prevention and treatment of diseases and clinical conditions associated with GFR. Glutamate Receptor, Ionotropic, Delta 1 (GRID1, Accession XM_043613) is another VGAM2136 host target gene. GRID1 BINDING SITE is HOST TARGET binding site found in the 3' untranslated region of mRNA encoded by GRID1, corresponding to a HOST TARGET binding site such as BINDING SITE I, BINDING SITE II or BINDING SITE III. Table 2 illustrates the complementarity of the nucleotide sequences of GRID1 BINDING SITE, designated SEQ ID:33982, to the nucleotide sequence of VGAM2136 RNA, herein designated VGAM RNA, also designated SEQ ID:4847.

Another function of VGAM2136 is therefore inhibition of Glutamate Receptor, Ionotropic, Delta 1 (GRID1, Accession XM_043613). Accordingly, utilities of VGAM2136 include diagnosis, prevention and treatment of diseases and clinical conditions associated with GRID1. KIAA0258 (Accession NM_014785) is another VGAM2136 host target gene. KIAA0258 BINDING SITE is HOST TARGET binding site found in the 3' untranslated region of mRNA encoded by KIAA0258, corresponding to a HOST TARGET binding site such as BINDING SITE I, BINDING SITE II or BINDING SITE III. Table 2 illustrates the complementarity of the nucleotide sequences of KIAA0258 BINDING SITE, designated SEQ ID:16651, to the nucleotide sequence of VGAM2136 RNA, herein designated VGAM RNA, also designated SEQ ID:4847.

Another function of VGAM2136 is therefore inhibition of KIAA0258 (Accession NM_014785). Accordingly, utilities of VGAM2136 include diagnosis, prevention and treatment of diseases and clinical conditions associated with KIAA0258. KIAA0863 (Accession NM_014913) is another VGAM2136 host target gene. KIAA0863 BINDING SITE1 and KIAA0863 BINDING SITE2 are HOST TARGET binding sites found in untranslated regions of mRNA encoded by KIAA0863, corresponding to HOST TARGET binding sites such as BINDING SITE I, BINDING SITE II or BINDING SITE III. Table 2 illustrates the complementarity of the nucleotide sequences of KIAA0863 BINDING SITE1 and KIAA0863 BINDING SITE2, designated SEQ ID:17152 and SEQ ID:45632 respectively, to the nucleotide sequence of VGAM2136 RNA, herein designated VGAM RNA, also designated SEQ ID:4847.

Another function of VGAM2136 is therefore inhibition of KIAA0863 (Accession NM_014913). Accordingly, utilities of VGAM2136 include diagnosis, prevention and treatment of diseases and clinical conditions associated with KIAA0863. MFN2 (Accession NM_014874) is another VGAM2136 host target gene. MFN2 BINDING SITE is HOST TARGET binding site found in the 3' untranslated region of mRNA encoded by MFN2, corresponding to a HOST TARGET binding site such as BINDING SITE I, BINDING SITE II or BINDING SITE III. Table 2 illustrates the complementarity of the nucleotide sequences of MFN2 BINDING SITE, designated SEQ ID:17011, to the nucleotide sequence of VGAM2136 RNA, herein designated VGAM RNA, also designated SEQ ID:4847.

Another function of VGAM2136 is therefore inhibition of MFN2 (Accession NM_014874). Accordingly, utilities of VGAM2136 include diagnosis, prevention and treatment of diseases and clinical conditions associated with MFN2. Neurolysin (metallopeptidase M3 family) (NLN, Accession NM_020726) is another VGAM2136 host target gene. NLN BINDING SITE is HOST TARGET binding site found in the 3' untranslated region of mRNA encoded by NLN, corresponding to a HOST TARGET binding site such as BINDING SITE I, BINDING SITE II or BINDING SITE III. Table 2 illustrates the complementarity of the nucleotide sequences of NLN BINDING SITE, designated SEQ ID:21857, to the nucleotide sequence of VGAM2136 RNA, herein designated VGAM RNA, also designated SEQ ID:4847.

Another function of VGAM2136 is therefore inhibition of Neurolysin (metallopeptidase M3 family) (NLN, Accession NM_020726). Accordingly, utilities of VGAM2136 include diagnosis, prevention and treatment of diseases and clinical conditions associated with NLN. PB1 (Accession NM_018165) is another VGAM2136 host target gene. PB1 BINDING SITE is HOST TARGET binding site found in the 3' untranslated region of mRNA encoded by PB1, corresponding to a HOST TARGET binding site such as BINDING SITE I, BINDING SITE II or BINDING SITE III. Table 2 illustrates the complementarity of the nucleotide sequences of PB1 BINDING SITE, designated SEQ ID:19982, to the nucleotide sequence of VGAM2136 RNA, herein designated VGAM RNA, also designated SEQ ID:4847.

Another function of VGAM2136 is therefore inhibition of PB1 (Accession NM_018165). Accordingly, utilities of VGAM2136 include diagnosis, prevention and treatment of diseases and clinical conditions associated with PB1. Protocadherin 19 (PCDH19, Accession XM_033173) is another VGAM2136 host target gene. PCDH19 BINDING SITE is HOST TARGET binding site found in the 3' untranslated region of mRNA encoded by PCDH19, corresponding to a HOST TARGET binding site such as BINDING SITE I, BINDING SITE II or BINDING SITE III. Table 2 illustrates the complementarity of the nucleotide sequences of PCDH19 BINDING SITE, designated SEQ ID:31863, to the nucleotide sequence of VGAM2136 RNA, herein designated VGAM RNA, also designated SEQ ID:4847.

Another function of VGAM2136 is therefore inhibition of Protocadherin 19 (PCDH19, Accession XM_033173). Accordingly, utilities of VGAM2136 include diagnosis, prevention and treatment of diseases and clinical conditions associated with PCDH19. Protein Phosphatase 1, Regulatory Subunit 10 (PPP1R10, Accession NM_002714) is another VGAM2136 host target gene. PPP1R10 BINDING SITE is HOST TARGET binding site found in the 3' untranslated region of mRNA encoded by PPP1R10, corresponding to a HOST TARGET binding site such as BINDING SITE I, BINDING SITE II or BINDING SITE III. Table 2 illustrates the complementarity of the nucleotide sequences of PPP1R10 BINDING SITE, designated SEQ ID:8579, to the nucleotide sequence of VGAM2136 RNA, herein designated VGAM RNA, also designated SEQ ID:4847.

Another function of VGAM2136 is therefore inhibition of Protein Phosphatase 1, Regulatory Subunit 10 (PPP1R10, Accession NM_002714). Accordingly, utilities of VGAM2136 include diagnosis, prevention and treatment of diseases and clinical conditions associated with PPP1R10. Proline-rich Gla (G-carboxyglutamic acid) Polypeptide 1 (PRRG1, Accession NM_000950) is another VGAM2136 host target gene. PRRG1 BINDING SITE is HOST TARGET binding site found in the 3' untranslated region of mRNA encoded by PRRG1, corresponding to a HOST TARGET binding site such as BINDING SITE I, BINDING SITE II or BINDING SITE III. Table 2 illustrates the complementarity of the nucleotide sequences of PRRG1 BINDING SITE, designated SEQ ID:6657, to the nucleotide sequence of VGAM2136 RNA, herein designated VGAM RNA, also designated SEQ ID:4847.

Another function of VGAM2136 is therefore inhibition of Proline-rich Gla (G-carboxyglutamic acid) Polypeptide 1 (PRRG1, Accession NM_000950). Accordingly, utilities of VGAM2136 include diagnosis, prevention and treatment of diseases and clinical conditions associated with PRRG1. Serum Response Factor (c-fos serum response element-binding transcription factor) (SRF, Accession NM_003131) is another VGAM2136 host target gene. SRF BINDING SITE is HOST TARGET binding site found in the 3' untranslated region of mRNA encoded by SRF, corresponding to a HOST TARGET binding site such as BINDING SITE I, BINDING SITE II or BINDING SITE III. Table 2 illustrates the complementarity of the nucleotide sequences of SRF BINDING SITE, designated SEQ ID:9096, to the nucleotide sequence of VGAM2136 RNA, herein designated VGAM RNA, also designated SEQ ID:4847.

Another function of VGAM2136 is therefore inhibition of Serum Response Factor (c-fos serum response element-binding transcription factor) (SRF, Accession NM_003131). Accordingly, utilities of VGAM2136 include diagnosis, prevention and treatment of diseases and clinical conditions associated with SRF. LOC125929 (Accession XM_064872) is another VGAM2136 host target gene. LOC125929 BINDING SITE is HOST TARGET binding site found in the 3' untranslated region of mRNA encoded by LOC125929, corresponding to a HOST TARGET binding site such as BINDING SITE I, BINDING SITE II or BINDING SITE III. Table 2 illustrates the complementarity of the nucleotide sequences of LOC125929 BINDING SITE, designated SEQ ID:37270, to the nucleotide sequence of VGAM2136 RNA, herein designated VGAM RNA, also designated SEQ ID:4847.

Another function of VGAM2136 is therefore inhibition of LOC125929 (Accession XM_064872). Accordingly, utilities of VGAM2136 include diagnosis, prevention and treatment of diseases and clinical conditions associated with LOC125929. LOC130162 (Accession XM_059406) is another VGAM2136 host target gene. LOC130162 BINDING SITE is HOST TARGET binding site found in the 3' untranslated region of mRNA encoded by LOC130162, corresponding to a HOST TARGET binding site such as BINDING SITE I, BINDING SITE II or BINDING SITE III. Table 2 illustrates the complementarity of the nucleotide sequences of LOC130162 BINDING SITE, designated SEQ ID:36984, to the nucleotide sequence of VGAM2136 RNA, herein designated VGAM RNA, also designated SEQ ID:4847.

Another function of VGAM2136 is therefore inhibition of LOC130162 (Accession XM_059406). Accordingly, utilities of VGAM2136 include diagnosis, prevention and treatment of diseases and clinical conditions associated with LOC130162. LOC130589 (Accession NM_138801) is another VGAM2136 host target gene. LOC130589 BINDING SITE is HOST TARGET binding site found in the 3' untranslated region of mRNA encoded by LOC130589, corresponding to a HOST TARGET binding site such as BINDING SITE I, BINDING SITE II or BINDING SITE III. Table 2 illustrates the complementarity of the nucleotide sequences of LOC130589 BINDING SITE, designated SEQ ID:29023, to the nucleotide sequence of VGAM2136 RNA, herein designated VGAM RNA, also designated SEQ ID:4847.

Another function of VGAM2136 is therefore inhibition of LOC130589 (Accession NM_138801). Accordingly, utilities of VGAM2136 include diagnosis, prevention and treatment of diseases and clinical conditions associated with LOC130589. LOC132228 (Accession XM_059581) is another VGAM2136 host target gene. LOC132228 BINDING SITE is HOST TARGET binding site found in the 3' untranslated region of mRNA encoded by LOC132228, corresponding to a HOST TARGET binding site such as BINDING SITE I, BINDING SITE II or BINDING SITE III. Table 2 illustrates the complementarity of the nucleotide sequences of LOC132228 BINDING SITE, designated SEQ ID:37021, to the nucleotide sequence of VGAM2136 RNA, herein designated VGAM RNA, also designated SEQ ID:4847.

Another function of VGAM2136 is therefore inhibition of LOC132228 (Accession XM_059581). Accordingly, utilities of VGAM2136 include diagnosis, prevention and treatment of diseases and clinical conditions associated with LOC132228. LOC146784 (Accession XM_085588) is another VGAM2136 host target gene. LOC146784 BINDING SITE is HOST TARGET binding site found in the 5' untranslated region of mRNA encoded by LOC146784, corresponding to a HOST TARGET binding site such as BINDING SITE I, BINDING SITE II or BINDING SITE III. Table 2 illustrates the complementarity of the nucleotide sequences of LOC146784 BINDING SITE, designated SEQ ID:38239, to the nucleotide sequence of VGAM2136 RNA, herein designated VGAM RNA, also designated SEQ ID:4847.

Another function of VGAM2136 is therefore inhibition of LOC146784 (Accession XM_085588). Accordingly, utilities of VGAM2136 include diagnosis, prevention and treatment of diseases and clinical conditions associated with LOC146784. LOC153077 (Accession XM_098307) is another VGAM2136 host target gene. LOC153077 BINDING SITE is HOST TARGET binding site found in the 3' untranslated region of mRNA encoded by LOC153077, corresponding to a HOST TARGET binding site such as BINDING SITE I, BINDING SITE II or BINDING SITE III. Table 2 illustrates the complementarity of the nucleotide sequences of LOC153077 BINDING SITE, designated SEQ ID:41568, to the nucleotide sequence of VGAM2136 RNA, herein designated VGAM RNA, also designated SEQ ID:4847.

Another function of VGAM2136 is therefore inhibition of LOC153077 (Accession XM_098307). Accordingly, utilities of VGAM2136 include diagnosis, prevention and treatment of diseases and clinical conditions associated with LOC153077. LOC158581 (Accession XM_098968) is another VGAM2136 host target gene. LOC158581 BINDING SITE is HOST TARGET binding site found in the 5' untranslated region of mRNA encoded by LOC158581, corresponding to a HOST TARGET binding site such as BINDING SITE I, BINDING SITE II or BINDING SITE III. Table 2 illustrates the complementarity of the nucleotide sequences of LOC158581 BINDING SITE, designated SEQ ID:42014, to the nucleotide sequence of VGAM2136 RNA, herein designated VGAM RNA, also designated SEQ ID:4847.

Another function of VGAM2136 is therefore inhibition of LOC158581 (Accession XM_098968). Accordingly, utilities of VGAM2136 include diagnosis, prevention and treatment of diseases and clinical conditions associated with LOC158581. LOC221143 (Accession XM_167986) is another VGAM2136 host target gene. LOC221143 BINDING SITE is HOST TARGET binding site found in the 3' untranslated region of mRNA encoded by LOC221143, corresponding to a HOST TARGET binding site such as BINDING SITE I, BINDING SITE II or BINDING SITE III. Table 2 illustrates the complementarity of the nucleotide sequences of LOC221143 BINDING SITE, designated SEQ ID:44942, to the nucleotide sequence of VGAM2136 RNA, herein designated VGAM RNA, also designated SEQ ID:4847.

Another function of VGAM2136 is therefore inhibition of LOC221143 (Accession XM_167986). Accordingly, utilities of VGAM2136 include diagnosis, prevention and treatment of diseases and clinical conditions associated with LOC221143. LOC221296 (Accession XM_166325) is another VGAM2136 host target gene. LOC221296 BINDING SITE is HOST TARGET binding site found in the 3' untranslated region of mRNA encoded by LOC221296, corresponding to a HOST TARGET binding site such as BINDING SITE I, BINDING SITE II or BINDING SITE III. Table 2 illustrates the complementarity of the nucleotide sequences of LOC221296 BINDING SITE, designated SEQ ID:44168, to the nucleotide sequence of VGAM2136 RNA, herein designated VGAM RNA, also designated SEQ ID:4847.

Another function of VGAM2136 is therefore inhibition of LOC221296 (Accession XM_166325). Accordingly, utilities of VGAM2136 include diagnosis, prevention and treatment of diseases and clinical conditions associated with LOC221296. FIG. 1 further provides a conceptual description of a novel bioinformatically detected viral gene of the present invention, referred to here as Viral Genomic Address Messenger 2137 (VGAM2137) viral gene, which modulates expression of respective host target genes thereof, the function and utility of which host target genes is known in the art.

VGAM2137 is a novel bioinformatically detected regulatory, non protein coding, viral micro RNA (miRNA) gene. The method by which VGAM2137 was detected is described hereinabove with reference to FIGS. 1-8.

VGAM2137 gene, herein designated VGAM GENE, is a viral gene contained in the genome of Ectromelia Virus. VGAM2137 host target gene, herein designated VGAM HOST TARGET GENE, is a human gene contained in the human genome.

VGAM2137 gene encodes a VGAM2137 precursor RNA, herein designated VGAM PRECURSOR RNA. Similar to other miRNA genes, and unlike most ordinary genes, VGAM2137 precursor RNA does not encode a protein. A nucleotide sequence identical or highly similar to the nucleotide sequence of VGAM2137 precursor RNA is designated SEQ ID:2123, and is provided hereinbelow with reference to the sequence listing part. Nucleotide sequence SEQ ID:2123 is located at position 174026 relative to the genome of Ectromelia Virus.

VGAM2137 precursor RNA folds onto itself, forming VGAM2137 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2137 folded precursor RNA into VGAM2137 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2137 RNA is designated SEQ ID:4848, and is provided hereinbelow with reference to the sequence listing part.

VGAM2137 host target gene, herein designated VGAM HOST TARGET GENE, encodes a corresponding messenger RNA, VGAM2137 host target RNA, herein designated VGAM HOST TARGET RNA. VGAM2137 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2137 RNA, herein designated VGAM RNA, binds complementarily to one or more host target binding sites located in untranslated regions of VGAM2137 host target RNA, herein designated VGAM HOST TARGET RNA. This complementary binding is due to the fact that the nucleotide sequence of VGAM2137 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2137 RNA, herein designated VGAM RNA, may have a different number of host target binding sites in untranslated regions of a VGAM2137 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2137 RNA, herein designated VGAM RNA, to host target binding sites on VGAM2137 host target RNA, herein designated VGAM HOST TARGET RNA, such as BINDING SITE I, BINDING SITE II and BINDING SITE III, inhibits translation of VGAM2137 host target RNA into VGAM2137 host target protein, herein designated VGAM HOST TARGET PROTEIN. VGAM host target protein is therefore outlined by a broken line.

It is appreciated that VGAM2137 host target gene, herein designated VGAM HOST TARGET GENE, in fact represents a plurality of VGAM2137 host target genes. The mRNA of each one of this plurality of VGAM2137 host target genes comprises one or more host target binding sites, each having a nucleotide sequence which is at least partly complementary to VGAM2137 RNA, herein designated VGAM RNA, and which when bound by VGAM2137 RNA causes inhibition of translation of respective one or more VGAM2137 host target proteins.

It is further appreciated by one skilled in the art that the mode of translational inhibition illustrated by FIG. 1 with specific reference to translational inhibition exerted by VGAM2137 gene, herein designated VGAM GENE, on one or more VGAM2137 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2137 is inhibition of expression of host target genes, as part of a novel viral mechanism of attacking a host. Accordingly, utilities of VGAM2137 include diagnosis, prevention and treatment of viral infection by Ectromelia Virus. Specific functions, and accordingly utilities, of VGAM2137 correlate with, and may be deduced from, the identity of the host target genes which VGAM2137 binds and inhibits, and the function of these host target genes, as elaborated hereinbelow.

Nucleotide sequences of the VGAM2137 precursor RNA, herein designated VGAM PRECURSOR RNA, and of the 'diced' VGAM2137 RNA, herein designated VGAM RNA, and a schematic representation of the secondary folding of VGAM2137 folded precursor RNA, herein designated VGAM FOLDED PRECURSOR RNA, of VGAM2137 are further described hereinbelow with reference to Table 1.

Nucleotide sequences of host target binding sites, such as BINDING SITE-I, BINDING SITE-II and BINDING SITE-III of FIG. 1, found on VGAM2137 host target RNA, and schematic representation of the complementarity of each of these host target binding sites to VGAM2137 RNA, herein designated VGAM RNA, are described hereinbelow with reference to Table 2.

As mentioned hereinabove with reference to FIG. 1, a function of VGAM2137 gene, herein designated VGAM is inhibition of expression of VGAM2137 target genes. It is appreciated that specific functions, and accordingly utilities, of VGAM2137 correlate with, and may be deduced from, the identity of the target genes which VGAM2137 binds and inhibits, and the function of these target genes, as elaborated hereinbelow.

Microtubule-associated Protein, RP/EB Family, Member 2 (MAPRE2, Accession NM_014268) is a VGAM2137 host target gene. MAPRE2 BINDING SITE is HOST TARGET binding site found in the 3' untranslated region of mRNA encoded by MAPRE2, corresponding to a HOST TARGET binding site such as BINDING SITE I, BINDING SITE II or BINDING SITE III. Table 2 illustrates the complementarity of the nucleotide sequences of MAPRE2 BINDING SITE, designated SEQ ID:15546, to the nucleotide sequence of VGAM2137 RNA, herein designated VGAM RNA, also designated SEQ ID:4848.

A function of VGAM2137 is therefore inhibition of Microtubule-associated Protein, RP/EB Family, Member 2 (MAPRE2, Accession NM_014268), a gene which The functional inactivation of the APC gene product is a key event in colorectal tumorigenesis. Accordingly, utilities of VGAM2137 include diagnosis, prevention and treatment of diseases and clinical conditions associated with MAPRE2. The function of MAPRE2 and its association with various diseases and clinical conditions, has been established by previous studies, as described hereinabove with reference to VGAM178. Zinc Finger Protein 255 (ZNF255, Accession NM_005774) is another VGAM2137 host target gene. ZNF255 BINDING SITE is HOST TARGET binding site found in the 5' untranslated region of mRNA encoded by ZNF255, corresponding to a HOST TARGET binding site such as BINDING SITE I, BINDING SITE II or BINDING SITE III. Table 2 illustrates the complementarity of the nucleotide sequences of ZNF255 BINDING SITE, designated SEQ ID:12347, to the nucleotide sequence of VGAM2137 RNA, herein designated VGAM RNA, also designated SEQ ID:4848.

Another function of VGAM2137 is therefore inhibition of Zinc Finger Protein 255 (ZNF255, Accession NM_005774). Accordingly, utilities of VGAM2137 include diagnosis, prevention and treatment of diseases and clinical conditions associated with ZNF255. FLJ12488 (Accession NM_031218) is another VGAM2137 host target gene. FLJ12488 BINDING SITE is HOST TARGET binding site found in the 3' untranslated region of mRNA encoded by FLJ12488, corresponding to a HOST TARGET binding site such as BINDING SITE I, BINDING SITE II or BINDING SITE III. Table 2 illustrates the complementarity of the nucleotide sequences of FLJ12488 BINDING SITE, designated SEQ ID:25266, to the nucleotide sequence of VGAM2137 RNA, herein designated VGAM RNA, also designated SEQ ID:4848.

Another function of VGAM2137 is therefore inhibition of FLJ12488 (Accession NM_031218). Accordingly, utilities of VGAM2137 include diagnosis, prevention and treatment of diseases and clinical conditions associated with FLJ12488. FLJ12788 (Accession NM_022492) is another VGAM2137 host target gene. FLJ12788 BINDING SITE is HOST TARGET binding site found in the 3' untranslated region of mRNA encoded by FLJ12788, corresponding to a HOST TARGET binding site such as BINDING SITE I, BINDING SITE II or BINDING SITE III. Table 2 illustrates the complementarity of the nucleotide sequences of FLJ12788 BINDING SITE, designated SEQ ID:22871, to the nucleotide sequence of VGAM2137 RNA, herein designated VGAM RNA, also designated SEQ ID:4848.

Another function of VGAM2137 is therefore inhibition of FLJ12788 (Accession NM_022492). Accordingly, utilities of VGAM2137 include diagnosis, prevention and treatment of diseases and clinical conditions associated with FLJ12788. HSA250839 (Accession NM_018401) is another VGAM2137 host target gene. HSA250839 BINDING SITE is HOST TARGET binding site found in the 3' untranslated region of mRNA encoded by HSA250839, corresponding to a HOST TARGET binding site such as BINDING SITE I, BINDING SITE II or BINDING SITE III. Table 2 illustrates the complementarity of the nucleotide sequences of HSA250839 BINDING SITE, designated SEQ ID:20439, to the nucleotide sequence of VGAM2137 RNA, herein designated VGAM RNA, also designated SEQ ID:4848.

Another function of VGAM2137 is therefore inhibition of HSA250839 (Accession NM_018401). Accordingly, utilities of VGAM2137 include diagnosis, prevention and treatment of diseases and clinical conditions associated with HSA250839. KIAA1877 (Accession XM_038616) is another VGAM2137 host target gene. KIAA1877 BINDING SITE is HOST TARGET binding site found in the 3' untranslated region of mRNA encoded by KIAA1877, corresponding to a HOST TARGET binding site such as BINDING SITE I, BINDING SITE II or BINDING SITE III. Table 2 illustrates the complementarity of the nucleotide sequences of KIAA1877 BINDING SITE, designated SEQ ID:32886, to the nucleotide sequence of VGAM2137 RNA, herein designated VGAM RNA, also designated SEQ ID:4848.

Another function of VGAM2137 is therefore inhibition of KIAA1877 (Accession XM_038616). Accordingly, utilities of VGAM2137 include diagnosis, prevention and treatment of diseases and clinical conditions associated with KIAA1877. MGC3771 (Accession NM_030970) is another VGAM2137 host target gene. MGC3771 BINDING SITE is HOST TARGET binding site found in the 5' untranslated region of mRNA encoded by MGC3771, corresponding to a HOST TARGET binding site such as BINDING SITE I, BINDING SITE II or BINDING SITE III. Table 2 illustrates the complementarity of the nucleotide sequences of MGC3771 BINDING SITE, designated SEQ ID:25234, to the nucleotide sequence of VGAM2137 RNA, herein designated VGAM RNA, also designated SEQ ID:4848.

Another function of VGAM2137 is therefore inhibition of MGC3771 (Accession NM_030970). Accordingly, utilities of VGAM2137 include diagnosis, prevention and treatment of diseases and clinical conditions associated with MGC3771. LOC162333 (Accession XM_102591) is another VGAM2137 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42140, to the nucleotide sequence of VGAM2137 RNA, herein designated VGAM RNA, also designated SEQ ID:4848.

Another function of VGAM2137 is therefore inhibition of LOC162333 (Accession XM_102591). Accordingly, utilities of VGAM2137 include diagnosis, prevention and treatment of diseases and clinical conditions associated with LOC162333. LOC90410 (Accession XM_031534) is another VGAM2137 host target gene. LOC90410 BINDING SITE is HOST TARGET binding site found in the 5' untranslated region of mRNA encoded by LOC90410, corresponding to a HOST TARGET binding site such as BINDING SITE I, BINDING SITE II or BINDING SITE III. Table 2 illustrates the complementarity of the nucleotide sequences of LOC90410 BINDING SITE, designated SEQ ID:31400, to the nucleotide sequence of VGAM2137 RNA, herein designated VGAM RNA, also designated SEQ ID:4848.

Another function of VGAM2137 is therefore inhibition of LOC90410 (Accession XM_031534). Accordingly, utilities of VGAM2137 include diagnosis, prevention and treatment of diseases and clinical conditions associated with LOC90410. FIG. 1 further provides a conceptual description of a novel bioinformatically detected viral gene of the present invention, referred to here as Viral Genomic Address Messenger 2138 (VGAM2138) viral gene, which modulates expression of respective host target genes thereof, the function and utility of which host target genes is known in the art.

VGAM2138 is a novel bioinformatically detected regulatory, non protein coding, viral micro RNA (miRNA) gene. The method by which VGAM2138 was detected is described hereinabove with reference to FIGS. 1-8.

VGAM2138 gene, herein designated VGAM GENE, is a viral gene contained in the genome of Ectromelia Virus. VGAM2138 host target gene, herein designated VGAM HOST TARGET GENE, is a human gene contained in the human genome.

VGAM2138 gene encodes a VGAM2138 precursor RNA, herein designated VGAM PRECURSOR RNA. Similar to other miRNA genes, and unlike most ordinary genes, VGAM2138 precursor RNA does not encode a protein. A nucleotide sequence identical or highly similar to the nucleotide sequence of VGAM2138 precursor RNA is designated SEQ ID:2124, and is provided hereinbelow with reference to the sequence listing part. Nucleotide sequence SEQ ID:2124 is located at position 168635 relative to the genome of Ectromelia Virus.

VGAM2138 precursor RNA folds onto itself, forming VGAM2138 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2138 folded precursor RNA into VGAM2138 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 41%) nucleotide sequence of VGAM2138 RNA is designated SEQ ID:4849, and is provided hereinbelow with reference to the sequence listing part.

VGAM2138 host target gene, herein designated VGAM HOST TARGET GENE, encodes a corresponding messenger RNA, VGAM2138 host target RNA, herein designated VGAM HOST TARGET RNA. VGAM2138 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2138 RNA, herein designated VGAM RNA, binds complementarily to one or more host target binding sites located in untranslated regions of VGAM2138 host target RNA, herein designated VGAM HOST TARGET RNA. This complementary binding is due to the fact that the nucleotide sequence of VGAM2138 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2138 RNA, herein designated VGAM RNA, may have a different number of host target binding sites in untranslated regions of a VGAM2138 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2138 RNA, herein designated VGAM RNA, to host target binding sites on VGAM2138 host target RNA, herein designated VGAM HOST TARGET RNA, such as BINDING SITE I, BINDING SITE II and BINDING SITE III, inhibits translation of VGAM2138 host target RNA into VGAM2138 host target protein, herein designated VGAM HOST TARGET PROTEIN. VGAM host target protein is therefore outlined by a broken line.

It is appreciated that VGAM2138 host target gene, herein designated VGAM HOST TARGET GENE, in fact represents a plurality of VGAM2138 host target genes. The mRNA of each one of this plurality of VGAM2138 host target genes comprises one or more host target binding sites, each having a nucleotide sequence which is at least partly complementary to VGAM2138 RNA, herein designated VGAM RNA, and which when bound by VGAM2138 RNA causes inhibition of translation of respective one or more VGAM2138 host target proteins.

It is further appreciated by one skilled in the art that the mode of translational inhibition illustrated by FIG. 1 with specific reference to translational inhibition exerted by VGAM2138 gene, herein designated VGAM GENE, on one or more VGAM2138 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2138 is inhibition of expression of host target genes, as part of a novel viral mechanism of attacking a host. Accordingly, utilities of VGAM2138 include diagnosis, prevention and treatment of viral infection by Ectromelia Virus. Specific functions, and accordingly utilities, of VGAM2138 correlate with, and may be deduced from, the identity of the host target genes which VGAM2138 binds and inhibits, and the function of these host target genes, as elaborated hereinbelow.

Nucleotide sequences of the VGAM2138 precursor RNA, herein designated VGAM PRECURSOR RNA, and of the 'diced' VGAM2138 RNA, herein designated VGAM RNA, and a schematic representation of the secondary folding of VGAM2138 folded precursor RNA, herein designated VGAM FOLDED PRECURSOR RNA, of VGAM2138 are further described hereinbelow with reference to Table 1.

Nucleotide sequences of host target binding sites, such as BINDING SITE-I, BINDING SITE-II and BINDING SITE-III of FIG. 1, found on VGAM2138 host target RNA, and schematic representation of the complementarity of each of these host target binding sites to VGAM2138 RNA, herein designated VGAM RNA, are described hereinbelow with reference to Table 2.

As mentioned hereinabove with reference to FIG. 1, a function of VGAM2138 gene, herein designated VGAM is inhibition of expression of VGAM2138 target genes. It is appreciated that specific functions, and accordingly utilities, of VGAM2138 correlate with, and may be deduced from, the identity of the target genes which VGAM2138 binds and inhibits, and the function of these target genes, as elaborated hereinbelow.

Cytochrome P450, Subfamily XXVIIB (25-hydroxyvitamin D-1-alpha-hydroxylase), Polypeptide 1 (CYP27B1, Accession NM_000785) is a VGAM2138 host target gene. CYP27B1 BINDING SITE is HOST TARGET binding site found in the 3' untranslated region of mRNA encoded by CYP27B1, corresponding to a HOST TARGET binding site such as BINDING SITE I, BINDING SITE II or BINDING SITE III. Table 2 illustrates the complementarity of the nucleotide sequences of CYP27B1 BINDING SITE, designated SEQ ID:6434, to the nucleotide sequence of VGAM2138 RNA, herein designated VGAM RNA, also designated SEQ ID:4849.

A function of VGAM2138 is therefore inhibition of Cytochrome P450, Subfamily XXVIIB (25-hydroxyvitamin D-1-alpha-hydroxylase), Polypeptide 1 (CYP27B1, Accession NM_000785). Accordingly, utilities of VGAM2138 include diagnosis, prevention and treatment of diseases and clinical conditions associated with CYP27B1. Glucose-6-phosphatase, Catalytic (glycogen storage disease type I, von Gierke disease) (G6PC, Accession NM_000151) is another VGAM2138 host target gene. G6PC BINDING SITE is HOST TARGET binding site found in the 3' untranslated region of mRNA encoded by G6PC, corresponding to a HOST TARGET binding site such as BINDING SITE I, BINDING SITE II or BINDING SITE III. Table 2 illustrates the complementarity of the nucleotide sequences of G6PC BINDING SITE, designated SEQ ID:5654, to the nucleotide sequence of VGAM2138 RNA, herein designated VGAM RNA, also designated SEQ ID:4849.

Another function of VGAM2138 is therefore inhibition of Glucose-6-phosphatase, Catalytic (glycogen storage disease type I, von Gierke disease) (G6PC, Accession NM_000151). Accordingly, utilities of VGAM2138 include diagnosis, prevention and treatment of diseases and clinical conditions associated with G6PC. KIAA0349 (Accession XM_166449) is another VGAM2138 host target gene. KIAA0349 BINDING SITE is HOST TARGET binding site found in the 3' untranslated region of mRNA encoded by KIAA0349, corresponding to a HOST TARGET binding site such as BINDING SITE I, BINDING SITE II or BINDING SITE III. Table 2 illustrates the complementarity of the nucleotide sequences of KIAA0349 BINDING SITE, designated SEQ ID:44340, to the nucleotide sequence of VGAM2138 RNA, herein designated VGAM RNA, also designated SEQ ID:4849.

Another function of VGAM2138 is therefore inhibition of KIAA0349 (Accession XM_166449). Accordingly, utilities of VGAM2138 include diagnosis, prevention and treatment of diseases and clinical conditions associated with KIAA0349. MIG (Accession NM_002416) is another VGAM2138 host target gene. MIG BINDING SITE is HOST TARGET binding site found in the 3' untranslated region of mRNA encoded by MIG, corresponding to a HOST TARGET binding site such as BINDING SITE I, BINDING SITE II or BINDING SITE III. Table 2 illustrates the complementarity of the nucleotide sequences of MIG BINDING SITE, designated SEQ ID:8249, to the nucleotide sequence of VGAM2138 RNA, herein designated VGAM RNA, also designated SEQ ID:4849.

Another function of VGAM2138 is therefore inhibition of MIG (Accession NM_002416). Accordingly, utilities of VGAM2138 include diagnosis, prevention and treatment of diseases and clinical conditions associated with MIG. LOC152925 (Accession XM_087559) is another VGAM2138 host target gene. LOC152925 BINDING SITE is HOST TARGET binding site found in the 3' untranslated region of mRNA encoded by LOC152925, corresponding to a HOST TARGET binding site such as BINDING SITE I, BINDING SITE II or BINDING SITE III. Table 2 illustrates the complementarity of the nucleotide sequences of LOC152925 BINDING SITE, designated SEQ ID:39338, to the nucleotide sequence of VGAM2138 RNA, herein designated VGAM RNA, also designated SEQ ID:4849.

Another function of VGAM2138 is therefore inhibition of LOC152925 (Accession XM_087559). Accordingly, utilities of VGAM2138 include diagnosis, prevention and treatment of diseases and clinical conditions associated with LOC152925. LOC158295 (Accession XM_098915) is another VGAM2138 host target gene. LOC158295 BINDING SITE is HOST TARGET binding site found in the 5' untranslated region of mRNA encoded by LOC158295, corresponding to a HOST TARGET binding site such as BINDING SITE I, BINDING SITE II or BINDING SITE III. Table 2 illustrates the complementarity of the nucleotide sequences of LOC158295 BINDING SITE, designated SEQ ID:41937, to the nucleotide sequence of VGAM2138 RNA, herein designated VGAM RNA, also designated SEQ ID:4849.

Another function of VGAM2138 is therefore inhibition of LOC158295 (Accession XM_098915). Accordingly, utilities of VGAM2138 include diagnosis, prevention and treatment of diseases and clinical conditions associated with LOC158295. LOC55885 (Accession NM_018640) is another VGAM2138 host target gene. LOC55885 BINDING SITE is HOST TARGET binding site found in the 3' untranslated region of mRNA encoded by LOC55885, corresponding to a HOST TARGET binding site such as BINDING SITE I, BINDING SITE II or BINDING SITE III. Table 2 illustrates the complementarity of the nucleotide sequences of LOC55885 BINDING SITE, designated SEQ ID:20710, to the nucleotide sequence of VGAM2138 RNA, herein designated VGAM RNA, also designated SEQ ID:4849.

Another function of VGAM2138 is therefore inhibition of LOC55885 (Accession NM_018640). Accordingly, utilities of VGAM2138 include diagnosis, prevention and treatment of diseases and clinical conditions associated with LOC55885. FIG. 1 further provides a conceptual description of a novel bioinformatically detected viral gene of the present invention, referred to here as Viral Genomic Address Messenger 2139 (VGAM2139) viral gene, which modulates expression of respective host target genes thereof, the function and utility of which host target genes is known in the art.

VGAM2139 is a novel bioinformatically detected regulatory, non protein coding, viral micro RNA (miRNA) gene. The method by which VGAM2139 was detected is described hereinabove with reference to FIGS. 1-8.

VGAM2139 gene, herein designated VGAM GENE, is a viral gene contained in the genome of Ectromelia Virus. VGAM2139 host target gene, herein designated VGAM HOST TARGET GENE, is a human gene contained in the human genome.

VGAM2139 gene encodes a VGAM2139 precursor RNA, herein designated VGAM PRECURSOR RNA. Similar to other miRNA genes, and unlike most ordinary genes, VGAM2139 precursor RNA does not encode a protein. A nucleotide sequence identical or highly similar to the nucleotide sequence of VGAM2139 precursor RNA is designated SEQ ID:2125, and is provided hereinbelow with reference to the sequence listing part. Nucleotide sequence SEQ ID:2125 is located at position 179020 relative to the genome of Ectromelia Virus.

VGAM2139 precursor RNA folds onto itself, forming VGAM2139 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2139 folded precursor RNA into VGAM2139 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2139 RNA is designated SEQ ID:4850, and is provided hereinbelow with reference to the sequence listing part.

VGAM2139 host target gene, herein designated VGAM HOST TARGET GENE, encodes a corresponding messenger RNA, VGAM2139 host target RNA, herein designated VGAM HOST TARGET RNA. VGAM2139 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2139 RNA, herein designated VGAM RNA, binds complementarily to one or more host target binding sites located in untranslated regions of VGAM2139 host target RNA, herein designated VGAM HOST TARGET RNA. This complementary binding is due to the fact that the nucleotide sequence of VGAM2139 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2139 RNA, herein designated VGAM RNA, may have a different number of host target binding sites in untranslated regions of a VGAM2139 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2139 RNA, herein designated VGAM RNA, to host target binding sites on VGAM2139 host target RNA, herein designated VGAM HOST TARGET RNA, such as BINDING SITE I, BINDING SITE II and BINDING SITE III, inhibits translation of VGAM2139 host target RNA into VGAM2139 host target protein, herein designated VGAM HOST TARGET PROTEIN. VGAM host target protein is therefore outlined by a broken line.

It is appreciated that VGAM2139 host target gene, herein designated VGAM HOST TARGET GENE, in fact represents a plurality of VGAM2139 host target genes. The mRNA of each one of this plurality of VGAM2139 host target genes comprises one or more host target binding sites, each having a nucleotide sequence which is at least partly complementary to VGAM2139 RNA, herein designated VGAM RNA, and which when bound by VGAM2139 RNA causes inhibition of translation of respective one or more VGAM2139 host target proteins.

It is further appreciated by one skilled in the art that the mode of translational inhibition illustrated by FIG. 1 with specific reference to translational inhibition exerted by VGAM2139 gene, herein designated VGAM GENE, on one or more VGAM2139 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2139 is inhibition of expression of host target genes, as part of a novel viral mechanism of attacking a host. Accordingly, utilities of VGAM2139 include diagnosis, prevention and treatment of viral infection by Ectromelia Virus. Specific functions, and accordingly utilities, of VGAM2139 correlate with, and may be deduced from, the identity of the host target genes which VGAM2139 binds and inhibits, and the function of these host target genes, as elaborated hereinbelow.

Nucleotide sequences of the VGAM2139 precursor RNA, herein designated VGAM PRECURSOR RNA, and of the 'diced' VGAM2139 RNA, herein designated VGAM RNA, and a schematic representation of the secondary folding of VGAM2139 folded precursor RNA, herein designated VGAM FOLDED PRECURSOR RNA, of VGAM2139 are further described hereinbelow with reference to Table 1.

Nucleotide sequences of host target binding sites, such as BINDING SITE-I, BINDING SITE-II and BINDING SITE-III of FIG. 1, found on VGAM2139 host target RNA, and schematic representation of the complementarity of each of these host target binding sites to VGAM2139 RNA, herein designated VGAM RNA, are described hereinbelow with reference to Table 2.

As mentioned hereinabove with reference to FIG. 1, a function of VGAM2139 gene, herein designated VGAM is inhibition of expression of VGAM2139 target genes. It is appreciated that specific functions, and accordingly utilities, of VGAM2139 correlate with, and may be deduced from, the identity of the target genes which VGAM2139 binds and inhibits, and the function of these target genes, as elaborated hereinbelow.

Notch Homolog 2 (Drosophila) (NOTCH2, Accession NM_024408) is a VGAM2139 host target gene. NOTCH2 BINDING SITE is HOST TARGET binding site found in the 3' untranslated region of mRNA encoded by NOTCH2, corresponding to a HOST TARGET binding site such as BINDING SITE I, BINDING SITE II or BINDING SITE III. Table 2 illustrates the complementarity of the nucleotide sequences of NOTCH2 BINDING SITE, designated SEQ ID:23649, to the nucleotide sequence of VGAM2139 RNA, herein designated VGAM RNA, also designated SEQ ID:4850.

A function of VGAM2139 is therefore inhibition of Notch Homolog 2 (Drosophila) (NOTCH2, Accession NM_024408), a gene which is moderately similar to a region of murine Notch1 and contains an ankyrin repeat. Accordingly, utilities of VGAM2139 include diagnosis, prevention and treatment of diseases and clinical conditions associated with NOTCH2. The function of NOTCH2 and its association with various diseases and clinical conditions, has been established by previous studies, as described hereinabove with reference to VGAM93. Guanine Nucleotide Binding Protein (G protein), Gamma 4 (GNG4, Accession NM_004485) is another VGAM2139 host target gene. GNG4 BINDING SITE is HOST TARGET binding site found in the 3' untranslated region of mRNA encoded by GNG4, corresponding to a HOST TARGET binding site such as BINDING SITE I, BINDING SITE II or BINDING SITE III. Table 2 illustrates the complementarity of the nucleotide sequences of GNG4 BINDING SITE, designated SEQ ID:10807, to the nucleotide sequence of VGAM2139 RNA, herein designated VGAM RNA, also designated SEQ ID:4850.

Another function of VGAM2139 is therefore inhibition of Guanine Nucleotide Binding Protein (G protein), Gamma 4 (GNG4, Accession NM_004485). Accordingly, utilities of VGAM2139 include diagnosis, prevention and treatment of diseases and clinical conditions associated with GNG4. KIAA1495 (Accession XM_055080) is another VGAM2139 host target gene. KIAA1495 BINDING SITE is HOST TARGET binding site found in the 3" untranslated region of mRNA encoded by KIAA1495, corresponding to a HOST TARGET binding site such as BINDING SITE I, BINDING SITE II or BINDING SITE III. Table 2 illustrates the complementarity of the nucleotide sequences of KIAA1495 BINDING SITE, designated SEQ ID:36223, to the nucleotide sequence of VGAM2139 RNA, herein designated VGAM RNA, also designated SEQ ID:4850.

Another function of VGAM2139 is therefore inhibition of KIAA1495 (Accession XM_055080). Accordingly, utilities of VGAM2139 include diagnosis, prevention and treatment of diseases and clinical conditions associated with KIAA1495. KIAA1582 (Accession XM_037262) is another VGAM2139 host target gene. KIAA1582 BINDING SITE is HOST TARGET binding site found in the 5' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32582, to the nucleotide sequence of VGAM2139 RNA, herein designated VGAM RNA, also designated SEQ ID:4850.

Another function of VGAM2139 is therefore inhibition of KIAA1582 (Accession XM_037262). Accordingly, utilities of VGAM2139 include diagnosis, prevention and treatment of diseases and clinical conditions associated with KIAA1582. LOC254826 (Accession XM_173188) is another VGAM2139 host target gene. LOC254826 BINDING SITE is HOST TARGET binding site found in the 3' untranslated region of mRNA encoded by LOC254826, corresponding to a HOST TARGET binding site such as BINDING SITE I, BINDING SITE II or BINDING SITE III. Table 2 illustrates the complementarity of the nucleotide sequences of LOC254826 BINDING SITE, designated SEQ ID:46435, to the nucleotide sequence of VGAM2139 RNA, herein designated VGAM RNA, also designated SEQ ID:4850.

Another function of VGAM2139 is therefore inhibition of LOC254826 (Accession XM_173188). Accordingly, utilities of VGAM2139 include diagnosis, prevention and treatment of diseases and clinical conditions associated with LOC254826. FIG. 1 further provides a conceptual description of a novel bioinformatically detected viral gene of the present invention, referred to here as Viral Genomic Address Messenger 2140 (VGAM2140) viral gene, which modulates expression of respective host target genes thereof, the function and utility of which host target genes is known in the art.

VGAM2140 is a novel bioinformatically detected regulatory, non protein coding, viral micro RNA (miRNA) gene. The method by which VGAM2140 was detected is described hereinabove with reference to FIGS. 1-8.

VGAM2140 gene, herein designated VGAM GENE, is a viral gene contained in the genome of Ectromelia Virus. VGAM2140 host target gene, herein designated VGAM HOST TARGET GENE, is a human gene contained in the human genome.

VGAM2140 gene encodes a VGAM2140 precursor RNA, herein designated VGAM PRECURSOR RNA. Similar to other miRNA genes, and unlike most ordinary genes, VGAM2140 precursor RNA does not encode a protein. A nucleotide sequence identical or highly similar to the nucleotide sequence of VGAM2140 precursor RNA is designated SEQ ID:2126, and is provided hereinbelow with reference to the sequence listing part. Nucleotide sequence SEQ ID:2126 is located at position 172080 relative to the genome of Ectromelia Virus.

VGAM2140 precursor RNA folds onto itself, forming VGAM2140 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2140 folded precursor RNA into VGAM2140 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM2140 RNA is designated SEQ ID:4851, and is provided hereinbelow with reference to the sequence listing part.

VGAM2140 host target gene, herein designated VGAM HOST TARGET GENE, encodes a corresponding messenger RNA, VGAM2140 host target RNA, herein designated VGAM HOST TARGET RNA. VGAM2140 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2140 RNA, herein designated VGAM RNA, binds complementarily to one or more host target binding sites located in untranslated regions of VGAM2140 host target RNA, herein designated VGAM HOST TARGET RNA. This complementary binding is due to the fact that the nucleotide sequence of VGAM2140 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2140 RNA, herein designated VGAM RNA, may have a different number of host target binding sites in untranslated regions of a VGAM2140 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2140 RNA, herein designated VGAM RNA, to host target binding sites on VGAM2140 host target RNA, herein designated VGAM HOST TARGET RNA, such as BINDING SITE I, BINDING SITE II and BINDING SITE III, inhibits translation of VGAM2140 host target RNA into VGAM2140 host target protein, herein designated VGAM HOST TARGET PROTEIN. VGAM host target protein is therefore outlined by a broken line.

It is appreciated that VGAM2140 host target gene, herein designated VGAM HOST TARGET GENE, in fact represents a plurality of VGAM2140 host target genes. The mRNA of each one of this plurality of VGAM2140 host target genes comprises one or more host target binding sites, each having a nucleotide sequence which is at least partly complementary to VGAM2140 RNA, herein designated VGAM RNA, and which when bound by VGAM2140 RNA causes inhibition of translation of respective one or more VGAM2140 host target proteins.

It is further appreciated by one skilled in the art that the mode of translational inhibition illustrated by FIG. 1 with specific reference to translational inhibition exerted by VGAM2140 gene, herein designated VGAM GENE, on one or more VGAM2140 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2140 is inhibition of expression of host target genes, as part of a novel viral mechanism of attacking a host. Accordingly, utilities of VGAM2140 include diagnosis, prevention and treatment of viral infection by Ectromelia Virus. Specific functions, and accordingly utilities, of VGAM2140 correlate with, and may be deduced from, the identity of the host target genes which VGAM2140 binds and inhibits, and the function of these host target genes, as elaborated hereinbelow.

Nucleotide sequences of the VGAM2140 precursor RNA, herein designated VGAM PRECURSOR RNA, and of the 'diced' VGAM2140 RNA, herein designated VGAM RNA, and a schematic representation of the secondary folding of VGAM2140 folded precursor RNA, herein designated VGAM FOLDED PRECURSOR RNA, of VGAM2140 are further described hereinbelow with reference to Table 1.

Nucleotide sequences of host target binding sites, such as BINDING SITE-I, BINDING SITE-II and BINDING SITE-III of FIG. 1, found on VGAM2140 host target RNA, and schematic representation of the complementarity of each of these host target binding sites to VGAM2140 RNA, herein designated VGAM RNA, are described hereinbelow with reference to Table 2.

As mentioned hereinabove with reference to FIG. 1, a function of VGAM2140 gene, herein designated VGAM is inhibition of expression of VGAM2140 target genes. It is appreciated that specific functions, and accordingly utilities, of VGAM2140 correlate with, and may be deduced from, the identity of the target genes which VGAM2140 binds and inhibits, and the function of these target genes, as elaborated hereinbelow.

Bromodomain Adjacent to Zinc Finger Domain, 1A (BAZ1A, Accession NM_013448) is a VGAM2140 host target gene. BAZ1A BINDING SITE is HOST TARGET binding site found in the 3' untranslated region of mRNA encoded by BAZ1A, corresponding to a HOST TARGET binding site such as BINDING SITE I, BINDING SITE II or BINDING SITE III. Table 2 illustrates the complementarity of the nucleotide sequences of BAZ1A BINDING SITE, designated SEQ ID:15115, to the nucleotide sequence of VGAM2140 RNA, herein designated VGAM RNA, also designated SEQ ID:4851.

A function of VGAM2140 is therefore inhibition of Bromodomain Adjacent to Zinc Finger Domain, 1A (BAZ1A, Accession NM_013448), a gene which acts as a chromatin-mediated transcriptional regulator. Accordingly, utilities of VGAM2140 include diagnosis, prevention and treatment of diseases and clinical conditions associated with BAZ1A. The function of BAZ1A has been established by previous studies. Bochar et al. (2000) purified a chromatin-remodeling complex, which they called WCRF, from HeLa nuclear extracts. The purified complex contains 2 proteins, BAZ1A at 180 kD, which they designated WCRF180, and SMARCA5 (OMIM Ref. No. 603375), which they designated WCRF135. Using in vitro ATP-dependent DNase I cleavage of mononucleosomes, they confirmed an ATP-dependent chromatin remodeling activity in the complex. Poot et al. (2000) identified BAZ1A, which they designated ACF1, within a chromatin remodeling complex, CHRAC, purified from HeLa cell nuclear extracts. They confirmed an interaction between BAZ1A and SNF2H (SMARCA5). Two small histone-fold proteins, CHRAC17 (POLE3; 607267) and CHRAC15 (CHRAC1; 607268), copurified with the complex, and the authors showed that these proteins form a DNA-binding heterodimer. Poot et al. (2000) determined that the purified complex could mobilize nucleosomes into a regularly spaced nucleosomal array and that the spacing activity was strictly ATP-dependent.

Full details of the abovementioned studies are described in the following publications, the disclosure of which are hereby incorporated by reference:

Bochar, D. A.; Savard, J.; Wang, W.; Lafleur, D. W.; Moore, P.; Cote, J.; Shiekhattar, R.: A family of chromatin remodeling factors related to Williams syndrome transcription factor. Proc. Nat. Acad. Sci. 97:1038-1043, 2000; and Poot, R. A.; Dellaire, G.; Hulsmann, B. B.; Grimaldi, M. A.; Corona, D. F. V.; Becker, P. B.; Bickmore, W. A.; Varga-Weisz, P. D.: HuCHRAC, a human ISWI chromatin remodelling complex.

Further studies establishing the function and utilities of BAZ1A are found in John Hopkins OMIM database record ID 605680, and in sited publications numbered 507 and 5074 listed in the bibliography section hereinbelow, which are also hereby incorporated by reference. APCL (Accession NM_005883) is another VGAM2140 host target gene. APCL BINDING SITE is HOST TARGET binding site found in the 3' untranslated region of mRNA encoded by APCL, corresponding to a HOST TARGET binding site such as BINDING SITE I, BINDING SITE II or BINDING SITE III. Table 2 illustrates the complementarity of the nucleotide sequences of APCL BINDING SITE, designated SEQ ID:12503, to the nucleotide sequence of VGAM2140 RNA, herein designated VGAM RNA, also designated SEQ ID:4851.

Another function of VGAM2140 is therefore inhibition of APCL (Accession NM_005883). Accordingly, utilities of VGAM2140 include diagnosis, prevention and treatment of diseases and clinical conditions associated with APCL. P5-1 (Accession NM_006674) is another VGAM2140 host target gene. P5-1 BINDING SITE is HOST TARGET binding site found in the 3' untranslated region of mRNA encoded by P5-1, corresponding to a HOST TARGET binding site such as BINDING SITE I, BINDING SITE II or BINDING SITE III. Table 2 illustrates the complementarity of the nucleotide sequences of P5-1 BINDING SITE, designated SEQ ID:13497, to the nucleotide sequence of VGAM2140 RNA, herein designated VGAM RNA, also designated SEQ ID:4851.

Another function of VGAM2140 is therefore inhibition of P5-1 (Accession NM_006674). Accordingly, utilities of VGAM2140 include diagnosis, prevention and treatment of diseases and clinical conditions associated with P5-1. LOC91286 (Accession XM_037444) is another VGAM2140 host target gene. LOC91286 BINDING SITE is HOST TARGET binding site found in the 5' untranslated region of mRNA encoded by LOC91286, corresponding to a HOST TARGET binding site such as BINDING SITE I, BINDING SITE II or BINDING SITE III. Table 2 illustrates the complementarity of the nucleotide sequences of LOC91286 BINDING SITE, designated SEQ ID:32623, to the nucleotide sequence of VGAM2140 RNA, herein designated VGAM RNA, also designated SEQ ID:4851.

Another function of VGAM2140 is therefore inhibition of LOC91286 (Accession XM_037444). Accordingly, utilities of VGAM2140 include diagnosis, prevention and treatment of diseases and clinical conditions associated with LOC91286. FIG. 1 further provides a conceptual description of a novel bioinformatically detected viral gene of the present invention, referred to here as Viral Genomic Address Messenger 2141 (VGAM2141) viral gene, which modulates expression of respective host target genes thereof, the function and utility of which host target genes is known in the art.

VGAM2141 is a novel bioinformatically detected regulatory, non protein coding, viral micro RNA (miRNA) gene. The method by which VGAM2141 was detected is described hereinabove with reference to FIGS. 1-8.

VGAM2141 gene, herein designated VGAM GENE, is a viral gene contained in the genome of Ectromelia Virus. VGAM2141 host target gene, herein designated VGAM HOST TARGET GENE, is a human gene contained in the human genome.

VGAM2141 gene encodes a VGAM2141 precursor RNA, herein designated VGAM PRECURSOR RNA. Similar to other miRNA genes, and unlike most ordinary genes, VGAM2141 precursor RNA does not encode a protein. A nucleotide sequence identical or highly similar to the nucleotide sequence of VGAM2141 precursor RNA is designated SEQ ID:2127, and is provided hereinbelow with reference to the sequence listing part. Nucleotide sequence SEQ ID:2127 is located at position 169712 relative to the genome of Ectromelia Virus.

VGAM2141 precursor RNA folds onto itself, forming VGAM2141 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2141 folded precursor RNA into VGAM2141 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2141 RNA is designated SEQ ID:4852, and is provided hereinbelow with reference to the sequence listing part.

VGAM2141 host target gene, herein designated VGAM HOST TARGET GENE, encodes a corresponding messenger RNA, VGAM2141 host target RNA, herein designated VGAM HOST TARGET RNA. VGAM2141 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2141 RNA, herein designated VGAM RNA, binds complementarily to one or more host target binding sites located in untranslated regions of VGAM2141 host target RNA, herein designated VGAM HOST TARGET RNA. This complementary binding is due to the fact that the nucleotide sequence of VGAM2141 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2141 RNA, herein designated VGAM RNA, may have a different number of host target binding sites in untranslated regions of a VGAM2141 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2141 RNA, herein designated VGAM RNA, to host target binding sites on VGAM2141 host target RNA, herein designated VGAM HOST TARGET RNA, such as BINDING SITE I, BINDING SITE II and BINDING SITE III, inhibits translation of VGAM2141 host target RNA into VGAM2141 host target protein, herein designated VGAM HOST TARGET PROTEIN. VGAM host target protein is therefore outlined by a broken line.

It is appreciated that VGAM2141 host target gene, herein designated VGAM HOST TARGET GENE, in fact represents a plurality of VGAM2141 host target genes. The mRNA of each one of this plurality of VGAM2141 host target genes comprises one or more host target binding sites, each having a nucleotide sequence which is at least partly complementary to VGAM2141 RNA, herein designated VGAM RNA, and which when bound by VGAM2141 RNA causes inhibition of translation of respective one or more VGAM2141 host target proteins.

It is further appreciated by one skilled in the art that the mode of translational inhibition illustrated by FIG. 1 with specific reference to translational inhibition exerted by VGAM2141 gene, herein designated VGAM GENE, on one or more VGAM2141 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2141 is inhibition of expression of host target genes, as part of a novel viral mechanism of attacking a host. Accordingly, utilities of VGAM2141 include diagnosis, prevention and treatment of viral infection by Ectromelia Virus. Specific functions, and accordingly utilities, of VGAM2141 correlate with, and may be deduced from, the identity of the host target genes which VGAM2141 binds and inhibits, and the function of these host target genes, as elaborated hereinbelow.

Nucleotide sequences of the VGAM2141 precursor RNA, herein designated VGAM PRECURSOR RNA, and of the 'diced' VGAM2141 RNA, herein designated VGAM RNA, and a schematic representation of the secondary folding of VGAM2141 folded precursor RNA, herein designated VGAM FOLDED PRECURSOR RNA, of VGAM2141 are further described hereinbelow with reference to Table 1.

Nucleotide sequences of host target binding sites, such as BINDING SITE-I, BINDING SITE-II and BINDING SITE-III of FIG. 1, found on VGAM2141 host target RNA, and schematic representation of the complementarity of each of these host target binding sites to VGAM2141 RNA, herein designated VGAM RNA, are described hereinbelow with reference to Table 2.

As mentioned hereinabove with reference to FIG. 1, a function of VGAM2141 gene, herein designated VGAM is inhibition of expression of VGAM2141 target genes. It is appreciated that specific functions, and accordingly utilities, of VGAM2141 correlate with, and may be deduced from, the identity of the target genes which VGAM2141 binds and inhibits, and the function of these target genes, as elaborated hereinbelow.

ESDN (Accession NM_080927) is a VGAM2141 host target gene. ESDN BINDING SITE is HOST TARGET binding site found in the 3' untranslated region of mRNA encoded by ESDN, corresponding to a HOST TARGET binding site such as BINDING SITE I, BINDING SITE II or BINDING SITE III. Table 2 illustrates the complementarity of the nucleotide sequences of ESDN BINDING SITE, designated SEQ ID:28151, to the nucleotide sequence of VGAM2141 RNA, herein designated VGAM RNA, also designated SEQ ID:4852.

A function of VGAM2141 is therefore inhibition of ESDN (Accession NM_080927). Accordingly, utilities of VGAM2141 include diagnosis, prevention and treatment of diseases and clinical conditions associated with ESDN. KIAA1317 (Accession XM_098368) is another VGAM2141 host target gene. KIAA1317 BINDING SITE is HOST TARGET binding site found in the 3" untranslated region of mRNA encoded by KIAA1317, corresponding to a HOST TARGET binding site such as BINDING SITE I, BINDING SITE II or BINDING SITE III. Table 2 illustrates the complementarity of the nucleotide sequences of KIAA1317 BINDING SITE, designated SEQ ID:41631, to the nucleotide sequence of VGAM2141 RNA, herein designated VGAM RNA, also designated SEQ ID:4852.

Another function of VGAM2141 is therefore inhibition of KIAA1317 (Accession XM_098368). Accordingly, utilities of VGAM2141 include diagnosis, prevention and treatment of diseases and clinical conditions associated with KIAA1317. LOC158295 (Accession XM_098915) is another VGAM2141 host target gene. LOC158295 BINDING SITE is HOST TARGET binding site found in the 5' untranslated region of mRNA encoded by LOC158295, corresponding to a HOST TARGET binding site such as BINDING SITE I, BINDING SITE II or BINDING SITE III. Table 2 illustrates the complementarity of the nucleotide sequences of LOC158295 BINDING SITE, designated SEQ ID:41939, to the nucleotide sequence of VGAM2141 RNA, herein designated VGAM RNA, also designated SEQ ID:4852.

Another function of VGAM2141 is therefore inhibition of LOC158295 (Accession XM_098915). Accordingly, utilities of VGAM2141 include diagnosis, prevention and treatment of diseases and clinical conditions associated with LOC158295. FIG. 1 further provides a conceptual description of a novel bioinformatically detected viral gene of the present invention, referred to here as Viral Genomic Address Messenger 2142 (VGAM2142) viral gene, which modulates expression of respective host target genes thereof, the function and utility of which host target genes is known in the art.

VGAM2142 is a novel bioinformatically detected regulatory, non protein coding, viral micro RNA (miRNA) gene. The method by which VGAM2142 was detected is described hereinabove with reference to FIGS. 1-8.

VGAM2142 gene, herein designated VGAM GENE, is a viral gene contained in the genome of Ectromelia Virus. VGAM2142 host target gene, herein designated VGAM HOST TARGET GENE, is a human gene contained in the human genome.

VGAM2142 gene encodes a VGAM2142 precursor RNA, herein designated VGAM PRECURSOR RNA. Similar to other miRNA genes, and unlike most ordinary genes, VGAM2142 precursor RNA does not encode a protein. A nucleotide sequence identical or highly similar to the nucleotide sequence of VGAM2142 precursor RNA is designated SEQ ID:2128, and is provided hereinbelow with reference to the sequence listing part. Nucleotide sequence SEQ ID:2128 is located at position 168447 relative to the genome of Ectromelia Virus.

VGAM2142 precursor RNA folds onto itself, forming VGAM2142 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2142 folded precursor RNA into VGAM2142 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2142 RNA is designated SEQ ID:4853, and is provided hereinbelow with reference to the sequence listing part.

VGAM2142 host target gene, herein designated VGAM HOST TARGET GENE, encodes a corresponding messenger RNA, VGAM2142 host target RNA, herein designated VGAM HOST TARGET RNA. VGAM2142 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2142 RNA, herein designated VGAM RNA, binds complementarily to one or more host target binding sites located in untranslated regions of VGAM2142 host target RNA, herein designated VGAM HOST TARGET RNA. This complementary binding is due to the fact that the nucleotide sequence of VGAM2142 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2142 RNA, herein designated VGAM RNA, may have a different number of host target binding sites in untranslated regions of a VGAM2142 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2142 RNA, herein designated VGAM RNA, to host target binding sites on VGAM2142 host target RNA, herein designated VGAM HOST TARGET RNA, such as BINDING SITE I, BINDING SITE II and BINDING SITE III, inhibits translation of VGAM2142 host target RNA into VGAM2142 host target protein, herein designated VGAM HOST TARGET PROTEIN. VGAM host target protein is therefore outlined by a broken line.

It is appreciated that VGAM2142 host target gene, herein designated VGAM HOST TARGET GENE, in fact represents a plurality of VGAM2142 host target genes. The mRNA of each one of this plurality of VGAM2142 host target genes comprises one or more host target binding sites, each having a nucleotide sequence which is at least partly complementary to VGAM2142 RNA, herein designated VGAM RNA, and which when bound by VGAM2142 RNA causes inhibition of translation of respective one or more VGAM2142 host target proteins.

It is further appreciated by one skilled in the art that the mode of translational inhibition illustrated by FIG. 1 with specific reference to translational inhibition exerted by VGAM2142 gene, herein designated VGAM GENE, on one or more VGAM2142 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2142 is inhibition of expression of host target genes, as part of a novel viral mechanism of attacking a host. Accordingly, utilities of VGAM2142 include diagnosis, prevention and treatment of viral infection by Ectromelia Virus. Specific functions, and accordingly utilities, of VGAM2142 correlate with, and may be deduced from, the identity of the host target genes which VGAM2142 binds and inhibits, and the function of these host target genes, as elaborated hereinbelow.

Nucleotide sequences of the VGAM2142 precursor RNA, herein designated VGAM PRECURSOR RNA, and of the 'diced' VGAM2142 RNA, herein designated VGAM RNA, and a schematic representation of the secondary folding of VGAM2142 folded precursor RNA, herein designated VGAM FOLDED PRECURSOR RNA, of VGAM2142 are further described hereinbelow with reference to Table 1.

Nucleotide sequences of host target binding sites, such as BINDING SITE-I, BINDING SITE-II and BINDING SITE-III of FIG. 1, found on VGAM2142 host target RNA, and schematic representation of the complementarity of each of these host target binding sites to VGAM2142 RNA, herein designated VGAM RNA, are described hereinbelow with reference to Table 2.

As mentioned hereinabove with reference to FIG. 1, a function of VGAM2142 gene, herein designated VGAM is inhibition of expression of VGAM2142 target genes. It is appreciated that specific functions, and accordingly utilities, of VGAM2142 correlate with, and may be deduced from, the identity of the target genes which VGAM2142 binds and inhibits, and the function of these target genes, as elaborated hereinbelow.

Dihydrolipoamide Branched Chain Transacylase (E2 component of branched chain keto acid dehydrogenase complex; maple syrup urine disease) (DBT, Accession NM_001918) is a VGAM2142 host target gene. DBT BINDING SITE is HOST TARGET binding site found in the 3' untranslated region of mRNA encoded by DBT, corresponding to a HOST TARGET binding site such as BINDING SITE I, BINDING SITE II or BINDING SITE III. Table 2 illustrates the complementarity of the nucleotide sequences of DBT BINDING SITE, designated SEQ ID:7634, to the nucleotide sequence of VGAM2142 RNA, herein designated VGAM RNA, also designated SEQ ID:4853.

A function of VGAM2142 is therefore inhibition of Dihydrolipoamide Branched Chain Transacylase (E2 component of branched chain keto acid dehydrogenase complex; maple syrup urine disease) (DBT, Accession NM_001918). Accordingly, utilities of VGAM2142 include diagnosis, prevention and treatment of diseases and clinical conditions associated with DBT. Replication Factor C (activator 1) 1, 145 kDa (RFC1, Accession NM_002913) is another VGAM2142 host target gene. RFC1 BINDING SITE is HOST TARGET binding site found in the 3' untranslated region of mRNA encoded by RFC1, corresponding to a HOST TARGET binding site such as BINDING SITE I, BINDING SITE II or BINDING SITE III. Table 2 illustrates the complementarity of the nucleotide sequences of RFC1 BINDING SITE, designated SEQ ID:8817, to the nucleotide sequence of VGAM2142 RNA, herein designated VGAM RNA, also designated SEQ ID:4853.

Another function of VGAM2142 is therefore inhibition of Replication Factor C (activator 1) 1, 145 kDa (RFC1, Accession NM_002913), a gene which plays a role in dna transcription, replication and/or repair. Accordingly, utilities of VGAM2142 include diagnosis, prevention and treatment of diseases and clinical conditions associated with RFC1. The function of RFC1 and its association with various diseases and clinical conditions, has been established by previous studies, as described hereinabove with reference to VGAM217. Suppressor of Cytokine Signaling 5 (SOCS5, Accession NM_014011) is another VGAM2142 host target gene. SOCS5 BINDING SITE is HOST TARGET binding site found in the 3' untranslated region of mRNA encoded by SOCS5, corresponding to a HOST TARGET binding site such as BINDING SITE I, BINDING SITE II or BINDING SITE III. Table 2 illustrates the complementarity of the nucleotide sequences of SOCS5 BINDING SITE, designated SEQ ID:15232, to the nucleotide sequence of VGAM2142 RNA, herein designated VGAM RNA, also designated SEQ ID:4853.

Another function of VGAM2142 is therefore inhibition of Suppressor of Cytokine Signaling 5 (SOCS5, Accession NM_014011). Accordingly, utilities of VGAM2142 include diagnosis, prevention and treatment of diseases and clinical conditions associated with SOCS5. KIAA1376 (Accession XM_033042) is another VGAM2142 host target gene. KIAA1376 BINDING SITE is HOST TARGET binding site found in the 3' untranslated region of mRNA encoded by KIAA1376, corresponding to a HOST TARGET binding site such as BINDING SITE I, BINDING SITE II or BINDING SITE III. Table 2 illustrates the complementarity of the nucleotide sequences of KIAA1376 BINDING SITE, designated SEQ ID:31822, to the nucleotide sequence of VGAM2142 RNA, herein designated VGAM RNA, also designated SEQ ID:4853.

Another function of VGAM2142 is therefore inhibition of KIAA1376 (Accession XM_033042). Accordingly, utilities of VGAM2142 include diagnosis, prevention and treatment of diseases and clinical conditions associated with KIAA1376. KIAA1617 (Accession XM_166140) is another VGAM2142 host target gene. KIAA1617 BINDING SITE is HOST TARGET binding site found in the 3' untranslated region of mRNA encoded by KIAA1617, corresponding to a HOST TARGET binding site such as BINDING SITE I, BINDING SITE II or BINDING SITE III. Table 2 illustrates the complementarity of the nucleotide sequences of KIAA1617 BINDING SITE, designated SEQ ID:43945, to the nucleotide sequence of VGAM2142 RNA, herein designated VGAM RNA, also designated SEQ ID:4853.

Another function of VGAM2142 is therefore inhibition of KIAA1617 (Accession XM_166140). Accordingly, utilities of VGAM2142 include diagnosis, prevention and treatment of diseases and clinical conditions associated with KIAA1617. NYD-SP20 (Accession NM_032598) is another VGAM2142 host target gene. NYD-SP20 BINDING SITE is HOST TARGET binding site found in the 5' untranslated region of mRNA encoded by NYD-SP20, corresponding to a HOST TARGET binding site such as BINDING SITE I, BINDING SITE II or BINDING SITE III. Table 2 illustrates the complementarity of the nucleotide sequences of NYD-SP20 BINDING SITE, designated SEQ ID:26328, to the nucleotide sequence of VGAM2142 RNA, herein designated VGAM RNA, also designated SEQ ID:4853.

Another function of VGAM2142 is therefore inhibition of NYD-SP20 (Accession NM_032598). Accordingly, utilities of VGAM2142 include diagnosis, prevention and treatment of diseases and clinical conditions associated with NYD-SP20. TGFB Inducible Early Growth Response (TIEG, Accession NM_005655) is another VGAM2142 host target gene. TIEG BINDING SITE is HOST TARGET binding site found in the 3' untranslated region of mRNA encoded by TIEG, corresponding to a HOST TARGET binding site such as BINDING SITE I, BINDING SITE II or BINDING SITE III. Table 2 illustrates the complementarity of the nucleotide sequences of TIEG BINDING SITE, designated SEQ ID:12193, to the nucleotide sequence of VGAM2142 RNA, herein designated VGAM RNA, also designated SEQ ID:4853.

Another function of VGAM2142 is therefore inhibition of TGFB Inducible Early Growth Response (TIEG, Accession NM_005655). Accordingly, utilities of VGAM2142 include diagnosis, prevention and treatment of diseases and clinical conditions associated with TIEG. LOC51339 (Accession NM_016651) is another VGAM2142 host target gene. LOC51339 BINDING SITE is HOST TARGET binding site found in the 3' untranslated region of mRNA encoded by LOC51339, corresponding to a HOST TARGET binding site such as BINDING SITE I, BINDING SITE II or BINDING SITE III. Table 2 illustrates the complementarity of the nucleotide sequences of LOC51339 BINDING SITE, designated SEQ ID:18768, to the nucleotide sequence of VGAM2142 RNA, herein designated VGAM RNA, also designated SEQ ID:4853.

Another function of VGAM2142 is therefore inhibition of LOC51339 (Accession NM_016651). Accordingly, utilities of VGAM2142 include diagnosis, prevention and treatment of diseases and clinical conditions associated with LOC51339. FIG. 1 further provides a conceptual description of a novel bioinformatically detected viral gene of the present invention, referred to here as Viral Genomic Address Messenger 2143 (VGAM2143) viral gene, which modulates expression of respective host target genes thereof, the function and utility of which host target genes is known in the art.

VGAM2143 is a novel bioinformatically detected regulatory, non protein coding, viral micro RNA (miRNA) gene. The method by which VGAM2143 was detected is described hereinabove with reference to FIGS. 1-8.

VGAM2143 gene, herein designated VGAM GENE, is a viral gene contained in the genome of Ectromelia Virus. VGAM2143 host target gene, herein designated VGAM HOST TARGET GENE, is a human gene contained in the human genome.

VGAM2143 gene encodes a VGAM2143 precursor RNA, herein designated VGAM PRECURSOR RNA. Similar to other miRNA genes, and unlike most ordinary genes, VGAM2143 precursor RNA does not encode a protein. A nucleotide sequence identical or highly similar to the nucleotide sequence of VGAM2143 precursor RNA is designated SEQ ID:2129, and is provided hereinbelow with reference to the sequence listing part. Nucleotide sequence SEQ ID:2129 is located at position 165143 relative to the genome of Ectromelia Virus.

VGAM2143 precursor RNA folds onto itself, forming VGAM2143 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2143 folded precursor RNA into VGAM2143 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2143 RNA is designated SEQ ID:4854, and is provided hereinbelow with reference to the sequence listing part.

VGAM2143 host target gene, herein designated VGAM HOST TARGET GENE, encodes a corresponding messenger RNA, VGAM2143 host target RNA, herein designated VGAM HOST TARGET RNA. VGAM2143 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2143 RNA, herein designated VGAM RNA, binds complementarily to one or more host target binding sites located in untranslated regions of VGAM2143 host target RNA, herein designated VGAM HOST TARGET RNA. This complementary binding is due to the fact that the nucleotide sequence of VGAM2143 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2143 RNA, herein designated VGAM RNA, may have a different number of host target binding sites in untranslated regions of a VGAM2143 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2143 RNA, herein designated VGAM RNA, to host target binding sites on VGAM2143 host target RNA, herein designated VGAM HOST TARGET RNA, such as BINDING SITE I, BINDING SITE II and BINDING SITE III, inhibits translation of VGAM2143 host target RNA into VGAM2143 host target protein, herein designated VGAM HOST TARGET PROTEIN. VGAM host target protein is therefore outlined by a broken line.

It is appreciated that VGAM2143 host target gene, herein designated VGAM HOST TARGET GENE, in fact represents a plurality of VGAM2143 host target genes. The mRNA of each one of this plurality of VGAM2143 host target genes comprises one or more host target binding sites, each having a nucleotide sequence which is at least partly complementary to VGAM2143 RNA, herein designated VGAM RNA, and which when bound by VGAM2143 RNA causes inhibition of translation of respective one or more VGAM2143 host target proteins.

It is further appreciated by one skilled in the art that the mode of translational inhibition illustrated by FIG. 1 with specific reference to translational inhibition exerted by VGAM2143 gene, herein designated VGAM GENE, on one or more VGAM2143 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2143 is inhibition of expression of host target genes, as part of a novel viral mechanism of attacking a host. Accordingly, utilities of VGAM2143 include diagnosis, prevention and treatment of viral infection by Ectromelia Virus. Specific functions, and accordingly utilities, of VGAM2143 correlate with, and may be deduced from, the identity of the host target genes which VGAM2143 binds and inhibits, and the function of these host target genes, as elaborated hereinbelow.

Nucleotide sequences of the VGAM2143 precursor RNA, herein designated VGAM PRECURSOR RNA, and of the 'diced' VGAM2143 RNA, herein designated VGAM RNA, and a schematic representation of the secondary folding of VGAM2143 folded precursor RNA, herein designated VGAM FOLDED PRECURSOR RNA, of VGAM2143 are further described hereinbelow with reference to Table 1.

Nucleotide sequences of host target binding sites, such as BINDING SITE-I, BINDING SITE-II and BINDING SITE-III of FIG. 1, found on VGAM2143 host target RNA, and schematic representation of the complementarity of each of these host target binding sites to VGAM2143 RNA, herein designated VGAM RNA, are described hereinbelow with reference to Table 2.

As mentioned hereinabove with reference to FIG. 1, a function of VGAM2143 gene, herein designated VGAM is inhibition of expression of VGAM2143 target genes. It is appreciated that specific functions, and accordingly utilities, of VGAM2143 correlate with, and may be deduced from, the identity of the target genes which VGAM2143 binds and inhibits, and the function of these target genes, as elaborated hereinbelow.

Espin (ESPN, Accession NM_031475) is a VGAM2143 host target gene. ESPN BINDING SITE is HOST TARGET binding site found in the 3' untranslated region of mRNA encoded by ESPN, corresponding to a HOST TARGET binding site such as BINDING SITE I, BINDING SITE II or BINDING SITE III. Table 2 illustrates the complementarity of the nucleotide sequences of ESPN BINDING SITE, designated SEQ ID:25548, to the nucleotide sequence of VGAM2143 RNA, herein designated VGAM RNA, also designated SEQ ID:4854.

A function of VGAM2143 is therefore inhibition of Espin (ESPN, Accession NM_031475), a gene which a membrane-cytoskeletal assemblages. Accordingly, utilities of VGAM2143 include diagnosis, prevention and treatment of diseases and clinical conditions associated with ESPN. The function of ESPN and its association with various diseases and clinical conditions, has been established by previous studies, as described hereinabove with reference to VGAM1006. Glucocorticoid Receptor DNA Binding Factor 1 (GRLF1, Accession XM_085943) is another VGAM2143 host target gene. GRLF1 BINDING SITE is HOST TARGET binding site found in the 3' untranslated region of mRNA encoded by GRLF1, corresponding to a HOST TARGET binding site such as BINDING SITE I, BINDING SITE II or BINDING SITE III. Table 2 illustrates the complementarity of the nucleotide sequences of GRLF1 BINDING SITE, designated SEQ ID:38407, to the nucleotide sequence of VGAM2143 RNA, herein designated VGAM RNA, also designated SEQ ID:4854.

Another function of VGAM2143 is therefore inhibition of Glucocorticoid Receptor DNA Binding Factor 1 (GRLF1, Accession XM_085943), a gene which inhibits transcription of the glucocorticoid receptor gene. Accordingly, utilities of VGAM2143 include diagnosis, prevention and treatment of diseases and clinical conditions associated with GRLF1. The function of GRLF1 and its association with various diseases and clinical conditions, has been established by previous studies, as described hereinabove with reference to VGAM55. Integrin, Alpha 2 (CD49B, alpha 2 subunit of VLA-2 receptor) (ITGA2, Accession NM_002203) is another VGAM2143 host target gene. ITGA2 BINDING SITE is HOST TARGET binding site found in the 3' untranslated region of mRNA encoded by ITGA2, corresponding to a HOST TARGET binding site such as BINDING SITE I, BINDING SITE II or BINDING SITE III. Table 2 illustrates the complementarity of the nucleotide sequences of ITGA2 BINDING SITE, designated SEQ ID:7962, to the nucleotide sequence of VGAM2143 RNA, herein designated VGAM RNA, also designated SEQ ID:4854.

Another function of VGAM2143 is therefore inhibition of Integrin, Alpha 2 (CD49B, alpha 2 subunit of VLA-2 receptor) (ITGA2, Accession NM_002203), a gene which has roles in blood clotting and angiogenesis, acts as a collagen and laminin receptor. Accordingly, utilities of VGAM2143 include diagnosis, prevention and treatment of diseases and clinical conditions associated with ITGA2. The function of ITGA2 and its association with various diseases and clinical conditions, has been established by previous studies, as described hereinabove with reference to VGAM827. Wilms Tumor 1 (WT1, Accession NM_024424) is another VGAM2143 host target gene. WT1 BINDING SITE1 through WT1 BINDING SITE4 are HOST TARGET binding sites found in untranslated regions of mRNA encoded by WT1, corresponding to HOST TARGET binding sites such as BINDING SITE I, BINDING SITE II or BINDING SITE III. Table 2 illustrates the complementarity of the nucleotide sequences of WT1 BINDING SITE1 through WT1 BINDING SITE4, designated SEQ ID:23667, SEQ ID:23671, SEQ ID:23675 and SEQ ID:5951 respectively, to the nucleotide sequence of VGAM2143 RNA, herein designated VGAM RNA, also designated SEQ ID:4854.

Another function of VGAM2143 is therefore inhibition of Wilms Tumor 1 (WT1, Accession NM_024424). Accordingly, utilities of VGAM2143 include diagnosis, prevention and treatment of diseases and clinical conditions associated with WT1. KIAA0993 (Accession XM_034413) is another VGAM2143 host target gene. KIAA0993 BINDING SITE is HOST TARGET binding site found in the 3' untranslated region of mRNA encoded by KIAA0993, corresponding to a HOST TARGET binding site such as BINDING SITE I, BINDING SITE II or BINDING SITE III. Table 2 illustrates the complementarity of the nucleotide sequences of KIAA0993 BINDING SITE, designated SEQ ID:32083, to the nucleotide sequence of VGAM2143 RNA, herein designated VGAM RNA, also designated SEQ ID:4854.

Another function of VGAM2143 is therefore inhibition of KIAA0993 (Accession XM_034413). Accordingly, utilities of VGAM2143 include diagnosis, prevention and treatment of diseases and clinical conditions associated with KIAA0993. KIAA1416 (Accession XM_098762) is another VGAM2143 host target gene. KIAA1416 BINDING SITE is HOST TARGET binding site found in the 5' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41797, to the nucleotide sequence of VGAM2143 RNA, herein designated VGAM RNA, also designated SEQ ID:4854.

Another function of VGAM2143 is therefore inhibition of KIAA1416 (Accession XM_098762). Accordingly, utilities of VGAM2143 include diagnosis, prevention and treatment of diseases and clinical conditions associated with KIAA1416. My015 (Accession XM_039512) is another VGAM2143 host target gene. My015 BINDING SITE is HOST TARGET binding site found in the 3' untranslated region of mRNA encoded by My015, corresponding to a HOST TARGET binding site such as BINDING SITE I, BINDING SITE II or BINDING SITE III. Table 2 illustrates the complementarity of the nucleotide sequences of My015 BINDING SITE, designated SEQ ID:33103, to the nucleotide sequence of VGAM2143 RNA, herein designated VGAM RNA, also designated SEQ ID:4854.

Another function of VGAM2143 is therefore inhibition of My015 (Accession XM_039512). Accordingly, utilities of VGAM2143 include diagnosis, prevention and treatment of diseases and clinical conditions associated with My015. Ras Association (RalGDS/AF-6) Domain Family 2 (RASSF2, Accession NM_014737) is another VGAM2143 host target gene. RASSF2 BINDING SITE is HOST TARGET binding site found in the 3' untranslated region of mRNA encoded by RASSF2, corresponding to a HOST TARGET binding site such as BINDING SITE I, BINDING SITE II or BINDING SITE III. Table 2 illustrates the complementarity of the nucleotide sequences of RASSF2 BINDING SITE, designated SEQ ID:16388, to the nucleotide sequence of VGAM2143 RNA, herein designated VGAM RNA, also designated SEQ ID:4854.

Another function of VGAM2143 is therefore inhibition of Ras Association (RalGDS/AF-6) Domain Family 2 (RASSF2, Accession NM_014737). Accordingly, utilities of VGAM2143 include diagnosis, prevention and treatment of diseases and clinical conditions associated with RASSF2. Tumor Protein P53 Inducible Nuclear Protein 1 (TP53INP1, Accession NM_033285) is another VGAM2143 host target gene. TP53INP1 BINDING SITE1 and TP53INP1 BINDING SITE2 are HOST TARGET binding sites found in untranslated regions of mRNA encoded by TP53INP1, corresponding to HOST TARGET binding sites such as BINDING SITE I, BINDING SITE II or BINDING SITE III. Table 2 illustrates the complementarity of the nucleotide sequences of TP53INP1 BINDING SITE1 and TP53INP1 BINDING SITE2, designated SEQ ID:27101 and SEQ ID:36112 respectively, to the nucleotide sequence of VGAM2143 RNA, herein designated VGAM RNA, also designated SEQ ID:4854.

Another function of VGAM2143 is therefore inhibition of Tumor Protein P53 Inducible Nuclear Protein 1 (TP53INP1, Accession NM_033285). Accordingly, utilities of VGAM2143 include diagnosis, prevention and treatment of diseases and clinical conditions associated with TP53INP1. LOC157503 (Accession XM_098767) is another VGAM2143 host target gene. LOC157503 BINDING SITE is HOST TARGET binding site found in the 3' untranslated region of mRNA encoded by LOC157503, corresponding to a HOST TARGET binding site such as BINDING SITE I, BINDING SITE II or BINDING SITE III. Table 2 illustrates the complementarity of the nucleotide sequences of LOC157503 BINDING SITE, designated SEQ ID:41815, to the nucleotide sequence of VGAM2143 RNA, herein designated VGAM RNA, also designated SEQ ID:4854.

Another function of VGAM2143 is therefore inhibition of LOC157503 (Accession XM_098767). Accordingly, utilities of VGAM2143 include diagnosis, prevention and treatment of diseases and clinical conditions associated with LOC157503. FIG. 1 further provides a conceptual description of a novel bioinformatically detected viral gene of the present invention, referred to here as Viral Genomic Address Messenger 2144 (VGAM2144) viral gene, which modulates expression of respective host target genes thereof, the function and utility of which host target genes is known in the art.

VGAM2144 is a novel bioinformatically detected regulatory, non protein coding, viral micro RNA (miRNA) gene. The method by which VGAM2144 was detected is described hereinabove with reference to FIGS. 1-8.

VGAM2144 gene, herein designated VGAM GENE, is a viral gene contained in the genome of Ectromelia Virus. VGAM2144 host target gene, herein designated VGAM HOST TARGET GENE, is a human gene contained in the human genome.

VGAM2144 gene encodes a VGAM2144 precursor RNA, herein designated VGAM PRECURSOR RNA. Similar to other miRNA genes, and unlike most ordinary genes, VGAM2144 precursor RNA does not encode a protein. A nucleotide sequence identical or highly similar to the nucleotide sequence of VGAM2144 precursor RNA is designated SEQ ID:2130, and is provided hereinbelow with reference to the sequence listing part. Nucleotide sequence SEQ ID:2130 is located at position 168263 relative to the genome of Ectromelia Virus.

VGAM2144 precursor RNA folds onto itself, forming VGAM2144 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2144 folded precursor RNA into VGAM2144 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2144 RNA is designated SEQ ID:4855, and is provided hereinbelow with reference to the sequence listing part.

VGAM2144 host target gene, herein designated VGAM HOST TARGET GENE, encodes a corresponding messenger RNA, VGAM2144 host target RNA, herein designated VGAM HOST TARGET RNA. VGAM2144 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2144 RNA, herein designated VGAM RNA, binds complementarily to one or more host target binding sites located in untranslated regions of VGAM2144 host target RNA, herein designated VGAM HOST TARGET RNA. This complementary binding is due to the fact that the nucleotide sequence of VGAM2144 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2144 RNA, herein designated VGAM RNA, may have a different number of host target binding sites in untranslated regions of a VGAM2144 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2144 RNA, herein designated VGAM RNA, to host target binding sites on VGAM2144 host target RNA, herein designated VGAM HOST TARGET RNA, such as BINDING SITE I, BINDING SITE II and BINDING SITE III, inhibits translation of VGAM2144 host target RNA into VGAM2144 host target protein, herein designated VGAM HOST TARGET PROTEIN. VGAM host target protein is therefore outlined by a broken line.

It is appreciated that VGAM2144 host target gene, herein designated VGAM HOST TARGET GENE, in fact represents a plurality of VGAM2144 host target genes. The mRNA of each one of this plurality of VGAM2144 host target genes comprises one or more host target binding sites, each having a nucleotide sequence which is at least partly complementary to VGAM2144 RNA, herein designated VGAM RNA, and which when bound by VGAM2144 RNA causes inhibition of translation of respective one or more VGAM2144 host target proteins.

It is further appreciated by one skilled in the art that the mode of translational inhibition illustrated by FIG. 1 with specific reference to translational inhibition exerted by VGAM2144 gene, herein designated VGAM GENE, on one or more VGAM2144 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2144 is inhibition of expression of host target genes, as part of a novel viral mechanism of attacking a host. Accordingly, utilities of VGAM2144 include diagnosis, prevention and treatment of viral infection by Ectromelia Virus. Specific functions, and accordingly utilities, of VGAM2144 correlate with, and may be deduced from, the identity of the host target genes which VGAM2144 binds and inhibits, and the function of these host target genes, as elaborated hereinbelow.

Nucleotide sequences of the VGAM2144 precursor RNA, herein designated VGAM PRECURSOR RNA, and of the 'diced' VGAM2144 RNA, herein designated VGAM RNA, and a schematic representation of the secondary folding of VGAM2144 folded precursor RNA, herein designated VGAM FOLDED PRECURSOR RNA, of VGAM2144 are further described hereinbelow with reference to Table 1.

Nucleotide sequences of host target binding sites, such as BINDING SITE-I, BINDING SITE-II and BINDING SITE-III of FIG. 1, found on VGAM2144 host target RNA, and schematic representation of the complementarity of each of these host target binding sites to VGAM2144 RNA, herein designated VGAM RNA, are described hereinbelow with reference to Table 2.

As mentioned hereinabove with reference to FIG. 1, a function of VGAM2144 gene, herein designated VGAM is inhibition of expression of VGAM2144 target genes. It is appreciated that specific functions, and accordingly utilities, of VGAM2144 correlate with, and may be deduced from, the identity of the target genes which VGAM2144 binds and inhibits, and the function of these target genes, as elaborated hereinbelow.

ATPase, Class VI, Type 11A (ATP11A, Accession XM_085028) is a VGAM2144 host target gene. ATP11A BINDING SITE is HOST TARGET binding site found in the 3' untranslated region of mRNA encoded by ATP11A, corresponding to a HOST TARGET binding site such as BINDING SITE I, BINDING SITE II or BINDING SITE III. Table 2 illustrates the complementarity of the nucleotide sequences of ATP11A BINDING SITE, designated SEQ ID:37808, to the nucleotide sequence of VGAM2144 RNA, herein designated VGAM RNA, also designated SEQ ID:4855.

A function of VGAM2144 is therefore inhibition of ATPase, Class VI, Type 11A (ATP11A, Accession XM_085028). Accordingly, utilities of VGAM2144 include diagnosis, prevention and treatment of diseases and clinical conditions associated with ATP11A. Chemokine (C-X-C motif) Receptor 6 (CXCR6, Accession NM_006564) is another VGAM2144 host target gene. CXCR6 BINDING SITE is HOST TARGET binding site found in the 3' untranslated region of mRNA encoded by CXCR6, corresponding to a HOST TARGET binding site such as BINDING SITE I, BINDING SITE II or BINDING SITE III. Table 2 illustrates the complementarity of the nucleotide sequences of CXCR6 BINDING SITE, designated SEQ ID:13333, to the nucleotide sequence of VGAM2144 RNA, herein designated VGAM RNA, also designated SEQ ID:4855.

Another function of VGAM2144 is therefore inhibition of Chemokine (C-X-C motif) Receptor 6 (CXCR6, Accession NM_006564), a gene which probably interacts between dendritic cells and T cells and regulates T-cell migration. Accordingly, utilities of VGAM2144 include diagnosis, prevention and treatment of diseases and clinical conditions associated with CXCR6. The function of CXCR6 has been established by previous studies. By RT-PCR on tumor-infiltrating lymphocyte lines with degenerate primers based on sequences of known chemokine receptors, Liao et al. (1997) isolated a cDNA encoding a GPCR, which they designated STRL33. Using an expression cloning strategy with a T-cell cDNA library, Deng et al. (1997) isolated an identical cDNA that they named BONZO. The predicted 342-amino acid STRL33/BONZO protein shares 25 to 30% amino acid identity with other chemokine receptors and is most similar to other GPCRs in the transmembrane domains. Northern blot analysis detected a 2.1-kb transcript in spleen, thymus, small intestine, and to a lesser extent in peripheral blood leukocytes, prostate, and colon; a 2.6-kb transcript was detected in placenta (Deng et al., 1997). By fluorometric calcium flux analysis, Liao et al. (1997) were unable to detect responses in STRL33-expressing cells to a variety of chemokines. However, coexpression of CD4 and STRL33/BONZO rendered cells able to fuse with macrophage-tropic HIV-1 (transmission-type) strains as well as with simian immunodeficiency virus. Liao et al. (1997) but not Deng et al. (1997) also detected fusion with T-cell-tropic HIV-1 strains. Liao et al. (1997) and Deng et al. (1997) speculated that expression of STRL33/BONZO may substitute for other HIV coreceptors, for example in CCR5 -/- individuals who become infected with HIV. By expression cloning of mouse Cxcl16 (OMIM Ref. No. 605398), Matloubian et al. (2000) identified a protein with 71% amino acid identity to human BONZO, which they renamed CXCR6. Human and mouse cells expressing CXCR6 showed a strong chemotactic response to CXCL16 but not to other chemokines. The authors concluded that CXCL16 and CXCR6 probably function in interactions between dendritic cells and T cells and in regulating T-cell migration in the splenic red pulp.

Full details of the abovementioned studies are described in the following publications, the disclosure of which are hereby incorporated by reference:

Liao, F.; Alkhatib, G.; Peden, K. W. C.; Sharma, G.; Berger, E. A.; Farber, J. M.: STRL33, a novel chemokine receptor-like protein, functions as a fusion cofactor for both macrophage-tropic and T cell line-tropic HIV-1. J. Exp. Med. 185: 2015-2023, 1997; and Matloubian, M.; David, A.; Engel, S.; Ryan, J. E.; Cyster, J. G.: A transmembrane CXC chemokine is a ligand for HIV-coreceptor Bonzo. Nature Immun. 1:298-304, 2000.

Further studies establishing the function and utilities of CXCR6 are found in John Hopkins OMIM database record ID 605163, and in sited publications numbered 4392-4394 listed in the bibliography section hereinbelow, which are also hereby incorporated by reference. DNA-damage-inducible Transcript 3 (DDIT3, Accession NM_004083) is another VGAM2144 host target gene. DDIT3 BINDING SITE is HOST TARGET binding site found in the 5' untranslated region of mRNA encoded by DDIT3, corresponding to a HOST TARGET binding site such as BINDING SITE I, BINDING SITE II or BINDING SITE III. Table 2 illustrates the complementarity of the nucleotide sequences of DDIT3 BINDING SITE, designated SEQ ID:10287, to the nucleotide sequence of VGAM2144 RNA, herein designated VGAM RNA, also designated SEQ ID:4855.

Another function of VGAM2144 is therefore inhibition of DNA-damage-inducible Transcript 3 (DDIT3, Accession NM_004083), a gene which May be a transcription factor and inhibits the DNA-binding activity of C/EBP and LAP. Accordingly, utilities of VGAM2144 include diagnosis, prevention and treatment of diseases and clinical conditions associated with DDIT3. The function of DDIT3 has been established by previous studies. CHOP is consistently rearranged in myxoid liposarcomas (Aman et al., 1992). In the characteristic chromosomal translocation t (12;16)(q13; p11), Crozat et al. (1993) showed that the CHOP gene is fused with a gene on chromosome 16 provisionally designated TLS (for 'translocated in liposarcoma'). The same gene was called FUS by Rabbitts et al. (1993); see 137070. The TLS gene was found to be a novel nuclear RNA-binding protein with extensive sequence similarity to EWS (OMIM Ref. No. 133450), the product of a gene commonly translocated in Ewing sarcoma. In TLS-CHOP, the RNA-binding domain of TLS is replaced by the DNA-binding and leucine zipper dimerization domain of CHOP. Targeting of a conserved effector domain of RNA-binding proteins to DNA may play a role in tumor formation. In an analysis of peripheral blood samples from 19 patients with myxoid liposarcoma due to t (12;16) and in 1 patient with myxoid liposarcoma due to t (12;22;20), resulting in the fusion of the CHOP and EWS genes, Panagopoulos et al. (1996) found FUS/CHOP hybrid fragments in 3 patients with t (12;16) and a EWS/CHOP hybrid in the patient with the latter translocation.

Full details of the abovementioned studies are described in the following publications, the disclosure of which are hereby incorporated by reference:

Crozat, A.; Aman, P.; Mandahl, N.; Ron, D.: Fusion of CHOP to a novel RNA-binding protein in human myxoid liposarcoma. Nature 363:640-644, 1993; and Panagopoulos, I.; Aman, P.; Mertens, F.; Mandahl, N.; Rydholm, A.; Bauer, H. F. C.; Mitelman, F.: Genomic PCR detects tumor cells in peripheral blood from patients with myxoid liposarco.

Further studies establishing the function and utilities of DDIT3 are found in John Hopkins OMIM database record ID 126337, and in sited publications numbered 87 and 3095-3100 listed in the bibliography section hereinbelow, which are also hereby incorporated by reference. Fibroblast Growth Factor Receptor-like 1 (FGFRL1, Accession NM_021923) is another VGAM2144 host target gene. FGFRL1 BINDING SITE is HOST TARGET binding site found in the 3' untranslated region of mRNA encoded by FGFRL1, corresponding to a HOST TARGET binding site such as BINDING SITE I, BINDING SITE II or BINDING SITE III. Table 2 illustrates the complementarity of the nucleotide sequences of FGFRL1 BINDING SITE, designated SEQ ID:22451, to the nucleotide sequence of VGAM2144 RNA, herein designated VGAM RNA, also designated SEQ ID:4855.

Another function of VGAM2144 is therefore inhibition of Fibroblast Growth Factor Receptor-like 1 (FGFRL1, Accession NM_021923). Accordingly, utilities of VGAM2144 include diagnosis, prevention and treatment of diseases and clinical conditions associated with FGFRL1. Solute Carrier Family 4, Sodium Bicarbonate Cotransporter, Member 4 (SLC4A4, Accession NM_003759) is another VGAM2144 host target gene. SLC4A4 BINDING SITE is HOST TARGET binding site found in the 3' untranslated region of mRNA encoded by SLC4A4, corresponding to a HOST TARGET binding site such as BINDING SITE I, BINDING SITE II or BINDING SITE III. Table 2 illustrates the complementarity of the nucleotide sequences of SLC4A4 BINDING SITE, designated SEQ ID:9838, to the nucleotide sequence of VGAM2144 RNA, herein designated VGAM RNA, also designated SEQ ID:4855.

Another function of VGAM2144 is therefore inhibition of Solute Carrier Family 4, Sodium Bicarbonate Cotransporter, Member 4 (SLC4A4, Accession NM_003759), a gene which is a sodium bicarbonate cotransporter. Accordingly, utilities of VGAM2144 include diagnosis, prevention and treatment of diseases and clinical conditions associated with SLC4A4. The function of SLC4A4 and its association with various diseases and clinical conditions, has been established by previous studies, as described hereinabove with reference to VGAM222. Tropomodulin (TMOD, Accession NM_003275) is another VGAM2144 host target gene. TMOD BINDING SITE is HOST TARGET binding site found in the 3' untranslated region of mRNA encoded by TMOD, corresponding to a HOST TARGET binding site such as BINDING SITE I, BINDING SITE II or BINDING SITE III. Table 2 illustrates the complementarity of the nucleotide sequences of TMOD BINDING SITE, designated SEQ ID:9294, to the nucleotide sequence of VGAM2144 RNA, herein designated VGAM RNA, also designated SEQ ID:4855.

Another function of VGAM2144 is therefore inhibition of Tropomodulin (TMOD, Accession NM_003275), a gene which blocks the elongation and depolymerization of the actin filaments at the pointed end. Accordingly, utilities of VGAM2144 include diagnosis, prevention and treatment of diseases and clinical conditions associated with TMOD. The function of TMOD and its association with various diseases and clinical conditions, has been established by previous studies, as described hereinabove with reference to VGAM716. FGD1 Family, Member 3 (FGD3, Accession XM_053487) is another VGAM2144 host target gene. FGD3 BINDING SITE is HOST TARGET binding site found in the 3' untranslated region of mRNA encoded by FGD3, corresponding to a HOST TARGET binding site such as BINDING SITE I, BINDING SITE II or BINDING SITE III. Table 2 illustrates the complementarity of the nucleotide sequences of FGD3 BINDING SITE, designated SEQ ID:36091, to the nucleotide sequence of VGAM2144 RNA, herein designated VGAM RNA, also designated SEQ ID:4855.

Another function of VGAM2144 is therefore inhibition of FGD1 Family, Member 3 (FGD3, Accession XM_053487). Accordingly, utilities of VGAM2144 include diagnosis, prevention and treatment of diseases and clinical conditions associated with FGD3. FLJ12838 (Accession NM_024641) is another VGAM2144 host target gene. FLJ12838 BINDING SITE is HOST TARGET binding site found in the 3' untranslated region of mRNA encoded by FLJ12838, corresponding to a HOST TARGET binding site such as BINDING SITE I, BINDING SITE II or BINDING SITE III. Table 2 illustrates the complementarity of the nucleotide sequences of FLJ12838 BINDING SITE, designated SEQ ID:23924, to the nucleotide sequence of VGAM2144 RNA, herein designated VGAM RNA, also designated SEQ ID:4855.

Another function of VGAM2144 is therefore inhibition of FLJ12838 (Accession NM_024641). Accordingly, utilities of VGAM2144 include diagnosis, prevention and treatment of diseases and clinical conditions associated with FLJ12838. HIC (Accession XM_041273) is another VGAM2144 host target gene. HIC BINDING SITE is HOST TARGET binding site found in the 3' untranslated region of mRNA encoded by HIC, corresponding to a HOST TARGET binding site such as BINDING SITE I, BINDING SITE II or BINDING SITE III. Table 2 illustrates the complementarity of the nucleotide sequences of HIC BINDING SITE, designated SEQ ID:33494, to the nucleotide sequence of VGAM2144 RNA, herein designated VGAM RNA, also designated SEQ ID:4855.

Another function of VGAM2144 is therefore inhibition of HIC (Accession XM_041273). Accordingly, utilities of VGAM2144 include diagnosis, prevention and treatment of diseases and clinical conditions associated with HIC. KIAA1309 (Accession NM_033495) is another VGAM2144 host target gene. KIAA1309 BINDING SITE is HOST TARGET binding site found in the 3" untranslated region of mRNA encoded by KIAA1309, corresponding to a HOST TARGET binding site such as BINDING SITE I, BINDING SITE II or BINDING SITE III. Table 2 illustrates the complementarity of the nucleotide sequences of KIAA1309 BINDING SITE, designated SEQ ID:27264, to the nucleotide sequence of VGAM2144 RNA, herein designated VGAM RNA, also designated SEQ ID:4855.

Another function of VGAM2144 is therefore inhibition of KIAA1309 (Accession NM_033495). Accordingly, utilities of VGAM2144 include diagnosis, prevention and treatment of diseases and clinical conditions associated with KIAA1309. Sodium Channel, Voltage-gated, Type XII, Alpha Polypeptide (SCN12A, Accession NM_014139) is another VGAM2144 host target gene. SCN12A BINDING SITE is HOST TARGET binding site found in the 3' untranslated region of mRNA encoded by SCN12A, corresponding to a HOST TARGET binding site such as BINDING SITE I, BINDING SITE II or BINDING SITE III. Table 2 illustrates the complementarity of the nucleotide sequences of SCN12A BINDING SITE, designated SEQ ID:15410, to the nucleotide sequence of VGAM2144 RNA, herein designated VGAM RNA, also designated SEQ ID:4855.

Another function of VGAM2144 is therefore inhibition of Sodium Channel, Voltage-gated, Type XII, Alpha Polypeptide (SCN12A, Accession NM_014139). Accordingly, utilities of VGAM2144 include diagnosis, prevention and treatment of diseases and clinical conditions associated with SCN12A. LOC145333 (Accession XM_096766) is another VGAM2144 host target gene. LOC145333 BINDING SITE is HOST TARGET binding site found in the 3' untranslated region of mRNA encoded by LOC145333, corresponding to a HOST TARGET binding site such as BINDING SITE I, BINDING SITE II or BINDING SITE III. Table 2 illustrates the complementarity of the nucleotide sequences of LOC145333 BINDING SITE, designated SEQ ID:40533, to the nucleotide sequence of VGAM2144 RNA, herein designated VGAM RNA, also designated SEQ ID:4855.

Another function of VGAM2144 is therefore inhibition of LOC145333 (Accession XM_096766). Accordingly, utilities of VGAM2144 include diagnosis, prevention and treatment of diseases and clinical conditions associated with LOC145333. LOC162333 (Accession XM_102591) is another VGAM2144 host target gene. LOC162333 BINDING SITE is HOST TARGET binding site found in the 5' untranslated region of mRNA encoded by LOC162333, corresponding to a HOST TARGET binding site such as BINDING SITE I, BINDING SITE II or BINDING SITE III. Table 2 illustrates the complementarity of the nucleotide sequences of LOC162333 BINDING SITE, designated SEQ ID:42137, to the nucleotide sequence of VGAM2144 RNA, herein designated VGAM RNA, also designated SEQ ID:4855.

Another function of VGAM2144 is therefore inhibition of LOC162333 (Accession XM_102591). Accordingly, utilities of VGAM2144 include diagnosis, prevention and treatment of diseases and clinical conditions associated with LOC162333. LOC222662 (Accession XM_167086) is another VGAM2144 host target gene. LOC222662 BINDING SITE is HOST TARGET binding site found in the 3' untranslated region of mRNA encoded by LOC222662, corresponding to a HOST TARGET binding site such as BINDING SITE I, BINDING SITE II or BINDING SITE III. Table 2 illustrates the complementarity of the nucleotide sequences of LOC222662 BINDING SITE, designated SEQ ID:44600, to the nucleotide sequence of VGAM2144 RNA, herein designated VGAM RNA, also designated SEQ ID:4855.

Another function of VGAM2144 is therefore inhibition of LOC222662 (Accession XM_167086). Accordingly, utilities of VGAM2144 include diagnosis, prevention and treatment of diseases and clinical conditions associated with LOC222662. LOC255082 (Accession XM_172843) is another VGAM2144 host target gene. LOC255082 BINDING SITE is HOST TARGET binding site found in the 5' untranslated region of mRNA encoded by LOC255082, corresponding to a HOST TARGET binding site such as BINDING SITE I, BINDING SITE II or BINDING SITE III. Table 2 illustrates the complementarity of the nucleotide sequences of LOC255082 BINDING SITE, designated SEQ ID:46115, to the nucleotide sequence of VGAM2144 RNA, herein designated VGAM RNA, also designated SEQ ID:4855.

Another function of VGAM2144 is therefore inhibition of LOC255082 (Accession XM_172843). Accordingly, utilities of VGAM2144 include diagnosis, prevention and treatment of diseases and clinical conditions associated with LOC255082. FIG. 1 further provides a conceptual description of a novel bioinformatically detected viral gene of the present invention, referred to here as Viral Genomic Address Messenger 2145 (VGAM2145) viral gene, which modulates expression of respective host target genes thereof, the function and utility of which host target genes is known in the art.

VGAM2145 is a novel bioinformatically detected regulatory, non protein coding, viral micro RNA (miRNA) gene. The method by which VGAM2145 was detected is described hereinabove with reference to FIGS. 1-8.

VGAM2145 gene, herein designated VGAM GENE, is a viral gene contained in the genome of Ectromelia Virus. VGAM2145 host target gene, herein designated VGAM HOST TARGET GENE, is a human gene contained in the human genome.

VGAM2145 gene encodes a VGAM2145 precursor RNA, herein designated VGAM PRECURSOR RNA. Similar to other miRNA genes, and unlike most ordinary genes, VGAM2145 precursor RNA does not encode a protein. A nucleotide sequence identical or highly similar to the nucleotide sequence of VGAM2145 precursor RNA is designated SEQ ID:2131, and is provided hereinbelow with reference to the sequence listing part. Nucleotide sequence SEQ ID:2131 is located at position 182220 relative to the genome of Ectromelia Virus.

VGAM2145 precursor RNA folds onto itself, forming VGAM2145 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2145 folded precursor RNA into VGAM2145 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2145 RNA is designated SEQ ID:4856, and is provided hereinbelow with reference to the sequence listing part.

VGAM2145 host target gene, herein designated VGAM HOST TARGET GENE, encodes a corresponding messenger RNA, VGAM2145 host target RNA, herein designated VGAM HOST TARGET RNA. VGAM2145 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2145 RNA, herein designated VGAM RNA, binds complementarily to one or more host target binding sites located in untranslated regions of VGAM2145 host target RNA, herein designated VGAM HOST TARGET RNA. This complementary binding is due to the fact that the nucleotide sequence of VGAM2145 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2145 RNA, herein designated VGAM RNA, may have a different number of host target binding sites in untranslated regions of a VGAM2145 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2145 RNA, herein designated VGAM RNA, to host target binding sites on VGAM2145 host target RNA, herein designated VGAM HOST TARGET RNA, such as BINDING SITE I, BINDING SITE II and BINDING SITE III, inhibits translation of VGAM2145 host target RNA into VGAM2145 host target protein, herein designated VGAM HOST TARGET PROTEIN. VGAM host target protein is therefore outlined by a broken line.

It is appreciated that VGAM2145 host target gene, herein designated VGAM HOST TARGET GENE, in fact represents a plurality of VGAM2145 host target genes. The mRNA of each one of this plurality of VGAM2145 host target genes comprises one or more host target binding sites, each having a nucleotide sequence which is at least partly complementary to VGAM2145 RNA, herein designated VGAM RNA, and which when bound by VGAM2145 RNA causes inhibition of translation of respective one or more VGAM2145 host target proteins.

It is further appreciated by one skilled in the art that the mode of translational inhibition illustrated by FIG. 1 with specific reference to translational inhibition exerted by VGAM2145 gene, herein designated VGAM GENE, on one or more VGAM2145 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2145 is inhibition of expression of host target genes, as part of a novel viral mechanism of attacking a host. Accordingly, utilities of VGAM2145 include diagnosis, prevention and treatment of viral infection by Ectromelia Virus. Specific functions, and accordingly utilities, of VGAM2145 correlate with, and may be deduced from, the identity of the host target genes which VGAM2145 binds and inhibits, and the function of these host target genes, as elaborated hereinbelow.

Nucleotide sequences of the VGAM2145 precursor RNA, herein designated VGAM PRECURSOR RNA, and of the 'diced' VGAM2145 RNA, herein designated VGAM RNA, and a schematic representation of the secondary folding of VGAM2145 folded precursor RNA, herein designated VGAM FOLDED PRECURSOR RNA, of VGAM2145 are further described hereinbelow with reference to Table 1.

Nucleotide sequences of host target binding sites, such as BINDING SITE-I, BINDING SITE-II and BINDING SITE-III of FIG. 1, found on VGAM2145 host target RNA, and schematic representation of the complementarity of each of these host target binding sites to VGAM2145 RNA, herein designated VGAM RNA, are described hereinbelow with reference to Table 2.

As mentioned hereinabove with reference to FIG. 1, a function of VGAM2145 gene, herein designated VGAM is inhibition of expression of VGAM2145 target genes. It is appreciated that specific functions, and accordingly utilities, of VGAM2145 correlate with, and may be deduced from, the identity of the target genes which VGAM2145 binds and inhibits, and the function of these target genes, as elaborated hereinbelow.

Early Growth Response 2 (Krox-20 homolog, Drosophila) (EGR2, Accession NM_000399) is a VGAM2145 host target gene. EGR2 BINDING SITE is HOST TARGET binding site found in the 3' untranslated region of mRNA encoded by EGR2, corresponding to a HOST TARGET binding site such as BINDING SITE I, BINDING SITE II or BINDING SITE III. Table 2 illustrates the complementarity of the nucleotide sequences of EGR2 BINDING SITE, designated SEQ ID:5971, to the nucleotide sequence of VGAM2145 RNA, herein designated VGAM RNA, also designated SEQ ID:4856.

A function of VGAM2145 is therefore inhibition of Early Growth Response 2 (Krox-20 homolog, Drosophila) (EGR2, Accession NM_000399), a gene which binds to two specific dna sites located in the promoter region of hox-1.4. Accordingly, utilities of VGAM2145 include diagnosis, prevention and treatment of diseases and clinical conditions associated with EGR2. The function of EGR2 and its association with various diseases and clinical conditions, has been established by previous studies, as described hereinabove with reference to VGAM234. LOC147184 (Accession NM_145274) is another VGAM2145 host target gene. LOC147184 BINDING SITE is HOST TARGET binding site found in the 5' untranslated region of mRNA encoded by LOC147184, corresponding to a HOST TARGET binding site such as BINDING SITE I, BINDING SITE II or BINDING SITE III. Table 2 illustrates the complementarity of the nucleotide sequences of LOC147184 BINDING SITE, designated SEQ ID:29787, to the nucleotide sequence of VGAM2145 RNA, herein designated VGAM RNA, also designated SEQ ID:4856.

Another function of VGAM2145 is therefore inhibition of LOC147184 (Accession NM_145274). Accordingly, utilities of VGAM2145 include diagnosis, prevention and treatment of diseases and clinical conditions associated with LOC147184. LOC90499 (Accession XM_032170) is another VGAM2145 host target gene. LOC90499 BINDING SITE is HOST TARGET binding site found in the 3' untranslated region of mRNA encoded by LOC90499, corresponding to a HOST TARGET binding site such as BINDING SITE I, BINDING SITE II or BINDING SITE III. Table 2 illustrates the complementarity of the nucleotide sequences of LOC90499 BINDING SITE, designated SEQ ID:31583, to the nucleotide sequence of VGAM2145 RNA, herein designated VGAM RNA, also designated SEQ ID:4856.

Another function of VGAM2145 is therefore inhibition of LOC90499 (Accession XM_032170). Accordingly, utilities of VGAM2145 include diagnosis, prevention and treatment of diseases and clinical conditions associated with LOC90499. FIG. 1 further provides a conceptual description of a novel bioinformatically detected viral gene of the present invention, referred to here as Viral Genomic Address Messenger 2146 (VGAM2146) viral gene, which modulates expression of respective host target genes thereof, the function and utility of which host target genes is known in the art.

VGAM2146 is a novel bioinformatically detected regulatory, non protein coding, viral micro RNA (miRNA) gene. The method by which VGAM2146 was detected is described hereinabove with reference to FIGS. 1-8.

VGAM2146 gene, herein designated VGAM GENE, is a viral gene contained in the genome of Rana Tigrina Ranavirus. VGAM2146 host target gene, herein designated VGAM HOST TARGET GENE, is a human gene contained in the human genome.

VGAM2146 gene encodes a VGAM2146 precursor RNA, herein designated VGAM PRECURSOR RNA. Similar to other miRNA genes, and unlike most ordinary genes, VGAM2146 precursor RNA does not encode a protein. A nucleotide sequence identical or highly similar to the nucleotide sequence of VGAM2146 precursor RNA is designated SEQ ID:2132, and is provided hereinbelow with reference to the sequence listing part. Nucleotide sequence SEQ ID:2132 is located at position 55138 relative to the genome of Rana Tigrina Ranavirus.

VGAM2146 precursor RNA folds onto itself, forming VGAM2146 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2146 folded precursor RNA into VGAM2146 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2146 RNA is designated SEQ ID:4857, and is provided hereinbelow with reference to the sequence listing part.

VGAM2146 host target gene, herein designated VGAM HOST TARGET GENE, encodes a corresponding messenger RNA, VGAM2146 host target RNA, herein designated VGAM HOST TARGET RNA. VGAM2146 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2146 RNA, herein designated VGAM RNA, binds complementarily to one or more host target binding sites located in untranslated regions of VGAM2146 host target RNA, herein designated VGAM HOST TARGET RNA. This complementary binding is due to the fact that the nucleotide sequence of VGAM2146 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2146 RNA, herein designated VGAM RNA, may have a different number of host target binding sites in untranslated regions of a VGAM2146 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2146 RNA, herein designated VGAM RNA, to host target binding sites on VGAM2146 host target RNA, herein designated VGAM HOST TARGET RNA, such as BINDING SITE I, BINDING SITE II and BINDING SITE III, inhibits translation of VGAM2146 host target RNA into VGAM2146 host target protein, herein designated VGAM HOST TARGET PROTEIN. VGAM host target protein is therefore outlined by a broken line.

It is appreciated that VGAM2146 host target gene, herein designated VGAM HOST TARGET GENE, in fact represents a plurality of VGAM2146 host target genes. The mRNA of each one of this plurality of VGAM2146 host target genes comprises one or more host target binding sites, each having a nucleotide sequence which is at least partly complementary to VGAM2146 RNA, herein designated VGAM RNA, and which when bound by VGAM2146 RNA causes inhibition of translation of respective one or more VGAM2146 host target proteins.

It is further appreciated by one skilled in the art that the mode of translational inhibition illustrated by FIG. 1 with specific reference to translational inhibition exerted by VGAM2146 gene, herein designated VGAM GENE, on one or more VGAM2146 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let- 7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2146 is inhibition of expression of host target genes, as part of a novel viral mechanism of attacking a host. Accordingly, utilities of VGAM2146 include diagnosis, prevention and treatment of viral infection by Rana Tigrina Ranavirus. Specific functions, and accordingly utilities, of VGAM2146 correlate with, and may be deduced from, the identity of the host target genes which VGAM2146 binds and inhibits, and the function of these host target genes, as elaborated hereinbelow.

Nucleotide sequences of the VGAM2146 precursor RNA, herein designated VGAM PRECURSOR RNA, and of the 'diced' VGAM2146 RNA, herein designated VGAM RNA, and a schematic representation of the secondary folding of VGAM2146 folded precursor RNA, herein designated VGAM FOLDED PRECURSOR RNA, of VGAM2146 are further described hereinbelow with reference to Table 1.

Nucleotide sequences of host target binding sites, such as BINDING SITE-I, BINDING SITE-II and BINDING SITE-III of FIG. 1, found on VGAM2146 host target RNA, and schematic representation of the complementarity of each of these host target binding sites to VGAM2146 RNA, herein designated VGAM RNA, are described hereinbelow with reference to Table 2.

As mentioned hereinabove with reference to FIG. 1, a function of VGAM2146 gene, herein designated VGAM is inhibition of expression of VGAM2146 target genes. It is appreciated that specific functions, and accordingly utilities, of VGAM2146 correlate with, and may be deduced from, the identity of the target genes which VGAM2146 binds and inhibits, and the function of these target genes, as elaborated hereinbelow.

Lipin 2 (LPIN2, Accession NM_014646) is a VGAM2146 host target gene. LPIN2 BINDING SITE is HOST TARGET binding site found in the 3' untranslated region of mRNA encoded by LPIN2, corresponding to a HOST TARGET binding site such as BINDING SITE I, BINDING SITE II or BINDING SITE III. Table 2 illustrates the complementarity of the nucleotide sequences of LPIN2 BINDING SITE, designated SEQ ID:16059, to the nucleotide sequence of VGAM2146 RNA, herein designated VGAM RNA, also designated SEQ ID:4857.

A function of VGAM2146 is therefore inhibition of Lipin 2 (LPIN2, Accession NM_014646). Accordingly, utilities of VGAM2146 include diagnosis, prevention and treatment of diseases and clinical conditions associated with LPIN2. Aminocarboxymuconate Semialdehyde Decarboxylase (acmsd, Accession NM_138326) is another VGAM2146 host target gene. acmsd BINDING SITE is HOST TARGET binding site found in the 5' untranslated region of mRNA encoded by acmsd, corresponding to a HOST TARGET binding site such as BINDING SITE I, BINDING SITE II or BINDING SITE III. Table 2 illustrates the complementarity of the nucleotide sequences of acmsd BINDING SITE, designated SEQ ID:28728, to the nucleotide sequence of VGAM2146 RNA, herein designated VGAM RNA, also designated SEQ ID:4857.

Another function of VGAM2146 is therefore inhibition of Aminocarboxymuconate Semialdehyde Decarboxylase (acmsd, Accession NM_138326). Accordingly, utilities of VGAM2146 include diagnosis, prevention and treatment of diseases and clinical conditions associated with acmsd. Chromosome 1 Open Reading Frame 34 (C1orf34, Accession XM_027172) is another VGAM2146 host target gene. C1orf34 BINDING SITE is HOST TARGET binding site found in the 3' untranslated region of mRNA encoded by C1orf34, corresponding to a HOST TARGET binding site such as BINDING SITE I, BINDING SITE II or BINDING SITE III. Table 2 illustrates the complementarity of the nucleotide sequences of C1orf34 BINDING SITE, designated SEQ ID:30431, to the nucleotide sequence of VGAM2146 RNA, herein designated VGAM RNA, also designated SEQ ID:4857.

Another function of VGAM2146 is therefore inhibition of Chromosome 1 Open Reading Frame 34 (C1orf34, Accession XM_027172). Accordingly, utilities of VGAM2146 include diagnosis, prevention and treatment of diseases and clinical conditions associated with C1orf34. KIAA1110 (Accession XM_029973) is another VGAM2146 host target gene. KIAA1110 BINDING SITE is HOST TARGET binding site found in the 3' untranslated region of mRNA encoded by KIAA1110, corresponding to a HOST TARGET binding site such as BINDING SITE I, BINDING SITE II or BINDING SITE III. Table 2 illustrates the complementarity of the nucleotide sequences of KIAA1110 BINDING SITE, designated SEQ ID:30980, to the nucleotide sequence of VGAM2146 RNA, herein designated VGAM RNA, also designated SEQ ID:4857.

Another function of VGAM2146 is therefore inhibition of KIAA1110 (Accession XM_029973). Accordingly, utilities of VGAM2146 include diagnosis, prevention and treatment of diseases and clinical conditions associated with KIAA1110. MGC14258 (Accession NM_032900) is another VGAM2146 host target gene. MGC14258 BINDING SITE is HOST TARGET binding site found in the 3' untranslated region of mRNA encoded by MGC14258, corresponding to a HOST TARGET binding site such as BINDING SITE I, BINDING SITE II or BINDING SITE III. Table 2 illustrates the complementarity of the nucleotide sequences of MGC14258 BINDING SITE, designated SEQ ID:26724, to the nucleotide sequence of VGAM2146 RNA, herein designated VGAM RNA, also designated SEQ ID:4857.

Another function of VGAM2146 is therefore inhibition of MGC14258 (Accession NM_032900). Accordingly, utilities of VGAM2146 include diagnosis, prevention and treatment of diseases and clinical conditions associated with MGC14258. LOC150372 (Accession XM_086893) is another VGAM2146 host target gene. LOC150372 BINDING SITE is HOST TARGET binding site found in the 3' untranslated region of mRNA encoded by LOC150372, corresponding to a HOST TARGET binding site such as BINDING SITE I, BINDING SITE II or BINDING SITE III. Table 2 illustrates the complementarity of the nucleotide sequences of LOC150372 BINDING SITE, designated SEQ ID:38942, to the nucleotide sequence of VGAM2146 RNA, herein designated VGAM RNA, also designated SEQ ID:4857.

Another function of VGAM2146 is therefore inhibition of LOC150372 (Accession XM_086893). Accordingly, utilities of VGAM2146 include diagnosis, prevention and treatment of diseases and clinical conditions associated with LOC150372. LOC153516 (Accession NM_138491) is another VGAM2146 host target gene. LOC153516 BINDING SITE is HOST TARGET binding site found in the 3' untranslated region of mRNA encoded by LOC153516, corresponding to a HOST TARGET binding site such as BINDING SITE I, BINDING SITE II or BINDING SITE III. Table 2 illustrates the complementarity of the nucleotide sequences of LOC153516 BINDING SITE, designated SEQ ID:28840, to the nucleotide sequence of VGAM2146 RNA, herein designated VGAM RNA, also designated SEQ ID:4857.

Another function of VGAM2146 is therefore inhibition of LOC153516 (Accession NM_138491). Accordingly, utilities of VGAM2146 include diagnosis, prevention and treatment of diseases and clinical conditions associated with LOC153516. FIG. 1 further provides a conceptual description of a novel bioinformatically detected viral gene of the present invention, referred to here as Viral Genomic Address Messenger 2147 (VGAM2147) viral gene, which modulates expression of respective host target genes thereof, the function and utility of which host target genes is known in the art.

VGAM2147 is a novel bioinformatically detected regulatory, non protein coding, viral micro RNA (miRNA) gene. The method by which VGAM2147 was detected is described hereinabove with reference to FIGS. 1-8.

VGAM2147 gene, herein designated VGAM GENE, is a viral gene contained in the genome of Rana Tigrina Ranavirus. VGAM2147 host target gene, herein designated VGAM HOST TARGET GENE, is a human gene contained in the human genome.

VGAM2147 gene encodes a VGAM2147 precursor RNA, herein designated VGAM PRECURSOR RNA. Similar to other miRNA genes, and unlike most ordinary genes, VGAM2147 precursor RNA does not encode a protein. A nucleotide sequence identical or highly similar to the nucleotide sequence of VGAM2147 precursor RNA is designated SEQ ID:2133, and is provided hereinbelow with reference to the sequence listing part. Nucleotide sequence SEQ ID:2133 is located at position 47097 relative to the genome of Rana Tigrina Ranavirus.

VGAM2147 precursor RNA folds onto itself, forming VGAM2147 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2147 folded precursor RNA into VGAM2147 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM2147 RNA is designated SEQ ID:4858, and is provided hereinbelow with reference to the sequence listing part.

VGAM2147 host target gene, herein designated VGAM HOST TARGET GENE, encodes a corresponding messenger RNA, VGAM2147 host target RNA, herein designated VGAM HOST TARGET RNA. VGAM2147 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2147 RNA, herein designated VGAM RNA, binds complementarily to one or more host target binding sites located in untranslated regions of VGAM2147 host target RNA, herein designated VGAM HOST TARGET RNA. This complementary binding is due to the fact that the nucleotide sequence of VGAM2147 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2147 RNA, herein designated VGAM RNA, may have a different number of host target binding sites in untranslated regions of a VGAM2147 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2147 RNA, herein designated VGAM RNA, to host target binding sites on VGAM2147 host target RNA, herein designated VGAM HOST TARGET RNA, such as BINDING SITE I, BINDING SITE II and BINDING SITE III, inhibits translation of VGAM2147 host target RNA into VGAM2147 host target protein, herein designated VGAM HOST TARGET PROTEIN. VGAM host target protein is therefore outlined by a broken line.

It is appreciated that VGAM2147 host target gene, herein designated VGAM HOST TARGET GENE, in fact represents a plurality of VGAM2147 host target genes. The mRNA of each one of this plurality of VGAM2147 host target genes comprises one or more host target binding sites, each having a nucleotide sequence which is at least partly complementary to VGAM2147 RNA, herein designated VGAM RNA, and which when bound by VGAM2147 RNA causes inhibition of translation of respective one or more VGAM2147 host target proteins.

It is further appreciated by one skilled in the art that the mode of translational inhibition illustrated by FIG. 1 with specific reference to translational inhibition exerted by VGAM2147 gene, herein designated VGAM GENE, on one or more VGAM2147 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2147 is inhibition of expression of host target genes, as part of a novel viral mechanism of attacking a host. Accordingly, utilities of VGAM2147 include diagnosis, prevention and treatment of viral infection by Rana Tigrina Ranavirus. Specific functions, and accordingly utilities, of VGAM2147 correlate with, and may be deduced from, the identity of the host target genes which VGAM2147 binds and inhibits, and the function of these host target genes, as elaborated hereinbelow.

Nucleotide sequences of the VGAM2147 precursor RNA, herein designated VGAM PRECURSOR RNA, and of the 'diced' VGAM2147 RNA, herein designated VGAM RNA, and a schematic representation of the secondary folding of VGAM2147 folded precursor RNA, herein designated VGAM FOLDED PRECURSOR RNA, of VGAM2147 are further described hereinbelow with reference to Table 1.

Nucleotide sequences of host target binding sites, such as BINDING SITE-I, BINDING SITE-II and BINDING SITE-III of FIG. 1, found on VGAM2147 host target RNA, and schematic representation of the complementarity of each of these host target binding sites to VGAM2147 RNA, herein designated VGAM RNA, are described hereinbelow with reference to Table 2.

As mentioned hereinabove with reference to FIG. 1, a function of VGAM2147 gene, herein designated VGAM is inhibition of expression of VGAM2147 target genes. It is appreciated that specific functions, and accordingly utilities, of VGAM2147 correlate with, and may be deduced from, the identity of the target genes which VGAM2147 binds and inhibits, and the function of these target genes, as elaborated hereinbelow.

GAC1 (Accession NM_006338) is a VGAM2147 host target gene. GAC1 BINDING SITE is HOST TARGET binding site found in the 3' untranslated region of mRNA encoded by GAC1, corresponding to a HOST TARGET binding site such as BINDING SITE I, BINDING SITE II or BINDING SITE III. Table 2 illustrates the complementarity of the nucleotide sequences of GAC1 BINDING SITE, designated SEQ ID:13038, to the nucleotide sequence of VGAM2147 RNA, herein designated VGAM RNA, also designated SEQ ID:4858.

A function of VGAM2147 is therefore inhibition of GAC1 (Accession NM_006338). Accordingly, utilities of VGAM2147 include diagnosis, prevention and treatment of diseases and clinical conditions associated with GAC1. LAPTM5 (Accession NM_006762) is another VGAM2147 host target gene. LAPTM5 BINDING SITE is HOST TARGET binding site found in the 3' untranslated region of mRNA encoded by LAPTM5, corresponding to a HOST TARGET binding site such as BINDING SITE I, BINDING SITE II or BINDING SITE III. Table 2 illustrates the complementarity of the nucleotide sequences of LAPTM5 BINDING SITE, designated SEQ ID:13617, to the nucleotide sequence of VGAM2147 RNA, herein designated VGAM RNA, also designated SEQ ID:4858.

Another function of VGAM2147 is therefore inhibition of LAPTM5 (Accession NM_006762). Accordingly, utilities of VGAM2147 include diagnosis, prevention and treatment of diseases and clinical conditions associated with LAPTM5. Sodium Channel, Voltage-gated, Type IV, Alpha Polypeptide (SCN4A, Accession NM_000334) is another VGAM2147 host target gene. SCN4A BINDING SITE is HOST TARGET binding site found in the 3" untranslated region of mRNA encoded by SCN4A, corresponding to a HOST TARGET binding site such as BINDING SITE I, BINDING SITE II or BINDING SITE III. Table 2 illustrates the complementarity of the nucleotide sequences of SCN4A BINDING SITE, designated SEQ ID:5889, to the nucleotide sequence of VGAM2147 RNA, herein designated VGAM RNA, also designated SEQ ID:4858.

Another function of VGAM2147 is therefore inhibition of Sodium Channel, Voltage-gated, Type IV, Alpha Polypeptide (SCN4A, Accession NM_000334). Accordingly, utilities of VGAM2147 include diagnosis, prevention and treatment of diseases and clinical conditions associated with SCN4A. Solute Carrier Family 22 (extraneuronal monoamine transporter), Member 3 (SLC22A3, Accession NM_021977) is another VGAM2147 host target gene. SLC22A3 BINDING SITE is HOST TARGET binding site found in the 3' untranslated region of mRNA encoded by SLC22A3, corresponding to a HOST TARGET binding site such as BINDING SITE I, BINDING SITE II or BINDING SITE III. Table 2 illustrates the complementarity of the nucleotide sequences of SLC22A3 BINDING SITE, designated SEQ ID:22506, to the nucleotide sequence of VGAM2147 RNA, herein designated VGAM RNA, also designated SEQ ID:4858.

Another function of VGAM2147 is therefore inhibition of Solute Carrier Family 22 (extraneuronal monoamine transporter), Member 3 (SLC22A3, Accession NM_021977), a gene which is a sodium-ion dependent, high affinity carnitine transporter. also transports organic cations without the involvement of sodium. involved in the active cellular uptake of carnitine. Accordingly, utilities of VGAM2147 include diagnosis, prevention and treatment of diseases and clinical conditions associated with SLC22A3. The function of SLC22A3 has been established by previous studies. By PCR using degenerate oligonucleotides corresponding to common sequence motifs of amphiphilic solute facilitators (e.g., SLC22A1; 602607) on cDNA from a human kidney carcinoma cell line, Grundemann et al. (1998) isolated a cDNA encoding SLC22A3, which they termed 'extraneuronal transporter for monoamine transmitters,' or EMT. The SLC22A3 gene encodes a deduced 556-amino acid protein containing 12 transmembrane segments. Expression analysis showed uptake of known catecholamine substrates by SLC22A3. RT-PCR analysis detected SLC22A3 expression in brain cortex, heart, and liver. Wu et al. (1998) showed that recombinant rat Oct3 can transport a wide variety of cationic neurotoxins and neurotransmitters, including 1-methyl-4-phenylpyridinium ion (MPP+) and dopamine. Oct3 was inhibited by several steroids, with beta-estradiol the most potent inhibitor. The authors stated that the transport characteristics and steroid sensitivity of Oct3 provide strong evidence for its molecular identity as the extraneuronal monoamine transporter (uptake-2). Northern blot analysis detected Oct3 expression in a number of rat tissues, including brain. In situ hybridization of rat brain showed that Oct3 is widely expressed in the brain, including in the hippocampus, cerebellum, and cerebral cortex. Wu et al. (1998) suggested that OCT3 plays a significant role in the disposition of cationic neurotoxins and neurotransmitters in the brain.

Full details of the abovementioned studies are described in the following publications, the disclosure of which are hereby incorporated by reference:

Grundemann, D.; Schechinger, B.; Rappold, G. A.; Schomig, E.: Molecular identification of the corticosterone-sensitive extraneuronal catecholamine transporter. Nature Neurosci. 1:349-351, 1998; and Wu, X.; Kekuda, R.; Huang, W.; Fei, Y.-J.; Leibach, F. H.; Chen, J.; Conway, S. J.; Ganapathy, V.: Identity of the organic cation transporter OCT3 as the extraneuronal monoamine transport.

Further studies establishing the function and utilities of SLC22A3 are found in John Hopkins OMIM database record ID 604842, and in sited publications numbered 694 and 5233 listed in the bibliography section hereinbelow, which are also hereby incorporated by reference. T-cell Leukemia Translocation Altered Gene (TCTA, Accession NM_022171) is another VGAM2147 host target gene. TCTA BINDING SITE is HOST TARGET binding site found in the 3' untranslated region of mRNA encoded by TCTA, corresponding to a HOST TARGET binding site such as BINDING SITE I, BINDING SITE II or BINDING SITE III. Table 2 illustrates the complementarity of the nucleotide sequences of TCTA BINDING SITE, designated SEQ ID:22731, to the nucleotide sequence of VGAM2147 RNA, herein designated VGAM RNA, also designated SEQ ID:4858.

Another function of VGAM2147 is therefore inhibition of T-cell Leukemia Translocation Altered Gene (TCTA, Accession NM_022171). Accordingly, utilities of VGAM2147 include diagnosis, prevention and treatment of diseases and clinical conditions associated with TCTA. Wolf-Hirschhorn Syndrome Candidate 1 (WHSC1, Accession NM_007331) is another VGAM2147 host target gene. WHSC1 BINDING SITE is HOST TARGET binding site found in the 3' untranslated region of mRNA encoded by WHSC1, corresponding to a HOST TARGET binding site such as BINDING SITE I, BINDING SITE II or BINDING SITE III. Table 2 illustrates the complementarity of the nucleotide sequences of WHSC1 BINDING SITE, designated SEQ ID:14251, to the nucleotide sequence of VGAM2147 RNA, herein designated VGAM RNA, also designated SEQ ID:4858.

Another function of VGAM2147 is therefore inhibition of Wolf-Hirschhorn Syndrome Candidate 1 (WHSC1, Accession NM_007331), a gene which binds covalently to and repairs g/t mismatches. Accordingly, utilities of VGAM2147 include diagnosis, prevention and treatment of diseases and clinical conditions associated with WHSC1. The function of WHSC1 and its association with various diseases and clinical conditions, has been established by previous studies, as described hereinabove with reference to VGAM200. WWP2 (Accession XM_028151) is another VGAM2147 host target gene. WWP2 BINDING SITE is HOST TARGET binding site found in the 3' untranslated region of mRNA encoded by WWP2, corresponding to a HOST TARGET binding site such as BINDING SITE I, BINDING SITE II or BINDING SITE III. Table 2 illustrates the complementarity of the nucleotide sequences of WWP2 BINDING SITE, designated SEQ ID:30622, to the nucleotide sequence of VGAM2147 RNA, herein designated VGAM RNA, also designated SEQ ID:4858.

Another function of VGAM2147 is therefore inhibition of WWP2 (Accession XM_028151), a gene which exhibits ubiquitin-protein ligase activity and contains WW and HECT domains. Accordingly, utilities of VGAM2147 include diagnosis, prevention and treatment of diseases and clinical conditions associated with WWP2. The function of WWP2 and its association with various diseases and clinical conditions, has been established by previous studies, as described hereinabove with reference to VGAM1959. Complement Component 1, Q Subcomponent, Receptor 1 (C1QR1, Accession NM_012072) is another VGAM2147 host target gene. C1QR1 BINDING SITE is HOST TARGET binding site found in the 3' untranslated region of mRNA encoded by C1QR1, corresponding to a HOST TARGET binding site such as BINDING SITE I, BINDING SITE II or BINDING SITE III. Table 2 illustrates the complementarity of the nucleotide sequences of C1QR1 BINDING SITE, designated SEQ ID:14332, to the nucleotide sequence of VGAM2147 RNA, herein designated VGAM RNA, also designated SEQ ID:4858.

Another function of VGAM2147 is therefore inhibition of Complement Component 1, Q Subcomponent, Receptor 1 (C1QR1, Accession NM_012072). Accordingly, utilities of VGAM2147 include diagnosis, prevention and treatment of diseases and clinical conditions associated with C1QR1. CPR2 (Accession NM_030900) is another VGAM2147 host target gene. CPR2 BINDING SITE is HOST TARGET binding site found in the 3' untranslated region of mRNA encoded by CPR2, corresponding to a HOST TARGET binding site such as BINDING SITE I, BINDING SITE II or BINDING SITE III. Table 2 illustrates the complementarity of the nucleotide sequences of CPR2 BINDING SITE, designated SEQ ID:25174, to the nucleotide sequence of VGAM2147 RNA, herein designated VGAM RNA, also designated SEQ ID:4858.

Another function of VGAM2147 is therefore inhibition of CPR2 (Accession NM_030900). Accordingly, utilities of VGAM2147 include diagnosis, prevention and treatment of diseases and clinical conditions associated with CPR2. FLJ21195 (Accession NM_022469) is another VGAM2147 host target gene. FLJ21195 BINDING SITE is HOST TARGET binding site found in the 3' untranslated region of mRNA encoded by FLJ21195, corresponding to a HOST TARGET binding site such as BINDING SITE I, BINDING SITE II or BINDING SITE III. Table 2 illustrates the complementarity of the nucleotide sequences of FLJ21195 BINDING SITE, designated SEQ ID:22827, to the nucleotide sequence of VGAM2147 RNA, herein designated VGAM RNA, also designated SEQ ID:4858.

Another function of VGAM2147 is therefore inhibition of FLJ21195 (Accession NM_022469). Accordingly, utilities of VGAM2147 include diagnosis, prevention and treatment of diseases and clinical conditions associated with FLJ21195. FLJ22795 (Accession NM_025084) is another VGAM2147 host target gene. FLJ22795 BINDING SITE is HOST TARGET binding site found in the 3' untranslated region of mRNA encoded by FLJ22795, corresponding to a HOST TARGET binding site such as BINDING SITE I, BINDING SITE II or BINDING SITE III. Table 2 illustrates the complementarity of the nucleotide sequences of FLJ22795 BINDING SITE, designated SEQ ID:24690, to the nucleotide sequence of VGAM2147 RNA, herein designated VGAM RNA, also designated SEQ ID:4858.

Another function of VGAM2147 is therefore inhibition of FLJ22795 (Accession NM_025084). Accordingly, utilities of VGAM2147 include diagnosis, prevention and treatment of diseases and clinical conditions associated with FLJ22795. Glutamate Receptor Interacting Protein 1 (GRIP1, Accession XM_047362) is another VGAM2147 host target gene. GRIP1 BINDING SITE is HOST TARGET binding site found in the 5' untranslated region of mRNA encoded by GRIP1, corresponding to a HOST TARGET binding site such as BINDING SITE I, BINDING SITE II or BINDING SITE III. Table 2 illustrates the complementarity of the nucleotide sequences of GRIP1 BINDING SITE, designated SEQ ID:34962, to the nucleotide sequence of VGAM2147 RNA, herein designated VGAM RNA, also designated SEQ ID:4858.

Another function of VGAM2147 is therefore inhibition of Glutamate Receptor Interacting Protein 1 (GRIP1, Accession XM_047362). Accordingly, utilities of VGAM2147 include diagnosis, prevention and treatment of diseases and clinical conditions associated with GRIP1. KIAA0014 (Accession NM_014665) is another VGAM2147 host target gene. KIAA0014 BINDING SITE is HOST TARGET binding site found in the 3' untranslated region of mRNA encoded by KIAA0014, corresponding to a HOST TARGET binding site such as BINDING SITE I, BINDING SITE II or BINDING SITE III. Table 2 illustrates the complementarity of the nucleotide sequences of KIAA0014 BINDING SITE, designated SEQ ID:16116, to the nucleotide sequence of VGAM2147 RNA, herein designated VGAM RNA, also designated SEQ ID:4858.

Another function of VGAM2147 is therefore inhibition of KIAA0014 (Accession NM_014665). Accordingly, utilities of VGAM2147 include diagnosis, prevention and treatment of diseases and clinical conditions associated with KIAA0014. KIAA1157 (Accession XM_051093) is another VGAM2147 host target gene. KIAA1157 BINDING SITE is HOST TARGET binding site found in the 3' untranslated region of mRNA encoded by KIAA1157, corresponding to a HOST TARGET binding site such as BINDING SITE I, BINDING SITE II or BINDING SITE III. Table 2 illustrates the complementarity of the nucleotide sequences of KIAA1157 BINDING SITE, designated SEQ ID:35752, to the nucleotide sequence of VGAM2147 RNA, herein designated VGAM RNA, also designated SEQ ID:4858.

Another function of VGAM2147 is therefore inhibition of KIAA1157 (Accession XM_051093). Accordingly, utilities of VGAM2147 include diagnosis, prevention and treatment of diseases and clinical conditions associated with KIAA1157. KIAA1274 (Accession XM_166125) is another VGAM2147 host target gene. KIAA1274 BINDING SITE is HOST TARGET binding site found in the 3' untranslated region of mRNA encoded by KIAA1274, corresponding to a HOST TARGET binding site such as BINDING SITE I, BINDING SITE II or BINDING SITE III. Table 2 illustrates the complementarity of the nucleotide sequences of KIAA1274 BINDING SITE, designated SEQ ID:43912, to the nucleotide sequence of VGAM2147 RNA, herein designated VGAM RNA, also designated SEQ ID:4858.

Another function of VGAM2147 is therefore inhibition of KIAA1274 (Accession XM_166125). Accordingly, utilities of VGAM2147 include diagnosis, prevention and treatment of diseases and clinical conditions associated with KIAA1274. KIAA1393 (Accession XM_050793) is another VGAM2147 host target gene. KIAA1393 BINDING SITE is HOST TARGET binding site found in the 3' untranslated region of mRNA encoded by KIAA1393, corresponding to a HOST TARGET binding site such as BINDING SITE I, BINDING SITE II or BINDING SITE III. Table 2 illustrates the complementarity of the nucleotide sequences of KIAA1393 BINDING SITE, designated SEQ ID:35687, to the nucleotide sequence of VGAM2147 RNA, herein designated VGAM RNA, also designated SEQ ID:4858.

Another function of VGAM2147 is therefore inhibition of KIAA1393 (Accession XM_050793). Accordingly, utilities of VGAM2147 include diagnosis, prevention and treatment of diseases and clinical conditions associated with KIAA1393. KIAA1909 (Accession XM_057996) is another VGAM2147 host target gene. KIAA1909 BINDING SITE is HOST TARGET binding site found in the 5' untranslated region of mRNA encoded by KIAA1909, corresponding to a HOST TARGET binding site such as BINDING SITE I, BINDING SITE II or BINDING SITE III. Table 2 illustrates the complementarity of the nucleotide sequences of KIAA1909 BINDING SITE, designated SEQ ID:36558, to the nucleotide sequence of VGAM2147 RNA, herein designated VGAM RNA, also designated SEQ ID:4858.

Another function of VGAM2147 is therefore inhibition of KIAA1909 (Accession XM_057996). Accordingly, utilities of VGAM2147 include diagnosis, prevention and treatment of diseases and clinical conditions associated with KIAA1909. Kallikrein 6 (neurosin, zyme) (KLK6, Accession NM_002774) is another VGAM2147 host target gene. KLK6 BINDING SITE is HOST TARGET binding site found in the 5' untranslated region of mRNA encoded by KLK6, corresponding to a HOST TARGET binding site such as BINDING SITE I, BINDING SITE II or BINDING SITE III. Table 2 illustrates the complementarity of the nucleotide sequences of KLK6 BINDING SITE, designated SEQ ID:8665, to the nucleotide sequence of VGAM2147 RNA, herein designated VGAM RNA, also designated SEQ ID:4858.

Another function of VGAM2147 is therefore inhibition of Kallikrein 6 (neurosin, zyme) (KLK6, Accession NM_002774). Accordingly, utilities of VGAM2147 include diagnosis, prevention and treatment of diseases and clinical conditions associated with KLK6. l (3) mbt-like 2 (Drosophila) (L3MBTL2, Accession XM_114201) is another VGAM2147 host target gene. L3MBTL2 BINDING SITE is HOST TARGET binding site found in the 3' untranslated region of mRNA encoded by L3MBTL2, corresponding to a HOST TARGET binding site such as BINDING SITE I, BINDING SITE II or BINDING SITE III. Table 2 illustrates the complementarity of the nucleotide sequences of L3MBTL2 BINDING SITE, designated SEQ ID:42792, to the nucleotide sequence of VGAM2147 RNA, herein designated VGAM RNA, also designated SEQ ID:4858.

Another function of VGAM2147 is therefore inhibition of l (3) mbt-like 2 (Drosophila) (L3MBTL2, Accession XM_114201). Accordingly, utilities of VGAM2147 include diagnosis, prevention and treatment of diseases and clinical conditions associated with L3MBTL2. LIM Domain Kinase 2 (LIMK2, Accession NM_016733) is another VGAM2147 host target gene. LIMK2 BINDING SITE is HOST TARGET binding site found in the 5' untranslated region of mRNA encoded by LIMK2, corresponding to a HOST TARGET binding site such as BINDING SITE I, BINDING SITE II or BINDING SITE III. Table 2 illustrates the complementarity of the nucleotide sequences of LIMK2 BINDING SITE, designated SEQ ID:18786, to the nucleotide sequence of VGAM2147 RNA, herein designated VGAM RNA, also designated SEQ ID:4858.

Another function of VGAM2147 is therefore inhibition of LIM Domain Kinase 2 (LIMK2, Accession NM_016733). Accordingly, utilities of VGAM2147 include diagnosis, prevention and treatment of diseases and clinical conditions associated with LIMK2. MGC15476 (Accession NM_145056) is another VGAM2147 host target gene. MGC15476 BINDING SITE is HOST TARGET binding site found in the 5' untranslated region of mRNA encoded by MGC15476, corresponding to a HOST TARGET binding site such as BINDING SITE I, BINDING SITE II or BINDING SITE III. Table 2 illustrates the complementarity of the nucleotide sequences of MGC15476 BINDING SITE, designated SEQ ID:29689, to the nucleotide sequence of VGAM2147 RNA, herein designated VGAM RNA, also designated SEQ ID:4858.

Another function of VGAM2147 is therefore inhibition of MGC15476 (Accession NM_145056). Accordingly, utilities of VGAM2147 include diagnosis, prevention and treatment of diseases and clinical conditions associated with MGC15476. Matrix Metalloproteinase 24 (membrane-inserted) (MMP24, Accession NM_006690) is another VGAM2147 host target gene. MMP24 BINDING SITE is HOST TARGET binding site found in the 3' untranslated region of mRNA encoded by MMP24, corresponding to a HOST TARGET binding site such as BINDING SITE I, BINDING SITE II or BINDING SITE III. Table 2 illustrates the complementarity of the nucleotide sequences of MMP24 BINDING SITE, designated SEQ ID:13505, to the nucleotide sequence of VGAM2147 RNA, herein designated VGAM RNA, also designated SEQ ID:4858.

Another function of VGAM2147 is therefore inhibition of Matrix Metalloproteinase 24 (membrane-inserted) (MMP24, Accession NM_006690). Accordingly, utilities of VGAM2147 include diagnosis, prevention and treatment of diseases and clinical conditions associated with MMP24. Oxysterol Binding Protein-like 5 (OSBPL5, Accession XM_052567) is another VGAM2147 host target gene. OSBPL5 BINDING SITE is HOST TARGET binding site found in the 3' untranslated region of mRNA encoded by OSBPL5, corresponding to a HOST TARGET binding site such as BINDING SITE I, BINDING SITE II or BINDING SITE III. Table 2 illustrates the complementarity of the nucleotide sequences of OSBPL5 BINDING SITE, designated SEQ ID:35989, to the nucleotide sequence of VGAM2147 RNA, herein designated VGAM RNA, also designated SEQ ID:4858.

Another function of VGAM2147 is therefore inhibition of Oxysterol Binding Protein-like 5 (OSBPL5, Accession XM_052567). Accordingly, utilities of VGAM2147 include diagnosis, prevention and treatment of diseases and clinical conditions associated with OSBPL5. SH3 and Multiple Ankyrin Repeat Domains 3 (SHANK3, Accession XM_037493) is another VGAM2147 host target gene. SHANK3 BINDING SITE is HOST TARGET binding site found in the 3' untranslated region of mRNA encoded by SHANK3, corresponding to a HOST TARGET binding site such as BINDING SITE I, BINDING SITE II or BINDING SITE III. Table 2 illustrates the complementarity of the nucleotide sequences of SHANK3 BINDING SITE, designated SEQ ID:32633, to the nucleotide sequence of VGAM2147 RNA, herein designated VGAM RNA, also designated SEQ ID:4858.

Another function of VGAM2147 is therefore inhibition of SH3 and Multiple Ankyrin Repeat Domains 3 (SHANK3, Accession XM_037493). Accordingly, utilities of VGAM2147 include diagnosis, prevention and treatment of diseases and clinical conditions associated with SHANK3. Ubiquitin Specific Protease 20 (USP20, Accession NM_006676) is another VGAM2147 host target gene. USP20 BINDING SITE is HOST TARGET binding site found in the 3' untranslated region of mRNA encoded by USP20, corresponding to a HOST TARGET binding site such as BINDING SITE I, BINDING SITE II or BINDING SITE III. Table 2 illustrates the complementarity of the nucleotide sequences of USP20 BINDING SITE, designated SEQ ID:13503, to the nucleotide sequence of VGAM2147 RNA, herein designated VGAM RNA, also designated SEQ ID:4858.

Another function of VGAM2147 is therefore inhibition of Ubiquitin Specific Protease 20 (USP20, Accession NM_006676). Accordingly, utilities of VGAM2147 include diagnosis, prevention and treatment of diseases and clinical conditions associated with USP20. LOC145717 (Accession XM_039771) is another VGAM2147 host target gene. LOC145717 BINDING SITE is HOST TARGET binding site found in the 3' untranslated region of mRNA encoded by LOC145717, corresponding to a HOST TARGET binding site such as BINDING SITE I, BINDING SITE II or BINDING SITE III. Table 2 illustrates the complementarity of the nucleotide sequences of LOC145717 BINDING SITE, designated SEQ ID:33194, to the nucleotide sequence of VGAM2147 RNA, herein designated VGAM RNA, also designated SEQ ID:4858.

Another function of VGAM2147 is therefore inhibition of LOC145717 (Accession XM_039771). Accordingly, utilities of VGAM2147 include diagnosis, prevention and treatment of diseases and clinical conditions associated with LOC145717. LOC157503 (Accession XM_098767) is another VGAM2147 host target gene. LOC157503 BINDING SITE is HOST TARGET binding site found in the 3' untranslated region of mRNA encoded by LOC157503, corresponding to a HOST TARGET binding site such as BINDING SITE I, BINDING SITE II or BINDING SITE III. Table 2 illustrates the complementarity of the nucleotide sequences of LOC157503 BINDING SITE, designated SEQ ID:41814, to the nucleotide sequence of VGAM2147 RNA, herein designated VGAM RNA, also designated SEQ ID:4858.

Another function of VGAM2147 is therefore inhibition of LOC157503 (Accession XM_098767). Accordingly, utilities of VGAM2147 include diagnosis, prevention and treatment of diseases and clinical conditions associated with LOC157503. LOC159199 (Accession XM_089441) is another VGAM2147 host target gene. LOC159199 BINDING SITE is HOST TARGET binding site found in the 5' untranslated region of mRNA encoded by LOC159199, corresponding to a HOST TARGET binding site such as BINDING SITE I, BINDING SITE II or BINDING SITE III. Table 2 illustrates the complementarity of the nucleotide sequences of LOC159199 BINDING SITE, designated SEQ ID:39981, to the nucleotide sequence of VGAM2147 RNA, herein designated VGAM RNA, also designated SEQ ID:4858.

Another function of VGAM2147 is therefore inhibition of LOC159199 (Accession XM_089441). Accordingly, utilities of VGAM2147 include diagnosis, prevention and treatment of diseases and clinical conditions associated with LOC159199. LOC205143 (Accession XM_119394) is another VGAM2147 host target gene. LOC205143 BINDING SITE is HOST TARGET binding site found in the 5' untranslated region of mRNA encoded by LOC205143, corresponding to a HOST TARGET binding site such as BINDING SITE I, BINDING SITE II or BINDING SITE III. Table 2 illustrates the complementarity of the nucleotide sequences of LOC205143 BINDING SITE, designated SEQ ID:43585, to the nucleotide sequence of VGAM2147 RNA, herein designated VGAM RNA, also designated SEQ ID:4858.

Another function of VGAM2147 is therefore inhibition of LOC205143 (Accession XM_119394). Accordingly, utilities of VGAM2147 include diagnosis, prevention and treatment of diseases and clinical conditions associated with LOC205143. LOC220537 (Accession XM_165406) is another VGAM2147 host target gene. LOC220537 BINDING SITE is HOST TARGET binding site found in the 3' untranslated region of mRNA encoded by LOC220537, corresponding to a HOST TARGET binding site such as BINDING SITE I, BINDING SITE II or BINDING SITE III. Table 2 illustrates the complementarity of the nucleotide sequences of LOC220537 BINDING SITE, designated SEQ ID:43623, to the nucleotide sequence of VGAM2147 RNA, herein designated VGAM RNA, also designated SEQ ID:4858.

Another function of VGAM2147 is therefore inhibition of LOC220537 (Accession XM_165406). Accordingly, utilities of VGAM2147 include diagnosis, prevention and treatment of diseases and clinical conditions associated with LOC220537. LOC256230 (Accession XM_173371) is another VGAM2147 host target gene. LOC256230 BINDING SITE is HOST TARGET binding site found in the 5' untranslated region of mRNA encoded by LOC256230, corresponding to a HOST TARGET binding site such as BINDING SITE I, BINDING SITE II or BINDING SITE III. Table 2 illustrates the complementarity of the nucleotide sequences of LOC256230 BINDING SITE, designated SEQ ID:46541, to the nucleotide sequence of VGAM2147 RNA, herein designated VGAM RNA, also designated SEQ ID:4858.

Another function of VGAM2147 is therefore inhibition of LOC256230 (Accession XM_173371). Accordingly, utilities of VGAM2147 include diagnosis, prevention and treatment of diseases and clinical conditions associated with LOC256230. LOC256231 (Accession XM_173372) is another VGAM2147 host target gene. LOC256231 BINDING SITE is HOST TARGET binding site found in the 5' untranslated region of mRNA encoded by LOC256231, corresponding to a HOST TARGET binding site such as BINDING SITE I, BINDING SITE II or BINDING SITE III. Table 2 illustrates the complementarity of the nucleotide sequences of LOC256231 BINDING SITE, designated SEQ ID:46543, to the nucleotide sequence of VGAM2147 RNA, herein designated VGAM RNA, also designated SEQ ID:4858.

Another function of VGAM2147 is therefore inhibition of LOC256231 (Accession XM_173372). Accordingly, utilities of VGAM2147 include diagnosis, prevention and treatment of diseases and clinical conditions associated with LOC256231. LOC256789 (Accession XM_173369) is another VGAM2147 host target gene. LOC256789 BINDING SITE is HOST TARGET binding site found in the 3' untranslated region of mRNA encoded by LOC256789, corresponding to a HOST TARGET binding site such as BINDING SITE I, BINDING SITE II or BINDING SITE III. Table 2 illustrates the complementarity of the nucleotide sequences of LOC256789 BINDING SITE, designated SEQ ID:46537, to the nucleotide sequence of VGAM2147 RNA, herein designated VGAM RNA, also designated SEQ ID:4858.

Another function of VGAM2147 is therefore inhibition of LOC256789 (Accession XM_173369). Accordingly, utilities of VGAM2147 include diagnosis, prevention and treatment of diseases and clinical conditions associated with LOC256789. LOC93538 (Accession XM_051927) is another VGAM2147 host target gene. LOC93538 BINDING SITE is HOST TARGET binding site found in the 5' untranslated region of mRNA encoded by LOC93538, corresponding to a HOST TARGET binding site such as BINDING SITE I, BINDING SITE II or BINDING SITE III. Table 2 illustrates the complementarity of the nucleotide sequences of LOC93538 BINDING SITE, designated SEQ ID:35924, to the nucleotide sequence of VGAM2147 RNA, herein designated VGAM RNA, also designated SEQ ID:4858.

Another function of VGAM2147 is therefore inhibition of LOC93538 (Accession XM_051927). Accordingly, utilities of VGAM2147 include diagnosis, prevention and treatment of diseases and clinical conditions associated with LOC93538. FIG. 1 further provides a conceptual description of a novel bioinformatically detected viral gene of the present invention, referred to here as Viral Genomic Address Messenger 2148 (VGAM2148) viral gene, which modulates expression of respective host target genes thereof, the function and utility of which host target genes is known in the art.

VGAM2148 is a novel bioinformatically detected regulatory, non protein coding, viral micro RNA (miRNA) gene. The method by which VGAM2148 was detected is described hereinabove with reference to FIGS. 1-8.

VGAM2148 gene, herein designated VGAM GENE, is a viral gene contained in the genome of Rana Tigrina Ranavirus. VGAM2148 host target gene, herein designated VGAM HOST TARGET GENE, is a human gene contained in the human genome.

VGAM2148 gene encodes a VGAM2148 precursor RNA, herein designated VGAM PRECURSOR RNA. Similar to other miRNA genes, and unlike most ordinary genes, VGAM2148 precursor RNA does not encode a protein. A nucleotide sequence identical or highly similar to the nucleotide sequence of VGAM2148 precursor RNA is designated SEQ ID:2134, and is provided hereinbelow with reference to the sequence listing part. Nucleotide sequence SEQ ID:2134 is located at position 62911 relative to the genome of Rana Tigrina Ranavirus.

VGAM2148 precursor RNA folds onto itself, forming VGAM2148 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2148 folded precursor RNA into VGAM2148 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM2148 RNA is designated SEQ ID:4859, and is provided hereinbelow with reference to the sequence listing part.

VGAM2148 host target gene, herein designated VGAM HOST TARGET GENE, encodes a corresponding messenger RNA, VGAM2148 host target RNA, herein designated VGAM HOST TARGET RNA. VGAM2148 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2148 RNA, herein designated VGAM RNA, binds complementarily to one or more host target binding sites located in untranslated regions of VGAM2148 host target RNA, herein designated VGAM HOST TARGET RNA. This complementary binding is due to the fact that the nucleotide sequence of VGAM2148 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2148 RNA, herein designated VGAM RNA, may have a different number of host target binding sites in untranslated regions of a VGAM2148 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2148 RNA, herein designated VGAM RNA, to host target binding sites on VGAM2148 host target RNA, herein designated VGAM HOST TARGET RNA, such as BINDING SITE I, BINDING SITE II and BINDING SITE III, inhibits translation of VGAM2148 host target RNA into VGAM2148 host target protein, herein designated VGAM HOST TARGET PROTEIN. VGAM host target protein is therefore outlined by a broken line.

It is appreciated that VGAM2148 host target gene, herein designated VGAM HOST TARGET GENE, in fact represents a plurality of VGAM2148 host target genes. The mRNA of each one of this plurality of VGAM2148 host target genes comprises one or more host target binding sites, each having a nucleotide sequence which is at least partly complementary to VGAM2148 RNA, herein designated VGAM RNA, and which when bound by VGAM2148 RNA causes inhibition of translation of respective one or more VGAM2148 host target proteins.

It is further appreciated by one skilled in the art that the mode of translational inhibition illustrated by FIG. 1 with specific reference to translational inhibition exerted by VGAM2148 gene, herein designated VGAM GENE, on one or more VGAM2148 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2148 is inhibition of expression of host target genes, as part of a novel viral mechanism of attacking a host. Accordingly, utilities of VGAM2148 include diagnosis, prevention and treatment of viral infection by Rana Tigrina Ranavirus. Specific functions, and accordingly utilities, of VGAM2148 correlate with, and may be deduced from, the identity of the host target genes which VGAM2148 binds and inhibits, and the function of these host target genes, as elaborated hereinbelow.

Nucleotide sequences of the VGAM2148 precursor RNA, herein designated VGAM PRECURSOR RNA, and of the 'diced' VGAM2148 RNA, herein designated VGAM RNA, and a schematic representation of the secondary folding of VGAM2148 folded precursor RNA, herein designated VGAM FOLDED PRECURSOR RNA, of VGAM2148 are further described hereinbelow with reference to Table 1.

Nucleotide sequences of host target binding sites, such as BINDING SITE-I, BINDING SITE-II and BINDING SITE-III of FIG. 1, found on VGAM2148 host target RNA, and schematic representation of the complementarity of each of these host target binding sites to VGAM2148 RNA, herein designated VGAM RNA, are described hereinbelow with reference to Table 2.

As mentioned hereinabove with reference to FIG. 1, a function of VGAM2148 gene, herein designated VGAM is inhibition of expression of VGAM2148 target genes. It is appreciated that specific functions, and accordingly utilities, of VGAM2148 correlate with, and may be deduced from, the identity of the target genes which VGAM2148 binds and inhibits, and the function of these target genes, as elaborated hereinbelow.

Low Density Lipoprotein Receptor (familial hypercholesterolemia) (LDLR, Accession NM_000527) is a VGAM2148 host target gene. LDLR BINDING SITE is HOST TARGET binding site found in the 3' untranslated region of mRNA encoded by LDLR, corresponding to a HOST TARGET binding site such as BINDING SITE I, BINDING SITE II or BINDING SITE III. Table 2 illustrates the complementarity of the nucleotide sequences of LDLR BINDING SITE, designated SEQ ID:6126, to the nucleotide sequence of VGAM2148 RNA, herein designated VGAM RNA, also designated SEQ ID:4859.

A function of VGAM2148 is therefore inhibition of Low Density Lipoprotein Receptor (familial hypercholesterolemia) (LDLR, Accession NM_000527), a gene which also acts as a tumor suppressor. Accordingly, utilities of VGAM2148 include diagnosis, prevention and treatment of diseases and clinical conditions associated with LDLR. The function of LDLR and its association with various diseases and clinical conditions, has been established by previous studies, as described hereinabove with reference to VGAM1030. Platelet-activating Factor Acetylhydrolase, Isoform Ib, Alpha Subunit 45 kDa (PAFAH1B1, Accession NM_000430) is another VGAM2148 host target gene. PAFAH1B1 BINDING SITE is HOST TARGET binding site found in the 3' untranslated region of mRNA encoded by PAFAH1B1, corresponding to a HOST TARGET binding site such as BINDING SITE I, BINDING SITE II or BINDING SITE III. Table 2 illustrates the complementarity of the nucleotide sequences of PAFAH1B1 BINDING SITE, designated SEQ ID:6007, to the nucleotide sequence of VGAM2148 RNA, herein designated VGAM RNA, also designated SEQ ID:4859.

Another function of VGAM2148 is therefore inhibition of Platelet-activating Factor Acetylhydrolase, Isoform Ib, Alpha Subunit 45 kDa (PAFAH1B1, Accession NM_000430). Accordingly, utilities of VGAM2148 include diagnosis, prevention and treatment of diseases and clinical conditions associated with PAFAH1B1. RAD50 Homolog (S. cerevisiae) (RAD50, Accession NM_005732) is another VGAM2148 host target gene. RAD50 BINDING SITE1 and RAD50 BINDING SITE2 are HOST TARGET binding sites found in untranslated regions of mRNA encoded by RAD50, corresponding to HOST TARGET binding sites such as BINDING SITE I, BINDING SITE II or BINDING SITE III. Table 2 illustrates the complementarity of the nucleotide sequences of RAD50 BINDING SITE1 and RAD50 BINDING SITE2, designated SEQ ID:12296 and SEQ ID:28554 respectively, to the nucleotide sequence of VGAM2148 RNA, herein designated VGAM RNA, also designated SEQ ID:4859.

Another function of VGAM2148 is therefore inhibition of RAD50 Homolog (S. cerevisiae) (RAD50, Accession NM_005732), a gene which is involved in dna double-strand break repair (dsbr). Accordingly, utilities of VGAM2148 include diagnosis, prevention and treatment of diseases and clinical conditions associated with RAD50. The function of RAD50 and its association with various diseases and clinical conditions, has been established by previous studies, as described hereinabove with reference to VGAM132. FLJ10618 (Accession NM_018155) is another VGAM2148 host target gene. FLJ10618 BINDING SITE is HOST TARGET binding site found in the 3' untranslated region of mRNA encoded by FLJ10618, corresponding to a HOST TARGET binding site such as BINDING SITE I, BINDING SITE II or BINDING SITE III. Table 2 illustrates the complementarity of the nucleotide sequences of FLJ10618 BINDING SITE, designated SEQ ID:19965, to the nucleotide sequence of VGAM2148 RNA, herein designated VGAM RNA, also designated SEQ ID:4859.

Another function of VGAM2148 is therefore inhibition of FLJ10618 (Accession NM_018155). Accordingly, utilities of VGAM2148 include diagnosis, prevention and treatment of diseases and clinical conditions associated with FLJ10618. KIAA0560 (Accession XM_029045) is another VGAM2148 host target gene. KIAA0560 BINDING SITE is HOST TARGET binding site found in the 3' untranslated region of mRNA encoded by KIAA0560, corresponding to a HOST TARGET binding site such as BINDING SITE I, BINDING SITE II or BINDING SITE III. Table 2 illustrates the complementarity of the nucleotide sequences of KIAA0560 BINDING SITE, designated SEQ ID:30836, to the nucleotide sequence of VGAM2148 RNA, herein designated VGAM RNA, also designated SEQ ID:4859.

Another function of VGAM2148 is therefore inhibition of KIAA0560 (Accession XM_029045). Accordingly, utilities of VGAM2148 include diagnosis, prevention and treatment of diseases and clinical conditions associated with KIAA0560. KIAA0748 (Accession NM_014796) is another VGAM2148 host target gene. KIAA0748 BINDING SITE is HOST TARGET binding site found in the 3' untranslated region of mRNA encoded by KIAA0748, corresponding to a HOST TARGET binding site such as BINDING SITE I, BINDING SITE II or BINDING SITE III. Table 2 illustrates the complementarity of the nucleotide sequences of KIAA0748 BINDING SITE, designated SEQ ID:16700, to the nucleotide sequence of VGAM2148 RNA, herein designated VGAM RNA, also designated SEQ ID:4859.

Another function of VGAM2148 is therefore inhibition of KIAA0748 (Accession NM_014796). Accordingly, utilities of VGAM2148 include diagnosis, prevention and treatment of diseases and clinical conditions associated with KIAA0748. KIAA0930 (Accession XM_047214) is another VGAM2148 host target gene. KIAA0930 BINDING SITE is HOST TARGET binding site found in the 3' untranslated region of mRNA encoded by KIAA0930, corresponding to a HOST TARGET binding site such as BINDING SITE I, BINDING SITE II or BINDING SITE III. Table 2 illustrates the complementarity of the nucleotide sequences of KIAA0930 BINDING SITE, designated SEQ ID:34910, to the nucleotide sequence of VGAM2148 RNA, herein designated VGAM RNA, also designated SEQ ID:4859.

Another function of VGAM2148 is therefore inhibition of KIAA0930 (Accession XM_047214). Accordingly, utilities of VGAM2148 include diagnosis, prevention and treatment of diseases and clinical conditions associated with KIAA0930. KIAA1238 (Accession XM_048675) is another VGAM2148 host target gene. KIAA1238 BINDING SITE is HOST TARGET binding site found in the 3' untranslated region of mRNA encoded by KIAA1238, corresponding to a HOST TARGET binding site such as BINDING SITE I, BINDING SITE II or BINDING SITE III. Table 2 illustrates the complementarity of the nucleotide sequences of KIAA1238 BINDING SITE, designated SEQ ID:35214, to the nucleotide sequence of VGAM2148 RNA, herein designated VGAM RNA, also designated SEQ ID:4859.

Another function of VGAM2148 is therefore inhibition of KIAA1238 (Accession XM_048675). Accordingly, utilities of VGAM2148 include diagnosis, prevention and treatment of diseases and clinical conditions associated with KIAA1238. SEF (Accession XM_045300) is another VGAM2148 host target gene. SEF BINDING SITE is HOST TARGET binding site found in the 3' untranslated region of mRNA encoded by SEF, corresponding to a HOST TARGET binding site such as BINDING SITE I, BINDING SITE II or BINDING SITE III. Table 2 illustrates the complementarity of the nucleotide sequences of SEF BINDING SITE, designated SEQ ID:34425, to the nucleotide sequence of VGAM2148 RNA, herein designated VGAM RNA, also designated SEQ ID:4859.

Another function of VGAM2148 is therefore inhibition of SEF (Accession XM_045300). Accordingly, utilities of VGAM2148 include diagnosis, prevention and treatment of diseases and clinical conditions associated with SEF. Ubiquitin-like, Containing PHD and RING Finger Domains, 2 (UHRF2, Accession XM_055929) is another VGAM2148 host target gene. UHRF2 BINDING SITE is HOST TARGET binding site found in the 3' untranslated region of mRNA encoded by UHRF2, corresponding to a HOST TARGET binding site such as BINDING SITE I, BINDING SITE II or BINDING SITE III. Table 2 illustrates the complementarity of the nucleotide sequences of UHRF2 BINDING SITE, designated SEQ ID:36355, to the nucleotide sequence of VGAM2148 RNA, herein designated VGAM RNA, also designated SEQ ID:4859.

Another function of VGAM2148 is therefore inhibition of Ubiquitin-like, Containing PHD and RING Finger Domains, 2 (UHRF2, Accession XM_055929). Accordingly, utilities of VGAM2148 include diagnosis, prevention and treatment of diseases and clinical conditions associated with UHRF2. LOC133258 (Accession XM_068260) is another VGAM2148 host target gene. LOC133258 BINDING SITE is HOST TARGET binding site found in the 5' untranslated region of mRNA encoded by LOC133258, corresponding to a HOST TARGET binding site such as BINDING SITE I, BINDING SITE II or BINDING SITE III. Table 2 illustrates the complementarity of the nucleotide sequences of LOC133258 BINDING SITE, designated SEQ ID:37377, to the nucleotide sequence of VGAM2148 RNA, herein designated VGAM RNA, also designated SEQ ID:4859.

Another function of VGAM2148 is therefore inhibition of LOC133258 (Accession XM_068260). Accordingly, utilities of VGAM2148 include diagnosis, prevention and treatment of diseases and clinical conditions associated with LOC133258. LOC146229 (Accession XM_085387) is another VGAM2148 host target gene. LOC146229 BINDING SITE is HOST TARGET binding site found in the 3' untranslated region of mRNA encoded by LOC146229, corresponding to a HOST TARGET binding site such as BINDING SITE I, BINDING SITE II or BINDING SITE III. Table 2 illustrates the complementarity of the nucleotide sequences of LOC146229 BINDING SITE, designated SEQ ID:38106, to the nucleotide sequence of VGAM2148 RNA, herein designated VGAM RNA, also designated SEQ ID:4859.

Another function of VGAM2148 is therefore inhibition of LOC146229 (Accession XM_085387). Accordingly, utilities of VGAM2148 include diagnosis, prevention and treatment of diseases and clinical conditions associated with LOC146229. LOC148824 (Accession XM_097527) is another VGAM2148 host target gene. LOC148824 BINDING SITE is HOST TARGET binding site found in the 3' untranslated region of mRNA encoded by LOC148824, corresponding to a HOST TARGET binding site such as BINDING SITE I, BINDING SITE II or BINDING SITE III. Table 2 illustrates the complementarity of the nucleotide sequences of LOC148824 BINDING SITE, designated SEQ ID:40907, to the nucleotide sequence of VGAM2148 RNA, herein designated VGAM RNA, also designated SEQ ID:4859.

Another function of VGAM2148 is therefore inhibition of LOC148824 (Accession XM_097527). Accordingly, utilities of VGAM2148 include diagnosis, prevention and treatment of diseases and clinical conditions associated with LOC148824. LOC221042 (Accession XM_167669) is another VGAM2148 host target gene. LOC221042 BINDING SITE is HOST TARGET binding site found in the 3' untranslated region of mRNA encoded by LOC221042, corresponding to a HOST TARGET binding site such as BINDING SITE I, BINDING SITE II or BINDING SITE III. Table 2 illustrates the complementarity of the nucleotide sequences of LOC221042 BINDING SITE, designated SEQ ID:44749, to the nucleotide sequence of VGAM2148 RNA, herein designated VGAM RNA, also designated SEQ ID:4859.

Another function of VGAM2148 is therefore inhibition of LOC221042 (Accession XM_167669). Accordingly, utilities of VGAM2148 include diagnosis, prevention and treatment of diseases and clinical conditions associated with LOC221042. FIG. 1 further provides a conceptual description of a novel bioinformatically detected viral gene of the present invention, referred to here as Viral Genomic Address Messenger 2149 (VGAM2149) viral gene, which modulates expression of respective host target genes thereof, the function and utility of which host target genes is known in the art.

VGAM2149 is a novel bioinformatically detected regulatory, non protein coding, viral micro RNA (miRNA) gene. The method by which VGAM2149 was detected is described hereinabove with reference to FIGS. 1-8.

VGAM2149 gene, herein designated VGAM GENE, is a viral gene contained in the genome of Rana Tigrina Ranavirus. VGAM2149 host target gene, herein designated VGAM HOST TARGET GENE, is a human gene contained in the human genome.

VGAM2149 gene encodes a VGAM2149 precursor RNA, herein designated VGAM PRECURSOR RNA. Similar to other miRNA genes, and unlike most ordinary genes, VGAM2149 precursor RNA does not encode a protein. A nucleotide sequence identical or highly similar to the nucleotide sequence of VGAM2149 precursor RNA is designated SEQ ID:2135, and is provided hereinbelow with reference to the sequence listing part. Nucleotide sequence SEQ ID:2135 is located at position 50593 relative to the genome of Rana Tigrina Ranavirus.

VGAM2149 precursor RNA folds onto itself, forming VGAM2149 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2149 folded precursor RNA into VGAM2149 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2149 RNA is designated SEQ ID:4860, and is provided hereinbelow with reference to the sequence listing part.

VGAM2149 host target gene, herein designated VGAM HOST TARGET GENE, encodes a corresponding messenger RNA, VGAM2149 host target RNA, herein designated VGAM HOST TARGET RNA. VGAM2149 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2149 RNA, herein designated VGAM RNA, binds complementarily to one or more host target binding sites located in untranslated regions of VGAM2149 host target RNA, herein designated VGAM HOST TARGET RNA. This complementary binding is due to the fact that the nucleotide sequence of VGAM2149 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2149 RNA, herein designated VGAM RNA, may have a different number of host target binding sites in untranslated regions of a VGAM2149 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2149 RNA, herein designated VGAM RNA, to host target binding sites on VGAM2149 host target RNA, herein designated VGAM HOST TARGET RNA, such as BINDING SITE I, BINDING SITE II and BINDING SITE III, inhibits translation of VGAM2149 host target RNA into VGAM2149 host target protein, herein designated VGAM HOST TARGET PROTEIN. VGAM host target protein is therefore outlined by a broken line.

It is appreciated that VGAM2149 host target gene, herein designated VGAM HOST TARGET GENE, in fact represents a plurality of VGAM2149 host target genes. The mRNA of each one of this plurality of VGAM2149 host target genes comprises one or more host target binding sites, each having a nucleotide sequence which is at least partly complementary to VGAM2149 RNA, herein designated VGAM RNA, and which when bound by VGAM2149 RNA causes inhibition of translation of respective one or more VGAM2149 host target proteins.

It is further appreciated by one skilled in the art that the mode of translational inhibition illustrated by FIG. 1 with specific reference to translational inhibition exerted by VGAM2149 gene, herein designated VGAM GENE, on one or more VGAM2149 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2149 is inhibition of expression of host target genes, as part of a novel viral mechanism of attacking a host. Accordingly, utilities of VGAM2149 include diagnosis, prevention and treatment of viral infection by Rana Tigrina Ranavirus. Specific functions, and accordingly utilities, of VGAM2149 correlate with, and may be deduced from, the identity of the host target genes which VGAM2149 binds and inhibits, and the function of these host target genes, as elaborated hereinbelow.

Nucleotide sequences of the VGAM2149 precursor RNA, herein designated VGAM PRECURSOR RNA, and of the 'diced' VGAM2149 RNA, herein designated VGAM RNA, and a schematic representation of the secondary folding of VGAM2149 folded precursor RNA, herein designated VGAM FOLDED PRECURSOR RNA, of VGAM2149 are further described hereinbelow with reference to Table 1.

Nucleotide sequences of host target binding sites, such as BINDING SITE-I, BINDING SITE-II and BINDING SITE-III of FIG. 1, found on VGAM2149 host target RNA, and schematic representation of the complementarity of each of these host target binding sites to VGAM2149 RNA, herein designated VGAM RNA, are described hereinbelow with reference to Table 2.

As mentioned hereinabove with reference to FIG. 1, a function of VGAM2149 gene, herein designated VGAM is inhibition of expression of VGAM2149 target genes. It is appreciated that specific functions, and accordingly utilities, of VGAM2149 correlate with, and may be deduced from, the identity of the target genes which VGAM2149 binds and inhibits, and the function of these target genes, as elaborated hereinbelow.

ATP-binding Cassette, Sub-family A (ABC1), Member 1 (ABCA1, Accession NM_005502) is a VGAM2149 host target gene. ABCA1 BINDING SITE is HOST TARGET binding site found in the 3' untranslated region of mRNA encoded by ABCA1, corresponding to a HOST TARGET binding site such as BINDING SITE I, BINDING SITE II or BINDING SITE III. Table 2 illustrates the complementarity of the nucleotide sequences of ABCA1 BINDING SITE, designated SEQ ID:12014, to the nucleotide sequence of VGAM2149 RNA, herein designated VGAM RNA, also designated SEQ ID:4860.

A function of VGAM2149 is therefore inhibition of ATP-binding Cassette, Sub-family A (ABC1), Member 1

(ABCA1, Accession NM_005502), a gene which camp-dependent and sulfonylurea-sensitive anion transporter. Accordingly, utilities of VGAM2149 include diagnosis, prevention and treatment of diseases and clinical conditions associated with ABCA1. The function of ABCA1 and its association with various diseases and clinical conditions, has been established by previous studies, as described hereinabove with reference to VGAM1956. General Transcription Factor II, I (GTF2I, Accession NM_032999) is another VGAM2149 host target gene. GTF2I BINDING SITE1 and GTF2I BINDING SITE2 are HOST TARGET binding sites found in untranslated regions of mRNA encoded by GTF2I, corresponding to HOST TARGET binding sites such as BINDING SITE I, BINDING SITE II or BINDING SITE III. Table 2 illustrates the complementarity of the nucleotide sequences of GTF2I BINDING SITE1 and GTF2I BINDING SITE2, designated SEQ ID:26884 and SEQ ID:26888 respectively, to the nucleotide sequence of VGAM2149 RNA, herein designated VGAM RNA, also designated SEQ ID:4860.

Another function of VGAM2149 is therefore inhibition of General Transcription Factor II, I (GTF2I, Accession NM_032999), a gene which interacts with the basal transcription machinery by coordinating the formation of a multiprotein complex at the c-fos promoter, and linking specific signal responsive activator complexes. Accordingly, utilities of VGAM2149 include diagnosis, prevention and treatment of diseases and clinical conditions associated with GTF2I. The function of GTF2I and its association with various diseases and clinical conditions, has been established by previous studies, as described hereinabove with reference to VGAM115. FLJ21736 (Accession NM_024922) is another VGAM2149 host target gene. FLJ21736 BINDING SITE is HOST TARGET binding site found in the 5' untranslated region of mRNA encoded by FLJ21736, corresponding to a HOST TARGET binding site such as BINDING SITE I, BINDING SITE II or BINDING SITE III. Table 2 illustrates the complementarity of the nucleotide sequences of FLJ21736 BINDING SITE, designated SEQ ID:24457, to the nucleotide sequence of VGAM2149 RNA, herein designated VGAM RNA, also designated SEQ ID:4860.

Another function of VGAM2149 is therefore inhibition of FLJ21736 (Accession NM_024922). Accordingly, utilities of VGAM2149 include diagnosis, prevention and treatment of diseases and clinical conditions associated with FLJ21736. KIAA1582 (Accession XM_037262) is another VGAM2149 host target gene. KIAA1582 BINDING SITE is HOST TARGET binding site found in the 5' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32588, to the nucleotide sequence of VGAM2149 RNA, herein designated VGAM RNA, also designated SEQ ID:4860.

Another function of VGAM2149 is therefore inhibition of KIAA1582 (Accession XM_037262). Accordingly, utilities of VGAM2149 include diagnosis, prevention and treatment of diseases and clinical conditions associated with KIAA1582. KIAA1775 (Accession NM_033100) is another VGAM2149 host target gene. KIAA1775 BINDING SITE is HOST TARGET binding site found in the 3' untranslated region of mRNA encoded by KIAA1775, corresponding to a HOST TARGET binding site such as BINDING SITE I, BINDING SITE II or BINDING SITE III. Table 2 illustrates the complementarity of the nucleotide sequences of KIAA1775 BINDING SITE, designated SEQ ID:26940, to the nucleotide sequence of VGAM2149 RNA, herein designated VGAM RNA, also designated SEQ ID:4860.

Another function of VGAM2149 is therefore inhibition of KIAA1775 (Accession NM_033100). Accordingly, utilities of VGAM2149 include diagnosis, prevention and treatment of diseases and clinical conditions associated with KIAA1775. Lysosomal-associated Membrane Protein 3 (LAMP3, Accession XM_003022) is another VGAM2149 host target gene. LAMP3 BINDING SITE is HOST TARGET binding site found in the 3' untranslated region of mRNA encoded by LAMP3, corresponding to a HOST TARGET binding site such as BINDING SITE I, BINDING SITE II or BINDING SITE III. Table 2 illustrates the complementarity of the nucleotide sequences of LAMP3 BINDING SITE, designated SEQ ID:29918, to the nucleotide sequence of VGAM2149 RNA, herein designated VGAM RNA, also designated SEQ ID:4860.

Another function of VGAM2149 is therefore inhibition of Lysosomal-associated Membrane Protein 3 (LAMP3, Accession XM_003022). Accordingly, utilities of VGAM2149 include diagnosis, prevention and treatment of diseases and clinical conditions associated with LAMP3. LW-1 (Accession XM_013128) is another VGAM2149 host target gene. LW-1 BINDING SITE1 and LW-1 BINDING SITE2 are HOST TARGET binding sites found in untranslated regions of mRNA encoded by LW-1, corresponding to HOST TARGET binding sites such as BINDING SITE I, BINDING SITE II or BINDING SITE III. Table 2 illustrates the complementarity of the nucleotide sequences of LW-1 BINDING SITE1 and LW-1 BINDING SITE2, designated SEQ ID:30232 and SEQ ID:18241 respectively, to the nucleotide sequence of VGAM2149 RNA, herein designated VGAM RNA, also designated SEQ ID:4860.

Another function of VGAM2149 is therefore inhibition of LW-1 (Accession XM_013128). Accordingly, utilities of VGAM2149 include diagnosis, prevention and treatment of diseases and clinical conditions associated with LW-1. LOC145781 (Accession XM_085235) is another VGAM2149 host target gene. LOC145781 BINDING SITE is HOST TARGET binding site found in the 3' untranslated region of mRNA encoded by LOC145781, corresponding to a HOST TARGET binding site such as BINDING SITE I, BINDING SITE II or BINDING SITE III. Table 2 illustrates the complementarity of the nucleotide sequences of LOC145781 BINDING SITE, designated SEQ ID:37981, to the nucleotide sequence of VGAM2149 RNA, herein designated VGAM RNA, also designated SEQ ID:4860.

Another function of VGAM2149 is therefore inhibition of LOC145781 (Accession XM_085235). Accordingly, utilities of VGAM2149 include diagnosis, prevention and treatment of diseases and clinical conditions associated with LOC145781. FIG. 1 further provides a conceptual description of a novel bioinformatically detected viral gene of the present invention, referred to here as Viral Genomic Address Messenger 2150 (VGAM2150) viral gene, which modulates expression of respective host target genes thereof, the function and utility of which host target genes is known in the art.

VGAM2150 is a novel bioinformatically detected regulatory, non protein coding, viral micro RNA (miRNA) gene. The method by which VGAM2150 was detected is described hereinabove with reference to FIGS. 1-8.

VGAM2150 gene, herein designated VGAM GENE, is a viral gene contained in the genome of Rana Tigrina Ranavirus. VGAM2150 host target gene, herein designated VGAM HOST TARGET GENE, is a human gene contained in the human genome.

VGAM2150 gene encodes a VGAM2150 precursor RNA, herein designated VGAM PRECURSOR RNA. Similar to other miRNA genes, and unlike most ordinary genes, VGAM2150 precursor RNA does not encode a protein. A nucleotide sequence identical or highly similar to the nucleotide sequence of VGAM2150 precursor RNA is designated SEQ ID:2136, and is provided hereinbelow with reference to the sequence listing part. Nucleotide sequence SEQ ID:2136 is located at position 52091 relative to the genome of Rana Tigrina Ranavirus.

VGAM2150 precursor RNA folds onto itself, forming VGAM2150 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2150 folded precursor RNA into VGAM2150 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2150 RNA is designated SEQ ID:4861, and is provided hereinbelow with reference to the sequence listing part.

VGAM2150 host target gene, herein designated VGAM HOST TARGET GENE, encodes a corresponding messenger RNA, VGAM2150 host target RNA, herein designated VGAM HOST TARGET RNA. VGAM2150 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2150 RNA, herein designated VGAM RNA, binds complementarily to one or more host target binding sites located in untranslated regions of VGAM2150 host target RNA, herein designated VGAM HOST TARGET RNA. This complementary binding is due to the fact that the nucleotide sequence of VGAM2150 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2150 RNA, herein designated VGAM RNA, may have a different number of host target binding sites in untranslated regions of a VGAM2150 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2150 RNA, herein designated VGAM RNA, to host target binding sites on VGAM2150 host target RNA, herein designated VGAM HOST TARGET RNA, such as BINDING SITE I, BINDING SITE II and BINDING SITE III, inhibits translation of VGAM2150 host target RNA into VGAM2150 host target protein, herein designated VGAM HOST TARGET PROTEIN. VGAM host target protein is therefore outlined by a broken line.

It is appreciated that VGAM2150 host target gene, herein designated VGAM HOST TARGET GENE, in fact represents a plurality of VGAM2150 host target genes. The mRNA of each one of this plurality of VGAM2150 host target genes comprises one or more host target binding sites, each having a nucleotide sequence which is at least partly complementary to VGAM2150 RNA, herein designated VGAM RNA, and which when bound by VGAM2150 RNA causes inhibition of translation of respective one or more VGAM2150 host target proteins.

It is further appreciated by one skilled in the art that the mode of translational inhibition illustrated by FIG. 1 with specific reference to translational inhibition exerted by VGAM2150 gene, herein designated VGAM GENE, on one or more VGAM2150 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2150 is inhibition of expression of host target genes, as part of a novel viral mechanism of attacking a host. Accordingly, utilities of VGAM2150 include diagnosis, prevention and treatment of viral infection by Rana Tigrina Ranavirus. Specific functions, and accordingly utilities, of VGAM2150 correlate with, and may be deduced from, the identity of the host target genes which VGAM2150 binds and inhibits, and the function of these host target genes, as elaborated hereinbelow.

Nucleotide sequences of the VGAM2150 precursor RNA, herein designated VGAM PRECURSOR RNA, and of the 'diced' VGAM2150 RNA, herein designated VGAM RNA, and a schematic representation of the secondary folding of VGAM2150 folded precursor RNA, herein designated VGAM FOLDED PRECURSOR RNA, of VGAM2150 are further described hereinbelow with reference to Table 1.

Nucleotide sequences of host target binding sites, such as BINDING SITE-I, BINDING SITE-II and BINDING SITE-III of FIG. 1, found on VGAM2150 host target RNA, and schematic representation of the complementarity of each of these host target binding sites to VGAM2150 RNA, herein designated VGAM RNA, are described hereinbelow with reference to Table 2.

As mentioned hereinabove with reference to FIG. 1, a function of VGAM2150 gene, herein designated VGAM is inhibition of expression of VGAM2150 target genes. It is appreciated that specific functions, and accordingly utilities, of VGAM2150 correlate with, and may be deduced from, the identity of the target genes which VGAM2150 binds and inhibits, and the function of these target genes, as elaborated hereinbelow.

Membrane-spanning 4-domains, Subfamily A, Member 1 (MS4A1, Accession NM_000139) is a VGAM2150 host target gene. MS4A1 BINDING SITE is HOST TARGET binding site found in the 3' untranslated region of mRNA encoded by MS4A1, corresponding to a HOST TARGET binding site such as BINDING SITE I, BINDING SITE II or BINDING SITE III. Table 2 illustrates the complementarity of the nucleotide sequences of MS4A1 BINDING SITE, designated SEQ ID:5635, to the nucleotide sequence of VGAM2150 RNA, herein designated VGAM RNA, also designated SEQ ID:4861.

A function of VGAM2150 is therefore inhibition of Membrane-spanning 4-domains, Subfamily A, Member 1 (MS4A1, Accession NM_000139), a gene which may be involved in the regulation of b-cell activation and proliferation. Accordingly, utilities of VGAM2150 include diagnosis, prevention and treatment of diseases and clinical conditions associated with MS4A1. The function of MS4A1 and its association with various diseases and clinical conditions, has been established by previous studies, as described hereinabove with reference to VGAM362. DKFZp434F1719 (Accession NM_032248) is another VGAM2150 host target gene. DKFZp434F1719 BINDING SITE is HOST TARGET binding site found in the 3' untranslated region of mRNA encoded by DKFZp434F1719, corresponding to a HOST TARGET binding site such as BINDING SITE I, BINDING SITE II or BINDING SITE III. Table 2 illustrates the complementarity of the nucleotide sequences of DKFZp434F1719 BINDING SITE, designated SEQ ID:25987, to the nucleotide sequence of VGAM2150 RNA, herein designated VGAM RNA, also designated SEQ ID:4861.

Another function of VGAM2150 is therefore inhibition of DKFZp434F1719 (Accession NM_032248). Accordingly, utilities of VGAM2150 include diagnosis, prevention and treatment of diseases and clinical conditions associated with DKFZp434F1719. FLJ14082 (Accession NM_025024) is another VGAM2150 host target gene. FLJ14082 BINDING SITE is HOST TARGET binding site found in the 3' untranslated region of mRNA encoded by FLJ14082, corresponding to a HOST TARGET binding site such as BINDING SITE I, BINDING SITE II or BINDING SITE III. Table 2 illustrates the complementarity of the nucleotide sequences of FLJ14082 BINDING SITE, designated SEQ ID:24607, to the nucleotide sequence of VGAM2150 RNA, herein designated VGAM RNA, also designated SEQ ID:4861.

Another function of VGAM2150 is therefore inhibition of FLJ14082 (Accession NM_025024). Accordingly, utilities of VGAM2150 include diagnosis, prevention and treatment of diseases and clinical conditions associated with FLJ14082. KIAA0471 (Accession NM_014857) is another VGAM2150 host target gene. KIAA0471 BINDING SITE is HOST TARGET binding site found in the 3' untranslated region of mRNA encoded by KIAA0471, corresponding to a HOST TARGET binding site such as BINDING SITE I, BINDING SITE II or BINDING SITE III. Table 2 illustrates the complementarity of the nucleotide sequences of KIAA0471 BINDING SITE, designated SEQ ID:16906, to the nucleotide sequence of VGAM2150 RNA, herein designated VGAM RNA, also designated SEQ ID:4861.

Another function of VGAM2150 is therefore inhibition of KIAA0471 (Accession NM_014857). Accordingly, utilities of VGAM2150 include diagnosis, prevention and treatment of diseases and clinical conditions associated with KIAA0471. KIAA0523 (Accession XM_041964) is another VGAM2150 host target gene. KIAA0523 BINDING SITE is HOST TARGET binding site found in the 3' untranslated region of mRNA encoded by KIAA0523, corresponding to a HOST TARGET binding site such as BINDING SITE I, BINDING SITE II or BINDING SITE III. Table 2 illustrates the complementarity of the nucleotide sequences of KIAA0523 BINDING SITE, designated SEQ ID:33645, to the nucleotide sequence of VGAM2150 RNA, herein designated VGAM RNA, also designated SEQ ID:4861.

Another function of VGAM2150 is therefore inhibition of KIAA0523 (Accession XM_041964). Accordingly, utilities of VGAM2150 include diagnosis, prevention and treatment of diseases and clinical conditions associated with KIAA0523. KIAA1674 (Accession XM_044065) is another VGAM2150 host target gene. KIAA1674 BINDING SITE is HOST TARGET binding site found in the 3' untranslated region of mRNA encoded by KIAA1674, corresponding to a HOST TARGET binding site such as BINDING SITE I, BINDING SITE II or BINDING SITE III. Table 2 illustrates the complementarity of the nucleotide sequences of KIAA1674 BINDING SITE, designated SEQ ID:34101, to the nucleotide sequence of VGAM2150 RNA, herein designated VGAM RNA, also designated SEQ ID:4861.

Another function of VGAM2150 is therefore inhibition of KIAA1674 (Accession XM_044065). Accordingly, utilities of VGAM2150 include diagnosis, prevention and treatment of diseases and clinical conditions associated with KIAA1674. KIAA1775 (Accession NM_033100) is another VGAM2150 host target gene. KIAA1775 BINDING SITE is HOST TARGET binding site found in the 3' untranslated region of mRNA encoded by KIAA1775, corresponding to a HOST TARGET binding site such as BINDING SITE I, BINDING SITE II or BINDING SITE III. Table 2 illustrates the complementarity of the nucleotide sequences of KIAA1775 BINDING SITE, designated SEQ ID:26939, to the nucleotide sequence of VGAM2150 RNA, herein designated VGAM RNA, also designated SEQ ID:4861.

Another function of VGAM2150 is therefore inhibition of KIAA1775 (Accession NM_033100). Accordingly, utilities of VGAM2150 include diagnosis, prevention and treatment of diseases and clinical conditions associated with KIAA1775. LOC145135 (Accession XM_096721) is another VGAM2150 host target gene. LOC145135 BINDING SITE is HOST TARGET binding site found in the 5' untranslated region of mRNA encoded by LOC145135, corresponding to a HOST TARGET binding site such as BINDING SITE I, BINDING SITE II or BINDING SITE III. Table 2 illustrates the complementarity of the nucleotide sequences of LOC145135 BINDING SITE, designated SEQ ID:40497, to the nucleotide sequence of VGAM2150 RNA, herein designated VGAM RNA, also designated SEQ ID:4861.

Another function of VGAM2150 is therefore inhibition of LOC145135 (Accession XM_096721). Accordingly, utilities of VGAM2150 include diagnosis, prevention and treatment of diseases and clinical conditions associated with LOC145135. LOC92285 (Accession XM_044051) is another VGAM2150 host target gene. LOC92285 BINDING SITE is HOST TARGET binding site found in the 5' untranslated region of mRNA encoded by LOC92285, corresponding to a HOST TARGET binding site such as BINDING SITE I, BINDING SITE II or BINDING SITE III. Table 2 illustrates the complementarity of the nucleotide sequences of LOC92285 BINDING SITE, designated SEQ ID:34094, to the nucleotide sequence of VGAM2150 RNA, herein designated VGAM RNA, also designated SEQ ID:4861.

Another function of VGAM2150 is therefore inhibition of LOC92285 (Accession XM_044051). Accordingly, utilities of VGAM2150 include diagnosis, prevention and treatment of diseases and clinical conditions associated with LOC92285. FIG. 1 further provides a conceptual description of a novel bioinformatically detected viral gene of the present invention, referred to here as Viral Genomic Address Messenger 2151 (VGAM2151) viral gene, which modulates expression of respective host target genes thereof, the function and utility of which host target genes is known in the art.

VGAM2151 is a novel bioinformatically detected regulatory, non protein coding, viral micro RNA (miRNA) gene.

The method by which VGAM2151 was detected is described hereinabove with reference to FIGS. 1-8.

VGAM2151 gene, herein designated VGAM GENE, is a viral gene contained in the genome of Rana Tigrina Ranavirus. VGAM2151 host target gene, herein designated VGAM HOST TARGET GENE, is a human gene contained in the human genome.

VGAM2151 gene encodes a VGAM2151 precursor RNA, herein designated VGAM PRECURSOR RNA. Similar to other miRNA genes, and unlike most ordinary genes, VGAM2151 precursor RNA does not encode a protein. A nucleotide sequence identical or highly similar to the nucleotide sequence of VGAM2151 precursor RNA is designated SEQ ID:2137, and is provided hereinbelow with reference to the sequence listing part. Nucleotide sequence SEQ ID:2137 is located at position 54437 relative to the genome of Rana Tigrina Ranavirus.

VGAM2151 precursor RNA folds onto itself, forming VGAM2151 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2151 folded precursor RNA into VGAM2151 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2151 RNA is designated SEQ ID:4862, and is provided hereinbelow with reference to the sequence listing part.

VGAM2151 host target gene, herein designated VGAM HOST TARGET GENE, encodes a corresponding messenger RNA, VGAM2151 host target RNA, herein designated VGAM HOST TARGET RNA. VGAM2151 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2151 RNA, herein designated VGAM RNA, binds complementarily to one or more host target binding sites located in untranslated regions of VGAM2151 host target RNA, herein designated VGAM HOST TARGET RNA. This complementary binding is due to the fact that the nucleotide sequence of VGAM2151 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2151 RNA, herein designated VGAM RNA, may have a different number of host target binding sites in untranslated regions of a VGAM2151 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2151 RNA, herein designated VGAM RNA, to host target binding sites on VGAM2151 host target RNA, herein designated VGAM HOST TARGET RNA, such as BINDING SITE I, BINDING SITE II and BINDING SITE III, inhibits translation of VGAM2151 host target RNA into VGAM2151 host target protein, herein designated VGAM HOST TARGET PROTEIN. VGAM host target protein is therefore outlined by a broken line.

It is appreciated that VGAM2151 host target gene, herein designated VGAM HOST TARGET GENE, in fact represents a plurality of VGAM2151 host target genes. The mRNA of each one of this plurality of VGAM2151 host target genes comprises one or more host target binding sites, each having a nucleotide sequence which is at least partly complementary to VGAM2151 RNA, herein designated VGAM RNA, and which when bound by VGAM2151 RNA causes inhibition of translation of respective one or more VGAM2151 host target proteins.

It is further appreciated by one skilled in the art that the mode of translational inhibition illustrated by FIG. 1 with specific reference to translational inhibition exerted by VGAM2151 gene, herein designated VGAM GENE, on one or more VGAM2151 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2151 is inhibition of expression of host target genes, as part of a novel viral mechanism of attacking a host. Accordingly, utilities of VGAM2151 include diagnosis, prevention and treatment of viral infection by Rana Tigrina Ranavirus. Specific functions, and accordingly utilities, of VGAM2151 correlate with, and may be deduced from, the identity of the host target genes which VGAM2151 binds and inhibits, and the function of these host target genes, as elaborated hereinbelow.

Nucleotide sequences of the VGAM2151 precursor RNA, herein designated VGAM PRECURSOR RNA, and of the 'diced' VGAM2151 RNA, herein designated VGAM RNA, and a schematic representation of the secondary folding of VGAM2151 folded precursor RNA, herein designated VGAM FOLDED PRECURSOR RNA, of VGAM2151 are further described hereinbelow with reference to Table 1.

Nucleotide sequences of host target binding sites, such as BINDING SITE-I, BINDING SITE-II and BINDING SITE-III of FIG. 1, found on VGAM2151 host target RNA, and schematic representation of the complementarity of each of these host target binding sites to VGAM2151 RNA, herein designated VGAM RNA, are described hereinbelow with reference to Table 2.

As mentioned hereinabove with reference to FIG. 1, a function of VGAM2151 gene, herein designated VGAM is inhibition of expression of VGAM2151 target genes. It is appreciated that specific functions, and accordingly utilities, of VGAM2151 correlate with, and may be deduced from, the identity of the target genes which VGAM2151 binds and inhibits, and the function of these target genes, as elaborated hereinbelow.

A Disintegrin and Metalloproteinase Domain 10 (ADAM10, Accession NM_001110) is a VGAM2151 host target gene. ADAM10 BINDING SITE is HOST TARGET binding site found in the 5' untranslated region of mRNA encoded by ADAM10, corresponding to a HOST TARGET binding site such as BINDING SITE I, BINDING SITE II or BINDING SITE III. Table 2 illustrates the complementarity of the nucleotide sequences of ADAM10 BINDING SITE, designated SEQ ID:6768, to the nucleotide sequence of VGAM2151 RNA, herein designated VGAM RNA, also designated SEQ ID:4862.

A function of VGAM2151 is therefore inhibition of A Disintegrin and Metalloproteinase Domain 10 (ADAM10, Accession NM_001110), a gene which Member of ADAM family of zinc metalloproteases. Accordingly, utilities of VGAM2151 include diagnosis, prevention and treatment of diseases and clinical conditions associated with ADAM10. The function of ADAM10 and its association with various diseases and clinical conditions, has been established by previous studies, as described hereinabove with reference to VGAM706. ADP-ribosyltransferase (NAD+; poly (ADP-ribose) Polymerase) (ADPRT, Accession NM_001618) is another VGAM2151 host target gene. ADPRT BINDING SITE is HOST TARGET binding site found in the 5' untranslated region of mRNA encoded by ADPRT, corresponding to a HOST TARGET binding site such as BINDING SITE I, BINDING SITE II or BINDING SITE III. Table 2 illustrates the complementarity of the nucleotide sequences of ADPRT BINDING SITE, designated SEQ ID:7325, to the nucleotide sequence of VGAM2151 RNA, herein designated VGAM RNA, also designated SEQ ID:4862.

Another function of VGAM2151 is therefore inhibition of ADP-ribosyltransferase (NAD+; poly (ADP-ribose) Polymerase) (ADPRT, Accession NM_001618), a gene which catalyzes addition of mono-ADP-ribose to arginine residues of proteins, inhibits Pol II transcription. Accordingly, utilities of VGAM2151 include diagnosis, prevention and treatment of diseases and clinical conditions associated with ADPRT. The function of ADPRT and its association with various diseases and clinical conditions, has been established by previous studies, as described hereinabove with reference to VGAM506. 1-acylglycerol-3-phosphate O-acyltransferase 2 (lysophosphatidic acid acyltransferase, beta) (AGPAT2, Accession NM_006412) is another VGAM2151 host target gene. AGPAT2 BINDING SITE1 and AGPAT2 BINDING SITE2 are HOST TARGET binding sites found in untranslated regions of mRNA encoded by AGPAT2, corresponding to HOST TARGET binding sites such as BINDING SITE I, BINDING SITE II or BINDING SITE III. Table 2 illustrates the complementarity of the nucleotide sequences of AGPAT2 BINDING SITE1 and AGPAT2 BINDING SITE2, designated SEQ ID:13118 and SEQ ID:32745 respectively, to the nucleotide sequence of VGAM2151 RNA, herein designated VGAM RNA, also designated SEQ ID:4862.

Another function of VGAM2151 is therefore inhibition of 1-acylglycerol-3-phosphate O-acyltransferase 2 (lysophosphatidic acid acyltransferase, beta) (AGPAT2, Accession NM_006412). Accordingly, utilities of VGAM2151 include diagnosis, prevention and treatment of diseases and clinical conditions associated with AGPAT2. V-raf Murine Sarcoma 3611 Viral Oncogene Homolog 1 (ARAF1, Accession XM_033884) is another VGAM2151 host target gene. ARAF1 BINDING SITE is HOST TARGET binding site found in the 5' untranslated region of mRNA encoded by ARAF1, corresponding to a HOST TARGET binding site such as BINDING SITE I, BINDING SITE II or BINDING SITE III. Table 2 illustrates the complementarity of the nucleotide sequences of ARAF1 BINDING SITE, designated SEQ ID:31982, to the nucleotide sequence of VGAM2151 RNA, herein designated VGAM RNA, also designated SEQ ID:4862.

Another function of VGAM2151 is therefore inhibition of V-raf Murine Sarcoma 3611 Viral Oncogene Homolog 1 (ARAF1, Accession XM_033884), a gene which may play a critical role in cell growth and development. Accordingly, utilities of VGAM2151 include diagnosis, prevention and treatment of diseases and clinical conditions associated with ARAF1. The function of ARAF1 and its association with various diseases and clinical conditions, has been established by previous studies, as described hereinabove with reference to VGAM996. Achaete-scute Complex-like 2 (Drosophila) (ASCL2, Accession XM_113673) is another VGAM2151 host target gene. ASCL2 BINDING SITE1 and ASCL2 BINDING SITE2 are HOST TARGET binding sites found in untranslated regions of mRNA encoded by ASCL2, corresponding to HOST TARGET binding sites such as BINDING SITE I, BINDING SITE II or BINDING SITE III. Table 2 illustrates the complementarity of the nucleotide sequences of ASCL2 BINDING SITE1 and ASCL2 BINDING SITE2, designated SEQ ID:42324 and SEQ ID:11671 respectively, to the nucleotide sequence of VGAM2151 RNA, herein designated VGAM RNA, also designated SEQ ID:4862.

Another function of VGAM2151 is therefore inhibition of Achaete-scute Complex-like 2 (Drosophila) (ASCL2, Accession XM_113673), a gene which is involved in the determination of the neuronal precursors in the nervous system. Accordingly, utilities of VGAM2151 include diagnosis, prevention and treatment of diseases and clinical conditions associated with ASCL2. The function of ASCL2 has been established by previous studies. The mammalian Achaete-Scute homologs are conserved mammalian cognates of the Drosophila Achaete-Scute complex. In rodents, 2 such genes have been identified: Mash1 (ASCL1; 100790) is expressed in neuronal progenita, while Mash2 (ASCL2) is expressed in spongiotrophoblast cells and their precursors. Both are members of the basic helix-loop-helix (bHLH) gene family, which includes MYC (OMIM Ref. No. 190080) and MYOD1 (OMIM Ref. No. 159970). Mash1 and Mash2 function as lineage-specific transcription factors essential for development of the neurectoderm and trophectoderm, respectively. Mice deficient for Mash2 die at 10 days postcoitum due to placental failure (Guillemot et al., 1994). In contrast, chimeric mice with heterozygous extraembryonic tissues and homozygous embryonic tissues are viable and normal, indicating that this gene, although essential for development of a placenta, is not important for the development of the embryo proper. Alders et al. (1997) noted that in the mouse, the Mash2 gene is subject to genomic imprinting with only the maternal allele being active. Mice carrying the homozygously mutated Mash2 gene die at 10 days postcoitum, as do heterozygous mice who inherited the mutant allele from their mother. Heterozygous mice who inherited the mutant allele from their father are viable. This phenomenon of paternal imprinting of a gene being critical for development of a placenta is an exception to the common imprinting rule: nuclear transplantation studies in mice show that imprinting is biased toward embryonic versus extraembryonic tissues with preferential expression of the maternal and paternal alleles in the embryo and placenta, respectively. Mash2 in the mouse maps to distal chromosome 7 and is closely linked to 3 other imprinted genes, Ins2 (OMIM Ref. No. 176730), Igf2 (OMIM Ref. No. 147470), and H19 (OMIM Ref. No. 103280). The conserved syntenic human chromosome region is 11p15.5. Alders et al. (1997) took advantage of this fact to isolate the human homolog of the MASH2 gene, which they designated HASH2. They showed that the gene maps proximal to, and in close proximity of, IGF2 and that the gene order in this region is HASH2-INS-IGF2-H19-tel. Expression studies showed that HASH2 is expressed in extravillus trophoblast cells only. The lack of expression in nonmalignant hydatidiform (androgenetic) moles indicated that HASH2 is also imprinted in man.

Full details of the abovementioned studies are described in the following publications, the disclosure of which are hereby incorporated by reference:

Alders, M.; Hodges, M.; Hadjantonakis, A.-K.; Postmus, J.; van Wijk, I.; Bliek, J.; de Meulemeester, M.; Westerveld, A.; Guillemot, F.; Oudejans, C.; Little, P.; Mannens, M.: The human Achaete-Scute homologue 2 (ASCL2, HASH2) maps to chromosome 11p15.5, close to IGF2 and is expressed in extravillus trophoblasts. Hum. Molec. Genet. 6:859-867, 1997; and Guillemot, F.; Nagy, A.; Auerbach, A.; Rossant, J.; Joyner, A. L.: Essential role of Mash-2 in extraembryonic development. Nature 371:333-336, 1994.

Further studies establishing the function and utilities of ASCL2 are found in John Hopkins OMIM database record ID 601886, and in sited publications numbered 6701-6702 listed in the bibliography section hereinbelow, which are also hereby incorporated by reference. B-cell CLL/lymphoma 11B (zinc finger protein) (BCL11B, Accession NM_138576) is another VGAM2151 host target gene. BCL11B BINDING SITE1 and BCL11B BINDING SITE2 are HOST TARGET binding sites found in untranslated regions of mRNA encoded by BCL11B, corresponding to HOST TARGET binding sites such as BINDING SITE I, BINDING SITE II or BINDING SITE III. Table 2 illustrates the complementarity of the nucleotide sequences of BCL11B BINDING SITE1 and BCL11B BINDING SITE2, designated SEQ ID:28891 and SEQ ID:23167 respectively, to the nucleotide sequence of VGAM2151 RNA, herein designated VGAM RNA, also designated SEQ ID:4862.

Another function of VGAM2151 is therefore inhibition of B-cell CLL/lymphoma 11B (zinc finger protein) (BCL11B, Accession NM_138576). Accordingly, utilities of VGAM2151 include diagnosis, prevention and treatment of diseases and clinical conditions associated with BCL11B. Breakpoint Cluster Region (BCR, Accession NM_004327) is another VGAM2151 host target gene. BCR BINDING SITE1 and BCR BINDING SITE2 are HOST TARGET binding sites found in untranslated regions of mRNA encoded by BCR, corresponding to HOST TARGET binding sites such as BINDING SITE I, BINDING SITE II or BINDING SITE III. Table 2 illustrates the complementarity of the nucleotide sequences of BCR BINDING SITE1 and BCR BINDING SITE2, designated SEQ ID:10527 and SEQ ID:31989 respectively, to the nucleotide sequence of VGAM2151 RNA, herein designated VGAM RNA, also designated SEQ ID:4862.

Another function of VGAM2151 is therefore inhibition of Breakpoint Cluster Region (BCR, Accession NM_004327), a gene which is a serine/threonine kinase that involves in the t (9;22) translocation (Philadelphia chromosome). Accordingly, utilities of VGAM2151 include diagnosis, prevention and treatment of diseases and clinical conditions associated with BCR. The function of BCR has been established by previous studies. The normal BCR gene occupies a region of about 135 kb on chromosome 22. It is expressed as mRNAs of 4.5- and 6.7-kb, which apparently encode for the same cytoplasmic 160-kD protein, and contains 23 exons as well as an unusual inverted repeat flanking the first exon. The BCR protein reportedly contains a unique serine/threonine kinase activity and at least two SH2 binding sites encoded in its first exon and a C-terminal domain that functions as a GTPase activating protein for p21(rac) (Diekmann et al., 1991); see rac serine/threonine protein kinase (OMIM Ref. No. 164730). Chissoe et al. (1995) sequenced the complete BCR gene and greater than 80% of the human ABL gene, which are both involved in the t (9;22) translocation (Philadelphia chromosome) associated with more than 90% of chronic myelogenous leukemia, 25 to 30% of adult and 2 to 10% of childhood acute lymphoblastic leukemia, and rare cases of acute myelogenous leukemia. Comparison of the gene with its cDNA sequence revealed the positions of 23 BCR exons and putative alternative BCR first and second exons. From the sequence of 4 newly studied Philadelphia chromosome translocations and a review of several other previously sequenced breakpoints, Chissoe et al. (1995) could discern no consistent breakpoint features. No clear-cut mechanism for Philadelphia chromosome translocation was evident. Because tyrosine kinase activity is essential to the transforming function of BCR-ABL, Druker et al. (2001) reasoned that an inhibitor of the kinase may be an effective treatment for CML. They found that indeed a tyrosine kinase inhibitor (OMIM Ref. No. STI571) was well tolerated and had significant antileukemic activity in patients with CML in whom treatment with standard chemotherapy had failed. This experience demonstrated the potential for the development of anticancer drugs based on the specific molecular abnormality present in a human cancer. Animal model experiments lend further support to the function of BCR. Cancer is thought to arise from multiple genetic events that establish irreversible malignancy. A different mechanism might be present in certain leukemias initiated by a chromosomal translocation. Huettner et al. (2000) adopted a new approach to determine if ablation of the genetic abnormality is sufficient for reversion. They generated a conditional transgenic model of BCR-ABL-induced leukemia. The most common form of the product of the fusion gene, p210 BCR-ABL1, is found in more than 90% of patients with chronic myelogenous leukemia and in up to 15% of adult patients with de novo acute lymphoblastic leukemia. Efforts to establish a useful transgenic model had been hampered by embryonic lethality when the oncogene is expressed during embryogenesis, by reduced penetrance, or by extremely long latency. Huettner et al. (2000) used the 'knock-in' approach to induce leukemia by p190 BCR-ABL1 (Castellanos et al., 1997). Lethal leukemia developed within an acceptable time frame in all animals, and complete remission was achieved by suppression of BCR-ABL1 expression, even after multiple rounds of induction and reversion. The results demonstrated that BCR-ABL1 is required for both induction and maintenance of leukemia. The findings suggested that complete and lasting remissions can be achieved if the genetic abnormality is abolished or silenced before secondary mutations are acquired. The results have implications for therapies that directly target leukemia oncogenes, with a relevant example being the use of BCR-ABL1-specific tyrosine kinase inhibitors.

It is appreciated that the abovementioned animal model for BCR is acknowledged by those skilled in the art as a scientifically valid animal model, as can be further appreciated from the publications sited hereinbelow.

Full details of the abovementioned studies are described in the following publications, the disclosure of which are hereby incorporated by reference:

Chissoe, S. L.; Bodenteich, A.; Wang, Y.-F.; Wang, Y.-P.; Burian, D.; Clifton, S. W.; Crabtree, J.; Freeman, A.; Iyer, K.; Jian, L.; Ma, Y.; McLaury, H.-J.; Pan, H.-Q.; Sarhan, O. H.;

Toth, S.; Wang, Z.; Zhang, G.; Heisterkamp, N.; Groffen, J.; Roe, B. A. : Sequence and analysis of the human ABL gene, the BCR gene, and regions involved in the Philadelphia chromosomal translocation. Genomics 27:67-82, 1995; and Huettner, C. S.; Zhang, P.; Van Etten, R. A.; Tenen, D. G.: Reversibility of acute B-cell leukaemia induced by BCR-ABL1. Nature Genet. 24:57-60, 2000.

Further studies establishing the function and utilities of BCR are found in John Hopkins OMIM database record ID 151410, and in sited publications numbered 11081-11088, 11375-11092, 11411, 11412-11416, 3659, 11417-11427, 3104, 11428-11441, 1135 and 11475-11496 listed in the bibliography section hereinbelow, which are also hereby incorporated by reference. Cadherin Related 23 (CDH23, Accession NM_052836) is another VGAM2151 host target gene. CDH23 BINDING SITE1 and CDH23 BINDING SITE2 are HOST TARGET binding sites found in untranslated regions of mRNA encoded by CDH23, corresponding to HOST TARGET binding sites such as BINDING SITE I, BINDING SITE II or BINDING SITE III. Table 2 illustrates the complementarity of the nucleotide sequences of CDH23 BINDING SITE1 and CDH23 BINDING SITE2, designated SEQ ID:27418 and SEQ ID:22670 respectively, to the nucleotide sequence of VGAM2151 RNA, herein designated VGAM RNA, also designated SEQ ID:4862.

Another function of VGAM2151 is therefore inhibition of Cadherin Related 23 (CDH23, Accession NM_052836). Accordingly, utilities of VGAM2151 include diagnosis, prevention and treatment of diseases and clinical conditions associated with CDH23. DXYS155E (Accession NM_005088) is another VGAM2151 host target gene. DXYS155E BINDING SITE is HOST TARGET binding site found in the 3' untranslated region of mRNA encoded by DXYS155E, corresponding to a HOST TARGET binding site such as BINDING SITE I, BINDING SITE II or BINDING SITE III. Table 2 illustrates the complementarity of the nucleotide sequences of DXYS155E BINDING SITE, designated SEQ ID:11541, to the nucleotide sequence of VGAM2151 RNA, herein designated VGAM RNA, also designated SEQ ID:4862.

Another function of VGAM2151 is therefore inhibition of DXYS155E (Accession NM_005088), a gene which may be involved in b-cell activation. may also be involved in signal transduction and gene regulation. Accordingly, utilities of VGAM2151 include diagnosis, prevention and treatment of diseases and clinical conditions associated with DXYS155E. The function of DXYS155E and its association with various diseases and clinical conditions, has been established by previous studies, as described hereinabove with reference to VGAM766. Engrailed Homolog 2 (EN2, Accession NM_001427) is another VGAM2151 host target gene. EN2 BINDING SITE is HOST TARGET binding site found in the 5' untranslated region of mRNA encoded by EN2, corresponding to a HOST TARGET binding site such as BINDING SITE I, BINDING SITE II or BINDING SITE III. Table 2 illustrates the complementarity of the nucleotide sequences of EN2 BINDING SITE, designated SEQ ID:7146, to the nucleotide sequence of VGAM2151 RNA, herein designated VGAM RNA, also designated SEQ ID:4862.

Another function of VGAM2151 is therefore inhibition of Engrailed Homolog 2 (EN2, Accession NM_001427), a gene which may be required for normal cerebellar development; a homeobox protein, very strongly similar to murine En2. Accordingly, utilities of VGAM2151 include diagnosis, prevention and treatment of diseases and clinical conditions associated with EN2. The function of EN2 and its association with various diseases and clinical conditions, has been established by previous studies, as described hereinabove with reference to VGAM232. F-box and Leucine-rich Repeat Protein 5 (FBXL5, Accession NM_033535) is another VGAM2151 host target gene. FBXL5 BINDING SITE is HOST TARGET binding site found in the 5' untranslated region of mRNA encoded by FBXL5, corresponding to a HOST TARGET binding site such as BINDING SITE I, BINDING SITE II or BINDING SITE III. Table 2 illustrates the complementarity of the nucleotide sequences of FBXL5 BINDING SITE, designated SEQ ID:27304, to the nucleotide sequence of VGAM2151 RNA, herein designated VGAM RNA, also designated SEQ ID:4862.

Another function of VGAM2151 is therefore inhibition of F-box and Leucine-rich Repeat Protein 5 (FBXL5, Accession NM_033535), a gene which is a putative SCF ubiquitin ligase subunit involved in protein degradation. Accordingly, utilities of VGAM2151 include diagnosis, prevention and treatment of diseases and clinical conditions associated with FBXL5. The function of FBXL5 and its association with various diseases and clinical conditions, has been established by previous studies, as described hereinabove with reference to VGAM61. F-box and Leucine-rich Repeat Protein 7 (FBXL7, Accession NM_012304) is another VGAM2151 host target gene. FBXL7 BINDING SITE is HOST TARGET binding site found in the 5' untranslated region of mRNA encoded by FBXL7, corresponding to a HOST TARGET binding site such as BINDING SITE I, BINDING SITE II or BINDING SITE III. Table 2 illustrates the complementarity of the nucleotide sequences of FBXL7 BINDING SITE, designated SEQ ID:14672, to the nucleotide sequence of VGAM2151 RNA, herein designated VGAM RNA, also designated SEQ ID:4862.

Another function of VGAM2151 is therefore inhibition of F-box and Leucine-rich Repeat Protein 7 (FBXL7, Accession NM_012304), a gene which may be involved in in phosphorylation-dependent ubiquitination. Accordingly, utilities of VGAM2151 include diagnosis, prevention and treatment of diseases and clinical conditions associated with FBXL7. The function of FBXL7 and its association with various diseases and clinical conditions, has been established by previous studies, as described hereinabove with reference to VGAM1924. Forkhead Box D2 (FOXD2, Accession NM_004474) is another VGAM2151 host target gene. FOXD2 BINDING SITE is HOST TARGET binding site found in the 5' untranslated region of mRNA encoded by FOXD2, corresponding to a HOST TARGET binding site such as BINDING SITE I, BINDING SITE II or BINDING SITE III. Table 2 illustrates the complementarity of the nucleotide sequences of FOXD2 BINDING SITE, designated SEQ ID:10788, to the nucleotide sequence of VGAM2151 RNA, herein designated VGAM RNA, also designated SEQ ID:4862.

Another function of VGAM2151 is therefore inhibition of Forkhead Box D2 (FOXD2, Accession NM_004474). Accordingly, utilities of VGAM2151 include diagnosis, prevention and treatment of diseases and clinical conditions associated with FOXD2. Follistatin-like 1 (FSTL1, Accession NM_007085) is another VGAM2151 host target gene. FSTL1 BINDING SITE is HOST TARGET binding site found in the 3' untranslated region of mRNA encoded by FSTL1, corresponding to a HOST TARGET binding site such as BINDING SITE I, BINDING SITE II or BINDING SITE III. Table 2 illustrates the complementarity of the nucleotide sequences of FSTL1 BINDING SITE, designated SEQ ID:13951, to the nucleotide sequence of VGAM2151 RNA, herein designated VGAM RNA, also designated SEQ ID:4862.

Another function of VGAM2151 is therefore inhibition of Follistatin-like 1 (FSTL1, Accession NM_007085), a gene which may modulate the action of some growth factors on cell proliferation and differentiation. Accordingly, utilities of VGAM2151 include diagnosis, prevention and treatment of diseases and clinical conditions associated with FSTL1. The function of FSTL1 and its association with various diseases and clinical conditions, has been established by previous studies, as described hereinabove with reference to VGAM791. HIR Histone Cell Cycle Regulation Defective Homolog A (S. cerevisiae) (HIRA, Accession NM_003325) is another VGAM2151 host target gene. HIRA BINDING SITE is HOST TARGET binding site found in the 5' untranslated region of mRNA encoded by HIRA, corresponding to a HOST TARGET binding site such as BINDING SITE I, BINDING SITE II or BINDING SITE III. Table 2 illustrates the complementarity of the nucleotide sequences of HIRA BINDING SITE, designated SEQ ID:9326, to the nucleotide sequence of VGAM2151 RNA, herein designated VGAM RNA, also designated SEQ ID:4862.

Another function of VGAM2151 is therefore inhibition of HIR Histone Cell Cycle Regulation Defective Homolog A (S. cerevisiae) (HIRA, Accession NM_003325), a gene which could have a part in mechanisms of transcriptional regulation similar to that played by yeast hir1 and hir2 together. Accordingly, utilities of VGAM2151 include diagnosis, prevention and treatment of diseases and clinical conditions associated with HIRA. The function of HIRA and its association with various diseases and clinical conditions, has been established by previous studies, as described hereinabove with reference to VGAM1259. Homeo Box A3 (HOXA3, Accession NM_030661) is another VGAM2151 host target gene. HOXA3 BINDING SITE is HOST TARGET binding site found in the 3' untranslated region of mRNA encoded by HOXA3, corresponding to a HOST TARGET binding site such as BINDING SITE I, BINDING SITE II or BINDING SITE III. Table 2 illustrates the complementarity of the nucleotide sequences of HOXA3 BINDING SITE, designated SEQ ID:24994, to the nucleotide sequence of VGAM2151 RNA, herein designated VGAM RNA, also designated SEQ ID:4862.

Another function of VGAM2151 is therefore inhibition of Homeo Box A3 (HOXA3, Accession NM_030661). Accordingly, utilities of VGAM2151 include diagnosis, prevention and treatment of diseases and clinical conditions associated with HOXA3. IQ Motif Containing GTPase Activating Protein 2 (IQGAP2, Accession NM_006633) is another VGAM2151 host target gene. IQGAP2 BINDING SITE is HOST TARGET binding site found in the 5' untranslated region of mRNA encoded by IQGAP2, corresponding to a HOST TARGET binding site such as BINDING SITE I, BINDING SITE II or BINDING SITE III. Table 2 illustrates the complementarity of the nucleotide sequences of IQGAP2 BINDING SITE, designated SEQ ID:13429, to the nucleotide sequence of VGAM2151 RNA, herein designated VGAM RNA, also designated SEQ ID:4862.

Another function of VGAM2151 is therefore inhibition of IQ Motif Containing GTPase Activating Protein 2 (IQGAP2, Accession NM_006633), a gene which Inhibits GTPase activity of Cdc42 and Rac1. Accordingly, utilities of VGAM2151 include diagnosis, prevention and treatment of diseases and clinical conditions associated with IQGAP2. The function of IQGAP2 and its association with various diseases and clinical conditions, has been established by previous studies, as described hereinabove with reference to VGAM110. Integrin, Alpha M (complement component receptor 3, alpha; also known as CD11b (p170), Macrophage Antigen Alpha Polypeptide) (ITGAM, Accession NM_000632) is another VGAM2151 host target gene. ITGAM BINDING SITE is HOST TARGET binding site found in the 3' untranslated region of mRNA encoded by ITGAM, corresponding to a HOST TARGET binding site such as BINDING SITE I, BINDING SITE II or BINDING SITE III. Table 2 illustrates the complementarity of the nucleotide sequences of ITGAM BINDING SITE, designated SEQ ID:6250, to the nucleotide sequence of VGAM2151 RNA, herein designated VGAM RNA, also designated SEQ ID:4862.

Another function of VGAM2151 is therefore inhibition of Integrin, Alpha M (complement component receptor 3, alpha; also known as CD11b (p170), Macrophage Antigen Alpha Polypeptide) (ITGAM, Accession NM_000632), a gene which is invovled in various adhesive interactions of monocytes, macrophages and granulocytes as well as in mediating the uptake of complement-coated particles. Accordingly, utilities of VGAM2151 include diagnosis, prevention and treatment of diseases and clinical conditions associated with ITGAM. The function of ITGAM and its association with various diseases and clinical conditions, has been established by previous studies, as described hereinabove with reference to VGAM1386. Inositol 1,4,5-triphosphate Receptor, Type 2 (ITPR2, Accession NM_002223) is another VGAM2151 host target gene. ITPR2 BINDING SITE is HOST TARGET binding site found in the 5' untranslated region of mRNA encoded by ITPR2, corresponding to a HOST TARGET binding site such as BINDING SITE I, BINDING SITE II or BINDING SITE III. Table 2 illustrates the complementarity of the nucleotide sequences of ITPR2 BINDING SITE, designated SEQ ID:7993, to the nucleotide sequence of VGAM2151 RNA, herein designated VGAM RNA, also designated SEQ ID:4862.

Another function of VGAM2151 is therefore inhibition of Inositol 1,4,5-triphosphate Receptor, Type 2 (ITPR2, Accession NM_002223). Accordingly, utilities of VGAM2151 include diagnosis, prevention and treatment of diseases and clinical conditions associated with ITPR2. Potassium Voltage-gated Channel, Shal-related Subfamily, Member 2 (KCND2, Accession NM_012281) is another VGAM2151 host target gene. KCND2 BINDING SITE is HOST TARGET binding site found in the 5' untranslated region of mRNA encoded by KCND2, corresponding to a HOST TARGET binding site such as BINDING SITE I, BINDING SITE II or BINDING SITE III. Table 2 illustrates the complementarity of the nucleotide sequences of KCND2 BINDING SITE, designated SEQ ID:14609, to the nucleotide sequence of VGAM2151 RNA, herein designated VGAM RNA, also designated SEQ ID:4862.

Another function of VGAM2151 is therefore inhibition of Potassium Voltage-gated Channel, Shal-related Subfamily, Member 2 (KCND2, Accession NM_012281), a gene which is prominent in the repolarization phase of the action potential. Accordingly, utilities of VGAM2151 include diagnosis, prevention and treatment of diseases and clinical conditions associated with KCND2. The function of KCND2 and its association with various diseases and clinical conditions, has been established by previous studies, as described hereinabove with reference to VGAM449. LIM Domain Only 2 (rhombotin-like 1) (LMO2, Accession NM_005574) is another VGAM2151 host target gene. LMO2 BINDING SITE is HOST TARGET binding site found in the 5' untranslated region of mRNA encoded by LMO2, corresponding to a HOST TARGET binding site such as BINDING SITE I, BINDING SITE II or BINDING SITE III. Table 2 illustrates the complementarity of the nucleotide sequences of LMO2

BINDING SITE, designated SEQ ID:12103, to the nucleotide sequence of VGAM2151 RNA, herein designated VGAM RNA, also designated SEQ ID:4862.

Another function of VGAM2151 is therefore inhibition of LIM Domain Only 2 (rhombotin-like 1) (LMO2, Accession NM_005574). Accordingly, utilities of VGAM2151 include diagnosis, prevention and treatment of diseases and clinical conditions associated with LMO2. Mitogen-activated Protein Kinase Kinase Kinase 5 (MAP3K5, Accession NM_005923) is another VGAM2151 host target gene. MAP3K5 BINDING SITE is HOST TARGET binding site found in the 5' untranslated region of mRNA encoded by MAP3K5, corresponding to a HOST TARGET binding site such as BINDING SITE I, BINDING SITE II or BINDING SITE III. Table 2 illustrates the complementarity of the nucleotide sequences of MAP3K5 BINDING SITE, designated SEQ ID:12547, to the nucleotide sequence of VGAM2151 RNA, herein designated VGAM RNA, also designated SEQ ID:4862.

Another function of VGAM2151 is therefore inhibition of Mitogen-activated Protein Kinase Kinase Kinase 5 (MAP3K5, Accession NM_005923), a gene which phosphorylates and activates two different subgroups of map kinase kinases, mkk4/sek1 and mkk3/mapkk6 (or mkk6).overexpression induces apoptotic cell death. Accordingly, utilities of VGAM2151 include diagnosis, prevention and treatment of diseases and clinical conditions associated with MAP3K5. The function of MAP3K5 and its association with various diseases and clinical conditions, has been established by previous studies, as described hereinabove with reference to VGAM1622. Mitogen-activated Protein Kinase Kinase Kinase 7 Interacting Protein 2 (MAP3K7IP2, Accession NM_015093) is another VGAM2151 host target gene. MAP3K7IP2 BINDING SITE is HOST TARGET binding site found in the 5' untranslated region of mRNA encoded by MAP3K7IP2, corresponding to a HOST TARGET binding site such as BINDING SITE I, BINDING SITE II or BINDING SITE III. Table 2 illustrates the complementarity of the nucleotide sequences of MAP3K7IP2 BINDING SITE, designated SEQ ID:17486, to the nucleotide sequence of VGAM2151 RNA, herein designated VGAM RNA, also designated SEQ ID:4862.

Another function of VGAM2151 is therefore inhibition of Mitogen-activated Protein Kinase Kinase Kinase 7 Interacting Protein 2 (MAP3K7IP2, Accession NM_015093). Accordingly, utilities of VGAM2151 include diagnosis, prevention and treatment of diseases and clinical conditions associated with MAP3K7IP2. Mitogen-activated Protein Kinase Kinase Kinase Kinase 5 (MAP4K5, Accession NM_006575) is another VGAM2151 host target gene. MAP4K5 BINDING SITE is HOST TARGET binding site found in the 5' untranslated region of mRNA encoded by MAP4K5, corresponding to a HOST TARGET binding site such as BINDING SITE I, BINDING SITE II or BINDING SITE III. Table 2 illustrates the complementarity of the nucleotide sequences of MAP4K5 BINDING SITE, designated SEQ ID:13342, to the nucleotide sequence of VGAM2151 RNA, herein designated VGAM RNA, also designated SEQ ID:4862.

Another function of VGAM2151 is therefore inhibition of Mitogen-activated Protein Kinase Kinase Kinase Kinase 5 (MAP4K5, Accession NM_006575). Accordingly, utilities of VGAM2151 include diagnosis, prevention and treatment of diseases and clinical conditions associated with MAP4K5. Mannose-P-dolichol Utilization Defect 1 (MPDU1, Accession NM_004870) is another VGAM2151 host target gene. MPDU1 BINDING SITE is HOST TARGET binding site found in the 3' untranslated region of mRNA encoded by MPDU1, corresponding to a HOST TARGET binding site such as BINDING SITE I, BINDING SITE II or BINDING SITE III. Table 2 illustrates the complementarity of the nucleotide sequences of MPDU1 BINDING SITE, designated SEQ ID:11298, to the nucleotide sequence of VGAM2151 RNA, herein designated VGAM RNA, also designated SEQ ID:4862.

Another function of VGAM2151 is therefore inhibition of Mannose-P-dolichol Utilization Defect 1 (MPDU1, Accession NM_004870), a gene which corrects the Lec15 mutant phenotype. Accordingly, utilities of VGAM2151 include diagnosis, prevention and treatment of diseases and clinical conditions associated with MPDU1. The function of MPDU1 and its association with various diseases and clinical conditions, has been established by previous studies, as described hereinabove with reference to VGAM1187.8-oxoguanine DNA Glycosylase (OGG1, Accession NM_016819) is another VGAM2151 host target gene. OGG1 BINDING SITE1 through OGG1 BINDING SITE3 are HOST TARGET binding sites found in untranslated regions of mRNA encoded by OGG1, corresponding to HOST TARGET binding sites such as BINDING SITE I, BINDING SITE II or BINDING SITE III. Table 2 illustrates the complementarity of the nucleotide sequences of OGG1 BINDING SITE1 through OGG1 BINDING SITE3, designated SEQ ID:18807, SEQ ID:18812 and SEQ ID:8390 respectively, to the nucleotide sequence of VGAM2151 RNA, herein designated VGAM RNA, also designated SEQ ID:4862.

Another function of VGAM2151 is therefore inhibition of 8-oxoguanine DNA Glycosylase (OGG1, Accession NM_016819), a gene which is involved in base excision DNA repair and removal of 8-oxyguanine. Accordingly, utilities of VGAM2151 include diagnosis, prevention and treatment of diseases and clinical conditions associated with OGG1. The function of OGG1 and its association with various diseases and clinical conditions, has been established by previous studies, as described hereinabove with reference to VGAM390. Protein Kinase (cAMP-dependent, catalytic) Inhibitor Alpha (PKIA, Accession NM_006823) is another VGAM2151 host target gene. PKIA BINDING SITE is HOST TARGET binding site found in the 3' untranslated region of mRNA encoded by PKIA, corresponding to a HOST TARGET binding site such as BINDING SITE I, BINDING SITE II or BINDING SITE III. Table 2 illustrates the complementarity of the nucleotide sequences of PKIA BINDING SITE, designated SEQ ID:13702, to the nucleotide sequence of VGAM2151 RNA, herein designated VGAM RNA, also designated SEQ ID:4862.

Another function of VGAM2151 is therefore inhibition of Protein Kinase (cAMP-dependent, catalytic) Inhibitor Alpha (PKIA, Accession NM_006823). Accordingly, utilities of VGAM2151 include diagnosis, prevention and treatment of diseases and clinical conditions associated with PKIA. POU Domain, Class 2, Transcription Factor 2 (POU2F2, Accession NM_002698) is another VGAM2151 host target gene. POU2F2 BINDING SITE is HOST TARGET binding site found in the 3' untranslated region of mRNA encoded by POU2F2, corresponding to a HOST TARGET binding site such as BINDING SITE I, BINDING SITE II or BINDING SITE III. Table 2 illustrates the complementarity of the nucleotide sequences of POU2F2 BINDING SITE, designated SEQ ID:8549, to the nucleotide sequence of VGAM2151 RNA, herein designated VGAM RNA, also designated SEQ ID:4862.

Another function of VGAM2151 is therefore inhibition of POU Domain, Class 2, Transcription Factor 2 (POU2F2, Accession NM_002698), a gene which activates immunoglobulin gene expression. Accordingly, utilities of VGAM2151 include diagnosis, prevention and treatment of diseases and clinical conditions associated with POU2F2. The function of POU2F2 has been established by previous studies. An understanding of development necessitates an understanding of the molecular mechanisms of cell type-specific gene expression. Using synthetic promoter constructions, it has been found that 2 sequences within immunoglobulin promoters are sufficient for lymphoid-specific promoter activity: an octamer, ATTTGCAT, and a TATA box. Staudt et al. (1988) isolated a cDNA which hybridized with mRNA transcripts that were largely restricted to lymphoid cells. The level of expression of the gene, termed OCT2, within different lymphoid cell lines correlated well with the amount of a nuclear factor called NFA2 that had previously been detected only in lymphoid cells. Ko et al. (1988) determined the DNA sequence of the OCT2 cDNA and showed that its gene product contains a homeobox. Site-directed mutagenesis of the homeobox domain abolished DNA binding. They demonstrated, furthermore, that the gene is located on chromosome 19, using hybridization to a panel of somatic cell hybrid DNAs. By linkage studies in an interspecific backcross and by studies of recombinant inbred strains, Siracusa et al. (1991) assigned the Otf2 gene to mouse chromosome 7. Whereas the Otf1 and Otf2 molecular probes recognize single loci, members of the Otf3 family map to mouse chromosomes 1, 2, 3, 6, 14, 17, and the X chromosome. Schubart et al. (2001) noted that Oct2-deficient mice die at birth but have normal B-cell development and transcription of immunoglobulin (Ig) genes. Oct-binding factor-1 (Obf1; 601206)-deficient mice are viable with unaffected B-cell development in bone marrow and normal serum IgM but have reduced B-cell numbers in spleen and low serum IgG. By creating double knockout mice, Schubart et al. (2001) confirmed that B-cell development and Ig gene transcription can proceed normally without these B-cell specific factors. However, in these animals the mature B-cell pool was strongly reduced, suggesting that these factors play an important role in controlling the expansion and/or maintenance of mature B cells.

Full details of the abovementioned studies are described in the following publications, the disclosure of which are hereby incorporated by reference:

Staudt, L. M.; Clerc, R. G.; Singh, H.; LeBowitz, J. H.; Sharp, P. A.; Baltimore, D.: Cloning of a lymphoid-specific cDNA encoding a protein binding the regulatory octamer DNA motif. Science 241:577-580, 1988; and Schubart, K.; Massa, S.; Schubart, D.; Corcoran, L. M.; Rolink, A. G.; Matthias, P.: B cell development and immunoglobulin gene transcription in the absence of Oct-2 and OBF-1. Nature Immu.

Further studies establishing the function and utilities of POU2F2 are found in John Hopkins OMIM database record ID 164176, and in sited publications numbered 1859, 10798-1079 and 10856 listed in the bibliography section hereinbelow, which are also hereby incorporated by reference. Protein Phosphatase 3 (formerly 2B), Catalytic Subunit, Gamma Isoform (calcineurin A gamma) (PPP3CC, Accession NM_005605) is another VGAM2151 host target gene. PPP3CC BINDING SITE is HOST TARGET binding site found in the 5' untranslated region of mRNA encoded by PPP3CC, corresponding to a HOST TARGET binding site such as BINDING SITE I, BINDING SITE II or BINDING SITE III. Table 2 illustrates the complementarity of the nucleotide sequences of PPP3CC BINDING SITE, designated SEQ ID:12127, to the nucleotide sequence of VGAM2151 RNA, herein designated VGAM RNA, also designated SEQ ID:4862.

Another function of VGAM2151 is therefore inhibition of Protein Phosphatase 3 (formerly 2B), Catalytic Subunit, Gamma Isoform (calcineurin A gamma) (PPP3CC, Accession NM_005605). Accordingly, utilities of VGAM2151 include diagnosis, prevention and treatment of diseases and clinical conditions associated with PPP3CC. Phosphatase and Tensin Homolog (mutated in multiple advanced cancers 1) (PTEN, Accession NM_000314) is another VGAM2151 host target gene. PTEN BINDING SITE1 through PTEN BINDING SITE5 are HOST TARGET binding sites found in untranslated regions of mRNA encoded by PTEN, corresponding to HOST TARGET binding sites such as BINDING SITE I, BINDING SITE II or BINDING SITE III. Table 2 illustrates the complementarity of the nucleotide sequences of PTEN BINDING SITE1 through PTEN BINDING SITE5, designated SEQ ID:5854, SEQ ID:5855, SEQ ID:5856, SEQ ID:5857 and SEQ ID:5853 respectively, to the nucleotide sequence of VGAM2151 RNA, herein designated VGAM RNA, also designated SEQ ID:4862.

Another function of VGAM2151 is therefore inhibition of Phosphatase and Tensin Homolog (mutated in multiple advanced cancers 1) (PTEN, Accession NM_000314). Accordingly, utilities of VGAM2151 include diagnosis, prevention and treatment of diseases and clinical conditions associated with PTEN. Protein Tyrosine Phosphatase Type IVA, Member 2 (PTP4A2, Accession NM_080392) is another VGAM2151 host target gene. PTP4A2 BINDING SITE1 and PTP4A2 BINDING SITE2 are HOST TARGET binding sites found in untranslated regions of mRNA encoded by PTP4A2, corresponding to HOST TARGET binding sites such as BINDING SITE I, BINDING SITE II or BINDING SITE III. Table 2 illustrates the complementarity of the nucleotide sequences of PTP4A2 BINDING SITE1 and PTP4A2 BINDING SITE2, designated SEQ ID:27830 and SEQ ID:34789 respectively, to the nucleotide sequence of VGAM2151 RNA, herein designated VGAM RNA, also designated SEQ ID:4862.

Another function of VGAM2151 is therefore inhibition of Protein Tyrosine Phosphatase Type IVA, Member 2 (PTP4A2, Accession NM_080392), a gene which is a protein tyrosine phosphatase which has a C-terminal prenylation site. Accordingly, utilities of VGAM2151 include diagnosis, prevention and treatment of diseases and clinical conditions associated with PTP4A2. The function of PTP4A2 and its association with various diseases and clinical conditions, has been established by previous studies, as described hereinabove with reference to VGAM217. RAD21 Homolog (S. pombe) (RAD21, Accession NM_006265) is another VGAM2151 host target gene. RAD21 BINDING SITE is HOST TARGET binding site found in the 5' untranslated region of mRNA encoded by RAD21, corresponding to a HOST TARGET binding site such as BINDING SITE I, BINDING SITE II or BINDING SITE III. Table 2 illustrates the complementarity of the nucleotide sequences of RAD21 BINDING SITE, designated SEQ ID:12946, to the nucleotide sequence of VGAM2151 RNA, herein designated VGAM RNA, also designated SEQ ID:4862.

Another function of VGAM2151 is therefore inhibition of RAD21 Homolog (S. pombe) (RAD21, Accession NM_006265), a gene which may act in double strand break repair. Accordingly, utilities of VGAM2151 include diagnosis, prevention and treatment of diseases and clinical conditions associated with RAD21. The function of RAD21 and its association with various diseases and clinical conditions, has been established by previous studies, as described hereinabove with reference to VGAM1928. RALBP1 Associated Eps Domain Containing 2 (REPS2, Accession NM_004726)

is another VGAM2151 host target gene. REPS2 BINDING SITE is HOST TARGET binding site found in the 5' untranslated region of mRNA encoded by REPS2, corresponding to a HOST TARGET binding site such as BINDING SITE I, BINDING SITE II or BINDING SITE III. Table 2 illustrates the complementarity of the nucleotide sequences of REPS2 BINDING SITE, designated SEQ ID:11098, to the nucleotide sequence of VGAM2151 RNA, herein designated VGAM RNA, also designated SEQ ID:4862.

Another function of VGAM2151 is therefore inhibition of RALBP1 Associated Eps Domain Containing 2 (REPS2, Accession NM_004726), a gene which interacts with the active form of RAS with adaptor protein GRB2 and binds calcium. Accordingly, utilities of VGAM2151 include diagnosis, prevention and treatment of diseases and clinical conditions associated with REPS2. The function of REPS2 and its association with various diseases and clinical conditions, has been established by previous studies, as described hereinabove with reference to VGAM709. Replication Factor C (activator 1) 4, 37 kDa (RFC4, Accession NM_002916) is another VGAM2151 host target gene. RFC4 BINDING SITE is HOST TARGET binding site found in the 5' untranslated region of mRNA encoded by RFC4, corresponding to a HOST TARGET binding site such as BINDING SITE I, BINDING SITE II or BINDING SITE III. Table 2 illustrates the complementarity of the nucleotide sequences of RFC4 BINDING SITE, designated SEQ ID:8821, to the nucleotide sequence of VGAM2151 RNA, herein designated VGAM RNA, also designated SEQ ID:4862.

Another function of VGAM2151 is therefore inhibition of Replication Factor C (activator 1) 4, 37 kDa (RFC4, Accession NM_002916), a gene which activates DNA polymerases for elongation of primed dna templates. Accordingly, utilities of VGAM2151 include diagnosis, prevention and treatment of diseases and clinical conditions associated with RFC4. The function of RFC4 has been established by previous studies. The elongation of primed DNA templates by DNA polymerase delta and DNA polymerase epsilon requires the action of 2 accessory proteins, proliferating cell nuclear antigen (PCNA; 176740) and activator 1 (A1; also called replication factor C). A1 is an enzyme that contains 5 different subunits of 140, 40, 38, 37, and 36 kD. Chen et al. (1992) isolated the gene encoding the 37-kD subunit from HeLa cells. The deduced amino acid sequence showed a high degree of homology to the 40-kD subunit of A1 but, unlike the 40-kD protein, the 37-kD expressed protein did not bind ATP. Other findings suggested that both the 37- and 40-kD subunits of A1 are required for the biologic role of A1 and that they may function differently in this process. See replication factor C, subunit 2 (RFC2; 600404). Wang et al. (2000) used immunoprecipitation and mass spectrometry analyses to identify BRCA1 (OMIM Ref. No. 113705)-associated proteins. They found that BRCA1 is part of a large multisubunit protein complex of tumor suppressors, DNA damage sensors, and signal transducers. They named this complex BASC, for 'BRCA1-associated genome surveillance complex.' Among the DNA repair proteins identified in the complex were ATM (OMIM Ref. No. 208900), BLM (OMIM Ref. No. 604610), MSH2 (OMIM Ref. No. 120435), MSH6 (OMIM Ref. No. 600678), MLH1 (OMIM Ref. No. 120436), the RAD50 (OMIM Ref. No. 604040)-MRE11 (OMIM Ref. No. 600814)-NBS1 (OMIM Ref. No. 602667) complex, and the RFC1 (OMIM Ref. No. 102579)-RFC2-RFC4 complex. Wang et al. (2000) suggested that BASC may serve as a sensor of abnormal DNA structures and/or as a regulator of the postreplication repair process.

Full details of the abovementioned studies are described in the following publications, the disclosure of which are hereby incorporated by reference:

Chen, M.; Pan, Z.-Q.; Hurwitz, J.: Studies of the cloned 37-kDa subunit of activator 1 (replication factor C) of HeLa cells. Proc. Nat. Acad. Sci. 89:5211-5215, 1992; and Wang, Y.; Cortez, D.; Yazdi, P.; Neff, N.; Elledge, S. J.; Qin, J.: BASC, a super complex of BRCA1-associated proteins involved in the recognition and repair of aberrant DNA structures.

Further studies establishing the function and utilities of RFC4 are found in John Hopkins OMIM database record ID 102577, and in sited publications numbered 427 and 7117-7118 listed in the bibliography section hereinbelow, which are also hereby incorporated by reference. RGL (Accession NM_015149) is another VGAM2151 host target gene. RGL BINDING SITE is HOST TARGET binding site found in the 5' untranslated region of mRNA encoded by RGL, corresponding to a HOST TARGET binding site such as BINDING SITE I, BINDING SITE II or BINDING SITE III. Table 2 illustrates the complementarity of the nucleotide sequences of RGL BINDING SITE, designated SEQ ID:17507, to the nucleotide sequence of VGAM2151 RNA, herein designated VGAM RNA, also designated SEQ ID:4862.

Another function of VGAM2151 is therefore inhibition of RGL (Accession NM_015149), a gene which is involved in nucleotide exchange factor. Accordingly, utilities of VGAM2151 include diagnosis, prevention and treatment of diseases and clinical conditions associated with RGL. The function of RGL and its association with various diseases and clinical conditions, has been established by previous studies, as described hereinabove with reference to VGAM861. Rho-associated, Coiled-coil Containing Protein Kinase 2 (ROCK2, Accession XM_038377) is another VGAM2151 host target gene. ROCK2 BINDING SITE is HOST TARGET binding site found in the 5' untranslated region of mRNA encoded by ROCK2, corresponding to a HOST TARGET binding site such as BINDING SITE I, BINDING SITE II or BINDING SITE III. Table 2 illustrates the complementarity of the nucleotide sequences of ROCK2 BINDING SITE, designated SEQ ID:32841, to the nucleotide sequence of VGAM2151 RNA, herein designated VGAM RNA, also designated SEQ ID:4862.

Another function of VGAM2151 is therefore inhibition of Rho-associated, Coiled-coil Containing Protein Kinase 2 (ROCK2, Accession XM_038377), a gene which regulates cytokinesis, smooth muscle contraction, the formation of actin stress fibers and focal adhesions. Accordingly, utilities of VGAM2151 include diagnosis, prevention and treatment of diseases and clinical conditions associated with ROCK2. The function of ROCK2 and its association with various diseases and clinical conditions, has been established by previous studies, as described hereinabove with reference to VGAM273. Tafazzin (cardiomyopathy, dilated 3A (X-linked); Endocardial Fibroelastosis 2; Barth Syndrome) (TAZ, Accession NM_015472) is another VGAM2151 host target gene. TAZ BINDING SITE is HOST TARGET binding site found in the 5' untranslated region of mRNA encoded by TAZ, corresponding to a HOST TARGET binding site such as BINDING SITE I, BINDING SITE II or BINDING SITE III. Table 2 illustrates the complementarity of the nucleotide sequences of TAZ BINDING SITE, designated SEQ ID:17753, to the nucleotide sequence of VGAM2151 RNA, herein designated VGAM RNA, also designated SEQ ID:4862.

Another function of VGAM2151 is therefore inhibition of Tafazzin (cardiomyopathy, dilated 3A (X-linked); Endocardial Fibroelastosis 2; Barth Syndrome) (TAZ, Accession NM_015472). Accordingly, utilities of VGAM2151 include diagnosis, prevention and treatment of diseases and clinical conditions associated with TAZ. TRK-fused Gene (TFG, Accession NM_006070) is another VGAM2151 host target gene. TFG BINDING SITE is HOST TARGET binding site found in the 5' untranslated region of mRNA encoded by TFG, corresponding to a HOST TARGET binding site such as BINDING SITE I, BINDING SITE II or BINDING SITE III. Table 2 illustrates the complementarity of the nucleotide sequences of TFG BINDING SITE, designated SEQ ID:12713, to the nucleotide sequence of VGAM2151 RNA, herein designated VGAM RNA, also designated SEQ ID:4862.

Another function of VGAM2151 is therefore inhibition of TRK-fused Gene (TFG, Accession NM_006070), a gene which is a chimeric protein that forms multimeric complexes in vivo. Accordingly, utilities of VGAM2151 include diagnosis, prevention and treatment of diseases and clinical conditions associated with TFG. The function of TFG has been established by previous studies. See 188550. Greco et al. (1995) stated that approximately 50% of papillary thyroid carcinomas are associated with rearrangements of the RET (OMIM Ref. No. 164761) and NTRK1 (OMIM Ref. No. 191315) transmembrane receptor tyrosine kinase proto-oncogenes. The rearrangements juxtapose the tyrosine kinase domain to 5-prime sequences from unrelated loci, yielding chimeric proteins with ectopic, constitutive tyrosine kinase activity. In one tumor, Greco et al. (1995) found a chimeric oncogene, designated TRKT3, in which 1,412 nucleotides of NTRK1 are fused to 598 nucleotides from a novel gene called TFG (TRK-fused gene). TRKT3 encodes a predicted 592-amino acid chimeric protein that forms multimeric complexes in vivo. Mencinger et al. (1997) identified the complete TFG gene by searching for ESTs that were similar to the N-terminal regions of EWS (OMIM Ref. No. 133450) and FUS (OMIM Ref. No. 137070). TFG encodes a predicted 400-amino acid protein with a putative N-terminal coiled-coil region. On Northern blots, the 2.2-kb TFG mRNA was expressed in all tissues tested. Greco et al. (1995) stated that a coiled-coil structure and ubiquitous expression are features shared by all NTRK1-activating genes as well as genes that activate other tyrosine kinase proto-oncogenes.

Full details of the abovementioned studies are described in the following publications, the disclosure of which are hereby incorporated by reference:

Greco, A.; Mariani, C.; Miranda, C.; Lupas, A.; Pagliardini, S.; Pomati, M.; Pierotti, M. A.: The DNA rearrangement that generates the TRK-T3 oncogene involves a novel gene on chromosome 3 whose product has a potential coiled-coil domain. Molec. Cell Biol. 15:6118-6127, 1995; and Mencinger, M.; Panagopoulos, I.; Andreasson, P.; Lassen, C.; Mitelman, F.; Aman, P.: Characterization and chromosomal mapping of the human TFG gene involved in thyroid carcinoma. Genom.

Further studies establishing the function and utilities of TFG are found in John Hopkins OMIM database record ID 602498, and in sited publications numbered 8252-8253 listed in the bibliography section hereinbelow, which are also hereby incorporated by reference. Translin (TSN, Accession NM_004622) is another VGAM2151 host target gene. TSN BINDING SITE is HOST TARGET binding site found in the 5' untranslated region of mRNA encoded by TSN, corresponding to a HOST TARGET binding site such as BINDING SITE I, BINDING SITE II or BINDING SITE III. Table 2 illustrates the complementarity of the nucleotide sequences of TSN BINDING SITE, designated SEQ ID:10986, to the nucleotide sequence of VGAM2151 RNA, herein designated VGAM RNA, also designated SEQ ID:4862.

Another function of VGAM2151 is therefore inhibition of Translin (TSN, Accession NM_004622), a gene which is a DNA binding protein and involved in DNA repair, replication, or recombination. Accordingly, utilities of VGAM2151 include diagnosis, prevention and treatment of diseases and clinical conditions associated with TSN. The function of TSN and its association with various diseases and clinical conditions, has been established by previous studies, as described hereinabove with reference to VGAM98. Wolf-Hirschhorn Syndrome Candidate 1-like 1 (WHSC1L1, Accession NM_017778) is another VGAM2151 host target gene. WHSC1L1 BINDING SITE1 and WHSC1L1 BINDING SITE2 are HOST TARGET binding sites found in untranslated regions of mRNA encoded by WHSC1L1, corresponding to HOST TARGET binding sites such as BINDING SITE I, BINDING SITE II or BINDING SITE III. Table 2 illustrates the complementarity of the nucleotide sequences of WHSC1L1 BINDING SITE1 and WHSC1L1 BINDING SITE2, designated SEQ ID:19410 and SEQ ID:23317 respectively, to the nucleotide sequence of VGAM2151 RNA, herein designated VGAM RNA, also designated SEQ ID:4862.

Another function of VGAM2151 is therefore inhibition of Wolf-Hirschhorn Syndrome Candidate 1-like 1 (WHSC1L1, Accession NM_017778), a gene which restores repair of base-base and single- nucleotide insertion-deletion mismatches, and increases the proficiency to process heteroduplexes with insertion-deletion mismatches. Accordingly, utilities of VGAM2151 include diagnosis, prevention and treatment of diseases and clinical conditions associated with WHSC1L1. The function of WHSC1L1 and its association with various diseases and clinical conditions, has been established by previous studies, as described hereinabove with reference to VGAM475. Zinc Finger Protein 6 (CMPX1) (ZNF6, Accession NM_021998) is another VGAM2151 host target gene. ZNF6 BINDING SITE is HOST TARGET binding site found in the 5' untranslated region of mRNA encoded by ZNF6, corresponding to a HOST TARGET binding site such as BINDING SITE I, BINDING SITE II or BINDING SITE III. Table 2 illustrates the complementarity of the nucleotide sequences of ZNF6 BINDING SITE, designated SEQ ID:22536, to the nucleotide sequence of VGAM2151 RNA, herein designated VGAM RNA, also designated SEQ ID:4862.

Another function of VGAM2151 is therefore inhibition of Zinc Finger Protein 6 (CMPX1) (ZNF6, Accession NM_021998). Accordingly, utilities of VGAM2151 include diagnosis, prevention and treatment of diseases and clinical conditions associated with ZNF6. BDG-29 (Accession XM_051343) is another VGAM2151 host target gene. BDG-29 BINDING SITE is HOST TARGET binding site found in the 3' untranslated region of mRNA encoded by BDG-29, corresponding to a HOST TARGET binding site such as BINDING SITE I, BINDING SITE II or BINDING SITE III. Table 2 illustrates the complementarity of the nucleotide sequences of BDG-29 BINDING SITE, designated SEQ ID:35818, to the nucleotide sequence of VGAM2151 RNA, herein designated VGAM RNA, also designated SEQ ID:4862.

Another function of VGAM2151 is therefore inhibition of BDG-29 (Accession XM_051343). Accordingly, utilities of VGAM2151 include diagnosis, prevention and treatment of diseases and clinical conditions associated with BDG-29. C3IP1 (Accession NM_021633) is another VGAM2151 host target gene. C3IP1 BINDING SITE is HOST TARGET binding site found in the 5' untranslated region of mRNA encoded by C3IP1, corresponding to a HOST TARGET binding site such as BINDING SITE I, BINDING SITE II or BINDING SITE III. Table 2 illustrates the complementarity of the nucleotide sequences of C3IP1 BINDING SITE, designated SEQ ID:22276, to the nucleotide sequence of VGAM2151 RNA, herein designated VGAM RNA, also designated SEQ ID:4862.

Another function of VGAM2151 is therefore inhibition of C3IP1 (Accession NM_021633). Accordingly, utilities of VGAM2151 include diagnosis, prevention and treatment of diseases and clinical conditions associated with C3IP1. CASPR3 (Accession NM_033655) is another VGAM2151 host target gene. CASPR3 BINDING SITE is HOST TARGET binding site found in the 3' untranslated region of mRNA encoded by CASPR3, corresponding to a HOST TARGET binding site such as BINDING SITE I, BINDING SITE II or BINDING SITE III. Table 2 illustrates the complementarity of the nucleotide sequences of CASPR3 BINDING SITE, designated SEQ ID:27384, to the nucleotide sequence of VGAM2151 RNA, herein designated VGAM RNA, also designated SEQ ID:4862.

Another function of VGAM2151 is therefore inhibition of CASPR3 (Accession NM_033655). Accordingly, utilities of VGAM2151 include diagnosis, prevention and treatment of diseases and clinical conditions associated with CASPR3. Centaurin, Gamma 2 (CENTG2, Accession NM_014914) is another VGAM2151 host target gene. CENTG2 BINDING SITE is HOST TARGET binding site found in the 5' untranslated region of mRNA encoded by CENTG2, corresponding to a HOST TARGET binding site such as BINDING SITE I, BINDING SITE II or BINDING SITE III. Table 2 illustrates the complementarity of the nucleotide sequences of CENTG2 BINDING SITE, designated SEQ ID:17160, to the nucleotide sequence of VGAM2151 RNA, herein designated VGAM RNA, also designated SEQ ID:4862.

Another function of VGAM2151 is therefore inhibition of Centaurin, Gamma 2 (CENTG2, Accession NM_014914). Accordingly, utilities of VGAM2151 include diagnosis, prevention and treatment of diseases and clinical conditions associated with CENTG2. COASTER (Accession NM_015555) is another VGAM2151 host target gene. COASTER BINDING SITE is HOST TARGET binding site found in the 5' untranslated region of mRNA encoded by COASTER, corresponding to a HOST TARGET binding site such as BINDING SITE I, BINDING SITE II or BINDING SITE III. Table 2 illustrates the complementarity of the nucleotide sequences of COASTER BINDING SITE, designated SEQ ID:17823, to the nucleotide sequence of VGAM2151 RNA, herein designated VGAM RNA, also designated SEQ ID:4862.

Another function of VGAM2151 is therefore inhibition of COASTER (Accession NM_015555). Accordingly, utilities of VGAM2151 include diagnosis, prevention and treatment of diseases and clinical conditions associated with COASTER. Collagen, Type IV, Alpha 3 (Goodpasture antigen) Binding Protein (COL4A3BP, Accession NM_005713) is another VGAM2151 host target gene. COL4A3BP BINDING SITE is HOST TARGET binding site found in the 5' untranslated region of mRNA encoded by COL4A3BP, corresponding to a HOST TARGET binding site such as BINDING SITE I, BINDING SITE II or BINDING SITE III. Table 2 illustrates the complementarity of the nucleotide sequences of COL4A3BP BINDING SITE, designated SEQ ID:12267, to the nucleotide sequence of VGAM2151 RNA, herein designated VGAM RNA, also designated SEQ ID:4862.

Another function of VGAM2151 is therefore inhibition of Collagen, Type IV, Alpha 3 (Goodpasture antigen) Binding Protein (COL4A3BP, Accession NM_005713). Accordingly, utilities of VGAM2151 include diagnosis, prevention and treatment of diseases and clinical conditions associated with COL4A3BP. D123 (Accession NM_006023) is another VGAM2151 host target gene. D123 BINDING SITE is HOST TARGET binding site found in the 5' untranslated region of mRNA encoded by D123, corresponding to a HOST TARGET binding site such as BINDING SITE I, BINDING SITE II or BINDING SITE III. Table 2 illustrates the complementarity of the nucleotide sequences of D123 BINDING SITE, designated SEQ ID:12641, to the nucleotide sequence of VGAM2151 RNA, herein designated VGAM RNA, also designated SEQ ID:4862.

Another function of VGAM2151 is therefore inhibition of D123 (Accession NM_006023). Accordingly, utilities of VGAM2151 include diagnosis, prevention and treatment of diseases and clinical conditions associated with D123. Death-associated Protein Kinase 2 (DAPK2, Accession NM_014326) is another VGAM2151 host target gene. DAPK2 BINDING SITE is HOST TARGET binding site found in the 3' untranslated region of mRNA encoded by DAPK2, corresponding to a HOST TARGET binding site such as BINDING SITE I, BINDING SITE II or BINDING SITE III. Table 2 illustrates the complementarity of the nucleotide sequences of DAPK2 BINDING SITE, designated SEQ ID:15635, to the nucleotide sequence of VGAM2151 RNA, herein designated VGAM RNA, also designated SEQ ID:4862.

Another function of VGAM2151 is therefore inhibition of Death-associated Protein Kinase 2 (DAPK2, Accession NM_014326). Accordingly, utilities of VGAM2151 include diagnosis, prevention and treatment of diseases and clinical conditions associated with DAPK2. DKFZP434M154 (Accession XM_051330) is another VGAM2151 host target gene. DKFZP434M154 BINDING SITE is HOST TARGET binding site found in the 5' untranslated region of mRNA encoded by DKFZP434M154, corresponding to a HOST TARGET binding site such as BINDING SITE I, BINDING SITE II or BINDING SITE III. Table 2 illustrates the complementarity of the nucleotide sequences of DKFZP434M154 BINDING SITE, designated SEQ ID:35808, to the nucleotide sequence of VGAM2151 RNA, herein designated VGAM RNA, also designated SEQ ID:4862.

Another function of VGAM2151 is therefore inhibition of DKFZP434M154 (Accession XM_051330). Accordingly, utilities of VGAM2151 include diagnosis, prevention and treatment of diseases and clinical conditions associated with DKFZP434M154. DKFZp434O0320 (Accession XM_097012) is another VGAM2151 host target gene. DKFZp434O0320 BINDING SITE is HOST TARGET binding site found in the 5' untranslated region of mRNA encoded by DKFZp434O0320, corresponding to a HOST TARGET binding site such as BINDING SITE I, BINDING SITE II or BINDING SITE III. Table 2 illustrates the complementarity of the nucleotide sequences of DKFZp434O0320 BINDING SITE, designated SEQ ID:40707, to the nucleotide sequence of VGAM2151 RNA, herein designated VGAM RNA, also designated SEQ ID:4862.

Another function of VGAM2151 is therefore inhibition of DKFZp434O0320 (Accession XM_097012). Accordingly, utilities of VGAM2151 include diagnosis, prevention and treatment of diseases and clinical conditions associated with DKFZp434O0320. DKFZP566K1924 (Accession XM_057469) is another VGAM2151 host target gene. DKFZP566K1924 BINDING SITE is HOST TARGET binding site found in the 5' untranslated region of mRNA encoded by DKFZP566K1924, corresponding to a HOST TARGET binding site such as BINDING SITE I, BINDING SITE II or BINDING SITE III. Table 2 illustrates the complementarity of the nucleotide sequences of DKFZP566K1924 BINDING SITE, designated SEQ ID:36521, to the nucleotide sequence of VGAM2151 RNA, herein designated VGAM RNA, also designated SEQ ID:4862.

Another function of VGAM2151 is therefore inhibition of DKFZP566K1924 (Accession XM_057469). Accordingly, utilities of VGAM2151 include diagnosis, prevention and treatment of diseases and clinical conditions associated with DKFZP566K1924. Dlc2 (Accession NM_080677) is another VGAM2151 host target gene. Dlc2 BINDING SITE is HOST TARGET binding site found in the 5' untranslated region of mRNA encoded by Dlc2, corresponding to a HOST TARGET binding site such as BINDING SITE I, BINDING SITE II or BINDING SITE III. Table 2 illustrates the complementarity of the nucleotide sequences of Dlc2 BINDING SITE, designated SEQ ID:27970, to the nucleotide sequence of VGAM2151 RNA, herein designated VGAM RNA, also designated SEQ ID:4862.

Another function of VGAM2151 is therefore inhibition of Dlc2 (Accession NM_080677). Accordingly, utilities of VGAM2151 include diagnosis, prevention and treatment of diseases and clinical conditions associated with Dlc2. EHM2 (Accession NM_019114) is another VGAM2151 host target gene. EHM2 BINDING SITE is HOST TARGET binding site found in the 5' untranslated region of mRNA encoded by EHM2, corresponding to a HOST TARGET binding site such as BINDING SITE I, BINDING SITE II or BINDING SITE III. Table 2 illustrates the complementarity of the nucleotide sequences of EHM2 BINDING SITE, designated SEQ ID:21188, to the nucleotide sequence of VGAM2151 RNA, herein designated VGAM RNA, also designated SEQ ID:4862.

Another function of VGAM2151 is therefore inhibition of EHM2 (Accession NM_019114). Accordingly, utilities of VGAM2151 include diagnosis, prevention and treatment of diseases and clinical conditions associated with EHM2. ELKS (Accession NM_015064) is another VGAM2151 host target gene. ELKS BINDING SITE is HOST TARGET binding site found in the 5' untranslated region of mRNA encoded by ELKS, corresponding to a HOST TARGET binding site such as BINDING SITE I, BINDING SITE II or BINDING SITE III. Table 2 illustrates the complementarity of the nucleotide sequences of ELKS BINDING SITE, designated SEQ ID:17421, to the nucleotide sequence of VGAM2151 RNA, herein designated VGAM RNA, also designated SEQ ID:4862.

Another function of VGAM2151 is therefore inhibition of ELKS (Accession NM_015064). Accordingly, utilities of VGAM2151 include diagnosis, prevention and treatment of diseases and clinical conditions associated with ELKS. EZFIT (Accession NM_021216) is another VGAM2151 host target gene. EZFIT BINDING SITE is HOST TARGET binding site found in the 5' untranslated region of mRNA encoded by EZFIT, corresponding to a HOST TARGET binding site such as BINDING SITE I, BINDING SITE II or BINDING SITE III. Table 2 illustrates the complementarity of the nucleotide sequences of EZFIT BINDING SITE, designated SEQ ID:22196, to the nucleotide sequence of VGAM2151 RNA, herein designated VGAM RNA, also designated SEQ ID:4862.

Another function of VGAM2151 is therefore inhibition of EZFIT (Accession NM_021216). Accordingly, utilities of VGAM2151 include diagnosis, prevention and treatment of diseases and clinical conditions associated with EZFIT. Fem-1 Homolog B (C. elegans) (FEM1B, Accession NM_015322) is another VGAM2151 host target gene. FEM1B BINDING SITE is HOST TARGET binding site found in the 5' untranslated region of mRNA encoded by FEM1B, corresponding to a HOST TARGET binding site such as BINDING SITE I, BINDING SITE II or BINDING SITE III. Table 2 illustrates the complementarity of the nucleotide sequences of FEM1B BINDING SITE, designated SEQ ID:17642, to the nucleotide sequence of VGAM2151 RNA, herein designated VGAM RNA, also designated SEQ ID:4862.

Another function of VGAM2151 is therefore inhibition of Fem-1 Homolog B (C. elegans) (FEM1B, Accession NM_015322). Accordingly, utilities of VGAM2151 include diagnosis, prevention and treatment of diseases and clinical conditions associated with FEM1B. FLJ10101 (Accession NM_024718) is another VGAM2151 host target gene. FLJ10101 BINDING SITE is HOST TARGET binding site found in the 5' untranslated region of mRNA encoded by FLJ10101, corresponding to a HOST TARGET binding site such as BINDING SITE I, BINDING SITE II or BINDING SITE III. Table 2 illustrates the complementarity of the nucleotide sequences of FLJ10101 BINDING SITE, designated SEQ ID:24049, to the nucleotide sequence of VGAM2151 RNA, herein designated VGAM RNA, also designated SEQ ID:4862.

Another function of VGAM2151 is therefore inhibition of FLJ10101 (Accession NM_024718). Accordingly, utilities of VGAM2151 include diagnosis, prevention and treatment of diseases and clinical conditions associated with FLJ10101. FLJ10244 (Accession NM_018037) is another VGAM2151 host target gene. FLJ10244 BINDING SITE is HOST TARGET binding site found in the 5' untranslated region of mRNA encoded by FLJ10244, corresponding to a HOST TARGET binding site such as BINDING SITE I, BINDING SITE II or BINDING SITE III. Table 2 illustrates the complementarity of the nucleotide sequences of FLJ10244 BINDING SITE, designated SEQ ID:19781, to the nucleotide sequence of VGAM2151 RNA, herein designated VGAM RNA, also designated SEQ ID:4862.

Another function of VGAM2151 is therefore inhibition of FLJ10244 (Accession NM_018037). Accordingly, utilities of VGAM2151 include diagnosis, prevention and treatment of diseases and clinical conditions associated with FLJ10244. FLJ12076 (Accession NM_025187) is another VGAM2151 host target gene. FLJ12076 BINDING SITE is HOST TARGET binding site found in the 5' untranslated region of mRNA encoded by FLJ12076, corresponding to a HOST TARGET binding site such as BINDING SITE I, BINDING SITE II or BINDING SITE III. Table 2 illustrates the complementarity of the nucleotide sequences of FLJ12076 BINDING SITE, designated SEQ ID:24824, to the nucleotide sequence of VGAM2151 RNA, herein designated VGAM RNA, also designated SEQ ID:4862.

Another function of VGAM2151 is therefore inhibition of FLJ12076 (Accession NM_025187). Accordingly, utilities of VGAM2151 include diagnosis, prevention and treatment of diseases and clinical conditions associated with FLJ12076. FLJ13204 (Accession NM_024761) is another VGAM2151 host target gene. FLJ13204 BINDING SITE is HOST TARGET binding site found in the 5' untranslated region of mRNA encoded by FLJ13204, corresponding to a HOST TARGET binding site such as BINDING SITE I, BINDING SITE II or BINDING SITE III. Table 2 illustrates the complementarity of the nucleotide sequences of FLJ13204 BINDING SITE, designated SEQ ID:24117, to the nucleotide sequence of VGAM2151 RNA, herein designated VGAM RNA, also designated SEQ ID:4862.

Another function of VGAM2151 is therefore inhibition of FLJ13204 (Accession NM_024761). Accordingly, utilities of VGAM2151 include diagnosis, prevention and treatment of diseases and clinical conditions associated with FLJ13204. FLJ13621 (Accession NM_025009) is another VGAM2151 host target gene. FLJ13621 BINDING SITE is HOST TARGET binding site found in the 5' untranslated region of mRNA encoded by FLJ13621, corresponding to a HOST TARGET binding site such as BINDING SITE I, BINDING SITE II or BINDING SITE III. Table 2 illustrates the complementarity of the nucleotide sequences of FLJ13621 BINDING SITE, designated SEQ ID:24581, to the nucleotide sequence of VGAM2151 RNA, herein designated VGAM RNA, also designated SEQ ID:4862.

Another function of VGAM2151 is therefore inhibition of FLJ13621 (Accession NM_025009). Accordingly, utilities of VGAM2151 include diagnosis, prevention and treatment of diseases and clinical conditions associated with FLJ13621. FLJ14356 (Accession NM_030824) is another VGAM2151 host target gene. FLJ14356 BINDING SITE is HOST TARGET binding site found in the 5' untranslated region of mRNA encoded by FLJ14356, corresponding to a HOST TARGET binding site such as BINDING SITE I, BINDING SITE II or BINDING SITE III. Table 2 illustrates the complementarity of the nucleotide sequences of FLJ14356 BINDING SITE, designated SEQ ID:25153, to the nucleotide sequence of VGAM2151 RNA, herein designated VGAM RNA, also designated SEQ ID:4862.

Another function of VGAM2151 is therefore inhibition of FLJ14356 (Accession NM_030824). Accordingly, utilities of VGAM2151 include diagnosis, prevention and treatment of diseases and clinical conditions associated with FLJ14356. FLJ20080 (Accession NM_017657) is another VGAM2151 host target gene. FLJ20080 BINDING SITE is HOST TARGET binding site found in the 5' untranslated region of mRNA encoded by FLJ20080, corresponding to a HOST TARGET binding site such as BINDING SITE I, BINDING SITE II or BINDING SITE III. Table 2 illustrates the complementarity of the nucleotide sequences of FLJ20080 BINDING SITE, designated SEQ ID:19180, to the nucleotide sequence of VGAM2151 RNA, herein designated VGAM RNA, also designated SEQ ID:4862.

Another function of VGAM2151 is therefore inhibition of FLJ20080 (Accession NM_017657). Accordingly, utilities of VGAM2151 include diagnosis, prevention and treatment of diseases and clinical conditions associated with FLJ20080. FLJ20435 (Accession NM_017821) is another VGAM2151 host target gene. FLJ20435 BINDING SITE is HOST TARGET binding site found in the 3' untranslated region of mRNA encoded by FLJ20435, corresponding to a HOST TARGET binding site such as BINDING SITE I, BINDING SITE II or BINDING SITE III. Table 2 illustrates the complementarity of the nucleotide sequences of FLJ20435 BINDING SITE, designated SEQ ID:19471, to the nucleotide sequence of VGAM2151 RNA, herein designated VGAM RNA, also designated SEQ ID:4862.

Another function of VGAM2151 is therefore inhibition of FLJ20435 (Accession NM_017821). Accordingly, utilities of VGAM2151 include diagnosis, prevention and treatment of diseases and clinical conditions associated with FLJ20435. FLJ20718 (Accession NM_017939) is another VGAM2151 host target gene. FLJ20718 BINDING SITE is HOST TARGET binding site found in the 5' untranslated region of mRNA encoded by FLJ20718, corresponding to a HOST TARGET binding site such as BINDING SITE I, BINDING SITE II or BINDING SITE III. Table 2 illustrates the complementarity of the nucleotide sequences of FLJ20718 BINDING SITE, designated SEQ ID:19635, to the nucleotide sequence of VGAM2151 RNA, herein designated VGAM RNA, also designated SEQ ID:4862.

Another function of VGAM2151 is therefore inhibition of FLJ20718 (Accession NM_017939). Accordingly, utilities of VGAM2151 include diagnosis, prevention and treatment of diseases and clinical conditions associated with FLJ20718. FLJ22393 (Accession NM_025106) is another VGAM2151 host target gene. FLJ22393 BINDING SITE is HOST TARGET binding site found in the 5' untranslated region of mRNA encoded by FLJ22393, corresponding to a HOST TARGET binding site such as BINDING SITE I, BINDING SITE II or BINDING SITE III. Table 2 illustrates the complementarity of the nucleotide sequences of FLJ22393 BINDING SITE, designated SEQ ID:24756, to the nucleotide sequence of VGAM2151 RNA, herein designated VGAM RNA, also designated SEQ ID:4862.

Another function of VGAM2151 is therefore inhibition of FLJ22393 (Accession NM_025106). Accordingly, utilities of VGAM2151 include diagnosis, prevention and treatment of diseases and clinical conditions associated with FLJ22393. FLJ22405 (Accession NM_022485) is another VGAM2151 host target gene. FLJ22405 BINDING SITE is HOST TARGET binding site found in the 5' untranslated region of mRNA encoded by FLJ22405, corresponding to a HOST TARGET binding site such as BINDING SITE I, BINDING SITE II or BINDING SITE III. Table 2 illustrates the complementarity of the nucleotide sequences of FLJ22405 BINDING SITE, designated SEQ ID:22866, to the nucleotide sequence of VGAM2151 RNA, herein designated VGAM RNA, also designated SEQ ID:4862.

Another function of VGAM2151 is therefore inhibition of FLJ22405 (Accession NM_022485). Accordingly, utilities of VGAM2151 include diagnosis, prevention and treatment of diseases and clinical conditions associated with FLJ22405. FLJ22457 (Accession NM_024901) is another VGAM2151 host target gene. FLJ22457 BINDING SITE is HOST TARGET binding site found in the 5' untranslated region of mRNA encoded by FLJ22457, corresponding to a HOST TARGET binding site such as BINDING SITE I, BINDING SITE II or BINDING SITE III. Table 2 illustrates the complementarity of the nucleotide sequences of FLJ22457 BINDING SITE, designated SEQ ID:24389, to the nucleotide sequence of VGAM2151 RNA, herein designated VGAM RNA, also designated SEQ ID:4862.

Another function of VGAM2151 is therefore inhibition of FLJ22457 (Accession NM_024901). Accordingly, utilities of VGAM2151 include diagnosis, prevention and treatment of diseases and clinical conditions associated with FLJ22457. Fused Toes Homolog (mouse) (FTS, Accession NM_022476) is another VGAM2151 host target gene. FTS BINDING SITE is HOST TARGET binding site found in the 5' untranslated region of mRNA encoded by FTS, corresponding to a HOST TARGET binding site such as BINDING SITE I, BINDING SITE II or BINDING SITE III. Table 2 illustrates the complementarity of the nucleotide sequences of FTS BINDING SITE, designated SEQ ID:22843, to the nucleotide sequence of VGAM2151 RNA, herein designated VGAM RNA, also designated SEQ ID:4862.

Another function of VGAM2151 is therefore inhibition of Fused Toes Homolog (mouse) (FTS, Accession NM_022476). Accordingly, utilities of VGAM2151 include diagnosis, prevention and treatment of diseases and clinical conditions associated with FTS. GDBR1 (Accession NM_016172) is another VGAM2151 host target gene.

GDBR1 BINDING SITE is HOST TARGET binding site found in the 5' untranslated region of mRNA encoded by GDBR1, corresponding to a HOST TARGET binding site such as BINDING SITE I, BINDING SITE II or BINDING SITE III. Table 2 illustrates the complementarity of the nucleotide sequences of GDBR1 BINDING SITE, designated SEQ ID:18262, to the nucleotide sequence of VGAM2151 RNA, herein designated VGAM RNA, also designated SEQ ID:4862.

Another function of VGAM2151 is therefore inhibition of GDBR1 (Accession NM_016172). Accordingly, utilities of VGAM2151 include diagnosis, prevention and treatment of diseases and clinical conditions associated with GDBR1. HSPC195 (Accession XM_087785) is another VGAM2151 host target gene. HSPC195 BINDING SITE1 and HSPC195 BINDING SITE2 are HOST TARGET binding sites found in untranslated regions of mRNA encoded by HSPC195, corresponding to HOST TARGET binding sites such as BINDING SITE I, BINDING SITE II or BINDING SITE III. Table 2 illustrates the complementarity of the nucleotide sequences of HSPC195 BINDING SITE1 and HSPC195 BINDING SITE2, designated SEQ ID:39424 and SEQ ID:39423 respectively, to the nucleotide sequence of VGAM2151 RNA, herein designated VGAM RNA, also designated SEQ ID:4862.

Another function of VGAM2151 is therefore inhibition of HSPC195 (Accession XM_087785). Accordingly, utilities of VGAM2151 include diagnosis, prevention and treatment of diseases and clinical conditions associated with HSPC195. Insulin-like Growth Factor 2, Antisense (IGF2AS, Accession NM_016412) is another VGAM2151 host target gene. IGF2AS BINDING SITE is HOST TARGET binding site found in the 3' untranslated region of mRNA encoded by IGF2AS, corresponding to a HOST TARGET binding site such as BINDING SITE I, BINDING SITE II or BINDING SITE III. Table 2 illustrates the complementarity of the nucleotide sequences of IGF2AS BINDING SITE, designated SEQ ID:18541, to the nucleotide sequence of VGAM2151 RNA, herein designated VGAM RNA, also designated SEQ ID:4862.

Another function of VGAM2151 is therefore inhibition of Insulin-like Growth Factor 2, Antisense (IGF2AS, Accession NM_016412). Accordingly, utilities of VGAM2151 include diagnosis, prevention and treatment of diseases and clinical conditions associated with IGF2AS. Inositol 1,3,4-triphosphate 5/6 Kinase (ITPK1, Accession NM_014216) is another VGAM2151 host target gene. ITPK1 BINDING SITE is HOST TARGET binding site found in the 5' untranslated region of mRNA encoded by ITPK1, corresponding to a HOST TARGET binding site such as BINDING SITE I, BINDING SITE II or BINDING SITE III. Table 2 illustrates the complementarity of the nucleotide sequences of ITPK1 BINDING SITE, designated SEQ ID:15482, to the nucleotide sequence of VGAM2151 RNA, herein designated VGAM RNA, also designated SEQ ID:4862.

Another function of VGAM2151 is therefore inhibition of Inositol 1,3,4-triphosphate 5/6 Kinase (ITPK1, Accession NM_014216). Accordingly, utilities of VGAM2151 include diagnosis, prevention and treatment of diseases and clinical conditions associated with ITPK1. JIK (Accession NM_016281) is another VGAM2151 host target gene. JIK BINDING SITE is HOST TARGET binding site found in the 5' untranslated region of mRNA encoded by JIK, corresponding to a HOST TARGET binding site such as BINDING SITE I, BINDING SITE II or BINDING SITE III. Table 2 illustrates the complementarity of the nucleotide sequences of JIK BINDING SITE, designated SEQ ID:18406, to the nucleotide sequence of VGAM2151 RNA, herein designated VGAM RNA, also designated SEQ ID:4862.

Another function of VGAM2151 is therefore inhibition of JIK (Accession NM_016281). Accordingly, utilities of VGAM2151 include diagnosis, prevention and treatment of diseases and clinical conditions associated with JIK. KIAA0191 (Accession XM_038288) is another VGAM2151 host target gene. KIAA0191 BINDING SITE is HOST TARGET binding site found in the 5" untranslated region of mRNA encoded by KIAA0191, corresponding to a HOST TARGET binding site such as BINDING SITE I, BINDING SITE II or BINDING SITE III. Table 2 illustrates the complementarity of the nucleotide sequences of KIAA0191 BINDING SITE, designated SEQ ID:32788, to the nucleotide sequence of VGAM2151 RNA, herein designated VGAM RNA, also designated SEQ ID:4862.

Another function of VGAM2151 is therefore inhibition of KIAA0191 (Accession XM_038288). Accordingly, utilities of VGAM2151 include diagnosis, prevention and treatment of diseases and clinical conditions associated with KIAA0191. KIAA0210 (Accession NM_014744) is another VGAM2151 host target gene. KIAA0210 BINDING SITE is HOST TARGET binding site found in the 3' untranslated region of mRNA encoded by KIAA0210, corresponding to a HOST TARGET binding site such as BINDING SITE I, BINDING SITE II or BINDING SITE III. Table 2 illustrates the complementarity of the nucleotide sequences of KIAA0210 BINDING SITE, designated SEQ ID:16426, to the nucleotide sequence of VGAM2151 RNA, herein designated VGAM RNA, also designated SEQ ID:4862.

Another function of VGAM2151 is therefore inhibition of KIAA0210 (Accession NM_014744). Accordingly, utilities of VGAM2151 include diagnosis, prevention and treatment of diseases and clinical conditions associated with KIAA0210. KIAA0227 (Accession XM_027236) is another VGAM2151 host target gene. KIAA0227 BINDING SITE is HOST TARGET binding site found in the 5' untranslated region of mRNA encoded by KIAA0227, corresponding to a HOST TARGET binding site such as BINDING SITE I, BINDING SITE II or BINDING SITE III. Table 2 illustrates the complementarity of the nucleotide sequences of KIAA0227 BINDING SITE, designated SEQ ID:30454, to the nucleotide sequence of VGAM2151 RNA, herein designated VGAM RNA, also designated SEQ ID:4862.

Another function of VGAM2151 is therefore inhibition of KIAA0227 (Accession XM_027236). Accordingly, utilities of VGAM2151 include diagnosis, prevention and treatment of diseases and clinical conditions associated with KIAA0227. KIAA0544 (Accession XM_048119) is another VGAM2151 host target gene. KIAA0544 BINDING SITE is HOST TARGET binding site found in the 3' untranslated region of mRNA encoded by KIAA0544, corresponding to a HOST TARGET binding site such as BINDING SITE I, BINDING SITE II or BINDING SITE III. Table 2 illustrates the complementarity of the nucleotide sequences of KIAA0544 BINDING SITE, designated SEQ ID:35115, to the nucleotide sequence of VGAM2151 RNA, herein designated VGAM RNA, also designated SEQ ID:4862.

Another function of VGAM2151 is therefore inhibition of KIAA0544 (Accession XM_048119). Accordingly, utilities of VGAM2151 include diagnosis, prevention and treatment of diseases and clinical conditions associated with KIAA0544. KIAA0607 (Accession XM_051931) is another VGAM2151 host target gene. KIAA0607 BINDING SITE is HOST TARGET binding site found in the 3' untranslated region of mRNA encoded by KIAA0607, corresponding to a HOST TARGET binding site such as BINDING SITE I, BINDING SITE II or BINDING SITE III. Table 2 illustrates the complementarity of the nucleotide sequences of KIAA0607 BINDING SITE, designated SEQ ID:35926, to the nucleotide sequence of VGAM2151 RNA, herein designated VGAM RNA, also designated SEQ ID:4862.

Another function of VGAM2151 is therefore inhibition of KIAA0607 (Accession XM_051931). Accordingly, utilities of VGAM2151 include diagnosis, prevention and treatment of diseases and clinical conditions associated with KIAA0607. KIAA0701 (Accession XM_045423) is another VGAM2151 host target gene. KIAA0701 BINDING SITE1 and KIAA0701 BINDING SITE2 are HOST TARGET binding sites found in untranslated regions of mRNA encoded by KIAA0701, corresponding to HOST TARGET binding sites such as BINDING SITE I, BINDING SITE II or BINDING SITE III. Table 2 illustrates the complementarity of the nucleotide sequences of KIAA0701 BINDING SITE1 and KIAA0701 BINDING SITE2, designated SEQ ID:34458 and SEQ ID:34459 respectively, to the nucleotide sequence of VGAM2151 RNA, herein designated VGAM RNA, also designated SEQ ID:4862.

Another function of VGAM2151 is therefore inhibition of KIAA0701 (Accession XM_045423). Accordingly, utilities of VGAM2151 include diagnosis, prevention and treatment of diseases and clinical conditions associated with KIAA0701. KIAA0721 (Accession NM_021648) is another VGAM2151 host target gene. KIAA0721 BINDING SITE1 and KIAA0721 BINDING SITE2 are HOST TARGET binding sites found in untranslated regions of mRNA encoded by KIAA0721, corresponding to HOST TARGET binding sites such as BINDING SITE I, BINDING SITE II or BINDING SITE III. Table 2 illustrates the complementarity of the nucleotide sequences of KIAA0721 BINDING SITE1 and KIAA0721 BINDING SITE2, designated SEQ ID:22321 and SEQ ID:36066 respectively, to the nucleotide sequence of VGAM2151 RNA, herein designated VGAM RNA, also designated SEQ ID:4862.

Another function of VGAM2151 is therefore inhibition of KIAA0721 (Accession NM_021648). Accordingly, utilities of VGAM2151 include diagnosis, prevention and treatment of diseases and clinical conditions associated with KIAA0721. KIAA1233 (Accession XM_032181) is another VGAM2151 host target gene. KIAA1233 BINDING SITE is HOST TARGET binding site found in the 5' untranslated region of mRNA encoded by KIAA1233, corresponding to a HOST TARGET binding site such as BINDING SITE I, BINDING SITE II or BINDING SITE III. Table 2 illustrates the complementarity of the nucleotide sequences of KIAA1233 BINDING SITE, designated SEQ ID:31591, to the nucleotide sequence of VGAM2151 RNA, herein designated VGAM RNA, also designated SEQ ID:4862.

Another function of VGAM2151 is therefore inhibition of KIAA1233 (Accession XM_032181). Accordingly, utilities of VGAM2151 include diagnosis, prevention and treatment of diseases and clinical conditions associated with KIAA1233. KIAA1322 (Accession XM_052626) is another VGAM2151 host target gene. KIAA1322 BINDING SITE is HOST TARGET binding site found in the 5' untranslated region of mRNA encoded by KIAA1322, corresponding to a HOST TARGET binding site such as BINDING SITE I, BINDING SITE II or BINDING SITE III. Table 2 illustrates the complementarity of the nucleotide sequences of KIAA1322 BINDING SITE, designated SEQ ID:36031, to the nucleotide sequence of VGAM2151 RNA, herein designated VGAM RNA, also designated SEQ ID:4862.

Another function of VGAM2151 is therefore inhibition of KIAA1322 (Accession XM_052626). Accordingly, utilities of VGAM2151 include diagnosis, prevention and treatment of diseases and clinical conditions associated with KIAA1322. KIAA1822 (Accession XM_041566) is another VGAM2151 host target gene. KIAA1822 BINDING SITE is HOST TARGET binding site found in the 3' untranslated region of mRNA encoded by KIAA1822, corresponding to a HOST TARGET binding site such as BINDING SITE I, BINDING SITE II or BINDING SITE III. Table 2 illustrates the complementarity of the nucleotide sequences of KIAA1822 BINDING SITE, designated SEQ ID:33553, to the nucleotide sequence of VGAM2151 RNA, herein designated VGAM RNA, also designated SEQ ID:4862.

Another function of VGAM2151 is therefore inhibition of KIAA1822 (Accession XM_041566). Accordingly, utilities of VGAM2151 include diagnosis, prevention and treatment of diseases and clinical conditions associated with KIAA1822. KIAA1940 (Accession XM_086981) is another VGAM2151 host target gene. KIAA1940 BINDING SITE is HOST TARGET binding site found in the 5' untranslated region of mRNA encoded by KIAA1940, corresponding to a HOST TARGET binding site such as BINDING SITE I, BINDING SITE II or BINDING SITE III. Table 2 illustrates the complementarity of the nucleotide sequences of KIAA1940 BINDING SITE, designated SEQ ID:39008, to the nucleotide sequence of VGAM2151 RNA, herein designated VGAM RNA, also designated SEQ ID:4862.

Another function of VGAM2151 is therefore inhibition of KIAA1940 (Accession XM_086981). Accordingly, utilities of VGAM2151 include diagnosis, prevention and treatment of diseases and clinical conditions associated with KIAA1940. KIAA1987 (Accession XM_113870) is another VGAM2151 host target gene. KIAA1987 BINDING SITE is HOST TARGET binding site found in the 3' untranslated region of mRNA encoded by KIAA1987, corresponding to a HOST TARGET binding site such as BINDING SITE I, BINDING SITE II or BINDING SITE III. Table 2 illustrates the complementarity of the nucleotide sequences of KIAA1987 BINDING SITE, designated SEQ ID:42499, to the nucleotide sequence of VGAM2151 RNA, herein designated VGAM RNA, also designated SEQ ID:4862.

Another function of VGAM2151 is therefore inhibition of KIAA1987 (Accession XM_113870). Accordingly, utilities of VGAM2151 include diagnosis, prevention and treatment of diseases and clinical conditions associated with KIAA1987. Kelch-like 4 (Drosophila) (KLHL4, Accession NM_019117) is another VGAM2151 host target gene. KLHL4 BINDING SITE is HOST TARGET binding site found in the 3' untranslated region of mRNA encoded by KLHL4, corresponding to a HOST TARGET binding site such as BINDING SITE I, BINDING SITE II or BINDING SITE III. Table 2 illustrates the complementarity of the nucleotide sequences of KLHL4 BINDING SITE, designated SEQ ID:21192, to the nucleotide sequence of VGAM2151 RNA, herein designated VGAM RNA, also designated SEQ ID:4862.

Another function of VGAM2151 is therefore inhibition of Kelch-like 4 (Drosophila) (KLHL4, Accession NM_019117). Accordingly, utilities of VGAM2151 include diagnosis, prevention and treatment of diseases and clinical conditions associated with KLHL4. LSR68 (Accession NM_018678) is another VGAM2151 host target gene. LSR68 BINDING SITE is HOST TARGET binding site found in the 5' untranslated region of mRNA encoded by LSR68, corresponding to a HOST TARGET binding site such as BINDING SITE I, BINDING SITE II or BINDING SITE III. Table 2 illustrates the complementarity of the nucleotide sequences of LSR68 BINDING SITE, designated SEQ ID:20752, to the nucleotide sequence of VGAM2151 RNA, herein designated VGAM RNA, also designated SEQ ID:4862.

Another function of VGAM2151 is therefore inhibition of LSR68 (Accession NM_018678). Accordingly, utilities of VGAM2151 include diagnosis, prevention and treatment of diseases and clinical conditions associated with LSR68. Mesoderm Development Candidate 1 (MESDC1, Accession NM_022566) is another VGAM2151 host target gene. MESDC1 BINDING SITE is HOST TARGET binding site found in the 5' untranslated region of mRNA encoded by MESDC1, corresponding to a HOST TARGET binding site such as BINDING SITE I, BINDING SITE II or BINDING SITE III. Table 2 illustrates the complementarity of the nucleotide sequences of MESDC1 BINDING SITE, designated SEQ ID:22883, to the nucleotide sequence of VGAM2151 RNA, herein designated VGAM RNA, also designated SEQ ID:4862.

Another function of VGAM2151 is therefore inhibition of Mesoderm Development Candidate 1 (MESDC1, Accession NM_022566). Accordingly, utilities of VGAM2151 include diagnosis, prevention and treatment of diseases and clinical conditions associated with MESDC1. MGC11296 (Accession NM_032352) is another VGAM2151 host target gene. MGC11296 BINDING SITE is HOST TARGET binding site found in the 5' untranslated region of mRNA encoded by MGC11296, corresponding to a HOST TARGET binding site such as BINDING SITE I, BINDING SITE II or BINDING SITE III. Table 2 illustrates the complementarity of the nucleotide sequences of MGC11296 BINDING SITE, designated SEQ ID:26141, to the nucleotide sequence of VGAM2151 RNA, herein designated VGAM RNA, also designated SEQ ID:4862.

Another function of VGAM2151 is therefore inhibition of MGC11296 (Accession NM_032352). Accordingly, utilities of VGAM2151 include diagnosis, prevention and treatment of diseases and clinical conditions associated with MGC11296. MGC11324 (Accession NM_032717) is another VGAM2151 host target gene. MGC11324 BINDING SITE is HOST TARGET binding site found in the 5' untranslated region of mRNA encoded by MGC11324, corresponding to a HOST TARGET binding site such as BINDING SITE I, BINDING SITE II or BINDING SITE III. Table 2 illustrates the complementarity of the nucleotide sequences of MGC11324 BINDING SITE, designated SEQ ID:26445, to the nucleotide sequence of VGAM2151 RNA, herein designated VGAM RNA, also designated SEQ ID:4862.

Another function of VGAM2151 is therefore inhibition of MGC11324 (Accession NM_032717). Accordingly, utilities of VGAM2151 include diagnosis, prevention and treatment of diseases and clinical conditions associated with MGC11324. MGC26684 (Accession NM_144568) is another VGAM2151 host target gene. MGC26684 BINDING SITE is HOST TARGET binding site found in the 5' untranslated region of mRNA encoded by MGC26684, corresponding to a HOST TARGET binding site such as BINDING SITE I, BINDING SITE II or BINDING SITE III. Table 2 illustrates the complementarity of the nucleotide sequences of MGC26684 BINDING SITE, designated SEQ ID:29373, to the nucleotide sequence of VGAM2151 RNA, herein designated VGAM RNA, also designated SEQ ID:4862.

Another function of VGAM2151 is therefore inhibition of MGC26684 (Accession NM_144568). Accordingly, utilities of VGAM2151 include diagnosis, prevention and treatment of diseases and clinical conditions associated with MGC26684. MGC3265 (Accession NM_024028) is another VGAM2151 host target gene. MGC3265 BINDING SITE is HOST TARGET binding site found in the 3' untranslated region of mRNA encoded by MGC3265, corresponding to a HOST TARGET binding site such as BINDING SITE I, BINDING SITE II or BINDING SITE III. Table 2 illustrates the complementarity of the nucleotide sequences of MGC3265 BINDING SITE, designated SEQ ID:23459, to the nucleotide sequence of VGAM2151 RNA, herein designated VGAM RNA, also designated SEQ ID:4862.

Another function of VGAM2151 is therefore inhibition of MGC3265 (Accession NM_024028). Accordingly, utilities of VGAM2151 include diagnosis, prevention and treatment of diseases and clinical conditions associated with MGC3265. MGC4368 (Accession NM_024510) is another VGAM2151 host target gene. MGC4368 BINDING SITE is HOST TARGET binding site found in the 5' untranslated region of mRNA encoded by MGC4368, corresponding to a HOST TARGET binding site such as BINDING SITE I, BINDING SITE II or BINDING SITE III. Table 2 illustrates the complementarity of the nucleotide sequences of MGC4368 BINDING SITE, designated SEQ ID:23701, to the nucleotide sequence of VGAM2151 RNA, herein designated VGAM RNA, also designated SEQ ID:4862.

Another function of VGAM2151 is therefore inhibition of MGC4368 (Accession NM_024510). Accordingly, utilities of VGAM2151 include diagnosis, prevention and treatment of diseases and clinical conditions associated with MGC4368. MIR (Accession XM_165739) is another VGAM2151 host target gene. MIR BINDING SITE is HOST TARGET binding site found in the 5' untranslated region of mRNA encoded by MIR, corresponding to a HOST TARGET binding site such as BINDING SITE I, BINDING SITE II or BINDING SITE III. Table 2 illustrates the complementarity of the nucleotide sequences of MIR BINDING SITE, designated SEQ ID:43739, to the nucleotide sequence of VGAM2151 RNA, herein designated VGAM RNA, also designated SEQ ID:4862.

Another function of VGAM2151 is therefore inhibition of MIR (Accession XM_165739). Accordingly, utilities of VGAM2151 include diagnosis, prevention and treatment of diseases and clinical conditions associated with MIR. Myelin Protein Zero-like 1 (MPZL1, Accession NM_003953) is another VGAM2151 host target gene. MPZL1 BINDING SITE is HOST TARGET binding site found in the 5' untranslated region of mRNA encoded by MPZL1, corresponding to a HOST TARGET binding site such as BINDING SITE I, BINDING SITE II or BINDING SITE III. Table 2 illustrates the complementarity of the nucleotide sequences of MPZL1 BINDING SITE, designated SEQ ID:10088, to the nucleotide sequence of VGAM2151 RNA, herein designated VGAM RNA, also designated SEQ ID:4862.

Another function of VGAM2151 is therefore inhibition of Myelin Protein Zero-like 1 (MPZL1, Accession NM_003953). Accordingly, utilities of VGAM2151 include diagnosis, prevention and treatment of diseases and clinical conditions associated with MPZL1. MY014 (Accession NM_030918) is another VGAM2151 host target gene. MY014 BINDING SITE is HOST TARGET binding site found in the 5' untranslated region of mRNA encoded by MY014, corresponding to a HOST TARGET binding site such as BINDING SITE I, BINDING SITE II or BINDING SITE III. Table 2 illustrates the complementarity of the nucleotide sequences of MY014 BINDING SITE, designated SEQ ID:25191, to the nucleotide sequence of VGAM2151 RNA, herein designated VGAM RNA, also designated SEQ ID:4862.

Another function of VGAM2151 is therefore inhibition of MY014 (Accession NM_030918). Accordingly, utilities of VGAM2151 include diagnosis, prevention and treatment of diseases and clinical conditions associated with MY014. Nuclear Receptor Co-repressor 1 (NCOR1, Accession NM_006311) is another VGAM2151 host target gene. NCOR1 BINDING SITE is HOST TARGET binding site found in the 5' untranslated region of mRNA encoded by NCOR1, corresponding to a HOST TARGET binding site such as BINDING SITE I, BINDING SITE II or BINDING SITE III. Table 2 illustrates the complementarity of the nucleotide sequences of NCOR1 BINDING SITE, designated SEQ ID:13002, to the nucleotide sequence of VGAM2151 RNA, herein designated VGAM RNA, also designated SEQ ID:4862.

Another function of VGAM2151 is therefore inhibition of Nuclear Receptor Co-repressor 1 (NCOR1, Accession NM_006311). Accordingly, utilities of VGAM2151 include diagnosis, prevention and treatment of diseases and clinical conditions associated with NCOR1. Netrin 4 (NTN4, Accession XM_031896) is another VGAM2151 host target gene. NTN4 BINDING SITE is HOST TARGET binding site found in the 5' untranslated region of mRNA encoded by NTN4, corresponding to a HOST TARGET binding site such as BINDING SITE I, BINDING SITE II or BINDING SITE III. Table 2 illustrates the complementarity of the nucleotide sequences of NTN4 BINDING SITE, designated SEQ ID:31515, to the nucleotide sequence of VGAM2151 RNA, herein designated VGAM RNA, also designated SEQ ID:4862.

Another function of VGAM2151 is therefore inhibition of Netrin 4 (NTN4, Accession XM_031896). Accordingly, utilities of VGAM2151 include diagnosis, prevention and treatment of diseases and clinical conditions associated with NTN4. Nucleoredoxin (NXN, Accession NM_022463) is another VGAM2151 host target gene. NXN BINDING SITE is HOST TARGET binding site found in the 3' untranslated region of mRNA encoded by NXN, corresponding to a HOST TARGET binding site such as BINDING SITE I, BINDING SITE II or BINDING SITE III. Table 2 illustrates the complementarity of the nucleotide sequences of NXN BINDING SITE, designated SEQ ID:22811, to the nucleotide sequence of VGAM2151 RNA, herein designated VGAM RNA, also designated SEQ ID:4862.

Another function of VGAM2151 is therefore inhibition of Nucleoredoxin (NXN, Accession NM_022463). Accordingly, utilities of VGAM2151 include diagnosis, prevention and treatment of diseases and clinical conditions associated with NXN. Olfactory Receptor, Family 2, Subfamily C, Member 3 (OR2C3, Accession XM_060575) is another VGAM2151 host target gene. OR2C3 BINDING SITE is HOST TARGET binding site found in the 3' untranslated region of mRNA encoded by OR2C3, corresponding to a HOST TARGET binding site such as BINDING SITE I, BINDING SITE II or BINDING SITE III. Table 2 illustrates the complementarity of the nucleotide sequences of OR2C3 BINDING SITE, designated SEQ ID:37175, to the nucleotide sequence of VGAM2151 RNA, herein designated VGAM RNA, also designated SEQ ID:4862.

Another function of VGAM2151 is therefore inhibition of Olfactory Receptor, Family 2, Subfamily C, Member 3 (OR2C3, Accession XM_060575). Accordingly, utilities of VGAM2151 include diagnosis, prevention and treatment of diseases and clinical conditions associated with OR2C3. Oxysterol Binding Protein-like 5 (OSBPL5, Accession XM_052567) is another VGAM2151 host target gene. OSBPL5 BINDING SITE is HOST TARGET binding site found in the 3' untranslated region of mRNA encoded by OSBPL5, corresponding to a HOST TARGET binding site such as BINDING SITE I, BINDING SITE II or BINDING SITE III. Table 2 illustrates the complementarity of the nucleotide sequences of OSBPL5 BINDING SITE, designated SEQ ID:35990, to the nucleotide sequence of VGAM2151 RNA, herein designated VGAM RNA, also designated SEQ ID:4862.

Another function of VGAM2151 is therefore inhibition of Oxysterol Binding Protein-like 5 (OSBPL5, Accession XM_052567). Accordingly, utilities of VGAM2151 include diagnosis, prevention and treatment of diseases and clinical conditions associated with OSBPL5. P5-1 (Accession NM_006674) is another VGAM2151 host target gene. P5-1 BINDING SITE is HOST TARGET binding site found in the 3' untranslated region of mRNA encoded by P5-1, corresponding to a HOST TARGET binding site such as BINDING SITE I, BINDING SITE II or BINDING SITE III. Table 2 illustrates the complementarity of the nucleotide sequences of P5-1 BINDING SITE, designated SEQ ID:13499, to the nucleotide sequence of VGAM2151 RNA, herein designated VGAM RNA, also designated SEQ ID:4862.

Another function of VGAM2151 is therefore inhibition of P5-1 (Accession NM_006674). Accordingly, utilities of VGAM2151 include diagnosis, prevention and treatment of diseases and clinical conditions associated with P5-1. P300/CBP-associated Factor (PCAF, Accession NM_003884) is another VGAM2151 host target gene. PCAF BINDING SITE is HOST TARGET binding site found in the 5' untranslated region of mRNA encoded by PCAF, corresponding to a HOST TARGET binding site such as BINDING SITE I, BINDING SITE II or BINDING SITE III. Table 2 illustrates the complementarity of the nucleotide sequences of PCAF BINDING SITE, designated SEQ ID:9964, to the nucleotide sequence of VGAM2151 RNA, herein designated VGAM RNA, also designated SEQ ID:4862.

Another function of VGAM2151 is therefore inhibition of P300/CBP-associated Factor (PCAF, Accession NM_003884). Accordingly, utilities of VGAM2151 include diagnosis, prevention and treatment of diseases and clinical conditions associated with PCAF. Proprotein Convertase Subtilisin/kexin Type 7 (PCSK7, Accession NM_004716) is another VGAM2151 host target gene. PCSK7 BINDING SITE is HOST TARGET binding site found in the 5' untranslated region of mRNA encoded by PCSK7, corresponding to a HOST TARGET binding site such as BINDING SITE I, BINDING SITE II or BINDING SITE III. Table 2 illustrates the complementarity of the nucleotide sequences of PCSK7 BINDING SITE, designated SEQ ID:11076, to the nucleotide sequence of VGAM2151 RNA, herein designated VGAM RNA, also designated SEQ ID:4862.

Another function of VGAM2151 is therefore inhibition of Proprotein Convertase Subtilisin/kexin Type 7 (PCSK7, Accession NM_004716). Accordingly, utilities of VGAM2151 include diagnosis, prevention and treatment of diseases and clinical conditions associated with PCSK7. Programmed Cell Death 7 (PDCD7, Accession XM_050977) is another VGAM2151 host target gene. PDCD7 BINDING SITE is HOST TARGET binding site found in the 3' untranslated region of mRNA encoded by PDCD7, corresponding to a HOST TARGET binding site such as BINDING SITE I, BINDING SITE II or BINDING SITE III. Table 2 illustrates the complementarity of the nucleotide sequences of PDCD7 BINDING SITE, designated SEQ ID:35696, to the nucleotide sequence of VGAM2151 RNA, herein designated VGAM RNA, also designated SEQ ID:4862.

Another function of VGAM2151 is therefore inhibition of Programmed Cell Death 7 (PDCD7, Accession XM_050977). Accordingly, utilities of VGAM2151 include diagnosis, prevention and treatment of diseases and clinical conditions associated with PDCD7. PEGASUS (Accession NM_022466) is another VGAM2151 host target gene. PEGASUS BINDING SITE1 and PEGASUS BINDING SITE2 are HOST TARGET binding sites found in untranslated regions of mRNA encoded by PEGASUS, corresponding to HOST TARGET binding sites such as BINDING SITE I, BINDING SITE II or BINDING SITE III. Table 2 illustrates the complementarity of the nucleotide sequences of PEGASUS BINDING SITE1 and PEGASUS BINDING SITE2, designated SEQ ID:22814 and SEQ ID:22815 respectively, to the nucleotide sequence of VGAM2151 RNA, herein designated VGAM RNA, also designated SEQ ID:4862.

Another function of VGAM2151 is therefore inhibition of PEGASUS (Accession NM_022466). Accordingly, utilities of VGAM2151 include diagnosis, prevention and treatment of diseases and clinical conditions associated with PEGASUS. PF1 (Accession XM_170828) is another VGAM2151 host target gene. PF1 BINDING SITE is HOST TARGET binding site found in the 5' untranslated region of mRNA encoded by PF1, corresponding to a HOST TARGET binding site such as BINDING SITE I, BINDING SITE II or BINDING SITE III. Table 2 illustrates the complementarity of the nucleotide sequences of PF1 BINDING SITE, designated SEQ ID:45604, to the nucleotide sequence of VGAM2151 RNA, herein designated VGAM RNA, also designated SEQ ID:4862.

Another function of VGAM2151 is therefore inhibition of PF1 (Accession XM_170828). Accordingly, utilities of VGAM2151 include diagnosis, prevention and treatment of diseases and clinical conditions associated with PF1. PPI5PIV (Accession NM_019892) is another VGAM2151 host target gene. PPI5PIV BINDING SITE is HOST TARGET binding site found in the 3' untranslated region of mRNA encoded by PPI5PIV, corresponding to a HOST TARGET binding site such as BINDING SITE I, BINDING SITE II or BINDING SITE III. Table 2 illustrates the complementarity of the nucleotide sequences of PPI5PIV BINDING SITE, designated SEQ ID:21277, to the nucleotide sequence of VGAM2151 RNA, herein designated VGAM RNA, also designated SEQ ID:4862.

Another function of VGAM2151 is therefore inhibition of PPI5PIV (Accession NM_019892). Accordingly, utilities of VGAM2151 include diagnosis, prevention and treatment of diseases and clinical conditions associated with PPI5PIV. Protein Tyrosine Phosphatase, Non-receptor Type Substrate 1 (PTPNS1, Accession NM_080792) is another VGAM2151 host target gene. PTPNS1 BINDING SITE is HOST TARGET binding site found in the 3' untranslated region of mRNA encoded by PTPNS1, corresponding to a HOST TARGET binding site such as BINDING SITE I, BINDING SITE II or BINDING SITE III. Table 2 illustrates the complementarity of the nucleotide sequences of PTPNS1 BINDING SITE, designated SEQ ID:28056, to the nucleotide sequence of VGAM2151 RNA, herein designated VGAM RNA, also designated SEQ ID:4862.

Another function of VGAM2151 is therefore inhibition of Protein Tyrosine Phosphatase, Non-receptor Type Substrate 1 (PTPNS1, Accession NM_080792). Accordingly, utilities of VGAM2151 include diagnosis, prevention and treatment of diseases and clinical conditions associated with PTPNS1. PTR4 (Accession XM_058546) is another VGAM2151 host target gene. PTR4 BINDING SITE is HOST TARGET binding site found in the 5' untranslated region of mRNA encoded by PTR4, corresponding to a HOST TARGET binding site such as BINDING SITE I, BINDING SITE II or BINDING SITE III. Table 2 illustrates the complementarity of the nucleotide sequences of PTR4 BINDING SITE, designated SEQ ID:36654, to the nucleotide sequence of VGAM2151 RNA, herein designated VGAM RNA, also designated SEQ ID:4862.

Another function of VGAM2151 is therefore inhibition of PTR4 (Accession XM_058546). Accordingly, utilities of VGAM2151 include diagnosis, prevention and treatment of diseases and clinical conditions associated with PTR4. RPH3A (Accession NM_014954) is another VGAM2151 host target gene. RPH3A BINDING SITE is HOST TARGET binding site found in the 3' untranslated region of mRNA encoded by RPH3A, corresponding to a HOST TARGET binding site such as BINDING SITE I, BINDING SITE II or BINDING SITE III. Table 2 illustrates the complementarity of the nucleotide sequences of RPH3A BINDING SITE, designated SEQ ID:17307, to the nucleotide sequence of VGAM2151 RNA, herein designated VGAM RNA, also designated SEQ ID:4862.

Another function of VGAM2151 is therefore inhibition of RPH3A (Accession NM_014954). Accordingly, utilities of VGAM2151 include diagnosis, prevention and treatment of diseases and clinical conditions associated with RPH3A. Solute Carrier Family 21 (organic anion transporter), Member 11 (SLC21A11, Accession XM_035268) is another VGAM2151 host target gene. SLC21A11 BINDING SITE is HOST TARGET binding site found in the 5' untranslated region of mRNA encoded by SLC21A11, corresponding to a HOST TARGET binding site such as BINDING SITE I, BINDING SITE II or BINDING SITE III. Table 2 illustrates the complementarity of the nucleotide sequences of SLC21A11 BINDING SITE, designated SEQ ID:32208, to the nucleotide sequence of VGAM2151 RNA, herein designated VGAM RNA, also designated SEQ ID:4862.

Another function of VGAM2151 is therefore inhibition of Solute Carrier Family 21 (organic anion transporter), Member 11 (SLC21A11, Accession XM_035268). Accordingly, utilities of VGAM2151 include diagnosis, prevention and treatment of diseases and clinical conditions associated with SLC21A11. Slit Homolog 1 (Drosophila) (SLIT1, Accession NM_003061) is another VGAM2151 host target gene. SLIT1 BINDING SITE is HOST TARGET binding site found in the 5' untranslated region of mRNA encoded by SLIT1, corresponding to a HOST TARGET binding site such as BINDING SITE I, BINDING SITE II or BINDING SITE III. Table 2 illustrates the complementarity of the nucleotide sequences of SLIT1 BINDING SITE, designated SEQ ID:9030, to the nucleotide sequence of VGAM2151 RNA, herein designated VGAM RNA, also designated SEQ ID:4862.

Another function of VGAM2151 is therefore inhibition of Slit Homolog 1 (Drosophila) (SLIT1, Accession NM_003061). Accordingly, utilities of VGAM2151 include diagnosis, prevention and treatment of diseases and clinical conditions associated with SLIT1. Serum Response Factor (c-fos serum response element-binding transcription factor) (SRF, Accession NM_003131) is another VGAM2151 host target gene. SRF BINDING SITE1 and SRF BINDING SITE2 are HOST TARGET binding sites found in untranslated regions of mRNA encoded by SRF, corresponding to HOST TARGET binding sites such as BINDING SITE I, BINDING SITE II or BINDING SITE III. Table 2 illustrates the complementarity of the nucleotide sequences of SRF BINDING SITE1 and SRF BINDING SITE2, designated SEQ ID:9101 and SEQ ID:9102 respectively, to the nucleotide sequence of VGAM2151 RNA, herein designated VGAM RNA, also designated SEQ ID:4862.

Another function of VGAM2151 is therefore inhibition of Serum Response Factor (c-fos serum response element-binding transcription factor) (SRF, Accession NM_003131). Accordingly, utilities of VGAM2151 include diagnosis, prevention and treatment of diseases and clinical conditions associated with SRF. Serine Threonine Kinase 39 (STE20/SPS1 homolog, yeast) (STK39, Accession NM_013233) is another VGAM2151 host target gene. STK39 BINDING SITE is HOST TARGET binding site found in the 5' untranslated region of mRNA encoded by STK39, corresponding to a HOST TARGET binding site such as BINDING SITE I, BINDING SITE II or BINDING SITE III. Table 2 illustrates the complementarity of the nucleotide sequences of STK39 BINDING SITE, designated SEQ ID:14894, to the nucleotide sequence of VGAM2151 RNA, herein designated VGAM RNA, also designated SEQ ID:4862.

Another function of VGAM2151 is therefore inhibition of Serine Threonine Kinase 39 (STE20/SPS1 homolog, yeast) (STK39, Accession NM_013233). Accordingly, utilities of VGAM2151 include diagnosis, prevention and treatment of diseases and clinical conditions associated with STK39. TU12B1-TY (Accession NM_016575) is another VGAM2151 host target gene. TU12B1-TY BINDING SITE is HOST TARGET binding site found in the 3' untranslated region of mRNA encoded by TU12B1-TY, corresponding to a HOST TARGET binding site such as BINDING SITE I, BINDING SITE II or BINDING SITE III. Table 2 illustrates the complementarity of the nucleotide sequences of TU12B1-TY BINDING SITE, designated SEQ ID:18649, to the nucleotide sequence of VGAM2151 RNA, herein designated VGAM RNA, also designated SEQ ID:4862.

Another function of VGAM2151 is therefore inhibition of TU12B1-TY (Accession NM_016575). Accordingly, utilities of VGAM2151 include diagnosis, prevention and treatment of diseases and clinical conditions associated with TU12B1-TY. TUSP (Accession NM_020245) is another VGAM2151 host target gene. TUSP BINDING SITE is HOST TARGET binding site found in the 3' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21530, to the nucleotide sequence of VGAM2151 RNA, herein designated VGAM RNA, also designated SEQ ID:4862.

Another function of VGAM2151 is therefore inhibition of TUSP (Accession NM_020245). Accordingly, utilities of VGAM2151 include diagnosis, prevention and treatment of diseases and clinical conditions associated with TUSP. Unc-51-like Kinase 2 (C. elegans) (ULK2, Accession NM_014683) is another VGAM2151 host target gene. ULK2 BINDING SITE is HOST TARGET binding site found in the 5' untranslated region of mRNA encoded by ULK2, corresponding to a HOST TARGET binding site such as BINDING SITE I, BINDING SITE II or BINDING SITE III. Table 2 illustrates the complementarity of the nucleotide sequences of ULK2 BINDING SITE, designated SEQ ID:16182, to the nucleotide sequence of VGAM2151 RNA, herein designated VGAM RNA, also designated SEQ ID:4862.

Another function of VGAM2151 is therefore inhibition of Unc-51-like Kinase 2 (C. elegans) (ULK2, Accession NM_014683). Accordingly, utilities of VGAM2151 include diagnosis, prevention and treatment of diseases and clinical conditions associated with ULK2. WIT-1 (Accession NM_015855) is another VGAM2151 host target gene. WIT-1 BINDING SITE is HOST TARGET binding site found in the 3' untranslated region of mRNA encoded by WIT-1, corresponding to a HOST TARGET binding site such as BINDING SITE I, BINDING SITE II or BINDING SITE III. Table 2 illustrates the complementarity of the nucleotide sequences of WIT-1 BINDING SITE, designated SEQ ID:17991, to the nucleotide sequence of VGAM2151 RNA, herein designated VGAM RNA, also designated SEQ ID:4862.

Another function of VGAM2151 is therefore inhibition of WIT-1 (Accession NM_015855). Accordingly, utilities of VGAM2151 include diagnosis, prevention and treatment of diseases and clinical conditions associated with WIT-1. Zinc Finger, DHHC Domain Containing 3 (ZDHHC3, Accession NM_016598) is another VGAM2151 host target gene. ZDHHC3 BINDING SITE is HOST TARGET binding site found in the 5' untranslated region of mRNA encoded by ZDHHC3, corresponding to a HOST TARGET binding site such as BINDING SITE I, BINDING SITE II or BINDING SITE III. Table 2 illustrates the complementarity of the nucleotide sequences of ZDHHC3 BINDING SITE, designated SEQ ID:18689, to the nucleotide sequence of VGAM2151 RNA, herein designated VGAM RNA, also designated SEQ ID:4862.

Another function of VGAM2151 is therefore inhibition of Zinc Finger, DHHC Domain Containing 3 (ZDHHC3, Accession NM_016598). Accordingly, utilities of VGAM2151 include diagnosis, prevention and treatment of diseases and clinical conditions associated with ZDHHC3. ZF (Accession NM_021212) is another VGAM2151 host target gene. ZF BINDING SITE is HOST TARGET binding site found in the 5' untranslated region of mRNA encoded by ZF, corresponding to a HOST TARGET binding site such as BINDING SITE I, BINDING SITE II or BINDING SITE III. Table 2 illustrates the complementarity of the nucleotide sequences of ZF BINDING SITE, designated SEQ ID:22191, to the nucleotide sequence of VGAM2151 RNA, herein designated VGAM RNA, also designated SEQ ID:4862.

Another function of VGAM2151 is therefore inhibition of ZF (Accession NM_021212). Accordingly, utilities of VGAM2151 include diagnosis, prevention and treatment of diseases and clinical conditions associated with ZF. Zinc Finger Protein 238 (ZNF238, Accession NM_006352) is another VGAM2151 host target gene. ZNF238 BINDING SITE is HOST TARGET binding site found in the 5' untranslated region of mRNA encoded by ZNF238, corresponding to a HOST TARGET binding site such as BINDING SITE I, BINDING SITE II or BINDING SITE III. Table 2 illustrates the complementarity of the nucleotide sequences of ZNF238 BINDING SITE, designated SEQ ID:13044, to the nucleotide sequence of VGAM2151 RNA, herein designated VGAM RNA, also designated SEQ ID:4862.

Another function of VGAM2151 is therefore inhibition of Zinc Finger Protein 238 (ZNF238, Accession NM_006352). Accordingly, utilities of VGAM2151 include diagnosis, prevention and treatment of diseases and clinical conditions associated with ZNF238. ZTL1 (Accession NM_024055) is another VGAM2151 host target gene. ZTL1 BINDING SITE1 and ZTL1 BINDING SITE2 are HOST TARGET binding sites found in untranslated regions of mRNA encoded by ZTL1, corresponding to HOST TARGET binding sites such as BINDING SITE I, BINDING SITE II or BINDING SITE III. Table 2 illustrates the complementarity of the nucleotide sequences of ZTL1 BINDING SITE1 and ZTL1 BINDING SITE2, designated SEQ ID:23492 and SEQ ID:23188 respectively, to the nucleotide sequence of VGAM2151 RNA, herein designated VGAM RNA, also designated SEQ ID:4862.

Another function of VGAM2151 is therefore inhibition of ZTL1 (Accession NM_024055). Accordingly, utilities of VGAM2151 include diagnosis, prevention and treatment of diseases and clinical conditions associated with ZTL1. LOC118851 (Accession XM_061180) is another VGAM2151 host target gene. LOC118851 BINDING SITE is HOST TARGET binding site found in the 5' untranslated region of mRNA encoded by LOC118851, corresponding to a HOST TARGET binding site such as BINDING SITE I, BINDING SITE II or BINDING SITE III. Table 2 illustrates the complementarity of the nucleotide sequences of LOC118851 BINDING SITE, designated SEQ ID:37202, to the nucleotide sequence of VGAM2151 RNA, herein designated VGAM RNA, also designated SEQ ID:4862.

Another function of VGAM2151 is therefore inhibition of LOC118851 (Accession XM_061180). Accordingly, utilities of VGAM2151 include diagnosis, prevention and treatment of diseases and clinical conditions associated with LOC118851. LOC121536 (Accession XM_058567) is another VGAM2151 host target gene. LOC121536 BINDING SITE is HOST TARGET binding site found in the 5' untranslated region of mRNA encoded by LOC121536, corresponding to a HOST TARGET binding site such as BINDING SITE I, BINDING SITE II or BINDING SITE III. Table 2 illustrates the complementarity of the nucleotide sequences of LOC121536 BINDING SITE, designated SEQ ID:36665, to the nucleotide sequence of VGAM2151 RNA, herein designated VGAM RNA, also designated SEQ ID:4862.

Another function of VGAM2151 is therefore inhibition of LOC121536 (Accession XM_058567). Accordingly, utilities of VGAM2151 include diagnosis, prevention and treatment of diseases and clinical conditions associated with LOC121536. LOC122553 (Accession XM_058630) is another VGAM2151 host target gene. LOC122553 BINDING SITE is HOST TARGET binding site found in the 5' untranslated region of mRNA encoded by LOC122553, corresponding to a HOST TARGET binding site such as BINDING SITE I, BINDING SITE II or BINDING SITE III. Table 2 illustrates the complementarity of the nucleotide sequences of LOC122553 BINDING SITE, designated SEQ ID:36690, to the nucleotide sequence of VGAM2151 RNA, herein designated VGAM RNA, also designated SEQ ID:4862.

Another function of VGAM2151 is therefore inhibition of LOC122553 (Accession XM_058630). Accordingly, utilities of VGAM2151 include diagnosis, prevention and treatment of diseases and clinical conditions associated with LOC122553. LOC122792 (Accession NM_145251) is another VGAM2151 host target gene. LOC122792 BINDING SITE is HOST TARGET binding site found in the 5' untranslated region of mRNA encoded by LOC122792, corresponding to a HOST TARGET binding site such as BINDING SITE I, BINDING SITE II or BINDING SITE III. Table 2 illustrates the complementarity of the nucleotide sequences of LOC122792 BINDING SITE, designated SEQ ID:29764, to the nucleotide sequence of VGAM2151 RNA, herein designated VGAM RNA, also designated SEQ ID:4862.

Another function of VGAM2151 is therefore inhibition of LOC122792 (Accession NM_145251). Accordingly, utilities of VGAM2151 include diagnosis, prevention and treatment of diseases and clinical conditions associated with LOC122792. LOC125228 (Accession XM_058913) is another VGAM2151 host target gene. LOC125228 BINDING SITE is HOST TARGET binding site found in the 5' untranslated region of mRNA encoded by LOC125228, corresponding to a HOST TARGET binding site such as BINDING SITE I, BINDING SITE II or BINDING SITE III. Table 2 illustrates the complementarity of the nucleotide sequences of LOC125228 BINDING SITE, designated SEQ ID:36792, to the nucleotide sequence of VGAM2151 RNA, herein designated VGAM RNA, also designated SEQ ID:4862.

Another function of VGAM2151 is therefore inhibition of LOC125228 (Accession XM_058913). Accordingly, utilities of VGAM2151 include diagnosis, prevention and treatment of diseases and clinical conditions associated with LOC125228. LOC126432 (Accession XM_059046) is another VGAM2151 host target gene. LOC126432 BINDING SITE is HOST TARGET binding site found in the 5' untranslated region of mRNA encoded by LOC126432, corresponding to a HOST TARGET binding site such as BINDING SITE I, BINDING SITE II or BINDING SITE III. Table 2 illustrates the complementarity of the nucleotide sequences of LOC126432 BINDING SITE, designated SEQ ID:36842, to the nucleotide sequence of VGAM2151 RNA, herein designated VGAM RNA, also designated SEQ ID:4862.

Another function of VGAM2151 is therefore inhibition of LOC126432 (Accession XM_059046). Accordingly, utilities of VGAM2151 include diagnosis, prevention and treatment of diseases and clinical conditions associated with LOC126432. LOC134553 (Accession XM_059723) is another VGAM2151 host target gene. LOC134553 BINDING SITE is HOST TARGET binding site found in the 5' untranslated region of mRNA encoded by LOC134553, corresponding to a HOST TARGET binding site such as BINDING SITE I, BINDING SITE II or BINDING SITE III. Table 2 illustrates the complementarity of the nucleotide sequences of LOC134553 BINDING SITE, designated SEQ ID:37077, to the nucleotide sequence of VGAM2151 RNA, herein designated VGAM RNA, also designated SEQ ID:4862.

Another function of VGAM2151 is therefore inhibition of LOC134553 (Accession XM_059723). Accordingly, utilities of VGAM2151 include diagnosis, prevention and treatment of diseases and clinical conditions associated with LOC134553. LOC146057 (Accession XM_085302) is another VGAM2151 host target gene. LOC146057 BINDING SITE is HOST TARGET binding site found in the 5' untranslated region of mRNA encoded by LOC146057, corresponding to a HOST TARGET binding site such as BINDING SITE I, BINDING SITE II or BINDING SITE III. Table 2 illustrates the complementarity of the nucleotide sequences of LOC146057 BINDING SITE, designated SEQ ID:38058, to the nucleotide sequence of VGAM2151 RNA, herein designated VGAM RNA, also designated SEQ ID:4862.

Another function of VGAM2151 is therefore inhibition of LOC146057 (Accession XM_085302). Accordingly, utilities of VGAM2151 include diagnosis, prevention and treatment of diseases and clinical conditions associated with LOC146057. LOC146439 (Accession XM_085463) is another VGAM2151 host target gene. LOC146439 BINDING SITE is HOST TARGET binding site found in the 5' untranslated region of mRNA encoded by LOC146439, corresponding to a HOST TARGET binding site such as BINDING SITE I, BINDING SITE II or BINDING SITE III. Table 2 illustrates the complementarity of the nucleotide sequences of LOC146439 BINDING SITE, designated SEQ ID:38151, to the nucleotide sequence of VGAM2151 RNA, herein designated VGAM RNA, also designated SEQ ID:4862.

Another function of VGAM2151 is therefore inhibition of LOC146439 (Accession XM_085463). Accordingly, utilities of VGAM2151 include diagnosis, prevention and treatment of diseases and clinical conditions associated with LOC146439. LOC147895 (Accession XM_097339) is another VGAM2151 host target gene. LOC147895 BINDING SITE is HOST TARGET binding site found in the 5' untranslated region of mRNA encoded by LOC147895, corresponding to a HOST TARGET binding site such as BIND- ING SITE I, BINDING SITE II or BINDING SITE III. Table 2 illustrates the complementarity of the nucleotide sequences of LOC147895 BINDING SITE, designated SEQ ID:40861, to the nucleotide sequence of VGAM2151 RNA, herein designated VGAM RNA, also designated SEQ ID:4862.

Another function of VGAM2151 is therefore inhibition of LOC147895 (Accession XM_097339). Accordingly, utilities of VGAM2151 include diagnosis, prevention and treatment of diseases and clinical conditions associated with LOC147895. LOC150113 (Accession XM_104532) is another VGAM2151 host target gene. LOC150113 BINDING SITE is HOST TARGET binding site found in the 5' untranslated region of mRNA encoded by LOC150113, corresponding to a HOST TARGET binding site such as BINDING SITE I, BINDING SITE II or BINDING SITE III. Table 2 illustrates the complementarity of the nucleotide sequences of LOC150113 BINDING SITE, designated SEQ ID:42168, to the nucleotide sequence of VGAM2151 RNA, herein designated VGAM RNA, also designated SEQ ID:4862.

Another function of VGAM2151 is therefore inhibition of LOC150113 (Accession XM_104532). Accordingly, utilities of VGAM2151 include diagnosis, prevention and treatment of diseases and clinical conditions associated with LOC150113. LOC151610 (Accession XM_087245) is another VGAM2151 host target gene. LOC151610 BINDING SITE is HOST TARGET binding site found in the 3' untranslated region of mRNA encoded by LOC151610, corresponding to a HOST TARGET binding site such as BINDING SITE I, BINDING SITE II or BINDING SITE III. Table 2 illustrates the complementarity of the nucleotide sequences of LOC151610 BINDING SITE, designated SEQ ID:39136, to the nucleotide sequence of VGAM2151 RNA, herein designated VGAM RNA, also designated SEQ ID:4862.

Another function of VGAM2151 is therefore inhibition of LOC151610 (Accession XM_087245). Accordingly, utilities of VGAM2151 include diagnosis, prevention and treatment of diseases and clinical conditions associated with LOC151610. LOC152059 (Accession XM_087372) is another VGAM2151 host target gene. LOC152059 BINDING SITE is HOST TARGET binding site found in the 5' untranslated region of mRNA encoded by LOC152059, corresponding to a HOST TARGET binding site such as BINDING SITE I, BINDING SITE II or BINDING SITE III. Table 2 illustrates the complementarity of the nucleotide sequences of LOC152059 BINDING SITE, designated SEQ ID:39208, to the nucleotide sequence of VGAM2151 RNA, herein designated VGAM RNA, also designated SEQ ID:4862.

Another function of VGAM2151 is therefore inhibition of LOC152059 (Accession XM_087372). Accordingly, utilities of VGAM2151 include diagnosis, prevention and treatment of diseases and clinical conditions associated with LOC152059. LOC158654 (Accession XM_088632) is another VGAM2151 host target gene. LOC158654 BINDING SITE is HOST TARGET binding site found in the 3' untranslated region of mRNA encoded by LOC158654, corresponding to a HOST TARGET binding site such as BINDING SITE I, BINDING SITE II or BINDING SITE III. Table 2 illustrates the complementarity of the nucleotide sequences of LOC158654 BINDING SITE, designated SEQ ID:39878, to the nucleotide sequence of VGAM2151 RNA, herein designated VGAM RNA, also designated SEQ ID:4862.

Another function of VGAM2151 is therefore inhibition of LOC158654 (Accession XM_088632). Accordingly, utilities of VGAM2151 include diagnosis, prevention and treatment of diseases and clinical conditions associated with LOC158654. LOC162022 (Accession XM_091293) is another VGAM2151 host target gene. LOC162022 BINDING SITE is HOST TARGET binding site found in the 5' untranslated region of mRNA encoded by LOC162022, corresponding to a HOST TARGET binding site such as BINDING SITE I, BINDING SITE II or BINDING SITE III. Table 2 illustrates the complementarity of the nucleotide sequences of LOC162022 BINDING SITE, designated SEQ ID:40044, to the nucleotide sequence of VGAM2151 RNA, herein designated VGAM RNA, also designated SEQ ID:4862.

Another function of VGAM2151 is therefore inhibition of LOC162022 (Accession XM_091293). Accordingly, utilities of VGAM2151 include diagnosis, prevention and treatment of diseases and clinical conditions associated with LOC162022. LOC199796 (Accession XM_058994) is another VGAM2151 host target gene. LOC199796 BINDING SITE is HOST TARGET binding site found in the 5' untranslated region of mRNA encoded by LOC199796, corresponding to a HOST TARGET binding site such as BINDING SITE I, BINDING SITE II or BINDING SITE III. Table 2 illustrates the complementarity of the nucleotide sequences of LOC199796 BINDING SITE, designated SEQ ID:36813, to the nucleotide sequence of VGAM2151 RNA, herein designated VGAM RNA, also designated SEQ ID:4862.

Another function of VGAM2151 is therefore inhibition of LOC199796 (Accession XM_058994). Accordingly, utilities of VGAM2151 include diagnosis, prevention and treatment of diseases and clinical conditions associated with LOC199796. LOC203069 (Accession XM_114618) is another VGAM2151 host target gene. LOC203069 BINDING SITE is HOST TARGET binding site found in the 5' untranslated region of mRNA encoded by LOC203069, corresponding to a HOST TARGET binding site such as BINDING SITE I, BINDING SITE II or BINDING SITE III. Table 2 illustrates the complementarity of the nucleotide sequences of LOC203069 BINDING SITE, designated SEQ ID:43001, to the nucleotide sequence of VGAM2151 RNA, herein designated VGAM RNA, also designated SEQ ID:4862.

Another function of VGAM2151 is therefore inhibition of LOC203069 (Accession XM_114618). Accordingly, utilities of VGAM2151 include diagnosis, prevention and treatment of diseases and clinical conditions associated with LOC203069. LOC221583 (Accession XM_166396) is another VGAM2151 host target gene. LOC221583 BINDING SITE is HOST TARGET binding site found in the 5' untranslated region of mRNA encoded by LOC221583, corresponding to a HOST TARGET binding site such as BINDING SITE I, BINDING SITE II or BINDING SITE III. Table 2 illustrates the complementarity of the nucleotide sequences of LOC221583 BINDING SITE, designated SEQ ID:44247, to the nucleotide sequence of VGAM2151 RNA, herein designated VGAM RNA, also designated SEQ ID:4862.

Another function of VGAM2151 is therefore inhibition of LOC221583 (Accession XM_166396). Accordingly, utilities of VGAM2151 include diagnosis, prevention and treatment of diseases and clinical conditions associated with LOC221583. LOC254181 (Accession XM_174526) is another VGAM2151 host target gene. LOC254181 BINDING SITE is HOST TARGET binding site found in the 5' untranslated region of mRNA encoded by LOC254181, corresponding to a HOST TARGET binding site such as BINDING SITE I, BINDING SITE II or BINDING SITE III. Table 2 illustrates the complementarity of the nucleotide sequences of LOC254181 BINDING SITE, designated SEQ ID:46598, to the nucleotide sequence of VGAM2151 RNA, herein designated VGAM RNA, also designated SEQ ID:4862.

Another function of VGAM2151 is therefore inhibition of LOC254181 (Accession XM_174526). Accordingly, utilities of VGAM2151 include diagnosis, prevention and treatment of diseases and clinical conditions associated with LOC254181. LOC256586 (Accession XM_170759) is another VGAM2151 host target gene. LOC256586 BINDING SITE is HOST TARGET binding site found in the 5' untranslated region of mRNA encoded by LOC256586, corresponding to a HOST TARGET binding site such as BINDING SITE I, BINDING SITE II or BINDING SITE III. Table 2 illustrates the complementarity of the nucleotide sequences of LOC256586 BINDING SITE, designated SEQ ID:45514, to the nucleotide sequence of VGAM2151 RNA, herein designated VGAM RNA, also designated SEQ ID:4862.

Another function of VGAM2151 is therefore inhibition of LOC256586 (Accession XM_170759). Accordingly, utilities of VGAM2151 include diagnosis, prevention and treatment of diseases and clinical conditions associated with LOC256586. LOC257438 (Accession XM_168338) is another VGAM2151 host target gene. LOC257438 BINDING SITE is HOST TARGET binding site found in the 3' untranslated region of mRNA encoded by LOC257438, corresponding to a HOST TARGET binding site such as BINDING SITE I, BINDING SITE II or BINDING SITE III. Table 2 illustrates the complementarity of the nucleotide sequences of LOC257438 BINDING SITE, designated SEQ ID:45108, to the nucleotide sequence of VGAM2151 RNA, herein designated VGAM RNA, also designated SEQ ID:4862.

Another function of VGAM2151 is therefore inhibition of LOC257438 (Accession XM_168338). Accordingly, utilities of VGAM2151 include diagnosis, prevention and treatment of diseases and clinical conditions associated with LOC257438. LOC257612 (Accession XM_175270) is another VGAM2151 host target gene. LOC257612 BINDING SITE is HOST TARGET binding site found in the 5' untranslated region of mRNA encoded by LOC257612, corresponding to a HOST TARGET binding site such as BINDING SITE I, BINDING SITE II or BINDING SITE III. Table 2 illustrates the complementarity of the nucleotide sequences of LOC257612 BINDING SITE, designated SEQ ID:46742, to the nucleotide sequence of VGAM2151 RNA, herein designated VGAM RNA, also designated SEQ ID:4862.

Another function of VGAM2151 is therefore inhibition of LOC257612 (Accession XM_175270). Accordingly, utilities of VGAM2151 include diagnosis, prevention and treatment of diseases and clinical conditions associated with LOC257612. LOC51015 (Accession NM_016048) is another VGAM2151 host target gene. LOC51015 BINDING SITE is HOST TARGET binding site found in the 5' untranslated region of mRNA encoded by LOC51015, corresponding to a HOST TARGET binding site such as BINDING SITE I, BINDING SITE II or BINDING SITE III. Table 2 illustrates the complementarity of the nucleotide sequences of LOC51015 BINDING SITE, designated SEQ ID:18127, to the nucleotide sequence of VGAM2151 RNA, herein designated VGAM RNA, also designated SEQ ID:4862.

Another function of VGAM2151 is therefore inhibition of LOC51015 (Accession NM_016048). Accordingly, utilities of VGAM2151 include diagnosis, prevention and treatment of diseases and clinical conditions associated with LOC51015. LOC57107 (Accession NM_020381) is another VGAM2151 host target gene. LOC57107 BINDING SITE is HOST TARGET binding site found in the 3' untranslated region of mRNA encoded by LOC57107, corresponding to a HOST TARGET binding site such as BINDING SITE I, BINDING SITE II or BINDING SITE III. Table 2 illustrates the complementarity of the nucleotide sequences of LOC57107 BINDING SITE, designated SEQ ID:21651, to the nucleotide sequence of VGAM2151 RNA, herein designated VGAM RNA, also designated SEQ ID:4862.

Another function of VGAM2151 is therefore inhibition of LOC57107 (Accession NM_020381). Accordingly, utilities of VGAM2151 include diagnosis, prevention and treatment of diseases and clinical conditions associated with LOC57107. LOC84548 (Accession XM_048904) is another VGAM2151 host target gene. LOC84548 BINDING SITE is HOST TARGET binding site found in the 5' untranslated region of mRNA encoded by LOC84548, corresponding to a HOST TARGET binding site such as BINDING SITE I, BINDING SITE II or BINDING SITE III. Table 2 illustrates the complementarity of the nucleotide sequences of LOC84548 BINDING SITE, designated SEQ ID:35298, to the nucleotide sequence of VGAM2151 RNA, herein designated VGAM RNA, also designated SEQ ID:4862.

Another function of VGAM2151 is therefore inhibition of LOC84548 (Accession XM_048904). Accordingly, utilities of VGAM2151 include diagnosis, prevention and treatment of diseases and clinical conditions associated with LOC84548. LOC90620 (Accession XM_032986) is another VGAM2151 host target gene. LOC90620 BINDING SITE is HOST TARGET binding site found in the 5' untranslated region of mRNA encoded by LOC90620, corresponding to a HOST TARGET binding site such as BINDING SITE I, BINDING SITE II or BINDING SITE III. Table 2 illustrates the complementarity of the nucleotide sequences of LOC90620 BINDING SITE, designated SEQ ID:31804, to the nucleotide sequence of VGAM2151 RNA, herein designated VGAM RNA, also designated SEQ ID:4862.

Another function of VGAM2151 is therefore inhibition of LOC90620 (Accession XM_032986). Accordingly, utilities of VGAM2151 include diagnosis, prevention and treatment of diseases and clinical conditions associated with LOC90620. LOC90835 (Accession XM_034371) is another VGAM2151 host target gene. LOC90835 BINDING SITE is HOST TARGET binding site found in the 5' untranslated region of mRNA encoded by LOC90835, corresponding to a HOST TARGET binding site such as BINDING SITE I, BINDING SITE II or BINDING SITE III. Table 2 illustrates the complementarity of the nucleotide sequences of LOC90835 BINDING SITE, designated SEQ ID:32073, to the nucleotide sequence of VGAM2151 RNA, herein designated VGAM RNA, also designated SEQ ID:4862.

Another function of VGAM2151 is therefore inhibition of LOC90835 (Accession XM_034371). Accordingly, utilities of VGAM2151 include diagnosis, prevention and treatment of diseases and clinical conditions associated with LOC90835. LOC90874 (Accession XM_034660) is another VGAM2151 host target gene. LOC90874 BINDING SITE is HOST TARGET binding site found in the 5' untranslated region of mRNA encoded by LOC90874, corresponding to a HOST TARGET binding site such as BINDING SITE I, BINDING SITE II or BINDING SITE III. Table 2 illustrates the complementarity of the nucleotide sequences of LOC90874 BINDING SITE, designated SEQ ID:32135, to the nucleotide sequence of VGAM2151 RNA, herein designated VGAM RNA, also designated SEQ ID:4862.

Another function of VGAM2151 is therefore inhibition of LOC90874 (Accession XM_034660). Accordingly, utilities of VGAM2151 include diagnosis, prevention and treatment of diseases and clinical conditions associated with LOC90874. LOC91156 (Accession XM_036558) is another VGAM2151 host target gene. LOC91156 BINDING SITE is HOST TARGET binding site found in the 5' untranslated region of mRNA encoded by LOC91156, corresponding to a HOST TARGET binding site such as BINDING SITE I, BINDING SITE II or BINDING SITE III. Table 2 illustrates the complementarity of the nucleotide sequences of LOC91156 BINDING SITE, designated SEQ ID:32465, to the nucleotide sequence of VGAM2151 RNA, herein designated VGAM RNA, also designated SEQ ID:4862.

Another function of VGAM2151 is therefore inhibition of LOC91156 (Accession XM_036558). Accordingly, utilities of VGAM2151 include diagnosis, prevention and treatment of diseases and clinical conditions associated with LOC91156. FIG. 1 further provides a conceptual description of a novel bioinformatically detected viral gene of the present invention, referred to here as Viral Genomic Address Messenger 2152 (VGAM2152) viral gene, which modulates expression of respective host target genes thereof, the function and utility of which host target genes is known in the art.

VGAM2152 is a novel bioinformatically detected regulatory, non protein coding, viral micro RNA (miRNA) gene. The method by which VGAM2152 was detected is described hereinabove with reference to FIGS. 1-8.

VGAM2152 gene, herein designated VGAM GENE, is a viral gene contained in the genome of Rana Tigrina Ranavirus. VGAM2152 host target gene, herein designated VGAM HOST TARGET GENE, is a human gene contained in the human genome.

VGAM2152 gene encodes a VGAM2152 precursor RNA, herein designated VGAM PRECURSOR RNA. Similar to other miRNA genes, and unlike most ordinary genes, VGAM2152 precursor RNA does not encode a protein. A nucleotide sequence identical or highly similar to the nucleotide sequence of VGAM2152 precursor RNA is designated SEQ ID:2138, and is provided hereinbelow with reference to the sequence listing part. Nucleotide sequence SEQ ID:2138 is located at position 44423 relative to the genome of Rana Tigrina Ranavirus.

VGAM2152 precursor RNA folds onto itself, forming VGAM2152 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2152 folded precursor RNA into VGAM2152 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2152 RNA is designated SEQ ID:4863, and is provided hereinbelow with reference to the sequence listing part.

VGAM2152 host target gene, herein designated VGAM HOST TARGET GENE, encodes a corresponding messenger RNA, VGAM2152 host target RNA, herein designated VGAM HOST TARGET RNA. VGAM2152 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2152 RNA, herein designated VGAM RNA, binds complementarily to one or more host target binding sites located in untranslated regions of VGAM2152 host target RNA, herein designated VGAM HOST TARGET RNA. This complementary binding is due to the fact that the nucleotide sequence of VGAM2152 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2152 RNA, herein designated VGAM RNA, may have a different number of host target binding sites in untranslated regions of a VGAM2152 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2152 RNA, herein designated VGAM RNA, to host target binding sites on VGAM2152 host target RNA, herein designated VGAM HOST TARGET RNA, such as BINDING SITE I, BINDING SITE II and BINDING SITE III, inhibits translation of VGAM2152 host target RNA into VGAM2152 host target protein, herein designated VGAM HOST TARGET PROTEIN. VGAM host target protein is therefore outlined by a broken line.

It is appreciated that VGAM2152 host target gene, herein designated VGAM HOST TARGET GENE, in fact represents a plurality of VGAM2152 host target genes. The mRNA of each one of this plurality of VGAM2152 host target genes comprises one or more host target binding sites, each having a nucleotide sequence which is at least partly complementary to VGAM2152 RNA, herein designated VGAM RNA, and which when bound by VGAM2152 RNA causes inhibition of translation of respective one or more VGAM2152 host target proteins.

It is further appreciated by one skilled in the art that the mode of translational inhibition illustrated by FIG. 1 with specific reference to translational inhibition exerted by VGAM2152 gene, herein designated VGAM GENE, on one or more VGAM2152 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2152 is inhibition of expression of host target genes, as part of a novel viral mechanism of attacking a host. Accordingly, utilities of VGAM2152 include diagnosis, prevention and treatment of viral infection by Rana Tigrina Ranavirus. Specific functions, and accordingly utilities, of VGAM2152 correlate with, and may be deduced from, the identity of the host target genes which VGAM2152 binds and inhibits, and the function of these host target genes, as elaborated hereinbelow.

Nucleotide sequences of the VGAM2152 precursor RNA, herein designated VGAM PRECURSOR RNA, and of the 'diced' VGAM2152 RNA, herein designated VGAM RNA, and a schematic representation of the secondary folding of VGAM2152 folded precursor RNA, herein designated VGAM FOLDED PRECURSOR RNA, of VGAM2152 are further described hereinbelow with reference to Table 1.

Nucleotide sequences of host target binding sites, such as BINDING SITE-I, BINDING SITE-II and BINDING SITE- III of FIG. 1, found on VGAM2152 host target RNA, and schematic representation of the complementarity of each of these host target binding sites to VGAM2152 RNA, herein designated VGAM RNA, are described hereinbelow with reference to Table 2.

As mentioned hereinabove with reference to FIG. 1, a function of VGAM2152 gene, herein designated VGAM is inhibition of expression of VGAM2152 target genes. It is appreciated that specific functions, and accordingly utilities, of VGAM2152 correlate with, and may be deduced from, the identity of the target genes which VGAM2152 binds and inhibits, and the function of these target genes, as elaborated hereinbelow.

FLJ10748 (Accession NM_018203) is a VGAM2152 host target gene. FLJ10748 BINDING SITE is HOST TARGET binding site found in the 5' untranslated region of mRNA encoded by FLJ10748, corresponding to a HOST TARGET binding site such as BINDING SITE I, BINDING SITE II or BINDING SITE III. Table 2 illustrates the complementarity of the nucleotide sequences of FLJ10748 BINDING SITE, designated SEQ ID:20087, to the nucleotide sequence of VGAM2152 RNA, herein designated VGAM RNA, also designated SEQ ID:4863.

A function of VGAM2152 is therefore inhibition of FLJ10748 (Accession NM_018203). Accordingly, utilities of VGAM2152 include diagnosis, prevention and treatment of diseases and clinical conditions associated with FLJ10748. LOC112937 (Accession XM_166199) is another VGAM2152 host target gene. LOC112937 BINDING SITE is HOST TARGET binding site found in the 5' untranslated region of mRNA encoded by LOC112937, corresponding to a HOST TARGET binding site such as BINDING SITE I, BINDING SITE II or BINDING SITE III. Table 2 illustrates the complementarity of the nucleotide sequences of LOC112937 BINDING SITE, designated SEQ ID:44006, to the nucleotide sequence of VGAM2152 RNA, herein designated VGAM RNA, also designated SEQ ID:4863.

Another function of VGAM2152 is therefore inhibition of LOC112937 (Accession XM_166199). Accordingly, utilities of VGAM2152 include diagnosis, prevention and treatment of diseases and clinical conditions associated with LOC112937. LOC158301 (Accession XM_088543) is another VGAM2152 host target gene. LOC158301 BINDING SITE is HOST TARGET binding site found in the 3' untranslated region of mRNA encoded by LOC158301, corresponding to a HOST TARGET binding site such as BINDING SITE I, BINDING SITE II or BINDING SITE III. Table 2 illustrates the complementarity of the nucleotide sequences of LOC158301 BINDING SITE, designated SEQ ID:39811, to the nucleotide sequence of VGAM2152 RNA, herein designated VGAM RNA, also designated SEQ ID:4863.

Another function of VGAM2152 is therefore inhibition of LOC158301 (Accession XM_088543). Accordingly, utilities of VGAM2152 include diagnosis, prevention and treatment of diseases and clinical conditions associated with LOC158301. FIG. 1 further provides a conceptual description of a novel bioinformatically detected viral gene of the present invention, referred to here as Viral Genomic Address Messenger 2153 (VGAM2153) viral gene, which modulates expression of respective host target genes thereof, the function and utility of which host target genes is known in the art.

VGAM2153 is a novel bioinformatically detected regulatory, non protein coding, viral micro RNA (miRNA) gene. The method by which VGAM2153 was detected is described hereinabove with reference to FIGS. 1-8.

VGAM2153 gene, herein designated VGAM GENE, is a viral gene contained in the genome of Rana Tigrina Ranavirus. VGAM2153 host target gene, herein designated VGAM HOST TARGET GENE, is a human gene contained in the human genome.

VGAM2153 gene encodes a VGAM2153 precursor RNA, herein designated VGAM PRECURSOR RNA. Similar to other miRNA genes, and unlike most ordinary genes, VGAM2153 precursor RNA does not encode a protein. A nucleotide sequence identical or highly similar to the nucleotide sequence of VGAM2153 precursor RNA is designated SEQ ID:2139, and is provided hereinbelow with reference to the sequence listing part. Nucleotide sequence SEQ ID:2139 is located at position 59440 relative to the genome of Rana Tigrina Ranavirus.

VGAM2153 precursor RNA folds onto itself, forming VGAM2153 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2153 folded precursor RNA into VGAM2153 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2153 RNA is designated SEQ ID:4864, and is provided hereinbelow with reference to the sequence listing part.

VGAM2153 host target gene, herein designated VGAM HOST TARGET GENE, encodes a corresponding messenger RNA, VGAM2153 host target RNA, herein designated VGAM HOST TARGET RNA. VGAM2153 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2153 RNA, herein designated VGAM RNA, binds complementarily to one or more host target binding sites located in untranslated regions of VGAM2153 host target RNA, herein designated VGAM HOST TARGET RNA. This complementary binding is due to the fact that the nucleotide sequence of VGAM2153 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2153 RNA, herein designated VGAM RNA, may have a different number of host target binding sites in untranslated regions of a VGAM2153 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2153 RNA, herein designated VGAM RNA, to host target binding sites on VGAM2153 host target RNA, herein designated VGAM HOST TARGET RNA, such as BINDING SITE I, BINDING SITE II and BINDING SITE III, inhibits translation of VGAM2153 host target RNA into VGAM2153 host target protein, herein designated VGAM HOST TARGET PROTEIN. VGAM host target protein is therefore outlined by a broken line.

It is appreciated that VGAM2153 host target gene, herein designated VGAM HOST TARGET GENE, in fact represents a plurality of VGAM2153 host target genes. The mRNA of each one of this plurality of VGAM2153 host target genes comprises one or more host target binding sites, each having a nucleotide sequence which is at least partly complementary to VGAM2153 RNA, herein designated VGAM RNA, and which when bound by VGAM2153 RNA causes inhibition of translation of respective one or more VGAM2153 host target proteins.

It is further appreciated by one skilled in the art that the mode of translational inhibition illustrated by FIG. 1 with specific reference to translational inhibition exerted by VGAM2153 gene, herein designated VGAM GENE, on one or more VGAM2153 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2153 is inhibition of expression of host target genes, as part of a novel viral mechanism of attacking a host. Accordingly, utilities of VGAM2153 include diagnosis, prevention and treatment of viral infection by Rana Tigrina Ranavirus. Specific functions, and accordingly utilities, of VGAM2153 correlate with, and may be deduced from, the identity of the host target genes which VGAM2153 binds and inhibits, and the function of these host target genes, as elaborated hereinbelow.

Nucleotide sequences of the VGAM2153 precursor RNA, herein designated VGAM PRECURSOR RNA, and of the 'diced' VGAM2153 RNA, herein designated VGAM RNA, and a schematic representation of the secondary folding of VGAM2153 folded precursor RNA, herein designated VGAM FOLDED PRECURSOR RNA, of VGAM2153 are further described hereinbelow with reference to Table 1.

Nucleotide sequences of host target binding sites, such as BINDING SITE-I, BINDING SITE-II and BINDING SITE-III of FIG. 1, found on VGAM2153 host target RNA, and schematic representation of the complementarity of each of these host target binding sites to VGAM2153 RNA, herein designated VGAM RNA, are described hereinbelow with reference to Table 2.

As mentioned hereinabove with reference to FIG. 1, a function of VGAM2153 gene, herein designated VGAM is inhibition of expression of VGAM2153 target genes. It is appreciated that specific functions, and accordingly utilities, of VGAM2153 correlate with, and may be deduced from, the identity of the target genes which VGAM2153 binds and inhibits, and the function of these target genes, as elaborated hereinbelow.

Core-binding Factor, Runt Domain, Alpha Subunit 2; Translocated To, 3 (CBFA2T3, Accession NM_005187) is a VGAM2153 host target gene. CBFA2T3 BINDING SITE is HOST TARGET binding site found in the 3' untranslated region of mRNA encoded by CBFA2T3, corresponding to a HOST TARGET binding site such as BINDING SITE I, BINDING SITE II or BINDING SITE III. Table 2 illustrates the complementarity of the nucleotide sequences of CBFA2T3 BINDING SITE, designated SEQ ID:11692, to the nucleotide sequence of VGAM2153 RNA, herein designated VGAM RNA, also designated SEQ ID:4864.

A function of VGAM2153 is therefore inhibition of Core-binding Factor, Runt Domain, Alpha Subunit 2; Translocated To, 3 (CBFA2T3, Accession NM_005187). Accordingly, utilities of VGAM2153 include diagnosis, prevention and treatment of diseases and clinical conditions associated with CBFA2T3. Cytoplasmic Linker Associated Protein 1 (CLASP1, Accession XM_037105) is another VGAM2153 host target gene. CLASP1 BINDING SITE is HOST TARGET binding site found in the 5' untranslated region of mRNA encoded by CLASP1, corresponding to a HOST TARGET binding site such as BINDING SITE I, BINDING SITE II or BINDING SITE III. Table 2 illustrates the complementarity of the nucleotide sequences of CLASP1 BINDING SITE, designated SEQ ID:32540, to the nucleotide sequence of VGAM2153 RNA, herein designated VGAM RNA, also designated SEQ ID:4864.

Another function of VGAM2153 is therefore inhibition of Cytoplasmic Linker Associated Protein 1 (CLASP1, Accession XM_037105), a gene which plays a role in the local regulation of microtubule dynamics. Accordingly, utilities of VGAM2153 include diagnosis, prevention and treatment of diseases and clinical conditions associated with CLASP1. The function of CLASP1 and its association with various diseases and clinical conditions, has been established by previous studies, as described hereinabove with reference to VGAM298. Interleukin 13 Receptor, Alpha 1 (IL13RA1, Accession NM_001560) is another VGAM2153 host target gene. IL13RA1 BINDING SITE is HOST TARGET binding site found in the 3' untranslated region of mRNA encoded by IL13RA1, corresponding to a HOST TARGET binding site such as BINDING SITE I, BINDING SITE II or BINDING SITE III. Table 2 illustrates the complementarity of the nucleotide sequences of IL13RA1 BINDING SITE, designated SEQ ID:7284, to the nucleotide sequence of VGAM2153 RNA, herein designated VGAM RNA, also designated SEQ ID:4864.

Another function of VGAM2153 is therefore inhibition of Interleukin 13 Receptor, Alpha 1 (IL13RA1, Accession NM_001560), a gene which binds il-13 with a low affinity. together with il-4r- alpha can form a functional receptor for il-13. Accordingly, utilities of VGAM2153 include diagnosis, prevention and treatment of diseases and clinical conditions associated with IL13RA1. The function of IL13RA1 and its association with various diseases and clinical conditions, has been established by previous studies, as described hereinabove with reference to VGAM144. Inositol 1,4,5-triphosphate Receptor, Type 1 (ITPR1, Accession NM_002222) is another VGAM2153 host target gene. ITPR1 BINDING SITE is HOST TARGET binding site found in the 3' untranslated region of mRNA encoded by ITPR1, corresponding to a HOST TARGET binding site such as BINDING SITE I, BINDING SITE II or BINDING SITE III. Table 2 illustrates the complementarity of the nucleotide sequences of ITPR1 BINDING SITE, designated SEQ ID:7984, to the nucleotide sequence of VGAM2153 RNA, herein designated VGAM RNA, also designated SEQ ID:4864.

Another function of VGAM2153 is therefore inhibition of Inositol 1,4,5-triphosphate Receptor, Type 1 (ITPR1, Accession NM_002222), a gene which couples cell membrane receptors to Ca2+ signal transduction pathways. Accordingly, utilities of VGAM2153 include diagnosis, prevention and treatment of diseases and clinical conditions associated with ITPR1. The function of ITPR1 and its association with various diseases and clinical conditions, has been established by previous studies, as described hereinabove with reference to VGAM106. Nijmegen Breakage Syndrome 1 (nibrin) (NBS1, Accession XM_045343) is another VGAM2153 host target gene. NBS1 BINDING SITE is HOST TARGET binding site found in the 3' untranslated region of mRNA encoded by NBS1, corresponding to a HOST TARGET binding site such as BINDING SITE I, BINDING SITE II or BINDING SITE III. Table 2 illustrates the complementarity of the nucleotide sequences of NBS1 BINDING SITE, designated SEQ ID:34435, to the nucleotide sequence of VGAM2153 RNA, herein designated VGAM RNA, also designated SEQ ID:4864.

Another function of VGAM2153 is therefore inhibition of Nijmegen Breakage Syndrome 1 (nibrin) (NBS1, Accession XM_045343), a gene which may be involved in repair of DNA double-strand breaks. Accordingly, utilities of VGAM2153 include diagnosis, prevention and treatment of diseases and clinical conditions associated with NBS1. The function of NBS1 and its association with various diseases and clinical conditions, has been established by previous studies, as described hereinabove with reference to VGAM450. NDRG Family Member 3 (NDRG3, Accession NM_032013) is another VGAM2153 host target gene. NDRG3 BINDING SITE is HOST TARGET binding site found in the 3' untranslated region of mRNA encoded by NDRG3, corresponding to a HOST TARGET binding site such as BINDING SITE I, BINDING SITE II or BINDING SITE III. Table 2 illustrates the complementarity of the nucleotide sequences of NDRG3 BINDING SITE, designated SEQ ID:25725, to the nucleotide sequence of VGAM2153 RNA, herein designated VGAM RNA, also designated SEQ ID:4864.

Another function of VGAM2153 is therefore inhibition of NDRG Family Member 3 (NDRG3, Accession NM_032013). Accordingly, utilities of VGAM2153 include diagnosis, prevention and treatment of diseases and clinical conditions associated with NDRG3. Nuclear Receptor Subfamily 2, Group E, Member 3 (NR2E3, Accession NM_016346) is another VGAM2153 host target gene. NR2E3 BINDING SITE is HOST TARGET binding site found in the 3' untranslated region of mRNA encoded by NR2E3, corresponding to a HOST TARGET binding site such as BINDING SITE I, BINDING SITE II or BINDING SITE III. Table 2 illustrates the complementarity of the nucleotide sequences of NR2E3 BINDING SITE, designated SEQ ID:18471, to the nucleotide sequence of VGAM2153 RNA, herein designated VGAM RNA, also designated SEQ ID:4864.

Another function of VGAM2153 is therefore inhibition of Nuclear Receptor Subfamily 2, Group E, Member 3 (NR2E3, Accession NM_016346). Accordingly, utilities of VGAM2153 include diagnosis, prevention and treatment of diseases and clinical conditions associated with NR2E3. RIG (Accession NM_006394) is another VGAM2153 host target gene. RIG BINDING SITE is HOST TARGET binding site found in the 3' untranslated region of mRNA encoded by RIG, corresponding to a HOST TARGET binding site such as BINDING SITE I, BINDING SITE II or BINDING SITE III. Table 2 illustrates the complementarity of the nucleotide sequences of RIG BINDING SITE, designated SEQ ID:13103, to the nucleotide sequence of VGAM2153 RNA, herein designated VGAM RNA, also designated SEQ ID:4864.

Another function of VGAM2153 is therefore inhibition of RIG (Accession NM_006394), a gene which is ribosomal protein S15. Accordingly, utilities of VGAM2153 include diagnosis, prevention and treatment of diseases and clinical conditions associated with RIG. The function of RIG and its association with various diseases and clinical conditions, has been established by previous studies, as described hereinabove with reference to VGAM206. Solute Carrier Family 22 (extraneuronal monoamine transporter), Member 3 (SLC22A3, Accession NM_021977) is another VGAM2153 host target gene. SLC22A3 BINDING SITE is HOST TARGET binding site found in the 3' untranslated region of mRNA encoded by SLC22A3, corresponding to a HOST TARGET binding site such as BINDING SITE I, BINDING SITE II or BINDING SITE III. Table 2 illustrates the complementarity of the nucleotide sequences of SLC22A3 BINDING SITE, designated SEQ ID:22507, to the nucleotide sequence of VGAM2153 RNA, herein designated VGAM RNA, also designated SEQ ID:4864.

Another function of VGAM2153 is therefore inhibition of Solute Carrier Family 22 (extraneuronal monoamine transporter), Member 3 (SLC22A3, Accession NM_021977), a gene which is a sodium-ion dependent, high affinity carnitine transporter. also transports organic cations without the involvement of sodium. involved in the active cellular uptake of carnitine. Accordingly, utilities of VGAM2153 include diagnosis, prevention and treatment of diseases and clinical conditions associated with SLC22A3. The function of SLC22A3 and its association with various diseases and clinical conditions, has been established by previous studies, as described hereinabove with reference to VGAM2147. WIG1 (Accession XM_170497) is another VGAM2153 host target gene. WIG1 BINDING SITE is HOST TARGET binding site found in the 5' untranslated region of mRNA encoded by WIG1, corresponding to a HOST TARGET binding site such as BINDING SITE I, BINDING SITE II or BINDING SITE III. Table 2 illustrates the complementarity of the nucleotide sequences of WIG1 BINDING SITE, designated SEQ ID:45336, to the nucleotide sequence of VGAM2153 RNA, herein designated VGAM RNA, also designated SEQ ID:4864.

Another function of VGAM2153 is therefore inhibition of WIG1 (Accession XM_170497), a gene which is a sensor of cellular stress conditions including oncogenic activation, DNA damage and hypoxia. Accordingly, utilities of VGAM2153 include diagnosis, prevention and treatment of diseases and clinical conditions associated with WIG1. The function of WIG1 has been established by previous studies. 1. Hellborg, F.; Qian, W.; Mendez-Vidal, C.; Asker, C.; Kost-Alimova, M.; Wilhelm, M.; Imreh, S.; Wiman, K. G.: Human wig-1, a p53 target gene that encodes a growth inhibitory zinc finger protein. Oncogene 20:5466-5474, 2001. PubMed ID:11571644 2. Varmeh-Ziaie, S.; Okan, I.; Wang, Y.; Magnusson, K. P.; Warthoe, P.; Strauss, M.; Wiman, K. G.: Wig-1, a new p53-induced gene encoding a zinc finger protein. Oncogene 15:2699-2704, 1997. PubMed ID:9400996

Full details of the abovementioned studies are described in the following publications, the disclosure of which are hereby incorporated by reference:

Hellborg, F.; Qian, W.; Mendez-Vidal, C.; Asker, C.; Kost-Alimova, M.; Wilhelm, M.; Imreh, S.; Wiman, K. G.: Human wig-1, a p53 target gene that encodes a growth inhibitory zinc finger protein. Oncogene 20:5466-5474, 2001; and Varmeh-Ziaie, S.; Okan, I.; Wang, Y.; Magnusson, K. P.; Warthoe, P.; Strauss, M.; Wiman, K. G.: Wig-1, a new p53-induced gene encoding a zinc finger protein. Oncogene 15:2699-2704, 1.

Further studies establishing the function and utilities of WIG1 are found in John Hopkins OMIM database record ID 606452, and in sited publications numbered 6272-6273 listed in the bibliography section hereinbelow, which are also hereby incorporated by reference. Zinc Finger Protein 202 (ZNF202, Accession NM_003455) is another VGAM2153 host target gene. ZNF202 BINDING SITE is HOST TARGET binding site found in the 3' untranslated region of mRNA encoded by ZNF202, corresponding to a HOST TARGET binding site such as BINDING SITE I, BINDING SITE II or BINDING SITE III. Table 2 illustrates the complementarity of the nucleotide sequences of ZNF202 BINDING SITE, designated SEQ ID:9509, to the nucleotide sequence of VGAM2153 RNA, herein designated VGAM RNA, also designated SEQ ID:4864.

Another function of VGAM2153 is therefore inhibition of Zinc Finger Protein 202 (ZNF202, Accession NM_003455). Accordingly, utilities of VGAM2153 include diagnosis, prevention and treatment of diseases and clinical conditions associated with ZNF202. Chromosome 9 Open Reading Frame 5 (C9orf5, Accession NM_032012) is another VGAM2153 host target gene. C9orf5 BINDING SITE is HOST TARGET binding site found in the 3' untranslated region of mRNA encoded by C9orf5, corresponding to a HOST TARGET binding site such as BINDING SITE I, BINDING SITE II or BINDING SITE III. Table 2 illustrates the complementarity of the nucleotide sequences of C9orf5 BINDING SITE, designated SEQ ID:25715, to the nucleotide sequence of VGAM2153 RNA, herein designated VGAM RNA, also designated SEQ ID:4864.

Another function of VGAM2153 is therefore inhibition of Chromosome 9 Open Reading Frame 5 (C9orf5, Accession NM_032012). Accordingly, utilities of VGAM2153 include diagnosis, prevention and treatment of diseases and clinical conditions associated with C9orf5. Chondrolectin (CHODL, Accession NM_024944) is another VGAM2153 host target gene. CHODL BINDING SITE is HOST TARGET binding site found in the 3" untranslated region of mRNA encoded by CHODL, corresponding to a HOST TARGET binding site such as BINDING SITE I, BINDING SITE II or BINDING SITE III. Table 2 illustrates the complementarity of the nucleotide sequences of CHODL BINDING SITE, designated SEQ ID:24490, to the nucleotide sequence of VGAM2153 RNA, herein designated VGAM RNA, also designated SEQ ID:4864.

Another function of VGAM2153 is therefore inhibition of Chondrolectin (CHODL, Accession NM_024944). Accordingly, utilities of VGAM2153 include diagnosis, prevention and treatment of diseases and clinical conditions associated with CHODL. CPR2 (Accession NM_030900) is another VGAM2153 host target gene. CPR2 BINDING SITE is HOST TARGET binding site found in the 3' untranslated region of mRNA encoded by CPR2, corresponding to a HOST TARGET binding site such as BINDING SITE I, BINDING SITE II or BINDING SITE III. Table 2 illustrates the complementarity of the nucleotide sequences of CPR2 BINDING SITE, designated SEQ ID:25173, to the nucleotide sequence of VGAM2153 RNA, herein designated VGAM RNA, also designated SEQ ID:4864.

Another function of VGAM2153 is therefore inhibition of CPR2 (Accession NM_030900). Accordingly, utilities of VGAM2153 include diagnosis, prevention and treatment of diseases and clinical conditions associated with CPR2. DKFZP586M1120 (Accession NM_031294) is another VGAM2153 host target gene. DKFZP586M1120 BINDING SITE is HOST TARGET binding site found in the 3' untranslated region of mRNA encoded by DKFZP586M1120, corresponding to a HOST TARGET binding site such as BINDING SITE I, BINDING SITE II or BINDING SITE III. Table 2 illustrates the complementarity of the nucleotide sequences of DKFZP586M1120 BINDING SITE, designated SEQ ID:25323, to the nucleotide sequence of VGAM2153 RNA, herein designated VGAM RNA, also designated SEQ ID:4864.

Another function of VGAM2153 is therefore inhibition of DKFZP586M1120 (Accession NM_031294). Accordingly, utilities of VGAM2153 include diagnosis, prevention and treatment of diseases and clinical conditions associated with DKFZP586M1120. DKFZp761K1423 (Accession NM_018422) is another VGAM2153 host target gene. DKFZp761K1423 BINDING SITE is HOST TARGET binding site found in the 5' untranslated region of mRNA encoded by DKFZp761K1423, corresponding to a HOST TARGET binding site such as BINDING SITE I, BINDING SITE II or BINDING SITE III. Table 2 illustrates the complementarity of the nucleotide sequences of DKFZp761K1423 BINDING SITE, designated SEQ ID:20470, to the nucleotide sequence of VGAM2153 RNA, herein designated VGAM RNA, also designated SEQ ID:4864.

Another function of VGAM2153 is therefore inhibition of DKFZp761K1423 (Accession NM_018422). Accordingly, utilities of VGAM2153 include diagnosis, prevention and treatment of diseases and clinical conditions associated with DKFZp761K1423. DKFZp762E1312 (Accession NM_018410) is another VGAM2153 host target gene. DKFZp762E1312 BINDING SITE is HOST TARGET binding site found in the 5' untranslated region of mRNA encoded by DKFZp762E1312, corresponding to a HOST TARGET binding site such as BINDING SITE I, BINDING SITE II or BINDING SITE III. Table 2 illustrates the complementarity of the nucleotide sequences of DKFZp762E1312 BINDING SITE, designated SEQ ID:20451, to the nucleotide sequence of VGAM2153 RNA, herein designated VGAM RNA, also designated SEQ ID:4864.

Another function of VGAM2153 is therefore inhibition of DKFZp762E1312 (Accession NM_018410). Accordingly, utilities of VGAM2153 include diagnosis, prevention and treatment of diseases and clinical conditions associated with DKFZp762E1312. EZF-2 (Accession NM_018337) is another VGAM2153 host target gene. EZF-2 BINDING SITE is HOST TARGET binding site found in the 3' untranslated region of mRNA encoded by EZF-2, corresponding to a HOST TARGET binding site such as BINDING SITE I, BINDING SITE II or BINDING SITE III. Table 2 illustrates the complementarity of the nucleotide sequences of EZF-2 BINDING SITE, designated SEQ ID:20341, to the nucleotide sequence of VGAM2153 RNA, herein designated VGAM RNA, also designated SEQ ID:4864.

Another function of VGAM2153 is therefore inhibition of EZF-2 (Accession NM_018337). Accordingly, utilities of VGAM2153 include diagnosis, prevention and treatment of diseases and clinical conditions associated with EZF-2. FLJ10520 (Accession NM_018124) is another VGAM2153 host target gene. FLJ10520 BINDING SITE is HOST TARGET binding site found in the 5' untranslated region of mRNA encoded by FLJ10520, corresponding to a HOST TARGET binding site such as BINDING SITE I, BINDING SITE II or BINDING SITE III. Table 2 illustrates the complementarity of the nucleotide sequences of FLJ10520 BINDING SITE, designated SEQ ID:19906, to the nucleotide sequence of VGAM2153 RNA, herein designated VGAM RNA, also designated SEQ ID:4864.

Another function of VGAM2153 is therefore inhibition of FLJ10520 (Accession NM_018124). Accordingly, utilities of VGAM2153 include diagnosis, prevention and treatment of diseases and clinical conditions associated with FLJ10520.

FLJ13110 (Accession NM_022912) is another VGAM2153 host target gene. FLJ13110 BINDING SITE is HOST TARGET binding site found in the 3' untranslated region of mRNA encoded by FLJ13110, corresponding to a HOST TARGET binding site such as BINDING SITE I, BINDING SITE II or BINDING SITE III. Table 2 illustrates the complementarity of the nucleotide sequences of FLJ13110 BINDING SITE, designated SEQ ID:23222, to the nucleotide sequence of VGAM2153 RNA, herein designated VGAM RNA, also designated SEQ ID:4864.

Another function of VGAM2153 is therefore inhibition of FLJ13110 (Accession NM_022912). Accordingly, utilities of VGAM2153 include diagnosis, prevention and treatment of diseases and clinical conditions associated with FLJ13110. FLJ13769 (Accession NM_025012) is another VGAM2153 host target gene. FLJ13769 BINDING SITE is HOST TARGET binding site found in the 3' untranslated region of mRNA encoded by FLJ13769, corresponding to a HOST TARGET binding site such as BINDING SITE I, BINDING SITE II or BINDING SITE III. Table 2 illustrates the complementarity of the nucleotide sequences of FLJ13769 BINDING SITE, designated SEQ ID:24596, to the nucleotide sequence of VGAM2153 RNA, herein designated VGAM RNA, also designated SEQ ID:4864.

Another function of VGAM2153 is therefore inhibition of FLJ13769 (Accession NM_025012). Accordingly, utilities of VGAM2153 include diagnosis, prevention and treatment of diseases and clinical conditions associated with FLJ13769. FLJ20081 (Accession NM_017658) is another VGAM2153 host target gene. FLJ20081 BINDING SITE is HOST TARGET binding site found in the 3' untranslated region of mRNA encoded by FLJ20081, corresponding to a HOST TARGET binding site such as BINDING SITE I, BINDING SITE II or BINDING SITE III. Table 2 illustrates the complementarity of the nucleotide sequences of FLJ20081 BINDING SITE, designated SEQ ID:19182, to the nucleotide sequence of VGAM2153 RNA, herein designated VGAM RNA, also designated SEQ ID:4864.

Another function of VGAM2153 is therefore inhibition of FLJ20081 (Accession NM_017658). Accordingly, utilities of VGAM2153 include diagnosis, prevention and treatment of diseases and clinical conditions associated with FLJ20081. FLJ20139 (Accession NM_017685) is another VGAM2153 host target gene. FLJ20139 BINDING SITE is HOST TARGET binding site found in the 5' untranslated region of mRNA encoded by FLJ20139, corresponding to a HOST TARGET binding site such as BINDING SITE I, BINDING SITE II or BINDING SITE III. Table 2 illustrates the complementarity of the nucleotide sequences of FLJ20139 BINDING SITE, designated SEQ ID:19234, to the nucleotide sequence of VGAM2153 RNA, herein designated VGAM RNA, also designated SEQ ID:4864.

Another function of VGAM2153 is therefore inhibition of FLJ20139 (Accession NM_017685). Accordingly, utilities of VGAM2153 include diagnosis, prevention and treatment of diseases and clinical conditions associated with FLJ20139. FLJ20477 (Accession NM_017837) is another VGAM2153 host target gene. FLJ20477 BINDING SITE is HOST TARGET binding site found in the 5' untranslated region of mRNA encoded by FLJ20477, corresponding to a HOST TARGET binding site such as BINDING SITE I, BINDING SITE II or BINDING SITE III. Table 2 illustrates the complementarity of the nucleotide sequences of FLJ20477 BINDING SITE, designated SEQ ID:19503, to the nucleotide sequence of VGAM2153 RNA, herein designated VGAM RNA, also designated SEQ ID:4864.

Another function of VGAM2153 is therefore inhibition of FLJ20477 (Accession NM_017837). Accordingly, utilities of VGAM2153 include diagnosis, prevention and treatment of diseases and clinical conditions associated with FLJ20477. FLJ21916 (Accession NM_023112) is another VGAM2153 host target gene. FLJ21916 BINDING SITE is HOST TARGET binding site found in the 3' untranslated region of mRNA encoded by FLJ21916, corresponding to a HOST TARGET binding site such as BINDING SITE I, BINDING SITE II or BINDING SITE III. Table 2 illustrates the complementarity of the nucleotide sequences of FLJ21916 BINDING SITE, designated SEQ ID:23381, to the nucleotide sequence of VGAM2153 RNA, herein designated VGAM RNA, also designated SEQ ID:4864.

Another function of VGAM2153 is therefore inhibition of FLJ21916 (Accession NM_023112). Accordingly, utilities of VGAM2153 include diagnosis, prevention and treatment of diseases and clinical conditions associated with FLJ21916. FLJ23510 (Accession NM_024720) is another VGAM2153 host target gene. FLJ23510 BINDING SITE is HOST TARGET binding site found in the 3' untranslated region of mRNA encoded by FLJ23510, corresponding to a HOST TARGET binding site such as BINDING SITE I, BINDING SITE II or BINDING SITE III. Table 2 illustrates the complementarity of the nucleotide sequences of FLJ23510 BINDING SITE, designated SEQ ID:24053, to the nucleotide sequence of VGAM2153 RNA, herein designated VGAM RNA, also designated SEQ ID:4864.

Another function of VGAM2153 is therefore inhibition of FLJ23510 (Accession NM_024720). Accordingly, utilities of VGAM2153 include diagnosis, prevention and treatment of diseases and clinical conditions associated with FLJ23510. FLJ30294 (Accession NM_144632) is another VGAM2153 host target gene. FLJ30294 BINDING SITE is HOST TARGET binding site found in the 5' untranslated region of mRNA encoded by FLJ30294, corresponding to a HOST TARGET binding site such as BINDING SITE I, BINDING SITE II or BINDING SITE III. Table 2 illustrates the complementarity of the nucleotide sequences of FLJ30294 BINDING SITE, designated SEQ ID:29451, to the nucleotide sequence of VGAM2153 RNA, herein designated VGAM RNA, also designated SEQ ID:4864.

Another function of VGAM2153 is therefore inhibition of FLJ30294 (Accession NM_144632). Accordingly, utilities of VGAM2153 include diagnosis, prevention and treatment of diseases and clinical conditions associated with FLJ30294. IKKE (Accession NM_014002) is another VGAM2153 host target gene. IKKE BINDING SITE is HOST TARGET binding site found in the 5' untranslated region of mRNA encoded by IKKE, corresponding to a HOST TARGET binding site such as BINDING SITE I, BINDING SITE II or BINDING SITE III. Table 2 illustrates the complementarity of the nucleotide sequences of IKKE BINDING SITE, designated SEQ ID:15204, to the nucleotide sequence of VGAM2153 RNA, herein designated VGAM RNA, also designated SEQ ID:4864.

Another function of VGAM2153 is therefore inhibition of IKKE (Accession NM_014002). Accordingly, utilities of VGAM2153 include diagnosis, prevention and treatment of diseases and clinical conditions associated with IKKE. KIAA0237 (Accession NM_014747) is another VGAM2153 host target gene. KIAA0237 BINDING SITE is HOST TARGET binding site found in the 3" untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BIND- ING SITE, designated SEQ ID:16458, to the nucleotide sequence of VGAM2153 RNA, herein designated VGAM RNA, also designated SEQ ID:4864.

Another function of VGAM2153 is therefore inhibition of KIAA0237 (Accession NM_014747). Accordingly, utilities of VGAM2153 include diagnosis, prevention and treatment of diseases and clinical conditions associated with KIAA0237. KIAA0337 (Accession NM_014786) is another VGAM2153 host target gene. KIAA0337 BINDING SITE is HOST TARGET binding site found in the 3' untranslated region of mRNA encoded by KIAA0337, corresponding to a HOST TARGET binding site such as BINDING SITE I, BINDING SITE II or BINDING SITE III. Table 2 illustrates the complementarity of the nucleotide sequences of KIAA0337 BINDING SITE, designated SEQ ID:16656, to the nucleotide sequence of VGAM2153 RNA, herein designated VGAM RNA, also designated SEQ ID:4864.

Another function of VGAM2153 is therefore inhibition of KIAA0337 (Accession NM_014786). Accordingly, utilities of VGAM2153 include diagnosis, prevention and treatment of diseases and clinical conditions associated with KIAA0337. KIAA0390 (Accession NM_014717) is another VGAM2153 host target gene. KIAA0390 BINDING SITE is HOST TARGET binding site found in the 3' untranslated region of mRNA encoded by KIAA0390, corresponding to a HOST TARGET binding site such as BINDING SITE I, BINDING SITE II or BINDING SITE III. Table 2 illustrates the complementarity of the nucleotide sequences of KIAA0390 BINDING SITE, designated SEQ ID:16271, to the nucleotide sequence of VGAM2153 RNA, herein designated VGAM RNA, also designated SEQ ID:4864.

Another function of VGAM2153 is therefore inhibition of KIAA0390 (Accession NM_014717). Accordingly, utilities of VGAM2153 include diagnosis, prevention and treatment of diseases and clinical conditions associated with KIAA0390. KIAA0451 (Accession NM_014826) is another VGAM2153 host target gene. KIAA0451 BINDING SITE is HOST TARGET binding site found in the 3' untranslated region of mRNA encoded by KIAA0451, corresponding to a HOST TARGET binding site such as BINDING SITE I, BINDING SITE II or BINDING SITE III. Table 2 illustrates the complementarity of the nucleotide sequences of KIAA0451 BINDING SITE, designated SEQ ID:16809, to the nucleotide sequence of VGAM2153 RNA, herein designated VGAM RNA, also designated SEQ ID:4864.

Another function of VGAM2153 is therefore inhibition of KIAA0451 (Accession NM_014826). Accordingly, utilities of VGAM2153 include diagnosis, prevention and treatment of diseases and clinical conditions associated with KIAA0451. KIAA0662 (Accession XM_088539) is another VGAM2153 host target gene. KIAA0662 BINDING SITE is HOST TARGET binding site found in the 3' untranslated region of mRNA encoded by KIAA0662, corresponding to a HOST TARGET binding site such as BINDING SITE I, BINDING SITE II or BINDING SITE III. Table 2 illustrates the complementarity of the nucleotide sequences of KIAA0662 BINDING SITE, designated SEQ ID:39804, to the nucleotide sequence of VGAM2153 RNA, herein designated VGAM RNA, also designated SEQ ID:4864.

Another function of VGAM2153 is therefore inhibition of KIAA0662 (Accession XM_088539). Accordingly, utilities of VGAM2153 include diagnosis, prevention and treatment of diseases and clinical conditions associated with KIAA0662. KIAA1318 (Accession XM_041080) is another VGAM2153 host target gene. KIAA1318 BINDING SITE is HOST TARGET binding site found in the 3' untranslated region of mRNA encoded by KIAA1318, corresponding to a HOST TARGET binding site such as BINDING SITE I, BINDING SITE II or BINDING SITE III. Table 2 illustrates the complementarity of the nucleotide sequences of KIAA1318 BINDING SITE, designated SEQ ID:33434, to the nucleotide sequence of VGAM2153 RNA, herein designated VGAM RNA, also designated SEQ ID:4864.

Another function of VGAM2153 is therefore inhibition of KIAA1318 (Accession XM_041080). Accordingly, utilities of VGAM2153 include diagnosis, prevention and treatment of diseases and clinical conditions associated with KIAA1318. KIAA1503 (Accession XM_043197) is another VGAM2153 host target gene. KIAA1503 BINDING SITE is HOST TARGET binding site found in the 5' untranslated region of mRNA encoded by KIAA1503, corresponding to a HOST TARGET binding site such as BINDING SITE I, BINDING SITE II or BINDING SITE III. Table 2 illustrates the complementarity of the nucleotide sequences of KIAA1503 BINDING SITE, designated SEQ ID:33917, to the nucleotide sequence of VGAM2153 RNA, herein designated VGAM RNA, also designated SEQ ID:4864.

Another function of VGAM2153 is therefore inhibition of KIAA1503 (Accession XM_043197). Accordingly, utilities of VGAM2153 include diagnosis, prevention and treatment of diseases and clinical conditions associated with KIAA1503. KIAA1582 (Accession XM_037262) is another VGAM2153 host target gene. KIAA1582 BINDING SITE is HOST TARGET binding site found in the 5' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32580, to the nucleotide sequence of VGAM2153 RNA, herein designated VGAM RNA, also designated SEQ ID:4864.

Another function of VGAM2153 is therefore inhibition of KIAA1582 (Accession XM_037262). Accordingly, utilities of VGAM2153 include diagnosis, prevention and treatment of diseases and clinical conditions associated with KIAA1582. KIAA1817 (Accession XM_042978) is another VGAM2153 host target gene. KIAA1817 BINDING SITE is HOST TARGET binding site found in the 3' untranslated region of mRNA encoded by KIAA1817, corresponding to a HOST TARGET binding site such as BINDING SITE I, BINDING SITE II or BINDING SITE III. Table 2 illustrates the complementarity of the nucleotide sequences of KIAA1817 BINDING SITE, designated SEQ ID:33863, to the nucleotide sequence of VGAM2153 RNA, herein designated VGAM RNA, also designated SEQ ID:4864.

Another function of VGAM2153 is therefore inhibition of KIAA1817 (Accession XM_042978). Accordingly, utilities of VGAM2153 include diagnosis, prevention and treatment of diseases and clinical conditions associated with KIAA1817. MGC10765 (Accession NM_024345) is another VGAM2153 host target gene. MGC10765 BINDING SITE is HOST TARGET binding site found in the 3' untranslated region of mRNA encoded by MGC10765, corresponding to a HOST TARGET binding site such as BINDING SITE I, BINDING SITE II or BINDING SITE III. Table 2 illustrates the complementarity of the nucleotide sequences of MGC10765 BINDING SITE, designated SEQ ID:23645, to the nucleotide sequence of VGAM2153 RNA, herein designated VGAM RNA, also designated SEQ ID:4864.

Another function of VGAM2153 is therefore inhibition of MGC10765 (Accession NM_024345). Accordingly, utilities of VGAM2153 include diagnosis, prevention and treatment of diseases and clinical conditions associated with MGC10765. MGC13053 (Accession NM_032710) is another VGAM2153 host target gene. MGC13053 BINDING SITE is HOST TARGET binding site found in the 3' untranslated region of mRNA encoded by MGC13053, corresponding to a HOST TARGET binding site such as BINDING SITE I, BINDING SITE II or BINDING SITE III. Table 2 illustrates the complementarity of the nucleotide sequences of MGC13053 BINDING SITE, designated SEQ ID:26422, to the nucleotide sequence of VGAM2153 RNA, herein designated VGAM RNA, also designated SEQ ID:4864.

Another function of VGAM2153 is therefore inhibition of MGC13053 (Accession NM_032710). Accordingly, utilities of VGAM2153 include diagnosis, prevention and treatment of diseases and clinical conditions associated with MGC13053. MGC13168 (Accession NM_032735) is another VGAM2153 host target gene. MGC13168 BINDING SITE is HOST TARGET binding site found in the 3' untranslated region of mRNA encoded by MGC13168, corresponding to a HOST TARGET binding site such as BINDING SITE I, BINDING SITE II or BINDING SITE III. Table 2 illustrates the complementarity of the nucleotide sequences of MGC13168 BINDING SITE, designated SEQ ID:26460, to the nucleotide sequence of VGAM2153 RNA, herein designated VGAM RNA, also designated SEQ ID:4864.

Another function of VGAM2153 is therefore inhibition of MGC13168 (Accession NM_032735). Accordingly, utilities of VGAM2153 include diagnosis, prevention and treatment of diseases and clinical conditions associated with MGC13168. MGC2508 (Accession NM_024327) is another VGAM2153 host target gene. MGC2508 BINDING SITE is HOST TARGET binding site found in the 3' untranslated region of mRNA encoded by MGC2508, corresponding to a HOST TARGET binding site such as BINDING SITE I, BINDING SITE II or BINDING SITE III. Table 2 illustrates the complementarity of the nucleotide sequences of MGC2508 BINDING SITE, designated SEQ ID:23619, to the nucleotide sequence of VGAM2153 RNA, herein designated VGAM RNA, also designated SEQ ID:4864.

Another function of VGAM2153 is therefore inhibition of MGC2508 (Accession NM_024327). Accordingly, utilities of VGAM2153 include diagnosis, prevention and treatment of diseases and clinical conditions associated with MGC2508. MGC2663 (Accession NM_024106) is another VGAM2153 host target gene. MGC2663 BINDING SITE is HOST TARGET binding site found in the 5' untranslated region of mRNA encoded by MGC2663, corresponding to a HOST TARGET binding site such as BINDING SITE I, BINDING SITE II or BINDING SITE III. Table 2 illustrates the complementarity of the nucleotide sequences of MGC2663 BINDING SITE, designated SEQ ID:23550, to the nucleotide sequence of VGAM2153 RNA, herein designated VGAM RNA, also designated SEQ ID:4864.

Another function of VGAM2153 is therefore inhibition of MGC2663 (Accession NM_024106). Accordingly, utilities of VGAM2153 include diagnosis, prevention and treatment of diseases and clinical conditions associated with MGC2663. PP1628 (Accession NM_025201) is another VGAM2153 host target gene. PP1628 BINDING SITE is HOST TARGET binding site found in the 5' untranslated region of mRNA encoded by PP1628, corresponding to a HOST TARGET binding site such as BINDING SITE I, BINDING SITE II or BINDING SITE III. Table 2 illustrates the complementarity of the nucleotide sequences of PP1628 BINDING SITE, designated SEQ ID:24859, to the nucleotide sequence of VGAM2153 RNA, herein designated VGAM RNA, also designated SEQ ID:4864.

Another function of VGAM2153 is therefore inhibition of PP1628 (Accession NM_025201). Accordingly, utilities of VGAM2153 include diagnosis, prevention and treatment of diseases and clinical conditions associated with PP1628. Polyglutamine Binding Protein 1 (PQBP1, Accession NM_005710) is another VGAM2153 host target gene. PQBP1 BINDING SITE is HOST TARGET binding site found in the 5' untranslated region of mRNA encoded by PQBP1, corresponding to a HOST TARGET binding site such as BINDING SITE I, BINDING SITE II or BINDING SITE III. Table 2 illustrates the complementarity of the nucleotide sequences of PQBP1 BINDING SITE, designated SEQ ID:12262, to the nucleotide sequence of VGAM2153 RNA, herein designated VGAM RNA, also designated SEQ ID:4864.

Another function of VGAM2153 is therefore inhibition of Polyglutamine Binding Protein 1 (PQBP1, Accession NM_005710). Accordingly, utilities of VGAM2153 include diagnosis, prevention and treatment of diseases and clinical conditions associated with PQBP1. RAB3-GAP150 (Accession NM_012414) is another VGAM2153 host target gene. RAB3-GAP150 BINDING SITE is HOST TARGET binding site found in the 3' untranslated region of mRNA encoded by RAB3-GAP150, corresponding to a HOST TARGET binding site such as BINDING SITE I, BINDING SITE II or BINDING SITE III. Table 2 illustrates the complementarity of the nucleotide sequences of RAB3-GAP150 BINDING SITE, designated SEQ ID:14790, to the nucleotide sequence of VGAM2153 RNA, herein designated VGAM RNA, also designated SEQ ID:4864.

Another function of VGAM2153 is therefore inhibition of RAB3-GAP150 (Accession NM_012414). Accordingly, utilities of VGAM2153 include diagnosis, prevention and treatment of diseases and clinical conditions associated with RAB3-GAP150. Suppressor of Ty 4 Homolog 1 (S. cerevisiae) (SUPT4H1, Accession NM_003168) is another VGAM2153 host target gene. SUPT4H1 BINDING SITE is HOST TARGET binding site found in the 3' untranslated region of mRNA encoded by SUPT4H1, corresponding to a HOST TARGET binding site such as BINDING SITE I, BINDING SITE II or BINDING SITE III. Table 2 illustrates the complementarity of the nucleotide sequences of SUPT4H1 BINDING SITE, designated SEQ ID:9145, to the nucleotide sequence of VGAM2153 RNA, herein designated VGAM RNA, also designated SEQ ID:4864.

Another function of VGAM2153 is therefore inhibition of Suppressor of Ty 4 Homolog 1 (S. cerevisiae) (SUPT4H1, Accession NM_003168). Accordingly, utilities of VGAM2153 include diagnosis, prevention and treatment of diseases and clinical conditions associated with SUPT4H1. VILL (Accession XM_043435) is another VGAM2153 host target gene. VILL BINDING SITE is HOST TARGET binding site found in the 5' untranslated region of mRNA encoded by VILL, corresponding to a HOST TARGET binding site such as BINDING SITE I, BINDING SITE II or BINDING SITE III. Table 2 illustrates the complementarity of the nucleotide sequences of VILL BINDING SITE, designated SEQ ID:33948, to the nucleotide sequence of VGAM2153 RNA, herein designated VGAM RNA, also designated SEQ ID:4864.

Another function of VGAM2153 is therefore inhibition of VILL (Accession XM_043435). Accordingly, utilities of VGAM2153 include diagnosis, prevention and treatment of diseases and clinical conditions associated with VILL. WSB1 (Accession NM_134264) is another VGAM2153 host target gene. WSB1 BINDING SITE is HOST TARGET binding site found in the 3' untranslated region of mRNA encoded by WSB1, corresponding to a HOST TARGET binding site such as BINDING SITE I, BINDING SITE II or BINDING SITE III. Table 2 illustrates the complementarity of the nucleotide sequences of WSB1 BINDING SITE, designated SEQ ID:28619, to the nucleotide sequence of VGAM2153 RNA, herein designated VGAM RNA, also designated SEQ ID:4864.

Another function of VGAM2153 is therefore inhibition of WSB1 (Accession NM_134264). Accordingly, utilities of VGAM2153 include diagnosis, prevention and treatment of diseases and clinical conditions associated with WSB1. YKT6 (Accession NM_006555) is another VGAM2153 host target gene. YKT6 BINDING SITE is HOST TARGET binding site found in the 3' untranslated region of mRNA encoded by YKT6, corresponding to a HOST TARGET binding site such as BINDING SITE I, BINDING SITE II or BINDING SITE III. Table 2 illustrates the complementarity of the nucleotide sequences of YKT6 BINDING SITE, designated SEQ ID:13322, to the nucleotide sequence of VGAM2153 RNA, herein designated VGAM RNA, also designated SEQ ID:4864.

Another function of VGAM2153 is therefore inhibition of YKT6 (Accession NM_006555). Accordingly, utilities of VGAM2153 include diagnosis, prevention and treatment of diseases and clinical conditions associated with YKT6. Zinc Finger Protein 271 (ZNF271, Accession XM_170865) is another VGAM2153 host target gene. ZNF271 BINDING SITE is HOST TARGET binding site found in the 5' untranslated region of mRNA encoded by ZNF271, corresponding to a HOST TARGET binding site such as BINDING SITE I, BINDING SITE II or BINDING SITE III. Table 2 illustrates the complementarity of the nucleotide sequences of ZNF271 BINDING SITE, designated SEQ ID:45636, to the nucleotide sequence of VGAM2153 RNA, herein designated VGAM RNA, also designated SEQ ID:4864.

Another function of VGAM2153 is therefore inhibition of Zinc Finger Protein 271 (ZNF271, Accession XM_170865). Accordingly, utilities of VGAM2153 include diagnosis, prevention and treatment of diseases and clinical conditions associated with ZNF271. LOC126392 (Accession XM_065057) is another VGAM2153 host target gene. LOC126392 BINDING SITE is HOST TARGET binding site found in the 5' untranslated region of mRNA encoded by LOC126392, corresponding to a HOST TARGET binding site such as BINDING SITE I, BINDING SITE II or BINDING SITE III. Table 2 illustrates the complementarity of the nucleotide sequences of LOC126392 BINDING SITE, designated SEQ ID:37275, to the nucleotide sequence of VGAM2153 RNA, herein designated VGAM RNA, also designated SEQ ID:4864.

Another function of VGAM2153 is therefore inhibition of LOC126392 (Accession XM_065057). Accordingly, utilities of VGAM2153 include diagnosis, prevention and treatment of diseases and clinical conditions associated with LOC126392. LOC144519 (Accession XM_084890) is another VGAM2153 host target gene. LOC144519 BINDING SITE is HOST TARGET binding site found in the 5' untranslated region of mRNA encoded by LOC144519, corresponding to a HOST TARGET binding site such as BINDING SITE I, BINDING SITE II or BINDING SITE III. Table 2 illustrates the complementarity of the nucleotide sequences of LOC144519 BINDING SITE, designated SEQ ID:37760, to the nucleotide sequence of VGAM2153 RNA, herein designated VGAM RNA, also designated SEQ ID:4864.

Another function of VGAM2153 is therefore inhibition of LOC144519 (Accession XM_084890). Accordingly, utilities of VGAM2153 include diagnosis, prevention and treatment of diseases and clinical conditions associated with LOC144519. LOC145899 (Accession XM_096899) is another VGAM2153 host target gene. LOC145899 BINDING SITE is HOST TARGET binding site found in the 5' untranslated region of mRNA encoded by LOC145899, corresponding to a HOST TARGET binding site such as BINDING SITE I, BINDING SITE II or BINDING SITE III. Table 2 illustrates the complementarity of the nucleotide sequences of LOC145899 BINDING SITE, designated SEQ ID:40625, to the nucleotide sequence of VGAM2153 RNA, herein designated VGAM RNA, also designated SEQ ID:4864.

Another function of VGAM2153 is therefore inhibition of LOC145899 (Accession XM_096899). Accordingly, utilities of VGAM2153 include diagnosis, prevention and treatment of diseases and clinical conditions associated with LOC145899. LOC146243 (Accession XM_096956) is another VGAM2153 host target gene. LOC146243 BINDING SITE is HOST TARGET binding site found in the 5' untranslated region of mRNA encoded by LOC146243, corresponding to a HOST TARGET binding site such as BINDING SITE I, BINDING SITE II or BINDING SITE III. Table 2 illustrates the complementarity of the nucleotide sequences of LOC146243 BINDING SITE, designated SEQ ID:40678, to the nucleotide sequence of VGAM2153 RNA, herein designated VGAM RNA, also designated SEQ ID:4864.

Another function of VGAM2153 is therefore inhibition of LOC146243 (Accession XM_096956). Accordingly, utilities of VGAM2153 include diagnosis, prevention and treatment of diseases and clinical conditions associated with LOC146243. LOC146802 (Accession XM_085595) is another VGAM2153 host target gene. LOC146802 BINDING SITE is HOST TARGET binding site found in the 3' untranslated region of mRNA encoded by LOC146802, corresponding to a HOST TARGET binding site such as BINDING SITE I, BINDING SITE II or BINDING SITE III. Table 2 illustrates the complementarity of the nucleotide sequences of LOC146802 BINDING SITE, designated SEQ ID:38246, to the nucleotide sequence of VGAM2153 RNA, herein designated VGAM RNA, also designated SEQ ID:4864.

Another function of VGAM2153 is therefore inhibition of LOC146802 (Accession XM_085595). Accordingly, utilities of VGAM2153 include diagnosis, prevention and treatment of diseases and clinical conditions associated with LOC146802. LOC147645 (Accession XM_085831) is another VGAM2153 host target gene. LOC147645 BINDING SITE is HOST TARGET binding site found in the 5' untranslated region of mRNA encoded by LOC147645, corresponding to a HOST TARGET binding site such as BINDING SITE I, BINDING SITE II or BINDING SITE III. Table 2 illustrates the complementarity of the nucleotide sequences of LOC147645 BINDING SITE, designated SEQ ID:38359, to the nucleotide sequence of VGAM2153 RNA, herein designated VGAM RNA, also designated SEQ ID:4864.

Another function of VGAM2153 is therefore inhibition of LOC147645 (Accession XM_085831). Accordingly, utilities of VGAM2153 include diagnosis, prevention and treatment of diseases and clinical conditions associated with LOC147645. LOC155038 (Accession XM_088130) is another VGAM2153 host target gene. LOC155038 BINDING SITE is HOST TARGET binding site found in the 3' untranslated region of mRNA encoded by LOC155038, corresponding to a HOST TARGET binding site such as BINDING SITE I, BINDING SITE II or BINDING SITE III. Table 2 illustrates the complementarity of the nucleotide sequences of LOC155038 BINDING SITE, designated SEQ ID:39533, to the nucleotide sequence of VGAM2153 RNA, herein designated VGAM RNA, also designated SEQ ID:4864.

Another function of VGAM2153 is therefore inhibition of LOC155038 (Accession XM_088130). Accordingly, utilities of VGAM2153 include diagnosis, prevention and treatment of diseases and clinical conditions associated with LOC155038. LOC158117 (Accession XM_088483) is another VGAM2153 host target gene. LOC158117 BINDING SITE is HOST TARGET binding site found in the 3' untranslated region of mRNA encoded by LOC158117, corresponding to a HOST TARGET binding site such as BINDING SITE I, BINDING SITE II or BINDING SITE III. Table 2 illustrates the complementarity of the nucleotide sequences of LOC158117 BINDING SITE, designated SEQ ID:39728, to the nucleotide sequence of VGAM2153 RNA, herein designated VGAM RNA, also designated SEQ ID:4864.

Another function of VGAM2153 is therefore inhibition of LOC158117 (Accession XM_088483). Accordingly, utilities of VGAM2153 include diagnosis, prevention and treatment of diseases and clinical conditions associated with LOC158117. LOC159199 (Accession XM_089441) is another VGAM2153 host target gene. LOC159199 BINDING SITE is HOST TARGET binding site found in the 5' untranslated region of mRNA encoded by LOC159199, corresponding to a HOST TARGET binding site such as BINDING SITE I, BINDING SITE II or BINDING SITE III. Table 2 illustrates the complementarity of the nucleotide sequences of LOC159199 BINDING SITE, designated SEQ ID:39982, to the nucleotide sequence of VGAM2153 RNA, herein designated VGAM RNA, also designated SEQ ID:4864.

Another function of VGAM2153 is therefore inhibition of LOC159199 (Accession XM_089441). Accordingly, utilities of VGAM2153 include diagnosis, prevention and treatment of diseases and clinical conditions associated with LOC159199. LOC161536 (Accession XM_090967) is another VGAM2153 host target gene. LOC161536 BINDING SITE is HOST TARGET binding site found in the 5' untranslated region of mRNA encoded by LOC161536, corresponding to a HOST TARGET binding site such as BINDING SITE I, BINDING SITE II or BINDING SITE III. Table 2 illustrates the complementarity of the nucleotide sequences of LOC161536 BINDING SITE, designated SEQ ID:40021, to the nucleotide sequence of VGAM2153 RNA, herein designated VGAM RNA, also designated SEQ ID:4864.

Another function of VGAM2153 is therefore inhibition of LOC161536 (Accession XM_090967). Accordingly, utilities of VGAM2153 include diagnosis, prevention and treatment of diseases and clinical conditions associated with LOC161536. LOC201514 (Accession XM_113975) is another VGAM2153 host target gene. LOC201514 BINDING SITE is HOST TARGET binding site found in the 5' untranslated region of mRNA encoded by LOC201514, corresponding to a HOST TARGET binding site such as BINDING SITE I, BINDING SITE II or BINDING SITE III. Table 2 illustrates the complementarity of the nucleotide sequences of LOC201514 BINDING SITE, designated SEQ ID:42583, to the nucleotide sequence of VGAM2153 RNA, herein designated VGAM RNA, also designated SEQ ID:4864.

Another function of VGAM2153 is therefore inhibition of LOC201514 (Accession XM_113975). Accordingly, utilities of VGAM2153 include diagnosis, prevention and treatment of diseases and clinical conditions associated with LOC201514. LOC201707 (Accession XM_114369) is another VGAM2153 host target gene. LOC201707 BINDING SITE is HOST TARGET binding site found in the 5' untranslated region of mRNA encoded by LOC201707, corresponding to a HOST TARGET binding site such as BINDING SITE I, BINDING SITE II or BINDING SITE III. Table 2 illustrates the complementarity of the nucleotide sequences of LOC201707 BINDING SITE, designated SEQ ID:42903, to the nucleotide sequence of VGAM2153 RNA, herein designated VGAM RNA, also designated SEQ ID:4864.

Another function of VGAM2153 is therefore inhibition of LOC201707 (Accession XM_114369). Accordingly, utilities of VGAM2153 include diagnosis, prevention and treatment of diseases and clinical conditions associated with LOC201707. LOC203275 (Accession XM_114667) is another VGAM2153 host target gene. LOC203275 BINDING SITE is HOST TARGET binding site found in the 3' untranslated region of mRNA encoded by LOC203275, corresponding to a HOST TARGET binding site such as BINDING SITE I, BINDING SITE II or BINDING SITE III. Table 2 illustrates the complementarity of the nucleotide sequences of LOC203275 BINDING SITE, designated SEQ ID:43025, to the nucleotide sequence of VGAM2153 RNA, herein designated VGAM RNA, also designated SEQ ID:4864.

Another function of VGAM2153 is therefore inhibition of LOC203275 (Accession XM_114667). Accordingly, utilities of VGAM2153 include diagnosis, prevention and treatment of diseases and clinical conditions associated with LOC203275. LOC221583 (Accession XM_166396) is another VGAM2153 host target gene. LOC221583 BINDING SITE is HOST TARGET binding site found in the 3' untranslated region of mRNA encoded by LOC221583, corresponding to a HOST TARGET binding site such as BINDING SITE I, BINDING SITE II or BINDING SITE III. Table 2 illustrates the complementarity of the nucleotide sequences of LOC221583 BINDING SITE, designated SEQ ID:44244, to the nucleotide sequence of VGAM2153 RNA, herein designated VGAM RNA, also designated SEQ ID:4864.

Another function of VGAM2153 is therefore inhibition of LOC221583 (Accession XM_166396). Accordingly, utilities of VGAM2153 include diagnosis, prevention and treatment of diseases and clinical conditions associated with LOC221583. LOC253936 (Accession XM_170637) is another VGAM2153 host target gene. LOC253936 BINDING SITE is HOST TARGET binding site found in the 3' untranslated region of mRNA encoded by LOC253936, corresponding to a HOST TARGET binding site such as BINDING SITE I, BINDING SITE II or BINDING SITE III. Table 2 illustrates the complementarity of the nucleotide sequences of LOC253936 BINDING SITE, designated SEQ ID:45408, to the nucleotide sequence of VGAM2153 RNA, herein designated VGAM RNA, also designated SEQ ID:4864.

Another function of VGAM2153 is therefore inhibition of LOC253936 (Accession XM_170637). Accordingly, utilities of VGAM2153 include diagnosis, prevention and treatment of diseases and clinical conditions associated with LOC253936. LOC255565 (Accession XM_170811) is another VGAM2153 host target gene. LOC255565 BINDING SITE is HOST TARGET binding site found in the 3' untranslated region of mRNA encoded by LOC255565, corresponding to a HOST TARGET binding site such as BINDING SITE I, BINDING SITE II or BINDING SITE III. Table 2 illustrates the complementarity of the nucleotide sequences of LOC255565 BINDING SITE, designated SEQ ID:45587, to the nucleotide sequence of VGAM2153 RNA, herein designated VGAM RNA, also designated SEQ ID:4864.

Another function of VGAM2153 is therefore inhibition of LOC255565 (Accession XM_170811). Accordingly, utilities of VGAM2153 include diagnosis, prevention and treatment of diseases and clinical conditions associated with LOC255565. LOC255974 (Accession XM_173706) is another VGAM2153 host target gene. LOC255974 BINDING SITE is HOST TARGET binding site found in the 5' untranslated region of mRNA encoded by LOC255974, corresponding to a HOST TARGET binding site such as BIND- ING SITE I, BINDING SITE II or BINDING SITE III. Table 2 illustrates the complementarity of the nucleotide sequences of LOC255974 BINDING SITE, designated SEQ ID:46557, to the nucleotide sequence of VGAM2153 RNA, herein designated VGAM RNA, also designated SEQ ID:4864.

Another function of VGAM2153 is therefore inhibition of LOC255974 (Accession XM_173706). Accordingly, utilities of VGAM2153 include diagnosis, prevention and treatment of diseases and clinical conditions associated with LOC255974. LOC256021 (Accession XM_172884) is another VGAM2153 host target gene. LOC256021 BINDING SITE is HOST TARGET binding site found in the 3' untranslated region of mRNA encoded by LOC256021, corresponding to a HOST TARGET binding site such as BINDING SITE I, BINDING SITE II or BINDING SITE III. Table 2 illustrates the complementarity of the nucleotide sequences of LOC256021 BINDING SITE, designated SEQ ID:46167, to the nucleotide sequence of VGAM2153 RNA, herein designated VGAM RNA, also designated SEQ ID:4864.

Another function of VGAM2153 is therefore inhibition of LOC256021 (Accession XM_172884). Accordingly, utilities of VGAM2153 include diagnosis, prevention and treatment of diseases and clinical conditions associated with LOC256021. LOC90010 (Accession XM_028150) is another VGAM2153 host target gene. LOC90010 BINDING SITE is HOST TARGET binding site found in the 3' untranslated region of mRNA encoded by LOC90010, corresponding to a HOST TARGET binding site such as BINDING SITE I, BINDING SITE II or BINDING SITE III. Table 2 illustrates the complementarity of the nucleotide sequences of LOC90010 BINDING SITE, designated SEQ ID:30620, to the nucleotide sequence of VGAM2153 RNA, herein designated VGAM RNA, also designated SEQ ID:4864.

Another function of VGAM2153 is therefore inhibition of LOC90010 (Accession XM_028150). Accordingly, utilities of VGAM2153 include diagnosis, prevention and treatment of diseases and clinical conditions associated with LOC90010. LOC90499 (Accession XM_032170) is another VGAM2153 host target gene. LOC90499 BINDING SITE is HOST TARGET binding site found in the 3' untranslated region of mRNA encoded by LOC90499, corresponding to a HOST TARGET binding site such as BINDING SITE I, BINDING SITE II or BINDING SITE III. Table 2 illustrates the complementarity of the nucleotide sequences of LOC90499 BINDING SITE, designated SEQ ID:31585, to the nucleotide sequence of VGAM2153 RNA, herein designated VGAM RNA, also designated SEQ ID:4864.

Another function of VGAM2153 is therefore inhibition of LOC90499 (Accession XM_032170). Accordingly, utilities of VGAM2153 include diagnosis, prevention and treatment of diseases and clinical conditions associated with LOC90499. FIG. 1 further provides a conceptual description of a novel bioinformatically detected viral gene of the present invention, referred to here as Viral Genomic Address Messenger 2154 (VGAM2154) viral gene, which modulates expression of respective host target genes thereof, the function and utility of which host target genes is known in the art.

VGAM2154 is a novel bioinformatically detected regulatory, non protein coding, viral micro RNA (miRNA) gene. The method by which VGAM2154 was detected is described hereinabove with reference to FIGS. 1-8.

VGAM2154 gene, herein designated VGAM GENE, is a viral gene contained in the genome of Rana Tigrina Ranavirus. VGAM2154 host target gene, herein designated VGAM HOST TARGET GENE, is a human gene contained in the human genome.

VGAM2154 gene encodes a VGAM2154 precursor RNA, herein designated VGAM PRECURSOR RNA. Similar to other miRNA genes, and unlike most ordinary genes, VGAM2154 precursor RNA does not encode a protein. A nucleotide sequence identical or highly similar to the nucleotide sequence of VGAM2154 precursor RNA is designated SEQ ID:2140, and is provided hereinbelow with reference to the sequence listing part. Nucleotide sequence SEQ ID:2140 is located at position 48817 relative to the genome of Rana Tigrina Ranavirus.

VGAM2154 precursor RNA folds onto itself, forming VGAM2154 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2154 folded precursor RNA into VGAM2154 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM2154 RNA is designated SEQ ID:4865, and is provided hereinbelow with reference to the sequence listing part.

VGAM2154 host target gene, herein designated VGAM HOST TARGET GENE, encodes a corresponding messenger RNA, VGAM2154 host target RNA, herein designated VGAM HOST TARGET RNA. VGAM2154 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2154 RNA, herein designated VGAM RNA, binds complementarily to one or more host target binding sites located in untranslated regions of VGAM2154 host target RNA, herein designated VGAM HOST TARGET RNA. This complementary binding is due to the fact that the nucleotide sequence of VGAM2154 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2154 RNA, herein designated VGAM RNA, may have a different number of host target binding sites in untranslated regions of a VGAM2154 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2154 RNA, herein designated VGAM RNA, to host target binding sites on VGAM2154 host target RNA, herein designated VGAM HOST TARGET RNA, such as BINDING SITE I, BINDING SITE II and BINDING SITE III, inhibits translation of VGAM2154 host target RNA into VGAM2154 host target protein, herein designated VGAM HOST TARGET PRO- TEIN. VGAM host target protein is therefore outlined by a broken line.

It is appreciated that VGAM2154 host target gene, herein designated VGAM HOST TARGET GENE, in fact represents a plurality of VGAM2154 host target genes. The mRNA of each one of this plurality of VGAM2154 host target genes comprises one or more host target binding sites, each having a nucleotide sequence which is at least partly complementary to VGAM2154 RNA, herein designated VGAM RNA, and which when bound by VGAM2154 RNA causes inhibition of translation of respective one or more VGAM2154 host target proteins.

It is further appreciated by one skilled in the art that the mode of translational inhibition illustrated by FIG. 1 with specific reference to translational inhibition exerted by VGAM2154 gene, herein designated VGAM GENE, on one or more VGAM2154 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2154 is inhibition of expression of host target genes, as part of a novel viral mechanism of attacking a host. Accordingly, utilities of VGAM2154 include diagnosis, prevention and treatment of viral infection by Rana Tigrina Ranavirus. Specific functions, and accordingly utilities, of VGAM2154 correlate with, and may be deduced from, the identity of the host target genes which VGAM2154 binds and inhibits, and the function of these host target genes, as elaborated hereinbelow.

Nucleotide sequences of the VGAM2154 precursor RNA, herein designated VGAM PRECURSOR RNA, and of the 'diced' VGAM2154 RNA, herein designated VGAM RNA, and a schematic representation of the secondary folding of VGAM2154 folded precursor RNA, herein designated VGAM FOLDED PRECURSOR RNA, of VGAM2154 are further described hereinbelow with reference to Table 1.

Nucleotide sequences of host target binding sites, such as BINDING SITE-I, BINDING SITE-II and BINDING SITE-III of FIG. 1, found on VGAM2154 host target RNA, and schematic representation of the complementarity of each of these host target binding sites to VGAM2154 RNA, herein designated VGAM RNA, are described hereinbelow with reference to Table 2.

As mentioned hereinabove with reference to FIG. 1, a function of VGAM2154 gene, herein designated VGAM is inhibition of expression of VGAM2154 target genes. It is appreciated that specific functions, and accordingly utilities, of VGAM2154 correlate with, and may be deduced from, the identity of the target genes which VGAM2154 binds and inhibits, and the function of these target genes, as elaborated hereinbelow.

Tumor-associated Calcium Signal Transducer 2 (TACSTD2, Accession NM_002353) is a VGAM2154 host target gene. TACSTD2 BINDING SITE is HOST TARGET binding site found in the 3' untranslated region of mRNA encoded by TACSTD2, corresponding to a HOST TARGET binding site such as BINDING SITE I, BINDING SITE II or BINDING SITE III. Table 2 illustrates the complementarity of the nucleotide sequences of TACSTD2 BINDING SITE, designated SEQ ID:8162, to the nucleotide sequence of VGAM2154 RNA, herein designated VGAM RNA, also designated SEQ ID:4865.

A function of VGAM2154 is therefore inhibition of Tumor-associated Calcium Signal Transducer 2 (TACSTD2, Accession NM_002353), a gene which belongs to ga733 tumor-associated antigen gene family and may function as growth factor receptors. Accordingly, utilities of VGAM2154 include diagnosis, prevention and treatment of diseases and clinical conditions associated with TACSTD2. The function of TACSTD2 and its association with various diseases and clinical conditions, has been established by previous studies, as described hereinabove with reference to VGAM210. E74-like Factor 1 (ets domain transcription factor) (ELF1, Accession XM_049376) is another VGAM2154 host target gene. ELF1 BINDING SITE is HOST TARGET binding site found in the 3' untranslated region of mRNA encoded by ELF1, corresponding to a HOST TARGET binding site such as BINDING SITE I, BINDING SITE II or BINDING SITE III. Table 2 illustrates the complementarity of the nucleotide sequences of ELF1 BINDING SITE, designated SEQ ID:35401, to the nucleotide sequence of VGAM2154 RNA, herein designated VGAM RNA, also designated SEQ ID:4865.

Another function of VGAM2154 is therefore inhibition of E74-like Factor 1 (ets domain transcription factor) (ELF1, Accession XM_049376). Accordingly, utilities of VGAM2154 include diagnosis, prevention and treatment of diseases and clinical conditions associated with ELF1. MGC16202 (Accession NM_032373) is another VGAM2154 host target gene. MGC16202 BINDING SITE is HOST TARGET binding site found in the 5' untranslated region of mRNA encoded by MGC16202, corresponding to a HOST TARGET binding site such as BINDING SITE I, BINDING SITE II or BINDING SITE III. Table 2 illustrates the complementarity of the nucleotide sequences of MGC16202 BINDING SITE, designated SEQ ID:26161, to the nucleotide sequence of VGAM2154 RNA, herein designated VGAM RNA, also designated SEQ ID:4865.

Another function of VGAM2154 is therefore inhibition of MGC16202 (Accession NM_032373). Accordingly, utilities of VGAM2154 include diagnosis, prevention and treatment of diseases and clinical conditions associated with MGC16202. LOC147219 (Accession XM_097214) is another VGAM2154 host target gene. LOC147219 BINDING SITE is HOST TARGET binding site found in the 5' untranslated region of mRNA encoded by LOC147219, corresponding to a HOST TARGET binding site such as BINDING SITE I, BINDING SITE II or BINDING SITE III. Table 2 illustrates the complementarity of the nucleotide sequences of LOC147219 BINDING SITE, designated SEQ ID:40824, to the nucleotide sequence of VGAM2154 RNA, herein designated VGAM RNA, also designated SEQ ID:4865.

Another function of VGAM2154 is therefore inhibition of LOC147219 (Accession XM_097214). Accordingly, utilities of VGAM2154 include diagnosis, prevention and treatment of diseases and clinical conditions associated with LOC147219. LOC153114 (Accession XM_098313) is another VGAM2154 host target gene. LOC153114 BINDING SITE is HOST TARGET binding site found in the 3' untranslated region of mRNA encoded by LOC153114, corresponding to a HOST TARGET binding site such as BINDING SITE I, BINDING SITE II or BINDING SITE III. Table 2 illustrates the complementarity of the nucleotide sequences of LOC153114 BINDING SITE, designated SEQ ID:41574, to the nucleotide sequence of VGAM2154 RNA, herein designated VGAM RNA, also designated SEQ ID:4865.

Another function of VGAM2154 is therefore inhibition of LOC153114 (Accession XM_098313). Accordingly, utilities of VGAM2154 include diagnosis, prevention and treatment of diseases and clinical conditions associated with LOC153114. FIG. 1 further provides a conceptual description of a novel bioinformatically detected viral gene of the present invention, referred to here as Viral Genomic Address Messenger 2155 (VGAM2155) viral gene, which modulates expression of respective host target genes thereof, the function and utility of which host target genes is known in the art.

VGAM2155 is a novel bioinformatically detected regulatory, non protein coding, viral micro RNA (miRNA) gene. The method by which VGAM2155 was detected is described hereinabove with reference to FIGS. 1-8.

VGAM2155 gene, herein designated VGAM GENE, is a viral gene contained in the genome of Monkeypox Virus. VGAM2155 host target gene, herein designated VGAM HOST TARGET GENE, is a human gene contained in the human genome.

VGAM2155 gene encodes a VGAM2155 precursor RNA, herein designated VGAM PRECURSOR RNA. Similar to other miRNA genes, and unlike most ordinary genes, VGAM2155 precursor RNA does not encode a protein. A nucleotide sequence identical or highly similar to the nucleotide sequence of VGAM2155 precursor RNA is designated SEQ ID:2141, and is provided hereinbelow with reference to the sequence listing part. Nucleotide sequence SEQ ID:2141 is located at position 168488 relative to the genome of Monkeypox Virus.

VGAM2155 precursor RNA folds onto itself, forming VGAM2155 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2155 folded precursor RNA into VGAM2155 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2155 RNA is designated SEQ ID:4866, and is provided hereinbelow with reference to the sequence listing part.

VGAM2155 host target gene, herein designated VGAM HOST TARGET GENE, encodes a corresponding messenger RNA, VGAM2155 host target RNA, herein designated VGAM HOST TARGET RNA. VGAM2155 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2155 RNA, herein designated VGAM RNA, binds complementarily to one or more host target binding sites located in untranslated regions of VGAM2155 host target RNA, herein designated VGAM HOST TARGET RNA. This complementary binding is due to the fact that the nucleotide sequence of VGAM2155 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2155 RNA, herein designated VGAM RNA, may have a different number of host target binding sites in untranslated regions of a VGAM2155 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2155 RNA, herein designated VGAM RNA, to host target binding sites on VGAM2155 host target RNA, herein designated VGAM HOST TARGET RNA, such as BINDING SITE I, BINDING SITE II and BINDING SITE III, inhibits translation of VGAM2155 host target RNA into VGAM2155 host target protein, herein designated VGAM HOST TARGET PROTEIN. VGAM host target protein is therefore outlined by a broken line.

It is appreciated that VGAM2155 host target gene, herein designated VGAM HOST TARGET GENE, in fact represents a plurality of VGAM2155 host target genes. The mRNA of each one of this plurality of VGAM2155 host target genes comprises one or more host target binding sites, each having a nucleotide sequence which is at least partly complementary to VGAM2155 RNA, herein designated VGAM RNA, and which when bound by VGAM2155 RNA causes inhibition of translation of respective one or more VGAM2155 host target proteins.

It is further appreciated by one skilled in the art that the mode of translational inhibition illustrated by FIG. 1 with specific reference to translational inhibition exerted by VGAM2155 gene, herein designated VGAM GENE, on one or more VGAM2155 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2155 is inhibition of expression of host target genes, as part of a novel viral mechanism of attacking a host. Accordingly, utilities of VGAM2155 include diagnosis, prevention and treatment of viral infection by Monkeypox Virus. Specific functions, and accordingly utilities, of VGAM2155 correlate with, and may be deduced from, the identity of the host target genes which VGAM2155 binds and inhibits, and the function of these host target genes, as elaborated hereinbelow.

Nucleotide sequences of the VGAM2155 precursor RNA, herein designated VGAM PRECURSOR RNA, and of the 'diced' VGAM2155 RNA, herein designated VGAM RNA, and a schematic representation of the secondary folding of VGAM2155 folded precursor RNA, herein designated VGAM FOLDED PRECURSOR RNA, of VGAM2155 are further described hereinbelow with reference to Table 1.

Nucleotide sequences of host target binding sites, such as BINDING SITE-I, BINDING SITE-II and BINDING SITE-III of FIG. 1, found on VGAM2155 host target RNA, and schematic representation of the complementarity of each of these host target binding sites to VGAM2155 RNA, herein designated VGAM RNA, are described hereinbelow with reference to Table 2.

As mentioned hereinabove with reference to FIG. 1, a function of VGAM2155 gene, herein designated VGAM is inhibition of expression of VGAM2155 target genes. It is appreciated that specific functions, and accordingly utilities, of VGAM2155 correlate with, and may be deduced from, the identity of the target genes which VGAM2155 binds and inhibits, and the function of these target genes, as elaborated hereinbelow.

Fibroblast Growth Factor Receptor 2 (bacteria-expressed kinase, keratinocyte growth factor receptor, craniofacial dysostosis 1, Crouzon syndrome, Pfeiffer syndrome, Jackson-Weiss syndrome) (FGFR2, Accession NM_000141) is a VGAM2155 host target gene. FGFR2 BINDING SITE1 through FGFR2 BINDING SITE6 are HOST TARGET binding sites found in untranslated regions of mRNA encoded by FGFR2, corresponding to HOST TARGET binding sites such as BINDING SITE I, BINDING SITE II or BINDING SITE III. Table 2 illustrates the complementarity of the nucleotide sequences of FGFR2 BINDING SITE1 through FGFR2 BINDING SITE6, designated SEQ ID:5641, SEQ ID:23237, SEQ ID:23244, SEQ ID:23291, SEQ ID:23297 and SEQ ID:23303 respectively, to the nucleotide sequence of VGAM2155 RNA, herein designated VGAM RNA, also designated SEQ ID:4866.

A function of VGAM2155 is therefore inhibition of Fibroblast Growth Factor Receptor 2 (bacteria-expressed kinase, keratinocyte growth factor receptor, craniofacial dysostosis 1, Crouzon syndrome, Pfeiffer syndrome, Jackson-Weiss syndrome) (FGFR2, Accession NM_000141). Accordingly, utilities of VGAM2155 include diagnosis, prevention and treatment of diseases and clinical conditions associated with FGFR2. Potassium Inwardly-rectifying Channel, Subfamily J, Member 6 (KCNJ6, Accession NM_002240) is another VGAM2155 host target gene. KCNJ6 BINDING SITE is HOST TARGET binding site found in the 3' untranslated region of mRNA encoded by KCNJ6, corresponding to a HOST TARGET binding site such as BINDING SITE I, BINDING SITE II or BINDING SITE III. Table 2 illustrates the complementarity of the nucleotide sequences of KCNJ6 BINDING SITE, designated SEQ ID:8023, to the nucleotide sequence of VGAM2155 RNA, herein designated VGAM RNA, also designated SEQ ID:4866.

Another function of VGAM2155 is therefore inhibition of Potassium Inwardly-rectifying Channel, Subfamily J, Member 6 (KCNJ6, Accession NM_002240), a gene which may be involved in the regulation of insulin secretion by glucose and/or neurotransmitters. Accordingly, utilities of VGAM2155 include diagnosis, prevention and treatment of diseases and clinical conditions associated with KCNJ6. The function of KCNJ6 has been established by previous studies. ATP-sensitive potassium channels, also called K(ATP) channels, are closed by an increase in the intracellular ATP concentration of the cell and thereby provide a means of linking cellular metabolism to the electrical excitability of the plasma membrane. Sakura et al. (1995) stated that their physiologic function is best understood in the pancreatic beta-cell where they play a key role in the regulation of insulin secretion in response to nutrients. Closure of K(ATP) channels, as the result of metabolically generated ATP, produces membrane depolarization. This leads to activation of voltage-sensitive Ca (2+) channels, Ca (2+) influx, and ultimately insulin release. Sakura et al. (1995) cloned the KCNJ6 gene, which encodes a putative subunit of a human ATP-sensitive K-channel expressed in brain and beta cells, and characterized its exon/intron structure. By screening of a somatic cell mapping panel and fluorescence in situ hybridization, they placed the gene on 21q22.1-q22.2. Analysis of SSCPs revealed the presence of 2 silent polymorphisms (pro149: CCG-CCA and asp328: GAC-GAT) with similar frequencies in normal and noninsulin-dependent diabetic patients. The weaver mutation, discovered by Lane (1964), had been studied intensively for more than 25 years (Rakic and Sidman, 1973) for insights into the normal processes of neural development and differentiation. Homozygous animals suffer from severe ataxia that is obvious by about the second postnatal week. The cerebellum of these animals is drastically reduced in size due to depletion of the major cell type of cerebellum, the granule cell neuron. Heterozygous animals are not ataxic but have an intermediate number of surviving granule cells. Patil et al. (1995), and other workers before them, found that the overall expression pattern of the Girk2 gene corresponds closely to the pattern of phenotypic effects in weaver mice. Expression in the cerebellum, substantia nigra, and testes is associated with a developmental loss of cells in those tissues. Expression of Girk2 in the cortex is consistent with seizures that affect weaver mice. Goldowitz and Smeyne (1995) diagrammed the developmental events in the early postnatal cerebellum in wildtype and weaver mice, the expression pattern of Girk2 mRNA in adult brain, and the proposed role of Girk2 in normal and abnormal granule cell differentiation.

Full details of the abovementioned studies are described in the following publications, the disclosure of which are hereby incorporated by reference:

Bandmann, O.; Davis, M. B.; Marsden, C. D.; Wood, N. W.: The human homologue of the Weaver mouse gene in familial and sporadic Parkinson's disease. Neuroscience 72:877-879, 1996; and Goldowitz, D.; Smeyne, R. J.: Tune into the weaver channel. Nature Genet. 11:107-109, 1995.

Further studies establishing the function and utilities of KCNJ6 are found in John Hopkins OMIM database record ID 600877, and in sited publications numbered 3274, 6844-684 and 10066-6851 listed in the bibliography section hereinbelow, which are also hereby incorporated by reference. FLJ14075 (Accession NM_024894) is another VGAM2155 host target gene. FLJ14075 BINDING SITE is HOST TARGET binding site found in the 3' untranslated region of mRNA encoded by FLJ14075, corresponding to a HOST TARGET binding site such as BINDING SITE I, BINDING SITE II or BINDING SITE III. Table 2 illustrates the complementarity of the nucleotide sequences of FLJ14075 BINDING SITE, designated SEQ ID:24373, to the nucleotide sequence of VGAM2155 RNA, herein designated VGAM RNA, also designated SEQ ID:4866.

Another function of VGAM2155 is therefore inhibition of FLJ14075 (Accession NM_024894). Accordingly, utilities of VGAM2155 include diagnosis, prevention and treatment of diseases and clinical conditions associated with FLJ14075. KIAA0626 (Accession NM_021647) is another VGAM2155 host target gene. KIAA0626 BINDING SITE is HOST TARGET binding site found in the 3' untranslated region of mRNA encoded by KIAA0626, corresponding to a HOST TARGET binding site such as BINDING SITE I, BINDING SITE II or BINDING SITE III. Table 2 illustrates the complementarity of the nucleotide sequences of KIAA0626 BINDING SITE, designated SEQ ID:22314, to the nucleotide sequence of VGAM2155 RNA, herein designated VGAM RNA, also designated SEQ ID:4866.

Another function of VGAM2155 is therefore inhibition of KIAA0626 (Accession NM_021647). Accordingly, utilities of VGAM2155 include diagnosis, prevention and treatment of diseases and clinical conditions associated with KIAA0626. FIG. 1 further provides a conceptual description of a novel bioinformatically detected viral gene of the present invention, referred to here as Viral Genomic Address Messenger 2156 (VGAM2156) viral gene, which modulates expression of respective host target genes thereof, the function and utility of which host target genes is known in the art.

VGAM2156 is a novel bioinformatically detected regulatory, non protein coding, viral micro RNA (miRNA) gene. The method by which VGAM2156 was detected is described hereinabove with reference to FIGS. 1-8.

VGAM2156 gene, herein designated VGAM GENE, is a viral gene contained in the genome of Monkeypox Virus. VGAM2156 host target gene, herein designated VGAM HOST TARGET GENE, is a human gene contained in the human genome.

VGAM2156 gene encodes a VGAM2156 precursor RNA, herein designated VGAM PRECURSOR RNA. Similar to other miRNA genes, and unlike most ordinary genes, VGAM2156 precursor RNA does not encode a protein. A nucleotide sequence identical or highly similar to the nucleotide sequence of VGAM2156 precursor RNA is designated SEQ ID:2142, and is provided hereinbelow with reference to the sequence listing part. Nucleotide sequence SEQ ID:2142 is located at position 170622 relative to the genome of Monkeypox Virus.

VGAM2156 precursor RNA folds onto itself, forming VGAM2156 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2156 folded precursor RNA into VGAM2156 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM2156 RNA is designated SEQ ID:4867, and is provided hereinbelow with reference to the sequence listing part.

VGAM2156 host target gene, herein designated VGAM HOST TARGET GENE, encodes a corresponding messenger RNA, VGAM2156 host target RNA, herein designated VGAM HOST TARGET RNA. VGAM2156 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2156 RNA, herein designated VGAM RNA, binds complementarily to one or more host target binding sites located in untranslated regions of VGAM2156 host target RNA, herein designated VGAM HOST TARGET RNA. This complementary binding is due to the fact that the nucleotide sequence of VGAM2156 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2156 RNA, herein designated VGAM RNA, may have a different number of host target binding sites in untranslated regions of a VGAM2156 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2156 RNA, herein designated VGAM RNA, to host target binding sites on VGAM2156 host target RNA, herein designated VGAM HOST TARGET RNA, such as BINDING SITE I, BINDING SITE II and BINDING SITE III, inhibits translation of VGAM2156 host target RNA into VGAM2156 host target protein, herein designated VGAM HOST TARGET PROTEIN. VGAM host target protein is therefore outlined by a broken line.

It is appreciated that VGAM2156 host target gene, herein designated VGAM HOST TARGET GENE, in fact represents a plurality of VGAM2156 host target genes. The mRNA of each one of this plurality of VGAM2156 host target genes comprises one or more host target binding sites, each having a nucleotide sequence which is at least partly complementary to VGAM2156 RNA, herein designated VGAM RNA, and which when bound by VGAM2156 RNA causes inhibition of translation of respective one or more VGAM2156 host target proteins.

It is further appreciated by one skilled in the art that the mode of translational inhibition illustrated by FIG. 1 with specific reference to translational inhibition exerted by VGAM2156 gene, herein designated VGAM GENE, on one or more VGAM2156 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2156 is inhibition of expression of host target genes, as part of a novel viral mechanism of attacking a host. Accordingly, utilities of VGAM2156 include diagnosis, prevention and treatment of viral infection by Monkeypox Virus. Specific functions, and accordingly utilities, of VGAM2156 correlate with, and may be deduced from, the identity of the host target genes which VGAM2156 binds and inhibits, and the function of these host target genes, as elaborated hereinbelow.

Nucleotide sequences of the VGAM2156 precursor RNA, herein designated VGAM PRECURSOR RNA, and of the 'diced' VGAM2156 RNA, herein designated VGAM RNA, and a schematic representation of the secondary folding of VGAM2156 folded precursor RNA, herein designated VGAM FOLDED PRECURSOR RNA, of VGAM2156 are further described hereinbelow with reference to Table 1.

Nucleotide sequences of host target binding sites, such as BINDING SITE-I, BINDING SITE-II and BINDING SITE-III of FIG. 1, found on VGAM2156 host target RNA, and schematic representation of the complementarity of each of these host target binding sites to VGAM2156 RNA, herein designated VGAM RNA, are described hereinbelow with reference to Table 2.

As mentioned hereinabove with reference to FIG. 1, a function of VGAM2156 gene, herein designated VGAM is inhibition of expression of VGAM2156 target genes. It is appreciated that specific functions, and accordingly utilities, of VGAM2156 correlate with, and may be deduced from, the identity of the target genes which VGAM2156 binds and inhibits, and the function of these target genes, as elaborated hereinbelow.

FLJ22283 (Accession NM_032220) is a VGAM2156 host target gene. FLJ22283 BINDING SITE is HOST TARGET binding site found in the 5' untranslated region of mRNA encoded by FLJ22283, corresponding to a HOST TARGET binding site such as BINDING SITE I, BINDING SITE II or BINDING SITE III. Table 2 illustrates the complementarity of the nucleotide sequences of FLJ22283 BINDING SITE, designated SEQ ID:25947, to the nucleotide sequence of VGAM2156 RNA, herein designated VGAM RNA, also designated SEQ ID:4867.

A function of VGAM2156 is therefore inhibition of FLJ22283 (Accession NM_032220). Accordingly, utilities of VGAM2156 include diagnosis, prevention and treatment of diseases and clinical conditions associated with FLJ22283. LOC219686 (Accession XM_165544) is another VGAM2156 host target gene. LOC219686 BINDING SITE is HOST TARGET binding site found in the 3' untranslated region of mRNA encoded by LOC219686, corresponding to a HOST TARGET binding site such as BINDING SITE I, BINDING SITE II or BINDING SITE III. Table 2 illustrates the complementarity of the nucleotide sequences of LOC219686 BINDING SITE, designated SEQ ID:43676, to the nucleotide sequence of VGAM2156 RNA, herein designated VGAM RNA, also designated SEQ ID:4867.

Another function of VGAM2156 is therefore inhibition of LOC219686 (Accession XM_165544). Accordingly, utilities of VGAM2156 include diagnosis, prevention and treatment of diseases and clinical conditions associated with LOC219686. FIG. 1 further provides a conceptual description of a novel bioinformatically detected viral gene of the present invention, referred to here as Viral Genomic Address Messenger 2157 (VGAM2157) viral gene, which modulates expression of respective host target genes thereof, the function and utility of which host target genes is known in the art.

VGAM2157 is a novel bioinformatically detected regulatory, non protein coding, viral micro RNA (miRNA) gene. The method by which VGAM2157 was detected is described hereinabove with reference to FIGS. 1-8.

VGAM2157 gene, herein designated VGAM GENE, is a viral gene contained in the genome of Monkeypox Virus. VGAM2157 host target gene, herein designated VGAM HOST TARGET GENE, is a human gene contained in the human genome.

VGAM2157 gene encodes a VGAM2157 precursor RNA, herein designated VGAM PRECURSOR RNA. Similar to other miRNA genes, and unlike most ordinary genes, VGAM2157 precursor RNA does not encode a protein. A nucleotide sequence identical or highly similar to the nucleotide sequence of VGAM2157 precursor RNA is designated SEQ ID:2143, and is provided hereinbelow with reference to the sequence listing part. Nucleotide sequence SEQ ID:2143 is located at position 162621 relative to the genome of Monkeypox Virus.

VGAM2157 precursor RNA folds onto itself, forming VGAM2157 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2157 folded precursor RNA into VGAM2157 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2157 RNA is designated SEQ ID:4868, and is provided hereinbelow with reference to the sequence listing part.

VGAM2157 host target gene, herein designated VGAM HOST TARGET GENE, encodes a corresponding messenger RNA, VGAM2157 host target RNA, herein designated VGAM HOST TARGET RNA. VGAM2157 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2157 RNA, herein designated VGAM RNA, binds complementarily to one or more host target binding sites located in untranslated regions of VGAM2157 host target RNA, herein designated VGAM HOST TARGET RNA. This complementary binding is due to the fact that the nucleotide sequence of VGAM2157 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2157 RNA, herein designated VGAM RNA, may have a different number of host target binding sites in untranslated regions of a VGAM2157 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2157 RNA, herein designated VGAM RNA, to host target binding sites on VGAM2157 host target RNA, herein designated VGAM HOST TARGET RNA, such as BINDING SITE I, BINDING SITE II and BINDING SITE III, inhibits translation of VGAM2157 host target RNA into VGAM2157 host target protein, herein designated VGAM HOST TARGET PROTEIN. VGAM host target protein is therefore outlined by a broken line.

It is appreciated that VGAM2157 host target gene, herein designated VGAM HOST TARGET GENE, in fact represents a plurality of VGAM2157 host target genes. The mRNA of each one of this plurality of VGAM2157 host target genes comprises one or more host target binding sites, each having a nucleotide sequence which is at least partly complementary to VGAM2157 RNA, herein designated VGAM RNA, and which when bound by VGAM2157 RNA causes inhibition of translation of respective one or more VGAM2157 host target proteins.

It is further appreciated by one skilled in the art that the mode of translational inhibition illustrated by FIG. 1 with specific reference to translational inhibition exerted by VGAM2157 gene, herein designated VGAM GENE, on one or more VGAM2157 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2157 is inhibition of expression of host target genes, as part of a novel viral mechanism of attacking a host. Accordingly, utilities of VGAM2157 include diagnosis, prevention and treatment of viral infection by Monkeypox Virus. Specific functions, and accordingly utilities, of VGAM2157 correlate with, and may be deduced from, the identity of the host target genes which VGAM2157 binds and inhibits, and the function of these host target genes, as elaborated hereinbelow.

Nucleotide sequences of the VGAM2157 precursor RNA, herein designated VGAM PRECURSOR RNA, and of the 'diced' VGAM2157 RNA, herein designated VGAM RNA, and a schematic representation of the secondary folding of VGAM2157 folded precursor RNA, herein designated VGAM FOLDED PRECURSOR RNA, of VGAM2157 are further described hereinbelow with reference to Table 1.

Nucleotide sequences of host target binding sites, such as BINDING SITE-I, BINDING SITE-II and BINDING SITE-III of FIG. 1, found on VGAM2157 host target RNA, and schematic representation of the complementarity of each of these host target binding sites to VGAM2157 RNA, herein designated VGAM RNA, are described hereinbelow with reference to Table 2.

As mentioned hereinabove with reference to FIG. 1, a function of VGAM2157 gene, herein designated VGAM is inhibition of expression of VGAM2157 target genes. It is appreciated that specific functions, and accordingly utilities, of VGAM2157 correlate with, and may be deduced from, the identity of the target genes which VGAM2157 binds and inhibits, and the function of these target genes, as elaborated hereinbelow.

Ficolin (collagen/fibrinogen domain containing lectin) 2 (hucolin) (FCN2, Accession NM_015838) is a VGAM2157 host target gene. FCN2 BINDING SITE is HOST TARGET binding site found in the 3' untranslated region of mRNA encoded by FCN2, corresponding to a HOST TARGET binding site such as BINDING SITE I, BINDING SITE II or BINDING SITE III. Table 2 illustrates the complementarity of the nucleotide sequences of FCN2 BINDING SITE, designated SEQ ID:17950, to the nucleotide sequence of VGAM2157 RNA, herein designated VGAM RNA, also designated SEQ ID:4868.

A function of VGAM2157 is therefore inhibition of Ficolin (collagen/fibrinogen domain containing lectin) 2 (hucolin) (FCN2, Accession NM_015838), a gene which is involved in phagocytosis of pathogens. Accordingly, utilities of VGAM2157 include diagnosis, prevention and treatment of diseases and clinical conditions associated with FCN2. The function of FCN2 and its association with various diseases and clinical conditions, has been established by previous studies, as described hereinabove with reference to VGAM493. LOC90148 (Accession XM_029430) is another VGAM2157 host target gene. LOC90148 BINDING SITE is HOST TARGET binding site found in the 3' untranslated region of mRNA encoded by LOC90148, corresponding to a HOST TARGET binding site such as BINDING SITE I, BINDING SITE II or BINDING SITE III. Table 2 illustrates the complementarity of the nucleotide sequences of LOC90148 BINDING SITE, designated SEQ ID:30890, to the nucleotide sequence of VGAM2157 RNA, herein designated VGAM RNA, also designated SEQ ID:4868.

Another function of VGAM2157 is therefore inhibition of LOC90148 (Accession XM_029430). Accordingly, utilities of VGAM2157 include diagnosis, prevention and treatment of diseases and clinical conditions associated with LOC90148. FIG. 1 further provides a conceptual description of a novel bioinformatically detected viral gene of the present invention, referred to here as Viral Genomic Address Messenger 2158 (VGAM2158) viral gene, which modulates expression of respective host target genes thereof, the function and utility of which host target genes is known in the art.

VGAM2158 is a novel bioinformatically detected regulatory, non protein coding, viral micro RNA (miRNA) gene. The method by which VGAM2158 was detected is described hereinabove with reference to FIGS. 1-8.

VGAM2158 gene, herein designated VGAM GENE, is a viral gene contained in the genome of Monkeypox Virus. VGAM2158 host target gene, herein designated VGAM HOST TARGET GENE, is a human gene contained in the human genome.

VGAM2158 gene encodes a VGAM2158 precursor RNA, herein designated VGAM PRECURSOR RNA. Similar to other miRNA genes, and unlike most ordinary genes, VGAM2158 precursor RNA does not encode a protein. A nucleotide sequence identical or highly similar to the nucleotide sequence of VGAM2158 precursor RNA is designated SEQ ID:2144, and is provided hereinbelow with reference to the sequence listing part. Nucleotide sequence SEQ ID:2144 is located at position 165985 relative to the genome of Monkeypox Virus.

VGAM2158 precursor RNA folds onto itself, forming VGAM2158 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2158 folded precursor RNA into VGAM2158 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2158 RNA is designated SEQ ID:4869, and is provided hereinbelow with reference to the sequence listing part.

VGAM2158 host target gene, herein designated VGAM HOST TARGET GENE, encodes a corresponding messenger RNA, VGAM2158 host target RNA, herein designated VGAM HOST TARGET RNA. VGAM2158 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2158 RNA, herein designated VGAM RNA, binds complementarily to one or more host target binding sites located in untranslated regions of VGAM2158 host target RNA, herein designated VGAM HOST TARGET RNA. This complementary binding is due to the fact that the nucleotide sequence of VGAM2158 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2158 RNA, herein designated VGAM RNA, may have a different number of host target binding sites in untranslated regions of a VGAM2158 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2158 RNA, herein designated VGAM RNA, to host target binding sites on VGAM2158 host target RNA, herein designated VGAM HOST TARGET RNA, such as BINDING SITE I, BINDING SITE II and BINDING SITE III, inhibits translation of VGAM2158 host target RNA into VGAM2158 host target protein, herein designated VGAM HOST TARGET PROTEIN. VGAM host target protein is therefore outlined by a broken line.

It is appreciated that VGAM2158 host target gene, herein designated VGAM HOST TARGET GENE, in fact represents a plurality of VGAM2158 host target genes. The mRNA of each one of this plurality of VGAM2158 host target genes comprises one or more host target binding sites, each having a nucleotide sequence which is at least partly complementary to VGAM2158 RNA, herein designated VGAM RNA, and which when bound by VGAM2158 RNA causes inhibition of translation of respective one or more VGAM2158 host target proteins.

It is further appreciated by one skilled in the art that the mode of translational inhibition illustrated by FIG. 1 with specific reference to translational inhibition exerted by VGAM2158 gene, herein designated VGAM GENE, on one or more VGAM2158 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2158 is inhibition of expression of host target genes, as part of a novel viral mechanism of attacking a host. Accordingly, utilities of VGAM2158 include diagnosis, prevention and treatment of viral infection by Monkeypox Virus. Specific functions, and accordingly utilities, of VGAM2158 correlate with, and may be deduced from, the identity of the host target genes which VGAM2158 binds and inhibits, and the function of these host target genes, as elaborated hereinbelow.

Nucleotide sequences of the VGAM2158 precursor RNA, herein designated VGAM PRECURSOR RNA, and of the 'diced' VGAM2158 RNA, herein designated VGAM RNA, and a schematic representation of the secondary folding of VGAM2158 folded precursor RNA, herein designated VGAM FOLDED PRECURSOR RNA, of VGAM2158 are further described hereinbelow with reference to Table 1.

Nucleotide sequences of host target binding sites, such as BINDING SITE-I, BINDING SITE-II and BINDING SITE-III of FIG. 1, found on VGAM2158 host target RNA, and schematic representation of the complementarity of each of these host target binding sites to VGAM2158 RNA, herein designated VGAM RNA, are described hereinbelow with reference to Table 2.

As mentioned hereinabove with reference to FIG. 1, a function of VGAM2158 gene, herein designated VGAM is inhibition of expression of VGAM2158 target genes. It is appreciated that specific functions, and accordingly utilities, of VGAM2158 correlate with, and may be deduced from, the identity of the target genes which VGAM2158 binds and inhibits, and the function of these target genes, as elaborated hereinbelow.

Dopachrome Tautomerase (dopachrome delta-isomerase, tyrosine-related protein 2) (DCT, Accession NM_001922) is a VGAM2158 host target gene. DCT BINDING SITE is HOST TARGET binding site found in the 5' untranslated region of mRNA encoded by DCT, corresponding to a HOST TARGET binding site such as BINDING SITE I, BINDING SITE II or BINDING SITE III. Table 2 illustrates the complementarity of the nucleotide sequences of DCT BINDING SITE, designated SEQ ID:7638, to the nucleotide sequence of VGAM2158 RNA, herein designated VGAM RNA, also designated SEQ ID:4869.

A function of VGAM2158 is therefore inhibition of Dopachrome Tautomerase (dopachrome delta-isomerase, tyrosine-related protein 2) (DCT, Accession NM_001922), a gene which regulates eumelanin and phaeomelanin levels. Accordingly, utilities of VGAM2158 include diagnosis, prevention and treatment of diseases and clinical conditions associated with DCT. The function of DCT has been established by previous studies. Sturm et al. (1995) showed that the TYRP1 protein is encoded in 7 exons spread over 24 kb of genomic DNA. By contrast, the TYRP2 protein is encoded by 8 exons. TYRP1, TYRP2, and the tyrosinase gene share a common C-terminal membrane spanning exon. The position of intron junctions suggested that TYRP1 was derived from a TYR duplication and then was itself duplicated to give rise to the TYRP2 gene. The comparisons also suggested that at least some of the introns within the TYR, TYRP1, and TYRP2 coding regions were gained after duplication and that intron slippage was unlikely to have occurred. NYESO1 (CTAG; 300156) is expressed on tumor cells of many different types, including melanoma. TRP2 is a melanoma-differentiation antigen. In a melanoma vaccine trial in patients with metastatic disease, Khong and Rosenberg (2002) identified tumor-infiltrating lymphocytes (TILs) that recognized NYESO1, TRP2, and a TRP2 splice variant from a patient who experienced dramatic tumor regression. The TILs expressed immunologic reactivity against these antigens before vaccination with antigens, none of which she had been vaccinated against. Khong and Rosenberg (2002) proposed that NYESO1 and TRP2 may be useful in the active immunotherapy of patients with melanoma.

Full details of the abovementioned studies are described in the following publications, the disclosure of which are hereby incorporated by reference:

Khong, H. T.; Rosenberg, S. A.: Pre-existing immunity to tyrosinase-related protein (TRP)-2, a new TRP-2 isoform, and the NY-ESO-1 melanoma antigen in a patient with a dramatic response to immunotherapy. J. Immun. 168:951-956, 2002; and Sturm, R. A.; O'Sullivan B. J.; Box, N. F.; Smith, A. G.; Smit, S. E.; Puttick, E. R. J.; Parsons, P. G.; Dunn, I. S.:

Chromosomal structure of the human TYRP1 and TYRP2 loci and compa.

Further studies establishing the function and utilities of DCT are found in John Hopkins OMIM database record ID 191275, and in sited publications numbered 2559-2566 listed in the bibliography section hereinbelow, which are also hereby incorporated by reference. EGF-like-domain, Multiple 5 (EGFL5, Accession XM_098838) is another VGAM2158 host target gene. EGFL5 BINDING SITE is HOST TARGET binding site found in the 3' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41876, to the nucleotide sequence of VGAM2158 RNA, herein designated VGAM RNA, also designated SEQ ID:4869.

Another function of VGAM2158 is therefore inhibition of EGF-like-domain, Multiple 5 (EGFL5, Accession XM_098838). Accordingly, utilities of VGAM2158 include diagnosis, prevention and treatment of diseases and clinical conditions associated with EGFL5. Hypoxia-inducible Factor 1, Alpha Subunit (basic helix-loop-helix transcription factor) (HIF1A, Accession NM_001530) is another VGAM2158 host target gene. HIF1A BINDING SITE is HOST TARGET binding site found in the 3' untranslated region of mRNA encoded by HIF1A, corresponding to a HOST TARGET binding site such as BINDING SITE I, BINDING SITE II or BINDING SITE III. Table 2 illustrates the complementarity of the nucleotide sequences of HIF1A BINDING SITE, designated SEQ ID:7267, to the nucleotide sequence of VGAM2158 RNA, herein designated VGAM RNA, also designated SEQ ID:4869.

Another function of VGAM2158 is therefore inhibition of Hypoxia-inducible Factor 1, Alpha Subunit (basic helix-loop-helix transcription factor) (HIF1A, Accession NM_001530), a gene which is a basic helix-loop-helix transcription factor and mediates transcriptional responses to hypoxia and dioxin-signaling. Accordingly, utilities of VGAM2158 include diagnosis, prevention and treatment of diseases and clinical conditions associated with HIF1A. The function of HIF1A and its association with various diseases and clinical conditions, has been established by previous studies, as described hereinabove with reference to VGAM229. Potassium Large Conductance Calcium-activated Channel, Subfamily M Beta Member 3 (KCNMB3, Accession NM_014407) is another VGAM2158 host target gene. KCNMB3 BINDING SITE is HOST TARGET binding site found in the 5' untranslated region of mRNA encoded by KCNMB3, corresponding to a HOST TARGET binding site such as BINDING SITE I, BINDING SITE II or BINDING SITE III. Table 2 illustrates the complementarity of the nucleotide sequences of KCNMB3 BINDING SITE, designated SEQ ID:15749, to the nucleotide sequence of VGAM2158 RNA, herein designated VGAM RNA, also designated SEQ ID:4869.

Another function of VGAM2158 is therefore inhibition of Potassium Large Conductance Calcium-activated Channel, Subfamily M Beta Member 3 (KCNMB3, Accession NM_014407), a gene which is similar to a regulatory subunit of Ca-activated potassium channel. Accordingly, utilities of VGAM2158 include diagnosis, prevention and treatment of diseases and clinical conditions associated with KCNMB3. The function of KCNMB3 and its association with various diseases and clinical conditions, has been established by previous studies, as described hereinabove with reference to VGAM111. Membrane Component, Chromosome 17, Surface Marker 2 (ovarian carcinoma antigen CA125) (M17S2, Accession NM_031858) is another VGAM2158 host target gene. M17S2 BINDING SITE1 through M17S2 BINDING SITE3 are HOST TARGET binding sites found in untranslated regions of mRNA encoded by M17S2, corresponding to HOST TARGET binding sites such as BINDING SITE I, BINDING SITE II or BINDING SITE III. Table 2 illustrates the complementarity of the nucleotide sequences of M17S2 BINDING SITE1 through M17S2 BINDING SITE3, designated SEQ ID:25609, SEQ ID:25622 and SEQ ID:12520 respectively, to the nucleotide sequence of VGAM2158 RNA, herein designated VGAM RNA, also designated SEQ ID:4869.

Another function of VGAM2158 is therefore inhibition of Membrane Component, Chromosome 17, Surface Marker 2 (ovarian carcinoma antigen CA125) (M17S2, Accession NM_031858), a gene which Contains a B-box/coiled coil motif. Accordingly, utilities of VGAM2158 include diagnosis, prevention and treatment of diseases and clinical conditions associated with M17S2. The function of M17S2 and its association with various diseases and clinical conditions, has been established by previous studies, as described hereinabove with reference to VGAM1081. Tumor Necrosis Factor Receptor Superfamily, Member 9 (TNFRSF9, Accession NM_001561) is another VGAM2158 host target gene. TNFRSF9 BINDING SITE is HOST TARGET binding site found in the 3' untranslated region of mRNA encoded by TNFRSF9, corresponding to a HOST TARGET binding site such as BINDING SITE I, BINDING SITE II or BINDING SITE III. Table 2 illustrates the complementarity of the nucleotide sequences of TNFRSF9 BINDING SITE, designated SEQ ID:7288, to the nucleotide sequence of VGAM2158 RNA, herein designated VGAM RNA, also designated SEQ ID:4869.

Another function of VGAM2158 is therefore inhibition of Tumor Necrosis Factor Receptor Superfamily, Member 9 (TNFRSF9, Accession NM_001561), a gene which inhibits proliferation of activated T lymphocytes. Accordingly, utilities of VGAM2158 include diagnosis, prevention and treatment of diseases and clinical conditions associated with TNFRSF9. The function of TNFRSF9 and its association with various diseases and clinical conditions, has been established by previous studies, as described hereinabove with reference to VGAM1954. Chromosome 13 Open Reading Frame 1 (C13orf1, Accession NM_020456) is another VGAM2158 host target gene. C13orf1 BINDING SITE is HOST TARGET binding site found in the 3' untranslated region of mRNA encoded by C13orf1, corresponding to a HOST TARGET binding site such as BINDING SITE I, BINDING SITE II or BINDING SITE III. Table 2 illustrates the complementarity of the nucleotide sequences of C13orf1 BINDING SITE, designated SEQ ID:21693, to the nucleotide sequence of VGAM2158 RNA, herein designated VGAM RNA, also designated SEQ ID:4869.

Another function of VGAM2158 is therefore inhibition of Chromosome 13 Open Reading Frame 1 (C13orf1, Accession NM_020456). Accordingly, utilities of VGAM2158 include diagnosis, prevention and treatment of diseases and clinical conditions associated with C13orf1. C3IP1 (Accession NM_021633) is another VGAM2158 host target gene. C3IP1 BINDING SITE is HOST TARGET binding site found in the 3' untranslated region of mRNA encoded by C3IP1, corresponding to a HOST TARGET binding site such as BINDING SITE I, BINDING SITE II or BINDING SITE III. Table 2 illustrates the complementarity of the nucleotide sequences of C3IP1 BINDING SITE, designated SEQ ID:22275, to the nucleotide sequence of VGAM2158 RNA, herein designated VGAM RNA, also designated SEQ ID:4869.

Another function of VGAM2158 is therefore inhibition of C3IP1 (Accession NM_021633). Accordingly, utilities of VGAM2158 include diagnosis, prevention and treatment of diseases and clinical conditions associated with C3IP1. Chromosome 5 Open Reading Frame 5 (C5orf5, Accession NM_016603) is another VGAM2158 host target gene. C5orf5 BINDING SITE is HOST TARGET binding site found in the 3' untranslated region of mRNA encoded by C5orf5, corresponding to a HOST TARGET binding site such as BINDING SITE I, BINDING SITE II or BINDING SITE III. Table 2 illustrates the complementarity of the nucleotide sequences of C5orf5 BINDING SITE, designated SEQ ID:18699, to the nucleotide sequence of VGAM2158 RNA, herein designated VGAM RNA, also designated SEQ ID:4869.

Another function of VGAM2158 is therefore inhibition of Chromosome 5 Open Reading Frame 5 (C5orf5, Accession NM_016603). Accordingly, utilities of VGAM2158 include diagnosis, prevention and treatment of diseases and clinical conditions associated with C5orf5. Histidine Triad Nucleotide Binding Protein 3 (HINT3, Accession NM_138571) is another VGAM2158 host target gene. HINT3 BINDING SITE is HOST TARGET binding site found in the 3' untranslated region of mRNA encoded by HINT3, corresponding to a HOST TARGET binding site such as BINDING SITE I, BINDING SITE II or BINDING SITE III. Table 2 illustrates the complementarity of the nucleotide sequences of HINT3 BINDING SITE, designated SEQ ID:28878, to the nucleotide sequence of VGAM2158 RNA, herein designated VGAM RNA, also designated SEQ ID:4869.

Another function of VGAM2158 is therefore inhibition of Histidine Triad Nucleotide Binding Protein 3 (HINT3, Accession NM_138571). Accordingly, utilities of VGAM2158 include diagnosis, prevention and treatment of diseases and clinical conditions associated with HINT3. KIAA0416 (Accession NM_015564) is another VGAM2158 host target gene. KIAA0416 BINDING SITE is HOST TARGET binding site found in the 3' untranslated region of mRNA encoded by KIAA0416, corresponding to a HOST TARGET binding site such as BINDING SITE I, BINDING SITE II or BINDING SITE III. Table 2 illustrates the complementarity of the nucleotide sequences of KIAA0416 BINDING SITE, designated SEQ ID:17837, to the nucleotide sequence of VGAM2158 RNA, herein designated VGAM RNA, also designated SEQ ID:4869.

Another function of VGAM2158 is therefore inhibition of KIAA0416 (Accession NM_015564). Accordingly, utilities of VGAM2158 include diagnosis, prevention and treatment of diseases and clinical conditions associated with KIAA0416. KIAA0781 (Accession XM_041314) is another VGAM2158 host target gene. KIAA0781 BINDING SITE is HOST TARGET binding site found in the 3' untranslated region of mRNA encoded by KIAA0781, corresponding to a HOST TARGET binding site such as BINDING SITE I, BINDING SITE II or BINDING SITE III. Table 2 illustrates the complementarity of the nucleotide sequences of KIAA0781 BINDING SITE, designated SEQ ID:33499, to the nucleotide sequence of VGAM2158 RNA, herein designated VGAM RNA, also designated SEQ ID:4869.

Another function of VGAM2158 is therefore inhibition of KIAA0781 (Accession XM_041314). Accordingly, utilities of VGAM2158 include diagnosis, prevention and treatment of diseases and clinical conditions associated with KIAA0781. KIAA0871 (Accession NM_014961) is another VGAM2158 host target gene. KIAA0871 BINDING SITE is HOST TARGET binding site found in the 3' untranslated region of mRNA encoded by KIAA0871, corresponding to a HOST TARGET binding site such as BINDING SITE I, BINDING SITE II or BINDING SITE III. Table 2 illustrates the complementarity of the nucleotide sequences of KIAA0871 BINDING SITE, designated SEQ ID:17332, to the nucleotide sequence of VGAM2158 RNA, herein designated VGAM RNA, also designated SEQ ID:4869.

Another function of VGAM2158 is therefore inhibition of KIAA0871 (Accession NM_014961). Accordingly, utilities of VGAM2158 include diagnosis, prevention and treatment of diseases and clinical conditions associated with KIAA0871. KIAA1505 (Accession XM_168469) is another VGAM2158 host target gene. KIAA1505 BINDING SITE is HOST TARGET binding site found in the 5' untranslated region of mRNA encoded by KIAA1505, corresponding to a HOST TARGET binding site such as BINDING SITE I, BINDING SITE II or BINDING SITE III. Table 2 illustrates the complementarity of the nucleotide sequences of KIAA1505 BINDING SITE, designated SEQ ID:45190, to the nucleotide sequence of VGAM2158 RNA, herein designated VGAM RNA, also designated SEQ ID:4869.

Another function of VGAM2158 is therefore inhibition of KIAA1505 (Accession XM_168469). Accordingly, utilities of VGAM2158 include diagnosis, prevention and treatment of diseases and clinical conditions associated with KIAA1505. KIAA1678 (Accession XM_051221) is another VGAM2158 host target gene. KIAA1678 BINDING SITE is HOST TARGET binding site found in the 3' untranslated region of mRNA encoded by KIAA1678, corresponding to a HOST TARGET binding site such as BINDING SITE I, BINDING SITE II or BINDING SITE III. Table 2 illustrates the complementarity of the nucleotide sequences of KIAA1678 BINDING SITE, designated SEQ ID:35787, to the nucleotide sequence of VGAM2158 RNA, herein designated VGAM RNA, also designated SEQ ID:4869.

Another function of VGAM2158 is therefore inhibition of KIAA1678 (Accession XM_051221). Accordingly, utilities of VGAM2158 include diagnosis, prevention and treatment of diseases and clinical conditions associated with KIAA1678. MGC16063 (Accession NM_053047) is another VGAM2158 host target gene. MGC16063 BINDING SITE is HOST TARGET binding site found in the 3' untranslated region of mRNA encoded by MGC16063, corresponding to a HOST TARGET binding site such as BINDING SITE I, BINDING SITE II or BINDING SITE III. Table 2 illustrates the complementarity of the nucleotide sequences of MGC16063 BINDING SITE, designated SEQ ID:27590, to the nucleotide sequence of VGAM2158 RNA, herein designated VGAM RNA, also designated SEQ ID:4869.

Another function of VGAM2158 is therefore inhibition of MGC16063 (Accession NM_053047). Accordingly, utilities of VGAM2158 include diagnosis, prevention and treatment of diseases and clinical conditions associated with MGC16063. MSTP031 (Accession NM_032035) is another VGAM2158 host target gene. MSTP031 BINDING SITE is HOST TARGET binding site found in the 5' untranslated region of mRNA encoded by MSTP031, corresponding to a HOST TARGET binding site such as BINDING SITE I, BINDING SITE II or BINDING SITE III. Table 2 illustrates the complementarity of the nucleotide sequences of MSTP031 BINDING SITE, designated SEQ ID:25734, to the nucleotide sequence of VGAM2158 RNA, herein designated VGAM RNA, also designated SEQ ID:4869.

Another function of VGAM2158 is therefore inhibition of MSTP031 (Accession NM_032035). Accordingly, utilities of VGAM2158 include diagnosis, prevention and treatment of diseases and clinical conditions associated with MSTP031. Neuron Navigator 3 (NAV3, Accession NM_014903) is another VGAM2158 host target gene. NAV3 BINDING SITE is HOST TARGET binding site found in the 3' untranslated region of mRNA encoded by NAV3, corresponding to a HOST TARGET binding site such as BINDING SITE I, BINDING SITE II or BINDING SITE III. Table 2 illustrates the complementarity of the nucleotide sequences of NAV3 BINDING SITE, designated SEQ ID:17088, to the nucleotide sequence of VGAM2158 RNA, herein designated VGAM RNA, also designated SEQ ID:4869.

Another function of VGAM2158 is therefore inhibition of Neuron Navigator 3 (NAV3, Accession NM_014903). Accordingly, utilities of VGAM2158 include diagnosis, prevention and treatment of diseases and clinical conditions associated with NAV3. LOC51212 (Accession NM_016380) is another VGAM2158 host target gene. LOC51212 BINDING SITE is HOST TARGET binding site found in the 5' untranslated region of mRNA encoded by LOC51212, corresponding to a HOST TARGET binding site such as BINDING SITE I, BINDING SITE II or BINDING SITE III. Table 2 illustrates the complementarity of the nucleotide sequences of LOC51212 BINDING SITE, designated SEQ ID:18518, to the nucleotide sequence of VGAM2158 RNA, herein designated VGAM RNA, also designated SEQ ID:4869.

Another function of VGAM2158 is therefore inhibition of LOC51212 (Accession NM_016380). Accordingly, utilities of VGAM2158 include diagnosis, prevention and treatment of diseases and clinical conditions associated with LOC51212. FIG. 1 further provides a conceptual description of a novel bioinformatically detected viral gene of the present invention, referred to here as Viral Genomic Address Messenger 2159 (VGAM2159) viral gene, which modulates expression of respective host target genes thereof, the function and utility of which host target genes is known in the art.

VGAM2159 is a novel bioinformatically detected regulatory, non protein coding, viral micro RNA (miRNA) gene. The method by which VGAM2159 was detected is described hereinabove with reference to FIGS. 1-8.

VGAM2159 gene, herein designated VGAM GENE, is a viral gene contained in the genome of Monkeypox Virus. VGAM2159 host target gene, herein designated VGAM HOST TARGET GENE, is a human gene contained in the human genome.

VGAM2159 gene encodes a VGAM2159 precursor RNA, herein designated VGAM PRECURSOR RNA. Similar to other miRNA genes, and unlike most ordinary genes, VGAM2159 precursor RNA does not encode a protein. A nucleotide sequence identical or highly similar to the nucleotide sequence of VGAM2159 precursor RNA is designated SEQ ID:2145, and is provided hereinbelow with reference to the sequence listing part. Nucleotide sequence SEQ ID:2145 is located at position 155355 relative to the genome of Monkeypox Virus.

VGAM2159 precursor RNA folds onto itself, forming VGAM2159 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2159 folded precursor RNA into VGAM2159 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2159 RNA is designated SEQ ID:4870, and is provided hereinbelow with reference to the sequence listing part.

VGAM2159 host target gene, herein designated VGAM HOST TARGET GENE, encodes a corresponding messenger RNA, VGAM2159 host target RNA, herein designated VGAM HOST TARGET RNA. VGAM2159 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2159 RNA, herein designated VGAM RNA, binds complementarily to one or more host target binding sites located in untranslated regions of VGAM2159 host target RNA, herein designated VGAM HOST TARGET RNA. This complementary binding is due to the fact that the nucleotide sequence of VGAM2159 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2159 RNA, herein designated VGAM RNA, may have a different number of host target binding sites in untranslated regions of a VGAM2159 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2159 RNA, herein designated VGAM RNA, to host target binding sites on VGAM2159 host target RNA, herein designated VGAM HOST TARGET RNA, such as BINDING SITE I, BINDING SITE II and BINDING SITE III, inhibits translation of VGAM2159 host target RNA into VGAM2159 host target protein, herein designated VGAM HOST TARGET PROTEIN. VGAM host target protein is therefore outlined by a broken line.

It is appreciated that VGAM2159 host target gene, herein designated VGAM HOST TARGET GENE, in fact represents a plurality of VGAM2159 host target genes. The mRNA of each one of this plurality of VGAM2159 host target genes comprises one or more host target binding sites, each having a nucleotide sequence which is at least partly complementary to VGAM2159 RNA, herein designated VGAM RNA, and which when bound by VGAM2159 RNA causes inhibition of translation of respective one or more VGAM2159 host target proteins.

It is further appreciated by one skilled in the art that the mode of translational inhibition illustrated by FIG. 1 with specific reference to translational inhibition exerted by VGAM2159 gene, herein designated VGAM GENE, on one or more VGAM2159 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2159 is inhibition of expression of host target genes, as part of a novel viral mechanism of attacking a host. Accordingly, utilities of VGAM2159 include diagnosis, prevention and treatment of viral infection by Monkeypox Virus. Specific functions, and accordingly utilities, of VGAM2159 correlate with, and may be deduced from, the identity of the host target genes which VGAM2159 binds and inhibits, and the function of these host target genes, as elaborated hereinbelow.

Nucleotide sequences of the VGAM2159 precursor RNA, herein designated VGAM PRECURSOR RNA, and of the 'diced' VGAM2159 RNA, herein designated VGAM RNA, and a schematic representation of the secondary folding of VGAM2159 folded precursor RNA, herein designated VGAM FOLDED PRECURSOR RNA, of VGAM2159 are further described hereinbelow with reference to Table 1.

Nucleotide sequences of host target binding sites, such as BINDING SITE-I, BINDING SITE-II and BINDING SITE-III of FIG. 1, found on VGAM2159 host target RNA, and schematic representation of the complementarity of each of these host target binding sites to VGAM2159 RNA, herein designated VGAM RNA, are described hereinbelow with reference to Table 2.

As mentioned hereinabove with reference to FIG. 1, a function of VGAM2159 gene, herein designated VGAM is inhibition of expression of VGAM2159 target genes. It is appreciated that specific functions, and accordingly utilities, of VGAM2159 correlate with, and may be deduced from, the identity of the target genes which VGAM2159 binds and inhibits, and the function of these target genes, as elaborated hereinbelow.

Espin (ESPN, Accession NM_031475) is a VGAM2159 host target gene. ESPN BINDING SITE is HOST TARGET binding site found in the 3' untranslated region of mRNA encoded by ESPN, corresponding to a HOST TARGET binding site such as BINDING SITE I, BINDING SITE II or BINDING SITE III. Table 2 illustrates the complementarity of the nucleotide sequences of ESPN BINDING SITE, designated SEQ ID:25548, to the nucleotide sequence of VGAM2159 RNA, herein designated VGAM RNA, also designated SEQ ID:4870.

A function of VGAM2159 is therefore inhibition of Espin (ESPN, Accession NM_031475), a gene which a membrane-cytoskeletal assemblages. Accordingly, utilities of VGAM2159 include diagnosis, prevention and treatment of diseases and clinical conditions associated with ESPN. The function of ESPN and its association with various diseases and clinical conditions, has been established by previous studies, as described hereinabove with reference to VGAM1006. Glucocorticoid Receptor DNA Binding Factor 1 (GRLF1, Accession XM_085943) is another VGAM2159 host target gene. GRLF1 BINDING SITE is HOST TARGET binding site found in the 3' untranslated region of mRNA encoded by GRLF1, corresponding to a HOST TARGET binding site such as BINDING SITE I, BINDING SITE II or BINDING SITE III. Table 2 illustrates the complementarity of the nucleotide sequences of GRLF1 BINDING SITE, designated SEQ ID:38407, to the nucleotide sequence of VGAM2159 RNA, herein designated VGAM RNA, also designated SEQ ID:4870.

Another function of VGAM2159 is therefore inhibition of Glucocorticoid Receptor DNA Binding Factor 1 (GRLF1, Accession XM_085943), a gene which inhibits transcription of the glucocorticoid receptor gene. Accordingly, utilities of VGAM2159 include diagnosis, prevention and treatment of diseases and clinical conditions associated with GRLF1. The function of GRLF1 and its association with various diseases and clinical conditions, has been established by previous studies, as described hereinabove with reference to VGAM55. Integrin, Alpha 2 (CD49B, alpha 2 subunit of VLA-2 receptor) (ITGA2, Accession NM_002203) is another VGAM2159 host target gene. ITGA2 BINDING SITE is HOST TARGET binding site found in the 3' untranslated region of mRNA encoded by ITGA2, corresponding to a HOST TARGET binding site such as BINDING SITE I, BINDING SITE II or BINDING SITE III. Table 2 illustrates the complementarity of the nucleotide sequences of ITGA2 BINDING SITE, designated SEQ ID:7962, to the nucleotide sequence of VGAM2159 RNA, herein designated VGAM RNA, also designated SEQ ID:4870.

Another function of VGAM2159 is therefore inhibition of Integrin, Alpha 2 (CD49B, alpha 2 subunit of VLA-2 receptor) (ITGA2, Accession NM_002203), a gene which has roles in blood clotting and angiogenesis, acts as a collagen and laminin receptor. Accordingly, utilities of VGAM2159 include diagnosis, prevention and treatment of diseases and clinical conditions associated with ITGA2. The function of ITGA2 and its association with various diseases and clinical conditions, has been established by previous studies, as described hereinabove with reference to VGAM827. Wilms Tumor 1 (WT1, Accession NM_024424) is another VGAM2159 host target gene. WT1 BINDING SITE1 through WT1 BINDING SITE4 are HOST TARGET binding sites found in untranslated regions of mRNA encoded by WT1, corresponding to HOST TARGET binding sites such as BINDING SITE I, BINDING SITE II or BINDING SITE III. Table 2 illustrates the complementarity of the nucleotide sequences of WT1 BINDING SITE1 through WT1 BINDING SITE4, designated SEQ ID:23667, SEQ ID:23675, SEQ ID:23671 and SEQ ID:5951 respectively, to the nucleotide sequence of VGAM2159 RNA, herein designated VGAM RNA, also designated SEQ ID:4870.

Another function of VGAM2159 is therefore inhibition of Wilms Tumor 1 (WT1, Accession NM_024424). Accordingly, utilities of VGAM2159 include diagnosis, prevention and treatment of diseases and clinical conditions associated with WT1. KIAA0993 (Accession XM_034413) is another VGAM2159 host target gene. KIAA0993 BINDING SITE is HOST TARGET binding site found in the 3' untranslated region of mRNA encoded by KIAA0993, corresponding to a HOST TARGET binding site such as BINDING SITE I, BINDING SITE II or BINDING SITE III. Table 2 illustrates the complementarity of the nucleotide sequences of KIAA0993 BINDING SITE, designated SEQ ID:32083, to the nucleotide sequence of VGAM2159 RNA, herein designated VGAM RNA, also designated SEQ ID:4870.

Another function of VGAM2159 is therefore inhibition of KIAA0993 (Accession XM_034413). Accordingly, utilities of VGAM2159 include diagnosis, prevention and treatment of diseases and clinical conditions associated with KIAA0993. KIAA1416 (Accession XM_098762) is another VGAM2159 host target gene. KIAA1416 BINDING SITE is HOST TARGET binding site found in the 5' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41797, to the nucleotide sequence of VGAM2159 RNA, herein designated VGAM RNA, also designated SEQ ID:4870.

Another function of VGAM2159 is therefore inhibition of KIAA1416 (Accession XM_098762). Accordingly, utilities of VGAM2159 include diagnosis, prevention and treatment of diseases and clinical conditions associated with KIAA1416. My015 (Accession XM_039512) is another VGAM2159 host target gene. My015 BINDING SITE is HOST TARGET binding site found in the 3' untranslated region of mRNA encoded by My015, corresponding to a HOST TARGET binding site such as BINDING SITE I, BINDING SITE II or BINDING SITE III. Table 2 illustrates the complementarity of the nucleotide sequences of My015 BINDING SITE, designated SEQ ID:33103, to the nucleotide sequence of VGAM2159 RNA, herein designated VGAM RNA, also designated SEQ ID:4870.

Another function of VGAM2159 is therefore inhibition of My015 (Accession XM_039512). Accordingly, utilities of VGAM2159 include diagnosis, prevention and treatment of diseases and clinical conditions associated with My015. Ras Association (RalGDS/AF-6) Domain Family 2 (RASSF2, Accession NM_014737) is another VGAM2159 host target gene. RASSF2 BINDING SITE is HOST TARGET binding site found in the 3' untranslated region of mRNA encoded by RASSF2, corresponding to a HOST TARGET binding site such as BINDING SITE I, BINDING SITE II or BINDING SITE III. Table 2 illustrates the complementarity of the nucleotide sequences of RASSF2 BINDING SITE, designated SEQ ID:16388, to the nucleotide sequence of VGAM2159 RNA, herein designated VGAM RNA, also designated SEQ ID:4870.

Another function of VGAM2159 is therefore inhibition of Ras Association (RalGDS/AF-6) Domain Family 2 (RASSF2, Accession NM_014737). Accordingly, utilities of VGAM2159 include diagnosis, prevention and treatment of diseases and clinical conditions associated with RASSF2. Tumor Protein P53 Inducible Nuclear Protein 1 (TP53INP1, Accession XM_053740) is another VGAM2159 host target gene. TP53INP1 BINDING SITE1 and TP53INP1 BINDING SITE2 are HOST TARGET binding sites found in untranslated regions of mRNA encoded by TP53INP1, corresponding to HOST TARGET binding sites such as BINDING SITE I, BINDING SITE II or BINDING SITE III. Table 2 illustrates the complementarity of the nucleotide sequences of TP53INP1 BINDING SITE1 and TP53INP1 BINDING SITE2, designated SEQ ID:36112 and SEQ ID:27101 respectively, to the nucleotide sequence of VGAM2159 RNA, herein designated VGAM RNA, also designated SEQ ID:4870.

Another function of VGAM2159 is therefore inhibition of Tumor Protein P53 Inducible Nuclear Protein 1 (TP53INP1, Accession XM_053740). Accordingly, utilities of VGAM2159 include diagnosis, prevention and treatment of diseases and clinical conditions associated with TP53INP1. LOC157503 (Accession XM_098767) is another VGAM2159 host target gene. LOC157503 BINDING SITE is HOST TARGET binding site found in the 3' untranslated region of mRNA encoded by LOC157503, corresponding to a HOST TARGET binding site such as BINDING SITE I, BINDING SITE II or BINDING SITE III. Table 2 illustrates the complementarity of the nucleotide sequences of LOC157503 BINDING SITE, designated SEQ ID:41815, to the nucleotide sequence of VGAM2159 RNA, herein designated VGAM RNA, also designated SEQ ID:4870.

Another function of VGAM2159 is therefore inhibition of LOC157503 (Accession XM_098767). Accordingly, utilities of VGAM2159 include diagnosis, prevention and treatment of diseases and clinical conditions associated with LOC157503. FIG. 1 further provides a conceptual description of a novel bioinformatically detected viral gene of the present invention, referred to here as Viral Genomic Address Messenger 2160 (VGAM2160) viral gene, which modulates expression of respective host target genes thereof, the function and utility of which host target genes is known in the art.

VGAM2160 is a novel bioinformatically detected regulatory, non protein coding, viral micro RNA (miRNA) gene. The method by which VGAM2160 was detected is described hereinabove with reference to FIGS. 1-8.

VGAM2160 gene, herein designated VGAM GENE, is a viral gene contained in the genome of Monkeypox Virus. VGAM2160 host target gene, herein designated VGAM HOST TARGET GENE, is a human gene contained in the human genome.

VGAM2160 gene encodes a VGAM2160 precursor RNA, herein designated VGAM PRECURSOR RNA. Similar to other miRNA genes, and unlike most ordinary genes, VGAM2160 precursor RNA does not encode a protein. A nucleotide sequence identical or highly similar to the nucleotide sequence of VGAM2160 precursor RNA is designated SEQ ID:2146, and is provided hereinbelow with reference to the sequence listing part. Nucleotide sequence SEQ ID:2146 is located at position 168205 relative to the genome of Monkeypox Virus.

VGAM2160 precursor RNA folds onto itself, forming VGAM2160 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2160 folded precursor RNA into VGAM2160 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM2160 RNA is designated SEQ ID:4871, and is provided hereinbelow with reference to the sequence listing part.

VGAM2160 host target gene, herein designated VGAM HOST TARGET GENE, encodes a corresponding messenger RNA, VGAM2160 host target RNA, herein designated VGAM HOST TARGET RNA. VGAM2160 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2160 RNA, herein designated VGAM RNA, binds complementarily to one or more host target binding sites located in untranslated regions of VGAM2160 host target RNA, herein designated VGAM HOST TARGET RNA. This complementary binding is due to the fact that the nucleotide sequence of VGAM2160 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2160 RNA, herein designated VGAM RNA, may have a different number of host target binding sites in untranslated regions of a VGAM2160 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2160 RNA, herein designated VGAM RNA, to host target binding sites on VGAM2160 host target RNA, herein designated VGAM HOST TARGET RNA, such as BINDING SITE I, BINDING SITE II and BINDING SITE III, inhibits translation of VGAM2160 host target RNA into VGAM2160 host target protein, herein designated VGAM HOST TARGET PROTEIN. VGAM host target protein is therefore outlined by a broken line.

It is appreciated that VGAM2160 host target gene, herein designated VGAM HOST TARGET GENE, in fact represents a plurality of VGAM2160 host target genes. The mRNA of each one of this plurality of VGAM2160 host target genes comprises one or more host target binding sites, each having a nucleotide sequence which is at least partly complementary to VGAM2160 RNA, herein designated VGAM RNA, and which when bound by VGAM2160 RNA causes inhibition of translation of respective one or more VGAM2160 host target proteins.

It is further appreciated by one skilled in the art that the mode of translational inhibition illustrated by FIG. 1 with specific reference to translational inhibition exerted by VGAM2160 gene, herein designated VGAM GENE, on one or more VGAM2160 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2160 is inhibition of expression of host target genes, as part of a novel viral mechanism of attacking a host. Accordingly, utilities of VGAM2160 include diagnosis, prevention and treatment of viral infection by Monkeypox Virus. Specific functions, and accordingly utilities, of VGAM2160 correlate with, and may be deduced from, the identity of the host target genes which VGAM2160 binds and inhibits, and the function of these target genes, as elaborated hereinbelow.

Nucleotide sequences of the VGAM2160 precursor RNA, herein designated VGAM PRECURSOR RNA, and of the 'diced' VGAM2160 RNA, herein designated VGAM RNA, and a schematic representation of the secondary folding of VGAM2160 folded precursor RNA, herein designated VGAM FOLDED PRECURSOR RNA, of VGAM2160 are further described hereinbelow with reference to Table 1.

Nucleotide sequences of host target binding sites, such as BINDING SITE-I, BINDING SITE-II and BINDING SITE-III of FIG. 1, found on VGAM2160 host target RNA, and schematic representation of the complementarity of each of these host target binding sites to VGAM2160 RNA, herein designated VGAM RNA, are described hereinbelow with reference to Table 2.

As mentioned hereinabove with reference to FIG. 1, a function of VGAM2160 gene, herein designated VGAM is inhibition of expression of VGAM2160 target genes. It is appreciated that specific functions, and accordingly utilities, of VGAM2160 correlate with, and may be deduced from, the identity of the target genes which VGAM2160 binds and inhibits, and the function of these target genes, as elaborated hereinbelow.

Hormonally Upregulated Neu-associated Kinase (HUNK, Accession NM_014586) is a VGAM2160 host target gene. HUNK BINDING SITE is HOST TARGET binding site found in the 3' untranslated region of mRNA encoded by HUNK, corresponding to a HOST TARGET binding site such as BINDING SITE I, BINDING SITE II or BINDING SITE III. Table 2 illustrates the complementarity of the nucleotide sequences of HUNK BINDING SITE, designated SEQ ID:15954, to the nucleotide sequence of VGAM2160 RNA, herein designated VGAM RNA, also designated SEQ ID:4871.

A function of VGAM2160 is therefore inhibition of Hormonally Upregulated Neu-associated Kinase (HUNK, Accession NM_014586). Accordingly, utilities of VGAM2160 include diagnosis, prevention and treatment of diseases and clinical conditions associated with HUNK. Splicing Factor, Arginine/serine-rich 7, 35kDa (SFRS7, Accession XM_002575) is another VGAM2160 host target gene. SFRS7 BINDING SITE is HOST TARGET binding site found in the 3' untranslated region of mRNA encoded by SFRS7, corresponding to a HOST TARGET binding site such as BINDING SITE I, BINDING SITE II or BINDING SITE III. Table 2 illustrates the complementarity of the nucleotide sequences of SFRS7 BINDING SITE, designated SEQ ID:29900, to the nucleotide sequence of VGAM2160 RNA, herein designated VGAM RNA, also designated SEQ ID:4871.

Another function of VGAM2160 is therefore inhibition of Splicing Factor, Arginine/serine-rich 7, 35 kDa (SFRS7, Accession XM_002575), a gene which is required for pre-mnra splicing. Accordingly, utilities of VGAM2160 include diagnosis, prevention and treatment of diseases and clinical conditions associated with SFRS7. The function of SFRS7 and its association with various diseases and clinical conditions, has been established by previous studies, as described hereinabove with reference to VGAM191. ARNTL2 (Accession NM_020183) is another VGAM2160 host target gene. ARNTL2 BINDING SITE is HOST TARGET binding site found in the 3' untranslated region of mRNA encoded by ARNTL2, corresponding to a HOST TARGET binding site such as BINDING SITE I, BINDING SITE II or BINDING SITE III. Table 2 illustrates the complementarity of the nucleotide sequences of ARNTL2 BINDING SITE, designated SEQ ID:21412, to the nucleotide sequence of VGAM2160 RNA, herein designated VGAM RNA, also designated SEQ ID:4871.

Another function of VGAM2160 is therefore inhibition of ARNTL2 (Accession NM_020183). Accordingly, utilities of VGAM2160 include diagnosis, prevention and treatment of diseases and clinical conditions associated with ARNTL2. FLJ12592 (Accession NM_032169) is another VGAM2160 host target gene. FLJ12592 BINDING SITE is HOST TARGET binding site found in the 3' untranslated region of mRNA encoded by FLJ12592, corresponding to a HOST TARGET binding site such as BINDING SITE I, BINDING SITE II or BINDING SITE III. Table 2 illustrates the complementarity of the nucleotide sequences of FLJ12592 BINDING SITE, designated SEQ ID:25875, to the nucleotide sequence of VGAM2160 RNA, herein designated VGAM RNA, also designated SEQ ID:4871.

Another function of VGAM2160 is therefore inhibition of FLJ12592 (Accession NM_032169). Accordingly, utilities of VGAM2160 include diagnosis, prevention and treatment of diseases and clinical conditions associated with FLJ12592. Hepatitis B Virus X Associated Protein (HBXAP, Accession NM_016578) is another VGAM2160 host target gene. HBXAP BINDING SITE is HOST TARGET binding site found in the 3' untranslated region of mRNA encoded by HBXAP, corresponding to a HOST TARGET binding site such as BINDING SITE I, BINDING SITE II or BINDING SITE III. Table 2 illustrates the complementarity of the nucleotide sequences of HBXAP BINDING SITE, designated SEQ ID:18657, to the nucleotide sequence of VGAM2160 RNA, herein designated VGAM RNA, also designated SEQ ID:4871.

Another function of VGAM2160 is therefore inhibition of Hepatitis B Virus X Associated Protein (HBXAP, Accession NM_016578). Accordingly, utilities of VGAM2160 include diagnosis, prevention and treatment of diseases and clinical conditions associated with HBXAP. KIAA0776 (Accession XM_035970) is another VGAM2160 host target gene. KIAA0776 BINDING SITE is HOST TARGET binding site found in the 3' untranslated region of mRNA encoded by KIAA0776, corresponding to a HOST TARGET binding site such as BINDING SITE I, BINDING SITE II or BINDING SITE III. Table 2 illustrates the complementarity of the nucleotide sequences of KIAA0776 BINDING SITE, designated SEQ ID:32363, to the nucleotide sequence of VGAM2160 RNA, herein designated VGAM RNA, also designated SEQ ID:4871.

Another function of VGAM2160 is therefore inhibition of KIAA0776 (Accession XM_035970). Accordingly, utilities of VGAM2160 include diagnosis, prevention and treatment of diseases and clinical conditions associated with KIAA0776. FIG. 1 further provides a conceptual description of a novel bioinformatically detected viral gene of the present invention, referred to here as Viral Genomic Address Messenger 2161 (VGAM2161) viral gene, which modulates expression of respective host target genes thereof, the function and utility of which host target genes is known in the art.

VGAM2161 is a novel bioinformatically detected regulatory, non protein coding, viral micro RNA (miRNA) gene. The method by which VGAM2161 was detected is described hereinabove with reference to FIGS. 1-8.

VGAM2161 gene, herein designated VGAM GENE, is a viral gene contained in the genome of Camelpox Virus. VGAM2161 host target gene, herein designated VGAM HOST TARGET GENE, is a human gene contained in the human genome.

VGAM2161 gene encodes a VGAM2161 precursor RNA, herein designated VGAM PRECURSOR RNA. Similar to other miRNA genes, and unlike most ordinary genes, VGAM2161 precursor RNA does not encode a protein. A nucleotide sequence identical or highly similar to the nucleotide sequence of VGAM2161 precursor RNA is designated SEQ ID:2147, and is provided hereinbelow with reference to the sequence listing part. Nucleotide sequence SEQ ID:2147 is located at position 194827 relative to the genome of Camelpox Virus.

VGAM2161 precursor RNA folds onto itself, forming VGAM2161 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2161 folded precursor RNA into VGAM2161 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2161 RNA is designated SEQ ID:4872, and is provided hereinbelow with reference to the sequence listing part.

VGAM2161 host target gene, herein designated VGAM HOST TARGET GENE, encodes a corresponding messenger RNA, VGAM2161 host target RNA, herein designated VGAM HOST TARGET RNA. VGAM2161 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2161 RNA, herein designated VGAM RNA, binds complementarily to one or more host target binding sites located in untranslated regions of VGAM2161 host target RNA, herein designated VGAM HOST TARGET RNA. This complementary binding is due to the fact that the nucleotide sequence of VGAM2161 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2161 RNA, herein designated VGAM RNA, may have a different number of host target binding sites in untranslated regions of a VGAM2161 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2161 RNA, herein designated VGAM RNA, to host target binding sites on VGAM2161 host target RNA, herein designated VGAM HOST TARGET RNA, such as BINDING SITE I, BINDING SITE II and BINDING SITE III, inhibits translation of VGAM2161 host target RNA into VGAM2161 host target protein, herein designated VGAM HOST TARGET PROTEIN. VGAM host target protein is therefore outlined by a broken line.

It is appreciated that VGAM2161 host target gene, herein designated VGAM HOST TARGET GENE, in fact represents a plurality of VGAM2161 host target genes. The mRNA of each one of this plurality of VGAM2161 host target genes comprises one or more host target binding sites, each having a nucleotide sequence which is at least partly complementary to VGAM2161 RNA, herein designated VGAM RNA, and which when bound by VGAM2161 RNA causes inhibition of translation of respective one or more VGAM2161 host target proteins.

It is further appreciated by one skilled in the art that the mode of translational inhibition illustrated by FIG. 1 with specific reference to translational inhibition exerted by VGAM2161 gene, herein designated VGAM GENE, on one or more VGAM2161 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2161 is inhibition of expression of host target genes, as part of a novel viral mechanism of attacking a host. Accordingly, utilities of VGAM2161 include diagnosis, prevention and treatment of viral infection by Camelpox Virus. Specific functions, and accordingly utilities, of VGAM2161 correlate with, and may be deduced from, the identity of the host target genes which VGAM2161 binds and inhibits, and the function of these host target genes, as elaborated hereinbelow.

Nucleotide sequences of the VGAM2161 precursor RNA, herein designated VGAM PRECURSOR RNA, and of the 'diced' VGAM2161 RNA, herein designated VGAM RNA, and a schematic representation of the secondary folding of VGAM2161 folded precursor RNA, herein designated VGAM FOLDED PRECURSOR RNA, of VGAM2161 are further described hereinbelow with reference to Table 1.

Nucleotide sequences of host target binding sites, such as BINDING SITE-I, BINDING SITE-II and BINDING SITE-III of FIG. 1, found on VGAM2161 host target RNA, and schematic representation of the complementarity of each of these host target binding sites to VGAM2161 RNA, herein designated VGAM RNA, are described hereinbelow with reference to Table 2.

As mentioned hereinabove with reference to FIG. 1, a function of VGAM2161 gene, herein designated VGAM is inhibition of expression of VGAM2161 target genes. It is appreciated that specific functions, and accordingly utilities, of VGAM2161 correlate with, and may be deduced from, the identity of the target genes which VGAM2161 binds and inhibits, and the function of these target genes, as elaborated hereinbelow.

DKFZp566D133 (Accession XM_050005) is a VGAM2161 host target gene. DKFZp566D133 BINDING SITE is HOST TARGET binding site found in the 3' untranslated region of mRNA encoded by DKFZp566D133, corresponding to a HOST TARGET binding site such as BINDING SITE I, BINDING SITE II or BINDING SITE III. Table 2 illustrates the complementarity of the nucleotide sequences of DKFZp566D133 BINDING SITE, designated SEQ ID:35545, to the nucleotide sequence of VGAM2161 RNA, herein designated VGAM RNA, also designated SEQ ID:4872.

A function of VGAM2161 is therefore inhibition of DKFZp566D133 (Accession XM_050005). Accordingly, utilities of VGAM2161 include diagnosis, prevention and treatment of diseases and clinical conditions associated with DKFZp566D133. SBBI31 (Accession NM_014035) is another VGAM2161 host target gene. SBBI31 BINDING SITE is HOST TARGET binding site found in the 3' untranslated region of mRNA encoded by SBBI31, corresponding to a HOST TARGET binding site such as BINDING SITE I, BINDING SITE II or BINDING SITE III. Table 2 illustrates the complementarity of the nucleotide sequences of SBBI31 BINDING SITE, designated SEQ ID:15264, to the nucleotide sequence of VGAM2161 RNA, herein designated VGAM RNA, also designated SEQ ID:4872.

Another function of VGAM2161 is therefore inhibition of SBBI31 (Accession NM_014035). Accordingly, utilities of VGAM2161 include diagnosis, prevention and treatment of diseases and clinical conditions associated with SBBI31. LOC253959 (Accession XM_170749) is another VGAM2161 host target gene. LOC253959 BINDING SITE is HOST TARGET binding site found in the 3' untranslated region of mRNA encoded by LOC253959, corresponding to a HOST TARGET binding site such as BINDING SITE I, BINDING SITE II or BINDING SITE III. Table 2 illustrates the complementarity of the nucleotide sequences of LOC253959 BINDING SITE, designated SEQ ID:45511, to the nucleotide sequence of VGAM2161 RNA, herein designated VGAM RNA, also designated SEQ ID:4872.

Another function of VGAM2161 is therefore inhibition of LOC253959 (Accession XM_170749). Accordingly, utilities of VGAM2161 include diagnosis, prevention and treatment of diseases and clinical conditions associated with LOC253959. LOC57107 (Accession NM_020381) is another VGAM2161 host target gene. LOC57107 BINDING SITE is HOST TARGET binding site found in the 3' untranslated region of mRNA encoded by LOC57107, corresponding to a HOST TARGET binding site such as BINDING SITE I, BINDING SITE II or BINDING SITE III. Table 2 illustrates the complementarity of the nucleotide sequences of LOC57107 BINDING SITE, designated SEQ ID:21647, to the nucleotide sequence of VGAM2161 RNA, herein designated VGAM RNA, also designated SEQ ID:4872.

Another function of VGAM2161 is therefore inhibition of LOC57107 (Accession NM_020381). Accordingly, utilities of VGAM2161 include diagnosis, prevention and treatment of diseases and clinical conditions associated with LOC57107. FIG. 1 further provides a conceptual description of a novel bioinformatically detected viral gene of the present invention, referred to here as Viral Genomic Address Messenger 2162 (VGAM2162) viral gene, which modulates expression of respective host target genes thereof, the function and utility of which host target genes is known in the art.

VGAM2162 is a novel bioinformatically detected regulatory, non protein coding, viral micro RNA (miRNA) gene. The method by which VGAM2162 was detected is described hereinabove with reference to FIGS. 1-8.

VGAM2162 gene, herein designated VGAM GENE, is a viral gene contained in the genome of Camelpox Virus. VGAM2162 host target gene, herein designated VGAM HOST TARGET GENE, is a human gene contained in the human genome.

VGAM2162 gene encodes a VGAM2162 precursor RNA, herein designated VGAM PRECURSOR RNA. Similar to other miRNA genes, and unlike most ordinary genes, VGAM2162 precursor RNA does not encode a protein. A nucleotide sequence identical or highly similar to the nucleotide sequence of VGAM2162 precursor RNA is designated SEQ ID:2148, and is provided hereinbelow with reference to the sequence listing part. Nucleotide sequence SEQ ID:2148 is located at position 195253 relative to the genome of Camelpox Virus.

VGAM2162 precursor RNA folds onto itself, forming VGAM2162 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2162 folded precursor RNA into VGAM2162 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2162 RNA is designated SEQ ID:4873, and is provided hereinbelow with reference to the sequence listing part.

VGAM2162 host target gene, herein designated VGAM HOST TARGET GENE, encodes a corresponding messenger RNA, VGAM2162 host target RNA, herein designated VGAM HOST TARGET RNA. VGAM2162 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2162 RNA, herein designated VGAM RNA, binds complementarily to one or more host target binding sites located in untranslated regions of VGAM2162 host target RNA, herein designated VGAM HOST TARGET RNA. This complementary binding is due to the fact that the nucleotide sequence of VGAM2162 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2162 RNA, herein designated VGAM RNA, may have a different number of host target binding sites in untranslated regions of a VGAM2162 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2162 RNA, herein designated VGAM RNA, to host target binding sites on VGAM2162 host target RNA, herein designated VGAM HOST TARGET RNA, such as BINDING SITE I, BINDING SITE II and BINDING SITE III, inhibits translation of VGAM2162 host target RNA into VGAM2162 host target protein, herein designated VGAM HOST TARGET PROTEIN. VGAM host target protein is therefore outlined by a broken line.

It is appreciated that VGAM2162 host target gene, herein designated VGAM HOST TARGET GENE, in fact represents a plurality of VGAM2162 host target genes. The mRNA of each one of this plurality of VGAM2162 host target genes comprises one or more host target binding sites, each having a nucleotide sequence which is at least partly complementary to VGAM2162 RNA, herein designated VGAM RNA, and which when bound by VGAM2162 RNA causes inhibition of translation of respective one or more VGAM2162 host target proteins.

It is further appreciated by one skilled in the art that the mode of translational inhibition illustrated by FIG. 1 with specific reference to translational inhibition exerted by VGAM2162 gene, herein designated VGAM GENE, on one or more VGAM2162 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2162 is inhibition of expression of host target genes, as part of a novel viral mechanism of attacking a host. Accordingly, utilities of VGAM2162 include diagnosis, prevention and treatment of viral infection by Camelpox Virus. Specific functions, and accordingly utilities, of VGAM2162 correlate with, and may be deduced from, the identity of the host target genes which VGAM2162 binds and inhibits, and the function of these host target genes, as elaborated hereinbelow.

Nucleotide sequences of the VGAM2162 precursor RNA, herein designated VGAM PRECURSOR RNA, and of the 'diced' VGAM2162 RNA, herein designated VGAM RNA, and a schematic representation of the secondary folding of VGAM2162 folded precursor RNA, herein designated VGAM FOLDED PRECURSOR RNA, of VGAM2162 are further described hereinbelow with reference to Table 1.

Nucleotide sequences of host target binding sites, such as BINDING SITE-I, BINDING SITE-II and BINDING SITE-III of FIG. 1, found on VGAM2162 host target RNA, and schematic representation of the complementarity of each of these host target binding sites to VGAM2162 RNA, herein designated VGAM RNA, are described hereinbelow with reference to Table 2.

As mentioned hereinabove with reference to FIG. 1, a function of VGAM2162 gene, herein designated VGAM is inhibition of expression of VGAM2162 target genes. It is appreciated that specific functions, and accordingly utilities, of VGAM2162 correlate with, and may be deduced from, the identity of the target genes which VGAM2162 binds and inhibits, and the function of these target genes, as elaborated hereinbelow.

Estrogen-related Receptor Gamma (ESRRG, Accession XM_039053) is a VGAM2162 host target gene. ESRRG BINDING SITE is HOST TARGET binding site found in the 3' untranslated region of mRNA encoded by ESRRG, corresponding to a HOST TARGET binding site such as BINDING SITE I, BINDING SITE II or BINDING SITE III. Table 2 illustrates the complementarity of the nucleotide sequences of ESRRG BINDING SITE, designated SEQ ID:32999, to the nucleotide sequence of VGAM2162 RNA, herein designated VGAM RNA, also designated SEQ ID:4873.

A function of VGAM2162 is therefore inhibition of Estrogen-related Receptor Gamma (ESRRG, Accession XM_039053), a gene which Estrogen-related receptor gamma. Accordingly, utilities of VGAM2162 include diagnosis, prevention and treatment of diseases and clinical conditions associated with ESRRG. The function of ESRRG and its association with various diseases and clinical conditions, has been established by previous studies, as described hereinabove with reference to VGAM359. Integrin, Alpha L (antigen CD11A (p180), Lymphocyte Function-associated Antigen 1; Alpha Polypeptide) (ITGAL, Accession NM_002209) is another VGAM2162 host target gene. ITGAL BINDING SITE is HOST TARGET binding site found in the 3' untranslated region of mRNA encoded by ITGAL, corresponding to a HOST TARGET binding site such as BINDING SITE I, BINDING SITE II or BINDING SITE III. Table 2 illustrates the complementarity of the nucleotide sequences of ITGAL BINDING SITE, designated SEQ ID:7972, to the nucleotide sequence of VGAM2162 RNA, herein designated VGAM RNA, also designated SEQ ID:4873.

Another function of VGAM2162 is therefore inhibition of Integrin, Alpha L (antigen CD11A (p180), Lymphocyte Function-associated Antigen 1; Alpha Polypeptide) (ITGAL, Accession NM_002209), a gene which s a receptor for icam1, icam2, icam3 and icam4. it is involved in a variety of immune phenomena including leukocyte-endothelial cell interaction, cytotoxic t-cell mediated killing, and antibody dependent killing by granulocytes and monocytes. Accordingly, utilities of VGAM2162 include diagnosis, prevention and treatment of diseases and clinical conditions associated with ITGAL. The function of ITGAL and its association with various diseases and clinical conditions, has been established by previous studies, as described hereinabove with reference to VGAM200. Nuclear Fragile X Mental Retardation Protein Interacting Protein 1 (NUFIP1, Accession NM_012345) is another VGAM2162 host target gene. NUFIP1 BINDING SITE is HOST TARGET binding site found in the 3' untranslated region of mRNA encoded by NUFIP1, corresponding to a HOST TARGET binding site such as BINDING SITE I, BINDING SITE II or BINDING SITE III. Table 2 illustrates the complementarity of the nucleotide sequences of NUFIP1 BINDING SITE, designated SEQ ID:14737, to the nucleotide sequence of VGAM2162 RNA, herein designated VGAM RNA, also designated SEQ ID:4873.

Another function of VGAM2162 is therefore inhibition of Nuclear Fragile X Mental Retardation Protein Interacting Protein 1 (NUFIP1, Accession NM_012345), a gene which binds and colocalizes with nuclear fragile X mental retardation protein. Accordingly, utilities of VGAM2162 include diagnosis, prevention and treatment of diseases and clinical conditions associated with NUFIP1. The function of NUFIP1 and its association with various diseases and clinical conditions, has been established by previous studies, as described hereinabove with reference to VGAM733. POU Domain, Class 2, Associating Factor 1 (POU2AF1, Accession NM_006235) is another VGAM2162 host target gene. POU2AF1 BINDING SITE is HOST TARGET binding site found in the 3' untranslated region of mRNA encoded by POU2AF1, corresponding to a HOST TARGET binding site such as BINDING SITE I, BINDING SITE II or BINDING SITE III. Table 2 illustrates the complementarity of the nucleotide sequences of POU2AF1 BINDING SITE, designated SEQ ID:12892, to the nucleotide sequence of VGAM2162 RNA, herein designated VGAM RNA, also designated SEQ ID:4873.

Another function of VGAM2162 is therefore inhibition of POU Domain, Class 2, Associating Factor 1 (POU2AF1, Accession NM_006235), a gene which is a transcriptional coactivator that specifically associates with either oct1 or oct2. Accordingly, utilities of VGAM2162 include diagnosis, prevention and treatment of diseases and clinical conditions associated with POU2AF1. The function of POU2AF1 and its association with various diseases and clinical conditions, has been established by previous studies, as described hereinabove with reference to VGAM171. Recombination Activating Gene 2 (RAG2, Accession XM_089839) is another VGAM2162 host target gene. RAG2 BINDING SITE is HOST TARGET binding site found in the 5' untranslated region of mRNA encoded by RAG2, corresponding to a HOST TARGET binding site such as BINDING SITE I, BINDING SITE II or BINDING SITE III. Table 2 illustrates the complementarity of the nucleotide sequences of RAG2 BINDING SITE, designated SEQ ID:39985, to the nucleotide sequence of VGAM2162 RNA, herein designated VGAM RNA, also designated SEQ ID:4873.

Another function of VGAM2162 is therefore inhibition of Recombination Activating Gene 2 (RAG2, Accession XM_089839). Accordingly, utilities of VGAM2162 include diagnosis, prevention and treatment of diseases and clinical conditions associated with RAG2. Tensin (TNS, Accession NM_022648) is another VGAM2162 host target gene. TNS BINDING SITE is HOST TARGET binding site found in the 3' untranslated region of mRNA encoded by TNS, corresponding to a HOST TARGET binding site such as BINDING SITE I, BINDING SITE II or BINDING SITE III. Table 2 illustrates the complementarity of the nucleotide sequences of TNS BINDING SITE, designated SEQ ID:22903, to the nucleotide sequence of VGAM2162 RNA, herein designated VGAM RNA, also designated SEQ ID:4873.

Another function of VGAM2162 is therefore inhibition of Tensin (TNS, Accession NM_022648). Accordingly, utilities of VGAM2162 include diagnosis, prevention and treatment of diseases and clinical conditions associated with TNS. DKFZP434I092 (Accession XM_042042) is another VGAM2162 host target gene. DKFZP434I092 BINDING SITE is HOST TARGET binding site found in the 3' untranslated region of mRNA encoded by DKFZP434I092, corresponding to a HOST TARGET binding site such as BINDING SITE I, BINDING SITE II or BINDING SITE III. Table 2 illustrates the complementarity of the nucleotide sequences of DKFZP434I092 BINDING SITE, designated SEQ ID:33673, to the nucleotide sequence of VGAM2162 RNA, herein designated VGAM RNA, also designated SEQ ID:4873.

Another function of VGAM2162 is therefore inhibition of DKFZP434I092 (Accession XM_042042). Accordingly, utilities of VGAM2162 include diagnosis, prevention and treatment of diseases and clinical conditions associated with DKFZP434I092. FLJ10656 (Accession NM_018170) is another VGAM2162 host target gene. FLJ10656 BINDING SITE is HOST TARGET binding site found in the 3' untranslated region of mRNA encoded by FLJ10656, corresponding to a HOST TARGET binding site such as BINDING SITE I, BINDING SITE II or BINDING SITE III. Table 2 illustrates the complementarity of the nucleotide sequences of FLJ10656 BINDING SITE, designated SEQ ID:19988, to the nucleotide sequence of VGAM2162 RNA, herein designated VGAM RNA, also designated SEQ ID:4873.

Another function of VGAM2162 is therefore inhibition of FLJ10656 (Accession NM_018170). Accordingly, utilities of VGAM2162 include diagnosis, prevention and treatment of diseases and clinical conditions associated with FLJ10656. GABA(A) Receptor-associated Protein Like 1 (GABARAPL1, Accession NM_031412) is another VGAM2162 host target gene. GABARAPL1 BINDING SITE is HOST TARGET binding site found in the 3' untranslated region of mRNA encoded by GABARAPL1, corresponding to a HOST TARGET binding site such as BINDING SITE I, BINDING SITE II or BINDING SITE III. Table 2 illustrates the complementarity of the nucleotide sequences of GABARAPL1 BINDING SITE, designated SEQ ID:25392, to the nucleotide sequence of VGAM2162 RNA, herein designated VGAM RNA, also designated SEQ ID:4873.

Another function of VGAM2162 is therefore inhibition of GABA(A) Receptor-associated Protein Like 1 (GABARAPL1, Accession NM_031412). Accordingly, utilities of VGAM2162 include diagnosis, prevention and treatment of diseases and clinical conditions associated with GABARAPL1. GABA(A) Receptors Associated Protein Like 3 (GABARAPL3, Accession NM_032568) is another VGAM2162 host target gene. GABARAPL3 BINDING SITE is HOST TARGET binding site found in the 3' untranslated region of mRNA encoded by GABARAPL3, corresponding to a HOST TARGET binding site such as BINDING SITE I, BINDING SITE II or BINDING SITE III. Table 2 illustrates the complementarity of the nucleotide sequences of GABARAPL3 BINDING SITE, designated SEQ ID:26300, to the nucleotide sequence of VGAM2162 RNA, herein designated VGAM RNA, also designated SEQ ID:4873.

Another function of VGAM2162 is therefore inhibition of GABA(A) Receptors Associated Protein Like 3 (GABARAPL3, Accession NM_032568). Accordingly, utilities of VGAM2162 include diagnosis, prevention and treatment of diseases and clinical conditions associated with GABARAPL3. HT002 (Accession NM_014066) is another VGAM2162 host target gene. HT002 BINDING SITE is HOST TARGET binding site found in the 3' untranslated region of mRNA encoded by HT002, corresponding to a HOST TARGET binding site such as BINDING SITE I, BINDING SITE II or BINDING SITE III. Table 2 illustrates the complementarity of the nucleotide sequences of HT002 BINDING SITE, designated SEQ ID:15281, to the nucleotide sequence of VGAM2162 RNA, herein designated VGAM RNA, also designated SEQ ID:4873.

Another function of VGAM2162 is therefore inhibition of HT002 (Accession NM_014066). Accordingly, utilities of VGAM2162 include diagnosis, prevention and treatment of diseases and clinical conditions associated with HT002. KIAA0475 (Accession NM_014864) is another VGAM2162 host target gene. KIAA0475 BINDING SITE is HOST TARGET binding site found in the 3' untranslated region of mRNA encoded by KIAA0475, corresponding to a HOST TARGET binding site such as BINDING SITE I, BINDING SITE II or BINDING SITE III. Table 2 illustrates the complementarity of the nucleotide sequences of KIAA0475 BINDING SITE, designated SEQ ID:16949, to the nucleotide sequence of VGAM2162 RNA, herein designated VGAM RNA, also designated SEQ ID:4873.

Another function of VGAM2162 is therefore inhibition of KIAA0475 (Accession NM_014864). Accordingly, utilities of VGAM2162 include diagnosis, prevention and treatment of diseases and clinical conditions associated with KIAA0475. KIAA0712 (Accession NM_014715) is another VGAM2162 host target gene. KIAA0712 BINDING SITE is HOST TARGET binding site found in the 5' untranslated region of mRNA encoded by KIAA0712, corresponding to a HOST TARGET binding site such as BINDING SITE I, BINDING SITE II or BINDING SITE III. Table 2 illustrates the complementarity of the nucleotide sequences of KIAA0712 BINDING SITE, designated SEQ ID:16262, to the nucleotide sequence of VGAM2162 RNA, herein designated VGAM RNA, also designated SEQ ID:4873.

Another function of VGAM2162 is therefore inhibition of KIAA0712 (Accession NM_014715). Accordingly, utilities of VGAM2162 include diagnosis, prevention and treatment of diseases and clinical conditions associated with KIAA0712. KIAA1301 (Accession XM_038999) is another VGAM2162 host target gene. KIAA1301 BINDING SITE is HOST TARGET binding site found in the 3' untranslated region of mRNA encoded by KIAA1301, corresponding to a HOST TARGET binding site such as BINDING SITE I, BINDING SITE II or BINDING SITE III. Table 2 illustrates the complementarity of the nucleotide sequences of KIAA1301 BINDING SITE, designated SEQ ID:32978, to the nucleotide sequence of VGAM2162 RNA, herein designated VGAM RNA, also designated SEQ ID:4873.

Another function of VGAM2162 is therefore inhibition of KIAA1301 (Accession XM_038999). Accordingly, utilities of VGAM2162 include diagnosis, prevention and treatment of diseases and clinical conditions associated with KIAA1301. Seizure Related 6 Homolog (mouse) (SEZ6, Accession XM_058869) is another VGAM2162 host target gene. SEZ6 BINDING SITE is HOST TARGET binding site found in the 3' untranslated region of mRNA encoded by SEZ6, corresponding to a HOST TARGET binding site such as BINDING SITE I, BINDING SITE II or BINDING SITE III. Table 2 illustrates the complementarity of the nucleotide sequences of SEZ6 BINDING SITE, designated SEQ ID:36774, to the nucleotide sequence of VGAM2162 RNA, herein designated VGAM RNA, also designated SEQ ID:4873.

Another function of VGAM2162 is therefore inhibition of Seizure Related 6 Homolog (mouse) (SEZ6, Accession XM_058869). Accordingly, utilities of VGAM2162 include diagnosis, prevention and treatment of diseases and clinical conditions associated with SEZ6. VMP1 (Accession NM_030938) is another VGAM2162 host target gene. VMP1 BINDING SITE is HOST TARGET binding site found in the 3' untranslated region of mRNA encoded by VMP1, corresponding to a HOST TARGET binding site such as BINDING SITE I, BINDING SITE II or BINDING SITE III. Table 2 illustrates the complementarity of the nucleotide sequences of VMP1 BINDING SITE, designated SEQ ID:25204, to the nucleotide sequence of VGAM2162 RNA, herein designated VGAM RNA, also designated SEQ ID:4873.

Another function of VGAM2162 is therefore inhibition of VMP1 (Accession NM_030938). Accordingly, utilities of VGAM2162 include diagnosis, prevention and treatment of diseases and clinical conditions associated with VMP1. LOC115110 (Accession XM_049825) is another VGAM2162 host target gene. LOC115110 BINDING SITE is HOST TARGET binding site found in the 3' untranslated region of mRNA encoded by LOC115110, corresponding to a HOST TARGET binding site such as BINDING SITE I, BINDING SITE II or BINDING SITE III. Table 2 illustrates the complementarity of the nucleotide sequences of LOC115110 BINDING SITE, designated SEQ ID:35503, to the nucleotide sequence of VGAM2162 RNA, herein designated VGAM RNA, also designated SEQ ID:4873.

Another function of VGAM2162 is therefore inhibition of LOC115110 (Accession XM_049825). Accordingly, utilities of VGAM2162 include diagnosis, prevention and treatment of diseases and clinical conditions associated with LOC115110. LOC132235 (Accession XM_072302) is another VGAM2162 host target gene. LOC132235 BINDING SITE is HOST TARGET binding site found in the 5' untranslated region of mRNA encoded by LOC132235, corresponding to a HOST TARGET binding site such as BINDING SITE I, BINDING SITE II or BINDING SITE III. Table 2 illustrates the complementarity of the nucleotide sequences of LOC132235 BINDING SITE, designated SEQ ID:37483, to the nucleotide sequence of VGAM2162 RNA, herein designated VGAM RNA, also designated SEQ ID:4873.

Another function of VGAM2162 is therefore inhibition of LOC132235 (Accession XM_072302). Accordingly, utilities of VGAM2162 include diagnosis, prevention and treatment of diseases and clinical conditions associated with LOC132235. LOC142941 (Accession XM_096363) is another VGAM2162 host target gene. LOC142941 BINDING SITE is HOST TARGET binding site found in the 3' untranslated region of mRNA encoded by LOC142941, corresponding to a HOST TARGET binding site such as BINDING SITE I, BINDING SITE II or BINDING SITE III. Table 2 illustrates the complementarity of the nucleotide sequences of LOC142941 BINDING SITE, designated SEQ ID:40322, to the nucleotide sequence of VGAM2162 RNA, herein designated VGAM RNA, also designated SEQ ID:4873.

Another function of VGAM2162 is therefore inhibition of LOC142941 (Accession XM_096363). Accordingly, utilities of VGAM2162 include diagnosis, prevention and treatment of diseases and clinical conditions associated with LOC142941. LOC158549 (Accession XM_098963) is another VGAM2162 host target gene. LOC158549 BINDING SITE is HOST TARGET binding site found in the 5' untranslated region of mRNA encoded by LOC158549, corresponding to a HOST TARGET binding site such as BINDING SITE I, BINDING SITE II or BINDING SITE III. Table 2 illustrates the complementarity of the nucleotide sequences of LOC158549 BINDING SITE, designated SEQ ID:42007, to the nucleotide sequence of VGAM2162 RNA, herein designated VGAM RNA, also designated SEQ ID:4873.

Another function of VGAM2162 is therefore inhibition of LOC158549 (Accession XM_098963). Accordingly, utilities of VGAM2162 include diagnosis, prevention and treatment of diseases and clinical conditions associated with LOC158549. LOC221882 (Accession XM_166507) is another VGAM2162 host target gene. LOC221882 BINDING SITE is HOST TARGET binding site found in the 5' untranslated region of mRNA encoded by LOC221882, corresponding to a HOST TARGET binding site such as BINDING SITE I, BINDING SITE II or BINDING SITE III. Table 2 illustrates the complementarity of the nucleotide sequences of LOC221882 BINDING SITE, designated SEQ ID:44434, to the nucleotide sequence of VGAM2162 RNA, herein designated VGAM RNA, also designated SEQ ID:4873.

Another function of VGAM2162 is therefore inhibition of LOC221882 (Accession XM_166507). Accordingly, utilities of VGAM2162 include diagnosis, prevention and treatment of diseases and clinical conditions associated with LOC221882. FIG. 1 further provides a conceptual description of a novel bioinformatically detected viral gene of the present invention, referred to here as Viral Genomic Address Messenger 2163 (VGAM2163) viral gene, which modulates expression of respective host target genes thereof, the function and utility of which host target genes is known in the art.

VGAM2163 is a novel bioinformatically detected regulatory, non protein coding, viral micro RNA (miRNA) gene. The method by which VGAM2163 was detected is described hereinabove with reference to FIGS. 1-8.

VGAM2163 gene, herein designated VGAM GENE, is a viral gene contained in the genome of Camelpox Virus. VGAM2163 host target gene, herein designated VGAM HOST TARGET GENE, is a human gene contained in the human genome.

VGAM2163 gene encodes a VGAM2163 precursor RNA, herein designated VGAM PRECURSOR RNA. Similar to other miRNA genes, and unlike most ordinary genes, VGAM2163 precursor RNA does not encode a protein. A nucleotide sequence identical or highly similar to the nucleotide sequence of VGAM2163 precursor RNA is designated SEQ ID:2149, and is provided hereinbelow with reference to the sequence listing part. Nucleotide sequence SEQ ID:2149 is located at position 184394 relative to the genome of Camelpox Virus.

VGAM2163 precursor RNA folds onto itself, forming VGAM2163 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2163 folded precursor RNA into VGAM2163 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 44%) nucleotide sequence of VGAM2163 RNA is designated SEQ ID:4874, and is provided hereinbelow with reference to the sequence listing part.

VGAM2163 host target gene, herein designated VGAM HOST TARGET GENE, encodes a corresponding messenger RNA, VGAM2163 host target RNA, herein designated VGAM HOST TARGET RNA. VGAM2163 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2163 RNA, herein designated VGAM RNA, binds complementarily to one or more host target binding sites located in untranslated regions of VGAM2163 host target RNA, herein designated VGAM HOST TARGET RNA. This complementary binding is due to the fact that the nucleotide sequence of VGAM2163 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2163 RNA, herein designated VGAM RNA, may have a different number of host target binding sites in untranslated regions of a VGAM2163 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2163 RNA, herein designated VGAM RNA, to host target binding sites on VGAM2163 host target RNA, herein designated VGAM HOST TARGET RNA, such as BINDING SITE I, BINDING SITE II and BINDING SITE III, inhibits translation of VGAM2163 host target RNA into VGAM2163 host target protein, herein designated VGAM HOST TARGET PROTEIN. VGAM host target protein is therefore outlined by a broken line.

It is appreciated that VGAM2163 host target gene, herein designated VGAM HOST TARGET GENE, in fact represents a plurality of VGAM2163 host target genes. The mRNA of each one of this plurality of VGAM2163 host target genes comprises one or more host target binding sites, each having a nucleotide sequence which is at least partly complementary to VGAM2163 RNA, herein designated VGAM RNA, and which when bound by VGAM2163 RNA causes inhibition of translation of respective one or more VGAM2163 host target proteins.

It is further appreciated by one skilled in the art that the mode of translational inhibition illustrated by FIG. 1 with specific reference to translational inhibition exerted by VGAM2163 gene, herein designated VGAM GENE, on one or more VGAM2163 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2163 is inhibition of expression of host target genes, as part of a novel viral mechanism of attacking a host. Accordingly, utilities of VGAM2163 include diagnosis, prevention and treatment of viral infection by Camelpox Virus. Specific functions, and accordingly utilities, of VGAM2163 correlate with, and may be deduced from, the identity of the host target genes which VGAM2163 binds and inhibits, and the function of these host target genes, as elaborated hereinbelow.

Nucleotide sequences of the VGAM2163 precursor RNA, herein designated VGAM PRECURSOR RNA, and of the 'diced' VGAM2163 RNA, herein designated VGAM RNA, and a schematic representation of the secondary folding of VGAM2163 folded precursor RNA, herein designated VGAM FOLDED PRECURSOR RNA, of VGAM2163 are further described hereinbelow with reference to Table 1.

Nucleotide sequences of host target binding sites, such as BINDING SITE-I, BINDING SITE-II and BINDING SITE-III of FIG. 1, found on VGAM2163 host target RNA, and schematic representation of the complementarity of each of these host target binding sites to VGAM2163 RNA, herein designated VGAM RNA, are described hereinbelow with reference to Table 2.

As mentioned hereinabove with reference to FIG. 1, a function of VGAM2163 gene, herein designated VGAM is inhibition of expression of VGAM2163 target genes. It is appreciated that specific functions, and accordingly utilities, of VGAM2163 correlate with, and may be deduced from, the identity of the target genes which VGAM2163 binds and inhibits, and the function of these target genes, as elaborated hereinbelow.

Chromosome 9 Open Reading Frame 12 (C9orf12, Accession NM_022755) is a VGAM2163 host target gene. C9orf12 BINDING SITE is HOST TARGET binding site found in the 3' untranslated region of mRNA encoded by C9orf12, corresponding to a HOST TARGET binding site such as BINDING SITE I, BINDING SITE II or BINDING SITE III. Table 2 illustrates the complementarity of the nucleotide sequences of C9orf12 BINDING SITE, designated SEQ ID:22990, to the nucleotide sequence of VGAM2163 RNA, herein designated VGAM RNA, also designated SEQ ID:4874.

A function of VGAM2163 is therefore inhibition of Chromosome 9 Open Reading Frame 12 (C9orf12, Accession NM_022755). Accordingly, utilities of VGAM2163 include diagnosis, prevention and treatment of diseases and clinical conditions associated with C9orf12. DKFZP564F013 (Accession XM_168479) is another VGAM2163 host target gene. DKFZP564F013 BINDING SITE is HOST TARGET binding site found in the 3' untranslated region of mRNA encoded by DKFZP564F013, corresponding to a HOST TARGET binding site such as BINDING SITE I, BINDING SITE II or BINDING SITE III. Table 2 illustrates the complementarity of the nucleotide sequences of DKFZP564F013 BINDING SITE, designated SEQ ID:45205, to the nucleotide sequence of VGAM2163 RNA, herein designated VGAM RNA, also designated SEQ ID:4874.

Another function of VGAM2163 is therefore inhibition of DKFZP564F013 (Accession XM_168479). Accordingly, utilities of VGAM2163 include diagnosis, prevention and treatment of diseases and clinical conditions associated with DKFZP564F013. LOC199923 (Accession XM_114057) is another VGAM2163 host target gene. LOC199923 BINDING SITE is HOST TARGET binding site found in the 3' untranslated region of mRNA encoded by LOC199923, corresponding to a HOST TARGET binding site such as BINDING SITE I, BINDING SITE II or BINDING SITE III. Table 2 illustrates the complementarity of the nucleotide sequences of LOC199923 BINDING SITE, designated SEQ ID:42665, to the nucleotide sequence of VGAM2163 RNA, herein designated VGAM RNA, also designated SEQ ID:4874.

Another function of VGAM2163 is therefore inhibition of LOC199923 (Accession XM_114057). Accordingly, utilities of VGAM2163 include diagnosis, prevention and treatment of diseases and clinical conditions associated with LOC199923. FIG. 1 further provides a conceptual description of a novel bioinformatically detected viral gene of the present invention, referred to here as Viral Genomic Address Messenger 2164 (VGAM2164) viral gene, which modulates expression of respective host target genes thereof, the function and utility of which host target genes is known in the art.

VGAM2164 is a novel bioinformatically detected regulatory, non protein coding, viral micro RNA (miRNA) gene. The method by which VGAM2164 was detected is described hereinabove with reference to FIGS. 1-8.

VGAM2164 gene, herein designated VGAM GENE, is a viral gene contained in the genome of Parsnip Yellow Fleck Virus. VGAM2164 host target gene, herein designated VGAM HOST TARGET GENE, is a human gene contained in the human genome.

VGAM2164 gene encodes a VGAM2164 precursor RNA, herein designated VGAM PRECURSOR RNA. Similar to other miRNA genes, and unlike most ordinary genes, VGAM2164 precursor RNA does not encode a protein. A nucleotide sequence identical or highly similar to the nucleotide sequence of VGAM2164 precursor RNA is designated SEQ ID:2150, and is provided hereinbelow with reference to the sequence listing part. Nucleotide sequence SEQ ID:2150 is located at position 4805 relative to the genome of Parsnip Yellow Fleck Virus.

VGAM2164 precursor RNA folds onto itself, forming VGAM2164 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2164 folded precursor RNA into VGAM2164 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2164 RNA is designated SEQ ID:4875, and is provided hereinbelow with reference to the sequence listing part.

VGAM2164 host target gene, herein designated VGAM HOST TARGET GENE, encodes a corresponding messenger RNA, VGAM2164 host target RNA, herein designated VGAM HOST TARGET RNA. VGAM2164 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2164 RNA, herein designated VGAM RNA, binds complementarily to one or more host target binding sites located in untranslated regions of VGAM2164 host target RNA, herein designated VGAM HOST TARGET RNA. This complementary binding is due to the fact that the nucleotide sequence of VGAM2164 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2164 RNA, herein designated VGAM RNA, may have a different number of host target binding sites in untranslated regions of a VGAM2164 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2164 RNA, herein designated VGAM RNA, to host target binding sites on VGAM2164 host target RNA, herein designated VGAM HOST TARGET RNA, such as BINDING SITE I, BINDING SITE II and BINDING SITE III, inhibits translation of VGAM2164 host target RNA into VGAM2164 host target protein, herein designated VGAM HOST TARGET PROTEIN. VGAM host target protein is therefore outlined by a broken line.

It is appreciated that VGAM2164 host target gene, herein designated VGAM HOST TARGET GENE, in fact represents a plurality of VGAM2164 host target genes. The mRNA of each one of this plurality of VGAM2164 host target genes comprises one or more host target binding sites, each having a nucleotide sequence which is at least partly complementary to VGAM2164 RNA, herein designated VGAM RNA, and which when bound by VGAM2164 RNA causes inhibition of translation of respective one or more VGAM2164 host target proteins.

It is further appreciated by one skilled in the art that the mode of translational inhibition illustrated by FIG. 1 with specific reference to translational inhibition exerted by VGAM2164 gene, herein designated VGAM GENE, on one or more VGAM2164 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2164 is inhibition of expression of host target genes, as part of a novel viral mechanism of attacking a host. Accordingly, utilities of VGAM2164 include diagnosis, prevention and treatment of viral infection by Parsnip Yellow Fleck Virus. Specific functions, and accordingly utilities, of VGAM2164 correlate with, and may be deduced from, the identity of the host target genes which VGAM2164 binds and inhibits, and the function of these host target genes, as elaborated hereinbelow.

Nucleotide sequences of the VGAM2164 precursor RNA, herein designated VGAM PRECURSOR RNA, and of the 'diced' VGAM2164 RNA, herein designated VGAM RNA, and a schematic representation of the secondary folding of VGAM2164 folded precursor RNA, herein designated VGAM FOLDED PRECURSOR RNA, of VGAM2164 are further described hereinbelow with reference to Table 1.

Nucleotide sequences of host target binding sites, such as BINDING SITE-I, BINDING SITE-II and BINDING SITE-III of FIG. 1, found on VGAM2164 host target RNA, and schematic representation of the complementarity of each of these host target binding sites to VGAM2164 RNA, herein designated VGAM RNA, are described hereinbelow with reference to Table 2.

As mentioned hereinabove with reference to FIG. 1, a function of VGAM2164 gene, herein designated VGAM is inhibition of expression of VGAM2164 target genes. It is appreciated that specific functions, and accordingly utilities, of VGAM2164 correlate with, and may be deduced from, the identity of the target genes which VGAM2164 binds and inhibits, and the function of these target genes, as elaborated hereinbelow.

Interleukin 6 Receptor (IL6R, Accession NM_000565) is a VGAM2164 host target gene. IL6R BINDING SITE is HOST TARGET binding site found in the 3' untranslated region of mRNA encoded by IL6R, corresponding to a HOST TARGET binding site such as BINDING SITE I, BINDING SITE II or BINDING SITE III. Table 2 illustrates the complementarity of the nucleotide sequences of IL6R BINDING SITE, designated SEQ ID:6171, to the nucleotide sequence of VGAM2164 RNA, herein designated VGAM RNA, also designated SEQ ID:4875.

A function of VGAM2164 is therefore inhibition of Interleukin 6 Receptor (IL6R, Accession NM_000565), a gene which is essential to the regulation of the immune response, hematopoiesis, and acute-phase reactions. Accordingly, utilities of VGAM2164 include diagnosis, prevention and treatment of diseases and clinical conditions associated with IL6R. The function of IL6R and its association with various diseases and clinical conditions, has been established by previous studies, as described hereinabove with reference to VGAM1189. XT3 (Accession NM_020208) is another VGAM2164 host target gene. XT3 BINDING SITE is HOST TARGET binding site found in the 3" untranslated region of mRNA encoded by XT3, corresponding to a HOST TARGET binding site such as BINDING SITE I, BINDING SITE II or BINDING SITE III. Table 2 illustrates the complementarity of the nucleotide sequences of XT3 BINDING SITE, designated SEQ ID:21441, to the nucleotide sequence of VGAM2164 RNA, herein designated VGAM RNA, also designated SEQ ID:4875.

Another function of VGAM2164 is therefore inhibition of XT3 (Accession NM_020208), a gene which is a Kidney-specific orphan transporter. Accordingly, utilities of VGAM2164 include diagnosis, prevention and treatment of diseases and clinical conditions associated with XT3. The function of XT3 and its association with various diseases and clinical conditions, has been established by previous studies, as described hereinabove with reference to VGAM21. F-box Only Protein 9 (FBXO9, Accession NM_033480) is another VGAM2164 host target gene. FBXO9 BINDING SITE is HOST TARGET binding site found in the 3' untranslated region of mRNA encoded by FBXO9, corresponding to a HOST TARGET binding site such as BINDING SITE I, BINDING SITE II or BINDING SITE III. Table 2 illustrates the complementarity of the nucleotide sequences of FBXO9 BINDING SITE, designated SEQ ID:27257, to the nucleotide sequence of VGAM2164 RNA, herein designated VGAM RNA, also designated SEQ ID:4875.

Another function of VGAM2164 is therefore inhibition of F-box Only Protein 9 (FBXO9, Accession NM_033480). Accordingly, utilities of VGAM2164 include diagnosis, prevention and treatment of diseases and clinical conditions associated with FBXO9. FLJ14840 (Accession NM_032850) is another VGAM2164 host target gene. FLJ14840 BINDING SITE is HOST TARGET binding site found in the 5' untranslated region of mRNA encoded by FLJ14840, corresponding to a HOST TARGET binding site such as BINDING SITE I, BINDING SITE II or BINDING SITE III. Table 2 illustrates the complementarity of the nucleotide sequences of FLJ14840 BINDING SITE, designated SEQ ID:26644, to the nucleotide sequence of VGAM2164 RNA, herein designated VGAM RNA, also designated SEQ ID:4875.

Another function of VGAM2164 is therefore inhibition of FLJ14840 (Accession NM_032850). Accordingly, utilities of VGAM2164 include diagnosis, prevention and treatment of diseases and clinical conditions associated with FLJ14840. Nup43 (Accession NM_024647) is another VGAM2164 host target gene. Nup43 BINDING SITE is HOST TARGET binding site found in the 3' untranslated region of mRNA encoded by Nup43, corresponding to a HOST TARGET binding site such as BINDING SITE I, BINDING SITE II or BINDING SITE III. Table 2 illustrates the complementarity of the nucleotide sequences of Nup43 BINDING SITE, designated SEQ ID:23932, to the nucleotide sequence of VGAM2164 RNA, herein designated VGAM RNA, also designated SEQ ID:4875.

Another function of VGAM2164 is therefore inhibition of Nup43 (Accession NM_024647). Accordingly, utilities of VGAM2164 include diagnosis, prevention and treatment of diseases and clinical conditions associated with Nup43. PRP8 Pre-mRNA Processing Factor 8 Homolog (yeast) (PRPF8, Accession XM_028335) is another VGAM2164 host target gene. PRPF8 BINDING SITE is HOST TARGET binding site found in the 3' untranslated region of mRNA encoded by PRPF8, corresponding to a HOST TARGET binding site such as BINDING SITE I, BINDING SITE II or BINDING SITE III. Table 2 illustrates the complementarity of the nucleotide sequences of PRPF8 BINDING SITE, designated SEQ ID:30684, to the nucleotide sequence of VGAM2164 RNA, herein designated VGAM RNA, also designated SEQ ID:4875.

Another function of VGAM2164 is therefore inhibition of PRP8 Pre-mRNA Processing Factor 8 Homolog (yeast) (PRPF8, Accession XM_028335). Accordingly, utilities of VGAM2164 include diagnosis, prevention and treatment of diseases and clinical conditions associated with PRPF8. YME1-like 1 (S. cerevisiae) (YME1L1, Accession NM_139312) is another VGAM2164 host target gene. YME1L1 BINDING SITE1 and YME1L1 BINDING SITE2 are HOST TARGET binding sites found in untranslated regions of mRNA encoded by YME1L1, corresponding to HOST TARGET binding sites such as BINDING SITE I, BINDING SITE II or BINDING SITE III. Table 2 illustrates the complementarity of the nucleotide sequences of YME1L1 BINDING SITE1 and YME1L1 BINDING SITE2, designated SEQ ID:29292 and SEQ ID:15536 respectively, to the nucleotide sequence of VGAM2164 RNA, herein designated VGAM RNA, also designated SEQ ID:4875.

Another function of VGAM2164 is therefore inhibition of YME1-like 1 (S. cerevisiae) (YME1L1, Accession NM_139312). Accordingly, utilities of VGAM2164 include diagnosis, prevention and treatment of diseases and clinical conditions associated with YME1L1. LOC147664 (Accession XM_085826) is another VGAM2164 host target gene. LOC147664 BINDING SITE is HOST TARGET binding site found in the 3' untranslated region of mRNA encoded by LOC147664, corresponding to a HOST TARGET binding site such as BINDING SITE I, BINDING SITE II or BINDING SITE III. Table 2 illustrates the complementarity of the nucleotide sequences of LOC147664 BINDING SITE, designated SEQ ID:38352, to the nucleotide sequence of VGAM2164 RNA, herein designated VGAM RNA, also designated SEQ ID:4875.

Another function of VGAM2164 is therefore inhibition of LOC147664 (Accession XM_085826). Accordingly, utilities of VGAM2164 include diagnosis, prevention and treatment of diseases and clinical conditions associated with LOC147664. LOC51336 (Accession NM_016646) is another VGAM2164 host target gene. LOC51336 BINDING SITE is HOST TARGET binding site found in the 3' untranslated region of mRNA encoded by LOC51336, corresponding to a HOST TARGET binding site such as BINDING SITE I, BINDING SITE II or BINDING SITE III. Table 2 illustrates the complementarity of the nucleotide sequences of LOC51336 BINDING SITE, designated SEQ ID:18755, to the nucleotide sequence of VGAM2164 RNA, herein designated VGAM RNA, also designated SEQ ID:4875.

Another function of VGAM2164 is therefore inhibition of LOC51336 (Accession NM_016646). Accordingly, utilities of VGAM2164 include diagnosis, prevention and treatment of diseases and clinical conditions associated with LOC51336. FIG. 1 further provides a conceptual description of a novel bioinformatically detected viral gene of the present invention, referred to here as Viral Genomic Address Messenger 2165 (VGAM2165) viral gene, which modulates expression of respective host target genes thereof, the function and utility of which host target genes is known in the art.

VGAM2165 is a novel bioinformatically detected regulatory, non protein coding, viral micro RNA (miRNA) gene. The method by which VGAM2165 was detected is described hereinabove with reference to FIGS. 1-8.

VGAM2165 gene, herein designated VGAM GENE, is a viral gene contained in the genome of Camelpox Virus. VGAM2165 host target gene, herein designated VGAM HOST TARGET GENE, is a human gene contained in the human genome.

VGAM2165 gene encodes a VGAM2165 precursor RNA, herein designated VGAM PRECURSOR RNA. Similar to other miRNA genes, and unlike most ordinary genes, VGAM2165 precursor RNA does not encode a protein. A nucleotide sequence identical or highly similar to the nucleotide sequence of VGAM2165 precursor RNA is designated SEQ ID:2151, and is provided hereinbelow with reference to the sequence listing part. Nucleotide sequence SEQ ID:2151 is located at position 196786 relative to the genome of Camelpox Virus.

VGAM2165 precursor RNA folds onto itself, forming VGAM2165 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2165 folded precursor RNA into VGAM2165 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2165 RNA is designated SEQ ID:4876, and is provided hereinbelow with reference to the sequence listing part.

VGAM2165 host target gene, herein designated VGAM HOST TARGET GENE, encodes a corresponding messenger RNA, VGAM2165 host target RNA, herein designated VGAM HOST TARGET RNA. VGAM2165 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2165 RNA, herein designated VGAM RNA, binds complementarily to one or more host target binding sites located in untranslated regions of VGAM2165 host target RNA, herein designated VGAM HOST TARGET RNA. This complementary binding is due to the fact that the nucleotide sequence of VGAM2165 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2165 RNA, herein designated VGAM RNA, may have a different number of host target binding sites in untranslated regions of a VGAM2165 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2165 RNA, herein designated VGAM RNA, to host target binding sites on VGAM2165 host target RNA, herein designated VGAM HOST TARGET RNA, such as BINDING SITE I, BINDING SITE II and BINDING SITE III, inhibits translation of VGAM2165 host target RNA into VGAM2165 host target protein, herein designated VGAM HOST TARGET PROTEIN. VGAM host target protein is therefore outlined by a broken line.

It is appreciated that VGAM2165 host target gene, herein designated VGAM HOST TARGET GENE, in fact represents a plurality of VGAM2165 host target genes. The mRNA of each one of this plurality of VGAM2165 host target genes comprises one or more host target binding sites, each having a nucleotide sequence which is at least partly complementary to VGAM2165 RNA, herein designated VGAM RNA, and which when bound by VGAM2165 RNA causes inhibition of translation of respective one or more VGAM2165 host target proteins.

It is further appreciated by one skilled in the art that the mode of translational inhibition illustrated by FIG. 1 with specific reference to translational inhibition exerted by VGAM2165 gene, herein designated VGAM GENE, on one or more VGAM2165 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2165 is inhibition of expression of host target genes, as part of a novel viral mechanism of attacking a host. Accordingly, utilities of VGAM2165 include diagnosis, prevention and treatment of viral infection by Camelpox Virus. Specific functions, and accordingly utilities, of VGAM2165 correlate with, and may be deduced from, the identity of the host target genes which VGAM2165 binds and inhibits, and the function of these host target genes, as elaborated hereinbelow.

Nucleotide sequences of the VGAM2165 precursor RNA, herein designated VGAM PRECURSOR RNA, and of the 'diced' VGAM2165 RNA, herein designated VGAM RNA, and a schematic representation of the secondary folding of VGAM2165 folded precursor RNA, herein designated VGAM FOLDED PRECURSOR RNA, of VGAM2165 are further described hereinbelow with reference to Table 1.

Nucleotide sequences of host target binding sites, such as BINDING SITE-I, BINDING SITE-II and BINDING SITE-III of FIG. 1, found on VGAM2165 host target RNA, and schematic representation of the complementarity of each of these host target binding sites to VGAM2165 RNA, herein designated VGAM RNA, are described hereinbelow with reference to Table 2.

As mentioned hereinabove with reference to FIG. 1, a function of VGAM2165 gene, herein designated VGAM is inhibition of expression of VGAM2165 target genes. It is appreciated that specific functions, and accordingly utilities, of VGAM2165 correlate with, and may be deduced from, the identity of the target genes which VGAM2165 binds and inhibits, and the function of these target genes, as elaborated hereinbelow.

Ephrin-B2 (EFNB2, Accession NM_004093) is a VGAM2165 host target gene. EFNB2 BINDING SITE is HOST TARGET binding site found in the 3' untranslated region of mRNA encoded by EFNB2, corresponding to a HOST TARGET binding site such as BINDING SITE I, BINDING SITE II or BINDING SITE III. Table 2 illustrates the complementarity of the nucleotide sequences of EFNB2 BINDING SITE, designated SEQ ID:10295, to the nucleotide sequence of VGAM2165 RNA, herein designated VGAM RNA, also designated SEQ ID:4876.

A function of VGAM2165 is therefore inhibition of Ephrin-B2 (EFNB2, Accession NM_004093). Accordingly, utilities of VGAM2165 include diagnosis, prevention and treatment of diseases and clinical conditions associated with EFNB2. Erythrocyte Membrane Protein Band 4.1-like 1 (EPB41L1, Accession XM_047295) is another VGAM2165 host target gene. EPB41L1 BINDING SITE is HOST TARGET binding site found in the 3' untranslated region of mRNA encoded by EPB41L1, corresponding to a HOST TARGET binding site such as BINDING SITE I, BINDING SITE II or BINDING SITE III. Table 2 illustrates the complementarity of the nucleotide sequences of EPB41L1 BINDING SITE, designated SEQ ID:34938, to the nucleotide sequence of VGAM2165 RNA, herein designated VGAM RNA, also designated SEQ ID:4876.

Another function of VGAM2165 is therefore inhibition of Erythrocyte Membrane Protein Band 4.1-like 1 (EPB41L1, Accession XM_047295). Accordingly, utilities of VGAM2165 include diagnosis, prevention and treatment of diseases and clinical conditions associated with EPB41L1. GABA(A) Receptors Associated Protein Like 3

(GABARAPL3, Accession NM_032568) is another VGAM2165 host target gene. GABARAPL3 BINDING SITE is HOST TARGET binding site found in the 3' untranslated region of mRNA encoded by GABARAPL3, corresponding to a HOST TARGET binding site such as BINDING SITE I, BINDING SITE II or BINDING SITE III. Table 2 illustrates the complementarity of the nucleotide sequences of GABARAPL3 BINDING SITE, designated SEQ ID:26295, to the nucleotide sequence of VGAM2165 RNA, herein designated VGAM RNA, also designated SEQ ID:4876.

Another function of VGAM2165 is therefore inhibition of GABA(A) Receptors Associated Protein Like 3 (GABARAPL3, Accession NM_032568). Accordingly, utilities of VGAM2165 include diagnosis, prevention and treatment of diseases and clinical conditions associated with GABARAPL3. KIAA0265 (Accession XM_045954) is another VGAM2165 host target gene. KIAA0265 BINDING SITE is HOST TARGET binding site found in the 3" untranslated region of mRNA encoded by KIAA0265, corresponding to a HOST TARGET binding site such as BINDING SITE I, BINDING SITE II or BINDING SITE III. Table 2 illustrates the complementarity of the nucleotide sequences of KIAA0265 BINDING SITE, designated SEQ ID:34621, to the nucleotide sequence of VGAM2165 RNA, herein designated VGAM RNA, also designated SEQ ID:4876.

Another function of VGAM2165 is therefore inhibition of KIAA0265 (Accession XM_045954). Accordingly, utilities of VGAM2165 include diagnosis, prevention and treatment of diseases and clinical conditions associated with KIAA0265. MGC13105 (Accession XM_049394) is another VGAM2165 host target gene. MGC13105 BINDING SITE is HOST TARGET binding site found in the 3' untranslated region of mRNA encoded by MGC13105, corresponding to a HOST TARGET binding site such as BINDING SITE I, BINDING SITE II or BINDING SITE III. Table 2 illustrates the complementarity of the nucleotide sequences of MGC13105 BINDING SITE, designated SEQ ID:35407, to the nucleotide sequence of VGAM2165 RNA, herein designated VGAM RNA, also designated SEQ ID:4876.

Another function of VGAM2165 is therefore inhibition of MGC13105 (Accession XM_049394). Accordingly, utilities of VGAM2165 include diagnosis, prevention and treatment of diseases and clinical conditions associated with MGC13105. LOC222681 (Accession XM_167116) is another VGAM2165 host target gene. LOC222681 BINDING SITE is HOST TARGET binding site found in the 3' untranslated region of mRNA encoded by LOC222681, corresponding to a HOST TARGET binding site such as BINDING SITE I, BINDING SITE II or BINDING SITE III. Table 2 illustrates the complementarity of the nucleotide sequences of LOC222681 BINDING SITE, designated SEQ ID:44606, to the nucleotide sequence of VGAM2165 RNA, herein designated VGAM RNA, also designated SEQ ID:4876.

Another function of VGAM2165 is therefore inhibition of LOC222681 (Accession XM_167116). Accordingly, utilities of VGAM2165 include diagnosis, prevention and treatment of diseases and clinical conditions associated with LOC222681. LOC255995 (Accession XM_173071) is another VGAM2165 host target gene. LOC255995 BINDING SITE is HOST TARGET binding site found in the 5' untranslated region of mRNA encoded by LOC255995, corresponding to a HOST TARGET binding site such as BINDING SITE I, BINDING SITE II or BINDING SITE III. Table 2 illustrates the complementarity of the nucleotide sequences of LOC255995 BINDING SITE, designated SEQ ID:46323, to the nucleotide sequence of VGAM2165 RNA, herein designated VGAM RNA, also designated SEQ ID:4876.

Another function of VGAM2165 is therefore inhibition of LOC255995 (Accession XM_173071). Accordingly, utilities of VGAM2165 include diagnosis, prevention and treatment of diseases and clinical conditions associated with LOC255995. LOC257507 (Accession XM_175204) is another VGAM2165 host target gene. LOC257507 BINDING SITE is HOST TARGET binding site found in the 3' untranslated region of mRNA encoded by LOC257507, corresponding to a HOST TARGET binding site such as BINDING SITE I, BINDING SITE II or BINDING SITE III. Table 2 illustrates the complementarity of the nucleotide sequences of LOC257507 BINDING SITE, designated SEQ ID:46672, to the nucleotide sequence of VGAM2165 RNA, herein designated VGAM RNA, also designated SEQ ID:4876.

Another function of VGAM2165 is therefore inhibition of LOC257507 (Accession XM_175204). Accordingly, utilities of VGAM2165 include diagnosis, prevention and treatment of diseases and clinical conditions associated with LOC257507. LOC257625 (Accession XM_175267) is another VGAM2165 host target gene. LOC257625 BINDING SITE is HOST TARGET binding site found in the 3' untranslated region of mRNA encoded by LOC257625, corresponding to a HOST TARGET binding site such as BINDING SITE I, BINDING SITE II or BINDING SITE III. Table 2 illustrates the complementarity of the nucleotide sequences of LOC257625 BINDING SITE, designated SEQ ID:46728, to the nucleotide sequence of VGAM2165 RNA, herein designated VGAM RNA, also designated SEQ ID:4876.

Another function of VGAM2165 is therefore inhibition of LOC257625 (Accession XM_175267). Accordingly, utilities of VGAM2165 include diagnosis, prevention and treatment of diseases and clinical conditions associated with LOC257625. LOC90777 (Accession XM_034052) is another VGAM2165 host target gene. LOC90777 BINDING SITE is HOST TARGET binding site found in the 3' untranslated region of mRNA encoded by LOC90777, corresponding to a HOST TARGET binding site such as BINDING SITE I, BINDING SITE II or BINDING SITE III. Table 2 illustrates the complementarity of the nucleotide sequences of LOC90777 BINDING SITE, designated SEQ ID:31991, to the nucleotide sequence of VGAM2165 RNA, herein designated VGAM RNA, also designated SEQ ID:4876.

Another function of VGAM2165 is therefore inhibition of LOC90777 (Accession XM_034052). Accordingly, utilities of VGAM2165 include diagnosis, prevention and treatment of diseases and clinical conditions associated with LOC90777. FIG. 1 further provides a conceptual description of a novel bioinformatically detected viral gene of the present invention, referred to here as Viral Genomic Address Messenger 2166 (VGAM2166) viral gene, which modulates expression of respective host target genes thereof, the function and utility of which host target genes is known in the art.

VGAM2166 is a novel bioinformatically detected regulatory, non protein coding, viral micro RNA (miRNA) gene. The method by which VGAM2166 was detected is described hereinabove with reference to FIGS. 1-8.

VGAM2166 gene, herein designated VGAM GENE, is a viral gene contained in the genome of Camelpox Virus. VGAM2166 host target gene, herein designated VGAM HOST TARGET GENE, is a human gene contained in the human genome.

VGAM2166 gene encodes a VGAM2166 precursor RNA, herein designated VGAM PRECURSOR RNA. Similar to other miRNA genes, and unlike most ordinary genes, VGAM2166 precursor RNA does not encode a protein. A nucleotide sequence identical or highly similar to the nucleotide sequence of VGAM2166 precursor RNA is designated SEQ ID:2152, and is provided hereinbelow with reference to the sequence listing part. Nucleotide sequence SEQ ID:2152 is located at position 186373 relative to the genome of Camelpox Virus.

VGAM2166 precursor RNA folds onto itself, forming VGAM2166 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2166 folded precursor RNA into VGAM2166 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2166 RNA is designated SEQ ID:4877, and is provided hereinbelow with reference to the sequence listing part.

VGAM2166 host target gene, herein designated VGAM HOST TARGET GENE, encodes a corresponding messenger RNA, VGAM2166 host target RNA, herein designated VGAM HOST TARGET RNA. VGAM2166 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2166 RNA, herein designated VGAM RNA, binds complementarily to one or more host target binding sites located in untranslated regions of VGAM2166 host target RNA, herein designated VGAM HOST TARGET RNA. This complementary binding is due to the fact that the nucleotide sequence of VGAM2166 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2166 RNA, herein designated VGAM RNA, may have a different number of host target binding sites in untranslated regions of a VGAM2166 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2166 RNA, herein designated VGAM RNA, to host target binding sites on VGAM2166 host target RNA, herein designated VGAM HOST TARGET RNA, such as BINDING SITE I, BINDING SITE II and BINDING SITE III, inhibits translation of VGAM2166 host target RNA into VGAM2166 host target protein, herein designated VGAM HOST TARGET PROTEIN. VGAM host target protein is therefore outlined by a broken line.

It is appreciated that VGAM2166 host target gene, herein designated VGAM HOST TARGET GENE, in fact represents a plurality of VGAM2166 host target genes. The mRNA of each one of this plurality of VGAM2166 host target genes comprises one or more host target binding sites, each having a nucleotide sequence which is at least partly complementary to VGAM2166 RNA, herein designated VGAM RNA, and which when bound by VGAM2166 RNA causes inhibition of translation of respective one or more VGAM2166 host target proteins.

It is further appreciated by one skilled in the art that the mode of translational inhibition illustrated by FIG. 1 with specific reference to translational inhibition exerted by VGAM2166 gene, herein designated VGAM GENE, on one or more VGAM2166 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2166 is inhibition of expression of host target genes, as part of a novel viral mechanism of attacking a host. Accordingly, utilities of VGAM2166 include diagnosis, prevention and treatment of viral infection by Camelpox Virus. Specific functions, and accordingly utilities, of VGAM2166 correlate with, and may be deduced from, the identity of the host target genes which VGAM2166 binds and inhibits, and the function of these host target genes, as elaborated hereinbelow.

Nucleotide sequences of the VGAM2166 precursor RNA, herein designated VGAM PRECURSOR RNA, and of the 'diced' VGAM2166 RNA, herein designated VGAM RNA, and a schematic representation of the secondary folding of VGAM2166 folded precursor RNA, herein designated VGAM FOLDED PRECURSOR RNA, of VGAM2166 are further described hereinbelow with reference to Table 1.

Nucleotide sequences of host target binding sites, such as BINDING SITE-I, BINDING SITE-II and BINDING SITE-III of FIG. 1, found on VGAM2166 host target RNA, and schematic representation of the complementarity of each of these host target binding sites to VGAM2166 RNA, herein designated VGAM RNA, are described hereinbelow with reference to Table 2.

As mentioned hereinabove with reference to FIG. 1, a function of VGAM2166 gene, herein designated VGAM is inhibition of expression of VGAM2166 target genes. It is appreciated that specific functions, and accordingly utilities, of VGAM2166 correlate with, and may be deduced from, the identity of the target genes which VGAM2166 binds and inhibits, and the function of these target genes, as elaborated hereinbelow.

BIG1 (Accession NM_006421) is a VGAM2166 host target gene. BIG1 BINDING SITE is HOST TARGET binding site found in the 3' untranslated region of mRNA encoded by BIG1, corresponding to a HOST TARGET binding site such as BINDING SITE I, BINDING SITE II or BINDING SITE III. Table 2 illustrates the complementarity of the nucleotide sequences of BIG1 BINDING SITE, designated SEQ ID:13138, to the nucleotide sequence of VGAM2166 RNA, herein designated VGAM RNA, also designated SEQ ID:4877.

A function of VGAM2166 is therefore inhibition of BIG1 (Accession NM_006421), a gene which is a guanine nucleotide-exchange protein, has a role in vesicular transport.

Accordingly, utilities of VGAM2166 include diagnosis, prevention and treatment of diseases and clinical conditions associated with BIG1. The function of BIG1 and its association with various diseases and clinical conditions, has been established by previous studies, as described hereinabove with reference to VGAM1190. E2F Transcription Factor 3 (E2F3, Accession NM_001949) is another VGAM2166 host target gene. E2F3 BINDING SITE is HOST TARGET binding site found in the 3' untranslated region of mRNA encoded by E2F3, corresponding to a HOST TARGET binding site such as BINDING SITE I, BINDING SITE II or BINDING SITE III. Table 2 illustrates the complementarity of the nucleotide sequences of E2F3 BINDING SITE, designated SEQ ID:7669, to the nucleotide sequence of VGAM2166 RNA, herein designated VGAM RNA, also designated SEQ ID:4877.

Another function of VGAM2166 is therefore inhibition of E2F Transcription Factor 3 (E2F3, Accession NM_001949), a gene which binds dna and controls cell-cycle progression from g1 to s phase. Accordingly, utilities of VGAM2166 include diagnosis, prevention and treatment of diseases and clinical conditions associated with E2F3. The function of E2F3 and its association with various diseases and clinical conditions, has been established by previous studies, as described hereinabove with reference to VGAM475. Potassium Channel, Subfamily K, Member 6 (KCNK6, Accession NM_004823) is another VGAM2166 host target gene. KCNK6 BINDING SITE is HOST TARGET binding site found in the 3' untranslated region of mRNA encoded by KCNK6, corresponding to a HOST TARGET binding site such as BINDING SITE I, BINDING SITE II or BINDING SITE III. Table 2 illustrates the complementarity of the nucleotide sequences of KCNK6 BINDING SITE, designated SEQ ID:11239, to the nucleotide sequence of VGAM2166 RNA, herein designated VGAM RNA, also designated SEQ ID:4877.

Another function of VGAM2166 is therefore inhibition of Potassium Channel, Subfamily K, Member 6 (KCNK6, Accession NM_004823), a gene which is an inward rectifying potassium channel protein. Accordingly, utilities of VGAM2166 include diagnosis, prevention and treatment of diseases and clinical conditions associated with KCNK6. The function of KCNK6 and its association with various diseases and clinical conditions, has been established by previous studies, as described hereinabove with reference to VGAM1190. RNA Binding Motif Protein 8A (RBM8A, Accession NM_005105) is another VGAM2166 host target gene. RBM8A BINDING SITE is HOST TARGET binding site found in the 3' untranslated region of mRNA encoded by RBM8A, corresponding to a HOST TARGET binding site such as BINDING SITE I, BINDING SITE II or BINDING SITE III. Table 2 illustrates the complementarity of the nucleotide sequences of RBM8A BINDING SITE, designated SEQ ID:11577, to the nucleotide sequence of VGAM2166 RNA, herein designated VGAM RNA, also designated SEQ ID:4877.

Another function of VGAM2166 is therefore inhibition of RNA Binding Motif Protein 8A (RBM8A, Accession NM_005105), a gene which involves in the pathway of gene expression postsplicing nuclear preexport mRNPs, and newly exported cytoplasmic mRNPs. Accordingly, utilities of VGAM2166 include diagnosis, prevention and treatment of diseases and clinical conditions associated with RBM8A. The function of RBM8A and its association with various diseases and clinical conditions, has been established by previous studies, as described hereinabove with reference to VGAM1864. Stearoyl-CoA Desaturase (delta-9-desaturase) (SCD, Accession NM_005063) is another VGAM2166 host target gene. SCD BINDING SITE is HOST TARGET binding site found in the 3' untranslated region of mRNA encoded by SCD, corresponding to a HOST TARGET binding site such as BINDING SITE I, BINDING SITE II or BINDING SITE III. Table 2 illustrates the complementarity of the nucleotide sequences of SCD BINDING SITE, designated SEQ ID:11494, to the nucleotide sequence of VGAM2166 RNA, herein designated VGAM RNA, also designated SEQ ID:4877.

Another function of VGAM2166 is therefore inhibition of Stearoyl-CoA Desaturase (delta-9-desaturase) (SCD, Accession NM_005063), a gene which functions in the synthesis of unsaturated fatty acids. Accordingly, utilities of VGAM2166 include diagnosis, prevention and treatment of diseases and clinical conditions associated with SCD. The function of SCD and its association with various diseases and clinical conditions, has been established by previous studies, as described hereinabove with reference to VGAM314. H2AV (Accession NM_138635) is another VGAM2166 host target gene. H2AV BINDING SITE is HOST TARGET binding site found in the 3' untranslated region of mRNA encoded by H2AV, corresponding to a HOST TARGET binding site such as BINDING SITE I, BINDING SITE II or BINDING SITE III. Table 2 illustrates the complementarity of the nucleotide sequences of H2AV BINDING SITE, designated SEQ ID:28909, to the nucleotide sequence of VGAM2166 RNA, herein designated VGAM RNA, also designated SEQ ID:4877.

Another function of VGAM2166 is therefore inhibition of H2AV (Accession NM_138635). Accordingly, utilities of VGAM2166 include diagnosis, prevention and treatment of diseases and clinical conditions associated with H2AV. KIAA0410 (Accession NM_014778) is another VGAM2166 host target gene. KIAA0410 BINDING SITE is HOST TARGET binding site found in the 3' untranslated region of mRNA encoded by KIAA0410, corresponding to a HOST TARGET binding site such as BINDING SITE I, BINDING SITE II or BINDING SITE III. Table 2 illustrates the complementarity of the nucleotide sequences of KIAA0410 BINDING SITE, designated SEQ ID:16621, to the nucleotide sequence of VGAM2166 RNA, herein designated VGAM RNA, also designated SEQ ID:4877.

Another function of VGAM2166 is therefore inhibition of KIAA0410 (Accession NM_014778). Accordingly, utilities of VGAM2166 include diagnosis, prevention and treatment of diseases and clinical conditions associated with KIAA0410. KIAA0795 (Accession NM_025010) is another VGAM2166 host target gene. KIAA0795 BINDING SITE is HOST TARGET binding site found in the 3' untranslated region of mRNA encoded by KIAA0795, corresponding to a HOST TARGET binding site such as BINDING SITE I, BINDING SITE II or BINDING SITE III. Table 2 illustrates the complementarity of the nucleotide sequences of KIAA0795 BINDING SITE, designated SEQ ID:24582, to the nucleotide sequence of VGAM2166 RNA, herein designated VGAM RNA, also designated SEQ ID:4877.

Another function of VGAM2166 is therefore inhibition of KIAA0795 (Accession NM_025010). Accordingly, utilities of VGAM2166 include diagnosis, prevention and treatment of diseases and clinical conditions associated with KIAA0795. KIAA1786 (Accession XM_038436) is another VGAM2166 host target gene. KIAA1786 BINDING SITE is HOST TARGET binding site found in the 3' untranslated region of mRNA encoded by KIAA1786, corresponding to a HOST TARGET binding site such as BINDING SITE I, BINDING SITE II or BINDING SITE III. Table 2 illustrates the complementarity of the nucleotide sequences of KIAA1786 BINDING SITE, designated SEQ ID:32846, to the nucleotide sequence of VGAM2166 RNA, herein designated VGAM RNA, also designated SEQ ID:4877.

Another function of VGAM2166 is therefore inhibition of KIAA1786 (Accession XM_038436). Accordingly, utilities of VGAM2166 include diagnosis, prevention and treatment of diseases and clinical conditions associated with KIAA1786. KIAA1900 (Accession XM_055299) is another VGAM2166 host target gene. KIAA1900 BINDING SITE is HOST TARGET binding site found in the 3' untranslated region of mRNA encoded by KIAA1900, corresponding to a HOST TARGET binding site such as BINDING SITE I, BINDING SITE II or BINDING SITE III. Table 2 illustrates the complementarity of the nucleotide sequences of KIAA1900 BINDING SITE, designated SEQ ID:36262, to the nucleotide sequence of VGAM2166 RNA, herein designated VGAM RNA, also designated SEQ ID:4877.

Another function of VGAM2166 is therefore inhibition of KIAA1900 (Accession XM_055299). Accordingly, utilities of VGAM2166 include diagnosis, prevention and treatment of diseases and clinical conditions associated with KIAA1900. RAP140 (Accession NM_015224) is another VGAM2166 host target gene. RAP140 BINDING SITE is HOST TARGET binding site found in the 3' untranslated region of mRNA encoded by RAP140, corresponding to a HOST TARGET binding site such as BINDING SITE I, BINDING SITE II or BINDING SITE III. Table 2 illustrates the complementarity of the nucleotide sequences of RAP140 BINDING SITE, designated SEQ ID:17559, to the nucleotide sequence of VGAM2166 RNA, herein designated VGAM RNA, also designated SEQ ID:4877.

Another function of VGAM2166 is therefore inhibition of RAP140 (Accession NM_015224). Accordingly, utilities of VGAM2166 include diagnosis, prevention and treatment of diseases and clinical conditions associated with RAP140. RNA Binding Motif Protein 7 (RBM7, Accession NM_016090) is another VGAM2166 host target gene. RBM7 BINDING SITE is HOST TARGET binding site found in the 3' untranslated region of mRNA encoded by RBM7, corresponding to a HOST TARGET binding site such as BINDING SITE I, BINDING SITE II or BINDING SITE III. Table 2 illustrates the complementarity of the nucleotide sequences of RBM7 BINDING SITE, designated SEQ ID:18179, to the nucleotide sequence of VGAM2166 RNA, herein designated VGAM RNA, also designated SEQ ID:4877.

Another function of VGAM2166 is therefore inhibition of RNA Binding Motif Protein 7 (RBM7, Accession NM_016090). Accordingly, utilities of VGAM2166 include diagnosis, prevention and treatment of diseases and clinical conditions associated with RBM7. LOC145820 (Accession XM_085246) is another VGAM2166 host target gene. LOC145820 BINDING SITE is HOST TARGET binding site found in the 3' untranslated region of mRNA encoded by LOC145820, corresponding to a HOST TARGET binding site such as BINDING SITE I, BINDING SITE II or BINDING SITE III. Table 2 illustrates the complementarity of the nucleotide sequences of LOC145820 BINDING SITE, designated SEQ ID:37988, to the nucleotide sequence of VGAM2166 RNA, herein designated VGAM RNA, also designated SEQ ID:4877.

Another function of VGAM2166 is therefore inhibition of LOC145820 (Accession XM_085246). Accordingly, utilities of VGAM2166 include diagnosis, prevention and treatment of diseases and clinical conditions associated with LOC145820. LOC150587 (Accession XM_097917) is another VGAM2166 host target gene. LOC150587 BINDING SITE is HOST TARGET binding site found in the 3' untranslated region of mRNA encoded by LOC150587, corresponding to a HOST TARGET binding site such as BINDING SITE I, BINDING SITE II or BINDING SITE III. Table 2 illustrates the complementarity of the nucleotide sequences of LOC150587 BINDING SITE, designated SEQ ID:41213, to the nucleotide sequence of VGAM2166 RNA, herein designated VGAM RNA, also designated SEQ ID:4877.

Another function of VGAM2166 is therefore inhibition of LOC150587 (Accession XM_097917). Accordingly, utilities of VGAM2166 include diagnosis, prevention and treatment of diseases and clinical conditions associated with LOC150587. LOC197003 (Accession XM_113798) is another VGAM2166 host target gene. LOC197003 BINDING SITE is HOST TARGET binding site found in the 3' untranslated region of mRNA encoded by LOC197003, corresponding to a HOST TARGET binding site such as BINDING SITE I, BINDING SITE II or BINDING SITE III. Table 2 illustrates the complementarity of the nucleotide sequences of LOC197003 BINDING SITE, designated SEQ ID:42443, to the nucleotide sequence of VGAM2166 RNA, herein designated VGAM RNA, also designated SEQ ID:4877.

Another function of VGAM2166 is therefore inhibition of LOC197003 (Accession XM_113798). Accordingly, utilities of VGAM2166 include diagnosis, prevention and treatment of diseases and clinical conditions associated with LOC197003. LOC54505 (Accession XM_042110) is another VGAM2166 host target gene. LOC54505 BINDING SITE is HOST TARGET binding site found in the 5' untranslated region of mRNA encoded by LOC54505, corresponding to a HOST TARGET binding site such as BINDING SITE I, BINDING SITE II or BINDING SITE III. Table 2 illustrates the complementarity of the nucleotide sequences of LOC54505 BINDING SITE, designated SEQ ID:33696, to the nucleotide sequence of VGAM2166 RNA, herein designated VGAM RNA, also designated SEQ ID:4877.

Another function of VGAM2166 is therefore inhibition of LOC54505 (Accession XM_042110). Accordingly, utilities of VGAM2166 include diagnosis, prevention and treatment of diseases and clinical conditions associated with LOC54505. FIG. 1 further provides a conceptual description of a novel bioinformatically detected viral gene of the present invention, referred to here as Viral Genomic Address Messenger 2167 (VGAM2167) viral gene, which modulates expression of respective host target genes thereof, the function and utility of which host target genes is known in the art.

VGAM2167 is a novel bioinformatically detected regulatory, non protein coding, viral micro RNA (miRNA) gene. The method by which VGAM2167 was detected is described hereinabove with reference to FIGS. 1-8.

VGAM2167 gene, herein designated VGAM GENE, is a viral gene contained in the genome of Parsnip Yellow Fleck Virus. VGAM2167 host target gene, herein designated VGAM HOST TARGET GENE, is a human gene contained in the human genome.

VGAM2167 gene encodes a VGAM2167 precursor RNA, herein designated VGAM PRECURSOR RNA. Similar to other miRNA genes, and unlike most ordinary genes, VGAM2167 precursor RNA does not encode a protein. A nucleotide sequence identical or highly similar to the nucleotide sequence of VGAM2167 precursor RNA is designated SEQ ID:2153, and is provided hereinbelow with reference to the sequence listing part. Nucleotide sequence SEQ ID:2153 is located at position 7389 relative to the genome of Parsnip Yellow Fleck Virus.

VGAM2167 precursor RNA folds onto itself, forming VGAM2167 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2167 folded precursor RNA into VGAM2167 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM2167 RNA is designated SEQ ID:4878, and is provided hereinbelow with reference to the sequence listing part.

VGAM2167 host target gene, herein designated VGAM HOST TARGET GENE, encodes a corresponding messenger RNA, VGAM2167 host target RNA, herein designated VGAM HOST TARGET RNA. VGAM2167 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2167 RNA, herein designated VGAM RNA, binds complementarily to one or more host target binding sites located in untranslated regions of VGAM2167 host target RNA, herein designated VGAM HOST TARGET RNA. This complementary binding is due to the fact that the nucleotide sequence of VGAM2167 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2167 RNA, herein designated VGAM RNA, may have a different number of host target binding sites in untranslated regions of a VGAM2167 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2167 RNA, herein designated VGAM RNA, to host target binding sites on VGAM2167 host target RNA, herein designated VGAM HOST TARGET RNA, such as BINDING SITE I, BINDING SITE II and BINDING SITE III, inhibits translation of VGAM2167 host target RNA into VGAM2167 host target protein, herein designated VGAM HOST TARGET PROTEIN. VGAM host target protein is therefore outlined by a broken line.

It is appreciated that VGAM2167 host target gene, herein designated VGAM HOST TARGET GENE, in fact represents a plurality of VGAM2167 host target genes. The mRNA of each one of this plurality of VGAM2167 host target genes comprises one or more host target binding sites, each having a nucleotide sequence which is at least partly complementary to VGAM2167 RNA, herein designated VGAM RNA, and which when bound by VGAM2167 RNA causes inhibition of translation of respective one or more VGAM2167 host target proteins.

It is further appreciated by one skilled in the art that the mode of translational inhibition illustrated by FIG. 1 with specific reference to translational inhibition exerted by VGAM2167 gene, herein designated VGAM GENE, on one or more VGAM2167 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2167 is inhibition of expression of host target genes, as part of a novel viral mechanism of attacking a host. Accordingly, utilities of VGAM2167 include diagnosis, prevention and treatment of viral infection by Parsnip Yellow Fleck Virus. Specific functions, and accordingly utilities, of VGAM2167 correlate with, and may be deduced from, the identity of the host target genes which VGAM2167 binds and inhibits, and the function of these host target genes, as elaborated hereinbelow.

Nucleotide sequences of the VGAM2167 precursor RNA, herein designated VGAM PRECURSOR RNA, and of the 'diced' VGAM2167 RNA, herein designated VGAM RNA, and a schematic representation of the secondary folding of VGAM2167 folded precursor RNA, herein designated VGAM FOLDED PRECURSOR RNA, of VGAM2167 are further described hereinbelow with reference to Table 1.

Nucleotide sequences of host target binding sites, such as BINDING SITE-I, BINDING SITE-II and BINDING SITE-III of FIG. 1, found on VGAM2167 host target RNA, and schematic representation of the complementarity of each of these host target binding sites to VGAM2167 RNA, herein designated VGAM RNA, are described hereinbelow with reference to Table 2.

As mentioned hereinabove with reference to FIG. 1, a function of VGAM2167 gene, herein designated VGAM is inhibition of expression of VGAM2167 target genes. It is appreciated that specific functions, and accordingly utilities, of VGAM2167 correlate with, and may be deduced from, the identity of the target genes which VGAM2167 binds and inhibits, and the function of these target genes, as elaborated hereinbelow.

Fibroblast Growth Factor 12 (FGF12, Accession NM_021032) is a VGAM2167 host target gene. FGF12 BINDING SITE is HOST TARGET binding site found in the 3' untranslated region of mRNA encoded by FGF12, corresponding to a HOST TARGET binding site such as BINDING SITE I, BINDING SITE II or BINDING SITE III. Table 2 illustrates the complementarity of the nucleotide sequences of FGF12 BINDING SITE, designated SEQ ID:22020, to the nucleotide sequence of VGAM2167 RNA, herein designated VGAM RNA, also designated SEQ ID:4878.

A function of VGAM2167 is therefore inhibition of Fibroblast Growth Factor 12 (FGF12, Accession NM_021032), a gene which probably involved in nervous system development and function. Accordingly, utilities of VGAM2167 include diagnosis, prevention and treatment of diseases and clinical conditions associated with FGF12. The function of FGF12 and its association with various diseases and clinical conditions, has been established by previous studies, as described hereinabove with reference to VGAM1025.

DKFZP434G1411 (Accession XM_166383) is another VGAM2167 host target gene. DKFZP434G1411 BINDING SITE is HOST TARGET binding site found in the 3' untranslated region of mRNA encoded by DKFZP434G1411, corresponding to a HOST TARGET binding site such as BINDING SITE I, BINDING SITE II or BINDING SITE III. Table 2 illustrates the complementarity of the nucleotide sequences of DKFZP434G1411 BINDING SITE, designated SEQ ID:44233, to the nucleotide sequence of VGAM2167 RNA, herein designated VGAM RNA, also designated SEQ ID:4878.

Another function of VGAM2167 is therefore inhibition of DKFZP434G1411 (Accession XM_166383). Accordingly, utilities of VGAM2167 include diagnosis, prevention and treatment of diseases and clinical conditions associated with DKFZP434G1411. Golgi Reassembly Stacking Protein 2, 55 kDa (GORASP2, Accession NM_015530) is another VGAM2167 host target gene. GORASP2 BINDING SITE is HOST TARGET binding site found in the 3' untranslated region of mRNA encoded by GORASP2, corresponding to a HOST TARGET binding site such as BINDING SITE I, BINDING SITE II or BINDING SITE III. Table 2 illustrates the complementarity of the nucleotide sequences of GORASP2 BINDING SITE, designated SEQ ID:17797, to the nucleotide sequence of VGAM2167 RNA, herein designated VGAM RNA, also designated SEQ ID:4878.

Another function of VGAM2167 is therefore inhibition of Golgi Reassembly Stacking Protein 2, 55 kDa (GORASP2, Accession NM_015530). Accordingly, utilities of VGAM2167 include diagnosis, prevention and treatment of diseases and clinical conditions associated with GORASP2. KIAA1396 (Accession XM_032054) is another VGAM2167 host target gene. KIAA1396 BINDING SITE is HOST TARGET binding site found in the 3" untranslated region of mRNA encoded by KIAA1396, corresponding to a HOST TARGET binding site such as BINDING SITE I, BINDING SITE II or BINDING SITE III. Table 2 illustrates the complementarity of the nucleotide sequences of KIAA1396 BINDING SITE, designated SEQ ID:31545, to the nucleotide sequence of VGAM2167 RNA, herein designated VGAM RNA, also designated SEQ ID:4878.

Another function of VGAM2167 is therefore inhibition of KIAA1396 (Accession XM_032054). Accordingly, utilities of VGAM2167 include diagnosis, prevention and treatment of diseases and clinical conditions associated with KIAA1396. LOC220936 (Accession XM_166137) is another VGAM2167 host target gene. LOC220936 BINDING SITE is HOST TARGET binding site found in the 3' untranslated region of mRNA encoded by LOC220936, corresponding to a HOST TARGET binding site such as BINDING SITE I, BINDING SITE II or BINDING SITE III. Table 2 illustrates the complementarity of the nucleotide sequences of LOC220936 BINDING SITE, designated SEQ ID:43932, to the nucleotide sequence of VGAM2167 RNA, herein designated VGAM RNA, also designated SEQ ID:4878.

Another function of VGAM2167 is therefore inhibition of LOC220936 (Accession XM_166137). Accordingly, utilities of VGAM2167 include diagnosis, prevention and treatment of diseases and clinical conditions associated with LOC220936. FIG. 1 further provides a conceptual description of a novel bioinformatically detected viral gene of the present invention, referred to here as Viral Genomic Address Messenger 2168 (VGAM2168) viral gene, which modulates expression of respective host target genes thereof, the function and utility of which host target genes is known in the art.

VGAM2168 is a novel bioinformatically detected regulatory, non protein coding, viral micro RNA (miRNA) gene. The method by which VGAM2168 was detected is described hereinabove with reference to FIGS. 1-8.

VGAM2168 gene, herein designated VGAM GENE, is a viral gene contained in the genome of Parsnip Yellow Fleck Virus. VGAM2168 host target gene, herein designated VGAM HOST TARGET GENE, is a human gene contained in the human genome.

VGAM2168 gene encodes a VGAM2168 precursor RNA, herein designated VGAM PRECURSOR RNA. Similar to other miRNA genes, and unlike most ordinary genes, VGAM2168 precursor RNA does not encode a protein. A nucleotide sequence identical or highly similar to the nucleotide sequence of VGAM2168 precursor RNA is designated SEQ ID:2154, and is provided hereinbelow with reference to the sequence listing part. Nucleotide sequence SEQ ID:2154 is located at position 4305 relative to the genome of Parsnip Yellow Fleck Virus.

VGAM2168 precursor RNA folds onto itself, forming VGAM2168 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2168 folded precursor RNA into VGAM2168 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2168 RNA is designated SEQ ID:4879, and is provided hereinbelow with reference to the sequence listing part.

VGAM2168 host target gene, herein designated VGAM HOST TARGET GENE, encodes a corresponding messenger RNA, VGAM2168 host target RNA, herein designated VGAM HOST TARGET RNA. VGAM2168 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2168 RNA, herein designated VGAM RNA, binds complementarily to one or more host target binding sites located in untranslated regions of VGAM2168 host target RNA, herein designated VGAM HOST TARGET RNA. This complementary binding is due to the fact that the nucleotide sequence of VGAM2168 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2168 RNA, herein designated VGAM RNA, may have a different number of host target binding sites in untranslated regions of a VGAM2168 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2168 RNA, herein designated VGAM RNA, to host target binding sites on VGAM2168 host target RNA, herein designated VGAM HOST TARGET RNA, such as BINDING SITE I, BINDING SITE II and BINDING SITE III, inhibits translation of VGAM2168 host target RNA into VGAM2168 host target protein, herein designated VGAM HOST TARGET PROTEIN. VGAM host target protein is therefore outlined by a broken line.

It is appreciated that VGAM2168 host target gene, herein designated VGAM HOST TARGET GENE, in fact represents a plurality of VGAM2168 host target genes. The mRNA of each one of this plurality of VGAM2168 host target genes comprises one or more host target binding sites, each having a nucleotide sequence which is at least partly complementary to VGAM2168 RNA, herein designated VGAM RNA, and which when bound by VGAM2168 RNA causes inhibition of translation of respective one or more VGAM2168 host target proteins.

It is further appreciated by one skilled in the art that the mode of translational inhibition illustrated by FIG. 1 with specific reference to translational inhibition exerted by VGAM2168 gene, herein designated VGAM GENE, on one or more VGAM2168 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2168 is inhibition of expression of host target genes, as part of a novel viral mechanism of attacking a host. Accordingly, utilities of VGAM2168 include diagnosis, prevention and treatment of viral infection by Parsnip Yellow Fleck Virus. Specific functions, and accordingly utilities, of VGAM2168 correlate with, and may be deduced from, the identity of the host target genes which VGAM2168 binds and inhibits, and the function of these host target genes, as elaborated hereinbelow.

Nucleotide sequences of the VGAM2168 precursor RNA, herein designated VGAM PRECURSOR RNA, and of the 'diced' VGAM2168 RNA, herein designated VGAM RNA, and a schematic representation of the secondary folding of VGAM2168 folded precursor RNA, herein designated VGAM FOLDED PRECURSOR RNA, of VGAM2168 are further described hereinbelow with reference to Table 1.

Nucleotide sequences of host target binding sites, such as BINDING SITE-I, BINDING SITE-II and BINDING SITE-III of FIG. 1, found on VGAM2168 host target RNA, and schematic representation of the complementarity of each of these host target binding sites to VGAM2168 RNA, herein designated VGAM RNA, are described hereinbelow with reference to Table 2.

As mentioned hereinabove with reference to FIG. 1, a function of VGAM2168 gene, herein designated VGAM is inhibition of expression of VGAM2168 target genes. It is appreciated that specific functions, and accordingly utilities, of VGAM2168 correlate with, and may be deduced from, the identity of the target genes which VGAM2168 binds and inhibits, and the function of these target genes, as elaborated hereinbelow.

Outer Dense Fiber of Sperm Tails 2 (ODF2, Accession NM_002540) is a VGAM2168 host target gene. ODF2 BINDING SITE is HOST TARGET binding site found in the 5' untranslated region of mRNA encoded by ODF2, corresponding to a HOST TARGET binding site such as BINDING SITE I, BINDING SITE II or BINDING SITE III. Table 2 illustrates the complementarity of the nucleotide sequences of ODF2 BINDING SITE, designated SEQ ID:8386, to the nucleotide sequence of VGAM2168 RNA, herein designated VGAM RNA, also designated SEQ ID:4879.

A function of VGAM2168 is therefore inhibition of Outer Dense Fiber of Sperm Tails 2 (ODF2, Accession NM_002540), a gene which is very strongly similar to rat Odf2. Accordingly, utilities of VGAM2168 include diagnosis, prevention and treatment of diseases and clinical conditions associated with ODF2. The function of ODF2 and its association with various diseases and clinical conditions, has been established by previous studies, as described hereinabove with reference to VGAM363. Spinocerebellar Ataxia 7 (olivopontocerebellar atrophy with retinal degeneration) (SCA7, Accession NM_000333) is another VGAM2168 host target gene. SCA7 BINDING SITE is HOST TARGET binding site found in the 3' untranslated region of mRNA encoded by SCA7, corresponding to a HOST TARGET binding site such as BINDING SITE I, BINDING SITE II or BINDING SITE III. Table 2 illustrates the complementarity of the nucleotide sequences of SCA7 BINDING SITE, designated SEQ ID:5886, to the nucleotide sequence of VGAM2168 RNA, herein designated VGAM RNA, also designated SEQ ID:4879.

Another function of VGAM2168 is therefore inhibition of Spinocerebellar Ataxia 7 (olivopontocerebellar atrophy with retinal degeneration) (SCA7, Accession NM_000333). Accordingly, utilities of VGAM2168 include diagnosis, prevention and treatment of diseases and clinical conditions associated with SCA7. Solute Carrier Family 26, Member 10 (SLC26A10, Accession NM_133489) is another VGAM2168 host target gene. SLC26A10 BINDING SITE is HOST TARGET binding site found in the 5' untranslated region of mRNA encoded by SLC26A10, corresponding to a HOST TARGET binding site such as BINDING SITE I, BINDING SITE II or BINDING SITE III. Table 2 illustrates the complementarity of the nucleotide sequences of SLC26A10 BINDING SITE, designated SEQ ID:28557, to the nucleotide sequence of VGAM2168 RNA, herein designated VGAM RNA, also designated SEQ ID:4879.

Another function of VGAM2168 is therefore inhibition of Solute Carrier Family 26, Member 10 (SLC26A10, Accession NM_133489). Accordingly, utilities of VGAM2168 include diagnosis, prevention and treatment of diseases and clinical conditions associated with SLC26A10. LOC158236 (Accession XM_098898) is another VGAM2168 host target gene. LOC158236 BINDING SITE is HOST TARGET binding site found in the 5' untranslated region of mRNA encoded by LOC158236, corresponding to a HOST TARGET binding site such as BINDING SITE I, BINDING SITE II or BINDING SITE III. Table 2 illustrates the complementarity of the nucleotide sequences of LOC158236 BINDING SITE, designated SEQ ID:41927, to the nucleotide sequence of VGAM2168 RNA, herein designated VGAM RNA, also designated SEQ ID:4879.

Another function of VGAM2168 is therefore inhibition of LOC158236 (Accession XM_098898). Accordingly, utilities of VGAM2168 include diagnosis, prevention and treatment of diseases and clinical conditions associated with LOC158236. LOC253264 (Accession XM_170639) is another VGAM2168 host target gene. LOC253264 BIND- ING SITE is HOST TARGET binding site found in the 5' untranslated region of mRNA encoded by LOC253264, corresponding to a HOST TARGET binding site such as BINDING SITE I, BINDING SITE II or BINDING SITE III. Table 2 illustrates the complementarity of the nucleotide sequences of LOC253264 BINDING SITE, designated SEQ ID:45417, to the nucleotide sequence of VGAM2168 RNA, herein designated VGAM RNA, also designated SEQ ID:4879.

Another function of VGAM2168 is therefore inhibition of LOC253264 (Accession XM_170639). Accordingly, utilities of VGAM2168 include diagnosis, prevention and treatment of diseases and clinical conditions associated with LOC253264. FIG. 1 further provides a conceptual description of a novel bioinformatically detected viral gene of the present invention, referred to here as Viral Genomic Address Messenger 2169 (VGAM2169) viral gene, which modulates expression of respective host target genes thereof, the function and utility of which host target genes is known in the art.

VGAM2169 is a novel bioinformatically detected regulatory, non protein coding, viral micro RNA (miRNA) gene. The method by which VGAM2169 was detected is described hereinabove with reference to FIGS. 1-8.

VGAM2169 gene, herein designated VGAM GENE, is a viral gene contained in the genome of Camelpox Virus. VGAM2169 host target gene, herein designated VGAM HOST TARGET GENE, is a human gene contained in the human genome.

VGAM2169 gene encodes a VGAM2169 precursor RNA, herein designated VGAM PRECURSOR RNA. Similar to other miRNA genes, and unlike most ordinary genes, VGAM2169 precursor RNA does not encode a protein. A nucleotide sequence identical or highly similar to the nucleotide sequence of VGAM2169 precursor RNA is designated SEQ ID:2155, and is provided hereinbelow with reference to the sequence listing part. Nucleotide sequence SEQ ID:2155 is located at position 183939 relative to the genome of Camelpox Virus.

VGAM2169 precursor RNA folds onto itself, forming VGAM2169 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2169 folded precursor RNA into VGAM2169 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM2169 RNA is designated SEQ ID:4880, and is provided hereinbelow with reference to the sequence listing part.

VGAM2169 host target gene, herein designated VGAM HOST TARGET GENE, encodes a corresponding messenger RNA, VGAM2169 host target RNA, herein designated VGAM HOST TARGET RNA. VGAM2169 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2169 RNA, herein designated VGAM RNA, binds complementarily to one or more host target binding sites located in untranslated regions of VGAM2169 host target RNA, herein designated VGAM HOST TARGET RNA. This complementary binding is due to the fact that the nucleotide sequence of VGAM2169 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2169 RNA, herein designated VGAM RNA, may have a different number of host target binding sites in untranslated regions of a VGAM2169 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2169 RNA, herein designated VGAM RNA, to host target binding sites on VGAM2169 host target RNA, herein designated VGAM HOST TARGET RNA, such as BINDING SITE I, BINDING SITE II and BINDING SITE III, inhibits translation of VGAM2169 host target RNA into VGAM2169 host target protein, herein designated VGAM HOST TARGET PROTEIN. VGAM host target protein is therefore outlined by a broken line.

It is appreciated that VGAM2169 host target gene, herein designated VGAM HOST TARGET GENE, in fact represents a plurality of VGAM2169 host target genes. The mRNA of each one of this plurality of VGAM2169 host target genes comprises one or more host target binding sites, each having a nucleotide sequence which is at least partly complementary to VGAM2169 RNA, herein designated VGAM RNA, and which when bound by VGAM2169 RNA causes inhibition of translation of respective one or more VGAM2169 host target proteins.

It is further appreciated by one skilled in the art that the mode of translational inhibition illustrated by FIG. 1 with specific reference to translational inhibition exerted by VGAM2169 gene, herein designated VGAM GENE, on one or more VGAM2169 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2169 is inhibition of expression of host target genes, as part of a novel viral mechanism of attacking a host. Accordingly, utilities of VGAM2169 include diagnosis, prevention and treatment of viral infection by Camelpox Virus. Specific functions, and accordingly utilities, of VGAM2169 correlate with, and may be deduced from, the identity of the host target genes which VGAM2169 binds and inhibits, and the function of these host target genes, as elaborated hereinbelow.

Nucleotide sequences of the VGAM2169 precursor RNA, herein designated VGAM PRECURSOR RNA, and of the 'diced' VGAM2169 RNA, herein designated VGAM RNA, and a schematic representation of the secondary folding of VGAM2169 folded precursor RNA, herein designated VGAM FOLDED PRECURSOR RNA, of VGAM2169 are further described hereinbelow with reference to Table 1.

Nucleotide sequences of host target binding sites, such as BINDING SITE-I, BINDING SITE-II and BINDING SITE-III of FIG. 1, found on VGAM2169 host target RNA, and schematic representation of the complementarity of each of these host target binding sites to VGAM2169 RNA, herein designated VGAM RNA, are described hereinbelow with reference to Table 2.

As mentioned hereinabove with reference to FIG. 1, a function of VGAM2169 gene, herein designated VGAM is inhibition of expression of VGAM2169 target genes. It is appreciated that specific functions, and accordingly utilities, of VGAM2169 correlate with, and may be deduced from, the identity of the target genes which VGAM2169 binds and inhibits, and the function of these target genes, as elaborated hereinbelow.

D10S170 (Accession NM_005436) is a VGAM2169 host target gene. D10S170 BINDING SITE is HOST TARGET binding site found in the 3' untranslated region of mRNA encoded by D10S170, corresponding to a HOST TARGET binding site such as BINDING SITE I, BINDING SITE II or BINDING SITE III. Table 2 illustrates the complementarity of the nucleotide sequences of D10S170 BINDING SITE, designated SEQ ID:11918, to the nucleotide sequence of VGAM2169 RNA, herein designated VGAM RNA, also designated SEQ ID:4880.

A function of VGAM2169 is therefore inhibition of D10S170 (Accession NM_005436), a gene which may provide a structural basis for generation of RET/PTC1 rearrangement. Accordingly, utilities of VGAM2169 include diagnosis, prevention and treatment of diseases and clinical conditions associated with D10S170. The function of D10S170 and its association with various diseases and clinical conditions, has been established by previous studies, as described hereinabove with reference to VGAM142. Deleted In Azoospermia-like (DAZL, Accession XM_042839) is another VGAM2169 host target gene. DAZL BINDING SITE is HOST TARGET binding site found in the 3' untranslated region of mRNA encoded by DAZL, corresponding to a HOST TARGET binding site such as BINDING SITE I, BINDING SITE II or BINDING SITE III. Table 2 illustrates the complementarity of the nucleotide sequences of DAZL BINDING SITE, designated SEQ ID:33798, to the nucleotide sequence of VGAM2169 RNA, herein designated VGAM RNA, also designated SEQ ID:4880.

Another function of VGAM2169 is therefore inhibition of Deleted In Azoospermia-like (DAZL, Accession XM_042839), a gene which may be essential for gametogenesis. Accordingly, utilities of VGAM2169 include diagnosis, prevention and treatment of diseases and clinical conditions associated with DAZL. The function of DAZL and its association with various diseases and clinical conditions, has been established by previous studies, as described hereinabove with reference to VGAM206. Dihydrolipoamide Branched Chain Transacylase (E2 component of branched chain keto acid dehydrogenase complex; maple syrup urine disease) (DBT, Accession NM_001918) is another VGAM2169 host target gene. DBT BINDING SITE is HOST TARGET binding site found in the 3' untranslated region of mRNA encoded by DBT, corresponding to a HOST TARGET binding site such as BINDING SITE I, BINDING SITE II or BINDING SITE III. Table 2 illustrates the complementarity of the nucleotide sequences of DBT BINDING SITE, designated SEQ ID:7632, to the nucleotide sequence of VGAM2169 RNA, herein designated VGAM RNA, also designated SEQ ID:4880.

Another function of VGAM2169 is therefore inhibition of Dihydrolipoamide Branched Chain Transacylase (E2 component of branched chain keto acid dehydrogenase complex; maple syrup urine disease) (DBT, Accession NM_001918). Accordingly, utilities of VGAM2169 include diagnosis, prevention and treatment of diseases and clinical conditions associated with DBT. LOC256277 (Accession XM_170644) is another VGAM2169 host target gene. LOC256277 BINDING SITE is HOST TARGET binding site found in the 5' untranslated region of mRNA encoded by LOC256277, corresponding to a HOST TARGET binding site such as BINDING SITE I, BINDING SITE II or BINDING SITE III. Table 2 illustrates the complementarity of the nucleotide sequences of LOC256277 BINDING SITE, designated SEQ ID:45424, to the nucleotide sequence of VGAM2169 RNA, herein designated VGAM RNA, also designated SEQ ID:4880.

Another function of VGAM2169 is therefore inhibition of LOC256277 (Accession XM_170644). Accordingly, utilities of VGAM2169 include diagnosis, prevention and treatment of diseases and clinical conditions associated with LOC256277. FIG. 1 further provides a conceptual description of a novel bioinformatically detected viral gene of the present invention, referred to here as Viral Genomic Address Messenger 2170 (VGAM2170) viral gene, which modulates expression of respective host target genes thereof, the function and utility of which host target genes is known in the art.

VGAM2170 is a novel bioinformatically detected regulatory, non protein coding, viral micro RNA (miRNA) gene. The method by which VGAM2170 was detected is described hereinabove with reference to FIGS. 1-8.

VGAM2170 gene, herein designated VGAM GENE, is a viral gene contained in the genome of Parsnip Yellow Fleck Virus. VGAM2170 host target gene, herein designated VGAM HOST TARGET GENE, is a human gene contained in the human genome.

VGAM2170 gene encodes a VGAM2170 precursor RNA, herein designated VGAM PRECURSOR RNA. Similar to other miRNA genes, and unlike most ordinary genes, VGAM2170 precursor RNA does not encode a protein. A nucleotide sequence identical or highly similar to the nucleotide sequence of VGAM2170 precursor RNA is designated SEQ ID:2156, and is provided hereinbelow with reference to the sequence listing part. Nucleotide sequence SEQ ID:2156 is located at position 8639 relative to the genome of Parsnip Yellow Fleck Virus.

VGAM2170 precursor RNA folds onto itself, forming VGAM2170 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2170 folded precursor RNA into VGAM2170 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2170 RNA is designated SEQ ID:4881, and is provided hereinbelow with reference to the sequence listing part.

VGAM2170 host target gene, herein designated VGAM HOST TARGET GENE, encodes a corresponding messenger RNA, VGAM2170 host target RNA, herein designated VGAM HOST TARGET RNA. VGAM2170 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2170 RNA, herein designated VGAM RNA, binds complementarily to one or more host target binding sites located in untranslated regions of VGAM2170 host target RNA, herein designated VGAM HOST TARGET RNA. This complementary binding is due to the fact that the nucleotide sequence of VGAM2170 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2170 RNA, herein designated VGAM RNA, may have a different number of host target binding sites in untranslated regions of a VGAM2170 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2170 RNA, herein designated VGAM RNA, to host target binding sites on VGAM2170 host target RNA, herein designated VGAM HOST TARGET RNA, such as BINDING SITE I, BINDING SITE II and BINDING SITE III, inhibits translation of VGAM2170 host target RNA into VGAM2170 host target protein, herein designated VGAM HOST TARGET PROTEIN. VGAM host target protein is therefore outlined by a broken line.

It is appreciated that VGAM2170 host target gene, herein designated VGAM HOST TARGET GENE, in fact represents a plurality of VGAM2170 host target genes. The mRNA of each one of this plurality of VGAM2170 host target genes comprises one or more host target binding sites, each having a nucleotide sequence which is at least partly complementary to VGAM2170 RNA, herein designated VGAM RNA, and which when bound by VGAM2170 RNA causes inhibition of translation of respective one or more VGAM2170 host target proteins.

It is further appreciated by one skilled in the art that the mode of translational inhibition illustrated by FIG. 1 with specific reference to translational inhibition exerted by VGAM2170 gene, herein designated VGAM GENE, on one or more VGAM2170 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2170 is inhibition of expression of host target genes, as part of a novel viral mechanism of attacking a host. Accordingly, utilities of VGAM2170 include diagnosis, prevention and treatment of viral infection by Parsnip Yellow Fleck Virus. Specific functions, and accordingly utilities, of VGAM2170 correlate with, and may be deduced from, the identity of the host target genes which VGAM2170 binds and inhibits, and the function of these host target genes, as elaborated hereinbelow.

Nucleotide sequences of the VGAM2170 precursor RNA, herein designated VGAM PRECURSOR RNA, and of the 'diced' VGAM2170 RNA, herein designated VGAM RNA, and a schematic representation of the secondary folding of VGAM2170 folded precursor RNA, herein designated VGAM FOLDED PRECURSOR RNA, of VGAM2170 are further described hereinbelow with reference to Table 1.

Nucleotide sequences of host target binding sites, such as BINDING SITE-I, BINDING SITE-II and BINDING SITE-III of FIG. 1, found on VGAM2170 host target RNA, and schematic representation of the complementarity of each of these host target binding sites to VGAM2170 RNA, herein designated VGAM RNA, are described hereinbelow with reference to Table 2.

As mentioned hereinabove with reference to FIG. 1, a function of VGAM2170 gene, herein designated VGAM is inhibition of expression of VGAM2170 target genes. It is appreciated that specific functions, and accordingly utilities, of VGAM2170 correlate with, and may be deduced from, the identity of the target genes which VGAM2170 binds and inhibits, and the function of these target genes, as elaborated hereinbelow.

Angiopoietin 1 (ANGPT1, Accession NM_001146) is a VGAM2170 host target gene. ANGPT1 BINDING SITE is HOST TARGET binding site found in the 3' untranslated region of mRNA encoded by ANGPT1, corresponding to a HOST TARGET binding site such as BINDING SITE I, BINDING SITE II or BINDING SITE III. Table 2 illustrates the complementarity of the nucleotide sequences of ANGPT1 BINDING SITE, designated SEQ ID:6817, to the nucleotide sequence of VGAM2170 RNA, herein designated VGAM RNA, also designated SEQ ID:4881.

A function of VGAM2170 is therefore inhibition of Angiopoietin 1 (ANGPT1, Accession NM_001146), a gene which binds and activates tie2 receptor by inducing its tyrosine phosphorylation. Accordingly, utilities of VGAM2170 include diagnosis, prevention and treatment of diseases and clinical conditions associated with ANGPT1. The function of ANGPT1 and its association with various diseases and clinical conditions, has been established by previous studies, as described hereinabove with reference to VGAM291. ATPase, Na+/K+ Transporting, Beta 2 Polypeptide (ATP1B2, Accession NM_001678) is another VGAM2170 host target gene. ATP1B2 BINDING SITE is HOST TARGET binding site found in the 3' untranslated region of mRNA encoded by ATP1B2, corresponding to a HOST TARGET binding site such as BINDING SITE I, BINDING SITE II or BINDING SITE III. Table 2 illustrates the complementarity of the nucleotide sequences of ATP1B2 BINDING SITE, designated SEQ ID:7397, to the nucleotide sequence of VGAM2170 RNA, herein designated VGAM RNA, also designated SEQ ID:4881.

Another function of VGAM2170 is therefore inhibition of ATPase, Na+/K+ Transporting, Beta 2 Polypeptide (ATP1B2, Accession NM_001678), a gene which catalyzes the hydrolysis of ATP coupled with the exchange of Na +/K+ ions across the plasma membrane. Accordingly, utilities of VGAM2170 include diagnosis, prevention and treatment of diseases and clinical conditions associated with ATP1B2. The function of ATP1B2 and its association with various diseases and clinical conditions, has been established by previous studies, as described hereinabove with reference to VGAM152. Adaptor-related Protein Complex 3, Mu 1 Subunit (AP3M1, Accession NM_012095) is another VGAM2170 host target gene. AP3M1 BINDING SITE is HOST TARGET binding site found in the 3' untranslated region of mRNA encoded by AP3M1, corresponding to a HOST TARGET binding site such as BINDING SITE I, BINDING SITE II or BINDING SITE III. Table 2 illustrates the complementarity of the nucleotide sequences of AP3M1 BINDING SITE, designated SEQ ID:14397, to the nucleotide sequence of VGAM2170 RNA, herein designated VGAM RNA, also designated SEQ ID:4881.

Another function of VGAM2170 is therefore inhibition of Adaptor-related Protein Complex 3, Mu 1 Subunit (AP3M1, Accession NM_012095). Accordingly, utilities of VGAM2170 include diagnosis, prevention and treatment of diseases and clinical conditions associated with AP3M1. BHC80 (Accession NM_016621) is another VGAM2170 host target gene. BHC80 BINDING SITE is HOST TARGET binding site found in the 3' untranslated region of mRNA encoded by BHC80, corresponding to a HOST TARGET binding site such as BINDING SITE I, BINDING SITE II or BINDING SITE III. Table 2 illustrates the complementarity of the nucleotide sequences of BHC80 BINDING SITE, designated SEQ ID:18729, to the nucleotide sequence of VGAM2170 RNA, herein designated VGAM RNA, also designated SEQ ID:4881.

Another function of VGAM2170 is therefore inhibition of BHC80 (Accession NM_016621). Accordingly, utilities of VGAM2170 include diagnosis, prevention and treatment of diseases and clinical conditions associated with BHC80. FLJ21916 (Accession NM_023112) is another VGAM2170 host target gene. FLJ21916 BINDING SITE is HOST TARGET binding site found in the 3' untranslated region of mRNA encoded by FLJ21916, corresponding to a HOST TARGET binding site such as BINDING SITE I, BINDING SITE II or BINDING SITE III. Table 2 illustrates the complementarity of the nucleotide sequences of FLJ21916 BINDING SITE, designated SEQ ID:23383, to the nucleotide sequence of VGAM2170 RNA, herein designated VGAM RNA, also designated SEQ ID:4881.

Another function of VGAM2170 is therefore inhibition of FLJ21916 (Accession NM_023112). Accordingly, utilities of VGAM2170 include diagnosis, prevention and treatment of diseases and clinical conditions associated with FLJ21916. KIAA0441 (Accession NM_014797) is another VGAM2170 host target gene. KIAA0441 BINDING SITE is HOST TARGET binding site found in the 5' untranslated region of mRNA encoded by KIAA0441, corresponding to a HOST TARGET binding site such as BINDING SITE I, BINDING SITE II or BINDING SITE III. Table 2 illustrates the complementarity of the nucleotide sequences of KIAA0441 BINDING SITE, designated SEQ ID:16709, to the nucleotide sequence of VGAM2170 RNA, herein designated VGAM RNA, also designated SEQ ID:4881.

Another function of VGAM2170 is therefore inhibition of KIAA0441 (Accession NM_014797). Accordingly, utilities of VGAM2170 include diagnosis, prevention and treatment of diseases and clinical conditions associated with KIAA0441. KIAA1157 (Accession XM_051093) is another VGAM2170 host target gene. KIAA1157 BINDING SITE is HOST TARGET binding site found in the 3' untranslated region of mRNA encoded by KIAA1157, corresponding to a HOST TARGET binding site such as BINDING SITE I, BINDING SITE II or BINDING SITE III. Table 2 illustrates the complementarity of the nucleotide sequences of KIAA1157 BINDING SITE, designated SEQ ID:35754, to the nucleotide sequence of VGAM2170 RNA, herein designated VGAM RNA, also designated SEQ ID:4881.

Another function of VGAM2170 is therefore inhibition of KIAA1157 (Accession XM_051093). Accordingly, utilities of VGAM2170 include diagnosis, prevention and treatment of diseases and clinical conditions associated with KIAA1157. PRO1580 (Accession NM_018502) is another VGAM2170 host target gene. PRO1580 BINDING SITE is HOST TARGET binding site found in the 5' untranslated region of mRNA encoded by PRO1580, corresponding to a HOST TARGET binding site such as BINDING SITE I, BINDING SITE II or BINDING SITE III. Table 2 illustrates the complementarity of the nucleotide sequences of PRO1580 BINDING SITE, designated SEQ ID:20567, to the nucleotide sequence of VGAM2170 RNA, herein designated VGAM RNA, also designated SEQ ID:4881.

Another function of VGAM2170 is therefore inhibition of PRO1580 (Accession NM_018502). Accordingly, utilities of VGAM2170 include diagnosis, prevention and treatment of diseases and clinical conditions associated with PRO1580. LOC257484 (Accession XM_114232) is another VGAM2170 host target gene. LOC257484 BINDING SITE is HOST TARGET binding site found in the 5' untranslated region of mRNA encoded by LOC257484, corresponding to a HOST TARGET binding site such as BINDING SITE I, BINDING SITE II or BINDING SITE III. Table 2 illustrates the complementarity of the nucleotide sequences of LOC257484 BINDING SITE, designated SEQ ID:42814, to the nucleotide sequence of VGAM2170 RNA, herein designated VGAM RNA, also designated SEQ ID:4881.

Another function of VGAM2170 is therefore inhibition of LOC257484 (Accession XM_114232). Accordingly, utilities of VGAM2170 include diagnosis, prevention and treatment of diseases and clinical conditions associated with LOC257484. LOC91351 (Accession XM_037817) is another VGAM2170 host target gene. LOC91351 BINDING SITE is HOST TARGET binding site found in the 3' untranslated region of mRNA encoded by LOC91351, corresponding to a HOST TARGET binding site such as BINDING SITE I, BINDING SITE II or BINDING SITE III. Table 2 illustrates the complementarity of the nucleotide sequences of LOC91351 BINDING SITE, designated SEQ ID:32698, to the nucleotide sequence of VGAM2170 RNA, herein designated VGAM RNA, also designated SEQ ID:4881.

Another function of VGAM2170 is therefore inhibition of LOC91351 (Accession XM_037817). Accordingly, utilities of VGAM2170 include diagnosis, prevention and treatment of diseases and clinical conditions associated with LOC91351. FIG. 1 further provides a conceptual description of a novel bioinformatically detected viral gene of the present invention, referred to here as Viral Genomic Address Messenger 2171 (VGAM2171) viral gene, which modulates expression of respective host target genes thereof, the function and utility of which host target genes is known in the art.

VGAM2171 is a novel bioinformatically detected regulatory, non protein coding, viral micro RNA (miRNA) gene. The method by which VGAM2171 was detected is described hereinabove with reference to FIGS. 1-8.

VGAM2171 gene, herein designated VGAM GENE, is a viral gene contained in the genome of Parsnip Yellow Fleck Virus. VGAM2171 host target gene, herein designated VGAM HOST TARGET GENE, is a human gene contained in the human genome.

VGAM2171 gene encodes a VGAM2171 precursor RNA, herein designated VGAM PRECURSOR RNA. Similar to other miRNA genes, and unlike most ordinary genes, VGAM2171 precursor RNA does not encode a protein. A nucleotide sequence identical or highly similar to the nucleotide sequence of VGAM2171 precursor RNA is designated SEQ ID:2157, and is provided hereinbelow with reference to the sequence listing part. Nucleotide sequence SEQ ID:2157 is located at position 5077 relative to the genome of Parsnip Yellow Fleck Virus.

VGAM2171 precursor RNA folds onto itself, forming VGAM2171 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2171 folded precursor RNA into VGAM2171 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2171 RNA is designated SEQ ID:4882, and is provided hereinbelow with reference to the sequence listing part.

VGAM2171 host target gene, herein designated VGAM HOST TARGET GENE, encodes a corresponding messenger RNA, VGAM2171 host target RNA, herein designated VGAM HOST TARGET RNA. VGAM2171 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2171 RNA, herein designated VGAM RNA, binds complementarily to one or more host target binding sites located in untranslated regions of VGAM2171 host target RNA, herein designated VGAM HOST TARGET RNA. This complementary binding is due to the fact that the nucleotide sequence of VGAM2171 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2171 RNA, herein designated VGAM RNA, may have a different number of host target binding sites in untranslated regions of a VGAM2171 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2171 RNA, herein designated VGAM RNA, to host target binding sites on VGAM2171 host target RNA, herein designated VGAM HOST TARGET RNA, such as BINDING SITE I, BINDING SITE II and BINDING SITE III, inhibits translation of VGAM2171 host target RNA into VGAM2171 host target protein, herein designated VGAM HOST TARGET PROTEIN. VGAM host target protein is therefore outlined by a broken line.

It is appreciated that VGAM2171 host target gene, herein designated VGAM HOST TARGET GENE, in fact represents a plurality of VGAM2171 host target genes. The mRNA of each one of this plurality of VGAM2171 host target genes comprises one or more host target binding sites, each having a nucleotide sequence which is at least partly complementary to VGAM2171 RNA, herein designated VGAM RNA, and which when bound by VGAM2171 RNA causes inhibition of translation of respective one or more VGAM2171 host target proteins.

It is further appreciated by one skilled in the art that the mode of translational inhibition illustrated by FIG. 1 with specific reference to translational inhibition exerted by VGAM2171 gene, herein designated VGAM GENE, on one or more VGAM2171 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2171 is inhibition of expression of host target genes, as part of a novel viral mechanism of attacking a host. Accordingly, utilities of VGAM2171 include diagnosis, prevention and treatment of viral infection by Parsnip Yellow Fleck Virus. Specific functions, and accordingly utilities, of VGAM2171 correlate with, and may be deduced from, the identity of the host target genes which VGAM2171 binds and inhibits, and the function of these host target genes, as elaborated hereinbelow.

Nucleotide sequences of the VGAM2171 precursor RNA, herein designated VGAM PRECURSOR RNA, and of the 'diced' VGAM2171 RNA, herein designated VGAM RNA, and a schematic representation of the secondary folding of VGAM2171 folded precursor RNA, herein designated VGAM FOLDED PRECURSOR RNA, of VGAM2171 are further described hereinbelow with reference to Table 1.

Nucleotide sequences of host target binding sites, such as BINDING SITE-I, BINDING SITE-II and BINDING SITE-III of FIG. 1, found on VGAM2171 host target RNA, and schematic representation of the complementarity of each of these host target binding sites to VGAM2171 RNA, herein designated VGAM RNA, are described hereinbelow with reference to Table 2.

As mentioned hereinabove with reference to FIG. 1, a function of VGAM2171 gene, herein designated VGAM is inhibition of expression of VGAM2171 target genes. It is appreciated that specific functions, and accordingly utilities, of VGAM2171 correlate with, and may be deduced from, the identity of the target genes which VGAM2171 binds and inhibits, and the function of these target genes, as elaborated hereinbelow.

Citron (rho-interacting, serine/threonine kinase 21) (CIT, Accession XM_045786) is a VGAM2171 host target gene. CIT BINDING SITE is HOST TARGET binding site found in the 3' untranslated region of mRNA encoded by CIT, corresponding to a HOST TARGET binding site such as BINDING SITE I, BINDING SITE II or BINDING SITE III. Table 2 illustrates the complementarity of the nucleotide sequences of CIT BINDING SITE, designated SEQ ID:34559, to the nucleotide sequence of VGAM2171 RNA, herein designated VGAM RNA, also designated SEQ ID:4882.

A function of VGAM2171 is therefore inhibition of Citron (rho-interacting, serine/threonine kinase 21) (CIT, Accession XM_045786), a gene which is increased several-fold by coexpression of constitutively active Rho. Accordingly, utilities of VGAM2171 include diagnosis, prevention and treatment of diseases and clinical conditions associated with CIT. The function of CIT and its association with various diseases and clinical conditions, has been established by previous studies, as described hereinabove with reference to VGAM393. KIAA0475 (Accession NM_014864) is another VGAM2171 host target gene. KIAA0475 BINDING SITE is HOST TARGET binding site found in the 3' untranslated region of mRNA encoded by KIAA0475, corresponding to a HOST TARGET binding site such as BINDING SITE I, BINDING SITE II or BINDING SITE III. Table 2 illustrates the complementarity of the nucleotide sequences of KIAA0475 BINDING SITE, designated SEQ ID:16944, to the nucleotide sequence of VGAM2171 RNA, herein designated VGAM RNA, also designated SEQ ID:4882.

Another function of VGAM2171 is therefore inhibition of KIAA0475 (Accession NM_014864). Accordingly, utilities of VGAM2171 include diagnosis, prevention and treatment of diseases and clinical conditions associated with KIAA0475. KIAA1649 (Accession NM_032311) is another VGAM2171 host target gene. KIAA1649 BINDING SITE1 and KIAA1649 BINDING SITE2 are HOST TARGET binding sites found in untranslated regions of mRNA encoded by KIAA1649, corresponding to HOST TARGET binding sites such as BINDING SITE I, BINDING SITE II or BINDING SITE III. Table 2 illustrates the complementarity of the nucleotide sequences of KIAA1649 BINDING SITE1 and KIAA1649 BINDING SITE2, designated SEQ ID:26100 and SEQ ID:33254 respectively, to the nucleotide sequence of VGAM2171 RNA, herein designated VGAM RNA, also designated SEQ ID:4882.

Another function of VGAM2171 is therefore inhibition of KIAA1649 (Accession NM_032311). Accordingly, utilities of VGAM2171 include diagnosis, prevention and treatment of diseases and clinical conditions associated with KIAA1649. TUSP (Accession NM_020245) is another VGAM2171 host target gene. TUSP BINDING SITE is HOST TARGET binding site found in the 3' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21520, to the nucleotide sequence of VGAM2171 RNA, herein designated VGAM RNA, also designated SEQ ID:4882.

Another function of VGAM2171 is therefore inhibition of TUSP (Accession NM_020245). Accordingly, utilities of VGAM2171 include diagnosis, prevention and treatment of diseases and clinical conditions associated with TUSP. Zinc Finger Protein 384 (ZNF384, Accession NM_133476) is another VGAM2171 host target gene. ZNF384 BINDING SITE is HOST TARGET binding site found in the 3' untranslated region of mRNA encoded by ZNF384, corresponding to a HOST TARGET binding site such as BINDING SITE I, BINDING SITE II or BINDING SITE III. Table 2 illustrates the complementarity of the nucleotide sequences of ZNF384 BINDING SITE, designated SEQ ID:28544, to the nucleotide sequence of VGAM2171 RNA, herein designated VGAM RNA, also designated SEQ ID:4882.

Another function of VGAM2171 is therefore inhibition of Zinc Finger Protein 384 (ZNF384, Accession NM_133476). Accordingly, utilities of VGAM2171 include diagnosis, prevention and treatment of diseases and clinical conditions associated with ZNF384. LOC221656 (Accession XM_166418) is another VGAM2171 host target gene. LOC221656 BINDING SITE is HOST TARGET binding site found in the 3' untranslated region of mRNA encoded by LOC221656, corresponding to a HOST TARGET binding site such as BINDING SITE I, BINDING SITE II or BINDING SITE III. Table 2 illustrates the complementarity of the nucleotide sequences of LOC221656 BINDING SITE, designated SEQ ID:44290, to the nucleotide sequence of VGAM2171 RNA, herein designated VGAM RNA, also designated SEQ ID:4882.

Another function of VGAM2171 is therefore inhibition of LOC221656 (Accession XM_166418). Accordingly, utilities of VGAM2171 include diagnosis, prevention and treatment of diseases and clinical conditions associated with LOC221656. FIG. 1 further provides a conceptual description of a novel bioinformatically detected viral gene of the present invention, referred to here as Viral Genomic Address Messenger 2172 (VGAM2172) viral gene, which modulates expression of respective host target genes thereof, the function and utility of which host target genes is known in the art.

VGAM2172 is a novel bioinformatically detected regulatory, non protein coding, viral micro RNA (miRNA) gene. The method by which VGAM2172 was detected is described hereinabove with reference to FIGS. 1-8.

VGAM2172 gene, herein designated VGAM GENE, is a viral gene contained in the genome of Parsnip Yellow Fleck Virus. VGAM2172 host target gene, herein designated VGAM HOST TARGET GENE, is a human gene contained in the human genome.

VGAM2172 gene encodes a VGAM2172 precursor RNA, herein designated VGAM PRECURSOR RNA. Similar to other miRNA genes, and unlike most ordinary genes, VGAM2172 precursor RNA does not encode a protein. A nucleotide sequence identical or highly similar to the nucleotide sequence of VGAM2172 precursor RNA is designated SEQ ID:2158, and is provided hereinbelow with reference to the sequence listing part. Nucleotide sequence SEQ ID:2158 is located at position 578 relative to the genome of Parsnip Yellow Fleck Virus.

VGAM2172 precursor RNA folds onto itself, forming VGAM2172 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2172 folded precursor RNA into VGAM2172 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM2172 RNA is designated SEQ ID:4883, and is provided hereinbelow with reference to the sequence listing part.

VGAM2172 host target gene, herein designated VGAM HOST TARGET GENE, encodes a corresponding messenger RNA, VGAM2172 host target RNA, herein designated VGAM HOST TARGET RNA. VGAM2172 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2172 RNA, herein designated VGAM RNA, binds complementarily to one or more host target binding sites located in untranslated regions of VGAM2172 host target RNA, herein designated VGAM HOST TARGET RNA. This complementary binding is due to the fact that the nucleotide sequence of VGAM2172 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2172 RNA, herein designated VGAM RNA, may have a different number of host target binding sites in untranslated regions of a VGAM2172 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2172 RNA, herein designated VGAM RNA, to host target binding sites on VGAM2172 host target RNA, herein designated VGAM HOST TARGET RNA, such as BINDING SITE I, BINDING SITE II and BINDING SITE III, inhibits translation of VGAM2172 host target RNA into VGAM2172 host target protein, herein designated VGAM HOST TARGET PROTEIN. VGAM host target protein is therefore outlined by a broken line.

It is appreciated that VGAM2172 host target gene, herein designated VGAM HOST TARGET GENE, in fact represents a plurality of VGAM2172 host target genes. The mRNA of each one of this plurality of VGAM2172 host target genes comprises one or more host target binding sites, each having a nucleotide sequence which is at least partly complementary to VGAM2172 RNA, herein designated VGAM RNA, and which when bound by VGAM2172 RNA causes inhibition of translation of respective one or more VGAM2172 host target proteins.

It is further appreciated by one skilled in the art that the mode of translational inhibition illustrated by FIG. 1 with specific reference to translational inhibition exerted by VGAM2172 gene, herein designated VGAM GENE, on one or more VGAM2172 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2172 is inhibition of expression of host target genes, as part of a novel viral mechanism of attacking a host. Accordingly, utilities of VGAM2172 include diagnosis, prevention and treatment of viral infection by Parsnip Yellow Fleck Virus. Specific functions, and accordingly utilities, of VGAM2172 correlate with, and may be deduced from, the identity of the host target genes which VGAM2172 binds and inhibits, and the function of these host target genes, as elaborated hereinbelow.

Nucleotide sequences of the VGAM2172 precursor RNA, herein designated VGAM PRECURSOR RNA, and of the 'diced' VGAM2172 RNA, herein designated VGAM RNA, and a schematic representation of the secondary folding of VGAM2172 folded precursor RNA, herein designated VGAM FOLDED PRECURSOR RNA, of VGAM2172 are further described hereinbelow with reference to Table 1.

Nucleotide sequences of host target binding sites, such as BINDING SITE-I, BINDING SITE-II and BINDING SITE-III of FIG. 1, found on VGAM2172 host target RNA, and schematic representation of the complementarity of each of these host target binding sites to VGAM2172 RNA, herein designated VGAM RNA, are described hereinbelow with reference to Table 2.

As mentioned hereinabove with reference to FIG. 1, a function of VGAM2172 gene, herein designated VGAM is inhibition of expression of VGAM2172 target genes. It is appreciated that specific functions, and accordingly utilities, of VGAM2172 correlate with, and may be deduced from, the identity of the target genes which VGAM2172 binds and inhibits, and the function of these target genes, as elaborated hereinbelow.

Aldehyde Dehydrogenase 3 Family, Member A2 (ALDH3A2, Accession XM_045060) is a VGAM2172 host target gene. ALDH3A2 BINDING SITE is HOST TARGET binding site found in the 3' untranslated region of mRNA encoded by ALDH3A2, corresponding to a HOST TARGET binding site such as BINDING SITE I, BINDING SITE II or BINDING SITE III. Table 2 illustrates the complementarity of the nucleotide sequences of ALDH3A2 BINDING SITE, designated SEQ ID:34338, to the nucleotide sequence of VGAM2172 RNA, herein designated VGAM RNA, also designated SEQ ID:4883.

A function of VGAM2172 is therefore inhibition of Aldehyde Dehydrogenase 3 Family, Member A2 (ALDH3A2, Accession XM_045060). Accordingly, utilities of VGAM2172 include diagnosis, prevention and treatment of diseases and clinical conditions associated with ALDH3A2. Fibroblast Growth Factor 2 (basic) (FGF2, Accession NM_002006) is another VGAM2172 host target gene. FGF2 BINDING SITE is HOST TARGET binding site found in the 3' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7730, to the nucleotide sequence of VGAM2172 RNA, herein designated VGAM RNA, also designated SEQ ID:4883.

Another function of VGAM2172 is therefore inhibition of Fibroblast Growth Factor 2 (basic) (FGF2, Accession NM_002006), a gene which probably involved in nervous system development and function. Accordingly, utilities of VGAM2172 include diagnosis, prevention and treatment of diseases and clinical conditions associated with FGF2. The function of FGF2 and its association with various diseases and clinical conditions, has been established by previous studies, as described hereinabove with reference to VGAM51. Heterogeneous Nuclear Ribonucleoprotein K (HNRPK, Accession NM_002140) is another VGAM2172 host target gene. HNRPK BINDING SITE1 and HNRPK BINDING SITE2 are HOST TARGET binding sites found in untranslated regions of mRNA encoded by HNRPK, corresponding to HOST TARGET binding sites such as BINDING SITE I, BINDING SITE II or BINDING SITE III. Table 2 illustrates the complementarity of the nucleotide sequences of HNRPK BINDING SITE1 and HNRPK BINDING SITE2, designated SEQ ID:7917 and SEQ ID:25281 respectively, to the nucleotide sequence of VGAM2172 RNA, herein designated VGAM RNA, also designated SEQ ID:4883.

Another function of VGAM2172 is therefore inhibition of Heterogeneous Nuclear Ribonucleoprotein K (HNRPK, Accession NM_002140), a gene which play a role in the nuclear metabolism of hnrnas, particularly for pre-mrnas that contain cytidine-rich sequence. Accordingly, utilities of VGAM2172 include diagnosis, prevention and treatment of diseases and clinical conditions associated with HNRPK. The function of HNRPK and its association with various diseases and clinical conditions, has been established by previous studies, as described hereinabove with reference to VGAM125. Peanut-like 2 (Drosophila) (PNUTL2, Accession NM_080415) is another VGAM2172 host target gene. PNUTL2 BINDING SITE1 and PNUTL2 BINDING SITE2 are HOST TARGET binding sites found in untranslated regions of mRNA encoded by PNUTL2, corresponding to HOST TARGET binding sites such as BINDING SITE I, BINDING SITE II or BINDING SITE III. Table 2 illustrates the complementarity of the nucleotide sequences of PNUTL2 BINDING SITE1 and PNUTL2 BINDING SITE2, designated SEQ ID:27833 and SEQ ID:23131 respectively, to the nucleotide sequence of VGAM2172 RNA, herein designated VGAM RNA, also designated SEQ ID:4883.

Another function of VGAM2172 is therefore inhibition of Peanut-like 2 (Drosophila) (PNUTL2, Accession NM_080415), a gene which is involved in cytokinesis. Accordingly, utilities of VGAM2172 include diagnosis, prevention and treatment of diseases and clinical conditions associated with PNUTL2. The function of PNUTL2 and its association with various diseases and clinical conditions, has been established by previous studies, as described hereinabove with reference to VGAM95. KIAA1054 (Accession XM_043493) is another VGAM2172 host target gene. KIAA1054 BINDING SITE is HOST TARGET binding site found in the 3' untranslated region of mRNA encoded by KIAA1054, corresponding to a HOST TARGET binding site such as BINDING SITE I, BINDING SITE II or BINDING SITE III. Table 2 illustrates the complementarity of the nucleotide sequences of KIAA1054 BINDING SITE, designated SEQ ID:33959, to the nucleotide sequence of VGAM2172 RNA, herein designated VGAM RNA, also designated SEQ ID:4883.

Another function of VGAM2172 is therefore inhibition of KIAA1054 (Accession XM_043493). Accordingly, utilities of VGAM2172 include diagnosis, prevention and treatment of diseases and clinical conditions associated with KIAA1054. KIAA1677 (Accession XM_040383) is another VGAM2172 host target gene. KIAA1677 BINDING SITE is HOST TARGET binding site found in the 3' untranslated region of mRNA encoded by KIAA1677, corresponding to a HOST TARGET binding site such as BINDING SITE I, BINDING SITE II or BINDING SITE III. Table 2 illustrates the complementarity of the nucleotide sequences of KIAA1677 BINDING SITE, designated SEQ ID:33292, to the nucleotide sequence of VGAM2172 RNA, herein designated VGAM RNA, also designated SEQ ID:4883.

Another function of VGAM2172 is therefore inhibition of KIAA1677 (Accession XM_040383). Accordingly, utilities of VGAM2172 include diagnosis, prevention and treatment of diseases and clinical conditions associated with KIAA1677. LOC148946 (Accession XM_097557) is another VGAM2172 host target gene. LOC148946 BINDING SITE is HOST TARGET binding site found in the 3' untranslated region of mRNA encoded by LOC148946, corresponding to a HOST TARGET binding site such as BINDING SITE I, BINDING SITE II or BINDING SITE III. Table 2 illustrates the complementarity of the nucleotide sequences of LOC148946 BINDING SITE, designated SEQ ID:40935, to the nucleotide sequence of VGAM2172 RNA, herein designated VGAM RNA, also designated SEQ ID:4883.

Another function of VGAM2172 is therefore inhibition of LOC148946 (Accession XM_097557). Accordingly, utilities of VGAM2172 include diagnosis, prevention and treatment of diseases and clinical conditions associated with LOC148946. LOC161829 (Accession XM_091161) is another VGAM2172 host target gene. LOC161829 BINDING SITE is HOST TARGET binding site found in the 5' untranslated region of mRNA encoded by LOC161829, corresponding to a HOST TARGET binding site such as BINDING SITE I, BINDING SITE II or BINDING SITE III. Table 2 illustrates the complementarity of the nucleotide sequences of LOC161829 BINDING SITE, designated SEQ ID:40039, to the nucleotide sequence of VGAM2172 RNA, herein designated VGAM RNA, also designated SEQ ID:4883.

Another function of VGAM2172 is therefore inhibition of LOC161829 (Accession XM_091161). Accordingly, utilities of VGAM2172 include diagnosis, prevention and treatment of diseases and clinical conditions associated with LOC161829. LOC219333 (Accession XM_167944) is another VGAM2172 host target gene. LOC219333 BINDING SITE is HOST TARGET binding site found in the 3' untranslated region of mRNA encoded by LOC219333, corresponding to a HOST TARGET binding site such as BINDING SITE I, BINDING SITE II or BINDING SITE III. Table 2 illustrates the complementarity of the nucleotide sequences of LOC219333 BINDING SITE, designated SEQ ID:44935, to the nucleotide sequence of VGAM2172 RNA, herein designated VGAM RNA, also designated SEQ ID:4883.

Another function of VGAM2172 is therefore inhibition of LOC219333 (Accession XM_167944). Accordingly, utilities of VGAM2172 include diagnosis, prevention and treatment of diseases and clinical conditions associated with LOC219333. FIG. 1 further provides a conceptual description of a novel bioinformatically detected viral gene of the present invention, referred to here as Viral Genomic Address Messenger 2173 (VGAM2173) viral gene, which modulates expression of respective host target genes thereof, the function and utility of which host target genes is known in the art.

VGAM2173 is a novel bioinformatically detected regulatory, non protein coding, viral micro RNA (miRNA) gene. The method by which VGAM2173 was detected is described hereinabove with reference to FIGS. 1-8.

VGAM2173 gene, herein designated VGAM GENE, is a viral gene contained in the genome of Parsnip Yellow Fleck Virus. VGAM2173 host target gene, herein designated VGAM HOST TARGET GENE, is a human gene contained in the human genome.

VGAM2173 gene encodes a VGAM2173 precursor RNA, herein designated VGAM PRECURSOR RNA. Similar to other miRNA genes, and unlike most ordinary genes, VGAM2173 precursor RNA does not encode a protein. A nucleotide sequence identical or highly similar to the nucleotide sequence of VGAM2173 precursor RNA is designated SEQ ID:2159, and is provided hereinbelow with reference to the sequence listing part. Nucleotide sequence SEQ ID:2159 is located at position 3661 relative to the genome of Parsnip Yellow Fleck Virus.

VGAM2173 precursor RNA folds onto itself, forming VGAM2173 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2173 folded precursor RNA into VGAM2173 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM2173 RNA is designated SEQ ID:4884, and is provided hereinbelow with reference to the sequence listing part.

VGAM2173 host target gene, herein designated VGAM HOST TARGET GENE, encodes a corresponding messenger RNA, VGAM2173 host target RNA, herein designated VGAM HOST TARGET RNA. VGAM2173 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2173 RNA, herein designated VGAM RNA, binds complementarily to one or more host target binding sites located in untranslated regions of VGAM2173 host target RNA, herein designated VGAM HOST TARGET RNA. This complementary binding is due to the fact that the nucleotide sequence of VGAM2173 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2173 RNA, herein designated VGAM RNA, may have a different number of host target binding sites in untranslated regions of a VGAM2173 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2173 RNA, herein designated VGAM RNA, to host target binding sites on VGAM2173 host target RNA, herein designated VGAM HOST TARGET RNA, such as BINDING SITE I, BINDING SITE II and BINDING SITE III, inhibits translation of VGAM2173 host target RNA into VGAM2173 host target protein, herein designated VGAM HOST TARGET PROTEIN. VGAM host target protein is therefore outlined by a broken line.

It is appreciated that VGAM2173 host target gene, herein designated VGAM HOST TARGET GENE, in fact represents a plurality of VGAM2173 host target genes. The mRNA of each one of this plurality of VGAM2173 host target genes comprises one or more host target binding sites, each having a nucleotide sequence which is at least partly complementary to VGAM2173 RNA, herein designated VGAM RNA, and which when bound by VGAM2173 RNA causes inhibition of translation of respective one or more VGAM2173 host target proteins.

It is further appreciated by one skilled in the art that the mode of translational inhibition illustrated by FIG. 1 with specific reference to translational inhibition exerted by VGAM2173 gene, herein designated VGAM GENE, on one or more VGAM2173 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2173 is inhibition of expression of host target genes, as part of a novel viral mechanism of attacking a host. Accordingly, utilities of VGAM2173 include diagnosis, prevention and treatment of viral infection by Parsnip Yellow Fleck Virus. Specific functions, and accordingly utilities, of VGAM2173 correlate with, and may be deduced from, the identity of the host target genes which VGAM2173 binds and inhibits, and the function of these host target genes, as elaborated hereinbelow.

Nucleotide sequences of the VGAM2173 precursor RNA, herein designated VGAM PRECURSOR RNA, and of the 'diced' VGAM2173 RNA, herein designated VGAM RNA, and a schematic representation of the secondary folding of VGAM2173 folded precursor RNA, herein designated VGAM FOLDED PRECURSOR RNA, of VGAM2173 are further described hereinbelow with reference to Table 1.

Nucleotide sequences of host target binding sites, such as BINDING SITE-I, BINDING SITE-II and BINDING SITE-III of FIG. 1, found on VGAM2173 host target RNA, and schematic representation of the complementarity of each of these host target binding sites to VGAM2173 RNA, herein designated VGAM RNA, are described hereinbelow with reference to Table 2.

As mentioned hereinabove with reference to FIG. 1, a function of VGAM2173 gene, herein designated VGAM is inhibition of expression of VGAM2173 target genes. It is appreciated that specific functions, and accordingly utilities, of VGAM2173 correlate with, and may be deduced from, the identity of the target genes which VGAM2173 binds and inhibits, and the function of these target genes, as elaborated hereinbelow.

Calcium Channel, Voltage-dependent, Gamma Subunit 3 (CACNG3, Accession NM_006539) is a VGAM2173 host target gene. CACNG3 BINDING SITE is HOST TARGET binding site found in the 5' untranslated region of mRNA encoded by CACNG3, corresponding to a HOST TARGET binding site such as BINDING SITE I, BINDING SITE II or BINDING SITE III. Table 2 illustrates the complementarity of the nucleotide sequences of CACNG3 BINDING SITE, designated SEQ ID:13291, to the nucleotide sequence of VGAM2173 RNA, herein designated VGAM RNA, also designated SEQ ID:4884.

A function of VGAM2173 is therefore inhibition of Calcium Channel, Voltage-dependent, Gamma Subunit 3 (CACNG3, Accession NM_006539), a gene which is thought to stabilize the calcium channel in an inactivated state. Accordingly, utilities of VGAM2173 include diagnosis, prevention and treatment of diseases and clinical conditions associated with CACNG3. The function of CACNG3 and its association with various diseases and clinical conditions, has been established by previous studies, as described hereinabove with reference to VGAM1551. Collagen, Type XI, Alpha 2 (COL11A2, Accession NM_080680) is another VGAM2173 host target gene. COL11A2 BINDING SITE1 and COL11A2 BINDING SITE2 are HOST TARGET binding sites found in untranslated regions of mRNA encoded by COL11A2, corresponding to HOST TARGET binding sites such as BINDING SITE I, BINDING SITE II or BINDING SITE III. Table 2 illustrates the complementarity of the nucleotide sequences of COL11A2 BINDING SITE1 and COL11A2 BINDING SITE2, designated SEQ ID:27977 and SEQ ID:27982 respectively, to the nucleotide sequence of VGAM2173 RNA, herein designated VGAM RNA, also designated SEQ ID:4884.

Another function of VGAM2173 is therefore inhibition of Collagen, Type XI, Alpha 2 (COL11A2, Accession NM_080680). Accordingly, utilities of VGAM2173 include diagnosis, prevention and treatment of diseases and clinical conditions associated with COL11A2. Hypoxia Up-regulated 1 (HYOU1, Accession XM_006464) is another VGAM2173 host target gene. HYOU1 BINDING SITE is HOST TARGET binding site found in the 3' untranslated region of mRNA encoded by HYOU1, corresponding to a HOST TARGET binding site such as BINDING SITE I, BINDING SITE II or BINDING SITE III. Table 2 illustrates the complementarity of the nucleotide sequences of HYOU1 BINDING SITE, designated SEQ ID:30002, to the nucleotide sequence of VGAM2173 RNA, herein designated VGAM RNA, also designated SEQ ID:4884.

Another function of VGAM2173 is therefore inhibition of Hypoxia Up-regulated 1 (HYOU1, Accession XM_006464). Accordingly, utilities of VGAM2173 include diagnosis, prevention and treatment of diseases and clinical conditions associated with HYOU1. Megakaryocyte-associated Tyrosine Kinase (MATK, Accession NM_002378) is another VGAM2173 host target gene. MATK BINDING SITE is HOST TARGET binding site found in the 5' untranslated region of mRNA encoded by MATK, corresponding to a HOST TARGET binding site such as BINDING SITE I, BINDING SITE II or BINDING SITE III. Table 2 illustrates the complementarity of the nucleotide sequences of MATK BINDING SITE, designated SEQ ID:8193, to the nucleotide sequence of VGAM2173 RNA, herein designated VGAM RNA, also designated SEQ ID:4884.

Another function of VGAM2173 is therefore inhibition of Megakaryocyte-associated Tyrosine Kinase (MATK, Accession NM_002378), a gene which can phosphorylate members of the SRC family of PTKs at the regulatory tyrosine residue. Accordingly, utilities of VGAM2173 include diagnosis, prevention and treatment of diseases and clinical conditions associated with MATK. The function of MATK has been established by previous studies. In the mouse, Klages et al. (1994) reported the molecular cloning and preliminary functional characterization of a nonreceptor protein tyrosine kinase (PTK) that is related to CSK (OMIM Ref. No. 124095). This PTK, designated Ctk for CSK-type protein-tyrosine kinase, was found to be a 52-kD protein expressed primarily in brain and predicted to be structurally similar to CSK. Klages et al. (1994) found that, like CSK, Ctk can phosphorylate members of the SRC family of PTKs at the regulatory tyrosine residue. Thus, Ctk and CSK define a family of kinases that phosphorylate carboxy-terminal regulatory tyrosine residues. Protein-tyrosine kinases play major roles in signal transduction pathways. Bennett et al. (1994) cloned a novel tyrosine kinase, termed megakaryoctye-associated tyrosine kinase (MATK), from a human megakaryocyte cDNA library using degenerate PCR. The MATK cDNA encodes a 527-amino acid protein that shows 50% amino acid identity to CSK and has the structural features of the CSK subfamily: SRC homology SH (2) and SH3 domains, a catalytic domain, a unique N terminus, lack of myristylation signals, lack of a negative regulatory phosphorylation site, and lack of an autophosphorylation site. Bennett et al. (1994) localized the MATK protein to the cytoplasm of megakaryocytic cells using immunofluorescence and immunoblot analysis of subcellular fractions. They showed by Northern blotting that the MATK gene is expressed abundantly in megakaryocytes and at a lower level in adult brain as a 2.3-kb transcript; it was not detectably expressed in any other examined tissue. Bennett et al. (1994) found that MATK expression is upregulated in megakaryocytic cells that are induced to differentiate by phorbol ester. They suggested that MATK functions in signal transduction pathways that are important in megakaryocyte growth and/or differentiation. Avraham et al. (1995) showed that MATK can phosphorylate the SRC (OMIM Ref. No. 176947) protein in vitro. Sakano et al. (1994) cloned the MATK cDNA, named HYL by them, and localized the gene to 19p13.3 using fluorescence in situ hybridization. Avraham et al. (1995) mapped the MATK gene to chromosome 19 using somatic cell hybrids and found that the murine Matk gene maps within a region of synteny on chromosome 10. Zrihan-Licht et al. (1997) reported that MATK is expressed in human breast cancer but not in the adjacent normal breast tissues, suggesting that MATK might be involved in signaling in some cases of breast cancer. Zrihan-Licht et al. (1997) demonstrated that MATK interacts with ErbB-2 (OMIM Ref. No. 164870) in vivo upon heregulin stimulation and that this interaction occurs via the SH2 domain of MATK.

Full details of the abovementioned studies are described in the following publications, the disclosure of which are hereby incorporated by reference:

Klages, S.; Adam, D.; Class, K.; Fargnoli, J.; Bolen, J. B.; Penhallow, R. C.: Ctk: a protein-tyrosine kinase related to Csk that defines an enzyme family. Proc. Nat. Acad. Sci. 91:2597-2601, 1994; and Avraham, S.; Jiang, S.; Ota, S.; Fu, Y.; Deng, B.; Dowler, L. L.; White, R. A.; Avraham, H.: Structural and functional studies of the intracellular tyrosine kinase MATK gene and its tra.

Further studies establishing the function and utilities of MATK are found in John Hopkins OMIM database record ID 600038, and in sited publications numbered 8119-8123 listed in the bibliography section hereinbelow, which are also hereby incorporated by reference. Paired Box Gene 5 (B-cell lineage specific activator protein) (PAX5, Accession NM_016734) is another VGAM2173 host target gene. PAX5 BINDING SITE is HOST TARGET binding site found in the 3' untranslated region of mRNA encoded by PAX5, corresponding to a HOST TARGET binding site such as BINDING SITE I, BINDING SITE II or BINDING SITE III. Table 2 illustrates the complementarity of the nucleotide sequences of PAX5 BINDING SITE, designated SEQ ID:18788, to the nucleotide sequence of VGAM2173 RNA, herein designated VGAM RNA, also designated SEQ ID:4884.

Another function of VGAM2173 is therefore inhibition of Paired Box Gene 5 (B-cell lineage specific activator protein) (PAX5, Accession NM_016734), a gene which plays a role in B-cell differentiation, neural development and spermatogenesis. Accordingly, utilities of VGAM2173 include diagnosis, prevention and treatment of diseases and clinical conditions associated with PAX5. The function of PAX5 and its association with various diseases and clinical conditions, has been established by previous studies, as described hereinabove with reference to VGAM1151. Prokineticin 1 (PROK1, Accession NM_032414) is another VGAM2173 host target gene. PROK1 BINDING SITE is HOST TARGET binding site found in the 3' untranslated region of mRNA encoded by PROK1, corresponding to a HOST TARGET binding site such as BINDING SITE I, BINDING SITE II or BINDING SITE III. Table 2 illustrates the complementarity of the nucleotide sequences of PROK1 BINDING SITE, designated SEQ ID:26196, to the nucleotide sequence of VGAM2173 RNA, herein designated VGAM RNA, also designated SEQ ID:4884.

Another function of VGAM2173 is therefore inhibition of Prokineticin 1 (PROK1, Accession NM_032414), a gene which induces proliferation, migration and fenestration in capillary endothelial cells derived from endocrine glands. Accordingly, utilities of VGAM2173 include diagnosis, prevention and treatment of diseases and clinical conditions associated with PROK1. The function of PROK1 and its association with various diseases and clinical conditions, has been established by previous studies, as described hereinabove with reference to VGAM1000. Transcription Factor 3 (E2A immunoglobulin enhancer binding factors E12/E47) (TCF3, Accession XM_047600) is another VGAM2173 host target gene. TCF3 BINDING SITE is HOST TARGET binding site found in the 3' untranslated region of mRNA encoded by TCF3, corresponding to a HOST TARGET binding site such as BINDING SITE I, BINDING SITE II or BINDING SITE III. Table 2 illustrates the complementarity of the nucleotide sequences of TCF3 BINDING SITE, designated SEQ ID:35004, to the nucleotide sequence of VGAM2173 RNA, herein designated VGAM RNA, also designated SEQ ID:4884.

Another function of VGAM2173 is therefore inhibition of Transcription Factor 3 (E2A immunoglobulin enhancer binding factors E12/E47) (TCF3, Accession XM_047600), a gene which plays major roles in determining tissue-specific cell fate during embryogenesis. Accordingly, utilities of VGAM2173 include diagnosis, prevention and treatment of diseases and clinical conditions associated with TCF3. The function of TCF3 and its association with various diseases and clinical conditions, has been established by previous studies, as described hereinabove with reference to VGAM144. XT3 (Accession NM_020208) is another VGAM2173 host target gene. XT3 BINDING SITE is HOST TARGET binding site found in the 3' untranslated region of mRNA encoded by XT3, corresponding to a HOST TARGET binding site such as BINDING SITE I, BINDING SITE II or BINDING SITE III. Table 2 illustrates the complementarity of the nucleotide sequences of XT3 BINDING SITE, designated SEQ ID:21437, to the nucleotide sequence of VGAM2173 RNA, herein designated VGAM RNA, also designated SEQ ID:4884.

Another function of VGAM2173 is therefore inhibition of XT3 (Accession NM_020208), a gene which is a Kidney-specific orphan transporter. Accordingly, utilities of VGAM2173 include diagnosis, prevention and treatment of diseases and clinical conditions associated with XT3. The function of XT3 and its association with various diseases and clinical conditions, has been established by previous studies, as described hereinabove with reference to VGAM21. Baculoviral IAP Repeat-containing 1 (BIRC1, Accession NM_004536) is another VGAM2173 host target gene. BIRC1 BINDING SITE is HOST TARGET binding site found in the 3' untranslated region of mRNA encoded by BIRC1, corresponding to a HOST TARGET binding site such as BINDING SITE I, BINDING SITE II or BINDING SITE III. Table 2 illustrates the complementarity of the nucleotide sequences of BIRC1 BINDING SITE, designated SEQ ID:10879, to the nucleotide sequence of VGAM2173 RNA, herein designated VGAM RNA, also designated SEQ ID:4884.

Another function of VGAM2173 is therefore inhibition of Baculoviral IAP Repeat-containing 1 (BIRC1, Accession NM_004536). Accordingly, utilities of VGAM2173 include diagnosis, prevention and treatment of diseases and clinical conditions associated with BIRC1. Chemokine (C-C motif) Receptor 5 (CCR5, Accession NM_000579) is another VGAM2173 host target gene. CCR5 BINDING SITE is HOST TARGET binding site found in the 3' untranslated region of mRNA encoded by CCR5, corresponding to a HOST TARGET binding site such as BINDING SITE I, BINDING SITE II or BINDING SITE III. Table 2 illustrates the complementarity of the nucleotide sequences of CCR5 BINDING SITE, designated SEQ ID:6181, to the nucleotide sequence of VGAM2173 RNA, herein designated VGAM RNA, also designated SEQ ID:4884.

Another function of VGAM2173 is therefore inhibition of Chemokine (C-C motif) Receptor 5 (CCR5, Accession NM_000579). Accordingly, utilities of VGAM2173 include diagnosis, prevention and treatment of diseases and clinical conditions associated with CCR5. DKFZP564D166 (Accession NM_030658) is another VGAM2173 host target gene. DKFZP564D166 BINDING SITE is HOST TARGET binding site found in the 3' untranslated region of mRNA encoded by DKFZP564D166, corresponding to a HOST TARGET binding site such as BINDING SITE I, BINDING SITE II or BINDING SITE III. Table 2 illustrates the complementarity of the nucleotide sequences of DKFZP564D166 BINDING SITE, designated SEQ ID:24988, to the nucleotide sequence of VGAM2173 RNA, herein designated VGAM RNA, also designated SEQ ID:4884.

Another function of VGAM2173 is therefore inhibition of DKFZP564D166 (Accession NM_030658). Accordingly, utilities of VGAM2173 include diagnosis, prevention and treatment of diseases and clinical conditions associated with DKFZP564D166. FLJ20400 (Accession XM_039306) is another VGAM2173 host target gene. FLJ20400 BINDING SITE is HOST TARGET binding site found in the 3' untranslated region of mRNA encoded by FLJ20400, corresponding to a HOST TARGET binding site such as BINDING SITE I, BINDING SITE II or BINDING SITE III. Table 2 illustrates the complementarity of the nucleotide sequences of FLJ20400 BINDING SITE, designated SEQ ID:33043, to the nucleotide sequence of VGAM2173 RNA, herein designated VGAM RNA, also designated SEQ ID:4884.

Another function of VGAM2173 is therefore inhibition of FLJ20400 (Accession XM_039306). Accordingly, utilities of VGAM2173 include diagnosis, prevention and treatment of diseases and clinical conditions associated with FLJ20400. KIAA0193 (Accession NM_014766) is another VGAM2173 host target gene. KIAA0193 BINDING SITE is HOST TARGET binding site found in the 3' untranslated region of mRNA encoded by KIAA0193, corresponding to a HOST TARGET binding site such as BINDING SITE I, BINDING SITE II or BINDING SITE III. Table 2 illustrates the complementarity of the nucleotide sequences of KIAA0193 BINDING SITE, designated SEQ ID:16537, to the nucleotide sequence of VGAM2173 RNA, herein designated VGAM RNA, also designated SEQ ID:4884.

Another function of VGAM2173 is therefore inhibition of KIAA0193 (Accession NM_014766). Accordingly, utilities of VGAM2173 include diagnosis, prevention and treatment of diseases and clinical conditions associated with KIAA0193. KIAA0648 (Accession XM_094043) is another VGAM2173 host target gene. KIAA0648 BINDING SITE is HOST TARGET binding site found in the 3' untranslated region of mRNA encoded by KIAA0648, corresponding to a HOST TARGET binding site such as BINDING SITE I, BINDING SITE II or BINDING SITE III. Table 2 illustrates the complementarity of the nucleotide sequences of KIAA0648 BINDING SITE, designated SEQ ID:40218, to the nucleotide sequence of VGAM2173 RNA, herein designated VGAM RNA, also designated SEQ ID:4884.

Another function of VGAM2173 is therefore inhibition of KIAA0648 (Accession XM_094043). Accordingly, utilities of VGAM2173 include diagnosis, prevention and treatment of diseases and clinical conditions associated with KIAA0648. KIAA0903 (Accession XM_049251) is another VGAM2173 host target gene. KIAA0903 BINDING SITE is HOST TARGET binding site found in the 3' untranslated region of mRNA encoded by KIAA0903, corresponding to a HOST TARGET binding site such as BINDING SITE I, BINDING SITE II or BINDING SITE III. Table 2 illustrates the complementarity of the nucleotide sequences of KIAA0903 BINDING SITE, designated SEQ ID:35366, to the nucleotide sequence of VGAM2173 RNA, herein designated VGAM RNA, also designated SEQ ID:4884.

Another function of VGAM2173 is therefore inhibition of KIAA0903 (Accession XM_049251). Accordingly, utilities of VGAM2173 include diagnosis, prevention and treatment of diseases and clinical conditions associated with KIAA0903. KIAA1037 (Accession NM_015023) is another VGAM2173 host target gene. KIAA1037 BINDING SITE is HOST TARGET binding site found in the 3' untranslated region of mRNA encoded by KIAA1037, corresponding to a HOST TARGET binding site such as BINDING SITE I, BINDING SITE II or BINDING SITE III. Table 2 illustrates the complementarity of the nucleotide sequences of KIAA1037 BINDING SITE, designated SEQ ID:17384, to the nucleotide sequence of VGAM2173 RNA, herein designated VGAM RNA, also designated SEQ ID:4884.

Another function of VGAM2173 is therefore inhibition of KIAA1037 (Accession NM_015023). Accordingly, utilities of VGAM2173 include diagnosis, prevention and treatment of diseases and clinical conditions associated with KIAA1037. KIAA1786 (Accession XM_038436) is another VGAM2173 host target gene. KIAA1786 BINDING SITE is HOST TARGET binding site found in the 3' untranslated region of mRNA encoded by KIAA1786, corresponding to a HOST TARGET binding site such as BINDING SITE I, BINDING SITE II or BINDING SITE III. Table 2 illustrates the complementarity of the nucleotide sequences of KIAA1786 BINDING SITE, designated SEQ ID:32844, to the nucleotide sequence of VGAM2173 RNA, herein designated VGAM RNA, also designated SEQ ID:4884.

Another function of VGAM2173 is therefore inhibition of KIAA1786 (Accession XM_038436). Accordingly, utilities of VGAM2173 include diagnosis, prevention and treatment of diseases and clinical conditions associated with KIAA1786. NSE1 (Accession NM_145175) is another VGAM2173 host target gene. NSE1 BINDING SITE is HOST TARGET binding site found in the 3' untranslated region of mRNA encoded by NSE1, corresponding to a HOST TARGET binding site such as BINDING SITE I, BINDING SITE II or BINDING SITE III. Table 2 illustrates the complementarity of the nucleotide sequences of NSE1 BINDING SITE, designated SEQ ID:29736, to the nucleotide sequence of VGAM2173 RNA, herein designated VGAM RNA, also designated SEQ ID:4884.

Another function of VGAM2173 is therefore inhibition of NSE1 (Accession NM_145175). Accordingly, utilities of VGAM2173 include diagnosis, prevention and treatment of diseases and clinical conditions associated with NSE1. P450RAI-2 (Accession NM_019885) is another VGAM2173 host target gene. P450RAI-2 BINDING SITE is HOST TARGET binding site found in the 3' untranslated region of mRNA encoded by P450RAI-2, corresponding to a HOST TARGET binding site such as BINDING SITE I, BINDING SITE II or BINDING SITE III. Table 2 illustrates the complementarity of the nucleotide sequences of P450RAI-2 BINDING SITE, designated SEQ ID:21269, to the nucleotide sequence of VGAM2173 RNA, herein designated VGAM RNA, also designated SEQ ID:4884.

Another function of VGAM2173 is therefore inhibition of P450RAI-2 (Accession NM_019885). Accordingly, utilities of VGAM2173 include diagnosis, prevention and treatment of diseases and clinical conditions associated with P450RAI-2. Protein Serine Kinase H1 (PSKH1, Accession XM_043047) is another VGAM2173 host target gene. PSKH1 BINDING SITE is HOST TARGET binding site found in the 3' untranslated region of mRNA encoded by PSKH1, corresponding to a HOST TARGET binding site such as BINDING SITE I, BINDING SITE II or BINDING SITE III. Table 2 illustrates the complementarity of the nucleotide sequences of PSKH1 BINDING SITE, designated SEQ ID:33866, to the nucleotide sequence of VGAM2173 RNA, herein designated VGAM RNA, also designated SEQ ID:4884.

Another function of VGAM2173 is therefore inhibition of Protein Serine Kinase H1 (PSKH1, Accession XM_043047). Accordingly, utilities of VGAM2173 include diagnosis, prevention and treatment of diseases and clinical conditions associated with PSKH1. RAB40A, Member RAS Oncogene Family (RAB40A, Accession XM_088733) is another VGAM2173 host target gene. RAB40A BINDING SITE is HOST TARGET binding site found in the 5' untranslated region of mRNA encoded by RAB40A, corresponding to a HOST TARGET binding site such as BINDING SITE I, BINDING SITE II or BINDING SITE III. Table 2 illustrates the complementarity of the nucleotide sequences of RAB40A BINDING SITE, designated SEQ ID:39927, to the nucleotide sequence of VGAM2173 RNA, herein designated VGAM RNA, also designated SEQ ID:4884.

Another function of VGAM2173 is therefore inhibition of RAB40A, Member RAS Oncogene Family (RAB40A, Accession XM_088733). Accordingly, utilities of VGAM2173 include diagnosis, prevention and treatment of diseases and clinical conditions associated with RAB40A. Rho-related BTB Domain Containing 2 (RHOBTB2, Accession XM_027679) is another VGAM2173 host target gene. RHOBTB2 BINDING SITE is HOST TARGET binding site found in the 3' untranslated region of mRNA encoded by RHOBTB2, corresponding to a HOST TARGET binding site such as BINDING SITE I, BINDING SITE II or BINDING SITE III. Table 2 illustrates the complementarity of the nucleotide sequences of RHOBTB2 BINDING SITE, designated SEQ ID:30557, to the nucleotide sequence of VGAM2173 RNA, herein designated VGAM RNA, also designated SEQ ID:4884.

Another function of VGAM2173 is therefore inhibition of Rho-related BTB Domain Containing 2 (RHOBTB2, Accession XM_027679). Accordingly, utilities of VGAM2173 include diagnosis, prevention and treatment of diseases and clinical conditions associated with RHOBTB2. SEC15B (Accession XM_039570) is another VGAM2173 host target gene. SEC15B BINDING SITE is HOST TARGET binding site found in the 3' untranslated region of mRNA encoded by SEC15B, corresponding to a HOST TARGET binding site such as BINDING SITE I, BINDING SITE II or BINDING SITE III. Table 2 illustrates the complementarity of the nucleotide sequences of SEC15B BINDING SITE, designated SEQ ID:33123, to the nucleotide sequence of VGAM2173

RNA, herein designated VGAM RNA, also designated SEQ ID:4884.

Another function of VGAM2173 is therefore inhibition of SEC15B (Accession XM_039570). Accordingly, utilities of VGAM2173 include diagnosis, prevention and treatment of diseases and clinical conditions associated with SEC15B. WD Repeat Domain 7 (WDR7, Accession NM_015285) is another VGAM2173 host target gene. WDR7 BINDING SITE is HOST TARGET binding site found in the 3' untranslated region of mRNA encoded by WDR7, corresponding to a HOST TARGET binding site such as BINDING SITE I, BINDING SITE II or BINDING SITE III. Table 2 illustrates the complementarity of the nucleotide sequences of WDR7 BINDING SITE, designated SEQ ID:17607, to the nucleotide sequence of VGAM2173 RNA, herein designated VGAM RNA, also designated SEQ ID:4884.

Another function of VGAM2173 is therefore inhibition of WD Repeat Domain 7 (WDR7, Accession NM_015285). Accordingly, utilities of VGAM2173 include diagnosis, prevention and treatment of diseases and clinical conditions associated with WDR7. LOC144558 (Accession XM_096629) is another VGAM2173 host target gene. LOC144558 BINDING SITE is HOST TARGET binding site found in the 5' untranslated region of mRNA encoded by LOC144558, corresponding to a HOST TARGET binding site such as BINDING SITE I, BINDING SITE II or BINDING SITE III. Table 2 illustrates the complementarity of the nucleotide sequences of LOC144558 BINDING SITE, designated SEQ ID:40436, to the nucleotide sequence of VGAM2173 RNA, herein designated VGAM RNA, also designated SEQ ID:4884.

Another function of VGAM2173 is therefore inhibition of LOC144558 (Accession XM_096629). Accordingly, utilities of VGAM2173 include diagnosis, prevention and treatment of diseases and clinical conditions associated with LOC144558. LOC153196 (Accession XM_098323) is another VGAM2173 host target gene. LOC153196 BINDING SITE is HOST TARGET binding site found in the 5' untranslated region of mRNA encoded by LOC153196, corresponding to a HOST TARGET binding site such as BINDING SITE I, BINDING SITE II or BINDING SITE III. Table 2 illustrates the complementarity of the nucleotide sequences of LOC153196 BINDING SITE, designated SEQ ID:41584, to the nucleotide sequence of VGAM2173 RNA, herein designated VGAM RNA, also designated SEQ ID:4884.

Another function of VGAM2173 is therefore inhibition of LOC153196 (Accession XM_098323). Accordingly, utilities of VGAM2173 include diagnosis, prevention and treatment of diseases and clinical conditions associated with LOC153196. LOC219731 (Accession XM_167596) is another VGAM2173 host target gene. LOC219731 BINDING SITE is HOST TARGET binding site found in the 5' untranslated region of mRNA encoded by LOC219731, corresponding to a HOST TARGET binding site such as BINDING SITE I, BINDING SITE II or BINDING SITE III. Table 2 illustrates the complementarity of the nucleotide sequences of LOC219731 BINDING SITE, designated SEQ ID:44714, to the nucleotide sequence of VGAM2173 RNA, herein designated VGAM RNA, also designated SEQ ID:4884.

Another function of VGAM2173 is therefore inhibition of LOC219731 (Accession XM_167596). Accordingly, utilities of VGAM2173 include diagnosis, prevention and treatment of diseases and clinical conditions associated with LOC219731. LOC91759 (Accession XM_040467) is another VGAM2173 host target gene. LOC91759 BINDING SITE is HOST TARGET binding site found in the 3' untranslated region of mRNA encoded by LOC91759, corresponding to a HOST TARGET binding site such as BINDING SITE I, BINDING SITE II or BINDING SITE III. Table 2 illustrates the complementarity of the nucleotide sequences of LOC91759 BINDING SITE, designated SEQ ID:33302, to the nucleotide sequence of VGAM2173 RNA, herein designated VGAM RNA, also designated SEQ ID:4884.

Another function of VGAM2173 is therefore inhibition of LOC91759 (Accession XM_040467). Accordingly, utilities of VGAM2173 include diagnosis, prevention and treatment of diseases and clinical conditions associated with LOC91759. FIG. 1 further provides a conceptual description of a novel bioinformatically detected viral gene of the present invention, referred to here as Viral Genomic Address Messenger 2174 (VGAM2174) viral gene, which modulates expression of respective host target genes thereof, the function and utility of which host target genes is known in the art.

VGAM2174 is a novel bioinformatically detected regulatory, non protein coding, viral micro RNA (miRNA) gene. The method by which VGAM2174 was detected is described hereinabove with reference to FIGS. 1-8.

VGAM2174 gene, herein designated VGAM GENE, is a viral gene contained in the genome of Rabbit Fibroma Virus. VGAM2174 host target gene, herein designated VGAM HOST TARGET GENE, is a human gene contained in the human genome.

VGAM2174 gene encodes a VGAM2174 precursor RNA, herein designated VGAM PRECURSOR RNA. Similar to other miRNA genes, and unlike most ordinary genes, VGAM2174 precursor RNA does not encode a protein. A nucleotide sequence identical or highly similar to the nucleotide sequence of VGAM2174 precursor RNA is designated SEQ ID:2160, and is provided hereinbelow with reference to the sequence listing part. Nucleotide sequence SEQ ID:2160 is located at position 17511 relative to the genome of Rabbit Fibroma Virus.

VGAM2174 precursor RNA folds onto itself, forming VGAM2174 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2174 folded precursor RNA into VGAM2174 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM2174 RNA is designated SEQ ID:4885, and is provided hereinbelow with reference to the sequence listing part.

VGAM2174 host target gene, herein designated VGAM HOST TARGET GENE, encodes a corresponding messenger RNA, VGAM2174 host target RNA, herein designated VGAM HOST TARGET RNA. VGAM2174 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2174 RNA, herein designated VGAM RNA, binds complementarily to one or more host target binding sites located in untranslated regions of VGAM2174 host target RNA, herein designated VGAM HOST TARGET RNA. This complementary binding is due to the fact that the nucleotide sequence of VGAM2174 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2174 RNA, herein designated VGAM RNA, may have a different number of host target binding sites in untranslated regions of a VGAM2174 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2174 RNA, herein designated VGAM RNA, to host target binding sites on VGAM2174 host target RNA, herein designated VGAM HOST TARGET RNA, such as BINDING SITE I, BINDING SITE II and BINDING SITE III, inhibits translation of VGAM2174 host target RNA into VGAM2174 host target protein, herein designated VGAM HOST TARGET PROTEIN. VGAM host target protein is therefore outlined by a broken line.

It is appreciated that VGAM2174 host target gene, herein designated VGAM HOST TARGET GENE, in fact represents a plurality of VGAM2174 host target genes. The mRNA of each one of this plurality of VGAM2174 host target genes comprises one or more host target binding sites, each having a nucleotide sequence which is at least partly complementary to VGAM2174 RNA, herein designated VGAM RNA, and which when bound by VGAM2174 RNA causes inhibition of translation of respective one or more VGAM2174 host target proteins.

It is further appreciated by one skilled in the art that the mode of translational inhibition illustrated by FIG. 1 with specific reference to translational inhibition exerted by VGAM2174 gene, herein designated VGAM GENE, on one or more VGAM2174 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2174 is inhibition of expression of host target genes, as part of a novel viral mechanism of attacking a host. Accordingly, utilities of VGAM2174 include diagnosis, prevention and treatment of viral infection by Rabbit Fibroma Virus. Specific functions, and accordingly utilities, of VGAM2174 correlate with, and may be deduced from, the identity of the host target genes which VGAM2174 binds and inhibits, and the function of these host target genes, as elaborated hereinbelow.

Nucleotide sequences of the VGAM2174 precursor RNA, herein designated VGAM PRECURSOR RNA, and of the 'diced' VGAM2174 RNA, herein designated VGAM RNA, and a schematic representation of the secondary folding of VGAM2174 folded precursor RNA, herein designated VGAM FOLDED PRECURSOR RNA, of VGAM2174 are further described hereinbelow with reference to Table 1.

Nucleotide sequences of host target binding sites, such as BINDING SITE-I, BINDING SITE-II and BINDING SITE-III of FIG. 1, found on VGAM2174 host target RNA, and schematic representation of the complementarity of each of these host target binding sites to VGAM2174 RNA, herein designated VGAM RNA, are described hereinbelow with reference to Table 2.

As mentioned hereinabove with reference to FIG. 1, a function of VGAM2174 gene, herein designated VGAM is inhibition of expression of VGAM2174 target genes. It is appreciated that specific functions, and accordingly utilities, of VGAM2174 correlate with, and may be deduced from, the identity of the target genes which VGAM2174 binds and inhibits, and the function of these target genes, as elaborated hereinbelow.

UDP-Gal:betaGlcNAc Beta 1,4-Galactosyltransferase, Polypeptide 5 (B4GALT5, Accession NM_004776) is a VGAM2174 host target gene. B4GALT5 BINDING SITE is HOST TARGET binding site found in the 3' untranslated region of mRNA encoded by B4GALT5, corresponding to a HOST TARGET binding site such as BINDING SITE I, BINDING SITE II or BINDING SITE III. Table 2 illustrates the complementarity of the nucleotide sequences of B4GALT5 BINDING SITE, designated SEQ ID:11166, to the nucleotide sequence of VGAM2174 RNA, herein designated VGAM RNA, also designated SEQ ID:4885.

A function of VGAM2174 is therefore inhibition of UDP-Gal:betaGlcNAc Beta 1,4-Galactosyltransferase, Polypeptide 5 (B4GALT5, Accession NM_004776). Accordingly, utilities of VGAM2174 include diagnosis, prevention and treatment of diseases and clinical conditions associated with B4GALT5. Roundabout, Axon Guidance Receptor, Homolog 1 (Drosophila) (ROBO1, Accession NM_133631) is another VGAM2174 host target gene. ROBO1 BINDING SITE1 and ROBO1 BINDING SITE2 are HOST TARGET binding sites found in untranslated regions of mRNA encoded by ROBO1, corresponding to HOST TARGET binding sites such as BINDING SITE I, BINDING SITE II or BINDING SITE III. Table 2 illustrates the complementarity of the nucleotide sequences of ROBO1 BINDING SITE1 and ROBO1 BINDING SITE2, designated SEQ ID:28586 and SEQ ID:8850 respectively, to the nucleotide sequence of VGAM2174 RNA, herein designated VGAM RNA, also designated SEQ ID:4885.

Another function of VGAM2174 is therefore inhibition of Roundabout, Axon Guidance Receptor, Homolog 1 (Drosophila) (ROBO1, Accession NM_133631), a gene which is an axon guidance receptor. Accordingly, utilities of VGAM2174 include diagnosis, prevention and treatment of diseases and clinical conditions associated with ROBO1. The function of ROBO1 and its association with various diseases and clinical conditions, has been established by previous studies, as described hereinabove with reference to VGAM37. KIAA0276 (Accession XM_048199) is another VGAM2174 host target gene. KIAA0276 BINDING SITE is HOST TARGET binding site found in the 3' untranslated region of mRNA encoded by KIAA0276, corresponding to a HOST TARGET binding site such as BINDING SITE I, BINDING SITE II or BINDING SITE III. Table 2 illustrates the complementarity of the nucleotide sequences of KIAA0276 BINDING SITE, designated SEQ ID:35139, to the nucleotide sequence of VGAM2174 RNA, herein designated VGAM RNA, also designated SEQ ID:4885.

Another function of VGAM2174 is therefore inhibition of KIAA0276 (Accession XM_048199). Accordingly, utilities of VGAM2174 include diagnosis, prevention and treatment of diseases and clinical conditions associated with KIAA0276. KIAA0976 (Accession NM_014917) is another VGAM2174 host target gene. KIAA0976 BINDING SITE is HOST TARGET binding site found in the 3' untranslated region of mRNA encoded by KIAA0976, corresponding to a HOST TARGET binding site such as BINDING SITE I, BINDING SITE II or BINDING SITE III. Table 2 illustrates the complementarity of the nucleotide sequences of KIAA0976 BINDING SITE, designated SEQ ID:17163, to the nucleotide sequence of VGAM2174 RNA, herein designated VGAM RNA, also designated SEQ ID:4885.

Another function of VGAM2174 is therefore inhibition of KIAA0976 (Accession NM_014917). Accordingly, utilities of VGAM2174 include diagnosis, prevention and treatment of diseases and clinical conditions associated with KIAA0976. PRO0618 (Accession NM_014133) is another VGAM2174 host target gene. PRO0618 BINDING SITE is HOST TARGET binding site found in the 3' untranslated region of mRNA encoded by PRO0618, corresponding to a HOST TARGET binding site such as BINDING SITE I, BINDING SITE II or BINDING SITE III. Table 2 illustrates the complementarity of the nucleotide sequences of PRO0618 BINDING SITE, designated SEQ ID:15399, to the nucleotide sequence of VGAM2174 RNA, herein designated VGAM RNA, also designated SEQ ID:4885.

Another function of VGAM2174 is therefore inhibition of PRO0618 (Accession NM_014133). Accordingly, utilities of VGAM2174 include diagnosis, prevention and treatment of diseases and clinical conditions associated with PRO0618. LOC90092 (Accession XM_028862) is another VGAM2174 host target gene. LOC90092 BINDING SITE is HOST TARGET binding site found in the 3' untranslated region of mRNA encoded by LOC90092, corresponding to a HOST TARGET binding site such as BINDING SITE I, BINDING SITE II or BINDING SITE III. Table 2 illustrates the complementarity of the nucleotide sequences of LOC90092 BINDING SITE, designated SEQ ID:30783, to the nucleotide sequence of VGAM2174 RNA, herein designated VGAM RNA, also designated SEQ ID:4885.

Another function of VGAM2174 is therefore inhibition of LOC90092 (Accession XM_028862). Accordingly, utilities of VGAM2174 include diagnosis, prevention and treatment of diseases and clinical conditions associated with LOC90092. FIG. 1 further provides a conceptual description of a novel bioinformatically detected viral gene of the present invention, referred to here as Viral Genomic Address Messenger 2175 (VGAM2175) viral gene, which modulates expression of respective host target genes thereof, the function and utility of which host target genes is known in the art.

VGAM2175 is a novel bioinformatically detected regulatory, non protein coding, viral micro RNA (miRNA) gene. The method by which VGAM2175 was detected is described hereinabove with reference to FIGS. 1-8.

VGAM2175 gene, herein designated VGAM GENE, is a viral gene contained in the genome of Rabbit Fibroma Virus. VGAM2175 host target gene, herein designated VGAM HOST TARGET GENE, is a human gene contained in the human genome.

VGAM2175 gene encodes a VGAM2175 precursor RNA, herein designated VGAM PRECURSOR RNA. Similar to other miRNA genes, and unlike most ordinary genes, VGAM2175 precursor RNA does not encode a protein. A nucleotide sequence identical or highly similar to the nucleotide sequence of VGAM2175 precursor RNA is designated SEQ ID:2161, and is provided hereinbelow with reference to the sequence listing part. Nucleotide sequence SEQ ID:2161 is located at position 10893 relative to the genome of Rabbit Fibroma Virus.

VGAM2175 precursor RNA folds onto itself, forming VGAM2175 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2175 folded precursor RNA into VGAM2175 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 68%) nucleotide sequence of VGAM2175 RNA is designated SEQ ID:4886, and is provided hereinbelow with reference to the sequence listing part.

VGAM2175 host target gene, herein designated VGAM HOST TARGET GENE, encodes a corresponding messenger RNA, VGAM2175 host target RNA, herein designated VGAM HOST TARGET RNA. VGAM2175 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2175 RNA, herein designated VGAM RNA, binds complementarily to one or more host target binding sites located in untranslated regions of VGAM2175 host target RNA, herein designated VGAM HOST TARGET RNA. This complementary binding is due to the fact that the nucleotide sequence of VGAM2175 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2175 RNA, herein designated VGAM RNA, may have a different number of host target binding sites in untranslated regions of a VGAM2175 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2175 RNA, herein designated VGAM RNA, to host target binding sites on VGAM2175 host target RNA, herein designated VGAM HOST TARGET RNA, such as BINDING SITE I, BINDING SITE II and BINDING SITE III, inhibits translation of VGAM2175 host target RNA into VGAM2175 host target protein, herein designated VGAM HOST TARGET PROTEIN. VGAM host target protein is therefore outlined by a broken line.

It is appreciated that VGAM2175 host target gene, herein designated VGAM HOST TARGET GENE, in fact represents a plurality of VGAM2175 host target genes. The mRNA of each one of this plurality of VGAM2175 host target genes comprises one or more host target binding sites, each having a nucleotide sequence which is at least partly complementary to VGAM2175 RNA, herein designated VGAM RNA, and which when bound by VGAM2175 RNA causes inhibition of translation of respective one or more VGAM2175 host target proteins.

It is further appreciated by one skilled in the art that the mode of translational inhibition illustrated by FIG. 1 with specific reference to translational inhibition exerted by VGAM2175 gene, herein designated VGAM GENE, on one or more VGAM2175 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2175 is inhibition of expression of host target genes, as part of a novel viral mechanism of attacking a host. Accordingly, utilities of VGAM2175 include diagnosis, prevention and treatment of viral infection by Rabbit Fibroma Virus. Specific functions, and accordingly utilities, of VGAM2175 correlate with, and may be deduced from, the identity of the host target genes which VGAM2175 binds and inhibits, and the function of these host target genes, as elaborated hereinbelow.

Nucleotide sequences of the VGAM2175 precursor RNA, herein designated VGAM PRECURSOR RNA, and of the 'diced' VGAM2175 RNA, herein designated VGAM RNA, and a schematic representation of the secondary folding of VGAM2175 folded precursor RNA, herein designated VGAM FOLDED PRECURSOR RNA, of VGAM2175 are further described hereinbelow with reference to Table 1.

Nucleotide sequences of host target binding sites, such as BINDING SITE-I, BINDING SITE-II and BINDING SITE-III of FIG. 1, found on VGAM2175 host target RNA, and schematic representation of the complementarity of each of these host target binding sites to VGAM2175 RNA, herein designated VGAM RNA, are described hereinbelow with reference to Table 2.

As mentioned hereinabove with reference to FIG. 1, a function of VGAM2175 gene, herein designated VGAM is inhibition of expression of VGAM2175 target genes. It is appreciated that specific functions, and accordingly utilities, of VGAM2175 correlate with, and may be deduced from, the identity of the target genes which VGAM2175 binds and inhibits, and the function of these target genes, as elaborated hereinbelow.

ATPase, Class VI, Type 11B (ATP11B, Accession XM_087254) is a VGAM2175 host target gene. ATP11B BINDING SITE is HOST TARGET binding site found in the 3' untranslated region of mRNA encoded by ATP11B, corresponding to a HOST TARGET binding site such as BINDING SITE I, BINDING SITE II or BINDING SITE III. Table 2 illustrates the complementarity of the nucleotide sequences of ATP11B BINDING SITE, designated SEQ ID:39142, to the nucleotide sequence of VGAM2175 RNA, herein designated VGAM RNA, also designated SEQ ID:4886.

A function of VGAM2175 is therefore inhibition of ATPase, Class VI, Type 11B (ATP11B, Accession XM_087254), a gene which is phosphorylated in their intermediate state, drives uphill transport of ions across membranes. Accordingly, utilities of VGAM2175 include diagnosis, prevention and treatment of diseases and clinical conditions associated with ATP11B. The function of ATP11B and its association with various diseases and clinical conditions, has been established by previous studies, as described hereinabove with reference to VGAM665. Egl Nine Homolog 3 (C. elegans) (EGLN3, Accession NM_022073) is another VGAM2175 host target gene. EGLN3 BINDING SITE is HOST TARGET binding site found in the 3' untranslated region of mRNA encoded by EGLN3, corresponding to a HOST TARGET binding site such as BINDING SITE I, BINDING SITE II or BINDING SITE III. Table 2 illustrates the complementarity of the nucleotide sequences of EGLN3 BINDING SITE, designated SEQ ID:22616, to the nucleotide sequence of VGAM2175 RNA, herein designated VGAM RNA, also designated SEQ ID:4886.

Another function of VGAM2175 is therefore inhibition of Egl Nine Homolog 3 (C. elegans) (EGLN3, Accession NM_022073), a gene which is an essential component of the pathway. Accordingly, utilities of VGAM2175 include diagnosis, prevention and treatment of diseases and clinical conditions associated with EGLN3. The function of EGLN3 and its association with various diseases and clinical conditions, has been established by previous studies, as described hereinabove with reference to VGAM206. Phosphodiesterase 4D, CAMP-specific (phosphodiesterase E3 dunce homolog, Drosophila) (PDE4D, Accession XM_056815) is another VGAM2175 host target gene. PDE4D BINDING SITE is HOST TARGET binding site found in the 3' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36433, to the nucleotide sequence of VGAM2175 RNA, herein designated VGAM RNA, also designated SEQ ID:4886.

Another function of VGAM2175 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM2175 include diagnosis, prevention and treatment of diseases and clinical conditions associated with PDE4D. The function of PDE4D and its association with various diseases and clinical conditions, has been established by previous studies, as described hereinabove with reference to VGAM180. Roundabout, Axon Guidance Receptor, Homolog 1 (Drosophila) (ROBO1, Accession NM_133631) is another VGAM2175 host target gene. ROBO1 BINDING SITE1 and ROBO1 BINDING SITE2 are HOST TARGET binding sites found in untranslated regions of mRNA encoded by ROBO1, corresponding to HOST TARGET binding sites such as BINDING SITE I, BINDING SITE II or BINDING SITE III. Table 2 illustrates the complementarity of the nucleotide sequences of ROBO1 BINDING SITE1 and ROBO1 BINDING SITE2, designated SEQ ID:28587 and SEQ ID:8851 respectively, to the nucleotide sequence of VGAM2175 RNA, herein designated VGAM RNA, also designated SEQ ID:4886.

Another function of VGAM2175 is therefore inhibition of Roundabout, Axon Guidance Receptor, Homolog 1 (Drosophila) (ROBO1, Accession NM_133631), a gene which is an axon guidance receptor. Accordingly, utilities of VGAM2175 include diagnosis, prevention and treatment of diseases and clinical conditions associated with ROBO1. The function of ROBO1 and its association with various diseases and clinical conditions, has been established by previous studies, as described hereinabove with reference to VGAM37. Transcription Termination Factor, RNA Polymerase II (TTF2, Accession NM_003594) is another VGAM2175 host target gene. TTF2 BINDING SITE is HOST TARGET binding site found in the 3' untranslated region of mRNA encoded by TTF2, corresponding to a HOST TARGET binding site such as BINDING SITE I, BINDING SITE II or BINDING SITE III. Table 2 illustrates the complementarity of the nucleotide sequences of TTF2 BINDING SITE, designated SEQ ID:9652, to the nucleotide sequence of VGAM2175 RNA, herein designated VGAM RNA, also designated SEQ ID:4886.

Another function of VGAM2175 is therefore inhibition of Transcription Termination Factor, RNA Polymerase II (TTF2, Accession NM_003594), a gene which is involved either in promoting the migration process or in repressing differentiation of the TFCs until migration has occurred. Accordingly, utilities of VGAM2175 include diagnosis, prevention and treatment of diseases and clinical conditions associated with TTF2. The function of TTF2 has been established by previous studies. Clifton-Bligh et al. (1998) demonstrated that the FKHL15 gene, which is the human homolog of the mouse Titf2 gene, was homozygously mutated in 2 sibs with thyroid agenesis, cleft palate, and choanal atresia, previously reported by Bamforth et al. (1989); see Bamforth-Lazarus syndrome (OMIM Ref. No. 241850). Spiky or curly hair was also a feature, as was bifid epiglottis. Polyhydramnios, which was present in the 2 pregnancies of the brothers and in another reported case of Bamforth-Lazarus syndrome, may have been caused by the choanal atresia. Clifton-Bligh et al. (1998) had found by a database search against the rat TTF2 gene more than 90% homology with FKHL15. The FKHL15 cDNA was encoded by a single-exon gene. A probe specific to the 3-prime UTR of FKHL15 detected a 5.3-kb transcript that was highly expressed in thyroid tissues, and a second 3.2-kb transcript seen in both thyroid and testis. Animal model experiments lend further support to the function of TTF2. Many members of the forkhead/winged-helix transcription factor family are key regulators of embryogenesis (Kaufmann and Knochel, 1996). Thyroid transcription factor-2 (TTF2), a forkhead domain-containing transcription factor, was cloned by Zannini et al. (1997) and the mouse gene, designated Titf2, was mapped to chromosome 4. De Felice et al. (1998) showed that Titf2-null mutant mice exhibit cleft palate and either a sublingual or completely absent thyroid gland. Thus, the Titf2-/- mutation results in neonatal hypothyroidism that showed similarity to thyroid dysgenesis in humans. Among the 1 in 3,000 or 4,000 newborns in which congenital hypothyroidism is detected, 80% have either an ectopic, small and sublingual thyroid, or have no thyroid tissue (Toublanc, 1992). Most of these cases appear sporadically, although a few cases of recurring familial thyroid dysgenesis (OMIM Ref. No. 218700) have been reported.

It is appreciated that the abovementioned animal model for TTF2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Clifton-Bligh, R. J.; Wentworth, J. M.; Heinz, P.; Crisp, M. S.; John, R.; Lazarus, J. H.; Ludgate, M.; Chatterjee, V. K.: Mutation of the gene encoding human TTF-2 associated with thyroid agenesis, cleft palate and choanal atresia. Nature Genet. 19:399-401, 1998; and De Felice, M.; Ovitt, C.; Biffali, E.; Rodriguez-Mallon, A.; Arra, C.; Anastassiadis, K.; Macchia, P. E.; Mattei, M.-G.; Mariano, A.; Scholer, H.; Macchia, V.; Di Lauro, R.: A mouse model.

Further studies establishing the function and utilities of TTF2 are found in John Hopkins OMIM database record ID 602617, and in sited publications numbered 943 and 12372-8462 listed in the bibliography section hereinbelow, which are also hereby incorporated by reference. Dynactin 4 (p62) (DCTN4, Accession XM_041993) is another VGAM2175 host target gene. DCTN4 BINDING SITE is HOST TARGET binding site found in the 3' untranslated region of mRNA encoded by DCTN4, corresponding to a HOST TARGET binding site such as BINDING SITE I, BINDING SITE II or BINDING SITE III. Table 2 illustrates the complementarity of the nucleotide sequences of DCTN4 BINDING SITE, designated SEQ ID:33663, to the nucleotide sequence of VGAM2175 RNA, herein designated VGAM RNA, also designated SEQ ID:4886.

Another function of VGAM2175 is therefore inhibition of Dynactin 4 (p62) (DCTN4, Accession XM_041993). Accordingly, utilities of VGAM2175 include diagnosis, prevention and treatment of diseases and clinical conditions associated with DCTN4. FLJ00001 (Accession XM_088525) is another VGAM2175 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39773, to the nucleotide sequence of VGAM2175 RNA, herein designated VGAM RNA, also designated SEQ ID:4886.

Another function of VGAM2175 is therefore inhibition of FLJ00001 (Accession XM_088525). Accordingly, utilities of VGAM2175 include diagnosis, prevention and treatment of diseases and clinical conditions associated with FLJ00001. LOC131308 (Accession XM_059501) is another VGAM2175 host target gene. LOC131308 BINDING SITE is HOST TARGET binding site found in the 3' untranslated region of mRNA encoded by LOC131308, corresponding to a HOST TARGET binding site such as BINDING SITE I, BINDING SITE II or BINDING SITE III. Table 2 illustrates the complementarity of the nucleotide sequences of LOC131308 BINDING SITE, designated SEQ ID:37012, to the nucleotide sequence of VGAM2175 RNA, herein designated VGAM RNA, also designated SEQ ID:4886.

Another function of VGAM2175 is therefore inhibition of LOC131308 (Accession XM_059501). Accordingly, utilities of VGAM2175 include diagnosis, prevention and treatment of diseases and clinical conditions associated with LOC131308. LOC257319 (Accession XM_171049) is another VGAM2175 host target gene. LOC257319 BINDING SITE is HOST TARGET binding site found in the 3' untranslated region of mRNA encoded by LOC257319, corresponding to a HOST TARGET binding site such as BINDING SITE I, BINDING SITE II or BINDING SITE III. Table 2 illustrates the complementarity of the nucleotide sequences of LOC257319 BINDING SITE, designated SEQ ID:45830, to the nucleotide sequence of VGAM2175 RNA, herein designated VGAM RNA, also designated SEQ ID:4886.

Another function of VGAM2175 is therefore inhibition of LOC257319 (Accession XM_171049). Accordingly, utilities of VGAM2175 include diagnosis, prevention and treatment of diseases and clinical conditions associated with LOC257319. FIG. 1 further provides a conceptual description of a novel bioinformatically detected viral gene of the present invention, referred to here as Viral Genomic Address Messenger 2176 (VGAM2176) viral gene, which modulates expression of respective host target genes thereof, the function and utility of which host target genes is known in the art.

VGAM2176 is a novel bioinformatically detected regulatory, non protein coding, viral micro RNA (miRNA) gene. The method by which VGAM2176 was detected is described hereinabove with reference to FIGS. 1-8.

VGAM2176 gene, herein designated VGAM GENE, is a viral gene contained in the genome of Rabbit Fibroma Virus. VGAM2176 host target gene, herein designated VGAM HOST TARGET GENE, is a human gene contained in the human genome.

VGAM2176 gene encodes a VGAM2176 precursor RNA, herein designated VGAM PRECURSOR RNA. Similar to other miRNA genes, and unlike most ordinary genes, VGAM2176 precursor RNA does not encode a protein. A nucleotide sequence identical or highly similar to the nucleotide sequence of VGAM2176 precursor RNA is designated SEQ ID:2162, and is provided hereinbelow with reference to the sequence listing part. Nucleotide sequence SEQ ID:2162 is located at position 10073 relative to the genome of Rabbit Fibroma Virus.

VGAM2176 precursor RNA folds onto itself, forming VGAM2176 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2176 folded precursor RNA into VGAM2176 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM2176 RNA is designated SEQ ID:4887, and is provided hereinbelow with reference to the sequence listing part.

VGAM2176 host target gene, herein designated VGAM HOST TARGET GENE, encodes a corresponding messenger RNA, VGAM2176 host target RNA, herein designated VGAM HOST TARGET RNA. VGAM2176 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2176 RNA, herein designated VGAM RNA, binds complementarily to one or more host target binding sites located in untranslated regions of VGAM2176 host target RNA, herein designated VGAM HOST TARGET RNA. This complementary binding is due to the fact that the nucleotide sequence of VGAM2176 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2176 RNA, herein designated VGAM RNA, may have a different number of host target binding sites in untranslated regions of a VGAM2176 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2176 RNA, herein designated VGAM RNA, to host target binding sites on VGAM2176 host target RNA, herein designated VGAM HOST TARGET RNA, such as BINDING SITE I, BINDING SITE II and BINDING SITE III, inhibits translation of VGAM2176 host target RNA into VGAM2176 host target protein, herein designated VGAM HOST TARGET PROTEIN. VGAM host target protein is therefore outlined by a broken line.

It is appreciated that VGAM2176 host target gene, herein designated VGAM HOST TARGET GENE, in fact represents a plurality of VGAM2176 host target genes. The mRNA of each one of this plurality of VGAM2176 host target genes comprises one or more host target binding sites, each having a nucleotide sequence which is at least partly complementary to VGAM2176 RNA, herein designated VGAM RNA, and which when bound by VGAM2176 RNA causes inhibition of translation of respective one or more VGAM2176 host target proteins.

It is further appreciated by one skilled in the art that the mode of translational inhibition illustrated by FIG. 1 with specific reference to translational inhibition exerted by VGAM2176 gene, herein designated VGAM GENE, on one or more VGAM2176 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2176 is inhibition of expression of host target genes, as part of a novel viral mechanism of attacking a host. Accordingly, utilities of VGAM2176 include diagnosis, prevention and treatment of viral infection by Rabbit Fibroma Virus. Specific functions, and accordingly utilities, of VGAM2176 correlate with, and may be deduced from, the identity of the host target genes which VGAM2176 binds and inhibits, and the function of these host target genes, as elaborated hereinbelow.

Nucleotide sequences of the VGAM2176 precursor RNA, herein designated VGAM PRECURSOR RNA, and of the 'diced' VGAM2176 RNA, herein designated VGAM RNA, and a schematic representation of the secondary folding of VGAM2176 folded precursor RNA, herein designated VGAM FOLDED PRECURSOR RNA, of VGAM2176 are further described hereinbelow with reference to Table 1.

Nucleotide sequences of host target binding sites, such as BINDING SITE-I, BINDING SITE-II and BINDING SITE-III of FIG. 1, found on VGAM2176 host target RNA, and schematic representation of the complementarity of each of these host target binding sites to VGAM2176 RNA, herein designated VGAM RNA, are described hereinbelow with reference to Table 2.

As mentioned hereinabove with reference to FIG. 1, a function of VGAM2176 gene, herein designated VGAM is inhibition of expression of VGAM2176 target genes. It is appreciated that specific functions, and accordingly utilities, of VGAM2176 correlate with, and may be deduced from, the identity of the target genes which VGAM2176 binds and inhibits, and the function of these target genes, as elaborated hereinbelow.

FLJ00007 (Accession XM_048928) is a VGAM2176 host target gene. FLJ00007 BINDING SITE is HOST TARGET binding site found in the 3' untranslated region of mRNA encoded by FLJ00007, corresponding to a HOST TARGET binding site such as BINDING SITE I, BINDING SITE II or BINDING SITE III. Table 2 illustrates the complementarity of the nucleotide sequences of FLJ00007 BINDING SITE, designated SEQ ID:35315, to the nucleotide sequence of VGAM2176 RNA, herein designated VGAM RNA, also designated SEQ ID:4887.

A function of VGAM2176 is therefore inhibition of FLJ00007 (Accession XM_048928). Accordingly, utilities of VGAM2176 include diagnosis, prevention and treatment of diseases and clinical conditions associated with FLJ00007. FLJ20060 (Accession NM_017645) is another VGAM2176 host target gene. FLJ20060 BINDING SITE is HOST TARGET binding site found in the 5' untranslated region of mRNA encoded by FLJ20060, corresponding to a HOST TARGET binding site such as BINDING SITE I, BINDING SITE II or BINDING SITE III. Table 2 illustrates the complementarity of the nucleotide sequences of FLJ20060 BINDING SITE, designated SEQ ID:19148, to the nucleotide sequence of VGAM2176 RNA, herein designated VGAM RNA, also designated SEQ ID:4887.

Another function of VGAM2176 is therefore inhibition of FLJ20060 (Accession NM_017645). Accordingly, utilities of VGAM2176 include diagnosis, prevention and treatment of diseases and clinical conditions associated with FLJ20060. LOC91250 (Accession XM_037135) is another VGAM2176 host target gene. LOC91250 BINDING SITE is HOST TARGET binding site found in the 5' untranslated region of mRNA encoded by LOC91250, corresponding to a HOST TARGET binding site such as BINDING SITE I, BINDING SITE II or BINDING SITE III. Table 2 illustrates the complementarity of the nucleotide sequences of LOC91250 BINDING SITE, designated SEQ ID:32549, to the nucleotide sequence of VGAM2176 RNA, herein designated VGAM RNA, also designated SEQ ID:4887.

Another function of VGAM2176 is therefore inhibition of LOC91250 (Accession XM_037135). Accordingly, utilities of VGAM2176 include diagnosis, prevention and treatment of diseases and clinical conditions associated with LOC91250. FIG. 1 further provides a conceptual description of a novel bioinformatically detected viral gene of the present invention, referred to here as Viral Genomic Address Messenger 2177 (VGAM2177) viral gene, which modulates expression of respective host target genes thereof, the function and utility of which host target genes is known in the art.

VGAM2177 is a novel bioinformatically detected regulatory, non protein coding, viral micro RNA (miRNA) gene. The method by which VGAM2177 was detected is described hereinabove with reference to FIGS. 1-8.

VGAM2177 gene, herein designated VGAM GENE, is a viral gene contained in the genome of Rabbit Fibroma Virus. VGAM2177 host target gene, herein designated VGAM HOST TARGET GENE, is a human gene contained in the human genome.

VGAM2177 gene encodes a VGAM2177 precursor RNA, herein designated VGAM PRECURSOR RNA. Similar to other miRNA genes, and unlike most ordinary genes, VGAM2177 precursor RNA does not encode a protein. A nucleotide sequence identical or highly similar to the nucleotide sequence of VGAM2177 precursor RNA is designated SEQ ID:2163, and is provided hereinbelow with reference to the sequence listing part. Nucleotide sequence SEQ ID:2163 is located at position 14151 relative to the genome of Rabbit Fibroma Virus.

VGAM2177 precursor RNA folds onto itself, forming VGAM2177 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2177 folded precursor RNA into VGAM2177 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2177 RNA is designated SEQ ID:4888, and is provided hereinbelow with reference to the sequence listing part.

VGAM2177 host target gene, herein designated VGAM HOST TARGET GENE, encodes a corresponding messenger RNA, VGAM2177 host target RNA, herein designated VGAM HOST TARGET RNA. VGAM2177 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2177 RNA, herein designated VGAM RNA, binds complementarily to one or more host target binding sites located in untranslated regions of VGAM2177 host target RNA, herein designated VGAM HOST TARGET RNA. This complementary binding is due to the fact that the nucleotide sequence of VGAM2177 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2177 RNA, herein designated VGAM RNA, may have a different number of host target binding sites in untranslated regions of a VGAM2177 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2177 RNA, herein designated VGAM RNA, to host target binding sites on VGAM2177 host target RNA, herein designated VGAM HOST TARGET RNA, such as BINDING SITE I, BINDING SITE II and BINDING SITE III, inhibits translation of VGAM2177 host target RNA into VGAM2177 host target protein, herein designated VGAM HOST TARGET PROTEIN. VGAM host target protein is therefore outlined by a broken line.

It is appreciated that VGAM2177 host target gene, herein designated VGAM HOST TARGET GENE, in fact represents a plurality of VGAM2177 host target genes. The mRNA of each one of this plurality of VGAM2177 host target genes comprises one or more host target binding sites, each having a nucleotide sequence which is at least partly complementary to VGAM2177 RNA, herein designated VGAM RNA, and which when bound by VGAM2177 RNA causes inhibition of translation of respective one or more VGAM2177 host target proteins.

It is further appreciated by one skilled in the art that the mode of translational inhibition illustrated by FIG. 1 with specific reference to translational inhibition exerted by VGAM2177 gene, herein designated VGAM GENE, on one or more VGAM2177 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2177 is inhibition of expression of host target genes, as part of a novel viral mechanism of attacking a host. Accordingly, utilities of VGAM2177 include diagnosis, prevention and treatment of viral infection by Rabbit Fibroma Virus. Specific functions, and accordingly utilities, of VGAM2177 correlate with, and may be deduced from, the identity of the host target genes which VGAM2177 binds and inhibits, and the function of these host target genes, as elaborated hereinbelow.

Nucleotide sequences of the VGAM2177 precursor RNA, herein designated VGAM PRECURSOR RNA, and of the 'diced' VGAM2177 RNA, herein designated VGAM RNA, and a schematic representation of the secondary folding of VGAM2177 folded precursor RNA, herein designated VGAM FOLDED PRECURSOR RNA, of VGAM2177 are further described hereinbelow with reference to Table 1.

Nucleotide sequences of host target binding sites, such as BINDING SITE-I, BINDING SITE-II and BINDING SITE-III of FIG. 1, found on VGAM2177 host target RNA, and schematic representation of the complementarity of each of these host target binding sites to VGAM2177 RNA, herein designated VGAM RNA, are described hereinbelow with reference to Table 2.

As mentioned hereinabove with reference to FIG. 1, a function of VGAM2177 gene, herein designated VGAM is inhibition of expression of VGAM2177 target genes. It is appreciated that specific functions, and accordingly utilities, of VGAM2177 correlate with, and may be deduced from, the identity of the target genes which VGAM2177 binds and inhibits, and the function of these target genes, as elaborated hereinbelow.

Inositol 1,4,5-triphosphate Receptor, Type 2 (ITPR2, Accession NM_002223) is a VGAM2177 host target gene. ITPR2 BINDING SITE is HOST TARGET binding site found in the 3' untranslated region of mRNA encoded by ITPR2, corresponding to a HOST TARGET binding site such as BINDING SITE I, BINDING SITE II or BINDING SITE III. Table 2 illustrates the complementarity of the nucleotide sequences of ITPR2 BINDING SITE, designated SEQ ID:7990, to the nucleotide sequence of VGAM2177 RNA, herein designated VGAM RNA, also designated SEQ ID:4888.

A function of VGAM2177 is therefore inhibition of Inositol 1,4,5-triphosphate Receptor, Type 2 (ITPR2, Accession NM_002223). Accordingly, utilities of VGAM2177 include diagnosis, prevention and treatment of diseases and clinical conditions associated with ITPR2. LOC151878 (Accession XM_087329) is another VGAM2177 host target gene. LOC151878 BINDING SITE is HOST TARGET binding site found in the 5' untranslated region of mRNA encoded by LOC151878, corresponding to a HOST TARGET binding site such as BINDING SITE I, BINDING SITE II or BINDING SITE III. Table 2 illustrates the complementarity of the nucleotide sequences of LOC151878 BINDING SITE, designated SEQ ID:39170, to the nucleotide sequence of VGAM2177 RNA, herein designated VGAM RNA, also designated SEQ ID:4888.

Another function of VGAM2177 is therefore inhibition of LOC151878 (Accession XM_087329). Accordingly, utilities of VGAM2177 include diagnosis, prevention and treatment of diseases and clinical conditions associated with LOC151878. FIG. 1 further provides a conceptual description of a novel bioinformatically detected viral gene of the present invention, referred to here as Viral Genomic Address Messenger 2178 (VGAM2178) viral gene, which modulates expression of respective host target genes thereof, the function and utility of which host target genes is known in the art.

VGAM2178 is a novel bioinformatically detected regulatory, non protein coding, viral micro RNA (miRNA) gene. The method by which VGAM2178 was detected is described hereinabove with reference to FIGS. 1-8.

VGAM2178 gene, herein designated VGAM GENE, is a viral gene contained in the genome of Rabbit Fibroma Virus. VGAM2178 host target gene, herein designated VGAM HOST TARGET GENE, is a human gene contained in the human genome.

VGAM2178 gene encodes a VGAM2178 precursor RNA, herein designated VGAM PRECURSOR RNA. Similar to other miRNA genes, and unlike most ordinary genes, VGAM2178 precursor RNA does not encode a protein. A nucleotide sequence identical or highly similar to the nucleotide sequence of VGAM2178 precursor RNA is designated SEQ ID:2164, and is provided hereinbelow with reference to the sequence listing part. Nucleotide sequence SEQ ID:2164 is located at position 22881 relative to the genome of Rabbit Fibroma Virus.

VGAM2178 precursor RNA folds onto itself, forming VGAM2178 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2178 folded precursor RNA into VGAM2178 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2178 RNA is designated SEQ ID:4889, and is provided hereinbelow with reference to the sequence listing part.

VGAM2178 host target gene, herein designated VGAM HOST TARGET GENE, encodes a corresponding messenger RNA, VGAM2178 host target RNA, herein designated VGAM HOST TARGET RNA. VGAM2178 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2178 RNA, herein designated VGAM RNA, binds complementarily to one or more host target binding sites located in untranslated regions of VGAM2178 host target RNA, herein designated VGAM HOST TARGET RNA. This complementary binding is due to the fact that the nucleotide sequence of VGAM2178 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2178 RNA, herein designated VGAM RNA, may have a different number of host target binding sites in untranslated regions of a VGAM2178 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2178 RNA, herein designated VGAM RNA, to host target binding sites on VGAM2178 host target RNA, herein designated VGAM HOST TARGET RNA, such as BINDING SITE I, BINDING SITE II and BINDING SITE III, inhibits translation of VGAM2178 host target RNA into VGAM2178 host target protein, herein designated VGAM HOST TARGET PROTEIN. VGAM host target protein is therefore outlined by a broken line.

It is appreciated that VGAM2178 host target gene, herein designated VGAM HOST TARGET GENE, in fact represents a plurality of VGAM2178 host target genes. The mRNA of each one of this plurality of VGAM2178 host target genes comprises one or more host target binding sites, each having a nucleotide sequence which is at least partly complementary to VGAM2178 RNA, herein designated VGAM RNA, and which when bound by VGAM2178 RNA causes inhibition of translation of respective one or more VGAM2178 host target proteins.

It is further appreciated by one skilled in the art that the mode of translational inhibition illustrated by FIG. 1 with specific reference to translational inhibition exerted by VGAM2178 gene, herein designated VGAM GENE, on one or more VGAM2178 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM2178 is inhibition of expression of host target genes, as part of a novel viral mechanism of attacking a host. Accordingly, utilities of VGAM2178 include diagnosis, prevention and treatment of viral infection by Rabbit Fibroma Virus. Specific functions, and accordingly utilities, of VGAM2178 correlate with, and may be deduced from, the identity of the host target genes which VGAM2178 binds and inhibits, and the function of these host target genes, as elaborated hereinbelow.

Nucleotide sequences of the VGAM2178 precursor RNA, herein designated VGAM PRECURSOR RNA, and of the ‘diced’ VGAM2178 RNA, herein designated VGAM RNA, and a schematic representation of the secondary folding of VGAM2178 folded precursor RNA, herein designated VGAM FOLDED PRECURSOR RNA, of VGAM2178 are further described hereinbelow with reference to Table 1.

Nucleotide sequences of host target binding sites, such as BINDING SITE-I, BINDING SITE-II and BINDING SITE-III of FIG. 1, found on VGAM2178 host target RNA, and schematic representation of the complementarity of each of these host target binding sites to VGAM2178 RNA, herein designated VGAM RNA, are described hereinbelow with reference to Table 2.

As mentioned hereinabove with reference to FIG. 1, a function of VGAM2178 gene, herein designated VGAM is inhibition of expression of VGAM2178 target genes. It is appreciated that specific functions, and accordingly utilities, of VGAM2178 correlate with, and may be deduced from, the identity of the target genes which VGAM2178 binds and inhibits, and the function of these target genes, as elaborated hereinbelow.

Retinoblastoma Binding Protein 9 (RBBP9, Accession XM_046553) is a VGAM2178 host target gene. RBBP9 BINDING SITE is HOST TARGET binding site found in the 3' untranslated region of mRNA encoded by RBBP9, corresponding to a HOST TARGET binding site such as BINDING SITE I, BINDING SITE II or BINDING SITE III. Table 2 illustrates the complementarity of the nucleotide sequences of RBBP9 BINDING SITE, designated SEQ ID:34745, to the nucleotide sequence of VGAM2178 RNA, herein designated VGAM RNA, also designated SEQ ID:4889.

A function of VGAM2178 is therefore inhibition of Retinoblastoma Binding Protein 9 (RBBP9, Accession XM_046553). Accordingly, utilities of VGAM2178 include diagnosis, prevention and treatment of diseases and clinical conditions associated with RBBP9. KIAA1056 (Accession NM_014894) is another VGAM2178 host target gene. KIAA1056 BINDING SITE is HOST TARGET binding site found in the 3' untranslated region of mRNA encoded by KIAA1056, corresponding to a HOST TARGET binding site such as BINDING SITE I, BINDING SITE II or BINDING SITE III. Table 2 illustrates the complementarity of the nucleotide sequences of KIAA1056 BINDING SITE, designated SEQ ID:17046, to the nucleotide sequence of VGAM2178 RNA, herein designated VGAM RNA, also designated SEQ ID:4889.

Another function of VGAM2178 is therefore inhibition of KIAA1056 (Accession NM_014894). Accordingly, utilities of VGAM2178 include diagnosis, prevention and treatment of diseases and clinical conditions associated with KIAA1056. KIAA1199 (Accession XM_051860) is another VGAM2178 host target gene. KIAA1199 BINDING SITE is HOST TARGET binding site found in the 3' untranslated region of mRNA encoded by KIAA1199, corresponding to a HOST TARGET binding site such as BINDING SITE I, BINDING SITE II or BINDING SITE III. Table 2 illustrates the complementarity of the nucleotide sequences of KIAA1199 BINDING SITE, designated SEQ ID:35898, to the nucleotide sequence of VGAM2178 RNA, herein designated VGAM RNA, also designated SEQ ID:4889.

Another function of VGAM2178 is therefore inhibition of KIAA1199 (Accession XM_051860). Accordingly, utilities of VGAM2178 include diagnosis, prevention and treatment of diseases and clinical conditions associated with KIAA1199. KIAA1458 (Accession XM_044434) is another VGAM2178 host target gene. KIAA1458 BINDING SITE is HOST TARGET binding site found in the 3' untranslated region of mRNA encoded by KIAA1458, corresponding to a HOST TARGET binding site such as BINDING SITE I, BINDING SITE II or BINDING SITE III. Table 2 illustrates the complementarity of the nucleotide sequences of KIAA1458 BINDING SITE, designated SEQ ID:34203, to the nucleotide sequence of VGAM2178 RNA, herein designated VGAM RNA, also designated SEQ ID:4889.

Another function of VGAM2178 is therefore inhibition of KIAA1458 (Accession XM_044434). Accordingly, utilities of VGAM2178 include diagnosis, prevention and treatment of diseases and clinical conditions associated with KIAA1458. LOC151234 (Accession XM_087136) is another VGAM2178 host target gene. LOC151234 BINDING SITE is HOST TARGET binding site found in the 3' untranslated region of mRNA encoded by LOC151234, corresponding to a HOST TARGET binding site such as BINDING SITE I, BINDING SITE II or BINDING SITE III. Table 2 illustrates the complementarity of the nucleotide sequences of LOC151234 BINDING SITE, designated SEQ ID:39080, to the nucleotide sequence of VGAM2178 RNA, herein designated VGAM RNA, also designated SEQ ID:4889.

Another function of VGAM2178 is therefore inhibition of LOC151234 (Accession XM_087136). Accordingly, utilities of VGAM2178 include diagnosis, prevention and treatment of diseases and clinical conditions associated with LOC151234. LOC257443 (Accession XM_171072) is another VGAM2178 host target gene. LOC257443 BINDING SITE is HOST TARGET binding site found in the 3' untranslated region of mRNA encoded by LOC257443, corresponding to a HOST TARGET binding site such as BINDING SITE I, BINDING SITE II or BINDING SITE III. Table 2 illustrates the complementarity of the nucleotide sequences of LOC257443 BINDING SITE, designated SEQ ID:45872, to the nucleotide sequence of VGAM2178 RNA, herein designated VGAM RNA, also designated SEQ ID:4889.

Another function of VGAM2178 is therefore inhibition of LOC257443 (Accession XM_171072). Accordingly, utilities of VGAM2178 include diagnosis, prevention and treatment of diseases and clinical conditions associated with LOC257443. FIG. 1 further provides a conceptual description of a novel bioinformatically detected viral gene of the present invention, referred to here as Viral Genomic Address Messenger 2179 (VGAM2179) viral gene, which modulates expression of respective host target genes thereof, the function and utility of which host target genes is known in the art.

VGAM2179 is a novel bioinformatically detected regulatory, non protein coding, viral micro RNA (miRNA) gene. The method by which VGAM2179 was detected is described hereinabove with reference to FIGS. 1-8.

VGAM2179 gene, herein designated VGAM GENE, is a viral gene contained in the genome of Rabbit Fibroma Virus. VGAM2179 host target gene, herein designated VGAM HOST TARGET GENE, is a human gene contained in the human genome.

VGAM2179 gene encodes a VGAM2179 precursor RNA, herein designated VGAM PRECURSOR RNA. Similar to other miRNA genes, and unlike most ordinary genes, VGAM2179 precursor RNA does not encode a protein. A nucleotide sequence identical or highly similar to the nucleotide sequence of VGAM2179 precursor RNA is designated SEQ ID:2165, and is provided hereinbelow with reference to the sequence listing part. Nucleotide sequence SEQ ID:2165 is located at position 15205 relative to the genome of Rabbit Fibroma Virus.

VGAM2179 precursor RNA folds onto itself, forming VGAM2179 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2179 folded precursor RNA into VGAM2179 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2179 RNA is designated SEQ ID:4890, and is provided hereinbelow with reference to the sequence listing part.

VGAM2179 host target gene, herein designated VGAM HOST TARGET GENE, encodes a corresponding messenger RNA, VGAM2179 host target RNA, herein designated VGAM HOST TARGET RNA. VGAM2179 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2179 RNA, herein designated VGAM RNA, binds complementarily to one or more host target binding sites located in untranslated regions of VGAM2179 host target RNA, herein designated VGAM HOST TARGET RNA. This complementary binding is due to the fact that the nucleotide sequence of VGAM2179 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2179 RNA, herein designated VGAM RNA, may have a different number of host target binding sites in untranslated regions of a VGAM2179 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2179 RNA, herein designated VGAM RNA, to host target binding sites on VGAM2179 host target RNA, herein designated VGAM HOST TARGET RNA, such as BINDING SITE I, BINDING SITE II and BINDING SITE III, inhibits translation of VGAM2179 host target RNA into VGAM2179 host target protein, herein designated VGAM HOST TARGET PROTEIN. VGAM host target protein is therefore outlined by a broken line.

It is appreciated that VGAM2179 host target gene, herein designated VGAM HOST TARGET GENE, in fact represents a plurality of VGAM2179 host target genes. The mRNA of each one of this plurality of VGAM2179 host target genes comprises one or more host target binding sites, each having a nucleotide sequence which is at least partly complementary to VGAM2179 RNA, herein designated VGAM RNA, and which when bound by VGAM2179 RNA causes inhibition of translation of respective one or more VGAM2179 host target proteins.

It is further appreciated by one skilled in the art that the mode of translational inhibition illustrated by FIG. 1 with specific reference to translational inhibition exerted by VGAM2179 gene, herein designated VGAM GENE, on one or more VGAM2179 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2179 is inhibition of expression of host target genes, as part of a novel viral mechanism of attacking a host. Accordingly, utilities of VGAM2179 include diagnosis, prevention and treatment of viral infection by Rabbit Fibroma Virus. Specific functions, and accordingly utilities, of VGAM2179 correlate with, and may be deduced from, the identity of the host target genes which VGAM2179 binds and inhibits, and the function of these host target genes, as elaborated hereinbelow.

Nucleotide sequences of the VGAM2179 precursor RNA, herein designated VGAM PRECURSOR RNA, and of the 'diced' VGAM2179 RNA, herein designated VGAM RNA, and a schematic representation of the secondary folding of VGAM2179 folded precursor RNA, herein designated VGAM FOLDED PRECURSOR RNA, of VGAM2179 are further described hereinbelow with reference to Table 1.

Nucleotide sequences of host target binding sites, such as BINDING SITE-I, BINDING SITE-II and BINDING SITE-III of FIG. 1, found on VGAM2179 host target RNA, and schematic representation of the complementarity of each of these host target binding sites to VGAM2179 RNA, herein designated VGAM RNA, are described hereinbelow with reference to Table 2.

As mentioned hereinabove with reference to FIG. 1, a function of VGAM2179 gene, herein designated VGAM is inhibition of expression of VGAM2179 target genes. It is appreciated that specific functions, and accordingly utilities, of VGAM2179 correlate with, and may be deduced from, the identity of the target genes which VGAM2179 binds and inhibits, and the function of these target genes, as elaborated hereinbelow.

LOC158865 (Accession XM_099000) is a VGAM2179 host target gene. LOC158865 BINDING SITE is HOST TARGET binding site found in the 5' untranslated region of mRNA encoded by LOC158865, corresponding to a HOST TARGET binding site such as BINDING SITE I, BINDING SITE II or BINDING SITE III. Table 2 illustrates the complementarity of the nucleotide sequences of LOC158865 BINDING SITE, designated SEQ ID:42037, to the nucleotide sequence of VGAM2179 RNA, herein designated VGAM RNA, also designated SEQ ID:4890.

A function of VGAM2179 is therefore inhibition of LOC158865 (Accession XM_099000). Accordingly, utilities of VGAM2179 include diagnosis, prevention and treatment of diseases and clinical conditions associated with LOC158865. FIG. 1 further provides a conceptual description of a novel bioinformatically detected viral gene of the present invention, referred to here as Viral Genomic Address Messenger 2180 (VGAM2180) viral gene, which modulates expression of respective host target genes thereof, the function and utility of which host target genes is known in the art.

VGAM2180 is a novel bioinformatically detected regulatory, non protein coding, viral micro RNA (miRNA) gene. The method by which VGAM2180 was detected is described hereinabove with reference to FIGS. 1-8.

VGAM2180 gene, herein designated VGAM GENE, is a viral gene contained in the genome of Yaba-like Disease Virus. VGAM2180 host target gene, herein designated VGAM HOST TARGET GENE, is a human gene contained in the human genome.

VGAM2180 gene encodes a VGAM2180 precursor RNA, herein designated VGAM PRECURSOR RNA. Similar to other miRNA genes, and unlike most ordinary genes, VGAM2180 precursor RNA does not encode a protein. A nucleotide sequence identical or highly similar to the nucleotide sequence of VGAM2180 precursor RNA is designated SEQ ID:2166, and is provided hereinbelow with reference to the sequence listing part. Nucleotide sequence SEQ ID:2166 is located at position 128284 relative to the genome of Yaba-like Disease Virus.

VGAM2180 precursor RNA folds onto itself, forming VGAM2180 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2180 folded precursor RNA into VGAM2180 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2180 RNA is designated SEQ ID:4891, and is provided hereinbelow with reference to the sequence listing part.

VGAM2180 host target gene, herein designated VGAM HOST TARGET GENE, encodes a corresponding messenger RNA, VGAM2180 host target RNA, herein designated VGAM HOST TARGET RNA. VGAM2180 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2180 RNA, herein designated VGAM RNA, binds complementarily to one or more host target binding sites located in untranslated regions of VGAM2180 host target RNA, herein designated VGAM HOST TARGET RNA. This complementary binding is due to the fact that the nucleotide sequence of VGAM2180 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2180 RNA, herein designated VGAM RNA, may have a different number of host target binding sites in untranslated regions of a VGAM2180 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2180 RNA, herein designated VGAM RNA, to host target binding sites on VGAM2180 host target RNA, herein designated VGAM HOST TARGET RNA, such as BINDING SITE I, BINDING SITE II and BINDING SITE III, inhibits translation of VGAM2180 host target RNA into VGAM2180 host target protein, herein designated VGAM HOST TARGET PROTEIN. VGAM host target protein is therefore outlined by a broken line.

It is appreciated that VGAM2180 host target gene, herein designated VGAM HOST TARGET GENE, in fact represents a plurality of VGAM2180 host target genes. The mRNA of each one of this plurality of VGAM2180 host target genes comprises one or more host target binding sites, each having a nucleotide sequence which is at least partly complementary to VGAM2180 RNA, herein designated VGAM RNA, and which when bound by VGAM2180 RNA causes inhibition of translation of respective one or more VGAM2180 host target proteins.

It is further appreciated by one skilled in the art that the mode of translational inhibition illustrated by FIG. 1 with specific reference to translational inhibition exerted by VGAM2180 gene, herein designated VGAM GENE, on one or more VGAM2180 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2180 is inhibition of expression of host target genes, as part of a novel viral mechanism of attacking a host. Accordingly, utilities of VGAM2180 include diagnosis, prevention and treatment of viral infection by Yaba-like Disease Virus. Specific functions, and accordingly utilities, of VGAM2180 correlate with, and may be deduced from, the identity of the host target genes which VGAM2180 binds and inhibits, and the function of these host target genes, as elaborated hereinbelow.

Nucleotide sequences of the VGAM2180 precursor RNA, herein designated VGAM PRECURSOR RNA, and of the 'diced' VGAM2180 RNA, herein designated VGAM RNA, and a schematic representation of the secondary folding of VGAM2180 folded precursor RNA, herein designated VGAM FOLDED PRECURSOR RNA, of VGAM2180 are further described hereinbelow with reference to Table 1.

Nucleotide sequences of host target binding sites, such as BINDING SITE-I, BINDING SITE-II and BINDING SITE-III of FIG. 1, found on VGAM2180 host target RNA, and schematic representation of the complementarity of each of these host target binding sites to VGAM2180 RNA, herein designated VGAM RNA, are described hereinbelow with reference to Table 2.

As mentioned hereinabove with reference to FIG. 1, a function of VGAM2180 gene, herein designated VGAM is inhibition of expression of VGAM2180 target genes. It is appreciated that specific functions, and accordingly utilities, of VGAM2180 correlate with, and may be deduced from, the identity of the target genes which VGAM2180 binds and inhibits, and the function of these target genes, as elaborated hereinbelow.

Zinc Finger Protein 387 (ZNF387, Accession NM_014682) is a VGAM2180 host target gene. ZNF387 BINDING SITE is HOST TARGET binding site found in the 3' untranslated region of mRNA encoded by ZNF387, corresponding to a HOST TARGET binding site such as BINDING SITE I, BINDING SITE II or BINDING SITE III. Table 2 illustrates the complementarity of the nucleotide sequences of ZNF387 BINDING SITE, designated SEQ ID:16178, to the nucleotide sequence of VGAM2180 RNA, herein designated VGAM RNA, also designated SEQ ID:4891.

A function of VGAM2180 is therefore inhibition of Zinc Finger Protein 387 (ZNF387, Accession NM_014682). Accordingly, utilities of VGAM2180 include diagnosis, prevention and treatment of diseases and clinical conditions associated with ZNF387. LOC157507 (Accession XM_088312) is another VGAM2180 host target gene. LOC157507 BINDING SITE is HOST TARGET binding site found in the 5' untranslated region of mRNA encoded by LOC157507, corresponding to a HOST TARGET binding site such as BINDING SITE I, BINDING SITE II or BINDING SITE III. Table 2 illustrates the complementarity of the nucleotide sequences of LOC157507 BINDING SITE, designated SEQ ID:39603, to the nucleotide sequence of VGAM2180 RNA, herein designated VGAM RNA, also designated SEQ ID:4891.

Another function of VGAM2180 is therefore inhibition of LOC157507 (Accession XM_088312). Accordingly, utilities of VGAM2180 include diagnosis, prevention and treatment of diseases and clinical conditions associated with LOC157507. FIG. 1 further provides a conceptual description of a novel bioinformatically detected viral gene of the present invention, referred to here as Viral Genomic Address Messenger 2181 (VGAM2181) viral gene, which modulates expression of respective host target genes thereof, the function and utility of which host target genes is known in the art.

VGAM2181 is a novel bioinformatically detected regulatory, non protein coding, viral micro RNA (miRNA) gene. The method by which VGAM2181 was detected is described hereinabove with reference to FIGS. 1-8.

VGAM2181 gene, herein designated VGAM GENE, is a viral gene contained in the genome of Yaba-like Disease Virus. VGAM2181 host target gene, herein designated VGAM HOST TARGET GENE, is a human gene contained in the human genome.

VGAM2181 gene encodes a VGAM2181 precursor RNA, herein designated VGAM PRECURSOR RNA. Similar to other miRNA genes, and unlike most ordinary genes, VGAM2181 precursor RNA does not encode a protein. A nucleotide sequence identical or highly similar to the nucleotide sequence of VGAM2181 precursor RNA is designated SEQ ID:2167, and is provided hereinbelow with reference to the sequence listing part. Nucleotide sequence SEQ ID:2167 is located at position 125843 relative to the genome of Yaba-like Disease Virus.

VGAM2181 precursor RNA folds onto itself, forming VGAM2181 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2181 folded precursor RNA into VGAM2181 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM2181 RNA is designated SEQ ID:4892, and is provided hereinbelow with reference to the sequence listing part.

VGAM2181 host target gene, herein designated VGAM HOST TARGET GENE, encodes a corresponding messenger RNA, VGAM2181 host target RNA, herein designated VGAM HOST TARGET RNA. VGAM2181 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2181 RNA, herein designated VGAM RNA, binds complementarily to one or more host target binding sites located in untranslated regions of VGAM2181 host target RNA, herein designated VGAM HOST TARGET RNA. This complementary binding is due to the fact that the nucleotide sequence of VGAM2181 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2181 RNA, herein designated VGAM RNA, may have a different number of host target binding sites in untranslated regions of a VGAM2181 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2181 RNA, herein designated VGAM RNA, to host target binding sites on VGAM2181 host target RNA, herein designated VGAM HOST TARGET RNA, such as BINDING SITE I, BINDING SITE II and BINDING SITE III, inhibits translation of VGAM2181 host target RNA into VGAM2181 host target protein, herein designated VGAM HOST TARGET PROTEIN. VGAM host target protein is therefore outlined by a broken line.

It is appreciated that VGAM2181 host target gene, herein designated VGAM HOST TARGET GENE, in fact represents a plurality of VGAM2181 host target genes. The mRNA of each one of this plurality of VGAM2181 host target genes comprises one or more host target binding sites, each having a nucleotide sequence which is at least partly complementary to VGAM2181 RNA, herein designated VGAM RNA, and which when bound by VGAM2181 RNA causes inhibition of translation of respective one or more VGAM2181 host target proteins.

It is further appreciated by one skilled in the art that the mode of translational inhibition illustrated by FIG. 1 with specific reference to translational inhibition exerted by VGAM2181 gene, herein designated VGAM GENE, on one or more VGAM2181 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2181 is inhibition of expression of host target genes, as part of a novel viral mechanism of attacking a host. Accordingly, utilities of VGAM2181 include diagnosis, prevention and treatment of viral infection by Yaba-like Disease Virus. Specific functions, and accordingly utilities, of VGAM2181 correlate with, and may be deduced from, the identity of the host target genes which VGAM2181 binds and inhibits, and the function of these host target genes, as elaborated hereinbelow.

Nucleotide sequences of the VGAM2181 precursor RNA, herein designated VGAM PRECURSOR RNA, and of the 'diced' VGAM2181 RNA, herein designated VGAM RNA, and a schematic representation of the secondary folding of VGAM2181 folded precursor RNA, herein designated VGAM FOLDED PRECURSOR RNA, of VGAM2181 are further described hereinbelow with reference to Table 1.

Nucleotide sequences of host target binding sites, such as BINDING SITE-I, BINDING SITE-II and BINDING SITE-III of FIG. 1, found on VGAM2181 host target RNA, and schematic representation of the complementarity of each of these host target binding sites to VGAM2181 RNA, herein designated VGAM RNA, are described hereinbelow with reference to Table 2.

As mentioned hereinabove with reference to FIG. 1, a function of VGAM2181 gene, herein designated VGAM is inhibition of expression of VGAM2181 target genes. It is appreciated that specific functions, and accordingly utilities, of VGAM2181 correlate with, and may be deduced from, the identity of the target genes which VGAM2181 binds and inhibits, and the function of these target genes, as elaborated hereinbelow.

Integrin, Alpha 1 (ITGA1, Accession XM_032902) is a VGAM2181 host target gene. ITGA1 BINDING SITE is HOST TARGET binding site found in the 3' untranslated region of mRNA encoded by ITGA1, corresponding to a HOST TARGET binding site such as BINDING SITE I, BINDING SITE II or BINDING SITE III. Table 2 illustrates the complementarity of the nucleotide sequences of ITGA1 BINDING SITE, designated SEQ ID:31790, to the nucleotide sequence of VGAM2181 RNA, herein designated VGAM RNA, also designated SEQ ID:4892.

A function of VGAM2181 is therefore inhibition of Integrin, Alpha 1 (ITGA1, Accession XM_032902). Accordingly, utilities of VGAM2181 include diagnosis, prevention and treatment of diseases and clinical conditions associated with ITGA1. Pyruvate Dehydrogenase Kinase, Isoenzyme 4 (PDK4, Accession XM_173198) is another VGAM2181 host target gene. PDK4 BINDING SITE is HOST TARGET binding site found in the 3' untranslated region of mRNA encoded by PDK4, corresponding to a HOST TARGET binding site such as BINDING SITE I, BINDING SITE II or BINDING SITE III. Table 2 illustrates the complementarity of the nucleotide sequences of PDK4 BINDING SITE, designated SEQ ID:46440, to the nucleotide sequence of VGAM2181 RNA, herein designated VGAM RNA, also designated SEQ ID:4892.

Another function of VGAM2181 is therefore inhibition of Pyruvate Dehydrogenase Kinase, Isoenzyme 4 (PDK4, Accession XM_173198). Accordingly, utilities of VGAM2181 include diagnosis, prevention and treatment of diseases and clinical conditions associated with PDK4. Podocalyxin-like (PODXL, Accession NM_005397) is another VGAM2181 host target gene. PODXL BINDING SITE is HOST TARGET binding site found in the 3' untranslated region of mRNA encoded by PODXL, corresponding to a HOST TARGET binding site such as BINDING SITE I, BINDING SITE II or BINDING SITE III. Table 2 illustrates the complementarity of the nucleotide sequences of PODXL BINDING SITE, designated SEQ ID:11875, to the nucleotide sequence of VGAM2181 RNA, herein designated VGAM RNA, also designated SEQ ID:4892.

Another function of VGAM2181 is therefore inhibition of Podocalyxin-like (PODXL, Accession NM_005397), a gene which is an antiadhesin. Accordingly, utilities of VGAM2181 include diagnosis, prevention and treatment of diseases and clinical conditions associated with PODXL. The function of PODXL and its association with various diseases and clinical conditions, has been established by previous studies, as described hereinabove with reference to VGAM247. Dual Specificity Phosphatase 10 (DUSP10, Accession NM_144729) is another VGAM2181 host target gene. DUSP10 BINDING SITE is HOST TARGET binding site found in the 5' untranslated region of mRNA encoded by DUSP10, corresponding to a HOST TARGET binding site such as BINDING SITE I, BINDING SITE II or BINDING SITE III. Table 2 illustrates the complementarity of the nucleotide sequences of DUSP10 BINDING SITE, designated SEQ ID:29556, to the nucleotide sequence of VGAM2181 RNA, herein designated VGAM RNA, also designated SEQ ID:4892.

Another function of VGAM2181 is therefore inhibition of Dual Specificity Phosphatase 10 (DUSP10, Accession NM_144729). Accordingly, utilities of VGAM2181 include diagnosis, prevention and treatment of diseases and clinical conditions associated with DUSP10. FLJ10342 (Accession NM_018064) is another VGAM2181 host target gene. FLJ10342 BINDING SITE is HOST TARGET binding site found in the 5' untranslated region of mRNA encoded by FLJ10342, corresponding to a HOST TARGET binding site such as BINDING SITE I, BINDING SITE II or BINDING SITE III. Table 2 illustrates the complementarity of the nucleotide sequences of FLJ10342 BINDING SITE, designated SEQ ID:19836, to the nucleotide sequence of VGAM2181 RNA, herein designated VGAM RNA, also designated SEQ ID:4892.

Another function of VGAM2181 is therefore inhibition of FLJ10342 (Accession NM_018064). Accordingly, utilities of VGAM2181 include diagnosis, prevention and treatment of diseases and clinical conditions associated with FLJ10342. FLJ11267 (Accession NM_019607) is another VGAM2181 host target gene. FLJ11267 BINDING SITE is HOST TARGET binding site found in the 3' untranslated region of mRNA encoded by FLJ11267, corresponding to a HOST TARGET binding site such as BINDING SITE I, BINDING SITE II or BINDING SITE III. Table 2 illustrates the complementarity of the nucleotide sequences of FLJ11267 BINDING SITE, designated SEQ ID:21224, to the nucleotide sequence of VGAM2181 RNA, herein designated VGAM RNA, also designated SEQ ID:4892.

Another function of VGAM2181 is therefore inhibition of FLJ11267 (Accession NM_019607). Accordingly, utilities of VGAM2181 include diagnosis, prevention and treatment of diseases and clinical conditions associated with FLJ11267. FLJ13340 (Accession NM_057175) is another VGAM2181 host target gene. FLJ13340 BINDING SITE is HOST TARGET binding site found in the 3' untranslated region of mRNA encoded by FLJ13340, corresponding to a HOST TARGET binding site such as BINDING SITE I, BINDING SITE II or BINDING SITE III. Table 2 illustrates the complementarity of the nucleotide sequences of FLJ13340 BINDING SITE, designated SEQ ID:27706, to the nucleotide sequence of VGAM2181 RNA, herein designated VGAM RNA, also designated SEQ ID:4892.

Another function of VGAM2181 is therefore inhibition of FLJ13340 (Accession NM_057175). Accordingly, utilities of VGAM2181 include diagnosis, prevention and treatment of diseases and clinical conditions associated with FLJ13340. FLJ21777 (Accession NM_032209) is another VGAM2181 host target gene. FLJ21777 BINDING SITE is HOST TARGET binding site found in the 5' untranslated region of mRNA encoded by FLJ21777, corresponding to a HOST TARGET binding site such as BINDING SITE I, BINDING SITE II or BINDING SITE III. Table 2 illustrates the complementarity of the nucleotide sequences of FLJ21777 BINDING SITE, designated SEQ ID:25923, to the nucleotide sequence of VGAM2181 RNA, herein designated VGAM RNA, also designated SEQ ID:4892.

Another function of VGAM2181 is therefore inhibition of FLJ21777 (Accession NM_032209). Accordingly, utilities of VGAM2181 include diagnosis, prevention and treatment of diseases and clinical conditions associated with FLJ21777. FLJ23153 (Accession NM_024636) is another VGAM2181 host target gene. FLJ23153 BINDING SITE is HOST TARGET binding site found in the 3' untranslated region of mRNA encoded by FLJ23153, corresponding to a HOST TARGET binding site such as BINDING SITE I, BINDING SITE II or BINDING SITE III. Table 2 illustrates the complementarity of the nucleotide sequences of FLJ23153 BINDING SITE, designated SEQ ID:23907, to the nucleotide sequence of VGAM2181 RNA, herein designated VGAM RNA, also designated SEQ ID:4892.

Another function of VGAM2181 is therefore inhibition of FLJ23153 (Accession NM_024636). Accordingly, utilities of VGAM2181 include diagnosis, prevention and treatment of diseases and clinical conditions associated with FLJ23153. FLJ31978 (Accession NM_144669) is another VGAM2181 host target gene. FLJ31978 BINDING SITE is HOST TARGET binding site found in the 3' untranslated region of mRNA encoded by FLJ31978, corresponding to a HOST TARGET binding site such as BINDING SITE I, BINDING SITE II or BINDING SITE III. Table 2 illustrates the complementarity of the nucleotide sequences of FLJ31978 BINDING SITE, designated SEQ ID:29488, to the nucleotide sequence of VGAM2181 RNA, herein designated VGAM RNA, also designated SEQ ID:4892.

Another function of VGAM2181 is therefore inhibition of FLJ31978 (Accession NM_144669). Accordingly, utilities of VGAM2181 include diagnosis, prevention and treatment of diseases and clinical conditions associated with FLJ31978. Heat Shock 90 kDa Protein 1, Alpha-like 3 (HSPCAL3, Accession XM_084514) is another VGAM2181 host target gene. HSPCAL3 BINDING SITE is HOST TARGET binding site found in the 3' untranslated region of mRNA encoded by HSPCAL3, corresponding to a HOST TARGET binding site such as BINDING SITE I, BINDING SITE II or BINDING SITE III. Table 2 illustrates the complementarity of the nucleotide sequences of HSPCAL3 BINDING SITE, designated SEQ ID:37615, to the nucleotide sequence of VGAM2181 RNA, herein designated VGAM RNA, also designated SEQ ID:4892.

Another function of VGAM2181 is therefore inhibition of Heat Shock 90kDa Protein 1, Alpha-like 3 (HSPCAL3, Accession XM_084514). Accordingly, utilities of VGAM2181 include diagnosis, prevention and treatment of diseases and clinical conditions associated with HSPCAL3. KIAA0276 (Accession XM_048199) is another VGAM2181 host target gene. KIAA0276 BINDING SITE is HOST TAR- GET binding site found in the 3" untranslated region of mRNA encoded by KIAA0276, corresponding to a HOST TARGET binding site such as BINDING SITE I, BINDING SITE II or BINDING SITE III. Table 2 illustrates the complementarity of the nucleotide sequences of KIAA0276 BINDING SITE, designated SEQ ID:35133, to the nucleotide sequence of VGAM2181 RNA, herein designated VGAM RNA, also designated SEQ ID:4892.

Another function of VGAM2181 is therefore inhibition of KIAA0276 (Accession XM_048199). Accordingly, utilities of VGAM2181 include diagnosis, prevention and treatment of diseases and clinical conditions associated with KIAA0276. TBDN100 (Accession NM_025085) is another VGAM2181 host target gene. TBDN100 BINDING SITE is HOST TARGET binding site found in the 3' untranslated region of mRNA encoded by TBDN100, corresponding to a HOST TARGET binding site such as BINDING SITE I, BINDING SITE II or BINDING SITE III. Table 2 illustrates the complementarity of the nucleotide sequences of TBDN100 BINDING SITE, designated SEQ ID:24697, to the nucleotide sequence of VGAM2181 RNA, herein designated VGAM RNA, also designated SEQ ID:4892.

Another function of VGAM2181 is therefore inhibition of TBDN100 (Accession NM_025085). Accordingly, utilities of VGAM2181 include diagnosis, prevention and treatment of diseases and clinical conditions associated with TBDN100. Thioesterase, Adipose Associated (THEA, Accession XM_038922) is another VGAM2181 host target gene. THEA BINDING SITE is HOST TARGET binding site found in the 3' untranslated region of mRNA encoded by THEA, corresponding to a HOST TARGET binding site such as BINDING SITE I, BINDING SITE II or BINDING SITE III. Table 2 illustrates the complementarity of the nucleotide sequences of THEA BINDING SITE, designated SEQ ID:32944, to the nucleotide sequence of VGAM2181 RNA, herein designated VGAM RNA, also designated SEQ ID:4892.

Another function of VGAM2181 is therefore inhibition of Thioesterase, Adipose Associated (THEA, Accession XM_038922). Accordingly, utilities of VGAM2181 include diagnosis, prevention and treatment of diseases and clinical conditions associated with THEA. TUSP (Accession NM_020245) is another VGAM2181 host target gene. TUSP BINDING SITE is HOST TARGET binding site found in the 5' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21519, to the nucleotide sequence of VGAM2181 RNA, herein designated VGAM RNA, also designated SEQ ID:4892.

Another function of VGAM2181 is therefore inhibition of TUSP (Accession NM_020245). Accordingly, utilities of VGAM2181 include diagnosis, prevention and treatment of diseases and clinical conditions associated with TUSP. UBCE7IP5 (Accession NM_014948) is another VGAM2181 host target gene. UBCE7IP5 BINDING SITE is HOST TARGET binding site found in the 3' untranslated region of mRNA encoded by UBCE7IP5, corresponding to a HOST TARGET binding site such as BINDING SITE I, BINDING SITE II or BINDING SITE III. Table 2 illustrates the complementarity of the nucleotide sequences of UBCE7IP5 BINDING SITE, designated SEQ ID:17269, to the nucleotide sequence of VGAM2181 RNA, herein designated VGAM RNA, also designated SEQ ID:4892.

Another function of VGAM2181 is therefore inhibition of UBCE7IP5 (Accession NM_014948). Accordingly, utilities of VGAM2181 include diagnosis, prevention and treatment of diseases and clinical conditions associated with UBCE7IP5. LOC143196 (Accession XM_096389) is another VGAM2181 host target gene. LOC143196 BINDING SITE is HOST TARGET binding site found in the 3' untranslated region of mRNA encoded by LOC143196, corresponding to a HOST TARGET binding site such as BINDING SITE I, BINDING SITE II or BINDING SITE III. Table 2 illustrates the complementarity of the nucleotide sequences of LOC143196 BINDING SITE, designated SEQ ID:40329, to the nucleotide sequence of VGAM2181 RNA, herein designated VGAM RNA, also designated SEQ ID:4892.

Another function of VGAM2181 is therefore inhibition of LOC143196 (Accession XM_096389). Accordingly, utilities of VGAM2181 include diagnosis, prevention and treatment of diseases and clinical conditions associated with LOC143196. LOC147837 (Accession XM_085915) is another VGAM2181 host target gene. LOC147837 BINDING SITE is HOST TARGET binding site found in the 3' untranslated region of mRNA encoded by LOC147837, corresponding to a HOST TARGET binding site such as BINDING SITE I, BINDING SITE II or BINDING SITE III. Table 2 illustrates the complementarity of the nucleotide sequences of LOC147837 BINDING SITE, designated SEQ ID:38391, to the nucleotide sequence of VGAM2181 RNA, herein designated VGAM RNA, also designated SEQ ID:4892.

Another function of VGAM2181 is therefore inhibition of LOC147837 (Accession XM_085915). Accordingly, utilities of VGAM2181 include diagnosis, prevention and treatment of diseases and clinical conditions associated with LOC147837. LOC149111 (Accession XM_086429) is another VGAM2181 host target gene. LOC149111 BINDING SITE is HOST TARGET binding site found in the 3' untranslated region of mRNA encoded by LOC149111, corresponding to a HOST TARGET binding site such as BINDING SITE I, BINDING SITE II or BINDING SITE III. Table 2 illustrates the complementarity of the nucleotide sequences of LOC149111 BINDING SITE, designated SEQ ID:38646, to the nucleotide sequence of VGAM2181 RNA, herein designated VGAM RNA, also designated SEQ ID:4892.

Another function of VGAM2181 is therefore inhibition of LOC149111 (Accession XM_086429). Accordingly, utilities of VGAM2181 include diagnosis, prevention and treatment of diseases and clinical conditions associated with LOC149111. LOC149420 (Accession XM_086530) is another VGAM2181 host target gene. LOC149420 BINDING SITE is HOST TARGET binding site found in the 3' untranslated region of mRNA encoded by LOC149420, corresponding to a HOST TARGET binding site such as BINDING SITE I, BINDING SITE II or BINDING SITE III. Table 2 illustrates the complementarity of the nucleotide sequences of LOC149420 BINDING SITE, designated SEQ ID:38746, to the nucleotide sequence of VGAM2181 RNA, herein designated VGAM RNA, also designated SEQ ID:4892.

Another function of VGAM2181 is therefore inhibition of LOC149420 (Accession XM_086530). Accordingly, utilities of VGAM2181 include diagnosis, prevention and treatment of diseases and clinical conditions associated with LOC149420. LOC151414 (Accession XM_087197) is another VGAM2181 host target gene. LOC151414 BINDING SITE is HOST TARGET binding site found in the 3' untranslated region of mRNA encoded by LOC151414, corresponding to a HOST TARGET binding site such as BINDING SITE I, BINDING SITE II or BINDING SITE III. Table 2 illustrates the complementarity of the nucleotide sequences of LOC151414 BINDING SITE, designated SEQ ID:39110, to the nucleotide sequence of VGAM2181 RNA, herein designated VGAM RNA, also designated SEQ ID:4892.

Another function of VGAM2181 is therefore inhibition of LOC151414 (Accession XM_087197). Accordingly, utilities of VGAM2181 include diagnosis, prevention and treatment of diseases and clinical conditions associated with LOC151414. LOC87769 (Accession XM_049058) is another VGAM2181 host target gene. LOC87769 BINDING SITE is HOST TARGET binding site found in the 5' untranslated region of mRNA encoded by LOC87769, corresponding to a HOST TARGET binding site such as BINDING SITE I, BINDING SITE II or BINDING SITE III. Table 2 illustrates the complementarity of the nucleotide sequences of LOC87769 BINDING SITE, designated SEQ ID:35335, to the nucleotide sequence of VGAM2181 RNA, herein designated VGAM RNA, also designated SEQ ID:4892.

Another function of VGAM2181 is therefore inhibition of LOC87769 (Accession XM_049058). Accordingly, utilities of VGAM2181 include diagnosis, prevention and treatment of diseases and clinical conditions associated with LOC87769. FIG. 1 further provides a conceptual description of a novel bioinformatically detected viral gene of the present invention, referred to here as Viral Genomic Address Messenger 2182 (VGAM2182) viral gene, which modulates expression of respective host target genes thereof, the function and utility of which host target genes is known in the art.

VGAM2182 is a novel bioinformatically detected regulatory, non protein coding, viral micro RNA (miRNA) gene. The method by which VGAM2182 was detected is described hereinabove with reference to FIGS. 1-8.

VGAM2182 gene, herein designated VGAM GENE, is a viral gene contained in the genome of Yaba-like Disease Virus. VGAM2182 host target gene, herein designated VGAM HOST TARGET GENE, is a human gene contained in the human genome.

VGAM2182 gene encodes a VGAM2182 precursor RNA, herein designated VGAM PRECURSOR RNA. Similar to other miRNA genes, and unlike most ordinary genes, VGAM2182 precursor RNA does not encode a protein. A nucleotide sequence identical or highly similar to the nucleotide sequence of VGAM2182 precursor RNA is designated SEQ ID:2168, and is provided hereinbelow with reference to the sequence listing part. Nucleotide sequence SEQ ID:2168 is located at position 132254 relative to the genome of Yaba-like Disease Virus.

VGAM2182 precursor RNA folds onto itself, forming VGAM2182 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2182 folded precursor RNA into VGAM2182 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2182 RNA is designated SEQ ID:4893, and is provided hereinbelow with reference to the sequence listing part.

VGAM2182 host target gene, herein designated VGAM HOST TARGET GENE, encodes a corresponding messenger RNA, VGAM2182 host target RNA, herein designated VGAM HOST TARGET RNA. VGAM2182 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2182 RNA, herein designated VGAM RNA, binds complementarily to one or more host target binding sites located in untranslated regions of VGAM2182 host target RNA, herein designated VGAM HOST TARGET RNA. This complementary binding is due to the fact that the nucleotide sequence of VGAM2182 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2182 RNA, herein designated VGAM RNA, may have a different number of host target binding sites in untranslated regions of a VGAM2182 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2182 RNA, herein designated VGAM RNA, to host target binding sites on VGAM2182 host target RNA, herein designated VGAM HOST TARGET RNA, such as BINDING SITE I, BINDING SITE II and BINDING SITE III, inhibits translation of VGAM2182 host target RNA into VGAM2182 host target protein, herein designated VGAM HOST TARGET PROTEIN. VGAM host target protein is therefore outlined by a broken line.

It is appreciated that VGAM2182 host target gene, herein designated VGAM HOST TARGET GENE, in fact represents a plurality of VGAM2182 host target genes. The mRNA of each one of this plurality of VGAM2182 host target genes comprises one or more host target binding sites, each having a nucleotide sequence which is at least partly complementary to VGAM2182 RNA, herein designated VGAM RNA, and which when bound by VGAM2182 RNA causes inhibition of translation of respective one or more VGAM2182 host target proteins.

It is further appreciated by one skilled in the art that the mode of translational inhibition illustrated by FIG. 1 with specific reference to translational inhibition exerted by VGAM2182 gene, herein designated VGAM GENE, on one or more VGAM2182 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2182 is inhibition of expression of host target genes, as part of a novel viral mechanism of attacking a host. Accordingly, utilities of VGAM2182 include diagnosis, prevention and treatment of viral infection by Yaba-like Disease Virus. Specific functions, and accordingly utilities, of VGAM2182 correlate with, and may be deduced from, the identity of the host target genes which VGAM2182 binds and inhibits, and the function of these host target genes, as elaborated hereinbelow.

Nucleotide sequences of the VGAM2182 precursor RNA, herein designated VGAM PRECURSOR RNA, and of the 'diced' VGAM2182 RNA, herein designated VGAM RNA, and a schematic representation of the secondary folding of VGAM2182 folded precursor RNA, herein designated VGAM FOLDED PRECURSOR RNA, of VGAM2182 are further described hereinbelow with reference to Table 1.

Nucleotide sequences of host target binding sites, such as BINDING SITE-I, BINDING SITE-II and BINDING SITE-III of FIG. 1, found on VGAM2182 host target RNA, and schematic representation of the complementarity of each of these host target binding sites to VGAM2182 RNA, herein designated VGAM RNA, are described hereinbelow with reference to Table 2.

As mentioned hereinabove with reference to FIG. 1, a function of VGAM2182 gene, herein designated VGAM is inhibition of expression of VGAM2182 target genes. It is appreciated that specific functions, and accordingly utilities, of VGAM2182 correlate with, and may be deduced from, the identity of the target genes which VGAM2182 binds and inhibits, and the function of these target genes, as elaborated hereinbelow.

Kelch-like 1 (Drosophila) (KLHL1, Accession NM_020866) is a VGAM2182 host target gene. KLHL1 BINDING SITE is HOST TARGET binding site found in the 3' untranslated region of mRNA encoded by KLHL1, corresponding to a HOST TARGET binding site such as BINDING SITE I, BINDING SITE II or BINDING SITE III. Table 2 illustrates the complementarity of the nucleotide sequences of KLHL1 BINDING SITE, designated SEQ ID:21920, to the nucleotide sequence of VGAM2182 RNA, herein designated VGAM RNA, also designated SEQ ID:4893.

A function of VGAM2182 is therefore inhibition of Kelch-like 1 (Drosophila) (KLHL1, Accession NM_020866). Accordingly, utilities of VGAM2182 include diagnosis, prevention and treatment of diseases and clinical conditions associated with KLHL1. Baculoviral IAP Repeat-containing 1 (BIRC1, Accession NM_004536) is another VGAM2182 host target gene. BIRC1 BINDING SITE is HOST TARGET binding site found in the 3' untranslated region of mRNA encoded by BIRC1, corresponding to a HOST TARGET binding site such as BINDING SITE I, BINDING SITE II or BINDING SITE III. Table 2 illustrates the complementarity of the nucleotide sequences of BIRC1 BINDING SITE, designated SEQ ID:10882, to the nucleotide sequence of VGAM2182 RNA, herein designated VGAM RNA, also designated SEQ ID:4893.

Another function of VGAM2182 is therefore inhibition of Baculoviral IAP Repeat-containing 1 (BIRC1, Accession NM_004536). Accordingly, utilities of VGAM2182 include diagnosis, prevention and treatment of diseases and clinical conditions associated with BIRC1. Chromosome 20 Open Reading Frame 103 (C20orf103, Accession NM_012261) is another VGAM2182 host target gene. C20orf103 BINDING SITE is HOST TARGET binding site found in the 3' untranslated region of mRNA encoded by C20orf103, corresponding to a HOST TARGET binding site such as BINDING SITE I, BINDING SITE II or BINDING SITE III. Table 2 illustrates the complementarity of the nucleotide sequences of C20orf103 BINDING SITE, designated SEQ ID:14569, to the nucleotide sequence of VGAM2182 RNA, herein designated VGAM RNA, also designated SEQ ID:4893.

Another function of VGAM2182 is therefore inhibition of Chromosome 20 Open Reading Frame 103 (C20orf103, Accession NM_012261). Accordingly, utilities of VGAM2182 include diagnosis, prevention and treatment of diseases and clinical conditions associated with C20orf103. KIAA1404 (Accession XM_030494) is another VGAM2182 host target gene. KIAA1404 BINDING SITE is HOST TARGET binding site found in the 3' untranslated region of mRNA encoded by KIAA1404, corresponding to a HOST TARGET binding site such as BINDING SITE I, BINDING SITE II or BINDING SITE III. Table 2 illustrates the complementarity of the nucleotide sequences of KIAA1404 BINDING SITE, designated SEQ ID:31048, to the nucleotide sequence of VGAM2182 RNA, herein designated VGAM RNA, also designated SEQ ID:4893.

Another function of VGAM2182 is therefore inhibition of KIAA1404 (Accession XM_030494). Accordingly, utilities of VGAM2182 include diagnosis, prevention and treatment of diseases and clinical conditions associated with KIAA1404. Serine/threonine Kinase 38 Like (STK38L, Accession XM_044823) is another VGAM2182 host target gene. STK38L BINDING SITE is HOST TARGET binding site found in the 3' untranslated region of mRNA encoded by STK38L, corresponding to a HOST TARGET binding site such as BINDING SITE I, BINDING SITE II or BINDING SITE III. Table 2 illustrates the complementarity of the nucleotide sequences of STK38L BINDING SITE, designated SEQ ID:34287, to the nucleotide sequence of VGAM2182 RNA, herein designated VGAM RNA, also designated SEQ ID:4893.

Another function of VGAM2182 is therefore inhibition of Serine/threonine Kinase 38 Like (STK38L, Accession XM_044823). Accordingly, utilities of VGAM2182 include diagnosis, prevention and treatment of diseases and clinical conditions associated with STK38L. FIG. 1 further provides a conceptual description of a novel bioinformatically detected viral gene of the present invention, referred to here as Viral Genomic Address Messenger 2183 (VGAM2183) viral gene, which modulates expression of respective host target genes thereof, the function and utility of which host target genes is known in the art.

VGAM2183 is a novel bioinformatically detected regulatory, non protein coding, viral micro RNA (miRNA) gene. The method by which VGAM2183 was detected is described hereinabove with reference to FIGS. 1-8.

VGAM2183 gene, herein designated VGAM GENE, is a viral gene contained in the genome of Yaba-like Disease Virus. VGAM2183 host target gene, herein designated VGAM HOST TARGET GENE, is a human gene contained in the human genome.

VGAM2183 gene encodes a VGAM2183 precursor RNA, herein designated VGAM PRECURSOR RNA. Similar to other miRNA genes, and unlike most ordinary genes, VGAM2183 precursor RNA does not encode a protein. A nucleotide sequence identical or highly similar to the nucleotide sequence of VGAM2183 precursor RNA is designated SEQ ID:2169, and is provided hereinbelow with reference to the sequence listing part. Nucleotide sequence SEQ ID:2169 is located at position 135497 relative to the genome of Yaba-like Disease Virus.

VGAM2183 precursor RNA folds onto itself, forming VGAM2183 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2183 folded precursor RNA into VGAM2183 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2183 RNA is designated SEQ ID:4894, and is provided hereinbelow with reference to the sequence listing part.

VGAM2183 host target gene, herein designated VGAM HOST TARGET GENE, encodes a corresponding messenger RNA, VGAM2183 host target RNA, herein designated VGAM HOST TARGET RNA. VGAM2183 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2183 RNA, herein designated VGAM RNA, binds complementarily to one or more host target binding sites located in untranslated regions of VGAM2183 host target RNA, herein designated VGAM HOST TARGET RNA. This complementary binding is due to the fact that the nucleotide sequence of VGAM2183 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2183 RNA, herein designated VGAM RNA, may have a different number of host target binding sites in untranslated regions of a VGAM2183 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2183 RNA, herein designated VGAM RNA, to host target binding sites on VGAM2183 host target RNA, herein designated VGAM HOST TARGET RNA, such as BINDING SITE I, BINDING SITE II and BINDING SITE III, inhibits translation of VGAM2183 host target RNA into VGAM2183 host target protein, herein designated VGAM HOST TARGET PROTEIN. VGAM host target protein is therefore outlined by a broken line.

It is appreciated that VGAM2183 host target gene, herein designated VGAM HOST TARGET GENE, in fact represents a plurality of VGAM2183 host target genes. The mRNA of each one of this plurality of VGAM2183 host target genes comprises one or more host target binding sites, each having a nucleotide sequence which is at least partly complementary to VGAM2183 RNA, herein designated VGAM RNA, and which when bound by VGAM2183 RNA causes inhibition of translation of respective one or more VGAM2183 host target proteins.

It is further appreciated by one skilled in the art that the mode of translational inhibition illustrated by FIG. 1 with specific reference to translational inhibition exerted by VGAM2183 gene, herein designated VGAM GENE, on one or more VGAM2183 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2183 is inhibition of expression of host target genes, as part of a novel viral mechanism of attacking a host. Accordingly, utilities of VGAM2183 include diagnosis, prevention and treatment of viral infection by Yaba-like Disease Virus. Specific functions, and accordingly utilities, of VGAM2183 correlate with, and may be deduced from, the identity of the host target genes which VGAM2183 binds and inhibits, and the function of these host target genes, as elaborated hereinbelow.

Nucleotide sequences of the VGAM2183 precursor RNA, herein designated VGAM PRECURSOR RNA, and of the 'diced' VGAM2183 RNA, herein designated VGAM RNA, and a schematic representation of the secondary folding of VGAM2183 folded precursor RNA, herein designated VGAM FOLDED PRECURSOR RNA, of VGAM2183 are further described hereinbelow with reference to Table 1.

Nucleotide sequences of host target binding sites, such as BINDING SITE-I, BINDING SITE-II and BINDING SITE-III of FIG. 1, found on VGAM2183 host target RNA, and schematic representation of the complementarity of each of these host target binding sites to VGAM2183 RNA, herein designated VGAM RNA, are described hereinbelow with reference to Table 2.

As mentioned hereinabove with reference to FIG. 1, a function of VGAM2183 gene, herein designated VGAM is inhibition of expression of VGAM2183 target genes. It is appreciated that specific functions, and accordingly utilities, of VGAM2183 correlate with, and may be deduced from, the identity of the target genes which VGAM2183 binds and inhibits, and the function of these target genes, as elaborated hereinbelow.

A Disintegrin and Metalloproteinase Domain 12 (meltrin alpha) (ADAM12, Accession NM_003474) is a VGAM2183 host target gene. ADAM12 BINDING SITE is HOST TARGET binding site found in the 3' untranslated region of mRNA encoded by ADAM12, corresponding to a HOST TARGET binding site such as BINDING SITE I, BINDING SITE II or BINDING SITE III. Table 2 illustrates the complementarity of the nucleotide sequences of ADAM12 BINDING SITE, designated SEQ ID:9545, to the nucleotide sequence of VGAM2183 RNA, herein designated VGAM RNA, also designated SEQ ID:4894.

A function of VGAM2183 is therefore inhibition of A Disintegrin and Metalloproteinase Domain 12 (meltrin alpha) (ADAM12, Accession NM_003474), a gene which involved in skeletal muscle regeneration, specifically at the onset of cell fusion. Accordingly, utilities of VGAM2183 include diagnosis, prevention and treatment of diseases and clinical conditions associated with ADAM12. The function of ADAM12 and its association with various diseases and clinical conditions, has been established by previous studies, as described hereinabove with reference to VGAM675. Caldesmon 1 (CALD1, Accession NM_033138) is another VGAM2183 host target gene. CALD1 BINDING SITE1 and CALD1 BINDING SITE2 are HOST TARGET binding sites found in untranslated regions of mRNA encoded by CALD1, corresponding to HOST TARGET binding sites such as BINDING SITE I, BINDING SITE II or BINDING SITE III. Table 2 illustrates the complementarity of the nucleotide sequences of CALD1 BINDING SITE1 and CALD1 BINDING SITE2, designated SEQ ID:26990 and SEQ ID:27008 respectively, to the nucleotide sequence of VGAM2183 RNA, herein designated VGAM RNA, also designated SEQ ID:4894.

Another function of VGAM2183 is therefore inhibition of Caldesmon 1 (CALD1, Accession NM_033138), a gene which is implicated in the regulation of actomyosin interactions in smooth muscle and nonmuscle cells. Accordingly, utilities of VGAM2183 include diagnosis, prevention and treatment of diseases and clinical conditions associated with CALD1. The function of CALD1 and its association with various diseases and clinical conditions, has been established by previous studies, as described hereinabove with reference to VGAM1960. FIG. 1 further provides a conceptual description of a novel bioinformatically detected viral gene of the present invention, referred to here as Viral Genomic Address Messenger 2184 (VGAM2184) viral gene, which modulates expression of respective host target genes thereof, the function and utility of which host target genes is known in the art.

VGAM2184 is a novel bioinformatically detected regulatory, non protein coding, viral micro RNA (miRNA) gene. The method by which VGAM2184 was detected is described hereinabove with reference to FIGS. 1-8.

VGAM2184 gene, herein designated VGAM GENE, is a viral gene contained in the genome of Monkeypox Virus. VGAM2184 host target gene, herein designated VGAM HOST TARGET GENE, is a human gene contained in the human genome.

VGAM2184 gene encodes a VGAM2184 precursor RNA, herein designated VGAM PRECURSOR RNA. Similar to other miRNA genes, and unlike most ordinary genes, VGAM2184 precursor RNA does not encode a protein. A nucleotide sequence identical or highly similar to the nucleotide sequence of VGAM2184 precursor RNA is designated SEQ ID:2170, and is provided hereinbelow with reference to the sequence listing part. Nucleotide sequence SEQ ID:2170 is located at position 187541 relative to the genome of Monkeypox Virus.

VGAM2184 precursor RNA folds onto itself, forming VGAM2184 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2184 folded precursor RNA into VGAM2184 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2184 RNA is designated SEQ ID:4895, and is provided hereinbelow with reference to the sequence listing part.

VGAM2184 host target gene, herein designated VGAM HOST TARGET GENE, encodes a corresponding messenger RNA, VGAM2184 host target RNA, herein designated VGAM HOST TARGET RNA. VGAM2184 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2184 RNA, herein designated VGAM RNA, binds complementarily to one or more host target binding sites located in untranslated regions of VGAM2184 host target RNA, herein designated VGAM HOST TARGET RNA. This complementary binding is due to the fact that the nucleotide sequence of VGAM2184 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2184 RNA, herein designated VGAM RNA, may have a different number of host target binding sites in untranslated regions of a VGAM2184 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2184 RNA, herein designated VGAM RNA, to host target binding sites on VGAM2184 host target RNA, herein designated VGAM HOST TARGET RNA, such as BINDING SITE I, BINDING SITE II and BINDING SITE III, inhibits translation of VGAM2184 host target RNA into VGAM2184 host target protein, herein designated VGAM HOST TARGET PROTEIN. VGAM host target protein is therefore outlined by a broken line.

It is appreciated that VGAM2184 host target gene, herein designated VGAM HOST TARGET GENE, in fact represents a plurality of VGAM2184 host target genes. The mRNA of each one of this plurality of VGAM2184 host target genes comprises one or more host target binding sites, each having a nucleotide sequence which is at least partly complementary to VGAM2184 RNA, herein designated VGAM RNA, and which when bound by VGAM2184 RNA causes inhibition of translation of respective one or more VGAM2184 host target proteins.

It is further appreciated by one skilled in the art that the mode of translational inhibition illustrated by FIG. 1 with specific reference to translational inhibition exerted by VGAM2184 gene, herein designated VGAM GENE, on one or more VGAM2184 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2184 is inhibition of expression of host target genes, as part of a novel viral mechanism of attacking a host. Accordingly, utilities of VGAM2184 include diagnosis, prevention and treatment of viral infection by Monkeypox Virus. Specific functions, and accordingly utilities, of VGAM2184 correlate with, and may be deduced from, the identity of the host target genes which VGAM2184 binds and inhibits, and the function of these host target genes, as elaborated hereinbelow.

Nucleotide sequences of the VGAM2184 precursor RNA, herein designated VGAM PRECURSOR RNA, and of the 'diced' VGAM2184 RNA, herein designated VGAM RNA, and a schematic representation of the secondary folding of VGAM2184 folded precursor RNA, herein designated VGAM FOLDED PRECURSOR RNA, of VGAM2184 are further described hereinbelow with reference to Table 1.

Nucleotide sequences of host target binding sites, such as BINDING SITE-I, BINDING SITE-II and BINDING SITE-III of FIG. 1, found on VGAM2184 host target RNA, and schematic representation of the complementarity of each of these host target binding sites to VGAM2184 RNA, herein designated VGAM RNA, are described hereinbelow with reference to Table 2.

As mentioned hereinabove with reference to FIG. 1, a function of VGAM2184 gene, herein designated VGAM is inhibition of expression of VGAM2184 target genes. It is appreciated that specific functions, and accordingly utilities, of VGAM2184 correlate with, and may be deduced from, the identity of the target genes which VGAM2184 binds and inhibits, and the function of these target genes, as elaborated hereinbelow.

Angiopoietin 1 (ANGPT1, Accession NM_001146) is a VGAM2184 host target gene. ANGPT1 BINDING SITE is HOST TARGET binding site found in the 3' untranslated region of mRNA encoded by ANGPT1, corresponding to a HOST TARGET binding site such as BINDING SITE I, BINDING SITE II or BINDING SITE III. Table 2 illustrates the complementarity of the nucleotide sequences of ANGPT1 BINDING SITE, designated SEQ ID:6813, to the nucleotide sequence of VGAM2184 RNA, herein designated VGAM RNA, also designated SEQ ID:4895.

A function of VGAM2184 is therefore inhibition of Angiopoietin 1 (ANGPT1, Accession NM_001146), a gene which binds and activates tie2 receptor by inducing its tyrosine phosphorylation. Accordingly, utilities of VGAM2184 include diagnosis, prevention and treatment of diseases and clinical conditions associated with ANGPT1. The function of ANGPT1 and its association with various diseases and clinical conditions, has been established by previous studies, as described hereinabove with reference to VGAM291. FLJ10970 (Accession NM_018286) is another VGAM2184 host target gene. FLJ10970 BINDING SITE is HOST TARGET binding site found in the 3' untranslated region of mRNA encoded by FLJ10970, corresponding to a HOST TARGET binding site such as BINDING SITE I, BINDING SITE II or BINDING SITE III. Table 2 illustrates the complementarity of the nucleotide sequences of FLJ10970 BINDING SITE, designated SEQ ID:20279, to the nucleotide sequence of VGAM2184 RNA, herein designated VGAM RNA, also designated SEQ ID:4895.

Another function of VGAM2184 is therefore inhibition of FLJ10970 (Accession NM_018286). Accordingly, utilities of VGAM2184 include diagnosis, prevention and treatment of diseases and clinical conditions associated with FLJ10970. KIAA0976 (Accession NM_014917) is another VGAM2184 host target gene. KIAA0976 BINDING SITE is HOST TARGET binding site found in the 3' untranslated region of mRNA encoded by KIAA0976, corresponding to a HOST TARGET binding site such as BINDING SITE I, BINDING SITE II or BINDING SITE III. Table 2 illustrates the complementarity of the nucleotide sequences of KIAA0976 BINDING SITE, designated SEQ ID:17168, to the nucleotide sequence of VGAM2184 RNA, herein designated VGAM RNA, also designated SEQ ID:4895.

Another function of VGAM2184 is therefore inhibition of KIAA0976 (Accession NM_014917). Accordingly, utilities of VGAM2184 include diagnosis, prevention and treatment of diseases and clinical conditions associated with KIAA0976. LOC118491 (Accession XM_058324) is another VGAM2184 host target gene. LOC118491 BINDING SITE is HOST TARGET binding site found in the 5' untranslated region of mRNA encoded by LOC118491, corresponding to a HOST TARGET binding site such as BINDING SITE I, BINDING SITE II or BINDING SITE III. Table 2 illustrates the complementarity of the nucleotide sequences of LOC118491 BINDING SITE, designated SEQ ID:36595, to the nucleotide sequence of VGAM2184 RNA, herein designated VGAM RNA, also designated SEQ ID:4895.

Another function of VGAM2184 is therefore inhibition of LOC118491 (Accession XM_058324). Accordingly, utilities of VGAM2184 include diagnosis, prevention and treatment of diseases and clinical conditions associated with LOC118491. FIG. 1 further provides a conceptual description of a novel bioinformatically detected viral gene of the present invention, referred to here as Viral Genomic Address Messenger 2185 (VGAM2185) viral gene, which modulates expression of respective host target genes thereof, the function and utility of which host target genes is known in the art.

VGAM2185 is a novel bioinformatically detected regulatory, non protein coding, viral micro RNA (miRNA) gene. The method by which VGAM2185 was detected is described hereinabove with reference to FIGS. 1-8.

VGAM2185 gene, herein designated VGAM GENE, is a viral gene contained in the genome of Camelpox Virus. VGAM2185 host target gene, herein designated VGAM HOST TARGET GENE, is a human gene contained in the human genome.

VGAM2185 gene encodes a VGAM2185 precursor RNA, herein designated VGAM PRECURSOR RNA. Similar to other miRNA genes, and unlike most ordinary genes, VGAM2185 precursor RNA does not encode a protein. A nucleotide sequence identical or highly similar to the nucleotide sequence of VGAM2185 precursor RNA is designated SEQ ID:2171, and is provided hereinbelow with reference to the sequence listing part. Nucleotide sequence SEQ ID:2171 is located at position 195252 relative to the genome of Camelpox Virus.

VGAM2185 precursor RNA folds onto itself, forming VGAM2185 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2185 folded precursor RNA into VGAM2185 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2185 RNA is designated SEQ ID:4896, and is provided hereinbelow with reference to the sequence listing part.

VGAM2185 host target gene, herein designated VGAM HOST TARGET GENE, encodes a corresponding messenger RNA, VGAM2185 host target RNA, herein designated VGAM HOST TARGET RNA. VGAM2185 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2185 RNA, herein designated VGAM RNA, binds complementarily to one or more host target binding sites located in untranslated regions of VGAM2185 host target RNA, herein designated VGAM HOST TARGET RNA. This complementary binding is due to the fact that the nucleotide sequence of VGAM2185 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2185 RNA, herein designated VGAM RNA, may have a different number of host target binding sites in untranslated regions of a VGAM2185 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2185 RNA, herein designated VGAM RNA, to host target binding sites on VGAM2185 host target RNA, herein designated VGAM HOST TARGET RNA, such as BINDING SITE I, BINDING SITE II and BINDING SITE III, inhibits translation of VGAM2185 host target RNA into VGAM2185 host target protein, herein designated VGAM HOST TARGET PROTEIN. VGAM host target protein is therefore outlined by a broken line.

It is appreciated that VGAM2185 host target gene, herein designated VGAM HOST TARGET GENE, in fact represents a plurality of VGAM2185 host target genes. The mRNA of each one of this plurality of VGAM2185 host target genes comprises one or more host target binding sites, each having a nucleotide sequence which is at least partly complementary to VGAM2185 RNA, herein designated VGAM RNA, and which when bound by VGAM2185 RNA causes inhibition of translation of respective one or more VGAM2185 host target proteins.

It is further appreciated by one skilled in the art that the mode of translational inhibition illustrated by FIG. 1 with specific reference to translational inhibition exerted by VGAM2185 gene, herein designated VGAM GENE, on one or more VGAM2185 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2185 is inhibition of expression of host target genes, as part of a novel viral mechanism of attacking a host. Accordingly, utilities of VGAM2185 include diagnosis, prevention and treatment of viral infection by Camelpox Virus. Specific functions, and accordingly utilities, of VGAM2185 correlate with, and may be deduced from, the identity of the host target genes which VGAM2185 binds and inhibits, and the function of these host target genes, as elaborated hereinbelow.

Nucleotide sequences of the VGAM2185 precursor RNA, herein designated VGAM PRECURSOR RNA, and of the 'diced' VGAM2185 RNA, herein designated VGAM RNA, and a schematic representation of the secondary folding of VGAM2185 folded precursor RNA, herein designated VGAM FOLDED PRECURSOR RNA, of VGAM2185 are further described hereinbelow with reference to Table 1.

Nucleotide sequences of host target binding sites, such as BINDING SITE-I, BINDING SITE-II and BINDING SITE-III of FIG. 1, found on VGAM2185 host target RNA, and schematic representation of the complementarity of each of these host target binding sites to VGAM2185 RNA, herein designated VGAM RNA, are described hereinbelow with reference to Table 2.

As mentioned hereinabove with reference to FIG. 1, a function of VGAM2185 gene, herein designated VGAM is inhibition of expression of VGAM2185 target genes. It is appreciated that specific functions, and accordingly utilities, of VGAM2185 correlate with, and may be deduced from, the identity of the target genes which VGAM2185 binds and inhibits, and the function of these target genes, as elaborated hereinbelow.

Estrogen-related Receptor Gamma (ESRRG, Accession XM_039053) is a VGAM2185 host target gene. ESRRG BINDING SITE is HOST TARGET binding site found in the 3' untranslated region of mRNA encoded by ESRRG, corresponding to a HOST TARGET binding site such as BINDING SITE I, BINDING SITE II or BINDING SITE III. Table 2 illustrates the complementarity of the nucleotide sequences of ESRRG BINDING SITE, designated SEQ ID:32999, to the nucleotide sequence of VGAM2185 RNA, herein designated VGAM RNA, also designated SEQ ID:4896.

A function of VGAM2185 is therefore inhibition of Estrogen-related Receptor Gamma (ESRRG, Accession XM_039053), a gene which Estrogen-related receptor gamma. Accordingly, utilities of VGAM2185 include diagnosis, prevention and treatment of diseases and clinical conditions associated with ESRRG. The function of ESRRG and its association with various diseases and clinical conditions, has been established by previous studies, as described hereinabove with reference to VGAM359. Integrin, Alpha L (antigen CD11A (p180), Lymphocyte Function-associated Antigen 1; Alpha Polypeptide) (ITGAL, Accession NM_002209) is another VGAM2185 host target gene. ITGAL BINDING SITE is HOST TARGET binding site found in the 3' untranslated region of mRNA encoded by ITGAL, corresponding to a HOST TARGET binding site such as BINDING SITE I, BINDING SITE II or BINDING SITE III. Table 2 illustrates the complementarity of the nucleotide sequences of ITGAL BINDING SITE, designated SEQ ID:7972, to the nucleotide sequence of VGAM2185 RNA, herein designated VGAM RNA, also designated SEQ ID:4896.

Another function of VGAM2185 is therefore inhibition of Integrin, Alpha L (antigen CD11A (p180), Lymphocyte Function-associated Antigen 1; Alpha Polypeptide) (ITGAL, Accession NM_002209), a gene which s a receptor for icam1, icam2, icam3 and icam4. it is involved in a variety of immune phenomena including leukocyte-endothelial cell interaction, cytotoxic t-cell mediated killing, and antibody dependent killing by granulocytes and monocytes. Accordingly, utilities of VGAM2185 include diagnosis, prevention and treatment of diseases and clinical conditions associated with ITGAL. The function of ITGAL and its association with various diseases and clinical conditions, has been established by previous studies, as described hereinabove with reference to VGAM200. Nuclear Fragile X Mental Retardation Protein Interacting Protein 1 (NUFIP1, Accession NM_012345) is another VGAM2185 host target gene. NUFIP1 BINDING SITE is HOST TARGET binding site found in the 3' untranslated region of mRNA encoded by NUFIP1, corresponding to a HOST TARGET binding site such as BINDING SITE I, BINDING SITE II or BINDING SITE III. Table 2 illustrates the complementarity of the nucleotide sequences of NUFIP1 BINDING SITE, designated SEQ ID:14737, to the nucleotide sequence of VGAM2185 RNA, herein designated VGAM RNA, also designated SEQ ID:4896.

Another function of VGAM2185 is therefore inhibition of Nuclear Fragile X Mental Retardation Protein Interacting Protein 1 (NUFIP1, Accession NM_012345), a gene which binds and colocalizes with nuclear fragile X mental retardation protein. Accordingly, utilities of VGAM2185 include diagnosis, prevention and treatment of diseases and clinical conditions associated with NUFIP1. The function of NUFIP1 and its association with various diseases and clinical conditions, has been established by previous studies, as described hereinabove with reference to VGAM733. POU Domain, Class 2, Associating Factor 1 (POU2AF1, Accession NM_006235) is another VGAM2185 host target gene. POU2AF1 BINDING SITE is HOST TARGET binding site found in the 3' untranslated region of mRNA encoded by POU2AF1, corresponding to a HOST TARGET binding site such as BINDING SITE I, BINDING SITE II or BINDING SITE III. Table 2 illustrates the complementarity of the nucleotide sequences of POU2AF1 BINDING SITE, designated SEQ ID:12892, to the nucleotide sequence of VGAM2185 RNA, herein designated VGAM RNA, also designated SEQ ID:4896.

Another function of VGAM2185 is therefore inhibition of POU Domain, Class 2, Associating Factor 1 (POU2AF1, Accession NM_006235), a gene which is a transcriptional coactivator that specifically associates with either oct1 or oct2. Accordingly, utilities of VGAM2185 include diagnosis, prevention and treatment of diseases and clinical conditions associated with POU2AF1. The function of POU2AF1 and its association with various diseases and clinical conditions, has been established by previous studies, as described hereinabove with reference to VGAM171. Recombination Activating Gene 2 (RAG2, Accession XM_089839) is another VGAM2185 host target gene. RAG2 BINDING SITE is HOST TARGET binding site found in the 5' untranslated region of mRNA encoded by RAG2, corresponding to a HOST TARGET binding site such as BINDING SITE I, BINDING SITE II or BINDING SITE III. Table 2 illustrates the complementarity of the nucleotide sequences of RAG2 BINDING SITE, designated SEQ ID:39985, to the nucleotide sequence of VGAM2185 RNA, herein designated VGAM RNA, also designated SEQ ID:4896.

Another function of VGAM2185 is therefore inhibition of Recombination Activating Gene 2 (RAG2, Accession XM_089839). Accordingly, utilities of VGAM2185 include diagnosis, prevention and treatment of diseases and clinical conditions associated with RAG2. Tensin (TNS, Accession NM_022648) is another VGAM2185 host target gene. TNS BINDING SITE is HOST TARGET binding site found in the 3' untranslated region of mRNA encoded by TNS, corresponding to a HOST TARGET binding site such as BINDING SITE I, BINDING SITE II or BINDING SITE III. Table 2 illustrates the complementarity of the nucleotide sequences of TNS BINDING SITE, designated SEQ ID:22903, to the nucleotide sequence of VGAM2185 RNA, herein designated VGAM RNA, also designated SEQ ID:4896.

Another function of VGAM2185 is therefore inhibition of Tensin (TNS, Accession NM_022648). Accordingly, utilities of VGAM2185 include diagnosis, prevention and treatment of diseases and clinical conditions associated with TNS. DKFZP434I092 (Accession XM_042042) is another VGAM2185 host target gene. DKFZP434I092 BINDING SITE is HOST TARGET binding site found in the 3' untranslated region of mRNA encoded by DKFZP434I092, corresponding to a HOST TARGET binding site such as BINDING SITE I, BINDING SITE II or BINDING SITE III. Table 2 illustrates the complementarity of the nucleotide sequences of DKFZP434I092 BINDING SITE, designated SEQ ID:33673, to the nucleotide sequence of VGAM2185 RNA, herein designated VGAM RNA, also designated SEQ ID:4896.

Another function of VGAM2185 is therefore inhibition of DKFZP434I092 (Accession XM_042042). Accordingly, utilities of VGAM2185 include diagnosis, prevention and treatment of diseases and clinical conditions associated with DKFZP434I092. FLJ10656 (Accession NM_018170) is another VGAM2185 host target gene. FLJ10656 BINDING SITE is HOST TARGET binding site found in the 3' untranslated region of mRNA encoded by FLJ10656, corresponding to a HOST TARGET binding site such as BINDING SITE I, BINDING SITE II or BINDING SITE III. Table 2 illustrates the complementarity of the nucleotide sequences of FLJ10656 BINDING SITE, designated SEQ ID:19988, to the nucleotide sequence of VGAM2185 RNA, herein designated VGAM RNA, also designated SEQ ID:4896.

Another function of VGAM2185 is therefore inhibition of FLJ10656 (Accession NM_018170). Accordingly, utilities of VGAM2185 include diagnosis, prevention and treatment of diseases and clinical conditions associated with FLJ10656. GABA(A) Receptor-associated Protein Like 1 (GABARAPL1, Accession NM_031412) is another VGAM2185 host target gene. GABARAPL1 BINDING SITE is HOST TARGET binding site found in the 3' untranslated region of mRNA encoded by GABARAPL1, corresponding to a HOST TARGET binding site such as BINDING SITE I, BINDING SITE II or BINDING SITE III. Table 2 illustrates the complementarity of the nucleotide sequences of GABARAPL1 BINDING SITE, designated SEQ ID:25392, to the nucleotide sequence of VGAM2185 RNA, herein designated VGAM RNA, also designated SEQ ID:4896.

Another function of VGAM2185 is therefore inhibition of GABA(A) Receptor-associated Protein Like 1 (GABARAPL1, Accession NM_031412). Accordingly, utilities of VGAM2185 include diagnosis, prevention and treatment of diseases and clinical conditions associated with GABARAPL1. GABA(A) Receptors Associated Protein Like 3 (GABARAPL3, Accession NM_032568) is another VGAM2185 host target gene. GABARAPL3 BINDING SITE is HOST TARGET binding site found in the 3' untranslated region of mRNA encoded by GABARAPL3, corresponding to a HOST TARGET binding site such as BINDING SITE I, BINDING SITE II or BINDING SITE III. Table 2 illustrates the complementarity of the nucleotide sequences of GABARAPL3 BINDING SITE, designated SEQ ID:26300, to the nucleotide sequence of VGAM2185 RNA, herein designated VGAM RNA, also designated SEQ ID:4896.

Another function of VGAM2185 is therefore inhibition of GABA(A) Receptors Associated Protein Like 3 (GABARAPL3, Accession NM_032568). Accordingly, utilities of VGAM2185 include diagnosis, prevention and treatment of diseases and clinical conditions associated with GABARAPL3. HT002 (Accession NM_014066) is another VGAM2185 host target gene. HT002 BINDING SITE is HOST TARGET binding site found in the 3' untranslated region of mRNA encoded by HT002, corresponding to a HOST TARGET binding site such as BINDING SITE I, BINDING SITE II or BINDING SITE III. Table 2 illustrates the complementarity of the nucleotide sequences of HT002 BINDING SITE, designated SEQ ID:15281, to the nucleotide sequence of VGAM2185 RNA, herein designated VGAM RNA, also designated SEQ ID:4896.

Another function of VGAM2185 is therefore inhibition of HT002 (Accession NM_014066). Accordingly, utilities of VGAM2185 include diagnosis, prevention and treatment of diseases and clinical conditions associated with HT002. KIAA0475 (Accession NM_014864) is another VGAM2185 host target gene. KIAA0475 BINDING SITE is HOST TARGET binding site found in the 3' untranslated region of mRNA encoded by KIAA0475, corresponding to a HOST TARGET binding site such as BINDING SITE I, BINDING SITE II or BINDING SITE III. Table 2 illustrates the complementarity of the nucleotide sequences of KIAA0475 BINDING SITE, designated SEQ ID:16949, to the nucleotide sequence of VGAM2185 RNA, herein designated VGAM RNA, also designated SEQ ID:4896.

Another function of VGAM2185 is therefore inhibition of KIAA0475 (Accession NM_014864). Accordingly, utilities of VGAM2185 include diagnosis, prevention and treatment of diseases and clinical conditions associated with KIAA0475. KIAA0712 (Accession NM_014715) is another VGAM2185 host target gene. KIAA0712 BINDING SITE is HOST TARGET binding site found in the 5' untranslated region of mRNA encoded by KIAA0712, corresponding to a HOST TARGET binding site such as BINDING SITE I, BINDING SITE II or BINDING SITE III. Table 2 illustrates the complementarity of the nucleotide sequences of KIAA0712 BINDING SITE, designated SEQ ID:16262, to the nucleotide sequence of VGAM2185 RNA, herein designated VGAM RNA, also designated SEQ ID:4896.

Another function of VGAM2185 is therefore inhibition of KIAA0712 (Accession NM_014715). Accordingly, utilities of VGAM2185 include diagnosis, prevention and treatment of diseases and clinical conditions associated with KIAA0712. KIAA1301 (Accession XM_038999) is another VGAM2185 host target gene. KIAA1301 BINDING SITE is HOST TARGET binding site found in the 3' untranslated region of mRNA encoded by KIAA1301, corresponding to a HOST TARGET binding site such as BINDING SITE I, BINDING SITE II or BINDING SITE III. Table 2 illustrates the complementarity of the nucleotide sequences of KIAA1301 BINDING SITE, designated SEQ ID:32978, to the nucleotide sequence of VGAM2185 RNA, herein designated VGAM RNA, also designated SEQ ID:4896.

Another function of VGAM2185 is therefore inhibition of KIAA1301 (Accession XM_038999). Accordingly, utilities of VGAM2185 include diagnosis, prevention and treatment of diseases and clinical conditions associated with KIAA1301. Seizure Related 6 Homolog (mouse) (SEZ6, Accession XM_058869) is another VGAM2185 host target gene. SEZ6 BINDING SITE is HOST TARGET binding site found in the 3' untranslated region of mRNA encoded by SEZ6, corresponding to a HOST TARGET binding site such as BINDING SITE I, BINDING SITE II or BINDING SITE III. Table 2 illustrates the complementarity of the nucleotide sequences of SEZ6 BINDING SITE, designated SEQ ID:36774, to the nucleotide sequence of VGAM2185 RNA, herein designated VGAM RNA, also designated SEQ ID:4896.

Another function of VGAM2185 is therefore inhibition of Seizure Related 6 Homolog (mouse) (SEZ6, Accession XM_058869). Accordingly, utilities of VGAM2185 include diagnosis, prevention and treatment of diseases and clinical conditions associated with SEZ6. VMP1 (Accession NM_030938) is another VGAM2185 host target gene. VMP1 BINDING SITE is HOST TARGET binding site found in the 3' untranslated region of mRNA encoded by VMP1, corresponding to a HOST TARGET binding site such as BINDING SITE I, BINDING SITE II or BINDING SITE III. Table 2 illustrates the complementarity of the nucleotide sequences of VMP1 BINDING SITE, designated SEQ ID:25204, to the nucleotide sequence of VGAM2185 RNA, herein designated VGAM RNA, also designated SEQ ID:4896.

Another function of VGAM2185 is therefore inhibition of VMP1 (Accession NM_030938). Accordingly, utilities of VGAM2185 include diagnosis, prevention and treatment of diseases and clinical conditions associated with VMP1. LOC115110 (Accession XM_049825) is another VGAM2185 host target gene. LOC115110 BINDING SITE is HOST TARGET binding site found in the 3' untranslated region of mRNA encoded by LOC115110, corresponding to a HOST TARGET binding site such as BINDING SITE I, BINDING SITE II or BINDING SITE III. Table 2 illustrates the complementarity of the nucleotide sequences of LOC115110 BINDING SITE, designated SEQ ID:35503, to the nucleotide sequence of VGAM2185 RNA, herein designated VGAM RNA, also designated SEQ ID:4896.

Another function of VGAM2185 is therefore inhibition of LOC115110 (Accession XM_049825). Accordingly, utilities of VGAM2185 include diagnosis, prevention and treatment of diseases and clinical conditions associated with LOC115110. LOC132235 (Accession XM_072302) is another VGAM2185 host target gene. LOC132235 BINDING SITE is HOST TARGET binding site found in the 5' untranslated region of mRNA encoded by LOC132235, corresponding to a HOST TARGET binding site such as BINDING SITE I, BINDING SITE II or BINDING SITE III. Table 2 illustrates the complementarity of the nucleotide sequences of LOC132235 BINDING SITE, designated SEQ ID:37483, to the nucleotide sequence of VGAM2185 RNA, herein designated VGAM RNA, also designated SEQ ID:4896.

Another function of VGAM2185 is therefore inhibition of LOC132235 (Accession XM_072302). Accordingly, utilities of VGAM2185 include diagnosis, prevention and treatment of diseases and clinical conditions associated with LOC132235. LOC142941 (Accession XM_096363) is another VGAM2185 host target gene. LOC142941 BINDING SITE is HOST TARGET binding site found in the 3' untranslated region of mRNA encoded by LOC142941, corresponding to a HOST TARGET binding site such as BINDING SITE I, BINDING SITE II or BINDING SITE III. Table 2 illustrates the complementarity of the nucleotide sequences of LOC142941 BINDING SITE, designated SEQ ID:40322, to the nucleotide sequence of VGAM2185 RNA, herein designated VGAM RNA, also designated SEQ ID:4896.

Another function of VGAM2185 is therefore inhibition of LOC142941 (Accession XM_096363). Accordingly, utilities of VGAM2185 include diagnosis, prevention and treatment of diseases and clinical conditions associated with LOC142941. LOC158549 (Accession XM_098963) is another VGAM2185 host target gene. LOC158549 BINDING SITE is HOST TARGET binding site found in the 5' untranslated region of mRNA encoded by LOC158549, corresponding to a HOST TARGET binding site such as BINDING SITE I, BINDING SITE II or BINDING SITE III. Table 2 illustrates the complementarity of the nucleotide sequences of LOC158549 BINDING SITE, designated SEQ ID:42007, to the nucleotide sequence of VGAM2185 RNA, herein designated VGAM RNA, also designated SEQ ID:4896.

Another function of VGAM2185 is therefore inhibition of LOC158549 (Accession XM_098963). Accordingly, utilities of VGAM2185 include diagnosis, prevention and treatment of diseases and clinical conditions associated with LOC158549. LOC221882 (Accession XM_166507) is another VGAM2185 host target gene. LOC221882 BINDING SITE is HOST TARGET binding site found in the 5' untranslated region of mRNA encoded by LOC221882, corresponding to a HOST TARGET binding site such as BINDING SITE I, BINDING SITE II or BINDING SITE III. Table 2 illustrates the complementarity of the nucleotide sequences of LOC221882 BINDING SITE, designated SEQ ID:44434, to the nucleotide sequence of VGAM2185 RNA, herein designated VGAM RNA, also designated SEQ ID:4896.

Another function of VGAM2185 is therefore inhibition of LOC221882 (Accession XM_166507). Accordingly, utilities of VGAM2185 include diagnosis, prevention and treatment of diseases and clinical conditions associated with LOC221882. FIG. 1 further provides a conceptual description of a novel bioinformatically detected viral gene of the present invention, referred to here as Viral Genomic Address Messenger 2186 (VGAM2186) viral gene, which modulates expression of respective host target genes thereof, the function and utility of which host target genes is known in the art.

VGAM2186 is a novel bioinformatically detected regulatory, non protein coding, viral micro RNA (miRNA) gene. The method by which VGAM2186 was detected is described hereinabove with reference to FIGS. 1-8.

VGAM2186 gene, herein designated VGAM GENE, is a viral gene contained in the genome of Monkeypox Virus. VGAM2186 host target gene, herein designated VGAM HOST TARGET GENE, is a human gene contained in the human genome.

VGAM2186 gene encodes a VGAM2186 precursor RNA, herein designated VGAM PRECURSOR RNA. Similar to other miRNA genes, and unlike most ordinary genes, VGAM2186 precursor RNA does not encode a protein. A nucleotide sequence identical or highly similar to the nucleotide sequence of VGAM2186 precursor RNA is designated SEQ ID:2172, and is provided hereinbelow with reference to the sequence listing part. Nucleotide sequence SEQ ID:2172 is located at position 184211 relative to the genome of Monkeypox Virus.

VGAM2186 precursor RNA folds onto itself, forming VGAM2186 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2186 folded precursor RNA into VGAM2186 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM2186 RNA is designated SEQ ID:4897, and is provided hereinbelow with reference to the sequence listing part.

VGAM2186 host target gene, herein designated VGAM HOST TARGET GENE, encodes a corresponding messenger RNA, VGAM2186 host target RNA, herein designated VGAM HOST TARGET RNA. VGAM2186 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2186 RNA, herein designated VGAM RNA, binds complementarily to one or more host target binding sites located in untranslated regions of VGAM2186 host target RNA, herein designated VGAM HOST TARGET RNA. This complementary binding is due to the fact that the nucleotide sequence of VGAM2186 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2186 RNA, herein designated VGAM RNA, may have a different number of host target binding sites in untranslated regions of a VGAM2186 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2186 RNA, herein designated VGAM RNA, to host target binding sites on VGAM2186 host target RNA, herein designated VGAM HOST TARGET RNA, such as BINDING SITE I, BINDING SITE II and BINDING SITE III, inhibits translation of VGAM2186 host target RNA into VGAM2186 host target protein, herein designated VGAM HOST TARGET PROTEIN. VGAM host target protein is therefore outlined by a broken line.

It is appreciated that VGAM2186 host target gene, herein designated VGAM HOST TARGET GENE, in fact represents a plurality of VGAM2186 host target genes. The mRNA of each one of this plurality of VGAM2186 host target genes comprises one or more host target binding sites, each having a nucleotide sequence which is at least partly complementary to VGAM2186 RNA, herein designated VGAM RNA, and which when bound by VGAM2186 RNA causes inhibition of translation of respective one or more VGAM2186 host target proteins.

It is further appreciated by one skilled in the art that the mode of translational inhibition illustrated by FIG. 1 with specific reference to translational inhibition exerted by VGAM2186 gene, herein designated VGAM GENE, on one or more VGAM2186 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2186 is inhibition of expression of host target genes, as part of a novel viral mechanism of attacking a host. Accordingly, utilities of VGAM2186 include diagnosis, prevention and treatment of viral infection by Monkeypox Virus. Specific functions, and accordingly utilities, of VGAM2186 correlate with, and may be deduced from, the identity of the host target genes which VGAM2186 binds and inhibits, and the function of these host target genes, as elaborated hereinbelow.

Nucleotide sequences of the VGAM2186 precursor RNA, herein designated VGAM PRECURSOR RNA, and of the 'diced' VGAM2186 RNA, herein designated VGAM RNA, and a schematic representation of the secondary folding of VGAM2186 folded precursor RNA, herein designated VGAM FOLDED PRECURSOR RNA, of VGAM2186 are further described hereinbelow with reference to Table 1.

Nucleotide sequences of host target binding sites, such as BINDING SITE-I, BINDING SITE-II and BINDING SITE-III of FIG. 1, found on VGAM2186 host target RNA, and schematic representation of the complementarity of each of these host target binding sites to VGAM2186 RNA, herein designated VGAM RNA, are described hereinbelow with reference to Table 2.

As mentioned hereinabove with reference to FIG. 1, a function of VGAM2186 gene, herein designated VGAM is inhibition of expression of VGAM2186 target genes. It is appreciated that specific functions, and accordingly utilities, of VGAM2186 correlate with, and may be deduced from, the identity of the target genes which VGAM2186 binds and inhibits, and the function of these target genes, as elaborated hereinbelow.

Glycoprotein M6A (GPM6A, Accession NM_005277) is a VGAM2186 host target gene. GPM6A BINDING SITE is HOST TARGET binding site found in the 3' untranslated region of mRNA encoded by GPM6A, corresponding to a HOST TARGET binding site such as BINDING SITE I, BINDING SITE II or BINDING SITE III. Table 2 illustrates the complementarity of the nucleotide sequences of GPM6A BINDING SITE, designated SEQ ID:11778, to the nucleotide sequence of VGAM2186 RNA, herein designated VGAM RNA, also designated SEQ ID:4897.

A function of VGAM2186 is therefore inhibition of Glycoprotein M6A (GPM6A, Accession NM_005277), a gene which may play a role in neuronal development. Accordingly, utilities of VGAM2186 include diagnosis, prevention and treatment of diseases and clinical conditions associated with GPM6A. The function of GPM6A and its association with various diseases and clinical conditions, has been established by previous studies, as described hereinabove with reference to VGAM326. Membrane-spanning 4-domains, Subfamily A, Member 1 (MS4A1, Accession NM_000139) is another VGAM2186 host target gene. MS4A1 BINDING SITE is HOST TARGET binding site found in the 3' untranslated region of mRNA encoded by MS4A1, corresponding to a HOST TARGET binding site such as BINDING SITE I, BINDING SITE II or BINDING SITE III. Table 2 illustrates the complementarity of the nucleotide sequences of MS4A1 BINDING SITE, designated SEQ ID:5633, to the nucleotide sequence of VGAM2186 RNA, herein designated VGAM RNA, also designated SEQ ID:4897.

Another function of VGAM2186 is therefore inhibition of Membrane-spanning 4-domains, Subfamily A, Member 1 (MS4A1, Accession NM_000139), a gene which may be involved in the regulation of b-cell activation and proliferation. Accordingly, utilities of VGAM2186 include diagnosis, prevention and treatment of diseases and clinical conditions associated with MS4A1. The function of MS4A1 and its association with various diseases and clinical conditions, has been established by previous studies, as described hereinabove with reference to VGAM362. Nuclear Receptor Subfamily 3, Group C, Member 1 (glucocorticoid receptor) (NR3C1, Accession NM_000176) is another VGAM2186 host target gene. NR3C1 BINDING SITE is HOST TARGET binding site found in the 3' untranslated region of mRNA encoded by NR3C1, corresponding to a HOST TARGET binding site such as BINDING SITE I, BINDING SITE II or BINDING SITE III. Table 2 illustrates the complementarity of the nucleotide sequences of NR3C1 BINDING SITE, designated SEQ ID:5684, to the nucleotide sequence of VGAM2186 RNA, herein designated VGAM RNA, also designated SEQ ID:4897.

Another function of VGAM2186 is therefore inhibition of Nuclear Receptor Subfamily 3, Group C, Member 1 (glucocorticoid receptor) (NR3C1, Accession NM_000176). Accordingly, utilities of VGAM2186 include diagnosis, prevention and treatment of diseases and clinical conditions associated with NR3C1. Smcx Homolog, X Chromosome (mouse) (SMCX, Accession NM_004187) is another VGAM2186 host target gene. SMCX BINDING SITE is HOST TARGET binding site found in the 3' untranslated region of mRNA encoded by SMCX, corresponding to a HOST TARGET binding site such as BINDING SITE I, BINDING SITE II or BINDING SITE III. Table 2 illustrates the complementarity of the nucleotide sequences of SMCX BINDING SITE, designated SEQ ID:10396, to the nucleotide sequence of VGAM2186 RNA, herein designated VGAM RNA, also designated SEQ ID:4897.

Another function of VGAM2186 is therefore inhibition of Smcx Homolog, X Chromosome (mouse) (SMCX, Accession NM_004187), a gene which escapes X inactivation. Accordingly, utilities of VGAM2186 include diagnosis, prevention and treatment of diseases and clinical conditions associated with SMCX. The function of SMCX and its association with various diseases and clinical conditions, has been established by previous studies, as described hereinabove with reference to VGAM60. Calcyphosphine 2 (CAPS2, Accession XM_047354) is another VGAM2186 host target gene. CAPS2 BINDING SITE is HOST TARGET binding site found in the 3' untranslated region of mRNA encoded by CAPS2, corresponding to a HOST TARGET binding site such as BINDING SITE I, BINDING SITE II or BINDING SITE III. Table 2 illustrates the complementarity of the nucleotide sequences of CAPS2 BINDING SITE, designated SEQ ID:34954, to the nucleotide sequence of VGAM2186 RNA, herein designated VGAM RNA, also designated SEQ ID:4897.

Another function of VGAM2186 is therefore inhibition of Calcyphosphine 2 (CAPS2, Accession XM_047354). Accordingly, utilities of VGAM2186 include diagnosis, prevention and treatment of diseases and clinical conditions associated with CAPS2. DKFZP434I092 (Accession XM_042042) is another VGAM2186 host target gene. DKFZP434I092 BINDING SITE is HOST TARGET binding site found in the 3' untranslated region of mRNA encoded by DKFZP434I092, corresponding to a HOST TARGET binding site such as BINDING SITE I, BINDING SITE II or BINDING SITE III. Table 2 illustrates the complementarity of the nucleotide sequences of DKFZP434I092 BINDING SITE, designated SEQ ID:33672, to the nucleotide sequence of VGAM2186 RNA, herein designated VGAM RNA, also designated SEQ ID:4897.

Another function of VGAM2186 is therefore inhibition of DKFZP434I092 (Accession XM_042042). Accordingly, utilities of VGAM2186 include diagnosis, prevention and treatment of diseases and clinical conditions associated with DKFZP434I092. ICK (Accession NM_014920) is another VGAM2186 host target gene. ICK BINDING SITE is HOST TARGET binding site found in the 3' untranslated region of mRNA encoded by ICK, corresponding to a HOST TARGET binding site such as BINDING SITE I, BINDING SITE II or BINDING SITE III. Table 2 illustrates the complementarity of the nucleotide sequences of ICK BINDING SITE, designated SEQ ID:17192, to the nucleotide sequence of VGAM2186 RNA, herein designated VGAM RNA, also designated SEQ ID:4897.

Another function of VGAM2186 is therefore inhibition of ICK (Accession NM_014920). Accordingly, utilities of VGAM2186 include diagnosis, prevention and treatment of diseases and clinical conditions associated with ICK. KIAA0746 (Accession XM_045277) is another VGAM2186 host target gene. KIAA0746 BINDING SITE is HOST TARGET binding site found in the 5" untranslated region of mRNA encoded by KIAA0746, corresponding to a HOST TARGET binding site such as BINDING SITE I, BINDING SITE II or BINDING SITE III. Table 2 illustrates the complementarity of the nucleotide sequences of KIAA0746 BINDING SITE, designated SEQ ID:34417, to the nucleotide sequence of VGAM2186 RNA, herein designated VGAM RNA, also designated SEQ ID:4897.

Another function of VGAM2186 is therefore inhibition of KIAA0746 (Accession XM_045277). Accordingly, utilities of VGAM2186 include diagnosis, prevention and treatment of diseases and clinical conditions associated with KIAA0746. Monocyte to Macrophage Differentiation-associated (MMD, Accession XM_008269) is another VGAM2186 host target gene. MMD BINDING SITE is HOST TARGET binding site found in the 3' untranslated region of mRNA encoded by MMD, corresponding to a HOST TARGET binding site such as BINDING SITE I, BINDING SITE II or BINDING SITE III. Table 2 illustrates the complementarity of the nucleotide sequences of MMD BINDING SITE, designated SEQ ID:30075, to the nucleotide sequence of VGAM2186 RNA, herein designated VGAM RNA, also designated SEQ ID:4897.

Another function of VGAM2186 is therefore inhibition of Monocyte to Macrophage Differentiation-associated (MMD, Accession XM_008269). Accordingly, utilities of VGAM2186 include diagnosis, prevention and treatment of diseases and clinical conditions associated with MMD. VIT1 (Accession NM_018693) is another VGAM2186 host target gene. VIT1 BINDING SITE is HOST TARGET binding site found in the 5' untranslated region of mRNA encoded by VIT1, corresponding to a HOST TARGET binding site such as BINDING SITE I, BINDING SITE II or BINDING SITE III. Table 2 illustrates the complementarity of the nucleotide sequences of VIT1 BINDING SITE, designated SEQ ID:20767, to the nucleotide sequence of VGAM2186 RNA, herein designated VGAM RNA, also designated SEQ ID:4897.

Another function of VGAM2186 is therefore inhibition of VIT1 (Accession NM_018693). Accordingly, utilities of VGAM2186 include diagnosis, prevention and treatment of diseases and clinical conditions associated with VIT1. LOC150311 (Accession XM_086858) is another VGAM2186 host target gene. LOC150311 BINDING SITE is HOST TARGET binding site found in the 5' untranslated region of mRNA encoded by LOC150311, corresponding to a HOST TARGET binding site such as BINDING SITE I, BINDING SITE II or BINDING SITE III. Table 2 illustrates the complementarity of the nucleotide sequences of LOC150311 BINDING SITE, designated SEQ ID:38925, to the nucleotide sequence of VGAM2186 RNA, herein designated VGAM RNA, also designated SEQ ID:4897.

Another function of VGAM2186 is therefore inhibition of LOC150311 (Accession XM_086858). Accordingly, utilities of VGAM2186 include diagnosis, prevention and treatment of diseases and clinical conditions associated with LOC150311. FIG. 1 further provides a conceptual description of a novel bioinformatically detected viral gene of the present invention, referred to here as Viral Genomic Address Messenger 2187 (VGAM2187) viral gene, which modulates expression of respective host target genes thereof, the function and utility of which host target genes is known in the art.

VGAM2187 is a novel bioinformatically detected regulatory, non protein coding, viral micro RNA (miRNA) gene. The method by which VGAM2187 was detected is described hereinabove with reference to FIGS. 1-8.

VGAM2187 gene, herein designated VGAM GENE, is a viral gene contained in the genome of Monkeypox Virus. VGAM2187 host target gene, herein designated VGAM HOST TARGET GENE, is a human gene contained in the human genome.

VGAM2187 gene encodes a VGAM2187 precursor RNA, herein designated VGAM PRECURSOR RNA. Similar to other miRNA genes, and unlike most ordinary genes, VGAM2187 precursor RNA does not encode a protein. A nucleotide sequence identical or highly similar to the nucleotide sequence of VGAM2187 precursor RNA is designated SEQ ID:2173, and is provided hereinbelow with reference to the sequence listing part. Nucleotide sequence SEQ ID:2173 is located at position 186422 relative to the genome of Monkeypox Virus.

VGAM2187 precursor RNA folds onto itself, forming VGAM2187 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2187 folded precursor RNA into VGAM2187 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2187 RNA is designated SEQ ID:4898, and is provided hereinbelow with reference to the sequence listing part.

VGAM2187 host target gene, herein designated VGAM HOST TARGET GENE, encodes a corresponding messenger RNA, VGAM2187 host target RNA, herein designated VGAM HOST TARGET RNA. VGAM2187 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2187 RNA, herein designated VGAM RNA, binds complementarily to one or more host target binding sites located in untranslated regions of VGAM2187 host target RNA, herein designated VGAM HOST TARGET RNA. This complementary binding is due to the fact that the nucleotide sequence of VGAM2187 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2187 RNA, herein designated VGAM RNA, may have a different number of host target binding sites in untranslated regions of a VGAM2187 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2187 RNA, herein designated VGAM RNA, to host target binding sites on VGAM2187 host target RNA, herein designated VGAM HOST TARGET RNA, such as BINDING SITE I, BINDING SITE II and BINDING SITE III, inhibits translation of VGAM2187 host target RNA into VGAM2187 host target protein, herein designated VGAM HOST TARGET PROTEIN. VGAM host target protein is therefore outlined by a broken line.

It is appreciated that VGAM2187 host target gene, herein designated VGAM HOST TARGET GENE, in fact represents a plurality of VGAM2187 host target genes. The mRNA of each one of this plurality of VGAM2187 host target genes comprises one or more host target binding sites, each having a nucleotide sequence which is at least partly complementary to VGAM2187 RNA, herein designated VGAM RNA, and which when bound by VGAM2187 RNA causes inhibition of translation of respective one or more VGAM2187 host target proteins.

It is further appreciated by one skilled in the art that the mode of translational inhibition illustrated by FIG. 1 with specific reference to translational inhibition exerted by VGAM2187 gene, herein designated VGAM GENE, on one or more VGAM2187 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2187 is inhibition of expression of host target genes, as part of a novel viral mechanism of attacking a host. Accordingly, utilities of VGAM2187 include diagnosis, prevention and treatment of viral infection by Monkeypox Virus. Specific functions, and accordingly utilities, of VGAM2187 correlate with, and may be deduced from, the identity of the host target genes which VGAM2187 binds and inhibits, and the function of these target genes, as elaborated hereinbelow.

Nucleotide sequences of the VGAM2187 precursor RNA, herein designated VGAM PRECURSOR RNA, and of the 'diced' VGAM2187 RNA, herein designated VGAM RNA, and a schematic representation of the secondary folding of VGAM2187 folded precursor RNA, herein designated VGAM FOLDED PRECURSOR RNA, of VGAM2187 are further described hereinbelow with reference to Table 1.

Nucleotide sequences of host target binding sites, such as BINDING SITE-I, BINDING SITE-II and BINDING SITE-III of FIG. 1, found on VGAM2187 host target RNA, and schematic representation of the complementarity of each of these host target binding sites to VGAM2187 RNA, herein designated VGAM RNA, are described hereinbelow with reference to Table 2.

As mentioned hereinabove with reference to FIG. 1, a function of VGAM2187 gene, herein designated VGAM is inhibition of expression of VGAM2187 target genes. It is appreciated that specific functions, and accordingly utilities, of VGAM2187 correlate with, and may be deduced from, the identity of the target genes which VGAM2187 binds and inhibits, and the function of these target genes, as elaborated hereinbelow.

Gap Junction Protein, Alpha 1, 43 kDa (connexin 43) (GJA1, Accession NM_000165) is a VGAM2187 host target gene. GJA1 BINDING SITE is HOST TARGET binding site found in the 3' untranslated region of mRNA encoded by GJA1, corresponding to a HOST TARGET binding site such as BINDING SITE I, BINDING SITE II or BINDING SITE III. Table 2 illustrates the complementarity of the nucleotide sequences of GJA1 BINDING SITE, designated SEQ ID:5677, to the nucleotide sequence of VGAM2187 RNA, herein designated VGAM RNA, also designated SEQ ID:4898.

A function of VGAM2187 is therefore inhibition of Gap Junction Protein, Alpha 1, 43 kDa (connexin 43) (GJA1, Accession NM_000165), a gene which may act in synchronizing heart contraction and embryonic development. Accordingly, utilities of VGAM2187 include diagnosis, prevention and treatment of diseases and clinical conditions associated with GJA1. The function of GJA1 and its association with various diseases and clinical conditions, has been established by previous studies, as described hereinabove with reference to VGAM341. Protocadherin 11 X-linked (PCDH11X, Accession NM_032968) is another VGAM2187 host target gene. PCDH11X BINDING SITE1 and PCDH11X BINDING SITE2 are HOST TARGET binding sites found in untranslated regions of mRNA encoded by PCDH11X, corresponding to HOST TARGET binding sites such as BINDING SITE I, BINDING SITE II or BINDING SITE III. Table 2 illustrates the complementarity of the nucleotide sequences of PCDH11X BINDING SITE1 and PCDH11X BINDING SITE2, designated SEQ ID:26783 and SEQ ID:26798 respectively, to the nucleotide sequence of VGAM2187 RNA, herein designated VGAM RNA, also designated SEQ ID:4898.

Another function of VGAM2187 is therefore inhibition of Protocadherin 11 X-linked (PCDH11X, Accession NM_032968), a gene which is thought to play a fundamental role in cell-cell recognition essential for the segmental development and function of the central nervous system. Accordingly, utilities of VGAM2187 include diagnosis, prevention and treatment of diseases and clinical conditions associated with PCDH11X. The function of PCDH11X and its association with various diseases and clinical conditions, has been established by previous studies, as described hereinabove with reference to VGAM433. FLJ20184 (Accession NM_017700) is another VGAM2187 host target gene. FLJ20184 BINDING SITE is HOST TARGET binding site found in the 3' untranslated region of mRNA encoded by FLJ20184, corresponding to a HOST TARGET binding site such as BINDING SITE I, BINDING SITE II or BINDING SITE III. Table 2 illustrates the complementarity of the nucleotide sequences of FLJ20184 BINDING SITE, designated SEQ ID:19273, to the nucleotide sequence of VGAM2187 RNA, herein designated VGAM RNA, also designated SEQ ID:4898.

Another function of VGAM2187 is therefore inhibition of FLJ20184 (Accession NM_017700). Accordingly, utilities of VGAM2187 include diagnosis, prevention and treatment of diseases and clinical conditions associated with FLJ20184. Syntaxin 3A (STX3A, Accession NM_004177) is another VGAM2187 host target gene. STX3A BINDING SITE is HOST TARGET binding site found in the 3' untranslated region of mRNA encoded by STX3A, corresponding to a HOST TARGET binding site such as BINDING SITE I, BINDING SITE II or BINDING SITE III. Table 2 illustrates the complementarity of the nucleotide sequences of STX3A BINDING SITE, designated SEQ ID:10386, to the nucleotide sequence of VGAM2187 RNA, herein designated VGAM RNA, also designated SEQ ID:4898.

Another function of VGAM2187 is therefore inhibition of Syntaxin 3A (STX3A, Accession NM_004177). Accordingly, utilities of VGAM2187 include diagnosis, prevention and treatment of diseases and clinical conditions associated with STX3A. Zinc Finger Protein 313 (ZNF313, Accession NM_018683) is another VGAM2187 host target gene. ZNF313 BINDING SITE is HOST TARGET binding site found in the 3' untranslated region of mRNA encoded by ZNF313, corresponding to a HOST TARGET binding site such as BINDING SITE I, BINDING SITE II or BINDING SITE III. Table 2 illustrates the complementarity of the nucleotide sequences of ZNF313 BINDING SITE, designated SEQ ID:20754, to the nucleotide sequence of VGAM2187 RNA, herein designated VGAM RNA, also designated SEQ ID:4898.

Another function of VGAM2187 is therefore inhibition of Zinc Finger Protein 313 (ZNF313, Accession NM_018683). Accordingly, utilities of VGAM2187 include diagnosis, prevention and treatment of diseases and clinical conditions associated with ZNF313. LOC130026 (Accession NM_138468) is another VGAM2187 host target gene. LOC130026 BINDING SITE is HOST TARGET binding site found in the 3' untranslated region of mRNA encoded by LOC130026, corresponding to a HOST TARGET binding site such as BINDING SITE I, BINDING SITE II or BINDING SITE III. Table 2 illustrates the complementarity of the nucleotide sequences of LOC130026 BINDING SITE, designated SEQ ID:28819, to the nucleotide sequence of VGAM2187 RNA, herein designated VGAM RNA, also designated SEQ ID:4898.

Another function of VGAM2187 is therefore inhibition of LOC130026 (Accession NM_138468). Accordingly, utilities of VGAM2187 include diagnosis, prevention and treatment of diseases and clinical conditions associated with LOC130026. LOC144438 (Accession XM_084860) is another VGAM2187 host target gene. LOC144438 BINDING SITE is HOST TARGET binding site found in the 3' untranslated region of mRNA encoded by LOC144438, corresponding to a HOST TARGET binding site such as BINDING SITE I, BINDING SITE II or BINDING SITE III. Table 2 illustrates the complementarity of the nucleotide sequences of LOC144438 BINDING SITE, designated SEQ ID:37737, to the nucleotide sequence of VGAM2187 RNA, herein designated VGAM RNA, also designated SEQ ID:4898.

Another function of VGAM2187 is therefore inhibition of LOC144438 (Accession XM_084860). Accordingly, utilities of VGAM2187 include diagnosis, prevention and treatment of diseases and clinical conditions associated with LOC144438. LOC149722 (Accession XM_097709) is another VGAM2187 host target gene. LOC149722 BINDING SITE is HOST TARGET binding site found in the 5' untranslated region of mRNA encoded by LOC149722, corresponding to a HOST TARGET binding site such as BINDING SITE I, BINDING SITE II or BINDING SITE III. Table 2 illustrates the complementarity of the nucleotide sequences of LOC149722 BINDING SITE, designated SEQ ID:41042, to the nucleotide sequence of VGAM2187 RNA, herein designated VGAM RNA, also designated SEQ ID:4898.

Another function of VGAM2187 is therefore inhibition of LOC149722 (Accession XM_097709). Accordingly, utilities of VGAM2187 include diagnosis, prevention and treatment of diseases and clinical conditions associated with LOC149722. LOC220988 (Accession XM_165561) is another VGAM2187 host target gene. LOC220988 BINDING SITE is HOST TARGET binding site found in the 3' untranslated region of mRNA encoded by LOC220988, corresponding to a HOST TARGET binding site such as BINDING SITE I, BINDING SITE II or BINDING SITE III. Table 2 illustrates the complementarity of the nucleotide sequences of LOC220988 BINDING SITE, designated SEQ ID:43681, to the nucleotide sequence of VGAM2187 RNA, herein designated VGAM RNA, also designated SEQ ID:4898.

Another function of VGAM2187 is therefore inhibition of LOC220988 (Accession XM_165561). Accordingly, utilities of VGAM2187 include diagnosis, prevention and treatment of diseases and clinical conditions associated with LOC220988. FIG. 1 further provides a conceptual description of a novel bioinformatically detected viral gene of the present invention, referred to here as Viral Genomic Address Messenger 2188 (VGAM2188) viral gene, which modulates expression of respective host target genes thereof, the function and utility of which host target genes is known in the art.

VGAM2188 is a novel bioinformatically detected regulatory, non protein coding, viral micro RNA (miRNA) gene. The method by which VGAM2188 was detected is described hereinabove with reference to FIGS. 1-8.

VGAM2188 gene, herein designated VGAM GENE, is a viral gene contained in the genome of Monkeypox Virus. VGAM2188 host target gene, herein designated VGAM HOST TARGET GENE, is a human gene contained in the human genome.

VGAM2188 gene encodes a VGAM2188 precursor RNA, herein designated VGAM PRECURSOR RNA. Similar to other miRNA genes, and unlike most ordinary genes, VGAM2188 precursor RNA does not encode a protein. A nucleotide sequence identical or highly similar to the nucleotide sequence of VGAM2188 precursor RNA is designated SEQ ID:2174, and is provided hereinbelow with reference to the sequence listing part. Nucleotide sequence SEQ ID:2174 is located at position 185906 relative to the genome of Monkeypox Virus.

VGAM2188 precursor RNA folds onto itself, forming VGAM2188 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2188 folded precursor RNA into VGAM2188 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2188 RNA is designated SEQ ID:4899, and is provided hereinbelow with reference to the sequence listing part.

VGAM2188 host target gene, herein designated VGAM HOST TARGET GENE, encodes a corresponding messenger RNA, VGAM2188 host target RNA, herein designated VGAM HOST TARGET RNA. VGAM2188 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2188 RNA, herein designated VGAM RNA, binds complementarily to one or more host target binding sites located in untranslated regions of VGAM2188 host target RNA, herein designated VGAM HOST TARGET RNA. This complementary binding is due to the fact that the nucleotide sequence of VGAM2188 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2188 RNA, herein designated VGAM RNA, may have a different number of host target binding sites in untranslated regions of a VGAM2188 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2188 RNA, herein designated VGAM RNA, to host target binding sites on VGAM2188 host target RNA, herein designated VGAM HOST TARGET RNA, such as BINDING SITE I, BINDING SITE II and BINDING SITE III, inhibits translation of VGAM2188 host target RNA into VGAM2188 host target protein, herein designated VGAM HOST TARGET PROTEIN. VGAM host target protein is therefore outlined by a broken line.

It is appreciated that VGAM2188 host target gene, herein designated VGAM HOST TARGET GENE, in fact represents a plurality of VGAM2188 host target genes. The mRNA of each one of this plurality of VGAM2188 host target genes comprises one or more host target binding sites, each having a nucleotide sequence which is at least partly complementary to VGAM2188 RNA, herein designated VGAM RNA, and which when bound by VGAM2188 RNA causes inhibition of translation of respective one or more VGAM2188 host target proteins.

It is further appreciated by one skilled in the art that the mode of translational inhibition illustrated by FIG. 1 with specific reference to translational inhibition exerted by VGAM2188 gene, herein designated VGAM GENE, on one or more VGAM2188 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2188 is inhibition of expression of host target genes, as part of a novel viral mechanism of attacking a host. Accordingly, utilities of VGAM2188 include diagnosis, prevention and treatment of viral infection by Monkeypox Virus. Specific functions, and accordingly utilities, of VGAM2188 correlate with, and may be deduced from, the identity of the host target genes which VGAM2188 binds and inhibits, and the function of these host target genes, as elaborated hereinbelow.

Nucleotide sequences of the VGAM2188 precursor RNA, herein designated VGAM PRECURSOR RNA, and of the 'diced' VGAM2188 RNA, herein designated VGAM RNA, and a schematic representation of the secondary folding of VGAM2188 folded precursor RNA, herein designated VGAM FOLDED PRECURSOR RNA, of VGAM2188 are further described hereinbelow with reference to Table 1.

Nucleotide sequences of host target binding sites, such as BINDING SITE-I, BINDING SITE-II and BINDING SITE-III of FIG. 1, found on VGAM2188 host target RNA, and schematic representation of the complementarity of each of these host target binding sites to VGAM2188 RNA, herein designated VGAM RNA, are described hereinbelow with reference to Table 2.

As mentioned hereinabove with reference to FIG. 1, a function of VGAM2188 gene, herein designated VGAM is inhibition of expression of VGAM2188 target genes. It is appreciated that specific functions, and accordingly utilities, of VGAM2188 correlate with, and may be deduced from, the identity of the target genes which VGAM2188 binds and inhibits, and the function of these target genes, as elaborated hereinbelow.

Calcitonin Receptor-like (CALCRL, Accession NM_005795) is a VGAM2188 host target gene. CALCRL BINDING SITE is HOST TARGET binding site found in the 3' untranslated region of mRNA encoded by CALCRL, corresponding to a HOST TARGET binding site such as BINDING SITE I, BINDING SITE II or BINDING SITE III. Table 2 illustrates the complementarity of the nucleotide sequences of CALCRL BINDING SITE, designated SEQ ID:12377, to the nucleotide sequence of VGAM2188 RNA, herein designated VGAM RNA, also designated SEQ ID:4899.

A function of VGAM2188 is therefore inhibition of Calcitonin Receptor-like (CALCRL, Accession NM_005795), a gene which is a receptor for calcitonin gene-related peptide type 1. Accordingly, utilities of VGAM2188 include diagnosis, prevention and treatment of diseases and clinical conditions associated with CALCRL. The function of CALCRL and its association with various diseases and clinical conditions, has been established by previous studies, as described hereinabove with reference to VGAM995. Desmocollin 1 (DSC1, Accession NM_004948) is another VGAM2188 host target gene. DSC1 BINDING SITE1 and DSC1 BINDING SITE2 are HOST TARGET binding sites found in untranslated regions of mRNA encoded by DSC1, corresponding to HOST TARGET binding sites such as BINDING SITE I, BINDING SITE II or BINDING SITE III. Table 2 illustrates the complementarity of the nucleotide sequences of DSC1 BINDING SITE1 and DSC1 BINDING SITE2, designated SEQ ID:11389 and SEQ ID:23659 respectively, to the nucleotide sequence of VGAM2188 RNA, herein designated VGAM RNA, also designated SEQ ID:4899.

Another function of VGAM2188 is therefore inhibition of Desmocollin 1 (DSC1, Accession NM_004948), a gene which is a component of intercellular desmosome junctions. Accordingly, utilities of VGAM2188 include diagnosis, prevention and treatment of diseases and clinical conditions associated with DSC1. The function of DSC1 and its association with various diseases and clinical conditions, has been established by previous studies, as described hereinabove with reference to VGAM1502. Runt-related Transcription Factor 3 (RUNX3, Accession NM_004350) is another VGAM2188 host target gene. RUNX3 BINDING SITE is HOST TARGET binding site found in the 3' untranslated region of mRNA encoded by RUNX3, corresponding to a HOST TARGET binding site such as BINDING SITE I, BINDING SITE II or BINDING SITE III. Table 2 illustrates the complementarity of the nucleotide sequences of RUNX3 BINDING SITE, designated SEQ ID:10551, to the nucleotide sequence of VGAM2188 RNA, herein designated VGAM RNA, also designated SEQ ID:4899.

Another function of VGAM2188 is therefore inhibition of Runt-related Transcription Factor 3 (RUNX3, Accession NM_004350), a gene which binds to the core site, 5'-pyg-pyggt-3', of a number of enhancers and promoters. Accordingly, utilities of VGAM2188 include diagnosis, prevention and treatment of diseases and clinical conditions associated with RUNX3. The function of RUNX3 and its association with various diseases and clinical conditions, has been established by previous studies, as described hereinabove with reference to VGAM1151. KIAA0731 (Accession XM_039975) is another VGAM2188 host target gene. KIAA0731 BINDING SITE is HOST TARGET binding site found in the 5' untranslated region of mRNA encoded by KIAA0731, corresponding to a HOST TARGET binding site such as BINDING SITE I, BINDING SITE II or BINDING SITE III. Table 2 illustrates the complementarity of the nucleotide sequences of KIAA0731 BINDING SITE, designated SEQ ID:33242, to the nucleotide sequence of VGAM2188 RNA, herein designated VGAM RNA, also designated SEQ ID:4899.

Another function of VGAM2188 is therefore inhibition of KIAA0731 (Accession XM_039975). Accordingly, utilities of VGAM2188 include diagnosis, prevention and treatment of diseases and clinical conditions associated with KIAA0731. Kruppel-like Factor 5 (intestinal) (KLF5, Accession NM_001730) is another VGAM2188 host target gene. KLF5 BINDING SITE is HOST TARGET binding site found in the 3' untranslated region of mRNA encoded by KLF5, corresponding to a HOST TARGET binding site such as BINDING SITE I, BINDING SITE II or BINDING SITE III. Table 2 illustrates the complementarity of the nucleotide sequences of KLF5 BINDING SITE, designated SEQ ID:7459, to the nucleotide sequence of VGAM2188 RNA, herein designated VGAM RNA, also designated SEQ ID:4899.

Another function of VGAM2188 is therefore inhibition of Kruppel-like Factor 5 (intestinal) (KLF5, Accession NM_001730). Accordingly, utilities of VGAM2188 include diagnosis, prevention and treatment of diseases and clinical conditions associated with KLF5. LOC149773 (Accession XM_086628) is another VGAM2188 host target gene. LOC149773 BINDING SITE is HOST TARGET binding site found in the 5' untranslated region of mRNA encoded by LOC149773, corresponding to a HOST TARGET binding site such as BINDING SITE I, BINDING SITE II or BINDING SITE III. Table 2 illustrates the complementarity of the nucleotide sequences of LOC149773 BINDING SITE, designated SEQ ID:38799, to the nucleotide sequence of VGAM2188 RNA, herein designated VGAM RNA, also designated SEQ ID:4899.

Another function of VGAM2188 is therefore inhibition of LOC149773 (Accession XM_086628). Accordingly, utilities of VGAM2188 include diagnosis, prevention and treatment of diseases and clinical conditions associated with LOC149773. LOC153387 (Accession XM_098369) is another VGAM2188 host target gene. LOC153387 BINDING SITE is HOST TARGET binding site found in the 5' untranslated region of mRNA encoded by LOC153387, corresponding to a HOST TARGET binding site such as BINDING SITE I, BINDING SITE II or BINDING SITE III. Table 2 illustrates the complementarity of the nucleotide sequences of LOC153387 BINDING SITE, designated SEQ ID:41634, to the nucleotide sequence of VGAM2188 RNA, herein designated VGAM RNA, also designated SEQ ID:4899.

Another function of VGAM2188 is therefore inhibition of LOC153387 (Accession XM_098369). Accordingly, utilities of VGAM2188 include diagnosis, prevention and treatment of diseases and clinical conditions associated with LOC153387. LOC51157 (Accession NM_016202) is another VGAM2188 host target gene. LOC51157 BINDING SITE is HOST TARGET binding site found in the 5' untranslated region of mRNA encoded by LOC51157, corresponding to a HOST TARGET binding site such as BINDING SITE I, BINDING SITE II or BINDING SITE III. Table 2 illustrates the complementarity of the nucleotide sequences of LOC51157 BINDING SITE, designated SEQ ID:18296, to the nucleotide sequence of VGAM2188 RNA, herein designated VGAM RNA, also designated SEQ ID:4899.

Another function of VGAM2188 is therefore inhibition of LOC51157 (Accession NM_016202). Accordingly, utilities of VGAM2188 include diagnosis, prevention and treatment of diseases and clinical conditions associated with LOC51157. FIG. 1 further provides a conceptual description of a novel bioinformatically detected viral gene of the present invention, referred to here as Viral Genomic Address Messenger 2189 (VGAM2189) viral gene, which modulates expression of respective host target genes thereof, the function and utility of which host target genes is known in the art.

VGAM2189 is a novel bioinformatically detected regulatory, non protein coding, viral micro RNA (miRNA) gene. The method by which VGAM2189 was detected is described hereinabove with reference to FIGS. 1-8.

VGAM2189 gene, herein designated VGAM GENE, is a viral gene contained in the genome of Monkeypox Virus. VGAM2189 host target gene, herein designated VGAM HOST TARGET GENE, is a human gene contained in the human genome.

VGAM2189 gene encodes a VGAM2189 precursor RNA, herein designated VGAM PRECURSOR RNA. Similar to other miRNA genes, and unlike most ordinary genes, VGAM2189 precursor RNA does not encode a protein. A nucleotide sequence identical or highly similar to the nucleotide sequence of VGAM2189 precursor RNA is designated SEQ ID:2175, and is provided hereinbelow with reference to the sequence listing part. Nucleotide sequence SEQ ID:2175 is located at position 189835 relative to the genome of Monkeypox Virus.

VGAM2189 precursor RNA folds onto itself, forming VGAM2189 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2189 folded precursor RNA into VGAM2189 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2189 RNA is designated SEQ ID:4900, and is provided hereinbelow with reference to the sequence listing part.

VGAM2189 host target gene, herein designated VGAM HOST TARGET GENE, encodes a corresponding messenger RNA, VGAM2189 host target RNA, herein designated VGAM HOST TARGET RNA. VGAM2189 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2189 RNA, herein designated VGAM RNA, binds complementarily to one or more host target binding sites located in untranslated regions of VGAM2189 host target RNA, herein designated VGAM HOST TARGET RNA. This complementary binding is due to the fact that the nucleotide sequence of VGAM2189 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2189 RNA, herein designated VGAM RNA, may have a different number of host target binding sites in untranslated regions of a VGAM2189 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2189 RNA, herein designated VGAM RNA, to host target binding sites on VGAM2189 host target RNA, herein designated VGAM HOST TARGET RNA, such as BINDING SITE I, BINDING SITE II and BINDING SITE III, inhibits translation of VGAM2189 host target RNA into VGAM2189 host target protein, herein designated VGAM HOST TARGET PROTEIN. VGAM host target protein is therefore outlined by a broken line.

It is appreciated that VGAM2189 host target gene, herein designated VGAM HOST TARGET GENE, in fact represents a plurality of VGAM2189 host target genes. The mRNA of each one of this plurality of VGAM2189 host target genes comprises one or more host target binding sites, each having a nucleotide sequence which is at least partly complementary to VGAM2189 RNA, herein designated VGAM RNA, and which when bound by VGAM2189 RNA causes inhibition of translation of respective one or more VGAM2189 host target proteins.

It is further appreciated by one skilled in the art that the mode of translational inhibition illustrated by FIG. 1 with specific reference to translational inhibition exerted by VGAM2189 gene, herein designated VGAM GENE, on one or more VGAM2189 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2189 is inhibition of expression of host target genes, as part of a novel viral mechanism of attacking a host. Accordingly, utilities of VGAM2189 include diagnosis, prevention and treatment of viral infection by Monkeypox Virus. Specific functions, and accordingly utilities, of VGAM2189 correlate with, and may be deduced from, the identity of the host target genes which VGAM2189 binds and inhibits, and the function of these host target genes, as elaborated hereinbelow.

Nucleotide sequences of the VGAM2189 precursor RNA, herein designated VGAM PRECURSOR RNA, and of the 'diced' VGAM2189 RNA, herein designated VGAM RNA, and a schematic representation of the secondary folding of VGAM2189 folded precursor RNA, herein designated VGAM FOLDED PRECURSOR RNA, of VGAM2189 are further described hereinbelow with reference to Table 1.

Nucleotide sequences of host target binding sites, such as BINDING SITE-I, BINDING SITE-II and BINDING SITE-III of FIG. 1, found on VGAM2189 host target RNA, and schematic representation of the complementarity of each of these host target binding sites to VGAM2189 RNA, herein designated VGAM RNA, are described hereinbelow with reference to Table 2.

As mentioned hereinabove with reference to FIG. 1, a function of VGAM2189 gene, herein designated VGAM is inhibition of expression of VGAM2189 target genes. It is appreciated that specific functions, and accordingly utilities, of VGAM2189 correlate with, and may be deduced from, the identity of the target genes which VGAM2189 binds and inhibits, and the function of these target genes, as elaborated hereinbelow.

Coagulation Factor III (thromboplastin, tissue factor) (F3, Accession XM_040465) is a VGAM2189 host target gene. F3 BINDING SITE is HOST TARGET binding site found in the 3' untranslated region of mRNA encoded by F3, corresponding to a HOST TARGET binding site such as BINDING SITE I, BINDING SITE II or BINDING SITE III. Table 2 illustrates the complementarity of the nucleotide sequences of F3 BINDING SITE, designated SEQ ID:33298, to the nucleotide sequence of VGAM2189 RNA, herein designated VGAM RNA, also designated SEQ ID:4900.

A function of VGAM2189 is therefore inhibition of Coagulation Factor III (thromboplastin, tissue factor) (F3, Accession XM_040465), a gene which functions in normal hemostasis. Accordingly, utilities of VGAM2189 include diagnosis, prevention and treatment of diseases and clinical conditions associated with F3. The function of F3 and its association with various diseases and clinical conditions, has been established by previous studies, as described hereinabove with reference to VGAM817. Chromosome 1 Open Reading Frame 24 (C1orf24, Accession NM_052966) is another VGAM2189 host target gene. C1orf24 BINDING SITE is HOST TARGET binding site found in the 3' untranslated region of mRNA encoded by C1orf24, corresponding to a HOST TARGET binding site such as BINDING SITE I, BINDING SITE II or BINDING SITE III. Table 2 illustrates the complementarity of the nucleotide sequences of C1orf24 BINDING SITE, designated SEQ ID:27528, to the nucleotide sequence of VGAM2189 RNA, herein designated VGAM RNA, also designated SEQ ID:4900.

Another function of VGAM2189 is therefore inhibition of Chromosome 1 Open Reading Frame 24 (C1orf24, Accession NM_052966). Accordingly, utilities of VGAM2189 include diagnosis, prevention and treatment of diseases and clinical conditions associated with C1orf24. Epsin 2 (EPN2, Accession NM_014964) is another VGAM2189 host target gene. EPN2 BINDING SITE is HOST TARGET binding site found in the 3' untranslated region of mRNA encoded by EPN2, corresponding to a HOST TARGET binding site such as BINDING SITE I, BINDING SITE II or BINDING SITE III. Table 2 illustrates the complementarity of the nucleotide sequences of EPN2 BINDING SITE, designated SEQ ID:17345, to the nucleotide sequence of VGAM2189 RNA, herein designated VGAM RNA, also designated SEQ ID:4900.

Another function of VGAM2189 is therefore inhibition of Epsin 2 (EPN2, Accession NM_014964). Accordingly, utilities of VGAM2189 include diagnosis, prevention and treatment of diseases and clinical conditions associated with EPN2. STAF65(gamma) (Accession NM_014860) is another VGAM2189 host target gene. STAF65(gamma) BINDING SITE is HOST TARGET binding site found in the 3' untranslated region of mRNA encoded by STAF65(gamma), corresponding to a HOST TARGET binding site such as BINDING SITE I, BINDING SITE II or BINDING SITE III. Table 2 illustrates the complementarity of the nucleotide sequences of STAF65(gamma) BINDING SITE, designated SEQ ID:16922, to the nucleotide sequence of VGAM2189 RNA, herein designated VGAM RNA, also designated SEQ ID:4900.

Another function of VGAM2189 is therefore inhibition of STAF65(gamma) (Accession NM_014860). Accordingly, utilities of VGAM2189 include diagnosis, prevention and treatment of diseases and clinical conditions associated with STAF65(gamma). FIG. 1 further provides a conceptual description of a novel bioinformatically detected viral gene of the present invention, referred to here as Viral Genomic Address Messenger 2190 (VGAM2190) viral gene, which modulates expression of respective host target genes thereof, the function and utility of which host target genes is known in the art.

VGAM2190 is a novel bioinformatically detected regulatory, non protein coding, viral micro RNA (miRNA) gene. The method by which VGAM2190 was detected is described hereinabove with reference to FIGS. 1-8.

VGAM2190 gene, herein designated VGAM GENE, is a viral gene contained in the genome of Monkeypox Virus. VGAM2190 host target gene, herein designated VGAM HOST TARGET GENE, is a human gene contained in the human genome.

VGAM2190 gene encodes a VGAM2190 precursor RNA, herein designated VGAM PRECURSOR RNA. Similar to other miRNA genes, and unlike most ordinary genes, VGAM2190 precursor RNA does not encode a protein. A nucleotide sequence identical or highly similar to the nucleotide sequence of VGAM2190 precursor RNA is designated SEQ ID:2176, and is provided hereinbelow with reference to the sequence listing part. Nucleotide sequence SEQ ID:2176 is located at position 181733 relative to the genome of Monkeypox Virus.

VGAM2190 precursor RNA folds onto itself, forming VGAM2190 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2190 folded precursor RNA into VGAM2190 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2190 RNA is designated SEQ ID:4901, and is provided hereinbelow with reference to the sequence listing part.

VGAM2190 host target gene, herein designated VGAM HOST TARGET GENE, encodes a corresponding messenger RNA, VGAM2190 host target RNA, herein designated VGAM HOST TARGET RNA. VGAM2190 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2190 RNA, herein designated VGAM RNA, binds complementarily to one or more host target binding sites located in untranslated regions of VGAM2190 host target RNA, herein designated VGAM HOST TARGET RNA. This complementary binding is due to the fact that the nucleotide sequence of VGAM2190 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2190 RNA, herein designated VGAM RNA, may have a different number of host target binding sites in untranslated regions of a VGAM2190 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2190 RNA, herein designated VGAM RNA, to host target binding sites on VGAM2190 host target RNA, herein designated VGAM HOST TARGET RNA, such as BINDING SITE I, BINDING SITE II and BINDING SITE III, inhibits translation of VGAM2190 host target RNA into VGAM2190 host target protein, herein designated VGAM HOST TARGET PROTEIN. VGAM host target protein is therefore outlined by a broken line.

It is appreciated that VGAM2190 host target gene, herein designated VGAM HOST TARGET GENE, in fact represents a plurality of VGAM2190 host target genes. The mRNA of each one of this plurality of VGAM2190 host target genes comprises one or more host target binding sites, each having a nucleotide sequence which is at least partly complementary to VGAM2190 RNA, herein designated VGAM RNA, and which when bound by VGAM2190 RNA causes inhibition of translation of respective one or more VGAM2190 host target proteins.

It is further appreciated by one skilled in the art that the mode of translational inhibition illustrated by FIG. 1 with specific reference to translational inhibition exerted by VGAM2190 gene, herein designated VGAM GENE, on one or more VGAM2190 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2190 is inhibition of expression of host target genes, as part of a novel viral mechanism of attacking a host. Accordingly, utilities of VGAM2190 include diagnosis, prevention and treatment of viral infection by Monkeypox Virus. Specific functions, and accordingly utilities, of VGAM2190 correlate with, and may be deduced from, the identity of the host target genes which VGAM2190 binds and inhibits, and the function of these host target genes, as elaborated hereinbelow.

Nucleotide sequences of the VGAM2190 precursor RNA, herein designated VGAM PRECURSOR RNA, and of the 'diced' VGAM2190 RNA, herein designated VGAM RNA, and a schematic representation of the secondary folding of VGAM2190 folded precursor RNA, herein designated VGAM FOLDED PRECURSOR RNA, of VGAM2190 are further described hereinbelow with reference to Table 1.

Nucleotide sequences of host target binding sites, such as BINDING SITE-I, BINDING SITE-II and BINDING SITE-III of FIG. 1, found on VGAM2190 host target RNA, and schematic representation of the complementarity of each of these host target binding sites to VGAM2190 RNA, herein designated VGAM RNA, are described hereinbelow with reference to Table 2.

As mentioned hereinabove with reference to FIG. 1, a function of VGAM2190 gene, herein designated VGAM is inhibition of expression of VGAM2190 target genes. It is appreciated that specific functions, and accordingly utilities, of VGAM2190 correlate with, and may be deduced from, the identity of the target genes which VGAM2190 binds and inhibits, and the function of these target genes, as elaborated hereinbelow.

Ribonucleotide Reductase M2 Polypeptide (RRM2, Accession NM_001034) is a VGAM2190 host target gene. RRM2 BINDING SITE is HOST TARGET binding site found in the 3' untranslated region of mRNA encoded by RRM2, corresponding to a HOST TARGET binding site such as BINDING SITE I, BINDING SITE II or BINDING SITE III. Table 2 illustrates the complementarity of the nucleotide sequences of RRM2 BINDING SITE, designated SEQ ID:6699, to the nucleotide sequence of VGAM2190 RNA, herein designated VGAM RNA, also designated SEQ ID:4901.

A function of VGAM2190 is therefore inhibition of Ribonucleotide Reductase M2 Polypeptide (RRM2, Accession NM_001034). Accordingly, utilities of VGAM2190 include diagnosis, prevention and treatment of diseases and clinical conditions associated with RRM2. KIAA1762 (Accession XM_033370) is another VGAM2190 host target gene. KIAA1762 BINDING SITE is HOST TARGET binding site found in the 3' untranslated region of mRNA encoded by KIAA1762, corresponding to a HOST TARGET binding site such as BINDING SITE I, BINDING SITE II or BINDING SITE III. Table 2 illustrates the complementarity of the nucleotide sequences of KIAA1762 BINDING SITE, designated SEQ ID:31910, to the nucleotide sequence of VGAM2190 RNA, herein designated VGAM RNA, also designated SEQ ID:4901.

Another function of VGAM2190 is therefore inhibition of KIAA1762 (Accession XM_033370). Accordingly, utilities of VGAM2190 include diagnosis, prevention and treatment of diseases and clinical conditions associated with KIAA1762. LOC157623 (Accession XM_088346) is another VGAM2190 host target gene. LOC157623 BINDING SITE is HOST TARGET binding site found in the 5' untranslated region of mRNA encoded by LOC157623, corresponding to a HOST TARGET binding site such as BINDING SITE I, BINDING SITE II or BINDING SITE III. Table 2 illustrates the complementarity of the nucleotide sequences of LOC157623 BINDING SITE, designated SEQ ID:39614, to the nucleotide sequence of VGAM2190 RNA, herein designated VGAM RNA, also designated SEQ ID:4901.

Another function of VGAM2190 is therefore inhibition of LOC157623 (Accession XM_088346). Accordingly, utilities of VGAM2190 include diagnosis, prevention and treatment of diseases and clinical conditions associated with LOC157623. LOC91759 (Accession XM_040467) is another VGAM2190 host target gene. LOC91759 BINDING SITE is HOST TARGET binding site found in the 5' untranslated region of mRNA encoded by LOC91759, corresponding to a HOST TARGET binding site such as BINDING SITE I, BINDING SITE II or BINDING SITE III. Table 2 illustrates the complementarity of the nucleotide sequences of LOC91759 BINDING SITE, designated SEQ ID:33299, to the nucleotide sequence of VGAM2190 RNA, herein designated VGAM RNA, also designated SEQ ID:4901.

Another function of VGAM2190 is therefore inhibition of LOC91759 (Accession XM_040467). Accordingly, utilities of VGAM2190 include diagnosis, prevention and treatment of diseases and clinical conditions associated with LOC91759. FIG. 1 further provides a conceptual description of a novel bioinformatically detected viral gene of the present invention, referred to here as Viral Genomic Address Messenger 2191 (VGAM2191) viral gene, which modulates expression of respective host target genes thereof, the function and utility of which host target genes is known in the art.

VGAM2191 is a novel bioinformatically detected regulatory, non protein coding, viral micro RNA (miRNA) gene. The method by which VGAM2191 was detected is described hereinabove with reference to FIGS. 1-8.

VGAM2191 gene, herein designated VGAM GENE, is a viral gene contained in the genome of Monkeypox Virus. VGAM2191 host target gene, herein designated VGAM HOST TARGET GENE, is a human gene contained in the human genome.

VGAM2191 gene encodes a VGAM2191 precursor RNA, herein designated VGAM PRECURSOR RNA. Similar to other miRNA genes, and unlike most ordinary genes, VGAM2191 precursor RNA does not encode a protein. A nucleotide sequence identical or highly similar to the nucleotide sequence of VGAM2191 precursor RNA is designated SEQ ID:2177, and is provided hereinbelow with reference to the sequence listing part. Nucleotide sequence SEQ ID:2177 is located at position 812 relative to the genome of Monkeypox Virus.

VGAM2191 precursor RNA folds onto itself, forming VGAM2191 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2191 folded precursor RNA into VGAM2191 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2191 RNA is designated SEQ ID:4902, and is provided hereinbelow with reference to the sequence listing part.

VGAM2191 host target gene, herein designated VGAM HOST TARGET GENE, encodes a corresponding messenger RNA, VGAM2191 host target RNA, herein designated VGAM HOST TARGET RNA. VGAM2191 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2191 RNA, herein designated VGAM RNA, binds complementarily to one or more host target binding sites located in untranslated regions of VGAM2191 host target RNA, herein designated VGAM HOST TARGET RNA. This complementary binding is due to the fact that the nucleotide sequence of VGAM2191 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2191 RNA, herein designated VGAM RNA, may have a different number of host target binding sites in untranslated regions of a VGAM2191 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2191 RNA, herein designated VGAM RNA, to host target binding sites on VGAM2191 host target RNA, herein designated VGAM HOST TARGET RNA, such as BINDING SITE I, BINDING SITE II and BINDING SITE III, inhibits translation of VGAM2191 host target RNA into VGAM2191 host target protein, herein designated VGAM HOST TARGET PROTEIN. VGAM host target protein is therefore outlined by a broken line.

It is appreciated that VGAM2191 host target gene, herein designated VGAM HOST TARGET GENE, in fact represents a plurality of VGAM2191 host target genes. The mRNA of each one of this plurality of VGAM2191 host target genes comprises one or more host target binding sites, each having a nucleotide sequence which is at least partly complementary to VGAM2191 RNA, herein designated VGAM RNA, and which when bound by VGAM2191 RNA causes inhibition of translation of respective one or more VGAM2191 host target proteins.

It is further appreciated by one skilled in the art that the mode of translational inhibition illustrated by FIG. 1 with specific reference to translational inhibition exerted by VGAM2191 gene, herein designated VGAM GENE, on one or more VGAM2191 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2191 is inhibition of expression of host target genes, as part of a novel viral mechanism of attacking a host. Accordingly, utilities of VGAM2191 include diagnosis, prevention and treatment of viral infection by Monkeypox Virus. Specific functions, and accordingly utilities, of VGAM2191 correlate with, and may be deduced from, the identity of the host target genes which VGAM2191 binds and inhibits, and the function of these host target genes, as elaborated hereinbelow.

Nucleotide sequences of the VGAM2191 precursor RNA, herein designated VGAM PRECURSOR RNA, and of the 'diced' VGAM2191 RNA, herein designated VGAM RNA, and a schematic representation of the secondary folding of VGAM2191 folded precursor RNA, herein designated VGAM FOLDED PRECURSOR RNA, of VGAM2191 are further described hereinbelow with reference to Table 1.

Nucleotide sequences of host target binding sites, such as BINDING SITE-I, BINDING SITE-II and BINDING SITE-III of FIG. 1, found on VGAM2191 host target RNA, and schematic representation of the complementarity of each of these host target binding sites to VGAM2191 RNA, herein designated VGAM RNA, are described hereinbelow with reference to Table 2.

As mentioned hereinabove with reference to FIG. 1, a function of VGAM2191 gene, herein designated VGAM is inhibition of expression of VGAM2191 target genes. It is appreciated that specific functions, and accordingly utilities, of VGAM2191 correlate with, and may be deduced from, the identity of the target genes which VGAM2191 binds and inhibits, and the function of these target genes, as elaborated hereinbelow.

EFG1 (Accession XM_170611) is a VGAM2191 host target gene. EFG1 BINDING SITE is HOST TARGET binding site found in the 3' untranslated region of mRNA encoded by EFG1, corresponding to a HOST TARGET binding site such as BINDING SITE I, BINDING SITE II or BINDING SITE III. Table 2 illustrates the complementarity of the nucleotide sequences of EFG1 BINDING SITE, designated SEQ ID:45397, to the nucleotide sequence of VGAM2191 RNA, herein designated VGAM RNA, also designated SEQ ID:4902.

A function of VGAM2191 is therefore inhibition of EFG1 (Accession XM_170611), a gene which promotes the gtp-dependent translocation of the nascent protein chain from the a-site to the p-site of the ribosome in the mitochondria. Accordingly, utilities of VGAM2191 include diagnosis, prevention and treatment of diseases and clinical conditions associated with EFG1. The function of EFG1 and its association with various diseases and clinical conditions, has been established by previous studies, as described hereinabove with reference to VGAM1753. Solute Carrier Family 6 (neurotransmitter transporter, dopamine), Member 3 (SLC6A3, Accession NM_001044) is another VGAM2191 host target gene. SLC6A3 BINDING SITE is HOST TARGET binding site found in the 3' untranslated region of mRNA encoded by SLC6A3, corresponding to a HOST TARGET binding site such as BINDING SITE I, BINDING SITE II or BINDING SITE III. Table 2 illustrates the complementarity of the nucleotide sequences of SLC6A3 BINDING SITE, designated SEQ ID:6713, to the nucleotide sequence of VGAM2191 RNA, herein designated VGAM RNA, also designated SEQ ID:4902.

Another function of VGAM2191 is therefore inhibition of Solute Carrier Family 6 (neurotransmitter transporter, dopamine), Member 3 (SLC6A3, Accession NM_001044), a gene which terminates the action of dopamine by its high affinity sodium-dependent reuptake into presynaptic terminals. Accordingly, utilities of VGAM2191 include diagnosis, prevention and treatment of diseases and clinical conditions associated with SLC6A3. The function of SLC6A3 and its association with various diseases and clinical conditions, has been established by previous studies, as described hereinabove with reference to VGAM1753. H2AV (Accession NM_138635) is another VGAM2191 host target gene. H2AV BINDING SITE is HOST TARGET binding site found in the 3' untranslated region of mRNA encoded by H2AV, corresponding to a HOST TARGET binding site such as BINDING SITE I, BINDING SITE II or BINDING SITE III. Table 2 illustrates the complementarity of the nucleotide sequences of H2AV BINDING SITE, designated SEQ ID:28912, to the nucleotide sequence of VGAM2191 RNA, herein designated VGAM RNA, also designated SEQ ID:4902.

Another function of VGAM2191 is therefore inhibition of H2AV (Accession NM_138635). Accordingly, utilities of VGAM2191 include diagnosis, prevention and treatment of diseases and clinical conditions associated with H2AV. HMP19 (Accession XM_113455) is another VGAM2191 host target gene. HMP19 BINDING SITE is HOST TARGET binding site found in the 3' untranslated region of mRNA encoded by HMP19, corresponding to a HOST TARGET binding site such as BINDING SITE I, BINDING SITE II or BINDING SITE III. Table 2 illustrates the complementarity of the nucleotide sequences of HMP19 BINDING SITE, designated SEQ ID:42273, to the nucleotide sequence of VGAM2191 RNA, herein designated VGAM RNA, also designated SEQ ID:4902.

Another function of VGAM2191 is therefore inhibition of HMP19 (Accession XM_113455). Accordingly, utilities of VGAM2191 include diagnosis, prevention and treatment of diseases and clinical conditions associated with HMP19. FIG. 1 further provides a conceptual description of a novel bioinformatically detected viral gene of the present invention, referred to here as Viral Genomic Address Messenger 2192 (VGAM2192) viral gene, which modulates expression of respective host target genes thereof, the function and utility of which host target genes is known in the art.

VGAM2192 is a novel bioinformatically detected regulatory, non protein coding, viral micro RNA (miRNA) gene. The method by which VGAM2192 was detected is described hereinabove with reference to FIGS. 1-8.

VGAM2192 gene, herein designated VGAM GENE, is a viral gene contained in the genome of Monkeypox Virus. VGAM2192 host target gene, herein designated VGAM HOST TARGET GENE, is a human gene contained in the human genome.

VGAM2192 gene encodes a VGAM2192 precursor RNA, herein designated VGAM PRECURSOR RNA. Similar to other miRNA genes, and unlike most ordinary genes, VGAM2192 precursor RNA does not encode a protein. A nucleotide sequence identical or highly similar to the nucleotide sequence of VGAM2192 precursor RNA is designated SEQ ID:2178, and is provided hereinbelow with reference to the sequence listing part. Nucleotide sequence SEQ ID:2178 is located at position 2502 relative to the genome of Monkeypox Virus.

VGAM2192 precursor RNA folds onto itself, forming VGAM2192 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2192 folded precursor RNA into VGAM2192 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2192 RNA is designated SEQ ID:4903, and is provided hereinbelow with reference to the sequence listing part.

VGAM2192 host target gene, herein designated VGAM HOST TARGET GENE, encodes a corresponding messenger RNA, VGAM2192 host target RNA, herein designated VGAM HOST TARGET RNA. VGAM2192 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2192 RNA, herein designated VGAM RNA, binds complementarily to one or more host target binding sites located in untranslated regions of VGAM2192 host target RNA, herein designated VGAM HOST TARGET RNA. This complementary binding is due to the fact that the nucleotide sequence of VGAM2192 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2192 RNA, herein designated VGAM RNA, may have a different number of host target binding sites in untranslated regions of a VGAM2192 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2192 RNA, herein designated VGAM RNA, to host target binding sites on VGAM2192 host target RNA, herein designated VGAM HOST TARGET RNA, such as BINDING SITE I, BINDING SITE II and BINDING SITE III, inhibits translation of VGAM2192 host target RNA into VGAM2192 host target protein, herein designated VGAM HOST TARGET PROTEIN. VGAM host target protein is therefore outlined by a broken line.

It is appreciated that VGAM2192 host target gene, herein designated VGAM HOST TARGET GENE, in fact represents a plurality of VGAM2192 host target genes. The mRNA of each one of this plurality of VGAM2192 host target genes comprises one or more host target binding sites, each having a nucleotide sequence which is at least partly complementary to VGAM2192 RNA, herein designated VGAM RNA, and which when bound by VGAM2192 RNA causes inhibition of translation of respective one or more VGAM2192 host target proteins.

It is further appreciated by one skilled in the art that the mode of translational inhibition illustrated by FIG. 1 with specific reference to translational inhibition exerted by VGAM2192 gene, herein designated VGAM GENE, on one or more VGAM2192 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2192 is inhibition of expression of host target genes, as part of a novel viral mechanism of attacking a host. Accordingly, utilities of VGAM2192 include diagnosis, prevention and treatment of viral infection by Monkeypox Virus. Specific functions, and accordingly utilities, of VGAM2192 correlate with, and may be deduced from, the identity of the host target genes which VGAM2192 binds and inhibits, and the function of these host target genes, as elaborated hereinbelow.

Nucleotide sequences of the VGAM2192 precursor RNA, herein designated VGAM PRECURSOR RNA, and of the 'diced' VGAM2192 RNA, herein designated VGAM RNA, and a schematic representation of the secondary folding of VGAM2192 folded precursor RNA, herein designated VGAM FOLDED PRECURSOR RNA, of VGAM2192 are further described hereinbelow with reference to Table 1.

Nucleotide sequences of host target binding sites, such as BINDING SITE-I, BINDING SITE-II and BINDING SITE-III of FIG. 1, found on VGAM2192 host target RNA, and schematic representation of the complementarity of each of these host target binding sites to VGAM2192 RNA, herein designated VGAM RNA, are described hereinbelow with reference to Table 2.

As mentioned hereinabove with reference to FIG. 1, a function of VGAM2192 gene, herein designated VGAM is inhibition of expression of VGAM2192 target genes. It is appreciated that specific functions, and accordingly utilities, of VGAM2192 correlate with, and may be deduced from, the identity of the target genes which VGAM2192 binds and inhibits, and the function of these target genes, as elaborated hereinbelow.

BTB and CNC Homology 1, Basic Leucine Zipper Transcription Factor 1 (BACH1, Accession NM_001186) is a VGAM2192 host target gene. BACH1 BINDING SITE is HOST TARGET binding site found in the 3' untranslated region of mRNA encoded by BACH1, corresponding to a HOST TARGET binding site such as BINDING SITE I, BINDING SITE II or BINDING SITE III. Table 2 illustrates the complementarity of the nucleotide sequences of BACH1 BINDING SITE, designated SEQ ID:6855, to the nucleotide sequence of VGAM2192 RNA, herein designated VGAM RNA, also designated SEQ ID:4903.

A function of VGAM2192 is therefore inhibition of BTB and CNC Homology 1, Basic Leucine Zipper Transcription Factor 1 (BACH1, Accession NM_001186), a gene which acts as repressor or activator, binds to nf-e2 binding sites. Accordingly, utilities of VGAM2192 include diagnosis, prevention and treatment of diseases and clinical conditions associated with BACH1. The function of BACH1 and its association with various diseases and clinical conditions, has been established by previous studies, as described hereinabove with reference to VGAM724. Estrogen Receptor 1 (ESR1, Accession NM_000125) is another VGAM2192 host target gene. ESR1 BINDING SITE is HOST TARGET binding site found in the 3' untranslated region of mRNA encoded by ESR1, corresponding to a HOST TARGET binding site such as BINDING SITE I, BINDING SITE II or BINDING SITE III. Table 2 illustrates the complementarity of the nucleotide sequences of ESR1 BINDING SITE, designated SEQ ID:5597, to the nucleotide sequence of VGAM2192 RNA, herein designated VGAM RNA, also designated SEQ ID:4903.

Another function of VGAM2192 is therefore inhibition of Estrogen Receptor 1 (ESR1, Accession NM_000125), a gene which involved in hormone-mediated inhibition of gene expression. Accordingly, utilities of VGAM2192 include diagnosis, prevention and treatment of diseases and clinical conditions associated with ESR1. The function of ESR1 and its association with various diseases and clinical conditions, has been established by previous studies, as described hereinabove with reference to VGAM695. IDI2 (Accession NM_033261) is another VGAM2192 host target gene. IDI2 BINDING SITE is HOST TARGET binding site found in the 3' untranslated region of mRNA encoded by IDI2, corresponding to a HOST TARGET binding site such as BINDING SITE I, BINDING SITE II or BINDING SITE III. Table 2 illustrates the complementarity of the nucleotide sequences of IDI2 BINDING SITE, designated SEQ ID:27089, to the nucleotide sequence of VGAM2192 RNA, herein designated VGAM RNA, also designated SEQ ID:4903.

Another function of VGAM2192 is therefore inhibition of IDI2 (Accession NM_033261). Accordingly, utilities of VGAM2192 include diagnosis, prevention and treatment of diseases and clinical conditions associated with IDI2. KIAA1979 (Accession XM_113984) is another VGAM2192 host target gene. KIAA1979 BINDING SITE is HOST TARGET binding site found in the 3' untranslated region of mRNA encoded by KIAA1979, corresponding to a HOST TARGET binding site such as BINDING SITE I, BINDING SITE II or BINDING SITE III. Table 2 illustrates the complementarity of the nucleotide sequences of KIAA1979 BINDING SITE, designated SEQ ID:42587, to the nucleotide sequence of VGAM2192 RNA, herein designated VGAM RNA, also designated SEQ ID:4903.

Another function of VGAM2192 is therefore inhibition of KIAA1979 (Accession XM_113984). Accordingly, utilities of VGAM2192 include diagnosis, prevention and treatment of diseases and clinical conditions associated with KIAA1979. LBP-9 (Accession NM_014553) is another VGAM2192 host target gene. LBP-9 BINDING SITE is HOST TARGET binding site found in the 3' untranslated region of mRNA encoded by LBP-9, corresponding to a HOST TARGET binding site such as BINDING SITE I, BINDING SITE II or BINDING SITE III. Table 2 illustrates the complementarity of the nucleotide sequences of LBP-9 BINDING SITE, designated SEQ ID:15880, to the nucleotide sequence of VGAM2192 RNA, herein designated VGAM RNA, also designated SEQ ID:4903.

Another function of VGAM2192 is therefore inhibition of LBP-9 (Accession NM_014553). Accordingly, utilities of VGAM2192 include diagnosis, prevention and treatment of diseases and clinical conditions associated with LBP-9. Lipoma HMGIC Fusion Partner-like 2 (LHFPL2, Accession XM_046054) is another VGAM2192 host target gene. LHFPL2 BINDING SITE is HOST TARGET binding site found in the 3' untranslated region of mRNA encoded by LHFPL2, corresponding to a HOST TARGET binding site such as BINDING SITE I, BINDING SITE II or BINDING SITE III. Table 2 illustrates the complementarity of the nucleotide sequences of LHFPL2 BINDING SITE, designated SEQ ID:34656, to the nucleotide sequence of VGAM2192 RNA, herein designated VGAM RNA, also designated SEQ ID:4903.

Another function of VGAM2192 is therefore inhibition of Lipoma HMGIC Fusion Partner-like 2 (LHFPL2, Accession XM_046054). Accordingly, utilities of VGAM2192 include diagnosis, prevention and treatment of diseases and clinical conditions associated with LHFPL2. Serologically Defined Colon Cancer Antigen 43 (SDCCAG43, Accession XM_046834) is another VGAM2192 host target gene. SDC-CAG43 BINDING SITE is HOST TARGET binding site found in the 3' untranslated region of mRNA encoded by SDCCAG43, corresponding to a HOST TARGET binding site such as BINDING SITE I, BINDING SITE II or BINDING SITE III. Table 2 illustrates the complementarity of the nucleotide sequences of SDCCAG43 BINDING SITE, designated SEQ ID:34844, to the nucleotide sequence of VGAM2192 RNA, herein designated VGAM RNA, also designated SEQ ID:4903.

Another function of VGAM2192 is therefore inhibition of Serologically Defined Colon Cancer Antigen 43 (SDCCAG43, Accession XM_046834). Accordingly, utilities of VGAM2192 include diagnosis, prevention and treatment of diseases and clinical conditions associated with SDCCAG43. TRAD (Accession NM_007064) is another VGAM2192 host target gene. TRAD BINDING SITE is HOST TARGET binding site found in the 3' untranslated region of mRNA encoded by TRAD, corresponding to a HOST TARGET binding site such as BINDING SITE I, BINDING SITE II or BINDING SITE III. Table 2 illustrates the complementarity of the nucleotide sequences of TRAD BINDING SITE, designated SEQ ID:13928, to the nucleotide sequence of VGAM2192 RNA, herein designated VGAM RNA, also designated SEQ ID:4903.

Another function of VGAM2192 is therefore inhibition of TRAD (Accession NM_007064). Accordingly, utilities of VGAM2192 include diagnosis, prevention and treatment of diseases and clinical conditions associated with TRAD. LOC135293 (Accession XM_072402) is another VGAM2192 host target gene. LOC135293 BINDING SITE is HOST TARGET binding site found in the 3' untranslated region of mRNA encoded by LOC135293, corresponding to a HOST TARGET binding site such as BINDING SITE I, BINDING SITE II or BINDING SITE III. Table 2 illustrates the complementarity of the nucleotide sequences of LOC135293 BINDING SITE, designated SEQ ID:37495, to the nucleotide sequence of VGAM2192 RNA, herein designated VGAM RNA, also designated SEQ ID:4903.

Another function of VGAM2192 is therefore inhibition of LOC135293 (Accession XM_072402). Accordingly, utilities of VGAM2192 include diagnosis, prevention and treatment of diseases and clinical conditions associated with LOC135293. FIG. 1 further provides a conceptual description of a novel bioinformatically detected viral gene of the present invention, referred to here as Viral Genomic Address Messenger 2193 (VGAM2193) viral gene, which modulates expression of respective host target genes thereof, the function and utility of which host target genes is known in the art.

VGAM2193 is a novel bioinformatically detected regulatory, non protein coding, viral micro RNA (miRNA) gene. The method by which VGAM2193 was detected is described hereinabove with reference to FIGS. 1-8.

VGAM2193 gene, herein designated VGAM GENE, is a viral gene contained in the genome of Cowpox Virus. VGAM2193 host target gene, herein designated VGAM HOST TARGET GENE, is a human gene contained in the human genome.

VGAM2193 gene encodes a VGAM2193 precursor RNA, herein designated VGAM PRECURSOR RNA. Similar to other miRNA genes, and unlike most ordinary genes, VGAM2193 precursor RNA does not encode a protein. A nucleotide sequence identical or highly similar to the nucleotide sequence of VGAM2193 precursor RNA is designated SEQ ID:2179, and is provided hereinbelow with reference to the sequence listing part. Nucleotide sequence SEQ ID:2179 is located at position 18641 relative to the genome of Cowpox Virus.

VGAM2193 precursor RNA folds onto itself, forming VGAM2193 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2193 folded precursor RNA into VGAM2193 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM2193 RNA is designated SEQ ID:4904, and is provided hereinbelow with reference to the sequence listing part.

VGAM2193 host target gene, herein designated VGAM HOST TARGET GENE, encodes a corresponding messenger RNA, VGAM2193 host target RNA, herein designated VGAM HOST TARGET RNA. VGAM2193 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2193 RNA, herein designated VGAM RNA, binds complementarily to one or more host target binding sites located in untranslated regions of VGAM2193 host target RNA, herein designated VGAM HOST TARGET RNA. This complementary binding is due to the fact that the nucleotide sequence of VGAM2193 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2193 RNA, herein designated VGAM RNA, may have a different number of host target binding sites in untranslated regions of a VGAM2193 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2193 RNA, herein designated VGAM RNA, to host target binding sites on VGAM2193 host target RNA, herein designated VGAM HOST TARGET RNA, such as BINDING SITE I, BINDING SITE II and BINDING SITE III, inhibits translation of VGAM2193 host target RNA into VGAM2193 host target protein, herein designated VGAM HOST TARGET PROTEIN. VGAM host target protein is therefore outlined by a broken line.

It is appreciated that VGAM2193 host target gene, herein designated VGAM HOST TARGET GENE, in fact represents a plurality of VGAM2193 host target genes. The mRNA of each one of this plurality of VGAM2193 host target genes comprises one or more host target binding sites, each having a nucleotide sequence which is at least partly complementary to VGAM2193 RNA, herein designated VGAM RNA, and which when bound by VGAM2193 RNA causes inhibition of translation of respective one or more VGAM2193 host target proteins.

It is further appreciated by one skilled in the art that the mode of translational inhibition illustrated by FIG. 1 with specific reference to translational inhibition exerted by VGAM2193 gene, herein designated VGAM GENE, on one or more VGAM2193 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2193 is inhibition of expression of host target genes, as part of a novel viral mechanism of attacking a host. Accordingly, utilities of VGAM2193 include diagnosis, prevention and treatment of viral infection by Cowpox Virus. Specific functions, and accordingly utilities, of VGAM2193 correlate with, and may be deduced from, the identity of the host target genes which VGAM2193 binds and inhibits, and the function of these host target genes, as elaborated hereinbelow.

Nucleotide sequences of the VGAM2193 precursor RNA, herein designated VGAM PRECURSOR RNA, and of the 'diced' VGAM2193 RNA, herein designated VGAM RNA, and a schematic representation of the secondary folding of VGAM2193 folded precursor RNA, herein designated VGAM FOLDED PRECURSOR RNA, of VGAM2193 are further described hereinbelow with reference to Table 1.

Nucleotide sequences of host target binding sites, such as BINDING SITE-I, BINDING SITE-II and BINDING SITE-III of FIG. 1, found on VGAM2193 host target RNA, and schematic representation of the complementarity of each of these host target binding sites to VGAM2193 RNA, herein designated VGAM RNA, are described hereinbelow with reference to Table 2.

As mentioned hereinabove with reference to FIG. 1, a function of VGAM2193 gene, herein designated VGAM is inhibition of expression of VGAM2193 target genes. It is appreciated that specific functions, and accordingly utilities, of VGAM2193 correlate with, and may be deduced from, the identity of the target genes which VGAM2193 binds and inhibits, and the function of these target genes, as elaborated hereinbelow.

Nuclear Receptor Coactivator 3 (NCOA3, Accession NM_006534) is a VGAM2193 host target gene. NCOA3 BINDING SITE is HOST TARGET binding site found in the 3' untranslated region of mRNA encoded by NCOA3, corresponding to a HOST TARGET binding site such as BINDING SITE I, BINDING SITE II or BINDING SITE III. Table 2 illustrates the complementarity of the nucleotide sequences of NCOA3 BINDING SITE, designated SEQ ID:13286, to the nucleotide sequence of VGAM2193 RNA, herein designated VGAM RNA, also designated SEQ ID:4904.

A function of VGAM2193 is therefore inhibition of Nuclear Receptor Coactivator 3 (NCOA3, Accession NM_006534), a gene which directly binds nuclear receptors and stimulates the transcriptional activities in hormone-dependent fashion. Accordingly, utilities of VGAM2193 include diagnosis, prevention and treatment of diseases and clinical conditions associated with NCOA3. The function of NCOA3 and its association with various diseases and clinical conditions, has been established by previous studies, as described hereinabove with reference to VGAM215. Phenylalanine Hydroxylase (PAH, Accession NM_000277) is another VGAM2193 host target gene. PAH BINDING SITE is HOST TARGET binding site found in the 3' untranslated region of mRNA encoded by PAH, corresponding to a HOST TARGET binding site such as BINDING SITE I, BINDING SITE II or BINDING SITE III. Table 2 illustrates the complementarity of the nucleotide sequences of PAH BINDING SITE, designated SEQ ID:5823, to the nucleotide sequence of VGAM2193 RNA, herein designated VGAM RNA, also designated SEQ ID:4904.

Another function of VGAM2193 is therefore inhibition of Phenylalanine Hydroxylase (PAH, Accession NM_000277). Accordingly, utilities of VGAM2193 include diagnosis, prevention and treatment of diseases and clinical conditions associated with PAH. Sialyltransferase 9 (CMP-NeuAc:lactosylceramide alpha-2,3-sialyl transferase; GM3 synthase) (SIAT9, Accession NM_003896) is another VGAM2193 host target gene. SIAT9 BINDING SITE is HOST TARGET binding site found in the 3' untranslated region of mRNA encoded by SIAT9, corresponding to a HOST TARGET binding site such as BINDING SITE I, BINDING SITE II or BINDING SITE III. Table 2 illustrates the complementarity of the nucleotide sequences of SIAT9 BINDING SITE, designated SEQ ID:9977, to the nucleotide sequence of VGAM2193 RNA, herein designated VGAM RNA, also designated SEQ ID:4904.

Another function of VGAM2193 is therefore inhibition of Sialyltransferase 9 (CMP-NeuAc:lactosylceramide alpha-2,3-sialyl transferase; GM3 synthase) (SIAT9, Accession NM_003896). Accordingly, utilities of VGAM2193 include diagnosis, prevention and treatment of diseases and clinical conditions associated with SIAT9. LOC51075 (Accession NM_015959) is another VGAM2193 host target gene. LOC51075 BINDING SITE is HOST TARGET binding site found in the 3' untranslated region of mRNA encoded by LOC51075, corresponding to a HOST TARGET binding site such as BINDING SITE I, BINDING SITE II or BINDING SITE III. Table 2 illustrates the complementarity of the nucleotide sequences of LOC51075 BINDING SITE, designated SEQ ID:18068, to the nucleotide sequence of VGAM2193 RNA, herein designated VGAM RNA, also designated SEQ ID:4904.

Another function of VGAM2193 is therefore inhibition of LOC51075 (Accession NM_015959). Accordingly, utilities of VGAM2193 include diagnosis, prevention and treatment of diseases and clinical conditions associated with LOC51075. FIG. 1 further provides a conceptual description of a novel bioinformatically detected viral gene of the present invention, referred to here as Viral Genomic Address Messenger 2194 (VGAM2194) viral gene, which modulates expression of respective host target genes thereof, the function and utility of which host target genes is known in the art.

VGAM2194 is a novel bioinformatically detected regulatory, non protein coding, viral micro RNA (miRNA) gene. The method by which VGAM2194 was detected is described hereinabove with reference to FIGS. 1-8.

VGAM2194 gene, herein designated VGAM GENE, is a viral gene contained in the genome of Monkeypox Virus. VGAM2194 host target gene, herein designated VGAM HOST TARGET GENE, is a human gene contained in the human genome.

VGAM2194 gene encodes a VGAM2194 precursor RNA, herein designated VGAM PRECURSOR RNA. Similar to other miRNA genes, and unlike most ordinary genes, VGAM2194 precursor RNA does not encode a protein. A nucleotide sequence identical or highly similar to the nucleotide sequence of VGAM2194 precursor RNA is designated SEQ ID:2180, and is provided hereinbelow with reference to the sequence listing part. Nucleotide sequence SEQ ID:2180 is located at position 269 relative to the genome of Monkeypox Virus.

VGAM2194 precursor RNA folds onto itself, forming VGAM2194 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2194 folded precursor RNA into VGAM2194 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2194 RNA is designated SEQ ID:4905, and is provided hereinbelow with reference to the sequence listing part.

VGAM2194 host target gene, herein designated VGAM HOST TARGET GENE, encodes a corresponding messenger RNA, VGAM2194 host target RNA, herein designated VGAM HOST TARGET RNA. VGAM2194 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2194 RNA, herein designated VGAM RNA, binds complementarily to one or more host target binding sites located in untranslated regions of VGAM2194 host target RNA, herein designated VGAM HOST TARGET RNA. This complementary binding is due to the fact that the nucleotide sequence of VGAM2194 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2194 RNA, herein designated VGAM RNA, may have a different number of host target binding sites in untranslated regions of a VGAM2194 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2194 RNA, herein designated VGAM RNA, to host target binding sites on VGAM2194 host target RNA, herein designated VGAM HOST TARGET RNA, such as BINDING SITE I, BINDING SITE II and BINDING SITE III, inhibits translation of VGAM2194 host target RNA into VGAM2194 host target protein, herein designated VGAM HOST TARGET PROTEIN. VGAM host target protein is therefore outlined by a broken line.

It is appreciated that VGAM2194 host target gene, herein designated VGAM HOST TARGET GENE, in fact represents a plurality of VGAM2194 host target genes. The mRNA of each one of this plurality of VGAM2194 host target genes comprises one or more host target binding sites, each having a nucleotide sequence which is at least partly complementary to VGAM2194 RNA, herein designated VGAM RNA, and which when bound by VGAM2194 RNA causes inhibition of translation of respective one or more VGAM2194 host target proteins.

It is further appreciated by one skilled in the art that the mode of translational inhibition illustrated by FIG. 1 with specific reference to translational inhibition exerted by VGAM2194 gene, herein designated VGAM GENE, on one or more VGAM2194 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2194 is inhibition of expression of host target genes, as part of a novel viral mechanism of attacking a host. Accordingly, utilities of VGAM2194 include diagnosis, prevention and treatment of viral infection by Monkeypox Virus. Specific functions, and accordingly utilities, of VGAM2194 correlate with, and may be deduced from, the identity of the host target genes which VGAM2194 binds and inhibits, and the function of these host target genes, as elaborated hereinbelow.

Nucleotide sequences of the VGAM2194 precursor RNA, herein designated VGAM PRECURSOR RNA, and of the 'diced' VGAM2194 RNA, herein designated VGAM RNA, and a schematic representation of the secondary folding of VGAM2194 folded precursor RNA, herein designated VGAM FOLDED PRECURSOR RNA, of VGAM2194 are further described hereinbelow with reference to Table 1.

Nucleotide sequences of host target binding sites, such as BINDING SITE-I, BINDING SITE-II and BINDING SITE-III of FIG. 1, found on VGAM2194 host target RNA, and schematic representation of the complementarity of each of these host target binding sites to VGAM2194 RNA, herein designated VGAM RNA, are described hereinbelow with reference to Table 2.

As mentioned hereinabove with reference to FIG. 1, a function of VGAM2194 gene, herein designated VGAM is inhibition of expression of VGAM2194 target genes. It is appreciated that specific functions, and accordingly utilities, of VGAM2194 correlate with, and may be deduced from, the identity of the target genes which VGAM2194 binds and inhibits, and the function of these target genes, as elaborated hereinbelow.

A Disintegrin and Metalloproteinase Domain 12 (meltrin alpha) (ADAM12, Accession NM_003474) is a VGAM2194 host target gene. ADAM12 BINDING SITE is HOST TARGET binding site found in the 3' untranslated region of mRNA encoded by ADAM12, corresponding to a HOST TARGET binding site such as BINDING SITE I, BINDING SITE II or BINDING SITE III. Table 2 illustrates the complementarity of the nucleotide sequences of ADAM12 BINDING SITE, designated SEQ ID:9546, to the nucleotide sequence of VGAM2194 RNA, herein designated VGAM RNA, also designated SEQ ID:4905.

A function of VGAM2194 is therefore inhibition of A Disintegrin and Metalloproteinase Domain 12 (meltrin alpha) (ADAM12, Accession NM_003474), a gene which involved in skeletal muscle regeneration, specifically at the onset of cell fusion. Accordingly, utilities of VGAM2194 include diagnosis, prevention and treatment of diseases and clinical conditions associated with ADAM12. The function of ADAM12 and its association with various diseases and clinical conditions, has been established by previous studies, as described hereinabove with reference to VGAM675. Adducin 3 (gamma) (ADD3, Accession NM_016824) is another VGAM2194 host target gene. ADD3 BINDING SITE is HOST TARGET binding site found in the 3' untranslated region of mRNA encoded by ADD3, corresponding to a HOST TARGET binding site such as BINDING SITE I, BINDING SITE II or BINDING SITE III. Table 2 illustrates the complementarity of the nucleotide sequences of ADD3 BINDING SITE, designated SEQ ID:18817, to the nucleotide sequence of VGAM2194 RNA, herein designated VGAM RNA, also designated SEQ ID:4905.

Another function of VGAM2194 is therefore inhibition of Adducin 3 (gamma) (ADD3, Accession NM_016824), a gene which membrane-cytoskeleton-associated protein that promotes the assembly of the spectrin-actin network. Accordingly, utilities of VGAM2194 include diagnosis, prevention and treatment of diseases and clinical conditions associated with ADD3. The function of ADD3 and its association with various diseases and clinical conditions, has been established by previous studies, as described hereinabove with reference to VGAM579. Chromosome 9 Open Reading Frame 12 (C9orf12, Accession NM_022755) is another VGAM2194 host target gene. C9orf12 BINDING SITE is HOST TARGET binding site found in the 3' untranslated region of mRNA encoded by C9orf12, corresponding to a HOST TARGET binding site such as BINDING SITE I, BINDING SITE II or BINDING SITE III. Table 2 illustrates the complementarity of the nucleotide sequences of C9orf12 BINDING SITE, designated SEQ ID:22989, to the nucleotide sequence of VGAM2194 RNA, herein designated VGAM RNA, also designated SEQ ID:4905.

Another function of VGAM2194 is therefore inhibition of Chromosome 9 Open Reading Frame 12 (C9orf12, Accession NM_022755). Accordingly, utilities of VGAM2194 include diagnosis, prevention and treatment of diseases and clinical conditions associated with C9orf12. KIAA1813 (Accession XM_046743) is another VGAM2194 host target gene. KIAA1813 BINDING SITE is HOST TARGET binding site found in the 5' untranslated region of mRNA encoded by KIAA1813, corresponding to a HOST TARGET binding site such as BINDING SITE I, BINDING SITE II or BINDING SITE III. Table 2 illustrates the complementarity of the nucleotide sequences of KIAA1813 BINDING SITE, designated SEQ ID:34807, to the nucleotide sequence of VGAM2194 RNA, herein designated VGAM RNA, also designated SEQ ID:4905.

Another function of VGAM2194 is therefore inhibition of KIAA1813 (Accession XM_046743). Accordingly, utilities of VGAM2194 include diagnosis, prevention and treatment of diseases and clinical conditions associated with KIAA1813. Ornithine Decarboxylase Antizyme Inhibitor (OAZIN, Accession NM_015878) is another VGAM2194 host target gene. OAZIN BINDING SITE is HOST TARGET binding site found in the 3' untranslated region of mRNA encoded by OAZIN, corresponding to a HOST TARGET binding site such as BINDING SITE I, BINDING SITE II or BINDING SITE III. Table 2 illustrates the complementarity of the nucleotide sequences of OAZIN BINDING SITE, designated SEQ ID:18023, to the nucleotide sequence of VGAM2194 RNA, herein designated VGAM RNA, also designated SEQ ID:4905.

Another function of VGAM2194 is therefore inhibition of Ornithine Decarboxylase Antizyme Inhibitor (OAZIN, Accession NM_015878). Accordingly, utilities of VGAM2194 include diagnosis, prevention and treatment of diseases and clinical conditions associated with OAZIN. Oncostatin M Receptor (OSMR, Accession NM_003999) is another VGAM2194 host target gene. OSMR BINDING SITE is HOST TARGET binding site found in the 3' untranslated region of mRNA encoded by OSMR, corresponding to a HOST TARGET binding site such as BINDING SITE I, BINDING SITE II or BINDING SITE III. Table 2 illustrates the complementarity of the nucleotide sequences of OSMR BINDING SITE, designated SEQ ID:10149, to the nucleotide sequence of VGAM2194 RNA, herein designated VGAM RNA, also designated SEQ ID:4905.

Another function of VGAM2194 is therefore inhibition of Oncostatin M Receptor (OSMR, Accession NM_003999). Accordingly, utilities of VGAM2194 include diagnosis, prevention and treatment of diseases and clinical conditions associated with OSMR. TSPAN-2 (Accession NM_005725) is another VGAM2194 host target gene. TSPAN-2 BINDING SITE is HOST TARGET binding site found in the 3' untranslated region of mRNA encoded by TSPAN-2, corresponding to a HOST TARGET binding site such as BINDING SITE I, BINDING SITE II or BINDING SITE III. Table 2 illustrates the complementarity of the nucleotide sequences of TSPAN-2 BINDING SITE, designated SEQ ID:12281, to the nucleotide sequence of VGAM2194 RNA, herein designated VGAM RNA, also designated SEQ ID:4905.

Another function of VGAM2194 is therefore inhibition of TSPAN-2 (Accession NM_005725). Accordingly, utilities of VGAM2194 include diagnosis, prevention and treatment of diseases and clinical conditions associated with TSPAN-2. FIG. 1 further provides a conceptual description of a novel bioinformatically detected viral gene of the present invention, referred to here as Viral Genomic Address Messenger 2195 (VGAM2195) viral gene, which modulates expression of respective host target genes thereof, the function and utility of which host target genes is known in the art.

VGAM2195 is a novel bioinformatically detected regulatory, non protein coding, viral micro RNA (miRNA) gene. The method by which VGAM2195 was detected is described hereinabove with reference to FIGS. 1-8.

VGAM2195 gene, herein designated VGAM GENE, is a viral gene contained in the genome of Yaba-like Disease Virus. VGAM2195 host target gene, herein designated VGAM HOST TARGET GENE, is a human gene contained in the human genome.

VGAM2195 gene encodes a VGAM2195 precursor RNA, herein designated VGAM PRECURSOR RNA. Similar to other miRNA genes, and unlike most ordinary genes, VGAM2195 precursor RNA does not encode a protein. A nucleotide sequence identical or highly similar to the nucleotide sequence of VGAM2195 precursor RNA is designated SEQ ID:2181, and is provided hereinbelow with reference to the sequence listing part. Nucleotide sequence SEQ ID:2181 is located at position 9471 relative to the genome of Yaba-like Disease Virus.

VGAM2195 precursor RNA folds onto itself, forming VGAM2195 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2195 folded precursor RNA into VGAM2195 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2195 RNA is designated SEQ ID:4906, and is provided hereinbelow with reference to the sequence listing part.

VGAM2195 host target gene, herein designated VGAM HOST TARGET GENE, encodes a corresponding messenger RNA, VGAM2195 host target RNA, herein designated VGAM HOST TARGET RNA. VGAM2195 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2195 RNA, herein designated VGAM RNA, binds complementarily to one or more host target binding sites located in untranslated regions of VGAM2195 host target RNA, herein designated VGAM HOST TARGET RNA. This complementary binding is due to the fact that the nucleotide sequence of VGAM2195 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2195 RNA, herein designated VGAM RNA, may have a different number of host target binding sites in untranslated regions of a VGAM2195 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2195 RNA, herein designated VGAM RNA, to host target binding sites on VGAM2195 host target RNA, herein designated VGAM HOST TARGET RNA, such as BINDING SITE I, BINDING SITE II and BINDING SITE III, inhibits translation of VGAM2195 host target RNA into VGAM2195 host target protein, herein designated VGAM HOST TARGET PROTEIN. VGAM host target protein is therefore outlined by a broken line.

It is appreciated that VGAM2195 host target gene, herein designated VGAM HOST TARGET GENE, in fact represents a plurality of VGAM2195 host target genes. The mRNA of each one of this plurality of VGAM2195 host target genes comprises one or more host target binding sites, each having a nucleotide sequence which is at least partly complementary to VGAM2195 RNA, herein designated VGAM RNA, and which when bound by VGAM2195 RNA causes inhibition of translation of respective one or more VGAM2195 host target proteins.

It is further appreciated by one skilled in the art that the mode of translational inhibition illustrated by FIG. 1 with specific reference to translational inhibition exerted by VGAM2195 gene, herein designated VGAM GENE, on one or more VGAM2195 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2195 is inhibition of expression of host target genes, as part of a novel viral mechanism of attacking a host. Accordingly, utilities of VGAM2195 include diagnosis, prevention and treatment of viral infection by Yaba-like Disease Virus. Specific functions, and accordingly utilities, of VGAM2195 correlate with, and may be deduced from, the identity of the host target genes which VGAM2195 binds and inhibits, and the function of these host target genes, as elaborated hereinbelow.

Nucleotide sequences of the VGAM2195 precursor RNA, herein designated VGAM PRECURSOR RNA, and of the 'diced' VGAM2195 RNA, herein designated VGAM RNA, and a schematic representation of the secondary folding of VGAM2195 folded precursor RNA, herein designated VGAM FOLDED PRECURSOR RNA, of VGAM2195 are further described hereinbelow with reference to Table 1.

Nucleotide sequences of host target binding sites, such as BINDING SITE-I, BINDING SITE-II and BINDING SITE-III of FIG. 1, found on VGAM2195 host target RNA, and schematic representation of the complementarity of each of these host target binding sites to VGAM2195 RNA, herein designated VGAM RNA, are described hereinbelow with reference to Table 2.

As mentioned hereinabove with reference to FIG. 1, a function of VGAM2195 gene, herein designated VGAM is inhibition of expression of VGAM2195 target genes. It is appreciated that specific functions, and accordingly utilities, of VGAM2195 correlate with, and may be deduced from, the identity of the target genes which VGAM2195 binds and inhibits, and the function of these target genes, as elaborated hereinbelow.

LOC256846 (Accession XM_170921) is a VGAM2195 host target gene. LOC256846 BINDING SITE is HOST TARGET binding site found in the 5' untranslated region of mRNA encoded by LOC256846, corresponding to a HOST TARGET binding site such as BINDING SITE I, BINDING SITE II or BINDING SITE III. Table 2 illustrates the complementarity of the nucleotide sequences of LOC256846 BINDING SITE, designated SEQ ID:45695, to the nucleotide sequence of VGAM2195 RNA, herein designated VGAM RNA, also designated SEQ ID:4906.

A function of VGAM2195 is therefore inhibition of LOC256846 (Accession XM_170921). Accordingly, utilities of VGAM2195 include diagnosis, prevention and treatment of diseases and clinical conditions associated with LOC256846. FIG. 1 further provides a conceptual description of a novel bioinformatically detected viral gene of the present invention, referred to here as Viral Genomic Address Messenger 2196 (VGAM2196) viral gene, which modulates expression of respective host target genes thereof, the function and utility of which host target genes is known in the art.

VGAM2196 is a novel bioinformatically detected regulatory, non protein coding, viral micro RNA (miRNA) gene. The method by which VGAM2196 was detected is described hereinabove with reference to FIGS. 1-8.

VGAM2196 gene, herein designated VGAM GENE, is a viral gene contained in the genome of Yaba-like Disease Virus. VGAM2196 host target gene, herein designated VGAM HOST TARGET GENE, is a human gene contained in the human genome.

VGAM2196 gene encodes a VGAM2196 precursor RNA, herein designated VGAM PRECURSOR RNA. Similar to other miRNA genes, and unlike most ordinary genes, VGAM2196 precursor RNA does not encode a protein. A nucleotide sequence identical or highly similar to the nucleotide sequence of VGAM2196 precursor RNA is designated SEQ ID:2182, and is provided hereinbelow with reference to the sequence listing part. Nucleotide sequence SEQ ID:2182 is located at position 11842 relative to the genome of Yaba-like Disease Virus.

VGAM2196 precursor RNA folds onto itself, forming VGAM2196 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2196 folded precursor RNA into VGAM2196 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2196 RNA is designated SEQ ID:4907, and is provided hereinbelow with reference to the sequence listing part.

VGAM2196 host target gene, herein designated VGAM HOST TARGET GENE, encodes a corresponding messenger RNA, VGAM2196 host target RNA, herein designated VGAM HOST TARGET RNA. VGAM2196 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2196 RNA, herein designated VGAM RNA, binds complementarily to one or more host target binding sites located in untranslated regions of VGAM2196 host target RNA, herein designated VGAM HOST TARGET RNA. This complementary binding is due to the fact that the nucleotide sequence of VGAM2196 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2196 RNA, herein designated VGAM RNA, may have a different number of host target binding sites in untranslated regions of a VGAM2196 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2196 RNA, herein designated VGAM RNA, to host target binding sites on VGAM2196 host target RNA, herein designated VGAM HOST TARGET RNA, such as BINDING SITE I, BINDING SITE II and BINDING SITE III, inhibits translation of VGAM2196 host target RNA into VGAM2196 host target protein, herein designated VGAM HOST TARGET PROTEIN. VGAM host target protein is therefore outlined by a broken line.

It is appreciated that VGAM2196 host target gene, herein designated VGAM HOST TARGET GENE, in fact represents a plurality of VGAM2196 host target genes. The mRNA of each one of this plurality of VGAM2196 host target genes comprises one or more host target binding sites, each having a nucleotide sequence which is at least partly complementary to VGAM2196 RNA, herein designated VGAM RNA, and which when bound by VGAM2196 RNA causes inhibition of translation of respective one or more VGAM2196 host target proteins.

It is further appreciated by one skilled in the art that the mode of translational inhibition illustrated by FIG. 1 with specific reference to translational inhibition exerted by VGAM2196 gene, herein designated VGAM GENE, on one or more VGAM2196 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2196 is inhibition of expression of host target genes, as part of a novel viral mechanism of attacking a host. Accordingly, utilities of VGAM2196 include diagnosis, prevention and treatment of viral infection by Yaba-like Disease Virus. Specific functions, and accordingly utilities, of VGAM2196 correlate with, and may be deduced from, the identity of the host target genes which VGAM2196 binds and inhibits, and the function of these host target genes, as elaborated hereinbelow.

Nucleotide sequences of the VGAM2196 precursor RNA, herein designated VGAM PRECURSOR RNA, and of the 'diced' VGAM2196 RNA, herein designated VGAM RNA, and a schematic representation of the secondary folding of VGAM2196 folded precursor RNA, herein designated VGAM FOLDED PRECURSOR RNA, of VGAM2196 are further described hereinbelow with reference to Table 1.

Nucleotide sequences of host target binding sites, such as BINDING SITE-I, BINDING SITE-II and BINDING SITE-III of FIG. 1, found on VGAM2196 host target RNA, and schematic representation of the complementarity of each of these host target binding sites to VGAM2196 RNA, herein designated VGAM RNA, are described hereinbelow with reference to Table 2.

As mentioned hereinabove with reference to FIG. 1, a function of VGAM2196 gene, herein designated VGAM is inhibition of expression of VGAM2196 target genes. It is appreciated that specific functions, and accordingly utilities, of VGAM2196 correlate with, and may be deduced from, the identity of the target genes which VGAM2196 binds and inhibits, and the function of these target genes, as elaborated hereinbelow.

Tripartite Motif-containing 34 (TRIM34, Accession NM_021616) is a VGAM2196 host target gene. TRIM34 BINDING SITE1 and TRIM34 BINDING SITE2 are HOST TARGET binding sites found in untranslated regions of mRNA encoded by TRIM34, corresponding to HOST TARGET binding sites such as BINDING SITE I, BINDING SITE II or BINDING SITE III. Table 2 illustrates the complementarity of the nucleotide sequences of TRIM34 BINDING SITE1 and TRIM34 BINDING SITE2, designated SEQ ID:22248 and SEQ ID:28172 respectively, to the nucleotide sequence of VGAM2196 RNA, herein designated VGAM RNA, also designated SEQ ID:4907.

A function of VGAM2196 is therefore inhibition of Tripartite Motif-containing 34 (TRIM34, Accession NM_021616). Accordingly, utilities of VGAM2196 include diagnosis, prevention and treatment of diseases and clinical conditions associated with TRIM34. FIG. 1 further provides a conceptual description of a novel bioinformatically detected viral gene of the present invention, referred to here as Viral Genomic Address Messenger 2197 (VGAM2197) viral gene, which modulates expression of respective host target genes thereof, the function and utility of which host target genes is known in the art.

VGAM2197 is a novel bioinformatically detected regulatory, non protein coding, viral micro RNA (miRNA) gene. The method by which VGAM2197 was detected is described hereinabove with reference to FIGS. 1-8.

VGAM2197 gene, herein designated VGAM GENE, is a viral gene contained in the genome of Yaba-like Disease Virus. VGAM2197 host target gene, herein designated VGAM HOST TARGET GENE, is a human gene contained in the human genome.

VGAM2197 gene encodes a VGAM2197 precursor RNA, herein designated VGAM PRECURSOR RNA. Similar to other miRNA genes, and unlike most ordinary genes, VGAM2197 precursor RNA does not encode a protein. A nucleotide sequence identical or highly similar to the nucleotide sequence of VGAM2197 precursor RNA is designated SEQ ID:2183, and is provided hereinbelow with reference to the sequence listing part. Nucleotide sequence SEQ ID:2183 is located at position 6543 relative to the genome of Yaba-like Disease Virus.

VGAM2197 precursor RNA folds onto itself, forming VGAM2197 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2197 folded precursor RNA into VGAM2197 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2197 RNA is designated SEQ ID:4908, and is provided hereinbelow with reference to the sequence listing part.

VGAM2197 host target gene, herein designated VGAM HOST TARGET GENE, encodes a corresponding messenger RNA, VGAM2197 host target RNA, herein designated VGAM HOST TARGET RNA. VGAM2197 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2197 RNA, herein designated VGAM RNA, binds complementarily to one or more host target binding sites located in untranslated regions of VGAM2197 host target RNA, herein designated VGAM HOST TARGET RNA. This complementary binding is due to the fact that the nucleotide sequence of VGAM2197 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2197 RNA, herein designated VGAM RNA, may have a different number of host target binding sites in untranslated regions of a VGAM2197 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2197 RNA, herein designated VGAM RNA, to host target binding sites on VGAM2197 host target RNA, herein designated VGAM HOST TARGET RNA, such as BINDING SITE I, BINDING SITE II and BINDING SITE III, inhibits translation of VGAM2197 host target RNA into VGAM2197 host target protein, herein designated VGAM HOST TARGET PROTEIN. VGAM host target protein is therefore outlined by a broken line.

It is appreciated that VGAM2197 host target gene, herein designated VGAM HOST TARGET GENE, in fact represents a plurality of VGAM2197 host target genes. The mRNA of each one of this plurality of VGAM2197 host target genes comprises one or more host target binding sites, each having a nucleotide sequence which is at least partly complementary to VGAM2197 RNA, herein designated VGAM RNA, and which when bound by VGAM2197 RNA causes inhibition of translation of respective one or more VGAM2197 host target proteins.

It is further appreciated by one skilled in the art that the mode of translational inhibition illustrated by FIG. 1 with specific reference to translational inhibition exerted by VGAM2197 gene, herein designated VGAM GENE, on one or more VGAM2197 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2197 is inhibition of expression of host target genes, as part of a novel viral mechanism of attacking a host. Accordingly, utilities of VGAM2197 include diagnosis, prevention and treatment of viral infection by Yaba-like Disease Virus. Specific functions, and accordingly utilities, of VGAM2197 correlate with, and may be deduced from, the identity of the host target genes which VGAM2197 binds and inhibits, and the function of these host target genes, as elaborated hereinbelow.

Nucleotide sequences of the VGAM2197 precursor RNA, herein designated VGAM PRECURSOR RNA, and of the 'diced' VGAM2197 RNA, herein designated VGAM RNA, and a schematic representation of the secondary folding of VGAM2197 folded precursor RNA, herein designated VGAM FOLDED PRECURSOR RNA, of VGAM2197 are further described hereinbelow with reference to Table 1.

Nucleotide sequences of host target binding sites, such as BINDING SITE-I, BINDING SITE-II and BINDING SITE-III of FIG. 1, found on VGAM2197 host target RNA, and schematic representation of the complementarity of each of these host target binding sites to VGAM2197 RNA, herein designated VGAM RNA, are described hereinbelow with reference to Table 2.

As mentioned hereinabove with reference to FIG. 1, a function of VGAM2197 gene, herein designated VGAM is inhibition of expression of VGAM2197 target genes. It is appreciated that specific functions, and accordingly utilities, of VGAM2197 correlate with, and may be deduced from, the identity of the target genes which VGAM2197 binds and inhibits, and the function of these target genes, as elaborated hereinbelow.

Caspase Recruitment Domain Family, Member 4 (CARD4, Accession NM_006092) is a VGAM2197 host target gene. CARD4 BINDING SITE is HOST TARGET binding site found in the 3' untranslated region of mRNA encoded by CARD4, corresponding to a HOST TARGET binding site such as BINDING SITE I, BINDING SITE II or BINDING SITE III. Table 2 illustrates the complementarity of the nucleotide sequences of CARD4 BINDING SITE, designated SEQ ID:12742, to the nucleotide sequence of VGAM2197 RNA, herein designated VGAM RNA, also designated SEQ ID:4908.

A function of VGAM2197 is therefore inhibition of Caspase Recruitment Domain Family, Member 4 (CARD4, Accession NM_006092), a gene which Activates CASP9 to induce apoptosis, regulates activation of NF-kappaB. Accordingly, utilities of VGAM2197 include diagnosis, prevention and treatment of diseases and clinical conditions associated with CARD4. The function of CARD4 and its association with various diseases and clinical conditions, has been established by previous studies, as described hereinabove with reference to VGAM492. Chemokine (C-X-C motif) Receptor 6 (CXCR6, Accession NM_006564) is another VGAM2197 host target gene. CXCR6 BINDING SITE is HOST TARGET binding site found in the 3' untranslated region of mRNA encoded by CXCR6, corresponding to a HOST TARGET binding site such as BINDING SITE I, BINDING SITE II or BINDING SITE III. Table 2 illustrates the complementarity of the nucleotide sequences of CXCR6 BINDING SITE, designated SEQ ID:13334, to the nucleotide sequence of VGAM2197 RNA, herein designated VGAM RNA, also designated SEQ ID:4908.

Another function of VGAM2197 is therefore inhibition of Chemokine (C-X-C motif) Receptor 6 (CXCR6, Accession NM_006564), a gene which probably interacts between dendritic cells and T cells and regulates T-cell migration. Accordingly, utilities of VGAM2197 include diagnosis, prevention and treatment of diseases and clinical conditions associated with CXCR6. The function of CXCR6 and its association with various diseases and clinical conditions, has been established by previous studies, as described hereinabove with reference to VGAM2144. Phosphoribosyl Pyrophosphate Synthetase-associated Protein 1 (PRPSAP1, Accession NM_002766) is another VGAM2197 host target gene. PRPSAP1 BINDING SITE is HOST TARGET binding site found in the 3' untranslated region of mRNA encoded by PRPSAP1, corresponding to a HOST TARGET binding site such as BINDING SITE I, BINDING SITE II or BINDING SITE III.

Table 2 illustrates the complementarity of the nucleotide sequences of PRPSAP1 BINDING SITE, designated SEQ ID:8659, to the nucleotide sequence of VGAM2197 RNA, herein designated VGAM RNA, also designated SEQ ID:4908.

Another function of VGAM2197 is therefore inhibition of Phosphoribosyl Pyrophosphate Synthetase-associated Protein 1 (PRPSAP1, Accession NM_002766), a gene which catalyzes the formation of PRPP from ATP and ribose 5-phosphate. Accordingly, utilities of VGAM2197 include diagnosis, prevention and treatment of diseases and clinical conditions associated with PRPSAP1. The function of PRPSAP1 and its association with various diseases and clinical conditions, has been established by previous studies, as described hereinabove with reference to VGAM914. SH3 and Multiple Ankyrin Repeat Domains 2 (SHANK2, Accession NM_012309) is another VGAM2197 host target gene. SHANK2 BINDING SITE is HOST TARGET binding site found in the 3' untranslated region of mRNA encoded by SHANK2, corresponding to a HOST TARGET binding site such as BINDING SITE I, BINDING SITE II or BINDING SITE III. Table 2 illustrates the complementarity of the nucleotide sequences of SHANK2 BINDING SITE, designated SEQ ID:14683, to the nucleotide sequence of VGAM2197 RNA, herein designated VGAM RNA, also designated SEQ ID:4908.

Another function of VGAM2197 is therefore inhibition of SH3 and Multiple Ankyrin Repeat Domains 2 (SHANK2, Accession NM_012309). Accordingly, utilities of VGAM2197 include diagnosis, prevention and treatment of diseases and clinical conditions associated with SHANK2. SMURF1 (Accession XM_166483) is another VGAM2197 host target gene. SMURF1 BINDING SITE is HOST TARGET binding site found in the 3' untranslated region of mRNA encoded by SMURF1, corresponding to a HOST TARGET binding site such as BINDING SITE I, BINDING SITE II or BINDING SITE III. Table 2 illustrates the complementarity of the nucleotide sequences of SMURF1 BINDING SITE, designated SEQ ID:44417, to the nucleotide sequence of VGAM2197 RNA, herein designated VGAM RNA, also designated SEQ ID:4908.

Another function of VGAM2197 is therefore inhibition of SMURF1 (Accession XM_166483). Accordingly, utilities of VGAM2197 include diagnosis, prevention and treatment of diseases and clinical conditions associated with SMURF1. TEM6 (Accession NM_022748) is another VGAM2197 host target gene. TEM6 BINDING SITE is HOST TARGET binding site found in the 3' untranslated region of mRNA encoded by TEM6, corresponding to a HOST TARGET binding site such as BINDING SITE I, BINDING SITE II or BINDING SITE III. Table 2 illustrates the complementarity of the nucleotide sequences of TEM6 BINDING SITE, designated SEQ ID:22962, to the nucleotide sequence of VGAM2197 RNA, herein designated VGAM RNA, also designated SEQ ID:4908.

Another function of VGAM2197 is therefore inhibition of TEM6 (Accession NM_022748), a gene which displays elevated expression during tumor angiogenesis. Accordingly, utilities of VGAM2197 include diagnosis, prevention and treatment of diseases and clinical conditions associated with TEM6. The function of TEM6 and its association with various diseases and clinical conditions, has been established by previous studies, as described hereinabove with reference to VGAM175. Chromosome 1 Open Reading Frame 9 (C1orf9, Accession NM_016227) is another VGAM2197 host target gene. C1orf9 BINDING SITE is HOST TARGET binding site found in the 3' untranslated region of mRNA encoded by C1orf9, corresponding to a HOST TARGET binding site such as BINDING SITE I, BINDING SITE II or BINDING SITE III. Table 2 illustrates the complementarity of the nucleotide sequences of C1orf9 BINDING SITE, designated SEQ ID:18340, to the nucleotide sequence of VGAM2197 RNA, herein designated VGAM RNA, also designated SEQ ID:4908.

Another function of VGAM2197 is therefore inhibition of Chromosome 1 Open Reading Frame 9 (C1orf9, Accession NM_016227). Accordingly, utilities of VGAM2197 include diagnosis, prevention and treatment of diseases and clinical conditions associated with C1orf9. Chromosome 20 Open Reading Frame 4 (C20orf4, Accession NM_015511) is another VGAM2197 host target gene. C20orf4 BINDING SITE is HOST TARGET binding site found in the 3' untranslated region of mRNA encoded by C20orf4, corresponding to a HOST TARGET binding site such as BINDING SITE I, BINDING SITE II or BINDING SITE III. Table 2 illustrates the complementarity of the nucleotide sequences of C20orf4 BINDING SITE, designated SEQ ID:17773, to the nucleotide sequence of VGAM2197 RNA, herein designated VGAM RNA, also designated SEQ ID:4908.

Another function of VGAM2197 is therefore inhibition of Chromosome 20 Open Reading Frame 4 (C20orf4, Accession NM_015511). Accordingly, utilities of VGAM2197 include diagnosis, prevention and treatment of diseases and clinical conditions associated with C20orf4. Deiodinase, Iodothyronine, Type II (DIO2, Accession NM_000793) is another VGAM2197 host target gene. DIO2 BINDING SITE1 and DIO2 BINDING SITE2 are HOST TARGET binding sites found in untranslated regions of mRNA encoded by DIO2, corresponding to HOST TARGET binding sites such as BINDING SITE I, BINDING SITE II or BINDING SITE III. Table 2 illustrates the complementarity of the nucleotide sequences of DIO2 BINDING SITE1 and DIO2 BINDING SITE2, designated SEQ ID:6463 and SEQ ID:15174 respectively, to the nucleotide sequence of VGAM2197 RNA, herein designated VGAM RNA, also designated SEQ ID:4908.

Another function of VGAM2197 is therefore inhibition of Deiodinase, Iodothyronine, Type II (DIO2, Accession NM_000793). Accordingly, utilities of VGAM2197 include diagnosis, prevention and treatment of diseases and clinical conditions associated with DIO2. HSH2 (Accession NM_032855) is another VGAM2197 host target gene. HSH2 BINDING SITE is HOST TARGET binding site found in the 3' untranslated region of mRNA encoded by HSH2, corresponding to a HOST TARGET binding site such as BINDING SITE I, BINDING SITE II or BINDING SITE III. Table 2 illustrates the complementarity of the nucleotide sequences of HSH2 BINDING SITE, designated SEQ ID:26655, to the nucleotide sequence of VGAM2197 RNA, herein designated VGAM RNA, also designated SEQ ID:4908.

Another function of VGAM2197 is therefore inhibition of HSH2 (Accession NM_032855). Accordingly, utilities of VGAM2197 include diagnosis, prevention and treatment of diseases and clinical conditions associated with HSH2. KIAA0322 (Accession XM_166591) is another VGAM2197 host target gene. KIAA0322 BINDING SITE is HOST TARGET binding site found in the 3' untranslated region of mRNA encoded by KIAA0322, corresponding to a HOST TARGET binding site such as BINDING SITE I, BINDING SITE II or BINDING SITE III. Table 2 illustrates the complementarity of the nucleotide sequences of KIAA0322 BINDING SITE, designated SEQ ID:44561, to the nucleotide sequence of VGAM2197 RNA, herein designated VGAM RNA, also designated SEQ ID:4908.

Another function of VGAM2197 is therefore inhibition of KIAA0322 (Accession XM_166591). Accordingly, utilities of VGAM2197 include diagnosis, prevention and treatment of diseases and clinical conditions associated with KIAA0322. KIAA0700 (Accession XM_050561) is another VGAM2197 host target gene. KIAA0700 BINDING SITE is HOST TARGET binding site found in the 3' untranslated region of mRNA encoded by KIAA0700, corresponding to a HOST TARGET binding site such as BINDING SITE I, BINDING SITE II or BINDING SITE III. Table 2 illustrates the complementarity of the nucleotide sequences of KIAA0700 BINDING SITE, designated SEQ ID:35661, to the nucleotide sequence of VGAM2197 RNA, herein designated VGAM RNA, also designated SEQ ID:4908.

Another function of VGAM2197 is therefore inhibition of KIAA0700 (Accession XM_050561). Accordingly, utilities of VGAM2197 include diagnosis, prevention and treatment of diseases and clinical conditions associated with KIAA0700. KIAA1045 (Accession XM_048592) is another VGAM2197 host target gene. KIAA1045 BINDING SITE is HOST TARGET binding site found in the 3' untranslated region of mRNA encoded by KIAA1045, corresponding to a HOST TARGET binding site such as BINDING SITE I, BINDING SITE II or BINDING SITE III. Table 2 illustrates the complementarity of the nucleotide sequences of KIAA1045 BINDING SITE, designated SEQ ID:35197, to the nucleotide sequence of VGAM2197 RNA, herein designated VGAM RNA, also designated SEQ ID:4908.

Another function of VGAM2197 is therefore inhibition of KIAA1045 (Accession XM_048592). Accordingly, utilities of VGAM2197 include diagnosis, prevention and treatment of diseases and clinical conditions associated with KIAA1045. KIAA1163 (Accession XM_086231) is another VGAM2197 host target gene. KIAA1163 BINDING SITE is HOST TARGET binding site found in the 3' untranslated region of mRNA encoded by KIAA1163, corresponding to a HOST TARGET binding site such as BINDING SITE I, BINDING SITE II or BINDING SITE III. Table 2 illustrates the complementarity of the nucleotide sequences of KIAA1163 BINDING SITE, designated SEQ ID:38558, to the nucleotide sequence of VGAM2197 RNA, herein designated VGAM RNA, also designated SEQ ID:4908.

Another function of VGAM2197 is therefore inhibition of KIAA1163 (Accession XM_086231). Accordingly, utilities of VGAM2197 include diagnosis, prevention and treatment of diseases and clinical conditions associated with KIAA1163. KIAA1673 (Accession XM_047672) is another VGAM2197 host target gene. KIAA1673 BINDING SITE is HOST TARGET binding site found in the 3' untranslated region of mRNA encoded by KIAA1673, corresponding to a HOST TARGET binding site such as BINDING SITE I, BINDING SITE II or BINDING SITE III. Table 2 illustrates the complementarity of the nucleotide sequences of KIAA1673 BINDING SITE, designated SEQ ID:35028, to the nucleotide sequence of VGAM2197 RNA, herein designated VGAM RNA, also designated SEQ ID:4908.

Another function of VGAM2197 is therefore inhibition of KIAA1673 (Accession XM_047672). Accordingly, utilities of VGAM2197 include diagnosis, prevention and treatment of diseases and clinical conditions associated with KIAA1673. MGC4172 (Accession NM_024308) is another VGAM2197 host target gene. MGC4172 BINDING SITE is HOST TARGET binding site found in the 3' untranslated region of mRNA encoded by MGC4172, corresponding to a HOST TARGET binding site such as BINDING SITE I, BINDING SITE II or BINDING SITE III. Table 2 illustrates the complementarity of the nucleotide sequences of MGC4172 BINDING SITE, designated SEQ ID:23602, to the nucleotide sequence of VGAM2197 RNA, herein designated VGAM RNA, also designated SEQ ID:4908.

Another function of VGAM2197 is therefore inhibition of MGC4172 (Accession NM_024308). Accordingly, utilities of VGAM2197 include diagnosis, prevention and treatment of diseases and clinical conditions associated with MGC4172. LOC132332 (Accession XM_072306) is another VGAM2197 host target gene. LOC132332 BINDING SITE is HOST TARGET binding site found in the 3' untranslated region of mRNA encoded by LOC132332, corresponding to a HOST TARGET binding site such as BINDING SITE I, BINDING SITE II or BINDING SITE III. Table 2 illustrates the complementarity of the nucleotide sequences of LOC132332 BINDING SITE, designated SEQ ID:37489, to the nucleotide sequence of VGAM2197 RNA, herein designated VGAM RNA, also designated SEQ ID:4908.

Another function of VGAM2197 is therefore inhibition of LOC132332 (Accession XM_072306). Accordingly, utilities of VGAM2197 include diagnosis, prevention and treatment of diseases and clinical conditions associated with LOC132332. LOC138654 (Accession XM_071015) is another VGAM2197 host target gene. LOC138654 BINDING SITE is HOST TARGET binding site found in the 5' untranslated region of mRNA encoded by LOC138654, corresponding to a HOST TARGET binding site such as BINDING SITE I, BINDING SITE II or BINDING SITE III. Table 2 illustrates the complementarity of the nucleotide sequences of LOC138654 BINDING SITE, designated SEQ ID:37398, to the nucleotide sequence of VGAM2197 RNA, herein designated VGAM RNA, also designated SEQ ID:4908.

Another function of VGAM2197 is therefore inhibition of LOC138654 (Accession XM_071015). Accordingly, utilities of VGAM2197 include diagnosis, prevention and treatment of diseases and clinical conditions associated with LOC138654. LOC149670 (Accession XM_086647) is another VGAM2197 host target gene. LOC149670 BINDING SITE is HOST TARGET binding site found in the 3' untranslated region of mRNA encoded by LOC149670, corresponding to a HOST TARGET binding site such as BINDING SITE I, BINDING SITE II or BINDING SITE III. Table 2 illustrates the complementarity of the nucleotide sequences of LOC149670 BINDING SITE, designated SEQ ID:38807, to the nucleotide sequence of VGAM2197 RNA, herein designated VGAM RNA, also designated SEQ ID:4908.

Another function of VGAM2197 is therefore inhibition of LOC149670 (Accession XM_086647). Accordingly, utilities of VGAM2197 include diagnosis, prevention and treatment of diseases and clinical conditions associated with LOC149670. LOC157695 (Accession XM_098811) is another VGAM2197 host target gene. LOC157695 BINDING SITE is HOST TARGET binding site found in the 5' untranslated region of mRNA encoded by LOC157695, corresponding to a HOST TARGET binding site such as BINDING SITE I, BINDING SITE II or BINDING SITE III. Table 2 illustrates the complementarity of the nucleotide sequences of LOC157695 BINDING SITE, designated SEQ ID:41831, to the nucleotide sequence of VGAM2197 RNA, herein designated VGAM RNA, also designated SEQ ID:4908.

Another function of VGAM2197 is therefore inhibition of LOC157695 (Accession XM_098811). Accordingly, utilities of VGAM2197 include diagnosis, prevention and treatment of diseases and clinical conditions associated with LOC157695. FIG. 1 further provides a conceptual description of a novel bioinformatically detected viral gene of the present invention, referred to here as Viral Genomic Address Messenger 2198 (VGAM2198) viral gene, which modulates expression of respective host target genes thereof, the function and utility of which host target genes is known in the art.

VGAM2198 is a novel bioinformatically detected regulatory, non protein coding, viral micro RNA (miRNA) gene. The method by which VGAM2198 was detected is described hereinabove with reference to FIGS. 1-8.

VGAM2198 gene, herein designated VGAM GENE, is a viral gene contained in the genome of Yaba-like Disease Virus. VGAM2198 host target gene, herein designated VGAM HOST TARGET GENE, is a human gene contained in the human genome.

VGAM2198 gene encodes a VGAM2198 precursor RNA, herein designated VGAM PRECURSOR RNA. Similar to other miRNA genes, and unlike most ordinary genes, VGAM2198 precursor RNA does not encode a protein. A nucleotide sequence identical or highly similar to the nucleotide sequence of VGAM2198 precursor RNA is designated SEQ ID:2184, and is provided hereinbelow with reference to the sequence listing part. Nucleotide sequence SEQ ID:2184 is located at position 22309 relative to the genome of Yaba-like Disease Virus.

VGAM2198 precursor RNA folds onto itself, forming VGAM2198 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2198 folded precursor RNA into VGAM2198 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2198 RNA is designated SEQ ID:4909, and is provided hereinbelow with reference to the sequence listing part.

VGAM2198 host target gene, herein designated VGAM HOST TARGET GENE, encodes a corresponding messenger RNA, VGAM2198 host target RNA, herein designated VGAM HOST TARGET RNA. VGAM2198 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2198 RNA, herein designated VGAM RNA, binds complementarily to one or more host target binding sites located in untranslated regions of VGAM2198 host target RNA, herein designated VGAM HOST TARGET RNA. This complementary binding is due to the fact that the nucleotide sequence of VGAM2198 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2198 RNA, herein designated VGAM RNA, may have a different number of host target binding sites in untranslated regions of a VGAM2198 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2198 RNA, herein designated VGAM RNA, to host target binding sites on VGAM2198 host target RNA, herein designated VGAM HOST TARGET RNA, such as BINDING SITE I, BINDING SITE II and BINDING SITE III, inhibits translation of VGAM2198 host target RNA into VGAM2198 host target protein, herein designated VGAM HOST TARGET PROTEIN. VGAM host target protein is therefore outlined by a broken line.

It is appreciated that VGAM2198 host target gene, herein designated VGAM HOST TARGET GENE, in fact represents a plurality of VGAM2198 host target genes. The mRNA of each one of this plurality of VGAM2198 host target genes comprises one or more host target binding sites, each having a nucleotide sequence which is at least partly complementary to VGAM2198 RNA, herein designated VGAM RNA, and which when bound by VGAM2198 RNA causes inhibition of translation of respective one or more VGAM2198 host target proteins.

It is further appreciated by one skilled in the art that the mode of translational inhibition illustrated by FIG. 1 with specific reference to translational inhibition exerted by VGAM2198 gene, herein designated VGAM GENE, on one or more VGAM2198 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2198 is inhibition of expression of host target genes, as part of a novel viral mechanism of attacking a host. Accordingly, utilities of VGAM2198 include diagnosis, prevention and treatment of viral infection by Yaba-like Disease Virus. Specific functions, and accordingly utilities, of VGAM2198 correlate with, and may be deduced from, the identity of the host target genes which VGAM2198 binds and inhibits, and the function of these host target genes, as elaborated hereinbelow.

Nucleotide sequences of the VGAM2198 precursor RNA, herein designated VGAM PRECURSOR RNA, and of the 'diced' VGAM2198 RNA, herein designated VGAM RNA, and a schematic representation of the secondary folding of VGAM2198 folded precursor RNA, herein designated VGAM FOLDED PRECURSOR RNA, of VGAM2198 are further described hereinbelow with reference to Table 1.

Nucleotide sequences of host target binding sites, such as BINDING SITE-I, BINDING SITE-II and BINDING SITE-III of FIG. 1, found on VGAM2198 host target RNA, and schematic representation of the complementarity of each of these host target binding sites to VGAM2198 RNA, herein designated VGAM RNA, are described hereinbelow with reference to Table 2.

As mentioned hereinabove with reference to FIG. 1, a function of VGAM2198 gene, herein designated VGAM is inhibition of expression of VGAM2198 target genes. It is appreciated that specific functions, and accordingly utilities, of VGAM2198 correlate with, and may be deduced from, the identity of the target genes which VGAM2198 binds and inhibits, and the function of these target genes, as elaborated hereinbelow.

Collagen, Type IV, Alpha 5 (Alport syndrome) (COL4A5, Accession NM_000495) is a VGAM2198 host target gene. COL4A5 BINDING SITE1 through COL4A5 BINDING SITE3 are HOST TARGET binding sites found in untranslated regions of mRNA encoded by COL4A5, corresponding to HOST TARGET binding sites such as BINDING SITE I, BINDING SITE II or BINDING SITE III. Table 2 illustrates the complementarity of the nucleotide sequences of COL4A5 BINDING SITE1 through COL4A5 BINDING SITE3, designated SEQ ID:6108, SEQ ID:27211 and SEQ ID:27214 respectively, to the nucleotide sequence of VGAM2198 RNA, herein designated VGAM RNA, also designated SEQ ID:4909.

A function of VGAM2198 is therefore inhibition of Collagen, Type IV, Alpha 5 (Alport syndrome) (COL4A5, Accession NM_000495). Accordingly, utilities of VGAM2198 include diagnosis, prevention and treatment of diseases and clinical conditions associated with COL4A5. MGC10646 (Accession NM_032693) is another VGAM2198 host target gene. MGC10646 BINDING SITE is HOST TARGET binding site found in the 3' untranslated region of mRNA encoded by MGC10646, corresponding to a HOST TARGET binding site such as BINDING SITE I, BINDING SITE II or BINDING SITE III. Table 2 illustrates the complementarity of the nucleotide sequences of MGC10646 BINDING SITE, designated SEQ ID:26413, to the nucleotide sequence of VGAM2198 RNA, herein designated VGAM RNA, also designated SEQ ID:4909.

Another function of VGAM2198 is therefore inhibition of MGC10646 (Accession NM_032693). Accordingly, utilities of VGAM2198 include diagnosis, prevention and treatment of diseases and clinical conditions associated with MGC10646. FIG. 1 further provides a conceptual description of a novel bioinformatically detected viral gene of the present invention, referred to here as Viral Genomic Address Messenger 2199 (VGAM2199) viral gene, which modulates expression of respective host target genes thereof, the function and utility of which host target genes is known in the art.

VGAM2199 is a novel bioinformatically detected regulatory, non protein coding, viral micro RNA (miRNA) gene. The method by which VGAM2199 was detected is described hereinabove with reference to FIGS. 1-8.

VGAM2199 gene, herein designated VGAM GENE, is a viral gene contained in the genome of Yaba-like Disease Virus. VGAM2199 host target gene, herein designated VGAM HOST TARGET GENE, is a human gene contained in the human genome.

VGAM2199 gene encodes a VGAM2199 precursor RNA, herein designated VGAM PRECURSOR RNA. Similar to other miRNA genes, and unlike most ordinary genes, VGAM2199 precursor RNA does not encode a protein. A nucleotide sequence identical or highly similar to the nucleotide sequence of VGAM2199 precursor RNA is designated SEQ ID:2185, and is provided hereinbelow with reference to the sequence listing part. Nucleotide sequence SEQ ID:2185 is located at position 3375 relative to the genome of Yaba-like Disease Virus.

VGAM2199 precursor RNA folds onto itself, forming VGAM2199 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2199 folded precursor RNA into VGAM2199 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2199 RNA is designated SEQ ID:4910, and is provided hereinbelow with reference to the sequence listing part.

VGAM2199 host target gene, herein designated VGAM HOST TARGET GENE, encodes a corresponding messenger RNA, VGAM2199 host target RNA, herein designated VGAM HOST TARGET RNA. VGAM2199 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2199 RNA, herein designated VGAM RNA, binds complementarily to one or more host target binding sites located in untranslated regions of VGAM2199 host target RNA, herein designated VGAM HOST TARGET RNA. This complementary binding is due to the fact that the nucleotide sequence of VGAM2199 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2199 RNA, herein designated VGAM RNA, may have a different number of host target binding sites in untranslated regions of a VGAM2199 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2199 RNA, herein designated VGAM RNA, to host target binding sites on VGAM2199 host target RNA, herein designated VGAM HOST TARGET RNA, such as BINDING SITE I, BINDING SITE II and BINDING SITE III, inhibits translation of VGAM2199 host target RNA into VGAM2199 host target protein, herein designated VGAM HOST TARGET PROTEIN. VGAM host target protein is therefore outlined by a broken line.

It is appreciated that VGAM2199 host target gene, herein designated VGAM HOST TARGET GENE, in fact represents a plurality of VGAM2199 host target genes. The mRNA of each one of this plurality of VGAM2199 host target genes comprises one or more host target binding sites, each having a nucleotide sequence which is at least partly complementary to VGAM2199 RNA, herein designated VGAM RNA, and which when bound by VGAM2199 RNA causes inhibition of translation of respective one or more VGAM2199 host target proteins.

It is further appreciated by one skilled in the art that the mode of translational inhibition illustrated by FIG. 1 with specific reference to translational inhibition exerted by VGAM2199 gene, herein designated VGAM GENE, on one or more VGAM2199 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2199 is inhibition of expression of host target genes, as part of a novel viral mechanism of attacking a host. Accordingly, utilities of VGAM2199 include diagnosis, prevention and treatment of viral infection by Yaba-like Disease Virus. Specific functions, and accordingly utilities, of VGAM2199 correlate with, and may be deduced from, the identity of the host target genes which VGAM2199 binds and inhibits, and the function of these host target genes, as elaborated hereinbelow.

Nucleotide sequences of the VGAM2199 precursor RNA, herein designated VGAM PRECURSOR RNA, and of the 'diced' VGAM2199 RNA, herein designated VGAM RNA, and a schematic representation of the secondary folding of VGAM2199 folded precursor RNA, herein designated VGAM FOLDED PRECURSOR RNA, of VGAM2199 are further described hereinbelow with reference to Table 1.

Nucleotide sequences of host target binding sites, such as BINDING SITE-I, BINDING SITE-II and BINDING SITE-III of FIG. 1, found on VGAM2199 host target RNA, and schematic representation of the complementarity of each of these host target binding sites to VGAM2199 RNA, herein designated VGAM RNA, are described hereinbelow with reference to Table 2.

As mentioned hereinabove with reference to FIG. 1, a function of VGAM2199 gene, herein designated VGAM is inhibition of expression of VGAM2199 target genes. It is appreciated that specific functions, and accordingly utilities, of VGAM2199 correlate with, and may be deduced from, the identity of the target genes which VGAM2199 binds and inhibits, and the function of these target genes, as elaborated hereinbelow.

LOC219672 (Accession XM_166111) is a VGAM2199 host target gene. LOC219672 BINDING SITE is HOST TARGET binding site found in the 5' untranslated region of mRNA encoded by LOC219672, corresponding to a HOST TARGET binding site such as BINDING SITE I, BINDING SITE II or BINDING SITE III. Table 2 illustrates the complementarity of the nucleotide sequences of LOC219672 BINDING SITE, designated SEQ ID:43888, to the nucleotide sequence of VGAM2199 RNA, herein designated VGAM RNA, also designated SEQ ID:4910.

A function of VGAM2199 is therefore inhibition of LOC219672 (Accession XM_166111). Accordingly, utilities of VGAM2199 include diagnosis, prevention and treatment of diseases and clinical conditions associated with LOC219672. FIG. 1 further provides a conceptual description of a novel bioinformatically detected viral gene of the present invention, referred to here as Viral Genomic Address Messenger 2200 (VGAM2200) viral gene, which modulates expression of respective host target genes thereof, the function and utility of which host target genes is known in the art.

VGAM2200 is a novel bioinformatically detected regulatory, non protein coding, viral micro RNA (miRNA) gene. The method by which VGAM2200 was detected is described hereinabove with reference to FIGS. 1-8.

VGAM2200 gene, herein designated VGAM GENE, is a viral gene contained in the genome of Cowpox Virus.

VGAM2200 host target gene, herein designated VGAM HOST TARGET GENE, is a human gene contained in the human genome.

VGAM2200 gene encodes a VGAM2200 precursor RNA, herein designated VGAM PRECURSOR RNA. Similar to other miRNA genes, and unlike most ordinary genes, VGAM2200 precursor RNA does not encode a protein. A nucleotide sequence identical or highly similar to the nucleotide sequence of VGAM2200 precursor RNA is designated SEQ ID:2186, and is provided hereinbelow with reference to the sequence listing part. Nucleotide sequence SEQ ID:2186 is located at position 184637 relative to the genome of Cowpox Virus.

VGAM2200 precursor RNA folds onto itself, forming VGAM2200 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2200 folded precursor RNA into VGAM2200 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM2200 RNA is designated SEQ ID:4911, and is provided hereinbelow with reference to the sequence listing part.

VGAM2200 host target gene, herein designated VGAM HOST TARGET GENE, encodes a corresponding messenger RNA, VGAM2200 host target RNA, herein designated VGAM HOST TARGET RNA. VGAM2200 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2200 RNA, herein designated VGAM RNA, binds complementarily to one or more host target binding sites located in untranslated regions of VGAM2200 host target RNA, herein designated VGAM HOST TARGET RNA. This complementary binding is due to the fact that the nucleotide sequence of VGAM2200 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2200 RNA, herein designated VGAM RNA, may have a different number of host target binding sites in untranslated regions of a VGAM2200 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2200 RNA, herein designated VGAM RNA, to host target binding sites on VGAM2200 host target RNA, herein designated VGAM HOST TARGET RNA, such as BINDING SITE I, BINDING SITE II and BINDING SITE III, inhibits translation of VGAM2200 host target RNA into VGAM2200 host target protein, herein designated VGAM HOST TARGET PROTEIN. VGAM host target protein is therefore outlined by a broken line.

It is appreciated that VGAM2200 host target gene, herein designated VGAM HOST TARGET GENE, in fact represents a plurality of VGAM2200 host target genes. The mRNA of each one of this plurality of VGAM2200 host target genes comprises one or more host target binding sites, each having a nucleotide sequence which is at least partly complementary to VGAM2200 RNA, herein designated VGAM RNA, and which when bound by VGAM2200 RNA causes inhibition of translation of respective one or more VGAM2200 host target proteins.

It is further appreciated by one skilled in the art that the mode of translational inhibition illustrated by FIG. 1 with specific reference to translational inhibition exerted by VGAM2200 gene, herein designated VGAM GENE, on one or more VGAM2200 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2200 is inhibition of expression of host target genes, as part of a novel viral mechanism of attacking a host. Accordingly, utilities of VGAM2200 include diagnosis, prevention and treatment of viral infection by Cowpox Virus. Specific functions, and accordingly utilities, of VGAM2200 correlate with, and may be deduced from, the identity of the host target genes which VGAM2200 binds and inhibits, and the function of these host target genes, as elaborated hereinbelow.

Nucleotide sequences of the VGAM2200 precursor RNA, herein designated VGAM PRECURSOR RNA, and of the 'diced' VGAM2200 RNA, herein designated VGAM RNA, and a schematic representation of the secondary folding of VGAM2200 folded precursor RNA, herein designated VGAM FOLDED PRECURSOR RNA, of VGAM2200 are further described hereinbelow with reference to Table 1.

Nucleotide sequences of host target binding sites, such as BINDING SITE-I, BINDING SITE-II and BINDING SITE-III of FIG. 1, found on VGAM2200 host target RNA, and schematic representation of the complementarity of each of these host target binding sites to VGAM2200 RNA, herein designated VGAM RNA, are described hereinbelow with reference to Table 2.

As mentioned hereinabove with reference to FIG. 1, a function of VGAM2200 gene, herein designated VGAM is inhibition of expression of VGAM2200 target genes. It is appreciated that specific functions, and accordingly utilities, of VGAM2200 correlate with, and may be deduced from, the identity of the target genes which VGAM2200 binds and inhibits, and the function of these target genes, as elaborated hereinbelow.

ENDOFIN (Accession NM_014733) is a VGAM2200 host target gene. ENDOFIN BINDING SITE is HOST TARGET binding site found in the 3' untranslated region of mRNA encoded by ENDOFIN, corresponding to a HOST TARGET binding site such as BINDING SITE I, BINDING SITE II or BINDING SITE III. Table 2 illustrates the complementarity of the nucleotide sequences of ENDOFIN BINDING SITE, designated SEQ ID:16368, to the nucleotide sequence of VGAM2200 RNA, herein designated VGAM RNA, also designated SEQ ID:4911.

A function of VGAM2200 is therefore inhibition of ENDOFIN (Accession NM_014733). Accordingly, utilities of VGAM2200 include diagnosis, prevention and treatment of diseases and clinical conditions associated with ENDOFIN. FLJ10498 (Accession NM_018115) is another VGAM2200 host target gene. FLJ10498 BINDING SITE is HOST TARGET binding site found in the 3' untranslated region of mRNA encoded by FLJ10498, corresponding to a HOST TARGET binding site such as BINDING SITE I, BINDING SITE II or BINDING SITE III. Table 2 illustrates the complementarity of the nucleotide sequences of FLJ10498 BINDING SITE, designated SEQ ID:19886, to the nucleotide sequence of VGAM2200 RNA, herein designated VGAM RNA, also designated SEQ ID:4911.

Another function of VGAM2200 is therefore inhibition of FLJ10498 (Accession NM_018115). Accordingly, utilities of VGAM2200 include diagnosis, prevention and treatment of diseases and clinical conditions associated with FLJ10498. KIAA0534 (Accession XM_049349) is another VGAM2200 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35381, to the nucleotide sequence of VGAM2200 RNA, herein designated VGAM RNA, also designated SEQ ID:4911.

Another function of VGAM2200 is therefore inhibition of KIAA0534 (Accession XM_049349). Accordingly, utilities of VGAM2200 include diagnosis, prevention and treatment of diseases and clinical conditions associated with KIAA0534. FIG. 1 further provides a conceptual description of a novel bioinformatically detected viral gene of the present invention, referred to here as Viral Genomic Address Messenger 2201 (VGAM2201) viral gene, which modulates expression of respective host target genes thereof, the function and utility of which host target genes is known in the art.

VGAM2201 is a novel bioinformatically detected regulatory, non protein coding, viral micro RNA (miRNA) gene. The method by which VGAM2201 was detected is described hereinabove with reference to FIGS. 1-8.

VGAM2201 gene, herein designated VGAM GENE, is a viral gene contained in the genome of Cowpox Virus. VGAM2201 host target gene, herein designated VGAM HOST TARGET GENE, is a human gene contained in the human genome.

VGAM2201 gene encodes a VGAM2201 precursor RNA, herein designated VGAM PRECURSOR RNA. Similar to other miRNA genes, and unlike most ordinary genes, VGAM2201 precursor RNA does not encode a protein. A nucleotide sequence identical or highly similar to the nucleotide sequence of VGAM2201 precursor RNA is designated SEQ ID:2187, and is provided hereinbelow with reference to the sequence listing part. Nucleotide sequence SEQ ID:2187 is located at position 185848 relative to the genome of Cowpox Virus.

VGAM2201 precursor RNA folds onto itself, forming VGAM2201 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2201 folded precursor RNA into VGAM2201 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2201 RNA is designated SEQ ID:4912, and is provided hereinbelow with reference to the sequence listing part.

VGAM2201 host target gene, herein designated VGAM HOST TARGET GENE, encodes a corresponding messenger RNA, VGAM2201 host target RNA, herein designated VGAM HOST TARGET RNA. VGAM2201 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2201 RNA, herein designated VGAM RNA, binds complementarily to one or more host target binding sites located in untranslated regions of VGAM2201 host target RNA, herein designated VGAM HOST TARGET RNA. This complementary binding is due to the fact that the nucleotide sequence of VGAM2201 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2201 RNA, herein designated VGAM RNA, may have a different number of host target binding sites in untranslated regions of a VGAM2201 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2201 RNA, herein designated VGAM RNA, to host target binding sites on VGAM2201 host target RNA, herein designated VGAM HOST TARGET RNA, such as BINDING SITE I, BINDING SITE II and BINDING SITE III, inhibits translation of VGAM2201 host target RNA into VGAM2201 host target protein, herein designated VGAM HOST TARGET PROTEIN. VGAM host target protein is therefore outlined by a broken line.

It is appreciated that VGAM2201 host target gene, herein designated VGAM HOST TARGET GENE, in fact represents a plurality of VGAM2201 host target genes. The mRNA of each one of this plurality of VGAM2201 host target genes comprises one or more host target binding sites, each having a nucleotide sequence which is at least partly complementary to VGAM2201 RNA, herein designated VGAM RNA, and which when bound by VGAM2201 RNA causes inhibition of translation of respective one or more VGAM2201 host target proteins.

It is further appreciated by one skilled in the art that the mode of translational inhibition illustrated by FIG. 1 with specific reference to translational inhibition exerted by VGAM2201 gene, herein designated VGAM GENE, on one or more VGAM2201 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2201 is inhibition of expression of host target genes, as part of a novel viral mechanism of attacking a host. Accordingly, utilities of VGAM2201 include diagnosis, prevention and treatment of viral infection by Cowpox Virus. Specific functions, and accordingly utilities, of VGAM2201 correlate with, and may be deduced from, the identity of the host target genes which VGAM2201 binds and inhibits, and the function of these host target genes, as elaborated hereinbelow.

Nucleotide sequences of the VGAM2201 precursor RNA, herein designated VGAM PRECURSOR RNA, and of the 'diced' VGAM2201 RNA, herein designated VGAM RNA, and a schematic representation of the secondary folding of VGAM2201 folded precursor RNA, herein designated VGAM FOLDED PRECURSOR RNA, of VGAM2201 are further described hereinbelow with reference to Table 1.

Nucleotide sequences of host target binding sites, such as BINDING SITE-I, BINDING SITE-II and BINDING SITE-III of FIG. 1, found on VGAM2201 host target RNA, and schematic representation of the complementarity of each of these host target binding sites to VGAM2201 RNA, herein designated VGAM RNA, are described hereinbelow with reference to Table 2.

As mentioned hereinabove with reference to FIG. 1, a function of VGAM2201 gene, herein designated VGAM is inhibition of expression of VGAM2201 target genes. It is appreciated that specific functions, and accordingly utilities, of VGAM2201 correlate with, and may be deduced from, the identity of the target genes which VGAM2201 binds and inhibits, and the function of these target genes, as elaborated hereinbelow.

Alpha-methylacyl-CoA Racemase (AMACR, Accession XM_043771) is a VGAM2201 host target gene. AMACR BINDING SITE is HOST TARGET binding site found in the 3' untranslated region of mRNA encoded by AMACR, corresponding to a HOST TARGET binding site such as BINDING SITE I, BINDING SITE II or BINDING SITE III. Table 2 illustrates the complementarity of the nucleotide sequences of AMACR BINDING SITE, designated SEQ ID:34016, to the nucleotide sequence of VGAM2201 RNA, herein designated VGAM RNA, also designated SEQ ID:4912.

A function of VGAM2201 is therefore inhibition of Alpha-methylacyl-CoA Racemase (AMACR, Accession XM_043771). Accordingly, utilities of VGAM2201 include diagnosis, prevention and treatment of diseases and clinical conditions associated with AMACR. ATPase, H+ Transporting, Lysosomal 13 kDa, V1 Subunit G Isoform 2 (ATP6V1G2, Accession NM_130463) is another VGAM2201 host target gene. ATP6V1G2 BINDING SITE1 and ATP6V1G2 BINDING SITE2 are HOST TARGET binding sites found in untranslated regions of mRNA encoded by ATP6V1G2, corresponding to HOST TARGET binding sites such as BINDING SITE I, BINDING SITE II or BINDING SITE III. Table 2 illustrates the complementarity of the nucleotide sequences of ATP6V1G2 BINDING SITE1 and ATP6V1G2 BINDING SITE2, designated SEQ ID:28222 and SEQ ID:28696 respectively, to the nucleotide sequence of VGAM2201 RNA, herein designated VGAM RNA, also designated SEQ ID:4912.

Another function of VGAM2201 is therefore inhibition of ATPase, H+ Transporting, Lysosomal 13 kDa, V1 Subunit G Isoform 2 (ATP6V1G2, Accession NM_130463). Accordingly, utilities of VGAM2201 include diagnosis, prevention and treatment of diseases and clinical conditions associated with ATP6V1G2. FLJ00007 (Accession XM_048928) is another VGAM2201 host target gene. FLJ00007 BINDING SITE is HOST TARGET binding site found in the 3' untranslated region of mRNA encoded by FLJ00007, corresponding to a HOST TARGET binding site such as BINDING SITE I, BINDING SITE II or BINDING SITE III. Table 2 illustrates the complementarity of the nucleotide sequences of FLJ00007 BINDING SITE, designated SEQ ID:35309, to the nucleotide sequence of VGAM2201 RNA, herein designated VGAM RNA, also designated SEQ ID:4912.

Another function of VGAM2201 is therefore inhibition of FLJ00007 (Accession XM_048928). Accordingly, utilities of VGAM2201 include diagnosis, prevention and treatment of diseases and clinical conditions associated with FLJ00007. FLJ13105 (Accession NM_025001) is another VGAM2201 host target gene. FLJ13105 BINDING SITE is HOST TARGET binding site found in the 3' untranslated region of mRNA encoded by FLJ13105, corresponding to a HOST TARGET binding site such as BINDING SITE I, BINDING SITE II or BINDING SITE III. Table 2 illustrates the complementarity of the nucleotide sequences of FLJ13105 BINDING SITE, designated SEQ ID:24570, to the nucleotide sequence of VGAM2201 RNA, herein designated VGAM RNA, also designated SEQ ID:4912.

Another function of VGAM2201 is therefore inhibition of FLJ13105 (Accession NM_025001). Accordingly, utilities of VGAM2201 include diagnosis, prevention and treatment of diseases and clinical conditions associated with FLJ13105. Protein Tyrosine Phosphatase, Receptor Type, R (PTPRR, Accession NM_130846) is another VGAM2201 host target gene. PTPRR BINDING SITE1 and PTPRR BINDING SITE2 are HOST TARGET binding sites found in untranslated regions of mRNA encoded by PTPRR, corresponding to HOST TARGET binding sites such as BINDING SITE I, BINDING SITE II or BINDING SITE III. Table 2 illustrates the complementarity of the nucleotide sequences of PTPRR BINDING SITE1 and PTPRR BINDING SITE2, designated SEQ ID:28381 and SEQ ID:8742 respectively, to the nucleotide sequence of VGAM2201 RNA, herein designated VGAM RNA, also designated SEQ ID:4912.

Another function of VGAM2201 is therefore inhibition of Protein Tyrosine Phosphatase, Receptor Type, R (PTPRR, Accession NM_130846). Accordingly, utilities of VGAM2201 include diagnosis, prevention and treatment of diseases and clinical conditions associated with PTPRR. LOC150213 (Accession XM_059324) is another VGAM2201 host target gene. LOC150213 BINDING SITE is HOST TARGET binding site found in the 3' untranslated region of mRNA encoded by LOC150213, corresponding to a HOST TARGET binding site such as BINDING SITE I, BINDING SITE II or BINDING SITE III. Table 2 illustrates the complementarity of the nucleotide sequences of LOC150213 BINDING SITE, designated SEQ ID:36958, to the nucleotide sequence of VGAM2201 RNA, herein designated VGAM RNA, also designated SEQ ID:4912.

Another function of VGAM2201 is therefore inhibition of LOC150213 (Accession XM_059324). Accordingly, utilities of VGAM2201 include diagnosis, prevention and treatment of diseases and clinical conditions associated with LOC150213. LOC151742 (Accession NM_139245) is another VGAM2201 host target gene. LOC151742 BINDING SITE is HOST TARGET binding site found in the 3' untranslated region of mRNA encoded by LOC151742, corresponding to a HOST TARGET binding site such as BINDING SITE I, BINDING SITE II or BINDING SITE III. Table 2 illustrates the complementarity of the nucleotide sequences of LOC151742 BINDING SITE, designated SEQ ID:29240, to the nucleotide sequence of VGAM2201 RNA, herein designated VGAM RNA, also designated SEQ ID:4912.

Another function of VGAM2201 is therefore inhibition of LOC151742 (Accession NM_139245). Accordingly, utilities of VGAM2201 include diagnosis, prevention and treatment of diseases and clinical conditions associated with LOC151742. FIG. 1 further provides a conceptual description of a novel bioinformatically detected viral gene of the present invention, referred to here as Viral Genomic Address Messenger 2202 (VGAM2202) viral gene, which modulates expression of respective host target genes thereof, the function and utility of which host target genes is known in the art.

VGAM2202 is a novel bioinformatically detected regulatory, non protein coding, viral micro RNA (miRNA) gene. The method by which VGAM2202 was detected is described hereinabove with reference to FIGS. 1-8.

VGAM2202 gene, herein designated VGAM GENE, is a viral gene contained in the genome of Camelpox Virus. VGAM2202 host target gene, herein designated VGAM HOST TARGET GENE, is a human gene contained in the human genome.

VGAM2202 gene encodes a VGAM2202 precursor RNA, herein designated VGAM PRECURSOR RNA. Similar to other miRNA genes, and unlike most ordinary genes, VGAM2202 precursor RNA does not encode a protein. A nucleotide sequence identical or highly similar to the nucleotide sequence of VGAM2202 precursor RNA is designated SEQ ID:2188, and is provided hereinbelow with reference to the sequence listing part. Nucleotide sequence SEQ ID:2188 is located at position 162506 relative to the genome of Camelpox Virus.

VGAM2202 precursor RNA folds onto itself, forming VGAM2202 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2202 folded precursor RNA into VGAM2202 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM2202 RNA is designated SEQ ID:4913, and is provided hereinbelow with reference to the sequence listing part.

VGAM2202 host target gene, herein designated VGAM HOST TARGET GENE, encodes a corresponding messenger RNA, VGAM2202 host target RNA, herein designated VGAM HOST TARGET RNA. VGAM2202 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2202 RNA, herein designated VGAM RNA, binds complementarily to one or more host target binding sites located in untranslated regions of VGAM2202 host target RNA, herein designated VGAM HOST TARGET RNA. This complementary binding is due to the fact that the nucleotide sequence of VGAM2202 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2202 RNA, herein designated VGAM RNA, may have a different number of host target binding sites in untranslated regions of a VGAM2202 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2202 RNA, herein designated VGAM RNA, to host target binding sites on VGAM2202 host target RNA, herein designated VGAM HOST TARGET RNA, such as BINDING SITE I, BINDING SITE II and BINDING SITE III, inhibits translation of VGAM2202 host target RNA into VGAM2202 host target protein, herein designated VGAM HOST TARGET PROTEIN. VGAM host target protein is therefore outlined by a broken line.

It is appreciated that VGAM2202 host target gene, herein designated VGAM HOST TARGET GENE, in fact represents a plurality of VGAM2202 host target genes. The mRNA of each one of this plurality of VGAM2202 host target genes comprises one or more host target binding sites, each having a nucleotide sequence which is at least partly complementary to VGAM2202 RNA, herein designated VGAM RNA, and which when bound by VGAM2202 RNA causes inhibition of translation of respective one or more VGAM2202 host target proteins.

It is further appreciated by one skilled in the art that the mode of translational inhibition illustrated by FIG. 1 with specific reference to translational inhibition exerted by VGAM2202 gene, herein designated VGAM GENE, on one or more VGAM2202 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2202 is inhibition of expression of host target genes, as part of a novel viral mechanism of attacking a host. Accordingly, utilities of VGAM2202 include diagnosis, prevention and treatment of viral infection by Camelpox Virus. Specific functions, and accordingly utilities, of VGAM2202 correlate with, and may be deduced from, the identity of the host target genes which VGAM2202 binds and inhibits, and the function of these host target genes, as elaborated hereinbelow.

Nucleotide sequences of the VGAM2202 precursor RNA, herein designated VGAM PRECURSOR RNA, and of the 'diced' VGAM2202 RNA, herein designated VGAM RNA, and a schematic representation of the secondary folding of VGAM2202 folded precursor RNA, herein designated VGAM FOLDED PRECURSOR RNA, of VGAM2202 are further described hereinbelow with reference to Table 1.

Nucleotide sequences of host target binding sites, such as BINDING SITE-I, BINDING SITE-II and BINDING SITE-III of FIG. 1, found on VGAM2202 host target RNA, and schematic representation of the complementarity of each of these host target binding sites to VGAM2202 RNA, herein designated VGAM RNA, are described hereinbelow with reference to Table 2.

As mentioned hereinabove with reference to FIG. 1, a function of VGAM2202 gene, herein designated VGAM is inhibition of expression of VGAM2202 target genes. It is appreciated that specific functions, and accordingly utilities, of VGAM2202 correlate with, and may be deduced from, the identity of the target genes which VGAM2202 binds and inhibits, and the function of these target genes, as elaborated hereinbelow.

Actinin, Alpha 2 (ACTN2, Accession NM_001103) is a VGAM2202 host target gene. ACTN2 BINDING SITE is HOST TARGET binding site found in the 3' untranslated region of mRNA encoded by ACTN2, corresponding to a HOST TARGET binding site such as BINDING SITE I, BINDING SITE II or BINDING SITE III. Table 2 illustrates the complementarity of the nucleotide sequences of ACTN2 BINDING SITE, designated SEQ ID:6754, to the nucleotide sequence of VGAM2202 RNA, herein designated VGAM RNA, also designated SEQ ID:4913.

A function of VGAM2202 is therefore inhibition of Actinin, Alpha 2 (ACTN2, Accession NM_001103), a gene which an actin-binding protein with multiple roles in different cell types. Accordingly, utilities of VGAM2202 include diagnosis, prevention and treatment of diseases and clinical conditions associated with ACTN2. The function of ACTN2 and its association with various diseases and clinical conditions, has been established by previous studies, as described hereinabove with reference to VGAM88. Synaptotagmin I (SYT1, Accession NM_005639) is another VGAM2202 host target gene. SYT1 BINDING SITE is HOST TARGET binding site found in the 3' untranslated region of mRNA encoded by SYT1, corresponding to a HOST TARGET binding site such as BINDING SITE I, BINDING SITE II or BINDING SITE III. Table 2 illustrates the complementarity of the nucleotide sequences of SYT1 BINDING SITE, designated SEQ ID:12168, to the nucleotide sequence of VGAM2202 RNA, herein designated VGAM RNA, also designated SEQ ID:4913.

Another function of VGAM2202 is therefore inhibition of Synaptotagmin I (SYT1, Accession NM_005639), a gene which may have a regulatory role in the membrane interactions during trafficking of synaptic vesicles at the active zone of the synapse. Accordingly, utilities of VGAM2202 include diagnosis, prevention and treatment of diseases and clinical conditions associated with SYT1. The function of SYT1 and its association with various diseases and clinical conditions, has been established by previous studies, as described hereinabove with reference to VGAM739. FLJ22173 (Accession NM_025041) is another VGAM2202 host target gene. FLJ22173 BINDING SITE is HOST TARGET binding site found in the 5' untranslated region of mRNA encoded by FLJ22173, corresponding to a HOST TARGET binding site such as BINDING SITE I, BINDING SITE II or BINDING SITE III. Table 2 illustrates the complementarity of the nucleotide sequences of FLJ22173 BINDING SITE, designated SEQ ID:24635, to the nucleotide sequence of VGAM2202 RNA, herein designated VGAM RNA, also designated SEQ ID:4913.

Another function of VGAM2202 is therefore inhibition of FLJ22173 (Accession NM_025041). Accordingly, utilities of VGAM2202 include diagnosis, prevention and treatment of diseases and clinical conditions associated with FLJ22173. SH3 Domain Binding Glutamic Acid-rich Protein Like 2 (SH3BGRL2, Accession NM_031469) is another VGAM2202 host target gene. SH3BGRL2 BINDING SITE is HOST TARGET binding site found in the 3' untranslated region of mRNA encoded by SH3BGRL2, corresponding to a HOST TARGET binding site such as BINDING SITE I, BINDING SITE II or BINDING SITE III. Table 2 illustrates the complementarity of the nucleotide sequences of SH3BGRL2 BINDING SITE, designated SEQ ID:25524, to the nucleotide sequence of VGAM2202 RNA, herein designated VGAM RNA, also designated SEQ ID:4913.

Another function of VGAM2202 is therefore inhibition of SH3 Domain Binding Glutamic Acid-rich Protein Like 2 (SH3BGRL2, Accession NM_031469). Accordingly, utilities of VGAM2202 include diagnosis, prevention and treatment of diseases and clinical conditions associated with SH3BGRL2. LOC146823 (Accession XM_097105) is another VGAM2202 host target gene. LOC146823 BINDING SITE is HOST TARGET binding site found in the 3' untranslated region of mRNA encoded by LOC146823, corresponding to a HOST TARGET binding site such as BINDING SITE I, BINDING SITE II or BINDING SITE III. Table 2 illustrates the complementarity of the nucleotide sequences of LOC146823 BINDING SITE, designated SEQ ID:40745, to the nucleotide sequence of VGAM2202 RNA, herein designated VGAM RNA, also designated SEQ ID:4913.

Another function of VGAM2202 is therefore inhibition of LOC146823 (Accession XM_097105). Accordingly, utilities of VGAM2202 include diagnosis, prevention and treatment of diseases and clinical conditions associated with LOC146823. LOC255231 (Accession XM_170908) is another VGAM2202 host target gene. LOC255231 BINDING SITE is HOST TARGET binding site found in the 3' untranslated region of mRNA encoded by LOC255231, corresponding to a HOST TARGET binding site such as BINDING SITE I, BINDING SITE II or BINDING SITE III. Table 2 illustrates the complementarity of the nucleotide sequences of LOC255231 BINDING SITE, designated SEQ ID:45671, to the nucleotide sequence of VGAM2202 RNA, herein designated VGAM RNA, also designated SEQ ID:4913.

Another function of VGAM2202 is therefore inhibition of LOC255231 (Accession XM_170908). Accordingly, utilities of VGAM2202 include diagnosis, prevention and treatment of diseases and clinical conditions associated with LOC255231. FIG. 1 further provides a conceptual description of a novel bioinformatically detected viral gene of the present invention, referred to here as Viral Genomic Address Messenger 2203 (VGAM2203) viral gene, which modulates expression of respective host target genes thereof, the function and utility of which host target genes is known in the art.

VGAM2203 is a novel bioinformatically detected regulatory, non protein coding, viral micro RNA (miRNA) gene. The method by which VGAM2203 was detected is described hereinabove with reference to FIGS. 1-8.

VGAM2203 gene, herein designated VGAM GENE, is a viral gene contained in the genome of Cowpox Virus. VGAM2203 host target gene, herein designated VGAM HOST TARGET GENE, is a human gene contained in the human genome.

VGAM2203 gene encodes a VGAM2203 precursor RNA, herein designated VGAM PRECURSOR RNA. Similar to other miRNA genes, and unlike most ordinary genes, VGAM2203 precursor RNA does not encode a protein. A nucleotide sequence identical or highly similar to the nucleotide sequence of VGAM2203 precursor RNA is designated SEQ ID:2189, and is provided hereinbelow with reference to the sequence listing part. Nucleotide sequence SEQ ID:2189 is located at position 173794 relative to the genome of Cowpox Virus.

VGAM2203 precursor RNA folds onto itself, forming VGAM2203 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2203 folded precursor RNA into VGAM2203 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2203 RNA is designated SEQ ID:4914, and is provided hereinbelow with reference to the sequence listing part.

VGAM2203 host target gene, herein designated VGAM HOST TARGET GENE, encodes a corresponding messenger RNA, VGAM2203 host target RNA, herein designated VGAM HOST TARGET RNA. VGAM2203 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2203 RNA, herein designated VGAM RNA, binds complementarily to one or more host target binding sites located in untranslated regions of VGAM2203 host target RNA, herein designated VGAM HOST TARGET RNA. This complementary binding is due to the fact that the nucleotide sequence of VGAM2203 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2203 RNA, herein designated VGAM RNA, may have a different number of host target binding sites in untranslated regions of a VGAM2203 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2203 RNA, herein designated VGAM RNA, to host target binding sites on VGAM2203 host target RNA, herein designated VGAM HOST TARGET RNA, such as BINDING SITE I, BINDING SITE II and BINDING SITE III, inhibits translation of VGAM2203 host target RNA into VGAM2203 host target protein, herein designated VGAM HOST TARGET PROTEIN. VGAM host target protein is therefore outlined by a broken line.

It is appreciated that VGAM2203 host target gene, herein designated VGAM HOST TARGET GENE, in fact represents a plurality of VGAM2203 host target genes. The mRNA of each one of this plurality of VGAM2203 host target genes comprises one or more host target binding sites, each having a nucleotide sequence which is at least partly complementary to VGAM2203 RNA, herein designated VGAM RNA, and which when bound by VGAM2203 RNA causes inhibition of translation of respective one or more VGAM2203 host target proteins.

It is further appreciated by one skilled in the art that the mode of translational inhibition illustrated by FIG. 1 with specific reference to translational inhibition exerted by VGAM2203 gene, herein designated VGAM GENE, on one or more VGAM2203 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2203 is inhibition of expression of host target genes, as part of a novel viral mechanism of attacking a host. Accordingly, utilities of VGAM2203 include diagnosis, prevention and treatment of viral infection by Cowpox Virus. Specific functions, and accordingly utilities, of VGAM2203 correlate with, and may be deduced from, the identity of the host target genes which VGAM2203 binds and inhibits, and the function of these host target genes, as elaborated hereinbelow.

Nucleotide sequences of the VGAM2203 precursor RNA, herein designated VGAM PRECURSOR RNA, and of the 'diced' VGAM2203 RNA, herein designated VGAM RNA, and a schematic representation of the secondary folding of VGAM2203 folded precursor RNA, herein designated VGAM FOLDED PRECURSOR RNA, of VGAM2203 are further described hereinbelow with reference to Table 1.

Nucleotide sequences of host target binding sites, such as BINDING SITE-I, BINDING SITE-II and BINDING SITE-III of FIG. 1, found on VGAM2203 host target RNA, and schematic representation of the complementarity of each of these host target binding sites to VGAM2203 RNA, herein designated VGAM RNA, are described hereinbelow with reference to Table 2.

As mentioned hereinabove with reference to FIG. 1, a function of VGAM2203 gene, herein designated VGAM is inhibition of expression of VGAM2203 target genes. It is appreciated that specific functions, and accordingly utilities, of VGAM2203 correlate with, and may be deduced from, the identity of the target genes which VGAM2203 binds and inhibits, and the function of these target genes, as elaborated hereinbelow.

Espin (ESPN, Accession NM_031475) is a VGAM2203 host target gene. ESPN BINDING SITE is HOST TARGET binding site found in the 3' untranslated region of mRNA encoded by ESPN, corresponding to a HOST TARGET binding site such as BINDING SITE I, BINDING SITE II or BINDING SITE III. Table 2 illustrates the complementarity of the nucleotide sequences of ESPN BINDING SITE, designated SEQ ID:25548, to the nucleotide sequence of VGAM2203 RNA, herein designated VGAM RNA, also designated SEQ ID:4914.

A function of VGAM2203 is therefore inhibition of Espin (ESPN, Accession NM_031475), a gene which a membrane-cytoskeletal assemblages. Accordingly, utilities of VGAM2203 include diagnosis, prevention and treatment of diseases and clinical conditions associated with ESPN. The function of ESPN and its association with various diseases and clinical conditions, has been established by previous studies, as described hereinabove with reference to VGAM1006. Glucocorticoid Receptor DNA Binding Factor 1 (GRLF1, Accession XM_085943) is another VGAM2203 host target gene. GRLF1 BINDING SITE is HOST TARGET binding site found in the 3' untranslated region of mRNA encoded by GRLF1, corresponding to a HOST TARGET binding site such as BINDING SITE I, BINDING SITE II or BINDING SITE III. Table 2 illustrates the complementarity of the nucleotide sequences of GRLF1 BINDING SITE, designated SEQ ID:38407, to the nucleotide sequence of VGAM2203 RNA, herein designated VGAM RNA, also designated SEQ ID:4914.

Another function of VGAM2203 is therefore inhibition of Glucocorticoid Receptor DNA Binding Factor 1 (GRLF1, Accession XM_085943), a gene which inhibits transcription of the glucocorticoid receptor gene. Accordingly, utilities of VGAM2203 include diagnosis, prevention and treatment of diseases and clinical conditions associated with GRLF1. The function of GRLF1 and its association with various diseases and clinical conditions, has been established by previous studies, as described hereinabove with reference to VGAM55. Integrin, Alpha 2 (CD49B, alpha 2 subunit of VLA-2 receptor) (ITGA2, Accession NM_002203) is another VGAM2203 host target gene. ITGA2 BINDING SITE is HOST TARGET binding site found in the 3' untranslated region of mRNA encoded by ITGA2, corresponding to a HOST TARGET binding site such as BINDING SITE I, BINDING SITE II or BINDING SITE III. Table 2 illustrates the complementarity of the nucleotide sequences of ITGA2 BINDING SITE, designated SEQ ID:7962, to the nucleotide sequence of VGAM2203 RNA, herein designated VGAM RNA, also designated SEQ ID:4914.

Another function of VGAM2203 is therefore inhibition of Integrin, Alpha 2 (CD49B, alpha 2 subunit of VLA-2 receptor) (ITGA2, Accession NM_002203), a gene which has roles in blood clotting and angiogenesis, acts as a collagen and laminin receptor. Accordingly, utilities of VGAM2203 include diagnosis, prevention and treatment of diseases and clinical conditions associated with ITGA2. The function of ITGA2 and its association with various diseases and clinical conditions, has been established by previous studies, as described hereinabove with reference to VGAM827. Wilms Tumor 1 (WT1, Accession NM_024425) is another VGAM2203 host target gene. WT1 BINDING SITE1 through WT1 BINDING SITE4 are HOST TARGET binding sites found in untranslated regions of mRNA encoded by WT1, corresponding to HOST TARGET binding sites such as BINDING SITE I, BINDING SITE II or BINDING SITE III. Table 2 illustrates the complementarity of the nucleotide sequences of WT1 BINDING SITE1 through WT1 BINDING SITE4, designated SEQ ID:23671, SEQ ID:23675, SEQ ID:23667 and SEQ ID:5951 respectively, to the nucleotide sequence of VGAM2203 RNA, herein designated VGAM RNA, also designated SEQ ID:4914.

Another function of VGAM2203 is therefore inhibition of Wilms Tumor 1 (WT1, Accession NM_024425). Accordingly, utilities of VGAM2203 include diagnosis, prevention and treatment of diseases and clinical conditions associated with WT1. KIAA0993 (Accession XM_034413) is another VGAM2203 host target gene. KIAA0993 BINDING SITE is HOST TARGET binding site found in the 3' untranslated region of mRNA encoded by KIAA0993, corresponding to a HOST TARGET binding site such as BINDING SITE I, BINDING SITE II or BINDING SITE III. Table 2 illustrates the complementarity of the nucleotide sequences of KIAA0993 BINDING SITE, designated SEQ ID:32083, to the nucleotide sequence of VGAM2203 RNA, herein designated VGAM RNA, also designated SEQ ID:4914.

Another function of VGAM2203 is therefore inhibition of KIAA0993 (Accession XM_034413). Accordingly, utilities of VGAM2203 include diagnosis, prevention and treatment of diseases and clinical conditions associated with KIAA0993. KIAA1416 (Accession XM_098762) is another VGAM2203 host target gene. KIAA1416 BINDING SITE is HOST TARGET binding site found in the 5' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41797, to the nucleotide sequence of VGAM2203 RNA, herein designated VGAM RNA, also designated SEQ ID:4914.

Another function of VGAM2203 is therefore inhibition of KIAA1416 (Accession XM_098762). Accordingly, utilities of VGAM2203 include diagnosis, prevention and treatment of diseases and clinical conditions associated with KIAA1416. My015 (Accession XM_039512) is another VGAM2203 host target gene. My015 BINDING SITE is HOST TARGET binding site found in the 3' untranslated region of mRNA encoded by My015, corresponding to a HOST TARGET binding site such as BINDING SITE I, BINDING SITE II or BINDING SITE III. Table 2 illustrates the complementarity of the nucleotide sequences of My015 BINDING SITE, designated SEQ ID:33103, to the nucleotide sequence of VGAM2203 RNA, herein designated VGAM RNA, also designated SEQ ID:4914.

Another function of VGAM2203 is therefore inhibition of My015 (Accession XM_039512). Accordingly, utilities of VGAM2203 include diagnosis, prevention and treatment of diseases and clinical conditions associated with My015. Ras Association (RalGDS/AF-6) Domain Family 2 (RASSF2, Accession NM_014737) is another VGAM2203 host target gene. RASSF2 BINDING SITE is HOST TARGET binding site found in the 3' untranslated region of mRNA encoded by RASSF2, corresponding to a HOST TARGET binding site such as BINDING SITE I, BINDING SITE II or BINDING SITE III. Table 2 illustrates the complementarity of the nucleotide sequences of RASSF2 BINDING SITE, designated SEQ ID:16388, to the nucleotide sequence of VGAM2203 RNA, herein designated VGAM RNA, also designated SEQ ID:4914.

Another function of VGAM2203 is therefore inhibition of Ras Association (RalGDS/AF-6) Domain Family 2 (RASSF2, Accession NM_014737). Accordingly, utilities of VGAM2203 include diagnosis, prevention and treatment of diseases and clinical conditions associated with RASSF2. Tumor Protein P53 Inducible Nuclear Protein 1 (TP53INP1, Accession NM_033285) is another VGAM2203 host target gene. TP53INP1 BINDING SITE1 and TP53INP1 BINDING SITE2 are HOST TARGET binding sites found in untranslated regions of mRNA encoded by TP53INP1, corresponding to HOST TARGET binding sites such as BINDING SITE I, BINDING SITE II or BINDING SITE III. Table 2 illustrates the complementarity of the nucleotide sequences of TP53INP1 BINDING SITE1 and TP53INP1 BINDING SITE2, designated SEQ ID:27101 and SEQ ID:36112 respectively, to the nucleotide sequence of VGAM2203 RNA, herein designated VGAM RNA, also designated SEQ ID:4914.

Another function of VGAM2203 is therefore inhibition of Tumor Protein P53 Inducible Nuclear Protein 1 (TP53INP1, Accession NM_033285). Accordingly, utilities of VGAM2203 include diagnosis, prevention and treatment of diseases and clinical conditions associated with TP53INP1. LOC157503 (Accession XM_098767) is another VGAM2203 host target gene. LOC157503 BINDING SITE is HOST TARGET binding site found in the 3' untranslated region of mRNA encoded by LOC157503, corresponding to a HOST TARGET binding site such as BINDING SITE I, BINDING SITE II or BINDING SITE III. Table 2 illustrates the complementarity of the nucleotide sequences of LOC157503 BINDING SITE, designated SEQ ID:41815, to the nucleotide sequence of VGAM2203 RNA, herein designated VGAM RNA, also designated SEQ ID:4914.

Another function of VGAM2203 is therefore inhibition of LOC157503 (Accession XM_098767). Accordingly, utilities of VGAM2203 include diagnosis, prevention and treatment of diseases and clinical conditions associated with LOC157503. FIG. 1 further provides a conceptual description of a novel bioinformatically detected viral gene of the present invention, referred to here as Viral Genomic Address Messenger 2204 (VGAM2204) viral gene, which modulates expression of respective host target genes thereof, the function and utility of which host target genes is known in the art.

VGAM2204 is a novel bioinformatically detected regulatory, non protein coding, viral micro RNA (miRNA) gene. The method by which VGAM2204 was detected is described hereinabove with reference to FIGS. 1-8.

VGAM2204 gene, herein designated VGAM GENE, is a viral gene contained in the genome of Cowpox Virus. VGAM2204 host target gene, herein designated VGAM HOST TARGET GENE, is a human gene contained in the human genome.

VGAM2204 gene encodes a VGAM2204 precursor RNA, herein designated VGAM PRECURSOR RNA. Similar to other miRNA genes, and unlike most ordinary genes, VGAM2204 precursor RNA does not encode a protein. A nucleotide sequence identical or highly similar to the nucleotide sequence of VGAM2204 precursor RNA is designated SEQ ID:2190, and is provided hereinbelow with reference to the sequence listing part. Nucleotide sequence SEQ ID:2190 is located at position 183474 relative to the genome of Cowpox Virus.

VGAM2204 precursor RNA folds onto itself, forming VGAM2204 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2204 folded precursor RNA into VGAM2204 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2204 RNA is designated SEQ ID:4915, and is provided hereinbelow with reference to the sequence listing part.

VGAM2204 host target gene, herein designated VGAM HOST TARGET GENE, encodes a corresponding messenger RNA, VGAM2204 host target RNA, herein designated VGAM HOST TARGET RNA. VGAM2204 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2204 RNA, herein designated VGAM RNA, binds complementarily to one or more host target binding sites located in untranslated regions of VGAM2204 host target RNA, herein designated VGAM HOST TARGET RNA. This complementary binding is due to the fact that the nucleotide sequence of VGAM2204 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2204 RNA, herein designated VGAM RNA, may have a different number of host target binding sites in untranslated regions of a VGAM2204 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2204 RNA, herein designated VGAM RNA, to host target binding sites on VGAM2204 host target RNA, herein designated VGAM HOST TARGET RNA, such as BINDING SITE I, BINDING SITE II and BINDING SITE III, inhibits translation of VGAM2204 host target RNA into VGAM2204 host target protein, herein designated VGAM HOST TARGET PROTEIN. VGAM host target protein is therefore outlined by a broken line.

It is appreciated that VGAM2204 host target gene, herein designated VGAM HOST TARGET GENE, in fact represents a plurality of VGAM2204 host target genes. The mRNA of each one of this plurality of VGAM2204 host target genes comprises one or more host target binding sites, each having a nucleotide sequence which is at least partly complementary to VGAM2204 RNA, herein designated VGAM RNA, and which when bound by VGAM2204 RNA causes inhibition of translation of respective one or more VGAM2204 host target proteins.

It is further appreciated by one skilled in the art that the mode of translational inhibition illustrated by FIG. 1 with specific reference to translational inhibition exerted by VGAM2204 gene, herein designated VGAM GENE, on one or more VGAM2204 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2204 is inhibition of expression of host target genes, as part of a novel viral mechanism of attacking a host. Accordingly, utilities of VGAM2204 include diagnosis, prevention and treatment of viral infection by Cowpox Virus. Specific functions, and accordingly utilities, of VGAM2204 correlate with, and may be deduced from, the identity of the host target genes which VGAM2204 binds and inhibits, and the function of these host target genes, as elaborated hereinbelow.

Nucleotide sequences of the VGAM2204 precursor RNA, herein designated VGAM PRECURSOR RNA, and of the 'diced' VGAM2204 RNA, herein designated VGAM RNA, and a schematic representation of the secondary folding of VGAM2204 folded precursor RNA, herein designated VGAM FOLDED PRECURSOR RNA, of VGAM2204 are further described hereinbelow with reference to Table 1.

Nucleotide sequences of host target binding sites, such as BINDING SITE-I, BINDING SITE-II and BINDING SITE-III of FIG. 1, found on VGAM2204 host target RNA, and schematic representation of the complementarity of each of these host target binding sites to VGAM2204 RNA, herein designated VGAM RNA, are described hereinbelow with reference to Table 2.

As mentioned hereinabove with reference to FIG. 1, a function of VGAM2204 gene, herein designated VGAM is inhibition of expression of VGAM2204 target genes. It is appreciated that specific functions, and accordingly utilities, of VGAM2204 correlate with, and may be deduced from, the identity of the target genes which VGAM2204 binds and inhibits, and the function of these target genes, as elaborated hereinbelow.

FLJ20094 (Accession NM_017665) is a VGAM2204 host target gene. FLJ20094 BINDING SITE is HOST TARGET binding site found in the 3' untranslated region of mRNA encoded by FLJ20094, corresponding to a HOST TARGET binding site such as BINDING SITE I, BINDING SITE II or BINDING SITE III. Table 2 illustrates the complementarity of the nucleotide sequences of FLJ20094 BINDING SITE, designated SEQ ID:19207, to the nucleotide sequence of VGAM2204 RNA, herein designated VGAM RNA, also designated SEQ ID:4915.

A function of VGAM2204 is therefore inhibition of FLJ20094 (Accession NM_017665). Accordingly, utilities of VGAM2204 include diagnosis, prevention and treatment of diseases and clinical conditions associated with FLJ20094. Tankyrase, TRF1-interacting Ankyrin-related ADP-ribose Polymerase 2 (TNKS2, Accession NM_025235) is another VGAM2204 host target gene. TNKS2 BINDING SITE is HOST TARGET binding site found in the 3' untranslated region of mRNA encoded by TNKS2, corresponding to a HOST TARGET binding site such as BINDING SITE I, BINDING SITE II or BINDING SITE III. Table 2 illustrates the complementarity of the nucleotide sequences of TNKS2 BINDING SITE, designated SEQ ID:24913, to the nucleotide sequence of VGAM2204 RNA, herein designated VGAM RNA, also designated SEQ ID:4915.

Another function of VGAM2204 is therefore inhibition of Tankyrase, TRF1-interacting Ankyrin-related ADP-ribose Polymerase 2 (TNKS2, Accession NM_025235). Accordingly, utilities of VGAM2204 include diagnosis, prevention and treatment of diseases and clinical conditions associated with TNKS2. LOC202025 (Accession XM_117353) is another VGAM2204 host target gene. LOC202025 BINDING SITE is HOST TARGET binding site found in the 5' untranslated region of mRNA encoded by LOC202025, corresponding to a HOST TARGET binding site such as BINDING SITE I, BINDING SITE II or BINDING SITE III. Table 2 illustrates the complementarity of the nucleotide sequences of LOC202025 BINDING SITE, designated SEQ ID:43400, to the nucleotide sequence of VGAM2204 RNA, herein designated VGAM RNA, also designated SEQ ID:4915.

Another function of VGAM2204 is therefore inhibition of LOC202025 (Accession XM_117353). Accordingly, utilities of VGAM2204 include diagnosis, prevention and treatment of diseases and clinical conditions associated with LOC202025. FIG. 1 further provides a conceptual description of a novel bioinformatically detected viral gene of the present invention, referred to here as Viral Genomic Address Messenger 2205 (VGAM2205) viral gene, which modulates expression of respective host target genes thereof, the function and utility of which host target genes is known in the art.

VGAM2205 is a novel bioinformatically detected regulatory, non protein coding, viral micro RNA (miRNA) gene. The method by which VGAM2205 was detected is described hereinabove with reference to FIGS. 1-8.

VGAM2205 gene, herein designated VGAM GENE, is a viral gene contained in the genome of Cowpox Virus. VGAM2205 host target gene, herein designated VGAM HOST TARGET GENE, is a human gene contained in the human genome.

VGAM2205 gene encodes a VGAM2205 precursor RNA, herein designated VGAM PRECURSOR RNA. Similar to other miRNA genes, and unlike most ordinary genes, VGAM2205 precursor RNA does not encode a protein. A nucleotide sequence identical or highly similar to the nucleotide sequence of VGAM2205 precursor RNA is designated SEQ ID:2191, and is provided hereinbelow with reference to the sequence listing part. Nucleotide sequence SEQ ID:2191 is located at position 188975 relative to the genome of Cowpox Virus.

VGAM2205 precursor RNA folds onto itself, forming VGAM2205 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2205 folded precursor RNA into VGAM2205 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2205 RNA is designated SEQ ID:4916, and is provided hereinbelow with reference to the sequence listing part.

VGAM2205 host target gene, herein designated VGAM HOST TARGET GENE, encodes a corresponding messenger RNA, VGAM2205 host target RNA, herein designated VGAM HOST TARGET RNA. VGAM2205 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2205 RNA, herein designated VGAM RNA, binds complementarily to one or more host target binding sites located in untranslated regions of VGAM2205 host target RNA, herein designated VGAM HOST TARGET RNA. This complementary binding is due to the fact that the nucleotide sequence of VGAM2205 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2205 RNA, herein designated VGAM RNA, may have a different number of host target binding sites in untranslated regions of a VGAM2205 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2205 RNA, herein designated VGAM RNA, to host target binding sites on VGAM2205 host target RNA, herein designated VGAM HOST TARGET RNA, such as BINDING SITE I, BINDING SITE II and BINDING SITE III, inhibits translation of VGAM2205 host target RNA into VGAM2205 host target protein, herein designated VGAM HOST TARGET PROTEIN. VGAM host target protein is therefore outlined by a broken line.

It is appreciated that VGAM2205 host target gene, herein designated VGAM HOST TARGET GENE, in fact represents a plurality of VGAM2205 host target genes. The mRNA of each one of this plurality of VGAM2205 host target genes comprises one or more host target binding sites, each having a nucleotide sequence which is at least partly complementary to VGAM2205 RNA, herein designated VGAM RNA, and which when bound by VGAM2205 RNA causes inhibition of translation of respective one or more VGAM2205 host target proteins.

It is further appreciated by one skilled in the art that the mode of translational inhibition illustrated by FIG. 1 with specific reference to translational inhibition exerted by VGAM2205 gene, herein designated VGAM GENE, on one or more VGAM2205 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2205 is inhibition of expression of host target genes, as part of a novel viral mechanism of attacking a host. Accordingly, utilities of VGAM2205 include diagnosis, prevention and treatment of viral infection by Cowpox Virus. Specific functions, and accordingly utilities, of VGAM2205 correlate with, and may be deduced from, the identity of the host target genes which VGAM2205 binds and inhibits, and the function of these target genes, as elaborated hereinbelow.

Nucleotide sequences of the VGAM2205 precursor RNA, herein designated VGAM PRECURSOR RNA, and of the 'diced' VGAM2205 RNA, herein designated VGAM RNA, and a schematic representation of the secondary folding of VGAM2205 folded precursor RNA, herein designated VGAM FOLDED PRECURSOR RNA, of VGAM2205 are further described hereinbelow with reference to Table 1.

Nucleotide sequences of host target binding sites, such as BINDING SITE-I, BINDING SITE-II and BINDING SITE-III of FIG. 1, found on VGAM2205 host target RNA, and schematic representation of the complementarity of each of these host target binding sites to VGAM2205 RNA, herein designated VGAM RNA, are described hereinbelow with reference to Table 2.

As mentioned hereinabove with reference to FIG. 1, a function of VGAM2205 gene, herein designated VGAM is inhibition of expression of VGAM2205 target genes. It is appreciated that specific functions, and accordingly utilities, of VGAM2205 correlate with, and may be deduced from, the identity of the target genes which VGAM2205 binds and inhibits, and the function of these target genes, as elaborated hereinbelow.

Ankyrin 3, Node of Ranvier (ankyrin G) (ANK3, Accession NM_020987) is a VGAM2205 host target gene. ANK3 BINDING SITE is HOST TARGET binding site found in the 3' untranslated region of mRNA encoded by ANK3, corresponding to a HOST TARGET binding site such as BINDING SITE I, BINDING SITE II or BINDING SITE III. Table 2 illustrates the complementarity of the nucleotide sequences of ANK3 BINDING SITE, designated SEQ ID:21984, to the nucleotide sequence of VGAM2205 RNA, herein designated VGAM RNA, also designated SEQ ID:4916.

A function of VGAM2205 is therefore inhibition of Ankyrin 3, Node of Ranvier (ankyrin G) (ANK3, Accession NM_020987), a gene which plays key roles in activities such as cell motility, activation, proliferation. Accordingly, utilities of VGAM2205 include diagnosis, prevention and treatment of diseases and clinical conditions associated with ANK3. The function of ANK3 and its association with various diseases and clinical conditions, has been established by previous studies, as described hereinabove with reference to VGAM1527. CD2-associated Protein (CD2AP, Accession NM_012120) is another VGAM2205 host target gene. CD2AP BINDING SITE is HOST TARGET binding site found in the 3' untranslated region of mRNA encoded by CD2AP, corresponding to a HOST TARGET binding site such as BINDING SITE I, BINDING SITE II or BINDING SITE III. Table 2 illustrates the complementarity of the nucleotide sequences of CD2AP BINDING SITE, designated SEQ ID:14433, to the nucleotide sequence of VGAM2205 RNA, herein designated VGAM RNA, also designated SEQ ID:4916.

Another function of VGAM2205 is therefore inhibition of CD2-associated Protein (CD2AP, Accession NM_012120), a gene which binds CAS ligand and may therefor involves in its growth regulatory pathway. Accordingly, utilities of VGAM2205 include diagnosis, prevention and treatment of diseases and clinical conditions associated with CD2AP. The function of CD2AP and its association with various diseases and clinical conditions, has been established by previous studies, as described hereinabove with reference to VGAM95. Cadherin 6, Type 2, K-cadherin (fetal kidney) (CDH6, Accession NM_004932) is another VGAM2205 host target gene. CDH6 BINDING SITE is HOST TARGET binding site found in the 3' untranslated region of mRNA encoded by CDH6, corresponding to a HOST TARGET binding site such as BINDING SITE I, BINDING SITE II or BINDING SITE III. Table 2 illustrates the complementarity of the nucleotide sequences of CDH6 BINDING SITE, designated SEQ ID:11378, to the nucleotide sequence of VGAM2205 RNA, herein designated VGAM RNA, also designated SEQ ID:4916.

Another function of VGAM2205 is therefore inhibition of Cadherin 6, Type 2, K-cadherin (fetal kidney) (CDH6, Accession NM_004932), a gene which is a calcium dependent cell adhesion protein. Accordingly, utilities of VGAM2205 include diagnosis, prevention and treatment of diseases and clinical conditions associated with CDH6. The function of CDH6 and its association with various diseases and clinical conditions, has been established by previous studies, as described hereinabove with reference to VGAM60. Mitogen-activated Protein Kinase Kinase Kinase 7 (MAP3K7, Accession NM_003188) is another VGAM2205 host target gene. MAP3K7 BINDING SITE is HOST TARGET binding site found in the 3' untranslated region of mRNA encoded by MAP3K7, corresponding to a HOST TARGET binding site such as BINDING SITE I, BINDING SITE II or BINDING SITE III. Table 2 illustrates the complementarity of the nucleotide sequences of MAP3K7 BINDING SITE, designated SEQ ID:9165, to the nucleotide sequence of VGAM2205 RNA, herein designated VGAM RNA, also designated SEQ ID:4916.

Another function of VGAM2205 is therefore inhibition of Mitogen-activated Protein Kinase Kinase Kinase 7 (MAP3K7, Accession NM_003188), a gene which can phosphorylate and activate yet undefined mapkks. mediator of tgf-beta signal transduction. stimulates nf-kappa b activation. Accordingly, utilities of VGAM2205 include diagnosis, prevention and treatment of diseases and clinical conditions associated with MAP3K7. The function of MAP3K7 and its association with various diseases and clinical conditions, has been established by previous studies, as described hereinabove with reference to VGAM1968. PSA (Accession NM_021154) is another VGAM2205 host target gene. PSA BINDING SITE1 and PSA BINDING SITE2 are HOST TARGET binding sites found in untranslated regions of mRNA encoded by PSA, corresponding to HOST TARGET binding sites such as BINDING SITE I, BINDING SITE II or BINDING SITE III. Table 2 illustrates the complementarity of the nucleotide sequences of PSA BINDING SITE1 and PSA BINDING SITE2, designated SEQ ID:22131 and SEQ ID:27740 respectively, to the nucleotide sequence of VGAM2205 RNA, herein designated VGAM RNA, also designated SEQ ID:4916.

Another function of VGAM2205 is therefore inhibition of PSA (Accession NM_021154), a gene which is puromycin-sensitive aminopeptidase and has metallopeptidase activity. Accordingly, utilities of VGAM2205 include diagnosis, prevention and treatment of diseases and clinical conditions associated with PSA. The function of PSA and its association with various diseases and clinical conditions, has been established by previous studies, as described hereinabove with reference to VGAM65. Transforming Growth Factor, Beta Receptor III (betaglycan, 300 kDa) (TGFBR3, Accession NM_003243) is another VGAM2205 host target gene. TGFBR3 BINDING SITE is HOST TARGET binding site found in the 3' untranslated region of mRNA encoded by TGFBR3, corresponding to a HOST TARGET binding site such as BINDING SITE I, BINDING SITE II or BINDING SITE III. Table 2 illustrates the complementarity of the nucleotide sequences of TGFBR3 BINDING SITE, designated SEQ ID:9253, to the nucleotide sequence of VGAM2205 RNA, herein designated VGAM RNA, also designated SEQ ID:4916.

Another function of VGAM2205 is therefore inhibition of Transforming Growth Factor, Beta Receptor III (betaglycan, 300 kDa) (TGFBR3, Accession NM_003243), a gene which involves in capturing and retaining TGF-beta for presentation to the signaling receptors. Accordingly, utilities of VGAM2205 include diagnosis, prevention and treatment of diseases and clinical conditions associated with TGFBR3. The function of TGFBR3 and its association with various diseases and clinical conditions, has been established by previous studies, as described hereinabove with reference to VGAM139. FLJ20136 (Accession NM_017684) is another VGAM2205 host target gene. FLJ20136 BINDING SITE is HOST TARGET binding site found in the 3' untranslated region of mRNA encoded by FLJ20136, corresponding to a HOST TARGET binding site such as BINDING SITE I, BINDING SITE II or BINDING SITE III. Table 2 illustrates the complementarity of the nucleotide sequences of FLJ20136 BINDING SITE, designated SEQ ID:19231, to the nucleotide sequence of VGAM2205 RNA, herein designated VGAM RNA, also designated SEQ ID:4916.

Another function of VGAM2205 is therefore inhibition of FLJ20136 (Accession NM_017684). Accordingly, utilities of VGAM2205 include diagnosis, prevention and treatment of diseases and clinical conditions associated with FLJ20136. IL-23R (Accession NM_144701) is another VGAM2205 host target gene. IL-23R BINDING SITE is HOST TARGET binding site found in the 3' untranslated region of mRNA encoded by IL-23R, corresponding to a HOST TARGET binding site such as BINDING SITE I, BINDING SITE II or BINDING SITE III. Table 2 illustrates the complementarity of the nucleotide sequences of IL-23R BINDING SITE, designated SEQ ID:29526, to the nucleotide sequence of VGAM2205 RNA, herein designated VGAM RNA, also designated SEQ ID:4916.

Another function of VGAM2205 is therefore inhibition of IL-23R (Accession NM_144701). Accordingly, utilities of VGAM2205 include diagnosis, prevention and treatment of diseases and clinical conditions associated with IL-23R. KIAA0007 (Accession XM_087089) is another VGAM2205 host target gene. KIAA0007 BINDING SITE is HOST TARGET binding site found in the 3' untranslated region of mRNA encoded by KIAA0007, corresponding to a HOST TARGET binding site such as BINDING SITE I, BINDING SITE II or BINDING SITE III. Table 2 illustrates the complementarity of the nucleotide sequences of KIAA0007 BINDING SITE, designated SEQ ID:39047, to the nucleotide sequence of VGAM2205 RNA, herein designated VGAM RNA, also designated SEQ ID:4916.

Another function of VGAM2205 is therefore inhibition of KIAA0007 (Accession XM_087089). Accordingly, utilities of VGAM2205 include diagnosis, prevention and treatment of diseases and clinical conditions associated with KIAA0007. MGC5576 (Accession NM_024056) is another VGAM2205 host target gene. MGC5576 BINDING SITE is HOST TARGET binding site found in the 3' untranslated region of mRNA encoded by MGC5576, corresponding to a HOST TARGET binding site such as BINDING SITE I, BINDING SITE II or BINDING SITE III. Table 2 illustrates the complementarity of the nucleotide sequences of MGC5576 BINDING SITE, designated SEQ ID:23494, to the nucleotide sequence of VGAM2205 RNA, herein designated VGAM RNA, also designated SEQ ID:4916.

Another function of VGAM2205 is therefore inhibition of MGC5576 (Accession NM_024056). Accordingly, utilities of VGAM2205 include diagnosis, prevention and treatment of diseases and clinical conditions associated with MGC5576. Oxysterol Binding Protein-like 5 (OSBPL5, Accession XM_052567) is another VGAM2205 host target gene. OSBPL5 BINDING SITE is HOST TARGET binding site found in the 3' untranslated region of mRNA encoded by OSBPL5, corresponding to a HOST TARGET binding site such as BINDING SITE I, BINDING SITE II or BINDING SITE III. Table 2 illustrates the complementarity of the nucleotide sequences of OSBPL5 BINDING SITE, designated SEQ ID:35993, to the nucleotide sequence of VGAM2205 RNA, herein designated VGAM RNA, also designated SEQ ID:4916.

Another function of VGAM2205 is therefore inhibition of Oxysterol Binding Protein-like 5 (OSBPL5, Accession XM_052567). Accordingly, utilities of VGAM2205 include diagnosis, prevention and treatment of diseases and clinical conditions associated with OSBPL5. PEGASUS (Accession NM_022466) is another VGAM2205 host target gene. PEGASUS BINDING SITE is HOST TARGET binding site found in the 3' untranslated region of mRNA encoded by PEGASUS, corresponding to a HOST TARGET binding site such as BINDING SITE I, BINDING SITE II or BINDING SITE III. Table 2 illustrates the complementarity of the nucleotide sequences of PEGASUS BINDING SITE, designated SEQ ID:22816, to the nucleotide sequence of VGAM2205 RNA, herein designated VGAM RNA, also designated SEQ ID:4916.

Another function of VGAM2205 is therefore inhibition of PEGASUS (Accession NM_022466). Accordingly, utilities of VGAM2205 include diagnosis, prevention and treatment of diseases and clinical conditions associated with PEGASUS. PURG (Accession NM_013357) is another VGAM2205 host target gene. PURG BINDING SITE is HOST TARGET binding site found in the 3' untranslated region of mRNA encoded by PURG, corresponding to a HOST TARGET binding site such as BINDING SITE I, BINDING SITE II or BINDING SITE III. Table 2 illustrates the complementarity of the nucleotide sequences of PURG BINDING SITE, designated SEQ ID:15007, to the nucleotide sequence of VGAM2205 RNA, herein designated VGAM RNA, also designated SEQ ID:4916.

Another function of VGAM2205 is therefore inhibition of PURG (Accession NM_013357). Accordingly, utilities of VGAM2205 include diagnosis, prevention and treatment of diseases and clinical conditions associated with PURG. SMOC2 (Accession XM_051452) is another VGAM2205 host target gene. SMOC2 BINDING SITE is HOST TARGET binding site found in the 3' untranslated region of mRNA encoded by SMOC2, corresponding to a HOST TARGET binding site such as BINDING SITE I, BINDING SITE II or BINDING SITE III. Table 2 illustrates the complementarity of the nucleotide sequences of SMOC2 BINDING SITE, designated SEQ ID:35838, to the nucleotide sequence of VGAM2205 RNA, herein designated VGAM RNA, also designated SEQ ID:4916.

Another function of VGAM2205 is therefore inhibition of SMOC2 (Accession XM_051452). Accordingly, utilities of VGAM2205 include diagnosis, prevention and treatment of diseases and clinical conditions associated with SMOC2. LOC122773 (Accession XM_058665) is another VGAM2205 host target gene. LOC122773 BINDING SITE is HOST TARGET binding site found in the 3' untranslated region of mRNA encoded by LOC122773, corresponding to a HOST TARGET binding site such as BINDING SITE I, BINDING SITE II or BINDING SITE III. Table 2 illustrates the complementarity of the nucleotide sequences of LOC122773 BINDING SITE, designated SEQ ID:36712, to the nucleotide sequence of VGAM2205 RNA, herein designated VGAM RNA, also designated SEQ ID:4916.

Another function of VGAM2205 is therefore inhibition of LOC122773 (Accession XM_058665). Accordingly, utilities of VGAM2205 include diagnosis, prevention and treatment of diseases and clinical conditions associated with LOC122773. LOC144305 (Accession XM_096572) is another VGAM2205 host target gene. LOC144305 BINDING SITE is HOST TARGET binding site found in the 3' untranslated region of mRNA encoded by LOC144305, corresponding to a HOST TARGET binding site such as BINDING SITE I, BINDING SITE II or BINDING SITE III. Table 2 illustrates the complementarity of the nucleotide sequences of LOC144305 BINDING SITE, designated SEQ ID:40402, to the nucleotide sequence of VGAM2205 RNA, herein designated VGAM RNA, also designated SEQ ID:4916.

Another function of VGAM2205 is therefore inhibition of LOC144305 (Accession XM_096572). Accordingly, utilities of VGAM2205 include diagnosis, prevention and treatment of diseases and clinical conditions associated with LOC144305. LOC145845 (Accession XM_096884) is another VGAM2205 host target gene. LOC145845 BINDING SITE is HOST TARGET binding site found in the 3' untranslated region of mRNA encoded by LOC145845, corresponding to a HOST TARGET binding site such as BINDING SITE I, BINDING SITE II or BINDING SITE III. Table 2 illustrates the complementarity of the nucleotide sequences of LOC145845 BINDING SITE, designated SEQ ID:40617, to the nucleotide sequence of VGAM2205 RNA, herein designated VGAM RNA, also designated SEQ ID:4916.

Another function of VGAM2205 is therefore inhibition of LOC145845 (Accession XM_096884). Accordingly, utilities of VGAM2205 include diagnosis, prevention and treatment of diseases and clinical conditions associated with LOC145845. LOC152185 (Accession NM_144718) is another VGAM2205 host target gene. LOC152185 BINDING SITE is HOST TARGET binding site found in the 3' untranslated region of mRNA encoded by LOC152185, corresponding to a HOST TARGET binding site such as BINDING SITE I, BINDING SITE II or BINDING SITE III. Table 2 illustrates the complementarity of the nucleotide sequences of LOC152185 BINDING SITE, designated SEQ ID:29540, to the nucleotide sequence of VGAM2205 RNA, herein designated VGAM RNA, also designated SEQ ID:4916.

Another function of VGAM2205 is therefore inhibition of LOC152185 (Accession NM_144718). Accordingly, utilities of VGAM2205 include diagnosis, prevention and treatment of diseases and clinical conditions associated with LOC152185. LOC153688 (Accession XM_098416) is another VGAM2205 host target gene. LOC153688 BINDING SITE is HOST TARGET binding site found in the 3' untranslated region of mRNA encoded by LOC153688, corresponding to a HOST TARGET binding site such as BINDING SITE I, BINDING SITE II or BINDING SITE III. Table 2 illustrates the complementarity of the nucleotide sequences of LOC153688 BINDING SITE, designated SEQ ID:41663, to the nucleotide sequence of VGAM2205 RNA, herein designated VGAM RNA, also designated SEQ ID:4916.

Another function of VGAM2205 is therefore inhibition of LOC153688 (Accession XM_098416). Accordingly, utilities of VGAM2205 include diagnosis, prevention and treatment of diseases and clinical conditions associated with LOC153688. LOC196527 (Accession XM_113743) is another VGAM2205 host target gene. LOC196527 BINDING SITE is HOST TARGET binding site found in the 3' untranslated region of mRNA encoded by LOC196527, corresponding to a HOST TARGET binding site such as BINDING SITE I, BINDING SITE II or BINDING SITE III. Table 2 illustrates the complementarity of the nucleotide sequences of LOC196527 BINDING SITE, designated SEQ ID:42402, to the nucleotide sequence of VGAM2205 RNA, herein designated VGAM RNA, also designated SEQ ID:4916.

Another function of VGAM2205 is therefore inhibition of LOC196527 (Accession XM_113743). Accordingly, utilities of VGAM2205 include diagnosis, prevention and treatment of diseases and clinical conditions associated with LOC196527. LOC221271 (Accession XM_166307) is another VGAM2205 host target gene. LOC221271 BINDING SITE is HOST TARGET binding site found in the 3' untranslated region of mRNA encoded by LOC221271, corresponding to a HOST TARGET binding site such as BINDING SITE I, BINDING SITE II or BINDING SITE III. Table 2 illustrates the complementarity of the nucleotide sequences of LOC221271 BINDING SITE, designated SEQ ID:44128, to the nucleotide sequence of VGAM2205 RNA, herein designated VGAM RNA, also designated SEQ ID:4916.

Another function of VGAM2205 is therefore inhibition of LOC221271 (Accession XM_166307). Accordingly, utilities of VGAM2205 include diagnosis, prevention and treatment of diseases and clinical conditions associated with LOC221271. FIG. 1 further provides a conceptual description of a novel bioinformatically detected viral gene of the present invention, referred to here as Viral Genomic Address Messenger 2206 (VGAM2206) viral gene, which modulates expression of respective host target genes thereof, the function and utility of which host target genes is known in the art.

VGAM2206 is a novel bioinformatically detected regulatory, non protein coding, viral micro RNA (miRNA) gene. The method by which VGAM2206 was detected is described hereinabove with reference to FIGS. 1-8.

VGAM2206 gene, herein designated VGAM GENE, is a viral gene contained in the genome of Cowpox Virus. VGAM2206 host target gene, herein designated VGAM HOST TARGET GENE, is a human gene contained in the human genome.

VGAM2206 gene encodes a VGAM2206 precursor RNA, herein designated VGAM PRECURSOR RNA. Similar to other miRNA genes, and unlike most ordinary genes, VGAM2206 precursor RNA does not encode a protein. A nucleotide sequence identical or highly similar to the nucleotide sequence of VGAM2206 precursor RNA is designated SEQ ID:2192, and is provided hereinbelow with reference to the sequence listing part. Nucleotide sequence SEQ ID:2192 is located at position 178296 relative to the genome of Cowpox Virus.

VGAM2206 precursor RNA folds onto itself, forming VGAM2206 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2206 folded precursor RNA into VGAM2206 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM2206 RNA is designated SEQ ID:4917, and is provided hereinbelow with reference to the sequence listing part.

VGAM2206 host target gene, herein designated VGAM HOST TARGET GENE, encodes a corresponding messenger RNA, VGAM2206 host target RNA, herein designated VGAM HOST TARGET RNA. VGAM2206 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2206 RNA, herein designated VGAM RNA, binds complementarily to one or more host target binding sites located in untranslated regions of VGAM2206 host target RNA, herein designated VGAM HOST TARGET RNA. This complementary binding is due to the fact that the nucleotide sequence of VGAM2206 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2206 RNA, herein designated VGAM RNA, may have a different number of host target binding sites in untranslated regions of a VGAM2206 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2206 RNA, herein designated VGAM RNA, to host target binding sites on VGAM2206 host target RNA, herein designated VGAM HOST TARGET RNA, such as BINDING SITE I, BINDING SITE II and BINDING SITE III, inhibits translation of VGAM2206 host target RNA into VGAM2206 host target protein, herein designated VGAM HOST TARGET PROTEIN. VGAM host target protein is therefore outlined by a broken line.

It is appreciated that VGAM2206 host target gene, herein designated VGAM HOST TARGET GENE, in fact represents a plurality of VGAM2206 host target genes. The mRNA of each one of this plurality of VGAM2206 host target genes comprises one or more host target binding sites, each having a nucleotide sequence which is at least partly complementary to VGAM2206 RNA, herein designated VGAM RNA, and which when bound by VGAM2206 RNA causes inhibition of translation of respective one or more VGAM2206 host target proteins.

It is further appreciated by one skilled in the art that the mode of translational inhibition illustrated by FIG. 1 with specific reference to translational inhibition exerted by VGAM2206 gene, herein designated VGAM GENE, on one or more VGAM2206 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2206 is inhibition of expression of host target genes, as part of a novel viral mechanism of attacking a host. Accordingly, utilities of VGAM2206 include diagnosis, prevention and treatment of viral infection by Cowpox Virus. Specific functions, and accordingly utilities, of VGAM2206 correlate with, and may be deduced from, the identity of the host target genes which VGAM2206 binds and inhibits, and the function of these host target genes, as elaborated hereinbelow.

Nucleotide sequences of the VGAM2206 precursor RNA, herein designated VGAM PRECURSOR RNA, and of the 'diced' VGAM2206 RNA, herein designated VGAM RNA, and a schematic representation of the secondary folding of VGAM2206 folded precursor RNA, herein designated VGAM FOLDED PRECURSOR RNA, of VGAM2206 are further described hereinbelow with reference to Table 1.

Nucleotide sequences of host target binding sites, such as BINDING SITE-I, BINDING SITE-II and BINDING SITE-III of FIG. 1, found on VGAM2206 host target RNA, and schematic representation of the complementarity of each of these host target binding sites to VGAM2206 RNA, herein designated VGAM RNA, are described hereinbelow with reference to Table 2.

As mentioned hereinabove with reference to FIG. 1, a function of VGAM2206 gene, herein designated VGAM is inhibition of expression of VGAM2206 target genes. It is appreciated that specific functions, and accordingly utilities, of VGAM2206 correlate with, and may be deduced from, the identity of the target genes which VGAM2206 binds and inhibits, and the function of these target genes, as elaborated hereinbelow.

DKFZp434G179 (Accession XM_087065) is a VGAM2206 host target gene. DKFZp434G179 BINDING SITE is HOST TARGET binding site found in the 3' untranslated region of mRNA encoded by DKFZp434G179, corresponding to a HOST TARGET binding site such as BINDING SITE I, BINDING SITE II or BINDING SITE III. Table 2 illustrates the complementarity of the nucleotide sequences of DKFZp434G179 BINDING SITE, designated SEQ ID:39039, to the nucleotide sequence of VGAM2206 RNA, herein designated VGAM RNA, also designated SEQ ID:4917.

A function of VGAM2206 is therefore inhibition of DKFZp434G179 (Accession XM_087065). Accordingly, utilities of VGAM2206 include diagnosis, prevention and treatment of diseases and clinical conditions associated with DKFZp434G179. ORM1-like 2 (S. cerevisiae) (ORMDL2, Accession NM_014182) is another VGAM2206 host target gene. ORMDL2 BINDING SITE is HOST TARGET binding site found in the 3' untranslated region of mRNA encoded by ORMDL2, corresponding to a HOST TARGET binding site such as BINDING SITE I, BINDING SITE II or BINDING SITE III. Table 2 illustrates the complementarity of the nucleotide sequences of ORMDL2 BINDING SITE, designated SEQ ID:15466, to the nucleotide sequence of VGAM2206 RNA, herein designated VGAM RNA, also designated SEQ ID:4917.

Another function of VGAM2206 is therefore inhibition of ORM1-like 2 (S. cerevisiae) (ORMDL2, Accession NM_014182). Accordingly, utilities of VGAM2206 include diagnosis, prevention and treatment of diseases and clinical conditions associated with ORMDL2. Tubby Homolog (mouse) (TUB, Accession NM_003320) is another VGAM2206 host target gene. TUB BINDING SITE is HOST TARGET binding site found in the 3' untranslated region of mRNA encoded by TUB, corresponding to a HOST TARGET binding site such as BINDING SITE I, BINDING SITE II or BINDING SITE III. Table 2 illustrates the complementarity of the nucleotide sequences of TUB BINDING SITE, designated SEQ ID:9321, to the nucleotide sequence of VGAM2206 RNA, herein designated VGAM RNA, also designated SEQ ID:4917.

Another function of VGAM2206 is therefore inhibition of Tubby Homolog (mouse) (TUB, Accession NM_003320). Accordingly, utilities of VGAM2206 include diagnosis, prevention and treatment of diseases and clinical conditions associated with TUB. LOC115265 (Accession XM_055596) is another VGAM2206 host target gene. LOC115265 BINDING SITE is HOST TARGET binding site found in the 3' untranslated region of mRNA encoded by LOC115265, corresponding to a HOST TARGET binding site such as BINDING SITE I, BINDING SITE II or BINDING SITE III. Table 2 illustrates the complementarity of the nucleotide sequences of LOC115265 BINDING SITE, designated SEQ ID:36307, to the nucleotide sequence of VGAM2206 RNA, herein designated VGAM RNA, also designated SEQ ID:4917.

Another function of VGAM2206 is therefore inhibition of LOC115265 (Accession XM_055596). Accordingly, utilities of VGAM2206 include diagnosis, prevention and treatment of diseases and clinical conditions associated with LOC115265. LOC157657 (Accession XM_088352) is another VGAM2206 host target gene. LOC157657 BINDING SITE is HOST TARGET binding site found in the 3' untranslated region of mRNA encoded by LOC157657, corresponding to a HOST TARGET binding site such as BINDING SITE I, BINDING SITE II or BINDING SITE III. Table 2 illustrates the complementarity of the nucleotide sequences of LOC157657 BINDING SITE, designated SEQ ID:39624, to the nucleotide sequence of VGAM2206 RNA, herein designated VGAM RNA, also designated SEQ ID:4917.

Another function of VGAM2206 is therefore inhibition of LOC157657 (Accession XM_088352). Accordingly, utilities of VGAM2206 include diagnosis, prevention and treatment of diseases and clinical conditions associated with LOC157657. FIG. 1 further provides a conceptual description of a novel bioinformatically detected viral gene of the present invention, referred to here as Viral Genomic Address Messenger 2207 (VGAM2207) viral gene, which modulates expression of respective host target genes thereof, the function and utility of which host target genes is known in the art.

VGAM2207 is a novel bioinformatically detected regulatory, non protein coding, viral micro RNA (miRNA) gene. The method by which VGAM2207 was detected is described hereinabove with reference to FIGS. 1-8.

VGAM2207 gene, herein designated VGAM GENE, is a viral gene contained in the genome of Myxoma Virus. VGAM2207 host target gene, herein designated VGAM HOST TARGET GENE, is a human gene contained in the human genome.

VGAM2207 gene encodes a VGAM2207 precursor RNA, herein designated VGAM PRECURSOR RNA. Similar to other miRNA genes, and unlike most ordinary genes, VGAM2207 precursor RNA does not encode a protein. A nucleotide sequence identical or highly similar to the nucleotide sequence of VGAM2207 precursor RNA is designated SEQ ID:2193, and is provided hereinbelow with reference to the sequence listing part. Nucleotide sequence SEQ ID:2193 is located at position 11555 relative to the genome of Myxoma Virus.

VGAM2207 precursor RNA folds onto itself, forming VGAM2207 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2207 folded precursor RNA into VGAM2207 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2207 RNA is designated SEQ ID:4918, and is provided hereinbelow with reference to the sequence listing part.

VGAM2207 host target gene, herein designated VGAM HOST TARGET GENE, encodes a corresponding messenger RNA, VGAM2207 host target RNA, herein designated VGAM HOST TARGET RNA. VGAM2207 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2207 RNA, herein designated VGAM RNA, binds complementarily to one or more host target binding sites located in untranslated regions of VGAM2207 host target RNA, herein designated VGAM HOST TARGET RNA. This complementary binding is due to the fact that the nucleotide sequence of VGAM2207 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2207 RNA, herein designated VGAM RNA, may have a different number of host target binding sites in untranslated regions of a VGAM2207 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2207 RNA, herein designated VGAM RNA, to host target binding sites on VGAM2207 host target RNA, herein designated VGAM HOST TARGET RNA, such as BINDING SITE I, BINDING SITE II and BINDING SITE III, inhibits translation of VGAM2207 host target RNA into VGAM2207 host target protein, herein designated VGAM HOST TARGET PROTEIN. VGAM host target protein is therefore outlined by a broken line.

It is appreciated that VGAM2207 host target gene, herein designated VGAM HOST TARGET GENE, in fact represents a plurality of VGAM2207 host target genes. The mRNA of each one of this plurality of VGAM2207 host target genes comprises one or more host target binding sites, each having a nucleotide sequence which is at least partly complementary to VGAM2207 RNA, herein designated VGAM RNA, and which when bound by VGAM2207 RNA causes inhibition of translation of respective one or more VGAM2207 host target proteins.

It is further appreciated by one skilled in the art that the mode of translational inhibition illustrated by FIG. 1 with specific reference to translational inhibition exerted by VGAM2207 gene, herein designated VGAM GENE, on one or more VGAM2207 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2207 is inhibition of expression of host target genes, as part of a novel viral mechanism of attacking a host. Accordingly, utilities of VGAM2207 include diagnosis, prevention and treatment of viral infection by Myxoma Virus. Specific functions, and accordingly utilities, of VGAM2207 correlate with, and may be deduced from, the identity of the host target genes which VGAM2207 binds and inhibits, and the function of these host target genes, as elaborated hereinbelow.

Nucleotide sequences of the VGAM2207 precursor RNA, herein designated VGAM PRECURSOR RNA, and of the 'diced' VGAM2207 RNA, herein designated VGAM RNA, and a schematic representation of the secondary folding of VGAM2207 folded precursor RNA, herein designated VGAM FOLDED PRECURSOR RNA, of VGAM2207 are further described hereinbelow with reference to Table 1.

Nucleotide sequences of host target binding sites, such as BINDING SITE-I, BINDING SITE-II and BINDING SITE-III of FIG. 1, found on VGAM2207 host target RNA, and schematic representation of the complementarity of each of these host target binding sites to VGAM2207 RNA, herein designated VGAM RNA, are described hereinbelow with reference to Table 2.

As mentioned hereinabove with reference to FIG. 1, a function of VGAM2207 gene, herein designated VGAM is inhibition of expression of VGAM2207 target genes. It is appreciated that specific functions, and accordingly utilities, of VGAM2207 correlate with, and may be deduced from, the identity of the target genes which VGAM2207 binds and inhibits, and the function of these target genes, as elaborated hereinbelow.

Poly (ADP-ribose) Glycohydrolase (PARG, Accession NM_003631) is a VGAM2207 host target gene. PARG BINDING SITE is HOST TARGET binding site found in the 3' untranslated region of mRNA encoded by PARG, corresponding to a HOST TARGET binding site such as BINDING SITE I, BINDING SITE II or BINDING SITE III. Table 2 illustrates the complementarity of the nucleotide sequences of PARG BINDING SITE, designated SEQ ID:9693, to the nucleotide sequence of VGAM2207 RNA, herein designated VGAM RNA, also designated SEQ ID:4918.

A function of VGAM2207 is therefore inhibition of Poly (ADP-ribose) Glycohydrolase (PARG, Accession NM_003631), a gene which is found in many tissues and may be subject to proteolysis generating smaller, active products. Accordingly, utilities of VGAM2207 include diagnosis, prevention and treatment of diseases and clinical conditions associated with PARG. The function of PARG has been established by previous studies. The synthesis and rapid turnover of ADP-ribose polymers is an immediate cellular response to DNA damage. Once synthesized by PARP (OMIM Ref. No. 173870), polymers are rapidly turned over and converted to free ADP-ribose by the action of poly (ADP-ribose) glycohydrolase (PARG). By PCR with degenerate primers based on the partial protein sequence of bovine PARG, Lin et al. (1997) isolated bovine PARG cDNAs. The protein had a calculated molecular mass of 111 kD, nearly twice the size of the 59-kD enzymatically active PARG isolated from bovine thymus. Using an activity gel assay of extracts from bacteria expressing PARG, the authors determined that cDNA encoded proteins of approximately 115 and 59 kD. The larger protein was sensitive to proteolysis, yielding a protein of approximately 59 kD. The enzymatically active 59-kD PARG corresponded to the C-terminal portion of the protein. The authors suggested that proteolysis explains the presence of PARG activity with a molecular mass of approximately 74 and 59 kD in bovine thymus preparations, and previous reports of a 74-kD PARG in guinea pig liver and human placenta. Using the sequence of the bovine cDNA, they searched sequence databases and identified human and rat PARG cDNAs. By fluorescence in situ hybridization, Ame et al. (1999) mapped the PARG gene to human chromosome 10q11.23 and mouse chromosome 14B.

Full details of the abovementioned studies are described in the following publications, the disclosure of which are hereby incorporated by reference:

Lin, W.; Ame, J.-C.; Aboul-Ela, N.; Jacobson, E. L.; Jacobson, M. K.: Isolation and characterization of the cDNA encoding bovine poly (ADP-ribose) glycohydrolase. J. Biol. Chem. 272:11895-11901, 1997; and Ame, J.-C.; Apiou, F.; Jacobson, E. L.; Jacobson, M. K.: Assignment of the poly (ADP-ribose) glycohydrolase gene (PARG) to human chromosome 10q11.23 and mouse chromosome 14B by in situ.

Further studies establishing the function and utilities of PARG are found in John Hopkins OMIM database record ID 603501, and in sited publications numbered 7988-7989 listed in the bibliography section hereinbelow, which are also hereby incorporated by reference. Suppression of Tumorigenicity 7 (ST7, Accession NM_021908) is another VGAM2207 host target gene. ST7 BINDING SITE is HOST TARGET binding site found in the 3' untranslated region of mRNA encoded by ST7, corresponding to a HOST TARGET binding site such as BINDING SITE I, BINDING SITE II or BINDING SITE III. Table 2 illustrates the complementarity of the nucleotide sequences of ST7 BINDING SITE, designated SEQ ID:22433, to the nucleotide sequence of VGAM2207 RNA, herein designated VGAM RNA, also designated SEQ ID:4918.

Another function of VGAM2207 is therefore inhibition of Suppression of Tumorigenicity 7 (ST7, Accession NM_021908), a gene which has a role in regulating cell-environment or cell-cell interactions. Accordingly, utilities of VGAM2207 include diagnosis, prevention and treatment of diseases and clinical conditions associated with ST7. The function of ST7 and its association with various diseases and clinical conditions, has been established by previous studies, as described hereinabove with reference to VGAM107. BMF (Accession NM_033503) is another VGAM2207 host target gene. BMF BINDING SITE is HOST TARGET binding site found in the 3' untranslated region of mRNA encoded by BMF, corresponding to a HOST TARGET binding site such as BINDING SITE I, BINDING SITE II or BINDING SITE III. Table 2 illustrates the complementarity of the nucleotide sequences of BMF BINDING SITE, designated SEQ ID:27284, to the nucleotide sequence of VGAM2207 RNA, herein designated VGAM RNA, also designated SEQ ID:4918.

Another function of VGAM2207 is therefore inhibition of BMF (Accession NM_033503). Accordingly, utilities of VGAM2207 include diagnosis, prevention and treatment of diseases and clinical conditions associated with BMF. FLJ11274 (Accession NM_018375) is another VGAM2207 host target gene. FLJ11274 BINDING SITE is HOST TARGET binding site found in the 3' untranslated region of mRNA encoded by FLJ11274, corresponding to a HOST TARGET binding site such as BINDING SITE I, BINDING SITE II or BINDING SITE III. Table 2 illustrates the complementarity of the nucleotide sequences of FLJ11274 BINDING SITE, designated SEQ ID:20402, to the nucleotide sequence of VGAM2207 RNA, herein designated VGAM RNA, also designated SEQ ID:4918.

Another function of VGAM2207 is therefore inhibition of FLJ11274 (Accession NM_018375). Accordingly, utilities of VGAM2207 include diagnosis, prevention and treatment of diseases and clinical conditions associated with FLJ11274. FLJ20457 (Accession NM_017832) is another VGAM2207 host target gene. FLJ20457 BINDING SITE is HOST TARGET binding site found in the 3' untranslated region of mRNA encoded by FLJ20457, corresponding to a HOST TARGET binding site such as BINDING SITE I, BINDING SITE II or BINDING SITE III. Table 2 illustrates the complementarity of the nucleotide sequences of FLJ20457 BINDING SITE, designated SEQ ID:19498, to the nucleotide sequence of VGAM2207 RNA, herein designated VGAM RNA, also designated SEQ ID:4918.

Another function of VGAM2207 is therefore inhibition of FLJ20457 (Accession NM_017832). Accordingly, utilities of VGAM2207 include diagnosis, prevention and treatment of diseases and clinical conditions associated with FLJ20457. KIAA1165 (Accession XM_041162) is another VGAM2207 host target gene. KIAA1165 BINDING SITE is HOST TARGET binding site found in the 3' untranslated region of mRNA encoded by KIAA1165, corresponding to a HOST TARGET binding site such as BINDING SITE I, BINDING SITE II or BINDING SITE III. Table 2 illustrates the complementarity of the nucleotide sequences of KIAA1165 BINDING SITE, designated SEQ ID:33479, to the nucleotide sequence of VGAM2207 RNA, herein designated VGAM RNA, also designated SEQ ID:4918.

Another function of VGAM2207 is therefore inhibition of KIAA1165 (Accession XM_041162). Accordingly, utilities of VGAM2207 include diagnosis, prevention and treatment of diseases and clinical conditions associated with KIAA1165. Mitochondrial Ribosomal Protein L13 (MRPL13, Accession NM_014078) is another VGAM2207 host target gene. MRPL13 BINDING SITE is HOST TARGET binding site found in the 5' untranslated region of mRNA encoded by MRPL13, corresponding to a HOST TARGET binding site such as BINDING SITE I, BINDING SITE II or BINDING SITE III. Table 2 illustrates the complementarity of the nucleotide sequences of MRPL13 BINDING SITE, designated SEQ ID:15305, to the nucleotide sequence of VGAM2207 RNA, herein designated VGAM RNA, also designated SEQ ID:4918.

Another function of VGAM2207 is therefore inhibition of Mitochondrial Ribosomal Protein L13 (MRPL13, Accession NM_014078). Accordingly, utilities of VGAM2207 include diagnosis, prevention and treatment of diseases and clinical conditions associated with MRPL13. LOC220565 (Accession XM_165417) is another VGAM2207 host target gene. LOC220565 BINDING SITE is HOST TARGET binding site found in the 3' untranslated region of mRNA encoded by LOC220565, corresponding to a HOST TARGET binding site such as BINDING SITE I, BINDING SITE II or BINDING SITE III. Table 2 illustrates the complementarity of the nucleotide sequences of LOC220565 BINDING SITE, designated SEQ ID:43636, to the nucleotide sequence of VGAM2207 RNA, herein designated VGAM RNA, also designated SEQ ID:4918.

Another function of VGAM2207 is therefore inhibition of LOC220565 (Accession XM_165417). Accordingly, utilities of VGAM2207 include diagnosis, prevention and treatment of diseases and clinical conditions associated with LOC220565. FIG. 1 further provides a conceptual description of a novel bioinformatically detected viral gene of the present invention, referred to here as Viral Genomic Address Messenger 2208 (VGAM2208) viral gene, which modulates expression of respective host target genes thereof, the function and utility of which host target genes is known in the art.

VGAM2208 is a novel bioinformatically detected regulatory, non protein coding, viral micro RNA (miRNA) gene. The method by which VGAM2208 was detected is described hereinabove with reference to FIGS. 1-8.

VGAM2208 gene, herein designated VGAM GENE, is a viral gene contained in the genome of Myxoma Virus. VGAM2208 host target gene, herein designated VGAM HOST TARGET GENE, is a human gene contained in the human genome.

VGAM2208 gene encodes a VGAM2208 precursor RNA, herein designated VGAM PRECURSOR RNA. Similar to other miRNA genes, and unlike most ordinary genes, VGAM2208 precursor RNA does not encode a protein. A nucleotide sequence identical or highly similar to the nucleotide sequence of VGAM2208 precursor RNA is designated SEQ ID:2194, and is provided hereinbelow with reference to the sequence listing part. Nucleotide sequence SEQ ID:2194 is located at position 21539 relative to the genome of Myxoma Virus.

VGAM2208 precursor RNA folds onto itself, forming VGAM2208 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2208 folded precursor RNA into VGAM2208 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2208 RNA is designated SEQ ID:4919, and is provided hereinbelow with reference to the sequence listing part.

VGAM2208 host target gene, herein designated VGAM HOST TARGET GENE, encodes a corresponding messenger RNA, VGAM2208 host target RNA, herein designated VGAM HOST TARGET RNA. VGAM2208 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2208 RNA, herein designated VGAM RNA, binds complementarily to one or more host target binding sites located in untranslated regions of VGAM2208 host target RNA, herein designated VGAM HOST TARGET RNA. This complementary binding is due to the fact that the nucleotide sequence of VGAM2208 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2208 RNA, herein designated VGAM RNA, may have a different number of host target binding sites in untranslated regions of a VGAM2208 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2208 RNA, herein designated VGAM RNA, to host target binding sites on VGAM2208 host target RNA, herein designated VGAM HOST TARGET RNA, such as BINDING SITE I, BINDING SITE II and BINDING SITE III, inhibits translation of VGAM2208 host target RNA into VGAM2208 host target protein, herein designated VGAM HOST TARGET PROTEIN. VGAM host target protein is therefore outlined by a broken line.

It is appreciated that VGAM2208 host target gene, herein designated VGAM HOST TARGET GENE, in fact represents a plurality of VGAM2208 host target genes. The mRNA of each one of this plurality of VGAM2208 host target genes comprises one or more host target binding sites, each having a nucleotide sequence which is at least partly complementary to VGAM2208 RNA, herein designated VGAM RNA, and which when bound by VGAM2208 RNA causes inhibition of translation of respective one or more VGAM2208 host target proteins.

It is further appreciated by one skilled in the art that the mode of translational inhibition illustrated by FIG. 1 with specific reference to translational inhibition exerted by VGAM2208 gene, herein designated VGAM GENE, on one or more VGAM2208 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2208 is inhibition of expression of host target genes, as part of a novel viral mechanism of attacking a host. Accordingly, utilities of VGAM2208 include diagnosis, prevention and treatment of viral infection by Myxoma Virus. Specific functions, and accordingly utilities, of VGAM2208 correlate with, and may be deduced from, the identity of the host target genes which VGAM2208 binds and inhibits, and the function of these host target genes, as elaborated hereinbelow.

Nucleotide sequences of the VGAM2208 precursor RNA, herein designated VGAM PRECURSOR RNA, and of the 'diced' VGAM2208 RNA, herein designated VGAM RNA, and a schematic representation of the secondary folding of VGAM2208 folded precursor RNA, herein designated VGAM FOLDED PRECURSOR RNA, of VGAM2208 are further described hereinbelow with reference to Table 1.

Nucleotide sequences of host target binding sites, such as BINDING SITE-I, BINDING SITE-II and BINDING SITE-III of FIG. 1, found on VGAM2208 host target RNA, and schematic representation of the complementarity of each of these host target binding sites to VGAM2208 RNA, herein designated VGAM RNA, are described hereinbelow with reference to Table 2.

As mentioned hereinabove with reference to FIG. 1, a function of VGAM2208 gene, herein designated VGAM is inhibition of expression of VGAM2208 target genes. It is appreciated that specific functions, and accordingly utilities, of VGAM2208 correlate with, and may be deduced from, the identity of the target genes which VGAM2208 binds and inhibits, and the function of these target genes, as elaborated hereinbelow.

Potassium Channel, Subfamily K, Member 1 (KCNK1, Accession NM_002245) is a VGAM2208 host target gene. KCNK1 BINDING SITE is HOST TARGET binding site found in the 3' untranslated region of mRNA encoded by KCNK1, corresponding to a HOST TARGET binding site such as BINDING SITE I, BINDING SITE II or BINDING SITE III. Table 2 illustrates the complementarity of the nucleotide sequences of KCNK1 BINDING SITE, designated SEQ ID:8032, to the nucleotide sequence of VGAM2208 RNA, herein designated VGAM RNA, also designated SEQ ID:4919.

A function of VGAM2208 is therefore inhibition of Potassium Channel, Subfamily K, Member 1 (KCNK1, Accession NM_002245), a gene which is an inward rectifying potassium channel. Accordingly, utilities of VGAM2208 include diagnosis, prevention and treatment of diseases and clinical conditions associated with KCNK1. The function of KCNK1 and its association with various diseases and clinical conditions, has been established by previous studies, as described hereinabove with reference to VGAM1959. FIG. 1 further provides a conceptual description of a novel bioinformatically detected viral gene of the present invention, referred to here as Viral Genomic Address Messenger 2209 (VGAM2209) viral gene, which modulates expression of respective host target genes thereof, the function and utility of which host target genes is known in the art.

VGAM2209 is a novel bioinformatically detected regulatory, non protein coding, viral micro RNA (miRNA) gene. The method by which VGAM2209 was detected is described hereinabove with reference to FIGS. 1-8.

VGAM2209 gene, herein designated VGAM GENE, is a viral gene contained in the genome of Myxoma Virus. VGAM2209 host target gene, herein designated VGAM HOST TARGET GENE, is a human gene contained in the human genome.

VGAM2209 gene encodes a VGAM2209 precursor RNA, herein designated VGAM PRECURSOR RNA. Similar to other miRNA genes, and unlike most ordinary genes, VGAM2209 precursor RNA does not encode a protein. A nucleotide sequence identical or highly similar to the nucleotide sequence of VGAM2209 precursor RNA is designated SEQ ID:2195, and is provided hereinbelow with reference to the sequence listing part. Nucleotide sequence SEQ ID:2195 is located at position 1250 relative to the genome of Myxoma Virus.

VGAM2209 precursor RNA folds onto itself, forming VGAM2209 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2209 folded precursor RNA into VGAM2209 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2209 RNA is designated SEQ ID:4920, and is provided hereinbelow with reference to the sequence listing part.

VGAM2209 host target gene, herein designated VGAM HOST TARGET GENE, encodes a corresponding messenger RNA, VGAM2209 host target RNA, herein designated VGAM HOST TARGET RNA. VGAM2209 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2209 RNA, herein designated VGAM RNA, binds complementarily to one or more host target binding sites located in untranslated regions of VGAM2209 host target RNA, herein designated VGAM HOST TARGET RNA. This complementary binding is due to the fact that the nucleotide sequence of VGAM2209 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2209 RNA, herein designated VGAM RNA, may have a different number of host target binding sites in untranslated regions of a VGAM2209 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2209 RNA, herein designated VGAM RNA, to host target binding sites on VGAM2209 host target RNA, herein designated VGAM HOST TARGET RNA, such as BINDING SITE I, BINDING SITE II and BINDING SITE III, inhibits translation of VGAM2209 host target RNA into VGAM2209 host target protein, herein designated VGAM HOST TARGET PROTEIN. VGAM host target protein is therefore outlined by a broken line.

It is appreciated that VGAM2209 host target gene, herein designated VGAM HOST TARGET GENE, in fact represents a plurality of VGAM2209 host target genes. The mRNA of each one of this plurality of VGAM2209 host target genes comprises one or more host target binding sites, each having a nucleotide sequence which is at least partly complementary to VGAM2209 RNA, herein designated VGAM RNA, and which when bound by VGAM2209 RNA causes inhibition of translation of respective one or more VGAM2209 host target proteins.

It is further appreciated by one skilled in the art that the mode of translational inhibition illustrated by FIG. 1 with specific reference to translational inhibition exerted by VGAM2209 gene, herein designated VGAM GENE, on one or more VGAM2209 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2209 is inhibition of expression of host target genes, as part of a novel viral mechanism of attacking a host. Accordingly, utilities of VGAM2209 include diagnosis, prevention and treatment of viral infection by Myxoma Virus. Specific functions, and accordingly utilities, of VGAM2209 correlate with, and may be deduced from, the identity of the host target genes which VGAM2209 binds and inhibits, and the function of these host target genes, as elaborated hereinbelow.

Nucleotide sequences of the VGAM2209 precursor RNA, herein designated VGAM PRECURSOR RNA, and of the 'diced' VGAM2209 RNA, herein designated VGAM RNA, and a schematic representation of the secondary folding of VGAM2209 folded precursor RNA, herein designated VGAM FOLDED PRECURSOR RNA, of VGAM2209 are further described hereinbelow with reference to Table 1.

Nucleotide sequences of host target binding sites, such as BINDING SITE-I, BINDING SITE-II and BINDING SITE-III of FIG. 1, found on VGAM2209 host target RNA, and schematic representation of the complementarity of each of these host target binding sites to VGAM2209 RNA, herein designated VGAM RNA, are described hereinbelow with reference to Table 2.

As mentioned hereinabove with reference to FIG. 1, a function of VGAM2209 gene, herein designated VGAM is inhibition of expression of VGAM2209 target genes. It is appreciated that specific functions, and accordingly utilities, of VGAM2209 correlate with, and may be deduced from, the identity of the target genes which VGAM2209 binds and inhibits, and the function of these target genes, as elaborated hereinbelow.

FLJ10620 (Accession NM_018157) is a VGAM2209 host target gene. FLJ10620 BINDING SITE is HOST TARGET binding site found in the 3' untranslated region of mRNA encoded by FLJ10620, corresponding to a HOST TARGET binding site such as BINDING SITE I, BINDING SITE II or BINDING SITE III. Table 2 illustrates the complementarity of the nucleotide sequences of FLJ10620 BINDING SITE, designated SEQ ID:19973, to the nucleotide sequence of VGAM2209 RNA, herein designated VGAM RNA, also designated SEQ ID:4920.

A function of VGAM2209 is therefore inhibition of FLJ10620 (Accession NM_018157). Accordingly, utilities of VGAM2209 include diagnosis, prevention and treatment of diseases and clinical conditions associated with FLJ10620. FLJ25415 (Accession NM_144708) is another VGAM2209 host target gene. FLJ25415 BINDING SITE is HOST TARGET binding site found in the 3' untranslated region of mRNA encoded by FLJ25415, corresponding to a HOST TARGET binding site such as BINDING SITE I, BINDING SITE II or BINDING SITE III. Table 2 illustrates the complementarity of the nucleotide sequences of FLJ25415 BINDING SITE, designated SEQ ID:29535, to the nucleotide sequence of VGAM2209 RNA, herein designated VGAM RNA, also designated SEQ ID:4920.

Another function of VGAM2209 is therefore inhibition of FLJ25415 (Accession NM_144708). Accordingly, utilities of VGAM2209 include diagnosis, prevention and treatment of diseases and clinical conditions associated with FLJ25415. FIG. 1 further provides a conceptual description of a novel bioinformatically detected viral gene of the present invention, referred to here as Viral Genomic Address Messenger 2210 (VGAM2210) viral gene, which modulates expression of respective host target genes thereof, the function and utility of which host target genes is known in the art.

VGAM2210 is a novel bioinformatically detected regulatory, non protein coding, viral micro RNA (miRNA) gene. The method by which VGAM2210 was detected is described hereinabove with reference to FIGS. 1-8.

VGAM2210 gene, herein designated VGAM GENE, is a viral gene contained in the genome of Myxoma Virus. VGAM2210 host target gene, herein designated VGAM HOST TARGET GENE, is a human gene contained in the human genome.

VGAM2210 gene encodes a VGAM2210 precursor RNA, herein designated VGAM PRECURSOR RNA. Similar to other miRNA genes, and unlike most ordinary genes, VGAM2210 precursor RNA does not encode a protein. A nucleotide sequence identical or highly similar to the nucleotide sequence of VGAM2210 precursor RNA is designated SEQ ID:2196, and is provided hereinbelow with reference to the sequence listing part. Nucleotide sequence SEQ ID:2196 is located at position 12338 relative to the genome of Myxoma Virus.

VGAM2210 precursor RNA folds onto itself, forming VGAM2210 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2210 folded precursor RNA into VGAM2210 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2210 RNA is designated SEQ ID:4921, and is provided hereinbelow with reference to the sequence listing part.

VGAM2210 host target gene, herein designated VGAM HOST TARGET GENE, encodes a corresponding messenger RNA, VGAM2210 host target RNA, herein designated VGAM HOST TARGET RNA. VGAM2210 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2210 RNA, herein designated VGAM RNA, binds complementarily to one or more host target binding sites located in untranslated regions of VGAM2210 host target RNA, herein designated VGAM HOST TARGET RNA. This complementary binding is due to the fact that the nucleotide sequence of VGAM2210 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2210 RNA, herein designated VGAM RNA, may have a different number of host target binding sites in untranslated regions of a VGAM2210 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2210 RNA, herein designated VGAM RNA, to host target binding sites on VGAM2210 host target RNA, herein designated VGAM HOST TARGET RNA, such as BINDING SITE I, BINDING SITE II and BINDING SITE III, inhibits translation of VGAM2210 host target RNA into VGAM2210 host target protein, herein designated VGAM HOST TARGET PROTEIN. VGAM host target protein is therefore outlined by a broken line.

It is appreciated that VGAM2210 host target gene, herein designated VGAM HOST TARGET GENE, in fact represents a plurality of VGAM2210 host target genes. The mRNA of each one of this plurality of VGAM2210 host target genes comprises one or more host target binding sites, each having a nucleotide sequence which is at least partly complementary to VGAM2210 RNA, herein designated VGAM RNA, and which when bound by VGAM2210 RNA causes inhibition of translation of respective one or more VGAM2210 host target proteins.

It is further appreciated by one skilled in the art that the mode of translational inhibition illustrated by FIG. 1 with specific reference to translational inhibition exerted by VGAM2210 gene, herein designated VGAM GENE, on one or more VGAM2210 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2210 is inhibition of expression of host target genes, as part of a novel viral mechanism of attacking a host. Accordingly, utilities of VGAM2210 include diagnosis, prevention and treatment of viral infection by Myxoma Virus. Specific functions, and accordingly utilities, of VGAM2210 correlate with, and may be deduced from, the identity of the host target genes which VGAM2210 binds and inhibits, and the function of these host target genes, as elaborated hereinbelow.

Nucleotide sequences of the VGAM2210 precursor RNA, herein designated VGAM PRECURSOR RNA, and of the 'diced' VGAM2210 RNA, herein designated VGAM RNA, and a schematic representation of the secondary folding of VGAM2210 folded precursor RNA, herein designated VGAM FOLDED PRECURSOR RNA, of VGAM2210 are further described hereinbelow with reference to Table 1.

Nucleotide sequences of host target binding sites, such as BINDING SITE-I, BINDING SITE-II and BINDING SITE-III of FIG. 1, found on VGAM2210 host target RNA, and schematic representation of the complementarity of each of these host target binding sites to VGAM2210 RNA, herein designated VGAM RNA, are described hereinbelow with reference to Table 2.

As mentioned hereinabove with reference to FIG. 1, a function of VGAM2210 gene, herein designated VGAM is inhibition of expression of VGAM2210 target genes. It is appreciated that specific functions, and accordingly utilities, of VGAM2210 correlate with, and may be deduced from, the identity of the target genes which VGAM2210 binds and inhibits, and the function of these target genes, as elaborated hereinbelow.

Tumor Necrosis Factor (ligand) Superfamily, Member 15 (TNFSF15, Accession NM_005118) is a VGAM2210 host target gene. TNFSF15 BINDING SITE is HOST TARGET binding site found in the 5' untranslated region of mRNA encoded by TNFSF15, corresponding to a HOST TARGET binding site such as BINDING SITE I, BINDING SITE II or BINDING SITE III. Table 2 illustrates the complementarity of the nucleotide sequences of TNFSF15 BINDING SITE, designated SEQ ID:11600, to the nucleotide sequence of VGAM2210 RNA, herein designated VGAM RNA, also designated SEQ ID:4921.

A function of VGAM2210 is therefore inhibition of Tumor Necrosis Factor (ligand) Superfamily, Member 15 (TNFSF15, Accession NM_005118), a gene which acts as an autocrine factor to induce apoptosis in endothelial cells. Accordingly, utilities of VGAM2210 include diagnosis, prevention and treatment of diseases and clinical conditions associated with TNFSF15. The function of TNFSF15 and its association with various diseases and clinical conditions, has been established by previous studies, as described hereinabove with reference to VGAM350. KIAA1497 (Accession XM_041431) is another VGAM2210 host target gene. KIAA1497 BINDING SITE is HOST TARGET binding site found in the 5' untranslated region of mRNA encoded by KIAA1497, corresponding to a HOST TARGET binding site such as BINDING SITE I, BINDING SITE II or BINDING SITE III. Table 2 illustrates the complementarity of the nucleotide sequences of KIAA1497 BINDING SITE, designated SEQ ID:33525, to the nucleotide sequence of VGAM2210 RNA, herein designated VGAM RNA, also designated SEQ ID:4921.

Another function of VGAM2210 is therefore inhibition of KIAA1497 (Accession XM_041431). Accordingly, utilities of VGAM2210 include diagnosis, prevention and treatment of diseases and clinical conditions associated with KIAA1497. FIG. 1 further provides a conceptual description of a novel bioinformatically detected viral gene of the present invention, referred to here as Viral Genomic Address Messenger 2211 (VGAM2211) viral gene, which modulates expression of respective host target genes thereof, the function and utility of which host target genes is known in the art.

VGAM2211 is a novel bioinformatically detected regulatory, non protein coding, viral micro RNA (miRNA) gene. The method by which VGAM2211 was detected is described hereinabove with reference to FIGS. 1-8.

VGAM2211 gene, herein designated VGAM GENE, is a viral gene contained in the genome of Myxoma Virus. VGAM2211 host target gene, herein designated VGAM HOST TARGET GENE, is a human gene contained in the human genome.

VGAM2211 gene encodes a VGAM2211 precursor RNA, herein designated VGAM PRECURSOR RNA. Similar to other miRNA genes, and unlike most ordinary genes, VGAM2211 precursor RNA does not encode a protein. A nucleotide sequence identical or highly similar to the nucleotide sequence of VGAM2211 precursor RNA is designated SEQ ID:2197, and is provided hereinbelow with reference to the sequence listing part. Nucleotide sequence SEQ ID:2197 is located at position 17880 relative to the genome of Myxoma Virus.

VGAM2211 precursor RNA folds onto itself, forming VGAM2211 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2211 folded precursor RNA into VGAM2211 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2211 RNA is designated SEQ ID:4922, and is provided hereinbelow with reference to the sequence listing part.

VGAM2211 host target gene, herein designated VGAM HOST TARGET GENE, encodes a corresponding messenger RNA, VGAM2211 host target RNA, herein designated VGAM HOST TARGET RNA. VGAM2211 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2211 RNA, herein designated VGAM RNA, binds complementarily to one or more host target binding sites located in untranslated regions of VGAM2211 host target RNA, herein designated VGAM HOST TARGET RNA. This complementary binding is due to the fact that the nucleotide sequence of VGAM2211 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2211 RNA, herein designated VGAM RNA, may have a different number of host target binding sites in untranslated regions of a VGAM2211 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2211 RNA, herein designated VGAM RNA, to host target binding sites on VGAM2211 host target RNA, herein designated VGAM HOST TARGET RNA, such as BINDING SITE I, BINDING SITE II and BINDING SITE III, inhibits translation of VGAM2211 host target RNA into VGAM2211 host target protein, herein designated VGAM HOST TARGET PROTEIN. VGAM host target protein is therefore outlined by a broken line.

It is appreciated that VGAM2211 host target gene, herein designated VGAM HOST TARGET GENE, in fact represents a plurality of VGAM2211 host target genes. The mRNA of each one of this plurality of VGAM2211 host target genes comprises one or more host target binding sites, each having a nucleotide sequence which is at least partly complementary to VGAM2211 RNA, herein designated VGAM RNA, and which when bound by VGAM2211 RNA causes inhibition of translation of respective one or more VGAM2211 host target proteins.

It is further appreciated by one skilled in the art that the mode of translational inhibition illustrated by FIG. 1 with specific reference to translational inhibition exerted by VGAM2211 gene, herein designated VGAM GENE, on one or more VGAM2211 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2211 is inhibition of expression of host target genes, as part of a novel viral mechanism of attacking a host. Accordingly, utilities of VGAM2211 include diagnosis, prevention and treatment of viral infection by Myxoma Virus. Specific functions, and accordingly utilities, of VGAM2211 correlate with, and may be deduced from, the identity of the host target genes which VGAM2211 binds and inhibits, and the function of these host target genes, as elaborated hereinbelow.

Nucleotide sequences of the VGAM2211 precursor RNA, herein designated VGAM PRECURSOR RNA, and of the 'diced' VGAM2211 RNA, herein designated VGAM RNA, and a schematic representation of the secondary folding of VGAM2211 folded precursor RNA, herein designated VGAM FOLDED PRECURSOR RNA, of VGAM2211 are further described hereinbelow with reference to Table 1.

Nucleotide sequences of host target binding sites, such as BINDING SITE-I, BINDING SITE-II and BINDING SITE-III of FIG. 1, found on VGAM2211 host target RNA, and schematic representation of the complementarity of each of these host target binding sites to VGAM2211 RNA, herein designated VGAM RNA, are described hereinbelow with reference to Table 2.

As mentioned hereinabove with reference to FIG. 1, a function of VGAM2211 gene, herein designated VGAM is inhibition of expression of VGAM2211 target genes. It is appreciated that specific functions, and accordingly utilities, of VGAM2211 correlate with, and may be deduced from, the identity of the target genes which VGAM2211 binds and inhibits, and the function of these target genes, as elaborated hereinbelow.

Contactin 2 (axonal) (CNTN2, Accession NM_005076) is a VGAM2211 host target gene. CNTN2 BINDING SITE is HOST TARGET binding site found in the 3' untranslated region of mRNA encoded by CNTN2, corresponding to a HOST TARGET binding site such as BINDING SITE I, BINDING SITE II or BINDING SITE III. Table 2 illustrates the complementarity of the nucleotide sequences of CNTN2 BINDING SITE, designated SEQ ID:11527, to the nucleotide sequence of VGAM2211 RNA, herein designated VGAM RNA, also designated SEQ ID:4922.

A function of VGAM2211 is therefore inhibition of Contactin 2 (axonal) (CNTN2, Accession NM_005076), a gene which may play a role in axonal growth and cell adhesion. Accordingly, utilities of VGAM2211 include diagnosis, prevention and treatment of diseases and clinical conditions associated with CNTN2. The function of CNTN2 and its association with various diseases and clinical conditions, has been established by previous studies, as described hereinabove with reference to VGAM259. DKFZP566I1024 (Accession XM_046506) is another VGAM2211 host target gene. DKFZP566I1024 BINDING SITE is HOST TARGET binding site found in the 3' untranslated region of mRNA encoded by DKFZP566I1024, corresponding to a HOST TARGET binding site such as BINDING SITE I, BINDING SITE II or BINDING SITE III. Table 2 illustrates the complementarity of the nucleotide sequences of DKFZP566I1024 BINDING SITE, designated SEQ ID:34734, to the nucleotide sequence of VGAM2211 RNA, herein designated VGAM RNA, also designated SEQ ID:4922.

Another function of VGAM2211 is therefore inhibition of DKFZP566I1024 (Accession XM_046506). Accordingly, utilities of VGAM2211 include diagnosis, prevention and treatment of diseases and clinical conditions associated with DKFZP566I1024. FLJ12078 (Accession NM_024977) is another VGAM2211 host target gene. FLJ12078 BINDING SITE is HOST TARGET binding site found in the 3' untranslated region of mRNA encoded by FLJ12078, corresponding to a HOST TARGET binding site such as BINDING SITE I, BINDING SITE II or BINDING SITE III. Table 2 illustrates the complementarity of the nucleotide sequences of FLJ12078 BINDING SITE, designated SEQ ID:24536, to the nucleotide sequence of VGAM2211 RNA, herein designated VGAM RNA, also designated SEQ ID:4922.

Another function of VGAM2211 is therefore inhibition of FLJ12078 (Accession NM_024977). Accordingly, utilities of VGAM2211 include diagnosis, prevention and treatment of diseases and clinical conditions associated with FLJ12078. GK001 (Accession NM_020198) is another VGAM2211 host target gene. GK001 BINDING SITE is HOST TARGET binding site found in the 3' untranslated region of mRNA encoded by GK001, corresponding to a HOST TARGET binding site such as BINDING SITE I, BINDING SITE II or BINDING SITE III. Table 2 illustrates the complementarity of the nucleotide sequences of GK001 BINDING SITE, designated SEQ ID:21430, to the nucleotide sequence of VGAM2211 RNA, herein designated VGAM RNA, also designated SEQ ID:4922.

Another function of VGAM2211 is therefore inhibition of GK001 (Accession NM_020198). Accordingly, utilities of VGAM2211 include diagnosis, prevention and treatment of diseases and clinical conditions associated with GK001. SCIN (Accession NM_033128) is another VGAM2211 host target gene. SCIN BINDING SITE is HOST TARGET binding site found in the 5' untranslated region of mRNA encoded by SCIN, corresponding to a HOST TARGET binding site such as BINDING SITE I, BINDING SITE II or BINDING SITE III. Table 2 illustrates the complementarity of the nucleotide sequences of SCIN BINDING SITE, designated SEQ ID:26972, to the nucleotide sequence of VGAM2211 RNA, herein designated VGAM RNA, also designated SEQ ID:4922.

Another function of VGAM2211 is therefore inhibition of SCIN (Accession NM_033128). Accordingly, utilities of VGAM2211 include diagnosis, prevention and treatment of diseases and clinical conditions associated with SCIN. Zinc Finger Protein 323 (ZNF323, Accession NM_030899) is another VGAM2211 host target gene. ZNF323 BINDING SITE is HOST TARGET binding site found in the 3' untranslated region of mRNA encoded by ZNF323, corresponding to a HOST TARGET binding site such as BINDING SITE I, BINDING SITE II or BINDING SITE III. Table 2 illustrates the complementarity of the nucleotide sequences of ZNF323 BINDING SITE, designated SEQ ID:25167, to the nucleotide sequence of VGAM2211 RNA, herein designated VGAM RNA, also designated SEQ ID:4922.

Another function of VGAM2211 is therefore inhibition of Zinc Finger Protein 323 (ZNF323, Accession NM_030899). Accordingly, utilities of VGAM2211 include diagnosis, prevention and treatment of diseases and clinical conditions associated with ZNF323. LOC152925 (Accession XM_087559) is another VGAM2211 host target gene. LOC152925 BINDING SITE is HOST TARGET binding site found in the 3' untranslated region of mRNA encoded by LOC152925, corresponding to a HOST TARGET binding site such as BINDING SITE I, BINDING SITE II or BINDING SITE III. Table 2 illustrates the complementarity of the nucleotide sequences of LOC152925 BINDING SITE, designated SEQ ID:39337, to the nucleotide sequence of VGAM2211 RNA, herein designated VGAM RNA, also designated SEQ ID:4922.

Another function of VGAM2211 is therefore inhibition of LOC152925 (Accession XM_087559). Accordingly, utilities of VGAM2211 include diagnosis, prevention and treatment of diseases and clinical conditions associated with LOC152925. FIG. 1 further provides a conceptual description of a novel bioinformatically detected viral gene of the present invention, referred to here as Viral Genomic Address Messenger 2212 (VGAM2212) viral gene, which modulates expression of respective host target genes thereof, the function and utility of which host target genes is known in the art.

VGAM2212 is a novel bioinformatically detected regulatory, non protein coding, viral micro RNA (miRNA) gene. The method by which VGAM2212 was detected is described hereinabove with reference to FIGS. 1-8.

VGAM2212 gene, herein designated VGAM GENE, is a viral gene contained in the genome of Myxoma Virus. VGAM2212 host target gene, herein designated VGAM HOST TARGET GENE, is a human gene contained in the human genome.

VGAM2212 gene encodes a VGAM2212 precursor RNA, herein designated VGAM PRECURSOR RNA. Similar to other miRNA genes, and unlike most ordinary genes, VGAM2212 precursor RNA does not encode a protein. A nucleotide sequence identical or highly similar to the nucleotide sequence of VGAM2212 precursor RNA is designated SEQ ID:2198, and is provided hereinbelow with reference to the sequence listing part. Nucleotide sequence SEQ ID:2198 is located at position 11366 relative to the genome of Myxoma Virus.

VGAM2212 precursor RNA folds onto itself, forming VGAM2212 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2212 folded precursor RNA into VGAM2212 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM2212 RNA is designated SEQ ID:4923, and is provided hereinbelow with reference to the sequence listing part.

VGAM2212 host target gene, herein designated VGAM HOST TARGET GENE, encodes a corresponding messenger RNA, VGAM2212 host target RNA, herein designated VGAM HOST TARGET RNA. VGAM2212 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2212 RNA, herein designated VGAM RNA, binds complementarily to one or more host target binding sites located in untranslated regions of VGAM2212 host target RNA, herein designated VGAM HOST TARGET RNA. This complementary binding is due to the fact that the nucleotide sequence of VGAM2212 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2212 RNA, herein designated VGAM RNA, may have a different number of host target binding sites in untranslated regions of a VGAM2212 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2212 RNA, herein designated VGAM RNA, to host target binding sites on VGAM2212 host target RNA, herein designated VGAM HOST TARGET RNA, such as BINDING SITE I, BINDING SITE II and BINDING SITE III, inhibits translation of VGAM2212 host target RNA into VGAM2212 host target protein, herein designated VGAM HOST TARGET PROTEIN. VGAM host target protein is therefore outlined by a broken line.

It is appreciated that VGAM2212 host target gene, herein designated VGAM HOST TARGET GENE, in fact represents a plurality of VGAM2212 host target genes. The mRNA of each one of this plurality of VGAM2212 host target genes comprises one or more host target binding sites, each having a nucleotide sequence which is at least partly complementary to VGAM2212 RNA, herein designated VGAM RNA, and which when bound by VGAM2212 RNA causes inhibition of translation of respective one or more VGAM2212 host target proteins.

It is further appreciated by one skilled in the art that the mode of translational inhibition illustrated by FIG. 1 with specific reference to translational inhibition exerted by VGAM2212 gene, herein designated VGAM GENE, on one or more VGAM2212 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2212 is inhibition of expression of host target genes, as part of a novel viral mechanism of attacking a host. Accordingly, utilities of VGAM2212 include diagnosis, prevention and treatment of viral infection by Myxoma Virus. Specific functions, and accordingly utilities, of VGAM2212 correlate with, and may be deduced from, the identity of the host target genes which VGAM2212 binds and inhibits, and the function of these host target genes, as elaborated hereinbelow.

Nucleotide sequences of the VGAM2212 precursor RNA, herein designated VGAM PRECURSOR RNA, and of the 'diced' VGAM2212 RNA, herein designated VGAM RNA, and a schematic representation of the secondary folding of VGAM2212 folded precursor RNA, herein designated VGAM FOLDED PRECURSOR RNA, of VGAM2212 are further described hereinbelow with reference to Table 1.

Nucleotide sequences of host target binding sites, such as BINDING SITE-I, BINDING SITE-II and BINDING SITE-III of FIG. 1, found on VGAM2212 host target RNA, and schematic representation of the complementarity of each of these host target binding sites to VGAM2212 RNA, herein designated VGAM RNA, are described hereinbelow with reference to Table 2.

As mentioned hereinabove with reference to FIG. 1, a function of VGAM2212 gene, herein designated VGAM is inhibition of expression of VGAM2212 target genes. It is appreciated that specific functions, and accordingly utilities, of VGAM2212 correlate with, and may be deduced from, the identity of the target genes which VGAM2212 binds and inhibits, and the function of these target genes, as elaborated hereinbelow.

Protein Kinase, CAMP-dependent, Regulatory, Type II, Alpha (PRKAR2A, Accession NM_004157) is a VGAM2212 host target gene. PRKAR2A BINDING SITE is HOST TARGET binding site found in the 5' untranslated region of mRNA encoded by PRKAR2A, corresponding to a HOST TARGET binding site such as BINDING SITE I, BINDING SITE II or BINDING SITE III. Table 2 illustrates the complementarity of the nucleotide sequences of PRKAR2A BINDING SITE, designated SEQ ID:10370, to the nucleotide sequence of VGAM2212 RNA, herein designated VGAM RNA, also designated SEQ ID:4923.

A function of VGAM2212 is therefore inhibition of Protein Kinase, CAMP-dependent, Regulatory, Type II, Alpha (PRKAR2A, Accession NM_004157), a gene which mediates membrane association by binding to anchoring proteins, including the map2 kinase. Accordingly, utilities of VGAM2212 include diagnosis, prevention and treatment of diseases and clinical conditions associated with PRKAR2A. The function of PRKAR2A has been established by previous studies. See 188830. Phosphorylation by cAMP-dependent protein kinases is essential for sperm motility. A cAMP-dependent protein kinase is bound to sperm flagella by a regulatory subunit (RII). Oyen et al. (1989) observed high testis-specific expression of a human homolog to the rat RII-alpha mRNA induced in haploid germ cells. They cloned a human cDNA that encodes a 404-amino acid polypeptide with a region (amino acids 45-75) divergent from that of the previously published mouse and rat sequences. By PCR and Southern blot analysis of somatic cell hybrid mapping panels and by radiation hybrid analysis, Tasken et al. (1998) mapped the PRKAR2A gene to chromosome 3p21.3-p21.2.

Full details of the abovementioned studies are described in the following publications, the disclosure of which are hereby incorporated by reference:

Oyen, O.; Myklebust, F.; Scott, J. D.; Hansson, V.; Jahnsen, T.: Human testis cDNA for the regulatory subunit RII alpha of cAMP-dependent protein kinase encodes an alternate amino-terminal region. FEBS Lett. 246:57-64, 1989; and Tasken, K.; Naylor, S. L.; Solberg, R.; Jahnsen, T.: Mapping of the gene encoding the regulatory subunit RII-alpha of cAMP-dependent protein kinase (locus PRKAR2A) to human chromosome r.

Further studies establishing the function and utilities of PRKAR2A are found in John Hopkins OMIM database record ID 176910, and in sited publications numbered 1154-1155 listed in the bibliography section hereinbelow, which are also hereby incorporated by reference. FIG. 1 further provides a conceptual description of a novel bioinformatically detected viral gene of the present invention, referred to here as Viral Genomic Address Messenger 2213 (VGAM2213) viral gene, which modulates expression of respective host target genes thereof, the function and utility of which host target genes is known in the art.

VGAM2213 is a novel bioinformatically detected regulatory, non protein coding, viral micro RNA (miRNA) gene. The method by which VGAM2213 was detected is described hereinabove with reference to FIGS. 1-8.

VGAM2213 gene, herein designated VGAM GENE, is a viral gene contained in the genome of Myxoma Virus. VGAM2213 host target gene, herein designated VGAM HOST TARGET GENE, is a human gene contained in the human genome.

VGAM2213 gene encodes a VGAM2213 precursor RNA, herein designated VGAM PRECURSOR RNA. Similar to other miRNA genes, and unlike most ordinary genes, VGAM2213 precursor RNA does not encode a protein. A nucleotide sequence identical or highly similar to the nucleotide sequence of VGAM2213 precursor RNA is designated SEQ ID:2199, and is provided hereinbelow with reference to the sequence listing part. Nucleotide sequence SEQ ID:2199 is located at position 12976 relative to the genome of Myxoma Virus.

VGAM2213 precursor RNA folds onto itself, forming VGAM2213 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2213 folded precursor RNA into VGAM2213 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM2213 RNA is designated SEQ ID:4924, and is provided hereinbelow with reference to the sequence listing part.

VGAM2213 host target gene, herein designated VGAM HOST TARGET GENE, encodes a corresponding messenger RNA, VGAM2213 host target RNA, herein designated VGAM HOST TARGET RNA. VGAM2213 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2213 RNA, herein designated VGAM RNA, binds complementarily to one or more host target binding sites located in untranslated regions of VGAM2213 host target RNA, herein designated VGAM HOST TARGET RNA. This complementary binding is due to the fact that the nucleotide sequence of VGAM2213 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2213 RNA, herein designated VGAM RNA, may have a different number of host target binding sites in untranslated regions of a VGAM2213 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2213 RNA, herein designated VGAM RNA, to host target binding sites on VGAM2213 host target RNA, herein designated VGAM HOST TARGET RNA, such as BINDING SITE I, BINDING SITE II and BINDING SITE III, inhibits translation of VGAM2213 host target RNA into VGAM2213 host target protein, herein designated VGAM HOST TARGET PROTEIN. VGAM host target protein is therefore outlined by a broken line.

It is appreciated that VGAM2213 host target gene, herein designated VGAM HOST TARGET GENE, in fact represents a plurality of VGAM2213 host target genes. The mRNA of each one of this plurality of VGAM2213 host target genes comprises one or more host target binding sites, each having a nucleotide sequence which is at least partly complementary to VGAM2213 RNA, herein designated VGAM RNA, and which when bound by VGAM2213 RNA causes inhibition of translation of respective one or more VGAM2213 host target proteins.

It is further appreciated by one skilled in the art that the mode of translational inhibition illustrated by FIG. 1 with specific reference to translational inhibition exerted by VGAM2213 gene, herein designated VGAM GENE, on one or more VGAM2213 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2213 is inhibition of expression of host target genes, as part of a novel viral mechanism of attacking a host. Accordingly, utilities of VGAM2213 include diagnosis, prevention and treatment of viral infection by Myxoma Virus. Specific functions, and accordingly utilities, of VGAM2213 correlate with, and may be deduced from, the identity of the host target genes which VGAM2213 binds and inhibits, and the function of these host target genes, as elaborated hereinbelow.

Nucleotide sequences of the VGAM2213 precursor RNA, herein designated VGAM PRECURSOR RNA, and of the 'diced' VGAM2213 RNA, herein designated VGAM RNA, and a schematic representation of the secondary folding of VGAM2213 folded precursor RNA, herein designated VGAM FOLDED PRECURSOR RNA, of VGAM2213 are further described hereinbelow with reference to Table 1.

Nucleotide sequences of host target binding sites, such as BINDING SITE-I, BINDING SITE-II and BINDING SITE-III of FIG. 1, found on VGAM2213 host target RNA, and schematic representation of the complementarity of each of these host target binding sites to VGAM2213 RNA, herein designated VGAM RNA, are described hereinbelow with reference to Table 2.

As mentioned hereinabove with reference to FIG. 1, a function of VGAM2213 gene, herein designated VGAM is inhibition of expression of VGAM2213 target genes. It is appreciated that specific functions, and accordingly utilities, of VGAM2213 correlate with, and may be deduced from, the identity of the target genes which VGAM2213 binds and inhibits, and the function of these target genes, as elaborated hereinbelow.

Extracellular Matrix Protein 2, Female Organ and Adipocyte Specific (ECM2, Accession NM_001393) is a VGAM2213 host target gene. ECM2 BINDING SITE is a HOST TARGET binding site found in the 3' untranslated region of mRNA encoded by ECM2, corresponding to a HOST TARGET binding site such as BINDING SITE I, BINDING SITE II or BINDING SITE III. Table 2 illustrates the complementarity of the nucleotide sequences of ECM2 BINDING SITE, designated SEQ ID:7088, to the nucleotide sequence of VGAM2213 RNA, herein designated VGAM RNA, also designated SEQ ID:4924.

A function of VGAM2213 is therefore inhibition of Extracellular Matrix Protein 2, Female Organ and Adipocyte Specific (ECM2, Accession NM_001393). Accordingly, utilities of VGAM2213 include diagnosis, prevention and treatment of diseases and clinical conditions associated with ECM2. PR Domain Containing 2, with ZNF Domain (PRDM2, Accession NM_012231) is another VGAM2213 host target gene. PRDM2 BINDING SITE1 and PRDM2 BINDING SITE2 are HOST TARGET binding sites found in untranslated regions of mRNA encoded by PRDM2, corresponding to HOST TARGET binding sites such as BINDING SITE I, BINDING SITE II or BINDING SITE III. Table 2 illustrates the complementarity of the nucleotide sequences of PRDM2 BINDING SITE1 and PRDM2 BINDING SITE2, designated SEQ ID:14536 and SEQ ID:18006 respectively, to the nucleotide sequence of VGAM2213 RNA, herein designated VGAM RNA, also designated SEQ ID:4924.

Another function of VGAM2213 is therefore inhibition of PR Domain Containing 2, with ZNF Domain (PRDM2, Accession NM_012231), a gene which plays a role in transcriptional regulation during neuronal differentiation and pathogenesis of retinoblastoma. Accordingly, utilities of VGAM2213 include diagnosis, prevention and treatment of diseases and clinical conditions associated with PRDM2. The function of PRDM2 and its association with various diseases and clinical conditions, has been established by previous studies, as described hereinabove with reference to VGAM120. FLJ10139 (Accession NM_018005) is another VGAM2213 host target gene. FLJ10139 BINDING SITE is HOST TARGET binding site found in the 3' untranslated region of mRNA encoded by FLJ10139, corresponding to a HOST TARGET binding site such as BINDING SITE I, BINDING SITE II or BINDING SITE III. Table 2 illustrates the complementarity of the nucleotide sequences of FLJ10139 BINDING SITE, designated SEQ ID:19736, to the nucleotide sequence of VGAM2213 RNA, herein designated VGAM RNA, also designated SEQ ID:4924.

Another function of VGAM2213 is therefore inhibition of FLJ10139 (Accession NM_018005). Accordingly, utilities of VGAM2213 include diagnosis, prevention and treatment of diseases and clinical conditions associated with FLJ10139. KIAA1165 (Accession XM_041162) is another VGAM2213 host target gene. KIAA1165 BINDING SITE is HOST TARGET binding site found in the 3' untranslated region of mRNA encoded by KIAA1165, corresponding to a HOST TARGET binding site such as BINDING SITE I, BINDING SITE II or BINDING SITE III. Table 2 illustrates the complementarity of the nucleotide sequences of KIAA1165 BINDING SITE, designated SEQ ID:33475, to the nucleotide sequence of VGAM2213 RNA, herein designated VGAM RNA, also designated SEQ ID:4924.

Another function of VGAM2213 is therefore inhibition of KIAA1165 (Accession XM_041162). Accordingly, utilities of VGAM2213 include diagnosis, prevention and treatment of diseases and clinical conditions associated with KIAA1165. mPA-PLA1 (Accession NM_139248) is another VGAM2213 host target gene. mPA-PLA1 BINDING SITE is HOST TARGET binding site found in the 3' untranslated region of mRNA encoded by mPA-PLA1, corresponding to a HOST TARGET binding site such as BINDING SITE I, BINDING SITE II or BINDING SITE III. Table 2 illustrates the complementarity of the nucleotide sequences of mPA-PLA1 BINDING SITE, designated SEQ ID:29250, to the nucleotide sequence of VGAM2213 RNA, herein designated VGAM RNA, also designated SEQ ID:4924.

Another function of VGAM2213 is therefore inhibition of mPA-PLA1 (Accession NM_139248). Accordingly, utilities of VGAM2213 include diagnosis, prevention and treatment of diseases and clinical conditions associated with mPA-PLA1. MTCH1 (Accession NM_014341) is another VGAM2213 host target gene. MTCH1 BINDING SITE is HOST TARGET binding site found in the 3' untranslated region of mRNA encoded by MTCH1, corresponding to a HOST TARGET binding site such as BINDING SITE I, BINDING SITE II or BINDING SITE III. Table 2 illustrates the complementarity of the nucleotide sequences of MTCH1 BINDING SITE, designated SEQ ID:15661, to the nucleotide sequence of VGAM2213 RNA, herein designated VGAM RNA, also designated SEQ ID:4924.

Another function of VGAM2213 is therefore inhibition of MTCH1 (Accession NM_014341). Accordingly, utilities of VGAM2213 include diagnosis, prevention and treatment of diseases and clinical conditions associated with MTCH1. LOC158364 (Accession XM_088546) is another VGAM2213 host target gene. LOC158364 BINDING SITE is HOST TARGET binding site found in the 5' untranslated region of mRNA encoded by LOC158364, corresponding to a HOST TARGET binding site such as BINDING SITE I, BINDING SITE II or BINDING SITE III. Table 2 illustrates the complementarity of the nucleotide sequences of LOC158364 BINDING SITE, designated SEQ ID:39817, to the nucleotide sequence of VGAM2213 RNA, herein designated VGAM RNA, also designated SEQ ID:4924.

Another function of VGAM2213 is therefore inhibition of LOC158364 (Accession XM_088546). Accordingly, utilities of VGAM2213 include diagnosis, prevention and treatment of diseases and clinical conditions associated with LOC158364. LOC221773 (Accession XM_165802) is another VGAM2213 host target gene. LOC221773 BINDING SITE is HOST TARGET binding site found in the 3' untranslated region of mRNA encoded by LOC221773, corresponding to a HOST TARGET binding site such as BINDING SITE I, BINDING SITE II or BINDING SITE III. Table 2 illustrates the complementarity of the nucleotide sequences of LOC221773 BINDING SITE, designated SEQ ID:43760, to the nucleotide sequence of VGAM2213 RNA, herein designated VGAM RNA, also designated SEQ ID:4924.

Another function of VGAM2213 is therefore inhibition of LOC221773 (Accession XM_165802). Accordingly, utilities of VGAM2213 include diagnosis, prevention and treatment of diseases and clinical conditions associated with LOC221773. FIG. 1 further provides a conceptual description of a novel bioinformatically detected viral gene of the present invention, referred to here as Viral Genomic Address Messenger 2214 (VGAM2214) viral gene, which modulates expression of respective host target genes thereof, the function and utility of which host target genes is known in the art.

VGAM2214 is a novel bioinformatically detected regulatory, non protein coding, viral micro RNA (miRNA) gene. The method by which VGAM2214 was detected is described hereinabove with reference to FIGS. 1-8.

VGAM2214 gene, herein designated VGAM GENE, is a viral gene contained in the genome of Myxoma Virus. VGAM2214 host target gene, herein designated VGAM HOST TARGET GENE, is a human gene contained in the human genome.

VGAM2214 gene encodes a VGAM2214 precursor RNA, herein designated VGAM PRECURSOR RNA. Similar to other miRNA genes, and unlike most ordinary genes, VGAM2214 precursor RNA does not encode a protein. A nucleotide sequence identical or highly similar to the nucleotide sequence of VGAM2214 precursor RNA is designated SEQ ID:2200, and is provided hereinbelow with reference to the sequence listing part. Nucleotide sequence SEQ ID:2200 is located at position 20836 relative to the genome of Myxoma Virus.

VGAM2214 precursor RNA folds onto itself, forming VGAM2214 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2214 folded precursor RNA into VGAM2214 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2214 RNA is designated SEQ ID:4925, and is provided hereinbelow with reference to the sequence listing part.

VGAM2214 host target gene, herein designated VGAM HOST TARGET GENE, encodes a corresponding messenger RNA, VGAM2214 host target RNA, herein designated VGAM HOST TARGET RNA. VGAM2214 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2214 RNA, herein designated VGAM RNA, binds complementarily to one or more host target binding sites located in untranslated regions of VGAM2214 host target RNA, herein designated VGAM HOST TARGET RNA. This complementary binding is due to the fact that the nucleotide sequence of VGAM2214 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2214 RNA, herein designated VGAM RNA, may have a different number of host target binding sites in untranslated regions of a VGAM2214 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2214 RNA, herein designated VGAM RNA, to host target binding sites on VGAM2214 host target RNA, herein designated VGAM HOST TARGET RNA, such as BINDING SITE I, BINDING SITE II and BINDING SITE III, inhibits translation of VGAM2214 host target RNA into VGAM2214 host target protein, herein designated VGAM HOST TARGET PROTEIN. VGAM host target protein is therefore outlined by a broken line.

It is appreciated that VGAM2214 host target gene, herein designated VGAM HOST TARGET GENE, in fact represents a plurality of VGAM2214 host target genes. The mRNA of each one of this plurality of VGAM2214 host target genes comprises one or more host target binding sites, each having a nucleotide sequence which is at least partly complementary to VGAM2214 RNA, herein designated VGAM RNA, and which when bound by VGAM2214 RNA causes inhibition of translation of respective one or more VGAM2214 host target proteins.

It is further appreciated by one skilled in the art that the mode of translational inhibition illustrated by FIG. 1 with specific reference to translational inhibition exerted by VGAM2214 gene, herein designated VGAM GENE, on one or more VGAM2214 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2214 is inhibition of expression of host target genes, as part of a novel viral mechanism of attacking a host. Accordingly, utilities of VGAM2214 include diagnosis, prevention and treatment of viral infection by Myxoma Virus. Specific functions, and accordingly utilities, of VGAM2214 correlate with, and may be deduced from, the identity of the host target genes which VGAM2214 binds and inhibits, and the function of these host target genes, as elaborated hereinbelow.

Nucleotide sequences of the VGAM2214 precursor RNA, herein designated VGAM PRECURSOR RNA, and of the 'diced' VGAM2214 RNA, herein designated VGAM RNA, and a schematic representation of the secondary folding of VGAM2214 folded precursor RNA, herein designated VGAM FOLDED PRECURSOR RNA, of VGAM2214 are further described hereinbelow with reference to Table 1.

Nucleotide sequences of host target binding sites, such as BINDING SITE-I, BINDING SITE-II and BINDING SITE-III of FIG. 1, found on VGAM2214 host target RNA, and schematic representation of the complementarity of each of these host target binding sites to VGAM2214 RNA, herein designated VGAM RNA, are described hereinbelow with reference to Table 2.

As mentioned hereinabove with reference to FIG. 1, a function of VGAM2214 gene, herein designated VGAM is inhibition of expression of VGAM2214 target genes. It is appreciated that specific functions, and accordingly utilities, of VGAM2214 correlate with, and may be deduced from, the identity of the target genes which VGAM2214 binds and inhibits, and the function of these target genes, as elaborated hereinbelow.

ATP Synthase, H+ Transporting, Mitochondrial F1 Complex, Beta Polypeptide (ATP5B, Accession XM_006710) is a VGAM2214 host target gene. ATP5B BINDING SITE is HOST TARGET binding site found in the 5' untranslated region of mRNA encoded by ATP5B, corresponding to a HOST TARGET binding site such as BINDING SITE I, BINDING SITE II or BINDING SITE III. Table 2 illustrates the complementarity of the nucleotide sequences of ATP5B BINDING SITE, designated SEQ ID:30008, to the nucleotide sequence of VGAM2214 RNA, herein designated VGAM RNA, also designated SEQ ID:4925.

A function of VGAM2214 is therefore inhibition of ATP Synthase, H+ Transporting, Mitochondrial F1 Complex, Beta Polypeptide (ATP5B, Accession XM_006710). Accordingly, utilities of VGAM2214 include diagnosis, prevention and treatment of diseases and clinical conditions associated with ATP5B. Retinoschisis (X-linked, juvenile) 1 (RS1, Accession NM_000330) is another VGAM2214 host target gene. RS1 BINDING SITE is HOST TARGET binding site found in the 3' untranslated region of mRNA encoded by RS1, corresponding to a HOST TARGET binding site such as BINDING SITE I, BINDING SITE II or BINDING SITE III. Table 2 illustrates the complementarity of the nucleotide sequences of RS1 BINDING SITE, designated SEQ ID:5877, to the nucleotide sequence of VGAM2214 RNA, herein designated VGAM RNA, also designated SEQ ID:4925.

Another function of VGAM2214 is therefore inhibition of Retinoschisis (X-linked, juvenile) 1 (RS1, Accession NM_000330). Accordingly, utilities of VGAM2214 include diagnosis, prevention and treatment of diseases and clinical conditions associated with RS1. ADP-ribosylation Factor Domain Protein 1, 64 kDa (ARFD1, Accession NM_001656) is another VGAM2214 host target gene. ARFD1 BINDING SITE is HOST TARGET binding site found in the 3' untranslated region of mRNA encoded by ARFD1, corresponding to a HOST TARGET binding site such as BINDING SITE I, BINDING SITE II or BINDING SITE III. Table 2 illustrates the complementarity of the nucleotide sequences of ARFD1 BINDING SITE, designated SEQ ID:7372, to the nucleotide sequence of VGAM2214 RNA, herein designated VGAM RNA, also designated SEQ ID:4925.

Another function of VGAM2214 is therefore inhibition of ADP-ribosylation Factor Domain Protein 1, 64 kDa (ARFD1, Accession NM_001656). Accordingly, utilities of VGAM2214 include diagnosis, prevention and treatment of diseases and clinical conditions associated with ARFD1. FLJ20666 (Accession NM_017922) is another VGAM2214 host target gene. FLJ20666 BINDING SITE1 and FLJ20666 BINDING SITE2 are HOST TARGET binding sites found in untranslated regions of mRNA encoded by FLJ20666, corresponding to HOST TARGET binding sites such as BINDING SITE I, BINDING SITE II or BINDING SITE III. Table 2 illustrates the complementarity of the nucleotide sequences of FLJ20666 BINDING SITE1 and FLJ20666 BINDING SITE2, designated SEQ ID:19586 and SEQ ID:20337 respectively, to the nucleotide sequence of VGAM2214 RNA, herein designated VGAM RNA, also designated SEQ ID:4925.

Another function of VGAM2214 is therefore inhibition of FLJ20666 (Accession NM_017922). Accordingly, utilities of VGAM2214 include diagnosis, prevention and treatment of diseases and clinical conditions associated with FLJ20666. Mitochondrial Ribosomal Protein L20 (MRPL20, Accession NM_017971) is another VGAM2214 host target gene. MRPL20 BINDING SITE is HOST TARGET binding site found in the 3' untranslated region of mRNA encoded by MRPL20, corresponding to a HOST TARGET binding site such as BINDING SITE I, BINDING SITE II or BINDING SITE III. Table 2 illustrates the complementarity of the nucleotide sequences of MRPL20 BINDING SITE, designated SEQ ID:19701, to the nucleotide sequence of VGAM2214 RNA, herein designated VGAM RNA, also designated SEQ ID:4925.

Another function of VGAM2214 is therefore inhibition of Mitochondrial Ribosomal Protein L20 (MRPL20, Accession NM_017971). Accordingly, utilities of VGAM2214 include diagnosis, prevention and treatment of diseases and clinical conditions associated with MRPL20. Phosphatase, Orphan 1 (phospho1, Accession XM_091572) is another VGAM2214 host target gene. phospho1 BINDING SITE is HOST TARGET binding site found in the 3' untranslated region of mRNA encoded by phospho1, corresponding to a HOST TARGET binding site such as BINDING SITE I, BINDING SITE II or BINDING SITE III. Table 2 illustrates the complementarity of the nucleotide sequences of phospho1 BINDING SITE, designated SEQ ID:40058, to the nucleotide sequence of VGAM2214 RNA, herein designated VGAM RNA, also designated SEQ ID:4925.

Another function of VGAM2214 is therefore inhibition of Phosphatase, Orphan 1 (phospho1, Accession XM_091572). Accordingly, utilities of VGAM2214 include diagnosis, prevention and treatment of diseases and clinical conditions associated with phospho1. Unc-5 Homolog D (C. elegans) (UNC5D, Accession NM_080872) is another VGAM2214 host target gene. UNC5D BINDING SITE is HOST TARGET binding site found in the 3' untranslated region of mRNA encoded by UNC5D, corresponding to a HOST TARGET binding site such as BINDING SITE I, BINDING SITE II or BINDING SITE III. Table 2 illustrates the complementarity of the nucleotide sequences of UNC5D BINDING SITE, designated SEQ ID:28118, to the nucleotide sequence of VGAM2214 RNA, herein designated VGAM RNA, also designated SEQ ID:4925.

Another function of VGAM2214 is therefore inhibition of Unc-5 Homolog D (C. elegans) (UNC5D, Accession NM_080872). Accordingly, utilities of VGAM2214 include diagnosis, prevention and treatment of diseases and clinical conditions associated with UNC5D. LOC130639 (Accession XM_059464) is another VGAM2214 host target gene. LOC130639 BINDING SITE is HOST TARGET binding site found in the 5' untranslated region of mRNA encoded by LOC130639, corresponding to a HOST TARGET binding site such as BINDING SITE I, BINDING SITE II or BINDING SITE III. Table 2 illustrates the complementarity of the nucleotide sequences of LOC130639 BINDING SITE, designated SEQ ID:37003, to the nucleotide sequence of VGAM2214 RNA, herein designated VGAM RNA, also designated SEQ ID:4925.

Another function of VGAM2214 is therefore inhibition of LOC130639 (Accession XM_059464). Accordingly, utilities of VGAM2214 include diagnosis, prevention and treatment of diseases and clinical conditions associated with LOC130639. FIG. 1 further provides a conceptual description of a novel bioinformatically detected viral gene of the present invention, referred to here as Viral Genomic Address Messenger 2215 (VGAM2215) viral gene, which modulates expression of respective host target genes thereof, the function and utility of which host target genes is known in the art.

VGAM2215 is a novel bioinformatically detected regulatory, non protein coding, viral micro RNA (miRNA) gene. The method by which VGAM2215 was detected is described hereinabove with reference to FIGS. 1-8.

VGAM2215 gene, herein designated VGAM GENE, is a viral gene contained in the genome of Ectromelia Virus. VGAM2215 host target gene, herein designated VGAM HOST TARGET GENE, is a human gene contained in the human genome.

VGAM2215 gene encodes a VGAM2215 precursor RNA, herein designated VGAM PRECURSOR RNA. Similar to other miRNA genes, and unlike most ordinary genes, VGAM2215 precursor RNA does not encode a protein. A nucleotide sequence identical or highly similar to the nucleotide sequence of VGAM2215 precursor RNA is designated SEQ ID:2201, and is provided hereinbelow with reference to the sequence listing part. Nucleotide sequence SEQ ID:2201 is located at position 9138 relative to the genome of Ectromelia Virus.

VGAM2215 precursor RNA folds onto itself, forming VGAM2215 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2215 folded precursor RNA into VGAM2215 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2215 RNA is designated SEQ ID:4926, and is provided hereinbelow with reference to the sequence listing part.

VGAM2215 host target gene, herein designated VGAM HOST TARGET GENE, encodes a corresponding messenger RNA, VGAM2215 host target RNA, herein designated VGAM HOST TARGET RNA. VGAM2215 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2215 RNA, herein designated VGAM RNA, binds complementarily to one or more host target binding sites located in untranslated regions of VGAM2215 host target RNA, herein designated VGAM HOST TARGET RNA. This complementary binding is due to the fact that the nucleotide sequence of VGAM2215 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2215 RNA, herein designated VGAM RNA, may have a different number of host target binding sites in untranslated regions of a VGAM2215 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2215 RNA, herein designated VGAM RNA, to host target binding sites on VGAM2215 host target RNA, herein designated VGAM HOST TARGET RNA, such as BINDING SITE I, BINDING SITE II and BINDING SITE III, inhibits translation of VGAM2215 host target RNA into VGAM2215 host target protein, herein designated VGAM HOST TARGET PROTEIN. VGAM host target protein is therefore outlined by a broken line.

It is appreciated that VGAM2215 host target gene, herein designated VGAM HOST TARGET GENE, in fact represents a plurality of VGAM2215 host target genes. The mRNA of each one of this plurality of VGAM2215 host target genes comprises one or more host target binding sites, each having a nucleotide sequence which is at least partly complementary to VGAM2215 RNA, herein designated VGAM RNA, and which when bound by VGAM2215 RNA causes inhibition of translation of respective one or more VGAM2215 host target proteins.

It is further appreciated by one skilled in the art that the mode of translational inhibition illustrated by FIG. 1 with specific reference to translational inhibition exerted by VGAM2215 gene, herein designated VGAM GENE, on one or more VGAM2215 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2215 is inhibition of expression of host target genes, as part of a novel viral mechanism of attacking a host. Accordingly, utilities of VGAM2215 include diagnosis, prevention and treatment of viral infection by Ectromelia Virus. Specific functions, and accordingly utilities, of VGAM2215 correlate with, and may be deduced from, the identity of the host target genes which VGAM2215 binds and inhibits, and the function of these host target genes, as elaborated hereinbelow.

Nucleotide sequences of the VGAM2215 precursor RNA, herein designated VGAM PRECURSOR RNA, and of the 'diced' VGAM2215 RNA, herein designated VGAM RNA, and a schematic representation of the secondary folding of VGAM2215 folded precursor RNA, herein designated VGAM FOLDED PRECURSOR RNA, of VGAM2215 are further described hereinbelow with reference to Table 1.

Nucleotide sequences of host target binding sites, such as BINDING SITE-I, BINDING SITE-II and BINDING SITE-III of FIG. 1, found on VGAM2215 host target RNA, and schematic representation of the complementarity of each of these host target binding sites to VGAM2215 RNA, herein designated VGAM RNA, are described hereinbelow with reference to Table 2.

As mentioned hereinabove with reference to FIG. 1, a function of VGAM2215 gene, herein designated VGAM is inhibition of expression of VGAM2215 target genes. It is appreciated that specific functions, and accordingly utilities, of VGAM2215 correlate with, and may be deduced from, the identity of the target genes which VGAM2215 binds and inhibits, and the function of these target genes, as elaborated hereinbelow.

Adrenergic, Beta, Receptor Kinase 2 (ADRBK2, Accession NM_005160) is a VGAM2215 host target gene. ADRBK2 BINDING SITE is HOST TARGET binding site found in the 3' untranslated region of mRNA encoded by ADRBK2, corresponding to a HOST TARGET binding site such as BINDING SITE I, BINDING SITE II or BINDING SITE III. Table 2 illustrates the complementarity of the nucleotide sequences of ADRBK2 BINDING SITE, designated SEQ ID:11641, to the nucleotide sequence of VGAM2215 RNA, herein designated VGAM RNA, also designated SEQ ID:4926.

A function of VGAM2215 is therefore inhibition of Adrenergic, Beta, Receptor Kinase 2 (ADRBK2, Accession NM_005160), a gene which regulates desensitization of G protein-coupled receptors. Accordingly, utilities of VGAM2215 include diagnosis, prevention and treatment of diseases and clinical conditions associated with ADRBK2. The function of ADRBK2 and its association with various diseases and clinical conditions, has been established by previous studies, as described hereinabove with reference to VGAM806. EGF-like-domain, Multiple 5 (EGFL5, Accession XM_098838) is another VGAM2215 host target gene. EGFL5 BINDING SITE is HOST TARGET binding site found in the 3' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41872, to the nucleotide sequence of VGAM2215 RNA, herein designated VGAM RNA, also designated SEQ ID:4926.

Another function of VGAM2215 is therefore inhibition of EGF-like-domain, Multiple 5 (EGFL5, Accession XM_098838). Accordingly, utilities of VGAM2215 include diagnosis, prevention and treatment of diseases and clinical conditions associated with EGFL5. Poly (ADP-ribose) Glycohydrolase (PARG, Accession NM_003631) is another VGAM2215 host target gene. PARG BINDING SITE is HOST TARGET binding site found in the 3' untranslated region of mRNA encoded by PARG, corresponding to a HOST TARGET binding site such as BINDING SITE I, BINDING SITE II or BINDING SITE III. Table 2 illustrates the complementarity of the nucleotide sequences of PARG BINDING SITE, designated SEQ ID:9692, to the nucleotide sequence of VGAM2215 RNA, herein designated VGAM RNA, also designated SEQ ID:4926.

Another function of VGAM2215 is therefore inhibition of Poly (ADP-ribose) Glycohydrolase (PARG, Accession NM_003631), a gene which is found in many tissues and may be subject to proteolysis generating smaller, active products. Accordingly, utilities of VGAM2215 include diagnosis, prevention and treatment of diseases and clinical conditions associated with PARG. The function of PARG and its association with various diseases and clinical conditions, has been established by previous studies, as described hereinabove with reference to VGAM2207. Protein Kinase C, Nu (PRKCN, Accession NM_005813) is another VGAM2215 host target gene. PRKCN BINDING SITE is HOST TARGET binding site found in the 3" untranslated region of mRNA encoded by PRKCN, corresponding to a HOST TARGET binding site such as BINDING SITE I, BINDING SITE II or BINDING SITE III. Table 2 illustrates the complementarity of the nucleotide sequences of PRKCN BINDING SITE, designated SEQ ID:12394, to the nucleotide sequence of VGAM2215 RNA, herein designated VGAM RNA, also designated SEQ ID:4926.

Another function of VGAM2215 is therefore inhibition of Protein Kinase C, Nu (PRKCN, Accession NM_005813). Accordingly, utilities of VGAM2215 include diagnosis, prevention and treatment of diseases and clinical conditions associated with PRKCN. Runt-related Transcription Factor 3 (RUNX3, Accession NM_004350) is another VGAM2215 host target gene. RUNX3 BINDING SITE is HOST TARGET binding site found in the 3' untranslated region of mRNA encoded by RUNX3, corresponding to a HOST TARGET binding site such as BINDING SITE I, BINDING SITE II or BINDING SITE III. Table 2 illustrates the complementarity of the nucleotide sequences of RUNX3 BINDING SITE, designated SEQ ID:10546, to the nucleotide sequence of VGAM2215 RNA, herein designated VGAM RNA, also designated SEQ ID:4926.

Another function of VGAM2215 is therefore inhibition of Runt-related Transcription Factor 3 (RUNX3, Accession NM_004350), a gene which binds to the core site, 5'-pygpyggt-3', of a number of enhancers and promoters. Accordingly, utilities of VGAM2215 include diagnosis, prevention and treatment of diseases and clinical conditions associated with RUNX3. The function of RUNX3 and its association with various diseases and clinical conditions, has been established by previous studies, as described hereinabove with reference to VGAM1151. FLJ20004 (Accession XM_170889) is another VGAM2215 host target gene. FLJ20004 BINDING SITE is HOST TARGET binding site found in the 3' untranslated region of mRNA encoded by FLJ20004, corresponding to a HOST TARGET binding site such as BINDING SITE I, BINDING SITE II or BINDING SITE III. Table 2 illustrates the complementarity of the nucleotide sequences of FLJ20004 BINDING SITE, designated SEQ ID:45642, to the nucleotide sequence of VGAM2215 RNA, herein designated VGAM RNA, also designated SEQ ID:4926.

Another function of VGAM2215 is therefore inhibition of FLJ20004 (Accession XM_170889). Accordingly, utilities of VGAM2215 include diagnosis, prevention and treatment of diseases and clinical conditions associated with FLJ20004. HTCD37 (Accession XM_041884) is another VGAM2215 host target gene. HTCD37 BINDING SITE is HOST TARGET binding site found in the 3' untranslated region of mRNA encoded by HTCD37, corresponding to a HOST TARGET binding site such as BINDING SITE I, BINDING SITE II or BINDING SITE III. Table 2 illustrates the complementarity of the nucleotide sequences of HTCD37 BINDING SITE, designated SEQ ID:33616, to the nucleotide sequence of VGAM2215 RNA, herein designated VGAM RNA, also designated SEQ ID:4926.

Another function of VGAM2215 is therefore inhibition of HTCD37 (Accession XM_041884). Accordingly, utilities of VGAM2215 include diagnosis, prevention and treatment of diseases and clinical conditions associated with HTCD37. KIAA0841 (Accession XM_049237) is another VGAM2215 host target gene. KIAA0841 BINDING SITE is HOST TARGET binding site found in the 3' untranslated region of mRNA encoded by KIAA0841, corresponding to a HOST TARGET binding site such as BINDING SITE I, BINDING SITE II or BINDING SITE III. Table 2 illustrates the complementarity of the nucleotide sequences of KIAA0841 BINDING SITE, designated SEQ ID:35357, to the nucleotide sequence of VGAM2215 RNA, herein designated VGAM RNA, also designated SEQ ID:4926.

Another function of VGAM2215 is therefore inhibition of KIAA0841 (Accession XM_049237). Accordingly, utilities of VGAM2215 include diagnosis, prevention and treatment of diseases and clinical conditions associated with KIAA0841. KIAA0855 (Accession NM_015003) is another VGAM2215 host target gene. KIAA0855 BINDING SITE is HOST TARGET binding site found in the 3' untranslated region of mRNA encoded by KIAA0855, corresponding to a HOST TARGET binding site such as BINDING SITE I, BINDING SITE II or BINDING SITE III. Table 2 illustrates the complementarity of the nucleotide sequences of KIAA0855 BINDING SITE, designated SEQ ID:17371, to the nucleotide sequence of VGAM2215 RNA, herein designated VGAM RNA, also designated SEQ ID:4926.

Another function of VGAM2215 is therefore inhibition of KIAA0855 (Accession NM_015003). Accordingly, utilities of VGAM2215 include diagnosis, prevention and treatment of diseases and clinical conditions associated with KIAA0855. KIAA1843 (Accession XM_030838) is another VGAM2215 host target gene. KIAA1843 BINDING SITE is HOST TARGET binding site found in the 3' untranslated region of mRNA encoded by KIAA1843, corresponding to a HOST TARGET binding site such as BINDING SITE I, BINDING SITE II or BINDING SITE III. Table 2 illustrates the complementarity of the nucleotide sequences of KIAA1843 BINDING SITE, designated SEQ ID:31160, to the nucleotide sequence of VGAM2215 RNA, herein designated VGAM RNA, also designated SEQ ID:4926.

Another function of VGAM2215 is therefore inhibition of KIAA1843 (Accession XM_030838). Accordingly, utilities of VGAM2215 include diagnosis, prevention and treatment of diseases and clinical conditions associated with KIAA1843. MGC2827 (Accession NM_023940) is another VGAM2215 host target gene. MGC2827 BINDING SITE is HOST TARGET binding site found in the 3' untranslated region of mRNA encoded by MGC2827, corresponding to a HOST TARGET binding site such as BINDING SITE I, BINDING SITE II or BINDING SITE III. Table 2 illustrates the complementarity of the nucleotide sequences of MGC2827 BINDING SITE, designated SEQ ID:23423, to the nucleotide sequence of VGAM2215 RNA, herein designated VGAM RNA, also designated SEQ ID:4926.

Another function of VGAM2215 is therefore inhibition of MGC2827 (Accession NM_023940). Accordingly, utilities of VGAM2215 include diagnosis, prevention and treatment of diseases and clinical conditions associated with MGC2827. NXP-2 (Accession XM_048706) is another VGAM2215 host target gene. NXP-2 BINDING SITE is HOST TARGET binding site found in the 3' untranslated region of mRNA encoded by NXP-2, corresponding to a HOST TARGET binding site such as BINDING SITE I, BINDING SITE II or BINDING SITE III. Table 2 illustrates the complementarity of the nucleotide sequences of NXP-2 BINDING SITE, designated SEQ ID:35228, to the nucleotide sequence of VGAM2215 RNA, herein designated VGAM RNA, also designated SEQ ID:4926.

Another function of VGAM2215 is therefore inhibition of NXP-2 (Accession XM_048706). Accordingly, utilities of VGAM2215 include diagnosis, prevention and treatment of diseases and clinical conditions associated with NXP-2. LOC148809 (Accession XM_086325) is another VGAM2215 host target gene. LOC148809 BINDING SITE is HOST TARGET binding site found in the 3' untranslated region of mRNA encoded by LOC148809, corresponding to a HOST TARGET binding site such as BINDING SITE I, BINDING SITE II or BINDING SITE III. Table 2 illustrates the complementarity of the nucleotide sequences of LOC148809 BINDING SITE, designated SEQ ID:38591, to the nucleotide sequence of VGAM2215 RNA, herein designated VGAM RNA, also designated SEQ ID:4926.

Another function of VGAM2215 is therefore inhibition of LOC148809 (Accession XM_086325). Accordingly, utilities of VGAM2215 include diagnosis, prevention and treatment of diseases and clinical conditions associated with LOC148809. LOC153387 (Accession XM_098369) is another VGAM2215 host target gene. LOC153387 BINDING SITE is HOST TARGET binding site found in the 5' untranslated region of mRNA encoded by LOC153387, corresponding to a HOST TARGET binding site such as BINDING SITE I, BINDING SITE II or BINDING SITE III. Table 2 illustrates the complementarity of the nucleotide sequences of LOC153387 BINDING SITE, designated SEQ ID:41633, to the nucleotide sequence of VGAM2215 RNA, herein designated VGAM RNA, also designated SEQ ID:4926.

Another function of VGAM2215 is therefore inhibition of LOC153387 (Accession XM_098369). Accordingly, utilities of VGAM2215 include diagnosis, prevention and treatment of diseases and clinical conditions associated with LOC153387. LOC169225 (Accession XM_108531) is another VGAM2215 host target gene. LOC169225 BINDING SITE is HOST TARGET binding site found in the 5' untranslated region of mRNA encoded by LOC169225, corresponding to a HOST TARGET binding site such as BINDING SITE I, BINDING SITE II or BINDING SITE III. Table 2 illustrates the complementarity of the nucleotide sequences of LOC169225 BINDING SITE, designated SEQ ID:42203, to the nucleotide sequence of VGAM2215 RNA, herein designated VGAM RNA, also designated SEQ ID:4926.

Another function of VGAM2215 is therefore inhibition of LOC169225 (Accession XM_108531). Accordingly, utilities of VGAM2215 include diagnosis, prevention and treatment of diseases and clinical conditions associated with LOC169225. LOC169966 (Accession XM_093010) is another VGAM2215 host target gene. LOC169966 BINDING SITE is HOST TARGET binding site found in the 3' untranslated region of mRNA encoded by LOC169966, corresponding to a HOST TARGET binding site such as BINDING SITE I, BINDING SITE II or BINDING SITE III. Table 2 illustrates the complementarity of the nucleotide sequences of LOC169966 BINDING SITE, designated SEQ ID:40163, to the nucleotide sequence of VGAM2215 RNA, herein designated VGAM RNA, also designated SEQ ID:4926.

Another function of VGAM2215 is therefore inhibition of LOC169966 (Accession XM_093010). Accordingly, utilities of VGAM2215 include diagnosis, prevention and treatment of diseases and clinical conditions associated with LOC169966. LOC51157 (Accession NM_016202) is another VGAM2215 host target gene. LOC51157 BINDING SITE is HOST TARGET binding site found in the 5' untranslated region of mRNA encoded by LOC51157, corresponding to a HOST TARGET binding site such as BINDING SITE I, BINDING SITE II or BINDING SITE III. Table 2 illustrates the complementarity of the nucleotide sequences of LOC51157 BINDING SITE, designated SEQ ID:18297, to the nucleotide sequence of VGAM2215 RNA, herein designated VGAM RNA, also designated SEQ ID:4926.

Another function of VGAM2215 is therefore inhibition of LOC51157 (Accession NM_016202). Accordingly, utilities of VGAM2215 include diagnosis, prevention and treatment of diseases and clinical conditions associated with LOC51157. FIG. 1 further provides a conceptual description of a novel bioinformatically detected viral gene of the present invention, referred to here as Viral Genomic Address Messenger 2216 (VGAM2216) viral gene, which modulates expression of respective host target genes thereof, the function and utility of which host target genes is known in the art.

VGAM2216 is a novel bioinformatically detected regulatory, non protein coding, viral micro RNA (miRNA) gene. The method by which VGAM2216 was detected is described hereinabove with reference to FIGS. 1-8.

VGAM2216 gene, herein designated VGAM GENE, is a viral gene contained in the genome of Ectromelia Virus. VGAM2216 host target gene, herein designated VGAM HOST TARGET GENE, is a human gene contained in the human genome.

VGAM2216 gene encodes a VGAM2216 precursor RNA, herein designated VGAM PRECURSOR RNA. Similar to other miRNA genes, and unlike most ordinary genes, VGAM2216 precursor RNA does not encode a protein. A nucleotide sequence identical or highly similar to the nucleotide sequence of VGAM2216 precursor RNA is designated SEQ ID:2202, and is provided hereinbelow with reference to the sequence listing part. Nucleotide sequence SEQ ID:2202 is located at position 192667 relative to the genome of Ectromelia Virus.

VGAM2216 precursor RNA folds onto itself, forming VGAM2216 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2216 folded precursor RNA into VGAM2216 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2216 RNA is designated SEQ ID:4927, and is provided hereinbelow with reference to the sequence listing part.

VGAM2216 host target gene, herein designated VGAM HOST TARGET GENE, encodes a corresponding messenger RNA, VGAM2216 host target RNA, herein designated VGAM HOST TARGET RNA. VGAM2216 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2216 RNA, herein designated VGAM RNA, binds complementarily to one or more host target binding sites located in untranslated regions of VGAM2216 host target RNA, herein designated VGAM HOST TARGET RNA. This complementary binding is due to the fact that the nucleotide sequence of VGAM2216 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2216 RNA, herein designated VGAM RNA, may have a different number of host target binding sites in untranslated regions of a VGAM2216 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2216 RNA, herein designated VGAM RNA, to host target binding sites on VGAM2216 host target RNA, herein designated VGAM HOST TARGET RNA, such as BINDING SITE I, BINDING SITE II and BINDING SITE III, inhibits translation of VGAM2216 host target RNA into VGAM2216 host target protein, herein designated VGAM HOST TARGET PROTEIN. VGAM host target protein is therefore outlined by a broken line.

It is appreciated that VGAM2216 host target gene, herein designated VGAM HOST TARGET GENE, in fact represents a plurality of VGAM2216 host target genes. The mRNA of each one of this plurality of VGAM2216 host target genes comprises one or more host target binding sites, each having a nucleotide sequence which is at least partly complementary to VGAM2216 RNA, herein designated VGAM RNA, and which when bound by VGAM2216 RNA causes inhibition of translation of respective one or more VGAM2216 host target proteins.

It is further appreciated by one skilled in the art that the mode of translational inhibition illustrated by FIG. 1 with specific reference to translational inhibition exerted by VGAM2216 gene, herein designated VGAM GENE, on one or more VGAM2216 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2216 is inhibition of expression of host target genes, as part of a novel viral mechanism of attacking a host. Accordingly, utilities of VGAM2216 include diagnosis, prevention and treatment of viral infection by Ectromelia Virus. Specific functions, and accordingly utilities, of VGAM2216 correlate with, and may be deduced from, the identity of the host target genes which VGAM2216 binds and inhibits, and the function of these host target genes, as elaborated hereinbelow.

Nucleotide sequences of the VGAM2216 precursor RNA, herein designated VGAM PRECURSOR RNA, and of the 'diced' VGAM2216 RNA, herein designated VGAM RNA, and a schematic representation of the secondary folding of VGAM2216 folded precursor RNA, herein designated VGAM FOLDED PRECURSOR RNA, of VGAM2216 are further described hereinbelow with reference to Table 1.

Nucleotide sequences of host target binding sites, such as BINDING SITE-I, BINDING SITE-II and BINDING SITE-III of FIG. 1, found on VGAM2216 host target RNA, and schematic representation of the complementarity of each of these host target binding sites to VGAM2216 RNA, herein designated VGAM RNA, are described hereinbelow with reference to Table 2.

As mentioned hereinabove with reference to FIG. 1, a function of VGAM2216 gene, herein designated VGAM is inhibition of expression of VGAM2216 target genes. It is appreciated that specific functions, and accordingly utilities, of VGAM2216 correlate with, and may be deduced from, the identity of the target genes which VGAM2216 binds and inhibits, and the function of these target genes, as elaborated hereinbelow.

Cytochrome P450, Subfamily IIIA (niphedipine oxidase), Polypeptide 4 (CYP3A4, Accession NM_017460) is a VGAM2216 host target gene. CYP3A4 BINDING SITE is HOST TARGET binding site found in the 3' untranslated region of mRNA encoded by CYP3A4, corresponding to a HOST TARGET binding site such as BINDING SITE I, BINDING SITE II or BINDING SITE III. Table 2 illustrates the complementarity of the nucleotide sequences of CYP3A4

BINDING SITE, designated SEQ ID:18931, to the nucleotide sequence of VGAM2216 RNA, herein designated VGAM RNA, also designated SEQ ID:4927.

A function of VGAM2216 is therefore inhibition of Cytochrome P450, Subfamily IIIA (niphedipine oxidase), Polypeptide 4 (CYP3A4, Accession NM_017460), a gene which may be involved in an nadph-dependent electron transport pathway. Accordingly, utilities of VGAM2216 include diagnosis, prevention and treatment of diseases and clinical conditions associated with CYP3A4. The function of CYP3A4 and its association with various diseases and clinical conditions, has been established by previous studies, as described hereinabove with reference to VGAM955. Inducible T-cell Co-stimulator (ICOS, Accession NM_012092) is another VGAM2216 host target gene. ICOS BINDING SITE is HOST TARGET binding site found in the 3' untranslated region of mRNA encoded by ICOS, corresponding to a HOST TARGET binding site such as BINDING SITE I, BINDING SITE II or BINDING SITE III. Table 2 illustrates the complementarity of the nucleotide sequences of ICOS BINDING SITE, designated SEQ ID:14382, to the nucleotide sequence of VGAM2216 RNA, herein designated VGAM RNA, also designated SEQ ID:4927.

Another function of VGAM2216 is therefore inhibition of Inducible T-cell Co-stimulator (ICOS, Accession NM_012092), a gene which forms homodimers and functions as an inducible T-cell co-stimulator. Accordingly, utilities of VGAM2216 include diagnosis, prevention and treatment of diseases and clinical conditions associated with ICOS. The function of ICOS and its association with various diseases and clinical conditions, has been established by previous studies, as described hereinabove with reference to VGAM18. LOC256790 (Accession XM_170679) is another VGAM2216 host target gene. LOC256790 BINDING SITE is HOST TARGET binding site found in the 5' untranslated region of mRNA encoded by LOC256790, corresponding to a HOST TARGET binding site such as BINDING SITE I, BINDING SITE II or BINDING SITE III. Table 2 illustrates the complementarity of the nucleotide sequences of LOC256790 BINDING SITE, designated SEQ ID:45459, to the nucleotide sequence of VGAM2216 RNA, herein designated VGAM RNA, also designated SEQ ID:4927.

Another function of VGAM2216 is therefore inhibition of LOC256790 (Accession XM_170679). Accordingly, utilities of VGAM2216 include diagnosis, prevention and treatment of diseases and clinical conditions associated with LOC256790. LOC91421 (Accession XM_038364) is another VGAM2216 host target gene. LOC91421 BINDING SITE is HOST TARGET binding site found in the 3' untranslated region of mRNA encoded by LOC91421, corresponding to a HOST TARGET binding site such as BINDING SITE I, BINDING SITE II or BINDING SITE III. Table 2 illustrates the complementarity of the nucleotide sequences of LOC91421 BINDING SITE, designated SEQ ID:32827, to the nucleotide sequence of VGAM2216 RNA, herein designated VGAM RNA, also designated SEQ ID:4927.

Another function of VGAM2216 is therefore inhibition of LOC91421 (Accession XM_038364). Accordingly, utilities of VGAM2216 include diagnosis, prevention and treatment of diseases and clinical conditions associated with LOC91421. FIG. 1 further provides a conceptual description of a novel bioinformatically detected viral gene of the present invention, referred to here as Viral Genomic Address Messenger 2217 (VGAM2217) viral gene, which modulates expression of respective host target genes thereof, the function and utility of which host target genes is known in the art.

VGAM2217 is a novel bioinformatically detected regulatory, non protein coding, viral micro RNA (miRNA) gene. The method by which VGAM2217 was detected is described hereinabove with reference to FIGS. 1-8.

VGAM2217 gene, herein designated VGAM GENE, is a viral gene contained in the genome of Ectromelia Virus. VGAM2217 host target gene, herein designated VGAM HOST TARGET GENE, is a human gene contained in the human genome.

VGAM2217 gene encodes a VGAM2217 precursor RNA, herein designated VGAM PRECURSOR RNA. Similar to other miRNA genes, and unlike most ordinary genes, VGAM2217 precursor RNA does not encode a protein. A nucleotide sequence identical or highly similar to the nucleotide sequence of VGAM2217 precursor RNA is designated SEQ ID:2203, and is provided hereinbelow with reference to the sequence listing part. Nucleotide sequence SEQ ID:2203 is located at position 198184 relative to the genome of Ectromelia Virus.

VGAM2217 precursor RNA folds onto itself, forming VGAM2217 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2217 folded precursor RNA into VGAM2217 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2217 RNA is designated SEQ ID:4928, and is provided hereinbelow with reference to the sequence listing part.

VGAM2217 host target gene, herein designated VGAM HOST TARGET GENE, encodes a corresponding messenger RNA, VGAM2217 host target RNA, herein designated VGAM HOST TARGET RNA. VGAM2217 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2217 RNA, herein designated VGAM RNA, binds complementarily to one or more host target binding sites located in untranslated regions of VGAM2217 host target RNA, herein designated VGAM HOST TARGET RNA. This complementary binding is due to the fact that the nucleotide sequence of VGAM2217 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2217 RNA, herein designated VGAM RNA, may have a different number of host target binding sites in untranslated regions of a VGAM2217 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2217 RNA, herein designated VGAM RNA, to host target binding sites on VGAM2217 host target RNA, herein designated VGAM HOST TARGET RNA, such as BINDING SITE I, BINDING SITE II and BINDING SITE III, inhibits translation of VGAM2217 host target RNA into VGAM2217 host target protein, herein designated VGAM HOST TARGET PROTEIN. VGAM host target protein is therefore outlined by a broken line.

It is appreciated that VGAM2217 host target gene, herein designated VGAM HOST TARGET GENE, in fact represents a plurality of VGAM2217 host target genes. The mRNA of each one of this plurality of VGAM2217 host target genes comprises one or more host target binding sites, each having a nucleotide sequence which is at least partly complementary to VGAM2217 RNA, herein designated VGAM RNA, and which when bound by VGAM2217 RNA causes inhibition of translation of respective one or more VGAM2217 host target proteins.

It is further appreciated by one skilled in the art that the mode of translational inhibition illustrated by FIG. 1 with specific reference to translational inhibition exerted by VGAM2217 gene, herein designated VGAM GENE, on one or more VGAM2217 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2217 is inhibition of expression of host target genes, as part of a novel viral mechanism of attacking a host. Accordingly, utilities of VGAM2217 include diagnosis, prevention and treatment of viral infection by Ectromelia Virus. Specific functions, and accordingly utilities, of VGAM2217 correlate with, and may be deduced from, the identity of the host target genes which VGAM2217 binds and inhibits, and the function of these host target genes, as elaborated hereinbelow.

Nucleotide sequences of the VGAM2217 precursor RNA, herein designated VGAM PRECURSOR RNA, and of the 'diced' VGAM2217 RNA, herein designated VGAM RNA, and a schematic representation of the secondary folding of VGAM2217 folded precursor RNA, herein designated VGAM FOLDED PRECURSOR RNA, of VGAM2217 are further described hereinbelow with reference to Table 1.

Nucleotide sequences of host target binding sites, such as BINDING SITE-I, BINDING SITE-II and BINDING SITE-III of FIG. 1, found on VGAM2217 host target RNA, and schematic representation of the complementarity of each of these host target binding sites to VGAM2217 RNA, herein designated VGAM RNA, are described hereinbelow with reference to Table 2.

As mentioned hereinabove with reference to FIG. 1, a function of VGAM2217 gene, herein designated VGAM is inhibition of expression of VGAM2217 target genes. It is appreciated that specific functions, and accordingly utilities, of VGAM2217 correlate with, and may be deduced from, the identity of the target genes which VGAM2217 binds and inhibits, and the function of these target genes, as elaborated hereinbelow.

Solute Carrier Family 22 (extraneuronal monoamine transporter), Member 3 (SLC22A3, Accession NM_021977) is a VGAM2217 host target gene. SLC22A3 BINDING SITE is HOST TARGET binding site found in the 3' untranslated region of mRNA encoded by SLC22A3, corresponding to a HOST TARGET binding site such as BINDING SITE I, BINDING SITE II or BINDING SITE III. Table 2 illustrates the complementarity of the nucleotide sequences of SLC22A3 BINDING SITE, designated SEQ ID:22503, to the nucleotide sequence of VGAM2217 RNA, herein designated VGAM RNA, also designated SEQ ID:4928.

A function of VGAM2217 is therefore inhibition of Solute Carrier Family 22 (extraneuronal monoamine transporter), Member 3 (SLC22A3, Accession NM_021977), a gene which is a sodium-ion dependent, high affinity carnitine transporter. also transports organic cations without the involvement of sodium. involved in the active cellular uptake of carnitine. Accordingly, utilities of VGAM2217 include diagnosis, prevention and treatment of diseases and clinical conditions associated with SLC22A3. The function of SLC22A3 and its association with various diseases and clinical conditions, has been established by previous studies, as described hereinabove with reference to VGAM2147. Solute Carrier Family 6 (neurotransmitter transporter, betaine/GABA), Member 12 (SLC6A12, Accession NM_003044) is another VGAM2217 host target gene. SLC6A12 BINDING SITE is HOST TARGET binding site found in the 3' untranslated region of mRNA encoded by SLC6A12, corresponding to a HOST TARGET binding site such as BINDING SITE I, BINDING SITE II or BINDING SITE III. Table 2 illustrates the complementarity of the nucleotide sequences of SLC6A12 BINDING SITE, designated SEQ ID:9010, to the nucleotide sequence of VGAM2217 RNA, herein designated VGAM RNA, also designated SEQ ID:4928.

Another function of VGAM2217 is therefore inhibition of Solute Carrier Family 6 (neurotransmitter transporter, betaine/GABA), Member 12 (SLC6A12, Accession NM_003044), a gene which transports betaine and gaba. Accordingly, utilities of VGAM2217 include diagnosis, prevention and treatment of diseases and clinical conditions associated with SLC6A12. The function of SLC6A12 and its association with various diseases and clinical conditions, has been established by previous studies, as described hereinabove with reference to VGAM293. Chromosome 22 Open Reading Frame 23 (C22orf23, Accession NM_032561) is another VGAM2217 host target gene. C22orf23 BINDING SITE is HOST TARGET binding site found in the 3' untranslated region of mRNA encoded by C22orf23, corresponding to a HOST TARGET binding site such as BINDING SITE I, BINDING SITE II or BINDING SITE III. Table 2 illustrates the complementarity of the nucleotide sequences of C22orf23 BINDING SITE, designated SEQ ID:26287, to the nucleotide sequence of VGAM2217 RNA, herein designated VGAM RNA, also designated SEQ ID:4928.

Another function of VGAM2217 is therefore inhibition of Chromosome 22 Open Reading Frame 23 (C22orf23, Accession NM_032561). Accordingly, utilities of VGAM2217 include diagnosis, prevention and treatment of diseases and clinical conditions associated with C22orf23. FLJ10159 (Accession NM_018013) is another VGAM2217 host target gene. FLJ10159 BINDING SITE is HOST TARGET binding site found in the 3' untranslated region of mRNA encoded by FLJ10159, corresponding to a HOST TARGET binding site such as BINDING SITE I, BINDING SITE II or BINDING SITE III. Table 2 illustrates the complementarity of the nucleotide sequences of FLJ10159 BINDING SITE, designated SEQ ID:19748, to the nucleotide sequence of VGAM2217 RNA, herein designated VGAM RNA, also designated SEQ ID:4928.

Another function of VGAM2217 is therefore inhibition of FLJ10159 (Accession NM_018013). Accordingly, utilities of VGAM2217 include diagnosis, prevention and treatment of diseases and clinical conditions associated with FLJ10159. KIAA1323 (Accession XM_032146) is another VGAM2217 host target gene. KIAA1323 BINDING SITE is HOST TARGET binding site found in the 3' untranslated region of mRNA encoded by KIAA1323, corresponding to a HOST TARGET binding site such as BINDING SITE I, BINDING SITE II or BINDING SITE III. Table 2 illustrates the complementarity of the nucleotide sequences of KIAA1323 BINDING SITE, designated SEQ ID:31566, to the nucleotide sequence of VGAM2217 RNA, herein designated VGAM RNA, also designated SEQ ID:4928.

Another function of VGAM2217 is therefore inhibition of KIAA1323 (Accession XM_032146). Accordingly, utilities of VGAM2217 include diagnosis, prevention and treatment of diseases and clinical conditions associated with KIAA1323. FIG. 1 further provides a conceptual description of a novel bioinformatically detected viral gene of the present invention, referred to here as Viral Genomic Address Messenger 2218 (VGAM2218) viral gene, which modulates expression of respective host target genes thereof, the function and utility of which host target genes is known in the art.

VGAM2218 is a novel bioinformatically detected regulatory, non protein coding, viral micro RNA (miRNA) gene. The method by which VGAM2218 was detected is described hereinabove with reference to FIGS. 1-8.

VGAM2218 gene, herein designated VGAM GENE, is a viral gene contained in the genome of Ectromelia Virus. VGAM2218 host target gene, herein designated VGAM HOST TARGET GENE, is a human gene contained in the human genome.

VGAM2218 gene encodes a VGAM2218 precursor RNA, herein designated VGAM PRECURSOR RNA. Similar to other miRNA genes, and unlike most ordinary genes, VGAM2218 precursor RNA does not encode a protein. A nucleotide sequence identical or highly similar to the nucleotide sequence of VGAM2218 precursor RNA is designated SEQ ID:2204, and is provided hereinbelow with reference to the sequence listing part. Nucleotide sequence SEQ ID:2204 is located at position 188178 relative to the genome of Ectromelia Virus.

VGAM2218 precursor RNA folds onto itself, forming VGAM2218 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2218 folded precursor RNA into VGAM2218 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2218 RNA is designated SEQ ID:4929, and is provided hereinbelow with reference to the sequence listing part.

VGAM2218 host target gene, herein designated VGAM HOST TARGET GENE, encodes a corresponding messenger RNA, VGAM2218 host target RNA, herein designated VGAM HOST TARGET RNA. VGAM2218 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2218 RNA, herein designated VGAM RNA, binds complementarily to one or more host target binding sites located in untranslated regions of VGAM2218 host target RNA, herein designated VGAM HOST TARGET RNA. This complementary binding is due to the fact that the nucleotide sequence of VGAM2218 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2218 RNA, herein designated VGAM RNA, may have a different number of host target binding sites in untranslated regions of a VGAM2218 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2218 RNA, herein designated VGAM RNA, to host target binding sites on VGAM2218 host target RNA, herein designated VGAM HOST TARGET RNA, such as BINDING SITE I, BINDING SITE II and BINDING SITE III, inhibits translation of VGAM2218 host target RNA into VGAM2218 host target protein, herein designated VGAM HOST TARGET PROTEIN. VGAM host target protein is therefore outlined by a broken line.

It is appreciated that VGAM2218 host target gene, herein designated VGAM HOST TARGET GENE, in fact represents a plurality of VGAM2218 host target genes. The mRNA of each one of this plurality of VGAM2218 host target genes comprises one or more host target binding sites, each having a nucleotide sequence which is at least partly complementary to VGAM2218 RNA, herein designated VGAM RNA, and which when bound by VGAM2218 RNA causes inhibition of translation of respective one or more VGAM2218 host target proteins.

It is further appreciated by one skilled in the art that the mode of translational inhibition illustrated by FIG. 1 with specific reference to translational inhibition exerted by VGAM2218 gene, herein designated VGAM GENE, on one or more VGAM2218 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2218 is inhibition of expression of host target genes, as part of a novel viral mechanism of attacking a host. Accordingly, utilities of VGAM2218 include diagnosis, prevention and treatment of viral infection by Ectromelia Virus. Specific functions, and accordingly utilities, of VGAM2218 correlate with, and may be deduced from, the identity of the host target genes which VGAM2218 binds and inhibits, and the function of these host target genes, as elaborated hereinbelow.

Nucleotide sequences of the VGAM2218 precursor RNA, herein designated VGAM PRECURSOR RNA, and of the 'diced' VGAM2218 RNA, herein designated VGAM RNA, and a schematic representation of the secondary folding of VGAM2218 folded precursor RNA, herein designated VGAM FOLDED PRECURSOR RNA, of VGAM2218 are further described hereinbelow with reference to Table 1.

Nucleotide sequences of host target binding sites, such as BINDING SITE-I, BINDING SITE-II and BINDING SITE-III of FIG. 1, found on VGAM2218 host target RNA, and schematic representation of the complementarity of each of these host target binding sites to VGAM2218 RNA, herein designated VGAM RNA, are described hereinbelow with reference to Table 2.

As mentioned hereinabove with reference to FIG. 1, a function of VGAM2218 gene, herein designated VGAM is inhibition of expression of VGAM2218 target genes. It is appreciated that specific functions, and accordingly utilities, of VGAM2218 correlate with, and may be deduced from, the identity of the target genes which VGAM2218 binds and inhibits, and the function of these target genes, as elaborated hereinbelow.

FLJ13072 (Accession XM_117117) is a VGAM2218 host target gene. FLJ13072 BINDING SITE is HOST TARGET binding site found in the 5' untranslated region of mRNA encoded by FLJ13072, corresponding to a HOST TARGET binding site such as BINDING SITE I, BINDING SITE II or BINDING SITE III. Table 2 illustrates the complementarity of the nucleotide sequences of FLJ13072 BINDING SITE, designated SEQ ID:43233, to the nucleotide sequence of VGAM2218 RNA, herein designated VGAM RNA, also designated SEQ ID:4929.

A function of VGAM2218 is therefore inhibition of FLJ13072 (Accession XM_117117). Accordingly, utilities of VGAM2218 include diagnosis, prevention and treatment of diseases and clinical conditions associated with FLJ13072. FIG. 1 further provides a conceptual description of a novel bioinformatically detected viral gene of the present invention, referred to here as Viral Genomic Address Messenger 2219 (VGAM2219) viral gene, which modulates expression of respective host target genes thereof, the function and utility of which host target genes is known in the art.

VGAM2219 is a novel bioinformatically detected regulatory, non protein coding, viral micro RNA (miRNA) gene. The method by which VGAM2219 was detected is described hereinabove with reference to FIGS. 1-8.

VGAM2219 gene, herein designated VGAM GENE, is a viral gene contained in the genome of Ectromelia Virus. VGAM2219 host target gene, herein designated VGAM HOST TARGET GENE, is a human gene contained in the human genome.

VGAM2219 gene encodes a VGAM2219 precursor RNA, herein designated VGAM PRECURSOR RNA. Similar to other miRNA genes, and unlike most ordinary genes, VGAM2219 precursor RNA does not encode a protein. A nucleotide sequence identical or highly similar to the nucleotide sequence of VGAM2219 precursor RNA is designated SEQ ID:2205, and is provided hereinbelow with reference to the sequence listing part. Nucleotide sequence SEQ ID:2205 is located at position 190763 relative to the genome of Ectromelia Virus.

VGAM2219 precursor RNA folds onto itself, forming VGAM2219 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2219 folded precursor RNA into VGAM2219 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM2219 RNA is designated SEQ ID:4930, and is provided hereinbelow with reference to the sequence listing part.

VGAM2219 host target gene, herein designated VGAM HOST TARGET GENE, encodes a corresponding messenger RNA, VGAM2219 host target RNA, herein designated VGAM HOST TARGET RNA. VGAM2219 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2219 RNA, herein designated VGAM RNA, binds complementarily to one or more host target binding sites located in untranslated regions of VGAM2219 host target RNA, herein designated VGAM HOST TARGET RNA. This complementary binding is due to the fact that the nucleotide sequence of VGAM2219 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2219 RNA, herein designated VGAM RNA, may have a different number of host target binding sites in untranslated regions of a VGAM2219 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2219 RNA, herein designated VGAM RNA, to host target binding sites on VGAM2219 host target RNA, herein designated VGAM HOST TARGET RNA, such as BINDING SITE I, BINDING SITE II and BINDING SITE III, inhibits translation of VGAM2219 host target RNA into VGAM2219 host target protein, herein designated VGAM HOST TARGET PROTEIN. VGAM host target protein is therefore outlined by a broken line.

It is appreciated that VGAM2219 host target gene, herein designated VGAM HOST TARGET GENE, in fact represents a plurality of VGAM2219 host target genes. The mRNA of each one of this plurality of VGAM2219 host target genes comprises one or more host target binding sites, each having a nucleotide sequence which is at least partly complementary to VGAM2219 RNA, herein designated VGAM RNA, and which when bound by VGAM2219 RNA causes inhibition of translation of respective one or more VGAM2219 host target proteins.

It is further appreciated by one skilled in the art that the mode of translational inhibition illustrated by FIG. 1 with specific reference to translational inhibition exerted by VGAM2219 gene, herein designated VGAM GENE, on one or more VGAM2219 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2219 is inhibition of expression of host target genes, as part of a novel viral mechanism of attacking a host. Accordingly, utilities of VGAM2219 include diagnosis, prevention and treatment of viral infection by Ectromelia Virus. Specific functions, and accordingly utilities, of VGAM2219 correlate with, and may be deduced from, the identity of the host target genes which VGAM2219 binds and inhibits, and the function of these host target genes, as elaborated hereinbelow.

Nucleotide sequences of the VGAM2219 precursor RNA, herein designated VGAM PRECURSOR RNA, and of the 'diced' VGAM2219 RNA, herein designated VGAM RNA, and a schematic representation of the secondary folding of VGAM2219 folded precursor RNA, herein designated VGAM FOLDED PRECURSOR RNA, of VGAM2219 are further described hereinbelow with reference to Table 1.

Nucleotide sequences of host target binding sites, such as BINDING SITE-I, BINDING SITE-II and BINDING SITE-III of FIG. 1, found on VGAM2219 host target RNA, and schematic representation of the complementarity of each of these host target binding sites to VGAM2219 RNA, herein designated VGAM RNA, are described hereinbelow with reference to Table 2.

As mentioned hereinabove with reference to FIG. 1, a function of VGAM2219 gene, herein designated VGAM is inhibition of expression of VGAM2219 target genes. It is appreciated that specific functions, and accordingly utilities, of VGAM2219 correlate with, and may be deduced from, the identity of the target genes which VGAM2219 binds and inhibits, and the function of these target genes, as elaborated hereinbelow.

Protocadherin Beta 16 (PCDHB16, Accession NM_020957) is a VGAM2219 host target gene. PCDHB16 BINDING SITE is HOST TARGET binding site found in the 3' untranslated region of mRNA encoded by PCDHB16, corresponding to a HOST TARGET binding site such as BINDING SITE I, BINDING SITE II or BINDING SITE III. Table 2 illustrates the complementarity of the nucleotide sequences of PCDHB16 BINDING SITE, designated SEQ ID:21945, to the nucleotide sequence of VGAM2219 RNA, herein designated VGAM RNA, also designated SEQ ID:4930.

A function of VGAM2219 is therefore inhibition of Protocadherin Beta 16 (PCDHB16, Accession NM_020957), a gene which is a potential calcium-dependent cell-adhesion protein. Accordingly, utilities of VGAM2219 include diagnosis, prevention and treatment of diseases and clinical conditions associated with PCDHB16. The function of PCDHB16 and its association with various diseases and clinical conditions, has been established by previous studies, as described hereinabove with reference to VGAM931. LOC221474 (Accession XM_166464) is another VGAM2219 host target gene. LOC221474 BINDING SITE is HOST TARGET binding site found in the 5' untranslated region of mRNA encoded by LOC221474, corresponding to a HOST TARGET binding site such as BINDING SITE I, BINDING SITE II or BINDING SITE III. Table 2 illustrates the complementarity of the nucleotide sequences of LOC221474 BINDING SITE, designated SEQ ID:44382, to the nucleotide sequence of VGAM2219 RNA, herein designated VGAM RNA, also designated SEQ ID:4930.

Another function of VGAM2219 is therefore inhibition of LOC221474 (Accession XM_166464). Accordingly, utilities of VGAM2219 include diagnosis, prevention and treatment of diseases and clinical conditions associated with LOC221474. FIG. 1 further provides a conceptual description of a novel bioinformatically detected viral gene of the present invention, referred to here as Viral Genomic Address Messenger 2220 (VGAM2220) viral gene, which modulates expression of respective host target genes thereof, the function and utility of which host target genes is known in the art.

VGAM2220 is a novel bioinformatically detected regulatory, non protein coding, viral micro RNA (miRNA) gene. The method by which VGAM2220 was detected is described hereinabove with reference to FIGS. 1-8.

VGAM2220 gene, herein designated VGAM GENE, is a viral gene contained in the genome of Ectromelia Virus. VGAM2220 host target gene, herein designated VGAM HOST TARGET GENE, is a human gene contained in the human genome.

VGAM2220 gene encodes a VGAM2220 precursor RNA, herein designated VGAM PRECURSOR RNA. Similar to other miRNA genes, and unlike most ordinary genes, VGAM2220 precursor RNA does not encode a protein. A nucleotide sequence identical or highly similar to the nucleotide sequence of VGAM2220 precursor RNA is designated SEQ ID:2206, and is provided hereinbelow with reference to the sequence listing part. Nucleotide sequence SEQ ID:2206 is located at position 196292 relative to the genome of Ectromelia Virus.

VGAM2220 precursor RNA folds onto itself, forming VGAM2220 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2220 folded precursor RNA into VGAM2220 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2220 RNA is designated SEQ ID:4931, and is provided hereinbelow with reference to the sequence listing part.

VGAM2220 host target gene, herein designated VGAM HOST TARGET GENE, encodes a corresponding messenger RNA, VGAM2220 host target RNA, herein designated VGAM HOST TARGET RNA. VGAM2220 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2220 RNA, herein designated VGAM RNA, binds complementarily to one or more host target binding sites located in untranslated regions of VGAM2220 host target RNA, herein designated VGAM HOST TARGET RNA. This complementary binding is due to the fact that the nucleotide sequence of VGAM2220 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2220 RNA, herein designated VGAM RNA, may have a different number of host target binding sites in untranslated regions of a VGAM2220 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2220 RNA, herein designated VGAM RNA, to host target binding sites on VGAM2220 host target RNA, herein designated VGAM HOST TARGET RNA, such as BINDING SITE I, BINDING SITE II and BINDING SITE III, inhibits translation of VGAM2220 host target RNA into VGAM2220 host target protein, herein designated VGAM HOST TARGET PROTEIN. VGAM host target protein is therefore outlined by a broken line.

It is appreciated that VGAM2220 host target gene, herein designated VGAM HOST TARGET GENE, in fact represents a plurality of VGAM2220 host target genes. The mRNA of each one of this plurality of VGAM2220 host target genes comprises one or more host target binding sites, each having a nucleotide sequence which is at least partly complementary to VGAM2220 RNA, herein designated VGAM RNA, and which when bound by VGAM2220 RNA causes inhibition of translation of respective one or more VGAM2220 host target proteins.

It is further appreciated by one skilled in the art that the mode of translational inhibition illustrated by FIG. 1 with specific reference to translational inhibition exerted by VGAM2220 gene, herein designated VGAM GENE, on one or more VGAM2220 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2220 is inhibition of expression of host target genes, as part of a novel viral mechanism of attacking a host. Accordingly, utilities of VGAM2220 include diagnosis, prevention and treatment of viral infection by Ectromelia Virus. Specific functions, and accordingly utilities, of VGAM2220 correlate with, and may be deduced from, the identity of the host target genes which VGAM2220 binds and inhibits, and the function of these host target genes, as elaborated hereinbelow.

Nucleotide sequences of the VGAM2220 precursor RNA, herein designated VGAM PRECURSOR RNA, and of the 'diced' VGAM2220 RNA, herein designated VGAM RNA, and a schematic representation of the secondary folding of VGAM2220 folded precursor RNA, herein designated VGAM FOLDED PRECURSOR RNA, of VGAM2220 are further described hereinbelow with reference to Table 1.

Nucleotide sequences of host target binding sites, such as BINDING SITE-I, BINDING SITE-II and BINDING SITE-III of FIG. 1, found on VGAM2220 host target RNA, and schematic representation of the complementarity of each of these host target binding sites to VGAM2220 RNA, herein designated VGAM RNA, are described hereinbelow with reference to Table 2.

As mentioned hereinabove with reference to FIG. 1, a function of VGAM2220 gene, herein designated VGAM is inhibition of expression of VGAM2220 target genes. It is appreciated that specific functions, and accordingly utilities, of VGAM2220 correlate with, and may be deduced from, the identity of the target genes which VGAM2220 binds and inhibits, and the function of these target genes, as elaborated hereinbelow.

PRO2435 (Accession NM_018527) is a VGAM2220 host target gene. PRO2435 BINDING SITE is HOST TARGET binding site found in the 5' untranslated region of mRNA encoded by PRO2435, corresponding to a HOST TARGET binding site such as BINDING SITE I, BINDING SITE II or BINDING SITE III. Table 2 illustrates the complementarity of the nucleotide sequences of PRO2435 BINDING SITE, designated SEQ ID:20598, to the nucleotide sequence of VGAM2220 RNA, herein designated VGAM RNA, also designated SEQ ID:4931.

A function of VGAM2220 is therefore inhibition of PRO2435 (Accession NM_018527). Accordingly, utilities of VGAM2220 include diagnosis, prevention and treatment of diseases and clinical conditions associated with PRO2435. LOC143425 (Accession XM_113695) is another VGAM2220 host target gene. LOC143425 BINDING SITE is HOST TARGET binding site found in the 3' untranslated region of mRNA encoded by LOC143425, corresponding to a HOST TARGET binding site such as BINDING SITE I, BINDING SITE II or BINDING SITE III. Table 2 illustrates the complementarity of the nucleotide sequences of LOC143425 BINDING SITE, designated SEQ ID:42354, to the nucleotide sequence of VGAM2220 RNA, herein designated VGAM RNA, also designated SEQ ID:4931.

Another function of VGAM2220 is therefore inhibition of LOC143425 (Accession XM_113695). Accordingly, utilities of VGAM2220 include diagnosis, prevention and treatment of diseases and clinical conditions associated with LOC143425. FIG. 1 further provides a conceptual description of a novel bioinformatically detected viral gene of the present invention, referred to here as Viral Genomic Address Messenger 2221 (VGAM2221) viral gene, which modulates expression of respective host target genes thereof, the function and utility of which host target genes is known in the art.

VGAM2221 is a novel bioinformatically detected regulatory, non protein coding, viral micro RNA (miRNA) gene. The method by which VGAM2221 was detected is described hereinabove with reference to FIGS. 1-8.

VGAM2221 gene, herein designated VGAM GENE, is a viral gene contained in the genome of Equine Herpesvirus 2. VGAM2221 host target gene, herein designated VGAM HOST TARGET GENE, is a human gene contained in the human genome.

VGAM2221 gene encodes a VGAM2221 precursor RNA, herein designated VGAM PRECURSOR RNA. Similar to other miRNA genes, and unlike most ordinary genes, VGAM2221 precursor RNA does not encode a protein. A nucleotide sequence identical or highly similar to the nucleotide sequence of VGAM2221 precursor RNA is designated SEQ ID:2207, and is provided hereinbelow with reference to the sequence listing part. Nucleotide sequence SEQ ID:2207 is located at position 161928 relative to the genome of Equine Herpesvirus 2.

VGAM2221 precursor RNA folds onto itself, forming VGAM2221 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2221 folded precursor RNA into VGAM2221 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM2221 RNA is designated SEQ ID:4932, and is provided hereinbelow with reference to the sequence listing part.

VGAM2221 host target gene, herein designated VGAM HOST TARGET GENE, encodes a corresponding messenger RNA, VGAM2221 host target RNA, herein designated VGAM HOST TARGET RNA. VGAM2221 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2221 RNA, herein designated VGAM RNA, binds complementarily to one or more host target binding sites located in untranslated regions of VGAM2221 host target RNA, herein designated VGAM HOST TARGET RNA. This complementary binding is due to the fact that the nucleotide sequence of VGAM2221 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2221 RNA, herein designated VGAM RNA, may have a different number of host target binding sites in untranslated regions of a VGAM2221 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2221 RNA, herein designated VGAM RNA, to host target binding sites on VGAM2221 host target RNA, herein designated VGAM HOST TARGET RNA, such as BINDING SITE I, BINDING SITE II and BINDING SITE III, inhibits translation of VGAM2221 host target RNA into VGAM2221 host target protein, herein designated VGAM HOST TARGET PROTEIN. VGAM host target protein is therefore outlined by a broken line.

It is appreciated that VGAM2221 host target gene, herein designated VGAM HOST TARGET GENE, in fact represents a plurality of VGAM2221 host target genes. The mRNA of each one of this plurality of VGAM2221 host target genes comprises one or more host target binding sites, each having a nucleotide sequence which is at least partly complementary to VGAM2221 RNA, herein designated VGAM RNA, and which when bound by VGAM2221 RNA causes inhibition of translation of respective one or more VGAM2221 host target proteins.

It is further appreciated by one skilled in the art that the mode of translational inhibition illustrated by FIG. 1 with specific reference to translational inhibition exerted by VGAM2221 gene, herein designated VGAM GENE, on one or more VGAM2221 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2221 is inhibition of expression of host target genes, as part of a novel viral mechanism of attacking a host. Accordingly, utilities of VGAM2221 include diagnosis, prevention and treatment of viral infection by Equine Herpesvirus 2. Specific functions, and accordingly utilities, of VGAM2221 correlate with, and may be deduced from, the identity of the host target genes which VGAM2221 binds and inhibits, and the function of these host target genes, as elaborated hereinbelow.

Nucleotide sequences of the VGAM2221 precursor RNA, herein designated VGAM PRECURSOR RNA, and of the 'diced' VGAM2221 RNA, herein designated VGAM RNA, and a schematic representation of the secondary folding of VGAM2221 folded precursor RNA, herein designated VGAM FOLDED PRECURSOR RNA, of VGAM2221 are further described hereinbelow with reference to Table 1.

Nucleotide sequences of host target binding sites, such as BINDING SITE-I, BINDING SITE-II and BINDING SITE-III of FIG. 1, found on VGAM2221 host target RNA, and schematic representation of the complementarity of each of these host target binding sites to VGAM2221 RNA, herein designated VGAM RNA, are described hereinbelow with reference to Table 2.

As mentioned hereinabove with reference to FIG. 1, a function of VGAM2221 gene, herein designated VGAM is inhibition of expression of VGAM2221 target genes. It is appreciated that specific functions, and accordingly utilities, of VGAM2221 correlate with, and may be deduced from, the identity of the target genes which VGAM2221 binds and inhibits, and the function of these target genes, as elaborated hereinbelow.

Chromodomain Helicase DNA Binding Protein 2 (CHD2, Accession NM_001271) is a VGAM2221 host target gene. CHD2 BINDING SITE is HOST TARGET binding site found in the 3' untranslated region of mRNA encoded by CHD2, corresponding to a HOST TARGET binding site such as BINDING SITE I, BINDING SITE II or BINDING SITE III. Table 2 illustrates the complementarity of the nucleotide sequences of CHD2 BINDING SITE, designated SEQ ID:6936, to the nucleotide sequence of VGAM2221 RNA, herein designated VGAM RNA, also designated SEQ ID:4932.

A function of VGAM2221 is therefore inhibition of Chromodomain Helicase DNA Binding Protein 2 (CHD2, Accession NM_001271). Accordingly, utilities of VGAM2221 include diagnosis, prevention and treatment of diseases and clinical conditions associated with CHD2. Coenzyme Q7 Homolog, Ubiquinone (yeast) (COQ7, Accession NM_016138) is another VGAM2221 host target gene. COQ7 BINDING SITE is HOST TARGET binding site found in the 3' untranslated region of mRNA encoded by COQ7, corresponding to a HOST TARGET binding site such as BINDING SITE I, BINDING SITE II or BINDING SITE III. Table 2 illustrates the complementarity of the nucleotide sequences of COQ7 BINDING SITE, designated SEQ ID:18222, to the nucleotide sequence of VGAM2221 RNA, herein designated VGAM RNA, also designated SEQ ID:4932.

Another function of VGAM2221 is therefore inhibition of Coenzyme Q7 Homolog, Ubiquinone (yeast) (COQ7, Accession NM_016138). Accordingly, utilities of VGAM2221 include diagnosis, prevention and treatment of diseases and clinical conditions associated with COQ7. KIAA1969 (Accession XM_086098) is another VGAM2221 host target gene. KIAA1969 BINDING SITE is HOST TARGET binding site found in the 3' untranslated region of mRNA encoded by KIAA1969, corresponding to a HOST TARGET binding site such as BINDING SITE I, BINDING SITE II or BINDING SITE III. Table 2 illustrates the complementarity of the nucleotide sequences of KIAA1969 BINDING SITE, designated SEQ ID:38490, to the nucleotide sequence of VGAM2221 RNA, herein designated VGAM RNA, also designated SEQ ID:4932.

Another function of VGAM2221 is therefore inhibition of KIAA1969 (Accession XM_086098). Accordingly, utilities of VGAM2221 include diagnosis, prevention and treatment of diseases and clinical conditions associated with KIAA1969. LOC153196 (Accession XM_098323) is another VGAM2221 host target gene. LOC153196 BINDING SITE is HOST TARGET binding site found in the 5' untranslated region of mRNA encoded by LOC153196, corresponding to a HOST TARGET binding site such as BINDING SITE I, BINDING SITE II or BINDING SITE III. Table 2 illustrates the complementarity of the nucleotide sequences of LOC153196 BINDING SITE, designated SEQ ID:41586, to the nucleotide sequence of VGAM2221 RNA, herein designated VGAM RNA, also designated SEQ ID:4932.

Another function of VGAM2221 is therefore inhibition of LOC153196 (Accession XM_098323). Accordingly, utilities of VGAM2221 include diagnosis, prevention and treatment of diseases and clinical conditions associated with LOC153196. LOC169026 (Accession XM_095471) is another VGAM2221 host target gene. LOC169026 BINDING SITE is HOST TARGET binding site found in the 3' untranslated region of mRNA encoded by LOC169026, corresponding to a HOST TARGET binding site such as BINDING SITE I, BINDING SITE II or BINDING SITE III. Table 2 illustrates the complementarity of the nucleotide sequences of LOC169026 BINDING SITE, designated SEQ ID:40260, to the nucleotide sequence of VGAM2221 RNA, herein designated VGAM RNA, also designated SEQ ID:4932.

Another function of VGAM2221 is therefore inhibition of LOC169026 (Accession XM_095471). Accordingly, utilities of VGAM2221 include diagnosis, prevention and treatment of diseases and clinical conditions associated with LOC169026. FIG. 1 further provides a conceptual description of a novel bioinformatically detected viral gene of the present invention, referred to here as Viral Genomic Address Messenger 2222 (VGAM2222) viral gene, which modulates expression of respective host target genes thereof, the function and utility of which host target genes is known in the art.

VGAM2222 is a novel bioinformatically detected regulatory, non protein coding, viral micro RNA (miRNA) gene. The method by which VGAM2222 was detected is described hereinabove with reference to FIGS. 1-8.

VGAM2222 gene, herein designated VGAM GENE, is a viral gene contained in the genome of Equine Herpesvirus 2. VGAM2222 host target gene, herein designated VGAM HOST TARGET GENE, is a human gene contained in the human genome.

VGAM2222 gene encodes a VGAM2222 precursor RNA, herein designated VGAM PRECURSOR RNA. Similar to other miRNA genes, and unlike most ordinary genes, VGAM2222 precursor RNA does not encode a protein. A nucleotide sequence identical or highly similar to the nucleotide sequence of VGAM2222 precursor RNA is designated SEQ ID:2208, and is provided hereinbelow with reference to the sequence listing part. Nucleotide sequence SEQ ID:2208 is located at position 11521 relative to the genome of Equine Herpesvirus 2.

VGAM2222 precursor RNA folds onto itself, forming VGAM2222 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2222 folded precursor RNA into VGAM2222 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM2222 RNA is designated SEQ ID:4933, and is provided hereinbelow with reference to the sequence listing part.

VGAM2222 host target gene, herein designated VGAM HOST TARGET GENE, encodes a corresponding messenger RNA, VGAM2222 host target RNA, herein designated VGAM HOST TARGET RNA. VGAM2222 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2222 RNA, herein designated VGAM RNA, binds complementarily to one or more host target binding sites located in untranslated regions of VGAM2222 host target RNA, herein designated VGAM HOST TARGET RNA. This complementary binding is due to the fact that the nucleotide sequence of VGAM2222 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2222 RNA, herein designated VGAM RNA, may have a different number of host target binding sites in untranslated regions of a VGAM2222 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2222 RNA, herein designated VGAM RNA, to host target binding sites on VGAM2222 host target RNA, herein designated VGAM HOST TARGET RNA, such as BINDING SITE I, BINDING SITE II and BINDING SITE III, inhibits translation of VGAM2222 host target RNA into VGAM2222 host target protein, herein designated VGAM HOST TARGET PROTEIN. VGAM host target protein is therefore outlined by a broken line.

It is appreciated that VGAM2222 host target gene, herein designated VGAM HOST TARGET GENE, in fact represents a plurality of VGAM2222 host target genes. The mRNA of each one of this plurality of VGAM2222 host target genes comprises one or more host target binding sites, each having a nucleotide sequence which is at least partly complementary to VGAM2222 RNA, herein designated VGAM RNA, and which when bound by VGAM2222 RNA causes inhibition of translation of respective one or more VGAM2222 host target proteins.

It is further appreciated by one skilled in the art that the mode of translational inhibition illustrated by FIG. 1 with specific reference to translational inhibition exerted by VGAM2222 gene, herein designated VGAM GENE, on one or more VGAM2222 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2222 is inhibition of expression of host target genes, as part of a novel viral mechanism of attacking a host. Accordingly, utilities of VGAM2222 include diagnosis, prevention and treatment of viral infection by Equine Herpesvirus 2. Specific functions, and accordingly utilities, of VGAM2222 correlate with, and may be deduced from, the identity of the host target genes which VGAM2222 binds and inhibits, and the function of these host target genes, as elaborated hereinbelow.

Nucleotide sequences of the VGAM2222 precursor RNA, herein designated VGAM PRECURSOR RNA, and of the 'diced' VGAM2222 RNA, herein designated VGAM RNA, and a schematic representation of the secondary folding of VGAM2222 folded precursor RNA, herein designated VGAM FOLDED PRECURSOR RNA, of VGAM2222 are further described hereinbelow with reference to Table 1.

Nucleotide sequences of host target binding sites, such as BINDING SITE-I, BINDING SITE-II and BINDING SITE-III of FIG. 1, found on VGAM2222 host target RNA, and schematic representation of the complementarity of each of these host target binding sites to VGAM2222 RNA, herein designated VGAM RNA, are described hereinbelow with reference to Table 2.

As mentioned hereinabove with reference to FIG. 1, a function of VGAM2222 gene, herein designated VGAM is inhibition of expression of VGAM2222 target genes. It is appreciated that specific functions, and accordingly utilities, of VGAM2222 correlate with, and may be deduced from, the identity of the target genes which VGAM2222 binds and inhibits, and the function of these target genes, as elaborated hereinbelow.

CSE-C (Accession XM_166163) is a VGAM2222 host target gene. CSE-C BINDING SITE is HOST TARGET binding site found in the 3' untranslated region of mRNA encoded by CSE-C, corresponding to a HOST TARGET binding site such as BINDING SITE I, BINDING SITE II or BINDING SITE III. Table 2 illustrates the complementarity of the nucleotide sequences of CSE-C BINDING SITE, designated SEQ ID:43982, to the nucleotide sequence of VGAM2222 RNA, herein designated VGAM RNA, also designated SEQ ID:4933.

A function of VGAM2222 is therefore inhibition of CSE-C (Accession XM_166163). Accordingly, utilities of VGAM2222 include diagnosis, prevention and treatment of diseases and clinical conditions associated with CSE-C. DKFZP434N178 (Accession XM_050278) is another VGAM2222 host target gene. DKFZP434N178 BINDING SITE is HOST TARGET binding site found in the 3' untranslated region of mRNA encoded by DKFZP434N178, corresponding to a HOST TARGET binding site such as BINDING SITE I, BINDING SITE II or BINDING SITE III. Table 2 illustrates the complementarity of the nucleotide sequences of DKFZP434N178 BINDING SITE, designated SEQ ID:35599, to the nucleotide sequence of VGAM2222 RNA, herein designated VGAM RNA, also designated SEQ ID:4933.

Another function of VGAM2222 is therefore inhibition of DKFZP434N178 (Accession XM_050278). Accordingly, utilities of VGAM2222 include diagnosis, prevention and treatment of diseases and clinical conditions associated with DKFZP434N178. LOC203411 (Accession XM_117547) is another VGAM2222 host target gene. LOC203411 BINDING SITE is HOST TARGET binding site found in the 3' untranslated region of mRNA encoded by LOC203411, corresponding to a HOST TARGET binding site such as BINDING SITE I, BINDING SITE II or BINDING SITE III. Table 2 illustrates the complementarity of the nucleotide sequences of LOC203411 BINDING SITE, designated SEQ ID:43566, to the nucleotide sequence of VGAM2222 RNA, herein designated VGAM RNA, also designated SEQ ID:4933.

Another function of VGAM2222 is therefore inhibition of LOC203411 (Accession XM_117547). Accordingly, utilities of VGAM2222 include diagnosis, prevention and treatment of diseases and clinical conditions associated with LOC203411. FIG. 1 further provides a conceptual description of a novel bioinformatically detected viral gene of the present invention, referred to here as Viral Genomic Address Messenger 2223 (VGAM2223) viral gene, which modulates expression of respective host target genes thereof, the function and utility of which host target genes is known in the art.

VGAM2223 is a novel bioinformatically detected regulatory, non protein coding, viral micro RNA (miRNA) gene. The method by which VGAM2223 was detected is described hereinabove with reference to FIGS. 1-8.

VGAM2223 gene, herein designated VGAM GENE, is a viral gene contained in the genome of Equine Herpesvirus 2. VGAM2223 host target gene, herein designated VGAM HOST TARGET GENE, is a human gene contained in the human genome.

VGAM2223 gene encodes a VGAM2223 precursor RNA, herein designated VGAM PRECURSOR RNA. Similar to other miRNA genes, and unlike most ordinary genes, VGAM2223 precursor RNA does not encode a protein. A nucleotide sequence identical or highly similar to the nucleotide sequence of VGAM2223 precursor RNA is designated SEQ ID:2209, and is provided hereinbelow with reference to the sequence listing part. Nucleotide sequence SEQ ID:2209 is located at position 2065 relative to the genome of Equine Herpesvirus 2.

VGAM2223 precursor RNA folds onto itself, forming VGAM2223 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2223 folded precursor RNA into VGAM2223 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM2223 RNA is designated SEQ ID:4934, and is provided hereinbelow with reference to the sequence listing part.

VGAM2223 host target gene, herein designated VGAM HOST TARGET GENE, encodes a corresponding messenger RNA, VGAM2223 host target RNA, herein designated VGAM HOST TARGET RNA. VGAM2223 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2223 RNA, herein designated VGAM RNA, binds complementarily to one or more host target binding sites located in untranslated regions of VGAM2223 host target RNA, herein designated VGAM HOST TARGET RNA. This complementary binding is due to the fact that the nucleotide sequence of VGAM2223 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2223 RNA, herein designated VGAM RNA, may have a different number of host target binding sites in untranslated regions of a VGAM2223 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2223 RNA, herein designated VGAM RNA, to host target binding sites on VGAM2223 host target RNA, herein designated VGAM HOST TARGET RNA, such as BINDING SITE I, BINDING SITE II and BINDING SITE III, inhibits translation of VGAM2223 host target RNA into VGAM2223 host target protein, herein designated VGAM HOST TARGET PROTEIN. VGAM host target protein is therefore outlined by a broken line.

It is appreciated that VGAM2223 host target gene, herein designated VGAM HOST TARGET GENE, in fact represents a plurality of VGAM2223 host target genes. The mRNA of each one of this plurality of VGAM2223 host target genes comprises one or more host target binding sites, each having a nucleotide sequence which is at least partly complementary to VGAM2223 RNA, herein designated VGAM RNA, and which when bound by VGAM2223 RNA causes inhibition of translation of respective one or more VGAM2223 host target proteins.

It is further appreciated by one skilled in the art that the mode of translational inhibition illustrated by FIG. 1 with specific reference to translational inhibition exerted by VGAM2223 gene, herein designated VGAM GENE, on one or more VGAM2223 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2223 is inhibition of expression of host target genes, as part of a novel viral mechanism of attacking a host. Accordingly, utilities of VGAM2223 include diagnosis, prevention and treatment of viral infection by Equine Herpesvirus 2. Specific functions, and accordingly utilities, of VGAM2223 correlate with, and may be deduced from, the identity of the host target genes which VGAM2223 binds and inhibits, and the function of these host target genes, as elaborated hereinbelow.

Nucleotide sequences of the VGAM2223 precursor RNA, herein designated VGAM PRECURSOR RNA, and of the 'diced' VGAM2223 RNA, herein designated VGAM RNA, and a schematic representation of the secondary folding of VGAM2223 folded precursor RNA, herein designated VGAM FOLDED PRECURSOR RNA, of VGAM2223 are further described hereinbelow with reference to Table 1.

Nucleotide sequences of host target binding sites, such as BINDING SITE-I, BINDING SITE-II and BINDING SITE-III of FIG. 1, found on VGAM2223 host target RNA, and schematic representation of the complementarity of each of these host target binding sites to VGAM2223 RNA, herein designated VGAM RNA, are described hereinbelow with reference to Table 2.

As mentioned hereinabove with reference to FIG. 1, a function of VGAM2223 gene, herein designated VGAM is inhibition of expression of VGAM2223 target genes. It is appreciated that specific functions, and accordingly utilities, of VGAM2223 correlate with, and may be deduced from, the identity of the target genes which VGAM2223 binds and inhibits, and the function of these target genes, as elaborated hereinbelow.

EGF-like-domain, Multiple 5 (EGFL5, Accession XM_098838) is a VGAM2223 host target gene. EGFL5 BINDING SITE is HOST TARGET binding site found in the 5' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41871, to the nucleotide sequence of VGAM2223 RNA, herein designated VGAM RNA, also designated SEQ ID:4934.

A function of VGAM2223 is therefore inhibition of EGF-like-domain, Multiple 5 (EGFL5, Accession XM_098838). Accordingly, utilities of VGAM2223 include diagnosis, prevention and treatment of diseases and clinical conditions associated with EGFL5. Egl Nine Homolog 1 (C. elegans)

(EGLN1, Accession NM_022051) is another VGAM2223 host target gene. EGLN1 BINDING SITE is HOST TARGET binding site found in the 5' untranslated region of mRNA encoded by EGLN1, corresponding to a HOST TARGET binding site such as BINDING SITE I, BINDING SITE II or BINDING SITE III. Table 2 illustrates the complementarity of the nucleotide sequences of EGLN1 BINDING SITE, designated SEQ ID:22586, to the nucleotide sequence of VGAM2223 RNA, herein designated VGAM RNA, also designated SEQ ID:4934.

Another function of VGAM2223 is therefore inhibition of Egl Nine Homolog 1 (C. elegans) (EGLN1, Accession NM_022051), a gene which is expressed in the cytoplasm of arterial smooth muscle cells. Accordingly, utilities of VGAM2223 include diagnosis, prevention and treatment of diseases and clinical conditions associated with EGLN1. The function of EGLN1 and its association with various diseases and clinical conditions, has been established by previous studies, as described hereinabove with reference to VGAM216. Erbb2 Interacting Protein (ERBB2IP, Accession NM_018695) is another VGAM2223 host target gene. ERBB2IP BINDING SITE is HOST TARGET binding site found in the 3' untranslated region of mRNA encoded by ERBB2IP, corresponding to a HOST TARGET binding site such as BINDING SITE I, BINDING SITE II or BINDING SITE III. Table 2 illustrates the complementarity of the nucleotide sequences of ERBB2IP BINDING SITE, designated SEQ ID:20769, to the nucleotide sequence of VGAM2223 RNA, herein designated VGAM RNA, also designated SEQ ID:4934.

Another function of VGAM2223 is therefore inhibition of Erbb2 Interacting Protein (ERBB2IP, Accession NM_018695), a gene which ERBB2 interacting protein; acts as an adaptor for the receptor ERBB2/HER2. Accordingly, utilities of VGAM2223 include diagnosis, prevention and treatment of diseases and clinical conditions associated with ERBB2IP. The function of ERBB2IP and its association with various diseases and clinical conditions, has been established by previous studies, as described hereinabove with reference to VGAM1019. FOG2 (Accession NM_012082) is another VGAM2223 host target gene. FOG2 BINDING SITE is HOST TARGET binding site found in the 3' untranslated region of mRNA encoded by FOG2, corresponding to a HOST TARGET binding site such as BINDING SITE I, BINDING SITE II or BINDING SITE III. Table 2 illustrates the complementarity of the nucleotide sequences of FOG2 BINDING SITE, designated SEQ ID:14371, to the nucleotide sequence of VGAM2223 RNA, herein designated VGAM RNA, also designated SEQ ID:4934.

Another function of VGAM2223 is therefore inhibition of FOG2 (Accession NM_012082), a gene which Interacts with and modulates activities of GATA-1 and mCtBP2. Accordingly, utilities of VGAM2223 include diagnosis, prevention and treatment of diseases and clinical conditions associated with FOG2. The function of FOG2 has been established by previous studies. Svensson et al. (1999) showed that mouse Fog2 associates physically with the N-terminal zinc finger of Gata4 both in vitro and in vivo. This interaction appears to modulate specifically the transcriptional activity of Gata4 because overexpression of Fog2 in both NIH 3T3 cells and primary rat cardiomyocytes repressed Gata4-dependent transcription from multiple cardiac-restricted promoters. Taken together, these results implicated FOG2 as a novel modulator of GATA4 function during cardiac development and suggested a paradigm in which tissue-specific interactions between different FOG and GATA proteins regulate the differentiation of distinct mesodermal cell lineages. Animal model experiments lend further support to the function of FOG2. GATA4 is a zinc finger transcription factor with a role in early cardiac development. GATA4-deficient mice fail to form a ventral heart tube and die of circulatory failure at embryonic day (E)8.5. Zfpm2, also know as Fog2, is a multi-zinc-finger protein that is coexpressed with Gata4 in the developing heart beginning at E8.5. Zfpm2 interacts specifically with the N-terminal zinc finger of Gata4 and represses Gata4-dependent transcription. Svensson et al. (2000) used targeted mutagenesis to explore the role of Zfpm2 in normal cardiac development. Zfpm2-deficient mice died of congestive heart failure at E13 with a syndrome of tricuspid atresia (OMIM Ref. No. 605067) that included an absent tricuspid valve, a large atrial septal defect, a ventral septal defect, an elongated left ventricular outflow tract, rightward displacement of the aortic valve, and pulmonic stenosis. These mice also displayed hypoplasia of the compact zone of the left ventricle. Findings indicated the importance of Zfpm2 in the normal looping and septation of the heart and suggested a genetic basis for the syndrome of tricuspid atresia.

It is appreciated that the abovementioned animal model for FOG2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Svensson, E. C.; Huggins, G. S.; Lin, H.; Clendenin, C.; Jiang, F.; Tufts, R.; Dardik, F. B.; Leiden, J. M.: A syndrome of tricuspid atresia in mice with a targeted mutation of the gene encoding Fog-2. Nature Genet. 25:353-356, 2000; and Svensson, E. C.; Tufts, R. L.; Polk, C. E.; Leiden, J. M.: Molecular cloning of FOG-2: a modulator of transcription factor GATA-4 in cardiomyocytes. Proc. Nat. Acad. Sci. 96:956-961.

Further studies establishing the function and utilities of FOG2 are found in John Hopkins OMIM database record ID 603693, and in sited publications numbered 991 and 9919-4953 listed in the bibliography section hereinbelow, which are also hereby incorporated by reference. TNF Receptor-associated Factor 5 (TRAF5, Accession NM_004619) is another VGAM2223 host target gene. TRAF5 BINDING SITE is HOST TARGET binding site found in the 3' untranslated region of mRNA encoded by TRAF5, corresponding to a HOST TARGET binding site such as BINDING SITE I, BINDING SITE II or BINDING SITE III. Table 2 illustrates the complementarity of the nucleotide sequences of TRAF5 BINDING SITE, designated SEQ ID:10963, to the nucleotide sequence of VGAM2223 RNA, herein designated VGAM RNA, also designated SEQ ID:4934.

Another function of VGAM2223 is therefore inhibition of TNF Receptor-associated Factor 5 (TRAF5, Accession NM_004619), a gene which Member of a family of proteins that interact with TNF receptors; binds the lymphotoxin beta receptor (LTBR). Accordingly, utilities of VGAM2223 include diagnosis, prevention and treatment of diseases and clinical conditions associated with TRAF5. The function of TRAF5 and its association with various diseases and clinical conditions, has been established by previous studies, as described hereinabove with reference to VGAM76. KIAA0643 (Accession NM_024793) is another VGAM2223 host target gene. KIAA0643 BINDING SITE is HOST TARGET binding site found in the 3' untranslated region of mRNA encoded by KIAA0643, corresponding to a HOST TARGET binding site such as BINDING SITE I, BINDING SITE II or BINDING SITE III. Table 2 illustrates the complementarity of the nucleotide sequences of KIAA0643 BIND- ING SITE, designated SEQ ID:24172, to the nucleotide sequence of VGAM2223 RNA, herein designated VGAM RNA, also designated SEQ ID:4934.

Another function of VGAM2223 is therefore inhibition of KIAA0643 (Accession NM_024793). Accordingly, utilities of VGAM2223 include diagnosis, prevention and treatment of diseases and clinical conditions associated with KIAA0643. KIAA1676 (Accession XM_167612) is another VGAM2223 host target gene. KIAA1676 BINDING SITE is HOST TARGET binding site found in the 3' untranslated region of mRNA encoded by KIAA1676, corresponding to a HOST TARGET binding site such as BINDING SITE I, BINDING SITE II or BINDING SITE III. Table 2 illustrates the complementarity of the nucleotide sequences of KIAA1676 BINDING SITE, designated SEQ ID:44725, to the nucleotide sequence of VGAM2223 RNA, herein designated VGAM RNA, also designated SEQ ID:4934.

Another function of VGAM2223 is therefore inhibition of KIAA1676 (Accession XM_167612). Accordingly, utilities of VGAM2223 include diagnosis, prevention and treatment of diseases and clinical conditions associated with KIAA1676. LOC199725 (Accession XM_117119) is another VGAM2223 host target gene. LOC199725 BINDING SITE is HOST TARGET binding site found in the 3' untranslated region of mRNA encoded by LOC199725, corresponding to a HOST TARGET binding site such as BINDING SITE I, BINDING SITE II or BINDING SITE III. Table 2 illustrates the complementarity of the nucleotide sequences of LOC199725 BINDING SITE, designated SEQ ID:43240, to the nucleotide sequence of VGAM2223 RNA, herein designated VGAM RNA, also designated SEQ ID:4934.

Another function of VGAM2223 is therefore inhibition of LOC199725 (Accession XM_117119). Accordingly, utilities of VGAM2223 include diagnosis, prevention and treatment of diseases and clinical conditions associated with LOC199725. LOC200347 (Accession XM_114219) is another VGAM2223 host target gene. LOC200347 BINDING SITE is HOST TARGET binding site found in the 5' untranslated region of mRNA encoded by LOC200347, corresponding to a HOST TARGET binding site such as BINDING SITE I, BINDING SITE II or BINDING SITE III. Table 2 illustrates the complementarity of the nucleotide sequences of LOC200347 BINDING SITE, designated SEQ ID:42805, to the nucleotide sequence of VGAM2223 RNA, herein designated VGAM RNA, also designated SEQ ID:4934.

Another function of VGAM2223 is therefore inhibition of LOC200347 (Accession XM_114219). Accordingly, utilities of VGAM2223 include diagnosis, prevention and treatment of diseases and clinical conditions associated with LOC200347. FIG. 1 further provides a conceptual description of a novel bioinformatically detected viral gene of the present invention, referred to here as Viral Genomic Address Messenger 2224 (VGAM2224) viral gene, which modulates expression of respective host target genes thereof, the function and utility of which host target genes is known in the art.

VGAM2224 is a novel bioinformatically detected regulatory, non protein coding, viral micro RNA (miRNA) gene. The method by which VGAM2224 was detected is described hereinabove with reference to FIGS. 1-8.

VGAM2224 gene, herein designated VGAM GENE, is a viral gene contained in the genome of Equine Herpesvirus 2. VGAM2224 host target gene, herein designated VGAM HOST TARGET GENE, is a human gene contained in the human genome.

VGAM2224 gene encodes a VGAM2224 precursor RNA, herein designated VGAM PRECURSOR RNA. Similar to other miRNA genes, and unlike most ordinary genes, VGAM2224 precursor RNA does not encode a protein. A nucleotide sequence identical or highly similar to the nucleotide sequence of VGAM2224 precursor RNA is designated SEQ ID:2210, and is provided hereinbelow with reference to the sequence listing part. Nucleotide sequence SEQ ID:2210 is located at position 2628 relative to the genome of Equine Herpesvirus 2.

VGAM2224 precursor RNA folds onto itself, forming VGAM2224 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2224 folded precursor RNA into VGAM2224 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2224 RNA is designated SEQ ID:4935, and is provided hereinbelow with reference to the sequence listing part.

VGAM2224 host target gene, herein designated VGAM HOST TARGET GENE, encodes a corresponding messenger RNA, VGAM2224 host target RNA, herein designated VGAM HOST TARGET RNA. VGAM2224 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2224 RNA, herein designated VGAM RNA, binds complementarily to one or more host target binding sites located in untranslated regions of VGAM2224 host target RNA, herein designated VGAM HOST TARGET RNA. This complementary binding is due to the fact that the nucleotide sequence of VGAM2224 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2224 RNA, herein designated VGAM RNA, may have a different number of host target binding sites in untranslated regions of a VGAM2224 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2224 RNA, herein designated VGAM RNA, to host target binding sites on VGAM2224 host target RNA, herein designated VGAM HOST TARGET RNA, such as BINDING SITE I, BINDING SITE II and BINDING SITE III, inhibits translation of VGAM2224 host target RNA into VGAM2224 host target protein, herein designated VGAM HOST TARGET PROTEIN. VGAM host target protein is therefore outlined by a broken line.

It is appreciated that VGAM2224 host target gene, herein designated VGAM HOST TARGET GENE, in fact represents a plurality of VGAM2224 host target genes. The mRNA of each one of this plurality of VGAM2224 host target genes comprises one or more host target binding sites, each having a nucleotide sequence which is at least partly complementary to VGAM2224 RNA, herein designated VGAM RNA, and which when bound by VGAM2224 RNA causes inhibition of translation of respective one or more VGAM2224 host target proteins.

It is further appreciated by one skilled in the art that the mode of translational inhibition illustrated by FIG. 1 with specific reference to translational inhibition exerted by VGAM2224 gene, herein designated VGAM GENE, on one or more VGAM2224 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2224 is inhibition of expression of host target genes, as part of a novel viral mechanism of attacking a host. Accordingly, utilities of VGAM2224 include diagnosis, prevention and treatment of viral infection by Equine Herpesvirus 2. Specific functions, and accordingly utilities, of VGAM2224 correlate with, and may be deduced from, the identity of the host target genes which VGAM2224 binds and inhibits, and the function of these host target genes, as elaborated hereinbelow.

Nucleotide sequences of the VGAM2224 precursor RNA, herein designated VGAM PRECURSOR RNA, and of the 'diced' VGAM2224 RNA, herein designated VGAM RNA, and a schematic representation of the secondary folding of VGAM2224 folded precursor RNA, herein designated VGAM FOLDED PRECURSOR RNA, of VGAM2224 are further described hereinbelow with reference to Table 1.

Nucleotide sequences of host target binding sites, such as BINDING SITE-I, BINDING SITE-II and BINDING SITE-III of FIG. 1, found on VGAM2224 host target RNA, and schematic representation of the complementarity of each of these host target binding sites to VGAM2224 RNA, herein designated VGAM RNA, are described hereinbelow with reference to Table 2.

As mentioned hereinabove with reference to FIG. 1, a function of VGAM2224 gene, herein designated VGAM is inhibition of expression of VGAM2224 target genes. It is appreciated that specific functions, and accordingly utilities, of VGAM2224 correlate with, and may be deduced from, the identity of the target genes which VGAM2224 binds and inhibits, and the function of these target genes, as elaborated hereinbelow.

Adenylate Cyclase 6 (ADCY6, Accession NM_015270) is a VGAM2224 host target gene. ADCY6 BINDING SITE1 and ADCY6 BINDING SITE2 are HOST TARGET binding sites found in untranslated regions of mRNA encoded by ADCY6, corresponding to HOST TARGET binding sites such as BINDING SITE I, BINDING SITE II or BINDING SITE III. Table 2 illustrates the complementarity of the nucleotide sequences of ADCY6 BINDING SITE1 and ADCY6 BINDING SITE2, designated SEQ ID:17586 and SEQ ID:21974 respectively, to the nucleotide sequence of VGAM2224 RNA, herein designated VGAM RNA, also designated SEQ ID:4935.

A function of VGAM2224 is therefore inhibition of Adenylate Cyclase 6 (ADCY6, Accession NM_015270), a gene which this a membrane-bound, ca (2+)-inhibitable adenylyl cyclase (by similarity). Accordingly, utilities of VGAM2224 include diagnosis, prevention and treatment of diseases and clinical conditions associated with ADCY6. The function of ADCY6 and its association with various diseases and clinical conditions, has been established by previous studies, as described hereinabove with reference to VGAM22. Zinc Finger Protein 36 (KOX 18) (ZNF36, Accession XM_168302) is another VGAM2224 host target gene. ZNF36 BINDING SITE is HOST TARGET binding site found in the 3' untranslated region of mRNA encoded by ZNF36, corresponding to a HOST TARGET binding site such as BINDING SITE I, BINDING SITE II or BINDING SITE III. Table 2 illustrates the complementarity of the nucleotide sequences of ZNF36 BINDING SITE, designated SEQ ID:45102, to the nucleotide sequence of VGAM2224 RNA, herein designated VGAM RNA, also designated SEQ ID:4935.

Another function of VGAM2224 is therefore inhibition of Zinc Finger Protein 36 (KOX 18) (ZNF36, Accession XM_168302), a gene which may be involved in transcriptional regulation. Accordingly, utilities of VGAM2224 include diagnosis, prevention and treatment of diseases and clinical conditions associated with ZNF36. The function of ZNF36 and its association with various diseases and clinical conditions, has been established by previous studies, as described hereinabove with reference to VGAM804. A Kinase (PRKA) Anchor Protein 11 (AKAP11, Accession NM_016248) is another VGAM2224 host target gene. AKAP11 BINDING SITE is HOST TARGET binding site found in the 3' untranslated region of mRNA encoded by AKAP11, corresponding to a HOST TARGET binding site such as BINDING SITE I, BINDING SITE II or BINDING SITE III. Table 2 illustrates the complementarity of the nucleotide sequences of AKAP11 BINDING SITE, designated SEQ ID:18371, to the nucleotide sequence of VGAM2224 RNA, herein designated VGAM RNA, also designated SEQ ID:4935.

Another function of VGAM2224 is therefore inhibition of A Kinase (PRKA) Anchor Protein 11 (AKAP11, Accession NM_016248). Accordingly, utilities of VGAM2224 include diagnosis, prevention and treatment of diseases and clinical conditions associated with AKAP11. FIG. 1 further provides a conceptual description of a novel bioinformatically detected viral gene of the present invention, referred to here as Viral Genomic Address Messenger 2225 (VGAM2225) viral gene, which modulates expression of respective host target genes thereof, the function and utility of which host target genes is known in the art.

VGAM2225 is a novel bioinformatically detected regulatory, non protein coding, viral micro RNA (miRNA) gene. The method by which VGAM2225 was detected is described hereinabove with reference to FIGS. 1-8.

VGAM2225 gene, herein designated VGAM GENE, is a viral gene contained in the genome of Equine Herpesvirus 2. VGAM2225 host target gene, herein designated VGAM HOST TARGET GENE, is a human gene contained in the human genome.

VGAM2225 gene encodes a VGAM2225 precursor RNA, herein designated VGAM PRECURSOR RNA. Similar to other miRNA genes, and unlike most ordinary genes, VGAM2225 precursor RNA does not encode a protein. A nucleotide sequence identical or highly similar to the nucleotide sequence of VGAM2225 precursor RNA is designated SEQ ID:2211, and is provided hereinbelow with reference to the sequence listing part. Nucleotide sequence SEQ ID:2211 is located at position 9536 relative to the genome of Equine Herpesvirus 2.

VGAM2225 precursor RNA folds onto itself, forming VGAM2225 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2225 folded precursor RNA into VGAM2225 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2225 RNA is designated SEQ ID:4936, and is provided hereinbelow with reference to the sequence listing part.

VGAM2225 host target gene, herein designated VGAM HOST TARGET GENE, encodes a corresponding messenger RNA, VGAM2225 host target RNA, herein designated VGAM HOST TARGET RNA. VGAM2225 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2225 RNA, herein designated VGAM RNA, binds complementarily to one or more host target binding sites located in untranslated regions of VGAM2225 host target RNA, herein designated VGAM HOST TARGET RNA. This complementary binding is due to the fact that the nucleotide sequence of VGAM2225 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2225 RNA, herein designated VGAM RNA, may have a different number of host target binding sites in untranslated regions of a VGAM2225 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2225 RNA, herein designated VGAM RNA, to host target binding sites on VGAM2225 host target RNA, herein designated VGAM HOST TARGET RNA, such as BINDING SITE I, BINDING SITE II and BINDING SITE III, inhibits translation of VGAM2225 host target RNA into VGAM2225 host target protein, herein designated VGAM HOST TARGET PROTEIN. VGAM host target protein is therefore outlined by a broken line.

It is appreciated that VGAM2225 host target gene, herein designated VGAM HOST TARGET GENE, in fact represents a plurality of VGAM2225 host target genes. The mRNA of each one of this plurality of VGAM2225 host target genes comprises one or more host target binding sites, each having a nucleotide sequence which is at least partly complementary to VGAM2225 RNA, herein designated VGAM RNA, and which when bound by VGAM2225 RNA causes inhibition of translation of respective one or more VGAM2225 host target proteins.

It is further appreciated by one skilled in the art that the mode of translational inhibition illustrated by FIG. 1 with specific reference to translational inhibition exerted by VGAM2225 gene, herein designated VGAM GENE, on one or more VGAM2225 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2225 is inhibition of expression of host target genes, as part of a novel viral mechanism of attacking a host. Accordingly, utilities of VGAM2225 include diagnosis, prevention and treatment of viral infection by Equine Herpesvirus 2. Specific functions, and accordingly utilities, of VGAM2225 correlate with, and may be deduced from, the identity of the host target genes which VGAM2225 binds and inhibits, and the function of these host target genes, as elaborated hereinbelow.

Nucleotide sequences of the VGAM2225 precursor RNA, herein designated VGAM PRECURSOR RNA, and of the 'diced' VGAM2225 RNA, herein designated VGAM RNA, and a schematic representation of the secondary folding of VGAM2225 folded precursor RNA, herein designated VGAM FOLDED PRECURSOR RNA, of VGAM2225 are further described hereinbelow with reference to Table 1.

Nucleotide sequences of host target binding sites, such as BINDING SITE-I, BINDING SITE-II and BINDING SITE-III of FIG. 1, found on VGAM2225 host target RNA, and schematic representation of the complementarity of each of these host target binding sites to VGAM2225 RNA, herein designated VGAM RNA, are described hereinbelow with reference to Table 2.

As mentioned hereinabove with reference to FIG. 1, a function of VGAM2225 gene, herein designated VGAM is inhibition of expression of VGAM2225 target genes. It is appreciated that specific functions, and accordingly utilities, of VGAM2225 correlate with, and may be deduced from, the identity of the target genes which VGAM2225 binds and inhibits, and the function of these target genes, as elaborated hereinbelow.

Exostoses (multiple)-like 3 (EXTL3, Accession NM_001440) is a VGAM2225 host target gene. EXTL3 BINDING SITE is HOST TARGET binding site found in the 3' untranslated region of mRNA encoded by EXTL3, corresponding to a HOST TARGET binding site such as BINDING SITE I, BINDING SITE II or BINDING SITE III. Table 2 illustrates the complementarity of the nucleotide sequences of EXTL3 BINDING SITE, designated SEQ ID:7166, to the nucleotide sequence of VGAM2225 RNA, herein designated VGAM RNA, also designated SEQ ID:4936.

A function of VGAM2225 is therefore inhibition of Exostoses (multiple)-like 3 (EXTL3, Accession NM_001440), a gene which a member of the multiple exostoses gene family. Accordingly, utilities of VGAM2225 include diagnosis, prevention and treatment of diseases and clinical conditions associated with EXTL3. The function of EXTL3 and its association with various diseases and clinical conditions, has been established by previous studies, as described hereinabove with reference to VGAM95. LanC Lantibiotic Synthetase Component C-like 1 (bacterial) (LANCL1, Accession NM_006055) is another VGAM2225 host target gene. LANCL1 BINDING SITE is HOST TARGET binding site found in the 3' untranslated region of mRNA encoded by LANCL1, corresponding to a HOST TARGET binding site such as BINDING SITE I, BINDING SITE II or BINDING SITE III. Table 2 illustrates the complementarity of the nucleotide sequences of LANCL1 BINDING SITE, designated SEQ ID:12693, to the nucleotide sequence of VGAM2225 RNA, herein designated VGAM RNA, also designated SEQ ID:4936.

Another function of VGAM2225 is therefore inhibition of LanC Lantibiotic Synthetase Component C-like 1 (bacterial) (LANCL1, Accession NM_006055), a gene which binds the C-terminus of stomatin. Accordingly, utilities of VGAM2225 include diagnosis, prevention and treatment of diseases and clinical conditions associated with LANCL1. The function of LANCL1 and its association with various diseases and clinical conditions, has been established by previous studies, as described hereinabove with reference to VGAM656. Lipoprotein Lipase (LPL, Accession NM_000237) is another VGAM2225 host target gene. LPL BINDING SITE is HOST TARGET binding site found in the 3' untranslated region of mRNA encoded by LPL, corresponding to a HOST TARGET binding site such as BINDING SITE I, BINDING SITE II or BINDING SITE III. Table 2 illustrates the complementarity of the nucleotide sequences of LPL BINDING SITE, designated SEQ ID:5750, to the nucleotide sequence of VGAM2225 RNA, herein designated VGAM RNA, also designated SEQ ID:4936.

Another function of VGAM2225 is therefore inhibition of Lipoprotein Lipase (LPL, Accession NM_000237), a gene which is the hydrolysis of triglycerides of circulating chylomicrons and very low density lipoproteins (vldl). the enzyme functions in the presence of apolipoprotein c-2 on the luminal surface of vascular. Accordingly, utilities of VGAM2225 include diagnosis, prevention and treatment of diseases and clinical conditions associated with LPL. The function of LPL and its association with various diseases and clinical conditions, has been established by previous studies, as described hereinabove with reference to VGAM55. FLJ22746 (Accession NM_024785) is another VGAM2225 host target gene. FLJ22746 BINDING SITE is HOST TARGET binding site found in the 3' untranslated region of mRNA encoded by FLJ22746, corresponding to a HOST TARGET binding site such as BINDING SITE I, BINDING SITE II or BINDING SITE III. Table 2 illustrates the complementarity of the nucleotide sequences of FLJ22746 BINDING SITE, designated SEQ ID:24162, to the nucleotide sequence of VGAM2225 RNA, herein designated VGAM RNA, also designated SEQ ID:4936.

Another function of VGAM2225 is therefore inhibition of FLJ22746 (Accession NM_024785). Accordingly, utilities of VGAM2225 include diagnosis, prevention and treatment of diseases and clinical conditions associated with FLJ22746. LOC128077 (Accession XM_059208) is another VGAM2225 host target gene. LOC128077 BINDING SITE is HOST TARGET binding site found in the 3' untranslated region of mRNA encoded by LOC128077, corresponding to a HOST TARGET binding site such as BINDING SITE I, BINDING SITE II or BINDING SITE III. Table 2 illustrates the complementarity of the nucleotide sequences of LOC128077 BINDING SITE, designated SEQ ID:36917, to the nucleotide sequence of VGAM2225 RNA, herein designated VGAM RNA, also designated SEQ ID:4936.

Another function of VGAM2225 is therefore inhibition of LOC128077 (Accession XM_059208). Accordingly, utilities of VGAM2225 include diagnosis, prevention and treatment of diseases and clinical conditions associated with LOC128077. LOC151201 (Accession XM_098021) is another VGAM2225 host target gene. LOC151201 BINDING SITE is HOST TARGET binding site found in the 5' untranslated region of mRNA encoded by LOC151201, corresponding to a HOST TARGET binding site such as BINDING SITE I, BINDING SITE II or BINDING SITE III. Table 2 illustrates the complementarity of the nucleotide sequences of LOC151201 BINDING SITE, designated SEQ ID:41320, to the nucleotide sequence of VGAM2225 RNA, herein designated VGAM RNA, also designated SEQ ID:4936.

Another function of VGAM2225 is therefore inhibition of LOC151201 (Accession XM_098021). Accordingly, utilities of VGAM2225 include diagnosis, prevention and treatment of diseases and clinical conditions associated with LOC151201. LOC152286 (Accession XM_098188) is another VGAM2225 host target gene. LOC152286 BINDING SITE is HOST TARGET binding site found in the 3' untranslated region of mRNA encoded by LOC152286, corresponding to a HOST TARGET binding site such as BINDING SITE I, BINDING SITE II or BINDING SITE III. Table 2 illustrates the complementarity of the nucleotide sequences of LOC152286 BINDING SITE, designated SEQ ID:41460, to the nucleotide sequence of VGAM2225 RNA, herein designated VGAM RNA, also designated SEQ ID:4936.

Another function of VGAM2225 is therefore inhibition of LOC152286 (Accession XM_098188). Accordingly, utilities of VGAM2225 include diagnosis, prevention and treatment of diseases and clinical conditions associated with LOC152286. LOC221747 (Accession XM_166460) is another VGAM2225 host target gene. LOC221747 BINDING SITE is HOST TARGET binding site found in the 3' untranslated region of mRNA encoded by LOC221747, corresponding to a HOST TARGET binding site such as BINDING SITE I, BINDING SITE II or BINDING SITE III. Table 2 illustrates the complementarity of the nucleotide sequences of LOC221747 BINDING SITE, designated SEQ ID:44364, to the nucleotide sequence of VGAM2225 RNA, herein designated VGAM RNA, also designated SEQ ID:4936.

Another function of VGAM2225 is therefore inhibition of LOC221747 (Accession XM_166460). Accordingly, utilities of VGAM2225 include diagnosis, prevention and treatment of diseases and clinical conditions associated with LOC221747. FIG. 1 further provides a conceptual description of a novel bioinformatically detected viral gene of the present invention, referred to here as Viral Genomic Address Messenger 2226 (VGAM2226) viral gene, which modulates expression of respective host target genes thereof, the function and utility of which host target genes is known in the art.

VGAM2226 is a novel bioinformatically detected regulatory, non protein coding, viral micro RNA (miRNA) gene. The method by which VGAM2226 was detected is described hereinabove with reference to FIGS. 1-8.

VGAM2226 gene, herein designated VGAM GENE, is a viral gene contained in the genome of Equine Herpesvirus 2. VGAM2226 host target gene, herein designated VGAM HOST TARGET GENE, is a human gene contained in the human genome.

VGAM2226 gene encodes a VGAM2226 precursor RNA, herein designated VGAM PRECURSOR RNA. Similar to other miRNA genes, and unlike most ordinary genes, VGAM2226 precursor RNA does not encode a protein. A nucleotide sequence identical or highly similar to the nucleotide sequence of VGAM2226 precursor RNA is designated SEQ ID:2212, and is provided hereinbelow with reference to the sequence listing part. Nucleotide sequence SEQ ID:2212 is located at position 161798 relative to the genome of Equine Herpesvirus 2.

VGAM2226 precursor RNA folds onto itself, forming VGAM2226 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2226 folded precursor RNA into VGAM2226 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2226 RNA is designated SEQ ID:4937, and is provided hereinbelow with reference to the sequence listing part.

VGAM2226 host target gene, herein designated VGAM HOST TARGET GENE, encodes a corresponding messenger RNA, VGAM2226 host target RNA, herein designated VGAM HOST TARGET RNA. VGAM2226 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2226 RNA, herein designated VGAM RNA, binds complementarily to one or more host target binding sites located in untranslated regions of VGAM2226 host target RNA, herein designated VGAM HOST TARGET RNA. This complementary binding is due to the fact that the nucleotide sequence of VGAM2226 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2226 RNA, herein designated VGAM RNA, may have a different number of host target binding sites in untranslated regions of a VGAM2226 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2226 RNA, herein designated VGAM RNA, to host target binding sites on VGAM2226 host target RNA, herein designated VGAM HOST TARGET RNA, such as BINDING SITE I, BINDING SITE II and BINDING SITE III, inhibits translation of VGAM2226 host target RNA into VGAM2226 host target protein, herein designated VGAM HOST TARGET PROTEIN. VGAM host target protein is therefore outlined by a broken line.

It is appreciated that VGAM2226 host target gene, herein designated VGAM HOST TARGET GENE, in fact represents a plurality of VGAM2226 host target genes. The mRNA of each one of this plurality of VGAM2226 host target genes comprises one or more host target binding sites, each having a nucleotide sequence which is at least partly complementary to VGAM2226 RNA, herein designated VGAM RNA, and which when bound by VGAM2226 RNA causes inhibition of translation of respective one or more VGAM2226 host target proteins.

It is further appreciated by one skilled in the art that the mode of translational inhibition illustrated by FIG. 1 with specific reference to translational inhibition exerted by VGAM2226 gene, herein designated VGAM GENE, on one or more VGAM2226 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2226 is inhibition of expression of host target genes, as part of a novel viral mechanism of attacking a host. Accordingly, utilities of VGAM2226 include diagnosis, prevention and treatment of viral infection by Equine Herpesvirus 2. Specific functions, and accordingly utilities, of VGAM2226 correlate with, and may be deduced from, the identity of the host target genes which VGAM2226 binds and inhibits, and the function of these host target genes, as elaborated hereinbelow.

Nucleotide sequences of the VGAM2226 precursor RNA, herein designated VGAM PRECURSOR RNA, and of the 'diced' VGAM2226 RNA, herein designated VGAM RNA, and a schematic representation of the secondary folding of VGAM2226 folded precursor RNA, herein designated VGAM FOLDED PRECURSOR RNA, of VGAM2226 are further described hereinbelow with reference to Table 1.

Nucleotide sequences of host target binding sites, such as BINDING SITE-I, BINDING SITE-II and BINDING SITE-III of FIG. 1, found on VGAM2226 host target RNA, and schematic representation of the complementarity of each of these host target binding sites to VGAM2226 RNA, herein designated VGAM RNA, are described hereinbelow with reference to Table 2.

As mentioned hereinabove with reference to FIG. 1, a function of VGAM2226 gene, herein designated VGAM is inhibition of expression of VGAM2226 target genes. It is appreciated that specific functions, and accordingly utilities, of VGAM2226 correlate with, and may be deduced from, the identity of the target genes which VGAM2226 binds and inhibits, and the function of these target genes, as elaborated hereinbelow.

B-cell CLL/lymphoma 6 (zinc finger protein 51) (BCL6, Accession NM_001706) is a VGAM2226 host target gene. BCL6 BINDING SITE1 and BCL6 BINDING SITE2 are HOST TARGET binding sites found in untranslated regions of mRNA encoded by BCL6, corresponding to HOST TARGET binding sites such as BINDING SITE I, BINDING SITE II or BINDING SITE III. Table 2 illustrates the complementarity of the nucleotide sequences of BCL6 BINDING SITE1 and BCL6 BINDING SITE2, designated SEQ ID:7428 and SEQ ID:29055 respectively, to the nucleotide sequence of VGAM2226 RNA, herein designated VGAM RNA, also designated SEQ ID:4937.

A function of VGAM2226 is therefore inhibition of B-cell CLL/lymphoma 6 (zinc finger protein 51) (BCL6, Accession NM_001706), a gene which is involved in the generation and maintenance of both T and B cells during immune responses. Accordingly, utilities of VGAM2226 include diagnosis, prevention and treatment of diseases and clinical conditions associated with BCL6. The function of BCL6 and its association with various diseases and clinical conditions, has been established by previous studies, as described hereinabove with reference to VGAM481. Diacylglycerol Kinase, Gamma 90 kDa (DGKG, Accession NM_001346) is another VGAM2226 host target gene. DGKG BINDING SITE is HOST TARGET binding site found in the 5' untranslated region of mRNA encoded by DGKG, corresponding to a HOST TARGET binding site such as BINDING SITE I, BINDING SITE II or BINDING SITE III. Table 2 illustrates the complementarity of the nucleotide sequences of DGKG BINDING SITE, designated SEQ ID:7024, to the nucleotide sequence of VGAM2226 RNA, herein designated VGAM RNA, also designated SEQ ID:4937.

Another function of VGAM2226 is therefore inhibition of Diacylglycerol Kinase, Gamma 90 kDa (DGKG, Accession NM_001346), a gene which may convert diacylglycerol to phosphatidic acid. Accordingly, utilities of VGAM2226 include diagnosis, prevention and treatment of diseases and clinical conditions associated with DGKG. The function of DGKG and its association with various diseases and clinical conditions, has been established by previous studies, as described hereinabove with reference to VGAM451. Heterogeneous Nuclear Ribonucleoprotein D (AU-rich element RNA binding protein 1, 37 kDa) (HNRPD, Accession NM_002138) is another VGAM2226 host target gene. HNRPD BINDING SITE1 and HNRPD BINDING SITE2 are HOST TARGET binding sites found in untranslated regions of mRNA encoded by HNRPD, corresponding to HOST TARGET binding sites such as BINDING SITE I, BINDING SITE II or BINDING SITE III. Table 2 illustrates the complementarity of the nucleotide sequences of HNRPD BINDING SITE1 and HNRPD BINDING SITE2, designated SEQ ID:7913 and SEQ ID:25363 respectively, to the nucleotide sequence of VGAM2226 RNA, herein designated VGAM RNA, also designated SEQ ID:4937.

Another function of VGAM2226 is therefore inhibition of Heterogeneous Nuclear Ribonucleoprotein D (AU-rich element RNA binding protein 1, 37 kDa) (HNRPD, Accession NM_002138). Accordingly, utilities of VGAM2226 include diagnosis, prevention and treatment of diseases and clinical conditions associated with HNRPD. Platelet Derived Growth Factor C (PDGFC, Accession NM_016205) is another VGAM2226 host target gene. PDGFC BINDING SITE is HOST TARGET binding site found in the 3' untranslated region of mRNA encoded by PDGFC, corresponding to a HOST TARGET binding site such as BINDING SITE I, BINDING SITE II or BINDING SITE III. Table 2 illustrates the complementarity of the nucleotide sequences of PDGFC BINDING SITE, designated SEQ ID:18300, to the nucleotide sequence of VGAM2226 RNA, herein designated VGAM RNA, also designated SEQ ID:4937.

Another function of VGAM2226 is therefore inhibition of Platelet Derived Growth Factor C (PDGFC, Accession NM_016205). Accordingly, utilities of VGAM2226 include diagnosis, prevention and treatment of diseases and clinical conditions associated with PDGFC. SENP7 (Accession NM_020654) is another VGAM2226 host target gene. SENP7 BINDING SITE is HOST TARGET binding site found in the 3' untranslated region of mRNA encoded by SENP7, corresponding to a HOST TARGET binding site such as BINDING SITE I, BINDING SITE II or BINDING SITE III. Table 2 illustrates the complementarity of the nucleotide sequences of SENP7 BINDING SITE, designated SEQ ID:21821, to the nucleotide sequence of VGAM2226 RNA, herein designated VGAM RNA, also designated SEQ ID:4937.

Another function of VGAM2226 is therefore inhibition of SENP7 (Accession NM_020654). Accordingly, utilities of VGAM2226 include diagnosis, prevention and treatment of diseases and clinical conditions associated with SENP7. SNRK (Accession NM_017719) is another VGAM2226 host target gene. SNRK BINDING SITE is HOST TARGET binding site found in the 3' untranslated region of mRNA encoded by SNRK, corresponding to a HOST TARGET binding site such as BINDING SITE I, BINDING SITE II or BINDING SITE III. Table 2 illustrates the complementarity of the nucleotide sequences of SNRK BINDING SITE, designated SEQ ID:19305, to the nucleotide sequence of VGAM2226 RNA, herein designated VGAM RNA, also designated SEQ ID:4937.

Another function of VGAM2226 is therefore inhibition of SNRK (Accession NM_017719). Accordingly, utilities of VGAM2226 include diagnosis, prevention and treatment of diseases and clinical conditions associated with SNRK. T-box 19 (TBX19, Accession NM_005149) is another VGAM2226 host target gene. TBX19 BINDING SITE is HOST TARGET binding site found in the 3' untranslated region of mRNA encoded by TBX19, corresponding to a HOST TARGET binding site such as BINDING SITE I, BINDING SITE II or BINDING SITE III. Table 2 illustrates the complementarity of the nucleotide sequences of TBX19 BINDING SITE, designated SEQ ID:11622, to the nucleotide sequence of VGAM2226 RNA, herein designated VGAM RNA, also designated SEQ ID:4937.

Another function of VGAM2226 is therefore inhibition of T-box 19 (TBX19, Accession NM_005149). Accordingly, utilities of VGAM2226 include diagnosis, prevention and treatment of diseases and clinical conditions associated with TBX19. LOC154282 (Accession XM_098505) is another VGAM2226 host target gene. LOC154282 BINDING SITE is HOST TARGET binding site found in the 3' untranslated region of mRNA encoded by LOC154282, corresponding to a HOST TARGET binding site such as BINDING SITE I, BINDING SITE II or BINDING SITE III. Table 2 illustrates the complementarity of the nucleotide sequences of LOC154282 BINDING SITE, designated SEQ ID:41695, to the nucleotide sequence of VGAM2226 RNA, herein designated VGAM RNA, also designated SEQ ID:4937.

Another function of VGAM2226 is therefore inhibition of LOC154282 (Accession XM_098505). Accordingly, utilities of VGAM2226 include diagnosis, prevention and treatment of diseases and clinical conditions associated with LOC154282. LOC92539 (Accession XM_045632) is another VGAM2226 host target gene. LOC92539 BINDING SITE is HOST TARGET binding site found in the 3' untranslated region of mRNA encoded by LOC92539, corresponding to a HOST TARGET binding site such as BINDING SITE I, BINDING SITE II or BINDING SITE III. Table 2 illustrates the complementarity of the nucleotide sequences of LOC92539 BINDING SITE, designated SEQ ID:34495, to the nucleotide sequence of VGAM2226 RNA, herein designated VGAM RNA, also designated SEQ ID:4937.

Another function of VGAM2226 is therefore inhibition of LOC92539 (Accession XM_045632). Accordingly, utilities of VGAM2226 include diagnosis, prevention and treatment of diseases and clinical conditions associated with LOC92539. FIG. 1 further provides a conceptual description of a novel bioinformatically detected viral gene of the present invention, referred to here as Viral Genomic Address Messenger 2227 (VGAM2227) viral gene, which modulates expression of respective host target genes thereof, the function and utility of which host target genes is known in the art.

VGAM2227 is a novel bioinformatically detected regulatory, non protein coding, viral micro RNA (miRNA) gene. The method by which VGAM2227 was detected is described hereinabove with reference to FIGS. 1-8.

VGAM2227 gene, herein designated VGAM GENE, is a viral gene contained in the genome of Equine Herpesvirus 2. VGAM2227 host target gene, herein designated VGAM HOST TARGET GENE, is a human gene contained in the human genome.

VGAM2227 gene encodes a VGAM2227 precursor RNA, herein designated VGAM PRECURSOR RNA. Similar to other miRNA genes, and unlike most ordinary genes, VGAM2227 precursor RNA does not encode a protein. A nucleotide sequence identical or highly similar to the nucleotide sequence of VGAM2227 precursor RNA is designated SEQ ID:2213, and is provided hereinbelow with reference to the sequence listing part. Nucleotide sequence SEQ ID:2213 is located at position 161250 relative to the genome of Equine Herpesvirus 2.

VGAM2227 precursor RNA folds onto itself, forming VGAM2227 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2227 folded precursor RNA into VGAM2227 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2227 RNA is designated SEQ ID:4938, and is provided hereinbelow with reference to the sequence listing part.

VGAM2227 host target gene, herein designated VGAM HOST TARGET GENE, encodes a corresponding messenger RNA, VGAM2227 host target RNA, herein designated VGAM HOST TARGET RNA. VGAM2227 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2227 RNA, herein designated VGAM RNA, binds complementarily to one or more host target binding sites located in untranslated regions of VGAM2227 host target RNA, herein designated VGAM HOST TARGET RNA. This complementary binding is due to the fact that the nucleotide sequence of VGAM2227 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2227 RNA, herein designated VGAM RNA, may have a different number of host target binding sites in untranslated regions of a VGAM2227 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2227 RNA, herein designated VGAM RNA, to host target binding sites on VGAM2227 host target RNA, herein designated VGAM HOST TARGET RNA, such as BINDING SITE I, BINDING SITE II and BINDING SITE III, inhibits translation of VGAM2227 host target RNA into VGAM2227 host target protein, herein designated VGAM HOST TARGET PROTEIN. VGAM host target protein is therefore outlined by a broken line.

It is appreciated that VGAM2227 host target gene, herein designated VGAM HOST TARGET GENE, in fact represents a plurality of VGAM2227 host target genes. The mRNA of each one of this plurality of VGAM2227 host target genes comprises one or more host target binding sites, each having a nucleotide sequence which is at least partly complementary to VGAM2227 RNA, herein designated VGAM RNA, and which when bound by VGAM2227 RNA causes inhibition of translation of respective one or more VGAM2227 host target proteins.

It is further appreciated by one skilled in the art that the mode of translational inhibition illustrated by FIG. 1 with specific reference to translational inhibition exerted by VGAM2227 gene, herein designated VGAM GENE, on one or more VGAM2227 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2227 is inhibition of expression of host target genes, as part of a novel viral mechanism of attacking a host. Accordingly, utilities of VGAM2227 include diagnosis, prevention and treatment of viral infection by Equine Herpesvirus 2. Specific functions, and accordingly utilities, of VGAM2227 correlate with, and may be deduced from, the identity of the host target genes which VGAM2227 binds and inhibits, and the function of these host target genes, as elaborated hereinbelow.

Nucleotide sequences of the VGAM2227 precursor RNA, herein designated VGAM PRECURSOR RNA, and of the 'diced' VGAM2227 RNA, herein designated VGAM RNA, and a schematic representation of the secondary folding of VGAM2227 folded precursor RNA, herein designated VGAM FOLDED PRECURSOR RNA, of VGAM2227 are further described hereinbelow with reference to Table 1.

Nucleotide sequences of host target binding sites, such as BINDING SITE-I, BINDING SITE-II and BINDING SITE-III of FIG. 1, found on VGAM2227 host target RNA, and schematic representation of the complementarity of each of these host target binding sites to VGAM2227 RNA, herein designated VGAM RNA, are described hereinbelow with reference to Table 2.

As mentioned hereinabove with reference to FIG. 1, a function of VGAM2227 gene, herein designated VGAM is inhibition of expression of VGAM2227 target genes. It is appreciated that specific functions, and accordingly utilities, of VGAM2227 correlate with, and may be deduced from, the identity of the target genes which VGAM2227 binds and inhibits, and the function of these target genes, as elaborated hereinbelow.

A Kinase (PRKA) Anchor Protein 13 (AKAP13, Accession XM_116974) is a VGAM2227 host target gene. AKAP13 BINDING SITE is HOST TARGET binding site found in the 3' untranslated region of mRNA encoded by AKAP13, corresponding to a HOST TARGET binding site such as BINDING SITE I, BINDING SITE II or BINDING SITE III. Table 2 illustrates the complementarity of the nucleotide sequences of AKAP13 BINDING SITE, designated SEQ ID:43183, to the nucleotide sequence of VGAM2227 RNA, herein designated VGAM RNA, also designated SEQ ID:4938.

A function of VGAM2227 is therefore inhibition of A Kinase (PRKA) Anchor Protein 13 (AKAP13, Accession XM_116974), a gene which regulates subcellular localization of type II cAMP-dependent PKA. Accordingly, utilities of VGAM2227 include diagnosis, prevention and treatment of diseases and clinical conditions associated with AKAP13. The function of AKAP13 and its association with various diseases and clinical conditions, has been established by previous studies, as described hereinabove with reference to VGAM17. Aldehyde Dehydrogenase 8 Family, Member A1 (ALDH8A1, Accession NM_022568) is another VGAM2227 host target gene. ALDH8A1 BINDING SITE is HOST TARGET binding site found in the 3' untranslated region of mRNA encoded by ALDH8A1, corresponding to a HOST TARGET binding site such as BINDING SITE I, BINDING SITE II or BINDING SITE III. Table 2 illustrates the complementarity of the nucleotide sequences of ALDH8A1 BINDING SITE, designated SEQ ID:22890, to the nucleotide sequence of VGAM2227 RNA, herein designated VGAM RNA, also designated SEQ ID:4938.

Another function of VGAM2227 is therefore inhibition of Aldehyde Dehydrogenase 8 Family, Member A1 (ALDH8A1, Accession NM_022568). Accordingly, utilities of VGAM2227 include diagnosis, prevention and treatment of diseases and clinical conditions associated with ALDH8A1. ATPase, Na+/K+ Transporting, Beta 2 Polypeptide (ATP1B2, Accession NM_001678) is another VGAM2227 host target gene. ATP1B2 BINDING SITE is HOST TARGET binding site found in the 3' untranslated region of mRNA encoded by ATP1B2, corresponding to a HOST TARGET binding site such as BINDING SITE I, BINDING SITE II or BINDING SITE III. Table 2 illustrates the complementarity of the nucleotide sequences of ATP1B2 BINDING SITE, designated SEQ ID:7396, to the nucleotide sequence of VGAM2227 RNA, herein designated VGAM RNA, also designated SEQ ID:4938.

Another function of VGAM2227 is therefore inhibition of ATPase, Na+/K+ Transporting, Beta 2 Polypeptide (ATP1B2, Accession NM_001678), a gene which catalyzes the hydrolysis of ATP coupled with the exchange of Na +/K+ ions across the plasma membrane. Accordingly, utilities of VGAM2227 include diagnosis, prevention and treatment of diseases and clinical conditions associated with ATP1B2. The function of ATP1B2 and its association with various diseases and clinical conditions, has been established by previous studies, as described hereinabove with reference to VGAM152. Cytoplasmic Linker Associated Protein 1 (CLASP1, Accession XM_037105) is another VGAM2227 host target gene. CLASP1 BINDING SITE is HOST TARGET binding site found in the 3' untranslated region of mRNA encoded by CLASP1, corresponding to a HOST TARGET binding site such as BINDING SITE I, BINDING SITE II or BINDING SITE III. Table 2 illustrates the complementarity of the nucleotide sequences of CLASP1 BINDING SITE, designated SEQ ID:32543, to the nucleotide sequence of VGAM2227 RNA, herein designated VGAM RNA, also designated SEQ ID:4938.

Another function of VGAM2227 is therefore inhibition of Cytoplasmic Linker Associated Protein 1 (CLASP1, Accession XM_037105), a gene which plays a role in the local regulation of microtubule dynamics. Accordingly, utilities of VGAM2227 include diagnosis, prevention and treatment of diseases and clinical conditions associated with CLASP1. The function of CLASP1 and its association with various diseases and clinical conditions, has been established by previous studies, as described hereinabove with reference to VGAM298. Potassium Voltage-gated Channel, Shaker-related Subfamily, Member 3 (KCNA3, Accession NM_002232) is another VGAM2227 host target gene. KCNA3 BINDING SITE is HOST TARGET binding site found in the 3' untranslated region of mRNA encoded by KCNA3, corresponding to a HOST TARGET binding site such as BINDING SITE I, BINDING SITE II or BINDING SITE III. Table 2 illustrates the complementarity of the nucleotide sequences of KCNA3 BINDING SITE, designated SEQ ID:8014, to the nucleotide sequence of VGAM2227 RNA, herein designated VGAM RNA, also designated SEQ ID:4938.

Another function of VGAM2227 is therefore inhibition of Potassium Voltage-gated Channel, Shaker-related Subfamily, Member 3 (KCNA3, Accession NM_002232). Accordingly, utilities of VGAM2227 include diagnosis, prevention and treatment of diseases and clinical conditions associated with KCNA3. Leptin (obesity homolog, mouse) (LEP, Accession NM_000230) is another VGAM2227 host target gene. LEP BINDING SITE is HOST TARGET binding site found in the 3' untranslated region of mRNA encoded by LEP, corresponding to a HOST TARGET binding site such as BINDING SITE I, BINDING SITE II or BINDING SITE III. Table 2 illustrates the complementarity of the nucleotide sequences of LEP BINDING SITE, designated SEQ ID:5737, to the nucleotide sequence of VGAM2227 RNA, herein designated VGAM RNA, also designated SEQ ID:4938.

Another function of VGAM2227 is therefore inhibition of Leptin (obesity homolog, mouse) (LEP, Accession NM_000230). Accordingly, utilities of VGAM2227 include diagnosis, prevention and treatment of diseases and clinical conditions associated with LEP. Mastermind-like 1 (Drosophila) (MAML1, Accession NM_014757) is another VGAM2227 host target gene. MAML1 BINDING SITE is HOST TARGET binding site found in the 3' untranslated region of mRNA encoded by MAML1, corresponding to a HOST TARGET binding site such as BINDING SITE I, BINDING SITE II or BINDING SITE III. Table 2 illustrates the complementarity of the nucleotide sequences of MAML1 BINDING SITE, designated SEQ ID:16501, to the nucleotide sequence of VGAM2227 RNA, herein designated VGAM RNA, also designated SEQ ID:4938.

Another function of VGAM2227 is therefore inhibition of Mastermind-like 1 (Drosophila) (MAML1, Accession NM_014757), a gene which MAML1 functions as a transcriptional coactivator for Notch signaling. Accordingly, utilities of VGAM2227 include diagnosis, prevention and treatment of diseases and clinical conditions associated with MAML1. The function of MAML1 and its association with various diseases and clinical conditions, has been established by previous studies, as described hereinabove with reference to VGAM556. Neuroepithelial Cell Transforming Gene 1 (NET1, Accession NM_005863) is another VGAM2227 host target gene. NET1 BINDING SITE is HOST TARGET binding site found in the 3' untranslated region of mRNA encoded by NET1, corresponding to a HOST TARGET binding site such as BINDING SITE I, BINDING SITE II or BINDING SITE III. Table 2 illustrates the complementarity of the nucleotide sequences of NET1 BINDING SITE, designated SEQ ID:12475, to the nucleotide sequence of VGAM2227 RNA, herein designated VGAM RNA, also designated SEQ ID:4938.

Another function of VGAM2227 is therefore inhibition of Neuroepithelial Cell Transforming Gene 1 (NET1, Accession NM_005863), a gene which is induced morphologic alterations and conferred a malignant phenotype in vitro and in nude mice. Accordingly, utilities of VGAM2227 include diagnosis, prevention and treatment of diseases and clinical conditions associated with NET1. The function of NET1 and its association with various diseases and clinical conditions, has been established by previous studies, as described hereinabove with reference to VGAM1333. Polymerase (DNA directed), Theta (POLQ, Accession NM_006596) is another VGAM2227 host target gene. POLQ BINDING SITE is HOST TARGET binding site found in the 3' untranslated region of mRNA encoded by POLQ, corresponding to a HOST TARGET binding site such as BINDING SITE I, BINDING SITE II or BINDING SITE III. Table 2 illustrates the complementarity of the nucleotide sequences of POLQ BINDING SITE, designated SEQ ID:13366, to the nucleotide sequence of VGAM2227 RNA, herein designated VGAM RNA, also designated SEQ ID:4938.

Another function of VGAM2227 is therefore inhibition of Polymerase (DNA directed), Theta (POLQ, Accession NM_006596), a gene which enhances untargeted mutagenesis. Accordingly, utilities of VGAM2227 include diagnosis, prevention and treatment of diseases and clinical conditions associated with POLQ. The function of POLQ and its association with various diseases and clinical conditions, has been established by previous studies, as described hereinabove with reference to VGAM922. RAD50 Homolog (S. cerevisiae) (RAD50, Accession NM_133482) is another VGAM2227 host target gene. RAD50 BINDING SITE is HOST TARGET binding site found in the 5' untranslated region of mRNA encoded by RAD50, corresponding to a HOST TARGET binding site such as BINDING SITE I, BINDING SITE II or BINDING SITE III. Table 2 illustrates the complementarity of the nucleotide sequences of RAD50 BINDING SITE, designated SEQ ID:28553, to the nucleotide sequence of VGAM2227 RNA, herein designated VGAM RNA, also designated SEQ ID:4938.

Another function of VGAM2227 is therefore inhibition of RAD50 Homolog (S. cerevisiae) (RAD50, Accession NM_133482), a gene which is involved in dna double-strand break repair (dsbr). Accordingly, utilities of VGAM2227 include diagnosis, prevention and treatment of diseases and clinical conditions associated with RAD50. The function of RAD50 and its association with various diseases and clinical conditions, has been established by previous studies, as described hereinabove with reference to VGAM132. AD022 (Accession XM_165725) is another VGAM2227 host target gene. AD022 BINDING SITE is HOST TARGET binding site found in the 3' untranslated region of mRNA encoded by AD022, corresponding to a HOST TARGET binding site such as BINDING SITE I, BINDING SITE II or BINDING SITE III. Table 2 illustrates the complementarity of the nucleotide sequences of AD022 BINDING SITE, designated SEQ ID:43738, to the nucleotide sequence of VGAM2227 RNA, herein designated VGAM RNA, also designated SEQ ID:4938.

Another function of VGAM2227 is therefore inhibition of AD022 (Accession XM_165725). Accordingly, utilities of VGAM2227 include diagnosis, prevention and treatment of diseases and clinical conditions associated with AD022. Butyrophilin, Subfamily 2, Member A2 (BTN2A2, Accession NM_006995) is another VGAM2227 host target gene. BTN2A2 BINDING SITE is HOST TARGET binding site found in the 3' untranslated region of mRNA encoded by BTN2A2, corresponding to a HOST TARGET binding site such as BINDING SITE I, BINDING SITE II or BINDING SITE III. Table 2 illustrates the complementarity of the nucleotide sequences of BTN2A2 BINDING SITE, designated SEQ ID:13862, to the nucleotide sequence of VGAM2227 RNA, herein designated VGAM RNA, also designated SEQ ID:4938.

Another function of VGAM2227 is therefore inhibition of Butyrophilin, Subfamily 2, Member A2 (BTN2A2, Accession NM_006995). Accordingly, utilities of VGAM2227 include diagnosis, prevention and treatment of diseases and clinical conditions associated with BTN2A2. Chromosome 21 Open Reading Frame 42 (C21orf42, Accession NM_058184) is another VGAM2227 host target gene. C21orf42 BINDING SITE is HOST TARGET binding site found in the 5' untranslated region of mRNA encoded by C21orf42, corresponding to a HOST TARGET binding site such as BINDING SITE I, BINDING SITE II or BINDING SITE III. Table 2 illustrates the complementarity of the nucleotide sequences of C21orf42 BINDING SITE, designated SEQ ID:27750, to the nucleotide sequence of VGAM2227 RNA, herein designated VGAM RNA, also designated SEQ ID:4938.

Another function of VGAM2227 is therefore inhibition of Chromosome 21 Open Reading Frame 42 (C21orf42, Accession NM_058184). Accordingly, utilities of VGAM2227 include diagnosis, prevention and treatment of diseases and clinical conditions associated with C21orf42. DKFZp547D155 (Accession XM_046977) is another VGAM2227 host target gene. DKFZp547D155 BINDING SITE is HOST TARGET binding site found in the 3' untranslated region of mRNA encoded by DKFZp547D155, corresponding to a HOST TARGET binding site such as BINDING SITE I, BINDING SITE II or BINDING SITE III. Table 2 illustrates the complementarity of the nucleotide sequences of DKFZp547D155 BINDING SITE, designated SEQ ID:34871, to the nucleotide sequence of VGAM2227 RNA, herein designated VGAM RNA, also designated SEQ ID:4938.

Another function of VGAM2227 is therefore inhibition of DKFZp547D155 (Accession XM_046977). Accordingly, utilities of VGAM2227 include diagnosis, prevention and treatment of diseases and clinical conditions associated with DKFZp547D155. F-box Protein 30 (FBXO30, Accession NM_032145) is another VGAM2227 host target gene. FBXO30 BINDING SITE is HOST TARGET binding site found in the 3' untranslated region of mRNA encoded by FBXO30, corresponding to a HOST TARGET binding site such as BINDING SITE I, BINDING SITE II or BINDING SITE III. Table 2 illustrates the complementarity of the nucleotide sequences of FBXO30 BINDING SITE, designated SEQ ID:25838, to the nucleotide sequence of VGAM2227 RNA, herein designated VGAM RNA, also designated SEQ ID:4938.

Another function of VGAM2227 is therefore inhibition of F-box Protein 30 (FBXO30, Accession NM_032145). Accordingly, utilities of VGAM2227 include diagnosis, prevention and treatment of diseases and clinical conditions associated with FBXO30. FLJ31978 (Accession NM_144669) is another VGAM2227 host target gene. FLJ31978 BINDING SITE is HOST TARGET binding site found in the 3' untranslated region of mRNA encoded by FLJ31978, corresponding to a HOST TARGET binding site such as BINDING SITE I, BINDING SITE II or BINDING SITE III. Table 2 illustrates the complementarity of the nucleotide sequences of FLJ31978 BINDING SITE, designated SEQ ID:29491, to the nucleotide sequence of VGAM2227 RNA, herein designated VGAM RNA, also designated SEQ ID:4938.

Another function of VGAM2227 is therefore inhibition of FLJ31978 (Accession NM_144669). Accordingly, utilities of VGAM2227 include diagnosis, prevention and treatment of diseases and clinical conditions associated with FLJ31978. HSU24186 (Accession NM_013347) is another VGAM2227 host target gene. HSU24186 BINDING SITE is HOST TARGET binding site found in the 5' untranslated region of mRNA encoded by HSU24186, corresponding to a HOST TARGET binding site such as BINDING SITE I, BINDING SITE II or BINDING SITE III. Table 2 illustrates the complementarity of the nucleotide sequences of HSU24186 BINDING SITE, designated SEQ ID:14991, to the nucleotide sequence of VGAM2227 RNA, herein designated VGAM RNA, also designated SEQ ID:4938.

Another function of VGAM2227 is therefore inhibition of HSU24186 (Accession NM_013347). Accordingly, utilities of VGAM2227 include diagnosis, prevention and treatment of diseases and clinical conditions associated with HSU24186. KIAA0939 (Accession XM_030524) is another VGAM2227 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31070, to the nucleotide sequence of VGAM2227 RNA, herein designated VGAM RNA, also designated SEQ ID:4938.

Another function of VGAM2227 is therefore inhibition of KIAA0939 (Accession XM_030524). Accordingly, utilities of VGAM2227 include diagnosis, prevention and treatment of diseases and clinical conditions associated with KIAA0939. KIAA1145 (Accession XM_037790) is another VGAM2227 host target gene. KIAA1145 BINDING SITE is HOST TARGET binding site found in the 5' untranslated region of mRNA encoded by KIAA1145, corresponding to a HOST TARGET binding site such as BINDING SITE I, BINDING SITE II or BINDING SITE III. Table 2 illustrates the complementarity of the nucleotide sequences of KIAA1145 BINDING SITE, designated SEQ ID:32681, to the nucleotide sequence of VGAM2227 RNA, herein designated VGAM RNA, also designated SEQ ID:4938.

Another function of VGAM2227 is therefore inhibition of KIAA1145 (Accession XM_037790). Accordingly, utilities of VGAM2227 include diagnosis, prevention and treatment of diseases and clinical conditions associated with KIAA1145. KIAA1432 (Accession XM_039698) is another VGAM2227 host target gene. KIAA1432 BINDING SITE is HOST TARGET binding site found in the 5' untranslated region of mRNA encoded by KIAA1432, corresponding to a HOST TARGET binding site such as BINDING SITE I, BINDING SITE II or BINDING SITE III. Table 2 illustrates the complementarity of the nucleotide sequences of KIAA1432 BINDING SITE, designated SEQ ID:33158, to the nucleotide sequence of VGAM2227 RNA, herein designated VGAM RNA, also designated SEQ ID:4938.

Another function of VGAM2227 is therefore inhibition of KIAA1432 (Accession XM_039698). Accordingly, utilities of VGAM2227 include diagnosis, prevention and treatment of diseases and clinical conditions associated with KIAA1432. KIAA1950 (Accession XM_166532) is another VGAM2227 host target gene. KIAA1950 BINDING SITE is HOST TARGET binding site found in the 3' untranslated region of mRNA encoded by KIAA1950, corresponding to a HOST TARGET binding site such as BINDING SITE I, BINDING SITE II or BINDING SITE III. Table 2 illustrates the complementarity of the nucleotide sequences of KIAA1950 BINDING SITE, designated SEQ ID:44493, to the nucleotide sequence of VGAM2227 RNA, herein designated VGAM RNA, also designated SEQ ID:4938.

Another function of VGAM2227 is therefore inhibition of KIAA1950 (Accession XM_166532). Accordingly, utilities of VGAM2227 include diagnosis, prevention and treatment of diseases and clinical conditions associated with KIAA1950. MFN2 (Accession NM_014874) is another VGAM2227 host target gene. MFN2 BINDING SITE is HOST TARGET binding site found in the 3' untranslated region of mRNA encoded by MFN2, corresponding to a HOST TARGET binding site such as BINDING SITE I, BINDING SITE II or BINDING SITE III. Table 2 illustrates the complementarity of the nucleotide sequences of MFN2 BINDING SITE, designated SEQ ID:17013, to the nucleotide sequence of VGAM2227 RNA, herein designated VGAM RNA, also designated SEQ ID:4938.

Another function of VGAM2227 is therefore inhibition of MFN2 (Accession NM_014874). Accordingly, utilities of VGAM2227 include diagnosis, prevention and treatment of diseases and clinical conditions associated with MFN2. MGC21738 (Accession NM_145044) is another VGAM2227 host target gene. MGC21738 BINDING SITE is HOST TARGET binding site found in the 3' untranslated region of mRNA encoded by MGC21738, corresponding to a HOST TARGET binding site such as BINDING SITE I, BINDING SITE II or BINDING SITE III. Table 2 illustrates the complementarity of the nucleotide sequences of MGC21738 BINDING SITE, designated SEQ ID:29678, to the nucleotide sequence of VGAM2227 RNA, herein designated VGAM RNA, also designated SEQ ID:4938.

Another function of VGAM2227 is therefore inhibition of MGC21738 (Accession NM_145044). Accordingly, utilities of VGAM2227 include diagnosis, prevention and treatment of diseases and clinical conditions associated with MGC21738. Signal Transducer and Activator of Transcription 5A (STAT5A, Accession NM_003152) is another VGAM2227 host target gene. STAT5A BINDING SITE is HOST TARGET binding site found in the 3" untranslated region of mRNA encoded by STAT5A, corresponding to a HOST TARGET binding site such as BINDING SITE I, BINDING SITE II or BINDING SITE III. Table 2 illustrates the complementarity of the nucleotide sequences of STAT5A BINDING SITE, designated SEQ ID:9130, to the nucleotide sequence of VGAM2227 RNA, herein designated VGAM RNA, also designated SEQ ID:4938.

Another function of VGAM2227 is therefore inhibition of Signal Transducer and Activator of Transcription 5A (STAT5A, Accession NM_003152). Accordingly, utilities of VGAM2227 include diagnosis, prevention and treatment of diseases and clinical conditions associated with STAT5A. LOC143872 (Accession XM_084665) is another VGAM2227 host target gene. LOC143872 BINDING SITE is HOST TARGET binding site found in the 3' untranslated region of mRNA encoded by LOC143872, corresponding to a HOST TARGET binding site such as BINDING SITE I, BINDING SITE II or BINDING SITE III. Table 2 illustrates the complementarity of the nucleotide sequences of LOC143872 BINDING SITE, designated SEQ ID:37655, to the nucleotide sequence of VGAM2227 RNA, herein designated VGAM RNA, also designated SEQ ID:4938.

Another function of VGAM2227 is therefore inhibition of LOC143872 (Accession XM_084665). Accordingly, utilities of VGAM2227 include diagnosis, prevention and treatment of diseases and clinical conditions associated with LOC143872. LOC144321 (Accession XM_096578) is another VGAM2227 host target gene. LOC144321 BINDING SITE is HOST TARGET binding site found in the 3' untranslated region of mRNA encoded by LOC144321, corresponding to a HOST TARGET binding site such as BINDING SITE I, BINDING SITE II or BINDING SITE III. Table 2 illustrates the complementarity of the nucleotide sequences of LOC144321 BINDING SITE, designated SEQ ID:40410, to the nucleotide sequence of VGAM2227 RNA, herein designated VGAM RNA, also designated SEQ ID:4938.

Another function of VGAM2227 is therefore inhibition of LOC144321 (Accession XM_096578). Accordingly, utilities of VGAM2227 include diagnosis, prevention and treatment of diseases and clinical conditions associated with LOC144321. LOC145482 (Accession XM_085154) is another VGAM2227 host target gene. LOC145482 BINDING SITE is HOST TARGET binding site found in the 3' untranslated region of mRNA encoded by LOC145482, corresponding to a HOST TARGET binding site such as BINDING SITE I, BINDING SITE II or BINDING SITE III. Table 2 illustrates the complementarity of the nucleotide sequences of LOC145482 BINDING SITE, designated SEQ ID:37878, to the nucleotide sequence of VGAM2227 RNA, herein designated VGAM RNA, also designated SEQ ID:4938.

Another function of VGAM2227 is therefore inhibition of LOC145482 (Accession XM_085154). Accordingly, utilities of VGAM2227 include diagnosis, prevention and treatment of diseases and clinical conditions associated with LOC145482. LOC146782 (Accession XM_083963) is another VGAM2227 host target gene. LOC146782 BINDING SITE is HOST TARGET binding site found in the 5' untranslated region of mRNA encoded by LOC146782, corresponding to a HOST TARGET binding site such as BINDING SITE I, BINDING SITE II or BINDING SITE III. Table 2 illustrates the complementarity of the nucleotide sequences of LOC146782 BINDING SITE, designated SEQ ID:37525, to the nucleotide sequence of VGAM2227 RNA, herein designated VGAM RNA, also designated SEQ ID:4938.

Another function of VGAM2227 is therefore inhibition of LOC146782 (Accession XM_083963). Accordingly, utilities of VGAM2227 include diagnosis, prevention and treatment of diseases and clinical conditions associated with LOC146782. LOC221474 (Accession XM_166464) is another VGAM2227 host target gene. LOC221474 BINDING SITE is HOST TARGET binding site found in the 3' untranslated region of mRNA encoded by LOC221474, corresponding to a HOST TARGET binding site such as BINDING SITE I, BINDING SITE II or BINDING SITE III. Table 2 illustrates the complementarity of the nucleotide sequences of LOC221474 BINDING SITE, designated SEQ ID:44381, to the nucleotide sequence of VGAM2227 RNA, herein designated VGAM RNA, also designated SEQ ID:4938.

Another function of VGAM2227 is therefore inhibition of LOC221474 (Accession XM_166464). Accordingly, utilities of VGAM2227 include diagnosis, prevention and treatment of diseases and clinical conditions associated with LOC221474. LOC90092 (Accession XM_028862) is another VGAM2227 host target gene. LOC90092 BINDING SITE is HOST TARGET binding site found in the 5' untranslated region of mRNA encoded by LOC90092, corresponding to a HOST TARGET binding site such as BINDING SITE I, BINDING SITE II or BINDING SITE III. Table 2 illustrates the complementarity of the nucleotide sequences of LOC90092 BINDING SITE, designated SEQ ID:30792, to the nucleotide sequence of VGAM2227 RNA, herein designated VGAM RNA, also designated SEQ ID:4938.

Another function of VGAM2227 is therefore inhibition of LOC90092 (Accession XM_028862). Accordingly, utilities of VGAM2227 include diagnosis, prevention and treatment of diseases and clinical conditions associated with LOC90092. LOC92344 (Accession XM_044455) is another VGAM2227 host target gene. LOC92344 BINDING SITE is HOST TARGET binding site found in the 3' untranslated region of mRNA encoded by LOC92344, corresponding to a HOST TARGET binding site such as BINDING SITE I, BINDING SITE II or BINDING SITE III. Table 2 illustrates the complementarity of the nucleotide sequences of LOC92344 BINDING SITE, designated SEQ ID:34210, to the nucleotide sequence of VGAM2227 RNA, herein designated VGAM RNA, also designated SEQ ID:4938.

Another function of VGAM2227 is therefore inhibition of LOC92344 (Accession XM_044455). Accordingly, utilities of VGAM2227 include diagnosis, prevention and treatment of diseases and clinical conditions associated with LOC92344. FIG. 1 further provides a conceptual description of a novel bioinformatically detected viral gene of the present invention, referred to here as Viral Genomic Address Messenger 2228 (VGAM2228) viral gene, which modulates expression of respective host target genes thereof, the function and utility of which host target genes is known in the art.

VGAM2228 is a novel bioinformatically detected regulatory, non protein coding, viral micro RNA (miRNA) gene. The method by which VGAM2228 was detected is described hereinabove with reference to FIGS. 1-8.

VGAM2228 gene, herein designated VGAM GENE, is a viral gene contained in the genome of Equine Herpesvirus 2. VGAM2228 host target gene, herein designated VGAM HOST TARGET GENE, is a human gene contained in the human genome.

VGAM2228 gene encodes a VGAM2228 precursor RNA, herein designated VGAM PRECURSOR RNA. Similar to other miRNA genes, and unlike most ordinary genes, VGAM2228 precursor RNA does not encode a protein. A nucleotide sequence identical or highly similar to the nucleotide sequence of VGAM2228 precursor RNA is designated SEQ ID:2214, and is provided hereinbelow with reference to the sequence listing part. Nucleotide sequence SEQ ID:2214 is located at position 162465 relative to the genome of Equine Herpesvirus 2.

VGAM2228 precursor RNA folds onto itself, forming VGAM2228 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2228 folded precursor RNA into VGAM2228 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2228 RNA is designated SEQ ID:4939, and is provided hereinbelow with reference to the sequence listing part.

VGAM2228 host target gene, herein designated VGAM HOST TARGET GENE, encodes a corresponding messenger RNA, VGAM2228 host target RNA, herein designated VGAM HOST TARGET RNA. VGAM2228 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2228 RNA, herein designated VGAM RNA, binds complementarily to one or more host target binding sites located in untranslated regions of VGAM2228 host target RNA, herein designated VGAM HOST TARGET RNA. This complementary binding is due to the fact that the nucleotide sequence of VGAM2228 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2228 RNA, herein designated VGAM RNA, may have a different number of host target binding sites in untranslated regions of a VGAM2228 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2228 RNA, herein designated VGAM RNA, to host target binding sites on VGAM2228 host target RNA, herein designated VGAM HOST TARGET RNA, such as BINDING SITE I, BINDING SITE II and BINDING SITE III, inhibits translation of VGAM2228 host target RNA into VGAM2228 host target protein, herein designated VGAM HOST TARGET PROTEIN. VGAM host target protein is therefore outlined by a broken line.

It is appreciated that VGAM2228 host target gene, herein designated VGAM HOST TARGET GENE, in fact represents a plurality of VGAM2228 host target genes. The mRNA of each one of this plurality of VGAM2228 host target genes comprises one or more host target binding sites, each having a nucleotide sequence which is at least partly complementary to VGAM2228 RNA, herein designated VGAM RNA, and which when bound by VGAM2228 RNA causes inhibition of translation of respective one or more VGAM2228 host target proteins.

It is further appreciated by one skilled in the art that the mode of translational inhibition illustrated by FIG. 1 with specific reference to translational inhibition exerted by VGAM2228 gene, herein designated VGAM GENE, on one or more VGAM2228 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2228 is inhibition of expression of host target genes, as part of a novel viral mechanism of attacking a host. Accordingly, utilities of VGAM2228 include diagnosis, prevention and treatment of viral infection by Equine Herpesvirus 2. Specific functions, and accordingly utilities, of VGAM2228 correlate with, and may be deduced from, the identity of the host target genes which VGAM2228 binds and inhibits, and the function of these host target genes, as elaborated hereinbelow.

Nucleotide sequences of the VGAM2228 precursor RNA, herein designated VGAM PRECURSOR RNA, and of the 'diced' VGAM2228 RNA, herein designated VGAM RNA, and a schematic representation of the secondary folding of VGAM2228 folded precursor RNA, herein designated VGAM FOLDED PRECURSOR RNA, of VGAM2228 are further described hereinbelow with reference to Table 1.

Nucleotide sequences of host target binding sites, such as BINDING SITE-I, BINDING SITE-II and BINDING SITE-III of FIG. 1, found on VGAM2228 host target RNA, and schematic representation of the complementarity of each of these host target binding sites to VGAM2228 RNA, herein designated VGAM RNA, are described hereinbelow with reference to Table 2.

As mentioned hereinabove with reference to FIG. 1, a function of VGAM2228 gene, herein designated VGAM is inhibition of expression of VGAM2228 target genes. It is appreciated that specific functions, and accordingly utilities, of VGAM2228 correlate with, and may be deduced from, the identity of the target genes which VGAM2228 binds and inhibits, and the function of these target genes, as elaborated hereinbelow.

Calcium Channel, Voltage-dependent, Gamma Subunit 7 (CACNG7, Accession NM_031896) is a VGAM2228 host target gene. CACNG7 BINDING SITE is HOST TARGET binding site found in the 3' untranslated region of mRNA encoded by CACNG7, corresponding to a HOST TARGET binding site such as BINDING SITE I, BINDING SITE II or BINDING SITE III. Table 2 illustrates the complementarity of the nucleotide sequences of CACNG7 BINDING SITE, designated SEQ ID:25641, to the nucleotide sequence of VGAM2228 RNA, herein designated VGAM RNA, also designated SEQ ID:4939.

A function of VGAM2228 is therefore inhibition of Calcium Channel, Voltage-dependent, Gamma Subunit 7 (CACNG7, Accession NM_031896), a gene which may stabilize the calcium channel in an inactivated (closed) state. Accordingly, utilities of VGAM2228 include diagnosis, prevention and treatment of diseases and clinical conditions associated with CACNG7. The function of CACNG7 has been established by previous studies. Voltage-dependent calcium channels couple membrane depolarization in a number of cellular processes. These activities are regulated by distinct channels composed of the pore-forming alpha-1 subunit (e.g., CACNA1D; 114206) and the modulatory beta (e.g., CACNB1; 114207), alpha-2/delta (e.g., CACNA2D1; 114204), and gamma (e.g., CACNG1; 114209) subunits. By RT-PCR and genomic sequence analysis, Burgess et al. (2001) determined that the CACNG7 gene, like CACNG6 and CACNG8, contains 4 exons.

Full details of the abovementioned studies are described in the following publications, the disclosure of which are hereby incorporated by reference:

Burgess, D. L.; Gefrides, L. A.; Foreman, P. J.; Noebels, J. L.: A cluster of three novel Ca (2+) channel gamma subunit genes on chromosome 19q13.4:evolution and expression profile of the gamma subunit gene family. Genomics 71: 339-350, 2001; and Chu, P.-J.; Robertson, H. M.; Best, P. M.: Calcium channel gamma subunits provide insights into the evolution of this gene family. Gene 280:37-48, 2001.

Further studies establishing the function and utilities of CACNG7 are found in John Hopkins OMIM database record ID 606899, and in sited publications numbered 4526-4527 listed in the bibliography section hereinbelow, which are also hereby incorporated by reference. Glutamate Receptor, Ionotropic, N-methyl D-aspartate-like 1A (GRINL1A, Accession XM_045376) is another VGAM2228 host target gene. GRINL1A BINDING SITE is HOST TARGET binding site found in the 3' untranslated region of mRNA encoded by GRINL1A, corresponding to a HOST TARGET binding site such as BINDING SITE I, BINDING SITE II or BINDING SITE III. Table 2 illustrates the complementarity of the nucleotide sequences of GRINL1A BINDING SITE, designated SEQ ID:34447, to the nucleotide sequence of VGAM2228 RNA, herein designated VGAM RNA, also designated SEQ ID:4939.

Another function of VGAM2228 is therefore inhibition of Glutamate Receptor, Ionotropic, N-methyl D-aspartate-like 1A (GRINL1A, Accession XM_045376), a gene which plays a role in the development and function of the mammalian brain. Accordingly, utilities of VGAM2228 include diagnosis, prevention and treatment of diseases and clinical conditions associated with GRINL1A. The function of GRINL1A and its association with various diseases and clinical conditions, has been established by previous studies, as described hereinabove with reference to VGAM53. Heparan Sulfate (glucosamine) 3-O-sulfotransferase 4 (HS3ST4, Accession XM_056254) is another VGAM2228 host target gene. HS3ST4 BINDING SITE is HOST TARGET binding site found in the 3' untranslated region of mRNA encoded by HS3ST4, corresponding to a HOST TARGET binding site such as BINDING SITE I, BINDING SITE II or BINDING SITE III. Table 2 illustrates the complementarity of the nucleotide sequences of HS3ST4 BINDING SITE, designated SEQ ID:36372, to the nucleotide sequence of VGAM2228 RNA, herein designated VGAM RNA, also designated SEQ ID:4939.

Another function of VGAM2228 is therefore inhibition of Heparan Sulfate (glucosamine) 3-O-sulfotransferase 4 (HS3ST4, Accession XM_056254). Accordingly, utilities of VGAM2228 include diagnosis, prevention and treatment of diseases and clinical conditions associated with HS3ST4. Integrin, Beta 3 (platelet glycoprotein IIIa, antigen CD61) (ITGB3, Accession NM_000212) is another VGAM2228 host target gene. ITGB3 BINDING SITE is HOST TARGET binding site found in the 3' untranslated region of mRNA encoded by ITGB3, corresponding to a HOST TARGET binding site such as BINDING SITE I, BINDING SITE II or BINDING SITE III. Table 2 illustrates the complementarity of the nucleotide sequences of ITGB3 BINDING SITE, designated SEQ ID:5708, to the nucleotide sequence of VGAM2228 RNA, herein designated VGAM RNA, also designated SEQ ID:4939.

Another function of VGAM2228 is therefore inhibition of Integrin, Beta 3 (platelet glycoprotein IIIa, antigen CD61) (ITGB3, Accession NM_000212). Accordingly, utilities of VGAM2228 include diagnosis, prevention and treatment of diseases and clinical conditions associated with ITGB3. Pre-B-cell Leukemia Transcription Factor 2 (PBX2, Accession NM_002586) is another VGAM2228 host target gene. PBX2 BINDING SITE is HOST TARGET binding site found in the 3' untranslated region of mRNA encoded by PBX2, corresponding to a HOST TARGET binding site such as BINDING SITE I, BINDING SITE II or BINDING SITE III. Table 2 illustrates the complementarity of the nucleotide sequences of PBX2 BINDING SITE, designated SEQ ID:8448, to the nucleotide sequence of VGAM2228 RNA, herein designated VGAM RNA, also designated SEQ ID:4939.

Another function of VGAM2228 is therefore inhibition of Pre-B-cell Leukemia Transcription Factor 2 (PBX2, Accession NM_002586), a gene which binds the sequence 5'-atcaatcaa-3'. Accordingly, utilities of VGAM2228 include diagnosis, prevention and treatment of diseases and clinical conditions associated with PBX2. The function of PBX2 and its association with various diseases and clinical conditions, has been established by previous studies, as described hereinabove with reference to VGAM1063. Zinc Finger Protein 264 (ZNF264, Accession NM_003417) is another VGAM2228 host target gene. ZNF264 BINDING SITE is HOST TARGET binding site found in the 3' untranslated region of mRNA encoded by ZNF264, corresponding to a HOST TARGET binding site such as BINDING SITE I, BINDING SITE II or BINDING SITE III. Table 2 illustrates the complementarity of the nucleotide sequences of ZNF264 BINDING SITE, designated SEQ ID:9461, to the nucleotide sequence of VGAM2228 RNA, herein designated VGAM RNA, also designated SEQ ID:4939.

Another function of VGAM2228 is therefore inhibition of Zinc Finger Protein 264 (ZNF264, Accession NM_003417). Accordingly, utilities of VGAM2228 include diagnosis, prevention and treatment of diseases and clinical conditions associated with ZNF264. CG012 (Accession XM_096710) is another VGAM2228 host target gene. CG012 BINDING SITE is HOST TARGET binding site found in the 3' untranslated region of mRNA encoded by CG012, corresponding to a HOST TARGET binding site such as BINDING SITE I, BINDING SITE II or BINDING SITE III. Table 2 illustrates the complementarity of the nucleotide sequences of CG012 BINDING SITE, designated SEQ ID:40489, to the nucleotide sequence of VGAM2228 RNA, herein designated VGAM RNA, also designated SEQ ID:4939.

Another function of VGAM2228 is therefore inhibition of CG012 (Accession XM_096710). Accordingly, utilities of VGAM2228 include diagnosis, prevention and treatment of diseases and clinical conditions associated with CG012. FLJ12604 (Accession XM_035022) is another VGAM2228 host target gene. FLJ12604 BINDING SITE is HOST TARGET binding site found in the 3' untranslated region of mRNA encoded by FLJ12604, corresponding to a HOST TARGET binding site such as BINDING SITE I, BINDING SITE II or BINDING SITE III. Table 2 illustrates the complementarity of the nucleotide sequences of FLJ12604 BINDING SITE, designated SEQ ID:32190, to the nucleotide sequence of VGAM2228 RNA, herein designated VGAM RNA, also designated SEQ ID:4939.

Another function of VGAM2228 is therefore inhibition of FLJ12604 (Accession XM_035022). Accordingly, utilities of VGAM2228 include diagnosis, prevention and treatment of diseases and clinical conditions associated with FLJ12604. Interleukin 1 Receptor Accessory Protein-like 1 (IL1RAPL1, Accession NM_014271) is another VGAM2228 host target gene. IL1RAPL1 BINDING SITE is HOST TARGET binding site found in the 5' untranslated region of mRNA encoded by IL1RAPL1, corresponding to a HOST TARGET binding site such as BINDING SITE I, BINDING SITE II or BINDING SITE III. Table 2 illustrates the complementarity of the nucleotide sequences of IL1RAPL1 BINDING SITE, designated SEQ ID:15553, to the nucleotide sequence of VGAM2228 RNA, herein designated VGAM RNA, also designated SEQ ID:4939.

Another function of VGAM2228 is therefore inhibition of Interleukin 1 Receptor Accessory Protein-like 1 (IL1RAPL1, Accession NM_014271). Accordingly, utilities of VGAM2228 include diagnosis, prevention and treatment of diseases and clinical conditions associated with IL1RAPL1. KIAA1069 (Accession XM_042635) is another VGAM2228 host target gene. KIAA1069 BINDING SITE is HOST TARGET binding site found in the 3' untranslated region of mRNA encoded by KIAA1069, corresponding to a HOST TARGET binding site such as BINDING SITE I, BINDING SITE II or BINDING SITE III. Table 2 illustrates the complementarity of the nucleotide sequences of KIAA1069 BINDING SITE, designated SEQ ID:33724, to the nucleotide sequence of VGAM2228 RNA, herein designated VGAM RNA, also designated SEQ ID:4939.

Another function of VGAM2228 is therefore inhibition of KIAA1069 (Accession XM_042635). Accordingly, utilities of VGAM2228 include diagnosis, prevention and treatment of diseases and clinical conditions associated with KIAA1069. KIAA1318 (Accession XM_041080) is another VGAM2228 host target gene. KIAA1318 BINDING SITE is HOST TARGET binding site found in the 3' untranslated region of mRNA encoded by KIAA1318, corresponding to a HOST TARGET binding site such as BINDING SITE I, BINDING SITE II or BINDING SITE III. Table 2 illustrates the complementarity of the nucleotide sequences of KIAA1318 BINDING SITE, designated SEQ ID:33432, to the nucleotide sequence of VGAM2228 RNA, herein designated VGAM RNA, also designated SEQ ID:4939.

Another function of VGAM2228 is therefore inhibition of KIAA1318 (Accession XM_041080). Accordingly, utilities of VGAM2228 include diagnosis, prevention and treatment of diseases and clinical conditions associated with KIAA1318. KIAA1468 (Accession XM_166289) is another VGAM2228 host target gene. KIAA1468 BINDING SITE is HOST TARGET binding site found in the 3' untranslated region of mRNA encoded by KIAA1468, corresponding to a HOST TARGET binding site such as BINDING SITE I, BINDING SITE II or BINDING SITE III. Table 2 illustrates the complementarity of the nucleotide sequences of KIAA1468 BINDING SITE, designated SEQ ID:44100, to the nucleotide sequence of VGAM2228 RNA, herein designated VGAM RNA, also designated SEQ ID:4939.

Another function of VGAM2228 is therefore inhibition of KIAA1468 (Accession XM_166289). Accordingly, utilities of VGAM2228 include diagnosis, prevention and treatment of diseases and clinical conditions associated with KIAA1468. SAE1 (Accession NM_005500) is another VGAM2228 host target gene. SAE1 BINDING SITE is HOST TARGET binding site found in the 3' untranslated region of mRNA encoded by SAE1, corresponding to a HOST TARGET binding site such as BINDING SITE I, BINDING SITE II or BINDING SITE III. Table 2 illustrates the complementarity of the nucleotide sequences of SAE1 BINDING SITE, designated SEQ ID:12005, to the nucleotide sequence of VGAM2228 RNA, herein designated VGAM RNA, also designated SEQ ID:4939.

Another function of VGAM2228 is therefore inhibition of SAE1 (Accession NM_005500). Accordingly, utilities of VGAM2228 include diagnosis, prevention and treatment of diseases and clinical conditions associated with SAE1. Zinc Finger Protein 36, C3H Type-like 2 (ZFP36L2, Accession NM_006887) is another VGAM2228 host target gene. ZFP36L2 BINDING SITE is HOST TARGET binding site found in the 3' untranslated region of mRNA encoded by ZFP36L2, corresponding to a HOST TARGET binding site such as BINDING SITE I, BINDING SITE II or BINDING SITE III. Table 2 illustrates the complementarity of the nucleotide sequences of ZFP36L2 BINDING SITE, designated SEQ ID:13754, to the nucleotide sequence of VGAM2228 RNA, herein designated VGAM RNA, also designated SEQ ID:4939.

Another function of VGAM2228 is therefore inhibition of Zinc Finger Protein 36, C3H Type-like 2 (ZFP36L2, Accession NM_006887). Accordingly, utilities of VGAM2228 include diagnosis, prevention and treatment of diseases and clinical conditions associated with ZFP36L2. LOC151571 (Accession XM_098088) is another VGAM2228 host target gene. LOC151571 BINDING SITE is HOST TARGET binding site found in the 5' untranslated region of mRNA encoded by LOC151571, corresponding to a HOST TARGET binding site such as BINDING SITE I, BINDING SITE II or BINDING SITE III. Table 2 illustrates the complementarity of the nucleotide sequences of LOC151571 BINDING SITE, designated SEQ ID:41373, to the nucleotide sequence of VGAM2228 RNA, herein designated VGAM RNA, also designated SEQ ID:4939.

Another function of VGAM2228 is therefore inhibition of LOC151571 (Accession XM_098088). Accordingly, utilities of VGAM2228 include diagnosis, prevention and treatment of diseases and clinical conditions associated with LOC151571. LOC158219 (Accession XM_088514) is another VGAM2228 host target gene. LOC158219 BINDING SITE is HOST TARGET binding site found in the 3' untranslated region of mRNA encoded by LOC158219, corresponding to a HOST TARGET binding site such as BINDING SITE I, BINDING SITE II or BINDING SITE III. Table 2 illustrates the complementarity of the nucleotide sequences of LOC158219 BINDING SITE, designated SEQ ID:39764, to the nucleotide sequence of VGAM2228 RNA, herein designated VGAM RNA, also designated SEQ ID:4939.

Another function of VGAM2228 is therefore inhibition of LOC158219 (Accession XM_088514). Accordingly, utilities of VGAM2228 include diagnosis, prevention and treatment of diseases and clinical conditions associated with LOC158219. LOC257415 (Accession XM_171177) is another VGAM2228 host target gene. LOC257415 BINDING SITE is HOST TARGET binding site found in the 3' untranslated region of mRNA encoded by LOC257415, corresponding to a HOST TARGET binding site such as BINDING SITE I, BINDING SITE II or BINDING SITE III. Table 2 illustrates the complementarity of the nucleotide sequences of LOC257415 BINDING SITE, designated SEQ ID:45959, to the nucleotide sequence of VGAM2228 RNA, herein designated VGAM RNA, also designated SEQ ID:4939.

Another function of VGAM2228 is therefore inhibition of LOC257415 (Accession XM_171177). Accordingly, utilities of VGAM2228 include diagnosis, prevention and treatment of diseases and clinical conditions associated with LOC257415. LOC57019 (Accession NM_020313) is another VGAM2228 host target gene. LOC57019 BINDING SITE is HOST TARGET binding site found in the 3' untranslated region of mRNA encoded by LOC57019, corresponding to a HOST TARGET binding site such as BINDING SITE I, BINDING SITE II or BINDING SITE III. Table 2 illustrates the complementarity of the nucleotide sequences of LOC57019 BINDING SITE, designated SEQ ID:21570, to the nucleotide sequence of VGAM2228 RNA, herein designated VGAM RNA, also designated SEQ ID:4939.

Another function of VGAM2228 is therefore inhibition of LOC57019 (Accession NM_020313). Accordingly, utilities of VGAM2228 include diagnosis, prevention and treatment of diseases and clinical conditions associated with LOC57019. FIG. 1 further provides a conceptual description of a novel bioinformatically detected viral gene of the present invention, referred to here as Viral Genomic Address Messenger 2229 (VGAM2229) viral gene, which modulates expression of respective host target genes thereof, the function and utility of which host target genes is known in the art.

VGAM2229 is a novel bioinformatically detected regulatory, non protein coding, viral micro RNA (miRNA) gene. The method by which VGAM2229 was detected is described hereinabove with reference to FIGS. 1-8.

VGAM2229 gene, herein designated VGAM GENE, is a viral gene contained in the genome of Potato Aucuba Mosaic Virus. VGAM2229 host target gene, herein designated VGAM HOST TARGET GENE, is a human gene contained in the human genome.

VGAM2229 gene encodes a VGAM2229 precursor RNA, herein designated VGAM PRECURSOR RNA. Similar to other miRNA genes, and unlike most ordinary genes, VGAM2229 precursor RNA does not encode a protein. A nucleotide sequence identical or highly similar to the nucleotide sequence of VGAM2229 precursor RNA is designated SEQ ID:2215, and is provided hereinbelow with reference to the sequence listing part. Nucleotide sequence SEQ ID:2215 is located at position 827 relative to the genome of Potato Aucuba Mosaic Virus.

VGAM2229 precursor RNA folds onto itself, forming VGAM2229 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2229 folded precursor RNA into VGAM2229 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM2229 RNA is designated SEQ ID:4940, and is provided hereinbelow with reference to the sequence listing part.

VGAM2229 host target gene, herein designated VGAM HOST TARGET GENE, encodes a corresponding messenger RNA, VGAM2229 host target RNA, herein designated VGAM HOST TARGET RNA. VGAM2229 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2229 RNA, herein designated VGAM RNA, binds complementarily to one or more host target binding sites located in untranslated regions of VGAM2229 host target RNA, herein designated VGAM HOST TARGET RNA. This complementary binding is due to the fact that the nucleotide sequence of VGAM2229 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2229 RNA, herein designated VGAM RNA, may have a different number of host target binding sites in untranslated regions of a VGAM2229 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2229 RNA, herein designated VGAM RNA, to host target binding sites on VGAM2229 host target RNA, herein designated VGAM HOST TARGET RNA, such as BINDING SITE I, BINDING SITE II and BINDING SITE III, inhibits translation of VGAM2229 host target RNA into VGAM2229 host target protein, herein designated VGAM HOST TARGET PROTEIN. VGAM host target protein is therefore outlined by a broken line.

It is appreciated that VGAM2229 host target gene, herein designated VGAM HOST TARGET GENE, in fact represents a plurality of VGAM2229 host target genes. The mRNA of each one of this plurality of VGAM2229 host target genes comprises one or more host target binding sites, each having a nucleotide sequence which is at least partly complementary to VGAM2229 RNA, herein designated VGAM RNA, and which when bound by VGAM2229 RNA causes inhibition of translation of respective one or more VGAM2229 host target proteins.

It is further appreciated by one skilled in the art that the mode of translational inhibition illustrated by FIG. 1 with specific reference to translational inhibition exerted by VGAM2229 gene, herein designated VGAM GENE, on one or more VGAM2229 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2229 is inhibition of expression of host target genes, as part of a novel viral mechanism of attacking a host. Accordingly, utilities of VGAM2229 include diagnosis, prevention and treatment of viral infection by Potato Aucuba Mosaic Virus. Specific functions, and accordingly utilities, of VGAM2229 correlate with, and may be deduced from, the identity of the host target genes which VGAM2229 binds and inhibits, and the function of these host target genes, as elaborated hereinbelow.

Nucleotide sequences of the VGAM2229 precursor RNA, herein designated VGAM PRECURSOR RNA, and of the 'diced' VGAM2229 RNA, herein designated VGAM RNA, and a schematic representation of the secondary folding of VGAM2229 folded precursor RNA, herein designated VGAM FOLDED PRECURSOR RNA, of VGAM2229 are further described hereinbelow with reference to Table 1.

Nucleotide sequences of host target binding sites, such as BINDING SITE-I, BINDING SITE-II and BINDING SITE-III of FIG. 1, found on VGAM2229 host target RNA, and schematic representation of the complementarity of each of these host target binding sites to VGAM2229 RNA, herein designated VGAM RNA, are described hereinbelow with reference to Table 2.

As mentioned hereinabove with reference to FIG. 1, a function of VGAM2229 gene, herein designated VGAM is inhibition of expression of VGAM2229 target genes. It is appreciated that specific functions, and accordingly utilities, of VGAM2229 correlate with, and may be deduced from, the identity of the target genes which VGAM2229 binds and inhibits, and the function of these target genes, as elaborated hereinbelow.

Pleiomorphic Adenoma Gene 1 (PLAG1, Accession NM_002655) is a VGAM2229 host target gene. PLAG1 BINDING SITE is HOST TARGET binding site found in the 3' untranslated region of mRNA encoded by PLAG1, corresponding to a HOST TARGET binding site such as BINDING SITE I, BINDING SITE II or BINDING SITE III. Table 2 illustrates the complementarity of the nucleotide sequences of PLAG1 BINDING SITE, designated SEQ ID:8516, to the nucleotide sequence of VGAM2229 RNA, herein designated VGAM RNA, also designated SEQ ID:4940.

A function of VGAM2229 is therefore inhibition of Pleiomorphic Adenoma Gene 1 (PLAG1, Accession NM_002655), a gene which contains a zinc finger domain. Accordingly, utilities of VGAM2229 include diagnosis, prevention and treatment of diseases and clinical conditions associated with PLAG1. The function of PLAG1 and its association with various diseases and clinical conditions, has been established by previous studies, as described hereinabove with reference to VGAM29. FLJ10140 (Accession NM_018006) is another VGAM2229 host target gene. FLJ10140 BINDING SITE is HOST TARGET binding site found in the 3' untranslated region of mRNA encoded by FLJ10140, corresponding to a HOST TARGET binding site such as BINDING SITE I, BINDING SITE II or BINDING SITE III. Table 2 illustrates the complementarity of the nucleotide sequences of FLJ10140 BINDING SITE, designated SEQ ID:19737, to the nucleotide sequence of VGAM2229 RNA, herein designated VGAM RNA, also designated SEQ ID:4940.

Another function of VGAM2229 is therefore inhibition of FLJ10140 (Accession NM_018006). Accordingly, utilities of VGAM2229 include diagnosis, prevention and treatment of diseases and clinical conditions associated with FLJ10140. FIG. 1 further provides a conceptual description of a novel bioinformatically detected viral gene of the present invention, referred to here as Viral Genomic Address Messenger 2230 (VGAM2230) viral gene, which modulates expression of respective host target genes thereof, the function and utility of which host target genes is known in the art.

VGAM2230 is a novel bioinformatically detected regulatory, non protein coding, viral micro RNA (miRNA) gene. The method by which VGAM2230 was detected is described hereinabove with reference to FIGS. 1-8.

VGAM2230 gene, herein designated VGAM GENE, is a viral gene contained in the genome of Potato Aucuba Mosaic Virus. VGAM2230 host target gene, herein designated VGAM HOST TARGET GENE, is a human gene contained in the human genome.

VGAM2230 gene encodes a VGAM2230 precursor RNA, herein designated VGAM PRECURSOR RNA. Similar to other miRNA genes, and unlike most ordinary genes, VGAM2230 precursor RNA does not encode a protein. A nucleotide sequence identical or highly similar to the nucleotide sequence of VGAM2230 precursor RNA is designated SEQ ID:2216, and is provided hereinbelow with reference to the sequence listing part. Nucleotide sequence SEQ ID:2216 is located at position 1300 relative to the genome of Potato Aucuba Mosaic Virus.

VGAM2230 precursor RNA folds onto itself, forming VGAM2230 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2230 folded precursor RNA into VGAM2230 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2230 RNA is designated SEQ ID:4941, and is provided hereinbelow with reference to the sequence listing part.

VGAM2230 host target gene, herein designated VGAM HOST TARGET GENE, encodes a corresponding messenger RNA, VGAM2230 host target RNA, herein designated VGAM HOST TARGET RNA. VGAM2230 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2230 RNA, herein designated VGAM RNA, binds complementarily to one or more host target binding sites located in untranslated regions of VGAM2230 host target RNA, herein designated VGAM HOST TARGET RNA. This complementary binding is due to the fact that the nucleotide sequence of VGAM2230 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2230 RNA, herein designated VGAM RNA, may have a different number of host target binding sites in untranslated regions of a VGAM2230 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2230 RNA, herein designated VGAM RNA, to host target binding sites on VGAM2230 host target RNA, herein designated VGAM HOST TARGET RNA, such as BINDING SITE I, BINDING SITE II and BINDING SITE III, inhibits translation of VGAM2230 host target RNA into VGAM2230 host target protein, herein designated VGAM HOST TARGET PROTEIN. VGAM host target protein is therefore outlined by a broken line.

It is appreciated that VGAM2230 host target gene, herein designated VGAM HOST TARGET GENE, in fact represents a plurality of VGAM2230 host target genes. The mRNA of each one of this plurality of VGAM2230 host target genes comprises one or more host target binding sites, each having a nucleotide sequence which is at least partly complementary to VGAM2230 RNA, herein designated VGAM RNA, and which when bound by VGAM2230 RNA causes inhibition of translation of respective one or more VGAM2230 host target proteins.

It is further appreciated by one skilled in the art that the mode of translational inhibition illustrated by FIG. 1 with specific reference to translational inhibition exerted by VGAM2230 gene, herein designated VGAM GENE, on one or more VGAM2230 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2230 is inhibition of expression of host target genes, as part of a novel viral mechanism of attacking a host. Accordingly, utilities of VGAM2230 include diagnosis, prevention and treatment of viral infection by Potato Aucuba Mosaic Virus. Specific functions, and accordingly utilities, of VGAM2230 correlate with, and may be deduced from, the identity of the host target genes which VGAM2230 binds and inhibits, and the function of these host target genes, as elaborated hereinbelow.

Nucleotide sequences of the VGAM2230 precursor RNA, herein designated VGAM PRECURSOR RNA, and of the 'diced' VGAM2230 RNA, herein designated VGAM RNA, and a schematic representation of the secondary folding of VGAM2230 folded precursor RNA, herein designated VGAM FOLDED PRECURSOR RNA, of VGAM2230 are further described hereinbelow with reference to Table 1.

Nucleotide sequences of host target binding sites, such as BINDING SITE-I, BINDING SITE-II and BINDING SITE-III of FIG. 1, found on VGAM2230 host target RNA, and schematic representation of the complementarity of each of these host target binding sites to VGAM2230 RNA, herein designated VGAM RNA, are described hereinbelow with reference to Table 2.

As mentioned hereinabove with reference to FIG. 1, a function of VGAM2230 gene, herein designated VGAM is inhibition of expression of VGAM2230 target genes. It is appreciated that specific functions, and accordingly utilities, of VGAM2230 correlate with, and may be deduced from, the identity of the target genes which VGAM2230 binds and inhibits, and the function of these target genes, as elaborated hereinbelow.

BIG1 (Accession NM_006421) is a VGAM2230 host target gene. BIG1 BINDING SITE is HOST TARGET binding site found in the 3' untranslated region of mRNA encoded by BIG1, corresponding to a HOST TARGET binding site such as BINDING SITE I, BINDING SITE II or BINDING SITE III. Table 2 illustrates the complementarity of the nucleotide sequences of BIG1 BINDING SITE, designated SEQ ID:13139, to the nucleotide sequence of VGAM2230 RNA, herein designated VGAM RNA, also designated SEQ ID:4941.

A function of VGAM2230 is therefore inhibition of BIG1 (Accession NM_006421), a gene which is a guanine nucleotide-exchange protein, has a role in vesicular transport. Accordingly, utilities of VGAM2230 include diagnosis, prevention and treatment of diseases and clinical conditions associated with BIG1. The function of BIG1 and its association with various diseases and clinical conditions, has been established by previous studies, as described hereinabove with reference to VGAM1190. Ca2+-dependent Activator Protein For Secretion (CADPS, Accession XM_036915) is another VGAM2230 host target gene. CADPS BINDING SITE is HOST TARGET binding site found in the 3' untranslated region of mRNA encoded by CADPS, corresponding to a HOST TARGET binding site such as BINDING SITE I, BINDING SITE II or BINDING SITE III. Table 2 illustrates the complementarity of the nucleotide sequences of CADPS BINDING SITE, designated SEQ ID:32508, to the nucleotide sequence of VGAM2230 RNA, herein designated VGAM RNA, also designated SEQ ID:4941.

Another function of VGAM2230 is therefore inhibition of Ca2+-dependent Activator Protein For Secretion (CADPS, Accession XM_036915), a gene which is required for the Ca2+-regulated exocytosis of secretory vesicles. Accordingly, utilities of VGAM2230 include diagnosis, prevention and treatment of diseases and clinical conditions associated with CADPS. The function of CADPS and its association with various diseases and clinical conditions, has been established by previous studies, as described hereinabove with reference to VGAM1315. Centaurin, Delta 1 (CENTD1, Accession NM_139182) is another VGAM2230 host target gene. CENTD1 BINDING SITE1 and CENTD1 BINDING SITE2 are HOST TARGET binding sites found in untranslated regions of mRNA encoded by CENTD1, corresponding to HOST TARGET binding sites such as BINDING SITE I, BINDING SITE II or BINDING SITE III. Table 2 illustrates the complementarity of the nucleotide sequences of CENTD1 BINDING SITE1 and CENTD1 BINDING SITE2, designated SEQ ID:29201 and SEQ ID:17563 respectively, to the nucleotide sequence of VGAM2230 RNA, herein designated VGAM RNA, also designated SEQ ID:4941.

Another function of VGAM2230 is therefore inhibition of Centaurin, Delta 1 (CENTD1, Accession NM_139182), a gene which is nvolved in cell signaling/communication. Accordingly, utilities of VGAM2230 include diagnosis, prevention and treatment of diseases and clinical conditions associated with CENTD1. The function of CENTD1 and its association with various diseases and clinical conditions, has been established by previous studies, as described hereinabove with reference to VGAM445. Protein Phosphatase 3 (formerly 2B), Catalytic Subunit, Alpha Isoform (calcineurin A alpha) (PPP3CA, Accession NM_000944) is another VGAM2230 host target gene. PPP3CA BINDING SITE is HOST TARGET binding site found in the 3' untranslated region of mRNA encoded by PPP3CA, corresponding to a HOST TARGET binding site such as BINDING SITE I, BINDING SITE II or BINDING SITE III. Table 2 illustrates the complementarity of the nucleotide sequences of PPP3CA BINDING SITE, designated SEQ ID:6646, to the nucleotide sequence of VGAM2230 RNA, herein designated VGAM RNA, also designated SEQ ID:4941.

Another function of VGAM2230 is therefore inhibition of Protein Phosphatase 3 (formerly 2B), Catalytic Subunit, Alpha Isoform (calcineurin A alpha) (PPP3CA, Accession NM_000944), a gene which is the catalytic subunit of calcium-dependent, calmodulin-stimulated protein phosphatase. Accordingly, utilities of VGAM2230 include diagnosis, prevention and treatment of diseases and clinical conditions associated with PPP3CA. The function of PPP3CA and its association with various diseases and clinical conditions, has been established by previous studies, as described hereinabove with reference to VGAM497. Phosphoribosyl Pyrophosphate Synthetase 2 (PRPS2, Accession NM_002765) is another VGAM2230 host target gene. PRPS2 BINDING SITE is HOST TARGET binding site found in the 3' untranslated region of mRNA encoded by PRPS2, corresponding to a HOST TARGET binding site such as BINDING SITE I, BINDING SITE II or BINDING SITE III. Table 2 illustrates the complementarity of the nucleotide sequences of PRPS2 BINDING SITE, designated SEQ ID:8657, to the nucleotide sequence of VGAM2230 RNA, herein designated VGAM RNA, also designated SEQ ID:4941.

Another function of VGAM2230 is therefore inhibition of Phosphoribosyl Pyrophosphate Synthetase 2 (PRPS2, Accession NM_002765), a gene which generates the PRPP needed for initiation of purine biosynthesis. Accordingly, utilities of VGAM2230 include diagnosis, prevention and treatment of diseases and clinical conditions associated with PRPS2. The function of PRPS2 and its association with various diseases and clinical conditions, has been established by previous studies, as described hereinabove with reference to VGAM828. RNA Binding Motif Protein 8A (RBM8A, Accession NM_005105) is another VGAM2230 host target gene. RBM8A BINDING SITE is HOST TARGET binding site found in the 3' untranslated region of mRNA encoded by RBM8A, corresponding to a HOST TARGET binding site such as BINDING SITE I, BINDING SITE II or BINDING SITE III. Table 2 illustrates the complementarity of the nucleotide sequences of RBM8A BINDING SITE, designated SEQ ID:11581, to the nucleotide sequence of VGAM2230 RNA, herein designated VGAM RNA, also designated SEQ ID:4941.

Another function of VGAM2230 is therefore inhibition of RNA Binding Motif Protein 8A (RBM8A, Accession NM_005105), a gene which involves in the pathway of gene expression postsplicing nuclear preexport mRNPs, and newly exported cytoplasmic mRNPs. Accordingly, utilities of VGAM2230 include diagnosis, prevention and treatment of diseases and clinical conditions associated with RBM8A. The function of RBM8A and its association with various diseases and clinical conditions, has been established by previous studies, as described hereinabove with reference to VGAM1864. V-yes-1 Yamaguchi Sarcoma Viral Oncogene Homolog 1 (YES1, Accession NM_005433) is another VGAM2230 host target gene. YES1 BINDING SITE is HOST TARGET binding site found in the 3' untranslated region of mRNA encoded by YES1, corresponding to a HOST TARGET binding site such as BINDING SITE I, BINDING SITE II or BINDING SITE III. Table 2 illustrates the complementarity of the nucleotide sequences of YES1 BINDING SITE, designated SEQ ID:11915, to the nucleotide sequence of VGAM2230 RNA, herein designated VGAM RNA, also designated SEQ ID:4941.

Another function of VGAM2230 is therefore inhibition of V-yes-1 Yamaguchi Sarcoma Viral Oncogene Homolog 1 (YES1, Accession NM_005433), a gene which is a putative protein-tyrosine kinase. Accordingly, utilities of VGAM2230 include diagnosis, prevention and treatment of diseases and clinical conditions associated with YES1. The function of YES1 and its association with various diseases and clinical conditions, has been established by previous studies, as described hereinabove with reference to VGAM74. Calmegin (CLGN, Accession NM_004362) is another VGAM2230 host target gene. CLGN BINDING SITE is HOST TARGET binding site found in the 3' untranslated region of mRNA encoded by CLGN, corresponding to a HOST TARGET binding site such as BINDING SITE I, BINDING SITE II or BINDING SITE III. Table 2 illustrates the complementarity of the nucleotide sequences of CLGN BINDING SITE, designated SEQ ID:10569, to the nucleotide sequence of VGAM2230 RNA, herein designated VGAM RNA, also designated SEQ ID:4941.

Another function of VGAM2230 is therefore inhibition of Calmegin (CLGN, Accession NM_004362). Accordingly, utilities of VGAM2230 include diagnosis, prevention and treatment of diseases and clinical conditions associated with CLGN. Cyclin M1 (CNNM1, Accession NM_020348) is another VGAM2230 host target gene. CNNM1 BINDING SITE is HOST TARGET binding site found in the 3' untranslated region of mRNA encoded by CNNM1, corresponding to a HOST TARGET binding site such as BINDING SITE I, BINDING SITE II or BINDING SITE III. Table 2 illustrates the complementarity of the nucleotide sequences of CNNM1 BINDING SITE, designated SEQ ID:21610, to the nucleotide sequence of VGAM2230 RNA, herein designated VGAM RNA, also designated SEQ ID:4941.

Another function of VGAM2230 is therefore inhibition of Cyclin M1 (CNNM1, Accession NM_020348). Accordingly, utilities of VGAM2230 include diagnosis, prevention and treatment of diseases and clinical conditions associated with CNNM1. DKFZp434C0923 (Accession NM_017598) is another VGAM2230 host target gene. DKFZp434C0923 BINDING SITE is HOST TARGET binding site found in the 5' untranslated region of mRNA encoded by DKFZp434C0923, corresponding to a HOST TARGET binding site such as BINDING SITE I, BINDING SITE II or BINDING SITE III. Table 2 illustrates the complementarity of the nucleotide sequences of DKFZp434C0923 BINDING SITE, designated SEQ ID:19066, to the nucleotide sequence of VGAM2230 RNA, herein designated VGAM RNA, also designated SEQ ID:4941.

Another function of VGAM2230 is therefore inhibition of DKFZp434C0923 (Accession NM_017598). Accordingly, utilities of VGAM2230 include diagnosis, prevention and treatment of diseases and clinical conditions associated with DKFZp434C0923. FLJ10704 (Accession NM_018185) is another VGAM2230 host target gene. FLJ10704 BINDING SITE is HOST TARGET binding site found in the 3' untranslated region of mRNA encoded by FLJ10704, corresponding to a HOST TARGET binding site such as BINDING SITE I, BINDING SITE II or BINDING SITE III. Table 2 illustrates the complementarity of the nucleotide sequences of FLJ10704 BINDING SITE, designated SEQ ID:20034, to the nucleotide sequence of VGAM2230 RNA, herein designated VGAM RNA, also designated SEQ ID:4941.

Another function of VGAM2230 is therefore inhibition of FLJ10704 (Accession NM_018185). Accordingly, utilities of VGAM2230 include diagnosis, prevention and treatment of diseases and clinical conditions associated with FLJ10704. FLJ11267 (Accession NM_019607) is another VGAM2230 host target gene. FLJ11267 BINDING SITE is HOST TARGET binding site found in the 5' untranslated region of mRNA encoded by FLJ11267, corresponding to a HOST TARGET binding site such as BINDING SITE I, BINDING SITE II or BINDING SITE III. Table 2 illustrates the complementarity of the nucleotide sequences of FLJ11267 BINDING SITE, designated SEQ ID:21225, to the nucleotide sequence of VGAM2230 RNA, herein designated VGAM RNA, also designated SEQ ID:4941.

Another function of VGAM2230 is therefore inhibition of FLJ11267 (Accession NM_019607). Accordingly, utilities of VGAM2230 include diagnosis, prevention and treatment of diseases and clinical conditions associated with FLJ11267. FLJ13962 (Accession NM_024862) is another VGAM2230 host target gene. FLJ13962 BINDING SITE is HOST TARGET binding site found in the 3' untranslated region of mRNA encoded by FLJ13962, corresponding to a HOST TARGET binding site such as BINDING SITE I, BINDING SITE II or BINDING SITE III. Table 2 illustrates the complementarity of the nucleotide sequences of FLJ13962 BINDING SITE, designated SEQ ID:24298, to the nucleotide sequence of VGAM2230 RNA, herein designated VGAM RNA, also designated SEQ ID:4941.

Another function of VGAM2230 is therefore inhibition of FLJ13962 (Accession NM_024862). Accordingly, utilities of VGAM2230 include diagnosis, prevention and treatment of diseases and clinical conditions associated with FLJ13962. FLJ20413 (Accession NM_017808) is another VGAM2230 host target gene. FLJ20413 BINDING SITE is HOST TARGET binding site found in the 3' untranslated region of mRNA encoded by FLJ20413, corresponding to a HOST TARGET binding site such as BINDING SITE I, BINDING SITE II or BINDING SITE III. Table 2 illustrates the complementarity of the nucleotide sequences of FLJ20413 BINDING SITE, designated SEQ ID:19455, to the nucleotide sequence of VGAM2230 RNA, herein designated VGAM RNA, also designated SEQ ID:4941.

Another function of VGAM2230 is therefore inhibition of FLJ20413 (Accession NM_017808). Accordingly, utilities of VGAM2230 include diagnosis, prevention and treatment of diseases and clinical conditions associated with FLJ20413. FLJ20729 (Accession NM_017953) is another VGAM2230 host target gene. FLJ20729 BINDING SITE is HOST TARGET binding site found in the 3' untranslated region of mRNA encoded by FLJ20729, corresponding to a HOST TARGET binding site such as BINDING SITE I, BINDING SITE II or BINDING SITE III. Table 2 illustrates the complementarity of the nucleotide sequences of FLJ20729 BINDING SITE, designated SEQ ID:19657, to the nucleotide sequence of VGAM2230 RNA, herein designated VGAM RNA, also designated SEQ ID:4941.

Another function of VGAM2230 is therefore inhibition of FLJ20729 (Accession NM_017953). Accordingly, utilities of VGAM2230 include diagnosis, prevention and treatment of diseases and clinical conditions associated with FLJ20729. KIAA0237 (Accession NM_014747) is another VGAM2230 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16453, to the nucleotide sequence of VGAM2230 RNA, herein designated VGAM RNA, also designated SEQ ID:4941.

Another function of VGAM2230 is therefore inhibition of KIAA0237 (Accession NM_014747). Accordingly, utilities of VGAM2230 include diagnosis, prevention and treatment of diseases and clinical conditions associated with KIAA0237. KIAA0746 (Accession XM_045277) is another VGAM2230 host target gene. KIAA0746 BINDING SITE is HOST TARGET binding site found in the 5' untranslated region of mRNA encoded by KIAA0746, corresponding to a HOST TARGET binding site such as BINDING SITE I, BINDING SITE II or BINDING SITE III. Table 2 illustrates the complementarity of the nucleotide sequences of KIAA0746 BINDING SITE, designated SEQ ID:34415, to the nucleotide sequence of VGAM2230 RNA, herein designated VGAM RNA, also designated SEQ ID:4941.

Another function of VGAM2230 is therefore inhibition of KIAA0746 (Accession XM_045277). Accordingly, utilities of VGAM2230 include diagnosis, prevention and treatment of diseases and clinical conditions associated with KIAA0746. KIAA0788 (Accession XM_049108) is another VGAM2230 host target gene. KIAA0788 BINDING SITE is HOST TARGET binding site found in the 3' untranslated region of mRNA encoded by KIAA0788, corresponding to a HOST TARGET binding site such as BINDING SITE I, BINDING SITE II or BINDING SITE III. Table 2 illustrates the complementarity of the nucleotide sequences of KIAA0788 BINDING SITE, designated SEQ ID:35344, to the nucleotide sequence of VGAM2230 RNA, herein designated VGAM RNA, also designated SEQ ID:4941.

Another function of VGAM2230 is therefore inhibition of KIAA0788 (Accession XM_049108). Accordingly, utilities of VGAM2230 include diagnosis, prevention and treatment of diseases and clinical conditions associated with KIAA0788. KIAA0795 (Accession NM_025010) is another VGAM2230 host target gene. KIAA0795 BINDING SITE is HOST TARGET binding site found in the 3' untranslated region of mRNA encoded by KIAA0795, corresponding to a HOST TARGET binding site such as BINDING SITE I, BINDING SITE II or BINDING SITE III. Table 2 illustrates the complementarity of the nucleotide sequences of KIAA0795 BINDING SITE, designated SEQ ID:24586, to the nucleotide sequence of VGAM2230 RNA, herein designated VGAM RNA, also designated SEQ ID:4941.

Another function of VGAM2230 is therefore inhibition of KIAA0795 (Accession NM_025010). Accordingly, utilities of VGAM2230 include diagnosis, prevention and treatment of diseases and clinical conditions associated with KIAA0795. KIAA1977 (Accession XM_058800) is another VGAM2230 host target gene. KIAA1977 BINDING SITE is HOST TARGET binding site found in the 5' untranslated region of mRNA encoded by KIAA1977, corresponding to a HOST TARGET binding site such as BINDING SITE I, BINDING SITE II or BINDING SITE III. Table 2 illustrates the complementarity of the nucleotide sequences of KIAA1977 BINDING SITE, designated SEQ ID:36746, to the nucleotide sequence of VGAM2230 RNA, herein designated VGAM RNA, also designated SEQ ID:4941.

Another function of VGAM2230 is therefore inhibition of KIAA1977 (Accession XM_058800). Accordingly, utilities of VGAM2230 include diagnosis, prevention and treatment of diseases and clinical conditions associated with KIAA1977. KR18 (Accession NM_033288) is another VGAM2230 host target gene. KR18 BINDING SITE is HOST TARGET binding site found in the 3' untranslated region of mRNA encoded by KR18, corresponding to a HOST TARGET binding site such as BINDING SITE I, BINDING SITE II or BINDING SITE III. Table 2 illustrates the complementarity of the nucleotide sequences of KR18 BINDING SITE, designated SEQ ID:27121, to the nucleotide sequence of VGAM2230 RNA, herein designated VGAM RNA, also designated SEQ ID:4941.

Another function of VGAM2230 is therefore inhibition of KR18 (Accession NM_033288). Accordingly, utilities of VGAM2230 include diagnosis, prevention and treatment of diseases and clinical conditions associated with KR18. LIG-1 (Accession XM_033712) is another VGAM2230 host target gene. LIG-1 BINDING SITE is HOST TARGET binding site found in the 3' untranslated region of mRNA encoded by LIG-1, corresponding to a HOST TARGET binding site such as BINDING SITE I, BINDING SITE II or BINDING SITE III. Table 2 illustrates the complementarity of the nucleotide sequences of LIG-1 BINDING SITE, designated SEQ ID:31954, to the nucleotide sequence of VGAM2230 RNA, herein designated VGAM RNA, also designated SEQ ID:4941.

Another function of VGAM2230 is therefore inhibition of LIG-1 (Accession XM_033712). Accordingly, utilities of VGAM2230 include diagnosis, prevention and treatment of diseases and clinical conditions associated with LIG-1. Nucleoporin 133 kDa (NUP133, Accession NM_018230) is another VGAM2230 host target gene. NUP133 BINDING SITE is HOST TARGET binding site found in the 3' untranslated region of mRNA encoded by NUP133, corresponding to a HOST TARGET binding site such as BINDING SITE I, BINDING SITE II or BINDING SITE III. Table 2 illustrates the complementarity of the nucleotide sequences of NUP133 BINDING SITE, designated SEQ ID:20168, to the nucleotide sequence of VGAM2230 RNA, herein designated VGAM RNA, also designated SEQ ID:4941.

Another function of VGAM2230 is therefore inhibition of Nucleoporin 133kDa (NUP133, Accession NM_018230). Accordingly, utilities of VGAM2230 include diagnosis, prevention and treatment of diseases and clinical conditions associated with NUP133. Pleiomorphic Adenoma Gene-like 2 (PLAGL2, Accession XM_047007) is another VGAM2230 host target gene. PLAGL2 BINDING SITE is HOST TARGET binding site found in the 3' untranslated region of mRNA encoded by PLAGL2, corresponding to a HOST TARGET binding site such as BINDING SITE I, BINDING SITE II or BINDING SITE III. Table 2 illustrates the complementarity of the nucleotide sequences of PLAGL2 BINDING SITE, designated SEQ ID:34880, to the nucleotide sequence of VGAM2230 RNA, herein designated VGAM RNA, also designated SEQ ID:4941.

Another function of VGAM2230 is therefore inhibition of Pleiomorphic Adenoma Gene-like 2 (PLAGL2, Accession XM_047007). Accordingly, utilities of VGAM2230 include diagnosis, prevention and treatment of diseases and clinical conditions associated with PLAGL2. RAN, Member RAS Oncogene Family (RAN, Accession NM_006325) is another VGAM2230 host target gene. RAN BINDING SITE is HOST TARGET binding site found in the 3' untranslated region of mRNA encoded by RAN, corresponding to a HOST TARGET binding site such as BINDING SITE I, BINDING SITE II or BINDING SITE III. Table 2 illustrates the complementarity of the nucleotide sequences of RAN BINDING SITE, designated SEQ ID:13017, to the nucleotide sequence of VGAM2230 RNA, herein designated VGAM RNA, also designated SEQ ID:4941.

Another function of VGAM2230 is therefore inhibition of RAN, Member RAS Oncogene Family (RAN, Accession NM_006325). Accordingly, utilities of VGAM2230 include diagnosis, prevention and treatment of diseases and clinical conditions associated with RAN. Roundabout, Axon Guidance Receptor, Homolog 2 (Drosophila) (ROBO2, Accession XM_031246) is another VGAM2230 host target gene. ROBO2 BINDING SITE is HOST TARGET binding site found in the 3' untranslated region of mRNA encoded by ROBO2, corresponding to a HOST TARGET binding site such as BINDING SITE I, BINDING SITE II or BINDING SITE III. Table 2 illustrates the complementarity of the nucleotide sequences of ROBO2 BINDING SITE, designated SEQ ID:31317, to the nucleotide sequence of VGAM2230 RNA, herein designated VGAM RNA, also designated SEQ ID:4941.

Another function of VGAM2230 is therefore inhibition of Roundabout, Axon Guidance Receptor, Homolog 2 (Drosophila) (ROBO2, Accession XM_031246). Accordingly, utilities of VGAM2230 include diagnosis, prevention and treatment of diseases and clinical conditions associated with ROBO2. SEC15B (Accession XM_039570) is another VGAM2230 host target gene. SEC15B BINDING SITE is HOST TARGET binding site found in the 3" untranslated region of mRNA encoded by SEC15B, corresponding to a HOST TARGET binding site such as BINDING SITE I, BINDING SITE II or BINDING SITE III. Table 2 illustrates the complementarity of the nucleotide sequences of SEC15B BINDING SITE, designated SEQ ID:33125, to the nucleotide sequence of VGAM2230 RNA, herein designated VGAM RNA, also designated SEQ ID:4941.

Another function of VGAM2230 is therefore inhibition of SEC15B (Accession XM_039570). Accordingly, utilities of VGAM2230 include diagnosis, prevention and treatment of diseases and clinical conditions associated with SEC15B. SH3 Domain Binding Glutamic Acid-rich Protein Like (SH3BGRL, Accession XM_030373) is another VGAM2230 host target gene. SH3BGRL BINDING SITE is HOST TARGET binding site found in the 3' untranslated region of mRNA encoded by SH3BGRL, corresponding to a HOST TARGET binding site such as BINDING SITE I, BINDING SITE II or BINDING SITE III. Table 2 illustrates the complementarity of the nucleotide sequences of SH3BGRL BINDING SITE, designated SEQ ID:31027, to the nucleotide sequence of VGAM2230 RNA, herein designated VGAM RNA, also designated SEQ ID:4941.

Another function of VGAM2230 is therefore inhibition of SH3 Domain Binding Glutamic Acid-rich Protein Like (SH3BGRL, Accession XM_030373). Accordingly, utilities of VGAM2230 include diagnosis, prevention and treatment of diseases and clinical conditions associated with SH3BGRL. TRIP-Br2 (Accession NM_014755) is another VGAM2230 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16494, to the nucleotide sequence of VGAM2230 RNA, herein designated VGAM RNA, also designated SEQ ID:4941.

Another function of VGAM2230 is therefore inhibition of TRIP-Br2 (Accession NM_014755). Accordingly, utilities of VGAM2230 include diagnosis, prevention and treatment of diseases and clinical conditions associated with TRIP-Br2. LOC157507 (Accession XM_088312) is another VGAM2230 host target gene. LOC157507 BINDING SITE is HOST TARGET binding site found in the 5' untranslated region of mRNA encoded by LOC157507, corresponding to a HOST TARGET binding site such as BINDING SITE I, BINDING SITE II or BINDING SITE III. Table 2 illustrates the complementarity of the nucleotide sequences of LOC157507 BINDING SITE, designated SEQ ID:39607, to the nucleotide sequence of VGAM2230 RNA, herein designated VGAM RNA, also designated SEQ ID:4941.

Another function of VGAM2230 is therefore inhibition of LOC157507 (Accession XM_088312). Accordingly, utilities of VGAM2230 include diagnosis, prevention and treatment of diseases and clinical conditions associated with LOC157507. LOC161742 (Accession XM_091095) is another VGAM2230 host target gene. LOC161742 BINDING SITE is HOST TARGET binding site found in the 3' untranslated region of mRNA encoded by LOC161742, corresponding to a HOST TARGET binding site such as BINDING SITE I, BINDING SITE II or BINDING SITE III. Table 2 illustrates the complementarity of the nucleotide sequences of LOC161742 BINDING SITE, designated SEQ ID:40028, to the nucleotide sequence of VGAM2230 RNA, herein designated VGAM RNA, also designated SEQ ID:4941.

Another function of VGAM2230 is therefore inhibition of LOC161742 (Accession XM_091095). Accordingly, utilities of VGAM2230 include diagnosis, prevention and treatment of diseases and clinical conditions associated with LOC161742. LOC162239 (Accession XM_091439) is another VGAM2230 host target gene. LOC162239 BINDING SITE is HOST TARGET binding site found in the 3' untranslated region of mRNA encoded by LOC162239, corresponding to a HOST TARGET binding site such as BINDING SITE I, BINDING SITE II or BINDING SITE III. Table 2 illustrates the complementarity of the nucleotide sequences of LOC162239 BINDING SITE, designated SEQ ID:40053, to the nucleotide sequence of VGAM2230 RNA, herein designated VGAM RNA, also designated SEQ ID:4941.

Another function of VGAM2230 is therefore inhibition of LOC162239 (Accession XM_091439). Accordingly, utilities of VGAM2230 include diagnosis, prevention and treatment of diseases and clinical conditions associated with LOC162239. LOC199704 (Accession XM_113994) is another VGAM2230 host target gene. LOC199704 BINDING SITE is HOST TARGET binding site found in the 3' untranslated region of mRNA encoded by LOC199704, corresponding to a HOST TARGET binding site such as BINDING SITE I, BINDING SITE II or BINDING SITE III. Table 2 illustrates the complementarity of the nucleotide sequences of LOC199704 BINDING SITE, designated SEQ ID:42602, to the nucleotide sequence of VGAM2230 RNA, herein designated VGAM RNA, also designated SEQ ID:4941.

Another function of VGAM2230 is therefore inhibition of LOC199704 (Accession XM_113994). Accordingly, utilities of VGAM2230 include diagnosis, prevention and treatment of diseases and clinical conditions associated with LOC199704. LOC220469 (Accession XM_084334) is another VGAM2230 host target gene. LOC220469 BINDING SITE is HOST TARGET binding site found in the 5' untranslated region of mRNA encoded by LOC220469, corresponding to a HOST TARGET binding site such as BINDING SITE I, BINDING SITE II or BINDING SITE III. Table 2 illustrates the complementarity of the nucleotide sequences of LOC220469 BINDING SITE, designated SEQ ID:37554, to the nucleotide sequence of VGAM2230 RNA, herein designated VGAM RNA, also designated SEQ ID:4941.

Another function of VGAM2230 is therefore inhibition of LOC220469 (Accession XM_084334). Accordingly, utilities of VGAM2230 include diagnosis, prevention and treatment of diseases and clinical conditions associated with LOC220469. LOC221002 (Accession XM_166156) is another VGAM2230 host target gene. LOC221002 BINDING SITE is HOST TARGET binding site found in the 3' untranslated region of mRNA encoded by LOC221002, corresponding to a HOST TARGET binding site such as BINDING SITE I, BINDING SITE II or BINDING SITE III. Table 2 illustrates the complementarity of the nucleotide sequences of LOC221002 BINDING SITE, designated SEQ ID:43975, to the nucleotide sequence of VGAM2230 RNA, herein designated VGAM RNA, also designated SEQ ID:4941.

Another function of VGAM2230 is therefore inhibition of LOC221002 (Accession XM_166156). Accordingly, utilities of VGAM2230 include diagnosis, prevention and treatment of diseases and clinical conditions associated with LOC221002. LOC56965 (Accession NM_020213) is another VGAM2230 host target gene. LOC56965 BINDING SITE is HOST TARGET binding site found in the 3' untranslated region of mRNA encoded by LOC56965, corresponding to a HOST TARGET binding site such as BINDING SITE I, BINDING SITE II or BINDING SITE III. Table 2 illustrates the complementarity of the nucleotide sequences of LOC56965 BINDING SITE, designated SEQ ID:21454, to the nucleotide sequence of VGAM2230 RNA, herein designated VGAM RNA, also designated SEQ ID:4941.

Another function of VGAM2230 is therefore inhibition of LOC56965 (Accession NM_020213). Accordingly, utilities of VGAM2230 include diagnosis, prevention and treatment of diseases and clinical conditions associated with LOC56965. LOC91050 (Accession XM_035703) is another VGAM2230 host target gene. LOC91050 BINDING SITE is HOST TARGET binding site found in the 3' untranslated region of mRNA encoded by LOC91050, corresponding to a HOST TARGET binding site such as BINDING SITE I, BINDING SITE II or BINDING SITE III. Table 2 illustrates the complementarity of the nucleotide sequences of LOC91050 BINDING SITE, designated SEQ ID:32337, to the nucleotide sequence of VGAM2230 RNA, herein designated VGAM RNA, also designated SEQ ID:4941.

Another function of VGAM2230 is therefore inhibition of LOC91050 (Accession XM_035703). Accordingly, utilities of VGAM2230 include diagnosis, prevention and treatment of diseases and clinical conditions associated with LOC91050. FIG. 1 further provides a conceptual description of a novel bioinformatically detected viral gene of the present invention, referred to here as Viral Genomic Address Messenger 2231 (VGAM2231) viral gene, which modulates expression of respective host target genes thereof, the function and utility of which host target genes is known in the art.

VGAM2231 is a novel bioinformatically detected regulatory, non protein coding, viral micro RNA (miRNA) gene. The method by which VGAM2231 was detected is described hereinabove with reference to FIGS. 1-8.

VGAM2231 gene, herein designated VGAM GENE, is a viral gene contained in the genome of Potato Aucuba Mosaic Virus. VGAM2231 host target gene, herein designated VGAM HOST TARGET GENE, is a human gene contained in the human genome.

VGAM2231 gene encodes a VGAM2231 precursor RNA, herein designated VGAM PRECURSOR RNA. Similar to other miRNA genes, and unlike most ordinary genes, VGAM2231 precursor RNA does not encode a protein. A nucleotide sequence identical or highly similar to the nucleotide sequence of VGAM2231 precursor RNA is designated SEQ ID:2217, and is provided hereinbelow with reference to the sequence listing part. Nucleotide sequence SEQ ID:2217 is located at position 1079 relative to the genome of Potato Aucuba Mosaic Virus.

VGAM2231 precursor RNA folds onto itself, forming VGAM2231 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2231 folded precursor RNA into VGAM2231 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2231 RNA is designated SEQ ID:4942, and is provided hereinbelow with reference to the sequence listing part.

VGAM2231 host target gene, herein designated VGAM HOST TARGET GENE, encodes a corresponding messenger RNA, VGAM2231 host target RNA, herein designated VGAM HOST TARGET RNA. VGAM2231 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2231 RNA, herein designated VGAM RNA, binds complementarily to one or more host target binding sites located in untranslated regions of VGAM2231 host target RNA, herein designated VGAM HOST TARGET RNA. This complementary binding is due to the fact that the nucleotide sequence of VGAM2231 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2231 RNA, herein designated VGAM RNA, may have a different number of host target binding sites in untranslated regions of a VGAM2231 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2231 RNA, herein designated VGAM RNA, to host target binding sites on VGAM2231 host target RNA, herein designated VGAM HOST TARGET RNA, such as BINDING SITE I, BINDING SITE II and BINDING SITE III, inhibits translation of VGAM2231 host target RNA into VGAM2231 host target protein, herein designated VGAM HOST TARGET PROTEIN. VGAM host target protein is therefore outlined by a broken line.

It is appreciated that VGAM2231 host target gene, herein designated VGAM HOST TARGET GENE, in fact represents a plurality of VGAM2231 host target genes. The mRNA of each one of this plurality of VGAM2231 host target genes comprises one or more host target binding sites, each having a nucleotide sequence which is at least partly complementary to VGAM2231 RNA, herein designated VGAM RNA, and which when bound by VGAM2231 RNA causes inhibition of translation of respective one or more VGAM2231 host target proteins.

It is further appreciated by one skilled in the art that the mode of translational inhibition illustrated by FIG. 1 with specific reference to translational inhibition exerted by VGAM2231 gene, herein designated VGAM GENE, on one or more VGAM2231 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2231 is inhibition of expression of host target genes, as part of a novel viral mechanism of attacking a host. Accordingly, utilities of VGAM2231 include diagnosis, prevention and treatment of viral infection by Potato Aucuba Mosaic Virus. Specific functions, and accordingly utilities, of VGAM2231 correlate with, and may be deduced from, the identity of the host target genes which VGAM2231 binds and inhibits, and the function of these host target genes, as elaborated hereinbelow.

Nucleotide sequences of the VGAM2231 precursor RNA, herein designated VGAM PRECURSOR RNA, and of the 'diced' VGAM2231 RNA, herein designated VGAM RNA, and a schematic representation of the secondary folding of VGAM2231 folded precursor RNA, herein designated VGAM FOLDED PRECURSOR RNA, of VGAM2231 are further described hereinbelow with reference to Table 1.

Nucleotide sequences of host target binding sites, such as BINDING SITE-I, BINDING SITE-II and BINDING SITE-III of FIG. 1, found on VGAM2231 host target RNA, and schematic representation of the complementarity of each of these host target binding sites to VGAM2231 RNA, herein designated VGAM RNA, are described hereinbelow with reference to Table 2.

As mentioned hereinabove with reference to FIG. 1, a function of VGAM2231 gene, herein designated VGAM is inhibition of expression of VGAM2231 target genes. It is appreciated that specific functions, and accordingly utilities, of VGAM2231 correlate with, and may be deduced from, the identity of the target genes which VGAM2231 binds and inhibits, and the function of these target genes, as elaborated hereinbelow.

ATPase, Na+/K+ Transporting, Alpha 2 (+) Polypeptide (ATP1A2, Accession NM_000702) is a VGAM2231 host target gene. ATP1A2 BINDING SITE is HOST TARGET binding site found in the 3' untranslated region of mRNA encoded by ATP1A2, corresponding to a HOST TARGET binding site such as BINDING SITE I, BINDING SITE II or BINDING SITE III. Table 2 illustrates the complementarity of the nucleotide sequences of ATP1A2 BINDING SITE, designated SEQ ID:6367, to the nucleotide sequence of VGAM2231 RNA, herein designated VGAM RNA, also designated SEQ ID:4942.

A function of VGAM2231 is therefore inhibition of ATPase, Na+/K+ Transporting, Alpha 2 (+) Polypeptide (ATP1A2, Accession NM_000702). Accordingly, utilities of VGAM2231 include diagnosis, prevention and treatment of diseases and clinical conditions associated with ATP1A2. Protocadherin Alpha 9 (PCDHA9, Accession NM_014005) is another VGAM2231 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:15214, to the nucleotide sequence of VGAM2231 RNA, herein designated VGAM RNA, also designated SEQ ID:4942.

Another function of VGAM2231 is therefore inhibition of Protocadherin Alpha 9 (PCDHA9, Accession NM_014005), a gene which is a calcium-dependent cell-adhesion protein. Accordingly, utilities of VGAM2231 include diagnosis, prevention and treatment of diseases and clinical conditions associated with PCDHA9. The function of PCDHA9 and its association with various diseases and clinical conditions, has been established by previous studies, as described hereinabove with reference to VGAM71. Protein Tyrosine Phosphatase, Receptor Type, A (PTPRA, Accession NM_002836) is another VGAM2231 host target gene. PTPRA BINDING SITE is HOST TARGET binding site found in the 5' untranslated region of mRNA encoded by PTPRA, corresponding to a HOST TARGET binding site such as BINDING SITE I, BINDING SITE II or BINDING SITE III. Table 2 illustrates the complementarity of the nucleotide sequences of PTPRA BINDING SITE, designated SEQ ID:8715, to the nucleotide sequence of VGAM2231 RNA, herein designated VGAM RNA, also designated SEQ ID:4942.

Another function of VGAM2231 is therefore inhibition of Protein Tyrosine Phosphatase, Receptor Type, A (PTPRA, Accession NM_002836), a gene which is the human homolog of the murine PTPase. Accordingly, utilities of VGAM2231 include diagnosis, prevention and treatment of diseases and clinical conditions associated with PTPRA. The function of PTPRA and its association with various diseases and clinical conditions, has been established by previous studies, as described hereinabove with reference to VGAM1205. Splicing Factor, Arginine/serine-rich 1 (splicing factor 2, alternate splicing factor) (SFRS1, Accession NM_006924) is another VGAM2231 host target gene. SFRS1 BINDING SITE is HOST TARGET binding site found in the 3' untranslated region of mRNA encoded by SFRS1, corresponding to a HOST TARGET binding site such as BINDING SITE I, BINDING SITE II or BINDING SITE III. Table 2 illustrates the complementarity of the nucleotide sequences of SFRS1 BINDING SITE, designated SEQ ID:13803, to the nucleotide sequence of VGAM2231 RNA, herein designated VGAM RNA, also designated SEQ ID:4942.

Another function of VGAM2231 is therefore inhibition of Splicing Factor, Arginine/serine-rich 1 (splicing factor 2, alternate splicing factor) (SFRS1, Accession NM_006924), a gene which plays an essential role in pre-mRNA splicing. Accordingly, utilities of VGAM2231 include diagnosis, prevention and treatment of diseases and clinical conditions associated with SFRS1. The function of SFRS1 and its association with various diseases and clinical conditions, has been established by previous studies, as described hereinabove with reference to VGAM323. Solute Carrier Family 22 (extraneuronal monoamine transporter), Member 3 (SLC22A3, Accession NM_021977) is another VGAM2231 host target gene. SLC22A3 BINDING SITE is HOST TARGET binding site found in the 3' untranslated region of mRNA encoded by SLC22A3, corresponding to a HOST TARGET binding site such as BINDING SITE I, BINDING SITE II or BINDING SITE III. Table 2 illustrates the complementarity of the nucleotide sequences of SLC22A3 BINDING SITE, designated SEQ ID:22504, to the nucleotide sequence of VGAM2231 RNA, herein designated VGAM RNA, also designated SEQ ID:4942.

Another function of VGAM2231 is therefore inhibition of Solute Carrier Family 22 (extraneuronal monoamine transporter), Member 3 (SLC22A3, Accession NM_021977), a gene which is a sodium-ion dependent, high affinity carnitine transporter. also transports organic cations without the involvement of sodium. involved in the active cellular uptake of carnitine. Accordingly, utilities of VGAM2231 include diagnosis, prevention and treatment of diseases and clinical conditions associated with SLC22A3. The function of SLC22A3 and its association with various diseases and clinical conditions, has been established by previous studies, as described hereinabove with reference to VGAM2147. Vanin 1 (VNN1, Accession NM_004666) is another VGAM2231 host target gene. VNN1 BINDING SITE is HOST TARGET binding site found in the 3' untranslated region of mRNA encoded by VNN1, corresponding to a HOST TARGET binding site such as BINDING SITE I, BINDING SITE II or BINDING SITE III. Table 2 illustrates the complementarity of the nucleotide sequences of VNN1 BINDING SITE, designated SEQ ID:11040, to the nucleotide sequence of VGAM2231 RNA, herein designated VGAM RNA, also designated SEQ ID:4942.

Another function of VGAM2231 is therefore inhibition of Vanin 1 (VNN1, Accession NM_004666), a gene which may regulate steps in thymus homing and play a role in mammalian sexual development. Accordingly, utilities of VGAM2231 include diagnosis, prevention and treatment of diseases and clinical conditions associated with VNN1. The function of VNN1 and its association with various diseases and clinical conditions, has been established by previous studies, as described hereinabove with reference to VGAM419. Zinc Finger Protein 124 (HZF-16) (ZNF124, Accession NM_003431) is another VGAM2231 host target gene. ZNF124 BINDING SITE is HOST TARGET binding site found in the 3' untranslated region of mRNA encoded by ZNF124, corresponding to a HOST TARGET binding site such as BINDING SITE I, BINDING SITE II or BINDING SITE III. Table 2 illustrates the complementarity of the nucleotide sequences of ZNF124 BINDING SITE, designated SEQ ID:9484, to the nucleotide sequence of VGAM2231 RNA, herein designated VGAM RNA, also designated SEQ ID:4942.

Another function of VGAM2231 is therefore inhibition of Zinc Finger Protein 124 (HZF-16) (ZNF124, Accession NM_003431). Accordingly, utilities of VGAM2231 include diagnosis, prevention and treatment of diseases and clinical conditions associated with ZNF124. Chromosome 22 Open Reading Frame 19 (C22orf19, Accession NM_003678) is another VGAM2231 host target gene. C22orf19 BINDING SITE is HOST TARGET binding site found in the 3' untranslated region of mRNA encoded by C22orf19, corresponding to a HOST TARGET binding site such as BINDING SITE I, BINDING SITE II or BINDING SITE III. Table 2 illustrates the complementarity of the nucleotide sequences of C22orf19 BINDING SITE, designated SEQ ID:9776, to the nucleotide sequence of VGAM2231 RNA, herein designated VGAM RNA, also designated SEQ ID:4942.

Another function of VGAM2231 is therefore inhibition of Chromosome 22 Open Reading Frame 19 (C22orf19, Accession NM_003678). Accordingly, utilities of VGAM2231 include diagnosis, prevention and treatment of diseases and clinical conditions associated with C22orf19. Chromosome 8 Open Reading Frame 2 (C8orf2, Accession NM_007175) is another VGAM2231 host target gene. C8orf2 BINDING SITE1 and C8orf2 BINDING SITE2 are HOST TARGET binding sites found in untranslated regions of mRNA encoded by C8orf2, corresponding to HOST TARGET binding sites such as BINDING SITE I, BINDING SITE II or BINDING SITE III. Table 2 illustrates the complementarity of the nucleotide sequences of C8orf2 BINDING SITE1 and C8orf2 BINDING SITE2, designated SEQ ID:14024 and SEQ ID:14025 respectively, to the nucleotide sequence of VGAM2231 RNA, herein designated VGAM RNA, also designated SEQ ID:4942.

Another function of VGAM2231 is therefore inhibition of Chromosome 8 Open Reading Frame 2 (C8orf2, Accession NM_007175). Accordingly, utilities of VGAM2231 include diagnosis, prevention and treatment of diseases and clinical conditions associated with C8orf2. FLJ23132 (Accession XM_171194) is another VGAM2231 host target gene. FLJ23132 BINDING SITE is HOST TARGET binding site found in the 3' untranslated region of mRNA encoded by FLJ23132, corresponding to a HOST TARGET binding site such as BINDING SITE I, BINDING SITE II or BINDING SITE III. Table 2 illustrates the complementarity of the nucleotide sequences of FLJ23132 BINDING SITE, designated SEQ ID:45982, to the nucleotide sequence of VGAM2231 RNA, herein designated VGAM RNA, also designated SEQ ID:4942.

Another function of VGAM2231 is therefore inhibition of FLJ23132 (Accession XM_171194). Accordingly, utilities of VGAM2231 include diagnosis, prevention and treatment of diseases and clinical conditions associated with FLJ23132.

HRD1 (Accession XM_045498) is another VGAM2231 host target gene. HRD1 BINDING SITE is HOST TARGET binding site found in the 3' untranslated region of mRNA encoded by HRD1, corresponding to a HOST TARGET binding site such as BINDING SITE I, BINDING SITE II or BINDING SITE III. Table 2 illustrates the complementarity of the nucleotide sequences of HRD1 BINDING SITE, designated SEQ ID:34475, to the nucleotide sequence of VGAM2231 RNA, herein designated VGAM RNA, also designated SEQ ID:4942.

Another function of VGAM2231 is therefore inhibition of HRD1 (Accession XM_045498). Accordingly, utilities of VGAM2231 include diagnosis, prevention and treatment of diseases and clinical conditions associated with HRD1. KIAA0009 (Accession NM_014637) is another VGAM2231 host target gene. KIAA0009 BINDING SITE is HOST TARGET binding site found in the 3' untranslated region of mRNA encoded by KIAA0009, corresponding to a HOST TARGET binding site such as BINDING SITE I, BINDING SITE II or BINDING SITE III. Table 2 illustrates the complementarity of the nucleotide sequences of KIAA0009 BINDING SITE, designated SEQ ID:16022, to the nucleotide sequence of VGAM2231 RNA, herein designated VGAM RNA, also designated SEQ ID:4942.

Another function of VGAM2231 is therefore inhibition of KIAA0009 (Accession NM_014637). Accordingly, utilities of VGAM2231 include diagnosis, prevention and treatment of diseases and clinical conditions associated with KIAA0009. MGC13523 (Accession NM_033411) is another VGAM2231 host target gene. MGC13523 BINDING SITE is HOST TARGET binding site found in the 5' untranslated region of mRNA encoded by MGC13523, corresponding to a HOST TARGET binding site such as BINDING SITE I, BINDING SITE II or BINDING SITE III. Table 2 illustrates the complementarity of the nucleotide sequences of MGC13523 BINDING SITE, designated SEQ ID:27234, to the nucleotide sequence of VGAM2231 RNA, herein designated VGAM RNA, also designated SEQ ID:4942.

Another function of VGAM2231 is therefore inhibition of MGC13523 (Accession NM_033411). Accordingly, utilities of VGAM2231 include diagnosis, prevention and treatment of diseases and clinical conditions associated with MGC13523. LOC150481 (Accession XM_086929) is another VGAM2231 host target gene. LOC150481 BINDING SITE is HOST TARGET binding site found in the 3' untranslated region of mRNA encoded by LOC150481, corresponding to a HOST TARGET binding site such as BINDING SITE I, BINDING SITE II or BINDING SITE III. Table 2 illustrates the complementarity of the nucleotide sequences of LOC150481 BINDING SITE, designated SEQ ID:38979, to the nucleotide sequence of VGAM2231 RNA, herein designated VGAM RNA, also designated SEQ ID:4942.

Another function of VGAM2231 is therefore inhibition of LOC150481 (Accession XM_086929). Accordingly, utilities of VGAM2231 include diagnosis, prevention and treatment of diseases and clinical conditions associated with LOC150481. LOC158191 (Accession XM_088505) is another VGAM2231 host target gene. LOC158191 BINDING SITE is HOST TARGET binding site found in the 3' untranslated region of mRNA encoded by LOC158191, corresponding to a HOST TARGET binding site such as BINDING SITE I, BINDING SITE II or BINDING SITE III. Table 2 illustrates the complementarity of the nucleotide sequences of LOC158191 BINDING SITE, designated SEQ ID:39758, to the nucleotide sequence of VGAM2231 RNA, herein designated VGAM RNA, also designated SEQ ID:4942.

Another function of VGAM2231 is therefore inhibition of LOC158191 (Accession XM_088505). Accordingly, utilities of VGAM2231 include diagnosis, prevention and treatment of diseases and clinical conditions associated with LOC158191. LOC201516 (Accession XM_113974) is another VGAM2231 host target gene. LOC201516 BINDING SITE is HOST TARGET binding site found in the 5' untranslated region of mRNA encoded by LOC201516, corresponding to a HOST TARGET binding site such as BINDING SITE I, BINDING SITE II or BINDING SITE III. Table 2 illustrates the complementarity of the nucleotide sequences of LOC201516 BINDING SITE, designated SEQ ID:42582, to the nucleotide sequence of VGAM2231 RNA, herein designated VGAM RNA, also designated SEQ ID:4942.

Another function of VGAM2231 is therefore inhibition of LOC201516 (Accession XM_113974). Accordingly, utilities of VGAM2231 include diagnosis, prevention and treatment of diseases and clinical conditions associated with LOC201516. LOC219672 (Accession XM_166111) is another VGAM2231 host target gene. LOC219672 BINDING SITE is HOST TARGET binding site found in the 5' untranslated region of mRNA encoded by LOC219672, corresponding to a HOST TARGET binding site such as BINDING SITE I, BINDING SITE II or BINDING SITE III. Table 2 illustrates the complementarity of the nucleotide sequences of LOC219672 BINDING SITE, designated SEQ ID:43890, to the nucleotide sequence of VGAM2231 RNA, herein designated VGAM RNA, also designated SEQ ID:4942.

Another function of VGAM2231 is therefore inhibition of LOC219672 (Accession XM_166111). Accordingly, utilities of VGAM2231 include diagnosis, prevention and treatment of diseases and clinical conditions associated with LOC219672. LOC219988 (Accession XM_166223) is another VGAM2231 host target gene. LOC219988 BINDING SITE is HOST TARGET binding site found in the 5' untranslated region of mRNA encoded by LOC219988, corresponding to a HOST TARGET binding site such as BINDING SITE I, BINDING SITE II or BINDING SITE III. Table 2 illustrates the complementarity of the nucleotide sequences of LOC219988 BINDING SITE, designated SEQ ID:44042, to the nucleotide sequence of VGAM2231 RNA, herein designated VGAM RNA, also designated SEQ ID:4942.

Another function of VGAM2231 is therefore inhibition of LOC219988 (Accession XM_166223). Accordingly, utilities of VGAM2231 include diagnosis, prevention and treatment of diseases and clinical conditions associated with LOC219988. LOC90190 (Accession XM_029758) is another VGAM2231 host target gene. LOC90190 BINDING SITE is HOST TARGET binding site found in the 3' untranslated region of mRNA encoded by LOC90190, corresponding to a HOST TARGET binding site such as BINDING SITE I, BINDING SITE II or BINDING SITE III. Table 2 illustrates the complementarity of the nucleotide sequences of LOC90190 BINDING SITE, designated SEQ ID:30947, to the nucleotide sequence of VGAM2231 RNA, herein designated VGAM RNA, also designated SEQ ID:4942.

Another function of VGAM2231 is therefore inhibition of LOC90190 (Accession XM_029758). Accordingly, utilities of VGAM2231 include diagnosis, prevention and treatment of diseases and clinical conditions associated with LOC90190. LOC91380 (Accession XM_038134) is another VGAM2231 host target gene. LOC91380 BINDING SITE is HOST TARGET binding site found in the 3' untranslated region of mRNA encoded by LOC91380, corresponding to a HOST TARGET binding site such as BINDING SITE I, BINDING SITE II or BINDING SITE III. Table 2 illustrates the complementarity of the nucleotide sequences of LOC91380 BINDING SITE, designated SEQ ID:32758, to the nucleotide sequence of VGAM2231 RNA, herein designated VGAM RNA, also designated SEQ ID:4942.

Another function of VGAM2231 is therefore inhibition of LOC91380 (Accession XM_038134). Accordingly, utilities of VGAM2231 include diagnosis, prevention and treatment of diseases and clinical conditions associated with LOC91380. FIG. 1 further provides a conceptual description of a novel bioinformatically detected viral gene of the present invention, referred to here as Viral Genomic Address Messenger 2232 (VGAM2232) viral gene, which modulates expression of respective host target genes thereof, the function and utility of which host target genes is known in the art.

VGAM2232 is a novel bioinformatically detected regulatory, non protein coding, viral micro RNA (miRNA) gene. The method by which VGAM2232 was detected is described hereinabove with reference to FIGS. 1-8.

VGAM2232 gene, herein designated VGAM GENE, is a viral gene contained in the genome of Porcine Epidemic Diarrhea Virus. VGAM2232 host target gene, herein designated VGAM HOST TARGET GENE, is a human gene contained in the human genome.

VGAM2232 gene encodes a VGAM2232 precursor RNA, herein designated VGAM PRECURSOR RNA. Similar to other miRNA genes, and unlike most ordinary genes, VGAM2232 precursor RNA does not encode a protein. A nucleotide sequence identical or highly similar to the nucleotide sequence of VGAM2232 precursor RNA is designated SEQ ID:2218, and is provided hereinbelow with reference to the sequence listing part. Nucleotide sequence SEQ ID:2218 is located at position 2170 relative to the genome of Porcine Epidemic Diarrhea Virus.

VGAM2232 precursor RNA folds onto itself, forming VGAM2232 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2232 folded precursor RNA into VGAM2232 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2232 RNA is designated SEQ ID:4943, and is provided hereinbelow with reference to the sequence listing part.

VGAM2232 host target gene, herein designated VGAM HOST TARGET GENE, encodes a corresponding messenger RNA, VGAM2232 host target RNA, herein designated VGAM HOST TARGET RNA. VGAM2232 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2232 RNA, herein designated VGAM RNA, binds complementarily to one or more host target binding sites located in untranslated regions of VGAM2232 host target RNA, herein designated VGAM HOST TARGET RNA. This complementary binding is due to the fact that the nucleotide sequence of VGAM2232 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2232 RNA, herein designated VGAM RNA, may have a different number of host target binding sites in untranslated regions of a VGAM2232 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2232 RNA, herein designated VGAM RNA, to host target binding sites on VGAM2232 host target RNA, herein designated VGAM HOST TARGET RNA, such as BINDING SITE I, BINDING SITE II and BINDING SITE III, inhibits translation of VGAM2232 host target RNA into VGAM2232 host target protein, herein designated VGAM HOST TARGET PROTEIN. VGAM host target protein is therefore outlined by a broken line.

It is appreciated that VGAM2232 host target gene, herein designated VGAM HOST TARGET GENE, in fact represents a plurality of VGAM2232 host target genes. The mRNA of each one of this plurality of VGAM2232 host target genes comprises one or more host target binding sites, each having a nucleotide sequence which is at least partly complementary to VGAM2232 RNA, herein designated VGAM RNA, and which when bound by VGAM2232 RNA causes inhibition of translation of respective one or more VGAM2232 host target proteins.

It is further appreciated by one skilled in the art that the mode of translational inhibition illustrated by FIG. 1 with specific reference to translational inhibition exerted by VGAM2232 gene, herein designated VGAM GENE, on one or more VGAM2232 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2232 is inhibition of expression of host target genes, as part of a novel viral mechanism of attacking a host. Accordingly, utilities of VGAM2232 include diagnosis, prevention and treatment of viral infection by Porcine Epidemic Diarrhea Virus. Specific functions, and accordingly utilities, of VGAM2232 correlate with, and may be deduced from, the identity of the host target genes which VGAM2232 binds and inhibits, and the function of these host target genes, as elaborated hereinbelow.

Nucleotide sequences of the VGAM2232 precursor RNA, herein designated VGAM PRECURSOR RNA, and of the 'diced' VGAM2232 RNA, herein designated VGAM RNA, and a schematic representation of the secondary folding of VGAM2232 folded precursor RNA, herein designated VGAM FOLDED PRECURSOR RNA, of VGAM2232 are further described hereinbelow with reference to Table 1.

Nucleotide sequences of host target binding sites, such as BINDING SITE-I, BINDING SITE-II and BINDING SITE-III of FIG. 1, found on VGAM2232 host target RNA, and schematic representation of the complementarity of each of these host target binding sites to VGAM2232 RNA, herein designated VGAM RNA, are described hereinbelow with reference to Table 2.

As mentioned hereinabove with reference to FIG. 1, a function of VGAM2232 gene, herein designated VGAM is inhibition of expression of VGAM2232 target genes. It is appreciated that specific functions, and accordingly utilities, of VGAM2232 correlate with, and may be deduced from, the identity of the target genes which VGAM2232 binds and inhibits, and the function of these target genes, as elaborated hereinbelow.

ATPase, Cu++ Transporting, Alpha Polypeptide (Menkes syndrome) (ATP7A, Accession NM_000052) is a VGAM2232 host target gene. ATP7A BINDING SITE is HOST TARGET binding site found in the 3' untranslated region of mRNA encoded by ATP7A, corresponding to a HOST TARGET binding site such as BINDING SITE I, BINDING SITE II or BINDING SITE III. Table 2 illustrates the complementarity of the nucleotide sequences of ATP7A BINDING SITE, designated SEQ ID:5494, to the nucleotide sequence of VGAM2232 RNA, herein designated VGAM RNA, also designated SEQ ID:4943.

A function of VGAM2232 is therefore inhibition of ATPase, Cu++ Transporting, Alpha Polypeptide (Menkes syndrome) (ATP7A, Accession NM_000052). Accordingly, utilities of VGAM2232 include diagnosis, prevention and treatment of diseases and clinical conditions associated with ATP7A. Branched Chain Aminotransferase 1, Cytosolic (BCAT1, Accession XM_038659) is another VGAM2232 host target gene. BCAT1 BINDING SITE is HOST TARGET binding site found in the 3' untranslated region of mRNA encoded by BCAT1, corresponding to a HOST TARGET binding site such as BINDING SITE I, BINDING SITE II or BINDING SITE III. Table 2 illustrates the complementarity of the nucleotide sequences of BCAT1 BINDING SITE, designated SEQ ID:32894, to the nucleotide sequence of VGAM2232 RNA, herein designated VGAM RNA, also designated SEQ ID:4943.

Another function of VGAM2232 is therefore inhibition of Branched Chain Aminotransferase 1, Cytosolic (BCAT1, Accession XM_038659), a gene which catalyzes of the essential branched chain leucine, isoleucine, and valine. Accordingly, utilities of VGAM2232 include diagnosis, prevention and treatment of diseases and clinical conditions associated with BCAT1. The function of BCAT1 and its association with various diseases and clinical conditions, has been established by previous studies, as described hereinabove with reference to VGAM1367. Frizzled Homolog 4 (Drosophila) (FZD4, Accession NM_012193) is another VGAM2232 host target gene. FZD4 BINDING SITE is HOST TARGET binding site found in the 3' untranslated region of mRNA encoded by FZD4, corresponding to a HOST TARGET binding site such as BINDING SITE I, BINDING SITE II or BINDING SITE III. Table 2 illustrates the complementarity of the nucleotide sequences of FZD4 BINDING SITE, designated SEQ ID:14481, to the nucleotide sequence of VGAM2232 RNA, herein designated VGAM RNA, also designated SEQ ID:4943.

Another function of VGAM2232 is therefore inhibition of Frizzled Homolog 4 (Drosophila) (FZD4, Accession NM_012193), a gene which may function in cell polarity, cell fate specification and cancer; similar to frizzled receptor family, has seven transmembrane domains. Accordingly, utilities of VGAM2232 include diagnosis, prevention and treatment of diseases and clinical conditions associated with FZD4. The function of FZD4 and its association with various diseases and clinical conditions, has been established by previous studies, as described hereinabove with reference to VGAM309. Mitogen-activated Protein Kinase 1 (MAPK1, Accession NM_002745) is another VGAM2232 host target gene. MAPK1 BINDING SITE is HOST TARGET binding site found in the 3' untranslated region of mRNA encoded by MAPK1, corresponding to a HOST TARGET binding site such as BINDING SITE I, BINDING SITE II or BINDING SITE III. Table 2 illustrates the complementarity of the nucleotide sequences of MAPK1 BINDING SITE, designated SEQ ID:8618, to the nucleotide sequence of VGAM2232 RNA, herein designated VGAM RNA, also designated SEQ ID:4943.

Another function of VGAM2232 is therefore inhibition of Mitogen-activated Protein Kinase 1 (MAPK1, Accession NM_002745), a gene which phosphorylates microtubule-associated protein-2 (map2). myelin basic protein (mbp), and elk-1; may promote entry in the cell cycle. Accordingly, utilities of VGAM2232 include diagnosis, prevention and treatment of diseases and clinical conditions associated with MAPK1. The function of MAPK1 and its association with various diseases and clinical conditions, has been established by previous studies, as described hereinabove with reference to VGAM217. RAD52 Homolog (S. cerevisiae) (RAD52, Accession NM_134422) is another VGAM2232 host target gene. RAD52 BINDING SITE1 through RAD52 BINDING SITE3 are HOST TARGET binding sites found in untranslated regions of mRNA encoded by RAD52, corresponding to HOST TARGET binding sites such as BINDING SITE I, BINDING SITE II or BINDING SITE III. Table 2 illustrates the complementarity of the nucleotide sequences of RAD52 BINDING SITE1 through RAD52 BINDING SITE3, designated SEQ ID:28641, SEQ ID:28651 and SEQ ID:28660 respectively, to the nucleotide sequence of VGAM2232 RNA, herein designated VGAM RNA, also designated SEQ ID:4943.

Another function of VGAM2232 is therefore inhibition of RAD52 Homolog (S. cerevisiae) (RAD52, Accession NM_134422). Accordingly, utilities of VGAM2232 include diagnosis, prevention and treatment of diseases and clinical conditions associated with RAD52. DKFZP434C171 (Accession NM_015621) is another VGAM2232 host target gene. DKFZP434C171 BINDING SITE is HOST TARGET binding site found in the 3' untranslated region of mRNA encoded by DKFZP434C171, corresponding to a HOST TARGET binding site such as BINDING SITE I, BINDING SITE II or BINDING SITE III. Table 2 illustrates the complementarity of the nucleotide sequences of DKFZP434C171 BINDING SITE, designated SEQ ID:17881, to the nucleotide sequence of VGAM2232 RNA, herein designated VGAM RNA, also designated SEQ ID:4943.

Another function of VGAM2232 is therefore inhibition of DKFZP434C171 (Accession NM_015621). Accordingly, utilities of VGAM2232 include diagnosis, prevention and treatment of diseases and clinical conditions associated with DKFZP434C171. KIAA0285 (Accession NM_014807) is another VGAM2232 host target gene. KIAA0285 BINDING SITE is HOST TARGET binding site found in the 5' untranslated region of mRNA encoded by KIAA0285, corresponding to a HOST TARGET binding site such as BINDING SITE I, BINDING SITE II or BINDING SITE III. Table 2 illustrates the complementarity of the nucleotide sequences of KIAA0285 BINDING SITE, designated SEQ ID:16747, to the nucleotide sequence of VGAM2232 RNA, herein designated VGAM RNA, also designated SEQ ID:4943.

Another function of VGAM2232 is therefore inhibition of KIAA0285 (Accession NM_014807). Accordingly, utilities of VGAM2232 include diagnosis, prevention and treatment of diseases and clinical conditions associated with KIAA0285. KIAA0408 (Accession NM_014702) is another VGAM2232 host target gene. KIAA0408 BINDING SITE is HOST TARGET binding site found in the 5' untranslated region of mRNA encoded by KIAA0408, corresponding to a HOST TARGET binding site such as BINDING SITE I, BINDING SITE II or BINDING SITE III. Table 2 illustrates the complementarity of the nucleotide sequences of KIAA0408 BINDING SITE, designated SEQ ID:16237, to the nucleotide sequence of VGAM2232 RNA, herein designated VGAM RNA, also designated SEQ ID:4943.

Another function of VGAM2232 is therefore inhibition of KIAA0408 (Accession NM_014702). Accordingly, utilities of VGAM2232 include diagnosis, prevention and treatment of diseases and clinical conditions associated with KIAA0408. KIAA1871 (Accession XM_028409) is another VGAM2232 host target gene. KIAA1871 BINDING SITE is HOST TARGET binding site found in the 3' untranslated region of mRNA encoded by KIAA1871, corresponding to a HOST TARGET binding site such as BINDING SITE I, BINDING SITE II or BINDING SITE III. Table 2 illustrates the complementarity of the nucleotide sequences of KIAA1871 BINDING SITE, designated SEQ ID:30707, to the nucleotide sequence of VGAM2232 RNA, herein designated VGAM RNA, also designated SEQ ID:4943.

Another function of VGAM2232 is therefore inhibition of KIAA1871 (Accession XM_028409). Accordingly, utilities of VGAM2232 include diagnosis, prevention and treatment of diseases and clinical conditions associated with KIAA1871. Phosphatase, Orphan 1 (phospho1, Accession XM_091572) is another VGAM2232 host target gene. phospho1 BINDING SITE is HOST TARGET binding site found in the 3' untranslated region of mRNA encoded by phospho1, corresponding to a HOST TARGET binding site such as BINDING SITE I, BINDING SITE II or BINDING SITE III. Table 2 illustrates the complementarity of the nucleotide sequences of phospho1 BINDING SITE, designated SEQ ID:40065, to the nucleotide sequence of VGAM2232 RNA, herein designated VGAM RNA, also designated SEQ ID:4943.

Another function of VGAM2232 is therefore inhibition of Phosphatase, Orphan 1 (phospho1, Accession XM_091572). Accordingly, utilities of VGAM2232 include diagnosis, prevention and treatment of diseases and clinical conditions associated with phospho1. PPI5PIV (Accession NM_019892) is another VGAM2232 host target gene. PPI5PIV BINDING SITE is HOST TARGET binding site found in the 3' untranslated region of mRNA encoded by PPI5PIV, corresponding to a HOST TARGET binding site such as BINDING SITE I, BINDING SITE II or BINDING SITE III. Table 2 illustrates the complementarity of the nucleotide sequences of PPI5PIV BINDING SITE, designated SEQ ID:21273, to the nucleotide sequence of VGAM2232 RNA, herein designated VGAM RNA, also designated SEQ ID:4943.

Another function of VGAM2232 is therefore inhibition of PPI5PIV (Accession NM_019892). Accordingly, utilities of VGAM2232 include diagnosis, prevention and treatment of diseases and clinical conditions associated with PPI5PIV. Thiamine Triphosphatase (THTPA, Accession NM_024328) is another VGAM2232 host target gene. THTPA BINDING SITE is HOST TARGET binding site found in the 3' untranslated region of mRNA encoded by THTPA, corresponding to a HOST TARGET binding site such as BINDING SITE I, BINDING SITE II or BINDING SITE III. Table 2 illustrates the complementarity of the nucleotide sequences of THTPA BINDING SITE, designated SEQ ID:23621, to the nucleotide sequence of VGAM2232 RNA, herein designated VGAM RNA, also designated SEQ ID:4943.

Another function of VGAM2232 is therefore inhibition of Thiamine Triphosphatase (THTPA, Accession NM_024328). Accordingly, utilities of VGAM2232 include diagnosis, prevention and treatment of diseases and clinical conditions associated with THTPA. TSPEAR (Accession NM_144991) is another VGAM2232 host target gene. TSPEAR BINDING SITE is HOST TARGET binding site found in the 3' untranslated region of mRNA encoded by TSPEAR, corresponding to a HOST TARGET binding site such as BINDING SITE I, BINDING SITE II or BINDING SITE III. Table 2 illustrates the complementarity of the nucleotide sequences of TSPEAR BINDING SITE, designated SEQ ID:29594, to the nucleotide sequence of VGAM2232 RNA, herein designated VGAM RNA, also designated SEQ ID:4943.

Another function of VGAM2232 is therefore inhibition of TSPEAR (Accession NM_144991). Accordingly, utilities of VGAM2232 include diagnosis, prevention and treatment of diseases and clinical conditions associated with TSPEAR. Zinc Finger Protein 297B (ZNF297B, Accession XM_088524) is another VGAM2232 host target gene. ZNF297B BINDING SITE1 and ZNF297B BINDING SITE2 are HOST TARGET binding sites found in untranslated regions of mRNA encoded by ZNF297B, corresponding to HOST TARGET binding sites such as BINDING SITE I, BINDING SITE II or BINDING SITE III. Table 2 illustrates the complementarity of the nucleotide sequences of ZNF297B BINDING SITE1 and ZNF297B BINDING SITE2, designated SEQ ID:39769 and SEQ ID:15218 respectively, to the nucleotide sequence of VGAM2232 RNA, herein designated VGAM RNA, also designated SEQ ID:4943.

Another function of VGAM2232 is therefore inhibition of Zinc Finger Protein 297B (ZNF297B, Accession XM_088524). Accordingly, utilities of VGAM2232 include diagnosis, prevention and treatment of diseases and clinical conditions associated with ZNF297B. LOC146520 (Accession XM_085492) is another VGAM2232 host target gene. LOC146520 BINDING SITE is HOST TARGET binding site found in the 5' untranslated region of mRNA encoded by LOC146520, corresponding to a HOST TARGET binding site such as BINDING SITE I, BINDING SITE II or BINDING SITE III. Table 2 illustrates the complementarity of the nucleotide sequences of LOC146520 BINDING SITE, designated SEQ ID:38188, to the nucleotide sequence of VGAM2232 RNA, herein designated VGAM RNA, also designated SEQ ID:4943.

Another function of VGAM2232 is therefore inhibition of LOC146520 (Accession XM_085492). Accordingly, utilities of VGAM2232 include diagnosis, prevention and treatment of diseases and clinical conditions associated with LOC146520. LOC149566 (Accession XM_097670) is another VGAM2232 host target gene. LOC149566 BINDING SITE is HOST TARGET binding site found in the 3' untranslated region of mRNA encoded by LOC149566, corresponding to a HOST TARGET binding site such as BINDING SITE I, BINDING SITE II or BINDING SITE III. Table 2 illustrates the complementarity of the nucleotide sequences of LOC149566 BINDING SITE, designated SEQ ID:41013, to the nucleotide sequence of VGAM2232 RNA, herein designated VGAM RNA, also designated SEQ ID:4943.

Another function of VGAM2232 is therefore inhibition of LOC149566 (Accession XM_097670). Accordingly, utilities of VGAM2232 include diagnosis, prevention and treatment of diseases and clinical conditions associated with LOC149566. LOC155435 (Accession XM_088257) is another VGAM2232 host target gene. LOC155435 BINDING SITE is HOST TARGET binding site found in the 3' untranslated region of mRNA encoded by LOC155435, corresponding to a HOST TARGET binding site such as BINDING SITE I, BINDING SITE II or BINDING SITE III. Table 2 illustrates the complementarity of the nucleotide sequences of LOC155435 BINDING SITE, designated SEQ ID:39565, to the nucleotide sequence of VGAM2232 RNA, herein designated VGAM RNA, also designated SEQ ID:4943.

Another function of VGAM2232 is therefore inhibition of LOC155435 (Accession XM_088257). Accordingly, utilities of VGAM2232 include diagnosis, prevention and treatment of diseases and clinical conditions associated with LOC155435. LOC202460 (Accession XM_114493) is another VGAM2232 host target gene. LOC202460 BINDING SITE is HOST TARGET binding site found in the 5' untranslated region of mRNA encoded by LOC202460, corresponding to a HOST TARGET binding site such as BINDING SITE I, BINDING SITE II or BINDING SITE III. Table 2 illustrates the complementarity of the nucleotide sequences of LOC202460 BINDING SITE, designated SEQ ID:42981, to the nucleotide sequence of VGAM2232 RNA, herein designated VGAM RNA, also designated SEQ ID:4943.

Another function of VGAM2232 is therefore inhibition of LOC202460 (Accession XM_114493). Accordingly, utilities of VGAM2232 include diagnosis, prevention and treatment of diseases and clinical conditions associated with LOC202460. LOC203080 (Accession XM_114623) is another VGAM2232 host target gene. LOC203080 BINDING SITE is HOST TARGET binding site found in the 5' untranslated region of mRNA encoded by LOC203080, corresponding to a HOST TARGET binding site such as BINDING SITE I, BINDING SITE II or BINDING SITE III. Table 2 illustrates the complementarity of the nucleotide sequences of LOC203080 BINDING SITE, designated SEQ ID:43003, to the nucleotide sequence of VGAM2232 RNA, herein designated VGAM RNA, also designated SEQ ID:4943.

Another function of VGAM2232 is therefore inhibition of LOC203080 (Accession XM_114623). Accordingly, utilities of VGAM2232 include diagnosis, prevention and treatment of diseases and clinical conditions associated with LOC203080. FIG. 1 further provides a conceptual description of a novel bioinformatically detected viral gene of the present invention, referred to here as Viral Genomic Address Messenger 2233 (VGAM2233) viral gene, which modulates expression of respective host target genes thereof, the function and utility of which host target genes is known in the art.

VGAM2233 is a novel bioinformatically detected regulatory, non protein coding, viral micro RNA (miRNA) gene. The method by which VGAM2233 was detected is described hereinabove with reference to FIGS. 1-8.

VGAM2233 gene, herein designated VGAM GENE, is a viral gene contained in the genome of Porcine Epidemic Diarrhea Virus. VGAM2233 host target gene, herein designated VGAM HOST TARGET GENE, is a human gene contained in the human genome.

VGAM2233 gene encodes a VGAM2233 precursor RNA, herein designated VGAM PRECURSOR RNA. Similar to other miRNA genes, and unlike most ordinary genes, VGAM2233 precursor RNA does not encode a protein. A nucleotide sequence identical or highly similar to the nucleotide sequence of VGAM2233 precursor RNA is designated SEQ ID:2219, and is provided hereinbelow with reference to the sequence listing part. Nucleotide sequence SEQ ID:2219 is located at position 17365 relative to the genome of Porcine Epidemic Diarrhea Virus.

VGAM2233 precursor RNA folds onto itself, forming VGAM2233 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2233 folded precursor RNA into VGAM2233 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2233 RNA is designated SEQ ID:4944, and is provided hereinbelow with reference to the sequence listing part.

VGAM2233 host target gene, herein designated VGAM HOST TARGET GENE, encodes a corresponding messenger RNA, VGAM2233 host target RNA, herein designated VGAM HOST TARGET RNA. VGAM2233 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2233 RNA, herein designated VGAM RNA, binds complementarily to one or more host target binding sites located in untranslated regions of VGAM2233 host target RNA, herein designated VGAM HOST TARGET RNA. This complementary binding is due to the fact that the nucleotide sequence of VGAM2233 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2233 RNA, herein designated VGAM RNA, may have a different number of host target binding sites in untranslated regions of a VGAM2233 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2233 RNA, herein designated VGAM RNA, to host target binding sites on VGAM2233 host target RNA, herein designated VGAM HOST TARGET RNA, such as BINDING SITE I, BINDING SITE II and BINDING SITE III, inhibits translation of VGAM2233 host target RNA into VGAM2233 host target protein, herein designated VGAM HOST TARGET PROTEIN. VGAM host target protein is therefore outlined by a broken line.

It is appreciated that VGAM2233 host target gene, herein designated VGAM HOST TARGET GENE, in fact represents a plurality of VGAM2233 host target genes. The mRNA of each one of this plurality of VGAM2233 host target genes comprises one or more host target binding sites, each having a nucleotide sequence which is at least partly complementary to VGAM2233 RNA, herein designated VGAM RNA, and which when bound by VGAM2233 RNA causes inhibition of translation of respective one or more VGAM2233 host target proteins.

It is further appreciated by one skilled in the art that the mode of translational inhibition illustrated by FIG. 1 with specific reference to translational inhibition exerted by VGAM2233 gene, herein designated VGAM GENE, on one or more VGAM2233 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2233 is inhibition of expression of host target genes, as part of a novel viral mechanism of attacking a host. Accordingly, utilities of VGAM2233 include diagnosis, prevention and treatment of viral infection by Porcine Epidemic Diarrhea Virus. Specific functions, and accordingly utilities, of VGAM2233 correlate with, and may be deduced from, the identity of the host target genes which VGAM2233 binds and inhibits, and the function of these host target genes, as elaborated hereinbelow.

Nucleotide sequences of the VGAM2233 precursor RNA, herein designated VGAM PRECURSOR RNA, and of the 'diced' VGAM2233 RNA, herein designated VGAM RNA, and a schematic representation of the secondary folding of VGAM2233 folded precursor RNA, herein designated VGAM FOLDED PRECURSOR RNA, of VGAM2233 are further described hereinbelow with reference to Table 1.

Nucleotide sequences of host target binding sites, such as BINDING SITE-I, BINDING SITE-II and BINDING SITE-III of FIG. 1, found on VGAM2233 host target RNA, and schematic representation of the complementarity of each of these host target binding sites to VGAM2233 RNA, herein designated VGAM RNA, are described hereinbelow with reference to Table 2.

As mentioned hereinabove with reference to FIG. 1, a function of VGAM2233 gene, herein designated VGAM is inhibition of expression of VGAM2233 target genes. It is appreciated that specific functions, and accordingly utilities, of VGAM2233 correlate with, and may be deduced from, the identity of the target genes which VGAM2233 binds and inhibits, and the function of these target genes, as elaborated hereinbelow.

SRY (sex determining region Y)-box 12 (SOX12, Accession NM_006943) is a VGAM2233 host target gene. SOX12 BINDING SITE is HOST TARGET binding site found in the 3' untranslated region of mRNA encoded by SOX12, corresponding to a HOST TARGET binding site such as BINDING SITE I, BINDING SITE II or BINDING SITE III. Table 2 illustrates the complementarity of the nucleotide sequences of SOX12 BINDING SITE, designated SEQ ID:13829, to the nucleotide sequence of VGAM2233 RNA, herein designated VGAM RNA, also designated SEQ ID:4944.

A function of VGAM2233 is therefore inhibition of SRY (sex determining region Y)-box 12 (SOX12, Accession NM_006943). Accordingly, utilities of VGAM2233 include diagnosis, prevention and treatment of diseases and clinical conditions associated with SOX12. Bromodomain and PHD Finger Containing, 3 (BRPF3, Accession XM_166450) is another VGAM2233 host target gene. BRPF3 BINDING SITE is HOST TARGET binding site found in the 3' untranslated region of mRNA encoded by BRPF3, corresponding to a HOST TARGET binding site such as BINDING SITE I, BINDING SITE II or BINDING SITE III. Table 2 illustrates the complementarity of the nucleotide sequences of BRPF3 BINDING SITE, designated SEQ ID:44344, to the nucleotide sequence of VGAM2233 RNA, herein designated VGAM RNA, also designated SEQ ID:4944.

Another function of VGAM2233 is therefore inhibition of Bromodomain and PHD Finger Containing, 3 (BRPF3, Accession XM_166450). Accordingly, utilities of VGAM2233 include diagnosis, prevention and treatment of diseases and clinical conditions associated with BRPF3. KIAA1202 (Accession XM_050478) is another VGAM2233 host target gene. KIAA1202 BINDING SITE is HOST TARGET binding site found in the 3' untranslated region of mRNA encoded by KIAA1202, corresponding to a HOST TARGET binding site such as BINDING SITE I, BINDING SITE II or BINDING SITE III. Table 2 illustrates the complementarity of the nucleotide sequences of KIAA1202 BINDING SITE, designated SEQ ID:35638, to the nucleotide sequence of VGAM2233 RNA, herein designated VGAM RNA, also designated SEQ ID:4944.

Another function of VGAM2233 is therefore inhibition of KIAA1202 (Accession XM_050478). Accordingly, utilities of VGAM2233 include diagnosis, prevention and treatment of diseases and clinical conditions associated with KIAA1202. Lipoma HMGIC Fusion Partner-like 2 (LHFPL2, Accession XM_046054) is another VGAM2233 host target gene. LHFPL2 BINDING SITE is HOST TARGET binding site found in the 3' untranslated region of mRNA encoded by LHFPL2, corresponding to a HOST TARGET binding site such as BINDING SITE I, BINDING SITE II or BINDING SITE III. Table 2 illustrates the complementarity of the nucleotide sequences of LHFPL2 BINDING SITE, designated SEQ ID:34658, to the nucleotide sequence of VGAM2233 RNA, herein designated VGAM RNA, also designated SEQ ID:4944.

Another function of VGAM2233 is therefore inhibition of Lipoma HMGIC Fusion Partner-like 2 (LHFPL2, Accession XM_046054). Accordingly, utilities of VGAM2233 include diagnosis, prevention and treatment of diseases and clinical conditions associated with LHFPL2. MGC1842 (Accession XM_037797) is another VGAM2233 host target gene. MGC1842 BINDING SITE is HOST TARGET binding site found in the 3' untranslated region of mRNA encoded by MGC1842, corresponding to a HOST TARGET binding site such as BINDING SITE I, BINDING SITE II or BINDING SITE III. Table 2 illustrates the complementarity of the nucleotide sequences of MGC1842 BINDING SITE, designated SEQ ID:32684, to the nucleotide sequence of VGAM2233 RNA, herein designated VGAM RNA, also designated SEQ ID:4944.

Another function of VGAM2233 is therefore inhibition of MGC1842 (Accession XM_037797). Accordingly, utilities of VGAM2233 include diagnosis, prevention and treatment of diseases and clinical conditions associated with MGC1842. p21(CDKN1A)-activated Kinase 7 (PAK7, Accession XM_045653) is another VGAM2233 host target gene. PAK7 BINDING SITE is HOST TARGET binding site found in the 3' untranslated region of mRNA encoded by PAK7, corresponding to a HOST TARGET binding site such as BINDING SITE I, BINDING SITE II or BINDING SITE III. Table 2 illustrates the complementarity of the nucleotide sequences of PAK7 BINDING SITE, designated SEQ ID:34509, to the nucleotide sequence of VGAM2233 RNA, herein designated VGAM RNA, also designated SEQ ID:4944.

Another function of VGAM2233 is therefore inhibition of p21(CDKN1A)-activated Kinase 7 (PAK7, Accession XM_045653). Accordingly, utilities of VGAM2233 include diagnosis, prevention and treatment of diseases and clinical conditions associated with PAK7. RALGPS1A (Accession NM_014636) is another VGAM2233 host target gene. RALGPS1A BINDING SITE is HOST TARGET binding site found in the 3' untranslated region of mRNA encoded by RALGPS1A, corresponding to a HOST TARGET binding site such as BINDING SITE I, BINDING SITE II or BINDING SITE III. Table 2 illustrates the complementarity of the nucleotide sequences of RALGPS1A BINDING SITE, designated SEQ ID:16014, to the nucleotide sequence of VGAM2233 RNA, herein designated VGAM RNA, also designated SEQ ID:4944.

Another function of VGAM2233 is therefore inhibition of RALGPS1A (Accession NM_014636). Accordingly, utilities of VGAM2233 include diagnosis, prevention and treatment of diseases and clinical conditions associated with RALGPS1A. Serine Protease Inhibitor-like, with Kunitz and WAP Domains 1 (eppin) (SPINLW1, Accession NM_020398) is another VGAM2233 host target gene. SPINLW1 BINDING SITE is HOST TARGET binding site found in the 3' untranslated region of mRNA encoded by SPINLW1, corresponding to a HOST TARGET binding site such as BINDING SITE I, BINDING SITE II or BINDING SITE III. Table 2 illustrates the complementarity of the nucleotide sequences of SPINLW1 BINDING SITE, designated SEQ ID:21666, to the nucleotide sequence of VGAM2233 RNA, herein designated VGAM RNA, also designated SEQ ID:4944.

Another function of VGAM2233 is therefore inhibition of Serine Protease Inhibitor-like, with Kunitz and WAP Domains 1 (eppin) (SPINLW1, Accession NM_020398). Accordingly, utilities of VGAM2233 include diagnosis, prevention and treatment of diseases and clinical conditions associated with SPINLW1. LOC127435 (Accession XM_072088) is another VGAM2233 host target gene. LOC127435 BINDING SITE is HOST TARGET binding site found in the 3' untranslated region of mRNA encoded by LOC127435, corresponding to a HOST TARGET binding site such as BINDING SITE I, BINDING SITE II or BINDING SITE III. Table 2 illustrates the complementarity of the nucleotide sequences of LOC127435 BINDING SITE, designated SEQ ID:37460, to the nucleotide sequence of VGAM2233 RNA, herein designated VGAM RNA, also designated SEQ ID:4944.

Another function of VGAM2233 is therefore inhibition of LOC127435 (Accession XM_072088). Accordingly, utilities of VGAM2233 include diagnosis, prevention and treatment of diseases and clinical conditions associated with LOC127435. LOC144866 (Accession XM_096699) is another VGAM2233 host target gene. LOC144866 BINDING SITE is HOST TARGET binding site found in the 5' untranslated region of mRNA encoded by LOC144866, corresponding to a HOST TARGET binding site such as BINDING SITE I, BINDING SITE II or BINDING SITE III. Table 2 illustrates the complementarity of the nucleotide sequences of LOC144866 BINDING SITE, designated SEQ ID:40474, to the nucleotide sequence of VGAM2233 RNA, herein designated VGAM RNA, also designated SEQ ID:4944.

Another function of VGAM2233 is therefore inhibition of LOC144866 (Accession XM_096699). Accordingly, utilities of VGAM2233 include diagnosis, prevention and treatment of diseases and clinical conditions associated with LOC144866. LOC163231 (Accession XM_092094) is another VGAM2233 host target gene. LOC163231 BINDING SITE is HOST TARGET binding site found in the 5' untranslated region of mRNA encoded by LOC163231, corresponding to a HOST TARGET binding site such as BINDING SITE I, BINDING SITE II or BINDING SITE III. Table 2 illustrates the complementarity of the nucleotide sequences of LOC163231 BINDING SITE, designated SEQ ID:40091, to the nucleotide sequence of VGAM2233 RNA, herein designated VGAM RNA, also designated SEQ ID:4944.

Another function of VGAM2233 is therefore inhibition of LOC163231 (Accession XM_092094). Accordingly, utilities of VGAM2233 include diagnosis, prevention and treatment of diseases and clinical conditions associated with LOC163231. LOC201952 (Accession XM_117345) is another VGAM2233 host target gene. LOC201952 BINDING SITE is HOST TARGET binding site found in the 5' untranslated region of mRNA encoded by LOC201952, corresponding to a HOST TARGET binding site such as BINDING SITE I, BINDING SITE II or BINDING SITE III. Table 2 illustrates the complementarity of the nucleotide sequences of LOC201952 BINDING SITE, designated SEQ ID:43393, to the nucleotide sequence of VGAM2233 RNA, herein designated VGAM RNA, also designated SEQ ID:4944.

Another function of VGAM2233 is therefore inhibition of LOC201952 (Accession XM_117345). Accordingly, utilities of VGAM2233 include diagnosis, prevention and treatment of diseases and clinical conditions associated with LOC201952. LOC253675 (Accession XM_172990) is another VGAM2233 host target gene. LOC253675 BINDING SITE is HOST TARGET binding site found in the 5' untranslated region of mRNA encoded by LOC253675, corresponding to a HOST TARGET binding site such as BINDING SITE I, BINDING SITE II or BINDING SITE III. Table 2 illustrates the complementarity of the nucleotide sequences of LOC253675 BINDING SITE, designated SEQ ID:46264, to the nucleotide sequence of VGAM2233 RNA, herein designated VGAM RNA, also designated SEQ ID:4944.

Another function of VGAM2233 is therefore inhibition of LOC253675 (Accession XM_172990). Accordingly, utilities of VGAM2233 include diagnosis, prevention and treatment of diseases and clinical conditions associated with LOC253675. LOC92080 (Accession XM_042704) is another VGAM2233 host target gene. LOC92080 BINDING SITE is HOST TARGET binding site found in the 5' untranslated region of mRNA encoded by LOC92080, corresponding to a HOST TARGET binding site such as BINDING SITE I, BINDING SITE II or BINDING SITE III. Table 2 illustrates the complementarity of the nucleotide sequences of LOC92080 BINDING SITE, designated SEQ ID:33756, to the nucleotide sequence of VGAM2233 RNA, herein designated VGAM RNA, also designated SEQ ID:4944.

Another function of VGAM2233 is therefore inhibition of LOC92080 (Accession XM_042704). Accordingly, utilities of VGAM2233 include diagnosis, prevention and treatment of diseases and clinical conditions associated with LOC92080. FIG. 1 further provides a conceptual description of a novel bioinformatically detected viral gene of the present invention, referred to here as Viral Genomic Address Messenger 2234 (VGAM2234) viral gene, which modulates expression of respective host target genes thereof, the function and utility of which host target genes is known in the art.

VGAM2234 is a novel bioinformatically detected regulatory, non protein coding, viral micro RNA (miRNA) gene.

The method by which VGAM2234 was detected is described hereinabove with reference to FIGS. 1-8.

VGAM2234 gene, herein designated VGAM GENE, is a viral gene contained in the genome of Porcine Epidemic Diarrhea Virus. VGAM2234 host target gene, herein designated VGAM HOST TARGET GENE, is a human gene contained in the human genome.

VGAM2234 gene encodes a VGAM2234 precursor RNA, herein designated VGAM PRECURSOR RNA. Similar to other miRNA genes, and unlike most ordinary genes, VGAM2234 precursor RNA does not encode a protein. A nucleotide sequence identical or highly similar to the nucleotide sequence of VGAM2234 precursor RNA is designated SEQ ID:2220, and is provided hereinbelow with reference to the sequence listing part. Nucleotide sequence SEQ ID:2220 is located at position 15172 relative to the genome of Porcine Epidemic Diarrhea Virus.

VGAM2234 precursor RNA folds onto itself, forming VGAM2234 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2234 folded precursor RNA into VGAM2234 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2234 RNA is designated SEQ ID:4945, and is provided hereinbelow with reference to the sequence listing part.

VGAM2234 host target gene, herein designated VGAM HOST TARGET GENE, encodes a corresponding messenger RNA, VGAM2234 host target RNA, herein designated VGAM HOST TARGET RNA. VGAM2234 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2234 RNA, herein designated VGAM RNA, binds complementarily to one or more host target binding sites located in untranslated regions of VGAM2234 host target RNA, herein designated VGAM HOST TARGET RNA. This complementary binding is due to the fact that the nucleotide sequence of VGAM2234 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2234 RNA, herein designated VGAM RNA, may have a different number of host target binding sites in untranslated regions of a VGAM2234 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2234 RNA, herein designated VGAM RNA, to host target binding sites on VGAM2234 host target RNA, herein designated VGAM HOST TARGET RNA, such as BINDING SITE I, BINDING SITE II and BINDING SITE III, inhibits translation of VGAM2234 host target RNA into VGAM2234 host target protein, herein designated VGAM HOST TARGET PROTEIN. VGAM host target protein is therefore outlined by a broken line.

It is appreciated that VGAM2234 host target gene, herein designated VGAM HOST TARGET GENE, in fact represents a plurality of VGAM2234 host target genes. The mRNA of each one of this plurality of VGAM2234 host target genes comprises one or more host target binding sites, each having a nucleotide sequence which is at least partly complementary to VGAM2234 RNA, herein designated VGAM RNA, and which when bound by VGAM2234 RNA causes inhibition of translation of respective one or more VGAM2234 host target proteins.

It is further appreciated by one skilled in the art that the mode of translational inhibition illustrated by FIG. 1 with specific reference to translational inhibition exerted by VGAM2234 gene, herein designated VGAM GENE, on one or more VGAM2234 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2234 is inhibition of expression of host target genes, as part of a novel viral mechanism of attacking a host. Accordingly, utilities of VGAM2234 include diagnosis, prevention and treatment of viral infection by Porcine Epidemic Diarrhea Virus. Specific functions, and accordingly utilities, of VGAM2234 correlate with, and may be deduced from, the identity of the host target genes which VGAM2234 binds and inhibits, and the function of these host target genes, as elaborated hereinbelow.

Nucleotide sequences of the VGAM2234 precursor RNA, herein designated VGAM PRECURSOR RNA, and of the 'diced' VGAM2234 RNA, herein designated VGAM RNA, and a schematic representation of the secondary folding of VGAM2234 folded precursor RNA, herein designated VGAM FOLDED PRECURSOR RNA, of VGAM2234 are further described hereinbelow with reference to Table 1.

Nucleotide sequences of host target binding sites, such as BINDING SITE-I, BINDING SITE-II and BINDING SITE-III of FIG. 1, found on VGAM2234 host target RNA, and schematic representation of the complementarity of each of these host target binding sites to VGAM2234 RNA, herein designated VGAM RNA, are described hereinbelow with reference to Table 2.

As mentioned hereinabove with reference to FIG. 1, a function of VGAM2234 gene, herein designated VGAM is inhibition of expression of VGAM2234 target genes. It is appreciated that specific functions, and accordingly utilities, of VGAM2234 correlate with, and may be deduced from, the identity of the target genes which VGAM2234 binds and inhibits, and the function of these target genes, as elaborated hereinbelow.

Ankyrin 3, Node of Ranvier (ankyrin G) (ANK3, Accession NM_020987) is a VGAM2234 host target gene. ANK3 BINDING SITE is HOST TARGET binding site found in the 3' untranslated region of mRNA encoded by ANK3, corresponding to a HOST TARGET binding site such as BINDING SITE I, BINDING SITE II or BINDING SITE III. Table 2 illustrates the complementarity of the nucleotide sequences of ANK3 BINDING SITE, designated SEQ ID:21982, to the nucleotide sequence of VGAM2234 RNA, herein designated VGAM RNA, also designated SEQ ID:4945.

A function of VGAM2234 is therefore inhibition of Ankyrin 3, Node of Ranvier (ankyrin G) (ANK3, Accession NM_020987), a gene which plays key roles in activities such as cell motility, activation, proliferation. Accordingly, utilities of VGAM2234 include diagnosis, prevention and treatment of diseases and clinical conditions associated with ANK3. The function of ANK3 and its association with various diseases and clinical conditions, has been established by previous studies, as described hereinabove with reference to VGAM1527. EPB72 (Accession NM_004099) is another VGAM2234 host target gene. EPB72 BINDING SITE is HOST TARGET binding site found in the 3' untranslated region of mRNA encoded by EPB72, corresponding to a HOST TARGET binding site such as BINDING SITE I, BINDING SITE II or BINDING SITE III. Table 2 illustrates the complementarity of the nucleotide sequences of EPB72 BINDING SITE, designated SEQ ID:10305, to the nucleotide sequence of VGAM2234 RNA, herein designated VGAM RNA, also designated SEQ ID:4945.

Another function of VGAM2234 is therefore inhibition of EPB72 (Accession NM_004099), a gene which may regulate cation conductance. Accordingly, utilities of VGAM2234 include diagnosis, prevention and treatment of diseases and clinical conditions associated with EPB72. The function of EPB72 and its association with various diseases and clinical conditions, has been established by previous studies, as described hereinabove with reference to VGAM1560. A Kinase (PRKA) Anchor Protein 6 (AKAP6, Accession NM_004274) is another VGAM2234 host target gene. AKAP6 BINDING SITE is HOST TARGET binding site found in the 3' untranslated region of mRNA encoded by AKAP6, corresponding to a HOST TARGET binding site such as BINDING SITE I, BINDING SITE II or BINDING SITE III. Table 2 illustrates the complementarity of the nucleotide sequences of AKAP6 BINDING SITE, designated SEQ ID:10489, to the nucleotide sequence of VGAM2234 RNA, herein designated VGAM RNA, also designated SEQ ID:4945.

Another function of VGAM2234 is therefore inhibition of A Kinase (PRKA) Anchor Protein 6 (AKAP6, Accession NM_004274). Accordingly, utilities of VGAM2234 include diagnosis, prevention and treatment of diseases and clinical conditions associated with AKAP6. Kelch-like 8 (Drosophila) (KLHL8, Accession XM_031735) is another VGAM2234 host target gene. KLHL8 BINDING SITE is HOST TARGET binding site found in the 3' untranslated region of mRNA encoded by KLHL8, corresponding to a HOST TARGET binding site such as BINDING SITE I, BINDING SITE II or BINDING SITE III. Table 2 illustrates the complementarity of the nucleotide sequences of KLHL8 BINDING SITE, designated SEQ ID:31476, to the nucleotide sequence of VGAM2234 RNA, herein designated VGAM RNA, also designated SEQ ID:4945.

Another function of VGAM2234 is therefore inhibition of Kelch-like 8 (Drosophila) (KLHL8, Accession XM_031735). Accordingly, utilities of VGAM2234 include diagnosis, prevention and treatment of diseases and clinical conditions associated with KLHL8. LOC200150 (Accession XM_114131) is another VGAM2234 host target gene. LOC200150 BINDING SITE is HOST TARGET binding site found in the 3' untranslated region of mRNA encoded by LOC200150, corresponding to a HOST TARGET binding site such as BINDING SITE I, BINDING SITE II or BINDING SITE III. Table 2 illustrates the complementarity of the nucleotide sequences of LOC200150 BINDING SITE, designated SEQ ID:42711, to the nucleotide sequence of VGAM2234 RNA, herein designated VGAM RNA, also designated SEQ ID:4945.

Another function of VGAM2234 is therefore inhibition of LOC200150 (Accession XM_114131). Accordingly, utilities of VGAM2234 include diagnosis, prevention and treatment of diseases and clinical conditions associated with LOC200150. LOC257319 (Accession XM_171049) is another VGAM2234 host target gene. LOC257319 BINDING SITE is HOST TARGET binding site found in the 3' untranslated region of mRNA encoded by LOC257319, corresponding to a HOST TARGET binding site such as BINDING SITE I, BINDING SITE II or BINDING SITE III. Table 2 illustrates the complementarity of the nucleotide sequences of LOC257319 BINDING SITE, designated SEQ ID:45834, to the nucleotide sequence of VGAM2234 RNA, herein designated VGAM RNA, also designated SEQ ID:4945.

Another function of VGAM2234 is therefore inhibition of LOC257319 (Accession XM_171049). Accordingly, utilities of VGAM2234 include diagnosis, prevention and treatment of diseases and clinical conditions associated with LOC257319. LOC89932 (Accession XM_027341) is another VGAM2234 host target gene. LOC89932 BINDING SITE is HOST TARGET binding site found in the 3' untranslated region of mRNA encoded by LOC89932, corresponding to a HOST TARGET binding site such as BINDING SITE I, BINDING SITE II or BINDING SITE III. Table 2 illustrates the complementarity of the nucleotide sequences of LOC89932 BINDING SITE, designated SEQ ID:30491, to the nucleotide sequence of VGAM2234 RNA, herein designated VGAM RNA, also designated SEQ ID:4945.

Another function of VGAM2234 is therefore inhibition of LOC89932 (Accession XM_027341). Accordingly, utilities of VGAM2234 include diagnosis, prevention and treatment of diseases and clinical conditions associated with LOC89932. FIG. 1 further provides a conceptual description of a novel bioinformatically detected viral gene of the present invention, referred to here as Viral Genomic Address Messenger 2235 (VGAM2235) viral gene, which modulates expression of respective host target genes thereof, the function and utility of which host target genes is known in the art.

VGAM2235 is a novel bioinformatically detected regulatory, non protein coding, viral micro RNA (miRNA) gene. The method by which VGAM2235 was detected is described hereinabove with reference to FIGS. 1-8.

VGAM2235 gene, herein designated VGAM GENE, is a viral gene contained in the genome of Porcine Epidemic Diarrhea Virus. VGAM2235 host target gene, herein designated VGAM HOST TARGET GENE, is a human gene contained in the human genome.

VGAM2235 gene encodes a VGAM2235 precursor RNA, herein designated VGAM PRECURSOR RNA. Similar to other miRNA genes, and unlike most ordinary genes, VGAM2235 precursor RNA does not encode a protein. A nucleotide sequence identical or highly similar to the nucleotide sequence of VGAM2235 precursor RNA is designated SEQ ID:2221, and is provided hereinbelow with reference to the sequence listing part. Nucleotide sequence SEQ ID:2221 is located at position 19252 relative to the genome of Porcine Epidemic Diarrhea Virus.

VGAM2235 precursor RNA folds onto itself, forming VGAM2235 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2235 folded precursor RNA into VGAM2235 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2235 RNA is designated SEQ ID:4946, and is provided hereinbelow with reference to the sequence listing part.

VGAM2235 host target gene, herein designated VGAM HOST TARGET GENE, encodes a corresponding messenger RNA, VGAM2235 host target RNA, herein designated VGAM HOST TARGET RNA. VGAM2235 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2235 RNA, herein designated VGAM RNA, binds complementarily to one or more host target binding sites located in untranslated regions of VGAM2235 host target RNA, herein designated VGAM HOST TARGET RNA. This complementary binding is due to the fact that the nucleotide sequence of VGAM2235 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2235 RNA, herein designated VGAM RNA, may have a different number of host target binding sites in untranslated regions of a VGAM2235 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2235 RNA, herein designated VGAM RNA, to host target binding sites on VGAM2235 host target RNA, herein designated VGAM HOST TARGET RNA, such as BINDING SITE I, BINDING SITE II and BINDING SITE III, inhibits translation of VGAM2235 host target RNA into VGAM2235 host target protein, herein designated VGAM HOST TARGET PROTEIN. VGAM host target protein is therefore outlined by a broken line.

It is appreciated that VGAM2235 host target gene, herein designated VGAM HOST TARGET GENE, in fact represents a plurality of VGAM2235 host target genes. The mRNA of each one of this plurality of VGAM2235 host target genes comprises one or more host target binding sites, each having a nucleotide sequence which is at least partly complementary to VGAM2235 RNA, herein designated VGAM RNA, and which when bound by VGAM2235 RNA causes inhibition of translation of respective one or more VGAM2235 host target proteins.

It is further appreciated by one skilled in the art that the mode of translational inhibition illustrated by FIG. 1 with specific reference to translational inhibition exerted by VGAM2235 gene, herein designated VGAM GENE, on one or more VGAM2235 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2235 is inhibition of expression of host target genes, as part of a novel viral mechanism of attacking a host. Accordingly, utilities of VGAM2235 include diagnosis, prevention and treatment of viral infection by Porcine Epidemic Diarrhea Virus. Specific functions, and accordingly utilities, of VGAM2235 correlate with, and may be deduced from, the identity of the host target genes which VGAM2235 binds and inhibits, and the function of these host target genes, as elaborated hereinbelow.

Nucleotide sequences of the VGAM2235 precursor RNA, herein designated VGAM PRECURSOR RNA, and of the 'diced' VGAM2235 RNA, herein designated VGAM RNA, and a schematic representation of the secondary folding of VGAM2235 folded precursor RNA, herein designated VGAM FOLDED PRECURSOR RNA, of VGAM2235 are further described hereinbelow with reference to Table 1.

Nucleotide sequences of host target binding sites, such as BINDING SITE-I, BINDING SITE-II and BINDING SITE-III of FIG. 1, found on VGAM2235 host target RNA, and schematic representation of the complementarity of each of these host target binding sites to VGAM2235 RNA, herein designated VGAM RNA, are described hereinbelow with reference to Table 2.

As mentioned hereinabove with reference to FIG. 1, a function of VGAM2235 gene, herein designated VGAM is inhibition of expression of VGAM2235 target genes. It is appreciated that specific functions, and accordingly utilities, of VGAM2235 correlate with, and may be deduced from, the identity of the target genes which VGAM2235 binds and inhibits, and the function of these target genes, as elaborated hereinbelow.

Arachidonate 15-lipoxygenase (ALOX15, Accession NM_001140) is a VGAM2235 host target gene. ALOX15 BINDING SITE is HOST TARGET binding site found in the 3' untranslated region of mRNA encoded by ALOX15, corresponding to a HOST TARGET binding site such as BINDING SITE I, BINDING SITE II or BINDING SITE III. Table 2 illustrates the complementarity of the nucleotide sequences of ALOX15 BINDING SITE, designated SEQ ID:6808, to the nucleotide sequence of VGAM2235 RNA, herein designated VGAM RNA, also designated SEQ ID:4946.

A function of VGAM2235 is therefore inhibition of Arachidonate 15-lipoxygenase (ALOX15, Accession NM_001140), a gene which converts arachidonic acid to 15s-hydroperoxyeicosatetraenoic acid. Accordingly, utilities of VGAM2235 include diagnosis, prevention and treatment of diseases and clinical conditions associated with ALOX15.

The function of ALOX15 and its association with various diseases and clinical conditions, has been established by previous studies, as described hereinabove with reference to VGAM282. ATPase, Class I, Type 8B, Member 2 (ATP8B2, Accession XM_036933) is another VGAM2235 host target gene. ATP8B2 BINDING SITE is HOST TARGET binding site found in the 5' untranslated region of mRNA encoded by ATP8B2, corresponding to a HOST TARGET binding site such as BINDING SITE I, BINDING SITE II or BINDING SITE III. Table 2 illustrates the complementarity of the nucleotide sequences of ATP8B2 BINDING SITE, designated SEQ ID:32515, to the nucleotide sequence of VGAM2235 RNA, herein designated VGAM RNA, also designated SEQ ID:4946.

Another function of VGAM2235 is therefore inhibition of ATPase, Class I, Type 8B, Member 2 (ATP8B2, Accession XM_036933). Accordingly, utilities of VGAM2235 include diagnosis, prevention and treatment of diseases and clinical conditions associated with ATP8B2. Collagen, Type XIX, Alpha 1 (COL19A1, Accession NM_001858) is another VGAM2235 host target gene. COL19A1 BINDING SITE is HOST TARGET binding site found in the 3' untranslated region of mRNA encoded by COL19A1, corresponding to a HOST TARGET binding site such as BINDING SITE I, BINDING SITE II or BINDING SITE III. Table 2 illustrates the complementarity of the nucleotide sequences of COL19A1 BINDING SITE, designated SEQ ID:7598, to the nucleotide sequence of VGAM2235 RNA, herein designated VGAM RNA, also designated SEQ ID:4946.

Another function of VGAM2235 is therefore inhibition of Collagen, Type XIX, Alpha 1 (COL19A1, Accession NM_001858), a gene which may act as a cross-bridge between fibrils and other extracellular matrix molecules. Accordingly, utilities of VGAM2235 include diagnosis, prevention and treatment of diseases and clinical conditions associated with COL19A1. The function of COL19A1 and its association with various diseases and clinical conditions, has been established by previous studies, as described hereinabove with reference to VGAM19. Carboxypeptidase N, Polypeptide 1, 50kD (CPN1, Accession NM_001308) is another VGAM2235 host target gene. CPN1 BINDING SITE is HOST TARGET binding site found in the 5' untranslated region of mRNA encoded by CPN1, corresponding to a HOST TARGET binding site such as BINDING SITE I, BINDING SITE II or BINDING SITE III. Table 2 illustrates the complementarity of the nucleotide sequences of CPN1 BINDING SITE, designated SEQ ID:6990, to the nucleotide sequence of VGAM2235 RNA, herein designated VGAM RNA, also designated SEQ ID:4946.

Another function of VGAM2235 is therefore inhibition of Carboxypeptidase N, Polypeptide 1, 50kD (CPN1, Accession NM_001308), a gene which cleaves basic amino acid residues from the C terminal of peptides and proteins. Accordingly, utilities of VGAM2235 include diagnosis, prevention and treatment of diseases and clinical conditions associated with CPN1. The function of CPN1 and its association with various diseases and clinical conditions, has been established by previous studies, as described hereinabove with reference to VGAM1965. Catenin (cadherin-associated protein), Delta 2 (neural plakophilin-related arm-repeat protein) (CTNND2, Accession NM_001332) is another VGAM2235 host target gene. CTNND2 BINDING SITE is HOST TARGET binding site found in the 3' untranslated region of mRNA encoded by CTNND2, corresponding to a HOST TARGET binding site such as BINDING SITE I, BINDING SITE II or BINDING SITE III. Table 2 illustrates the complementarity of the nucleotide sequences of CTNND2 BINDING SITE, designated SEQ ID:7014, to the nucleotide sequence of VGAM2235 RNA, herein designated VGAM RNA, also designated SEQ ID:4946.

Another function of VGAM2235 is therefore inhibition of Catenin (cadherin-associated protein), Delta 2 (neural plakophilin-related arm-repeat protein) (CTNND2, Accession NM_001332), a gene which interacts with presenilin 1 (PSEN1) and is a member of the plakoglobin/armadillo family. Accordingly, utilities of VGAM2235 include diagnosis, prevention and treatment of diseases and clinical conditions associated with CTNND2. The function of CTNND2 has been established by previous studies. Armadillo-like proteins are characterized by a series of armadillo repeats, first defined in the Drosophila 'armadillO' gene product, that are typically 42 to 45 amino acids long. These proteins can be divided into subfamilies based on the number of repeats, their overall sequence similarity, and the dispersion of the repeats throughout their sequences. Members of the p120 (ctn)/plakophilin subfamily of Armadillo-like proteins, including CTNND1 (OMIM Ref. No. 601045), CTNND2, PKP1 (OMIM Ref. No. 601975), PKP2 (OMIM Ref. No. 602861), PKP4 (OMIM Ref. No. 604276), and ARVCF (OMIM Ref. No. 602269), have 10 armadillo repeats each In a search for proteins with sequence homology to PKP1, Paffenholz and Franke (1997) identified a human cDNA with 45% amino acid identity to PKP1 in a segment within the armadillo (arm) repeat units. Antibodies raised against the arm repeat region recognized 2 polypeptide bands of approximately 150 and 160 kD in immunoblots of mouse brain and a weak band of approximately 160 kD in mouse skeletal muscle and pancreas. The authors, therefore, named the protein NPRAP for 'neural plakophilin-related arm-repeat protein.' Paffenholz and Franke (1997) isolated 2 partial human cDNA clones from a human fetal brain cDNA library. The longer displays 91% identity to the complete mouse cDNA. Northern blot analysis of a number of human and bovine cell lines and tissues detected CTNND2 expression as 5- and 6-kb transcripts only in human fetal brain RNA Full details of the abovementioned studies are described in the following publications, the disclosure of which are hereby incorporated by reference:

Paffenholz, R.; Franke, W. W.: Identification and localization of a neurally expressed member of the plakoglobin/armadillo multigene family. Differentiation 61:293-304, 1997; and Medina, M.; Marinescu, R. C.; Overhauser, J.; Kosik, K. S.: Hemizygosity of delta-catenin (CTNND2) is associated with severe mental retardation in cri-du-chat syndrome. Genomics 63:157.

Further studies establishing the function and utilities of CTNND2 are found in John Hopkins OMIM database record ID 604275, and in sited publications numbered 702 and 7385-7387 listed in the bibliography section hereinbelow, which are also hereby incorporated by reference. Interleukin 12 Receptor, Beta 2 (IL12RB2, Accession NM_001559) is another VGAM2235 host target gene. IL12RB2 BINDING SITE is HOST TARGET binding site found in the 3' untranslated region of mRNA encoded by IL12RB2, corresponding to a HOST TARGET binding site such as BINDING SITE I, BINDING SITE II or BINDING SITE III. Table 2 illustrates the complementarity of the nucleotide sequences of IL12RB2 BINDING SITE, designated SEQ ID:7279, to the nucleotide sequence of VGAM2235 RNA, herein designated VGAM RNA, also designated SEQ ID:4946.

Another function of VGAM2235 is therefore inhibition of Interleukin 12 Receptor, Beta 2 (IL12RB2, Accession NM_001559), a gene which is involved in il-12 transduction.

binds to il-12 with a low affinity. Accordingly, utilities of VGAM2235 include diagnosis, prevention and treatment of diseases and clinical conditions associated with IL12RB2. The function of IL12RB2 and its association with various diseases and clinical conditions, has been established by previous studies, as described hereinabove with reference to VGAM326. Pre-B-cell Leukemia Transcription Factor 3 (PBX3, Accession NM_006195) is another VGAM2235 host target gene. PBX3 BINDING SITE is HOST TARGET binding site found in the 3' untranslated region of mRNA encoded by PBX3, corresponding to a HOST TARGET binding site such as BINDING SITE I, BINDING SITE II or BINDING SITE III. Table 2 illustrates the complementarity of the nucleotide sequences of PBX3 BINDING SITE, designated SEQ ID:12868, to the nucleotide sequence of VGAM2235 RNA, herein designated VGAM RNA, also designated SEQ ID:4946.

Another function of VGAM2235 is therefore inhibition of Pre-B-cell Leukemia Transcription Factor 3 (PBX3, Accession NM_006195). Accordingly, utilities of VGAM2235 include diagnosis, prevention and treatment of diseases and clinical conditions associated with PBX3. Protein Phosphatase 3 (formerly 2B), Catalytic Subunit, Alpha Isoform (calcineurin A alpha) (PPP3CA, Accession NM_000944) is another VGAM2235 host target gene. PPP3CA BINDING SITE is HOST TARGET binding site found in the 3" untranslated region of mRNA encoded by PPP3CA, corresponding to a HOST TARGET binding site such as BINDING SITE I, BINDING SITE II or BINDING SITE III. Table 2 illustrates the complementarity of the nucleotide sequences of PPP3CA BINDING SITE, designated SEQ ID:6643, to the nucleotide sequence of VGAM2235 RNA, herein designated VGAM RNA, also designated SEQ ID:4946.

Another function of VGAM2235 is therefore inhibition of Protein Phosphatase 3 (formerly 2B), Catalytic Subunit, Alpha Isoform (calcineurin A alpha) (PPP3CA, Accession NM_000944), a gene which is the catalytic subunit of calcium-dependent, calmodulin-stimulated protein phosphatase. Accordingly, utilities of VGAM2235 include diagnosis, prevention and treatment of diseases and clinical conditions associated with PPP3CA. The function of PPP3CA and its association with various diseases and clinical conditions, has been established by previous studies, as described hereinabove with reference to VGAM497. Peroxisomal Farnesylated Protein (PXF, Accession NM_002857) is another VGAM2235 host target gene. PXF BINDING SITE is HOST TARGET binding site found in the 3" untranslated region of mRNA encoded by PXF, corresponding to a HOST TARGET binding site such as BINDING SITE I, BINDING SITE II or BINDING SITE III. Table 2 illustrates the complementarity of the nucleotide sequences of PXF BINDING SITE, designated SEQ ID:8750, to the nucleotide sequence of VGAM2235 RNA, herein designated VGAM RNA, also designated SEQ ID:4946.

Another function of VGAM2235 is therefore inhibition of Peroxisomal Farnesylated Protein (PXF, Accession NM_002857), a gene which may function in peroxisomal biogenesis or assembly. Accordingly, utilities of VGAM2235 include diagnosis, prevention and treatment of diseases and clinical conditions associated with PXF. The function of PXF and its association with various diseases and clinical conditions, has been established by previous studies, as described hereinabove with reference to VGAM193. Regulatory Factor X-associated Protein (RFXAP, Accession NM_000538) is another VGAM2235 host target gene. RFXAP BINDING SITE is HOST TARGET binding site found in the 3' untranslated region of mRNA encoded by RFXAP, corresponding to a HOST TARGET binding site such as BINDING SITE I, BINDING SITE II or BINDING SITE III. Table 2 illustrates the complementarity of the nucleotide sequences of RFXAP BINDING SITE, designated SEQ ID:6134, to the nucleotide sequence of VGAM2235 RNA, herein designated VGAM RNA, also designated SEQ ID:4946.

Another function of VGAM2235 is therefore inhibition of Regulatory Factor X-associated Protein (RFXAP, Accession NM_000538), a gene which binds to the x-box of mhc ii promoters and is a transcriptional regulator. Accordingly, utilities of VGAM2235 include diagnosis, prevention and treatment of diseases and clinical conditions associated with RFXAP. The function of RFXAP and its association with various diseases and clinical conditions, has been established by previous studies, as described hereinabove with reference to VGAM797. HSA243666 (Accession NM_017582) is another VGAM2235 host target gene. HSA243666 BINDING SITE is HOST TARGET binding site found in the 3' untranslated region of mRNA encoded by HSA243666, corresponding to a HOST TARGET binding site such as BINDING SITE I, BINDING SITE II or BINDING SITE III. Table 2 illustrates the complementarity of the nucleotide sequences of HSA243666 BINDING SITE, designated SEQ ID:19019, to the nucleotide sequence of VGAM2235 RNA, herein designated VGAM RNA, also designated SEQ ID:4946.

Another function of VGAM2235 is therefore inhibition of HSA243666 (Accession NM_017582). Accordingly, utilities of VGAM2235 include diagnosis, prevention and treatment of diseases and clinical conditions associated with HSA243666. MCM10 Minichromosome Maintenance Deficient 10 (S. cerevisiae) (MCM10, Accession NM_018518) is another VGAM2235 host target gene. MCM10 BINDING SITE is HOST TARGET binding site found in the 3' untranslated region of mRNA encoded by MCM10, corresponding to a HOST TARGET binding site such as BINDING SITE I, BINDING SITE II or BINDING SITE III. Table 2 illustrates the complementarity of the nucleotide sequences of MCM10 BINDING SITE, designated SEQ ID:20592, to the nucleotide sequence of VGAM2235 RNA, herein designated VGAM RNA, also designated SEQ ID:4946.

Another function of VGAM2235 is therefore inhibition of MCM10 Minichromosome Maintenance Deficient 10 (S. cerevisiae) (MCM10, Accession NM_018518). Accordingly, utilities of VGAM2235 include diagnosis, prevention and treatment of diseases and clinical conditions associated with MCM10. Neuropilin (NRP) and Tolloid (TLL)-like 1 (NETO1, Accession NM_138966) is another VGAM2235 host target gene. NETO1 BINDING SITE is HOST TARGET binding site found in the 3' untranslated region of mRNA encoded by NETO1, corresponding to a HOST TARGET binding site such as BINDING SITE I, BINDING SITE II or BINDING SITE III. Table 2 illustrates the complementarity of the nucleotide sequences of NETO1 BINDING SITE, designated SEQ ID:29070, to the nucleotide sequence of VGAM2235 RNA, herein designated VGAM RNA, also designated SEQ ID:4946.

Another function of VGAM2235 is therefore inhibition of Neuropilin (NRP) and Tolloid (TLL)-like 1 (NETO1, Accession NM_138966). Accordingly, utilities of VGAM2235 include diagnosis, prevention and treatment of diseases and clinical conditions associated with NETO1. PEPP3 (Accession NM_014935) is another VGAM2235 host target gene. PEPP3 BINDING SITE is HOST TARGET binding site found in the 3' untranslated region of mRNA encoded by PEPP3, corresponding to a HOST TARGET binding site such as BINDING SITE I, BINDING SITE II or BINDING SITE III. Table 2 illustrates the complementarity of the nucleotide sequences of PEPP3 BINDING SITE, designated SEQ ID:17233, to the nucleotide sequence of VGAM2235 RNA, herein designated VGAM RNA, also designated SEQ ID:4946.

Another function of VGAM2235 is therefore inhibition of PEPP3 (Accession NM_014935). Accordingly, utilities of VGAM2235 include diagnosis, prevention and treatment of diseases and clinical conditions associated with PEPP3. ZID (Accession NM_006626) is another VGAM2235 host target gene. ZID BINDING SITE is HOST TARGET binding site found in the 3' untranslated region of mRNA encoded by ZID, corresponding to a HOST TARGET binding site such as BINDING SITE I, BINDING SITE II or BINDING SITE III. Table 2 illustrates the complementarity of the nucleotide sequences of ZID BINDING SITE, designated SEQ ID:13414, to the nucleotide sequence of VGAM2235 RNA, herein designated VGAM RNA, also designated SEQ ID:4946.

Another function of VGAM2235 is therefore inhibition of ZID (Accession NM_006626). Accordingly, utilities of VGAM2235 include diagnosis, prevention and treatment of diseases and clinical conditions associated with ZID. Zinc Finger Protein 237 (ZNF237, Accession NM_014242) is another VGAM2235 host target gene. ZNF237 BINDING SITE is HOST TARGET binding site found in the 3' untranslated region of mRNA encoded by ZNF237, corresponding to a HOST TARGET binding site such as BINDING SITE I, BINDING SITE II or BINDING SITE III. Table 2 illustrates the complementarity of the nucleotide sequences of ZNF237 BINDING SITE, designated SEQ ID:15504, to the nucleotide sequence of VGAM2235 RNA, herein designated VGAM RNA, also designated SEQ ID:4946.

Another function of VGAM2235 is therefore inhibition of Zinc Finger Protein 237 (ZNF237, Accession NM_014242). Accordingly, utilities of VGAM2235 include diagnosis, prevention and treatment of diseases and clinical conditions associated with ZNF237. LOC122786 (Accession XM_058660) is another VGAM2235 host target gene. LOC122786 BINDING SITE is HOST TARGET binding site found in the 3' untranslated region of mRNA encoded by LOC122786, corresponding to a HOST TARGET binding site such as BINDING SITE I, BINDING SITE II or BINDING SITE III. Table 2 illustrates the complementarity of the nucleotide sequences of LOC122786 BINDING SITE, designated SEQ ID:36697, to the nucleotide sequence of VGAM2235 RNA, herein designated VGAM RNA, also designated SEQ ID:4946.

Another function of VGAM2235 is therefore inhibition of LOC122786 (Accession XM_058660). Accordingly, utilities of VGAM2235 include diagnosis, prevention and treatment of diseases and clinical conditions associated with LOC122786. LOC124801 (Accession XM_058850) is another VGAM2235 host target gene. LOC124801 BINDING SITE is HOST TARGET binding site found in the 3' untranslated region of mRNA encoded by LOC124801, corresponding to a HOST TARGET binding site such as BINDING SITE I, BINDING SITE II or BINDING SITE III. Table 2 illustrates the complementarity of the nucleotide sequences of LOC124801 BINDING SITE, designated SEQ ID:36762, to the nucleotide sequence of VGAM2235 RNA, herein designated VGAM RNA, also designated SEQ ID:4946.

Another function of VGAM2235 is therefore inhibition of LOC124801 (Accession XM_058850). Accordingly, utilities of VGAM2235 include diagnosis, prevention and treatment of diseases and clinical conditions associated with LOC124801. FIG. 1 further provides a conceptual description of a novel bioinformatically detected viral gene of the present invention, referred to here as Viral Genomic Address Messenger 2236 (VGAM2236) viral gene, which modulates expression of respective host target genes thereof, the function and utility of which host target genes is known in the art.

VGAM2236 is a novel bioinformatically detected regulatory, non protein coding, viral micro RNA (miRNA) gene. The method by which VGAM2236 was detected is described hereinabove with reference to FIGS. 1-8.

VGAM2236 gene, herein designated VGAM GENE, is a viral gene contained in the genome of Porcine Epidemic Diarrhea Virus. VGAM2236 host target gene, herein designated VGAM HOST TARGET GENE, is a human gene contained in the human genome.

VGAM2236 gene encodes a VGAM2236 precursor RNA, herein designated VGAM PRECURSOR RNA. Similar to other miRNA genes, and unlike most ordinary genes, VGAM2236 precursor RNA does not encode a protein. A nucleotide sequence identical or highly similar to the nucleotide sequence of VGAM2236 precursor RNA is designated SEQ ID:2222, and is provided hereinbelow with reference to the sequence listing part. Nucleotide sequence SEQ ID:2222 is located at position 3556 relative to the genome of Porcine Epidemic Diarrhea Virus.

VGAM2236 precursor RNA folds onto itself, forming VGAM2236 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2236 folded precursor RNA into VGAM2236 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM2236 RNA is designated SEQ ID:4947, and is provided hereinbelow with reference to the sequence listing part.

VGAM2236 host target gene, herein designated VGAM HOST TARGET GENE, encodes a corresponding messenger RNA, VGAM2236 host target RNA, herein designated VGAM HOST TARGET RNA. VGAM2236 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2236 RNA, herein designated VGAM RNA, binds complementarily to one or more host target binding sites located in untranslated regions of VGAM2236 host target RNA, herein designated VGAM HOST TARGET RNA. This complementary binding is due to the fact that the nucleotide sequence of VGAM2236 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2236 RNA, herein designated VGAM RNA, may have a different number of host target binding sites in untranslated regions of a VGAM2236 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2236 RNA, herein designated VGAM RNA, to host target binding sites on VGAM2236 host target RNA, herein designated VGAM HOST TARGET RNA, such as BINDING SITE I, BINDING SITE II and BINDING SITE III, inhibits translation of VGAM2236 host target RNA into VGAM2236 host target protein, herein designated VGAM HOST TARGET PROTEIN. VGAM host target protein is therefore outlined by a broken line.

It is appreciated that VGAM2236 host target gene, herein designated VGAM HOST TARGET GENE, in fact represents a plurality of VGAM2236 host target genes. The mRNA of each one of this plurality of VGAM2236 host target genes comprises one or more host target binding sites, each having a nucleotide sequence which is at least partly complementary to VGAM2236 RNA, herein designated VGAM RNA, and which when bound by VGAM2236 RNA causes inhibition of translation of respective one or more VGAM2236 host target proteins.

It is further appreciated by one skilled in the art that the mode of translational inhibition illustrated by FIG. 1 with specific reference to translational inhibition exerted by VGAM2236 gene, herein designated VGAM GENE, on one or more VGAM2236 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2236 is inhibition of expression of host target genes, as part of a novel viral mechanism of attacking a host. Accordingly, utilities of VGAM2236 include diagnosis, prevention and treatment of viral infection by Porcine Epidemic Diarrhea Virus. Specific functions, and accordingly utilities, of VGAM2236 correlate with, and may be deduced from, the identity of the host target genes which VGAM2236 binds and inhibits, and the function of these host target genes, as elaborated hereinbelow.

Nucleotide sequences of the VGAM2236 precursor RNA, herein designated VGAM PRECURSOR RNA, and of the 'diced' VGAM2236 RNA, herein designated VGAM RNA, and a schematic representation of the secondary folding of VGAM2236 folded precursor RNA, herein designated VGAM FOLDED PRECURSOR RNA, of VGAM2236 are further described hereinbelow with reference to Table 1.

Nucleotide sequences of host target binding sites, such as BINDING SITE-I, BINDING SITE-II and BINDING SITE-III of FIG. 1, found on VGAM2236 host target RNA, and schematic representation of the complementarity of each of these host target binding sites to VGAM2236 RNA, herein designated VGAM RNA, are described hereinbelow with reference to Table 2.

As mentioned hereinabove with reference to FIG. 1, a function of VGAM2236 gene, herein designated VGAM is inhibition of expression of VGAM2236 target genes. It is appreciated that specific functions, and accordingly utilities, of VGAM2236 correlate with, and may be deduced from, the identity of the target genes which VGAM2236 binds and inhibits, and the function of these target genes, as elaborated hereinbelow.

A Kinase (PRKA) Anchor Protein 2 (AKAP2, Accession NM_007203) is a VGAM2236 host target gene. AKAP2 BINDING SITE is HOST TARGET binding site found in the 3' untranslated region of mRNA encoded by AKAP2, corresponding to a HOST TARGET binding site such as BINDING SITE I, BINDING SITE II or BINDING SITE III. Table 2 illustrates the complementarity of the nucleotide sequences of AKAP2 BINDING SITE, designated SEQ ID:14062, to the nucleotide sequence of VGAM2236 RNA, herein designated VGAM RNA, also designated SEQ ID:4947.

A function of VGAM2236 is therefore inhibition of A Kinase (PRKA) Anchor Protein 2 (AKAP2, Accession NM_007203), a gene which binds to regulatory subunit (rii) of protein kinase a. Accordingly, utilities of VGAM2236 include diagnosis, prevention and treatment of diseases and clinical conditions associated with AKAP2. The function of AKAP2 and its association with various diseases and clinical conditions, has been established by previous studies, as described hereinabove with reference to VGAM18. Autocrine Motility Factor Receptor (AMFR, Accession NM_138958) is another VGAM2236 host target gene. AMFR BINDING SITE1 and AMFR BINDING SITE2 are HOST TARGET binding sites found in untranslated regions of mRNA encoded by AMFR, corresponding to HOST TARGET binding sites such as BINDING SITE I, BINDING SITE II or BINDING SITE III. Table 2 illustrates the complementarity of the nucleotide sequences of AMFR BINDING SITE1 and AMFR BINDING SITE2, designated SEQ ID:29067 and SEQ ID:6811 respectively, to the nucleotide sequence of VGAM2236 RNA, herein designated VGAM RNA, also designated SEQ ID:4947.

Another function of VGAM2236 is therefore inhibition of Autocrine Motility Factor Receptor (AMFR, Accession NM_138958), a gene which acts to stimulate migration of fibrosarcoma cells. Accordingly, utilities of VGAM2236 include diagnosis, prevention and treatment of diseases and clinical conditions associated with AMFR. The function of AMFR and its association with various diseases and clinical conditions, has been established by previous studies, as described hereinabove with reference to VGAM440. Diptheria Toxin Resistance Protein Required For Diphthamide Biosynthesis-like 2 (S. cerevisiae) (DPH2L2, Accession NM_001384) is another VGAM2236 host target gene. DPH2L2 BINDING SITE is HOST TARGET binding site found in the 3' untranslated region of mRNA encoded by DPH2L2, corresponding to a HOST TARGET binding site such as BINDING SITE I, BINDING SITE II or BINDING SITE III. Table 2 illustrates the complementarity of the nucleotide sequences of DPH2L2 BINDING SITE, designated SEQ ID:7060, to the nucleotide sequence of VGAM2236 RNA, herein designated VGAM RNA, also designated SEQ ID:4947.

Another function of VGAM2236 is therefore inhibition of Diptheria Toxin Resistance Protein Required For Diphthamide Biosynthesis-like 2 (S. cerevisiae) (DPH2L2, Accession NM_001384), a gene which is required for diphthamide biosynthesis. Accordingly, utilities of VGAM2236 include diagnosis, prevention and treatment of diseases and clinical conditions associated with DPH2L2. The function of DPH2L2 and its association with various diseases and clinical conditions, has been established by previous studies, as described hereinabove with reference to VGAM1221. Hemoglobin, Epsilon 1 (HBE1, Accession NM_005330) is another VGAM2236 host target gene. HBE1 BINDING SITE is HOST TARGET binding site found in the 5' untranslated region of mRNA encoded by HBE1, corresponding to a HOST TARGET binding site such as BINDING SITE I, BINDING SITE II or BINDING SITE III. Table 2 illustrates the complementarity of the nucleotide sequences of HBE1 BINDING SITE, designated SEQ ID:11805, to the nucleotide sequence of VGAM2236 RNA, herein designated VGAM RNA, also designated SEQ ID:4947.

Another function of VGAM2236 is therefore inhibition of Hemoglobin, Epsilon 1 (HBE1, Accession NM_005330), a gene which modulates erythrocyte metabolism and senescence, a source of physiological active catabolites. Accordingly, utilities of VGAM2236 include diagnosis, prevention and treatment of diseases and clinical conditions associated with HBE1. The function of HBE1 has been established by previous studies. The epsilon locus determines the epsilon, or non-alpha, chain of embryonic hemoglobin (originally known as Gower-2). No mutations affecting the epsilon chain have yet been identified. Gower-1 is a tetramer of epsilon chains. The epsilon locus may be linked to the delta-beta complex. The amino acid sequence of the epsilon chain is similar to those of the delta and beta chains. Furthermore, the homologous chain in the mouse is linked to the beta locus (Gilman and Smithies, 1968). Shen and Smithies (1982) determined the complete nucleotide sequence of the 3.4-kb stretch of DNA 5-prime to the epsilon gene where a pseudogene (psi-beta-2) was thought to reside (Fritsch et al., 1980). They concluded that no globin-related gene exists there and provided a possible explanation for the earlier contrary conclusion. By studies in transgenic mice, Raich et al. (1992) demonstrated that deletion of a ‘negative element’ located between -182 and -467 bp upstream of the HBE gene cap site resulted in continuation of HBE gene expression in the definitive erythroblasts of the fetal liver and in the red blood cells of adult animals. The findings provided direct in vivo evidence that cis-acting silencing elements are involved in the developmental control of the HBE gene. He and Russell (2002) analyzed the anti-sickling properties of HBE both in vitro as well as in vivo in a well-established mouse model of sickle cell anemia (OMIM Ref. No. 603903). These animals, expressing 100% of human Hb S (141900.0243), display a chronic hemolytic anemia with compensatory marrow and extramedullary erythropoiesis, abundant circulating sickled erythrocytes, and chronic tissue damage evidenced by parallel histopathologic and functional deficits. By comparison, related mice that coexpress Hb S as well as HBE exhibited normal physiologic, morphologic, histologic, and functional attributes. Subsequent in vitro analyses substantiated results from whole-animal studies, indicating that the polymerization of deoxygenated Hb S can be significantly slowed by relatively small quantities of HBE. Together, the in vivo and in vitro analyses suggested that reactivation of epsilon-globin gene expression would be therapeutically beneficial to adults with sickle phenotypes, and provide a rationale for detailed investigations into the molecular basis for its developmental silencing.

Full details of the abovementioned studies are described in the following publications, the disclosure of which are hereby incorporated by reference:

Shen, S.-H.; Smithies, O.: Human globin psi-beta-2 is not a globin-related sequence. Nucleic Acids Res. 10:7809-7818, 1982; and He, Z.; Russell, J. E.: A human embryonic hemoglobin inhibits Hb S polymerization in vitro and restores a normal phenotype to mouse models of sickle cell disease. Proc. Nat. Acad. Sci.

Further studies establishing the function and utilities of HBE1 are found in John Hopkins OMIM database record ID 142100, and in sited publications numbered 11689-11699 listed in the bibliography section hereinbelow, which are also hereby incorporated by reference. Heat Shock 70 kDa Protein 4 (HSPA4, Accession XM_114482) is another VGAM2236 host target gene. HSPA4 BINDING SITE is HOST TARGET binding site found in the 3' untranslated region of mRNA encoded by HSPA4, corresponding to a HOST TARGET binding site such as BINDING SITE I, BINDING SITE II or BINDING SITE III. Table 2 illustrates the complementarity of the nucleotide sequences of HSPA4 BINDING SITE, designated SEQ ID:42975, to the nucleotide sequence of VGAM2236 RNA, herein designated VGAM RNA, also designated SEQ ID:4947.

Another function of VGAM2236 is therefore inhibition of Heat Shock 70kDa Protein 4 (HSPA4, Accession XM_114482). Accordingly, utilities of VGAM2236 include diagnosis, prevention and treatment of diseases and clinical conditions associated with HSPA4. V-ski Sarcoma Viral Oncogene Homolog (avian) (SKI, Accession NM_003036) is another VGAM2236 host target gene. SKI BINDING SITE is HOST TARGET binding site found in the 3' untranslated region of mRNA encoded by SKI, corresponding to a HOST TARGET binding site such as BINDING SITE I, BINDING SITE II or BINDING SITE III. Table 2 illustrates the complementarity of the nucleotide sequences of SKI BINDING SITE, designated SEQ ID:8990, to the nucleotide sequence of VGAM2236 RNA, herein designated VGAM RNA, also designated SEQ ID:4947.

Another function of VGAM2236 is therefore inhibition of V-ski Sarcoma Viral Oncogene Homolog (avian) (SKI, Accession NM_003036). Accordingly, utilities of VGAM2236 include diagnosis, prevention and treatment of diseases and clinical conditions associated with SKI. Transmembrane Protease, Serine 2 (TMPRSS2, Accession NM_005656) is another VGAM2236 host target gene. TMPRSS2 BINDING SITE is HOST TARGET binding site found in the 3' untranslated region of mRNA encoded by TMPRSS2, corresponding to a HOST TARGET binding site such as BINDING SITE I, BINDING SITE II or BINDING SITE III. Table 2 illustrates the complementarity of the nucleotide sequences of TMPRSS2 BINDING SITE, designated SEQ ID:12196, to the nucleotide sequence of VGAM2236 RNA, herein designated VGAM RNA, also designated SEQ ID:4947.

Another function of VGAM2236 is therefore inhibition of Transmembrane Protease, Serine 2 (TMPRSS2, Accession NM_005656). Accordingly, utilities of VGAM2236 include diagnosis, prevention and treatment of diseases and clinical conditions associated with TMPRSS2. Chromosome 20 Open Reading Frame 150 (C20orf150, Accession XM_037265) is another VGAM2236 host target gene. C20orf150 BINDING SITE is HOST TARGET binding site found in the 3' untranslated region of mRNA encoded by C20orf150, corresponding to a HOST TARGET binding site such as BINDING SITE I, BINDING SITE II or BINDING SITE III. Table 2 illustrates the complementarity of the nucleotide sequences of C20orf150 BINDING SITE, designated SEQ ID:32599, to the nucleotide sequence of VGAM2236 RNA, herein designated VGAM RNA, also designated SEQ ID:4947.

Another function of VGAM2236 is therefore inhibition of Chromosome 20 Open Reading Frame 150 (C20orf150, Accession XM_037265). Accordingly, utilities of VGAM2236 include diagnosis, prevention and treatment of diseases and clinical conditions associated with C20orf150. Cleavage Stimulation Factor, 3' Pre-RNA, Subunit 1, 50 kDa (CSTF1, Accession NM_001324) is another VGAM2236 host target gene. CSTF1 BINDING SITE is HOST TARGET binding site found in the 5' untranslated region of mRNA encoded by CSTF1, corresponding to a HOST TARGET binding site such as BINDING SITE I, BINDING SITE II or BINDING SITE III. Table 2 illustrates the complementarity of the nucleotide sequences of CSTF1 BINDING SITE, designated SEQ ID:7009, to the nucleotide sequence of VGAM2236 RNA, herein designated VGAM RNA, also designated SEQ ID:4947.

Another function of VGAM2236 is therefore inhibition of Cleavage Stimulation Factor, 3' Pre-RNA, Subunit 1, 50 kDa (CSTF1, Accession NM_001324). Accordingly, utilities of VGAM2236 include diagnosis, prevention and treatment of diseases and clinical conditions associated with CSTF1. FLJ12700 (Accession NM_024910) is another VGAM2236 host target gene. FLJ12700 BINDING SITE is HOST TARGET binding site found in the 3' untranslated region of mRNA encoded by FLJ12700, corresponding to a HOST TARGET binding site such as BINDING SITE I, BINDING SITE II or BINDING SITE III. Table 2 illustrates the complementarity of the nucleotide sequences of FLJ12700 BINDING SITE, designated SEQ ID:24414, to the nucleotide sequence of VGAM2236 RNA, herein designated VGAM RNA, also designated SEQ ID:4947.

Another function of VGAM2236 is therefore inhibition of FLJ12700 (Accession NM_024910). Accordingly, utilities of VGAM2236 include diagnosis, prevention and treatment of diseases and clinical conditions associated with FLJ12700. FLJ20320 (Accession NM_017765) is another VGAM2236 host target gene. FLJ20320 BINDING SITE is HOST TARGET binding site found in the 5' untranslated region of mRNA encoded by FLJ20320, corresponding to a HOST TARGET binding site such as BINDING SITE I, BINDING SITE II or BINDING SITE III. Table 2 illustrates the complementarity of the nucleotide sequences of FLJ20320 BINDING SITE, designated SEQ ID:19383, to the nucleotide sequence of VGAM2236 RNA, herein designated VGAM RNA, also designated SEQ ID:4947.

Another function of VGAM2236 is therefore inhibition of FLJ20320 (Accession NM_017765). Accordingly, utilities of VGAM2236 include diagnosis, prevention and treatment of diseases and clinical conditions associated with FLJ20320. Glycoprotein V (platelet) (GP5, Accession NM_004488) is another VGAM2236 host target gene. GP5 BINDING SITE is HOST TARGET binding site found in the 3' untranslated region of mRNA encoded by GP5, corresponding to a HOST TARGET binding site such as BINDING SITE I, BINDING SITE II or BINDING SITE III. Table 2 illustrates the complementarity of the nucleotide sequences of GP5 BINDING SITE, designated SEQ ID:10821, to the nucleotide sequence of VGAM2236 RNA, herein designated VGAM RNA, also designated SEQ ID:4947.

Another function of VGAM2236 is therefore inhibition of Glycoprotein V (platelet) (GP5, Accession NM_004488). Accordingly, utilities of VGAM2236 include diagnosis, prevention and treatment of diseases and clinical conditions associated with GP5. KIAA0649 (Accession NM_014811) is another VGAM2236 host target gene. KIAA0649 BINDING SITE is HOST TARGET binding site found in the 3' untranslated region of mRNA encoded by KIAA0649, corresponding to a HOST TARGET binding site such as BINDING SITE I, BINDING SITE II or BINDING SITE III. Table 2 illustrates the complementarity of the nucleotide sequences of KIAA0649 BINDING SITE, designated SEQ ID:16773, to the nucleotide sequence of VGAM2236 RNA, herein designated VGAM RNA, also designated SEQ ID:4947.

Another function of VGAM2236 is therefore inhibition of KIAA0649 (Accession NM_014811). Accordingly, utilities of VGAM2236 include diagnosis, prevention and treatment of diseases and clinical conditions associated with KIAA0649. KIAA1383 (Accession XM_045859) is another VGAM2236 host target gene. KIAA1383 BINDING SITE is HOST TARGET binding site found in the 3' untranslated region of mRNA encoded by KIAA1383, corresponding to a HOST TARGET binding site such as BINDING SITE I, BINDING SITE II or BINDING SITE III. Table 2 illustrates the complementarity of the nucleotide sequences of KIAA1383 BINDING SITE, designated SEQ ID:34585, to the nucleotide sequence of VGAM2236 RNA, herein designated VGAM RNA, also designated SEQ ID:4947.

Another function of VGAM2236 is therefore inhibition of KIAA1383 (Accession XM_045859). Accordingly, utilities of VGAM2236 include diagnosis, prevention and treatment of diseases and clinical conditions associated with KIAA1383. PA26 (Accession NM_014454) is another VGAM2236 host target gene. PA26 BINDING SITE is HOST TARGET binding site found in the 3' untranslated region of mRNA encoded by PA26, corresponding to a HOST TARGET binding site such as BINDING SITE I, BINDING SITE II or BINDING SITE III. Table 2 illustrates the complementarity of the nucleotide sequences of PA26 BINDING SITE, designated SEQ ID:15808, to the nucleotide sequence of VGAM2236 RNA, herein designated VGAM RNA, also designated SEQ ID:4947.

Another function of VGAM2236 is therefore inhibition of PA26 (Accession NM_014454). Accordingly, utilities of VGAM2236 include diagnosis, prevention and treatment of diseases and clinical conditions associated with PA26. Solute Carrier Family 5 (choline transporter), Member 7 (SLC5A7, Accession NM_021815) is another VGAM2236 host target gene. SLC5A7 BINDING SITE is HOST TARGET binding site found in the 3' untranslated region of mRNA encoded by SLC5A7, corresponding to a HOST TARGET binding site such as BINDING SITE I, BINDING SITE II or BINDING SITE III. Table 2 illustrates the complementarity of the nucleotide sequences of SLC5A7 BINDING SITE, designated SEQ ID:22394, to the nucleotide sequence of VGAM2236 RNA, herein designated VGAM RNA, also designated SEQ ID:4947.

Another function of VGAM2236 is therefore inhibition of Solute Carrier Family 5 (choline transporter), Member 7 (SLC5A7, Accession NM_021815). Accordingly, utilities of VGAM2236 include diagnosis, prevention and treatment of diseases and clinical conditions associated with SLC5A7. LOC118987 (Accession XM_058361) is another VGAM2236 host target gene. LOC118987 BINDING SITE is HOST TARGET binding site found in the 3' untranslated region of mRNA encoded by LOC118987, corresponding to a HOST TARGET binding site such as BINDING SITE I, BINDING SITE II or BINDING SITE III. Table 2 illustrates the complementarity of the nucleotide sequences of LOC118987 BINDING SITE, designated SEQ ID:36609, to the nucleotide sequence of VGAM2236 RNA, herein designated VGAM RNA, also designated SEQ ID:4947.

Another function of VGAM2236 is therefore inhibition of LOC118987 (Accession XM_058361). Accordingly, utilities of VGAM2236 include diagnosis, prevention and treatment of diseases and clinical conditions associated with LOC118987. LOC150245 (Accession XM_097843) is another VGAM2236 host target gene. LOC150245 BIND- ING SITE is HOST TARGET binding site found in the 3' untranslated region of mRNA encoded by LOC150245, corresponding to a HOST TARGET binding site such as BINDING SITE I, BINDING SITE II or BINDING SITE III. Table 2 illustrates the complementarity of the nucleotide sequences of LOC150245 BINDING SITE, designated SEQ ID:41164, to the nucleotide sequence of VGAM2236 RNA, herein designated VGAM RNA, also designated SEQ ID:4947.

Another function of VGAM2236 is therefore inhibition of LOC150245 (Accession XM_097843). Accordingly, utilities of VGAM2236 include diagnosis, prevention and treatment of diseases and clinical conditions associated with LOC150245. LOC151162 (Accession XM_098012) is another VGAM2236 host target gene. LOC151162 BINDING SITE is HOST TARGET binding site found in the 5' untranslated region of mRNA encoded by LOC151162, corresponding to a HOST TARGET binding site such as BINDING SITE I, BINDING SITE II or BINDING SITE III. Table 2 illustrates the complementarity of the nucleotide sequences of LOC151162 BINDING SITE, designated SEQ ID:41309, to the nucleotide sequence of VGAM2236 RNA, herein designated VGAM RNA, also designated SEQ ID:4947.

Another function of VGAM2236 is therefore inhibition of LOC151162 (Accession XM_098012). Accordingly, utilities of VGAM2236 include diagnosis, prevention and treatment of diseases and clinical conditions associated with LOC151162. LOC158056 (Accession XM_088463) is another VGAM2236 host target gene. LOC158056 BINDING SITE is HOST TARGET binding site found in the 5' untranslated region of mRNA encoded by LOC158056, corresponding to a HOST TARGET binding site such as BINDING SITE I, BINDING SITE II or BINDING SITE III. Table 2 illustrates the complementarity of the nucleotide sequences of LOC158056 BINDING SITE, designated SEQ ID:39719, to the nucleotide sequence of VGAM2236 RNA, herein designated VGAM RNA, also designated SEQ ID:4947.

Another function of VGAM2236 is therefore inhibition of LOC158056 (Accession XM_088463). Accordingly, utilities of VGAM2236 include diagnosis, prevention and treatment of diseases and clinical conditions associated with LOC158056. LOC202134 (Accession XM_117365) is another VGAM2236 host target gene. LOC202134 BINDING SITE is HOST TARGET binding site found in the 3' untranslated region of mRNA encoded by LOC202134, corresponding to a HOST TARGET binding site such as BINDING SITE I, BINDING SITE II or BINDING SITE III. Table 2 illustrates the complementarity of the nucleotide sequences of LOC202134 BINDING SITE, designated SEQ ID:43414, to the nucleotide sequence of VGAM2236 RNA, herein designated VGAM RNA, also designated SEQ ID:4947.

Another function of VGAM2236 is therefore inhibition of LOC202134 (Accession XM_117365). Accordingly, utilities of VGAM2236 include diagnosis, prevention and treatment of diseases and clinical conditions associated with LOC202134. LOC203377 (Accession XM_117540) is another VGAM2236 host target gene. LOC203377 BINDING SITE is HOST TARGET binding site found in the 5' untranslated region of mRNA encoded by LOC203377, corresponding to a HOST TARGET binding site such as BINDING SITE I, BINDING SITE II or BINDING SITE III. Table 2 illustrates the complementarity of the nucleotide sequences of LOC203377 BINDING SITE, designated SEQ ID:43544, to the nucleotide sequence of VGAM2236 RNA, herein designated VGAM RNA, also designated SEQ ID:4947.

Another function of VGAM2236 is therefore inhibition of LOC203377 (Accession XM_117540). Accordingly, utilities of VGAM2236 include diagnosis, prevention and treatment of diseases and clinical conditions associated with LOC203377. LOC220988 (Accession XM_165561) is another VGAM2236 host target gene. LOC220988 BINDING SITE is HOST TARGET binding site found in the 3' untranslated region of mRNA encoded by LOC220988, corresponding to a HOST TARGET binding site such as BINDING SITE I, BINDING SITE II or BINDING SITE III. Table 2 illustrates the complementarity of the nucleotide sequences of LOC220988 BINDING SITE, designated SEQ ID:43683, to the nucleotide sequence of VGAM2236 RNA, herein designated VGAM RNA, also designated SEQ ID:4947.

Another function of VGAM2236 is therefore inhibition of LOC220988 (Accession XM_165561). Accordingly, utilities of VGAM2236 include diagnosis, prevention and treatment of diseases and clinical conditions associated with LOC220988. LOC221271 (Accession XM_166307) is another VGAM2236 host target gene. LOC221271 BINDING SITE is HOST TARGET binding site found in the 3' untranslated region of mRNA encoded by LOC221271, corresponding to a HOST TARGET binding site such as BINDING SITE I, BINDING SITE II or BINDING SITE III. Table 2 illustrates the complementarity of the nucleotide sequences of LOC221271 BINDING SITE, designated SEQ ID:44123, to the nucleotide sequence of VGAM2236 RNA, herein designated VGAM RNA, also designated SEQ ID:4947.

Another function of VGAM2236 is therefore inhibition of LOC221271 (Accession XM_166307). Accordingly, utilities of VGAM2236 include diagnosis, prevention and treatment of diseases and clinical conditions associated with LOC221271. LOC92370 (Accession XM_044665) is another VGAM2236 host target gene. LOC92370 BINDING SITE is HOST TARGET binding site found in the 3' untranslated region of mRNA encoded by LOC92370, corresponding to a HOST TARGET binding site such as BINDING SITE I, BINDING SITE II or BINDING SITE III. Table 2 illustrates the complementarity of the nucleotide sequences of LOC92370 BINDING SITE, designated SEQ ID:34259, to the nucleotide sequence of VGAM2236 RNA, herein designated VGAM RNA, also designated SEQ ID:4947.

Another function of VGAM2236 is therefore inhibition of LOC92370 (Accession XM_044665). Accordingly, utilities of VGAM2236 include diagnosis, prevention and treatment of diseases and clinical conditions associated with LOC92370. LOC93048 (Accession XM_048903) is another VGAM2236 host target gene. LOC93048 BINDING SITE is HOST TARGET binding site found in the 5' untranslated region of mRNA encoded by LOC93048, corresponding to a HOST TARGET binding site such as BINDING SITE I, BINDING SITE II or BINDING SITE III. Table 2 illustrates the complementarity of the nucleotide sequences of LOC93048 BINDING SITE, designated SEQ ID:35296, to the nucleotide sequence of VGAM2236 RNA, herein designated VGAM RNA, also designated SEQ ID:4947.

Another function of VGAM2236 is therefore inhibition of LOC93048 (Accession XM_048903). Accordingly, utilities of VGAM2236 include diagnosis, prevention and treatment of diseases and clinical conditions associated with LOC93048. FIG. 1 further provides a conceptual description of a novel bioinformatically detected viral gene of the present invention, referred to here as Viral Genomic Address Messenger 2237 (VGAM2237) viral gene, which modulates expression of respective host target genes thereof, the function and utility of which host target genes is known in the art.

VGAM2237 is a novel bioinformatically detected regulatory, non protein coding, viral micro RNA (miRNA) gene. The method by which VGAM2237 was detected is described hereinabove with reference to FIGS. 1-8.

VGAM2237 gene, herein designated VGAM GENE, is a viral gene contained in the genome of Porcine Epidemic Diarrhea Virus. VGAM2237 host target gene, herein designated VGAM HOST TARGET GENE, is a human gene contained in the human genome.

VGAM2237 gene encodes a VGAM2237 precursor RNA, herein designated VGAM PRECURSOR RNA. Similar to other miRNA genes, and unlike most ordinary genes, VGAM2237 precursor RNA does not encode a protein. A nucleotide sequence identical or highly similar to the nucleotide sequence of VGAM2237 precursor RNA is designated SEQ ID:2223, and is provided hereinbelow with reference to the sequence listing part. Nucleotide sequence SEQ ID:2223 is located at position 26770 relative to the genome of Porcine Epidemic Diarrhea Virus.

VGAM2237 precursor RNA folds onto itself, forming VGAM2237 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2237 folded precursor RNA into VGAM2237 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM2237 RNA is designated SEQ ID:4948, and is provided hereinbelow with reference to the sequence listing part.

VGAM2237 host target gene, herein designated VGAM HOST TARGET GENE, encodes a corresponding messenger RNA, VGAM2237 host target RNA, herein designated VGAM HOST TARGET RNA. VGAM2237 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2237 RNA, herein designated VGAM RNA, binds complementarily to one or more host target binding sites located in untranslated regions of VGAM2237 host target RNA, herein designated VGAM HOST TARGET RNA. This complementary binding is due to the fact that the nucleotide sequence of VGAM2237 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2237 RNA, herein designated VGAM RNA, may have a different number of host target binding sites in untranslated regions of a VGAM2237 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2237 RNA, herein designated VGAM RNA, to host target binding sites on VGAM2237 host target RNA, herein designated VGAM HOST TARGET RNA, such as BINDING SITE I, BINDING SITE II and BINDING SITE III, inhibits translation of VGAM2237 host target RNA into VGAM2237 host target protein, herein designated VGAM HOST TARGET PROTEIN. VGAM host target protein is therefore outlined by a broken line.

It is appreciated that VGAM2237 host target gene, herein designated VGAM HOST TARGET GENE, in fact represents a plurality of VGAM2237 host target genes. The mRNA of each one of this plurality of VGAM2237 host target genes comprises one or more host target binding sites, each having a nucleotide sequence which is at least partly complementary to VGAM2237 RNA, herein designated VGAM RNA, and which when bound by VGAM2237 RNA causes inhibition of translation of respective one or more VGAM2237 host target proteins.

It is further appreciated by one skilled in the art that the mode of translational inhibition illustrated by FIG. 1 with specific reference to translational inhibition exerted by VGAM2237 gene, herein designated VGAM GENE, on one or more VGAM2237 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2237 is inhibition of expression of host target genes, as part of a novel viral mechanism of attacking a host. Accordingly, utilities of VGAM2237 include diagnosis, prevention and treatment of viral infection by Porcine Epidemic Diarrhea Virus. Specific functions, and accordingly utilities, of VGAM2237 correlate with, and may be deduced from, the identity of the host target genes which VGAM2237 binds and inhibits, and the function of these host target genes, as elaborated hereinbelow.

Nucleotide sequences of the VGAM2237 precursor RNA, herein designated VGAM PRECURSOR RNA, and of the 'diced' VGAM2237 RNA, herein designated VGAM RNA, and a schematic representation of the secondary folding of VGAM2237 folded precursor RNA, herein designated VGAM FOLDED PRECURSOR RNA, of VGAM2237 are further described hereinbelow with reference to Table 1.

Nucleotide sequences of host target binding sites, such as BINDING SITE-I, BINDING SITE-II and BINDING SITE-III of FIG. 1, found on VGAM2237 host target RNA, and schematic representation of the complementarity of each of these host target binding sites to VGAM2237 RNA, herein designated VGAM RNA, are described hereinbelow with reference to Table 2.

As mentioned hereinabove with reference to FIG. 1, a function of VGAM2237 gene, herein designated VGAM is inhibition of expression of VGAM2237 target genes. It is appreciated that specific functions, and accordingly utilities, of VGAM2237 correlate with, and may be deduced from, the identity of the target genes which VGAM2237 binds and inhibits, and the function of these target genes, as elaborated hereinbelow.

Core-binding Factor, Runt Domain, Alpha Subunit 2; Translocated To, 3 (CBFA2T3, Accession NM_005187) is a VGAM2237 host target gene. CBFA2T3 BINDING SITE is HOST TARGET binding site found in the 3' untranslated region of mRNA encoded by CBFA2T3, corresponding to a HOST TARGET binding site such as BINDING SITE I, BINDING SITE II or BINDING SITE III. Table 2 illustrates the complementarity of the nucleotide sequences of CBFA2T3 BINDING SITE, designated SEQ ID:11689, to the nucleotide sequence of VGAM2237 RNA, herein designated VGAM RNA, also designated SEQ ID:4948.

A function of VGAM2237 is therefore inhibition of Core-binding Factor, Runt Domain, Alpha Subunit 2; Translocated To, 3 (CBFA2T3, Accession NM_005187). Accordingly, utilities of VGAM2237 include diagnosis, prevention and treatment of diseases and clinical conditions associated with CBFA2T3. DEAD/H (Asp-Glu-Ala-Asp/His) Box Polypeptide, Y Chromosome (DBY, Accession NM_004660) is another VGAM2237 host target gene. DBY BINDING SITE is HOST TARGET binding site found in the 3' untranslated region of mRNA encoded by DBY, corresponding to a HOST TARGET binding site such as BINDING SITE I, BINDING SITE II or BINDING SITE III. Table 2 illustrates the complementarity of the nucleotide sequences of DBY BINDING SITE, designated SEQ ID:11025, to the nucleotide sequence of VGAM2237 RNA, herein designated VGAM RNA, also designated SEQ ID:4948.

Another function of VGAM2237 is therefore inhibition of DEAD/H (Asp-Glu-Ala-Asp/His) Box Polypeptide, Y Chromosome (DBY, Accession NM_004660), a gene which plays a key role in the spermatogenic process. Accordingly, utilities of VGAM2237 include diagnosis, prevention and treatment of diseases and clinical conditions associated with DBY. The function of DBY and its association with various diseases and clinical conditions, has been established by previous studies, as described hereinabove with reference to VGAM374. Deafness, Autosomal Dominant 5 (DFNA5, Accession NM_004403) is another VGAM2237 host target gene. DFNA5 BINDING SITE is HOST TARGET binding site found in the 3' untranslated region of mRNA encoded by DFNA5, corresponding to a HOST TARGET binding site such as BINDING SITE I, BINDING SITE II or BINDING SITE III. Table 2 illustrates the complementarity of the nucleotide sequences of DFNA5 BINDING SITE, designated SEQ ID:10654, to the nucleotide sequence of VGAM2237 RNA, herein designated VGAM RNA, also designated SEQ ID:4948.

Another function of VGAM2237 is therefore inhibition of Deafness, Autosomal Dominant 5 (DFNA5, Accession NM_004403). Accordingly, utilities of VGAM2237 include diagnosis, prevention and treatment of diseases and clinical conditions associated with DFNA5. Histamine N-methyltransferase (HNMT, Accession NM_006895) is another VGAM2237 host target gene. HNMT BINDING SITE is HOST TARGET binding site found in the 5' untranslated region of mRNA encoded by HNMT, corresponding to a HOST TARGET binding site such as BINDING SITE I, BINDING SITE II or BINDING SITE III. Table 2 illustrates the complementarity of the nucleotide sequences of HNMT BINDING SITE, designated SEQ ID:13767, to the nucleotide sequence of VGAM2237 RNA, herein designated VGAM RNA, also designated SEQ ID:4948.

Another function of VGAM2237 is therefore inhibition of Histamine N-methyltransferase (HNMT, Accession NM_006895), a gene which inactivates histamine by n-methylation. Accordingly, utilities of VGAM2237 include diagnosis, prevention and treatment of diseases and clinical conditions associated with HNMT. The function of HNMT has been established by previous studies. Preuss et al. (1998) demonstrated a common 314C-T polymorphism in the HNMT gene resulting in a thr105-to-ile amino acid substitution (605238.0001). The 314T allele is associated with decreased levels of both HNMT enzymatic activity and immunoreactive protein; therefore, the presence of the 314T allele would be expected to result in reduced histamine metabolism and increased bronchoconstriction. Yan et al. (2000) characterized the common, functionally significant 314T polymorphism in DNA samples from 237 randomly selected Caucasian control subjects and 192 samples from Caucasian asthmatic patients. The frequency of the 314T allele of the HNMT gene was 0.08 in the control samples and 0.14 in samples from Caucasian asthmatic patients (odds ratio=1.9, P less than 0.01), indicating a significant increase in the frequency of subjects with low HNMT activity among asthmatics.

Full details of the abovementioned studies are described in the following publications, the disclosure of which are hereby incorporated by reference:

Preuss, C. V.; Wood, T. C.; Szumlanski, C. L.; Raftogianis, R. B.; Otterness, D. M.; Girard, B.; Scott, M. C.; Weinshilboum, R. M.: Human histamine N-methyltransferase pharmacogenetics: common genetic polymorphisms that alter activity. Molec. Pharm. 53:708-717, 1998; and Yan, L.; Galinsky, R. E.; Bernstein, J. A.; Liggett, S. B.; Weinshilboum, R. M.: Histamine N-methyltransferase pharmacogenetics: association of a common functional polymorphism with asthma.

Further studies establishing the function and utilities of HNMT are found in John Hopkins OMIM database record ID 605238, and in sited publications numbered 7488-7493 listed in the bibliography section hereinbelow, which are also hereby incorporated by reference. Junctophilin 2 (JPH2, Accession XM_170491) is another VGAM2237 host target gene. JPH2 BINDING SITE is HOST TARGET binding site found in the 5' untranslated region of mRNA encoded by JPH2, corresponding to a HOST TARGET binding site such as BINDING SITE I, BINDING SITE II or BINDING SITE III. Table 2 illustrates the complementarity of the nucleotide sequences of JPH2 BINDING SITE, designated SEQ ID:45333, to the nucleotide sequence of VGAM2237 RNA, herein designated VGAM RNA, also designated SEQ ID:4948.

Another function of VGAM2237 is therefore inhibition of Junctophilin 2 (JPH2, Accession XM_170491), a gene which mediates cross talk between cell surface and intracellular ion channels. Accordingly, utilities of VGAM2237 include diagnosis, prevention and treatment of diseases and clinical conditions associated with JPH2. The function of JPH2 and its association with various diseases and clinical conditions, has been established by previous studies, as described hereinabove with reference to VGAM295. Neurobeachin (NBEA, Accession XM_170732) is another VGAM2237 host target gene. NBEA BINDING SITE is HOST TARGET binding site found in the 3' untranslated region of mRNA encoded by NBEA, corresponding to a HOST TARGET binding site such as BINDING SITE I, BINDING SITE II or BINDING SITE III. Table 2 illustrates the complementarity of the nucleotide sequences of NBEA BINDING SITE, designated SEQ ID:45494, to the nucleotide sequence of VGAM2237 RNA, herein designated VGAM RNA, also designated SEQ ID:4948.

Another function of VGAM2237 is therefore inhibition of Neurobeachin (NBEA, Accession XM_170732), a gene which may mediate protein-protein interactions. Accordingly, utilities of VGAM2237 include diagnosis, prevention and treatment of diseases and clinical conditions associated with NBEA. The function of NBEA and its association with various diseases and clinical conditions, has been established by previous studies, as described hereinabove with reference to VGAM459. Translin (TSN, Accession NM_004622) is another VGAM2237 host target gene. TSN BINDING SITE is HOST TARGET binding site found in the 3' untranslated region of mRNA encoded by TSN, corresponding to a HOST TARGET binding site such as BINDING SITE I, BINDING SITE II or BINDING SITE III. Table 2 illustrates the complementarity of the nucleotide sequences of TSN BINDING SITE, designated SEQ ID:10987, to the nucleotide sequence of VGAM2237 RNA, herein designated VGAM RNA, also designated SEQ ID:4948.

Another function of VGAM2237 is therefore inhibition of Translin (TSN, Accession NM_004622), a gene which is a DNA binding protein and involved in DNA repair, replication, or recombination. Accordingly, utilities of VGAM2237 include diagnosis, prevention and treatment of diseases and clinical conditions associated with TSN. The function of TSN and its association with various diseases and clinical conditions, has been established by previous studies, as described hereinabove with reference to VGAM98. Vinculin (VCL, Accession NM_003373) is another VGAM2237 host target gene. VCL BINDING SITE1 and VCL BINDING SITE2 are HOST TARGET binding sites found in untranslated regions of mRNA encoded by VCL, corresponding to HOST TARGET binding sites such as BINDING SITE I, BINDING SITE II or BINDING SITE III. Table 2 illustrates the complementarity of the nucleotide sequences of VCL BINDING SITE1 and VCL BINDING SITE2, designated SEQ ID:9406 and SEQ ID:15195 respectively, to the nucleotide sequence of VGAM2237 RNA, herein designated VGAM RNA, also designated SEQ ID:4948.

Another function of VGAM2237 is therefore inhibition of Vinculin (VCL, Accession NM_003373). Accordingly, utilities of VGAM2237 include diagnosis, prevention and treatment of diseases and clinical conditions associated with VCL. CASPR3 (Accession NM_024879) is another VGAM2237 host target gene. CASPR3 BINDING SITE1 and CASPR3 BINDING SITE2 are HOST TARGET binding sites found in untranslated regions of mRNA encoded by CASPR3, corresponding to HOST TARGET binding sites such as BINDING SITE I, BINDING SITE II or BINDING SITE III. Table 2 illustrates the complementarity of the nucleotide sequences of CASPR3 BINDING SITE1 and CASPR3 BINDING SITE2, designated SEQ ID:24317 and SEQ ID:27388 respectively, to the nucleotide sequence of VGAM2237 RNA, herein designated VGAM RNA, also designated SEQ ID:4948.

Another function of VGAM2237 is therefore inhibition of CASPR3 (Accession NM_024879). Accordingly, utilities of VGAM2237 include diagnosis, prevention and treatment of diseases and clinical conditions associated with CASPR3. Death Associated Transcription Factor 1 (DATF1, Accession NM_022105) is another VGAM2237 host target gene. DATF1 BINDING SITE1 and DATF1 BINDING SITE2 are HOST TARGET binding sites found in untranslated regions of mRNA encoded by DATF1, corresponding to HOST TARGET binding sites such as BINDING SITE I, BINDING SITE II or BINDING SITE III. Table 2 illustrates the complementarity of the nucleotide sequences of DATF1 BINDING SITE1 and DATF1 BINDING SITE2, designated SEQ ID:22652 and SEQ ID:25991 respectively, to the nucleotide sequence of VGAM2237 RNA, herein designated VGAM RNA, also designated SEQ ID:4948.

Another function of VGAM2237 is therefore inhibition of Death Associated Transcription Factor 1 (DATF1, Accession NM_022105). Accordingly, utilities of VGAM2237 include diagnosis, prevention and treatment of diseases and clinical conditions associated with DATF1. FLJ12529 (Accession NM_024811) is another VGAM2237 host target gene. FLJ12529 BINDING SITE is HOST TARGET binding site found in the 3' untranslated region of mRNA encoded by FLJ12529, corresponding to a HOST TARGET binding site such as BINDING SITE I, BINDING SITE II or BINDING SITE III. Table 2 illustrates the complementarity of the nucleotide sequences of FLJ12529 BINDING SITE, designated SEQ ID:24190, to the nucleotide sequence of VGAM2237 RNA, herein designated VGAM RNA, also designated SEQ ID:4948.

Another function of VGAM2237 is therefore inhibition of FLJ12529 (Accession NM_024811). Accordingly, utilities of VGAM2237 include diagnosis, prevention and treatment of diseases and clinical conditions associated with FLJ12529. KIAA0408 (Accession NM_014702) is another VGAM2237 host target gene. KIAA0408 BINDING SITE is HOST TARGET binding site found in the 3' untranslated region of mRNA encoded by KIAA0408, corresponding to a HOST TARGET binding site such as BINDING SITE I, BINDING SITE II or BINDING SITE III. Table 2 illustrates the complementarity of the nucleotide sequences of KIAA0408 BINDING SITE, designated SEQ ID:16228, to the nucleotide sequence of VGAM2237 RNA, herein designated VGAM RNA, also designated SEQ ID:4948.

Another function of VGAM2237 is therefore inhibition of KIAA0408 (Accession NM_014702). Accordingly, utilities of VGAM2237 include diagnosis, prevention and treatment of diseases and clinical conditions associated with KIAA0408. KIAA0618 (Accession NM_014833) is another VGAM2237 host target gene. KIAA0618 BINDING SITE is HOST TARGET binding site found in the 3' untranslated region of mRNA encoded by KIAA0618, corresponding to a HOST TARGET binding site such as BINDING SITE I, BINDING SITE II or BINDING SITE III. Table 2 illustrates the complementarity of the nucleotide sequences of KIAA0618 BINDING SITE, designated SEQ ID:16831, to the nucleotide sequence of VGAM2237 RNA, herein designated VGAM RNA, also designated SEQ ID:4948.

Another function of VGAM2237 is therefore inhibition of KIAA0618 (Accession NM_014833). Accordingly, utilities of VGAM2237 include diagnosis, prevention and treatment of diseases and clinical conditions associated with KIAA0618. KIAA1191 (Accession NM_020444) is another VGAM2237 host target gene. KIAA1191 BINDING SITE is HOST TARGET binding site found in the 3' untranslated region of mRNA encoded by KIAA1191, corresponding to a HOST TARGET binding site such as BINDING SITE I, BINDING SITE II or BINDING SITE III. Table 2 illustrates the complementarity of the nucleotide sequences of KIAA1191 BINDING SITE, designated SEQ ID:21683, to the nucleotide sequence of VGAM2237 RNA, herein designated VGAM RNA, also designated SEQ ID:4948.

Another function of VGAM2237 is therefore inhibition of KIAA1191 (Accession NM_020444). Accordingly, utilities of VGAM2237 include diagnosis, prevention and treatment of diseases and clinical conditions associated with KIAA1191. KIAA1944 (Accession XM_062545) is another VGAM2237 host target gene. KIAA1944 BINDING SITE is HOST TARGET binding site found in the 3' untranslated region of mRNA encoded by KIAA1944, corresponding to a HOST TARGET binding site such as BINDING SITE I, BINDING SITE II or BINDING SITE III. Table 2 illustrates the complementarity of the nucleotide sequences of KIAA1944 BINDING SITE, designated SEQ ID:37232, to the nucleotide sequence of VGAM2237 RNA, herein designated VGAM RNA, also designated SEQ ID:4948.

Another function of VGAM2237 is therefore inhibition of KIAA1944 (Accession XM_062545). Accordingly, utilities of VGAM2237 include diagnosis, prevention and treatment of diseases and clinical conditions associated with KIAA1944. MGC2668 (Accession XM_026968) is another VGAM2237 host target gene. MGC2668 BINDING SITE is HOST TARGET binding site found in the 3' untranslated region of mRNA encoded by MGC2668, corresponding to a HOST TARGET binding site such as BINDING SITE I, BINDING SITE II or BINDING SITE III. Table 2 illustrates the complementarity of the nucleotide sequences of MGC2668 BINDING SITE, designated SEQ ID:30379, to the nucleotide sequence of VGAM2237 RNA, herein designated VGAM RNA, also designated SEQ ID:4948.

Another function of VGAM2237 is therefore inhibition of MGC2668 (Accession XM_026968). Accordingly, utilities of VGAM2237 include diagnosis, prevention and treatment of diseases and clinical conditions associated with MGC2668. NIN283 (Accession NM_032268) is another VGAM2237 host target gene. NIN283 BINDING SITE is HOST TARGET binding site found in the 3' untranslated region of mRNA encoded by NIN283, corresponding to a HOST TARGET binding site such as BINDING SITE I, BINDING SITE II or BINDING SITE III. Table 2 illustrates the complementarity of the nucleotide sequences of NIN283 BINDING SITE, designated SEQ ID:26013, to the nucleotide sequence of VGAM2237 RNA, herein designated VGAM RNA, also designated SEQ ID:4948.

Another function of VGAM2237 is therefore inhibition of NIN283 (Accession NM_032268). Accordingly, utilities of VGAM2237 include diagnosis, prevention and treatment of diseases and clinical conditions associated with NIN283. TRABID (Accession XM_043669) is another VGAM2237 host target gene. TRABID BINDING SITE is HOST TARGET binding site found in the 5' untranslated region of mRNA encoded by TRABID, corresponding to a HOST TARGET binding site such as BINDING SITE I, BINDING SITE II or BINDING SITE III. Table 2 illustrates the complementarity of the nucleotide sequences of TRABID BINDING SITE, designated SEQ ID:33992, to the nucleotide sequence of VGAM2237 RNA, herein designated VGAM RNA, also designated SEQ ID:4948.

Another function of VGAM2237 is therefore inhibition of TRABID (Accession XM_043669). Accordingly, utilities of VGAM2237 include diagnosis, prevention and treatment of diseases and clinical conditions associated with TRABID. LOC139770 (Accession XM_060053) is another VGAM2237 host target gene. LOC139770 BINDING SITE is HOST TARGET binding site found in the 3' untranslated region of mRNA encoded by LOC139770, corresponding to a HOST TARGET binding site such as BINDING SITE I, BINDING SITE II or BINDING SITE III. Table 2 illustrates the complementarity of the nucleotide sequences of LOC139770 BINDING SITE, designated SEQ ID:37150, to the nucleotide sequence of VGAM2237 RNA, herein designated VGAM RNA, also designated SEQ ID:4948.

Another function of VGAM2237 is therefore inhibition of LOC139770 (Accession XM_060053). Accordingly, utilities of VGAM2237 include diagnosis, prevention and treatment of diseases and clinical conditions associated with LOC139770. LOC146268 (Accession XM_085397) is another VGAM2237 host target gene. LOC146268 BINDING SITE is HOST TARGET binding site found in the 3' untranslated region of mRNA encoded by LOC146268, corresponding to a HOST TARGET binding site such as BINDING SITE I, BINDING SITE II or BINDING SITE III. Table 2 illustrates the complementarity of the nucleotide sequences of LOC146268 BINDING SITE, designated SEQ ID:38124, to the nucleotide sequence of VGAM2237 RNA, herein designated VGAM RNA, also designated SEQ ID:4948.

Another function of VGAM2237 is therefore inhibition of LOC146268 (Accession XM_085397). Accordingly, utilities of VGAM2237 include diagnosis, prevention and treatment of diseases and clinical conditions associated with LOC146268. LOC147136 (Accession XM_085716) is another VGAM2237 host target gene. LOC147136 BINDING SITE is HOST TARGET binding site found in the 3' untranslated region of mRNA encoded by LOC147136, corresponding to a HOST TARGET binding site such as BINDING SITE I, BINDING SITE II or BINDING SITE III. Table 2 illustrates the complementarity of the nucleotide sequences of LOC147136 BINDING SITE, designated SEQ ID:38298, to the nucleotide sequence of VGAM2237 RNA, herein designated VGAM RNA, also designated SEQ ID:4948.

Another function of VGAM2237 is therefore inhibition of LOC147136 (Accession XM_085716). Accordingly, utilities of VGAM2237 include diagnosis, prevention and treatment of diseases and clinical conditions associated with LOC147136. LOC219793 (Accession XM_166127) is another VGAM2237 host target gene. LOC219793 BINDING SITE is HOST TARGET binding site found in the 5' untranslated region of mRNA encoded by LOC219793, corresponding to a HOST TARGET binding site such as BINDING SITE I, BINDING SITE II or BINDING SITE III. Table 2 illustrates the complementarity of the nucleotide sequences of LOC219793 BINDING SITE, designated SEQ ID:43915, to the nucleotide sequence of VGAM2237 RNA, herein designated VGAM RNA, also designated SEQ ID:4948.

Another function of VGAM2237 is therefore inhibition of LOC219793 (Accession XM_166127). Accordingly, utilities of VGAM2237 include diagnosis, prevention and treatment of diseases and clinical conditions associated with LOC219793. LOC219920 (Accession XM_167787) is another VGAM2237 host target gene. LOC219920 BINDING SITE is HOST TARGET binding site found in the 5' untranslated region of mRNA encoded by LOC219920, corresponding to a HOST TARGET binding site such as BINDING SITE I, BINDING SITE II or BINDING SITE III. Table 2 illustrates the complementarity of the nucleotide sequences of LOC219920 BINDING SITE, designated SEQ ID:44812, to the nucleotide sequence of VGAM2237 RNA, herein designated VGAM RNA, also designated SEQ ID:4948.

Another function of VGAM2237 is therefore inhibition of LOC219920 (Accession XM_167787). Accordingly, utilities of VGAM2237 include diagnosis, prevention and treatment of diseases and clinical conditions associated with LOC219920. FIG. 1 further provides a conceptual description of a novel bioinformatically detected viral gene of the present invention, referred to here as Viral Genomic Address Messenger 2238 (VGAM2238) viral gene, which modulates expression of respective host target genes thereof, the function and utility of which host target genes is known in the art.

VGAM2238 is a novel bioinformatically detected regulatory, non protein coding, viral micro RNA (miRNA) gene. The method by which VGAM2238 was detected is described hereinabove with reference to FIGS. 1-8.

VGAM2238 gene, herein designated VGAM GENE, is a viral gene contained in the genome of Porcine Epidemic Diarrhea Virus. VGAM2238 host target gene, herein designated VGAM HOST TARGET GENE, is a human gene contained in the human genome.

VGAM2238 gene encodes a VGAM2238 precursor RNA, herein designated VGAM PRECURSOR RNA. Similar to other miRNA genes, and unlike most ordinary genes, VGAM2238 precursor RNA does not encode a protein. A nucleotide sequence identical or highly similar to the nucleotide sequence of VGAM2238 precursor RNA is designated SEQ ID:2224, and is provided hereinbelow with reference to the sequence listing part. Nucleotide sequence SEQ ID:2224 is located at position 7462 relative to the genome of Porcine Epidemic Diarrhea Virus.

VGAM2238 precursor RNA folds onto itself, forming VGAM2238 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2238 folded precursor RNA into VGAM2238 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2238 RNA is designated SEQ ID:4949, and is provided hereinbelow with reference to the sequence listing part.

VGAM2238 host target gene, herein designated VGAM HOST TARGET GENE, encodes a corresponding messenger RNA, VGAM2238 host target RNA, herein designated VGAM HOST TARGET RNA. VGAM2238 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2238 RNA, herein designated VGAM RNA, binds complementarily to one or more host target binding sites located in untranslated regions of VGAM2238 host target RNA, herein designated VGAM HOST TARGET RNA. This complementary binding is due to the fact that the nucleotide sequence of VGAM2238 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2238 RNA, herein designated VGAM RNA, may have a different number of host target binding sites in untranslated regions of a VGAM2238 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2238 RNA, herein designated VGAM RNA, to host target binding sites on VGAM2238 host target RNA, herein designated VGAM HOST TARGET RNA, such as BINDING SITE I, BINDING SITE II and BINDING SITE III, inhibits translation of VGAM2238 host target RNA into VGAM2238 host target protein, herein designated VGAM HOST TARGET PROTEIN. VGAM host target protein is therefore outlined by a broken line.

It is appreciated that VGAM2238 host target gene, herein designated VGAM HOST TARGET GENE, in fact represents a plurality of VGAM2238 host target genes. The mRNA of each one of this plurality of VGAM2238 host target genes comprises one or more host target binding sites, each having a nucleotide sequence which is at least partly complementary to VGAM2238 RNA, herein designated VGAM RNA, and which when bound by VGAM2238 RNA causes inhibition of translation of respective one or more VGAM2238 host target proteins.

It is further appreciated by one skilled in the art that the mode of translational inhibition illustrated by FIG. 1 with specific reference to translational inhibition exerted by VGAM2238 gene, herein designated VGAM GENE, on one or more VGAM2238 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2238 is inhibition of expression of host target genes, as part of a novel viral mechanism of attacking a host. Accordingly, utilities of VGAM2238 include diagnosis, prevention and treatment of viral infection by Porcine Epidemic Diarrhea Virus. Specific functions, and accordingly utilities, of VGAM2238 correlate with, and may be deduced from, the identity of the host target genes which VGAM2238 binds and inhibits, and the function of these host target genes, as elaborated hereinbelow.

Nucleotide sequences of the VGAM2238 precursor RNA, herein designated VGAM PRECURSOR RNA, and of the 'diced' VGAM2238 RNA, herein designated VGAM RNA, and a schematic representation of the secondary folding of VGAM2238 folded precursor RNA, herein designated VGAM FOLDED PRECURSOR RNA, of VGAM2238 are further described hereinbelow with reference to Table 1.

Nucleotide sequences of host target binding sites, such as BINDING SITE-I, BINDING SITE-II and BINDING SITE-III of FIG. 1, found on VGAM2238 host target RNA, and schematic representation of the complementarity of each of these host target binding sites to VGAM2238 RNA, herein designated VGAM RNA, are described hereinbelow with reference to Table 2.

As mentioned hereinabove with reference to FIG. 1, a function of VGAM2238 gene, herein designated VGAM is inhibition of expression of VGAM2238 target genes. It is appreciated that specific functions, and accordingly utilities, of VGAM2238 correlate with, and may be deduced from, the identity of the target genes which VGAM2238 binds and inhibits, and the function of these target genes, as elaborated hereinbelow.

Adenylate Cyclase 7 (ADCY7, Accession NM_001114) is a VGAM2238 host target gene. ADCY7 BINDING SITE is HOST TARGET binding site found in the 3' untranslated region of mRNA encoded by ADCY7, corresponding to a HOST TARGET binding site such as BINDING SITE I, BINDING SITE II or BINDING SITE III. Table 2 illustrates the complementarity of the nucleotide sequences of ADCY7

BINDING SITE, designated SEQ ID:6784, to the nucleotide sequence of VGAM2238 RNA, herein designated VGAM RNA, also designated SEQ ID:4949.

A function of VGAM2238 is therefore inhibition of Adenylate Cyclase 7 (ADCY7, Accession NM_001114), a gene which this a membrane-bound, ca (2+)-inhibitable adenylyl cyclase. Accordingly, utilities of VGAM2238 include diagnosis, prevention and treatment of diseases and clinical conditions associated with ADCY7. The function of ADCY7 and its association with various diseases and clinical conditions, has been established by previous studies, as described hereinabove with reference to VGAM108. ATPase, Aminophospholipid Transporter-like, Class I, Type 8A, Member 2 (ATP8A2, Accession XM_167916) is another VGAM2238 host target gene. ATP8A2 BINDING SITE is HOST TARGET binding site found in the 3' untranslated region of mRNA encoded by ATP8A2, corresponding to a HOST TARGET binding site such as BINDING SITE I, BINDING SITE II or BINDING SITE III. Table 2 illustrates the complementarity of the nucleotide sequences of ATP8A2 BINDING SITE, designated SEQ ID:44921, to the nucleotide sequence of VGAM2238 RNA, herein designated VGAM RNA, also designated SEQ ID:4949.

Another function of VGAM2238 is therefore inhibition of ATPase, Aminophospholipid Transporter-like, Class I, Type 8A, Member 2 (ATP8A2, Accession XM_167916). Accordingly, utilities of VGAM2238 include diagnosis, prevention and treatment of diseases and clinical conditions associated with ATP8A2. B-cell CLL/lymphoma 6 (zinc finger protein 51) (BCL6, Accession NM_001706) is another VGAM2238 host target gene. BCL6 BINDING SITE is HOST TARGET binding site found in the 5' untranslated region of mRNA encoded by BCL6, corresponding to a HOST TARGET binding site such as BINDING SITE I, BINDING SITE II or BINDING SITE III. Table 2 illustrates the complementarity of the nucleotide sequences of BCL6 BINDING SITE, designated SEQ ID:7431, to the nucleotide sequence of VGAM2238 RNA, herein designated VGAM RNA, also designated SEQ ID:4949.

Another function of VGAM2238 is therefore inhibition of B-cell CLL/lymphoma 6 (zinc finger protein 51) (BCL6, Accession NM_001706), a gene which is involved in the generation and maintenance of both T and B cells during immune responses. Accordingly, utilities of VGAM2238 include diagnosis, prevention and treatment of diseases and clinical conditions associated with BCL6. The function of BCL6 and its association with various diseases and clinical conditions, has been established by previous studies, as described hereinabove with reference to VGAM481. Myeloid/lymphoid Or Mixed-lineage Leukemia (trithorax homolog, Drosophila); Translocated To, 4 (MLLT4, Accession XM_051832) is another VGAM2238 host target gene. MLLT4 BINDING SITE is HOST TARGET binding site found in the 3' untranslated region of mRNA encoded by MLLT4, corresponding to a HOST TARGET binding site such as BINDING SITE I, BINDING SITE II or BINDING SITE III. Table 2 illustrates the complementarity of the nucleotide sequences of MLLT4 BINDING SITE, designated SEQ ID:35887, to the nucleotide sequence of VGAM2238 RNA, herein designated VGAM RNA, also designated SEQ ID:4949.

Another function of VGAM2238 is therefore inhibition of Myeloid/lymphoid Or Mixed-lineage Leukemia (trithorax homolog, Drosophila); Translocated To, 4 (MLLT4, Accession XM_051832), a gene which may act as an intracellular signaling component. Accordingly, utilities of VGAM2238 include diagnosis, prevention and treatment of diseases and clinical conditions associated with MLLT4. The function of MLLT4 and its association with various diseases and clinical conditions, has been established by previous studies, as described hereinabove with reference to VGAM1608. Proteasome (prosome, macropain) Activator Subunit 3 (PA28 gamma; Ki) (PSME3, Accession NM_005789) is another VGAM2238 host target gene. PSME3 BINDING SITE is HOST TARGET binding site found in the 5' untranslated region of mRNA encoded by PSME3, corresponding to a HOST TARGET binding site such as BINDING SITE I, BINDING SITE II or BINDING SITE III. Table 2 illustrates the complementarity of the nucleotide sequences of PSME3 BINDING SITE, designated SEQ ID:12371, to the nucleotide sequence of VGAM2238 RNA, herein designated VGAM RNA, also designated SEQ ID:4949.

Another function of VGAM2238 is therefore inhibition of Proteasome (prosome, macropain) Activator Subunit 3 (PA28 gamma; Ki) (PSME3, Accession NM_005789), a gene which is the activator subunit of the proteasome (prosome macropain). Accordingly, utilities of VGAM2238 include diagnosis, prevention and treatment of diseases and clinical conditions associated with PSME3. The function of PSME3 and its association with various diseases and clinical conditions, has been established by previous studies, as described hereinabove with reference to VGAM1498. RAB23, Member RAS Oncogene Family (RAB23, Accession NM_016277) is another VGAM2238 host target gene. RAB23 BINDING SITE is HOST TARGET binding site found in the 3' untranslated region of mRNA encoded by RAB23, corresponding to a HOST TARGET binding site such as BINDING SITE I, BINDING SITE II or BINDING SITE III. Table 2 illustrates the complementarity of the nucleotide sequences of RAB23 BINDING SITE, designated SEQ ID:18400, to the nucleotide sequence of VGAM2238 RNA, herein designated VGAM RNA, also designated SEQ ID:4949.

Another function of VGAM2238 is therefore inhibition of RAB23, Member RAS Oncogene Family (RAB23, Accession NM_016277), a gene which is involved in the regulation of intracellular membrane trafficking. Accordingly, utilities of VGAM2238 include diagnosis, prevention and treatment of diseases and clinical conditions associated with RAB23. The function of RAB23 and its association with various diseases and clinical conditions, has been established by previous studies, as described hereinabove with reference to VGAM340. Solute Carrier Family 1 (neuronal/epithelial high affinity glutamate transporter, system Xag), Member 1 (SLC1A1, Accession NM_004170) is another VGAM2238 host target gene. SLC1A1 BINDING SITE is HOST TARGET binding site found in the 3' untranslated region of mRNA encoded by SLC1A1, corresponding to a HOST TARGET binding site such as BINDING SITE I, BINDING SITE II or BINDING SITE III. Table 2 illustrates the complementarity of the nucleotide sequences of SLC1A1 BINDING SITE, designated SEQ ID:10377, to the nucleotide sequence of VGAM2238 RNA, herein designated VGAM RNA, also designated SEQ ID:4949.

Another function of VGAM2238 is therefore inhibition of Solute Carrier Family 1 (neuronal/epithelial high affinity glutamate transporter, system Xag), Member 1 (SLC1A1, Accession NM_004170), a gene which is a glutamate transporter, essential for terminating the postsynaptic action of glutamate by rapidly removing it from the synaptic cleft. Accordingly, utilities of VGAM2238 include diagnosis, prevention and treatment of diseases and clinical conditions associated with SLC1A1. The function of SLC1A1 and its association with various diseases and clinical conditions, has been established by previous studies, as described hereinabove with reference to VGAM206. ATPase, Class II, Type 9A (ATP9A, Accession XM_030577) is another VGAM2238 host target gene. ATP9A BINDING SITE is HOST TARGET binding site found in the 3' untranslated region of mRNA encoded by ATP9A, corresponding to a HOST TARGET binding site such as BINDING SITE I, BINDING SITE II or BINDING SITE III. Table 2 illustrates the complementarity of the nucleotide sequences of ATP9A BINDING SITE, designated SEQ ID:31085, to the nucleotide sequence of VGAM2238 RNA, herein designated VGAM RNA, also designated SEQ ID:4949.

Another function of VGAM2238 is therefore inhibition of ATPase, Class II, Type 9A (ATP9A, Accession XM_030577). Accordingly, utilities of VGAM2238 include diagnosis, prevention and treatment of diseases and clinical conditions associated with ATP9A. Diacylglycerol Kinase, Delta 130 kDa (DGKD, Accession XM_002384) is another VGAM2238 host target gene. DGKD BINDING SITE is HOST TARGET binding site found in the 3' untranslated region of mRNA encoded by DGKD, corresponding to a HOST TARGET binding site such as BINDING SITE I, BINDING SITE II or BINDING SITE III. Table 2 illustrates the complementarity of the nucleotide sequences of DGKD BINDING SITE, designated SEQ ID:29883, to the nucleotide sequence of VGAM2238 RNA, herein designated VGAM RNA, also designated SEQ ID:4949.

Another function of VGAM2238 is therefore inhibition of Diacylglycerol Kinase, Delta 130 kDa (DGKD, Accession XM_002384). Accordingly, utilities of VGAM2238 include diagnosis, prevention and treatment of diseases and clinical conditions associated with DGKD. FLJ10520 (Accession NM_018124) is another VGAM2238 host target gene. FLJ10520 BINDING SITE is HOST TARGET binding site found in the 3' untranslated region of mRNA encoded by FLJ10520, corresponding to a HOST TARGET binding site such as BINDING SITE I, BINDING SITE II or BINDING SITE III. Table 2 illustrates the complementarity of the nucleotide sequences of FLJ10520 BINDING SITE, designated SEQ ID:19905, to the nucleotide sequence of VGAM2238 RNA, herein designated VGAM RNA, also designated SEQ ID:4949.

Another function of VGAM2238 is therefore inhibition of FLJ10520 (Accession NM_018124). Accordingly, utilities of VGAM2238 include diagnosis, prevention and treatment of diseases and clinical conditions associated with FLJ10520. FLJ20618 (Accession NM_017903) is another VGAM2238 host target gene. FLJ20618 BINDING SITE is HOST TARGET binding site found in the 3' untranslated region of mRNA encoded by FLJ20618, corresponding to a HOST TARGET binding site such as BINDING SITE I, BINDING SITE II or BINDING SITE III. Table 2 illustrates the complementarity of the nucleotide sequences of FLJ20618 BINDING SITE, designated SEQ ID:19569, to the nucleotide sequence of VGAM2238 RNA, herein designated VGAM RNA, also designated SEQ ID:4949.

Another function of VGAM2238 is therefore inhibition of FLJ20618 (Accession NM_017903). Accordingly, utilities of VGAM2238 include diagnosis, prevention and treatment of diseases and clinical conditions associated with FLJ20618. Glutamate Receptor, Ionotropic, N-methyl-D-aspartate 3A (GRIN3A, Accession NM_133445) is another VGAM2238 host target gene. GRIN3A BINDING SITE is HOST TARGET binding site found in the 3' untranslated region of mRNA encoded by GRIN3A, corresponding to a HOST TARGET binding site such as BINDING SITE I, BINDING SITE II or BINDING SITE III. Table 2 illustrates the complementarity of the nucleotide sequences of GRIN3A BINDING SITE, designated SEQ ID:28536, to the nucleotide sequence of VGAM2238 RNA, herein designated VGAM RNA, also designated SEQ ID:4949.

Another function of VGAM2238 is therefore inhibition of Glutamate Receptor, Ionotropic, N-methyl-D-aspartate 3A (GRIN3A, Accession NM_133445). Accordingly, utilities of VGAM2238 include diagnosis, prevention and treatment of diseases and clinical conditions associated with GRIN3A. H2A Histone Family, Member J (H2AFJ, Accession NM_018267) is another VGAM2238 host target gene. H2AFJ BINDING SITE is HOST TARGET binding site found in the 3' untranslated region of mRNA encoded by H2AFJ, corresponding to a HOST TARGET binding site such as BINDING SITE I, BINDING SITE II or BINDING SITE III. Table 2 illustrates the complementarity of the nucleotide sequences of H2AFJ BINDING SITE, designated SEQ ID:20237, to the nucleotide sequence of VGAM2238 RNA, herein designated VGAM RNA, also designated SEQ ID:4949.

Another function of VGAM2238 is therefore inhibition of H2A Histone Family, Member J (H2AFJ, Accession NM_018267). Accordingly, utilities of VGAM2238 include diagnosis, prevention and treatment of diseases and clinical conditions associated with H2AFJ. KIAA0565 (Accession XM_039912) is another VGAM2238 host target gene. KIAA0565 BINDING SITE is HOST TARGET binding site found in the 5' untranslated region of mRNA encoded by KIAA0565, corresponding to a HOST TARGET binding site such as BINDING SITE I, BINDING SITE II or BINDING SITE III. Table 2 illustrates the complementarity of the nucleotide sequences of KIAA0565 BINDING SITE, designated SEQ ID:33216, to the nucleotide sequence of VGAM2238 RNA, herein designated VGAM RNA, also designated SEQ ID:4949.

Another function of VGAM2238 is therefore inhibition of KIAA0565 (Accession XM_039912). Accordingly, utilities of VGAM2238 include diagnosis, prevention and treatment of diseases and clinical conditions associated with KIAA0565. KIAA0677 (Accession NM_014663) is another VGAM2238 host target gene. KIAA0677 BINDING SITE is HOST TARGET binding site found in the 3' untranslated region of mRNA encoded by KIAA0677, corresponding to a HOST TARGET binding site such as BINDING SITE I, BINDING SITE II or BINDING SITE III. Table 2 illustrates the complementarity of the nucleotide sequences of KIAA0677 BINDING SITE, designated SEQ ID:16110, to the nucleotide sequence of VGAM2238 RNA, herein designated VGAM RNA, also designated SEQ ID:4949.

Another function of VGAM2238 is therefore inhibition of KIAA0677 (Accession NM_014663). Accordingly, utilities of VGAM2238 include diagnosis, prevention and treatment of diseases and clinical conditions associated with KIAA0677. KIAA0794 (Accession XM_087353) is another VGAM2238 host target gene. KIAA0794 BINDING SITE is HOST TARGET binding site found in the 3' untranslated region of mRNA encoded by KIAA0794, corresponding to a HOST TARGET binding site such as BINDING SITE I, BINDING SITE II or BINDING SITE III. Table 2 illustrates the complementarity of the nucleotide sequences of KIAA0794 BINDING SITE, designated SEQ ID:39177, to the nucleotide sequence of VGAM2238 RNA, herein designated VGAM RNA, also designated SEQ ID:4949.

Another function of VGAM2238 is therefore inhibition of KIAA0794 (Accession XM_087353). Accordingly, utilities of VGAM2238 include diagnosis, prevention and treatment of diseases and clinical conditions associated with KIAA0794. KIAA0979 (Accession NM_015032) is another VGAM2238 host target gene. KIAA0979 BINDING SITE is HOST TARGET binding site found in the 3' untranslated region of mRNA encoded by KIAA0979, corresponding to a HOST TARGET binding site such as BINDING SITE I, BINDING SITE II or BINDING SITE III. Table 2 illustrates the complementarity of the nucleotide sequences of KIAA0979 BINDING SITE, designated SEQ ID:17387, to the nucleotide sequence of VGAM2238 RNA, herein designated VGAM RNA, also designated SEQ ID:4949.

Another function of VGAM2238 is therefore inhibition of KIAA0979 (Accession NM_015032). Accordingly, utilities of VGAM2238 include diagnosis, prevention and treatment of diseases and clinical conditions associated with KIAA0979. Lipoma HMGIC Fusion Partner (LHFP, Accession NM_005780) is another VGAM2238 host target gene. LHFP BINDING SITE is HOST TARGET binding site found in the 3' untranslated region of mRNA encoded by LHFP, corresponding to a HOST TARGET binding site such as BINDING SITE I, BINDING SITE II or BINDING SITE III. Table 2 illustrates the complementarity of the nucleotide sequences of LHFP BINDING SITE, designated SEQ ID:12356, to the nucleotide sequence of VGAM2238 RNA, herein designated VGAM RNA, also designated SEQ ID:4949.

Another function of VGAM2238 is therefore inhibition of Lipoma HMGIC Fusion Partner (LHFP, Accession NM_005780). Accordingly, utilities of VGAM2238 include diagnosis, prevention and treatment of diseases and clinical conditions associated with LHFP. MKP-7 (Accession XM_039106) is another VGAM2238 host target gene. MKP-7 BINDING SITE is HOST TARGET binding site found in the 5' untranslated region of mRNA encoded by MKP-7, corresponding to a HOST TARGET binding site such as BINDING SITE I, BINDING SITE II or BINDING SITE III. Table 2 illustrates the complementarity of the nucleotide sequences of MKP-7 BINDING SITE, designated SEQ ID:33007, to the nucleotide sequence of VGAM2238 RNA, herein designated VGAM RNA, also designated SEQ ID:4949.

Another function of VGAM2238 is therefore inhibition of MKP-7 (Accession XM_039106). Accordingly, utilities of VGAM2238 include diagnosis, prevention and treatment of diseases and clinical conditions associated with MKP-7. PORIMIN (Accession NM_052932) is another VGAM2238 host target gene. PORIMIN BINDING SITE is HOST TARGET binding site found in the 3' untranslated region of mRNA encoded by PORIMIN, corresponding to a HOST TARGET binding site such as BINDING SITE I, BINDING SITE II or BINDING SITE III. Table 2 illustrates the complementarity of the nucleotide sequences of PORIMIN BINDING SITE, designated SEQ ID:27491, to the nucleotide sequence of VGAM2238 RNA, herein designated VGAM RNA, also designated SEQ ID:4949.

Another function of VGAM2238 is therefore inhibition of PORIMIN (Accession NM_052932). Accordingly, utilities of VGAM2238 include diagnosis, prevention and treatment of diseases and clinical conditions associated with PORIMIN. Protein Tyrosine Kinase 9 (PTK9, Accession NM_002822) is another VGAM2238 host target gene. PTK9 BINDING SITE is HOST TARGET binding site found in the 3' untranslated region of mRNA encoded by PTK9, corresponding to a HOST TARGET binding site such as BINDING SITE I, BINDING SITE II or BINDING SITE III. Table 2 illustrates the complementarity of the nucleotide sequences of PTK9 BINDING SITE, designated SEQ ID:8691, to the nucleotide sequence of VGAM2238 RNA, herein designated VGAM RNA, also designated SEQ ID:4949.

Another function of VGAM2238 is therefore inhibition of Protein Tyrosine Kinase 9 (PTK9, Accession NM_002822). Accordingly, utilities of VGAM2238 include diagnosis, prevention and treatment of diseases and clinical conditions associated with PTK9. Syntaphilin (SNPH, Accession NM_014723) is another VGAM2238 host target gene. SNPH BINDING SITE is HOST TARGET binding site found in the 3' untranslated region of mRNA encoded by SNPH, corresponding to a HOST TARGET binding site such as BINDING SITE I, BINDING SITE II or BINDING SITE III. Table 2 illustrates the complementarity of the nucleotide sequences of SNPH BINDING SITE, designated SEQ ID:16295, to the nucleotide sequence of VGAM2238 RNA, herein designated VGAM RNA, also designated SEQ ID:4949.

Another function of VGAM2238 is therefore inhibition of Syntaphilin (SNPH, Accession NM_014723). Accordingly, utilities of VGAM2238 include diagnosis, prevention and treatment of diseases and clinical conditions associated with SNPH. LOC115509 (Accession XM_056092) is another VGAM2238 host target gene. LOC115509 BINDING SITE is HOST TARGET binding site found in the 3' untranslated region of mRNA encoded by LOC115509, corresponding to a HOST TARGET binding site such as BINDING SITE I, BINDING SITE II or BINDING SITE III. Table 2 illustrates the complementarity of the nucleotide sequences of LOC115509 BINDING SITE, designated SEQ ID:36364, to the nucleotide sequence of VGAM2238 RNA, herein designated VGAM RNA, also designated SEQ ID:4949.

Another function of VGAM2238 is therefore inhibition of LOC115509 (Accession XM_056092). Accordingly, utilities of VGAM2238 include diagnosis, prevention and treatment of diseases and clinical conditions associated with LOC115509. LOC134266 (Accession XM_059701) is another VGAM2238 host target gene. LOC134266 BINDING SITE is HOST TARGET binding site found in the 3' untranslated region of mRNA encoded by LOC134266, corresponding to a HOST TARGET binding site such as BINDING SITE I, BINDING SITE II or BINDING SITE III. Table 2 illustrates the complementarity of the nucleotide sequences of LOC134266 BINDING SITE, designated SEQ ID:37068, to the nucleotide sequence of VGAM2238 RNA, herein designated VGAM RNA, also designated SEQ ID:4949.

Another function of VGAM2238 is therefore inhibition of LOC134266 (Accession XM_059701). Accordingly, utilities of VGAM2238 include diagnosis, prevention and treatment of diseases and clinical conditions associated with LOC134266. LOC145439 (Accession XM_085144) is another VGAM2238 host target gene. LOC145439 BINDING SITE is HOST TARGET binding site found in the 5' untranslated region of mRNA encoded by LOC145439, corresponding to a HOST TARGET binding site such as BINDING SITE I, BINDING SITE II or BINDING SITE III. Table 2 illustrates the complementarity of the nucleotide sequences of LOC145439 BINDING SITE, designated SEQ ID:37865, to the nucleotide sequence of VGAM2238 RNA, herein designated VGAM RNA, also designated SEQ ID:4949.

Another function of VGAM2238 is therefore inhibition of LOC145439 (Accession XM_085144). Accordingly, utilities of VGAM2238 include diagnosis, prevention and treatment of diseases and clinical conditions associated with LOC145439. LOC146819 (Accession XM_085605) is another VGAM2238 host target gene. LOC146819 BINDING SITE is HOST TARGET binding site found in the 3' untranslated region of mRNA encoded by LOC146819, corresponding to a HOST TARGET binding site such as BINDING SITE I, BINDING SITE II or BINDING SITE III. Table 2 illustrates the complementarity of the nucleotide sequences of LOC146819 BINDING SITE, designated SEQ ID:38254, to the nucleotide sequence of VGAM2238 RNA, herein designated VGAM RNA, also designated SEQ ID:4949.

Another function of VGAM2238 is therefore inhibition of LOC146819 (Accession XM_085605). Accordingly, utilities of VGAM2238 include diagnosis, prevention and treatment of diseases and clinical conditions associated with LOC146819. LOC146821 (Accession XM_085597) is another VGAM2238 host target gene. LOC146821 BINDING SITE is HOST TARGET binding site found in the 3' untranslated region of mRNA encoded by LOC146821, corresponding to a HOST TARGET binding site such as BINDING SITE I, BINDING SITE II or BINDING SITE III. Table 2 illustrates the complementarity of the nucleotide sequences of LOC146821 BINDING SITE, designated SEQ ID:38252, to the nucleotide sequence of VGAM2238 RNA, herein designated VGAM RNA, also designated SEQ ID:4949.

Another function of VGAM2238 is therefore inhibition of LOC146821 (Accession XM_085597). Accordingly, utilities of VGAM2238 include diagnosis, prevention and treatment of diseases and clinical conditions associated with LOC146821. LOC150142 (Accession XM_086791) is another VGAM2238 host target gene. LOC150142 BINDING SITE is HOST TARGET binding site found in the 5' untranslated region of mRNA encoded by LOC150142, corresponding to a HOST TARGET binding site such as BINDING SITE I, BINDING SITE II or BINDING SITE III. Table 2 illustrates the complementarity of the nucleotide sequences of LOC150142 BINDING SITE, designated SEQ ID:38853, to the nucleotide sequence of VGAM2238 RNA, herein designated VGAM RNA, also designated SEQ ID:4949.

Another function of VGAM2238 is therefore inhibition of LOC150142 (Accession XM_086791). Accordingly, utilities of VGAM2238 include diagnosis, prevention and treatment of diseases and clinical conditions associated with LOC150142. LOC201287 (Accession XM_113947) is another VGAM2238 host target gene. LOC201287 BINDING SITE is HOST TARGET binding site found in the 5' untranslated region of mRNA encoded by LOC201287, corresponding to a HOST TARGET binding site such as BINDING SITE I, BINDING SITE II or BINDING SITE III. Table 2 illustrates the complementarity of the nucleotide sequences of LOC201287 BINDING SITE, designated SEQ ID:42559, to the nucleotide sequence of VGAM2238 RNA, herein designated VGAM RNA, also designated SEQ ID:4949.

Another function of VGAM2238 is therefore inhibition of LOC201287 (Accession XM_113947). Accordingly, utilities of VGAM2238 include diagnosis, prevention and treatment of diseases and clinical conditions associated with LOC201287. LOC219627 (Accession XM_166402) is another VGAM2238 host target gene. LOC219627 BINDING SITE is HOST TARGET binding site found in the 5' untranslated region of mRNA encoded by LOC219627, corresponding to a HOST TARGET binding site such as BINDING SITE I, BINDING SITE II or BINDING SITE III. Table 2 illustrates the complementarity of the nucleotide sequences of LOC219627 BINDING SITE, designated SEQ ID:44271, to the nucleotide sequence of VGAM2238 RNA, herein designated VGAM RNA, also designated SEQ ID:4949.

Another function of VGAM2238 is therefore inhibition of LOC219627 (Accession XM_166402). Accordingly, utilities of VGAM2238 include diagnosis, prevention and treatment of diseases and clinical conditions associated with LOC219627. LOC220705 (Accession XM_166000) is another VGAM2238 host target gene. LOC220705 BINDING SITE is HOST TARGET binding site found in the 3' untranslated region of mRNA encoded by LOC220705, corresponding to a HOST TARGET binding site such as BINDING SITE I, BINDING SITE II or BINDING SITE III. Table 2 illustrates the complementarity of the nucleotide sequences of LOC220705 BINDING SITE, designated SEQ ID:43834, to the nucleotide sequence of VGAM2238 RNA, herein designated VGAM RNA, also designated SEQ ID:4949.

Another function of VGAM2238 is therefore inhibition of LOC220705 (Accession XM_166000). Accordingly, utilities of VGAM2238 include diagnosis, prevention and treatment of diseases and clinical conditions associated with LOC220705. LOC221895 (Accession XM_166511) is another VGAM2238 host target gene. LOC221895 BINDING SITE is HOST TARGET binding site found in the 3' untranslated region of mRNA encoded by LOC221895, corresponding to a HOST TARGET binding site such as BINDING SITE I, BINDING SITE II or BINDING SITE III. Table 2 illustrates the complementarity of the nucleotide sequences of LOC221895 BINDING SITE, designated SEQ ID:44442, to the nucleotide sequence of VGAM2238 RNA, herein designated VGAM RNA, also designated SEQ ID:4949.

Another function of VGAM2238 is therefore inhibition of LOC221895 (Accession XM_166511). Accordingly, utilities of VGAM2238 include diagnosis, prevention and treatment of diseases and clinical conditions associated with LOC221895. LOC222060 (Accession XM_168427) is another VGAM2238 host target gene. LOC222060 BINDING SITE is HOST TARGET binding site found in the 5' untranslated region of mRNA encoded by LOC222060, corresponding to a HOST TARGET binding site such as BINDING SITE I, BINDING SITE II or BINDING SITE III. Table 2 illustrates the complementarity of the nucleotide sequences of LOC222060 BINDING SITE, designated SEQ ID:45160, to the nucleotide sequence of VGAM2238 RNA, herein designated VGAM RNA, also designated SEQ ID:4949.

Another function of VGAM2238 is therefore inhibition of LOC222060 (Accession XM_168427). Accordingly, utilities of VGAM2238 include diagnosis, prevention and treatment of diseases and clinical conditions associated with LOC222060. LOC256207 (Accession XM_170837) is another VGAM2238 host target gene. LOC256207 BINDING SITE is HOST TARGET binding site found in the 5' untranslated region of mRNA encoded by LOC256207, corresponding to a HOST TARGET binding site such as BINDING SITE I, BINDING SITE II or BINDING SITE III. Table 2 illustrates the complementarity of the nucleotide sequences of LOC256207 BINDING SITE, designated SEQ ID:45617, to the nucleotide sequence of VGAM2238 RNA, herein designated VGAM RNA, also designated SEQ ID:4949.

Another function of VGAM2238 is therefore inhibition of LOC256207 (Accession XM_170837). Accordingly, utilities of VGAM2238 include diagnosis, prevention and treatment of diseases and clinical conditions associated with LOC256207. LOC86651 (Accession XM_044052) is another VGAM2238 host target gene. LOC86651 BINDING SITE is HOST TARGET binding site found in the 3' untranslated region of mRNA encoded by LOC86651, corresponding to a HOST TARGET binding site such as BINDING SITE I, BINDING SITE II or BINDING SITE III. Table 2 illustrates the complementarity of the nucleotide sequences of LOC86651 BINDING SITE, designated SEQ ID:34098, to the nucleotide sequence of VGAM2238 RNA, herein designated VGAM RNA, also designated SEQ ID:4949.

Another function of VGAM2238 is therefore inhibition of LOC86651 (Accession XM_044052). Accordingly, utilities of VGAM2238 include diagnosis, prevention and treatment of diseases and clinical conditions associated with LOC86651. LOC91151 (Accession NM_033208) is another VGAM2238 host target gene. LOC91151 BINDING SITE is HOST TARGET binding site found in the 5' untranslated region of mRNA encoded by LOC91151, corresponding to a HOST TARGET binding site such as BINDING SITE I, BINDING SITE II or BINDING SITE III. Table 2 illustrates the complementarity of the nucleotide sequences of LOC91151 BINDING SITE, designated SEQ ID:27053, to the nucleotide sequence of VGAM2238 RNA, herein designated VGAM RNA, also designated SEQ ID:4949.

Another function of VGAM2238 is therefore inhibition of LOC91151 (Accession NM_033208). Accordingly, utilities of VGAM2238 include diagnosis, prevention and treatment of diseases and clinical conditions associated with LOC91151. FIG. 1 further provides a conceptual description of a novel bioinformatically detected viral gene of the present invention, referred to here as Viral Genomic Address Messenger 2239 (VGAM2239) viral gene, which modulates expression of respective host target genes thereof, the function and utility of which host target genes is known in the art.

VGAM2239 is a novel bioinformatically detected regulatory, non protein coding, viral micro RNA (miRNA) gene. The method by which VGAM2239 was detected is described hereinabove with reference to FIGS. 1-8.

VGAM2239 gene, herein designated VGAM GENE, is a viral gene contained in the genome of Porcine Epidemic Diarrhea Virus. VGAM2239 host target gene, herein designated VGAM HOST TARGET GENE, is a human gene contained in the human genome.

VGAM2239 gene encodes a VGAM2239 precursor RNA, herein designated VGAM PRECURSOR RNA. Similar to other miRNA genes, and unlike most ordinary genes, VGAM2239 precursor RNA does not encode a protein. A nucleotide sequence identical or highly similar to the nucleotide sequence of VGAM2239 precursor RNA is designated SEQ ID:2225, and is provided hereinbelow with reference to the sequence listing part. Nucleotide sequence SEQ ID:2225 is located at position 11663 relative to the genome of Porcine Epidemic Diarrhea Virus.

VGAM2239 precursor RNA folds onto itself, forming VGAM2239 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2239 folded precursor RNA into VGAM2239 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM2239 RNA is designated SEQ ID:4950, and is provided hereinbelow with reference to the sequence listing part.

VGAM2239 host target gene, herein designated VGAM HOST TARGET GENE, encodes a corresponding messenger RNA, VGAM2239 host target RNA, herein designated VGAM HOST TARGET RNA. VGAM2239 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2239 RNA, herein designated VGAM RNA, binds complementarily to one or more host target binding sites located in untranslated regions of VGAM2239 host target RNA, herein designated VGAM HOST TARGET RNA. This complementary binding is due to the fact that the nucleotide sequence of VGAM2239 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2239 RNA, herein designated VGAM RNA, may have a different number of host target binding sites in untranslated regions of a VGAM2239 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2239 RNA, herein designated VGAM RNA, to host target binding sites on VGAM2239 host target RNA, herein designated VGAM HOST TARGET RNA, such as BINDING SITE I, BINDING SITE II and BINDING SITE III, inhibits translation of VGAM2239 host target RNA into VGAM2239 host target protein, herein designated VGAM HOST TARGET PROTEIN. VGAM host target protein is therefore outlined by a broken line.

It is appreciated that VGAM2239 host target gene, herein designated VGAM HOST TARGET GENE, in fact represents a plurality of VGAM2239 host target genes. The mRNA of each one of this plurality of VGAM2239 host target genes comprises one or more host target binding sites, each having a nucleotide sequence which is at least partly complementary to VGAM2239 RNA, herein designated VGAM RNA, and which when bound by VGAM2239 RNA causes inhibition of translation of respective one or more VGAM2239 host target proteins.

It is further appreciated by one skilled in the art that the mode of translational inhibition illustrated by FIG. 1 with specific reference to translational inhibition exerted by VGAM2239 gene, herein designated VGAM GENE, on one or more VGAM2239 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2239 is inhibition of expression of host target genes, as part of a novel viral mechanism of attacking a host. Accordingly, utilities of VGAM2239 include diagnosis, prevention and treatment of viral infection by Porcine Epidemic Diarrhea Virus. Specific functions, and accordingly utilities, of VGAM2239 correlate with, and may be deduced from, the identity of the host target genes which VGAM2239 binds and inhibits, and the function of these host target genes, as elaborated hereinbelow.

Nucleotide sequences of the VGAM2239 precursor RNA, herein designated VGAM PRECURSOR RNA, and of the 'diced' VGAM2239 RNA, herein designated VGAM RNA, and a schematic representation of the secondary folding of VGAM2239 folded precursor RNA, herein designated VGAM FOLDED PRECURSOR RNA, of VGAM2239 are further described hereinbelow with reference to Table 1.

Nucleotide sequences of host target binding sites, such as BINDING SITE-I, BINDING SITE-II and BINDING SITE-III of FIG. 1, found on VGAM2239 host target RNA, and schematic representation of the complementarity of each of these host target binding sites to VGAM2239 RNA, herein designated VGAM RNA, are described hereinbelow with reference to Table 2.

As mentioned hereinabove with reference to FIG. 1, a function of VGAM2239 gene, herein designated VGAM is inhibition of expression of VGAM2239 target genes. It is appreciated that specific functions, and accordingly utilities, of VGAM2239 correlate with, and may be deduced from, the identity of the target genes which VGAM2239 binds and inhibits, and the function of these target genes, as elaborated hereinbelow.

ATP-binding Cassette, Sub-family A (ABC1), Member 1 (ABCA1, Accession NM_005502) is a VGAM2239 host target gene. ABCA1 BINDING SITE is HOST TARGET binding site found in the 3' untranslated region of mRNA encoded by ABCA1, corresponding to a HOST TARGET binding site such as BINDING SITE I, BINDING SITE II or BINDING SITE III. Table 2 illustrates the complementarity of the nucleotide sequences of ABCA1 BINDING SITE, designated SEQ ID:12015, to the nucleotide sequence of VGAM2239 RNA, herein designated VGAM RNA, also designated SEQ ID:4950.

A function of VGAM2239 is therefore inhibition of ATP-binding Cassette, Sub-family A (ABC1), Member 1 (ABCA1, Accession NM_005502), a gene which camp-dependent and sulfonylurea-sensitive anion transporter. Accordingly, utilities of VGAM2239 include diagnosis, prevention and treatment of diseases and clinical conditions associated with ABCA1. The function of ABCA1 and its association with various diseases and clinical conditions, has been established by previous studies, as described hereinabove with reference to VGAM1956. Eukaryotic Translation Initiation Factor 1A (EIF1A, Accession XM_114147) is another VGAM2239 host target gene. EIF1A BINDING SITE is HOST TARGET binding site found in the 3' untranslated region of mRNA encoded by EIF1A, corresponding to a HOST TARGET binding site such as BINDING SITE I, BINDING SITE II or BINDING SITE III. Table 2 illustrates the complementarity of the nucleotide sequences of EIF1A BINDING SITE, designated SEQ ID:42719, to the nucleotide sequence of VGAM2239 RNA, herein designated VGAM RNA, also designated SEQ ID:4950.

Another function of VGAM2239 is therefore inhibition of Eukaryotic Translation Initiation Factor 1A (EIF1A, Accession XM_114147), a gene which seems to be required for maximal rate of protein biosynthesis. Accordingly, utilities of VGAM2239 include diagnosis, prevention and treatment of diseases and clinical conditions associated with EIF1A. The function of EIF1A and its association with various diseases and clinical conditions, has been established by previous studies, as described hereinabove with reference to VGAM120. Protocadherin 12 (PCDH12, Accession NM_016580) is another VGAM2239 host target gene. PCDH12 BINDING SITE is HOST TARGET binding site found in the 5' untranslated region of mRNA encoded by PCDH12, corresponding to a HOST TARGET binding site such as BINDING SITE I, BINDING SITE II or BINDING SITE III. Table 2 illustrates the complementarity of the nucleotide sequences of PCDH12 BINDING SITE, designated SEQ ID:18658, to the nucleotide sequence of VGAM2239 RNA, herein designated VGAM RNA, also designated SEQ ID:4950.

Another function of VGAM2239 is therefore inhibition of Protocadherin 12 (PCDH12, Accession NM_016580), a gene which is a member of a family of nonclassical cadherins. Accordingly, utilities of VGAM2239 include diagnosis, prevention and treatment of diseases and clinical conditions associated with PCDH12. The function of PCDH12 has been established by previous studies. Murine vascular endothelial cadherin-2 is a cellular adhesion molecule that is distinct from vascular endothelial cadherin-1 (CDH5; 601120) in that it does not interact with catenins and does not appear to affect cell migration or growth (Telo et al., 1998). By sequence database searching, Wu and Maniatis (2000) identified a human VE-cadherin-2 homolog, which they called protocadherin-12 (OMIM Ref. No. PCDH12), encoding a deduced 1,184-amino acid protein that shares 81% sequence identity with the mouse protein. PCDH12 contains 4 exons; a single large exon encodes the extracellular and transmembrane domains, and 3 small exons encode the cytoplasmic domain. Wu and Maniatis (2000) concluded that the presence of unusually large exons is a characteristic feature of protocadherin. Using the mouse Pcdh12 cDNA sequence and RACE-PCR reactions, Ludwig et al. (2000) cloned a full-length PCDH12 cDNA from a human fetal kidney cDNA library. Northern blot analysis detected expression of a 5-kb PCHD12 transcript chiefly in highly vascularized tissues including the heart and placenta, but most tissues contained a low level of expression. Prominent expression was also detected in the spleen. Some tissues, including skeletal muscle and peripheral blood leukocytes, possessed transcripts of a larger size.

Full details of the abovementioned studies are described in the following publications, the disclosure of which are hereby incorporated by reference:

Wu, Q.; Maniatis, T.: Large exons encoding multiple ectodomains are a characteristic feature of protocadherin genes. Proc. Nat. Acad. Sci. 97:3124-3129, 2000; and Ludwig, D.; Lorenz, J.; Dejana, E.; Bohlen, P.; Hicklin, D. J.; Witte, L.; Pytowski, B.: cDNA cloning, chromosomal mapping, and expression analysis of human VE-cadherin-2. Mammalian Ge.

Further studies establishing the function and utilities of PCDH12 are found in John Hopkins OMIM database record ID 605622, and in sited publications numbered 6956-695 and 7438 listed in the bibliography section hereinbelow, which are also hereby incorporated by reference. Ribonucleotide Reductase M2 B (TP53 inducible) (RRM2B, Accession XM_042096) is another VGAM2239 host target gene. RRM2B BINDING SITE is HOST TARGET binding site found in the 3' untranslated region of mRNA encoded by RRM2B, corresponding to a HOST TARGET binding site such as BINDING SITE I, BINDING SITE II or BINDING SITE III. Table 2 illustrates the complementarity of the nucleotide sequences of RRM2B BINDING SITE, designated SEQ ID:33689, to the nucleotide sequence of VGAM2239 RNA, herein designated VGAM RNA, also designated SEQ ID:4950.

Another function of VGAM2239 is therefore inhibition of Ribonucleotide Reductase M2 B (TP53 inducible) (RRM2B, Accession XM_042096). Accordingly, utilities of VGAM2239 include diagnosis, prevention and treatment of diseases and clinical conditions associated with RRM2B. V-akt Murine Thymoma Viral Oncogene Homolog 3 (protein kinase B, gamma) (AKT3, Accession NM_005465) is another VGAM2239 host target gene. AKT3 BINDING SITE is HOST TARGET binding site found in the 3' untranslated region of mRNA encoded by AKT3, corresponding to a HOST TARGET binding site such as BINDING SITE I, BINDING SITE II or BINDING SITE III. Table 2 illustrates the complementarity of the nucleotide sequences of AKT3 BINDING SITE, designated SEQ ID:11957, to the nucleotide sequence of VGAM2239 RNA, herein designated VGAM RNA, also designated SEQ ID:4950.

Another function of VGAM2239 is therefore inhibition of V-akt Murine Thymoma Viral Oncogene Homolog 3 (protein kinase B, gamma) (AKT3, Accession NM_005465). Accordingly, utilities of VGAM2239 include diagnosis, prevention and treatment of diseases and clinical conditions associated with AKT3. DnaJ (Hsp40) Homolog, Subfamily C, Member 6 (DNAJC6, Accession NM_014787) is another VGAM2239 host target gene. DNAJC6 BINDING SITE is HOST TARGET binding site found in the 3' untranslated region of mRNA encoded by DNAJC6, corresponding to a HOST TARGET binding site such as BINDING SITE I, BINDING SITE II or BINDING SITE III. Table 2 illustrates the complementarity of the nucleotide sequences of DNAJC6 BINDING SITE, designated SEQ ID:16661, to the nucleotide sequence of VGAM2239 RNA, herein designated VGAM RNA, also designated SEQ ID:4950.

Another function of VGAM2239 is therefore inhibition of DnaJ (Hsp40) Homolog, Subfamily C, Member 6 (DNAJC6, Accession NM_014787). Accordingly, utilities of VGAM2239 include diagnosis, prevention and treatment of diseases and clinical conditions associated with DNAJC6. KIAA0694 (Accession XM_051970) is another VGAM2239 host target gene. KIAA0694 BINDING SITE is HOST TARGET binding site found in the 3" untranslated region of mRNA encoded by KIAA0694, corresponding to a HOST TARGET binding site such as BINDING SITE I, BINDING SITE II or BINDING SITE III. Table 2 illustrates the complementarity of the nucleotide sequences of KIAA0694 BINDING SITE, designated SEQ ID:35928, to the nucleotide sequence of VGAM2239 RNA, herein designated VGAM RNA, also designated SEQ ID:4950.

Another function of VGAM2239 is therefore inhibition of KIAA0694 (Accession XM_051970). Accordingly, utilities of VGAM2239 include diagnosis, prevention and treatment of diseases and clinical conditions associated with KIAA0694. KIAA0892 (Accession XM_048457) is another VGAM2239 host target gene. KIAA0892 BINDING SITE is HOST TARGET binding site found in the 3' untranslated region of mRNA encoded by KIAA0892, corresponding to a HOST TARGET binding site such as BINDING SITE I, BINDING SITE II or BINDING SITE III. Table 2 illustrates the complementarity of the nucleotide sequences of KIAA0892 BINDING SITE, designated SEQ ID:35169, to the nucleotide sequence of VGAM2239 RNA, herein designated VGAM RNA, also designated SEQ ID:4950.

Another function of VGAM2239 is therefore inhibition of KIAA0892 (Accession XM_048457). Accordingly, utilities of VGAM2239 include diagnosis, prevention and treatment of diseases and clinical conditions associated with KIAA0892. Low Density Lipoprotein-related Protein 1B (deleted in tumors) (LRP1B, Accession NM_018557) is another VGAM2239 host target gene. LRP1B BINDING SITE is HOST TARGET binding site found in the 3' untranslated region of mRNA encoded by LRP1B, corresponding to a HOST TARGET binding site such as BINDING SITE I, BINDING SITE II or BINDING SITE III. Table 2 illustrates the complementarity of the nucleotide sequences of LRP1B BINDING SITE, designated SEQ ID:20639, to the nucleotide sequence of VGAM2239 RNA, herein designated VGAM RNA, also designated SEQ ID:4950.

Another function of VGAM2239 is therefore inhibition of Low Density Lipoprotein-related Protein 1B (deleted in tumors) (LRP1B, Accession NM_018557). Accordingly, utilities of VGAM2239 include diagnosis, prevention and treatment of diseases and clinical conditions associated with LRP1B. Nuclear Receptor Subfamily 6, Group A, Member 1 (NR6A1, Accession NM_033334) is another VGAM2239 host target gene. NR6A1 BINDING SITE1 through NR6A1 BINDING SITE3 are HOST TARGET binding sites found in untranslated regions of mRNA encoded by NR6A1, corresponding to HOST TARGET binding sites such as BINDING SITE I, BINDING SITE II or BINDING SITE III. Table 2 illustrates the complementarity of the nucleotide sequences of NR6A1 BINDING SITE1 through NR6A1 BINDING SITE3, designated SEQ ID:27181, SEQ ID:27187 and SEQ ID:7233 respectively, to the nucleotide sequence of VGAM2239 RNA, herein designated VGAM RNA, also designated SEQ ID:4950.

Another function of VGAM2239 is therefore inhibition of Nuclear Receptor Subfamily 6, Group A, Member 1 (NR6A1, Accession NM_033334). Accordingly, utilities of VGAM2239 include diagnosis, prevention and treatment of diseases and clinical conditions associated with NR6A1. LOC147632 (Accession NM_138478) is another VGAM2239 host target gene. LOC147632 BINDING SITE is HOST TARGET binding site found in the 5' untranslated region of mRNA encoded by LOC147632, corresponding to a HOST TARGET binding site such as BINDING SITE I, BINDING SITE II or BINDING SITE III. Table 2 illustrates the complementarity of the nucleotide sequences of LOC147632 BINDING SITE, designated SEQ ID:28826, to the nucleotide sequence of VGAM2239 RNA, herein designated VGAM RNA, also designated SEQ ID:4950.

Another function of VGAM2239 is therefore inhibition of LOC147632 (Accession NM_138478). Accordingly, utilities of VGAM2239 include diagnosis, prevention and treatment of diseases and clinical conditions associated with LOC147632. LOC148894 (Accession XM_097542) is another VGAM2239 host target gene. LOC148894 BINDING SITE is HOST TARGET binding site found in the 3' untranslated region of mRNA encoded by LOC148894, corresponding to a HOST TARGET binding site such as BINDING SITE I, BINDING SITE II or BINDING SITE III. Table 2 illustrates the complementarity of the nucleotide sequences of LOC148894 BINDING SITE, designated SEQ ID:40919, to the nucleotide sequence of VGAM2239 RNA, herein designated VGAM RNA, also designated SEQ ID:4950.

Another function of VGAM2239 is therefore inhibition of LOC148894 (Accession XM_097542). Accordingly, utilities of VGAM2239 include diagnosis, prevention and treatment of diseases and clinical conditions associated with LOC148894. LOC151473 (Accession XM_087215) is another VGAM2239 host target gene. LOC151473 BINDING SITE is HOST TARGET binding site found in the 3' untranslated region of mRNA encoded by LOC151473, corresponding to a HOST TARGET binding site such as BINDING SITE I, BINDING SITE II or BINDING SITE III. Table 2 illustrates the complementarity of the nucleotide sequences of LOC151473 BINDING SITE, designated SEQ ID:39120, to the nucleotide sequence of VGAM2239 RNA, herein designated VGAM RNA, also designated SEQ ID:4950.

Another function of VGAM2239 is therefore inhibition of LOC151473 (Accession XM_087215). Accordingly, utilities of VGAM2239 include diagnosis, prevention and treatment of diseases and clinical conditions associated with LOC151473. LOC151521 (Accession XM_098076) is another VGAM2239 host target gene. LOC151521 BINDING SITE is HOST TARGET binding site found in the 5' untranslated region of mRNA encoded by LOC151521, corresponding to a HOST TARGET binding site such as BINDING SITE I, BINDING SITE II or BINDING SITE III. Table 2 illustrates the complementarity of the nucleotide sequences of LOC151521 BINDING SITE, designated SEQ ID:41370, to the nucleotide sequence of VGAM2239 RNA, herein designated VGAM RNA, also designated SEQ ID:4950.

Another function of VGAM2239 is therefore inhibition of LOC151521 (Accession XM_098076). Accordingly, utilities of VGAM2239 include diagnosis, prevention and treatment of diseases and clinical conditions associated with LOC151521. LOC157349 (Accession XM_088298) is another VGAM2239 host target gene. LOC157349 BINDING SITE is HOST TARGET binding site found in the 5' untranslated region of mRNA encoded by LOC157349, corresponding to a HOST TARGET binding site such as BINDING SITE I, BINDING SITE II or BINDING SITE III. Table 2 illustrates the complementarity of the nucleotide sequences of LOC157349 BINDING SITE, designated SEQ ID:39594, to the nucleotide sequence of VGAM2239 RNA, herein designated VGAM RNA, also designated SEQ ID:4950.

Another function of VGAM2239 is therefore inhibition of LOC157349 (Accession XM_088298). Accordingly, utilities of VGAM2239 include diagnosis, prevention and treatment of diseases and clinical conditions associated with LOC157349. LOC200150 (Accession XM_114131) is another VGAM2239 host target gene. LOC200150 BINDING SITE is HOST TARGET binding site found in the 3' untranslated region of mRNA encoded by LOC200150, corresponding to a HOST TARGET binding site such as BINDING SITE I, BINDING SITE II or BINDING SITE III. Table 2 illustrates the complementarity of the nucleotide sequences of LOC200150 BINDING SITE, designated SEQ ID:42713, to the nucleotide sequence of VGAM2239 RNA, herein designated VGAM RNA, also designated SEQ ID:4950.

Another function of VGAM2239 is therefore inhibition of LOC200150 (Accession XM_114131). Accordingly, utilities of VGAM2239 include diagnosis, prevention and treatment of diseases and clinical conditions associated with LOC200150. LOC51185 (Accession NM_016302) is another VGAM2239 host target gene. LOC51185 BINDING SITE is HOST TARGET binding site found in the 3' untranslated region of mRNA encoded by LOC51185, corresponding to a HOST TARGET binding site such as BINDING SITE I, BINDING SITE II or BINDING SITE III. Table 2 illustrates the complementarity of the nucleotide sequences of LOC51185 BINDING SITE, designated SEQ ID:18424, to the nucleotide sequence of VGAM2239 RNA, herein designated VGAM RNA, also designated SEQ ID:4950.

Another function of VGAM2239 is therefore inhibition of LOC51185 (Accession NM_016302). Accordingly, utilities of VGAM2239 include diagnosis, prevention and treatment of diseases and clinical conditions associated with LOC51185. LOC56906 (Accession NM_020147) is another VGAM2239 host target gene. LOC56906 BINDING SITE is HOST TARGET binding site found in the 3' untranslated region of mRNA encoded by LOC56906, corresponding to a HOST TARGET binding site such as BINDING SITE I, BINDING SITE II or BINDING SITE III. Table 2 illustrates the complementarity of the nucleotide sequences of LOC56906 BINDING SITE, designated SEQ ID:21343, to the nucleotide sequence of VGAM2239 RNA, herein designated VGAM RNA, also designated SEQ ID:4950.

Another function of VGAM2239 is therefore inhibition of LOC56906 (Accession NM_020147). Accordingly, utilities of VGAM2239 include diagnosis, prevention and treatment of diseases and clinical conditions associated with LOC56906. LOC92539 (Accession XM_045632) is another VGAM2239 host target gene. LOC92539 BINDING SITE is HOST TARGET binding site found in the 5' untranslated region of mRNA encoded by LOC92539, corresponding to a HOST TARGET binding site such as BINDING SITE I, BINDING SITE II or BINDING SITE III. Table 2 illustrates the complementarity of the nucleotide sequences of LOC92539 BINDING SITE, designated SEQ ID:34500, to the nucleotide sequence of VGAM2239 RNA, herein designated VGAM RNA, also designated SEQ ID:4950.

Another function of VGAM2239 is therefore inhibition of LOC92539 (Accession XM_045632). Accordingly, utilities of VGAM2239 include diagnosis, prevention and treatment of diseases and clinical conditions associated with LOC92539. FIG. 1 further provides a conceptual description of a novel bioinformatically detected viral gene of the present invention, referred to here as Viral Genomic Address Messenger 2240 (VGAM2240) viral gene, which modulates expression of respective host target genes thereof, the function and utility of which host target genes is known in the art.

VGAM2240 is a novel bioinformatically detected regulatory, non protein coding, viral micro RNA (miRNA) gene. The method by which VGAM2240 was detected is described hereinabove with reference to FIGS. 1-8.

VGAM2240 gene, herein designated VGAM GENE, is a viral gene contained in the genome of Porcine Epidemic Diarrhea Virus. VGAM2240 host target gene, herein designated VGAM HOST TARGET GENE, is a human gene contained in the human genome.

VGAM2240 gene encodes a VGAM2240 precursor RNA, herein designated VGAM PRECURSOR RNA. Similar to other miRNA genes, and unlike most ordinary genes, VGAM2240 precursor RNA does not encode a protein. A nucleotide sequence identical or highly similar to the nucleotide sequence of VGAM2240 precursor RNA is designated SEQ ID:2226, and is provided hereinbelow with reference to the sequence listing part. Nucleotide sequence SEQ ID:2226 is located at position 27326 relative to the genome of Porcine Epidemic Diarrhea Virus.

VGAM2240 precursor RNA folds onto itself, forming VGAM2240 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2240 folded precursor RNA into VGAM2240 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM2240 RNA is designated SEQ ID:4951, and is provided hereinbelow with reference to the sequence listing part.

VGAM2240 host target gene, herein designated VGAM HOST TARGET GENE, encodes a corresponding messenger RNA, VGAM2240 host target RNA, herein designated VGAM HOST TARGET RNA. VGAM2240 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2240 RNA, herein designated VGAM RNA, binds complementarily to one or more host target binding sites located in untranslated regions of VGAM2240 host target RNA, herein designated VGAM HOST TARGET RNA. This complementary binding is due to the fact that the nucleotide sequence of VGAM2240 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2240 RNA, herein designated VGAM RNA, may have a different number of host target binding sites in untranslated regions of a VGAM2240 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2240 RNA, herein designated VGAM RNA, to host target binding sites on VGAM2240 host target RNA, herein designated VGAM HOST TARGET RNA, such as BINDING SITE I, BINDING SITE II and BINDING SITE III, inhibits translation of VGAM2240 host target RNA into VGAM2240 host target protein, herein designated VGAM HOST TARGET PROTEIN. VGAM host target protein is therefore outlined by a broken line.

It is appreciated that VGAM2240 host target gene, herein designated VGAM HOST TARGET GENE, in fact represents a plurality of VGAM2240 host target genes. The mRNA of each one of this plurality of VGAM2240 host target genes comprises one or more host target binding sites, each having a nucleotide sequence which is at least partly complementary to VGAM2240 RNA, herein designated VGAM RNA, and which when bound by VGAM2240 RNA causes inhibition of translation of respective one or more VGAM2240 host target proteins.

It is further appreciated by one skilled in the art that the mode of translational inhibition illustrated by FIG. 1 with specific reference to translational inhibition exerted by VGAM2240 gene, herein designated VGAM GENE, on one or more VGAM2240 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2240 is inhibition of expression of host target genes, as part of a novel viral mechanism of attacking a host. Accordingly, utilities of VGAM2240 include diagnosis, prevention and treatment of viral infection by Porcine Epidemic Diarrhea Virus. Specific functions, and accordingly utilities, of VGAM2240 correlate with, and may be deduced from, the identity of the host target genes which VGAM2240 binds and inhibits, and the function of these host target genes, as elaborated hereinbelow.

Nucleotide sequences of the VGAM2240 precursor RNA, herein designated VGAM PRECURSOR RNA, and of the 'diced' VGAM2240 RNA, herein designated VGAM RNA, and a schematic representation of the secondary folding of VGAM2240 folded precursor RNA, herein designated VGAM FOLDED PRECURSOR RNA, of VGAM2240 are further described hereinbelow with reference to Table 1.

Nucleotide sequences of host target binding sites, such as BINDING SITE-I, BINDING SITE-II and BINDING SITE-III of FIG. 1, found on VGAM2240 host target RNA, and schematic representation of the complementarity of each of these host target binding sites to VGAM2240 RNA, herein designated VGAM RNA, are described hereinbelow with reference to Table 2.

As mentioned hereinabove with reference to FIG. 1, a function of VGAM2240 gene, herein designated VGAM is inhibition of expression of VGAM2240 target genes. It is appreciated that specific functions, and accordingly utilities, of VGAM2240 correlate with, and may be deduced from, the identity of the target genes which VGAM2240 binds and inhibits, and the function of these target genes, as elaborated hereinbelow.

Solute Carrier Family 39 (zinc transporter), Member 1 (SLC39A1, Accession NM_014437) is a VGAM2240 host target gene. SLC39A1 BINDING SITE is HOST TARGET binding site found in the 3" untranslated region of mRNA encoded by SLC39A1, corresponding to a HOST TARGET binding site such as BINDING SITE I, BINDING SITE II or BINDING SITE III. Table 2 illustrates the complementarity of the nucleotide sequences of SLC39A1 BINDING SITE, designated SEQ ID:15794, to the nucleotide sequence of VGAM2240 RNA, herein designated VGAM RNA, also designated SEQ ID:4951.

A function of VGAM2240 is therefore inhibition of Solute Carrier Family 39 (zinc transporter), Member 1 (SLC39A1, Accession NM_014437), a gene which is a divalent (zinc/iron) metal ion transporter. Accordingly, utilities of VGAM2240 include diagnosis, prevention and treatment of diseases and clinical conditions associated with SLC39A1. The function of SLC39A1 and its association with various diseases and clinical conditions, has been established by previous studies, as described hereinabove with reference to VGAM1049. SRY (sex determining region Y)-box 12 (SOX12, Accession NM_006943) is another VGAM2240 host target gene. SOX12 BINDING SITE is HOST TARGET binding site found in the 5' untranslated region of mRNA encoded by SOX12, corresponding to a HOST TARGET binding site such as BINDING SITE I, BINDING SITE II or BINDING SITE III. Table 2 illustrates the complementarity of the nucleotide sequences of SOX12 BINDING SITE, designated SEQ ID:13828, to the nucleotide sequence of VGAM2240 RNA, herein designated VGAM RNA, also designated SEQ ID:4951.

Another function of VGAM2240 is therefore inhibition of SRY (sex determining region Y)-box 12 (SOX12, Accession NM_006943). Accordingly, utilities of VGAM2240 include diagnosis, prevention and treatment of diseases and clinical conditions associated with SOX12. Ras Association (RalGDS/AF-6) Domain Family 2 (RASSF2, Accession NM_014737) is another VGAM2240 host target gene. RASSF2 BINDING SITE is HOST TARGET binding site found in the 3' untranslated region of mRNA encoded by RASSF2, corresponding to a HOST TARGET binding site such as BINDING SITE I, BINDING SITE II or BINDING SITE III. Table 2 illustrates the complementarity of the nucleotide sequences of RASSF2 BINDING SITE, designated SEQ ID:16391, to the nucleotide sequence of VGAM2240 RNA, herein designated VGAM RNA, also designated SEQ ID:4951.

Another function of VGAM2240 is therefore inhibition of Ras Association (RalGDS/AF-6) Domain Family 2 (RASSF2, Accession NM_014737). Accordingly, utilities of VGAM2240 include diagnosis, prevention and treatment of diseases and clinical conditions associated with RASSF2. Signal Sequence Receptor, Gamma (translocon-associated protein gamma) (SSR3, Accession NM_007107) is another VGAM2240 host target gene. SSR3 BINDING SITE is HOST TARGET binding site found in the 3' untranslated region of mRNA encoded by SSR3, corresponding to a HOST TARGET binding site such as BINDING SITE I, BINDING SITE II or BINDING SITE III. Table 2 illustrates the complementarity of the nucleotide sequences of SSR3 BINDING SITE, designated SEQ ID:13973, to the nucleotide sequence of VGAM2240 RNA, herein designated VGAM RNA, also designated SEQ ID:4951.

Another function of VGAM2240 is therefore inhibition of Signal Sequence Receptor, Gamma (translocon-associated protein gamma) (SSR3, Accession NM_007107). Accordingly, utilities of VGAM2240 include diagnosis, prevention and treatment of diseases and clinical conditions associated with SSR3. LOC152200 (Accession XM_098174) is another VGAM2240 host target gene. LOC152200 BINDING SITE is HOST TARGET binding site found in the 3' untranslated region of mRNA encoded by LOC152200, corresponding to a HOST TARGET binding site such as BINDING SITE I, BINDING SITE II or BINDING SITE III. Table 2 illustrates the complementarity of the nucleotide sequences of LOC152200 BINDING SITE, designated SEQ ID:41436, to the nucleotide sequence of VGAM2240 RNA, herein designated VGAM RNA, also designated SEQ ID:4951.

Another function of VGAM2240 is therefore inhibition of LOC152200 (Accession XM_098174). Accordingly, utilities of VGAM2240 include diagnosis, prevention and treatment of diseases and clinical conditions associated with LOC152200. FIG. 1 further provides a conceptual description of a novel bioinformatically detected viral gene of the present invention, referred to here as Viral Genomic Address Messenger 2241 (VGAM2241) viral gene, which modulates expression of respective host target genes thereof, the function and utility of which host target genes is known in the art.

VGAM2241 is a novel bioinformatically detected regulatory, non protein coding, viral micro RNA (miRNA) gene. The method by which VGAM2241 was detected is described hereinabove with reference to FIGS. 1-8.

VGAM2241 gene, herein designated VGAM GENE, is a viral gene contained in the genome of Porcine Epidemic Diarrhea Virus. VGAM2241 host target gene, herein designated VGAM HOST TARGET GENE, is a human gene contained in the human genome.

VGAM2241 gene encodes a VGAM2241 precursor RNA, herein designated VGAM PRECURSOR RNA. Similar to other miRNA genes, and unlike most ordinary genes, VGAM2241 precursor RNA does not encode a protein. A nucleotide sequence identical or highly similar to the nucleotide sequence of VGAM2241 precursor RNA is designated SEQ ID:2227, and is provided hereinbelow with reference to the sequence listing part. Nucleotide sequence SEQ ID:2227 is located at position 14383 relative to the genome of Porcine Epidemic Diarrhea Virus.

VGAM2241 precursor RNA folds onto itself, forming VGAM2241 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2241 folded precursor RNA into VGAM2241 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2241 RNA is designated SEQ ID:4952, and is provided hereinbelow with reference to the sequence listing part.

VGAM2241 host target gene, herein designated VGAM HOST TARGET GENE, encodes a corresponding messenger RNA, VGAM2241 host target RNA, herein designated VGAM HOST TARGET RNA. VGAM2241 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2241 RNA, herein designated VGAM RNA, binds complementarily to one or more host target binding sites located in untranslated regions of VGAM2241 host target RNA, herein designated VGAM HOST TARGET RNA. This complementary binding is due to the fact that the nucleotide sequence of VGAM2241 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2241 RNA, herein designated VGAM RNA, may have a different number of host target binding sites in untranslated regions of a VGAM2241 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2241 RNA, herein designated VGAM RNA, to host target binding sites on VGAM2241 host target RNA, herein designated VGAM HOST TARGET RNA, such as BINDING SITE I, BINDING SITE II and BINDING SITE III, inhibits translation of VGAM2241 host target RNA into VGAM2241 host target protein, herein designated VGAM HOST TARGET PROTEIN. VGAM host target protein is therefore outlined by a broken line.

It is appreciated that VGAM2241 host target gene, herein designated VGAM HOST TARGET GENE, in fact represents a plurality of VGAM2241 host target genes. The mRNA of each one of this plurality of VGAM2241 host target genes comprises one or more host target binding sites, each having a nucleotide sequence which is at least partly complementary to VGAM2241 RNA, herein designated VGAM RNA, and which when bound by VGAM2241 RNA causes inhibition of translation of respective one or more VGAM2241 host target proteins.

It is further appreciated by one skilled in the art that the mode of translational inhibition illustrated by FIG. 1 with specific reference to translational inhibition exerted by VGAM2241 gene, herein designated VGAM GENE, on one or more VGAM2241 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2241 is inhibition of expression of host target genes, as part of a novel viral mechanism of attacking a host. Accordingly, utilities of VGAM2241 include diagnosis, prevention and treatment of viral infection by Porcine Epidemic Diarrhea Virus. Specific functions, and accordingly utilities, of VGAM2241 correlate with, and may be deduced from, the identity of the host target genes which VGAM2241 binds and inhibits, and the function of these host target genes, as elaborated hereinbelow.

Nucleotide sequences of the VGAM2241 precursor RNA, herein designated VGAM PRECURSOR RNA, and of the 'diced' VGAM2241 RNA, herein designated VGAM RNA, and a schematic representation of the secondary folding of VGAM2241 folded precursor RNA, herein designated VGAM FOLDED PRECURSOR RNA, of VGAM2241 are further described hereinbelow with reference to Table 1.

Nucleotide sequences of host target binding sites, such as BINDING SITE-I, BINDING SITE-II and BINDING SITE-III of FIG. 1, found on VGAM2241 host target RNA, and schematic representation of the complementarity of each of these host target binding sites to VGAM2241 RNA, herein designated VGAM RNA, are described hereinbelow with reference to Table 2.

As mentioned hereinabove with reference to FIG. 1, a function of VGAM2241 gene, herein designated VGAM is inhibition of expression of VGAM2241 target genes. It is appreciated that specific functions, and accordingly utilities, of VGAM2241 correlate with, and may be deduced from, the identity of the target genes which VGAM2241 binds and inhibits, and the function of these target genes, as elaborated hereinbelow.

POPX1 (Accession NM_014906) is a VGAM2241 host target gene. POPX1 BINDING SITE is HOST TARGET binding site found in the 3' untranslated region of mRNA encoded by POPX1, corresponding to a HOST TARGET binding site such as BINDING SITE I, BINDING SITE II or BINDING SITE III. Table 2 illustrates the complementarity of the nucleotide sequences of POPX1 BINDING SITE, designated SEQ ID:17117, to the nucleotide sequence of VGAM2241 RNA, herein designated VGAM RNA, also designated SEQ ID:4952.

A function of VGAM2241 is therefore inhibition of POPX1 (Accession NM_014906). Accordingly, utilities of VGAM2241 include diagnosis, prevention and treatment of diseases and clinical conditions associated with POPX1. PRO2714 (Accession NM_018534) is another VGAM2241 host target gene. PRO2714 BINDING SITE is HOST TARGET binding site found in the 5' untranslated region of mRNA encoded by PRO2714, corresponding to a HOST TARGET binding site such as BINDING SITE I, BINDING SITE II or BINDING SITE III. Table 2 illustrates the complementarity of the nucleotide sequences of PRO2714 BINDING SITE, designated SEQ ID:20603, to the nucleotide sequence of VGAM2241 RNA, herein designated VGAM RNA, also designated SEQ ID:4952.

Another function of VGAM2241 is therefore inhibition of PRO2714 (Accession NM_018534). Accordingly, utilities of VGAM2241 include diagnosis, prevention and treatment of diseases and clinical conditions associated with PRO2714. Solute Carrier Family 11 (proton-coupled divalent metal ion transporters), Member 2 (SLC11A2, Accession NM_000617) is another VGAM2241 host target gene. SLC11A2 BINDING SITE is HOST TARGET binding site found in the 3' untranslated region of mRNA encoded by SLC11A2, corresponding to a HOST TARGET binding site such as BINDING SITE I, BINDING SITE II or BINDING SITE III. Table 2 illustrates the complementarity of the nucleotide sequences of SLC11A2 BINDING SITE, designated SEQ ID:6223, to the nucleotide sequence of VGAM2241 RNA, herein designated VGAM RNA, also designated SEQ ID:4952.

Another function of VGAM2241 is therefore inhibition of Solute Carrier Family 11 (proton-coupled divalent metal ion transporters), Member 2 (SLC11A2, Accession NM_000617). Accordingly, utilities of VGAM2241 include diagnosis, prevention and treatment of diseases and clinical conditions associated with SLC11A2. LOC254228 (Accession XM_171123) is another VGAM2241 host target gene. LOC254228 BINDING SITE is HOST TARGET binding site found in the 3' untranslated region of mRNA encoded by LOC254228, corresponding to a HOST TARGET binding site such as BINDING SITE I, BINDING SITE II or BINDING SITE III. Table 2 illustrates the complementarity of the nucleotide sequences of LOC254228 BINDING SITE, designated SEQ ID:45918, to the nucleotide sequence of VGAM2241 RNA, herein designated VGAM RNA, also designated SEQ ID:4952.

Another function of VGAM2241 is therefore inhibition of LOC254228 (Accession XM_171123). Accordingly, utilities of VGAM2241 include diagnosis, prevention and treatment of diseases and clinical conditions associated with LOC254228. LOC90736 (Accession XM_033811) is another VGAM2241 host target gene. LOC90736 BINDING SITE is HOST TARGET binding site found in the 3' untranslated region of mRNA encoded by LOC90736, corresponding to a HOST TARGET binding site such as BINDING SITE I, BINDING SITE II or BINDING SITE III. Table 2 illustrates the complementarity of the nucleotide sequences of LOC90736 BINDING SITE, designated SEQ ID:31959, to the nucleotide sequence of VGAM2241 RNA, herein designated VGAM RNA, also designated SEQ ID:4952.

Another function of VGAM2241 is therefore inhibition of LOC90736 (Accession XM_033811). Accordingly, utilities of VGAM2241 include diagnosis, prevention and treatment of diseases and clinical conditions associated with LOC90736. FIG. 1 further provides a conceptual description of a novel bioinformatically detected viral gene of the present invention, referred to here as Viral Genomic Address Messenger 2242 (VGAM2242) viral gene, which modulates expression of respective host target genes thereof, the function and utility of which host target genes is known in the art.

VGAM2242 is a novel bioinformatically detected regulatory, non protein coding, viral micro RNA (miRNA) gene. The method by which VGAM2242 was detected is described hereinabove with reference to FIGS. 1-8.

VGAM2242 gene, herein designated VGAM GENE, is a viral gene contained in the genome of Porcine Epidemic Diarrhea Virus. VGAM2242 host target gene, herein designated VGAM HOST TARGET GENE, is a human gene contained in the human genome.

VGAM2242 gene encodes a VGAM2242 precursor RNA, herein designated VGAM PRECURSOR RNA. Similar to other miRNA genes, and unlike most ordinary genes, VGAM2242 precursor RNA does not encode a protein. A nucleotide sequence identical or highly similar to the nucleotide sequence of VGAM2242 precursor RNA is designated SEQ ID:2228, and is provided hereinbelow with reference to the sequence listing part. Nucleotide sequence SEQ ID:2228 is located at position 2414 relative to the genome of Porcine Epidemic Diarrhea Virus.

VGAM2242 precursor RNA folds onto itself, forming VGAM2242 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2242 folded precursor RNA into VGAM2242 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2242 RNA is designated SEQ ID:4953, and is provided hereinbelow with reference to the sequence listing part.

VGAM2242 host target gene, herein designated VGAM HOST TARGET GENE, encodes a corresponding messenger RNA, VGAM2242 host target RNA, herein designated VGAM HOST TARGET RNA. VGAM2242 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2242 RNA, herein designated VGAM RNA, binds complementarily to one or more host target binding sites located in untranslated regions of VGAM2242 host target RNA, herein designated VGAM HOST TARGET RNA. This complementary binding is due to the fact that the nucleotide sequence of VGAM2242 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2242 RNA, herein designated VGAM RNA, may have a different number of host target binding sites in untranslated regions of a VGAM2242 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2242 RNA, herein designated VGAM RNA, to host target binding sites on VGAM2242 host target RNA, herein designated VGAM HOST TARGET RNA, such as BINDING SITE I, BINDING SITE II and BINDING SITE III, inhibits translation of VGAM2242 host target RNA into VGAM2242 host target protein, herein designated VGAM HOST TARGET PROTEIN. VGAM host target protein is therefore outlined by a broken line.

It is appreciated that VGAM2242 host target gene, herein designated VGAM HOST TARGET GENE, in fact represents a plurality of VGAM2242 host target genes. The mRNA of each one of this plurality of VGAM2242 host target genes comprises one or more host target binding sites, each having a nucleotide sequence which is at least partly complementary to VGAM2242 RNA, herein designated VGAM RNA, and which when bound by VGAM2242 RNA causes inhibition of translation of respective one or more VGAM2242 host target proteins.

It is further appreciated by one skilled in the art that the mode of translational inhibition illustrated by FIG. 1 with specific reference to translational inhibition exerted by VGAM2242 gene, herein designated VGAM GENE, on one or more VGAM2242 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2242 is inhibition of expression of host target genes, as part of a novel viral mechanism of attacking a host. Accordingly, utilities of VGAM2242 include diagnosis, prevention and treatment of viral infection by Porcine Epidemic Diarrhea Virus. Specific functions, and accordingly utilities, of VGAM2242 correlate with, and may be deduced from, the identity of the host target genes which VGAM2242 binds and inhibits, and the function of these host target genes, as elaborated hereinbelow.

Nucleotide sequences of the VGAM2242 precursor RNA, herein designated VGAM PRECURSOR RNA, and of the 'diced' VGAM2242 RNA, herein designated VGAM RNA, and a schematic representation of the secondary folding of VGAM2242 folded precursor RNA, herein designated VGAM FOLDED PRECURSOR RNA, of VGAM2242 are further described hereinbelow with reference to Table 1.

Nucleotide sequences of host target binding sites, such as BINDING SITE-I, BINDING SITE-II and BINDING SITE-III of FIG. 1, found on VGAM2242 host target RNA, and schematic representation of the complementarity of each of these host target binding sites to VGAM2242 RNA, herein designated VGAM RNA, are described hereinbelow with reference to Table 2.

As mentioned hereinabove with reference to FIG. 1, a function of VGAM2242 gene, herein designated VGAM is inhibition of expression of VGAM2242 target genes. It is appreciated that specific functions, and accordingly utilities, of VGAM2242 correlate with, and may be deduced from, the identity of the target genes which VGAM2242 binds and inhibits, and the function of these target genes, as elaborated hereinbelow.

Aldehyde Dehydrogenase 1 Family, Member A3 (ALDH1A3, Accession NM_000693) is a VGAM2242 host target gene. ALDH1A3 BINDING SITE is HOST TARGET binding site found in the 3' untranslated region of mRNA encoded by ALDH1A3, corresponding to a HOST TARGET binding site such as BINDING SITE I, BINDING SITE II or BINDING SITE III. Table 2 illustrates the complementarity of the nucleotide sequences of ALDH1A3 BINDING SITE, designated SEQ ID:6354, to the nucleotide sequence of VGAM2242 RNA, herein designated VGAM RNA, also designated SEQ ID:4953.

A function of VGAM2242 is therefore inhibition of Aldehyde Dehydrogenase 1 Family, Member A3 (ALDH1A3, Accession NM_000693), a gene which plays a major role in the detoxification of aldehydes generated by alcohol metabolism and lipid peroxidation. Accordingly, utilities of VGAM2242 include diagnosis, prevention and treatment of diseases and clinical conditions associated with ALDH1A3. The function of ALDH1A3 and its association with various diseases and clinical conditions, has been established by previous studies, as described hereinabove with reference to VGAM565. Annexin A9 (ANXA9, Accession NM_003568) is another VGAM2242 host target gene. ANXA9 BINDING SITE is HOST TARGET binding site found in the 5' untranslated region of mRNA encoded by ANXA9, corresponding to a HOST TARGET binding site such as BINDING SITE I, BINDING SITE II or BINDING SITE III. Table 2 illustrates the complementarity of the nucleotide sequences of ANXA9 BINDING SITE, designated SEQ ID:9622, to the nucleotide sequence of VGAM2242 RNA, herein designated VGAM RNA, also designated SEQ ID:4953.

Another function of VGAM2242 is therefore inhibition of Annexin A9 (ANXA9, Accession NM_003568), a gene which aggregates and cooperatively binds anionic phospholipids and extracellular matrix proteins. Accordingly, utilities of VGAM2242 include diagnosis, prevention and treatment of diseases and clinical conditions associated with ANXA9. The function of ANXA9 and its association with various diseases and clinical conditions, has been established by previous studies, as described hereinabove with reference to VGAM1485. Caspase Recruitment Domain Family, Member 6 (CARD6, Accession NM_032587) is another VGAM2242 host target gene. CARD6 BINDING SITE is HOST TARGET binding site found in the 3' untranslated region of mRNA encoded by CARD6, corresponding to a HOST TARGET binding site such as BINDING SITE I, BINDING SITE II or BINDING SITE III. Table 2 illustrates the complementarity of the nucleotide sequences of CARD6 BINDING SITE, designated SEQ ID:26321, to the nucleotide sequence of VGAM2242 RNA, herein designated VGAM RNA, also designated SEQ ID:4953.

Another function of VGAM2242 is therefore inhibition of Caspase Recruitment Domain Family, Member 6 (CARD6, Accession NM_032587). Accordingly, utilities of VGAM2242 include diagnosis, prevention and treatment of diseases and clinical conditions associated with CARD6. DKFZp434C0923 (Accession NM_017598) is another VGAM2242 host target gene. DKFZp434C0923 BINDING SITE is HOST TARGET binding site found in the 3' untranslated region of mRNA encoded by DKFZp434C0923, corresponding to a HOST TARGET binding site such as BINDING SITE I, BINDING SITE II or BINDING SITE III. Table 2 illustrates the complementarity of the nucleotide sequences of DKFZp434C0923 BINDING SITE, designated SEQ ID:19062, to the nucleotide sequence of VGAM2242 RNA, herein designated VGAM RNA, also designated SEQ ID:4953.

Another function of VGAM2242 is therefore inhibition of DKFZp434C0923 (Accession NM_017598). Accordingly, utilities of VGAM2242 include diagnosis, prevention and treatment of diseases and clinical conditions associated with DKFZp434C0923. FLJ13491 (Accession NM_024623) is another VGAM2242 host target gene. FLJ13491 BINDING SITE is HOST TARGET binding site found in the 3' untranslated region of mRNA encoded by FLJ13491, corresponding to a HOST TARGET binding site such as BINDING SITE I, BINDING SITE II or BINDING SITE III. Table 2 illustrates the complementarity of the nucleotide sequences of FLJ13491 BINDING SITE, designated SEQ ID:23886, to the nucleotide sequence of VGAM2242 RNA, herein designated VGAM RNA, also designated SEQ ID:4953.

Another function of VGAM2242 is therefore inhibition of FLJ13491 (Accession NM_024623). Accordingly, utilities of VGAM2242 include diagnosis, prevention and treatment of diseases and clinical conditions associated with FLJ13491. KIAA1229 (Accession XM_030665) is another VGAM2242 host target gene. KIAA1229 BINDING SITE is HOST TARGET binding site found in the 3' untranslated region of mRNA encoded by KIAA1229, corresponding to a HOST TARGET binding site such as BINDING SITE I, BINDING SITE II or BINDING SITE III. Table 2 illustrates the complementarity of the nucleotide sequences of KIAA1229 BINDING SITE, designated SEQ ID:31096, to the nucleotide sequence of VGAM2242 RNA, herein designated VGAM RNA, also designated SEQ ID:4953.

Another function of VGAM2242 is therefore inhibition of KIAA1229 (Accession XM_030665). Accordingly, utilities of VGAM2242 include diagnosis, prevention and treatment of diseases and clinical conditions associated with KIAA1229. LOC157798 (Accession XM_098827) is another VGAM2242 host target gene. LOC157798 BINDING SITE is HOST TARGET binding site found in the 5' untranslated region of mRNA encoded by LOC157798, corresponding to a HOST TARGET binding site such as BINDING SITE I, BINDING SITE II or BINDING SITE III. Table 2 illustrates the complementarity of the nucleotide sequences of LOC157798 BINDING SITE, designated SEQ ID:41853, to the nucleotide sequence of VGAM2242 RNA, herein designated VGAM RNA, also designated SEQ ID:4953.

Another function of VGAM2242 is therefore inhibition of LOC157798 (Accession XM_098827). Accordingly, utilities of VGAM2242 include diagnosis, prevention and treatment of diseases and clinical conditions associated with LOC157798. LOC92912 (Accession XM_047970) is another VGAM2242 host target gene. LOC92912 BINDING SITE is HOST TARGET binding site found in the 5' untranslated region of mRNA encoded by LOC92912, corresponding to a HOST TARGET binding site such as BINDING SITE I, BINDING SITE II or BINDING SITE III. Table 2 illustrates the complementarity of the nucleotide sequences of LOC92912 BINDING SITE, designated SEQ ID:35083, to the nucleotide sequence of VGAM2242 RNA, herein designated VGAM RNA, also designated SEQ ID:4953.

Another function of VGAM2242 is therefore inhibition of LOC92912 (Accession XM_047970). Accordingly, utilities of VGAM2242 include diagnosis, prevention and treatment of diseases and clinical conditions associated with LOC92912. FIG. 1 further provides a conceptual description of a novel bioinformatically detected viral gene of the present invention, referred to here as Viral Genomic Address Messenger 2243 (VGAM2243) viral gene, which modulates expression of respective host target genes thereof, the function and utility of which host target genes is known in the art.

VGAM2243 is a novel bioinformatically detected regulatory, non protein coding, viral micro RNA (miRNA) gene. The method by which VGAM2243 was detected is described hereinabove with reference to FIGS. 1-8.

VGAM2243 gene, herein designated VGAM GENE, is a viral gene contained in the genome of Porcine Epidemic Diarrhea Virus. VGAM2243 host target gene, herein designated VGAM HOST TARGET GENE, is a human gene contained in the human genome.

VGAM2243 gene encodes a VGAM2243 precursor RNA, herein designated VGAM PRECURSOR RNA. Similar to other miRNA genes, and unlike most ordinary genes, VGAM2243 precursor RNA does not encode a protein. A nucleotide sequence identical or highly similar to the nucleotide sequence of VGAM2243 precursor RNA is designated SEQ ID:2229, and is provided hereinbelow with reference to the sequence listing part. Nucleotide sequence SEQ ID:2229 is located at position 19645 relative to the genome of Porcine Epidemic Diarrhea Virus.

VGAM2243 precursor RNA folds onto itself, forming VGAM2243 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2243 folded precursor RNA into VGAM2243 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2243 RNA is designated SEQ ID:4954, and is provided hereinbelow with reference to the sequence listing part.

VGAM2243 host target gene, herein designated VGAM HOST TARGET GENE, encodes a corresponding messenger RNA, VGAM2243 host target RNA, herein designated VGAM HOST TARGET RNA. VGAM2243 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2243 RNA, herein designated VGAM RNA, binds complementarily to one or more host target binding sites located in untranslated regions of VGAM2243 host target RNA, herein designated VGAM HOST TARGET RNA. This complementary binding is due to the fact that the nucleotide sequence of VGAM2243 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2243 RNA, herein designated VGAM RNA, may have a different number of host target binding sites in untranslated regions of a VGAM2243 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2243 RNA, herein designated VGAM RNA, to host target binding sites on VGAM2243 host target RNA, herein designated VGAM HOST TARGET RNA, such as BINDING SITE I, BINDING SITE II and BINDING SITE III, inhibits translation of VGAM2243 host target RNA into VGAM2243 host target protein, herein designated VGAM HOST TARGET PROTEIN. VGAM host target protein is therefore outlined by a broken line.

It is appreciated that VGAM2243 host target gene, herein designated VGAM HOST TARGET GENE, in fact represents a plurality of VGAM2243 host target genes. The mRNA of each one of this plurality of VGAM2243 host target genes comprises one or more host target binding sites, each having a nucleotide sequence which is at least partly complementary to VGAM2243 RNA, herein designated VGAM RNA, and which when bound by VGAM2243 RNA causes inhibition of translation of respective one or more VGAM2243 host target proteins.

It is further appreciated by one skilled in the art that the mode of translational inhibition illustrated by FIG. 1 with specific reference to translational inhibition exerted by VGAM2243 gene, herein designated VGAM GENE, on one or more VGAM2243 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2243 is inhibition of expression of host target genes, as part of a novel viral mechanism of attacking a host. Accordingly, utilities of VGAM2243 include diagnosis, prevention and treatment of viral infection by Porcine Epidemic Diarrhea Virus. Specific functions, and accordingly utilities, of VGAM2243 correlate with, and may be deduced from, the identity of the host target genes which VGAM2243 binds and inhibits, and the function of these host target genes, as elaborated hereinbelow.

Nucleotide sequences of the VGAM2243 precursor RNA, herein designated VGAM PRECURSOR RNA, and of the 'diced' VGAM2243 RNA, herein designated VGAM RNA, and a schematic representation of the secondary folding of VGAM2243 folded precursor RNA, herein designated VGAM FOLDED PRECURSOR RNA, of VGAM2243 are further described hereinbelow with reference to Table 1.

Nucleotide sequences of host target binding sites, such as BINDING SITE-I, BINDING SITE-II and BINDING SITE-III of FIG. 1, found on VGAM2243 host target RNA, and schematic representation of the complementarity of each of these host target binding sites to VGAM2243 RNA, herein designated VGAM RNA, are described hereinbelow with reference to Table 2.

As mentioned hereinabove with reference to FIG. 1, a function of VGAM2243 gene, herein designated VGAM is inhibition of expression of VGAM2243 target genes. It is appreciated that specific functions, and accordingly utilities, of VGAM2243 correlate with, and may be deduced from, the identity of the target genes which VGAM2243 binds and inhibits, and the function of these target genes, as elaborated hereinbelow.

Exostoses (multiple)-like 2 (EXTL2, Accession NM_001439) is a VGAM2243 host target gene. EXTL2 BINDING SITE is HOST TARGET binding site found in the 3' untranslated region of mRNA encoded by EXTL2, corresponding to a HOST TARGET binding site such as BIND- ING SITE I, BINDING SITE II or BINDING SITE III. Table 2 illustrates the complementarity of the nucleotide sequences of EXTL2 BINDING SITE, designated SEQ ID:7161, to the nucleotide sequence of VGAM2243 RNA, herein designated VGAM RNA, also designated SEQ ID:4954.

A function of VGAM2243 is therefore inhibition of Exostoses (multiple)-like 2 (EXTL2, Accession NM_001439), a gene which is homologous to the EXT and EXTL genes. Accordingly, utilities of VGAM2243 include diagnosis, prevention and treatment of diseases and clinical conditions associated with EXTL2. The function of EXTL2 and its association with various diseases and clinical conditions, has been established by previous studies, as described hereinabove with reference to VGAM743. Leucine-rich Repeat-containing 2 (LRRC2, Accession NM_024512) is another VGAM2243 host target gene. LRRC2 BINDING SITE is HOST TARGET binding site found in the 3' untranslated region of mRNA encoded by LRRC2, corresponding to a HOST TARGET binding site such as BINDING SITE I, BINDING SITE II or BINDING SITE III. Table 2 illustrates the complementarity of the nucleotide sequences of LRRC2 BINDING SITE, designated SEQ ID:23702, to the nucleotide sequence of VGAM2243 RNA, herein designated VGAM RNA, also designated SEQ ID:4954.

Another function of VGAM2243 is therefore inhibition of Leucine-rich Repeat-containing 2 (LRRC2, Accession NM_024512). Accordingly, utilities of VGAM2243 include diagnosis, prevention and treatment of diseases and clinical conditions associated with LRRC2. Antigen Identified By Monoclonal Antibody Ki-67 (MKI67, Accession NM_002417) is another VGAM2243 host target gene. MKI67 BINDING SITE is HOST TARGET binding site found in the 3' untranslated region of mRNA encoded by MKI67, corresponding to a HOST TARGET binding site such as BINDING SITE I, BINDING SITE II or BINDING SITE III. Table 2 illustrates the complementarity of the nucleotide sequences of MKI67 BINDING SITE, designated SEQ ID:8253, to the nucleotide sequence of VGAM2243 RNA, herein designated VGAM RNA, also designated SEQ ID:4954.

Another function of VGAM2243 is therefore inhibition of Antigen Identified By Monoclonal Antibody Ki-67 (MKI67, Accession NM_002417), a gene which thought to be required for maintaining cell proliferation. Accordingly, utilities of VGAM2243 include diagnosis, prevention and treatment of diseases and clinical conditions associated with MKI67. The function of MKI67 and its association with various diseases and clinical conditions, has been established by previous studies, as described hereinabove with reference to VGAM786. HML2 (Accession NM_006344) is another VGAM2243 host target gene. HML2 BINDING SITE is HOST TARGET binding site found in the 5' untranslated region of mRNA encoded by HML2, corresponding to a HOST TARGET binding site such as BINDING SITE I, BINDING SITE II or BINDING SITE III. Table 2 illustrates the complementarity of the nucleotide sequences of HML2 BINDING SITE, designated SEQ ID:13041, to the nucleotide sequence of VGAM2243 RNA, herein designated VGAM RNA, also designated SEQ ID:4954.

Another function of VGAM2243 is therefore inhibition of HML2 (Accession NM_006344). Accordingly, utilities of VGAM2243 include diagnosis, prevention and treatment of diseases and clinical conditions associated with HML2. KIAA0057 (Accession NM_012288) is another VGAM2243 host target gene. KIAA0057 BINDING SITE is HOST TARGET binding site found in the 3' untranslated region of mRNA encoded by KIAA0057, corresponding to a HOST TARGET binding site such as BINDING SITE I, BINDING SITE II or BINDING SITE III. Table 2 illustrates the complementarity of the nucleotide sequences of KIAA0057 BINDING SITE, designated SEQ ID:14617, to the nucleotide sequence of VGAM2243 RNA, herein designated VGAM RNA, also designated SEQ ID:4954.

Another function of VGAM2243 is therefore inhibition of KIAA0057 (Accession NM_012288). Accordingly, utilities of VGAM2243 include diagnosis, prevention and treatment of diseases and clinical conditions associated with KIAA0057. LOC145757 (Accession XM_085227) is another VGAM2243 host target gene. LOC145757 BINDING SITE is HOST TARGET binding site found in the 5' untranslated region of mRNA encoded by LOC145757, corresponding to a HOST TARGET binding site such as BINDING SITE I, BINDING SITE II or BINDING SITE III. Table 2 illustrates the complementarity of the nucleotide sequences of LOC145757 BINDING SITE, designated SEQ ID:37971, to the nucleotide sequence of VGAM2243 RNA, herein designated VGAM RNA, also designated SEQ ID:4954.

Another function of VGAM2243 is therefore inhibition of LOC145757 (Accession XM_085227). Accordingly, utilities of VGAM2243 include diagnosis, prevention and treatment of diseases and clinical conditions associated with LOC145757. LOC149506 (Accession XM_097661) is another VGAM2243 host target gene. LOC149506 BINDING SITE is HOST TARGET binding site found in the 3' untranslated region of mRNA encoded by LOC149506, corresponding to a HOST TARGET binding site such as BINDING SITE I, BINDING SITE II or BINDING SITE III. Table 2 illustrates the complementarity of the nucleotide sequences of LOC149506 BINDING SITE, designated SEQ ID:41004, to the nucleotide sequence of VGAM2243 RNA, herein designated VGAM RNA, also designated SEQ ID:4954.

Another function of VGAM2243 is therefore inhibition of LOC149506 (Accession XM_097661). Accordingly, utilities of VGAM2243 include diagnosis, prevention and treatment of diseases and clinical conditions associated with LOC149506. FIG. 1 further provides a conceptual description of a novel bioinformatically detected viral gene of the present invention, referred to here as Viral Genomic Address Messenger 2244 (VGAM2244) viral gene, which modulates expression of respective host target genes thereof, the function and utility of which host target genes is known in the art.

VGAM2244 is a novel bioinformatically detected regulatory, non protein coding, viral micro RNA (miRNA) gene. The method by which VGAM2244 was detected is described hereinabove with reference to FIGS. 1-8.

VGAM2244 gene, herein designated VGAM GENE, is a viral gene contained in the genome of Porcine Epidemic Diarrhea Virus. VGAM2244 host target gene, herein designated VGAM HOST TARGET GENE, is a human gene contained in the human genome.

VGAM2244 gene encodes a VGAM2244 precursor RNA, herein designated VGAM PRECURSOR RNA. Similar to other miRNA genes, and unlike most ordinary genes, VGAM2244 precursor RNA does not encode a protein. A nucleotide sequence identical or highly similar to the nucleotide sequence of VGAM2244 precursor RNA is designated SEQ ID:2230, and is provided hereinbelow with reference to the sequence listing part. Nucleotide sequence SEQ ID:2230 is located at position 23117 relative to the genome of Porcine Epidemic Diarrhea Virus.

VGAM2244 precursor RNA folds onto itself, forming VGAM2244 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2244 folded precursor RNA into VGAM2244 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2244 RNA is designated SEQ ID:4955, and is provided hereinbelow with reference to the sequence listing part.

VGAM2244 host target gene, herein designated VGAM HOST TARGET GENE, encodes a corresponding messenger RNA, VGAM2244 host target RNA, herein designated VGAM HOST TARGET RNA. VGAM2244 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2244 RNA, herein designated VGAM RNA, binds complementarily to one or more host target binding sites located in untranslated regions of VGAM2244 host target RNA, herein designated VGAM HOST TARGET RNA. This complementary binding is due to the fact that the nucleotide sequence of VGAM2244 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2244 RNA, herein designated VGAM RNA, may have a different number of host target binding sites in untranslated regions of a VGAM2244 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2244 RNA, herein designated VGAM RNA, to host target binding sites on VGAM2244 host target RNA, herein designated VGAM HOST TARGET RNA, such as BINDING SITE I, BINDING SITE II and BINDING SITE III, inhibits translation of VGAM2244 host target RNA into VGAM2244 host target protein, herein designated VGAM HOST TARGET PROTEIN. VGAM host target protein is therefore outlined by a broken line.

It is appreciated that VGAM2244 host target gene, herein designated VGAM HOST TARGET GENE, in fact represents a plurality of VGAM2244 host target genes. The mRNA of each one of this plurality of VGAM2244 host target genes comprises one or more host target binding sites, each having a nucleotide sequence which is at least partly complementary to VGAM2244 RNA, herein designated VGAM RNA, and which when bound by VGAM2244 RNA causes inhibition of translation of respective one or more VGAM2244 host target proteins.

It is further appreciated by one skilled in the art that the mode of translational inhibition illustrated by FIG. 1 with specific reference to translational inhibition exerted by VGAM2244 gene, herein designated VGAM GENE, on one or more VGAM2244 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2244 is inhibition of expression of host target genes, as part of a novel viral mechanism of attacking a host. Accordingly, utilities of VGAM2244 include diagnosis, prevention and treatment of viral infection by Porcine Epidemic Diarrhea Virus. Specific functions, and accordingly utilities, of VGAM2244 correlate with, and may be deduced from, the identity of the host target genes which VGAM2244 binds and inhibits, and the function of these host target genes, as elaborated hereinbelow.

Nucleotide sequences of the VGAM2244 precursor RNA, herein designated VGAM PRECURSOR RNA, and of the 'diced' VGAM2244 RNA, herein designated VGAM RNA, and a schematic representation of the secondary folding of VGAM2244 folded precursor RNA, herein designated VGAM FOLDED PRECURSOR RNA, of VGAM2244 are further described hereinbelow with reference to Table 1.

Nucleotide sequences of host target binding sites, such as BINDING SITE-I, BINDING SITE-II and BINDING SITE-III of FIG. 1, found on VGAM2244 host target RNA, and schematic representation of the complementarity of each of these host target binding sites to VGAM2244 RNA, herein designated VGAM RNA, are described hereinbelow with reference to Table 2.

As mentioned hereinabove with reference to FIG. 1, a function of VGAM2244 gene, herein designated VGAM is inhibition of expression of VGAM2244 target genes. It is appreciated that specific functions, and accordingly utilities, of VGAM2244 correlate with, and may be deduced from, the identity of the target genes which VGAM2244 binds and inhibits, and the function of these target genes, as elaborated hereinbelow.

Kell Blood Group Precursor (McLeod phenotype) (XK, Accession NM_021083) is a VGAM2244 host target gene. XK BINDING SITE is HOST TARGET binding site found in the 3' untranslated region of mRNA encoded by XK, corresponding to a HOST TARGET binding site such as BINDING SITE I, BINDING SITE II or BINDING SITE III. Table 2 illustrates the complementarity of the nucleotide sequences of XK BINDING SITE, designated SEQ ID:22060, to the nucleotide sequence of VGAM2244 RNA, herein designated VGAM RNA, also designated SEQ ID:4955.

A function of VGAM2244 is therefore inhibition of Kell Blood Group Precursor (McLeod phenotype) (XK, Accession NM_021083). Accordingly, utilities of VGAM2244 include diagnosis, prevention and treatment of diseases and clinical conditions associated with XK. POF1B (Accession NM_024921) is another VGAM2244 host target gene. POF1B BINDING SITE is HOST TARGET binding site found in the 3' untranslated region of mRNA encoded by POF1B, corresponding to a HOST TARGET binding site such as BINDING SITE I, BINDING SITE II or BINDING SITE III. Table 2 illustrates the complementarity of the nucleotide sequences of POF1B BINDING SITE, designated SEQ ID:24454, to the nucleotide sequence of VGAM2244 RNA, herein designated VGAM RNA, also designated SEQ ID:4955.

Another function of VGAM2244 is therefore inhibition of POF1B (Accession NM_024921). Accordingly, utilities of VGAM2244 include diagnosis, prevention and treatment of diseases and clinical conditions associated with POF1B. LOC158156 (Accession XM_088496) is another VGAM2244 host target gene. LOC158156 BINDING SITE is HOST TARGET binding site found in the 3' untranslated region of mRNA encoded by LOC158156, corresponding to a HOST TARGET binding site such as BINDING SITE I, BINDING SITE II or BINDING SITE III. Table 2 illustrates the complementarity of the nucleotide sequences of LOC158156 BINDING SITE, designated SEQ ID:39738, to the nucleotide sequence of VGAM2244 RNA, herein designated VGAM RNA, also designated SEQ ID:4955.

Another function of VGAM2244 is therefore inhibition of LOC158156 (Accession XM_088496). Accordingly, utilities of VGAM2244 include diagnosis, prevention and treatment of diseases and clinical conditions associated with LOC158156. FIG. 1 further provides a conceptual description of a novel bioinformatically detected viral gene of the present invention, referred to here as Viral Genomic Address Messenger 2245 (VGAM2245) viral gene, which modulates expression of respective host target genes thereof, the function and utility of which host target genes is known in the art.

VGAM2245 is a novel bioinformatically detected regulatory, non protein coding, viral micro RNA (miRNA) gene. The method by which VGAM2245 was detected is described hereinabove with reference to FIGS. 1-8.

VGAM2245 gene, herein designated VGAM GENE, is a viral gene contained in the genome of Porcine Epidemic Diarrhea Virus. VGAM2245 host target gene, herein designated VGAM HOST TARGET GENE, is a human gene contained in the human genome.

VGAM2245 gene encodes a VGAM2245 precursor RNA, herein designated VGAM PRECURSOR RNA. Similar to other miRNA genes, and unlike most ordinary genes, VGAM2245 precursor RNA does not encode a protein. A nucleotide sequence identical or highly similar to the nucleotide sequence of VGAM2245 precursor RNA is designated SEQ ID:2231, and is provided hereinbelow with reference to the sequence listing part. Nucleotide sequence SEQ ID:2231 is located at position 11817 relative to the genome of Porcine Epidemic Diarrhea Virus.

VGAM2245 precursor RNA folds onto itself, forming VGAM2245 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2245 folded precursor RNA into VGAM2245 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2245 RNA is designated SEQ ID:4956, and is provided hereinbelow with reference to the sequence listing part.

VGAM2245 host target gene, herein designated VGAM HOST TARGET GENE, encodes a corresponding messenger RNA, VGAM2245 host target RNA, herein designated VGAM HOST TARGET RNA. VGAM2245 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2245 RNA, herein designated VGAM RNA, binds complementarily to one or more host target binding sites located in untranslated regions of VGAM2245 host target RNA, herein designated VGAM HOST TARGET RNA. This complementary binding is due to the fact that the nucleotide sequence of VGAM2245 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2245 RNA, herein designated VGAM RNA, may have a different number of host target binding sites in untranslated regions of a VGAM2245 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2245 RNA, herein designated VGAM RNA, to host target binding sites on VGAM2245 host target RNA, herein designated VGAM HOST TARGET RNA, such as BINDING SITE I, BINDING SITE II and BINDING SITE III, inhibits translation of VGAM2245 host target RNA into VGAM2245 host target protein, herein designated VGAM HOST TARGET PROTEIN. VGAM host target protein is therefore outlined by a broken line.

It is appreciated that VGAM2245 host target gene, herein designated VGAM HOST TARGET GENE, in fact represents a plurality of VGAM2245 host target genes. The mRNA of each one of this plurality of VGAM2245 host target genes comprises one or more host target binding sites, each having a nucleotide sequence which is at least partly complementary to VGAM2245 RNA, herein designated VGAM RNA, and which when bound by VGAM2245 RNA causes inhibition of translation of respective one or more VGAM2245 host target proteins.

It is further appreciated by one skilled in the art that the mode of translational inhibition illustrated by FIG. 1 with specific reference to translational inhibition exerted by VGAM2245 gene, herein designated VGAM GENE, on one or more VGAM2245 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2245 is inhibition of expression of host target genes, as part of a novel viral mechanism of attacking a host. Accordingly, utilities of VGAM2245 include diagnosis, prevention and treatment of viral infection by Porcine Epidemic Diarrhea Virus. Specific functions, and accordingly utilities, of VGAM2245 correlate with, and may be deduced from, the identity of the host target genes which VGAM2245 binds and inhibits, and the function of these host target genes, as elaborated hereinbelow.

Nucleotide sequences of the VGAM2245 precursor RNA, herein designated VGAM PRECURSOR RNA, and of the 'diced' VGAM2245 RNA, herein designated VGAM RNA, and a schematic representation of the secondary folding of VGAM2245 folded precursor RNA, herein designated VGAM FOLDED PRECURSOR RNA, of VGAM2245 are further described hereinbelow with reference to Table 1.

Nucleotide sequences of host target binding sites, such as BINDING SITE-I, BINDING SITE-II and BINDING SITE-III of FIG. 1, found on VGAM2245 host target RNA, and schematic representation of the complementarity of each of these host target binding sites to VGAM2245 RNA, herein designated VGAM RNA, are described hereinbelow with reference to Table 2.

As mentioned hereinabove with reference to FIG. 1, a function of VGAM2245 gene, herein designated VGAM is inhibition of expression of VGAM2245 target genes. It is appreciated that specific functions, and accordingly utilities, of VGAM2245 correlate with, and may be deduced from, the identity of the target genes which VGAM2245 binds and inhibits, and the function of these target genes, as elaborated hereinbelow.

Ac-like Transposable Element (ALTE, Accession NM_004729) is a VGAM2245 host target gene. ALTE BINDING SITE is HOST TARGET binding site found in the 3' untranslated region of mRNA encoded by ALTE, corresponding to a HOST TARGET binding site such as BINDING SITE I, BINDING SITE II or BINDING SITE III. Table 2 illustrates the complementarity of the nucleotide sequences of ALTE BINDING SITE, designated SEQ ID:11106, to the nucleotide sequence of VGAM2245 RNA, herein designated VGAM RNA, also designated SEQ ID:4956.

A function of VGAM2245 is therefore inhibition of Ac-like Transposable Element (ALTE, Accession NM_004729). Accordingly, utilities of VGAM2245 include diagnosis, prevention and treatment of diseases and clinical conditions associated with ALTE. BCL2-associated Athanogene 2 (BAG2, Accession XM_165779) is another VGAM2245 host target gene. BAG2 BINDING SITE is HOST TARGET binding site found in the 5' untranslated region of mRNA encoded by BAG2, corresponding to a HOST TARGET binding site such as BINDING SITE I, BINDING SITE II or BINDING SITE III. Table 2 illustrates the complementarity of the nucleotide sequences of BAG2 BINDING SITE, designated SEQ ID:43752, to the nucleotide sequence of VGAM2245 RNA, herein designated VGAM RNA, also designated SEQ ID:4956.

Another function of VGAM2245 is therefore inhibition of BCL2-associated Athanogene 2 (BAG2, Accession XM_165779). Accordingly, utilities of VGAM2245 include diagnosis, prevention and treatment of diseases and clinical conditions associated with BAG2. DKFZp547D155 (Accession XM_046977) is another VGAM2245 host target gene. DKFZp547D155 BINDING SITE is HOST TARGET binding site found in the 3' untranslated region of mRNA encoded by DKFZp547D155, corresponding to a HOST TARGET binding site such as BINDING SITE I, BINDING SITE II or BINDING SITE III. Table 2 illustrates the complementarity of the nucleotide sequences of DKFZp547D155 BINDING SITE, designated SEQ ID:34870, to the nucleotide sequence of VGAM2245 RNA, herein designated VGAM RNA, also designated SEQ ID:4956.

Another function of VGAM2245 is therefore inhibition of DKFZp547D155 (Accession XM_046977). Accordingly, utilities of VGAM2245 include diagnosis, prevention and treatment of diseases and clinical conditions associated with DKFZp547D155. DKFZP586A011 (Accession NM_015416) is another VGAM2245 host target gene. DKFZP586A011 BINDING SITE is HOST TARGET binding site found in the 3' untranslated region of mRNA encoded by DKFZP586A011, corresponding to a HOST TARGET binding site such as BINDING SITE I, BINDING SITE II or BINDING SITE III. Table 2 illustrates the complementarity of the nucleotide sequences of DKFZP586A011 BINDING SITE, designated SEQ ID:17717, to the nucleotide sequence of VGAM2245 RNA, herein designated VGAM RNA, also designated SEQ ID:4956.

Another function of VGAM2245 is therefore inhibition of DKFZP586A011 (Accession NM_015416). Accordingly, utilities of VGAM2245 include diagnosis, prevention and treatment of diseases and clinical conditions associated with DKFZP586A011. FLJ10719 (Accession XM_031328) is another VGAM2245 host target gene. FLJ10719 BINDING SITE is HOST TARGET binding site found in the 3' untranslated region of mRNA encoded by FLJ10719, corresponding to a HOST TARGET binding site such as BINDING SITE I, BINDING SITE II or BINDING SITE III. Table 2 illustrates the complementarity of the nucleotide sequences of FLJ10719 BINDING SITE, designated SEQ ID:31342, to the nucleotide sequence of VGAM2245 RNA, herein designated VGAM RNA, also designated SEQ ID:4956.

Another function of VGAM2245 is therefore inhibition of FLJ10719 (Accession XM_031328). Accordingly, utilities of VGAM2245 include diagnosis, prevention and treatment of diseases and clinical conditions associated with FLJ10719. KLK15 (Accession NM_023006) is another VGAM2245 host target gene. KLK15 BINDING SITE1 and KLK15 BINDING SITE2 are HOST TARGET binding sites found in untranslated regions of mRNA encoded by KLK15, corresponding to HOST TARGET binding sites such as BINDING SITE I, BINDING SITE II or BINDING SITE III. Table 2 illustrates the complementarity of the nucleotide sequences of KLK15 BINDING SITE1 and KLK15 BINDING SITE2, designated SEQ ID:23266 and SEQ ID:28864 respectively, to the nucleotide sequence of VGAM2245 RNA, herein designated VGAM RNA, also designated SEQ ID:4956.

Another function of VGAM2245 is therefore inhibition of KLK15 (Accession NM_023006). Accordingly, utilities of VGAM2245 include diagnosis, prevention and treatment of diseases and clinical conditions associated with KLK15. Stromal Cell Derived Factor Receptor 1 (SDFR1, Accession NM_012428) is another VGAM2245 host target gene. SDFR1 BINDING SITE1 and SDFR1 BINDING SITE2 are HOST TARGET binding sites found in untranslated regions of mRNA encoded by SDFR1, corresponding to HOST TARGET binding sites such as BINDING SITE I, BINDING SITE II or BINDING SITE III. Table 2 illustrates the complementarity of the nucleotide sequences of SDFR1 BINDING SITE1 and SDFR1 BINDING SITE2, designated SEQ ID:14803 and SEQ ID:18930 respectively, to the nucleotide sequence of VGAM2245 RNA, herein designated VGAM RNA, also designated SEQ ID:4956.

Another function of VGAM2245 is therefore inhibition of Stromal Cell Derived Factor Receptor 1 (SDFR1, Accession NM_012428). Accordingly, utilities of VGAM2245 include diagnosis, prevention and treatment of diseases and clinical conditions associated with SDFR1. LOC146540 (Accession XM_085497) is another VGAM2245 host target gene. LOC146540 BINDING SITE is HOST TARGET binding site found in the 3' untranslated region of mRNA encoded by LOC146540, corresponding to a HOST TARGET binding site such as BINDING SITE I, BINDING SITE II or BINDING SITE III. Table 2 illustrates the complementarity of the nucleotide sequences of LOC146540 BINDING SITE, designated SEQ ID:38199, to the nucleotide sequence of VGAM2245 RNA, herein designated VGAM RNA, also designated SEQ ID:4956.

Another function of VGAM2245 is therefore inhibition of LOC146540 (Accession XM_085497). Accordingly, utilities of VGAM2245 include diagnosis, prevention and treatment of diseases and clinical conditions associated with LOC146540. LOC152485 (Accession XM_087479) is another VGAM2245 host target gene. LOC152485 BINDING SITE is HOST TARGET binding site found in the 3' untranslated region of mRNA encoded by LOC152485, corresponding to a HOST TARGET binding site such as BINDING SITE I, BINDING SITE II or BINDING SITE III. Table 2 illustrates the complementarity of the nucleotide sequences of LOC152485 BINDING SITE, designated SEQ ID:39280, to the nucleotide sequence of VGAM2245 RNA, herein designated VGAM RNA, also designated SEQ ID:4956.

Another function of VGAM2245 is therefore inhibition of LOC152485 (Accession XM_087479). Accordingly, utilities of VGAM2245 include diagnosis, prevention and treatment of diseases and clinical conditions associated with LOC152485. LOC91300 (Accession XM_170568) is another VGAM2245 host target gene. LOC91300 BINDING SITE1 and LOC91300 BINDING SITE2 are HOST TARGET binding sites found in untranslated regions of mRNA encoded by LOC91300, corresponding to HOST TARGET binding sites such as BINDING SITE I, BINDING SITE II or BINDING SITE III. Table 2 illustrates the complementarity of the nucleotide sequences of LOC91300 BINDING SITE1 and LOC91300 BINDING SITE2, designated SEQ ID:45385 and SEQ ID:29004 respectively, to the nucleotide sequence of VGAM2245 RNA, herein designated VGAM RNA, also designated SEQ ID:4956.

Another function of VGAM2245 is therefore inhibition of LOC91300 (Accession XM_170568). Accordingly, utilities of VGAM2245 include diagnosis, prevention and treatment of diseases and clinical conditions associated with LOC91300. Paired Basic Amino Acid Cleaving System 4 (PACE4, Accession NM_002570) is another VGAM2246 host target gene. PACE4 BINDING SITE1 and PACE4 BINDING SITE2 are HOST TARGET binding sites found in untranslated regions of mRNA encoded by PACE4, corresponding to HOST TARGET binding sites such as BINDING SITE I, BINDING SITE II or BINDING SITE III. Table 2 illustrates the complementarity of the nucleotide sequences of PACE4 BINDING SITE1 and PACE4 BINDING SITE2, designated SEQ ID:8429 and SEQ ID:28718 respectively, to the nucleotide sequence of VGAM2246 RNA, herein designated VGAM RNA, also designated SEQ ID:4957.

Another function of VGAM2246 is therefore inhibition of Paired Basic Amino Acid Cleaving System 4 (PACE4, Accession NM_002570), a gene which processes hormone precursors by cleaving paired basic amino acids. Accordingly, utilities of VGAM2246 include diagnosis, prevention and treatment of diseases and clinical conditions associated with PACE4. The function of PACE4 and its association with various diseases and clinical conditions, has been established by previous studies, as described hereinabove with reference to VGAM1194. Tissue Inhibitor of Metalloproteinase 3 (Sorsby fundus dystrophy, pseudoinflammatory) (TIMP3, Accession NM_000362) is another VGAM2246 host target gene. TIMP3 BINDING SITE is HOST TARGET binding site found in the 3' untranslated region of mRNA encoded by TIMP3, corresponding to a HOST TARGET binding site such as BINDING SITE I, BINDING SITE II or BINDING SITE III. Table 2 illustrates the complementarity of the nucleotide sequences of TIMP3 BINDING SITE, designated SEQ ID:5929, to the nucleotide sequence of VGAM2246 RNA, herein designated VGAM RNA, also designated SEQ ID:4957.

Another function of VGAM2246 is therefore inhibition of Tissue Inhibitor of Metalloproteinase 3 (Sorsby fundus dystrophy, pseudoinflammatory) (TIMP3, Accession NM_000362). Accordingly, utilities of VGAM2246 include diagnosis, prevention and treatment of diseases and clinical conditions associated with TIMP3. FLJ10620 (Accession NM_018157) is another VGAM2246 host target gene. FLJ10620 BINDING SITE is HOST TARGET binding site found in the 3' untranslated region of mRNA encoded by FLJ10620, corresponding to a HOST TARGET binding site such as BINDING SITE I, BINDING SITE II or BINDING SITE III. Table 2 illustrates the complementarity of the nucleotide sequences of FLJ10620 BINDING SITE, designated SEQ ID:19974, to the nucleotide sequence of VGAM2246 RNA, herein designated VGAM RNA, also designated SEQ ID:4957.

Another function of VGAM2246 is therefore inhibition of FLJ10620 (Accession NM_018157). Accordingly, utilities of VGAM2246 include diagnosis, prevention and treatment of diseases and clinical conditions associated with FLJ10620. FLJ12355 (Accession NM_024988) is another VGAM2246 host target gene. FLJ12355 BINDING SITE is HOST TARGET binding site found in the 3' untranslated region of mRNA encoded by FLJ12355, corresponding to a HOST TARGET binding site such as BINDING SITE I, BINDING SITE II or BINDING SITE III. Table 2 illustrates the complementarity of the nucleotide sequences of FLJ12355 BINDING SITE, designated SEQ ID:24544, to the nucleotide sequence of VGAM2246 RNA, herein designated VGAM RNA, also designated SEQ ID:4957.

Another function of VGAM2246 is therefore inhibition of FLJ12355 (Accession NM_024988). Accordingly, utilities of VGAM2246 include diagnosis, prevention and treatment of diseases and clinical conditions associated with FLJ12355. KIAA0515 (Accession XM_033380) is another VGAM2246 host target gene. KIAA0515 BINDING SITE is HOST TARGET binding site found in the 3' untranslated region of mRNA encoded by KIAA0515, corresponding to a HOST TARGET binding site such as BINDING SITE I, BINDING SITE II or BINDING SITE III. Table 2 illustrates the complementarity of the nucleotide sequences of KIAA0515 BINDING SITE, designated SEQ ID:31917, to the nucleotide sequence of VGAM2246 RNA, herein designated VGAM RNA, also designated SEQ ID:4957.

Another function of VGAM2246 is therefore inhibition of KIAA0515 (Accession XM_033380). Accordingly, utilities of VGAM2246 include diagnosis, prevention and treatment of diseases and clinical conditions associated with KIAA0515. KIAA1165 (Accession XM_041162) is another VGAM2246 host target gene. KIAA1165 BINDING SITE is HOST TARGET binding site found in the 3' untranslated region of mRNA encoded by KIAA1165, corresponding to a HOST TARGET binding site such as BINDING SITE I, BINDING SITE II or BINDING SITE III. Table 2 illustrates the complementarity of the nucleotide sequences of KIAA1165 BINDING SITE, designated SEQ ID:33476, to the nucleotide sequence of VGAM2246 RNA, herein designated VGAM RNA, also designated SEQ ID:4957.

Another function of VGAM2246 is therefore inhibition of KIAA1165 (Accession XM_041162). Accordingly, utilities of VGAM2246 include diagnosis, prevention and treatment of diseases and clinical conditions associated with KIAA1165. LOC137964 (Accession XM_059933) is another VGAM2246 host target gene. LOC137964 BINDING SITE is HOST TARGET binding site found in the 3' untranslated region of mRNA encoded by LOC137964, corresponding to a HOST TARGET binding site such as BINDING SITE I, BINDING SITE II or BINDING SITE III. Table 2 illustrates the complementarity of the nucleotide sequences of LOC137964 BINDING SITE, designated SEQ ID:37109, to the nucleotide sequence of VGAM2246 RNA, herein designated VGAM RNA, also designated SEQ ID:4957.

Another function of VGAM2246 is therefore inhibition of LOC137964 (Accession XM_059933). Accordingly, utilities of VGAM2246 include diagnosis, prevention and treatment of diseases and clinical conditions associated with LOC137964. LOC145474 (Accession XM_085147) is another VGAM2246 host target gene. LOC145474 BINDING SITE is HOST TARGET binding site found in the 5' untranslated region of mRNA encoded by LOC145474, corresponding to a HOST TARGET binding site such as BINDING SITE I, BINDING SITE II or BINDING SITE III. Table 2 illustrates the complementarity of the nucleotide sequences of LOC145474 BINDING SITE, designated SEQ ID:37868, to the nucleotide sequence of VGAM2246 RNA, herein designated VGAM RNA, also designated SEQ ID:4957.

Another function of VGAM2246 is therefore inhibition of LOC145474 (Accession XM_085147). Accordingly, utilities of VGAM2246 include diagnosis, prevention and treatment of diseases and clinical conditions associated with LOC145474. LOC158654 (Accession XM_088632) is another VGAM2246 host target gene. LOC158654 BINDING SITE is HOST TARGET binding site found in the 3' untranslated region of mRNA encoded by LOC158654, corresponding to a HOST TARGET binding site such as BINDING SITE I, BINDING SITE II or BINDING SITE III. Table 2 illustrates the complementarity of the nucleotide sequences of LOC158654 BINDING SITE, designated SEQ ID:39873, to the nucleotide sequence of VGAM2246 RNA, herein designated VGAM RNA, also designated SEQ ID:4957.

Another function of VGAM2246 is therefore inhibition of LOC158654 (Accession XM_088632). Accordingly, utilities of VGAM2246 include diagnosis, prevention and treatment of diseases and clinical conditions associated with LOC158654. LOC253897 (Accession XM_171187) is another VGAM2246 host target gene. LOC253897 BINDING SITE is HOST TARGET binding site found in the 3' untranslated region of mRNA encoded by LOC253897, corresponding to a HOST TARGET binding site such as BINDING SITE I, BINDING SITE II or BINDING SITE III. Table 2 illustrates the complementarity of the nucleotide sequences of LOC253897 BINDING SITE, designated SEQ ID:45966, to the nucleotide sequence of VGAM2246 RNA, herein designated VGAM RNA, also designated SEQ ID:4957.

Another function of VGAM2246 is therefore inhibition of LOC253897 (Accession XM_171187). Accordingly, utilities of VGAM2246 include diagnosis, prevention and treatment of diseases and clinical conditions associated with LOC253897. FIG. 1 further provides a conceptual description of a novel bioinformatically detected viral gene of the present invention, referred to here as Viral Genomic Address Messenger 2247 (VGAM2247) viral gene, which modulates expression of respective host target genes thereof, the function and utility of which host target genes is known in the art.

VGAM2247 is a novel bioinformatically detected regulatory, non protein coding, viral micro RNA (miRNA) gene. The method by which VGAM2247 was detected is described hereinabove with reference to FIGS. 1-8.

VGAM2247 gene, herein designated VGAM GENE, is a viral gene contained in the genome of Transmissible Gastroenteritis Virus. VGAM2247 host target gene, herein designated VGAM HOST TARGET GENE, is a human gene contained in the human genome.

VGAM2247 gene encodes a VGAM2247 precursor RNA, herein designated VGAM PRECURSOR RNA. Similar to other miRNA genes, and unlike most ordinary genes, VGAM2247 precursor RNA does not encode a protein. A nucleotide sequence identical or highly similar to the nucleotide sequence of VGAM2247 precursor RNA is designated SEQ ID:2233, and is provided hereinbelow with reference to the sequence listing part. Nucleotide sequence SEQ ID:2233 is located at position 6648 relative to the genome of Transmissible Gastroenteritis Virus.

VGAM2247 precursor RNA folds onto itself, forming VGAM2247 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2247 folded precursor RNA into VGAM2247 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM2247 RNA is designated SEQ ID:4958, and is provided hereinbelow with reference to the sequence listing part.

VGAM2247 host target gene, herein designated VGAM HOST TARGET GENE, encodes a corresponding messenger RNA, VGAM2247 host target RNA, herein designated VGAM HOST TARGET RNA. VGAM2247 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2247 RNA, herein designated VGAM RNA, binds complementarily to one or more host target binding sites located in untranslated regions of VGAM2247 host target RNA, herein designated VGAM HOST TARGET RNA. This complementary binding is due to the fact that the nucleotide sequence of VGAM2247 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2247 RNA, herein designated VGAM RNA, may have a different number of host target binding sites in untranslated regions of a VGAM2247 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2247 RNA, herein designated VGAM RNA, to host target binding sites on VGAM2247 host target RNA, herein designated VGAM HOST TARGET RNA, such as BINDING SITE I, BINDING SITE II and BINDING SITE III, inhibits translation of VGAM2247 host target RNA into VGAM2247 host target protein, herein designated VGAM HOST TARGET PROTEIN. VGAM host target protein is therefore outlined by a broken line.

It is appreciated that VGAM2247 host target gene, herein designated VGAM HOST TARGET GENE, in fact represents a plurality of VGAM2247 host target genes. The mRNA of each one of this plurality of VGAM2247 host target genes comprises one or more host target binding sites, each having a nucleotide sequence which is at least partly complementary to VGAM2247 RNA, herein designated VGAM RNA, and which when bound by VGAM2247 RNA causes inhibition of translation of respective one or more VGAM2247 host target proteins.

It is further appreciated by one skilled in the art that the mode of translational inhibition illustrated by FIG. 1 with specific reference to translational inhibition exerted by VGAM2247 gene, herein designated VGAM GENE, on one or more VGAM2247 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2247 is inhibition of expression of host target genes, as part of a novel viral mechanism of attacking a host. Accordingly, utilities of VGAM2247 include diagnosis, prevention and treatment of viral infection by Transmissible Gastroenteritis Virus. Specific functions, and accordingly utilities, of VGAM2247 correlate with, and may be deduced from, the identity of the host target genes which VGAM2247 binds and inhibits, and the function of these host target genes, as elaborated hereinbelow.

Nucleotide sequences of the VGAM2247 precursor RNA, herein designated VGAM PRECURSOR RNA, and of the 'diced' VGAM2247 RNA, herein designated VGAM RNA, and a schematic representation of the secondary folding of VGAM2247 folded precursor RNA, herein designated VGAM FOLDED PRECURSOR RNA, of VGAM2247 are further described hereinbelow with reference to Table 1.

Nucleotide sequences of host target binding sites, such as BINDING SITE-I, BINDING SITE-II and BINDING SITE-III of FIG. 1, found on VGAM2247 host target RNA, and schematic representation of the complementarity of each of these host target binding sites to VGAM2247 RNA, herein designated VGAM RNA, are described hereinbelow with reference to Table 2.

As mentioned hereinabove with reference to FIG. 1, a function of VGAM2247 gene, herein designated VGAM is inhibition of expression of VGAM2247 target genes. It is appreciated that specific functions, and accordingly utilities, of VGAM2247 correlate with, and may be deduced from, the identity of the target genes which VGAM2247 binds and inhibits, and the function of these target genes, as elaborated hereinbelow.

Synaptojanin 2 (SYNJ2, Accession XM_029746) is a VGAM2247 host target gene. SYNJ2 BINDING SITE is HOST TARGET binding site found in the 3' untranslated region of mRNA encoded by SYNJ2, corresponding to a HOST TARGET binding site such as BINDING SITE I, BINDING SITE II or BINDING SITE III. Table 2 illustrates the complementarity of the nucleotide sequences of SYNJ2 BINDING SITE, designated SEQ ID:30943, to the nucleotide sequence of VGAM2247 RNA, herein designated VGAM RNA, also designated SEQ ID:4958.

A function of VGAM2247 is therefore inhibition of Synaptojanin 2 (SYNJ2, Accession XM_029746). Accordingly, utilities of VGAM2247 include diagnosis, prevention and treatment of diseases and clinical conditions associated with SYNJ2. LOC125704 (Accession XM_058931) is another VGAM2247 host target gene. LOC125704 BINDING SITE is HOST TARGET binding site found in the 3' untranslated region of mRNA encoded by LOC125704, corresponding to a HOST TARGET binding site such as BINDING SITE I, BINDING SITE II or BINDING SITE III. Table 2 illustrates the complementarity of the nucleotide sequences of LOC125704 BINDING SITE, designated SEQ ID:36797, to the nucleotide sequence of VGAM2247 RNA, herein designated VGAM RNA, also designated SEQ ID:4958.

Another function of VGAM2247 is therefore inhibition of LOC125704 (Accession XM_058931). Accordingly, utilities of VGAM2247 include diagnosis, prevention and treatment of diseases and clinical conditions associated with LOC125704. LOC132321 (Accession XM_059585) is another VGAM2247 host target gene. LOC132321 BINDING SITE is HOST TARGET binding site found in the 3' untranslated region of mRNA encoded by LOC132321, corresponding to a HOST TARGET binding site such as BINDING SITE I, BINDING SITE II or BINDING SITE III. Table 2 illustrates the complementarity of the nucleotide sequences of LOC132321 BINDING SITE, designated SEQ ID:37025, to the nucleotide sequence of VGAM2247 RNA, herein designated VGAM RNA, also designated SEQ ID:4958.

Another function of VGAM2247 is therefore inhibition of LOC132321 (Accession XM_059585). Accordingly, utilities of VGAM2247 include diagnosis, prevention and treatment of diseases and clinical conditions associated with LOC132321. LOC219894 (Accession XM_167782) is another VGAM2247 host target gene. LOC219894 BINDING SITE is HOST TARGET binding site found in the 5' untranslated region of mRNA encoded by LOC219894, corresponding to a HOST TARGET binding site such as BINDING SITE I, BINDING SITE II or BINDING SITE III. Table 2 illustrates the complementarity of the nucleotide sequences of LOC219894 BINDING SITE, designated SEQ ID:44793, to the nucleotide sequence of VGAM2247 RNA, herein designated VGAM RNA, also designated SEQ ID:4958.

Another function of VGAM2247 is therefore inhibition of LOC219894 (Accession XM_167782). Accordingly, utilities of VGAM2247 include diagnosis, prevention and treatment of diseases and clinical conditions associated with LOC219894. FIG. 1 further provides a conceptual description of a novel bioinformatically detected viral gene of the present invention, referred to here as Viral Genomic Address Messenger 2248 (VGAM2248) viral gene, which modulates expression of respective host target genes thereof, the function and utility of which host target genes is known in the art.

VGAM2248 is a novel bioinformatically detected regulatory, non protein coding, viral micro RNA (miRNA) gene.

The method by which VGAM2248 was detected is described hereinabove with reference to FIGS. 1-8.

VGAM2248 gene, herein designated VGAM GENE, is a viral gene contained in the genome of Transmissible Gastroenteritis Virus. VGAM2248 host target gene, herein designated VGAM HOST TARGET GENE, is a human gene contained in the human genome.

VGAM2248 gene encodes a VGAM2248 precursor RNA, herein designated VGAM PRECURSOR RNA. Similar to other miRNA genes, and unlike most ordinary genes, VGAM2248 precursor RNA does not encode a protein. A nucleotide sequence identical or highly similar to the nucleotide sequence of VGAM2248 precursor RNA is designated SEQ ID:2234, and is provided hereinbelow with reference to the sequence listing part. Nucleotide sequence SEQ ID:2234 is located at position 10637 relative to the genome of Transmissible Gastroenteritis Virus.

VGAM2248 precursor RNA folds onto itself, forming VGAM2248 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2248 folded precursor RNA into VGAM2248 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2248 RNA is designated SEQ ID:4959, and is provided hereinbelow with reference to the sequence listing part.

VGAM2248 host target gene, herein designated VGAM HOST TARGET GENE, encodes a corresponding messenger RNA, VGAM2248 host target RNA, herein designated VGAM HOST TARGET RNA. VGAM2248 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2248 RNA, herein designated VGAM RNA, binds complementarily to one or more host target binding sites located in untranslated regions of VGAM2248 host target RNA, herein designated VGAM HOST TARGET RNA. This complementary binding is due to the fact that the nucleotide sequence of VGAM2248 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2248 RNA, herein designated VGAM RNA, may have a different number of host target binding sites in untranslated regions of a VGAM2248 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2248 RNA, herein designated VGAM RNA, to host target binding sites on VGAM2248 host target RNA, herein designated VGAM HOST TARGET RNA, such as BINDING SITE I, BINDING SITE II and BINDING SITE III, inhibits translation of VGAM2248 host target RNA into VGAM2248 host target protein, herein designated VGAM HOST TARGET PROTEIN. VGAM host target protein is therefore outlined by a broken line.

It is appreciated that VGAM2248 host target gene, herein designated VGAM HOST TARGET GENE, in fact represents a plurality of VGAM2248 host target genes. The mRNA of each one of this plurality of VGAM2248 host target genes comprises one or more host target binding sites, each having a nucleotide sequence which is at least partly complementary to VGAM2248 RNA, herein designated VGAM RNA, and which when bound by VGAM2248 RNA causes inhibition of translation of respective one or more VGAM2248 host target proteins.

It is further appreciated by one skilled in the art that the mode of translational inhibition illustrated by FIG. 1 with specific reference to translational inhibition exerted by VGAM2248 gene, herein designated VGAM GENE, on one or more VGAM2248 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2248 is inhibition of expression of host target genes, as part of a novel viral mechanism of attacking a host. Accordingly, utilities of VGAM2248 include diagnosis, prevention and treatment of viral infection by Transmissible Gastroenteritis Virus. Specific functions, and accordingly utilities, of VGAM2248 correlate with, and may be deduced from, the identity of the host target genes which VGAM2248 binds and inhibits, and the function of these host target genes, as elaborated hereinbelow.

Nucleotide sequences of the VGAM2248 precursor RNA, herein designated VGAM PRECURSOR RNA, and of the 'diced' VGAM2248 RNA, herein designated VGAM RNA, and a schematic representation of the secondary folding of VGAM2248 folded precursor RNA, herein designated VGAM FOLDED PRECURSOR RNA, of VGAM2248 are further described hereinbelow with reference to Table 1.

Nucleotide sequences of host target binding sites, such as BINDING SITE-I, BINDING SITE-II and BINDING SITE-III of FIG. 1, found on VGAM2248 host target RNA, and schematic representation of the complementarity of each of these host target binding sites to VGAM2248 RNA, herein designated VGAM RNA, are described hereinbelow with reference to Table 2.

As mentioned hereinabove with reference to FIG. 1, a function of VGAM2248 gene, herein designated VGAM is inhibition of expression of VGAM2248 target genes. It is appreciated that specific functions, and accordingly utilities, of VGAM2248 correlate with, and may be deduced from, the identity of the target genes which VGAM2248 binds and inhibits, and the function of these target genes, as elaborated hereinbelow.

KIAA0731 (Accession XM_039975) is a VGAM2248 host target gene. KIAA0731 BINDING SITE is HOST TARGET binding site found in the 5' untranslated region of mRNA encoded by KIAA0731, corresponding to a HOST TARGET binding site such as BINDING SITE I, BINDING SITE II or BINDING SITE III. Table 2 illustrates the complementarity of the nucleotide sequences of KIAA0731 BINDING SITE, designated SEQ ID:33238, to the nucleotide sequence of VGAM2248 RNA, herein designated VGAM RNA, also designated SEQ ID:4959.

A function of VGAM2248 is therefore inhibition of KIAA0731 (Accession XM_039975). Accordingly, utilities of VGAM2248 include diagnosis, prevention and treatment of diseases and clinical conditions associated with KIAA0731. LOC256112 (Accession XM_172829) is another VGAM2248 host target gene. LOC256112 BINDING SITE is HOST TARGET binding site found in the 3' untranslated region of mRNA encoded by LOC256112, corresponding to a HOST TARGET binding site such as BINDING SITE I, BINDING SITE II or BINDING SITE III. Table 2 illustrates the complementarity of the nucleotide sequences of LOC256112 BINDING SITE, designated SEQ ID:46104, to the nucleotide sequence of VGAM2248 RNA, herein designated VGAM RNA, also designated SEQ ID:4959.

Another function of VGAM2248 is therefore inhibition of LOC256112 (Accession XM_172829). Accordingly, utilities of VGAM2248 include diagnosis, prevention and treatment of diseases and clinical conditions associated with LOC256112. FIG. 1 further provides a conceptual description of a novel bioinformatically detected viral gene of the present invention, referred to here as Viral Genomic Address Messenger 2249 (VGAM2249) viral gene, which modulates expression of respective host target genes thereof, the function and utility of which host target genes is known in the art.

VGAM2249 is a novel bioinformatically detected regulatory, non protein coding, viral micro RNA (miRNA) gene. The method by which VGAM2249 was detected is described hereinabove with reference to FIGS. 1-8.

VGAM2249 gene, herein designated VGAM GENE, is a viral gene contained in the genome of Transmissible Gastroenteritis Virus. VGAM2249 host target gene, herein designated VGAM HOST TARGET GENE, is a human gene contained in the human genome.

VGAM2249 gene encodes a VGAM2249 precursor RNA, herein designated VGAM PRECURSOR RNA. Similar to other miRNA genes, and unlike most ordinary genes, VGAM2249 precursor RNA does not encode a protein. A nucleotide sequence identical or highly similar to the nucleotide sequence of VGAM2249 precursor RNA is designated SEQ ID:2235, and is provided hereinbelow with reference to the sequence listing part. Nucleotide sequence SEQ ID:2235 is located at position 7046 relative to the genome of Transmissible Gastroenteritis Virus.

VGAM2249 precursor RNA folds onto itself, forming VGAM2249 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2249 folded precursor RNA into VGAM2249 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2249 RNA is designated SEQ ID:4960, and is provided hereinbelow with reference to the sequence listing part.

VGAM2249 host target gene, herein designated VGAM HOST TARGET GENE, encodes a corresponding messenger RNA, VGAM2249 host target RNA, herein designated VGAM HOST TARGET RNA. VGAM2249 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2249 RNA, herein designated VGAM RNA, binds complementarily to one or more host target binding sites located in untranslated regions of VGAM2249 host target RNA, herein designated VGAM HOST TARGET RNA. This complementary binding is due to the fact that the nucleotide sequence of VGAM2249 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2249 RNA, herein designated VGAM RNA, may have a different number of host target binding sites in untranslated regions of a VGAM2249 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2249 RNA, herein designated VGAM RNA, to host target binding sites on VGAM2249 host target RNA, herein designated VGAM HOST TARGET RNA, such as BINDING SITE I, BINDING SITE II and BINDING SITE III, inhibits translation of VGAM2249 host target RNA into VGAM2249 host target protein, herein designated VGAM HOST TARGET PROTEIN. VGAM host target protein is therefore outlined by a broken line.

It is appreciated that VGAM2249 host target gene, herein designated VGAM HOST TARGET GENE, in fact represents a plurality of VGAM2249 host target genes. The mRNA of each one of this plurality of VGAM2249 host target genes comprises one or more host target binding sites, each having a nucleotide sequence which is at least partly complementary to VGAM2249 RNA, herein designated VGAM RNA, and which when bound by VGAM2249 RNA causes inhibition of translation of respective one or more VGAM2249 host target proteins.

It is further appreciated by one skilled in the art that the mode of translational inhibition illustrated by FIG. 1 with specific reference to translational inhibition exerted by VGAM2249 gene, herein designated VGAM GENE, on one or more VGAM2249 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2249 is inhibition of expression of host target genes, as part of a novel viral mechanism of attacking a host. Accordingly, utilities of VGAM2249 include diagnosis, prevention and treatment of viral infection by Transmissible Gastroenteritis Virus. Specific functions, and accordingly utilities, of VGAM2249 correlate with, and may be deduced from, the identity of the host target genes which VGAM2249 binds and inhibits, and the function of these host target genes, as elaborated hereinbelow.

Nucleotide sequences of the VGAM2249 precursor RNA, herein designated VGAM PRECURSOR RNA, and of the 'diced' VGAM2249 RNA, herein designated VGAM RNA, and a schematic representation of the secondary folding of VGAM2249 folded precursor RNA, herein designated VGAM FOLDED PRECURSOR RNA, of VGAM2249 are further described hereinbelow with reference to Table 1.

Nucleotide sequences of host target binding sites, such as BINDING SITE-I, BINDING SITE-II and BINDING SITE-III of FIG. 1, found on VGAM2249 host target RNA, and schematic representation of the complementarity of each of these host target binding sites to VGAM2249 RNA, herein designated VGAM RNA, are described hereinbelow with reference to Table 2.

As mentioned hereinabove with reference to FIG. 1, a function of VGAM2249 gene, herein designated VGAM is inhibition of expression of VGAM2249 target genes. It is appreciated that specific functions, and accordingly utilities, of VGAM2249 correlate with, and may be deduced from, the identity of the target genes which VGAM2249 binds and inhibits, and the function of these target genes, as elaborated hereinbelow.

ATPase, Cu++ Transporting, Alpha Polypeptide (Menkes syndrome) (ATP7A, Accession NM_000052) is a VGAM2249 host target gene. ATP7A BINDING SITE is HOST TARGET binding site found in the 3' untranslated region of mRNA encoded by ATP7A, corresponding to a HOST TARGET binding site such as BINDING SITE I, BINDING SITE II or BINDING SITE III. Table 2 illustrates the complementarity of the nucleotide sequences of ATP7A BINDING SITE, designated SEQ ID:5499, to the nucleotide sequence of VGAM2249 RNA, herein designated VGAM RNA, also designated SEQ ID:4960.

A function of VGAM2249 is therefore inhibition of ATPase, Cu++ Transporting, Alpha Polypeptide (Menkes syndrome) (ATP7A, Accession NM_000052). Accordingly, utilities of VGAM2249 include diagnosis, prevention and treatment of diseases and clinical conditions associated with ATP7A. EPB72 (Accession NM_004099) is another VGAM2249 host target gene. EPB72 BINDING SITE is HOST TARGET binding site found in the 3' untranslated region of mRNA encoded by EPB72, corresponding to a HOST TARGET binding site such as BINDING SITE I, BINDING SITE II or BINDING SITE III. Table 2 illustrates the complementarity of the nucleotide sequences of EPB72 BINDING SITE, designated SEQ ID:10306, to the nucleotide sequence of VGAM2249 RNA, herein designated VGAM RNA, also designated SEQ ID:4960.

Another function of VGAM2249 is therefore inhibition of EPB72 (Accession NM_004099), a gene which may regulate cation conductance. Accordingly, utilities of VGAM2249 include diagnosis, prevention and treatment of diseases and clinical conditions associated with EPB72. The function of EPB72 and its association with various diseases and clinical conditions, has been established by previous studies, as described hereinabove with reference to VGAM1560. Four and A Half LIM Domains 1 (FHL1, Accession NM_001449) is another VGAM2249 host target gene. FHL1 BINDING SITE is HOST TARGET binding site found in the 3' untranslated region of mRNA encoded by FHL1, corresponding to a HOST TARGET binding site such as BINDING SITE I, BINDING SITE II or BINDING SITE III. Table 2 illustrates the complementarity of the nucleotide sequences of FHL1 BINDING SITE, designated SEQ ID:7180, to the nucleotide sequence of VGAM2249 RNA, herein designated VGAM RNA, also designated SEQ ID:4960.

Another function of VGAM2249 is therefore inhibition of Four and A Half LIM Domains 1 (FHL1, Accession NM_001449), a gene which may have an involvement in muscle development or hypertrophy. Accordingly, utilities of VGAM2249 include diagnosis, prevention and treatment of diseases and clinical conditions associated with FHL1. The function of FHL1 and its association with various diseases and clinical conditions, has been established by previous studies, as described hereinabove with reference to VGAM1816. V-kit Hardy-Zuckerman 4 Feline Sarcoma Viral Oncogene Homolog (KIT, Accession NM_000222) is another VGAM2249 host target gene. KIT BINDING SITE is HOST TARGET binding site found in the 3' untranslated region of mRNA encoded by KIT, corresponding to a HOST TARGET binding site such as BINDING SITE I, BINDING SITE II or BINDING SITE III. Table 2 illustrates the complementarity of the nucleotide sequences of KIT BINDING SITE, designated SEQ ID:5733, to the nucleotide sequence of VGAM2249 RNA, herein designated VGAM RNA, also designated SEQ ID:4960.

Another function of VGAM2249 is therefore inhibition of V-kit Hardy-Zuckerman 4 Feline Sarcoma Viral Oncogene Homolog (KIT, Accession NM_000222), a gene which is the receptor for stem cell factor (mast cell growth factor) and has a tyrosine-protein kinase activity. Accordingly, utilities of VGAM2249 include diagnosis, prevention and treatment of diseases and clinical conditions associated with KIT. The function of KIT and its association with various diseases and clinical conditions, has been established by previous studies, as described hereinabove with reference to VGAM173. Crn, Crooked Neck-like 1 (Drosophila) (CRNKL1, Accession NM_016652) is another VGAM2249 host target gene. CRNKL1 BINDING SITE is HOST TARGET binding site found in the 3' untranslated region of mRNA encoded by CRNKL1, corresponding to a HOST TARGET binding site such as BINDING SITE I, BINDING SITE II or BINDING SITE III. Table 2 illustrates the complementarity of the nucleotide sequences of CRNKL1 BINDING SITE, designated SEQ ID:18773, to the nucleotide sequence of VGAM2249 RNA, herein designated VGAM RNA, also designated SEQ ID:4960.

Another function of VGAM2249 is therefore inhibition of Crn, Crooked Neck-like 1 (Drosophila) (CRNKL1, Accession NM_016652). Accordingly, utilities of VGAM2249 include diagnosis, prevention and treatment of diseases and clinical conditions associated with CRNKL1. DKFZp434E2220 (Accession NM_017612) is another VGAM2249 host target gene. DKFZp434E2220 BINDING SITE is HOST TARGET binding site found in the 3' untranslated region of mRNA encoded by DKFZp434E2220, corresponding to a HOST TARGET binding site such as BINDING SITE I, BINDING SITE II or BINDING SITE III. Table 2 illustrates the complementarity of the nucleotide sequences of DKFZp434E2220 BINDING SITE, designated SEQ ID:19114, to the nucleotide sequence of VGAM2249 RNA, herein designated VGAM RNA, also designated SEQ ID:4960.

Another function of VGAM2249 is therefore inhibition of DKFZp434E2220 (Accession NM_017612). Accordingly, utilities of VGAM2249 include diagnosis, prevention and treatment of diseases and clinical conditions associated with DKFZp434E2220. FLJ11259 (Accession NM_018370) is another VGAM2249 host target gene. FLJ11259 BINDING SITE is HOST TARGET binding site found in the 3' untranslated region of mRNA encoded by FLJ11259, corresponding to a HOST TARGET binding site such as BINDING SITE I, BINDING SITE II or BINDING SITE III. Table 2 illustrates the complementarity of the nucleotide sequences of FLJ11259 BINDING SITE, designated SEQ ID:20382, to the nucleotide sequence of VGAM2249 RNA, herein designated VGAM RNA, also designated SEQ ID:4960.

Another function of VGAM2249 is therefore inhibition of FLJ11259 (Accession NM_018370). Accordingly, utilities of VGAM2249 include diagnosis, prevention and treatment of diseases and clinical conditions associated with FLJ11259. FLJ14775 (Accession NM_032837) is another VGAM2249 host target gene. FLJ14775 BINDING SITE is HOST TARGET binding site found in the 3' untranslated region of mRNA encoded by FLJ14775, corresponding to a HOST TARGET binding site such as BINDING SITE I, BINDING SITE II or BINDING SITE III. Table 2 illustrates the complementarity of the nucleotide sequences of FLJ14775 BINDING SITE, designated SEQ ID:26619, to the nucleotide sequence of VGAM2249 RNA, herein designated VGAM RNA, also designated SEQ ID:4960.

Another function of VGAM2249 is therefore inhibition of FLJ14775 (Accession NM_032837). Accordingly, utilities of VGAM2249 include diagnosis, prevention and treatment of diseases and clinical conditions associated with FLJ14775. LOC131873 (Accession XM_067585) is another VGAM2249 host target gene. LOC131873 BINDING SITE is HOST TARGET binding site found in the 5' untranslated region of mRNA encoded by LOC131873, corresponding to a HOST TARGET binding site such as BINDING SITE I, BINDING SITE II or BINDING SITE III. Table 2 illustrates the complementarity of the nucleotide sequences of LOC131873 BINDING SITE, designated SEQ ID:37367, to the nucleotide sequence of VGAM2249 RNA, herein designated VGAM RNA, also designated SEQ ID:4960.

Another function of VGAM2249 is therefore inhibition of LOC131873 (Accession XM_067585). Accordingly, utilities of VGAM2249 include diagnosis, prevention and treatment of diseases and clinical conditions associated with LOC131873. LOC255798 (Accession XM_173087) is another VGAM2249 host target gene. LOC255798 BINDING SITE is HOST TARGET binding site found in the 3' untranslated region of mRNA encoded by LOC255798, corresponding to a HOST TARGET binding site such as BINDING SITE I, BINDING SITE II or BINDING SITE III. Table 2 illustrates the complementarity of the nucleotide sequences of LOC255798 BINDING SITE, designated SEQ ID:46352, to the nucleotide sequence of VGAM2249 RNA, herein designated VGAM RNA, also designated SEQ ID:4960.

Another function of VGAM2249 is therefore inhibition of LOC255798 (Accession XM_173087). Accordingly, utilities of VGAM2249 include diagnosis, prevention and treatment of diseases and clinical conditions associated with LOC255798. FIG. 1 further provides a conceptual description of a novel bioinformatically detected viral gene of the present invention, referred to here as Viral Genomic Address Messenger 2250 (VGAM2250) viral gene, which modulates expression of respective host target genes thereof, the function and utility of which host target genes is known in the art.

VGAM2250 is a novel bioinformatically detected regulatory, non protein coding, viral micro RNA (miRNA) gene. The method by which VGAM2250 was detected is described hereinabove with reference to FIGS. 1-8.

VGAM2250 gene, herein designated VGAM GENE, is a viral gene contained in the genome of Transmissible Gastroenteritis Virus. VGAM2250 host target gene, herein designated VGAM HOST TARGET GENE, is a human gene contained in the human genome.

VGAM2250 gene encodes a VGAM2250 precursor RNA, herein designated VGAM PRECURSOR RNA. Similar to other miRNA genes, and unlike most ordinary genes, VGAM2250 precursor RNA does not encode a protein. A nucleotide sequence identical or highly similar to the nucleotide sequence of VGAM2250 precursor RNA is designated SEQ ID:2236, and is provided hereinbelow with reference to the sequence listing part. Nucleotide sequence SEQ ID:2236 is located at position 14152 relative to the genome of Transmissible Gastroenteritis Virus.

VGAM2250 precursor RNA folds onto itself, forming VGAM2250 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2250 folded precursor RNA into VGAM2250 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2250 RNA is designated SEQ ID:4961, and is provided hereinbelow with reference to the sequence listing part.

VGAM2250 host target gene, herein designated VGAM HOST TARGET GENE, encodes a corresponding messenger RNA, VGAM2250 host target RNA, herein designated VGAM HOST TARGET RNA. VGAM2250 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2250 RNA, herein designated VGAM RNA, binds complementarily to one or more host target binding sites located in untranslated regions of VGAM2250 host target RNA, herein designated VGAM HOST TARGET RNA. This complementary binding is due to the fact that the nucleotide sequence of VGAM2250 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2250 RNA, herein designated VGAM RNA, may have a different number of host target binding sites in untranslated regions of a VGAM2250 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2250 RNA, herein designated VGAM RNA, to host target binding sites on VGAM2250 host target RNA, herein designated VGAM HOST TARGET RNA, such as BINDING SITE I, BINDING SITE II and BINDING SITE III, inhibits translation of VGAM2250 host target RNA into VGAM2250 host target protein, herein designated VGAM HOST TARGET PROTEIN. VGAM host target protein is therefore outlined by a broken line.

It is appreciated that VGAM2250 host target gene, herein designated VGAM HOST TARGET GENE, in fact represents a plurality of VGAM2250 host target genes. The mRNA of each one of this plurality of VGAM2250 host target genes comprises one or more host target binding sites, each having a nucleotide sequence which is at least partly complementary to VGAM2250 RNA, herein designated VGAM RNA, and which when bound by VGAM2250 RNA causes inhibition of translation of respective one or more VGAM2250 host target proteins.

It is further appreciated by one skilled in the art that the mode of translational inhibition illustrated by FIG. 1 with specific reference to translational inhibition exerted by VGAM2250 gene, herein designated VGAM GENE, on one or more VGAM2250 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2250 is inhibition of expression of host target genes, as part of a novel viral mechanism of attacking a host. Accordingly, utilities of VGAM2250 include diagnosis, prevention and treatment of viral infection by Transmissible Gastroenteritis Virus. Specific functions, and accordingly utilities, of VGAM2250 correlate with, and may be deduced from, the identity of the host target genes which VGAM2250 binds and inhibits, and the function of these host target genes, as elaborated hereinbelow.

Nucleotide sequences of the VGAM2250 precursor RNA, herein designated VGAM PRECURSOR RNA, and of the 'diced' VGAM2250 RNA, herein designated VGAM RNA, and a schematic representation of the secondary folding of VGAM2250 folded precursor RNA, herein designated VGAM FOLDED PRECURSOR RNA, of VGAM2250 are further described hereinbelow with reference to Table 1.

Nucleotide sequences of host target binding sites, such as BINDING SITE-I, BINDING SITE-II and BINDING SITE-III of FIG. 1, found on VGAM2250 host target RNA, and schematic representation of the complementarity of each of these host target binding sites to VGAM2250 RNA, herein designated VGAM RNA, are described hereinbelow with reference to Table 2.

As mentioned hereinabove with reference to FIG. 1, a function of VGAM2250 gene, herein designated VGAM is inhibition of expression of VGAM2250 target genes. It is appreciated that specific functions, and accordingly utilities, of VGAM2250 correlate with, and may be deduced from, the identity of the target genes which VGAM2250 binds and inhibits, and the function of these target genes, as elaborated hereinbelow.

Optic Atrophy 1 (autosomal dominant) (OPA1, Accession NM_130833) is a VGAM2250 host target gene. OPA1 BINDING SITE1 through OPA1 BINDING SITE5 are HOST TARGET binding sites found in untranslated regions of mRNA encoded by OPA1, corresponding to HOST TARGET binding sites such as BINDING SITE I, BINDING SITE II or BINDING SITE III. Table 2 illustrates the complementarity of the nucleotide sequences of OPA1 BINDING SITE1 through OPA1 BINDING SITE5, designated SEQ ID:28319, SEQ ID:28327, SEQ ID:28335, SEQ ID:28343 and SEQ ID:28351 respectively, to the nucleotide sequence of VGAM2250 RNA, herein designated VGAM RNA, also designated SEQ ID:4961.

A function of VGAM2250 is therefore inhibition of Optic Atrophy 1 (autosomal dominant) (OPA1, Accession NM_130833). Accordingly, utilities of VGAM2250 include diagnosis, prevention and treatment of diseases and clinical conditions associated with OPA1. KIAA1096 (Accession XM_043678) is another VGAM2250 host target gene. KIAA1096 BINDING SITE is HOST TARGET binding site found in the 3' untranslated region of mRNA encoded by KIAA1096, corresponding to a HOST TARGET binding site such as BINDING SITE I, BINDING SITE II or BINDING SITE III. Table 2 illustrates the complementarity of the nucleotide sequences of KIAA1096 BINDING SITE, designated SEQ ID:33996, to the nucleotide sequence of VGAM2250 RNA, herein designated VGAM RNA, also designated SEQ ID:4961.

Another function of VGAM2250 is therefore inhibition of KIAA1096 (Accession XM_043678). Accordingly, utilities of VGAM2250 include diagnosis, prevention and treatment of diseases and clinical conditions associated with KIAA1096. MGC16142 (Accession NM_032763) is another VGAM2250 host target gene. MGC16142 BINDING SITE is HOST TARGET binding site found in the 3' untranslated region of mRNA encoded by MGC16142, corresponding to a HOST TARGET binding site such as BINDING SITE I, BINDING SITE II or BINDING SITE III. Table 2 illustrates the complementarity of the nucleotide sequences of MGC16142 BINDING SITE, designated SEQ ID:26506, to the nucleotide sequence of VGAM2250 RNA, herein designated VGAM RNA, also designated SEQ ID:4961.

Another function of VGAM2250 is therefore inhibition of MGC16142 (Accession NM_032763). Accordingly, utilities of VGAM2250 include diagnosis, prevention and treatment of diseases and clinical conditions associated with MGC16142. Protocadherin 19 (PCDH19, Accession XM_033173) is another VGAM2250 host target gene. PCDH19 BINDING SITE is HOST TARGET binding site found in the 3' untranslated region of mRNA encoded by PCDH19, corresponding to a HOST TARGET binding site such as BINDING SITE I, BINDING SITE II or BINDING SITE III. Table 2 illustrates the complementarity of the nucleotide sequences of PCDH19 BINDING SITE, designated SEQ ID:31858, to the nucleotide sequence of VGAM2250 RNA, herein designated VGAM RNA, also designated SEQ ID:4961.

Another function of VGAM2250 is therefore inhibition of Protocadherin 19 (PCDH19, Accession XM_033173). Accordingly, utilities of VGAM2250 include diagnosis, prevention and treatment of diseases and clinical conditions associated with PCDH19. RODH-4 (Accession NM_003708) is another VGAM2250 host target gene. RODH-4 BINDING SITE is HOST TARGET binding site found in the 5' untranslated region of mRNA encoded by RODH-4, corresponding to a HOST TARGET binding site such as BINDING SITE I, BINDING SITE II or BINDING SITE III. Table 2 illustrates the complementarity of the nucleotide sequences of RODH-4 BINDING SITE, designated SEQ ID:9807, to the nucleotide sequence of VGAM2250 RNA, herein designated VGAM RNA, also designated SEQ ID:4961.

Another function of VGAM2250 is therefore inhibition of RODH-4 (Accession NM_003708). Accordingly, utilities of VGAM2250 include diagnosis, prevention and treatment of diseases and clinical conditions associated with RODH-4. LOC145123 (Accession XM_041473) is another VGAM2250 host target gene. LOC145123 BINDING SITE is HOST TARGET binding site found in the 3' untranslated region of mRNA encoded by LOC145123, corresponding to a HOST TARGET binding site such as BINDING SITE I, BINDING SITE II or BINDING SITE III. Table 2 illustrates the complementarity of the nucleotide sequences of LOC145123 BINDING SITE, designated SEQ ID:33532, to the nucleotide sequence of VGAM2250 RNA, herein designated VGAM RNA, also designated SEQ ID:4961.

Another function of VGAM2250 is therefore inhibition of LOC145123 (Accession XM_041473). Accordingly, utilities of VGAM2250 include diagnosis, prevention and treatment of diseases and clinical conditions associated with LOC145123. LOC147791 (Accession XM_097293) is another VGAM2250 host target gene. LOC147791 BINDING SITE is HOST TARGET binding site found in the 3' untranslated region of mRNA encoded by LOC147791, corresponding to a HOST TARGET binding site such as BINDING SITE I, BINDING SITE II or BINDING SITE III. Table 2 illustrates the complementarity of the nucleotide sequences of LOC147791 BINDING SITE, designated SEQ ID:40857, to the nucleotide sequence of VGAM2250 RNA, herein designated VGAM RNA, also designated SEQ ID:4961.

Another function of VGAM2250 is therefore inhibition of LOC147791 (Accession XM_097293). Accordingly, utilities of VGAM2250 include diagnosis, prevention and treatment of diseases and clinical conditions associated with LOC147791. FIG. 1 further provides a conceptual description of a novel bioinformatically detected viral gene of the present invention, referred to here as Viral Genomic Address Messenger 2251 (VGAM2251) viral gene, which modulates expression of respective host target genes thereof, the function and utility of which host target genes is known in the art.

VGAM2251 is a novel bioinformatically detected regulatory, non protein coding, viral micro RNA (miRNA) gene. The method by which VGAM2251 was detected is described hereinabove with reference to FIGS. 1-8.

VGAM2251 gene, herein designated VGAM GENE, is a viral gene contained in the genome of Transmissible Gastroenteritis Virus. VGAM2251 host target gene, herein designated VGAM HOST TARGET GENE, is a human gene contained in the human genome.

VGAM2251 gene encodes a VGAM2251 precursor RNA, herein designated VGAM PRECURSOR RNA. Similar to other miRNA genes, and unlike most ordinary genes, VGAM2251 precursor RNA does not encode a protein. A nucleotide sequence identical or highly similar to the nucleotide sequence of VGAM2251 precursor RNA is designated SEQ ID:2237, and is provided hereinbelow with reference to the sequence listing part. Nucleotide sequence SEQ ID:2237 is located at position 4728 relative to the genome of Transmissible Gastroenteritis Virus.

VGAM2251 precursor RNA folds onto itself, forming VGAM2251 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2251 folded precursor RNA into VGAM2251 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2251 RNA is designated SEQ ID:4962, and is provided hereinbelow with reference to the sequence listing part.

VGAM2251 host target gene, herein designated VGAM HOST TARGET GENE, encodes a corresponding messenger RNA, VGAM2251 host target RNA, herein designated VGAM HOST TARGET RNA. VGAM2251 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2251 RNA, herein designated VGAM RNA, binds complementarily to one or more host target binding sites located in untranslated regions of VGAM2251 host target RNA, herein designated VGAM HOST TARGET RNA. This complementary binding is due to the fact that the nucleotide sequence of VGAM2251 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2251 RNA, herein designated VGAM RNA, may have a different number of host target binding sites in untranslated regions of a VGAM2251 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2251 RNA, herein designated VGAM RNA, to host target binding sites on VGAM2251 host target RNA, herein designated VGAM HOST TARGET RNA, such as BINDING SITE I, BINDING SITE II and BINDING SITE III, inhibits translation of VGAM2251 host target RNA into VGAM2251 host target protein, herein designated VGAM HOST TARGET PROTEIN. VGAM host target protein is therefore outlined by a broken line.

It is appreciated that VGAM2251 host target gene, herein designated VGAM HOST TARGET GENE, in fact represents a plurality of VGAM2251 host target genes. The mRNA of each one of this plurality of VGAM2251 host target genes comprises one or more host target binding sites, each having a nucleotide sequence which is at least partly complementary to VGAM2251 RNA, herein designated VGAM RNA, and which when bound by VGAM2251 RNA causes inhibition of translation of respective one or more VGAM2251 host target proteins.

It is further appreciated by one skilled in the art that the mode of translational inhibition illustrated by FIG. 1 with specific reference to translational inhibition exerted by VGAM2251 gene, herein designated VGAM GENE, on one or more VGAM2251 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2251 is inhibition of expression of host target genes, as part of a novel viral mechanism of attacking a host. Accordingly, utilities of VGAM2251 include diagnosis, prevention and treatment of viral infection by Transmissible Gastroenteritis Virus. Specific functions, and accordingly utilities, of VGAM2251 correlate with, and may be deduced from, the identity of the host target genes which VGAM2251 binds and inhibits, and the function of these host target genes, as elaborated hereinbelow.

Nucleotide sequences of the VGAM2251 precursor RNA, herein designated VGAM PRECURSOR RNA, and of the 'diced' VGAM2251 RNA, herein designated VGAM RNA, and a schematic representation of the secondary folding of VGAM2251 folded precursor RNA, herein designated VGAM FOLDED PRECURSOR RNA, of VGAM2251 are further described hereinbelow with reference to Table 1.

Nucleotide sequences of host target binding sites, such as BINDING SITE-I, BINDING SITE-II and BINDING SITE-III of FIG. 1, found on VGAM2251 host target RNA, and schematic representation of the complementarity of each of these host target binding sites to VGAM2251 RNA, herein designated VGAM RNA, are described hereinbelow with reference to Table 2.

As mentioned hereinabove with reference to FIG. 1, a function of VGAM2251 gene, herein designated VGAM is inhibition of expression of VGAM2251 target genes. It is appreciated that specific functions, and accordingly utilities, of VGAM2251 correlate with, and may be deduced from, the identity of the target genes which VGAM2251 binds and inhibits, and the function of these target genes, as elaborated hereinbelow.

Alcohol Dehydrogenase 5 (class III), Chi Polypeptide (ADH5, Accession NM_000671) is a VGAM2251 host target gene. ADH5 BINDING SITE is HOST TARGET binding site found in the 3' untranslated region of mRNA encoded by ADH5, corresponding to a HOST TARGET binding site such as BINDING SITE I, BINDING SITE II or BINDING SITE III. Table 2 illustrates the complementarity of the nucleotide sequences of ADH5 BINDING SITE, designated SEQ ID:6324, to the nucleotide sequence of VGAM2251 RNA, herein designated VGAM RNA, also designated SEQ ID:4962.

A function of VGAM2251 is therefore inhibition of Alcohol Dehydrogenase 5 (class III), Chi Polypeptide (ADH5, Accession NM_000671), a gene which oxidizes ethanol and activated by fatty acids. It oxidizes ethanol very poorly. Accordingly, utilities of VGAM2251 include diagnosis, prevention and treatment of diseases and clinical conditions associated with ADH5. The function of ADH5 and its association with various diseases and clinical conditions, has been established by previous studies, as described hereinabove with reference to VGAM438. Fibronectin Leucine Rich Transmembrane Protein 2 (FLRT2, Accession NM_013231) is another VGAM2251 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14886, to the nucleotide sequence of VGAM2251 RNA, herein designated VGAM RNA, also designated SEQ ID:4962.

Another function of VGAM2251 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM2251 include diagnosis, prevention and treatment of diseases and clinical conditions associated with FLRT2. The function of FLRT2 and its association with various diseases and clinical conditions, has been established by previous studies, as described hereinabove with reference to VGAM247. FBJ Murine Osteosarcoma Viral Oncogene Homolog B (FOSB, Accession NM_006732) is another VGAM2251 host target gene. FOSB BINDING SITE is HOST TARGET binding site found in the 3' untranslated region of mRNA encoded by FOSB, corresponding to a HOST TARGET binding site such as BINDING SITE I, BINDING SITE II or BINDING SITE III. Table 2 illustrates the complementarity of the nucleotide sequences of FOSB BINDING SITE, designated SEQ ID:13583, to the nucleotide sequence of VGAM2251 RNA, herein designated VGAM RNA, also designated SEQ ID:4962.

Another function of VGAM2251 is therefore inhibition of FBJ Murine Osteosarcoma Viral Oncogene Homolog B (FOSB, Accession NM_006732), a gene which interacts with jun proteins enhancing their dna binding activity. Accordingly, utilities of VGAM2251 include diagnosis, prevention and treatment of diseases and clinical conditions associated with FOSB. The function of FOSB and its association with various diseases and clinical conditions, has been established by previous studies, as described hereinabove with reference to VGAM747. IRTA2 (Accession NM_031281) is another VGAM2251 host target gene. IRTA2 BINDING SITE is HOST TARGET binding site found in the 3' untranslated region of mRNA encoded by IRTA2, corresponding to a HOST TARGET binding site such as BINDING SITE I, BINDING SITE II or BINDING SITE III. Table 2 illustrates the complementarity of the nucleotide sequences of IRTA2 BINDING SITE, designated SEQ ID:25297, to the nucleotide sequence of VGAM2251 RNA, herein designated VGAM RNA, also designated SEQ ID:4962.

Another function of VGAM2251 is therefore inhibition of IRTA2 (Accession NM_031281), a gene which binds to the fc region of immunoglobulins gamma low affinity receptor. Accordingly, utilities of VGAM2251 include diagnosis, prevention and treatment of diseases and clinical conditions associated with IRTA2. The function of IRTA2 and its association with various diseases and clinical conditions, has been established by previous studies, as described hereinabove with reference to VGAM206. Membrane Metallo-endopeptidase (neutral endopeptidase, enkephalinase, CALLA, CD10) (MME, Accession NM_007289) is another VGAM2251 host target gene. MME BINDING SITE1 through MME BINDING SITE4 are HOST TARGET binding sites found in untranslated regions of mRNA encoded by MME, corresponding to HOST TARGET binding sites such as BINDING SITE I, BINDING SITE II or BINDING SITE III. Table 2 illustrates the complementarity of the nucleotide sequences of MME BINDING SITE1 through MME BINDING SITE4, designated SEQ ID:14160, SEQ ID:14155, SEQ ID:14151 and SEQ ID:6603 respectively, to the nucleotide sequence of VGAM2251 RNA, herein designated VGAM RNA, also designated SEQ ID:4962.

Another function of VGAM2251 is therefore inhibition of Membrane Metallo-endopeptidase (neutral endopeptidase, enkephalinase, CALLA, CD10) (MME, Accession NM_007289), a gene which is thermolysin-like specificity. Accordingly, utilities of VGAM2251 include diagnosis, prevention and treatment of diseases and clinical conditions associated with MME. The function of MME and its association with various diseases and clinical conditions, has been established by previous studies, as described hereinabove with reference to VGAM1332. Polymerase (DNA directed), Theta (POLQ, Accession NM_006596) is another VGAM2251 host target gene. POLQ BINDING SITE is HOST TARGET binding site found in the 3' untranslated region of mRNA encoded by POLQ, corresponding to a HOST TARGET binding site such as BINDING SITE I, BINDING SITE II or BINDING SITE III. Table 2 illustrates the complementarity of the nucleotide sequences of POLQ BINDING SITE, designated SEQ ID:13367, to the nucleotide sequence of VGAM2251 RNA, herein designated VGAM RNA, also designated SEQ ID:4962.

Another function of VGAM2251 is therefore inhibition of Polymerase (DNA directed), Theta (POLQ, Accession NM_006596), a gene which enhances untargeted mutagenesis. Accordingly, utilities of VGAM2251 include diagnosis, prevention and treatment of diseases and clinical conditions associated with POLQ. The function of POLQ and its association with various diseases and clinical conditions, has been established by previous studies, as described hereinabove with reference to VGAM922. Roundabout, Axon Guidance Receptor, Homolog 1 (Drosophila) (ROBO1, Accession NM_133631) is another VGAM2251 host target gene. ROBO1 BINDING SITE1 and ROBO1 BINDING SITE2 are HOST TARGET binding sites found in untranslated regions of mRNA encoded by ROBO1, corresponding to HOST TARGET binding sites such as BINDING SITE I, BINDING SITE II or BINDING SITE III. Table 2 illustrates the complementarity of the nucleotide sequences of ROBO1 BINDING SITE1 and ROBO1 BINDING SITE2, designated SEQ ID:28585 and SEQ ID:8849 respectively, to the nucleotide sequence of VGAM2251 RNA, herein designated VGAM RNA, also designated SEQ ID:4962.

Another function of VGAM2251 is therefore inhibition of Roundabout, Axon Guidance Receptor, Homolog 1 (Drosophila) (ROBO1, Accession NM_133631), a gene which is an axon guidance receptor. Accordingly, utilities of VGAM2251 include diagnosis, prevention and treatment of diseases and clinical conditions associated with ROBO1. The function of ROBO1 and its association with various diseases and clinical conditions, has been established by previous studies, as described hereinabove with reference to VGAM37. Synuclein, Alpha (non A4 component of amyloid precursor) (SNCA, Accession NM_000345) is another VGAM2251 host target gene. SNCA BINDING SITE is HOST TARGET binding site found in the 3' untranslated region of mRNA encoded by SNCA, corresponding to a HOST TARGET binding site such as BINDING SITE I, BINDING SITE II or BINDING SITE III. Table 2 illustrates the complementarity of the nucleotide sequences of SNCA BINDING SITE, designated SEQ ID:5897, to the nucleotide sequence of VGAM2251 RNA, herein designated VGAM RNA, also designated SEQ ID:4962.

Another function of VGAM2251 is therefore inhibition of Synuclein, Alpha (non A4 component of amyloid precursor) (SNCA, Accession NM_000345). Accordingly, utilities of VGAM2251 include diagnosis, prevention and treatment of diseases and clinical conditions associated with SNCA. Supervillin (SVIL, Accession NM_003174) is another VGAM2251 host target gene. SVIL BINDING SITE1 and SVIL BINDING SITE2 are HOST TARGET binding sites found in untranslated regions of mRNA encoded by SVIL, corresponding to HOST TARGET binding sites such as BINDING SITE I, BINDING SITE II or BINDING SITE III. Table 2 illustrates the complementarity of the nucleotide sequences of SVIL BINDING SITE1 and SVIL BINDING SITE2, designated SEQ ID:9150 and SEQ ID:22347 respectively, to the nucleotide sequence of VGAM2251 RNA, herein designated VGAM RNA, also designated SEQ ID:4962.

Another function of VGAM2251 is therefore inhibition of Supervillin (SVIL, Accession NM_003174), a gene which binds actin, links filamentous actin with the plasma membrane; and contains putative nuclear localization signals. Accordingly, utilities of VGAM2251 include diagnosis, prevention and treatment of diseases and clinical conditions associated with SVIL. The function of SVIL and its association with various diseases and clinical conditions, has been established by previous studies, as described hereinabove with reference to VGAM1459. Visinin-like 1 (VSNL1, Accession NM_003385) is another VGAM2251 host target gene. VSNL1 BINDING SITE is HOST TARGET binding site found in the 3' untranslated region of mRNA encoded by VSNL1, corresponding to a HOST TARGET binding site such as BINDING SITE I, BINDING SITE II or BINDING SITE III. Table 2 illustrates the complementarity of the nucleotide sequences of VSNL1 BINDING SITE, designated SEQ ID:9417, to the nucleotide sequence of VGAM2251 RNA, herein designated VGAM RNA, also designated SEQ ID:4962.

Another function of VGAM2251 is therefore inhibition of Visinin-like 1 (VSNL1, Accession NM_003385). Accordingly, utilities of VGAM2251 include diagnosis, prevention and treatment of diseases and clinical conditions associated with VSNL1. ARPP-19 (Accession NM_006628) is another VGAM2251 host target gene. ARPP-19 BINDING SITE is HOST TARGET binding site found in the 3' untranslated region of mRNA encoded by ARPP-19, corresponding to a HOST TARGET binding site such as BINDING SITE I, BINDING SITE II or BINDING SITE III. Table 2 illustrates the complementarity of the nucleotide sequences of ARPP-19 BINDING SITE, designated SEQ ID:13424, to the nucleotide sequence of VGAM2251 RNA, herein designated VGAM RNA, also designated SEQ ID:4962.

Another function of VGAM2251 is therefore inhibition of ARPP-19 (Accession NM_006628). Accordingly, utilities of VGAM2251 include diagnosis, prevention and treatment of diseases and clinical conditions associated with ARPP-19. Chromosome 21 Open Reading Frame 7 (C21orf7, Accession NM_020152) is another VGAM2251 host target gene. C21orf7 BINDING SITE is HOST TARGET binding site found in the 3' untranslated region of mRNA encoded by C21orf7, corresponding to a HOST TARGET binding site such as BINDING SITE I, BINDING SITE II or BINDING SITE III. Table 2 illustrates the complementarity of the nucleotide sequences of C21orf7 BINDING SITE, designated SEQ ID:21362, to the nucleotide sequence of VGAM2251 RNA, herein designated VGAM RNA, also designated SEQ ID:4962.

Another function of VGAM2251 is therefore inhibition of Chromosome 21 Open Reading Frame 7 (C21orf7, Accession NM_020152). Accordingly, utilities of VGAM2251 include diagnosis, prevention and treatment of diseases and clinical conditions associated with C21orf7. DKFZP586J0619 (Accession XM_088280) is another VGAM2251 host target gene. DKFZP586J0619 BINDING SITE is HOST TARGET binding site found in the 3' untranslated region of mRNA encoded by DKFZP586J0619, corresponding to a HOST TARGET binding site such as BINDING SITE I, BINDING SITE II or BINDING SITE III. Table 2 illustrates the complementarity of the nucleotide sequences of DKFZP586J0619 BINDING SITE, designated SEQ ID:39582, to the nucleotide sequence of VGAM2251 RNA, herein designated VGAM RNA, also designated SEQ ID:4962.

Another function of VGAM2251 is therefore inhibition of DKFZP586J0619 (Accession XM_088280). Accordingly, utilities of VGAM2251 include diagnosis, prevention and treatment of diseases and clinical conditions associated with DKFZP586J0619. FKSG42 (Accession NM_032032) is another VGAM2251 host target gene. FKSG42 BINDING SITE is HOST TARGET binding site found in the 3' untranslated region of mRNA encoded by FKSG42, corresponding to a HOST TARGET binding site such as BINDING SITE I, BINDING SITE II or BINDING SITE III. Table 2 illustrates the complementarity of the nucleotide sequences of FKSG42 BINDING SITE, designated SEQ ID:25733, to the nucleotide sequence of VGAM2251 RNA, herein designated VGAM RNA, also designated SEQ ID:4962.

Another function of VGAM2251 is therefore inhibition of FKSG42 (Accession NM_032032). Accordingly, utilities of VGAM2251 include diagnosis, prevention and treatment of diseases and clinical conditions associated with FKSG42. FLJ10352 (Accession NM_032142) is another VGAM2251 host target gene. FLJ10352 BINDING SITE is HOST TARGET binding site found in the 3' untranslated region of mRNA encoded by FLJ10352, corresponding to a HOST TARGET binding site such as BINDING SITE I, BINDING SITE II or BINDING SITE III. Table 2 illustrates the complementarity of the nucleotide sequences of FLJ10352 BINDING SITE, designated SEQ ID:25830, to the nucleotide sequence of VGAM2251 RNA, herein designated VGAM RNA, also designated SEQ ID:4962.

Another function of VGAM2251 is therefore inhibition of FLJ10352 (Accession NM_032142). Accordingly, utilities of VGAM2251 include diagnosis, prevention and treatment of diseases and clinical conditions associated with FLJ10352. FLJ20275 (Accession NM_017737) is another VGAM2251 host target gene. FLJ20275 BINDING SITE is HOST TARGET binding site found in the 3' untranslated region of mRNA encoded by FLJ20275, corresponding to a HOST TARGET binding site such as BINDING SITE I, BINDING SITE II or BINDING SITE III. Table 2 illustrates the complementarity of the nucleotide sequences of FLJ20275 BINDING SITE, designated SEQ ID:19321, to the nucleotide sequence of VGAM2251 RNA, herein designated VGAM RNA, also designated SEQ ID:4962.

Another function of VGAM2251 is therefore inhibition of FLJ20275 (Accession NM_017737). Accordingly, utilities of VGAM2251 include diagnosis, prevention and treatment of diseases and clinical conditions associated with FLJ20275. FLJ23074 (Accession NM_025052) is another VGAM2251 host target gene. FLJ23074 BINDING SITE is HOST TARGET binding site found in the 3' untranslated region of mRNA encoded by FLJ23074, corresponding to a HOST TARGET binding site such as BINDING SITE I, BINDING SITE II or BINDING SITE III. Table 2 illustrates the complementarity of the nucleotide sequences of FLJ23074 BINDING SITE, designated SEQ ID:24649, to the nucleotide sequence of VGAM2251 RNA, herein designated VGAM RNA, also designated SEQ ID:4962.

Another function of VGAM2251 is therefore inhibition of FLJ23074 (Accession NM_025052). Accordingly, utilities of VGAM2251 include diagnosis, prevention and treatment of diseases and clinical conditions associated with FLJ23074. IL22R (Accession NM_021258) is another VGAM2251 host target gene. IL22R BINDING SITE is HOST TARGET binding site found in the 3' untranslated region of mRNA encoded by IL22R, corresponding to a HOST TARGET binding site such as BINDING SITE I, BINDING SITE II or BINDING SITE III. Table 2 illustrates the complementarity of the nucleotide sequences of IL22R BINDING SITE, designated SEQ ID:22235, to the nucleotide sequence of VGAM2251 RNA, herein designated VGAM RNA, also designated SEQ ID:4962.

Another function of VGAM2251 is therefore inhibition of IL22R (Accession NM_021258). Accordingly, utilities of VGAM2251 include diagnosis, prevention and treatment of diseases and clinical conditions associated with IL22R. KIAA0296 (Accession NM_014699) is another VGAM2251 host target gene. KIAA0296 BINDING SITE is HOST TARGET binding site found in the 3' untranslated region of mRNA encoded by KIAA0296, corresponding to a HOST TARGET binding site such as BINDING SITE I, BINDING SITE II or BINDING SITE III. Table 2 illustrates the complementarity of the nucleotide sequences of KIAA0296 BINDING SITE, designated SEQ ID:16223, to the nucleotide sequence of VGAM2251 RNA, herein designated VGAM RNA, also designated SEQ ID:4962.

Another function of VGAM2251 is therefore inhibition of KIAA0296 (Accession NM_014699). Accordingly, utilities of VGAM2251 include diagnosis, prevention and treatment of diseases and clinical conditions associated with KIAA0296. KIAA0376 (Accession XM_037759) is another VGAM2251 host target gene. KIAA0376 BINDING SITE is HOST TARGET binding site found in the 3' untranslated region of mRNA encoded by KIAA0376, corresponding to a HOST TARGET binding site such as BINDING SITE I, BINDING SITE II or BINDING SITE III. Table 2 illustrates the complementarity of the nucleotide sequences of KIAA0376 BINDING SITE, designated SEQ ID:32676, to the nucleotide sequence of VGAM2251 RNA, herein designated VGAM RNA, also designated SEQ ID:4962.

Another function of VGAM2251 is therefore inhibition of KIAA0376 (Accession XM_037759). Accordingly, utilities of VGAM2251 include diagnosis, prevention and treatment of diseases and clinical conditions associated with KIAA0376. M96 (Accession NM_007358) is another VGAM2251 host target gene. M96 BINDING SITE is HOST TARGET binding site found in the 3' untranslated region of mRNA encoded by M96, corresponding to a HOST TARGET binding site such as BINDING SITE I, BINDING SITE II or BINDING SITE III. Table 2 illustrates the complementarity of the nucleotide sequences of M96 BINDING SITE, designated SEQ ID:14287, to the nucleotide sequence of VGAM2251 RNA, herein designated VGAM RNA, also designated SEQ ID:4962.

Another function of VGAM2251 is therefore inhibition of M96 (Accession NM_007358). Accordingly, utilities of VGAM2251 include diagnosis, prevention and treatment of diseases and clinical conditions associated with M96. mPA-PLA1 (Accession NM_139248) is another VGAM2251 host target gene. mPA-PLA1 BINDING SITE is HOST TARGET binding site found in the 3' untranslated region of mRNA encoded by mPA-PLA1, corresponding to a HOST TARGET binding site such as BINDING SITE I, BINDING SITE II or BINDING SITE III. Table 2 illustrates the complementarity of the nucleotide sequences of mPA-PLA1 BINDING SITE, designated SEQ ID:29251, to the nucleotide sequence of VGAM2251 RNA, herein designated VGAM RNA, also designated SEQ ID:4962.

Another function of VGAM2251 is therefore inhibition of mPA-PLA1 (Accession NM_139248). Accordingly, utilities of VGAM2251 include diagnosis, prevention and treatment of diseases and clinical conditions associated with mPA-PLA1. LOC149910 (Accession XM_086699) is another VGAM2251 host target gene. LOC149910 BINDING SITE is HOST TARGET binding site found in the 3' untranslated region of mRNA encoded by LOC149910, corresponding to a HOST TARGET binding site such as BINDING SITE I, BINDING SITE II or BINDING SITE III. Table 2 illustrates the complementarity of the nucleotide sequences of LOC149910 BINDING SITE, designated SEQ ID:38829, to the nucleotide sequence of VGAM2251 RNA, herein designated VGAM RNA, also designated SEQ ID:4962.

Another function of VGAM2251 is therefore inhibition of LOC149910 (Accession XM_086699). Accordingly, utilities of VGAM2251 include diagnosis, prevention and treatment of diseases and clinical conditions associated with LOC149910. LOC206426 (Accession XM_116505) is another VGAM2251 host target gene. LOC206426 BINDING SITE is HOST TARGET binding site found in the 3' untranslated region of mRNA encoded by LOC206426, corresponding to a HOST TARGET binding site such as BINDING SITE I, BINDING SITE II or BINDING SITE III. Table 2 illustrates the complementarity of the nucleotide sequences of LOC206426 BINDING SITE, designated SEQ ID:43121, to the nucleotide sequence of VGAM2251 RNA, herein designated VGAM RNA, also designated SEQ ID:4962.

Another function of VGAM2251 is therefore inhibition of LOC206426 (Accession XM_116505). Accordingly, utilities of VGAM2251 include diagnosis, prevention and treatment of diseases and clinical conditions associated with LOC206426. LOC220963 (Accession XM_166145) is another VGAM2251 host target gene. LOC220963 BINDING SITE is HOST TARGET binding site found in the 3' untranslated region of mRNA encoded by LOC220963, corresponding to a HOST TARGET binding site such as BINDING SITE I, BINDING SITE II or BINDING SITE III. Table 2 illustrates the complementarity of the nucleotide sequences of LOC220963 BINDING SITE, designated SEQ ID:43957, to the nucleotide sequence of VGAM2251 RNA, herein designated VGAM RNA, also designated SEQ ID:4962.

Another function of VGAM2251 is therefore inhibition of LOC220963 (Accession XM_166145). Accordingly, utilities of VGAM2251 include diagnosis, prevention and treatment of diseases and clinical conditions associated with LOC220963. LOC91012 (Accession XM_035503) is another VGAM2251 host target gene. LOC91012 BINDING SITE is HOST TARGET binding site found in the 5' untranslated region of mRNA encoded by LOC91012, corresponding to a HOST TARGET binding site such as BINDING SITE I, BINDING SITE II or BINDING SITE III. Table 2 illustrates the complementarity of the nucleotide sequences of LOC91012 BINDING SITE, designated SEQ ID:32281, to the nucleotide sequence of VGAM2251 RNA, herein designated VGAM RNA, also designated SEQ ID:4962.

Another function of VGAM2251 is therefore inhibition of LOC91012 (Accession XM_035503). Accordingly, utilities of VGAM2251 include diagnosis, prevention and treatment of diseases and clinical conditions associated with LOC91012. FIG. 1 further provides a conceptual description of a novel bioinformatically detected viral gene of the present invention, referred to here as Viral Genomic Address Messenger 2252 (VGAM2252) viral gene, which modulates expression of respective host target genes thereof, the function and utility of which host target genes is known in the art.

VGAM2252 is a novel bioinformatically detected regulatory, non protein coding, viral micro RNA (miRNA) gene. The method by which VGAM2252 was detected is described hereinabove with reference to FIGS. 1-8.

VGAM2252 gene, herein designated VGAM GENE, is a viral gene contained in the genome of Transmissible Gastroenteritis Virus. VGAM2252 host target gene, herein designated VGAM HOST TARGET GENE, is a human gene contained in the human genome.

VGAM2252 gene encodes a VGAM2252 precursor RNA, herein designated VGAM PRECURSOR RNA. Similar to other miRNA genes, and unlike most ordinary genes, VGAM2252 precursor RNA does not encode a protein. A nucleotide sequence identical or highly similar to the nucleotide sequence of VGAM2252 precursor RNA is designated SEQ ID:2238, and is provided hereinbelow with reference to the sequence listing part. Nucleotide sequence SEQ ID:2238 is located at position 9049 relative to the genome of Transmissible Gastroenteritis Virus.

VGAM2252 precursor RNA folds onto itself, forming VGAM2252 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2252 folded precursor RNA into VGAM2252 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 87%) nucleotide sequence of VGAM2252 RNA is designated SEQ ID:4963, and is provided hereinbelow with reference to the sequence listing part.

VGAM2252 host target gene, herein designated VGAM HOST TARGET GENE, encodes a corresponding messenger RNA, VGAM2252 host target RNA, herein designated VGAM HOST TARGET RNA. VGAM2252 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2252 RNA, herein designated VGAM RNA, binds complementarily to one or more host target binding sites located in untranslated regions of VGAM2252 host target RNA, herein designated VGAM HOST TARGET RNA. This complementary binding is due to the fact that the nucleotide sequence of VGAM2252 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2252 RNA, herein designated VGAM RNA, may have a different number of host target binding sites in untranslated regions of a VGAM2252 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2252 RNA, herein designated VGAM RNA, to host target binding sites on VGAM2252 host target RNA, herein designated VGAM HOST TARGET RNA, such as BINDING SITE I, BINDING SITE II and BINDING SITE III, inhibits translation of VGAM2252 host target RNA into VGAM2252 host target protein, herein designated VGAM HOST TARGET PROTEIN. VGAM host target protein is therefore outlined by a broken line.

It is appreciated that VGAM2252 host target gene, herein designated VGAM HOST TARGET GENE, in fact represents a plurality of VGAM2252 host target genes. The mRNA of each one of this plurality of VGAM2252 host target genes comprises one or more host target binding sites, each having a nucleotide sequence which is at least partly complementary to VGAM2252 RNA, herein designated VGAM RNA, and which when bound by VGAM2252 RNA causes inhibition of translation of respective one or more VGAM2252 host target proteins.

It is further appreciated by one skilled in the art that the mode of translational inhibition illustrated by FIG. 1 with specific reference to translational inhibition exerted by VGAM2252 gene, herein designated VGAM GENE, on one or more VGAM2252 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2252 is inhibition of expression of host target genes, as part of a novel viral mechanism of attacking a host. Accordingly, utilities of VGAM2252 include diagnosis, prevention and treatment of viral infection by Transmissible Gastroenteritis Virus. Specific functions, and accordingly utilities, of VGAM2252 correlate with, and may be deduced from, the identity of the host target genes which VGAM2252 binds and inhibits, and the function of these host target genes, as elaborated hereinbelow.

Nucleotide sequences of the VGAM2252 precursor RNA, herein designated VGAM PRECURSOR RNA, and of the 'diced' VGAM2252 RNA, herein designated VGAM RNA, and a schematic representation of the secondary folding of VGAM2252 folded precursor RNA, herein designated VGAM FOLDED PRECURSOR RNA, of VGAM2252 are further described hereinbelow with reference to Table 1.

Nucleotide sequences of host target binding sites, such as BINDING SITE-I, BINDING SITE-II and BINDING SITE-III of FIG. 1, found on VGAM2252 host target RNA, and schematic representation of the complementarity of each of these host target binding sites to VGAM2252 RNA, herein designated VGAM RNA, are described hereinbelow with reference to Table 2.

As mentioned hereinabove with reference to FIG. 1, a function of VGAM2252 gene, herein designated VGAM is inhibition of expression of VGAM2252 target genes. It is appreciated that specific functions, and accordingly utilities, of VGAM2252 correlate with, and may be deduced from, the identity of the target genes which VGAM2252 binds and inhibits, and the function of these target genes, as elaborated hereinbelow.

Carnitine Acetyltransferase (CRAT, Accession NM_000755) is a VGAM2252 host target gene. CRAT BINDING SITE1 and CRAT BINDING SITE2 are HOST TARGET binding sites found in untranslated regions of mRNA encoded by CRAT, corresponding to HOST TARGET binding sites such as BINDING SITE I, BINDING SITE II or BINDING SITE III. Table 2 illustrates the complementarity of the nucleotide sequences of CRAT BINDING SITE1 and CRAT BINDING SITE2, designated SEQ ID:6408 and SEQ ID:10153 respectively, to the nucleotide sequence of VGAM2252 RNA, herein designated VGAM RNA, also designated SEQ ID:4963.

A function of VGAM2252 is therefore inhibition of Carnitine Acetyltransferase (CRAT, Accession NM_000755), a gene which catalyzes the reversible transfer of acyl groups from an acyl-CoA thioester to carnitine. Accordingly, utilities of VGAM2252 include diagnosis, prevention and treatment of diseases and clinical conditions associated with CRAT. The function of CRAT and its association with various diseases and clinical conditions, has been established by previous studies, as described hereinabove with reference to VGAM1189. A Disintegrin and Metalloproteinase Domain 9 (meltrin gamma) (ADAM9, Accession NM_003816) is another VGAM2252 host target gene. ADAM9 BINDING SITE is HOST TARGET binding site found in the 3' untranslated region of mRNA encoded by ADAM9, corresponding to a HOST TARGET binding site such as BINDING SITE I, BINDING SITE II or BINDING SITE III. Table 2 illustrates the complementarity of the nucleotide sequences of ADAM9 BINDING SITE, designated SEQ ID:9906, to the nucleotide sequence of VGAM2252 RNA, herein designated VGAM RNA, also designated SEQ ID:4963.

Another function of VGAM2252 is therefore inhibition of A Disintegrin and Metalloproteinase Domain 9 (meltrin gamma) (ADAM9, Accession NM_003816). Accordingly, utilities of VGAM2252 include diagnosis, prevention and treatment of diseases and clinical conditions associated with ADAM9. CDV-1 (Accession NM_031473) is another VGAM2252 host target gene. CDV-1 BINDING SITE is HOST TARGET binding site found in the 3' untranslated region of mRNA encoded by CDV-1, corresponding to a HOST TARGET binding site such as BINDING SITE I, BINDING SITE II or BINDING SITE III. Table 2 illustrates the complementarity of the nucleotide sequences of CDV-1 BINDING SITE, designated SEQ ID:25540, to the nucleotide sequence of VGAM2252 RNA, herein designated VGAM RNA, also designated SEQ ID:4963.

Another function of VGAM2252 is therefore inhibition of CDV-1 (Accession NM_031473). Accordingly, utilities of VGAM2252 include diagnosis, prevention and treatment of diseases and clinical conditions associated with CDV-1. Mitogen-activated Protein Kinase 8 Interacting Protein 2 (MAPK8IP2, Accession NM_139124) is another VGAM2252 host target gene. MAPK8IP2 BINDING SITE1 through MAPK8IP2 BINDING SITE3 are HOST TARGET binding sites found in untranslated regions of mRNA encoded by MAPK8IP2, corresponding to HOST TARGET binding sites such as BINDING SITE I, BINDING SITE II or BINDING SITE III. Table 2 illustrates the complementarity of the nucleotide sequences of MAPK8IP2 BINDING SITE1 through MAPK8IP2 BINDING SITE3, designated SEQ ID:29156, SEQ ID:14705 and SEQ ID:18553 respectively, to the nucleotide sequence of VGAM2252 RNA, herein designated VGAM RNA, also designated SEQ ID:4963.

Another function of VGAM2252 is therefore inhibition of Mitogen-activated Protein Kinase 8 Interacting Protein 2 (MAPK8IP2, Accession NM_139124). Accordingly, utilities of VGAM2252 include diagnosis, prevention and treatment of diseases and clinical conditions associated with MAPK8IP2. LOC221641 (Accession XM_168090) is another VGAM2252 host target gene. LOC221641 BINDING SITE is HOST TARGET binding site found in the 5' untranslated region of mRNA encoded by LOC221641, corresponding to a HOST TARGET binding site such as BINDING SITE I, BINDING SITE II or BINDING SITE III. Table 2 illustrates the complementarity of the nucleotide sequences of LOC221641 BINDING SITE, designated SEQ ID:45008, to the nucleotide sequence of VGAM2252 RNA, herein designated VGAM RNA, also designated SEQ ID:4963.

Another function of VGAM2252 is therefore inhibition of LOC221641 (Accession XM_168090). Accordingly, utilities of VGAM2252 include diagnosis, prevention and treatment of diseases and clinical conditions associated with LOC221641. FIG. 1 further provides a conceptual description of a novel bioinformatically detected viral gene of the present invention, referred to here as Viral Genomic Address Messenger 2253 (VGAM2253) viral gene, which modulates expression of respective host target genes thereof, the function and utility of which host target genes is known in the art.

VGAM2253 is a novel bioinformatically detected regulatory, non protein coding, viral micro RNA (miRNA) gene. The method by which VGAM2253 was detected is described hereinabove with reference to FIGS. 1-8.

VGAM2253 gene, herein designated VGAM GENE, is a viral gene contained in the genome of Transmissible Gastroenteritis Virus. VGAM2253 host target gene, herein designated VGAM HOST TARGET GENE, is a human gene contained in the human genome.

VGAM2253 gene encodes a VGAM2253 precursor RNA, herein designated VGAM PRECURSOR RNA. Similar to other miRNA genes, and unlike most ordinary genes, VGAM2253 precursor RNA does not encode a protein. A nucleotide sequence identical or highly similar to the nucleotide sequence of VGAM2253 precursor RNA is designated SEQ ID:2239, and is provided hereinbelow with reference to the sequence listing part. Nucleotide sequence SEQ ID:2239 is located at position 2988 relative to the genome of Transmissible Gastroenteritis Virus.

VGAM2253 precursor RNA folds onto itself, forming VGAM2253 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2253 folded precursor RNA into VGAM2253 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM2253 RNA is designated SEQ ID:4964, and is provided hereinbelow with reference to the sequence listing part.

VGAM2253 host target gene, herein designated VGAM HOST TARGET GENE, encodes a corresponding messenger RNA, VGAM2253 host target RNA, herein designated VGAM HOST TARGET RNA. VGAM2253 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2253 RNA, herein designated VGAM RNA, binds complementarily to one or more host target binding sites located in untranslated regions of VGAM2253 host target RNA, herein designated VGAM HOST TARGET RNA. This complementary binding is due to the fact that the nucleotide sequence of VGAM2253 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2253 RNA, herein designated VGAM RNA, may have a different number of host target binding sites in untranslated regions of a VGAM2253 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2253 RNA, herein designated VGAM RNA, to host target binding sites on VGAM2253 host target RNA, herein designated VGAM HOST TARGET RNA, such as BINDING SITE I, BINDING SITE II and BINDING SITE III, inhibits translation of VGAM2253 host target RNA into VGAM2253 host target protein, herein designated VGAM HOST TARGET PROTEIN. VGAM host target protein is therefore outlined by a broken line.

It is appreciated that VGAM2253 host target gene, herein designated VGAM HOST TARGET GENE, in fact represents a plurality of VGAM2253 host target genes. The mRNA of each one of this plurality of VGAM2253 host target genes comprises one or more host target binding sites, each having a nucleotide sequence which is at least partly complementary to VGAM2253 RNA, herein designated VGAM RNA, and which when bound by VGAM2253 RNA causes inhibition of translation of respective one or more VGAM2253 host target proteins.

It is further appreciated by one skilled in the art that the mode of translational inhibition illustrated by FIG. 1 with specific reference to translational inhibition exerted by VGAM2253 gene, herein designated VGAM GENE, on one or more VGAM2253 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2253 is inhibition of expression of host target genes, as part of a novel viral mechanism of attacking a host. Accordingly, utilities of VGAM2253 include diagnosis, prevention and treatment of viral infection by Transmissible Gastroenteritis Virus. Specific functions, and accordingly utilities, of VGAM2253 correlate with, and may be deduced from, the identity of the host target genes which VGAM2253 binds and inhibits, and the function of these host target genes, as elaborated hereinbelow.

Nucleotide sequences of the VGAM2253 precursor RNA, herein designated VGAM PRECURSOR RNA, and of the 'diced' VGAM2253 RNA, herein designated VGAM RNA, and a schematic representation of the secondary folding of VGAM2253 folded precursor RNA, herein designated VGAM FOLDED PRECURSOR RNA, of VGAM2253 are further described hereinbelow with reference to Table 1.

Nucleotide sequences of host target binding sites, such as BINDING SITE-I, BINDING SITE-II and BINDING SITE-III of FIG. 1, found on VGAM2253 host target RNA, and schematic representation of the complementarity of each of these host target binding sites to VGAM2253 RNA, herein designated VGAM RNA, are described hereinbelow with reference to Table 2.

As mentioned hereinabove with reference to FIG. 1, a function of VGAM2253 gene, herein designated VGAM is inhibition of expression of VGAM2253 target genes. It is appreciated that specific functions, and accordingly utilities, of VGAM2253 correlate with, and may be deduced from, the identity of the target genes which VGAM2253 binds and inhibits, and the function of these target genes, as elaborated hereinbelow.

A Kinase (PRKA) Anchor Protein 2 (AKAP2, Accession NM_007203) is a VGAM2253 host target gene. AKAP2 BINDING SITE is HOST TARGET binding site found in the 3' untranslated region of mRNA encoded by AKAP2, corresponding to a HOST TARGET binding site such as BINDING SITE I, BINDING SITE II or BINDING SITE III. Table 2 illustrates the complementarity of the nucleotide sequences of AKAP2 BINDING SITE, designated SEQ ID:14064, to the nucleotide sequence of VGAM2253 RNA, herein designated VGAM RNA, also designated SEQ ID:4964.

A function of VGAM2253 is therefore inhibition of A Kinase (PRKA) Anchor Protein 2 (AKAP2, Accession NM_007203), a gene which binds to regulatory subunit (rii) of protein kinase a. Accordingly, utilities of VGAM2253 include diagnosis, prevention and treatment of diseases and clinical conditions associated with AKAP2. The function of AKAP2 and its association with various diseases and clinical conditions, has been established by previous studies, as described hereinabove with reference to VGAM18. Dual-specificity tyrosine-(Y)-phosphorylation Regulated Kinase 1A (DYRK1A, Accession NM_001396) is another VGAM2253 host target gene. DYRK1A BINDING SITE1 through DYRK1A BINDING SITE3 are HOST TARGET binding sites found in untranslated regions of mRNA encoded by DYRK1A, corresponding to HOST TARGET binding sites such as BINDING SITE I, BINDING SITE II or BINDING SITE III. Table 2 illustrates the complementarity of the nucleotide sequences of DYRK1A BINDING SITE1 through DYRK1A BINDING SITE3, designated SEQ ID:7095, SEQ ID:28167 and SEQ ID:28190 respectively, to the nucleotide sequence of VGAM2253 RNA, herein designated VGAM RNA, also designated SEQ ID:4964.

Another function of VGAM2253 is therefore inhibition of Dual-specificity tyrosine-(Y)-phosphorylation Regulated Kinase 1A (DYRK1A, Accession NM_001396), a gene which regulates cell proliferation and may be involved in brain development. Accordingly, utilities of VGAM2253 include diagnosis, prevention and treatment of diseases and clinical conditions associated with DYRK1A. The function of DYRK1A and its association with various diseases and clinical conditions, has been established by previous studies, as described hereinabove with reference to VGAM42. Integrin, Alpha 1 (ITGA1, Accession XM_032902) is another VGAM2253 host target gene. ITGA1 BINDING SITE is HOST TARGET binding site found in the 3' untranslated region of mRNA encoded by ITGA1, corresponding to a HOST TARGET binding site such as BINDING SITE I, BINDING SITE II or BINDING SITE III. Table 2 illustrates the complementarity of the nucleotide sequences of ITGA1 BINDING SITE, designated SEQ ID:31791, to the nucleotide sequence of VGAM2253 RNA, herein designated VGAM RNA, also designated SEQ ID:4964.

Another function of VGAM2253 is therefore inhibition of Integrin, Alpha 1 (ITGA1, Accession XM_032902). Accordingly, utilities of VGAM2253 include diagnosis, prevention and treatment of diseases and clinical conditions associated with ITGA1. Latrophilin 1 (LPHH1, Accession NM_012302) is another VGAM2253 host target gene. LPHH1 BINDING SITE is HOST TARGET binding site found in the 3' untranslated region of mRNA encoded by LPHH1, corresponding to a HOST TARGET binding site such as BINDING SITE I, BINDING SITE II or BINDING SITE III. Table 2 illustrates the complementarity of the nucleotide sequences of LPHH1 BINDING SITE, designated SEQ ID:14670, to the nucleotide sequence of VGAM2253 RNA, herein designated VGAM RNA, also designated SEQ ID:4964.

Another function of VGAM2253 is therefore inhibition of Latrophilin 1 (LPHH1, Accession NM_012302), a gene which probably involved in cell adhesion within tissues and receptor signalling. Accordingly, utilities of VGAM2253 include diagnosis, prevention and treatment of diseases and clinical conditions associated with LPHH1. The function of LPHH1 has been established by previous studies. In a study of breast tumor samples, Hoggard et al. (1995) reported a region, 1p31.1, with a high frequency of loss of heterozygosity (LOH). In order to identify candidate sequences, mutation of which might contribute to the development of breast cancer, White et al. (1998) carried out mapping studies of ESTs localized to 1p31.1. They identified and characterized a novel gene, LPHH1 (latrophilin homolog-1), located adjacent to the smallest region of overlapping loss seen in tumors. The 4,209-bp open reading frame of the 7-kb LPHH1 transcript encoded a peptide that showed approximately 65% identity to rat latrophilin, a G-coupled, 7-span transmembrane protein that binds alpha-latrotoxin. Surprisingly, while expression of the rat gene was strictly restricted to neurologic and perhaps some endocrine cells, the human sequence appeared to be expressed very widely in all normal tissues tested. The range of transcripts encoded in a breast tumor cell line, compared to normal breast, suggested that gene product variability was higher in the tumor Full details of the abovementioned studies are described in the following publications, the disclosure of which are hereby incorporated by reference:

Hoggard, N.; Brintell, B.; Howell, A.; Weissenbach, J.; Varley, J.: Allelic imbalance on chromosome 1 in human breast cancer. II. Microsatellite repeat analysis. Genes Chromosomes Cancer 12:24-31, 1995; and White, G. R. M.; Varley, J. M.; Heighway, J.: Isolation and characterization of a human homologue of the latrophilin gene from a region of 1p31.1 implicated in breast cancer. Oncogene 17.

Further studies establishing the function and utilities of LPHH1 are found in John Hopkins OMIM database record ID 607018, and in sited publications numbered 5377-5378 listed in the bibliography section hereinbelow, which are also hereby incorporated by reference. Mitogen-activated Protein Kinase Kinase Kinase 7 Interacting Protein 2 (MAP3K7IP2, Accession NM_015093) is another VGAM2253 host target gene. MAP3K7IP2 BINDING SITE is HOST TARGET binding site found in the 3' untranslated region of mRNA encoded by MAP3K7IP2, corresponding to a HOST TARGET binding site such as BINDING SITE I, BINDING SITE II or BINDING SITE III. Table 2 illustrates the complementarity of the nucleotide sequences of MAP3K7IP2 BINDING SITE, designated SEQ ID:17487, to the nucleotide sequence of VGAM2253 RNA, herein designated VGAM RNA, also designated SEQ ID:4964.

Another function of VGAM2253 is therefore inhibition of Mitogen-activated Protein Kinase Kinase Kinase 7 Interacting Protein 2 (MAP3K7IP2, Accession NM_015093). Accordingly, utilities of VGAM2253 include diagnosis, prevention and treatment of diseases and clinical conditions associated with MAP3K7IP2. AD-020 (Accession XM_002161) is another VGAM2253 host target gene. AD-020 BINDING SITE1 and AD-020 BINDING SITE2 are HOST TARGET binding sites found in untranslated regions of mRNA encoded by AD-020, corresponding to HOST TARGET binding sites such as BINDING SITE I, BINDING SITE II or BINDING SITE III. Table 2 illustrates the complementarity of the nucleotide sequences of AD-020 BINDING SITE1 and AD-020 BINDING SITE2, designated SEQ ID:29871 and SEQ ID:21341 respectively, to the nucleotide sequence of VGAM2253 RNA, herein designated VGAM RNA, also designated SEQ ID:4964.

Another function of VGAM2253 is therefore inhibition of AD-020 (Accession XM_002161). Accordingly, utilities of VGAM2253 include diagnosis, prevention and treatment of diseases and clinical conditions associated with AD-020. FLJ11101 (Accession NM_018322) is another VGAM2253 host target gene. FLJ11101 BINDING SITE is HOST TARGET binding site found in the 3' untranslated region of mRNA encoded by FLJ11101, corresponding to a HOST TARGET binding site such as BINDING SITE I, BINDING SITE II or BINDING SITE III. Table 2 illustrates the complementarity of the nucleotide sequences of FLJ11101 BINDING SITE, designated SEQ ID:20314, to the nucleotide sequence of VGAM2253 RNA, herein designated VGAM RNA, also designated SEQ ID:4964.

Another function of VGAM2253 is therefore inhibition of FLJ11101 (Accession NM_018322). Accordingly, utilities of VGAM2253 include diagnosis, prevention and treatment of diseases and clinical conditions associated with FLJ11101. FLJ21144 (Accession NM_022774) is another VGAM2253 host target gene. FLJ21144 BINDING SITE is HOST TARGET binding site found in the 3' untranslated region of mRNA encoded by FLJ21144, corresponding to a HOST TARGET binding site such as BINDING SITE I, BINDING SITE II or BINDING SITE III. Table 2 illustrates the complementarity of the nucleotide sequences of FLJ21144 BINDING SITE, designated SEQ ID:23038, to the nucleotide sequence of VGAM2253 RNA, herein designated VGAM RNA, also designated SEQ ID:4964.

Another function of VGAM2253 is therefore inhibition of FLJ21144 (Accession NM_022774). Accordingly, utilities of VGAM2253 include diagnosis, prevention and treatment of diseases and clinical conditions associated with FLJ21144. UDP-N-acetyl-alpha-D-galactosamine:polypeptide N-acetylgalactosaminyltransferase 6 (GalNAc-T6) (GALNT6, Accession NM_007210) is another VGAM2253 host target gene. GALNT6 BINDING SITE is HOST TARGET binding site found in the 3' untranslated region of mRNA encoded by GALNT6, corresponding to a HOST TARGET binding site such as BINDING SITE I, BINDING SITE II or BINDING SITE III. Table 2 illustrates the complementarity of the nucleotide sequences of GALNT6 BINDING SITE, designated SEQ ID:14073, to the nucleotide sequence of VGAM2253 RNA, herein designated VGAM RNA, also designated SEQ ID:4964.

Another function of VGAM2253 is therefore inhibition of UDP-N-acetyl-alpha-D-galactosamine:polypeptide N-acetylgalactosaminyltransferase 6 (GalNAc-T6) (GALNT6, Accession NM_007210). Accordingly, utilities of VGAM2253 include diagnosis, prevention and treatment of diseases and clinical conditions associated with GALNT6. KIAA1240 (Accession XM_039676) is another VGAM2253 host target gene. KIAA1240 BINDING SITE is HOST TARGET binding site found in the 3' untranslated region of mRNA encoded by KIAA1240, corresponding to a HOST TARGET binding site such as BINDING SITE I, BINDING SITE II or BINDING SITE III. Table 2 illustrates the complementarity of the nucleotide sequences of KIAA1240 BINDING SITE, designated SEQ ID:33144, to the nucleotide sequence of VGAM2253 RNA, herein designated VGAM RNA, also designated SEQ ID:4964.

Another function of VGAM2253 is therefore inhibition of KIAA1240 (Accession XM_039676). Accordingly, utilities of VGAM2253 include diagnosis, prevention and treatment of diseases and clinical conditions associated with KIAA1240. MGC22014 (Accession XM_035307) is another VGAM2253 host target gene. MGC22014 BINDING SITE is HOST TARGET binding site found in the 3' untranslated region of mRNA encoded by MGC22014, corresponding to a HOST TARGET binding site such as BINDING SITE I, BINDING SITE II or BINDING SITE III. Table 2 illustrates the complementarity of the nucleotide sequences of MGC22014 BINDING SITE, designated SEQ ID:32224, to the nucleotide sequence of VGAM2253 RNA, herein designated VGAM RNA, also designated SEQ ID:4964.

Another function of VGAM2253 is therefore inhibition of MGC22014 (Accession XM_035307). Accordingly, utilities of VGAM2253 include diagnosis, prevention and treatment of diseases and clinical conditions associated with MGC22014. LOC143173 (Accession XM_016685) is another VGAM2253 host target gene. LOC143173 BINDING SITE is HOST TARGET binding site found in the 5' untranslated region of mRNA encoded by LOC143173, corresponding to a HOST TARGET binding site such as BINDING SITE I, BINDING SITE II or BINDING SITE III. Table 2 illustrates the complementarity of the nucleotide sequences of LOC143173 BINDING SITE, designated SEQ ID:30272, to the nucleotide sequence of VGAM2253 RNA, herein designated VGAM RNA, also designated SEQ ID:4964.

Another function of VGAM2253 is therefore inhibition of LOC143173 (Accession XM_016685). Accordingly, utilities of VGAM2253 include diagnosis, prevention and treatment of diseases and clinical conditions associated with LOC143173. LOC149722 (Accession XM_097709) is another VGAM2253 host target gene. LOC149722 BINDING SITE is HOST TARGET binding site found in the 5' untranslated region of mRNA encoded by LOC149722, corresponding to a HOST TARGET binding site such as BINDING SITE I, BINDING SITE II or BINDING SITE III. Table 2 illustrates the complementarity of the nucleotide sequences of LOC149722 BINDING SITE, designated SEQ ID:41043, to the nucleotide sequence of VGAM2253 RNA, herein designated VGAM RNA, also designated SEQ ID:4964.

Another function of VGAM2253 is therefore inhibition of LOC149722 (Accession XM_097709). Accordingly, utilities of VGAM2253 include diagnosis, prevention and treatment of diseases and clinical conditions associated with LOC149722. LOC152627 (Accession XM_087495) is another VGAM2253 host target gene. LOC152627 BINDING SITE is HOST TARGET binding site found in the 5' untranslated region of mRNA encoded by LOC152627, corresponding to a HOST TARGET binding site such as BINDING SITE I, BINDING SITE II or BINDING SITE III. Table 2 illustrates the complementarity of the nucleotide sequences of LOC152627 BINDING SITE, designated SEQ ID:39295, to the nucleotide sequence of VGAM2253 RNA, herein designated VGAM RNA, also designated SEQ ID:4964.

Another function of VGAM2253 is therefore inhibition of LOC152627 (Accession XM_087495). Accordingly, utilities of VGAM2253 include diagnosis, prevention and treatment of diseases and clinical conditions associated with LOC152627. LOC257482 (Accession XM_168544) is another VGAM2253 host target gene. LOC257482 BINDING SITE is HOST TARGET binding site found in the 3' untranslated region of mRNA encoded by LOC257482, corresponding to a HOST TARGET binding site such as BINDING SITE I, BINDING SITE II or BINDING SITE III. Table 2 illustrates the complementarity of the nucleotide sequences of LOC257482 BINDING SITE, designated SEQ ID:45233, to the nucleotide sequence of VGAM2253 RNA, herein designated VGAM RNA, also designated SEQ ID:4964.

Another function of VGAM2253 is therefore inhibition of LOC257482 (Accession XM_168544). Accordingly, utilities of VGAM2253 include diagnosis, prevention and treatment of diseases and clinical conditions associated with LOC257482. LOC257485 (Accession XM_037746) is another VGAM2253 host target gene. LOC257485 BINDING SITE is HOST TARGET binding site found in the 3' untranslated region of mRNA encoded by LOC257485, corresponding to a HOST TARGET binding site such as BINDING SITE I, BINDING SITE II or BINDING SITE III. Table 2 illustrates the complementarity of the nucleotide sequences of LOC257485 BINDING SITE, designated SEQ ID:32670, to the nucleotide sequence of VGAM2253 RNA, herein designated VGAM RNA, also designated SEQ ID:4964.

Another function of VGAM2253 is therefore inhibition of LOC257485 (Accession XM_037746). Accordingly, utilities of VGAM2253 include diagnosis, prevention and treatment of diseases and clinical conditions associated with LOC257485. LOC90670 (Accession XM_033352) is another VGAM2253 host target gene. LOC90670 BINDING SITE is HOST TARGET binding site found in the 3' untranslated region of mRNA encoded by LOC90670, corresponding to a HOST TARGET binding site such as BINDING SITE I, BINDING SITE II or BINDING SITE III. Table 2 illustrates the complementarity of the nucleotide sequences of LOC90670 BINDING SITE, designated SEQ ID:31883, to the nucleotide sequence of VGAM2253 RNA, herein designated VGAM RNA, also designated SEQ ID:4964.

Another function of VGAM2253 is therefore inhibition of LOC90670 (Accession XM_033352). Accordingly, utilities of VGAM2253 include diagnosis, prevention and treatment of diseases and clinical conditions associated with LOC90670. FIG. 1 further provides a conceptual description of a novel bioinformatically detected viral gene of the present invention, referred to here as Viral Genomic Address Messenger 2254 (VGAM2254) viral gene, which modulates expression of respective host target genes thereof, the function and utility of which host target genes is known in the art.

VGAM2254 is a novel bioinformatically detected regulatory, non protein coding, viral micro RNA (miRNA) gene. The method by which VGAM2254 was detected is described hereinabove with reference to FIGS. 1-8.

VGAM2254 gene, herein designated VGAM GENE, is a viral gene contained in the genome of Transmissible Gastroenteritis Virus. VGAM2254 host target gene, herein designated VGAM HOST TARGET GENE, is a human gene contained in the human genome.

VGAM2254 gene encodes a VGAM2254 precursor RNA, herein designated VGAM PRECURSOR RNA. Similar to other miRNA genes, and unlike most ordinary genes, VGAM2254 precursor RNA does not encode a protein. A nucleotide sequence identical or highly similar to the nucleotide sequence of VGAM2254 precursor RNA is designated SEQ ID:2240, and is provided hereinbelow with reference to the sequence listing part. Nucleotide sequence SEQ ID:2240 is located at position 9818 relative to the genome of Transmissible Gastroenteritis Virus.

VGAM2254 precursor RNA folds onto itself, forming VGAM2254 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2254 folded precursor RNA into VGAM2254 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2254 RNA is designated SEQ ID:4965, and is provided hereinbelow with reference to the sequence listing part.

VGAM2254 host target gene, herein designated VGAM HOST TARGET GENE, encodes a corresponding messenger RNA, VGAM2254 host target RNA, herein designated VGAM HOST TARGET RNA. VGAM2254 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2254 RNA, herein designated VGAM RNA, binds complementarily to one or more host target binding sites located in untranslated regions of VGAM2254 host target RNA, herein designated VGAM HOST TARGET RNA. This complementary binding is due to the fact that the nucleotide sequence of VGAM2254 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2254 RNA, herein designated VGAM RNA, may have a different number of host target binding sites in untranslated regions of a VGAM2254 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2254 RNA, herein designated VGAM RNA, to host target binding sites on VGAM2254 host target RNA, herein designated VGAM HOST TARGET RNA, such as BINDING SITE I, BINDING SITE II and BINDING SITE III, inhibits translation of VGAM2254 host target RNA into VGAM2254 host target protein, herein designated VGAM HOST TARGET PROTEIN. VGAM host target protein is therefore outlined by a broken line.

It is appreciated that VGAM2254 host target gene, herein designated VGAM HOST TARGET GENE, in fact represents a plurality of VGAM2254 host target genes. The mRNA of each one of this plurality of VGAM2254 host target genes comprises one or more host target binding sites, each having a nucleotide sequence which is at least partly complementary to VGAM2254 RNA, herein designated VGAM RNA, and which when bound by VGAM2254 RNA causes inhibition of translation of respective one or more VGAM2254 host target proteins.

It is further appreciated by one skilled in the art that the mode of translational inhibition illustrated by FIG. 1 with specific reference to translational inhibition exerted by VGAM2254 gene, herein designated VGAM GENE, on one or more VGAM2254 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2254 is inhibition of expression of host target genes, as part of a novel viral mechanism of attacking a host. Accordingly, utilities of VGAM2254 include diagnosis, prevention and treatment of viral infection by Transmissible Gastroenteritis Virus. Specific functions, and accordingly utilities, of VGAM2254 correlate with, and may be deduced from, the identity of the host target genes which VGAM2254 binds and inhibits, and the function of these host target genes, as elaborated hereinbelow.

Nucleotide sequences of the VGAM2254 precursor RNA, herein designated VGAM PRECURSOR RNA, and of the 'diced' VGAM2254 RNA, herein designated VGAM RNA, and a schematic representation of the secondary folding of VGAM2254 folded precursor RNA, herein designated VGAM FOLDED PRECURSOR RNA, of VGAM2254 are further described hereinbelow with reference to Table 1.

Nucleotide sequences of host target binding sites, such as BINDING SITE-I, BINDING SITE-II and BINDING SITE-III of FIG. 1, found on VGAM2254 host target RNA, and schematic representation of the complementarity of each of these host target binding sites to VGAM2254 RNA, herein designated VGAM RNA, are described hereinbelow with reference to Table 2.

As mentioned hereinabove with reference to FIG. 1, a function of VGAM2254 gene, herein designated VGAM is inhibition of expression of VGAM2254 target genes. It is appreciated that specific functions, and accordingly utilities, of VGAM2254 correlate with, and may be deduced from, the identity of the target genes which VGAM2254 binds and inhibits, and the function of these target genes, as elaborated hereinbelow.

Acid Phosphatase, Testicular (ACPT, Accession NM_080789) is a VGAM2254 host target gene. ACPT BINDING SITE1 and ACPT BINDING SITE2 are HOST TARGET binding sites found in untranslated regions of mRNA encoded by ACPT, corresponding to HOST TARGET binding sites such as BINDING SITE I, BINDING SITE II or BINDING SITE III. Table 2 illustrates the complementarity of the nucleotide sequences of ACPT BINDING SITE1 and ACPT BINDING SITE2, designated SEQ ID:28045 and SEQ ID:28048 respectively, to the nucleotide sequence of VGAM2254 RNA, herein designated VGAM RNA, also designated SEQ ID:4965.

A function of VGAM2254 is therefore inhibition of Acid Phosphatase, Testicular (ACPT, Accession NM_080789). Accordingly, utilities of VGAM2254 include diagnosis, prevention and treatment of diseases and clinical conditions associated with ACPT. Capping Protein (actin filament) Muscle Z-line, Alpha 1 (CAPZA1, Accession XM_052116) is another VGAM2254 host target gene. CAPZA1 BINDING SITE is HOST TARGET binding site found in the 3' untranslated region of mRNA encoded by CAPZA1, corresponding to a HOST TARGET binding site such as BINDING SITE I, BINDING SITE II or BINDING SITE III. Table 2 illustrates the complementarity of the nucleotide sequences of CAPZA1 BINDING SITE, designated SEQ ID:35951, to the nucleotide sequence of VGAM2254 RNA, herein designated VGAM RNA, also designated SEQ ID:4965.

Another function of VGAM2254 is therefore inhibition of Capping Protein (actin filament) Muscle Z-line, Alpha 1 (CAPZA1, Accession XM_052116), a gene which is alpha 1 subunit of actin filament capping protein; binds actin, has roles in cell motility and actin assembly. Accordingly, utilities of VGAM2254 include diagnosis, prevention and treatment of diseases and clinical conditions associated with CAPZA1. The function of CAPZA1 and its association with various diseases and clinical conditions, has been established by previous studies, as described hereinabove with reference to VGAM547. V-erb-a Erythroblastic Leukemia Viral Oncogene Homolog 4 (avian) (ERBB4, Accession NM_005235) is another VGAM2254 host target gene. ERBB4 BINDING SITE is HOST TARGET binding site found in the 3' untranslated region of mRNA encoded by ERBB4, corresponding to a HOST TARGET binding site such as BINDING SITE I, BINDING SITE II or BINDING SITE III. Table 2 illustrates the complementarity of the nucleotide sequences of ERBB4 BINDING SITE, designated SEQ ID:11745, to the nucleotide sequence of VGAM2254 RNA, herein designated VGAM RNA, also designated SEQ ID:4965.

Another function of VGAM2254 is therefore inhibition of V-erb-a Erythroblastic Leukemia Viral Oncogene Homolog 4 (avian) (ERBB4, Accession NM_005235), a gene which may function in growth/differentiation of normal and transformed cells. Accordingly, utilities of VGAM2254 include diagnosis, prevention and treatment of diseases and clinical conditions associated with ERBB4. The function of ERBB4 and its association with various diseases and clinical conditions, has been established by previous studies, as described hereinabove with reference to VGAM381. Fibronectin Leucine Rich Transmembrane Protein 2 (FLRT2, Accession NM_013231) is another VGAM2254 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14885, to the nucleotide sequence of VGAM2254 RNA, herein designated VGAM RNA, also designated SEQ ID:4965.

Another function of VGAM2254 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM2254 include diagnosis, prevention and treatment of diseases and clinical conditions associated with FLRT2. The function of FLRT2 and its association with various diseases and clinical conditions, has been established by previous studies, as described hereinabove with reference to VGAM247. Nitric Oxide Synthase 1 (neuronal) (NOS1, Accession NM_000620) is another VGAM2254 host target gene. NOS1 BINDING SITE is HOST TARGET binding site found in the 3' untranslated region of mRNA encoded by NOS1, corresponding to a HOST TARGET binding site such as BINDING SITE I, BINDING SITE II or BINDING SITE III. Table 2 illustrates the complementarity of the nucleotide sequences of NOS1 BINDING SITE, designated SEQ ID:6235, to the nucleotide sequence of VGAM2254 RNA, herein designated VGAM RNA, also designated SEQ ID:4965.

Another function of VGAM2254 is therefore inhibition of Nitric Oxide Synthase 1 (neuronal) (NOS1, Accession NM_000620), a gene which produces nitric oxide (no) which is a messenger molecule with diverse functions throughout the body. Accordingly, utilities of VGAM2254 include diagnosis, prevention and treatment of diseases and clinical conditions associated with NOS1. The function of NOS1 and its association with various diseases and clinical conditions, has been established by previous studies, as described hereinabove with reference to VGAM323. Solute Carrier Family 4, Sodium Bicarbonate Cotransporter, Member 7 (SLC4A7, Accession NM_003615) is another VGAM2254 host target gene. SLC4A7 BINDING SITE is HOST TARGET binding site found in the 3' untranslated region of mRNA encoded by SLC4A7, corresponding to a HOST TARGET binding site such as BINDING SITE I, BINDING SITE II or BINDING SITE III. Table 2 illustrates the complementarity of the nucleotide sequences of SLC4A7 BINDING SITE, designated SEQ ID:9670, to the nucleotide sequence of VGAM2254 RNA, herein designated VGAM RNA, also designated SEQ ID:4965.

Another function of VGAM2254 is therefore inhibition of Solute Carrier Family 4, Sodium Bicarbonate Cotransporter, Member 7 (SLC4A7, Accession NM_003615), a gene which mediates the coupled movement of sodium and bicarbonate ions across the plasma membrane. Accordingly, utilities of VGAM2254 include diagnosis, prevention and treatment of diseases and clinical conditions associated with SLC4A7. The function of SLC4A7 and its association with various diseases and clinical conditions, has been established by previous studies, as described hereinabove with reference to VGAM66. Chromosome 21 Open Reading Frame 108 (C21orf108, Accession XM_114191) is another VGAM2254 host target gene. C21orf108 BINDING SITE is HOST TARGET binding site found in the 3' untranslated region of mRNA encoded by C21orf108, corresponding to a HOST TARGET binding site such as BINDING SITE I, BINDING SITE II or BINDING SITE III. Table 2 illustrates the complementarity of the nucleotide sequences of C21orf108 BINDING SITE, designated SEQ ID:42769, to the nucleotide sequence of VGAM2254 RNA, herein designated VGAM RNA, also designated SEQ ID:4965.

Another function of VGAM2254 is therefore inhibition of Chromosome 21 Open Reading Frame 108 (C21orf108, Accession XM_114191). Accordingly, utilities of VGAM2254 include diagnosis, prevention and treatment of diseases and clinical conditions associated with C21orf108. DKFZp434C0328 (Accession NM_017577) is another VGAM2254 host target gene. DKFZp434C0328 BINDING SITE is HOST TARGET binding site found in the 5' untranslated region of mRNA encoded by DKFZp434C0328, corresponding to a HOST TARGET binding site such as BINDING SITE I, BINDING SITE II or BINDING SITE III. Table 2 illustrates the complementarity of the nucleotide sequences of DKFZp434C0328 BINDING SITE, designated SEQ ID:19011, to the nucleotide sequence of VGAM2254 RNA, herein designated VGAM RNA, also designated SEQ ID:4965.

Another function of VGAM2254 is therefore inhibition of DKFZp434C0328 (Accession NM_017577). Accordingly, utilities of VGAM2254 include diagnosis, prevention and treatment of diseases and clinical conditions associated with DKFZp434C0328. FLJ10971 (Accession NM_018287) is another VGAM2254 host target gene. FLJ10971 BINDING SITE is HOST TARGET binding site found in the 3' untranslated region of mRNA encoded by FLJ10971, corresponding to a HOST TARGET binding site such as BINDING SITE I, BINDING SITE II or BINDING SITE III. Table 2 illustrates the complementarity of the nucleotide sequences of FLJ10971 BINDING SITE, designated SEQ ID:20280, to the nucleotide sequence of VGAM2254 RNA, herein designated VGAM RNA, also designated SEQ ID:4965.

Another function of VGAM2254 is therefore inhibition of FLJ10971 (Accession NM_018287). Accordingly, utilities of VGAM2254 include diagnosis, prevention and treatment of diseases and clinical conditions associated with FLJ10971. FLJ13397 (Accession NM_024948) is another VGAM2254 host target gene. FLJ13397 BINDING SITE is HOST TARGET binding site found in the 3' untranslated region of mRNA encoded by FLJ13397, corresponding to a HOST TARGET binding site such as BINDING SITE I, BINDING SITE II or BINDING SITE III. Table 2 illustrates the complementarity of the nucleotide sequences of FLJ13397 BINDING SITE, designated SEQ ID:24500, to the nucleotide sequence of VGAM2254 RNA, herein designated VGAM RNA, also designated SEQ ID:4965.

Another function of VGAM2254 is therefore inhibition of FLJ13397 (Accession NM_024948). Accordingly, utilities of VGAM2254 include diagnosis, prevention and treatment of diseases and clinical conditions associated with FLJ13397. FLJ14249 (Accession NM_106552) is another VGAM2254 host target gene. FLJ14249 BINDING SITE1 and FLJ14249 BINDING SITE2 are HOST TARGET binding sites found in untranslated regions of mRNA encoded by FLJ14249, corresponding to HOST TARGET binding sites such as BINDING SITE I, BINDING SITE II or BINDING SITE III. Table 2 illustrates the complementarity of the nucleotide sequences of FLJ14249 BINDING SITE1 and FLJ14249 BINDING SITE2, designated SEQ ID:28171 and SEQ ID:22801 respectively, to the nucleotide sequence of VGAM2254 RNA, herein designated VGAM RNA, also designated SEQ ID:4965.

Another function of VGAM2254 is therefore inhibition of FLJ14249 (Accession NM_106552). Accordingly, utilities of VGAM2254 include diagnosis, prevention and treatment of diseases and clinical conditions associated with FLJ14249. KIAA1361 (Accession XM_030845) is another VGAM2254 host target gene. KIAA1361 BINDING SITE is HOST TARGET binding site found in the 3' untranslated region of mRNA encoded by KIAA1361, corresponding to a HOST TARGET binding site such as BINDING SITE I, BINDING SITE II or BINDING SITE III. Table 2 illustrates the complementarity of the nucleotide sequences of KIAA1361 BINDING SITE, designated SEQ ID:31168, to the nucleotide sequence of VGAM2254 RNA, herein designated VGAM RNA, also designated SEQ ID:4965.

Another function of VGAM2254 is therefore inhibition of KIAA1361 (Accession XM_030845). Accordingly, utilities of VGAM2254 include diagnosis, prevention and treatment of diseases and clinical conditions associated with KIAA1361. Karyopherin Alpha 6 (importin alpha 7) (KPNA6, Accession NM_012316) is another VGAM2254 host target gene. KPNA6 BINDING SITE is HOST TARGET binding site found in the 3' untranslated region of mRNA encoded by KPNA6, corresponding to a HOST TARGET binding site such as BINDING SITE I, BINDING SITE II or BINDING SITE III. Table 2 illustrates the complementarity of the nucleotide sequences of KPNA6 BINDING SITE, designated SEQ ID:14689, to the nucleotide sequence of VGAM2254 RNA, herein designated VGAM RNA, also designated SEQ ID:4965.

Another function of VGAM2254 is therefore inhibition of Karyopherin Alpha 6 (importin alpha 7) (KPNA6, Accession NM_012316). Accordingly, utilities of VGAM2254 include diagnosis, prevention and treatment of diseases and clinical conditions associated with KPNA6. Neuromedin U Receptor 2 (NMU2R, Accession NM_020167) is another VGAM2254 host target gene. NMU2R BINDING SITE is HOST TARGET binding site found in the 3' untranslated region of mRNA encoded by NMU2R, corresponding to a HOST TARGET binding site such as BINDING SITE I, BINDING SITE II or BINDING SITE III. Table 2 illustrates the complementarity of the nucleotide sequences of NMU2R BINDING SITE, designated SEQ ID:21385, to the nucleotide sequence of VGAM2254 RNA, herein designated VGAM RNA, also designated SEQ ID:4965.

Another function of VGAM2254 is therefore inhibition of Neuromedin U Receptor 2 (NMU2R, Accession NM_020167). Accordingly, utilities of VGAM2254 include diagnosis, prevention and treatment of diseases and clinical conditions associated with NMU2R. RAB14, Member RAS Oncogene Family (RAB14, Accession NM_016322) is another VGAM2254 host target gene. RAB14 BINDING SITE is HOST TARGET binding site found in the 3' untranslated region of mRNA encoded by RAB14, corresponding to a HOST TARGET binding site such as BINDING SITE I, BINDING SITE II or BINDING SITE III. Table 2 illustrates the complementarity of the nucleotide sequences of RAB14 BINDING SITE, designated SEQ ID:18447, to the nucleotide sequence of VGAM2254 RNA, herein designated VGAM RNA, also designated SEQ ID:4965.

Another function of VGAM2254 is therefore inhibition of RAB14, Member RAS Oncogene Family (RAB14, Accession NM_016322). Accordingly, utilities of VGAM2254 include diagnosis, prevention and treatment of diseases and clinical conditions associated with RAB14. T-box 19 (TBX19, Accession NM_005149) is another VGAM2254 host target gene. TBX19 BINDING SITE is HOST TARGET binding site found in the 3' untranslated region of mRNA encoded by TBX19, corresponding to a HOST TARGET binding site such as BINDING SITE I, BINDING SITE II or BINDING SITE III. Table 2 illustrates the complementarity of the nucleotide sequences of TBX19 BINDING SITE, designated SEQ ID:11624, to the nucleotide sequence of VGAM2254 RNA, herein designated VGAM RNA, also designated SEQ ID:4965.

Another function of VGAM2254 is therefore inhibition of T-box 19 (TBX19, Accession NM_005149). Accordingly, utilities of VGAM2254 include diagnosis, prevention and treatment of diseases and clinical conditions associated with TBX19. LOC129831 (Accession XM_059376) is another VGAM2254 host target gene. LOC129831 BINDING SITE is HOST TARGET binding site found in the 3' untranslated region of mRNA encoded by LOC129831, corresponding to a HOST TARGET binding site such as BINDING SITE I, BINDING SITE II or BINDING SITE III. Table 2 illustrates the complementarity of the nucleotide sequences of LOC129831 BINDING SITE, designated SEQ ID:36981, to the nucleotide sequence of VGAM2254 RNA, herein designated VGAM RNA, also designated SEQ ID:4965.

Another function of VGAM2254 is therefore inhibition of LOC129831 (Accession XM_059376). Accordingly, utilities of VGAM2254 include diagnosis, prevention and treatment of diseases and clinical conditions associated with LOC129831. LOC146545 (Accession XM_085501) is another VGAM2254 host target gene. LOC146545 BINDING SITE is HOST TARGET binding site found in the 5' untranslated region of mRNA encoded by LOC146545, corresponding to a HOST TARGET binding site such as BINDING SITE I, BINDING SITE II or BINDING SITE III. Table 2 illustrates the complementarity of the nucleotide sequences of LOC146545 BINDING SITE, designated SEQ ID:38201, to the nucleotide sequence of VGAM2254 RNA, herein designated VGAM RNA, also designated SEQ ID:4965.

Another function of VGAM2254 is therefore inhibition of LOC146545 (Accession XM_085501). Accordingly, utilities of VGAM2254 include diagnosis, prevention and treatment of diseases and clinical conditions associated with LOC146545. LOC149111 (Accession XM_086429) is another VGAM2254 host target gene. LOC149111 BINDING SITE is HOST TARGET binding site found in the 3' untranslated region of mRNA encoded by LOC149111, corresponding to a HOST TARGET binding site such as BINDING SITE I, BINDING SITE II or BINDING SITE III. Table 2 illustrates the complementarity of the nucleotide sequences of LOC149111 BINDING SITE, designated SEQ ID:38648, to the nucleotide sequence of VGAM2254 RNA, herein designated VGAM RNA, also designated SEQ ID:4965.

Another function of VGAM2254 is therefore inhibition of LOC149111 (Accession XM_086429). Accordingly, utilities of VGAM2254 include diagnosis, prevention and treatment of diseases and clinical conditions associated with LOC149111. LOC152897 (Accession XM_087555) is another VGAM2254 host target gene. LOC152897 BINDING SITE is HOST TARGET binding site found in the 5' untranslated region of mRNA encoded by LOC152897, corresponding to a HOST TARGET binding site such as BINDING SITE I, BINDING SITE II or BINDING SITE III. Table 2 illustrates the complementarity of the nucleotide sequences of LOC152897 BINDING SITE, designated SEQ ID:39327, to the nucleotide sequence of VGAM2254 RNA, herein designated VGAM RNA, also designated SEQ ID:4965.

Another function of VGAM2254 is therefore inhibition of LOC152897 (Accession XM_087555). Accordingly, utilities of VGAM2254 include diagnosis, prevention and treatment of diseases and clinical conditions associated with LOC152897. LOC199676 (Accession XM_117107) is another VGAM2254 host target gene. LOC199676 BINDING SITE is HOST TARGET binding site found in the 5' untranslated region of mRNA encoded by LOC199676, corresponding to a HOST TARGET binding site such as BINDING SITE I, BINDING SITE II or BINDING SITE III. Table 2 illustrates the complementarity of the nucleotide sequences of LOC199676 BINDING SITE, designated SEQ ID:43225, to the nucleotide sequence of VGAM2254 RNA, herein designated VGAM RNA, also designated SEQ ID:4965.

Another function of VGAM2254 is therefore inhibition of LOC199676 (Accession XM_117107). Accordingly, utilities of VGAM2254 include diagnosis, prevention and treatment of diseases and clinical conditions associated with LOC199676. LOC221814 (Accession XM_168226) is another VGAM2254 host target gene. LOC221814 BINDING SITE is HOST TARGET binding site found in the 3' untranslated region of mRNA encoded by LOC221814, corresponding to a HOST TARGET binding site such as BINDING SITE I, BINDING SITE II or BINDING SITE III. Table 2 illustrates the complementarity of the nucleotide sequences of LOC221814 BINDING SITE, designated SEQ ID:45093, to the nucleotide sequence of VGAM2254 RNA, herein designated VGAM RNA, also designated SEQ ID:4965.

Another function of VGAM2254 is therefore inhibition of LOC221814 (Accession XM_168226). Accordingly, utilities of VGAM2254 include diagnosis, prevention and treatment of diseases and clinical conditions associated with LOC221814. LOC253868 (Accession XM_170975) is another VGAM2254 host target gene. LOC253868 BINDING SITE is HOST TARGET binding site found in the 3' untranslated region of mRNA encoded by LOC253868, corresponding to a HOST TARGET binding site such as BINDING SITE I, BINDING SITE II or BINDING SITE III. Table 2 illustrates the complementarity of the nucleotide sequences of LOC253868 BINDING SITE, designated SEQ ID:45750, to the nucleotide sequence of VGAM2254 RNA, herein designated VGAM RNA, also designated SEQ ID:4965.

Another function of VGAM2254 is therefore inhibition of LOC253868 (Accession XM_170975). Accordingly, utilities of VGAM2254 include diagnosis, prevention and treatment of diseases and clinical conditions associated with LOC253868. LOC255515 (Accession XM_171185) is another VGAM2254 host target gene. LOC255515 BINDING SITE is HOST TARGET binding site found in the 3' untranslated region of mRNA encoded by LOC255515, corresponding to a HOST TARGET binding site such as BINDING SITE I, BINDING SITE II or BINDING SITE III. Table 2 illustrates the complementarity of the nucleotide sequences of LOC255515 BINDING SITE, designated SEQ ID:45961, to the nucleotide sequence of VGAM2254 RNA, herein designated VGAM RNA, also designated SEQ ID:4965.

Another function of VGAM2254 is therefore inhibition of LOC255515 (Accession XM_171185). Accordingly, utilities of VGAM2254 include diagnosis, prevention and treatment of diseases and clinical conditions associated with LOC255515. LOC56181 (Accession XM_170954) is another VGAM2254 host target gene. LOC56181 BINDING SITE is HOST TARGET binding site found in the 3' untranslated region of mRNA encoded by LOC56181, corresponding to a HOST TARGET binding site such as BINDING SITE I, BINDING SITE II or BINDING SITE III. Table 2 illustrates the complementarity of the nucleotide sequences of LOC56181 BINDING SITE, designated SEQ ID:45740, to the nucleotide sequence of VGAM2254 RNA, herein designated VGAM RNA, also designated SEQ ID:4965.

Another function of VGAM2254 is therefore inhibition of LOC56181 (Accession XM_170954). Accordingly, utilities of VGAM2254 include diagnosis, prevention and treatment of diseases and clinical conditions associated with LOC56181. FIG. 1 further provides a conceptual description of a novel bioinformatically detected viral gene of the present invention, referred to here as Viral Genomic Address Messenger 2255 (VGAM2255) viral gene, which modulates expression of respective host target genes thereof, the function and utility of which host target genes is known in the art.

VGAM2255 is a novel bioinformatically detected regulatory, non protein coding, viral micro RNA (miRNA) gene. The method by which VGAM2255 was detected is described hereinabove with reference to FIGS. 1-8.

VGAM2255 gene, herein designated VGAM GENE, is a viral gene contained in the genome of Transmissible Gastroenteritis Virus. VGAM2255 host target gene, herein designated VGAM HOST TARGET GENE, is a human gene contained in the human genome.

VGAM2255 gene encodes a VGAM2255 precursor RNA, herein designated VGAM PRECURSOR RNA. Similar to other miRNA genes, and unlike most ordinary genes, VGAM2255 precursor RNA does not encode a protein. A nucleotide sequence identical or highly similar to the nucleotide sequence of VGAM2255 precursor RNA is designated SEQ ID:2241, and is provided hereinbelow with reference to the sequence listing part. Nucleotide sequence SEQ ID:2241 is located at position 11215 relative to the genome of Transmissible Gastroenteritis Virus.

VGAM2255 precursor RNA folds onto itself, forming VGAM2255 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2255 folded precursor RNA into VGAM2255 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM2255 RNA is designated SEQ ID:4966, and is provided hereinbelow with reference to the sequence listing part.

VGAM2255 host target gene, herein designated VGAM HOST TARGET GENE, encodes a corresponding messenger RNA, VGAM2255 host target RNA, herein designated VGAM HOST TARGET RNA. VGAM2255 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2255 RNA, herein designated VGAM RNA, binds complementarily to one or more host target binding sites located in untranslated regions of VGAM2255 host target RNA, herein designated VGAM HOST TARGET RNA. This complementary binding is due to the fact that the nucleotide sequence of VGAM2255 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2255 RNA, herein designated VGAM RNA, may have a different number of host target binding sites in untranslated regions of a VGAM2255 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2255 RNA, herein designated VGAM RNA, to host target binding sites on VGAM2255 host target RNA, herein designated VGAM HOST TARGET RNA, such as BINDING SITE I, BINDING SITE II and BINDING SITE III, inhibits translation of VGAM2255 host target RNA into VGAM2255 host target protein, herein designated VGAM HOST TARGET PROTEIN. VGAM host target protein is therefore outlined by a broken line.

It is appreciated that VGAM2255 host target gene, herein designated VGAM HOST TARGET GENE, in fact represents a plurality of VGAM2255 host target genes. The mRNA of each one of this plurality of VGAM2255 host target genes comprises one or more host target binding sites, each having a nucleotide sequence which is at least partly complementary to VGAM2255 RNA, herein designated VGAM RNA, and which when bound by VGAM2255 RNA causes inhibition of translation of respective one or more VGAM2255 host target proteins.

It is further appreciated by one skilled in the art that the mode of translational inhibition illustrated by FIG. 1 with specific reference to translational inhibition exerted by VGAM2255 gene, herein designated VGAM GENE, on one or more VGAM2255 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2255 is inhibition of expression of host target genes, as part of a novel viral mechanism of attacking a host. Accordingly, utilities of VGAM2255 include diagnosis, prevention and treatment of viral infection by Transmissible Gastroenteritis Virus. Specific functions, and accordingly utilities, of VGAM2255 correlate with, and may be deduced from, the identity of the host target genes which VGAM2255 binds and inhibits, and the function of these host target genes, as elaborated hereinbelow.

Nucleotide sequences of the VGAM2255 precursor RNA, herein designated VGAM PRECURSOR RNA, and of the 'diced' VGAM2255 RNA, herein designated VGAM RNA, and a schematic representation of the secondary folding of VGAM2255 folded precursor RNA, herein designated VGAM FOLDED PRECURSOR RNA, of VGAM2255 are further described hereinbelow with reference to Table 1.

Nucleotide sequences of host target binding sites, such as BINDING SITE-I, BINDING SITE-II and BINDING SITE-III of FIG. 1, found on VGAM2255 host target RNA, and schematic representation of the complementarity of each of these host target binding sites to VGAM2255 RNA, herein designated VGAM RNA, are described hereinbelow with reference to Table 2.

As mentioned hereinabove with reference to FIG. 1, a function of VGAM2255 gene, herein designated VGAM is inhibition of expression of VGAM2255 target genes. It is appreciated that specific functions, and accordingly utilities, of VGAM2255 correlate with, and may be deduced from, the identity of the target genes which VGAM2255 binds and inhibits, and the function of these target genes, as elaborated hereinbelow.

Neurotrophic Tyrosine Kinase, Receptor, Type 2 (NTRK2, Accession NM_006180) is a VGAM2255 host target gene. NTRK2 BINDING SITE is HOST TARGET binding site found in the 3' untranslated region of mRNA encoded by NTRK2, corresponding to a HOST TARGET binding site such as BINDING SITE I, BINDING SITE II or BINDING SITE III. Table 2 illustrates the complementarity of the nucleotide sequences of NTRK2 BINDING SITE, designated SEQ ID:12849, to the nucleotide sequence of VGAM2255 RNA, herein designated VGAM RNA, also designated SEQ ID:4966.

A function of VGAM2255 is therefore inhibition of Neurotrophic Tyrosine Kinase, Receptor, Type 2 (NTRK2, Accession NM_006180), a gene which is involved in the development and/or maintenance of the nervous system. Accordingly, utilities of VGAM2255 include diagnosis, prevention and treatment of diseases and clinical conditions associated with NTRK2. The function of NTRK2 and its association with various diseases and clinical conditions, has been established by previous studies, as described hereinabove with reference to VGAM341. Tumor Necrosis Factor (ligand) Superfamily, Member 4 (tax-transcriptionally activated glycoprotein 1, 34 kDa) (TNFSF4, Accession NM_003326) is another VGAM2255 host target gene. TNFSF4 BINDING SITE is HOST TARGET binding site found in the 3' untranslated region of mRNA encoded by TNFSF4, corresponding to a HOST TARGET binding site such as BINDING SITE I, BINDING SITE II or BINDING SITE III. Table 2 illustrates the complementarity of the nucleotide sequences of TNFSF4 BINDING SITE, designated SEQ ID:9329, to the nucleotide sequence of VGAM2255 RNA, herein designated VGAM RNA, also designated SEQ ID:4966.

Another function of VGAM2255 is therefore inhibition of Tumor Necrosis Factor (ligand) Superfamily, Member 4 (tax-transcriptionally activated glycoprotein 1, 34 kDa) (TNFSF4, Accession NM_003326), a gene which co-stimulates t cell proliferation and cytokine production. Accordingly, utilities of VGAM2255 include diagnosis, prevention and treatment of diseases and clinical conditions associated with TNFSF4. The function of TNFSF4 and its association with various diseases and clinical conditions, has been established by previous studies, as described hereinabove with reference to VGAM463. FLJ10352 (Accession NM_032142) is another VGAM2255 host target gene. FLJ10352 BINDING SITE is HOST TARGET binding site found in the 3' untranslated region of mRNA encoded by FLJ10352, corresponding to a HOST TARGET binding site such as BINDING SITE I, BINDING SITE II or BINDING SITE III. Table 2 illustrates the complementarity of the nucleotide sequences of FLJ10352 BINDING SITE, designated SEQ ID:25829, to the nucleotide sequence of VGAM2255 RNA, herein designated VGAM RNA, also designated SEQ ID:4966.

Another function of VGAM2255 is therefore inhibition of FLJ10352 (Accession NM_032142). Accordingly, utilities of VGAM2255 include diagnosis, prevention and treatment of diseases and clinical conditions associated with FLJ10352. JIK (Accession NM_016281) is another VGAM2255 host target gene. JIK BINDING SITE is HOST TARGET binding site found in the 3' untranslated region of mRNA encoded by JIK, corresponding to a HOST TARGET binding site such as BINDING SITE I, BINDING SITE II or BINDING SITE III. Table 2 illustrates the complementarity of the nucleotide sequences of JIK BINDING SITE, designated SEQ ID:18407, to the nucleotide sequence of VGAM2255 RNA, herein designated VGAM RNA, also designated SEQ ID:4966.

Another function of VGAM2255 is therefore inhibition of JIK (Accession NM_016281). Accordingly, utilities of VGAM2255 include diagnosis, prevention and treatment of diseases and clinical conditions associated with JIK. LOC115574 (Accession XM_056240) is another VGAM2255 host target gene. LOC115574 BINDING SITE is HOST TARGET binding site found in the 3' untranslated region of mRNA encoded by LOC115574, corresponding to a HOST TARGET binding site such as BINDING SITE I, BINDING SITE II or BINDING SITE III. Table 2 illustrates the complementarity of the nucleotide sequences of LOC115574 BINDING SITE, designated SEQ ID:36366, to the nucleotide sequence of VGAM2255 RNA, herein designated VGAM RNA, also designated SEQ ID:4966.

Another function of VGAM2255 is therefore inhibition of LOC115574 (Accession XM_056240). Accordingly, utilities of VGAM2255 include diagnosis, prevention and treatment of diseases and clinical conditions associated with LOC115574. LOC149711 (Accession XM_097720) is another VGAM2255 host target gene. LOC149711 BINDING SITE is HOST TARGET binding site found in the 3' untranslated region of mRNA encoded by LOC149711, corresponding to a HOST TARGET binding site such as BINDING SITE I, BINDING SITE II or BINDING SITE III. Table 2 illustrates the complementarity of the nucleotide sequences of LOC149711 BINDING SITE, designated SEQ ID:41072, to the nucleotide sequence of VGAM2255 RNA, herein designated VGAM RNA, also designated SEQ ID:4966.

Another function of VGAM2255 is therefore inhibition of LOC149711 (Accession XM_097720). Accordingly, utilities of VGAM2255 include diagnosis, prevention and treatment of diseases and clinical conditions associated with LOC149711. LOC149837 (Accession XM_097747) is another VGAM2255 host target gene. LOC149837 BINDING SITE is HOST TARGET binding site found in the 3' untranslated region of mRNA encoded by LOC149837, corresponding to a HOST TARGET binding site such as BINDING SITE I, BINDING SITE II or BINDING SITE III. Table 2 illustrates the complementarity of the nucleotide sequences of LOC149837 BINDING SITE, designated SEQ ID:41100, to the nucleotide sequence of VGAM2255 RNA, herein designated VGAM RNA, also designated SEQ ID:4966.

Another function of VGAM2255 is therefore inhibition of LOC149837 (Accession XM_097747). Accordingly, utilities of VGAM2255 include diagnosis, prevention and treatment of diseases and clinical conditions associated with LOC149837. LOC220766 (Accession XM_165471) is another VGAM2255 host target gene. LOC220766 BINDING SITE is HOST TARGET binding site found in the 5' untranslated region of mRNA encoded by LOC220766, corresponding to a HOST TARGET binding site such as BINDING SITE I, BINDING SITE II or BINDING SITE III. Table 2 illustrates the complementarity of the nucleotide sequences of LOC220766 BINDING SITE, designated SEQ ID:43650, to the nucleotide sequence of VGAM2255 RNA, herein designated VGAM RNA, also designated SEQ ID:4966.

Another function of VGAM2255 is therefore inhibition of LOC220766 (Accession XM_165471). Accordingly, utilities of VGAM2255 include diagnosis, prevention and treatment of diseases and clinical conditions associated with LOC220766. LOC221272 (Accession XM_168050) is another VGAM2255 host target gene. LOC221272 BINDING SITE is HOST TARGET binding site found in the 5' untranslated region of mRNA encoded by LOC221272, corresponding to a HOST TARGET binding site such as BINDING SITE I, BINDING SITE II or BINDING SITE III. Table 2 illustrates the complementarity of the nucleotide sequences of LOC221272 BINDING SITE, designated SEQ ID:44965, to the nucleotide sequence of VGAM2255 RNA, herein designated VGAM RNA, also designated SEQ ID:4966.

Another function of VGAM2255 is therefore inhibition of LOC221272 (Accession XM_168050). Accordingly, utilities of VGAM2255 include diagnosis, prevention and treatment of diseases and clinical conditions associated with LOC221272. FIG. 1 further provides a conceptual description of a novel bioinformatically detected viral gene of the present invention, referred to here as Viral Genomic Address Messenger 2256 (VGAM2256) viral gene, which modulates expression of respective host target genes thereof, the function and utility of which host target genes is known in the art.

VGAM2256 is a novel bioinformatically detected regulatory, non protein coding, viral micro RNA (miRNA) gene. The method by which VGAM2256 was detected is described hereinabove with reference to FIGS. 1-8.

VGAM2256 gene, herein designated VGAM GENE, is a viral gene contained in the genome of Oat Chlorotic Stunt Virus. VGAM2256 host target gene, herein designated VGAM HOST TARGET GENE, is a human gene contained in the human genome.

VGAM2256 gene encodes a VGAM2256 precursor RNA, herein designated VGAM PRECURSOR RNA. Similar to other miRNA genes, and unlike most ordinary genes, VGAM2256 precursor RNA does not encode a protein. A nucleotide sequence identical or highly similar to the nucleotide sequence of VGAM2256 precursor RNA is designated SEQ ID:2242, and is provided hereinbelow with reference to the sequence listing part. Nucleotide sequence SEQ ID:2242 is located at position 1813 relative to the genome of Oat Chlorotic Stunt Virus.

VGAM2256 precursor RNA folds onto itself, forming VGAM2256 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2256 folded precursor RNA into VGAM2256 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 44%) nucleotide sequence of VGAM2256 RNA is designated SEQ ID:4967, and is provided hereinbelow with reference to the sequence listing part.

VGAM2256 host target gene, herein designated VGAM HOST TARGET GENE, encodes a corresponding messenger RNA, VGAM2256 host target RNA, herein designated VGAM HOST TARGET RNA. VGAM2256 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2256 RNA, herein designated VGAM RNA, binds complementarily to one or more host target binding sites located in untranslated regions of VGAM2256 host target RNA, herein designated VGAM HOST TARGET RNA. This complementary binding is due to the fact that the nucleotide sequence of VGAM2256 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2256 RNA, herein designated VGAM RNA, may have a different number of host target binding sites in untranslated regions of a VGAM2256 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2256 RNA, herein designated VGAM RNA, to host target binding sites on VGAM2256 host target RNA, herein designated VGAM HOST TARGET RNA, such as BINDING SITE I, BINDING SITE II and BINDING SITE III, inhibits translation of VGAM2256 host target RNA into VGAM2256 host target protein, herein designated VGAM HOST TARGET PROTEIN. VGAM host target protein is therefore outlined by a broken line.

It is appreciated that VGAM2256 host target gene, herein designated VGAM HOST TARGET GENE, in fact represents a plurality of VGAM2256 host target genes. The mRNA of each one of this plurality of VGAM2256 host target genes comprises one or more host target binding sites, each having a nucleotide sequence which is at least partly complementary to VGAM2256 RNA, herein designated VGAM RNA, and which when bound by VGAM2256 RNA causes inhibition of translation of respective one or more VGAM2256 host target proteins.

It is further appreciated by one skilled in the art that the mode of translational inhibition illustrated by FIG. 1 with specific reference to translational inhibition exerted by VGAM2256 gene, herein designated VGAM GENE, on one or more VGAM2256 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2256 is inhibition of expression of host target genes, as part of a novel viral mechanism of attacking a host. Accordingly, utilities of VGAM2256 include diagnosis, prevention and treatment of viral infection by Oat Chlorotic Stunt Virus. Specific functions, and accordingly utilities, of VGAM2256 correlate with, and may be deduced from, the identity of the host target genes which VGAM2256 binds and inhibits, and the function of these host target genes, as elaborated hereinbelow.

Nucleotide sequences of the VGAM2256 precursor RNA, herein designated VGAM PRECURSOR RNA, and of the 'diced' VGAM2256 RNA, herein designated VGAM RNA, and a schematic representation of the secondary folding of VGAM2256 folded precursor RNA, herein designated VGAM FOLDED PRECURSOR RNA, of VGAM2256 are further described hereinbelow with reference to Table 1.

Nucleotide sequences of host target binding sites, such as BINDING SITE-I, BINDING SITE-II and BINDING SITE-III of FIG. 1, found on VGAM2256 host target RNA, and schematic representation of the complementarity of each of these host target binding sites to VGAM2256 RNA, herein designated VGAM RNA, are described hereinbelow with reference to Table 2.

As mentioned hereinabove with reference to FIG. 1, a function of VGAM2256 gene, herein designated VGAM is inhibition of expression of VGAM2256 target genes. It is appreciated that specific functions, and accordingly utilities, of VGAM2256 correlate with, and may be deduced from, the identity of the target genes which VGAM2256 binds and inhibits, and the function of these target genes, as elaborated hereinbelow.

FAT Tumor Suppressor Homolog 2 (Drosophila) (FAT2, Accession NM_001447) is a VGAM2256 host target gene. FAT2 BINDING SITE is HOST TARGET binding site found in the 3' untranslated region of mRNA encoded by FAT2, corresponding to a HOST TARGET binding site such as BINDING SITE I, BINDING SITE II or BINDING SITE III. Table 2 illustrates the complementarity of the nucleotide sequences of FAT2 BINDING SITE, designated SEQ ID:7172, to the nucleotide sequence of VGAM2256 RNA, herein designated VGAM RNA, also designated SEQ ID:4967.

A function of VGAM2256 is therefore inhibition of FAT Tumor Suppressor Homolog 2 (Drosophila) (FAT2, Accession NM_001447), a gene which could function as a cell-adhesion protein. Accordingly, utilities of VGAM2256 include diagnosis, prevention and treatment of diseases and clinical conditions associated with FAT2. The function of FAT2 and its association with various diseases and clinical conditions, has been established by previous studies, as described hereinabove with reference to VGAM949. KIAA0930 (Accession XM_047214) is another VGAM2256 host target gene. KIAA0930 BINDING SITE is HOST TARGET binding site found in the 3' untranslated region of mRNA encoded by KIAA0930, corresponding to a HOST TARGET binding site such as BINDING SITE I, BINDING SITE II or BINDING SITE III. Table 2 illustrates the complementarity of the nucleotide sequences of KIAA0930 BINDING SITE, designated SEQ ID:34913, to the nucleotide sequence of VGAM2256 RNA, herein designated VGAM RNA, also designated SEQ ID:4967.

Another function of VGAM2256 is therefore inhibition of KIAA0930 (Accession XM_047214). Accordingly, utilities of VGAM2256 include diagnosis, prevention and treatment of diseases and clinical conditions associated with KIAA0930. Peptidyl Arginine Deiminase, Type I (PADI1, Accession XM_030498) is another VGAM2256 host target gene. PADI1 BINDING SITE is HOST TARGET binding site found in the 3' untranslated region of mRNA encoded by PADI1, corresponding to a HOST TARGET binding site such as BINDING SITE I, BINDING SITE II or BINDING SITE III. Table 2 illustrates the complementarity of the nucleotide sequences of PADI1 BINDING SITE, designated SEQ ID:31054, to the nucleotide sequence of VGAM2256 RNA, herein designated VGAM RNA, also designated SEQ ID:4967.

Another function of VGAM2256 is therefore inhibition of Peptidyl Arginine Deiminase, Type I (PADI1, Accession XM_030498). Accordingly, utilities of VGAM2256 include diagnosis, prevention and treatment of diseases and clinical conditions associated with PADI1. LOC144600 (Accession XM_096639) is another VGAM2256 host target gene. LOC144600 BINDING SITE is HOST TARGET binding site found in the 5' untranslated region of mRNA encoded by LOC144600, corresponding to a HOST TARGET binding site such as BINDING SITE I, BINDING SITE II or BINDING SITE III. Table 2 illustrates the complementarity of the nucleotide sequences of LOC144600 BINDING SITE, designated SEQ ID:40446, to the nucleotide sequence of VGAM2256 RNA, herein designated VGAM RNA, also designated SEQ ID:4967.

Another function of VGAM2256 is therefore inhibition of LOC144600 (Accession XM_096639). Accordingly, utilities of VGAM2256 include diagnosis, prevention and treatment of diseases and clinical conditions associated with LOC144600. FIG. 1 further provides a conceptual description of a novel bioinformatically detected viral gene of the present invention, referred to here as Viral Genomic Address Messenger 2257 (VGAM2257) viral gene, which modulates expression of respective host target genes thereof, the function and utility of which host target genes is known in the art.

VGAM2257 is a novel bioinformatically detected regulatory, non protein coding, viral micro RNA (miRNA) gene. The method by which VGAM2257 was detected is described hereinabove with reference to FIGS. 1-8.

VGAM2257 gene, herein designated VGAM GENE, is a viral gene contained in the genome of Oat Chlorotic Stunt Virus. VGAM2257 host target gene, herein designated VGAM HOST TARGET GENE, is a human gene contained in the human genome.

VGAM2257 gene encodes a VGAM2257 precursor RNA, herein designated VGAM PRECURSOR RNA. Similar to other miRNA genes, and unlike most ordinary genes, VGAM2257 precursor RNA does not encode a protein. A nucleotide sequence identical or highly similar to the nucleotide sequence of VGAM2257 precursor RNA is designated SEQ ID:2243, and is provided hereinbelow with reference to the sequence listing part. Nucleotide sequence SEQ ID:2243 is located at position 987 relative to the genome of Oat Chlorotic Stunt Virus.

VGAM2257 precursor RNA folds onto itself, forming VGAM2257 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2257 folded precursor RNA into VGAM2257 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM2257 RNA is designated SEQ ID:4968, and is provided hereinbelow with reference to the sequence listing part.

VGAM2257 host target gene, herein designated VGAM HOST TARGET GENE, encodes a corresponding messenger RNA, VGAM2257 host target RNA, herein designated VGAM HOST TARGET RNA. VGAM2257 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2257 RNA, herein designated VGAM RNA, binds complementarily to one or more host target binding sites located in untranslated regions of VGAM2257 host target RNA, herein designated VGAM HOST TARGET RNA. This complementary binding is due to the fact that the nucleotide sequence of VGAM2257 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2257 RNA, herein designated VGAM RNA, may have a different number of host target binding sites in untranslated regions of a VGAM2257 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2257 RNA, herein designated VGAM RNA, to host target binding sites on VGAM2257 host target RNA, herein designated VGAM HOST TARGET RNA, such as BINDING SITE I, BINDING SITE II and BINDING SITE III, inhibits translation of VGAM2257 host target RNA into VGAM2257 host target protein, herein designated VGAM HOST TARGET PROTEIN. VGAM host target protein is therefore outlined by a broken line.

It is appreciated that VGAM2257 host target gene, herein designated VGAM HOST TARGET GENE, in fact represents a plurality of VGAM2257 host target genes. The mRNA of each one of this plurality of VGAM2257 host target genes comprises one or more host target binding sites, each having a nucleotide sequence which is at least partly complementary to VGAM2257 RNA, herein designated VGAM RNA, and which when bound by VGAM2257 RNA causes inhibition of translation of respective one or more VGAM2257 host target proteins.

It is further appreciated by one skilled in the art that the mode of translational inhibition illustrated by FIG. 1 with specific reference to translational inhibition exerted by VGAM2257 gene, herein designated VGAM GENE, on one or more VGAM2257 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2257 is inhibition of expression of host target genes, as part of a novel viral mechanism of attacking a host. Accordingly, utilities of VGAM2257 include diagnosis, prevention and treatment of viral infection by Oat Chlorotic Stunt Virus. Specific functions, and accordingly utilities, of VGAM2257 correlate with, and may be deduced from, the identity of the host target genes which VGAM2257 binds and inhibits, and the function of these host target genes, as elaborated hereinbelow.

Nucleotide sequences of the VGAM2257 precursor RNA, herein designated VGAM PRECURSOR RNA, and of the 'diced' VGAM2257 RNA, herein designated VGAM RNA, and a schematic representation of the secondary folding of VGAM2257 folded precursor RNA, herein designated VGAM FOLDED PRECURSOR RNA, of VGAM2257 are further described hereinbelow with reference to Table 1.

Nucleotide sequences of host target binding sites, such as BINDING SITE-I, BINDING SITE-II and BINDING SITE-III of FIG. 1, found on VGAM2257 host target RNA, and schematic representation of the complementarity of each of these host target binding sites to VGAM2257 RNA, herein designated VGAM RNA, are described hereinbelow with reference to Table 2.

As mentioned hereinabove with reference to FIG. 1, a function of VGAM2257 gene, herein designated VGAM is inhibition of expression of VGAM2257 target genes. It is appreciated that specific functions, and accordingly utilities, of VGAM2257 correlate with, and may be deduced from, the identity of the target genes which VGAM2257 binds and inhibits, and the function of these target genes, as elaborated hereinbelow.

Cholinergic Receptor, Muscarinic 1 (CHRM1, Accession XM_170669) is a VGAM2257 host target gene. CHRM1 BINDING SITE is HOST TARGET binding site found in the 5' untranslated region of mRNA encoded by CHRM1, corresponding to a HOST TARGET binding site such as BINDING SITE I, BINDING SITE II or BINDING SITE III. Table 2 illustrates the complementarity of the nucleotide sequences of CHRM1 BINDING SITE, designated SEQ ID:45441, to the nucleotide sequence of VGAM2257 RNA, herein designated VGAM RNA, also designated SEQ ID:4968.

A function of VGAM2257 is therefore inhibition of Cholinergic Receptor, Muscarinic 1 (CHRM1, Accession XM_170669), a gene which mediates various cellular responses. Accordingly, utilities of VGAM2257 include diagnosis, prevention and treatment of diseases and clinical conditions associated with CHRM1. The function of CHRM1 and its association with various diseases and clinical conditions, has been established by previous studies, as described hereinabove with reference to VGAM302. Ficolin (collagen/fibrinogen domain containing lectin) 2 (hucolin) (FCN2, Accession NM_015839) is another VGAM2257 host target gene. FCN2 BINDING SITE is HOST TARGET binding site found in the 3' untranslated region of mRNA encoded by FCN2, corresponding to a HOST TARGET binding site such as BINDING SITE I, BINDING SITE II or BINDING SITE III. Table 2 illustrates the complementarity of the nucleotide sequences of FCN2 BINDING SITE, designated SEQ ID:17954, to the nucleotide sequence of VGAM2257 RNA, herein designated VGAM RNA, also designated SEQ ID:4968.

Another function of VGAM2257 is therefore inhibition of Ficolin (collagen/fibrinogen domain containing lectin) 2 (hucolin) (FCN2, Accession NM_015839), a gene which is involved in phagocytosis of pathogens. Accordingly, utilities of VGAM2257 include diagnosis, prevention and treatment of diseases and clinical conditions associated with FCN2. The function of FCN2 and its association with various diseases and clinical conditions, has been established by previous studies, as described hereinabove with reference to VGAM493. Mitogen-activated Protein Kinase Kinase Kinase 8 (MAP3K8, Accession NM_005204) is another VGAM2257 host target gene. MAP3K8 BINDING SITE is HOST TARGET binding site found in the 5' untranslated region of mRNA encoded by MAP3K8, corresponding to a HOST TARGET binding site such as BINDING SITE I, BINDING SITE II or BINDING SITE III. Table 2 illustrates the complementarity of the nucleotide sequences of MAP3K8 BINDING SITE, designated SEQ ID:11706, to the nucleotide sequence of VGAM2257 RNA, herein designated VGAM RNA, also designated SEQ ID:4968.

Another function of VGAM2257 is therefore inhibition of Mitogen-activated Protein Kinase Kinase Kinase 8 (MAP3K8, Accession NM_005204), a gene which is able to activate nf-kappa-b 1 by stimulating proteasome-mediated p. Accordingly, utilities of VGAM2257 include diagnosis, prevention and treatment of diseases and clinical conditions associated with MAP3K8. The function of MAP3K8 and its association with various diseases and clinical conditions, has been established by previous studies, as described hereinabove with reference to VGAM32. Protocadherin 9 (PCDH9, Accession XM_096054) is another VGAM2257 host target gene. PCDH9 BINDING SITE is HOST TARGET binding site found in the 5' untranslated region of mRNA encoded by PCDH9, corresponding to a HOST TARGET binding site such as BINDING SITE I, BINDING SITE II or BINDING SITE III. Table 2 illustrates the complementarity of the nucleotide sequences of PCDH9 BINDING SITE, designated SEQ ID:40296, to the nucleotide sequence of VGAM2257 RNA, herein designated VGAM RNA, also designated SEQ ID:4968.

Another function of VGAM2257 is therefore inhibition of Protocadherin 9 (PCDH9, Accession XM_096054). Accordingly, utilities of VGAM2257 include diagnosis, prevention and treatment of diseases and clinical conditions associated with PCDH9. Serine/threonine Kinase 10 (STK10, Accession NM_005990) is another VGAM2257 host target gene. STK10 BINDING SITE is HOST TARGET binding site found in the 3' untranslated region of mRNA encoded by STK10, corresponding to a HOST TARGET binding site such as BINDING SITE I, BINDING SITE II or BINDING SITE III. Table 2 illustrates the complementarity of the nucleotide sequences of STK10 BINDING SITE, designated SEQ ID:12614, to the nucleotide sequence of VGAM2257 RNA, herein designated VGAM RNA, also designated SEQ ID:4968.

Another function of VGAM2257 is therefore inhibition of Serine/threonine Kinase 10 (STK10, Accession NM_005990), a gene which can act on substrates such as myelin basic protein and histone iia on serine and threonine residues. Accordingly, utilities of VGAM2257 include diagnosis, prevention and treatment of diseases and clinical conditions associated with STK10. The function of STK10 and its association with various diseases and clinical conditions, has been established by previous studies, as described hereinabove with reference to VGAM1958. TEA Domain Family Member 3 (TEAD3, Accession NM_003214) is another VGAM2257 host target gene. TEAD3 BINDING SITE is HOST TARGET binding site found in the 5' untranslated region of mRNA encoded by TEAD3, corresponding to a HOST TARGET binding site such as BINDING SITE I, BINDING SITE II or BINDING SITE III. Table 2 illustrates the complementarity of the nucleotide sequences of TEAD3 BINDING SITE, designated SEQ ID:9210, to the nucleotide sequence of VGAM2257 RNA, herein designated VGAM RNA, also designated SEQ ID:4968.

Another function of VGAM2257 is therefore inhibition of TEA Domain Family Member 3 (TEAD3, Accession NM_003214), a gene which binds to multiple functional elements of the human chorionic somatomammotropin-b gene enhancer. Accordingly, utilities of VGAM2257 include diagnosis, prevention and treatment of diseases and clinical conditions associated with TEAD3. The function of TEAD3 and its association with various diseases and clinical conditions, has been established by previous studies, as described hereinabove with reference to VGAM299. Wolf-Hirschhorn Syndrome Candidate 1-like 1 (WHSC1L1, Accession NM_023034) is another VGAM2257 host target gene. WHSC1L1 BINDING SITE1 and WHSC1L1 BINDING SITE2 are HOST TARGET binding sites found in untranslated regions of mRNA encoded by WHSC1L1, corresponding to HOST TARGET binding sites such as BINDING SITE I, BINDING SITE II or BINDING SITE III. Table 2 illustrates the complementarity of the nucleotide sequences of WHSC1L1 BINDING SITE1 and WHSC1L1 BINDING SITE2, designated SEQ ID:23318 and SEQ ID:19411 respectively, to the nucleotide sequence of VGAM2257 RNA, herein designated VGAM RNA, also designated SEQ ID:4968.

Another function of VGAM2257 is therefore inhibition of Wolf-Hirschhorn Syndrome Candidate 1-like 1 (WHSC1L1, Accession NM_023034), a gene which restores repair of base-base and single- nucleotide insertion-deletion mismatches, and increases the proficiency to process heteroduplexes with insertion-deletion mismatches. Accordingly, utilities of VGAM2257 include diagnosis, prevention and treatment of diseases and clinical conditions associated with WHSC1L1. The function of WHSC1L1 and its association with various diseases and clinical conditions, has been established by previous studies, as described hereinabove with reference to VGAM475. LOC203871 (Accession XM_115029) is another VGAM2257 host target gene. LOC203871 BINDING SITE is HOST TARGET binding site found in the 5' untranslated region of mRNA encoded by LOC203871, corresponding to a HOST TARGET binding site such as BINDING SITE I, BINDING SITE II or BINDING SITE III. Table 2 illustrates the complementarity of the nucleotide sequences of LOC203871 BINDING SITE, designated SEQ ID:43080, to the nucleotide sequence of VGAM2257 RNA, herein designated VGAM RNA, also designated SEQ ID:4968.

Another function of VGAM2257 is therefore inhibition of LOC203871 (Accession XM_115029). Accordingly, utilities of VGAM2257 include diagnosis, prevention and treatment of diseases and clinical conditions associated with LOC203871. LOC221250 (Accession XM_166301) is another VGAM2257 host target gene. LOC221250 BINDING SITE is HOST TARGET binding site found in the 5' untranslated region of mRNA encoded by LOC221250, corresponding to a HOST TARGET binding site such as BINDING SITE I, BINDING SITE II or BINDING SITE III. Table 2 illustrates the complementarity of the nucleotide sequences of LOC221250 BINDING SITE, designated SEQ ID:44120, to the nucleotide sequence of VGAM2257 RNA, herein designated VGAM RNA, also designated SEQ ID:4968.

Another function of VGAM2257 is therefore inhibition of LOC221250 (Accession XM_166301). Accordingly, utilities of VGAM2257 include diagnosis, prevention and treatment of diseases and clinical conditions associated with LOC221250. LOC253805 (Accession XM_172854) is another VGAM2257 host target gene. LOC253805 BINDING SITE is HOST TARGET binding site found in the 3' untranslated region of mRNA encoded by LOC253805, corresponding to a HOST TARGET binding site such as BINDING SITE I, BINDING SITE II or BINDING SITE III. Table 2 illustrates the complementarity of the nucleotide sequences of LOC253805 BINDING SITE, designated SEQ ID:46135, to the nucleotide sequence of VGAM2257 RNA, herein designated VGAM RNA, also designated SEQ ID:4968.

Another function of VGAM2257 is therefore inhibition of LOC253805 (Accession XM_172854). Accordingly, utilities of VGAM2257 include diagnosis, prevention and treatment of diseases and clinical conditions associated with LOC253805. LOC91145 (Accession XM_036454) is another VGAM2257 host target gene. LOC91145 BINDING SITE is HOST TARGET binding site found in the 3' untranslated region of mRNA encoded by LOC91145, corresponding to a HOST TARGET binding site such as BINDING SITE I, BINDING SITE II or BINDING SITE III. Table 2 illustrates the complementarity of the nucleotide sequences of LOC91145 BINDING SITE, designated SEQ ID:32451, to the nucleotide sequence of VGAM2257 RNA, herein designated VGAM RNA, also designated SEQ ID:4968.

Another function of VGAM2257 is therefore inhibition of LOC91145 (Accession XM_036454). Accordingly, utilities of VGAM2257 include diagnosis, prevention and treatment of diseases and clinical conditions associated with LOC91145. FIG. 1 further provides a conceptual description of a novel bioinformatically detected viral gene of the present invention, referred to here as Viral Genomic Address Messenger 2258 (VGAM2258) viral gene, which modulates expression of respective host target genes thereof, the function and utility of which host target genes is known in the art.

VGAM2258 is a novel bioinformatically detected regulatory, non protein coding, viral micro RNA (miRNA) gene. The method by which VGAM2258 was detected is described hereinabove with reference to FIGS. 1-8.

VGAM2258 gene, herein designated VGAM GENE, is a viral gene contained in the genome of Oat Chlorotic Stunt Virus. VGAM2258 host target gene, herein designated VGAM HOST TARGET GENE, is a human gene contained in the human genome.

VGAM2258 gene encodes a VGAM2258 precursor RNA, herein designated VGAM PRECURSOR RNA. Similar to other miRNA genes, and unlike most ordinary genes, VGAM2258 precursor RNA does not encode a protein. A nucleotide sequence identical or highly similar to the nucleotide sequence of VGAM2258 precursor RNA is designated SEQ ID:2244, and is provided hereinbelow with reference to the sequence listing part. Nucleotide sequence SEQ ID:2244 is located at position 1727 relative to the genome of Oat Chlorotic Stunt Virus.

VGAM2258 precursor RNA folds onto itself, forming VGAM2258 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2258 folded precursor RNA into VGAM2258 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 49%) nucleotide sequence of VGAM2258 RNA is designated SEQ ID:4969, and is provided hereinbelow with reference to the sequence listing part.

VGAM2258 host target gene, herein designated VGAM HOST TARGET GENE, encodes a corresponding messenger RNA, VGAM2258 host target RNA, herein designated VGAM HOST TARGET RNA. VGAM2258 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2258 RNA, herein designated VGAM RNA, binds complementarily to one or more host target binding sites located in untranslated regions of VGAM2258 host target RNA, herein designated VGAM HOST TARGET RNA. This complementary binding is due to the fact that the nucleotide sequence of VGAM2258 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2258 RNA, herein designated VGAM RNA, may have a different number of host target binding sites in untranslated regions of a VGAM2258 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2258 RNA, herein designated VGAM RNA, to host target binding sites on VGAM2258 host target RNA, herein designated VGAM HOST TARGET RNA, such as BINDING SITE I, BINDING SITE II and BINDING SITE III, inhibits translation of VGAM2258 host target RNA into VGAM2258 host target protein, herein designated VGAM HOST TARGET PROTEIN. VGAM host target protein is therefore outlined by a broken line.

It is appreciated that VGAM2258 host target gene, herein designated VGAM HOST TARGET GENE, in fact represents a plurality of VGAM2258 host target genes. The mRNA of each one of this plurality of VGAM2258 host target genes comprises one or more host target binding sites, each having a nucleotide sequence which is at least partly complementary to VGAM2258 RNA, herein designated VGAM RNA, and which when bound by VGAM2258 RNA causes inhibition of translation of respective one or more VGAM2258 host target proteins.

It is further appreciated by one skilled in the art that the mode of translational inhibition illustrated by FIG. 1 with specific reference to translational inhibition exerted by VGAM2258 gene, herein designated VGAM GENE, on one or more VGAM2258 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2258 is inhibition of expression of host target genes, as part of a novel viral mechanism of attacking a host. Accordingly, utilities of VGAM2258 include diagnosis, prevention and treatment of viral infection by Oat Chlorotic Stunt Virus. Specific functions, and accordingly utilities, of VGAM2258 correlate with, and may be deduced from, the identity of the host target genes which VGAM2258 binds and inhibits, and the function of these host target genes, as elaborated hereinbelow.

Nucleotide sequences of the VGAM2258 precursor RNA, herein designated VGAM PRECURSOR RNA, and of the 'diced' VGAM2258 RNA, herein designated VGAM RNA, and a schematic representation of the secondary folding of VGAM2258 folded precursor RNA, herein designated VGAM FOLDED PRECURSOR RNA, of VGAM2258 are further described hereinbelow with reference to Table 1.

Nucleotide sequences of host target binding sites, such as BINDING SITE-I, BINDING SITE-II and BINDING SITE-III of FIG. 1, found on VGAM2258 host target RNA, and schematic representation of the complementarity of each of these host target binding sites to VGAM2258 RNA, herein designated VGAM RNA, are described hereinbelow with reference to Table 2.

As mentioned hereinabove with reference to FIG. 1, a function of VGAM2258 gene, herein designated VGAM is inhibition of expression of VGAM2258 target genes. It is appreciated that specific functions, and accordingly utilities, of VGAM2258 correlate with, and may be deduced from, the identity of the target genes which VGAM2258 binds and inhibits, and the function of these target genes, as elaborated hereinbelow.

Ets Variant Gene 5 (ets-related molecule) (ETV5, Accession NM_004454) is a VGAM2258 host target gene. ETV5 BINDING SITE is HOST TARGET binding site found in the 3' untranslated region of mRNA encoded by ETV5, corresponding to a HOST TARGET binding site such as BINDING SITE I, BINDING SITE II or BINDING SITE III. Table 2 illustrates the complementarity of the nucleotide sequences of ETV5 BINDING SITE, designated SEQ ID:10747, to the nucleotide sequence of VGAM2258 RNA, herein designated VGAM RNA, also designated SEQ ID:4969.

A function of VGAM2258 is therefore inhibition of Ets Variant Gene 5 (ets-related molecule) (ETV5, Accession NM_004454), a gene which DNA binding protein of the Ets oncoprotein family. Accordingly, utilities of VGAM2258 include diagnosis, prevention and treatment of diseases and clinical conditions associated with ETV5. The function of ETV5 and its association with various diseases and clinical conditions, has been established by previous studies, as described hereinabove with reference to VGAM1171. Hepatocyte Nuclear Factor 4, Gamma (HNF4G, Accession NM_004133) is another VGAM2258 host target gene. HNF4G BINDING SITE is HOST TARGET binding site found in the 5' untranslated region of mRNA encoded by HNF4G, corresponding to a HOST TARGET binding site such as BINDING SITE I, BINDING SITE II or BINDING SITE III. Table 2 illustrates the complementarity of the nucleotide sequences of HNF4G BINDING SITE, designated SEQ ID:10346, to the nucleotide sequence of VGAM2258 RNA, herein designated VGAM RNA, also designated SEQ ID:4969.

Another function of VGAM2258 is therefore inhibition of Hepatocyte Nuclear Factor 4, Gamma (HNF4G, Accession NM_004133), a gene which may be involved in differential regulation of HNF4-dependent genes. Accordingly, utilities of VGAM2258 include diagnosis, prevention and treatment of diseases and clinical conditions associated with HNF4G. The function of HNF4G has been established by previous studies. By screening kidney cDNA libraries with a probe based on frog Hnf4-beta, Drewes et al. (1996) isolated cDNAs encoding HNF4G and variants of HNF4A. Sequence analysis predicted that the 774-amino acid HNF4G protein has a relatively long N-terminal domain compared with that of HNF4A, and nearly identical DNA-binding and ligand-binding domains. The C-terminal F domain of HNF4G is 37% identical to that of HNF4A. Northern blot analysis revealed weak expression of 5.5- and 4.1-kb HNF4G transcripts in pancreas, kidney, small intestine, and testis, with no expression detected in liver or other tissues tested. In contrast, expression of HNF4A was detected in liver as well as in all tissues expressing HNF4G. Cells expressing HNF4G had significantly less transactivation potential compared with those expressing HNF4A. Drewes et al. (1996) concluded that differential transcriptional regulation of HNF4-dependent genes may be due to differential expression of HNF4 proteins. By PCR analysis of genomic DNA from hybrid cell lines, Drewes et al. (1996) mapped the HNF4G gene to chromosome 8. Taraviras et al. (2000) mapped the mouse Hnf4g gene to chromosome 3A.

Full details of the abovementioned studies are described in the following publications, the disclosure of which are hereby incorporated by reference:

Drewes, T.; Senkel, S.; Holewa, B.; Ryffel, G. U.: Human hepatocyte nuclear factor 4 isoforms are encoded by distinct and differentially expressed genes. Molec. Cell. Biol. 16:925-931, 1996; and Taraviras, S.; Mantamadiotis, T.; Dong-Si, T.; Mincheva, A.; Lichter, P.; Drewes, T.; Ryffel, G. U.; Monaghan, A. P.; Schutz, G.: Primary structure, chromosomal mapping, expression and tra.

Further studies establishing the function and utilities of HNF4G are found in John Hopkins OMIM database record ID 605966, and in sited publications numbered 6811-6812 listed in the bibliography section hereinbelow, which are also hereby incorporated by reference. Intersectin 1 (SH3 domain protein) (ITSN1, Accession NM_003024) is another VGAM2258 host target gene. ITSN1 BINDING SITE is HOST TARGET binding site found in the 3' untranslated region of mRNA encoded by ITSN1, corresponding to a HOST TARGET binding site such as BINDING SITE I, BINDING SITE II or BINDING SITE III. Table 2 illustrates the complementarity of the nucleotide sequences of ITSN1 BINDING SITE, designated SEQ ID:8955, to the nucleotide sequence of VGAM2258 RNA, herein designated VGAM RNA, also designated SEQ ID:4969.

Another function of VGAM2258 is therefore inhibition of Intersectin 1 (SH3 domain protein) (ITSN1, Accession NM_003024), a gene which may be involved in endocytosis and synaptic vesicle recycling. Accordingly, utilities of VGAM2258 include diagnosis, prevention and treatment of diseases and clinical conditions associated with ITSN1. The function of ITSN1 and its association with various diseases and clinical conditions, has been established by previous studies, as described hereinabove with reference to VGAM1233. Tumor Necrosis Factor (ligand) Superfamily, Member 4 (tax-transcriptionally activated glycoprotein 1, 34 kDa) (TNFSF4, Accession NM_003326) is another VGAM2258 host target gene. TNFSF4 BINDING SITE is HOST TARGET binding site found in the 3' untranslated region of mRNA encoded by TNFSF4, corresponding to a HOST TARGET binding site such as BINDING SITE I, BINDING SITE II or BINDING SITE III. Table 2 illustrates the complementarity of the nucleotide sequences of TNFSF4 BINDING SITE, designated SEQ ID:9332, to the nucleotide sequence of VGAM2258 RNA, herein designated VGAM RNA, also designated SEQ ID:4969.

Another function of VGAM2258 is therefore inhibition of Tumor Necrosis Factor (ligand) Superfamily, Member 4 (tax-transcriptionally activated glycoprotein 1, 34 kDa) (TNFSF4, Accession NM_003326), a gene which co-stimulates t cell proliferation and cytokine production. Accordingly, utilities of VGAM2258 include diagnosis, prevention and treatment of diseases and clinical conditions associated with TNFSF4. The function of TNFSF4 and its association with various diseases and clinical conditions, has been established by previous studies, as described hereinabove with reference to VGAM463. Chromosome 20 Open Reading Frame 12 (C20orf12, Accession NM_018152) is another VGAM2258 host target gene. C20orf12 BINDING SITE is HOST TARGET binding site found in the 5' untranslated region of mRNA encoded by C20orf12, corresponding to a HOST TARGET binding site such as BINDING SITE I, BINDING SITE II or BINDING SITE III. Table 2 illustrates the complementarity of the nucleotide sequences of C20orf12 BINDING SITE, designated SEQ ID:19958, to the nucleotide sequence of VGAM2258 RNA, herein designated VGAM RNA, also designated SEQ ID:4969.

Another function of VGAM2258 is therefore inhibition of Chromosome 20 Open Reading Frame 12 (C20orf12, Accession NM_018152). Accordingly, utilities of VGAM2258 include diagnosis, prevention and treatment of diseases and clinical conditions associated with C20orf12. Chloride Intracellular Channel 4 (CLIC4, Accession NM_013943) is another VGAM2258 host target gene. CLIC4 BINDING SITE is HOST TARGET binding site found in the 3' untranslated region of mRNA encoded by CLIC4, corresponding to a HOST TARGET binding site such as BINDING SITE I, BINDING SITE II or BINDING SITE III. Table 2 illustrates the complementarity of the nucleotide sequences of CLIC4 BINDING SITE, designated SEQ ID:15129, to the nucleotide sequence of VGAM2258 RNA, herein designated VGAM RNA, also designated SEQ ID:4969.

Another function of VGAM2258 is therefore inhibition of Chloride Intracellular Channel 4 (CLIC4, Accession NM_013943). Accordingly, utilities of VGAM2258 include diagnosis, prevention and treatment of diseases and clinical conditions associated with CLIC4. DKFZp434A171 (Accession XM_047716) is another VGAM2258 host target gene. DKFZp434A171 BINDING SITE is HOST TARGET binding site found in the 5' untranslated region of mRNA encoded by DKFZp434A171, corresponding to a HOST TARGET binding site such as BINDING SITE I, BINDING SITE II or BINDING SITE III. Table 2 illustrates the complementarity of the nucleotide sequences of DKFZp434A171 BINDING SITE, designated SEQ ID:35037, to the nucleotide sequence of VGAM2258 RNA, herein designated VGAM RNA, also designated SEQ ID:4969.

Another function of VGAM2258 is therefore inhibition of DKFZp434A171 (Accession XM_047716). Accordingly, utilities of VGAM2258 include diagnosis, prevention and treatment of diseases and clinical conditions associated with DKFZp434A171. IPLA2(GAMMA) (Accession XM_027224) is another VGAM2258 host target gene. IPLA2 (GAMMA) BINDING SITE is HOST TARGET binding site found in the 3' untranslated region of mRNA encoded by IPLA2(GAMMA), corresponding to a HOST TARGET binding site such as BINDING SITE I, BINDING SITE II or BINDING SITE III. Table 2 illustrates the complementarity of the nucleotide sequences of IPLA2(GAMMA) BINDING SITE, designated SEQ ID:30445, to the nucleotide sequence of VGAM2258 RNA, herein designated VGAM RNA, also designated SEQ ID:4969.

Another function of VGAM2258 is therefore inhibition of IPLA2(GAMMA) (Accession XM_027224). Accordingly, utilities of VGAM2258 include diagnosis, prevention and treatment of diseases and clinical conditions associated with IPLA2(GAMMA). KIAA0171 (Accession NM_014666) is another VGAM2258 host target gene. KIAA0171 BINDING SITE is HOST TARGET binding site found in the 3' untranslated region of mRNA encoded by KIAA0171, corresponding to a HOST TARGET binding site such as BINDING SITE I, BINDING SITE II or BINDING SITE III. Table 2 illustrates the complementarity of the nucleotide sequences of KIAA0171 BINDING SITE, designated SEQ ID:16122, to the nucleotide sequence of VGAM2258 RNA, herein designated VGAM RNA, also designated SEQ ID:4969.

Another function of VGAM2258 is therefore inhibition of KIAA0171 (Accession NM_014666). Accordingly, utilities of VGAM2258 include diagnosis, prevention and treatment of diseases and clinical conditions associated with KIAA0171. KIAA1879 (Accession XM_056635) is another VGAM2258 host target gene. KIAA1879 BINDING SITE is HOST TARGET binding site found in the 5' untranslated region of mRNA encoded by KIAA1879, corresponding to a HOST TARGET binding site such as BINDING SITE I, BINDING SITE II or BINDING SITE III. Table 2 illustrates the complementarity of the nucleotide sequences of KIAA1879 BINDING SITE, designated SEQ ID:36414, to the nucleotide sequence of VGAM2258 RNA, herein designated VGAM RNA, also designated SEQ ID:4969.

Another function of VGAM2258 is therefore inhibition of KIAA1879 (Accession XM_056635). Accordingly, utilities of VGAM2258 include diagnosis, prevention and treatment of diseases and clinical conditions associated with KIAA1879. Kelch-like 4 (Drosophila) (KLHL4, Accession NM_019117) is another VGAM2258 host target gene. KLHL4 BINDING SITE is HOST TARGET binding site found in the 3' untranslated region of mRNA encoded by KLHL4, corresponding to a HOST TARGET binding site such as BINDING SITE I, BINDING SITE II or BINDING SITE III. Table 2 illustrates the complementarity of the nucleotide sequences of KLHL4 BINDING SITE, designated SEQ ID:21195, to the nucleotide sequence of VGAM2258 RNA, herein designated VGAM RNA, also designated SEQ ID:4969.

Another function of VGAM2258 is therefore inhibition of Kelch-like 4 (Drosophila) (KLHL4, Accession NM_019117). Accordingly, utilities of VGAM2258 include diagnosis, prevention and treatment of diseases and clinical conditions associated with KLHL4. LanC Lantibiotic Synthetase Component C-like 2 (bacterial) (LANCL2, Accession NM_018697) is another VGAM2258 host target gene. LANCL2 BINDING SITE is HOST TARGET binding site found in the 3' untranslated region of mRNA encoded by LANCL2, corresponding to a HOST TARGET binding site such as BINDING SITE I, BINDING SITE II or BINDING SITE III. Table 2 illustrates the complementarity of the nucleotide sequences of LANCL2 BINDING SITE, designated SEQ ID:20777, to the nucleotide sequence of VGAM2258 RNA, herein designated VGAM RNA, also designated SEQ ID:4969.

Another function of VGAM2258 is therefore inhibition of LanC Lantibiotic Synthetase Component C-like 2 (bacterial) (LANCL2, Accession NM_018697). Accordingly, utilities of VGAM2258 include diagnosis, prevention and treatment of diseases and clinical conditions associated with LANCL2. LEC3 (Accession NM_015236) is another VGAM2258 host target gene. LEC3 BINDING SITE is HOST TARGET binding site found in the 3' untranslated region of mRNA encoded by LEC3, corresponding to a HOST TARGET binding site such as BINDING SITE I, BINDING SITE II or BINDING SITE III. Table 2 illustrates the complementarity of the nucleotide sequences of LEC3 BINDING SITE, designated SEQ ID:17569, to the nucleotide sequence of VGAM2258 RNA, herein designated VGAM RNA, also designated SEQ ID:4969.

Another function of VGAM2258 is therefore inhibition of LEC3 (Accession NM_015236). Accordingly, utilities of VGAM2258 include diagnosis, prevention and treatment of diseases and clinical conditions associated with LEC3. MGC21688 (Accession NM_144635) is another VGAM2258 host target gene. MGC21688 BINDING SITE is HOST TARGET binding site found in the 3' untranslated region of mRNA encoded by MGC21688, corresponding to a HOST TARGET binding site such as BINDING SITE I, BINDING SITE II or BINDING SITE III. Table 2 illustrates the complementarity of the nucleotide sequences of MGC21688 BINDING SITE, designated SEQ ID:29454, to the nucleotide sequence of VGAM2258 RNA, herein designated VGAM RNA, also designated SEQ ID:4969.

Another function of VGAM2258 is therefore inhibition of MGC21688 (Accession NM_144635). Accordingly, utilities of VGAM2258 include diagnosis, prevention and treatment of diseases and clinical conditions associated with MGC21688. MGC5566 (Accession NM_024049) is another VGAM2258 host target gene. MGC5566 BINDING SITE is HOST TARGET binding site found in the 3' untranslated region of mRNA encoded by MGC5566, corresponding to a HOST TARGET binding site such as BINDING SITE I, BINDING SITE II or BINDING SITE III. Table 2 illustrates the complementarity of the nucleotide sequences of MGC5566 BINDING SITE, designated SEQ ID:23486, to the nucleotide sequence of VGAM2258 RNA, herein designated VGAM RNA, also designated SEQ ID:4969.

Another function of VGAM2258 is therefore inhibition of MGC5566 (Accession NM_024049). Accordingly, utilities of VGAM2258 include diagnosis, prevention and treatment of diseases and clinical conditions associated with MGC5566. Mitochondrial Ribosomal Protein S21 (MRPS21, Accession NM_018997) is another VGAM2258 host target gene. MRPS21 BINDING SITE is HOST TARGET binding site found in the 5' untranslated region of mRNA encoded by MRPS21, corresponding to a HOST TARGET binding site such as BINDING SITE I, BINDING SITE II or BINDING SITE III. Table 2 illustrates the complementarity of the nucleotide sequences of MRPS21 BINDING SITE, designated SEQ ID:21070, to the nucleotide sequence of VGAM2258 RNA, herein designated VGAM RNA, also designated SEQ ID:4969.

Another function of VGAM2258 is therefore inhibition of Mitochondrial Ribosomal Protein S21 (MRPS21, Accession NM_018997). Accordingly, utilities of VGAM2258 include diagnosis, prevention and treatment of diseases and clinical conditions associated with MRPS21. Nuclear Receptor Coactivator 2 (NCOA2, Accession NM_006540) is another VGAM2258 host target gene. NCOA2 BINDING SITE is HOST TARGET binding site found in the 3' untranslated region of mRNA encoded by NCOA2, corresponding to a HOST TARGET binding site such as BINDING SITE I, BINDING SITE II or BINDING SITE III. Table 2 illustrates the complementarity of the nucleotide sequences of NCOA2 BINDING SITE, designated SEQ ID:13295, to the nucleotide sequence of VGAM2258 RNA, herein designated VGAM RNA, also designated SEQ ID:4969.

Another function of VGAM2258 is therefore inhibition of Nuclear Receptor Coactivator 2 (NCOA2, Accession NM_006540). Accordingly, utilities of VGAM2258 include diagnosis, prevention and treatment of diseases and clinical conditions associated with NCOA2. RP4-622L5 (Accession NM_019118) is another VGAM2258 host target gene. RP4-622L5 BINDING SITE is HOST TARGET binding site found in the 3' untranslated region of mRNA encoded by RP4-622L5, corresponding to a HOST TARGET binding site such as BINDING SITE I, BINDING SITE II or BINDING SITE III. Table 2 illustrates the complementarity of the nucleotide sequences of RP4-622L5 BINDING SITE, designated SEQ ID:21201, to the nucleotide sequence of VGAM2258 RNA, herein designated VGAM RNA, also designated SEQ ID:4969.

Another function of VGAM2258 is therefore inhibition of RP4-622L5 (Accession NM_019118). Accordingly, utilities of VGAM2258 include diagnosis, prevention and treatment of diseases and clinical conditions associated with RP4-622L5. TACTILE (Accession NM_005816) is another VGAM2258 host target gene. TACTILE BINDING SITE is HOST TARGET binding site found in the 3' untranslated region of mRNA encoded by TACTILE, corresponding to a HOST TARGET binding site such as BINDING SITE I, BINDING SITE II or BINDING SITE III. Table 2 illustrates the complementarity of the nucleotide sequences of TACTILE BINDING SITE, designated SEQ ID:12412, to the nucleotide sequence of VGAM2258 RNA, herein designated VGAM RNA, also designated SEQ ID:4969.

Another function of VGAM2258 is therefore inhibition of TACTILE (Accession NM_005816). Accordingly, utilities of VGAM2258 include diagnosis, prevention and treatment of diseases and clinical conditions associated with TACTILE. LOC112840 (Accession NM_080666) is another VGAM2258 host target gene. LOC112840 BINDING SITE is HOST TARGET binding site found in the 3' untranslated region of mRNA encoded by LOC112840, corresponding to a HOST TARGET binding site such as BINDING SITE I, BINDING SITE II or BINDING SITE III. Table 2 illustrates the complementarity of the nucleotide sequences of LOC112840 BINDING SITE, designated SEQ ID:27957, to the nucleotide sequence of VGAM2258 RNA, herein designated VGAM RNA, also designated SEQ ID:4969.

Another function of VGAM2258 is therefore inhibition of LOC112840 (Accession NM_080666). Accordingly, utilities of VGAM2258 include diagnosis, prevention and treatment of diseases and clinical conditions associated with LOC112840. LOC127702 (Accession XM_060619) is another VGAM2258 host target gene. LOC127702 BINDING SITE is HOST TARGET binding site found in the 3' untranslated region of mRNA encoded by LOC127702, corresponding to a HOST TARGET binding site such as BINDING SITE I, BINDING SITE II or BINDING SITE III. Table 2 illustrates the complementarity of the nucleotide sequences of LOC127702 BINDING SITE, designated SEQ ID:37181, to the nucleotide sequence of VGAM2258 RNA, herein designated VGAM RNA, also designated SEQ ID:4969.

Another function of VGAM2258 is therefore inhibition of LOC127702 (Accession XM_060619). Accordingly, utilities of VGAM2258 include diagnosis, prevention and treatment of diseases and clinical conditions associated with LOC127702. LOC146287 (Accession XM_096967) is another VGAM2258 host target gene. LOC146287 BINDING SITE is HOST TARGET binding site found in the 5' untranslated region of mRNA encoded by LOC146287, corresponding to a HOST TARGET binding site such as BINDING SITE I, BINDING SITE II or BINDING SITE III. Table 2 illustrates the complementarity of the nucleotide sequences of LOC146287 BINDING SITE, designated SEQ ID:40689, to the nucleotide sequence of VGAM2258 RNA, herein designated VGAM RNA, also designated SEQ ID:4969.

Another function of VGAM2258 is therefore inhibition of LOC146287 (Accession XM_096967). Accordingly, utilities of VGAM2258 include diagnosis, prevention and treatment of diseases and clinical conditions associated with LOC146287. LOC150933 (Accession XM_097971) is another VGAM2258 host target gene. LOC150933 BINDING SITE is HOST TARGET binding site found in the 3' untranslated region of mRNA encoded by LOC150933, corresponding to a HOST TARGET binding site such as BINDING SITE I, BINDING SITE II or BINDING SITE III. Table 2 illustrates the complementarity of the nucleotide sequences of LOC150933 BINDING SITE, designated SEQ ID:41271, to the nucleotide sequence of VGAM2258 RNA, herein designated VGAM RNA, also designated SEQ ID:4969.

Another function of VGAM2258 is therefore inhibition of LOC150933 (Accession XM_097971). Accordingly, utilities of VGAM2258 include diagnosis, prevention and treatment of diseases and clinical conditions associated with LOC150933. LOC255374 (Accession XM_171171) is another VGAM2258 host target gene. LOC255374 BINDING SITE is HOST TARGET binding site found in the 5' untranslated region of mRNA encoded by LOC255374, corresponding to a HOST TARGET binding site such as BINDING SITE I, BINDING SITE II or BINDING SITE III. Table 2 illustrates the complementarity of the nucleotide sequences of LOC255374 BINDING SITE, designated SEQ ID:45955, to the nucleotide sequence of VGAM2258 RNA, herein designated VGAM RNA, also designated SEQ ID:4969.

Another function of VGAM2258 is therefore inhibition of LOC255374 (Accession XM_171171). Accordingly, utilities of VGAM2258 include diagnosis, prevention and treatment of diseases and clinical conditions associated with LOC255374. LOC90906 (Accession XM_034809) is another VGAM2258 host target gene. LOC90906 BINDING SITE is HOST TARGET binding site found in the 5' untranslated region of mRNA encoded by LOC90906, corresponding to a HOST TARGET binding site such as BINDING SITE I, BINDING SITE II or BINDING SITE III. Table 2 illustrates the complementarity of the nucleotide sequences of LOC90906 BINDING SITE, designated SEQ ID:32150, to the nucleotide sequence of VGAM2258 RNA, herein designated VGAM RNA, also designated SEQ ID:4969.

Another function of VGAM2258 is therefore inhibition of LOC90906 (Accession XM_034809). Accordingly, utilities of VGAM2258 include diagnosis, prevention and treatment of diseases and clinical conditions associated with LOC90906. LOC92080 (Accession XM_042704) is another VGAM2258 host target gene. LOC92080 BINDING SITE is HOST TARGET binding site found in the 3' untranslated region of mRNA encoded by LOC92080, corresponding to a HOST TARGET binding site such as BINDING SITE I, BINDING SITE II or BINDING SITE III. Table 2 illustrates the complementarity of the nucleotide sequences of LOC92080 BINDING SITE, designated SEQ ID:33758, to the nucleotide sequence of VGAM2258 RNA, herein designated VGAM RNA, also designated SEQ ID:4969.

Another function of VGAM2258 is therefore inhibition of LOC92080 (Accession XM_042704). Accordingly, utilities of VGAM2258 include diagnosis, prevention and treatment of diseases and clinical conditions associated with LOC92080. FIG. 1 further provides a conceptual description of a novel bioinformatically detected viral gene of the present invention, referred to here as Viral Genomic Address Messenger 2259 (VGAM2259) viral gene, which modulates expression of respective host target genes thereof, the function and utility of which host target genes is known in the art.

VGAM2259 is a novel bioinformatically detected regulatory, non protein coding, viral micro RNA (miRNA) gene. The method by which VGAM2259 was detected is described hereinabove with reference to FIGS. 1-8.

VGAM2259 gene, herein designated VGAM GENE, is a viral gene contained in the genome of Alcelaphine Herpesvirus 1. VGAM2259 host target gene, herein designated VGAM HOST TARGET GENE, is a human gene contained in the human genome.

VGAM2259 gene encodes a VGAM2259 precursor RNA, herein designated VGAM PRECURSOR RNA. Similar to other miRNA genes, and unlike most ordinary genes, VGAM2259 precursor RNA does not encode a protein. A nucleotide sequence identical or highly similar to the nucleotide sequence of VGAM2259 precursor RNA is designated SEQ ID:2245, and is provided hereinbelow with reference to the sequence listing part. Nucleotide sequence SEQ ID:2245 is located at position 30401 relative to the genome of Alcelaphine Herpesvirus 1.

VGAM2259 precursor RNA folds onto itself, forming VGAM2259 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2259 folded precursor RNA into VGAM2259 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 72%) nucleotide sequence of VGAM2259 RNA is designated SEQ ID:4970, and is provided hereinbelow with reference to the sequence listing part.

VGAM2259 host target gene, herein designated VGAM HOST TARGET GENE, encodes a corresponding messenger RNA, VGAM2259 host target RNA, herein designated VGAM HOST TARGET RNA. VGAM2259 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2259 RNA, herein designated VGAM RNA, binds complementarily to one or more host target binding sites located in untranslated regions of VGAM2259 host target RNA, herein designated VGAM HOST TARGET RNA. This complementary binding is due to the fact that the nucleotide sequence of VGAM2259 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2259 RNA, herein designated VGAM RNA, may have a different number of host target binding sites in untranslated regions of a VGAM2259 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2259 RNA, herein designated VGAM RNA, to host target binding sites on VGAM2259 host target RNA, herein designated VGAM HOST TARGET RNA, such as BINDING SITE I, BINDING SITE II and BINDING SITE III, inhibits translation of VGAM2259 host target RNA into VGAM2259 host target protein, herein designated VGAM HOST TARGET PROTEIN. VGAM host target protein is therefore outlined by a broken line.

It is appreciated that VGAM2259 host target gene, herein designated VGAM HOST TARGET GENE, in fact represents a plurality of VGAM2259 host target genes. The mRNA of each one of this plurality of VGAM2259 host target genes comprises one or more host target binding sites, each having a nucleotide sequence which is at least partly complementary to VGAM2259 RNA, herein designated VGAM RNA, and which when bound by VGAM2259 RNA causes inhibition of translation of respective one or more VGAM2259 host target proteins.

It is further appreciated by one skilled in the art that the mode of translational inhibition illustrated by FIG. 1 with specific reference to translational inhibition exerted by VGAM2259 gene, herein designated VGAM GENE, on one or more VGAM2259 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2259 is inhibition of expression of host target genes, as part of a novel viral mechanism of attacking a host. Accordingly, utilities of VGAM2259 include diagnosis, prevention and treatment of viral infection by Alcelaphine Herpesvirus 1. Specific functions, and accordingly utilities, of VGAM2259 correlate with, and may be deduced from, the identity of the host target genes which VGAM2259 binds and inhibits, and the function of these host target genes, as elaborated hereinbelow.

Nucleotide sequences of the VGAM2259 precursor RNA, herein designated VGAM PRECURSOR RNA, and of the 'diced' VGAM2259 RNA, herein designated VGAM RNA, and a schematic representation of the secondary folding of VGAM2259 folded precursor RNA, herein designated VGAM FOLDED PRECURSOR RNA, of VGAM2259 are further described hereinbelow with reference to Table 1.

Nucleotide sequences of host target binding sites, such as BINDING SITE-I, BINDING SITE-II and BINDING SITE-III of FIG. 1, found on VGAM2259 host target RNA, and schematic representation of the complementarity of each of these host target binding sites to VGAM2259 RNA, herein designated VGAM RNA, are described hereinbelow with reference to Table 2.

As mentioned hereinabove with reference to FIG. 1, a function of VGAM2259 gene, herein designated VGAM is inhibition of expression of VGAM2259 target genes. It is appreciated that specific functions, and accordingly utilities, of VGAM2259 correlate with, and may be deduced from, the identity of the target genes which VGAM2259 binds and inhibits, and the function of these target genes, as elaborated hereinbelow.

ADP-ribosyltransferase (NAD+; poly (ADP-ribose) Polymerase) (ADPRT, Accession NM_001618) is a VGAM2259 host target gene. ADPRT BINDING SITE is HOST TARGET binding site found in the 3' untranslated region of mRNA encoded by ADPRT, corresponding to a HOST TARGET binding site such as BINDING SITE I, BINDING SITE II or BINDING SITE III. Table 2 illustrates the complementarity of the nucleotide sequences of ADPRT BINDING SITE, designated SEQ ID:7326, to the nucleotide sequence of VGAM2259 RNA, herein designated VGAM RNA, also designated SEQ ID:4970.

A function of VGAM2259 is therefore inhibition of ADP-ribosyltransferase (NAD+; poly (ADP-ribose) Polymerase) (ADPRT, Accession NM_001618), a gene which catalyzes addition of mono-ADP-ribose to arginine residues of proteins, inhibits Pol II transcription. Accordingly, utilities of VGAM2259 include diagnosis, prevention and treatment of diseases and clinical conditions associated with ADPRT. The function of ADPRT and its association with various diseases and clinical conditions, has been established by previous studies, as described hereinabove with reference to VGAM506. Diptheria Toxin Resistance Protein Required For Diphthamide Biosynthesis-like 1 (S. cerevisiae) (DPH2L1, Accession NM_001383) is another VGAM2259 host target gene. DPH2L1 BINDING SITE is HOST TARGET binding site found in the 3' untranslated region of mRNA encoded by DPH2L1, corresponding to a HOST TARGET binding site such as BINDING SITE I, BINDING SITE II or BINDING SITE III. Table 2 illustrates the complementarity of the nucleotide sequences of DPH2L1 BINDING SITE, designated SEQ ID:7055, to the nucleotide sequence of VGAM2259 RNA, herein designated VGAM RNA, also designated SEQ ID:4970.

Another function of VGAM2259 is therefore inhibition of Diptheria Toxin Resistance Protein Required For Diphthamide Biosynthesis-like 1 (S. cerevisiae) (DPH2L1, Accession NM_001383), a gene which may be involved in regulating global protein synthesis; has similarity to S. cerevisiae Dph2p. Accordingly, utilities of VGAM2259 include diagnosis, prevention and treatment of diseases and clinical conditions associated with DPH2L1. The function of DPH2L1 and its association with various diseases and clinical conditions, has been established by previous studies, as described hereinabove with reference to VGAM608. Guanylate Binding Protein 1, Interferon-inducible, 67 kDa (GBP1, Accession NM_002053) is another VGAM2259 host target gene. GBP1 BINDING SITE is HOST TARGET binding site found in the 3' untranslated region of mRNA encoded by GBP1, corresponding to a HOST TARGET binding site such as BINDING SITE I, BINDING SITE II or BINDING SITE III. Table 2 illustrates the complementarity of the nucleotide sequences of GBP1 BINDING SITE, designated SEQ ID:7811, to the nucleotide sequence of VGAM2259 RNA, herein designated VGAM RNA, also designated SEQ ID:4970.

Another function of VGAM2259 is therefore inhibition of Guanylate Binding Protein 1, Interferon-inducible, 67 kDa (GBP1, Accession NM_002053), a gene which specifically binds guanylate nucleotides (GMP, GDP and GTP). Accordingly, utilities of VGAM2259 include diagnosis, prevention and treatment of diseases and clinical conditions associated with GBP1. The function of GBP1 and its association with various diseases and clinical conditions, has been established by previous studies, as described hereinabove with reference to VGAM46. Neurotrophic Tyrosine Kinase, Receptor, Type 2 (NTRK2, Accession NM_006180) is another VGAM2259 host target gene. NTRK2 BINDING SITE is HOST TARGET binding site found in the 3' untranslated region of mRNA encoded by NTRK2, corresponding to a HOST TARGET binding site such as BINDING SITE I, BINDING SITE II or BINDING SITE III. Table 2 illustrates the complementarity of the nucleotide sequences of NTRK2 BINDING SITE, designated SEQ ID:12844, to the nucleotide sequence of VGAM2259 RNA, herein designated VGAM RNA, also designated SEQ ID:4970.

Another function of VGAM2259 is therefore inhibition of Neurotrophic Tyrosine Kinase, Receptor, Type 2 (NTRK2, Accession NM_006180), a gene which is involved in the development and/or maintenance of the nervous system. Accordingly, utilities of VGAM2259 include diagnosis, prevention and treatment of diseases and clinical conditions associated with NTRK2. The function of NTRK2 and its association with various diseases and clinical conditions, has been established by previous studies, as described hereinabove with reference to VGAM341. Phosphodiesterase 4B, CAMP-specific (phosphodiesterase E4 dunce homolog, Drosophila) (PDE4B, Accession NM_002600) is another VGAM2259 host target gene. PDE4B BINDING SITE is HOST TARGET binding site found in the 3' untranslated region of mRNA encoded by PDE4B, corresponding to a HOST TARGET binding site such as BINDING SITE I, BINDING SITE II or BINDING SITE III. Table 2 illustrates the complementarity of the nucleotide sequences of PDE4B BINDING SITE, designated SEQ ID:8464, to the nucleotide sequence of VGAM2259 RNA, herein designated VGAM RNA, also designated SEQ ID:4970.

Another function of VGAM2259 is therefore inhibition of Phosphodiesterase 4B, CAMP-specific (phosphodiesterase E4 dunce homolog, Drosophila) (PDE4B, Accession NM_002600), a gene which may be involved in mediating central nervous system effects of therapeutic agents ranging from antidepressants to antiasthmatic and anti-inflammatory agents. Accordingly, utilities of VGAM2259 include diagnosis, prevention and treatment of diseases and clinical conditions associated with PDE4B. The function of PDE4B and its association with various diseases and clinical conditions, has been established by previous studies, as described hereinabove with reference to VGAM51. PRO0149 (Accession NM_014117) is another VGAM2259 host target gene. PRO0149 BINDING SITE is HOST TARGET binding site found in the 5' untranslated region of mRNA encoded by PRO0149, corresponding to a HOST TARGET binding site such as BINDING SITE I, BINDING SITE II or BINDING SITE III. Table 2 illustrates the complementarity of the nucleotide sequences of PRO0149 BINDING SITE, designated SEQ ID:15370, to the nucleotide sequence of VGAM2259 RNA, herein designated VGAM RNA, also designated SEQ ID:4970.

Another function of VGAM2259 is therefore inhibition of PRO0149 (Accession NM_014117). Accordingly, utilities of VGAM2259 include diagnosis, prevention and treatment of diseases and clinical conditions associated with PRO0149. PRP8 Pre-mRNA Processing Factor 8 Homolog (yeast) (PRPF8, Accession XM_028335) is another VGAM2259 host target gene. PRPF8 BINDING SITE is HOST TARGET binding site found in the 3' untranslated region of mRNA encoded by PRPF8, corresponding to a HOST TARGET binding site such as BINDING SITE I, BINDING SITE II or BINDING SITE III. Table 2 illustrates the complementarity of the nucleotide sequences of PRPF8 BINDING SITE, designated SEQ ID:30688, to the nucleotide sequence of VGAM2259 RNA, herein designated VGAM RNA, also designated SEQ ID:4970.

Another function of VGAM2259 is therefore inhibition of PRP8 Pre-mRNA Processing Factor 8 Homolog (yeast) (PRPF8, Accession XM_028335). Accordingly, utilities of VGAM2259 include diagnosis, prevention and treatment of diseases and clinical conditions associated with PRPF8. LOC127428 (Accession XM_059144) is another VGAM2259 host target gene. LOC127428 BINDING SITE is HOST TARGET binding site found in the 3' untranslated region of mRNA encoded by LOC127428, corresponding to a HOST TARGET binding site such as BINDING SITE I, BINDING SITE II or BINDING SITE III. Table 2 illustrates the complementarity of the nucleotide sequences of LOC127428 BINDING SITE, designated SEQ ID:36899, to the nucleotide sequence of VGAM2259 RNA, herein designated VGAM RNA, also designated SEQ ID:4970.

Another function of VGAM2259 is therefore inhibition of LOC127428 (Accession XM_059144). Accordingly, utilities of VGAM2259 include diagnosis, prevention and treatment of diseases and clinical conditions associated with LOC127428. LOC149175 (Accession XM_086445) is another VGAM2259 host target gene. LOC149175 BINDING SITE is HOST TARGET binding site found in the 3' untranslated region of mRNA encoded by LOC149175, corresponding to a HOST TARGET binding site such as BINDING SITE I, BINDING SITE II or BINDING SITE III. Table 2 illustrates the complementarity of the nucleotide sequences of LOC149175 BINDING SITE, designated SEQ ID:38659, to the nucleotide sequence of VGAM2259 RNA, herein designated VGAM RNA, also designated SEQ ID:4970.

Another function of VGAM2259 is therefore inhibition of LOC149175 (Accession XM_086445). Accordingly, utilities of VGAM2259 include diagnosis, prevention and treatment of diseases and clinical conditions associated with LOC149175. LOC158318 (Accession XM_098925) is another VGAM2259 host target gene. LOC158318 BINDING SITE is HOST TARGET binding site found in the 5' untranslated region of mRNA encoded by LOC158318, corresponding to a HOST TARGET binding site such as BINDING SITE I, BINDING SITE II or BINDING SITE III. Table 2 illustrates the complementarity of the nucleotide sequences of LOC158318 BINDING SITE, designated SEQ ID:41956, to the nucleotide sequence of VGAM2259 RNA, herein designated VGAM RNA, also designated SEQ ID:4970.

Another function of VGAM2259 is therefore inhibition of LOC158318 (Accession XM_098925). Accordingly, utilities of VGAM2259 include diagnosis, prevention and treatment of diseases and clinical conditions associated with LOC158318. LOC158450 (Accession XM_088580) is another VGAM2259 host target gene. LOC158450 BINDING SITE is HOST TARGET binding site found in the 5' untranslated region of mRNA encoded by LOC158450, corresponding to a HOST TARGET binding site such as BINDING SITE I, BINDING SITE II or BINDING SITE III. Table 2 illustrates the complementarity of the nucleotide sequences of LOC158450 BINDING SITE, designated SEQ ID:39845, to the nucleotide sequence of VGAM2259 RNA, herein designated VGAM RNA, also designated SEQ ID:4970.

Another function of VGAM2259 is therefore inhibition of LOC158450 (Accession XM_088580). Accordingly, utilities of VGAM2259 include diagnosis, prevention and treatment of diseases and clinical conditions associated with LOC158450. LOC158504 (Accession XM_088591) is another VGAM2259 host target gene. LOC158504 BINDING SITE is HOST TARGET binding site found in the 5' untranslated region of mRNA encoded by LOC158504, corresponding to a HOST TARGET binding site such as BINDING SITE I, BINDING SITE II or BINDING SITE III. Table 2 illustrates the complementarity of the nucleotide sequences of LOC158504 BINDING SITE, designated SEQ ID:39856, to the nucleotide sequence of VGAM2259 RNA, herein designated VGAM RNA, also designated SEQ ID:4970.

Another function of VGAM2259 is therefore inhibition of LOC158504 (Accession XM_088591). Accordingly, utilities of VGAM2259 include diagnosis, prevention and treatment of diseases and clinical conditions associated with LOC158504. LOC51170 (Accession NM_016245) is another VGAM2259 host target gene. LOC51170 BINDING SITE is HOST TARGET binding site found in the 3' untranslated region of mRNA encoded by LOC51170, corresponding to a HOST TARGET binding site such as BINDING SITE I, BINDING SITE II or BINDING SITE III. Table 2 illustrates the complementarity of the nucleotide sequences of LOC51170 BINDING SITE, designated SEQ ID:18364, to the nucleotide sequence of VGAM2259 RNA, herein designated VGAM RNA, also designated SEQ ID:4970.

Another function of VGAM2259 is therefore inhibition of LOC51170 (Accession NM_016245). Accordingly, utilities of VGAM2259 include diagnosis, prevention and treatment of diseases and clinical conditions associated with LOC51170. LOC90249 (Accession XM_030300) is another VGAM2259 host target gene. LOC90249 BINDING SITE is HOST TARGET binding site found in the 3' untranslated region of mRNA encoded by LOC90249, corresponding to a HOST TARGET binding site such as BINDING SITE I, BINDING SITE II or BINDING SITE III. Table 2 illustrates the complementarity of the nucleotide sequences of LOC90249 BINDING SITE, designated SEQ ID:31015, to the nucleotide sequence of VGAM2259 RNA, herein designated VGAM RNA, also designated SEQ ID:4970.

Another function of VGAM2259 is therefore inhibition of LOC90249 (Accession XM_030300). Accordingly, utilities of VGAM2259 include diagnosis, prevention and treatment of diseases and clinical conditions associated with LOC90249. FIG. 1 further provides a conceptual description of a novel bioinformatically detected viral gene of the present invention, referred to here as Viral Genomic Address Messenger 2260 (VGAM2260) viral gene, which modulates expression of respective host target genes thereof, the function and utility of which host target genes is known in the art.

VGAM2260 is a novel bioinformatically detected regulatory, non protein coding, viral micro RNA (miRNA) gene. The method by which VGAM2260 was detected is described hereinabove with reference to FIGS. 1-8.

VGAM2260 gene, herein designated VGAM GENE, is a viral gene contained in the genome of Alcelaphine Herpesvirus 1. VGAM2260 host target gene, herein designated VGAM HOST TARGET GENE, is a human gene contained in the human genome.

VGAM2260 gene encodes a VGAM2260 precursor RNA, herein designated VGAM PRECURSOR RNA. Similar to other miRNA genes, and unlike most ordinary genes, VGAM2260 precursor RNA does not encode a protein. A nucleotide sequence identical or highly similar to the nucleotide sequence of VGAM2260 precursor RNA is designated SEQ ID:2246, and is provided hereinbelow with reference to the sequence listing part. Nucleotide sequence SEQ ID:2246 is located at position 26713 relative to the genome of Alcelaphine Herpesvirus 1.

VGAM2260 precursor RNA folds onto itself, forming VGAM2260 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2260 folded precursor RNA into VGAM2260 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 62%) nucleotide sequence of VGAM2260 RNA is designated SEQ ID:4971, and is provided hereinbelow with reference to the sequence listing part.

VGAM2260 host target gene, herein designated VGAM HOST TARGET GENE, encodes a corresponding messenger RNA, VGAM2260 host target RNA, herein designated VGAM HOST TARGET RNA. VGAM2260 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2260 RNA, herein designated VGAM RNA, binds complementarily to one or more host target binding sites located in untranslated regions of VGAM2260 host target RNA, herein designated VGAM HOST TARGET RNA. This complementary binding is due to the fact that the nucleotide sequence of VGAM2260 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2260 RNA, herein designated VGAM RNA, may have a different number of host target binding sites in untranslated regions of a VGAM2260 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2260 RNA, herein designated VGAM RNA, to host target binding sites on VGAM2260 host target RNA, herein designated VGAM HOST TARGET RNA, such as BINDING SITE I, BINDING SITE II and BINDING SITE III, inhibits translation of VGAM2260 host target RNA into VGAM2260 host target protein, herein designated VGAM HOST TARGET PROTEIN. VGAM host target protein is therefore outlined by a broken line.

It is appreciated that VGAM2260 host target gene, herein designated VGAM HOST TARGET GENE, in fact represents a plurality of VGAM2260 host target genes. The mRNA of each one of this plurality of VGAM2260 host target genes comprises one or more host target binding sites, each having a nucleotide sequence which is at least partly complementary to VGAM2260 RNA, herein designated VGAM RNA, and which when bound by VGAM2260 RNA causes inhibition of translation of respective one or more VGAM2260 host target proteins.

It is further appreciated by one skilled in the art that the mode of translational inhibition illustrated by FIG. 1 with specific reference to translational inhibition exerted by VGAM2260 gene, herein designated VGAM GENE, on one or more VGAM2260 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2260 is inhibition of expression of host target genes, as part of a novel viral mechanism of attacking a host. Accordingly, utilities of VGAM2260 include diagnosis, prevention and treatment of viral infection by Alcelaphine Herpesvirus 1. Specific functions, and accordingly utilities, of VGAM2260 correlate with, and may be deduced from, the identity of the host target genes which VGAM2260 binds and inhibits, and the function of these host target genes, as elaborated hereinbelow.

Nucleotide sequences of the VGAM2260 precursor RNA, herein designated VGAM PRECURSOR RNA, and of the 'diced' VGAM2260 RNA, herein designated VGAM RNA, and a schematic representation of the secondary folding of VGAM2260 folded precursor RNA, herein designated VGAM FOLDED PRECURSOR RNA, of VGAM2260 are further described hereinbelow with reference to Table 1.

Nucleotide sequences of host target binding sites, such as BINDING SITE-I, BINDING SITE-II and BINDING SITE-III of FIG. 1, found on VGAM2260 host target RNA, and schematic representation of the complementarity of each of these host target binding sites to VGAM2260 RNA, herein designated VGAM RNA, are described hereinbelow with reference to Table 2.

As mentioned hereinabove with reference to FIG. 1, a function of VGAM2260 gene, herein designated VGAM is inhibition of expression of VGAM2260 target genes. It is appreciated that specific functions, and accordingly utilities, of VGAM2260 correlate with, and may be deduced from, the identity of the target genes which VGAM2260 binds and inhibits, and the function of these target genes, as elaborated hereinbelow.

Secretogranin III (SCG3, Accession NM_013243) is a VGAM2260 host target gene. SCG3 BINDING SITE is HOST TARGET binding site found in the 3' untranslated region of mRNA encoded by SCG3, corresponding to a HOST TARGET binding site such as BINDING SITE I, BINDING SITE II or BINDING SITE III. Table 2 illustrates the complementarity of the nucleotide sequences of SCG3 BINDING SITE, designated SEQ ID:14902, to the nucleotide sequence of VGAM2260 RNA, herein designated VGAM RNA, also designated SEQ ID:4971.

A function of VGAM2260 is therefore inhibition of Secretogranin III (SCG3, Accession NM_013243). Accordingly, utilities of VGAM2260 include diagnosis, prevention and treatment of diseases and clinical conditions associated with SCG3. Chromosome 11 Open Reading Frame 23 (C11orf23, Accession NM_018312) is another VGAM2260 host target gene. C11orf23 BINDING SITE is HOST TARGET binding site found in the 3' untranslated region of mRNA encoded by C11orf23, corresponding to a HOST TARGET binding site such as BINDING SITE I, BINDING SITE II or BINDING SITE III. Table 2 illustrates the complementarity of the nucleotide sequences of C11orf23 BINDING SITE, designated SEQ ID:20302, to the nucleotide sequence of VGAM2260 RNA, herein designated VGAM RNA, also designated SEQ ID:4971.

Another function of VGAM2260 is therefore inhibition of Chromosome 11 Open Reading Frame 23 (C11orf23, Accession NM_018312). Accordingly, utilities of VGAM2260 include diagnosis, prevention and treatment of diseases and clinical conditions associated with C11orf23. COAS3 (Accession NM_139020) is another VGAM2260 host target gene. COAS3 BINDING SITE is HOST TARGET binding site found in the 3' untranslated region of mRNA encoded by COAS3, corresponding to a HOST TARGET binding site such as BINDING SITE I, BINDING SITE II or BINDING SITE III. Table 2 illustrates the complementarity of the nucleotide sequences of COAS3 BINDING SITE, designated SEQ ID:29119, to the nucleotide sequence of VGAM2260 RNA, herein designated VGAM RNA, also designated SEQ ID:4971.

Another function of VGAM2260 is therefore inhibition of COAS3 (Accession NM_139020). Accordingly, utilities of VGAM2260 include diagnosis, prevention and treatment of diseases and clinical conditions associated with COAS3. FLJ12076 (Accession NM_025187) is another VGAM2260 host target gene. FLJ12076 BINDING SITE is HOST TARGET binding site found in the 3' untranslated region of mRNA encoded by FLJ12076, corresponding to a HOST TARGET binding site such as BINDING SITE I, BINDING SITE II or BINDING SITE III. Table 2 illustrates the complementarity of the nucleotide sequences of FLJ12076 BINDING SITE, designated SEQ ID:24822, to the nucleotide sequence of VGAM2260 RNA, herein designated VGAM RNA, also designated SEQ ID:4971.

Another function of VGAM2260 is therefore inhibition of FLJ12076 (Accession NM_025187). Accordingly, utilities of VGAM2260 include diagnosis, prevention and treatment of diseases and clinical conditions associated with FLJ12076. KIAA1550 (Accession XM_039393) is another VGAM2260 host target gene. KIAA1550 BINDING SITE is HOST TARGET binding site found in the 3' untranslated region of mRNA encoded by KIAA1550, corresponding to a HOST TARGET binding site such as BINDING SITE I, BINDING SITE II or BINDING SITE III. Table 2 illustrates the complementarity of the nucleotide sequences of KIAA1550 BINDING SITE, designated SEQ ID:33069, to the nucleotide sequence of VGAM2260 RNA, herein designated VGAM RNA, also designated SEQ ID:4971.

Another function of VGAM2260 is therefore inhibition of KIAA1550 (Accession XM_039393). Accordingly, utilities of VGAM2260 include diagnosis, prevention and treatment of diseases and clinical conditions associated with KIAA1550. NRBF-2 (Accession NM_030759) is another VGAM2260 host target gene. NRBF-2 BINDING SITE is HOST TARGET binding site found in the 3' untranslated region of mRNA encoded by NRBF-2, corresponding to a HOST TARGET binding site such as BINDING SITE I, BINDING SITE II or BINDING SITE III. Table 2 illustrates the complementarity of the nucleotide sequences of NRBF-2 BINDING SITE, designated SEQ ID:25043, to the nucleotide sequence of VGAM2260 RNA, herein designated VGAM RNA, also designated SEQ ID:4971.

Another function of VGAM2260 is therefore inhibition of NRBF-2 (Accession NM_030759). Accordingly, utilities of VGAM2260 include diagnosis, prevention and treatment of diseases and clinical conditions associated with NRBF-2. SE57-1 (Accession NM_025214) is another VGAM2260 host target gene. SE57-1 BINDING SITE is HOST TARGET binding site found in the 3' untranslated region of mRNA encoded by SE57-1, corresponding to a HOST TARGET binding site such as BINDING SITE I, BINDING SITE II or BINDING SITE III. Table 2 illustrates the complementarity of the nucleotide sequences of SE57-1 BINDING SITE, designated SEQ ID:24887, to the nucleotide sequence of VGAM2260 RNA, herein designated VGAM RNA, also designated SEQ ID:4971.

Another function of VGAM2260 is therefore inhibition of SE57-1 (Accession NM_025214). Accordingly, utilities of VGAM2260 include diagnosis, prevention and treatment of diseases and clinical conditions associated with SE57-1. WWP1 (Accession XM_087357) is another VGAM2260 host target gene. WWP1 BINDING SITE is HOST TARGET binding site found in the 5' untranslated region of mRNA encoded by WWP1, corresponding to a HOST TARGET binding site such as BINDING SITE I, BINDING SITE II or BINDING SITE III. Table 2 illustrates the complementarity of the nucleotide sequences of WWP1 BINDING SITE, designated SEQ ID:39190, to the nucleotide sequence of VGAM2260 RNA, herein designated VGAM RNA, also designated SEQ ID:4971.

Another function of VGAM2260 is therefore inhibition of WWP1 (Accession XM_087357). Accordingly, utilities of VGAM2260 include diagnosis, prevention and treatment of diseases and clinical conditions associated with WWP1. FIG. 1 further provides a conceptual description of a novel bioinformatically detected viral gene of the present invention, referred to here as Viral Genomic Address Messenger 2261 (VGAM2261) viral gene, which modulates expression of respective host target genes thereof, the function and utility of which host target genes is known in the art.

VGAM2261 is a novel bioinformatically detected regulatory, non protein coding, viral micro RNA (miRNA) gene. The method by which VGAM2261 was detected is described hereinabove with reference to FIGS. 1-8.

VGAM2261 gene, herein designated VGAM GENE, is a viral gene contained in the genome of Alcelaphine Herpesvirus 1. VGAM2261 host target gene, herein designated VGAM HOST TARGET GENE, is a human gene contained in the human genome.

VGAM2261 gene encodes a VGAM2261 precursor RNA, herein designated VGAM PRECURSOR RNA. Similar to other miRNA genes, and unlike most ordinary genes, VGAM2261 precursor RNA does not encode a protein. A nucleotide sequence identical or highly similar to the nucleotide sequence of VGAM2261 precursor RNA is designated SEQ ID:2247, and is provided hereinbelow with reference to the sequence listing part. Nucleotide sequence SEQ ID:2247 is located at position 24763 relative to the genome of Alcelaphine Herpesvirus 1.

VGAM2261 precursor RNA folds onto itself, forming VGAM2261 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2261 folded precursor RNA into VGAM2261 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2261 RNA is designated SEQ ID:4972, and is provided hereinbelow with reference to the sequence listing part.

VGAM2261 host target gene, herein designated VGAM HOST TARGET GENE, encodes a corresponding messenger RNA, VGAM2261 host target RNA, herein designated VGAM HOST TARGET RNA. VGAM2261 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2261 RNA, herein designated VGAM RNA, binds complementarily to one or more host target binding sites located in untranslated regions of VGAM2261 host target RNA, herein designated VGAM HOST TARGET RNA. This complementary binding is due to the fact that the nucleotide sequence of VGAM2261 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2261 RNA, herein designated VGAM RNA, may have a different number of host target binding sites in untranslated regions of a VGAM2261 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2261 RNA, herein designated VGAM RNA, to host target binding sites on VGAM2261 host target RNA, herein designated VGAM HOST TARGET RNA, such as BINDING SITE I, BINDING SITE II and BINDING SITE III, inhibits translation of VGAM2261 host target RNA into VGAM2261 host target protein, herein designated VGAM HOST TARGET PROTEIN. VGAM host target protein is therefore outlined by a broken line.

It is appreciated that VGAM2261 host target gene, herein designated VGAM HOST TARGET GENE, in fact represents a plurality of VGAM2261 host target genes. The mRNA of each one of this plurality of VGAM2261 host target genes comprises one or more host target binding sites, each having a nucleotide sequence which is at least partly complementary to VGAM2261 RNA, herein designated VGAM RNA, and which when bound by VGAM2261 RNA causes inhibition of translation of respective one or more VGAM2261 host target proteins.

It is further appreciated by one skilled in the art that the mode of translational inhibition illustrated by FIG. 1 with specific reference to translational inhibition exerted by VGAM2261 gene, herein designated VGAM GENE, on one or more VGAM2261 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2261 is inhibition of expression of host target genes, as part of a novel viral mechanism of attacking a host. Accordingly, utilities of VGAM2261 include diagnosis, prevention and treatment of viral infection by Alcelaphine Herpesvirus 1. Specific functions, and accordingly utilities, of VGAM2261 correlate with, and may be deduced from, the identity of the host target genes which VGAM2261 binds and inhibits, and the function of these host target genes, as elaborated hereinbelow.

Nucleotide sequences of the VGAM2261 precursor RNA, herein designated VGAM PRECURSOR RNA, and of the 'diced' VGAM2261 RNA, herein designated VGAM RNA, and a schematic representation of the secondary folding of VGAM2261 folded precursor RNA, herein designated VGAM FOLDED PRECURSOR RNA, of VGAM2261 are further described hereinbelow with reference to Table 1.

Nucleotide sequences of host target binding sites, such as BINDING SITE-I, BINDING SITE-II and BINDING SITE-III of FIG. 1, found on VGAM2261 host target RNA, and schematic representation of the complementarity of each of these host target binding sites to VGAM2261 RNA, herein designated VGAM RNA, are described hereinbelow with reference to Table 2.

As mentioned hereinabove with reference to FIG. 1, a function of VGAM2261 gene, herein designated VGAM is inhibition of expression of VGAM2261 target genes. It is appreciated that specific functions, and accordingly utilities, of VGAM2261 correlate with, and may be deduced from, the identity of the target genes which VGAM2261 binds and inhibits, and the function of these target genes, as elaborated hereinbelow.

ATPase, Ca++ Transporting, Ubiquitous (ATP2A3, Accession NM_005173) is a VGAM2261 host target gene. ATP2A3 BINDING SITE is HOST TARGET binding site found in the 3' untranslated region of mRNA encoded by ATP2A3, corresponding to a HOST TARGET binding site such as BINDING SITE I, BINDING SITE II or BINDING SITE III. Table 2 illustrates the complementarity of the nucleotide sequences of ATP2A3 BINDING SITE, designated SEQ ID:11672, to the nucleotide sequence of VGAM2261 RNA, herein designated VGAM RNA, also designated SEQ ID:4972.

A function of VGAM2261 is therefore inhibition of ATPase, Ca++ Transporting, Ubiquitous (ATP2A3, Accession NM_005173). Accordingly, utilities of VGAM2261 include diagnosis, prevention and treatment of diseases and clinical conditions associated with ATP2A3. Gamma-aminobutyric Acid (GABA) A Receptor, Pi (GABRP, Accession NM_014211) is another VGAM2261 host target gene. GABRP BINDING SITE is HOST TARGET binding site found in the 3' untranslated region of mRNA encoded by GABRP, corresponding to a HOST TARGET binding site such as BINDING SITE I, BINDING SITE II or BINDING SITE III. Table 2 illustrates the complementarity of the nucleotide sequences of GABRP BINDING SITE, designated SEQ ID:15478, to the nucleotide sequence of VGAM2261 RNA, herein designated VGAM RNA, also designated SEQ ID:4972.

Another function of VGAM2261 is therefore inhibition of Gamma-aminobutyric Acid (GABA) A Receptor, Pi (GABRP, Accession NM_014211), a gene which mediates neuronal inhibition by binding to the gaba/benzodiazepine receptor and opening an integral chloride channel. Accordingly, utilities of VGAM2261 include diagnosis, prevention and treatment of diseases and clinical conditions associated with GABRP. The function of GABRP and its association with various diseases and clinical conditions, has been established by previous studies, as described hereinabove with reference to VGAM795. N-deacetylase/N-sulfotransferase (heparan glucosaminyl) 1 (NDST1, Accession NM_001543) is another VGAM2261 host target gene. NDST1 BINDING SITE is HOST TARGET binding site found in the 5' untranslated region of mRNA encoded by NDST1, corresponding to a HOST TARGET binding site such as BINDING SITE I, BINDING SITE II or BINDING SITE III. Table 2 illustrates the complementarity of the nucleotide sequences of NDST1 BINDING SITE, designated SEQ ID:7270, to the nucleotide sequence of VGAM2261 RNA, herein designated VGAM RNA, also designated SEQ ID:4972.

Another function of VGAM2261 is therefore inhibition of N-deacetylase/N-sulfotransferase (heparan glucosaminyl) 1 (NDST1, Accession NM_001543), a gene which catalyses the n-sulfation and n-deacetylation of glucosamine of the glycosaminoglycan in heparan sulfate. Accordingly, utilities of VGAM2261 include diagnosis, prevention and treatment of diseases and clinical conditions associated with NDST1. The function of NDST1 has been established by previous studies. Dixon et al. (1995) cloned a human heparan sulfate N-deacetylase/N-sulfotransferase cDNA from a placental library using a cosmid from the Treacher Collins syndrome (OMIM Ref. No. 154500) candidate region, 5q32-q33.1. They detected 2 different mRNAs, which varied in the length of the 3-prime UTR but encoded the same protein. The sequence predicted an 882-amino acid protein which is 98% identical to the previously reported rat gene (Hashimoto et al., 1995). The Treacher Collins Syndrome Collaborative Group (1996) stated that the most 5-prime exon of HSST lies approximately 150 kb distal to 'TREACLE,' the gene responsible for Treacher Collins syndrome. Gladwin et al. (1996) elucidated the genomic organization of the HSST gene with identification of 14 exons which were tested for Treacher-Collins-specific mutations. Mutations within the coding sequence and adjacent splice junctions of HSST were excluded from a causative role in the pathogenesis of Treacher Collins syndrome.

Full details of the abovementioned studies are described in the following publications, the disclosure of which are hereby incorporated by reference:

Dixon, J.; Loftus, S. K.; Gladwin, A. J.; Scambler, P. J.; Wasmuth, J. J.; Dixon, M. J.: Cloning of the human heparan sulfate-N-deacetylase/N-sulfotransferase gene from the Treacher Collins syndrome candidate region at 5q32-q33.1. Genomics 26:239-244, 1995; and Gladwin, A. J.; Dixon, J.; Loftus, S. K.; Wasmuth, J. J.; Dixon, M. J.: Genomic organization of the human heparan sulfate-N-deacetylase/N-sulfotransferase gene: exclusion from a causat.

Further studies establishing the function and utilities of NDST1 are found in John Hopkins OMIM database record ID 600853, and in sited publications numbered 10062-1006 and 3538 listed in the bibliography section hereinbelow, which are also hereby incorporated by reference. Protein Phosphatase 2 (formerly 2A), Regulatory Subunit B (PR 52), Beta Isoform (PPP2R2B, Accession NM_004576) is another VGAM2261 host target gene. PPP2R2B BINDING SITE is HOST TARGET binding site found in the 5" untranslated region of mRNA encoded by PPP2R2B, corresponding to a HOST TARGET binding site such as BINDING SITE I, BINDING SITE II or BINDING SITE III. Table 2 illustrates the complementarity of the nucleotide sequences of PPP2R2B BINDING SITE, designated SEQ ID:10923, to the nucleotide sequence of VGAM2261 RNA, herein designated VGAM RNA, also designated SEQ ID:4972.

Another function of VGAM2261 is therefore inhibition of Protein Phosphatase 2 (formerly 2A), Regulatory Subunit B (PR 52), Beta Isoform (PPP2R2B, Accession NM_004576). Accordingly, utilities of VGAM2261 include diagnosis, prevention and treatment of diseases and clinical conditions associated with PPP2R2B. Ryanodine Receptor 3 (RYR3, Accession NM_001036) is another VGAM2261 host target gene. RYR3 BINDING SITE is HOST TARGET binding site found in the 3' untranslated region of mRNA encoded by RYR3, corresponding to a HOST TARGET binding site such as BINDING SITE I, BINDING SITE II or BINDING SITE III. Table 2 illustrates the complementarity of the nucleotide sequences of RYR3 BINDING SITE, designated SEQ ID:6700, to the nucleotide sequence of VGAM2261 RNA, herein designated VGAM RNA, also designated SEQ ID:4972.

Another function of VGAM2261 is therefore inhibition of Ryanodine Receptor 3 (RYR3, Accession NM_001036), a gene which is involved in communication between transverse-tubules and sarcoplasmic reticulum. Accordingly, utilities of VGAM2261 include diagnosis, prevention and treatment of diseases and clinical conditions associated with RYR3. The function of RYR3 and its association with various diseases and clinical conditions, has been established by previous studies, as described hereinabove with reference to VGAM2014. Solute Carrier Family 9 (sodium/hydrogen exchanger), Isoform 1 (antiporter, Na+/H+, amiloride sensitive) (SLC9A1, Accession XM_046881) is another VGAM2261 host target gene. SLC9A1 BINDING SITE is HOST TARGET binding site found in the 3' untranslated region of mRNA encoded by SLC9A1, corresponding to a HOST TARGET binding site such as BINDING SITE I, BINDING SITE II or BINDING SITE III. Table 2 illustrates the complementarity of the nucleotide sequences of SLC9A1 BINDING SITE, designated SEQ ID:34857, to the nucleotide sequence of VGAM2261 RNA, herein designated VGAM RNA, also designated SEQ ID:4972.

Another function of VGAM2261 is therefore inhibition of Solute Carrier Family 9 (sodium/hydrogen exchanger), Isoform 1 (antiporter, Na+/H+, amiloride sensitive) (SLC9A1, Accession XM_046881), a gene which is involved in ph regulation to eliminate acids generated by active metabolism or to counter adverse environmental conditions. Accordingly, utilities of VGAM2261 include diagnosis, prevention and treatment of diseases and clinical conditions associated with SLC9A1. The function of SLC9A1 and its association with various diseases and clinical conditions, has been established by previous studies, as described hereinabove with reference to VGAM206. TYRO3 Protein Tyrosine Kinase (TYRO3, Accession NM_006293) is another VGAM2261 host target gene. TYRO3 BINDING SITE is HOST TARGET binding site found in the 3' untranslated region of mRNA encoded by TYRO3, corresponding to a HOST TARGET binding site such as BINDING SITE I, BINDING SITE II or BINDING SITE III. Table 2 illustrates the complementarity of the nucleotide sequences of TYRO3 BINDING SITE, designated SEQ ID:12984, to the nucleotide sequence of VGAM2261 RNA, herein designated VGAM RNA, also designated SEQ ID:4972.

Another function of VGAM2261 is therefore inhibition of TYRO3 Protein Tyrosine Kinase (TYRO3, Accession NM_006293), a gene which may be involved in cell adhesion processes, particularly in the central nervous system. Accordingly, utilities of VGAM2261 include diagnosis, prevention and treatment of diseases and clinical conditions associated with TYRO3. The function of TYRO3 and its association with various diseases and clinical conditions, has been established by previous studies, as described hereinabove with reference to VGAM711. ALK7 (Accession XM_065712) is another VGAM2261 host target gene. ALK7 BINDING SITE is HOST TARGET binding site found in the 5' untranslated region of mRNA encoded by ALK7, corresponding to a HOST TARGET binding site such as BINDING SITE I, BINDING SITE II or BINDING SITE III. Table 2 illustrates the complementarity of the nucleotide sequences of ALK7 BINDING SITE, designated SEQ ID:37294, to the nucleotide sequence of VGAM2261 RNA, herein designated VGAM RNA, also designated SEQ ID:4972.

Another function of VGAM2261 is therefore inhibition of ALK7 (Accession XM_065712). Accordingly, utilities of VGAM2261 include diagnosis, prevention and treatment of diseases and clinical conditions associated with ALK7. Chromosome 6 Open Reading Frame 37 (C6orf37, Accession XM_041375) is another VGAM2261 host target gene. C6orf37 BINDING SITE is HOST TARGET binding site found in the 3' untranslated region of mRNA encoded by C6orf37, corresponding to a HOST TARGET binding site such as BINDING SITE I, BINDING SITE II or BINDING SITE III. Table 2 illustrates the complementarity of the nucleotide sequences of C6orf37 BINDING SITE, designated SEQ ID:33512, to the nucleotide sequence of VGAM2261 RNA, herein designated VGAM RNA, also designated SEQ ID:4972.

Another function of VGAM2261 is therefore inhibition of Chromosome 6 Open Reading Frame 37 (C6orf37, Accession XM_041375). Accordingly, utilities of VGAM2261 include diagnosis, prevention and treatment of diseases and clinical conditions associated with C6orf37. DC-TM4F2 (Accession NM_030927) is another VGAM2261 host target gene. DC-TM4F2 BINDING SITE is HOST TARGET binding site found in the 3' untranslated region of mRNA encoded by DC-TM4F2, corresponding to a HOST TARGET binding site such as BINDING SITE I, BINDING SITE II or BINDING SITE III. Table 2 illustrates the complementarity of the nucleotide sequences of DC-TM4F2 BINDING SITE, designated SEQ ID:25197, to the nucleotide sequence of VGAM2261 RNA, herein designated VGAM RNA, also designated SEQ ID:4972.

Another function of VGAM2261 is therefore inhibition of DC-TM4F2 (Accession NM_030927). Accordingly, utilities of VGAM2261 include diagnosis, prevention and treatment of diseases and clinical conditions associated with DC-TM4F2. Dynactin 4 (p62) (DCTN4, Accession XM_041993) is another VGAM2261 host target gene. DCTN4 BINDING SITE is HOST TARGET binding site found in the 3' untranslated region of mRNA encoded by DCTN4, corresponding to a HOST TARGET binding site such as BINDING SITE I, BINDING SITE II or BINDING SITE III. Table 2 illustrates the complementarity of the nucleotide sequences of DCTN4 BINDING SITE, designated SEQ ID:33664, to the nucleotide sequence of VGAM2261 RNA, herein designated VGAM RNA, also designated SEQ ID:4972.

Another function of VGAM2261 is therefore inhibition of Dynactin 4 (p62) (DCTN4, Accession XM_041993). Accordingly, utilities of VGAM2261 include diagnosis, prevention and treatment of diseases and clinical conditions associated with DCTN4. FLJ22127 (Accession NM_022775) is another VGAM2261 host target gene. FLJ22127 BINDING SITE is HOST TARGET binding site found in the 3' untranslated region of mRNA encoded by FLJ22127, corresponding to a HOST TARGET binding site such as BINDING SITE I, BINDING SITE II or BINDING SITE III. Table 2 illustrates the complementarity of the nucleotide sequences of FLJ22127 BINDING SITE, designated SEQ ID:23041, to the nucleotide sequence of VGAM2261 RNA, herein designated VGAM RNA, also designated SEQ ID:4972.

Another function of VGAM2261 is therefore inhibition of FLJ22127 (Accession NM_022775). Accordingly, utilities of VGAM2261 include diagnosis, prevention and treatment of diseases and clinical conditions associated with FLJ22127. FLJ23447 (Accession NM_024825) is another VGAM2261 host target gene. FLJ23447 BINDING SITE is HOST TARGET binding site found in the 5' untranslated region of mRNA encoded by FLJ23447, corresponding to a HOST TARGET binding site such as BINDING SITE I, BINDING SITE II or BINDING SITE III. Table 2 illustrates the complementarity of the nucleotide sequences of FLJ23447 BINDING SITE, designated SEQ ID:24217, to the nucleotide sequence of VGAM2261 RNA, herein designated VGAM RNA, also designated SEQ ID:4972.

Another function of VGAM2261 is therefore inhibition of FLJ23447 (Accession NM_024825). Accordingly, utilities of VGAM2261 include diagnosis, prevention and treatment of diseases and clinical conditions associated with FLJ23447. KIAA0323 (Accession XM_032634) is another VGAM2261 host target gene. KIAA0323 BINDING SITE is HOST TARGET binding site found in the 3' untranslated region of mRNA encoded by KIAA0323, corresponding to a HOST TARGET binding site such as BINDING SITE I, BINDING SITE II or BINDING SITE III. Table 2 illustrates the complementarity of the nucleotide sequences of KIAA0323 BINDING SITE, designated SEQ ID:31689, to the nucleotide sequence of VGAM2261 RNA, herein designated VGAM RNA, also designated SEQ ID:4972.

Another function of VGAM2261 is therefore inhibition of KIAA0323 (Accession XM_032634). Accordingly, utilities of VGAM2261 include diagnosis, prevention and treatment of diseases and clinical conditions associated with KIAA0323. KIAA1045 (Accession XM_048592) is another VGAM2261 host target gene. KIAA1045 BINDING SITE is HOST TARGET binding site found in the 3' untranslated region of mRNA encoded by KIAA1045, corresponding to a HOST TARGET binding site such as BINDING SITE I, BINDING SITE II or BINDING SITE III. Table 2 illustrates the complementarity of the nucleotide sequences of KIAA1045 BINDING SITE, designated SEQ ID:35198, to the nucleotide sequence of VGAM2261 RNA, herein designated VGAM RNA, also designated SEQ ID:4972.

Another function of VGAM2261 is therefore inhibition of KIAA1045 (Accession XM_048592). Accordingly, utilities of VGAM2261 include diagnosis, prevention and treatment of diseases and clinical conditions associated with KIAA1045. KIAA1509 (Accession XM_029353) is another VGAM2261 host target gene. KIAA1509 BINDING SITE is HOST TARGET binding site found in the 3' untranslated region of mRNA encoded by KIAA1509, corresponding to a HOST TARGET binding site such as BINDING SITE I, BINDING SITE II or BINDING SITE III. Table 2 illustrates the complementarity of the nucleotide sequences of KIAA1509 BINDING SITE, designated SEQ ID:30873, to the nucleotide sequence of VGAM2261 RNA, herein designated VGAM RNA, also designated SEQ ID:4972.

Another function of VGAM2261 is therefore inhibition of KIAA1509 (Accession XM_029353). Accordingly, utilities of VGAM2261 include diagnosis, prevention and treatment of diseases and clinical conditions associated with KIAA1509. Mesoderm Development Candidate 2 (MESDC2, Accession XM_051854) is another VGAM2261 host target gene. MESDC2 BINDING SITE is HOST TARGET binding site found in the 3' untranslated region of mRNA encoded by MESDC2, corresponding to a HOST TARGET binding site such as BINDING SITE I, BINDING SITE II or BINDING SITE III. Table 2 illustrates the complementarity of the nucleotide sequences of MESDC2 BINDING SITE, designated SEQ ID:35890, to the nucleotide sequence of VGAM2261 RNA, herein designated VGAM RNA, also designated SEQ ID:4972.

Another function of VGAM2261 is therefore inhibition of Mesoderm Development Candidate 2 (MESDC2, Accession XM_051854). Accordingly, utilities of VGAM2261 include diagnosis, prevention and treatment of diseases and clinical conditions associated with MESDC2. MGC11352 (Accession XM_035941) is another VGAM2261 host target gene. MGC11352 BINDING SITE is HOST TARGET binding site found in the 5' untranslated region of mRNA encoded by MGC11352, corresponding to a HOST TARGET binding site such as BINDING SITE I, BINDING SITE II or BINDING SITE III. Table 2 illustrates the complementarity of the nucleotide sequences of MGC11352 BINDING SITE, designated SEQ ID:32355, to the nucleotide sequence of VGAM2261 RNA, herein designated VGAM RNA, also designated SEQ ID:4972.

Another function of VGAM2261 is therefore inhibition of MGC11352 (Accession XM_035941). Accordingly, utilities of VGAM2261 include diagnosis, prevention and treatment of diseases and clinical conditions associated with MGC11352. LOC147645 (Accession XM_085831) is another VGAM2261 host target gene. LOC147645 BINDING SITE is HOST TARGET binding site found in the 3' untranslated region of mRNA encoded by LOC147645, corresponding to a HOST TARGET binding site such as BINDING SITE I, BINDING SITE II or BINDING SITE III. Table 2 illustrates the complementarity of the nucleotide sequences of LOC147645 BINDING SITE, designated SEQ ID:38358, to the nucleotide sequence of VGAM2261 RNA, herein designated VGAM RNA, also designated SEQ ID:4972.

Another function of VGAM2261 is therefore inhibition of LOC147645 (Accession XM_085831). Accordingly, utilities of VGAM2261 include diagnosis, prevention and treatment of diseases and clinical conditions associated with LOC147645. LOC151742 (Accession NM_139245) is another VGAM2261 host target gene. LOC151742 BINDING SITE is HOST TARGET binding site found in the 3' untranslated region of mRNA encoded by LOC151742, corresponding to a HOST TARGET binding site such as BINDING SITE I, BINDING SITE II or BINDING SITE III. Table 2 illustrates the complementarity of the nucleotide sequences of LOC151742 BINDING SITE, designated SEQ ID:29242, to the nucleotide sequence of VGAM2261 RNA, herein designated VGAM RNA, also designated SEQ ID:4972.

Another function of VGAM2261 is therefore inhibition of LOC151742 (Accession NM_139245). Accordingly, utilities of VGAM2261 include diagnosis, prevention and treatment of diseases and clinical conditions associated with LOC151742. LOC154790 (Accession XM_088044) is another VGAM2261 host target gene. LOC154790 BINDING SITE is HOST TARGET binding site found in the 5' untranslated region of mRNA encoded by LOC154790, corresponding to a HOST TARGET binding site such as BINDING SITE I, BINDING SITE II or BINDING SITE III. Table 2 illustrates the complementarity of the nucleotide sequences of LOC154790 BINDING SITE, designated SEQ ID:39490, to the nucleotide sequence of VGAM2261 RNA, herein designated VGAM RNA, also designated SEQ ID:4972.

Another function of VGAM2261 is therefore inhibition of LOC154790 (Accession XM_088044). Accordingly, utilities of VGAM2261 include diagnosis, prevention and treatment of diseases and clinical conditions associated with LOC154790. LOC219914 (Accession XM_167788) is another VGAM2261 host target gene. LOC219914 BINDING SITE is HOST TARGET binding site found in the 5' untranslated region of mRNA encoded by LOC219914, corresponding to a HOST TARGET binding site such as BINDING SITE I, BINDING SITE II or BINDING SITE III. Table 2 illustrates the complementarity of the nucleotide sequences of LOC219914 BINDING SITE, designated SEQ ID:44815, to the nucleotide sequence of VGAM2261 RNA, herein designated VGAM RNA, also designated SEQ ID:4972.

Another function of VGAM2261 is therefore inhibition of LOC219914 (Accession XM_167788). Accordingly, utilities of VGAM2261 include diagnosis, prevention and treatment of diseases and clinical conditions associated with LOC219914. LOC222008 (Accession XM_168361) is another VGAM2261 host target gene. LOC222008 BINDING SITE is HOST TARGET binding site found in the 3' untranslated region of mRNA encoded by LOC222008, corresponding to a HOST TARGET binding site such as BINDING SITE I, BINDING SITE II or BINDING SITE III. Table 2 illustrates the complementarity of the nucleotide sequences of LOC222008 BINDING SITE, designated SEQ ID:45123, to the nucleotide sequence of VGAM2261 RNA, herein designated VGAM RNA, also designated SEQ ID:4972.

Another function of VGAM2261 is therefore inhibition of LOC222008 (Accession XM_168361). Accordingly, utilities of VGAM2261 include diagnosis, prevention and treatment of diseases and clinical conditions associated with LOC222008. LOC256979 (Accession XM_171162) is another VGAM2261 host target gene. LOC256979 BINDING SITE is HOST TARGET binding site found in the 5' untranslated region of mRNA encoded by LOC256979, corresponding to a HOST TARGET binding site such as BINDING SITE I, BINDING SITE II or BINDING SITE III. Table 2 illustrates the complementarity of the nucleotide sequences of LOC256979 BINDING SITE, designated SEQ ID:45951, to the nucleotide sequence of VGAM2261 RNA, herein designated VGAM RNA, also designated SEQ ID:4972.

Another function of VGAM2261 is therefore inhibition of LOC256979 (Accession XM_171162). Accordingly, utilities of VGAM2261 include diagnosis, prevention and treatment of diseases and clinical conditions associated with LOC256979. LOC56181 (Accession XM_170954) is another VGAM2261 host target gene. LOC56181 BINDING SITE is HOST TARGET binding site found in the 5' untranslated region of mRNA encoded by LOC56181, corresponding to a HOST TARGET binding site such as BINDING SITE I, BINDING SITE II or BINDING SITE III. Table 2 illustrates the complementarity of the nucleotide sequences of LOC56181 BINDING SITE, designated SEQ ID:45738, to the nucleotide sequence of VGAM2261 RNA, herein designated VGAM RNA, also designated SEQ ID:4972.

Another function of VGAM2261 is therefore inhibition of LOC56181 (Accession XM_170954). Accordingly, utilities of VGAM2261 include diagnosis, prevention and treatment of diseases and clinical conditions associated with LOC56181. FIG. 1 further provides a conceptual description of a novel bioinformatically detected viral gene of the present invention, referred to here as Viral Genomic Address Messenger 2262 (VGAM2262) viral gene, which modulates expression of respective host target genes thereof, the function and utility of which host target genes is known in the art.

VGAM2262 is a novel bioinformatically detected regulatory, non protein coding, viral micro RNA (miRNA) gene. The method by which VGAM2262 was detected is described hereinabove with reference to FIGS. 1-8.

VGAM2262 gene, herein designated VGAM GENE, is a viral gene contained in the genome of Alcelaphine Herpesvirus 1. VGAM2262 host target gene, herein designated VGAM HOST TARGET GENE, is a human gene contained in the human genome.

VGAM2262 gene encodes a VGAM2262 precursor RNA, herein designated VGAM PRECURSOR RNA. Similar to other miRNA genes, and unlike most ordinary genes, VGAM2262 precursor RNA does not encode a protein. A nucleotide sequence identical or highly similar to the nucleotide sequence of VGAM2262 precursor RNA is designated SEQ ID:2248, and is provided hereinbelow with reference to the sequence listing part. Nucleotide sequence SEQ ID:2248 is located at position 17900 relative to the genome of Alcelaphine Herpesvirus 1.

VGAM2262 precursor RNA folds onto itself, forming VGAM2262 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2262 folded precursor RNA into VGAM2262 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM2262 RNA is designated SEQ ID:4973, and is provided hereinbelow with reference to the sequence listing part.

VGAM2262 host target gene, herein designated VGAM HOST TARGET GENE, encodes a corresponding messenger RNA, VGAM2262 host target RNA, herein designated VGAM HOST TARGET RNA. VGAM2262 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2262 RNA, herein designated VGAM RNA, binds complementarily to one or more host target binding sites located in untranslated regions of VGAM2262 host target RNA, herein designated VGAM HOST TARGET RNA. This complementary binding is due to the fact that the nucleotide sequence of VGAM2262 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2262 RNA, herein designated VGAM RNA, may have a different number of host target binding sites in untranslated regions of a VGAM2262 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2262 RNA, herein designated VGAM RNA, to host target binding sites on VGAM2262 host target RNA, herein designated VGAM HOST TARGET RNA, such as BINDING SITE I, BINDING SITE II and BINDING SITE III, inhibits translation of VGAM2262 host target RNA into VGAM2262 host target protein, herein designated VGAM HOST TARGET PROTEIN. VGAM host target protein is therefore outlined by a broken line.

It is appreciated that VGAM2262 host target gene, herein designated VGAM HOST TARGET GENE, in fact represents a plurality of VGAM2262 host target genes. The mRNA of each one of this plurality of VGAM2262 host target genes comprises one or more host target binding sites, each having a nucleotide sequence which is at least partly complementary to VGAM2262 RNA, herein designated VGAM RNA, and which when bound by VGAM2262 RNA causes inhibition of translation of respective one or more VGAM2262 host target proteins.

It is further appreciated by one skilled in the art that the mode of translational inhibition illustrated by FIG. 1 with specific reference to translational inhibition exerted by VGAM2262 gene, herein designated VGAM GENE, on one or more VGAM2262 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2262 is inhibition of expression of host target genes, as part of a novel viral mechanism of attacking a host. Accordingly, utilities of VGAM2262 include diagnosis, prevention and treatment of viral infection by Alcelaphine Herpesvirus 1. Specific functions, and accordingly utilities, of VGAM2262 correlate with, and may be deduced from, the identity of the host target genes which VGAM2262 binds and inhibits, and the function of these host target genes, as elaborated hereinbelow.

Nucleotide sequences of the VGAM2262 precursor RNA, herein designated VGAM PRECURSOR RNA, and of the 'diced' VGAM2262 RNA, herein designated VGAM RNA, and a schematic representation of the secondary folding of VGAM2262 folded precursor RNA, herein designated VGAM FOLDED PRECURSOR RNA, of VGAM2262 are further described hereinbelow with reference to Table 1.

Nucleotide sequences of host target binding sites, such as BINDING SITE-I, BINDING SITE-II and BINDING SITE-III of FIG. 1, found on VGAM2262 host target RNA, and schematic representation of the complementarity of each of these host target binding sites to VGAM2262 RNA, herein designated VGAM RNA, are described hereinbelow with reference to Table 2.

As mentioned hereinabove with reference to FIG. 1, a function of VGAM2262 gene, herein designated VGAM is inhibition of expression of VGAM2262 target genes. It is appreciated that specific functions, and accordingly utilities, of VGAM2262 correlate with, and may be deduced from, the identity of the target genes which VGAM2262 binds and inhibits, and the function of these target genes, as elaborated hereinbelow.

Caspase 9, Apoptosis-related Cysteine Protease (CASP9, Accession NM_001229) is a VGAM2262 host target gene. CASP9 BINDING SITE is HOST TARGET binding site found in the 3' untranslated region of mRNA encoded by CASP9, corresponding to a HOST TARGET binding site such as BINDING SITE I, BINDING SITE II or BINDING SITE III. Table 2 illustrates the complementarity of the nucleotide sequences of CASP9 BINDING SITE, designated SEQ ID:6898, to the nucleotide sequence of VGAM2262 RNA, herein designated VGAM RNA, also designated SEQ ID:4973.

A function of VGAM2262 is therefore inhibition of Caspase 9, Apoptosis-related Cysteine Protease (CASP9, Accession NM_001229). Accordingly, utilities of VGAM2262 include diagnosis, prevention and treatment of diseases and clinical conditions associated with CASP9. DKFZP586A011 (Accession NM_015416) is another VGAM2262 host target gene. DKFZP586A011 BINDING SITE is HOST TARGET binding site found in the 3' untranslated region of mRNA encoded by DKFZP586A011, corresponding to a HOST TARGET binding site such as BINDING SITE I, BINDING SITE II or BINDING SITE III. Table 2 illustrates the complementarity of the nucleotide sequences of DKFZP586A011 BINDING SITE, designated SEQ ID:17716, to the nucleotide sequence of VGAM2262 RNA, herein designated VGAM RNA, also designated SEQ ID:4973.

Another function of VGAM2262 is therefore inhibition of DKFZP586A011 (Accession NM_015416). Accordingly, utilities of VGAM2262 include diagnosis, prevention and treatment of diseases and clinical conditions associated with DKFZP586A011. HSU24186 (Accession NM_013347) is another VGAM2262 host target gene. HSU24186 BINDING SITE is HOST TARGET binding site found in the 5' untranslated region of mRNA encoded by HSU24186, corresponding to a HOST TARGET binding site such as BINDING SITE I, BINDING SITE II or BINDING SITE III. Table 2 illustrates the complementarity of the nucleotide sequences of HSU24186 BINDING SITE, designated SEQ ID:14990, to the nucleotide sequence of VGAM2262 RNA, herein designated VGAM RNA, also designated SEQ ID:4973.

Another function of VGAM2262 is therefore inhibition of HSU24186 (Accession NM_013347). Accordingly, utilities of VGAM2262 include diagnosis, prevention and treatment of diseases and clinical conditions associated with HSU24186. KIAA1497 (Accession XM_041431) is another VGAM2262 host target gene. KIAA1497 BINDING SITE is HOST TARGET binding site found in the 5' untranslated region of mRNA encoded by KIAA1497, corresponding to a HOST TARGET binding site such as BINDING SITE I, BINDING SITE II or BINDING SITE III. Table 2 illustrates the complementarity of the nucleotide sequences of KIAA1497 BINDING SITE, designated SEQ ID:33523, to the nucleotide sequence of VGAM2262 RNA, herein designated VGAM RNA, also designated SEQ ID:4973.

Another function of VGAM2262 is therefore inhibition of KIAA1497 (Accession XM_041431). Accordingly, utilities of VGAM2262 include diagnosis, prevention and treatment of diseases and clinical conditions associated with KIAA1497. Mannosidase, Alpha, Class 1C, Member 1 (MAN1C1, Accession NM_020379) is another VGAM2262 host target gene. MAN1C1 BINDING SITE is HOST TARGET binding site found in the 5' untranslated region of mRNA encoded by MAN1C1, corresponding to a HOST TARGET binding site such as BINDING SITE I, BINDING SITE II or BINDING SITE III. Table 2 illustrates the complementarity of the nucleotide sequences of MAN1C1 BINDING SITE, designated SEQ ID:21643, to the nucleotide sequence of VGAM2262 RNA, herein designated VGAM RNA, also designated SEQ ID:4973.

Another function of VGAM2262 is therefore inhibition of Mannosidase, Alpha, Class 1C, Member 1 (MAN1C1, Accession NM_020379). Accordingly, utilities of VGAM2262 include diagnosis, prevention and treatment of diseases and clinical conditions associated with MAN1C1. PRO0902 (Accession NM_053057) is another VGAM2262 host target gene. PRO0902 BINDING SITE is HOST TARGET binding site found in the 5" untranslated region of mRNA encoded by PRO0902, corresponding to a HOST TARGET binding site such as BINDING SITE I, BINDING SITE II or BINDING SITE III. Table 2 illustrates the complementarity of the nucleotide sequences of PRO0902 BINDING SITE, designated SEQ ID:27605, to the nucleotide sequence of VGAM2262 RNA, herein designated VGAM RNA, also designated SEQ ID:4973.

Another function of VGAM2262 is therefore inhibition of PRO0902 (Accession NM_053057). Accordingly, utilities of VGAM2262 include diagnosis, prevention and treatment of diseases and clinical conditions associated with PRO0902. LOC222159 (Accession XM_168421) is another VGAM2262 host target gene. LOC222159 BINDING SITE is HOST TARGET binding site found in the 5' untranslated region of mRNA encoded by LOC222159, corresponding to a HOST TARGET binding site such as BINDING SITE I, BINDING SITE II or BINDING SITE III. Table 2 illustrates the complementarity of the nucleotide sequences of LOC222159 BINDING SITE, designated SEQ ID:45147, to the nucleotide sequence of VGAM2262 RNA, herein designated VGAM RNA, also designated SEQ ID:4973.

Another function of VGAM2262 is therefore inhibition of LOC222159 (Accession XM_168421). Accordingly, utilities of VGAM2262 include diagnosis, prevention and treatment of diseases and clinical conditions associated with LOC222159. FIG. 1 further provides a conceptual description of a novel bioinformatically detected viral gene of the present invention, referred to here as Viral Genomic Address Messenger 2263 (VGAM2263) viral gene, which modulates expression of respective host target genes thereof, the function and utility of which host target genes is known in the art.

VGAM2263 is a novel bioinformatically detected regulatory, non protein coding, viral micro RNA (miRNA) gene. The method by which VGAM2263 was detected is described hereinabove with reference to FIGS. 1-8.

VGAM2263 gene, herein designated VGAM GENE, is a viral gene contained in the genome of Alcelaphine Herpesvirus 1. VGAM2263 host target gene, herein designated VGAM HOST TARGET GENE, is a human gene contained in the human genome.

VGAM2263 gene encodes a VGAM2263 precursor RNA, herein designated VGAM PRECURSOR RNA. Similar to other miRNA genes, and unlike most ordinary genes, VGAM2263 precursor RNA does not encode a protein. A nucleotide sequence identical or highly similar to the nucleotide sequence of VGAM2263 precursor RNA is designated SEQ ID:2249, and is provided hereinbelow with reference to the sequence listing part. Nucleotide sequence SEQ ID:2249 is located at position 27186 relative to the genome of Alcelaphine Herpesvirus 1.

VGAM2263 precursor RNA folds onto itself, forming VGAM2263 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2263 folded precursor RNA into VGAM2263 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM2263 RNA is designated SEQ ID:4974, and is provided hereinbelow with reference to the sequence listing part.

VGAM2263 host target gene, herein designated VGAM HOST TARGET GENE, encodes a corresponding messenger RNA, VGAM2263 host target RNA, herein designated VGAM HOST TARGET RNA. VGAM2263 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2263 RNA, herein designated VGAM RNA, binds complementarily to one or more host target binding sites located in untranslated regions of VGAM2263 host target RNA, herein designated VGAM HOST TARGET RNA. This complementary binding is due to the fact that the nucleotide sequence of VGAM2263 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2263 RNA, herein designated VGAM RNA, may have a different number of host target binding sites in untranslated regions of a VGAM2263 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2263 RNA, herein designated VGAM RNA, to host target binding sites on VGAM2263 host target RNA, herein designated VGAM HOST TARGET RNA, such as BINDING SITE I, BINDING SITE II and BINDING SITE III, inhibits translation of VGAM2263 host target RNA into VGAM2263 host target protein, herein designated VGAM HOST TARGET PROTEIN. VGAM host target protein is therefore outlined by a broken line.

It is appreciated that VGAM2263 host target gene, herein designated VGAM HOST TARGET GENE, in fact represents a plurality of VGAM2263 host target genes. The mRNA of each one of this plurality of VGAM2263 host target genes comprises one or more host target binding sites, each having a nucleotide sequence which is at least partly complementary to VGAM2263 RNA, herein designated VGAM RNA, and which when bound by VGAM2263 RNA causes inhibition of translation of respective one or more VGAM2263 host target proteins.

It is further appreciated by one skilled in the art that the mode of translational inhibition illustrated by FIG. 1 with specific reference to translational inhibition exerted by VGAM2263 gene, herein designated VGAM GENE, on one or more VGAM2263 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2263 is inhibition of expression of host target genes, as part of a novel viral mechanism of attacking a host. Accordingly, utilities of VGAM2263 include diagnosis, prevention and treatment of viral infection by Alcelaphine Herpesvirus 1. Specific functions, and accordingly utilities, of VGAM2263 correlate with, and may be deduced from, the identity of the host target genes which VGAM2263 binds and inhibits, and the function of these host target genes, as elaborated hereinbelow.

Nucleotide sequences of the VGAM2263 precursor RNA, herein designated VGAM PRECURSOR RNA, and of the 'diced' VGAM2263 RNA, herein designated VGAM RNA, and a schematic representation of the secondary folding of VGAM2263 folded precursor RNA, herein designated VGAM FOLDED PRECURSOR RNA, of VGAM2263 are further described hereinbelow with reference to Table 1.

Nucleotide sequences of host target binding sites, such as BINDING SITE-I, BINDING SITE-II and BINDING SITE-III of FIG. 1, found on VGAM2263 host target RNA, and schematic representation of the complementarity of each of these host target binding sites to VGAM2263 RNA, herein designated VGAM RNA, are described hereinbelow with reference to Table 2.

As mentioned hereinabove with reference to FIG. 1, a function of VGAM2263 gene, herein designated VGAM is inhibition of expression of VGAM2263 target genes. It is appreciated that specific functions, and accordingly utilities, of VGAM2263 correlate with, and may be deduced from, the identity of the target genes which VGAM2263 binds and inhibits, and the function of these target genes, as elaborated hereinbelow.

GTP Cyclohydrolase 1 (dopa-responsive dystonia) (GCH1, Accession NM_000161) is a VGAM2263 host target gene. GCH1 BINDING SITE is HOST TARGET binding site found in the 3' untranslated region of mRNA encoded by GCH1, corresponding to a HOST TARGET binding site such as BINDING SITE I, BINDING SITE II or BINDING SITE III. Table 2 illustrates the complementarity of the nucleotide sequences of GCH1 BINDING SITE, designated SEQ ID:5665, to the nucleotide sequence of VGAM2263 RNA, herein designated VGAM RNA, also designated SEQ ID:4974.

A function of VGAM2263 is therefore inhibition of GTP Cyclohydrolase 1 (dopa-responsive dystonia) (GCH1, Accession NM_000161). Accordingly, utilities of VGAM2263 include diagnosis, prevention and treatment of diseases and clinical conditions associated with GCH1. RAN Binding Protein 2-like 1 (RANBP2L1, Accession NM_032260) is another VGAM2263 host target gene. RANBP2L1 BINDING SITE is HOST TARGET binding site found in the 5' untranslated region of mRNA encoded by RANBP2L1, corresponding to a HOST TARGET binding site such as BINDING SITE I, BINDING SITE II or BINDING SITE III. Table 2 illustrates the complementarity of the nucleotide sequences of RANBP2L1 BINDING SITE, designated SEQ ID:26004, to the nucleotide sequence of VGAM2263 RNA, herein designated VGAM RNA, also designated SEQ ID:4974.

Another function of VGAM2263 is therefore inhibition of RAN Binding Protein 2-like 1 (RANBP2L1, Accession NM_032260). Accordingly, utilities of VGAM2263 include diagnosis, prevention and treatment of diseases and clinical conditions associated with RANBP2L1. Single-minded Homolog 1 (Drosophila) (SIM1, Accession NM_005068) is another VGAM2263 host target gene. SIM1 BINDING SITE is HOST TARGET binding site found in the 3' untranslated region of mRNA encoded by SIM1, corresponding to a HOST TARGET binding site such as BINDING SITE I, BINDING SITE II or BINDING SITE III. Table 2 illustrates the complementarity of the nucleotide sequences of SIM1 BINDING SITE, designated SEQ ID:11510, to the nucleotide sequence of VGAM2263 RNA, herein designated VGAM RNA, also designated SEQ ID:4974.

Another function of VGAM2263 is therefore inhibition of Single-minded Homolog 1 (Drosophila) (SIM1, Accession NM_005068), a gene which may have pleiotropic effects during embryogenesis and in the adult. Accordingly, utilities of VGAM2263 include diagnosis, prevention and treatment of diseases and clinical conditions associated with SIM1. The function of SIM1 and its association with various diseases and clinical conditions, has been established by previous studies, as described hereinabove with reference to VGAM665. Potassium Voltage-gated Channel, Delayed-rectifier, Subfamily S, Member 1 (KCNS1, Accession NM_002251) is another VGAM2263 host target gene. KCNS1 BINDING SITE is HOST TARGET binding site found in the 5' untranslated region of mRNA encoded by KCNS1, corresponding to a HOST TARGET binding site such as BINDING SITE I, BINDING SITE II or BINDING SITE III. Table 2 illustrates the complementarity of the nucleotide sequences of KCNS1 BINDING SITE, designated SEQ ID:8045, to the nucleotide sequence of VGAM2263 RNA, herein designated VGAM RNA, also designated SEQ ID:4974.

Another function of VGAM2263 is therefore inhibition of Potassium Voltage-gated Channel, Delayed-rectifier, Subfamily S, Member 1 (KCNS1, Accession NM_002251). Accordingly, utilities of VGAM2263 include diagnosis, prevention and treatment of diseases and clinical conditions associated with KCNS1. KIAA0446 (Accession XM_044155) is another VGAM2263 host target gene. KIAA0446 BINDING SITE is HOST TARGET binding site found in the 5' untranslated region of mRNA encoded by KIAA0446, corresponding to a HOST TARGET binding site such as BINDING SITE I, BINDING SITE II or BINDING SITE III. Table 2 illustrates the complementarity of the nucleotide sequences of KIAA0446 BINDING SITE, designated SEQ ID:34155, to the nucleotide sequence of VGAM2263 RNA, herein designated VGAM RNA, also designated SEQ ID:4974.

Another function of VGAM2263 is therefore inhibition of KIAA0446 (Accession XM_044155). Accordingly, utilities of VGAM2263 include diagnosis, prevention and treatment of diseases and clinical conditions associated with KIAA0446. KIAA1828 (Accession XM_057526) is another VGAM2263 host target gene. KIAA1828 BINDING SITE is HOST TARGET binding site found in the 5' untranslated region of mRNA encoded by KIAA1828, corresponding to a HOST TARGET binding site such as BINDING SITE I, BINDING SITE II or BINDING SITE III. Table 2 illustrates the complementarity of the nucleotide sequences of KIAA1828 BINDING SITE, designated SEQ ID:36525, to the nucleotide sequence of VGAM2263 RNA, herein designated VGAM RNA, also designated SEQ ID:4974.

Another function of VGAM2263 is therefore inhibition of KIAA1828 (Accession XM_057526). Accordingly, utilities of VGAM2263 include diagnosis, prevention and treatment of diseases and clinical conditions associated with KIAA1828. Zinc Finger, DHHC Domain Containing 3 (ZDHHC3, Accession NM_016598) is another VGAM2263 host target gene. ZDHHC3 BINDING SITE is HOST TARGET binding site found in the 3' untranslated region of mRNA encoded by ZDHHC3, corresponding to a HOST TARGET binding site such as BINDING SITE I, BINDING SITE II or BINDING SITE III. Table 2 illustrates the complementarity of the nucleotide sequences of ZDHHC3 BINDING SITE, designated SEQ ID:18691, to the nucleotide sequence of VGAM2263 RNA, herein designated VGAM RNA, also designated SEQ ID:4974.

Another function of VGAM2263 is therefore inhibition of Zinc Finger, DHHC Domain Containing 3 (ZDHHC3, Accession NM_016598). Accordingly, utilities of VGAM2263 include diagnosis, prevention and treatment of diseases and clinical conditions associated with ZDHHC3. LOC130813 (Accession XM_065904) is another VGAM2263 host target gene. LOC130813 BINDING SITE is HOST TARGET binding site found in the 3' untranslated region of mRNA encoded by LOC130813, corresponding to a HOST TARGET binding site such as BINDING SITE I, BINDING SITE II or BINDING SITE III. Table 2 illustrates the complementarity of the nucleotide sequences of LOC130813 BINDING SITE, designated SEQ ID:37308, to the nucleotide sequence of VGAM2263 RNA, herein designated VGAM RNA, also designated SEQ ID:4974.

Another function of VGAM2263 is therefore inhibition of LOC130813 (Accession XM_065904). Accordingly, utilities of VGAM2263 include diagnosis, prevention and treatment of diseases and clinical conditions associated with LOC130813. LOC150759 (Accession XM_086995) is another VGAM2263 host target gene. LOC150759 BINDING SITE is HOST TARGET binding site found in the 3' untranslated region of mRNA encoded by LOC150759, corresponding to a HOST TARGET binding site such as BINDING SITE I, BINDING SITE II or BINDING SITE III. Table 2 illustrates the complementarity of the nucleotide sequences of LOC150759 BINDING SITE, designated SEQ ID:39014, to the nucleotide sequence of VGAM2263 RNA, herein designated VGAM RNA, also designated SEQ ID:4974.

Another function of VGAM2263 is therefore inhibition of LOC150759 (Accession XM_086995). Accordingly, utilities of VGAM2263 include diagnosis, prevention and treatment of diseases and clinical conditions associated with LOC150759. LOC151323 (Accession XM_087168) is another VGAM2263 host target gene. LOC151323 BINDING SITE is HOST TARGET binding site found in the 3' untranslated region of mRNA encoded by LOC151323, corresponding to a HOST TARGET binding site such as BINDING SITE I, BINDING SITE II or BINDING SITE III. Table 2 illustrates the complementarity of the nucleotide sequences of LOC151323 BINDING SITE, designated SEQ ID:39103, to the nucleotide sequence of VGAM2263 RNA, herein designated VGAM RNA, also designated SEQ ID:4974.

Another function of VGAM2263 is therefore inhibition of LOC151323 (Accession XM_087168). Accordingly, utilities of VGAM2263 include diagnosis, prevention and treatment of diseases and clinical conditions associated with LOC151323. LOC200399 (Accession XM_114226) is another VGAM2263 host target gene. LOC200399 BINDING SITE is HOST TARGET binding site found in the 3' untranslated region of mRNA encoded by LOC200399, corresponding to a HOST TARGET binding site such as BINDING SITE I, BINDING SITE II or BINDING SITE III. Table 2 illustrates the complementarity of the nucleotide sequences of LOC200399 BINDING SITE, designated SEQ ID:42811, to the nucleotide sequence of VGAM2263 RNA, herein designated VGAM RNA, also designated SEQ ID:4974.

Another function of VGAM2263 is therefore inhibition of LOC200399 (Accession XM_114226). Accordingly, utilities of VGAM2263 include diagnosis, prevention and treatment of diseases and clinical conditions associated with LOC200399. FIG. 1 further provides a conceptual description of a novel bioinformatically detected viral gene of the present invention, referred to here as Viral Genomic Address Messenger 2264 (VGAM2264) viral gene, which modulates expression of respective host target genes thereof, the function and utility of which host target genes is known in the art.

VGAM2264 is a novel bioinformatically detected regulatory, non protein coding, viral micro RNA (miRNA) gene. The method by which VGAM2264 was detected is described hereinabove with reference to FIGS. 1-8.

VGAM2264 gene, herein designated VGAM GENE, is a viral gene contained in the genome of Alcelaphine Herpesvirus 1. VGAM2264 host target gene, herein designated VGAM HOST TARGET GENE, is a human gene contained in the human genome.

VGAM2264 gene encodes a VGAM2264 precursor RNA, herein designated VGAM PRECURSOR RNA. Similar to other miRNA genes, and unlike most ordinary genes, VGAM2264 precursor RNA does not encode a protein. A nucleotide sequence identical or highly similar to the nucleotide sequence of VGAM2264 precursor RNA is designated SEQ ID:2250, and is provided hereinbelow with reference to the sequence listing part. Nucleotide sequence SEQ ID:2250 is located at position 20319 relative to the genome of Alcelaphine Herpesvirus 1.

VGAM2264 precursor RNA folds onto itself, forming VGAM2264 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2264 folded precursor RNA into VGAM2264 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2264 RNA is designated SEQ ID:4975, and is provided hereinbelow with reference to the sequence listing part.

VGAM2264 host target gene, herein designated VGAM HOST TARGET GENE, encodes a corresponding messenger RNA, VGAM2264 host target RNA, herein designated VGAM HOST TARGET RNA. VGAM2264 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2264 RNA, herein designated VGAM RNA, binds complementarily to one or more host target binding sites located in untranslated regions of VGAM2264 host target RNA, herein designated VGAM HOST TARGET RNA. This complementary binding is due to the fact that the nucleotide sequence of VGAM2264 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2264 RNA, herein designated VGAM RNA, may have a different number of host target binding sites in untranslated regions of a VGAM2264 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2264 RNA, herein designated VGAM RNA, to host target binding sites on VGAM2264 host target RNA, herein designated VGAM HOST TARGET RNA, such as BINDING SITE I, BINDING SITE II and BINDING SITE III, inhibits translation of VGAM2264 host target RNA into VGAM2264 host target protein, herein designated VGAM HOST TARGET PROTEIN. VGAM host target protein is therefore outlined by a broken line.

It is appreciated that VGAM2264 host target gene, herein designated VGAM HOST TARGET GENE, in fact represents a plurality of VGAM2264 host target genes. The mRNA of each one of this plurality of VGAM2264 host target genes comprises one or more host target binding sites, each having a nucleotide sequence which is at least partly complementary to VGAM2264 RNA, herein designated VGAM RNA, and which when bound by VGAM2264 RNA causes inhibition of translation of respective one or more VGAM2264 host target proteins.

It is further appreciated by one skilled in the art that the mode of translational inhibition illustrated by FIG. 1 with specific reference to translational inhibition exerted by VGAM2264 gene, herein designated VGAM GENE, on one or more VGAM2264 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2264 is inhibition of expression of host target genes, as part of a novel viral mechanism of attacking a host. Accordingly, utilities of VGAM2264 include diagnosis, prevention and treatment of viral infection by Alcelaphine Herpesvirus 1. Specific functions, and accordingly utilities, of VGAM2264 correlate with, and may be deduced from, the identity of the host target genes which VGAM2264 binds and inhibits, and the function of these host target genes, as elaborated hereinbelow.

Nucleotide sequences of the VGAM2264 precursor RNA, herein designated VGAM PRECURSOR RNA, and of the 'diced' VGAM2264 RNA, herein designated VGAM RNA, and a schematic representation of the secondary folding of VGAM2264 folded precursor RNA, herein designated VGAM FOLDED PRECURSOR RNA, of VGAM2264 are further described hereinbelow with reference to Table 1.

Nucleotide sequences of host target binding sites, such as BINDING SITE-I, BINDING SITE-II and BINDING SITE-III of FIG. 1, found on VGAM2264 host target RNA, and schematic representation of the complementarity of each of these host target binding sites to VGAM2264 RNA, herein designated VGAM RNA, are described hereinbelow with reference to Table 2.

As mentioned hereinabove with reference to FIG. 1, a function of VGAM2264 gene, herein designated VGAM is inhibition of expression of VGAM2264 target genes. It is appreciated that specific functions, and accordingly utilities, of VGAM2264 correlate with, and may be deduced from, the identity of the target genes which VGAM2264 binds and inhibits, and the function of these target genes, as elaborated hereinbelow.

COX11 Homolog, Cytochrome C Oxidase Assembly Protein (yeast) (COX11, Accession NM_004375) is a VGAM2264 host target gene. COX11 BINDING SITE is HOST TARGET binding site found in the 3' untranslated region of mRNA encoded by COX11, corresponding to a HOST TARGET binding site such as BINDING SITE I, BINDING SITE II or BINDING SITE III. Table 2 illustrates the complementarity of the nucleotide sequences of COX11 BINDING SITE, designated SEQ ID:10593, to the nucleotide sequence of VGAM2264 RNA, herein designated VGAM RNA, also designated SEQ ID:4975.

A function of VGAM2264 is therefore inhibition of COX11 Homolog, Cytochrome C Oxidase Assembly Protein (yeast) (COX11, Accession NM_004375). Accordingly, utilities of VGAM2264 include diagnosis, prevention and treatment of diseases and clinical conditions associated with COX11. Chemokine (C-X-C motif) Ligand 13 (B-cell chemoattractant) (CXCL13, Accession NM_006419) is another VGAM2264 host target gene. CXCL13 BINDING SITE is HOST TARGET binding site found in the 3' untranslated region of mRNA encoded by CXCL13, corresponding to a HOST TARGET binding site such as BINDING SITE I, BINDING SITE II or BINDING SITE III. Table 2 illustrates the complementarity of the nucleotide sequences of CXCL13 BINDING SITE, designated SEQ ID:13135, to the nucleotide sequence of VGAM2264 RNA, herein designated VGAM RNA, also designated SEQ ID:4975.

Another function of VGAM2264 is therefore inhibition of Chemokine (C-X-C motif) Ligand 13 (B-cell chemoattractant) (CXCL13, Accession NM_006419), a gene which plays a role in directing the migration of b lymphocytes to follicles. Accordingly, utilities of VGAM2264 include diagnosis, prevention and treatment of diseases and clinical conditions associated with CXCL13. The function of CXCL13 and its association with various diseases and clinical conditions, has been established by previous studies, as described hereinabove with reference to VGAM1276. Myotubularin Related Protein 6 (MTMR6, Accession XM_167970) is another VGAM2264 host target gene. MTMR6 BINDING SITE is HOST TARGET binding site found in the 3' untranslated region of mRNA encoded by MTMR6, corresponding to a HOST TARGET binding site such as BINDING SITE I, BINDING SITE II or BINDING SITE III. Table 2 illustrates the complementarity of the nucleotide sequences of MTMR6 BINDING SITE, designated SEQ ID:44937, to the nucleotide sequence of VGAM2264 RNA, herein designated VGAM RNA, also designated SEQ ID:4975.

Another function of VGAM2264 is therefore inhibition of Myotubularin Related Protein 6 (MTMR6, Accession XM_167970). Accordingly, utilities of VGAM2264 include diagnosis, prevention and treatment of diseases and clinical conditions associated with MTMR6. Hairy/enhancer-of-split Related with YRPW Motif 2 (HEY2, Accession NM_012259) is another VGAM2264 host target gene. HEY2 BINDING SITE is HOST TARGET binding site found in the 3' untranslated region of mRNA encoded by HEY2, corresponding to a HOST TARGET binding site such as BINDING SITE I, BINDING SITE II or BINDING SITE III. Table 2 illustrates the complementarity of the nucleotide sequences of HEY2 BINDING SITE, designated SEQ ID:14565, to the nucleotide sequence of VGAM2264 RNA, herein designated VGAM RNA, also designated SEQ ID:4975.

Another function of VGAM2264 is therefore inhibition of Hairy/enhancer-of-split Related with YRPW Motif 2 (HEY2, Accession NM_012259). Accordingly, utilities of VGAM2264 include diagnosis, prevention and treatment of diseases and clinical conditions associated with HEY2. KIAA0546 (Accession XM_049055) is another VGAM2264 host target gene. KIAA0546 BINDING SITE is HOST TARGET binding site found in the 3' untranslated region of mRNA encoded by KIAA0546, corresponding to a HOST TARGET binding site such as BINDING SITE I, BINDING SITE II or BINDING SITE III. Table 2 illustrates the complementarity of the nucleotide sequences of KIAA0546 BINDING SITE, designated SEQ ID:35330, to the nucleotide sequence of VGAM2264 RNA, herein designated VGAM RNA, also designated SEQ ID:4975.

Another function of VGAM2264 is therefore inhibition of KIAA0546 (Accession XM_049055). Accordingly, utilities of VGAM2264 include diagnosis, prevention and treatment of diseases and clinical conditions associated with KIAA0546. KIAA1511 (Accession XM_046581) is another VGAM2264 host target gene. KIAA1511 BINDING SITE is HOST TARGET binding site found in the 3' untranslated region of mRNA encoded by KIAA1511, corresponding to a HOST TARGET binding site such as BINDING SITE I, BINDING SITE II or BINDING SITE III. Table 2 illustrates the complementarity of the nucleotide sequences of KIAA1511 BINDING SITE, designated SEQ ID:34755, to the nucleotide sequence of VGAM2264 RNA, herein designated VGAM RNA, also designated SEQ ID:4975.

Another function of VGAM2264 is therefore inhibition of KIAA1511 (Accession XM_046581). Accordingly, utilities of VGAM2264 include diagnosis, prevention and treatment of diseases and clinical conditions associated with KIAA1511. Phosphodiesterase 1C, Calmodulin-dependent 70kDa (PDE1C, Accession NM_005020) is another VGAM2264 host target gene. PDE1C BINDING SITE1 and PDE1C BINDING SITE2 are HOST TARGET binding sites found in untranslated regions of mRNA encoded by PDE1C, corresponding to HOST TARGET binding sites such as BINDING SITE I, BINDING SITE II or BINDING SITE III. Table 2 illustrates the complementarity of the nucleotide sequences of PDE1C BINDING SITE1 and PDE1C BINDING SITE2, designated SEQ ID:11458 and SEQ ID:11459 respectively, to the nucleotide sequence of VGAM2264 RNA, herein designated VGAM RNA, also designated SEQ ID:4975.

Another function of VGAM2264 is therefore inhibition of Phosphodiesterase 1C, Calmodulin-dependent 70 kDa (PDE1C, Accession NM_005020). Accordingly, utilities of VGAM2264 include diagnosis, prevention and treatment of diseases and clinical conditions associated with PDE1C. LOC169436 (Accession XM_095696) is another VGAM2264 host target gene. LOC169436 BINDING SITE is HOST TARGET binding site found in the 5' untranslated region of mRNA encoded by LOC169436, corresponding to a HOST TARGET binding site such as BINDING SITE I, BINDING SITE II or BINDING SITE III. Table 2 illustrates the complementarity of the nucleotide sequences of LOC169436 BINDING SITE, designated SEQ ID:40277, to the nucleotide sequence of VGAM2264 RNA, herein designated VGAM RNA, also designated SEQ ID:4975.

Another function of VGAM2264 is therefore inhibition of LOC169436 (Accession XM_095696). Accordingly, utilities of VGAM2264 include diagnosis, prevention and treatment of diseases and clinical conditions associated with LOC169436. LOC92399 (Accession NM_138777) is another VGAM2264 host target gene. LOC92399 BINDING SITE is HOST TARGET binding site found in the 3' untranslated region of mRNA encoded by LOC92399, corresponding to a HOST TARGET binding site such as BINDING SITE I, BINDING SITE II or BINDING SITE III. Table 2 illustrates the complementarity of the nucleotide sequences of LOC92399 BINDING SITE, designated SEQ ID:29012, to the nucleotide sequence of VGAM2264 RNA, herein designated VGAM RNA, also designated SEQ ID:4975.

Another function of VGAM2264 is therefore inhibition of LOC92399 (Accession NM_138777). Accordingly, utilities of VGAM2264 include diagnosis, prevention and treatment of diseases and clinical conditions associated with LOC92399. FIG. 1 further provides a conceptual description of a novel bioinformatically detected viral gene of the present invention, referred to here as Viral Genomic Address Messenger 2265 (VGAM2265) viral gene, which modulates expression of respective host target genes thereof, the function and utility of which host target genes is known in the art.

VGAM2265 is a novel bioinformatically detected regulatory, non protein coding, viral micro RNA (miRNA) gene. The method by which VGAM2265 was detected is described hereinabove with reference to FIGS. 1-8.

VGAM2265 gene, herein designated VGAM GENE, is a viral gene contained in the genome of Alcelaphine Herpesvirus 1. VGAM2265 host target gene, herein designated VGAM HOST TARGET GENE, is a human gene contained in the human genome.

VGAM2265 gene encodes a VGAM2265 precursor RNA, herein designated VGAM PRECURSOR RNA. Similar to other miRNA genes, and unlike most ordinary genes, VGAM2265 precursor RNA does not encode a protein. A nucleotide sequence identical or highly similar to the nucleotide sequence of VGAM2265 precursor RNA is designated SEQ ID:2251, and is provided hereinbelow with reference to the sequence listing part. Nucleotide sequence SEQ ID:2251 is located at position 27645 relative to the genome of Alcelaphine Herpesvirus 1.

VGAM2265 precursor RNA folds onto itself, forming VGAM2265 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2265 folded precursor RNA into VGAM2265 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2265 RNA is designated SEQ ID:4976, and is provided hereinbelow with reference to the sequence listing part.

VGAM2265 host target gene, herein designated VGAM HOST TARGET GENE, encodes a corresponding messenger RNA, VGAM2265 host target RNA, herein designated VGAM HOST TARGET RNA. VGAM2265 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2265 RNA, herein designated VGAM RNA, binds complementarily to one or more host target binding sites located in untranslated regions of VGAM2265 host target RNA, herein designated VGAM HOST TARGET RNA. This complementary binding is due to the fact that the nucleotide sequence of VGAM2265 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2265 RNA, herein designated VGAM RNA, may have a different number of host target binding sites in untranslated regions of a VGAM2265 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2265 RNA, herein designated VGAM RNA, to host target binding sites on VGAM2265 host target RNA, herein designated VGAM HOST TARGET RNA, such as BINDING SITE I, BINDING SITE II and BINDING SITE III, inhibits translation of VGAM2265 host target RNA into VGAM2265 host target protein, herein designated VGAM HOST TARGET PROTEIN. VGAM host target protein is therefore outlined by a broken line.

It is appreciated that VGAM2265 host target gene, herein designated VGAM HOST TARGET GENE, in fact represents a plurality of VGAM2265 host target genes. The mRNA of each one of this plurality of VGAM2265 host target genes comprises one or more host target binding sites, each having a nucleotide sequence which is at least partly complementary to VGAM2265 RNA, herein designated VGAM RNA, and which when bound by VGAM2265 RNA causes inhibition of translation of respective one or more VGAM2265 host target proteins.

It is further appreciated by one skilled in the art that the mode of translational inhibition illustrated by FIG. 1 with specific reference to translational inhibition exerted by VGAM2265 gene, herein designated VGAM GENE, on one or more VGAM2265 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2265 is inhibition of expression of host target genes, as part of a novel viral mechanism of attacking a host. Accordingly, utilities of VGAM2265 include diagnosis, prevention and treatment of viral infection by Alcelaphine Herpesvirus 1. Specific functions, and accordingly utilities, of VGAM2265 correlate with, and may be deduced from, the identity of the host target genes which VGAM2265 binds and inhibits, and the function of these host target genes, as elaborated hereinbelow.

Nucleotide sequences of the VGAM2265 precursor RNA, herein designated VGAM PRECURSOR RNA, and of the 'diced' VGAM2265 RNA, herein designated VGAM RNA, and a schematic representation of the secondary folding of VGAM2265 folded precursor RNA, herein designated VGAM FOLDED PRECURSOR RNA, of VGAM2265 are further described hereinbelow with reference to Table 1.

Nucleotide sequences of host target binding sites, such as BINDING SITE-I, BINDING SITE-II and BINDING SITE-III of FIG. 1, found on VGAM2265 host target RNA, and schematic representation of the complementarity of each of these host target binding sites to VGAM2265 RNA, herein designated VGAM RNA, are described hereinbelow with reference to Table 2.

As mentioned hereinabove with reference to FIG. 1, a function of VGAM2265 gene, herein designated VGAM is inhibition of expression of VGAM2265 target genes. It is appreciated that specific functions, and accordingly utilities, of VGAM2265 correlate with, and may be deduced from, the identity of the target genes which VGAM2265 binds and inhibits, and the function of these target genes, as elaborated hereinbelow.

Rho GTPase Activating Protein 6 (ARHGAP6, Accession NM_001174) is a VGAM2265 host target gene. ARHGAP6 BINDING SITE1 and ARHGAP6 BINDING SITE2 are HOST TARGET binding sites found in untranslated regions of mRNA encoded by ARHGAP6, corresponding to HOST TARGET binding sites such as BINDING SITE I, BINDING SITE II or BINDING SITE III. Table 2 illustrates the complementarity of the nucleotide sequences of ARHGAP6 BINDING SITE1 and ARHGAP6 BINDING SITE2, designated SEQ ID:6839 and SEQ ID:15083 respectively, to the nucleotide sequence of VGAM2265 RNA, herein designated VGAM RNA, also designated SEQ ID:4976.

A function of VGAM2265 is therefore inhibition of Rho GTPase Activating Protein 6 (ARHGAP6, Accession NM_001174), a gene which activates the rho-type GTPases by converting them to an inactive GTP-bound state. Accordingly, utilities of VGAM2265 include diagnosis, prevention and treatment of diseases and clinical conditions associated with ARHGAP6. The function of ARHGAP6 and its association with various diseases and clinical conditions, has been established by previous studies, as described hereinabove with reference to VGAM55. Proteasome (prosome, macropain) Subunit, Beta Type, 9 (large multifunctional protease 2) (PSMB9, Accession NM_002800) is another VGAM2265 host target gene. PSMB9 BINDING SITE is HOST TARGET binding site found in the 3' untranslated region of mRNA encoded by PSMB9, corresponding to a HOST TARGET binding site such as BINDING SITE I, BINDING SITE II or BINDING SITE III. Table 2 illustrates the complementarity of the nucleotide sequences of PSMB9 BINDING SITE, designated SEQ ID:8674, to the nucleotide sequence of VGAM2265 RNA, herein designated VGAM RNA, also designated SEQ ID:4976.

Another function of VGAM2265 is therefore inhibition of Proteasome (prosome, macropain) Subunit, Beta Type, 9 (large multifunctional protease 2) (PSMB9, Accession NM_002800), a gene which is one component of a multicatalytic proteinase complex. Accordingly, utilities of VGAM2265 include diagnosis, prevention and treatment of diseases and clinical conditions associated with PSMB9. The function of PSMB9 and its association with various diseases and clinical conditions, has been established by previous studies, as described hereinabove with reference to VGAM1915. CGG Triplet Repeat Binding Protein 1 (CGGBP1, Accession NM_003663) is another VGAM2265 host target gene. CGGBP1 BINDING SITE is HOST TARGET binding site found in the 3' untranslated region of mRNA encoded by CGGBP1, corresponding to a HOST TARGET binding site such as BINDING SITE I, BINDING SITE II or BINDING SITE III. Table 2 illustrates the complementarity of the nucleotide sequences of CGGBP1 BINDING SITE, designated SEQ ID:9736, to the nucleotide sequence of VGAM2265 RNA, herein designated VGAM RNA, also designated SEQ ID:4976.

Another function of VGAM2265 is therefore inhibition of CGG Triplet Repeat Binding Protein 1 (CGGBP1, Accession NM_003663). Accordingly, utilities of VGAM2265 include diagnosis, prevention and treatment of diseases and clinical conditions associated with CGGBP1. Dual Specificity Phosphatase 10 (DUSP10, Accession NM_007207) is another VGAM2265 host target gene. DUSP10 BINDING SITE1 and DUSP10 BINDING SITE2 are HOST TARGET binding sites found in untranslated regions of mRNA encoded by DUSP10, corresponding to HOST TARGET binding sites such as BINDING SITE I, BINDING SITE II or BINDING SITE III. Table 2 illustrates the complementarity of the nucleotide sequences of DUSP10 BINDING SITE1 and DUSP10 BINDING SITE2, designated SEQ ID:14070 and SEQ ID:29554 respectively, to the nucleotide sequence of VGAM2265 RNA, herein designated VGAM RNA, also designated SEQ ID:4976.

Another function of VGAM2265 is therefore inhibition of Dual Specificity Phosphatase 10 (DUSP10, Accession NM_007207). Accordingly, utilities of VGAM2265 include diagnosis, prevention and treatment of diseases and clinical conditions associated with DUSP10. KIAA0140 (Accession NM_014661) is another VGAM2265 host target gene. KIAA0140 BINDING SITE is HOST TARGET binding site found in the 3' untranslated region of mRNA encoded by KIAA0140, corresponding to a HOST TARGET binding site such as BINDING SITE I, BINDING SITE II or BINDING SITE III. Table 2 illustrates the complementarity of the nucleotide sequences of KIAA0140 BINDING SITE, designated SEQ ID:16106, to the nucleotide sequence of VGAM2265 RNA, herein designated VGAM RNA, also designated SEQ ID:4976.

Another function of VGAM2265 is therefore inhibition of KIAA0140 (Accession NM_014661). Accordingly, utilities of VGAM2265 include diagnosis, prevention and treatment of diseases and clinical conditions associated with KIAA0140. KIAA1211 (Accession XM_044178) is another VGAM2265 host target gene. KIAA1211 BINDING SITE is HOST TARGET binding site found in the 3' untranslated region of mRNA encoded by KIAA1211, corresponding to a HOST TARGET binding site such as BINDING SITE I, BINDING SITE II or BINDING SITE III. Table 2 illustrates the complementarity of the nucleotide sequences of KIAA1211 BINDING SITE, designated SEQ ID:34157, to the nucleotide sequence of VGAM2265 RNA, herein designated VGAM RNA, also designated SEQ ID:4976.

Another function of VGAM2265 is therefore inhibition of KIAA1211 (Accession XM_044178). Accordingly, utilities of VGAM2265 include diagnosis, prevention and treatment of diseases and clinical conditions associated with KIAA1211. KIAA1676 (Accession XM_167612) is another VGAM2265 host target gene. KIAA1676 BINDING SITE is HOST TARGET binding site found in the 3' untranslated region of mRNA encoded by KIAA1676, corresponding to a HOST TARGET binding site such as BINDING SITE I, BINDING SITE II or BINDING SITE III. Table 2 illustrates the complementarity of the nucleotide sequences of KIAA1676 BINDING SITE, designated SEQ ID:44723, to the nucleotide sequence of VGAM2265 RNA, herein designated VGAM RNA, also designated SEQ ID:4976.

Another function of VGAM2265 is therefore inhibition of KIAA1676 (Accession XM_167612). Accordingly, utilities of VGAM2265 include diagnosis, prevention and treatment of diseases and clinical conditions associated with KIAA1676. Microtubule-actin Crosslinking Factor 1 (MACF1, Accession NM_033044) is another VGAM2265 host target gene. MACF1 BINDING SITE is HOST TARGET binding site found in the 3' untranslated region of mRNA encoded by MACF1, corresponding to a HOST TARGET binding site such as BINDING SITE I, BINDING SITE II or BINDING SITE III. Table 2 illustrates the complementarity of the nucleotide sequences of MACF1 BINDING SITE, designated SEQ ID:26933, to the nucleotide sequence of VGAM2265 RNA, herein designated VGAM RNA, also designated SEQ ID:4976.

Another function of VGAM2265 is therefore inhibition of Microtubule-actin Crosslinking Factor 1 (MACF1, Accession NM_033044). Accordingly, utilities of VGAM2265 include diagnosis, prevention and treatment of diseases and clinical conditions associated with MACF1. Makorin, Ring Finger Protein, 2 (MKRN2, Accession XM_051580) is another VGAM2265 host target gene. MKRN2 BINDING SITE is HOST TARGET binding site found in the 3' untranslated region of mRNA encoded by MKRN2, corresponding to a HOST TARGET binding site such as BINDING SITE I, BINDING SITE II or BINDING SITE III. Table 2 illustrates the complementarity of the nucleotide sequences of MKRN2 BINDING SITE, designated SEQ ID:35855, to the nucleotide sequence of VGAM2265 RNA, herein designated VGAM RNA, also designated SEQ ID:4976.

Another function of VGAM2265 is therefore inhibition of Makorin, Ring Finger Protein, 2 (MKRN2, Accession XM_051580). Accordingly, utilities of VGAM2265 include diagnosis, prevention and treatment of diseases and clinical conditions associated with MKRN2. POPX1 (Accession NM_014906) is another VGAM2265 host target gene. POPX1 BINDING SITE is HOST TARGET binding site found in the 3' untranslated region of mRNA encoded by POPX1, corresponding to a HOST TARGET binding site such as BINDING SITE I, BINDING SITE II or BINDING SITE III. Table 2 illustrates the complementarity of the nucleotide sequences of POPX1 BINDING SITE, designated SEQ ID:17114, to the nucleotide sequence of VGAM2265 RNA, herein designated VGAM RNA, also designated SEQ ID:4976.

Another function of VGAM2265 is therefore inhibition of POPX1 (Accession NM_014906). Accordingly, utilities of VGAM2265 include diagnosis, prevention and treatment of diseases and clinical conditions associated with POPX1. TRIP-Br2 (Accession NM_014755) is another VGAM2265 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16478, to the nucleotide sequence of VGAM2265 RNA, herein designated VGAM RNA, also designated SEQ ID:4976.

Another function of VGAM2265 is therefore inhibition of TRIP-Br2 (Accession NM_014755). Accordingly, utilities of VGAM2265 include diagnosis, prevention and treatment of diseases and clinical conditions associated with TRIP-Br2. LOC144997 (Accession XM_096702) is another VGAM2265 host target gene. LOC144997 BINDING SITE is HOST TARGET binding site found in the 3' untranslated region of mRNA encoded by LOC144997, corresponding to a HOST TARGET binding site such as BINDING SITE I, BINDING SITE II or BINDING SITE III. Table 2 illustrates the complementarity of the nucleotide sequences of LOC144997 BINDING SITE, designated SEQ ID:40481, to the nucleotide sequence of VGAM2265 RNA, herein designated VGAM RNA, also designated SEQ ID:4976.

Another function of VGAM2265 is therefore inhibition of LOC144997 (Accession XM_096702). Accordingly, utilities of VGAM2265 include diagnosis, prevention and treatment of diseases and clinical conditions associated with LOC144997. LOC159053 (Accession XM_099021) is another VGAM2265 host target gene. LOC159053 BINDING SITE is HOST TARGET binding site found in the 3' untranslated region of mRNA encoded by LOC159053, corresponding to a HOST TARGET binding site such as BINDING SITE I, BINDING SITE II or BINDING SITE III. Table 2 illustrates the complementarity of the nucleotide sequences of LOC159053 BINDING SITE, designated SEQ ID:42059, to the nucleotide sequence of VGAM2265 RNA, herein designated VGAM RNA, also designated SEQ ID:4976.

Another function of VGAM2265 is therefore inhibition of LOC159053 (Accession XM_099021). Accordingly, utilities of VGAM2265 include diagnosis, prevention and treatment of diseases and clinical conditions associated with LOC159053. FIG. 1 further provides a conceptual description of a novel bioinformatically detected viral gene of the present invention, referred to here as Viral Genomic Address Messenger 2266 (VGAM2266) viral gene, which modulates expression of respective host target genes thereof, the function and utility of which host target genes is known in the art.

VGAM2266 is a novel bioinformatically detected regulatory, non protein coding, viral micro RNA (miRNA) gene. The method by which VGAM2266 was detected is described hereinabove with reference to FIGS. 1-8.

VGAM2266 gene, herein designated VGAM GENE, is a viral gene contained in the genome of Alcelaphine Herpesvirus 1. VGAM2266 host target gene, herein designated VGAM HOST TARGET GENE, is a human gene contained in the human genome.

VGAM2266 gene encodes a VGAM2266 precursor RNA, herein designated VGAM PRECURSOR RNA. Similar to other miRNA genes, and unlike most ordinary genes, VGAM2266 precursor RNA does not encode a protein. A nucleotide sequence identical or highly similar to the nucleotide sequence of VGAM2266 precursor RNA is designated SEQ ID:2252, and is provided hereinbelow with reference to the sequence listing part. Nucleotide sequence SEQ ID:2252 is located at position 27936 relative to the genome of Alcelaphine Herpesvirus 1.

VGAM2266 precursor RNA folds onto itself, forming VGAM2266 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2266 folded precursor RNA into VGAM2266 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2266 RNA is designated SEQ ID:4977, and is provided hereinbelow with reference to the sequence listing part.

VGAM2266 host target gene, herein designated VGAM HOST TARGET GENE, encodes a corresponding messenger RNA, VGAM2266 host target RNA, herein designated VGAM HOST TARGET RNA. VGAM2266 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2266 RNA, herein designated VGAM RNA, binds complementarily to one or more host target binding sites located in untranslated regions of VGAM2266 host target RNA, herein designated VGAM HOST TARGET RNA. This complementary binding is due to the fact that the nucleotide sequence of VGAM2266 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2266 RNA, herein designated VGAM RNA, may have a different number of host target binding sites in untranslated regions of a VGAM2266 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2266 RNA, herein designated VGAM RNA, to host target binding sites on VGAM2266 host target RNA, herein designated VGAM HOST TARGET RNA, such as BINDING SITE I, BINDING SITE II and BINDING SITE III, inhibits translation of VGAM2266 host target RNA into VGAM2266 host target protein, herein designated VGAM HOST TARGET PROTEIN. VGAM host target protein is therefore outlined by a broken line.

It is appreciated that VGAM2266 host target gene, herein designated VGAM HOST TARGET GENE, in fact represents a plurality of VGAM2266 host target genes. The mRNA of each one of this plurality of VGAM2266 host target genes comprises one or more host target binding sites, each having a nucleotide sequence which is at least partly complementary to VGAM2266 RNA, herein designated VGAM RNA, and which when bound by VGAM2266 RNA causes inhibition of translation of respective one or more VGAM2266 host target proteins.

It is further appreciated by one skilled in the art that the mode of translational inhibition illustrated by FIG. 1 with specific reference to translational inhibition exerted by VGAM2266 gene, herein designated VGAM GENE, on one or more VGAM2266 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2266 is inhibition of expression of host target genes, as part of a novel viral mechanism of attacking a host. Accordingly, utilities of VGAM2266 include diagnosis, prevention and treatment of viral infection by Alcelaphine Herpesvirus 1. Specific functions, and accordingly utilities, of VGAM2266 correlate with, and may be deduced from, the identity of the host target genes which VGAM2266 binds and inhibits, and the function of these host target genes, as elaborated hereinbelow.

Nucleotide sequences of the VGAM2266 precursor RNA, herein designated VGAM PRECURSOR RNA, and of the 'diced' VGAM2266 RNA, herein designated VGAM RNA, and a schematic representation of the secondary folding of VGAM2266 folded precursor RNA, herein designated VGAM FOLDED PRECURSOR RNA, of VGAM2266 are further described hereinbelow with reference to Table 1.

Nucleotide sequences of host target binding sites, such as BINDING SITE-I, BINDING SITE-II and BINDING SITE-III of FIG. 1, found on VGAM2266 host target RNA, and schematic representation of the complementarity of each of these host target binding sites to VGAM2266 RNA, herein designated VGAM RNA, are described hereinbelow with reference to Table 2.

As mentioned hereinabove with reference to FIG. 1, a function of VGAM2266 gene, herein designated VGAM is inhibition of expression of VGAM2266 target genes. It is appreciated that specific functions, and accordingly utilities, of VGAM2266 correlate with, and may be deduced from, the identity of the target genes which VGAM2266 binds and inhibits, and the function of these target genes, as elaborated hereinbelow.

Inhibitor of Kappa Light Polypeptide Gene Enhancer In B-cells, Kinase Beta (IKBKB, Accession XM_032491) is a VGAM2266 host target gene. IKBKB BINDING SITE is HOST TARGET binding site found in the 3' untranslated region of mRNA encoded by IKBKB, corresponding to a HOST TARGET binding site such as BINDING SITE I, BINDING SITE II or BINDING SITE III. Table 2 illustrates the complementarity of the nucleotide sequences of IKBKB BINDING SITE, designated SEQ ID:31662, to the nucleotide sequence of VGAM2266 RNA, herein designated VGAM RNA, also designated SEQ ID:4977.

A function of VGAM2266 is therefore inhibition of Inhibitor of Kappa Light Polypeptide Gene Enhancer In B-cells, Kinase Beta (IKBKB, Accession XM_032491), a gene which leads to the dissociation of the inhibitor/nf-kappa-b complex. Accordingly, utilities of VGAM2266 include diagnosis, prevention and treatment of diseases and clinical conditions associated with IKBKB. The function of IKBKB has been established by previous studies. Woronicz et al. (1997) observed that IKK-beta activated NF-kappa-B when overexpressed and phosphorylated serine residues 32 and 36 of I-kappa-B-alpha and 19 and 23 of I-kappa-B-beta. The activity of IKK-beta was stimulated by TNF (OMIM Ref. No. 191160) and IL1. IKK-alpha and IKK-beta formed heterodimers that interacted with NF-kappa-B-inducing kinase (NIK; 604655). Overexpression of catalytically inactive IKK-beta blocked cytokine-induced NF-kappa-B activation. Thus, the active I-kappa-B kinase complex appears to require 3 distinct protein kinases: IKK-alpha, IKK-beta, and NIK. Mercurio et al. (1997) found that mutations in IKK2 had a more pronounced effect upon NFKB activation than did comparable mutations in IKK1. Ozes et al. (1999) showed that AKT1 (OMIM Ref. No. 164730) is involved in the activation of NFKB1 by TNF, following the activation of phosphatidylinositol 3-kinase (PIK3; OMIM Ref. No. 171834). Constitutively active AKT1 induces NFKB1 activity, mediated by phosphorylation of IKK-alpha at threonine 23, which can be blocked by activated NIK. Conversely, NIK activation of NFKB1, mediated by phosphorylation of IKK-alpha at serine 176, is blocked by an AKT1 mutant lacking kinase activity (i.e., kinase dead AKT), indicating that both AKT1 and NIK are necessary for TNF activation of NFKB1 through the phosphorylation of IKK-alpha. IKK-beta is not phosphorylated by either NIK or AKT1 and is apparently differentially regulated. Tang et al. (2001) reported that IKK-beta is specifically proteolyzed by caspase-3 (OMIM Ref. No. 600636)-related caspases at aspartic acid residues 78, 242, 373, and 546 during TNF-alpha-induced apoptosis. Proteolysis of IKK-beta eliminated its enzymatic activity, interfered with IKK activation, and promoted TNF-alpha killing. Point mutations that abrogated IKK-beta proteolysis generated a caspase-resistant IKK-beta mutant that suppressed TNF-alpha-induced apoptosis. This study demonstrated that TNF-alpha-induced apoptosis requires caspase-mediated proteolysis of IKK-beta. Rossi et al. (2000) demonstrated a novel mechanism of anti-inflammatory activity that was based on the direct inhibition and modification of the IKK-beta subunit of IKK. Since IKK-beta is responsible for the activation of NF-kappa-B by proinflammatory stimuli, Rossi et al. (2000) suggested that their findings explained how cyclopentenone prostaglandins function and can be used to improve the utility of COX2 (OMIM Ref. No. 600262) inhibitors. May et al. (2000) determined that an N-terminal alpha-helical region of NEMO (OMIM Ref. No. 300248) associates with a region of IKKA and IKKB that they termed the NBD for 'NEMO-binding domain.' The NBD is a 6-amino acid C-terminal segment within the region denoted alpha-2 of IKKA and IKKB. Wildtype, but not mutant, NDB peptide inhibited cytokine-induced NFKB activation and ameliorated experimental acute inflammation Animal model experiments lend further support to the function of IKBKB. Pasparakis et al. (2002) used Cre/loxP-mediated gene targeting to investigate the function of IKK2 specifically in epidermal keratinocytes. IKK2 deficiency inhibits NFKB activation, but does not lead to cell-autonomous hyperproliferation or impaired differentiation of keratinocytes. Mice with epidermis-specific deletion of IKK2 develop a severe inflammatory skin disease, which is caused by a tumor necrosis factor (OMIM Ref. No. 191160)-mediated, alpha-beta T-cell-independent inflammatory response that develops in the skin shortly after birth. Pasparakis et al. (2002) concluded that the critical function of IKK2-mediated NFKB activity in epidermal keratinocytes is to regulate mechanisms that maintain the immune homeostasis of the skin.

It is appreciated that the abovementioned animal model for IKBKB is acknowledged by those skilled in the art as a scientifically valid animal model, as can be further appreciated from the publications sited hereinbelow.

Full details of the abovementioned studies are described in the following publications, the disclosure of which are hereby incorporated by reference:

Pasparakis, M.; Courtois, G.; Hafner, M.; Schmidt-Supprian, M.; Nenci, A.; Toksoy, A.; Krampert, M.; Goebeler, M.; Gillitzer, R.; Israel, A.; Krieg, T.; Rajewsky, K.; Haase, I.: TNF-mediated inflammatory skin disease in mice with epidermis-specific deletion of IKK2. Nature 417:861-866, 2002; and May, M. J.; d'Acquisto, F.; Madge, L. A.; Glockner, J.; Pober, J. S.; Ghosh, S. : Selective inhibition of NF-kappa-B activation by a peptide that blocks the interaction of NEMO with the.

Further studies establishing the function and utilities of IKBKB are found in John Hopkins OMIM database record ID 603258, and in sited publications numbered 8500-8176, 9198, 9201, 12739-850 and 12225 listed in the bibliography section hereinbelow, which are also hereby incorporated by reference. NORE1 (Accession NM_031437) is another VGAM2266 host target gene. NORE1 BINDING SITE is HOST TARGET binding site found in the 3' untranslated region of mRNA encoded by NORE1, corresponding to a HOST TARGET binding site such as BINDING SITE I, BINDING SITE II or BINDING SITE III. Table 2 illustrates the complementarity of the nucleotide sequences of NORE1 BINDING SITE, designated SEQ ID:25444, to the nucleotide sequence of VGAM2266 RNA, herein designated VGAM RNA, also designated SEQ ID:4977.

Another function of VGAM2266 is therefore inhibition of NORE1 (Accession NM_031437), a gene which may modulate intracellular signal transduction pathways. Accordingly, utilities of VGAM2266 include diagnosis, prevention and treatment of diseases and clinical conditions associated with NORE1. The function of NORE1 and its association with various diseases and clinical conditions, has been established by previous studies, as described hereinabove with reference to VGAM276. Heat Shock 90 kDa Protein 1, Alpha-like 3 (HSPCAL3, Accession XM_084514) is another VGAM2266 host target gene. HSPCAL3 BINDING SITE is HOST TARGET binding site found in the 3' untranslated region of mRNA encoded by HSPCAL3, corresponding to a HOST TARGET binding site such as BINDING SITE I, BINDING SITE II or BINDING SITE III. Table 2 illustrates the complementarity of the nucleotide sequences of HSPCAL3 BINDING SITE, designated SEQ ID:37617, to the nucleotide sequence of VGAM2266 RNA, herein designated VGAM RNA, also designated SEQ ID:4977.

Another function of VGAM2266 is therefore inhibition of Heat Shock 90kDa Protein 1, Alpha-like 3 (HSPCAL3, Accession XM_084514). Accordingly, utilities of VGAM2266 include diagnosis, prevention and treatment of diseases and clinical conditions associated with HSPCAL3. RTBDN (Accession NM_031429) is another VGAM2266 host target gene. RTBDN BINDING SITE is HOST TARGET binding site found in the 5' untranslated region of mRNA encoded by RTBDN, corresponding to a HOST TARGET binding site such as BINDING SITE I, BINDING SITE II or BINDING SITE III. Table 2 illustrates the complementarity of the nucleotide sequences of RTBDN BINDING SITE, designated SEQ ID:25424, to the nucleotide sequence of VGAM2266 RNA, herein designated VGAM RNA, also designated SEQ ID:4977.

Another function of VGAM2266 is therefore inhibition of RTBDN (Accession NM_031429). Accordingly, utilities of VGAM2266 include diagnosis, prevention and treatment of diseases and clinical conditions associated with RTBDN. FIG. 1 further provides a conceptual description of a novel bioinformatically detected viral gene of the present invention, referred to here as Viral Genomic Address Messenger 2267 (VGAM2267) viral gene, which modulates expression of respective host target genes thereof, the function and utility of which host target genes is known in the art.

VGAM2267 is a novel bioinformatically detected regulatory, non protein coding, viral micro RNA (miRNA) gene. The method by which VGAM2267 was detected is described hereinabove with reference to FIGS. 1-8.

VGAM2267 gene, herein designated VGAM GENE, is a viral gene contained in the genome of Alcelaphine Herpesvirus 1. VGAM2267 host target gene, herein designated VGAM HOST TARGET GENE, is a human gene contained in the human genome.

VGAM2267 gene encodes a VGAM2267 precursor RNA, herein designated VGAM PRECURSOR RNA. Similar to other miRNA genes, and unlike most ordinary genes, VGAM2267 precursor RNA does not encode a protein. A nucleotide sequence identical or highly similar to the nucleotide sequence of VGAM2267 precursor RNA is designated SEQ ID:2253, and is provided hereinbelow with reference to the sequence listing part. Nucleotide sequence SEQ ID:2253 is located at position 29434 relative to the genome of Alcelaphine Herpesvirus 1.

VGAM2267 precursor RNA folds onto itself, forming VGAM2267 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2267 folded precursor RNA into VGAM2267 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2267 RNA is designated SEQ ID:4978, and is provided hereinbelow with reference to the sequence listing part.

VGAM2267 host target gene, herein designated VGAM HOST TARGET GENE, encodes a corresponding messenger RNA, VGAM2267 host target RNA, herein designated VGAM HOST TARGET RNA. VGAM2267 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2267 RNA, herein designated VGAM RNA, binds complementarily to one or more host target binding sites located in untranslated regions of VGAM2267 host target RNA, herein designated VGAM HOST TARGET RNA. This complementary binding is due to the fact that the nucleotide sequence of VGAM2267 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2267 RNA, herein designated VGAM RNA, may have a different number of host target binding sites in untranslated regions of a VGAM2267 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2267 RNA, herein designated VGAM RNA, to host target binding sites on VGAM2267 host target RNA, herein designated VGAM HOST TARGET RNA, such as BINDING SITE I, BINDING SITE II and BINDING SITE III, inhibits translation of VGAM2267 host target RNA into VGAM2267 host target protein, herein designated VGAM HOST TARGET PROTEIN. VGAM host target protein is therefore outlined by a broken line.

It is appreciated that VGAM2267 host target gene, herein designated VGAM HOST TARGET GENE, in fact represents a plurality of VGAM2267 host target genes. The mRNA of each one of this plurality of VGAM2267 host target genes comprises one or more host target binding sites, each having a nucleotide sequence which is at least partly complementary to VGAM2267 RNA, herein designated VGAM RNA, and which when bound by VGAM2267 RNA causes inhibition of translation of respective one or more VGAM2267 host target proteins.

It is further appreciated by one skilled in the art that the mode of translational inhibition illustrated by FIG. 1 with specific reference to translational inhibition exerted by VGAM2267 gene, herein designated VGAM GENE, on one or more VGAM2267 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2267 is inhibition of expression of host target genes, as part of a novel viral mechanism of attacking a host. Accordingly, utilities of VGAM2267 include diagnosis, prevention and treatment of viral infection by Alcelaphine Herpesvirus 1. Specific functions, and accordingly utilities, of VGAM2267 correlate with, and may be deduced from, the identity of the host target genes which VGAM2267 binds and inhibits, and the function of these host target genes, as elaborated hereinbelow.

Nucleotide sequences of the VGAM2267 precursor RNA, herein designated VGAM PRECURSOR RNA, and of the 'diced' VGAM2267 RNA, herein designated VGAM RNA, and a schematic representation of the secondary folding of VGAM2267 folded precursor RNA, herein designated VGAM FOLDED PRECURSOR RNA, of VGAM2267 are further described hereinbelow with reference to Table 1.

Nucleotide sequences of host target binding sites, such as BINDING SITE-I, BINDING SITE-II and BINDING SITE-III of FIG. 1, found on VGAM2267 host target RNA, and schematic representation of the complementarity of each of these host target binding sites to VGAM2267 RNA, herein designated VGAM RNA, are described hereinbelow with reference to Table 2.

As mentioned hereinabove with reference to FIG. 1, a function of VGAM2267 gene, herein designated VGAM is inhibition of expression of VGAM2267 target genes. It is appreciated that specific functions, and accordingly utilities, of VGAM2267 correlate with, and may be deduced from, the identity of the target genes which VGAM2267 binds and inhibits, and the function of these target genes, as elaborated hereinbelow.

Histamine Receptor H1 (HRH1, Accession NM_000861) is a VGAM2267 host target gene. HRH1 BINDING SITE is HOST TARGET binding site found in the 3' untranslated region of mRNA encoded by HRH1, corresponding to a HOST TARGET binding site such as BINDING SITE I, BINDING SITE II or BINDING SITE III. Table 2 illustrates the complementarity of the nucleotide sequences of HRH1 BINDING SITE, designated SEQ ID:6524, to the nucleotide sequence of VGAM2267 RNA, herein designated VGAM RNA, also designated SEQ ID:4978.

A function of VGAM2267 is therefore inhibition of Histamine Receptor H1 (HRH1, Accession NM_000861), a gene which stimulates the synthesis of inositol phosphate. Accordingly, utilities of VGAM2267 include diagnosis, prevention and treatment of diseases and clinical conditions associated with HRH1. The function of HRH1 and its association with various diseases and clinical conditions, has been established by previous studies, as described hereinabove with reference to VGAM766. DKFZP564I122 (Accession XM_032397) is another VGAM2267 host target gene. DKFZP564I122 BINDING SITE is HOST TARGET binding site found in the 3' untranslated region of mRNA encoded by DKFZP564I122, corresponding to a HOST TARGET binding site such as BINDING SITE I, BINDING SITE II or BINDING SITE III. Table 2 illustrates the complementarity of the nucleotide sequences of DKFZP564I122 BINDING SITE, designated SEQ ID:31643, to the nucleotide sequence of VGAM2267 RNA, herein designated VGAM RNA, also designated SEQ ID:4978.

Another function of VGAM2267 is therefore inhibition of DKFZP564I122 (Accession XM_032397). Accordingly, utilities of VGAM2267 include diagnosis, prevention and treatment of diseases and clinical conditions associated with DKFZP564I122. Integrin, Alpha 10 (ITGA10, Accession XM_002097) is another VGAM2267 host target gene. ITGA10 BINDING SITE is HOST TARGET binding site found in the 5' untranslated region of mRNA encoded by ITGA10, corresponding to a HOST TARGET binding site such as BINDING SITE I, BINDING SITE II or BINDING SITE III. Table 2 illustrates the complementarity of the nucleotide sequences of ITGA10 BINDING SITE, designated SEQ ID:29866, to the nucleotide sequence of VGAM2267 RNA, herein designated VGAM RNA, also designated SEQ ID:4978.

Another function of VGAM2267 is therefore inhibition of Integrin, Alpha 10 (ITGA10, Accession XM_002097). Accordingly, utilities of VGAM2267 include diagnosis, prevention and treatment of diseases and clinical conditions associated with ITGA10. YKT6 (Accession NM_006555) is another VGAM2267 host target gene. YKT6 BINDING SITE is HOST TARGET binding site found in the 3' untranslated region of mRNA encoded by YKT6, corresponding to a HOST TARGET binding site such as BINDING SITE I, BINDING SITE II or BINDING SITE III. Table 2 illustrates the complementarity of the nucleotide sequences of YKT6 BINDING SITE, designated SEQ ID:13321, to the nucleotide sequence of VGAM2267 RNA, herein designated VGAM RNA, also designated SEQ ID:4978.

Another function of VGAM2267 is therefore inhibition of YKT6 (Accession NM_006555). Accordingly, utilities of VGAM2267 include diagnosis, prevention and treatment of diseases and clinical conditions associated with YKT6. ZFD25 (Accession NM_016220) is another VGAM2267 host target gene. ZFD25 BINDING SITE is HOST TARGET binding site found in the 3' untranslated region of mRNA encoded by ZFD25, corresponding to a HOST TARGET binding site such as BINDING SITE I, BINDING SITE II or BINDING SITE III. Table 2 illustrates the complementarity of the nucleotide sequences of ZFD25 BINDING SITE, designated SEQ ID:18324, to the nucleotide sequence of VGAM2267 RNA, herein designated VGAM RNA, also designated SEQ ID:4978.

Another function of VGAM2267 is therefore inhibition of ZFD25 (Accession NM_016220). Accordingly, utilities of VGAM2267 include diagnosis, prevention and treatment of diseases and clinical conditions associated with ZFD25. FIG. 1 further provides a conceptual description of a novel bioinformatically detected viral gene of the present invention, referred to here as Viral Genomic Address Messenger 2268 (VGAM2268) viral gene, which modulates expression of respective host target genes thereof, the function and utility of which host target genes is known in the art.

VGAM2268 is a novel bioinformatically detected regulatory, non protein coding, viral micro RNA (miRNA) gene. The method by which VGAM2268 was detected is described hereinabove with reference to FIGS. 1-8.

VGAM2268 gene, herein designated VGAM GENE, is a viral gene contained in the genome of Alcelaphine Herpesvirus 1. VGAM2268 host target gene, herein designated VGAM HOST TARGET GENE, is a human gene contained in the human genome.

VGAM2268 gene encodes a VGAM2268 precursor RNA, herein designated VGAM PRECURSOR RNA. Similar to other miRNA genes, and unlike most ordinary genes, VGAM2268 precursor RNA does not encode a protein. A nucleotide sequence identical or highly similar to the nucleotide sequence of VGAM2268 precursor RNA is designated SEQ ID:2254, and is provided hereinbelow with reference to the sequence listing part. Nucleotide sequence SEQ ID:2254 is located at position 29021 relative to the genome of Alcelaphine Herpesvirus 1.

VGAM2268 precursor RNA folds onto itself, forming VGAM2268 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2268 folded precursor RNA into VGAM2268 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2268 RNA is designated SEQ ID:4979, and is provided hereinbelow with reference to the sequence listing part.

VGAM2268 host target gene, herein designated VGAM HOST TARGET GENE, encodes a corresponding messenger RNA, VGAM2268 host target RNA, herein designated VGAM HOST TARGET RNA. VGAM2268 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2268 RNA, herein designated VGAM RNA, binds complementarily to one or more host target binding sites located in untranslated regions of VGAM2268 host target RNA, herein designated VGAM HOST TARGET RNA. This complementary binding is due to the fact that the nucleotide sequence of VGAM2268 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2268 RNA, herein designated VGAM RNA, may have a different number of host target binding sites in untranslated regions of a VGAM2268 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2268 RNA, herein designated VGAM RNA, to host target binding sites on VGAM2268 host target RNA, herein designated VGAM HOST TARGET RNA, such as BINDING SITE I, BINDING SITE II and BINDING SITE III, inhibits translation of VGAM2268 host target RNA into VGAM2268 host target protein, herein designated VGAM HOST TARGET PROTEIN. VGAM host target protein is therefore outlined by a broken line.

It is appreciated that VGAM2268 host target gene, herein designated VGAM HOST TARGET GENE, in fact represents a plurality of VGAM2268 host target genes. The mRNA of each one of this plurality of VGAM2268 host target genes comprises one or more host target binding sites, each having a nucleotide sequence which is at least partly complementary to VGAM2268 RNA, herein designated VGAM RNA, and which when bound by VGAM2268 RNA causes inhibition of translation of respective one or more VGAM2268 host target proteins.

It is further appreciated by one skilled in the art that the mode of translational inhibition illustrated by FIG. 1 with specific reference to translational inhibition exerted by VGAM2268 gene, herein designated VGAM GENE, on one or more VGAM2268 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2268 is inhibition of expression of host target genes, as part of a novel viral mechanism of attacking a host. Accordingly, utilities of VGAM2268 include diagnosis, prevention and treatment of viral infection by Alcelaphine Herpesvirus 1. Specific functions, and accordingly utilities, of VGAM2268 correlate with, and may be deduced from, the identity of the host target genes which VGAM2268 binds and inhibits, and the function of these host target genes, as elaborated hereinbelow.

Nucleotide sequences of the VGAM2268 precursor RNA, herein designated VGAM PRECURSOR RNA, and of the 'diced' VGAM2268 RNA, herein designated VGAM RNA, and a schematic representation of the secondary folding of VGAM2268 folded precursor RNA, herein designated VGAM FOLDED PRECURSOR RNA, of VGAM2268 are further described hereinbelow with reference to Table 1.

Nucleotide sequences of host target binding sites, such as BINDING SITE-I, BINDING SITE-II and BINDING SITE-III of FIG. 1, found on VGAM2268 host target RNA, and schematic representation of the complementarity of each of these host target binding sites to VGAM2268 RNA, herein designated VGAM RNA, are described hereinbelow with reference to Table 2.

As mentioned hereinabove with reference to FIG. 1, a function of VGAM2268 gene, herein designated VGAM is inhibition of expression of VGAM2268 target genes. It is appreciated that specific functions, and accordingly utilities, of VGAM2268 correlate with, and may be deduced from, the identity of the target genes which VGAM2268 binds and inhibits, and the function of these target genes, as elaborated hereinbelow.

IRTA1 (Accession NM_031282) is a VGAM2268 host target gene. IRTA1 BINDING SITE is HOST TARGET binding site found in the 3' untranslated region of mRNA encoded by IRTA1, corresponding to a HOST TARGET binding site such as BINDING SITE I, BINDING SITE II or BINDING SITE III. Table 2 illustrates the complementarity of the nucleotide sequences of IRTA1 BINDING SITE, designated SEQ ID:25304, to the nucleotide sequence of VGAM2268 RNA, herein designated VGAM RNA, also designated SEQ ID:4979.

A function of VGAM2268 is therefore inhibition of IRTA1 (Accession NM_031282). Accordingly, utilities of VGAM2268 include diagnosis, prevention and treatment of diseases and clinical conditions associated with IRTA1. Methylthioadenosine Phosphorylase (MTAP, Accession NM_002451) is another VGAM2268 host target gene. MTAP BINDING SITE is HOST TARGET binding site found in the 3' untranslated region of mRNA encoded by MTAP, corresponding to a HOST TARGET binding site such as BINDING SITE I, BINDING SITE II or BINDING SITE III. Table 2 illustrates the complementarity of the nucleotide sequences of MTAP BINDING SITE, designated SEQ ID:8288, to the nucleotide sequence of VGAM2268 RNA, herein designated VGAM RNA, also designated SEQ ID:4979.

Another function of VGAM2268 is therefore inhibition of Methylthioadenosine Phosphorylase (MTAP, Accession NM_002451), a gene which plays a major role in polyamine metabolism. Accordingly, utilities of VGAM2268 include diagnosis, prevention and treatment of diseases and clinical conditions associated with MTAP. The function of MTAP and its association with various diseases and clinical conditions, has been established by previous studies, as described hereinabove with reference to VGAM68. Prospero-related Homeobox 1 (PROX1, Accession NM_002763) is another VGAM2268 host target gene. PROX1 BINDING SITE is HOST TARGET binding site found in the 5' untranslated region of mRNA encoded by PROX1, corresponding to a HOST TARGET binding site such as BINDING SITE I, BINDING SITE II or BINDING SITE III. Table 2 illustrates the complementarity of the nucleotide sequences of PROX1 BINDING SITE, designated SEQ ID:8652, to the nucleotide sequence of VGAM2268 RNA, herein designated VGAM RNA, also designated SEQ ID:4979.

Another function of VGAM2268 is therefore inhibition of Prospero-related Homeobox 1 (PROX1, Accession NM_002763), a gene which may regulate gene expression and development of postmitotic undifferentiated young neurons. Accordingly, utilities of VGAM2268 include diagnosis, prevention and treatment of diseases and clinical conditions associated with PROX1. The function of PROX1 and its association with various diseases and clinical conditions, has been established by previous studies, as described hereinabove with reference to VGAM430. Arginyl Aminopeptidase (aminopeptidase B)-like 1 (RNPEPL1, Accession NM_018226) is another VGAM2268 host target gene. RNPEPL1 BINDING SITE is HOST TARGET binding site found in the 3' untranslated region of mRNA encoded by RNPEPL1, corresponding to a HOST TARGET binding site such as BINDING SITE I, BINDING SITE II or BINDING SITE III. Table 2 illustrates the complementarity of the nucleotide sequences of RNPEPL1 BINDING SITE, designated SEQ ID:20164, to the nucleotide sequence of VGAM2268 RNA, herein designated VGAM RNA, also designated SEQ ID:4979.

Another function of VGAM2268 is therefore inhibition of Arginyl Aminopeptidase (aminopeptidase B)-like 1 (RN- PEPL1, Accession NM_018226). Accordingly, utilities of VGAM2268 include diagnosis, prevention and treatment of diseases and clinical conditions associated with RNPEPL1. V-akt Murine Thymoma Viral Oncogene Homolog 3 (protein kinase B, gamma) (AKT3, Accession NM_005465) is another VGAM2268 host target gene. AKT3 BINDING SITE is HOST TARGET binding site found in the 3' untranslated region of mRNA encoded by AKT3, corresponding to a HOST TARGET binding site such as BINDING SITE I, BINDING SITE II or BINDING SITE III. Table 2 illustrates the complementarity of the nucleotide sequences of AKT3 BINDING SITE, designated SEQ ID:11961, to the nucleotide sequence of VGAM2268 RNA, herein designated VGAM RNA, also designated SEQ ID:4979.

Another function of VGAM2268 is therefore inhibition of V-akt Murine Thymoma Viral Oncogene Homolog 3 (protein kinase B, gamma) (AKT3, Accession NM_005465). Accordingly, utilities of VGAM2268 include diagnosis, prevention and treatment of diseases and clinical conditions associated with AKT3. Chromosome 20 Open Reading Frame 38 (C20orf38, Accession NM_018327) is another VGAM2268 host target gene. C20orf38 BINDING SITE is HOST TARGET binding site found in the 3' untranslated region of mRNA encoded by C20orf38, corresponding to a HOST TARGET binding site such as BINDING SITE I, BINDING SITE II or BINDING SITE III. Table 2 illustrates the complementarity of the nucleotide sequences of C20orf38 BINDING SITE, designated SEQ ID:20324, to the nucleotide sequence of VGAM2268 RNA, herein designated VGAM RNA, also designated SEQ ID:4979.

Another function of VGAM2268 is therefore inhibition of Chromosome 20 Open Reading Frame 38 (C20orf38, Accession NM_018327). Accordingly, utilities of VGAM2268 include diagnosis, prevention and treatment of diseases and clinical conditions associated with C20orf38. KIAA1160 (Accession NM_020701) is another VGAM2268 host target gene. KIAA1160 BINDING SITE is HOST TARGET binding site found in the 3' untranslated region of mRNA encoded by KIAA1160, corresponding to a HOST TARGET binding site such as BINDING SITE I, BINDING SITE II or BINDING SITE III. Table 2 illustrates the complementarity of the nucleotide sequences of KIAA1160 BINDING SITE, designated SEQ ID:21851, to the nucleotide sequence of VGAM2268 RNA, herein designated VGAM RNA, also designated SEQ ID:4979.

Another function of VGAM2268 is therefore inhibition of KIAA1160 (Accession NM_020701). Accordingly, utilities of VGAM2268 include diagnosis, prevention and treatment of diseases and clinical conditions associated with KIAA1160. KIAA1198 (Accession XM_032674) is another VGAM2268 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31715, to the nucleotide sequence of VGAM2268 RNA, herein designated VGAM RNA, also designated SEQ ID:4979.

Another function of VGAM2268 is therefore inhibition of KIAA1198 (Accession XM_032674). Accordingly, utilities of VGAM2268 include diagnosis, prevention and treatment of diseases and clinical conditions associated with KIAA1198. KOC1 (Accession XM_165847) is another VGAM2268 host target gene. KOC1 BINDING SITE is HOST TARGET binding site found in the 3' untranslated region of mRNA encoded by KOC1, corresponding to a HOST TARGET binding site such as BINDING SITE I, BINDING SITE II or BINDING SITE III. Table 2 illustrates the complementarity of the nucleotide sequences of KOC1 BINDING SITE, designated SEQ ID:43779, to the nucleotide sequence of VGAM2268 RNA, herein designated VGAM RNA, also designated SEQ ID:4979.

Another function of VGAM2268 is therefore inhibition of KOC1 (Accession XM_165847). Accordingly, utilities of VGAM2268 include diagnosis, prevention and treatment of diseases and clinical conditions associated with KOC1. Leiomodin 1 (smooth muscle) (LMOD1, Accession NM_012134) is another VGAM2268 host target gene. LMOD1 BINDING SITE is HOST TARGET binding site found in the 3' untranslated region of mRNA encoded by LMOD1, corresponding to a HOST TARGET binding site such as BINDING SITE I, BINDING SITE II or BINDING SITE III. Table 2 illustrates the complementarity of the nucleotide sequences of LMOD1 BINDING SITE, designated SEQ ID:14445, to the nucleotide sequence of VGAM2268 RNA, herein designated VGAM RNA, also designated SEQ ID:4979.

Another function of VGAM2268 is therefore inhibition of Leiomodin 1 (smooth muscle) (LMOD1, Accession NM_012134). Accordingly, utilities of VGAM2268 include diagnosis, prevention and treatment of diseases and clinical conditions associated with LMOD1. Polymerase (DNA directed), Mu (POLM, Accession XM_165867) is another VGAM2268 host target gene. POLM BINDING SITE is HOST TARGET binding site found in the 3' untranslated region of mRNA encoded by POLM, corresponding to a HOST TARGET binding site such as BINDING SITE I, BINDING SITE II or BINDING SITE III. Table 2 illustrates the complementarity of the nucleotide sequences of POLM BINDING SITE, designated SEQ ID:43783, to the nucleotide sequence of VGAM2268 RNA, herein designated VGAM RNA, also designated SEQ ID:4979.

Another function of VGAM2268 is therefore inhibition of Polymerase (DNA directed), Mu (POLM, Accession XM_165867). Accordingly, utilities of VGAM2268 include diagnosis, prevention and treatment of diseases and clinical conditions associated with POLM. PRP8 Pre-mRNA Processing Factor 8 Homolog (yeast) (PRPF8, Accession XM_028335) is another VGAM2268 host target gene. PRPF8 BINDING SITE is HOST TARGET binding site found in the 3' untranslated region of mRNA encoded by PRPF8, corresponding to a HOST TARGET binding site such as BINDING SITE I, BINDING SITE II or BINDING SITE III. Table 2 illustrates the complementarity of the nucleotide sequences of PRPF8 BINDING SITE, designated SEQ ID:30676, to the nucleotide sequence of VGAM2268 RNA, herein designated VGAM RNA, also designated SEQ ID:4979.

Another function of VGAM2268 is therefore inhibition of PRP8 Pre-mRNA Processing Factor 8 Homolog (yeast) (PRPF8, Accession XM_028335). Accordingly, utilities of VGAM2268 include diagnosis, prevention and treatment of diseases and clinical conditions associated with PRPF8. Regulatory Factor X, 4 (influences HLA class II expression) (RFX4, Accession NM_032491) is another VGAM2268 host target gene. RFX4 BINDING SITE is HOST TARGET binding site found in the 3' untranslated region of mRNA encoded by RFX4, corresponding to a HOST TARGET binding site such as BINDING SITE I, BINDING SITE II or BINDING SITE III. Table 2 illustrates the complementarity of the nucleotide sequences of RFX4 BINDING SITE, designated SEQ ID:26243, to the nucleotide sequence of VGAM2268 RNA, herein designated VGAM RNA, also designated SEQ ID:4979.

Another function of VGAM2268 is therefore inhibition of Regulatory Factor X, 4 (influences HLA class II expression) (RFX4, Accession NM_032491). Accordingly, utilities of VGAM2268 include diagnosis, prevention and treatment of diseases and clinical conditions associated with RFX4. Rho-related BTB Domain Containing 3 (RHOBTB3, Accession NM_014899) is another VGAM2268 host target gene. RHOBTB3 BINDING SITE is HOST TARGET binding site found in the 3' untranslated region of mRNA encoded by RHOBTB3, corresponding to a HOST TARGET binding site such as BINDING SITE I, BINDING SITE II or BINDING SITE III. Table 2 illustrates the complementarity of the nucleotide sequences of RHOBTB3 BINDING SITE, designated SEQ ID:17077, to the nucleotide sequence of VGAM2268 RNA, herein designated VGAM RNA, also designated SEQ ID:4979.

Another function of VGAM2268 is therefore inhibition of Rho-related BTB Domain Containing 3 (RHOBTB3, Accession NM_014899). Accordingly, utilities of VGAM2268 include diagnosis, prevention and treatment of diseases and clinical conditions associated with RHOBTB3. RLUCL (Accession NM_058192) is another VGAM2268 host target gene. RLUCL BINDING SITE is HOST TARGET binding site found in the 3' untranslated region of mRNA encoded by RLUCL, corresponding to a HOST TARGET binding site such as BINDING SITE I, BINDING SITE II or BINDING SITE III. Table 2 illustrates the complementarity of the nucleotide sequences of RLUCL BINDING SITE, designated SEQ ID:27753, to the nucleotide sequence of VGAM2268 RNA, herein designated VGAM RNA, also designated SEQ ID:4979.

Another function of VGAM2268 is therefore inhibition of RLUCL (Accession NM_058192). Accordingly, utilities of VGAM2268 include diagnosis, prevention and treatment of diseases and clinical conditions associated with RLUCL. Ring Finger Protein (C3HC4 type) 8 (RNF8, Accession NM_003958) is another VGAM2268 host target gene. RNF8 BINDING SITE is HOST TARGET binding site found in the 3' untranslated region of mRNA encoded by RNF8, corresponding to a HOST TARGET binding site such as BINDING SITE I, BINDING SITE II or BINDING SITE III. Table 2 illustrates the complementarity of the nucleotide sequences of RNF8 BINDING SITE, designated SEQ ID:10102, to the nucleotide sequence of VGAM2268 RNA, herein designated VGAM RNA, also designated SEQ ID:4979.

Another function of VGAM2268 is therefore inhibition of Ring Finger Protein (C3HC4 type) 8 (RNF8, Accession NM_003958). Accordingly, utilities of VGAM2268 include diagnosis, prevention and treatment of diseases and clinical conditions associated with RNF8. Ubiquitin Specific Protease 8 (USP8, Accession NM_005154) is another VGAM2268 host target gene. USP8 BINDING SITE is HOST TARGET binding site found in the 3' untranslated region of mRNA encoded by USP8, corresponding to a HOST TARGET binding site such as BINDING SITE I, BINDING SITE II or BINDING SITE III. Table 2 illustrates the complementarity of the nucleotide sequences of USP8 BINDING SITE, designated SEQ ID:11632, to the nucleotide sequence of VGAM2268 RNA, herein designated VGAM RNA, also designated SEQ ID:4979.

Another function of VGAM2268 is therefore inhibition of Ubiquitin Specific Protease 8 (USP8, Accession NM_005154). Accordingly, utilities of VGAM2268 include diagnosis, prevention and treatment of diseases and clinical conditions associated with USP8. LOC144438 (Accession XM_084860) is another VGAM2268 host target gene. LOC144438 BINDING SITE is HOST TARGET binding site found in the 3' untranslated region of mRNA encoded by LOC144438, corresponding to a HOST TARGET binding site such as BINDING SITE I, BINDING SITE II or BINDING SITE III. Table 2 illustrates the complementarity of the nucleotide sequences of LOC144438 BINDING SITE, designated SEQ ID:37741, to the nucleotide sequence of VGAM2268 RNA, herein designated VGAM RNA, also designated SEQ ID:4979.

Another function of VGAM2268 is therefore inhibition of LOC144438 (Accession XM_084860). Accordingly, utilities of VGAM2268 include diagnosis, prevention and treatment of diseases and clinical conditions associated with LOC144438. LOC196955 (Accession XM_085210) is another VGAM2268 host target gene. LOC196955 BINDING SITE is HOST TARGET binding site found in the 5' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37942, to the nucleotide sequence of VGAM2268 RNA, herein designated VGAM RNA, also designated SEQ ID:4979.

Another function of VGAM2268 is therefore inhibition of LOC196955 (Accession XM_085210). Accordingly, utilities of VGAM2268 include diagnosis, prevention and treatment of diseases and clinical conditions associated with LOC196955. LOC200488 (Accession XM_117240) is another VGAM2268 host target gene. LOC200488 BINDING SITE is HOST TARGET binding site found in the 5' untranslated region of mRNA encoded by LOC200488, corresponding to a HOST TARGET binding site such as BINDING SITE I, BINDING SITE II or BINDING SITE III. Table 2 illustrates the complementarity of the nucleotide sequences of LOC200488 BINDING SITE, designated SEQ ID:43317, to the nucleotide sequence of VGAM2268 RNA, herein designated VGAM RNA, also designated SEQ ID:4979.

Another function of VGAM2268 is therefore inhibition of LOC200488 (Accession XM_117240). Accordingly, utilities of VGAM2268 include diagnosis, prevention and treatment of diseases and clinical conditions associated with LOC200488. LOC200940 (Accession XM_114324) is another VGAM2268 host target gene. LOC200940 BINDING SITE is HOST TARGET binding site found in the 5' untranslated region of mRNA encoded by LOC200940, corresponding to a HOST TARGET binding site such as BINDING SITE I, BINDING SITE II or BINDING SITE III. Table 2 illustrates the complementarity of the nucleotide sequences of LOC200940 BINDING SITE, designated SEQ ID:42875, to the nucleotide sequence of VGAM2268 RNA, herein designated VGAM RNA, also designated SEQ ID:4979.

Another function of VGAM2268 is therefore inhibition of LOC200940 (Accession XM_114324). Accordingly, utilities of VGAM2268 include diagnosis, prevention and treatment of diseases and clinical conditions associated with LOC200940. LOC255057 (Accession XM_170903) is another VGAM2268 host target gene. LOC255057 BINDING SITE is HOST TARGET binding site found in the 3' untranslated region of mRNA encoded by LOC255057, corresponding to a HOST TARGET binding site such as BINDING SITE I, BINDING SITE II or BINDING SITE III. Table 2 illustrates the complementarity of the nucleotide sequences of LOC255057 BINDING SITE, designated SEQ ID:45662, to the nucleotide sequence of VGAM2268 RNA, herein designated VGAM RNA, also designated SEQ ID:4979.

Another function of VGAM2268 is therefore inhibition of LOC255057 (Accession XM_170903). Accordingly, utilities of VGAM2268 include diagnosis, prevention and treatment of diseases and clinical conditions associated with LOC255057. FIG. 1 further provides a conceptual description of a novel bioinformatically detected viral gene of the present invention, referred to here as Viral Genomic Address Messenger 2269 (VGAM2269) viral gene, which modulates expression of respective host target genes thereof, the function and utility of which host target genes is known in the art.

VGAM2269 is a novel bioinformatically detected regulatory, non protein coding, viral micro RNA (miRNA) gene. The method by which VGAM2269 was detected is described hereinabove with reference to FIGS. 1-8.

VGAM2269 gene, herein designated VGAM GENE, is a viral gene contained in the genome of Alcelaphine Herpesvirus 1. VGAM2269 host target gene, herein designated VGAM HOST TARGET GENE, is a human gene contained in the human genome.

VGAM2269 gene encodes a VGAM2269 precursor RNA, herein designated VGAM PRECURSOR RNA. Similar to other miRNA genes, and unlike most ordinary genes, VGAM2269 precursor RNA does not encode a protein. A nucleotide sequence identical or highly similar to the nucleotide sequence of VGAM2269 precursor RNA is designated SEQ ID:2255, and is provided hereinbelow with reference to the sequence listing part. Nucleotide sequence SEQ ID:2255 is located at position 30842 relative to the genome of Alcelaphine Herpesvirus 1.

VGAM2269 precursor RNA folds onto itself, forming VGAM2269 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2269 folded precursor RNA into VGAM2269 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM2269 RNA is designated SEQ ID:4980, and is provided hereinbelow with reference to the sequence listing part.

VGAM2269 host target gene, herein designated VGAM HOST TARGET GENE, encodes a corresponding messenger RNA, VGAM2269 host target RNA, herein designated VGAM HOST TARGET RNA. VGAM2269 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2269 RNA, herein designated VGAM RNA, binds complementarily to one or more host target binding sites located in untranslated regions of VGAM2269 host target RNA, herein designated VGAM HOST TARGET RNA. This complementary binding is due to the fact that the nucleotide sequence of VGAM2269 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2269 RNA, herein designated VGAM RNA, may have a different number of host target binding sites in untranslated regions of a VGAM2269 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2269 RNA, herein designated VGAM RNA, to host target binding sites on VGAM2269 host target RNA, herein designated VGAM HOST TARGET RNA, such as BINDING SITE I, BINDING SITE II and BINDING SITE III, inhibits translation of VGAM2269 host target RNA into VGAM2269 host target protein, herein designated VGAM HOST TARGET PROTEIN. VGAM host target protein is therefore outlined by a broken line.

It is appreciated that VGAM2269 host target gene, herein designated VGAM HOST TARGET GENE, in fact represents a plurality of VGAM2269 host target genes. The mRNA of each one of this plurality of VGAM2269 host target genes comprises one or more host target binding sites, each having a nucleotide sequence which is at least partly complementary to VGAM2269 RNA, herein designated VGAM RNA, and which when bound by VGAM2269 RNA causes inhibition of translation of respective one or more VGAM2269 host target proteins.

It is further appreciated by one skilled in the art that the mode of translational inhibition illustrated by FIG. 1 with specific reference to translational inhibition exerted by VGAM2269 gene, herein designated VGAM GENE, on one or more VGAM2269 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2269 is inhibition of expression of host target genes, as part of a novel viral mechanism of attacking a host. Accordingly, utilities of VGAM2269 include diagnosis, prevention and treatment of viral infection by Alcelaphine Herpesvirus 1. Specific functions, and accordingly utilities, of VGAM2269 correlate with, and may be deduced from, the identity of the host target genes which VGAM2269 binds and inhibits, and the function of these host target genes, as elaborated hereinbelow.

Nucleotide sequences of the VGAM2269 precursor RNA, herein designated VGAM PRECURSOR RNA, and of the 'diced' VGAM2269 RNA, herein designated VGAM RNA, and a schematic representation of the secondary folding of VGAM2269 folded precursor RNA, herein designated VGAM FOLDED PRECURSOR RNA, of VGAM2269 are further described hereinbelow with reference to Table 1.

Nucleotide sequences of host target binding sites, such as BINDING SITE-I, BINDING SITE-II and BINDING SITE-III of FIG. 1, found on VGAM2269 host target RNA, and schematic representation of the complementarity of each of these host target binding sites to VGAM2269 RNA, herein designated VGAM RNA, are described hereinbelow with As mentioned hereinabove with reference to FIG. 1, a function of VGAM2269 gene, herein designated VGAM is inhibition of expression of VGAM2269 target genes. It is appreciated that specific functions, and accordingly utilities, of VGAM2269 correlate with, and may be deduced from, the identity of the target genes which VGAM2269 binds and inhibits, and the function of these target genes, as elaborated hereinbelow.

A Kinase (PRKA) Anchor Protein 13 (AKAP13, Accession XM_116974) is a VGAM2269 host target gene. AKAP13 BINDING SITE is HOST TARGET binding site found in the 3' untranslated region of mRNA encoded by AKAP13, corresponding to a HOST TARGET binding site such as BINDING SITE I, BINDING SITE II or BINDING SITE III. Table 2 illustrates the complementarity of the nucleotide sequences of AKAP13 BINDING SITE, designated SEQ ID:43180, to the nucleotide sequence of VGAM2269 RNA, herein designated VGAM RNA, also designated SEQ ID:4980.

A function of VGAM2269 is therefore inhibition of A Kinase (PRKA) Anchor Protein 13 (AKAP13, Accession XM_116974), a gene which regulates subcellular localization of type II cAMP-dependent PKA. Accordingly, utilities of VGAM2269 include diagnosis, prevention and treatment of diseases and clinical conditions associated with AKAP13. The function of AKAP13 and its association with various diseases and clinical conditions, has been established by previous studies, as described hereinabove with reference to VGAM17. Aldehyde Dehydrogenase 3 Family, Member B1 (ALDH3B1, Accession XM_166190) is another VGAM2269 host target gene. ALDH3B1 BINDING SITE is HOST TARGET binding site found in the 3' untranslated region of mRNA encoded by ALDH3B1, corresponding to a HOST TARGET binding site such as BINDING SITE I, BINDING SITE II or BINDING SITE III. Table 2 illustrates the complementarity of the nucleotide sequences of ALDH3B1 BINDING SITE, designated SEQ ID:44000, to the nucleotide sequence of VGAM2269 RNA, herein designated VGAM RNA, also designated SEQ ID:4980.

Another function of VGAM2269 is therefore inhibition of Aldehyde Dehydrogenase 3 Family, Member B1 (ALDH3B1, Accession XM_166190), a gene which may play a major role in the detoxification of aldehydes generated by alcohol metabolism and lipid peroxidation. Accordingly, utilities of VGAM2269 include diagnosis, prevention and treatment of diseases and clinical conditions associated with ALDH3B1. The function of ALDH3B1 and its association with various diseases and clinical conditions, has been established by previous studies, as described hereinabove with reference to VGAM2007. Branched Chain Aminotransferase 1, Cytosolic (BCAT1, Accession XM_038659) is another VGAM2269 host target gene. BCAT1 BINDING SITE is HOST TARGET binding site found in the 3' untranslated region of mRNA encoded by BCAT1, corresponding to a HOST TARGET binding site such as BINDING SITE I, BINDING SITE II or BINDING SITE III. Table 2 illustrates the complementarity of the nucleotide sequences of BCAT1 BINDING SITE, designated SEQ ID:32897, to the nucleotide sequence of VGAM2269 RNA, herein designated VGAM RNA, also designated SEQ ID:4980.

Another function of VGAM2269 is therefore inhibition of Branched Chain Aminotransferase 1, Cytosolic (BCAT1, Accession XM_038659), a gene which catalyzes of the essential branched chain leucine, isoleucine, and valine. Accordingly, utilities of VGAM2269 include diagnosis, prevention and treatment of diseases and clinical conditions associated with BCAT1. The function of BCAT1 and its association with various diseases and clinical conditions, has been established by previous studies, as described hereinabove with reference to VGAM1367. Ret Proto-oncogene (multiple endocrine neoplasia and medullary thyroid carcinoma 1, Hirschsprung disease) (RET, Accession NM_020630) is another VGAM2269 host target gene. RET BINDING SITE is HOST TARGET binding site found in the 3' untranslated region of mRNA encoded by RET, corresponding to a HOST TARGET binding site such as BINDING SITE I, BINDING SITE II or BINDING SITE III. Table 2 illustrates the complementarity of the nucleotide sequences of RET BINDING SITE, designated SEQ ID:21789, to the nucleotide sequence of VGAM2269 RNA, herein designated VGAM RNA, also designated SEQ ID:4980.

Another function of VGAM2269 is therefore inhibition of Ret Proto-oncogene (multiple endocrine neoplasia and medullary thyroid carcinoma 1, Hirschsprung disease) (RET, Accession NM_020630), a gene which transduces signals for cell growth and differentiation. Accordingly, utilities of VGAM2269 include diagnosis, prevention and treatment of diseases and clinical conditions associated with RET. The function of RET and its association with various diseases and clinical conditions, has been established by previous studies, as described hereinabove with reference to VGAM381. Regulator of G-protein Signalling 5 (RGS5, Accession NM_003617) is another VGAM2269 host target gene. RGS5 BINDING SITE is HOST TARGET binding site found in the 3' untranslated region of mRNA encoded by RGS5, corresponding to a HOST TARGET binding site such as BINDING SITE I, BINDING SITE II or BINDING SITE III. Table 2 illustrates the complementarity of the nucleotide sequences of RGS5 BINDING SITE, designated SEQ ID:9680, to the nucleotide sequence of VGAM2269 RNA, herein designated VGAM RNA, also designated SEQ ID:4980.

Another function of VGAM2269 is therefore inhibition of Regulator of G-protein Signalling 5 (RGS5, Accession NM_003617). Accordingly, utilities of VGAM2269 include diagnosis, prevention and treatment of diseases and clinical conditions associated with RGS5. Roundabout, Axon Guidance Receptor, Homolog 1 (Drosophila) (ROBO1, Accession NM_133631) is another VGAM2269 host target gene. ROBO1 BINDING SITE is HOST TARGET binding site found in the 5' untranslated region of mRNA encoded by ROBO1, corresponding to a HOST TARGET binding site such as BINDING SITE I, BINDING SITE II or BINDING SITE III. Table 2 illustrates the complementarity of the nucleotide sequences of ROBO1 BINDING SITE, designated SEQ ID:28588, to the nucleotide sequence of VGAM2269 RNA, herein designated VGAM RNA, also designated SEQ ID:4980.

Another function of VGAM2269 is therefore inhibition of Roundabout, Axon Guidance Receptor, Homolog 1 (Drosophila) (ROBO1, Accession NM_133631), a gene which is an axon guidance receptor. Accordingly, utilities of VGAM2269 include diagnosis, prevention and treatment of diseases and clinical conditions associated with ROBO1. The function of ROBO1 and its association with various diseases and clinical conditions, has been established by previous studies, as described hereinabove with reference to VGAM37. Syndecan 4 (amphiglycan, ryudocan) (SDC4, Accession NM_002999) is another VGAM2269 host target gene. SDC4 BINDING SITE is HOST TARGET binding site found in the 3' untranslated region of mRNA encoded by SDC4, corresponding to a HOST TARGET binding site such as BINDING SITE I, BINDING SITE II or BINDING SITE III. Table 2 illustrates the complementarity of the nucleotide sequences of SDC4 BINDING SITE, designated SEQ ID:8894, to the nucleotide sequence of VGAM2269 RNA, herein designated VGAM RNA, also designated SEQ ID:4980.

Another function of VGAM2269 is therefore inhibition of Syndecan 4 (amphiglycan, ryudocan) (SDC4, Accession NM_002999), a gene which is a cell surface proteoglycan. Accordingly, utilities of VGAM2269 include diagnosis, prevention and treatment of diseases and clinical conditions associated with SDC4. The function of SDC4 and its association with various diseases and clinical conditions, has been established by previous studies, as described hereinabove with reference to VGAM552. Solute Carrier Family 21 (prostaglandin transporter), Member 2 (SLC21A2, Accession NM_005630) is another VGAM2269 host target gene. SLC21A2 BINDING SITE is HOST TARGET binding site found in the 3' untranslated region of mRNA encoded by SLC21A2, corresponding to a HOST TARGET binding site such as BINDING SITE I, BINDING SITE II or BINDING SITE III. Table 2 illustrates the complementarity of the nucleotide sequences of SLC21A2 BINDING SITE, designated SEQ ID:12160, to the nucleotide sequence of VGAM2269 RNA, herein designated VGAM RNA, also designated SEQ ID:4980.

Another function of VGAM2269 is therefore inhibition of Solute Carrier Family 21 (prostaglandin transporter), Member 2 (SLC21A2, Accession NM_005630), a gene which is a Prostaglandin transporter. Accordingly, utilities of VGAM2269 include diagnosis, prevention and treatment of diseases and clinical conditions associated with SLC21A2. The function of SLC21A2 and its association with various diseases and clinical conditions, has been established by previous studies, as described hereinabove with reference to VGAM83. T-cell Acute Lymphocytic Leukemia 1 (TAL1, Accession NM_003189) is another VGAM2269 host target gene. TAL1 BINDING SITE is HOST TARGET binding site found in the 3' untranslated region of mRNA encoded by TAL1, corresponding to a HOST TARGET binding site such as BINDING SITE I, BINDING SITE II or BINDING SITE III. Table 2 illustrates the complementarity of the nucleotide sequences of TAL1 BINDING SITE, designated SEQ ID:9174, to the nucleotide sequence of VGAM2269 RNA, herein designated VGAM RNA, also designated SEQ ID:4980.

Another function of VGAM2269 is therefore inhibition of T-cell Acute Lymphocytic Leukemia 1 (TAL1, Accession NM_003189), a gene which may help control cell growth and differentiation. Accordingly, utilities of VGAM2269 include diagnosis, prevention and treatment of diseases and clinical conditions associated with TAL1. The function of TAL1 and its association with various diseases and clinical conditions, has been established by previous studies, as described hereinabove with reference to VGAM172. Ubiquitin-conjugating Enzyme E2L 3 (UBE2L3, Accession NM_003347) is another VGAM2269 host target gene. UBE2L3 BINDING SITE is HOST TARGET binding site found in the 3' untranslated region of mRNA encoded by UBE2L3, corresponding to a HOST TARGET binding site such as BINDING SITE I, BINDING SITE II or BINDING SITE III. Table 2 illustrates the complementarity of the nucleotide sequences of UBE2L3 BINDING SITE, designated SEQ ID:9362, to the nucleotide sequence of VGAM2269 RNA, herein designated VGAM RNA, also designated SEQ ID:4980.

Another function of VGAM2269 is therefore inhibition of Ubiquitin-conjugating Enzyme E2L 3 (UBE2L3, Accession NM_003347), a gene which catalyzes the covalent attachment of ubiquitin to other proteins. Accordingly, utilities of VGAM2269 include diagnosis, prevention and treatment of diseases and clinical conditions associated with UBE2L3. The function of UBE2L3 and its association with various diseases and clinical conditions, has been established by previous studies, as described hereinabove with reference to VGAM215. Calsyntenin 1 (CLSTN1, Accession NM_014944) is another VGAM2269 host target gene. CLSTN1 BINDING SITE is HOST TARGET binding site found in the 5' untranslated region of mRNA encoded by CLSTN1, corresponding to a HOST TARGET binding site such as BINDING SITE I, BINDING SITE II or BINDING SITE III. Table 2 illustrates the complementarity of the nucleotide sequences of CLSTN1 BINDING SITE, designated SEQ ID:17258, to the nucleotide sequence of VGAM2269 RNA, herein designated VGAM RNA, also designated SEQ ID:4980.

Another function of VGAM2269 is therefore inhibition of Calsyntenin 1 (CLSTN1, Accession NM_014944). Accordingly, utilities of VGAM2269 include diagnosis, prevention and treatment of diseases and clinical conditions associated with CLSTN1. D21S2056E (Accession NM_003683) is another VGAM2269 host target gene. D21S2056E BINDING SITE is HOST TARGET binding site found in the 3' untranslated region of mRNA encoded by D21S2056E, corresponding to a HOST TARGET binding site such as BINDING SITE I, BINDING SITE II or BINDING SITE III. Table 2 illustrates the complementarity of the nucleotide sequences of D21S2056E BINDING SITE, designated SEQ ID:9790, to the nucleotide sequence of VGAM2269 RNA, herein designated VGAM RNA, also designated SEQ ID:4980.

Another function of VGAM2269 is therefore inhibition of D21S2056E (Accession NM_003683). Accordingly, utilities of VGAM2269 include diagnosis, prevention and treatment of diseases and clinical conditions associated with D21S2056E. Fatty Acid Desaturase 2 (FADS2, Accession NM_004265) is another VGAM2269 host target gene. FADS2 BINDING SITE is HOST TARGET binding site found in the 3' untranslated region of mRNA encoded by FADS2, corresponding to a HOST TARGET binding site such as BINDING SITE I, BINDING SITE II or BINDING SITE III. Table 2 illustrates the complementarity of the nucleotide sequences of FADS2 BINDING SITE, designated SEQ ID:10470, to the nucleotide sequence of VGAM2269 RNA, herein designated VGAM RNA, also designated SEQ ID:4980.

Another function of VGAM2269 is therefore inhibition of Fatty Acid Desaturase 2 (FADS2, Accession NM_004265). Accordingly, utilities of VGAM2269 include diagnosis, prevention and treatment of diseases and clinical conditions associated with FADS2. FLJ13265 (Accession NM_024877) is another VGAM2269 host target gene. FLJ13265 BINDING SITE is HOST TARGET binding site found in the 3' untranslated region of mRNA encoded by FLJ13265, corresponding to a HOST TARGET binding site such as BINDING SITE I, BINDING SITE II or BINDING SITE III. Table 2 illustrates the complementarity of the nucleotide sequences of FLJ13265 BINDING SITE, designated SEQ ID:24314, to the nucleotide sequence of VGAM2269 RNA, herein designated VGAM RNA, also designated SEQ ID:4980.

Another function of VGAM2269 is therefore inhibition of FLJ13265 (Accession NM_024877). Accordingly, utilities of VGAM2269 include diagnosis, prevention and treatment of diseases and clinical conditions associated with FLJ13265. KIAA1854 (Accession XM_049884) is another VGAM2269 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35538, to the nucleotide sequence of VGAM2269 RNA, herein designated VGAM RNA, also designated SEQ ID:4980.

Another function of VGAM2269 is therefore inhibition of KIAA1854 (Accession XM_049884). Accordingly, utilities of VGAM2269 include diagnosis, prevention and treatment of diseases and clinical conditions associated with KIAA1854. KIAA1855 (Accession XM_166453) is another VGAM2269 host target gene. KIAA1855 BINDING SITE is HOST TARGET binding site found in the 3' untranslated region of mRNA encoded by KIAA1855, corresponding to a HOST TARGET binding site such as BINDING SITE I, BINDING SITE II or BINDING SITE III. Table 2 illustrates the complementarity of the nucleotide sequences of KIAA1855 BINDING SITE, designated SEQ ID:44363, to the nucleotide sequence of VGAM2269 RNA, herein designated VGAM RNA, also designated SEQ ID:4980.

Another function of VGAM2269 is therefore inhibition of KIAA1855 (Accession XM_166453). Accordingly, utilities of VGAM2269 include diagnosis, prevention and treatment of diseases and clinical conditions associated with KIAA1855. MGC15854 (Accession NM_145029) is another VGAM2269 host target gene. MGC15854 BINDING SITE is HOST TARGET binding site found in the 5' untranslated region of mRNA encoded by MGC15854, corresponding to a HOST TARGET binding site such as BINDING SITE I, BINDING SITE II or BINDING SITE III. Table 2 illustrates the complementarity of the nucleotide sequences of MGC15854 BINDING SITE, designated SEQ ID:29646, to the nucleotide sequence of VGAM2269 RNA, herein designated VGAM RNA, also designated SEQ ID:4980.

Another function of VGAM2269 is therefore inhibition of MGC15854 (Accession NM_145029). Accordingly, utilities of VGAM2269 include diagnosis, prevention and treatment of diseases and clinical conditions associated with MGC15854. Tumor Necrosis Factor, Alpha-induced Protein 3 (TNFAIP3, Accession NM_006290) is another VGAM2269 host target gene. TNFAIP3 BINDING SITE is HOST TARGET binding site found in the 3' untranslated region of mRNA encoded by TNFAIP3, corresponding to a HOST TARGET binding site such as BINDING SITE I, BINDING SITE II or BINDING SITE III. Table 2 illustrates the complementarity of the nucleotide sequences of TNFAIP3 BINDING SITE, designated SEQ ID:12980, to the nucleotide sequence of VGAM2269 RNA, herein designated VGAM RNA, also designated SEQ ID:4980.

Another function of VGAM2269 is therefore inhibition of Tumor Necrosis Factor, Alpha-induced Protein 3 (TNFAIP3, Accession NM_006290). Accordingly, utilities of VGAM2269 include diagnosis, prevention and treatment of diseases and clinical conditions associated with TNFAIP3. TNF Receptor-associated Factor 6 (TRAF6, Accession NM_004620) is another VGAM2269 host target gene. TRAF6 BINDING SITE is HOST TARGET binding site found in the 3' untranslated region of mRNA encoded by TRAF6, corresponding to a HOST TARGET binding site such as BINDING SITE I, BINDING SITE II or BINDING SITE III. Table 2 illustrates the complementarity of the nucleotide sequences of TRAF6 BINDING SITE, designated SEQ ID:10970, to the nucleotide sequence of VGAM2269 RNA, herein designated VGAM RNA, also designated SEQ ID:4980.

Another function of VGAM2269 is therefore inhibition of TNF Receptor-associated Factor 6 (TRAF6, Accession NM_004620). Accordingly, utilities of VGAM2269 include diagnosis, prevention and treatment of diseases and clinical conditions associated with TRAF6. VPS39 (Accession XM_031720) is another VGAM2269 host target gene. VPS39 BINDING SITE is HOST TARGET binding site found in the 3' untranslated region of mRNA encoded by VPS39, corresponding to a HOST TARGET binding site such as BINDING SITE I, BINDING SITE II or BINDING SITE III. Table 2 illustrates the complementarity of the nucleotide sequences of VPS39 BINDING SITE, designated SEQ ID:31474, to the nucleotide sequence of VGAM2269 RNA, herein designated VGAM RNA, also designated SEQ ID:4980.

Another function of VGAM2269 is therefore inhibition of VPS39 (Accession XM_031720). Accordingly, utilities of VGAM2269 include diagnosis, prevention and treatment of diseases and clinical conditions associated with VPS39. WIT-1 (Accession NM_015855) is another VGAM2269 host target gene. WIT-1 BINDING SITE is HOST TARGET binding site found in the 3' untranslated region of mRNA encoded by WIT-1, corresponding to a HOST TARGET binding site such as BINDING SITE I, BINDING SITE II or BINDING SITE III. Table 2 illustrates the complementarity of the nucleotide sequences of WIT-1 BINDING SITE, designated SEQ ID:17992, to the nucleotide sequence of VGAM2269 RNA, herein designated VGAM RNA, also designated SEQ ID:4980.

Another function of VGAM2269 is therefore inhibition of WIT-1 (Accession NM_015855). Accordingly, utilities of VGAM2269 include diagnosis, prevention and treatment of diseases and clinical conditions associated with WIT-1. LOC129607 (Accession XM_059368) is another VGAM2269 host target gene. LOC129607 BINDING SITE is HOST TARGET binding site found in the 3' untranslated region of mRNA encoded by LOC129607, corresponding to a HOST TARGET binding site such as BINDING SITE I, BINDING SITE II or BINDING SITE III. Table 2 illustrates the complementarity of the nucleotide sequences of LOC129607 BINDING SITE, designated SEQ ID:36976, to the nucleotide sequence of VGAM2269 RNA, herein designated VGAM RNA, also designated SEQ ID:4980.

Another function of VGAM2269 is therefore inhibition of LOC129607 (Accession XM_059368). Accordingly, utilities of VGAM2269 include diagnosis, prevention and treatment of diseases and clinical conditions associated with LOC129607. LOC144308 (Accession XM_096575) is another VGAM2269 host target gene. LOC144308 BINDING SITE is HOST TARGET binding site found in the 3' untranslated region of mRNA encoded by LOC144308, corresponding to a HOST TARGET binding site such as BINDING SITE I, BINDING SITE II or BINDING SITE III. Table 2 illustrates the complementarity of the nucleotide sequences of LOC144308 BINDING SITE, designated SEQ ID:40409, to the nucleotide sequence of VGAM2269 RNA, herein designated VGAM RNA, also designated SEQ ID:4980.

Another function of VGAM2269 is therefore inhibition of LOC144308 (Accession XM_096575). Accordingly, utilities of VGAM2269 include diagnosis, prevention and treatment of diseases and clinical conditions associated with LOC144308. LOC145761 (Accession XM_096855) is another VGAM2269 host target gene. LOC145761 BINDING SITE is HOST TARGET binding site found in the 5' untranslated region of mRNA encoded by LOC145761, corresponding to a HOST TARGET binding site such as BINDING SITE I, BINDING SITE II or BINDING SITE III. Table 2 illustrates the complementarity of the nucleotide sequences of LOC145761 BINDING SITE, designated SEQ ID:40586, to the nucleotide sequence of VGAM2269 RNA, herein designated VGAM RNA, also designated SEQ ID:4980.

Another function of VGAM2269 is therefore inhibition of LOC145761 (Accession XM_096855). Accordingly, utilities of VGAM2269 include diagnosis, prevention and treatment of diseases and clinical conditions associated with LOC145761. LOC158310 (Accession XM_098919) is another VGAM2269 host target gene. LOC158310 BINDING SITE is HOST TARGET binding site found in the 5' untranslated region of mRNA encoded by LOC158310, corresponding to a HOST TARGET binding site such as BINDING SITE I, BINDING SITE II or BINDING SITE III. Table 2 illustrates the complementarity of the nucleotide sequences of LOC158310 BINDING SITE, designated SEQ ID:41945, to the nucleotide sequence of VGAM2269 RNA, herein designated VGAM RNA, also designated SEQ ID:4980.

Another function of VGAM2269 is therefore inhibition of LOC158310 (Accession XM_098919). Accordingly, utilities of VGAM2269 include diagnosis, prevention and treatment of diseases and clinical conditions associated with LOC158310. LOC199986 (Accession XM_117168) is another VGAM2269 host target gene. LOC199986 BINDING SITE is HOST TARGET binding site found in the 5' untranslated region of mRNA encoded by LOC199986, corresponding to a HOST TARGET binding site such as BINDING SITE I, BINDING SITE II or BINDING SITE III. Table 2 illustrates the complementarity of the nucleotide sequences of LOC199986 BINDING SITE, designated SEQ ID:43270, to the nucleotide sequence of VGAM2269 RNA, herein designated VGAM RNA, also designated SEQ ID:4980.

Another function of VGAM2269 is therefore inhibition of LOC199986 (Accession XM_117168). Accordingly, utilities of VGAM2269 include diagnosis, prevention and treatment of diseases and clinical conditions associated with LOC199986. LOC201952 (Accession XM_117345) is another VGAM2269 host target gene. LOC201952 BINDING SITE is HOST TARGET binding site found in the 5' untranslated region of mRNA encoded by LOC201952, corresponding to a HOST TARGET binding site such as BINDING SITE I, BINDING SITE II or BINDING SITE III. Table 2 illustrates the complementarity of the nucleotide sequences of LOC201952 BINDING SITE, designated SEQ ID:43396, to the nucleotide sequence of VGAM2269 RNA, herein designated VGAM RNA, also designated SEQ ID:4980.

Another function of VGAM2269 is therefore inhibition of LOC201952 (Accession XM_117345). Accordingly, utilities of VGAM2269 include diagnosis, prevention and treatment of diseases and clinical conditions associated with LOC201952. LOC219404 (Accession XM_167909) is another VGAM2269 host target gene. LOC219404 BINDING SITE is HOST TARGET binding site found in the 3' untranslated region of mRNA encoded by LOC219404, corresponding to a HOST TARGET binding site such as BINDING SITE I, BINDING SITE II or BINDING SITE III. Table 2 illustrates the complementarity of the nucleotide sequences of LOC219404 BINDING SITE, designated SEQ ID:44911, to the nucleotide sequence of VGAM2269 RNA, herein designated VGAM RNA, also designated SEQ ID:4980.

Another function of VGAM2269 is therefore inhibition of LOC219404 (Accession XM_167909). Accordingly, utilities of VGAM2269 include diagnosis, prevention and treatment of diseases and clinical conditions associated with LOC219404. LOC219653 (Accession XM_166093) is another VGAM2269 host target gene. LOC219653 BINDING SITE is HOST TARGET binding site found in the 3' untranslated region of mRNA encoded by LOC219653, corresponding to a HOST TARGET binding site such as BINDING SITE I, BINDING SITE II or BINDING SITE III. Table 2 illustrates the complementarity of the nucleotide sequences of LOC219653 BINDING SITE, designated SEQ ID:43868, to the nucleotide sequence of VGAM2269 RNA, herein designated VGAM RNA, also designated SEQ ID:4980.

Another function of VGAM2269 is therefore inhibition of LOC219653 (Accession XM_166093). Accordingly, utilities of VGAM2269 include diagnosis, prevention and treatment of diseases and clinical conditions associated with LOC219653. LOC221178 (Accession XM_167936) is another VGAM2269 host target gene. LOC221178 BINDING SITE is HOST TARGET binding site found in the 3' untranslated region of mRNA encoded by LOC221178, corresponding to a HOST TARGET binding site such as BINDING SITE I, BINDING SITE II or BINDING SITE III. Table 2 illustrates the complementarity of the nucleotide sequences of LOC221178 BINDING SITE, designated SEQ ID:44927, to the nucleotide sequence of VGAM2269 RNA, herein designated VGAM RNA, also designated SEQ ID:4980.

Another function of VGAM2269 is therefore inhibition of LOC221178 (Accession XM_167936). Accordingly, utilities of VGAM2269 include diagnosis, prevention and treatment of diseases and clinical conditions associated with LOC221178. LOC245812 (Accession XM_168296) is another VGAM2269 host target gene. LOC245812 BINDING SITE is HOST TARGET binding site found in the 3' untranslated region of mRNA encoded by LOC245812, corresponding to a HOST TARGET binding site such as BINDING SITE I, BINDING SITE II or BINDING SITE III. Table 2 illustrates the complementarity of the nucleotide sequences of LOC245812 BINDING SITE, designated SEQ ID:45100, to the nucleotide sequence of VGAM2269 RNA, herein designated VGAM RNA, also designated SEQ ID:4980.

Another function of VGAM2269 is therefore inhibition of LOC245812 (Accession XM_168296). Accordingly, utilities of VGAM2269 include diagnosis, prevention and treatment of diseases and clinical conditions associated with LOC245812. LOC91660 (Accession XM_039902) is another VGAM2269 host target gene. LOC91660 BINDING SITE is HOST TARGET binding site found in the 5' untranslated region of mRNA encoded by LOC91660, corresponding to a HOST TARGET binding site such as BINDING SITE I, BINDING SITE II or BINDING SITE III. Table 2 illustrates the complementarity of the nucleotide sequences of LOC91660 BINDING SITE, designated SEQ ID:33208, to the nucleotide sequence of VGAM2269 RNA, herein designated VGAM RNA, also designated SEQ ID:4980.

Another function of VGAM2269 is therefore inhibition of LOC91660 (Accession XM_039902). Accordingly, utilities of VGAM2269 include diagnosis, prevention and treatment of diseases and clinical conditions associated with LOC91660. LOC92689 (Accession XM_046663) is another VGAM2269 host target gene. LOC92689 BINDING SITE is HOST TARGET binding site found in the 3' untranslated region of mRNA encoded by LOC92689, corresponding to a HOST TARGET binding site such as BINDING SITE I, BINDING SITE II or BINDING SITE III. Table 2 illustrates the complementarity of the nucleotide sequences of LOC92689 BINDING SITE, designated SEQ ID:34785, to the nucleotide sequence of VGAM2269 RNA, herein designated VGAM RNA, also designated SEQ ID:4980.

Another function of VGAM2269 is therefore inhibition of LOC92689 (Accession XM_046663). Accordingly, utilities of VGAM2269 include diagnosis, prevention and treatment of diseases and clinical conditions associated with LOC92689. LOC92906 (Accession NM_138394) is another VGAM2269 host target gene. LOC92906 BINDING SITE is HOST TARGET binding site found in the 5' untranslated region of mRNA encoded by LOC92906, corresponding to a HOST TARGET binding site such as BINDING SITE I, BINDING SITE II or BINDING SITE III. Table 2 illustrates the complementarity of the nucleotide sequences of LOC92906 BINDING SITE, designated SEQ ID:28762, to the nucleotide sequence of VGAM2269 RNA, herein designated VGAM RNA, also designated SEQ ID:4980.

Another function of VGAM2269 is therefore inhibition of LOC92906 (Accession NM_138394). Accordingly, utilities of VGAM2269 include diagnosis, prevention and treatment of diseases and clinical conditions associated with LOC92906. FIG. 1 further provides a conceptual description of a novel bioinformatically detected viral gene of the present invention, referred to here as Viral Genomic Address Messenger 2270 (VGAM2270) viral gene, which modulates expression of respective host target genes thereof, the function and utility of which host target genes is known in the art.

VGAM2270 is a novel bioinformatically detected regulatory, non protein coding, viral micro RNA (miRNA) gene. The method by which VGAM2270 was detected is described hereinabove with reference to FIGS. 1-8.

VGAM2270 gene, herein designated VGAM GENE, is a viral gene contained in the genome of Alcelaphine Herpesvirus 1. VGAM2270 host target gene, herein designated VGAM HOST TARGET GENE, is a human gene contained in the human genome.

VGAM2270 gene encodes a VGAM2270 precursor RNA, herein designated VGAM PRECURSOR RNA. Similar to other miRNA genes, and unlike most ordinary genes, VGAM2270 precursor RNA does not encode a protein. A nucleotide sequence identical or highly similar to the nucleotide sequence of VGAM2270 precursor RNA is designated SEQ ID:2256, and is provided hereinbelow with reference to the sequence listing part. Nucleotide sequence SEQ ID:2256 is located at position 26539 relative to the genome of Alcelaphine Herpesvirus 1.

VGAM2270 precursor RNA folds onto itself, forming VGAM2270 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2270 folded precursor RNA into VGAM2270 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2270 RNA is designated SEQ ID:4981, and is provided hereinbelow with reference to the sequence listing part.

VGAM2270 host target gene, herein designated VGAM HOST TARGET GENE, encodes a corresponding messenger RNA, VGAM2270 host target RNA, herein designated VGAM HOST TARGET RNA. VGAM2270 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2270 RNA, herein designated VGAM RNA, binds complementarily to one or more host target binding sites located in untranslated regions of VGAM2270 host target RNA, herein designated VGAM HOST TARGET RNA. This complementary binding is due to the fact that the nucleotide sequence of VGAM2270 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2270 RNA, herein designated VGAM RNA, may have a different number of host target binding sites in untranslated regions of a VGAM2270 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2270 RNA, herein designated VGAM RNA, to host target binding sites on VGAM2270 host target RNA, herein designated VGAM HOST TARGET RNA, such as BINDING SITE I, BINDING SITE II and BINDING SITE III, inhibits translation of VGAM2270 host target RNA into VGAM2270 host target protein, herein designated VGAM HOST TARGET PROTEIN. VGAM host target protein is therefore outlined by a broken line.

It is appreciated that VGAM2270 host target gene, herein designated VGAM HOST TARGET GENE, in fact represents a plurality of VGAM2270 host target genes. The mRNA of each one of this plurality of VGAM2270 host target genes comprises one or more host target binding sites, each having a nucleotide sequence which is at least partly complementary to VGAM2270 RNA, herein designated VGAM RNA, and which when bound by VGAM2270 RNA causes inhibition of translation of respective one or more VGAM2270 host target proteins.

It is further appreciated by one skilled in the art that the mode of translational inhibition illustrated by FIG. 1 with specific reference to translational inhibition exerted by VGAM2270 gene, herein designated VGAM GENE, on one or more VGAM2270 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2270 is inhibition of expression of host target genes, as part of a novel viral mechanism of attacking a host. Accordingly, utilities of VGAM2270 include diagnosis, prevention and treatment of viral infection by Alcelaphine Herpesvirus 1. Specific functions, and accordingly utilities, of VGAM2270 correlate with, and may be deduced from, the identity of the host target genes which VGAM2270 binds and inhibits, and the function of these host target genes, as elaborated hereinbelow.

Nucleotide sequences of the VGAM2270 precursor RNA, herein designated VGAM PRECURSOR RNA, and of the 'diced' VGAM2270 RNA, herein designated VGAM RNA, and a schematic representation of the secondary folding of VGAM2270 folded precursor RNA, herein designated VGAM FOLDED PRECURSOR RNA, of VGAM2270 are further described hereinbelow with reference to Table 1.

Nucleotide sequences of host target binding sites, such as BINDING SITE-I, BINDING SITE-II and BINDING SITE-III of FIG. 1, found on VGAM2270 host target RNA, and schematic representation of the complementarity of each of these host target binding sites to VGAM2270 RNA, herein designated VGAM RNA, are described hereinbelow with reference to Table 2.

As mentioned hereinabove with reference to FIG. 1, a function of VGAM2270 gene, herein designated VGAM is inhibition of expression of VGAM2270 target genes. It is appreciated that specific functions, and accordingly utilities, of VGAM2270 correlate with, and may be deduced from, the identity of the target genes which VGAM2270 binds and inhibits, and the function of these target genes, as elaborated hereinbelow.

HEF1 (Accession NM_006403) is a VGAM2270 host target gene. HEF1 BINDING SITE is HOST TARGET binding site found in the 3' untranslated region of mRNA encoded by HEF1, corresponding to a HOST TARGET binding site such as BINDING SITE I, BINDING SITE II or BINDING SITE III. Table 2 illustrates the complementarity of the nucleotide sequences of HEF1 BINDING SITE, designated SEQ ID:13110, to the nucleotide sequence of VGAM2270 RNA, herein designated VGAM RNA, also designated SEQ ID:4981.

A function of VGAM2270 is therefore inhibition of HEF1 (Accession NM_006403). Accordingly, utilities of VGAM2270 include diagnosis, prevention and treatment of diseases and clinical conditions associated with HEF1. FIG. 1 further provides a conceptual description of a novel bioinformatically detected viral gene of the present invention, referred to here as Viral Genomic Address Messenger 2271 (VGAM2271) viral gene, which modulates expression of respective host target genes thereof, the function and utility of which host target genes is known in the art.

VGAM2271 is a novel bioinformatically detected regulatory, non protein coding, viral micro RNA (miRNA) gene. The method by which VGAM2271 was detected is described hereinabove with reference to FIGS. 1-8.

VGAM2271 gene, herein designated VGAM GENE, is a viral gene contained in the genome of Alcelaphine Herpesvirus 1. VGAM2271 host target gene, herein designated VGAM HOST TARGET GENE, is a human gene contained in the human genome.

VGAM2271 gene encodes a VGAM2271 precursor RNA, herein designated VGAM PRECURSOR RNA. Similar to other miRNA genes, and unlike most ordinary genes, VGAM2271 precursor RNA does not encode a protein. A nucleotide sequence identical or highly similar to the nucleotide sequence of VGAM2271 precursor RNA is designated SEQ ID:2257, and is provided hereinbelow with reference to the sequence listing part. Nucleotide sequence SEQ ID:2257 is located at position 29858 relative to the genome of Alcelaphine Herpesvirus 1.

VGAM2271 precursor RNA folds onto itself, forming VGAM2271 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2271 folded precursor RNA into VGAM2271 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2271 RNA is designated SEQ ID:4982, and is provided hereinbelow with reference to the sequence listing part.

VGAM2271 host target gene, herein designated VGAM HOST TARGET GENE, encodes a corresponding messenger RNA, VGAM2271 host target RNA, herein designated VGAM HOST TARGET RNA. VGAM2271 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2271 RNA, herein designated VGAM RNA, binds complementarily to one or more host target binding sites located in untranslated regions of VGAM2271 host target RNA, herein designated VGAM HOST TARGET RNA. This complementary binding is due to the fact that the nucleotide sequence of VGAM2271 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2271 RNA, herein designated VGAM RNA, may have a different number of host target binding sites in untranslated regions of a VGAM2271 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2271 RNA, herein designated VGAM RNA, to host target binding sites on VGAM2271 host target RNA, herein designated VGAM HOST TARGET RNA, such as BINDING SITE I, BINDING SITE II and BINDING SITE III, inhibits translation of VGAM2271 host target RNA into VGAM2271 host target protein, herein designated VGAM HOST TARGET PROTEIN. VGAM host target protein is therefore outlined by a broken line.

It is appreciated that VGAM2271 host target gene, herein designated VGAM HOST TARGET GENE, in fact represents a plurality of VGAM2271 host target genes. The mRNA of each one of this plurality of VGAM2271 host target genes comprises one or more host target binding sites, each having a nucleotide sequence which is at least partly complementary to VGAM2271 RNA, herein designated VGAM RNA, and which when bound by VGAM2271 RNA causes inhibition of translation of respective one or more VGAM2271 host target proteins.

It is further appreciated by one skilled in the art that the mode of translational inhibition illustrated by FIG. 1 with specific reference to translational inhibition exerted by VGAM2271 gene, herein designated VGAM GENE, on one or more VGAM2271 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let- 7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2271 is inhibition of expression of host target genes, as part of a novel viral mechanism of attacking a host. Accordingly, utilities of VGAM2271 include diagnosis, prevention and treatment of viral infection by Alcelaphine Herpesvirus 1. Specific functions, and accordingly utilities, of VGAM2271 correlate with, and may be deduced from, the identity of the host target genes which VGAM2271 binds and inhibits, and the function of these host target genes, as elaborated hereinbelow.

Nucleotide sequences of the VGAM2271 precursor RNA, herein designated VGAM PRECURSOR RNA, and of the 'diced' VGAM2271 RNA, herein designated VGAM RNA, and a schematic representation of the secondary folding of VGAM2271 folded precursor RNA, herein designated VGAM FOLDED PRECURSOR RNA, of VGAM2271 are further described hereinbelow with reference to Table 1.

Nucleotide sequences of host target binding sites, such as BINDING SITE-I, BINDING SITE-II and BINDING SITE-III of FIG. 1, found on VGAM2271 host target RNA, and schematic representation of the complementarity of each of these host target binding sites to VGAM2271 RNA, herein designated VGAM RNA, are described hereinbelow with reference to Table 2.

As mentioned hereinabove with reference to FIG. 1, a function of VGAM2271 gene, herein designated VGAM is inhibition of expression of VGAM2271 target genes. It is appreciated that specific functions, and accordingly utilities, of VGAM2271 correlate with, and may be deduced from, the identity of the target genes which VGAM2271 binds and inhibits, and the function of these target genes, as elaborated hereinbelow.

Protein Phosphatase 3 (formerly 2B), Catalytic Subunit, Alpha Isoform (calcineurin A alpha) (PPP3CA, Accession NM_000944) is a VGAM2271 host target gene. PPP3CA BINDING SITE is HOST TARGET binding site found in the 3' untranslated region of mRNA encoded by PPP3CA, corresponding to a HOST TARGET binding site such as BINDING SITE I, BINDING SITE II or BINDING SITE III. Table 2 illustrates the complementarity of the nucleotide sequences of PPP3CA BINDING SITE, designated SEQ ID:6642, to the nucleotide sequence of VGAM2271 RNA, herein designated VGAM RNA, also designated SEQ ID:4982.

A function of VGAM2271 is therefore inhibition of Protein Phosphatase 3 (formerly 2B), Catalytic Subunit, Alpha Isoform (calcineurin A alpha) (PPP3CA, Accession NM_000944), a gene which is the catalytic subunit of calcium-dependent, calmodulin-stimulated protein phosphatase. Accordingly, utilities of VGAM2271 include diagnosis, prevention and treatment of diseases and clinical conditions associated with PPP3CA. The function of PPP3CA and its association with various diseases and clinical conditions, has been established by previous studies, as described hereinabove with reference to VGAM497. Ceramide Kinase (cerk, Accession NM_022766) is another VGAM2271 host target gene. cerk BINDING SITE is HOST TARGET binding site found in the 3' untranslated region of mRNA encoded by cerk, corresponding to a HOST TARGET binding site such as BINDING SITE I, BINDING SITE II or BINDING SITE III. Table 2 illustrates the complementarity of the nucleotide sequences of cerk BINDING SITE, designated SEQ ID:23012, to the nucleotide sequence of VGAM2271 RNA, herein designated VGAM RNA, also designated SEQ ID:4982.

Another function of VGAM2271 is therefore inhibition of Ceramide Kinase (cerk, Accession NM_022766). Accordingly, utilities of VGAM2271 include diagnosis, prevention and treatment of diseases and clinical conditions associated with cerk. DKFZP434P0111 (Accession XM_041116) is another VGAM2271 host target gene. DKFZP434P0111 BINDING SITE is HOST TARGET binding site found in the 3' untranslated region of mRNA encoded by DKFZP434P0111, corresponding to a HOST TARGET binding site such as BINDING SITE I, BINDING SITE II or BINDING SITE III. Table 2 illustrates the complementarity of the nucleotide sequences of DKFZP434P0111 BINDING SITE, designated SEQ ID:33453, to the nucleotide sequence of VGAM2271 RNA, herein designated VGAM RNA, also designated SEQ ID:4982.

Another function of VGAM2271 is therefore inhibition of DKFZP434P0111 (Accession XM_041116). Accordingly, utilities of VGAM2271 include diagnosis, prevention and treatment of diseases and clinical conditions associated with DKFZP434P0111. FLJ11004 (Accession NM_018296) is another VGAM2271 host target gene. FLJ11004 BINDING SITE is HOST TARGET binding site found in the 5' untranslated region of mRNA encoded by FLJ11004, corresponding to a HOST TARGET binding site such as BINDING SITE I, BINDING SITE II or BINDING SITE III. Table 2 illustrates the complementarity of the nucleotide sequences of FLJ11004 BINDING SITE, designated SEQ ID:20286, to the nucleotide sequence of VGAM2271 RNA, herein designated VGAM RNA, also designated SEQ ID:4982.

Another function of VGAM2271 is therefore inhibition of FLJ11004 (Accession NM_018296). Accordingly, utilities of VGAM2271 include diagnosis, prevention and treatment of diseases and clinical conditions associated with FLJ11004. FLJ21276 (Accession NM_024633) is another VGAM2271 host target gene. FLJ21276 BINDING SITE is HOST TARGET binding site found in the 3' untranslated region of mRNA encoded by FLJ21276, corresponding to a HOST TARGET binding site such as BINDING SITE I, BINDING SITE II or BINDING SITE III. Table 2 illustrates the complementarity of the nucleotide sequences of FLJ21276 BINDING SITE, designated SEQ ID:23900, to the nucleotide sequence of VGAM2271 RNA, herein designated VGAM RNA, also designated SEQ ID:4982.

Another function of VGAM2271 is therefore inhibition of FLJ21276 (Accession NM_024633). Accordingly, utilities of VGAM2271 include diagnosis, prevention and treatment of diseases and clinical conditions associated with FLJ21276. IDI2 (Accession NM_033261) is another VGAM2271 host target gene. IDI2 BINDING SITE is HOST TARGET binding site found in the 3' untranslated region of mRNA encoded by IDI2, corresponding to a HOST TARGET binding site such as BINDING SITE I, BINDING SITE II or BINDING SITE III. Table 2 illustrates the complementarity of the nucleotide sequences of IDI2 BINDING SITE, designated SEQ ID:27090, to the nucleotide sequence of VGAM2271 RNA, herein designated VGAM RNA, also designated SEQ ID:4982.

Another function of VGAM2271 is therefore inhibition of IDI2 (Accession NM_033261). Accordingly, utilities of VGAM2271 include diagnosis, prevention and treatment of diseases and clinical conditions associated with IDI2. RAB-R (Accession NM_006076) is another VGAM2271 host target gene. RAB-R BINDING SITE is HOST TARGET binding site found in the 3' untranslated region of mRNA encoded by RAB-R, corresponding to a HOST TARGET binding site such as BINDING SITE I, BINDING SITE II or BINDING SITE III. Table 2 illustrates the complementarity of the nucleotide sequences of RAB-R BINDING SITE, designated SEQ ID:12720, to the nucleotide sequence of VGAM2271 RNA, herein designated VGAM RNA, also designated SEQ ID:4982.

Another function of VGAM2271 is therefore inhibition of RAB-R (Accession NM_006076). Accordingly, utilities of VGAM2271 include diagnosis, prevention and treatment of diseases and clinical conditions associated with RAB-R. LOC165693 (Accession XM_093373) is another VGAM2271 host target gene. LOC165693 BINDING SITE is HOST TARGET binding site found in the 3' untranslated region of mRNA encoded by LOC165693, corresponding to a HOST TARGET binding site such as BINDING SITE I, BINDING SITE II or BINDING SITE III. Table 2 illustrates the complementarity of the nucleotide sequences of LOC165693 BINDING SITE, designated SEQ ID:40186, to the nucleotide sequence of VGAM2271 RNA, herein designated VGAM RNA, also designated SEQ ID:4982.

Another function of VGAM2271 is therefore inhibition of LOC165693 (Accession XM_093373). Accordingly, utilities of VGAM2271 include diagnosis, prevention and treatment of diseases and clinical conditions associated with LOC165693. LOC255042 (Accession XM_170896) is another VGAM2271 host target gene. LOC255042 BINDING SITE is HOST TARGET binding site found in the 3' untranslated region of mRNA encoded by LOC255042, corresponding to a HOST TARGET binding site such as BINDING SITE I, BINDING SITE II or BINDING SITE III. Table 2 illustrates the complementarity of the nucleotide sequences of LOC255042 BINDING SITE, designated SEQ ID:45649, to the nucleotide sequence of VGAM2271 RNA, herein designated VGAM RNA, also designated SEQ ID:4982.

Another function of VGAM2271 is therefore inhibition of LOC255042 (Accession XM_170896). Accordingly, utilities of VGAM2271 include diagnosis, prevention and treatment of diseases and clinical conditions associated with LOC255042. FIG. 1 further provides a conceptual description of a novel bioinformatically detected viral gene of the present invention, referred to here as Viral Genomic Address Messenger 2272 (VGAM2272) viral gene, which modulates expression of respective host target genes thereof, the function and utility of which host target genes is known in the art.

VGAM2272 is a novel bioinformatically detected regulatory, non protein coding, viral micro RNA (miRNA) gene. The method by which VGAM2272 was detected is described hereinabove with reference to FIGS. 1-8.

VGAM2272 gene, herein designated VGAM GENE, is a viral gene contained in the genome of Alcelaphine Herpesvirus 1. VGAM2272 host target gene, herein designated VGAM HOST TARGET GENE, is a human gene contained in the human genome.

VGAM2272 gene encodes a VGAM2272 precursor RNA, herein designated VGAM PRECURSOR RNA. Similar to other miRNA genes, and unlike most ordinary genes, VGAM2272 precursor RNA does not encode a protein. A nucleotide sequence identical or highly similar to the nucleotide sequence of VGAM2272 precursor RNA is designated SEQ ID:2258, and is provided hereinbelow with reference to the sequence listing part. Nucleotide sequence SEQ ID:2258 is located at position 18433 relative to the genome of Alcelaphine Herpesvirus 1.

VGAM2272 precursor RNA folds onto itself, forming VGAM2272 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2272 folded precursor RNA into VGAM2272 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2272 RNA is designated SEQ ID:4983, and is provided hereinbelow with reference to the sequence listing part.

VGAM2272 host target gene, herein designated VGAM HOST TARGET GENE, encodes a corresponding messenger RNA, VGAM2272 host target RNA, herein designated VGAM HOST TARGET RNA. VGAM2272 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2272 RNA, herein designated VGAM RNA, binds complementarily to one or more host target binding sites located in untranslated regions of VGAM2272 host target RNA, herein designated VGAM HOST TARGET RNA. This complementary binding is due to the fact that the nucleotide sequence of VGAM2272 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2272 RNA, herein designated VGAM RNA, may have a different number of host target binding sites in untranslated regions of a VGAM2272 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2272 RNA, herein designated VGAM RNA, to host target binding sites on VGAM2272 host target RNA, herein designated VGAM HOST TARGET RNA, such as BINDING SITE I, BINDING SITE II and BINDING SITE III, inhibits translation of VGAM2272 host target RNA into VGAM2272 host target protein, herein designated VGAM HOST TARGET PROTEIN. VGAM host target protein is therefore outlined by a broken line.

It is appreciated that VGAM2272 host target gene, herein designated VGAM HOST TARGET GENE, in fact represents a plurality of VGAM2272 host target genes. The mRNA of each one of this plurality of VGAM2272 host target genes comprises one or more host target binding sites, each having a nucleotide sequence which is at least partly complementary to VGAM2272 RNA, herein designated VGAM RNA, and which when bound by VGAM2272 RNA causes inhibition of translation of respective one or more VGAM2272 host target proteins.

It is further appreciated by one skilled in the art that the mode of translational inhibition illustrated by FIG. 1 with specific reference to translational inhibition exerted by VGAM2272 gene, herein designated VGAM GENE, on one or more VGAM2272 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2272 is inhibition of expression of host target genes, as part of a novel viral mechanism of attacking a host. Accordingly, utilities of VGAM2272 include diagnosis, prevention and treatment of viral infection by Alcelaphine Herpesvirus 1. Specific functions, and accordingly utilities, of VGAM2272 correlate with, and may be deduced from, the identity of the host target genes which VGAM2272 binds and inhibits, and the function of these host target genes, as elaborated hereinbelow.

Nucleotide sequences of the VGAM2272 precursor RNA, herein designated VGAM PRECURSOR RNA, and of the 'diced' VGAM2272 RNA, herein designated VGAM RNA, and a schematic representation of the secondary folding of VGAM2272 folded precursor RNA, herein designated VGAM FOLDED PRECURSOR RNA, of VGAM2272 are further described hereinbelow with reference to Table 1.

Nucleotide sequences of host target binding sites, such as BINDING SITE-I, BINDING SITE-II and BINDING SITE-III of FIG. 1, found on VGAM2272 host target RNA, and schematic representation of the complementarity of each of these host target binding sites to VGAM2272 RNA, herein designated VGAM RNA, are described hereinbelow with reference to Table 2.

As mentioned hereinabove with reference to FIG. 1, a function of VGAM2272 gene, herein designated VGAM is inhibition of expression of VGAM2272 target genes. It is appreciated that specific functions, and accordingly utilities, of VGAM2272 correlate with, and may be deduced from, the identity of the target genes which VGAM2272 binds and inhibits, and the function of these target genes, as elaborated hereinbelow.

Formyl Peptide Receptor-like 1 (FPRL1, Accession NM_001462) is a VGAM2272 host target gene. FPRL1 BINDING SITE is HOST TARGET binding site found in the 5' untranslated region of mRNA encoded by FPRL1, corresponding to a HOST TARGET binding site such as BINDING SITE I, BINDING SITE II or BINDING SITE III. Table 2 illustrates the complementarity of the nucleotide sequences of FPRL1 BINDING SITE, designated SEQ ID:7195, to the nucleotide sequence of VGAM2272 RNA, herein designated VGAM RNA, also designated SEQ ID:4983.

A function of VGAM2272 is therefore inhibition of Formyl Peptide Receptor-like 1 (FPRL1, Accession NM_001462). Accordingly, utilities of VGAM2272 include diagnosis, prevention and treatment of diseases and clinical conditions associated with FPRL1. LIM Domain Kinase 1 (LIMK1, Accession NM_016735) is another VGAM2272 host target gene. LIMK1 BINDING SITE is HOST TARGET binding site found in the 3' untranslated region of mRNA encoded by LIMK1, corresponding to a HOST TARGET binding site such as BINDING SITE I, BINDING SITE II or BINDING SITE III. Table 2 illustrates the complementarity of the nucleotide sequences of LIMK1 BINDING SITE, designated SEQ ID:18800, to the nucleotide sequence of VGAM2272 RNA, herein designated VGAM RNA, also designated SEQ ID:4983.

Another function of VGAM2272 is therefore inhibition of LIM Domain Kinase 1 (LIMK1, Accession NM_016735). Accordingly, utilities of VGAM2272 include diagnosis, prevention and treatment of diseases and clinical conditions associated with LIMK1. Myeloid Cell Leukemia Sequence 1 (BCL2-related) (MCL1, Accession NM_021960) is another VGAM2272 host target gene. MCL1 BINDING SITE is HOST TARGET binding site found in the 3' untranslated region of mRNA encoded by MCL1, corresponding to a HOST TARGET binding site such as BINDING SITE I, BINDING SITE II or BINDING SITE III. Table 2 illustrates the complementarity of the nucleotide sequences of MCL1 BINDING SITE, designated SEQ ID:22486, to the nucleotide sequence of VGAM2272 RNA, herein designated VGAM RNA, also designated SEQ ID:4983.

Another function of VGAM2272 is therefore inhibition of Myeloid Cell Leukemia Sequence 1 (BCL2-related) (MCL1, Accession NM_021960), a gene which involved in programing of differentiation and concomitant maintenance of viability. Accordingly, utilities of VGAM2272 include diagnosis, prevention and treatment of diseases and clinical conditions associated with MCL1. The function of MCL1 and its association with various diseases and clinical conditions, has been established by previous studies, as described hereinabove with reference to VGAM1083. Chromosome 5 Open Reading Frame 4 (C5orf4, Accession NM_016348) is another VGAM2272 host target gene. C5orf4 BINDING SITE1 and C5orf4 BINDING SITE2 are HOST TARGET binding sites found in untranslated regions of mRNA encoded by C5orf4, corresponding to HOST TARGET binding sites such as BINDING SITE I, BINDING SITE II or BINDING SITE III. Table 2 illustrates the complementarity of the nucleotide sequences of C5orf4 BINDING SITE1 and C5orf4 BINDING SITE2, designated SEQ ID:18472 and SEQ ID:26177 respectively, to the nucleotide sequence of VGAM2272 RNA, herein designated VGAM RNA, also designated SEQ ID:4983.

Another function of VGAM2272 is therefore inhibition of Chromosome 5 Open Reading Frame 4 (C5orf4, Accession NM_016348). Accordingly, utilities of VGAM2272 include diagnosis, prevention and treatment of diseases and clinical conditions associated with C5orf4. DKFZP434C128 (Accession XM_036086) is another VGAM2273 host target gene. DKFZP434C128 BINDING SITE is HOST TARGET binding site found in the 3' untranslated region of mRNA encoded by DKFZP434C128, corresponding to a HOST TARGET binding site such as BINDING SITE I, BINDING SITE II or BINDING SITE III. Table 2 illustrates the complementarity of the nucleotide sequences of DKFZP434C128 BINDING SITE, designated SEQ ID:32374, to the nucleotide sequence of VGAM2273 RNA, herein designated VGAM RNA, also designated SEQ ID:4984.

Another function of VGAM2273 is therefore inhibition of DKFZP434C128 (Accession XM_036086). Accordingly, utilities of VGAM2273 include diagnosis, prevention and treatment of diseases and clinical conditions associated with DKFZP434C128. IMP-2 (Accession NM_006548) is another VGAM2273 host target gene. IMP-2 BINDING SITE is HOST TARGET binding site found in the 3' untranslated region of mRNA encoded by IMP-2, corresponding to a HOST TARGET binding site such as BINDING SITE I, BINDING SITE II or BINDING SITE III. Table 2 illustrates the complementarity of the nucleotide sequences of IMP-2 BINDING SITE, designated SEQ ID:13302, to the nucleotide sequence of VGAM2273 RNA, herein designated VGAM RNA, also designated SEQ ID:4984.

Another function of VGAM2273 is therefore inhibition of IMP-2 (Accession NM_006548). Accordingly, utilities of VGAM2273 include diagnosis, prevention and treatment of diseases and clinical conditions associated with IMP-2. Transducer of ERBB2, 2 (TOB2, Accession XM_170995) is another VGAM2273 host target gene. TOB2 BINDING SITE is HOST TARGET binding site found in the 3' untranslated region of mRNA encoded by TOB2, corresponding to a HOST TARGET binding site such as BINDING SITE I, BINDING SITE II or BINDING SITE III. Table 2 illustrates the complementarity of the nucleotide sequences of TOB2 BINDING SITE, designated SEQ ID:45764, to the nucleotide sequence of VGAM2273 RNA, herein designated VGAM RNA, also designated SEQ ID:4984.

Another function of VGAM2273 is therefore inhibition of Transducer of ERBB2, 2 (TOB2, Accession XM_170995). Accordingly, utilities of VGAM2273 include diagnosis, prevention and treatment of diseases and clinical conditions associated with TOB2. LOC147671 (Accession XM_085844) is another VGAM2273 host target gene. LOC147671 BINDING SITE is HOST TARGET binding site found in the 3' untranslated region of mRNA encoded by LOC147671, corresponding to a HOST TARGET binding site such as BINDING SITE I, BINDING SITE II or BINDING SITE III. Table 2 illustrates the complementarity of the nucleotide sequences of LOC147671 BINDING SITE, designated SEQ ID:38376, to the nucleotide sequence of VGAM2273 RNA, herein designated VGAM RNA, also designated SEQ ID:4984.

Another function of VGAM2273 is therefore inhibition of LOC147671 (Accession XM_085844). Accordingly, utilities of VGAM2273 include diagnosis, prevention and treatment of diseases and clinical conditions associated with LOC147671. LOC158819 (Accession XM_098995) is another VGAM2273 host target gene. LOC158819 BINDING SITE is HOST TARGET binding site found in the 3' untranslated region of mRNA encoded by LOC158819, corresponding to a HOST TARGET binding site such as BINDING SITE I, BINDING SITE II or BINDING SITE III. Table 2 illustrates the complementarity of the nucleotide sequences of LOC158819 BINDING SITE, designated SEQ ID:42024, to the nucleotide sequence of VGAM2273 RNA, herein designated VGAM RNA, also designated SEQ ID:4984.

Another function of VGAM2273 is therefore inhibition of LOC158819 (Accession XM_098995). Accordingly, utilities of VGAM2273 include diagnosis, prevention and treatment of diseases and clinical conditions associated with LOC158819. LOC200014 (Accession XM_114087) is another VGAM2273 host target gene. LOC200014 BINDING SITE is HOST TARGET binding site found in the 3' untranslated region of mRNA encoded by LOC200014, corresponding to a HOST TARGET binding site such as BINDING SITE I, BINDING SITE II or BINDING SITE III. Table 2 illustrates the complementarity of the nucleotide sequences of LOC200014 BINDING SITE, designated SEQ ID:42693, to the nucleotide sequence of VGAM2273 RNA, herein designated VGAM RNA, also designated SEQ ID:4984.

Another function of VGAM2273 is therefore inhibition of LOC200014 (Accession XM_114087). Accordingly, utilities of VGAM2273 include diagnosis, prevention and treatment of diseases and clinical conditions associated with LOC200014. FIG. 1 further provides a conceptual description of a novel bioinformatically detected viral gene of the present invention, referred to here as Viral Genomic Address Messenger 2274 (VGAM2274) viral gene, which modulates expression of respective host target genes thereof, the function and utility of which host target genes is known in the art.

VGAM2274 is a novel bioinformatically detected regulatory, non protein coding, viral micro RNA (miRNA) gene. The method by which VGAM2274 was detected is described hereinabove with reference to FIGS. 1-8.

VGAM2274 gene, herein designated VGAM GENE, is a viral gene contained in the genome of Alcelaphine Herpesvirus 1. VGAM2274 host target gene, herein designated VGAM HOST TARGET GENE, is a human gene contained in the human genome.

VGAM2274 gene encodes a VGAM2274 precursor RNA, herein designated VGAM PRECURSOR RNA. Similar to other miRNA genes, and unlike most ordinary genes, VGAM2274 precursor RNA does not encode a protein. A nucleotide sequence identical or highly similar to the nucleotide sequence of VGAM2274 precursor RNA is designated SEQ ID:2260, and is provided hereinbelow with reference to the sequence listing part. Nucleotide sequence SEQ ID:2260 is located at position 31577 relative to the genome of Alcelaphine Herpesvirus 1.

VGAM2274 precursor RNA folds onto itself, forming VGAM2274 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2274 folded precursor RNA into VGAM2274 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2274 RNA is designated SEQ ID:4985, and is provided hereinbelow with reference to the sequence listing part.

VGAM2274 host target gene, herein designated VGAM HOST TARGET GENE, encodes a corresponding messenger RNA, VGAM2274 host target RNA, herein designated VGAM HOST TARGET RNA. VGAM2274 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2274 RNA, herein designated VGAM RNA, binds complementarily to one or more host target binding sites located in untranslated regions of VGAM2274 host target RNA, herein designated VGAM HOST TARGET RNA. This complementary binding is due to the fact that the nucleotide sequence of VGAM2274 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2274 RNA, herein designated VGAM RNA, may have a different number of host target binding sites in untranslated regions of a VGAM2274 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2274 RNA, herein designated VGAM RNA, to host target binding sites on VGAM2274 host target RNA, herein designated VGAM HOST TARGET RNA, such as BINDING SITE I, BINDING SITE II and BINDING SITE III, inhibits translation of VGAM2274 host target RNA into VGAM2274 host target protein, herein designated VGAM HOST TARGET PROTEIN. VGAM host target protein is therefore outlined by a broken line.

It is appreciated that VGAM2274 host target gene, herein designated VGAM HOST TARGET GENE, in fact represents a plurality of VGAM2274 host target genes. The mRNA of each one of this plurality of VGAM2274 host target genes comprises one or more host target binding sites, each having a nucleotide sequence which is at least partly complementary to VGAM2274 RNA, herein designated VGAM RNA, and which when bound by VGAM2274 RNA causes inhibition of translation of respective one or more VGAM2274 host target proteins.

It is further appreciated by one skilled in the art that the mode of translational inhibition illustrated by FIG. 1 with specific reference to translational inhibition exerted by VGAM2274 gene, herein designated VGAM GENE, on one or more VGAM2274 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2274 is inhibition of expression of host target genes, as part of a novel viral mechanism of attacking a host. Accordingly, utilities of VGAM2274 include diagnosis, prevention and treatment of viral infection by Alcelaphine Herpesvirus 1. Specific functions, and accordingly utilities, of VGAM2274 correlate with, and may be deduced from, the identity of the host target genes which VGAM2274 binds and inhibits, and the function of these host target genes, as elaborated hereinbelow.

Nucleotide sequences of the VGAM2274 precursor RNA, herein designated VGAM PRECURSOR RNA, and of the 'diced' VGAM2274 RNA, herein designated VGAM RNA, and a schematic representation of the secondary folding of VGAM2274 folded precursor RNA, herein designated VGAM FOLDED PRECURSOR RNA, of VGAM2274 are further described hereinbelow with reference to Table 1.

Nucleotide sequences of host target binding sites, such as BINDING SITE-I, BINDING SITE-II and BINDING SITE-III of FIG. 1, found on VGAM2274 host target RNA, and schematic representation of the complementarity of each of these host target binding sites to VGAM2274 RNA, herein designated VGAM RNA, are described hereinbelow with reference to Table 2.

As mentioned hereinabove with reference to FIG. 1, a function of VGAM2274 gene, herein designated VGAM is inhibition of expression of VGAM2274 target genes. It is appreciated that specific functions, and accordingly utilities, of VGAM2274 correlate with, and may be deduced from, the identity of the target genes which VGAM2274 binds and inhibits, and the function of these target genes, as elaborated hereinbelow.

Alpha Thalassemia/mental Retardation Syndrome X-linked (RAD54 homolog, S. cerevisiae) (ATRX, Accession NM_000489) is a VGAM2274 host target gene. ATRX BINDING SITE1 and ATRX BINDING SITE2 are HOST TARGET binding sites found in untranslated regions of mRNA encoded by ATRX, corresponding to HOST TARGET binding sites such as BINDING SITE I, BINDING SITE II or BINDING SITE III. Table 2 illustrates the complementarity of the nucleotide sequences of ATRX BINDING SITE1 and ATRX BINDING SITE2, designated SEQ ID:6094 and SEQ ID:28683 respectively, to the nucleotide sequence of VGAM2274 RNA, herein designated VGAM RNA, also designated SEQ ID:4985.

A function of VGAM2274 is therefore inhibition of Alpha Thalassemia/mental Retardation Syndrome X-linked (RAD54 homolog, S. cerevisiae) (ATRX, Accession NM_000489). Accordingly, utilities of VGAM2274 include diagnosis, prevention and treatment of diseases and clinical conditions associated with ATRX. KIAA1102 (Accession XM_044461) is another VGAM2274 host target gene. KIAA1102 BINDING SITE is HOST TARGET binding site found in the 3' untranslated region of mRNA encoded by KIAA1102, corresponding to a HOST TARGET binding site such as BINDING SITE I, BINDING SITE II or BINDING SITE III. Table 2 illustrates the complementarity of the nucleotide sequences of KIAA1102 BINDING SITE, designated SEQ ID:34211, to the nucleotide sequence of VGAM2274 RNA, herein designated VGAM RNA, also designated SEQ ID:4985.

Another function of VGAM2274 is therefore inhibition of KIAA1102 (Accession XM_044461). Accordingly, utilities of VGAM2274 include diagnosis, prevention and treatment of diseases and clinical conditions associated with KIAA1102. FIG. 1 further provides a conceptual description of a novel bioinformatically detected viral gene of the present invention, referred to here as Viral Genomic Address Messenger 2275 (VGAM2275) viral gene, which modulates expression of respective host target genes thereof, the function and utility of which host target genes is known in the art.

VGAM2275 is a novel bioinformatically detected regulatory, non protein coding, viral micro RNA (miRNA) gene. The method by which VGAM2275 was detected is described hereinabove with reference to FIGS. 1-8.

VGAM2275 gene, herein designated VGAM GENE, is a viral gene contained in the genome of Alcelaphine Herpesvirus 1. VGAM2275 host target gene, herein designated VGAM HOST TARGET GENE, is a human gene contained in the human genome.

VGAM2275 gene encodes a VGAM2275 precursor RNA, herein designated VGAM PRECURSOR RNA. Similar to other miRNA genes, and unlike most ordinary genes, VGAM2275 precursor RNA does not encode a protein. A nucleotide sequence identical or highly similar to the nucleotide sequence of VGAM2275 precursor RNA is designated SEQ ID:2261, and is provided hereinbelow with reference to the sequence listing part. Nucleotide sequence SEQ ID:2261 is located at position 30158 relative to the genome of Alcelaphine Herpesvirus 1.

VGAM2275 precursor RNA folds onto itself, forming VGAM2275 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2275 folded precursor RNA into VGAM2275 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2275 RNA is designated SEQ ID:4986, and is provided hereinbelow with reference to the sequence listing part.

VGAM2275 host target gene, herein designated VGAM HOST TARGET GENE, encodes a corresponding messenger RNA, VGAM2275 host target RNA, herein designated VGAM HOST TARGET RNA. VGAM2275 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2275 RNA, herein designated VGAM RNA, binds complementarily to one or more host target binding sites located in untranslated regions of VGAM2275 host target RNA, herein designated VGAM HOST TARGET RNA. This complementary binding is due to the fact that the nucleotide sequence of VGAM2275 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2275 RNA, herein designated VGAM RNA, may have a different number of host target binding sites in untranslated regions of a VGAM2275 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2275 RNA, herein designated VGAM RNA, to host target binding sites on VGAM2275 host target RNA, herein designated VGAM HOST TARGET RNA, such as BINDING SITE I, BINDING SITE II and BINDING SITE III, inhibits translation of VGAM2275 host target RNA into VGAM2275 host target protein, herein designated VGAM HOST TARGET PROTEIN. VGAM host target protein is therefore outlined by a broken line.

It is appreciated that VGAM2275 host target gene, herein designated VGAM HOST TARGET GENE, in fact represents a plurality of VGAM2275 host target genes. The mRNA of each one of this plurality of VGAM2275 host target genes comprises one or more host target binding sites, each having a nucleotide sequence which is at least partly complementary to VGAM2275 RNA, herein designated VGAM RNA, and which when bound by VGAM2275 RNA causes inhibition of translation of respective one or more VGAM2275 host target proteins.

It is further appreciated by one skilled in the art that the mode of translational inhibition illustrated by FIG. 1 with specific reference to translational inhibition exerted by VGAM2275 gene, herein designated VGAM GENE, on one or more VGAM2275 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2275 is inhibition of expression of host target genes, as part of a novel viral mechanism of attacking a host. Accordingly, utilities of VGAM2275 include diagnosis, prevention and treatment of viral infection by Alcelaphine Herpesvirus 1. Specific functions, and accordingly utilities, of VGAM2275 correlate with, and may be deduced from, the identity of the host target genes which VGAM2275 binds and inhibits, and the function of these host target genes, as elaborated hereinbelow.

Nucleotide sequences of the VGAM2275 precursor RNA, herein designated VGAM PRECURSOR RNA, and of the 'diced' VGAM2275 RNA, herein designated VGAM RNA, and a schematic representation of the secondary folding of VGAM2275 folded precursor RNA, herein designated VGAM FOLDED PRECURSOR RNA, of VGAM2275 are further described hereinbelow with reference to Table 1.

Nucleotide sequences of host target binding sites, such as BINDING SITE-I, BINDING SITE-II and BINDING SITE-III of FIG. 1, found on VGAM2275 host target RNA, and schematic representation of the complementarity of each of these host target binding sites to VGAM2275 RNA, herein designated VGAM RNA, are described hereinbelow with reference to Table 2.

As mentioned hereinabove with reference to FIG. 1, a function of VGAM2275 gene, herein designated VGAM is inhibition of expression of VGAM2275 target genes. It is appreciated that specific functions, and accordingly utilities, of VGAM2275 correlate with, and may be deduced from, the identity of the target genes which VGAM2275 binds and inhibits, and the function of these target genes, as elaborated hereinbelow.

Collagen, Type VI, Alpha 2 (COL6A2, Accession NM_058175) is a VGAM2275 host target gene. COL6A2 BINDING SITE is HOST TARGET binding site found in the 3' untranslated region of mRNA encoded by COL6A2, corresponding to a HOST TARGET binding site such as BINDING SITE I, BINDING SITE II or BINDING SITE III. Table 2 illustrates the complementarity of the nucleotide sequences of COL6A2 BINDING SITE, designated SEQ ID:27726, to the nucleotide sequence of VGAM2275 RNA, herein designated VGAM RNA, also designated SEQ ID:4986.

A function of VGAM2275 is therefore inhibition of Collagen, Type VI, Alpha 2 (COL6A2, Accession NM_058175). Accordingly, utilities of VGAM2275 include diagnosis, prevention and treatment of diseases and clinical conditions associated with COL6A2. DKFZP434H132 (Accession XM_057020) is another VGAM2275 host target gene. DKFZP434H132 BINDING SITE is HOST TARGET binding site found in the 5' untranslated region of mRNA encoded by DKFZP434H132, corresponding to a HOST TARGET binding site such as BINDING SITE I, BINDING SITE II or BINDING SITE III. Table 2 illustrates the complementarity of the nucleotide sequences of DKFZP434H132 BINDING SITE, designated SEQ ID:36445, to the nucleotide sequence of VGAM2275 RNA, herein designated VGAM RNA, also designated SEQ ID:4986.

Another function of VGAM2275 is therefore inhibition of DKFZP434H132 (Accession XM_057020). Accordingly, utilities of VGAM2275 include diagnosis, prevention and treatment of diseases and clinical conditions associated with DKFZP434H132. DKFZP586I2223 (Accession NM_080730) is another VGAM2275 host target gene. DKFZP586I2223 BINDING SITE1 through DKFZP586I2223 BINDING SITE3 are HOST TARGET binding sites found in untranslated regions of mRNA encoded by DKFZP586I2223, corresponding to HOST TARGET binding sites such as BINDING SITE I, BINDING SITE II or BINDING SITE III. Table 2 illustrates the complementarity of the nucleotide sequences of DKFZP586I2223 BINDING SITE1 through DKFZP586I2223 BINDING SITE3, designated SEQ ID:28017, SEQ ID:28019 and SEQ ID:17730 respectively, to the nucleotide sequence of VGAM2275 RNA, herein designated VGAM RNA, also designated SEQ ID:4986.

Another function of VGAM2275 is therefore inhibition of DKFZP586I2223 (Accession NM_080730). Accordingly, utilities of VGAM2275 include diagnosis, prevention and treatment of diseases and clinical conditions associated with DKFZP586I2223. FLJ00007 (Accession XM_048928) is another VGAM2275 host target gene. FLJ00007 BINDING SITE is HOST TARGET binding site found in the 3' untranslated region of mRNA encoded by FLJ00007, corresponding to a HOST TARGET binding site such as BINDING SITE I, BINDING SITE II or BINDING SITE III. Table 2 illustrates the complementarity of the nucleotide sequences of FLJ00007 BINDING SITE, designated SEQ ID:35310, to the nucleotide sequence of VGAM2275 RNA, herein designated VGAM RNA, also designated SEQ ID:4986.

Another function of VGAM2275 is therefore inhibition of FLJ00007 (Accession XM_048928). Accordingly, utilities of VGAM2275 include diagnosis, prevention and treatment of diseases and clinical conditions associated with FLJ00007. FLJ23231 (Accession NM_025079) is another VGAM2275 host target gene. FLJ23231 BINDING SITE is HOST TARGET binding site found in the 3' untranslated region of mRNA encoded by FLJ23231, corresponding to a HOST TARGET binding site such as BINDING SITE I, BINDING SITE II or BINDING SITE III. Table 2 illustrates the complementarity of the nucleotide sequences of FLJ23231 BINDING SITE, designated SEQ ID:24679, to the nucleotide sequence of VGAM2275 RNA, herein designated VGAM RNA, also designated SEQ ID:4986.

Another function of VGAM2275 is therefore inhibition of FLJ23231 (Accession NM_025079). Accordingly, utilities of VGAM2275 include diagnosis, prevention and treatment of diseases and clinical conditions associated with FLJ23231. MIG2 (Accession XM_051693) is another VGAM2275 host target gene. MIG2 BINDING SITE is HOST TARGET binding site found in the 3' untranslated region of mRNA encoded by MIG2, corresponding to a HOST TARGET binding site such as BINDING SITE I, BINDING SITE II or BINDING SITE III. Table 2 illustrates the complementarity of the nucleotide sequences of MIG2 BINDING SITE, designated SEQ ID:35863, to the nucleotide sequence of VGAM2275 RNA, herein designated VGAM RNA, also designated SEQ ID:4986.

Another function of VGAM2275 is therefore inhibition of MIG2 (Accession XM_051693). Accordingly, utilities of VGAM2275 include diagnosis, prevention and treatment of diseases and clinical conditions associated with MIG2. PRO0650 (Accession NM_014137) is another VGAM2275 host target gene. PRO0650 BINDING SITE is HOST TARGET binding site found in the 5' untranslated region of mRNA encoded by PRO0650, corresponding to a HOST TARGET binding site such as BINDING SITE I, BINDING SITE II or BINDING SITE III. Table 2 illustrates the complementarity of the nucleotide sequences of PRO0650 BINDING SITE, designated SEQ ID:15403, to the nucleotide sequence of VGAM2275 RNA, herein designated VGAM RNA, also designated SEQ ID:4986.

Another function of VGAM2275 is therefore inhibition of PRO0650 (Accession NM_014137). Accordingly, utilities of VGAM2275 include diagnosis, prevention and treatment of diseases and clinical conditions associated with PRO0650. LOC165140 (Accession XM_092406) is another VGAM2275 host target gene. LOC165140 BINDING SITE is HOST TARGET binding site found in the 5' untranslated region of mRNA encoded by LOC165140, corresponding to a HOST TARGET binding site such as BINDING SITE I, BINDING SITE II or BINDING SITE III. Table 2 illustrates the complementarity of the nucleotide sequences of LOC165140 BINDING SITE, designated SEQ ID:40117, to the nucleotide sequence of VGAM2275 RNA, herein designated VGAM RNA, also designated SEQ ID:4986.

Another function of VGAM2275 is therefore inhibition of LOC165140 (Accession XM_092406). Accordingly, utilities of VGAM2275 include diagnosis, prevention and treatment of diseases and clinical conditions associated with LOC165140. LOC197414 (Accession XM_113880) is another VGAM2275 host target gene. LOC197414 BINDING SITE is HOST TARGET binding site found in the 3' untranslated region of mRNA encoded by LOC197414, corresponding to a HOST TARGET binding site such as BINDING SITE I, BINDING SITE II or BINDING SITE III. Table 2 illustrates the complementarity of the nucleotide sequences of LOC197414 BINDING SITE, designated SEQ ID:42514, to the nucleotide sequence of VGAM2275 RNA, herein designated VGAM RNA, also designated SEQ ID:4986.

Another function of VGAM2275 is therefore inhibition of LOC197414 (Accession XM_113880). Accordingly, utilities of VGAM2275 include diagnosis, prevention and treatment of diseases and clinical conditions associated with LOC197414. LOC199923 (Accession XM_114057) is another VGAM2275 host target gene. LOC199923 BINDING SITE is HOST TARGET binding site found in the 3' untranslated region of mRNA encoded by LOC199923, corresponding to a HOST TARGET binding site such as BINDING SITE I, BINDING SITE II or BINDING SITE III. Table 2 illustrates the complementarity of the nucleotide sequences of LOC199923 BINDING SITE, designated SEQ ID:42669, to the nucleotide sequence of VGAM2275 RNA, herein designated VGAM RNA, also designated SEQ ID:4986.

Another function of VGAM2275 is therefore inhibition of LOC199923 (Accession XM_114057). Accordingly, utilities of VGAM2275 include diagnosis, prevention and treatment of diseases and clinical conditions associated with LOC199923. LOC222160 (Accession XM_168431) is another VGAM2275 host target gene. LOC222160 BINDING SITE is HOST TARGET binding site found in the 3' untranslated region of mRNA encoded by LOC222160, corresponding to a HOST TARGET binding site such as BINDING SITE I, BINDING SITE II or BINDING SITE III. Table 2 illustrates the complementarity of the nucleotide sequences of LOC222160 BINDING SITE, designated SEQ ID:45167, to the nucleotide sequence of VGAM2275 RNA, herein designated VGAM RNA, also designated SEQ ID:4986.

Another function of VGAM2275 is therefore inhibition of LOC222160 (Accession XM_168431). Accordingly, utilities of VGAM2275 include diagnosis, prevention and treatment of diseases and clinical conditions associated with LOC222160. LOC255645 (Accession XM_172967) is another VGAM2275 host target gene. LOC255645 BINDING SITE is HOST TARGET binding site found in the 3' untranslated region of mRNA encoded by LOC255645, corresponding to a HOST TARGET binding site such as BINDING SITE I, BINDING SITE II or BINDING SITE III. Table 2 illustrates the complementarity of the nucleotide sequences of LOC255645 BINDING SITE, designated SEQ ID:46221, to the nucleotide sequence of VGAM2275 RNA, herein designated VGAM RNA, also designated SEQ ID:4986.

Another function of VGAM2275 is therefore inhibition of LOC255645 (Accession XM_172967). Accordingly, utilities of VGAM2275 include diagnosis, prevention and treatment of diseases and clinical conditions associated with LOC255645. LOC90092 (Accession XM_028862) is another VGAM2275 host target gene. LOC90092 BINDING SITE is HOST TARGET binding site found in the 5' untranslated region of mRNA encoded by LOC90092, corresponding to a HOST TARGET binding site such as BINDING SITE I, BINDING SITE II or BINDING SITE III. Table 2 illustrates the complementarity of the nucleotide sequences of LOC90092 BINDING SITE, designated SEQ ID:30787, to the nucleotide sequence of VGAM2275 RNA, herein designated VGAM RNA, also designated SEQ ID:4986.

Another function of VGAM2275 is therefore inhibition of LOC90092 (Accession XM_028862). Accordingly, utilities of VGAM2275 include diagnosis, prevention and treatment of diseases and clinical conditions associated with LOC90092. FIG. 1 further provides a conceptual description of a novel bioinformatically detected viral gene of the present invention, referred to here as Viral Genomic Address Messenger 2276 (VGAM2276) viral gene, which modulates expression of respective host target genes thereof, the function and utility of which host target genes is known in the art.

VGAM2276 is a novel bioinformatically detected regulatory, non protein coding, viral micro RNA (miRNA) gene. The method by which VGAM2276 was detected is described hereinabove with reference to FIGS. 1-8.

VGAM2276 gene, herein designated VGAM GENE, is a viral gene contained in the genome of Alcelaphine Herpesvirus 1. VGAM2276 host target gene, herein designated VGAM HOST TARGET GENE, is a human gene contained in the human genome.

VGAM2276 gene encodes a VGAM2276 precursor RNA, herein designated VGAM PRECURSOR RNA. Similar to other miRNA genes, and unlike most ordinary genes, VGAM2276 precursor RNA does not encode a protein. A nucleotide sequence identical or highly similar to the nucleotide sequence of VGAM2276 precursor RNA is designated SEQ ID:2262, and is provided hereinbelow with reference to the sequence listing part. Nucleotide sequence SEQ ID:2262 is located at position 30027 relative to the genome of Alcelaphine Herpesvirus 1.

VGAM2276 precursor RNA folds onto itself, forming VGAM2276 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2276 folded precursor RNA into VGAM2276 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 60%) nucleotide sequence of VGAM2276 RNA is designated SEQ ID:4987, and is provided hereinbelow with reference to the sequence listing part.

VGAM2276 host target gene, herein designated VGAM HOST TARGET GENE, encodes a corresponding messenger RNA, VGAM2276 host target RNA, herein designated VGAM HOST TARGET RNA. VGAM2276 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2276 RNA, herein designated VGAM RNA, binds complementarily to one or more host target binding sites located in untranslated regions of VGAM2276 host target RNA, herein designated VGAM HOST TARGET RNA. This complementary binding is due to the fact that the nucleotide sequence of VGAM2276 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2276 RNA, herein designated VGAM RNA, may have a different number of host target binding sites in untranslated regions of a VGAM2276 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2276 RNA, herein designated VGAM RNA, to host target binding sites on VGAM2276 host target RNA, herein designated VGAM HOST TARGET RNA, such as BINDING SITE I, BINDING SITE II and BINDING SITE III, inhibits translation of VGAM2276 host target RNA into VGAM2276 host target protein, herein designated VGAM HOST TARGET PROTEIN. VGAM host target protein is therefore outlined by a broken line.

It is appreciated that VGAM2276 host target gene, herein designated VGAM HOST TARGET GENE, in fact represents a plurality of VGAM2276 host target genes. The mRNA of each one of this plurality of VGAM2276 host target genes comprises one or more host target binding sites, each having a nucleotide sequence which is at least partly complementary to VGAM2276 RNA, herein designated VGAM RNA, and which when bound by VGAM2276 RNA causes inhibition of translation of respective one or more VGAM2276 host target proteins.

It is further appreciated by one skilled in the art that the mode of translational inhibition illustrated by FIG. 1 with specific reference to translational inhibition exerted by VGAM2276 gene, herein designated VGAM GENE, on one or more VGAM2276 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2276 is inhibition of expression of host target genes, as part of a novel viral mechanism of attacking a host. Accordingly, utilities of VGAM2276 include diagnosis, prevention and treatment of viral infection by Alcelaphine Herpesvirus 1. Specific functions, and accordingly utilities, of VGAM2276 correlate with, and may be deduced from, the identity of the host target genes which VGAM2276 binds and inhibits, and the function of these host target genes, as elaborated hereinbelow.

Nucleotide sequences of the VGAM2276 precursor RNA, herein designated VGAM PRECURSOR RNA, and of the 'diced' VGAM2276 RNA, herein designated VGAM RNA, and a schematic representation of the secondary folding of VGAM2276 folded precursor RNA, herein designated VGAM FOLDED PRECURSOR RNA, of VGAM2276 are further described hereinbelow with reference to Table 1.

Nucleotide sequences of host target binding sites, such as BINDING SITE-I, BINDING SITE-II and BINDING SITE-III of FIG. 1, found on VGAM2276 host target RNA, and schematic representation of the complementarity of each of these host target binding sites to VGAM2276 RNA, herein designated VGAM RNA, are described hereinbelow with reference to Table 2.

As mentioned hereinabove with reference to FIG. 1, a function of VGAM2276 gene, herein designated VGAM is inhibition of expression of VGAM2276 target genes. It is appreciated that specific functions, and accordingly utilities, of VGAM2276 correlate with, and may be deduced from, the identity of the target genes which VGAM2276 binds and inhibits, and the function of these target genes, as elaborated hereinbelow.

Ankylosis, Progressive Homolog (mouse) (ANKH, Accession NM_054027) is a VGAM2276 host target gene. ANKH BINDING SITE1 and ANKH BINDING SITE2 are HOST TARGET binding sites found in untranslated regions of mRNA encoded by ANKH, corresponding to HOST TARGET binding sites such as BINDING SITE I, BINDING SITE II or BINDING SITE III. Table 2 illustrates the complementarity of the nucleotide sequences of ANKH BINDING SITE1 and ANKH BINDING SITE2, designated SEQ ID:27635 and SEQ ID:21252 respectively, to the nucleotide sequence of VGAM2276 RNA, herein designated VGAM RNA, also designated SEQ ID:4987.

A function of VGAM2276 is therefore inhibition of Ankylosis, Progressive Homolog (mouse) (ANKH, Accession NM_054027), a gene which regulates intra- and extracellular levels of inorganic pyrophosphate (ppi), probably functioning as ppi transporter. Accordingly, utilities of VGAM2276 include diagnosis, prevention and treatment of diseases and clinical conditions associated with ANKH. The function of ANKH and its association with various diseases and clinical conditions, has been established by previous studies, as described hereinabove with reference to VGAM1247. Deleted In Lung and Esophageal Cancer 1 (DLEC1, Accession NM_007336) is another VGAM2276 host target gene. DLEC1 BINDING SITE1 and DLEC1 BINDING SITE2 are HOST TARGET binding sites found in untranslated regions of mRNA encoded by DLEC1, corresponding to HOST TARGET binding sites such as BINDING SITE I, BINDING SITE II or BINDING SITE III. Table 2 illustrates the complementarity of the nucleotide sequences of DLEC1 BINDING SITE1 and DLEC1 BINDING SITE2, designated SEQ ID:14264 and SEQ ID:14271 respectively, to the nucleotide sequence of VGAM2276 RNA, herein designated VGAM RNA, also designated SEQ ID:4987.

Another function of VGAM2276 is therefore inhibition of Deleted In Lung and Esophageal Cancer 1 (DLEC1, Accession NM_007336). Accordingly, utilities of VGAM2276 include diagnosis, prevention and treatment of diseases and clinical conditions associated with DLEC1. LENG4 (Accession NM_024298) is another VGAM2276 host target gene. LENG4 BINDING SITE is HOST TARGET binding site found in the 3' untranslated region of mRNA encoded by LENG4, corresponding to a HOST TARGET binding site such as BINDING SITE I, BINDING SITE II or BINDING SITE III. Table 2 illustrates the complementarity of the nucleotide sequences of LENG4 BINDING SITE, designated SEQ ID:23586, to the nucleotide sequence of VGAM2276 RNA, herein designated VGAM RNA, also designated SEQ ID:4987.

Another function of VGAM2276 is therefore inhibition of LENG4 (Accession NM_024298), a gene which may be a transmembrane protein. Accordingly, utilities of VGAM2276 include diagnosis, prevention and treatment of diseases and clinical conditions associated with LENG4. The function of LENG4 and its association with various diseases and clinical conditions, has been established by previous studies, as described hereinabove with reference to VGAM259. Lipoprotein Lipase (LPL, Accession NM_000237) is another VGAM2276 host target gene. LPL BINDING SITE is HOST TARGET binding site found in the 3" untranslated region of mRNA encoded by LPL, corresponding to a HOST TARGET binding site such as BINDING SITE I, BINDING SITE II or BINDING SITE III. Table 2 illustrates the complementarity of the nucleotide sequences of LPL BINDING SITE, designated SEQ ID:5753, to the nucleotide sequence of VGAM2276 RNA, herein designated VGAM RNA, also designated SEQ ID:4987.

Another function of VGAM2276 is therefore inhibition of Lipoprotein Lipase (LPL, Accession NM_000237), a gene which is the hydrolysis of triglycerides of circulating chylomicrons and very low density lipoproteins (vldl). the enzyme functions in the presence of apolipoprotein c-2 on the luminal surface of vascular. Accordingly, utilities of VGAM2276 include diagnosis, prevention and treatment of diseases and clinical conditions associated with LPL. The function of LPL and its association with various diseases and clinical conditions, has been established by previous studies, as described hereinabove with reference to VGAM55. Mannosidase, Alpha, Class 2C, Member 1 (MAN2C1, Accession XM_053585) is another VGAM2276 host target gene. MAN2C1 BINDING SITE is HOST TARGET binding site found in the 5' untranslated region of mRNA encoded by MAN2C1, corresponding to a HOST TARGET binding site such as BINDING SITE I, BINDING SITE II or BINDING SITE III. Table 2 illustrates the complementarity of the nucleotide sequences of MAN2C1 BINDING SITE, designated SEQ ID:36102, to the nucleotide sequence of VGAM2276 RNA, herein designated VGAM RNA, also designated SEQ ID:4987.

Another function of VGAM2276 is therefore inhibition of Mannosidase, Alpha, Class 2C, Member 1 (MAN2C1, Accession XM_053585), a gene which is Strongly similar to a region of rat ER alpha-mannosidase. Accordingly, utilities of VGAM2276 include diagnosis, prevention and treatment of diseases and clinical conditions associated with MAN2C1. The function of MAN2C1 and its association with various diseases and clinical conditions, has been established by previous studies, as described hereinabove with reference to VGAM958. Membrane Protein, Palmitoylated 2 (MAGUK p55 subfamily member 2) (MPP2, Accession XM_008355) is another VGAM2276 host target gene. MPP2 BINDING SITE is HOST TARGET binding site found in the 3' untranslated region of mRNA encoded by MPP2, corresponding to a HOST TARGET binding site such as BINDING SITE I, BINDING SITE II or BINDING SITE III. Table 2 illustrates the complementarity of the nucleotide sequences of MPP2 BINDING SITE, designated SEQ ID:30082, to the nucleotide sequence of VGAM2276 RNA, herein designated VGAM RNA, also designated SEQ ID:4987.

Another function of VGAM2276 is therefore inhibition of Membrane Protein, Palmitoylated 2 (MAGUK p55 subfamily member 2) (MPP2, Accession XM_008355). Accordingly, utilities of VGAM2276 include diagnosis, prevention and treatment of diseases and clinical conditions associated with MPP2. poly (A) Binding Protein, Cytoplasmic 1 (PABPC1, Accession NM_002568) is another VGAM2276 host target gene. PABPC1 BINDING SITE is HOST TARGET binding site found in the 5' untranslated region of mRNA encoded by PABPC1, corresponding to a HOST TARGET binding site such as BINDING SITE I, BINDING SITE II or BINDING SITE III. Table 2 illustrates the complementarity of the nucleotide sequences of PABPC1 BINDING SITE, designated SEQ ID:8419, to the nucleotide sequence of VGAM2276 RNA, herein designated VGAM RNA, also designated SEQ ID:4987.

Another function of VGAM2276 is therefore inhibition of poly (A) Binding Protein, Cytoplasmic 1 (PABPC1, Accession NM_002568), a gene which involves in cytoplasmic regulatory processes of mRNA metabolism. Accordingly, utilities of VGAM2276 include diagnosis, prevention and treatment of diseases and clinical conditions associated with PABPC1. The function of PABPC1 and its association with various diseases and clinical conditions, has been established by previous studies, as described hereinabove with reference to VGAM280. Solute Carrier Family 13 (sodium-dependent dicarboxylate transporter), Member 3 (SLC13A3, Accession XM_017841) is another VGAM2276 host target gene. SLC13A3 BINDING SITE is HOST TARGET binding site found in the 3' untranslated region of mRNA encoded by SLC13A3, corresponding to a HOST TARGET binding site such as BINDING SITE I, BINDING SITE II or BINDING SITE III. Table 2 illustrates the complementarity of the nucleotide sequences of SLC13A3 BINDING SITE, designated SEQ ID:30329, to the nucleotide sequence of VGAM2276 RNA, herein designated VGAM RNA, also designated SEQ ID:4987.

Another function of VGAM2276 is therefore inhibition of Solute Carrier Family 13 (sodium-dependent dicarboxylate transporter), Member 3 (SLC13A3, Accession XM_017841). Accordingly, utilities of VGAM2276 include diagnosis, prevention and treatment of diseases and clinical conditions associated with SLC13A3. Steroidogenic Acute Regulatory Protein (STAR, Accession NM_000349) is another VGAM2276 host target gene. STAR BINDING SITE is HOST TARGET binding site found in the 3' untranslated region of mRNA encoded by STAR, corresponding to a HOST TARGET binding site such as BINDING SITE I, BINDING SITE II or BINDING SITE III. Table 2 illustrates the complementarity of the nucleotide sequences of STAR BINDING SITE, designated SEQ ID:5904, to the nucleotide sequence of VGAM2276 RNA, herein designated VGAM RNA, also designated SEQ ID:4987.

Another function of VGAM2276 is therefore inhibition of Steroidogenic Acute Regulatory Protein (STAR, Accession NM_000349). Accordingly, utilities of VGAM2276 include diagnosis, prevention and treatment of diseases and clinical conditions associated with STAR. Suppressor of Fused Homolog (Drosophila) (SUFU, Accession NM_016169) is another VGAM2276 host target gene. SUFU BINDING SITE is HOST TARGET binding site found in the 3' untranslated region of mRNA encoded by SUFU, corresponding to a HOST TARGET binding site such as BINDING SITE I, BINDING SITE II or BINDING SITE III. Table 2 illustrates the complementarity of the nucleotide sequences of SUFU BINDING SITE, designated SEQ ID:18258, to the nucleotide sequence of VGAM2276 RNA, herein designated VGAM RNA, also designated SEQ ID:4987.

Another function of VGAM2276 is therefore inhibition of Suppressor of Fused Homolog (Drosophila) (SUFU, Accession NM_016169). Accordingly, utilities of VGAM2276 include diagnosis, prevention and treatment of diseases and clinical conditions associated with SUFU. Testis Enhanced Gene Transcript (BAX inhibitor 1) (TEGT, Accession XM_035490) is another VGAM2276 host target gene. TEGT BINDING SITE is HOST TARGET binding site found in the 3' untranslated region of mRNA encoded by TEGT, corresponding to a HOST TARGET binding site such as BINDING SITE I, BINDING SITE II or BINDING SITE III. Table 2 illustrates the complementarity of the nucleotide sequences of TEGT BINDING SITE, designated SEQ ID:32275, to the nucleotide sequence of VGAM2276 RNA, herein designated VGAM RNA, also designated SEQ ID:4987.

Another function of VGAM2276 is therefore inhibition of Testis Enhanced Gene Transcript (BAX inhibitor 1) (TEGT, Accession XM_035490), a gene which is a suppressor of apoptosis. Accordingly, utilities of VGAM2276 include diagnosis, prevention and treatment of diseases and clinical conditions associated with TEGT. The function of TEGT has been established by previous studies. Walter et al. (1994) identified a single-copy gene in the rat for which 2 transcripts were found in each organ tested. The shorter transcript of about 1 kb was highly abundant in the postpubertal testis. The gene was therefore designated Tegt (for testis enhanced gene transcript). Using a rat Tegt probe, Walter et al. (1995) screened a human testis cDNA library and isolated the human homolog of the rat Tegt gene. The gene in the rat and human S does not belong to any known gene family of vertebrates. The deduced amino acid sequence of the gene and a bacterial protein of unknown function show low but significant homology and very similar hydrophobicity profiles. The 2 different transcripts are due to alternative usage of 2 polyadenylation sites. The presence of a nuclear targeting motif indicates that the gene product must localize to the nucleus. By Southern blot analysis of DNA from rat/human somatic cell hybrids, Walter et al. (1995) mapped the TEGT gene to human chromosome 12. Fluorescence in situ hybridization refined the assignment to 12q12-q13. This localization agrees with the assignment of the gene to rat chromosome 7 and to mouse chromosome 15. The mammalian proapoptotic protein BAX (OMIM Ref. No. 600040) confers a lethal phenotype when expressed in yeast. By exploiting this phenotype, Xu and Reed (1998) identified a human BAX inhibitor, BI1. BI1 is an evolutionarily conserved integral membrane protein containing 6 predicted membrane-spanning segments and is predominantly localized to intracellular membranes, similar to BCL2 family proteins. The predicted protein contains 237 amino acids and is identical to TEGT. BI1 can interact with BCL2 (OMIM Ref. No. 151430) and BCLX(L) but not BAX or BAK, as demonstrated by in vivo crosslinking and coimmunoprecipitation studies. When overexpressed in mammalian cells, BI1 suppressed apoptosis induced by BAX, etoposide, staurosporine, and growth factor deprivation, but not by FAS (CD95). Conversely, BI1 antisense induced apoptosis.

BI1 thus represents a regulator of cell death pathways controlled by BCL2 and BAX.

Full details of the abovementioned studies are described in the following publications, the disclosure of which are hereby incorporated by reference:

Walter, L.; Marynen, P.; Szpirer, J.; Levan, G.; Gunther, E.: Identification of a novel conserved human gene, TEGT. Genomics 28:301-304, 1995; and Xu, Q.; Reed, J. C.: Bax inhibitor-1, a mammalian apoptosis suppressor identified by functional screening in yeast. Molec. Cell 1:337-346, 1998.

Further studies establishing the function and utilities of TEGT are found in John Hopkins OMIM database record ID 600748, and in sited publications numbered 7568-7570 listed in the bibliography section hereinbelow, which are also hereby incorporated by reference. DKFZp434K2435 (Accession NM_032256) is another VGAM2276 host target gene. DKFZp434K2435 BINDING SITE is HOST TARGET binding site found in the 3' untranslated region of mRNA encoded by DKFZp434K2435, corresponding to a HOST TARGET binding site such as BINDING SITE I, BINDING SITE II or BINDING SITE III. Table 2 illustrates the complementarity of the nucleotide sequences of DKFZp434K2435 BINDING SITE, designated SEQ ID:26000, to the nucleotide sequence of VGAM2276 RNA, herein designated VGAM RNA, also designated SEQ ID:4987.

Another function of VGAM2276 is therefore inhibition of DKFZp434K2435 (Accession NM_032256). Accordingly, utilities of VGAM2276 include diagnosis, prevention and treatment of diseases and clinical conditions associated with DKFZp434K2435. DKFZp547E052 (Accession NM_032276) is another VGAM2276 host target gene. DKFZp547E052 BINDING SITE is HOST TARGET binding site found in the 3' untranslated region of mRNA encoded by DKFZp547E052, corresponding to a HOST TARGET binding site such as BINDING SITE I, BINDING SITE II or BINDING SITE III. Table 2 illustrates the complementarity of the nucleotide sequences of DKFZp547E052 BINDING SITE, designated SEQ ID:26031, to the nucleotide sequence of VGAM2276 RNA, herein designated VGAM RNA, also designated SEQ ID:4987.

Another function of VGAM2276 is therefore inhibition of DKFZp547E052 (Accession NM_032276). Accordingly, utilities of VGAM2276 include diagnosis, prevention and treatment of diseases and clinical conditions associated with DKFZp547E052. FLJ12287 (Accession NM_022367) is another VGAM2276 host target gene. FLJ12287 BINDING SITE is HOST TARGET binding site found in the 3' untranslated region of mRNA encoded by FLJ12287, corresponding to a HOST TARGET binding site such as BINDING SITE I, BINDING SITE II or BINDING SITE III. Table 2 illustrates the complementarity of the nucleotide sequences of FLJ12287 BINDING SITE, designated SEQ ID:22755, to the nucleotide sequence of VGAM2276 RNA, herein designated VGAM RNA, also designated SEQ ID:4987.

Another function of VGAM2276 is therefore inhibition of FLJ12287 (Accession NM_022367). Accordingly, utilities of VGAM2276 include diagnosis, prevention and treatment of diseases and clinical conditions associated with FLJ12287. FLJ13162 (Accession NM_025002) is another VGAM2276 host target gene. FLJ13162 BINDING SITE is HOST TARGET binding site found in the 3' untranslated region of mRNA encoded by FLJ13162, corresponding to a HOST TARGET binding site such as BINDING SITE I, BINDING SITE II or BINDING SITE III. Table 2 illustrates the complementarity of the nucleotide sequences of FLJ13162 BINDING SITE, designated SEQ ID:24573, to the nucleotide sequence of VGAM2276 RNA, herein designated VGAM RNA, also designated SEQ ID:4987.

Another function of VGAM2276 is therefore inhibition of FLJ13162 (Accession NM_025002). Accordingly, utilities of VGAM2276 include diagnosis, prevention and treatment of diseases and clinical conditions associated with FLJ13162. FLJ14743 (Accession XM_042708) is another VGAM2276 host target gene. FLJ14743 BINDING SITE is HOST TARGET binding site found in the 3' untranslated region of mRNA encoded by FLJ14743, corresponding to a HOST TARGET binding site such as BINDING SITE I, BINDING SITE II or BINDING SITE III. Table 2 illustrates the complementarity of the nucleotide sequences of FLJ14743 BINDING SITE, designated SEQ ID:33761, to the nucleotide sequence of VGAM2276 RNA, herein designated VGAM RNA, also designated SEQ ID:4987.

Another function of VGAM2276 is therefore inhibition of FLJ14743 (Accession XM_042708). Accordingly, utilities of VGAM2276 include diagnosis, prevention and treatment of diseases and clinical conditions associated with FLJ14743. FLJ20739 (Accession XM_042197) is another VGAM2276 host target gene. FLJ20739 BINDING SITE is HOST TARGET binding site found in the 3' untranslated region of mRNA encoded by FLJ20739, corresponding to a HOST TARGET binding site such as BINDING SITE I, BINDING SITE II or BINDING SITE III. Table 2 illustrates the complementarity of the nucleotide sequences of FLJ20739 BINDING SITE, designated SEQ ID:33703, to the nucleotide sequence of VGAM2276 RNA, herein designated VGAM RNA, also designated SEQ ID:4987.

Another function of VGAM2276 is therefore inhibition of FLJ20739 (Accession XM_042197). Accordingly, utilities of VGAM2276 include diagnosis, prevention and treatment of diseases and clinical conditions associated with FLJ20739. KIAA0082 (Accession XM_166400) is another VGAM2276 host target gene. KIAA0082 BINDING SITE is HOST TARGET binding site found in the 3' untranslated region of mRNA encoded by KIAA0082, corresponding to a HOST TARGET binding site such as BINDING SITE I, BINDING SITE II or BINDING SITE III. Table 2 illustrates the complementarity of the nucleotide sequences of KIAA0082 BINDING SITE, designated SEQ ID:44264, to the nucleotide sequence of VGAM2276 RNA, herein designated VGAM RNA, also designated SEQ ID:4987.

Another function of VGAM2276 is therefore inhibition of KIAA0082 (Accession XM_166400). Accordingly, utilities of VGAM2276 include diagnosis, prevention and treatment of diseases and clinical conditions associated with KIAA0082. KIAA0494 (Accession NM_014774) is another VGAM2276 host target gene. KIAA0494 BINDING SITE is HOST TARGET binding site found in the 3' untranslated region of mRNA encoded by KIAA0494, corresponding to a HOST TARGET binding site such as BINDING SITE I, BINDING SITE II or BINDING SITE III. Table 2 illustrates the complementarity of the nucleotide sequences of KIAA0494 BINDING SITE, designated SEQ ID:16588, to the nucleotide sequence of VGAM2276 RNA, herein designated VGAM RNA, also designated SEQ ID:4987.

Another function of VGAM2276 is therefore inhibition of KIAA0494 (Accession NM_014774). Accordingly, utilities of VGAM2276 include diagnosis, prevention and treatment of diseases and clinical conditions associated with KIAA0494. KIAA0872 (Accession NM_014940) is another VGAM2276 host target gene. KIAA0872 BINDING SITE is HOST TARGET binding site found in the 3' untranslated region of mRNA encoded by KIAA0872, corresponding to a HOST TARGET binding site such as BINDING SITE I, BINDING SITE II or BINDING SITE III. Table 2 illustrates the complementarity of the nucleotide sequences of KIAA0872 BINDING SITE, designated SEQ ID:17248, to the nucleotide sequence of VGAM2276 RNA, herein designated VGAM RNA, also designated SEQ ID:4987.

Another function of VGAM2276 is therefore inhibition of KIAA0872 (Accession NM_014940). Accordingly, utilities of VGAM2276 include diagnosis, prevention and treatment of diseases and clinical conditions associated with KIAA0872. KIAA1344 (Accession XM_051699) is another VGAM2276 host target gene. KIAA1344 BINDING SITE is HOST TARGET binding site found in the 3' untranslated region of mRNA encoded by KIAA1344, corresponding to a HOST TARGET binding site such as BINDING SITE I, BINDING SITE II or BINDING SITE III. Table 2 illustrates the complementarity of the nucleotide sequences of KIAA1344 BINDING SITE, designated SEQ ID:35873, to the nucleotide sequence of VGAM2276 RNA, herein designated VGAM RNA, also designated SEQ ID:4987.

Another function of VGAM2276 is therefore inhibition of KIAA1344 (Accession XM_051699). Accordingly, utilities of VGAM2276 include diagnosis, prevention and treatment of diseases and clinical conditions associated with KIAA1344. KIAA1416 (Accession XM_098762) is another VGAM2276 host target gene. KIAA1416 BINDING SITE is HOST TARGET binding site found in the 5' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41804, to the nucleotide sequence of VGAM2276 RNA, herein designated VGAM RNA, also designated SEQ ID:4987.

Another function of VGAM2276 is therefore inhibition of KIAA1416 (Accession XM_098762). Accordingly, utilities of VGAM2276 include diagnosis, prevention and treatment of diseases and clinical conditions associated with KIAA1416. KIAA1821 (Accession XM_050101) is another VGAM2276 host target gene. KIAA1821 BINDING SITE is HOST TARGET binding site found in the 3' untranslated region of mRNA encoded by KIAA1821, corresponding to a HOST TARGET binding site such as BINDING SITE I, BINDING SITE II or BINDING SITE III. Table 2 illustrates the complementarity of the nucleotide sequences of KIAA1821 BINDING SITE, designated SEQ ID:35554, to the nucleotide sequence of VGAM2276 RNA, herein designated VGAM RNA, also designated SEQ ID:4987.

Another function of VGAM2276 is therefore inhibition of KIAA1821 (Accession XM_050101). Accordingly, utilities of VGAM2276 include diagnosis, prevention and treatment of diseases and clinical conditions associated with KIAA1821. KIAA1870 (Accession NM_032888) is another VGAM2276 host target gene. KIAA1870 BINDING SITE is HOST TARGET binding site found in the 5' untranslated region of mRNA encoded by KIAA1870, corresponding to a HOST TARGET binding site such as BINDING SITE I, BINDING SITE II or BINDING SITE III. Table 2 illustrates the complementarity of the nucleotide sequences of KIAA1870 BINDING SITE, designated SEQ ID:26712, to the nucleotide sequence of VGAM2276 RNA, herein designated VGAM RNA, also designated SEQ ID:4987.

Another function of VGAM2276 is therefore inhibition of KIAA1870 (Accession NM_032888). Accordingly, utilities of VGAM2276 include diagnosis, prevention and treatment of diseases and clinical conditions associated with KIAA1870. MGC10334 (Accession NM_030575) is another VGAM2276 host target gene. MGC10334 BINDING SITE is HOST TARGET binding site found in the 5' untranslated region of mRNA encoded by MGC10334, corresponding to a HOST TARGET binding site such as BINDING SITE I, BINDING SITE II or BINDING SITE III. Table 2 illustrates the complementarity of the nucleotide sequences of MGC10334 BINDING SITE, designated SEQ ID:24949, to the nucleotide sequence of VGAM2276 RNA, herein designated VGAM RNA, also designated SEQ ID:4987.

Another function of VGAM2276 is therefore inhibition of MGC10334 (Accession NM_030575). Accordingly, utilities of VGAM2276 include diagnosis, prevention and treatment of diseases and clinical conditions associated with MGC10334. Paralemmin (PALM, Accession NM_002579) is another VGAM2276 host target gene. PALM BINDING SITE is HOST TARGET binding site found in the 3' untranslated region of mRNA encoded by PALM, corresponding to a HOST TARGET binding site such as BINDING SITE I, BINDING SITE II or BINDING SITE III. Table 2 illustrates the complementarity of the nucleotide sequences of PALM BINDING SITE, designated SEQ ID:8438, to the nucleotide sequence of VGAM2276 RNA, herein designated VGAM RNA, also designated SEQ ID:4987.

Another function of VGAM2276 is therefore inhibition of Paralemmin (PALM, Accession NM_002579). Accordingly, utilities of VGAM2276 include diagnosis, prevention and treatment of diseases and clinical conditions associated with PALM. Placenta-specific 3 (PLAC3, Accession XM_045115) is another VGAM2276 host target gene. PLAC3 BINDING SITE is HOST TARGET binding site found in the 5' untranslated region of mRNA encoded by PLAC3, corresponding to a HOST TARGET binding site such as BINDING SITE I, BINDING SITE II or BINDING SITE III. Table 2 illustrates the complementarity of the nucleotide sequences of PLAC3 BINDING SITE, designated SEQ ID:34365, to the nucleotide sequence of VGAM2276 RNA, herein designated VGAM RNA, also designated SEQ ID:4987.

Another function of VGAM2276 is therefore inhibition of Placenta-specific 3 (PLAC3, Accession XM_045115). Accordingly, utilities of VGAM2276 include diagnosis, prevention and treatment of diseases and clinical conditions associated with PLAC3. PRO2015 (Accession NM_018512) is another VGAM2276 host target gene. PRO2015 BINDING SITE is HOST TARGET binding site found in the 5' untranslated region of mRNA encoded by PRO2015, corresponding to a HOST TARGET binding site such as BINDING SITE I, BINDING SITE II or BINDING SITE III. Table 2 illustrates the complementarity of the nucleotide sequences of PRO2015 BINDING SITE, designated SEQ ID:20586, to the nucleotide sequence of VGAM2276 RNA, herein designated VGAM RNA, also designated SEQ ID:4987.

Another function of VGAM2276 is therefore inhibition of PRO2015 (Accession NM_018512). Accordingly, utilities of VGAM2276 include diagnosis, prevention and treatment of diseases and clinical conditions associated with PRO2015. Signal-regulatory Protein Beta 1 (SIRPB1, Accession NM_006065) is another VGAM2276 host target gene. SIRPB1 BINDING SITE is HOST TARGET binding site found in the 3' untranslated region of mRNA encoded by SIRPB1, corresponding to a HOST TARGET binding site such as BINDING SITE I, BINDING SITE II or BINDING SITE III. Table 2 illustrates the complementarity of the nucleotide sequences of SIRPB1 BINDING SITE, designated SEQ ID:12711, to the nucleotide sequence of VGAM2276 RNA, herein designated VGAM RNA, also designated SEQ ID:4987.

Another function of VGAM2276 is therefore inhibition of Signal-regulatory Protein Beta 1 (SIRPB1, Accession NM_006065). Accordingly, utilities of VGAM2276 include diagnosis, prevention and treatment of diseases and clinical conditions associated with SIRPB1. TU3A (Accession NM_007177) is another VGAM2276 host target gene. TU3A BINDING SITE is HOST TARGET binding site found in the 5' untranslated region of mRNA encoded by TU3A, corresponding to a HOST TARGET binding site such as BINDING SITE I, BINDING SITE II or BINDING SITE III. Table 2 illustrates the complementarity of the nucleotide sequences of TU3A BINDING SITE, designated SEQ ID:14036, to the nucleotide sequence of VGAM2276 RNA, herein designated VGAM RNA, also designated SEQ ID:4987.

Another function of VGAM2276 is therefore inhibition of TU3A (Accession NM_007177). Accordingly, utilities of VGAM2276 include diagnosis, prevention and treatment of diseases and clinical conditions associated with TU3A. ZFP100 (Accession XM_046390) is another VGAM2276 host target gene. ZFP100 BINDING SITE is HOST TARGET binding site found in the 3' untranslated region of mRNA encoded by ZFP100, corresponding to a HOST TARGET binding site such as BINDING SITE I, BINDING SITE II or BINDING SITE III. Table 2 illustrates the complementarity of the nucleotide sequences of ZFP100 BINDING SITE, designated SEQ ID:34707, to the nucleotide sequence of VGAM2276 RNA, herein designated VGAM RNA, also designated SEQ ID:4987.

Another function of VGAM2276 is therefore inhibition of ZFP100 (Accession XM_046390). Accordingly, utilities of VGAM2276 include diagnosis, prevention and treatment of diseases and clinical conditions associated with ZFP100. LOC129642 (Accession NM_138799) is another VGAM2276 host target gene. LOC129642 BINDING SITE is HOST TARGET binding site found in the 5' untranslated region of mRNA encoded by LOC129642, corresponding to a HOST TARGET binding site such as BINDING SITE I, BINDING SITE II or BINDING SITE III. Table 2 illustrates the complementarity of the nucleotide sequences of LOC129642 BINDING SITE, designated SEQ ID:29021, to the nucleotide sequence of VGAM2276 RNA, herein designated VGAM RNA, also designated SEQ ID:4987.

Another function of VGAM2276 is therefore inhibition of LOC129642 (Accession NM_138799). Accordingly, utilities of VGAM2276 include diagnosis, prevention and treatment of diseases and clinical conditions associated with LOC129642. LOC143666 (Accession XM_096465) is another VGAM2276 host target gene. LOC143666 BINDING SITE is HOST TARGET binding site found in the 5' untranslated region of mRNA encoded by LOC143666, corresponding to a HOST TARGET binding site such as BINDING SITE I, BINDING SITE II or BINDING SITE III. Table 2 illustrates the complementarity of the nucleotide sequences of LOC143666 BINDING SITE, designated SEQ ID:40371, to the nucleotide sequence of VGAM2276 RNA, herein designated VGAM RNA, also designated SEQ ID:4987.

Another function of VGAM2276 is therefore inhibition of LOC143666 (Accession XM_096465). Accordingly, utilities of VGAM2276 include diagnosis, prevention and treatment of diseases and clinical conditions associated with LOC143666. LOC147229 (Accession XM_085742) is another VGAM2276 host target gene. LOC147229 BINDING SITE is HOST TARGET binding site found in the 3' untranslated region of mRNA encoded by LOC147229, corresponding to a HOST TARGET binding site such as BINDING SITE I, BINDING SITE II or BINDING SITE III. Table 2 illustrates the complementarity of the nucleotide sequences of LOC147229 BINDING SITE, designated SEQ ID:38322, to the nucleotide sequence of VGAM2276 RNA, herein designated VGAM RNA, also designated SEQ ID:4987.

Another function of VGAM2276 is therefore inhibition of LOC147229 (Accession XM_085742). Accordingly, utilities of VGAM2276 include diagnosis, prevention and treatment of diseases and clinical conditions associated with LOC147229. LOC150319 (Accession XM_086816) is another VGAM2276 host target gene. LOC150319 BINDING SITE is HOST TARGET binding site found in the 3' untranslated region of mRNA encoded by LOC150319, corresponding to a HOST TARGET binding site such as BINDING SITE I, BINDING SITE II or BINDING SITE III. Table 2 illustrates the complementarity of the nucleotide sequences of LOC150319 BINDING SITE, designated SEQ ID:38892, to the nucleotide sequence of VGAM2276 RNA, herein designated VGAM RNA, also designated SEQ ID:4987.

Another function of VGAM2276 is therefore inhibition of LOC150319 (Accession XM_086816). Accordingly, utilities of VGAM2276 include diagnosis, prevention and treatment of diseases and clinical conditions associated with LOC150319. LOC157918 (Accession XM_098842) is another VGAM2276 host target gene. LOC157918 BINDING SITE is HOST TARGET binding site found in the 3' untranslated region of mRNA encoded by LOC157918, corresponding to a HOST TARGET binding site such as BINDING SITE I, BINDING SITE II or BINDING SITE III. Table 2 illustrates the complementarity of the nucleotide sequences of LOC157918 BINDING SITE, designated SEQ ID:41895, to the nucleotide sequence of VGAM2276 RNA, herein designated VGAM RNA, also designated SEQ ID:4987.

Another function of VGAM2276 is therefore inhibition of LOC157918 (Accession XM_098842). Accordingly, utilities of VGAM2276 include diagnosis, prevention and treatment of diseases and clinical conditions associated with LOC157918. LOC157919 (Accession XM_088420) is another VGAM2276 host target gene. LOC157919 BINDING SITE is HOST TARGET binding site found in the 5' untranslated region of mRNA encoded by LOC157919, corresponding to a HOST TARGET binding site such as BINDING SITE I, BINDING SITE II or BINDING SITE III. Table 2 illustrates the complementarity of the nucleotide sequences of LOC157919 BINDING SITE, designated SEQ ID:39682, to the nucleotide sequence of VGAM2276 RNA, herein designated VGAM RNA, also designated SEQ ID:4987.

Another function of VGAM2276 is therefore inhibition of LOC157919 (Accession XM_088420). Accordingly, utilities of VGAM2276 include diagnosis, prevention and treatment of diseases and clinical conditions associated with LOC157919. LOC200197 (Accession XM_114148) is another VGAM2276 host target gene. LOC200197 BINDING SITE is HOST TARGET binding site found in the 3' untranslated region of mRNA encoded by LOC200197, corresponding to a HOST TARGET binding site such as BINDING SITE I, BINDING SITE II or BINDING SITE III. Table 2 illustrates the complementarity of the nucleotide sequences of LOC200197 BINDING SITE, designated SEQ ID:42731, to the nucleotide sequence of VGAM2276 RNA, herein designated VGAM RNA, also designated SEQ ID:4987.

Another function of VGAM2276 is therefore inhibition of LOC200197 (Accession XM_114148). Accordingly, utilities of VGAM2276 include diagnosis, prevention and treatment of diseases and clinical conditions associated with LOC200197. LOC200583 (Accession XM_114265) is another VGAM2276 host target gene. LOC200583 BINDING SITE is HOST TARGET binding site found in the 5' untranslated region of mRNA encoded by LOC200583, corresponding to a HOST TARGET binding site such as BINDING SITE I, BINDING SITE II or BINDING SITE III. Table 2 illustrates the complementarity of the nucleotide sequences of LOC200583 BINDING SITE, designated SEQ ID:42822, to the nucleotide sequence of VGAM2276 RNA, herein designated VGAM RNA, also designated SEQ ID:4987.

Another function of VGAM2276 is therefore inhibition of LOC200583 (Accession XM_114265). Accordingly, utilities of VGAM2276 include diagnosis, prevention and treatment of diseases and clinical conditions associated with LOC200583. LOC202052 (Accession XM_117355) is another VGAM2276 host target gene. LOC202052 BINDING SITE is HOST TARGET binding site found in the 3' untranslated region of mRNA encoded by LOC202052, corresponding to a HOST TARGET binding site such as BINDING SITE I, BINDING SITE II or BINDING SITE III. Table 2 illustrates the complementarity of the nucleotide sequences of LOC202052 BINDING SITE, designated SEQ ID:43409, to the nucleotide sequence of VGAM2276 RNA, herein designated VGAM RNA, also designated SEQ ID:4987.

Another function of VGAM2276 is therefore inhibition of LOC202052 (Accession XM_117355). Accordingly, utilities of VGAM2276 include diagnosis, prevention and treatment of diseases and clinical conditions associated with LOC202052. LOC220827 (Accession XM_166052) is another VGAM2276 host target gene. LOC220827 BINDING SITE is HOST TARGET binding site found in the 3' untranslated region of mRNA encoded by LOC220827, corresponding to a HOST TARGET binding site such as BINDING SITE I, BINDING SITE II or BINDING SITE III. Table 2 illustrates the complementarity of the nucleotide sequences of LOC220827 BINDING SITE, designated SEQ ID:43844, to the nucleotide sequence of VGAM2276 RNA, herein designated VGAM RNA, also designated SEQ ID:4987.

Another function of VGAM2276 is therefore inhibition of LOC220827 (Accession XM_166052). Accordingly, utilities of VGAM2276 include diagnosis, prevention and treatment of diseases and clinical conditions associated with LOC220827. LOC222008 (Accession XM_168361) is another VGAM2276 host target gene. LOC222008 BINDING SITE is HOST TARGET binding site found in the 3' untranslated region of mRNA encoded by LOC222008, corresponding to a HOST TARGET binding site such as BINDING SITE I, BINDING SITE II or BINDING SITE III. Table 2 illustrates the complementarity of the nucleotide sequences of LOC222008 BINDING SITE, designated SEQ ID:45126, to the nucleotide sequence of VGAM2276 RNA, herein designated VGAM RNA, also designated SEQ ID:4987.

Another function of VGAM2276 is therefore inhibition of LOC222008 (Accession XM_168361). Accordingly, utilities of VGAM2276 include diagnosis, prevention and treatment of diseases and clinical conditions associated with LOC222008. LOC92017 (Accession XM_042234) is another VGAM2276 host target gene. LOC92017 BINDING SITE is HOST TARGET binding site found in the 3' untranslated region of mRNA encoded by LOC92017, corresponding to a HOST TARGET binding site such as BINDING SITE I, BINDING SITE II or BINDING SITE III. Table 2 illustrates the complementarity of the nucleotide sequences of LOC92017 BINDING SITE, designated SEQ ID:33710, to the nucleotide sequence of VGAM2276 RNA, herein designated VGAM RNA, also designated SEQ ID:4987.

Another function of VGAM2276 is therefore inhibition of LOC92017 (Accession XM_042234). Accordingly, utilities of VGAM2276 include diagnosis, prevention and treatment of diseases and clinical conditions associated with LOC92017. FIG. 1 further provides a conceptual description of a novel bioinformatically detected viral gene of the present invention, referred to here as Viral Genomic Address Messenger 2277 (VGAM2277) viral gene, which modulates expression of respective host target genes thereof, the function and utility of which host target genes is known in the art.

VGAM2277 is a novel bioinformatically detected regulatory, non protein coding, viral micro RNA (miRNA) gene. The method by which VGAM2277 was detected is described hereinabove with reference to FIGS. 1-8.

VGAM2277 gene, herein designated VGAM GENE, is a viral gene contained in the genome of Alcelaphine Herpesvirus 1. VGAM2277 host target gene, herein designated VGAM HOST TARGET GENE, is a human gene contained in the human genome.

VGAM2277 gene encodes a VGAM2277 precursor RNA, herein designated VGAM PRECURSOR RNA. Similar to other miRNA genes, and unlike most ordinary genes, VGAM2277 precursor RNA does not encode a protein. A nucleotide sequence identical or highly similar to the nucleotide sequence of VGAM2277 precursor RNA is designated SEQ ID:2263, and is provided hereinbelow with reference to the sequence listing part. Nucleotide sequence SEQ ID:2263 is located at position 27286 relative to the genome of Alcelaphine Herpesvirus 1.

VGAM2277 precursor RNA folds onto itself, forming VGAM2277 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2277 folded precursor RNA into VGAM2277 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2277 RNA is designated SEQ ID:4988, and is provided hereinbelow with reference to the sequence listing part.

VGAM2277 host target gene, herein designated VGAM HOST TARGET GENE, encodes a corresponding messenger RNA, VGAM2277 host target RNA, herein designated VGAM HOST TARGET RNA. VGAM2277 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2277 RNA, herein designated VGAM RNA, binds complementarily to one or more host target binding sites located in untranslated regions of VGAM2277 host target RNA, herein designated VGAM HOST TARGET RNA. This complementary binding is due to the fact that the nucleotide sequence of VGAM2277 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2277 RNA, herein designated VGAM RNA, may have a different number of host target binding sites in untranslated regions of a VGAM2277 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2277 RNA, herein designated VGAM RNA, to host target binding sites on VGAM2277 host target RNA, herein designated VGAM HOST TARGET RNA, such as BINDING SITE I, BINDING SITE II and BINDING SITE III, inhibits translation of VGAM2277 host target RNA into VGAM2277 host target protein, herein designated VGAM HOST TARGET PROTEIN. VGAM host target protein is therefore outlined by a broken line.

It is appreciated that VGAM2277 host target gene, herein designated VGAM HOST TARGET GENE, in fact represents a plurality of VGAM2277 host target genes. The mRNA of each one of this plurality of VGAM2277 host target genes comprises one or more host target binding sites, each having a nucleotide sequence which is at least partly complementary to VGAM2277 RNA, herein designated VGAM RNA, and which when bound by VGAM2277 RNA causes inhibition of translation of respective one or more VGAM2277 host target proteins.

It is further appreciated by one skilled in the art that the mode of translational inhibition illustrated by FIG. 1 with specific reference to translational inhibition exerted by VGAM2277 gene, herein designated VGAM GENE, on one or more VGAM2277 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2277 is inhibition of expression of host target genes, as part of a novel viral mechanism of attacking a host. Accordingly, utilities of VGAM2277 include diagnosis, prevention and treatment of viral infection by Alcelaphine Herpesvirus 1. Specific functions, and accordingly utilities, of VGAM2277 correlate with, and may be deduced from, the identity of the host target genes which VGAM2277 binds and inhibits, and the function of these host target genes, as elaborated hereinbelow.

Nucleotide sequences of the VGAM2277 precursor RNA, herein designated VGAM PRECURSOR RNA, and of the 'diced' VGAM2277 RNA, herein designated VGAM RNA, and a schematic representation of the secondary folding of VGAM2277 folded precursor RNA, herein designated VGAM FOLDED PRECURSOR RNA, of VGAM2277 are further described hereinbelow with reference to Table 1.

Nucleotide sequences of host target binding sites, such as BINDING SITE-I, BINDING SITE-II and BINDING SITE-III of FIG. 1, found on VGAM2277 host target RNA, and schematic representation of the complementarity of each of these host target binding sites to VGAM2277 RNA, herein designated VGAM RNA, are described hereinbelow with reference to Table 2.

As mentioned hereinabove with reference to FIG. 1, a function of VGAM2277 gene, herein designated VGAM is inhibition of expression of VGAM2277 target genes. It is appreciated that specific functions, and accordingly utilities, of VGAM2277 correlate with, and may be deduced from, the identity of the target genes which VGAM2277 binds and inhibits, and the function of these target genes, as elaborated hereinbelow.

ATPase, Aminophospholipid Transporter-like, Class I, Type 8A, Member 2 (ATP8A2, Accession XM_167916) is a VGAM2277 host target gene. ATP8A2 BINDING SITE is HOST TARGET binding site found in the 3' untranslated region of mRNA encoded by ATP8A2, corresponding to a HOST TARGET binding site such as BINDING SITE I, BINDING SITE II or BINDING SITE III. Table 2 illustrates the complementarity of the nucleotide sequences of ATP8A2 BINDING SITE, designated SEQ ID:44920, to the nucleotide sequence of VGAM2277 RNA, herein designated VGAM RNA, also designated SEQ ID:4988.

A function of VGAM2277 is therefore inhibition of ATPase, Aminophospholipid Transporter-like, Class I, Type 8A, Member 2 (ATP8A2, Accession XM_167916). Accordingly, utilities of VGAM2277 include diagnosis, prevention and treatment of diseases and clinical conditions associated with ATP8A2. Filamin B, Beta (actin binding protein 278) (FLNB, Accession XM_030806) is another VGAM2277 host target gene. FLNB BINDING SITE is HOST TARGET binding site found in the 3' untranslated region of mRNA encoded by FLNB, corresponding to a HOST TARGET binding site such as BINDING SITE I, BINDING SITE II or BINDING SITE III. Table 2 illustrates the complementarity of the nucleotide sequences of FLNB BINDING SITE, designated SEQ ID:31138, to the nucleotide sequence of VGAM2277 RNA, herein designated VGAM RNA, also designated SEQ ID:4988.

Another function of VGAM2277 is therefore inhibition of Filamin B, Beta (actin binding protein 278) (FLNB, Accession XM_030806), a gene which Filamin B, beta; binds actin, interacts with cytoplasmic domain of Ibalpha. Accordingly, utilities of VGAM2277 include diagnosis, prevention and treatment of diseases and clinical conditions associated with FLNB. The function of FLNB and its association with various diseases and clinical conditions, has been established by previous studies, as described hereinabove with reference to VGAM416. Myxovirus (influenza virus) Resistance 2 (mouse) (MX2, Accession NM_002463) is another VGAM2277 host target gene. MX2 BINDING SITE is HOST TARGET binding site found in the 3' untranslated region of mRNA encoded by MX2, corresponding to a HOST TARGET binding site such as BINDING SITE I, BINDING SITE II or BINDING SITE III. Table 2 illustrates the complementarity of the nucleotide sequences of MX2 BINDING SITE, designated SEQ ID:8294, to the nucleotide sequence of VGAM2277 RNA, herein designated VGAM RNA, also designated SEQ ID:4988.

Another function of VGAM2277 is therefore inhibition of Myxovirus (influenza virus) Resistance 2 (mouse) (MX2, Accession NM_002463). Accordingly, utilities of VGAM2277 include diagnosis, prevention and treatment of diseases and clinical conditions associated with MX2. PAG (Accession NM_018440) is another VGAM2277 host target gene. PAG BINDING SITE is HOST TARGET binding site found in the 3' untranslated region of mRNA encoded by PAG, corresponding to a HOST TARGET binding site such as BINDING SITE I, BINDING SITE II or BINDING SITE III. Table 2 illustrates the complementarity of the nucleotide sequences of PAG BINDING SITE, designated SEQ ID:20511, to the nucleotide sequence of VGAM2277 RNA, herein designated VGAM RNA, also designated SEQ ID:4988.

Another function of VGAM2277 is therefore inhibition of PAG (Accession NM_018440). Accordingly, utilities of VGAM2277 include diagnosis, prevention and treatment of diseases and clinical conditions associated with PAG. Protocadherin 9 (PCDH9, Accession XM_096054) is another VGAM2277 host target gene. PCDH9 BINDING SITE is HOST TARGET binding site found in the 5' untranslated region of mRNA encoded by PCDH9, corresponding to a HOST TARGET binding site such as BINDING SITE I, BINDING SITE II or BINDING SITE III. Table 2 illustrates the complementarity of the nucleotide sequences of PCDH9 BINDING SITE, designated SEQ ID:40293, to the nucleotide sequence of VGAM2277 RNA, herein designated VGAM RNA, also designated SEQ ID:4988.

Another function of VGAM2277 is therefore inhibition of Protocadherin 9 (PCDH9, Accession XM_096054). Accordingly, utilities of VGAM2277 include diagnosis, prevention and treatment of diseases and clinical conditions associated with PCDH9. Ribonuclease/angiogenin Inhibitor (RNH, Accession NM_002939) is another VGAM2277 host target gene. RNH BINDING SITE is HOST TARGET binding site found in the 5' untranslated region of mRNA encoded by RNH, corresponding to a HOST TARGET binding site such as BINDING SITE I, BINDING SITE II or BINDING SITE III. Table 2 illustrates the complementarity of the nucleotide sequences of RNH BINDING SITE, designated SEQ ID:8843, to the nucleotide sequence of VGAM2277 RNA, herein designated VGAM RNA, also designated SEQ ID:4988.

Another function of VGAM2277 is therefore inhibition of Ribonuclease/angiogenin Inhibitor (RNH, Accession NM_002939), a gene which is an inhibitor of pancreatic rnase and angiogenin. may also function in the modulation of cellular activities. Accordingly, utilities of VGAM2277 include diagnosis, prevention and treatment of diseases and clinical conditions associated with RNH. The function of RNH and its association with various diseases and clinical conditions, has been established by previous studies, as described hereinabove with reference to VGAM484. Tumor Necrosis Factor (ligand) Superfamily, Member 8 (TNFSF8, Accession NM_001244) is another VGAM2277 host target gene. TNFSF8 BINDING SITE is HOST TARGET binding site found in the 3' untranslated region of mRNA encoded by TNFSF8, corresponding to a HOST TARGET binding site such as BINDING SITE I, BINDING SITE II or BINDING SITE III. Table 2 illustrates the complementarity of the nucleotide sequences of TNFSF8 BINDING SITE, designated SEQ ID:6915, to the nucleotide sequence of VGAM2277 RNA, herein designated VGAM RNA, also designated SEQ ID:4988.

Another function of VGAM2277 is therefore inhibition of Tumor Necrosis Factor (ligand) Superfamily, Member 8 (TNFSF8, Accession NM_001244), a gene which cytokine that binds to tnfrsf8/cd30. induces proliferation of t cells. Accordingly, utilities of VGAM2277 include diagnosis, prevention and treatment of diseases and clinical conditions associated with TNFSF8. The function of TNFSF8 and its association with various diseases and clinical conditions, has been established by previous studies, as described hereinabove with reference to VGAM655. ARP3 Actin-related Protein 3 Homolog (yeast) (ACTR3, Accession NM_005721) is another VGAM2277 host target gene. ACTR3 BINDING SITE is HOST TARGET binding site found in the 3' untranslated region of mRNA encoded by ACTR3, corresponding to a HOST TARGET binding site such as BINDING SITE I, BINDING SITE II or BINDING SITE III. Table 2 illustrates the complementarity of the nucleotide sequences of ACTR3 BINDING SITE, designated SEQ ID:12273, to the nucleotide sequence of VGAM2277 RNA, herein designated VGAM RNA, also designated SEQ ID:4988.

Another function of VGAM2277 is therefore inhibition of ARP3 Actin-related Protein 3 Homolog (yeast) (ACTR3, Accession NM_005721). Accordingly, utilities of VGAM2277 include diagnosis, prevention and treatment of diseases and clinical conditions associated with ACTR3. ERp44 (Accession XM_088476) is another VGAM2277 host target gene. ERp44 BINDING SITE is HOST TARGET binding site found in the 3' untranslated region of mRNA encoded by ERp44, corresponding to a HOST TARGET binding site such as BINDING SITE I, BINDING SITE II or BINDING SITE III. Table 2 illustrates the complementarity of the nucleotide sequences of ERp44 BINDING SITE, designated SEQ ID:39721, to the nucleotide sequence of VGAM2277 RNA, herein designated VGAM RNA, also designated SEQ ID:4988.

Another function of VGAM2277 is therefore inhibition of ERp44 (Accession XM_088476). Accordingly, utilities of VGAM2277 include diagnosis, prevention and treatment of diseases and clinical conditions associated with ERp44. FLJ10330 (Accession NM_018061) is another VGAM2277 host target gene. FLJ10330 BINDING SITE is HOST TARGET binding site found in the 3' untranslated region of mRNA encoded by FLJ10330, corresponding to a HOST TARGET binding site such as BINDING SITE I, BINDING SITE II or BINDING SITE III. Table 2 illustrates the complementarity of the nucleotide sequences of FLJ10330 BINDING SITE, designated SEQ ID:19832, to the nucleotide sequence of VGAM2277 RNA, herein designated VGAM RNA, also designated SEQ ID:4988.

Another function of VGAM2277 is therefore inhibition of FLJ10330 (Accession NM_018061). Accordingly, utilities of VGAM2277 include diagnosis, prevention and treatment of diseases and clinical conditions associated with FLJ10330. FLJ10849 (Accession NM_018243) is another VGAM2277 host target gene. FLJ10849 BINDING SITE is HOST TARGET binding site found in the 3' untranslated region of mRNA encoded by FLJ10849, corresponding to a HOST TARGET binding site such as BINDING SITE I, BINDING SITE II or BINDING SITE III. Table 2 illustrates the complementarity of the nucleotide sequences of FLJ10849 BINDING SITE, designated SEQ ID:20203, to the nucleotide sequence of VGAM2277 RNA, herein designated VGAM RNA, also designated SEQ ID:4988.

Another function of VGAM2277 is therefore inhibition of FLJ10849 (Accession NM_018243). Accordingly, utilities of VGAM2277 include diagnosis, prevention and treatment of diseases and clinical conditions associated with FLJ10849. FLJ23121 (Accession NM_024694) is another VGAM2277 host target gene. FLJ23121 BINDING SITE is HOST TARGET binding site found in the 3' untranslated region of mRNA encoded by FLJ23121, corresponding to a HOST TARGET binding site such as BINDING SITE I, BINDING SITE II or BINDING SITE III. Table 2 illustrates the complementarity of the nucleotide sequences of FLJ23121 BINDING SITE, designated SEQ ID:24003, to the nucleotide sequence of VGAM2277 RNA, herein designated VGAM RNA, also designated SEQ ID:4988.

Another function of VGAM2277 is therefore inhibition of FLJ23121 (Accession NM_024694). Accordingly, utilities of VGAM2277 include diagnosis, prevention and treatment of diseases and clinical conditions associated with FLJ23121. FLJ23519 (Accession NM_032240) is another VGAM2277 host target gene. FLJ23519 BINDING SITE1 and FLJ23519 BINDING SITE2 are HOST TARGET binding sites found in untranslated regions of mRNA encoded by FLJ23519, corresponding to HOST TARGET binding sites such as BINDING SITE I, BINDING SITE II or BINDING SITE III. Table 2 illustrates the complementarity of the nucleotide sequences of FLJ23519 BINDING SITE1 and FLJ23519 BINDING SITE2, designated SEQ ID:25973 and SEQ ID:34306 respectively, to the nucleotide sequence of VGAM2277 RNA, herein designated VGAM RNA, also designated SEQ ID:4988.

Another function of VGAM2277 is therefore inhibition of FLJ23519 (Accession NM_032240). Accordingly, utilities of VGAM2277 include diagnosis, prevention and treatment of diseases and clinical conditions associated with FLJ23519. KIAA1130 (Accession XM_031104) is another VGAM2277 host target gene. KIAA1130 BINDING SITE is HOST TARGET binding site found in the 3' untranslated region of mRNA encoded by KIAA1130, corresponding to a HOST TARGET binding site such as BINDING SITE I, BINDING SITE II or BINDING SITE III. Table 2 illustrates the complementarity of the nucleotide sequences of KIAA1130 BINDING SITE, designated SEQ ID:31279, to the nucleotide sequence of VGAM2277 RNA, herein designated VGAM RNA, also designated SEQ ID:4988.

Another function of VGAM2277 is therefore inhibition of KIAA1130 (Accession XM_031104). Accordingly, utilities of VGAM2277 include diagnosis, prevention and treatment of diseases and clinical conditions associated with KIAA1130. KIAA1238 (Accession XM_048675) is another VGAM2277 host target gene. KIAA1238 BINDING SITE is HOST TARGET binding site found in the 3' untranslated region of mRNA encoded by KIAA1238, corresponding to a HOST TARGET binding site such as BINDING SITE I, BINDING SITE II or BINDING SITE III. Table 2 illustrates the complementarity of the nucleotide sequences of KIAA1238 BINDING SITE, designated SEQ ID:35216, to the nucleotide sequence of VGAM2277 RNA, herein designated VGAM RNA, also designated SEQ ID:4988.

Another function of VGAM2277 is therefore inhibition of KIAA1238 (Accession XM_048675). Accordingly, utilities of VGAM2277 include diagnosis, prevention and treatment of diseases and clinical conditions associated with KIAA1238. LAP1B (Accession XM_035429) is another VGAM2277 host target gene. LAP1B BINDING SITE is HOST TARGET binding site found in the 5' untranslated region of mRNA encoded by LAP1B, corresponding to a HOST TARGET binding site such as BINDING SITE I, BINDING SITE II or BINDING SITE III. Table 2 illustrates the complementarity of the nucleotide sequences of LAP1B BINDING SITE, designated SEQ ID:32262, to the nucleotide sequence of VGAM2277 RNA, herein designated VGAM RNA, also designated SEQ ID:4988.

Another function of VGAM2277 is therefore inhibition of LAP1B (Accession XM_035429). Accordingly, utilities of VGAM2277 include diagnosis, prevention and treatment of diseases and clinical conditions associated with LAP1B. MGC14289 (Accession NM_080660) is another VGAM2277 host target gene. MGC14289 BINDING SITE is HOST TARGET binding site found in the 3' untranslated region of mRNA encoded by MGC14289, corresponding to a HOST TARGET binding site such as BINDING SITE I, BINDING SITE II or BINDING SITE III. Table 2 illustrates the complementarity of the nucleotide sequences of MGC14289 BINDING SITE, designated SEQ ID:27947, to the nucleotide sequence of VGAM2277 RNA, herein designated VGAM RNA, also designated SEQ ID:4988.

Another function of VGAM2277 is therefore inhibition of MGC14289 (Accession NM_080660). Accordingly, utilities of VGAM2277 include diagnosis, prevention and treatment of diseases and clinical conditions associated with MGC14289. Purinergic Receptor P2X, Ligand-gated Ion Channel, 1 (P2RX1, Accession XM_040635) is another VGAM2277 host target gene. P2RX1 BINDING SITE is HOST TARGET binding site found in the 3' untranslated region of mRNA encoded by P2RX1, corresponding to a HOST TARGET binding site such as BINDING SITE I, BINDING SITE II or BINDING SITE III. Table 2 illustrates the complementarity of the nucleotide sequences of P2RX1 BINDING SITE, designated SEQ ID:33351, to the nucleotide sequence of VGAM2277 RNA, herein designated VGAM RNA, also designated SEQ ID:4988.

Another function of VGAM2277 is therefore inhibition of Purinergic Receptor P2X, Ligand-gated Ion Channel, 1 (P2RX1, Accession XM_040635). Accordingly, utilities of VGAM2277 include diagnosis, prevention and treatment of diseases and clinical conditions associated with P2RX1. SYNCOILIN (Accession NM_030786) is another VGAM2277 host target gene. SYNCOILIN BINDING SITE is HOST TARGET binding site found in the 3' untranslated region of mRNA encoded by SYNCOILIN, corresponding to a HOST TARGET binding site such as BINDING SITE I, BINDING SITE II or BINDING SITE III. Table 2 illustrates the complementarity of the nucleotide sequences of SYNCOILIN BINDING SITE, designated SEQ ID:25080, to the nucleotide sequence of VGAM2277 RNA, herein designated VGAM RNA, also designated SEQ ID:4988.

Another function of VGAM2277 is therefore inhibition of SYNCOILIN (Accession NM_030786). Accordingly, utilities of VGAM2277 include diagnosis, prevention and treatment of diseases and clinical conditions associated with SYNCOILIN. LOC132880 (Accession XM_059609) is another VGAM2277 host target gene. LOC132880 BINDING SITE is HOST TARGET binding site found in the 5' untranslated region of mRNA encoded by LOC132880, corresponding to a HOST TARGET binding site such as BINDING SITE I, BINDING SITE II or BINDING SITE III. Table 2 illustrates the complementarity of the nucleotide sequences of LOC132880 BINDING SITE, designated SEQ ID:37030, to the nucleotide sequence of VGAM2277 RNA, herein designated VGAM RNA, also designated SEQ ID:4988.

Another function of VGAM2277 is therefore inhibition of LOC132880 (Accession XM_059609). Accordingly, utilities of VGAM2277 include diagnosis, prevention and treatment of diseases and clinical conditions associated with LOC132880. LOC158014 (Accession XM_088442) is another VGAM2277 host target gene. LOC158014 BINDING SITE is HOST TARGET binding site found in the 5' untranslated region of mRNA encoded by LOC158014, corresponding to a HOST TARGET binding site such as BINDING SITE I, BINDING SITE II or BINDING SITE III. Table 2 illustrates the complementarity of the nucleotide sequences of LOC158014 BINDING SITE, designated SEQ ID:39691, to the nucleotide sequence of VGAM2277 RNA, herein designated VGAM RNA, also designated SEQ ID:4988.

Another function of VGAM2277 is therefore inhibition of LOC158014 (Accession XM_088442). Accordingly, utilities of VGAM2277 include diagnosis, prevention and treatment of diseases and clinical conditions associated with LOC158014. LOC158357 (Accession XM_088553) is another VGAM2277 host target gene. LOC158357 BINDING SITE is HOST TARGET binding site found in the 3' untranslated region of mRNA encoded by LOC158357, corresponding to a HOST TARGET binding site such as BINDING SITE I, BINDING SITE II or BINDING SITE III. Table 2 illustrates the complementarity of the nucleotide sequences of LOC158357 BINDING SITE, designated SEQ ID:39819, to the nucleotide sequence of VGAM2277 RNA, herein designated VGAM RNA, also designated SEQ ID:4988.

Another function of VGAM2277 is therefore inhibition of LOC158357 (Accession XM_088553). Accordingly, utilities of VGAM2277 include diagnosis, prevention and treatment of diseases and clinical conditions associated with LOC158357. LOC162137 (Accession XM_102426) is another VGAM2277 host target gene. LOC162137 BINDING SITE is HOST TARGET binding site found in the 3' untranslated region of mRNA encoded by LOC162137, corresponding to a HOST TARGET binding site such as BINDING SITE I, BINDING SITE II or BINDING SITE III. Table 2 illustrates the complementarity of the nucleotide sequences of LOC162137 BINDING SITE, designated SEQ ID:42113, to the nucleotide sequence of VGAM2277 RNA, herein designated VGAM RNA, also designated SEQ ID:4988.

Another function of VGAM2277 is therefore inhibition of LOC162137 (Accession XM_102426). Accordingly, utilities of VGAM2277 include diagnosis, prevention and treatment of diseases and clinical conditions associated with LOC162137. LOC253596 (Accession XM_170934) is another VGAM2277 host target gene. LOC253596 BINDING SITE is HOST TARGET binding site found in the 5' untranslated region of mRNA encoded by LOC253596, corresponding to a HOST TARGET binding site such as BINDING SITE I, BINDING SITE II or BINDING SITE III. Table 2 illustrates the complementarity of the nucleotide sequences of LOC253596 BINDING SITE, designated SEQ ID:45722, to the nucleotide sequence of VGAM2277 RNA, herein designated VGAM RNA, also designated SEQ ID:4988.

Another function of VGAM2277 is therefore inhibition of LOC253596 (Accession XM_170934). Accordingly, utilities of VGAM2277 include diagnosis, prevention and treatment of diseases and clinical conditions associated with LOC253596. FIG. 1 further provides a conceptual description of a novel bioinformatically detected viral gene of the present invention, referred to here as Viral Genomic Address Messenger 2278 (VGAM2278) viral gene, which modulates expression of respective host target genes thereof, the function and utility of which host target genes is known in the art.

VGAM2278 is a novel bioinformatically detected regulatory, non protein coding, viral micro RNA (miRNA) gene. The method by which VGAM2278 was detected is described hereinabove with reference to FIGS. 1-8.

VGAM2278 gene, herein designated VGAM GENE, is a viral gene contained in the genome of Alcelaphine Herpesvirus 1. VGAM2278 host target gene, herein designated VGAM HOST TARGET GENE, is a human gene contained in the human genome.

VGAM2278 gene encodes a VGAM2278 precursor RNA, herein designated VGAM PRECURSOR RNA. Similar to other miRNA genes, and unlike most ordinary genes, VGAM2278 precursor RNA does not encode a protein. A nucleotide sequence identical or highly similar to the nucleotide sequence of VGAM2278 precursor RNA is designated SEQ ID:2264, and is provided hereinbelow with reference to the sequence listing part. Nucleotide sequence SEQ ID:2264 is located at position 29724 relative to the genome of Alcelaphine Herpesvirus 1.

VGAM2278 precursor RNA folds onto itself, forming VGAM2278 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2278 folded precursor RNA into VGAM2278 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2278 RNA is designated SEQ ID:4989, and is provided hereinbelow with reference to the sequence listing part.

VGAM2278 host target gene, herein designated VGAM HOST TARGET GENE, encodes a corresponding messenger RNA, VGAM2278 host target RNA, herein designated VGAM HOST TARGET RNA. VGAM2278 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2278 RNA, herein designated VGAM RNA, binds complementarily to one or more host target binding sites located in untranslated regions of VGAM2278 host target RNA, herein designated VGAM HOST TARGET RNA. This complementary binding is due to the fact that the nucleotide sequence of VGAM2278 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2278 RNA, herein designated VGAM RNA, may have a different number of host target binding sites in untranslated regions of a VGAM2278 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2278 RNA, herein designated VGAM RNA, to host target binding sites on VGAM2278 host target RNA, herein designated VGAM HOST TARGET RNA, such as BINDING SITE I, BINDING SITE II and BINDING SITE III, inhibits translation of VGAM2278 host target RNA into VGAM2278 host target protein, herein designated VGAM HOST TARGET PROTEIN. VGAM host target protein is therefore outlined by a broken line.

It is appreciated that VGAM2278 host target gene, herein designated VGAM HOST TARGET GENE, in fact represents a plurality of VGAM2278 host target genes. The mRNA of each one of this plurality of VGAM2278 host target genes comprises one or more host target binding sites, each having a nucleotide sequence which is at least partly complementary to VGAM2278 RNA, herein designated VGAM RNA, and which when bound by VGAM2278 RNA causes inhibition of translation of respective one or more VGAM2278 host target proteins.

It is further appreciated by one skilled in the art that the mode of translational inhibition illustrated by FIG. 1 with specific reference to translational inhibition exerted by VGAM2278 gene, herein designated VGAM GENE, on one or more VGAM2278 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2278 is inhibition of expression of host target genes, as part of a novel viral mechanism of attacking a host. Accordingly, utilities of VGAM2278 include diagnosis, prevention and treatment of viral infection by Alcelaphine Herpesvirus 1. Specific functions, and accordingly utilities, of VGAM2278 correlate with, and may be deduced from, the identity of the host target genes which VGAM2278 binds and inhibits, and the function of these host target genes, as elaborated hereinbelow.

Nucleotide sequences of the VGAM2278 precursor RNA, herein designated VGAM PRECURSOR RNA, and of the 'diced' VGAM2278 RNA, herein designated VGAM RNA, and a schematic representation of the secondary folding of VGAM2278 folded precursor RNA, herein designated VGAM FOLDED PRECURSOR RNA, of VGAM2278 are further described hereinbelow with reference to Table 1.

Nucleotide sequences of host target binding sites, such as BINDING SITE-I, BINDING SITE-II and BINDING SITE-III of FIG. 1, found on VGAM2278 host target RNA, and schematic representation of the complementarity of each of these host target binding sites to VGAM2278 RNA, herein designated VGAM RNA, are described hereinbelow with reference to Table 2.

As mentioned hereinabove with reference to FIG. 1, a function of VGAM2278 gene, herein designated VGAM is inhibition of expression of VGAM2278 target genes. It is appreciated that specific functions, and accordingly utilities, of VGAM2278 correlate with, and may be deduced from, the identity of the target genes which VGAM2278 binds and inhibits, and the function of these target genes, as elaborated hereinbelow.

LOC200339 (Accession XM_117226) is a VGAM2278 host target gene. LOC200339 BINDING SITE1 and LOC200339 BINDING SITE2 are HOST TARGET binding sites found in untranslated regions of mRNA encoded by LOC200339, corresponding to HOST TARGET binding sites such as BINDING SITE I, BINDING SITE II or BINDING SITE III. Table 2 illustrates the complementarity of the nucleotide sequences of LOC200339 BINDING SITE1 and LOC200339 BINDING SITE2, designated SEQ ID:43301 and SEQ ID:43302 respectively, to the nucleotide sequence of VGAM2278 RNA, herein designated VGAM RNA, also designated SEQ ID:4989.

A function of VGAM2278 is therefore inhibition of LOC200339 (Accession XM_117226). Accordingly, utilities of VGAM2278 include diagnosis, prevention and treatment of diseases and clinical conditions associated with LOC200339. FIG. 1 further provides a conceptual description of a novel bioinformatically detected viral gene of the present invention, referred to here as Viral Genomic Address Messenger 2279 (VGAM2279) viral gene, which modulates expression of respective host target genes thereof, the function and utility of which host target genes is known in the art.

VGAM2279 is a novel bioinformatically detected regulatory, non protein coding, viral micro RNA (miRNA) gene. The method by which VGAM2279 was detected is described hereinabove with reference to FIGS. 1-8.

VGAM2279 gene, herein designated VGAM GENE, is a viral gene contained in the genome of Alcelaphine Herpesvirus 1. VGAM2279 host target gene, herein designated VGAM HOST TARGET GENE, is a human gene contained in the human genome.

VGAM2279 gene encodes a VGAM2279 precursor RNA, herein designated VGAM PRECURSOR RNA. Similar to other miRNA genes, and unlike most ordinary genes, VGAM2279 precursor RNA does not encode a protein. A nucleotide sequence identical or highly similar to the nucleotide sequence of VGAM2279 precursor RNA is designated SEQ ID:2265, and is provided hereinbelow with reference to the sequence listing part. Nucleotide sequence SEQ ID:2265 is located at position 26039 relative to the genome of Alcelaphine Herpesvirus 1.

VGAM2279 precursor RNA folds onto itself, forming VGAM2279 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2279 folded precursor RNA into VGAM2279 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM2279 RNA is designated SEQ ID:4990, and is provided hereinbelow with reference to the sequence listing part.

VGAM2279 host target gene, herein designated VGAM HOST TARGET GENE, encodes a corresponding messenger RNA, VGAM2279 host target RNA, herein designated VGAM HOST TARGET RNA. VGAM2279 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2279 RNA, herein designated VGAM RNA, binds complementarily to one or more host target binding sites located in untranslated regions of VGAM2279 host target RNA, herein designated VGAM HOST TARGET RNA. This complementary binding is due to the fact that the nucleotide sequence of VGAM2279 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2279 RNA, herein designated VGAM RNA, may have a different number of host target binding sites in untranslated regions of a VGAM2279 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2279 RNA, herein designated VGAM RNA, to host target binding sites on VGAM2279 host target RNA, herein designated VGAM HOST TARGET RNA, such as BINDING SITE I, BINDING SITE II and BINDING SITE III, inhibits translation of VGAM2279 host target RNA into VGAM2279 host target protein, herein designated VGAM HOST TARGET PROTEIN. VGAM host target protein is therefore outlined by a broken line.

It is appreciated that VGAM2279 host target gene, herein designated VGAM HOST TARGET GENE, in fact represents a plurality of VGAM2279 host target genes. The mRNA of each one of this plurality of VGAM2279 host target genes comprises one or more host target binding sites, each having a nucleotide sequence which is at least partly complementary to VGAM2279 RNA, herein designated VGAM RNA, and which when bound by VGAM2279 RNA causes inhibition of translation of respective one or more VGAM2279 host target proteins.

It is further appreciated by one skilled in the art that the mode of translational inhibition illustrated by FIG. 1 with specific reference to translational inhibition exerted by VGAM2279 gene, herein designated VGAM GENE, on one or more VGAM2279 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2279 is inhibition of expression of host target genes, as part of a novel viral mechanism of attacking a host. Accordingly, utilities of VGAM2279 include diagnosis, prevention and treatment of viral infection by Alcelaphine Herpesvirus 1. Specific functions, and accordingly utilities, of VGAM2279 correlate with, and may be deduced from, the identity of the host target genes which VGAM2279 binds and inhibits, and the function of these host target genes, as elaborated hereinbelow.

Nucleotide sequences of the VGAM2279 precursor RNA, herein designated VGAM PRECURSOR RNA, and of the 'diced' VGAM2279 RNA, herein designated VGAM RNA, and a schematic representation of the secondary folding of VGAM2279 folded precursor RNA, herein designated VGAM FOLDED PRECURSOR RNA, of VGAM2279 are further described hereinbelow with reference to Table 1.

Nucleotide sequences of host target binding sites, such as BINDING SITE-I, BINDING SITE-II and BINDING SITE-III of FIG. 1, found on VGAM2279 host target RNA, and schematic representation of the complementarity of each of these host target binding sites to VGAM2279 RNA, herein designated VGAM RNA, are described hereinbelow with reference to Table 2.

As mentioned hereinabove with reference to FIG. 1, a function of VGAM2279 gene, herein designated VGAM is inhibition of expression of VGAM2279 target genes. It is appreciated that specific functions, and accordingly utilities, of VGAM2279 correlate with, and may be deduced from, the identity of the target genes which VGAM2279 binds and inhibits, and the function of these target genes, as elaborated hereinbelow.

Guanine Nucleotide Binding Protein (G protein), Alpha Z Polypeptide (GNAZ, Accession NM_002073) is a VGAM2279 host target gene. GNAZ BINDING SITE is HOST TARGET binding site found in the 3' untranslated region of mRNA encoded by GNAZ, corresponding to a HOST TARGET binding site such as BINDING SITE I, BINDING SITE II or BINDING SITE III. Table 2 illustrates the complementarity of the nucleotide sequences of GNAZ BINDING SITE, designated SEQ ID:7844, to the nucleotide sequence of VGAM2279 RNA, herein designated VGAM RNA, also designated SEQ ID:4990.

A function of VGAM2279 is therefore inhibition of Guanine Nucleotide Binding Protein (G protein), Alpha Z Polypeptide (GNAZ, Accession NM_002073), a gene which functions as modulator or transducer in various transmembrane signaling systems. Accordingly, utilities of VGAM2279 include diagnosis, prevention and treatment of diseases and clinical conditions associated with GNAZ. The function of GNAZ and its association with various diseases and clinical conditions, has been established by previous studies, as described hereinabove with reference to VGAM1508. Zinc Finger Protein 265 (ZNF265, Accession NM_005455) is another VGAM2279 host target gene. ZNF265 BINDING SITE is HOST TARGET binding site found in the 3' untranslated region of mRNA encoded by ZNF265, corresponding to a HOST TARGET binding site such as BINDING SITE I, BINDING SITE II or BINDING SITE III. Table 2 illustrates the complementarity of the nucleotide sequences of ZNF265 BINDING SITE, designated SEQ ID:11939, to the nucleotide sequence of VGAM2279 RNA, herein designated VGAM RNA, also designated SEQ ID:4990.

Another function of VGAM2279 is therefore inhibition of Zinc Finger Protein 265 (ZNF265, Accession NM_005455). Accordingly, utilities of VGAM2279 include diagnosis, prevention and treatment of diseases and clinical conditions associated with ZNF265. BCL2-associated Athanogene 2 (BAG2, Accession XM_165779) is another VGAM2279 host target gene. BAG2 BINDING SITE is HOST TARGET binding site found in the 3' untranslated region of mRNA encoded by BAG2, corresponding to a HOST TARGET binding site such as BINDING SITE I, BINDING SITE II or BINDING SITE III. Table 2 illustrates the complementarity of the nucleotide sequences of BAG2 BINDING SITE, designated SEQ ID:43751, to the nucleotide sequence of VGAM2279 RNA, herein designated VGAM RNA, also designated SEQ ID:4990.

Another function of VGAM2279 is therefore inhibition of BCL2-associated Athanogene 2 (BAG2, Accession XM_165779). Accordingly, utilities of VGAM2279 include diagnosis, prevention and treatment of diseases and clinical conditions associated with BAG2. DEFCAP (Accession NM_033004) is another VGAM2279 host target gene. DEFCAP BINDING SITE1 through DEFCAP BINDING SITE3 are HOST TARGET binding sites found in untranslated regions of mRNA encoded by DEFCAP, corresponding to HOST TARGET binding sites such as BINDING SITE I, BINDING SITE II or BINDING SITE III. Table 2 illustrates the complementarity of the nucleotide sequences of DEFCAP BINDING SITE1 through DEFCAP BINDING SITE3, designated SEQ ID:26891, SEQ ID:26892 and SEQ ID:17200 respectively, to the nucleotide sequence of VGAM2279 RNA, herein designated VGAM RNA, also designated SEQ ID:4990.

Another function of VGAM2279 is therefore inhibition of DEFCAP (Accession NM_033004). Accordingly, utilities of VGAM2279 include diagnosis, prevention and treatment of diseases and clinical conditions associated with DEFCAP. FLJ21140 (Accession NM_024776) is another VGAM2279 host target gene. FLJ21140 BINDING SITE is HOST TARGET binding site found in the 5' untranslated region of mRNA encoded by FLJ21140, corresponding to a HOST TARGET binding site such as BINDING SITE I, BINDING SITE II or BINDING SITE III. Table 2 illustrates the complementarity of the nucleotide sequences of FLJ21140 BINDING SITE, designated SEQ ID:24138, to the nucleotide sequence of VGAM2279 RNA, herein designated VGAM RNA, also designated SEQ ID:4990.

Another function of VGAM2279 is therefore inhibition of FLJ21140 (Accession NM_024776). Accordingly, utilities of VGAM2279 include diagnosis, prevention and treatment of diseases and clinical conditions associated with FLJ21140. RALGPS1A (Accession NM_014636) is another VGAM2279 host target gene. RALGPS1A BINDING SITE is HOST TARGET binding site found in the 3' untranslated region of mRNA encoded by RALGPS1A, corresponding to a HOST TARGET binding site such as BINDING SITE I, BINDING SITE II or BINDING SITE III. Table 2 illustrates the complementarity of the nucleotide sequences of RALGPS1A BINDING SITE, designated SEQ ID:16015, to the nucleotide sequence of VGAM2279 RNA, herein designated VGAM RNA, also designated SEQ ID:4990.

Another function of VGAM2279 is therefore inhibition of RALGPS1A (Accession NM_014636). Accordingly, utilities of VGAM2279 include diagnosis, prevention and treatment of diseases and clinical conditions associated with RALGPS1A. Thioesterase, Adipose Associated (THEA, Accession XM_038922) is another VGAM2279 host target gene. THEA BINDING SITE is HOST TARGET binding site found in the 3' untranslated region of mRNA encoded by THEA, corresponding to a HOST TARGET binding site such as BINDING SITE I, BINDING SITE II or BINDING SITE III. Table 2 illustrates the complementarity of the nucleotide sequences of THEA BINDING SITE, designated SEQ ID:32945, to the nucleotide sequence of VGAM2279 RNA, herein designated VGAM RNA, also designated SEQ ID:4990.

Another function of VGAM2279 is therefore inhibition of Thioesterase, Adipose Associated (THEA, Accession XM_038922). Accordingly, utilities of VGAM2279 include diagnosis, prevention and treatment of diseases and clinical conditions associated with THEA. LOC146515 (Accession XM_085493) is another VGAM2279 host target gene. LOC146515 BINDING SITE is HOST TARGET binding site found in the 3' untranslated region of mRNA encoded by LOC146515, corresponding to a HOST TARGET binding site such as BINDING SITE I, BINDING SITE II or BINDING SITE III. Table 2 illustrates the complementarity of the nucleotide sequences of LOC146515 BINDING SITE, designated SEQ ID:38191, to the nucleotide sequence of VGAM2279 RNA, herein designated VGAM RNA, also designated SEQ ID:4990.

Another function of VGAM2279 is therefore inhibition of LOC146515 (Accession XM_085493). Accordingly, utilities of VGAM2279 include diagnosis, prevention and treatment of diseases and clinical conditions associated with LOC146515. FIG. 1 further provides a conceptual description of a novel bioinformatically detected viral gene of the present invention, referred to here as Viral Genomic Address Messenger 2280 (VGAM2280) viral gene, which modulates expression of respective host target genes thereof, the function and utility of which host target genes is known in the art.

VGAM2280 is a novel bioinformatically detected regulatory, non protein coding, viral micro RNA (miRNA) gene. The method by which VGAM2280 was detected is described hereinabove with reference to FIGS. 1-8.

VGAM2280 gene, herein designated VGAM GENE, is a viral gene contained in the genome of Alcelaphine Herpesvirus 1. VGAM2280 host target gene, herein designated VGAM HOST TARGET GENE, is a human gene contained in the human genome.

VGAM2280 gene encodes a VGAM2280 precursor RNA, herein designated VGAM PRECURSOR RNA. Similar to other miRNA genes, and unlike most ordinary genes, VGAM2280 precursor RNA does not encode a protein. A nucleotide sequence identical or highly similar to the nucleotide sequence of VGAM2280 precursor RNA is designated SEQ ID:2266, and is provided hereinbelow with reference to the sequence listing part. Nucleotide sequence SEQ ID:2266 is located at position 27049 relative to the genome of Alcelaphine Herpesvirus 1.

VGAM2280 precursor RNA folds onto itself, forming VGAM2280 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2280 folded precursor RNA into VGAM2280 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2280 RNA is designated SEQ ID:4991, and is provided hereinbelow with reference to the sequence listing part.

VGAM2280 host target gene, herein designated VGAM HOST TARGET GENE, encodes a corresponding messenger RNA, VGAM2280 host target RNA, herein designated VGAM HOST TARGET RNA. VGAM2280 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2280 RNA, herein designated VGAM RNA, binds complementarily to one or more host target binding sites located in untranslated regions of VGAM2280 host target RNA, herein designated VGAM HOST TARGET RNA. This complementary binding is due to the fact that the nucleotide sequence of VGAM2280 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2280 RNA, herein designated VGAM RNA, may have a different number of host target binding sites in untranslated regions of a VGAM2280 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2280 RNA, herein designated VGAM RNA, to host target binding sites on VGAM2280 host target RNA, herein designated VGAM HOST TARGET RNA, such as BINDING SITE I, BINDING SITE II and BINDING SITE III, inhibits translation of VGAM2280 host target RNA into VGAM2280 host target protein, herein designated VGAM HOST TARGET PROTEIN. VGAM host target protein is therefore outlined by a broken line.

It is appreciated that VGAM2280 host target gene, herein designated VGAM HOST TARGET GENE, in fact represents a plurality of VGAM2280 host target genes. The mRNA of each one of this plurality of VGAM2280 host target genes comprises one or more host target binding sites, each having a nucleotide sequence which is at least partly complementary to VGAM2280 RNA, herein designated VGAM RNA, and which when bound by VGAM2280 RNA causes inhibition of translation of respective one or more VGAM2280 host target proteins.

It is further appreciated by one skilled in the art that the mode of translational inhibition illustrated by FIG. 1 with specific reference to translational inhibition exerted by VGAM2280 gene, herein designated VGAM GENE, on one or more VGAM2280 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2280 is inhibition of expression of host target genes, as part of a novel viral mechanism of attacking a host. Accordingly, utilities of VGAM2280 include diagnosis, prevention and treatment of viral infection by Alcelaphine Herpesvirus 1. Specific functions, and accordingly utilities, of VGAM2280 correlate with, and may be deduced from, the identity of the host target genes which VGAM2280 binds and inhibits, and the function of these host target genes, as elaborated hereinbelow.

Nucleotide sequences of the VGAM2280 precursor RNA, herein designated VGAM PRECURSOR RNA, and of the 'diced' VGAM2280 RNA, herein designated VGAM RNA, and a schematic representation of the secondary folding of VGAM2280 folded precursor RNA, herein designated VGAM FOLDED PRECURSOR RNA, of VGAM2280 are further described hereinbelow with reference to Table 1.

Nucleotide sequences of host target binding sites, such as BINDING SITE-I, BINDING SITE-II and BINDING SITE-III of FIG. 1, found on VGAM2280 host target RNA, and schematic representation of the complementarity of each of these host target binding sites to VGAM2280 RNA, herein designated VGAM RNA, are described hereinbelow with reference to Table 2.

As mentioned hereinabove with reference to FIG. 1, a function of VGAM2280 gene, herein designated VGAM is inhibition of expression of VGAM2280 target genes. It is appreciated that specific functions, and accordingly utilities, of VGAM2280 correlate with, and may be deduced from, the identity of the target genes which VGAM2280 binds and inhibits, and the function of these target genes, as elaborated hereinbelow.

ATPase, Cu++ Transporting, Alpha Polypeptide (Menkes syndrome) (ATP7A, Accession NM_000052) is a VGAM2280 host target gene. ATP7A BINDING SITE is HOST TARGET binding site found in the 3' untranslated region of mRNA encoded by ATP7A, corresponding to a HOST TARGET binding site such as BINDING SITE I, BINDING SITE II or BINDING SITE III. Table 2 illustrates the complementarity of the nucleotide sequences of ATP7A BINDING SITE, designated SEQ ID:5491, to the nucleotide sequence of VGAM2280 RNA, herein designated VGAM RNA, also designated SEQ ID:4991.

A function of VGAM2280 is therefore inhibition of ATPase, Cu++ Transporting, Alpha Polypeptide (Menkes syndrome) (ATP7A, Accession NM_000052). Accordingly, utilities of VGAM2280 include diagnosis, prevention and treatment of diseases and clinical conditions associated with ATP7A. Dachshund Homolog (Drosophila) (DACH, Accession NM_080759) is another VGAM2280 host target gene. DACH BINDING SITE is HOST TARGET binding site found in the 3' untranslated region of mRNA encoded by DACH, corresponding to a HOST TARGET binding site such as BINDING SITE I, BINDING SITE II or BINDING SITE III. Table 2 illustrates the complementarity of the nucleotide sequences of DACH BINDING SITE, designated SEQ ID:28043, to the nucleotide sequence of VGAM2280 RNA, herein designated VGAM RNA, also designated SEQ ID:4991.

Another function of VGAM2280 is therefore inhibition of Dachshund Homolog (Drosophila) (DACH, Accession NM_080759), a gene which regulates early progenitor cell proliferation during retinogenesis and pituitary development. Accordingly, utilities of VGAM2280 include diagnosis, prevention and treatment of diseases and clinical conditions associated with DACH. The function of DACH and its association with various diseases and clinical conditions, has been established by previous studies, as described hereinabove with reference to VGAM260. Faciogenital Dysplasia (Aarskog-Scott syndrome) (FGD1, Accession NM_004463) is another VGAM2280 host target gene. FGD1 BINDING SITE is HOST TARGET binding site found in the 3' untranslated region of mRNA encoded by FGD1, corresponding to a HOST TARGET binding site such as BINDING SITE I, BINDING SITE II or BINDING SITE III. Table 2 illustrates the complementarity of the nucleotide sequences of FGD1 BINDING SITE, designated SEQ ID:10767, to the nucleotide sequence of VGAM2280 RNA, herein designated VGAM RNA, also designated SEQ ID:4991.

Another function of VGAM2280 is therefore inhibition of Faciogenital Dysplasia (Aarskog-Scott syndrome) (FGD1, Accession NM_004463), a gene which activates the ras-like family of rho- and rac proteins by exchanging bound gdp for free gtp. Accordingly, utilities of VGAM2280 include diagnosis, prevention and treatment of diseases and clinical conditions associated with FGD1. The function of FGD1 and its association with various diseases and clinical conditions, has been established by previous studies, as described hereinabove with reference to VGAM1593. Glycogenin (GYG, Accession NM_004130) is another VGAM2280 host target gene. GYG BINDING SITE is HOST TARGET binding site found in the 3' untranslated region of mRNA encoded by GYG, corresponding to a HOST TARGET binding site such as BINDING SITE I, BINDING SITE II or BINDING SITE III. Table 2 illustrates the complementarity of the nucleotide sequences of GYG BINDING SITE, designated SEQ ID:10337, to the nucleotide sequence of VGAM2280 RNA, herein designated VGAM RNA, also designated SEQ ID:4991.

Another function of VGAM2280 is therefore inhibition of Glycogenin (GYG, Accession NM_004130), a gene which primes de novo glycogen synthesis. Accordingly, utilities of VGAM2280 include diagnosis, prevention and treatment of diseases and clinical conditions associated with GYG. The function of GYG and its association with various diseases and clinical conditions, has been established by previous studies, as described hereinabove with reference to VGAM777. PCTAIRE Protein Kinase 1 (PCTK1, Accession NM_006201) is another VGAM2280 host target gene. PCTK1 BINDING SITE1 through PCTK1 BINDING SITE3 are HOST TARGET binding sites found in untranslated regions of mRNA encoded by PCTK1, corresponding to HOST TARGET binding sites such as BINDING SITE I, BINDING SITE II or BINDING SITE III. Table 2 illustrates the complementarity of the nucleotide sequences of PCTK1 BINDING SITE1 through PCTK1 BINDING SITE3, designated SEQ ID:12871, SEQ ID:26906 and SEQ ID:26912 respectively, to the nucleotide sequence of VGAM2280 RNA, herein designated VGAM RNA, also designated SEQ ID:4991.

Another function of VGAM2280 is therefore inhibition of PCTAIRE Protein Kinase 1 (PCTK1, Accession NM_006201), a gene which may play a role in signal transduction cascades in terminally differentiated cells. Accordingly, utilities of VGAM2280 include diagnosis, prevention and treatment of diseases and clinical conditions associated with PCTK1. The function of PCTK1 and its association with various diseases and clinical conditions, has been established by previous studies, as described hereinabove with reference to VGAM75. RalA Binding Protein 1 (RALBP1, Accession NM_006788) is another VGAM2280 host target gene. RALBP1 BINDING SITE is HOST TARGET binding site found in the 3' untranslated region of mRNA encoded by RALBP1, corresponding to a HOST TARGET binding site such as BINDING SITE I, BINDING SITE II or BINDING SITE III. Table 2 illustrates the complementarity of the nucleotide sequences of RALBP1 BINDING SITE, designated SEQ ID:13658, to the nucleotide sequence of VGAM2280 RNA, herein designated VGAM RNA, also designated SEQ ID:4991.

Another function of VGAM2280 is therefore inhibition of RalA Binding Protein 1 (RALBP1, Accession NM_006788), a gene which plays a role in signal transduction and catalyzes the transport of glutathione conjugates and xenobiotics. Accordingly, utilities of VGAM2280 include diagnosis, prevention and treatment of diseases and clinical conditions associated with RALBP1. The function of RALBP1 and its association with various diseases and clinical conditions, has been established by previous studies, as described hereinabove with reference to VGAM345. Solute Carrier Family 35 (CMP-sialic acid transporter), Member 1 (SLC35A1, Accession NM_006416) is another VGAM2280 host target gene. SLC35A1 BINDING SITE is HOST TARGET binding site found in the 3' untranslated region of mRNA encoded by SLC35A1, corresponding to a HOST TARGET binding site such as BINDING SITE I, BINDING SITE II or BINDING SITE III. Table 2 illustrates the complementarity of the nucleotide sequences of SLC35A1 BINDING SITE, designated SEQ ID:13125, to the nucleotide sequence of VGAM2280 RNA, herein designated VGAM RNA, also designated SEQ ID:4991.

Another function of VGAM2280 is therefore inhibition of Solute Carrier Family 35 (CMP-sialic acid transporter), Member 1 (SLC35A1, Accession NM_006416), a gene which transports cmp-sialic acid from the cytosol into golgi vesicles. Accordingly, utilities of VGAM2280 include diagnosis, prevention and treatment of diseases and clinical conditions associated with SLC35A1. The function of SLC35A1 and its association with various diseases and clinical conditions, has been established by previous studies, as described hereinabove with reference to VGAM152. Transient Receptor Potential Cation Channel, Subfamily V, Member 1 (TRPV1, Accession NM_080704) is another VGAM2280 host target gene. TRPV1 BINDING SITE1 through TRPV1 BINDING SITE4 are HOST TARGET binding sites found in untranslated regions of mRNA encoded by TRPV1, corresponding to HOST TARGET binding sites such as BINDING SITE I, BINDING SITE II or BINDING SITE III. Table 2 illustrates the complementarity of the nucleotide sequences of TRPV1 BINDING SITE1 through TRPV1 BINDING SITE4, designated SEQ ID:27993, SEQ ID:28001, SEQ ID:28009 and SEQ ID:20813 respectively, to the nucleotide sequence of VGAM2280 RNA, herein designated VGAM RNA, also designated SEQ ID:4991.

Another function of VGAM2280 is therefore inhibition of Transient Receptor Potential Cation Channel, Subfamily V, Member 1 (TRPV1, Accession NM_080704), a gene which functions as a receptor for capsaicin. Accordingly, utilities of VGAM2280 include diagnosis, prevention and treatment of diseases and clinical conditions associated with TRPV1. The function of TRPV1 and its association with various diseases and clinical conditions, has been established by previous studies, as described hereinabove with reference to VGAM146. Oxysterol Binding Protein-like 10 (OSBPL10, Accession NM_017784) is another VGAM2280 host target gene. OSBPL10 BINDING SITE is HOST TARGET binding site found in the 3' untranslated region of mRNA encoded by OSBPL10, corresponding to a HOST TARGET binding site such as BINDING SITE I, BINDING SITE II or BINDING SITE III. Table 2 illustrates the complementarity of the nucleotide sequences of OSBPL10 BINDING SITE, designated SEQ ID:19415, to the nucleotide sequence of VGAM2280 RNA, herein designated VGAM RNA, also designated SEQ ID:4991.

Another function of VGAM2280 is therefore inhibition of Oxysterol Binding Protein-like 10 (OSBPL10, Accession NM_017784). Accordingly, utilities of VGAM2280 include diagnosis, prevention and treatment of diseases and clinical conditions associated with OSBPL10. Transducin-like Enhancer of Split 4 (E(sp1) Homolog, Drosophila) (TLE4, Accession XM_042357) is another VGAM2280 host target gene. TLE4 BINDING SITE is HOST TARGET binding site found in the 3' untranslated region of mRNA encoded by TLE4, corresponding to a HOST TARGET binding site such as BINDING SITE I, BINDING SITE II or BINDING SITE III. Table 2 illustrates the complementarity of the nucleotide sequences of TLE4 BINDING SITE, designated SEQ ID:33719, to the nucleotide sequence of VGAM2280 RNA, herein designated VGAM RNA, also designated SEQ ID:4991.

Another function of VGAM2280 is therefore inhibition of Transducin-like Enhancer of Split 4 (E(sp1) Homolog, Drosophila) (TLE4, Accession XM_042357). Accordingly, utilities of VGAM2280 include diagnosis, prevention and treatment of diseases and clinical conditions associated with TLE4. Ubiquitin-like, Containing PHD and RING Finger Domains, 1 (UHRF1, Accession NM_013282) is another VGAM2280 host target gene. UHRF1 BINDING SITE is HOST TARGET binding site found in the 3' untranslated region of mRNA encoded by UHRF1, corresponding to a HOST TARGET binding site such as BINDING SITE I, BINDING SITE II or BINDING SITE III. Table 2 illustrates the complementarity of the nucleotide sequences of UHRF1 BINDING SITE, designated SEQ ID:14950, to the nucleotide sequence of VGAM2280 RNA, herein designated VGAM RNA, also designated SEQ ID:4991.

Another function of VGAM2280 is therefore inhibition of Ubiquitin-like, Containing PHD and RING Finger Domains, 1 (UHRF1, Accession NM_013282). Accordingly, utilities of VGAM2280 include diagnosis, prevention and treatment of diseases and clinical conditions associated with UHRF1. LOC126133 (Accession XM_058991) is another VGAM2280 host target gene. LOC126133 BINDING SITE is HOST TARGET binding site found in the 5' untranslated region of mRNA encoded by LOC126133, corresponding to a HOST TARGET binding site such as BINDING SITE I, BINDING SITE II or BINDING SITE III. Table 2 illustrates the complementarity of the nucleotide sequences of LOC126133 BINDING SITE, designated SEQ ID:36804, to the nucleotide sequence of VGAM2280 RNA, herein designated VGAM RNA, also designated SEQ ID:4991.

Another function of VGAM2280 is therefore inhibition of LOC126133 (Accession XM_058991). Accordingly, utilities of VGAM2280 include diagnosis, prevention and treatment of diseases and clinical conditions associated with LOC126133. LOC142948 (Accession XM_096364) is another VGAM2280 host target gene. LOC142948 BINDING SITE is HOST TARGET binding site found in the 3' untranslated region of mRNA encoded by LOC142948, corresponding to a HOST TARGET binding site such as BINDING SITE I, BINDING SITE II or BINDING SITE III. Table 2 illustrates the complementarity of the nucleotide sequences of LOC142948 BINDING SITE, designated SEQ ID:40325, to the nucleotide sequence of VGAM2280 RNA, herein designated VGAM RNA, also designated SEQ ID:4991.

Another function of VGAM2280 is therefore inhibition of LOC142948 (Accession XM_096364). Accordingly, utilities of VGAM2280 include diagnosis, prevention and treatment of diseases and clinical conditions associated with LOC142948. LOC159160 (Accession XM_018413) is another VGAM2280 host target gene. LOC159160 BINDING SITE is HOST TARGET binding site found in the 5' untranslated region of mRNA encoded by LOC159160, corresponding to a HOST TARGET binding site such as BINDING SITE I, BINDING SITE II or BINDING SITE III. Table 2 illustrates the complementarity of the nucleotide sequences of LOC159160 BINDING SITE, designated SEQ ID:30358, to the nucleotide sequence of VGAM2280 RNA, herein designated VGAM RNA, also designated SEQ ID:4991.

Another function of VGAM2280 is therefore inhibition of LOC159160 (Accession XM_018413). Accordingly, utilities of VGAM2280 include diagnosis, prevention and treatment of diseases and clinical conditions associated with LOC159160. LOC91947 (Accession XM_041721) is another VGAM2280 host target gene. LOC91947 BINDING SITE is HOST TARGET binding site found in the 3' untranslated region of mRNA encoded by LOC91947, corresponding to a HOST TARGET binding site such as BINDING SITE I, BINDING SITE II or BINDING SITE III. Table 2 illustrates the complementarity of the nucleotide sequences of LOC91947 BINDING SITE, designated SEQ ID:33570, to the nucleotide sequence of VGAM2280 RNA, herein designated VGAM RNA, also designated SEQ ID:4991.

Another function of VGAM2280 is therefore inhibition of LOC91947 (Accession XM_041721). Accordingly, utilities of VGAM2280 include diagnosis, prevention and treatment of diseases and clinical conditions associated with LOC91947. FIG. 1 further provides a conceptual description of a novel bioinformatically detected viral gene of the present invention, referred to here as Viral Genomic Address Messenger 2281 (VGAM2281) viral gene, which modulates expression of respective host target genes thereof, the function and utility of which host target genes is known in the art.

VGAM2281 is a novel bioinformatically detected regulatory, non protein coding, viral micro RNA (miRNA) gene. The method by which VGAM2281 was detected is described hereinabove with reference to FIGS. 1-8.

VGAM2281 gene, herein designated VGAM GENE, is a viral gene contained in the genome of Murine Hepatitis Virus. VGAM2281 host target gene, herein designated VGAM HOST TARGET GENE, is a human gene contained in the human genome.

VGAM2281 gene encodes a VGAM2281 precursor RNA, herein designated VGAM PRECURSOR RNA. Similar to other miRNA genes, and unlike most ordinary genes, VGAM2281 precursor RNA does not encode a protein. A nucleotide sequence identical or highly similar to the nucleotide sequence of VGAM2281 precursor RNA is designated SEQ ID:2267, and is provided hereinbelow with reference to the sequence listing part. Nucleotide sequence SEQ ID:2267 is located at position 22070 relative to the genome of Murine Hepatitis Virus.

VGAM2281 precursor RNA folds onto itself, forming VGAM2281 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2281 folded precursor RNA into VGAM2281 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2281 RNA is designated SEQ ID:4992, and is provided hereinbelow with reference to the sequence listing part.

VGAM2281 host target gene, herein designated VGAM HOST TARGET GENE, encodes a corresponding messenger RNA, VGAM2281 host target RNA, herein designated VGAM HOST TARGET RNA. VGAM2281 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2281 RNA, herein designated VGAM RNA, binds complementarily to one or more host target binding sites located in untranslated regions of VGAM2281 host target RNA, herein designated VGAM HOST TARGET RNA. This complementary binding is due to the fact that the nucleotide sequence of VGAM2281 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2281 RNA, herein designated VGAM RNA, may have a different number of host target binding sites in untranslated regions of a VGAM2281 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2281 RNA, herein designated VGAM RNA, to host target binding sites on VGAM2281 host target RNA, herein designated VGAM HOST TARGET RNA, such as BINDING SITE I, BINDING SITE II and BINDING SITE III, inhibits translation of VGAM2281 host target RNA into VGAM2281 host target protein, herein designated VGAM HOST TARGET PROTEIN. VGAM host target protein is therefore outlined by a broken line.

It is appreciated that VGAM2281 host target gene, herein designated VGAM HOST TARGET GENE, in fact represents a plurality of VGAM2281 host target genes. The mRNA of each one of this plurality of VGAM2281 host target genes comprises one or more host target binding sites, each having a nucleotide sequence which is at least partly complementary to VGAM2281 RNA, herein designated VGAM RNA, and which when bound by VGAM2281 RNA causes inhibition of translation of respective one or more VGAM2281 host target proteins.

It is further appreciated by one skilled in the art that the mode of translational inhibition illustrated by FIG. 1 with specific reference to translational inhibition exerted by VGAM2281 gene, herein designated VGAM GENE, on one or more VGAM2281 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2281 is inhibition of expression of host target genes, as part of a novel viral mechanism of attacking a host. Accordingly, utilities of VGAM2281 include diagnosis, prevention and treatment of viral infection by Murine Hepatitis Virus. Specific functions, and accordingly utilities, of VGAM2281 correlate with, and may be deduced from, the identity of the host target genes which VGAM2281 binds and inhibits, and the function of these host target genes, as elaborated hereinbelow.

Nucleotide sequences of the VGAM2281 precursor RNA, herein designated VGAM PRECURSOR RNA, and of the 'diced' VGAM2281 RNA, herein designated VGAM RNA, and a schematic representation of the secondary folding of VGAM2281 folded precursor RNA, herein designated VGAM FOLDED PRECURSOR RNA, of VGAM2281 are further described hereinbelow with reference to Table 1.

Nucleotide sequences of host target binding sites, such as BINDING SITE-I, BINDING SITE-II and BINDING SITE-III of FIG. 1, found on VGAM2281 host target RNA, and schematic representation of the complementarity of each of these host target binding sites to VGAM2281 RNA, herein designated VGAM RNA, are described hereinbelow with reference to Table 2.

As mentioned hereinabove with reference to FIG. 1, a function of VGAM2281 gene, herein designated VGAM is inhibition of expression of VGAM2281 target genes. It is appreciated that specific functions, and accordingly utilities, of VGAM2281 correlate with, and may be deduced from, the identity of the target genes which VGAM2281 binds and inhibits, and the function of these target genes, as elaborated hereinbelow.

Forkhead Box D2 (FOXD2, Accession NM_004474) is a VGAM2281 host target gene. FOXD2 BINDING SITE is HOST TARGET binding site found in the 5' untranslated region of mRNA encoded by FOXD2, corresponding to a HOST TARGET binding site such as BINDING SITE I, BINDING SITE II or BINDING SITE III. Table 2 illustrates the complementarity of the nucleotide sequences of FOXD2 BINDING SITE, designated SEQ ID:10791, to the nucleotide sequence of VGAM2281 RNA, herein designated VGAM RNA, also designated SEQ ID:4992.

A function of VGAM2281 is therefore inhibition of Forkhead Box D2 (FOXD2, Accession NM_004474). Accordingly, utilities of VGAM2281 include diagnosis, prevention and treatment of diseases and clinical conditions associated with FOXD2. Glioblastoma Amplified Sequence (GBAS, Accession NM_001483) is another VGAM2281 host target gene. GBAS BINDING SITE is HOST TARGET binding site found in the 3' untranslated region of mRNA encoded by GBAS, corresponding to a HOST TARGET binding site such as BINDING SITE I, BINDING SITE II or BINDING SITE III. Table 2 illustrates the complementarity of the nucleotide sequences of GBAS BINDING SITE, designated SEQ ID:7226, to the nucleotide sequence of VGAM2281 RNA, herein designated VGAM RNA, also designated SEQ ID:4992.

Another function of VGAM2281 is therefore inhibition of Glioblastoma Amplified Sequence (GBAS, Accession NM_001483), a gene which might be involved in vesicular transport. Accordingly, utilities of VGAM2281 include diagnosis, prevention and treatment of diseases and clinical conditions associated with GBAS. The function of GBAS and its association with various diseases and clinical conditions, has been established by previous studies, as described hereinabove with reference to VGAM859. Hyaluronan Synthase 3 (HAS3, Accession NM_005329) is another VGAM2281 host target gene. HAS3 BINDING SITE is HOST TARGET binding site found in the 3' untranslated region of mRNA encoded by HAS3, corresponding to a HOST TARGET binding site such as BINDING SITE I, BINDING SITE II or BINDING SITE III. Table 2 illustrates the complementarity of the nucleotide sequences of HAS3 BINDING SITE, designated SEQ ID:11804, to the nucleotide sequence of VGAM2281 RNA, herein designated VGAM RNA, also designated SEQ ID:4992.

Another function of VGAM2281 is therefore inhibition of Hyaluronan Synthase 3 (HAS3, Accession NM_005329), a gene which plays a role in hyaluronan/hyaluronic acid (ha) synthesis. Accordingly, utilities of VGAM2281 include diagnosis, prevention and treatment of diseases and clinical conditions associated with HAS3. The function of HAS3 and its association with various diseases and clinical conditions, has been established by previous studies, as described hereinabove with reference to VGAM498. Phosphoribosylaminoimidazole Carboxylase, Phosphoribosylaminoimidazole Succinocarboxamide Synthetase (PAICS, Accession NM_006452) is another VGAM2281 host target gene. PAICS BINDING SITE is HOST TARGET binding site found in the 3' untranslated region of mRNA encoded by PAICS, corresponding to a HOST TARGET binding site such as BINDING SITE I, BINDING SITE II or BINDING SITE III. Table 2 illustrates the complementarity of the nucleotide sequences of PAICS BINDING SITE, designated SEQ ID:13164, to the nucleotide sequence of VGAM2281 RNA, herein designated VGAM RNA, also designated SEQ ID:4992.

Another function of VGAM2281 is therefore inhibition of Phosphoribosylaminoimidazole Carboxylase, Phosphoribosylaminoimidazole Succinocarboxamide Synthetase (PAICS, Accession NM_006452), a gene which is required for purine biosynthesis. Accordingly, utilities of VGAM2281 include diagnosis, prevention and treatment of diseases and clinical conditions associated with PAICS. The function of PAICS and its association with various diseases and clinical conditions, has been established by previous studies, as described hereinabove with reference to VGAM894. CLONE24945 (Accession NM_015683) is another VGAM2281 host target gene. CLONE24945 BINDING SITE is HOST TARGET binding site found in the 3' untranslated region of mRNA encoded by CLONE24945, corresponding to a HOST TARGET binding site such as BINDING SITE I, BINDING SITE II or BINDING SITE III. Table 2 illustrates the complementarity of the nucleotide sequences of CLONE24945 BINDING SITE, designated SEQ ID:17906, to the nucleotide sequence of VGAM2281 RNA, herein designated VGAM RNA, also designated SEQ ID:4992.

Another function of VGAM2281 is therefore inhibition of CLONE24945 (Accession NM_015683). Accordingly, utilities of VGAM2281 include diagnosis, prevention and treatment of diseases and clinical conditions associated with CLONE24945. CRMP5 (Accession NM_020134) is another VGAM2281 host target gene. CRMP5 BINDING SITE is HOST TARGET binding site found in the 3' untranslated region of mRNA encoded by CRMP5, corresponding to a HOST TARGET binding site such as BINDING SITE I, BINDING SITE II or BINDING SITE III. Table 2 illustrates the complementarity of the nucleotide sequences of CRMP5 BINDING SITE, designated SEQ ID:21333, to the nucleotide sequence of VGAM2281 RNA, herein designated VGAM RNA, also designated SEQ ID:4992.

Another function of VGAM2281 is therefore inhibition of CRMP5 (Accession NM_020134). Accordingly, utilities of VGAM2281 include diagnosis, prevention and treatment of diseases and clinical conditions associated with CRMP5. KIAA0420 (Accession XM_032693) is another VGAM2281 host target gene. KIAA0420 BINDING SITE is HOST TARGET binding site found in the 3' untranslated region of mRNA encoded by KIAA0420, corresponding to a HOST TARGET binding site such as BINDING SITE I, BINDING SITE II or BINDING SITE III. Table 2 illustrates the complementarity of the nucleotide sequences of KIAA0420 BINDING SITE, designated SEQ ID:31725, to the nucleotide sequence of VGAM2281 RNA, herein designated VGAM RNA, also designated SEQ ID:4992.

Another function of VGAM2281 is therefore inhibition of KIAA0420 (Accession XM_032693). Accordingly, utilities of VGAM2281 include diagnosis, prevention and treatment of diseases and clinical conditions associated with KIAA0420. KIAA1198 (Accession XM_032674) is another VGAM2281 host target gene. KIAA1198 BINDING SITE1 and KIAA1198 BINDING SITE2 are HOST TARGET binding sites found in untranslated regions of mRNA encoded by KIAA1198, corresponding to HOST TARGET binding sites such as BINDING SITE I, BINDING SITE II or BINDING SITE III. Table 2 illustrates the complementarity of the nucleotide sequences of KIAA1198 BINDING SITE1 and KIAA1198 BINDING SITE2, designated SEQ ID:31705 and SEQ ID:31717 respectively, to the nucleotide sequence of VGAM2281 RNA, herein designated VGAM RNA, also designated SEQ ID:4992.

Another function of VGAM2281 is therefore inhibition of KIAA1198 (Accession XM_032674). Accordingly, utilities of VGAM2281 include diagnosis, prevention and treatment of diseases and clinical conditions associated with KIAA1198. LOC148114 (Accession XM_086050) is another VGAM2281 host target gene. LOC148114 BINDING SITE is HOST TARGET binding site found in the 5' untranslated region of mRNA encoded by LOC148114, corresponding to a HOST TARGET binding site such as BINDING SITE I, BINDING SITE II or BINDING SITE III. Table 2 illustrates the complementarity of the nucleotide sequences of LOC148114 BINDING SITE, designated SEQ ID:38464, to the nucleotide sequence of VGAM2281 RNA, herein designated VGAM RNA, also designated SEQ ID:4992.

Another function of VGAM2281 is therefore inhibition of LOC148114 (Accession XM_086050). Accordingly, utilities of VGAM2281 include diagnosis, prevention and treatment of diseases and clinical conditions associated with LOC148114. LOC257354 (Accession XM_170810) is another VGAM2281 host target gene. LOC257354 BINDING SITE is HOST TARGET binding site found in the 3' untranslated region of mRNA encoded by LOC257354, corresponding to a HOST TARGET binding site such as BINDING SITE I, BINDING SITE II or BINDING SITE III. Table 2 illustrates the complementarity of the nucleotide sequences of LOC257354 BINDING SITE, designated SEQ ID:45578, to the nucleotide sequence of VGAM2281 RNA, herein designated VGAM RNA, also designated SEQ ID:4992.

Another function of VGAM2281 is therefore inhibition of LOC257354 (Accession XM_170810). Accordingly, utilities of VGAM2281 include diagnosis, prevention and treatment of diseases and clinical conditions associated with LOC257354. FIG. 1 further provides a conceptual description of a novel bioinformatically detected viral gene of the present invention, referred to here as Viral Genomic Address Messenger 2282 (VGAM2282) viral gene, which modulates expression of respective host target genes thereof, the function and utility of which host target genes is known in the art.

VGAM2282 is a novel bioinformatically detected regulatory, non protein coding, viral micro RNA (miRNA) gene. The method by which VGAM2282 was detected is described hereinabove with reference to FIGS. 1-8.

VGAM2282 gene, herein designated VGAM GENE, is a viral gene contained in the genome of Murine Hepatitis Virus. VGAM2282 host target gene, herein designated VGAM HOST TARGET GENE, is a human gene contained in the human genome.

VGAM2282 gene encodes a VGAM2282 precursor RNA, herein designated VGAM PRECURSOR RNA. Similar to other miRNA genes, and unlike most ordinary genes, VGAM2282 precursor RNA does not encode a protein. A nucleotide sequence identical or highly similar to the nucleotide sequence of VGAM2282 precursor RNA is designated SEQ ID:2268, and is provided hereinbelow with reference to the sequence listing part. Nucleotide sequence SEQ ID:2268 is located at position 26667 relative to the genome of Murine Hepatitis Virus.

VGAM2282 precursor RNA folds onto itself, forming VGAM2282 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2282 folded precursor RNA into VGAM2282 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2282 RNA is designated SEQ ID:4993, and is provided hereinbelow with reference to the sequence listing part.

VGAM2282 host target gene, herein designated VGAM HOST TARGET GENE, encodes a corresponding messenger RNA, VGAM2282 host target RNA, herein designated VGAM HOST TARGET RNA. VGAM2282 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2282 RNA, herein designated VGAM RNA, binds complementarily to one or more host target binding sites located in untranslated regions of VGAM2282 host target RNA, herein designated VGAM HOST TARGET RNA. This complementary binding is due to the fact that the nucleotide sequence of VGAM2282 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2282 RNA, herein designated VGAM RNA, may have a different number of host target binding sites in untranslated regions of a VGAM2282 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2282 RNA, herein designated VGAM RNA, to host target binding sites on VGAM2282 host target RNA, herein designated VGAM HOST TARGET RNA, such as BINDING SITE I, BINDING SITE II and BINDING SITE III, inhibits translation of VGAM2282 host target RNA into VGAM2282 host target protein, herein designated VGAM HOST TARGET PROTEIN. VGAM host target protein is therefore outlined by a broken line.

It is appreciated that VGAM2282 host target gene, herein designated VGAM HOST TARGET GENE, in fact represents a plurality of VGAM2282 host target genes. The mRNA of each one of this plurality of VGAM2282 host target genes comprises one or more host target binding sites, each having a nucleotide sequence which is at least partly complementary to VGAM2282 RNA, herein designated VGAM RNA, and which when bound by VGAM2282 RNA causes inhibition of translation of respective one or more VGAM2282 host target proteins.

It is further appreciated by one skilled in the art that the mode of translational inhibition illustrated by FIG. 1 with specific reference to translational inhibition exerted by VGAM2282 gene, herein designated VGAM GENE, on one or more VGAM2282 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2282 is inhibition of expression of host target genes, as part of a novel viral mechanism of attacking a host. Accordingly, utilities of VGAM2282 include diagnosis, prevention and treatment of viral infection by Murine Hepatitis Virus. Specific functions, and accordingly utilities, of VGAM2282 correlate with, and may be deduced from, the identity of the host target genes which VGAM2282 binds and inhibits, and the function of these host target genes, as elaborated hereinbelow.

Nucleotide sequences of the VGAM2282 precursor RNA, herein designated VGAM PRECURSOR RNA, and of the 'diced' VGAM2282 RNA, herein designated VGAM RNA, and a schematic representation of the secondary folding of VGAM2282 folded precursor RNA, herein designated VGAM FOLDED PRECURSOR RNA, of VGAM2282 are further described hereinbelow with reference to Table 1.

Nucleotide sequences of host target binding sites, such as BINDING SITE-I, BINDING SITE-II and BINDING SITE-III of FIG. 1, found on VGAM2282 host target RNA, and schematic representation of the complementarity of each of these host target binding sites to VGAM2282 RNA, herein designated VGAM RNA, are described hereinbelow with reference to Table 2.

As mentioned hereinabove with reference to FIG. 1, a function of VGAM2282 gene, herein designated VGAM is inhibition of expression of VGAM2282 target genes. It is appreciated that specific functions, and accordingly utilities, of VGAM2282 correlate with, and may be deduced from, the identity of the target genes which VGAM2282 binds and inhibits, and the function of these target genes, as elaborated hereinbelow.

Rac/Cdc42 Guanine Nucleotide Exchange Factor (GEF) 6 (ARHGEF6, Accession XM_042963) is a VGAM2282 host target gene. ARHGEF6 BINDING SITE is HOST TARGET binding site found in the 3' untranslated region of mRNA encoded by ARHGEF6, corresponding to a HOST TARGET binding site such as BINDING SITE I, BINDING SITE II or BINDING SITE III. Table 2 illustrates the complementarity of the nucleotide sequences of ARHGEF6 BINDING SITE, designated SEQ ID:33844, to the nucleotide sequence of VGAM2282 RNA, herein designated VGAM RNA, also designated SEQ ID:4993.

A function of VGAM2282 is therefore inhibition of Rac/Cdc42 Guanine Nucleotide Exchange Factor (GEF) 6 (ARHGEF6, Accession XM_042963). Accordingly, utilities of VGAM2282 include diagnosis, prevention and treatment of diseases and clinical conditions associated with ARHGEF6. Bromodomain Adjacent to Zinc Finger Domain, 1B (BAZ1B, Accession NM_032408) is another VGAM2282 host target gene. BAZ1B BINDING SITE is HOST TARGET binding site found in the 3' untranslated region of mRNA encoded by BAZ1B, corresponding to a HOST TARGET binding site such as BINDING SITE I, BINDING SITE II or BINDING SITE III. Table 2 illustrates the complementarity of the nucleotide sequences of BAZ1B BINDING SITE, designated SEQ ID:26191, to the nucleotide sequence of VGAM2282 RNA, herein designated VGAM RNA, also designated SEQ ID:4993.

Another function of VGAM2282 is therefore inhibition of Bromodomain Adjacent to Zinc Finger Domain, 1B (BAZ1B, Accession NM_032408). Accordingly, utilities of VGAM2282 include diagnosis, prevention and treatment of diseases and clinical conditions associated with BAZ1B. Casein Kinase 1, Gamma 3 (CSNK1G3, Accession NM_004384) is another VGAM2282 host target gene.

CSNK1G3 BINDING SITE is HOST TARGET binding site found in the 3' untranslated region of mRNA encoded by CSNK1G3, corresponding to a HOST TARGET binding site such as BINDING SITE I, BINDING SITE II or BINDING SITE III. Table 2 illustrates the complementarity of the nucleotide sequences of CSNK1G3 BINDING SITE, designated SEQ ID:10610, to the nucleotide sequence of VGAM2282 RNA, herein designated VGAM RNA, also designated SEQ ID:4993.

Another function of VGAM2282 is therefore inhibition of Casein Kinase 1, Gamma 3 (CSNK1G3, Accession NM_004384). Accordingly, utilities of VGAM2282 include diagnosis, prevention and treatment of diseases and clinical conditions associated with CSNK1G3. Glutaminase (GLS, Accession NM_014905) is another VGAM2282 host target gene. GLS BINDING SITE is HOST TARGET binding site found in the 3' untranslated region of mRNA encoded by GLS, corresponding to a HOST TARGET binding site such as BINDING SITE I, BINDING SITE II or BINDING SITE III. Table 2 illustrates the complementarity of the nucleotide sequences of GLS BINDING SITE, designated SEQ ID:17108, to the nucleotide sequence of VGAM2282 RNA, herein designated VGAM RNA, also designated SEQ ID:4993.

Another function of VGAM2282 is therefore inhibition of Glutaminase (GLS, Accession NM_014905). Accordingly, utilities of VGAM2282 include diagnosis, prevention and treatment of diseases and clinical conditions associated with GLS. LENG4 (Accession NM_024298) is another VGAM2282 host target gene. LENG4 BINDING SITE is HOST TARGET binding site found in the 5' untranslated region of mRNA encoded by LENG4, corresponding to a HOST TARGET binding site such as BINDING SITE I, BINDING SITE II or BINDING SITE III. Table 2 illustrates the complementarity of the nucleotide sequences of LENG4 BINDING SITE, designated SEQ ID:23580, to the nucleotide sequence of VGAM2282 RNA, herein designated VGAM RNA, also designated SEQ ID:4993.

Another function of VGAM2282 is therefore inhibition of LENG4 (Accession NM_024298), a gene which may be a transmembrane protein. Accordingly, utilities of VGAM2282 include diagnosis, prevention and treatment of diseases and clinical conditions associated with LENG4. The function of LENG4 and its association with various diseases and clinical conditions, has been established by previous studies, as described hereinabove with reference to VGAM259. Polycystic Kidney Disease 2 (autosomal dominant) (PKD2, Accession XM_011124) is another VGAM2282 host target gene. PKD2 BINDING SITE is HOST TARGET binding site found in the 3' untranslated region of mRNA encoded by PKD2, corresponding to a HOST TARGET binding site such as BINDING SITE I, BINDING SITE II or BINDING SITE III. Table 2 illustrates the complementarity of the nucleotide sequences of PKD2 BINDING SITE, designated SEQ ID:30177, to the nucleotide sequence of VGAM2282 RNA, herein designated VGAM RNA, also designated SEQ ID:4993.

Another function of VGAM2282 is therefore inhibition of Polycystic Kidney Disease 2 (autosomal dominant) (PKD2, Accession XM_011124). Accordingly, utilities of VGAM2282 include diagnosis, prevention and treatment of diseases and clinical conditions associated with PKD2. Synaptosomal-associated Protein, 25 kDa (SNAP25, Accession NM_130811) is another VGAM2282 host target gene. SNAP25 BINDING SITE1 and SNAP25 BINDING SITE2 are HOST TARGET binding sites found in untranslated regions of mRNA encoded by SNAP25, corresponding to HOST TARGET binding sites such as BINDING SITE I, BINDING SITE II or BINDING SITE III. Table 2 illustrates the complementarity of the nucleotide sequences of SNAP25 BINDING SITE1 and SNAP25 BINDING SITE2, designated SEQ ID:28318 and SEQ ID:9055 respectively, to the nucleotide sequence of VGAM2282 RNA, herein designated VGAM RNA, also designated SEQ ID:4993.

Another function of VGAM2282 is therefore inhibition of Synaptosomal-associated Protein, 25 kDa (SNAP25, Accession NM_130811). Accordingly, utilities of VGAM2282 include diagnosis, prevention and treatment of diseases and clinical conditions associated with SNAP25. WAS Protein Family, Member 3 (WASF3, Accession NM_006646) is another VGAM2282 host target gene. WASF3 BINDING SITE is HOST TARGET binding site found in the 3' untranslated region of mRNA encoded by WASF3, corresponding to a HOST TARGET binding site such as BINDING SITE I, BINDING SITE II or BINDING SITE III. Table 2 illustrates the complementarity of the nucleotide sequences of WASF3 BINDING SITE, designated SEQ ID:13440, to the nucleotide sequence of VGAM2282 RNA, herein designated VGAM RNA, also designated SEQ ID:4993.

Another function of VGAM2282 is therefore inhibition of WAS Protein Family, Member 3 (WASF3, Accession NM_006646), a gene which stimulates actin polymerization. Accordingly, utilities of VGAM2282 include diagnosis, prevention and treatment of diseases and clinical conditions associated with WASF3. The function of WASF3 and its association with various diseases and clinical conditions, has been established by previous studies, as described hereinabove with reference to VGAM1692. Wolf-Hirschhorn Syndrome Candidate 1 (WHSC1, Accession NM_014919) is another VGAM2282 host target gene. WHSC1 BINDING SITE is HOST TARGET binding site found in the 3' untranslated region of mRNA encoded by WHSC1, corresponding to a HOST TARGET binding site such as BINDING SITE I, BINDING SITE II or BINDING SITE III. Table 2 illustrates the complementarity of the nucleotide sequences of WHSC1 BINDING SITE, designated SEQ ID:17176, to the nucleotide sequence of VGAM2282 RNA, herein designated VGAM RNA, also designated SEQ ID:4993.

Another function of VGAM2282 is therefore inhibition of Wolf-Hirschhorn Syndrome Candidate 1 (WHSC1, Accession NM_014919), a gene which binds covalently to and repairs g/t mismatches. Accordingly, utilities of VGAM2282 include diagnosis, prevention and treatment of diseases and clinical conditions associated with WHSC1. The function of WHSC1 and its association with various diseases and clinical conditions, has been established by previous studies, as described hereinabove with reference to VGAM200. Rho Guanine Nucleotide Exchange Factor (GEF) 3 (ARHGEF3, Accession NM_019555) is another VGAM2282 host target gene. ARHGEF3 BINDING SITE is HOST TARGET binding site found in the 3' untranslated region of mRNA encoded by ARHGEF3, corresponding to a HOST TARGET binding site such as BINDING SITE I, BINDING SITE II or BINDING SITE III. Table 2 illustrates the complementarity of the nucleotide sequences of ARHGEF3 BINDING SITE, designated SEQ ID:21211, to the nucleotide sequence of VGAM2282 RNA, herein designated VGAM RNA, also designated SEQ ID:4993.

Another function of VGAM2282 is therefore inhibition of Rho Guanine Nucleotide Exchange Factor (GEF) 3 (ARHGEF3, Accession NM_019555). Accordingly, utilities of VGAM2282 include diagnosis, prevention and treatment of diseases and clinical conditions associated with ARHGEF3. BCE-1 (Accession NM_007005) is another VGAM2282 host target gene. BCE-1 BINDING SITE is HOST TARGET binding site found in the 5' untranslated region of mRNA encoded by BCE-1, corresponding to a HOST TARGET binding site such as BINDING SITE I, BINDING SITE II or BINDING SITE III. Table 2 illustrates the complementarity of the nucleotide sequences of BCE-1 BINDING SITE, designated SEQ ID:13868, to the nucleotide sequence of VGAM2282 RNA, herein designated VGAM RNA, also designated SEQ ID:4993.

Another function of VGAM2282 is therefore inhibition of BCE-1 (Accession NM_007005). Accordingly, utilities of VGAM2282 include diagnosis, prevention and treatment of diseases and clinical conditions associated with BCE-1. Chromosome 19 Open Reading Frame 7 (C19orf7, Accession XM_028253) is another VGAM2282 host target gene. C19orf7 BINDING SITE is HOST TARGET binding site found in the 3' untranslated region of mRNA encoded by C19orf7, corresponding to a HOST TARGET binding site such as BINDING SITE I, BINDING SITE II or BINDING SITE III. Table 2 illustrates the complementarity of the nucleotide sequences of C19orf7 BINDING SITE, designated SEQ ID:30635, to the nucleotide sequence of VGAM2282 RNA, herein designated VGAM RNA, also designated SEQ ID:4993.

Another function of VGAM2282 is therefore inhibition of Chromosome 19 Open Reading Frame 7 (C19orf7, Accession XM_028253). Accordingly, utilities of VGAM2282 include diagnosis, prevention and treatment of diseases and clinical conditions associated with C19orf7. Chromosome 20 Open Reading Frame 36 (C20orf36, Accession NM_018257) is another VGAM2282 host target gene. C20orf36 BINDING SITE is HOST TARGET binding site found in the 3' untranslated region of mRNA encoded by C20orf36, corresponding to a HOST TARGET binding site such as BINDING SITE I, BINDING SITE II or BINDING SITE III. Table 2 illustrates the complementarity of the nucleotide sequences of C20orf36 BINDING SITE, designated SEQ ID:20222, to the nucleotide sequence of VGAM2282 RNA, herein designated VGAM RNA, also designated SEQ ID:4993.

Another function of VGAM2282 is therefore inhibition of Chromosome 20 Open Reading Frame 36 (C20orf36, Accession NM_018257). Accordingly, utilities of VGAM2282 include diagnosis, prevention and treatment of diseases and clinical conditions associated with C20orf36. CHCR (Accession NM_018388) is another VGAM2282 host target gene. CHCR BINDING SITE is HOST TARGET binding site found in the 3' untranslated region of mRNA encoded by CHCR, corresponding to a HOST TARGET binding site such as BINDING SITE I, BINDING SITE II or BINDING SITE III. Table 2 illustrates the complementarity of the nucleotide sequences of CHCR BINDING SITE, designated SEQ ID:20421, to the nucleotide sequence of VGAM2282 RNA, herein designated VGAM RNA, also designated SEQ ID:4993.

Another function of VGAM2282 is therefore inhibition of CHCR (Accession NM_018388). Accordingly, utilities of VGAM2282 include diagnosis, prevention and treatment of diseases and clinical conditions associated with CHCR. Elongation of Very Long Chain Fatty Acids (FEN1/Elo2, SUR4/Elo3, yeast)-like 2 (ELOVL2, Accession NM_017770) is another VGAM2282 host target gene. ELOVL2 BINDING SITE is HOST TARGET binding site found in the 3' untranslated region of mRNA encoded by ELOVL2, corresponding to a HOST TARGET binding site such as BINDING SITE I, BINDING SITE II or BINDING SITE III. Table 2 illustrates the complementarity of the nucleotide sequences of ELOVL2 BINDING SITE, designated SEQ ID:19388, to the nucleotide sequence of VGAM2282 RNA, herein designated VGAM RNA, also designated SEQ ID:4993.

Another function of VGAM2282 is therefore inhibition of Elongation of Very Long Chain Fatty Acids (FEN1/Elo2, SUR4/Elo3, yeast)-like 2 (ELOVL2, Accession NM_017770). Accordingly, utilities of VGAM2282 include diagnosis, prevention and treatment of diseases and clinical conditions associated with ELOVL2. ERAP140 (Accession XM_059748) is another VGAM2282 host target gene. ERAP140 BINDING SITE is HOST TARGET binding site found in the 5' untranslated region of mRNA encoded by ERAP140, corresponding to a HOST TARGET binding site such as BINDING SITE I, BINDING SITE II or BINDING SITE III. Table 2 illustrates the complementarity of the nucleotide sequences of ERAP140 BINDING SITE, designated SEQ ID:37083, to the nucleotide sequence of VGAM2282 RNA, herein designated VGAM RNA, also designated SEQ ID:4993.

Another function of VGAM2282 is therefore inhibition of ERAP140 (Accession XM_059748). Accordingly, utilities of VGAM2282 include diagnosis, prevention and treatment of diseases and clinical conditions associated with ERAP140. FLJ10781 (Accession NM_018215) is another VGAM2282 host target gene. FLJ10781 BINDING SITE is HOST TARGET binding site found in the 3' untranslated region of mRNA encoded by FLJ10781, corresponding to a HOST TARGET binding site such as BINDING SITE I, BINDING SITE II or BINDING SITE III. Table 2 illustrates the complementarity of the nucleotide sequences of FLJ10781 BINDING SITE, designated SEQ ID:20139, to the nucleotide sequence of VGAM2282 RNA, herein designated VGAM RNA, also designated SEQ ID:4993.

Another function of VGAM2282 is therefore inhibition of FLJ10781 (Accession NM_018215). Accordingly, utilities of VGAM2282 include diagnosis, prevention and treatment of diseases and clinical conditions associated with FLJ10781. FLJ13162 (Accession NM_025002) is another VGAM2282 host target gene. FLJ13162 BINDING SITE is HOST TARGET binding site found in the 3' untranslated region of mRNA encoded by FLJ13162, corresponding to a HOST TARGET binding site such as BINDING SITE I, BINDING SITE II or BINDING SITE III. Table 2 illustrates the complementarity of the nucleotide sequences of FLJ13162 BINDING SITE, designated SEQ ID:24572, to the nucleotide sequence of VGAM2282 RNA, herein designated VGAM RNA, also designated SEQ ID:4993.

Another function of VGAM2282 is therefore inhibition of FLJ13162 (Accession NM_025002). Accordingly, utilities of VGAM2282 include diagnosis, prevention and treatment of diseases and clinical conditions associated with FLJ13162. FLJ20130 (Accession NM_017681) is another VGAM2282 host target gene. FLJ20130 BINDING SITE is HOST TARGET binding site found in the 3' untranslated region of mRNA encoded by FLJ20130, corresponding to a HOST TARGET binding site such as BINDING SITE I, BINDING SITE II or BINDING SITE III. Table 2 illustrates the complementarity of the nucleotide sequences of FLJ20130 BINDING SITE, designated SEQ ID:19226, to the nucleotide sequence of VGAM2282 RNA, herein designated VGAM RNA, also designated SEQ ID:4993.

Another function of VGAM2282 is therefore inhibition of FLJ20130 (Accession NM_017681). Accordingly, utilities of VGAM2282 include diagnosis, prevention and treatment of diseases and clinical conditions associated with FLJ20130. FLJ20344 (Accession NM_017776) is another VGAM2282 host target gene. FLJ20344 BINDING SITE is HOST TARGET binding site found in the 3' untranslated region of mRNA encoded by FLJ20344, corresponding to a HOST TARGET binding site such as BINDING SITE I, BINDING SITE II or BINDING SITE III. Table 2 illustrates the complementarity of the nucleotide sequences of FLJ20344 BINDING SITE, designated SEQ ID:19402, to the nucleotide sequence of VGAM2282 RNA, herein designated VGAM RNA, also designated SEQ ID:4993.

Another function of VGAM2282 is therefore inhibition of FLJ20344 (Accession NM_017776). Accordingly, utilities of VGAM2282 include diagnosis, prevention and treatment of diseases and clinical conditions associated with FLJ20344. FLJ20972 (Accession NM_025030) is another VGAM2282 host target gene. FLJ20972 BINDING SITE is HOST TARGET binding site found in the 3' untranslated region of mRNA encoded by FLJ20972, corresponding to a HOST TARGET binding site such as BINDING SITE I, BINDING SITE II or BINDING SITE III. Table 2 illustrates the complementarity of the nucleotide sequences of FLJ20972 BINDING SITE, designated SEQ ID:24623, to the nucleotide sequence of VGAM2282 RNA, herein designated VGAM RNA, also designated SEQ ID:4993.

Another function of VGAM2282 is therefore inhibition of FLJ20972 (Accession NM_025030). Accordingly, utilities of VGAM2282 include diagnosis, prevention and treatment of diseases and clinical conditions associated with FLJ20972. FLJ23462 (Accession NM_024843) is another VGAM2282 host target gene. FLJ23462 BINDING SITE is HOST TARGET binding site found in the 3' untranslated region of mRNA encoded by FLJ23462, corresponding to a HOST TARGET binding site such as BINDING SITE I, BINDING SITE II or BINDING SITE III. Table 2 illustrates the complementarity of the nucleotide sequences of FLJ23462 BINDING SITE, designated SEQ ID:24262, to the nucleotide sequence of VGAM2282 RNA, herein designated VGAM RNA, also designated SEQ ID:4993.

Another function of VGAM2282 is therefore inhibition of FLJ23462 (Accession NM_024843). Accordingly, utilities of VGAM2282 include diagnosis, prevention and treatment of diseases and clinical conditions associated with FLJ23462. Golgi Autoantigen, Golgin Subfamily A, 1 (GOLGA1, Accession NM_002077) is another VGAM2282 host target gene. GOLGA1 BINDING SITE is HOST TARGET binding site found in the 5' untranslated region of mRNA encoded by GOLGA1, corresponding to a HOST TARGET binding site such as BINDING SITE I, BINDING SITE II or BINDING SITE III. Table 2 illustrates the complementarity of the nucleotide sequences of GOLGA1 BINDING SITE, designated SEQ ID:7861, to the nucleotide sequence of VGAM2282 RNA, herein designated VGAM RNA, also designated SEQ ID:4993.

Another function of VGAM2282 is therefore inhibition of Golgi Autoantigen, Golgin Subfamily A, 1 (GOLGA1, Accession NM_002077). Accordingly, utilities of VGAM2282 include diagnosis, prevention and treatment of diseases and clinical conditions associated with GOLGA1. KIAA0820 (Accession XM_044463) is another VGAM2282 host target gene. KIAA0820 BINDING SITE is HOST TARGET binding site found in the 3' untranslated region of mRNA encoded by KIAA0820, corresponding to a HOST TARGET binding site such as BINDING SITE I, BINDING SITE II or BINDING SITE III. Table 2 illustrates the complementarity of the nucleotide sequences of KIAA0820 BINDING SITE, designated SEQ ID:34217, to the nucleotide sequence of VGAM2282 RNA, herein designated VGAM RNA, also designated SEQ ID:4993.

Another function of VGAM2282 is therefore inhibition of KIAA0820 (Accession XM_044463). Accordingly, utilities of VGAM2282 include diagnosis, prevention and treatment of diseases and clinical conditions associated with KIAA0820. KIAA1281 (Accession XM_114432) is another VGAM2282 host target gene. KIAA1281 BINDING SITE is HOST TARGET binding site found in the 3' untranslated region of mRNA encoded by KIAA1281, corresponding to a HOST TARGET binding site such as BINDING SITE I, BINDING SITE II or BINDING SITE III. Table 2 illustrates the complementarity of the nucleotide sequences of KIAA1281 BINDING SITE, designated SEQ ID:42960, to the nucleotide sequence of VGAM2282 RNA, herein designated VGAM RNA, also designated SEQ ID:4993.

Another function of VGAM2282 is therefore inhibition of KIAA1281 (Accession XM_114432). Accordingly, utilities of VGAM2282 include diagnosis, prevention and treatment of diseases and clinical conditions associated with KIAA1281. KIAA1775 (Accession NM_033100) is another VGAM2282 host target gene. KIAA1775 BINDING SITE is HOST TARGET binding site found in the 3' untranslated region of mRNA encoded by KIAA1775, corresponding to a HOST TARGET binding site such as BINDING SITE I, BINDING SITE II or BINDING SITE III. Table 2 illustrates the complementarity of the nucleotide sequences of KIAA1775 BINDING SITE, designated SEQ ID:26938, to the nucleotide sequence of VGAM2282 RNA, herein designated VGAM RNA, also designated SEQ ID:4993.

Another function of VGAM2282 is therefore inhibition of KIAA1775 (Accession NM_033100). Accordingly, utilities of VGAM2282 include diagnosis, prevention and treatment of diseases and clinical conditions associated with KIAA1775. KIAA1925 (Accession XM_166375) is another VGAM2282 host target gene. KIAA1925 BINDING SITE is HOST TARGET binding site found in the 5' untranslated region of mRNA encoded by KIAA1925, corresponding to a HOST TARGET binding site such as BINDING SITE I, BINDING SITE II or BINDING SITE III. Table 2 illustrates the complementarity of the nucleotide sequences of KIAA1925 BINDING SITE, designated SEQ ID:44207, to the nucleotide sequence of VGAM2282 RNA, herein designated VGAM RNA, also designated SEQ ID:4993.

Another function of VGAM2282 is therefore inhibition of KIAA1925 (Accession XM_166375). Accordingly, utilities of VGAM2282 include diagnosis, prevention and treatment of diseases and clinical conditions associated with KIAA1925. KIAA1987 (Accession XM_113870) is another VGAM2282 host target gene. KIAA1987 BINDING SITE is HOST TARGET binding site found in the 3' untranslated region of mRNA encoded by KIAA1987, corresponding to a HOST TARGET binding site such as BINDING SITE I, BINDING SITE II or BINDING SITE III. Table 2 illustrates the complementarity of the nucleotide sequences of KIAA1987 BINDING SITE, designated SEQ ID:42492, to the nucleotide sequence of VGAM2282 RNA, herein designated VGAM RNA, also designated SEQ ID:4993.

Another function of VGAM2282 is therefore inhibition of KIAA1987 (Accession XM_113870). Accordingly, utilities of VGAM2282 include diagnosis, prevention and treatment of diseases and clinical conditions associated with KIAA1987. N-ethylmaleimide-sensitive Factor Attachment Protein, Gamma (NAPG, Accession XM_172983) is another VGAM2282 host target gene. NAPG BINDING SITE is HOST TARGET binding site found in the 3' untranslated region of mRNA encoded by NAPG, corresponding to a HOST TARGET binding site such as BINDING SITE I, BINDING SITE II or BINDING SITE III. Table 2 illustrates the complementarity of the nucleotide sequences of NAPG BINDING SITE, designated SEQ ID:46253, to the nucleotide sequence of VGAM2282 RNA, herein designated VGAM RNA, also designated SEQ ID:4993.

Another function of VGAM2282 is therefore inhibition of N-ethylmaleimide-sensitive Factor Attachment Protein, Gamma (NAPG, Accession XM_172983). Accordingly, utilities of VGAM2282 include diagnosis, prevention and treatment of diseases and clinical conditions associated with NAPG. Peroxisomal Biogenesis Factor 12 (PEX12, Accession NM_000286) is another VGAM2282 host target gene. PEX12 BINDING SITE is HOST TARGET binding site found in the 3' untranslated region of mRNA encoded by PEX12, corresponding to a HOST TARGET binding site such as BINDING SITE I, BINDING SITE II or BINDING SITE III. Table 2 illustrates the complementarity of the nucleotide sequences of PEX12 BINDING SITE, designated SEQ ID:5831, to the nucleotide sequence of VGAM2282 RNA, herein designated VGAM RNA, also designated SEQ ID:4993.

Another function of VGAM2282 is therefore inhibition of Peroxisomal Biogenesis Factor 12 (PEX12, Accession NM_000286). Accordingly, utilities of VGAM2282 include diagnosis, prevention and treatment of diseases and clinical conditions associated with PEX12. PSR (Accession XM_036784) is another VGAM2282 host target gene. PSR BINDING SITE is HOST TARGET binding site found in the 3' untranslated region of mRNA encoded by PSR, corresponding to a HOST TARGET binding site such as BINDING SITE I, BINDING SITE II or BINDING SITE III. Table 2 illustrates the complementarity of the nucleotide sequences of PSR BINDING SITE, designated SEQ ID:32497, to the nucleotide sequence of VGAM2282 RNA, herein designated VGAM RNA, also designated SEQ ID:4993.

Another function of VGAM2282 is therefore inhibition of PSR (Accession XM_036784). Accordingly, utilities of VGAM2282 include diagnosis, prevention and treatment of diseases and clinical conditions associated with PSR. SES2 (Accession NM_031459) is another VGAM2282 host target gene. SES2 BINDING SITE is HOST TARGET binding site found in the 3' untranslated region of mRNA encoded by SES2, corresponding to a HOST TARGET binding site such as BINDING SITE I, BINDING SITE II or BINDING SITE III. Table 2 illustrates the complementarity of the nucleotide sequences of SES2 BINDING SITE, designated SEQ ID:25480, to the nucleotide sequence of VGAM2282 RNA, herein designated VGAM RNA, also designated SEQ ID:4993.

Another function of VGAM2282 is therefore inhibition of SES2 (Accession NM_031459). Accordingly, utilities of VGAM2282 include diagnosis, prevention and treatment of diseases and clinical conditions associated with SES2. Thioesterase, Adipose Associated (THEA, Accession XM_038922) is another VGAM2282 host target gene. THEA BINDING SITE is HOST TARGET binding site found in the 3' untranslated region of mRNA encoded by THEA, corresponding to a HOST TARGET binding site such as BINDING SITE I, BINDING SITE II or BINDING SITE III. Table 2 illustrates the complementarity of the nucleotide sequences of THEA BINDING SITE, designated SEQ ID:32947, to the nucleotide sequence of VGAM2282 RNA, herein designated VGAM RNA, also designated SEQ ID:4993.

Another function of VGAM2282 is therefore inhibition of Thioesterase, Adipose Associated (THEA, Accession XM_038922). Accordingly, utilities of VGAM2282 include diagnosis, prevention and treatment of diseases and clinical conditions associated with THEA. Ubiquitin Specific Protease 24 (USP24, Accession XM_165973) is another VGAM2282 host target gene. USP24 BINDING SITE is HOST TARGET binding site found in the 3' untranslated region of mRNA encoded by USP24, corresponding to a HOST TARGET binding site such as BINDING SITE I, BINDING SITE II or BINDING SITE III. Table 2 illustrates the complementarity of the nucleotide sequences of USP24 BINDING SITE, designated SEQ ID:43814, to the nucleotide sequence of VGAM2282 RNA, herein designated VGAM RNA, also designated SEQ ID:4993.

Another function of VGAM2282 is therefore inhibition of Ubiquitin Specific Protease 24 (USP24, Accession XM_165973). Accordingly, utilities of VGAM2282 include diagnosis, prevention and treatment of diseases and clinical conditions associated with USP24. LOC145815 (Accession XM_096874) is another VGAM2282 host target gene. LOC145815 BINDING SITE is HOST TARGET binding site found in the 5' untranslated region of mRNA encoded by LOC145815, corresponding to a HOST TARGET binding site such as BINDING SITE I, BINDING SITE II or BINDING SITE III. Table 2 illustrates the complementarity of the nucleotide sequences of LOC145815 BINDING SITE, designated SEQ ID:40607, to the nucleotide sequence of VGAM2282 RNA, herein designated VGAM RNA, also designated SEQ ID:4993.

Another function of VGAM2282 is therefore inhibition of LOC145815 (Accession XM_096874). Accordingly, utilities of VGAM2282 include diagnosis, prevention and treatment of diseases and clinical conditions associated with LOC145815. LOC146449 (Accession XM_028046) is another VGAM2282 host target gene. LOC146449 BINDING SITE is HOST TARGET binding site found in the 3' untranslated region of mRNA encoded by LOC146449, corresponding to a HOST TARGET binding site such as BINDING SITE I, BINDING SITE II or BINDING SITE III. Table 2 illustrates the complementarity of the nucleotide sequences of LOC146449 BINDING SITE, designated SEQ ID:30611, to the nucleotide sequence of VGAM2282 RNA, herein designated VGAM RNA, also designated SEQ ID:4993.

Another function of VGAM2282 is therefore inhibition of LOC146449 (Accession XM_028046). Accordingly, utilities of VGAM2282 include diagnosis, prevention and treatment of diseases and clinical conditions associated with LOC146449. LOC197414 (Accession XM_113880) is another VGAM2282 host target gene. LOC197414 BINDING SITE is HOST TARGET binding site found in the 3' untranslated region of mRNA encoded by LOC197414, corresponding to a HOST TARGET binding site such as BINDING SITE I, BINDING SITE II or BINDING SITE III. Table 2 illustrates the complementarity of the nucleotide sequences of LOC197414 BINDING SITE, designated SEQ ID:42515, to the nucleotide sequence of VGAM2282 RNA, herein designated VGAM RNA, also designated SEQ ID:4993.

Another function of VGAM2282 is therefore inhibition of LOC197414 (Accession XM_113880). Accordingly, utilities of VGAM2282 include diagnosis, prevention and treatment of diseases and clinical conditions associated with LOC197414. LOC221002 (Accession XM_166156) is another VGAM2282 host target gene. LOC221002 BINDING SITE is HOST TARGET binding site found in the 3' untranslated region of mRNA encoded by LOC221002, corresponding to a HOST TARGET binding site such as BINDING SITE I, BINDING SITE II or BINDING SITE III. Table 2 illustrates the complementarity of the nucleotide sequences of LOC221002 BINDING SITE, designated SEQ ID:43976, to the nucleotide sequence of VGAM2282 RNA, herein designated VGAM RNA, also designated SEQ ID:4993.

Another function of VGAM2282 is therefore inhibition of LOC221002 (Accession XM_166156). Accordingly, utilities of VGAM2282 include diagnosis, prevention and treatment of diseases and clinical conditions associated with LOC221002. LOC83693 (Accession NM_031463) is another VGAM2282 host target gene. LOC83693 BINDING SITE is HOST TARGET binding site found in the 3' untranslated region of mRNA encoded by LOC83693, corresponding to a HOST TARGET binding site such as BINDING SITE I, BINDING SITE II or BINDING SITE III. Table 2 illustrates the complementarity of the nucleotide sequences of LOC83693 BINDING SITE, designated SEQ ID:25498, to the nucleotide sequence of VGAM2282 RNA, herein designated VGAM RNA, also designated SEQ ID:4993.

Another function of VGAM2282 is therefore inhibition of LOC83693 (Accession NM_031463). Accordingly, utilities of VGAM2282 include diagnosis, prevention and treatment of diseases and clinical conditions associated with LOC83693. FIG. 1 further provides a conceptual description of a novel bioinformatically detected viral gene of the present invention, referred to here as Viral Genomic Address Messenger 2283 (VGAM2283) viral gene, which modulates expression of respective host target genes thereof, the function and utility of which host target genes is known in the art.

VGAM2283 is a novel bioinformatically detected regulatory, non protein coding, viral micro RNA (miRNA) gene. The method by which VGAM2283 was detected is described hereinabove with reference to FIGS. 1-8.

VGAM2283 gene, herein designated VGAM GENE, is a viral gene contained in the genome of Murine Hepatitis Virus. VGAM2283 host target gene, herein designated VGAM HOST TARGET GENE, is a human gene contained in the human genome.

VGAM2283 gene encodes a VGAM2283 precursor RNA, herein designated VGAM PRECURSOR RNA. Similar to other miRNA genes, and unlike most ordinary genes, VGAM2283 precursor RNA does not encode a protein. A nucleotide sequence identical or highly similar to the nucleotide sequence of VGAM2283 precursor RNA is designated SEQ ID:2269, and is provided hereinbelow with reference to the sequence listing part. Nucleotide sequence SEQ ID:2269 is located at position 23988 relative to the genome of Murine Hepatitis Virus.

VGAM2283 precursor RNA folds onto itself, forming VGAM2283 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2283 folded precursor RNA into VGAM2283 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 45%) nucleotide sequence of VGAM2283 RNA is designated SEQ ID:4994, and is provided hereinbelow with reference to the sequence listing part.

VGAM2283 host target gene, herein designated VGAM HOST TARGET GENE, encodes a corresponding messenger RNA, VGAM2283 host target RNA, herein designated VGAM HOST TARGET RNA. VGAM2283 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2283 RNA, herein designated VGAM RNA, binds complementarily to one or more host target binding sites located in untranslated regions of VGAM2283 host target RNA, herein designated VGAM HOST TARGET RNA. This complementary binding is due to the fact that the nucleotide sequence of VGAM2283 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2283 RNA, herein designated VGAM RNA, may have a different number of host target binding sites in untranslated regions of a VGAM2283 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2283 RNA, herein designated VGAM RNA, to host target binding sites on VGAM2283 host target RNA, herein designated VGAM HOST TARGET RNA, such as BINDING SITE I, BINDING SITE II and BINDING SITE III, inhibits translation of VGAM2283 host target RNA into VGAM2283 host target protein, herein designated VGAM HOST TARGET PROTEIN. VGAM host target protein is therefore outlined by a broken line.

It is appreciated that VGAM2283 host target gene, herein designated VGAM HOST TARGET GENE, in fact represents a plurality of VGAM2283 host target genes. The mRNA of each one of this plurality of VGAM2283 host target genes comprises one or more host target binding sites, each having a nucleotide sequence which is at least partly complementary to VGAM2283 RNA, herein designated VGAM RNA, and which when bound by VGAM2283 RNA causes inhibition of translation of respective one or more VGAM2283 host target proteins.

It is further appreciated by one skilled in the art that the mode of translational inhibition illustrated by FIG. 1 with specific reference to translational inhibition exerted by VGAM2283 gene, herein designated VGAM GENE, on one or more VGAM2283 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM2283 is inhibition of expression of host target genes, as part of a novel viral mechanism of attacking a host. Accordingly, utilities of VGAM2283 include diagnosis, prevention and treatment of viral infection by Murine Hepatitis Virus. Specific functions, and accordingly utilities, of VGAM2283 correlate with, and may be deduced from, the identity of the host target genes which VGAM2283 binds and inhibits, and the function of these host target genes, as elaborated hereinbelow.

Nucleotide sequences of the VGAM2283 precursor RNA, herein designated VGAM PRECURSOR RNA, and of the 'diced' VGAM2283 RNA, herein designated VGAM RNA, and a schematic representation of the secondary folding of VGAM2283 folded precursor RNA, herein designated VGAM FOLDED PRECURSOR RNA, of VGAM2283 are further described hereinbelow with reference to Table 1.

Nucleotide sequences of host target binding sites, such as BINDING SITE-I, BINDING SITE-II and BINDING SITE-III of FIG. 1, found on VGAM2283 host target RNA, and schematic representation of the complementarity of each of these host target binding sites to VGAM2283 RNA, herein designated VGAM RNA, are described hereinbelow with reference to Table 2.

As mentioned hereinabove with reference to FIG. 1, a function of VGAM2283 gene, herein designated VGAM is inhibition of expression of VGAM2283 target genes. It is appreciated that specific functions, and accordingly utilities, of VGAM2283 correlate with, and may be deduced from, the identity of the target genes which VGAM2283 binds and inhibits, and the function of these target genes, as elaborated hereinbelow.

Frizzled Homolog 10 (Drosophila) (FZD10, Accession NM_007197) is a VGAM2283 host target gene. FZD10 BINDING SITE is HOST TARGET binding site found in the 3' untranslated region of mRNA encoded by FZD10, corresponding to a HOST TARGET binding site such as BINDING SITE I, BINDING SITE II or BINDING SITE III. Table 2 illustrates the complementarity of the nucleotide sequences of FZD10 BINDING SITE, designated SEQ ID:14052, to the nucleotide sequence of VGAM2283 RNA, herein designated VGAM RNA, also designated SEQ ID:4994.

A function of VGAM2283 is therefore inhibition of Frizzled Homolog 10 (Drosophila) (FZD10, Accession NM_007197). Accordingly, utilities of VGAM2283 include diagnosis, prevention and treatment of diseases and clinical conditions associated with FZD10. Chromosome 17 Open Reading Frame 31 (C17orf31, Accession NM_017575) is another VGAM2283 host target gene. C17orf31 BINDING SITE is HOST TARGET binding site found in the 5' untranslated region of mRNA encoded by C17orf31, corresponding to a HOST TARGET binding site such as BINDING SITE I, BINDING SITE II or BINDING SITE III. Table 2 illustrates the complementarity of the nucleotide sequences of C17orf31 BINDING SITE, designated SEQ ID:18997, to the nucleotide sequence of VGAM2283 RNA, herein designated VGAM RNA, also designated SEQ ID:4994.

Another function of VGAM2283 is therefore inhibition of Chromosome 17 Open Reading Frame 31 (C17orf31, Accession NM_017575). Accordingly, utilities of VGAM2283 include diagnosis, prevention and treatment of diseases and clinical conditions associated with C17orf31. CL683 (Accession NM_015696) is another VGAM2283 host target gene. CL683 BINDING SITE is HOST TARGET binding site found in the 3' untranslated region of mRNA encoded by CL683, corresponding to a HOST TARGET binding site such as BINDING SITE I, BINDING SITE II or BINDING SITE III. Table 2 illustrates the complementarity of the nucleotide sequences of CL683 BINDING SITE, designated SEQ ID:17925, to the nucleotide sequence of VGAM2283 RNA, herein designated VGAM RNA, also designated SEQ ID:4994.

Another function of VGAM2283 is therefore inhibition of CL683 (Accession NM_015696). Accordingly, utilities of VGAM2283 include diagnosis, prevention and treatment of diseases and clinical conditions associated with CL683. FLJ13710 (Accession NM_024817) is another VGAM2283 host target gene. FLJ13710 BINDING SITE is HOST TARGET binding site found in the 3' untranslated region of mRNA encoded by FLJ13710, corresponding to a HOST TARGET binding site such as BINDING SITE I, BINDING SITE II or BINDING SITE III. Table 2 illustrates the complementarity of the nucleotide sequences of FLJ13710 BINDING SITE, designated SEQ ID:24203, to the nucleotide sequence of VGAM2283 RNA, herein designated VGAM RNA, also designated SEQ ID:4994.

Another function of VGAM2283 is therefore inhibition of FLJ13710 (Accession NM_024817). Accordingly, utilities of VGAM2283 include diagnosis, prevention and treatment of diseases and clinical conditions associated with FLJ13710. KIAA1679 (Accession XM_046570) is another VGAM2283 host target gene. KIAA1679 BINDING SITE is HOST TARGET binding site found in the 3' untranslated region of mRNA encoded by KIAA1679, corresponding to a HOST TARGET binding site such as BINDING SITE I, BINDING SITE II or BINDING SITE III. Table 2 illustrates the complementarity of the nucleotide sequences of KIAA1679 BINDING SITE, designated SEQ ID:34749, to the nucleotide sequence of VGAM2283 RNA, herein designated VGAM RNA, also designated SEQ ID:4994.

Another function of VGAM2283 is therefore inhibition of KIAA1679 (Accession XM_046570). Accordingly, utilities of VGAM2283 include diagnosis, prevention and treatment of diseases and clinical conditions associated with KIAA1679. PLU-1 (Accession XM_113375) is another VGAM2283 host target gene. PLU-1 BINDING SITE1 and PLU-1 BINDING SITE2 are HOST TARGET binding sites found in untranslated regions of mRNA encoded by PLU-1, corresponding to HOST TARGET binding sites such as BINDING SITE I, BINDING SITE II or BINDING SITE III. Table 2 illustrates the complementarity of the nucleotide sequences of PLU-1 BINDING SITE1 and PLU-1 BINDING SITE2, designated SEQ ID:42250 and SEQ ID:13401 respectively, to the nucleotide sequence of VGAM2283 RNA, herein designated VGAM RNA, also designated SEQ ID:4994.

Another function of VGAM2283 is therefore inhibition of PLU-1 (Accession XM_113375). Accordingly, utilities of VGAM2283 include diagnosis, prevention and treatment of diseases and clinical conditions associated with PLU-1. Heterogeneous Nuclear Ribonucleoprotein U (scaffold attachment factor A) (HNRPU, Accession NM_004501) is another VGAM2284 host target gene. HNRPU BINDING SITE1 and HNRPU BINDING SITE2 are HOST TARGET binding sites found in untranslated regions of mRNA encoded by HNRPU, corresponding to HOST TARGET binding sites such as BINDING SITE I, BINDING SITE II or BINDING SITE III. Table 2 illustrates the complementarity of the nucleotide sequences of HNRPU BINDING SITE1 and HNRPU BINDING SITE2, designated SEQ ID:10836 and SEQ ID:25580 respectively, to the nucleotide sequence of VGAM2284 RNA, herein designated VGAM RNA, also designated SEQ ID:4995.

Another function of VGAM2284 is therefore inhibition of Heterogeneous Nuclear Ribonucleoprotein U (scaffold attachment factor A) (HNRPU, Accession NM_004501). Accordingly, utilities of VGAM2284 include diagnosis, prevention and treatment of diseases and clinical conditions associated with HNRPU. LOC148254 (Accession XM_086121) is another VGAM2284 host target gene. LOC148254 BINDING SITE is HOST TARGET binding site found in the 3' untranslated region of mRNA encoded by LOC148254, corresponding to a HOST TARGET binding site such as BINDING SITE I, BINDING SITE II or BIND- ING SITE III. Table 2 illustrates the complementarity of the nucleotide sequences of LOC148254 BINDING SITE, designated SEQ ID:38501, to the nucleotide sequence of VGAM2284 RNA, herein designated VGAM RNA, also designated SEQ ID:4995.

Another function of VGAM2284 is therefore inhibition of LOC148254 (Accession XM_086121). Accordingly, utilities of VGAM2284 include diagnosis, prevention and treatment of diseases and clinical conditions associated with LOC148254. FIG. 1 further provides a conceptual description of a novel bioinformatically detected viral gene of the present invention, referred to here as Viral Genomic Address Messenger 2285 (VGAM2285) viral gene, which modulates expression of respective host target genes thereof, the function and utility of which host target genes is known in the art.

VGAM2285 is a novel bioinformatically detected regulatory, non protein coding, viral micro RNA (miRNA) gene. The method by which VGAM2285 was detected is described hereinabove with reference to FIGS. 1-8.

VGAM2285 gene, herein designated VGAM GENE, is a viral gene contained in the genome of Murine Hepatitis Virus. VGAM2285 host target gene, herein designated VGAM HOST TARGET GENE, is a human gene contained in the human genome.

VGAM2285 gene encodes a VGAM2285 precursor RNA, herein designated VGAM PRECURSOR RNA. Similar to other miRNA genes, and unlike most ordinary genes, VGAM2285 precursor RNA does not encode a protein. A nucleotide sequence identical or highly similar to the nucleotide sequence of VGAM2285 precursor RNA is designated SEQ ID:2271, and is provided hereinbelow with reference to the sequence listing part. Nucleotide sequence SEQ ID:2271 is located at position 13151 relative to the genome of Murine Hepatitis Virus.

VGAM2285 precursor RNA folds onto itself, forming VGAM2285 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2285 folded precursor RNA into VGAM2285 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2285 RNA is designated SEQ ID:4996, and is provided hereinbelow with reference to the sequence listing part.

VGAM2285 host target gene, herein designated VGAM HOST TARGET GENE, encodes a corresponding messenger RNA, VGAM2285 host target RNA, herein designated VGAM HOST TARGET RNA. VGAM2285 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2285 RNA, herein designated VGAM RNA, binds complementarily to one or more host target binding sites located in untranslated regions of VGAM2285 host target RNA, herein designated VGAM HOST TARGET RNA. This complementary binding is due to the fact that the nucleotide sequence of VGAM2285 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2285 RNA, herein designated VGAM RNA, may have a different number of host target binding sites in untranslated regions of a VGAM2285 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2285 RNA, herein designated VGAM RNA, to host target binding sites on VGAM2285 host target RNA, herein designated VGAM HOST TARGET RNA, such as BINDING SITE I, BINDING SITE II and BINDING SITE III, inhibits translation of VGAM2285 host target RNA into VGAM2285 host target protein, herein designated VGAM HOST TARGET PROTEIN. VGAM host target protein is therefore outlined by a broken line.

It is appreciated that VGAM2285 host target gene, herein designated VGAM HOST TARGET GENE, in fact represents a plurality of VGAM2285 host target genes. The mRNA of each one of this plurality of VGAM2285 host target genes comprises one or more host target binding sites, each having a nucleotide sequence which is at least partly complementary to VGAM2285 RNA, herein designated VGAM RNA, and which when bound by VGAM2285 RNA causes inhibition of translation of respective one or more VGAM2285 host target proteins.

It is further appreciated by one skilled in the art that the mode of translational inhibition illustrated by FIG. 1 with specific reference to translational inhibition exerted by VGAM2285 gene, herein designated VGAM GENE, on one or more VGAM2285 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2285 is inhibition of expression of host target genes, as part of a novel viral mechanism of attacking a host. Accordingly, utilities of VGAM2285 include diagnosis, prevention and treatment of viral infection by Murine Hepatitis Virus. Specific functions, and accordingly utilities, of VGAM2285 correlate with, and may be deduced from, the identity of the host target genes which VGAM2285 binds and inhibits, and the function of these host target genes, as elaborated hereinbelow.

Nucleotide sequences of the VGAM2285 precursor RNA, herein designated VGAM PRECURSOR RNA, and of the 'diced' VGAM2285 RNA, herein designated VGAM RNA, and a schematic representation of the secondary folding of VGAM2285 folded precursor RNA, herein designated VGAM FOLDED PRECURSOR RNA, of VGAM2285 are further described hereinbelow with reference to Table 1.

Nucleotide sequences of host target binding sites, such as BINDING SITE-I, BINDING SITE-II and BINDING SITE-III of FIG. 1, found on VGAM2285 host target RNA, and schematic representation of the complementarity of each of these host target binding sites to VGAM2285 RNA, herein designated VGAM RNA, are described hereinbelow with reference to Table 2.

As mentioned hereinabove with reference to FIG. 1, a function of VGAM2285 gene, herein designated VGAM is inhibition of expression of VGAM2285 target genes. It is appreciated that specific functions, and accordingly utilities, of VGAM2285 correlate with, and may be deduced from, the identity of the target genes which VGAM2285 binds and inhibits, and the function of these target genes, as elaborated hereinbelow.

Adrenergic, Alpha-2B-, Receptor (ADRA2B, Accession NM_000682) is a VGAM2285 host target gene. ADRA2B BINDING SITE is HOST TARGET binding site found in the 3' untranslated region of mRNA encoded by ADRA2B, corresponding to a HOST TARGET binding site such as BINDING SITE I, BINDING SITE II or BINDING SITE III. Table 2 illustrates the complementarity of the nucleotide sequences of ADRA2B BINDING SITE, designated SEQ ID:6339, to the nucleotide sequence of VGAM2285 RNA, herein designated VGAM RNA, also designated SEQ ID:4996.

A function of VGAM2285 is therefore inhibition of Adrenergic, Alpha-2B-, Receptor (ADRA2B, Accession NM_000682), a gene which mediate the catecholamine-induced inhibition of adenylate cyclase through the action of g proteins. Accordingly, utilities of VGAM2285 include diagnosis, prevention and treatment of diseases and clinical conditions associated with ADRA2B. The function of ADRA2B and its association with various diseases and clinical conditions, has been established by previous studies, as described hereinabove with reference to VGAM609. B-cell CLL/lymphoma 2 (BCL2, Accession NM_000633) is another VGAM2285 host target gene. BCL2 BINDING SITE is HOST TARGET binding site found in the 3' untranslated region of mRNA encoded by BCL2, corresponding to a HOST TARGET binding site such as BINDING SITE I, BINDING SITE II or BINDING SITE III. Table 2 illustrates the complementarity of the nucleotide sequences of BCL2 BINDING SITE, designated SEQ ID:6254, to the nucleotide sequence of VGAM2285 RNA, herein designated VGAM RNA, also designated SEQ ID:4996.

Another function of VGAM2285 is therefore inhibition of B-cell CLL/lymphoma 2 (BCL2, Accession NM_000633). Accordingly, utilities of VGAM2285 include diagnosis, prevention and treatment of diseases and clinical conditions associated with BCL2. Clock Homolog (mouse) (CLOCK, Accession NM_004898) is another VGAM2285 host target gene. CLOCK BINDING SITE is HOST TARGET binding site found in the 3' untranslated region of mRNA encoded by CLOCK, corresponding to a HOST TARGET binding site such as BINDING SITE I, BINDING SITE II or BINDING SITE III. Table 2 illustrates the complementarity of the nucleotide sequences of CLOCK BINDING SITE, designated SEQ ID:11334, to the nucleotide sequence of VGAM2285 RNA, herein designated VGAM RNA, also designated SEQ ID:4996.

Another function of VGAM2285 is therefore inhibition of Clock Homolog (mouse) (CLOCK, Accession NM_004898). Accordingly, utilities of VGAM2285 include diagnosis, prevention and treatment of diseases and clinical conditions associated with CLOCK. Contactin Associated Protein-like 2 (CNTNAP2, Accession NM_014141) is another VGAM2285 host target gene. CNTNAP2 BINDING SITE is HOST TARGET binding site found in the 3' untranslated region of mRNA encoded by CNTNAP2, corresponding to a HOST TARGET binding site such as BINDING SITE I, BINDING SITE II or BINDING SITE III. Table 2 illustrates the complementarity of the nucleotide sequences of CNTNAP2 BINDING SITE, designated SEQ ID:15415, to the nucleotide sequence of VGAM2285 RNA, herein designated VGAM RNA, also designated SEQ ID:4996.

Another function of VGAM2285 is therefore inhibition of Contactin Associated Protein-like 2 (CNTNAP2, Accession NM_014141). Accordingly, utilities of VGAM2285 include diagnosis, prevention and treatment of diseases and clinical conditions associated with CNTNAP2. Hepatocyte Growth Factor (hepapoietin A; scatter factor) (HGF, Accession XM_168542) is another VGAM2285 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45218, to the nucleotide sequence of VGAM2285 RNA, herein designated VGAM RNA, also designated SEQ ID:4996.

Another function of VGAM2285 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM2285 include diagnosis, prevention and treatment of diseases and clinical conditions associated with HGF. The function of HGF and its association with various diseases and clinical conditions, has been established by previous studies, as described hereinabove with reference to VGAM174. Potassium Intermediate/small Conductance Calcium-activated Channel, Subfamily N, Member 2 (KCNN2, Accession NM_021614) is another VGAM2285 host target gene. KCNN2 BINDING SITE is HOST TARGET binding site found in the 5' untranslated region of mRNA encoded by KCNN2, corresponding to a HOST TARGET binding site such as BINDING SITE I, BINDING SITE II or BINDING SITE III. Table 2 illustrates the complementarity of the nucleotide sequences of KCNN2 BINDING SITE, designated SEQ ID:22242, to the nucleotide sequence of VGAM2285 RNA, herein designated VGAM RNA, also designated SEQ ID:4996.

Another function of VGAM2285 is therefore inhibition of Potassium Intermediate/small Conductance Calcium-activated Channel, Subfamily N, Member 2 (KCNN2, Accession NM_021614), a gene which forms a voltage-independent potassium channel activated by intracellular calcium. Accordingly, utilities of VGAM2285 include diagnosis, prevention and treatment of diseases and clinical conditions associated with KCNN2. The function of KCNN2 has been established by previous studies. Calcium-activated potassium channels respond to changes in intracellular calcium concentration and couple calcium metabolism to potassium flux and membrane excitability. Based on their electrophysiologic properties, calcium-activated potassium channels are classified as large conductance, calcium- and voltage-gated channels (BK, e.g., KCNMB4; 605223), intermediate conductance, voltage-independent channels (IK, e.g., KCNN4; 602754), and small conductance, voltage-independent channels (SK, e.g., KCNN3; 602983). By screening a Jurkat T-cell cDNA library using RT-PCR with degenerate primers based on rat and human SK channels, followed by searching an EST database, Desai et al. (2000) isolated a cDNA encoding KCNN2, which they termed SK2. Sequence analysis predicted that the 579-amino acid protein, which is 97% identical to the rat sequence, contains multiple phosphorylation sites and no N-glycosylation sites. Northern blot analysis detected a major 2.5-kb transcript that was expressed most strongly in liver and brain, with lower levels in kidney and Jurkat (but not peripheral) T cells. A minor 4.4-kb transcript was expressed in heart and skeletal muscle, and a 1.3-kb transcript was expressed in brain and liver. Functional analysis showed that KCNN2 expresses a potassium current that is sensitive to apamin, scyllatoxin, and tubocurarine and is insensitive to charybdotoxin. Schumacher et al. (2001) determined the crystal structure of calmodulin (OMIM Ref. No. 114180) bound to KCNN2. The calmodulin-binding domain forms an elongated dimer with a calmodulin molecule bound at each end; each calmodulin wraps around 3 alpha helices, 2 from 1 calmodulin-binding domain subunit and 1 from the other.

Full details of the abovementioned studies are described in the following publications, the disclosure of which are hereby incorporated by reference:

Desai, R.; Peretz, A.; Idelson, H.; Lazarovici, P.; Attali, B.: Ca (2+)-activated K(+) channels in human leukemic Jurkat T cells: molecular cloning, biochemical and functional characterization. J. Biol. Chem. 275:39954-39963, 2000; and Schumacher, M. A.; Rivard, A. F.; Bachinger, H. P.; Adelman, J. P.: Structure of the gating domain of a Ca (2+)-activated K+ channel complexed with Ca (2+)/calmodulin. Nature 410:1120.

Further studies establishing the function and utilities of KCNN2 are found in John Hopkins OMIM database record ID 605879, and in sited publications numbered 700 and 12582 listed in the bibliography section hereinbelow, which are also hereby incorporated by reference. Arginyl Aminopeptidase (aminopeptidase B)-like 1 (RNPEPL1, Accession NM_018226) is another VGAM2285 host target gene. RNPEPL1 BINDING SITE is HOST TARGET binding site found in the 3' untranslated region of mRNA encoded by RNPEPL1, corresponding to a HOST TARGET binding site such as BINDING SITE I, BINDING SITE II or BINDING SITE III. Table 2 illustrates the complementarity of the nucleotide sequences of RNPEPL1 BINDING SITE, designated SEQ ID:20159, to the nucleotide sequence of VGAM2285 RNA, herein designated VGAM RNA, also designated SEQ ID:4996.

Another function of VGAM2285 is therefore inhibition of Arginyl Aminopeptidase (aminopeptidase B)-like 1 (RNPEPL1, Accession NM_018226). Accordingly, utilities of VGAM2285 include diagnosis, prevention and treatment of diseases and clinical conditions associated with RNPEPL1. TM7SF3 (Accession XM_006748) is another VGAM2285 host target gene. TM7SF3 BINDING SITE is HOST TARGET binding site found in the 3' untranslated region of mRNA encoded by TM7SF3, corresponding to a HOST TARGET binding site such as BINDING SITE I, BINDING SITE II or BINDING SITE III. Table 2 illustrates the complementarity of the nucleotide sequences of TM7SF3 BINDING SITE, designated SEQ ID:30010, to the nucleotide sequence of VGAM2285 RNA, herein designated VGAM RNA, also designated SEQ ID:4996.

Another function of VGAM2285 is therefore inhibition of TM7SF3 (Accession XM_006748). Accordingly, utilities of VGAM2285 include diagnosis, prevention and treatment of diseases and clinical conditions associated with TM7SF3. FLJ10388 (Accession NM_018082) is another VGAM2285 host target gene. FLJ10388 BINDING SITE is HOST TARGET binding site found in the 3' untranslated region of mRNA encoded by FLJ10388, corresponding to a HOST TARGET binding site such as BINDING SITE I, BINDING SITE II or BINDING SITE III. Table 2 illustrates the complementarity of the nucleotide sequences of FLJ10388 BINDING SITE, designated SEQ ID:19844, to the nucleotide sequence of VGAM2285 RNA, herein designated VGAM RNA, also designated SEQ ID:4996.

Another function of VGAM2285 is therefore inhibition of FLJ10388 (Accession NM_018082). Accordingly, utilities of VGAM2285 include diagnosis, prevention and treatment of diseases and clinical conditions associated with FLJ10388. KIAA1879 (Accession XM_056635) is another VGAM2285 host target gene. KIAA1879 BINDING SITE is HOST TARGET binding site found in the 3' untranslated region of mRNA encoded by KIAA1879, corresponding to a HOST TARGET binding site such as BINDING SITE I, BINDING SITE II or BINDING SITE III. Table 2 illustrates the complementarity of the nucleotide sequences of KIAA1879 BINDING SITE, designated SEQ ID:36409, to the nucleotide sequence of VGAM2285 RNA, herein designated VGAM RNA, also designated SEQ ID:4996.

Another function of VGAM2285 is therefore inhibition of KIAA1879 (Accession XM_056635). Accordingly, utilities of VGAM2285 include diagnosis, prevention and treatment of diseases and clinical conditions associated with KIAA1879. LOC157697 (Accession XM_088365) is another VGAM2285 host target gene. LOC157697 BINDING SITE is HOST TARGET binding site found in the 5' untranslated region of mRNA encoded by LOC157697, corresponding to a HOST TARGET binding site such as BINDING SITE I, BINDING SITE II or BINDING SITE III. Table 2 illustrates the complementarity of the nucleotide sequences of LOC157697 BINDING SITE, designated SEQ ID:39647, to the nucleotide sequence of VGAM2285 RNA, herein designated VGAM RNA, also designated SEQ ID:4996.

Another function of VGAM2285 is therefore inhibition of LOC157697 (Accession XM_088365). Accordingly, utilities of VGAM2285 include diagnosis, prevention and treatment of diseases and clinical conditions associated with LOC157697. LOC219894 (Accession XM_167782) is another VGAM2285 host target gene. LOC219894 BINDING SITE is HOST TARGET binding site found in the 3' untranslated region of mRNA encoded by LOC219894, corresponding to a HOST TARGET binding site such as BINDING SITE I, BINDING SITE II or BINDING SITE III. Table 2 illustrates the complementarity of the nucleotide sequences of LOC219894 BINDING SITE, designated SEQ ID:44794, to the nucleotide sequence of VGAM2285 RNA, herein designated VGAM RNA, also designated SEQ ID:4996.

Another function of VGAM2285 is therefore inhibition of LOC219894 (Accession XM_167782). Accordingly, utilities of VGAM2285 include diagnosis, prevention and treatment of diseases and clinical conditions associated with LOC219894. FIG. 1 further provides a conceptual description of a novel bioinformatically detected viral gene of the present invention, referred to here as Viral Genomic Address Messenger 2286 (VGAM2286) viral gene, which modulates expression of respective host target genes thereof, the function and utility of which host target genes is known in the art.

VGAM2286 is a novel bioinformatically detected regulatory, non protein coding, viral micro RNA (miRNA) gene. The method by which VGAM2286 was detected is described hereinabove with reference to FIGS. 1-8.

VGAM2286 gene, herein designated VGAM GENE, is a viral gene contained in the genome of Murine Hepatitis Virus. VGAM2286 host target gene, herein designated VGAM HOST TARGET GENE, is a human gene contained in the human genome.

VGAM2286 gene encodes a VGAM2286 precursor RNA, herein designated VGAM PRECURSOR RNA. Similar to other miRNA genes, and unlike most ordinary genes, VGAM2286 precursor RNA does not encode a protein. A nucleotide sequence identical or highly similar to the nucleotide sequence of VGAM2286 precursor RNA is designated SEQ ID:2272, and is provided hereinbelow with reference to the sequence listing part. Nucleotide sequence SEQ ID:2272 is located at position 4778 relative to the genome of Murine Hepatitis Virus.

VGAM2286 precursor RNA folds onto itself, forming VGAM2286 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2286 folded precursor RNA into VGAM2286 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM2286 RNA is designated SEQ ID:4997, and is provided hereinbelow with reference to the sequence listing part.

VGAM2286 host target gene, herein designated VGAM HOST TARGET GENE, encodes a corresponding messenger RNA, VGAM2286 host target RNA, herein designated VGAM HOST TARGET RNA. VGAM2286 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2286 RNA, herein designated VGAM RNA, binds complementarily to one or more host target binding sites located in untranslated regions of VGAM2286 host target RNA, herein designated VGAM HOST TARGET RNA. This complementary binding is due to the fact that the nucleotide sequence of VGAM2286 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2286 RNA, herein designated VGAM RNA, may have a different number of host target binding sites in untranslated regions of a VGAM2286 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2286 RNA, herein designated VGAM RNA, to host target binding sites on VGAM2286 host target RNA, herein designated VGAM HOST TARGET RNA, such as BINDING SITE I, BINDING SITE II and BINDING SITE III, inhibits translation of VGAM2286 host target RNA into VGAM2286 host target protein, herein designated VGAM HOST TARGET PROTEIN. VGAM host target protein is therefore outlined by a broken line.

It is appreciated that VGAM2286 host target gene, herein designated VGAM HOST TARGET GENE, in fact represents a plurality of VGAM2286 host target genes. The mRNA of each one of this plurality of VGAM2286 host target genes comprises one or more host target binding sites, each having a nucleotide sequence which is at least partly complementary to VGAM2286 RNA, herein designated VGAM RNA, and which when bound by VGAM2286 RNA causes inhibition of translation of respective one or more VGAM2286 host target proteins.

It is further appreciated by one skilled in the art that the mode of translational inhibition illustrated by FIG. 1 with specific reference to translational inhibition exerted by VGAM2286 gene, herein designated VGAM GENE, on one or more VGAM2286 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2286 is inhibition of expression of host target genes, as part of a novel viral mechanism of attacking a host. Accordingly, utilities of VGAM2286 include diagnosis, prevention and treatment of viral infection by Murine Hepatitis Virus. Specific functions, and accordingly utilities, of VGAM2286 correlate with, and may be deduced from, the identity of the host target genes which VGAM2286 binds and inhibits, and the function of these host target genes, as elaborated hereinbelow.

Nucleotide sequences of the VGAM2286 precursor RNA, herein designated VGAM PRECURSOR RNA, and of the 'diced' VGAM2286 RNA, herein designated VGAM RNA, and a schematic representation of the secondary folding of VGAM2286 folded precursor RNA, herein designated VGAM FOLDED PRECURSOR RNA, of VGAM2286 are further described hereinbelow with reference to Table 1.

Nucleotide sequences of host target binding sites, such as BINDING SITE-I, BINDING SITE-II and BINDING SITE-III of FIG. 1, found on VGAM2286 host target RNA, and schematic representation of the complementarity of each of these host target binding sites to VGAM2286 RNA, herein designated VGAM RNA, are described hereinbelow with reference to Table 2.

As mentioned hereinabove with reference to FIG. 1, a function of VGAM2286 gene, herein designated VGAM is inhibition of expression of VGAM2286 target genes. It is appreciated that specific functions, and accordingly utilities, of VGAM2286 correlate with, and may be deduced from, the identity of the target genes which VGAM2286 binds and inhibits, and the function of these target genes, as elaborated hereinbelow.

FLJ14346 (Accession NM_025029) is a VGAM2286 host target gene. FLJ14346 BINDING SITE is HOST TARGET binding site found in the 3' untranslated region of mRNA encoded by FLJ14346, corresponding to a HOST TARGET binding site such as BINDING SITE I, BINDING SITE II or BINDING SITE III. Table 2 illustrates the complementarity of the nucleotide sequences of FLJ14346 BINDING SITE, designated SEQ ID:24620, to the nucleotide sequence of VGAM2286 RNA, herein designated VGAM RNA, also designated SEQ ID:4997.

A function of VGAM2286 is therefore inhibition of FLJ14346 (Accession NM_025029). Accordingly, utilities of VGAM2286 include diagnosis, prevention and treatment of diseases and clinical conditions associated with FLJ14346. FLJ20366 (Accession NM_017786) is another VGAM2286 host target gene. FLJ20366 BINDING SITE is HOST TARGET binding site found in the 3' untranslated region of mRNA encoded by FLJ20366, corresponding to a HOST TARGET binding site such as BINDING SITE I, BINDING SITE II or BINDING SITE III. Table 2 illustrates the complementarity of the nucleotide sequences of FLJ20366 BINDING SITE, designated SEQ ID:19418, to the nucleotide sequence of VGAM2286 RNA, herein designated VGAM RNA, also designated SEQ ID:4997.

Another function of VGAM2286 is therefore inhibition of FLJ20366 (Accession NM_017786). Accordingly, utilities of VGAM2286 include diagnosis, prevention and treatment of diseases and clinical conditions associated with FLJ20366. NIR3 (Accession XM_038799) is another VGAM2286 host target gene. NIR3 BINDING SITE is HOST TARGET binding site found in the 3' untranslated region of mRNA encoded by NIR3, corresponding to a HOST TARGET binding site such as BINDING SITE I, BINDING SITE II or BINDING SITE III. Table 2 illustrates the complementarity of the nucleotide sequences of NIR3 BINDING SITE, designated SEQ ID:32928, to the nucleotide sequence of VGAM2286 RNA, herein designated VGAM RNA, also designated SEQ ID:4997.

Another function of VGAM2286 is therefore inhibition of NIR3 (Accession XM_038799). Accordingly, utilities of VGAM2286 include diagnosis, prevention and treatment of diseases and clinical conditions associated with NIR3. LOC92492 (Accession XM_045396) is another VGAM2286 host target gene. LOC92492 BINDING SITE is HOST TARGET binding site found in the 5' untranslated region of mRNA encoded by LOC92492, corresponding to a HOST TARGET binding site such as BINDING SITE I, BINDING SITE II or BINDING SITE III. Table 2 illustrates the complementarity of the nucleotide sequences of LOC92492 BINDING SITE, designated SEQ ID:34452, to the nucleotide sequence of VGAM2286 RNA, herein designated VGAM RNA, also designated SEQ ID:4997.

Another function of VGAM2286 is therefore inhibition of LOC92492 (Accession XM_045396). Accordingly, utilities of VGAM2286 include diagnosis, prevention and treatment of diseases and clinical conditions associated with LOC92492. FIG. 1 further provides a conceptual description of a novel bioinformatically detected viral gene of the present invention, referred to here as Viral Genomic Address Messenger 2287 (VGAM2287) viral gene, which modulates expression of respective host target genes thereof, the function and utility of which host target genes is known in the art.

VGAM2287 is a novel bioinformatically detected regulatory, non protein coding, viral micro RNA (miRNA) gene. The method by which VGAM2287 was detected is described hereinabove with reference to FIGS. 1-8.

VGAM2287 gene, herein designated VGAM GENE, is a viral gene contained in the genome of Murine Hepatitis Virus. VGAM2287 host target gene, herein designated VGAM HOST TARGET GENE, is a human gene contained in the human genome.

VGAM2287 gene encodes a VGAM2287 precursor RNA, herein designated VGAM PRECURSOR RNA. Similar to other miRNA genes, and unlike most ordinary genes, VGAM2287 precursor RNA does not encode a protein. A nucleotide sequence identical or highly similar to the nucleotide sequence of VGAM2287 precursor RNA is designated SEQ ID:2273, and is provided hereinbelow with reference to the sequence listing part. Nucleotide sequence SEQ ID:2273 is located at position 3614 relative to the genome of Murine Hepatitis Virus.

VGAM2287 precursor RNA folds onto itself, forming VGAM2287 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2287 folded precursor RNA into VGAM2287 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2287 RNA is designated SEQ ID:4998, and is provided hereinbelow with reference to the sequence listing part.

VGAM2287 host target gene, herein designated VGAM HOST TARGET GENE, encodes a corresponding messenger RNA, VGAM2287 host target RNA, herein designated VGAM HOST TARGET RNA. VGAM2287 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2287 RNA, herein designated VGAM RNA, binds complementarily to one or more host target binding sites located in untranslated regions of VGAM2287 host target RNA, herein designated VGAM HOST TARGET RNA. This complementary binding is due to the fact that the nucleotide sequence of VGAM2287 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2287 RNA, herein designated VGAM RNA, may have a different number of host target binding sites in untranslated regions of a VGAM2287 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2287 RNA, herein designated VGAM RNA, to host target binding sites on VGAM2287 host target RNA, herein designated VGAM HOST TARGET RNA, such as BINDING SITE I, BINDING SITE II and BINDING SITE III, inhibits translation of VGAM2287 host target RNA into VGAM2287 host target protein, herein designated VGAM HOST TARGET PROTEIN. VGAM host target protein is therefore outlined by a broken line.

It is appreciated that VGAM2287 host target gene, herein designated VGAM HOST TARGET GENE, in fact represents a plurality of VGAM2287 host target genes. The mRNA of each one of this plurality of VGAM2287 host target genes comprises one or more host target binding sites, each having a nucleotide sequence which is at least partly complementary to VGAM2287 RNA, herein designated VGAM RNA, and which when bound by VGAM2287 RNA causes inhibition of translation of respective one or more VGAM2287 host target proteins.

It is further appreciated by one skilled in the art that the mode of translational inhibition illustrated by FIG. 1 with specific reference to translational inhibition exerted by VGAM2287 gene, herein designated VGAM GENE, on one or more VGAM2287 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2287 is inhibition of expression of host target genes, as part of a novel viral mechanism of attacking a host. Accordingly, utilities of VGAM2287 include diagnosis, prevention and treatment of viral infection by Murine Hepatitis Virus. Specific functions, and accordingly utilities, of VGAM2287 correlate with, and may be deduced from, the identity of the host target genes which VGAM2287 binds and inhibits, and the function of these host target genes, as elaborated hereinbelow.

Nucleotide sequences of the VGAM2287 precursor RNA, herein designated VGAM PRECURSOR RNA, and of the 'diced' VGAM2287 RNA, herein designated VGAM RNA, and a schematic representation of the secondary folding of VGAM2287 folded precursor RNA, herein designated VGAM FOLDED PRECURSOR RNA, of VGAM2287 are further described hereinbelow with reference to Table 1.

Nucleotide sequences of host target binding sites, such as BINDING SITE-I, BINDING SITE-II and BINDING SITE-III of FIG. 1, found on VGAM2287 host target RNA, and schematic representation of the complementarity of each of these host target binding sites to VGAM2287 RNA, herein designated VGAM RNA, are described hereinbelow with reference to Table 2.

As mentioned hereinabove with reference to FIG. 1, a function of VGAM2287 gene, herein designated VGAM is inhibition of expression of VGAM2287 target genes. It is appreciated that specific functions, and accordingly utilities, of VGAM2287 correlate with, and may be deduced from, the identity of the target genes which VGAM2287 binds and inhibits, and the function of these target genes, as elaborated hereinbelow.

FLJ13646 (Accession NM_024584) is a VGAM2287 host target gene. FLJ13646 BINDING SITE is HOST TARGET binding site found in the 3' untranslated region of mRNA encoded by FLJ13646, corresponding to a HOST TARGET binding site such as BINDING SITE I, BINDING SITE II or BINDING SITE III. Table 2 illustrates the complementarity of the nucleotide sequences of FLJ13646 BINDING SITE, designated SEQ ID:23811, to the nucleotide sequence of VGAM2287 RNA, herein designated VGAM RNA, also designated SEQ ID:4998.

A function of VGAM2287 is therefore inhibition of FLJ13646 (Accession NM_024584). Accordingly, utilities of VGAM2287 include diagnosis, prevention and treatment of diseases and clinical conditions associated with FLJ13646. KIAA1937 (Accession XM_057107) is another VGAM2287 host target gene. KIAA1937 BINDING SITE is HOST TARGET binding site found in the 3' untranslated region of mRNA encoded by KIAA1937, corresponding to a HOST TARGET binding site such as BINDING SITE I, BINDING SITE II or BINDING SITE III. Table 2 illustrates the complementarity of the nucleotide sequences of KIAA1937 BINDING SITE, designated SEQ ID:36482, to the nucleotide sequence of VGAM2287 RNA, herein designated VGAM RNA, also designated SEQ ID:4998.

Another function of VGAM2287 is therefore inhibition of KIAA1937 (Accession XM_057107). Accordingly, utilities of VGAM2287 include diagnosis, prevention and treatment of diseases and clinical conditions associated with KIAA1937. Neuronal Guanine Nucleotide Exchange Factor (NGEF, Accession XM_044799) is another VGAM2287 host target gene. NGEF BINDING SITE is HOST TARGET binding site found in the 3' untranslated region of mRNA encoded by NGEF, corresponding to a HOST TARGET binding site such as BINDING SITE I, BINDING SITE II or BINDING SITE III. Table 2 illustrates the complementarity of the nucleotide sequences of NGEF BINDING SITE, designated SEQ ID:34275, to the nucleotide sequence of VGAM2287 RNA, herein designated VGAM RNA, also designated SEQ ID:4998.

Another function of VGAM2287 is therefore inhibition of Neuronal Guanine Nucleotide Exchange Factor (NGEF, Accession XM_044799). Accordingly, utilities of VGAM2287 include diagnosis, prevention and treatment of diseases and clinical conditions associated with NGEF. LOC152765 (Accession XM_087519) is another VGAM2287 host target gene. LOC152765 BINDING SITE is HOST TARGET binding site found in the 3' untranslated region of mRNA encoded by LOC152765, corresponding to a HOST TARGET binding site such as BINDING SITE I, BINDING SITE II or BINDING SITE III. Table 2 illustrates the complementarity of the nucleotide sequences of LOC152765 BINDING SITE, designated SEQ ID:39318, to the nucleotide sequence of VGAM2287 RNA, herein designated VGAM RNA, also designated SEQ ID:4998.

Another function of VGAM2287 is therefore inhibition of LOC152765 (Accession XM_087519). Accordingly, utilities of VGAM2287 include diagnosis, prevention and treatment of diseases and clinical conditions associated with LOC152765. LOC255045 (Accession XM_171243) is another VGAM2287 host target gene. LOC255045 BINDING SITE is HOST TARGET binding site found in the 3' untranslated region of mRNA encoded by LOC255045, corresponding to a HOST TARGET binding site such as BINDING SITE I, BINDING SITE II or BINDING SITE III. Table 2 illustrates the complementarity of the nucleotide sequences of LOC255045 BINDING SITE, designated SEQ ID:46030, to the nucleotide sequence of VGAM2287 RNA, herein designated VGAM RNA, also designated SEQ ID:4998.

Another function of VGAM2287 is therefore inhibition of LOC255045 (Accession XM_171243). Accordingly, utilities of VGAM2287 include diagnosis, prevention and treatment of diseases and clinical conditions associated with LOC255045. FIG. 1 further provides a conceptual description of a novel bioinformatically detected viral gene of the present invention, referred to here as Viral Genomic Address Messenger 2288 (VGAM2288) viral gene, which modulates expression of respective host target genes thereof, the function and utility of which host target genes is known in the art.

VGAM2288 is a novel bioinformatically detected regulatory, non protein coding, viral micro RNA (miRNA) gene.

The method by which VGAM2288 was detected is described hereinabove with reference to FIGS. 1-8.

VGAM2288 gene, herein designated VGAM GENE, is a viral gene contained in the genome of Murine Hepatitis Virus. VGAM2288 host target gene, herein designated VGAM HOST TARGET GENE, is a human gene contained in the human genome.

VGAM2288 gene encodes a VGAM2288 precursor RNA, herein designated VGAM PRECURSOR RNA. Similar to other miRNA genes, and unlike most ordinary genes, VGAM2288 precursor RNA does not encode a protein. A nucleotide sequence identical or highly similar to the nucleotide sequence of VGAM2288 precursor RNA is designated SEQ ID:2274, and is provided hereinbelow with reference to the sequence listing part. Nucleotide sequence SEQ ID:2274 is located at position 23052 relative to the genome of Murine Hepatitis Virus.

VGAM2288 precursor RNA folds onto itself, forming VGAM2288 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2288 folded precursor RNA into VGAM2288 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2288 RNA is designated SEQ ID:4999, and is provided hereinbelow with reference to the sequence listing part.

VGAM2288 host target gene, herein designated VGAM HOST TARGET GENE, encodes a corresponding messenger RNA, VGAM2288 host target RNA, herein designated VGAM HOST TARGET RNA. VGAM2288 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2288 RNA, herein designated VGAM RNA, binds complementarily to one or more host target binding sites located in untranslated regions of VGAM2288 host target RNA, herein designated VGAM HOST TARGET RNA. This complementary binding is due to the fact that the nucleotide sequence of VGAM2288 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2288 RNA, herein designated VGAM RNA, may have a different number of host target binding sites in untranslated regions of a VGAM2288 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2288 RNA, herein designated VGAM RNA, to host target binding sites on VGAM2288 host target RNA, herein designated VGAM HOST TARGET RNA, such as BINDING SITE I, BINDING SITE II and BINDING SITE III, inhibits translation of VGAM2288 host target RNA into VGAM2288 host target protein, herein designated VGAM HOST TARGET PROTEIN. VGAM host target protein is therefore outlined by a broken line.

It is appreciated that VGAM2288 host target gene, herein designated VGAM HOST TARGET GENE, in fact represents a plurality of VGAM2288 host target genes. The mRNA of each one of this plurality of VGAM2288 host target genes comprises one or more host target binding sites, each having a nucleotide sequence which is at least partly complementary to VGAM2288 RNA, herein designated VGAM RNA, and which when bound by VGAM2288 RNA causes inhibition of translation of respective one or more VGAM2288 host target proteins.

It is further appreciated by one skilled in the art that the mode of translational inhibition illustrated by FIG. 1 with specific reference to translational inhibition exerted by VGAM2288 gene, herein designated VGAM GENE, on one or more VGAM2288 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2288 is inhibition of expression of host target genes, as part of a novel viral mechanism of attacking a host. Accordingly, utilities of VGAM2288 include diagnosis, prevention and treatment of viral infection by Murine Hepatitis Virus. Specific functions, and accordingly utilities, of VGAM2288 correlate with, and may be deduced from, the identity of the host target genes which VGAM2288 binds and inhibits, and the function of these host target genes, as elaborated hereinbelow.

Nucleotide sequences of the VGAM2288 precursor RNA, herein designated VGAM PRECURSOR RNA, and of the 'diced' VGAM2288 RNA, herein designated VGAM RNA, and a schematic representation of the secondary folding of VGAM2288 folded precursor RNA, herein designated VGAM FOLDED PRECURSOR RNA, of VGAM2288 are further described hereinbelow with reference to Table 1.

Nucleotide sequences of host target binding sites, such as BINDING SITE-I, BINDING SITE-II and BINDING SITE-III of FIG. 1, found on VGAM2288 host target RNA, and schematic representation of the complementarity of each of these host target binding sites to VGAM2288 RNA, herein designated VGAM RNA, are described hereinbelow with reference to Table 2.

As mentioned hereinabove with reference to FIG. 1, a function of VGAM2288 gene, herein designated VGAM is inhibition of expression of VGAM2288 target genes. It is appreciated that specific functions, and accordingly utilities, of VGAM2288 correlate with, and may be deduced from, the identity of the target genes which VGAM2288 binds and inhibits, and the function of these target genes, as elaborated hereinbelow.

ATPase, Na+/K+ Transporting, Alpha 2 (+) Polypeptide (ATP1A2, Accession NM_000702) is a VGAM2288 host target gene. ATP1A2 BINDING SITE is HOST TARGET binding site found in the 3' untranslated region of mRNA encoded by ATP1A2, corresponding to a HOST TARGET binding site such as BINDING SITE I, BINDING SITE II or BINDING SITE III. Table 2 illustrates the complementarity of the nucleotide sequences of ATP1A2 BINDING SITE, designated SEQ ID:6370, to the nucleotide sequence of VGAM2288 RNA, herein designated VGAM RNA, also designated SEQ ID:4999.

A function of VGAM2288 is therefore inhibition of ATPase, Na+/K+ Transporting, Alpha 2 (+) Polypeptide (ATP1A2, Accession NM_000702). Accordingly, utilities of VGAM2288 include diagnosis, prevention and treatment of diseases and clinical conditions associated with ATP1A2. HCA4 (Accession XM_085287) is another VGAM2288 host target gene. HCA4 BINDING SITE is HOST TARGET binding site found in the 3' untranslated region of mRNA encoded by HCA4, corresponding to a HOST TARGET binding site such as BINDING SITE I, BINDING SITE II or BINDING SITE III. Table 2 illustrates the complementarity of the nucleotide sequences of HCA4 BINDING SITE, designated SEQ ID:38027, to the nucleotide sequence of VGAM2288 RNA, herein designated VGAM RNA, also designated SEQ ID:4999.

Another function of VGAM2288 is therefore inhibition of HCA4 (Accession XM_085287). Accordingly, utilities of VGAM2288 include diagnosis, prevention and treatment of diseases and clinical conditions associated with HCA4. KIAA0247 (Accession NM_014734) is another VGAM2288 host target gene. KIAA0247 BINDING SITE is HOST TARGET binding site found in the 3' untranslated region of mRNA encoded by KIAA0247, corresponding to a HOST TARGET binding site such as BINDING SITE I, BINDING SITE II or BINDING SITE III. Table 2 illustrates the complementarity of the nucleotide sequences of KIAA0247 BINDING SITE, designated SEQ ID:16379, to the nucleotide sequence of VGAM2288 RNA, herein designated VGAM RNA, also designated SEQ ID:4999.

Another function of VGAM2288 is therefore inhibition of KIAA0247 (Accession NM_014734). Accordingly, utilities of VGAM2288 include diagnosis, prevention and treatment of diseases and clinical conditions associated with KIAA0247. KIAA0319 (Accession NM_014809) is another VGAM2288 host target gene. KIAA0319 BINDING SITE is HOST TARGET binding site found in the 3' untranslated region of mRNA encoded by KIAA0319, corresponding to a HOST TARGET binding site such as BINDING SITE I, BINDING SITE II or BINDING SITE III. Table 2 illustrates the complementarity of the nucleotide sequences of KIAA0319 BINDING SITE, designated SEQ ID:16760, to the nucleotide sequence of VGAM2288 RNA, herein designated VGAM RNA, also designated SEQ ID:4999.

Another function of VGAM2288 is therefore inhibition of KIAA0319 (Accession NM_014809). Accordingly, utilities of VGAM2288 include diagnosis, prevention and treatment of diseases and clinical conditions associated with KIAA0319. KIAA0794 (Accession XM_087353) is another VGAM2288 host target gene. KIAA0794 BINDING SITE is HOST TARGET binding site found in the 3' untranslated region of mRNA encoded by KIAA0794, corresponding to a HOST TARGET binding site such as BINDING SITE I, BINDING SITE II or BINDING SITE III. Table 2 illustrates the complementarity of the nucleotide sequences of KIAA0794 BINDING SITE, designated SEQ ID:39185, to the nucleotide sequence of VGAM2288 RNA, herein designated VGAM RNA, also designated SEQ ID:4999.

Another function of VGAM2288 is therefore inhibition of KIAA0794 (Accession XM_087353). Accordingly, utilities of VGAM2288 include diagnosis, prevention and treatment of diseases and clinical conditions associated with KIAA0794. LOC153810 (Accession XM_087778) is another VGAM2288 host target gene. LOC153810 BINDING SITE is HOST TARGET binding site found in the 3' untranslated region of mRNA encoded by LOC153810, corresponding to a HOST TARGET binding site such as BINDING SITE I, BINDING SITE II or BINDING SITE III. Table 2 illustrates the complementarity of the nucleotide sequences of LOC153810 BINDING SITE, designated SEQ ID:39411, to the nucleotide sequence of VGAM2288 RNA, herein designated VGAM RNA, also designated SEQ ID:4999.

Another function of VGAM2288 is therefore inhibition of LOC153810 (Accession XM_087778). Accordingly, utilities of VGAM2288 include diagnosis, prevention and treatment of diseases and clinical conditions associated with LOC153810. LOC253272 (Accession XM_170906) is another VGAM2288 host target gene. LOC253272 BINDING SITE is HOST TARGET binding site found in the 5' untranslated region of mRNA encoded by LOC253272, corresponding to a HOST TARGET binding site such as BINDING SITE I, BINDING SITE II or BINDING SITE III. Table 2 illustrates the complementarity of the nucleotide sequences of LOC253272 BINDING SITE, designated SEQ ID:45664, to the nucleotide sequence of VGAM2288 RNA, herein designated VGAM RNA, also designated SEQ ID:4999.

Another function of VGAM2288 is therefore inhibition of LOC253272 (Accession XM_170906). Accordingly, utilities of VGAM2288 include diagnosis, prevention and treatment of diseases and clinical conditions associated with LOC253272. LOC90643 (Accession XM_033145) is another VGAM2288 host target gene. LOC90643 BINDING SITE is HOST TARGET binding site found in the 3' untranslated region of mRNA encoded by LOC90643, corresponding to a HOST TARGET binding site such as BINDING SITE I, BINDING SITE II or BINDING SITE III. Table 2 illustrates the complementarity of the nucleotide sequences of LOC90643 BINDING SITE, designated SEQ ID:31855, to the nucleotide sequence of VGAM2288 RNA, herein designated VGAM RNA, also designated SEQ ID:4999.

Another function of VGAM2288 is therefore inhibition of LOC90643 (Accession XM_033145). Accordingly, utilities of VGAM2288 include diagnosis, prevention and treatment of diseases and clinical conditions associated with LOC90643. LOC93206 (Accession XM_049838) is another VGAM2288 host target gene. LOC93206 BINDING SITE is HOST TARGET binding site found in the 3' untranslated region of mRNA encoded by LOC93206, corresponding to a HOST TARGET binding site such as BINDING SITE I, BINDING SITE II or BINDING SITE III. Table 2 illustrates the complementarity of the nucleotide sequences of LOC93206 BINDING SITE, designated SEQ ID:35518, to the nucleotide sequence of VGAM2288 RNA, herein designated VGAM RNA, also designated SEQ ID:4999.

Another function of VGAM2288 is therefore inhibition of LOC93206 (Accession XM_049838). Accordingly, utilities of VGAM2288 include diagnosis, prevention and treatment of diseases and clinical conditions associated with LOC93206. FIG. 1 further provides a conceptual description of a novel bioinformatically detected viral gene of the present invention, referred to here as Viral Genomic Address Messenger 2289 (VGAM2289) viral gene, which modulates expression of respective host target genes thereof, the function and utility of which host target genes is known in the art.

VGAM2289 is a novel bioinformatically detected regulatory, non protein coding, viral micro RNA (miRNA) gene. The method by which VGAM2289 was detected is described hereinabove with reference to FIGS. 1-8.

VGAM2289 gene, herein designated VGAM GENE, is a viral gene contained in the genome of Murine Hepatitis Virus. VGAM2289 host target gene, herein designated VGAM HOST TARGET GENE, is a human gene contained in the human genome.

VGAM2289 gene encodes a VGAM2289 precursor RNA, herein designated VGAM PRECURSOR RNA. Similar to other miRNA genes, and unlike most ordinary genes, VGAM2289 precursor RNA does not encode a protein. A nucleotide sequence identical or highly similar to the nucleotide sequence of VGAM2289 precursor RNA is designated SEQ ID:2275, and is provided hereinbelow with reference to the sequence listing part. Nucleotide sequence SEQ ID:2275 is located at position 12369 relative to the genome of Murine Hepatitis Virus.

VGAM2289 precursor RNA folds onto itself, forming VGAM2289 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2289 folded precursor RNA into VGAM2289 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2289 RNA is designated SEQ ID:5000, and is provided hereinbelow with reference to the sequence listing part.

VGAM2289 host target gene, herein designated VGAM HOST TARGET GENE, encodes a corresponding messenger RNA, VGAM2289 host target RNA, herein designated VGAM HOST TARGET RNA. VGAM2289 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2289 RNA, herein designated VGAM RNA, binds complementarily to one or more host target binding sites located in untranslated regions of VGAM2289 host target RNA, herein designated VGAM HOST TARGET RNA. This complementary binding is due to the fact that the nucleotide sequence of VGAM2289 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2289 RNA, herein designated VGAM RNA, may have a different number of host target binding sites in untranslated regions of a VGAM2289 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2289 RNA, herein designated VGAM RNA, to host target binding sites on VGAM2289 host target RNA, herein designated VGAM HOST TARGET RNA, such as BINDING SITE I, BINDING SITE II and BINDING SITE III, inhibits translation of VGAM2289 host target RNA into VGAM2289 host target protein, herein designated VGAM HOST TARGET PROTEIN. VGAM host target protein is therefore outlined by a broken line.

It is appreciated that VGAM2289 host target gene, herein designated VGAM HOST TARGET GENE, in fact represents a plurality of VGAM2289 host target genes. The mRNA of each one of this plurality of VGAM2289 host target genes comprises one or more host target binding sites, each having a nucleotide sequence which is at least partly complementary to VGAM2289 RNA, herein designated VGAM RNA, and which when bound by VGAM2289 RNA causes inhibition of translation of respective one or more VGAM2289 host target proteins.

It is further appreciated by one skilled in the art that the mode of translational inhibition illustrated by FIG. 1 with specific reference to translational inhibition exerted by VGAM2289 gene, herein designated VGAM GENE, on one or more VGAM2289 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2289 is inhibition of expression of host target genes, as part of a novel viral mechanism of attacking a host. Accordingly, utilities of VGAM2289 include diagnosis, prevention and treatment of viral infection by Murine Hepatitis Virus. Specific functions, and accordingly utilities, of VGAM2289 correlate with, and may be deduced from, the identity of the host target genes which VGAM2289 binds and inhibits, and the function of these host target genes, as elaborated hereinbelow.

Nucleotide sequences of the VGAM2289 precursor RNA, herein designated VGAM PRECURSOR RNA, and of the 'diced' VGAM2289 RNA, herein designated VGAM RNA, and a schematic representation of the secondary folding of VGAM2289 folded precursor RNA, herein designated VGAM FOLDED PRECURSOR RNA, of VGAM2289 are further described hereinbelow with reference to Table 1.

Nucleotide sequences of host target binding sites, such as BINDING SITE-I, BINDING SITE-II and BINDING SITE-III of FIG. 1, found on VGAM2289 host target RNA, and schematic representation of the complementarity of each of these host target binding sites to VGAM2289 RNA, herein designated VGAM RNA, are described hereinbelow with reference to Table 2.

As mentioned hereinabove with reference to FIG. 1, a function of VGAM2289 gene, herein designated VGAM is inhibition of expression of VGAM2289 target genes. It is appreciated that specific functions, and accordingly utilities, of VGAM2289 correlate with, and may be deduced from, the identity of the target genes which VGAM2289 binds and inhibits, and the function of these target genes, as elaborated hereinbelow.

NORE1 (Accession NM_031437) is a VGAM2289 host target gene. NORE1 BINDING SITE is HOST TARGET binding site found in the 3' untranslated region of mRNA encoded by NORE1, corresponding to a HOST TARGET binding site such as BINDING SITE I, BINDING SITE II or BINDING SITE III. Table 2 illustrates the complementarity of the nucleotide sequences of NORE1 BINDING SITE, designated SEQ ID:25445, to the nucleotide sequence of VGAM2289 RNA, herein designated VGAM RNA, also designated SEQ ID:5000.

A function of VGAM2289 is therefore inhibition of NORE1 (Accession NM_031437), a gene which may modulate intracellular signal transduction pathways. Accordingly, utilities of VGAM2289 include diagnosis, prevention and treatment of diseases and clinical conditions associated with NORE1. The function of NORE1 and its association with various diseases and clinical conditions, has been established by previous studies, as described hereinabove with reference to VGAM276. FLJ13117 (Accession NM_023071) is another VGAM2289 host target gene. FLJ13117 BINDING SITE is HOST TARGET binding site found in the 3' untranslated region of mRNA encoded by FLJ13117, corresponding to a HOST TARGET binding site such as BINDING SITE I, BINDING SITE II or BINDING SITE III. Table 2 illustrates the complementarity of the nucleotide sequences of FLJ13117 BINDING SITE, designated SEQ ID:23327, to the nucleotide sequence of VGAM2289 RNA, herein designated VGAM RNA, also designated SEQ ID:5000.

Another function of VGAM2289 is therefore inhibition of FLJ13117 (Accession NM_023071). Accordingly, utilities of VGAM2289 include diagnosis, prevention and treatment of diseases and clinical conditions associated with FLJ13117. KIAA0212 (Accession NM_014674) is another VGAM2289 host target gene. KIAA0212 BINDING SITE is HOST TARGET binding site found in the 3' untranslated region of mRNA encoded by KIAA0212, corresponding to a HOST TARGET binding site such as BINDING SITE I, BINDING SITE II or BINDING SITE III. Table 2 illustrates the complementarity of the nucleotide sequences of KIAA0212 BINDING SITE, designated SEQ ID:16143, to the nucleotide sequence of VGAM2289 RNA, herein designated VGAM RNA, also designated SEQ ID:5000.

Another function of VGAM2289 is therefore inhibition of KIAA0212 (Accession NM_014674). Accordingly, utilities of VGAM2289 include diagnosis, prevention and treatment of diseases and clinical conditions associated with KIAA0212. KIAA0982 (Accession NM_014023) is another VGAM2289 host target gene. KIAA0982 BINDING SITE is HOST TARGET binding site found in the 3' untranslated region of mRNA encoded by KIAA0982, corresponding to a HOST TARGET binding site such as BINDING SITE I, BINDING SITE II or BINDING SITE III. Table 2 illustrates the complementarity of the nucleotide sequences of KIAA0982 BINDING SITE, designated SEQ ID:15248, to the nucleotide sequence of VGAM2289 RNA, herein designated VGAM RNA, also designated SEQ ID:5000.

Another function of VGAM2289 is therefore inhibition of KIAA0982 (Accession NM_014023). Accordingly, utilities of VGAM2289 include diagnosis, prevention and treatment of diseases and clinical conditions associated with KIAA0982. KIAA1164 (Accession XM_045358) is another VGAM2289 host target gene. KIAA1164 BINDING SITE is HOST TARGET binding site found in the 3' untranslated region of mRNA encoded by KIAA1164, corresponding to a HOST TARGET binding site such as BINDING SITE I, BINDING SITE II or BINDING SITE III. Table 2 illustrates the complementarity of the nucleotide sequences of KIAA1164 BINDING SITE, designated SEQ ID:34442, to the nucleotide sequence of VGAM2289 RNA, herein designated VGAM RNA, also designated SEQ ID:5000.

Another function of VGAM2289 is therefore inhibition of KIAA1164 (Accession XM_045358). Accordingly, utilities of VGAM2289 include diagnosis, prevention and treatment of diseases and clinical conditions associated with KIAA1164. MGC13090 (Accession NM_032711) is another VGAM2289 host target gene. MGC13090 BINDING SITE is HOST TARGET binding site found in the 3' untranslated region of mRNA encoded by MGC13090, corresponding to a HOST TARGET binding site such as BINDING SITE I, BINDING SITE II or BINDING SITE III. Table 2 illustrates the complementarity of the nucleotide sequences of MGC13090 BINDING SITE, designated SEQ ID:26428, to the nucleotide sequence of VGAM2289 RNA, herein designated VGAM RNA, also designated SEQ ID:5000.

Another function of VGAM2289 is therefore inhibition of MGC13090 (Accession NM_032711). Accordingly, utilities of VGAM2289 include diagnosis, prevention and treatment of diseases and clinical conditions associated with MGC13090. Oxysterol Binding Protein-like 8 (OSBPL8, Accession NM_020841) is another VGAM2289 host target gene. OSBPL8 BINDING SITE is HOST TARGET binding site found in the 3' untranslated region of mRNA encoded by OSBPL8, corresponding to a HOST TARGET binding site such as BINDING SITE I, BINDING SITE II or BINDING SITE III. Table 2 illustrates the complementarity of the nucleotide sequences of OSBPL8 BINDING SITE, designated SEQ ID:21906, to the nucleotide sequence of VGAM2289 RNA, herein designated VGAM RNA, also designated SEQ ID:5000.

Another function of VGAM2289 is therefore inhibition of Oxysterol Binding Protein-like 8 (OSBPL8, Accession NM_020841). Accordingly, utilities of VGAM2289 include diagnosis, prevention and treatment of diseases and clinical conditions associated with OSBPL8. PTK6 Protein Tyrosine Kinase 6 (PTK6, Accession NM_005975) is another VGAM2289 host target gene. PTK6 BINDING SITE is HOST TARGET binding site found in the 3' untranslated region of mRNA encoded by PTK6, corresponding to a HOST TARGET binding site such as BINDING SITE I, BINDING SITE II or BINDING SITE III. Table 2 illustrates the complementarity of the nucleotide sequences of PTK6 BINDING SITE, designated SEQ ID:12601, to the nucleotide sequence of VGAM2289 RNA, herein designated VGAM RNA, also designated SEQ ID:5000.

Another function of VGAM2289 is therefore inhibition of PTK6 Protein Tyrosine Kinase 6 (PTK6, Accession NM_005975). Accordingly, utilities of VGAM2289 include diagnosis, prevention and treatment of diseases and clinical conditions associated with PTK6. SB52 (Accession NM_138335) is another VGAM2289 host target gene. SB52 BINDING SITE is HOST TARGET binding site found in the 3' untranslated region of mRNA encoded by SB52, corresponding to a HOST TARGET binding site such as BINDING SITE I, BINDING SITE II or BINDING SITE III. Table 2 illustrates the complementarity of the nucleotide sequences of SB52 BINDING SITE, designated SEQ ID:28734, to the nucleotide sequence of VGAM2289 RNA, herein designated VGAM RNA, also designated SEQ ID:5000.

Another function of VGAM2289 is therefore inhibition of SB52 (Accession NM_138335). Accordingly, utilities of VGAM2289 include diagnosis, prevention and treatment of diseases and clinical conditions associated with SB52. Solute Carrier Family 5 (choline transporter), Member 7 (SLC5A7, Accession NM_021815) is another VGAM2289 host target gene. SLC5A7 BINDING SITE is HOST TARGET binding site found in the 3' untranslated region of mRNA encoded by SLC5A7, corresponding to a HOST TARGET binding site such as BINDING SITE I, BINDING SITE II or BINDING SITE III. Table 2 illustrates the complementarity of the nucleotide sequences of SLC5A7 BINDING SITE, designated SEQ ID:22393, to the nucleotide sequence of VGAM2289 RNA, herein designated VGAM RNA, also designated SEQ ID:5000.

Another function of VGAM2289 is therefore inhibition of Solute Carrier Family 5 (choline transporter), Member 7 (SLC5A7, Accession NM_021815). Accordingly, utilities of VGAM2289 include diagnosis, prevention and treatment of diseases and clinical conditions associated with SLC5A7.

FIG. 1 further provides a conceptual description of a novel bioinformatically detected viral gene of the present invention, referred to here as Viral Genomic Address Messenger 2290 (VGAM2290) viral gene, which modulates expression of respective host target genes thereof, the function and utility of which host target genes is known in the art.

VGAM2290 is a novel bioinformatically detected regulatory, non protein coding, viral micro RNA (miRNA) gene. The method by which VGAM2290 was detected is described hereinabove with reference to FIGS. 1-8.

VGAM2290 gene, herein designated VGAM GENE, is a viral gene contained in the genome of Murine Hepatitis Virus. VGAM2290 host target gene, herein designated VGAM HOST TARGET GENE, is a human gene contained in the human genome.

VGAM2290 gene encodes a VGAM2290 precursor RNA, herein designated VGAM PRECURSOR RNA. Similar to other miRNA genes, and unlike most ordinary genes, VGAM2290 precursor RNA does not encode a protein. A nucleotide sequence identical or highly similar to the nucleotide sequence of VGAM2290 precursor RNA is designated SEQ ID:2276, and is provided hereinbelow with reference to the sequence listing part. Nucleotide sequence SEQ ID:2276 is located at position 16166 relative to the genome of Murine Hepatitis Virus.

VGAM2290 precursor RNA folds onto itself, forming VGAM2290 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2290 folded precursor RNA into VGAM2290 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2290 RNA is designated SEQ ID:5001, and is provided hereinbelow with reference to the sequence listing part.

VGAM2290 host target gene, herein designated VGAM HOST TARGET GENE, encodes a corresponding messenger RNA, VGAM2290 host target RNA, herein designated VGAM HOST TARGET RNA. VGAM2290 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2290 RNA, herein designated VGAM RNA, binds complementarily to one or more host target binding sites located in untranslated regions of VGAM2290 host target RNA, herein designated VGAM HOST TARGET RNA. This complementary binding is due to the fact that the nucleotide sequence of VGAM2290 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2290 RNA, herein designated VGAM RNA, may have a different number of host target binding sites in untranslated regions of a VGAM2290 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2290 RNA, herein designated VGAM RNA, to host target binding sites on VGAM2290 host target RNA, herein designated VGAM HOST TARGET RNA, such as BINDING SITE I, BINDING SITE II and BINDING SITE III, inhibits translation of VGAM2290 host target RNA into VGAM2290 host target protein, herein designated VGAM HOST TARGET PROTEIN. VGAM host target protein is therefore outlined by a broken line.

It is appreciated that VGAM2290 host target gene, herein designated VGAM HOST TARGET GENE, in fact represents a plurality of VGAM2290 host target genes. The mRNA of each one of this plurality of VGAM2290 host target genes comprises one or more host target binding sites, each having a nucleotide sequence which is at least partly complementary to VGAM2290 RNA, herein designated VGAM RNA, and which when bound by VGAM2290 RNA causes inhibition of translation of respective one or more VGAM2290 host target proteins.

It is further appreciated by one skilled in the art that the mode of translational inhibition illustrated by FIG. 1 with specific reference to translational inhibition exerted by VGAM2290 gene, herein designated VGAM GENE, on one or more VGAM2290 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2290 is inhibition of expression of host target genes, as part of a novel viral mechanism of attacking a host. Accordingly, utilities of VGAM2290 include diagnosis, prevention and treatment of viral infection by Murine Hepatitis Virus. Specific functions, and accordingly utilities, of VGAM2290 correlate with, and may be deduced from, the identity of the host target genes which VGAM2290 binds and inhibits, and the function of these host target genes, as elaborated hereinbelow.

Nucleotide sequences of the VGAM2290 precursor RNA, herein designated VGAM PRECURSOR RNA, and of the 'diced' VGAM2290 RNA, herein designated VGAM RNA, and a schematic representation of the secondary folding of VGAM2290 folded precursor RNA, herein designated VGAM FOLDED PRECURSOR RNA, of VGAM2290 are further described hereinbelow with reference to Table 1.

Nucleotide sequences of host target binding sites, such as BINDING SITE-I, BINDING SITE-II and BINDING SITE-III of FIG. 1, found on VGAM2290 host target RNA, and schematic representation of the complementarity of each of these host target binding sites to VGAM2290 RNA, herein designated VGAM RNA, are described hereinbelow with reference to Table 2.

As mentioned hereinabove with reference to FIG. 1, a function of VGAM2290 gene, herein designated VGAM is inhibition of expression of VGAM2290 target genes. It is appreciated that specific functions, and accordingly utilities, of VGAM2290 correlate with, and may be deduced from, the identity of the target genes which VGAM2290 binds and inhibits, and the function of these target genes, as elaborated hereinbelow.

FLJ13912 (Accession NM_022770) is a VGAM2290 host target gene. FLJ13912 BINDING SITE is HOST TARGET binding site found in the 3' untranslated region of mRNA encoded by FLJ13912, corresponding to a HOST TARGET binding site such as BINDING SITE I, BINDING SITE II or BINDING SITE III. Table 2 illustrates the complementarity of the nucleotide sequences of FLJ13912 BINDING SITE, designated SEQ ID:23030, to the nucleotide sequence of VGAM2290 RNA, herein designated VGAM RNA, also designated SEQ ID:5001.

A function of VGAM2290 is therefore inhibition of FLJ13912 (Accession NM_022770). Accordingly, utilities of VGAM2290 include diagnosis, prevention and treatment of diseases and clinical conditions associated with FLJ13912. Junctional Adhesion Molecule 1 (JAM1, Accession NM_144503) is another VGAM2290 host target gene. JAM1 BINDING SITE1 and JAM1 BINDING SITE2 are HOST TARGET binding sites found in untranslated regions of mRNA encoded by JAM1, corresponding to HOST TARGET binding sites such as BINDING SITE I, BINDING SITE II or BINDING SITE III. Table 2 illustrates the complementarity of the nucleotide sequences of JAM1 BINDING SITE1 and JAM1 BINDING SITE2, designated SEQ ID:29338 and SEQ ID:29349 respectively, to the nucleotide sequence of VGAM2290 RNA, herein designated VGAM RNA, also designated SEQ ID:5001.

Another function of VGAM2290 is therefore inhibition of Junctional Adhesion Molecule 1 (JAM1, Accession NM_144503). Accordingly, utilities of VGAM2290 include diagnosis, prevention and treatment of diseases and clinical conditions associated with JAM1. Mitogen-activated Protein Kinase 8 Interacting Protein 3 (MAPK8IP3, Accession NM_033392) is another VGAM2290 host target gene. MAPK8IP3 BINDING SITE is HOST TARGET binding site found in the 3' untranslated region of mRNA encoded by MAPK8IP3, corresponding to a HOST TARGET binding site such as BINDING SITE I, BINDING SITE II or BINDING SITE III. Table 2 illustrates the complementarity of the nucleotide sequences of MAPK8IP3 BINDING SITE, designated SEQ ID:27219, to the nucleotide sequence of VGAM2290 RNA, herein designated VGAM RNA, also designated SEQ ID:5001.

Another function of VGAM2290 is therefore inhibition of Mitogen-activated Protein Kinase 8 Interacting Protein 3 (MAPK8IP3, Accession NM_033392). Accordingly, utilities of VGAM2290 include diagnosis, prevention and treatment of diseases and clinical conditions associated with MAPK8IP3. Olfactory Receptor, Family 2, Subfamily C, Member 3 (OR2C3, Accession XM_060575) is another VGAM2290 host target gene. OR2C3 BINDING SITE is HOST TARGET binding site found in the 5' untranslated region of mRNA encoded by OR2C3, corresponding to a HOST TARGET binding site such as BINDING SITE I, BINDING SITE II or BINDING SITE III. Table 2 illustrates the complementarity of the nucleotide sequences of OR2C3 BINDING SITE, designated SEQ ID:37178, to the nucleotide sequence of VGAM2290 RNA, herein designated VGAM RNA, also designated SEQ ID:5001.

Another function of VGAM2290 is therefore inhibition of Olfactory Receptor, Family 2, Subfamily C, Member 3 (OR2C3, Accession XM_060575). Accordingly, utilities of VGAM2290 include diagnosis, prevention and treatment of diseases and clinical conditions associated with OR2C3. Protein Phosphatase 1, Regulatory Subunit 10 (PPP1R10, Accession NM_002714) is another VGAM2290 host target gene. PPP1R10 BINDING SITE is HOST TARGET binding site found in the 3' untranslated region of mRNA encoded by PPP1R10, corresponding to a HOST TARGET binding site such as BINDING SITE I, BINDING SITE II or BINDING SITE III. Table 2 illustrates the complementarity of the nucleotide sequences of PPP1R10 BINDING SITE, designated SEQ ID:8576, to the nucleotide sequence of VGAM2290 RNA, herein designated VGAM RNA, also designated SEQ ID:5001.

Another function of VGAM2290 is therefore inhibition of Protein Phosphatase 1, Regulatory Subunit 10 (PPP1R10, Accession NM_002714). Accordingly, utilities of VGAM2290 include diagnosis, prevention and treatment of diseases and clinical conditions associated with PPP1R10.

FIG. 1 further provides a conceptual description of a novel bioinformatically detected viral gene of the present invention, referred to here as Viral Genomic Address Messenger 2291 (VGAM2291) viral gene, which modulates expression of respective host target genes thereof, the function and utility of which host target genes is known in the art.

VGAM2291 is a novel bioinformatically detected regulatory, non protein coding, viral micro RNA (miRNA) gene. The method by which VGAM2291 was detected is described hereinabove with reference to FIGS. 1-8.

VGAM2291 gene, herein designated VGAM GENE, is a viral gene contained in the genome of Murine Hepatitis Virus. VGAM2291 host target gene, herein designated VGAM HOST TARGET GENE, is a human gene contained in the human genome.

VGAM2291 gene encodes a VGAM2291 precursor RNA, herein designated VGAM PRECURSOR RNA. Similar to other miRNA genes, and unlike most ordinary genes, VGAM2291 precursor RNA does not encode a protein. A nucleotide sequence identical or highly similar to the nucleotide sequence of VGAM2291 precursor RNA is designated SEQ ID:2277, and is provided hereinbelow with reference to the sequence listing part. Nucleotide sequence SEQ ID:2277 is located at position 15049 relative to the genome of Murine Hepatitis Virus.

VGAM2291 precursor RNA folds onto itself, forming VGAM2291 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2291 folded precursor RNA into VGAM2291 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2291 RNA is designated SEQ ID:5002, and is provided hereinbelow with reference to the sequence listing part.

VGAM2291 host target gene, herein designated VGAM HOST TARGET GENE, encodes a corresponding messenger RNA, VGAM2291 host target RNA, herein designated VGAM HOST TARGET RNA. VGAM2291 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2291 RNA, herein designated VGAM RNA, binds complementarily to one or more host target binding sites located in untranslated regions of VGAM2291 host target RNA, herein designated VGAM HOST TARGET RNA. This complementary binding is due to the fact that the nucleotide sequence of VGAM2291 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2291 RNA, herein designated VGAM RNA, may have a different number of host target binding sites in untranslated regions of a VGAM2291 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2291 RNA, herein designated VGAM RNA, to host target binding sites on VGAM2291 host target RNA, herein designated VGAM HOST TARGET RNA, such as BINDING SITE I, BINDING SITE II and BINDING SITE III, inhibits translation of VGAM2291 host target RNA into VGAM2291 host target protein, herein designated VGAM HOST TARGET PROTEIN. VGAM host target protein is therefore outlined by a broken line.

It is appreciated that VGAM2291 host target gene, herein designated VGAM HOST TARGET GENE, in fact represents a plurality of VGAM2291 host target genes. The mRNA of each one of this plurality of VGAM2291 host target genes comprises one or more host target binding sites, each having a nucleotide sequence which is at least partly complementary to VGAM2291 RNA, herein designated VGAM RNA, and which when bound by VGAM2291 RNA causes inhibition of translation of respective one or more VGAM2291 host target proteins.

It is further appreciated by one skilled in the art that the mode of translational inhibition illustrated by FIG. 1 with specific reference to translational inhibition exerted by VGAM2291 gene, herein designated VGAM GENE, on one or more VGAM2291 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2291 is inhibition of expression of host target genes, as part of a novel viral mechanism of attacking a host. Accordingly, utilities of VGAM2291 include diagnosis, prevention and treatment of viral infection by Murine Hepatitis Virus. Specific functions, and accordingly utilities, of VGAM2291 correlate with, and may be deduced from, the identity of the host target genes which VGAM2291 binds and inhibits, and the function of these host target genes, as elaborated hereinbelow.

Nucleotide sequences of the VGAM2291 precursor RNA, herein designated VGAM PRECURSOR RNA, and of the 'diced' VGAM2291 RNA, herein designated VGAM RNA, and a schematic representation of the secondary folding of VGAM2291 folded precursor RNA, herein designated VGAM FOLDED PRECURSOR RNA, of VGAM2291 are further described hereinbelow with reference to Table 1.

Nucleotide sequences of host target binding sites, such as BINDING SITE-I, BINDING SITE-II and BINDING SITE-III of FIG. 1, found on VGAM2291 host target RNA, and schematic representation of the complementarity of each of these host target binding sites to VGAM2291 RNA, herein designated VGAM RNA, are described hereinbelow with reference to Table 2.

As mentioned hereinabove with reference to FIG. 1, a function of VGAM2291 gene, herein designated VGAM is inhibition of expression of VGAM2291 target genes. It is appreciated that specific functions, and accordingly utilities, of VGAM2291 correlate with, and may be deduced from, the identity of the target genes which VGAM2291 binds and inhibits, and the function of these target genes, as elaborated hereinbelow.

Transient Receptor Potential Cation Channel, Subfamily M, Member 8 (TRPM8, Accession NM_024080) is a VGAM2291 host target gene. TRPM8 BINDING SITE is HOST TARGET binding site found in the 3' untranslated region of mRNA encoded by TRPM8, corresponding to a HOST TARGET binding site such as BINDING SITE I, BINDING SITE II or BINDING SITE III. Table 2 illustrates the complementarity of the nucleotide sequences of TRPM8 BINDING SITE, designated SEQ ID:23515, to the nucleotide sequence of VGAM2291 RNA, herein designated VGAM RNA, also designated SEQ ID:5002.

A function of VGAM2291 is therefore inhibition of Transient Receptor Potential Cation Channel, Subfamily M, Member 8 (TRPM8, Accession NM_024080), a gene which is thought to form a receptor-activated calcium permeant cation channel. Accordingly, utilities of VGAM2291 include diagnosis, prevention and treatment of diseases and clinical conditions associated with TRPM8. The function of TRPM8 and its association with various diseases and clinical conditions, has been established by previous studies, as described hereinabove with reference to VGAM201. Paired Mesoderm Homeobox 2b (PMX2B, Accession NM_003924) is another VGAM2291 host target gene. PMX2B BINDING SITE is HOST TARGET binding site found in the 5' untranslated region of mRNA encoded by PMX2B, corresponding to a HOST TARGET binding site such as BINDING SITE I, BINDING SITE II or BINDING SITE III. Table 2 illustrates the complementarity of the nucleotide sequences of PMX2B BINDING SITE, designated SEQ ID:10015, to the nucleotide sequence of VGAM2291 RNA, herein designated VGAM RNA, also designated SEQ ID:5002.

Another function of VGAM2291 is therefore inhibition of Paired Mesoderm Homeobox 2b (PMX2B, Accession NM_003924). Accordingly, utilities of VGAM2291 include diagnosis, prevention and treatment of diseases and clinical conditions associated with PMX2B. LOC130813 (Accession XM_065904) is another VGAM2291 host target gene. LOC130813 BINDING SITE is HOST TARGET binding site found in the 3' untranslated region of mRNA encoded by LOC130813, corresponding to a HOST TARGET binding site such as BINDING SITE I, BINDING SITE II or BINDING SITE III. Table 2 illustrates the complementarity of the nucleotide sequences of LOC130813 BINDING SITE, designated SEQ ID:37309, to the nucleotide sequence of VGAM2291 RNA, herein designated VGAM RNA, also designated SEQ ID:5002.

Another function of VGAM2291 is therefore inhibition of LOC130813 (Accession XM_065904). Accordingly, utilities of VGAM2291 include diagnosis, prevention and treatment of diseases and clinical conditions associated with LOC130813. LOC135818 (Accession XM_059804) is another VGAM2291 host target gene. LOC135818 BINDING SITE is HOST TARGET binding site found in the 3' untranslated region of mRNA encoded by LOC135818, corresponding to a HOST TARGET binding site such as BINDING SITE I, BINDING SITE II or BINDING SITE III. Table 2 illustrates the complementarity of the nucleotide sequences of LOC135818 BINDING SITE, designated SEQ ID:37092, to the nucleotide sequence of VGAM2291 RNA, herein designated VGAM RNA, also designated SEQ ID:5002.

Another function of VGAM2291 is therefore inhibition of LOC135818 (Accession XM_059804). Accordingly, utilities of VGAM2291 include diagnosis, prevention and treatment of diseases and clinical conditions associated with LOC135818. LOC196528 (Accession XM_113745) is another VGAM2291 host target gene. LOC196528 BINDING SITE is HOST TARGET binding site found in the 3' untranslated region of mRNA encoded by LOC196528, corresponding to a HOST TARGET binding site such as BINDING SITE I, BINDING SITE II or BINDING SITE III. Table 2 illustrates the complementarity of the nucleotide sequences of LOC196528 BINDING SITE, designated SEQ ID:42405, to the nucleotide sequence of VGAM2291 RNA, herein designated VGAM RNA, also designated SEQ ID:5002.

Another function of VGAM2291 is therefore inhibition of LOC196528 (Accession XM_113745). Accordingly, utilities of VGAM2291 include diagnosis, prevention and treatment of diseases and clinical conditions associated with LOC196528. FIG. 1 further provides a conceptual description of a novel bioinformatically detected viral gene of the present invention, referred to here as Viral Genomic Address Messenger 2292 (VGAM2292) viral gene, which modulates expression of respective host target genes thereof, the function and utility of which host target genes is known in the art.

VGAM2292 is a novel bioinformatically detected regulatory, non protein coding, viral micro RNA (miRNA) gene. The method by which VGAM2292 was detected is described hereinabove with reference to FIGS. 1-8.

VGAM2292 gene, herein designated VGAM GENE, is a viral gene contained in the genome of Murine Hepatitis Virus. VGAM2292 host target gene, herein designated VGAM HOST TARGET GENE, is a human gene contained in the human genome.

VGAM2292 gene encodes a VGAM2292 precursor RNA, herein designated VGAM PRECURSOR RNA. Similar to other miRNA genes, and unlike most ordinary genes, VGAM2292 precursor RNA does not encode a protein. A nucleotide sequence identical or highly similar to the nucleotide sequence of VGAM2292 precursor RNA is designated SEQ ID:2278, and is provided hereinbelow with reference to the sequence listing part. Nucleotide sequence SEQ ID:2278 is located at position 5645 relative to the genome of Murine Hepatitis Virus.

VGAM2292 precursor RNA folds onto itself, forming VGAM2292 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2292 folded precursor RNA into VGAM2292 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM2292 RNA is designated SEQ ID:5003, and is provided hereinbelow with reference to the sequence listing part.

VGAM2292 host target gene, herein designated VGAM HOST TARGET GENE, encodes a corresponding messenger RNA, VGAM2292 host target RNA, herein designated VGAM HOST TARGET RNA. VGAM2292 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2292 RNA, herein designated VGAM RNA, binds complementarily to one or more host target binding sites located in untranslated regions of VGAM2292 host target RNA, herein designated VGAM HOST TARGET RNA. This complementary binding is due to the fact that the nucleotide sequence of VGAM2292 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2292 RNA, herein designated VGAM RNA, may have a different number of host target binding sites in untranslated regions of a VGAM2292 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2292 RNA, herein designated VGAM RNA, to host target binding sites on VGAM2292 host target RNA, herein designated VGAM HOST TARGET RNA, such as BINDING SITE I, BINDING SITE II and BINDING SITE III, inhibits translation of VGAM2292 host target RNA into VGAM2292 host target protein, herein designated VGAM HOST TARGET PRO- TEIN. VGAM host target protein is therefore outlined by a broken line.

It is appreciated that VGAM2292 host target gene, herein designated VGAM HOST TARGET GENE, in fact represents a plurality of VGAM2292 host target genes. The mRNA of each one of this plurality of VGAM2292 host target genes comprises one or more host target binding sites, each having a nucleotide sequence which is at least partly complementary to VGAM2292 RNA, herein designated VGAM RNA, and which when bound by VGAM2292 RNA causes inhibition of translation of respective one or more VGAM2292 host target proteins.

It is further appreciated by one skilled in the art that the mode of translational inhibition illustrated by FIG. 1 with specific reference to translational inhibition exerted by VGAM2292 gene, herein designated VGAM GENE, on one or more VGAM2292 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2292 is inhibition of expression of host target genes, as part of a novel viral mechanism of attacking a host. Accordingly, utilities of VGAM2292 include diagnosis, prevention and treatment of viral infection by Murine Hepatitis Virus. Specific functions, and accordingly utilities, of VGAM2292 correlate with, and may be deduced from, the identity of the host target genes which VGAM2292 binds and inhibits, and the function of these host target genes, as elaborated hereinbelow.

Nucleotide sequences of the VGAM2292 precursor RNA, herein designated VGAM PRECURSOR RNA, and of the 'diced' VGAM2292 RNA, herein designated VGAM RNA, and a schematic representation of the secondary folding of VGAM2292 folded precursor RNA, herein designated VGAM FOLDED PRECURSOR RNA, of VGAM2292 are further described hereinbelow with reference to Table 1.

Nucleotide sequences of host target binding sites, such as BINDING SITE-I, BINDING SITE-II and BINDING SITE-III of FIG. 1, found on VGAM2292 host target RNA, and schematic representation of the complementarity of each of these host target binding sites to VGAM2292 RNA, herein designated VGAM RNA, are described hereinbelow with reference to Table 2.

As mentioned hereinabove with reference to FIG. 1, a function of VGAM2292 gene, herein designated VGAM is inhibition of expression of VGAM2292 target genes. It is appreciated that specific functions, and accordingly utilities, of VGAM2292 correlate with, and may be deduced from, the identity of the target genes which VGAM2292 binds and inhibits, and the function of these target genes, as elaborated hereinbelow.

DKFZP564D0478 (Accession NM_032125) is a VGAM2292 host target gene. DKFZP564D0478 BINDING SITE is HOST TARGET binding site found in the 3' untranslated region of mRNA encoded by DKFZP564D0478, corresponding to a HOST TARGET binding site such as BINDING SITE I, BINDING SITE II or BINDING SITE III. Table 2 illustrates the complementarity of the nucleotide sequences of DKFZP564D0478 BINDING SITE, designated SEQ ID:25811, to the nucleotide sequence of VGAM2292 RNA, herein designated VGAM RNA, also designated SEQ ID:5003.

A function of VGAM2292 is therefore inhibition of DKFZP564D0478 (Accession NM_032125). Accordingly, utilities of VGAM2292 include diagnosis, prevention and treatment of diseases and clinical conditions associated with DKFZP564D0478. DKFZP566G1424 (Accession XM_097771) is another VGAM2292 host target gene. DKFZP566G1424 BINDING SITE is HOST TARGET binding site found in the 3' untranslated region of mRNA encoded by DKFZP566G1424, corresponding to a HOST TARGET binding site such as BINDING SITE I, BINDING SITE II or BINDING SITE III. Table 2 illustrates the complementarity of the nucleotide sequences of DKFZP566G1424 BINDING SITE, designated SEQ ID:41118, to the nucleotide sequence of VGAM2292 RNA, herein designated VGAM RNA, also designated SEQ ID:5003.

Another function of VGAM2292 is therefore inhibition of DKFZP566G1424 (Accession XM_097771). Accordingly, utilities of VGAM2292 include diagnosis, prevention and treatment of diseases and clinical conditions associated with DKFZP566G1424. FIG. 1 further provides a conceptual description of a novel bioinformatically detected viral gene of the present invention, referred to here as Viral Genomic Address Messenger 2293 (VGAM2293) viral gene, which modulates expression of respective host target genes thereof, the function and utility of which host target genes is known in the art.

VGAM2293 is a novel bioinformatically detected regulatory, non protein coding, viral micro RNA (miRNA) gene. The method by which VGAM2293 was detected is described hereinabove with reference to FIGS. 1-8.

VGAM2293 gene, herein designated VGAM GENE, is a viral gene contained in the genome of Murine Hepatitis Virus. VGAM2293 host target gene, herein designated VGAM HOST TARGET GENE, is a human gene contained in the human genome.

VGAM2293 gene encodes a VGAM2293 precursor RNA, herein designated VGAM PRECURSOR RNA. Similar to other miRNA genes, and unlike most ordinary genes, VGAM2293 precursor RNA does not encode a protein. A nucleotide sequence identical or highly similar to the nucleotide sequence of VGAM2293 precursor RNA is designated SEQ ID:2279, and is provided hereinbelow with reference to the sequence listing part. Nucleotide sequence SEQ ID:2279 is located at position 25465 relative to the genome of Murine Hepatitis Virus.

VGAM2293 precursor RNA folds onto itself, forming VGAM2293 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2293 folded precursor RNA into VGAM2293 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM2293 RNA is designated SEQ ID:5004, and is provided hereinbelow with reference to the sequence listing part.

VGAM2293 host target gene, herein designated VGAM HOST TARGET GENE, encodes a corresponding messenger RNA, VGAM2293 host target RNA, herein designated VGAM HOST TARGET RNA. VGAM2293 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2293 RNA, herein designated VGAM RNA, binds complementarily to one or more host target binding sites located in untranslated regions of VGAM2293 host target RNA, herein designated VGAM HOST TARGET RNA. This complementary binding is due to the fact that the nucleotide sequence of VGAM2293 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2293 RNA, herein designated VGAM RNA, may have a different number of host target binding sites in untranslated regions of a VGAM2293 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2293 RNA, herein designated VGAM RNA, to host target binding sites on VGAM2293 host target RNA, herein designated VGAM HOST TARGET RNA, such as BINDING SITE I, BINDING SITE II and BINDING SITE III, inhibits translation of VGAM2293 host target RNA into VGAM2293 host target protein, herein designated VGAM HOST TARGET PROTEIN. VGAM host target protein is therefore outlined by a broken line.

It is appreciated that VGAM2293 host target gene, herein designated VGAM HOST TARGET GENE, in fact represents a plurality of VGAM2293 host target genes. The mRNA of each one of this plurality of VGAM2293 host target genes comprises one or more host target binding sites, each having a nucleotide sequence which is at least partly complementary to VGAM2293 RNA, herein designated VGAM RNA, and which when bound by VGAM2293 RNA causes inhibition of translation of respective one or more VGAM2293 host target proteins.

It is further appreciated by one skilled in the art that the mode of translational inhibition illustrated by FIG. 1 with specific reference to translational inhibition exerted by VGAM2293 gene, herein designated VGAM GENE, on one or more VGAM2293 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2293 is inhibition of expression of host target genes, as part of a novel viral mechanism of attacking a host. Accordingly, utilities of VGAM2293 include diagnosis, prevention and treatment of viral infection by Murine Hepatitis Virus. Specific functions, and accordingly utilities, of VGAM2293 correlate with, and may be deduced from, the identity of the host target genes which VGAM2293 binds and inhibits, and the function of these host target genes, as elaborated hereinbelow.

Nucleotide sequences of the VGAM2293 precursor RNA, herein designated VGAM PRECURSOR RNA, and of the 'diced' VGAM2293 RNA, herein designated VGAM RNA, and a schematic representation of the secondary folding of VGAM2293 folded precursor RNA, herein designated VGAM FOLDED PRECURSOR RNA, of VGAM2293 are further described hereinbelow with reference to Table 1.

Nucleotide sequences of host target binding sites, such as BINDING SITE-I, BINDING SITE-II and BINDING SITE-III of FIG. 1, found on VGAM2293 host target RNA, and schematic representation of the complementarity of each of these host target binding sites to VGAM2293 RNA, herein designated VGAM RNA, are described hereinbelow with reference to Table 2.

As mentioned hereinabove with reference to FIG. 1, a function of VGAM2293 gene, herein designated VGAM is inhibition of expression of VGAM2293 target genes. It is appreciated that specific functions, and accordingly utilities, of VGAM2293 correlate with, and may be deduced from, the identity of the target genes which VGAM2293 binds and inhibits, and the function of these target genes, as elaborated hereinbelow.

Microtubule-associated Protein 1A (MAP1A, Accession NM_002373) is a VGAM2293 host target gene. MAP1A BINDING SITE is HOST TARGET binding site found in the 3' untranslated region of mRNA encoded by MAP1A, corresponding to a HOST TARGET binding site such as BINDING SITE I, BINDING SITE II or BINDING SITE III. Table 2 illustrates the complementarity of the nucleotide sequences of MAP1A BINDING SITE, designated SEQ ID:8185, to the nucleotide sequence of VGAM2293 RNA, herein designated VGAM RNA, also designated SEQ ID:5004.

A function of VGAM2293 is therefore inhibition of Microtubule-associated Protein 1A (MAP1A, Accession NM_002373), a gene which is a structural protein involved in the filamentous cross- bridging between microtubules and other skeletal elements. Accordingly, utilities of VGAM2293 include diagnosis, prevention and treatment of diseases and clinical conditions associated with MAP1A. The function of MAP1A and its association with various diseases and clinical conditions, has been established by previous studies, as described hereinabove with reference to VGAM315. Villin 2 (ezrin) (VIL2, Accession NM_003379) is another VGAM2293 host target gene. VIL2 BINDING SITE is HOST TARGET binding site found in the 3' untranslated region of mRNA encoded by VIL2, corresponding to a HOST TARGET binding site such as BINDING SITE I, BINDING SITE II or BINDING SITE III. Table 2 illustrates the complementarity of the nucleotide sequences of VIL2 BINDING SITE, designated SEQ ID:9410, to the nucleotide sequence of VGAM2293 RNA, herein designated VGAM RNA, also designated SEQ ID:5004.

Another function of VGAM2293 is therefore inhibition of Villin 2 (ezrin) (VIL2, Accession NM_003379), a gene which is involved in the formation of the immunological synapse and in T cell activation. Accordingly, utilities of VGAM2293 include diagnosis, prevention and treatment of diseases and clinical conditions associated with VIL2. The function of VIL2 has been established by previous studies. The immunologic synapse is the T cell-APC (antigen-presenting cell) contact site where T-cell receptors, coreceptors, signaling molecules, and adhesion receptors polarize upon antigen recognition. The formation of the immunologic synapse is thought to be important for receptor signal transduction and full T-lymphocyte activation. Using superantigen-stimulated Jurkat cells and confocal microscopy, Roumier et al. (2001) demonstrated that ezrin, F-actin (see OMIM Ref. No. ACTA1; 102610), and CD43 (OMIM Ref. No. 182160) relocalize to the sides, not the center, of the T cell-APC contact area after T-cell activation, suggesting that ezrin may contribute to setting the scaffold between the actin cytoskeleton and transmembrane proteins facilitating cell-cell interactions and receptor retention. Using mouse helper T cell lines and confocal microscopy, Allenspach et al. (2001) determined that the cytoplasmic tail of CD43 is necessary and sufficient for CD43 removal from the immunologic synapse. In at least some cells, CD43 is located at the distal pole of the T cell together with ezrin and moesin. No differences in the behavior of ezrin and moesin were noted throughout the study. Using cells from Cd43 -/- mice, Allenspach et al. (2001) observed that ERM proteins move independently of the large CD43 mucin. Overexpression of a dominant-negative ERM mutant containing the N-terminal 320 amino acids of ezrin inhibited the activation-induced movement of CD43 without affecting conjugate formation. The dominant-negative mutant reduced cytokine production but not the expression of T-cell activation markers Full details of the abovementioned studies are described in the following publications, the disclosure of which are hereby incorporated by reference:

Roumier, A.; Olivo-Marin, J. C.; Arpin, M.; Michel, F.; Martin, M.; Mangeat, P.; Acuto, O.; Dautry-Varsat, A.; Alcover, A.: The membrane-microfilament linker ezrin is involved in the formation of the immunological synapse and in T cell activation. Immunity 15:715-728, 2001; and Allenspach, E. J.; Cullinan, P.; Tong, J.; Tang, Q.; Tesciuba, A. G.; Cannon, J. L.; Takahashi, S. M.; Morgan, R.; Burkhardt, J. K.; Sperling, A. I.: ERM-dependent movement of CD43 defin.

Further studies establishing the function and utilities of VIL2 are found in John Hopkins OMIM database record ID 123900, and in sited publications numbered 4347-4355 listed in the bibliography section hereinbelow, which are also hereby incorporated by reference. ATP-binding Cassette, Sub-family A (ABC1), Member 10 (ABCA10, Accession NM_080282) is another VGAM2293 host target gene. ABCA10 BINDING SITE is HOST TARGET binding site found in the 5' untranslated region of mRNA encoded by ABCA10, corresponding to a HOST TARGET binding site such as BINDING SITE I, BINDING SITE II or BINDING SITE III. Table 2 illustrates the complementarity of the nucleotide sequences of ABCA10 BINDING SITE, designated SEQ ID:27825, to the nucleotide sequence of VGAM2293 RNA, herein designated VGAM RNA, also designated SEQ ID:5004.

Another function of VGAM2293 is therefore inhibition of ATP-binding Cassette, Sub-family A (ABC1), Member 10 (ABCA10, Accession NM_080282). Accordingly, utilities of VGAM2293 include diagnosis, prevention and treatment of diseases and clinical conditions associated with ABCA10. Chromosome 11 Open Reading Frame 23 (C11orf23, Accession NM_018312) is another VGAM2293 host target gene. C11orf23 BINDING SITE is HOST TARGET binding site found in the 3' untranslated region of mRNA encoded by C11orf23, corresponding to a HOST TARGET binding site such as BINDING SITE I, BINDING SITE II or BINDING SITE III. Table 2 illustrates the complementarity of the nucleotide sequences of C11orf23 BINDING SITE, designated SEQ ID:20301, to the nucleotide sequence of VGAM2293 RNA, herein designated VGAM RNA, also designated SEQ ID:5004.

Another function of VGAM2293 is therefore inhibition of Chromosome 11 Open Reading Frame 23 (C11orf23, Accession NM_018312). Accordingly, utilities of VGAM2293 include diagnosis, prevention and treatment of diseases and clinical conditions associated with C11orf23. KIAA0472 (Accession XM_050147) is another VGAM2293 host target gene. KIAA0472 BINDING SITE is HOST TARGET binding site found in the 3' untranslated region of mRNA encoded by KIAA0472, corresponding to a HOST TARGET binding site such as BINDING SITE I, BINDING SITE II or BINDING SITE III. Table 2 illustrates the complementarity of the nucleotide sequences of KIAA0472 BINDING SITE, designated SEQ ID:35575, to the nucleotide sequence of VGAM2293 RNA, herein designated VGAM RNA, also designated SEQ ID:5004.

Another function of VGAM2293 is therefore inhibition of KIAA0472 (Accession XM_050147). Accordingly, utilities of VGAM2293 include diagnosis, prevention and treatment of diseases and clinical conditions associated with KIAA0472. KIAA0847 (Accession XM_085298) is another VGAM2293 host target gene. KIAA0847 BINDING SITE is HOST TARGET binding site found in the 3' untranslated region of mRNA encoded by KIAA0847, corresponding to a HOST TARGET binding site such as BINDING SITE I, BINDING SITE II or BINDING SITE III. Table 2 illustrates the complementarity of the nucleotide sequences of KIAA0847 BINDING SITE, designated SEQ ID:38047, to the nucleotide sequence of VGAM2293 RNA, herein designated VGAM RNA, also designated SEQ ID:5004.

Another function of VGAM2293 is therefore inhibition of KIAA0847 (Accession XM_085298). Accordingly, utilities of VGAM2293 include diagnosis, prevention and treatment of diseases and clinical conditions associated with KIAA0847. LBP-9 (Accession NM_014553) is another VGAM2293 host target gene. LBP-9 BINDING SITE is HOST TARGET binding site found in the 3' untranslated region of mRNA encoded by LBP-9, corresponding to a HOST TARGET binding site such as BINDING SITE I, BINDING SITE II or BINDING SITE III. Table 2 illustrates the complementarity of the nucleotide sequences of LBP-9 BINDING SITE, designated SEQ ID:15876, to the nucleotide sequence of VGAM2293 RNA, herein designated VGAM RNA, also designated SEQ ID:5004.

Another function of VGAM2293 is therefore inhibition of LBP-9 (Accession NM_014553). Accordingly, utilities of VGAM2293 include diagnosis, prevention and treatment of diseases and clinical conditions associated with LBP-9. LOC143914 (Accession XM_084654) is another VGAM2293 host target gene. LOC143914 BINDING SITE is HOST TARGET binding site found in the 5' untranslated region of mRNA encoded by LOC143914, corresponding to a HOST TARGET binding site such as BINDING SITE I, BINDING SITE II or BINDING SITE III. Table 2 illustrates the complementarity of the nucleotide sequences of LOC143914 BINDING SITE, designated SEQ ID:37634, to the nucleotide sequence of VGAM2293 RNA, herein designated VGAM RNA, also designated SEQ ID:5004.

Another function of VGAM2293 is therefore inhibition of LOC143914 (Accession XM_084654). Accordingly, utilities of VGAM2293 include diagnosis, prevention and treatment of diseases and clinical conditions associated with LOC143914. FIG. 1 further provides a conceptual description of a novel bioinformatically detected viral gene of the present invention, referred to here as Viral Genomic Address Messenger 2294 (VGAM2294) viral gene, which modulates expression of respective host target genes thereof, the function and utility of which host target genes is known in the art.

VGAM2294 is a novel bioinformatically detected regulatory, non protein coding, viral micro RNA (miRNA) gene. The method by which VGAM2294 was detected is described hereinabove with reference to FIGS. 1-8.

VGAM2294 gene, herein designated VGAM GENE, is a viral gene contained in the genome of Murine Hepatitis Virus. VGAM2294 host target gene, herein designated VGAM HOST TARGET GENE, is a human gene contained in the human genome.

VGAM2294 gene encodes a VGAM2294 precursor RNA, herein designated VGAM PRECURSOR RNA. Similar to other miRNA genes, and unlike most ordinary genes, VGAM2294 precursor RNA does not encode a protein. A nucleotide sequence identical or highly similar to the nucleotide sequence of VGAM2294 precursor RNA is designated SEQ ID:2280, and is provided hereinbelow with reference to the sequence listing part. Nucleotide sequence SEQ ID:2280 is located at position 22784 relative to the genome of Murine Hepatitis Virus.

VGAM2294 precursor RNA folds onto itself, forming VGAM2294 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2294 folded precursor RNA into VGAM2294 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2294 RNA is designated SEQ ID:5005, and is provided hereinbelow with reference to the sequence listing part.

VGAM2294 host target gene, herein designated VGAM HOST TARGET GENE, encodes a corresponding messenger RNA, VGAM2294 host target RNA, herein designated VGAM HOST TARGET RNA. VGAM2294 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2294 RNA, herein designated VGAM RNA, binds complementarily to one or more host target binding sites located in untranslated regions of VGAM2294 host target RNA, herein designated VGAM HOST TARGET RNA. This complementary binding is due to the fact that the nucleotide sequence of VGAM2294 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2294 RNA, herein designated VGAM RNA, may have a different number of host target binding sites in untranslated regions of a VGAM2294 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2294 RNA, herein designated VGAM RNA, to host target binding sites on VGAM2294 host target RNA, herein designated VGAM HOST TARGET RNA, such as BINDING SITE I, BINDING SITE II and BINDING SITE III, inhibits translation of VGAM2294 host target RNA into VGAM2294 host target protein, herein designated VGAM HOST TARGET PROTEIN. VGAM host target protein is therefore outlined by a broken line.

It is appreciated that VGAM2294 host target gene, herein designated VGAM HOST TARGET GENE, in fact represents a plurality of VGAM2294 host target genes. The mRNA of each one of this plurality of VGAM2294 host target genes comprises one or more host target binding sites, each having a nucleotide sequence which is at least partly complementary to VGAM2294 RNA, herein designated VGAM RNA, and which when bound by VGAM2294 RNA causes inhibition of translation of respective one or more VGAM2294 host target proteins.

It is further appreciated by one skilled in the art that the mode of translational inhibition illustrated by FIG. 1 with specific reference to translational inhibition exerted by VGAM2294 gene, herein designated VGAM GENE, on one or more VGAM2294 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2294 is inhibition of expression of host target genes, as part of a novel viral mechanism of attacking a host. Accordingly, utilities of VGAM2294 include diagnosis, prevention and treatment of viral infection by Murine Hepatitis Virus. Specific functions, and accordingly utilities, of VGAM2294 correlate with, and may be deduced from, the identity of the host target genes which VGAM2294 binds and inhibits, and the function of these host target genes, as elaborated hereinbelow.

Nucleotide sequences of the VGAM2294 precursor RNA, herein designated VGAM PRECURSOR RNA, and of the 'diced' VGAM2294 RNA, herein designated VGAM RNA, and a schematic representation of the secondary folding of VGAM2294 folded precursor RNA, herein designated VGAM FOLDED PRECURSOR RNA, of VGAM2294 are further described hereinbelow with reference to Table 1.

Nucleotide sequences of host target binding sites, such as BINDING SITE-I, BINDING SITE-II and BINDING SITE-III of FIG. 1, found on VGAM2294 host target RNA, and schematic representation of the complementarity of each of these host target binding sites to VGAM2294 RNA, herein designated VGAM RNA, are described hereinbelow with reference to Table 2.

As mentioned hereinabove with reference to FIG. 1, a function of VGAM2294 gene, herein designated VGAM is inhibition of expression of VGAM2294 target genes. It is appreciated that specific functions, and accordingly utilities, of VGAM2294 correlate with, and may be deduced from, the identity of the target genes which VGAM2294 binds and inhibits, and the function of these target genes, as elaborated hereinbelow.

A Disintegrin and Metalloproteinase Domain 19 (meltrin beta) (ADAM19, Accession NM_033274) is a VGAM2294 host target gene. ADAM19 BINDING SITE is HOST TARGET binding site found in the 3' untranslated region of mRNA encoded by ADAM19, corresponding to a HOST TARGET binding site such as BINDING SITE I, BINDING SITE II or BINDING SITE III. Table 2 illustrates the complementarity of the nucleotide sequences of ADAM19 BINDING SITE, designated SEQ ID:27093, to the nucleotide sequence of VGAM2294 RNA, herein designated VGAM RNA, also designated SEQ ID:5005.

A function of VGAM2294 is therefore inhibition of A Disintegrin and Metalloproteinase Domain 19 (meltrin beta) (ADAM19, Accession NM_033274), a gene which participates in the proteolytic processing of beta-type neuregulin isoforms. Accordingly, utilities of VGAM2294 include diagnosis, prevention and treatment of diseases and clinical conditions associated with ADAM19. The function of ADAM19 and its association with various diseases and clinical conditions, has been established by previous studies, as described hereinabove with reference to VGAM179. LOC92228 (Accession XM_043731) is another VGAM2294 host target gene. LOC92228 BINDING SITE is HOST TARGET binding site found in the 3' untranslated region of mRNA encoded by LOC92228, corresponding to a HOST TARGET binding site such as BINDING SITE I, BINDING SITE II or BINDING SITE III. Table 2 illustrates the complementarity of the nucleotide sequences of LOC92228 BINDING SITE, designated SEQ ID:34002, to the nucleotide sequence of VGAM2294 RNA, herein designated VGAM RNA, also designated SEQ ID:5005.

Another function of VGAM2294 is therefore inhibition of LOC92228 (Accession XM_043731). Accordingly, utilities of VGAM2294 include diagnosis, prevention and treatment of diseases and clinical conditions associated with LOC92228. FIG. 1 further provides a conceptual description of a novel bioinformatically detected viral gene of the present invention, referred to here as Viral Genomic Address Messenger 2295 (VGAM2295) viral gene, which modulates expression of respective host target genes thereof, the function and utility of which host target genes is known in the art.

VGAM2295 is a novel bioinformatically detected regulatory, non protein coding, viral micro RNA (miRNA) gene. The method by which VGAM2295 was detected is described hereinabove with reference to FIGS. 1-8.

VGAM2295 gene, herein designated VGAM GENE, is a viral gene contained in the genome of Ectromelia Virus. VGAM2295 host target gene, herein designated VGAM HOST TARGET GENE, is a human gene contained in the human genome.

VGAM2295 gene encodes a VGAM2295 precursor RNA, herein designated VGAM PRECURSOR RNA. Similar to other miRNA genes, and unlike most ordinary genes, VGAM2295 precursor RNA does not encode a protein. A nucleotide sequence identical or highly similar to the nucleotide sequence of VGAM2295 precursor RNA is designated SEQ ID:2281, and is provided hereinbelow with reference to the sequence listing part. Nucleotide sequence SEQ ID:2281 is located at position 43938 relative to the genome of Ectromelia Virus.

VGAM2295 precursor RNA folds onto itself, forming VGAM2295 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2295 folded precursor RNA into VGAM2295 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2295 RNA is designated SEQ ID:5006, and is provided hereinbelow with reference to the sequence listing part.

VGAM2295 host target gene, herein designated VGAM HOST TARGET GENE, encodes a corresponding messenger RNA, VGAM2295 host target RNA, herein designated VGAM HOST TARGET RNA. VGAM2295 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2295 RNA, herein designated VGAM RNA, binds complementarily to one or more host target binding sites located in untranslated regions of VGAM2295 host target RNA, herein designated VGAM HOST TARGET RNA. This complementary binding is due to the fact that the nucleotide sequence of VGAM2295 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2295 RNA, herein designated VGAM RNA, may have a different number of host target binding sites in untranslated regions of a VGAM2295 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2295 RNA, herein designated VGAM RNA, to host target binding sites on VGAM2295 host target RNA, herein designated VGAM HOST TARGET RNA, such as BINDING SITE I, BINDING SITE II and BINDING SITE III, inhibits translation of VGAM2295 host target RNA into VGAM2295 host target protein, herein designated VGAM HOST TARGET PROTEIN. VGAM host target protein is therefore outlined by a broken line.

It is appreciated that VGAM2295 host target gene, herein designated VGAM HOST TARGET GENE, in fact represents a plurality of VGAM2295 host target genes. The mRNA of each one of this plurality of VGAM2295 host target genes comprises one or more host target binding sites, each having a nucleotide sequence which is at least partly complementary to VGAM2295 RNA, herein designated VGAM RNA, and which when bound by VGAM2295 RNA causes inhibition of translation of respective one or more VGAM2295 host target proteins.

It is further appreciated by one skilled in the art that the mode of translational inhibition illustrated by FIG. 1 with specific reference to translational inhibition exerted by VGAM2295 gene, herein designated VGAM GENE, on one or more VGAM2295 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2295 is inhibition of expression of host target genes, as part of a novel viral mechanism of attacking a host. Accordingly, utilities of VGAM2295 include diagnosis, prevention and treatment of viral infection by Ectromelia Virus. Specific functions, and accordingly utilities, of VGAM2295 correlate with, and may be deduced from, the identity of the host target genes which VGAM2295 binds and inhibits, and the function of these host target genes, as elaborated hereinbelow.

Nucleotide sequences of the VGAM2295 precursor RNA, herein designated VGAM PRECURSOR RNA, and of the 'diced' VGAM2295 RNA, herein designated VGAM RNA, and a schematic representation of the secondary folding of VGAM2295 folded precursor RNA, herein designated VGAM FOLDED PRECURSOR RNA, of VGAM2295 are further described hereinbelow with reference to Table 1.

Nucleotide sequences of host target binding sites, such as BINDING SITE-I, BINDING SITE-II and BINDING SITE-III of FIG. 1, found on VGAM2295 host target RNA, and schematic representation of the complementarity of each of these host target binding sites to VGAM2295 RNA, herein designated VGAM RNA, are described hereinbelow with reference to Table 2.

As mentioned hereinabove with reference to FIG. 1, a function of VGAM2295 gene, herein designated VGAM is inhibition of expression of VGAM2295 target genes. It is appreciated that specific functions, and accordingly utilities, of VGAM2295 correlate with, and may be deduced from, the identity of the target genes which VGAM2295 binds and inhibits, and the function of these target genes, as elaborated hereinbelow.

TAF9 RNA Polymerase II, TATA Box Binding Protein (TBP)-associated Factor, 32 kDa (TAF9, Accession NM_003187) is a VGAM2295 host target gene. TAF9 BINDING SITE is HOST TARGET binding site found in the 5' untranslated region of mRNA encoded by TAF9, corresponding to a HOST TARGET binding site such as BINDING SITE I, BINDING SITE II or BINDING SITE III. Table 2 illustrates the complementarity of the nucleotide sequences of TAF9 BINDING SITE, designated SEQ ID:9163, to the nucleotide sequence of VGAM2295 RNA, herein designated VGAM RNA, also designated SEQ ID:5006.

A function of VGAM2295 is therefore inhibition of TAF9 RNA Polymerase II, TATA Box Binding Protein (TBP)-associated Factor, 32 kDa (TAF9, Accession NM_003187), a gene which may function as a coactivator of transcription. Accordingly, utilities of VGAM2295 include diagnosis, prevention and treatment of diseases and clinical conditions associated with TAF9. The function of TAF9 has been established by previous studies. Klemm et al. (1995) cloned a human TFIID subunit, which they termed hTAFII32. The 32-kD protein was isolated from HeLa cell nuclear extracts and partially sequenced. A degenerate oligomer was designed and used to probe a human HeLa cell cDNA library. The identified cDNA has a deduced amino acid sequence of 264 residues and is related to the Drosophila TAFII40. Klemm et al. (1995) showed that TAFII32 interacts with GTF2B (OMIM Ref. No. 189963) and with the viral transcriptional transactivator VP16. The authors showed that recombinantly expressed TAFII32 was functional in a partial recombinant TFIID complex and that the recombinant complex mediated activation by a GAL4-VP16 fusion protein. Lu and Levine (1995) cloned TAF9, which they called TAFII31. TAF9 encodes a 264-amino acid protein. Immunoprecipitation and binding analyses showed interaction of TAF9 with the N-terminal domain of p53 (OMIM Ref. No. 191170) at sites identical to those bound by MDM2 (OMIM Ref. No. 164785), the major cellular negative regulator of p53 activity. Antibodies to TAF9 inhibited p53-activated transcription. Lu and Levine (1995) concluded that p53 activity is regulated by 2 proteins competing for the same region of the p53 protein.

Full details of the abovementioned studies are described in the following publications, the disclosure of which are hereby incorporated by reference:

Klemm, R. D.; Goodrich, J. A.; Zhou, S.; Tjian, R.: Molecular cloning and expression of the 32-kDa subunit of human TFIID reveals interactions with VP16 and TFIIB that mediate transcriptional activation. Proc. Nat. Acad. Sci. 92:5788-5792, 1995; and Lu, H.; Levine, A. J.: Human TAFII31 protein is a transcriptional coactivator of the p53 protein. Proc. Nat. Acad. Sci. 92:5154-5158, 1995.

Further studies establishing the function and utilities of TAF9 are found in John Hopkins OMIM database record ID 600822, and in sited publications numbered 7536-7538 listed in the bibliography section hereinbelow, which are also hereby incorporated by reference. KIAA1866 (Accession XM_027658) is another VGAM2295 host target gene. KIAA1866 BINDING SITE is HOST TARGET binding site found in the 3' untranslated region of mRNA encoded by KIAA1866, corresponding to a HOST TARGET binding site such as BINDING SITE I, BINDING SITE II or BINDING SITE III. Table 2 illustrates the complementarity of the nucleotide sequences of KIAA1866 BINDING SITE, designated SEQ ID:30554, to the nucleotide sequence of VGAM2295 RNA, herein designated VGAM RNA, also designated SEQ ID:5006.

Another function of VGAM2295 is therefore inhibition of KIAA1866 (Accession XM_027658). Accordingly, utilities of VGAM2295 include diagnosis, prevention and treatment of diseases and clinical conditions associated with KIAA1866. LOC200269 (Accession XM_114175) is another VGAM2295 host target gene. LOC200269 BINDING SITE is HOST TARGET binding site found in the 3' untranslated region of mRNA encoded by LOC200269, corresponding to a HOST TARGET binding site such as BINDING SITE I, BINDING SITE II or BINDING SITE III. Table 2 illustrates the complementarity of the nucleotide sequences of LOC200269 BINDING SITE, designated SEQ ID:42757, to the nucleotide sequence of VGAM2295 RNA, herein designated VGAM RNA, also designated SEQ ID:5006.

Another function of VGAM2295 is therefore inhibition of LOC200269 (Accession XM_114175). Accordingly, utilities of VGAM2295 include diagnosis, prevention and treatment of diseases and clinical conditions associated with LOC200269. LOC255461 (Accession XM_173207) is another VGAM2295 host target gene. LOC255461 BINDING SITE is HOST TARGET binding site found in the 5' untranslated region of mRNA encoded by LOC255461, corresponding to a HOST TARGET binding site such as BINDING SITE I, BINDING SITE II or BINDING SITE III. Table 2 illustrates the complementarity of the nucleotide sequences of LOC255461 BINDING SITE, designated SEQ ID:46461, to the nucleotide sequence of VGAM2295 RNA, herein designated VGAM RNA, also designated SEQ ID:5006.

Another function of VGAM2295 is therefore inhibition of LOC255461 (Accession XM_173207). Accordingly, utilities of VGAM2295 include diagnosis, prevention and treatment of diseases and clinical conditions associated with LOC255461. LOC255516 (Accession XM_173212) is another VGAM2295 host target gene. LOC255516 BINDING SITE is HOST TARGET binding site found in the 5' untranslated region of mRNA encoded by LOC255516, corresponding to a HOST TARGET binding site such as BINDING SITE I, BINDING SITE II or BINDING SITE III. Table 2 illustrates the complementarity of the nucleotide sequences of LOC255516 BINDING SITE, designated SEQ ID:46467, to the nucleotide sequence of VGAM2295 RNA, herein designated VGAM RNA, also designated SEQ ID:5006.

Another function of VGAM2295 is therefore inhibition of LOC255516 (Accession XM_173212). Accordingly, utilities of VGAM2295 include diagnosis, prevention and treatment of diseases and clinical conditions associated with LOC255516. FIG. 1 further provides a conceptual description of a novel bioinformatically detected viral gene of the present invention, referred to here as Viral Genomic Address Messenger 2296 (VGAM2296) viral gene, which modulates expression of respective host target genes thereof, the function and utility of which host target genes is known in the art.

VGAM2296 is a novel bioinformatically detected regulatory, non protein coding, viral micro RNA (miRNA) gene. The method by which VGAM2296 was detected is described hereinabove with reference to FIGS. 1-8.

VGAM2296 gene, herein designated VGAM GENE, is a viral gene contained in the genome of Ectromelia Virus. VGAM2296 host target gene, herein designated VGAM HOST TARGET GENE, is a human gene contained in the human genome.

VGAM2296 gene encodes a VGAM2296 precursor RNA, herein designated VGAM PRECURSOR RNA. Similar to other miRNA genes, and unlike most ordinary genes, VGAM2296 precursor RNA does not encode a protein. A nucleotide sequence identical or highly similar to the nucleotide sequence of VGAM2296 precursor RNA is designated SEQ ID:2282, and is provided hereinbelow with reference to the sequence listing part. Nucleotide sequence SEQ ID:2282 is located at position 27612 relative to the genome of Ectromelia Virus.

VGAM2296 precursor RNA folds onto itself, forming VGAM2296 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2296 folded precursor RNA into VGAM2296 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2296 RNA is designated SEQ ID:5007, and is provided hereinbelow with reference to the sequence listing part.

VGAM2296 host target gene, herein designated VGAM HOST TARGET GENE, encodes a corresponding messenger RNA, VGAM2296 host target RNA, herein designated VGAM HOST TARGET RNA. VGAM2296 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2296 RNA, herein designated VGAM RNA, binds complementarily to one or more host target binding sites located in untranslated regions of VGAM2296 host target RNA, herein designated VGAM HOST TARGET RNA. This complementary binding is due to the fact that the nucleotide sequence of VGAM2296 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2296 RNA, herein designated VGAM RNA, may have a different number of host target binding sites in untranslated regions of a VGAM2296 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2296 RNA, herein designated VGAM RNA, to host target binding sites on VGAM2296 host target RNA, herein designated VGAM HOST TARGET RNA, such as BINDING SITE I, BINDING SITE II and BINDING SITE III, inhibits translation of VGAM2296 host target RNA into VGAM2296 host target protein, herein designated VGAM HOST TARGET PROTEIN. VGAM host target protein is therefore outlined by a broken line.

It is appreciated that VGAM2296 host target gene, herein designated VGAM HOST TARGET GENE, in fact represents a plurality of VGAM2296 host target genes. The mRNA of each one of this plurality of VGAM2296 host target genes comprises one or more host target binding sites, each having a nucleotide sequence which is at least partly complementary to VGAM2296 RNA, herein designated VGAM RNA, and which when bound by VGAM2296 RNA causes inhibition of translation of respective one or more VGAM2296 host target proteins.

It is further appreciated by one skilled in the art that the mode of translational inhibition illustrated by FIG. 1 with specific reference to translational inhibition exerted by VGAM2296 gene, herein designated VGAM GENE, on one or more VGAM2296 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2296 is inhibition of expression of host target genes, as part of a novel viral mechanism of attacking a host. Accordingly, utilities of VGAM2296 include diagnosis, prevention and treatment of viral infection by Ectromelia Virus. Specific functions, and accordingly utilities, of VGAM2296 correlate with, and may be deduced from, the identity of the host target genes which VGAM2296 binds and inhibits, and the function of these host target genes, as elaborated hereinbelow.

Nucleotide sequences of the VGAM2296 precursor RNA, herein designated VGAM PRECURSOR RNA, and of the 'diced' VGAM2296 RNA, herein designated VGAM RNA, and a schematic representation of the secondary folding of VGAM2296 folded precursor RNA, herein designated VGAM FOLDED PRECURSOR RNA, of VGAM2296 are further described hereinbelow with reference to Table 1.

Nucleotide sequences of host target binding sites, such as BINDING SITE-I, BINDING SITE-II and BINDING SITE-III of FIG. 1, found on VGAM2296 host target RNA, and schematic representation of the complementarity of each of these host target binding sites to VGAM2296 RNA, herein designated VGAM RNA, are described hereinbelow with reference to Table 2.

As mentioned hereinabove with reference to FIG. 1, a function of VGAM2296 gene, herein designated VGAM is inhibition of expression of VGAM2296 target genes. It is appreciated that specific functions, and accordingly utilities, of VGAM2296 correlate with, and may be deduced from, the identity of the target genes which VGAM2296 binds and inhibits, and the function of these target genes, as elaborated hereinbelow.

Cadherin 11, Type 2, OB-cadherin (osteoblast) (CDH11, Accession NM_033664) is a VGAM2296 host target gene. CDH11 BINDING SITE is HOST TARGET binding site found in the 3' untranslated region of mRNA encoded by CDH11, corresponding to a HOST TARGET binding site such as BINDING SITE I, BINDING SITE II or BINDING SITE III. Table 2 illustrates the complementarity of the nucleotide sequences of CDH11 BINDING SITE, designated SEQ ID:27392, to the nucleotide sequence of VGAM2296 RNA, herein designated VGAM RNA, also designated SEQ ID:5007.

A function of VGAM2296 is therefore inhibition of Cadherin 11, Type 2, OB-cadherin (osteoblast) (CDH11, Accession NM_033664), a gene which plays an role in development and maintenance of tissues. Accordingly, utilities of VGAM2296 include diagnosis, prevention and treatment of diseases and clinical conditions associated with CDH11. The function of CDH11 has been established by previous studies. Cadherins are a group of cell surface glycoproteins that mediate Ca (2+)-dependent cell-cell adhesion (Tanihara et al., 1994). These proteins have a molecular mass of about 120 kD and are composed of an extracellular domain at the N-terminal end and a relatively small cytoplasmic domain at the C-terminal end; the 2 domains are connected by a single membrane-spanning sequence. The extracellular domain consists of 5 subdomains, each of which contains a cadherin-specific motif. Cadherin expression is regulated spatially as well as temporally. Cadherins are thought to play an important role in development and maintenance of tissues through selective cell-cell adhesion activity and may be involved also in the invasion and metastasis of malignant tumors. Okazaki et al. (1994) identified a new member of the cadherin family, which they called OB (osteoblast)-cadherin, in a mouse osteoblastic cell line and human osteosarcoma. OB-cadherin was also weakly expressed in stroma cell lines that are the progenitor cells of osteoblasts. Expression of the CDHOB gene in the osteoblastic cell line was up-regulated during differentiation, suggesting a specific function in bone cell differentiation and bone formation. Two different forms of human OB-cadherin cDNA were cloned; one was a counterpart of the mouse gene and the other encoded a protein with a truncated cytoplasmic domain. The protein was designated cadherin-11 (symbol: CDH11) by the Human Genome Nomenclature Committee.

Full details of the abovementioned studies are described in the following publications, the disclosure of which are hereby incorporated by reference:

Kools, P.; Vanhalst, K.; Wan den Eynde, E.; van Roy, F.: The human cadherin-10 gene: complete coding sequence, predominant expression in the brain and mapping on chromosome 5p13-13. FEBS Lett. 452:328-334, 1999; and Suzuki, S.; Sano, K.; Tanihara, H.: Diversity of the cadherin family: evidence for eight new cadherins in nervous tissue. Cell Regul. 2:261-270, 1991.

Further studies establishing the function and utilities of CDH11 are found in John Hopkins OMIM database record ID 600023, and in sited publications numbered 833 and 11646-8336 listed in the bibliography section hereinbelow, which are also hereby incorporated by reference. Enolase 2, (gamma, neuronal) (ENO2, Accession NM_001975) is another VGAM2296 host target gene. ENO2 BINDING SITE is HOST TARGET binding site found in the 5' untranslated region of mRNA encoded by ENO2, corresponding to a HOST TARGET binding site such as BINDING SITE I, BINDING SITE II or BINDING SITE III. Table 2 illustrates the complementarity of the nucleotide sequences of ENO2 BINDING SITE, designated SEQ ID:7704, to the nucleotide sequence of VGAM2296 RNA, herein designated VGAM RNA, also designated SEQ ID:5007.

Another function of VGAM2296 is therefore inhibition of Enolase 2, (gamma, neuronal) (ENO2, Accession NM_001975), a gene which converts 2-phospho-D-glycerate to phosphoenolpyruvate in glycolysis. Accordingly, utilities of VGAM2296 include diagnosis, prevention and treatment of diseases and clinical conditions associated with ENO2. The function of ENO2 and its association with various diseases and clinical conditions, has been established by previous studies, as described hereinabove with reference to VGAM1151. Klotho (KL, Accession NM_004795) is another VGAM2296 host target gene. KL BINDING SITE is HOST TARGET binding site found in the 3' untranslated region of mRNA encoded by KL, corresponding to a HOST TARGET binding site such as BINDING SITE I, BINDING SITE II or BINDING SITE III. Table 2 illustrates the complementarity of the nucleotide sequences of KL BINDING SITE, designated SEQ ID:11203, to the nucleotide sequence of VGAM2296 RNA, herein designated VGAM RNA, also designated SEQ ID:5007.

Another function of VGAM2296 is therefore inhibition of Klotho (KL, Accession NM_004795), a gene which has similarity to beta-glucosidases. Accordingly, utilities of VGAM2296 include diagnosis, prevention and treatment of diseases and clinical conditions associated with KL. The function of KL and its association with various diseases and clinical conditions, has been established by previous studies, as described hereinabove with reference to VGAM1730. Claudin 1 (CLDN1, Accession NM_021101) is another VGAM2296 host target gene. CLDN1 BINDING SITE is HOST TARGET binding site found in the 3' untranslated region of mRNA encoded by CLDN1, corresponding to a HOST TARGET binding site such as BINDING SITE I, BINDING SITE II or BINDING SITE III. Table 2 illustrates the complementarity of the nucleotide sequences of CLDN1 BINDING SITE, designated SEQ ID:22079, to the nucleotide sequence of VGAM2296 RNA, herein designated VGAM RNA, also designated SEQ ID:5007.

Another function of VGAM2296 is therefore inhibition of Claudin 1 (CLDN1, Accession NM_021101). Accordingly, utilities of VGAM2296 include diagnosis, prevention and treatment of diseases and clinical conditions associated with CLDN1. Golgi Associated, Gamma Adaptin Ear Containing, ARF Binding Protein 2 (GGA2, Accession NM_138640) is another VGAM2296 host target gene. GGA2 BINDING SITE1 and GGA2 BINDING SITE2 are HOST TARGET binding sites found in untranslated regions of mRNA encoded by GGA2, corresponding to HOST TARGET binding sites such as BINDING SITE I, BINDING SITE II or BINDING SITE III. Table 2 illustrates the complementarity of the nucleotide sequences of GGA2 BINDING SITE1 and GGA2 BINDING SITE2, designated SEQ ID:28918 and SEQ ID:17398 respectively, to the nucleotide sequence of VGAM2296 RNA, herein designated VGAM RNA, also designated SEQ ID:5007.

Another function of VGAM2296 is therefore inhibition of Golgi Associated, Gamma Adaptin Ear Containing, ARF Binding Protein 2 (GGA2, Accession NM_138640). Accordingly, utilities of VGAM2296 include diagnosis, prevention and treatment of diseases and clinical conditions associated with GGA2. KIAA0323 (Accession XM_032634) is another VGAM2296 host target gene. KIAA0323 BINDING SITE is HOST TARGET binding site found in the 3' untranslated region of mRNA encoded by KIAA0323, corresponding to a HOST TARGET binding site such as BINDING SITE I, BINDING SITE II or BINDING SITE III. Table 2 illustrates the complementarity of the nucleotide sequences of KIAA0323 BINDING SITE, designated SEQ ID:31694, to the nucleotide sequence of VGAM2296 RNA, herein designated VGAM RNA, also designated SEQ ID:5007.

Another function of VGAM2296 is therefore inhibition of KIAA0323 (Accession XM_032634). Accordingly, utilities of VGAM2296 include diagnosis, prevention and treatment of diseases and clinical conditions associated with KIAA0323. KIAA1582 (Accession XM_037262) is another VGAM2296 host target gene. KIAA1582 BINDING SITE is HOST TARGET binding site found in the 5' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32585, to the nucleotide sequence of VGAM2296 RNA, herein designated VGAM RNA, also designated SEQ ID:5007.

Another function of VGAM2296 is therefore inhibition of KIAA1582 (Accession XM_037262). Accordingly, utilities of VGAM2296 include diagnosis, prevention and treatment of diseases and clinical conditions associated with KIAA1582. phorbolin-1 (Accession XM_114206) is another VGAM2296 host target gene. phorbolin-1 BINDING SITE is HOST TARGET binding site found in the 5' untranslated region of mRNA encoded by phorbolin-1, corresponding to a HOST TARGET binding site such as BINDING SITE I, BINDING SITE II or BINDING SITE III. Table 2 illustrates the complementarity of the nucleotide sequences of phorbolin-1 BINDING SITE, designated SEQ ID:42797, to the nucleotide sequence of VGAM2296 RNA, herein designated VGAM RNA, also designated SEQ ID:5007.

Another function of VGAM2296 is therefore inhibition of phorbolin-1 (Accession XM_114206). Accordingly, utilities of VGAM2296 include diagnosis, prevention and treatment of diseases and clinical conditions associated with phorbolin-1. Proline-rich Gla (G-carboxyglutamic acid) Polypeptide 1 (PRRG1, Accession NM_000950) is another VGAM2296 host target gene. PRRG1 BINDING SITE is HOST TARGET binding site found in the 3' untranslated region of mRNA encoded by PRRG1, corresponding to a HOST TARGET binding site such as BINDING SITE I, BINDING SITE II or BINDING SITE III. Table 2 illustrates the complementarity of the nucleotide sequences of PRRG1 BINDING SITE, designated SEQ ID:6654, to the nucleotide sequence of VGAM2296 RNA, herein designated VGAM RNA, also designated SEQ ID:5007.

Another function of VGAM2296 is therefore inhibition of Proline-rich Gla (G-carboxyglutamic acid) Polypeptide 1 (PRRG1, Accession NM_000950). Accordingly, utilities of VGAM2296 include diagnosis, prevention and treatment of diseases and clinical conditions associated with PRRG1. Three Prime Repair Exonuclease 1 (TREX1, Accession NM_033627) is another VGAM2296 host target gene. TREX1 BINDING SITE is HOST TARGET binding site found in the 5' untranslated region of mRNA encoded by TREX1, corresponding to a HOST TARGET binding site such as BINDING SITE I, BINDING SITE II or BINDING SITE III. Table 2 illustrates the complementarity of the nucleotide sequences of TREX1 BINDING SITE, designated SEQ ID:27339, to the nucleotide sequence of VGAM2296 RNA, herein designated VGAM RNA, also designated SEQ ID:5007.

Another function of VGAM2296 is therefore inhibition of Three Prime Repair Exonuclease 1 (TREX1, Accession NM_033627). Accordingly, utilities of VGAM2296 include diagnosis, prevention and treatment of diseases and clinical conditions associated with TREX1. LOC219653 (Accession XM_166093) is another VGAM2296 host target gene. LOC219653 BINDING SITE is HOST TARGET binding site found in the 3' untranslated region of mRNA encoded by LOC219653, corresponding to a HOST TARGET binding site such as BINDING SITE I, BINDING SITE II or BINDING SITE III. Table 2 illustrates the complementarity of the nucleotide sequences of LOC219653 BINDING SITE, designated SEQ ID:43866, to the nucleotide sequence of VGAM2296 RNA, herein designated VGAM RNA, also designated SEQ ID:5007.

Another function of VGAM2296 is therefore inhibition of LOC219653 (Accession XM_166093). Accordingly, utilities of VGAM2296 include diagnosis, prevention and treatment of diseases and clinical conditions associated with LOC219653. LOC51285 (Accession NM_016563) is another VGAM2296 host target gene. LOC51285 BINDING SITE is HOST TARGET binding site found in the 3' untranslated region of mRNA encoded by LOC51285, corresponding to a HOST TARGET binding site such as BINDING SITE I, BINDING SITE II or BINDING SITE III. Table 2 illustrates the complementarity of the nucleotide sequences of LOC51285 BINDING SITE, designated SEQ ID:18635, to the nucleotide sequence of VGAM2296 RNA, herein designated VGAM RNA, also designated SEQ ID:5007.

Another function of VGAM2296 is therefore inhibition of LOC51285 (Accession NM_016563). Accordingly, utilities of VGAM2296 include diagnosis, prevention and treatment of diseases and clinical conditions associated with LOC51285. FIG. 1 further provides a conceptual description of a novel bioinformatically detected viral gene of the present invention, referred to here as Viral Genomic Address Messenger 2297 (VGAM2297) viral gene, which modulates expression of respective host target genes thereof, the function and utility of which host target genes is known in the art.

VGAM2297 is a novel bioinformatically detected regulatory, non protein coding, viral micro RNA (miRNA) gene. The method by which VGAM2297 was detected is described hereinabove with reference to FIGS. 1-8.

VGAM2297 gene, herein designated VGAM GENE, is a viral gene contained in the genome of Ectromelia Virus. VGAM2297 host target gene, herein designated VGAM HOST TARGET GENE, is a human gene contained in the human genome.

VGAM2297 gene encodes a VGAM2297 precursor RNA, herein designated VGAM PRECURSOR RNA. Similar to other miRNA genes, and unlike most ordinary genes, VGAM2297 precursor RNA does not encode a protein. A nucleotide sequence identical or highly similar to the nucleotide sequence of VGAM2297 precursor RNA is designated SEQ ID:2283, and is provided hereinbelow with reference to the sequence listing part. Nucleotide sequence SEQ ID:2283 is located at position 28555 relative to the genome of Ectromelia Virus.

VGAM2297 precursor RNA folds onto itself, forming VGAM2297 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2297 folded precursor RNA into VGAM2297 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2297 RNA is designated SEQ ID:5008, and is provided hereinbelow with reference to the sequence listing part.

VGAM2297 host target gene, herein designated VGAM HOST TARGET GENE, encodes a corresponding messenger RNA, VGAM2297 host target RNA, herein designated VGAM HOST TARGET RNA. VGAM2297 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2297 RNA, herein designated VGAM RNA, binds complementarily to one or more host target binding sites located in untranslated regions of VGAM2297 host target RNA, herein designated VGAM HOST TARGET RNA. This complementary binding is due to the fact that the nucleotide sequence of VGAM2297 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2297 RNA, herein designated VGAM RNA, may have a different number of host target binding sites in untranslated regions of a VGAM2297 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2297 RNA, herein designated VGAM RNA, to host target binding sites on VGAM2297 host target RNA, herein designated VGAM HOST TARGET RNA, such as BINDING SITE I, BINDING SITE II and BINDING SITE III, inhibits translation of VGAM2297 host target RNA into VGAM2297 host target protein, herein designated VGAM HOST TARGET PROTEIN. VGAM host target protein is therefore outlined by a broken line.

It is appreciated that VGAM2297 host target gene, herein designated VGAM HOST TARGET GENE, in fact represents a plurality of VGAM2297 host target genes. The mRNA of each one of this plurality of VGAM2297 host target genes comprises one or more host target binding sites, each having a nucleotide sequence which is at least partly complementary to VGAM2297 RNA, herein designated VGAM RNA, and which when bound by VGAM2297 RNA causes inhibition of translation of respective one or more VGAM2297 host target proteins.

It is further appreciated by one skilled in the art that the mode of translational inhibition illustrated by FIG. 1 with specific reference to translational inhibition exerted by VGAM2297 gene, herein designated VGAM GENE, on one or more VGAM2297 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2297 is inhibition of expression of host target genes, as part of a novel viral mechanism of attacking a host. Accordingly, utilities of VGAM2297 include diagnosis, prevention and treatment of viral infection by Ectromelia Virus. Specific functions, and accordingly utilities, of VGAM2297 correlate with, and may be deduced from, the identity of the host target genes which VGAM2297 binds and inhibits, and the function of these host target genes, as elaborated hereinbelow.

Nucleotide sequences of the VGAM2297 precursor RNA, herein designated VGAM PRECURSOR RNA, and of the 'diced' VGAM2297 RNA, herein designated VGAM RNA, and a schematic representation of the secondary folding of VGAM2297 folded precursor RNA, herein designated VGAM FOLDED PRECURSOR RNA, of VGAM2297 are further described hereinbelow with reference to Table 1.

Nucleotide sequences of host target binding sites, such as BINDING SITE-I, BINDING SITE-II and BINDING SITE-III of FIG. 1, found on VGAM2297 host target RNA, and schematic representation of the complementarity of each of these host target binding sites to VGAM2297 RNA, herein designated VGAM RNA, are described hereinbelow with reference to Table 2.

As mentioned hereinabove with reference to FIG. 1, a function of VGAM2297 gene, herein designated VGAM is inhibition of expression of VGAM2297 target genes. It is appreciated that specific functions, and accordingly utilities, of VGAM2297 correlate with, and may be deduced from, the identity of the target genes which VGAM2297 binds and inhibits, and the function of these target genes, as elaborated hereinbelow.

Mitogen-activated Protein Kinase 14 (MAPK14, Accession NM_001315) is a VGAM2297 host target gene. MAPK14 BINDING SITE1 through MAPK14 BINDING SITE3 are HOST TARGET binding sites found in untranslated regions of mRNA encoded by MAPK14, corresponding to HOST TARGET binding sites such as BINDING SITE I, BINDING SITE II or BINDING SITE III. Table 2 illustrates the complementarity of the nucleotide sequences of MAPK14 BINDING SITE1 through MAPK14 BINDING SITE3, designated SEQ ID:7005, SEQ ID:29109 and SEQ ID:29116 respectively, to the nucleotide sequence of VGAM2297 RNA, herein designated VGAM RNA, also designated SEQ ID:5008.

A function of VGAM2297 is therefore inhibition of Mitogen-activated Protein Kinase 14 (MAPK14, Accession NM_001315), a gene which is important for cytokine production; responds to changes in extracellular osmolarity. Accordingly, utilities of VGAM2297 include diagnosis, prevention and treatment of diseases and clinical conditions associated with MAPK14. The function of MAPK14 and its association with various diseases and clinical conditions, has been established by previous studies, as described hereinabove with reference to VGAM107. FLJ25415 (Accession NM_144708) is another VGAM2297 host target gene. FLJ25415 BINDING SITE is HOST TARGET binding site found in the 5' untranslated region of mRNA encoded by FLJ25415, corresponding to a HOST TARGET binding site such as BINDING SITE I, BINDING SITE II or BINDING SITE III. Table 2 illustrates the complementarity of the nucleotide sequences of FLJ25415 BINDING SITE, designated SEQ ID:29532, to the nucleotide sequence of VGAM2297 RNA, herein designated VGAM RNA, also designated SEQ ID:5008.

Another function of VGAM2297 is therefore inhibition of FLJ25415 (Accession NM_144708). Accordingly, utilities of VGAM2297 include diagnosis, prevention and treatment of diseases and clinical conditions associated with FLJ25415. PRO2032 (Accession NM_018615) is another VGAM2297 host target gene. PRO2032 BINDING SITE is HOST TARGET binding site found in the 3' untranslated region of mRNA encoded by PRO2032, corresponding to a HOST TARGET binding site such as BINDING SITE I, BINDING SITE II or BINDING SITE III. Table 2 illustrates the complementarity of the nucleotide sequences of PRO2032 BINDING SITE, designated SEQ ID:20686, to the nucleotide sequence of VGAM2297 RNA, herein designated VGAM RNA, also designated SEQ ID:5008.

Another function of VGAM2297 is therefore inhibition of PRO2032 (Accession NM_018615). Accordingly, utilities of VGAM2297 include diagnosis, prevention and treatment of diseases and clinical conditions associated with PRO2032. PRO2730 (Accession NM_025222) is another VGAM2297 host target gene. PRO2730 BINDING SITE is HOST TARGET binding site found in the 5' untranslated region of mRNA encoded by PRO2730, corresponding to a HOST TARGET binding site such as BINDING SITE I, BINDING SITE II or BINDING SITE III. Table 2 illustrates the complementarity of the nucleotide sequences of PRO2730 BINDING SITE, designated SEQ ID:24899, to the nucleotide sequence of VGAM2297 RNA, herein designated VGAM RNA, also designated SEQ ID:5008.

Another function of VGAM2297 is therefore inhibition of PRO2730 (Accession NM_025222). Accordingly, utilities of VGAM2297 include diagnosis, prevention and treatment of diseases and clinical conditions associated with PRO2730.

LOC149830 (Accession XM_097746) is another VGAM2297 host target gene. LOC149830 BINDING SITE is HOST TARGET binding site found in the 3' untranslated region of mRNA encoded by LOC149830, corresponding to a HOST TARGET binding site such as BINDING SITE I, BINDING SITE II or BINDING SITE III. Table 2 illustrates the complementarity of the nucleotide sequences of LOC149830 BINDING SITE, designated SEQ ID:41094, to the nucleotide sequence of VGAM2297 RNA, herein designated VGAM RNA, also designated SEQ ID:5008.

Another function of VGAM2297 is therefore inhibition of LOC149830 (Accession XM_097746). Accordingly, utilities of VGAM2297 include diagnosis, prevention and treatment of diseases and clinical conditions associated with LOC149830. FIG. 1 further provides a conceptual description of a novel bioinformatically detected viral gene of the present invention, referred to here as Viral Genomic Address Messenger 2298 (VGAM2298) viral gene, which modulates expression of respective host target genes thereof, the function and utility of which host target genes is known in the art.

VGAM2298 is a novel bioinformatically detected regulatory, non protein coding, viral micro RNA (miRNA) gene. The method by which VGAM2298 was detected is described hereinabove with reference to FIGS. 1-8.

VGAM2298 gene, herein designated VGAM GENE, is a viral gene contained in the genome of Ectromelia Virus. VGAM2298 host target gene, herein designated VGAM HOST TARGET GENE, is a human gene contained in the human genome.

VGAM2298 gene encodes a VGAM2298 precursor RNA, herein designated VGAM PRECURSOR RNA. Similar to other miRNA genes, and unlike most ordinary genes, VGAM2298 precursor RNA does not encode a protein. A nucleotide sequence identical or highly similar to the nucleotide sequence of VGAM2298 precursor RNA is designated SEQ ID:2284, and is provided hereinbelow with reference to the sequence listing part. Nucleotide sequence SEQ ID:2284 is located at position 32155 relative to the genome of Ectromelia Virus.

VGAM2298 precursor RNA folds onto itself, forming VGAM2298 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2298 folded precursor RNA into VGAM2298 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2298 RNA is designated SEQ ID:5009, and is provided hereinbelow with reference to the sequence listing part.

VGAM2298 host target gene, herein designated VGAM HOST TARGET GENE, encodes a corresponding messenger RNA, VGAM2298 host target RNA, herein designated VGAM HOST TARGET RNA. VGAM2298 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2298 RNA, herein designated VGAM RNA, binds complementarily to one or more host target binding sites located in untranslated regions of VGAM2298 host target RNA, herein designated VGAM HOST TARGET RNA. This complementary binding is due to the fact that the nucleotide sequence of VGAM2298 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2298 RNA, herein designated VGAM RNA, may have a different number of host target binding sites in untranslated regions of a VGAM2298 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2298 RNA, herein designated VGAM RNA, to host target binding sites on VGAM2298 host target RNA, herein designated VGAM HOST TARGET RNA, such as BINDING SITE I, BINDING SITE II and BINDING SITE III, inhibits translation of VGAM2298 host target RNA into VGAM2298 host target protein, herein designated VGAM HOST TARGET PROTEIN. VGAM host target protein is therefore outlined by a broken line.

It is appreciated that VGAM2298 host target gene, herein designated VGAM HOST TARGET GENE, in fact represents a plurality of VGAM2298 host target genes. The mRNA of each one of this plurality of VGAM2298 host target genes comprises one or more host target binding sites, each having a nucleotide sequence which is at least partly complementary to VGAM2298 RNA, herein designated VGAM RNA, and which when bound by VGAM2298 RNA causes inhibition of translation of respective one or more VGAM2298 host target proteins.

It is further appreciated by one skilled in the art that the mode of translational inhibition illustrated by FIG. 1 with specific reference to translational inhibition exerted by VGAM2298 gene, herein designated VGAM GENE, on one or more VGAM2298 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2298 is inhibition of expression of host target genes, as part of a novel viral mechanism of attacking a host. Accordingly, utilities of VGAM2298 include diagnosis, prevention and treatment of viral infection by Ectromelia Virus. Specific functions, and accordingly utilities, of VGAM2298 correlate with, and may be deduced from, the identity of the host target genes which VGAM2298 binds and inhibits, and the function of these host target genes, as elaborated hereinbelow.

Nucleotide sequences of the VGAM2298 precursor RNA, herein designated VGAM PRECURSOR RNA, and of the 'diced' VGAM2298 RNA, herein designated VGAM RNA, and a schematic representation of the secondary folding of VGAM2298 folded precursor RNA, herein designated VGAM FOLDED PRECURSOR RNA, of VGAM2298 are further described hereinbelow with reference to Table 1.

Nucleotide sequences of host target binding sites, such as BINDING SITE-I, BINDING SITE-II and BINDING SITE-III of FIG. 1, found on VGAM2298 host target RNA, and schematic representation of the complementarity of each of these host target binding sites to VGAM2298 RNA, herein designated VGAM RNA, are described hereinbelow with reference to Table 2.

As mentioned hereinabove with reference to FIG. 1, a function of VGAM2298 gene, herein designated VGAM is inhibition of expression of VGAM2298 target genes. It is appreciated that specific functions, and accordingly utilities, of VGAM2298 correlate with, and may be deduced from, the identity of the target genes which VGAM2298 binds and inhibits, and the function of these target genes, as elaborated hereinbelow.

FK506 Binding Protein 14, 22 KDa (FKBP14, Accession NM_017946) is a VGAM2298 host target gene. FKBP14 BINDING SITE is HOST TARGET binding site found in the 3' untranslated region of mRNA encoded by FKBP14, corresponding to a HOST TARGET binding site such as BINDING SITE I, BINDING SITE II or BINDING SITE III. Table 2 illustrates the complementarity of the nucleotide sequences of FKBP14 BINDING SITE, designated SEQ ID:19643, to the nucleotide sequence of VGAM2298 RNA, herein designated VGAM RNA, also designated SEQ ID:5009.

A function of VGAM2298 is therefore inhibition of FK506 Binding Protein 14, 22 KDa (FKBP14, Accession NM_017946). Accordingly, utilities of VGAM2298 include diagnosis, prevention and treatment of diseases and clinical conditions associated with FKBP14. MDS028 (Accession NM_018463) is another VGAM2298 host target gene. MDS028 BINDING SITE is HOST TARGET binding site found in the 3' untranslated region of mRNA encoded by MDS028, corresponding to a HOST TARGET binding site such as BINDING SITE I, BINDING SITE II or BINDING SITE III. Table 2 illustrates the complementarity of the nucleotide sequences of MDS028 BINDING SITE, designated SEQ ID:20533, to the nucleotide sequence of VGAM2298 RNA, herein designated VGAM RNA, also designated SEQ ID:5009.

Another function of VGAM2298 is therefore inhibition of MDS028 (Accession NM_018463). Accordingly, utilities of VGAM2298 include diagnosis, prevention and treatment of diseases and clinical conditions associated with MDS028. LOC203429 (Accession XM_114701) is another VGAM2298 host target gene. LOC203429 BINDING SITE is HOST TARGET binding site found in the 3' untranslated region of mRNA encoded by LOC203429, corresponding to a HOST TARGET binding site such as BINDING SITE I, BINDING SITE II or BINDING SITE III. Table 2 illustrates the complementarity of the nucleotide sequences of LOC203429 BINDING SITE, designated SEQ ID:43047, to the nucleotide sequence of VGAM2298 RNA, herein designated VGAM RNA, also designated SEQ ID:5009.

Another function of VGAM2298 is therefore inhibition of LOC203429 (Accession XM_114701). Accordingly, utilities of VGAM2298 include diagnosis, prevention and treatment of diseases and clinical conditions associated with LOC203429. FIG. 1 further provides a conceptual description of a novel bioinformatically detected viral gene of the present invention, referred to here as Viral Genomic Address Messenger 2299 (VGAM2299) viral gene, which modulates expression of respective host target genes thereof, the function and utility of which host target genes is known in the art.

VGAM2299 is a novel bioinformatically detected regulatory, non protein coding, viral micro RNA (miRNA) gene. The method by which VGAM2299 was detected is described hereinabove with reference to FIGS. 1-8.

VGAM2299 gene, herein designated VGAM GENE, is a viral gene contained in the genome of Ectromelia Virus. VGAM2299 host target gene, herein designated VGAM HOST TARGET GENE, is a human gene contained in the human genome.

VGAM2299 gene encodes a VGAM2299 precursor RNA, herein designated VGAM PRECURSOR RNA. Similar to other miRNA genes, and unlike most ordinary genes, VGAM2299 precursor RNA does not encode a protein. A nucleotide sequence identical or highly similar to the nucleotide sequence of VGAM2299 precursor RNA is designated SEQ ID:2285, and is provided hereinbelow with reference to the sequence listing part. Nucleotide sequence SEQ ID:2285 is located at position 23346 relative to the genome of Ectromelia Virus.

VGAM2299 precursor RNA folds onto itself, forming VGAM2299 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2299 folded precursor RNA into VGAM2299 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2299 RNA is designated SEQ ID:5010, and is provided hereinbelow with reference to the sequence listing part.

VGAM2299 host target gene, herein designated VGAM HOST TARGET GENE, encodes a corresponding messenger RNA, VGAM2299 host target RNA, herein designated VGAM HOST TARGET RNA. VGAM2299 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2299 RNA, herein designated VGAM RNA, binds complementarily to one or more host target binding sites located in untranslated regions of VGAM2299 host target RNA, herein designated VGAM HOST TARGET RNA. This complementary binding is due to the fact that the nucleotide sequence of VGAM2299 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2299 RNA, herein designated VGAM RNA, may have a different number of host target binding sites in untranslated regions of a VGAM2299 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2299 RNA, herein designated VGAM RNA, to host target binding sites on VGAM2299 host target RNA, herein designated VGAM HOST TARGET RNA, such as BINDING SITE I, BINDING SITE II and BINDING SITE III, inhibits translation of VGAM2299 host target RNA into VGAM2299 host target protein, herein designated VGAM HOST TARGET PROTEIN. VGAM host target protein is therefore outlined by a broken line.

It is appreciated that VGAM2299 host target gene, herein designated VGAM HOST TARGET GENE, in fact represents a plurality of VGAM2299 host target genes. The mRNA of each one of this plurality of VGAM2299 host target genes comprises one or more host target binding sites, each having a nucleotide sequence which is at least partly complementary to VGAM2299 RNA, herein designated VGAM RNA, and which when bound by VGAM2299 RNA causes inhibition of translation of respective one or more VGAM2299 host target proteins.

It is further appreciated by one skilled in the art that the mode of translational inhibition illustrated by FIG. 1 with specific reference to translational inhibition exerted by VGAM2299 gene, herein designated VGAM GENE, on one or more VGAM2299 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2299 is inhibition of expression of host target genes, as part of a novel viral mechanism of attacking a host. Accordingly, utilities of VGAM2299 include diagnosis, prevention and treatment of viral infection by Ectromelia Virus. Specific functions, and accordingly utilities, of VGAM2299 correlate with, and may be deduced from, the identity of the host target genes which VGAM2299 binds and inhibits, and the function of these host target genes, as elaborated hereinbelow.

Nucleotide sequences of the VGAM2299 precursor RNA, herein designated VGAM PRECURSOR RNA, and of the 'diced' VGAM2299 RNA, herein designated VGAM RNA, and a schematic representation of the secondary folding of VGAM2299 folded precursor RNA, herein designated VGAM FOLDED PRECURSOR RNA, of VGAM2299 are further described hereinbelow with reference to Table 1.

Nucleotide sequences of host target binding sites, such as BINDING SITE-I, BINDING SITE-II and BINDING SITE-III of FIG. 1, found on VGAM2299 host target RNA, and schematic representation of the complementarity of each of these host target binding sites to VGAM2299 RNA, herein designated VGAM RNA, are described hereinbelow with reference to Table 2.

As mentioned hereinabove with reference to FIG. 1, a function of VGAM2299 gene, herein designated VGAM is inhibition of expression of VGAM2299 target genes. It is appreciated that specific functions, and accordingly utilities, of VGAM2299 correlate with, and may be deduced from, the identity of the target genes which VGAM2299 binds and inhibits, and the function of these target genes, as elaborated hereinbelow.

TYRO3 Protein Tyrosine Kinase (TYRO3, Accession NM_006293) is a VGAM2299 host target gene. TYRO3 BINDING SITE is HOST TARGET binding site found in the 5' untranslated region of mRNA encoded by TYRO3, corresponding to a HOST TARGET binding site such as BINDING SITE I, BINDING SITE II or BINDING SITE III. Table 2 illustrates the complementarity of the nucleotide sequences of TYRO3 BINDING SITE, designated SEQ ID:12983, to the nucleotide sequence of VGAM2299 RNA, herein designated VGAM RNA, also designated SEQ ID:5010.

A function of VGAM2299 is therefore inhibition of TYRO3 Protein Tyrosine Kinase (TYRO3, Accession NM_006293), a gene which may be involved in cell adhesion processes, particularly in the central nervous system. Accordingly, utilities of VGAM2299 include diagnosis, prevention and treatment of diseases and clinical conditions associated with TYRO3. The function of TYRO3 and its association with various diseases and clinical conditions, has been established by previous studies, as described hereinabove with reference to VGAM711. FIG. 1 further provides a conceptual description of a novel bioinformatically detected viral gene of the present invention, referred to here as Viral Genomic Address Messenger 2300 (VGAM2300) viral gene, which modulates expression of respective host target genes thereof, the function and utility of which host target genes is known in the art.

VGAM2300 is a novel bioinformatically detected regulatory, non protein coding, viral micro RNA (miRNA) gene. The method by which VGAM2300 was detected is described hereinabove with reference to FIGS. 1-8.

VGAM2300 gene, herein designated VGAM GENE, is a viral gene contained in the genome of Ectromelia Virus. VGAM2300 host target gene, herein designated VGAM HOST TARGET GENE, is a human gene contained in the human genome.

VGAM2300 gene encodes a VGAM2300 precursor RNA, herein designated VGAM PRECURSOR RNA. Similar to other miRNA genes, and unlike most ordinary genes, VGAM2300 precursor RNA does not encode a protein. A nucleotide sequence identical or highly similar to the nucleotide sequence of VGAM2300 precursor RNA is designated SEQ ID:2286, and is provided hereinbelow with reference to the sequence listing part. Nucleotide sequence SEQ ID:2286 is located at position 38978 relative to the genome of Ectromelia Virus.

VGAM2300 precursor RNA folds onto itself, forming VGAM2300 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2300 folded precursor RNA into VGAM2300 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM2300 RNA is designated SEQ ID:5011, and is provided hereinbelow with reference to the sequence listing part.

VGAM2300 host target gene, herein designated VGAM HOST TARGET GENE, encodes a corresponding messenger RNA, VGAM2300 host target RNA, herein designated VGAM HOST TARGET RNA. VGAM2300 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2300 RNA, herein designated VGAM RNA, binds complementarily to one or more host target binding sites located in untranslated regions of VGAM2300 host target RNA, herein designated VGAM HOST TARGET RNA. This complementary binding is due to the fact that the nucleotide sequence of VGAM2300 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2300 RNA, herein designated VGAM RNA, may have a different number of host target binding sites in untranslated regions of a VGAM2300 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2300 RNA, herein designated VGAM RNA, to host target binding sites on VGAM2300 host target RNA, herein designated VGAM HOST TARGET RNA, such as BINDING SITE I, BINDING SITE II and BINDING SITE III, inhibits translation of VGAM2300 host target RNA into VGAM2300 host target protein, herein designated VGAM HOST TARGET PROTEIN. VGAM host target protein is therefore outlined by a broken line.

It is appreciated that VGAM2300 host target gene, herein designated VGAM HOST TARGET GENE, in fact represents a plurality of VGAM2300 host target genes. The mRNA of each one of this plurality of VGAM2300 host target genes comprises one or more host target binding sites, each having a nucleotide sequence which is at least partly complementary to VGAM2300 RNA, herein designated VGAM RNA, and which when bound by VGAM2300 RNA causes inhibition of translation of respective one or more VGAM2300 host target proteins.

It is further appreciated by one skilled in the art that the mode of translational inhibition illustrated by FIG. 1 with specific reference to translational inhibition exerted by VGAM2300 gene, herein designated VGAM GENE, on one or more VGAM2300 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2300 is inhibition of expression of host target genes, as part of a novel viral mechanism of attacking a host. Accordingly, utilities of VGAM2300 include diagnosis, prevention and treatment of viral infection by Ectromelia Virus. Specific functions, and accordingly utilities, of VGAM2300 correlate with, and may be deduced from, the identity of the host target genes which VGAM2300 binds and inhibits, and the function of these host target genes, as elaborated hereinbelow.

Nucleotide sequences of the VGAM2300 precursor RNA, herein designated VGAM PRECURSOR RNA, and of the 'diced' VGAM2300 RNA, herein designated VGAM RNA, and a schematic representation of the secondary folding of VGAM2300 folded precursor RNA, herein designated VGAM FOLDED PRECURSOR RNA, of VGAM2300 are further described hereinbelow with reference to Table 1.

Nucleotide sequences of host target binding sites, such as BINDING SITE-I, BINDING SITE-II and BINDING SITE-III of FIG. 1, found on VGAM2300 host target RNA, and schematic representation of the complementarity of each of these host target binding sites to VGAM2300 RNA, herein designated VGAM RNA, are described hereinbelow with reference to Table 2.

As mentioned hereinabove with reference to FIG. 1, a function of VGAM2300 gene, herein designated VGAM is inhibition of expression of VGAM2300 target genes. It is appreciated that specific functions, and accordingly utilities, of VGAM2300 correlate with, and may be deduced from, the identity of the target genes which VGAM2300 binds and inhibits, and the function of these target genes, as elaborated hereinbelow.

RAD17 Homolog (S. pombe) (RAD17, Accession NM_002873) is a VGAM2300 host target gene. RAD17 BINDING SITE1 through RAD17 BINDING SITE6 are HOST TARGET binding sites found in untranslated regions of mRNA encoded by RAD17, corresponding to HOST TARGET binding sites such as BINDING SITE I, BINDING SITE II or BINDING SITE III. Table 2 illustrates the complementarity of the nucleotide sequences of RAD17 BINDING SITE1 through RAD17 BINDING SITE6, designated SEQ ID:8783, SEQ ID:28480, SEQ ID:28484, SEQ ID:28486, SEQ ID:28488 and SEQ ID:28490 respectively, to the nucleotide sequence of VGAM2300 RNA, herein designated VGAM RNA, also designated SEQ ID:5011.

A function of VGAM2300 is therefore inhibition of RAD17 Homolog (S. pombe) (RAD17, Accession NM_002873), a gene which may have a role in DNA damage-dependent and DNA replication-dependent cell cycle checkpoints. Accordingly, utilities of VGAM2300 include diagnosis, prevention and treatment of diseases and clinical conditions associated with RAD17. The function of RAD17 and its association with various diseases and clinical conditions, has been established by previous studies, as described hereinabove with reference to VGAM209. Testis-specific Transcript, Y-linked 2 (TTTY2, Accession XM_099029) is another VGAM2300 host target gene. TTTY2 BINDING SITE is HOST TARGET binding site found in the 5' untranslated region of mRNA encoded by TTTY2, corresponding to a HOST TARGET binding site such as BINDING SITE I, BINDING SITE II or BINDING SITE III. Table 2 illustrates the complementarity of the nucleotide sequences of TTTY2 BINDING SITE, designated SEQ ID:42071, to the nucleotide sequence of VGAM2300 RNA, herein designated VGAM RNA, also designated SEQ ID:5011.

Another function of VGAM2300 is therefore inhibition of Testis-specific Transcript, Y-linked 2 (TTTY2, Accession XM_099029). Accordingly, utilities of VGAM2300 include diagnosis, prevention and treatment of diseases and clinical conditions associated with TTTY2. LOC149606 (Accession XM_086600) is another VGAM2300 host target gene. LOC149606 BINDING SITE is HOST TARGET binding site found in the 3' untranslated region of mRNA encoded by LOC149606, corresponding to a HOST TARGET binding site such as BINDING SITE I, BINDING SITE II or BINDING SITE III. Table 2 illustrates the complementarity of the nucleotide sequences of LOC149606 BINDING SITE, designated SEQ ID:38783, to the nucleotide sequence of VGAM2300 RNA, herein designated VGAM RNA, also designated SEQ ID:5011.

Another function of VGAM2300 is therefore inhibition of LOC149606 (Accession XM_086600). Accordingly, utilities of VGAM2300 include diagnosis, prevention and treatment of diseases and clinical conditions associated with LOC149606. LOC159148 (Accession XM_099030) is another VGAM2300 host target gene. LOC159148 BINDING SITE is HOST TARGET binding site found in the 5' untranslated region of mRNA encoded by LOC159148, corresponding to a HOST TARGET binding site such as BINDING SITE I, BINDING SITE II or BINDING SITE III. Table 2 illustrates the complementarity of the nucleotide sequences of LOC159148 BINDING SITE, designated SEQ ID:42078, to the nucleotide sequence of VGAM2300 RNA, herein designated VGAM RNA, also designated SEQ ID:5011.

Another function of VGAM2300 is therefore inhibition of LOC159148 (Accession XM_099030). Accordingly, utilities of VGAM2300 include diagnosis, prevention and treatment of diseases and clinical conditions associated with LOC159148. FIG. 1 further provides a conceptual description of a novel bioinformatically detected viral gene of the present invention, referred to here as Viral Genomic Address Messenger 2301 (VGAM2301) viral gene, which modulates expression of respective host target genes thereof, the function and utility of which host target genes is known in the art.

VGAM2301 is a novel bioinformatically detected regulatory, non protein coding, viral micro RNA (miRNA) gene. The method by which VGAM2301 was detected is described hereinabove with reference to FIGS. 1-8.

VGAM2301 gene, herein designated VGAM GENE, is a viral gene contained in the genome of Ectromelia Virus. VGAM2301 host target gene, herein designated VGAM HOST TARGET GENE, is a human gene contained in the human genome.

VGAM2301 gene encodes a VGAM2301 precursor RNA, herein designated VGAM PRECURSOR RNA. Similar to other miRNA genes, and unlike most ordinary genes, VGAM2301 precursor RNA does not encode a protein. A nucleotide sequence identical or highly similar to the nucleotide sequence of VGAM2301 precursor RNA is designated SEQ ID:2287, and is provided hereinbelow with reference to the sequence listing part. Nucleotide sequence SEQ ID:2287 is located at position 30387 relative to the genome of Ectromelia Virus.

VGAM2301 precursor RNA folds onto itself, forming VGAM2301 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2301 folded precursor RNA into VGAM2301 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2301 RNA is designated SEQ ID:5012, and is provided hereinbelow with reference to the sequence listing part.

VGAM2301 host target gene, herein designated VGAM HOST TARGET GENE, encodes a corresponding messenger RNA, VGAM2301 host target RNA, herein designated VGAM HOST TARGET RNA. VGAM2301 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2301 RNA, herein designated VGAM RNA, binds complementarily to one or more host target binding sites located in untranslated regions of VGAM2301 host target RNA, herein designated VGAM HOST TARGET RNA. This complementary binding is due to the fact that the nucleotide sequence of VGAM2301 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2301 RNA, herein designated VGAM RNA, may have a different number of host target binding sites in untranslated regions of a VGAM2301 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2301 RNA, herein designated VGAM RNA, to host target binding sites on VGAM2301 host target RNA, herein designated VGAM HOST TARGET RNA, such as BINDING SITE I, BINDING SITE II and BINDING SITE III, inhibits translation of VGAM2301 host target RNA into VGAM2301 host target protein, herein designated VGAM HOST TARGET PROTEIN. VGAM host target protein is therefore outlined by a broken line.

It is appreciated that VGAM2301 host target gene, herein designated VGAM HOST TARGET GENE, in fact represents a plurality of VGAM2301 host target genes. The mRNA of each one of this plurality of VGAM2301 host target genes comprises one or more host target binding sites, each having a nucleotide sequence which is at least partly complementary to VGAM2301 RNA, herein designated VGAM RNA, and which when bound by VGAM2301 RNA causes inhibition of translation of respective one or more VGAM2301 host target proteins.

It is further appreciated by one skilled in the art that the mode of translational inhibition illustrated by FIG. 1 with specific reference to translational inhibition exerted by VGAM2301 gene, herein designated VGAM GENE, on one or more VGAM2301 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2301 is inhibition of expression of host target genes, as part of a novel viral mechanism of attacking a host. Accordingly, utilities of VGAM2301 include diagnosis, prevention and treatment of viral infection by Ectromelia Virus. Specific functions, and accordingly utilities, of VGAM2301 correlate with, and may be deduced from, the identity of the host target genes which VGAM2301 binds and inhibits, and the function of these host target genes, as elaborated hereinbelow.

Nucleotide sequences of the VGAM2301 precursor RNA, herein designated VGAM PRECURSOR RNA, and of the 'diced' VGAM2301 RNA, herein designated VGAM RNA, and a schematic representation of the secondary folding of VGAM2301 folded precursor RNA, herein designated VGAM FOLDED PRECURSOR RNA, of VGAM2301 are further described hereinbelow with reference to Table 1.

Nucleotide sequences of host target binding sites, such as BINDING SITE-I, BINDING SITE-II and BINDING SITE-III of FIG. 1, found on VGAM2301 host target RNA, and schematic representation of the complementarity of each of these host target binding sites to VGAM2301 RNA, herein designated VGAM RNA, are described hereinbelow with reference to Table 2.

As mentioned hereinabove with reference to FIG. 1, a function of VGAM2301 gene, herein designated VGAM is inhibition of expression of VGAM2301 target genes. It is appreciated that specific functions, and accordingly utilities, of VGAM2301 correlate with, and may be deduced from, the identity of the target genes which VGAM2301 binds and inhibits, and the function of these target genes, as elaborated hereinbelow.

Ankyrin Repeat Domain 6 (ANKRD6, Accession NM_014942) is a VGAM2301 host target gene. ANKRD6 BINDING SITE is HOST TARGET binding site found in the 3' untranslated region of mRNA encoded by ANKRD6, corresponding to a HOST TARGET binding site such as BINDING SITE I, BINDING SITE II or BINDING SITE III. Table 2 illustrates the complementarity of the nucleotide sequences of ANKRD6 BINDING SITE, designated SEQ ID:17252, to the nucleotide sequence of VGAM2301 RNA, herein designated VGAM RNA, also designated SEQ ID:5012.

A function of VGAM2301 is therefore inhibition of Ankyrin Repeat Domain 6 (ANKRD6, Accession NM_014942). Accordingly, utilities of VGAM2301 include diagnosis, prevention and treatment of diseases and clinical conditions associated with ANKRD6. DKFZP564O1863 (Accession XM_043922) is another VGAM2301 host target gene. DKFZP564O1863 BINDING SITE is HOST TARGET binding site found in the 3' untranslated region of mRNA encoded by DKFZP564O1863, corresponding to a HOST TARGET binding site such as BINDING SITE I, BINDING SITE II or BINDING SITE III. Table 2 illustrates the complementarity of the nucleotide sequences of DKFZP564O1863 BINDING SITE, designated SEQ ID:34044, to the nucleotide sequence of VGAM2301 RNA, herein designated VGAM RNA, also designated SEQ ID:5012.

Another function of VGAM2301 is therefore inhibition of DKFZP564O1863 (Accession XM_043922). Accordingly, utilities of VGAM2301 include diagnosis, prevention and treatment of diseases and clinical conditions associated with DKFZP564O1863. FIG. 1 further provides a conceptual description of a novel bioinformatically detected viral gene of the present invention, referred to here as Viral Genomic Address Messenger 2302 (VGAM2302) viral gene, which modulates expression of respective host target genes thereof, the function and utility of which host target genes is known in the art.

VGAM2302 is a novel bioinformatically detected regulatory, non protein coding, viral micro RNA (miRNA) gene. The method by which VGAM2302 was detected is described hereinabove with reference to FIGS. 1-8.

VGAM2302 gene, herein designated VGAM GENE, is a viral gene contained in the genome of Ectromelia Virus. VGAM2302 host target gene, herein designated VGAM HOST TARGET GENE, is a human gene contained in the human genome.

VGAM2302 gene encodes a VGAM2302 precursor RNA, herein designated VGAM PRECURSOR RNA. Similar to other miRNA genes, and unlike most ordinary genes, VGAM2302 precursor RNA does not encode a protein. A nucleotide sequence identical or highly similar to the nucleotide sequence of VGAM2302 precursor RNA is designated SEQ ID:2288, and is provided hereinbelow with reference to the sequence listing part. Nucleotide sequence SEQ ID:2288 is located at position 44731 relative to the genome of Ectromelia Virus.

VGAM2302 precursor RNA folds onto itself, forming VGAM2302 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2302 folded precursor RNA into VGAM2302 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2302 RNA is designated SEQ ID:5013, and is provided hereinbelow with reference to the sequence listing part.

VGAM2302 host target gene, herein designated VGAM HOST TARGET GENE, encodes a corresponding messenger RNA, VGAM2302 host target RNA, herein designated VGAM HOST TARGET RNA. VGAM2302 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2302 RNA, herein designated VGAM RNA, binds complementarily to one or more host target binding sites located in untranslated regions of VGAM2302 host target RNA, herein designated VGAM HOST TARGET RNA. This complementary binding is due to the fact that the nucleotide sequence of VGAM2302 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2302 RNA, herein designated VGAM RNA, may have a different number of host target binding sites in untranslated regions of a VGAM2302 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2302 RNA, herein designated VGAM RNA, to host target binding sites on VGAM2302 host target RNA, herein designated VGAM HOST TARGET RNA, such as BINDING SITE I, BINDING SITE II and BINDING SITE III, inhibits translation of VGAM2302 host target RNA into VGAM2302 host target protein, herein designated VGAM HOST TARGET PROTEIN. VGAM host target protein is therefore outlined by a broken line.

It is appreciated that VGAM2302 host target gene, herein designated VGAM HOST TARGET GENE, in fact represents a plurality of VGAM2302 host target genes. The mRNA of each one of this plurality of VGAM2302 host target genes comprises one or more host target binding sites, each having a nucleotide sequence which is at least partly complementary to VGAM2302 RNA, herein designated VGAM RNA, and which when bound by VGAM2302 RNA causes inhibition of translation of respective one or more VGAM2302 host target proteins.

It is further appreciated by one skilled in the art that the mode of translational inhibition illustrated by FIG. 1 with specific reference to translational inhibition exerted by VGAM2302 gene, herein designated VGAM GENE, on one or more VGAM2302 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2302 is inhibition of expression of host target genes, as part of a novel viral mechanism of attacking a host. Accordingly, utilities of VGAM2302 include diagnosis, prevention and treatment of viral infection by Ectromelia Virus. Specific functions, and accordingly utilities, of VGAM2302 correlate with, and may be deduced from, the identity of the host target genes which VGAM2302 binds and inhibits, and the function of these host target genes, as elaborated hereinbelow.

Nucleotide sequences of the VGAM2302 precursor RNA, herein designated VGAM PRECURSOR RNA, and of the 'diced' VGAM2302 RNA, herein designated VGAM RNA, and a schematic representation of the secondary folding of VGAM2302 folded precursor RNA, herein designated VGAM FOLDED PRECURSOR RNA, of VGAM2302 are further described hereinbelow with reference to Table 1.

Nucleotide sequences of host target binding sites, such as BINDING SITE-I, BINDING SITE-II and BINDING SITE-III of FIG. 1, found on VGAM2302 host target RNA, and schematic representation of the complementarity of each of these host target binding sites to VGAM2302 RNA, herein designated VGAM RNA, are described hereinbelow with reference to Table 2.

As mentioned hereinabove with reference to FIG. 1, a function of VGAM2302 gene, herein designated VGAM is inhibition of expression of VGAM2302 target genes. It is appreciated that specific functions, and accordingly utilities, of VGAM2302 correlate with, and may be deduced from, the identity of the target genes which VGAM2302 binds and inhibits, and the function of these target genes, as elaborated hereinbelow.

Carbonic Anhydrase XII (CA12, Accession NM_001218) is a VGAM2302 host target gene. CA12 BINDING SITE is HOST TARGET binding site found in the 3' untranslated region of mRNA encoded by CA12, corresponding to a HOST TARGET binding site such as BINDING SITE I, BINDING SITE II or BINDING SITE III. Table 2 illustrates the complementarity of the nucleotide sequences of CA12 BINDING SITE, designated SEQ ID:6881, to the nucleotide sequence of VGAM2302 RNA, herein designated VGAM RNA, also designated SEQ ID:5013.

A function of VGAM2302 is therefore inhibition of Carbonic Anhydrase XII (CA12, Accession NM_001218), a gene which functions in cellular transport and metabolic processes. Accordingly, utilities of VGAM2302 include diagnosis, prevention and treatment of diseases and clinical conditions associated with CA12. The function of CA12 and its association with various diseases and clinical conditions, has been established by previous studies, as described hereinabove with reference to VGAM508. Cytoplasmic Linker Associated Protein 2 (CLASP2, Accession XM_035453) is another VGAM2302 host target gene. CLASP2 BINDING SITE is HOST TARGET binding site found in the 3' untranslated region of mRNA encoded by CLASP2, corresponding to a HOST TARGET binding site such as BINDING SITE I, BINDING SITE II or BINDING SITE III. Table 2 illustrates the complementarity of the nucleotide sequences of CLASP2 BINDING SITE, designated SEQ ID:32270, to the nucleotide sequence of VGAM2302 RNA, herein designated VGAM RNA, also designated SEQ ID:5013.

Another function of VGAM2302 is therefore inhibition of Cytoplasmic Linker Associated Protein 2 (CLASP2, Accession XM_035453), a gene which is involved in the regional regulation of microtubule dynamics in motile fibroblasts. Accordingly, utilities of VGAM2302 include diagnosis, prevention and treatment of diseases and clinical conditions associated with CLASP2. The function of CLASP2 and its association with various diseases and clinical conditions, has been established by previous studies, as described hereinabove with reference to VGAM897. Cytochrome P450, Subfamily XXIV (vitamin D 24-hydroxylase) (CYP24, Accession NM_000782) is another VGAM2302 host target gene. CYP24 BINDING SITE is HOST TARGET binding site found in the 3' untranslated region of mRNA encoded by CYP24, corresponding to a HOST TARGET binding site such as BINDING SITE I, BINDING SITE II or BINDING SITE III. Table 2 illustrates the complementarity of the nucleotide sequences of CYP24 BINDING SITE, designated SEQ ID:6427, to the nucleotide sequence of VGAM2302 RNA, herein designated VGAM RNA, also designated SEQ ID:5013.

Another function of VGAM2302 is therefore inhibition of Cytochrome P450, Subfamily XXIV (vitamin D 24-hydroxylase) (CYP24, Accession NM_000782), a gene which induces the differentiation of promyelocytes into monocytes/macrophages. Accordingly, utilities of VGAM2302 include diagnosis, prevention and treatment of diseases and clinical conditions associated with CYP24. The function of CYP24 and its association with various diseases and clinical conditions, has been established by previous studies, as described hereinabove with reference to VGAM1204. G Protein-coupled Receptor 48 (GPR48, Accession NM_018490) is another VGAM2302 host target gene. GPR48 BINDING SITE is HOST TARGET binding site found in the 3' untranslated region of mRNA encoded by GPR48, corresponding to a HOST TARGET binding site such as BINDING SITE I, BINDING SITE II or BINDING SITE III. Table 2 illustrates the complementarity of the nucleotide sequences of GPR48 BINDING SITE, designated SEQ ID:20549, to the nucleotide sequence of VGAM2302 RNA, herein designated VGAM RNA, also designated SEQ ID:5013.

Another function of VGAM2302 is therefore inhibition of G Protein-coupled Receptor 48 (GPR48, Accession NM_018490), a gene which binds to follicle-stimulating hormone and thyroid-stimulating hormone. Accordingly, utilities of VGAM2302 include diagnosis, prevention and treatment of diseases and clinical conditions associated with GPR48. The function of GPR48 and its association with various diseases and clinical conditions, has been established by previous studies, as described hereinabove with reference to VGAM376. Phosphatidylinositol Glycan, Class A (paroxysmal nocturnal hemoglobinuria) (PIGA, Accession NM_020472) is another VGAM2302 host target gene. PIGA BINDING SITE1 and PIGA BINDING SITE2 are HOST TARGET binding sites found in untranslated regions of mRNA encoded by PIGA, corresponding to HOST TARGET binding sites such as BINDING SITE I, BINDING SITE II or BINDING SITE III. Table 2 illustrates the complementarity of the nucleotide sequences of PIGA BINDING SITE1 and PIGA BINDING SITE2, designated SEQ ID:21710 and SEQ ID:21717 respectively, to the nucleotide sequence of VGAM2302 RNA, herein designated VGAM RNA, also designated SEQ ID:5013.

Another function of VGAM2302 is therefore inhibition of Phosphatidylinositol Glycan, Class A (paroxysmal nocturnal hemoglobinuria) (PIGA, Accession NM_020472). Accordingly, utilities of VGAM2302 include diagnosis, prevention and treatment of diseases and clinical conditions associated with PIGA. Translocase of Outer Mitochondrial Membrane 70 Homolog A (yeast) (TOMM70A, Accession NM_014820) is another VGAM2302 host target gene. TOMM70A BINDING SITE is HOST TARGET binding site found in the 3' untranslated region of mRNA encoded by TOMM70A, corresponding to a HOST TARGET binding site such as BINDING SITE I, BINDING SITE II or BINDING SITE III. Table 2 illustrates the complementarity of the nucleotide sequences of TOMM70A BINDING SITE, designated SEQ ID:16787, to the nucleotide sequence of VGAM2302 RNA, herein designated VGAM RNA, also designated SEQ ID:5013.

Another function of VGAM2302 is therefore inhibition of Translocase of Outer Mitochondrial Membrane 70 Homolog A (yeast) (TOMM70A, Accession NM_014820). Accordingly, utilities of VGAM2302 include diagnosis, prevention and treatment of diseases and clinical conditions associated with TOMM70A. LOC145815 (Accession XM_096874) is another VGAM2302 host target gene. LOC145815 BINDING SITE is HOST TARGET binding site found in the 5' untranslated region of mRNA encoded by LOC145815, corresponding to a HOST TARGET binding site such as BINDING SITE I, BINDING SITE II or BINDING SITE III. Table 2 illustrates the complementarity of the nucleotide sequences of LOC145815 BINDING SITE, designated SEQ ID:40606, to the nucleotide sequence of VGAM2302 RNA, herein designated VGAM RNA, also designated SEQ ID:5013.

Another function of VGAM2302 is therefore inhibition of LOC145815 (Accession XM_096874). Accordingly, utilities of VGAM2302 include diagnosis, prevention and treatment of diseases and clinical conditions associated with LOC145815. FIG. 1 further provides a conceptual description of a novel bioinformatically detected viral gene of the present invention, referred to here as Viral Genomic Address Messenger 2303 (VGAM2303) viral gene, which modulates expression of respective host target genes thereof, the function and utility of which host target genes is known in the art.

VGAM2303 is a novel bioinformatically detected regulatory, non protein coding, viral micro RNA (miRNA) gene. The method by which VGAM2303 was detected is described hereinabove with reference to FIGS. 1-8.

VGAM2303 gene, herein designated VGAM GENE, is a viral gene contained in the genome of Ectromelia Virus. VGAM2303 host target gene, herein designated VGAM HOST TARGET GENE, is a human gene contained in the human genome.

VGAM2303 gene encodes a VGAM2303 precursor RNA, herein designated VGAM PRECURSOR RNA. Similar to other miRNA genes, and unlike most ordinary genes, VGAM2303 precursor RNA does not encode a protein. A nucleotide sequence identical or highly similar to the nucleotide sequence of VGAM2303 precursor RNA is designated SEQ ID:2289, and is provided hereinbelow with reference to the sequence listing part. Nucleotide sequence SEQ ID:2289 is located at position 38706 relative to the genome of Ectromelia Virus.

VGAM2303 precursor RNA folds onto itself, forming VGAM2303 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2303 folded precursor RNA into VGAM2303 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2303 RNA is designated SEQ ID:5014, and is provided hereinbelow with reference to the sequence listing part.

VGAM2303 host target gene, herein designated VGAM HOST TARGET GENE, encodes a corresponding messenger RNA, VGAM2303 host target RNA, herein designated VGAM HOST TARGET RNA. VGAM2303 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2303 RNA, herein designated VGAM RNA, binds complementarily to one or more host target binding sites located in untranslated regions of VGAM2303 host target RNA, herein designated VGAM HOST TARGET RNA. This complementary binding is due to the fact that the nucleotide sequence of VGAM2303 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2303 RNA, herein designated VGAM RNA, may have a different number of host target binding sites in untranslated regions of a VGAM2303 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2303 RNA, herein designated VGAM RNA, to host target binding sites on VGAM2303 host target RNA, herein designated VGAM HOST TARGET RNA, such as BINDING SITE I, BINDING SITE II and BINDING SITE III, inhibits translation of VGAM2303 host target RNA into VGAM2303 host target protein, herein designated VGAM HOST TARGET PROTEIN. VGAM host target protein is therefore outlined by a broken line.

It is appreciated that VGAM2303 host target gene, herein designated VGAM HOST TARGET GENE, in fact represents a plurality of VGAM2303 host target genes. The mRNA of each one of this plurality of VGAM2303 host target genes comprises one or more host target binding sites, each having a nucleotide sequence which is at least partly complementary to VGAM2303 RNA, herein designated VGAM RNA, and which when bound by VGAM2303 RNA causes inhibition of translation of respective one or more VGAM2303 host target proteins.

It is further appreciated by one skilled in the art that the mode of translational inhibition illustrated by FIG. 1 with specific reference to translational inhibition exerted by VGAM2303 gene, herein designated VGAM GENE, on one or more VGAM2303 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2303 is inhibition of expression of host target genes, as part of a novel viral mechanism of attacking a host. Accordingly, utilities of VGAM2303 include diagnosis, prevention and treatment of viral infection by Ectromelia Virus. Specific functions, and accordingly utilities, of VGAM2303 correlate with, and may be deduced from, the identity of the host target genes which VGAM2303 binds and inhibits, and the function of these host target genes, as elaborated hereinbelow.

Nucleotide sequences of the VGAM2303 precursor RNA, herein designated VGAM PRECURSOR RNA, and of the 'diced' VGAM2303 RNA, herein designated VGAM RNA, and a schematic representation of the secondary folding of VGAM2303 folded precursor RNA, herein designated VGAM FOLDED PRECURSOR RNA, of VGAM2303 are further described hereinbelow with reference to Table 1.

Nucleotide sequences of host target binding sites, such as BINDING SITE-I, BINDING SITE-II and BINDING SITE-III of FIG. 1, found on VGAM2303 host target RNA, and schematic representation of the complementarity of each of these host target binding sites to VGAM2303 RNA, herein designated VGAM RNA, are described hereinbelow with reference to Table 2.

As mentioned hereinabove with reference to FIG. 1, a function of VGAM2303 gene, herein designated VGAM is inhibition of expression of VGAM2303 target genes. It is appreciated that specific functions, and accordingly utilities, of VGAM2303 correlate with, and may be deduced from, the identity of the target genes which VGAM2303 binds and inhibits, and the function of these target genes, as elaborated hereinbelow.

Actinin, Alpha 2 (ACTN2, Accession NM_001103) is a VGAM2303 host target gene. ACTN2 BINDING SITE is HOST TARGET binding site found in the 3' untranslated region of mRNA encoded by ACTN2, corresponding to a HOST TARGET binding site such as BINDING SITE I, BINDING SITE II or BINDING SITE III. Table 2 illustrates the complementarity of the nucleotide sequences of ACTN2 BINDING SITE, designated SEQ ID:6757, to the nucleotide sequence of VGAM2303 RNA, herein designated VGAM RNA, also designated SEQ ID:5014.

A function of VGAM2303 is therefore inhibition of Actinin, Alpha 2 (ACTN2, Accession NM_001103), a gene which an actin-binding protein with multiple roles in different cell types. Accordingly, utilities of VGAM2303 include diagnosis, prevention and treatment of diseases and clinical conditions associated with ACTN2. The function of ACTN2 and its association with various diseases and clinical conditions, has been established by previous studies, as described hereinabove with reference to VGAM88. Centaurin, Delta 1 (CENTD1, Accession NM_015230) is another VGAM2303 host target gene. CENTD1 BINDING SITE1 and CENTD1 BINDING SITE2 are HOST TARGET binding sites found in untranslated regions of mRNA encoded by CENTD1, corresponding to HOST TARGET binding sites such as BINDING SITE I, BINDING SITE II or BINDING SITE III. Table 2 illustrates the complementarity of the nucleotide sequences of CENTD1 BINDING SITE1 and CENTD1 BINDING SITE2, designated SEQ ID:17561 and SEQ ID:29199 respectively, to the nucleotide sequence of VGAM2303 RNA, herein designated VGAM RNA, also designated SEQ ID:5014.

Another function of VGAM2303 is therefore inhibition of Centaurin, Delta 1 (CENTD1, Accession NM_015230), a gene which is nvolved in cell signaling/communication. Accordingly, utilities of VGAM2303 include diagnosis, prevention and treatment of diseases and clinical conditions associated with CENTD1. The function of CENTD1 and its association with various diseases and clinical conditions, has been established by previous studies, as described hereinabove with reference to VGAM445. Synapsin III (SYN3, Accession NM_133633) is another VGAM2303 host target gene. SYN3 BINDING SITE1 through SYN3 BINDING SITE3 are HOST TARGET binding sites found in untranslated regions of mRNA encoded by SYN3, corresponding to HOST TARGET binding sites such as BINDING SITE I, BINDING SITE II or BINDING SITE III. Table 2 illustrates the complementarity of the nucleotide sequences of SYN3 BINDING SITE1 through SYN3 BINDING SITE3, designated SEQ ID:28594, SEQ ID:9583 and SEQ ID:19543 respectively, to the nucleotide sequence of VGAM2303 RNA, herein designated VGAM RNA, also designated SEQ ID:5014.

Another function of VGAM2303 is therefore inhibition of Synapsin III (SYN3, Accession NM_133633), a gene which may be involved in the regulation of neurotransmitter release and synaptogenesis. Accordingly, utilities of VGAM2303 include diagnosis, prevention and treatment of diseases and clinical conditions associated with SYN3. The function of SYN3 and its association with various diseases and clinical conditions, has been established by previous studies, as described hereinabove with reference to VGAM925. LOC219688 (Accession XM_167568) is another VGAM2303 host target gene. LOC219688 BINDING SITE is HOST TARGET binding site found in the 5' untranslated region of mRNA encoded by LOC219688, corresponding to a HOST TARGET binding site such as BINDING SITE I, BINDING SITE II or BINDING SITE III. Table 2 illustrates the complementarity of the nucleotide sequences of LOC219688 BINDING SITE, designated SEQ ID:44697, to the nucleotide sequence of VGAM2303 RNA, herein designated VGAM RNA, also designated SEQ ID:5014.

Another function of VGAM2303 is therefore inhibition of LOC219688 (Accession XM_167568). Accordingly, utilities of VGAM2303 include diagnosis, prevention and treatment of diseases and clinical conditions associated with LOC219688. LOC255533 (Accession XM_173073) is another VGAM2303 host target gene. LOC255533 BINDING SITE is HOST TARGET binding site found in the 5' untranslated region of mRNA encoded by LOC255533, corresponding to a HOST TARGET binding site such as BINDING SITE I, BINDING SITE II or BINDING SITE III. Table 2 illustrates the complementarity of the nucleotide sequences of LOC255533 BINDING SITE, designated SEQ ID:46331, to the nucleotide sequence of VGAM2303 RNA, herein designated VGAM RNA, also designated SEQ ID:5014.

Another function of VGAM2303 is therefore inhibition of LOC255533 (Accession XM_173073). Accordingly, utilities of VGAM2303 include diagnosis, prevention and treatment of diseases and clinical conditions associated with LOC255533. FIG. 1 further provides a conceptual description of a novel bioinformatically detected viral gene of the present invention, referred to here as Viral Genomic Address Messenger 2304 (VGAM2304) viral gene, which modulates expression of respective host target genes thereof, the function and utility of which host target genes is known in the art.

VGAM2304 is a novel bioinformatically detected regulatory, non protein coding, viral micro RNA (miRNA) gene. The method by which VGAM2304 was detected is described hereinabove with reference to FIGS. 1-8.

VGAM2304 gene, herein designated VGAM GENE, is a viral gene contained in the genome of Ectromelia Virus. VGAM2304 host target gene, herein designated VGAM HOST TARGET GENE, is a human gene contained in the human genome.

VGAM2304 gene encodes a VGAM2304 precursor RNA, herein designated VGAM PRECURSOR RNA. Similar to other miRNA genes, and unlike most ordinary genes, VGAM2304 precursor RNA does not encode a protein. A nucleotide sequence identical or highly similar to the nucleotide sequence of VGAM2304 precursor RNA is designated SEQ ID:2290, and is provided hereinbelow with reference to the sequence listing part. Nucleotide sequence SEQ ID:2290 is located at position 35690 relative to the genome of Ectromelia Virus.

VGAM2304 precursor RNA folds onto itself, forming VGAM2304 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2304 folded precursor RNA into VGAM2304 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM2304 RNA is designated SEQ ID:5015, and is provided hereinbelow with reference to the sequence listing part.

VGAM2304 host target gene, herein designated VGAM HOST TARGET GENE, encodes a corresponding messenger RNA, VGAM2304 host target RNA, herein designated VGAM HOST TARGET RNA. VGAM2304 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2304 RNA, herein designated VGAM RNA, binds complementarily to one or more host target binding sites located in untranslated regions of VGAM2304 host target RNA, herein designated VGAM HOST TARGET RNA. This complementary binding is due to the fact that the nucleotide sequence of VGAM2304 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2304 RNA, herein designated VGAM RNA, may have a different number of host target binding sites in untranslated regions of a VGAM2304 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2304 RNA, herein designated VGAM RNA, to host target binding sites on VGAM2304 host target RNA, herein designated VGAM HOST TARGET RNA, such as BINDING SITE I, BINDING SITE II and BINDING SITE III, inhibits translation of VGAM2304 host target RNA into VGAM2304 host target protein, herein designated VGAM HOST TARGET PROTEIN. VGAM host target protein is therefore outlined by a broken line.

It is appreciated that VGAM2304 host target gene, herein designated VGAM HOST TARGET GENE, in fact represents a plurality of VGAM2304 host target genes. The mRNA of each one of this plurality of VGAM2304 host target genes comprises one or more host target binding sites, each having a nucleotide sequence which is at least partly complementary to VGAM2304 RNA, herein designated VGAM RNA, and which when bound by VGAM2304 RNA causes inhibition of translation of respective one or more VGAM2304 host target proteins.

It is further appreciated by one skilled in the art that the mode of translational inhibition illustrated by FIG. 1 with specific reference to translational inhibition exerted by VGAM2304 gene, herein designated VGAM GENE, on one or more VGAM2304 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM2304 is inhibition of expression of host target genes, as part of a novel viral mechanism of attacking a host. Accordingly, utilities of VGAM2304 include diagnosis, prevention and treatment of viral infection by Ectromelia Virus. Specific functions, and accordingly utilities, of VGAM2304 correlate with, and may be deduced from, the identity of the host target genes which VGAM2304 binds and inhibits, and the function of these host target genes, as elaborated hereinbelow.

Nucleotide sequences of the VGAM2304 precursor RNA, herein designated VGAM PRECURSOR RNA, and of the ‘diced’ VGAM2304 RNA, herein designated VGAM RNA, and a schematic representation of the secondary folding of VGAM2304 folded precursor RNA, herein designated VGAM FOLDED PRECURSOR RNA, of VGAM2304 are further described hereinbelow with reference to Table 1.

Nucleotide sequences of host target binding sites, such as BINDING SITE-I, BINDING SITE-II and BINDING SITE-III of FIG. 1, found on VGAM2304 host target RNA, and schematic representation of the complementarity of each of these host target binding sites to VGAM2304 RNA, herein designated VGAM RNA, are described hereinbelow with reference to Table 2.

As mentioned hereinabove with reference to FIG. 1, a function of VGAM2304 gene, herein designated VGAM is inhibition of expression of VGAM2304 target genes. It is appreciated that specific functions, and accordingly utilities, of VGAM2304 correlate with, and may be deduced from, the identity of the target genes which VGAM2304 binds and inhibits, and the function of these target genes, as elaborated hereinbelow.

CUB and Sushi Multiple Domains 1 (CSMD1, Accession XM_054838) is a VGAM2304 host target gene. CSMD1 BINDING SITE is HOST TARGET binding site found in the 3' untranslated region of mRNA encoded by CSMD1, corresponding to a HOST TARGET binding site such as BINDING SITE I, BINDING SITE II or BINDING SITE III. Table 2 illustrates the complementarity of the nucleotide sequences of CSMD1 BINDING SITE, designated SEQ ID:36188, to the nucleotide sequence of VGAM2304 RNA, herein designated VGAM RNA, also designated SEQ ID:5015.

A function of VGAM2304 is therefore inhibition of CUB and Sushi Multiple Domains 1 (CSMD1, Accession XM_054838). Accordingly, utilities of VGAM2304 include diagnosis, prevention and treatment of diseases and clinical conditions associated with CSMD1. DRIL2 (Accession NM_006465) is another VGAM2304 host target gene. DRIL2 BINDING SITE is HOST TARGET binding site found in the 3' untranslated region of mRNA encoded by DRIL2, corresponding to a HOST TARGET binding site such as BINDING SITE I, BINDING SITE II or BINDING SITE III. Table 2 illustrates the complementarity of the nucleotide sequences of DRIL2 BINDING SITE, designated SEQ ID:13182, to the nucleotide sequence of VGAM2304 RNA, herein designated VGAM RNA, also designated SEQ ID:5015.

Another function of VGAM2304 is therefore inhibition of DRIL2 (Accession NM_006465). Accordingly, utilities of VGAM2304 include diagnosis, prevention and treatment of diseases and clinical conditions associated with DRIL2. LOC158187 (Accession XM_098892) is another VGAM2304 host target gene. LOC158187 BINDING SITE is HOST TARGET binding site found in the 3' untranslated region of mRNA encoded by LOC158187, corresponding to a HOST TARGET binding site such as BINDING SITE I, BINDING SITE II or BINDING SITE III. Table 2 illustrates the complementarity of the nucleotide sequences of LOC158187 BINDING SITE, designated SEQ ID:41919, to the nucleotide sequence of VGAM2304 RNA, herein designated VGAM RNA, also designated SEQ ID:5015.

Another function of VGAM2304 is therefore inhibition of LOC158187 (Accession XM_098892). Accordingly, utilities of VGAM2304 include diagnosis, prevention and treatment of diseases and clinical conditions associated with LOC158187. FIG. 1 further provides a conceptual description of a novel bioinformatically detected viral gene of the present invention, referred to here as Viral Genomic Address Messenger 2305 (VGAM2305) viral gene, which modulates expression of respective host target genes thereof, the function and utility of which host target genes is known in the art.

VGAM2305 is a novel bioinformatically detected regulatory, non protein coding, viral micro RNA (miRNA) gene. The method by which VGAM2305 was detected is described hereinabove with reference to FIGS. 1-8.

VGAM2305 gene, herein designated VGAM GENE, is a viral gene contained in the genome of Camelpox Virus. VGAM2305 host target gene, herein designated VGAM HOST TARGET GENE, is a human gene contained in the human genome.

VGAM2305 gene encodes a VGAM2305 precursor RNA, herein designated VGAM PRECURSOR RNA. Similar to other miRNA genes, and unlike most ordinary genes, VGAM2305 precursor RNA does not encode a protein. A nucleotide sequence identical or highly similar to the nucleotide sequence of VGAM2305 precursor RNA is designated SEQ ID:2291, and is provided hereinbelow with reference to the sequence listing part. Nucleotide sequence SEQ ID:2291 is located at position 38932 relative to the genome of Camelpox Virus.

VGAM2305 precursor RNA folds onto itself, forming VGAM2305 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2305 folded precursor RNA into VGAM2305 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM2305 RNA is designated SEQ ID:5016, and is provided hereinbelow with reference to the sequence listing part.

VGAM2305 host target gene, herein designated VGAM HOST TARGET GENE, encodes a corresponding messenger RNA, VGAM2305 host target RNA, herein designated VGAM HOST TARGET RNA. VGAM2305 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2305 RNA, herein designated VGAM RNA, binds complementarily to one or more host target binding sites located in untranslated regions of VGAM2305 host target RNA, herein designated VGAM HOST TARGET RNA. This complementary binding is due to the fact that the nucleotide sequence of VGAM2305 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2305 RNA, herein designated VGAM RNA, may have a different number of host target binding sites in untranslated regions of a VGAM2305 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2305 RNA, herein designated VGAM RNA, to host target binding sites on VGAM2305 host target RNA, herein designated VGAM HOST TARGET RNA, such as BINDING SITE I, BINDING SITE II and BINDING SITE III, inhibits translation of VGAM2305 host target RNA into VGAM2305 host target protein, herein designated VGAM HOST TARGET PROTEIN. VGAM host target protein is therefore outlined by a broken line.

It is appreciated that VGAM2305 host target gene, herein designated VGAM HOST TARGET GENE, in fact represents a plurality of VGAM2305 host target genes. The mRNA of each one of this plurality of VGAM2305 host target genes comprises one or more host target binding sites, each having a nucleotide sequence which is at least partly complementary to VGAM2305 RNA, herein designated VGAM RNA, and which when bound by VGAM2305 RNA causes inhibition of translation of respective one or more VGAM2305 host target proteins.

It is further appreciated by one skilled in the art that the mode of translational inhibition illustrated by FIG. 1 with specific reference to translational inhibition exerted by VGAM2305 gene, herein designated VGAM GENE, on one or more VGAM2305 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2305 is inhibition of expression of host target genes, as part of a novel viral mechanism of attacking a host. Accordingly, utilities of VGAM2305 include diagnosis, prevention and treatment of viral infection by Camelpox Virus. Specific functions, and accordingly utilities, of VGAM2305 correlate with, and may be deduced from, the identity of the host target genes which VGAM2305 binds and inhibits, and the function of these host target genes, as elaborated hereinbelow.

Nucleotide sequences of the VGAM2305 precursor RNA, herein designated VGAM PRECURSOR RNA, and of the 'diced' VGAM2305 RNA, herein designated VGAM RNA, and a schematic representation of the secondary folding of VGAM2305 folded precursor RNA, herein designated VGAM FOLDED PRECURSOR RNA, of VGAM2305 are further described hereinbelow with reference to Table 1.

Nucleotide sequences of host target binding sites, such as BINDING SITE-I, BINDING SITE-II and BINDING SITE- III of FIG. 1, found on VGAM2305 host target RNA, and schematic representation of the complementarity of each of these host target binding sites to VGAM2305 RNA, herein designated VGAM RNA, are described hereinbelow with reference to Table 2.

As mentioned hereinabove with reference to FIG. 1, a function of VGAM2305 gene, herein designated VGAM is inhibition of expression of VGAM2305 target genes. It is appreciated that specific functions, and accordingly utilities, of VGAM2305 correlate with, and may be deduced from, the identity of the target genes which VGAM2305 binds and inhibits, and the function of these target genes, as elaborated hereinbelow.

GA (Accession NM_013267) is a VGAM2305 host target gene. GA BINDING SITE is HOST TARGET binding site found in the 5' untranslated region of mRNA encoded by GA, corresponding to a HOST TARGET binding site such as BINDING SITE I, BINDING SITE II or BINDING SITE III. Table 2 illustrates the complementarity of the nucleotide sequences of GA BINDING SITE, designated SEQ ID:14936, to the nucleotide sequence of VGAM2305 RNA, herein designated VGAM RNA, also designated SEQ ID:5016.

A function of VGAM2305 is therefore inhibition of GA (Accession NM_013267). Accordingly, utilities of VGAM2305 include diagnosis, prevention and treatment of diseases and clinical conditions associated with GA. KIAA0753 (Accession NM_014804) is another VGAM2305 host target gene. KIAA0753 BINDING SITE is HOST TARGET binding site found in the 3" untranslated region of mRNA encoded by KIAA0753, corresponding to a HOST TARGET binding site such as BINDING SITE I, BINDING SITE II or BINDING SITE III. Table 2 illustrates the complementarity of the nucleotide sequences of KIAA0753 BINDING SITE, designated SEQ ID:16737, to the nucleotide sequence of VGAM2305 RNA, herein designated VGAM RNA, also designated SEQ ID:5016.

Another function of VGAM2305 is therefore inhibition of KIAA0753 (Accession NM_014804). Accordingly, utilities of VGAM2305 include diagnosis, prevention and treatment of diseases and clinical conditions associated with KIAA0753. KIAA1130 (Accession XM_031104) is another VGAM2305 host target gene. KIAA1130 BINDING SITE is HOST TARGET binding site found in the 3' untranslated region of mRNA encoded by KIAA1130, corresponding to a HOST TARGET binding site such as BINDING SITE I, BINDING SITE II or BINDING SITE III. Table 2 illustrates the complementarity of the nucleotide sequences of KIAA1130 BINDING SITE, designated SEQ ID:31289, to the nucleotide sequence of VGAM2305 RNA, herein designated VGAM RNA, also designated SEQ ID:5016.

Another function of VGAM2305 is therefore inhibition of KIAA1130 (Accession XM_031104). Accordingly, utilities of VGAM2305 include diagnosis, prevention and treatment of diseases and clinical conditions associated with KIAA1130. Ribosomal Protein L36 (RPL36, Accession NM_015414) is another VGAM2305 host target gene. RPL36 BINDING SITE is HOST TARGET binding site found in the 5' untranslated region of mRNA encoded by RPL36, corresponding to a HOST TARGET binding site such as BINDING SITE I, BINDING SITE II or BINDING SITE III. Table 2 illustrates the complementarity of the nucleotide sequences of RPL36 BINDING SITE, designated SEQ ID:17715, to the nucleotide sequence of VGAM2305 RNA, herein designated VGAM RNA, also designated SEQ ID:5016.

Another function of VGAM2305 is therefore inhibition of Ribosomal Protein L36 (RPL36, Accession NM_015414). Accordingly, utilities of VGAM2305 include diagnosis, prevention and treatment of diseases and clinical conditions associated with RPL36. LOC56920 (Accession NM_020163) is another VGAM2305 host target gene. LOC56920 BINDING SITE is HOST TARGET binding site found in the 3' untranslated region of mRNA encoded by LOC56920, corresponding to a HOST TARGET binding site such as BINDING SITE I, BINDING SITE II or BINDING SITE III. Table 2 illustrates the complementarity of the nucleotide sequences of LOC56920 BINDING SITE, designated SEQ ID:21381, to the nucleotide sequence of VGAM2305 RNA, herein designated VGAM RNA, also designated SEQ ID:5016.

Another function of VGAM2305 is therefore inhibition of LOC56920 (Accession NM_020163). Accordingly, utilities of VGAM2305 include diagnosis, prevention and treatment of diseases and clinical conditions associated with LOC56920. FIG. 1 further provides a conceptual description of a novel bioinformatically detected viral gene of the present invention, referred to here as Viral Genomic Address Messenger 2306 (VGAM2306) viral gene, which modulates expression of respective host target genes thereof, the function and utility of which host target genes is known in the art.

VGAM2306 is a novel bioinformatically detected regulatory, non protein coding, viral micro RNA (miRNA) gene. The method by which VGAM2306 was detected is described hereinabove with reference to FIGS. 1-8.

VGAM2306 gene, herein designated VGAM GENE, is a viral gene contained in the genome of Ectromelia Virus. VGAM2306 host target gene, herein designated VGAM HOST TARGET GENE, is a human gene contained in the human genome.

VGAM2306 gene encodes a VGAM2306 precursor RNA, herein designated VGAM PRECURSOR RNA. Similar to other miRNA genes, and unlike most ordinary genes, VGAM2306 precursor RNA does not encode a protein. A nucleotide sequence identical or highly similar to the nucleotide sequence of VGAM2306 precursor RNA is designated SEQ ID:2292, and is provided hereinbelow with reference to the sequence listing part. Nucleotide sequence SEQ ID:2292 is located at position 43278 relative to the genome of Ectromelia Virus.

VGAM2306 precursor RNA folds onto itself, forming VGAM2306 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2306 folded precursor RNA into VGAM2306 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2306 RNA is designated SEQ ID:5017, and is provided hereinbelow with reference to the sequence listing part.

VGAM2306 host target gene, herein designated VGAM HOST TARGET GENE, encodes a corresponding messenger RNA, VGAM2306 host target RNA, herein designated VGAM HOST TARGET RNA. VGAM2306 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2306 RNA, herein designated VGAM RNA, binds complementarily to one or more host target binding sites located in untranslated regions of VGAM2306 host target RNA, herein designated VGAM HOST TARGET RNA. This complementary binding is due to the fact that the nucleotide sequence of VGAM2306 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2306 RNA, herein designated VGAM RNA, may have a different number of host target binding sites in untranslated regions of a VGAM2306 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2306 RNA, herein designated VGAM RNA, to host target binding sites on VGAM2306 host target RNA, herein designated VGAM HOST TARGET RNA, such as BINDING SITE I, BINDING SITE II and BINDING SITE III, inhibits translation of VGAM2306 host target RNA into VGAM2306 host target protein, herein designated VGAM HOST TARGET PROTEIN. VGAM host target protein is therefore outlined by a broken line.

It is appreciated that VGAM2306 host target gene, herein designated VGAM HOST TARGET GENE, in fact represents a plurality of VGAM2306 host target genes. The mRNA of each one of this plurality of VGAM2306 host target genes comprises one or more host target binding sites, each having a nucleotide sequence which is at least partly complementary to VGAM2306 RNA, herein designated VGAM RNA, and which when bound by VGAM2306 RNA causes inhibition of translation of respective one or more VGAM2306 host target proteins.

It is further appreciated by one skilled in the art that the mode of translational inhibition illustrated by FIG. 1 with specific reference to translational inhibition exerted by VGAM2306 gene, herein designated VGAM GENE, on one or more VGAM2306 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2306 is inhibition of expression of host target genes, as part of a novel viral mechanism of attacking a host. Accordingly, utilities of VGAM2306 include diagnosis, prevention and treatment of viral infection by Ectromelia Virus. Specific functions, and accordingly utilities, of VGAM2306 correlate with, and may be deduced from, the identity of the host target genes which VGAM2306 binds and inhibits, and the function of these host target genes, as elaborated hereinbelow.

Nucleotide sequences of the VGAM2306 precursor RNA, herein designated VGAM PRECURSOR RNA, and of the 'diced' VGAM2306 RNA, herein designated VGAM RNA, and a schematic representation of the secondary folding of VGAM2306 folded precursor RNA, herein designated VGAM FOLDED PRECURSOR RNA, of VGAM2306 are further described hereinbelow with reference to Table 1.

Nucleotide sequences of host target binding sites, such as BINDING SITE-I, BINDING SITE-II and BINDING SITE-III of FIG. 1, found on VGAM2306 host target RNA, and schematic representation of the complementarity of each of these host target binding sites to VGAM2306 RNA, herein designated VGAM RNA, are described hereinbelow with reference to Table 2.

As mentioned hereinabove with reference to FIG. 1, a function of VGAM2306 gene, herein designated VGAM is inhibition of expression of VGAM2306 target genes. It is appreciated that specific functions, and accordingly utilities, of VGAM2306 correlate with, and may be deduced from, the identity of the target genes which VGAM2306 binds and inhibits, and the function of these target genes, as elaborated hereinbelow.

BUB3 Budding Uninhibited By Benzimidazoles 3 Homolog (yeast) (BUB3, Accession NM_004725) is a VGAM2306 host target gene. BUB3 BINDING SITE is HOST TARGET binding site found in the 3' untranslated region of mRNA encoded by BUB3, corresponding to a HOST TARGET binding site such as BINDING SITE I, BINDING SITE II or BINDING SITE III. Table 2 illustrates the complementarity of the nucleotide sequences of BUB3 BINDING SITE, designated SEQ ID:11094, to the nucleotide sequence of VGAM2306 RNA, herein designated VGAM RNA, also designated SEQ ID:5017.

A function of VGAM2306 is therefore inhibition of BUB3 Budding Uninhibited By Benzimidazoles 3 Homolog (yeast) (BUB3, Accession NM_004725), a gene which has a role in the mitotic spindle checkpoint. Accordingly, utilities of VGAM2306 include diagnosis, prevention and treatment of diseases and clinical conditions associated with BUB3. The function of BUB3 and its association with various diseases and clinical conditions, has been established by previous studies, as described hereinabove with reference to VGAM1361. Membrane Metallo-endopeptidase (neutral endopeptidase, enkephalinase, CALLA, CD10) (MME, Accession NM_007289) is another VGAM2306 host target gene. MME BINDING SITE1 through MME BINDING SITE4 are HOST TARGET binding sites found in untranslated regions of mRNA encoded by MME, corresponding to HOST TARGET binding sites such as BINDING SITE I, BINDING SITE II or BINDING SITE III. Table 2 illustrates the complementarity of the nucleotide sequences of MME BINDING SITE1 through MME BINDING SITE4, designated SEQ ID:14159, SEQ ID:6602, SEQ ID:14150 and SEQ ID:14154 respectively, to the nucleotide sequence of VGAM2306 RNA, herein designated VGAM RNA, also designated SEQ ID:5017.

Another function of VGAM2306 is therefore inhibition of Membrane Metallo-endopeptidase (neutral endopeptidase, enkephalinase, CALLA, CD10) (MME, Accession NM_007289), a gene which is thermolysin-like specificity. Accordingly, utilities of VGAM2306 include diagnosis, prevention and treatment of diseases and clinical conditions associated with MME. The function of MME and its association with various diseases and clinical conditions, has been established by previous studies, as described hereinabove with reference to VGAM1332. LOC126669 (Accession XM_060121) is another VGAM2306 host target gene. LOC126669 BINDING SITE is HOST TARGET binding site found in the 3' untranslated region of mRNA encoded by LOC126669, corresponding to a HOST TARGET binding site such as BINDING SITE I, BINDING SITE II or BINDING SITE III. Table 2 illustrates the complementarity of the nucleotide sequences of LOC126669 BINDING SITE, designated SEQ ID:37154, to the nucleotide sequence of VGAM2306 RNA, herein designated VGAM RNA, also designated SEQ ID:5017.

Another function of VGAM2306 is therefore inhibition of LOC126669 (Accession XM_060121). Accordingly, utilities of VGAM2306 include diagnosis, prevention and treatment of diseases and clinical conditions associated with LOC126669. LOC154789 (Accession XM_088043) is another VGAM2306 host target gene. LOC154789 BINDING SITE is HOST TARGET binding site found in the 5' untranslated region of mRNA encoded by LOC154789, corresponding to a HOST TARGET binding site such as BINDING SITE I, BINDING SITE II or BINDING SITE III. Table 2 illustrates the complementarity of the nucleotide sequences of LOC154789 BINDING SITE, designated SEQ ID:39485, to the nucleotide sequence of VGAM2306 RNA, herein designated VGAM RNA, also designated SEQ ID:5017.

Another function of VGAM2306 is therefore inhibition of LOC154789 (Accession XM_088043). Accordingly, utilities of VGAM2306 include diagnosis, prevention and treatment of diseases and clinical conditions associated with LOC154789. LOC220963 (Accession XM_166145) is another VGAM2306 host target gene. LOC220963 BINDING SITE is HOST TARGET binding site found in the 3' untranslated region of mRNA encoded by LOC220963, corresponding to a HOST TARGET binding site such as BINDING SITE I, BINDING SITE II or BINDING SITE III. Table 2 illustrates the complementarity of the nucleotide sequences of LOC220963 BINDING SITE, designated SEQ ID:43958, to the nucleotide sequence of VGAM2306 RNA, herein designated VGAM RNA, also designated SEQ ID:5017.

Another function of VGAM2306 is therefore inhibition of LOC220963 (Accession XM_166145). Accordingly, utilities of VGAM2306 include diagnosis, prevention and treatment of diseases and clinical conditions associated with LOC220963. FIG. 1 further provides a conceptual description of a novel bioinformatically detected viral gene of the present invention, referred to here as Viral Genomic Address Messenger 2307 (VGAM2307) viral gene, which modulates expression of respective host target genes thereof, the function and utility of which host target genes is known in the art.

VGAM2307 is a novel bioinformatically detected regulatory, non protein coding, viral micro RNA (miRNA) gene. The method by which VGAM2307 was detected is described hereinabove with reference to FIGS. 1-8.

VGAM2307 gene, herein designated VGAM GENE, is a viral gene contained in the genome of Lumpy Skin Disease Virus. VGAM2307 host target gene, herein designated VGAM HOST TARGET GENE, is a human gene contained in the human genome.

VGAM2307 gene encodes a VGAM2307 precursor RNA, herein designated VGAM PRECURSOR RNA. Similar to other miRNA genes, and unlike most ordinary genes, VGAM2307 precursor RNA does not encode a protein. A nucleotide sequence identical or highly similar to the nucleotide sequence of VGAM2307 precursor RNA is designated SEQ ID:2293, and is provided hereinbelow with reference to the sequence listing part. Nucleotide sequence SEQ ID:2293 is located at position 122989 relative to the genome of Lumpy Skin Disease Virus.

VGAM2307 precursor RNA folds onto itself, forming VGAM2307 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2307 folded precursor RNA into VGAM2307 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM2307 RNA is designated SEQ ID:5018, and is provided hereinbelow with reference to the sequence listing part.

VGAM2307 host target gene, herein designated VGAM HOST TARGET GENE, encodes a corresponding messenger RNA, VGAM2307 host target RNA, herein designated VGAM HOST TARGET RNA. VGAM2307 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2307 RNA, herein designated VGAM RNA, binds complementarily to one or more host target binding sites located in untranslated regions of VGAM2307 host target RNA, herein designated VGAM HOST TARGET RNA. This complementary binding is due to the fact that the nucleotide sequence of VGAM2307 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2307 RNA, herein designated VGAM RNA, may have a different number of host target binding sites in untranslated regions of a VGAM2307 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2307 RNA, herein designated VGAM RNA, to host target binding sites on VGAM2307 host target RNA, herein designated VGAM HOST TARGET RNA, such as BINDING SITE I, BINDING SITE II and BINDING SITE III, inhibits translation of VGAM2307 host target RNA into VGAM2307 host target protein, herein designated VGAM HOST TARGET PROTEIN. VGAM host target protein is therefore outlined by a broken line.

It is appreciated that VGAM2307 host target gene, herein designated VGAM HOST TARGET GENE, in fact represents a plurality of VGAM2307 host target genes. The mRNA of each one of this plurality of VGAM2307 host target genes comprises one or more host target binding sites, each having a nucleotide sequence which is at least partly complementary to VGAM2307 RNA, herein designated VGAM RNA, and which when bound by VGAM2307 RNA causes inhibition of translation of respective one or more VGAM2307 host target proteins.

It is further appreciated by one skilled in the art that the mode of translational inhibition illustrated by FIG. 1 with specific reference to translational inhibition exerted by VGAM2307 gene, herein designated VGAM GENE, on one or more VGAM2307 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2307 is inhibition of expression of host target genes, as part of a novel viral mechanism of attacking a host. Accordingly, utilities of VGAM2307 include diagnosis, prevention and treatment of viral infection by Lumpy Skin Disease Virus. Specific functions, and accordingly utilities, of VGAM2307 correlate with, and may be deduced from, the identity of the host target genes which VGAM2307 binds and inhibits, and the function of these host target genes, as elaborated hereinbelow.

Nucleotide sequences of the VGAM2307 precursor RNA, herein designated VGAM PRECURSOR RNA, and of the 'diced' VGAM2307 RNA, herein designated VGAM RNA, and a schematic representation of the secondary folding of VGAM2307 folded precursor RNA, herein designated VGAM FOLDED PRECURSOR RNA, of VGAM2307 are further described hereinbelow with reference to Table 1.

Nucleotide sequences of host target binding sites, such as BINDING SITE-I, BINDING SITE-II and BINDING SITE-III of FIG. 1, found on VGAM2307 host target RNA, and schematic representation of the complementarity of each of these host target binding sites to VGAM2307 RNA, herein designated VGAM RNA, are described hereinbelow with reference to Table 2.

As mentioned hereinabove with reference to FIG. 1, a function of VGAM2307 gene, herein designated VGAM is inhibition of expression of VGAM2307 target genes. It is appreciated that specific functions, and accordingly utilities, of VGAM2307 correlate with, and may be deduced from, the identity of the target genes which VGAM2307 binds and inhibits, and the function of these target genes, as elaborated hereinbelow.

Cadherin 6, Type 2, K-cadherin (fetal kidney) (CDH6, Accession NM_004932) is a VGAM2307 host target gene. CDH6 BINDING SITE is HOST TARGET binding site found in the 3' untranslated region of mRNA encoded by CDH6, corresponding to a HOST TARGET binding site such as BINDING SITE I, BINDING SITE II or BINDING SITE III. Table 2 illustrates the complementarity of the nucleotide sequences of CDH6 BINDING SITE, designated SEQ ID:11375, to the nucleotide sequence of VGAM2307 RNA, herein designated VGAM RNA, also designated SEQ ID:5018.

A function of VGAM2307 is therefore inhibition of Cadherin 6, Type 2, K-cadherin (fetal kidney) (CDH6, Accession NM_004932), a gene which is a calcium dependent cell adhesion protein. Accordingly, utilities of VGAM2307 include diagnosis, prevention and treatment of diseases and clinical conditions associated with CDH6. The function of CDH6 and its association with various diseases and clinical conditions, has been established by previous studies, as described hereinabove with reference to VGAM60. Carboxypeptidase D (CPD, Accession NM_001304) is another VGAM2307 host target gene. CPD BINDING SITE is HOST TARGET binding site found in the 3' untranslated region of mRNA encoded by CPD, corresponding to a HOST TARGET binding site such as BINDING SITE I, BINDING SITE II or BINDING SITE III. Table 2 illustrates the complementarity of the nucleotide sequences of CPD BINDING SITE, designated SEQ ID:6981, to the nucleotide sequence of VGAM2307 RNA, herein designated VGAM RNA, also designated SEQ ID:5018.

Another function of VGAM2307 is therefore inhibition of Carboxypeptidase D (CPD, Accession NM_001304), a gene which is a membrane-bound metalloprotease. Accordingly, utilities of VGAM2307 include diagnosis, prevention and treatment of diseases and clinical conditions associated with CPD. The function of CPD and its association with various diseases and clinical conditions, has been established by previous studies, as described hereinabove with reference to VGAM596. Norrie Disease (pseudoglioma) (NDP, Accession NM_000266) is another VGAM2307 host target gene. NDP BINDING SITE is HOST TARGET binding site found in the 3' untranslated region of mRNA encoded by NDP, corresponding to a HOST TARGET binding site such as BINDING SITE I, BINDING SITE II or BINDING SITE III. Table 2 illustrates the complementarity of the nucleotide sequences of NDP BINDING SITE, designated SEQ ID:5808, to the nucleotide sequence of VGAM2307 RNA, herein designated VGAM RNA, also designated SEQ ID:5018.

Another function of VGAM2307 is therefore inhibition of Norrie Disease (pseudoglioma) (NDP, Accession NM_000266), a gene which may be involved in a pathway that regulates neural cell differentiation and proliferation. Accordingly, utilities of VGAM2307 include diagnosis, prevention and treatment of diseases and clinical conditions associated with NDP. The function of NDP and its association with various diseases and clinical conditions, has been established by previous studies, as described hereinabove with reference to VGAM113. Suppressor of Cytokine Signaling 5 (SOCS5, Accession NM_014011) is another VGAM2307 host target gene. SOCS5 BINDING SITE is HOST TARGET binding site found in the 3' untranslated region of mRNA encoded by SOCS5, corresponding to a HOST TARGET binding site such as BINDING SITE I, BINDING SITE II or BINDING SITE III. Table 2 illustrates the complementarity of the nucleotide sequences of SOCS5 BINDING SITE, designated SEQ ID:15230, to the nucleotide sequence of VGAM2307 RNA, herein designated VGAM RNA, also designated SEQ ID:5018.

Another function of VGAM2307 is therefore inhibition of Suppressor of Cytokine Signaling 5 (SOCS5, Accession NM_014011). Accordingly, utilities of VGAM2307 include diagnosis, prevention and treatment of diseases and clinical conditions associated with SOCS5. HSA250839 (Accession NM_018401) is another VGAM2307 host target gene. HSA250839 BINDING SITE is HOST TARGET binding site found in the 3' untranslated region of mRNA encoded by HSA250839, corresponding to a HOST TARGET binding site such as BINDING SITE I, BINDING SITE II or BINDING SITE III. Table 2 illustrates the complementarity of the nucleotide sequences of HSA250839 BINDING SITE, designated SEQ ID:20436, to the nucleotide sequence of VGAM2307 RNA, herein designated VGAM RNA, also designated SEQ ID:5018.

Another function of VGAM2307 is therefore inhibition of HSA250839 (Accession NM_018401). Accordingly, utilities of VGAM2307 include diagnosis, prevention and treatment of diseases and clinical conditions associated with HSA250839. LOC149372 (Accession XM_086509) is another VGAM2307 host target gene. LOC149372 BINDING SITE is HOST TARGET binding site found in the 5' untranslated region of mRNA encoded by LOC149372, corresponding to a HOST TARGET binding site such as BINDING SITE I, BINDING SITE II or BINDING SITE III. Table 2 illustrates the complementarity of the nucleotide sequences of LOC149372 BINDING SITE, designated SEQ ID:38732, to the nucleotide sequence of VGAM2307 RNA, herein designated VGAM RNA, also designated SEQ ID:5018.

Another function of VGAM2307 is therefore inhibition of LOC149372 (Accession XM_086509). Accordingly, utilities of VGAM2307 include diagnosis, prevention and treatment of diseases and clinical conditions associated with LOC149372. LOC149844 (Accession XM_086675) is another VGAM2307 host target gene. LOC149844 BINDING SITE is HOST TARGET binding site found in the 5' untranslated region of mRNA encoded by LOC149844, corresponding to a HOST TARGET binding site such as BINDING SITE I, BINDING SITE II or BINDING SITE III. Table 2 illustrates the complementarity of the nucleotide sequences of LOC149844 BINDING SITE, designated SEQ ID:38820, to the nucleotide sequence of VGAM2307 RNA, herein designated VGAM RNA, also designated SEQ ID:5018.

Another function of VGAM2307 is therefore inhibition of LOC149844 (Accession XM_086675). Accordingly, utilities of VGAM2307 include diagnosis, prevention and treatment of diseases and clinical conditions associated with LOC149844. LOC51133 (Accession NM_016121) is another VGAM2307 host target gene. LOC51133 BINDING SITE is HOST TARGET binding site found in the 5' untranslated region of mRNA encoded by LOC51133, corresponding to a HOST TARGET binding site such as BINDING SITE I, BINDING SITE II or BINDING SITE III. Table 2 illustrates the complementarity of the nucleotide sequences of LOC51133 BINDING SITE, designated SEQ ID:18205, to the nucleotide sequence of VGAM2307 RNA, herein designated VGAM RNA, also designated SEQ ID:5018.

Another function of VGAM2307 is therefore inhibition of LOC51133 (Accession NM_016121). Accordingly, utilities of VGAM2307 include diagnosis, prevention and treatment of diseases and clinical conditions associated with LOC51133. LOC89135 (Accession XM_016232) is another VGAM2307 host target gene. LOC89135 BINDING SITE is HOST TARGET binding site found in the 5' untranslated region of mRNA encoded by LOC89135, corresponding to a HOST TARGET binding site such as BINDING SITE I, BINDING SITE II or BINDING SITE III. Table 2 illustrates the complementarity of the nucleotide sequences of LOC89135 BINDING SITE, designated SEQ ID:30249, to the nucleotide sequence of VGAM2307 RNA, herein designated VGAM RNA, also designated SEQ ID:5018.

Another function of VGAM2307 is therefore inhibition of LOC89135 (Accession XM_016232). Accordingly, utilities of VGAM2307 include diagnosis, prevention and treatment of diseases and clinical conditions associated with LOC89135. FIG. 1 further provides a conceptual description of a novel bioinformatically detected viral gene of the present invention, referred to here as Viral Genomic Address Messenger 2308 (VGAM2308) viral gene, which modulates expression of respective host target genes thereof, the function and utility of which host target genes is known in the art.

VGAM2308 is a novel bioinformatically detected regulatory, non protein coding, viral micro RNA (miRNA) gene. The method by which VGAM2308 was detected is described hereinabove with reference to FIGS. 1-8.

VGAM2308 gene, herein designated VGAM GENE, is a viral gene contained in the genome of Goatpox Virus. VGAM2308 host target gene, herein designated VGAM HOST TARGET GENE, is a human gene contained in the human genome.

VGAM2308 gene encodes a VGAM2308 precursor RNA, herein designated VGAM PRECURSOR RNA. Similar to other miRNA genes, and unlike most ordinary genes, VGAM2308 precursor RNA does not encode a protein. A nucleotide sequence identical or highly similar to the nucleotide sequence of VGAM2308 precursor RNA is designated SEQ ID:2294, and is provided hereinbelow with reference to the sequence listing part. Nucleotide sequence SEQ ID:2294 is located at position 123501 relative to the genome of Goatpox Virus.

VGAM2308 precursor RNA folds onto itself, forming VGAM2308 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2308 folded precursor RNA into VGAM2308 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2308 RNA is designated SEQ ID:5019, and is provided hereinbelow with reference to the sequence listing part.

VGAM2308 host target gene, herein designated VGAM HOST TARGET GENE, encodes a corresponding messenger RNA, VGAM2308 host target RNA, herein designated VGAM HOST TARGET RNA. VGAM2308 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2308 RNA, herein designated VGAM RNA, binds complementarily to one or more host target binding sites located in untranslated regions of VGAM2308 host target RNA, herein designated VGAM HOST TARGET RNA. This complementary binding is due to the fact that the nucleotide sequence of VGAM2308 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2308 RNA, herein designated VGAM RNA, may have a different number of host target binding sites in untranslated regions of a VGAM2308 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2308 RNA, herein designated VGAM RNA, to host target binding sites on VGAM2308 host target RNA, herein designated VGAM HOST TARGET RNA, such as BINDING SITE I, BINDING SITE II and BINDING SITE III, inhibits translation of VGAM2308 host target RNA into VGAM2308 host target protein, herein designated VGAM HOST TARGET PROTEIN. VGAM host target protein is therefore outlined by a broken line.

It is appreciated that VGAM2308 host target gene, herein designated VGAM HOST TARGET GENE, in fact represents a plurality of VGAM2308 host target genes. The mRNA of each one of this plurality of VGAM2308 host target genes comprises one or more host target binding sites, each having a nucleotide sequence which is at least partly complementary to VGAM2308 RNA, herein designated VGAM RNA, and which when bound by VGAM2308 RNA causes inhibition of translation of respective one or more VGAM2308 host target proteins.

It is further appreciated by one skilled in the art that the mode of translational inhibition illustrated by FIG. 1 with specific reference to translational inhibition exerted by VGAM2308 gene, herein designated VGAM GENE, on one or more VGAM2308 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2308 is inhibition of expression of host target genes, as part of a novel viral mechanism of attacking a host. Accordingly, utilities of VGAM2308 include diagnosis, prevention and treatment of viral infection by Goatpox Virus. Specific functions, and accordingly utilities, of VGAM2308 correlate with, and may be deduced from, the identity of the host target genes which VGAM2308 binds and inhibits, and the function of these host target genes, as elaborated hereinbelow.

Nucleotide sequences of the VGAM2308 precursor RNA, herein designated VGAM PRECURSOR RNA, and of the 'diced' VGAM2308 RNA, herein designated VGAM RNA, and a schematic representation of the secondary folding of VGAM2308 folded precursor RNA, herein designated VGAM FOLDED PRECURSOR RNA, of VGAM2308 are further described hereinbelow with reference to Table 1.

Nucleotide sequences of host target binding sites, such as BINDING SITE-I, BINDING SITE-II and BINDING SITE-III of FIG. 1, found on VGAM2308 host target RNA, and schematic representation of the complementarity of each of these host target binding sites to VGAM2308 RNA, herein designated VGAM RNA, are described hereinbelow with reference to Table 2.

As mentioned hereinabove with reference to FIG. 1, a function of VGAM2308 gene, herein designated VGAM is inhibition of expression of VGAM2308 target genes. It is appreciated that specific functions, and accordingly utilities, of VGAM2308 correlate with, and may be deduced from, the identity of the target genes which VGAM2308 binds and inhibits, and the function of these target genes, as elaborated hereinbelow.

Giant Axonal Neuropathy (gigaxonin) (GAN, Accession NM_022041) is a VGAM2308 host target gene. GAN BINDING SITE is HOST TARGET binding site found in the 3' untranslated region of mRNA encoded by GAN, corresponding to a HOST TARGET binding site such as BINDING SITE I, BINDING SITE II or BINDING SITE III. Table 2 illustrates the complementarity of the nucleotide sequences of GAN BINDING SITE, designated SEQ ID:22561, to the nucleotide sequence of VGAM2308 RNA, herein designated VGAM RNA, also designated SEQ ID:5019.

A function of VGAM2308 is therefore inhibition of Giant Axonal Neuropathy (gigaxonin) (GAN, Accession NM_022041), a gene which plays an important role in neurofilament architecture. Accordingly, utilities of VGAM2308 include diagnosis, prevention and treatment of diseases and clinical conditions associated with GAN. The function of GAN and its association with various diseases and clinical conditions, has been established by previous studies, as described hereinabove with reference to VGAM606. DKFZP434F0318 (Accession NM_030817) is another VGAM2308 host target gene. DKFZP434F0318 BINDING SITE is HOST TARGET binding site found in the 3' untranslated region of mRNA encoded by DKFZP434F0318, corresponding to a HOST TARGET binding site such as BINDING SITE I, BINDING SITE II or BINDING SITE III. Table 2 illustrates the complementarity of the nucleotide sequences of DKFZP434F0318 BINDING SITE, designated SEQ ID:25139, to the nucleotide sequence of VGAM2308 RNA, herein designated VGAM RNA, also designated SEQ ID:5019.

Another function of VGAM2308 is therefore inhibition of DKFZP434F0318 (Accession NM_030817). Accordingly, utilities of VGAM2308 include diagnosis, prevention and treatment of diseases and clinical conditions associated with DKFZP434F0318. DKFZP761E2110 (Accession NM_030953) is another VGAM2308 host target gene. DKFZP761E2110 BINDING SITE is HOST TARGET binding site found in the 3' untranslated region of mRNA encoded by DKFZP761E2110, corresponding to a HOST TARGET binding site such as BINDING SITE I, BINDING SITE II or BINDING SITE III. Table 2 illustrates the complementarity of the nucleotide sequences of DKFZP761E2110 BINDING SITE, designated SEQ ID:25223, to the nucleotide sequence of VGAM2308 RNA, herein designated VGAM RNA, also designated SEQ ID:5019.

Another function of VGAM2308 is therefore inhibition of DKFZP761E2110 (Accession NM_030953). Accordingly, utilities of VGAM2308 include diagnosis, prevention and treatment of diseases and clinical conditions associated with DKFZP761E2110. KIAA1393 (Accession XM_050793) is another VGAM2308 host target gene. KIAA1393 BINDING SITE is HOST TARGET binding site found in the 3' untranslated region of mRNA encoded by KIAA1393, corresponding to a HOST TARGET binding site such as BINDING SITE I, BINDING SITE II or BINDING SITE III. Table 2 illustrates the complementarity of the nucleotide sequences of KIAA1393 BINDING SITE, designated SEQ ID:35686, to the nucleotide sequence of VGAM2308 RNA, herein designated VGAM RNA, also designated SEQ ID:5019.

Another function of VGAM2308 is therefore inhibition of KIAA1393 (Accession XM_050793). Accordingly, utilities of VGAM2308 include diagnosis, prevention and treatment of diseases and clinical conditions associated with KIAA1393. KIAA1495 (Accession XM_055080) is another VGAM2308 host target gene. KIAA1495 BINDING SITE is HOST TARGET binding site found in the 3' untranslated region of mRNA encoded by KIAA1495, corresponding to a HOST TARGET binding site such as BINDING SITE I, BINDING SITE II or BINDING SITE III. Table 2 illustrates the complementarity of the nucleotide sequences of KIAA1495 BINDING SITE, designated SEQ ID:36224, to the nucleotide sequence of VGAM2308 RNA, herein designated VGAM RNA, also designated SEQ ID:5019.

Another function of VGAM2308 is therefore inhibition of KIAA1495 (Accession XM_055080). Accordingly, utilities of VGAM2308 include diagnosis, prevention and treatment of diseases and clinical conditions associated with KIAA1495. KIAA1954 (Accession XM_085375) is another VGAM2308 host target gene. KIAA1954 BINDING SITE is HOST TARGET binding site found in the 3' untranslated region of mRNA encoded by KIAA1954, corresponding to a HOST TARGET binding site such as BINDING SITE I, BINDING SITE II or BINDING SITE III. Table 2 illustrates the complementarity of the nucleotide sequences of KIAA1954 BINDING SITE, designated SEQ ID:38096, to the nucleotide sequence of VGAM2308 RNA, herein designated VGAM RNA, also designated SEQ ID:5019.

Another function of VGAM2308 is therefore inhibition of KIAA1954 (Accession XM_085375). Accordingly, utilities of VGAM2308 include diagnosis, prevention and treatment of diseases and clinical conditions associated with KIAA1954. Karyopherin Alpha 6 (importin alpha 7) (KPNA6, Accession NM_012316) is another VGAM2308 host target gene. KPNA6 BINDING SITE is HOST TARGET binding site found in the 3' untranslated region of mRNA encoded by KPNA6, corresponding to a HOST TARGET binding site such as BINDING SITE I, BINDING SITE II or BINDING SITE III. Table 2 illustrates the complementarity of the nucleotide sequences of KPNA6 BINDING SITE, designated SEQ ID:14686, to the nucleotide sequence of VGAM2308 RNA, herein designated VGAM RNA, also designated SEQ ID:5019.

Another function of VGAM2308 is therefore inhibition of Karyopherin Alpha 6 (importin alpha 7) (KPNA6, Accession NM_012316). Accordingly, utilities of VGAM2308 include diagnosis, prevention and treatment of diseases and clinical conditions associated with KPNA6. RAP140 (Accession NM_015224) is another VGAM2308 host target gene. RAP140 BINDING SITE is HOST TARGET binding site found in the 5' untranslated region of mRNA encoded by RAP140, corresponding to a HOST TARGET binding site such as BINDING SITE I, BINDING SITE II or BINDING SITE III. Table 2 illustrates the complementarity of the nucleotide sequences of RAP140 BINDING SITE, designated SEQ ID:17555, to the nucleotide sequence of VGAM2308 RNA, herein designated VGAM RNA, also designated SEQ ID:5019.

Another function of VGAM2308 is therefore inhibition of RAP140 (Accession NM_015224). Accordingly, utilities of VGAM2308 include diagnosis, prevention and treatment of diseases and clinical conditions associated with RAP140. Serine Palmitoyltransferase, Long Chain Base Subunit 2 (SPTLC2, Accession NM_004863) is another VGAM2308 host target gene. SPTLC2 BINDING SITE is HOST TARGET binding site found in the 3' untranslated region of mRNA encoded by SPTLC2, corresponding to a HOST TARGET binding site such as BINDING SITE I, BINDING SITE II or BINDING SITE III. Table 2 illustrates the complementarity of the nucleotide sequences of SPTLC2 BINDING SITE, designated SEQ ID:11275, to the nucleotide sequence of VGAM2308 RNA, herein designated VGAM RNA, also designated SEQ ID:5019.

Another function of VGAM2308 is therefore inhibition of Serine Palmitoyltransferase, Long Chain Base Subunit 2 (SPTLC2, Accession NM_004863). Accordingly, utilities of VGAM2308 include diagnosis, prevention and treatment of diseases and clinical conditions associated with SPTLC2. LOC115219 (Accession XM_055499) is another VGAM2308 host target gene. LOC115219 BINDING SITE is HOST TARGET binding site found in the 3' untranslated region of mRNA encoded by LOC115219, corresponding to a HOST TARGET binding site such as BINDING SITE I, BINDING SITE II or BINDING SITE III. Table 2 illustrates the complementarity of the nucleotide sequences of LOC115219 BINDING SITE, designated SEQ ID:36277, to the nucleotide sequence of VGAM2308 RNA, herein designated VGAM RNA, also designated SEQ ID:5019.

Another function of VGAM2308 is therefore inhibition of LOC115219 (Accession XM_055499). Accordingly, utilities of VGAM2308 include diagnosis, prevention and treatment of diseases and clinical conditions associated with LOC115219. LOC202451 (Accession XM_117401) is another VGAM2308 host target gene. LOC202451 BINDING SITE is HOST TARGET binding site found in the 5' untranslated region of mRNA encoded by LOC202451, corresponding to a HOST TARGET binding site such as BINDING SITE I, BINDING SITE II or BINDING SITE III. Table 2 illustrates the complementarity of the nucleotide sequences of LOC202451 BINDING SITE, designated SEQ ID:43438, to the nucleotide sequence of VGAM2308 RNA, herein designated VGAM RNA, also designated SEQ ID:5019.

Another function of VGAM2308 is therefore inhibition of LOC202451 (Accession XM_117401). Accordingly, utilities of VGAM2308 include diagnosis, prevention and treatment of diseases and clinical conditions associated with LOC202451. LOC51185 (Accession NM_016302) is another VGAM2308 host target gene. LOC51185 BINDING SITE is HOST TARGET binding site found in the 3' untranslated region of mRNA encoded by LOC51185, corresponding to a HOST TARGET binding site such as BINDING SITE I, BINDING SITE II or BINDING SITE III. Table 2 illustrates the complementarity of the nucleotide sequences of LOC51185 BINDING SITE, designated SEQ ID:18423, to the nucleotide sequence of VGAM2308 RNA, herein designated VGAM RNA, also designated SEQ ID:5019.

Another function of VGAM2308 is therefore inhibition of LOC51185 (Accession NM_016302). Accordingly, utilities of VGAM2308 include diagnosis, prevention and treatment of diseases and clinical conditions associated with LOC51185. FIG. 1 further provides a conceptual description of a novel bioinformatically detected viral gene of the present invention, referred to here as Viral Genomic Address Messenger 2309 (VGAM2309) viral gene, which modulates expression of respective host target genes thereof, the function and utility of which host target genes is known in the art.

VGAM2309 is a novel bioinformatically detected regulatory, non protein coding, viral micro RNA (miRNA) gene. The method by which VGAM2309 was detected is described hereinabove with reference to FIGS. 1-8.

VGAM2309 gene, herein designated VGAM GENE, is a viral gene contained in the genome of Lumpy Skin Disease Virus. VGAM2309 host target gene, herein designated VGAM HOST TARGET GENE, is a human gene contained in the human genome.

VGAM2309 gene encodes a VGAM2309 precursor RNA, herein designated VGAM PRECURSOR RNA. Similar to other miRNA genes, and unlike most ordinary genes, VGAM2309 precursor RNA does not encode a protein. A nucleotide sequence identical or highly similar to the nucleotide sequence of VGAM2309 precursor RNA is designated SEQ ID:2295, and is provided hereinbelow with reference to the sequence listing part. Nucleotide sequence SEQ ID:2295 is located at position 127569 relative to the genome of Lumpy Skin Disease Virus.

VGAM2309 precursor RNA folds onto itself, forming VGAM2309 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2309 folded precursor RNA into VGAM2309 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2309 RNA is designated SEQ ID:5020, and is provided hereinbelow with reference to the sequence listing part.

VGAM2309 host target gene, herein designated VGAM HOST TARGET GENE, encodes a corresponding messenger RNA, VGAM2309 host target RNA, herein designated VGAM HOST TARGET RNA. VGAM2309 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2309 RNA, herein designated VGAM RNA, binds complementarily to one or more host target binding sites located in untranslated regions of VGAM2309 host target RNA, herein designated VGAM HOST TARGET RNA. This complementary binding is due to the fact that the nucleotide sequence of VGAM2309 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2309 RNA, herein designated VGAM RNA, may have a different number of host target binding sites in untranslated regions of a VGAM2309 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2309 RNA, herein designated VGAM RNA, to host target binding sites on VGAM2309 host target RNA, herein designated VGAM HOST TARGET RNA, such as BINDING SITE I, BINDING SITE II and BINDING SITE III, inhibits translation of VGAM2309 host target RNA into VGAM2309 host target protein, herein designated VGAM HOST TARGET PROTEIN. VGAM host target protein is therefore outlined by a broken line.

It is appreciated that VGAM2309 host target gene, herein designated VGAM HOST TARGET GENE, in fact represents a plurality of VGAM2309 host target genes. The mRNA of each one of this plurality of VGAM2309 host target genes comprises one or more host target binding sites, each having a nucleotide sequence which is at least partly complementary to VGAM2309 RNA, herein designated VGAM RNA, and which when bound by VGAM2309 RNA causes inhibition of translation of respective one or more VGAM2309 host target proteins.

It is further appreciated by one skilled in the art that the mode of translational inhibition illustrated by FIG. 1 with specific reference to translational inhibition exerted by VGAM2309 gene, herein designated VGAM GENE, on one or more VGAM2309 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2309 is inhibition of expression of host target genes, as part of a novel viral mechanism of attacking a host. Accordingly, utilities of VGAM2309 include diagnosis, prevention and treatment of viral infection by Lumpy Skin Disease Virus. Specific functions, and accordingly utilities, of VGAM2309 correlate with, and may be deduced from, the identity of the host target genes which VGAM2309 binds and inhibits, and the function of these host target genes, as elaborated hereinbelow.

Nucleotide sequences of the VGAM2309 precursor RNA, herein designated VGAM PRECURSOR RNA, and of the 'diced' VGAM2309 RNA, herein designated VGAM RNA, and a schematic representation of the secondary folding of VGAM2309 folded precursor RNA, herein designated VGAM FOLDED PRECURSOR RNA, of VGAM2309 are further described hereinbelow with reference to Table 1.

Nucleotide sequences of host target binding sites, such as BINDING SITE-I, BINDING SITE-II and BINDING SITE-III of FIG. 1, found on VGAM2309 host target RNA, and schematic representation of the complementarity of each of these host target binding sites to VGAM2309 RNA, herein designated VGAM RNA, are described hereinbelow with reference to Table 2.

As mentioned hereinabove with reference to FIG. 1, a function of VGAM2309 gene, herein designated VGAM is inhibition of expression of VGAM2309 target genes. It is appreciated that specific functions, and accordingly utilities, of VGAM2309 correlate with, and may be deduced from, the identity of the target genes which VGAM2309 binds and inhibits, and the function of these target genes, as elaborated hereinbelow.

FLJ23189 (Accession NM_025057) is a VGAM2309 host target gene. FLJ23189 BINDING SITE is HOST TARGET binding site found in the 3' untranslated region of mRNA encoded by FLJ23189, corresponding to a HOST TARGET binding site such as BINDING SITE I, BINDING SITE II or BINDING SITE III. Table 2 illustrates the complementarity of the nucleotide sequences of FLJ23189 BINDING SITE, designated SEQ ID:24656, to the nucleotide sequence of VGAM2309 RNA, herein designated VGAM RNA, also designated SEQ ID:5020.

A function of VGAM2309 is therefore inhibition of FLJ23189 (Accession NM_025057). Accordingly, utilities of VGAM2309 include diagnosis, prevention and treatment of diseases and clinical conditions associated with FLJ23189.

FIG. 1 further provides a conceptual description of a novel bioinformatically detected viral gene of the present invention, referred to here as Viral Genomic Address Messenger 2310 (VGAM2310) viral gene, which modulates expression of respective host target genes thereof, the function and utility of which host target genes is known in the art.

VGAM2310 is a novel bioinformatically detected regulatory, non protein coding, viral micro RNA (miRNA) gene. The method by which VGAM2310 was detected is described hereinabove with reference to FIGS. 1-8.

VGAM2310 gene, herein designated VGAM GENE, is a viral gene contained in the genome of Lumpy Skin Disease Virus. VGAM2310 host target gene, herein designated VGAM HOST TARGET GENE, is a human gene contained in the human genome.

VGAM2310 gene encodes a VGAM2310 precursor RNA, herein designated VGAM PRECURSOR RNA. Similar to other miRNA genes, and unlike most ordinary genes, VGAM2310 precursor RNA does not encode a protein. A nucleotide sequence identical or highly similar to the nucleotide sequence of VGAM2310 precursor RNA is designated SEQ ID:2296, and is provided hereinbelow with reference to the sequence listing part. Nucleotide sequence SEQ ID:2296 is located at position 135569 relative to the genome of Lumpy Skin Disease Virus.

VGAM2310 precursor RNA folds onto itself, forming VGAM2310 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2310 folded precursor RNA into VGAM2310 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2310 RNA is designated SEQ ID:5021, and is provided hereinbelow with reference to the sequence listing part.

VGAM2310 host target gene, herein designated VGAM HOST TARGET GENE, encodes a corresponding messenger RNA, VGAM2310 host target RNA, herein designated VGAM HOST TARGET RNA. VGAM2310 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2310 RNA, herein designated VGAM RNA, binds complementarily to one or more host target binding sites located in untranslated regions of VGAM2310 host target RNA, herein designated VGAM HOST TARGET RNA. This complementary binding is due to the fact that the nucleotide sequence of VGAM2310 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2310 RNA, herein designated VGAM RNA, may have a different number of host target binding sites in untranslated regions of a VGAM2310 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2310 RNA, herein designated VGAM RNA, to host target binding sites on VGAM2310 host target RNA, herein designated VGAM HOST TARGET RNA, such as BINDING SITE I, BINDING SITE II and BINDING SITE III, inhibits translation of VGAM2310 host target RNA into VGAM2310 host target protein, herein designated VGAM HOST TARGET PROTEIN. VGAM host target protein is therefore outlined by a broken line.

It is appreciated that VGAM2310 host target gene, herein designated VGAM HOST TARGET GENE, in fact represents a plurality of VGAM2310 host target genes. The mRNA of each one of this plurality of VGAM2310 host target genes comprises one or more host target binding sites, each having a nucleotide sequence which is at least partly complementary to VGAM2310 RNA, herein designated VGAM RNA, and which when bound by VGAM2310 RNA causes inhibition of translation of respective one or more VGAM2310 host target proteins.

It is further appreciated by one skilled in the art that the mode of translational inhibition illustrated by FIG. 1 with specific reference to translational inhibition exerted by VGAM2310 gene, herein designated VGAM GENE, on one or more VGAM2310 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2310 is inhibition of expression of host target genes, as part of a novel viral mechanism of attacking a host. Accordingly, utilities of VGAM2310 include diagnosis, prevention and treatment of viral infection by Lumpy Skin Disease Virus. Specific functions, and accordingly utilities, of VGAM2310 correlate with, and may be deduced from, the identity of the host target genes which VGAM2310 binds and inhibits, and the function of these host target genes, as elaborated hereinbelow.

Nucleotide sequences of the VGAM2310 precursor RNA, herein designated VGAM PRECURSOR RNA, and of the 'diced' VGAM2310 RNA, herein designated VGAM RNA, and a schematic representation of the secondary folding of VGAM2310 folded precursor RNA, herein designated VGAM FOLDED PRECURSOR RNA, of VGAM2310 are further described hereinbelow with reference to Table 1.

Nucleotide sequences of host target binding sites, such as BINDING SITE-I, BINDING SITE-II and BINDING SITE-III of FIG. 1, found on VGAM2310 host target RNA, and schematic representation of the complementarity of each of these host target binding sites to VGAM2310 RNA, herein designated VGAM RNA, are described hereinbelow with reference to Table 2.

As mentioned hereinabove with reference to FIG. 1, a function of VGAM2310 gene, herein designated VGAM is inhibition of expression of VGAM2310 target genes. It is appreciated that specific functions, and accordingly utilities, of VGAM2310 correlate with, and may be deduced from, the identity of the target genes which VGAM2310 binds and inhibits, and the function of these target genes, as elaborated hereinbelow.

Caldesmon 1 (CALD1, Accession NM_033138) is a VGAM2310 host target gene. CALD1 BINDING SITE1 and CALD1 BINDING SITE2 are HOST TARGET binding sites found in untranslated regions of mRNA encoded by CALD1, corresponding to HOST TARGET binding sites such as BINDING SITE I, BINDING SITE II or BINDING SITE III. Table 2 illustrates the complementarity of the nucleotide sequences of CALD1 BINDING SITE1 and CALD1 BINDING SITE2, designated SEQ ID:26991 and SEQ ID:27009 respectively, to the nucleotide sequence of VGAM2310 RNA, herein designated VGAM RNA, also designated SEQ ID:5021.

A function of VGAM2310 is therefore inhibition of Caldesmon 1 (CALD1, Accession NM_033138), a gene which is implicated in the regulation of actomyosin interactions in smooth muscle and nonmuscle cells. Accordingly, utilities of VGAM2310 include diagnosis, prevention and treatment of diseases and clinical conditions associated with CALD1. The function of CALD1 and its association with various diseases and clinical conditions, has been established by previous studies, as described hereinabove with reference to VGAM1960. Secreted Frizzled-related Protein 4 (SFRP4, Accession NM_003014) is another VGAM2310 host target gene. SFRP4 BINDING SITE is HOST TARGET binding site found in the 3' untranslated region of mRNA encoded by SFRP4, corresponding to a HOST TARGET binding site such as BINDING SITE I, BINDING SITE II or BINDING SITE III. Table 2 illustrates the complementarity of the nucleotide sequences of SFRP4 BINDING SITE, designated SEQ ID:8937, to the nucleotide sequence of VGAM2310 RNA, herein designated VGAM RNA, also designated SEQ ID:5021.

Another function of VGAM2310 is therefore inhibition of Secreted Frizzled-related Protein 4 (SFRP4, Accession NM_003014). Accordingly, utilities of VGAM2310 include diagnosis, prevention and treatment of diseases and clinical conditions associated with SFRP4. CG018 (Accession NM_052818) is another VGAM2310 host target gene. CG018 BINDING SITE is HOST TARGET binding site found in the 3' untranslated region of mRNA encoded by CG018, corresponding to a HOST TARGET binding site such as BINDING SITE I, BINDING SITE II or BINDING SITE III. Table 2 illustrates the complementarity of the nucleotide sequences of CG018 BINDING SITE, designated SEQ ID:27404, to the nucleotide sequence of VGAM2310 RNA, herein designated VGAM RNA, also designated SEQ ID:5021.

Another function of VGAM2310 is therefore inhibition of CG018 (Accession NM_052818). Accordingly, utilities of VGAM2310 include diagnosis, prevention and treatment of diseases and clinical conditions associated with CG018. Hypermethylated In Cancer 2 (HIC2, Accession XM_036937) is another VGAM2310 host target gene. HIC2 BINDING SITE is HOST TARGET binding site found in the 3' untranslated region of mRNA encoded by HIC2, corresponding to a HOST TARGET binding site such as BINDING SITE I, BINDING SITE II or BINDING SITE III. Table 2 illustrates the complementarity of the nucleotide sequences of HIC2 BINDING SITE, designated SEQ ID:32524, to the nucleotide sequence of VGAM2310 RNA, herein designated VGAM RNA, also designated SEQ ID:5021.

Another function of VGAM2310 is therefore inhibition of Hypermethylated In Cancer 2 (HIC2, Accession XM_036937). Accordingly, utilities of VGAM2310 include diagnosis, prevention and treatment of diseases and clinical conditions associated with HIC2. HTGN29 (Accession NM_020199) is another VGAM2310 host target gene. HTGN29 BINDING SITE is HOST TARGET binding site found in the 3' untranslated region of mRNA encoded by HTGN29, corresponding to a HOST TARGET binding site such as BINDING SITE I, BINDING SITE II or BINDING SITE III. Table 2 illustrates the complementarity of the nucleotide sequences of HTGN29 BINDING SITE, designated SEQ ID:21431, to the nucleotide sequence of VGAM2310 RNA, herein designated VGAM RNA, also designated SEQ ID:5021.

Another function of VGAM2310 is therefore inhibition of HTGN29 (Accession NM_020199). Accordingly, utilities of VGAM2310 include diagnosis, prevention and treatment of diseases and clinical conditions associated with HTGN29. KIAA1257 (Accession XM_031577) is another VGAM2310 host target gene. KIAA1257 BINDING SITE is HOST TARGET binding site found in the 3' untranslated region of mRNA encoded by KIAA1257, corresponding to a HOST TARGET binding site such as BINDING SITE I, BINDING SITE II or BINDING SITE III. Table 2 illustrates the complementarity of the nucleotide sequences of KIAA1257 BINDING SITE, designated SEQ ID:31438, to the nucleotide sequence of VGAM2310 RNA, herein designated VGAM RNA, also designated SEQ ID:5021.

Another function of VGAM2310 is therefore inhibition of KIAA1257 (Accession XM_031577). Accordingly, utilities of VGAM2310 include diagnosis, prevention and treatment of diseases and clinical conditions associated with KIAA1257. LOC201725 (Accession XM_114370) is another VGAM2310 host target gene. LOC201725 BINDING SITE is HOST TARGET binding site found in the 3' untranslated region of mRNA encoded by LOC201725, corresponding to a HOST TARGET binding site such as BINDING SITE I, BINDING SITE II or BINDING SITE III. Table 2 illustrates the complementarity of the nucleotide sequences of LOC201725 BINDING SITE, designated SEQ ID:42904, to the nucleotide sequence of VGAM2310 RNA, herein designated VGAM RNA, also designated SEQ ID:5021.

Another function of VGAM2310 is therefore inhibition of LOC201725 (Accession XM_114370). Accordingly, utilities of VGAM2310 include diagnosis, prevention and treatment of diseases and clinical conditions associated with LOC201725. LOC221810 (Accession XM_168222) is another VGAM2310 host target gene. LOC221810 BINDING SITE is HOST TARGET binding site found in the 3' untranslated region of mRNA encoded by LOC221810, corresponding to a HOST TARGET binding site such as BINDING SITE I, BINDING SITE II or BINDING SITE III. Table 2 illustrates the complementarity of the nucleotide sequences of LOC221810 BINDING SITE, designated SEQ ID:45082, to the nucleotide sequence of VGAM2310 RNA, herein designated VGAM RNA, also designated SEQ ID:5021.

Another function of VGAM2310 is therefore inhibition of LOC221810 (Accession XM_168222). Accordingly, utilities of VGAM2310 include diagnosis, prevention and treatment of diseases and clinical conditions associated with LOC221810. LOC256073 (Accession XM_172972) is another VGAM2310 host target gene. LOC256073 BINDING SITE is HOST TARGET binding site found in the 3' untranslated region of mRNA encoded by LOC256073, corresponding to a HOST TARGET binding site such as BINDING SITE I, BINDING SITE II or BINDING SITE III. Table 2 illustrates the complementarity of the nucleotide sequences of LOC256073 BINDING SITE, designated SEQ ID:46228, to the nucleotide sequence of VGAM2310 RNA, herein designated VGAM RNA, also designated SEQ ID:5021.

Another function of VGAM2310 is therefore inhibition of LOC256073 (Accession XM_172972). Accordingly, utilities of VGAM2310 include diagnosis, prevention and treatment of diseases and clinical conditions associated with LOC256073. FIG. 1 further provides a conceptual description of a novel bioinformatically detected viral gene of the present invention, referred to here as Viral Genomic Address Messenger 2311 (VGAM2311) viral gene, which modulates expression of respective host target genes thereof, the function and utility of which host target genes is known in the art.

VGAM2311 is a novel bioinformatically detected regulatory, non protein coding, viral micro RNA (miRNA) gene. The method by which VGAM2311 was detected is described hereinabove with reference to FIGS. 1-8.

VGAM2311 gene, herein designated VGAM GENE, is a viral gene contained in the genome of Lumpy Skin Disease Virus. VGAM2311 host target gene, herein designated VGAM HOST TARGET GENE, is a human gene contained in the human genome.

VGAM2311 gene encodes a VGAM2311 precursor RNA, herein designated VGAM PRECURSOR RNA. Similar to other miRNA genes, and unlike most ordinary genes, VGAM2311 precursor RNA does not encode a protein. A nucleotide sequence identical or highly similar to the nucleotide sequence of VGAM2311 precursor RNA is designated SEQ ID:2297, and is provided hereinbelow with reference to the sequence listing part. Nucleotide sequence SEQ ID:2297 is located at position 139025 relative to the genome of Lumpy Skin Disease Virus.

VGAM2311 precursor RNA folds onto itself, forming VGAM2311 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2311 folded precursor RNA into VGAM2311 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM2311 RNA is designated SEQ ID:5022, and is provided hereinbelow with reference to the sequence listing part.

VGAM2311 host target gene, herein designated VGAM HOST TARGET GENE, encodes a corresponding messenger RNA, VGAM2311 host target RNA, herein designated VGAM HOST TARGET RNA. VGAM2311 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2311 RNA, herein designated VGAM RNA, binds complementarily to one or more host target binding sites located in untranslated regions of VGAM2311 host target RNA, herein designated VGAM HOST TARGET RNA. This complementary binding is due to the fact that the nucleotide sequence of VGAM2311 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2311 RNA, herein designated VGAM RNA, may have a different number of host target binding sites in untranslated regions of a VGAM2311 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2311 RNA, herein designated VGAM RNA, to host target binding sites on VGAM2311 host target RNA, herein designated VGAM HOST TARGET RNA, such as BINDING SITE I, BINDING SITE II and BINDING SITE III, inhibits translation of VGAM2311 host target RNA into VGAM2311 host target protein, herein designated VGAM HOST TARGET PROTEIN. VGAM host target protein is therefore outlined by a broken line.

It is appreciated that VGAM2311 host target gene, herein designated VGAM HOST TARGET GENE, in fact represents a plurality of VGAM2311 host target genes. The mRNA of each one of this plurality of VGAM2311 host target genes comprises one or more host target binding sites, each having a nucleotide sequence which is at least partly complementary to VGAM2311 RNA, herein designated VGAM RNA, and which when bound by VGAM2311 RNA causes inhibition of translation of respective one or more VGAM2311 host target proteins.

It is further appreciated by one skilled in the art that the mode of translational inhibition illustrated by FIG. 1 with specific reference to translational inhibition exerted by VGAM2311 gene, herein designated VGAM GENE, on one or more VGAM2311 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2311 is inhibition of expression of host target genes, as part of a novel viral mechanism of attacking a host. Accordingly, utilities of VGAM2311 include diagnosis, prevention and treatment of viral infection by Lumpy Skin Disease Virus. Specific functions, and accordingly utilities, of VGAM2311 correlate with, and may be deduced from, the identity of the host target genes which VGAM2311 binds and inhibits, and the function of these host target genes, as elaborated hereinbelow.

Nucleotide sequences of the VGAM2311 precursor RNA, herein designated VGAM PRECURSOR RNA, and of the 'diced' VGAM2311 RNA, herein designated VGAM RNA, and a schematic representation of the secondary folding of VGAM2311 folded precursor RNA, herein designated VGAM FOLDED PRECURSOR RNA, of VGAM2311 are further described hereinbelow with reference to Table 1.

Nucleotide sequences of host target binding sites, such as BINDING SITE-I, BINDING SITE-II and BINDING SITE-III of FIG. 1, found on VGAM2311 host target RNA, and schematic representation of the complementarity of each of these host target binding sites to VGAM2311 RNA, herein designated VGAM RNA, are described hereinbelow with reference to Table 2.

As mentioned hereinabove with reference to FIG. 1, a function of VGAM2311 gene, herein designated VGAM is inhibition of expression of VGAM2311 target genes. It is appreciated that specific functions, and accordingly utilities, of VGAM2311 correlate with, and may be deduced from, the identity of the target genes which VGAM2311 binds and inhibits, and the function of these target genes, as elaborated hereinbelow.

Myotubularin Related Protein 8 (MTMR8, Accession NM_015458) is a VGAM2311 host target gene. MTMR8 BINDING SITE is HOST TARGET binding site found in the 3' untranslated region of mRNA encoded by MTMR8, corresponding to a HOST TARGET binding site such as BINDING SITE I, BINDING SITE II or BINDING SITE III. Table 2 illustrates the complementarity of the nucleotide sequences of MTMR8 BINDING SITE, designated SEQ ID:17746, to the nucleotide sequence of VGAM2311 RNA, herein designated VGAM RNA, also designated SEQ ID:5022.

A function of VGAM2311 is therefore inhibition of Myotubularin Related Protein 8 (MTMR8, Accession NM_015458), a gene which could be a tyrosine-phosphatase. Accordingly, utilities of VGAM2311 include diagnosis, prevention and treatment of diseases and clinical conditions associated with MTMR8. The function of MTMR8 and its association with various diseases and clinical conditions, has been established by previous studies, as described hereinabove with reference to VGAM379. PR Domain Containing 4 (PRDM4, Accession NM_012406) is another VGAM2311 host target gene. PRDM4 BINDING SITE is HOST TARGET binding site found in the 3' untranslated region of mRNA encoded by PRDM4, corresponding to a HOST TARGET binding site such as BINDING SITE I, BINDING SITE II or BINDING SITE III. Table 2 illustrates the complementarity of the nucleotide sequences of PRDM4 BINDING SITE, designated SEQ ID:14786, to the nucleotide sequence of VGAM2311 RNA, herein designated VGAM RNA, also designated SEQ ID:5022.

Another function of VGAM2311 is therefore inhibition of PR Domain Containing 4 (PRDM4, Accession NM_012406). Accordingly, utilities of VGAM2311 include diagnosis, prevention and treatment of diseases and clinical conditions associated with PRDM4. Solute Carrier Family 35 (UDP-N-acetylglucosamine (UDP-GlcNAc) Transporter), Member 3 (SLC35A3, Accession NM_012243) is another VGAM2311 host target gene. SLC35A3 BINDING SITE is HOST TARGET binding site found in the 3" untranslated region of mRNA encoded by SLC35A3, corresponding to a HOST TARGET binding site such as BINDING SITE I, BINDING SITE II or BINDING SITE III. Table 2 illustrates the complementarity of the nucleotide sequences of SLC35A3 BINDING SITE, designated SEQ ID:14548, to the nucleotide sequence of VGAM2311 RNA, herein designated VGAM RNA, also designated SEQ ID:5022.

Another function of VGAM2311 is therefore inhibition of Solute Carrier Family 35 (UDP-N-acetylglucosamine (UDP-GlcNAc) Transporter), Member 3 (SLC35A3, Accession NM_012243). Accordingly, utilities of VGAM2311 include diagnosis, prevention and treatment of diseases and clinical conditions associated with SLC35A3. SON DNA Binding Protein (SON, Accession NM_058183) is another VGAM2311 host target gene. SON BINDING SITE1 through SON BINDING SITE3 are HOST TARGET binding sites found in untranslated regions of mRNA encoded by SON, corresponding to HOST TARGET binding sites such as BINDING SITE I, BINDING SITE II or BINDING SITE III. Table 2 illustrates the complementarity of the nucleotide sequences of SON BINDING SITE1 through SON BINDING SITE3, designated SEQ ID:27744, SEQ ID:29040 and SEQ ID:29045 respectively, to the nucleotide sequence of VGAM2311 RNA, herein designated VGAM RNA, also designated SEQ ID:5022.

Another function of VGAM2311 is therefore inhibition of SON DNA Binding Protein (SON, Accession NM_058183). Accordingly, utilities of VGAM2311 include diagnosis, prevention and treatment of diseases and clinical conditions associated with SON. KIAA1600 (Accession XM_049351) is another VGAM2311 host target gene. KIAA1600 BINDING SITE is HOST TARGET binding site found in the 3' untranslated region of mRNA encoded by KIAA1600, corresponding to a HOST TARGET binding site such as BINDING SITE I, BINDING SITE II or BINDING SITE III. Table 2 illustrates the complementarity of the nucleotide sequences of KIAA1600 BINDING SITE, designated SEQ ID:35390, to the nucleotide sequence of VGAM2311 RNA, herein designated VGAM RNA, also designated SEQ ID:5022.

Another function of VGAM2311 is therefore inhibition of KIAA1600 (Accession XM_049351). Accordingly, utilities of VGAM2311 include diagnosis, prevention and treatment of diseases and clinical conditions associated with KIAA1600. MGC4737 (Accession NM_031466) is another VGAM2311 host target gene. MGC4737 BINDING SITE is HOST TARGET binding site found in the 5' untranslated region of mRNA encoded by MGC4737, corresponding to a HOST TARGET binding site such as BINDING SITE I, BINDING SITE II or BINDING SITE III. Table 2 illustrates the complementarity of the nucleotide sequences of MGC4737 BINDING SITE, designated SEQ ID:25507, to the nucleotide sequence of VGAM2311 RNA, herein designated VGAM RNA, also designated SEQ ID:5022.

Another function of VGAM2311 is therefore inhibition of MGC4737 (Accession NM_031466). Accordingly, utilities of VGAM2311 include diagnosis, prevention and treatment of diseases and clinical conditions associated with MGC4737. LOC126964 (Accession XM_059100) is another VGAM2311 host target gene. LOC126964 BINDING SITE is HOST TARGET binding site found in the 3' untranslated region of mRNA encoded by LOC126964, corresponding to a HOST TARGET binding site such as BINDING SITE I, BINDING SITE II or BINDING SITE III. Table 2 illustrates the complementarity of the nucleotide sequences of LOC126964 BINDING SITE, designated SEQ ID:36884, to the nucleotide sequence of VGAM2311 RNA, herein designated VGAM RNA, also designated SEQ ID:5022.

Another function of VGAM2311 is therefore inhibition of LOC126964 (Accession XM_059100). Accordingly, utilities of VGAM2311 include diagnosis, prevention and treatment of diseases and clinical conditions associated with LOC126964. LOC128344 (Accession XM_059234) is another VGAM2311 host target gene. LOC128344 BINDING SITE is HOST TARGET binding site found in the 3' untranslated region of mRNA encoded by LOC128344, corresponding to a HOST TARGET binding site such as BINDING SITE I, BINDING SITE II or BINDING SITE III. Table 2 illustrates the complementarity of the nucleotide sequences of LOC128344 BINDING SITE, designated SEQ ID:36923, to the nucleotide sequence of VGAM2311 RNA, herein designated VGAM RNA, also designated SEQ ID:5022.

Another function of VGAM2311 is therefore inhibition of LOC128344 (Accession XM_059234). Accordingly, utilities of VGAM2311 include diagnosis, prevention and treatment of diseases and clinical conditions associated with LOC128344. LOC152245 (Accession XM_098182) is another VGAM2311 host target gene. LOC152245 BINDING SITE is HOST TARGET binding site found in the 3' untranslated region of mRNA encoded by LOC152245, corresponding to a HOST TARGET binding site such as BINDING SITE I, BINDING SITE II or BINDING SITE III. Table 2 illustrates the complementarity of the nucleotide sequences of LOC152245 BINDING SITE, designated SEQ ID:41451, to the nucleotide sequence of VGAM2311 RNA, herein designated VGAM RNA, also designated SEQ ID:5022.

Another function of VGAM2311 is therefore inhibition of LOC152245 (Accession XM_098182). Accordingly, utilities of VGAM2311 include diagnosis, prevention and treatment of diseases and clinical conditions associated with LOC152245. FIG. 1 further provides a conceptual description of a novel bioinformatically detected viral gene of the present invention, referred to here as Viral Genomic Address Messenger 2312 (VGAM2312) viral gene, which modulates expression of respective host target genes thereof, the function and utility of which host target genes is known in the art.

VGAM2312 is a novel bioinformatically detected regulatory, non protein coding, viral micro RNA (miRNA) gene. The method by which VGAM2312 was detected is described hereinabove with reference to FIGS. 1-8.

VGAM2312 gene, herein designated VGAM GENE, is a viral gene contained in the genome of Lumpy Skin Disease Virus. VGAM2312 host target gene, herein designated VGAM HOST TARGET GENE, is a human gene contained in the human genome.

VGAM2312 gene encodes a VGAM2312 precursor RNA, herein designated VGAM PRECURSOR RNA. Similar to other miRNA genes, and unlike most ordinary genes, VGAM2312 precursor RNA does not encode a protein. A nucleotide sequence identical or highly similar to the nucleotide sequence of VGAM2312 precursor RNA is designated SEQ ID:2298, and is provided hereinbelow with reference to the sequence listing part. Nucleotide sequence SEQ ID:2298 is located at position 2051 relative to the genome of Lumpy Skin Disease Virus.

VGAM2312 precursor RNA folds onto itself, forming VGAM2312 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2312 folded precursor RNA into VGAM2312 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM2312 RNA is designated SEQ ID:5023, and is provided hereinbelow with reference to the sequence listing part.

VGAM2312 host target gene, herein designated VGAM HOST TARGET GENE, encodes a corresponding messenger RNA, VGAM2312 host target RNA, herein designated VGAM HOST TARGET RNA. VGAM2312 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2312 RNA, herein designated VGAM RNA, binds complementarily to one or more host target binding sites located in untranslated regions of VGAM2312 host target RNA, herein designated VGAM HOST TARGET RNA. This complementary binding is due to the fact that the nucleotide sequence of VGAM2312 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2312 RNA, herein designated VGAM RNA, may have a different number of host target binding sites in untranslated regions of a VGAM2312 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2312 RNA, herein designated VGAM RNA, to host target binding sites on VGAM2312 host target RNA, herein designated VGAM HOST TARGET RNA, such as BINDING SITE I, BINDING SITE II and BINDING SITE III, inhibits translation of VGAM2312 host target RNA into VGAM2312 host target protein, herein designated VGAM HOST TARGET PROTEIN. VGAM host target protein is therefore outlined by a broken line.

It is appreciated that VGAM2312 host target gene, herein designated VGAM HOST TARGET GENE, in fact represents a plurality of VGAM2312 host target genes. The mRNA of each one of this plurality of VGAM2312 host target genes comprises one or more host target binding sites, each having a nucleotide sequence which is at least partly complementary to VGAM2312 RNA, herein designated VGAM RNA, and which when bound by VGAM2312 RNA causes inhibition of translation of respective one or more VGAM2312 host target proteins.

It is further appreciated by one skilled in the art that the mode of translational inhibition illustrated by FIG. 1 with specific reference to translational inhibition exerted by VGAM2312 gene, herein designated VGAM GENE, on one or more VGAM2312 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2312 is inhibition of expression of host target genes, as part of a novel viral mechanism of attacking a host. Accordingly, utilities of VGAM2312 include diagnosis, prevention and treatment of viral infection by Lumpy Skin Disease Virus. Specific functions, and accordingly utilities, of VGAM2312 correlate with, and may be deduced from, the identity of the host target genes which VGAM2312 binds and inhibits, and the function of these host target genes, as elaborated hereinbelow.

Nucleotide sequences of the VGAM2312 precursor RNA, herein designated VGAM PRECURSOR RNA, and of the 'diced' VGAM2312 RNA, herein designated VGAM RNA, and a schematic representation of the secondary folding of VGAM2312 folded precursor RNA, herein designated VGAM FOLDED PRECURSOR RNA, of VGAM2312 are further described hereinbelow with reference to Table 1.

Nucleotide sequences of host target binding sites, such as BINDING SITE-I, BINDING SITE-II and BINDING SITE-III of FIG. 1, found on VGAM2312 host target RNA, and schematic representation of the complementarity of each of these host target binding sites to VGAM2312 RNA, herein designated VGAM RNA, are described hereinbelow with reference to Table 2.

As mentioned hereinabove with reference to FIG. 1, a function of VGAM2312 gene, herein designated VGAM is inhibition of expression of VGAM2312 target genes. It is appreciated that specific functions, and accordingly utilities, of VGAM2312 correlate with, and may be deduced from, the identity of the target genes which VGAM2312 binds and inhibits, and the function of these target genes, as elaborated hereinbelow.

Heterogeneous Nuclear Ribonucleoprotein D-like (HNRPDL, Accession NM_005463) is a VGAM2312 host target gene. HNRPDL BINDING SITE is HOST TARGET binding site found in the 3' untranslated region of mRNA encoded by HNRPDL, corresponding to a HOST TARGET binding site such as BINDING SITE I, BINDING SITE II or BINDING SITE III. Table 2 illustrates the complementarity of the nucleotide sequences of HNRPDL BINDING SITE, designated SEQ ID:11956, to the nucleotide sequence of VGAM2312 RNA, herein designated VGAM RNA, also designated SEQ ID:5023.

A function of VGAM2312 is therefore inhibition of Heterogeneous Nuclear Ribonucleoprotein D-like (HNRPDL, Accession NM_005463), a gene which binds to rna molecules that contain au-rich elements. Accordingly, utilities of VGAM2312 include diagnosis, prevention and treatment of diseases and clinical conditions associated with HNRPDL. The function of HNRPDL and its association with various diseases and clinical conditions, has been established by previous studies, as described hereinabove with reference to VGAM144. 5-hydroxytryptamine (serotonin) Receptor 4 (HTR4, Accession NM_000870) is another VGAM2312 host target gene. HTR4 BINDING SITE is HOST TARGET binding site found in the 3' untranslated region of mRNA encoded by HTR4, corresponding to a HOST TARGET binding site such as BINDING SITE I, BINDING SITE II or BINDING SITE III. Table 2 illustrates the complementarity of the nucleotide sequences of HTR4 BINDING SITE, designated SEQ ID:6544, to the nucleotide sequence of VGAM2312 RNA, herein designated VGAM RNA, also designated SEQ ID:5023.

Another function of VGAM2312 is therefore inhibition of 5-hydroxytryptamine (serotonin) Receptor 4 (HTR4, Accession NM_000870), a gene which mediates calcium channel currents. Accordingly, utilities of VGAM2312 include diagnosis, prevention and treatment of diseases and clinical conditions associated with HTR4. The function of HTR4 and its association with various diseases and clinical conditions, has been established by previous studies, as described hereinabove with reference to VGAM65. V-src Sarcoma (Schmidt-Ruppin A-2) Viral Oncogene Homolog (avian) (SRC, Accession NM_005417) is another VGAM2312 host target gene. SRC BINDING SITE is HOST TARGET binding site found in the 3' untranslated region of mRNA encoded by SRC, corresponding to a HOST TARGET binding site such as BINDING SITE I, BINDING SITE II or BINDING SITE III. Table 2 illustrates the complementarity of the nucleotide sequences of SRC BINDING SITE, designated SEQ ID:11887, to the nucleotide sequence of VGAM2312 RNA, herein designated VGAM RNA, also designated SEQ ID:5023.

Another function of VGAM2312 is therefore inhibition of V-src Sarcoma (Schmidt-Ruppin A-2) Viral Oncogene Homolog (avian) (SRC, Accession NM_005417), a gene which is a tyrosine kinase. Accordingly, utilities of VGAM2312 include diagnosis, prevention and treatment of diseases and clinical conditions associated with SRC. The function of SRC and its association with various diseases and clinical conditions, has been established by previous studies, as described hereinabove with reference to VGAM721. Sulfotransferase Family, Cytosolic, 1C, Member 1 (SULT1C1, Accession NM_001056) is another VGAM2312 host target gene. SULT1C1 BINDING SITE is HOST TARGET binding site found in the 3' untranslated region of mRNA encoded by SULT1C1, corresponding to a HOST TARGET binding site such as BINDING SITE I, BINDING SITE II or BINDING SITE III. Table 2 illustrates the complementarity of the nucleotide sequences of SULT1C1 BINDING SITE, designated SEQ ID:6720, to the nucleotide sequence of VGAM2312 RNA, herein designated VGAM RNA, also designated SEQ ID:5023.

Another function of VGAM2312 is therefore inhibition of Sulfotransferase Family, Cytosolic, 1C, Member 1 (SULT1C1, Accession NM_001056). Accordingly, utilities of VGAM2312 include diagnosis, prevention and treatment of diseases and clinical conditions associated with SULT1C1. Transcription Factor 2, Hepatic; LF-B3; Variant Hepatic Nuclear Factor (TCF2, Accession NM_006481) is another VGAM2312 host target gene. TCF2 BINDING SITE is HOST TARGET binding site found in the 3' untranslated region of mRNA encoded by TCF2, corresponding to a HOST TARGET binding site such as BINDING SITE I, BINDING SITE II or BINDING SITE III. Table 2 illustrates the complementarity of the nucleotide sequences of TCF2 BINDING SITE, designated SEQ ID:13202, to the nucleotide sequence of VGAM2312 RNA, herein designated VGAM RNA, also designated SEQ ID:5023.

Another function of VGAM2312 is therefore inhibition of Transcription Factor 2, Hepatic; LF-B3; Variant Hepatic Nuclear Factor (TCF2, Accession NM_006481), a gene which probably binds to the inverted palindrome 5'-gttaatnattaac-3'. Accordingly, utilities of VGAM2312 include diagnosis, prevention and treatment of diseases and clinical conditions associated with TCF2. The function of TCF2 and its association with various diseases and clinical conditions, has been established by previous studies, as described hereinabove with reference to VGAM118. Testis Enhanced Gene Transcript (BAX inhibitor 1) (TEGT, Accession XM_035490) is another VGAM2312 host target gene. TEGT BINDING SITE is HOST TARGET binding site found in the 3' untranslated region of mRNA encoded by TEGT, corresponding to a HOST TARGET binding site such as BINDING SITE I, BINDING SITE II or BINDING SITE III. Table 2 illustrates the complementarity of the nucleotide sequences of TEGT BINDING SITE, designated SEQ ID:32274, to the nucleotide sequence of VGAM2312 RNA, herein designated VGAM RNA, also designated SEQ ID:5023.

Another function of VGAM2312 is therefore inhibition of Testis Enhanced Gene Transcript (BAX inhibitor 1) (TEGT, Accession XM_035490), a gene which is a suppressor of apoptosis. Accordingly, utilities of VGAM2312 include diagnosis, prevention and treatment of diseases and clinical conditions associated with TEGT. The function of TEGT and its association with various diseases and clinical conditions, has been established by previous studies, as described hereinabove with reference to VGAM2276. Visinin-like 1 (VSNL1, Accession NM_003385) is another VGAM2312 host target gene. VSNL1 BINDING SITE is HOST TARGET binding site found in the 3' untranslated region of mRNA encoded by VSNL1, corresponding to a HOST TARGET binding site such as BINDING SITE I, BINDING SITE II or BINDING SITE III. Table 2 illustrates the complementarity of the nucleotide sequences of VSNL1 BINDING SITE, designated SEQ ID:9418, to the nucleotide sequence of VGAM2312 RNA, herein designated VGAM RNA, also designated SEQ ID:5023.

Another function of VGAM2312 is therefore inhibition of Visinin-like 1 (VSNL1, Accession NM_003385). Accordingly, utilities of VGAM2312 include diagnosis, prevention and treatment of diseases and clinical conditions associated with VSNL1. DCOHM (Accession NM_032151) is another VGAM2312 host target gene. DCOHM BINDING SITE is HOST TARGET binding site found in the 3' untranslated region of mRNA encoded by DCOHM, corresponding to a HOST TARGET binding site such as BINDING SITE I, BINDING SITE II or BINDING SITE III. Table 2 illustrates the complementarity of the nucleotide sequences of DCOHM BINDING SITE, designated SEQ ID:25844, to the nucleotide sequence of VGAM2312 RNA, herein designated VGAM RNA, also designated SEQ ID:5023.

Another function of VGAM2312 is therefore inhibition of DCOHM (Accession NM_032151). Accordingly, utilities of VGAM2312 include diagnosis, prevention and treatment of diseases and clinical conditions associated with DCOHM. EFS2 (Accession NM_005864) is another VGAM2312 host target gene. EFS2 BINDING SITE is HOST TARGET binding site found in the 3' untranslated region of mRNA encoded by EFS2, corresponding to a HOST TARGET binding site such as BINDING SITE I, BINDING SITE II or BINDING SITE III. Table 2 illustrates the complementarity of the nucleotide sequences of EFS2 BINDING SITE, designated SEQ ID:12480, to the nucleotide sequence of VGAM2312 RNA, herein designated VGAM RNA, also designated SEQ ID:5023.

Another function of VGAM2312 is therefore inhibition of EFS2 (Accession NM_005864). Accordingly, utilities of VGAM2312 include diagnosis, prevention and treatment of diseases and clinical conditions associated with EFS2. FLJ10511 (Accession NM_018120) is another VGAM2312 host target gene. FLJ10511 BINDING SITE is HOST TARGET binding site found in the 3' untranslated region of mRNA encoded by FLJ10511, corresponding to a HOST TARGET binding site such as BINDING SITE I, BINDING SITE II or BINDING SITE III. Table 2 illustrates the complementarity of the nucleotide sequences of FLJ10511 BINDING SITE, designated SEQ ID:19901, to the nucleotide sequence of VGAM2312 RNA, herein designated VGAM RNA, also designated SEQ ID:5023.

Another function of VGAM2312 is therefore inhibition of FLJ10511 (Accession NM_018120). Accordingly, utilities of VGAM2312 include diagnosis, prevention and treatment of diseases and clinical conditions associated with FLJ10511. FLJ20040 (Accession NM_018992) is another VGAM2312 host target gene. FLJ20040 BINDING SITE is HOST TARGET binding site found in the 3' untranslated region of mRNA encoded by FLJ20040, corresponding to a HOST TARGET binding site such as BINDING SITE I, BINDING SITE II or BINDING SITE III. Table 2 illustrates the complementarity of the nucleotide sequences of FLJ20040 BINDING SITE, designated SEQ ID:21067, to the nucleotide sequence of VGAM2312 RNA, herein designated VGAM RNA, also designated SEQ ID:5023.

Another function of VGAM2312 is therefore inhibition of FLJ20040 (Accession NM_018992). Accordingly, utilities of VGAM2312 include diagnosis, prevention and treatment of diseases and clinical conditions associated with FLJ20040. FLJ22569 (Accession NM_023925) is another VGAM2312 host target gene. FLJ22569 BINDING SITE is HOST TARGET binding site found in the 5' untranslated region of mRNA encoded by FLJ22569, corresponding to a HOST TARGET binding site such as BINDING SITE I, BINDING SITE II or BINDING SITE III. Table 2 illustrates the complementarity of the nucleotide sequences of FLJ22569 BINDING SITE, designated SEQ ID:23401, to the nucleotide sequence of VGAM2312 RNA, herein designated VGAM RNA, also designated SEQ ID:5023.

Another function of VGAM2312 is therefore inhibition of FLJ22569 (Accession NM_023925). Accordingly, utilities of VGAM2312 include diagnosis, prevention and treatment of diseases and clinical conditions associated with FLJ22569. FLJ23053 (Accession NM_022907) is another VGAM2312 host target gene. FLJ23053 BINDING SITE is HOST TARGET binding site found in the 3' untranslated region of mRNA encoded by FLJ23053, corresponding to a HOST TARGET binding site such as BINDING SITE I, BINDING SITE II or BINDING SITE III. Table 2 illustrates the complementarity of the nucleotide sequences of FLJ23053 BINDING SITE, designated SEQ ID:23208, to the nucleotide sequence of VGAM2312 RNA, herein designated VGAM RNA, also designated SEQ ID:5023.

Another function of VGAM2312 is therefore inhibition of FLJ23053 (Accession NM_022907). Accordingly, utilities of VGAM2312 include diagnosis, prevention and treatment of diseases and clinical conditions associated with FLJ23053. Glutamate Receptor, Ionotropic, Delta 1 (GRID1, Accession XM_043613) is another VGAM2312 host target gene. GRID1 BINDING SITE is HOST TARGET binding site found in the 3' untranslated region of mRNA encoded by GRID1, corresponding to a HOST TARGET binding site such as BINDING SITE I, BINDING SITE II or BINDING SITE III. Table 2 illustrates the complementarity of the nucleotide sequences of GRID1 BINDING SITE, designated SEQ ID:33978, to the nucleotide sequence of VGAM2312 RNA, herein designated VGAM RNA, also designated SEQ ID:5023.

Another function of VGAM2312 is therefore inhibition of Glutamate Receptor, Ionotropic, Delta 1 (GRID1, Accession XM_043613). Accordingly, utilities of VGAM2312 include diagnosis, prevention and treatment of diseases and clinical conditions associated with GRID1. KIAA0268 (Accession XM_046126) is another VGAM2312 host target gene. KIAA0268 BINDING SITE is HOST TARGET binding site found in the 3' untranslated region of mRNA encoded by KIAA0268, corresponding to a HOST TARGET binding site such as BINDING SITE I, BINDING SITE II or BINDING SITE III. Table 2 illustrates the complementarity of the nucleotide sequences of KIAA0268 BINDING SITE, designated SEQ ID:34684, to the nucleotide sequence of VGAM2312 RNA, herein designated VGAM RNA, also designated SEQ ID:5023.

Another function of VGAM2312 is therefore inhibition of KIAA0268 (Accession XM_046126). Accordingly, utilities of VGAM2312 include diagnosis, prevention and treatment of diseases and clinical conditions associated with KIAA0268. MGC12466 (Accession XM_086336) is another VGAM2312 host target gene. MGC12466 BINDING SITE is HOST TARGET binding site found in the 3' untranslated region of mRNA encoded by MGC12466, corresponding to a HOST TARGET binding site such as BINDING SITE I, BINDING SITE II or BINDING SITE III. Table 2 illustrates the complementarity of the nucleotide sequences of MGC12466 BINDING SITE, designated SEQ ID:38610, to the nucleotide sequence of VGAM2312 RNA, herein designated VGAM RNA, also designated SEQ ID:5023.

Another function of VGAM2312 is therefore inhibition of MGC12466 (Accession XM_086336). Accordingly, utilities of VGAM2312 include diagnosis, prevention and treatment of diseases and clinical conditions associated with MGC12466. LOC145135 (Accession XM_096721) is another VGAM2312 host target gene. LOC145135 BINDING SITE is HOST TARGET binding site found in the 5' untranslated region of mRNA encoded by LOC145135, corresponding to a HOST TARGET binding site such as BINDING SITE I, BINDING SITE II or BINDING SITE III. Table 2 illustrates the complementarity of the nucleotide sequences of LOC145135 BINDING SITE, designated SEQ ID:40498, to the nucleotide sequence of VGAM2312 RNA, herein designated VGAM RNA, also designated SEQ ID:5023.

Another function of VGAM2312 is therefore inhibition of LOC145135 (Accession XM_096721). Accordingly, utilities of VGAM2312 include diagnosis, prevention and treatment of diseases and clinical conditions associated with LOC145135. LOC196528 (Accession XM_113745) is another VGAM2312 host target gene. LOC196528 BINDING SITE is HOST TARGET binding site found in the 3' untranslated region of mRNA encoded by LOC196528, corresponding to a HOST TARGET binding site such as BINDING SITE I, BINDING SITE II or BINDING SITE III. Table 2 illustrates the complementarity of the nucleotide sequences of LOC196528 BINDING SITE, designated SEQ ID:42407, to the nucleotide sequence of VGAM2312 RNA, herein designated VGAM RNA, also designated SEQ ID:5023.

Another function of VGAM2312 is therefore inhibition of LOC196528 (Accession XM_113745). Accordingly, utilities of VGAM2312 include diagnosis, prevention and treatment of diseases and clinical conditions associated with LOC196528. LOC92303 (Accession XM_044108) is another VGAM2312 host target gene. LOC92303 BINDING SITE is HOST TARGET binding site found in the 3' untranslated region of mRNA encoded by LOC92303, corresponding to a HOST TARGET binding site such as BINDING SITE I, BINDING SITE II or BINDING SITE III. Table 2 illustrates the complementarity of the nucleotide sequences of LOC92303 BINDING SITE, designated SEQ ID:34135, to the nucleotide sequence of VGAM2312 RNA, herein designated VGAM RNA, also designated SEQ ID:5023.

Another function of VGAM2312 is therefore inhibition of LOC92303 (Accession XM_044108). Accordingly, utilities of VGAM2312 include diagnosis, prevention and treatment of diseases and clinical conditions associated with LOC92303. LOC93587 (Accession XM_052377) is another VGAM2312 host target gene. LOC93587 BINDING SITE is HOST TARGET binding site found in the 3' untranslated region of mRNA encoded by LOC93587, corresponding to a HOST TARGET binding site such as BINDING SITE I, BINDING SITE II or BINDING SITE III. Table 2 illustrates the complementarity of the nucleotide sequences of LOC93587 BINDING SITE, designated SEQ ID:35964, to the nucleotide sequence of VGAM2312 RNA, herein designated VGAM RNA, also designated SEQ ID:5023.

Another function of VGAM2312 is therefore inhibition of LOC93587 (Accession XM_052377). Accordingly, utilities of VGAM2312 include diagnosis, prevention and treatment of diseases and clinical conditions associated with LOC93587. FIG. 1 further provides a conceptual description of a novel bioinformatically detected viral gene of the present invention, referred to here as Viral Genomic Address Messenger 2313 (VGAM2313) viral gene, which modulates expression of respective host target genes thereof, the function and utility of which host target genes is known in the art.

VGAM2313 is a novel bioinformatically detected regulatory, non protein coding, viral micro RNA (miRNA) gene. The method by which VGAM2313 was detected is described hereinabove with reference to FIGS. 1-8.

VGAM2313 gene, herein designated VGAM GENE, is a viral gene contained in the genome of Lumpy Skin Disease Virus. VGAM2313 host target gene, herein designated VGAM HOST TARGET GENE, is a human gene contained in the human genome.

VGAM2313 gene encodes a VGAM2313 precursor RNA, herein designated VGAM PRECURSOR RNA. Similar to other miRNA genes, and unlike most ordinary genes, VGAM2313 precursor RNA does not encode a protein. A nucleotide sequence identical or highly similar to the nucleotide sequence of VGAM2313 precursor RNA is designated SEQ ID:2299, and is provided hereinbelow with reference to the sequence listing part. Nucleotide sequence SEQ ID:2299 is located at position 146111 relative to the genome of Lumpy Skin Disease Virus.

VGAM2313 precursor RNA folds onto itself, forming VGAM2313 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2313 folded precursor RNA into VGAM2313 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM2313 RNA is designated SEQ ID:5024, and is provided hereinbelow with reference to the sequence listing part.

VGAM2313 host target gene, herein designated VGAM HOST TARGET GENE, encodes a corresponding messenger RNA, VGAM2313 host target RNA, herein designated VGAM HOST TARGET RNA. VGAM2313 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2313 RNA, herein designated VGAM RNA, binds complementarily to one or more host target binding sites located in untranslated regions of VGAM2313 host target RNA, herein designated VGAM HOST TARGET RNA. This complementary binding is due to the fact that the nucleotide sequence of VGAM2313 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2313 RNA, herein designated VGAM RNA, may have a different number of host target binding sites in untranslated regions of a VGAM2313 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2313 RNA, herein designated VGAM RNA, to host target binding sites on VGAM2313 host target RNA, herein designated VGAM HOST TARGET RNA, such as BINDING SITE I, BINDING SITE II and BINDING SITE III, inhibits translation of VGAM2313 host target RNA into VGAM2313 host target protein, herein designated VGAM HOST TARGET PROTEIN. VGAM host target protein is therefore outlined by a broken line.

It is appreciated that VGAM2313 host target gene, herein designated VGAM HOST TARGET GENE, in fact represents a plurality of VGAM2313 host target genes. The mRNA of each one of this plurality of VGAM2313 host target genes comprises one or more host target binding sites, each having a nucleotide sequence which is at least partly complementary to VGAM2313 RNA, herein designated VGAM RNA, and which when bound by VGAM2313 RNA causes inhibition of translation of respective one or more VGAM2313 host target proteins.

It is further appreciated by one skilled in the art that the mode of translational inhibition illustrated by FIG. 1 with specific reference to translational inhibition exerted by VGAM2313 gene, herein designated VGAM GENE, on one or more VGAM2313 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2313 is inhibition of expression of host target genes, as part of a novel viral mechanism of attacking a host. Accordingly, utilities of VGAM2313 include diagnosis, prevention and treatment of viral infection by Lumpy Skin Disease Virus. Specific functions, and accordingly utilities, of VGAM2313 correlate with, and may be deduced from, the identity of the host target genes which VGAM2313 binds and inhibits, and the function of these host target genes, as elaborated hereinbelow.

Nucleotide sequences of the VGAM2313 precursor RNA, herein designated VGAM PRECURSOR RNA, and of the 'diced' VGAM2313 RNA, herein designated VGAM RNA, and a schematic representation of the secondary folding of VGAM2313 folded precursor RNA, herein designated VGAM FOLDED PRECURSOR RNA, of VGAM2313 are further described hereinbelow with reference to Table 1.

Nucleotide sequences of host target binding sites, such as BINDING SITE-I, BINDING SITE-II and BINDING SITE-III of FIG. 1, found on VGAM2313 host target RNA, and schematic representation of the complementarity of each of these host target binding sites to VGAM2313 RNA, herein designated VGAM RNA, are described hereinbelow with reference to Table 2.

As mentioned hereinabove with reference to FIG. 1, a function of VGAM2313 gene, herein designated VGAM is inhibition of expression of VGAM2313 target genes. It is appreciated that specific functions, and accordingly utilities, of VGAM2313 correlate with, and may be deduced from, the identity of the target genes which VGAM2313 binds and inhibits, and the function of these target genes, as elaborated hereinbelow.

Glucosaminyl (N-acetyl) Transferase 1, Core 2 (beta-1,6-N-acetylglucosaminyltransferase) (GCNT1, Accession NM_001490) is a VGAM2313 host target gene. GCNT1 BINDING SITE is HOST TARGET binding site found in the 3' untranslated region of mRNA encoded by GCNT1, corresponding to a HOST TARGET binding site such as BINDING SITE I, BINDING SITE II or BINDING SITE III. Table 2 illustrates the complementarity of the nucleotide sequences of GCNT1 BINDING SITE, designated SEQ ID:7236, to the nucleotide sequence of VGAM2313 RNA, herein designated VGAM RNA, also designated SEQ ID:5024.

A function of VGAM2313 is therefore inhibition of Glucosaminyl (N-acetyl) Transferase 1, Core 2 (beta-1,6-N-acetylglucosaminyltransferase) (GCNT1, Accession NM_001490), a gene which forms critical branches in o-glycans. Accordingly, utilities of VGAM2313 include diagnosis, prevention and treatment of diseases and clinical conditions associated with GCNT1. The function of GCNT1 and its association with various diseases and clinical conditions, has been established by previous studies, as described hereinabove with reference to VGAM149. Serine/threonine Kinase 6 (STK6, Accession NM_003600) is another VGAM2313 host target gene. STK6 BINDING SITE is HOST TARGET binding site found in the 3' untranslated region of mRNA encoded by STK6, corresponding to a HOST TARGET binding site such as BINDING SITE I, BINDING SITE II or BINDING SITE III. Table 2 illustrates the complementarity of the nucleotide sequences of STK6 BINDING SITE, designated SEQ ID:9653, to the nucleotide sequence of VGAM2313 RNA, herein designated VGAM RNA, also designated SEQ ID:5024.

Another function of VGAM2313 is therefore inhibition of Serine/threonine Kinase 6 (STK6, Accession NM_003600), a gene which is serine/threonine kinase 6 which is most highly expressed during mitosis. Accordingly, utilities of VGAM2313 include diagnosis, prevention and treatment of diseases and clinical conditions associated with STK6. The function of STK6 and its association with various diseases and clinical conditions, has been established by previous studies, as described hereinabove with reference to VGAM1212. FLJ12595 (Accession NM_024994) is another VGAM2313 host target gene. FLJ12595 BINDING SITE is HOST TARGET binding site found in the 5' untranslated region of mRNA encoded by FLJ12595, corresponding to a HOST TARGET binding site such as BINDING SITE I, BINDING SITE II or BINDING SITE III. Table 2 illustrates the complementarity of the nucleotide sequences of FLJ12595 BINDING SITE, designated SEQ ID:24555, to the nucleotide sequence of VGAM2313 RNA, herein designated VGAM RNA, also designated SEQ ID:5024.

Another function of VGAM2313 is therefore inhibition of FLJ12595 (Accession NM_024994). Accordingly, utilities of VGAM2313 include diagnosis, prevention and treatment of diseases and clinical conditions associated with FLJ12595. HSPC031 (Accession NM_016101) is another VGAM2313 host target gene. HSPC031 BINDING SITE is HOST TARGET binding site found in the 3' untranslated region of mRNA encoded by HSPC031, corresponding to a HOST TARGET binding site such as BINDING SITE I, BINDING SITE II or BINDING SITE III. Table 2 illustrates the complementarity of the nucleotide sequences of HSPC031 BINDING SITE, designated SEQ ID:18183, to the nucleotide sequence of VGAM2313 RNA, herein designated VGAM RNA, also designated SEQ ID:5024.

Another function of VGAM2313 is therefore inhibition of HSPC031 (Accession NM_016101). Accordingly, utilities of VGAM2313 include diagnosis, prevention and treatment of diseases and clinical conditions associated with HSPC031. KIAA1719 (Accession XM_042936) is another VGAM2313 host target gene. KIAA1719 BINDING SITE is HOST TARGET binding site found in the 3' untranslated region of mRNA encoded by KIAA1719, corresponding to a HOST TARGET binding site such as BINDING SITE I, BINDING SITE II or BINDING SITE III. Table 2 illustrates the complementarity of the nucleotide sequences of KIAA1719 BINDING SITE, designated SEQ ID:33815, to the nucleotide sequence of VGAM2313 RNA, herein designated VGAM RNA, also designated SEQ ID:5024.

Another function of VGAM2313 is therefore inhibition of KIAA1719 (Accession XM_042936). Accordingly, utilities of VGAM2313 include diagnosis, prevention and treatment of diseases and clinical conditions associated with KIAA1719. pcnp (Accession NM_020357) is another VGAM2313 host target gene. pcnp BINDING SITE is HOST TARGET binding site found in the 3' untranslated region of mRNA encoded by pcnp, corresponding to a HOST TARGET binding site such as BINDING SITE I, BINDING SITE II or BINDING SITE III. Table 2 illustrates the complementarity of the nucleotide sequences of pcnp BINDING SITE, designated SEQ ID:21624, to the nucleotide sequence of VGAM2313 RNA, herein designated VGAM RNA, also designated SEQ ID:5024.

Another function of VGAM2313 is therefore inhibition of pcnp (Accession NM_020357). Accordingly, utilities of VGAM2313 include diagnosis, prevention and treatment of diseases and clinical conditions associated with pcnp. Protein Tyrosine Phosphatase, Receptor Type, U (PTPRU, Accession NM_005704) is another VGAM2313 host target gene. PTPRU BINDING SITE1 through PTPRU BINDING SITE3 are HOST TARGET binding sites found in untranslated regions of mRNA encoded by PTPRU, corresponding to HOST TARGET binding sites such as BINDING SITE I, BINDING SITE II or BINDING SITE III. Table 2 illustrates the complementarity of the nucleotide sequences of PTPRU BINDING SITE1 through PTPRU BINDING SITE3, designated SEQ ID:12253, SEQ ID:28403 and SEQ ID:28398 respectively, to the nucleotide sequence of VGAM2313 RNA, herein designated VGAM RNA, also designated SEQ ID:5024.

Another function of VGAM2313 is therefore inhibition of Protein Tyrosine Phosphatase, Receptor Type, U (PTPRU, Accession NM_005704). Accordingly, utilities of VGAM2313 include diagnosis, prevention and treatment of diseases and clinical conditions associated with PTPRU. LOC202108 (Accession XM_114442) is another VGAM2313 host target gene. LOC202108 BINDING SITE is HOST TARGET binding site found in the 5' untranslated region of mRNA encoded by LOC202108, corresponding to a HOST TARGET binding site such as BINDING SITE I, BINDING SITE II or BINDING SITE III. Table 2 illustrates the complementarity of the nucleotide sequences of LOC202108 BINDING SITE, designated SEQ ID:42964, to the nucleotide sequence of VGAM2313 RNA, herein designated VGAM RNA, also designated SEQ ID:5024.

Another function of VGAM2313 is therefore inhibition of LOC202108 (Accession XM_114442). Accordingly, utilities of VGAM2313 include diagnosis, prevention and treatment of diseases and clinical conditions associated with LOC202108. FIG. 1 further provides a conceptual description of a novel bioinformatically detected viral gene of the present invention, referred to here as Viral Genomic Address Messenger 2314 (VGAM2314) viral gene, which modulates expression of respective host target genes thereof, the function and utility of which host target genes is known in the art.

VGAM2314 is a novel bioinformatically detected regulatory, non protein coding, viral micro RNA (miRNA) gene. The method by which VGAM2314 was detected is described hereinabove with reference to FIGS. 1-8.

VGAM2314 gene, herein designated VGAM GENE, is a viral gene contained in the genome of Lumpy Skin Disease Virus. VGAM2314 host target gene, herein designated VGAM HOST TARGET GENE, is a human gene contained in the human genome.

VGAM2314 gene encodes a VGAM2314 precursor RNA, herein designated VGAM PRECURSOR RNA. Similar to other miRNA genes, and unlike most ordinary genes, VGAM2314 precursor RNA does not encode a protein. A nucleotide sequence identical or highly similar to the nucleotide sequence of VGAM2314 precursor RNA is designated SEQ ID:2300, and is provided hereinbelow with reference to the sequence listing part. Nucleotide sequence SEQ ID:2300 is located at position 715 relative to the genome of Lumpy Skin Disease Virus.

VGAM2314 precursor RNA folds onto itself, forming VGAM2314 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2314 folded precursor RNA into VGAM2314 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM2314 RNA is designated SEQ ID:5025, and is provided hereinbelow with reference to the sequence listing part.

VGAM2314 host target gene, herein designated VGAM HOST TARGET GENE, encodes a corresponding messenger RNA, VGAM2314 host target RNA, herein designated VGAM HOST TARGET RNA. VGAM2314 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2314 RNA, herein designated VGAM RNA, binds complementarily to one or more host target binding sites located in untranslated regions of VGAM2314 host target RNA, herein designated VGAM HOST TARGET RNA. This complementary binding is due to the fact that the nucleotide sequence of VGAM2314 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2314 RNA, herein designated VGAM RNA, may have a different number of host target binding sites in untranslated regions of a VGAM2314 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2314 RNA, herein designated VGAM RNA, to host target binding sites on VGAM2314 host target RNA, herein designated VGAM HOST TARGET RNA, such as BINDING SITE I, BINDING SITE II and BINDING SITE III, inhibits translation of VGAM2314 host target RNA into VGAM2314 host target protein, herein designated VGAM HOST TARGET PROTEIN. VGAM host target protein is therefore outlined by a broken line.

It is appreciated that VGAM2314 host target gene, herein designated VGAM HOST TARGET GENE, in fact represents a plurality of VGAM2314 host target genes. The mRNA of each one of this plurality of VGAM2314 host target genes comprises one or more host target binding sites, each having a nucleotide sequence which is at least partly complementary to VGAM2314 RNA, herein designated VGAM RNA, and which when bound by VGAM2314 RNA causes inhibition of translation of respective one or more VGAM2314 host target proteins.

It is further appreciated by one skilled in the art that the mode of translational inhibition illustrated by FIG. 1 with specific reference to translational inhibition exerted by VGAM2314 gene, herein designated VGAM GENE, on one or more VGAM2314 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2314 is inhibition of expression of host target genes, as part of a novel viral mechanism of attacking a host. Accordingly, utilities of VGAM2314 include diagnosis, prevention and treatment of viral infection by Lumpy Skin Disease Virus. Specific functions, and accordingly utilities, of VGAM2314 correlate with, and may be deduced from, the identity of the host target genes which VGAM2314 binds and inhibits, and the function of these host target genes, as elaborated hereinbelow.

Nucleotide sequences of the VGAM2314 precursor RNA, herein designated VGAM PRECURSOR RNA, and of the 'diced' VGAM2314 RNA, herein designated VGAM RNA, and a schematic representation of the secondary folding of VGAM2314 folded precursor RNA, herein designated VGAM FOLDED PRECURSOR RNA, of VGAM2314 are further described hereinbelow with reference to Table 1.

Nucleotide sequences of host target binding sites, such as BINDING SITE-I, BINDING SITE-II and BINDING SITE-III of FIG. 1, found on VGAM2314 host target RNA, and schematic representation of the complementarity of each of these host target binding sites to VGAM2314 RNA, herein designated VGAM RNA, are described hereinbelow with reference to Table 2.

As mentioned hereinabove with reference to FIG. 1, a function of VGAM2314 gene, herein designated VGAM is inhibition of expression of VGAM2314 target genes. It is appreciated that specific functions, and accordingly utilities, of VGAM2314 correlate with, and may be deduced from, the identity of the target genes which VGAM2314 binds and inhibits, and the function of these target genes, as elaborated hereinbelow.

ATPase, Ca++ Transporting, Cardiac Muscle, Slow Twitch 2 (ATP2A2, Accession NM_001681) is a VGAM2314 host target gene. ATP2A2 BINDING SITE is HOST TARGET binding site found in the 3' untranslated region of mRNA encoded by ATP2A2, corresponding to a HOST TARGET binding site such as BINDING SITE I, BINDING SITE II or BINDING SITE III. Table 2 illustrates the complementarity of the nucleotide sequences of ATP2A2 BINDING SITE, designated SEQ ID:7399, to the nucleotide sequence of VGAM2314 RNA, herein designated VGAM RNA, also designated SEQ ID:5025.

A function of VGAM2314 is therefore inhibition of ATPase, Ca++ Transporting, Cardiac Muscle, Slow Twitch 2 (ATP2A2, Accession NM_001681). Accordingly, utilities of VGAM2314 include diagnosis, prevention and treatment of diseases and clinical conditions associated with ATP2A2. Cartilage Associated Protein (CRTAP, Accession NM_006371) is another VGAM2314 host target gene. CRTAP BINDING SITE is HOST TARGET binding site found in the 3' untranslated region of mRNA encoded by CRTAP, corresponding to a HOST TARGET binding site such as BINDING SITE I, BINDING SITE II or BINDING SITE III. Table 2 illustrates the complementarity of the nucleotide sequences of CRTAP BINDING SITE, designated SEQ ID:13059, to the nucleotide sequence of VGAM2314 RNA, herein designated VGAM RNA, also designated SEQ ID:5025.

Another function of VGAM2314 is therefore inhibition of Cartilage Associated Protein (CRTAP, Accession NM_006371), a gene which is a novel developmentally regulated chick embryo protein. Accordingly, utilities of VGAM2314 include diagnosis, prevention and treatment of diseases and clinical conditions associated with CRTAP. The function of CRTAP and its association with various diseases and clinical conditions, has been established by previous studies, as described hereinabove with reference to VGAM152. Casein Kinase 2, Alpha 1 Polypeptide (CSNK2A1, Accession NM_001895) is another VGAM2314 host target gene. CSNK2A1 BINDING SITE is HOST TARGET binding site found in the 3' untranslated region of mRNA encoded by CSNK2A1, corresponding to a HOST TARGET binding site such as BINDING SITE I, BINDING SITE II or BINDING SITE III. Table 2 illustrates the complementarity of the nucleotide sequences of CSNK2A1 BINDING SITE, designated SEQ ID:7622, to the nucleotide sequence of VGAM2314 RNA, herein designated VGAM RNA, also designated SEQ ID:5025.

Another function of VGAM2314 is therefore inhibition of Casein Kinase 2, Alpha 1 Polypeptide (CSNK2A1, Accession NM_001895), a gene which cphosphorylates acidic protein such as casein. Accordingly, utilities of VGAM2314 include diagnosis, prevention and treatment of diseases and clinical conditions associated with CSNK2A1. The function of CSNK2A1 and its association with various diseases and clinical conditions, has been established by previous studies, as described hereinabove with reference to VGAM1597. Hippocalcin-like 1 (HPCAL1, Accession NM_002149) is another VGAM2314 host target gene. HPCAL1 BINDING SITE1 and HPCAL1 BINDING SITE2 are HOST TARGET binding sites found in untranslated regions of mRNA encoded by HPCAL1, corresponding to HOST TARGET binding sites such as BINDING SITE I, BINDING SITE II or BINDING SITE III. Table 2 illustrates the complementarity of the nucleotide sequences of HPCAL1 BINDING SITE1 and HPCAL1 BINDING SITE2, designated SEQ ID:7929 and SEQ ID:28636 respectively, to the nucleotide sequence of VGAM2314 RNA, herein designated VGAM RNA, also designated SEQ ID:5025.

Another function of VGAM2314 is therefore inhibition of Hippocalcin-like 1 (HPCAL1, Accession NM_002149). Accordingly, utilities of VGAM2314 include diagnosis, prevention and treatment of diseases and clinical conditions associated with HPCAL1. Single-minded Homolog 1 (Drosophila) (SIM1, Accession NM_005068) is another VGAM2314 host target gene. SIM1 BINDING SITE is HOST TARGET binding site found in the 5' untranslated region of mRNA encoded by SIM1, corresponding to a HOST TARGET binding site such as BINDING SITE I, BINDING SITE II or BINDING SITE III. Table 2 illustrates the complementarity of the nucleotide sequences of SIM1 BINDING SITE, designated SEQ ID:11507, to the nucleotide sequence of VGAM2314 RNA, herein designated VGAM RNA, also designated SEQ ID:5025.

Another function of VGAM2314 is therefore inhibition of Single-minded Homolog 1 (Drosophila) (SIM1, Accession NM_005068), a gene which may have pleiotropic effects during embryogenesis and in the adult. Accordingly, utilities of VGAM2314 include diagnosis, prevention and treatment of diseases and clinical conditions associated with SIM1. The function of SIM1 and its association with various diseases and clinical conditions, has been established by previous studies, as described hereinabove with reference to VGAM665. Solute Carrier Family 22 (organic anion/cation transporter), Member 12 (SLC22A12, Accession NM_144585) is another VGAM2314 host target gene. SLC22A12 BINDING SITE is HOST TARGET binding site found in the 3' untranslated region of mRNA encoded by SLC22A12, corresponding to a HOST TARGET binding site such as BINDING SITE I, BINDING SITE II or BINDING SITE III. Table 2 illustrates the complementarity of the nucleotide sequences of SLC22A12 BINDING SITE, designated SEQ ID:29401, to the nucleotide sequence of VGAM2314 RNA, herein designated VGAM RNA, also designated SEQ ID:5025.

Another function of VGAM2314 is therefore inhibition of Solute Carrier Family 22 (organic anion/cation transporter), Member 12 (SLC22A12, Accession NM_144585), a gene which is a urate -anion exchanger regulating blood yrate levels. Accordingly, utilities of VGAM2314 include diagnosis, prevention and treatment of diseases and clinical conditions associated with SLC22A12. The function of SLC22A12 and its association with various diseases and clinical conditions, has been established by previous studies, as described hereinabove with reference to VGAM1034. Transforming Growth Factor, Alpha (TGFA, Accession NM_003236) is another VGAM2314 host target gene. TGFA BINDING SITE is HOST TARGET binding site found in the 3' untranslated region of mRNA encoded by TGFA, corresponding to a HOST TARGET binding site such as BINDING SITE I, BINDING SITE II or BINDING SITE III. Table 2 illustrates the complementarity of the nucleotide sequences of TGFA BINDING SITE, designated SEQ ID:9229, to the nucleotide sequence of VGAM2314 RNA, herein designated VGAM RNA, also designated SEQ ID:5025.

Another function of VGAM2314 is therefore inhibition of Transforming Growth Factor, Alpha (TGFA, Accession NM_003236), a gene which is able to bind to the egf receptor and to act synergistically with tgf beta to promote anchorage-independent cell proliferation in soft agar. Accordingly, utilities of VGAM2314 include diagnosis, prevention and treatment of diseases and clinical conditions associated with TGFA. The function of TGFA and its association with various diseases and clinical conditions, has been established by previous studies, as described hereinabove with reference to VGAM328. Ubiquitin-conjugating Enzyme E2B (RAD6 homolog) (UBE2B, Accession NM_003337) is another VGAM2314 host target gene. UBE2B BINDING SITE is HOST TARGET binding site found in the 3' untranslated region of mRNA encoded by UBE2B, corresponding to a HOST TARGET binding site such as BINDING SITE I, BINDING SITE II or BINDING SITE III. Table 2 illustrates the complementarity of the nucleotide sequences of UBE2B BINDING SITE, designated SEQ ID:9344, to the nucleotide sequence of VGAM2314 RNA, herein designated VGAM RNA, also designated SEQ ID:5025.

Another function of VGAM2314 is therefore inhibition of Ubiquitin-conjugating Enzyme E2B (RAD6 homolog) (UBE2B, Accession NM_003337), a gene which catalyzes the covalent attachment of ubiquitin to other proteins and is required for postreplication repair of uv-damaged dna. Accordingly, utilities of VGAM2314 include diagnosis, prevention and treatment of diseases and clinical conditions associated with UBE2B. The function of UBE2B has been established by previous studies. The RAD6 pathway is central to postreplicative DNA repair in eukaryotic cells. Two principal elements of this pathway are the ubiquitin-conjugating enzymes RAD6 and the MMS2 (OMIM Ref. No. 603001)-UBC13 (OMIM Ref. No. 603679) heterodimer, which are recruited to chromatin by the RING-finger proteins RAD18 (OMIM Ref. No. 605256) and RAD5 (OMIM Ref. No. 607266), respectively. Hoege et al. (2002) showed that UBC9 (OMIM Ref. No. 601661), a small ubiquitin-related modifier (SUMO)-conjugating enzyme, is also affiliated with this pathway and that proliferating cell nuclear antigen (PCNA; 176740), a DNA polymerase sliding clamp involved in DNA synthesis and repair, is a substrate. PCNA is monoubiquitinated through RAD6 and RAD18, modified by lys63-linked multiubiquitination, which additionally requires MMS2, UBC13, and RAD5, and is conjugated to SUMO by UBC9. All 3 modifications affect the same lysine residue of PCNA, K164, suggesting that they label PCNA for alternative functions. Hoege et al. (2002) demonstrated that these modifications differentially affect resistance to DNA damage, and that damage-induced PCNA ubiquitination is elementary for DNA repair and occurs at the same conserved residue in yeast and human S. Animal model experiments lend further support to the function of UBE2B. Roest et al. (1996) reported the phenotype of the first animal mutant in the ubiquitin pathway. Experimental inactivation of the RAD6B gene in mice caused male infertility. Derailment of spermatogenesis became overt during the postmeiotic condensation of chromatin in spermatids. In yeast the gene is not only implicated in postreplication repair and damage-induced mutagenesis but is also required for sporulation and may modulate chromatin structure via histone ubiquitination. The authors stated that the findings in the 'knock-out' mice provided a parallel between yeast sporulation and mammalian spermatogenesis and strongly implicated RAD6-dependent ubiquitination in chromatin remodeling in the human. Since heterozygous male mice and even knockout female mice are completely normal and fertile and thus able to transmit the defect, similar RAD6B mutations may cause male infertility in man. The fact that the RAD6B mice are viable and phenotypically normal is presumably due to functional redundancy with RAD6A (OMIM Ref. No. 312180).

It is appreciated that the abovementioned animal model for UBE2B is acknowledged by those skilled in the art as a scientifically valid animal model, as can be further appreciated from the publications sited hereinbelow.

Full details of the abovementioned studies are described in the following publications, the disclosure of which are hereby incorporated by reference:

Hoege, C.; Pfander, B.; Moldovan, G.-L.; Pyrowolakis, G.; Jentsch, S.: RAD6-dependent DNA repair is linked to modification of PCNA by ubiquitin and SUMO. Nature 419:135-141, 2002; and Roest, H. P.; van Klaveren, J.; de Wit, J.; van Gurp, C. G.; Koken, M. H. M.; Vermey, M.; van Roijen, J. H.; Hoogerbrugge, J. W.; Vreeburg, J. T. M.; Baarends, W. M.; Bootsma, D.; Grootego.

Further studies establishing the function and utilities of UBE2B are found in John Hopkins OMIM database record ID 179095, and in sited publications numbered 1793-1194 listed in the bibliography section hereinbelow, which are also hereby incorporated by reference. FLJ10468 (Accession NM_018101) is another VGAM2314 host target gene. FLJ10468 BINDING SITE is HOST TARGET binding site found in the 3' untranslated region of mRNA encoded by FLJ10468, corresponding to a HOST TARGET binding site such as BINDING SITE I, BINDING SITE II or BINDING SITE III. Table 2 illustrates the complementarity of the nucleotide sequences of FLJ10468 BINDING SITE, designated SEQ ID:19872, to the nucleotide sequence of VGAM2314 RNA, herein designated VGAM RNA, also designated SEQ ID:5025.

Another function of VGAM2314 is therefore inhibition of FLJ10468 (Accession NM_018101). Accordingly, utilities of VGAM2314 include diagnosis, prevention and treatment of diseases and clinical conditions associated with FLJ10468. FLJ14146 (Accession NM_024709) is another VGAM2314 host target gene. FLJ14146 BINDING SITE is HOST TARGET binding site found in the 3' untranslated region of mRNA encoded by FLJ14146, corresponding to a HOST TARGET binding site such as BINDING SITE I, BINDING SITE II or BINDING SITE III. Table 2 illustrates the complementarity of the nucleotide sequences of FLJ14146 BINDING SITE, designated SEQ ID:24028, to the nucleotide sequence of VGAM2314 RNA, herein designated VGAM RNA, also designated SEQ ID:5025.

Another function of VGAM2314 is therefore inhibition of FLJ14146 (Accession NM_024709). Accordingly, utilities of VGAM2314 include diagnosis, prevention and treatment of diseases and clinical conditions associated with FLJ14146. FLJ20651 (Accession NM_017919) is another VGAM2314 host target gene. FLJ20651 BINDING SITE is HOST TARGET binding site found in the 3' untranslated region of mRNA encoded by FLJ20651, corresponding to a HOST TARGET binding site such as BINDING SITE I, BINDING SITE II or BINDING SITE III. Table 2 illustrates the complementarity of the nucleotide sequences of FLJ20651 BINDING SITE, designated SEQ ID:19573, to the nucleotide sequence of VGAM2314 RNA, herein designated VGAM RNA, also designated SEQ ID:5025.

Another function of VGAM2314 is therefore inhibition of FLJ20651 (Accession NM_017919). Accordingly, utilities of VGAM2314 include diagnosis, prevention and treatment of diseases and clinical conditions associated with FLJ20651. FLJ21162 (Accession NM_024873) is another VGAM2314 host target gene. FLJ21162 BINDING SITE is HOST TARGET binding site found in the 5' untranslated region of mRNA encoded by FLJ21162, corresponding to a HOST TARGET binding site such as BINDING SITE I, BINDING SITE II or BINDING SITE III. Table 2 illustrates the complementarity of the nucleotide sequences of FLJ21162 BINDING SITE, designated SEQ ID:24305, to the nucleotide sequence of VGAM2314 RNA, herein designated VGAM RNA, also designated SEQ ID:5025.

Another function of VGAM2314 is therefore inhibition of FLJ21162 (Accession NM_024873). Accordingly, utilities of VGAM2314 include diagnosis, prevention and treatment of diseases and clinical conditions associated with FLJ21162. KIAA0164 (Accession NM_014739) is another VGAM2314 host target gene. KIAA0164 BINDING SITE is HOST TARGET binding site found in the 3' untranslated region of mRNA encoded by KIAA0164, corresponding to a HOST TARGET binding site such as BINDING SITE I, BINDING SITE II or BINDING SITE III. Table 2 illustrates the complementarity of the nucleotide sequences of KIAA0164 BINDING SITE, designated SEQ ID:16402, to the nucleotide sequence of VGAM2314 RNA, herein designated VGAM RNA, also designated SEQ ID:5025.

Another function of VGAM2314 is therefore inhibition of KIAA0164 (Accession NM_014739). Accordingly, utilities of VGAM2314 include diagnosis, prevention and treatment of diseases and clinical conditions associated with KIAA0164. KIAA0356 (Accession XM_038655) is another VGAM2314 host target gene. KIAA0356 BINDING SITE is HOST TARGET binding site found in the 3' untranslated region of mRNA encoded by KIAA0356, corresponding to a HOST TARGET binding site such as BINDING SITE I, BINDING SITE II or BINDING SITE III. Table 2 illustrates the complementarity of the nucleotide sequences of KIAA0356 BINDING SITE, designated SEQ ID:32889, to the nucleotide sequence of VGAM2314 RNA, herein designated VGAM RNA, also designated SEQ ID:5025.

Another function of VGAM2314 is therefore inhibition of KIAA0356 (Accession XM_038655). Accordingly, utilities of VGAM2314 include diagnosis, prevention and treatment of diseases and clinical conditions associated with KIAA0356. KIAA0514 (Accession NM_014696) is another VGAM2314 host target gene. KIAA0514 BINDING SITE is HOST TARGET binding site found in the 3' untranslated region of mRNA encoded by KIAA0514, corresponding to a HOST TARGET binding site such as BINDING SITE I, BINDING SITE II or BINDING SITE III. Table 2 illustrates the complementarity of the nucleotide sequences of KIAA0514 BINDING SITE, designated SEQ ID:16199, to the nucleotide sequence of VGAM2314 RNA, herein designated VGAM RNA, also designated SEQ ID:5025.

Another function of VGAM2314 is therefore inhibition of KIAA0514 (Accession NM_014696). Accordingly, utilities of VGAM2314 include diagnosis, prevention and treatment of diseases and clinical conditions associated with KIAA0514. KIAA1610 (Accession XM_040622) is another VGAM2314 host target gene. KIAA1610 BINDING SITE is HOST TARGET binding site found in the 3' untranslated region of mRNA encoded by KIAA1610, corresponding to a HOST TARGET binding site such as BINDING SITE I, BINDING SITE II or BINDING SITE III. Table 2 illustrates the complementarity of the nucleotide sequences of KIAA1610 BINDING SITE, designated SEQ ID:33341, to the nucleotide sequence of VGAM2314 RNA, herein designated VGAM RNA, also designated SEQ ID:5025.

Another function of VGAM2314 is therefore inhibition of KIAA1610 (Accession XM_040622). Accordingly, utilities of VGAM2314 include diagnosis, prevention and treatment of diseases and clinical conditions associated with KIAA1610. KIAA1954 (Accession XM_085375) is another VGAM2314 host target gene. KIAA1954 BINDING SITE is HOST TARGET binding site found in the 3' untranslated region of mRNA encoded by KIAA1954, corresponding to a HOST TARGET binding site such as BINDING SITE I, BINDING SITE II or BINDING SITE III. Table 2 illustrates the complementarity of the nucleotide sequences of KIAA1954 BINDING SITE, designated SEQ ID:38090, to the nucleotide sequence of VGAM2314 RNA, herein designated VGAM RNA, also designated SEQ ID:5025.

Another function of VGAM2314 is therefore inhibition of KIAA1954 (Accession XM_085375). Accordingly, utilities of VGAM2314 include diagnosis, prevention and treatment of diseases and clinical conditions associated with KIAA1954. Peroxisomal Biogenesis Factor 12 (PEX12, Accession NM_000286) is another VGAM2314 host target gene. PEX12 BINDING SITE is HOST TARGET binding site found in the 5' untranslated region of mRNA encoded by PEX12, corresponding to a HOST TARGET binding site such as BINDING SITE I, BINDING SITE II or BINDING SITE III. Table 2 illustrates the complementarity of the nucleotide sequences of PEX12 BINDING SITE, designated SEQ ID:5832, to the nucleotide sequence of VGAM2314 RNA, herein designated VGAM RNA, also designated SEQ ID:5025.

Another function of VGAM2314 is therefore inhibition of Peroxisomal Biogenesis Factor 12 (PEX12, Accession NM_000286). Accordingly, utilities of VGAM2314 include diagnosis, prevention and treatment of diseases and clinical conditions associated with PEX12. RAP2B, Member of RAS Oncogene Family (RAP2B, Accession XM_171061) is another VGAM2314 host target gene. RAP2B BINDING SITE is HOST TARGET binding site found in the 3' untranslated region of mRNA encoded by RAP2B, corresponding to a HOST TARGET binding site such as BINDING SITE I, BINDING SITE II or BINDING SITE III. Table 2 illustrates the complementarity of the nucleotide sequences of RAP2B BINDING SITE, designated SEQ ID:45858, to the nucleotide sequence of VGAM2314 RNA, herein designated VGAM RNA, also designated SEQ ID:5025.

Another function of VGAM2314 is therefore inhibition of RAP2B, Member of RAS Oncogene Family (RAP2B, Accession XM_171061). Accordingly, utilities of VGAM2314 include diagnosis, prevention and treatment of diseases and clinical conditions associated with RAP2B. LOC151877 (Accession XM_098132) is another VGAM2314 host target gene. LOC151877 BINDING SITE is HOST TARGET binding site found in the 3' untranslated region of mRNA encoded by LOC151877, corresponding to a HOST TARGET binding site such as BINDING SITE I, BINDING SITE II or BINDING SITE III. Table 2 illustrates the complementarity of the nucleotide sequences of LOC151877 BINDING SITE, designated SEQ ID:41392, to the nucleotide sequence of VGAM2314 RNA, herein designated VGAM RNA, also designated SEQ ID:5025.

Another function of VGAM2314 is therefore inhibition of LOC151877 (Accession XM_098132). Accordingly, utilities of VGAM2314 include diagnosis, prevention and treatment of diseases and clinical conditions associated with LOC151877. LOC168489 (Accession XM_095134) is another VGAM2314 host target gene. LOC168489 BINDING SITE is HOST TARGET binding site found in the 5' untranslated region of mRNA encoded by LOC168489, corresponding to a HOST TARGET binding site such as BINDING SITE I, BINDING SITE II or BINDING SITE III. Table 2 illustrates the complementarity of the nucleotide sequences of LOC168489 BINDING SITE, designated SEQ ID:40249, to the nucleotide sequence of VGAM2314 RNA, herein designated VGAM RNA, also designated SEQ ID:5025.

Another function of VGAM2314 is therefore inhibition of LOC168489 (Accession XM_095134). Accordingly, utilities of VGAM2314 include diagnosis, prevention and treatment of diseases and clinical conditions associated with LOC168489. LOC197319 (Accession XM_113862) is another VGAM2314 host target gene. LOC197319 BINDING SITE is HOST TARGET binding site found in the 3' untranslated region of mRNA encoded by LOC197319, corresponding to a HOST TARGET binding site such as BINDING SITE I, BINDING SITE II or BINDING SITE III. Table 2 illustrates the complementarity of the nucleotide sequences of LOC197319 BINDING SITE, designated SEQ ID:42474, to the nucleotide sequence of VGAM2314 RNA, herein designated VGAM RNA, also designated SEQ ID:5025.

Another function of VGAM2314 is therefore inhibition of LOC197319 (Accession XM_113862). Accordingly, utilities of VGAM2314 include diagnosis, prevention and treatment of diseases and clinical conditions associated with LOC197319. LOC221773 (Accession XM_165802) is another VGAM2314 host target gene. LOC221773 BINDING SITE is HOST TARGET binding site found in the 3' untranslated region of mRNA encoded by LOC221773, corresponding to a HOST TARGET binding site such as BINDING SITE I, BINDING SITE II or BINDING SITE III. Table 2 illustrates the complementarity of the nucleotide sequences of LOC221773 BINDING SITE, designated SEQ ID:43758, to the nucleotide sequence of VGAM2314 RNA, herein designated VGAM RNA, also designated SEQ ID:5025.

Another function of VGAM2314 is therefore inhibition of LOC221773 (Accession XM_165802). Accordingly, utilities of VGAM2314 include diagnosis, prevention and treatment of diseases and clinical conditions associated with LOC221773. LOC90591 (Accession XM_032811) is another VGAM2314 host target gene. LOC90591 BINDING SITE is HOST TARGET binding site found in the 3' untranslated region of mRNA encoded by LOC90591, corresponding to a HOST TARGET binding site such as BINDING SITE I, BINDING SITE II or BINDING SITE III. Table 2 illustrates the complementarity of the nucleotide sequences of LOC90591 BINDING SITE, designated SEQ ID:31757, to the nucleotide sequence of VGAM2314 RNA, herein designated VGAM RNA, also designated SEQ ID:5025.

Another function of VGAM2314 is therefore inhibition of LOC90591 (Accession XM_032811). Accordingly, utilities of VGAM2314 include diagnosis, prevention and treatment of diseases and clinical conditions associated with LOC90591. FIG. 1 further provides a conceptual description of a novel bioinformatically detected viral gene of the present invention, referred to here as Viral Genomic Address Messenger 2315 (VGAM2315) viral gene, which modulates expression of respective host target genes thereof, the function and utility of which host target genes is known in the art.

VGAM2315 is a novel bioinformatically detected regulatory, non protein coding, viral micro RNA (miRNA) gene. The method by which VGAM2315 was detected is described hereinabove with reference to FIGS. 1-8.

VGAM2315 gene, herein designated VGAM GENE, is a viral gene contained in the genome of Lumpy Skin Disease Virus. VGAM2315 host target gene, herein designated VGAM HOST TARGET GENE, is a human gene contained in the human genome.

VGAM2315 gene encodes a VGAM2315 precursor RNA, herein designated VGAM PRECURSOR RNA. Similar to other miRNA genes, and unlike most ordinary genes, VGAM2315 precursor RNA does not encode a protein. A nucleotide sequence identical or highly similar to the nucleotide sequence of VGAM2315 precursor RNA is designated SEQ ID:2301, and is provided hereinbelow with reference to the sequence listing part. Nucleotide sequence SEQ ID:2301 is located at position 128712 relative to the genome of Lumpy Skin Disease Virus.

VGAM2315 precursor RNA folds onto itself, forming VGAM2315 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2315 folded precursor RNA into VGAM2315 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2315 RNA is designated SEQ ID:5026, and is provided hereinbelow with reference to the sequence listing part.

VGAM2315 host target gene, herein designated VGAM HOST TARGET GENE, encodes a corresponding messenger RNA, VGAM2315 host target RNA, herein designated VGAM HOST TARGET RNA. VGAM2315 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2315 RNA, herein designated VGAM RNA, binds complementarily to one or more host target binding sites located in untranslated regions of VGAM2315 host target RNA, herein designated VGAM HOST TARGET RNA. This complementary binding is due to the fact that the nucleotide sequence of VGAM2315 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2315 RNA, herein designated VGAM RNA, may have a different number of host target binding sites in untranslated regions of a VGAM2315 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2315 RNA, herein designated VGAM RNA, to host target binding sites on VGAM2315 host target RNA, herein designated VGAM HOST TARGET RNA, such as BINDING SITE I, BINDING SITE II and BINDING SITE III, inhibits translation of VGAM2315 host target RNA into VGAM2315 host target protein, herein designated VGAM HOST TARGET PROTEIN. VGAM host target protein is therefore outlined by a broken line.

It is appreciated that VGAM2315 host target gene, herein designated VGAM HOST TARGET GENE, in fact represents a plurality of VGAM2315 host target genes. The mRNA of each one of this plurality of VGAM2315 host target genes comprises one or more host target binding sites, each having a nucleotide sequence which is at least partly complementary to VGAM2315 RNA, herein designated VGAM RNA, and which when bound by VGAM2315 RNA causes inhibition of translation of respective one or more VGAM2315 host target proteins.

It is further appreciated by one skilled in the art that the mode of translational inhibition illustrated by FIG. 1 with specific reference to translational inhibition exerted by VGAM2315 gene, herein designated VGAM GENE, on one or more VGAM2315 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2315 is inhibition of expression of host target genes, as part of a novel viral mechanism of attacking a host. Accordingly, utilities of VGAM2315 include diagnosis, prevention and treatment of viral infection by Lumpy Skin Disease Virus. Specific functions, and accordingly utilities, of VGAM2315 correlate with, and may be deduced from, the identity of the host target genes which VGAM2315 binds and inhibits, and the function of these host target genes, as elaborated hereinbelow.

Nucleotide sequences of the VGAM2315 precursor RNA, herein designated VGAM PRECURSOR RNA, and of the 'diced' VGAM2315 RNA, herein designated VGAM RNA, and a schematic representation of the secondary folding of VGAM2315 folded precursor RNA, herein designated VGAM FOLDED PRECURSOR RNA, of VGAM2315 are further described hereinbelow with reference to Table 1.

Nucleotide sequences of host target binding sites, such as BINDING SITE-I, BINDING SITE-II and BINDING SITE-III of FIG. 1, found on VGAM2315 host target RNA, and schematic representation of the complementarity of each of these host target binding sites to VGAM2315 RNA, herein designated VGAM RNA, are described hereinbelow with reference to Table 2.

As mentioned hereinabove with reference to FIG. 1, a function of VGAM2315 gene, herein designated VGAM is inhibition of expression of VGAM2315 target genes. It is appreciated that specific functions, and accordingly utilities, of VGAM2315 correlate with, and may be deduced from, the identity of the target genes which VGAM2315 binds and inhibits, and the function of these target genes, as elaborated hereinbelow.

Transient Receptor Potential Cation Channel, Subfamily M, Member 8 (TRPM8, Accession NM_024080) is a VGAM2315 host target gene. TRPM8 BINDING SITE is HOST TARGET binding site found in the 3' untranslated region of mRNA encoded by TRPM8, corresponding to a HOST TARGET binding site such as BINDING SITE I, BINDING SITE II or BINDING SITE III. Table 2 illustrates the complementarity of the nucleotide sequences of TRPM8 BINDING SITE, designated SEQ ID:23518, to the nucleotide sequence of VGAM2315 RNA, herein designated VGAM RNA, also designated SEQ ID:5026.

A function of VGAM2315 is therefore inhibition of Transient Receptor Potential Cation Channel, Subfamily M, Member 8 (TRPM8, Accession NM_024080), a gene which is thought to form a receptor-activated calcium permeant cation channel. Accordingly, utilities of VGAM2315 include diagnosis, prevention and treatment of diseases and clinical conditions associated with TRPM8. The function of TRPM8 and its association with various diseases and clinical conditions, has been established by previous studies, as described hereinabove with reference to VGAM201. UDP-glucose Dehydrogenase (UGDH, Accession NM_003359) is another VGAM2315 host target gene. UGDH BINDING SITE is HOST TARGET binding site found in the 3' untranslated region of mRNA encoded by UGDH, corresponding to a HOST TARGET binding site such as BINDING SITE I, BINDING SITE II or BINDING SITE III. Table 2 illustrates the complementarity of the nucleotide sequences of UGDH BINDING SITE, designated SEQ ID:9386, to the nucleotide sequence of VGAM2315 RNA, herein designated VGAM RNA, also designated SEQ ID:5026.

Another function of VGAM2315 is therefore inhibition of UDP-glucose Dehydrogenase (UGDH, Accession NM_003359), a gene which is an UDP-glucose dehydrogenase. Accordingly, utilities of VGAM2315 include diagnosis, prevention and treatment of diseases and clinical conditions associated with UGDH. The function of UGDH and its association with various diseases and clinical conditions, has been established by previous studies, as described hereinabove with reference to VGAM74. FLJ23259 (Accession NM_024727) is another VGAM2315 host target gene. FLJ23259 BINDING SITE is HOST TARGET binding site found in the 3' untranslated region of mRNA encoded by FLJ23259, corresponding to a HOST TARGET binding site such as BINDING SITE I, BINDING SITE II or BINDING SITE III. Table 2 illustrates the complementarity of the nucleotide sequences of FLJ23259 BINDING SITE, designated SEQ ID:24063, to the nucleotide sequence of VGAM2315 RNA, herein designated VGAM RNA, also designated SEQ ID:5026.

Another function of VGAM2315 is therefore inhibition of FLJ23259 (Accession NM_024727). Accordingly, utilities of VGAM2315 include diagnosis, prevention and treatment of diseases and clinical conditions associated with FLJ23259. FIG. 1 further provides a conceptual description of a novel bioinformatically detected viral gene of the present invention, referred to here as Viral Genomic Address Messenger 2316 (VGAM2316) viral gene, which modulates expression of respective host target genes thereof, the function and utility of which host target genes is known in the art.

VGAM2316 is a novel bioinformatically detected regulatory, non protein coding, viral micro RNA (miRNA) gene. The method by which VGAM2316 was detected is described hereinabove with reference to FIGS. 1-8.

VGAM2316 gene, herein designated VGAM GENE, is a viral gene contained in the genome of Rana Tigrina Ranavirus. VGAM2316 host target gene, herein designated VGAM HOST TARGET GENE, is a human gene contained in the human genome.

VGAM2316 gene encodes a VGAM2316 precursor RNA, herein designated VGAM PRECURSOR RNA. Similar to other miRNA genes, and unlike most ordinary genes, VGAM2316 precursor RNA does not encode a protein. A nucleotide sequence identical or highly similar to the nucleotide sequence of VGAM2316 precursor RNA is designated SEQ ID:2302, and is provided hereinbelow with reference to the sequence listing part. Nucleotide sequence SEQ ID:2302 is located at position 33473 relative to the genome of Rana Tigrina Ranavirus.

VGAM2316 precursor RNA folds onto itself, forming VGAM2316 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2316 folded precursor RNA into VGAM2316 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2316 RNA is designated SEQ ID:5027, and is provided hereinbelow with reference to the sequence listing part.

VGAM2316 host target gene, herein designated VGAM HOST TARGET GENE, encodes a corresponding messenger RNA, VGAM2316 host target RNA, herein designated VGAM HOST TARGET RNA. VGAM2316 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2316 RNA, herein designated VGAM RNA, binds complementarily to one or more host target binding sites located in untranslated regions of VGAM2316 host target RNA, herein designated VGAM HOST TARGET RNA. This complementary binding is due to the fact that the nucleotide sequence of VGAM2316 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2316 RNA, herein designated VGAM RNA, may have a different number of host target binding sites in untranslated regions of a VGAM2316 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2316 RNA, herein designated VGAM RNA, to host target binding sites on VGAM2316 host target RNA, herein designated VGAM HOST TARGET RNA, such as BINDING SITE I, BINDING SITE II and BINDING SITE III, inhibits translation of VGAM2316 host target RNA into VGAM2316 host target protein, herein designated VGAM HOST TARGET PROTEIN. VGAM host target protein is therefore outlined by a broken line.

It is appreciated that VGAM2316 host target gene, herein designated VGAM HOST TARGET GENE, in fact represents a plurality of VGAM2316 host target genes. The mRNA of each one of this plurality of VGAM2316 host target genes comprises one or more host target binding sites, each having a nucleotide sequence which is at least partly complementary to VGAM2316 RNA, herein designated VGAM RNA, and which when bound by VGAM2316 RNA causes inhibition of translation of respective one or more VGAM2316 host target proteins.

It is further appreciated by one skilled in the art that the mode of translational inhibition illustrated by FIG. 1 with specific reference to translational inhibition exerted by VGAM2316 gene, herein designated VGAM GENE, on one or more VGAM2316 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2316 is inhibition of expression of host target genes, as part of a novel viral mechanism of attacking a host. Accordingly, utilities of VGAM2316 include diagnosis, prevention and treatment of viral infection by Rana Tigrina Ranavirus. Specific functions, and accordingly utilities, of VGAM2316 correlate with, and may be deduced from, the identity of the host target genes which VGAM2316 binds and inhibits, and the function of these host target genes, as elaborated hereinbelow.

Nucleotide sequences of the VGAM2316 precursor RNA, herein designated VGAM PRECURSOR RNA, and of the 'diced' VGAM2316 RNA, herein designated VGAM RNA, and a schematic representation of the secondary folding of VGAM2316 folded precursor RNA, herein designated VGAM FOLDED PRECURSOR RNA, of VGAM2316 are further described hereinbelow with reference to Table 1.

Nucleotide sequences of host target binding sites, such as BINDING SITE-I, BINDING SITE-II and BINDING SITE-III of FIG. 1, found on VGAM2316 host target RNA, and schematic representation of the complementarity of each of these host target binding sites to VGAM2316 RNA, herein designated VGAM RNA, are described hereinbelow with reference to Table 2.

As mentioned hereinabove with reference to FIG. 1, a function of VGAM2316 gene, herein designated VGAM is inhibition of expression of VGAM2316 target genes. It is appreciated that specific functions, and accordingly utilities, of VGAM2316 correlate with, and may be deduced from, the identity of the target genes which VGAM2316 binds and inhibits, and the function of these target genes, as elaborated hereinbelow.

UDP-Gal:betaGlcNAc Beta 1,4-Galactosyltransferase, Polypeptide 1 (B4GALT1, Accession NM_001497) is a VGAM2316 host target gene. B4GALT1 BINDING SITE is HOST TARGET binding site found in the 3' untranslated region of mRNA encoded by B4GALT1, corresponding to a HOST TARGET binding site such as BINDING SITE I, BINDING SITE II or BINDING SITE III. Table 2 illustrates the complementarity of the nucleotide sequences of B4GALT1 BINDING SITE, designated SEQ ID:7248, to the nucleotide sequence of VGAM2316 RNA, herein designated VGAM RNA, also designated SEQ ID:5027.

A function of VGAM2316 is therefore inhibition of UDP-Gal:betaGlcNAc Beta 1,4-Galactosyltransferase, Polypeptide 1 (B4GALT1, Accession NM_001497). Accordingly, utilities of VGAM2316 include diagnosis, prevention and treatment of diseases and clinical conditions associated with B4GALT1. Dystrophin (muscular dystrophy, Duchenne and Becker types) (DMD, Accession NM_004013) is another VGAM2316 host target gene. DMD BINDING SITE1 through DMD BINDING SITE3 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 through DMD BINDING SITE3, designated SEQ ID:10200, SEQ ID:10227 and SEQ ID:10239 respectively, to the nucleotide sequence of VGAM2316 RNA, herein designated VGAM RNA, also designated SEQ ID:5027.

Another function of VGAM2316 is therefore inhibition of Dystrophin (muscular dystrophy, Duchenne and Becker types) (DMD, Accession NM_004013), a gene which muscular dystrophy. Accordingly, utilities of VGAM2316 include diagnosis, prevention and treatment of diseases and clinical conditions associated with DMD. The function of DMD and its association with various diseases and clinical conditions, has been established by previous studies, as described hereinabove with reference to VGAM218. Fibroblast Growth Factor Receptor 2 (bacteria-expressed kinase, keratinocyte growth factor receptor, craniofacial dysostosis 1, Crouzon syndrome, Pfeiffer syndrome, Jackson-Weiss syndrome) (FGFR2, Accession NM_022972) is another VGAM2316 host target gene. FGFR2 BINDING SITE1 through FGFR2 BINDING SITE6 are HOST TARGET binding sites found in untranslated regions of mRNA encoded by FGFR2, corresponding to HOST TARGET binding sites such as BINDING SITE I, BINDING SITE II or BINDING SITE III. Table 2 illustrates the complementarity of the nucleotide sequences of FGFR2 BINDING SITE1 through FGFR2 BINDING SITE6, designated SEQ ID:23245, SEQ ID:23292, SEQ ID:5642, SEQ ID:23298, SEQ ID:23304 and SEQ ID:13672 respectively, to the nucleotide sequence of VGAM2316 RNA, herein designated VGAM RNA, also designated SEQ ID:5027.

Another function of VGAM2316 is therefore inhibition of Fibroblast Growth Factor Receptor 2 (bacteria-expressed kinase, keratinocyte growth factor receptor, craniofacial dysostosis 1, Crouzon syndrome, Pfeiffer syndrome, Jackson-Weiss syndrome) (FGFR2, Accession NM_022972). Accordingly, utilities of VGAM2316 include diagnosis, prevention and treatment of diseases and clinical conditions associated with FGFR2. PART1 (Accession NM_016590) is another VGAM2316 host target gene. PART1 BINDING SITE is HOST TARGET binding site found in the 3' untranslated region of mRNA encoded by PART1, corresponding to a HOST TARGET binding site such as BINDING SITE I, BINDING SITE II or BINDING SITE III. Table 2 illustrates the complementarity of the nucleotide sequences of PART1 BINDING SITE, designated SEQ ID:18667, to the nucleotide sequence of VGAM2316 RNA, herein designated VGAM RNA, also designated SEQ ID:5027.

Another function of VGAM2316 is therefore inhibition of PART1 (Accession NM_016590). Accordingly, utilities of VGAM2316 include diagnosis, prevention and treatment of diseases and clinical conditions associated with PART1. Prostaglandin-endoperoxide Synthase 1 (prostaglandin G/H synthase and cyclooxygenase) (PTGS1, Accession NM_000962) is another VGAM2316 host target gene. PTGS1 BINDING SITE1 and PTGS1 BINDING SITE2 are HOST TARGET binding sites found in untranslated regions of mRNA encoded by PTGS1, corresponding to HOST TARGET binding sites such as BINDING SITE I, BINDING SITE II or BINDING SITE III. Table 2 illustrates the complementarity of the nucleotide sequences of PTGS1 BINDING SITE1 and PTGS1 BINDING SITE2, designated SEQ ID:6676 and SEQ ID:27897 respectively, to the nucleotide sequence of VGAM2316 RNA, herein designated VGAM RNA, also designated SEQ ID:5027.

Another function of VGAM2316 is therefore inhibition of Prostaglandin-endoperoxide Synthase 1 (prostaglandin G/H synthase and cyclooxygenase) (PTGS1, Accession NM_000962), a gene which may play an important role in regulating or promoting cell proliferation in some normal and neoplastically transformed cells. Accordingly, utilities of VGAM2316 include diagnosis, prevention and treatment of diseases and clinical conditions associated with PTGS1. The function of PTGS1 and its association with various diseases and clinical conditions, has been established by previous studies, as described hereinabove with reference to VGAM1224. FLJ22174 (Accession NM_021945) is another VGAM2316 host target gene. FLJ22174 BINDING SITE is HOST TARGET binding site found in the 5' untranslated region of mRNA encoded by FLJ22174, corresponding to a HOST TARGET binding site such as BINDING SITE I, BINDING SITE II or BINDING SITE III. Table 2 illustrates the complementarity of the nucleotide sequences of FLJ22174 BINDING SITE, designated SEQ ID:22468, to the nucleotide sequence of VGAM2316 RNA, herein designated VGAM RNA, also designated SEQ ID:5027.

Another function of VGAM2316 is therefore inhibition of FLJ22174 (Accession NM_021945). Accordingly, utilities of VGAM2316 include diagnosis, prevention and treatment of diseases and clinical conditions associated with FLJ22174. KIAA0222 (Accession NM_014643) is another VGAM2316 host target gene. KIAA0222 BINDING SITE is HOST TARGET binding site found in the 3' untranslated region of mRNA encoded by KIAA0222, corresponding to a HOST TARGET binding site such as BINDING SITE I, BINDING SITE II or BINDING SITE III. Table 2 illustrates the complementarity of the nucleotide sequences of KIAA0222 BINDING SITE, designated SEQ ID:16048, to the nucleotide sequence of VGAM2316 RNA, herein designated VGAM RNA, also designated SEQ ID:5027.

Another function of VGAM2316 is therefore inhibition of KIAA0222 (Accession NM_014643). Accordingly, utilities of VGAM2316 include diagnosis, prevention and treatment of diseases and clinical conditions associated with KIAA0222. RAB10, Member RAS Oncogene Family (RAB10, Accession XM_097979) is another VGAM2316 host target gene. RAB10 BINDING SITE is HOST TARGET binding site found in the 3' untranslated region of mRNA encoded by RAB10, corresponding to a HOST TARGET binding site such as BINDING SITE I, BINDING SITE II or BINDING SITE III. Table 2 illustrates the complementarity of the nucleotide sequences of RAB10 BINDING SITE, designated SEQ ID:41282, to the nucleotide sequence of VGAM2316 RNA, herein designated VGAM RNA, also designated SEQ ID:5027.

Another function of VGAM2316 is therefore inhibition of RAB10, Member RAS Oncogene Family (RAB10, Accession XM_097979). Accordingly, utilities of VGAM2316 include diagnosis, prevention and treatment of diseases and clinical conditions associated with RAB10. Sema Domain, Immunoglobulin Domain (Ig), Transmembrane Domain (TM) and Short Cytoplasmic Domain, (semaphorin) 4G (SEMA4G, Accession XM_170638) is another VGAM2316 host target gene. SEMA4G BINDING SITE is HOST TARGET binding site found in the 5" untranslated region of mRNA encoded by SEMA4G, corresponding to a HOST TARGET binding site such as BINDING SITE I, BINDING SITE II or BINDING SITE III. Table 2 illustrates the complementarity of the nucleotide sequences of SEMA4G BINDING SITE, designated SEQ ID:45411, to the nucleotide sequence of VGAM2316 RNA, herein designated VGAM RNA, also designated SEQ ID:5027.

Another function of VGAM2316 is therefore inhibition of Sema Domain, Immunoglobulin Domain (Ig), Transmembrane Domain (TM) and Short Cytoplasmic Domain, (semaphorin) 4G (SEMA4G, Accession XM_170638). Accordingly, utilities of VGAM2316 include diagnosis, prevention and treatment of diseases and clinical conditions associated with SEMA4G. ZAK (Accession NM_016653) is another VGAM2316 host target gene. ZAK BINDING SITE is HOST TARGET binding site found in the 3' untranslated region of mRNA encoded by ZAK, corresponding to a HOST TARGET binding site such as BINDING SITE I, BINDING SITE II or BINDING SITE III. Table 2 illustrates the complementarity of the nucleotide sequences of ZAK BINDING SITE, designated SEQ ID:18776, to the nucleotide sequence of VGAM2316 RNA, herein designated VGAM RNA, also designated SEQ ID:5027.

Another function of VGAM2316 is therefore inhibition of ZAK (Accession NM_016653). Accordingly, utilities of VGAM2316 include diagnosis, prevention and treatment of diseases and clinical conditions associated with ZAK. LOC131363 (Accession XM_067344) is another VGAM2316 host target gene. LOC131363 BINDING SITE is HOST TARGET binding site found in the 5' untranslated region of mRNA encoded by LOC131363, corresponding to a HOST TARGET binding site such as BINDING SITE I, BINDING SITE II or BINDING SITE III. Table 2 illustrates the complementarity of the nucleotide sequences of LOC131363 BINDING SITE, designated SEQ ID:37353, to the nucleotide sequence of VGAM2316 RNA, herein designated VGAM RNA, also designated SEQ ID:5027.

Another function of VGAM2316 is therefore inhibition of LOC131363 (Accession XM_067344). Accordingly, utilities of VGAM2316 include diagnosis, prevention and treatment of diseases and clinical conditions associated with LOC131363. LOC147057 (Accession XM_097166) is another VGAM2316 host target gene. LOC147057 BINDING SITE is HOST TARGET binding site found in the 3' untranslated region of mRNA encoded by LOC147057, corresponding to a HOST TARGET binding site such as BINDING SITE I, BINDING SITE II or BINDING SITE III. Table 2 illustrates the complementarity of the nucleotide sequences of LOC147057 BINDING SITE, designated SEQ ID:40785, to the nucleotide sequence of VGAM2316 RNA, herein designated VGAM RNA, also designated SEQ ID:5027.

Another function of VGAM2316 is therefore inhibition of LOC147057 (Accession XM_097166). Accordingly, utilities of VGAM2316 include diagnosis, prevention and treatment of diseases and clinical conditions associated with LOC147057. LOC152580 (Accession XM_098240) is another VGAM2316 host target gene. LOC152580 BINDING SITE is HOST TARGET binding site found in the 5' untranslated region of mRNA encoded by LOC152580, corresponding to a HOST TARGET binding site such as BINDING SITE I, BINDING SITE II or BINDING SITE III. Table 2 illustrates the complementarity of the nucleotide sequences of LOC152580 BINDING SITE, designated SEQ ID:41521, to the nucleotide sequence of VGAM2316 RNA, herein designated VGAM RNA, also designated SEQ ID:5027.

Another function of VGAM2316 is therefore inhibition of LOC152580 (Accession XM_098240). Accordingly, utilities of VGAM2316 include diagnosis, prevention and treatment of diseases and clinical conditions associated with LOC152580. LOC221751 (Accession XM_166370) is another VGAM2316 host target gene. LOC221751 BINDING SITE is HOST TARGET binding site found in the 5' untranslated region of mRNA encoded by LOC221751, corresponding to a HOST TARGET binding site such as BINDING SITE I, BINDING SITE II or BINDING SITE III. Table 2 illustrates the complementarity of the nucleotide sequences of LOC221751 BINDING SITE, designated SEQ ID:44191, to the nucleotide sequence of VGAM2316 RNA, herein designated VGAM RNA, also designated SEQ ID:5027.

Another function of VGAM2316 is therefore inhibition of LOC221751 (Accession XM_166370). Accordingly, utilities of VGAM2316 include diagnosis, prevention and treatment of diseases and clinical conditions associated with LOC221751. LOC89932 (Accession XM_027341) is another VGAM2316 host target gene. LOC89932 BINDING SITE is HOST TARGET binding site found in the 3' untranslated region of mRNA encoded by LOC89932, corresponding to a HOST TARGET binding site such as BINDING SITE I, BINDING SITE II or BINDING SITE III. Table 2 illustrates the complementarity of the nucleotide sequences of LOC89932 BINDING SITE, designated SEQ ID:30495, to the nucleotide sequence of VGAM2316 RNA, herein designated VGAM RNA, also designated SEQ ID:5027.

Another function of VGAM2316 is therefore inhibition of LOC89932 (Accession XM_027341). Accordingly, utilities of VGAM2316 include diagnosis, prevention and treatment of diseases and clinical conditions associated with LOC89932. FIG. 1 further provides a conceptual description of a novel bioinformatically detected viral gene of the present invention, referred to here as Viral Genomic Address Messenger 2317 (VGAM2317) viral gene, which modulates expression of respective host target genes thereof, the function and utility of which host target genes is known in the art.

VGAM2317 is a novel bioinformatically detected regulatory, non protein coding, viral micro RNA (miRNA) gene. The method by which VGAM2317 was detected is described hereinabove with reference to FIGS. 1-8.

VGAM2317 gene, herein designated VGAM GENE, is a viral gene contained in the genome of Rana Tigrina Ranavirus. VGAM2317 host target gene, herein designated VGAM HOST TARGET GENE, is a human gene contained in the human genome.

VGAM2317 gene encodes a VGAM2317 precursor RNA, herein designated VGAM PRECURSOR RNA. Similar to other miRNA genes, and unlike most ordinary genes, VGAM2317 precursor RNA does not encode a protein. A nucleotide sequence identical or highly similar to the nucleotide sequence of VGAM2317 precursor RNA is designated SEQ ID:2303, and is provided hereinbelow with reference to the sequence listing part. Nucleotide sequence SEQ ID:2303 is located at position 24685 relative to the genome of Rana Tigrina Ranavirus.

VGAM2317 precursor RNA folds onto itself, forming VGAM2317 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2317 folded precursor RNA into VGAM2317 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2317 RNA is designated SEQ ID:5028, and is provided hereinbelow with reference to the sequence listing part.

VGAM2317 host target gene, herein designated VGAM HOST TARGET GENE, encodes a corresponding messenger RNA, VGAM2317 host target RNA, herein designated VGAM HOST TARGET RNA. VGAM2317 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2317 RNA, herein designated VGAM RNA, binds complementarily to one or more host target binding sites located in untranslated regions of VGAM2317 host target RNA, herein designated VGAM HOST TARGET RNA. This complementary binding is due to the fact that the nucleotide sequence of VGAM2317 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2317 RNA, herein designated VGAM RNA, may have a different number of host target binding sites in untranslated regions of a VGAM2317 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2317 RNA, herein designated VGAM RNA, to host target binding sites on VGAM2317 host target RNA, herein designated VGAM HOST TARGET RNA, such as BINDING SITE I, BINDING SITE II and BINDING SITE III, inhibits translation of VGAM2317 host target RNA into VGAM2317 host target protein, herein designated VGAM HOST TARGET PROTEIN. VGAM host target protein is therefore outlined by a broken line.

It is appreciated that VGAM2317 host target gene, herein designated VGAM HOST TARGET GENE, in fact represents a plurality of VGAM2317 host target genes. The mRNA of each one of this plurality of VGAM2317 host target genes comprises one or more host target binding sites, each having a nucleotide sequence which is at least partly complementary to VGAM2317 RNA, herein designated VGAM RNA, and which when bound by VGAM2317 RNA causes inhibition of translation of respective one or more VGAM2317 host target proteins.

It is further appreciated by one skilled in the art that the mode of translational inhibition illustrated by FIG. 1 with specific reference to translational inhibition exerted by VGAM2317 gene, herein designated VGAM GENE, on one or more VGAM2317 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2317 is inhibition of expression of host target genes, as part of a novel viral mechanism of attacking a host. Accordingly, utilities of VGAM2317 include diagnosis, prevention and treatment of viral infection by Rana Tigrina Ranavirus. Specific functions, and accordingly utilities, of VGAM2317 correlate with, and may be deduced from, the identity of the host target genes which VGAM2317 binds and inhibits, and the function of these host target genes, as elaborated hereinbelow.

Nucleotide sequences of the VGAM2317 precursor RNA, herein designated VGAM PRECURSOR RNA, and of the 'diced' VGAM2317 RNA, herein designated VGAM RNA, and a schematic representation of the secondary folding of VGAM2317 folded precursor RNA, herein designated VGAM FOLDED PRECURSOR RNA, of VGAM2317 are further described hereinbelow with reference to Table 1.

Nucleotide sequences of host target binding sites, such as BINDING SITE-I, BINDING SITE-II and BINDING SITE-III of FIG. 1, found on VGAM2317 host target RNA, and schematic representation of the complementarity of each of these host target binding sites to VGAM2317 RNA, herein designated VGAM RNA, are described hereinbelow with reference to Table 2.

As mentioned hereinabove with reference to FIG. 1, a function of VGAM2317 gene, herein designated VGAM is inhibition of expression of VGAM2317 target genes. It is appreciated that specific functions, and accordingly utilities, of VGAM2317 correlate with, and may be deduced from, the identity of the target genes which VGAM2317 binds and inhibits, and the function of these target genes, as elaborated hereinbelow.

Carbohydrate Kinase-like (CARKL, Accession NM_013276) is a VGAM2317 host target gene. CARKL BINDING SITE is HOST TARGET binding site found in the 3' untranslated region of mRNA encoded by CARKL, corresponding to a HOST TARGET binding site such as BINDING SITE I, BINDING SITE II or BINDING SITE III. Table 2 illustrates the complementarity of the nucleotide sequences of CARKL BINDING SITE, designated SEQ ID:14937, to the nucleotide sequence of VGAM2317 RNA, herein designated VGAM RNA, also designated SEQ ID:5028.

A function of VGAM2317 is therefore inhibition of Carbohydrate Kinase-like (CARKL, Accession NM_013276), a gene which is a putative carbohydrate kinase and may be a modifier for the cystinosis phenotype. Accordingly, utilities of VGAM2317 include diagnosis, prevention and treatment of diseases and clinical conditions associated with CARKL. The function of CARKL and its association with various diseases and clinical conditions, has been established by previous studies, as described hereinabove with reference to VGAM419. Mitogen-activated Protein Kinase Kinase Kinase 11 (MAP3K11, Accession NM_002419) is another VGAM2317 host target gene. MAP3K11 BINDING SITE is HOST TARGET binding site found in the 5' untranslated region of mRNA encoded by MAP3K11, corresponding to a HOST TARGET binding site such as BINDING SITE I, BINDING SITE II or BINDING SITE III. Table 2 illustrates the complementarity of the nucleotide sequences of MAP3K11 BINDING SITE, designated SEQ ID:8256, to the nucleotide sequence of VGAM2317 RNA, herein designated VGAM RNA, also designated SEQ ID:5028.

Another function of VGAM2317 is therefore inhibition of Mitogen-activated Protein Kinase Kinase Kinase 11 (MAP3K11, Accession NM_002419), a gene which is a PROTEIN-TYROSINE KINASE. Accordingly, utilities of VGAM2317 include diagnosis, prevention and treatment of diseases and clinical conditions associated with MAP3K11. The function of MAP3K11 has been established by previous studies. Using RT-PCR and cDNA library screening, Ing et al. (1994) identified MAP3K11, a novel protein kinase, from human thymus. The deduced open reading frame, derived from sequencing a 3.5-kb MAP3K11 cDNA, encodes a protein of 847 amino acids with several interesting structural features. These include an SH3 domain in the absence of an SH2 domain, a region containing 2 leucine zippers with an adjacent C-terminal basic region, and a proline rich region. The new kinase showed homology with the mixed-lineage family of protein kinases (MLKs) and shared the unusual leucine zipper-basic motif found in previously identified MLK kinases; Ing et al. (1994) therefore called the protein MLK3. By Northern blot analysis, MAP3K11 mRNA was detected in a wide variety of normal and transformed human cell lines and tissues. SH2 domains refer to src homology 2 domains, which were first identified in the SRC gene family and found in a variety of proteins involved in signal transduction. Proteins bearing an SH3 domain also participate in receptor tyrosine kinase-mediated signal transduction. Using fluorescence in situ hybridization, Ing et al. (1994) mapped the MAP3K11 gene to 11q13.1-q13.3. Courseaux et al. (1996) used a combination of methods to refine maps of the approximately 5-Mb region of 11q13 that includes MEN1 (OMIM Ref. No. 131100). They proposed the following gene order: cen--PGA--FTH1--UGB--AHNAK--ROM1--MDU1--CHRM1--COX8--EMK1--FKBP2--PLCB3--[PYGM, ZFM1]--FAU--CAPN1--[MAP3K11, RELA]--FOSL1--SEA--CFL1--tel Full details of the abovementioned studies are described in the following publications, the disclosure of which are hereby incorporated by reference:

Courseaux, A.; Grosgeorge, J.; Gaudray, P.; Pannett, A. A. J.; Forbes, S. A.; Williamson, C.; Bassett, D.; Thakker, R. V.; Teh, B. T.; Farnebo, F.; Shepherd, J.; Skogseid, B.; Larsson, C.; Giraud, S.; Zhang, C. X.; Salandre, J.; Calender, A.: Definition of the minimal MEN1 candidate area based on a 5-Mb integrated map of proximal 11q13. Genomics 37:354-365, 1996; and Ing, Y. L.; Leung, I. W. L.; Heng, H. H. Q.; Tsui, L.-C.; Lassam, N. J.: MLK-3: identification of a widely-expressed protein kinase bearing an SH3 domain and a leucine zipper-basic regi.

Further studies establishing the function and utilities of MAP3K11 are found in John Hopkins OMIM database record ID 600050, and in sited publications numbered 398 and 7725 listed in the bibliography section hereinbelow, which are also hereby incorporated by reference. P114-RHO-GEF (Accession NM_015318) is another VGAM2317 host target gene. P114-RHO-GEF BINDING SITE is HOST TARGET binding site found in the 3' untranslated region of mRNA encoded by P114-RHO-GEF, corresponding to a HOST TARGET binding site such as BINDING SITE I, BINDING SITE II or BINDING SITE III. Table 2 illustrates the complementarity of the nucleotide sequences of P114-RHO-GEF BINDING SITE, designated SEQ ID:17639, to the nucleotide sequence of VGAM2317 RNA, herein designated VGAM RNA, also designated SEQ ID:5028.

Another function of VGAM2317 is therefore inhibition of P114-RHO-GEF (Accession NM_015318). Accordingly, utilities of VGAM2317 include diagnosis, prevention and treatment of diseases and clinical conditions associated with P114-RHO-GEF. LOC144347 (Accession XM_084832) is another VGAM2317 host target gene. LOC144347 BIND- ING SITE is HOST TARGET binding site found in the 3' untranslated region of mRNA encoded by LOC144347, corresponding to a HOST TARGET binding site such as BINDING SITE I, BINDING SITE II or BINDING SITE III. Table 2 illustrates the complementarity of the nucleotide sequences of LOC144347 BINDING SITE, designated SEQ ID:37722, to the nucleotide sequence of VGAM2317 RNA, herein designated VGAM RNA, also designated SEQ ID:5028.

Another function of VGAM2317 is therefore inhibition of LOC144347 (Accession XM_084832). Accordingly, utilities of VGAM2317 include diagnosis, prevention and treatment of diseases and clinical conditions associated with LOC144347. LOC146243 (Accession XM_096956) is another VGAM2317 host target gene. LOC146243 BINDING SITE is HOST TARGET binding site found in the 3' untranslated region of mRNA encoded by LOC146243, corresponding to a HOST TARGET binding site such as BINDING SITE I, BINDING SITE II or BINDING SITE III. Table 2 illustrates the complementarity of the nucleotide sequences of LOC146243 BINDING SITE, designated SEQ ID:40675, to the nucleotide sequence of VGAM2317 RNA, herein designated VGAM RNA, also designated SEQ ID:5028.

Another function of VGAM2317 is therefore inhibition of LOC146243 (Accession XM_096956). Accordingly, utilities of VGAM2317 include diagnosis, prevention and treatment of diseases and clinical conditions associated with LOC146243. LOC255231 (Accession XM_170908) is another VGAM2317 host target gene. LOC255231 BINDING SITE is HOST TARGET binding site found in the 3' untranslated region of mRNA encoded by LOC255231, corresponding to a HOST TARGET binding site such as BINDING SITE I, BINDING SITE II or BINDING SITE III. Table 2 illustrates the complementarity of the nucleotide sequences of LOC255231 BINDING SITE, designated SEQ ID:45673, to the nucleotide sequence of VGAM2317 RNA, herein designated VGAM RNA, also designated SEQ ID:5028.

Another function of VGAM2317 is therefore inhibition of LOC255231 (Accession XM_170908). Accordingly, utilities of VGAM2317 include diagnosis, prevention and treatment of diseases and clinical conditions associated with LOC255231. FIG. 1 further provides a conceptual description of a novel bioinformatically detected viral gene of the present invention, referred to here as Viral Genomic Address Messenger 2318 (VGAM2318) viral gene, which modulates expression of respective host target genes thereof, the function and utility of which host target genes is known in the art.

VGAM2318 is a novel bioinformatically detected regulatory, non protein coding, viral micro RNA (miRNA) gene. The method by which VGAM2318 was detected is described hereinabove with reference to FIGS. 1-8.

VGAM2318 gene, herein designated VGAM GENE, is a viral gene contained in the genome of Rana Tigrina Ranavirus. VGAM2318 host target gene, herein designated VGAM HOST TARGET GENE, is a human gene contained in the human genome.

VGAM2318 gene encodes a VGAM2318 precursor RNA, herein designated VGAM PRECURSOR RNA. Similar to other miRNA genes, and unlike most ordinary genes, VGAM2318 precursor RNA does not encode a protein. A nucleotide sequence identical or highly similar to the nucleotide sequence of VGAM2318 precursor RNA is designated SEQ ID:2304, and is provided hereinbelow with reference to the sequence listing part. Nucleotide sequence SEQ ID:2304 is located at position 35010 relative to the genome of Rana Tigrina Ranavirus.

VGAM2318 precursor RNA folds onto itself, forming VGAM2318 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2318 folded precursor RNA into VGAM2318 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2318 RNA is designated SEQ ID:5029, and is provided hereinbelow with reference to the sequence listing part.

VGAM2318 host target gene, herein designated VGAM HOST TARGET GENE, encodes a corresponding messenger RNA, VGAM2318 host target RNA, herein designated VGAM HOST TARGET RNA. VGAM2318 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2318 RNA, herein designated VGAM RNA, binds complementarily to one or more host target binding sites located in untranslated regions of VGAM2318 host target RNA, herein designated VGAM HOST TARGET RNA. This complementary binding is due to the fact that the nucleotide sequence of VGAM2318 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2318 RNA, herein designated VGAM RNA, may have a different number of host target binding sites in untranslated regions of a VGAM2318 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2318 RNA, herein designated VGAM RNA, to host target binding sites on VGAM2318 host target RNA, herein designated VGAM HOST TARGET RNA, such as BINDING SITE I, BINDING SITE II and BINDING SITE III, inhibits translation of VGAM2318 host target RNA into VGAM2318 host target protein, herein designated VGAM HOST TARGET PROTEIN. VGAM host target protein is therefore outlined by a broken line.

It is appreciated that VGAM2318 host target gene, herein designated VGAM HOST TARGET GENE, in fact represents a plurality of VGAM2318 host target genes. The mRNA of each one of this plurality of VGAM2318 host target genes comprises one or more host target binding sites, each having a nucleotide sequence which is at least partly complementary to VGAM2318 RNA, herein designated VGAM RNA, and which when bound by VGAM2318 RNA causes inhibition of translation of respective one or more VGAM2318 host target proteins.

It is further appreciated by one skilled in the art that the mode of translational inhibition illustrated by FIG. 1 with specific reference to translational inhibition exerted by VGAM2318 gene, herein designated VGAM GENE, on one or more VGAM2318 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2318 is inhibition of expression of host target genes, as part of a novel viral mechanism of attacking a host. Accordingly, utilities of VGAM2318 include diagnosis, prevention and treatment of viral infection by Rana Tigrina Ranavirus. Specific functions, and accordingly utilities, of VGAM2318 correlate with, and may be deduced from, the identity of the host target genes which VGAM2318 binds and inhibits, and the function of these host target genes, as elaborated hereinbelow.

Nucleotide sequences of the VGAM2318 precursor RNA, herein designated VGAM PRECURSOR RNA, and of the 'diced' VGAM2318 RNA, herein designated VGAM RNA, and a schematic representation of the secondary folding of VGAM2318 folded precursor RNA, herein designated VGAM FOLDED PRECURSOR RNA, of VGAM2318 are further described hereinbelow with reference to Table 1.

Nucleotide sequences of host target binding sites, such as BINDING SITE-I, BINDING SITE-II and BINDING SITE-III of FIG. 1, found on VGAM2318 host target RNA, and schematic representation of the complementarity of each of these host target binding sites to VGAM2318 RNA, herein designated VGAM RNA, are described hereinbelow with reference to Table 2.

As mentioned hereinabove with reference to FIG. 1, a function of VGAM2318 gene, herein designated VGAM is inhibition of expression of VGAM2318 target genes. It is appreciated that specific functions, and accordingly utilities, of VGAM2318 correlate with, and may be deduced from, the identity of the target genes which VGAM2318 binds and inhibits, and the function of these target genes, as elaborated hereinbelow.

Dishevelled, Dsh Homolog 3 (Drosophila) (DVL3, Accession NM_004423) is a VGAM2318 host target gene. DVL3 BINDING SITE is HOST TARGET binding site found in the 3' untranslated region of mRNA encoded by DVL3, corresponding to a HOST TARGET binding site such as BINDING SITE I, BINDING SITE II or BINDING SITE III. Table 2 illustrates the complementarity of the nucleotide sequences of DVL3 BINDING SITE, designated SEQ ID:10694, to the nucleotide sequence of VGAM2318 RNA, herein designated VGAM RNA, also designated SEQ ID:5029.

A function of VGAM2318 is therefore inhibition of Dishevelled, Dsh Homolog 3 (Drosophila) (DVL3, Accession NM_004423), a gene which regulates cell proliferation. Accordingly, utilities of VGAM2318 include diagnosis, prevention and treatment of diseases and clinical conditions associated with DVL3. The function of DVL3 and its association with various diseases and clinical conditions, has been established by previous studies, as described hereinabove with reference to VGAM57. Ephrin-B1 (EFNB1, Accession NM_004429) is another VGAM2318 host target gene. EFNB1 BINDING SITE is HOST TARGET binding site found in the 3' untranslated region of mRNA encoded by EFNB1, corresponding to a HOST TARGET binding site such as BINDING SITE I, BINDING SITE II or BINDING SITE III. Table 2 illustrates the complementarity of the nucleotide sequences of EFNB1 BINDING SITE, designated SEQ ID:10707, to the nucleotide sequence of VGAM2318 RNA, herein designated VGAM RNA, also designated SEQ ID:5029.

Another function of VGAM2318 is therefore inhibition of Ephrin-B1 (EFNB1, Accession NM_004429), a gene which is a transmembrane ligand of Eph-related receptor tyrosine kinases, has a role in cell adhesion. Accordingly, utilities of VGAM2318 include diagnosis, prevention and treatment of diseases and clinical conditions associated with EFNB1. The function of EFNB1 and its association with various diseases and clinical conditions, has been established by previous studies, as described hereinabove with reference to VGAM390. LIM Homeobox Protein 5 (LHX5, Accession NM_022363) is another VGAM2318 host target gene. LHX5 BINDING SITE is HOST TARGET binding site found in the 5' untranslated region of mRNA encoded by LHX5, corresponding to a HOST TARGET binding site such as BINDING SITE I, BINDING SITE II or BINDING SITE III. Table 2 illustrates the complementarity of the nucleotide sequences of LHX5 BINDING SITE, designated SEQ ID:22749, to the nucleotide sequence of VGAM2318 RNA, herein designated VGAM RNA, also designated SEQ ID:5029.

Another function of VGAM2318 is therefore inhibition of LIM Homeobox Protein 5 (LHX5, Accession NM_022363). Accordingly, utilities of VGAM2318 include diagnosis, prevention and treatment of diseases and clinical conditions associated with LHX5. Mannan-binding Lectin Serine Protease 1 (C4/C2 activating component of Ra-reactive factor) (MASP1, Accession NM_001879) is another VGAM2318 host target gene. MASP1 BINDING SITE is HOST TARGET binding site found in the 3' untranslated region of mRNA encoded by MASP1, corresponding to a HOST TARGET binding site such as BINDING SITE I, BINDING SITE II or BINDING SITE III. Table 2 illustrates the complementarity of the nucleotide sequences of MASP1 BINDING SITE, designated SEQ ID:7606, to the nucleotide sequence of VGAM2318 RNA, herein designated VGAM RNA, also designated SEQ ID:5029.

Another function of VGAM2318 is therefore inhibition of Mannan-binding Lectin Serine Protease 1 (C4/C2 activating component of Ra-reactive factor) (MASP1, Accession NM_001879), a gene which a complement-dependent bactericidal factor. Accordingly, utilities of VGAM2318 include diagnosis, prevention and treatment of diseases and clinical conditions associated with MASP1. The function of MASP1 and its association with various diseases and clinical conditions, has been established by previous studies, as described hereinabove with reference to VGAM566. Myogenin (myogenic factor 4) (MYOG, Accession XM_001688) is another VGAM2318 host target gene. MYOG BINDING SITE is HOST TARGET binding site found in the 3' untranslated region of mRNA encoded by MYOG, corresponding to a HOST TARGET binding site such as BINDING SITE I, BINDING SITE II or BINDING SITE III. Table 2 illustrates the complementarity of the nucleotide sequences of MYOG BINDING SITE, designated SEQ ID:29847, to the nucleotide sequence of VGAM2318 RNA, herein designated VGAM RNA, also designated SEQ ID:5029.

Another function of VGAM2318 is therefore inhibition of Myogenin (myogenic factor 4) (MYOG, Accession XM_001688), a gene which can induce myogenesis in a variety of cell types. Accordingly, utilities of VGAM2318 include diagnosis, prevention and treatment of diseases and clinical conditions associated with MYOG. The function of MYOG and its association with various diseases and clinical conditions, has been established by previous studies, as described hereinabove with reference to VGAM1793. Polypyrimidine Tract Binding Protein 1 (PTBP1, Accession NM_002819) is another VGAM2318 host target gene. PTBP1 BINDING SITE1 and PTBP1 BINDING SITE2 are HOST TARGET binding sites found in untranslated regions of mRNA encoded by PTBP1, corresponding to HOST TARGET binding sites such as BINDING SITE I, BINDING SITE II or BINDING SITE III. Table 2 illustrates the complementarity of the nucleotide sequences of PTBP1 BINDING SITE1 and PTBP1 BINDING SITE2, designated SEQ ID:8684 and SEQ ID:25704 respectively, to the nucleotide sequence of VGAM2318 RNA, herein designated VGAM RNA, also designated SEQ ID:5029.

Another function of VGAM2318 is therefore inhibition of Polypyrimidine Tract Binding Protein 1 (PTBP1, Accession NM_002819), a gene which is required for pre-mRNA splicing, and acts via the protein degradation ubiquitin-proteasome pathway. Accordingly, utilities of VGAM2318 include diagnosis, prevention and treatment of diseases and clinical conditions associated with PTBP1. The function of PTBP1 has been established by previous studies. Polypyrimidine tract-binding protein (PTB), also known as heterogeneous nuclear ribonucleoprotein type I (hnRNP I), is a 59.6-kD nuclear protein that binds pre-mRNAs in specific regions of the hnRNA-protein complexes sensitive to micrococcal nuclease. The hnRNP I protein shows an unusual pattern of nuclear localization (Ghetti et al., 1992). It has been implicated in pre-mRNA splicing. Inclusion of cardiac troponin T (TNNT2; 191045) exon 5 in embryonic muscle requires conserved flanking intronic elements (MSEs). Charlet-B. et al. (2002) found that ETR3 (CUGBP2; 602538), a member of the CELF family, binds U/G motifs in 2 MSEs and directly activates exon inclusion in vitro. They showed that binding and activation by ETR3 are directly antagonized by PTB. The use of dominant-negative mutants demonstrated that endogenous CELF and PTB activities are required for MSE-dependent activation and repression in muscle and nonmuscle cells, respectively. Combined use of CELF and PTB dominant-negative mutants provided an in vivo demonstration that antagonistic splicing activities exist within the same cells.

Full details of the abovementioned studies are described in the following publications, the disclosure of which are hereby incorporated by reference:

Ghetti, A.; Pinol-Roma, S.; Michael, W. M.; Morandi, C.; Dreyfuss, G.: HNRNP I, the polypyrimidine tract-binding protein: distinct nuclear localization and association with hnRNAs. Nucleic Acids Res. 20:3671-3678, 1992; and Charlet-B., N.; Logan, P.; Singh, G.; Cooper, T. A.: Dynamic antagonism between ETR-3 and PTB regulates cell type-specific alternative splicing. Molec. Cell 9:649-658, 2002.

Further studies establishing the function and utilities of PTBP1 are found in John Hopkins OMIM database record ID 600693, and in sited publications numbered 10492-9983 listed in the bibliography section hereinbelow, which are also hereby incorporated by reference. ADP-ribosylation Factor GTPase Activating Protein 1 (ARFGAP1, Accession NM_018209) is another VGAM2318 host target gene. ARFGAP1 BINDING SITE is HOST TARGET binding site found in the 3' untranslated region of mRNA encoded by ARFGAP1, corresponding to a HOST TARGET binding site such as BINDING SITE I, BINDING SITE II or BINDING SITE III. Table 2 illustrates the complementarity of the nucleotide sequences of ARFGAP1 BINDING SITE, designated SEQ ID:20108, to the nucleotide sequence of VGAM2318 RNA, herein designated VGAM RNA, also designated SEQ ID:5029.

Another function of VGAM2318 is therefore inhibition of ADP-ribosylation Factor GTPase Activating Protein 1 (ARFGAP1, Accession NM_018209). Accordingly, utilities of VGAM2318 include diagnosis, prevention and treatment of diseases and clinical conditions associated with ARFGAP1. Burkitt Lymphoma Receptor 1, GTP Binding Protein (chemokine (C-X-C motif) Receptor 5) (BLR1, Accession NM_032966) is another VGAM2318 host target gene. BLR1 BINDING SITE is HOST TARGET binding site found in the 5' untranslated region of mRNA encoded by BLR1, corresponding to a HOST TARGET binding site such as BINDING SITE I, BINDING SITE II or BINDING SITE III. Table 2 illustrates the complementarity of the nucleotide sequences of BLR1 BINDING SITE, designated SEQ ID:26775, to the nucleotide sequence of VGAM2318 RNA, herein designated VGAM RNA, also designated SEQ ID:5029.

Another function of VGAM2318 is therefore inhibition of Burkitt Lymphoma Receptor 1, GTP Binding Protein (chemokine (C-X-C motif) Receptor 5) (BLR1, Accession NM_032966). Accordingly, utilities of VGAM2318 include diagnosis, prevention and treatment of diseases and clinical conditions associated with BLR1. Chromosome 20 Open Reading Frame 110 (C20orf110, Accession XM_086728) is another VGAM2318 host target gene. C20orf110 BINDING SITE is HOST TARGET binding site found in the 3' untranslated region of mRNA encoded by C20orf110, corresponding to a HOST TARGET binding site such as BINDING SITE I, BINDING SITE II or BINDING SITE III. Table 2 illustrates the complementarity of the nucleotide sequences of C20orf110 BINDING SITE, designated SEQ ID:38837, to the nucleotide sequence of VGAM2318 RNA, herein designated VGAM RNA, also designated SEQ ID:5029.

Another function of VGAM2318 is therefore inhibition of Chromosome 20 Open Reading Frame 110 (C20orf110, Accession XM_086728). Accordingly, utilities of VGAM2318 include diagnosis, prevention and treatment of diseases and clinical conditions associated with C20orf110. Collagen, Type IV, Alpha 3 (Goodpasture antigen) Binding Protein (COL4A3BP, Accession NM_005713) is another VGAM2318 host target gene. COL4A3BP BINDING SITE is HOST TARGET binding site found in the 5' untranslated region of mRNA encoded by COL4A3BP, corresponding to a HOST TARGET binding site such as BINDING SITE I, BINDING SITE II or BINDING SITE III. Table 2 illustrates the complementarity of the nucleotide sequences of COL4A3BP BINDING SITE, designated SEQ ID:12266, to the nucleotide sequence of VGAM2318 RNA, herein designated VGAM RNA, also designated SEQ ID:5029.

Another function of VGAM2318 is therefore inhibition of Collagen, Type IV, Alpha 3 (Goodpasture antigen) Binding Protein (COL4A3BP, Accession NM_005713). Accordingly, utilities of VGAM2318 include diagnosis, prevention and treatment of diseases and clinical conditions associated with COL4A3BP. Cathepsin O (CTSO, Accession NM_001334) is another VGAM2318 host target gene. CTSO BINDING SITE is HOST TARGET binding site found in the 3' untranslated region of mRNA encoded by CTSO, corresponding to a HOST TARGET binding site such as BINDING SITE I, BINDING SITE II or BINDING SITE III. Table 2 illustrates the complementarity of the nucleotide sequences of CTSO BINDING SITE, designated SEQ ID:7016, to the nucleotide sequence of VGAM2318 RNA, herein designated VGAM RNA, also designated SEQ ID:5029.

Another function of VGAM2318 is therefore inhibition of Cathepsin O (CTSO, Accession NM_001334). Accordingly, utilities of VGAM2318 include diagnosis, prevention and treatment of diseases and clinical conditions associated with CTSO. FLJ10743 (Accession NM_018201) is another VGAM2318 host target gene. FLJ10743 BINDING SITE is HOST TARGET binding site found in the 3' untranslated region of mRNA encoded by FLJ10743, corresponding to a HOST TARGET binding site such as BINDING SITE I, BINDING SITE II or BINDING SITE III. Table 2 illustrates the complementarity of the nucleotide sequences of FLJ10743 BINDING SITE, designated SEQ ID:20077, to the nucleotide sequence of VGAM2318 RNA, herein designated VGAM RNA, also designated SEQ ID:5029.

Another function of VGAM2318 is therefore inhibition of FLJ10743 (Accession NM_018201). Accordingly, utilities of VGAM2318 include diagnosis, prevention and treatment of diseases and clinical conditions associated with FLJ10743. FLJ14124 (Accession NM_024868) is another VGAM2318 host target gene. FLJ14124 BINDING SITE is HOST TARGET binding site found in the 3' untranslated region of mRNA encoded by FLJ14124, corresponding to a HOST TARGET binding site such as BINDING SITE I, BINDING SITE II or BINDING SITE III. Table 2 illustrates the complementarity of the nucleotide sequences of FLJ14124 BINDING SITE, designated SEQ ID:24304, to the nucleotide sequence of VGAM2318 RNA, herein designated VGAM RNA, also designated SEQ ID:5029.

Another function of VGAM2318 is therefore inhibition of FLJ14124 (Accession NM_024868). Accordingly, utilities of VGAM2318 include diagnosis, prevention and treatment of diseases and clinical conditions associated with FLJ14124. FLJ14824 (Accession NM_032846) is another VGAM2318 host target gene. FLJ14824 BINDING SITE is HOST TARGET binding site found in the 3' untranslated region of mRNA encoded by FLJ14824, corresponding to a HOST TARGET binding site such as BINDING SITE I, BINDING SITE II or BINDING SITE III. Table 2 illustrates the complementarity of the nucleotide sequences of FLJ14824 BINDING SITE, designated SEQ ID:26641, to the nucleotide sequence of VGAM2318 RNA, herein designated VGAM RNA, also designated SEQ ID:5029.

Another function of VGAM2318 is therefore inhibition of FLJ14824 (Accession NM_032846). Accordingly, utilities of VGAM2318 include diagnosis, prevention and treatment of diseases and clinical conditions associated with FLJ14824. HSU79303 (Accession NM_013301) is another VGAM2318 host target gene. HSU79303 BINDING SITE is HOST TARGET binding site found in the 3' untranslated region of mRNA encoded by HSU79303, corresponding to a HOST TARGET binding site such as BINDING SITE I, BINDING SITE II or BINDING SITE III. Table 2 illustrates the complementarity of the nucleotide sequences of HSU79303 BINDING SITE, designated SEQ ID:14960, to the nucleotide sequence of VGAM2318 RNA, herein designated VGAM RNA, also designated SEQ ID:5029.

Another function of VGAM2318 is therefore inhibition of HSU79303 (Accession NM_013301). Accordingly, utilities of VGAM2318 include diagnosis, prevention and treatment of diseases and clinical conditions associated with HSU79303. ICB-1 (Accession NM_004848) is another VGAM2318 host target gene. ICB-1 BINDING SITE is HOST TARGET binding site found in the 3' untranslated region of mRNA encoded by ICB-1, corresponding to a HOST TARGET binding site such as BINDING SITE I, BINDING SITE II or BINDING SITE III. Table 2 illustrates the complementarity of the nucleotide sequences of ICB-1 BINDING SITE, designated SEQ ID:11258, to the nucleotide sequence of VGAM2318 RNA, herein designated VGAM RNA, also designated SEQ ID:5029.

Another function of VGAM2318 is therefore inhibition of ICB-1 (Accession NM_004848). Accordingly, utilities of VGAM2318 include diagnosis, prevention and treatment of diseases and clinical conditions associated with ICB-1. KIAA0010 (Accession NM_014671) is another VGAM2318 host target gene. KIAA0010 BINDING SITE is HOST TARGET binding site found in the 5' untranslated region of mRNA encoded by KIAA0010, corresponding to a HOST TARGET binding site such as BINDING SITE I, BINDING SITE II or BINDING SITE III. Table 2 illustrates the complementarity of the nucleotide sequences of KIAA0010 BINDING SITE, designated SEQ ID:16129, to the nucleotide sequence of VGAM2318 RNA, herein designated VGAM RNA, also designated SEQ ID:5029.

Another function of VGAM2318 is therefore inhibition of KIAA0010 (Accession NM_014671). Accordingly, utilities of VGAM2318 include diagnosis, prevention and treatment of diseases and clinical conditions associated with KIAA0010. KIAA0121 (Accession XM_052386) is another VGAM2318 host target gene. KIAA0121 BINDING SITE is HOST TARGET binding site found in the 5' untranslated region of mRNA encoded by KIAA0121, corresponding to a HOST TARGET binding site such as BINDING SITE I, BINDING SITE II or BINDING SITE III. Table 2 illustrates the complementarity of the nucleotide sequences of KIAA0121 BINDING SITE, designated SEQ ID:35969, to the nucleotide sequence of VGAM2318 RNA, herein designated VGAM RNA, also designated SEQ ID:5029.

Another function of VGAM2318 is therefore inhibition of KIAA0121 (Accession XM_052386). Accordingly, utilities of VGAM2318 include diagnosis, prevention and treatment of diseases and clinical conditions associated with KIAA0121. KIAA0194 (Accession XM_038362) is another VGAM2318 host target gene. KIAA0194 BINDING SITE is HOST TARGET binding site found in the 3' untranslated region of mRNA encoded by KIAA0194, corresponding to a HOST TARGET binding site such as BINDING SITE I, BINDING SITE II or BINDING SITE III. Table 2 illustrates the complementarity of the nucleotide sequences of KIAA0194 BINDING SITE, designated SEQ ID:32822, to the nucleotide sequence of VGAM2318 RNA, herein designated VGAM RNA, also designated SEQ ID:5029.

Another function of VGAM2318 is therefore inhibition of KIAA0194 (Accession XM_038362). Accordingly, utilities of VGAM2318 include diagnosis, prevention and treatment of diseases and clinical conditions associated with KIAA0194. KIAA1691 (Accession XM_166523) is another VGAM2318 host target gene. KIAA1691 BINDING SITE is HOST TARGET binding site found in the 3' untranslated region of mRNA encoded by KIAA1691, corresponding to a HOST TARGET binding site such as BINDING SITE I, BINDING SITE II or BINDING SITE III. Table 2 illustrates the complementarity of the nucleotide sequences of KIAA1691 BINDING SITE, designated SEQ ID:44467, to the nucleotide sequence of VGAM2318 RNA, herein designated VGAM RNA, also designated SEQ ID:5029.

Another function of VGAM2318 is therefore inhibition of KIAA1691 (Accession XM_166523). Accordingly, utilities of VGAM2318 include diagnosis, prevention and treatment of diseases and clinical conditions associated with KIAA1691. Neuronal Guanine Nucleotide Exchange Factor (NGEF, Accession XM_044799) is another VGAM2318 host target gene. NGEF BINDING SITE is HOST TARGET binding site found in the 3' untranslated region of mRNA encoded by NGEF, corresponding to a HOST TARGET binding site such as BINDING SITE I, BINDING SITE II or BINDING SITE III. Table 2 illustrates the complementarity of the nucleotide sequences of NGEF BINDING SITE, designated SEQ ID:34276, to the nucleotide sequence of VGAM2318 RNA, herein designated VGAM RNA, also designated SEQ ID:5029.

Another function of VGAM2318 is therefore inhibition of Neuronal Guanine Nucleotide Exchange Factor (NGEF, Accession XM_044799). Accordingly, utilities of VGAM2318 include diagnosis, prevention and treatment of diseases and clinical conditions associated with NGEF. REPRIMO (Accession NM_019845) is another VGAM2318 host target gene. REPRIMO BINDING SITE is HOST TARGET binding site found in the 3' untranslated region of mRNA encoded by REPRIMO, corresponding to a HOST TARGET binding site such as BINDING SITE I, BINDING SITE II or BINDING SITE III. Table 2 illustrates the complementarity of the nucleotide sequences of REPRIMO BINDING SITE, designated SEQ ID:21248, to the nucleotide sequence of VGAM2318 RNA, herein designated VGAM RNA, also designated SEQ ID:5029.

Another function of VGAM2318 is therefore inhibition of REPRIMO (Accession NM_019845). Accordingly, utilities of VGAM2318 include diagnosis, prevention and treatment of diseases and clinical conditions associated with REPRIMO. ZF5128 (Accession NM_014347) is another VGAM2318 host target gene. ZF5128 BINDING SITE is HOST TARGET binding site found in the 3' untranslated region of mRNA encoded by ZF5128, corresponding to a HOST TARGET binding site such as BINDING SITE I, BINDING SITE II or BINDING SITE III. Table 2 illustrates the complementarity of the nucleotide sequences of ZF5128 BINDING SITE, designated SEQ ID:15669, to the nucleotide sequence of VGAM2318 RNA, herein designated VGAM RNA, also designated SEQ ID:5029.

Another function of VGAM2318 is therefore inhibition of ZF5128 (Accession NM_014347). Accordingly, utilities of VGAM2318 include diagnosis, prevention and treatment of diseases and clinical conditions associated with ZF5128. LOC147136 (Accession XM_085716) is another VGAM2318 host target gene. LOC147136 BINDING SITE is HOST TARGET binding site found in the 3' untranslated region of mRNA encoded by LOC147136, corresponding to a HOST TARGET binding site such as BINDING SITE I, BINDING SITE II or BINDING SITE III. Table 2 illustrates the complementarity of the nucleotide sequences of LOC147136 BINDING SITE, designated SEQ ID:38302, to the nucleotide sequence of VGAM2318 RNA, herein designated VGAM RNA, also designated SEQ ID:5029.

Another function of VGAM2318 is therefore inhibition of LOC147136 (Accession XM_085716). Accordingly, utilities of VGAM2318 include diagnosis, prevention and treatment of diseases and clinical conditions associated with LOC147136. LOC153196 (Accession XM_098323) is another VGAM2318 host target gene. LOC153196 BINDING SITE is HOST TARGET binding site found in the 5' untranslated region of mRNA encoded by LOC153196, corresponding to a HOST TARGET binding site such as BINDING SITE I, BINDING SITE II or BINDING SITE III. Table 2 illustrates the complementarity of the nucleotide sequences of LOC153196 BINDING SITE, designated SEQ ID:41589, to the nucleotide sequence of VGAM2318 RNA, herein designated VGAM RNA, also designated SEQ ID:5029.

Another function of VGAM2318 is therefore inhibition of LOC153196 (Accession XM_098323). Accordingly, utilities of VGAM2318 include diagnosis, prevention and treatment of diseases and clinical conditions associated with LOC153196. LOC158654 (Accession XM_088632) is another VGAM2318 host target gene. LOC158654 BINDING SITE is HOST TARGET binding site found in the 3' untranslated region of mRNA encoded by LOC158654, corresponding to a HOST TARGET binding site such as BINDING SITE I, BINDING SITE II or BINDING SITE III. Table 2 illustrates the complementarity of the nucleotide sequences of LOC158654 BINDING SITE, designated SEQ ID:39877, to the nucleotide sequence of VGAM2318 RNA, herein designated VGAM RNA, also designated SEQ ID:5029.

Another function of VGAM2318 is therefore inhibition of LOC158654 (Accession XM_088632). Accordingly, utilities of VGAM2318 include diagnosis, prevention and treatment of diseases and clinical conditions associated with LOC158654. FIG. 1 further provides a conceptual description of a novel bioinformatically detected viral gene of the present invention, referred to here as Viral Genomic Address Messenger 2319 (VGAM2319) viral gene, which modulates expression of respective host target genes thereof, the function and utility of which host target genes is known in the art.

VGAM2319 is a novel bioinformatically detected regulatory, non protein coding, viral micro RNA (miRNA) gene. The method by which VGAM2319 was detected is described hereinabove with reference to FIGS. 1-8.

VGAM2319 gene, herein designated VGAM GENE, is a viral gene contained in the genome of Rana Tigrina Ranavirus. VGAM2319 host target gene, herein designated VGAM HOST TARGET GENE, is a human gene contained in the human genome.

VGAM2319 gene encodes a VGAM2319 precursor RNA, herein designated VGAM PRECURSOR RNA. Similar to other miRNA genes, and unlike most ordinary genes, VGAM2319 precursor RNA does not encode a protein. A nucleotide sequence identical or highly similar to the nucleotide sequence of VGAM2319 precursor RNA is designated SEQ ID:2305, and is provided hereinbelow with reference to the sequence listing part. Nucleotide sequence SEQ ID:2305 is located at position 15762 relative to the genome of Rana Tigrina Ranavirus.

VGAM2319 precursor RNA folds onto itself, forming VGAM2319 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2319 folded precursor RNA into VGAM2319 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2319 RNA is designated SEQ ID:5030, and is provided hereinbelow with reference to the sequence listing part.

VGAM2319 host target gene, herein designated VGAM HOST TARGET GENE, encodes a corresponding messenger RNA, VGAM2319 host target RNA, herein designated VGAM HOST TARGET RNA. VGAM2319 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2319 RNA, herein designated VGAM RNA, binds complementarily to one or more host target binding sites located in untranslated regions of VGAM2319 host target RNA, herein designated VGAM HOST TARGET RNA. This complementary binding is due to the fact that the nucleotide sequence of VGAM2319 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2319 RNA, herein designated VGAM RNA, may have a different number of host target binding sites in untranslated regions of a VGAM2319 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2319 RNA, herein designated VGAM RNA, to host target binding sites on VGAM2319 host target RNA, herein designated VGAM HOST TARGET RNA, such as BINDING SITE I, BINDING SITE II and BINDING SITE III, inhibits translation of VGAM2319 host target RNA into VGAM2319 host target protein, herein designated VGAM HOST TARGET PROTEIN. VGAM host target protein is therefore outlined by a broken line.

It is appreciated that VGAM2319 host target gene, herein designated VGAM HOST TARGET GENE, in fact represents a plurality of VGAM2319 host target genes. The mRNA of each one of this plurality of VGAM2319 host target genes comprises one or more host target binding sites, each having a nucleotide sequence which is at least partly complementary to VGAM2319 RNA, herein designated VGAM RNA, and which when bound by VGAM2319 RNA causes inhibition of translation of respective one or more VGAM2319 host target proteins.

It is further appreciated by one skilled in the art that the mode of translational inhibition illustrated by FIG. 1 with specific reference to translational inhibition exerted by VGAM2319 gene, herein designated VGAM GENE, on one or more VGAM2319 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2319 is inhibition of expression of host target genes, as part of a novel viral mechanism of attacking a host. Accordingly, utilities of VGAM2319 include diagnosis, prevention and treatment of viral infection by Rana Tigrina Ranavirus. Specific functions, and accordingly utilities, of VGAM2319 correlate with, and may be deduced from, the identity of the host target genes which VGAM2319 binds and inhibits, and the function of these host target genes, as elaborated hereinbelow.

Nucleotide sequences of the VGAM2319 precursor RNA, herein designated VGAM PRECURSOR RNA, and of the 'diced' VGAM2319 RNA, herein designated VGAM RNA, and a schematic representation of the secondary folding of VGAM2319 folded precursor RNA, herein designated VGAM FOLDED PRECURSOR RNA, of VGAM2319 are further described hereinbelow with reference to Table 1.

Nucleotide sequences of host target binding sites, such as BINDING SITE-I, BINDING SITE-II and BINDING SITE-III of FIG. 1, found on VGAM2319 host target RNA, and schematic representation of the complementarity of each of these host target binding sites to VGAM2319 RNA, herein designated VGAM RNA, are described hereinbelow with reference to Table 2.

As mentioned hereinabove with reference to FIG. 1, a function of VGAM2319 gene, herein designated VGAM is inhibition of expression of VGAM2319 target genes. It is appreciated that specific functions, and accordingly utilities, of VGAM2319 correlate with, and may be deduced from, the identity of the target genes which VGAM2319 binds and inhibits, and the function of these target genes, as elaborated hereinbelow.

Protein Tyrosine Phosphatase, Non-receptor Type 18 (brain-derived) (PTPN18, Accession NM_014369) is a VGAM2319 host target gene. PTPN18 BINDING SITE is HOST TARGET binding site found in the 3' untranslated region of mRNA encoded by PTPN18, corresponding to a HOST TARGET binding site such as BINDING SITE I, BINDING SITE II or BINDING SITE III. Table 2 illustrates the complementarity of the nucleotide sequences of PTPN18 BINDING SITE, designated SEQ ID:15704, to the nucleotide sequence of VGAM2319 RNA, herein designated VGAM RNA, also designated SEQ ID:5030.

A function of VGAM2319 is therefore inhibition of Protein Tyrosine Phosphatase, Non-receptor Type 18 (brain-derived) (PTPN18, Accession NM_014369). Accordingly, utilities of VGAM2319 include diagnosis, prevention and treatment of diseases and clinical conditions associated with PTPN18. Tumor Necrosis Factor Receptor Superfamily, Member 11a, Activator of NFKB (TNFRSF11A, Accession NM_003839) is another VGAM2319 host target gene. TNFRSF11A BINDING SITE is HOST TARGET binding site found in the 3' untranslated region of mRNA encoded by TNFRSF11A, corresponding to a HOST TARGET binding site such as BINDING SITE I, BINDING SITE II or BINDING SITE III. Table 2 illustrates the complementarity of the nucleotide sequences of TNFRSF11A BINDING SITE, designated SEQ ID:9932, to the nucleotide sequence of VGAM2319 RNA, herein designated VGAM RNA, also designated SEQ ID:5030.

Another function of VGAM2319 is therefore inhibition of Tumor Necrosis Factor Receptor Superfamily, Member 11a, Activator of NFKB (TNFRSF11A, Accession NM_003839). Accordingly, utilities of VGAM2319 include diagnosis, prevention and treatment of diseases and clinical conditions associated with TNFRSF11A. AFAP (Accession NM_021638) is another VGAM2319 host target gene. AFAP BINDING SITE is HOST TARGET binding site found in the 3' untranslated region of mRNA encoded by AFAP, corresponding to a HOST TARGET binding site such as BINDING SITE I, BINDING SITE II or BINDING SITE III. Table 2 illustrates the complementarity of the nucleotide sequences of AFAP BINDING SITE, designated SEQ ID:22293, to the nucleotide sequence of VGAM2319 RNA, herein designated VGAM RNA, also designated SEQ ID:5030.

Another function of VGAM2319 is therefore inhibition of AFAP (Accession NM_021638). Accordingly, utilities of VGAM2319 include diagnosis, prevention and treatment of diseases and clinical conditions associated with AFAP. LOC221362 (Accession XM_168093) is another VGAM2319 host target gene. LOC221362 BINDING SITE is HOST TARGET binding site found in the 3' untranslated region of mRNA encoded by LOC221362, corresponding to a HOST TARGET binding site such as BINDING SITE I, BINDING SITE II or BINDING SITE III. Table 2 illustrates the complementarity of the nucleotide sequences of LOC221362 BINDING SITE, designated SEQ ID:45022, to the nucleotide sequence of VGAM2319 RNA, herein designated VGAM RNA, also designated SEQ ID:5030.

Another function of VGAM2319 is therefore inhibition of LOC221362 (Accession XM_168093). Accordingly, utilities of VGAM2319 include diagnosis, prevention and treatment of diseases and clinical conditions associated with LOC221362. FIG. 1 further provides a conceptual description of a novel bioinformatically detected viral gene of the present invention, referred to here as Viral Genomic Address Messenger 2320 (VGAM2320) viral gene, which modulates expression of respective host target genes thereof, the function and utility of which host target genes is known in the art.

VGAM2320 is a novel bioinformatically detected regulatory, non protein coding, viral micro RNA (miRNA) gene. The method by which VGAM2320 was detected is described hereinabove with reference to FIGS. 1-8.

VGAM2320 gene, herein designated VGAM GENE, is a viral gene contained in the genome of Rana Tigrina Ranavirus. VGAM2320 host target gene, herein designated VGAM HOST TARGET GENE, is a human gene contained in the human genome.

VGAM2320 gene encodes a VGAM2320 precursor RNA, herein designated VGAM PRECURSOR RNA. Similar to other miRNA genes, and unlike most ordinary genes, VGAM2320 precursor RNA does not encode a protein. A nucleotide sequence identical or highly similar to the nucleotide sequence of VGAM2320 precursor RNA is designated SEQ ID:2306, and is provided hereinbelow with reference to the sequence listing part. Nucleotide sequence SEQ ID:2306 is located at position 28526 relative to the genome of Rana Tigrina Ranavirus.

VGAM2320 precursor RNA folds onto itself, forming VGAM2320 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2320 folded precursor RNA into VGAM2320 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM2320 RNA is designated SEQ ID:5031, and is provided hereinbelow with reference to the sequence listing part.

VGAM2320 host target gene, herein designated VGAM HOST TARGET GENE, encodes a corresponding messenger RNA, VGAM2320 host target RNA, herein designated VGAM HOST TARGET RNA. VGAM2320 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2320 RNA, herein designated VGAM RNA, binds complementarily to one or more host target binding sites located in untranslated regions of VGAM2320 host target RNA, herein designated VGAM HOST TARGET RNA. This complementary binding is due to the fact that the nucleotide sequence of VGAM2320 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2320 RNA, herein designated VGAM RNA, may have a different number of host target binding sites in untranslated regions of a VGAM2320 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2320 RNA, herein designated VGAM RNA, to host target binding sites on VGAM2320 host target RNA, herein designated VGAM HOST TARGET RNA, such as BINDING SITE I, BINDING SITE II and BINDING SITE III, inhibits translation of VGAM2320 host target RNA into VGAM2320 host target protein, herein designated VGAM HOST TARGET PROTEIN. VGAM host target protein is therefore outlined by a broken line.

It is appreciated that VGAM2320 host target gene, herein designated VGAM HOST TARGET GENE, in fact represents a plurality of VGAM2320 host target genes. The mRNA of each one of this plurality of VGAM2320 host target genes comprises one or more host target binding sites, each having a nucleotide sequence which is at least partly complementary to VGAM2320 RNA, herein designated VGAM RNA, and which when bound by VGAM2320 RNA causes inhibition of translation of respective one or more VGAM2320 host target proteins.

It is further appreciated by one skilled in the art that the mode of translational inhibition illustrated by FIG. 1 with specific reference to translational inhibition exerted by VGAM2320 gene, herein designated VGAM GENE, on one or more VGAM2320 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2320 is inhibition of expression of host target genes, as part of a novel viral mechanism of attacking a host. Accordingly, utilities of VGAM2320 include diagnosis, prevention and treatment of viral infection by Rana Tigrina Ranavirus. Specific functions, and accordingly utilities, of VGAM2320 correlate with, and may be deduced from, the identity of the host target genes which VGAM2320 binds and inhibits, and the function of these host target genes, as elaborated hereinbelow.

Nucleotide sequences of the VGAM2320 precursor RNA, herein designated VGAM PRECURSOR RNA, and of the 'diced' VGAM2320 RNA, herein designated VGAM RNA, and a schematic representation of the secondary folding of VGAM2320 folded precursor RNA, herein designated VGAM FOLDED PRECURSOR RNA, of VGAM2320 are further described hereinbelow with reference to Table 1.

Nucleotide sequences of host target binding sites, such as BINDING SITE-I, BINDING SITE-II and BINDING SITE-III of FIG. 1, found on VGAM2320 host target RNA, and schematic representation of the complementarity of each of these host target binding sites to VGAM2320 RNA, herein designated VGAM RNA, are described hereinbelow with reference to Table 2.

As mentioned hereinabove with reference to FIG. 1, a function of VGAM2320 gene, herein designated VGAM is inhibition of expression of VGAM2320 target genes. It is appreciated that specific functions, and accordingly utilities, of VGAM2320 correlate with, and may be deduced from, the identity of the target genes which VGAM2320 binds and inhibits, and the function of these target genes, as elaborated hereinbelow.

DEK Oncogene (DNA binding) (DEK, Accession NM_003472) is a VGAM2320 host target gene. DEK BINDING SITE is HOST TARGET binding site found in the 3' untranslated region of mRNA encoded by DEK, corresponding to a HOST TARGET binding site such as BINDING SITE I, BINDING SITE II or BINDING SITE III. Table 2 illustrates the complementarity of the nucleotide sequences of DEK BINDING SITE, designated SEQ ID:9537, to the nucleotide sequence of VGAM2320 RNA, herein designated VGAM RNA, also designated SEQ ID:5031.

A function of VGAM2320 is therefore inhibition of DEK Oncogene (DNA binding) (DEK, Accession NM_003472), a gene which interacts in transcriptional regulation and signal transduction. Accordingly, utilities of VGAM2320 include diagnosis, prevention and treatment of diseases and clinical conditions associated with DEK. The function of DEK and its association with various diseases and clinical conditions, has been established by previous studies, as described hereinabove with reference to VGAM795. Hemochromatosis (HFE, Accession NM_139004) is another VGAM2320 host target gene. HFE BINDING SITE1 through HFE BINDING SITE6 are HOST TARGET binding sites found in untranslated regions of mRNA encoded by HFE, corresponding to HOST TARGET binding sites such as BINDING SITE I, BINDING SITE II or BINDING SITE III. Table 2 illustrates the complementarity of the nucleotide sequences of HFE BINDING SITE1 through HFE BINDING SITE6, designated SEQ ID:29098, SEQ ID:29100, SEQ ID:29101, SEQ ID:29102, SEQ ID:29103 and SEQ ID:5984 respectively, to the nucleotide sequence of VGAM2320 RNA, herein designated VGAM RNA, also designated SEQ ID:5031.

Another function of VGAM2320 is therefore inhibition of Hemochromatosis (HFE, Accession NM_139004). Accordingly, utilities of VGAM2320 include diagnosis, prevention and treatment of diseases and clinical conditions associated with HFE. Presenilin 1 (Alzheimer disease 3) (PSEN1, Accession NM_000021) is another VGAM2320 host target gene. PSEN1 BINDING SITE1 and PSEN1 BINDING SITE2 are HOST TARGET binding sites found in untranslated regions of mRNA encoded by PSEN1, corresponding to HOST TARGET binding sites such as BINDING SITE I, BINDING SITE II or BINDING SITE III. Table 2 illustrates the complementarity of the nucleotide sequences of PSEN1 BINDING SITE1 and PSEN1 BINDING SITE2, designated SEQ ID:5456 and SEQ ID:25335 respectively, to the nucleotide sequence of VGAM2320 RNA, herein designated VGAM RNA, also designated SEQ ID:5031.

Another function of VGAM2320 is therefore inhibition of Presenilin 1 (Alzheimer disease 3) (PSEN1, Accession NM_000021). Accordingly, utilities of VGAM2320 include diagnosis, prevention and treatment of diseases and clinical conditions associated with PSEN1. FLJ14640 (Accession NM_032816) is another VGAM2320 host target gene. FLJ14640 BINDING SITE is HOST TARGET binding site found in the 5' untranslated region of mRNA encoded by FLJ14640, corresponding to a HOST TARGET binding site such as BINDING SITE I, BINDING SITE II or BINDING SITE III. Table 2 illustrates the complementarity of the nucleotide sequences of FLJ14640 BINDING SITE, designated SEQ ID:26585, to the nucleotide sequence of VGAM2320 RNA, herein designated VGAM RNA, also designated SEQ ID:5031.

Another function of VGAM2320 is therefore inhibition of FLJ14640 (Accession NM_032816). Accordingly, utilities of VGAM2320 include diagnosis, prevention and treatment of diseases and clinical conditions associated with FLJ14640. FLJ22635 (Accession NM_025092) is another VGAM2320 host target gene. FLJ22635 BINDING SITE is HOST TARGET binding site found in the 3' untranslated region of mRNA encoded by FLJ22635, corresponding to a HOST TARGET binding site such as BINDING SITE I, BINDING SITE II or BINDING SITE III. Table 2 illustrates the complementarity of the nucleotide sequences of FLJ22635 BINDING SITE, designated SEQ ID:24715, to the nucleotide sequence of VGAM2320 RNA, herein designated VGAM RNA, also designated SEQ ID:5031.

Another function of VGAM2320 is therefore inhibition of FLJ22635 (Accession NM_025092). Accordingly, utilities of VGAM2320 include diagnosis, prevention and treatment of diseases and clinical conditions associated with FLJ22635. GABA(A) Receptor-associated Protein Like 1 (GABARAPL1, Accession NM_031412) is another VGAM2320 host target gene. GABARAPL1 BINDING SITE is HOST TARGET binding site found in the 3' untranslated region of mRNA encoded by GABARAPL1, corresponding to a HOST TARGET binding site such as BINDING SITE I, BINDING SITE II or BINDING SITE III. Table 2 illustrates the complementarity of the nucleotide sequences of GABARAPL1 BINDING SITE, designated SEQ ID:25389, to the nucleotide sequence of VGAM2320 RNA, herein designated VGAM RNA, also designated SEQ ID:5031.

Another function of VGAM2320 is therefore inhibition of GABA(A) Receptor-associated Protein Like 1 (GABARAPL1, Accession NM_031412). Accordingly, utilities of VGAM2320 include diagnosis, prevention and treatment of diseases and clinical conditions associated with GABARAPL1. KIAA0441 (Accession NM_014797) is another VGAM2320 host target gene. KIAA0441 BINDING SITE is HOST TARGET binding site found in the 3" untranslated region of mRNA encoded by KIAA0441, corresponding to a HOST TARGET binding site such as BINDING SITE I, BINDING SITE II or BINDING SITE III. Table 2 illustrates the complementarity of the nucleotide sequences of KIAA0441 BINDING SITE, designated SEQ ID:16708, to the nucleotide sequence of VGAM2320 RNA, herein designated VGAM RNA, also designated SEQ ID:5031.

Another function of VGAM2320 is therefore inhibition of KIAA0441 (Accession NM_014797). Accordingly, utilities of VGAM2320 include diagnosis, prevention and treatment of diseases and clinical conditions associated with KIAA0441. KIAA0494 (Accession NM_014774) is another VGAM2320 host target gene. KIAA0494 BINDING SITE is HOST TARGET binding site found in the 3' untranslated region of mRNA encoded by KIAA0494, corresponding to a HOST TARGET binding site such as BINDING SITE I, BINDING SITE II or BINDING SITE III. Table 2 illustrates the complementarity of the nucleotide sequences of KIAA0494 BINDING SITE, designated SEQ ID:16587, to the nucleotide sequence of VGAM2320 RNA, herein designated VGAM RNA, also designated SEQ ID:5031.

Another function of VGAM2320 is therefore inhibition of KIAA0494 (Accession NM_014774). Accordingly, utilities of VGAM2320 include diagnosis, prevention and treatment of diseases and clinical conditions associated with KIAA0494. MGC27277 (Accession NM_144989) is another VGAM2320 host target gene. MGC27277 BINDING SITE is HOST TARGET binding site found in the 3' untranslated region of mRNA encoded by MGC27277, corresponding to a HOST TARGET binding site such as BINDING SITE I, BINDING SITE II or BINDING SITE III. Table 2 illustrates the complementarity of the nucleotide sequences of MGC27277 BINDING SITE, designated SEQ ID:29592, to the nucleotide sequence of VGAM2320 RNA, herein designated VGAM RNA, also designated SEQ ID:5031.

Another function of VGAM2320 is therefore inhibition of MGC27277 (Accession NM_144989). Accordingly, utilities of VGAM2320 include diagnosis, prevention and treatment of diseases and clinical conditions associated with MGC27277. LOC129530 (Accession XM_059362) is another VGAM2320 host target gene. LOC129530 BINDING SITE is HOST TARGET binding site found in the 5' untranslated region of mRNA encoded by LOC129530, corresponding to a HOST TARGET binding site such as BINDING SITE I, BINDING SITE II or BINDING SITE III. Table 2 illustrates the complementarity of the nucleotide sequences of LOC129530 BINDING SITE, designated SEQ ID:36971, to the nucleotide sequence of VGAM2320 RNA, herein designated VGAM RNA, also designated SEQ ID:5031.

Another function of VGAM2320 is therefore inhibition of LOC129530 (Accession XM_059362). Accordingly, utilities of VGAM2320 include diagnosis, prevention and treatment of diseases and clinical conditions associated with LOC129530. LOC145678 (Accession XM_096832) is another VGAM2320 host target gene. LOC145678 BINDING SITE is HOST TARGET binding site found in the 3' untranslated region of mRNA encoded by LOC145678, corresponding to a HOST TARGET binding site such as BINDING SITE I, BINDING SITE II or BINDING SITE III. Table 2 illustrates the complementarity of the nucleotide sequences of LOC145678 BINDING SITE, designated SEQ ID:40555, to the nucleotide sequence of VGAM2320 RNA, herein designated VGAM RNA, also designated SEQ ID:5031.

Another function of VGAM2320 is therefore inhibition of LOC145678 (Accession XM_096832). Accordingly, utilities of VGAM2320 include diagnosis, prevention and treatment of diseases and clinical conditions associated with LOC145678. FIG. 1 further provides a conceptual description of a novel bioinformatically detected viral gene of the present invention, referred to here as Viral Genomic Address Messenger 2321 (VGAM2321) viral gene, which modulates expression of respective host target genes thereof, the function and utility of which host target genes is known in the art.

VGAM2321 is a novel bioinformatically detected regulatory, non protein coding, viral micro RNA (miRNA) gene. The method by which VGAM2321 was detected is described hereinabove with reference to FIGS. 1-8.

VGAM2321 gene, herein designated VGAM GENE, is a viral gene contained in the genome of Rana Tigrina Ranavirus. VGAM2321 host target gene, herein designated VGAM HOST TARGET GENE, is a human gene contained in the human genome.

VGAM2321 gene encodes a VGAM2321 precursor RNA, herein designated VGAM PRECURSOR RNA. Similar to other miRNA genes, and unlike most ordinary genes, VGAM2321 precursor RNA does not encode a protein. A nucleotide sequence identical or highly similar to the nucleotide sequence of VGAM2321 precursor RNA is designated SEQ ID:2307, and is provided hereinbelow with reference to the sequence listing part. Nucleotide sequence SEQ ID:2307 is located at position 24842 relative to the genome of Rana Tigrina Ranavirus.

VGAM2321 precursor RNA folds onto itself, forming VGAM2321 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2321 folded precursor RNA into VGAM2321 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2321 RNA is designated SEQ ID:5032, and is provided hereinbelow with reference to the sequence listing part.

VGAM2321 host target gene, herein designated VGAM HOST TARGET GENE, encodes a corresponding messenger RNA, VGAM2321 host target RNA, herein designated VGAM HOST TARGET RNA. VGAM2321 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2321 RNA, herein designated VGAM RNA, binds complementarily to one or more host target binding sites located in untranslated regions of VGAM2321 host target RNA, herein designated VGAM HOST TARGET RNA. This complementary binding is due to the fact that the nucleotide sequence of VGAM2321 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2321 RNA, herein designated VGAM RNA, may have a different number of host target binding sites in untranslated regions of a VGAM2321 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2321 RNA, herein designated VGAM RNA, to host target binding sites on VGAM2321 host target RNA, herein designated VGAM HOST TARGET RNA, such as BINDING SITE I, BINDING SITE II and BINDING SITE III, inhibits translation of VGAM2321 host target RNA into VGAM2321 host target protein, herein designated VGAM HOST TARGET PROTEIN. VGAM host target protein is therefore outlined by a broken line.

It is appreciated that VGAM2321 host target gene, herein designated VGAM HOST TARGET GENE, in fact represents a plurality of VGAM2321 host target genes. The mRNA of each one of this plurality of VGAM2321 host target genes comprises one or more host target binding sites, each having a nucleotide sequence which is at least partly complementary to VGAM2321 RNA, herein designated VGAM RNA, and which when bound by VGAM2321 RNA causes inhibition of translation of respective one or more VGAM2321 host target proteins.

It is further appreciated by one skilled in the art that the mode of translational inhibition illustrated by FIG. 1 with specific reference to translational inhibition exerted by VGAM2321 gene, herein designated VGAM GENE, on one or more VGAM2321 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2321 is inhibition of expression of host target genes, as part of a novel viral mechanism of attacking a host. Accordingly, utilities of VGAM2321 include diagnosis, prevention and treatment of viral infection by Rana Tigrina Ranavirus. Specific functions, and accordingly utilities, of VGAM2321 correlate with, and may be deduced from, the identity of the host target genes which VGAM2321 binds and inhibits, and the function of these host target genes, as elaborated hereinbelow.

Nucleotide sequences of the VGAM2321 precursor RNA, herein designated VGAM PRECURSOR RNA, and of the 'diced' VGAM2321 RNA, herein designated VGAM RNA, and a schematic representation of the secondary folding of VGAM2321 folded precursor RNA, herein designated VGAM FOLDED PRECURSOR RNA, of VGAM2321 are further described hereinbelow with reference to Table 1.

Nucleotide sequences of host target binding sites, such as BINDING SITE-I, BINDING SITE-II and BINDING SITE-III of FIG. 1, found on VGAM2321 host target RNA, and schematic representation of the complementarity of each of these host target binding sites to VGAM2321 RNA, herein designated VGAM RNA, are described hereinbelow with reference to Table 2.

As mentioned hereinabove with reference to FIG. 1, a function of VGAM2321 gene, herein designated VGAM is inhibition of expression of VGAM2321 target genes. It is appreciated that specific functions, and accordingly utilities, of VGAM2321 correlate with, and may be deduced from, the identity of the target genes which VGAM2321 binds and inhibits, and the function of these target genes, as elaborated hereinbelow.

CD4 Antigen (p55) (CD4, Accession NM_000616) is a VGAM2321 host target gene. CD4 BINDING SITE is HOST TARGET binding site found in the 3' untranslated region of mRNA encoded by CD4, corresponding to a HOST TARGET binding site such as BINDING SITE I, BINDING SITE II or BINDING SITE III. Table 2 illustrates the complementarity of the nucleotide sequences of CD4 BINDING SITE, designated SEQ ID:6218, to the nucleotide sequence of VGAM2321 RNA, herein designated VGAM RNA, also designated SEQ ID:5032.

A function of VGAM2321 is therefore inhibition of CD4 Antigen (p55) (CD4, Accession NM_000616), a gene which is T-cell surface glycoprotein and has role in cell-cell interactions and may act in signal transduction. Accordingly, utilities of VGAM2321 include diagnosis, prevention and treatment of diseases and clinical conditions associated with CD4. The function of CD4 and its association with various diseases and clinical conditions, has been established by previous studies, as described hereinabove with reference to VGAM381. V-maf Musculoaponeurotic Fibrosarcoma Oncogene Homolog K (avian) (MAFK, Accession NM_002360) is another VGAM2321 host target gene. MAFK BINDING SITE is HOST TARGET binding site found in the 5' untranslated region of mRNA encoded by MAFK, corresponding to a HOST TARGET binding site such as BINDING SITE I, BINDING SITE II or BINDING SITE III. Table 2 illustrates the complementarity of the nucleotide sequences of MAFK BINDING SITE, designated SEQ ID:8172, to the nucleotide sequence of VGAM2321 RNA, herein designated VGAM RNA, also designated SEQ ID:5032.

Another function of VGAM2321 is therefore inhibition of V-maf Musculoaponeurotic Fibrosarcoma Oncogene Homolog K (avian) (MAFK, Accession NM_002360), a gene which is involved in regulation of transcription at NEF2 sites. Accordingly, utilities of VGAM2321 include diagnosis, prevention and treatment of diseases and clinical conditions associated with MAFK. The function of MAFK and its association with various diseases and clinical conditions, has been established by previous studies, as described hereinabove with reference to VGAM1505. Multiple Endocrine Neoplasia I (MEN1, Accession NM_130803) is another VGAM2321 host target gene. MEN1 BINDING SITE1 and MEN1 BINDING SITE2 are HOST TARGET binding sites found in untranslated regions of mRNA encoded by MEN1, corresponding to HOST TARGET binding sites such as BINDING SITE I, BINDING SITE II or BINDING SITE III. Table 2 illustrates the complementarity of the nucleotide sequences of MEN1 BINDING SITE1 and MEN1 BINDING SITE2, designated SEQ ID:28298 and SEQ ID:28302 respectively, to the nucleotide sequence of VGAM2321 RNA, herein designated VGAM RNA, also designated SEQ ID:5032.

Another function of VGAM2321 is therefore inhibition of Multiple Endocrine Neoplasia I (MEN1, Accession NM_130803). Accordingly, utilities of VGAM2321 include diagnosis, prevention and treatment of diseases and clinical conditions associated with MEN1. Usher Syndrome 3A (USH3A, Accession NM_052995) is another VGAM2321 host target gene. USH3A BINDING SITE is HOST TARGET binding site found in the 5' untranslated region of mRNA encoded by USH3A, corresponding to a HOST TARGET binding site such as BINDING SITE I, BINDING SITE II or BINDING SITE III. Table 2 illustrates the complementarity of the nucleotide sequences of USH3A BINDING SITE, designated SEQ ID:27562, to the nucleotide sequence of VGAM2321 RNA, herein designated VGAM RNA, also designated SEQ ID:5032.

Another function of VGAM2321 is therefore inhibition of Usher Syndrome 3A (USH3A, Accession NM_052995). Accordingly, utilities of VGAM2321 include diagnosis, prevention and treatment of diseases and clinical conditions associated with USH3A. Glucocorticoid Modulatory Element Binding Protein 2 (GMEB2, Accession NM_012384) is another VGAM2321 host target gene. GMEB2 BINDING SITE is HOST TARGET binding site found in the 3' untranslated region of mRNA encoded by GMEB2, corresponding to a HOST TARGET binding site such as BINDING SITE I, BINDING SITE II or BINDING SITE III. Table 2 illustrates the complementarity of the nucleotide sequences of GMEB2 BINDING SITE, designated SEQ ID:14738, to the nucleotide sequence of VGAM2321 RNA, herein designated VGAM RNA, also designated SEQ ID:5032.

Another function of VGAM2321 is therefore inhibition of Glucocorticoid Modulatory Element Binding Protein 2 (GMEB2, Accession NM_012384). Accordingly, utilities of VGAM2321 include diagnosis, prevention and treatment of diseases and clinical conditions associated with GMEB2. R3H Domain (binds single-stranded nucleic acids) Containing (R3HDM, Accession NM_015361) is another VGAM2321 host target gene. R3HDM BINDING SITE is HOST TARGET binding site found in the 3' untranslated region of mRNA encoded by R3HDM, corresponding to a HOST TARGET binding site such as BINDING SITE I, BINDING SITE II or BINDING SITE III. Table 2 illustrates the complementarity of the nucleotide sequences of R3HDM BINDING SITE, designated SEQ ID:17662, to the nucleotide sequence of VGAM2321 RNA, herein designated VGAM RNA, also designated SEQ ID:5032.

Another function of VGAM2321 is therefore inhibition of R3H Domain (binds single-stranded nucleic acids) Containing (R3HDM, Accession NM_015361). Accordingly, utilities of VGAM2321 include diagnosis, prevention and treatment of diseases and clinical conditions associated with R3HDM. LOC145216 (Accession XM_096730) is another VGAM2321 host target gene. LOC145216 BINDING SITE is HOST TARGET binding site found in the 3' untranslated region of mRNA encoded by LOC145216, corresponding to a HOST TARGET binding site such as BINDING SITE I, BINDING SITE II or BINDING SITE III. Table 2 illustrates the complementarity of the nucleotide sequences of LOC145216 BINDING SITE, designated SEQ ID:40509, to the nucleotide sequence of VGAM2321 RNA, herein designated VGAM RNA, also designated SEQ ID:5032.

Another function of VGAM2321 is therefore inhibition of LOC145216 (Accession XM_096730). Accordingly, utilities of VGAM2321 include diagnosis, prevention and treatment of diseases and clinical conditions associated with LOC145216. LOC148697 (Accession XM_086276) is another VGAM2321 host target gene. LOC148697 BINDING SITE is HOST TARGET binding site found in the 3' untranslated region of mRNA encoded by LOC148697, corresponding to a HOST TARGET binding site such as BINDING SITE I, BINDING SITE II or BINDING SITE III. Table 2 illustrates the complementarity of the nucleotide sequences of LOC148697 BINDING SITE, designated SEQ ID:38572, to the nucleotide sequence of VGAM2321 RNA, herein designated VGAM RNA, also designated SEQ ID:5032.

Another function of VGAM2321 is therefore inhibition of LOC148697 (Accession XM_086276). Accordingly, utilities of VGAM2321 include diagnosis, prevention and treatment of diseases and clinical conditions associated with LOC148697. LOC152580 (Accession XM_098240) is another VGAM2321 host target gene. LOC152580 BINDING SITE is HOST TARGET binding site found in the 5' untranslated region of mRNA encoded by LOC152580, corresponding to a HOST TARGET binding site such as BINDING SITE I, BINDING SITE II or BINDING SITE III. Table 2 illustrates the complementarity of the nucleotide sequences of LOC152580 BINDING SITE, designated SEQ ID:41523, to the nucleotide sequence of VGAM2321 RNA, herein designated VGAM RNA, also designated SEQ ID:5032.

Another function of VGAM2321 is therefore inhibition of LOC152580 (Accession XM_098240). Accordingly, utilities of VGAM2321 include diagnosis, prevention and treatment of diseases and clinical conditions associated with LOC152580. LOC254431 (Accession XM_173024) is another VGAM2321 host target gene. LOC254431 BINDING SITE is HOST TARGET binding site found in the 3' untranslated region of mRNA encoded by LOC254431, corresponding to a HOST TARGET binding site such as BINDING SITE I, BINDING SITE II or BINDING SITE III. Table 2 illustrates the complementarity of the nucleotide sequences of LOC254431 BINDING SITE, designated SEQ ID:46292, to the nucleotide sequence of VGAM2321 RNA, herein designated VGAM RNA, also designated SEQ ID:5032.

Another function of VGAM2321 is therefore inhibition of LOC254431 (Accession XM_173024). Accordingly, utilities of VGAM2321 include diagnosis, prevention and treatment of diseases and clinical conditions associated with LOC254431. FIG. 1 further provides a conceptual description of a novel bioinformatically detected viral gene of the present invention, referred to here as Viral Genomic Address Messenger 2322 (VGAM2322) viral gene, which modulates expression of respective host target genes thereof, the function and utility of which host target genes is known in the art.

VGAM2322 is a novel bioinformatically detected regulatory, non protein coding, viral micro RNA (miRNA) gene. The method by which VGAM2322 was detected is described hereinabove with reference to FIGS. 1-8.

VGAM2322 gene, herein designated VGAM GENE, is a viral gene contained in the genome of Rana Tigrina Ranavirus. VGAM2322 host target gene, herein designated VGAM HOST TARGET GENE, is a human gene contained in the human genome.

VGAM2322 gene encodes a VGAM2322 precursor RNA, herein designated VGAM PRECURSOR RNA. Similar to other miRNA genes, and unlike most ordinary genes, VGAM2322 precursor RNA does not encode a protein. A nucleotide sequence identical or highly similar to the nucleotide sequence of VGAM2322 precursor RNA is designated SEQ ID:2308, and is provided hereinbelow with reference to the sequence listing part. Nucleotide sequence SEQ ID:2308 is located at position 49980 relative to the genome of Rana Tigrina Ranavirus.

VGAM2322 precursor RNA folds onto itself, forming VGAM2322 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2322 folded precursor RNA into VGAM2322 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2322 RNA is designated SEQ ID:5033, and is provided hereinbelow with reference to the sequence listing part.

VGAM2322 host target gene, herein designated VGAM HOST TARGET GENE, encodes a corresponding messenger RNA, VGAM2322 host target RNA, herein designated VGAM HOST TARGET RNA. VGAM2322 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2322 RNA, herein designated VGAM RNA, binds complementarily to one or more host target binding sites located in untranslated regions of VGAM2322 host target RNA, herein designated VGAM HOST TARGET RNA. This complementary binding is due to the fact that the nucleotide sequence of VGAM2322 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2322 RNA, herein designated VGAM RNA, may have a different number of host target binding sites in untranslated regions of a VGAM2322 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2322 RNA, herein designated VGAM RNA, to host target binding sites on VGAM2322 host target RNA, herein designated VGAM HOST TARGET RNA, such as BINDING SITE I, BINDING SITE II and BINDING SITE III, inhibits translation of VGAM2322 host target RNA into VGAM2322 host target protein, herein designated VGAM HOST TARGET PROTEIN. VGAM host target protein is therefore outlined by a broken line.

It is appreciated that VGAM2322 host target gene, herein designated VGAM HOST TARGET GENE, in fact represents a plurality of VGAM2322 host target genes. The mRNA of each one of this plurality of VGAM2322 host target genes comprises one or more host target binding sites, each having a nucleotide sequence which is at least partly complementary to VGAM2322 RNA, herein designated VGAM RNA, and which when bound by VGAM2322 RNA causes inhibition of translation of respective one or more VGAM2322 host target proteins.

It is further appreciated by one skilled in the art that the mode of translational inhibition illustrated by FIG. 1 with specific reference to translational inhibition exerted by VGAM2322 gene, herein designated VGAM GENE, on one or more VGAM2322 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2322 is inhibition of expression of host target genes, as part of a novel viral mechanism of attacking a host. Accordingly, utilities of VGAM2322 include diagnosis, prevention and treatment of viral infection by Rana Tigrina Ranavirus. Specific functions, and accordingly utilities, of VGAM2322 correlate with, and may be deduced from, the identity of the host target genes which VGAM2322 binds and inhibits, and the function of these host target genes, as elaborated hereinbelow.

Nucleotide sequences of the VGAM2322 precursor RNA, herein designated VGAM PRECURSOR RNA, and of the 'diced' VGAM2322 RNA, herein designated VGAM RNA, and a schematic representation of the secondary folding of VGAM2322 folded precursor RNA, herein designated VGAM FOLDED PRECURSOR RNA, of VGAM2322 are further described hereinbelow with reference to Table 1.

Nucleotide sequences of host target binding sites, such as BINDING SITE-I, BINDING SITE-II and BINDING SITE-III of FIG. 1, found on VGAM2322 host target RNA, and schematic representation of the complementarity of each of these host target binding sites to VGAM2322 RNA, herein designated VGAM RNA, are described hereinbelow with reference to Table 2.

As mentioned hereinabove with reference to FIG. 1, a function of VGAM2322 gene, herein designated VGAM is inhibition of expression of VGAM2322 target genes. It is appreciated that specific functions, and accordingly utilities, of VGAM2322 correlate with, and may be deduced from, the identity of the target genes which VGAM2322 binds and inhibits, and the function of these target genes, as elaborated hereinbelow.

APG5 Autophagy 5-like (S. cerevisiae) (APG5L, Accession NM_004849) is a VGAM2322 host target gene. APG5L BINDING SITE is HOST TARGET binding site found in the 3' untranslated region of mRNA encoded by APG5L, corresponding to a HOST TARGET binding site such as BINDING SITE I, BINDING SITE II or BINDING SITE III. Table 2 illustrates the complementarity of the nucleotide sequences of APG5L BINDING SITE, designated SEQ ID:11261, to the nucleotide sequence of VGAM2322 RNA, herein designated VGAM RNA, also designated SEQ ID:5033.

A function of VGAM2322 is therefore inhibition of APG5 Autophagy 5-like (S. cerevisiae) (APG5L, Accession NM_004849), a gene which conjugates to apg12 and associates with isolation membrane to form cup-shaped isolation membrane and autophagosome. Accordingly, utilities of VGAM2322 include diagnosis, prevention and treatment of diseases and clinical conditions associated with APG5L. The function of APG5L and its association with various diseases and clinical conditions, has been established by previous studies, as described hereinabove with reference to VGAM492. UDP-Gal:betaGlcNAc Beta 1,4- Galactosyltransferase, Polypeptide 5 (B4GALT5, Accession NM_004776) is another VGAM2322 host target gene. B4GALT5 BINDING SITE is HOST TARGET binding site found in the 3' untranslated region of mRNA encoded by B4GALT5, corresponding to a HOST TARGET binding site such as BINDING SITE I, BINDING SITE II or BINDING SITE III. Table 2 illustrates the complementarity of the nucleotide sequences of B4GALT5 BINDING SITE, designated SEQ ID:11171, to the nucleotide sequence of VGAM2322 RNA, herein designated VGAM RNA, also designated SEQ ID:5033.

Another function of VGAM2322 is therefore inhibition of UDP-Gal:betaGlcNAc Beta 1,4-Galactosyltransferase, Polypeptide 5 (B4GALT5, Accession NM_004776). Accordingly, utilities of VGAM2322 include diagnosis, prevention and treatment of diseases and clinical conditions associated with B4GALT5. Early Growth Response 2 (Krox-20 homolog, Drosophila) (EGR2, Accession NM_000399) is another VGAM2322 host target gene. EGR2 BINDING SITE is HOST TARGET binding site found in the 3' untranslated region of mRNA encoded by EGR2, corresponding to a HOST TARGET binding site such as BINDING SITE I, BINDING SITE II or BINDING SITE III. Table 2 illustrates the complementarity of the nucleotide sequences of EGR2 BINDING SITE, designated SEQ ID:5970, to the nucleotide sequence of VGAM2322 RNA, herein designated VGAM RNA, also designated SEQ ID:5033.

Another function of VGAM2322 is therefore inhibition of Early Growth Response 2 (Krox-20 homolog, Drosophila) (EGR2, Accession NM_000399), a gene which binds to two specific dna sites located in the promoter region of hox-1.4. Accordingly, utilities of VGAM2322 include diagnosis, prevention and treatment of diseases and clinical conditions associated with EGR2. The function of EGR2 and its association with various diseases and clinical conditions, has been established by previous studies, as described hereinabove with reference to VGAM234. FUS1 (Accession NM_007275) is another VGAM2322 host target gene. FUS1 BINDING SITE is HOST TARGET binding site found in the 3' untranslated region of mRNA encoded by FUS1, corresponding to a HOST TARGET binding site such as BINDING SITE I, BINDING SITE II or BINDING SITE III. Table 2 illustrates the complementarity of the nucleotide sequences of FUS1 BINDING SITE, designated SEQ ID:14136, to the nucleotide sequence of VGAM2322 RNA, herein designated VGAM RNA, also designated SEQ ID:5033.

Another function of VGAM2322 is therefore inhibition of FUS1 (Accession NM_007275), a gene which may function as a tumor suppressor. Accordingly, utilities of VGAM2322 include diagnosis, prevention and treatment of diseases and clinical conditions associated with FUS1. The function of FUS1 and its association with various diseases and clinical conditions, has been established by previous studies, as described hereinabove with reference to VGAM1246. Potassium Channel, Subfamily K, Member 4 (KCNK4, Accession NM_033310) is another VGAM2322 host target gene. KCNK4 BINDING SITE is HOST TARGET binding site found in the 5' untranslated region of mRNA encoded by KCNK4, corresponding to a HOST TARGET binding site such as BINDING SITE I, BINDING SITE II or BINDING SITE III. Table 2 illustrates the complementarity of the nucleotide sequences of KCNK4 BINDING SITE, designated SEQ ID:27150, to the nucleotide sequence of VGAM2322 RNA, herein designated VGAM RNA, also designated SEQ ID:5033.

Another function of VGAM2322 is therefore inhibition of Potassium Channel, Subfamily K, Member 4 (KCNK4, Accession NM_033310). Accordingly, utilities of VGAM2322 include diagnosis, prevention and treatment of diseases and clinical conditions associated with KCNK4. MUS81 (Accession NM_025128) is another VGAM2322 host target gene. MUS81 BINDING SITE is HOST TARGET binding site found in the 5' untranslated region of mRNA encoded by MUS81, corresponding to a HOST TARGET binding site such as BINDING SITE I, BINDING SITE II or BINDING SITE III. Table 2 illustrates the complementarity of the nucleotide sequences of MUS81 BINDING SITE, designated SEQ ID:24771, to the nucleotide sequence of VGAM2322 RNA, herein designated VGAM RNA, also designated SEQ ID:5033.

Another function of VGAM2322 is therefore inhibition of MUS81 (Accession NM_025128). Accordingly, utilities of VGAM2322 include diagnosis, prevention and treatment of diseases and clinical conditions associated with MUS81. Nijmegen Breakage Syndrome 1 (nibrin) (NBS1, Accession XM_045343) is another VGAM2322 host target gene. NBS1 BINDING SITE is HOST TARGET binding site found in the 3' untranslated region of mRNA encoded by NBS1, corresponding to a HOST TARGET binding site such as BINDING SITE I, BINDING SITE II or BINDING SITE III. Table 2 illustrates the complementarity of the nucleotide sequences of NBS1 BINDING SITE, designated SEQ ID:34437, to the nucleotide sequence of VGAM2322 RNA, herein designated VGAM RNA, also designated SEQ ID:5033.

Another function of VGAM2322 is therefore inhibition of Nijmegen Breakage Syndrome 1 (nibrin) (NBS1, Accession XM_045343), a gene which may be involved in repair of DNA double-strand breaks. Accordingly, utilities of VGAM2322 include diagnosis, prevention and treatment of diseases and clinical conditions associated with NBS1. The function of NBS1 and its association with various diseases and clinical conditions, has been established by previous studies, as described hereinabove with reference to VGAM450. Numb Homolog (Drosophila) (NUMB, Accession NM_003744) is another VGAM2322 host target gene. NUMB BINDING SITE is HOST TARGET binding site found in the 3' untranslated region of mRNA encoded by NUMB, corresponding to a HOST TARGET binding site such as BINDING SITE I, BINDING SITE II or BINDING SITE III. Table 2 illustrates the complementarity of the nucleotide sequences of NUMB BINDING SITE, designated SEQ ID:9832, to the nucleotide sequence of VGAM2322 RNA, herein designated VGAM RNA, also designated SEQ ID:5033.

Another function of VGAM2322 is therefore inhibition of Numb Homolog (Drosophila) (NUMB, Accession NM_003744), a gene which may act in generating asymmetric cell division during neurogenesisand is strongly similar to murine Numb. Accordingly, utilities of VGAM2322 include diagnosis, prevention and treatment of diseases and clinical conditions associated with NUMB. The function of NUMB has been established by previous studies. During Drosophila neurogenesis, differential partitioning of the 'Numb' (dNumb) gene product is necessary for daughter cells to adopt distinct fates. Numb is thought to act by causing a bias in the cell-cell interaction mediated by Notch (see OMIM Ref. No. JAG2; 602570). Zhong et al. (1996) isolated cDNAs encoding mouse Numb (mNumb). The N-terminal region of the deduced 593-amino acid mouse protein contains a predicted phosphotyrosine-binding domain and shares 63% identity with dNumb. The C-terminal half shows little similarity with dNumb and includes a proline-rich segment with potential SH3-binding sites. Immunofluorescence experiments revealed that mNumb is asymmetrically localized to the apical membrane of dividing ventricular neural progenitors during mouse cortical neurogenesis. However, unlike dNumb, there was no correlation between cleavage planes and mNumb localization at the apical cell membrane in anaphase ventricular cells. Zhong et al. (1996) expressed mNumb in Drosophila embryos and found that it localized asymmetrically in dividing neural precursors and rescued the Numb mutant phenotype. Yeast 2-hybrid assays and in vitro binding experiments demonstrated that mNumb can physically interact with the intracellular domain of mouse Notch1 (OMIM Ref. No. 190198). The authors concluded that shared molecular mechanisms generate asymmetric cell divisions during neurogenesis of vertebrates and invertebrates. Salcini et al. (1997) reported that both the NUMB and NUMB-like (NUMBL; 604018) proteins bind to the EH protein-protein interaction domain found in EPS15 (OMIM Ref. No. 600051) and other proteins. Coimmunoprecipitation studies demonstrated that NUMB and EPS15 are associated in vivo. This association appears to be mediated by an interaction between the EH domain of EPS15 and an asn-pro-phe (NPF) motif located near the C terminus of NUMB.

Full details of the abovementioned studies are described in the following publications, the disclosure of which are hereby incorporated by reference:

Salcini, A. E.; Confalonieri, S.; Doria, M.; Santolini, E.; Tassi, E.; Minenkova, O.; Cesareni, G.; Pelicci, P. G.; Di Fiore, P. P.: Binding specificity and in vivo targets of the EH domain, a novel protein-protein interaction module. Genes Dev. 11:2239-2249, 1997; and Zhong, W.; Feder, J. N.; Jiang, M.-M.; Jan, L. Y.; Jan, Y. N.: Asymmetric localization of a mammalian Numb homolog during mouse cortical neurogenesis. Neuron 17:43-53, 1996.

Further studies establishing the function and utilities of NUMB are found in John Hopkins OMIM database record ID 603728, and in sited publications numbered 7012-5839 listed in the bibliography section hereinbelow, which are also hereby incorporated by reference. Oligophrenin 1 (OPHN1, Accession NM_002547) is another VGAM2322 host target gene. OPHN1 BINDING SITE is HOST TARGET binding site found in the 3' untranslated region of mRNA encoded by OPHN1, corresponding to a HOST TARGET binding site such as BINDING SITE I, BINDING SITE II or BINDING SITE III. Table 2 illustrates the complementarity of the nucleotide sequences of OPHN1 BINDING SITE, designated SEQ ID:8398, to the nucleotide sequence of VGAM2322 RNA, herein designated VGAM RNA, also designated SEQ ID:5033.

Another function of VGAM2322 is therefore inhibition of Oligophrenin 1 (OPHN1, Accession NM_002547). Accordingly, utilities of VGAM2322 include diagnosis, prevention and treatment of diseases and clinical conditions associated with OPHN1. Protein Kinase C, Mu (PRKCM, Accession NM_002742) is another VGAM2322 host target gene. PRKCM BINDING SITE is HOST TARGET binding site found in the 3' untranslated region of mRNA encoded by PRKCM, corresponding to a HOST TARGET binding site such as BINDING SITE I, BINDING SITE II or BINDING SITE III. Table 2 illustrates the complementarity of the nucleotide sequences of PRKCM BINDING SITE, designated SEQ ID:8613, to the nucleotide sequence of VGAM2322 RNA, herein designated VGAM RNA, also designated SEQ ID:5033.

Another function of VGAM2322 is therefore inhibition of Protein Kinase C, Mu (PRKCM, Accession NM_002742). Accordingly, utilities of VGAM2322 include diagnosis, prevention and treatment of diseases and clinical conditions associated with PRKCM. Retinoid X Receptor, Alpha (RXRA, Accession NM_002957) is another VGAM2322 host target gene. RXRA BINDING SITE is HOST TARGET binding site found in the 3' untranslated region of mRNA encoded by RXRA, corresponding to a HOST TARGET binding site such as BINDING SITE I, BINDING SITE II or BINDING SITE III. Table 2 illustrates the complementarity of the nucleotide sequences of RXRA BINDING SITE, designated SEQ ID:8868, to the nucleotide sequence of VGAM2322 RNA, herein designated VGAM RNA, also designated SEQ ID:5033.

Another function of VGAM2322 is therefore inhibition of Retinoid X Receptor, Alpha (RXRA, Accession NM_002957), a gene which activates genes required for vitamin A metabolism, binds 9-cis retinoic acid. Accordingly, utilities of VGAM2322 include diagnosis, prevention and treatment of diseases and clinical conditions associated with RXRA. The function of RXRA and its association with various diseases and clinical conditions, has been established by previous studies, as described hereinabove with reference to VGAM349. SIP (Accession NM_014412) is another VGAM2322 host target gene. SIP BINDING SITE is HOST TARGET binding site found in the 3' untranslated region of mRNA encoded by SIP, corresponding to a HOST TARGET binding site such as BINDING SITE I, BINDING SITE II or BINDING SITE III. Table 2 illustrates the complementarity of the nucleotide sequences of SIP BINDING SITE, designated SEQ ID:15756, to the nucleotide sequence of VGAM2322 RNA, herein designated VGAM RNA, also designated SEQ ID:5033.

Another function of VGAM2322 is therefore inhibition of SIP (Accession NM_014412). Accordingly, utilities of VGAM2322 include diagnosis, prevention and treatment of diseases and clinical conditions associated with SIP. Zinc-fingers and Homeoboxes 1 (ZHX1, Accession NM_007222) is another VGAM2322 host target gene. ZHX1 BINDING SITE is HOST TARGET binding site found in the 3' untranslated region of mRNA encoded by ZHX1, corresponding to a HOST TARGET binding site such as BINDING SITE I, BINDING SITE II or BINDING SITE III. Table 2 illustrates the complementarity of the nucleotide sequences of ZHX1 BINDING SITE, designated SEQ ID:14090, to the nucleotide sequence of VGAM2322 RNA, herein designated VGAM RNA, also designated SEQ ID:5033.

Another function of VGAM2322 is therefore inhibition of Zinc-fingers and Homeoboxes 1 (ZHX1, Accession NM_007222). Accordingly, utilities of VGAM2322 include diagnosis, prevention and treatment of diseases and clinical conditions associated with ZHX1. FLJ20257 (Accession NM_019606) is another VGAM2322 host target gene. FLJ20257 BINDING SITE is HOST TARGET binding site found in the 3' untranslated region of mRNA encoded by FLJ20257, corresponding to a HOST TARGET binding site such as BINDING SITE I, BINDING SITE II or BINDING SITE III. Table 2 illustrates the complementarity of the nucleotide sequences of FLJ20257 BINDING SITE, designated SEQ ID:21219, to the nucleotide sequence of VGAM2322 RNA, herein designated VGAM RNA, also designated SEQ ID:5033.

Another function of VGAM2322 is therefore inhibition of FLJ20257 (Accession NM_019606). Accordingly, utilities of VGAM2322 include diagnosis, prevention and treatment of diseases and clinical conditions associated with FLJ20257. FLJ21865 (Accession NM_022759) is another VGAM2322 host target gene. FLJ21865 BINDING SITE is HOST TARGET binding site found in the 3' untranslated region of mRNA encoded by FLJ21865, corresponding to a HOST TARGET binding site such as BINDING SITE I, BINDING SITE II or BINDING SITE III. Table 2 illustrates the complementarity of the nucleotide sequences of FLJ21865 BINDING SITE, designated SEQ ID:22999, to the nucleotide sequence of VGAM2322 RNA, herein designated VGAM RNA, also designated SEQ ID:5033.

Another function of VGAM2322 is therefore inhibition of FLJ21865 (Accession NM_022759). Accordingly, utilities of VGAM2322 include diagnosis, prevention and treatment of diseases and clinical conditions associated with FLJ21865. FLJ22160 (Accession NM_024585) is another VGAM2322 host target gene. FLJ22160 BINDING SITE is HOST TARGET binding site found in the 3' untranslated region of mRNA encoded by FLJ22160, corresponding to a HOST TARGET binding site such as BINDING SITE I, BINDING SITE II or BINDING SITE III. Table 2 illustrates the complementarity of the nucleotide sequences of FLJ22160 BINDING SITE, designated SEQ ID:23821, to the nucleotide sequence of VGAM2322 RNA, herein designated VGAM RNA, also designated SEQ ID:5033.

Another function of VGAM2322 is therefore inhibition of FLJ22160 (Accession NM_024585). Accordingly, utilities of VGAM2322 include diagnosis, prevention and treatment of diseases and clinical conditions associated with FLJ22160. KIAA1328 (Accession XM_029429) is another VGAM2322 host target gene. KIAA1328 BINDING SITE is HOST TARGET binding site found in the 3' untranslated region of mRNA encoded by KIAA1328, corresponding to a HOST TARGET binding site such as BINDING SITE I, BINDING SITE II or BINDING SITE III. Table 2 illustrates the complementarity of the nucleotide sequences of KIAA1328 BINDING SITE, designated SEQ ID:30887, to the nucleotide sequence of VGAM2322 RNA, herein designated VGAM RNA, also designated SEQ ID:5033.

Another function of VGAM2322 is therefore inhibition of KIAA1328 (Accession XM_029429). Accordingly, utilities of VGAM2322 include diagnosis, prevention and treatment of diseases and clinical conditions associated with KIAA1328. KIAA1354 (Accession XM_027604) is another VGAM2322 host target gene. KIAA1354 BINDING SITE is HOST TARGET binding site found in the 3' untranslated region of mRNA encoded by KIAA1354, corresponding to a HOST TARGET binding site such as BINDING SITE I, BINDING SITE II or BINDING SITE III. Table 2 illustrates the complementarity of the nucleotide sequences of KIAA1354 BINDING SITE, designated SEQ ID:30539, to the nucleotide sequence of VGAM2322 RNA, herein designated VGAM RNA, also designated SEQ ID:5033.

Another function of VGAM2322 is therefore inhibition of KIAA1354 (Accession XM_027604). Accordingly, utilities of VGAM2322 include diagnosis, prevention and treatment of diseases and clinical conditions associated with KIAA1354. KIAA1554 (Accession XM_170834) is another VGAM2322 host target gene. KIAA1554 BINDING SITE is HOST TARGET binding site found in the 3' untranslated region of mRNA encoded by KIAA1554, corresponding to a HOST TARGET binding site such as BINDING SITE I, BINDING SITE II or BINDING SITE III. Table 2 illustrates the complementarity of the nucleotide sequences of KIAA1554 BINDING SITE, designated SEQ ID:45611, to the nucleotide sequence of VGAM2322 RNA, herein designated VGAM RNA, also designated SEQ ID:5033.

Another function of VGAM2322 is therefore inhibition of KIAA1554 (Accession XM_170834). Accordingly, utilities of VGAM2322 include diagnosis, prevention and treatment of diseases and clinical conditions associated with KIAA1554. OS4 (Accession NM_005730) is another VGAM2322 host target gene. OS4 BINDING SITE is HOST TARGET binding site found in the 3' untranslated region of mRNA encoded by OS4, corresponding to a HOST TARGET binding site such as BINDING SITE I, BINDING SITE II or BINDING SITE III. Table 2 illustrates the complementarity of the nucleotide sequences of OS4 BINDING SITE, designated SEQ ID:12288, to the nucleotide sequence of VGAM2322 RNA, herein designated VGAM RNA, also designated SEQ ID:5033.

Another function of VGAM2322 is therefore inhibition of OS4 (Accession NM_005730). Accordingly, utilities of VGAM2322 include diagnosis, prevention and treatment of diseases and clinical conditions associated with OS4. Oxysterol Binding Protein-like 3 (OSBPL3, Accession NM_015550) is another VGAM2322 host target gene. OSBPL3 BINDING SITE is HOST TARGET binding site found in the 3' untranslated region of mRNA encoded by OSBPL3, corresponding to a HOST TARGET binding site such as BINDING SITE I, BINDING SITE II or BINDING SITE III. Table 2 illustrates the complementarity of the nucleotide sequences of OSBPL3 BINDING SITE, designated SEQ ID:17812, to the nucleotide sequence of VGAM2322 RNA, herein designated VGAM RNA, also designated SEQ ID:5033.

Another function of VGAM2322 is therefore inhibition of Oxysterol Binding Protein-like 3 (OSBPL3, Accession NM_015550). Accordingly, utilities of VGAM2322 include diagnosis, prevention and treatment of diseases and clinical conditions associated with OSBPL3. PRO0365 (Accession NM_014126) is another VGAM2322 host target gene. PRO0365 BINDING SITE is HOST TARGET binding site found in the 5' untranslated region of mRNA encoded by PRO0365, corresponding to a HOST TARGET binding site such as BINDING SITE I, BINDING SITE II or BINDING SITE III. Table 2 illustrates the complementarity of the nucleotide sequences of PRO0365 BINDING SITE, designated SEQ ID:15384, to the nucleotide sequence of VGAM2322 RNA, herein designated VGAM RNA, also designated SEQ ID:5033.

Another function of VGAM2322 is therefore inhibition of PRO0365 (Accession NM_014126). Accordingly, utilities of VGAM2322 include diagnosis, prevention and treatment of diseases and clinical conditions associated with PRO0365. RAB20, Member RAS Oncogene Family (RAB20, Accession NM_017817) is another VGAM2322 host target gene. RAB20 BINDING SITE is HOST TARGET binding site found in the 3' untranslated region of mRNA encoded by RAB20, corresponding to a HOST TARGET binding site such as BINDING SITE I, BINDING SITE II or BINDING SITE III. Table 2 illustrates the complementarity of the nucleotide sequences of RAB20 BINDING SITE, designated SEQ ID:19465, to the nucleotide sequence of VGAM2322 RNA, herein designated VGAM RNA, also designated SEQ ID:5033.

Another function of VGAM2322 is therefore inhibition of RAB20, Member RAS Oncogene Family (RAB20, Accession NM_017817). Accordingly, utilities of VGAM2322 include diagnosis, prevention and treatment of diseases and clinical conditions associated with RAB20. TRIP-Br2 (Accession NM_014755) is another VGAM2322 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16480, to the nucleotide sequence of VGAM2322 RNA, herein designated VGAM RNA, also designated SEQ ID:5033.

Another function of VGAM2322 is therefore inhibition of TRIP-Br2 (Accession NM_014755). Accordingly, utilities of VGAM2322 include diagnosis, prevention and treatment of diseases and clinical conditions associated with TRIP-Br2. LOC118978 (Accession XM_071677) is another VGAM2322 host target gene. LOC118978 BINDING SITE is HOST TARGET binding site found in the 5' untranslated region of mRNA encoded by LOC118978, corresponding to a HOST TARGET binding site such as BINDING SITE I, BINDING SITE II or BINDING SITE III. Table 2 illustrates the complementarity of the nucleotide sequences of LOC118978 BINDING SITE, designated SEQ ID:37412, to the nucleotide sequence of VGAM2322 RNA, herein designated VGAM RNA, also designated SEQ ID:5033.

Another function of VGAM2322 is therefore inhibition of LOC118978 (Accession XM_071677). Accordingly, utilities of VGAM2322 include diagnosis, prevention and treatment of diseases and clinical conditions associated with LOC118978. LOC159110 (Accession XM_088753) is another VGAM2322 host target gene. LOC159110 BINDING SITE is HOST TARGET binding site found in the 3' untranslated region of mRNA encoded by LOC159110, corresponding to a HOST TARGET binding site such as BINDING SITE I, BINDING SITE II or BINDING SITE III. Table 2 illustrates the complementarity of the nucleotide sequences of LOC159110 BINDING SITE, designated SEQ ID:39943, to the nucleotide sequence of VGAM2322 RNA, herein designated VGAM RNA, also designated SEQ ID:5033.

Another function of VGAM2322 is therefore inhibition of LOC159110 (Accession XM_088753). Accordingly, utilities of VGAM2322 include diagnosis, prevention and treatment of diseases and clinical conditions associated with LOC159110. LOC159116 (Accession XM_088752) is another VGAM2322 host target gene. LOC159116 BINDING SITE is HOST TARGET binding site found in the 3' untranslated region of mRNA encoded by LOC159116, corresponding to a HOST TARGET binding site such as BINDING SITE I, BINDING SITE II or BINDING SITE III. Table 2 illustrates the complementarity of the nucleotide sequences of LOC159116 BINDING SITE, designated SEQ ID:39941, to the nucleotide sequence of VGAM2322 RNA, herein designated VGAM RNA, also designated SEQ ID:5033.

Another function of VGAM2322 is therefore inhibition of LOC159116 (Accession XM_088752). Accordingly, utilities of VGAM2322 include diagnosis, prevention and treatment of diseases and clinical conditions associated with LOC159116. LOC203221 (Accession XM_116795) is another VGAM2322 host target gene. LOC203221 BINDING SITE is HOST TARGET binding site found in the 5' untranslated region of mRNA encoded by LOC203221, corresponding to a HOST TARGET binding site such as BINDING SITE I, BINDING SITE II or BINDING SITE III. Table 2 illustrates the complementarity of the nucleotide sequences of LOC203221 BINDING SITE, designated SEQ ID:43126, to the nucleotide sequence of VGAM2322 RNA, herein designated VGAM RNA, also designated SEQ ID:5033.

Another function of VGAM2322 is therefore inhibition of LOC203221 (Accession XM_116795). Accordingly, utilities of VGAM2322 include diagnosis, prevention and treatment of diseases and clinical conditions associated with LOC203221. LOC90844 (Accession XM_034434) is another VGAM2322 host target gene. LOC90844 BINDING SITE is HOST TARGET binding site found in the 3' untranslated region of mRNA encoded by LOC90844, corresponding to a HOST TARGET binding site such as BINDING SITE I, BINDING SITE II or BINDING SITE III. Table 2 illustrates the complementarity of the nucleotide sequences of LOC90844 BINDING SITE, designated SEQ ID:32118, to the nucleotide sequence of VGAM2322 RNA, herein designated VGAM RNA, also designated SEQ ID:5033.

Another function of VGAM2322 is therefore inhibition of LOC90844 (Accession XM_034434). Accordingly, utilities of VGAM2322 include diagnosis, prevention and treatment of diseases and clinical conditions associated with LOC90844. FIG. 1 further provides a conceptual description of a novel bioinformatically detected viral gene of the present invention, referred to here as Viral Genomic Address Messenger 2323 (VGAM2323) viral gene, which modulates expression of respective host target genes thereof, the function and utility of which host target genes is known in the art.

VGAM2323 is a novel bioinformatically detected regulatory, non protein coding, viral micro RNA (miRNA) gene. The method by which VGAM2323 was detected is described hereinabove with reference to FIGS. 1-8.

VGAM2323 gene, herein designated VGAM GENE, is a viral gene contained in the genome of Rana Tigrina Ranavirus. VGAM2323 host target gene, herein designated VGAM HOST TARGET GENE, is a human gene contained in the human genome.

VGAM2323 gene encodes a VGAM2323 precursor RNA, herein designated VGAM PRECURSOR RNA. Similar to other miRNA genes, and unlike most ordinary genes, VGAM2323 precursor RNA does not encode a protein. A nucleotide sequence identical or highly similar to the nucleotide sequence of VGAM2323 precursor RNA is designated SEQ ID:2309, and is provided hereinbelow with reference to the sequence listing part. Nucleotide sequence SEQ ID:2309 is located at position 27691 relative to the genome of Rana Tigrina Ranavirus.

VGAM2323 precursor RNA folds onto itself, forming VGAM2323 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2323 folded precursor RNA into VGAM2323 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2323 RNA is designated SEQ ID:5034, and is provided hereinbelow with reference to the sequence listing part.

VGAM2323 host target gene, herein designated VGAM HOST TARGET GENE, encodes a corresponding messenger RNA, VGAM2323 host target RNA, herein designated VGAM HOST TARGET RNA. VGAM2323 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2323 RNA, herein designated VGAM RNA, binds complementarily to one or more host target binding sites located in untranslated regions of VGAM2323 host target RNA, herein designated VGAM HOST TARGET RNA. This complementary binding is due to the fact that the nucleotide sequence of VGAM2323 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2323 RNA, herein designated VGAM RNA, may have a different number of host target binding sites in untranslated regions of a VGAM2323 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2323 RNA, herein designated VGAM RNA, to host target binding sites on VGAM2323 host target RNA, herein designated VGAM HOST TARGET RNA, such as BINDING SITE I, BINDING SITE II and BINDING SITE III, inhibits translation of VGAM2323 host target RNA into VGAM2323 host target protein, herein designated VGAM HOST TARGET PROTEIN. VGAM host target protein is therefore outlined by a broken line.

It is appreciated that VGAM2323 host target gene, herein designated VGAM HOST TARGET GENE, in fact represents a plurality of VGAM2323 host target genes. The mRNA of each one of this plurality of VGAM2323 host target genes comprises one or more host target binding sites, each having a nucleotide sequence which is at least partly complementary to VGAM2323 RNA, herein designated VGAM RNA, and which when bound by VGAM2323 RNA causes inhibition of translation of respective one or more VGAM2323 host target proteins.

It is further appreciated by one skilled in the art that the mode of translational inhibition illustrated by FIG. 1 with specific reference to translational inhibition exerted by VGAM2323 gene, herein designated VGAM GENE, on one or more VGAM2323 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2323 is inhibition of expression of host target genes, as part of a novel viral mechanism of attacking a host. Accordingly, utilities of VGAM2323 include diagnosis, prevention and treatment of viral infection by Rana Tigrina Ranavirus. Specific functions, and accordingly utilities, of VGAM2323 correlate with, and may be deduced from, the identity of the host target genes which VGAM2323 binds and inhibits, and the function of these host target genes, as elaborated hereinbelow.

Nucleotide sequences of the VGAM2323 precursor RNA, herein designated VGAM PRECURSOR RNA, and of the 'diced' VGAM2323 RNA, herein designated VGAM RNA, and a schematic representation of the secondary folding of VGAM2323 folded precursor RNA, herein designated VGAM FOLDED PRECURSOR RNA, of VGAM2323 are further described hereinbelow with reference to Table 1.

Nucleotide sequences of host target binding sites, such as BINDING SITE-I, BINDING SITE-II and BINDING SITE-III of FIG. 1, found on VGAM2323 host target RNA, and schematic representation of the complementarity of each of these host target binding sites to VGAM2323 RNA, herein designated VGAM RNA, are described hereinbelow with reference to Table 2.

As mentioned hereinabove with reference to FIG. 1, a function of VGAM2323 gene, herein designated VGAM is inhibition of expression of VGAM2323 target genes. It is appreciated that specific functions, and accordingly utilities, of VGAM2323 correlate with, and may be deduced from, the identity of the target genes which VGAM2323 binds and inhibits, and the function of these target genes, as elaborated hereinbelow.

KIAA0620 (Accession XM_030707) is a VGAM2323 host target gene. KIAA0620 BINDING SITE is HOST TARGET binding site found in the 3' untranslated region of mRNA encoded by KIAA0620, corresponding to a HOST TARGET binding site such as BINDING SITE I, BINDING SITE II or BINDING SITE III. Table 2 illustrates the complementarity of the nucleotide sequences of KIAA0620 BINDING SITE, designated SEQ ID:31120, to the nucleotide sequence of VGAM2323 RNA, herein designated VGAM RNA, also designated SEQ ID:5034.

A function of VGAM2323 is therefore inhibition of KIAA0620 (Accession XM_030707). Accordingly, utilities of VGAM2323 include diagnosis, prevention and treatment of diseases and clinical conditions associated with KIAA0620. KIAA1023 (Accession NM_017604) is another VGAM2323 host target gene. KIAA1023 BINDING SITE is HOST TARGET binding site found in the 3' untranslated region of mRNA encoded by KIAA1023, corresponding to a HOST TARGET binding site such as BINDING SITE I, BINDING SITE II or BINDING SITE III. Table 2 illustrates the complementarity of the nucleotide sequences of KIAA1023 BINDING SITE, designated SEQ ID:19087, to the nucleotide sequence of VGAM2323 RNA, herein designated VGAM RNA, also designated SEQ ID:5034.

Another function of VGAM2323 is therefore inhibition of KIAA1023 (Accession NM_017604). Accordingly, utilities of VGAM2323 include diagnosis, prevention and treatment of diseases and clinical conditions associated with KIAA1023. LOC127534 (Accession XM_060532) is another VGAM2323 host target gene. LOC127534 BINDING SITE is HOST TARGET binding site found in the 3' untranslated region of mRNA encoded by LOC127534, corresponding to a HOST TARGET binding site such as BINDING SITE I, BINDING SITE II or BINDING SITE III. Table 2 illustrates the complementarity of the nucleotide sequences of LOC127534 BINDING SITE, designated SEQ ID:37164, to the nucleotide sequence of VGAM2323 RNA, herein designated VGAM RNA, also designated SEQ ID:5034.

Another function of VGAM2323 is therefore inhibition of LOC127534 (Accession XM_060532). Accordingly, utilities of VGAM2323 include diagnosis, prevention and treatment of diseases and clinical conditions associated with LOC127534. LOC155179 (Accession XM_088169) is another VGAM2323 host target gene. LOC155179 BINDING SITE is HOST TARGET binding site found in the 3' untranslated region of mRNA encoded by LOC155179, corresponding to a HOST TARGET binding site such as BINDING SITE I, BINDING SITE II or BINDING SITE III. Table 2 illustrates the complementarity of the nucleotide sequences of LOC155179 BINDING SITE, designated SEQ ID:39554, to the nucleotide sequence of VGAM2323 RNA, herein designated VGAM RNA, also designated SEQ ID:5034.

Another function of VGAM2323 is therefore inhibition of LOC155179 (Accession XM_088169). Accordingly, utilities of VGAM2323 include diagnosis, prevention and treatment of diseases and clinical conditions associated with LOC155179. FIG. 1 further provides a conceptual description of a novel bioinformatically detected viral gene of the present invention, referred to here as Viral Genomic Address Messenger 2324 (VGAM2324) viral gene, which modulates expression of respective host target genes thereof, the function and utility of which host target genes is known in the art.

VGAM2324 is a novel bioinformatically detected regulatory, non protein coding, viral micro RNA (miRNA) gene. The method by which VGAM2324 was detected is described hereinabove with reference to FIGS. 1-8.

VGAM2324 gene, herein designated VGAM GENE, is a viral gene contained in the genome of Rana Tigrina Ranavirus. VGAM2324 host target gene, herein designated VGAM HOST TARGET GENE, is a human gene contained in the human genome.

VGAM2324 gene encodes a VGAM2324 precursor RNA, herein designated VGAM PRECURSOR RNA. Similar to other miRNA genes, and unlike most ordinary genes, VGAM2324 precursor RNA does not encode a protein. A nucleotide sequence identical or highly similar to the nucleotide sequence of VGAM2324 precursor RNA is designated SEQ ID:2310, and is provided hereinbelow with reference to the sequence listing part. Nucleotide sequence SEQ ID:2310 is located at position 26882 relative to the genome of Rana Tigrina Ranavirus.

VGAM2324 precursor RNA folds onto itself, forming VGAM2324 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2324 folded precursor RNA into VGAM2324 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2324 RNA is designated SEQ ID:5035, and is provided hereinbelow with reference to the sequence listing part.

VGAM2324 host target gene, herein designated VGAM HOST TARGET GENE, encodes a corresponding messenger RNA, VGAM2324 host target RNA, herein designated VGAM HOST TARGET RNA. VGAM2324 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2324 RNA, herein designated VGAM RNA, binds complementarily to one or more host target binding sites located in untranslated regions of VGAM2324 host target RNA, herein designated VGAM HOST TARGET RNA. This complementary binding is due to the fact that the nucleotide sequence of VGAM2324 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2324 RNA, herein designated VGAM RNA, may have a different number of host target binding sites in untranslated regions of a VGAM2324 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2324 RNA, herein designated VGAM RNA, to host target binding sites on VGAM2324 host target RNA, herein designated VGAM HOST TARGET RNA, such as BINDING SITE I, BINDING SITE II and BINDING SITE III, inhibits translation of VGAM2324 host target RNA into VGAM2324 host target protein, herein designated VGAM HOST TARGET PROTEIN. VGAM host target protein is therefore outlined by a broken line.

It is appreciated that VGAM2324 host target gene, herein designated VGAM HOST TARGET GENE, in fact represents a plurality of VGAM2324 host target genes. The mRNA of each one of this plurality of VGAM2324 host target genes comprises one or more host target binding sites, each having a nucleotide sequence which is at least partly complementary to VGAM2324 RNA, herein designated VGAM RNA, and which when bound by VGAM2324 RNA causes inhibition of translation of respective one or more VGAM2324 host target proteins.

It is further appreciated by one skilled in the art that the mode of translational inhibition illustrated by FIG. 1 with specific reference to translational inhibition exerted by VGAM2324 gene, herein designated VGAM GENE, on one or more VGAM2324 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2324 is inhibition of expression of host target genes, as part of a novel viral mechanism of attacking a host. Accordingly, utilities of VGAM2324 include diagnosis, prevention and treatment of viral infection by Rana Tigrina Ranavirus. Specific functions, and accordingly utilities, of VGAM2324 correlate with, and may be deduced from, the identity of the host target genes which VGAM2324 binds and inhibits, and the function of these host target genes, as elaborated hereinbelow.

Nucleotide sequences of the VGAM2324 precursor RNA, herein designated VGAM PRECURSOR RNA, and of the 'diced' VGAM2324 RNA, herein designated VGAM RNA, and a schematic representation of the secondary folding of VGAM2324 folded precursor RNA, herein designated VGAM FOLDED PRECURSOR RNA, of VGAM2324 are further described hereinbelow with reference to Table 1.

Nucleotide sequences of host target binding sites, such as BINDING SITE-I, BINDING SITE-II and BINDING SITE-III of FIG. 1, found on VGAM2324 host target RNA, and schematic representation of the complementarity of each of these host target binding sites to VGAM2324 RNA, herein designated VGAM RNA, are described hereinbelow with reference to Table 2.

As mentioned hereinabove with reference to FIG. 1, a function of VGAM2324 gene, herein designated VGAM is inhibition of expression of VGAM2324 target genes. It is appreciated that specific functions, and accordingly utilities, of VGAM2324 correlate with, and may be deduced from, the identity of the target genes which VGAM2324 binds and inhibits, and the function of these target genes, as elaborated hereinbelow.

FLJ20298 (Accession NM_017752) is a VGAM2324 host target gene. FLJ20298 BINDING SITE is HOST TARGET binding site found in the 3' untranslated region of mRNA encoded by FLJ20298, corresponding to a HOST TARGET binding site such as BINDING SITE I, BINDING SITE II or BINDING SITE III. Table 2 illustrates the complementarity of the nucleotide sequences of FLJ20298 BINDING SITE, designated SEQ ID:19363, to the nucleotide sequence of VGAM2324 RNA, herein designated VGAM RNA, also designated SEQ ID:5035.

A function of VGAM2324 is therefore inhibition of FLJ20298 (Accession NM_017752). Accordingly, utilities of VGAM2324 include diagnosis, prevention and treatment of diseases and clinical conditions associated with FLJ20298. LOC152445 (Accession XM_098231) is another VGAM2324 host target gene. LOC152445 BINDING SITE is HOST TARGET binding site found in the 5' untranslated region of mRNA encoded by LOC152445, corresponding to a HOST TARGET binding site such as BINDING SITE I, BINDING SITE II or BINDING SITE III. Table 2 illustrates the complementarity of the nucleotide sequences of LOC152445 BINDING SITE, designated SEQ ID:41508, to the nucleotide sequence of VGAM2324 RNA, herein designated VGAM RNA, also designated SEQ ID:5035.

Another function of VGAM2324 is therefore inhibition of LOC152445 (Accession XM_098231). Accordingly, utilities of VGAM2324 include diagnosis, prevention and treatment of diseases and clinical conditions associated with LOC152445. FIG. 1 further provides a conceptual description of a novel bioinformatically detected viral gene of the present invention, referred to here as Viral Genomic Address Messenger 2325 (VGAM2325) viral gene, which modulates expression of respective host target genes thereof, the function and utility of which host target genes is known in the art.

VGAM2325 is a novel bioinformatically detected regulatory, non protein coding, viral micro RNA (miRNA) gene. The method by which VGAM2325 was detected is described hereinabove with reference to FIGS. 1-8.

VGAM2325 gene, herein designated VGAM GENE, is a viral gene contained in the genome of Rana Tigrina Ranavirus. VGAM2325 host target gene, herein designated VGAM HOST TARGET GENE, is a human gene contained in the human genome.

VGAM2325 gene encodes a VGAM2325 precursor RNA, herein designated VGAM PRECURSOR RNA. Similar to other miRNA genes, and unlike most ordinary genes, VGAM2325 precursor RNA does not encode a protein. A nucleotide sequence identical or highly similar to the nucleotide sequence of VGAM2325 precursor RNA is designated SEQ ID:2311, and is provided hereinbelow with reference to the sequence listing part. Nucleotide sequence SEQ ID:2311 is located at position 28131 relative to the genome of Rana Tigrina Ranavirus.

VGAM2325 precursor RNA folds onto itself, forming VGAM2325 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2325 folded precursor RNA into VGAM2325 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM2325 RNA is designated SEQ ID:5036, and is provided hereinbelow with reference to the sequence listing part.

VGAM2325 host target gene, herein designated VGAM HOST TARGET GENE, encodes a corresponding messenger RNA, VGAM2325 host target RNA, herein designated VGAM HOST TARGET RNA. VGAM2325 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2325 RNA, herein designated VGAM RNA, binds complementarily to one or more host target binding sites located in untranslated regions of VGAM2325 host target RNA, herein designated VGAM HOST TARGET RNA. This complementary binding is due to the fact that the nucleotide sequence of VGAM2325 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2325 RNA, herein designated VGAM RNA, may have a different number of host target binding sites in untranslated regions of a VGAM2325 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2325 RNA, herein designated VGAM RNA, to host target binding sites on VGAM2325 host target RNA, herein designated VGAM HOST TARGET RNA, such as BINDING SITE I, BINDING SITE II and BINDING SITE III, inhibits translation of VGAM2325 host target RNA into VGAM2325 host target protein, herein designated VGAM HOST TARGET PROTEIN. VGAM host target protein is therefore outlined by a broken line.

It is appreciated that VGAM2325 host target gene, herein designated VGAM HOST TARGET GENE, in fact represents a plurality of VGAM2325 host target genes. The mRNA of each one of this plurality of VGAM2325 host target genes comprises one or more host target binding sites, each having a nucleotide sequence which is at least partly complementary to VGAM2325 RNA, herein designated VGAM RNA, and which when bound by VGAM2325 RNA causes inhibition of translation of respective one or more VGAM2325 host target proteins.

It is further appreciated by one skilled in the art that the mode of translational inhibition illustrated by FIG. 1 with specific reference to translational inhibition exerted by VGAM2325 gene, herein designated VGAM GENE, on one or more VGAM2325 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2325 is inhibition of expression of host target genes, as part of a novel viral mechanism of attacking a host. Accordingly, utilities of VGAM2325 include diagnosis, prevention and treatment of viral infection by Rana Tigrina Ranavirus. Specific functions, and accordingly utilities, of VGAM2325 correlate with, and may be deduced from, the identity of the host target genes which VGAM2325 binds and inhibits, and the function of these host target genes, as elaborated hereinbelow.

Nucleotide sequences of the VGAM2325 precursor RNA, herein designated VGAM PRECURSOR RNA, and of the 'diced' VGAM2325 RNA, herein designated VGAM RNA, and a schematic representation of the secondary folding of VGAM2325 folded precursor RNA, herein designated VGAM FOLDED PRECURSOR RNA, of VGAM2325 are further described hereinbelow with reference to Table 1.

Nucleotide sequences of host target binding sites, such as BINDING SITE-I, BINDING SITE-II and BINDING SITE-III of FIG. 1, found on VGAM2325 host target RNA, and schematic representation of the complementarity of each of these host target binding sites to VGAM2325 RNA, herein designated VGAM RNA, are described hereinbelow with reference to Table 2.

As mentioned hereinabove with reference to FIG. 1, a function of VGAM2325 gene, herein designated VGAM is inhibition of expression of VGAM2325 target genes. It is appreciated that specific functions, and accordingly utilities, of VGAM2325 correlate with, and may be deduced from, the identity of the target genes which VGAM2325 binds and inhibits, and the function of these target genes, as elaborated hereinbelow.

BCLG (Accession NM_030766) is a VGAM2325 host target gene. BCLG BINDING SITE1 through BCLG BINDING SITE3 are HOST TARGET binding sites found in untranslated regions of mRNA encoded by BCLG, corresponding to HOST TARGET binding sites such as BINDING SITE I, BINDING SITE II or BINDING SITE III. Table 2 illustrates the complementarity of the nucleotide sequences of BCLG BINDING SITE1 through BCLG BINDING SITE3, designated SEQ ID:25050, SEQ ID:28966 and SEQ ID:28968 respectively, to the nucleotide sequence of VGAM2325 RNA, herein designated VGAM RNA, also designated SEQ ID:5036.

A function of VGAM2325 is therefore inhibition of BCLG (Accession NM_030766). Accordingly, utilities of VGAM2325 include diagnosis, prevention and treatment of diseases and clinical conditions associated with BCLG. LIM Domain Binding 2 (LDB2, Accession NM_001290) is another VGAM2325 host target gene. LDB2 BINDING SITE is HOST TARGET binding site found in the 3' untranslated region of mRNA encoded by LDB2, corresponding to a HOST TARGET binding site such as BINDING SITE I, BINDING SITE II or BINDING SITE III. Table 2 illustrates the complementarity of the nucleotide sequences of LDB2 BINDING SITE, designated SEQ ID:6969, to the nucleotide sequence of VGAM2325 RNA, herein designated VGAM RNA, also designated SEQ ID:5036.

Another function of VGAM2325 is therefore inhibition of LIM Domain Binding 2 (LDB2, Accession NM_001290), a gene which physically interacts with the LIM domains of nuclear proteins. Accordingly, utilities of VGAM2325 include diagnosis, prevention and treatment of diseases and clinical conditions associated with LDB2. The function of LDB2 has been established by previous studies. Genes encoding LIM domain-binding factors were initially isolated in a screen for proteins that physically interact with the LIM domains of nuclear proteins. These proteins are capable of binding to a variety of transcription factors and are likely to function at enhancers to bring together diverse transcription factors and form higher order activation complexes or to block formation of such complexes (Jurata and Gill, 1997). The family of genes encoding LIM domain-binding factors includes 2 members isolated from the mouse, Clim1 (Bach et al., 1997) and Clim2/Lbd1/Nli (Agulnick et al., 1996; Jurata et al., 1996; Bach et al., 1997) and their homologs cloned from the frog, chicken, and fly. The fact that LIM domain-binding factors are likely to be involved in the coordination of the transcriptional activity of many diverse factors might implicate them in human phenotypes characterized by multiple affected sites. Semina et al. (1998) cloned the human genes CLIM1 and CLIM2 (OMIM Ref. No. 603451). They identified human sequences homologous to the mouse gene encoding Nli/Lbd1 in the EST database. Human sequences homologous to both Clim1 and Clim2 proteins were found. To obtain full-length cDNA clones for both genes, they screened a human craniofacial cDNA library with the corresponding human clones. The CLIM1 composite cDNA was found to be 2,351 bp long; the CLIM2 composite cDNA was found to be 1,953 bp long. The genes encode proteins of similar size, 373 and 375 amino acids, respectively. The proteins show a very high degree of identity with their homologs from other species as well as with each other. Using the Genebridge 4 radiation hybrid panel, Semina et al. (1998) mapped the CLIM1 and CLIM2 genes. CLIM1 was localized to 4p16-p15 and the map position was refined to 4p15 with a regional mapping panel for human chromosome 4. CLIM2 was localized to 10q24-q25; this region shares homology with the distal region of mouse chromosome 19, where the mouse gene Lbd1 was mapped by Yamashita et al. (1998).

Full details of the abovementioned studies are described in the following publications, the disclosure of which are hereby incorporated by reference:

Semina, E. V.; Altherr, M. R.; Murray, J. C.: Cloning and chromosomal localization of two novel human genes encoding LIM-domain binding factors CLIM1 and CLIM2/LDB1/NL1. Mammalian Genome 9:921-924, 1998; and Yamashita, T.; Agulnick, A. D.; Copeland, N. G.; Gilbert, D. J.; Jenkins, N. A.; Westphal, H.: Genomic structure and chromosomal localization of the mouse LIM domain-binding protein 1 g.

Further studies establishing the function and utilities of LDB2 are found in John Hopkins OMIM database record ID 603450, and in sited publications numbered 5977-5982 listed in the bibliography section hereinbelow, which are also hereby incorporated by reference. Podocalyxin-like (PODXL, Accession NM_005397) is another VGAM2325 host target gene. PODXL BINDING SITE is HOST TARGET binding site found in the 3' untranslated region of mRNA encoded by PODXL, corresponding to a HOST TARGET binding site such as BINDING SITE I, BINDING SITE II or BINDING SITE III. Table 2 illustrates the complementarity of the nucleotide sequences of PODXL BINDING SITE, designated SEQ ID:11872, to the nucleotide sequence of VGAM2325 RNA, herein designated VGAM RNA, also designated SEQ ID:5036.

Another function of VGAM2325 is therefore inhibition of Podocalyxin-like (PODXL, Accession NM_005397), a gene which is an antiadhesin. Accordingly, utilities of VGAM2325 include diagnosis, prevention and treatment of diseases and clinical conditions associated with PODXL. The function of PODXL and its association with various diseases and clinical conditions, has been established by previous studies, as described hereinabove with reference to VGAM247. TR2 (Accession XM_051264) is another VGAM2325 host target gene. TR2 BINDING SITE is HOST TARGET binding site found in the 3' untranslated region of mRNA encoded by TR2, corresponding to a HOST TARGET binding site such as BINDING SITE I, BINDING SITE II or BINDING SITE III. Table 2 illustrates the complementarity of the nucleotide sequences of TR2 BINDING SITE, designated SEQ ID:35793, to the nucleotide sequence of VGAM2325 RNA, herein designated VGAM RNA, also designated SEQ ID:5036.

Another function of VGAM2325 is therefore inhibition of TR2 (Accession XM_051264), a gene which maintains high levels of reduced glutathione in the cytosol (by similarity). Accordingly, utilities of VGAM2325 include diagnosis, prevention and treatment of diseases and clinical conditions associated with TR2. The function of TR2 and its association with various diseases and clinical conditions, has been established by previous studies, as described hereinabove with reference to VGAM125. Chromosome 20 Open Reading Frame 18 (C20orf18, Accession NM_031228) is another VGAM2325 host target gene. C20orf18 BINDING SITE is HOST TARGET binding site found in the 3' untranslated region of mRNA encoded by C20orf18, corresponding to a HOST TARGET binding site such as BINDING SITE I, BINDING SITE II or BINDING SITE III. Table 2 illustrates the complementarity of the nucleotide sequences of C20orf18 BINDING SITE, designated SEQ ID:25275, to the nucleotide sequence of VGAM2325 RNA, herein designated VGAM RNA, also designated SEQ ID:5036.

Another function of VGAM2325 is therefore inhibition of Chromosome 20 Open Reading Frame 18 (C20orf18, Accession NM_031228). Accordingly, utilities of VGAM2325 include diagnosis, prevention and treatment of diseases and clinical conditions associated with C20orf18. Dynactin 4 (p62) (DCTN4, Accession XM_041993) is another VGAM2325 host target gene. DCTN4 BINDING SITE is HOST TARGET binding site found in the 3' untranslated region of mRNA encoded by DCTN4, corresponding to a HOST TARGET binding site such as BINDING SITE I, BINDING SITE II or BINDING SITE III. Table 2 illustrates the complementarity of the nucleotide sequences of DCTN4 BINDING SITE, designated SEQ ID:33666, to the nucleotide sequence of VGAM2325 RNA, herein designated VGAM RNA, also designated SEQ ID:5036.

Another function of VGAM2325 is therefore inhibition of Dynactin 4 (p62) (DCTN4, Accession XM_041993). Accordingly, utilities of VGAM2325 include diagnosis, prevention and treatment of diseases and clinical conditions associated with DCTN4. KIAA1855 (Accession XM_166453) is another VGAM2325 host target gene. KIAA1855 BINDING SITE is HOST TARGET binding site found in the 3' untranslated region of mRNA encoded by KIAA1855, corresponding to a HOST TARGET binding site such as BINDING SITE I, BINDING SITE II or BINDING SITE III. Table 2 illustrates the complementarity of the nucleotide sequences of KIAA1855 BINDING SITE, designated SEQ ID:44353, to the nucleotide sequence of VGAM2325 RNA, herein designated VGAM RNA, also designated SEQ ID:5036.

Another function of VGAM2325 is therefore inhibition of KIAA1855 (Accession XM_166453). Accordingly, utilities of VGAM2325 include diagnosis, prevention and treatment of diseases and clinical conditions associated with KIAA1855. LOC158402 (Accession XM_098936) is another VGAM2325 host target gene. LOC158402 BINDING SITE is HOST TARGET binding site found in the 5' untranslated region of mRNA encoded by LOC158402, corresponding to a HOST TARGET binding site such as BINDING SITE I, BINDING SITE II or BINDING SITE III. Table 2 illustrates the complementarity of the nucleotide sequences of LOC158402 BINDING SITE, designated SEQ ID:41977, to the nucleotide sequence of VGAM2325 RNA, herein designated VGAM RNA, also designated SEQ ID:5036.

Another function of VGAM2325 is therefore inhibition of LOC158402 (Accession XM_098936). Accordingly, utilities of VGAM2325 include diagnosis, prevention and treatment of diseases and clinical conditions associated with LOC158402. LOC56963 (Accession XM_049372) is another VGAM2325 host target gene. LOC56963 BINDING SITE is HOST TARGET binding site found in the 3' untranslated region of mRNA encoded by LOC56963, corresponding to a HOST TARGET binding site such as BINDING SITE I, BINDING SITE II or BINDING SITE III. Table 2 illustrates the complementarity of the nucleotide sequences of LOC56963 BINDING SITE, designated SEQ ID:35400, to the nucleotide sequence of VGAM2325 RNA, herein designated VGAM RNA, also designated SEQ ID:5036.

Another function of VGAM2325 is therefore inhibition of LOC56963 (Accession XM_049372). Accordingly, utilities of VGAM2325 include diagnosis, prevention and treatment of diseases and clinical conditions associated with LOC56963. FIG. 1 further provides a conceptual description of a novel bioinformatically detected viral gene of the present invention, referred to here as Viral Genomic Address Messenger 2326 (VGAM2326) viral gene, which modulates expression of respective host target genes thereof, the function and utility of which host target genes is known in the art.

VGAM2326 is a novel bioinformatically detected regulatory, non protein coding, viral micro RNA (miRNA) gene. The method by which VGAM2326 was detected is described hereinabove with reference to FIGS. 1-8.

VGAM2326 gene, herein designated VGAM GENE, is a viral gene contained in the genome of Rana Tigrina Ranavirus. VGAM2326 host target gene, herein designated VGAM HOST TARGET GENE, is a human gene contained in the human genome.

VGAM2326 gene encodes a VGAM2326 precursor RNA, herein designated VGAM PRECURSOR RNA. Similar to other miRNA genes, and unlike most ordinary genes, VGAM2326 precursor RNA does not encode a protein. A nucleotide sequence identical or highly similar to the nucleotide sequence of VGAM2326 precursor RNA is designated SEQ ID:2312, and is provided hereinbelow with reference to the sequence listing part. Nucleotide sequence SEQ ID:2312 is located at position 37660 relative to the genome of Rana Tigrina Ranavirus.

VGAM2326 precursor RNA folds onto itself, forming VGAM2326 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2326 folded precursor RNA into VGAM2326 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2326 RNA is designated SEQ ID:5037, and is provided hereinbelow with reference to the sequence listing part.

VGAM2326 host target gene, herein designated VGAM HOST TARGET GENE, encodes a corresponding messenger RNA, VGAM2326 host target RNA, herein designated VGAM HOST TARGET RNA. VGAM2326 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2326 RNA, herein designated VGAM RNA, binds complementarily to one or more host target binding sites located in untranslated regions of VGAM2326 host target RNA, herein designated VGAM HOST TARGET RNA. This complementary binding is due to the fact that the nucleotide sequence of VGAM2326 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2326 RNA, herein designated VGAM RNA, may have a different number of host target binding sites in untranslated regions of a VGAM2326 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2326 RNA, herein designated VGAM RNA, to host target binding sites on VGAM2326 host target RNA, herein designated VGAM HOST TARGET RNA, such as BINDING SITE I, BINDING SITE II and BINDING SITE III, inhibits translation of VGAM2326 host target RNA into VGAM2326 host target protein, herein designated VGAM HOST TARGET PROTEIN. VGAM host target protein is therefore outlined by a broken line.

It is appreciated that VGAM2326 host target gene, herein designated VGAM HOST TARGET GENE, in fact represents a plurality of VGAM2326 host target genes. The mRNA of each one of this plurality of VGAM2326 host target genes comprises one or more host target binding sites, each having a nucleotide sequence which is at least partly complementary to VGAM2326 RNA, herein designated VGAM RNA, and which when bound by VGAM2326 RNA causes inhibition of translation of respective one or more VGAM2326 host target proteins.

It is further appreciated by one skilled in the art that the mode of translational inhibition illustrated by FIG. 1 with specific reference to translational inhibition exerted by VGAM2326 gene, herein designated VGAM GENE, on one or more VGAM2326 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2326 is inhibition of expression of host target genes, as part of a novel viral mechanism of attacking a host. Accordingly, utilities of VGAM2326 include diagnosis, prevention and treatment of viral infection by Rana Tigrina Ranavirus. Specific functions, and accordingly utilities, of VGAM2326 correlate with, and may be deduced from, the identity of the host target genes which VGAM2326 binds and inhibits, and the function of these host target genes, as elaborated hereinbelow.

Nucleotide sequences of the VGAM2326 precursor RNA, herein designated VGAM PRECURSOR RNA, and of the 'diced' VGAM2326 RNA, herein designated VGAM RNA, and a schematic representation of the secondary folding of VGAM2326 folded precursor RNA, herein designated VGAM FOLDED PRECURSOR RNA, of VGAM2326 are further described hereinbelow with reference to Table 1.

Nucleotide sequences of host target binding sites, such as BINDING SITE-I, BINDING SITE-II and BINDING SITE-III of FIG. 1, found on VGAM2326 host target RNA, and schematic representation of the complementarity of each of these host target binding sites to VGAM2326 RNA, herein designated VGAM RNA, are described hereinbelow with reference to Table 2.

As mentioned hereinabove with reference to FIG. 1, a function of VGAM2326 gene, herein designated VGAM is inhibition of expression of VGAM2326 target genes. It is appreciated that specific functions, and accordingly utilities, of VGAM2326 correlate with, and may be deduced from, the identity of the target genes which VGAM2326 binds and inhibits, and the function of these target genes, as elaborated hereinbelow.

B-cell CLL/lymphoma 6 (zinc finger protein 51) (BCL6, Accession NM_138931) is a VGAM2326 host target gene. BCL6 BINDING SITE is HOST TARGET binding site found in the 5' untranslated region of mRNA encoded by BCL6, corresponding to a HOST TARGET binding site such as BINDING SITE I, BINDING SITE II or BINDING SITE III. Table 2 illustrates the complementarity of the nucleotide sequences of BCL6 BINDING SITE, designated SEQ ID:29057, to the nucleotide sequence of VGAM2326 RNA, herein designated VGAM RNA, also designated SEQ ID:5037.

A function of VGAM2326 is therefore inhibition of B-cell CLL/lymphoma 6 (zinc finger protein 51) (BCL6, Accession NM_138931), a gene which is involved in the generation and maintenance of both T and B cells during immune responses. Accordingly, utilities of VGAM2326 include diagnosis, prevention and treatment of diseases and clinical conditions associated with BCL6. The function of BCL6 and its association with various diseases and clinical conditions, has been established by previous studies, as described hereinabove with reference to VGAM481. Staufen, RNA Binding Protein (Drosophila) (STAU, Accession NM_017454) is another VGAM2326 host target gene. STAU BINDING SITE1 through STAU BINDING SITE4 are HOST TARGET binding sites found in untranslated regions of mRNA encoded by STAU, corresponding to HOST TARGET binding sites such as BINDING SITE I, BINDING SITE II or BINDING SITE III. Table 2 illustrates the complementarity of the nucleotide sequences of STAU BINDING SITE1 through STAU BINDING SITE4, designated SEQ ID:18925, SEQ ID:10941, SEQ ID:18913 and SEQ ID:18919 respectively, to the nucleotide sequence of VGAM2326 RNA, herein designated VGAM RNA, also designated SEQ ID:5037.

Another function of VGAM2326 is therefore inhibition of Staufen, RNA Binding Protein (Drosophila) (STAU, Accession NM_017454), a gene which may play a role in specific positioning of mrnas at given sites in the cell and in stimulating their translation at the site. Accordingly, utilities of VGAM2326 include diagnosis, prevention and treatment of diseases and clinical conditions associated with STAU. The function of STAU and its association with various diseases and clinical conditions, has been established by previous studies, as described hereinabove with reference to VGAM916. Huntingtin-associated Protein Interacting Protein (duo) (HAPIP, Accession NM_003947) is another VGAM2326 host target gene. HAPIP BINDING SITE is HOST TARGET binding site found in the 3' untranslated region of mRNA encoded by HAPIP, corresponding to a HOST TARGET binding site such as BINDING SITE I, BINDING SITE II or BINDING SITE III. Table 2 illustrates the complementarity of the nucleotide sequences of HAPIP BINDING SITE, designated SEQ ID:10065, to the nucleotide sequence of VGAM2326 RNA, herein designated VGAM RNA, also designated SEQ ID:5037.

Another function of VGAM2326 is therefore inhibition of Huntingtin-associated Protein Interacting Protein (duo) (HAPIP, Accession NM_003947). Accordingly, utilities of VGAM2326 include diagnosis, prevention and treatment of diseases and clinical conditions associated with HAPIP. KIAA0092 (Accession NM_014679) is another VGAM2326 host target gene. KIAA0092 BINDING SITE is HOST TARGET binding site found in the 3' untranslated region of mRNA encoded by KIAA0092, corresponding to a HOST TARGET binding site such as BINDING SITE I, BINDING SITE II or BINDING SITE III. Table 2 illustrates the complementarity of the nucleotide sequences of KIAA0092 BINDING SITE, designated SEQ ID:16151, to the nucleotide sequence of VGAM2326 RNA, herein designated VGAM RNA, also designated SEQ ID:5037.

Another function of VGAM2326 is therefore inhibition of KIAA0092 (Accession NM_014679). Accordingly, utilities of VGAM2326 include diagnosis, prevention and treatment of diseases and clinical conditions associated with KIAA0092. KIAA0217 (Accession XM_040265) is another VGAM2326 host target gene. KIAA0217 BINDING SITE is HOST TARGET binding site found in the 3' untranslated region of mRNA encoded by KIAA0217, corresponding to a HOST TARGET binding site such as BINDING SITE I, BINDING SITE II or BINDING SITE III. Table 2 illustrates the complementarity of the nucleotide sequences of KIAA0217 BINDING SITE, designated SEQ ID:33282, to the nucleotide sequence of VGAM2326 RNA, herein designated VGAM RNA, also designated SEQ ID:5037.

Another function of VGAM2326 is therefore inhibition of KIAA0217 (Accession XM_040265). Accordingly, utilities of VGAM2326 include diagnosis, prevention and treatment of diseases and clinical conditions associated with KIAA0217. LIM Domain Kinase 2 (LIMK2, Accession NM_016733) is another VGAM2326 host target gene. LIMK2 BINDING SITE1 and LIMK2 BINDING SITE2 are HOST TARGET binding sites found in untranslated regions of mRNA encoded by LIMK2, corresponding to HOST TARGET binding sites such as BINDING SITE I, BINDING SITE II or BINDING SITE III. Table 2 illustrates the complementarity of the nucleotide sequences of LIMK2 BINDING SITE1 and LIMK2 BINDING SITE2, designated SEQ ID:18785 and SEQ ID:12095 respectively, to the nucleotide sequence of VGAM2326 RNA, herein designated VGAM RNA, also designated SEQ ID:5037.

Another function of VGAM2326 is therefore inhibition of LIM Domain Kinase 2 (LIMK2, Accession NM_016733). Accordingly, utilities of VGAM2326 include diagnosis, prevention and treatment of diseases and clinical conditions associated with LIMK2. LOC150225 (Accession XM_097870) is another VGAM2326 host target gene. LOC150225 BINDING SITE is HOST TARGET binding site found in the 3' untranslated region of mRNA encoded by LOC150225, corresponding to a HOST TARGET binding site such as BINDING SITE I, BINDING SITE II or BINDING SITE III. Table 2 illustrates the complementarity of the nucleotide sequences of LOC150225 BINDING SITE, designated SEQ ID:41185, to the nucleotide sequence of VGAM2326 RNA, herein designated VGAM RNA, also designated SEQ ID:5037.

Another function of VGAM2326 is therefore inhibition of LOC150225 (Accession XM_097870). Accordingly, utilities of VGAM2326 include diagnosis, prevention and treatment of diseases and clinical conditions associated with LOC150225. LOC158191 (Accession XM_088505) is another VGAM2326 host target gene. LOC158191 BINDING SITE is HOST TARGET binding site found in the 5' untranslated region of mRNA encoded by LOC158191, corresponding to a HOST TARGET binding site such as BINDING SITE I, BINDING SITE II or BINDING SITE III. Table 2 illustrates the complementarity of the nucleotide sequences of LOC158191 BINDING SITE, designated SEQ ID:39757, to the nucleotide sequence of VGAM2326 RNA, herein designated VGAM RNA, also designated SEQ ID:5037.

Another function of VGAM2326 is therefore inhibition of LOC158191 (Accession XM_088505). Accordingly, utilities of VGAM2326 include diagnosis, prevention and treatment of diseases and clinical conditions associated with LOC158191. LOC196446 (Accession XM_113722) is another VGAM2326 host target gene. LOC196446 BINDING SITE is HOST TARGET binding site found in the 3' untranslated region of mRNA encoded by LOC196446, corresponding to a HOST TARGET binding site such as BINDING SITE I, BINDING SITE II or BINDING SITE III. Table 2 illustrates the complementarity of the nucleotide sequences of LOC196446 BINDING SITE, designated SEQ ID:42372, to the nucleotide sequence of VGAM2326 RNA, herein designated VGAM RNA, also designated SEQ ID:5037.

Another function of VGAM2326 is therefore inhibition of LOC196446 (Accession XM_113722). Accordingly, utilities of VGAM2326 include diagnosis, prevention and treatment of diseases and clinical conditions associated with LOC196446. LOC222182 (Accession XM_168471) is another VGAM2326 host target gene. LOC222182 BINDING SITE is HOST TARGET binding site found in the 3' untranslated region of mRNA encoded by LOC222182, corresponding to a HOST TARGET binding site such as BINDING SITE I, BINDING SITE II or BINDING SITE III. Table 2 illustrates the complementarity of the nucleotide sequences of LOC222182 BINDING SITE, designated SEQ ID:45195, to the nucleotide sequence of VGAM2326 RNA, herein designated VGAM RNA, also designated SEQ ID:5037.

Another function of VGAM2326 is therefore inhibition of LOC222182 (Accession XM_168471). Accordingly, utilities of VGAM2326 include diagnosis, prevention and treatment of diseases and clinical conditions associated with LOC222182. LOC90841 (Accession XM_034427) is another VGAM2326 host target gene. LOC90841 BINDING SITE is HOST TARGET binding site found in the 5' untranslated region of mRNA encoded by LOC90841, corresponding to a HOST TARGET binding site such as BINDING SITE I, BINDING SITE II or BINDING SITE III. Table 2 illustrates the complementarity of the nucleotide sequences of LOC90841 BINDING SITE, designated SEQ ID:32111, to the nucleotide sequence of VGAM2326 RNA, herein designated VGAM RNA, also designated SEQ ID:5037.

Another function of VGAM2326 is therefore inhibition of LOC90841 (Accession XM_034427). Accordingly, utilities of VGAM2326 include diagnosis, prevention and treatment of diseases and clinical conditions associated with LOC90841. LOC91056 (Accession XM_170662) is another VGAM2326 host target gene. LOC91056 BINDING SITE is HOST TARGET binding site found in the 3' untranslated region of mRNA encoded by LOC91056, corresponding to a HOST TARGET binding site such as BINDING SITE I, BINDING SITE II or BINDING SITE III. Table 2 illustrates the complementarity of the nucleotide sequences of LOC91056 BINDING SITE, designated SEQ ID:45438, to the nucleotide sequence of VGAM2326 RNA, herein designated VGAM RNA, also designated SEQ ID:5037.

Another function of VGAM2326 is therefore inhibition of LOC91056 (Accession XM_170662). Accordingly, utilities of VGAM2326 include diagnosis, prevention and treatment of diseases and clinical conditions associated with LOC91056. FIG. 1 further provides a conceptual description of a novel bioinformatically detected viral gene of the present invention, referred to here as Viral Genomic Address Messenger 2327 (VGAM2327) viral gene, which modulates expression of respective host target genes thereof, the function and utility of which host target genes is known in the art.

VGAM2327 is a novel bioinformatically detected regulatory, non protein coding, viral micro RNA (miRNA) gene. The method by which VGAM2327 was detected is described hereinabove with reference to FIGS. 1-8.

VGAM2327 gene, herein designated VGAM GENE, is a viral gene contained in the genome of Rana Tigrina Ranavirus. VGAM2327 host target gene, herein designated VGAM HOST TARGET GENE, is a human gene contained in the human genome.

VGAM2327 gene encodes a VGAM2327 precursor RNA, herein designated VGAM PRECURSOR RNA. Similar to other miRNA genes, and unlike most ordinary genes, VGAM2327 precursor RNA does not encode a protein. A nucleotide sequence identical or highly similar to the nucleotide sequence of VGAM2327 precursor RNA is designated SEQ ID:2313, and is provided hereinbelow with reference to the sequence listing part. Nucleotide sequence SEQ ID:2313 is located at position 30986 relative to the genome of Rana Tigrina Ranavirus.

VGAM2327 precursor RNA folds onto itself, forming VGAM2327 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2327 folded precursor RNA into VGAM2327 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 90%) nucleotide sequence of VGAM2327 RNA is designated SEQ ID:5038, and is provided hereinbelow with reference to the sequence listing part.

VGAM2327 host target gene, herein designated VGAM HOST TARGET GENE, encodes a corresponding messenger RNA, VGAM2327 host target RNA, herein designated VGAM HOST TARGET RNA. VGAM2327 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2327 RNA, herein designated VGAM RNA, binds complementarily to one or more host target binding sites located in untranslated regions of VGAM2327 host target RNA, herein designated VGAM HOST TARGET RNA. This complementary binding is due to the fact that the nucleotide sequence of VGAM2327 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2327 RNA, herein designated VGAM RNA, may have a different number of host target binding sites in untranslated regions of a VGAM2327 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2327 RNA, herein designated VGAM RNA, to host target binding sites on VGAM2327 host target RNA, herein designated VGAM HOST TARGET RNA, such as BINDING SITE I, BINDING SITE II and BINDING SITE III, inhibits translation of VGAM2327 host target RNA into VGAM2327 host target protein, herein designated VGAM HOST TARGET PROTEIN. VGAM host target protein is therefore outlined by a broken line.

It is appreciated that VGAM2327 host target gene, herein designated VGAM HOST TARGET GENE, in fact represents a plurality of VGAM2327 host target genes. The mRNA of each one of this plurality of VGAM2327 host target genes comprises one or more host target binding sites, each having a nucleotide sequence which is at least partly complementary to VGAM2327 RNA, herein designated VGAM RNA, and which when bound by VGAM2327 RNA causes inhibition of translation of respective one or more VGAM2327 host target proteins.

It is further appreciated by one skilled in the art that the mode of translational inhibition illustrated by FIG. 1 with specific reference to translational inhibition exerted by VGAM2327 gene, herein designated VGAM GENE, on one or more VGAM2327 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2327 is inhibition of expression of host target genes, as part of a novel viral mechanism of attacking a host. Accordingly, utilities of VGAM2327 include diagnosis, prevention and treatment of viral infection by Rana Tigrina Ranavirus. Specific functions, and accordingly utilities, of VGAM2327 correlate with, and may be deduced from, the identity of the host target genes which VGAM2327 binds and inhibits, and the function of these host target genes, as elaborated hereinbelow.

Nucleotide sequences of the VGAM2327 precursor RNA, herein designated VGAM PRECURSOR RNA, and of the 'diced' VGAM2327 RNA, herein designated VGAM RNA, and a schematic representation of the secondary folding of VGAM2327 folded precursor RNA, herein designated VGAM FOLDED PRECURSOR RNA, of VGAM2327 are further described hereinbelow with reference to Table 1.

Nucleotide sequences of host target binding sites, such as BINDING SITE-I, BINDING SITE-II and BINDING SITE-III of FIG. 1, found on VGAM2327 host target RNA, and schematic representation of the complementarity of each of these host target binding sites to VGAM2327 RNA, herein designated VGAM RNA, are described hereinbelow with reference to Table 2.

As mentioned hereinabove with reference to FIG. 1, a function of VGAM2327 gene, herein designated VGAM is inhibition of expression of VGAM2327 target genes. It is appreciated that specific functions, and accordingly utilities, of VGAM2327 correlate with, and may be deduced from, the identity of the target genes which VGAM2327 binds and inhibits, and the function of these target genes, as elaborated hereinbelow.

G Protein-coupled Receptor 61 (GPR61, Accession XM_086232) is a VGAM2327 host target gene. GPR61 BINDING SITE is HOST TARGET binding site found in the 5' untranslated region of mRNA encoded by GPR61, corresponding to a HOST TARGET binding site such as BINDING SITE I, BINDING SITE II or BINDING SITE III. Table 2 illustrates the complementarity of the nucleotide sequences of GPR61 BINDING SITE, designated SEQ ID:38562, to the nucleotide sequence of VGAM2327 RNA, herein designated VGAM RNA, also designated SEQ ID:5038.

A function of VGAM2327 is therefore inhibition of G Protein-coupled Receptor 61 (GPR61, Accession XM_086232), a gene which transduces extracellular signals through heterotrimeric G proteins. Accordingly, utilities of VGAM2327 include diagnosis, prevention and treatment of diseases and clinical conditions associated with GPR61. The function of GPR61 and its association with various diseases and clinical conditions, has been established by previous studies, as described hereinabove with reference to VGAM1958. Phospholipid Scramblase 1 (PLSCR1, Accession NM_021105) is another VGAM2327 host target gene. PLSCR1 BINDING SITE is HOST TARGET binding site found in the 3' untranslated region of mRNA encoded by PLSCR1, corresponding to a HOST TARGET binding site such as BINDING SITE I, BINDING SITE II or BINDING SITE III. Table 2 illustrates the complementarity of the nucleotide sequences of PLSCR1 BINDING SITE, designated SEQ ID:22085, to the nucleotide sequence of VGAM2327 RNA, herein designated VGAM RNA, also designated SEQ ID:5038.

Another function of VGAM2327 is therefore inhibition of Phospholipid Scramblase 1 (PLSCR1, Accession NM_021105), a gene which involves in the initiation of fibrin clot formation and in the recognition of apoptotic and injured cells by the reticuloendothelial system. Accordingly, utilities of VGAM2327 include diagnosis, prevention and treatment of diseases and clinical conditions associated with PLSCR1. The function of PLSCR1 has been established by previous studies. Quantitative immunoblotting revealed that PL scramblase levels are approximately 10-fold higher in platelets than in erythrocytes, which Zhou et al. (1997) stated was consistent with the apparent increased enzyme activity of the platelet plasma membrane. Using Northern blot analysis, the authors demonstrated that PL scramblase was expressed as 1.6- and 2.6-kb mRNAs in all tissues and cell lines tested. Independently, Kasukabe et al. (1998) identified PL scramblase as the human homolog of mouse MmTRA1b (Mm1 cell-derived transplantability-associated gene 1b), the gene encoding a truncated leukemogenesis-associated cDNA, MmTRA1a. Human and mouse MmTRA1b are 78% identical. Sequence analysis revealed that the predicted human protein contains 3 leucine repeats and a proline-rich N-terminal domain with 3 motifs which may act as docking sites for SH3 motifs. Kasukabe et al. (1998) noted that mouse MmTRA1b was distinct from a putative mouse PL scramblase homolog identified by Zhou et al. (1998). The mouse protein described by Zhou et al. (1998) shares 75% and 71% identity with mouse MmTRA1b and human PL scramblase, respectively Full details of the abovementioned studies are described in the following publications, the disclosure of which are hereby incorporated by reference:

Kasukabe, T.; Kobayashi, H.; Kaneko, Y.; Okabe-Kado, J.; Honma, Y.: Identity of human normal counterpart (MmTRA1b) of mouse leukemogenesis-associated gene (MmTRA1a) product as a plasma membrane phospholipid scramblase and chromosome mapping of the human MmTRA1b/phospholipid scramblase gene. Biochem. Biophys. Res. Commun. 249:449-455, 1998; and Zhou, Q.; Zhao, J.; Stout, J. G.; Luhm, R. A.; Wiedmer, T.; Sims, P. J.: Molecular cloning of human plasma membrane phospholipid scramblase: a protein mediating transbilayer movement of pl.

Further studies establishing the function and utilities of PLSCR1 are found in John Hopkins OMIM database record ID 604170, and in sited publications numbered 8704-5061 listed in the bibliography section hereinbelow, which are also hereby incorporated by reference. Solute Carrier Family 21 (prostaglandin transporter), Member 2 (SLC21A2, Accession NM_005630) is another VGAM2327 host target gene. SLC21A2 BINDING SITE is HOST TARGET binding site found in the 3' untranslated region of mRNA encoded by SLC21A2, corresponding to a HOST TARGET binding site such as BINDING SITE I, BINDING SITE II or BINDING SITE III. Table 2 illustrates the complementarity of the nucleotide sequences of SLC21A2 BINDING SITE, designated SEQ ID:12154, to the nucleotide sequence of VGAM2327 RNA, herein designated VGAM RNA, also designated SEQ ID:5038.

Another function of VGAM2327 is therefore inhibition of Solute Carrier Family 21 (prostaglandin transporter), Member 2 (SLC21A2, Accession NM_005630), a gene which is a Prostaglandin transporter. Accordingly, utilities of VGAM2327 include diagnosis, prevention and treatment of diseases and clinical conditions associated with SLC21A2. The function of SLC21A2 and its association with various diseases and clinical conditions, has been established by previous studies, as described hereinabove with reference to VGAM83. FLJ10702 (Accession NM_018184) is another VGAM2327 host target gene. FLJ10702 BINDING SITE is HOST TARGET binding site found in the 3' untranslated region of mRNA encoded by FLJ10702, corresponding to a HOST TARGET binding site such as BINDING SITE I, BINDING SITE II or BINDING SITE III. Table 2 illustrates the complementarity of the nucleotide sequences of FLJ10702 BINDING SITE, designated SEQ ID:20024, to the nucleotide sequence of VGAM2327 RNA, herein designated VGAM RNA, also designated SEQ ID:5038.

Another function of VGAM2327 is therefore inhibition of FLJ10702 (Accession NM_018184). Accordingly, utilities of VGAM2327 include diagnosis, prevention and treatment of diseases and clinical conditions associated with FLJ10702. FLJ12287 (Accession NM_022367) is another VGAM2327 host target gene. FLJ12287 BINDING SITE is HOST TARGET binding site found in the 3' untranslated region of mRNA encoded by FLJ12287, corresponding to a HOST TARGET binding site such as BINDING SITE I, BINDING SITE II or BINDING SITE III. Table 2 illustrates the complementarity of the nucleotide sequences of FLJ12287 BINDING SITE, designated SEQ ID:22753, to the nucleotide sequence of VGAM2327 RNA, herein designated VGAM RNA, also designated SEQ ID:5038.

Another function of VGAM2327 is therefore inhibition of FLJ12287 (Accession NM_022367). Accordingly, utilities of VGAM2327 include diagnosis, prevention and treatment of diseases and clinical conditions associated with FLJ12287. MGC20253 (Accession NM_144583) is another VGAM2327 host target gene. MGC20253 BINDING SITE is HOST TARGET binding site found in the 3' untranslated region of mRNA encoded by MGC20253, corresponding to a HOST TARGET binding site such as BINDING SITE I, BINDING SITE II or BINDING SITE III. Table 2 illustrates the complementarity of the nucleotide sequences of MGC20253 BINDING SITE, designated SEQ ID:29396, to the nucleotide sequence of VGAM2327 RNA, herein designated VGAM RNA, also designated SEQ ID:5038.

Another function of VGAM2327 is therefore inhibition of MGC20253 (Accession NM_144583). Accordingly, utilities of VGAM2327 include diagnosis, prevention and treatment of diseases and clinical conditions associated with MGC20253. PR Domain Containing 10 (PRDM10, Accession NM_020228) is another VGAM2327 host target gene. PRDM10 BINDING SITE is HOST TARGET binding site found in the 3' untranslated region of mRNA encoded by PRDM10, corresponding to a HOST TARGET binding site such as BINDING SITE I, BINDING SITE II or BINDING SITE III. Table 2 illustrates the complementarity of the nucleotide sequences of PRDM10 BINDING SITE, designated SEQ ID:21495, to the nucleotide sequence of VGAM2327 RNA, herein designated VGAM RNA, also designated SEQ ID:5038.

Another function of VGAM2327 is therefore inhibition of PR Domain Containing 10 (PRDM10, Accession NM_020228). Accordingly, utilities of VGAM2327 include diagnosis, prevention and treatment of diseases and clinical conditions associated with PRDM10. FIG. 1 further provides a conceptual description of a novel bioinformatically detected viral gene of the present invention, referred to here as Viral Genomic Address Messenger 2328 (VGAM2328) viral gene, which modulates expression of respective host target genes thereof, the function and utility of which host target genes is known in the art.

VGAM2328 is a novel bioinformatically detected regulatory, non protein coding, viral micro RNA (miRNA) gene. The method by which VGAM2328 was detected is described hereinabove with reference to FIGS. 1-8.

VGAM2328 gene, herein designated VGAM GENE, is a viral gene contained in the genome of Rana Tigrina Ranavirus. VGAM2328 host target gene, herein designated VGAM HOST TARGET GENE, is a human gene contained in the human genome.

VGAM2328 gene encodes a VGAM2328 precursor RNA, herein designated VGAM PRECURSOR RNA. Similar to other miRNA genes, and unlike most ordinary genes, VGAM2328 precursor RNA does not encode a protein. A nucleotide sequence identical or highly similar to the nucleotide sequence of VGAM2328 precursor RNA is designated SEQ ID:2314, and is provided hereinbelow with reference to the sequence listing part. Nucleotide sequence SEQ ID:2314 is located at position 16752 relative to the genome of Rana Tigrina Ranavirus.

VGAM2328 precursor RNA folds onto itself, forming VGAM2328 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2328 folded precursor RNA into VGAM2328 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2328 RNA is designated SEQ ID:5039, and is provided hereinbelow with reference to the sequence listing part.

VGAM2328 host target gene, herein designated VGAM HOST TARGET GENE, encodes a corresponding messenger RNA, VGAM2328 host target RNA, herein designated VGAM HOST TARGET RNA. VGAM2328 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2328 RNA, herein designated VGAM RNA, binds complementarily to one or more host target binding sites located in untranslated regions of VGAM2328 host target RNA, herein designated VGAM HOST TARGET RNA. This complementary binding is due to the fact that the nucleotide sequence of VGAM2328 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2328 RNA, herein designated VGAM RNA, may have a different number of host target binding sites in untranslated regions of a VGAM2328 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2328 RNA, herein designated VGAM RNA, to host target binding sites on VGAM2328 host target RNA, herein designated VGAM HOST TARGET RNA, such as BINDING SITE I, BINDING SITE II and BINDING SITE III, inhibits translation of VGAM2328 host target RNA into VGAM2328 host target protein, herein designated VGAM HOST TARGET PROTEIN. VGAM host target protein is therefore outlined by a broken line.

It is appreciated that VGAM2328 host target gene, herein designated VGAM HOST TARGET GENE, in fact represents a plurality of VGAM2328 host target genes. The mRNA of each one of this plurality of VGAM2328 host target genes comprises one or more host target binding sites, each having a nucleotide sequence which is at least partly complementary to VGAM2328 RNA, herein designated VGAM RNA, and which when bound by VGAM2328 RNA causes inhibition of translation of respective one or more VGAM2328 host target proteins.

It is further appreciated by one skilled in the art that the mode of translational inhibition illustrated by FIG. 1 with specific reference to translational inhibition exerted by VGAM2328 gene, herein designated VGAM GENE, on one or more VGAM2328 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2328 is inhibition of expression of host target genes, as part of a novel viral mechanism of attacking a host. Accordingly, utilities of VGAM2328 include diagnosis, prevention and treatment of viral infection by Rana Tigrina Ranavirus. Specific functions, and accordingly utilities, of VGAM2328 correlate with, and may be deduced from, the identity of the host target genes which VGAM2328 binds and inhibits, and the function of these host target genes, as elaborated hereinbelow.

Nucleotide sequences of the VGAM2328 precursor RNA, herein designated VGAM PRECURSOR RNA, and of the 'diced' VGAM2328 RNA, herein designated VGAM RNA, and a schematic representation of the secondary folding of VGAM2328 folded precursor RNA, herein designated VGAM FOLDED PRECURSOR RNA, of VGAM2328 are further described hereinbelow with reference to Table 1.

Nucleotide sequences of host target binding sites, such as BINDING SITE-I, BINDING SITE-II and BINDING SITE-III of FIG. 1, found on VGAM2328 host target RNA, and schematic representation of the complementarity of each of these host target binding sites to VGAM2328 RNA, herein designated VGAM RNA, are described hereinbelow with reference to Table 2.

As mentioned hereinabove with reference to FIG. 1, a function of VGAM2328 gene, herein designated VGAM is inhibition of expression of VGAM2328 target genes. It is appreciated that specific functions, and accordingly utilities, of VGAM2328 correlate with, and may be deduced from, the identity of the target genes which VGAM2328 binds and inhibits, and the function of these target genes, as elaborated hereinbelow.

A Kinase (PRKA) Anchor Protein 13 (AKAP13, Accession NM_144767) is a VGAM2328 host target gene. AKAP13 BINDING SITE is HOST TARGET binding site found in the 5' untranslated region of mRNA encoded by AKAP13, corresponding to a HOST TARGET binding site such as BINDING SITE I, BINDING SITE II or BINDING SITE III. Table 2 illustrates the complementarity of the nucleotide sequences of AKAP13 BINDING SITE, designated SEQ ID:29559, to the nucleotide sequence of VGAM2328 RNA, herein designated VGAM RNA, also designated SEQ ID:5039.

A function of VGAM2328 is therefore inhibition of A Kinase (PRKA) Anchor Protein 13 (AKAP13, Accession NM_144767), a gene which regulates subcellular localization of type II cAMP-dependent PKA. Accordingly, utilities of VGAM2328 include diagnosis, prevention and treatment of diseases and clinical conditions associated with AKAP13. The function of AKAP13 and its association with various diseases and clinical conditions, has been established by previous studies, as described hereinabove with reference to VGAM17. Distal-less Homeobox 4 (DLX4, Accession NM_138281) is another VGAM2328 host target gene. DLX4 BINDING SITE1 and DLX4 BINDING SITE2 are HOST TARGET binding sites found in untranslated regions of mRNA encoded by DLX4, corresponding to HOST TARGET binding sites such as BINDING SITE I, BINDING SITE II or BINDING SITE III. Table 2 illustrates the complementarity of the nucleotide sequences of DLX4 BINDING SITE1 and DLX4 BINDING SITE2, designated SEQ ID:28694 and SEQ ID:7646 respectively, to the nucleotide sequence of VGAM2328 RNA, herein designated VGAM RNA, also designated SEQ ID:5039.

Another function of VGAM2328 is therefore inhibition of Distal-less Homeobox 4 (DLX4, Accession NM_138281), a gene which may regulate gene expression, morphogenesis, and differentiation. Accordingly, utilities of VGAM2328 include diagnosis, prevention and treatment of diseases and clinical conditions associated with DLX4. The function of DLX4 and its association with various diseases and clinical conditions, has been established by previous studies, as described hereinabove with reference to VGAM1929. Meis1, Myeloid Ecotropic Viral Integration Site 1 Homolog 2 (mouse) (MEIS2, Accession NM_020149) is another VGAM2328 host target gene. MEIS2 BINDING SITE is HOST TARGET binding site found in the 3' untranslated region of mRNA encoded by MEIS2, corresponding to a HOST TARGET binding site such as BINDING SITE I, BINDING SITE II or BINDING SITE III. Table 2 illustrates the complementarity of the nucleotide sequences of MEIS2 BINDING SITE, designated SEQ ID:21349, to the nucleotide sequence of VGAM2328 RNA, herein designated VGAM RNA, also designated SEQ ID:5039.

Another function of VGAM2328 is therefore inhibition of Meis1, Myeloid Ecotropic Viral Integration Site 1 Homolog 2 (mouse) (MEIS2, Accession NM_020149), a gene which may regulate gene expression and control cell differentiation. Accordingly, utilities of VGAM2328 include diagnosis, prevention and treatment of diseases and clinical conditions associated with MEIS2. The function of MEIS2 and its association with various diseases and clinical conditions, has been established by previous studies, as described hereinabove with reference to VGAM1244. Norrie Disease (pseudoglioma) (NDP, Accession NM_000266) is another VGAM2328 host target gene. NDP BINDING SITE is HOST TARGET binding site found in the 3' untranslated region of mRNA encoded by NDP, corresponding to a HOST TARGET binding site such as BINDING SITE I, BINDING SITE II or BINDING SITE III. Table 2 illustrates the complementarity of the nucleotide sequences of NDP BINDING SITE, designated SEQ ID:5810, to the nucleotide sequence of VGAM2328 RNA, herein designated VGAM RNA, also designated SEQ ID:5039.

Another function of VGAM2328 is therefore inhibition of Norrie Disease (pseudoglioma) (NDP, Accession NM_000266), a gene which may be involved in a pathway that regulates neural cell differentiation and proliferation. Accordingly, utilities of VGAM2328 include diagnosis, prevention and treatment of diseases and clinical conditions associated with NDP. The function of NDP and its association with various diseases and clinical conditions, has been established by previous studies, as described hereinabove with reference to VGAM113. Nuclear Factor Related to Kappa B Binding Protein (NFRKB, Accession NM_006165) is another VGAM2328 host target gene. NFRKB BINDING SITE is HOST TARGET binding site found in the 5' untranslated region of mRNA encoded by NFRKB, corresponding to a HOST TARGET binding site such as BINDING SITE I, BINDING SITE II or BINDING SITE III. Table 2 illustrates the complementarity of the nucleotide sequences of NFRKB BINDING SITE, designated SEQ ID:12824, to the nucleotide sequence of VGAM2328 RNA, herein designated VGAM RNA, also designated SEQ ID:5039.

Another function of VGAM2328 is therefore inhibition of Nuclear Factor Related to Kappa B Binding Protein (NFRKB, Accession NM_006165). Accordingly, utilities of VGAM2328 include diagnosis, prevention and treatment of diseases and clinical conditions associated with NFRKB. UC28 (Accession NM_021635) is another VGAM2328 host target gene. UC28 BINDING SITE is HOST TARGET binding site found in the 3' untranslated region of mRNA encoded by UC28, corresponding to a HOST TARGET binding site such as BINDING SITE I, BINDING SITE II or BINDING SITE III. Table 2 illustrates the complementarity of the nucleotide sequences of UC28 BINDING SITE, designated SEQ ID:22282, to the nucleotide sequence of VGAM2328 RNA, herein designated VGAM RNA, also designated SEQ ID:5039.

Another function of VGAM2328 is therefore inhibition of UC28 (Accession NM_021635). Accordingly, utilities of VGAM2328 include diagnosis, prevention and treatment of diseases and clinical conditions associated with UC28. C1q and Tumor Necrosis Factor Related Protein 7 (C1QTNF7, Accession NM_031911) is another VGAM2328 host target gene. C1QTNF7 BINDING SITE is HOST TARGET binding site found in the 3' untranslated region of mRNA encoded by C1QTNF7, corresponding to a HOST TARGET binding site such as BINDING SITE I, BINDING SITE II or BINDING SITE III. Table 2 illustrates the complementarity of the nucleotide sequences of C1QTNF7 BINDING SITE, designated SEQ ID:25668, to the nucleotide sequence of VGAM2328 RNA, herein designated VGAM RNA, also designated SEQ ID:5039.

Another function of VGAM2328 is therefore inhibition of C1q and Tumor Necrosis Factor Related Protein 7 (C1QTNF7, Accession NM_031911). Accordingly, utilities of VGAM2328 include diagnosis, prevention and treatment of diseases and clinical conditions associated with C1QTNF7. KIAA1416 (Accession XM_098762) is another VGAM2328 host target gene. KIAA1416 BINDING SITE is HOST TARGET binding site found in the 3' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41805, to the nucleotide sequence of VGAM2328 RNA, herein designated VGAM RNA, also designated SEQ ID:5039.

Another function of VGAM2328 is therefore inhibition of KIAA1416 (Accession XM_098762). Accordingly, utilities of VGAM2328 include diagnosis, prevention and treatment of diseases and clinical conditions associated with KIAA1416. KIAA1493 (Accession XM_034415) is another VGAM2328 host target gene. KIAA1493 BINDING SITE is HOST TARGET binding site found in the 3' untranslated region of mRNA encoded by KIAA1493, corresponding to a HOST TARGET binding site such as BINDING SITE I, BINDING SITE II or BINDING SITE III. Table 2 illustrates the complementarity of the nucleotide sequences of KIAA1493 BINDING SITE, designated SEQ ID:32096, to the nucleotide sequence of VGAM2328 RNA, herein designated VGAM RNA, also designated SEQ ID:5039.

Another function of VGAM2328 is therefore inhibition of KIAA1493 (Accession XM_034415). Accordingly, utilities of VGAM2328 include diagnosis, prevention and treatment of diseases and clinical conditions associated with KIAA1493. KIAA1524 (Accession XM_056015) is another VGAM2328 host target gene. KIAA1524 BINDING SITE is HOST TARGET binding site found in the 3' untranslated region of mRNA encoded by KIAA1524, corresponding to a HOST TARGET binding site such as BINDING SITE I, BINDING SITE II or BINDING SITE III. Table 2 illustrates the complementarity of the nucleotide sequences of KIAA1524 BINDING SITE, designated SEQ ID:36361, to the nucleotide sequence of VGAM2328 RNA, herein designated VGAM RNA, also designated SEQ ID:5039.

Another function of VGAM2328 is therefore inhibition of KIAA1524 (Accession XM_056015). Accordingly, utilities of VGAM2328 include diagnosis, prevention and treatment of diseases and clinical conditions associated with KIAA1524. KIAA1904 (Accession XM_056282) is another VGAM2328 host target gene. KIAA1904 BINDING SITE is HOST TARGET binding site found in the 3' untranslated region of mRNA encoded by KIAA1904, corresponding to a HOST TARGET binding site such as BINDING SITE I, BINDING SITE II or BINDING SITE III. Table 2 illustrates the complementarity of the nucleotide sequences of KIAA1904 BINDING SITE, designated SEQ ID:36384, to the nucleotide sequence of VGAM2328 RNA, herein designated VGAM RNA, also designated SEQ ID:5039.

Another function of VGAM2328 is therefore inhibition of KIAA1904 (Accession XM_056282). Accordingly, utilities of VGAM2328 include diagnosis, prevention and treatment of diseases and clinical conditions associated with KIAA1904. TUSP (Accession NM_020245) is another VGAM2328 host target gene. TUSP BINDING SITE is HOST TARGET binding site found in the 3' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21538, to the nucleotide sequence of VGAM2328 RNA, herein designated VGAM RNA, also designated SEQ ID:5039.

Another function of VGAM2328 is therefore inhibition of TUSP (Accession NM_020245). Accordingly, utilities of VGAM2328 include diagnosis, prevention and treatment of diseases and clinical conditions associated with TUSP. LOC128989 (Accession XM_059310) is another VGAM2328 host target gene. LOC128989 BINDING SITE is HOST TARGET binding site found in the 3' untranslated region of mRNA encoded by LOC128989, corresponding to a HOST TARGET binding site such as BINDING SITE I, BINDING SITE II or BINDING SITE III. Table 2 illustrates the complementarity of the nucleotide sequences of LOC128989 BINDING SITE, designated SEQ ID:36942, to the nucleotide sequence of VGAM2328 RNA, herein designated VGAM RNA, also designated SEQ ID:5039.

Another function of VGAM2328 is therefore inhibition of LOC128989 (Accession XM_059310). Accordingly, utilities of VGAM2328 include diagnosis, prevention and treatment of diseases and clinical conditions associated with LOC128989. LOC146455 (Accession XM_085471) is another VGAM2328 host target gene. LOC146455 BINDING SITE is HOST TARGET binding site found in the 3' untranslated region of mRNA encoded by LOC146455, corresponding to a HOST TARGET binding site such as BIND- ING SITE I, BINDING SITE II or BINDING SITE III. Table 2 illustrates the complementarity of the nucleotide sequences of LOC146455 BINDING SITE, designated SEQ ID:38157, to the nucleotide sequence of VGAM2328 RNA, herein designated VGAM RNA, also designated SEQ ID:5039.

Another function of VGAM2328 is therefore inhibition of LOC146455 (Accession XM_085471). Accordingly, utilities of VGAM2328 include diagnosis, prevention and treatment of diseases and clinical conditions associated with LOC146455. LOC150282 (Accession XM_086852) is another VGAM2328 host target gene. LOC150282 BINDING SITE is HOST TARGET binding site found in the 5' untranslated region of mRNA encoded by LOC150282, corresponding to a HOST TARGET binding site such as BINDING SITE I, BINDING SITE II or BINDING SITE III. Table 2 illustrates the complementarity of the nucleotide sequences of LOC150282 BINDING SITE, designated SEQ ID:38919, to the nucleotide sequence of VGAM2328 RNA, herein designated VGAM RNA, also designated SEQ ID:5039.

Another function of VGAM2328 is therefore inhibition of LOC150282 (Accession XM_086852). Accordingly, utilities of VGAM2328 include diagnosis, prevention and treatment of diseases and clinical conditions associated with LOC150282. LOC219731 (Accession XM_167596) is another VGAM2328 host target gene. LOC219731 BINDING SITE is HOST TARGET binding site found in the 5' untranslated region of mRNA encoded by LOC219731, corresponding to a HOST TARGET binding site such as BINDING SITE I, BINDING SITE II or BINDING SITE III. Table 2 illustrates the complementarity of the nucleotide sequences of LOC219731 BINDING SITE, designated SEQ ID:44719, to the nucleotide sequence of VGAM2328 RNA, herein designated VGAM RNA, also designated SEQ ID:5039.

Another function of VGAM2328 is therefore inhibition of LOC219731 (Accession XM_167596). Accordingly, utilities of VGAM2328 include diagnosis, prevention and treatment of diseases and clinical conditions associated with LOC219731. LOC254024 (Accession XM_171285) is another VGAM2328 host target gene. LOC254024 BINDING SITE is HOST TARGET binding site found in the 5' untranslated region of mRNA encoded by LOC254024, corresponding to a HOST TARGET binding site such as BINDING SITE I, BINDING SITE II or BINDING SITE III. Table 2 illustrates the complementarity of the nucleotide sequences of LOC254024 BINDING SITE, designated SEQ ID:46040, to the nucleotide sequence of VGAM2328 RNA, herein designated VGAM RNA, also designated SEQ ID:5039.

Another function of VGAM2328 is therefore inhibition of LOC254024 (Accession XM_171285). Accordingly, utilities of VGAM2328 include diagnosis, prevention and treatment of diseases and clinical conditions associated with LOC254024. FIG. 1 further provides a conceptual description of a novel bioinformatically detected viral gene of the present invention, referred to here as Viral Genomic Address Messenger 2329 (VGAM2329) viral gene, which modulates expression of respective host target genes thereof, the function and utility of which host target genes is known in the art.

VGAM2329 is a novel bioinformatically detected regulatory, non protein coding, viral micro RNA (miRNA) gene. The method by which VGAM2329 was detected is described hereinabove with reference to FIGS. 1-8.

VGAM2329 gene, herein designated VGAM GENE, is a viral gene contained in the genome of Equine Herpesvirus 2. VGAM2329 host target gene, herein designated VGAM HOST TARGET GENE, is a human gene contained in the human genome.

VGAM2329 gene encodes a VGAM2329 precursor RNA, herein designated VGAM PRECURSOR RNA. Similar to other miRNA genes, and unlike most ordinary genes, VGAM2329 precursor RNA does not encode a protein. A nucleotide sequence identical or highly similar to the nucleotide sequence of VGAM2329 precursor RNA is designated SEQ ID:2315, and is provided hereinbelow with reference to the sequence listing part. Nucleotide sequence SEQ ID:2315 is located at position 39739 relative to the genome of Equine Herpesvirus 2.

VGAM2329 precursor RNA folds onto itself, forming VGAM2329 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2329 folded precursor RNA into VGAM2329 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2329 RNA is designated SEQ ID:5040, and is provided hereinbelow with reference to the sequence listing part.

VGAM2329 host target gene, herein designated VGAM HOST TARGET GENE, encodes a corresponding messenger RNA, VGAM2329 host target RNA, herein designated VGAM HOST TARGET RNA. VGAM2329 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2329 RNA, herein designated VGAM RNA, binds complementarily to one or more host target binding sites located in untranslated regions of VGAM2329 host target RNA, herein designated VGAM HOST TARGET RNA. This complementary binding is due to the fact that the nucleotide sequence of VGAM2329 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2329 RNA, herein designated VGAM RNA, may have a different number of host target binding sites in untranslated regions of a VGAM2329 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2329 RNA, herein designated VGAM RNA, to host target binding sites on VGAM2329 host target RNA, herein designated VGAM HOST TARGET RNA, such as BINDING SITE I, BINDING SITE II and BINDING SITE III, inhibits translation of VGAM2329 host target RNA into VGAM2329 host target protein, herein designated VGAM HOST TARGET PRO- TEIN. VGAM host target protein is therefore outlined by a broken line.

It is appreciated that VGAM2329 host target gene, herein designated VGAM HOST TARGET GENE, in fact represents a plurality of VGAM2329 host target genes. The mRNA of each one of this plurality of VGAM2329 host target genes comprises one or more host target binding sites, each having a nucleotide sequence which is at least partly complementary to VGAM2329 RNA, herein designated VGAM RNA, and which when bound by VGAM2329 RNA causes inhibition of translation of respective one or more VGAM2329 host target proteins.

It is further appreciated by one skilled in the art that the mode of translational inhibition illustrated by FIG. 1 with specific reference to translational inhibition exerted by VGAM2329 gene, herein designated VGAM GENE, on one or more VGAM2329 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2329 is inhibition of expression of host target genes, as part of a novel viral mechanism of attacking a host. Accordingly, utilities of VGAM2329 include diagnosis, prevention and treatment of viral infection by Equine Herpesvirus 2. Specific functions, and accordingly utilities, of VGAM2329 correlate with, and may be deduced from, the identity of the host target genes which VGAM2329 binds and inhibits, and the function of these host target genes, as elaborated hereinbelow.

Nucleotide sequences of the VGAM2329 precursor RNA, herein designated VGAM PRECURSOR RNA, and of the 'diced' VGAM2329 RNA, herein designated VGAM RNA, and a schematic representation of the secondary folding of VGAM2329 folded precursor RNA, herein designated VGAM FOLDED PRECURSOR RNA, of VGAM2329 are further described hereinbelow with reference to Table 1.

Nucleotide sequences of host target binding sites, such as BINDING SITE-I, BINDING SITE-II and BINDING SITE-III of FIG. 1, found on VGAM2329 host target RNA, and schematic representation of the complementarity of each of these host target binding sites to VGAM2329 RNA, herein designated VGAM RNA, are described hereinbelow with reference to Table 2.

As mentioned hereinabove with reference to FIG. 1, a function of VGAM2329 gene, herein designated VGAM is inhibition of expression of VGAM2329 target genes. It is appreciated that specific functions, and accordingly utilities, of VGAM2329 correlate with, and may be deduced from, the identity of the target genes which VGAM2329 binds and inhibits, and the function of these target genes, as elaborated hereinbelow.

APM1 (Accession NM_004797) is a VGAM2329 host target gene. APM1 BINDING SITE is HOST TARGET binding site found in the 3' untranslated region of mRNA encoded by APM1, corresponding to a HOST TARGET binding site such as BINDING SITE I, BINDING SITE II or BINDING SITE III. Table 2 illustrates the complementarity of the nucleotide sequences of APM1 BINDING SITE, designated SEQ ID:11205, to the nucleotide sequence of VGAM2329 RNA, herein designated VGAM RNA, also designated SEQ ID:5040.

A function of VGAM2329 is therefore inhibition of APM1 (Accession NM_004797). Accordingly, utilities of VGAM2329 include diagnosis, prevention and treatment of diseases and clinical conditions associated with APM1. UDP-Gal:betaGlcNAc Beta 1,4-Galactosyltransferase, Polypeptide 3 (B4GALT3, Accession NM_003779) is another VGAM2329 host target gene. B4GALT3 BINDING SITE is HOST TARGET binding site found in the 5' untranslated region of mRNA encoded by B4GALT3, corresponding to a HOST TARGET binding site such as BINDING SITE I, BINDING SITE II or BINDING SITE III. Table 2 illustrates the complementarity of the nucleotide sequences of B4GALT3 BINDING SITE, designated SEQ ID:9863, to the nucleotide sequence of VGAM2329 RNA, herein designated VGAM RNA, also designated SEQ ID:5040.

Another function of VGAM2329 is therefore inhibition of UDP-Gal:betaGlcNAc Beta 1,4-Galactosyltransferase, Polypeptide 3 (B4GALT3, Accession NM_003779). Accordingly, utilities of VGAM2329 include diagnosis, prevention and treatment of diseases and clinical conditions associated with B4GALT3. Cysteine Knot Superfamily 1, BMP Antagonist 1 (CKTSF1B1, Accession NM_013372) is another VGAM2329 host target gene. CKTSF1B1 BINDING SITE is HOST TARGET binding site found in the 3' untranslated region of mRNA encoded by CKTSF1B1, corresponding to a HOST TARGET binding site such as BINDING SITE I, BINDING SITE II or BINDING SITE III. Table 2 illustrates the complementarity of the nucleotide sequences of CKTSF1B1 BINDING SITE, designated SEQ ID:15020, to the nucleotide sequence of VGAM2329 RNA, herein designated VGAM RNA, also designated SEQ ID:5040.

Another function of VGAM2329 is therefore inhibition of Cysteine Knot Superfamily 1, BMP Antagonist 1 (CKTSF1B1, Accession NM_013372), a gene which blocks signaling of bone morphogenetic protein (BMP) . Accordingly, utilities of VGAM2329 include diagnosis, prevention and treatment of diseases and clinical conditions associated with CKTSF1B1. The function of CKTSF1B1 and its association with various diseases and clinical conditions, has been established by previous studies, as described hereinabove with reference to VGAM28. Potassium Inwardly-rectifying Channel, Subfamily J, Member 3 (KCNJ3, Accession NM_002239) is another VGAM2329 host target gene. KCNJ3 BINDING SITE is HOST TARGET binding site found in the 3' untranslated region of mRNA encoded by KCNJ3, corresponding to a HOST TARGET binding site such as BINDING SITE I, BINDING SITE II or BINDING SITE III. Table 2 illustrates the complementarity of the nucleotide sequences of KCNJ3 BINDING SITE, designated SEQ ID:8021, to the nucleotide sequence of VGAM2329 RNA, herein designated VGAM RNA, also designated SEQ ID:5040.

Another function of VGAM2329 is therefore inhibition of Potassium Inwardly-rectifying Channel, Subfamily J, Member 3 (KCNJ3, Accession NM_002239), a gene which is a potassium inwardly-rectifying channel. Accordingly, utilities of VGAM2329 include diagnosis, prevention and treatment of diseases and clinical conditions associated with KCNJ3. The function of KCNJ3 has been established by previous studies. Inwardly rectifying potassium channels control the excitability of neuronal cells by allowing potassium ion influx through a nonvoltage-gated mechanism. See 602208. Stoffel et al. (1994) screened a rat insulinoma cell line cDNA library with a human IRK1 (OMIM Ref. No. 600681) probe. A cDNA, designated RINm5F by them, was shown to be highly expressed in atrial myocardium and brain. The same sequence was reported by Kubo et al. (1993) and was designated GIRK1. It was shown to be a G protein-coupled muscarinic potassium channel related to ROMK1 (OMIM Ref. No. 600359) and IRK1. Stoffel et al. (1994) isolated and partially characterized the human GIRK1 gene which was assigned to chromosome 2 using a somatic cell hybrid DNA panel and localized it to 2q24.1 by fluorescence in situ hybridization. A polymorphic dinucleotide repeat sequence was found in the GIRK1 genomic clones and used to map the locus genetically. Schoots et al. (1996) cloned the complete human GIRK1 gene by probing a cerebellum cDNA library with the rat gene. The cDNA encodes a predicted 501-amino acid protein whose sequence is 99% identical to that of rat GIRK1. Northern blot analysis showed that human GIRK1 is expressed as 2 mRNAs (4.3 kb and 6.2 kb) that are most abundant in brain, but are also seen in kidney and heart. In Xenopus oocytes that coexpressed GIRK1 and the rat serotonin receptor 5-HT-1A (OMIM Ref. No. 109760), serotonin evoked inward potassium currents. Schoots et al. (1997) found that the KCNJ3 gene, which they referred to as Kir3.1, contains 3 exons and spans more than 45 kb Full details of the abovementioned studies are described in the following publications, the disclosure of which are hereby incorporated by reference:

Kubo, Y.; Reuveny, E.; Slesinger, P. A.; Jan, Y. N.; Jan, L. Y.: Primary structure and functional expression of a rat G-protein-coupled muscarinic potassium channel. Nature 364:802-806, 1993; and Schoots, O.; Voskoglou, T.; Van Tol, H. H. M.: Genomic organization and promoter analysis of the human G-protein-coupled K+ channel Kir3.1 (KCNJ3/HGIRK1). Genomics 39:279-288, 1997.

Further studies establishing the function and utilities of KCNJ3 are found in John Hopkins OMIM database record ID 601534, and in sited publications numbered 7203-7206 listed in the bibliography section hereinbelow, which are also hereby incorporated by reference. Membrane Metallo-endopeptidase (neutral endopeptidase, enkephalinase, CALLA, CD10) (MME, Accession NM_007289) is another VGAM2329 host target gene. MME BINDING SITE1 through MME BINDING SITE4 are HOST TARGET binding sites found in untranslated regions of mRNA encoded by MME, corresponding to HOST TARGET binding sites such as BINDING SITE I, BINDING SITE II or BINDING SITE III. Table 2 illustrates the complementarity of the nucleotide sequences of MME BINDING SITE1 through MME BINDING SITE4, designated SEQ ID:14157, SEQ ID:14153, SEQ ID:14149 and SEQ ID:6601 respectively, to the nucleotide sequence of VGAM2329 RNA, herein designated VGAM RNA, also designated SEQ ID:5040.

Another function of VGAM2329 is therefore inhibition of Membrane Metallo-endopeptidase (neutral endopeptidase, enkephalinase, CALLA, CD10) (MME, Accession NM_007289), a gene which is thermolysin-like specificity. Accordingly, utilities of VGAM2329 include diagnosis, prevention and treatment of diseases and clinical conditions associated with MME. The function of MME and its association with various diseases and clinical conditions, has been established by previous studies, as described hereinabove with reference to VGAM1332. RAN Binding Protein 2 (RANBP2, Accession NM_006267) is another VGAM2329 host target gene. RANBP2 BINDING SITE is HOST TARGET binding site found in the 3' untranslated region of mRNA encoded by RANBP2, corresponding to a HOST TARGET binding site such as BINDING SITE I, BINDING SITE II or BINDING SITE III. Table 2 illustrates the complementarity of the nucleotide sequences of RANBP2 BINDING SITE, designated SEQ ID:12947, to the nucleotide sequence of VGAM2329 RNA, herein designated VGAM RNA, also designated SEQ ID:5040.

Another function of VGAM2329 is therefore inhibition of RAN Binding Protein 2 (RANBP2, Accession NM_006267), a gene which is thought to control a variety of cellular functions through its interactions with other proteins. Accordingly, utilities of VGAM2329 include diagnosis, prevention and treatment of diseases and clinical conditions associated with RANBP2. The function of RANBP2 and its association with various diseases and clinical conditions, has been established by previous studies, as described hereinabove with reference to VGAM1337. Ribosomal Protein L10 (RPL10, Accession NM_006013) is another VGAM2329 host target gene. RPL10 BINDING SITE is HOST TARGET binding site found in the 3' untranslated region of mRNA encoded by RPL10, corresponding to a HOST TARGET binding site such as BINDING SITE I, BINDING SITE II or BINDING SITE III. Table 2 illustrates the complementarity of the nucleotide sequences of RPL10 BINDING SITE, designated SEQ ID:12621, to the nucleotide sequence of VGAM2329 RNA, herein designated VGAM RNA, also designated SEQ ID:5040.

Another function of VGAM2329 is therefore inhibition of Ribosomal Protein L10 (RPL10, Accession NM_006013), a gene which may be a component of the 60S ribosomal subunit. Accordingly, utilities of VGAM2329 include diagnosis, prevention and treatment of diseases and clinical conditions associated with RPL10. The function of RPL10 and its association with various diseases and clinical conditions, has been established by previous studies, as described hereinabove with reference to VGAM476. T-cell Acute Lymphocytic Leukemia 1 (TAL1, Accession NM_003189) is another VGAM2329 host target gene. TAL1 BINDING SITE is HOST TARGET binding site found in the 5' untranslated region of mRNA encoded by TAL1, corresponding to a HOST TARGET binding site such as BINDING SITE I, BINDING SITE II or BINDING SITE III. Table 2 illustrates the complementarity of the nucleotide sequences of TAL1 BINDING SITE, designated SEQ ID:9167, to the nucleotide sequence of VGAM2329 RNA, herein designated VGAM RNA, also designated SEQ ID:5040.

Another function of VGAM2329 is therefore inhibition of T-cell Acute Lymphocytic Leukemia 1 (TAL1, Accession NM_003189), a gene which may help control cell growth and differentiation. Accordingly, utilities of VGAM2329 include diagnosis, prevention and treatment of diseases and clinical conditions associated with TAL1. The function of TAL1 and its association with various diseases and clinical conditions, has been established by previous studies, as described hereinabove with reference to VGAM172. Tumor Necrosis Factor Receptor Superfamily, Member 1B (TNFRSF1B, Accession NM_001066) is another VGAM2329 host target gene. TNFRSF1B BINDING SITE is HOST TARGET binding site found in the 3' untranslated region of mRNA encoded by TNFRSF1B, corresponding to a HOST TARGET binding site such as BINDING SITE I, BINDING SITE II or BINDING SITE III. Table 2 illustrates the complementarity of the nucleotide sequences of TNFRSF1B BINDING SITE, designated SEQ ID:6733, to the nucleotide sequence of VGAM2329 RNA, herein designated VGAM RNA, also designated SEQ ID:5040.

Another function of VGAM2329 is therefore inhibition of Tumor Necrosis Factor Receptor Superfamily, Member 1B (TNFRSF1B, Accession NM_001066), a gene which mediates proinflammatory cellular responses. Accordingly, utilities of VGAM2329 include diagnosis, prevention and treatment of diseases and clinical conditions associated with TNFRSF1B. The function of TNFRSF1B and its association with various diseases and clinical conditions, has been established by previous studies, as described hereinabove with reference to VGAM939. Chromosome 1 Open Reading Frame 24 (C1orf24, Accession NM_052966) is another VGAM2329 host target gene. C1orf24 BINDING SITE is HOST TARGET binding site found in the 3' untranslated region of mRNA encoded by C1orf24, corresponding to a HOST TARGET binding site such as BINDING SITE I, BINDING SITE II or BINDING SITE III. Table 2 illustrates the complementarity of the nucleotide sequences of C1orf24 BINDING SITE, designated SEQ ID:27525, to the nucleotide sequence of VGAM2329 RNA, herein designated VGAM RNA, also designated SEQ ID:5040.

Another function of VGAM2329 is therefore inhibition of Chromosome 1 Open Reading Frame 24 (C1orf24, Accession NM_052966). Accordingly, utilities of VGAM2329 include diagnosis, prevention and treatment of diseases and clinical conditions associated with C1orf24. DKFZP564O123 (Accession XM_002810) is another VGAM2329 host target gene. DKFZP564O123 BINDING SITE is HOST TARGET binding site found in the 3' untranslated region of mRNA encoded by DKFZP564O123, corresponding to a HOST TARGET binding site such as BINDING SITE I, BINDING SITE II or BINDING SITE III. Table 2 illustrates the complementarity of the nucleotide sequences of DKFZP564O123 BINDING SITE, designated SEQ ID:29904, to the nucleotide sequence of VGAM2329 RNA, herein designated VGAM RNA, also designated SEQ ID:5040.

Another function of VGAM2329 is therefore inhibition of DKFZP564O123 (Accession XM_002810). Accordingly, utilities of VGAM2329 include diagnosis, prevention and treatment of diseases and clinical conditions associated with DKFZP564O123. KIAA1560 (Accession XM_034422) is another VGAM2329 host target gene. KIAA1560 BINDING SITE is HOST TARGET binding site found in the 3' untranslated region of mRNA encoded by KIAA1560, corresponding to a HOST TARGET binding site such as BINDING SITE I, BINDING SITE II or BINDING SITE III. Table 2 illustrates the complementarity of the nucleotide sequences of KIAA1560 BINDING SITE, designated SEQ ID:32097, to the nucleotide sequence of VGAM2329 RNA, herein designated VGAM RNA, also designated SEQ ID:5040.

Another function of VGAM2329 is therefore inhibition of KIAA1560 (Accession XM_034422). Accordingly, utilities of VGAM2329 include diagnosis, prevention and treatment of diseases and clinical conditions associated with KIAA1560. MGC3222 (Accession NM_024334) is another VGAM2329 host target gene. MGC3222 BINDING SITE is HOST TARGET binding site found in the 3' untranslated region of mRNA encoded by MGC3222, corresponding to a HOST TARGET binding site such as BINDING SITE I, BINDING SITE II or BINDING SITE III. Table 2 illustrates the complementarity of the nucleotide sequences of MGC3222 BINDING SITE, designated SEQ ID:23640, to the nucleotide sequence of VGAM2329 RNA, herein designated VGAM RNA, also designated SEQ ID:5040.

Another function of VGAM2329 is therefore inhibition of MGC3222 (Accession NM_024334). Accordingly, utilities of VGAM2329 include diagnosis, prevention and treatment of diseases and clinical conditions associated with MGC3222. Peroxisomal Membrane Protein 4, 24 kDa (PXMP4, Accession NM_007238) is another VGAM2329 host target gene. PXMP4 BINDING SITE is HOST TARGET binding site found in the 3' untranslated region of mRNA encoded by PXMP4, corresponding to a HOST TARGET binding site such as BINDING SITE I, BINDING SITE II or BINDING SITE III. Table 2 illustrates the complementarity of the nucleotide sequences of PXMP4 BINDING SITE, designated SEQ ID:14110, to the nucleotide sequence of VGAM2329 RNA, herein designated VGAM RNA, also designated SEQ ID:5040.

Another function of VGAM2329 is therefore inhibition of Peroxisomal Membrane Protein 4, 24 kDa (PXMP4, Accession NM_007238). Accordingly, utilities of VGAM2329 include diagnosis, prevention and treatment of diseases and clinical conditions associated with PXMP4. Rab11-FIP2 (Accession NM_014904) is another VGAM2329 host target gene. Rab11-FIP2 BINDING SITE is HOST TARGET binding site found in the 3" untranslated region of mRNA encoded by Rab11-FIP2, corresponding to a HOST TARGET binding site such as BINDING SITE I, BINDING SITE II or BINDING SITE III. Table 2 illustrates the complementarity of the nucleotide sequences of Rab11-FIP2 BINDING SITE, designated SEQ ID:17093, to the nucleotide sequence of VGAM2329 RNA, herein designated VGAM RNA, also designated SEQ ID:5040.

Another function of VGAM2329 is therefore inhibition of Rab11-FIP2 (Accession NM_014904). Accordingly, utilities of VGAM2329 include diagnosis, prevention and treatment of diseases and clinical conditions associated with Rab11-FIP2. Rabip4R (Accession NM_017987) is another VGAM2329 host target gene. Rabip4R BINDING SITE is HOST TARGET binding site found in the 3' untranslated region of mRNA encoded by Rabip4R, corresponding to a HOST TARGET binding site such as BINDING SITE I, BINDING SITE II or BINDING SITE III. Table 2 illustrates the complementarity of the nucleotide sequences of Rabip4R BINDING SITE, designated SEQ ID:19714, to the nucleotide sequence of VGAM2329 RNA, herein designated VGAM RNA, also designated SEQ ID:5040.

Another function of VGAM2329 is therefore inhibition of Rabip4R (Accession NM_017987). Accordingly, utilities of VGAM2329 include diagnosis, prevention and treatment of diseases and clinical conditions associated with Rabip4R. Rho-related BTB Domain Containing 1 (RHOBTB1, Accession XM_166144) is another VGAM2329 host target gene. RHOBTB1 BINDING SITE is HOST TARGET binding site found in the 3' untranslated region of mRNA encoded by RHOBTB1, corresponding to a HOST TARGET binding site such as BINDING SITE I, BINDING SITE II or BINDING SITE III. Table 2 illustrates the complementarity of the nucleotide sequences of RHOBTB1 BINDING SITE, designated SEQ ID:43948, to the nucleotide sequence of VGAM2329 RNA, herein designated VGAM RNA, also designated SEQ ID:5040.

Another function of VGAM2329 is therefore inhibition of Rho-related BTB Domain Containing 1 (RHOBTB1, Accession XM_166144). Accordingly, utilities of VGAM2329 include diagnosis, prevention and treatment of diseases and clinical conditions associated with RHOBTB1. Solute Carrier Family 1 (glutamate transporter), Member 7 (SLC1A7, Accession NM_006671) is another VGAM2329 host target gene. SLC1A7 BINDING SITE is HOST TARGET binding site found in the 3' untranslated region of mRNA encoded by SLC1A7, corresponding to a HOST TARGET binding site such as BINDING SITE I, BINDING SITE II or BINDING SITE III. Table 2 illustrates the complementarity of the nucleotide sequences of SLC1A7 BINDING SITE, designated SEQ ID:13487, to the nucleotide sequence of VGAM2329 RNA, herein designated VGAM RNA, also designated SEQ ID:5040.

Another function of VGAM2329 is therefore inhibition of Solute Carrier Family 1 (glutamate transporter), Member 7 (SLC1A7, Accession NM_006671). Accordingly, utilities of VGAM2329 include diagnosis, prevention and treatment of diseases and clinical conditions associated with SLC1A7. SMT3 Suppressor of Mif Two 3 Homolog 2 (yeast) (SMT3H2, Accession NM_006937) is another VGAM2329 host target gene. SMT3H2 BINDING SITE is HOST TARGET binding site found in the 3' untranslated region of mRNA encoded by SMT3H2, corresponding to a HOST TARGET binding site such as BINDING SITE I, BINDING SITE II or BINDING SITE III. Table 2 illustrates the complementarity of the nucleotide sequences of SMT3H2 BINDING SITE, designated SEQ ID:13818, to the nucleotide sequence of VGAM2329 RNA, herein designated VGAM RNA, also designated SEQ ID:5040.

Another function of VGAM2329 is therefore inhibition of SMT3 Suppressor of Mif Two 3 Homolog 2 (yeast) (SMT3H2, Accession NM_006937). Accordingly, utilities of VGAM2329 include diagnosis, prevention and treatment of diseases and clinical conditions associated with SMT3H2. LOC112687 (Accession XM_053145) is another VGAM2329 host target gene. LOC112687 BINDING SITE is HOST TARGET binding site found in the 3' untranslated region of mRNA encoded by LOC112687, corresponding to a HOST TARGET binding site such as BINDING SITE I, BINDING SITE II or BINDING SITE III. Table 2 illustrates the complementarity of the nucleotide sequences of LOC112687 BINDING SITE, designated SEQ ID:36063, to the nucleotide sequence of VGAM2329 RNA, herein designated VGAM RNA, also designated SEQ ID:5040.

Another function of VGAM2329 is therefore inhibition of LOC112687 (Accession XM_053145). Accordingly, utilities of VGAM2329 include diagnosis, prevention and treatment of diseases and clinical conditions associated with LOC112687. LOC143154 (Accession XM_084441) is another VGAM2329 host target gene. LOC143154 BINDING SITE is HOST TARGET binding site found in the 3' untranslated region of mRNA encoded by LOC143154, corresponding to a HOST TARGET binding site such as BINDING SITE I, BINDING SITE II or BINDING SITE III. Table 2 illustrates the complementarity of the nucleotide sequences of LOC143154 BINDING SITE, designated SEQ ID:37583, to the nucleotide sequence of VGAM2329 RNA, herein designated VGAM RNA, also designated SEQ ID:5040.

Another function of VGAM2329 is therefore inhibition of LOC143154 (Accession XM_084441). Accordingly, utilities of VGAM2329 include diagnosis, prevention and treatment of diseases and clinical conditions associated with LOC143154. LOC144262 (Accession XM_084793) is another VGAM2329 host target gene. LOC144262 BINDING SITE is HOST TARGET binding site found in the 5' untranslated region of mRNA encoded by LOC144262, corresponding to a HOST TARGET binding site such as BINDING SITE I, BINDING SITE II or BINDING SITE III. Table 2 illustrates the complementarity of the nucleotide sequences of LOC144262 BINDING SITE, designated SEQ ID:37703, to the nucleotide sequence of VGAM2329 RNA, herein designated VGAM RNA, also designated SEQ ID:5040.

Another function of VGAM2329 is therefore inhibition of LOC144262 (Accession XM_084793). Accordingly, utilities of VGAM2329 include diagnosis, prevention and treatment of diseases and clinical conditions associated with LOC144262. LOC151632 (Accession XM_098098) is another VGAM2329 host target gene. LOC151632 BINDING SITE is HOST TARGET binding site found in the 5' untranslated region of mRNA encoded by LOC151632, corresponding to a HOST TARGET binding site such as BINDING SITE I, BINDING SITE II or BINDING SITE III. Table 2 illustrates the complementarity of the nucleotide sequences of LOC151632 BINDING SITE, designated SEQ ID:41380, to the nucleotide sequence of VGAM2329 RNA, herein designated VGAM RNA, also designated SEQ ID:5040.

Another function of VGAM2329 is therefore inhibition of LOC151632 (Accession XM_098098). Accordingly, utilities of VGAM2329 include diagnosis, prevention and treatment of diseases and clinical conditions associated with LOC151632. LOC152271 (Accession XM_087419) is another VGAM2329 host target gene. LOC152271 BINDING SITE is HOST TARGET binding site found in the 3' untranslated region of mRNA encoded by LOC152271, corresponding to a HOST TARGET binding site such as BINDING SITE I, BINDING SITE II or BINDING SITE III. Table 2 illustrates the complementarity of the nucleotide sequences of LOC152271 BINDING SITE, designated SEQ ID:39237, to the nucleotide sequence of VGAM2329 RNA, herein designated VGAM RNA, also designated SEQ ID:5040.

Another function of VGAM2329 is therefore inhibition of LOC152271 (Accession XM_087419). Accordingly, utilities of VGAM2329 include diagnosis, prevention and treatment of diseases and clinical conditions associated with LOC152271. LOC158434 (Accession XM_098939) is another VGAM2329 host target gene. LOC158434 BINDING SITE is HOST TARGET binding site found in the 5' untranslated region of mRNA encoded by LOC158434, corresponding to a HOST TARGET binding site such as BINDING SITE I, BINDING SITE II or BINDING SITE III. Table 2 illustrates the complementarity of the nucleotide sequences of LOC158434 BINDING SITE, designated SEQ ID:41980, to the nucleotide sequence of VGAM2329 RNA, herein designated VGAM RNA, also designated SEQ ID:5040.

Another function of VGAM2329 is therefore inhibition of LOC158434 (Accession XM_098939). Accordingly, utilities of VGAM2329 include diagnosis, prevention and treatment of diseases and clinical conditions associated with LOC158434. LOC158662 (Accession XM_088633) is another VGAM2329 host target gene. LOC158662 BINDING SITE is HOST TARGET binding site found in the 5' untranslated region of mRNA encoded by LOC158662, corresponding to a HOST TARGET binding site such as BINDING SITE I, BINDING SITE II or BINDING SITE III. Table 2 illustrates the complementarity of the nucleotide sequences of LOC158662 BINDING SITE, designated SEQ ID:39879, to the nucleotide sequence of VGAM2329 RNA, herein designated VGAM RNA, also designated SEQ ID:5040.

Another function of VGAM2329 is therefore inhibition of LOC158662 (Accession XM_088633). Accordingly, utilities of VGAM2329 include diagnosis, prevention and treatment of diseases and clinical conditions associated with LOC158662. LOC200904 (Accession XM_117291) is another VGAM2329 host target gene. LOC200904 BINDING SITE is HOST TARGET binding site found in the 5' untranslated region of mRNA encoded by LOC200904, corresponding to a HOST TARGET binding site such as BINDING SITE I, BINDING SITE II or BINDING SITE III. Table 2 illustrates the complementarity of the nucleotide sequences of LOC200904 BINDING SITE, designated SEQ ID:43359, to the nucleotide sequence of VGAM2329 RNA, herein designated VGAM RNA, also designated SEQ ID:5040.

Another function of VGAM2329 is therefore inhibition of LOC200904 (Accession XM_117291). Accordingly, utilities of VGAM2329 include diagnosis, prevention and treatment of diseases and clinical conditions associated with LOC200904. LOC201824 (Accession XM_114384) is another VGAM2329 host target gene. LOC201824 BINDING SITE is HOST TARGET binding site found in the 3' untranslated region of mRNA encoded by LOC201824, corresponding to a HOST TARGET binding site such as BINDING SITE I, BINDING SITE II or BINDING SITE III. Table 2 illustrates the complementarity of the nucleotide sequences of LOC201824 BINDING SITE, designated SEQ ID:42919, to the nucleotide sequence of VGAM2329 RNA, herein designated VGAM RNA, also designated SEQ ID:5040.

Another function of VGAM2329 is therefore inhibition of LOC201824 (Accession XM_114384). Accordingly, utilities of VGAM2329 include diagnosis, prevention and treatment of diseases and clinical conditions associated with LOC201824. LOC203083 (Accession XM_117496) is another VGAM2329 host target gene. LOC203083 BINDING SITE is HOST TARGET binding site found in the 5' untranslated region of mRNA encoded by LOC203083, corresponding to a HOST TARGET binding site such as BINDING SITE I, BINDING SITE II or BINDING SITE III. Table 2 illustrates the complementarity of the nucleotide sequences of LOC203083 BINDING SITE, designated SEQ ID:43476, to the nucleotide sequence of VGAM2329 RNA, herein designated VGAM RNA, also designated SEQ ID:5040.

Another function of VGAM2329 is therefore inhibition of LOC203083 (Accession XM_117496). Accordingly, utilities of VGAM2329 include diagnosis, prevention and treatment of diseases and clinical conditions associated with LOC203083. LOC219294 (Accession XM_167566) is another VGAM2329 host target gene. LOC219294 BINDING SITE is HOST TARGET binding site found in the 3' untranslated region of mRNA encoded by LOC219294, corresponding to a HOST TARGET binding site such as BINDING SITE I, BINDING SITE II or BINDING SITE III. Table 2 illustrates the complementarity of the nucleotide sequences of LOC219294 BINDING SITE, designated SEQ ID:44684, to the nucleotide sequence of VGAM2329 RNA, herein designated VGAM RNA, also designated SEQ ID:5040.

Another function of VGAM2329 is therefore inhibition of LOC219294 (Accession XM_167566). Accordingly, utilities of VGAM2329 include diagnosis, prevention and treatment of diseases and clinical conditions associated with LOC219294. LOC219300 (Accession XM_168749) is another VGAM2329 host target gene. LOC219300 BINDING SITE is HOST TARGET binding site found in the 5' untranslated region of mRNA encoded by LOC219300, corresponding to a HOST TARGET binding site such as BINDING SITE I, BINDING SITE II or BINDING SITE III. Table 2 illustrates the complementarity of the nucleotide sequences of LOC219300 BINDING SITE, designated SEQ ID:45287, to the nucleotide sequence of VGAM2329 RNA, herein designated VGAM RNA, also designated SEQ ID:5040.

Another function of VGAM2329 is therefore inhibition of LOC219300 (Accession XM_168749). Accordingly, utilities of VGAM2329 include diagnosis, prevention and treatment of diseases and clinical conditions associated with LOC219300. LOC219919 (Accession XM_167785) is another VGAM2329 host target gene. LOC219919 BINDING SITE is HOST TARGET binding site found in the 5' untranslated region of mRNA encoded by LOC219919, corresponding to a HOST TARGET binding site such as BINDING SITE I, BINDING SITE II or BINDING SITE III. Table 2 illustrates the complementarity of the nucleotide sequences of LOC219919 BINDING SITE, designated SEQ ID:44798, to the nucleotide sequence of VGAM2329 RNA, herein designated VGAM RNA, also designated SEQ ID:5040.

Another function of VGAM2329 is therefore inhibition of LOC219919 (Accession XM_167785). Accordingly, utilities of VGAM2329 include diagnosis, prevention and treatment of diseases and clinical conditions associated with LOC219919. LOC254176 (Accession XM_173215) is another VGAM2329 host target gene. LOC254176 BINDING SITE is HOST TARGET binding site found in the 5' untranslated region of mRNA encoded by LOC254176, corresponding to a HOST TARGET binding site such as BINDING SITE I, BINDING SITE II or BINDING SITE III. Table 2 illustrates the complementarity of the nucleotide sequences of LOC254176 BINDING SITE, designated SEQ ID:46473, to the nucleotide sequence of VGAM2329 RNA, herein designated VGAM RNA, also designated SEQ ID:5040.

Another function of VGAM2329 is therefore inhibition of LOC254176 (Accession XM_173215). Accordingly, utilities of VGAM2329 include diagnosis, prevention and treatment of diseases and clinical conditions associated with LOC254176. LOC255327 (Accession XM_171236) is another VGAM2329 host target gene. LOC255327 BINDING SITE is HOST TARGET binding site found in the 5' untranslated region of mRNA encoded by LOC255327, corresponding to a HOST TARGET binding site such as BINDING SITE I, BINDING SITE II or BINDING SITE III. Table 2 illustrates the complementarity of the nucleotide sequences of LOC255327 BINDING SITE, designated SEQ ID:46021, to the nucleotide sequence of VGAM2329 RNA, herein designated VGAM RNA, also designated SEQ ID:5040.

Another function of VGAM2329 is therefore inhibition of LOC255327 (Accession XM_171236). Accordingly, utilities of VGAM2329 include diagnosis, prevention and treatment of diseases and clinical conditions associated with LOC255327. LOC256594 (Accession XM_173127) is another VGAM2329 host target gene. LOC256594 BINDING SITE is HOST TARGET binding site found in the 5' untranslated region of mRNA encoded by LOC256594, corresponding to a HOST TARGET binding site such as BINDING SITE I, BINDING SITE II or BINDING SITE III. Table 2 illustrates the complementarity of the nucleotide sequences of LOC256594 BINDING SITE, designated SEQ ID:46376, to the nucleotide sequence of VGAM2329 RNA, herein designated VGAM RNA, also designated SEQ ID:5040.

Another function of VGAM2329 is therefore inhibition of LOC256594 (Accession XM_173127). Accordingly, utilities of VGAM2329 include diagnosis, prevention and treatment of diseases and clinical conditions associated with LOC256594. LOC51301 (Accession NM_016591) is another VGAM2329 host target gene. LOC51301 BINDING SITE is HOST TARGET binding site found in the 5' untranslated region of mRNA encoded by LOC51301, corresponding to a HOST TARGET binding site such as BINDING SITE I, BINDING SITE II or BINDING SITE III. Table 2 illustrates the complementarity of the nucleotide sequences of LOC51301 BINDING SITE, designated SEQ ID:18668, to the nucleotide sequence of VGAM2329 RNA, herein designated VGAM RNA, also designated SEQ ID:5040.

Another function of VGAM2329 is therefore inhibition of LOC51301 (Accession NM_016591). Accordingly, utilities of VGAM2329 include diagnosis, prevention and treatment of diseases and clinical conditions associated with LOC51301. LOC90826 (Accession XM_034321) is another VGAM2329 host target gene. LOC90826 BINDING SITE is HOST TARGET binding site found in the 3' untranslated region of mRNA encoded by LOC90826, corresponding to a HOST TARGET binding site such as BINDING SITE I, BINDING SITE II or BINDING SITE III. Table 2 illustrates the complementarity of the nucleotide sequences of LOC90826 BINDING SITE, designated SEQ ID:32047, to the nucleotide sequence of VGAM2329 RNA, herein designated VGAM RNA, also designated SEQ ID:5040.

Another function of VGAM2329 is therefore inhibition of LOC90826 (Accession XM_034321). Accordingly, utilities of VGAM2329 include diagnosis, prevention and treatment of diseases and clinical conditions associated with LOC90826. LOC93206 (Accession XM_049838) is another VGAM2329 host target gene. LOC93206 BINDING SITE is HOST TARGET binding site found in the 3' untranslated region of mRNA encoded by LOC93206, corresponding to a HOST TARGET binding site such as BINDING SITE I, BINDING SITE II or BINDING SITE III. Table 2 illustrates the complementarity of the nucleotide sequences of LOC93206 BINDING SITE, designated SEQ ID:35514, to the nucleotide sequence of VGAM2329 RNA, herein designated VGAM RNA, also designated SEQ ID:5040.

Another function of VGAM2329 is therefore inhibition of LOC93206 (Accession XM_049838). Accordingly, utilities of VGAM2329 include diagnosis, prevention and treatment of diseases and clinical conditions associated with LOC93206. FIG. 1 further provides a conceptual description of a novel bioinformatically detected viral gene of the present invention, referred to here as Viral Genomic Address Messenger 2330 (VGAM2330) viral gene, which modulates expression of respective host target genes thereof, the function and utility of which host target genes is known in the art.

VGAM2330 is a novel bioinformatically detected regulatory, non protein coding, viral micro RNA (miRNA) gene. The method by which VGAM2330 was detected is described hereinabove with reference to FIGS. 1-8.

VGAM2330 gene, herein designated VGAM GENE, is a viral gene contained in the genome of Equine Herpesvirus 2. VGAM2330 host target gene, herein designated VGAM HOST TARGET GENE, is a human gene contained in the human genome.

VGAM2330 gene encodes a VGAM2330 precursor RNA, herein designated VGAM PRECURSOR RNA. Similar to other miRNA genes, and unlike most ordinary genes, VGAM2330 precursor RNA does not encode a protein. A nucleotide sequence identical or highly similar to the nucleotide sequence of VGAM2330 precursor RNA is designated SEQ ID:2316, and is provided hereinbelow with reference to the sequence listing part. Nucleotide sequence SEQ ID:2316 is located at position 1147 relative to the genome of Equine Herpesvirus 2.

VGAM2330 precursor RNA folds onto itself, forming VGAM2330 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2330 folded precursor RNA into VGAM2330 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM2330 RNA is designated SEQ ID:5041, and is provided hereinbelow with reference to the sequence listing part.

VGAM2330 host target gene, herein designated VGAM HOST TARGET GENE, encodes a corresponding messenger RNA, VGAM2330 host target RNA, herein designated VGAM HOST TARGET RNA. VGAM2330 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2330 RNA, herein designated VGAM RNA, binds complementarily to one or more host target binding sites located in untranslated regions of VGAM2330 host target RNA, herein designated VGAM HOST TARGET RNA. This complementary binding is due to the fact that the nucleotide sequence of VGAM2330 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2330 RNA, herein designated VGAM RNA, may have a different number of host target binding sites in untranslated regions of a VGAM2330 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2330 RNA, herein designated VGAM RNA, to host target binding sites on VGAM2330 host target RNA, herein designated VGAM HOST TARGET RNA, such as BINDING SITE I, BINDING SITE II and BINDING SITE III, inhibits translation of VGAM2330 host target RNA into VGAM2330 host target protein, herein designated VGAM HOST TARGET PROTEIN. VGAM host target protein is therefore outlined by a broken line.

It is appreciated that VGAM2330 host target gene, herein designated VGAM HOST TARGET GENE, in fact represents a plurality of VGAM2330 host target genes. The mRNA of each one of this plurality of VGAM2330 host target genes comprises one or more host target binding sites, each having a nucleotide sequence which is at least partly complementary to VGAM2330 RNA, herein designated VGAM RNA, and which when bound by VGAM2330 RNA causes inhibition of translation of respective one or more VGAM2330 host target proteins.

It is further appreciated by one skilled in the art that the mode of translational inhibition illustrated by FIG. 1 with specific reference to translational inhibition exerted by VGAM2330 gene, herein designated VGAM GENE, on one or more VGAM2330 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2330 is inhibition of expression of host target genes, as part of a novel viral mechanism of attacking a host. Accordingly, utilities of VGAM2330 include diagnosis, prevention and treatment of viral infection by Equine Herpesvirus 2. Specific functions, and accordingly utilities, of VGAM2330 correlate with, and may be deduced from, the identity of the host target genes which VGAM2330 binds and inhibits, and the function of these host target genes, as elaborated hereinbelow.

Nucleotide sequences of the VGAM2330 precursor RNA, herein designated VGAM PRECURSOR RNA, and of the 'diced' VGAM2330 RNA, herein designated VGAM RNA, and a schematic representation of the secondary folding of VGAM2330 folded precursor RNA, herein designated VGAM FOLDED PRECURSOR RNA, of VGAM2330 are further described hereinbelow with reference to Table 1.

Nucleotide sequences of host target binding sites, such as BINDING SITE-I, BINDING SITE-II and BINDING SITE-III of FIG. 1, found on VGAM2330 host target RNA, and schematic representation of the complementarity of each of these host target binding sites to VGAM2330 RNA, herein designated VGAM RNA, are described hereinbelow with reference to Table 2.

As mentioned hereinabove with reference to FIG. 1, a function of VGAM2330 gene, herein designated VGAM is inhibition of expression of VGAM2330 target genes. It is appreciated that specific functions, and accordingly utilities, of VGAM2330 correlate with, and may be deduced from, the identity of the target genes which VGAM2330 binds and inhibits, and the function of these target genes, as elaborated hereinbelow.

AF5Q31 (Accession NM_014423) is a VGAM2330 host target gene. AF5Q31 BINDING SITE is HOST TARGET binding site found in the 5' untranslated region of mRNA encoded by AF5Q31, corresponding to a HOST TARGET binding site such as BINDING SITE I, BINDING SITE II or BINDING SITE III. Table 2 illustrates the complementarity of the nucleotide sequences of AF5Q31 BINDING SITE, designated SEQ ID:15778, to the nucleotide sequence of VGAM2330 RNA, herein designated VGAM RNA, also designated SEQ ID:5041.

A function of VGAM2330 is therefore inhibition of AF5Q31 (Accession NM_014423). Accordingly, utilities of VGAM2330 include diagnosis, prevention and treatment of diseases and clinical conditions associated with AF5Q31. Centromere Protein B, 80 kDa (CENPB, Accession XM_045451) is another VGAM2330 host target gene. CENPB BINDING SITE is HOST TARGET binding site found in the 3' untranslated region of mRNA encoded by CENPB, corresponding to a HOST TARGET binding site such as BINDING SITE I, BINDING SITE II or BINDING SITE III. Table 2 illustrates the complementarity of the nucleotide sequences of CENPB BINDING SITE, designated SEQ ID:34465, to the nucleotide sequence of VGAM2330 RNA, herein designated VGAM RNA, also designated SEQ ID:5041.

Another function of VGAM2330 is therefore inhibition of Centromere Protein B, 80 kDa (CENPB, Accession XM_045451), a gene which is the major centromere antigen. Accordingly, utilities of VGAM2330 include diagnosis, prevention and treatment of diseases and clinical conditions associated with CENPB. The function of CENPB and its association with various diseases and clinical conditions, has been established by previous studies, as described hereinabove with reference to VGAM206. Cysteine and Glycine-rich Protein 1 (CSRP1, Accession NM_004078) is another VGAM2330 host target gene. CSRP1 BINDING SITE is HOST TARGET binding site found in the 3' untranslated region of mRNA encoded by CSRP1, corresponding to a HOST TARGET binding site such as BINDING SITE I, BINDING SITE II or BINDING SITE III. Table 2 illustrates the complementarity of the nucleotide sequences of CSRP1 BINDING SITE, designated SEQ ID:10279, to the nucleotide sequence of VGAM2330 RNA, herein designated VGAM RNA, also designated SEQ ID:5041.

Another function of VGAM2330 is therefore inhibition of Cysteine and Glycine-rich Protein 1 (CSRP1, Accession NM_004078), a gene which could play a role in neuronal development. Accordingly, utilities of VGAM2330 include diagnosis, prevention and treatment of diseases and clinical conditions associated with CSRP1. The function of CSRP1 and its association with various diseases and clinical conditions, has been established by previous studies, as described hereinabove with reference to VGAM743. EphA8 (EPHA8, Accession NM_020526) is another VGAM2330 host target gene. EPHA8 BINDING SITE is HOST TARGET binding site found in the 3' untranslated region of mRNA encoded by EPHA8, corresponding to a HOST TARGET binding site such as BINDING SITE I, BINDING SITE II or BINDING SITE III. Table 2 illustrates the complementarity of the nucleotide sequences of EPHA8 BINDING SITE, designated SEQ ID:21750, to the nucleotide sequence of VGAM2330 RNA, herein designated VGAM RNA, also designated SEQ ID:5041.

Another function of VGAM2330 is therefore inhibition of EphA8 (EPHA8, Accession NM_020526), a gene which Eph-related receptor tyrosine kinase A8. Accordingly, utilities of VGAM2330 include diagnosis, prevention and treatment of diseases and clinical conditions associated with EPHA8. The function of EPHA8 and its association with various diseases and clinical conditions, has been established by previous studies, as described hereinabove with reference to VGAM494. Glutamate Decarboxylase 1 (brain, 67 kDa) (GAD1, Accession NM_000817) is another VGAM2330 host target gene. GAD1 BINDING SITE is HOST TARGET binding site found in the 5' untranslated region of mRNA encoded by GAD1, corresponding to a HOST TARGET binding site such as BINDING SITE I, BINDING SITE II or BINDING SITE III. Table 2 illustrates the complementarity of the nucleotide sequences of GAD1 BINDING SITE, designated SEQ ID:6480, to the nucleotide sequence of VGAM2330 RNA, herein designated VGAM RNA, also designated SEQ ID:5041.

Another function of VGAM2330 is therefore inhibition of Glutamate Decarboxylase 1 (brain, 67 kDa) (GAD1, Accession NM_000817), a gene which catalyzes the conversion of glutamic acid to gamma-aminobutyric acid. Accordingly, utilities of VGAM2330 include diagnosis, prevention and treatment of diseases and clinical conditions associated with GAD1. The function of GAD1 and its association with various diseases and clinical conditions, has been established by previous studies, as described hereinabove with reference to VGAM691. Homeo Box C9 (HOXC9, Accession XM_028620) is another VGAM2330 host target gene. HOXC9 BINDING SITE is HOST TARGET binding site found in the 3' untranslated region of mRNA encoded by HOXC9, corresponding to a HOST TARGET binding site such as BINDING SITE I, BINDING SITE II or BINDING SITE III. Table 2 illustrates the complementarity of the nucleotide sequences of HOXC9 BINDING SITE, designated SEQ ID:30719, to the nucleotide sequence of VGAM2330 RNA, herein designated VGAM RNA, also designated SEQ ID:5041.

Another function of VGAM2330 is therefore inhibition of Homeo Box C9 (HOXC9, Accession XM_028620). Accordingly, utilities of VGAM2330 include diagnosis, prevention and treatment of diseases and clinical conditions associated with HOXC9. Kangai 1 (suppression of tumorigenicity 6, prostate; CD82 antigen (R2 leukocyte antigen, antigen detected by monoclonal and antibody IA4)) (KAI1, Accession NM_002231) is another VGAM2330 host target gene. KAI1 BINDING SITE is HOST TARGET binding site found in the 3' untranslated region of mRNA encoded by KAI1, corresponding to a HOST TARGET binding site such as BINDING SITE I, BINDING SITE II or BINDING SITE III. Table 2 illustrates the complementarity of the nucleotide sequences of KAI1 BINDING SITE, designated SEQ ID:8012, to the nucleotide sequence of VGAM2330 RNA, herein designated VGAM RNA, also designated SEQ ID:5041.

Another function of VGAM2330 is therefore inhibition of Kangai 1 (suppression of tumorigenicity 6, prostate; CD82 antigen (R2 leukocyte antigen, antigen detected by monoclonal and antibody IA4)) (KAI1, Accession NM_002231), a gene which associates with cd4 or cd8 and delivers costimulatory signals for the tcr/cd3 pathway. Accordingly, utilities of VGAM2330 include diagnosis, prevention and treatment of diseases and clinical conditions associated with KAI1. The function of KAI1 has been established by previous studies. As noted, KAI1 is capable of inhibiting the metastatic process in experimental animals. The expression of the KAI1 gene is also downregulated during tumor progression of prostate, breast, lung, bladder, and pancreatic cancers in human S, and this down regulation appears to be at the level of transcription or posttranscription. Mashimo et al. (1998) found that the tumor suppressor gene p53 (TP53; 191170) can directly activate the KAI1 gene by interacting with the 5-prime upstream region. The p53 responding region is located approximately 860 bases upstream of the transcriptional initiation site, and contains a typical tandem repeat of the p53 consensus binding sequence. Mutations of this sequence abolish the responsiveness to p53 and also the ability to bind to p53 protein. Immunohistochemical analysis of 177 samples of human prostate tumors showed that the expression of the KAI1 gene correlated strongly with that of the p53 gene and that the loss of these 2 markers resulted in poor survival of patients. The data indicated a direct relationship between p53 and KAI1 genes and suggested that the loss of p53 function, which is commonly observed in many types of cancer, leads to down regulation of the KAI1 gene, which may result in progression of metastases Baek et al. (2002) demonstrated that interleukin-1-beta (IL1B; 147720) causes nuclear export of a specific NCOR (OMIM Ref. No. 600849) corepressor complex, resulting in derepression of a specific subset of nuclear factor-kappa-B (NFKB; OMIM Ref. No. 164011)-regulated genes. These genes are exemplified by the tetraspanin KAI1, which regulates membrane receptor function. Nuclear export of the NCOR/TAB2 (OMIM Ref. No. 605101)/HDAC3 (OMIM Ref. No. 605166) complex by IL1B is temporally linked to selective recruitment of a TIP60 (OMIM Ref. No. 601409) coactivator complex. KAI1 is also directly activated by a ternary complex, dependent on the acetyltransferase activity of TIP60, that consists of the presenilin-dependent C-terminal cleavage product of the beta amyloid precursor protein (APP; 104760), FE65 (OMIM Ref. No. 602709), and TIP60, identifying a specific in vivo gene target of an APP-dependent transcription complex in the brain Full details of the abovementioned studies are described in the following publications, the disclosure of which are hereby incorporated by reference:

Mashimo, T.; Watabe, M.; Hirota, S.; Hosobe, S.; Miura, K.; Tegtmeyer, P. J.; Rinker-Shaeffer, C. W.; Watabe, K.: The expression of the KAI1 gene, a tumor metastasis suppressor, is directly activated by p53. Proc. Nat. Acad. Sci. 95:11307-11311, 1998; and Baek, S. H.; Ohgi, K. A.; Rose, D. W.; Koo, E. H.; Glass, C. K.; Rosenfeld, M. G. : Exchange of N-CoR corepressor and Tip60 coactivator complexes links gene expression by NF-kappa-B and.

Further studies establishing the function and utilities of KAI1 are found in John Hopkins OMIM database record ID 600623, and in sited publications numbered 481, 6562-6564, 1635-1636, 6565-656 and 5081 listed in the bibliography section hereinbelow, which are also hereby incorporated by reference. Paired Box Gene 2 (PAX2, Accession NM_003987) is another VGAM2330 host target gene. PAX2 BINDING SITE1 and PAX2 BINDING SITE2 are HOST TARGET binding sites found in untranslated regions of mRNA encoded by PAX2, corresponding to HOST TARGET binding sites such as BINDING SITE I, BINDING SITE II or BINDING SITE III. Table 2 illustrates the complementarity of the nucleotide sequences of PAX2 BINDING SITE1 and PAX2 BINDING SITE2, designated SEQ ID:10139 and SEQ ID:10145 respectively, to the nucleotide sequence of VGAM2330 RNA, herein designated VGAM RNA, also designated SEQ ID:5041.

Another function of VGAM2330 is therefore inhibition of Paired Box Gene 2 (PAX2, Accession NM_003987), a gene which involves in kidney cell differentiation. Accordingly, utilities of VGAM2330 include diagnosis, prevention and treatment of diseases and clinical conditions associated with PAX2. The function of PAX2 and its association with various diseases and clinical conditions, has been established by previous studies, as described hereinabove with reference to VGAM407. PCTAIRE Protein Kinase 1 (PCTK1, Accession NM_033019) is another VGAM2330 host target gene. PCTK1 BINDING SITE1 through PCTK1 BINDING SITE3 are HOST TARGET binding sites found in untranslated regions of mRNA encoded by PCTK1, corresponding to HOST TARGET binding sites such as BINDING SITE I, BINDING SITE II or BINDING SITE III. Table 2 illustrates the complementarity of the nucleotide sequences of PCTK1 BINDING SITE1 through PCTK1 BINDING SITE3, designated SEQ ID:26914, SEQ ID:12873 and SEQ ID:12875 respectively, to the nucleotide sequence of VGAM2330 RNA, herein designated VGAM RNA, also designated SEQ ID:5041.

Another function of VGAM2330 is therefore inhibition of PCTAIRE Protein Kinase 1 (PCTK1, Accession NM_033019), a gene which may play a role in signal transduction cascades in terminally differentiated cells. Accordingly, utilities of VGAM2330 include diagnosis, prevention and treatment of diseases and clinical conditions associated with PCTK1. The function of PCTK1 and its association with various diseases and clinical conditions, has been established by previous studies, as described hereinabove with reference to VGAM75. Profilin 2 (PFN2, Accession NM_002628) is another VGAM2330 host target gene. PFN2 BINDING SITE1 and PFN2 BINDING SITE2 are HOST TARGET binding sites found in untranslated regions of mRNA encoded by PFN2, corresponding to HOST TARGET binding sites such as BINDING SITE I, BINDING SITE II or BINDING SITE III. Table 2 illustrates the complementarity of the nucleotide sequences of PFN2 BINDING SITE1 and PFN2 BINDING SITE2, designated SEQ ID:8489 and SEQ ID:12745 respectively, to the nucleotide sequence of VGAM2330 RNA, herein designated VGAM RNA, also designated SEQ ID:5041.

Another function of VGAM2330 is therefore inhibition of Profilin 2 (PFN2, Accession NM_002628). Accordingly, utilities of VGAM2330 include diagnosis, prevention and treatment of diseases and clinical conditions associated with PFN2. Serine (or cysteine) Proteinase Inhibitor, Clade B (ovalbumin), Member 9 (SERPINB9, Accession NM_004155) is another VGAM2330 host target gene. SERPINB9 BINDING SITE is HOST TARGET binding site found in the 3' untranslated region of mRNA encoded by SERPINB9, corresponding to a HOST TARGET binding site such as BINDING SITE I, BINDING SITE II or BINDING SITE III. Table 2 illustrates the complementarity of the nucleotide sequences of SERPINB9 BINDING SITE, designated SEQ ID:10363, to the nucleotide sequence of VGAM2330 RNA, herein designated VGAM RNA, also designated SEQ ID:5041.

Another function of VGAM2330 is therefore inhibition of Serine (or cysteine) Proteinase Inhibitor, Clade B (ovalbumin), Member 9 (SERPINB9, Accession NM_004155), a gene which may be a serpin serine protease inhibitor that interacts with granzyme B (GZMB). Accordingly, utilities of VGAM2330 include diagnosis, prevention and treatment of diseases and clinical conditions associated with SERPINB9. The function of SERPINB9 and its association with various diseases and clinical conditions, has been established by previous studies, as described hereinabove with reference to VGAM60. V-ski Sarcoma Viral Oncogene Homolog (avian) (SKI, Accession NM_003036) is another VGAM2330 host target gene. SKI BINDING SITE is HOST TARGET binding site found in the 3' untranslated region of mRNA encoded by SKI, corresponding to a HOST TARGET binding site such as BINDING SITE I, BINDING SITE II or BINDING SITE III. Table 2 illustrates the complementarity of the nucleotide sequences of SKI BINDING SITE, designated SEQ ID:8989, to the nucleotide sequence of VGAM2330 RNA, herein designated VGAM RNA, also designated SEQ ID:5041.

Another function of VGAM2330 is therefore inhibition of V-ski Sarcoma Viral Oncogene Homolog (avian) (SKI, Accession NM_003036). Accordingly, utilities of VGAM2330 include diagnosis, prevention and treatment of diseases and clinical conditions associated with SKI. Tafazzin (cardiomyopathy, dilated 3A (X-linked); Endocardial Fibroelastosis 2; Barth Syndrome) (TAZ, Accession NM_000116) is another VGAM2330 host target gene. TAZ BINDING SITE is HOST TARGET binding site found in the 3' untranslated region of mRNA encoded by TAZ, corresponding to a HOST TARGET binding site such as BINDING SITE I, BINDING SITE II or BINDING SITE III. Table 2 illustrates the complementarity of the nucleotide sequences of TAZ BINDING SITE, designated SEQ ID:5588, to the nucleotide sequence of VGAM2330 RNA, herein designated VGAM RNA, also designated SEQ ID:5041.

Another function of VGAM2330 is therefore inhibition of Tafazzin (cardiomyopathy, dilated 3A (X-linked); Endocardial Fibroelastosis 2; Barth Syndrome) (TAZ, Accession NM_000116). Accordingly, utilities of VGAM2330 include diagnosis, prevention and treatment of diseases and clinical conditions associated with TAZ. Translocase of Inner Mitochondrial Membrane 23 Homolog (yeast) (TIMM23, Accession XM_011891) is another VGAM2330 host target gene. TIMM23 BINDING SITE is HOST TARGET binding site found in the 3' untranslated region of mRNA encoded by TIMM23, corresponding to a HOST TARGET binding site such as BINDING SITE I, BINDING SITE II or BINDING SITE III. Table 2 illustrates the complementarity of the nucleotide sequences of TIMM23 BINDING SITE, designated SEQ ID:30197, to the nucleotide sequence of VGAM2330 RNA, herein designated VGAM RNA, also designated SEQ ID:5041.

Another function of VGAM2330 is therefore inhibition of Translocase of Inner Mitochondrial Membrane 23 Homolog (yeast) (TIMM23, Accession XM_011891), a gene which translocates nuclear-encoded proteins into the mitochondrion. Accordingly, utilities of VGAM2330 include diagnosis, prevention and treatment of diseases and clinical conditions associated with TIMM23. The function of TIMM23 and its association with various diseases and clinical conditions, has been established by previous studies, as described hereinabove with reference to VGAM1958. Chromosome 4 Open Reading Frame 6 (C4orf6, Accession NM_005750) is another VGAM2330 host target gene. C4orf6 BINDING SITE is HOST TARGET binding site found in the 5' untranslated region of mRNA encoded by C4orf6, corresponding to a HOST TARGET binding site such as BINDING SITE I, BINDING SITE II or BINDING SITE III. Table 2 illustrates the complementarity of the nucleotide sequences of C4orf6 BINDING SITE, designated SEQ ID:12311, to the nucleotide sequence of VGAM2330 RNA, herein designated VGAM RNA, also designated SEQ ID:5041.

Another function of VGAM2330 is therefore inhibition of Chromosome 4 Open Reading Frame 6 (C4orf6, Accession NM_005750). Accordingly, utilities of VGAM2330 include diagnosis, prevention and treatment of diseases and clinical conditions associated with C4orf6. DKFZP434K1772 (Accession XM_041936) is another VGAM2330 host target gene. DKFZP434K1772 BINDING SITE is HOST TARGET binding site found in the 3' untranslated region of mRNA encoded by DKFZP434K1772, corresponding to a HOST TARGET binding site such as BINDING SITE I, BINDING SITE II or BINDING SITE III. Table 2 illustrates the complementarity of the nucleotide sequences of DKFZP434K1772 BINDING SITE, designated SEQ ID:33633, to the nucleotide sequence of VGAM2330 RNA, herein designated VGAM RNA, also designated SEQ ID:5041.

Another function of VGAM2330 is therefore inhibition of DKFZP434K1772 (Accession XM_041936). Accordingly, utilities of VGAM2330 include diagnosis, prevention and treatment of diseases and clinical conditions associated with DKFZP434K1772. DKFZP564D172 (Accession NM_032042) is another VGAM2330 host target gene. DKFZP564D172 BINDING SITE is HOST TARGET binding site found in the 3' untranslated region of mRNA encoded by DKFZP564D172, corresponding to a HOST TARGET binding site such as BINDING SITE I, BINDING SITE II or BINDING SITE III. Table 2 illustrates the complementarity of the nucleotide sequences of DKFZP564D172 BINDING SITE, designated SEQ ID:25750, to the nucleotide sequence of VGAM2330 RNA, herein designated VGAM RNA, also designated SEQ ID:5041.

Another function of VGAM2330 is therefore inhibition of DKFZP564D172 (Accession NM_032042). Accordingly, utilities of VGAM2330 include diagnosis, prevention and treatment of diseases and clinical conditions associated with DKFZP564D172. E74-like Factor 4 (ets domain transcription factor) (ELF4, Accession NM_001421) is another VGAM2330 host target gene. ELF4 BINDING SITE is HOST TARGET binding site found in the 3' untranslated region of mRNA encoded by ELF4, corresponding to a HOST TARGET binding site such as BINDING SITE I, BINDING SITE II or BINDING SITE III. Table 2 illustrates the complementarity of the nucleotide sequences of ELF4 BINDING SITE, designated SEQ ID:7122, to the nucleotide sequence of VGAM2330 RNA, herein designated VGAM RNA, also designated SEQ ID:5041.

Another function of VGAM2330 is therefore inhibition of E74-like Factor 4 (ets domain transcription factor) (ELF4, Accession NM_001421). Accordingly, utilities of VGAM2330 include diagnosis, prevention and treatment of diseases and clinical conditions associated with ELF4. FLJ10206 (Accession NM_018025) is another VGAM2330 host target gene. FLJ10206 BINDING SITE is HOST TARGET binding site found in the 5' untranslated region of mRNA encoded by FLJ10206, corresponding to a HOST TARGET binding site such as BINDING SITE I, BINDING SITE II or BINDING SITE III. Table 2 illustrates the complementarity of the nucleotide sequences of FLJ10206 BINDING SITE, designated SEQ ID:19767, to the nucleotide sequence of VGAM2330 RNA, herein designated VGAM RNA, also designated SEQ ID:5041.

Another function of VGAM2330 is therefore inhibition of FLJ10206 (Accession NM_018025). Accordingly, utilities of VGAM2330 include diagnosis, prevention and treatment of diseases and clinical conditions associated with FLJ10206. FLJ13710 (Accession NM_024817) is another VGAM2330 host target gene. FLJ13710 BINDING SITE is HOST TARGET binding site found in the 3' untranslated region of mRNA encoded by FLJ13710, corresponding to a HOST TARGET binding site such as BINDING SITE I, BINDING SITE II or BINDING SITE III. Table 2 illustrates the complementarity of the nucleotide sequences of FLJ13710 BINDING SITE, designated SEQ ID:24205, to the nucleotide sequence of VGAM2330 RNA, herein designated VGAM RNA, also designated SEQ ID:5041.

Another function of VGAM2330 is therefore inhibition of FLJ13710 (Accession NM_024817). Accordingly, utilities of VGAM2330 include diagnosis, prevention and treatment of diseases and clinical conditions associated with FLJ13710. KIAA0022 (Accession NM_014880) is another VGAM2330 host target gene. KIAA0022 BINDING SITE is HOST TARGET binding site found in the 3' untranslated region of mRNA encoded by KIAA0022, corresponding to a HOST TARGET binding site such as BINDING SITE I, BINDING SITE II or BINDING SITE III. Table 2 illustrates the complementarity of the nucleotide sequences of KIAA0022 BINDING SITE, designated SEQ ID:17027, to the nucleotide sequence of VGAM2330 RNA, herein designated VGAM RNA, also designated SEQ ID:5041.

Another function of VGAM2330 is therefore inhibition of KIAA0022 (Accession NM_014880). Accordingly, utilities of VGAM2330 include diagnosis, prevention and treatment of diseases and clinical conditions associated with KIAA0022. KIAA0173 (Accession NM_014640) is another VGAM2330 host target gene. KIAA0173 BINDING SITE is HOST TARGET binding site found in the 3' untranslated region of mRNA encoded by KIAA0173, corresponding to a HOST TARGET binding site such as BINDING SITE I, BINDING SITE II or BINDING SITE III. Table 2 illustrates the complementarity of the nucleotide sequences of KIAA0173 BINDING SITE, designated SEQ ID:16039, to the nucleotide sequence of VGAM2330 RNA, herein designated VGAM RNA, also designated SEQ ID:5041.

Another function of VGAM2330 is therefore inhibition of KIAA0173 (Accession NM_014640). Accordingly, utilities of VGAM2330 include diagnosis, prevention and treatment of diseases and clinical conditions associated with KIAA0173. KIAA0515 (Accession XM_033380) is another VGAM2330 host target gene. KIAA0515 BINDING SITE is HOST TARGET binding site found in the 3' untranslated region of mRNA encoded by KIAA0515, corresponding to a HOST TARGET binding site such as BINDING SITE I, BINDING SITE II or BINDING SITE III. Table 2 illustrates the complementarity of the nucleotide sequences of KIAA0515 BINDING SITE, designated SEQ ID:31922, to the nucleotide sequence of VGAM2330 RNA, herein designated VGAM RNA, also designated SEQ ID:5041.

Another function of VGAM2330 is therefore inhibition of KIAA0515 (Accession XM_033380). Accordingly, utilities of VGAM2330 include diagnosis, prevention and treatment of diseases and clinical conditions associated with KIAA0515. KIAA0774 (Accession XM_166270) is another VGAM2330 host target gene. KIAA0774 BINDING SITE is HOST TARGET binding site found in the 5' untranslated region of mRNA encoded by KIAA0774, corresponding to a HOST TARGET binding site such as BINDING SITE I, BINDING SITE II or BINDING SITE III. Table 2 illustrates the complementarity of the nucleotide sequences of KIAA0774 BINDING SITE, designated SEQ ID:44090, to the nucleotide sequence of VGAM2330 RNA, herein designated VGAM RNA, also designated SEQ ID:5041.

Another function of VGAM2330 is therefore inhibition of KIAA0774 (Accession XM_166270). Accordingly, utilities of VGAM2330 include diagnosis, prevention and treatment of diseases and clinical conditions associated with KIAA0774. KIAA0819 (Accession XM_032996) is another VGAM2330 host target gene. KIAA0819 BINDING SITE is HOST TARGET binding site found in the 3' untranslated region of mRNA encoded by KIAA0819, corresponding to a HOST TARGET binding site such as BINDING SITE I, BINDING SITE II or BINDING SITE III. Table 2 illustrates the complementarity of the nucleotide sequences of KIAA0819 BINDING SITE, designated SEQ ID:31807, to the nucleotide sequence of VGAM2330 RNA, herein designated VGAM RNA, also designated SEQ ID:5041.

Another function of VGAM2330 is therefore inhibition of KIAA0819 (Accession XM_032996). Accordingly, utilities of VGAM2330 include diagnosis, prevention and treatment of diseases and clinical conditions associated with KIAA0819. KIAA1437 (Accession XM_026998) is another VGAM2330 host target gene. KIAA1437 BINDING SITE is HOST TARGET binding site found in the 5' untranslated region of mRNA encoded by KIAA1437, corresponding to a HOST TARGET binding site such as BINDING SITE I, BINDING SITE II or BINDING SITE III. Table 2 illustrates the complementarity of the nucleotide sequences of KIAA1437 BINDING SITE, designated SEQ ID:30387, to the nucleotide sequence of VGAM2330 RNA, herein designated VGAM RNA, also designated SEQ ID:5041.

Another function of VGAM2330 is therefore inhibition of KIAA1437 (Accession XM_026998). Accordingly, utilities of VGAM2330 include diagnosis, prevention and treatment of diseases and clinical conditions associated with KIAA1437. MGC20470 (Accession NM_145053) is another VGAM2330 host target gene. MGC20470 BINDING SITE is HOST TARGET binding site found in the 3' untranslated region of mRNA encoded by MGC20470, corresponding to a HOST TARGET binding site such as BINDING SITE I, BINDING SITE II or BINDING SITE III. Table 2 illustrates the complementarity of the nucleotide sequences of MGC20470 BINDING SITE, designated SEQ ID:29685, to the nucleotide sequence of VGAM2330 RNA, herein designated VGAM RNA, also designated SEQ ID:5041.

Another function of VGAM2330 is therefore inhibition of MGC20470 (Accession NM_145053). Accordingly, utilities of VGAM2330 include diagnosis, prevention and treatment of diseases and clinical conditions associated with MGC20470. MGC4796 (Accession XM_029031) is another VGAM2330 host target gene. MGC4796 BINDING SITE is HOST TARGET binding site found in the 3' untranslated region of mRNA encoded by MGC4796, corresponding to a HOST TARGET binding site such as BINDING SITE I, BINDING SITE II or BINDING SITE III. Table 2 illustrates the complementarity of the nucleotide sequences of MGC4796 BINDING SITE, designated SEQ ID:30831, to the nucleotide sequence of VGAM2330 RNA, herein designated VGAM RNA, also designated SEQ ID:5041.

Another function of VGAM2330 is therefore inhibition of MGC4796 (Accession XM_029031). Accordingly, utilities of VGAM2330 include diagnosis, prevention and treatment of diseases and clinical conditions associated with MGC4796. PRP8 Pre-mRNA Processing Factor 8 Homolog (yeast) (PRPF8, Accession XM_028335) is another VGAM2330 host target gene. PRPF8 BINDING SITE is HOST TARGET binding site found in the 3' untranslated region of mRNA encoded by PRPF8, corresponding to a HOST TARGET binding site such as BINDING SITE I, BINDING SITE II or BINDING SITE III. Table 2 illustrates the complementarity of the nucleotide sequences of PRPF8 BINDING SITE, designated SEQ ID:30681, to the nucleotide sequence of VGAM2330 RNA, herein designated VGAM RNA, also designated SEQ ID:5041.

Another function of VGAM2330 is therefore inhibition of PRP8 Pre-mRNA Processing Factor 8 Homolog (yeast) (PRPF8, Accession XM_028335). Accordingly, utilities of VGAM2330 include diagnosis, prevention and treatment of diseases and clinical conditions associated with PRPF8. RAB40C, Member RAS Oncogene Family (RAB40C, Accession NM_021168) is another VGAM2330 host target gene. RAB40C BINDING SITE is HOST TARGET binding site found in the 3' untranslated region of mRNA encoded by RAB40C, corresponding to a HOST TARGET binding site such as BINDING SITE I, BINDING SITE II or BINDING SITE III. Table 2 illustrates the complementarity of the nucleotide sequences of RAB40C BINDING SITE, designated SEQ ID:22146, to the nucleotide sequence of VGAM2330 RNA, herein designated VGAM RNA, also designated SEQ ID:5041.

Another function of VGAM2330 is therefore inhibition of RAB40C, Member RAS Oncogene Family (RAB40C, Accession NM_021168). Accordingly, utilities of VGAM2330 include diagnosis, prevention and treatment of diseases and clinical conditions associated with RAB40C. RER1 (Accession NM_007033) is another VGAM2330 host target gene. RER1 BINDING SITE is HOST TARGET binding site found in the 3' untranslated region of mRNA encoded by RER1, corresponding to a HOST TARGET binding site such as BINDING SITE I, BINDING SITE II or BINDING SITE III. Table 2 illustrates the complementarity of the nucleotide sequences of RER1 BINDING SITE, designated SEQ ID:13903, to the nucleotide sequence of VGAM2330 RNA, herein designated VGAM RNA, also designated SEQ ID:5041.

Another function of VGAM2330 is therefore inhibition of RER1 (Accession NM_007033). Accordingly, utilities of VGAM2330 include diagnosis, prevention and treatment of diseases and clinical conditions associated with RER1. Syndecan 3 (N-syndecan) (SDC3, Accession NM_014654) is another VGAM2330 host target gene. SDC3 BINDING SITE is HOST TARGET binding site found in the 3' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16090, to the nucleotide sequence of VGAM2330 RNA, herein designated VGAM RNA, also designated SEQ ID:5041.

Another function of VGAM2330 is therefore inhibition of Syndecan 3 (N-syndecan) (SDC3, Accession NM_014654). Accordingly, utilities of VGAM2330 include diagnosis, prevention and treatment of diseases and clinical conditions associated with SDC3. LOC116411 (Accession XM_058095) is another VGAM2330 host target gene. LOC116411 BINDING SITE is HOST TARGET binding site found in the 5' untranslated region of mRNA encoded by LOC116411, corresponding to a HOST TARGET binding site such as BINDING SITE I, BINDING SITE II or BINDING SITE III. Table 2 illustrates the complementarity of the nucleotide sequences of LOC116411 BINDING SITE, designated SEQ ID:36569, to the nucleotide sequence of VGAM2330 RNA, herein designated VGAM RNA, also designated SEQ ID:5041.

Another function of VGAM2330 is therefore inhibition of LOC116411 (Accession XM_058095). Accordingly, utilities of VGAM2330 include diagnosis, prevention and treatment of diseases and clinical conditions associated with LOC116411. LOC129880 (Accession XM_059383) is another VGAM2330 host target gene. LOC129880 BINDING SITE is HOST TARGET binding site found in the 3' untranslated region of mRNA encoded by LOC129880, corresponding to a HOST TARGET binding site such as BINDING SITE I, BINDING SITE II or BINDING SITE III. Table 2 illustrates the complementarity of the nucleotide sequences of LOC129880 BINDING SITE, designated SEQ ID:36983, to the nucleotide sequence of VGAM2330 RNA, herein designated VGAM RNA, also designated SEQ ID:5041.

Another function of VGAM2330 is therefore inhibition of LOC129880 (Accession XM_059383). Accordingly, utilities of VGAM2330 include diagnosis, prevention and treatment of diseases and clinical conditions associated with LOC129880. LOC149422 (Accession XM_086527) is another VGAM2330 host target gene. LOC149422 BINDING SITE is HOST TARGET binding site found in the 3' untranslated region of mRNA encoded by LOC149422, corresponding to a HOST TARGET binding site such as BINDING SITE I, BINDING SITE II or BINDING SITE III. Table 2 illustrates the complementarity of the nucleotide sequences of LOC149422 BINDING SITE, designated SEQ ID:38744, to the nucleotide sequence of VGAM2330 RNA, herein designated VGAM RNA, also designated SEQ ID:5041.

Another function of VGAM2330 is therefore inhibition of LOC149422 (Accession XM_086527). Accordingly, utilities of VGAM2330 include diagnosis, prevention and treatment of diseases and clinical conditions associated with LOC149422. LOC154043 (Accession XM_087831) is another VGAM2330 host target gene. LOC154043 BINDING SITE is HOST TARGET binding site found in the 3' untranslated region of mRNA encoded by LOC154043, corresponding to a HOST TARGET binding site such as BINDING SITE I, BINDING SITE II or BINDING SITE III. Table 2 illustrates the complementarity of the nucleotide sequences of LOC154043 BINDING SITE, designated SEQ ID:39459, to the nucleotide sequence of VGAM2330 RNA, herein designated VGAM RNA, also designated SEQ ID:5041.

Another function of VGAM2330 is therefore inhibition of LOC154043 (Accession XM_087831). Accordingly, utilities of VGAM2330 include diagnosis, prevention and treatment of diseases and clinical conditions associated with LOC154043. LOC155382 (Accession XM_098713) is another VGAM2330 host target gene. LOC155382 BINDING SITE is HOST TARGET binding site found in the 3' untranslated region of mRNA encoded by LOC155382, corresponding to a HOST TARGET binding site such as BINDING SITE I, BINDING SITE II or BINDING SITE III. Table 2 illustrates the complementarity of the nucleotide sequences of LOC155382 BINDING SITE, designated SEQ ID:41766, to the nucleotide sequence of VGAM2330 RNA, herein designated VGAM RNA, also designated SEQ ID:5041.

Another function of VGAM2330 is therefore inhibition of LOC155382 (Accession XM_098713). Accordingly, utilities of VGAM2330 include diagnosis, prevention and treatment of diseases and clinical conditions associated with LOC155382. LOC158364 (Accession XM_088546) is another VGAM2330 host target gene. LOC158364 BINDING SITE is HOST TARGET binding site found in the 5' untranslated region of mRNA encoded by LOC158364, corresponding to a HOST TARGET binding site such as BINDING SITE I, BINDING SITE II or BINDING SITE III. Table 2 illustrates the complementarity of the nucleotide sequences of LOC158364 BINDING SITE, designated SEQ ID:39816, to the nucleotide sequence of VGAM2330 RNA, herein designated VGAM RNA, also designated SEQ ID:5041.

Another function of VGAM2330 is therefore inhibition of LOC158364 (Accession XM_088546). Accordingly, utilities of VGAM2330 include diagnosis, prevention and treatment of diseases and clinical conditions associated with LOC158364. LOC170393 (Accession XM_096327) is another VGAM2330 host target gene. LOC170393 BINDING SITE is HOST TARGET binding site found in the 3' untranslated region of mRNA encoded by LOC170393, corresponding to a HOST TARGET binding site such as BINDING SITE I, BINDING SITE II or BINDING SITE III. Table 2 illustrates the complementarity of the nucleotide sequences of LOC170393 BINDING SITE, designated SEQ ID:40312, to the nucleotide sequence of VGAM2330 RNA, herein designated VGAM RNA, also designated SEQ ID:5041.

Another function of VGAM2330 is therefore inhibition of LOC170393 (Accession XM_096327). Accordingly, utilities of VGAM2330 include diagnosis, prevention and treatment of diseases and clinical conditions associated with LOC170393. LOC202868 (Accession XM_117477) is another VGAM2330 host target gene. LOC202868 BINDING SITE is HOST TARGET binding site found in the 5' untranslated region of mRNA encoded by LOC202868, corresponding to a HOST TARGET binding site such as BINDING SITE I, BINDING SITE II or BINDING SITE III. Table 2 illustrates the complementarity of the nucleotide sequences of LOC202868 BINDING SITE, designated SEQ ID:43449, to the nucleotide sequence of VGAM2330 RNA, herein designated VGAM RNA, also designated SEQ ID:5041.

Another function of VGAM2330 is therefore inhibition of LOC202868 (Accession XM_117477). Accordingly, utilities of VGAM2330 include diagnosis, prevention and treatment of diseases and clinical conditions associated with LOC202868. LOC219649 (Accession XM_167562) is another VGAM2330 host target gene. LOC219649 BINDING SITE is HOST TARGET binding site found in the 3' untranslated region of mRNA encoded by LOC219649, corresponding to a HOST TARGET binding site such as BINDING SITE I, BINDING SITE II or BINDING SITE III. Table 2 illustrates the complementarity of the nucleotide sequences of LOC219649 BINDING SITE, designated SEQ ID:44665, to the nucleotide sequence of VGAM2330 RNA, herein designated VGAM RNA, also designated SEQ ID:5041.

Another function of VGAM2330 is therefore inhibition of LOC219649 (Accession XM_167562). Accordingly, utilities of VGAM2330 include diagnosis, prevention and treatment of diseases and clinical conditions associated with LOC219649. LOC253664 (Accession XM_170673) is another VGAM2330 host target gene. LOC253664 BINDING SITE is HOST TARGET binding site found in the 5' untranslated region of mRNA encoded by LOC253664, corresponding to a HOST TARGET binding site such as BINDING SITE I, BINDING SITE II or BINDING SITE III. Table 2 illustrates the complementarity of the nucleotide sequences of LOC253664 BINDING SITE, designated SEQ ID:45451, to the nucleotide sequence of VGAM2330 RNA, herein designated VGAM RNA, also designated SEQ ID:5041.

Another function of VGAM2330 is therefore inhibition of LOC253664 (Accession XM_170673). Accordingly, utilities of VGAM2330 include diagnosis, prevention and treatment of diseases and clinical conditions associated with LOC253664. LOC256306 (Accession XM_172976) is another VGAM2330 host target gene. LOC256306 BINDING SITE is HOST TARGET binding site found in the 5' untranslated region of mRNA encoded by LOC256306, corresponding to a HOST TARGET binding site such as BINDING SITE I, BINDING SITE II or BINDING SITE III. Table 2 illustrates the complementarity of the nucleotide sequences of LOC256306 BINDING SITE, designated SEQ ID:46238, to the nucleotide sequence of VGAM2330 RNA, herein designated VGAM RNA, also designated SEQ ID:5041.

Another function of VGAM2330 is therefore inhibition of LOC256306 (Accession XM_172976). Accordingly, utilities of VGAM2330 include diagnosis, prevention and treatment of diseases and clinical conditions associated with LOC256306. LOC90198 (Accession XM_029882) is another VGAM2330 host target gene. LOC90198 BINDING SITE is HOST TARGET binding site found in the 5' untranslated region of mRNA encoded by LOC90198, corresponding to a HOST TARGET binding site such as BINDING SITE I, BINDING SITE II or BINDING SITE III. Table 2 illustrates the complementarity of the nucleotide sequences of LOC90198 BINDING SITE, designated SEQ ID:30959, to the nucleotide sequence of VGAM2330 RNA, herein designated VGAM RNA, also designated SEQ ID:5041.

Another function of VGAM2330 is therefore inhibition of LOC90198 (Accession XM_029882). Accordingly, utilities of VGAM2330 include diagnosis, prevention and treatment of diseases and clinical conditions associated with LOC90198. LOC90249 (Accession XM_030300) is another VGAM2330 host target gene. LOC90249 BINDING SITE is HOST TARGET binding site found in the 3' untranslated region of mRNA encoded by LOC90249, corresponding to a HOST TARGET binding site such as BINDING SITE I, BINDING SITE II or BINDING SITE III. Table 2 illustrates the complementarity of the nucleotide sequences of LOC90249 BINDING SITE, designated SEQ ID:31009, to the nucleotide sequence of VGAM2330 RNA, herein designated VGAM RNA, also designated SEQ ID:5041.

Another function of VGAM2330 is therefore inhibition of LOC90249 (Accession XM_030300). Accordingly, utilities of VGAM2330 include diagnosis, prevention and treatment of diseases and clinical conditions associated with LOC90249. LOC91064 (Accession XM_035806) is another VGAM2330 host target gene. LOC91064 BINDING SITE is HOST TARGET binding site found in the 5' untranslated region of mRNA encoded by LOC91064, corresponding to a HOST TARGET binding site such as BINDING SITE I, BINDING SITE II or BINDING SITE III. Table 2 illustrates the complementarity of the nucleotide sequences of LOC91064 BINDING SITE, designated SEQ ID:32341, to the nucleotide sequence of VGAM2330 RNA, herein designated VGAM RNA, also designated SEQ ID:5041.

Another function of VGAM2330 is therefore inhibition of LOC91064 (Accession XM_035806). Accordingly, utilities of VGAM2330 include diagnosis, prevention and treatment of diseases and clinical conditions associated with LOC91064. LOC91355 (Accession XM_037825) is another VGAM2330 host target gene. LOC91355 BINDING SITE is HOST TARGET binding site found in the 5' untranslated region of mRNA encoded by LOC91355, corresponding to a HOST TARGET binding site such as BINDING SITE I, BINDING SITE II or BINDING SITE III. Table 2 illustrates the complementarity of the nucleotide sequences of LOC91355 BINDING SITE, designated SEQ ID:32703, to the nucleotide sequence of VGAM2330 RNA, herein designated VGAM RNA, also designated SEQ ID:5041.

Another function of VGAM2330 is therefore inhibition of LOC91355 (Accession XM_037825). Accordingly, utilities of VGAM2330 include diagnosis, prevention and treatment of diseases and clinical conditions associated with LOC91355. LOC92697 (Accession XM_046715) is another VGAM2330 host target gene. LOC92697 BINDING SITE1 and LOC92697 BINDING SITE2 are HOST TARGET binding sites found in untranslated regions of mRNA encoded by LOC92697, corresponding to HOST TARGET binding sites such as BINDING SITE I, BINDING SITE II or BINDING SITE III. Table 2 illustrates the complementarity of the nucleotide sequences of LOC92697 BINDING SITE1 and LOC92697 BINDING SITE2, designated SEQ ID:34802 and SEQ ID:34803 respectively, to the nucleotide sequence of VGAM2330 RNA, herein designated VGAM RNA, also designated SEQ ID:5041.

Another function of VGAM2330 is therefore inhibition of LOC92697 (Accession XM_046715). Accordingly, utilities of VGAM2330 include diagnosis, prevention and treatment of diseases and clinical conditions associated with LOC92697. Placental Growth Factor, Vascular Endothelial Growth Factor-related Protein (PGF, Accession NM_002632) is another VGAM2331 host target gene. PGF BINDING SITE is HOST TARGET binding site found in the 3' untranslated region of mRNA encoded by PGF, corresponding to a HOST TARGET binding site such as BINDING SITE I, BINDING SITE II or BINDING SITE III. Table 2 illustrates the complementarity of the nucleotide sequences of PGF BINDING SITE, designated SEQ ID:8490, to the nucleotide sequence of VGAM2331 RNA, herein designated VGAM RNA, also designated SEQ ID:5042.

Another function of VGAM2331 is therefore inhibition of Placental Growth Factor, Vascular Endothelial Growth Factor-related Protein (PGF, Accession NM_002632), a gene which is a growth factor active in angiogenesis, and endothelial cell growth, stimulating cell proliferation and migration. it binds to receptor vegfr-1/fl. Accordingly, utilities of VGAM2331 include diagnosis, prevention and treatment of diseases and clinical conditions associated with PGF. The function of PGF and its association with various diseases and clinical conditions, has been established by previous studies, as described hereinabove with reference to VGAM1420. Organic Cationic Transporter-like 3 (ORCTL3, Accession NM_004256) is another VGAM2331 host target gene. ORCTL3 BINDING SITE is HOST TARGET binding site found in the 3' untranslated region of mRNA encoded by ORCTL3, corresponding to a HOST TARGET binding site such as BINDING SITE I, BINDING SITE II or BINDING SITE III. Table 2 illustrates the complementarity of the nucleotide sequences of ORCTL3 BINDING SITE, designated SEQ ID:10442, to the nucleotide sequence of VGAM2331 RNA, herein designated VGAM RNA, also designated SEQ ID:5042.

Another function of VGAM2331 is therefore inhibition of Organic Cationic Transporter-like 3 (ORCTL3, Accession NM_004256). Accordingly, utilities of VGAM2331 include diagnosis, prevention and treatment of diseases and clinical conditions associated with ORCTL3. LOC202459 (Accession NM_145303) is another VGAM2331 host target gene. LOC202459 BINDING SITE is HOST TARGET binding site found in the 5' untranslated region of mRNA encoded by LOC202459, corresponding to a HOST TARGET binding site such as BINDING SITE I, BINDING SITE II or BINDING SITE III. Table 2 illustrates the complementarity of the nucleotide sequences of LOC202459 BINDING SITE, designated SEQ ID:29815, to the nucleotide sequence of VGAM2331 RNA, herein designated VGAM RNA, also designated SEQ ID:5042.

Another function of VGAM2331 is therefore inhibition of LOC202459 (Accession NM_145303). Accordingly, utilities of VGAM2331 include diagnosis, prevention and treatment of diseases and clinical conditions associated with LOC202459. FIG. 1 further provides a conceptual description of a novel bioinformatically detected viral gene of the present invention, referred to here as Viral Genomic Address Messenger 2332 (VGAM2332) viral gene, which modulates expression of respective host target genes thereof, the function and utility of which host target genes is known in the art.

VGAM2332 is a novel bioinformatically detected regulatory, non protein coding, viral micro RNA (miRNA) gene. The method by which VGAM2332 was detected is described hereinabove with reference to FIGS. 1-8.

VGAM2332 gene, herein designated VGAM GENE, is a viral gene contained in the genome of Equine Herpesvirus 2. VGAM2332 host target gene, herein designated VGAM HOST TARGET GENE, is a human gene contained in the human genome.

VGAM2332 gene encodes a VGAM2332 precursor RNA, herein designated VGAM PRECURSOR RNA. Similar to other miRNA genes, and unlike most ordinary genes, VGAM2332 precursor RNA does not encode a protein. A nucleotide sequence identical or highly similar to the nucleotide sequence of VGAM2332 precursor RNA is designated SEQ ID:2318, and is provided hereinbelow with reference to the sequence listing part. Nucleotide sequence SEQ ID:2318 is located at position 21991 relative to the genome of Equine Herpesvirus 2.

VGAM2332 precursor RNA folds onto itself, forming VGAM2332 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2332 folded precursor RNA into VGAM2332 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2332 RNA is designated SEQ ID:5043, and is provided hereinbelow with reference to the sequence listing part.

VGAM2332 host target gene, herein designated VGAM HOST TARGET GENE, encodes a corresponding messenger RNA, VGAM2332 host target RNA, herein designated VGAM HOST TARGET RNA. VGAM2332 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2332 RNA, herein designated VGAM RNA, binds complementarily to one or more host target binding sites located in untranslated regions of VGAM2332 host target RNA, herein designated VGAM HOST TARGET RNA. This complementary binding is due to the fact that the nucleotide sequence of VGAM2332 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2332 RNA, herein designated VGAM RNA, may have a different number of host target binding sites in untranslated regions of a VGAM2332 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2332 RNA, herein designated VGAM RNA, to host target binding sites on VGAM2332 host target RNA, herein designated VGAM HOST TARGET RNA, such as BINDING SITE I, BINDING SITE II and BINDING SITE III, inhibits translation of VGAM2332 host target RNA into VGAM2332 host target protein, herein designated VGAM HOST TARGET PROTEIN. VGAM host target protein is therefore outlined by a broken line.

It is appreciated that VGAM2332 host target gene, herein designated VGAM HOST TARGET GENE, in fact represents a plurality of VGAM2332 host target genes. The mRNA of each one of this plurality of VGAM2332 host target genes comprises one or more host target binding sites, each having a nucleotide sequence which is at least partly complementary to VGAM2332 RNA, herein designated VGAM RNA, and which when bound by VGAM2332 RNA causes inhibition of translation of respective one or more VGAM2332 host target proteins.

It is further appreciated by one skilled in the art that the mode of translational inhibition illustrated by FIG. 1 with specific reference to translational inhibition exerted by VGAM2332 gene, herein designated VGAM GENE, on one or more VGAM2332 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2332 is inhibition of expression of host target genes, as part of a novel viral mechanism of attacking a host. Accordingly, utilities of VGAM2332 include diagnosis, prevention and treatment of viral infection by Equine Herpesvirus 2. Specific functions, and accordingly utilities, of VGAM2332 correlate with, and may be deduced from, the identity of the host target genes which VGAM2332 binds and inhibits, and the function of these host target genes, as elaborated hereinbelow.

Nucleotide sequences of the VGAM2332 precursor RNA, herein designated VGAM PRECURSOR RNA, and of the 'diced' VGAM2332 RNA, herein designated VGAM RNA, and a schematic representation of the secondary folding of VGAM2332 folded precursor RNA, herein designated VGAM FOLDED PRECURSOR RNA, of VGAM2332 are further described hereinbelow with reference to Table 1.

Nucleotide sequences of host target binding sites, such as BINDING SITE-I, BINDING SITE-II and BINDING SITE-III of FIG. 1, found on VGAM2332 host target RNA, and schematic representation of the complementarity of each of these host target binding sites to VGAM2332 RNA, herein designated VGAM RNA, are described hereinbelow with reference to Table 2.

As mentioned hereinabove with reference to FIG. 1, a function of VGAM2332 gene, herein designated VGAM is inhibition of expression of VGAM2332 target genes. It is appreciated that specific functions, and accordingly utilities, of VGAM2332 correlate with, and may be deduced from, the identity of the target genes which VGAM2332 binds and inhibits, and the function of these target genes, as elaborated hereinbelow.

5-hydroxytryptamine (serotonin) Receptor 6 (HTR6, Accession NM_000871) is a VGAM2332 host target gene. HTR6 BINDING SITE is HOST TARGET binding site found in the 5' untranslated region of mRNA encoded by HTR6, corresponding to a HOST TARGET binding site such as BINDING SITE I, BINDING SITE II or BINDING SITE III. Table 2 illustrates the complementarity of the nucleotide sequences of HTR6 BINDING SITE, designated SEQ ID:6547, to the nucleotide sequence of VGAM2332 RNA, herein designated VGAM RNA, also designated SEQ ID:5043.

A function of VGAM2332 is therefore inhibition of 5-hydroxytryptamine (serotonin) Receptor 6 (HTR6, Accession NM_000871), a gene which stimulates adenylate cyclase. Accordingly, utilities of VGAM2332 include diagnosis, prevention and treatment of diseases and clinical conditions associated with HTR6. The function of HTR6 and its association with various diseases and clinical conditions, has been established by previous studies, as described hereinabove with reference to VGAM326. FLJ10043 (Accession NM_017979) is another VGAM2332 host target gene. FLJ10043 BINDING SITE is HOST TARGET binding site found in the 3' untranslated region of mRNA encoded by FLJ10043, corresponding to a HOST TARGET binding site such as BINDING SITE I, BINDING SITE II or BINDING SITE III. Table 2 illustrates the complementarity of the nucleotide sequences of FLJ10043 BINDING SITE, designated SEQ ID:19708, to the nucleotide sequence of VGAM2332 RNA, herein designated VGAM RNA, also designated SEQ ID:5043.

Another function of VGAM2332 is therefore inhibition of FLJ10043 (Accession NM_017979). Accordingly, utilities of VGAM2332 include diagnosis, prevention and treatment of diseases and clinical conditions associated with FLJ10043. FLJ20694 (Accession NM_017928) is another VGAM2332 host target gene. FLJ20694 BINDING SITE is HOST TARGET binding site found in the 3' untranslated region of mRNA encoded by FLJ20694, corresponding to a HOST TARGET binding site such as BINDING SITE I, BINDING SITE II or BINDING SITE III. Table 2 illustrates the complementarity of the nucleotide sequences of FLJ20694 BINDING SITE, designated SEQ ID:19605, to the nucleotide sequence of VGAM2332 RNA, herein designated VGAM RNA, also designated SEQ ID:5043.

Another function of VGAM2332 is therefore inhibition of FLJ20694 (Accession NM_017928). Accordingly, utilities of VGAM2332 include diagnosis, prevention and treatment of diseases and clinical conditions associated with FLJ20694. KIAA0798 (Accession NM_014650) is another VGAM2332 host target gene. KIAA0798 BINDING SITE is HOST TAR- GET binding site found in the 3' untranslated region of mRNA encoded by KIAA0798, corresponding to a HOST TARGET binding site such as BINDING SITE I, BINDING SITE II or BINDING SITE III. Table 2 illustrates the complementarity of the nucleotide sequences of KIAA0798 BINDING SITE, designated SEQ ID:16066, to the nucleotide sequence of VGAM2332 RNA, herein designated VGAM RNA, also designated SEQ ID:5043.

Another function of VGAM2332 is therefore inhibition of KIAA0798 (Accession NM_014650). Accordingly, utilities of VGAM2332 include diagnosis, prevention and treatment of diseases and clinical conditions associated with KIAA0798. KLK15 (Accession NM_138563) is another VGAM2332 host target gene. KLK15 BINDING SITE1 and KLK15 BINDING SITE2 are HOST TARGET binding sites found in untranslated regions of mRNA encoded by KLK15, corresponding to HOST TARGET binding sites such as BINDING SITE I, BINDING SITE II or BINDING SITE III. Table 2 illustrates the complementarity of the nucleotide sequences of KLK15 BINDING SITE1 and KLK15 BINDING SITE2, designated SEQ ID:28862 and SEQ ID:23264 respectively, to the nucleotide sequence of VGAM2332 RNA, herein designated VGAM RNA, also designated SEQ ID:5043.

Another function of VGAM2332 is therefore inhibition of KLK15 (Accession NM_138563). Accordingly, utilities of VGAM2332 include diagnosis, prevention and treatment of diseases and clinical conditions associated with KLK15. LOC121838 (Accession XM_071772) is another VGAM2332 host target gene. LOC121838 BINDING SITE is HOST TARGET binding site found in the 5' untranslated region of mRNA encoded by LOC121838, corresponding to a HOST TARGET binding site such as BINDING SITE I, BINDING SITE II or BINDING SITE III. Table 2 illustrates the complementarity of the nucleotide sequences of LOC121838 BINDING SITE, designated SEQ ID:37418, to the nucleotide sequence of VGAM2332 RNA, herein designated VGAM RNA, also designated SEQ ID:5043.

Another function of VGAM2332 is therefore inhibition of LOC121838 (Accession XM_071772). Accordingly, utilities of VGAM2332 include diagnosis, prevention and treatment of diseases and clinical conditions associated with LOC121838. LOC220739 (Accession XM_167548) is another VGAM2332 host target gene. LOC220739 BINDING SITE is HOST TARGET binding site found in the 3' untranslated region of mRNA encoded by LOC220739, corresponding to a HOST TARGET binding site such as BINDING SITE I, BINDING SITE II or BINDING SITE III. Table 2 illustrates the complementarity of the nucleotide sequences of LOC220739 BINDING SITE, designated SEQ ID:44654, to the nucleotide sequence of VGAM2332 RNA, herein designated VGAM RNA, also designated SEQ ID:5043.

Another function of VGAM2332 is therefore inhibition of LOC220739 (Accession XM_167548). Accordingly, utilities of VGAM2332 include diagnosis, prevention and treatment of diseases and clinical conditions associated with LOC220739. LOC222066 (Accession XM_166582) is another VGAM2332 host target gene. LOC222066 BINDING SITE is HOST TARGET binding site found in the 3' untranslated region of mRNA encoded by LOC222066, corresponding to a HOST TARGET binding site such as BINDING SITE I, BINDING SITE II or BINDING SITE III. Table 2 illustrates the complementarity of the nucleotide sequences of LOC222066 BINDING SITE, designated SEQ ID:44555, to the nucleotide sequence of VGAM2332 RNA, herein designated VGAM RNA, also designated SEQ ID:5043.

Another function of VGAM2332 is therefore inhibition of LOC222066 (Accession XM_166582). Accordingly, utilities of VGAM2332 include diagnosis, prevention and treatment of diseases and clinical conditions associated with LOC222066. LOC254685 (Accession XM_172876) is another VGAM2332 host target gene. LOC254685 BINDING SITE is HOST TARGET binding site found in the 5' untranslated region of mRNA encoded by LOC254685, corresponding to a HOST TARGET binding site such as BINDING SITE I, BINDING SITE II or BINDING SITE III. Table 2 illustrates the complementarity of the nucleotide sequences of LOC254685 BINDING SITE, designated SEQ ID:46152, to the nucleotide sequence of VGAM2332 RNA, herein designated VGAM RNA, also designated SEQ ID:5043.

Another function of VGAM2332 is therefore inhibition of LOC254685 (Accession XM_172876). Accordingly, utilities of VGAM2332 include diagnosis, prevention and treatment of diseases and clinical conditions associated with LOC254685. FIG. 1 further provides a conceptual description of a novel bioinformatically detected viral gene of the present invention, referred to here as Viral Genomic Address Messenger 2333 (VGAM2333) viral gene, which modulates expression of respective host target genes thereof, the function and utility of which host target genes is known in the art.

VGAM2333 is a novel bioinformatically detected regulatory, non protein coding, viral micro RNA (miRNA) gene. The method by which VGAM2333 was detected is described hereinabove with reference to FIGS. 1-8.

VGAM2333 gene, herein designated VGAM GENE, is a viral gene contained in the genome of Equine Herpesvirus 2. VGAM2333 host target gene, herein designated VGAM HOST TARGET GENE, is a human gene contained in the human genome.

VGAM2333 gene encodes a VGAM2333 precursor RNA, herein designated VGAM PRECURSOR RNA. Similar to other miRNA genes, and unlike most ordinary genes, VGAM2333 precursor RNA does not encode a protein. A nucleotide sequence identical or highly similar to the nucleotide sequence of VGAM2333 precursor RNA is designated SEQ ID:2319, and is provided hereinbelow with reference to the sequence listing part. Nucleotide sequence SEQ ID:2319 is located at position 36149 relative to the genome of Equine Herpesvirus 2.

VGAM2333 precursor RNA folds onto itself, forming VGAM2333 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2333 folded precursor RNA into VGAM2333 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2333 RNA is designated SEQ ID:5044, and is provided hereinbelow with reference to the sequence listing part.

VGAM2333 host target gene, herein designated VGAM HOST TARGET GENE, encodes a corresponding messenger RNA, VGAM2333 host target RNA, herein designated VGAM HOST TARGET RNA. VGAM2333 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2333 RNA, herein designated VGAM RNA, binds complementarily to one or more host target binding sites located in untranslated regions of VGAM2333 host target RNA, herein designated VGAM HOST TARGET RNA. This complementary binding is due to the fact that the nucleotide sequence of VGAM2333 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2333 RNA, herein designated VGAM RNA, may have a different number of host target binding sites in untranslated regions of a VGAM2333 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2333 RNA, herein designated VGAM RNA, to host target binding sites on VGAM2333 host target RNA, herein designated VGAM HOST TARGET RNA, such as BINDING SITE I, BINDING SITE II and BINDING SITE III, inhibits translation of VGAM2333 host target RNA into VGAM2333 host target protein, herein designated VGAM HOST TARGET PROTEIN. VGAM host target protein is therefore outlined by a broken line.

It is appreciated that VGAM2333 host target gene, herein designated VGAM HOST TARGET GENE, in fact represents a plurality of VGAM2333 host target genes. The mRNA of each one of this plurality of VGAM2333 host target genes comprises one or more host target binding sites, each having a nucleotide sequence which is at least partly complementary to VGAM2333 RNA, herein designated VGAM RNA, and which when bound by VGAM2333 RNA causes inhibition of translation of respective one or more VGAM2333 host target proteins.

It is further appreciated by one skilled in the art that the mode of translational inhibition illustrated by FIG. 1 with specific reference to translational inhibition exerted by VGAM2333 gene, herein designated VGAM GENE, on one or more VGAM2333 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2333 is inhibition of expression of host target genes, as part of a novel viral mechanism of attacking a host. Accordingly, utilities of VGAM2333 include diagnosis, prevention and treatment of viral infection by Equine Herpesvirus 2. Specific functions, and accordingly utilities, of VGAM2333 correlate with, and may be deduced from, the identity of the host target genes which VGAM2333 binds and inhibits, and the function of these host target genes, as elaborated hereinbelow.

Nucleotide sequences of the VGAM2333 precursor RNA, herein designated VGAM PRECURSOR RNA, and of the 'diced' VGAM2333 RNA, herein designated VGAM RNA, and a schematic representation of the secondary folding of VGAM2333 folded precursor RNA, herein designated VGAM FOLDED PRECURSOR RNA, of VGAM2333 are further described hereinbelow with reference to Table 1.

Nucleotide sequences of host target binding sites, such as BINDING SITE-I, BINDING SITE-II and BINDING SITE-III of FIG. 1, found on VGAM2333 host target RNA, and schematic representation of the complementarity of each of these host target binding sites to VGAM2333 RNA, herein designated VGAM RNA, are described hereinbelow with reference to Table 2.

As mentioned hereinabove with reference to FIG. 1, a function of VGAM2333 gene, herein designated VGAM is inhibition of expression of VGAM2333 target genes. It is appreciated that specific functions, and accordingly utilities, of VGAM2333 correlate with, and may be deduced from, the identity of the target genes which VGAM2333 binds and inhibits, and the function of these target genes, as elaborated hereinbelow.

GLI-Kruppel Family Member GLI2 (GLI2, Accession NM_030379) is a VGAM2333 host target gene. GLI2 BINDING SITE is HOST TARGET binding site found in the 5' untranslated region of mRNA encoded by GLI2, corresponding to a HOST TARGET binding site such as BINDING SITE I, BINDING SITE II or BINDING SITE III. Table 2 illustrates the complementarity of the nucleotide sequences of GLI2 BINDING SITE, designated SEQ ID:24937, to the nucleotide sequence of VGAM2333 RNA, herein designated VGAM RNA, also designated SEQ ID:5044.

A function of VGAM2333 is therefore inhibition of GLI-Kruppel Family Member GLI2 (GLI2, Accession NM_030379), a gene which may promote tax-dependent transcription of T-cell leukemia virus type 1 genes. Accordingly, utilities of VGAM2333 include diagnosis, prevention and treatment of diseases and clinical conditions associated with GLI2. The function of GLI2 and its association with various diseases and clinical conditions, has been established by previous studies, as described hereinabove with reference to VGAM465. Solute Carrier Family 19 (thiamine transporter), Member 2 (SLC19A2, Accession XM_044421) is another VGAM2333 host target gene. SLC19A2 BINDING SITE is HOST TARGET binding site found in the 3' untranslated region of mRNA encoded by SLC19A2, corresponding to a HOST TARGET binding site such as BINDING SITE I, BINDING SITE II or BINDING SITE III. Table 2 illustrates the complementarity of the nucleotide sequences of SLC19A2 BINDING SITE, designated SEQ ID:34193, to the nucleotide sequence of VGAM2333 RNA, herein designated VGAM RNA, also designated SEQ ID:5044.

Another function of VGAM2333 is therefore inhibition of Solute Carrier Family 19 (thiamine transporter), Member 2 (SLC19A2, Accession XM_044421). Accordingly, utilities of VGAM2333 include diagnosis, prevention and treatment of diseases and clinical conditions associated with SLC19A2. FLJ11210 (Accession XM_005298) is another VGAM2333 host target gene. FLJ11210 BINDING SITE is HOST TARGET binding site found in the 3' untranslated region of mRNA encoded by FLJ11210, corresponding to a HOST TARGET binding site such as BINDING SITE I, BINDING SITE II or BINDING SITE III. Table 2 illustrates the complementarity of the nucleotide sequences of FLJ11210 BINDING SITE, designated SEQ ID:29973, to the nucleotide sequence of VGAM2333 RNA, herein designated VGAM RNA, also designated SEQ ID:5044.

Another function of VGAM2333 is therefore inhibition of FLJ11210 (Accession XM_005298). Accordingly, utilities of VGAM2333 include diagnosis, prevention and treatment of diseases and clinical conditions associated with FLJ11210. FLJ22167 (Accession NM_024533) is another VGAM2333 host target gene. FLJ22167 BINDING SITE is HOST TARGET binding site found in the 5' untranslated region of mRNA encoded by FLJ22167, corresponding to a HOST TARGET binding site such as BINDING SITE I, BINDING SITE II or BINDING SITE III. Table 2 illustrates the complementarity of the nucleotide sequences of FLJ22167 BINDING SITE, designated SEQ ID:23744, to the nucleotide sequence of VGAM2333 RNA, herein designated VGAM RNA, also designated SEQ ID:5044.

Another function of VGAM2333 is therefore inhibition of FLJ22167 (Accession NM_024533). Accordingly, utilities of VGAM2333 include diagnosis, prevention and treatment of diseases and clinical conditions associated with FLJ22167. KIAA0285 (Accession NM_014807) is another VGAM2333 host target gene. KIAA0285 BINDING SITE is HOST TARGET binding site found in the 3' untranslated region of mRNA encoded by KIAA0285, corresponding to a HOST TARGET binding site such as BINDING SITE I, BINDING SITE II or BINDING SITE III. Table 2 illustrates the complementarity of the nucleotide sequences of KIAA0285 BINDING SITE, designated SEQ ID:16755, to the nucleotide sequence of VGAM2333 RNA, herein designated VGAM RNA, also designated SEQ ID:5044.

Another function of VGAM2333 is therefore inhibition of KIAA0285 (Accession NM_014807). Accordingly, utilities of VGAM2333 include diagnosis, prevention and treatment of diseases and clinical conditions associated with KIAA0285. KIAA0635 (Accession NM_014645) is another VGAM2333 host target gene. KIAA0635 BINDING SITE is HOST TARGET binding site found in the 5' untranslated region of mRNA encoded by KIAA0635, corresponding to a HOST TARGET binding site such as BINDING SITE I, BINDING SITE II or BINDING SITE III. Table 2 illustrates the complementarity of the nucleotide sequences of KIAA0635 BINDING SITE, designated SEQ ID:16057, to the nucleotide sequence of VGAM2333 RNA, herein designated VGAM RNA, also designated SEQ ID:5044.

Another function of VGAM2333 is therefore inhibition of KIAA0635 (Accession NM_014645). Accordingly, utilities of VGAM2333 include diagnosis, prevention and treatment of diseases and clinical conditions associated with KIAA0635. KIAA1656 (Accession XM_038022) is another VGAM2333 host target gene. KIAA1656 BINDING SITE is HOST TARGET binding site found in the 3' untranslated region of mRNA encoded by KIAA1656, corresponding to a HOST TARGET binding site such as BINDING SITE I, BINDING SITE II or BINDING SITE III. Table 2 illustrates the complementarity of the nucleotide sequences of KIAA1656 BINDING SITE, designated SEQ ID:32737, to the nucleotide sequence of VGAM2333 RNA, herein designated VGAM RNA, also designated SEQ ID:5044.

Another function of VGAM2333 is therefore inhibition of KIAA1656 (Accession XM_038022). Accordingly, utilities of VGAM2333 include diagnosis, prevention and treatment of diseases and clinical conditions associated with KIAA1656. LIG-1 (Accession XM_033712) is another VGAM2333 host target gene. LIG-1 BINDING SITE is HOST TARGET binding site found in the 3' untranslated region of mRNA encoded by LIG-1, corresponding to a HOST TARGET binding site such as BINDING SITE I, BINDING SITE II or BINDING SITE III. Table 2 illustrates the complementarity of the nucleotide sequences of LIG-1 BINDING SITE, designated SEQ ID:31956, to the nucleotide sequence of VGAM2333 RNA, herein designated VGAM RNA, also designated SEQ ID:5044.

Another function of VGAM2333 is therefore inhibition of LIG-1 (Accession XM_033712). Accordingly, utilities of VGAM2333 include diagnosis, prevention and treatment of diseases and clinical conditions associated with LIG-1. PFTAIRE Protein Kinase 1 (PFTK1, Accession NM_012395) is another VGAM2333 host target gene. PFTK1 BINDING SITE is HOST TARGET binding site found in the 3' untranslated region of mRNA encoded by PFTK1, corresponding to a HOST TARGET binding site such as BINDING SITE I, BINDING SITE II or BINDING SITE III. Table 2 illustrates the complementarity of the nucleotide sequences of PFTK1 BINDING SITE, designated SEQ ID:14750, to the nucleotide sequence of VGAM2333 RNA, herein designated VGAM RNA, also designated SEQ ID:5044.

Another function of VGAM2333 is therefore inhibition of PFTAIRE Protein Kinase 1 (PFTK1, Accession NM_012395). Accordingly, utilities of VGAM2333 include diagnosis, prevention and treatment of diseases and clinical conditions associated with PFTK1. LOC255565 (Accession XM_170811) is another VGAM2333 host target gene. LOC255565 BINDING SITE is HOST TARGET binding site found in the 5' untranslated region of mRNA encoded by LOC255565, corresponding to a HOST TARGET binding site such as BINDING SITE I, BINDING SITE II or BINDING SITE III. Table 2 illustrates the complementarity of the nucleotide sequences of LOC255565 BINDING SITE, designated SEQ ID:45592, to the nucleotide sequence of VGAM2333 RNA, herein designated VGAM RNA, also designated SEQ ID:5044.

Another function of VGAM2333 is therefore inhibition of LOC255565 (Accession XM_170811). Accordingly, utilities of VGAM2333 include diagnosis, prevention and treatment of diseases and clinical conditions associated with LOC255565. FIG. 1 further provides a conceptual description of a novel bioinformatically detected viral gene of the present invention, referred to here as Viral Genomic Address Messenger 2334 (VGAM2334) viral gene, which modulates expression of respective host target genes thereof, the function and utility of which host target genes is known in the art.

VGAM2334 is a novel bioinformatically detected regulatory, non protein coding, viral micro RNA (miRNA) gene. The method by which VGAM2334 was detected is described hereinabove with reference to FIGS. 1-8.

VGAM2334 gene, herein designated VGAM GENE, is a viral gene contained in the genome of Equine Herpesvirus 2. VGAM2334 host target gene, herein designated VGAM HOST TARGET GENE, is a human gene contained in the human genome.

VGAM2334 gene encodes a VGAM2334 precursor RNA, herein designated VGAM PRECURSOR RNA. Similar to other miRNA genes, and unlike most ordinary genes, VGAM2334 precursor RNA does not encode a protein. A nucleotide sequence identical or highly similar to the nucleotide sequence of VGAM2334 precursor RNA is designated SEQ ID:2320, and is provided hereinbelow with reference to the sequence listing part. Nucleotide sequence SEQ ID:2320 is located at position 40967 relative to the genome of Equine Herpesvirus 2.

VGAM2334 precursor RNA folds onto itself, forming VGAM2334 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2334 folded precursor RNA into VGAM2334 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2334 RNA is designated SEQ ID:5045, and is provided hereinbelow with reference to the sequence listing part.

VGAM2334 host target gene, herein designated VGAM HOST TARGET GENE, encodes a corresponding messenger RNA, VGAM2334 host target RNA, herein designated VGAM HOST TARGET RNA. VGAM2334 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2334 RNA, herein designated VGAM RNA, binds complementarily to one or more host target binding sites located in untranslated regions of VGAM2334 host target RNA, herein designated VGAM HOST TARGET RNA. This complementary binding is due to the fact that the nucleotide sequence of VGAM2334 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2334 RNA, herein designated VGAM RNA, may have a different number of host target binding sites in untranslated regions of a VGAM2334 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2334 RNA, herein designated VGAM RNA, to host target binding sites on VGAM2334 host target RNA, herein designated VGAM HOST TARGET RNA, such as BINDING SITE I, BINDING SITE II and BINDING SITE III, inhibits translation of VGAM2334 host target RNA into VGAM2334 host target protein, herein designated VGAM HOST TARGET PROTEIN. VGAM host target protein is therefore outlined by a broken line.

It is appreciated that VGAM2334 host target gene, herein designated VGAM HOST TARGET GENE, in fact represents a plurality of VGAM2334 host target genes. The mRNA of each one of this plurality of VGAM2334 host target genes comprises one or more host target binding sites, each having a nucleotide sequence which is at least partly complementary to VGAM2334 RNA, herein designated VGAM RNA, and which when bound by VGAM2334 RNA causes inhibition of translation of respective one or more VGAM2334 host target proteins.

It is further appreciated by one skilled in the art that the mode of translational inhibition illustrated by FIG. 1 with specific reference to translational inhibition exerted by VGAM2334 gene, herein designated VGAM GENE, on one or more VGAM2334 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2334 is inhibition of expression of host target genes, as part of a novel viral mechanism of attacking a host. Accordingly, utilities of VGAM2334 include diagnosis, prevention and treatment of viral infection by Equine Herpesvirus 2. Specific functions, and accordingly utilities, of VGAM2334 correlate with, and may be deduced from, the identity of the host target genes which VGAM2334 binds and inhibits, and the function of these host target genes, as elaborated hereinbelow.

Nucleotide sequences of the VGAM2334 precursor RNA, herein designated VGAM PRECURSOR RNA, and of the 'diced' VGAM2334 RNA, herein designated VGAM RNA, and a schematic representation of the secondary folding of VGAM2334 folded precursor RNA, herein designated VGAM FOLDED PRECURSOR RNA, of VGAM2334 are further described hereinbelow with reference to Table 1.

Nucleotide sequences of host target binding sites, such as BINDING SITE-I, BINDING SITE-II and BINDING SITE-III of FIG. 1, found on VGAM2334 host target RNA, and schematic representation of the complementarity of each of these host target binding sites to VGAM2334 RNA, herein designated VGAM RNA, are described hereinbelow with reference to Table 2.

As mentioned hereinabove with reference to FIG. 1, a function of VGAM2334 gene, herein designated VGAM is inhibition of expression of VGAM2334 target genes. It is appreciated that specific functions, and accordingly utilities, of VGAM2334 correlate with, and may be deduced from, the identity of the target genes which VGAM2334 binds and inhibits, and the function of these target genes, as elaborated hereinbelow.

Eukaryotic Translation Initiation Factor 3, Subunit 10 Theta, 150/170 kDa (EIF3S10, Accession XM_049795) is a VGAM2334 host target gene. EIF3S10 BINDING SITE is HOST TARGET binding site found in the 3' untranslated region of mRNA encoded by EIF3S10, corresponding to a HOST TARGET binding site such as BINDING SITE I, BINDING SITE II or BINDING SITE III. Table 2 illustrates the complementarity of the nucleotide sequences of EIF3S10 BINDING SITE, designated SEQ ID:35499, to the nucleotide sequence of VGAM2334 RNA, herein designated VGAM RNA, also designated SEQ ID:5045.

A function of VGAM2334 is therefore inhibition of Eukaryotic Translation Initiation Factor 3, Subunit 10 Theta, 150/170 kDa (EIF3S10, Accession XM_049795), a gene which binds to the 40s ribosome and promotes the binding of methionyl-trnai and mrna. Accordingly, utilities of VGAM2334 include diagnosis, prevention and treatment of diseases and clinical conditions associated with EIF3S10. The function of EIF3S10 and its association with various diseases and clinical conditions, has been established by previous studies, as described hereinabove with reference to VGAM882. Gap Junction Protein, Beta 3, 31 kDa (connexin 31) (GJB3, Accession NM_024009) is another VGAM2334 host target gene. GJB3 BINDING SITE is HOST TARGET binding site found in the 3' untranslated region of mRNA encoded by GJB3, corresponding to a HOST TARGET binding site such as BINDING SITE I, BINDING SITE II or BINDING SITE III. Table 2 illustrates the complementarity of the nucleotide sequences of GJB3 BINDING SITE, designated SEQ ID:23435, to the nucleotide sequence of VGAM2334 RNA, herein designated VGAM RNA, also designated SEQ ID:5045.

Another function of VGAM2334 is therefore inhibition of Gap Junction Protein, Beta 3, 31 kDa (connexin 31) (GJB3, Accession NM_024009). Accordingly, utilities of VGAM2334 include diagnosis, prevention and treatment of diseases and clinical conditions associated with GJB3. Guanine Nucleotide Binding Protein (G protein), Alpha 15 (Gq class) (GNA15, Accession XM_009220) is another VGAM2334 host target gene. GNA15 BINDING SITE is HOST TARGET binding site found in the 5' untranslated region of mRNA encoded by GNA15, corresponding to a HOST TARGET binding site such as BINDING SITE I, BINDING SITE II or BINDING SITE III. Table 2 illustrates the complementarity of the nucleotide sequences of GNA15 BINDING SITE, designated SEQ ID:30102, to the nucleotide sequence of VGAM2334 RNA, herein designated VGAM RNA, also designated SEQ ID:5045.

Another function of VGAM2334 is therefore inhibition of Guanine Nucleotide Binding Protein (G protein), Alpha 15 (Gq class) (GNA15, Accession XM_009220). Accordingly, utilities of VGAM2334 include diagnosis, prevention and treatment of diseases and clinical conditions associated with GNA15. Huntingtin Interacting Protein 1 (HIP1, Accession NM_005338) is another VGAM2334 host target gene. HIP1 BINDING SITE is HOST TARGET binding site found in the 3' untranslated region of mRNA encoded by HIP1, corresponding to a HOST TARGET binding site such as BINDING SITE I, BINDING SITE II or BINDING SITE III. Table 2 illustrates the complementarity of the nucleotide sequences of HIP1 BINDING SITE, designated SEQ ID:11810, to the nucleotide sequence of VGAM2334 RNA, herein designated VGAM RNA, also designated SEQ ID:5045.

Another function of VGAM2334 is therefore inhibition of Huntingtin Interacting Protein 1 (HIP1, Accession NM_005338), a gene which is a membrane protein and interacts with huntingtin. Accordingly, utilities of VGAM2334 include diagnosis, prevention and treatment of diseases and clinical conditions associated with HIP1. The function of HIP1 and its association with various diseases and clinical conditions, has been established by previous studies, as described hereinabove with reference to VGAM474. Human Immunodeficiency Virus Type I Enhancer Binding Protein 3 (HIVEP3, Accession NM_024503) is another VGAM2334 host target gene. HIVEP3 BINDING SITE is HOST TARGET binding site found in the 5' untranslated region of mRNA encoded by HIVEP3, corresponding to a HOST TARGET binding site such as BINDING SITE I, BINDING SITE II or BINDING SITE III. Table 2 illustrates the complementarity of the nucleotide sequences of HIVEP3 BINDING SITE, designated SEQ ID:23697, to the nucleotide sequence of VGAM2334 RNA, herein designated VGAM RNA, also designated SEQ ID:5045.

Another function of VGAM2334 is therefore inhibition of Human Immunodeficiency Virus Type I Enhancer Binding Protein 3 (HIVEP3, Accession NM_024503), a gene which is required for transcriptional activation of glucose- repressible alcohol dehydrogenase (adh2). Accordingly, utilities of VGAM2334 include diagnosis, prevention and treatment of diseases and clinical conditions associated with HIVEP3. The function of HIVEP3 and its association with various diseases and clinical conditions, has been established by previous studies, as described hereinabove with reference to VGAM1781. Serine/threonine Kinase 10 (STK10, Accession NM_005990) is another VGAM2334 host target gene. STK10 BINDING SITE is HOST TARGET binding site found in the 3' untranslated region of mRNA encoded by STK10, corresponding to a HOST TARGET binding site such as BINDING SITE I, BINDING SITE II or BINDING SITE III. Table 2 illustrates the complementarity of the nucleotide sequences of STK10 BINDING SITE, designated SEQ ID:12612, to the nucleotide sequence of VGAM2334 RNA, herein designated VGAM RNA, also designated SEQ ID:5045.

Another function of VGAM2334 is therefore inhibition of Serine/threonine Kinase 10 (STK10, Accession NM_005990), a gene which can act on substrates such as myelin basic protein and histone iia on serine and threonine residues. Accordingly, utilities of VGAM2334 include diagnosis, prevention and treatment of diseases and clinical conditions associated with STK10. The function of STK10 and its association with various diseases and clinical conditions, has been established by previous studies, as described hereinabove with reference to VGAM1958. A Kinase (PRKA) Anchor Protein 7 (AKAP7, Accession NM_004842) is another VGAM2334 host target gene. AKAP7 BINDING SITE1 through AKAP7 BINDING SITE3 are HOST TARGET binding sites found in untranslated regions of mRNA encoded by AKAP7, corresponding to HOST TARGET binding sites such as BINDING SITE I, BINDING SITE II or BINDING SITE III. Table 2 illustrates the complementarity of the nucleotide sequences of AKAP7 BINDING SITE1 through AKAP7 BINDING SITE3, designated SEQ ID:11252, SEQ ID:18515 and SEQ ID:28905 respectively, to the nucleotide sequence of VGAM2334 RNA, herein designated VGAM RNA, also designated SEQ ID:5045.

Another function of VGAM2334 is therefore inhibition of A Kinase (PRKA) Anchor Protein 7 (AKAP7, Accession NM_004842). Accordingly, utilities of VGAM2334 include diagnosis, prevention and treatment of diseases and clinical conditions associated with AKAP7. Chromosome 5 Open Reading Frame 7 (C5orf7, Accession XM_033576) is another VGAM2334 host target gene. C5orf7 BINDING SITE is HOST TARGET binding site found in the 3' untranslated region of mRNA encoded by C5orf7, corresponding to a HOST TARGET binding site such as BINDING SITE I, BINDING SITE II or BINDING SITE III. Table 2 illustrates the complementarity of the nucleotide sequences of C5orf7 BINDING SITE, designated SEQ ID:31939, to the nucleotide sequence of VGAM2334 RNA, herein designated VGAM RNA, also designated SEQ ID:5045.

Another function of VGAM2334 is therefore inhibition of Chromosome 5 Open Reading Frame 7 (C5orf7, Accession XM_033576). Accordingly, utilities of VGAM2334 include diagnosis, prevention and treatment of diseases and clinical conditions associated with C5orf7. FLJ10081 (Accession NM_017991) is another VGAM2334 host target gene. FLJ10081 BINDING SITE is HOST TARGET binding site found in the 3' untranslated region of mRNA encoded by FLJ10081, corresponding to a HOST TARGET binding site such as BINDING SITE I, BINDING SITE II or BINDING SITE III. Table 2 illustrates the complementarity of the nucleotide sequences of FLJ10081 BINDING SITE, designated SEQ ID:19721, to the nucleotide sequence of VGAM2334 RNA, herein designated VGAM RNA, also designated SEQ ID:5045.

Another function of VGAM2334 is therefore inhibition of FLJ10081 (Accession NM_017991). Accordingly, utilities of VGAM2334 include diagnosis, prevention and treatment of diseases and clinical conditions associated with FLJ10081. FLJ13491 (Accession NM_024623) is another VGAM2334 host target gene. FLJ13491 BINDING SITE is HOST TARGET binding site found in the 5' untranslated region of mRNA encoded by FLJ13491, corresponding to a HOST TARGET binding site such as BINDING SITE I, BINDING SITE II or BINDING SITE III. Table 2 illustrates the complementarity of the nucleotide sequences of FLJ13491 BINDING SITE, designated SEQ ID:23885, to the nucleotide sequence of VGAM2334 RNA, herein designated VGAM RNA, also designated SEQ ID:5045.

Another function of VGAM2334 is therefore inhibition of FLJ13491 (Accession NM_024623). Accordingly, utilities of VGAM2334 include diagnosis, prevention and treatment of diseases and clinical conditions associated with FLJ13491. FLJ21308 (Accession NM_024615) is another VGAM2334 host target gene. FLJ21308 BINDING SITE is HOST TARGET binding site found in the 5' untranslated region of mRNA encoded by FLJ21308, corresponding to a HOST TARGET binding site such as BINDING SITE I, BINDING SITE II or BINDING SITE III. Table 2 illustrates the complementarity of the nucleotide sequences of FLJ21308 BINDING SITE, designated SEQ ID:23877, to the nucleotide sequence of VGAM2334 RNA, herein designated VGAM RNA, also designated SEQ ID:5045.

Another function of VGAM2334 is therefore inhibition of FLJ21308 (Accession NM_024615). Accordingly, utilities of VGAM2334 include diagnosis, prevention and treatment of diseases and clinical conditions associated with FLJ21308. FLJ21918 (Accession NM_024939) is another VGAM2334 host target gene. FLJ21918 BINDING SITE is HOST TARGET binding site found in the 3' untranslated region of mRNA encoded by FLJ21918, corresponding to a HOST TARGET binding site such as BINDING SITE I, BINDING SITE II or BINDING SITE III. Table 2 illustrates the complementarity of the nucleotide sequences of FLJ21918 BINDING SITE, designated SEQ ID:24481, to the nucleotide sequence of VGAM2334 RNA, herein designated VGAM RNA, also designated SEQ ID:5045.

Another function of VGAM2334 is therefore inhibition of FLJ21918 (Accession NM_024939). Accordingly, utilities of VGAM2334 include diagnosis, prevention and treatment of diseases and clinical conditions associated with FLJ21918. FLJ22173 (Accession NM_025041) is another VGAM2334 host target gene. FLJ22173 BINDING SITE is HOST TARGET binding site found in the 5' untranslated region of mRNA encoded by FLJ22173, corresponding to a HOST TARGET binding site such as BINDING SITE I, BINDING SITE II or BINDING SITE III. Table 2 illustrates the complementarity of the nucleotide sequences of FLJ22173 BINDING SITE, designated SEQ ID:24634, to the nucleotide sequence of VGAM2334 RNA, herein designated VGAM RNA, also designated SEQ ID:5045.

Another function of VGAM2334 is therefore inhibition of FLJ22173 (Accession NM_025041). Accordingly, utilities of VGAM2334 include diagnosis, prevention and treatment of diseases and clinical conditions associated with FLJ22173. KIAA1155 (Accession XM_030864) is another VGAM2334 host target gene. KIAA1155 BINDING SITE is HOST TARGET binding site found in the 3' untranslated region of mRNA encoded by KIAA1155, corresponding to a HOST TARGET binding site such as BINDING SITE I, BINDING SITE II or BINDING SITE III. Table 2 illustrates the complementarity of the nucleotide sequences of KIAA1155 BINDING SITE, designated SEQ ID:31193, to the nucleotide sequence of VGAM2334 RNA, herein designated VGAM RNA, also designated SEQ ID:5045.

Another function of VGAM2334 is therefore inhibition of KIAA1155 (Accession XM_030864). Accordingly, utilities of VGAM2334 include diagnosis, prevention and treatment of diseases and clinical conditions associated with KIAA1155. KIAA1560 (Accession XM_034422) is another VGAM2334 host target gene. KIAA1560 BINDING SITE is HOST TARGET binding site found in the 3' untranslated region of mRNA encoded by KIAA1560, corresponding to a HOST TARGET binding site such as BINDING SITE I, BINDING SITE II or BINDING SITE III. Table 2 illustrates the complementarity of the nucleotide sequences of KIAA1560 BINDING SITE, designated SEQ ID:32098, to the nucleotide sequence of VGAM2334 RNA, herein designated VGAM RNA, also designated SEQ ID:5045.

Another function of VGAM2334 is therefore inhibition of KIAA1560 (Accession XM_034422). Accordingly, utilities of VGAM2334 include diagnosis, prevention and treatment of diseases and clinical conditions associated with KIAA1560. KIAA1764 (Accession XM_045086) is another VGAM2334 host target gene. KIAA1764 BINDING SITE is HOST TARGET binding site found in the 5' untranslated region of mRNA encoded by KIAA1764, corresponding to a HOST TARGET binding site such as BINDING SITE I, BINDING SITE II or BINDING SITE III. Table 2 illustrates the complementarity of the nucleotide sequences of KIAA1764 BINDING SITE, designated SEQ ID:34351, to the nucleotide sequence of VGAM2334 RNA, herein designated VGAM RNA, also designated SEQ ID:5045.

Another function of VGAM2334 is therefore inhibition of KIAA1764 (Accession XM_045086). Accordingly, utilities of VGAM2334 include diagnosis, prevention and treatment of diseases and clinical conditions associated with KIAA1764. KIAA1936 (Accession XM_056082) is another VGAM2334 host target gene. KIAA1936 BINDING SITE is HOST TARGET binding site found in the 5' untranslated region of mRNA encoded by KIAA1936, corresponding to a HOST TARGET binding site such as BINDING SITE I, BINDING SITE II or BINDING SITE III. Table 2 illustrates the complementarity of the nucleotide sequences of KIAA1936 BINDING SITE, designated SEQ ID:36362, to the nucleotide sequence of VGAM2334 RNA, herein designated VGAM RNA, also designated SEQ ID:5045.

Another function of VGAM2334 is therefore inhibition of KIAA1936 (Accession XM_056082). Accordingly, utilities of VGAM2334 include diagnosis, prevention and treatment of diseases and clinical conditions associated with KIAA1936. LOC150605 (Accession XM_097927) is another VGAM2334 host target gene. LOC150605 BINDING SITE is HOST TARGET binding site found in the 5' untranslated region of mRNA encoded by LOC150605, corresponding to a HOST TARGET binding site such as BINDING SITE I, BINDING SITE II or BINDING SITE III. Table 2 illustrates the complementarity of the nucleotide sequences of LOC150605 BINDING SITE, designated SEQ ID:41227, to the nucleotide sequence of VGAM2334 RNA, herein designated VGAM RNA, also designated SEQ ID:5045.

Another function of VGAM2334 is therefore inhibition of LOC150605 (Accession XM_097927). Accordingly, utilities of VGAM2334 include diagnosis, prevention and treatment of diseases and clinical conditions associated with LOC150605. LOC157858 (Accession XM_098833) is another VGAM2334 host target gene. LOC157858 BINDING SITE is HOST TARGET binding site found in the 5' untranslated region of mRNA encoded by LOC157858, corresponding to a HOST TARGET binding site such as BINDING SITE I, BINDING SITE II or BINDING SITE III. Table 2 illustrates the complementarity of the nucleotide sequences of LOC157858 BINDING SITE, designated SEQ ID:41864, to the nucleotide sequence of VGAM2334 RNA, herein designated VGAM RNA, also designated SEQ ID:5045.

Another function of VGAM2334 is therefore inhibition of LOC157858 (Accession XM_098833). Accordingly, utilities of VGAM2334 include diagnosis, prevention and treatment of diseases and clinical conditions associated with LOC157858. LOC254057 (Accession XM_173085) is another VGAM2334 host target gene. LOC254057 BINDING SITE is HOST TARGET binding site found in the 5' untranslated region of mRNA encoded by LOC254057, corresponding to a HOST TARGET binding site such as BINDING SITE I, BINDING SITE II or BINDING SITE III. Table 2 illustrates the complementarity of the nucleotide sequences of LOC254057 BINDING SITE, designated SEQ ID:46341, to the nucleotide sequence of VGAM2334 RNA, herein designated VGAM RNA, also designated SEQ ID:5045.

Another function of VGAM2334 is therefore inhibition of LOC254057 (Accession XM_173085). Accordingly, utilities of VGAM2334 include diagnosis, prevention and treatment of diseases and clinical conditions associated with LOC254057. LOC90485 (Accession XM_032059) is another VGAM2334 host target gene. LOC90485 BINDING SITE is HOST TARGET binding site found in the 3' untranslated region of mRNA encoded by LOC90485, corresponding to a HOST TARGET binding site such as BINDING SITE I, BINDING SITE II or BINDING SITE III. Table 2 illustrates the complementarity of the nucleotide sequences of LOC90485 BINDING SITE, designated SEQ ID:31552, to the nucleotide sequence of VGAM2334 RNA, herein designated VGAM RNA, also designated SEQ ID:5045.

Another function of VGAM2334 is therefore inhibition of LOC90485 (Accession XM_032059). Accordingly, utilities of VGAM2334 include diagnosis, prevention and treatment of diseases and clinical conditions associated with LOC90485. FIG. 1 further provides a conceptual description of a novel bioinformatically detected viral gene of the present invention, referred to here as Viral Genomic Address Messenger 2335 (VGAM2335) viral gene, which modulates expression of respective host target genes thereof, the function and utility of which host target genes is known in the art.

VGAM2335 is a novel bioinformatically detected regulatory, non protein coding, viral micro RNA (miRNA) gene. The method by which VGAM2335 was detected is described hereinabove with reference to FIGS. 1-8.

VGAM2335 gene, herein designated VGAM GENE, is a viral gene contained in the genome of Equine Herpesvirus 2. VGAM2335 host target gene, herein designated VGAM HOST TARGET GENE, is a human gene contained in the human genome.

VGAM2335 gene encodes a VGAM2335 precursor RNA, herein designated VGAM PRECURSOR RNA. Similar to other miRNA genes, and unlike most ordinary genes, VGAM2335 precursor RNA does not encode a protein. A nucleotide sequence identical or highly similar to the nucleotide sequence of VGAM2335 precursor RNA is designated SEQ ID:2321, and is provided hereinbelow with reference to the sequence listing part. Nucleotide sequence SEQ ID:2321 is located at position 42087 relative to the genome of Equine Herpesvirus 2.

VGAM2335 precursor RNA folds onto itself, forming VGAM2335 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2335 folded precursor RNA into VGAM2335 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM2335 RNA is designated SEQ ID:5046, and is provided hereinbelow with reference to the sequence listing part.

VGAM2335 host target gene, herein designated VGAM HOST TARGET GENE, encodes a corresponding messenger RNA, VGAM2335 host target RNA, herein designated VGAM HOST TARGET RNA. VGAM2335 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2335 RNA, herein designated VGAM RNA, binds complementarily to one or more host target binding sites located in untranslated regions of VGAM2335 host target RNA, herein designated VGAM HOST TARGET RNA. This complementary binding is due to the fact that the nucleotide sequence of VGAM2335 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2335 RNA, herein designated VGAM RNA, may have a different number of host target binding sites in untranslated regions of a VGAM2335 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2335 RNA, herein designated VGAM RNA, to host target binding sites on VGAM2335 host target RNA, herein designated VGAM HOST TARGET RNA, such as BINDING SITE I, BINDING SITE II and BINDING SITE III, inhibits translation of VGAM2335 host target RNA into VGAM2335 host target protein, herein designated VGAM HOST TARGET PROTEIN. VGAM host target protein is therefore outlined by a broken line.

It is appreciated that VGAM2335 host target gene, herein designated VGAM HOST TARGET GENE, in fact represents a plurality of VGAM2335 host target genes. The mRNA of each one of this plurality of VGAM2335 host target genes comprises one or more host target binding sites, each having a nucleotide sequence which is at least partly complementary to VGAM2335 RNA, herein designated VGAM RNA, and which when bound by VGAM2335 RNA causes inhibition of translation of respective one or more VGAM2335 host target proteins.

It is further appreciated by one skilled in the art that the mode of translational inhibition illustrated by FIG. 1 with specific reference to translational inhibition exerted by VGAM2335 gene, herein designated VGAM GENE, on one or more VGAM2335 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2335 is inhibition of expression of host target genes, as part of a novel viral mechanism of attacking a host. Accordingly, utilities of VGAM2335 include diagnosis, prevention and treatment of viral infection by Equine Herpesvirus 2. Specific functions, and accordingly utilities, of VGAM2335 correlate with, and may be deduced from, the identity of the host target genes which VGAM2335 binds and inhibits, and the function of these host target genes, as elaborated hereinbelow.

Nucleotide sequences of the VGAM2335 precursor RNA, herein designated VGAM PRECURSOR RNA, and of the 'diced' VGAM2335 RNA, herein designated VGAM RNA, and a schematic representation of the secondary folding of VGAM2335 folded precursor RNA, herein designated VGAM FOLDED PRECURSOR RNA, of VGAM2335 are further described hereinbelow with reference to Table 1.

Nucleotide sequences of host target binding sites, such as BINDING SITE-I, BINDING SITE-II and BINDING SITE-III of FIG. 1, found on VGAM2335 host target RNA, and schematic representation of the complementarity of each of these host target binding sites to VGAM2335 RNA, herein designated VGAM RNA, are described hereinbelow with reference to Table 2.

As mentioned hereinabove with reference to FIG. 1, a function of VGAM2335 gene, herein designated VGAM is inhibition of expression of VGAM2335 target genes. It is appreciated that specific functions, and accordingly utilities, of VGAM2335 correlate with, and may be deduced from, the identity of the target genes which VGAM2335 binds and inhibits, and the function of these target genes, as elaborated hereinbelow.

CARPX (Accession NM_020178) is a VGAM2335 host target gene. CARPX BINDING SITE is HOST TARGET binding site found in the 3' untranslated region of mRNA encoded by CARPX, corresponding to a HOST TARGET binding site such as BINDING SITE I, BINDING SITE II or BINDING SITE III. Table 2 illustrates the complementarity of the nucleotide sequences of CARPX BINDING SITE, designated SEQ ID:21396, to the nucleotide sequence of VGAM2335 RNA, herein designated VGAM RNA, also designated SEQ ID:5046.

A function of VGAM2335 is therefore inhibition of CARPX (Accession NM_020178), a gene which is alpha-carbonic anhydrases-related protein. Accordingly, utilities of VGAM2335 include diagnosis, prevention and treatment of diseases and clinical conditions associated with CARPX. The function of CARPX and its association with various diseases and clinical conditions, has been established by previous studies, as described hereinabove with reference to VGAM904. PLAB (Accession XM_038098) is another VGAM2335 host target gene. PLAB BINDING SITE is HOST TARGET binding site found in the 5' untranslated region of mRNA encoded by PLAB, corresponding to a HOST TARGET binding site such as BINDING SITE I, BINDING SITE II or BINDING SITE III. Table 2 illustrates the complementarity of the nucleotide sequences of PLAB BINDING SITE, designated SEQ ID:32753, to the nucleotide sequence of VGAM2335 RNA, herein designated VGAM RNA, also designated SEQ ID:5046.

Another function of VGAM2335 is therefore inhibition of PLAB (Accession XM_038098), a gene which regulates tissue differentiation and maintenance. Accordingly, utilities of VGAM2335 include diagnosis, prevention and treatment of diseases and clinical conditions associated with PLAB. The function of PLAB has been established by previous studies. Bone morphogenetic proteins (e.g., BMP5; 112265) are members of the transforming growth factor-beta (see OMIM Ref. No. TGFB1; 190180) superfamily and regulate tissue differentiation and maintenance. They are synthesized as precursor molecules that are processed at a dibasic cleavage site to release C-terminal domains containing a characteristic motif of 7 conserved cysteines in the mature protein. By screening a full-length cDNA library constructed from a fibrosarcoma cell line for secretory proteins, Yokoyama-Kobayashi et al. (1997) isolated a cDNA encoding a 308-amino acid protein related to TGFB. Northern blot analysis detected strongest expression of a 1.35-kb transcript in placenta, with lower levels in prostate and colon and some expression in kidney. By searching an EST database for TGFB/BMP-related sequences, Hromas et al. (1997) identified a cDNA encoding an identical protein, which they called PLAB (placental BMP). Through analysis of hematopoietic progenitor proliferation, they found that PLAB reduces the growth of granulocytes and macrophages. By searching an EST database, followed by screening a placental cDNA library, Paralkar et al. (1998) isolated a cDNA encoding PLAB, which they called PDF (prostate-derived factor). Western blot analysis showed that PDF is expressed as a 16-kD protein under reducing conditions. In situ hybridization and immunohistochemical analysis demonstrated that PDF is expressed at high levels in cells of the terminal villi in placenta and in the epithelium of prostate but not in other accessory male genital glands. Using subtraction cloning in a monocyte/macrophage cell line, Bootcov et al. (1997) isolated a cDNA encoding PLAB, which they called MIC1 (macrophage-inhibiting cytokine-1). Sequence analysis predicted that the mature secreted MIC1 protein contains 224 amino acids. Northern blot analysis showed that MIC1 is not expressed in undifferentiated cells but is progressively upregulated upon differentiation with retinoic acid followed by phorbol ester or cytokine (e.g., TNFA; 191160) treatment. Exposure of macrophages to MIC1 or TGFB1, followed by stimulation with lipopolysaccharide, suppressed the production of TNFA. Unlike most TGFB superfamily members, in which the amino acid sequence is completely conserved, MIC1 shares only 70% amino acid identity with its rodent counterparts (Bottner et al., 1999). Using FISH, Bottner et al. (1999) mapped the MIC1 gene to 19p13.2-p13.1.

Full details of the abovementioned studies are described in the following publications, the disclosure of which are hereby incorporated by reference:

Paralkar, V. M.; Vail, A. L.; Grasser, W. A.; Brown, T. A.; Xu, H.; Vukicevic, S.; Ke, H. Z.; Qi, H.; Owen, T. A.; Thompson, D. D.: Cloning and characterization of a novel member of the transforming growth factor-beta/bone morphogenetic protein family. J. Biol. Chem. 273:13760-13767, 1998; and Yokoyama-Kobayashi, M.; Saeki, M.; Sekine, S.; Kato, S.: Human cDNA encoding a novel TGF-beta superfamily protein highly expressed in placenta. J. Biochem. 122:622-626, 1997.

Further studies establishing the function and utilities of PLAB are found in John Hopkins OMIM database record ID 605312, and in sited publications numbered 7446-745 and 7454-7452 listed in the bibliography section hereinbelow, which are also hereby incorporated by reference. FLJ21916 (Accession NM_023112) is another VGAM2335 host target gene. FLJ21916 BINDING SITE is HOST TARGET binding site found in the 3' untranslated region of mRNA encoded by FLJ21916, corresponding to a HOST TARGET binding site such as BINDING SITE I, BINDING SITE II or BINDING SITE III. Table 2 illustrates the complementarity of the nucleotide sequences of FLJ21916 BINDING SITE, designated SEQ ID:23379, to the nucleotide sequence of VGAM2335 RNA, herein designated VGAM RNA, also designated SEQ ID:5046.

Another function of VGAM2335 is therefore inhibition of FLJ21916 (Accession NM_023112). Accordingly, utilities of VGAM2335 include diagnosis, prevention and treatment of diseases and clinical conditions associated with FLJ21916. FLJ23233 (Accession NM_024691) is another VGAM2335 host target gene. FLJ23233 BINDING SITE is HOST TARGET binding site found in the 3' untranslated region of mRNA encoded by FLJ23233, corresponding to a HOST TARGET binding site such as BINDING SITE I, BINDING SITE II or BINDING SITE III. Table 2 illustrates the complementarity of the nucleotide sequences of FLJ23233 BINDING SITE, designated SEQ ID:24000, to the nucleotide sequence of VGAM2335 RNA, herein designated VGAM RNA, also designated SEQ ID:5046.

Another function of VGAM2335 is therefore inhibition of FLJ23233 (Accession NM_024691). Accordingly, utilities of VGAM2335 include diagnosis, prevention and treatment of diseases and clinical conditions associated with FLJ23233. Ring Finger Protein (C3HC4 type) 8 (RNF8, Accession NM_003958) is another VGAM2335 host target gene. RNF8 BINDING SITE is HOST TARGET binding site found in the 3' untranslated region of mRNA encoded by RNF8, corresponding to a HOST TARGET binding site such as BINDING SITE I, BINDING SITE II or BINDING SITE III. Table 2 illustrates the complementarity of the nucleotide sequences of RNF8 BINDING SITE, designated SEQ ID:10094, to the nucleotide sequence of VGAM2335 RNA, herein designated VGAM RNA, also designated SEQ ID:5046.

Another function of VGAM2335 is therefore inhibition of Ring Finger Protein (C3HC4 type) 8 (RNF8, Accession NM_003958). Accordingly, utilities of VGAM2335 include diagnosis, prevention and treatment of diseases and clinical conditions associated with RNF8. LOC149461 (Accession XM_086547) is another VGAM2335 host target gene. LOC149461 BINDING SITE is HOST TARGET binding site found in the 3' untranslated region of mRNA encoded by LOC149461, corresponding to a HOST TARGET binding site such as BINDING SITE I, BINDING SITE II or BINDING SITE III. Table 2 illustrates the complementarity of the nucleotide sequences of LOC149461 BINDING SITE, designated SEQ ID:38762, to the nucleotide sequence of VGAM2335 RNA, herein designated VGAM RNA, also designated SEQ ID:5046.

Another function of VGAM2335 is therefore inhibition of LOC149461 (Accession XM_086547). Accordingly, utilities of VGAM2335 include diagnosis, prevention and treatment of diseases and clinical conditions associated with LOC149461. LOC152018 (Accession XM_098156) is another VGAM2335 host target gene. LOC152018 BINDING SITE is HOST TARGET binding site found in the 3' untranslated region of mRNA encoded by LOC152018, corresponding to a HOST TARGET binding site such as BINDING SITE I, BINDING SITE II or BINDING SITE III. Table 2 illustrates the complementarity of the nucleotide sequences of LOC152018 BINDING SITE, designated SEQ ID:41420, to the nucleotide sequence of VGAM2335 RNA, herein designated VGAM RNA, also designated SEQ ID:5046.

Another function of VGAM2335 is therefore inhibition of LOC152018 (Accession XM_098156). Accordingly, utilities of VGAM2335 include diagnosis, prevention and treatment of diseases and clinical conditions associated with LOC152018. LOC164684 (Accession XM_092926) is another VGAM2335 host target gene. LOC164684 BINDING SITE is HOST TARGET binding site found in the 3' untranslated region of mRNA encoded by LOC164684, corresponding to a HOST TARGET binding site such as BINDING SITE I, BINDING SITE II or BINDING SITE III. Table 2 illustrates the complementarity of the nucleotide sequences of LOC164684 BINDING SITE, designated SEQ ID:40160, to the nucleotide sequence of VGAM2335 RNA, herein designated VGAM RNA, also designated SEQ ID:5046.

Another function of VGAM2335 is therefore inhibition of LOC164684 (Accession XM_092926). Accordingly, utilities of VGAM2335 include diagnosis, prevention and treatment of diseases and clinical conditions associated with LOC164684. LOC203083 (Accession XM_117496) is another VGAM2335 host target gene. LOC203083 BINDING SITE is HOST TARGET binding site found in the 5' untranslated region of mRNA encoded by LOC203083, corresponding to a HOST TARGET binding site such as BINDING SITE I, BINDING SITE II or BINDING SITE III. Table 2 illustrates the complementarity of the nucleotide sequences of LOC203083 BINDING SITE, designated SEQ ID:43477, to the nucleotide sequence of VGAM2335 RNA, herein designated VGAM RNA, also designated SEQ ID:5046.

Another function of VGAM2335 is therefore inhibition of LOC203083 (Accession XM_117496). Accordingly, utilities of VGAM2335 include diagnosis, prevention and treatment of diseases and clinical conditions associated with LOC203083. LOC254176 (Accession XM_173215) is another VGAM2335 host target gene. LOC254176 BINDING SITE is HOST TARGET binding site found in the 5' untranslated region of mRNA encoded by LOC254176, corresponding to a HOST TARGET binding site such as BINDING SITE I, BINDING SITE II or BINDING SITE III. Table 2 illustrates the complementarity of the nucleotide sequences of LOC254176 BINDING SITE, designated SEQ ID:46474, to the nucleotide sequence of VGAM2335 RNA, herein designated VGAM RNA, also designated SEQ ID:5046.

Another function of VGAM2335 is therefore inhibition of LOC254176 (Accession XM_173215). Accordingly, utilities of VGAM2335 include diagnosis, prevention and treatment of diseases and clinical conditions associated with LOC254176. FIG. 1 further provides a conceptual description of a novel bioinformatically detected viral gene of the present invention, referred to here as Viral Genomic Address Messenger 2336 (VGAM2336) viral gene, which modulates expression of respective host target genes thereof, the function and utility of which host target genes is known in the art.

VGAM2336 is a novel bioinformatically detected regulatory, non protein coding, viral micro RNA (miRNA) gene. The method by which VGAM2336 was detected is described hereinabove with reference to FIGS. 1-8.

VGAM2336 gene, herein designated VGAM GENE, is a viral gene contained in the genome of Equine Herpesvirus 2. VGAM2336 host target gene, herein designated VGAM HOST TARGET GENE, is a human gene contained in the human genome.

VGAM2336 gene encodes a VGAM2336 precursor RNA, herein designated VGAM PRECURSOR RNA. Similar to other miRNA genes, and unlike most ordinary genes, VGAM2336 precursor RNA does not encode a protein. A nucleotide sequence identical or highly similar to the nucleotide sequence of VGAM2336 precursor RNA is designated SEQ ID:2322, and is provided hereinbelow with reference to the sequence listing part. Nucleotide sequence SEQ ID:2322 is located at position 40488 relative to the genome of Equine Herpesvirus 2.

VGAM2336 precursor RNA folds onto itself, forming VGAM2336 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2336 folded precursor RNA into VGAM2336 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2336 RNA is designated SEQ ID:5047, and is provided hereinbelow with reference to the sequence listing part.

VGAM2336 host target gene, herein designated VGAM HOST TARGET GENE, encodes a corresponding messenger RNA, VGAM2336 host target RNA, herein designated VGAM HOST TARGET RNA. VGAM2336 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2336 RNA, herein designated VGAM RNA, binds complementarily to one or more host target binding sites located in untranslated regions of VGAM2336 host target RNA, herein designated VGAM HOST TARGET RNA. This complementary binding is due to the fact that the nucleotide sequence of VGAM2336 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2336 RNA, herein designated VGAM RNA, may have a different number of host target binding sites in untranslated regions of a VGAM2336 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2336 RNA, herein designated VGAM RNA, to host target binding sites on VGAM2336 host target RNA, herein designated VGAM HOST TARGET RNA, such as BINDING SITE I, BINDING SITE II and BINDING SITE III, inhibits translation of VGAM2336 host target RNA into VGAM2336 host target protein, herein designated VGAM HOST TARGET PROTEIN. VGAM host target protein is therefore outlined by a broken line.

It is appreciated that VGAM2336 host target gene, herein designated VGAM HOST TARGET GENE, in fact represents a plurality of VGAM2336 host target genes. The mRNA of each one of this plurality of VGAM2336 host target genes comprises one or more host target binding sites, each having a nucleotide sequence which is at least partly complementary to VGAM2336 RNA, herein designated VGAM RNA, and which when bound by VGAM2336 RNA causes inhibition of translation of respective one or more VGAM2336 host target proteins.

It is further appreciated by one skilled in the art that the mode of translational inhibition illustrated by FIG. 1 with specific reference to translational inhibition exerted by VGAM2336 gene, herein designated VGAM GENE, on one or more VGAM2336 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2336 is inhibition of expression of host target genes, as part of a novel viral mechanism of attacking a host. Accordingly, utilities of VGAM2336 include diagnosis, prevention and treatment of viral infection by Equine Herpesvirus 2. Specific functions, and accordingly utilities, of VGAM2336 correlate with, and may be deduced from, the identity of the host target genes which VGAM2336 binds and inhibits, and the function of these host target genes, as elaborated hereinbelow.

Nucleotide sequences of the VGAM2336 precursor RNA, herein designated VGAM PRECURSOR RNA, and of the 'diced' VGAM2336 RNA, herein designated VGAM RNA, and a schematic representation of the secondary folding of VGAM2336 folded precursor RNA, herein designated VGAM FOLDED PRECURSOR RNA, of VGAM2336 are further described hereinbelow with reference to Table 1.

Nucleotide sequences of host target binding sites, such as BINDING SITE-I, BINDING SITE-II and BINDING SITE-III of FIG. 1, found on VGAM2336 host target RNA, and schematic representation of the complementarity of each of these host target binding sites to VGAM2336 RNA, herein designated VGAM RNA, are described hereinbelow with reference to Table 2.

As mentioned hereinabove with reference to FIG. 1, a function of VGAM2336 gene, herein designated VGAM is inhibition of expression of VGAM2336 target genes. It is appreciated that specific functions, and accordingly utilities, of VGAM2336 correlate with, and may be deduced from, the identity of the target genes which VGAM2336 binds and inhibits, and the function of these target genes, as elaborated hereinbelow.

ATPase, Aminophospholipid Transporter-like, Class I, Type 8A, Member 2 (ATP8A2, Accession XM_167916) is a VGAM2336 host target gene. ATP8A2 BINDING SITE is HOST TARGET binding site found in the 3' untranslated region of mRNA encoded by ATP8A2, corresponding to a HOST TARGET binding site such as BINDING SITE I, BINDING SITE II or BINDING SITE III. Table 2 illustrates the complementarity of the nucleotide sequences of ATP8A2

BINDING SITE, designated SEQ ID:44922, to the nucleotide sequence of VGAM2336 RNA, herein designated VGAM RNA, also designated SEQ ID:5047.

A function of VGAM2336 is therefore inhibition of ATPase, Aminophospholipid Transporter-like, Class I, Type 8A, Member 2 (ATP8A2, Accession XM_167916). Accordingly, utilities of VGAM2336 include diagnosis, prevention and treatment of diseases and clinical conditions associated with ATP8A2. KIAA0218 (Accession NM_014760) is another VGAM2336 host target gene. KIAA0218 BINDING SITE is HOST TARGET binding site found in the 3' untranslated region of mRNA encoded by KIAA0218, corresponding to a HOST TARGET binding site such as BINDING SITE I, BINDING SITE II or BINDING SITE III. Table 2 illustrates the complementarity of the nucleotide sequences of KIAA0218 BINDING SITE, designated SEQ ID:16517, to the nucleotide sequence of VGAM2336 RNA, herein designated VGAM RNA, also designated SEQ ID:5047.

Another function of VGAM2336 is therefore inhibition of KIAA0218 (Accession NM_014760). Accordingly, utilities of VGAM2336 include diagnosis, prevention and treatment of diseases and clinical conditions associated with KIAA0218. KIAA0570 (Accession NM_014709) is another VGAM2336 host target gene. KIAA0570 BINDING SITE is HOST TARGET binding site found in the 3' untranslated region of mRNA encoded by KIAA0570, corresponding to a HOST TARGET binding site such as BINDING SITE I, BINDING SITE II or BINDING SITE III. Table 2 illustrates the complementarity of the nucleotide sequences of KIAA0570 BINDING SITE, designated SEQ ID:16255, to the nucleotide sequence of VGAM2336 RNA, herein designated VGAM RNA, also designated SEQ ID:5047.

Another function of VGAM2336 is therefore inhibition of KIAA0570 (Accession NM_014709). Accordingly, utilities of VGAM2336 include diagnosis, prevention and treatment of diseases and clinical conditions associated with KIAA0570. Rho-related BTB Domain Containing 2 (RHOBTB2, Accession XM_027679) is another VGAM2336 host target gene. RHOBTB2 BINDING SITE is HOST TARGET binding site found in the 3' untranslated region of mRNA encoded by RHOBTB2, corresponding to a HOST TARGET binding site such as BINDING SITE I, BINDING SITE II or BINDING SITE III. Table 2 illustrates the complementarity of the nucleotide sequences of RHOBTB2 BINDING SITE, designated SEQ ID:30560, to the nucleotide sequence of VGAM2336 RNA, herein designated VGAM RNA, also designated SEQ ID:5047.

Another function of VGAM2336 is therefore inhibition of Rho-related BTB Domain Containing 2 (RHOBTB2, Accession XM_027679). Accordingly, utilities of VGAM2336 include diagnosis, prevention and treatment of diseases and clinical conditions associated with RHOBTB2. LOC149910 (Accession XM_086699) is another VGAM2336 host target gene. LOC149910 BINDING SITE is HOST TARGET binding site found in the 3' untranslated region of mRNA encoded by LOC149910, corresponding to a HOST TARGET binding site such as BINDING SITE I, BINDING SITE II or BINDING SITE III. Table 2 illustrates the complementarity of the nucleotide sequences of LOC149910 BINDING SITE, designated SEQ ID:38826, to the nucleotide sequence of VGAM2336 RNA, herein designated VGAM RNA, also designated SEQ ID:5047.

Another function of VGAM2336 is therefore inhibition of LOC149910 (Accession XM_086699). Accordingly, utilities of VGAM2336 include diagnosis, prevention and treatment of diseases and clinical conditions associated with LOC149910. LOC151361 (Accession XM_098048) is another VGAM2336 host target gene. LOC151361 BINDING SITE is HOST TARGET binding site found in the 3' untranslated region of mRNA encoded by LOC151361, corresponding to a HOST TARGET binding site such as BINDING SITE I, BINDING SITE II or BINDING SITE III. Table 2 illustrates the complementarity of the nucleotide sequences of LOC151361 BINDING SITE, designated SEQ ID:41330, to the nucleotide sequence of VGAM2336 RNA, herein designated VGAM RNA, also designated SEQ ID:5047.

Another function of VGAM2336 is therefore inhibition of LOC151361 (Accession XM_098048). Accordingly, utilities of VGAM2336 include diagnosis, prevention and treatment of diseases and clinical conditions associated with LOC151361. FIG. 1 further provides a conceptual description of a novel bioinformatically detected viral gene of the present invention, referred to here as Viral Genomic Address Messenger 2337 (VGAM2337) viral gene, which modulates expression of respective host target genes thereof, the function and utility of which host target genes is known in the art.

VGAM2337 is a novel bioinformatically detected regulatory, non protein coding, viral micro RNA (miRNA) gene. The method by which VGAM2337 was detected is described hereinabove with reference to FIGS. 1-8.

VGAM2337 gene, herein designated VGAM GENE, is a viral gene contained in the genome of Equine Herpesvirus 2. VGAM2337 host target gene, herein designated VGAM HOST TARGET GENE, is a human gene contained in the human genome.

VGAM2337 gene encodes a VGAM2337 precursor RNA, herein designated VGAM PRECURSOR RNA. Similar to other miRNA genes, and unlike most ordinary genes, VGAM2337 precursor RNA does not encode a protein. A nucleotide sequence identical or highly similar to the nucleotide sequence of VGAM2337 precursor RNA is designated SEQ ID:2323, and is provided hereinbelow with reference to the sequence listing part. Nucleotide sequence SEQ ID:2323 is located at position 42439 relative to the genome of Equine Herpesvirus 2.

VGAM2337 precursor RNA folds onto itself, forming VGAM2337 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2337 folded precursor RNA into VGAM2337 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2337 RNA is designated SEQ ID:5048, and is provided hereinbelow with reference to the sequence listing part.

VGAM2337 host target gene, herein designated VGAM HOST TARGET GENE, encodes a corresponding messenger RNA, VGAM2337 host target RNA, herein designated VGAM HOST TARGET RNA. VGAM2337 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2337 RNA, herein designated VGAM RNA, binds complementarily to one or more host target binding sites located in untranslated regions of VGAM2337 host target RNA, herein designated VGAM HOST TARGET RNA. This complementary binding is due to the fact that the nucleotide sequence of VGAM2337 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2337 RNA, herein designated VGAM RNA, may have a different number of host target binding sites in untranslated regions of a VGAM2337 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2337 RNA, herein designated VGAM RNA, to host target binding sites on VGAM2337 host target RNA, herein designated VGAM HOST TARGET RNA, such as BINDING SITE I, BINDING SITE II and BINDING SITE III, inhibits translation of VGAM2337 host target RNA into VGAM2337 host target protein, herein designated VGAM HOST TARGET PROTEIN. VGAM host target protein is therefore outlined by a broken line.

It is appreciated that VGAM2337 host target gene, herein designated VGAM HOST TARGET GENE, in fact represents a plurality of VGAM2337 host target genes. The mRNA of each one of this plurality of VGAM2337 host target genes comprises one or more host target binding sites, each having a nucleotide sequence which is at least partly complementary to VGAM2337 RNA, herein designated VGAM RNA, and which when bound by VGAM2337 RNA causes inhibition of translation of respective one or more VGAM2337 host target proteins.

It is further appreciated by one skilled in the art that the mode of translational inhibition illustrated by FIG. 1 with specific reference to translational inhibition exerted by VGAM2337 gene, herein designated VGAM GENE, on one or more VGAM2337 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2337 is inhibition of expression of host target genes, as part of a novel viral mechanism of attacking a host. Accordingly, utilities of VGAM2337 include diagnosis, prevention and treatment of viral infection by Equine Herpesvirus 2. Specific functions, and accordingly utilities, of VGAM2337 correlate with, and may be deduced from, the identity of the host target genes which VGAM2337 binds and inhibits, and the function of these host target genes, as elaborated hereinbelow.

Nucleotide sequences of the VGAM2337 precursor RNA, herein designated VGAM PRECURSOR RNA, and of the 'diced' VGAM2337 RNA, herein designated VGAM RNA, and a schematic representation of the secondary folding of VGAM2337 folded precursor RNA, herein designated VGAM FOLDED PRECURSOR RNA, of VGAM2337 are further described hereinbelow with reference to Table 1.

Nucleotide sequences of host target binding sites, such as BINDING SITE-I, BINDING SITE-II and BINDING SITE-III of FIG. 1, found on VGAM2337 host target RNA, and schematic representation of the complementarity of each of these host target binding sites to VGAM2337 RNA, herein designated VGAM RNA, are described hereinbelow with reference to Table 2.

As mentioned hereinabove with reference to FIG. 1, a function of VGAM2337 gene, herein designated VGAM is inhibition of expression of VGAM2337 target genes. It is appreciated that specific functions, and accordingly utilities, of VGAM2337 correlate with, and may be deduced from, the identity of the target genes which VGAM2337 binds and inhibits, and the function of these target genes, as elaborated hereinbelow.

BRCA1 Associated Protein-1 (ubiquitin carboxy-terminal hydrolase) (BAP1, Accession NM_004656) is a VGAM2337 host target gene. BAP1 BINDING SITE is HOST TARGET binding site found in the 3' untranslated region of mRNA encoded by BAP1, corresponding to a HOST TARGET binding site such as BINDING SITE I, BINDING SITE II or BINDING SITE III. Table 2 illustrates the complementarity of the nucleotide sequences of BAP1 BINDING SITE, designated SEQ ID:11023, to the nucleotide sequence of VGAM2337 RNA, herein designated VGAM RNA, also designated SEQ ID:5048.

A function of VGAM2337 is therefore inhibition of BRCA1 Associated Protein-1 (ubiquitin carboxy-terminal hydrolase) (BAP1, Accession NM_004656). Accordingly, utilities of VGAM2337 include diagnosis, prevention and treatment of diseases and clinical conditions associated with BAP1. Ficolin (collagen/fibrinogen domain containing lectin) 2 (hucolin) (FCN2, Accession NM_015838) is another VGAM2337 host target gene. FCN2 BINDING SITE1 and FCN2 BINDING SITE2 are HOST TARGET binding sites found in untranslated regions of mRNA encoded by FCN2, corresponding to HOST TARGET binding sites such as BINDING SITE I, BINDING SITE II or BINDING SITE III. Table 2 illustrates the complementarity of the nucleotide sequences of FCN2 BINDING SITE1 and FCN2 BINDING SITE2, designated SEQ ID:17951 and SEQ ID:17953 respectively, to the nucleotide sequence of VGAM2337 RNA, herein designated VGAM RNA, also designated SEQ ID:5048.

Another function of VGAM2337 is therefore inhibition of Ficolin (collagen/fibrinogen domain containing lectin) 2 (hucolin) (FCN2, Accession NM_015838), a gene which is involved in phagocytosis of pathogens. Accordingly, utilities of VGAM2337 include diagnosis, prevention and treatment of diseases and clinical conditions associated with FCN2. The function of FCN2 and its association with various diseases and clinical conditions, has been established by previous studies, as described hereinabove with reference to VGAM493. BIKE (Accession NM_017593) is another VGAM2337 host target gene. BIKE BINDING SITE is HOST TARGET binding site found in the 3' untranslated region of mRNA encoded by BIKE, corresponding to a HOST TARGET binding site such as BINDING SITE I, BINDING SITE II or BINDING SITE III. Table 2 illustrates the complementarity of the nucleotide sequences of BIKE BINDING SITE, designated SEQ ID:19040, to the nucleotide sequence of VGAM2337 RNA, herein designated VGAM RNA, also designated SEQ ID:5048.

Another function of VGAM2337 is therefore inhibition of BIKE (Accession NM_017593). Accordingly, utilities of VGAM2337 include diagnosis, prevention and treatment of diseases and clinical conditions associated with BIKE. Burkitt Lymphoma Receptor 1, GTP Binding Protein (chemokine (C-X-C motif) Receptor 5) (BLR1, Accession NM_032966) is another VGAM2337 host target gene. BLR1 BINDING SITE1 and BLR1 BINDING SITE2 are HOST TARGET binding sites found in untranslated regions of mRNA encoded by BLR1, corresponding to HOST TARGET binding sites such as BINDING SITE I, BINDING SITE II or BINDING SITE III. Table 2 illustrates the complementarity of the nucleotide sequences of BLR1 BINDING SITE1 and BLR1 BINDING SITE2, designated SEQ ID:26774 and SEQ ID:7445 respectively, to the nucleotide sequence of VGAM2337 RNA, herein designated VGAM RNA, also designated SEQ ID:5048.

Another function of VGAM2337 is therefore inhibition of Burkitt Lymphoma Receptor 1, GTP Binding Protein (chemokine (C-X-C motif) Receptor 5) (BLR1, Accession NM_032966). Accordingly, utilities of VGAM2337 include diagnosis, prevention and treatment of diseases and clinical conditions associated with BLR1. CUB and Sushi Multiple Domains 1 (CSMD1, Accession XM_054838) is another VGAM2337 host target gene. CSMD1 BINDING SITE is HOST TARGET binding site found in the 3' untranslated region of mRNA encoded by CSMD1, corresponding to a HOST TARGET binding site such as BINDING SITE I, BINDING SITE II or BINDING SITE III. Table 2 illustrates the complementarity of the nucleotide sequences of CSMD1 BINDING SITE, designated SEQ ID:36191, to the nucleotide sequence of VGAM2337 RNA, herein designated VGAM RNA, also designated SEQ ID:5048.

Another function of VGAM2337 is therefore inhibition of CUB and Sushi Multiple Domains 1 (CSMD1, Accession XM_054838). Accordingly, utilities of VGAM2337 include diagnosis, prevention and treatment of diseases and clinical conditions associated with CSMD1. FLJ20435 (Accession NM_017821) is another VGAM2337 host target gene. FLJ20435 BINDING SITE is HOST TARGET binding site found in the 3' untranslated region of mRNA encoded by FLJ20435, corresponding to a HOST TARGET binding site such as BINDING SITE I, BINDING SITE II or BINDING SITE III. Table 2 illustrates the complementarity of the nucleotide sequences of FLJ20435 BINDING SITE, designated SEQ ID:19469, to the nucleotide sequence of VGAM2337 RNA, herein designated VGAM RNA, also designated SEQ ID:5048.

Another function of VGAM2337 is therefore inhibition of FLJ20435 (Accession NM_017821). Accordingly, utilities of VGAM2337 include diagnosis, prevention and treatment of diseases and clinical conditions associated with FLJ20435. MAD4 (Accession NM_006454) is another VGAM2337 host target gene. MAD4 BINDING SITE is HOST TARGET binding site found in the 3' untranslated region of mRNA encoded by MAD4, corresponding to a HOST TARGET binding site such as BINDING SITE I, BINDING SITE II or BINDING SITE III. Table 2 illustrates the complementarity of the nucleotide sequences of MAD4 BINDING SITE, designated SEQ ID:13170, to the nucleotide sequence of VGAM2337 RNA, herein designated VGAM RNA, also designated SEQ ID:5048.

Another function of VGAM2337 is therefore inhibition of MAD4 (Accession NM_006454). Accordingly, utilities of VGAM2337 include diagnosis, prevention and treatment of diseases and clinical conditions associated with MAD4. MGC2721 (Accession NM_032737) is another VGAM2337 host target gene. MGC2721 BINDING SITE is HOST TARGET binding site found in the 3' untranslated region of mRNA encoded by MGC2721, corresponding to a HOST TARGET binding site such as BINDING SITE I, BINDING SITE II or BINDING SITE III. Table 2 illustrates the complementarity of the nucleotide sequences of MGC2721 BINDING SITE, designated SEQ ID:26463, to the nucleotide sequence of VGAM2337 RNA, herein designated VGAM RNA, also designated SEQ ID:5048.

Another function of VGAM2337 is therefore inhibition of MGC2721 (Accession NM_032737). Accordingly, utilities of VGAM2337 include diagnosis, prevention and treatment of diseases and clinical conditions associated with MGC2721. Nucleoredoxin (NXN, Accession NM_022463) is another VGAM2337 host target gene. NXN BINDING SITE is HOST TARGET binding site found in the 3' untranslated region of mRNA encoded by NXN, corresponding to a HOST TARGET binding site such as BINDING SITE I, BINDING SITE II or BINDING SITE III. Table 2 illustrates the complementarity of the nucleotide sequences of NXN BINDING SITE, designated SEQ ID:22808, to the nucleotide sequence of VGAM2337 RNA, herein designated VGAM RNA, also designated SEQ ID:5048.

Another function of VGAM2337 is therefore inhibition of Nucleoredoxin (NXN, Accession NM_022463). Accordingly, utilities of VGAM2337 include diagnosis, prevention and treatment of diseases and clinical conditions associated with NXN. Purinergic Receptor P2X-like 1, Orphan Receptor (P2RXL1, Accession NM_005446) is another VGAM2337 host target gene. P2RXL1 BINDING SITE is HOST TARGET binding site found in the 3' untranslated region of mRNA encoded by P2RXL1, corresponding to a HOST TARGET binding site such as BINDING SITE I, BINDING SITE II or BINDING SITE III. Table 2 illustrates the complementarity of the nucleotide sequences of P2RXL1 BINDING SITE, designated SEQ ID:11929, to the nucleotide sequence of VGAM2337 RNA, herein designated VGAM RNA, also designated SEQ ID:5048.

Another function of VGAM2337 is therefore inhibition of Purinergic Receptor P2X-like 1, Orphan Receptor (P2RXL1, Accession NM_005446). Accordingly, utilities of VGAM2337 include diagnosis, prevention and treatment of diseases and clinical conditions associated with P2RXL1. TACTILE (Accession NM_005816) is another VGAM2337 host target gene. TACTILE BINDING SITE is HOST TARGET binding site found in the 3' untranslated region of mRNA encoded by TACTILE, corresponding to a HOST TARGET binding site such as BINDING SITE I, BINDING SITE II or BINDING SITE III. Table 2 illustrates the complementarity of the nucleotide sequences of TACTILE BINDING SITE, designated SEQ ID:12410, to the nucleotide sequence of VGAM2337 RNA, herein designated VGAM RNA, also designated SEQ ID:5048.

Another function of VGAM2337 is therefore inhibition of TACTILE (Accession NM_005816). Accordingly, utilities of VGAM2337 include diagnosis, prevention and treatment of diseases and clinical conditions associated with TACTILE. Zinc Finger Protein 213 (ZNF213, Accession XM_036493) is another VGAM2337 host target gene. ZNF213 BINDING SITE is HOST TARGET binding site found in the 5' untranslated region of mRNA encoded by ZNF213, corresponding to a HOST TARGET binding site such as BINDING SITE I, BINDING SITE II or BINDING SITE III. Table 2 illustrates the complementarity of the nucleotide sequences of ZNF213 BINDING SITE, designated SEQ ID:32463, to the nucleotide sequence of VGAM2337 RNA, herein designated VGAM RNA, also designated SEQ ID:5048.

Another function of VGAM2337 is therefore inhibition of Zinc Finger Protein 213 (ZNF213, Accession XM_036493). Accordingly, utilities of VGAM2337 include diagnosis, prevention and treatment of diseases and clinical conditions associated with ZNF213. LOC257482 (Accession XM_168544) is another VGAM2337 host target gene. LOC257482 BINDING SITE is HOST TARGET binding site found in the 3' untranslated region of mRNA encoded by LOC257482, corresponding to a HOST TARGET binding site such as BINDING SITE I, BINDING SITE II or BINDING SITE III. Table 2 illustrates the complementarity of the nucleotide sequences of LOC257482 BINDING SITE, designated SEQ ID:45236, to the nucleotide sequence of VGAM2337 RNA, herein designated VGAM RNA, also designated SEQ ID:5048.

Another function of VGAM2337 is therefore inhibition of LOC257482 (Accession XM_168544). Accordingly, utilities of VGAM2337 include diagnosis, prevention and treatment of diseases and clinical conditions associated with LOC257482. FIG. 1 further provides a conceptual description of a novel bioinformatically detected viral gene of the present invention, referred to here as Viral Genomic Address Messenger 2338 (VGAM2338) viral gene, which modulates expression of respective host target genes thereof, the function and utility of which host target genes is known in the art.

VGAM2338 is a novel bioinformatically detected regulatory, non protein coding, viral micro RNA (miRNA) gene. The method by which VGAM2338 was detected is described hereinabove with reference to FIGS. 1-8.

VGAM2338 gene, herein designated VGAM GENE, is a viral gene contained in the genome of Equine Herpesvirus 2. VGAM2338 host target gene, herein designated VGAM HOST TARGET GENE, is a human gene contained in the human genome.

VGAM2338 gene encodes a VGAM2338 precursor RNA, herein designated VGAM PRECURSOR RNA. Similar to other miRNA genes, and unlike most ordinary genes, VGAM2338 precursor RNA does not encode a protein. A nucleotide sequence identical or highly similar to the nucleotide sequence of VGAM2338 precursor RNA is designated SEQ ID:2324, and is provided hereinbelow with reference to the sequence listing part. Nucleotide sequence SEQ ID:2324 is located at position 36402 relative to the genome of Equine Herpesvirus 2.

VGAM2338 precursor RNA folds onto itself, forming VGAM2338 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2338 folded precursor RNA into VGAM2338 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2338 RNA is designated SEQ ID:5049, and is provided hereinbelow with reference to the sequence listing part.

VGAM2338 host target gene, herein designated VGAM HOST TARGET GENE, encodes a corresponding messenger RNA, VGAM2338 host target RNA, herein designated VGAM HOST TARGET RNA. VGAM2338 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2338 RNA, herein designated VGAM RNA, binds complementarily to one or more host target binding sites located in untranslated regions of VGAM2338 host target RNA, herein designated VGAM HOST TARGET RNA. This complementary binding is due to the fact that the nucleotide sequence of VGAM2338 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2338 RNA, herein designated VGAM RNA, may have a different number of host target binding sites in untranslated regions of a VGAM2338 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2338 RNA, herein designated VGAM RNA, to host target binding sites on VGAM2338 host target RNA, herein designated VGAM HOST TARGET RNA, such as BINDING SITE I, BINDING SITE II and BINDING SITE III, inhibits translation of VGAM2338 host target RNA into VGAM2338 host target protein, herein designated VGAM HOST TARGET PROTEIN. VGAM host target protein is therefore outlined by a broken line.

It is appreciated that VGAM2338 host target gene, herein designated VGAM HOST TARGET GENE, in fact represents a plurality of VGAM2338 host target genes. The mRNA of each one of this plurality of VGAM2338 host target genes comprises one or more host target binding sites, each having a nucleotide sequence which is at least partly complementary to VGAM2338 RNA, herein designated VGAM RNA, and which when bound by VGAM2338 RNA causes inhibition of translation of respective one or more VGAM2338 host target proteins.

It is further appreciated by one skilled in the art that the mode of translational inhibition illustrated by FIG. 1 with specific reference to translational inhibition exerted by VGAM2338 gene, herein designated VGAM GENE, on one or more VGAM2338 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2338 is inhibition of expression of host target genes, as part of a novel viral mechanism of attacking a host. Accordingly, utilities of VGAM2338 include diagnosis, prevention and treatment of viral infection by Equine Herpesvirus 2. Specific functions, and accordingly utilities, of VGAM2338 correlate with, and may be deduced from, the identity of the host target genes which VGAM2338 binds and inhibits, and the function of these host target genes, as elaborated hereinbelow.

Nucleotide sequences of the VGAM2338 precursor RNA, herein designated VGAM PRECURSOR RNA, and of the 'diced' VGAM2338 RNA, herein designated VGAM RNA, and a schematic representation of the secondary folding of VGAM2338 folded precursor RNA, herein designated VGAM FOLDED PRECURSOR RNA, of VGAM2338 are further described hereinbelow with reference to Table 1.

Nucleotide sequences of host target binding sites, such as BINDING SITE-I, BINDING SITE-II and BINDING SITE-III of FIG. 1, found on VGAM2338 host target RNA, and schematic representation of the complementarity of each of these host target binding sites to VGAM2338 RNA, herein designated VGAM RNA, are described hereinbelow with reference to Table 2.

As mentioned hereinabove with reference to FIG. 1, a function of VGAM2338 gene, herein designated VGAM is inhibition of expression of VGAM2338 target genes. It is appreciated that specific functions, and accordingly utilities, of VGAM2338 correlate with, and may be deduced from, the identity of the target genes which VGAM2338 binds and inhibits, and the function of these target genes, as elaborated hereinbelow.

Aquaporin 1 (channel-forming integral protein, 28 kDa) (AQP1, Accession NM_000385) is a VGAM2338 host target gene. AQP1 BINDING SITE is HOST TARGET binding site found in the 3' untranslated region of mRNA encoded by AQP1, corresponding to a HOST TARGET binding site such as BINDING SITE I, BINDING SITE II or BINDING SITE III. Table 2 illustrates the complementarity of the nucleotide sequences of AQP1 BINDING SITE, designated SEQ ID:5960, to the nucleotide sequence of VGAM2338 RNA, herein designated VGAM RNA, also designated SEQ ID:5049.

A function of VGAM2338 is therefore inhibition of Aquaporin 1 (channel-forming integral protein, 28 kDa) (AQP1, Accession NM_000385). Accordingly, utilities of VGAM2338 include diagnosis, prevention and treatment of diseases and clinical conditions associated with AQP1. UDP-Gal:betaGlcNAc Beta 1,4-Galactosyltransferase, Polypeptide 6 (B4GALT6, Accession XM_008799) is another VGAM2338 host target gene. B4GALT6 BINDING SITE is HOST TARGET binding site found in the 3' untranslated region of mRNA encoded by B4GALT6, corresponding to a HOST TARGET binding site such as BINDING SITE I, BINDING SITE II or BINDING SITE III. Table 2 illustrates the complementarity of the nucleotide sequences of B4GALT6 BINDING SITE, designated SEQ ID:30092, to the nucleotide sequence of VGAM2338 RNA, herein designated VGAM RNA, also designated SEQ ID:5049.

Another function of VGAM2338 is therefore inhibition of UDP-Gal:betaGlcNAc Beta 1,4-Galactosyltransferase, Polypeptide 6 (B4GALT6, Accession XM_008799). Accordingly, utilities of VGAM2338 include diagnosis, prevention and treatment of diseases and clinical conditions associated with B4GALT6. B-cell CLL/lymphoma 2 (BCL2, Accession NM_000633) is another VGAM2338 host target gene. BCL2 BINDING SITE is HOST TARGET binding site found in the 3' untranslated region of mRNA encoded by BCL2, corresponding to a HOST TARGET binding site such as BINDING SITE I, BINDING SITE II or BINDING SITE III. Table 2 illustrates the complementarity of the nucleotide sequences of BCL2 BINDING SITE, designated SEQ ID:6252, to the nucleotide sequence of VGAM2338 RNA, herein designated VGAM RNA, also designated SEQ ID:5049.

Another function of VGAM2338 is therefore inhibition of B-cell CLL/lymphoma 2 (BCL2, Accession NM_000633). Accordingly, utilities of VGAM2338 include diagnosis, prevention and treatment of diseases and clinical conditions associated with BCL2. Calcium-sensing Receptor (hypocalciuric hypercalcemia 1, severe neonatal hyperparathyroidism) (CASR, Accession NM_000388) is another VGAM2338 host target gene. CASR BINDING SITE is HOST TARGET binding site found in the 5' untranslated region of mRNA encoded by CASR, corresponding to a HOST TARGET binding site such as BINDING SITE I, BINDING SITE II or BINDING SITE III. Table 2 illustrates the complementarity of the nucleotide sequences of CASR BINDING SITE, designated SEQ ID:5961, to the nucleotide sequence of VGAM2338 RNA, herein designated VGAM RNA, also designated SEQ ID:5049.

Another function of VGAM2338 is therefore inhibition of Calcium-sensing Receptor (hypocalciuric hypercalcemia 1, severe neonatal hyperparathyroidism) (CASR, Accession NM_000388). Accordingly, utilities of VGAM2338 include diagnosis, prevention and treatment of diseases and clinical conditions associated with CASR. CERD4 (Accession NM_012074) is another VGAM2338 host target gene. CERD4 BINDING SITE is HOST TARGET binding site found in the 3' untranslated region of mRNA encoded by CERD4, corresponding to a HOST TARGET binding site such as BINDING SITE I, BINDING SITE II or BINDING SITE III. Table 2 illustrates the complementarity of the nucleotide sequences of CERD4 BINDING SITE, designated SEQ ID:14351, to the nucleotide sequence of VGAM2338 RNA, herein designated VGAM RNA, also designated SEQ ID:5049.

Another function of VGAM2338 is therefore inhibition of CERD4 (Accession NM_012074). Accordingly, utilities of VGAM2338 include diagnosis, prevention and treatment of diseases and clinical conditions associated with CERD4. Diacylglycerol O-acyltransferase Homolog 2 (mouse) (DGAT2, Accession NM_032564) is another VGAM2338 host target gene. DGAT2 BINDING SITE is HOST TARGET binding site found in the 3' untranslated region of mRNA encoded by DGAT2, corresponding to a HOST TARGET binding site such as BINDING SITE I, BINDING SITE II or BINDING SITE III. Table 2 illustrates the complementarity of the nucleotide sequences of DGAT2 BINDING SITE, designated SEQ ID:26289, to the nucleotide sequence of VGAM2338 RNA, herein designated VGAM RNA, also designated SEQ ID:5049.

Another function of VGAM2338 is therefore inhibition of Diacylglycerol O-acyltransferase Homolog 2 (mouse) (DGAT2, Accession NM_032564). Accordingly, utilities of VGAM2338 include diagnosis, prevention and treatment of diseases and clinical conditions associated with DGAT2. Inositol Hexaphosphate Kinase 3 (IHPK3, Accession NM_054111) is another VGAM2338 host target gene. IHPK3 BINDING SITE is HOST TARGET binding site found in the 5' untranslated region of mRNA encoded by IHPK3, corresponding to a HOST TARGET binding site such as BINDING SITE I, BINDING SITE II or BINDING SITE III. Table 2 illustrates the complementarity of the nucleotide sequences of IHPK3 BINDING SITE, designated SEQ ID:27659, to the nucleotide sequence of VGAM2338 RNA, herein designated VGAM RNA, also designated SEQ ID:5049.

Another function of VGAM2338 is therefore inhibition of Inositol Hexaphosphate Kinase 3 (IHPK3, Accession NM_054111). Accordingly, utilities of VGAM2338 include diagnosis, prevention and treatment of diseases and clinical conditions associated with IHPK3. Interleukin 17E (IL17E, Accession NM_022789) is another VGAM2338 host target gene. IL17E BINDING SITE is HOST TARGET binding site found in the 5" untranslated region of mRNA encoded by IL17E, corresponding to a HOST TARGET binding site such as BINDING SITE I, BINDING SITE II or BINDING SITE III. Table 2 illustrates the complementarity of the nucleotide sequences of IL17E BINDING SITE, designated SEQ ID:23070, to the nucleotide sequence of VGAM2338 RNA, herein designated VGAM RNA, also designated SEQ ID:5049.

Another function of VGAM2338 is therefore inhibition of Interleukin 17E (IL17E, Accession NM_022789), a gene which induces activation of nf-kappab and stimulates production of the proinflammatory chemokine il-8. Accordingly, utilities of VGAM2338 include diagnosis, prevention and treatment of diseases and clinical conditions associated with IL17E. The function of IL17E has been established by previous studies. By genomic DNA sequence analysis, Lee et al. (2001) identified a cDNA encoding IL17E. Sequence analysis predicted that the 177-amino acid protein shares 16 to 20% identity with IL17, IL17B (OMIM Ref. No. 604627), and IL17C (OMIM Ref. No. 604628). These proteins share 20 to 30% identity in the C terminus, and all contain 4 conserved cysteine residues. Although Northern blot analysis revealed no IL17E expression, RT-PCR detected low-level expression in several tissues, including brain, kidney, lung, prostate, testis, spinal cord, adrenal gland, and trachea Treatment of mice in vivo with Il17e by Fort et al. (2001) resulted in induction of Th2-type cytokines, eosinophilia, increased serum immunoglobulin, and the development of histologic changes in lungs and the gastrointestinal tract. In contrast, other IL17-related cytokines induce proinflammatory cytokines and neutrophil migration. RT-PCR, ELISA, and flow cytometric analyses demonstrated that Il17e induces Th2-type cytokine expression and production by non-T, non-B accessory cells that express high levels of major histocompatibility complex class II and low levels of Cd11c (ITGAX; 151510).

Full details of the abovementioned studies are described in the following publications, the disclosure of which are hereby incorporated by reference:

Lee, J.; Ho, W.-H.; Maruoka, M.; Corpuz, R. T.; Baldwin, D. T.; Foster, J. S.; Goddard, A. D.; Yansura, D. G.; Vandlen, R. L.; Wood, W. L.; Gurney, A. L.: IL-17E, a novel proinflammatory ligand for the IL-17 receptor homolog IL-17Rh1. J. Biol. Chem. 276:1660-1664, 2001; and Fort, M. M.; Cheung, J.; Yen, D.; Li, J.; Zurawski, S. M.; Lo, S.; Menon, S.; Clifford, T.; Hunte, B.; Lesley, R.; Muchamuel, T.; Hurst, S. D.; Zurawski, G.; Leach, M. W.; Gorman, D. M.

Further studies establishing the function and utilities of IL17E are found in John Hopkins OMIM database record ID 605658, and in sited publications numbered 640 and 6408 listed in the bibliography section hereinbelow, which are also hereby incorporated by reference. Interleukin 1 Receptor Antagonist (IL1RN, Accession NM_000577) is another VGAM2338 host target gene. IL1RN BINDING SITE is HOST TARGET binding site found in the 3" untranslated region of mRNA encoded by IL1RN, corresponding to a HOST TARGET binding site such as BINDING SITE I, BINDING SITE II or BINDING SITE III. Table 2 illustrates the complementarity of the nucleotide sequences of IL1RN BINDING SITE, designated SEQ ID:6178, to the nucleotide sequence of VGAM2338 RNA, herein designated VGAM RNA, also designated SEQ ID:5049.

Another function of VGAM2338 is therefore inhibition of Interleukin 1 Receptor Antagonist (IL1RN, Accession NM_000577), a gene which inhibits the activity of il-1 by binding to its receptor. il-1ra has no il-1 like activity. Accordingly, utilities of VGAM2338 include diagnosis, prevention and treatment of diseases and clinical conditions associated with IL1RN. The function of IL1RN and its association with various diseases and clinical conditions, has been established by previous studies, as described hereinabove with reference to VGAM193. Muscleblind-like (Drosophila) (MBNL, Accession NM_021038) is another VGAM2338 host target gene. MBNL BINDING SITE is HOST TARGET binding site found in the 5' untranslated region of mRNA encoded by MBNL, corresponding to a HOST TARGET binding site such as BINDING SITE I, BINDING SITE II or BINDING SITE III. Table 2 illustrates the complementarity of the nucleotide sequences of MBNL BINDING SITE, designated SEQ ID:22026, to the nucleotide sequence of VGAM2338 RNA, herein designated VGAM RNA, also designated SEQ ID:5049.

Another function of VGAM2338 is therefore inhibition of Muscleblind-like (Drosophila) (MBNL, Accession NM_021038), a gene which binds to cug triplet repeat expansion dsrna (by similarity). Accordingly, utilities of VGAM2338 include diagnosis, prevention and treatment of diseases and clinical conditions associated with MBNL. The function of MBNL and its association with various diseases and clinical conditions, has been established by previous studies, as described hereinabove with reference to VGAM95. Platelet-derived Growth Factor Beta Polypeptide (simian sarcoma viral (v-sis) Oncogene Homolog) (PDGFB, Accession NM_002608) is another VGAM2338 host target gene. PDGFB BINDING SITE is HOST TARGET binding site found in the 3' untranslated region of mRNA encoded by PDGFB, corresponding to a HOST TARGET binding site such as BINDING SITE I, BINDING SITE II or BINDING SITE III. Table 2 illustrates the complementarity of the nucleotide sequences of PDGFB BINDING SITE, designated SEQ ID:8468, to the nucleotide sequence of VGAM2338 RNA, herein designated VGAM RNA, also designated SEQ ID:5049.

Another function of VGAM2338 is therefore inhibition of Platelet-derived Growth Factor Beta Polypeptide (simian sarcoma viral (v-sis) Oncogene Homolog) (PDGFB, Accession NM_002608), a gene which plays an important role in stimulating adjacent cells to grow and thereby heal the wound. Accordingly, utilities of VGAM2338 include diagnosis, prevention and treatment of diseases and clinical conditions associated with PDGFB. The function of PDGFB and its association with various diseases and clinical conditions, has been established by previous studies, as described hereinabove with reference to VGAM173. Phosphoinositide-3-kinase, Regulatory Subunit, Polypeptide 3 (p55, gamma) (PIK3R3, Accession XM_027982) is another VGAM2338 host target gene. PIK3R3 BINDING SITE is HOST TARGET binding site found in the 3' untranslated region of mRNA encoded by PIK3R3, corresponding to a HOST TARGET binding site such as BINDING SITE I, BINDING SITE II or BINDING SITE III. Table 2 illustrates the complementarity of the nucleotide sequences of PIK3R3 BINDING SITE, designated SEQ ID:30600, to the nucleotide sequence of VGAM2338 RNA, herein designated VGAM RNA, also designated SEQ ID:5049.

Another function of VGAM2338 is therefore inhibition of Phosphoinositide-3-kinase, Regulatory Subunit, Polypeptide 3 (p55, gamma) (PIK3R3, Accession XM_027982). Accordingly, utilities of VGAM2338 include diagnosis, prevention and treatment of diseases and clinical conditions associated with PIK3R3. Peanut-like 1 (Drosophila) (PNUTL1, Accession NM_002688) is another VGAM2338 host target gene. PNUTL1 BINDING SITE is HOST TARGET binding site found in the 3' untranslated region of mRNA encoded by PNUTL1, corresponding to a HOST TARGET binding site such as BINDING SITE I, BINDING SITE II or BINDING SITE III. Table 2 illustrates the complementarity of the nucleotide sequences of PNUTL1 BINDING SITE, designated SEQ ID:8546, to the nucleotide sequence of VGAM2338 RNA, herein designated VGAM RNA, also designated SEQ ID:5049.

Another function of VGAM2338 is therefore inhibition of Peanut-like 1 (Drosophila) (PNUTL1, Accession NM_002688). Accordingly, utilities of VGAM2338 include diagnosis, prevention and treatment of diseases and clinical conditions associated with PNUTL1. Secreted Frizzled-related Protein 1 (SFRP1, Accession NM_003012) is another VGAM2338 host target gene. SFRP1 BINDING SITE is HOST TARGET binding site found in the 3' untranslated region of mRNA encoded by SFRP1, corresponding to a HOST TARGET binding site such as BINDING SITE I, BINDING SITE II or BINDING SITE III. Table 2 illustrates the complementarity of the nucleotide sequences of SFRP1 BINDING SITE, designated SEQ ID:8928, to the nucleotide sequence of VGAM2338 RNA, herein designated VGAM RNA, also designated SEQ ID:5049.

Another function of VGAM2338 is therefore inhibition of Secreted Frizzled-related Protein 1 (SFRP1, Accession NM_003012), a gene which is a receptor for wnt proteins that may have an anti-apoptotic function. Accordingly, utilities of VGAM2338 include diagnosis, prevention and treatment of diseases and clinical conditions associated with SFRP1. The function of SFRP1 and its association with various diseases and clinical conditions, has been established by previous studies, as described hereinabove with reference to VGAM250. Teratocarcinoma-derived Growth Factor 1 (TDGF1, Accession NM_003212) is another VGAM2338 host target gene. TDGF1 BINDING SITE is HOST TARGET binding site found in the 3' untranslated region of mRNA encoded by TDGF1, corresponding to a HOST TARGET binding site such as BINDING SITE I, BINDING SITE II or BINDING SITE III. Table 2 illustrates the complementarity of the nucleotide sequences of TDGF1 BINDING SITE, designated SEQ ID:9209, to the nucleotide sequence of VGAM2338 RNA, herein designated VGAM RNA, also designated SEQ ID:5049.

Another function of VGAM2338 is therefore inhibition of Teratocarcinoma-derived Growth Factor 1 (TDGF1, Accession NM_003212), a gene which can play a role in the determination of the epiblastic cells that subsequently give rise to the mesoderm. Accordingly, utilities of VGAM2338 include diagnosis, prevention and treatment of diseases and clinical conditions associated with TDGF1. The function of TDGF1 and its association with various diseases and clinical conditions, has been established by previous studies, as described hereinabove with reference to VGAM1322. Kell Blood Group Precursor (McLeod phenotype) (XK, Accession NM_021083) is another VGAM2338 host target gene. XK BINDING SITE is HOST TARGET binding site found in the 3' untranslated region of mRNA encoded by XK, corresponding to a HOST TARGET binding site such as BINDING SITE I, BINDING SITE II or BINDING SITE III. Table 2 illustrates the complementarity of the nucleotide sequences of XK BINDING SITE, designated SEQ ID:22061, to the nucleotide sequence of VGAM2338 RNA, herein designated VGAM RNA, also designated SEQ ID:5049.

Another function of VGAM2338 is therefore inhibition of Kell Blood Group Precursor (McLeod phenotype) (XK, Accession NM_021083). Accordingly, utilities of VGAM2338 include diagnosis, prevention and treatment of diseases and clinical conditions associated with XK. Chromosome 11 Open Reading Frame 11 (C11orf11, Accession XM_167769) is another VGAM2338 host target gene. C11orf11 BINDING SITE is HOST TARGET binding site found in the 5' untranslated region of mRNA encoded by C11orf11, corresponding to a HOST TARGET binding site such as BINDING SITE I, BINDING SITE II or BINDING SITE III. Table 2 illustrates the complementarity of the nucleotide sequences of C11orf11 BINDING SITE, designated SEQ ID:44782, to the nucleotide sequence of VGAM2338 RNA, herein designated VGAM RNA, also designated SEQ ID:5049.

Another function of VGAM2338 is therefore inhibition of Chromosome 11 Open Reading Frame 11 (C11orf11, Accession XM_167769). Accordingly, utilities of VGAM2338 include diagnosis, prevention and treatment of diseases and clinical conditions associated with C11orf11. DKFZP434E2135 (Accession NM_030804) is another VGAM2338 host target gene. DKFZP434E2135 BINDING SITE is HOST TARGET binding site found in the 3' untranslated region of mRNA encoded by DKFZP434E2135, corresponding to a HOST TARGET binding site such as BINDING SITE I, BINDING SITE II or BINDING SITE III. Table 2 illustrates the complementarity of the nucleotide sequences of DKFZP434E2135 BINDING SITE, designated SEQ ID:25116, to the nucleotide sequence of VGAM2338 RNA, herein designated VGAM RNA, also designated SEQ ID:5049.

Another function of VGAM2338 is therefore inhibition of DKFZP434E2135 (Accession NM_030804). Accordingly, utilities of VGAM2338 include diagnosis, prevention and treatment of diseases and clinical conditions associated with DKFZP434E2135. EFA6R (Accession NM_015310) is another VGAM2338 host target gene. EFA6R BINDING SITE is HOST TARGET binding site found in the 3' untranslated region of mRNA encoded by EFA6R, corresponding to a HOST TARGET binding site such as BINDING SITE I, BINDING SITE II or BINDING SITE III. Table 2 illustrates the complementarity of the nucleotide sequences of EFA6R BINDING SITE, designated SEQ ID:17623, to the nucleotide sequence of VGAM2338 RNA, herein designated VGAM RNA, also designated SEQ ID:5049.

Another function of VGAM2338 is therefore inhibition of EFA6R (Accession NM_015310). Accordingly, utilities of VGAM2338 include diagnosis, prevention and treatment of diseases and clinical conditions associated with EFA6R. FLJ10829 (Accession NM_018234) is another VGAM2338 host target gene. FLJ10829 BINDING SITE is HOST TARGET binding site found in the 3' untranslated region of mRNA encoded by FLJ10829, corresponding to a HOST TARGET binding site such as BINDING SITE I, BINDING SITE II or BINDING SITE III. Table 2 illustrates the complementarity of the nucleotide sequences of FLJ10829 BINDING SITE, designated SEQ ID:20179, to the nucleotide sequence of VGAM2338 RNA, herein designated VGAM RNA, also designated SEQ ID:5049.

Another function of VGAM2338 is therefore inhibition of FLJ10829 (Accession NM_018234). Accordingly, utilities of VGAM2338 include diagnosis, prevention and treatment of diseases and clinical conditions associated with FLJ10829. FLJ11608 (Accession NM_024557) is another VGAM2338 host target gene. FLJ11608 BINDING SITE is HOST TARGET binding site found in the 3' untranslated region of mRNA encoded by FLJ11608, corresponding to a HOST TARGET binding site such as BINDING SITE I, BINDING SITE II or BINDING SITE III. Table 2 illustrates the complementarity of the nucleotide sequences of FLJ11608 BINDING SITE, designated SEQ ID:23776, to the nucleotide sequence of VGAM2338 RNA, herein designated VGAM RNA, also designated SEQ ID:5049.

Another function of VGAM2338 is therefore inhibition of FLJ11608 (Accession NM_024557). Accordingly, utilities of VGAM2338 include diagnosis, prevention and treatment of diseases and clinical conditions associated with FLJ11608. FLJ20073 (Accession NM_017654) is another VGAM2338 host target gene. FLJ20073 BINDING SITE is HOST TARGET binding site found in the 3' untranslated region of mRNA encoded by FLJ20073, corresponding to a HOST TARGET binding site such as BINDING SITE I, BINDING SITE II or BINDING SITE III. Table 2 illustrates the complementarity of the nucleotide sequences of FLJ20073 BINDING SITE, designated SEQ ID:19164, to the nucleotide sequence of VGAM2338 RNA, herein designated VGAM RNA, also designated SEQ ID:5049.

Another function of VGAM2338 is therefore inhibition of FLJ20073 (Accession NM_017654). Accordingly, utilities of VGAM2338 include diagnosis, prevention and treatment of diseases and clinical conditions associated with FLJ20073. FLJ20274 (Accession XM_031455) is another VGAM2338 host target gene. FLJ20274 BINDING SITE is HOST TARGET binding site found in the 3' untranslated region of mRNA encoded by FLJ20274, corresponding to a HOST TARGET binding site such as BINDING SITE I, BINDING SITE II or BINDING SITE III. Table 2 illustrates the complementarity of the nucleotide sequences of FLJ20274 BINDING SITE, designated SEQ ID:31385, to the nucleotide sequence of VGAM2338 RNA, herein designated VGAM RNA, also designated SEQ ID:5049.

Another function of VGAM2338 is therefore inhibition of FLJ20274 (Accession XM_031455). Accordingly, utilities of VGAM2338 include diagnosis, prevention and treatment of diseases and clinical conditions associated with FLJ20274. GABA(A) Receptors Associated Protein Like 3 (GABARAPL3, Accession NM_032568) is another VGAM2338 host target gene. GABARAPL3 BINDING SITE is HOST TARGET binding site found in the 3' untranslated region of mRNA encoded by GABARAPL3, corresponding to a HOST TARGET binding site such as BINDING SITE I, BINDING SITE II or BINDING SITE III. Table 2 illustrates the complementarity of the nucleotide sequences of GABARAPL3 BINDING SITE, designated SEQ ID:26297, to the nucleotide sequence of VGAM2338 RNA, herein designated VGAM RNA, also designated SEQ ID:5049.

Another function of VGAM2338 is therefore inhibition of GABA(A) Receptors Associated Protein Like 3 (GABARAPL3, Accession NM_032568). Accordingly, utilities of VGAM2338 include diagnosis, prevention and treatment of diseases and clinical conditions associated with GABARAPL3. GMPPB (Accession XM_171044) is another VGAM2338 host target gene. GMPPB BINDING SITE is HOST TARGET binding site found in the 5' untranslated region of mRNA encoded by GMPPB, corresponding to a HOST TARGET binding site such as BINDING SITE I, BINDING SITE II or BINDING SITE III. Table 2 illustrates the complementarity of the nucleotide sequences of GMPPB BINDING SITE, designated SEQ ID:45809, to the nucleotide sequence of VGAM2338 RNA, herein designated VGAM RNA, also designated SEQ ID:5049.

Another function of VGAM2338 is therefore inhibition of GMPPB (Accession XM_171044). Accordingly, utilities of VGAM2338 include diagnosis, prevention and treatment of diseases and clinical conditions associated with GMPPB. KIAA0143 (Accession XM_035825) is another VGAM2338 host target gene. KIAA0143 BINDING SITE is HOST TARGET binding site found in the 3' untranslated region of mRNA encoded by KIAA0143, corresponding to a HOST TARGET binding site such as BINDING SITE I, BINDING SITE II or BINDING SITE III. Table 2 illustrates the complementarity of the nucleotide sequences of KIAA0143 BINDING SITE, designated SEQ ID:32350, to the nucleotide sequence of VGAM2338 RNA, herein designated VGAM RNA, also designated SEQ ID:5049.

Another function of VGAM2338 is therefore inhibition of KIAA0143 (Accession XM_035825). Accordingly, utilities of VGAM2338 include diagnosis, prevention and treatment of diseases and clinical conditions associated with KIAA0143. KIAA0161 (Accession NM_014746) is another VGAM2338 host target gene. KIAA0161 BINDING SITE is HOST TARGET binding site found in the 3' untranslated region of mRNA encoded by KIAA0161, corresponding to a HOST TARGET binding site such as BINDING SITE I, BINDING SITE II or BINDING SITE III. Table 2 illustrates the complementarity of the nucleotide sequences of KIAA0161 BINDING SITE, designated SEQ ID:16429, to the nucleotide sequence of VGAM2338 RNA, herein designated VGAM RNA, also designated SEQ ID:5049.

Another function of VGAM2338 is therefore inhibition of KIAA0161 (Accession NM_014746). Accordingly, utilities of VGAM2338 include diagnosis, prevention and treatment of diseases and clinical conditions associated with KIAA0161. KIAA0495 (Accession XM_031397) is another VGAM2338 host target gene. KIAA0495 BINDING SITE is HOST TARGET binding site found in the 3' untranslated region of mRNA encoded by KIAA0495, corresponding to a HOST TARGET binding site such as BINDING SITE I, BINDING SITE II or BINDING SITE III. Table 2 illustrates the complementarity of the nucleotide sequences of KIAA0495 BINDING SITE, designated SEQ ID:31367, to the nucleotide sequence of VGAM2338 RNA, herein designated VGAM RNA, also designated SEQ ID:5049.

Another function of VGAM2338 is therefore inhibition of KIAA0495 (Accession XM_031397). Accordingly, utilities of VGAM2338 include diagnosis, prevention and treatment of diseases and clinical conditions associated with KIAA0495. KIAA0542 (Accession XM_038520) is another VGAM2338 host target gene. KIAA0542 BINDING SITE is HOST TARGET binding site found in the 3' untranslated region of mRNA encoded by KIAA0542, corresponding to a HOST TARGET binding site such as BINDING SITE I, BINDING SITE II or BINDING SITE III. Table 2 illustrates the complementarity of the nucleotide sequences of KIAA0542 BINDING SITE, designated SEQ ID:32858, to the nucleotide sequence of VGAM2338 RNA, herein designated VGAM RNA, also designated SEQ ID:5049.

Another function of VGAM2338 is therefore inhibition of KIAA0542 (Accession XM_038520). Accordingly, utilities of VGAM2338 include diagnosis, prevention and treatment of diseases and clinical conditions associated with KIAA0542. KIAA0774 (Accession XM_166270) is another VGAM2338 host target gene. KIAA0774 BINDING SITE is HOST TARGET binding site found in the 5' untranslated region of mRNA encoded by KIAA0774, corresponding to a HOST TARGET binding site such as BINDING SITE I, BINDING SITE II or BINDING SITE III. Table 2 illustrates the complementarity of the nucleotide sequences of KIAA0774 BINDING SITE, designated SEQ ID:44089, to the nucleotide sequence of VGAM2338 RNA, herein designated VGAM RNA, also designated SEQ ID:5049.

Another function of VGAM2338 is therefore inhibition of KIAA0774 (Accession XM_166270). Accordingly, utilities of VGAM2338 include diagnosis, prevention and treatment of diseases and clinical conditions associated with KIAA0774. KIAA1223 (Accession XM_048747) is another VGAM2338 host target gene. KIAA1223 BINDING SITE is HOST TARGET binding site found in the 3' untranslated region of mRNA encoded by KIAA1223, corresponding to a HOST TARGET binding site such as BINDING SITE I, BINDING SITE II or BINDING SITE III. Table 2 illustrates the complementarity of the nucleotide sequences of KIAA1223 BINDING SITE, designated SEQ ID:35244, to the nucleotide sequence of VGAM2338 RNA, herein designated VGAM RNA, also designated SEQ ID:5049.

Another function of VGAM2338 is therefore inhibition of KIAA1223 (Accession XM_048747). Accordingly, utilities of VGAM2338 include diagnosis, prevention and treatment of diseases and clinical conditions associated with KIAA1223. LHPP (Accession NM_022126) is another VGAM2338 host target gene. LHPP BINDING SITE is HOST TARGET binding site found in the 3' untranslated region of mRNA encoded by LHPP, corresponding to a HOST TARGET binding site such as BINDING SITE I, BINDING SITE II or BINDING SITE III. Table 2 illustrates the complementarity of the nucleotide sequences of LHPP BINDING SITE, designated SEQ ID:22673, to the nucleotide sequence of VGAM2338 RNA, herein designated VGAM RNA, also designated SEQ ID:5049.

Another function of VGAM2338 is therefore inhibition of LHPP (Accession NM_022126). Accordingly, utilities of VGAM2338 include diagnosis, prevention and treatment of diseases and clinical conditions associated with LHPP. MGC14161 (Accession NM_032892) is another VGAM2338 host target gene. MGC14161 BINDING SITE is HOST TARGET binding site found in the 5' untranslated region of mRNA encoded by MGC14161, corresponding to a HOST TARGET binding site such as BINDING SITE I, BINDING SITE II or BINDING SITE III. Table 2 illustrates the complementarity of the nucleotide sequences of MGC14161 BINDING SITE, designated SEQ ID:26719, to the nucleotide sequence of VGAM2338 RNA, herein designated VGAM RNA, also designated SEQ ID:5049.

Another function of VGAM2338 is therefore inhibition of MGC14161 (Accession NM_032892). Accordingly, utilities of VGAM2338 include diagnosis, prevention and treatment of diseases and clinical conditions associated with MGC14161. NECL1 (Accession NM_021189) is another VGAM2338 host target gene. NECL1 BINDING SITE is HOST TARGET binding site found in the 3' untranslated region of mRNA encoded by NECL1, corresponding to a HOST TARGET binding site such as BINDING SITE I, BINDING SITE II or BINDING SITE III. Table 2 illustrates the complementarity of the nucleotide sequences of NECL1 BINDING SITE, designated SEQ ID:22164, to the nucleotide sequence of VGAM2338 RNA, herein designated VGAM RNA, also designated SEQ ID:5049.

Another function of VGAM2338 is therefore inhibition of NECL1 (Accession NM_021189). Accordingly, utilities of VGAM2338 include diagnosis, prevention and treatment of diseases and clinical conditions associated with NECL1. Proline-rich Gla (G-carboxyglutamic acid) Polypeptide 1 (PRRG1, Accession NM_000950) is another VGAM2338 host target gene. PRRG1 BINDING SITE is HOST TARGET binding site found in the 3' untranslated region of mRNA encoded by PRRG1, corresponding to a HOST TARGET binding site such as BINDING SITE I, BINDING SITE II or BINDING SITE III. Table 2 illustrates the complementarity of the nucleotide sequences of PRRG1 BINDING SITE, designated SEQ ID:6652, to the nucleotide sequence of VGAM2338 RNA, herein designated VGAM RNA, also designated SEQ ID:5049.

Another function of VGAM2338 is therefore inhibition of Proline-rich Gla (G-carboxyglutamic acid) Polypeptide 1 (PRRG1, Accession NM_000950). Accordingly, utilities of VGAM2338 include diagnosis, prevention and treatment of diseases and clinical conditions associated with PRRG1. SEC14-like 1 (S. cerevisiae) (SEC14L1, Accession NM_003003) is another VGAM2338 host target gene. SEC14L1 BINDING SITE is HOST TARGET binding site found in the 3' untranslated region of mRNA encoded by SEC14L1, corresponding to a HOST TARGET binding site such as BINDING SITE I, BINDING SITE II or BINDING SITE III. Table 2 illustrates the complementarity of the nucleotide sequences of SEC14L1 BINDING SITE, designated SEQ ID:8908, to the nucleotide sequence of VGAM2338 RNA, herein designated VGAM RNA, also designated SEQ ID:5049.

Another function of VGAM2338 is therefore inhibition of SEC14-like 1 (S. cerevisiae) (SEC14L1, Accession NM_003003). Accordingly, utilities of VGAM2338 include diagnosis, prevention and treatment of diseases and clinical conditions associated with SEC14L1. Sideroflexin 5 (SFXN5, Accession NM_144579) is another VGAM2338 host target gene. SFXN5 BINDING SITE is HOST TARGET binding site found in the 3' untranslated region of mRNA encoded by SFXN5, corresponding to a HOST TARGET binding site such as BINDING SITE I, BINDING SITE II or BINDING SITE III. Table 2 illustrates the complementarity of the nucleotide sequences of SFXN5 BINDING SITE, designated SEQ ID:29387, to the nucleotide sequence of VGAM2338 RNA, herein designated VGAM RNA, also designated SEQ ID:5049.

Another function of VGAM2338 is therefore inhibition of Sideroflexin 5 (SFXN5, Accession NM_144579). Accordingly, utilities of VGAM2338 include diagnosis, prevention and treatment of diseases and clinical conditions associated with SFXN5. Unc-5 Homolog D (C. elegans) (UNC5D, Accession NM_080872) is another VGAM2338 host target gene. UNC5D BINDING SITE is HOST TARGET binding site found in the 3' untranslated region of mRNA encoded by UNC5D, corresponding to a HOST TARGET binding site such as BINDING SITE I, BINDING SITE II or BINDING SITE III. Table 2 illustrates the complementarity of the nucleotide sequences of UNC5D BINDING SITE, designated SEQ ID:28111, to the nucleotide sequence of VGAM2338 RNA, herein designated VGAM RNA, also designated SEQ ID:5049.

Another function of VGAM2338 is therefore inhibition of Unc-5 Homolog D (C. elegans) (UNC5D, Accession NM_080872). Accordingly, utilities of VGAM2338 include diagnosis, prevention and treatment of diseases and clinical conditions associated with UNC5D. LOC122553 (Accession XM_058630) is another VGAM2338 host target gene. LOC122553 BINDING SITE is HOST TARGET binding site found in the 3' untranslated region of mRNA encoded by LOC122553, corresponding to a HOST TARGET binding site such as BINDING SITE I, BINDING SITE II or BINDING SITE III. Table 2 illustrates the complementarity of the nucleotide sequences of LOC122553 BINDING SITE, designated SEQ ID:36688, to the nucleotide sequence of VGAM2338 RNA, herein designated VGAM RNA, also designated SEQ ID:5049.

Another function of VGAM2338 is therefore inhibition of LOC122553 (Accession XM_058630). Accordingly, utilities of VGAM2338 include diagnosis, prevention and treatment of diseases and clinical conditions associated with LOC122553. LOC126823 (Accession XM_059086) is another VGAM2338 host target gene. LOC126823 BINDING SITE is HOST TARGET binding site found in the 5' untranslated region of mRNA encoded by LOC126823, corresponding to a HOST TARGET binding site such as BINDING SITE I, BINDING SITE II or BINDING SITE III. Table 2 illustrates the complementarity of the nucleotide sequences of LOC126823 BINDING SITE, designated SEQ ID:36864, to the nucleotide sequence of VGAM2338 RNA, herein designated VGAM RNA, also designated SEQ ID:5049.

Another function of VGAM2338 is therefore inhibition of LOC126823 (Accession XM_059086). Accordingly, utilities of VGAM2338 include diagnosis, prevention and treatment of diseases and clinical conditions associated with LOC126823. LOC132338 (Accession XM_067793) is another VGAM2338 host target gene. LOC132338 BINDING SITE is HOST TARGET binding site found in the 5' untranslated region of mRNA encoded by LOC132338, corresponding to a HOST TARGET binding site such as BINDING SITE I, BINDING SITE II or BINDING SITE III. Table 2 illustrates the complementarity of the nucleotide sequences of LOC132338 BINDING SITE, designated SEQ ID:37368, to the nucleotide sequence of VGAM2338 RNA, herein designated VGAM RNA, also designated SEQ ID:5049.

Another function of VGAM2338 is therefore inhibition of LOC132338 (Accession XM_067793). Accordingly, utilities of VGAM2338 include diagnosis, prevention and treatment of diseases and clinical conditions associated with LOC132338. LOC146774 (Accession XM_085584) is another VGAM2338 host target gene. LOC146774 BINDING SITE is HOST TARGET binding site found in the 3' untranslated region of mRNA encoded by LOC146774, corresponding to a HOST TARGET binding site such as BINDING SITE I, BINDING SITE II or BINDING SITE III. Table 2 illustrates the complementarity of the nucleotide sequences of LOC146774 BINDING SITE, designated SEQ ID:38233, to the nucleotide sequence of VGAM2338 RNA, herein designated VGAM RNA, also designated SEQ ID:5049.

Another function of VGAM2338 is therefore inhibition of LOC146774 (Accession XM_085584). Accordingly, utilities of VGAM2338 include diagnosis, prevention and treatment of diseases and clinical conditions associated with LOC146774. LOC149577 (Accession XM_097675) is another VGAM2338 host target gene. LOC149577 BINDING SITE is HOST TARGET binding site found in the 3' untranslated region of mRNA encoded by LOC149577, corresponding to a HOST TARGET binding site such as BINDING SITE I, BINDING SITE II or BINDING SITE III. Table 2 illustrates the complementarity of the nucleotide sequences of LOC149577 BINDING SITE, designated SEQ ID:41021, to the nucleotide sequence of VGAM2338 RNA, herein designated VGAM RNA, also designated SEQ ID:5049.

Another function of VGAM2338 is therefore inhibition of LOC149577 (Accession XM_097675). Accordingly, utilities of VGAM2338 include diagnosis, prevention and treatment of diseases and clinical conditions associated with LOC149577. LOC158288 (Accession XM_098912) is another VGAM2338 host target gene. LOC158288 BINDING SITE is HOST TARGET binding site found in the 5' untranslated region of mRNA encoded by LOC158288, corresponding to a HOST TARGET binding site such as BINDING SITE I, BINDING SITE II or BINDING SITE III. Table 2 illustrates the complementarity of the nucleotide sequences of LOC158288 BINDING SITE, designated SEQ ID:41928, to the nucleotide sequence of VGAM2338 RNA, herein designated VGAM RNA, also designated SEQ ID:5049.

Another function of VGAM2338 is therefore inhibition of LOC158288 (Accession XM_098912). Accordingly, utilities of VGAM2338 include diagnosis, prevention and treatment of diseases and clinical conditions associated with LOC158288. LOC163231 (Accession XM_092094) is another VGAM2338 host target gene. LOC163231 BINDING SITE is HOST TARGET binding site found in the 5' untranslated region of mRNA encoded by LOC163231, corresponding to a HOST TARGET binding site such as BINDING SITE I, BINDING SITE II or BINDING SITE III. Table 2 illustrates the complementarity of the nucleotide sequences of LOC163231 BINDING SITE, designated SEQ ID:40098, to the nucleotide sequence of VGAM2338 RNA, herein designated VGAM RNA, also designated SEQ ID:5049.

Another function of VGAM2338 is therefore inhibition of LOC163231 (Accession XM_092094). Accordingly, utilities of VGAM2338 include diagnosis, prevention and treatment of diseases and clinical conditions associated with LOC163231. LOC255742 (Accession XM_171617) is another VGAM2338 host target gene. LOC255742 BINDING SITE is HOST TARGET binding site found in the 5' untranslated region of mRNA encoded by LOC255742, corresponding to a HOST TARGET binding site such as BINDING SITE I, BINDING SITE II or BINDING SITE III. Table 2 illustrates the complementarity of the nucleotide sequences of LOC255742 BINDING SITE, designated SEQ ID:46054, to the nucleotide sequence of VGAM2338 RNA, herein designated VGAM RNA, also designated SEQ ID:5049.

Another function of VGAM2338 is therefore inhibition of LOC255742 (Accession XM_171617). Accordingly, utilities of VGAM2338 include diagnosis, prevention and treatment of diseases and clinical conditions associated with LOC255742. LOC85414 (Accession NM_033102) is another VGAM2338 host target gene. LOC85414 BINDING SITE is HOST TARGET binding site found in the 3' untranslated region of mRNA encoded by LOC85414, corresponding to a HOST TARGET binding site such as BINDING SITE I, BINDING SITE II or BINDING SITE III. Table 2 illustrates the complementarity of the nucleotide sequences of LOC85414 BINDING SITE, designated SEQ ID:26948, to the nucleotide sequence of VGAM2338 RNA, herein designated VGAM RNA, also designated SEQ ID:5049.

Another function of VGAM2338 is therefore inhibition of LOC85414 (Accession NM_033102). Accordingly, utilities of VGAM2338 include diagnosis, prevention and treatment of diseases and clinical conditions associated with LOC85414. LOC90268 (Accession XM_030424) is another VGAM2338 host target gene. LOC90268 BINDING SITE is HOST TARGET binding site found in the 5' untranslated region of mRNA encoded by LOC90268, corresponding to a HOST TARGET binding site such as BINDING SITE I, BINDING SITE II or BINDING SITE III. Table 2 illustrates the complementarity of the nucleotide sequences of LOC90268 BINDING SITE, designated SEQ ID:31040, to the nucleotide sequence of VGAM2338 RNA, herein designated VGAM RNA, also designated SEQ ID:5049.

Another function of VGAM2338 is therefore inhibition of LOC90268 (Accession XM_030424). Accordingly, utilities of VGAM2338 include diagnosis, prevention and treatment of diseases and clinical conditions associated with LOC90268. LOC91801 (Accession NM_138775) is another VGAM2338 host target gene. LOC91801 BINDING SITE is HOST TARGET binding site found in the 3' untranslated region of mRNA encoded by LOC91801, corresponding to a HOST TARGET binding site such as BINDING SITE I, BINDING SITE II or BINDING SITE III. Table 2 illustrates the complementarity of the nucleotide sequences of LOC91801 BINDING SITE, designated SEQ ID:29008, to the nucleotide sequence of VGAM2338 RNA, herein designated VGAM RNA, also designated SEQ ID:5049.

Another function of VGAM2338 is therefore inhibition of LOC91801 (Accession NM_138775). Accordingly, utilities of VGAM2338 include diagnosis, prevention and treatment of diseases and clinical conditions associated with LOC91801. FIG. 1 further provides a conceptual description of a novel bioinformatically detected viral gene of the present invention, referred to here as Viral Genomic Address Messenger 2339 (VGAM2339) viral gene, which modulates expression of respective host target genes thereof, the function and utility of which host target genes is known in the art.

VGAM2339 is a novel bioinformatically detected regulatory, non protein coding, viral micro RNA (miRNA) gene. The method by which VGAM2339 was detected is described hereinabove with reference to FIGS. 1-8.

VGAM2339 gene, herein designated VGAM GENE, is a viral gene contained in the genome of Equine Herpesvirus 2. VGAM2339 host target gene, herein designated VGAM HOST TARGET GENE, is a human gene contained in the human genome.

VGAM2339 gene encodes a VGAM2339 precursor RNA, herein designated VGAM PRECURSOR RNA. Similar to other miRNA genes, and unlike most ordinary genes, VGAM2339 precursor RNA does not encode a protein. A nucleotide sequence identical or highly similar to the nucleotide sequence of VGAM2339 precursor RNA is designated SEQ ID:2325, and is provided hereinbelow with reference to the sequence listing part. Nucleotide sequence SEQ ID:2325 is located at position 42978 relative to the genome of Equine Herpesvirus 2.

VGAM2339 precursor RNA folds onto itself, forming VGAM2339 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2339 folded precursor RNA into VGAM2339 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM2339 RNA is designated SEQ ID:5050, and is provided hereinbelow with reference to the sequence listing part.

VGAM2339 host target gene, herein designated VGAM HOST TARGET GENE, encodes a corresponding messenger RNA, VGAM2339 host target RNA, herein designated VGAM HOST TARGET RNA. VGAM2339 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2339 RNA, herein designated VGAM RNA, binds complementarily to one or more host target binding sites located in untranslated regions of VGAM2339 host target RNA, herein designated VGAM HOST TARGET RNA. This complementary binding is due to the fact that the nucleotide sequence of VGAM2339 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2339 RNA, herein designated VGAM RNA, may have a different number of host target binding sites in untranslated regions of a VGAM2339 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2339 RNA, herein designated VGAM RNA, to host target binding sites on VGAM2339 host target RNA, herein designated VGAM HOST TARGET RNA, such as BINDING SITE I, BINDING SITE II and BINDING SITE III, inhibits translation of VGAM2339 host target RNA into VGAM2339 host target protein, herein designated VGAM HOST TARGET PROTEIN. VGAM host target protein is therefore outlined by a broken line.

It is appreciated that VGAM2339 host target gene, herein designated VGAM HOST TARGET GENE, in fact represents a plurality of VGAM2339 host target genes. The mRNA of each one of this plurality of VGAM2339 host target genes comprises one or more host target binding sites, each having a nucleotide sequence which is at least partly complementary to VGAM2339 RNA, herein designated VGAM RNA, and which when bound by VGAM2339 RNA causes inhibition of translation of respective one or more VGAM2339 host target proteins.

It is further appreciated by one skilled in the art that the mode of translational inhibition illustrated by FIG. 1 with specific reference to translational inhibition exerted by VGAM2339 gene, herein designated VGAM GENE, on one or more VGAM2339 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2339 is inhibition of expression of host target genes, as part of a novel viral mechanism of attacking a host. Accordingly, utilities of VGAM2339 include diagnosis, prevention and treatment of viral infection by Equine Herpesvirus 2. Specific functions, and accordingly utilities, of VGAM2339 correlate with, and may be deduced from, the identity of the host target genes which VGAM2339 binds and inhibits, and the function of these host target genes, as elaborated hereinbelow.

Nucleotide sequences of the VGAM2339 precursor RNA, herein designated VGAM PRECURSOR RNA, and of the 'diced' VGAM2339 RNA, herein designated VGAM RNA, and a schematic representation of the secondary folding of VGAM2339 folded precursor RNA, herein designated VGAM FOLDED PRECURSOR RNA, of VGAM2339 are further described hereinbelow with reference to Table 1.

Nucleotide sequences of host target binding sites, such as BINDING SITE-I, BINDING SITE-II and BINDING SITE-III of FIG. 1, found on VGAM2339 host target RNA, and schematic representation of the complementarity of each of these host target binding sites to VGAM2339 RNA, herein designated VGAM RNA, are described hereinbelow with reference to Table 2.

As mentioned hereinabove with reference to FIG. 1, a function of VGAM2339 gene, herein designated VGAM is inhibition of expression of VGAM2339 target genes. It is appreciated that specific functions, and accordingly utilities, of VGAM2339 correlate with, and may be deduced from, the identity of the target genes which VGAM2339 binds and inhibits, and the function of these target genes, as elaborated hereinbelow.

Potassium Inwardly-rectifying Channel, Subfamily J, Member 15 (KCNJ15, Accession NM_002243) is a VGAM2339 host target gene. KCNJ15 BINDING SITE is HOST TARGET binding site found in the 3' untranslated region of mRNA encoded by KCNJ15, corresponding to a HOST TARGET binding site such as BINDING SITE I, BINDING SITE II or BINDING SITE III. Table 2 illustrates the complementarity of the nucleotide sequences of KCNJ15 BINDING SITE, designated SEQ ID:8030, to the nucleotide sequence of VGAM2339 RNA, herein designated VGAM RNA, also designated SEQ ID:5050.

A function of VGAM2339 is therefore inhibition of Potassium Inwardly-rectifying Channel, Subfamily J, Member 15 (KCNJ15, Accession NM_002243). Accordingly, utilities of VGAM2339 include diagnosis, prevention and treatment of diseases and clinical conditions associated with KCNJ15. Phosphoprotein Enriched In Astrocytes 15 (PEA15, Accession NM_003768) is another VGAM2339 host target gene. PEA15 BINDING SITE is HOST TARGET binding site found in the 3' untranslated region of mRNA encoded by PEA15, corresponding to a HOST TARGET binding site such as BINDING SITE I, BINDING SITE II or BINDING SITE III. Table 2 illustrates the complementarity of the nucleotide sequences of PEA15 BINDING SITE, designated SEQ ID:9846, to the nucleotide sequence of VGAM2339 RNA, herein designated VGAM RNA, also designated SEQ ID:5050.

Another function of VGAM2339 is therefore inhibition of Phosphoprotein Enriched In Astrocytes 15 (PEA15, Accession NM_003768), a gene which is a phosphoprotein and involved in glucose uptake. Accordingly, utilities of VGAM2339 include diagnosis, prevention and treatment of diseases and clinical conditions associated with PEA15. The function of PEA15 and its association with various diseases and clinical conditions, has been established by previous studies, as described hereinabove with reference to VGAM949. Splicing Factor, Arginine/serine-rich 2, Interacting Protein (SFRS2IP, Accession NM_004719) is another VGAM2339 host target gene. SFRS2IP BINDING SITE is HOST TARGET binding site found in the 5' untranslated region of mRNA encoded by SFRS2IP, corresponding to a HOST TARGET binding site such as BINDING SITE I, BINDING SITE II or BINDING SITE III. Table 2 illustrates the complementarity of the nucleotide sequences of SFRS2IP BINDING SITE, designated SEQ ID:11084, to the nucleotide sequence of VGAM2339 RNA, herein designated VGAM RNA, also designated SEQ ID:5050.

Another function of VGAM2339 is therefore inhibition of Splicing Factor, Arginine/serine-rich 2, Interacting Protein (SFRS2IP, Accession NM_004719), a gene which plays an essential role in pre-mRNA splicing. Accordingly, utilities of VGAM2339 include diagnosis, prevention and treatment of diseases and clinical conditions associated with SFRS2IP. The function of SFRS2IP and its association with various diseases and clinical conditions, has been established by previous studies, as described hereinabove with reference to VGAM700. Surfeit 6 (SURF6, Accession NM_006753) is another VGAM2339 host target gene. SURF6 BINDING SITE is HOST TARGET binding site found in the 3' untranslated region of mRNA encoded by SURF6, corresponding to a HOST TARGET binding site such as BINDING SITE I, BINDING SITE II or BINDING SITE III. Table 2 illustrates the complementarity of the nucleotide sequences of SURF6 BINDING SITE, designated SEQ ID:13609, to the nucleotide sequence of VGAM2339 RNA, herein designated VGAM RNA, also designated SEQ ID:5050.

Another function of VGAM2339 is therefore inhibition of Surfeit 6 (SURF6, Accession NM_006753). Accordingly, utilities of VGAM2339 include diagnosis, prevention and treatment of diseases and clinical conditions associated with SURF6. Ubiquitin-conjugating Enzyme E2 Variant 1 (UBE2V1, Accession NM_021988) is another VGAM2339 host target gene. UBE2V1 BINDING SITE1 through UBE2V1 BINDING SITE3 are HOST TARGET binding sites found in untranslated regions of mRNA encoded by UBE2V1, corresponding to HOST TARGET binding sites such as BINDING SITE I, BINDING SITE II or BINDING SITE III. Table 2 illustrates the complementarity of the nucleotide sequences of UBE2V1 BINDING SITE1 through UBE2V1 BINDING SITE3, designated SEQ ID:22519, SEQ ID:22766 and SEQ ID:9367 respectively, to the nucleotide sequence of VGAM2339 RNA, herein designated VGAM RNA, also designated SEQ ID:5050.

Another function of VGAM2339 is therefore inhibition of Ubiquitin-conjugating Enzyme E2 Variant 1 (UBE2V1, Accession NM_021988), a gene which may play a role in signaling for DNA repair. Accordingly, utilities of VGAM2339 include diagnosis, prevention and treatment of diseases and clinical conditions associated with UBE2V1. The function of UBE2V1 and its association with various diseases and clinical conditions, has been established by previous studies, as described hereinabove with reference to VGAM155. KIAA0217 (Accession XM_040265) is another VGAM2339 host target gene. KIAA0217 BINDING SITE is HOST TARGET binding site found in the 3' untranslated region of mRNA encoded by KIAA0217, corresponding to a HOST TARGET binding site such as BINDING SITE I, BINDING SITE II or BINDING SITE III. Table 2 illustrates the complementarity of the nucleotide sequences of KIAA0217 BINDING SITE, designated SEQ ID:33275, to the nucleotide sequence of VGAM2339 RNA, herein designated VGAM RNA, also designated SEQ ID:5050.

Another function of VGAM2339 is therefore inhibition of KIAA0217 (Accession XM_040265). Accordingly, utilities of VGAM2339 include diagnosis, prevention and treatment of diseases and clinical conditions associated with KIAA0217. MCF.2 Cell Line Derived Transforming Sequence-like (MCF2L, Accession XM_027516) is another VGAM2339 host target gene. MCF2L BINDING SITE is HOST TARGET binding site found in the 3' untranslated region of mRNA encoded by MCF2L, corresponding to a HOST TARGET binding site such as BINDING SITE I, BINDING SITE II or BINDING SITE III. Table 2 illustrates the complementarity of the nucleotide sequences of MCF2L BINDING SITE, designated SEQ ID:30507, to the nucleotide sequence of VGAM2339 RNA, herein designated VGAM RNA, also designated SEQ ID:5050.

Another function of VGAM2339 is therefore inhibition of MCF.2 Cell Line Derived Transforming Sequence-like (MCF2L, Accession XM_027516). Accordingly, utilities of VGAM2339 include diagnosis, prevention and treatment of diseases and clinical conditions associated with MCF2L. LOC116028 (Accession XM_057225) is another VGAM2339 host target gene. LOC116028 BINDING SITE is HOST TARGET binding site found in the 3' untranslated region of mRNA encoded by LOC116028, corresponding to a HOST TARGET binding site such as BINDING SITE I, BINDING SITE II or BINDING SITE III. Table 2 illustrates the complementarity of the nucleotide sequences of LOC116028 BINDING SITE, designated SEQ ID:36491, to the nucleotide sequence of VGAM2339 RNA, herein designated VGAM RNA, also designated SEQ ID:5050.

Another function of VGAM2339 is therefore inhibition of LOC116028 (Accession XM_057225). Accordingly, utilities of VGAM2339 include diagnosis, prevention and treatment of diseases and clinical conditions associated with LOC116028. LOC149013 (Accession XM_086398) is another VGAM2339 host target gene. LOC149013 BINDING SITE is HOST TARGET binding site found in the 3' untranslated region of mRNA encoded by LOC149013, corresponding to a HOST TARGET binding site such as BINDING SITE I, BINDING SITE II or BINDING SITE III. Table 2 illustrates the complementarity of the nucleotide sequences of LOC149013 BINDING SITE, designated SEQ ID:38631, to the nucleotide sequence of VGAM2339 RNA, herein designated VGAM RNA, also designated SEQ ID:5050.

Another function of VGAM2339 is therefore inhibition of LOC149013 (Accession XM_086398). Accordingly, utilities of VGAM2339 include diagnosis, prevention and treatment of diseases and clinical conditions associated with LOC149013. FIG. 1 further provides a conceptual description of a novel bioinformatically detected viral gene of the present invention, referred to here as Viral Genomic Address Messenger 2340 (VGAM2340) viral gene, which modulates expression of respective host target genes thereof, the function and utility of which host target genes is known in the art.

VGAM2340 is a novel bioinformatically detected regulatory, non protein coding, viral micro RNA (miRNA) gene. The method by which VGAM2340 was detected is described hereinabove with reference to FIGS. 1-8.

VGAM2340 gene, herein designated VGAM GENE, is a viral gene contained in the genome of Equine Herpesvirus 2. VGAM2340 host target gene, herein designated VGAM HOST TARGET GENE, is a human gene contained in the human genome.

VGAM2340 gene encodes a VGAM2340 precursor RNA, herein designated VGAM PRECURSOR RNA. Similar to other miRNA genes, and unlike most ordinary genes, VGAM2340 precursor RNA does not encode a protein. A nucleotide sequence identical or highly similar to the nucleotide sequence of VGAM2340 precursor RNA is designated SEQ ID:2326, and is provided hereinbelow with reference to the sequence listing part. Nucleotide sequence SEQ ID:2326 is located at position 42263 relative to the genome of Equine Herpesvirus 2.

VGAM2340 precursor RNA folds onto itself, forming VGAM2340 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2340 folded precursor RNA into VGAM2340 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2340 RNA is designated SEQ ID:5051, and is provided hereinbelow with reference to the sequence listing part.

VGAM2340 host target gene, herein designated VGAM HOST TARGET GENE, encodes a corresponding messenger RNA, VGAM2340 host target RNA, herein designated VGAM HOST TARGET RNA. VGAM2340 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2340 RNA, herein designated VGAM RNA, binds complementarily to one or more host target binding sites located in untranslated regions of VGAM2340 host target RNA, herein designated VGAM HOST TARGET RNA. This complementary binding is due to the fact that the nucleotide sequence of VGAM2340 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2340 RNA, herein designated VGAM RNA, may have a different number of host target binding sites in untranslated regions of a VGAM2340 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2340 RNA, herein designated VGAM RNA, to host target binding sites on VGAM2340 host target RNA, herein designated VGAM HOST TARGET RNA, such as BINDING SITE I, BINDING SITE II and BINDING SITE III, inhibits translation of VGAM2340 host target RNA into VGAM2340 host target protein, herein designated VGAM HOST TARGET PROTEIN. VGAM host target protein is therefore outlined by a broken line.

It is appreciated that VGAM2340 host target gene, herein designated VGAM HOST TARGET GENE, in fact represents a plurality of VGAM2340 host target genes. The mRNA of each one of this plurality of VGAM2340 host target genes comprises one or more host target binding sites, each having a nucleotide sequence which is at least partly complementary to VGAM2340 RNA, herein designated VGAM RNA, and which when bound by VGAM2340 RNA causes inhibition of translation of respective one or more VGAM2340 host target proteins.

It is further appreciated by one skilled in the art that the mode of translational inhibition illustrated by FIG. 1 with specific reference to translational inhibition exerted by VGAM2340 gene, herein designated VGAM GENE, on one or more VGAM2340 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2340 is inhibition of expression of host target genes, as part of a novel viral mechanism of attacking a host. Accordingly, utilities of VGAM2340 include diagnosis, prevention and treatment of viral infection by Equine Herpesvirus 2. Specific functions, and accordingly utilities, of VGAM2340 correlate with, and may be deduced from, the identity of the host target genes which VGAM2340 binds and inhibits, and the function of these host target genes, as elaborated hereinbelow.

Nucleotide sequences of the VGAM2340 precursor RNA, herein designated VGAM PRECURSOR RNA, and of the 'diced' VGAM2340 RNA, herein designated VGAM RNA, and a schematic representation of the secondary folding of VGAM2340 folded precursor RNA, herein designated VGAM FOLDED PRECURSOR RNA, of VGAM2340 are further described hereinbelow with reference to Table 1.

Nucleotide sequences of host target binding sites, such as BINDING SITE-I, BINDING SITE-II and BINDING SITE-III of FIG. 1, found on VGAM2340 host target RNA, and schematic representation of the complementarity of each of these host target binding sites to VGAM2340 RNA, herein designated VGAM RNA, are described hereinbelow with reference to Table 2.

As mentioned hereinabove with reference to FIG. 1, a function of VGAM2340 gene, herein designated VGAM is inhibition of expression of VGAM2340 target genes. It is appreciated that specific functions, and accordingly utilities, of VGAM2340 correlate with, and may be deduced from, the identity of the target genes which VGAM2340 binds and inhibits, and the function of these target genes, as elaborated hereinbelow.

Kallmann Syndrome 1 Sequence (KAL1, Accession NM_000216) is a VGAM2340 host target gene. KAL1 BINDING SITE is HOST TARGET binding site found in the 3' untranslated region of mRNA encoded by KAL1, corresponding to a HOST TARGET binding site such as BINDING SITE I, BINDING SITE II or BINDING SITE III. Table 2 illustrates the complementarity of the nucleotide sequences of KAL1 BINDING SITE, designated SEQ ID:5714, to the nucleotide sequence of VGAM2340 RNA, herein designated VGAM RNA, also designated SEQ ID:5051.

A function of VGAM2340 is therefore inhibition of Kallmann Syndrome 1 Sequence (KAL1, Accession NM_000216). Accordingly, utilities of VGAM2340 include diagnosis, prevention and treatment of diseases and clinical conditions associated with KAL1. Platelet-derived Growth Factor Receptor, Beta Polypeptide (PDGFRB, Accession XM_038350) is another VGAM2340 host target gene. PDGFRB BINDING SITE is HOST TARGET binding site found in the 3" untranslated region of mRNA encoded by PDGFRB, corresponding to a HOST TARGET binding site such as BINDING SITE I, BINDING SITE II or BINDING SITE III. Table 2 illustrates the complementarity of the nucleotide sequences of PDGFRB BINDING SITE, designated SEQ ID:32816, to the nucleotide sequence of VGAM2340 RNA, herein designated VGAM RNA, also designated SEQ ID:5051.

Another function of VGAM2340 is therefore inhibition of Platelet-derived Growth Factor Receptor, Beta Polypeptide (PDGFRB, Accession XM_038350), a gene which Platelet-derived growth factor receptor beta chain; tyrosine kinase receptor. Accordingly, utilities of VGAM2340 include diagnosis, prevention and treatment of diseases and clinical conditions associated with PDGFRB. The function of PDGFRB and its association with various diseases and clinical conditions, has been established by previous studies, as described hereinabove with reference to VGAM125. PTPN13-like, Y-linked (PRY, Accession XM_013161) is another VGAM2340 host target gene. PRY BINDING SITE is HOST TARGET binding site found in the 5' untranslated region of mRNA encoded by PRY, corresponding to a HOST TARGET binding site such as BINDING SITE I, BINDING SITE II or BINDING SITE III. Table 2 illustrates the complementarity of the nucleotide sequences of PRY BINDING SITE, designated SEQ ID:30233, to the nucleotide sequence of VGAM2340 RNA, herein designated VGAM RNA, also designated SEQ ID:5051.

Another function of VGAM2340 is therefore inhibition of PTPN13-like, Y-linked (PRY, Accession XM_013161), a gene which may act as a protein tyrosine phosphatase. Accordingly, utilities of VGAM2340 include diagnosis, prevention and treatment of diseases and clinical conditions associated with PRY. The function of PRY and its association with various diseases and clinical conditions, has been established by previous studies, as described hereinabove with reference to VGAM2280. Wingless-type MMTV Integration Site Family, Member 8B (WNT8B, Accession XM_005702) is another VGAM2340 host target gene. WNT8B BINDING SITE is HOST TARGET binding site found in the 3' untranslated region of mRNA encoded by WNT8B, corresponding to a HOST TARGET binding site such as BINDING SITE I, BINDING SITE II or BINDING SITE III. Table 2 illustrates the complementarity of the nucleotide sequences of WNT8B BINDING SITE, designated SEQ ID:29982, to the nucleotide sequence of VGAM2340 RNA, herein designated VGAM RNA, also designated SEQ ID:5051.

Another function of VGAM2340 is therefore inhibition of Wingless-type MMTV Integration Site Family, Member 8B (WNT8B, Accession XM_005702), a gene which is the ligand for members of the frizzled family of seven transmembrane receptors and may play an important role in the development and differentiation of certain forebrain structures. Accordingly, utilities of VGAM2340 include diagnosis, prevention and treatment of diseases and clinical conditions associated with WNT8B. The function of WNT8B and its association with various diseases and clinical conditions, has been established by previous studies, as described hereinabove with reference to VGAM636. DKFZP547L112 (Accession XM_039353) is another VGAM2340 host target gene. DKFZP547L112 BINDING SITE is HOST TARGET binding site found in the 5' untranslated region of mRNA encoded by DKFZP547L112, corresponding to a HOST TARGET binding site such as BINDING SITE I, BINDING SITE II or BINDING SITE III. Table 2 illustrates the complementarity of the nucleotide sequences of DKFZP547L112 BINDING SITE, designated SEQ ID:33054, to the nucleotide sequence of VGAM2340 RNA, herein designated VGAM RNA, also designated SEQ ID:5051.

Another function of VGAM2340 is therefore inhibition of DKFZP547L112 (Accession XM_039353). Accordingly, utilities of VGAM2340 include diagnosis, prevention and treatment of diseases and clinical conditions associated with DKFZP547L112. FLJ20694 (Accession NM_017928) is another VGAM2340 host target gene. FLJ20694 BINDING SITE is HOST TARGET binding site found in the 3' untranslated region of mRNA encoded by FLJ20694, corresponding to a HOST TARGET binding site such as BINDING SITE I, BINDING SITE II or BINDING SITE III. Table 2 illustrates the complementarity of the nucleotide sequences of FLJ20694 BINDING SITE, designated SEQ ID:19604, to the nucleotide sequence of VGAM2340 RNA, herein designated VGAM RNA, also designated SEQ ID:5051.

Another function of VGAM2340 is therefore inhibition of FLJ20694 (Accession NM_017928). Accordingly, utilities of VGAM2340 include diagnosis, prevention and treatment of diseases and clinical conditions associated with FLJ20694. KIAA1169 (Accession NM_017901) is another VGAM2340 host target gene. KIAA1169 BINDING SITE is HOST TARGET binding site found in the 3' untranslated region of mRNA encoded by KIAA1169, corresponding to a HOST TARGET binding site such as BINDING SITE I, BINDING SITE II or BINDING SITE III. Table 2 illustrates the complementarity of the nucleotide sequences of KIAA1169 BINDING SITE, designated SEQ ID:19567, to the nucleotide sequence of VGAM2340 RNA, herein designated VGAM RNA, also designated SEQ ID:5051.

Another function of VGAM2340 is therefore inhibition of KIAA1169 (Accession NM_017901). Accordingly, utilities of VGAM2340 include diagnosis, prevention and treatment of diseases and clinical conditions associated with KIAA1169. KIAA1817 (Accession XM_042978) is another VGAM2340 host target gene. KIAA1817 BINDING SITE is HOST TARGET binding site found in the 3' untranslated region of mRNA encoded by KIAA1817, corresponding to a HOST TARGET binding site such as BINDING SITE I, BINDING SITE II or BINDING SITE III. Table 2 illustrates the complementarity of the nucleotide sequences of KIAA1817 BINDING SITE, designated SEQ ID:33860, to the nucleotide sequence of VGAM2340 RNA, herein designated VGAM RNA, also designated SEQ ID:5051.

Another function of VGAM2340 is therefore inhibition of KIAA1817 (Accession XM_042978). Accordingly, utilities of VGAM2340 include diagnosis, prevention and treatment of diseases and clinical conditions associated with KIAA1817. Lipoma HMGIC Fusion Partner-like 2 (LHFPL2, Accession XM_046054) is another VGAM2340 host target gene. LHFPL2 BINDING SITE is HOST TARGET binding site found in the 3' untranslated region of mRNA encoded by LHFPL2, corresponding to a HOST TARGET binding site such as BINDING SITE I, BINDING SITE II or BINDING SITE III. Table 2 illustrates the complementarity of the nucleotide sequences of LHFPL2 BINDING SITE, designated SEQ ID:34657, to the nucleotide sequence of VGAM2340 RNA, herein designated VGAM RNA, also designated SEQ ID:5051.

Another function of VGAM2340 is therefore inhibition of Lipoma HMGIC Fusion Partner-like 2 (LHFPL2, Accession XM_046054). Accordingly, utilities of VGAM2340 include diagnosis, prevention and treatment of diseases and clinical conditions associated with LHFPL2. Nuclear Receptor Subfamily 2, Group F, Member 1 (NR2F1, Accession XM_171117) is another VGAM2340 host target gene. NR2F1 BINDING SITE is HOST TARGET binding site found in the 3' untranslated region of mRNA encoded by NR2F1, corresponding to a HOST TARGET binding site such as BINDING SITE I, BINDING SITE II or BINDING SITE III. Table 2 illustrates the complementarity of the nucleotide sequences of NR2F1 BINDING SITE, designated SEQ ID:45915, to the nucleotide sequence of VGAM2340 RNA, herein designated VGAM RNA, also designated SEQ ID:5051.

Another function of VGAM2340 is therefore inhibition of Nuclear Receptor Subfamily 2, Group F, Member 1 (NR2F1, Accession XM_171117). Accordingly, utilities of VGAM2340 include diagnosis, prevention and treatment of diseases and clinical conditions associated with NR2F1. LOC159160 (Accession XM_018413) is another VGAM2340 host target gene. LOC159160 BINDING SITE is HOST TARGET binding site found in the 5' untranslated region of mRNA encoded by LOC159160, corresponding to a HOST TARGET binding site such as BINDING SITE I, BINDING SITE II or BINDING SITE III. Table 2 illustrates the complementarity of the nucleotide sequences of LOC159160 BINDING SITE, designated SEQ ID:30357, to the nucleotide sequence of VGAM2340 RNA, herein designated VGAM RNA, also designated SEQ ID:5051.

Another function of VGAM2340 is therefore inhibition of LOC159160 (Accession XM_018413). Accordingly, utilities of VGAM2340 include diagnosis, prevention and treatment of diseases and clinical conditions associated with LOC159160. FIG. 1 further provides a conceptual description of a novel bioinformatically detected viral gene of the present invention, referred to here as Viral Genomic Address Messenger 2341 (VGAM2341) viral gene, which modulates expression of respective host target genes thereof, the function and utility of which host target genes is known in the art.

VGAM2341 is a novel bioinformatically detected regulatory, non protein coding, viral micro RNA (miRNA) gene. The method by which VGAM2341 was detected is described hereinabove with reference to FIGS. 1-8.

VGAM2341 gene, herein designated VGAM GENE, is a viral gene contained in the genome of Equine Herpesvirus 2. VGAM2341 host target gene, herein designated VGAM HOST TARGET GENE, is a human gene contained in the human genome.

VGAM2341 gene encodes a VGAM2341 precursor RNA, herein designated VGAM PRECURSOR RNA. Similar to other miRNA genes, and unlike most ordinary genes, VGAM2341 precursor RNA does not encode a protein. A nucleotide sequence identical or highly similar to the nucleotide sequence of VGAM2341 precursor RNA is designated SEQ ID:2327, and is provided hereinbelow with reference to the sequence listing part. Nucleotide sequence SEQ ID:2327 is located at position 38415 relative to the genome of Equine Herpesvirus 2.

VGAM2341 precursor RNA folds onto itself, forming VGAM2341 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2341 folded precursor RNA into VGAM2341 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2341 RNA is designated SEQ ID:5052, and is provided hereinbelow with reference to the sequence listing part.

VGAM2341 host target gene, herein designated VGAM HOST TARGET GENE, encodes a corresponding messenger RNA, VGAM2341 host target RNA, herein designated VGAM HOST TARGET RNA. VGAM2341 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2341 RNA, herein designated VGAM RNA, binds complementarily to one or more host target binding sites located in untranslated regions of VGAM2341 host target RNA, herein designated VGAM HOST TARGET RNA. This complementary binding is due to the fact that the nucleotide sequence of VGAM2341 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2341 RNA, herein designated VGAM RNA, may have a different number of host target binding sites in untranslated regions of a VGAM2341 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2341 RNA, herein designated VGAM RNA, to host target binding sites on VGAM2341 host target RNA, herein designated VGAM HOST TARGET RNA, such as BINDING SITE I, BINDING SITE II and BINDING SITE III, inhibits translation of VGAM2341 host target RNA into VGAM2341 host target protein, herein designated VGAM HOST TARGET PROTEIN. VGAM host target protein is therefore outlined by a broken line.

It is appreciated that VGAM2341 host target gene, herein designated VGAM HOST TARGET GENE, in fact represents a plurality of VGAM2341 host target genes. The mRNA of each one of this plurality of VGAM2341 host target genes comprises one or more host target binding sites, each having a nucleotide sequence which is at least partly complementary to VGAM2341 RNA, herein designated VGAM RNA, and which when bound by VGAM2341 RNA causes inhibition of translation of respective one or more VGAM2341 host target proteins.

It is further appreciated by one skilled in the art that the mode of translational inhibition illustrated by FIG. 1 with specific reference to translational inhibition exerted by VGAM2341 gene, herein designated VGAM GENE, on one or more VGAM2341 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM2341 is inhibition of expression of host target genes, as part of a novel viral mechanism of attacking a host. Accordingly, utilities of VGAM2341 include diagnosis, prevention and treatment of viral infection by Equine Herpesvirus 2. Specific functions, and accordingly utilities, of VGAM2341 correlate with, and may be deduced from, the identity of the host target genes which VGAM2341 binds and inhibits, and the function of these host target genes, as elaborated hereinbelow.

Nucleotide sequences of the VGAM2341 precursor RNA, herein designated VGAM PRECURSOR RNA, and of the ‘diced’ VGAM2341 RNA, herein designated VGAM RNA, and a schematic representation of the secondary folding of VGAM2341 folded precursor RNA, herein designated VGAM FOLDED PRECURSOR RNA, of VGAM2341 are further described hereinbelow with reference to Table 1.

Nucleotide sequences of host target binding sites, such as BINDING SITE-I, BINDING SITE-II and BINDING SITE-III of FIG. 1, found on VGAM2341 host target RNA, and schematic representation of the complementarity of each of these host target binding sites to VGAM2341 RNA, herein designated VGAM RNA, are described hereinbelow with reference to Table 2.

As mentioned hereinabove with reference to FIG. 1, a function of VGAM2341 gene, herein designated VGAM is inhibition of expression of VGAM2341 target genes. It is appreciated that specific functions, and accordingly utilities, of VGAM2341 correlate with, and may be deduced from, the identity of the target genes which VGAM2341 binds and inhibits, and the function of these target genes, as elaborated hereinbelow.

Adenylate Cyclase 6 (ADCY6, Accession NM_020983) is a VGAM2341 host target gene. ADCY6 BINDING SITE1 and ADCY6 BINDING SITE2 are HOST TARGET binding sites found in untranslated regions of mRNA encoded by ADCY6, corresponding to HOST TARGET binding sites such as BINDING SITE I, BINDING SITE II or BINDING SITE III. Table 2 illustrates the complementarity of the nucleotide sequences of ADCY6 BINDING SITE1 and ADCY6 BINDING SITE2, designated SEQ ID:21973 and SEQ ID:17585 respectively, to the nucleotide sequence of VGAM2341 RNA, herein designated VGAM RNA, also designated SEQ ID:5052.

A function of VGAM2341 is therefore inhibition of Adenylate Cyclase 6 (ADCY6, Accession NM_020983), a gene which this a membrane-bound, ca (2+)-inhibitable adenylyl cyclase (by similarity). Accordingly, utilities of VGAM2341 include diagnosis, prevention and treatment of diseases and clinical conditions associated with ADCY6. The function of ADCY6 and its association with various diseases and clinical conditions, has been established by previous studies, as described hereinabove with reference to VGAM22. Contactin 3 (plasmacytoma associated) (CNTN3, Accession XM_039627) is another VGAM2341 host target gene. CNTN3 BINDING SITE is HOST TARGET binding site found in the 3' untranslated region of mRNA encoded by CNTN3, corresponding to a HOST TARGET binding site such as BINDING SITE I, BINDING SITE II or BINDING SITE III. Table 2 illustrates the complementarity of the nucleotide sequences of CNTN3 BINDING SITE, designated SEQ ID:33134, to the nucleotide sequence of VGAM2341 RNA, herein designated VGAM RNA, also designated SEQ ID:5052.

Another function of VGAM2341 is therefore inhibition of Contactin 3 (plasmacytoma associated) (CNTN3, Accession XM_039627), a gene which may play a role in the initial growth and guidance of axons. Accordingly, utilities of VGAM2341 include diagnosis, prevention and treatment of diseases and clinical conditions associated with CNTN3. The function of CNTN3 and its association with various diseases and clinical conditions, has been established by previous studies, as described hereinabove with reference to VGAM420. Dual Adaptor of Phosphotyrosine and 3-phosphoinositides (DAPP1, Accession NM_014395) is another VGAM2341 host target gene. DAPP1 BINDING SITE is HOST TARGET binding site found in the 3' untranslated region of mRNA encoded by DAPP1, corresponding to a HOST TARGET binding site such as BINDING SITE I, BINDING SITE II or BINDING SITE III. Table 2 illustrates the complementarity of the nucleotide sequences of DAPP1 BINDING SITE, designated SEQ ID:15733, to the nucleotide sequence of VGAM2341 RNA, herein designated VGAM RNA, also designated SEQ ID:5052.

Another function of VGAM2341 is therefore inhibition of Dual Adaptor of Phosphotyrosine and 3-phosphoinositides (DAPP1, Accession NM_014395), a gene which regulates the ras-cyclic amp pathway. Accordingly, utilities of VGAM2341 include diagnosis, prevention and treatment of diseases and clinical conditions associated with DAPP1. The function of DAPP1 and its association with various diseases and clinical conditions, has been established by previous studies, as described hereinabove with reference to VGAM283. Integrin, Alpha 6 (ITGA6, Accession NM_000210) is another VGAM2341 host target gene. ITGA6 BINDING SITE is HOST TARGET binding site found in the 3' untranslated region of mRNA encoded by ITGA6, corresponding to a HOST TARGET binding site such as BINDING SITE I, BINDING SITE II or BINDING SITE III. Table 2 illustrates the complementarity of the nucleotide sequences of ITGA6 BINDING SITE, designated SEQ ID:5705, to the nucleotide sequence of VGAM2341 RNA, herein designated VGAM RNA, also designated SEQ ID:5052.

Another function of VGAM2341 is therefore inhibition of Integrin, Alpha 6 (ITGA6, Accession NM_000210). Accordingly, utilities of VGAM2341 include diagnosis, prevention and treatment of diseases and clinical conditions associated with ITGA6. Phosphoenolpyruvate Carboxykinase 1 (soluble) (PCK1, Accession XM_009672) is another VGAM2341 host target gene. PCK1 BINDING SITE is HOST TARGET binding site found in the 3' untranslated region of mRNA encoded by PCK1, corresponding to a HOST TARGET binding site such as BINDING SITE I, BINDING SITE II or BINDING SITE III. Table 2 illustrates the complementarity of the nucleotide sequences of PCK1 BINDING SITE, designated SEQ ID:30116, to the nucleotide sequence of VGAM2341 RNA, herein designated VGAM RNA, also designated SEQ ID:5052.

Another function of VGAM2341 is therefore inhibition of Phosphoenolpyruvate Carboxykinase 1 (soluble) (PCK1, Accession XM_009672), a gene which forms phosphoenolpyruvate by decarboxylation of oxaloacetate. Accordingly, utilities of VGAM2341 include diagnosis, prevention and treatment of diseases and clinical conditions associated with PCK1. The function of PCK1 has been established by previous studies. Yu et al. (1993) used primers derived from the rat liver PEPCK sequence to amplify a portion of the human liver cDNA and to screen a YAC library of human genomic DNA. The sequences of human and rat PEPCK cDNA differed at 16% of the nucleotides compared. From the nucleotide sequence of a cDNA, Stoffel et al. (1993) determined that the PEPCK1 gene product is a protein of 622 amino acids whose sequence shows 90% identity with that of the cognate rat enzyme. Animal model experiments lend further support to the function of PCK1. Olswang et al. (2002) found that an induced mutation in the binding site for peroxisome proliferator-activated receptor-gamma (PPARG; 601487), which is called the PPAR element (PPARE), in the Pepckc gene reduced adipose tissue size and fat content in mice. The mutation abolished expression of the Pepckc gene in white adipose tissue and considerably reduced its expression in brown adipose tissue, whereas the level of cytoplasmic Pepckc mRNA in liver and kidney remained normal. Epididymal white adipose tissue from these mice had a reduced triglyceride deposition, whereas 25% of the animals displayed lipodystrophy. There was also a greatly reduced level of lipid accumulation in brown adipose tissue. A strong correlation between the hepatic content of triglycerides and the size of the epididymal fat pad in PPARE -/- mice suggested that hepatic triglyceride synthesis predominantly utilizes free fatty acids derived from the adipose tissue. Unlike other models, PPARE -/- mice with lipodystrophy did not exhibit the lipodystrophy-associated features of diabetes and displayed only moderate hyperglycemia. These studies established the importance of the PPARE site for PEPCKC gene expression in adipose tissue and the role of PEPCKC in the regulation of glyceroneogenesis, a pathway critical for maintaining the deposition of triglycerides in adipose tissue.

It is appreciated that the abovementioned animal model for PCK1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Olswang, Y.; Cohen, H.; Papo, O.; Cassuto, H.; Croniger, C. M.; Hakimi, P.; Tilghman, S. M.; Hanson, R. W.; Reshef, L.: A mutation in the peroxisome proliferator-activated receptor gamma-binding site in the gene for the cytosolic form of phosphoenolpyruvate carboxykinase reduces adipose tissue size and fat content in mice. Proc. Nat. Acad. Sci. 99:625-630, 2002; and Yu, H.; Thun, R.; Chandrasekharappa, S.; Trent, J. M.; Zhang, J.; Meisler, M. H.: Human PCK1 encoding phosphoenolpyruvate carboxykinase is located on chromosome 20q13.2. Genomics 15:2.

Further studies establishing the function and utilities of PCK1 are found in John Hopkins OMIM database record ID 261680, and in sited publications numbered 9409, 9413-941 and 9414-9415 listed in the bibliography section hereinbelow, which are also hereby incorporated by reference. Thymine-DNA Glycosylase (TDG, Accession NM_003211) is another VGAM2341 host target gene. TDG BINDING SITE is HOST TARGET binding site found in the 3' untranslated region of mRNA encoded by TDG, corresponding to a HOST TARGET binding site such as BINDING SITE I, BINDING SITE II or BINDING SITE III. Table 2 illustrates the complementarity of the nucleotide sequences of TDG BINDING SITE, designated SEQ ID:9207, to the nucleotide sequence of VGAM2341 RNA, herein designated VGAM RNA, also designated SEQ ID:5052.

Another function of VGAM2341 is therefore inhibition of Thymine-DNA Glycosylase (TDG, Accession NM_003211), a gene which excises uracil and thymine from mispairs with guanidine. Accordingly, utilities of VGAM2341 include diagnosis, prevention and treatment of diseases and clinical conditions associated with TDG. The function of TDG and its association with various diseases and clinical conditions, has been established by previous studies, as described hereinabove with reference to VGAM196. Zinc Finger Protein 80 (pT17) (ZNF80, Accession NM_007136) is another VGAM2341 host target gene. ZNF80 BINDING SITE is HOST TARGET binding site found in the 3' untranslated region of mRNA encoded by ZNF80, corresponding to a HOST TARGET binding site such as BINDING SITE I, BINDING SITE II or BINDING SITE III. Table 2 illustrates the complementarity of the nucleotide sequences of ZNF80 BINDING SITE, designated SEQ ID:13984, to the nucleotide sequence of VGAM2341 RNA, herein designated VGAM RNA, also designated SEQ ID:5052.

Another function of VGAM2341 is therefore inhibition of Zinc Finger Protein 80 (pT17) (ZNF80, Accession NM_007136). Accordingly, utilities of VGAM2341 include diagnosis, prevention and treatment of diseases and clinical conditions associated with ZNF80. Butyrophilin, Subfamily 2, Member A2 (BTN2A2, Accession NM_006995) is another VGAM2341 host target gene. BTN2A2 BINDING SITE is HOST TARGET binding site found in the 3' untranslated region of mRNA encoded by BTN2A2, corresponding to a HOST TARGET binding site such as BINDING SITE I, BINDING SITE II or BINDING SITE III. Table 2 illustrates the complementarity of the nucleotide sequences of BTN2A2 BINDING SITE, designated SEQ ID:13860, to the nucleotide sequence of VGAM2341 RNA, herein designated VGAM RNA, also designated SEQ ID:5052.

Another function of VGAM2341 is therefore inhibition of Butyrophilin, Subfamily 2, Member A2 (BTN2A2, Accession NM_006995). Accordingly, utilities of VGAM2341 include diagnosis, prevention and treatment of diseases and clinical conditions associated with BTN2A2. FLJ20288 (Accession NM_024668) is another VGAM2341 host target gene. FLJ20288 BINDING SITE is HOST TARGET binding site found in the 5' untranslated region of mRNA encoded by FLJ20288, corresponding to a HOST TARGET binding site such as BINDING SITE I, BINDING SITE II or BINDING SITE III. Table 2 illustrates the complementarity of the nucleotide sequences of FLJ20288 BINDING SITE, designated SEQ ID:23972, to the nucleotide sequence of VGAM2341 RNA, herein designated VGAM RNA, also designated SEQ ID:5052.

Another function of VGAM2341 is therefore inhibition of FLJ20288 (Accession NM_024668). Accordingly, utilities of VGAM2341 include diagnosis, prevention and treatment of diseases and clinical conditions associated with FLJ20288. KIAA1086 (Accession XM_047610) is another VGAM2341 host target gene. KIAA1086 BINDING SITE is HOST TARGET binding site found in the 3' untranslated region of mRNA encoded by KIAA1086, corresponding to a HOST TARGET binding site such as BINDING SITE I, BINDING SITE II or BINDING SITE III. Table 2 illustrates the complementarity of the nucleotide sequences of KIAA1086 BINDING SITE, designated SEQ ID:35010, to the nucleotide sequence of VGAM2341 RNA, herein designated VGAM RNA, also designated SEQ ID:5052.

Another function of VGAM2341 is therefore inhibition of KIAA1086 (Accession XM_047610). Accordingly, utilities of VGAM2341 include diagnosis, prevention and treatment of diseases and clinical conditions associated with KIAA1086. KIAA1600 (Accession XM_049351) is another VGAM2341 host target gene. KIAA1600 BINDING SITE is HOST TARGET binding site found in the 3' untranslated region of mRNA encoded by KIAA1600, corresponding to a HOST TARGET binding site such as BINDING SITE I, BINDING SITE II or BINDING SITE III. Table 2 illustrates the complementarity of the nucleotide sequences of KIAA1600 BINDING SITE, designated SEQ ID:35396, to the nucleotide sequence of VGAM2341 RNA, herein designated VGAM RNA, also designated SEQ ID:5052.

Another function of VGAM2341 is therefore inhibition of KIAA1600 (Accession XM_049351). Accordingly, utilities of VGAM2341 include diagnosis, prevention and treatment of diseases and clinical conditions associated with KIAA1600. Phosphodiesterase 3A, CGMP-inhibited (PDE3A, Accession NM_000921) is another VGAM2341 host target gene. PDE3A BINDING SITE is HOST TARGET binding site found in the 3' untranslated region of mRNA encoded by PDE3A, corresponding to a HOST TARGET binding site such as BINDING SITE I, BINDING SITE II or BINDING SITE III. Table 2 illustrates the complementarity of the nucleotide sequences of PDE3A BINDING SITE, designated SEQ ID:6633, to the nucleotide sequence of VGAM2341 RNA, herein designated VGAM RNA, also designated SEQ ID:5052.

Another function of VGAM2341 is therefore inhibition of Phosphodiesterase 3A, CGMP-inhibited (PDE3A, Accession NM_000921). Accordingly, utilities of VGAM2341 include diagnosis, prevention and treatment of diseases and clinical conditions associated with PDE3A. Rho-related BTB Domain Containing 1 (RHOBTB1, Accession XM_166144) is another VGAM2341 host target gene. RHOBTB1 BINDING SITE is HOST TARGET binding site found in the 3' untranslated region of mRNA encoded by RHOBTB1, corresponding to a HOST TARGET binding site such as BINDING SITE I, BINDING SITE II or BINDING SITE III. Table 2 illustrates the complementarity of the nucleotide sequences of RHOBTB1 BINDING SITE, designated SEQ ID:43954, to the nucleotide sequence of VGAM2341 RNA, herein designated VGAM RNA, also designated SEQ ID:5052.

Another function of VGAM2341 is therefore inhibition of Rho-related BTB Domain Containing 1 (RHOBTB1, Accession XM_166144). Accordingly, utilities of VGAM2341 include diagnosis, prevention and treatment of diseases and clinical conditions associated with RHOBTB1. Ubiquitin Specific Protease 25 (USP25, Accession NM_013396) is another VGAM2341 host target gene. USP25 BINDING SITE is HOST TARGET binding site found in the 3' untranslated region of mRNA encoded by USP25, corresponding to a HOST TARGET binding site such as BINDING SITE I, BINDING SITE II or BINDING SITE III. Table 2 illustrates the complementarity of the nucleotide sequences of USP25 BINDING SITE, designated SEQ ID:15050, to the nucleotide sequence of VGAM2341 RNA, herein designated VGAM RNA, also designated SEQ ID:5052.

Another function of VGAM2341 is therefore inhibition of Ubiquitin Specific Protease 25 (USP25, Accession NM_013396). Accordingly, utilities of VGAM2341 include diagnosis, prevention and treatment of diseases and clinical conditions associated with USP25. LOC147077 (Accession XM_085699) is another VGAM2341 host target gene. LOC147077 BINDING SITE is HOST TARGET binding site found in the 3' untranslated region of mRNA encoded by LOC147077, corresponding to a HOST TARGET binding site such as BINDING SITE I, BINDING SITE II or BINDING SITE III. Table 2 illustrates the complementarity of the nucleotide sequences of LOC147077 BINDING SITE, designated SEQ ID:38291, to the nucleotide sequence of VGAM2341 RNA, herein designated VGAM RNA, also designated SEQ ID:5052.

Another function of VGAM2341 is therefore inhibition of LOC147077 (Accession XM_085699). Accordingly, utilities of VGAM2341 include diagnosis, prevention and treatment of diseases and clinical conditions associated with LOC147077. LOC153077 (Accession XM_098307) is another VGAM2341 host target gene. LOC153077 BINDING SITE is HOST TARGET binding site found in the 3' untranslated region of mRNA encoded by LOC153077, corresponding to a HOST TARGET binding site such as BINDING SITE I, BINDING SITE II or BINDING SITE III. Table 2 illustrates the complementarity of the nucleotide sequences of LOC153077 BINDING SITE, designated SEQ ID:41572, to the nucleotide sequence of VGAM2341 RNA, herein designated VGAM RNA, also designated SEQ ID:5052.

Another function of VGAM2341 is therefore inhibition of LOC153077 (Accession XM_098307). Accordingly, utilities of VGAM2341 include diagnosis, prevention and treatment of diseases and clinical conditions associated with LOC153077. LOC255177 (Accession XM_172941) is another VGAM2341 host target gene. LOC255177 BINDING SITE is HOST TARGET binding site found in the 3' untranslated region of mRNA encoded by LOC255177, corresponding to a HOST TARGET binding site such as BINDING SITE I, BINDING SITE II or BINDING SITE III. Table 2 illustrates the complementarity of the nucleotide sequences of LOC255177 BINDING SITE, designated SEQ ID:46204, to the nucleotide sequence of VGAM2341 RNA, herein designated VGAM RNA, also designated SEQ ID:5052.

Another function of VGAM2341 is therefore inhibition of LOC255177 (Accession XM_172941). Accordingly, utilities of VGAM2341 include diagnosis, prevention and treatment of diseases and clinical conditions associated with LOC255177. LOC92379 (Accession XM_044712) is another VGAM2341 host target gene. LOC92379 BINDING SITE is HOST TARGET binding site found in the 3' untranslated region of mRNA encoded by LOC92379, corresponding to a HOST TARGET binding site such as BINDING SITE I, BINDING SITE II or BINDING SITE III. Table 2 illustrates the complementarity of the nucleotide sequences of LOC92379 BINDING SITE, designated SEQ ID:34269, to the nucleotide sequence of VGAM2341 RNA, herein designated VGAM RNA, also designated SEQ ID:5052.

Another function of VGAM2341 is therefore inhibition of LOC92379 (Accession XM_044712). Accordingly, utilities of VGAM2341 include diagnosis, prevention and treatment of diseases and clinical conditions associated with LOC92379. FIG. 1 further provides a conceptual description of a novel bioinformatically detected viral gene of the present invention, referred to here as Viral Genomic Address Messenger 2342 (VGAM2342) viral gene, which modulates expression of respective host target genes thereof, the function and utility of which host target genes is known in the art.

VGAM2342 is a novel bioinformatically detected regulatory, non protein coding, viral micro RNA (miRNA) gene. The method by which VGAM2342 was detected is described hereinabove with reference to FIGS. 1-8.

VGAM2342 gene, herein designated VGAM GENE, is a viral gene contained in the genome of Equine Herpesvirus 2. VGAM2342 host target gene, herein designated VGAM HOST TARGET GENE, is a human gene contained in the human genome.

VGAM2342 gene encodes a VGAM2342 precursor RNA, herein designated VGAM PRECURSOR RNA. Similar to other miRNA genes, and unlike most ordinary genes, VGAM2342 precursor RNA does not encode a protein. A nucleotide sequence identical or highly similar to the nucleotide sequence of VGAM2342 precursor RNA is designated SEQ ID:2328, and is provided hereinbelow with reference to the sequence listing part. Nucleotide sequence SEQ ID:2328 is located at position 43910 relative to the genome of Equine Herpesvirus 2.

VGAM2342 precursor RNA folds onto itself, forming VGAM2342 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2342 folded precursor RNA into VGAM2342 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2342 RNA is designated SEQ ID:5053, and is provided hereinbelow with reference to the sequence listing part.

VGAM2342 host target gene, herein designated VGAM HOST TARGET GENE, encodes a corresponding messenger RNA, VGAM2342 host target RNA, herein designated VGAM HOST TARGET RNA. VGAM2342 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2342 RNA, herein designated VGAM RNA, binds complementarily to one or more host target binding sites located in untranslated regions of VGAM2342 host target RNA, herein designated VGAM HOST TARGET RNA. This complementary binding is due to the fact that the nucleotide sequence of VGAM2342 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2342 RNA, herein designated VGAM RNA, may have a different number of host target binding sites in untranslated regions of a VGAM2342 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2342 RNA, herein designated VGAM RNA, to host target binding sites on VGAM2342 host target RNA, herein designated VGAM HOST TARGET RNA, such as BINDING SITE I, BINDING SITE II and BINDING SITE III, inhibits translation of VGAM2342 host target RNA into VGAM2342 host target protein, herein designated VGAM HOST TARGET PROTEIN. VGAM host target protein is therefore outlined by a broken line.

It is appreciated that VGAM2342 host target gene, herein designated VGAM HOST TARGET GENE, in fact represents a plurality of VGAM2342 host target genes. The mRNA of each one of this plurality of VGAM2342 host target genes comprises one or more host target binding sites, each having a nucleotide sequence which is at least partly complementary to VGAM2342 RNA, herein designated VGAM RNA, and which when bound by VGAM2342 RNA causes inhibition of translation of respective one or more VGAM2342 host target proteins.

It is further appreciated by one skilled in the art that the mode of translational inhibition illustrated by FIG. 1 with specific reference to translational inhibition exerted by VGAM2342 gene, herein designated VGAM GENE, on one or more VGAM2342 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2342 is inhibition of expression of host target genes, as part of a novel viral mechanism of attacking a host. Accordingly, utilities of VGAM2342 include diagnosis, prevention and treatment of viral infection by Equine Herpesvirus 2. Specific functions, and accordingly utilities, of VGAM2342 correlate with, and may be deduced from, the identity of the host target genes which VGAM2342 binds and inhibits, and the function of these host target genes, as elaborated hereinbelow.

Nucleotide sequences of the VGAM2342 precursor RNA, herein designated VGAM PRECURSOR RNA, and of the 'diced' VGAM2342 RNA, herein designated VGAM RNA, and a schematic representation of the secondary folding of VGAM2342 folded precursor RNA, herein designated VGAM FOLDED PRECURSOR RNA, of VGAM2342 are further described hereinbelow with reference to Table 1.

Nucleotide sequences of host target binding sites, such as BINDING SITE-I, BINDING SITE-II and BINDING SITE-III of FIG. 1, found on VGAM2342 host target RNA, and schematic representation of the complementarity of each of these host target binding sites to VGAM2342 RNA, herein designated VGAM RNA, are described hereinbelow with reference to Table 2.

As mentioned hereinabove with reference to FIG. 1, a function of VGAM2342 gene, herein designated VGAM is inhibition of expression of VGAM2342 target genes. It is appreciated that specific functions, and accordingly utilities, of VGAM2342 correlate with, and may be deduced from, the identity of the target genes which VGAM2342 binds and inhibits, and the function of these target genes, as elaborated hereinbelow.

Aldehyde Dehydrogenase 3 Family, Member A2 (ALDH3A2, Accession XM_045060) is a VGAM2342 host target gene. ALDH3A2 BINDING SITE is HOST TARGET binding site found in the 5' untranslated region of mRNA encoded by ALDH3A2, corresponding to a HOST TARGET binding site such as BINDING SITE I, BINDING SITE II or BINDING SITE III. Table 2 illustrates the complementarity of the nucleotide sequences of ALDH3A2 BINDING SITE, designated SEQ ID:34341, to the nucleotide sequence of VGAM2342 RNA, herein designated VGAM RNA, also designated SEQ ID:5053.

A function of VGAM2342 is therefore inhibition of Aldehyde Dehydrogenase 3 Family, Member A2 (ALDH3A2, Accession XM_045060). Accordingly, utilities of VGAM2342 include diagnosis, prevention and treatment of diseases and clinical conditions associated with ALDH3A2. Mitogen-activated Protein Kinase Kinase Kinase 14 (MAP3K14, Accession NM_003954) is another VGAM2342 host target gene. MAP3K14 BINDING SITE is HOST TARGET binding site found in the 3' untranslated region of mRNA encoded by MAP3K14, corresponding to a HOST TARGET binding site such as BINDING SITE I, BINDING SITE II or BINDING SITE III. Table 2 illustrates the complementarity of the nucleotide sequences of MAP3K14 BINDING SITE, designated SEQ ID:10092, to the nucleotide sequence of VGAM2342 RNA, herein designated VGAM RNA, also designated SEQ ID:5053.

Another function of VGAM2342 is therefore inhibition of Mitogen-activated Protein Kinase Kinase Kinase 14 (MAP3K14, Accession NM_003954), a gene which is involved in the activation of nf-kappa-b and its transcriptional activity. induces the processing of nf-kappa-b 2/p100. could act in a receptor-selective manner (by similarity). Accordingly, utilities of VGAM2342 include diagnosis, prevention and treatment of diseases and clinical conditions associated with MAP3K14. The function of MAP3K14 and its association with various diseases and clinical conditions, has been established by previous studies, as described hereinabove with reference to VGAM55. Multiple Endocrine Neoplasia I (MEN1, Accession XM_167804) is another VGAM2342 host target gene. MEN1 BINDING SITE is HOST TARGET binding site found in the 5' untranslated region of mRNA encoded by MEN1, corresponding to a HOST TARGET binding site such as BINDING SITE I, BINDING SITE II or BINDING SITE III. Table 2 illustrates the complementarity of the nucleotide sequences of MEN1 BINDING SITE, designated SEQ ID:44848, to the nucleotide sequence of VGAM2342 RNA, herein designated VGAM RNA, also designated SEQ ID:5053.

Another function of VGAM2342 is therefore inhibition of Multiple Endocrine Neoplasia I (MEN1, Accession XM_167804). Accordingly, utilities of VGAM2342 include diagnosis, prevention and treatment of diseases and clinical conditions associated with MEN1. Neogenin Homolog 1 (chicken) (NEO1, Accession NM_002499) is another VGAM2342 host target gene. NEO1 BINDING SITE is HOST TARGET binding site found in the 3' untranslated region of mRNA encoded by NEO1, corresponding to a HOST TARGET binding site such as BINDING SITE I, BINDING SITE II or BINDING SITE III. Table 2 illustrates the complementarity of the nucleotide sequences of NEO1 BINDING SITE, designated SEQ ID:8315, to the nucleotide sequence of VGAM2342 RNA, herein designated VGAM RNA, also designated SEQ ID:5053.

Another function of VGAM2342 is therefore inhibition of Neogenin Homolog 1 (chicken) (NEO1, Accession NM_002499), a gene which regulates the transition of undifferentiated proliferating cells to their differentiated state. Accordingly, utilities of VGAM2342 include diagnosis, prevention and treatment of diseases and clinical conditions associated with NEO1. The function of NEO1 and its association with various diseases and clinical conditions, has been established by previous studies, as described hereinabove with reference to VGAM329. ADMP (Accession NM_145035) is another VGAM2342 host target gene. ADMP BINDING SITE is HOST TARGET binding site found in the 3' untranslated region of mRNA encoded by ADMP, corresponding to a HOST TARGET binding site such as BINDING SITE I, BINDING SITE II or BINDING SITE III. Table 2 illustrates the complementarity of the nucleotide sequences of ADMP BINDING SITE, designated SEQ ID:29659, to the nucleotide sequence of VGAM2342 RNA, herein designated VGAM RNA, also designated SEQ ID:5053.

Another function of VGAM2342 is therefore inhibition of ADMP (Accession NM_145035). Accordingly, utilities of VGAM2342 include diagnosis, prevention and treatment of diseases and clinical conditions associated with ADMP. Bromodomain Containing 4 (BRD4, Accession NM_058243) is another VGAM2342 host target gene. BRD4 BINDING SITE is HOST TARGET binding site found in the 3' untranslated region of mRNA encoded by BRD4, corresponding to a HOST TARGET binding site such as BINDING SITE I, BINDING SITE II or BINDING SITE III. Table 2 illustrates the complementarity of the nucleotide sequences of BRD4 BINDING SITE, designated SEQ ID:27776, to the nucleotide sequence of VGAM2342 RNA, herein designated VGAM RNA, also designated SEQ ID:5053.

Another function of VGAM2342 is therefore inhibition of Bromodomain Containing 4 (BRD4, Accession NM_058243). Accordingly, utilities of VGAM2342 include diagnosis, prevention and treatment of diseases and clinical conditions associated with BRD4. DKFZP434B205 (Accession XM_059966) is another VGAM2342 host target gene. DKFZP434B205 BINDING SITE is HOST TARGET binding site found in the 3' untranslated region of mRNA encoded by DKFZP434B205, corresponding to a HOST TARGET binding site such as BINDING SITE I, BINDING SITE II or BINDING SITE III. Table 2 illustrates the complementarity of the nucleotide sequences of DKFZP434B205 BINDING SITE, designated SEQ ID:37126, to the nucleotide sequence of VGAM2342 RNA, herein designated VGAM RNA, also designated SEQ ID:5053.

Another function of VGAM2342 is therefore inhibition of DKFZP434B205 (Accession XM_059966). Accordingly, utilities of VGAM2342 include diagnosis, prevention and treatment of diseases and clinical conditions associated with DKFZP434B205. DKFZp547O146 (Accession NM_020224) is another VGAM2342 host target gene. DKFZp547O146 BINDING SITE is HOST TARGET binding site found in the 5' untranslated region of mRNA encoded by DKFZp547O146, corresponding to a HOST TARGET binding site such as BINDING SITE I, BINDING SITE II or BINDING SITE III. Table 2 illustrates the complementarity of the nucleotide sequences of DKFZp547O146 BINDING SITE, designated SEQ ID:21482, to the nucleotide sequence of VGAM2342 RNA, herein designated VGAM RNA, also designated SEQ ID:5053.

Another function of VGAM2342 is therefore inhibition of DKFZp547O146 (Accession NM_020224). Accordingly, utilities of VGAM2342 include diagnosis, prevention and treatment of diseases and clinical conditions associated with DKFZp547O146. FLJ10781 (Accession NM_018215) is another VGAM2342 host target gene. FLJ10781 BINDING SITE is HOST TARGET binding site found in the 5' untranslated region of mRNA encoded by FLJ10781, corresponding to a HOST TARGET binding site such as BINDING SITE I, BINDING SITE II or BINDING SITE III. Table 2 illustrates the complementarity of the nucleotide sequences of FLJ10781 BINDING SITE, designated SEQ ID:20135, to the nucleotide sequence of VGAM2342 RNA, herein designated VGAM RNA, also designated SEQ ID:5053.

Another function of VGAM2342 is therefore inhibition of FLJ10781 (Accession NM_018215). Accordingly, utilities of VGAM2342 include diagnosis, prevention and treatment of diseases and clinical conditions associated with FLJ10781. FLJ12387 (Accession NM_022822) is another VGAM2342 host target gene. FLJ12387 BINDING SITE is HOST TARGET binding site found in the 3' untranslated region of mRNA encoded by FLJ12387, corresponding to a HOST TARGET binding site such as BINDING SITE I, BINDING SITE II or BINDING SITE III. Table 2 illustrates the complementarity of the nucleotide sequences of FLJ12387 BINDING SITE, designated SEQ ID:23101, to the nucleotide sequence of VGAM2342 RNA, herein designated VGAM RNA, also designated SEQ ID:5053.

Another function of VGAM2342 is therefore inhibition of FLJ12387 (Accession NM_022822). Accordingly, utilities of VGAM2342 include diagnosis, prevention and treatment of diseases and clinical conditions associated with FLJ12387. FLJ14810 (Accession NM_032843) is another VGAM2342 host target gene. FLJ14810 BINDING SITE is HOST TARGET binding site found in the 3' untranslated region of mRNA encoded by FLJ14810, corresponding to a HOST TARGET binding site such as BINDING SITE I, BINDING SITE II or BINDING SITE III. Table 2 illustrates the complementarity of the nucleotide sequences of FLJ14810 BINDING SITE, designated SEQ ID:26633, to the nucleotide sequence of VGAM2342 RNA, herein designated VGAM RNA, also designated SEQ ID:5053.

Another function of VGAM2342 is therefore inhibition of FLJ14810 (Accession NM_032843). Accordingly, utilities of VGAM2342 include diagnosis, prevention and treatment of diseases and clinical conditions associated with FLJ14810. FLJ22059 (Accession NM_022752) is another VGAM2342 host target gene. FLJ22059 BINDING SITE is HOST TARGET binding site found in the 5' untranslated region of mRNA encoded by FLJ22059, corresponding to a HOST TARGET binding site such as BINDING SITE I, BINDING SITE II or BINDING SITE III. Table 2 illustrates the complementarity of the nucleotide sequences of FLJ22059 BINDING SITE, designated SEQ ID:22975, to the nucleotide sequence of VGAM2342 RNA, herein designated VGAM RNA, also designated SEQ ID:5053.

Another function of VGAM2342 is therefore inhibition of FLJ22059 (Accession NM_022752). Accordingly, utilities of VGAM2342 include diagnosis, prevention and treatment of diseases and clinical conditions associated with FLJ22059. FLJ23462 (Accession NM_024843) is another VGAM2342 host target gene. FLJ23462 BINDING SITE is HOST TARGET binding site found in the 3' untranslated region of mRNA encoded by FLJ23462, corresponding to a HOST TARGET binding site such as BINDING SITE I, BINDING SITE II or BINDING SITE III. Table 2 illustrates the complementarity of the nucleotide sequences of FLJ23462 BINDING SITE, designated SEQ ID:24265, to the nucleotide sequence of VGAM2342 RNA, herein designated VGAM RNA, also designated SEQ ID:5053.

Another function of VGAM2342 is therefore inhibition of FLJ23462 (Accession NM_024843). Accordingly, utilities of VGAM2342 include diagnosis, prevention and treatment of diseases and clinical conditions associated with FLJ23462. HZFW1 (Accession NM_025236) is another VGAM2342 host target gene. HZFW1 BINDING SITE is HOST TARGET binding site found in the 3' untranslated region of mRNA encoded by HZFW1, corresponding to a HOST TARGET binding site such as BINDING SITE I, BINDING SITE II or BINDING SITE III. Table 2 illustrates the complementarity of the nucleotide sequences of HZFW1 BINDING SITE, designated SEQ ID:24915, to the nucleotide sequence of VGAM2342 RNA, herein designated VGAM RNA, also designated SEQ ID:5053.

Another function of VGAM2342 is therefore inhibition of HZFW1 (Accession NM_025236). Accordingly, utilities of VGAM2342 include diagnosis, prevention and treatment of diseases and clinical conditions associated with HZFW1. KIAA0014 (Accession NM_014665) is another VGAM2342 host target gene. KIAA0014 BINDING SITE is HOST TARGET binding site found in the 3' untranslated region of mRNA encoded by KIAA0014, corresponding to a HOST TARGET binding site such as BINDING SITE I, BINDING SITE II or BINDING SITE III. Table 2 illustrates the complementarity of the nucleotide sequences of KIAA0014 BINDING SITE, designated SEQ ID:16113, to the nucleotide sequence of VGAM2342 RNA, herein designated VGAM RNA, also designated SEQ ID:5053.

Another function of VGAM2342 is therefore inhibition of KIAA0014 (Accession NM_014665). Accordingly, utilities of VGAM2342 include diagnosis, prevention and treatment of diseases and clinical conditions associated with KIAA0014. KIAA0237 (Accession NM_014747) is another VGAM2342 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16445, to the nucleotide sequence of VGAM2342 RNA, herein designated VGAM RNA, also designated SEQ ID:5053.

Another function of VGAM2342 is therefore inhibition of KIAA0237 (Accession NM_014747). Accordingly, utilities of VGAM2342 include diagnosis, prevention and treatment of diseases and clinical conditions associated with KIAA0237. KIAA0514 (Accession NM_014696) is another VGAM2342 host target gene. KIAA0514 BINDING SITE is HOST TARGET binding site found in the 3' untranslated region of mRNA encoded by KIAA0514, corresponding to a HOST TARGET binding site such as BINDING SITE I, BINDING SITE II or BINDING SITE III. Table 2 illustrates the complementarity of the nucleotide sequences of KIAA0514 BINDING SITE, designated SEQ ID:16206, to the nucleotide sequence of VGAM2342 RNA, herein designated VGAM RNA, also designated SEQ ID:5053.

Another function of VGAM2342 is therefore inhibition of KIAA0514 (Accession NM_014696). Accordingly, utilities of VGAM2342 include diagnosis, prevention and treatment of diseases and clinical conditions associated with KIAA0514. KIAA0672 (Accession NM_014859) is another VGAM2342 host target gene. KIAA0672 BINDING SITE is HOST TARGET binding site found in the 5' untranslated region of mRNA encoded by KIAA0672, corresponding to a HOST TARGET binding site such as BINDING SITE I, BINDING SITE II or BINDING SITE III. Table 2 illustrates the complementarity of the nucleotide sequences of KIAA0672 BINDING SITE, designated SEQ ID:16918, to the nucleotide sequence of VGAM2342 RNA, herein designated VGAM RNA, also designated SEQ ID:5053.

Another function of VGAM2342 is therefore inhibition of KIAA0672 (Accession NM_014859). Accordingly, utilities of VGAM2342 include diagnosis, prevention and treatment of diseases and clinical conditions associated with KIAA0672. KIAA1196 (Accession XM_028968) is another VGAM2342 host target gene. KIAA1196 BINDING SITE is HOST TARGET binding site found in the 3' untranslated region of mRNA encoded by KIAA1196, corresponding to a HOST TARGET binding site such as BINDING SITE I, BINDING SITE II or BINDING SITE III. Table 2 illustrates the complementarity of the nucleotide sequences of KIAA1196 BINDING SITE, designated SEQ ID:30821, to the nucleotide sequence of VGAM2342 RNA, herein designated VGAM RNA, also designated SEQ ID:5053.

Another function of VGAM2342 is therefore inhibition of KIAA1196 (Accession XM_028968). Accordingly, utilities of VGAM2342 include diagnosis, prevention and treatment of diseases and clinical conditions associated with KIAA1196. KIAA1468 (Accession XM_166289) is another VGAM2342 host target gene. KIAA1468 BINDING SITE is HOST TARGET binding site found in the 3' untranslated region of mRNA encoded by KIAA1468, corresponding to a HOST TARGET binding site such as BINDING SITE I, BINDING SITE II or BINDING SITE III. Table 2 illustrates the complementarity of the nucleotide sequences of KIAA1468 BINDING SITE, designated SEQ ID:44098, to the nucleotide sequence of VGAM2342 RNA, herein designated VGAM RNA, also designated SEQ ID:5053.

Another function of VGAM2342 is therefore inhibition of KIAA1468 (Accession XM_166289). Accordingly, utilities of VGAM2342 include diagnosis, prevention and treatment of diseases and clinical conditions associated with KIAA1468. KIAA1762 (Accession XM_033370) is another VGAM2342 host target gene. KIAA1762 BINDING SITE is HOST TARGET binding site found in the 3' untranslated region of mRNA encoded by KIAA1762, corresponding to a HOST TARGET binding site such as BINDING SITE I, BINDING SITE II or BINDING SITE III. Table 2 illustrates the complementarity of the nucleotide sequences of KIAA1762 BINDING SITE, designated SEQ ID:31911, to the nucleotide sequence of VGAM2342 RNA, herein designated VGAM RNA, also designated SEQ ID:5053.

Another function of VGAM2342 is therefore inhibition of KIAA1762 (Accession XM_033370). Accordingly, utilities of VGAM2342 include diagnosis, prevention and treatment of diseases and clinical conditions associated with KIAA1762. Leucine-rich Repeat LGI Family, Member 3 (LGI3, Accession NM_139278) is another VGAM2342 host target gene. LGI3 BINDING SITE is HOST TARGET binding site found in the 3' untranslated region of mRNA encoded by LGI3, corresponding to a HOST TARGET binding site such as BINDING SITE I, BINDING SITE II or BINDING SITE III. Table 2 illustrates the complementarity of the nucleotide sequences of LGI3 BINDING SITE, designated SEQ ID:29277, to the nucleotide sequence of VGAM2342 RNA, herein designated VGAM RNA, also designated SEQ ID:5053.

Another function of VGAM2342 is therefore inhibition of Leucine-rich Repeat LGI Family, Member 3 (LGI3, Accession NM_139278). Accordingly, utilities of VGAM2342 include diagnosis, prevention and treatment of diseases and clinical conditions associated with LGI3. MGC13170 (Accession NM_032712) is another VGAM2342 host target gene. MGC13170 BINDING SITE is HOST TARGET binding site found in the 5' untranslated region of mRNA encoded by MGC13170, corresponding to a HOST TARGET binding site such as BINDING SITE I, BINDING SITE II or BINDING SITE III. Table 2 illustrates the complementarity of the nucleotide sequences of MGC13170 BINDING SITE, designated SEQ ID:26434, to the nucleotide sequence of VGAM2342 RNA, herein designated VGAM RNA, also designated SEQ ID:5053.

Another function of VGAM2342 is therefore inhibition of MGC13170 (Accession NM_032712). Accordingly, utilities of VGAM2342 include diagnosis, prevention and treatment of diseases and clinical conditions associated with MGC13170. RI58 (Accession NM_012420) is another VGAM2342 host target gene. RI58 BINDING SITE is HOST TARGET binding site found in the 3' untranslated region of mRNA encoded by RI58, corresponding to a HOST TARGET binding site such as BINDING SITE I, BINDING SITE II or BINDING SITE III. Table 2 illustrates the complementarity of the nucleotide sequences of RI58 BINDING SITE, designated SEQ ID:14795, to the nucleotide sequence of VGAM2342 RNA, herein designated VGAM RNA, also designated SEQ ID:5053.

Another function of VGAM2342 is therefore inhibition of RI58 (Accession NM_012420). Accordingly, utilities of VGAM2342 include diagnosis, prevention and treatment of diseases and clinical conditions associated with RI58. SP329 (Accession NM_030793) is another VGAM2342 host target gene. SP329 BINDING SITE is HOST TARGET binding site found in the 5' untranslated region of mRNA encoded by SP329, corresponding to a HOST TARGET binding site such as BINDING SITE I, BINDING SITE II or BINDING SITE III. Table 2 illustrates the complementarity of the nucleotide sequences of SP329 BINDING SITE, designated SEQ ID:25096, to the nucleotide sequence of VGAM2342 RNA, herein designated VGAM RNA, also designated SEQ ID:5053.

Another function of VGAM2342 is therefore inhibition of SP329 (Accession NM_030793). Accordingly, utilities of VGAM2342 include diagnosis, prevention and treatment of diseases and clinical conditions associated with SP329. UBCE7IP5 (Accession NM_014948) is another VGAM2342 host target gene. UBCE7IP5 BINDING SITE is HOST TARGET binding site found in the 3' untranslated region of mRNA encoded by UBCE7IP5, corresponding to a HOST TARGET binding site such as BINDING SITE I, BINDING SITE II or BINDING SITE III. Table 2 illustrates the complementarity of the nucleotide sequences of UBCE7IP5 BINDING SITE, designated SEQ ID:17270, to the nucleotide sequence of VGAM2342 RNA, herein designated VGAM RNA, also designated SEQ ID:5053.

Another function of VGAM2342 is therefore inhibition of UBCE7IP5 (Accession NM_014948). Accordingly, utilities of VGAM2342 include diagnosis, prevention and treatment of diseases and clinical conditions associated with UBCE7IP5. LOC123591 (Accession XM_063741) is another VGAM2342 host target gene. LOC123591 BINDING SITE is HOST TARGET binding site found in the 5' untranslated region of mRNA encoded by LOC123591, corresponding to a HOST TARGET binding site such as BINDING SITE I, BINDING SITE II or BINDING SITE III. Table 2 illustrates the complementarity of the nucleotide sequences of LOC123591 BINDING SITE, designated SEQ ID:37252, to the nucleotide sequence of VGAM2342 RNA, herein designated VGAM RNA, also designated SEQ ID:5053.

Another function of VGAM2342 is therefore inhibition of LOC123591 (Accession XM_063741). Accordingly, utilities of VGAM2342 include diagnosis, prevention and treatment of diseases and clinical conditions associated with LOC123591. LOC145371 (Accession XM_085123) is another VGAM2342 host target gene. LOC145371 BINDING SITE is HOST TARGET binding site found in the 3' untranslated region of mRNA encoded by LOC145371, corresponding to a HOST TARGET binding site such as BINDING SITE I, BINDING SITE II or BINDING SITE III. Table 2 illustrates the complementarity of the nucleotide sequences of LOC145371 BINDING SITE, designated SEQ ID:37845, to the nucleotide sequence of VGAM2342 RNA, herein designated VGAM RNA, also designated SEQ ID:5053.

Another function of VGAM2342 is therefore inhibition of LOC145371 (Accession XM_085123). Accordingly, utilities of VGAM2342 include diagnosis, prevention and treatment of diseases and clinical conditions associated with LOC145371. LOC149478 (Accession XM_086536) is another VGAM2342 host target gene. LOC149478 BINDING SITE is HOST TARGET binding site found in the 5' untranslated region of mRNA encoded by LOC149478, corresponding to a HOST TARGET binding site such as BINDING SITE I, BINDING SITE II or BINDING SITE III. Table 2 illustrates the complementarity of the nucleotide sequences of LOC149478 BINDING SITE, designated SEQ ID:38752, to the nucleotide sequence of VGAM2342 RNA, herein designated VGAM RNA, also designated SEQ ID:5053.

Another function of VGAM2342 is therefore inhibition of LOC149478 (Accession XM_086536). Accordingly, utilities of VGAM2342 include diagnosis, prevention and treatment of diseases and clinical conditions associated with LOC149478. LOC152762 (Accession XM_087518) is another VGAM2342 host target gene. LOC152762 BINDING SITE is HOST TARGET binding site found in the 3' untranslated region of mRNA encoded by LOC152762, corresponding to a HOST TARGET binding site such as BINDING SITE I, BINDING SITE II or BINDING SITE III. Table 2 illustrates the complementarity of the nucleotide sequences of LOC152762 BINDING SITE, designated SEQ ID:39306, to the nucleotide sequence of VGAM2342 RNA, herein designated VGAM RNA, also designated SEQ ID:5053.

Another function of VGAM2342 is therefore inhibition of LOC152762 (Accession XM_087518). Accordingly, utilities of VGAM2342 include diagnosis, prevention and treatment of diseases and clinical conditions associated with LOC152762. LOC153516 (Accession NM_138491) is another VGAM2342 host target gene. LOC153516 BINDING SITE is HOST TARGET binding site found in the 3' untranslated region of mRNA encoded by LOC153516, corresponding to a HOST TARGET binding site such as BINDING SITE I, BINDING SITE II or BINDING SITE III. Table 2 illustrates the complementarity of the nucleotide sequences of LOC153516 BINDING SITE, designated SEQ ID:28841, to the nucleotide sequence of VGAM2342 RNA, herein designated VGAM RNA, also designated SEQ ID:5053.

Another function of VGAM2342 is therefore inhibition of LOC153516 (Accession NM_138491). Accordingly, utilities of VGAM2342 include diagnosis, prevention and treatment of diseases and clinical conditions associated with LOC153516. LOC163412 (Accession XM_088868) is another VGAM2342 host target gene. LOC163412 BINDING SITE is HOST TARGET binding site found in the 5' untranslated region of mRNA encoded by LOC163412, corresponding to a HOST TARGET binding site such as BINDING SITE I, BINDING SITE II or BINDING SITE III. Table 2 illustrates the complementarity of the nucleotide sequences of LOC163412 BINDING SITE, designated SEQ ID:39952, to the nucleotide sequence of VGAM2342 RNA, herein designated VGAM RNA, also designated SEQ ID:5053.

Another function of VGAM2342 is therefore inhibition of LOC163412 (Accession XM_088868). Accordingly, utilities of VGAM2342 include diagnosis, prevention and treatment of diseases and clinical conditions associated with LOC163412. LOC222182 (Accession XM_168471) is another VGAM2342 host target gene. LOC222182 BINDING SITE is HOST TARGET binding site found in the 3' untranslated region of mRNA encoded by LOC222182, corresponding to a HOST TARGET binding site such as BINDING SITE I, BINDING SITE II or BINDING SITE III. Table 2 illustrates the complementarity of the nucleotide sequences of LOC222182 BINDING SITE, designated SEQ ID:45196, to the nucleotide sequence of VGAM2342 RNA, herein designated VGAM RNA, also designated SEQ ID:5053.

Another function of VGAM2342 is therefore inhibition of LOC222182 (Accession XM_168471). Accordingly, utilities of VGAM2342 include diagnosis, prevention and treatment of diseases and clinical conditions associated with LOC222182. FIG. 1 further provides a conceptual description of a novel bioinformatically detected viral gene of the present invention, referred to here as Viral Genomic Address Messenger 2343 (VGAM2343) viral gene, which modulates expression of respective host target genes thereof, the function and utility of which host target genes is known in the art.

VGAM2343 is a novel bioinformatically detected regulatory, non protein coding, viral micro RNA (miRNA) gene. The method by which VGAM2343 was detected is described hereinabove with reference to FIGS. 1-8.

VGAM2343 gene, herein designated VGAM GENE, is a viral gene contained in the genome of Equine Herpesvirus 2. VGAM2343 host target gene, herein designated VGAM HOST TARGET GENE, is a human gene contained in the human genome.

VGAM2343 gene encodes a VGAM2343 precursor RNA, herein designated VGAM PRECURSOR RNA. Similar to other miRNA genes, and unlike most ordinary genes, VGAM2343 precursor RNA does not encode a protein. A nucleotide sequence identical or highly similar to the nucleotide sequence of VGAM2343 precursor RNA is designated SEQ ID:2329, and is provided hereinbelow with reference to the sequence listing part. Nucleotide sequence SEQ ID:2329 is located at position 43126 relative to the genome of Equine Herpesvirus 2.

VGAM2343 precursor RNA folds onto itself, forming VGAM2343 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2343 folded precursor RNA into VGAM2343 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2343 RNA is designated SEQ ID:5054, and is provided hereinbelow with reference to the sequence listing part.

VGAM2343 host target gene, herein designated VGAM HOST TARGET GENE, encodes a corresponding messenger RNA, VGAM2343 host target RNA, herein designated VGAM HOST TARGET RNA. VGAM2343 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2343 RNA, herein designated VGAM RNA, binds complementarily to one or more host target binding sites located in untranslated regions of VGAM2343 host target RNA, herein designated VGAM HOST TARGET RNA. This complementary binding is due to the fact that the nucleotide sequence of VGAM2343 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2343 RNA, herein designated VGAM RNA, may have a different number of host target binding sites in untranslated regions of a VGAM2343 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2343 RNA, herein designated VGAM RNA, to host target binding sites on VGAM2343 host target RNA, herein designated VGAM HOST TARGET RNA, such as BINDING SITE I, BINDING SITE II and BINDING SITE III, inhibits translation of VGAM2343 host target RNA into VGAM2343 host target protein, herein designated VGAM HOST TARGET PROTEIN. VGAM host target protein is therefore outlined by a broken line.

It is appreciated that VGAM2343 host target gene, herein designated VGAM HOST TARGET GENE, in fact represents a plurality of VGAM2343 host target genes. The mRNA of each one of this plurality of VGAM2343 host target genes comprises one or more host target binding sites, each having a nucleotide sequence which is at least partly complementary to VGAM2343 RNA, herein designated VGAM RNA, and which when bound by VGAM2343 RNA causes inhibition of translation of respective one or more VGAM2343 host target proteins.

It is further appreciated by one skilled in the art that the mode of translational inhibition illustrated by FIG. 1 with specific reference to translational inhibition exerted by VGAM2343 gene, herein designated VGAM GENE, on one or more VGAM2343 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2343 is inhibition of expression of host target genes, as part of a novel viral mechanism of attacking a host. Accordingly, utilities of VGAM2343 include diagnosis, prevention and treatment of viral infection by Equine Herpesvirus 2. Specific functions, and accordingly utilities, of VGAM2343 correlate with, and may be deduced from, the identity of the host target genes which VGAM2343 binds and inhibits, and the function of these host target genes, as elaborated hereinbelow.

Nucleotide sequences of the VGAM2343 precursor RNA, herein designated VGAM PRECURSOR RNA, and of the 'diced' VGAM2343 RNA, herein designated VGAM RNA, and a schematic representation of the secondary folding of VGAM2343 folded precursor RNA, herein designated VGAM FOLDED PRECURSOR RNA, of VGAM2343 are further described hereinbelow with reference to Table 1.

Nucleotide sequences of host target binding sites, such as BINDING SITE-I, BINDING SITE-II and BINDING SITE-III of FIG. 1, found on VGAM2343 host target RNA, and schematic representation of the complementarity of each of these host target binding sites to VGAM2343 RNA, herein designated VGAM RNA, are described hereinbelow with reference to Table 2.

As mentioned hereinabove with reference to FIG. 1, a function of VGAM2343 gene, herein designated VGAM is inhibition of expression of VGAM2343 target genes. It is appreciated that specific functions, and accordingly utilities, of VGAM2343 correlate with, and may be deduced from, the identity of the target genes which VGAM2343 binds and inhibits, and the function of these target genes, as elaborated hereinbelow.

CDT6 (Accession NM_021146) is a VGAM2343 host target gene. CDT6 BINDING SITE is HOST TARGET binding site found in the 5' untranslated region of mRNA encoded by CDT6, corresponding to a HOST TARGET binding site such as BINDING SITE I, BINDING SITE II or BINDING SITE III. Table 2 illustrates the complementarity of the nucleotide sequences of CDT6 BINDING SITE, designated SEQ ID:22119, to the nucleotide sequence of VGAM2343 RNA, herein designated VGAM RNA, also designated SEQ ID:5054.

A function of VGAM2343 is therefore inhibition of CDT6 (Accession NM_021146). Accordingly, utilities of VGAM2343 include diagnosis, prevention and treatment of diseases and clinical conditions associated with CDT6. P114-RHO-GEF (Accession NM_015318) is another VGAM2343 host target gene. P114-RHO-GEF BINDING SITE is HOST TARGET binding site found in the 3' untranslated region of mRNA encoded by P114-RHO-GEF, corresponding to a HOST TARGET binding site such as BINDING SITE I, BINDING SITE II or BINDING SITE III. Table 2 illustrates the complementarity of the nucleotide sequences of P114-RHO-GEF BINDING SITE, designated SEQ ID:17637, to the nucleotide sequence of VGAM2343 RNA, herein designated VGAM RNA, also designated SEQ ID:5054.

Another function of VGAM2343 is therefore inhibition of P114-RHO-GEF (Accession NM_015318). Accordingly, utilities of VGAM2343 include diagnosis, prevention and treatment of diseases and clinical conditions associated with P114-RHO-GEF. ZFD25 (Accession NM_016220) is another VGAM2343 host target gene. ZFD25 BINDING SITE is HOST TARGET binding site found in the 5' untranslated region of mRNA encoded by ZFD25, corresponding to a HOST TARGET binding site such as BINDING SITE I, BINDING SITE II or BINDING SITE III. Table 2 illustrates the complementarity of the nucleotide sequences of ZFD25 BINDING SITE, designated SEQ ID:18321, to the nucleotide sequence of VGAM2343 RNA, herein designated VGAM RNA, also designated SEQ ID:5054.

Another function of VGAM2343 is therefore inhibition of ZFD25 (Accession NM_016220). Accordingly, utilities of VGAM2343 include diagnosis, prevention and treatment of diseases and clinical conditions associated with ZFD25. LOC151414 (Accession XM_087197) is another VGAM2343 host target gene. LOC151414 BINDING SITE is HOST TARGET binding site found in the 3' untranslated region of mRNA encoded by LOC151414, corresponding to a HOST TARGET binding site such as BINDING SITE I, BINDING SITE II or BINDING SITE III. Table 2 illustrates the complementarity of the nucleotide sequences of LOC151414 BINDING SITE, designated SEQ ID:39107, to the nucleotide sequence of VGAM2343 RNA, herein designated VGAM RNA, also designated SEQ ID:5054.

Another function of VGAM2343 is therefore inhibition of LOC151414 (Accession XM_087197). Accordingly, utilities of VGAM2343 include diagnosis, prevention and treatment of diseases and clinical conditions associated with LOC151414. LOC90550 (Accession XM_054582) is another VGAM2343 host target gene. LOC90550 BINDING SITE is HOST TARGET binding site found in the 3' untranslated region of mRNA encoded by LOC90550, corresponding to a HOST TARGET binding site such as BINDING SITE I, BINDING SITE II or BINDING SITE III. Table 2 illustrates the complementarity of the nucleotide sequences of LOC90550 BINDING SITE, designated SEQ ID:36176, to the nucleotide sequence of VGAM2343 RNA, herein designated VGAM RNA, also designated SEQ ID:5054.

Another function of VGAM2343 is therefore inhibition of LOC90550 (Accession XM_054582). Accordingly, utilities of VGAM2343 include diagnosis, prevention and treatment of diseases and clinical conditions associated with LOC90550. FIG. 1 further provides a conceptual description of a novel bioinformatically detected viral gene of the present invention, referred to here as Viral Genomic Address Messenger 2344 (VGAM2344) viral gene, which modulates expression of respective host target genes thereof, the function and utility of which host target genes is known in the art.

VGAM2344 is a novel bioinformatically detected regulatory, non protein coding, viral micro RNA (miRNA) gene. The method by which VGAM2344 was detected is described hereinabove with reference to FIGS. 1-8.

VGAM2344 gene, herein designated VGAM GENE, is a viral gene contained in the genome of Equine Herpesvirus 2. VGAM2344 host target gene, herein designated VGAM HOST TARGET GENE, is a human gene contained in the human genome.

VGAM2344 gene encodes a VGAM2344 precursor RNA, herein designated VGAM PRECURSOR RNA. Similar to other miRNA genes, and unlike most ordinary genes, VGAM2344 precursor RNA does not encode a protein. A nucleotide sequence identical or highly similar to the nucleotide sequence of VGAM2344 precursor RNA is designated SEQ ID:2330, and is provided hereinbelow with reference to the sequence listing part. Nucleotide sequence SEQ ID:2330 is located at position 38540 relative to the genome of Equine Herpesvirus 2.

VGAM2344 precursor RNA folds onto itself, forming VGAM2344 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2344 folded precursor RNA into VGAM2344 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 92%) nucleotide sequence of VGAM2344 RNA is designated SEQ ID:5055, and is provided hereinbelow with reference to the sequence listing part.

VGAM2344 host target gene, herein designated VGAM HOST TARGET GENE, encodes a corresponding messenger RNA, VGAM2344 host target RNA, herein designated VGAM HOST TARGET RNA. VGAM2344 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2344 RNA, herein designated VGAM RNA, binds complementarily to one or more host target binding sites located in untranslated regions of VGAM2344 host target RNA, herein designated VGAM HOST TARGET RNA. This complementary binding is due to the fact that the nucleotide sequence of VGAM2344 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2344 RNA, herein designated VGAM RNA, may have a different number of host target binding sites in untranslated regions of a VGAM2344 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2344 RNA, herein designated VGAM RNA, to host target binding sites on VGAM2344 host target RNA, herein designated VGAM HOST TARGET RNA, such as BINDING SITE I, BINDING SITE II and BINDING SITE III, inhibits translation of VGAM2344 host target RNA into VGAM2344 host target protein, herein designated VGAM HOST TARGET PROTEIN. VGAM host target protein is therefore outlined by a broken line.

It is appreciated that VGAM2344 host target gene, herein designated VGAM HOST TARGET GENE, in fact represents a plurality of VGAM2344 host target genes. The mRNA of each one of this plurality of VGAM2344 host target genes comprises one or more host target binding sites, each having a nucleotide sequence which is at least partly complementary to VGAM2344 RNA, herein designated VGAM RNA, and which when bound by VGAM2344 RNA causes inhibition of translation of respective one or more VGAM2344 host target proteins.

It is further appreciated by one skilled in the art that the mode of translational inhibition illustrated by FIG. 1 with specific reference to translational inhibition exerted by VGAM2344 gene, herein designated VGAM GENE, on one or more VGAM2344 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2344 is inhibition of expression of host target genes, as part of a novel viral mechanism of attacking a host. Accordingly, utilities of VGAM2344 include diagnosis, prevention and treatment of viral infection by Equine Herpesvirus 2. Specific functions, and accordingly utilities, of VGAM2344 correlate with, and may be deduced from, the identity of the host target genes which VGAM2344 binds and inhibits, and the function of these host target genes, as elaborated hereinbelow.

Nucleotide sequences of the VGAM2344 precursor RNA, herein designated VGAM PRECURSOR RNA, and of the 'diced' VGAM2344 RNA, herein designated VGAM RNA, and a schematic representation of the secondary folding of VGAM2344 folded precursor RNA, herein designated VGAM FOLDED PRECURSOR RNA, of VGAM2344 are further described hereinbelow with reference to Table 1.

Nucleotide sequences of host target binding sites, such as BINDING SITE-I, BINDING SITE-II and BINDING SITE-III of FIG. 1, found on VGAM2344 host target RNA, and schematic representation of the complementarity of each of these host target binding sites to VGAM2344 RNA, herein designated VGAM RNA, are described hereinbelow with reference to Table 2.

As mentioned hereinabove with reference to FIG. 1, a function of VGAM2344 gene, herein designated VGAM is inhibition of expression of VGAM2344 target genes. It is appreciated that specific functions, and accordingly utilities, of VGAM2344 correlate with, and may be deduced from, the identity of the target genes which VGAM2344 binds and inhibits, and the function of these target genes, as elaborated hereinbelow.

Dual Adaptor of Phosphotyrosine and 3-phosphoinositides (DAPP1, Accession NM_014395) is a VGAM2344 host target gene. DAPP1 BINDING SITE is HOST TARGET binding site found in the 3' untranslated region of mRNA encoded by DAPP1, corresponding to a HOST TARGET binding site such as BINDING SITE I, BINDING SITE II or BINDING SITE III. Table 2 illustrates the complementarity of the nucleotide sequences of DAPP1 BINDING SITE, designated SEQ ID:15730, to the nucleotide sequence of VGAM2344 RNA, herein designated VGAM RNA, also designated SEQ ID:5055.

A function of VGAM2344 is therefore inhibition of Dual Adaptor of Phosphotyrosine and 3-phosphoinositides (DAPP1, Accession NM_014395), a gene which regulates the ras-cyclic amp pathway. Accordingly, utilities of VGAM2344 include diagnosis, prevention and treatment of diseases and clinical conditions associated with DAPP1. The function of DAPP1 and its association with various diseases and clinical conditions, has been established by previous studies, as described hereinabove with reference to VGAM283. FLJ23189 (Accession NM_025057) is another VGAM2344 host target gene. FLJ23189 BINDING SITE is HOST TARGET binding site found in the 3' untranslated region of mRNA encoded by FLJ23189, corresponding to a HOST TARGET binding site such as BINDING SITE I, BINDING SITE II or BINDING SITE III. Table 2 illustrates the complementarity of the nucleotide sequences of FLJ23189 BINDING SITE, designated SEQ ID:24657, to the nucleotide sequence of VGAM2344 RNA, herein designated VGAM RNA, also designated SEQ ID:5055.

Another function of VGAM2344 is therefore inhibition of FLJ23189 (Accession NM_025057). Accordingly, utilities of VGAM2344 include diagnosis, prevention and treatment of diseases and clinical conditions associated with FLJ23189. KIAA0063 (Accession NM_014876) is another VGAM2344 host target gene. KIAA0063 BINDING SITE is HOST TARGET binding site found in the 3' untranslated region of mRNA encoded by KIAA0063, corresponding to a HOST TARGET binding site such as BINDING SITE I, BINDING SITE II or BINDING SITE III. Table 2 illustrates the complementarity of the nucleotide sequences of KIAA0063 BINDING SITE, designated SEQ ID:17017, to the nucleotide sequence of VGAM2344 RNA, herein designated VGAM RNA, also designated SEQ ID:5055.

Another function of VGAM2344 is therefore inhibition of KIAA0063 (Accession NM_014876). Accordingly, utilities of VGAM2344 include diagnosis, prevention and treatment of diseases and clinical conditions associated with KIAA0063. KIAA0802 (Accession XM_031357) is another VGAM2344 host target gene. KIAA0802 BINDING SITE is HOST TARGET binding site found in the 5' untranslated region of mRNA encoded by KIAA0802, corresponding to a HOST TARGET binding site such as BINDING SITE I, BINDING SITE II or BINDING SITE III. Table 2 illustrates the complementarity of the nucleotide sequences of KIAA0802 BINDING SITE, designated SEQ ID:31351, to the nucleotide sequence of VGAM2344 RNA, herein designated VGAM RNA, also designated SEQ ID:5055.

Another function of VGAM2344 is therefore inhibition of KIAA0802 (Accession XM_031357). Accordingly, utilities of VGAM2344 include diagnosis, prevention and treatment of diseases and clinical conditions associated with KIAA0802. KIAA1560 (Accession XM_034422) is another VGAM2344 host target gene. KIAA1560 BINDING SITE is HOST TARGET binding site found in the 3' untranslated region of mRNA encoded by KIAA1560, corresponding to a HOST TARGET binding site such as BINDING SITE I, BINDING SITE II or BINDING SITE III. Table 2 illustrates the complementarity of the nucleotide sequences of KIAA1560 BINDING SITE, designated SEQ ID:32101, to the nucleotide sequence of VGAM2344 RNA, herein designated VGAM RNA, also designated SEQ ID:5055.

Another function of VGAM2344 is therefore inhibition of KIAA1560 (Accession XM_034422). Accordingly, utilities of VGAM2344 include diagnosis, prevention and treatment of diseases and clinical conditions associated with KIAA1560. Solute Carrier Family 25 (mitochondrial oxodicarboxylate carrier), Member 21 (SLC25A21, Accession NM_030631) is another VGAM2344 host target gene. SLC25A21 BINDING SITE is HOST TARGET binding site found in the 3' untranslated region of mRNA encoded by SLC25A21, corresponding to a HOST TARGET binding site such as BINDING SITE I, BINDING SITE II or BINDING SITE III. Table 2 illustrates the complementarity of the nucleotide sequences of SLC25A21 BINDING SITE, designated SEQ ID:24967, to the nucleotide sequence of VGAM2344 RNA, herein designated VGAM RNA, also designated SEQ ID:5055.

Another function of VGAM2344 is therefore inhibition of Solute Carrier Family 25 (mitochondrial oxodicarboxylate carrier), Member 21 (SLC25A21, Accession NM_030631). Accordingly, utilities of VGAM2344 include diagnosis, prevention and treatment of diseases and clinical conditions associated with SLC25A21. FIG. 1 further provides a conceptual description of a novel bioinformatically detected viral gene of the present invention, referred to here as Viral Genomic Address Messenger 2345 (VGAM2345) viral gene, which modulates expression of respective host target genes thereof, the function and utility of which host target genes is known in the art.

VGAM2345 is a novel bioinformatically detected regulatory, non protein coding, viral micro RNA (miRNA) gene. The method by which VGAM2345 was detected is described hereinabove with reference to FIGS. 1-8.

VGAM2345 gene, herein designated VGAM GENE, is a viral gene contained in the genome of Equine Herpesvirus 2. VGAM2345 host target gene, herein designated VGAM HOST TARGET GENE, is a human gene contained in the human genome.

VGAM2345 gene encodes a VGAM2345 precursor RNA, herein designated VGAM PRECURSOR RNA. Similar to other miRNA genes, and unlike most ordinary genes, VGAM2345 precursor RNA does not encode a protein. A nucleotide sequence identical or highly similar to the nucleotide sequence of VGAM2345 precursor RNA is designated SEQ ID:2331, and is provided hereinbelow with reference to the sequence listing part. Nucleotide sequence SEQ ID:2331 is located at position 41319 relative to the genome of Equine Herpesvirus 2.

VGAM2345 precursor RNA folds onto itself, forming VGAM2345 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2345 folded precursor RNA into VGAM2345 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2345 RNA is designated SEQ ID:5056, and is provided hereinbelow with reference to the sequence listing part.

VGAM2345 host target gene, herein designated VGAM HOST TARGET GENE, encodes a corresponding messenger RNA, VGAM2345 host target RNA, herein designated VGAM HOST TARGET RNA. VGAM2345 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2345 RNA, herein designated VGAM RNA, binds complementarily to one or more host target binding sites located in untranslated regions of VGAM2345 host target RNA, herein designated VGAM HOST TARGET RNA. This complementary binding is due to the fact that the nucleotide sequence of VGAM2345 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2345 RNA, herein designated VGAM RNA, may have a different number of host target binding sites in untranslated regions of a VGAM2345 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2345 RNA, herein designated VGAM RNA, to host target binding sites on VGAM2345 host target RNA, herein designated VGAM HOST TARGET RNA, such as BINDING SITE I, BINDING SITE II and BINDING SITE III, inhibits translation of VGAM2345 host target RNA into VGAM2345 host target protein, herein designated VGAM HOST TARGET PROTEIN. VGAM host target protein is therefore outlined by a broken line.

It is appreciated that VGAM2345 host target gene, herein designated VGAM HOST TARGET GENE, in fact represents a plurality of VGAM2345 host target genes. The mRNA of each one of this plurality of VGAM2345 host target genes comprises one or more host target binding sites, each having a nucleotide sequence which is at least partly complementary to VGAM2345 RNA, herein designated VGAM RNA, and which when bound by VGAM2345 RNA causes inhibition of translation of respective one or more VGAM2345 host target proteins.

It is further appreciated by one skilled in the art that the mode of translational inhibition illustrated by FIG. 1 with specific reference to translational inhibition exerted by VGAM2345 gene, herein designated VGAM GENE, on one or more VGAM2345 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2345 is inhibition of expression of host target genes, as part of a novel viral mechanism of attacking a host. Accordingly, utilities of VGAM2345 include diagnosis, prevention and treatment of viral infection by Equine Herpesvirus 2. Specific functions, and accordingly utilities, of VGAM2345 correlate with, and may be deduced from, the identity of the host target genes which VGAM2345 binds and inhibits, and the function of these host target genes, as elaborated hereinbelow.

Nucleotide sequences of the VGAM2345 precursor RNA, herein designated VGAM PRECURSOR RNA, and of the 'diced' VGAM2345 RNA, herein designated VGAM RNA, and a schematic representation of the secondary folding of VGAM2345 folded precursor RNA, herein designated VGAM FOLDED PRECURSOR RNA, of VGAM2345 are further described hereinbelow with reference to Table 1.

Nucleotide sequences of host target binding sites, such as BINDING SITE-I, BINDING SITE-II and BINDING SITE-III of FIG. 1, found on VGAM2345 host target RNA, and schematic representation of the complementarity of each of these host target binding sites to VGAM2345 RNA, herein designated VGAM RNA, are described hereinbelow with reference to Table 2.

As mentioned hereinabove with reference to FIG. 1, a function of VGAM2345 gene, herein designated VGAM is inhibition of expression of VGAM2345 target genes. It is appreciated that specific functions, and accordingly utilities, of VGAM2345 correlate with, and may be deduced from, the identity of the target genes which VGAM2345 binds and inhibits, and the function of these target genes, as elaborated hereinbelow.

Ets Variant Gene 3 (ETV3, Accession NM_005240) is a VGAM2345 host target gene. ETV3 BINDING SITE is HOST TARGET binding site found in the 3' untranslated region of mRNA encoded by ETV3, corresponding to a HOST TARGET binding site such as BINDING SITE I, BINDING SITE II or BINDING SITE III. Table 2 illustrates the complementarity of the nucleotide sequences of ETV3 BINDING SITE, designated SEQ ID:11750, to the nucleotide sequence of VGAM2345 RNA, herein designated VGAM RNA, also designated SEQ ID:5056.

A function of VGAM2345 is therefore inhibition of Ets Variant Gene 3 (ETV3, Accession NM_005240), a gene which Member of the ETS oncoprotein family. Accordingly, utilities of VGAM2345 include diagnosis, prevention and treatment of diseases and clinical conditions associated with ETV3. The function of ETV3 and its association with various diseases and clinical conditions, has been established by previous studies, as described hereinabove with reference to VGAM791. Nuclear Receptor Subfamily 5, Group A, Member 2 (NR5A2, Accession NM_003822) is another VGAM2345 host target gene. NR5A2 BINDING SITE is HOST TARGET binding site found in the 3' untranslated region of mRNA encoded by NR5A2, corresponding to a HOST TARGET binding site such as BINDING SITE I, BINDING SITE II or BINDING SITE III. Table 2 illustrates the complementarity of the nucleotide sequences of NR5A2 BINDING SITE, designated SEQ ID:9912, to the nucleotide sequence of VGAM2345 RNA, herein designated VGAM RNA, also designated SEQ ID:5056.

Another function of VGAM2345 is therefore inhibition of Nuclear Receptor Subfamily 5, Group A, Member 2 (NR5A2, Accession NM_003822), a gene which is a member of nuclear receptor superfamily of trancriptional activators and activates the hepatitis B virus (HBV) promoter. Accordingly, utilities of VGAM2345 include diagnosis, prevention and treatment of diseases and clinical conditions associated with NR5A2. The function of NR5A2 and its association with various diseases and clinical conditions, has been established by previous studies, as described hereinabove with reference to VGAM375. Uncoupling Protein 3 (mitochondrial, proton carrier) (UCP3, Accession NM_003356) is another VGAM2345 host target gene. UCP3 BINDING SITE is HOST TARGET binding site found in the 3' untranslated region of mRNA encoded by UCP3, corresponding to a HOST TARGET binding site such as BINDING SITE I, BINDING SITE II or BINDING SITE III. Table 2 illustrates the complementarity of the nucleotide sequences of UCP3 BINDING SITE, designated SEQ ID:9383, to the nucleotide sequence of VGAM2345 RNA, herein designated VGAM RNA, also designated SEQ ID:5056.

Another function of VGAM2345 is therefore inhibition of Uncoupling Protein 3 (mitochondrial, proton carrier) (UCP3, Accession NM_003356), a gene which is a mitochondrial transporter protein that creates proton leaks across the inner mitochondrial membrane, thus uncoupling oxidative phosphorylation. Accordingly, utilities of VGAM2345 include diagnosis, prevention and treatment of diseases and clinical conditions associated with UCP3. The function of UCP3 and its association with various diseases and clinical conditions, has been established by previous studies, as described hereinabove with reference to VGAM1317. DKFZp762K2015 (Accession XM_051791) is another VGAM2345 host target gene. DKFZp762K2015 BINDING SITE is HOST TARGET binding site found in the 3' untranslated region of mRNA encoded by DKFZp762K2015, corresponding to a HOST TARGET binding site such as BINDING SITE I, BINDING SITE II or BINDING SITE III. Table 2 illustrates the complementarity of the nucleotide sequences of DKFZp762K2015 BINDING SITE, designated SEQ ID:35884, to the nucleotide sequence of VGAM2345 RNA, herein designated VGAM RNA, also designated SEQ ID:5056.

Another function of VGAM2345 is therefore inhibition of DKFZp762K2015 (Accession XM_051791). Accordingly, utilities of VGAM2345 include diagnosis, prevention and treatment of diseases and clinical conditions associated with DKFZp762K2015. FLJ13340 (Accession NM_057175) is another VGAM2345 host target gene. FLJ13340 BINDING SITE is HOST TARGET binding site found in the 3' untranslated region of mRNA encoded by FLJ13340, corresponding to a HOST TARGET binding site such as BINDING SITE I, BINDING SITE II or BINDING SITE III. Table 2 illustrates the complementarity of the nucleotide sequences of FLJ13340 BINDING SITE, designated SEQ ID:27703, to the nucleotide sequence of VGAM2345 RNA, herein designated VGAM RNA, also designated SEQ ID:5056.

Another function of VGAM2345 is therefore inhibition of FLJ13340 (Accession NM_057175). Accordingly, utilities of VGAM2345 include diagnosis, prevention and treatment of diseases and clinical conditions associated with FLJ13340. HTEX4 (Accession XM_166378) is another VGAM2345 host target gene. HTEX4 BINDING SITE1 through HTEX4 BINDING SITE3 are HOST TARGET binding sites found in untranslated regions of mRNA encoded by HTEX4, corresponding to HOST TARGET binding sites such as BINDING SITE I, BINDING SITE II or BINDING SITE III. Table 2 illustrates the complementarity of the nucleotide sequences of HTEX4 BINDING SITE1 through HTEX4 BINDING SITE3, designated SEQ ID:44215, SEQ ID:46651 and SEQ ID:46720 respectively, to the nucleotide sequence of VGAM2345 RNA, herein designated VGAM RNA, also designated SEQ ID:5056.

Another function of VGAM2345 is therefore inhibition of HTEX4 (Accession XM_166378). Accordingly, utilities of VGAM2345 include diagnosis, prevention and treatment of diseases and clinical conditions associated with HTEX4. TBDN100 (Accession NM_025085) is another VGAM2345 host target gene. TBDN100 BINDING SITE is HOST TARGET binding site found in the 3' untranslated region of mRNA encoded by TBDN100, corresponding to a HOST TARGET binding site such as BINDING SITE I, BINDING SITE II or BINDING SITE III. Table 2 illustrates the complementarity of the nucleotide sequences of TBDN100 BINDING SITE, designated SEQ ID:24692, to the nucleotide sequence of VGAM2345 RNA, herein designated VGAM RNA, also designated SEQ ID:5056.

Another function of VGAM2345 is therefore inhibition of TBDN100 (Accession NM_025085). Accordingly, utilities of VGAM2345 include diagnosis, prevention and treatment of diseases and clinical conditions associated with TBDN100. TU3A (Accession NM_007177) is another VGAM2345 host target gene. TU3A BINDING SITE is HOST TARGET binding site found in the 3' untranslated region of mRNA encoded by TU3A, corresponding to a HOST TARGET binding site such as BINDING SITE I, BINDING SITE II or BINDING SITE III. Table 2 illustrates the complementarity of the nucleotide sequences of TU3A BINDING SITE, designated SEQ ID:14031, to the nucleotide sequence of VGAM2345 RNA, herein designated VGAM RNA, also designated SEQ ID:5056.

Another function of VGAM2345 is therefore inhibition of TU3A (Accession NM_007177). Accordingly, utilities of VGAM2345 include diagnosis, prevention and treatment of diseases and clinical conditions associated with TU3A. ZNF-U69274 (Accession NM_014415) is another VGAM2345 host target gene. ZNF-U69274 BINDING SITE is HOST TARGET binding site found in the 3' untranslated region of mRNA encoded by ZNF-U69274, corresponding to a HOST TARGET binding site such as BINDING SITE I, BINDING SITE II or BINDING SITE III. Table 2 illustrates the complementarity of the nucleotide sequences of ZNF-U69274 BINDING SITE, designated SEQ ID:15761, to the nucleotide sequence of VGAM2345 RNA, herein designated VGAM RNA, also designated SEQ ID:5056.

Another function of VGAM2345 is therefore inhibition of ZNF-U69274 (Accession NM_014415). Accordingly, utilities of VGAM2345 include diagnosis, prevention and treatment of diseases and clinical conditions associated with ZNF-U69274. LOC201627 (Accession XM_114353) is another VGAM2345 host target gene. LOC201627 BINDING SITE is HOST TARGET binding site found in the 3' untranslated region of mRNA encoded by LOC201627, corresponding to a HOST TARGET binding site such as BINDING SITE I, BINDING SITE II or BINDING SITE III. Table 2 illustrates the complementarity of the nucleotide sequences of LOC201627 BINDING SITE, designated SEQ ID:42893, to the nucleotide sequence of VGAM2345 RNA, herein designated VGAM RNA, also designated SEQ ID:5056.

Another function of VGAM2345 is therefore inhibition of LOC201627 (Accession XM_114353). Accordingly, utilities of VGAM2345 include diagnosis, prevention and treatment of diseases and clinical conditions associated with LOC201627. LOC255777 (Accession XM_171342) is another VGAM2345 host target gene. LOC255777 BINDING SITE is HOST TARGET binding site found in the 5' untranslated region of mRNA encoded by LOC255777, corresponding to a HOST TARGET binding site such as BINDING SITE I, BINDING SITE II or BINDING SITE III. Table 2 illustrates the complementarity of the nucleotide sequences of LOC255777 BINDING SITE, designated SEQ ID:46041, to the nucleotide sequence of VGAM2345 RNA, herein designated VGAM RNA, also designated SEQ ID:5056.

Another function of VGAM2345 is therefore inhibition of LOC255777 (Accession XM_171342). Accordingly, utilities of VGAM2345 include diagnosis, prevention and treatment of diseases and clinical conditions associated with LOC255777. FIG. 1 further provides a conceptual description of a novel bioinformatically detected viral gene of the present invention, referred to here as Viral Genomic Address Messenger 2346 (VGAM2346) viral gene, which modulates expression of respective host target genes thereof, the function and utility of which host target genes is known in the art.

VGAM2346 is a novel bioinformatically detected regulatory, non protein coding, viral micro RNA (miRNA) gene. The method by which VGAM2346 was detected is described hereinabove with reference to FIGS. 1-8.

VGAM2346 gene, herein designated VGAM GENE, is a viral gene contained in the genome of Equine Herpesvirus 2. VGAM2346 host target gene, herein designated VGAM HOST TARGET GENE, is a human gene contained in the human genome.

VGAM2346 gene encodes a VGAM2346 precursor RNA, herein designated VGAM PRECURSOR RNA. Similar to other miRNA genes, and unlike most ordinary genes, VGAM2346 precursor RNA does not encode a protein. A nucleotide sequence identical or highly similar to the nucleotide sequence of VGAM2346 precursor RNA is designated SEQ ID:2332, and is provided hereinbelow with reference to the sequence listing part. Nucleotide sequence SEQ ID:2332 is located at position 38013 relative to the genome of Equine Herpesvirus 2.

VGAM2346 precursor RNA folds onto itself, forming VGAM2346 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2346 folded precursor RNA into VGAM2346 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2346 RNA is designated SEQ ID:5057, and is provided hereinbelow with reference to the sequence listing part.

VGAM2346 host target gene, herein designated VGAM HOST TARGET GENE, encodes a corresponding messenger RNA, VGAM2346 host target RNA, herein designated VGAM HOST TARGET RNA. VGAM2346 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2346 RNA, herein designated VGAM RNA, binds complementarily to one or more host target binding sites located in untranslated regions of VGAM2346 host target RNA, herein designated VGAM HOST TARGET RNA. This complementary binding is due to the fact that the nucleotide sequence of VGAM2346 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2346 RNA, herein designated VGAM RNA, may have a different number of host target binding sites in untranslated regions of a VGAM2346 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2346 RNA, herein designated VGAM RNA, to host target binding sites on VGAM2346 host target RNA, herein designated VGAM HOST TARGET RNA, such as BINDING SITE I, BINDING SITE II and BINDING SITE III, inhibits translation of VGAM2346 host target RNA into VGAM2346 host target protein, herein designated VGAM HOST TARGET PROTEIN. VGAM host target protein is therefore outlined by a broken line.

It is appreciated that VGAM2346 host target gene, herein designated VGAM HOST TARGET GENE, in fact represents a plurality of VGAM2346 host target genes. The mRNA of each one of this plurality of VGAM2346 host target genes comprises one or more host target binding sites, each having a nucleotide sequence which is at least partly complementary to VGAM2346 RNA, herein designated VGAM RNA, and which when bound by VGAM2346 RNA causes inhibition of translation of respective one or more VGAM2346 host target proteins.

It is further appreciated by one skilled in the art that the mode of translational inhibition illustrated by FIG. 1 with specific reference to translational inhibition exerted by VGAM2346 gene, herein designated VGAM GENE, on one or more VGAM2346 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2346 is inhibition of expression of host target genes, as part of a novel viral mechanism of attacking a host. Accordingly, utilities of VGAM2346 include diagnosis, prevention and treatment of viral infection by Equine Herpesvirus 2. Specific functions, and accordingly utilities, of VGAM2346 correlate with, and may be deduced from, the identity of the host target genes which VGAM2346 binds and inhibits, and the function of these host target genes, as elaborated hereinbelow.

Nucleotide sequences of the VGAM2346 precursor RNA, herein designated VGAM PRECURSOR RNA, and of the 'diced' VGAM2346 RNA, herein designated VGAM RNA, and a schematic representation of the secondary folding of VGAM2346 folded precursor RNA, herein designated VGAM FOLDED PRECURSOR RNA, of VGAM2346 are further described hereinbelow with reference to Table 1.

Nucleotide sequences of host target binding sites, such as BINDING SITE-I, BINDING SITE-II and BINDING SITE-III of FIG. 1, found on VGAM2346 host target RNA, and schematic representation of the complementarity of each of these host target binding sites to VGAM2346 RNA, herein designated VGAM RNA, are described hereinbelow with reference to Table 2.

As mentioned hereinabove with reference to FIG. 1, a function of VGAM2346 gene, herein designated VGAM is inhibition of expression of VGAM2346 target genes. It is appreciated that specific functions, and accordingly utilities, of VGAM2346 correlate with, and may be deduced from, the identity of the target genes which VGAM2346 binds and inhibits, and the function of these target genes, as elaborated hereinbelow.

Aquaporin 6, Kidney Specific (AQP6, Accession NM_053286) is a VGAM2346 host target gene. AQP6 BINDING SITE is HOST TARGET binding site found in the 5' untranslated region of mRNA encoded by AQP6, corresponding to a HOST TARGET binding site such as BINDING SITE I, BINDING SITE II or BINDING SITE III. Table 2 illustrates the complementarity of the nucleotide sequences of AQP6 BINDING SITE, designated SEQ ID:27616, to the nucleotide sequence of VGAM2346 RNA, herein designated VGAM RNA, also designated SEQ ID:5057.

A function of VGAM2346 is therefore inhibition of Aquaporin 6, Kidney Specific (AQP6, Accession NM_053286), a gene which participates in distinct physiologic function such as glomerular filtration, tubular endocytosis, and acid-base metabolism. Accordingly, utilities of VGAM2346 include diagnosis, prevention and treatment of diseases and clinical conditions associated with AQP6. The function of AQP6 and its association with various diseases and clinical conditions, has been established by previous studies, as described hereinabove with reference to VGAM340. Rho GTPase Activating Protein 6 (ARHGAP6, Accession NM_001174) is another VGAM2346 host target gene. ARHGAP6 BINDING SITE is HOST TARGET binding site found in the 3' untranslated region of mRNA encoded by ARHGAP6, corresponding to a HOST TARGET binding site such as BINDING SITE I, BINDING SITE II or BINDING SITE III. Table 2 illustrates the complementarity of the nucleotide sequences of ARHGAP6 BINDING SITE, designated SEQ ID:6846, to the nucleotide sequence of VGAM2346 RNA, herein designated VGAM RNA, also designated SEQ ID:5057.

Another function of VGAM2346 is therefore inhibition of Rho GTPase Activating Protein 6 (ARHGAP6, Accession NM_001174), a gene which activates the rho-type GTPases by converting them to an inactive GTP-bound state. Accordingly, utilities of VGAM2346 include diagnosis, prevention and treatment of diseases and clinical conditions associated with ARHGAP6. The function of ARHGAP6 and its association with various diseases and clinical conditions, has been established by previous studies, as described hereinabove with reference to VGAM55. Chitinase 3-like 1 (cartilage glycoprotein-39) (CHI3L1, Accession NM_001276) is another VGAM2346 host target gene. CHI3L1 BINDING SITE is HOST TARGET binding site found in the 3' untranslated region of mRNA encoded by CHI3L1, corresponding to a HOST TARGET binding site such as BINDING SITE I, BINDING SITE II or BINDING SITE III. Table 2 illustrates the complementarity of the nucleotide sequences of CHI3L1

BINDING SITE, designated SEQ ID:6942, to the nucleotide sequence of VGAM2346 RNA, herein designated VGAM RNA, also designated SEQ ID:5057.

Another function of VGAM2346 is therefore inhibition of Chitinase 3-like 1 (cartilage glycoprotein-39) (CHI3L1, Accession NM_001276), a gene which participates in the capacity of cells to respond to and cope with changes. Accordingly, utilities of VGAM2346 include diagnosis, prevention and treatment of diseases and clinical conditions associated with CHI3L1. The function of CHI3L1 and its association with various diseases and clinical conditions, has been established by previous studies, as described hereinabove with reference to VGAM1727. Collagen, Type VI, Alpha 3 (COL6A3, Accession NM_057167) is another VGAM2346 host target gene. COL6A3 BINDING SITE1 and COL6A3 BINDING SITE2 are HOST TARGET binding sites found in untranslated regions of mRNA encoded by COL6A3, corresponding to HOST TARGET binding sites such as BINDING SITE I, BINDING SITE II or BINDING SITE III. Table 2 illustrates the complementarity of the nucleotide sequences of COL6A3 BINDING SITE1 and COL6A3 BINDING SITE2, designated SEQ ID:27671 and SEQ ID:10587 respectively, to the nucleotide sequence of VGAM2346 RNA, herein designated VGAM RNA, also designated SEQ ID:5057.

Another function of VGAM2346 is therefore inhibition of Collagen, Type VI, Alpha 3 (COL6A3, Accession NM_057167). Accordingly, utilities of VGAM2346 include diagnosis, prevention and treatment of diseases and clinical conditions associated with COL6A3. DEAD/H (Asp-Glu-Ala-Asp/His) Box Polypeptide 20, 103 kDa (DDX20, Accession NM_007204) is another VGAM2346 host target gene. DDX20 BINDING SITE is HOST TARGET binding site found in the 5' untranslated region of mRNA encoded by DDX20, corresponding to a HOST TARGET binding site such as BINDING SITE I, BINDING SITE II or BINDING SITE III. Table 2 illustrates the complementarity of the nucleotide sequences of DDX20 BINDING SITE, designated SEQ ID:14067, to the nucleotide sequence of VGAM2346 RNA, herein designated VGAM RNA, also designated SEQ ID:5057.

Another function of VGAM2346 is therefore inhibition of DEAD/H (Asp-Glu-Ala-Asp/His) Box Polypeptide 20, 103 kDa (DDX20, Accession NM_007204), a gene which interacts with SMN and is required for pre-mRNA splicing in the nucleus. Accordingly, utilities of VGAM2346 include diagnosis, prevention and treatment of diseases and clinical conditions associated with DDX20. The function of DDX20 and its association with various diseases and clinical conditions, has been established by previous studies, as described hereinabove with reference to VGAM1929. Dishevelled, Dsh Homolog 1 (Drosophila) (DVL1, Accession XM_001589) is another VGAM2346 host target gene. DVL1 BINDING SITE is HOST TARGET binding site found in the 3' untranslated region of mRNA encoded by DVL1, corresponding to a HOST TARGET binding site such as BINDING SITE I, BINDING SITE II or BINDING SITE III. Table 2 illustrates the complementarity of the nucleotide sequences of DVL1 BINDING SITE, designated SEQ ID:29843, to the nucleotide sequence of VGAM2346 RNA, herein designated VGAM RNA, also designated SEQ ID:5057.

Another function of VGAM2346 is therefore inhibition of Dishevelled, Dsh Homolog 1 (Drosophila) (DVL1, Accession XM_001589), a gene which may play a role in the signal transduction pathway. Accordingly, utilities of VGAM2346 include diagnosis, prevention and treatment of diseases and clinical conditions associated with DVL1. The function of DVL1 and its association with various diseases and clinical conditions, has been established by previous studies, as described hereinabove with reference to VGAM232. Gamma-glutamyltransferase 2 (GGT2, Accession XM_057166) is another VGAM2346 host target gene. GGT2 BINDING SITE is HOST TARGET binding site found in the 5' untranslated region of mRNA encoded by GGT2, corresponding to a HOST TARGET binding site such as BINDING SITE I, BINDING SITE II or BINDING SITE III. Table 2 illustrates the complementarity of the nucleotide sequences of GGT2 BINDING SITE, designated SEQ ID:36490, to the nucleotide sequence of VGAM2346 RNA, herein designated VGAM RNA, also designated SEQ ID:5057.

Another function of VGAM2346 is therefore inhibition of Gamma-glutamyltransferase 2 (GGT2, Accession XM_057166). Accordingly, utilities of VGAM2346 include diagnosis, prevention and treatment of diseases and clinical conditions associated with GGT2. Mannosyl (alpha-1,3-)-glycoprotein Beta-1,2-N-acetylglucosaminyltransferase (MGAT1, Accession NM_002406) is another VGAM2346 host target gene. MGAT1 BINDING SITE is HOST TARGET binding site found in the 5' untranslated region of mRNA encoded by MGAT1, corresponding to a HOST TARGET binding site such as BINDING SITE I, BINDING SITE II or BINDING SITE III. Table 2 illustrates the complementarity of the nucleotide sequences of MGAT1 BINDING SITE, designated SEQ ID:8227, to the nucleotide sequence of VGAM2346 RNA, herein designated VGAM RNA, also designated SEQ ID:5057.

Another function of VGAM2346 is therefore inhibition of Mannosyl (alpha-1,3-)-glycoprotein Beta-1,2-N-acetylglucosaminyltransferase (MGAT1, Accession NM_002406), a gene which exists as a single protein-encoding exon. Accordingly, utilities of VGAM2346 include diagnosis, prevention and treatment of diseases and clinical conditions associated with MGAT1. The function of MGAT1 and its association with various diseases and clinical conditions, has been established by previous studies, as described hereinabove with reference to VGAM165. Nuclear Receptor Co-repressor 2 (NCOR2, Accession NM_006312) is another VGAM2346 host target gene. NCOR2 BINDING SITE is HOST TARGET binding site found in the 3' untranslated region of mRNA encoded by NCOR2, corresponding to a HOST TARGET binding site such as BINDING SITE I, BINDING SITE II or BINDING SITE III. Table 2 illustrates the complementarity of the nucleotide sequences of NCOR2 BINDING SITE, designated SEQ ID:13004, to the nucleotide sequence of VGAM2346 RNA, herein designated VGAM RNA, also designated SEQ ID:5057.

Another function of VGAM2346 is therefore inhibition of Nuclear Receptor Co-repressor 2 (NCOR2, Accession NM_006312), a gene which mediates the transcriptional repression activity of some nuclear receptors by promoting chromatin condensation, thus preventing access of the basal transcription. Accordingly, utilities of VGAM2346 include diagnosis, prevention and treatment of diseases and clinical conditions associated with NCOR2. The function of NCOR2 has been established by previous studies. Fischle et al. (2002) showed that the catalytic domain of HDAC4 (OMIM Ref. No. 605314) interacts with HDAC3 (OMIM Ref. No. 605166) via the transcriptional corepressor NCOR2. All experimental conditions leading to the suppression of HDAC4 binding to NCOR2 and to HDAC3 resulted in loss of enzymatic activity associated with HDAC4. These observations indicated that class II HDACs regulate transcription by bridging the enzymatically active NCOR2-HDAC3 complex and select transcription factors.

Full details of the abovementioned studies are described in the following publications, the disclosure of which are hereby incorporated by reference:

Fischle, W.; Dequiedt, F.; Hendzel, M. J.; Guenther, M. G.; Lazar, M. A.; Voelter, W.; Verdin, E.: Enzymatic activity associated with class II HDACs is dependent on a multiprotein complex containing HDAC3 and SMRT/N-CoR. Molec. Cell 9:45-57, 2002; and Horlein, A. J.; Naar, A. M.; Heinzel, T.; Torchia, J.; Gloss, B.; Kurokawa, R.; Ryan, A.; Kamel, Y.; Soderstrom, M.; Glass, C. K.; Rosenfeld, M. G.: Ligand-independent repression by t.

Further studies establishing the function and utilities of NCOR2 are found in John Hopkins OMIM database record ID 600848, and in sited publications numbered 9945-9950 listed in the bibliography section hereinbelow, which are also hereby incorporated by reference. Phosphomannomutase 2 (PMM2, Accession XM_050755) is another VGAM2346 host target gene. PMM2 BINDING SITE is HOST TARGET binding site found in the 3' untranslated region of mRNA encoded by PMM2, corresponding to a HOST TARGET binding site such as BINDING SITE I, BINDING SITE II or BINDING SITE III. Table 2 illustrates the complementarity of the nucleotide sequences of PMM2 BINDING SITE, designated SEQ ID:35681, to the nucleotide sequence of VGAM2346 RNA, herein designated VGAM RNA, also designated SEQ ID:5057.

Another function of VGAM2346 is therefore inhibition of Phosphomannomutase 2 (PMM2, Accession XM_050755). Accordingly, utilities of VGAM2346 include diagnosis, prevention and treatment of diseases and clinical conditions associated with PMM2. Protein Phosphatase 1, Regulatory (inhibitor) Subunit 8 (PPP1R8, Accession NM_138558) is another VGAM2346 host target gene. PPP1R8 BINDING SITE1 and PPP1R8 BINDING SITE2 are HOST TARGET binding sites found in untranslated regions of mRNA encoded by PPP1R8, corresponding to HOST TARGET binding sites such as BINDING SITE I, BINDING SITE II or BINDING SITE III. Table 2 illustrates the complementarity of the nucleotide sequences of PPP1R8 BINDING SITE1 and PPP1R8 BINDING SITE2, designated SEQ ID:28854 and SEQ ID:8568 respectively, to the nucleotide sequence of VGAM2346 RNA, herein designated VGAM RNA, also designated SEQ ID:5057.

Another function of VGAM2346 is therefore inhibition of Protein Phosphatase 1, Regulatory (inhibitor) Subunit 8 (PPP1R8, Accession NM_138558), a gene which is an inhibitor subunit of the major nuclear protein phosphatase-1 (pp-1). Accordingly, utilities of VGAM2346 include diagnosis, prevention and treatment of diseases and clinical conditions associated with PPP1R8. The function of PPP1R8 and its association with various diseases and clinical conditions, has been established by previous studies, as described hereinabove with reference to VGAM101. Chromosome 20 Open Reading Frame 175 (C20orf175, Accession NM_080829) is another VGAM2346 host target gene. C20orf175 BINDING SITE is HOST TARGET binding site found in the 5' untranslated region of mRNA encoded by C20orf175, corresponding to a HOST TARGET binding site such as BINDING SITE I, BINDING SITE II or BINDING SITE III. Table 2 illustrates the complementarity of the nucleotide sequences of C20orf175 BINDING SITE, designated SEQ ID:28094, to the nucleotide sequence of VGAM2346 RNA, herein designated VGAM RNA, also designated SEQ ID:5057.

Another function of VGAM2346 is therefore inhibition of Chromosome 20 Open Reading Frame 175 (C20orf175, Accession NM_080829). Accordingly, utilities of VGAM2346 include diagnosis, prevention and treatment of diseases and clinical conditions associated with C20orf175. CUB and Sushi Multiple Domains 1 (CSMD1, Accession NM_033225) is another VGAM2346 host target gene. CSMD1 BINDING SITE1 and CSMD1 BINDING SITE2 are HOST TARGET binding sites found in untranslated regions of mRNA encoded by CSMD1, corresponding to HOST TARGET binding sites such as BINDING SITE I, BINDING SITE II or BINDING SITE III. Table 2 illustrates the complementarity of the nucleotide sequences of CSMD1 BINDING SITE1 and CSMD1 BINDING SITE2, designated SEQ ID:27069 and SEQ ID:36187 respectively, to the nucleotide sequence of VGAM2346 RNA, herein designated VGAM RNA, also designated SEQ ID:5057.

Another function of VGAM2346 is therefore inhibition of CUB and Sushi Multiple Domains 1 (CSMD1, Accession NM_033225). Accordingly, utilities of VGAM2346 include diagnosis, prevention and treatment of diseases and clinical conditions associated with CSMD1. DKFZP564B147 (Accession XM_088745) is another VGAM2346 host target gene. DKFZP564B147 BINDING SITE is HOST TARGET binding site found in the 5' untranslated region of mRNA encoded by DKFZP564B147, corresponding to a HOST TARGET binding site such as BINDING SITE I, BINDING SITE II or BINDING SITE III. Table 2 illustrates the complementarity of the nucleotide sequences of DKFZP564B147 BINDING SITE, designated SEQ ID:39935, to the nucleotide sequence of VGAM2346 RNA, herein designated VGAM RNA, also designated SEQ ID:5057.

Another function of VGAM2346 is therefore inhibition of DKFZP564B147 (Accession XM_088745). Accordingly, utilities of VGAM2346 include diagnosis, prevention and treatment of diseases and clinical conditions associated with DKFZP564B147. Dedicator of Cyto-kinesis 3 (DOCK3, Accession XM_039259) is another VGAM2346 host target gene. DOCK3 BINDING SITE is HOST TARGET binding site found in the 3' untranslated region of mRNA encoded by DOCK3, corresponding to a HOST TARGET binding site such as BINDING SITE I, BINDING SITE II or BINDING SITE III. Table 2 illustrates the complementarity of the nucleotide sequences of DOCK3 BINDING SITE, designated SEQ ID:33038, to the nucleotide sequence of VGAM2346 RNA, herein designated VGAM RNA, also designated SEQ ID:5057.

Another function of VGAM2346 is therefore inhibition of Dedicator of Cyto-kinesis 3 (DOCK3, Accession XM_039259). Accordingly, utilities of VGAM2346 include diagnosis, prevention and treatment of diseases and clinical conditions associated with DOCK3. FLJ13153 (Accession NM_024786) is another VGAM2346 host target gene. FLJ13153 BINDING SITE is HOST TARGET binding site found in the 5' untranslated region of mRNA encoded by FLJ13153, corresponding to a HOST TARGET binding site such as BINDING SITE I, BINDING SITE II or BINDING SITE III. Table 2 illustrates the complementarity of the nucleotide sequences of FLJ13153 BINDING SITE, designated SEQ ID:24166, to the nucleotide sequence of VGAM2346 RNA, herein designated VGAM RNA, also designated SEQ ID:5057.

Another function of VGAM2346 is therefore inhibition of FLJ13153 (Accession NM_024786). Accordingly, utilities of VGAM2346 include diagnosis, prevention and treatment of diseases and clinical conditions associated with FLJ13153. FLJ14621 (Accession NM_032811) is another VGAM2346 host target gene. FLJ14621 BINDING SITE is HOST TARGET binding site found in the 5' untranslated region of mRNA encoded by FLJ14621, corresponding to a HOST TARGET binding site such as BINDING SITE I, BINDING SITE II or BINDING SITE III. Table 2 illustrates the complementarity of the nucleotide sequences of FLJ14621 BINDING SITE, designated SEQ ID:26580, to the nucleotide sequence of VGAM2346 RNA, herein designated VGAM RNA, also designated SEQ ID:5057.

Another function of VGAM2346 is therefore inhibition of FLJ14621 (Accession NM_032811). Accordingly, utilities of VGAM2346 include diagnosis, prevention and treatment of diseases and clinical conditions associated with FLJ14621. FLJ20752 (Accession NM_019048) is another VGAM2346 host target gene. FLJ20752 BINDING SITE is HOST TARGET binding site found in the 5' untranslated region of mRNA encoded by FLJ20752, corresponding to a HOST TARGET binding site such as BINDING SITE I, BINDING SITE II or BINDING SITE III. Table 2 illustrates the complementarity of the nucleotide sequences of FLJ20752 BINDING SITE, designated SEQ ID:21129, to the nucleotide sequence of VGAM2346 RNA, herein designated VGAM RNA, also designated SEQ ID:5057.

Another function of VGAM2346 is therefore inhibition of FLJ20752 (Accession NM_019048). Accordingly, utilities of VGAM2346 include diagnosis, prevention and treatment of diseases and clinical conditions associated with FLJ20752. FLJ21709 (Accession XM_085480) is another VGAM2346 host target gene. FLJ21709 BINDING SITE is HOST TARGET binding site found in the 3' untranslated region of mRNA encoded by FLJ21709, corresponding to a HOST TARGET binding site such as BINDING SITE I, BINDING SITE II or BINDING SITE III. Table 2 illustrates the complementarity of the nucleotide sequences of FLJ21709 BINDING SITE, designated SEQ ID:38172, to the nucleotide sequence of VGAM2346 RNA, herein designated VGAM RNA, also designated SEQ ID:5057.

Another function of VGAM2346 is therefore inhibition of FLJ21709 (Accession XM_085480). Accordingly, utilities of VGAM2346 include diagnosis, prevention and treatment of diseases and clinical conditions associated with FLJ21709. FLJ22477 (Accession NM_024735) is another VGAM2346 host target gene. FLJ22477 BINDING SITE is HOST TARGET binding site found in the 5' untranslated region of mRNA encoded by FLJ22477, corresponding to a HOST TARGET binding site such as BINDING SITE I, BINDING SITE II or BINDING SITE III. Table 2 illustrates the complementarity of the nucleotide sequences of FLJ22477 BINDING SITE, designated SEQ ID:24075, to the nucleotide sequence of VGAM2346 RNA, herein designated VGAM RNA, also designated SEQ ID:5057.

Another function of VGAM2346 is therefore inhibition of FLJ22477 (Accession NM_024735). Accordingly, utilities of VGAM2346 include diagnosis, prevention and treatment of diseases and clinical conditions associated with FLJ22477. FLJ32865 (Accession NM_144613) is another VGAM2346 host target gene. FLJ32865 BINDING SITE is HOST TARGET binding site found in the 3' untranslated region of mRNA encoded by FLJ32865, corresponding to a HOST TARGET binding site such as BINDING SITE I, BINDING SITE II or BINDING SITE III. Table 2 illustrates the complementarity of the nucleotide sequences of FLJ32865 BINDING SITE, designated SEQ ID:29429, to the nucleotide sequence of VGAM2346 RNA, herein designated VGAM RNA, also designated SEQ ID:5057.

Another function of VGAM2346 is therefore inhibition of FLJ32865 (Accession NM_144613). Accordingly, utilities of VGAM2346 include diagnosis, prevention and treatment of diseases and clinical conditions associated with FLJ32865. HGC6.1.1 (Accession NM_014354) is another VGAM2346 host target gene. HGC6.1.1 BINDING SITE is HOST TARGET binding site found in the 3' untranslated region of mRNA encoded by HGC6.1.1, corresponding to a HOST TARGET binding site such as BINDING SITE I, BINDING SITE II or BINDING SITE III. Table 2 illustrates the complementarity of the nucleotide sequences of HGC6.1.1 BINDING SITE, designated SEQ ID:15685, to the nucleotide sequence of VGAM2346 RNA, herein designated VGAM RNA, also designated SEQ ID:5057.

Another function of VGAM2346 is therefore inhibition of HGC6.1.1 (Accession NM_014354). Accordingly, utilities of VGAM2346 include diagnosis, prevention and treatment of diseases and clinical conditions associated with HGC6.1.1. KIAA0010 (Accession NM_014671) is another VGAM2346 host target gene. KIAA0010 BINDING SITE is HOST TARGET binding site found in the 5' untranslated region of mRNA encoded by KIAA0010, corresponding to a HOST TARGET binding site such as BINDING SITE I, BINDING SITE II or BINDING SITE III. Table 2 illustrates the complementarity of the nucleotide sequences of KIAA0010 BINDING SITE, designated SEQ ID:16131, to the nucleotide sequence of VGAM2346 RNA, herein designated VGAM RNA, also designated SEQ ID:5057.

Another function of VGAM2346 is therefore inhibition of KIAA0010 (Accession NM_014671). Accordingly, utilities of VGAM2346 include diagnosis, prevention and treatment of diseases and clinical conditions associated with KIAA0010. KIAA1881 (Accession XM_170901) is another VGAM2346 host target gene. KIAA1881 BINDING SITE is HOST TARGET binding site found in the 3' untranslated region of mRNA encoded by KIAA1881, corresponding to a HOST TARGET binding site such as BINDING SITE I, BINDING SITE II or BINDING SITE III. Table 2 illustrates the complementarity of the nucleotide sequences of KIAA1881 BINDING SITE, designated SEQ ID:45657, to the nucleotide sequence of VGAM2346 RNA, herein designated VGAM RNA, also designated SEQ ID:5057.

Another function of VGAM2346 is therefore inhibition of KIAA1881 (Accession XM_170901). Accordingly, utilities of VGAM2346 include diagnosis, prevention and treatment of diseases and clinical conditions associated with KIAA1881. MGC20486 (Accession NM_052844) is another VGAM2346 host target gene. MGC20486 BINDING SITE is HOST TARGET binding site found in the 5' untranslated region of mRNA encoded by MGC20486, corresponding to a HOST TARGET binding site such as BINDING SITE I, BINDING SITE II or BINDING SITE III. Table 2 illustrates the complementarity of the nucleotide sequences of MGC20486 BINDING SITE, designated SEQ ID:27422, to the nucleotide sequence of VGAM2346 RNA, herein designated VGAM RNA, also designated SEQ ID:5057.

Another function of VGAM2346 is therefore inhibition of MGC20486 (Accession NM_052844). Accordingly, utilities of VGAM2346 include diagnosis, prevention and treatment of diseases and clinical conditions associated with MGC20486. PRP8 Pre-mRNA Processing Factor 8 Homolog (yeast) (PRPF8, Accession XM_028335) is another VGAM2346 host target gene. PRPF8 BINDING SITE is HOST TARGET binding site found in the 3' untranslated region of mRNA encoded by PRPF8, corresponding to a HOST TARGET binding site such as BINDING SITE I, BINDING SITE II or BINDING SITE III. Table 2 illustrates the complementarity of the nucleotide sequences of PRPF8 BINDING SITE, designated SEQ ID:30685, to the nucleotide sequence of VGAM2346 RNA, herein designated VGAM RNA, also designated SEQ ID:5057.

Another function of VGAM2346 is therefore inhibition of PRP8 Pre-mRNA Processing Factor 8 Homolog (yeast) (PRPF8, Accession XM_028335). Accordingly, utilities of VGAM2346 include diagnosis, prevention and treatment of diseases and clinical conditions associated with PRPF8. ZD52F10 (Accession NM_033317) is another VGAM2346 host target gene. ZD52F10 BINDING SITE is HOST TARGET binding site found in the 5' untranslated region of mRNA encoded by ZD52F10, corresponding to a HOST TARGET binding site such as BINDING SITE I, BINDING SITE II or BINDING SITE III. Table 2 illustrates the complementarity of the nucleotide sequences of ZD52F10 BINDING SITE, designated SEQ ID:27155, to the nucleotide sequence of VGAM2346 RNA, herein designated VGAM RNA, also designated SEQ ID:5057.

Another function of VGAM2346 is therefore inhibition of ZD52F10 (Accession NM_033317). Accordingly, utilities of VGAM2346 include diagnosis, prevention and treatment of diseases and clinical conditions associated with ZD52F10. LOC150538 (Accession XM_086945) is another VGAM2346 host target gene. LOC150538 BINDING SITE is HOST TARGET binding site found in the 3' untranslated region of mRNA encoded by LOC150538, corresponding to a HOST TARGET binding site such as BINDING SITE I, BINDING SITE II or BINDING SITE III. Table 2 illustrates the complementarity of the nucleotide sequences of LOC150538 BINDING SITE, designated SEQ ID:38992, to the nucleotide sequence of VGAM2346 RNA, herein designated VGAM RNA, also designated SEQ ID:5057.

Another function of VGAM2346 is therefore inhibition of LOC150538 (Accession XM_086945). Accordingly, utilities of VGAM2346 include diagnosis, prevention and treatment of diseases and clinical conditions associated with LOC150538. LOC157740 (Accession XM_088375) is another VGAM2346 host target gene. LOC157740 BINDING SITE is HOST TARGET binding site found in the 5' untranslated region of mRNA encoded by LOC157740, corresponding to a HOST TARGET binding site such as BINDING SITE I, BINDING SITE II or BINDING SITE III. Table 2 illustrates the complementarity of the nucleotide sequences of LOC157740 BINDING SITE, designated SEQ ID:39648, to the nucleotide sequence of VGAM2346 RNA, herein designated VGAM RNA, also designated SEQ ID:5057.

Another function of VGAM2346 is therefore inhibition of LOC157740 (Accession XM_088375). Accordingly, utilities of VGAM2346 include diagnosis, prevention and treatment of diseases and clinical conditions associated with LOC157740. LOC158117 (Accession XM_088483) is another VGAM2346 host target gene. LOC158117 BINDING SITE is HOST TARGET binding site found in the 3' untranslated region of mRNA encoded by LOC158117, corresponding to a HOST TARGET binding site such as BINDING SITE I, BINDING SITE II or BINDING SITE III. Table 2 illustrates the complementarity of the nucleotide sequences of LOC158117 BINDING SITE, designated SEQ ID:39729, to the nucleotide sequence of VGAM2346 RNA, herein designated VGAM RNA, also designated SEQ ID:5057.

Another function of VGAM2346 is therefore inhibition of LOC158117 (Accession XM_088483). Accordingly, utilities of VGAM2346 include diagnosis, prevention and treatment of diseases and clinical conditions associated with LOC158117. LOC158972 (Accession XM_099009) is another VGAM2346 host target gene. LOC158972 BINDING SITE is HOST TARGET binding site found in the 3' untranslated region of mRNA encoded by LOC158972, corresponding to a HOST TARGET binding site such as BINDING SITE I, BINDING SITE II or BINDING SITE III. Table 2 illustrates the complementarity of the nucleotide sequences of LOC158972 BINDING SITE, designated SEQ ID:42043, to the nucleotide sequence of VGAM2346 RNA, herein designated VGAM RNA, also designated SEQ ID:5057.

Another function of VGAM2346 is therefore inhibition of LOC158972 (Accession XM_099009). Accordingly, utilities of VGAM2346 include diagnosis, prevention and treatment of diseases and clinical conditions associated with LOC158972. LOC203275 (Accession XM_114667) is another VGAM2346 host target gene. LOC203275 BINDING SITE is HOST TARGET binding site found in the 3' untranslated region of mRNA encoded by LOC203275, corresponding to a HOST TARGET binding site such as BINDING SITE I, BINDING SITE II or BINDING SITE III. Table 2 illustrates the complementarity of the nucleotide sequences of LOC203275 BINDING SITE, designated SEQ ID:43027, to the nucleotide sequence of VGAM2346 RNA, herein designated VGAM RNA, also designated SEQ ID:5057.

Another function of VGAM2346 is therefore inhibition of LOC203275 (Accession XM_114667). Accordingly, utilities of VGAM2346 include diagnosis, prevention and treatment of diseases and clinical conditions associated with LOC203275. LOC219513 (Accession XM_169166) is another VGAM2346 host target gene. LOC219513 BINDING SITE is HOST TARGET binding site found in the 3' untranslated region of mRNA encoded by LOC219513, corresponding to a HOST TARGET binding site such as BINDING SITE I, BINDING SITE II or BINDING SITE III. Table 2 illustrates the complementarity of the nucleotide sequences of LOC219513 BINDING SITE, designated SEQ ID:45293, to the nucleotide sequence of VGAM2346 RNA, herein designated VGAM RNA, also designated SEQ ID:5057.

Another function of VGAM2346 is therefore inhibition of LOC219513 (Accession XM_169166). Accordingly, utilities of VGAM2346 include diagnosis, prevention and treatment of diseases and clinical conditions associated with LOC219513. LOC221271 (Accession XM_166307) is another VGAM2346 host target gene. LOC221271 BINDING SITE is HOST TARGET binding site found in the 5' untranslated region of mRNA encoded by LOC221271, corresponding to a HOST TARGET binding site such as BINDING SITE I, BINDING SITE II or BINDING SITE III. Table 2 illustrates the complementarity of the nucleotide sequences of LOC221271 BINDING SITE, designated SEQ ID:44124, to the nucleotide sequence of VGAM2346 RNA, herein designated VGAM RNA, also designated SEQ ID:5057.

Another function of VGAM2346 is therefore inhibition of LOC221271 (Accession XM_166307). Accordingly, utilities of VGAM2346 include diagnosis, prevention and treatment of diseases and clinical conditions associated with LOC221271. LOC256812 (Accession XM_174147) is another VGAM2346 host target gene. LOC256812 BINDING SITE is HOST TARGET binding site found in the 5' untranslated region of mRNA encoded by LOC256812, corresponding to a HOST TARGET binding site such as BINDING SITE I, BINDING SITE II or BINDING SITE III. Table 2 illustrates the complementarity of the nucleotide sequences of LOC256812 BINDING SITE, designated SEQ ID:46579, to the nucleotide sequence of VGAM2346 RNA, herein designated VGAM RNA, also designated SEQ ID:5057.

Another function of VGAM2346 is therefore inhibition of LOC256812 (Accession XM_174147). Accordingly, utilities of VGAM2346 include diagnosis, prevention and treatment of diseases and clinical conditions associated with LOC256812. LOC257422 (Accession XM_172923) is another VGAM2346 host target gene. LOC257422 BINDING SITE is HOST TARGET binding site found in the 5' untranslated region of mRNA encoded by LOC257422, corresponding to a HOST TARGET binding site such as BINDING SITE I, BINDING SITE II or BINDING SITE III. Table 2 illustrates the complementarity of the nucleotide sequences of LOC257422 BINDING SITE, designated SEQ ID:46190, to the nucleotide sequence of VGAM2346 RNA, herein designated VGAM RNA, also designated SEQ ID:5057.

Another function of VGAM2346 is therefore inhibition of LOC257422 (Accession XM_172923). Accordingly, utilities of VGAM2346 include diagnosis, prevention and treatment of diseases and clinical conditions associated with LOC257422. LOC57228 (Accession NM_020467) is another VGAM2346 host target gene. LOC57228 BINDING SITE is HOST TARGET binding site found in the 5' untranslated region of mRNA encoded by LOC57228, corresponding to a HOST TARGET binding site such as BINDING SITE I, BINDING SITE II or BINDING SITE III. Table 2 illustrates the complementarity of the nucleotide sequences of LOC57228 BINDING SITE, designated SEQ ID:21706, to the nucleotide sequence of VGAM2346 RNA, herein designated VGAM RNA, also designated SEQ ID:5057.

Another function of VGAM2346 is therefore inhibition of LOC57228 (Accession NM_020467). Accordingly, utilities of VGAM2346 include diagnosis, prevention and treatment of diseases and clinical conditions associated with LOC57228. FIG. 1 further provides a conceptual description of a novel bioinformatically detected viral gene of the present invention, referred to here as Viral Genomic Address Messenger 2347 (VGAM2347) viral gene, which modulates expression of respective host target genes thereof, the function and utility of which host target genes is known in the art.

VGAM2347 is a novel bioinformatically detected regulatory, non protein coding, viral micro RNA (miRNA) gene. The method by which VGAM2347 was detected is described hereinabove with reference to FIGS. 1-8.

VGAM2347 gene, herein designated VGAM GENE, is a viral gene contained in the genome of Equine Herpesvirus 2. VGAM2347 host target gene, herein designated VGAM HOST TARGET GENE, is a human gene contained in the human genome.

VGAM2347 gene encodes a VGAM2347 precursor RNA, herein designated VGAM PRECURSOR RNA. Similar to other miRNA genes, and unlike most ordinary genes, VGAM2347 precursor RNA does not encode a protein. A nucleotide sequence identical or highly similar to the nucleotide sequence of VGAM2347 precursor RNA is designated SEQ ID:2333, and is provided hereinbelow with reference to the sequence listing part. Nucleotide sequence SEQ ID:2333 is located at position 44095 relative to the genome of Equine Herpesvirus 2.

VGAM2347 precursor RNA folds onto itself, forming VGAM2347 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2347 folded precursor RNA into VGAM2347 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 65%) nucleotide sequence of VGAM2347 RNA is designated SEQ ID:5058, and is provided hereinbelow with reference to the sequence listing part.

VGAM2347 host target gene, herein designated VGAM HOST TARGET GENE, encodes a corresponding messenger RNA, VGAM2347 host target RNA, herein designated VGAM HOST TARGET RNA. VGAM2347 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2347 RNA, herein designated VGAM RNA, binds complementarily to one or more host target binding sites located in untranslated regions of VGAM2347 host target RNA, herein designated VGAM HOST TARGET RNA. This complementary binding is due to the fact that the nucleotide sequence of VGAM2347 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2347 RNA, herein designated VGAM RNA, may have a different number of host target binding sites in untranslated regions of a VGAM2347 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2347 RNA, herein designated VGAM RNA, to host target binding sites on VGAM2347 host target RNA, herein designated VGAM HOST TARGET RNA, such as BINDING SITE I, BINDING SITE II and BINDING SITE III, inhibits translation of VGAM2347 host target RNA into VGAM2347 host target protein, herein designated VGAM HOST TARGET PROTEIN. VGAM host target protein is therefore outlined by a broken line.

It is appreciated that VGAM2347 host target gene, herein designated VGAM HOST TARGET GENE, in fact represents a plurality of VGAM2347 host target genes. The mRNA of each one of this plurality of VGAM2347 host target genes comprises one or more host target binding sites, each having a nucleotide sequence which is at least partly complementary to VGAM2347 RNA, herein designated VGAM RNA, and which when bound by VGAM2347 RNA causes inhibition of translation of respective one or more VGAM2347 host target proteins.

It is further appreciated by one skilled in the art that the mode of translational inhibition illustrated by FIG. 1 with specific reference to translational inhibition exerted by VGAM2347 gene, herein designated VGAM GENE, on one or more VGAM2347 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2347 is inhibition of expression of host target genes, as part of a novel viral mechanism of attacking a host. Accordingly, utilities of VGAM2347 include diagnosis, prevention and treatment of viral infection by Equine Herpesvirus 2. Specific functions, and accordingly utilities, of VGAM2347 correlate with, and may be deduced from, the identity of the host target genes which VGAM2347 binds and inhibits, and the function of these host target genes, as elaborated hereinbelow.

Nucleotide sequences of the VGAM2347 precursor RNA, herein designated VGAM PRECURSOR RNA, and of the 'diced' VGAM2347 RNA, herein designated VGAM RNA, and a schematic representation of the secondary folding of VGAM2347 folded precursor RNA, herein designated VGAM FOLDED PRECURSOR RNA, of VGAM2347 are further described hereinbelow with reference to Table 1.

Nucleotide sequences of host target binding sites, such as BINDING SITE-I, BINDING SITE-II and BINDING SITE-III of FIG. 1, found on VGAM2347 host target RNA, and schematic representation of the complementarity of each of these host target binding sites to VGAM2347 RNA, herein designated VGAM RNA, are described hereinbelow with reference to Table 2.

As mentioned hereinabove with reference to FIG. 1, a function of VGAM2347 gene, herein designated VGAM is inhibition of expression of VGAM2347 target genes. It is appreciated that specific functions, and accordingly utilities, of VGAM2347 correlate with, and may be deduced from, the identity of the target genes which VGAM2347 binds and inhibits, and the function of these target genes, as elaborated hereinbelow.

Casein Kinase 1, Alpha 1 (CSNK1A1, Accession NM_001892) is a VGAM2347 host target gene. CSNK1A1 BINDING SITE is HOST TARGET binding site found in the 3' untranslated region of mRNA encoded by CSNK1A1, corresponding to a HOST TARGET binding site such as BINDING SITE I, BINDING SITE II or BINDING SITE III. Table 2 illustrates the complementarity of the nucleotide sequences of CSNK1A1 BINDING SITE, designated SEQ ID:7620, to the nucleotide sequence of VGAM2347 RNA, herein designated VGAM RNA, also designated SEQ ID:5058.

A function of VGAM2347 is therefore inhibition of Casein Kinase 1, Alpha 1 (CSNK1A1, Accession NM_001892). Accordingly, utilities of VGAM2347 include diagnosis, prevention and treatment of diseases and clinical conditions associated with CSNK1A1. MAP-kinase Activating Death Domain (MADD, Accession NM_003682) is another VGAM2347 host target gene. MADD BINDING SITE1 through MADD BINDING SITE6 are HOST TARGET binding sites found in untranslated regions of mRNA encoded by MADD, corresponding to HOST TARGET binding sites such as BINDING SITE I, BINDING SITE II or BINDING SITE III. Table 2 illustrates the complementarity of the nucleotide sequences of MADD BINDING SITE1 through MADD BINDING SITE6, designated SEQ ID:9788, SEQ ID:28237, SEQ ID:28243, SEQ ID:28248, SEQ ID:28253 and SEQ ID:28258 respectively, to the nucleotide sequence of VGAM2347 RNA, herein designated VGAM RNA, also designated SEQ ID:5058.

Another function of VGAM2347 is therefore inhibition of MAP-kinase Activating Death Domain (MADD, Accession NM_003682), a gene which may regulate two different pathways for neural activities.interacts with the type-1 tumor necrosis factor receptor (TNFR1); death domain-containing protein. Accordingly, utilities of VGAM2347 include diagnosis, prevention and treatment of diseases and clinical conditions associated with MADD. The function of MADD and its association with various diseases and clinical conditions, has been established by previous studies, as described hereinabove with reference to VGAM430. CMRF-35H (Accession XM_046925) is another VGAM2347 host target gene. CMRF-35H BINDING SITE is HOST TARGET binding site found in the 3' untranslated region of mRNA encoded by CMRF-35H, corresponding to a HOST TARGET binding site such as BINDING SITE I, BINDING SITE II or BINDING SITE III. Table 2 illustrates the complementarity of the nucleotide sequences of CMRF-35H BINDING SITE, designated SEQ ID:34861, to the nucleotide sequence of VGAM2347 RNA, herein designated VGAM RNA, also designated SEQ ID:5058.

Another function of VGAM2347 is therefore inhibition of CMRF-35H (Accession XM_046925). Accordingly, utilities of VGAM2347 include diagnosis, prevention and treatment of diseases and clinical conditions associated with CMRF-35H. CCR4-NOT Transcription Complex, Subunit 3 (CNOT3, Accession NM_014516) is another VGAM2347 host target gene. CNOT3 BINDING SITE is HOST TARGET binding site found in the 5' untranslated region of mRNA encoded by CNOT3, corresponding to a HOST TARGET binding site such as BINDING SITE I, BINDING SITE II or BINDING SITE III. Table 2 illustrates the complementarity of the nucleotide sequences of CNOT3 BINDING SITE, designated SEQ ID:15843, to the nucleotide sequence of VGAM2347 RNA, herein designated VGAM RNA, also designated SEQ ID:5058.

Another function of VGAM2347 is therefore inhibition of CCR4-NOT Transcription Complex, Subunit 3 (CNOT3, Accession NM_014516). Accordingly, utilities of VGAM2347 include diagnosis, prevention and treatment of diseases and clinical conditions associated with CNOT3. DKFZP564D172 (Accession NM_032042) is another VGAM2347 host target gene. DKFZP564D172 BINDING SITE is HOST TARGET binding site found in the 3' untranslated region of mRNA encoded by DKFZP564D172, corresponding to a HOST TARGET binding site such as BINDING SITE I, BINDING SITE II or BINDING SITE III. Table 2 illustrates the complementarity of the nucleotide sequences of DKFZP564D172 BINDING SITE, designated SEQ ID:25753, to the nucleotide sequence of VGAM2347 RNA, herein designated VGAM RNA, also designated SEQ ID:5058.

Another function of VGAM2347 is therefore inhibition of DKFZP564D172 (Accession NM_032042). Accordingly, utilities of VGAM2347 include diagnosis, prevention and treatment of diseases and clinical conditions associated with DKFZP564D172. FLJ14327 (Accession NM_024912) is another VGAM2347 host target gene. FLJ14327 BINDING SITE is HOST TARGET binding site found in the 3' untranslated region of mRNA encoded by FLJ14327, corresponding to a HOST TARGET binding site such as BINDING SITE I, BINDING SITE II or BINDING SITE III. Table 2 illustrates the complementarity of the nucleotide sequences of FLJ14327 BINDING SITE, designated SEQ ID:24430, to the nucleotide sequence of VGAM2347 RNA, herein designated VGAM RNA, also designated SEQ ID:5058.

Another function of VGAM2347 is therefore inhibition of FLJ14327 (Accession NM_024912). Accordingly, utilities of VGAM2347 include diagnosis, prevention and treatment of diseases and clinical conditions associated with FLJ14327. FLJ22233 (Accession NM_024959) is another VGAM2347 host target gene. FLJ22233 BINDING SITE is HOST TARGET binding site found in the 3' untranslated region of mRNA encoded by FLJ22233, corresponding to a HOST TARGET binding site such as BINDING SITE I, BINDING SITE II or BINDING SITE III. Table 2 illustrates the complementarity of the nucleotide sequences of FLJ22233 BINDING SITE, designated SEQ ID:24514, to the nucleotide sequence of VGAM2347 RNA, herein designated VGAM RNA, also designated SEQ ID:5058.

Another function of VGAM2347 is therefore inhibition of FLJ22233 (Accession NM_024959). Accordingly, utilities of VGAM2347 include diagnosis, prevention and treatment of diseases and clinical conditions associated with FLJ22233. NEU4 (Accession NM_080741) is another VGAM2347 host target gene. NEU4 BINDING SITE is HOST TARGET binding site found in the 5' untranslated region of mRNA encoded by NEU4, corresponding to a HOST TARGET binding site such as BINDING SITE I, BINDING SITE II or BINDING SITE III. Table 2 illustrates the complementarity of the nucleotide sequences of NEU4 BINDING SITE, designated SEQ ID:28028, to the nucleotide sequence of VGAM2347 RNA, herein designated VGAM RNA, also designated SEQ ID:5058.

Another function of VGAM2347 is therefore inhibition of NEU4 (Accession NM_080741). Accordingly, utilities of VGAM2347 include diagnosis, prevention and treatment of diseases and clinical conditions associated with NEU4. LOC112868 (Accession XM_053402) is another VGAM2347 host target gene. LOC112868 BINDING SITE is HOST TARGET binding site found in the 3' untranslated region of mRNA encoded by LOC112868, corresponding to a HOST TARGET binding site such as BINDING SITE I, BINDING SITE II or BINDING SITE III. Table 2 illustrates the complementarity of the nucleotide sequences of LOC112868 BINDING SITE, designated SEQ ID:36079, to the nucleotide sequence of VGAM2347 RNA, herein designated VGAM RNA, also designated SEQ ID:5058.

Another function of VGAM2347 is therefore inhibition of LOC112868 (Accession XM_053402). Accordingly, utilities of VGAM2347 include diagnosis, prevention and treatment of diseases and clinical conditions associated with LOC112868. LOC151826 (Accession XM_087312) is another VGAM2347 host target gene. LOC151826 BINDING SITE is HOST TARGET binding site found in the 3' untranslated region of mRNA encoded by LOC151826, corresponding to a HOST TARGET binding site such as BINDING SITE I, BINDING SITE II or BINDING SITE III. Table 2 illustrates the complementarity of the nucleotide sequences of LOC151826 BINDING SITE, designated SEQ ID:39165, to the nucleotide sequence of VGAM2347 RNA, herein designated VGAM RNA, also designated SEQ ID:5058.

Another function of VGAM2347 is therefore inhibition of LOC151826 (Accession XM_087312). Accordingly, utilities of VGAM2347 include diagnosis, prevention and treatment of diseases and clinical conditions associated with LOC151826. LOC152313 (Accession XM_098190) is another VGAM2347 host target gene. LOC152313 BINDING SITE1 and LOC152313 BINDING SITE2 are HOST TARGET binding sites found in untranslated regions of mRNA encoded by LOC152313, corresponding to HOST TARGET binding sites such as BINDING SITE I, BINDING SITE II or BINDING SITE III. Table 2 illustrates the complementarity of the nucleotide sequences of LOC152313 BINDING SITE1 and LOC152313 BINDING SITE2, designated SEQ ID:41478 and SEQ ID:41479 respectively, to the nucleotide sequence of VGAM2347 RNA, herein designated VGAM RNA, also designated SEQ ID:5058.

Another function of VGAM2347 is therefore inhibition of LOC152313 (Accession XM_098190). Accordingly, utilities of VGAM2347 include diagnosis, prevention and treatment of diseases and clinical conditions associated with LOC152313. LOC92568 (Accession XM_045852) is another VGAM2347 host target gene. LOC92568 BINDING SITE is HOST TARGET binding site found in the 3' untranslated region of mRNA encoded by LOC92568, corresponding to a HOST TARGET binding site such as BINDING SITE I, BINDING SITE II or BINDING SITE III. Table 2 illustrates the complementarity of the nucleotide sequences of LOC92568 BINDING SITE, designated SEQ ID:34580, to the nucleotide sequence of VGAM2347 RNA, herein designated VGAM RNA, also designated SEQ ID:5058.

Another function of VGAM2347 is therefore inhibition of LOC92568 (Accession XM_045852). Accordingly, utilities of VGAM2347 include diagnosis, prevention and treatment of diseases and clinical conditions associated with LOC92568. FIG. 1 further provides a conceptual description of a novel bioinformatically detected viral gene of the present invention, referred to here as Viral Genomic Address Messenger 2348 (VGAM2348) viral gene, which modulates expression of respective host target genes thereof, the function and utility of which host target genes is known in the art.

VGAM2348 is a novel bioinformatically detected regulatory, non protein coding, viral micro RNA (miRNA) gene. The method by which VGAM2348 was detected is described hereinabove with reference to FIGS. 1-8.

VGAM2348 gene, herein designated VGAM GENE, is a viral gene contained in the genome of Equine Herpesvirus 2. VGAM2348 host target gene, herein designated VGAM HOST TARGET GENE, is a human gene contained in the human genome.

VGAM2348 gene encodes a VGAM2348 precursor RNA, herein designated VGAM PRECURSOR RNA. Similar to other miRNA genes, and unlike most ordinary genes, VGAM2348 precursor RNA does not encode a protein. A nucleotide sequence identical or highly similar to the nucleotide sequence of VGAM2348 precursor RNA is designated SEQ ID:2334, and is provided hereinbelow with reference to the sequence listing part. Nucleotide sequence SEQ ID:2334 is located at position 16485 relative to the genome of Equine Herpesvirus 2.

VGAM2348 precursor RNA folds onto itself, forming VGAM2348 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2348 folded precursor RNA into VGAM2348 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM2348 RNA is designated SEQ ID:5059, and is provided hereinbelow with reference to the sequence listing part.

VGAM2348 host target gene, herein designated VGAM HOST TARGET GENE, encodes a corresponding messenger RNA, VGAM2348 host target RNA, herein designated VGAM HOST TARGET RNA. VGAM2348 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2348 RNA, herein designated VGAM RNA, binds complementarily to one or more host target binding sites located in untranslated regions of VGAM2348 host target RNA, herein designated VGAM HOST TARGET RNA. This complementary binding is due to the fact that the nucleotide sequence of VGAM2348 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2348 RNA, herein designated VGAM RNA, may have a different number of host target binding sites in untranslated regions of a VGAM2348 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2348 RNA, herein designated VGAM RNA, to host target binding sites on VGAM2348 host target RNA, herein designated VGAM HOST TARGET RNA, such as BINDING SITE I, BINDING SITE II and BINDING SITE III, inhibits translation of VGAM2348 host target RNA into VGAM2348 host target protein, herein designated VGAM HOST TARGET PROTEIN. VGAM host target protein is therefore outlined by a broken line.

It is appreciated that VGAM2348 host target gene, herein designated VGAM HOST TARGET GENE, in fact represents a plurality of VGAM2348 host target genes. The mRNA of each one of this plurality of VGAM2348 host target genes comprises one or more host target binding sites, each having a nucleotide sequence which is at least partly complementary to VGAM2348 RNA, herein designated VGAM RNA, and which when bound by VGAM2348 RNA causes inhibition of translation of respective one or more VGAM2348 host target proteins.

It is further appreciated by one skilled in the art that the mode of translational inhibition illustrated by FIG. 1 with specific reference to translational inhibition exerted by VGAM2348 gene, herein designated VGAM GENE, on one or more VGAM2348 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2348 is inhibition of expression of host target genes, as part of a novel viral mechanism of attacking a host. Accordingly, utilities of VGAM2348 include diagnosis, prevention and treatment of viral infection by Equine Herpesvirus 2. Specific functions, and accordingly utilities, of VGAM2348 correlate with, and may be deduced from, the identity of the host target genes which VGAM2348 binds and inhibits, and the function of these host target genes, as elaborated hereinbelow.

Nucleotide sequences of the VGAM2348 precursor RNA, herein designated VGAM PRECURSOR RNA, and of the 'diced' VGAM2348 RNA, herein designated VGAM RNA, and a schematic representation of the secondary folding of VGAM2348 folded precursor RNA, herein designated VGAM FOLDED PRECURSOR RNA, of VGAM2348 are further described hereinbelow with reference to Table 1.

Nucleotide sequences of host target binding sites, such as BINDING SITE-I, BINDING SITE-II and BINDING SITE-III of FIG. 1, found on VGAM2348 host target RNA, and schematic representation of the complementarity of each of these host target binding sites to VGAM2348 RNA, herein designated VGAM RNA, are described hereinbelow with reference to Table 2.

As mentioned hereinabove with reference to FIG. 1, a function of VGAM2348 gene, herein designated VGAM is inhibition of expression of VGAM2348 target genes. It is appreciated that specific functions, and accordingly utilities, of VGAM2348 correlate with, and may be deduced from, the identity of the target genes which VGAM2348 binds and inhibits, and the function of these target genes, as elaborated hereinbelow.

Isocitrate Dehydrogenase 1 (NADP+), Soluble (IDH1, Accession XM_028869) is a VGAM2348 host target gene. IDH1 BINDING SITE is HOST TARGET binding site found in the 3' untranslated region of mRNA encoded by IDH1, corresponding to a HOST TARGET binding site such as BINDING SITE I, BINDING SITE II or BINDING SITE III. Table 2 illustrates the complementarity of the nucleotide sequences of IDH1 BINDING SITE, designated SEQ ID:30800, to the nucleotide sequence of VGAM2348 RNA, herein designated VGAM RNA, also designated SEQ ID:5059.

A function of VGAM2348 is therefore inhibition of Isocitrate Dehydrogenase 1 (NADP+), Soluble (IDH1, Accession XM_028869), a gene which decarboxylates isocitrate into alpha-ketoglutarate. Accordingly, utilities of VGAM2348 include diagnosis, prevention and treatment of diseases and clinical conditions associated with IDH1. The function of IDH1 and its association with various diseases and clinical conditions, has been established by previous studies, as described hereinabove with reference to VGAM1928.

FLJ20060 (Accession NM_017645) is another VGAM2348 host target gene. FLJ20060 BINDING SITE is HOST TARGET binding site found in the 3' untranslated region of mRNA encoded by FLJ20060, corresponding to a HOST TARGET binding site such as BINDING SITE I, BINDING SITE II or BINDING SITE III. Table 2 illustrates the complementarity of the nucleotide sequences of FLJ20060 BINDING SITE, designated SEQ ID:19150, to the nucleotide sequence of VGAM2348 RNA, herein designated VGAM RNA, also designated SEQ ID:5059.

Another function of VGAM2348 is therefore inhibition of FLJ20060 (Accession NM_017645). Accordingly, utilities of VGAM2348 include diagnosis, prevention and treatment of diseases and clinical conditions associated with FLJ20060.

Growth Hormone Inducible Transmembrane Protein (GHITM, Accession NM_014394) is another VGAM2348 host target gene. GHITM BINDING SITE is HOST TARGET binding site found in the 3' untranslated region of mRNA encoded by GHITM, corresponding to a HOST TARGET binding site such as BINDING SITE I, BINDING SITE II or BINDING SITE III. Table 2 illustrates the complementarity of the nucleotide sequences of GHITM BINDING SITE, designated SEQ ID:15727, to the nucleotide sequence of VGAM2348 RNA, herein designated VGAM RNA, also designated SEQ ID:5059.

Another function of VGAM2348 is therefore inhibition of Growth Hormone Inducible Transmembrane Protein (GHITM, Accession NM_014394). Accordingly, utilities of VGAM2348 include diagnosis, prevention and treatment of diseases and clinical conditions associated with GHITM. Guanine Nucleotide Binding Protein (G protein), Gamma 4 (GNG4, Accession NM_004485) is another VGAM2348 host target gene. GNG4 BINDING SITE is HOST TARGET binding site found in the 3' untranslated region of mRNA encoded by GNG4, corresponding to a HOST TARGET binding site such as BINDING SITE I, BINDING SITE II or BINDING SITE III. Table 2 illustrates the complementarity of the nucleotide sequences of GNG4 BINDING SITE, designated SEQ ID:10812, to the nucleotide sequence of VGAM2348 RNA, herein designated VGAM RNA, also designated SEQ ID:5059.

Another function of VGAM2348 is therefore inhibition of Guanine Nucleotide Binding Protein (G protein), Gamma 4 (GNG4, Accession NM_004485). Accordingly, utilities of VGAM2348 include diagnosis, prevention and treatment of diseases and clinical conditions associated with GNG4. KIAA1228 (Accession XM_036408) is another VGAM2348 host target gene. KIAA1228 BINDING SITE is HOST TARGET binding site found in the 3" untranslated region of mRNA encoded by KIAA1228, corresponding to a HOST TARGET binding site such as BINDING SITE I, BINDING SITE II or BINDING SITE III. Table 2 illustrates the complementarity of the nucleotide sequences of KIAA1228 BINDING SITE, designated SEQ ID:32447, to the nucleotide sequence of VGAM2348 RNA, herein designated VGAM RNA, also designated SEQ ID:5059.

Another function of VGAM2348 is therefore inhibition of KIAA1228 (Accession XM_036408). Accordingly, utilities of VGAM2348 include diagnosis, prevention and treatment of diseases and clinical conditions associated with KIAA1228. KIAA1361 (Accession XM_030845) is another VGAM2348 host target gene. KIAA1361 BINDING SITE is HOST TARGET binding site found in the 3' untranslated region of mRNA encoded by KIAA1361, corresponding to a HOST TARGET binding site such as BINDING SITE I, BINDING SITE II or BINDING SITE III. Table 2 illustrates the complementarity of the nucleotide sequences of KIAA1361 BINDING SITE, designated SEQ ID:31166, to the nucleotide sequence of VGAM2348 RNA, herein designated VGAM RNA, also designated SEQ ID:5059.

Another function of VGAM2348 is therefore inhibition of KIAA1361 (Accession XM_030845). Accordingly, utilities of VGAM2348 include diagnosis, prevention and treatment of diseases and clinical conditions associated with KIAA1361. LOC222001 (Accession XM_167489) is another VGAM2348 host target gene. LOC222001 BINDING SITE is HOST TARGET binding site found in the 3' untranslated region of mRNA encoded by LOC222001, corresponding to a HOST TARGET binding site such as BINDING SITE I, BINDING SITE II or BINDING SITE III. Table 2 illustrates the complementarity of the nucleotide sequences of LOC222001 BINDING SITE, designated SEQ ID:44641, to the nucleotide sequence of VGAM2348 RNA, herein designated VGAM RNA, also designated SEQ ID:5059.

Another function of VGAM2348 is therefore inhibition of LOC222001 (Accession XM_167489). Accordingly, utilities of VGAM2348 include diagnosis, prevention and treatment of diseases and clinical conditions associated with LOC222001. FIG. 1 further provides a conceptual description of a novel bioinformatically detected viral gene of the present invention, referred to here as Viral Genomic Address Messenger 2349 (VGAM2349) viral gene, which modulates expression of respective host target genes thereof, the function and utility of which host target genes is known in the art.

VGAM2349 is a novel bioinformatically detected regulatory, non protein coding, viral micro RNA (miRNA) gene. The method by which VGAM2349 was detected is described hereinabove with reference to FIGS. 1-8.

VGAM2349 gene, herein designated VGAM GENE, is a viral gene contained in the genome of Equine Herpesvirus 2. VGAM2349 host target gene, herein designated VGAM HOST TARGET GENE, is a human gene contained in the human genome.

VGAM2349 gene encodes a VGAM2349 precursor RNA, herein designated VGAM PRECURSOR RNA. Similar to other miRNA genes, and unlike most ordinary genes, VGAM2349 precursor RNA does not encode a protein. A nucleotide sequence identical or highly similar to the nucleotide sequence of VGAM2349 precursor RNA is designated SEQ ID:2335, and is provided hereinbelow with reference to the sequence listing part. Nucleotide sequence SEQ ID:2335 is located at position 19286 relative to the genome of Equine Herpesvirus 2.

VGAM2349 precursor RNA folds onto itself, forming VGAM2349 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2349 folded precursor RNA into VGAM2349 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM2349 RNA is designated SEQ ID:5060, and is provided hereinbelow with reference to the sequence listing part.

VGAM2349 host target gene, herein designated VGAM HOST TARGET GENE, encodes a corresponding messenger RNA, VGAM2349 host target RNA, herein designated VGAM HOST TARGET RNA. VGAM2349 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2349 RNA, herein designated VGAM RNA, binds complementarily to one or more host target binding sites located in untranslated regions of VGAM2349 host target RNA, herein designated VGAM HOST TARGET RNA. This complementary binding is due to the fact that the nucleotide sequence of VGAM2349 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2349 RNA, herein designated VGAM RNA, may have a different number of host target binding sites in untranslated regions of a VGAM2349 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2349 RNA, herein designated VGAM RNA, to host target binding sites on VGAM2349 host target RNA, herein designated VGAM HOST TARGET RNA, such as BINDING SITE I, BINDING SITE II and BINDING SITE III, inhibits translation of VGAM2349 host target RNA into VGAM2349 host target protein, herein designated VGAM HOST TARGET PROTEIN. VGAM host target protein is therefore outlined by a broken line.

It is appreciated that VGAM2349 host target gene, herein designated VGAM HOST TARGET GENE, in fact represents a plurality of VGAM2349 host target genes. The mRNA of each one of this plurality of VGAM2349 host target genes comprises one or more host target binding sites, each having a nucleotide sequence which is at least partly complementary to VGAM2349 RNA, herein designated VGAM RNA, and which when bound by VGAM2349 RNA causes inhibition of translation of respective one or more VGAM2349 host target proteins.

It is further appreciated by one skilled in the art that the mode of translational inhibition illustrated by FIG. 1 with specific reference to translational inhibition exerted by VGAM2349 gene, herein designated VGAM GENE, on one or more VGAM2349 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2349 is inhibition of expression of host target genes, as part of a novel viral mechanism of attacking a host. Accordingly, utilities of VGAM2349 include diagnosis, prevention and treatment of viral infection by Equine Herpesvirus 2. Specific functions, and accordingly utilities, of VGAM2349 correlate with, and may be deduced from, the identity of the host target genes which VGAM2349 binds and inhibits, and the function of these target genes, as elaborated hereinbelow.

Nucleotide sequences of the VGAM2349 precursor RNA, herein designated VGAM PRECURSOR RNA, and of the 'diced' VGAM2349 RNA, herein designated VGAM RNA, and a schematic representation of the secondary folding of VGAM2349 folded precursor RNA, herein designated VGAM FOLDED PRECURSOR RNA, of VGAM2349 are further described hereinbelow with reference to Table 1.

Nucleotide sequences of host target binding sites, such as BINDING SITE-I, BINDING SITE-II and BINDING SITE-III of FIG. 1, found on VGAM2349 host target RNA, and schematic representation of the complementarity of each of these host target binding sites to VGAM2349 RNA, herein designated VGAM RNA, are described hereinbelow with reference to Table 2.

As mentioned hereinabove with reference to FIG. 1, a function of VGAM2349 gene, herein designated VGAM is inhibition of expression of VGAM2349 target genes. It is appreciated that specific functions, and accordingly utilities, of VGAM2349 correlate with, and may be deduced from, the identity of the target genes which VGAM2349 binds and inhibits, and the function of these target genes, as elaborated hereinbelow.

ATP-binding Cassette, Sub-family D (ALD), Member 1 (ABCD1, Accession NM_000033) is a VGAM2349 host target gene. ABCD1 BINDING SITE is HOST TARGET binding site found in the 5' untranslated region of mRNA encoded by ABCD1, corresponding to a HOST TARGET binding site such as BINDING SITE I, BINDING SITE II or BINDING SITE III. Table 2 illustrates the complementarity of the nucleotide sequences of ABCD1 BINDING SITE, designated SEQ ID:5471, to the nucleotide sequence of VGAM2349 RNA, herein designated VGAM RNA, also designated SEQ ID:5060.

A function of VGAM2349 is therefore inhibition of ATP-binding Cassette, Sub-family D (ALD), Member 1 (ABCD1, Accession NM_000033). Accordingly, utilities of VGAM2349 include diagnosis, prevention and treatment of diseases and clinical conditions associated with ABCD1. Ankyrin 1, Erythrocytic (ANK1, Accession XM_016774) is another VGAM2349 host target gene. ANK1 BINDING SITE is HOST TARGET binding site found in the 3' untranslated region of mRNA encoded by ANK1, corresponding to a HOST TARGET binding site such as BINDING SITE I, BINDING SITE II or BINDING SITE III. Table 2 illustrates the complementarity of the nucleotide sequences of ANK1 BINDING SITE, designated SEQ ID:30286, to the nucleotide sequence of VGAM2349 RNA, herein designated VGAM RNA, also designated SEQ ID:5060.

Another function of VGAM2349 is therefore inhibition of Ankyrin 1, Erythrocytic (ANK1, Accession XM_016774). Accordingly, utilities of VGAM2349 include diagnosis, prevention and treatment of diseases and clinical conditions associated with ANK1. AXL Receptor Tyrosine Kinase (AXL, Accession NM_021913) is another VGAM2349 host target gene. AXL BINDING SITE1 and AXL BINDING SITE2 are HOST TARGET binding sites found in untranslated regions of mRNA encoded by AXL, corresponding to HOST TARGET binding sites such as BINDING SITE I, BINDING SITE II or BINDING SITE III. Table 2 illustrates the complementarity of the nucleotide sequences of AXL BINDING SITE1 and AXL BINDING SITE2, designated SEQ ID:22444 and SEQ ID:7423 respectively, to the nucleotide sequence of VGAM2349 RNA, herein designated VGAM RNA, also designated SEQ ID:5060.

Another function of VGAM2349 is therefore inhibition of AXL Receptor Tyrosine Kinase (AXL, Accession NM_021913). Accordingly, utilities of VGAM2349 include diagnosis, prevention and treatment of diseases and clinical conditions associated with AXL. Collagen, Type XI, Alpha 2 (COL11A2, Accession NM_080681) is another VGAM2349 host target gene. COL11A2 BINDING SITE1 and COL11A2 BINDING SITE2 are HOST TARGET binding sites found in untranslated regions of mRNA encoded by COL11A2, corresponding to HOST TARGET binding sites such as BINDING SITE I, BINDING SITE II or BINDING SITE III. Table 2 illustrates the complementarity of the nucleotide sequences of COL11A2 BINDING SITE1 and COL11A2 BINDING SITE2, designated SEQ ID:27981 and SEQ ID:35917 respectively, to the nucleotide sequence of VGAM2349 RNA, herein designated VGAM RNA, also designated SEQ ID:5060.

Another function of VGAM2349 is therefore inhibition of Collagen, Type XI, Alpha 2 (COL11A2, Accession NM_080681). Accordingly, utilities of VGAM2349 include diagnosis, prevention and treatment of diseases and clinical conditions associated with COL11A2. Discs, Large (Drosophila) Homolog 5 (DLG5, Accession XM_096398) is another VGAM2349 host target gene. DLG5 BINDING SITE is HOST TARGET binding site found in the 3' untranslated region of mRNA encoded by DLG5, corresponding to a HOST TARGET binding site such as BINDING SITE I, BINDING SITE II or BINDING SITE III. Table 2 illustrates the complementarity of the nucleotide sequences of DLG5 BINDING SITE, designated SEQ ID:40338, to the nucleotide sequence of VGAM2349 RNA, herein designated VGAM RNA, also designated SEQ ID:5060.

Another function of VGAM2349 is therefore inhibition of Discs, Large (Drosophila) Homolog 5 (DLG5, Accession XM_096398), a gene which may transmit extracellular signals to inhibit cell proliferation. Accordingly, utilities of VGAM2349 include diagnosis, prevention and treatment of diseases and clinical conditions associated with DLG5. The function of DLG5 and its association with various diseases and clinical conditions, has been established by previous studies, as described hereinabove with reference to VGAM444. Fibroblast Growth Factor Receptor-like 1 (FGFRL1, Accession NM_021923) is another VGAM2349 host target gene. FGFRL1 BINDING SITE is HOST TARGET binding site found in the 3' untranslated region of mRNA encoded by FGFRL1, corresponding to a HOST TARGET binding site such as BINDING SITE I, BINDING SITE II or BINDING SITE III. Table 2 illustrates the complementarity of the nucleotide sequences of FGFRL1 BINDING SITE, designated SEQ ID:22450, to the nucleotide sequence of VGAM2349 RNA, herein designated VGAM RNA, also designated SEQ ID:5060.

Another function of VGAM2349 is therefore inhibition of Fibroblast Growth Factor Receptor-like 1 (FGFRL1, Accession NM_021923). Accordingly, utilities of VGAM2349 include diagnosis, prevention and treatment of diseases and clinical conditions associated with FGFRL1. General Transcription Factor II, I (GTF2I, Accession NM_032999) is another VGAM2349 host target gene. GTF2I BINDING SITE1 and GTF2I BINDING SITE2 are HOST TARGET binding sites found in untranslated regions of mRNA encoded by GTF2I, corresponding to HOST TARGET binding sites such as BINDING SITE I, BINDING SITE II or BINDING SITE III. Table 2 illustrates the complementarity of the nucleotide sequences of GTF2I BINDING SITE1 and GTF2I BINDING SITE2, designated SEQ ID:26886 and SEQ ID:26890 respectively, to the nucleotide sequence of VGAM2349 RNA, herein designated VGAM RNA, also designated SEQ ID:5060.

Another function of VGAM2349 is therefore inhibition of General Transcription Factor II, I (GTF2I, Accession NM_032999), a gene which interacts with the basal transcription machinery by coordinating the formation of a multiprotein complex at the c-fos promoter, and linking specific signal responsive activator complexes. Accordingly, utilities of VGAM2349 include diagnosis, prevention and treatment of diseases and clinical conditions associated with GTF2I. The function of GTF2I and its association with various diseases and clinical conditions, has been established by previous studies, as described hereinabove with reference to VGAM115. Homeo Box D3 (HOXD3, Accession NM_006898) is another VGAM2349 host target gene. HOXD3 BINDING SITE is HOST TARGET binding site found in the 5' untranslated region of mRNA encoded by HOXD3, corresponding to a HOST TARGET binding site such as BINDING SITE I, BINDING SITE II or BINDING SITE III. Table 2 illustrates the complementarity of the nucleotide sequences of HOXD3 BINDING SITE, designated SEQ ID:13773, to the nucleotide sequence of VGAM2349 RNA, herein designated VGAM RNA, also designated SEQ ID:5060.

Another function of VGAM2349 is therefore inhibition of Homeo Box D3 (HOXD3, Accession NM_006898), a gene which plays a role in the differentiation process of hematopoietic cells. Accordingly, utilities of VGAM2349 include diagnosis, prevention and treatment of diseases and clinical conditions associated with HOXD3. The function of HOXD3 and its association with various diseases and clinical conditions, has been established by previous studies, as described hereinabove with reference to VGAM1384. Kinesin Family Member 3C (KIF3C, Accession NM_002254) is another VGAM2349 host target gene. KIF3C BINDING SITE is HOST TARGET binding site found in the 3' untranslated region of mRNA encoded by KIF3C, corresponding to a HOST TARGET binding site such as BINDING SITE I, BINDING SITE II or BINDING SITE III. Table 2 illustrates the complementarity of the nucleotide sequences of KIF3C BINDING SITE, designated SEQ ID:8059, to the nucleotide sequence of VGAM2349 RNA, herein designated VGAM RNA, also designated SEQ ID:5060.

Another function of VGAM2349 is therefore inhibition of Kinesin Family Member 3C (KIF3C, Accession NM_002254). Accordingly, utilities of VGAM2349 include diagnosis, prevention and treatment of diseases and clinical conditions associated with KIF3C. Myeloid/lymphoid Or Mixed-lineage Leukemia (trithorax homolog, Drosophila); Translocated To, 7 (MLLT7, Accession NM_005938) is another VGAM2349 host target gene. MLLT7 BINDING SITE1 and MLLT7 BINDING SITE2 are HOST TARGET binding sites found in untranslated regions of mRNA encoded by MLLT7, corresponding to HOST TARGET binding sites such as BINDING SITE I, BINDING SITE II or BINDING SITE III. Table 2 illustrates the complementarity of the nucleotide sequences of MLLT7 BINDING SITE1 and MLLT7 BINDING SITE2, designated SEQ ID:12576 and SEQ ID:12577 respectively, to the nucleotide sequence of VGAM2349 RNA, herein designated VGAM RNA, also designated SEQ ID:5060.

Another function of VGAM2349 is therefore inhibition of Myeloid/lymphoid Or Mixed-lineage Leukemia (trithorax homolog, Drosophila); Translocated To, 7 (MLLT7, Accession NM_005938), a gene which is a Member of the forkhead family. Accordingly, utilities of VGAM2349 include diagnosis, prevention and treatment of diseases and clinical conditions associated with MLLT7. The function of MLLT7 and its association with various diseases and clinical conditions, has been established by previous studies, as described hereinabove with reference to VGAM175. Mevalonate Kinase (mevalonic aciduria) (MVK, Accession XM_027151) is another VGAM2349 host target gene. MVK BINDING SITE is HOST TARGET binding site found in the 3' untranslated region of mRNA encoded by MVK, corresponding to a HOST TARGET binding site such as BINDING SITE I, BINDING SITE II or BINDING SITE III. Table 2 illustrates the complementarity of the nucleotide sequences of MVK BINDING SITE, designated SEQ ID:30426, to the nucleotide sequence of VGAM2349 RNA, herein designated VGAM RNA, also designated SEQ ID:5060.

Another function of VGAM2349 is therefore inhibition of Mevalonate Kinase (mevalonic aciduria) (MVK, Accession XM_027151). Accordingly, utilities of VGAM2349 include diagnosis, prevention and treatment of diseases and clinical conditions associated with MVK. Myosin Light Chain Kinase 2, Skeletal Muscle (MYLK2, Accession NM_033118) is another VGAM2349 host target gene. MYLK2 BINDING SITE is HOST TARGET binding site found in the 3' untranslated region of mRNA encoded by MYLK2, corresponding to a HOST TARGET binding site such as BINDING SITE I, BINDING SITE II or BINDING SITE III. Table 2 illustrates the complementarity of the nucleotide sequences of MYLK2 BINDING SITE, designated SEQ ID:26965, to the nucleotide sequence of VGAM2349 RNA, herein designated VGAM RNA, also designated SEQ ID:5060.

Another function of VGAM2349 is therefore inhibition of Myosin Light Chain Kinase 2, Skeletal Muscle (MYLK2, Accession NM_033118). Accordingly, utilities of VGAM2349 include diagnosis, prevention and treatment of diseases and clinical conditions associated with MYLK2. Myosin XVA (MYO15A, Accession NM_016239) is another VGAM2349 host target gene. MYO15A BINDING SITE is HOST TARGET binding site found in the 3' untranslated region of mRNA encoded by MYO15A, corresponding to a HOST TARGET binding site such as BINDING SITE I, BINDING SITE II or BINDING SITE III. Table 2 illustrates the complementarity of the nucleotide sequences of MYO15A BINDING SITE, designated SEQ ID:18354, to the nucleotide sequence of VGAM2349 RNA, herein designated VGAM RNA, also designated SEQ ID:5060.

Another function of VGAM2349 is therefore inhibition of Myosin XVA (MYO15A, Accession NM_016239), a gene which acts as actin-based motors. Accordingly, utilities of VGAM2349 include diagnosis, prevention and treatment of diseases and clinical conditions associated with MYO15A. The function of MYO15A and its association with various diseases and clinical conditions, has been established by previous studies, as described hereinabove with reference to VGAM985. Neuro-oncological Ventral Antigen 1 (NOVA1, Accession NM_006489) is another VGAM2349 host target gene. NOVA1 BINDING SITE1 and NOVA1 BINDING SITE2 are HOST TARGET binding sites found in untranslated regions of mRNA encoded by NOVA1, corresponding to HOST TARGET binding sites such as BINDING SITE I, BINDING SITE II or BINDING SITE III. Table 2 illustrates the complementarity of the nucleotide sequences of NOVA1 BINDING SITE1 and NOVA1 BINDING SITE2, designated SEQ ID:13216 and SEQ ID:8347 respectively, to the nucleotide sequence of VGAM2349 RNA, herein designated VGAM RNA, also designated SEQ ID:5060.

Another function of VGAM2349 is therefore inhibition of Neuro-oncological Ventral Antigen 1 (NOVA1, Accession NM_006489), a gene which may regulate rna splicing or metabolism in a specific subset of developing neurons. Accordingly, utilities of VGAM2349 include diagnosis, prevention and treatment of diseases and clinical conditions associated with NOVA1. The function of NOVA1 and its association with various diseases and clinical conditions, has been established by previous studies, as described hereinabove with reference to VGAM521. PCTAIRE Protein Kinase 1 (PCTK1, Accession NM_033018) is another VGAM2349 host target gene. PCTK1 BINDING SITE is HOST TARGET binding site found in the 5' untranslated region of mRNA encoded by PCTK1, corresponding to a HOST TARGET binding site such as BINDING SITE I, BINDING SITE II or BINDING SITE III. Table 2 illustrates the complementarity of the nucleotide sequences of PCTK1 BINDING SITE, designated SEQ ID:26910, to the nucleotide sequence of VGAM2349 RNA, herein designated VGAM RNA, also designated SEQ ID:5060.

Another function of VGAM2349 is therefore inhibition of PCTAIRE Protein Kinase 1 (PCTK1, Accession NM_033018), a gene which may play a role in signal transduction cascades in terminally differentiated cells. Accordingly, utilities of VGAM2349 include diagnosis, prevention and treatment of diseases and clinical conditions associated with PCTK1. The function of PCTK1 and its association with various diseases and clinical conditions, has been established by previous studies, as described hereinabove with reference to VGAM75. Polymeric Immunoglobulin Receptor (PIGR, Accession XM_052013) is another VGAM2349 host target gene. PIGR BINDING SITE is HOST TARGET binding site found in the 3' untranslated region of mRNA encoded by PIGR, corresponding to a HOST TARGET binding site such as BINDING SITE I, BINDING SITE II or BINDING SITE III. Table 2 illustrates the complementarity of the nucleotide sequences of PIGR BINDING SITE, designated SEQ ID:35939, to the nucleotide sequence of VGAM2349 RNA, herein designated VGAM RNA, also designated SEQ ID:5060.

Another function of VGAM2349 is therefore inhibition of Polymeric Immunoglobulin Receptor (PIGR, Accession XM_052013). Accordingly, utilities of VGAM2349 include diagnosis, prevention and treatment of diseases and clinical conditions associated with PIGR. Ret Proto-oncogene (multiple endocrine neoplasia and medullary thyroid carcinoma 1, Hirschsprung disease) (RET, Accession NM_020630) is another VGAM2349 host target gene. RET BINDING SITE is HOST TARGET binding site found in the 3' untranslated region of mRNA encoded by RET, corresponding to a HOST TARGET binding site such as BINDING SITE I, BINDING SITE II or BINDING SITE III. Table 2 illustrates the complementarity of the nucleotide sequences of RET BINDING SITE, designated SEQ ID:21784, to the nucleotide sequence of VGAM2349 RNA, herein designated VGAM RNA, also designated SEQ ID:5060.

Another function of VGAM2349 is therefore inhibition of Ret Proto-oncogene (multiple endocrine neoplasia and medullary thyroid carcinoma 1, Hirschsprung disease) (RET, Accession NM_020630), a gene which transduces signals for cell growth and differentiation. Accordingly, utilities of VGAM2349 include diagnosis, prevention and treatment of diseases and clinical conditions associated with RET. The function of RET and its association with various diseases and clinical conditions, has been established by previous studies, as described hereinabove with reference to VGAM381. Ret Finger Protein (RFP, Accession NM_006510) is another VGAM2349 host target gene. RFP BINDING SITE is HOST TARGET binding site found in the 5' untranslated region of mRNA encoded by RFP, corresponding to a HOST TARGET binding site such as BINDING SITE I, BINDING SITE II or BINDING SITE III. Table 2 illustrates the complementarity of the nucleotide sequences of RFP BINDING SITE, designated SEQ ID:13259, to the nucleotide sequence of VGAM2349 RNA, herein designated VGAM RNA, also designated SEQ ID:5060.

Another function of VGAM2349 is therefore inhibition of Ret Finger Protein (RFP, Accession NM_006510), a gene which involvels in transcriptional regulation and may act in male germ cell development. Accordingly, utilities of VGAM2349 include diagnosis, prevention and treatment of diseases and clinical conditions associated with RFP. The function of RFP and its association with various diseases and clinical conditions, has been established by previous studies, as described hereinabove with reference to VGAM302. Seizure Related 6 Homolog (mouse)-like (SEZ6L, Accession NM_021115) is another VGAM2349 host target gene. SEZ6L BINDING SITE is HOST TARGET binding site found in the 5' untranslated region of mRNA encoded by SEZ6L, corresponding to a HOST TARGET binding site such as BINDING SITE I, BINDING SITE II or BINDING SITE III. Table 2 illustrates the complementarity of the nucleotide sequences of SEZ6L BINDING SITE, designated SEQ ID:22093, to the nucleotide sequence of VGAM2349 RNA, herein designated VGAM RNA, also designated SEQ ID:5060.

Another function of VGAM2349 is therefore inhibition of Seizure Related 6 Homolog (mouse)-like (SEZ6L, Accession NM_021115). Accordingly, utilities of VGAM2349 include diagnosis, prevention and treatment of diseases and clinical conditions associated with SEZ6L. Small Glutamine-rich Tetratricopeptide Repeat (TPR)-containing (SGT, Accession NM_003021) is another VGAM2349 host target gene. SGT BINDING SITE is HOST TARGET binding site found in the 3' untranslated region of mRNA encoded by SGT, corresponding to a HOST TARGET binding site such as BINDING SITE I, BINDING SITE II or BINDING SITE III. Table 2 illustrates the complementarity of the nucleotide sequences of SGT BINDING SITE, designated SEQ ID:8941, to the nucleotide sequence of VGAM2349 RNA, herein designated VGAM RNA, also designated SEQ ID:5060.

Another function of VGAM2349 is therefore inhibition of Small Glutamine-rich Tetratricopeptide Repeat (TPR)-containing (SGT, Accession NM_003021). Accordingly, utilities of VGAM2349 include diagnosis, prevention and treatment of diseases and clinical conditions associated with SGT. Testis Enhanced Gene Transcript (BAX inhibitor 1) (TEGT, Accession XM_035490) is another VGAM2349 host target gene. TEGT BINDING SITE is HOST TARGET binding site found in the 3' untranslated region of mRNA encoded by TEGT, corresponding to a HOST TARGET binding site such as BINDING SITE I, BINDING SITE II or BINDING SITE III. Table 2 illustrates the complementarity of the nucleotide sequences of TEGT BINDING SITE, designated SEQ ID:32273, to the nucleotide sequence of VGAM2349 RNA, herein designated VGAM RNA, also designated SEQ ID:5060.

Another function of VGAM2349 is therefore inhibition of Testis Enhanced Gene Transcript (BAX inhibitor 1) (TEGT, Accession XM_035490), a gene which is a suppressor of apoptosis. Accordingly, utilities of VGAM2349 include diagnosis, prevention and treatment of diseases and clinical conditions associated with TEGT. The function of TEGT and its association with various diseases and clinical conditions, has been established by previous studies, as described hereinabove with reference to VGAM2276. Tensin (TNS, Accession NM_022648) is another VGAM2349 host target gene. TNS BINDING SITE is HOST TARGET binding site found in the 5' untranslated region of mRNA encoded by TNS, corresponding to a HOST TARGET binding site such as BINDING SITE I, BINDING SITE II or BINDING SITE III. Table 2 illustrates the complementarity of the nucleotide sequences of TNS BINDING SITE, designated SEQ ID:22902, to the nucleotide sequence of VGAM2349 RNA, herein designated VGAM RNA, also designated SEQ ID:5060.

Another function of VGAM2349 is therefore inhibition of Tensin (TNS, Accession NM_022648). Accordingly, utilities of VGAM2349 include diagnosis, prevention and treatment of diseases and clinical conditions associated with TNS. Topoisomerase (DNA) III Beta (TOP3B, Accession NM_003935) is another VGAM2349 host target gene. TOP3B BINDING SITE is HOST TARGET binding site found in the 5' untranslated region of mRNA encoded by TOP3B, corresponding to a HOST TARGET binding site such as BINDING SITE I, BINDING SITE II or BINDING SITE III. Table 2 illustrates the complementarity of the nucleotide sequences of TOP3B BINDING SITE, designated SEQ ID:10037, to the nucleotide sequence of VGAM2349 RNA, herein designated VGAM RNA, also designated SEQ ID:5060.

Another function of VGAM2349 is therefore inhibition of Topoisomerase (DNA) III Beta (TOP3B, Accession NM_003935). Accordingly, utilities of VGAM2349 include diagnosis, prevention and treatment of diseases and clinical conditions associated with TOP3B. Activating Transcription Factor 3 (ATF3, Accession NM_004024) is another VGAM2349 host target gene. ATF3 BINDING SITE is HOST TARGET binding site found in the 3' untranslated region of mRNA encoded by ATF3, corresponding to a HOST TARGET binding site such as BINDING SITE I, BINDING SITE II or BINDING SITE III. Table 2 illustrates the complementarity of the nucleotide sequences of ATF3 BINDING SITE, designated SEQ ID:10244, to the nucleotide sequence of VGAM2349 RNA, herein designated VGAM RNA, also designated SEQ ID:5060.

Another function of VGAM2349 is therefore inhibition of Activating Transcription Factor 3 (ATF3, Accession NM_004024). Accordingly, utilities of VGAM2349 include diagnosis, prevention and treatment of diseases and clinical conditions associated with ATF3. Chromosome 20 Open Reading Frame 178 (C20orf178, Accession XM_059282) is another VGAM2349 host target gene. C20orf178 BINDING SITE is HOST TARGET binding site found in the 3' untranslated region of mRNA encoded by C20orf178, corresponding to a HOST TARGET binding site such as BINDING SITE I, BINDING SITE II or BINDING SITE III. Table 2 illustrates the complementarity of the nucleotide sequences of C20orf178 BINDING SITE, designated SEQ ID:36935, to the nucleotide sequence of VGAM2349 RNA, herein designated VGAM RNA, also designated SEQ ID:5060.

Another function of VGAM2349 is therefore inhibition of Chromosome 20 Open Reading Frame 178 (C20orf178, Accession XM_059282). Accordingly, utilities of VGAM2349 include diagnosis, prevention and treatment of diseases and clinical conditions associated with C20orf178. Casein Kinase 1, Gamma 1 (CSNK1G1, Accession NM_022048) is another VGAM2349 host target gene. CSNK1G1 BINDING SITE is HOST TARGET binding site found in the 3' untranslated region of mRNA encoded by CSNK1G1, corresponding to a HOST TARGET binding site such as BINDING SITE I, BINDING SITE II or BINDING SITE III. Table 2 illustrates the complementarity of the nucleotide sequences of CSNK1G1 BINDING SITE, designated SEQ ID:22569, to the nucleotide sequence of VGAM2349 RNA, herein designated VGAM RNA, also designated SEQ ID:5060.

Another function of VGAM2349 is therefore inhibition of Casein Kinase 1, Gamma 1 (CSNK1G1, Accession NM_022048). Accordingly, utilities of VGAM2349 include diagnosis, prevention and treatment of diseases and clinical conditions associated with CSNK1G1. CSR1 (Accession NM_016240) is another VGAM2349 host target gene. CSR1 BINDING SITE is HOST TARGET binding site found in the 3' untranslated region of mRNA encoded by CSR1, corresponding to a HOST TARGET binding site such as BINDING SITE I, BINDING SITE II or BINDING SITE III. Table 2 illustrates the complementarity of the nucleotide sequences of CSR1 BINDING SITE, designated SEQ ID:18359, to the nucleotide sequence of VGAM2349 RNA, herein designated VGAM RNA, also designated SEQ ID:5060.

Another function of VGAM2349 is therefore inhibition of CSR1 (Accession NM_016240). Accordingly, utilities of VGAM2349 include diagnosis, prevention and treatment of diseases and clinical conditions associated with CSR1. Diacylglycerol Kinase, Delta 130 kDa (DGKD, Accession XM_002384) is another VGAM2349 host target gene. DGKD BINDING SITE1 and DGKD BINDING SITE2 are HOST TARGET binding sites found in untranslated regions of mRNA encoded by DGKD, corresponding to HOST TARGET binding sites such as BINDING SITE I, BINDING SITE II or BINDING SITE III. Table 2 illustrates the complementarity of the nucleotide sequences of DGKD BINDING SITE1 and DGKD BINDING SITE2, designated SEQ ID:29885 and SEQ ID:29886 respectively, to the nucleotide sequence of VGAM2349 RNA, herein designated VGAM RNA, also designated SEQ ID:5060.

Another function of VGAM2349 is therefore inhibition of Diacylglycerol Kinase, Delta 130 kDa (DGKD, Accession XM_002384). Accordingly, utilities of VGAM2349 include diagnosis, prevention and treatment of diseases and clinical conditions associated with DGKD. DKFZP564O0423 (Accession XM_166254) is another VGAM2349 host target gene. DKFZP564O0423 BINDING SITE is HOST TARGET binding site found in the 3' untranslated region of mRNA encoded by DKFZP564O0423, corresponding to a HOST TARGET binding site such as BINDING SITE I, BINDING SITE II or BINDING SITE III. Table 2 illustrates the complementarity of the nucleotide sequences of DKFZP564O0423 BINDING SITE, designated SEQ ID:44067, to the nucleotide sequence of VGAM2349 RNA, herein designated VGAM RNA, also designated SEQ ID:5060.

Another function of VGAM2349 is therefore inhibition of DKFZP564O0423 (Accession XM_166254). Accordingly, utilities of VGAM2349 include diagnosis, prevention and treatment of diseases and clinical conditions associated with DKFZP564O0423. DKFZP761D0211 (Accession NM_032039) is another VGAM2349 host target gene. DKFZP761D0211 BINDING SITE is HOST TARGET binding site found in the 3' untranslated region of mRNA encoded by DKFZP761D0211, corresponding to a HOST TARGET binding site such as BINDING SITE I, BINDING SITE II or BINDING SITE III. Table 2 illustrates the complementarity of the nucleotide sequences of DKFZP761D0211 BINDING SITE, designated SEQ ID:25736, to the nucleotide sequence of VGAM2349 RNA, herein designated VGAM RNA, also designated SEQ ID:5060.

Another function of VGAM2349 is therefore inhibition of DKFZP761D0211 (Accession NM_032039). Accordingly, utilities of VGAM2349 include diagnosis, prevention and treatment of diseases and clinical conditions associated with DKFZP761D0211. FLJ10597 (Accession NM_018150) is another VGAM2349 host target gene. FLJ10597 BINDING SITE is HOST TARGET binding site found in the 3' untranslated region of mRNA encoded by FLJ10597, corresponding to a HOST TARGET binding site such as BINDING SITE I, BINDING SITE II or BINDING SITE III. Table 2 illustrates the complementarity of the nucleotide sequences of FLJ10597 BINDING SITE, designated SEQ ID:19953, to the nucleotide sequence of VGAM2349 RNA, herein designated VGAM RNA, also designated SEQ ID:5060.

Another function of VGAM2349 is therefore inhibition of FLJ10597 (Accession NM_018150). Accordingly, utilities of VGAM2349 include diagnosis, prevention and treatment of diseases and clinical conditions associated with FLJ10597. FLJ10661 (Accession NM_018172) is another VGAM2349 host target gene. FLJ10661 BINDING SITE is HOST TARGET binding site found in the 3' untranslated region of mRNA encoded by FLJ10661, corresponding to a HOST TARGET binding site such as BINDING SITE I, BINDING SITE II or BINDING SITE III. Table 2 illustrates the complementarity of the nucleotide sequences of FLJ10661 BINDING SITE, designated SEQ ID:19997, to the nucleotide sequence of VGAM2349 RNA, herein designated VGAM RNA, also designated SEQ ID:5060.

Another function of VGAM2349 is therefore inhibition of FLJ10661 (Accession NM_018172). Accordingly, utilities of VGAM2349 include diagnosis, prevention and treatment of diseases and clinical conditions associated with FLJ10661. FLJ21276 (Accession NM_024633) is another VGAM2349 host target gene. FLJ21276 BINDING SITE is HOST TARGET binding site found in the 3' untranslated region of mRNA encoded by FLJ21276, corresponding to a HOST TARGET binding site such as BINDING SITE I, BINDING SITE II or BINDING SITE III. Table 2 illustrates the complementarity of the nucleotide sequences of FLJ21276 BINDING SITE, designated SEQ ID:23902, to the nucleotide sequence of VGAM2349 RNA, herein designated VGAM RNA, also designated SEQ ID:5060.

Another function of VGAM2349 is therefore inhibition of FLJ21276 (Accession NM_024633). Accordingly, utilities of VGAM2349 include diagnosis, prevention and treatment of diseases and clinical conditions associated with FLJ21276. Golgi Associated, Gamma Adaptin Ear Containing, ARF Binding Protein 2 (GGA2, Accession NM_138640) is another VGAM2349 host target gene. GGA2 BINDING SITE1 and GGA2 BINDING SITE2 are HOST TARGET binding sites found in untranslated regions of mRNA encoded by GGA2, corresponding to HOST TARGET binding sites such as BINDING SITE I, BINDING SITE II or BINDING SITE III. Table 2 illustrates the complementarity of the nucleotide sequences of GGA2 BINDING SITE1 and GGA2 BINDING SITE2, designated SEQ ID:28921 and SEQ ID:17400 respectively, to the nucleotide sequence of VGAM2349 RNA, herein designated VGAM RNA, also designated SEQ ID:5060.

Another function of VGAM2349 is therefore inhibition of Golgi Associated, Gamma Adaptin Ear Containing, ARF Binding Protein 2 (GGA2, Accession NM_138640). Accordingly, utilities of VGAM2349 include diagnosis, prevention and treatment of diseases and clinical conditions associated with GGA2. H326 (Accession NM_015726) is another VGAM2349 host target gene. H326 BINDING SITE is HOST TARGET binding site found in the 5' untranslated region of mRNA encoded by H326, corresponding to a HOST TARGET binding site such as BINDING SITE I, BINDING SITE II or BINDING SITE III. Table 2 illustrates the complementarity of the nucleotide sequences of H326 BINDING SITE, designated SEQ ID:17939, to the nucleotide sequence of VGAM2349 RNA, herein designated VGAM RNA, also designated SEQ ID:5060.

Another function of VGAM2349 is therefore inhibition of H326 (Accession NM_015726). Accordingly, utilities of VGAM2349 include diagnosis, prevention and treatment of diseases and clinical conditions associated with H326. KIAA0153 (Accession NM_015140) is another VGAM2349 host target gene. KIAA0153 BINDING SITE is HOST TARGET binding site found in the 3' untranslated region of mRNA encoded by KIAA0153, corresponding to a HOST TARGET binding site such as BINDING SITE I, BINDING SITE II or BINDING SITE III. Table 2 illustrates the complementarity of the nucleotide sequences of KIAA0153 BINDING SITE, designated SEQ ID:17498, to the nucleotide sequence of VGAM2349 RNA, herein designated VGAM RNA, also designated SEQ ID:5060.

Another function of VGAM2349 is therefore inhibition of KIAA0153 (Accession NM_015140). Accordingly, utilities of VGAM2349 include diagnosis, prevention and treatment of diseases and clinical conditions associated with KIAA0153. KIAA0527 (Accession XM_171054) is another VGAM2349 host target gene. KIAA0527 BINDING SITE is HOST TARGET binding site found in the 3' untranslated region of mRNA encoded by KIAA0527, corresponding to a HOST TARGET binding site such as BINDING SITE I, BINDING SITE II or BINDING SITE III. Table 2 illustrates the complementarity of the nucleotide sequences of KIAA0527 BINDING SITE, designated SEQ ID:45843, to the nucleotide sequence of VGAM2349 RNA, herein designated VGAM RNA, also designated SEQ ID:5060.

Another function of VGAM2349 is therefore inhibition of KIAA0527 (Accession XM_171054). Accordingly, utilities of VGAM2349 include diagnosis, prevention and treatment of diseases and clinical conditions associated with KIAA0527. KIAA0819 (Accession XM_032996) is another VGAM2349 host target gene. KIAA0819 BINDING SITE is HOST TARGET binding site found in the 3' untranslated region of mRNA encoded by KIAA0819, corresponding to a HOST TARGET binding site such as BINDING SITE I, BINDING SITE II or BINDING SITE III. Table 2 illustrates the complementarity of the nucleotide sequences of KIAA0819 BINDING SITE, designated SEQ ID:31808, to the nucleotide sequence of VGAM2349 RNA, herein designated VGAM RNA, also designated SEQ ID:5060.

Another function of VGAM2349 is therefore inhibition of KIAA0819 (Accession XM_032996). Accordingly, utilities of VGAM2349 include diagnosis, prevention and treatment of diseases and clinical conditions associated with KIAA0819. KIAA1110 (Accession XM_029973) is another VGAM2349 host target gene. KIAA1110 BINDING SITE is HOST TARGET binding site found in the 3' untranslated region of mRNA encoded by KIAA1110, corresponding to a HOST TARGET binding site such as BINDING SITE I, BINDING SITE II or BINDING SITE III. Table 2 illustrates the complementarity of the nucleotide sequences of KIAA1110 BINDING SITE, designated SEQ ID:30985, to the nucleotide sequence of VGAM2349 RNA, herein designated VGAM RNA, also designated SEQ ID:5060.

Another function of VGAM2349 is therefore inhibition of KIAA1110 (Accession XM_029973). Accordingly, utilities of VGAM2349 include diagnosis, prevention and treatment of diseases and clinical conditions associated with KIAA1110. KIAA1228 (Accession XM_036408) is another VGAM2349 host target gene. KIAA1228 BINDING SITE is HOST TARGET binding site found in the 3' untranslated region of mRNA encoded by KIAA1228, corresponding to a HOST TARGET binding site such as BINDING SITE I, BINDING SITE II or BINDING SITE III. Table 2 illustrates the complementarity of the nucleotide sequences of KIAA1228 BINDING SITE, designated SEQ ID:32445, to the nucleotide sequence of VGAM2349 RNA, herein designated VGAM RNA, also designated SEQ ID:5060.

Another function of VGAM2349 is therefore inhibition of KIAA1228 (Accession XM_036408). Accordingly, utilities of VGAM2349 include diagnosis, prevention and treatment of diseases and clinical conditions associated with KIAA1228. KIAA1538 (Accession XM_049474) is another VGAM2349 host target gene. KIAA1538 BINDING SITE is HOST TARGET binding site found in the 3' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35430, to the nucleotide sequence of VGAM2349 RNA, herein designated VGAM RNA, also designated SEQ ID:5060.

Another function of VGAM2349 is therefore inhibition of KIAA1538 (Accession XM_049474). Accordingly, utilities of VGAM2349 include diagnosis, prevention and treatment of diseases and clinical conditions associated with KIAA1538. KIAA1559 (Accession XM_054472) is another VGAM2349 host target gene. KIAA1559 BINDING SITE is HOST TARGET binding site found in the 3' untranslated region of mRNA encoded by KIAA1559, corresponding to a HOST TARGET binding site such as BINDING SITE I, BINDING SITE II or BINDING SITE III. Table 2 illustrates the complementarity of the nucleotide sequences of KIAA1559 BINDING SITE, designated SEQ ID:36163, to the nucleotide sequence of VGAM2349 RNA, herein designated VGAM RNA, also designated SEQ ID:5060.

Another function of VGAM2349 is therefore inhibition of KIAA1559 (Accession XM_054472). Accordingly, utilities of VGAM2349 include diagnosis, prevention and treatment of diseases and clinical conditions associated with KIAA1559. KIAA1751 (Accession XM_049768) is another VGAM2349 host target gene. KIAA1751 BINDING SITE is HOST TARGET binding site found in the 3' untranslated region of mRNA encoded by KIAA1751, corresponding to a HOST TARGET binding site such as BINDING SITE I, BINDING SITE II or BINDING SITE III. Table 2 illustrates the complementarity of the nucleotide sequences of KIAA1751 BINDING SITE, designated SEQ ID:35497, to the nucleotide sequence of VGAM2349 RNA, herein designated VGAM RNA, also designated SEQ ID:5060.

Another function of VGAM2349 is therefore inhibition of KIAA1751 (Accession XM_049768). Accordingly, utilities of VGAM2349 include diagnosis, prevention and treatment of diseases and clinical conditions associated with KIAA1751. KIAA1755 (Accession XM_028810) is another VGAM2349 host target gene. KIAA1755 BINDING SITE is HOST TARGET binding site found in the 5' untranslated region of mRNA encoded by KIAA1755, corresponding to a HOST TARGET binding site such as BINDING SITE I, BINDING SITE II or BINDING SITE III. Table 2 illustrates the complementarity of the nucleotide sequences of KIAA1755 BINDING SITE, designated SEQ ID:30751, to the nucleotide sequence of VGAM2349 RNA, herein designated VGAM RNA, also designated SEQ ID:5060.

Another function of VGAM2349 is therefore inhibition of KIAA1755 (Accession XM_028810). Accordingly, utilities of VGAM2349 include diagnosis, prevention and treatment of diseases and clinical conditions associated with KIAA1755. KIAA1784 (Accession XM_036660) is another VGAM2349 host target gene. KIAA1784 BINDING SITE is HOST TARGET binding site found in the 3' untranslated region of mRNA encoded by KIAA1784, corresponding to a HOST TARGET binding site such as BINDING SITE I, BINDING SITE II or BINDING SITE III. Table 2 illustrates the complementarity of the nucleotide sequences of KIAA1784 BINDING SITE, designated SEQ ID:32485, to the nucleotide sequence of VGAM2349 RNA, herein designated VGAM RNA, also designated SEQ ID:5060.

Another function of VGAM2349 is therefore inhibition of KIAA1784 (Accession XM_036660). Accordingly, utilities of VGAM2349 include diagnosis, prevention and treatment of diseases and clinical conditions associated with KIAA1784. KIAA1870 (Accession NM_032888) is another VGAM2349 host target gene. KIAA1870 BINDING SITE is HOST TARGET binding site found in the 5' untranslated region of mRNA encoded by KIAA1870, corresponding to a HOST TARGET binding site such as BINDING SITE I, BINDING SITE II or BINDING SITE III. Table 2 illustrates the complementarity of the nucleotide sequences of KIAA1870 BINDING SITE, designated SEQ ID:26710, to the nucleotide sequence of VGAM2349 RNA, herein designated VGAM RNA, also designated SEQ ID:5060.

Another function of VGAM2349 is therefore inhibition of KIAA1870 (Accession NM_032888). Accordingly, utilities of VGAM2349 include diagnosis, prevention and treatment of diseases and clinical conditions associated with KIAA1870. KIAA1957 (Accession XM_065166) is another VGAM2349 host target gene. KIAA1957 BINDING SITE is HOST TARGET binding site found in the 3' untranslated region of mRNA encoded by KIAA1957, corresponding to a HOST TARGET binding site such as BINDING SITE I, BINDING SITE II or BINDING SITE III. Table 2 illustrates the complementarity of the nucleotide sequences of KIAA1957 BINDING SITE, designated SEQ ID:37277, to the nucleotide sequence of VGAM2349 RNA, herein designated VGAM RNA, also designated SEQ ID:5060.

Another function of VGAM2349 is therefore inhibition of KIAA1957 (Accession XM_065166). Accordingly, utilities of VGAM2349 include diagnosis, prevention and treatment of diseases and clinical conditions associated with KIAA1957. MGC16279 (Accession NM_032916) is another VGAM2349 host target gene. MGC16279 BINDING SITE is HOST TARGET binding site found in the 3' untranslated region of mRNA encoded by MGC16279, corresponding to a HOST TARGET binding site such as BINDING SITE I, BINDING SITE II or BINDING SITE III. Table 2 illustrates the complementarity of the nucleotide sequences of MGC16279 BINDING SITE, designated SEQ ID:26732, to the nucleotide sequence of VGAM2349 RNA, herein designated VGAM RNA, also designated SEQ ID:5060.

Another function of VGAM2349 is therefore inhibition of MGC16279 (Accession NM_032916). Accordingly, utilities of VGAM2349 include diagnosis, prevention and treatment of diseases and clinical conditions associated with MGC16279. MGC33182 (Accession XM_062903) is another VGAM2349 host target gene. MGC33182 BINDING SITE is HOST TARGET binding site found in the 5' untranslated region of mRNA encoded by MGC33182, corresponding to a HOST TARGET binding site such as BINDING SITE I, BINDING SITE II or BINDING SITE III. Table 2 illustrates the complementarity of the nucleotide sequences of MGC33182 BINDING SITE, designated SEQ ID:37233, to the nucleotide sequence of VGAM2349 RNA, herein designated VGAM RNA, also designated SEQ ID:5060.

Another function of VGAM2349 is therefore inhibition of MGC33182 (Accession XM_062903). Accordingly, utilities of VGAM2349 include diagnosis, prevention and treatment of diseases and clinical conditions associated with MGC33182. MGC4415 (Accession NM_031484) is another VGAM2349 host target gene. MGC4415 BINDING SITE is HOST TARGET binding site found in the 3' untranslated region of mRNA encoded by MGC4415, corresponding to a HOST TARGET binding site such as BINDING SITE I, BINDING SITE II or BINDING SITE III. Table 2 illustrates the complementarity of the nucleotide sequences of MGC4415 BINDING SITE, designated SEQ ID:25568, to the nucleotide sequence of VGAM2349 RNA, herein designated VGAM RNA, also designated SEQ ID:5060.

Another function of VGAM2349 is therefore inhibition of MGC4415 (Accession NM_031484). Accordingly, utilities of VGAM2349 include diagnosis, prevention and treatment of diseases and clinical conditions associated with MGC4415. MGC4677 (Accession NM_052871) is another VGAM2349 host target gene. MGC4677 BINDING SITE is HOST TARGET binding site found in the 5' untranslated region of mRNA encoded by MGC4677, corresponding to a HOST TARGET binding site such as BINDING SITE I, BINDING SITE II or BINDING SITE III. Table 2 illustrates the complementarity of the nucleotide sequences of MGC4677 BINDING SITE, designated SEQ ID:27452, to the nucleotide sequence of VGAM2349 RNA, herein designated VGAM RNA, also designated SEQ ID:5060.

Another function of VGAM2349 is therefore inhibition of MGC4677 (Accession NM_052871). Accordingly, utilities of VGAM2349 include diagnosis, prevention and treatment of diseases and clinical conditions associated with MGC4677. Myelin Transcription Factor 1-like (MYT1L, Accession XM_039762) is another VGAM2349 host target gene. MYT1L BINDING SITE is HOST TARGET binding site found in the 5' untranslated region of mRNA encoded by MYT1L, corresponding to a HOST TARGET binding site such as BINDING SITE I, BINDING SITE II or BINDING SITE III. Table 2 illustrates the complementarity of the nucleotide sequences of MYT1L BINDING SITE, designated SEQ ID:33185, to the nucleotide sequence of VGAM2349 RNA, herein designated VGAM RNA, also designated SEQ ID:5060.

Another function of VGAM2349 is therefore inhibition of Myelin Transcription Factor 1-like (MYT1L, Accession XM_039762). Accordingly, utilities of VGAM2349 include diagnosis, prevention and treatment of diseases and clinical conditions associated with MYT1L. Phosphatidylinositol-4-phosphate 5-kinase, Type II, Beta (PIP5K2B, Accession NM_003559) is another VGAM2349 host target gene. PIP5K2B BINDING SITE is HOST TARGET binding site found in the 3' untranslated region of mRNA encoded by PIP5K2B, corresponding to a HOST TARGET binding site such as BINDING SITE I, BINDING SITE II or BINDING SITE III. Table 2 illustrates the complementarity of the nucleotide sequences of PIP5K2B BINDING SITE, designated SEQ ID:9613, to the nucleotide sequence of VGAM2349 RNA, herein designated VGAM RNA, also designated SEQ ID:5060.

Another function of VGAM2349 is therefore inhibition of Phosphatidylinositol-4-phosphate 5-kinase, Type II, Beta (PIP5K2B, Accession NM_003559). Accordingly, utilities of VGAM2349 include diagnosis, prevention and treatment of diseases and clinical conditions associated with PIP5K2B. Phospholipase A2, Group VI (cytosolic, calcium-independent) (PLA2G6, Accession XM_039248) is another VGAM2349 host target gene. PLA2G6 BINDING SITE is HOST TARGET binding site found in the 3' untranslated region of mRNA encoded by PLA2G6, corresponding to a HOST TARGET binding site such as BINDING SITE I, BINDING SITE II or BINDING SITE III. Table 2 illustrates the complementarity of the nucleotide sequences of PLA2G6 BINDING SITE, designated SEQ ID:33031, to the nucleotide sequence of VGAM2349 RNA, herein designated VGAM RNA, also designated SEQ ID:5060.

Another function of VGAM2349 is therefore inhibition of Phospholipase A2, Group VI (cytosolic, calcium-independent) (PLA2G6, Accession XM_039248). Accordingly, utilities of VGAM2349 include diagnosis, prevention and treatment of diseases and clinical conditions associated with PLA2G6. Sodium Channel, Voltage-gated, Type XII, Alpha Polypeptide (SCN12A, Accession NM_014139) is another VGAM2349 host target gene. SCN12A BINDING SITE is HOST TARGET binding site found in the 3' untranslated region of mRNA encoded by SCN12A, corresponding to a HOST TARGET binding site such as BINDING SITE I, BINDING SITE II or BINDING SITE III. Table 2 illustrates the complementarity of the nucleotide sequences of SCN12A BINDING SITE, designated SEQ ID:15411, to the nucleotide sequence of VGAM2349 RNA, herein designated VGAM RNA, also designated SEQ ID:5060.

Another function of VGAM2349 is therefore inhibition of Sodium Channel, Voltage-gated, Type XII, Alpha Polypeptide (SCN12A, Accession NM_014139). Accordingly, utilities of VGAM2349 include diagnosis, prevention and treatment of diseases and clinical conditions associated with SCN12A. Stathmin-like 3 (STMN3, Accession NM_015894) is another VGAM2349 host target gene. STMN3 BINDING SITE is HOST TARGET binding site found in the 3' untranslated region of mRNA encoded by STMN3, corresponding to a HOST TARGET binding site such as BINDING SITE I, BINDING SITE II or BINDING SITE III. Table 2 illustrates the complementarity of the nucleotide sequences of STMN3 BINDING SITE, designated SEQ ID:18038, to the nucleotide sequence of VGAM2349 RNA, herein designated VGAM RNA, also designated SEQ ID:5060.

Another function of VGAM2349 is therefore inhibition of Stathmin-like 3 (STMN3, Accession NM_015894). Accordingly, utilities of VGAM2349 include diagnosis, prevention and treatment of diseases and clinical conditions associated with STMN3. TUSP (Accession NM_020245) is another VGAM2349 host target gene. TUSP BINDING SITE is HOST TARGET binding site found in the 5' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21525, to the nucleotide sequence of VGAM2349 RNA, herein designated VGAM RNA, also designated SEQ ID:5060.

Another function of VGAM2349 is therefore inhibition of TUSP (Accession NM_020245). Accordingly, utilities of VGAM2349 include diagnosis, prevention and treatment of diseases and clinical conditions associated with TUSP. VI (Accession NM_013443) is another VGAM2349 host target gene. VI BINDING SITE is HOST TARGET binding site found in the 3' untranslated region of mRNA encoded by VI, corresponding to a HOST TARGET binding site such as BINDING SITE I, BINDING SITE II or BINDING SITE III. Table 2 illustrates the complementarity of the nucleotide sequences of VI BINDING SITE, designated SEQ ID:15107, to the nucleotide sequence of VGAM2349 RNA, herein designated VGAM RNA, also designated SEQ ID:5060.

Another function of VGAM2349 is therefore inhibition of VI (Accession NM_013443). Accordingly, utilities of VGAM2349 include diagnosis, prevention and treatment of diseases and clinical conditions associated with VI. VIT1 (Accession NM_018693) is another VGAM2349 host target gene. VIT1 BINDING SITE is HOST TARGET binding site found in the 3' untranslated region of mRNA encoded by VIT1, corresponding to a HOST TARGET binding site such as BINDING SITE I, BINDING SITE II or BINDING SITE III. Table 2 illustrates the complementarity of the nucleotide sequences of VIT1 BINDING SITE, designated SEQ ID:20765, to the nucleotide sequence of VGAM2349 RNA, herein designated VGAM RNA, also designated SEQ ID:5060.

Another function of VGAM2349 is therefore inhibition of VIT1 (Accession NM_018693). Accordingly, utilities of VGAM2349 include diagnosis, prevention and treatment of diseases and clinical conditions associated with VIT1. VTI2 (Accession NM_006370) is another VGAM2349 host target gene. VTI2 BINDING SITE is HOST TARGET binding site found in the 5' untranslated region of mRNA encoded by VTI2, corresponding to a HOST TARGET binding site such as BINDING SITE I, BINDING SITE II or BINDING SITE III. Table 2 illustrates the complementarity of the nucleotide sequences of VTI2 BINDING SITE, designated SEQ ID:13057, to the nucleotide sequence of VGAM2349 RNA, herein designated VGAM RNA, also designated SEQ ID:5060.

Another function of VGAM2349 is therefore inhibition of VTI2 (Accession NM_006370). Accordingly, utilities of VGAM2349 include diagnosis, prevention and treatment of diseases and clinical conditions associated with VTI2. Zinc Finger Protein 95 Homolog (mouse) (ZFP95, Accession NM_014569) is another VGAM2349 host target gene. ZFP95 BINDING SITE1 and ZFP95 BINDING SITE2 are HOST TARGET binding sites found in untranslated regions of mRNA encoded by ZFP95, corresponding to HOST TARGET binding sites such as BINDING SITE I, BINDING SITE II or BINDING SITE III. Table 2 illustrates the complementarity of the nucleotide sequences of ZFP95 BINDING SITE1 and ZFP95 BINDING SITE2, designated SEQ ID:15919 and SEQ ID:29709 respectively, to the nucleotide sequence of VGAM2349 RNA, herein designated VGAM RNA, also designated SEQ ID:5060.

Another function of VGAM2349 is therefore inhibition of Zinc Finger Protein 95 Homolog (mouse) (ZFP95, Accession NM_014569). Accordingly, utilities of VGAM2349 include diagnosis, prevention and treatment of diseases and clinical conditions associated with ZFP95. LOC115073 (Accession XM_055193) is another VGAM2349 host target gene. LOC115073 BINDING SITE is HOST TARGET binding site found in the 5' untranslated region of mRNA encoded by LOC115073, corresponding to a HOST TARGET binding site such as BINDING SITE I, BINDING SITE II or BINDING SITE III. Table 2 illustrates the complementarity of the nucleotide sequences of LOC115073 BINDING SITE, designated SEQ ID:36239, to the nucleotide sequence of VGAM2349 RNA, herein designated VGAM RNA, also designated SEQ ID:5060.

Another function of VGAM2349 is therefore inhibition of LOC115073 (Accession XM_055193). Accordingly, utilities of VGAM2349 include diagnosis, prevention and treatment of diseases and clinical conditions associated with LOC115073. LOC121274 (Accession XM_058547) is another VGAM2349 host target gene. LOC121274 BINDING SITE is HOST TARGET binding site found in the 3' untranslated region of mRNA encoded by LOC121274, corresponding to a HOST TARGET binding site such as BINDING SITE I, BINDING SITE II or BINDING SITE III. Table 2 illustrates the complementarity of the nucleotide sequences of LOC121274 BINDING SITE, designated SEQ ID:36656, to the nucleotide sequence of VGAM2349 RNA, herein designated VGAM RNA, also designated SEQ ID:5060.

Another function of VGAM2349 is therefore inhibition of LOC121274 (Accession XM_058547). Accordingly, utilities of VGAM2349 include diagnosis, prevention and treatment of diseases and clinical conditions associated with LOC121274. LOC135763 (Accession NM_138572) is another VGAM2349 host target gene. LOC135763 BINDING SITE is HOST TARGET binding site found in the 3' untranslated region of mRNA encoded by LOC135763, corresponding to a HOST TARGET binding site such as BINDING SITE I, BINDING SITE II or BINDING SITE III. Table 2 illustrates the complementarity of the nucleotide sequences of LOC135763 BINDING SITE, designated SEQ ID:28881, to the nucleotide sequence of VGAM2349 RNA, herein designated VGAM RNA, also designated SEQ ID:5060.

Another function of VGAM2349 is therefore inhibition of LOC135763 (Accession NM_138572). Accordingly, utilities of VGAM2349 include diagnosis, prevention and treatment of diseases and clinical conditions associated with LOC135763. LOC144231 (Accession XM_096561) is another VGAM2349 host target gene. LOC144231 BINDING SITE is HOST TARGET binding site found in the 5' untranslated region of mRNA encoded by LOC144231, corresponding to a HOST TARGET binding site such as BINDING SITE I, BINDING SITE II or BINDING SITE III. Table 2 illustrates the complementarity of the nucleotide sequences of LOC144231 BINDING SITE, designated SEQ ID:40393, to the nucleotide sequence of VGAM2349 RNA, herein designated VGAM RNA, also designated SEQ ID:5060.

Another function of VGAM2349 is therefore inhibition of LOC144231 (Accession XM_096561). Accordingly, utilities of VGAM2349 include diagnosis, prevention and treatment of diseases and clinical conditions associated with LOC144231. LOC144465 (Accession XM_084874) is another VGAM2349 host target gene. LOC144465 BINDING SITE is HOST TARGET binding site found in the 3' untranslated region of mRNA encoded by LOC144465, corresponding to a HOST TARGET binding site such as BINDING SITE I, BINDING SITE II or BINDING SITE III. Table 2 illustrates the complementarity of the nucleotide sequences of LOC144465 BINDING SITE, designated SEQ ID:37751, to the nucleotide sequence of VGAM2349 RNA, herein designated VGAM RNA, also designated SEQ ID:5060.

Another function of VGAM2349 is therefore inhibition of LOC144465 (Accession XM_084874). Accordingly, utilities of VGAM2349 include diagnosis, prevention and treatment of diseases and clinical conditions associated with LOC144465. LOC145945 (Accession XM_096908) is another VGAM2349 host target gene. LOC145945 BINDING SITE is HOST TARGET binding site found in the 5' untranslated region of mRNA encoded by LOC145945, corresponding to a HOST TARGET binding site such as BINDING SITE I, BINDING SITE II or BINDING SITE III. Table 2 illustrates the complementarity of the nucleotide sequences of LOC145945 BINDING SITE, designated SEQ ID:40632, to the nucleotide sequence of VGAM2349 RNA, herein designated VGAM RNA, also designated SEQ ID:5060.

Another function of VGAM2349 is therefore inhibition of LOC145945 (Accession XM_096908). Accordingly, utilities of VGAM2349 include diagnosis, prevention and treatment of diseases and clinical conditions associated with LOC145945. LOC148760 (Accession XM_097514) is another VGAM2349 host target gene. LOC148760 BINDING SITE is HOST TARGET binding site found in the 3' untranslated region of mRNA encoded by LOC148760, corresponding to a HOST TARGET binding site such as BINDING SITE I, BINDING SITE II or BINDING SITE III. Table 2 illustrates the complementarity of the nucleotide sequences of LOC148760 BINDING SITE, designated SEQ ID:40896, to the nucleotide sequence of VGAM2349 RNA, herein designated VGAM RNA, also designated SEQ ID:5060.

Another function of VGAM2349 is therefore inhibition of LOC148760 (Accession XM_097514). Accordingly, utilities of VGAM2349 include diagnosis, prevention and treatment of diseases and clinical conditions associated with LOC148760. LOC149194 (Accession XM_086458) is another VGAM2349 host target gene. LOC149194 BINDING SITE is HOST TARGET binding site found in the 3' untranslated region of mRNA encoded by LOC149194, corresponding to a HOST TARGET binding site such as BINDING SITE I, BINDING SITE II or BINDING SITE III. Table 2 illustrates the complementarity of the nucleotide sequences of LOC149194 BINDING SITE, designated SEQ ID:38670, to the nucleotide sequence of VGAM2349 RNA, herein designated VGAM RNA, also designated SEQ ID:5060.

Another function of VGAM2349 is therefore inhibition of LOC149194 (Accession XM_086458). Accordingly, utilities of VGAM2349 include diagnosis, prevention and treatment of diseases and clinical conditions associated with LOC149194. LOC151162 (Accession XM_098012) is another VGAM2349 host target gene. LOC151162 BINDING SITE is HOST TARGET binding site found in the 5' untranslated region of mRNA encoded by LOC151162, corresponding to a HOST TARGET binding site such as BINDING SITE I, BINDING SITE II or BINDING SITE III. Table 2 illustrates the complementarity of the nucleotide sequences of LOC151162 BINDING SITE, designated SEQ ID:41305, to the nucleotide sequence of VGAM2349 RNA, herein designated VGAM RNA, also designated SEQ ID:5060.

Another function of VGAM2349 is therefore inhibition of LOC151162 (Accession XM_098012). Accordingly, utilities of VGAM2349 include diagnosis, prevention and treatment of diseases and clinical conditions associated with LOC151162. LOC154449 (Accession XM_087928) is another VGAM2349 host target gene. LOC154449 BINDING SITE is HOST TARGET binding site found in the 5' untranslated region of mRNA encoded by LOC154449, corresponding to a HOST TARGET binding site such as BINDING SITE I, BINDING SITE II or BINDING SITE III. Table 2 illustrates the complementarity of the nucleotide sequences of LOC154449 BINDING SITE, designated SEQ ID:39475, to the nucleotide sequence of VGAM2349 RNA, herein designated VGAM RNA, also designated SEQ ID:5060.

Another function of VGAM2349 is therefore inhibition of LOC154449 (Accession XM_087928). Accordingly, utilities of VGAM2349 include diagnosis, prevention and treatment of diseases and clinical conditions associated with LOC154449. LOC157450 (Accession XM_048209) is another VGAM2349 host target gene. LOC157450 BINDING SITE is HOST TARGET binding site found in the 3' untranslated region of mRNA encoded by LOC157450, corresponding to a HOST TARGET binding site such as BINDING SITE I, BINDING SITE II or BINDING SITE III. Table 2 illustrates the complementarity of the nucleotide sequences of LOC157450 BINDING SITE, designated SEQ ID:35147, to the nucleotide sequence of VGAM2349 RNA, herein designated VGAM RNA, also designated SEQ ID:5060.

Another function of VGAM2349 is therefore inhibition of LOC157450 (Accession XM_048209). Accordingly, utilities of VGAM2349 include diagnosis, prevention and treatment of diseases and clinical conditions associated with LOC157450. LOC157860 (Accession XM_098832) is another VGAM2349 host target gene. LOC157860 BINDING SITE is HOST TARGET binding site found in the 3' untranslated region of mRNA encoded by LOC157860, corresponding to a HOST TARGET binding site such as BINDING SITE I, BINDING SITE II or BINDING SITE III. Table 2 illustrates the complementarity of the nucleotide sequences of LOC157860 BINDING SITE, designated SEQ ID:41859, to the nucleotide sequence of VGAM2349 RNA, herein designated VGAM RNA, also designated SEQ ID:5060.

Another function of VGAM2349 is therefore inhibition of LOC157860 (Accession XM_098832). Accordingly, utilities of VGAM2349 include diagnosis, prevention and treatment of diseases and clinical conditions associated with LOC157860. LOC158490 (Accession XM_088585) is another VGAM2349 host target gene. LOC158490 BINDING SITE is HOST TARGET binding site found in the 3' untranslated region of mRNA encoded by LOC158490, corresponding to a HOST TARGET binding site such as BINDING SITE I, BINDING SITE II or BINDING SITE III. Table 2 illustrates the complementarity of the nucleotide sequences of LOC158490 BINDING SITE, designated SEQ ID:39851, to the nucleotide sequence of VGAM2349 RNA, herein designated VGAM RNA, also designated SEQ ID:5060.

Another function of VGAM2349 is therefore inhibition of LOC158490 (Accession XM_088585). Accordingly, utilities of VGAM2349 include diagnosis, prevention and treatment of diseases and clinical conditions associated with LOC158490. LOC158819 (Accession XM_098995) is another VGAM2349 host target gene. LOC158819 BINDING SITE is HOST TARGET binding site found in the 5' untranslated region of mRNA encoded by LOC158819, corresponding to a HOST TARGET binding site such as BINDING SITE I, BINDING SITE II or BINDING SITE III. Table 2 illustrates the complementarity of the nucleotide sequences of LOC158819 BINDING SITE, designated SEQ ID:42025, to the nucleotide sequence of VGAM2349 RNA, herein designated VGAM RNA, also designated SEQ ID:5060.

Another function of VGAM2349 is therefore inhibition of LOC158819 (Accession XM_098995). Accordingly, utilities of VGAM2349 include diagnosis, prevention and treatment of diseases and clinical conditions associated with LOC158819. LOC168489 (Accession XM_095134) is another VGAM2349 host target gene. LOC168489 BINDING SITE is HOST TARGET binding site found in the 5' untranslated region of mRNA encoded by LOC168489, corresponding to a HOST TARGET binding site such as BINDING SITE I, BINDING SITE II or BINDING SITE III. Table 2 illustrates the complementarity of the nucleotide sequences of LOC168489 BINDING SITE, designated SEQ ID:40250, to the nucleotide sequence of VGAM2349 RNA, herein designated VGAM RNA, also designated SEQ ID:5060.

Another function of VGAM2349 is therefore inhibition of LOC168489 (Accession XM_095134). Accordingly, utilities of VGAM2349 include diagnosis, prevention and treatment of diseases and clinical conditions associated with LOC168489. LOC203377 (Accession XM_117540) is another VGAM2349 host target gene. LOC203377 BINDING SITE is HOST TARGET binding site found in the 5' untranslated region of mRNA encoded by LOC203377, corresponding to a HOST TARGET binding site such as BINDING SITE I, BINDING SITE II or BINDING SITE III. Table 2 illustrates the complementarity of the nucleotide sequences of LOC203377 BINDING SITE, designated SEQ ID:43540, to the nucleotide sequence of VGAM2349 RNA, herein designated VGAM RNA, also designated SEQ ID:5060.

Another function of VGAM2349 is therefore inhibition of LOC203377 (Accession XM_117540). Accordingly, utilities of VGAM2349 include diagnosis, prevention and treatment of diseases and clinical conditions associated with LOC203377. LOC221692 (Accession XM_166420) is another VGAM2349 host target gene. LOC221692 BINDING SITE is HOST TARGET binding site found in the 3' untranslated region of mRNA encoded by LOC221692, corresponding to a HOST TARGET binding site such as BINDING SITE I, BINDING SITE II or BINDING SITE III. Table 2 illustrates the complementarity of the nucleotide sequences of LOC221692 BINDING SITE, designated SEQ ID:44298, to the nucleotide sequence of VGAM2349 RNA, herein designated VGAM RNA, also designated SEQ ID:5060.

Another function of VGAM2349 is therefore inhibition of LOC221692 (Accession XM_166420). Accordingly, utilities of VGAM2349 include diagnosis, prevention and treatment of diseases and clinical conditions associated with LOC221692. LOC221715 (Accession XM_168092) is another VGAM2349 host target gene. LOC221715 BINDING SITE is HOST TARGET binding site found in the 5' untranslated region of mRNA encoded by LOC221715, corresponding to a HOST TARGET binding site such as BINDING SITE I, BINDING SITE II or BINDING SITE III. Table 2 illustrates the complementarity of the nucleotide sequences of LOC221715 BINDING SITE, designated SEQ ID:45017, to the nucleotide sequence of VGAM2349 RNA, herein designated VGAM RNA, also designated SEQ ID:5060.

Another function of VGAM2349 is therefore inhibition of LOC221715 (Accession XM_168092). Accordingly, utilities of VGAM2349 include diagnosis, prevention and treatment of diseases and clinical conditions associated with LOC221715. LOC254205 (Accession XM_172962) is another VGAM2349 host target gene. LOC254205 BINDING SITE is HOST TARGET binding site found in the 5' untranslated region of mRNA encoded by LOC254205, corresponding to a HOST TARGET binding site such as BINDING SITE I, BINDING SITE II or BINDING SITE III. Table 2 illustrates the complementarity of the nucleotide sequences of LOC254205 BINDING SITE, designated SEQ ID:46218, to the nucleotide sequence of VGAM2349 RNA, herein designated VGAM RNA, also designated SEQ ID:5060.

Another function of VGAM2349 is therefore inhibition of LOC254205 (Accession XM_172962). Accordingly, utilities of VGAM2349 include diagnosis, prevention and treatment of diseases and clinical conditions associated with LOC254205. LOC255101 (Accession XM_173080) is another VGAM2349 host target gene. LOC255101 BINDING SITE is HOST TARGET binding site found in the 5' untranslated region of mRNA encoded by LOC255101, corresponding to a HOST TARGET binding site such as BINDING SITE I, BINDING SITE II or BINDING SITE III. Table 2 illustrates the complementarity of the nucleotide sequences of LOC255101 BINDING SITE, designated SEQ ID:46339, to the nucleotide sequence of VGAM2349 RNA, herein designated VGAM RNA, also designated SEQ ID:5060.

Another function of VGAM2349 is therefore inhibition of LOC255101 (Accession XM_173080). Accordingly, utilities of VGAM2349 include diagnosis, prevention and treatment of diseases and clinical conditions associated with LOC255101. LOC256337 (Accession XM_170643) is another VGAM2349 host target gene. LOC256337 BINDING SITE is HOST TARGET binding site found in the 3' untranslated region of mRNA encoded by LOC256337, corresponding to a HOST TARGET binding site such as BINDING SITE I, BINDING SITE II or BINDING SITE III. Table 2 illustrates the complementarity of the nucleotide sequences of LOC256337 BINDING SITE, designated SEQ ID:45421, to the nucleotide sequence of VGAM2349 RNA, herein designated VGAM RNA, also designated SEQ ID:5060.

Another function of VGAM2349 is therefore inhibition of LOC256337 (Accession XM_170643). Accordingly, utilities of VGAM2349 include diagnosis, prevention and treatment of diseases and clinical conditions associated with LOC256337. LOC90309 (Accession XM_030830) is another VGAM2349 host target gene. LOC90309 BINDING SITE is HOST TARGET binding site found in the 5' untranslated region of mRNA encoded by LOC90309, corresponding to a HOST TARGET binding site such as BINDING SITE I, BINDING SITE II or BINDING SITE III. Table 2 illustrates the complementarity of the nucleotide sequences of LOC90309 BINDING SITE, designated SEQ ID:31151, to the nucleotide sequence of VGAM2349 RNA, herein designated VGAM RNA, also designated SEQ ID:5060.

Another function of VGAM2349 is therefore inhibition of LOC90309 (Accession XM_030830). Accordingly, utilities of VGAM2349 include diagnosis, prevention and treatment of diseases and clinical conditions associated with LOC90309. LOC91960 (Accession XM_041872) is another VGAM2349 host target gene. LOC91960 BINDING SITE is HOST TARGET binding site found in the 3' untranslated region of mRNA encoded by LOC91960, corresponding to a HOST TARGET binding site such as BINDING SITE I, BINDING SITE II or BINDING SITE III. Table 2 illustrates the complementarity of the nucleotide sequences of LOC91960 BINDING SITE, designated SEQ ID:33612, to the nucleotide sequence of VGAM2349 RNA, herein designated VGAM RNA, also designated SEQ ID:5060.

Another function of VGAM2349 is therefore inhibition of LOC91960 (Accession XM_041872). Accordingly, utilities of VGAM2349 include diagnosis, prevention and treatment of diseases and clinical conditions associated with LOC91960. LOC92340 (Accession XM_044426) is another VGAM2349 host target gene. LOC92340 BINDING SITE is HOST TARGET binding site found in the 3' untranslated region of mRNA encoded by LOC92340, corresponding to a HOST TARGET binding site such as BINDING SITE I, BINDING SITE II or BINDING SITE III. Table 2 illustrates the complementarity of the nucleotide sequences of LOC92340 BINDING SITE, designated SEQ ID:34198, to the nucleotide sequence of VGAM2349 RNA, herein designated VGAM RNA, also designated SEQ ID:5060.

Another function of VGAM2349 is therefore inhibition of LOC92340 (Accession XM_044426). Accordingly, utilities of VGAM2349 include diagnosis, prevention and treatment of diseases and clinical conditions associated with LOC92340. LOC92822 (Accession XM_047520) is another VGAM2349 host target gene. LOC92822 BINDING SITE is HOST TARGET binding site found in the 3' untranslated region of mRNA encoded by LOC92822, corresponding to a HOST TARGET binding site such as BINDING SITE I, BINDING SITE II or BINDING SITE III. Table 2 illustrates the complementarity of the nucleotide sequences of LOC92822 BINDING SITE, designated SEQ ID:34985, to the nucleotide sequence of VGAM2349 RNA, herein designated VGAM RNA, also designated SEQ ID:5060.

Another function of VGAM2349 is therefore inhibition of LOC92822 (Accession XM_047520). Accordingly, utilities of VGAM2349 include diagnosis, prevention and treatment of diseases and clinical conditions associated with LOC92822. LOC93320 (Accession XM_050534) is another VGAM2349 host target gene. LOC93320 BINDING SITE is HOST TARGET binding site found in the 3' untranslated region of mRNA encoded by LOC93320, corresponding to a HOST TARGET binding site such as BINDING SITE I, BINDING SITE II or BINDING SITE III. Table 2 illustrates the complementarity of the nucleotide sequences of LOC93320 BINDING SITE, designated SEQ ID:35656, to the nucleotide sequence of VGAM2349 RNA, herein designated VGAM RNA, also designated SEQ ID:5060.

Another function of VGAM2349 is therefore inhibition of LOC93320 (Accession XM_050534). Accordingly, utilities of VGAM2349 include diagnosis, prevention and treatment of diseases and clinical conditions associated with LOC93320. FIG. 1 further provides a conceptual description of a novel bioinformatically detected viral gene of the present invention, referred to here as Viral Genomic Address Messenger 2350 (VGAM2350) viral gene, which modulates expression of respective host target genes thereof, the function and utility of which host target genes is known in the art.

VGAM2350 is a novel bioinformatically detected regulatory, non protein coding, viral micro RNA (miRNA) gene. The method by which VGAM2350 was detected is described hereinabove with reference to FIGS. 1-8.

VGAM2350 gene, herein designated VGAM GENE, is a viral gene contained in the genome of Equine Herpesvirus 2. VGAM2350 host target gene, herein designated VGAM HOST TARGET GENE, is a human gene contained in the human genome.

VGAM2350 gene encodes a VGAM2350 precursor RNA, herein designated VGAM PRECURSOR RNA. Similar to other miRNA genes, and unlike most ordinary genes, VGAM2350 precursor RNA does not encode a protein. A nucleotide sequence identical or highly similar to the nucleotide sequence of VGAM2350 precursor RNA is designated SEQ ID:2336, and is provided hereinbelow with reference to the sequence listing part. Nucleotide sequence SEQ ID:2336 is located at position 13649 relative to the genome of Equine Herpesvirus 2.

VGAM2350 precursor RNA folds onto itself, forming VGAM2350 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2350 folded precursor RNA into VGAM2350 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2350 RNA is designated SEQ ID:5061, and is provided hereinbelow with reference to the sequence listing part.

VGAM2350 host target gene, herein designated VGAM HOST TARGET GENE, encodes a corresponding messenger RNA, VGAM2350 host target RNA, herein designated VGAM HOST TARGET RNA. VGAM2350 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2350 RNA, herein designated VGAM RNA, binds complementarily to one or more host target binding sites located in untranslated regions of VGAM2350 host target RNA, herein designated VGAM HOST TARGET RNA. This complementary binding is due to the fact that the nucleotide sequence of VGAM2350 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2350 RNA, herein designated VGAM RNA, may have a different number of host target binding sites in untranslated regions of a VGAM2350 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2350 RNA, herein designated VGAM RNA, to host target binding sites on VGAM2350 host target RNA, herein designated VGAM HOST TARGET RNA, such as BINDING SITE I, BINDING SITE II and BINDING SITE III, inhibits translation of VGAM2350 host target RNA into VGAM2350 host target protein, herein designated VGAM HOST TARGET PROTEIN. VGAM host target protein is therefore outlined by a broken line.

It is appreciated that VGAM2350 host target gene, herein designated VGAM HOST TARGET GENE, in fact represents a plurality of VGAM2350 host target genes. The mRNA of each one of this plurality of VGAM2350 host target genes comprises one or more host target binding sites, each having a nucleotide sequence which is at least partly complementary to VGAM2350 RNA, herein designated VGAM RNA, and which when bound by VGAM2350 RNA causes inhibition of translation of respective one or more VGAM2350 host target proteins.

It is further appreciated by one skilled in the art that the mode of translational inhibition illustrated by FIG. 1 with specific reference to translational inhibition exerted by VGAM2350 gene, herein designated VGAM GENE, on one or more VGAM2350 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2350 is inhibition of expression of host target genes, as part of a novel viral mechanism of attacking a host. Accordingly, utilities of VGAM2350 include diagnosis, prevention and treatment of viral infection by Equine Herpesvirus 2. Specific functions, and accordingly utilities, of VGAM2350 correlate with, and may be deduced from, the identity of the host target genes which VGAM2350 binds and inhibits, and the function of these host target genes, as elaborated hereinbelow.

Nucleotide sequences of the VGAM2350 precursor RNA, herein designated VGAM PRECURSOR RNA, and of the 'diced' VGAM2350 RNA, herein designated VGAM RNA, and a schematic representation of the secondary folding of VGAM2350 folded precursor RNA, herein designated VGAM FOLDED PRECURSOR RNA, of VGAM2350 are further described hereinbelow with reference to Table 1.

Nucleotide sequences of host target binding sites, such as BINDING SITE-I, BINDING SITE-II and BINDING SITE-III of FIG. 1, found on VGAM2350 host target RNA, and schematic representation of the complementarity of each of these host target binding sites to VGAM2350 RNA, herein designated VGAM RNA, are described hereinbelow with reference to Table 2.

As mentioned hereinabove with reference to FIG. 1, a function of VGAM2350 gene, herein designated VGAM is inhibition of expression of VGAM2350 target genes. It is appreciated that specific functions, and accordingly utilities, of VGAM2350 correlate with, and may be deduced from, the identity of the target genes which VGAM2350 binds and inhibits, and the function of these target genes, as elaborated hereinbelow.

A Disintegrin and Metalloproteinase Domain 8 (ADAM8, Accession NM_001109) is a VGAM2350 host target gene. ADAM8 BINDING SITE is HOST TARGET binding site found in the 3' untranslated region of mRNA encoded by ADAM8, corresponding to a HOST TARGET binding site such as BINDING SITE I, BINDING SITE II or BINDING SITE III. Table 2 illustrates the complementarity of the nucleotide sequences of ADAM8 BINDING SITE, designated SEQ ID:6766, to the nucleotide sequence of VGAM2350 RNA, herein designated VGAM RNA, also designated SEQ ID:5061.

A function of VGAM2350 is therefore inhibition of A Disintegrin and Metalloproteinase Domain 8 (ADAM8, Accession NM_001109). Accordingly, utilities of VGAM2350 include diagnosis, prevention and treatment of diseases and clinical conditions associated with ADAM8. Bone Morphogenetic Protein 1 (BMP1, Accession NM_006131) is another VGAM2350 host target gene. BMP1 BINDING SITE1 and BMP1 BINDING SITE2 are HOST TARGET binding sites found in untranslated regions of mRNA encoded by BMP1, corresponding to HOST TARGET binding sites such as BINDING SITE I, BINDING SITE II or BINDING SITE III. Table 2 illustrates the complementarity of the nucleotide sequences of BMP1 BINDING SITE1 and BMP1 BINDING SITE2, designated SEQ ID:12771 and SEQ ID:12774 respectively, to the nucleotide sequence of VGAM2350 RNA, herein designated VGAM RNA, also designated SEQ ID:5061.

Another function of VGAM2350 is therefore inhibition of Bone Morphogenetic Protein 1 (BMP1, Accession NM_006131), a gene which cleaves procollagens leading to formation of extracellular matrix. Accordingly, utilities of VGAM2350 include diagnosis, prevention and treatment of diseases and clinical conditions associated with BMP1. The function of BMP1 and its association with various diseases and clinical conditions, has been established by previous studies, as described hereinabove with reference to VGAM247. Integrin, Alpha L (antigen CD11A (p180), Lymphocyte Function-associated Antigen 1; Alpha Polypeptide) (ITGAL, Accession NM_002209) is another VGAM2350 host target gene. ITGAL BINDING SITE is HOST TARGET binding site found in the 3' untranslated region of mRNA encoded by ITGAL, corresponding to a HOST TARGET binding site such as BINDING SITE I, BINDING SITE II or BINDING SITE III. Table 2 illustrates the complementarity of the nucleotide sequences of ITGAL BINDING SITE, designated SEQ ID:7970, to the nucleotide sequence of VGAM2350 RNA, herein designated VGAM RNA, also designated SEQ ID:5061.

Another function of VGAM2350 is therefore inhibition of Integrin, Alpha L (antigen CD11A (p180), Lymphocyte Function-associated Antigen 1; Alpha Polypeptide) (ITGAL, Accession NM_002209), a gene which s a receptor for icam1, icam2, icam3 and icam4. it is involved in a variety of immune phenomena including leukocyte-endothelial cell interaction, cytotoxic t-cell mediated killing, and antibody dependent killing by granulocytes and monocytes. Accordingly, utilities of VGAM2350 include diagnosis, prevention and treatment of diseases and clinical conditions associated with ITGAL. The function of ITGAL and its association with various diseases and clinical conditions, has been established by previous studies, as described hereinabove with reference to VGAM200. Laminin, Gamma 1 (formerly LAMB2) (LAMC1, Accession NM_002293) is another VGAM2350 host target gene. LAMC1 BINDING SITE is HOST TARGET binding site found in the 5' untranslated region of mRNA encoded by LAMC1, corresponding to a HOST TARGET binding site such as BINDING SITE I, BINDING SITE II or BINDING SITE III. Table 2 illustrates the complementarity of the nucleotide sequences of LAMC1 BINDING SITE, designated SEQ ID:8076, to the nucleotide sequence of VGAM2350 RNA, herein designated VGAM RNA, also designated SEQ ID:5061.

Another function of VGAM2350 is therefore inhibition of Laminin, Gamma 1 (formerly LAMB2) (LAMC1, Accession NM_002293), a gene which may mediate the attachment, migration, and organization of cells into tissues. Accordingly, utilities of VGAM2350 include diagnosis, prevention and treatment of diseases and clinical conditions associated with LAMC1. The function of LAMC1 and its association with various diseases and clinical conditions, has been established by previous studies, as described hereinabove with reference to VGAM812. P3 (Accession NM_019848) is another VGAM2350 host target gene. P3 BINDING SITE is HOST TARGET binding site found in the 5" untranslated region of mRNA encoded by P3, corresponding to a HOST TARGET binding site such as BINDING SITE I, BINDING SITE II or BINDING SITE III. Table 2 illustrates the complementarity of the nucleotide sequences of P3 BINDING SITE, designated SEQ ID:21255, to the nucleotide sequence of VGAM2350 RNA, herein designated VGAM RNA, also designated SEQ ID:5061.

Another function of VGAM2350 is therefore inhibition of P3 (Accession NM_019848). Accordingly, utilities of VGAM2350 include diagnosis, prevention and treatment of diseases and clinical conditions associated with P3. Presenilin 2 (Alzheimer disease 4) (PSEN2, Accession NM_000447) is another VGAM2350 host target gene. PSEN2 BINDING SITE1 and PSEN2 BINDING SITE2 are HOST TARGET binding sites found in untranslated regions of mRNA encoded by PSEN2, corresponding to HOST TARGET binding sites such as BINDING SITE I, BINDING SITE II or BINDING SITE III. Table 2 illustrates the complementarity of the nucleotide sequences of PSEN2 BINDING SITE1 and PSEN2 BINDING SITE2, designated SEQ ID:6034 and SEQ ID:14864 respectively, to the nucleotide sequence of VGAM2350 RNA, herein designated VGAM RNA, also designated SEQ ID:5061.

Another function of VGAM2350 is therefore inhibition of Presenilin 2 (Alzheimer disease 4) (PSEN2, Accession NM_000447). Accordingly, utilities of VGAM2350 include diagnosis, prevention and treatment of diseases and clinical conditions associated with PSEN2. Transglutaminase 2 (C polypeptide, protein-glutamine-gamma-glutamyltransferase) (TGM2, Accession NM_004613) is another VGAM2350 host target gene. TGM2 BINDING SITE is HOST TARGET binding site found in the 3' untranslated region of mRNA encoded by TGM2, corresponding to a HOST TARGET binding site such as BINDING SITE I, BINDING SITE II or BINDING SITE III. Table 2 illustrates the complementarity of the nucleotide sequences of TGM2 BINDING SITE, designated SEQ ID:10955, to the nucleotide sequence of VGAM2350 RNA, herein designated VGAM RNA, also designated SEQ ID:5061.

Another function of VGAM2350 is therefore inhibition of Transglutaminase 2 (C polypeptide, protein-glutamine-gamma-glutamyltransferase) (TGM2, Accession NM_004613), a gene which catalyzes the cross-linking of proteins and the conjugation of polyamines to proteins. Accordingly, utilities of VGAM2350 include diagnosis, prevention and treatment of diseases and clinical conditions associated with TGM2. The function of TGM2 and its association with various diseases and clinical conditions, has been established by previous studies, as described hereinabove with reference to VGAM899. TIC (Accession NM_012455) is another VGAM2350 host target gene. TIC BINDING SITE1 and TIC BINDING SITE2 are HOST TARGET binding sites found in untranslated regions of mRNA encoded by TIC, corresponding to HOST TARGET binding sites such as BINDING SITE I, BINDING SITE II or BINDING SITE III.

Table 2 illustrates the complementarity of the nucleotide sequences of TIC BINDING SITE1 and TIC BINDING SITE2, designated SEQ ID:14826 and SEQ ID:14827 respectively, to the nucleotide sequence of VGAM2350 RNA, herein designated VGAM RNA, also designated SEQ ID:5061.

Another function of VGAM2350 is therefore inhibition of TIC (Accession NM_012455). Accordingly, utilities of VGAM2350 include diagnosis, prevention and treatment of diseases and clinical conditions associated with TIC. Apg4B (Accession NM_013325) is another VGAM2350 host target gene. Apg4B BINDING SITE is HOST TARGET binding site found in the 3' untranslated region of mRNA encoded by Apg4B, corresponding to a HOST TARGET binding site such as BINDING SITE I, BINDING SITE II or BINDING SITE III. Table 2 illustrates the complementarity of the nucleotide sequences of Apg4B BINDING SITE, designated SEQ ID:14976, to the nucleotide sequence of VGAM2350 RNA, herein designated VGAM RNA, also designated SEQ ID:5061.

Another function of VGAM2350 is therefore inhibition of Apg4B (Accession NM_013325). Accordingly, utilities of VGAM2350 include diagnosis, prevention and treatment of diseases and clinical conditions associated with Apg4B. Chromosome 11 Open Reading Frame 9 (C11orf9, Accession NM_013279) is another VGAM2350 host target gene. C11orf9 BINDING SITE is HOST TARGET binding site found in the 3' untranslated region of mRNA encoded by C11orf9, corresponding to a HOST TARGET binding site such as BINDING SITE I, BINDING SITE II or BINDING SITE III. Table 2 illustrates the complementarity of the nucleotide sequences of C11orf9 BINDING SITE, designated SEQ ID:14945, to the nucleotide sequence of VGAM2350 RNA, herein designated VGAM RNA, also designated SEQ ID:5061.

Another function of VGAM2350 is therefore inhibition of Chromosome 11 Open Reading Frame 9 (C11orf9, Accession NM_013279). Accordingly, utilities of VGAM2350 include diagnosis, prevention and treatment of diseases and clinical conditions associated with C11orf9. Calcium Channel, Voltage-dependent, Alpha 1H Subunit (CACNA1H, Accession NM_021098) is another VGAM2350 host target gene. CACNA1H BINDING SITE is HOST TARGET binding site found in the 5' untranslated region of mRNA encoded by CACNA1H, corresponding to a HOST TARGET binding site such as BINDING SITE I, BINDING SITE II or BINDING SITE III. Table 2 illustrates the complementarity of the nucleotide sequences of CACNA1H BINDING SITE, designated SEQ ID:22077, to the nucleotide sequence of VGAM2350 RNA, herein designated VGAM RNA, also designated SEQ ID:5061.

Another function of VGAM2350 is therefore inhibition of Calcium Channel, Voltage-dependent, Alpha 1H Subunit (CACNA1H, Accession NM_021098). Accordingly, utilities of VGAM2350 include diagnosis, prevention and treatment of diseases and clinical conditions associated with CACNA1H. Cat Eye Syndrome Chromosome Region, Candidate 7 (CECR7, Accession XM_086803) is another VGAM2350 host target gene. CECR7 BINDING SITE is HOST TARGET binding site found in the 5' untranslated region of mRNA encoded by CECR7, corresponding to a HOST TARGET binding site such as BINDING SITE I, BINDING SITE II or BINDING SITE III. Table 2 illustrates the complementarity of the nucleotide sequences of CECR7 BINDING SITE, designated SEQ ID:38878, to the nucleotide sequence of VGAM2350 RNA, herein designated VGAM RNA, also designated SEQ ID:5061.

Another function of VGAM2350 is therefore inhibition of Cat Eye Syndrome Chromosome Region, Candidate 7 (CECR7, Accession XM_086803). Accordingly, utilities of VGAM2350 include diagnosis, prevention and treatment of diseases and clinical conditions associated with CECR7. Chorionic Gonadotropin, Beta Polypeptide 7 (CGB7, Accession NM_033142) is another VGAM2350 host target gene. CGB7 BINDING SITE is HOST TARGET binding site found in the 5' untranslated region of mRNA encoded by CGB7, corresponding to a HOST TARGET binding site such as BINDING SITE I, BINDING SITE II or BINDING SITE III. Table 2 illustrates the complementarity of the nucleotide sequences of CGB7 BINDING SITE, designated SEQ ID:26993, to the nucleotide sequence of VGAM2350 RNA, herein designated VGAM RNA, also designated SEQ ID:5061.

Another function of VGAM2350 is therefore inhibition of Chorionic Gonadotropin, Beta Polypeptide 7 (CGB7, Accession NM_033142). Accordingly, utilities of VGAM2350 include diagnosis, prevention and treatment of diseases and clinical conditions associated with CGB7. CRMP5 (Accession NM_020134) is another VGAM2350 host target gene. CRMP5 BINDING SITE is HOST TARGET binding site found in the 3' untranslated region of mRNA encoded by CRMP5, corresponding to a HOST TARGET binding site such as BINDING SITE I, BINDING SITE II or BINDING SITE III. Table 2 illustrates the complementarity of the nucleotide sequences of CRMP5 BINDING SITE, designated SEQ ID:21332, to the nucleotide sequence of VGAM2350 RNA, herein designated VGAM RNA, also designated SEQ ID:5061.

Another function of VGAM2350 is therefore inhibition of CRMP5 (Accession NM_020134). Accordingly, utilities of VGAM2350 include diagnosis, prevention and treatment of diseases and clinical conditions associated with CRMP5. FLJ11160 (Accession NM_018344) is another VGAM2350 host target gene. FLJ11160 BINDING SITE is HOST TARGET binding site found in the 3' untranslated region of mRNA encoded by FLJ11160, corresponding to a HOST TARGET binding site such as BINDING SITE I, BINDING SITE II or BINDING SITE III. Table 2 illustrates the complementarity of the nucleotide sequences of FLJ11160 BINDING SITE, designated SEQ ID:20352, to the nucleotide sequence of VGAM2350 RNA, herein designated VGAM RNA, also designated SEQ ID:5061.

Another function of VGAM2350 is therefore inhibition of FLJ11160 (Accession NM_018344). Accordingly, utilities of VGAM2350 include diagnosis, prevention and treatment of diseases and clinical conditions associated with FLJ11160. FLJ12438 (Accession NM_021933) is another VGAM2350 host target gene. FLJ12438 BINDING SITE is HOST TARGET binding site found in the 5' untranslated region of mRNA encoded by FLJ12438, corresponding to a HOST TARGET binding site such as BINDING SITE I, BINDING SITE II or BINDING SITE III. Table 2 illustrates the complementarity of the nucleotide sequences of FLJ12438 BINDING SITE, designated SEQ ID:22455, to the nucleotide sequence of VGAM2350 RNA, herein designated VGAM RNA, also designated SEQ ID:5061.

Another function of VGAM2350 is therefore inhibition of FLJ12438 (Accession NM_021933). Accordingly, utilities of VGAM2350 include diagnosis, prevention and treatment of diseases and clinical conditions associated with FLJ12438. FLJ14957 (Accession NM_032866) is another VGAM2350 host target gene. FLJ14957 BINDING SITE is HOST TARGET binding site found in the 3' untranslated region of mRNA encoded by FLJ14957, corresponding to a HOST TARGET binding site such as BINDING SITE I, BINDING SITE II or BINDING SITE III. Table 2 illustrates the complementarity of the nucleotide sequences of FLJ14957 BINDING SITE, designated SEQ ID:26682, to the nucleotide sequence of VGAM2350 RNA, herein designated VGAM RNA, also designated SEQ ID:5061.

Another function of VGAM2350 is therefore inhibition of FLJ14957 (Accession NM_032866). Accordingly, utilities of VGAM2350 include diagnosis, prevention and treatment of diseases and clinical conditions associated with FLJ14957. FLJ22195 (Accession NM_022758) is another VGAM2350 host target gene. FLJ22195 BINDING SITE is HOST TARGET binding site found in the 5' untranslated region of mRNA encoded by FLJ22195, corresponding to a HOST TARGET binding site such as BINDING SITE I, BINDING SITE II or BINDING SITE III. Table 2 illustrates the complementarity of the nucleotide sequences of FLJ22195 BINDING SITE, designated SEQ ID:22998, to the nucleotide sequence of VGAM2350 RNA, herein designated VGAM RNA, also designated SEQ ID:5061.

Another function of VGAM2350 is therefore inhibition of FLJ22195 (Accession NM_022758). Accordingly, utilities of VGAM2350 include diagnosis, prevention and treatment of diseases and clinical conditions associated with FLJ22195. FLJ23306 (Accession NM_024530) is another VGAM2350 host target gene. FLJ23306 BINDING SITE is HOST TARGET binding site found in the 5' untranslated region of mRNA encoded by FLJ23306, corresponding to a HOST TARGET binding site such as BINDING SITE I, BINDING SITE II or BINDING SITE III. Table 2 illustrates the complementarity of the nucleotide sequences of FLJ23306 BINDING SITE, designated SEQ ID:23734, to the nucleotide sequence of VGAM2350 RNA, herein designated VGAM RNA, also designated SEQ ID:5061.

Another function of VGAM2350 is therefore inhibition of FLJ23306 (Accession NM_024530). Accordingly, utilities of VGAM2350 include diagnosis, prevention and treatment of diseases and clinical conditions associated with FLJ23306. Junctional Adhesion Molecule 1 (JAM1, Accession NM_144503) is another VGAM2350 host target gene. JAM1 BINDING SITE is HOST TARGET binding site found in the 5' untranslated region of mRNA encoded by JAM1, corresponding to a HOST TARGET binding site such as BINDING SITE I, BINDING SITE II or BINDING SITE III. Table 2 illustrates the complementarity of the nucleotide sequences of JAM1 BINDING SITE, designated SEQ ID:29339, to the nucleotide sequence of VGAM2350 RNA, herein designated VGAM RNA, also designated SEQ ID:5061.

Another function of VGAM2350 is therefore inhibition of Junctional Adhesion Molecule 1 (JAM1, Accession NM_144503). Accordingly, utilities of VGAM2350 include diagnosis, prevention and treatment of diseases and clinical conditions associated with JAM1. K-ALPHA-1 (Accession XM_084866) is another VGAM2350 host target gene. K-ALPHA-1 BINDING SITE is HOST TARGET binding site found in the 5' untranslated region of mRNA encoded by K-ALPHA-1, corresponding to a HOST TARGET binding site such as BINDING SITE I, BINDING SITE II or BINDING SITE III. Table 2 illustrates the complementarity of the nucleotide sequences of K-ALPHA-1 BINDING SITE, designated SEQ ID:37743, to the nucleotide sequence of VGAM2350 RNA, herein designated VGAM RNA, also designated SEQ ID:5061.

Another function of VGAM2350 is therefore inhibition of K-ALPHA-1 (Accession XM_084866). Accordingly, utilities of VGAM2350 include diagnosis, prevention and treatment of diseases and clinical conditions associated with K-ALPHA-1. KIAA0544 (Accession XM_048119) is another VGAM2350 host target gene. KIAA0544 BINDING SITE is HOST TARGET binding site found in the 3' untranslated region of mRNA encoded by KIAA0544, corresponding to a HOST TARGET binding site such as BINDING SITE I, BINDING SITE II or BINDING SITE III. Table 2 illustrates the complementarity of the nucleotide sequences of KIAA0544 BINDING SITE, designated SEQ ID:35111, to the nucleotide sequence of VGAM2350 RNA, herein designated VGAM RNA, also designated SEQ ID:5061.

Another function of VGAM2350 is therefore inhibition of KIAA0544 (Accession XM_048119). Accordingly, utilities of VGAM2350 include diagnosis, prevention and treatment of diseases and clinical conditions associated with KIAA0544. KIAA0789 (Accession XM_033113) is another VGAM2350 host target gene. KIAA0789 BINDING SITE is HOST TARGET binding site found in the 5' untranslated region of mRNA encoded by KIAA0789, corresponding to a HOST TARGET binding site such as BINDING SITE I, BINDING SITE II or BINDING SITE III. Table 2 illustrates the complementarity of the nucleotide sequences of KIAA0789 BINDING SITE, designated SEQ ID:31847, to the nucleotide sequence of VGAM2350 RNA, herein designated VGAM RNA, also designated SEQ ID:5061.

Another function of VGAM2350 is therefore inhibition of KIAA0789 (Accession XM_033113). Accordingly, utilities of VGAM2350 include diagnosis, prevention and treatment of diseases and clinical conditions associated with KIAA0789. KIAA0945 (Accession NM_014952) is another VGAM2350 host target gene. KIAA0945 BINDING SITE is HOST TARGET binding site found in the 3' untranslated region of mRNA encoded by KIAA0945, corresponding to a HOST TARGET binding site such as BINDING SITE I, BINDING SITE II or BINDING SITE III. Table 2 illustrates the complementarity of the nucleotide sequences of KIAA0945 BINDING SITE, designated SEQ ID:17295, to the nucleotide sequence of VGAM2350 RNA, herein designated VGAM RNA, also designated SEQ ID:5061.

Another function of VGAM2350 is therefore inhibition of KIAA0945 (Accession NM_014952). Accordingly, utilities of VGAM2350 include diagnosis, prevention and treatment of diseases and clinical conditions associated with KIAA0945. KIAA1055 (Accession XM_038509) is another VGAM2350 host target gene. KIAA1055 BINDING SITE is HOST TARGET binding site found in the 3' untranslated region of mRNA encoded by KIAA1055, corresponding to a HOST TARGET binding site such as BINDING SITE I, BINDING SITE II or BINDING SITE III. Table 2 illustrates the complementarity of the nucleotide sequences of KIAA1055 BINDING SITE, designated SEQ ID:32851, to the nucleotide sequence of VGAM2350 RNA, herein designated VGAM RNA, also designated SEQ ID:5061.

Another function of VGAM2350 is therefore inhibition of KIAA1055 (Accession XM_038509). Accordingly, utilities of VGAM2350 include diagnosis, prevention and treatment of diseases and clinical conditions associated with KIAA1055. KIAA1762 (Accession XM_033370) is another VGAM2350 host target gene. KIAA1762 BINDING SITE is HOST TARGET binding site found in the 3' untranslated region of mRNA encoded by KIAA1762, corresponding to a HOST TARGET binding site such as BINDING SITE I, BINDING SITE II or BINDING SITE III. Table 2 illustrates the complementarity of the nucleotide sequences of KIAA1762 BINDING SITE, designated SEQ ID:31912, to the nucleotide sequence of VGAM2350 RNA, herein designated VGAM RNA, also designated SEQ ID:5061.

Another function of VGAM2350 is therefore inhibition of KIAA1762 (Accession XM_033370). Accordingly, utilities of VGAM2350 include diagnosis, prevention and treatment of diseases and clinical conditions associated with KIAA1762. KIAA1906 (Accession XM_055095) is another VGAM2350 host target gene. KIAA1906 BINDING SITE is HOST TARGET binding site found in the 3' untranslated region of mRNA encoded by KIAA1906, corresponding to a HOST TARGET binding site such as BINDING SITE I, BINDING SITE II or BINDING SITE III. Table 2 illustrates the complementarity of the nucleotide sequences of KIAA1906 BINDING SITE, designated SEQ ID:36228, to the nucleotide sequence of VGAM2350 RNA, herein designated VGAM RNA, also designated SEQ ID:5061.

Another function of VGAM2350 is therefore inhibition of KIAA1906 (Accession XM_055095). Accordingly, utilities of VGAM2350 include diagnosis, prevention and treatment of diseases and clinical conditions associated with KIAA1906. Mitogen-activated Protein Kinase Kinase Kinase 3 (MAP3K3, Accession NM_002401) is another VGAM2350 host target gene. MAP3K3 BINDING SITE is HOST TARGET binding site found in the 3' untranslated region of mRNA encoded by MAP3K3, corresponding to a HOST TARGET binding site such as BINDING SITE I, BINDING SITE II or BINDING SITE III. Table 2 illustrates the complementarity of the nucleotide sequences of MAP3K3 BINDING SITE, designated SEQ ID:8221, to the nucleotide sequence of VGAM2350 RNA, herein designated VGAM RNA, also designated SEQ ID:5061.

Another function of VGAM2350 is therefore inhibition of Mitogen-activated Protein Kinase Kinase Kinase 3 (MAP3K3, Accession NM_002401). Accordingly, utilities of VGAM2350 include diagnosis, prevention and treatment of diseases and clinical conditions associated with MAP3K3. MDN1, Midasin Homolog (yeast) (MDN1, Accession XM_031539) is another VGAM2350 host target gene. MDN1 BINDING SITE is HOST TARGET binding site found in the 3' untranslated region of mRNA encoded by MDN1, corresponding to a HOST TARGET binding site such as BINDING SITE I, BINDING SITE II or BINDING SITE III. Table 2 illustrates the complementarity of the nucleotide sequences of MDN1 BINDING SITE, designated SEQ ID:31410, to the nucleotide sequence of VGAM2350 RNA, herein designated VGAM RNA, also designated SEQ ID:5061.

Another function of VGAM2350 is therefore inhibition of MDN1, Midasin Homolog (yeast) (MDN1, Accession XM_031539). Accordingly, utilities of VGAM2350 include diagnosis, prevention and treatment of diseases and clinical conditions associated with MDN1. MGC13170 (Accession NM_032712) is another VGAM2350 host target gene. MGC13170 BINDING SITE is HOST TARGET binding site found in the 5' untranslated region of mRNA encoded by MGC13170, corresponding to a HOST TARGET binding site such as BINDING SITE I, BINDING SITE II or BINDING SITE III. Table 2 illustrates the complementarity of the nucleotide sequences of MGC13170 BINDING SITE, designated SEQ ID:26433, to the nucleotide sequence of VGAM2350 RNA, herein designated VGAM RNA, also designated SEQ ID:5061.

Another function of VGAM2350 is therefore inhibition of MGC13170 (Accession NM_032712). Accordingly, utilities of VGAM2350 include diagnosis, prevention and treatment of diseases and clinical conditions associated with MGC13170. Neuronal Pentraxin Receptor (NPTXR, Accession NM_058178) is another VGAM2350 host target gene. NPTXR BINDING SITE1 and NPTXR BINDING SITE2 are HOST TARGET binding sites found in untranslated regions of mRNA encoded by NPTXR, corresponding to HOST TARGET binding sites such as BINDING SITE I, BINDING SITE II or BINDING SITE III. Table 2 illustrates the complementarity of the nucleotide sequences of NPTXR BINDING SITE1 and NPTXR BINDING SITE2, designated SEQ ID:27733 and SEQ ID:15585 respectively, to the nucleotide sequence of VGAM2350 RNA, herein designated VGAM RNA, also designated SEQ ID:5061.

Another function of VGAM2350 is therefore inhibition of Neuronal Pentraxin Receptor (NPTXR, Accession NM_058178). Accordingly, utilities of VGAM2350 include diagnosis, prevention and treatment of diseases and clinical conditions associated with NPTXR. START Domain Containing 7 (STARD7, Accession NM_020151) is another VGAM2350 host target gene. STARD7 BINDING SITE1 through STARD7 BINDING SITE3 are HOST TARGET binding sites found in untranslated regions of mRNA encoded by STARD7, corresponding to HOST TARGET binding sites such as BINDING SITE I, BINDING SITE II or BINDING SITE III. Table 2 illustrates the complementarity of the nucleotide sequences of STARD7 BINDING SITE1 through STARD7 BINDING SITE3, designated SEQ ID:21357, SEQ ID:21358 and SEQ ID:29260 respectively, to the nucleotide sequence of VGAM2350 RNA, herein designated VGAM RNA, also designated SEQ ID:5061.

Another function of VGAM2350 is therefore inhibition of START Domain Containing 7 (STARD7, Accession NM_020151). Accordingly, utilities of VGAM2350 include diagnosis, prevention and treatment of diseases and clinical conditions associated with STARD7. LOC120425 (Accession XM_058463) is another VGAM2350 host target gene. LOC120425 BINDING SITE is HOST TARGET binding site found in the 3' untranslated region of mRNA encoded by LOC120425, corresponding to a HOST TARGET binding site such as BINDING SITE I, BINDING SITE II or BINDING SITE III. Table 2 illustrates the complementarity of the nucleotide sequences of LOC120425 BINDING SITE, designated SEQ ID:36621, to the nucleotide sequence of VGAM2350 RNA, herein designated VGAM RNA, also designated SEQ ID:5061.

Another function of VGAM2350 is therefore inhibition of LOC120425 (Accession XM_058463). Accordingly, utilities of VGAM2350 include diagnosis, prevention and treatment of diseases and clinical conditions associated with LOC120425. LOC146823 (Accession XM_097105) is another VGAM2350 host target gene. LOC146823 BINDING SITE is HOST TARGET binding site found in the 3' untranslated region of mRNA encoded by LOC146823, corresponding to a HOST TARGET binding site such as BINDING SITE I, BINDING SITE II or BINDING SITE III. Table 2 illustrates the complementarity of the nucleotide sequences of LOC146823 BINDING SITE, designated SEQ ID:40747, to the nucleotide sequence of VGAM2350 RNA, herein designated VGAM RNA, also designated SEQ ID:5061.

Another function of VGAM2350 is therefore inhibition of LOC146823 (Accession XM_097105). Accordingly, utilities of VGAM2350 include diagnosis, prevention and treatment of diseases and clinical conditions associated with LOC146823. LOC150372 (Accession XM_086893) is another VGAM2350 host target gene. LOC150372 BINDING SITE is HOST TARGET binding site found in the 3' untranslated region of mRNA encoded by LOC150372, corresponding to a HOST TARGET binding site such as BINDING SITE I, BINDING SITE II or BINDING SITE III. Table 2 illustrates the complementarity of the nucleotide sequences of LOC150372 BINDING SITE, designated SEQ ID:38941, to the nucleotide sequence of VGAM2350 RNA, herein designated VGAM RNA, also designated SEQ ID:5061.

Another function of VGAM2350 is therefore inhibition of LOC150372 (Accession XM_086893). Accordingly, utilities of VGAM2350 include diagnosis, prevention and treatment of diseases and clinical conditions associated with LOC150372. LOC151176 (Accession XM_098016) is another VGAM2350 host target gene. LOC151176 BINDING SITE is HOST TARGET binding site found in the 3' untranslated region of mRNA encoded by LOC151176, corresponding to a HOST TARGET binding site such as BINDING SITE I, BINDING SITE II or BINDING SITE III. Table 2 illustrates the complementarity of the nucleotide sequences of LOC151176 BINDING SITE, designated SEQ ID:41314, to the nucleotide sequence of VGAM2350 RNA, herein designated VGAM RNA, also designated SEQ ID:5061.

Another function of VGAM2350 is therefore inhibition of LOC151176 (Accession XM_098016). Accordingly, utilities of VGAM2350 include diagnosis, prevention and treatment of diseases and clinical conditions associated with LOC151176. LOC153577 (Accession XM_098394) is another VGAM2350 host target gene. LOC153577 BINDING SITE is HOST TARGET binding site found in the 3' untranslated region of mRNA encoded by LOC153577, corresponding to a HOST TARGET binding site such as BINDING SITE I, BINDING SITE II or BINDING SITE III. Table 2 illustrates the complementarity of the nucleotide sequences of LOC153577 BINDING SITE, designated SEQ ID:41644, to the nucleotide sequence of VGAM2350 RNA, herein designated VGAM RNA, also designated SEQ ID:5061.

Another function of VGAM2350 is therefore inhibition of LOC153577 (Accession XM_098394). Accordingly, utilities of VGAM2350 include diagnosis, prevention and treatment of diseases and clinical conditions associated with LOC153577. LOC157653 (Accession XM_088353) is another VGAM2350 host target gene. LOC157653 BINDING SITE is HOST TARGET binding site found in the 5' untranslated region of mRNA encoded by LOC157653, corresponding to a HOST TARGET binding site such as BINDING SITE I, BINDING SITE II or BINDING SITE III. Table 2 illustrates the complementarity of the nucleotide sequences of LOC157653 BINDING SITE, designated SEQ ID:39634, to the nucleotide sequence of VGAM2350 RNA, herein designated VGAM RNA, also designated SEQ ID:5061.

Another function of VGAM2350 is therefore inhibition of LOC157653 (Accession XM_088353). Accordingly, utilities of VGAM2350 include diagnosis, prevention and treatment of diseases and clinical conditions associated with LOC157653. LOC163682 (Accession XM_099402) is another VGAM2350 host target gene. LOC163682 BINDING SITE is HOST TARGET binding site found in the 5' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42095, to the nucleotide sequence of VGAM2350 RNA, herein designated VGAM RNA, also designated SEQ ID:5061.

Another function of VGAM2350 is therefore inhibition of LOC163682 (Accession XM_099402). Accordingly, utilities of VGAM2350 include diagnosis, prevention and treatment of diseases and clinical conditions associated with LOC163682. LOC222681 (Accession XM_167116) is another VGAM2350 host target gene. LOC222681 BINDING SITE is HOST TARGET binding site found in the 5' untranslated region of mRNA encoded by LOC222681, corresponding to a HOST TARGET binding site such as BIND- ING SITE I, BINDING SITE II or BINDING SITE III. Table 2 illustrates the complementarity of the nucleotide sequences of LOC222681 BINDING SITE, designated SEQ ID:44615, to the nucleotide sequence of VGAM2350 RNA, herein designated VGAM RNA, also designated SEQ ID:5061.

Another function of VGAM2350 is therefore inhibition of LOC222681 (Accession XM_167116). Accordingly, utilities of VGAM2350 include diagnosis, prevention and treatment of diseases and clinical conditions associated with LOC222681. LOC253216 (Accession XM_170765) is another VGAM2350 host target gene. LOC253216 BINDING SITE is HOST TARGET binding site found in the 3' untranslated region of mRNA encoded by LOC253216, corresponding to a HOST TARGET binding site such as BINDING SITE I, BINDING SITE II or BINDING SITE III. Table 2 illustrates the complementarity of the nucleotide sequences of LOC253216 BINDING SITE, designated SEQ ID:45518, to the nucleotide sequence of VGAM2350 RNA, herein designated VGAM RNA, also designated SEQ ID:5061.

Another function of VGAM2350 is therefore inhibition of LOC253216 (Accession XM_170765). Accordingly, utilities of VGAM2350 include diagnosis, prevention and treatment of diseases and clinical conditions associated with LOC253216. LOC257507 (Accession XM_175204) is another VGAM2350 host target gene. LOC257507 BINDING SITE is HOST TARGET binding site found in the 5' untranslated region of mRNA encoded by LOC257507, corresponding to a HOST TARGET binding site such as BINDING SITE I, BINDING SITE II or BINDING SITE III. Table 2 illustrates the complementarity of the nucleotide sequences of LOC257507 BINDING SITE, designated SEQ ID:46681, to the nucleotide sequence of VGAM2350 RNA, herein designated VGAM RNA, also designated SEQ ID:5061.

Another function of VGAM2350 is therefore inhibition of LOC257507 (Accession XM_175204). Accordingly, utilities of VGAM2350 include diagnosis, prevention and treatment of diseases and clinical conditions associated with LOC257507. LOC257625 (Accession XM_175267) is another VGAM2350 host target gene. LOC257625 BINDING SITE is HOST TARGET binding site found in the 5' untranslated region of mRNA encoded by LOC257625, corresponding to a HOST TARGET binding site such as BINDING SITE I, BINDING SITE II or BINDING SITE III. Table 2 illustrates the complementarity of the nucleotide sequences of LOC257625 BINDING SITE, designated SEQ ID:46737, to the nucleotide sequence of VGAM2350 RNA, herein designated VGAM RNA, also designated SEQ ID:5061.

Another function of VGAM2350 is therefore inhibition of LOC257625 (Accession XM_175267). Accordingly, utilities of VGAM2350 include diagnosis, prevention and treatment of diseases and clinical conditions associated with LOC257625. FIG. 1 further provides a conceptual description of a novel bioinformatically detected viral gene of the present invention, referred to here as Viral Genomic Address Messenger 2351 (VGAM2351) viral gene, which modulates expression of respective host target genes thereof, the function and utility of which host target genes is known in the art.

VGAM2351 is a novel bioinformatically detected regulatory, non protein coding, viral micro RNA (miRNA) gene. The method by which VGAM2351 was detected is described hereinabove with reference to FIGS. 1-8.

VGAM2351 gene, herein designated VGAM GENE, is a viral gene contained in the genome of Equine Herpesvirus 2. VGAM2351 host target gene, herein designated VGAM HOST TARGET GENE, is a human gene contained in the human genome.

VGAM2351 gene encodes a VGAM2351 precursor RNA, herein designated VGAM PRECURSOR RNA. Similar to other miRNA genes, and unlike most ordinary genes, VGAM2351 precursor RNA does not encode a protein. A nucleotide sequence identical or highly similar to the nucleotide sequence of VGAM2351 precursor RNA is designated SEQ ID:2337, and is provided hereinbelow with reference to the sequence listing part. Nucleotide sequence SEQ ID:2337 is located at position 28694 relative to the genome of Equine Herpesvirus 2.

VGAM2351 precursor RNA folds onto itself, forming VGAM2351 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2351 folded precursor RNA into VGAM2351 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM2351 RNA is designated SEQ ID:5062, and is provided hereinbelow with reference to the sequence listing part.

VGAM2351 host target gene, herein designated VGAM HOST TARGET GENE, encodes a corresponding messenger RNA, VGAM2351 host target RNA, herein designated VGAM HOST TARGET RNA. VGAM2351 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2351 RNA, herein designated VGAM RNA, binds complementarily to one or more host target binding sites located in untranslated regions of VGAM2351 host target RNA, herein designated VGAM HOST TARGET RNA. This complementary binding is due to the fact that the nucleotide sequence of VGAM2351 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2351 RNA, herein designated VGAM RNA, may have a different number of host target binding sites in untranslated regions of a VGAM2351 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2351 RNA, herein designated VGAM RNA, to host target binding sites on VGAM2351 host target RNA, herein designated VGAM HOST TARGET RNA, such as BINDING SITE I, BINDING SITE II and BINDING SITE III, inhibits translation of VGAM2351 host target RNA into VGAM2351 host target protein, herein designated VGAM HOST TARGET PRO- TEIN. VGAM host target protein is therefore outlined by a broken line.

It is appreciated that VGAM2351 host target gene, herein designated VGAM HOST TARGET GENE, in fact represents a plurality of VGAM2351 host target genes. The mRNA of each one of this plurality of VGAM2351 host target genes comprises one or more host target binding sites, each having a nucleotide sequence which is at least partly complementary to VGAM2351 RNA, herein designated VGAM RNA, and which when bound by VGAM2351 RNA causes inhibition of translation of respective one or more VGAM2351 host target proteins.

It is further appreciated by one skilled in the art that the mode of translational inhibition illustrated by FIG. 1 with specific reference to translational inhibition exerted by VGAM2351 gene, herein designated VGAM GENE, on one or more VGAM2351 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2351 is inhibition of expression of host target genes, as part of a novel viral mechanism of attacking a host. Accordingly, utilities of VGAM2351 include diagnosis, prevention and treatment of viral infection by Equine Herpesvirus 2. Specific functions, and accordingly utilities, of VGAM2351 correlate with, and may be deduced from, the identity of the host target genes which VGAM2351 binds and inhibits, and the function of these host target genes, as elaborated hereinbelow.

Nucleotide sequences of the VGAM2351 precursor RNA, herein designated VGAM PRECURSOR RNA, and of the 'diced' VGAM2351 RNA, herein designated VGAM RNA, and a schematic representation of the secondary folding of VGAM2351 folded precursor RNA, herein designated VGAM FOLDED PRECURSOR RNA, of VGAM2351 are further described hereinbelow with reference to Table 1.

Nucleotide sequences of host target binding sites, such as BINDING SITE-I, BINDING SITE-II and BINDING SITE-III of FIG. 1, found on VGAM2351 host target RNA, and schematic representation of the complementarity of each of these host target binding sites to VGAM2351 RNA, herein designated VGAM RNA, are described hereinbelow with reference to Table 2.

As mentioned hereinabove with reference to FIG. 1, a function of VGAM2351 gene, herein designated VGAM is inhibition of expression of VGAM2351 target genes. It is appreciated that specific functions, and accordingly utilities, of VGAM2351 correlate with, and may be deduced from, the identity of the target genes which VGAM2351 binds and inhibits, and the function of these target genes, as elaborated hereinbelow.

A Disintegrin-like and Metalloprotease (reprolysin type) with Thrombospondin Type 1 Motif, 4 (ADAMTS4, Accession NM_005099) is a VGAM2351 host target gene. ADAMTS4 BINDING SITE is HOST TARGET binding site found in the 3' untranslated region of mRNA encoded by ADAMTS4, corresponding to a HOST TARGET binding site such as BINDING SITE I, BINDING SITE II or BINDING SITE III. Table 2 illustrates the complementarity of the nucleotide sequences of ADAMTS4 BINDING SITE, designated SEQ ID:11569, to the nucleotide sequence of VGAM2351 RNA, herein designated VGAM RNA, also designated SEQ ID:5062.

A function of VGAM2351 is therefore inhibition of A Disintegrin-like and Metalloprotease (reprolysin type) with Thrombospondin Type 1 Motif, 4 (ADAMTS4, Accession NM_005099), a gene which cleaves aggrecan, a cartilage proteoglycan, and may be involved in its turnover. Accordingly, utilities of VGAM2351 include diagnosis, prevention and treatment of diseases and clinical conditions associated with ADAMTS4. The function of ADAMTS4 and its association with various diseases and clinical conditions, has been established by previous studies, as described hereinabove with reference to VGAM809. Activating Transcription Factor 7 (ATF7, Accession NM_006856) is another VGAM2351 host target gene. ATF7 BINDING SITE is HOST TARGET binding site found in the 3' untranslated region of mRNA encoded by ATF7, corresponding to a HOST TARGET binding site such as BINDING SITE I, BINDING SITE II or BINDING SITE III. Table 2 illustrates the complementarity of the nucleotide sequences of ATF7 BINDING SITE, designated SEQ ID:13725, to the nucleotide sequence of VGAM2351 RNA, herein designated VGAM RNA, also designated SEQ ID:5062.

Another function of VGAM2351 is therefore inhibition of Activating Transcription Factor 7 (ATF7, Accession NM_006856). Accordingly, utilities of VGAM2351 include diagnosis, prevention and treatment of diseases and clinical conditions associated with ATF7. Glucose-6-phosphatase, Catalytic (glycogen storage disease type I, von Gierke disease) (G6PC, Accession NM_000151) is another VGAM2351 host target gene. G6PC BINDING SITE is HOST TARGET binding site found in the 3' untranslated region of mRNA encoded by G6PC, corresponding to a HOST TARGET binding site such as BINDING SITE I, BINDING SITE II or BINDING SITE III. Table 2 illustrates the complementarity of the nucleotide sequences of G6PC BINDING SITE, designated SEQ ID:5658, to the nucleotide sequence of VGAM2351 RNA, herein designated VGAM RNA, also designated SEQ ID:5062.

Another function of VGAM2351 is therefore inhibition of Glucose-6-phosphatase, Catalytic (glycogen storage disease type I, von Gierke disease) (G6PC, Accession NM_000151). Accordingly, utilities of VGAM2351 include diagnosis, prevention and treatment of diseases and clinical conditions associated with G6PC. Huntingtin (Huntington disease) (HD, Accession NM_002111) is another VGAM2351 host target gene. HD BINDING SITE is HOST TARGET binding site found in the 3' untranslated region of mRNA encoded by HD, corresponding to a HOST TARGET binding site such as BINDING SITE I, BINDING SITE II or BINDING SITE III. Table 2 illustrates the complementarity of the nucleotide sequences of HD BINDING SITE, designated SEQ ID:7897, to the nucleotide sequence of VGAM2351 RNA, herein designated VGAM RNA, also designated SEQ ID:5062.

Another function of VGAM2351 is therefore inhibition of Huntingtin (Huntington disease) (HD, Accession NM_002111). Accordingly, utilities of VGAM2351 include diagnosis, prevention and treatment of diseases and clinical conditions associated with HD. Interleukin-1 Receptor-associated Kinase 4 (IRAK4, Accession XM_028349) is another VGAM2351 host target gene. IRAK4 BINDING SITE is HOST TARGET binding site found in the 3' untranslated region of mRNA encoded by IRAK4, corresponding to a HOST TARGET binding site such as BINDING SITE I, BINDING SITE II or BINDING SITE III. Table 2 illustrates the complementarity of the nucleotide sequences of IRAK4 BINDING SITE, designated SEQ ID:30691, to the nucleotide sequence of VGAM2351 RNA, herein designated VGAM RNA, also designated SEQ ID:5062.

Another function of VGAM2351 is therefore inhibition of Interleukin-1 Receptor-associated Kinase 4 (IRAK4, Accession XM_028349), a gene which may function as an IRAK1 kinase, triggering a cascade of phosphorylation events. Accordingly, utilities of VGAM2351 include diagnosis, prevention and treatment of diseases and clinical conditions associated with IRAK4. The function of IRAK4 and its association with various diseases and clinical conditions, has been established by previous studies, as described hereinabove with reference to VGAM1291. NDRG Family Member 3 (NDRG3, Accession NM_032013) is another VGAM2351 host target gene. NDRG3 BINDING SITE is HOST TARGET binding site found in the 3' untranslated region of mRNA encoded by NDRG3, corresponding to a HOST TARGET binding site such as BINDING SITE I, BINDING SITE II or BINDING SITE III. Table 2 illustrates the complementarity of the nucleotide sequences of NDRG3 BINDING SITE, designated SEQ ID:25726, to the nucleotide sequence of VGAM2351 RNA, herein designated VGAM RNA, also designated SEQ ID:5062.

Another function of VGAM2351 is therefore inhibition of NDRG Family Member 3 (NDRG3, Accession NM_032013). Accordingly, utilities of VGAM2351 include diagnosis, prevention and treatment of diseases and clinical conditions associated with NDRG3. Regenerating Islet-derived-like, Pancreatic Stone Protein-like, Pancreatic Thread Protein-like (rat) (REGL, Accession NM_006508) is another VGAM2351 host target gene. REGL BINDING SITE is HOST TARGET binding site found in the 3' untranslated region of mRNA encoded by REGL, corresponding to a HOST TARGET binding site such as BINDING SITE I, BINDING SITE II or BINDING SITE III. Table 2 illustrates the complementarity of the nucleotide sequences of REGL BINDING SITE, designated SEQ ID:13256, to the nucleotide sequence of VGAM2351 RNA, herein designated VGAM RNA, also designated SEQ ID:5062.

Another function of VGAM2351 is therefore inhibition of Regenerating Islet-derived-like, Pancreatic Stone Protein-like, Pancreatic Thread Protein-like (rat) (REGL, Accession NM_006508), a gene which is a member of REG family with unknown function. Accordingly, utilities of VGAM2351 include diagnosis, prevention and treatment of diseases and clinical conditions associated with REGL. The function of REGL and its association with various diseases and clinical conditions, has been established by previous studies, as described hereinabove with reference to VGAM200. SMT3 Suppressor of Mif Two 3 Homolog 1 (yeast) (SMT3H1, Accession XM_009805) is another VGAM2351 host target gene. SMT3H1 BINDING SITE is HOST TARGET binding site found in the 3' untranslated region of mRNA encoded by SMT3H1, corresponding to a HOST TARGET binding site such as BINDING SITE I, BINDING SITE II or BINDING SITE III. Table 2 illustrates the complementarity of the nucleotide sequences of SMT3H1 BINDING SITE, designated SEQ ID:30126, to the nucleotide sequence of VGAM2351 RNA, herein designated VGAM RNA, also designated SEQ ID:5062.

Another function of VGAM2351 is therefore inhibition of SMT3 Suppressor of Mif Two 3 Homolog 1 (yeast) (SMT3H1, Accession XM_009805), a gene which is involved in the function and/or structure of the eukaryotic kinetochore. Accordingly, utilities of VGAM2351 include diagnosis, prevention and treatment of diseases and clinical conditions associated with SMT3H1. The function of SMT3H1 and its association with various diseases and clinical conditions, has been established by previous studies, as described hereinabove with reference to VGAM119. FLJ13102 (Accession NM_024887) is another VGAM2351 host target gene. FLJ13102 BINDING SITE is HOST TARGET binding site found in the 3' untranslated region of mRNA encoded by FLJ13102, corresponding to a HOST TARGET binding site such as BINDING SITE I, BINDING SITE II or BINDING SITE III. Table 2 illustrates the complementarity of the nucleotide sequences of FLJ13102 BINDING SITE, designated SEQ ID:24344, to the nucleotide sequence of VGAM2351 RNA, herein designated VGAM RNA, also designated SEQ ID:5062.

Another function of VGAM2351 is therefore inhibition of FLJ13102 (Accession NM_024887). Accordingly, utilities of VGAM2351 include diagnosis, prevention and treatment of diseases and clinical conditions associated with FLJ13102. FLJ20320 (Accession NM_017765) is another VGAM2351 host target gene. FLJ20320 BINDING SITE is HOST TARGET binding site found in the 3' untranslated region of mRNA encoded by FLJ20320, corresponding to a HOST TARGET binding site such as BINDING SITE I, BINDING SITE II or BINDING SITE III. Table 2 illustrates the complementarity of the nucleotide sequences of FLJ20320 BINDING SITE, designated SEQ ID:19384, to the nucleotide sequence of VGAM2351 RNA, herein designated VGAM RNA, also designated SEQ ID:5062.

Another function of VGAM2351 is therefore inhibition of FLJ20320 (Accession NM_017765). Accordingly, utilities of VGAM2351 include diagnosis, prevention and treatment of diseases and clinical conditions associated with FLJ20320. FLJ20584 (Accession NM_017891) is another VGAM2351 host target gene. FLJ20584 BINDING SITE is HOST TARGET binding site found in the 3' untranslated region of mRNA encoded by FLJ20584, corresponding to a HOST TARGET binding site such as BINDING SITE I, BINDING SITE II or BINDING SITE III. Table 2 illustrates the complementarity of the nucleotide sequences of FLJ20584 BINDING SITE, designated SEQ ID:19562, to the nucleotide sequence of VGAM2351 RNA, herein designated VGAM RNA, also designated SEQ ID:5062.

Another function of VGAM2351 is therefore inhibition of FLJ20584 (Accession NM_017891). Accordingly, utilities of VGAM2351 include diagnosis, prevention and treatment of diseases and clinical conditions associated with FLJ20584. G Protein-coupled Receptor Kinase-interactor 1 (GIT1, Accession NM_014030) is another VGAM2351 host target gene. GIT1 BINDING SITE is HOST TARGET binding site found in the 3' untranslated region of mRNA encoded by GIT1, corresponding to a HOST TARGET binding site such as BINDING SITE I, BINDING SITE II or BINDING SITE III. Table 2 illustrates the complementarity of the nucleotide sequences of GIT1 BINDING SITE, designated SEQ ID:15256, to the nucleotide sequence of VGAM2351 RNA, herein designated VGAM RNA, also designated SEQ ID:5062.

Another function of VGAM2351 is therefore inhibition of G Protein-coupled Receptor Kinase-interactor 1 (GIT1, Accession NM_014030). Accordingly, utilities of VGAM2351 include diagnosis, prevention and treatment of diseases and clinical conditions associated with GIT1. KIAA0980 (Accession NM_025176) is another VGAM2351 host target gene. KIAA0980 BINDING SITE is HOST TARGET binding site found in the 3' untranslated region of mRNA encoded by KIAA0980, corresponding to a HOST TARGET binding site such as BINDING SITE I, BINDING SITE II or BINDING SITE III. Table 2 illustrates the complementarity of the nucleotide sequences of KIAA0980 BINDING SITE, designated SEQ ID:24812, to the nucleotide sequence of VGAM2351 RNA, herein designated VGAM RNA, also designated SEQ ID:5062.

Another function of VGAM2351 is therefore inhibition of KIAA0980 (Accession NM_025176). Accordingly, utilities of VGAM2351 include diagnosis, prevention and treatment of diseases and clinical conditions associated with KIAA0980. KIAA1553 (Accession XM_166320) is another VGAM2351 host target gene. KIAA1553 BINDING SITE is HOST TARGET binding site found in the 3' untranslated region of mRNA encoded by KIAA1553, corresponding to a HOST TARGET binding site such as BINDING SITE I, BINDING SITE II or BINDING SITE III. Table 2 illustrates the complementarity of the nucleotide sequences of KIAA1553 BINDING SITE, designated SEQ ID:44144, to the nucleotide sequence of VGAM2351 RNA, herein designated VGAM RNA, also designated SEQ ID:5062.

Another function of VGAM2351 is therefore inhibition of KIAA1553 (Accession XM_166320). Accordingly, utilities of VGAM2351 include diagnosis, prevention and treatment of diseases and clinical conditions associated with KIAA1553. KIAA1854 (Accession XM_049884) is another VGAM2351 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35535, to the nucleotide sequence of VGAM2351 RNA, herein designated VGAM RNA, also designated SEQ ID:5062.

Another function of VGAM2351 is therefore inhibition of KIAA1854 (Accession XM_049884). Accordingly, utilities of VGAM2351 include diagnosis, prevention and treatment of diseases and clinical conditions associated with KIAA1854. Oxysterol Binding Protein-like 8 (OSBPL8, Accession NM_020841) is another VGAM2351 host target gene. OSBPL8 BINDING SITE is HOST TARGET binding site found in the 3' untranslated region of mRNA encoded by OSBPL8, corresponding to a HOST TARGET binding site such as BINDING SITE I, BINDING SITE II or BINDING SITE III. Table 2 illustrates the complementarity of the nucleotide sequences of OSBPL8 BINDING SITE, designated SEQ ID:21910, to the nucleotide sequence of VGAM2351 RNA, herein designated VGAM RNA, also designated SEQ ID:5062.

Another function of VGAM2351 is therefore inhibition of Oxysterol Binding Protein-like 8 (OSBPL8, Accession NM_020841). Accordingly, utilities of VGAM2351 include diagnosis, prevention and treatment of diseases and clinical conditions associated with OSBPL8. PHRET1 (Accession NM_021200) is another VGAM2351 host target gene. PHRET1 BINDING SITE is HOST TARGET binding site found in the 3' untranslated region of mRNA encoded by PHRET1, corresponding to a HOST TARGET binding site such as BINDING SITE I, BINDING SITE II or BINDING SITE III. Table 2 illustrates the complementarity of the nucleotide sequences of PHRET1 BINDING SITE, designated SEQ ID:22178, to the nucleotide sequence of VGAM2351 RNA, herein designated VGAM RNA, also designated SEQ ID:5062.

Another function of VGAM2351 is therefore inhibition of PHRET1 (Accession NM_021200). Accordingly, utilities of VGAM2351 include diagnosis, prevention and treatment of diseases and clinical conditions associated with PHRET1.

Ubiquitin Specific Protease 2 (USP2, Accession NM_004205) is another VGAM2351 host target gene. USP2 BINDING SITE is HOST TARGET binding site found in the 5' untranslated region of mRNA encoded by USP2, corresponding to a HOST TARGET binding site such as BINDING SITE I, BINDING SITE II or BINDING SITE III. Table 2 illustrates the complementarity of the nucleotide sequences of USP2 BINDING SITE, designated SEQ ID:10401, to the nucleotide sequence of VGAM2351 RNA, herein designated VGAM RNA, also designated SEQ ID:5062.

Another function of VGAM2351 is therefore inhibition of Ubiquitin Specific Protease 2 (USP2, Accession NM_004205). Accordingly, utilities of VGAM2351 include diagnosis, prevention and treatment of diseases and clinical conditions associated with USP2. LOC130412 (Accession XM_065708) is another VGAM2351 host target gene. LOC130412 BINDING SITE is HOST TARGET binding site found in the 5' untranslated region of mRNA encoded by LOC130412, corresponding to a HOST TARGET binding site such as BINDING SITE I, BINDING SITE II or BINDING SITE III. Table 2 illustrates the complementarity of the nucleotide sequences of LOC130412 BINDING SITE, designated SEQ ID:37293, to the nucleotide sequence of VGAM2351 RNA, herein designated VGAM RNA, also designated SEQ ID:5062.

Another function of VGAM2351 is therefore inhibition of LOC130412 (Accession XM_065708). Accordingly, utilities of VGAM2351 include diagnosis, prevention and treatment of diseases and clinical conditions associated with LOC130412. LOC146337 (Accession XM_096982) is another VGAM2351 host target gene. LOC146337 BINDING SITE is HOST TARGET binding site found in the 3' untranslated region of mRNA encoded by LOC146337, corresponding to a HOST TARGET binding site such as BINDING SITE I, BINDING SITE II or BINDING SITE III. Table 2 illustrates the complementarity of the nucleotide sequences of LOC146337 BINDING SITE, designated SEQ ID:40693, to the nucleotide sequence of VGAM2351 RNA, herein designated VGAM RNA, also designated SEQ ID:5062.

Another function of VGAM2351 is therefore inhibition of LOC146337 (Accession XM_096982). Accordingly, utilities of VGAM2351 include diagnosis, prevention and treatment of diseases and clinical conditions associated with LOC146337. LOC152794 (Accession XM_087525) is another VGAM2351 host target gene. LOC152794 BINDING SITE is HOST TARGET binding site found in the 5' untranslated region of mRNA encoded by LOC152794, corresponding to a HOST TARGET binding site such as BINDING SITE I, BINDING SITE II or BINDING SITE III. Table 2 illustrates the complementarity of the nucleotide sequences of LOC152794 BINDING SITE, designated SEQ ID:39322, to the nucleotide sequence of VGAM2351 RNA, herein designated VGAM RNA, also designated SEQ ID:5062.

Another function of VGAM2351 is therefore inhibition of LOC152794 (Accession XM_087525). Accordingly, utilities of VGAM2351 include diagnosis, prevention and treatment of diseases and clinical conditions associated with LOC152794. LOC206012 (Accession XM_116275) is another VGAM2351 host target gene. LOC206012 BINDING SITE is HOST TARGET binding site found in the 5' untranslated region of mRNA encoded by LOC206012, corresponding to a HOST TARGET binding site such as BINDING SITE I, BINDING SITE II or BINDING SITE III. Table 2 illustrates the complementarity of the nucleotide sequences of LOC206012 BINDING SITE, designated SEQ ID:43110, to the nucleotide sequence of VGAM2351 RNA, herein designated VGAM RNA, also designated SEQ ID:5062.

Another function of VGAM2351 is therefore inhibition of LOC206012 (Accession XM_116275). Accordingly, utilities of VGAM2351 include diagnosis, prevention and treatment of diseases and clinical conditions associated with LOC206012. LOC254251 (Accession XM_171088) is another VGAM2351 host target gene. LOC254251 BINDING SITE is HOST TARGET binding site found in the 5' untranslated region of mRNA encoded by LOC254251, corresponding to a HOST TARGET binding site such as BINDING SITE I, BINDING SITE II or BINDING SITE III. Table 2 illustrates the complementarity of the nucleotide sequences of LOC254251 BINDING SITE, designated SEQ ID:45901, to the nucleotide sequence of VGAM2351 RNA, herein designated VGAM RNA, also designated SEQ ID:5062.

Another function of VGAM2351 is therefore inhibition of LOC254251 (Accession XM_171088). Accordingly, utilities of VGAM2351 include diagnosis, prevention and treatment of diseases and clinical conditions associated with LOC254251. LOC257480 (Accession XM_085456) is another VGAM2351 host target gene. LOC257480 BINDING SITE is HOST TARGET binding site found in the 5' untranslated region of mRNA encoded by LOC257480, corresponding to a HOST TARGET binding site such as BINDING SITE I, BINDING SITE II or BINDING SITE III. Table 2 illustrates the complementarity of the nucleotide sequences of LOC257480 BINDING SITE, designated SEQ ID:38146, to the nucleotide sequence of VGAM2351 RNA, herein designated VGAM RNA, also designated SEQ ID:5062.

Another function of VGAM2351 is therefore inhibition of LOC257480 (Accession XM_085456). Accordingly, utilities of VGAM2351 include diagnosis, prevention and treatment of diseases and clinical conditions associated with LOC257480. LOC257612 (Accession XM_175270) is another VGAM2351 host target gene. LOC257612 BINDING SITE is HOST TARGET binding site found in the 5' untranslated region of mRNA encoded by LOC257612, corresponding to a HOST TARGET binding site such as BINDING SITE I, BINDING SITE II or BINDING SITE III. Table 2 illustrates the complementarity of the nucleotide sequences of LOC257612 BINDING SITE, designated SEQ ID:46743, to the nucleotide sequence of VGAM2351 RNA, herein designated VGAM RNA, also designated SEQ ID:5062.

Another function of VGAM2351 is therefore inhibition of LOC257612 (Accession XM_175270). Accordingly, utilities of VGAM2351 include diagnosis, prevention and treatment of diseases and clinical conditions associated with LOC257612. LOC91156 (Accession XM_036558) is another VGAM2351 host target gene. LOC91156 BINDING SITE is HOST TARGET binding site found in the 5' untranslated region of mRNA encoded by LOC91156, corresponding to a HOST TARGET binding site such as BINDING SITE I, BINDING SITE II or BINDING SITE III. Table 2 illustrates the complementarity of the nucleotide sequences of LOC91156 BINDING SITE, designated SEQ ID:32466, to the nucleotide sequence of VGAM2351 RNA, herein designated VGAM RNA, also designated SEQ ID:5062.

Another function of VGAM2351 is therefore inhibition of LOC91156 (Accession XM_036558). Accordingly, utilities of VGAM2351 include diagnosis, prevention and treatment of diseases and clinical conditions associated with LOC91156. FIG. 1 further provides a conceptual description of a novel bioinformatically detected viral gene of the present invention, referred to here as Viral Genomic Address Messenger 2352 (VGAM2352) viral gene, which modulates expression of respective host target genes thereof, the function and utility of which host target genes is known in the art.

VGAM2352 is a novel bioinformatically detected regulatory, non protein coding, viral micro RNA (miRNA) gene. The method by which VGAM2352 was detected is described hereinabove with reference to FIGS. 1-8.

VGAM2352 gene, herein designated VGAM GENE, is a viral gene contained in the genome of Equine Herpesvirus 2. VGAM2352 host target gene, herein designated VGAM HOST TARGET GENE, is a human gene contained in the human genome.

VGAM2352 gene encodes a VGAM2352 precursor RNA, herein designated VGAM PRECURSOR RNA. Similar to other miRNA genes, and unlike most ordinary genes, VGAM2352 precursor RNA does not encode a protein. A nucleotide sequence identical or highly similar to the nucleotide sequence of VGAM2352 precursor RNA is designated SEQ ID:2338, and is provided hereinbelow with reference to the sequence listing part. Nucleotide sequence SEQ ID:2338 is located at position 8029 relative to the genome of Equine Herpesvirus 2.

VGAM2352 precursor RNA folds onto itself, forming VGAM2352 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2352 folded precursor RNA into VGAM2352 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM2352 RNA is designated SEQ ID:5063, and is provided hereinbelow with reference to the sequence listing part.

VGAM2352 host target gene, herein designated VGAM HOST TARGET GENE, encodes a corresponding messenger RNA, VGAM2352 host target RNA, herein designated VGAM HOST TARGET RNA. VGAM2352 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2352 RNA, herein designated VGAM RNA, binds complementarily to one or more host target binding sites located in untranslated regions of VGAM2352 host target RNA, herein designated VGAM HOST TARGET RNA. This complementary binding is due to the fact that the nucleotide sequence of VGAM2352 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2352 RNA, herein designated VGAM RNA, may have a different number of host target binding sites in untranslated regions of a VGAM2352 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2352 RNA, herein designated VGAM RNA, to host target binding sites on VGAM2352 host target RNA, herein designated VGAM HOST TARGET RNA, such as BINDING SITE I, BINDING SITE II and BINDING SITE III, inhibits translation of VGAM2352 host target RNA into VGAM2352 host target protein, herein designated VGAM HOST TARGET PROTEIN. VGAM host target protein is therefore outlined by a broken line.

It is appreciated that VGAM2352 host target gene, herein designated VGAM HOST TARGET GENE, in fact represents a plurality of VGAM2352 host target genes. The mRNA of each one of this plurality of VGAM2352 host target genes comprises one or more host target binding sites, each having a nucleotide sequence which is at least partly complementary to VGAM2352 RNA, herein designated VGAM RNA, and which when bound by VGAM2352 RNA causes inhibition of translation of respective one or more VGAM2352 host target proteins.

It is further appreciated by one skilled in the art that the mode of translational inhibition illustrated by FIG. 1 with specific reference to translational inhibition exerted by VGAM2352 gene, herein designated VGAM GENE, on one or more VGAM2352 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2352 is inhibition of expression of host target genes, as part of a novel viral mechanism of attacking a host. Accordingly, utilities of VGAM2352 include diagnosis, prevention and treatment of viral infection by Equine Herpesvirus 2. Specific functions, and accordingly utilities, of VGAM2352 correlate with, and may be deduced from, the identity of the host target genes which VGAM2352 binds and inhibits, and the function of these host target genes, as elaborated hereinbelow.

Nucleotide sequences of the VGAM2352 precursor RNA, herein designated VGAM PRECURSOR RNA, and of the 'diced' VGAM2352 RNA, herein designated VGAM RNA, and a schematic representation of the secondary folding of VGAM2352 folded precursor RNA, herein designated VGAM FOLDED PRECURSOR RNA, of VGAM2352 are further described hereinbelow with reference to Table 1.

Nucleotide sequences of host target binding sites, such as BINDING SITE-I, BINDING SITE-II and BINDING SITE-III of FIG. 1, found on VGAM2352 host target RNA, and schematic representation of the complementarity of each of these host target binding sites to VGAM2352 RNA, herein designated VGAM RNA, are described hereinbelow with reference to Table 2.

As mentioned hereinabove with reference to FIG. 1, a function of VGAM2352 gene, herein designated VGAM is inhibition of expression of VGAM2352 target genes. It is appreciated that specific functions, and accordingly utilities, of VGAM2352 correlate with, and may be deduced from, the identity of the target genes which VGAM2352 binds and inhibits, and the function of these target genes, as elaborated hereinbelow.

ATPase, Cu++ Transporting, Beta Polypeptide (Wilson disease) (ATP7B, Accession NM_000053) is a VGAM2352 host target gene. ATP7B BINDING SITE is HOST TARGET binding site found in the 3' untranslated region of mRNA encoded by ATP7B, corresponding to a HOST TARGET binding site such as BINDING SITE I, BINDING SITE II or BINDING SITE III. Table 2 illustrates the complementarity of the nucleotide sequences of ATP7B BINDING SITE, designated SEQ ID:5503, to the nucleotide sequence of VGAM2352 RNA, herein designated VGAM RNA, also designated SEQ ID:5063.

A function of VGAM2352 is therefore inhibition of ATPase, Cu++ Transporting, Beta Polypeptide (Wilson disease) (ATP7B, Accession NM_000053). Accordingly, utilities of VGAM2352 include diagnosis, prevention and treatment of diseases and clinical conditions associated with ATP7B. Beta-1,3-glucuronyltransferase 1 (glucuronosyltransferase P) (B3GAT1, Accession NM_018644) is another VGAM2352 host target gene. B3GAT1 BINDING SITE1 and B3GAT1 BINDING SITE2 are HOST TARGET binding sites found in untranslated regions of mRNA encoded by B3GAT1, corresponding to HOST TARGET binding sites such as BINDING SITE I, BINDING SITE II or BINDING SITE III. Table 2 illustrates the complementarity of the nucleotide sequences of B3GAT1 BINDING SITE1 and B3GAT1 BINDING SITE2, designated SEQ ID:20715 and SEQ ID:27627 respectively, to the nucleotide sequence of VGAM2352 RNA, herein designated VGAM RNA, also designated SEQ ID:5063.

Another function of VGAM2352 is therefore inhibition of Beta-1,3-glucuronyltransferase 1 (glucuronosyltransferase P) (B3GAT1, Accession NM_018644). Accordingly, utilities of VGAM2352 include diagnosis, prevention and treatment of diseases and clinical conditions associated with B3GAT1. CERD4 (Accession NM_012074) is another VGAM2352 host target gene. CERD4 BINDING SITE is HOST TARGET binding site found in the 3' untranslated region of mRNA encoded by CERD4, corresponding to a HOST TARGET binding site such as BINDING SITE I, BINDING SITE II or BINDING SITE III. Table 2 illustrates the complementarity of the nucleotide sequences of CERD4 BINDING SITE, designated SEQ ID:14342, to the nucleotide sequence of VGAM2352 RNA, herein designated VGAM RNA, also designated SEQ ID:5063.

Another function of VGAM2352 is therefore inhibition of CERD4 (Accession NM_012074). Accordingly, utilities of VGAM2352 include diagnosis, prevention and treatment of diseases and clinical conditions associated with CERD4. Dihydropyrimidinase-like 3 (DPYSL3, Accession NM_001387) is another VGAM2352 host target gene. DPYSL3 BINDING SITE is HOST TARGET binding site found in the 3' untranslated region of mRNA encoded by DPYSL3, corresponding to a HOST TARGET binding site such as BINDING SITE I, BINDING SITE II or BINDING SITE III. Table 2 illustrates the complementarity of the nucleotide sequences of DPYSL3 BINDING SITE, designated SEQ ID:7069, to the nucleotide sequence of VGAM2352 RNA, herein designated VGAM RNA, also designated SEQ ID:5063.

Another function of VGAM2352 is therefore inhibition of Dihydropyrimidinase-like 3 (DPYSL3, Accession NM_001387), a gene which is a member of the dihydropyrimidinase family. Accordingly, utilities of VGAM2352 include diagnosis, prevention and treatment of diseases and clinical conditions associated with DPYSL3. The function of DPYSL3 and its association with various diseases and clinical conditions, has been established by previous studies, as described hereinabove with reference to VGAM24. Guanine Nucleotide Binding Protein (G protein), Beta Polypeptide 1 (GNB1, Accession NM_002074) is another VGAM2352 host target gene. GNB1 BINDING SITE is HOST TARGET binding site found in the 3' untranslated region of mRNA encoded by GNB1, corresponding to a HOST TARGET binding site such as BINDING SITE I, BINDING SITE II or BINDING SITE III. Table 2 illustrates the complementarity of the nucleotide sequences of GNB1 BINDING SITE, designated SEQ ID:7848, to the nucleotide sequence of VGAM2352 RNA, herein designated VGAM RNA, also designated SEQ ID:5063.

Another function of VGAM2352 is therefore inhibition of Guanine Nucleotide Binding Protein (G protein), Beta Polypeptide 1 (GNB1, Accession NM_002074). Accordingly, utilities of VGAM2352 include diagnosis, prevention and treatment of diseases and clinical conditions associated with GNB1. Interleukin 2 Receptor, Alpha (IL2RA, Accession NM_000417) is another VGAM2352 host target gene. IL2RA BINDING SITE is HOST TARGET binding site found in the 3' untranslated region of mRNA encoded by IL2RA, corresponding to a HOST TARGET binding site such as BINDING SITE I, BINDING SITE II or BINDING SITE III. Table 2 illustrates the complementarity of the nucleotide sequences of IL2RA BINDING SITE, designated SEQ ID:5997, to the nucleotide sequence of VGAM2352 RNA, herein designated VGAM RNA, also designated SEQ ID:5063.

Another function of VGAM2352 is therefore inhibition of Interleukin 2 Receptor, Alpha (IL2RA, Accession NM_000417), a gene which plays a role in T cell mediated immune response. Accordingly, utilities of VGAM2352 include diagnosis, prevention and treatment of diseases and clinical conditions associated with IL2RA. The function of IL2RA and its association with various diseases and clinical conditions, has been established by previous studies, as described hereinabove with reference to VGAM1168. Low Density Lipoprotein-related Protein 1 (alpha-2-macroglobulin receptor) (LRP1, Accession NM_002332) is another VGAM2352 host target gene. LRP1 BINDING SITE is HOST TARGET binding site found in the 3' untranslated region of mRNA encoded by LRP1, corresponding to a HOST TARGET binding site such as BINDING SITE I, BINDING SITE II or BINDING SITE III. Table 2 illustrates the complementarity of the nucleotide sequences of LRP1 BINDING SITE, designated SEQ ID:8135, to the nucleotide sequence of VGAM2352 RNA, herein designated VGAM RNA, also designated SEQ ID:5063.

Another function of VGAM2352 is therefore inhibition of Low Density Lipoprotein-related Protein 1 (alpha-2-macroglobulin receptor) (LRP1, Accession NM_002332), a gene which is a recycling lipoprotein receptor with possible growth-modulating effects. Accordingly, utilities of VGAM2352 include diagnosis, prevention and treatment of diseases and clinical conditions associated with LRP1. The function of LRP1 and its association with various diseases and clinical conditions, has been established by previous studies, as described hereinabove with reference to VGAM885. MAX Gene Associated (MGA, Accession XM_031689) is another VGAM2352 host target gene. MGA BINDING SITE is HOST TARGET binding site found in the 3' untranslated region of mRNA encoded by MGA, corresponding to a HOST TARGET binding site such as BINDING SITE I, BINDING SITE II or BINDING SITE III. Table 2 illustrates the complementarity of the nucleotide sequences of MGA BINDING SITE, designated SEQ ID:31453, to the nucleotide sequence of VGAM2352 RNA, herein designated VGAM RNA, also designated SEQ ID:5063.

Another function of VGAM2352 is therefore inhibition of MAX Gene Associated (MGA, Accession XM_031689), a gene which plays a role in the final steps of digestion of starch. Accordingly, utilities of VGAM2352 include diagnosis, prevention and treatment of diseases and clinical conditions associated with MGA. The function of MGA and its association with various diseases and clinical conditions, has been established by previous studies, as described hereinabove with reference to VGAM2003. Moesin (MSN, Accession XM_013042) is another VGAM2352 host target gene. MSN BINDING SITE is HOST TARGET binding site found in the 3" untranslated region of mRNA encoded by MSN, corresponding to a HOST TARGET binding site such as BINDING SITE I, BINDING SITE II or BINDING SITE III. Table 2 illustrates the complementarity of the nucleotide sequences of MSN BINDING SITE, designated SEQ ID:30224, to the nucleotide sequence of VGAM2352 RNA, herein designated VGAM RNA, also designated SEQ ID:5063.

Another function of VGAM2352 is therefore inhibition of Moesin (MSN, Accession XM_013042), a gene which may have a role linking the cytoskeleton to the plasma membrane. Accordingly, utilities of VGAM2352 include diagnosis, prevention and treatment of diseases and clinical conditions associated with MSN. The function of MSN and its association with various diseases and clinical conditions, has been established by previous studies, as described hereinabove with reference to VGAM248. RAN Binding Protein 3 (RANBP3, Accession NM_003624) is another VGAM2352 host target gene. RANBP3 BINDING SITE1 and RANBP3 BINDING SITE2 are HOST TARGET binding sites found in untranslated regions of mRNA encoded by RANBP3, corresponding to HOST TARGET binding sites such as BINDING SITE I, BINDING SITE II or BINDING SITE III. Table 2 illustrates the complementarity of the nucleotide sequences of RANBP3 BINDING SITE1 and RANBP3 BINDING SITE2, designated SEQ ID:9687 and SEQ ID:14239 respectively, to the nucleotide sequence of VGAM2352 RNA, herein designated VGAM RNA, also designated SEQ ID:5063.

Another function of VGAM2352 is therefore inhibition of RAN Binding Protein 3 (RANBP3, Accession NM_003624). Accordingly, utilities of VGAM2352 include diagnosis, prevention and treatment of diseases and clinical conditions associated with RANBP3. Zinc Finger Protein 141 (clone pHZ-44) (ZNF141, Accession NM_003441) is another VGAM2352 host target gene. ZNF141 BINDING SITE is HOST TARGET binding site found in the 3' untranslated region of mRNA encoded by ZNF141, corresponding to a HOST TARGET binding site such as BINDING SITE I, BINDING SITE II or BINDING SITE III. Table 2 illustrates the complementarity of the nucleotide sequences of ZNF141 BINDING SITE, designated SEQ ID:9496, to the nucleotide sequence of VGAM2352 RNA, herein designated VGAM RNA, also designated SEQ ID:5063.

Another function of VGAM2352 is therefore inhibition of Zinc Finger Protein 141 (clone pHZ-44) (ZNF141, Accession NM_003441). Accordingly, utilities of VGAM2352 include diagnosis, prevention and treatment of diseases and clinical conditions associated with ZNF141. AFAP (Accession NM_021638) is another VGAM2352 host target gene. AFAP BINDING SITE is HOST TARGET binding site found in the 3' untranslated region of mRNA encoded by AFAP, corresponding to a HOST TARGET binding site such as BINDING SITE I, BINDING SITE II or BINDING SITE III. Table 2 illustrates the complementarity of the nucleotide sequences of AFAP BINDING SITE, designated SEQ ID:22289, to the nucleotide sequence of VGAM2352 RNA, herein designated VGAM RNA, also designated SEQ ID:5063.

Another function of VGAM2352 is therefore inhibition of AFAP (Accession NM_021638). Accordingly, utilities of VGAM2352 include diagnosis, prevention and treatment of diseases and clinical conditions associated with AFAP. Discoidin Domain Receptor Family, Member 1 (DDR1, Accession NM_013993) is another VGAM2352 host target gene. DDR1 BINDING SITE1 through DDR1 BINDING SITE3 are HOST TARGET binding sites found in untranslated regions of mRNA encoded by DDR1, corresponding to HOST TARGET binding sites such as BINDING SITE I, BINDING SITE II or BINDING SITE III. Table 2 illustrates the complementarity of the nucleotide sequences of DDR1 BINDING SITE1 through DDR1 BINDING SITE3, designated SEQ ID:15178, SEQ ID:15180 and SEQ ID:7677 respectively, to the nucleotide sequence of VGAM2352 RNA, herein designated VGAM RNA, also designated SEQ ID:5063.

Another function of VGAM2352 is therefore inhibition of Discoidin Domain Receptor Family, Member 1 (DDR1, Accession NM_013993). Accordingly, utilities of VGAM2352 include diagnosis, prevention and treatment of diseases and clinical conditions associated with DDR1. FLJ12895 (Accession NM_023926) is another VGAM2352 host target gene. FLJ12895 BINDING SITE is HOST TARGET binding site found in the 5' untranslated region of mRNA encoded by FLJ12895, corresponding to a HOST TARGET binding site such as BINDING SITE I, BINDING SITE II or BINDING SITE III. Table 2 illustrates the complementarity of the nucleotide sequences of FLJ12895 BINDING SITE, designated SEQ ID:23403, to the nucleotide sequence of VGAM2352 RNA, herein designated VGAM RNA, also designated SEQ ID:5063.

Another function of VGAM2352 is therefore inhibition of FLJ12895 (Accession NM_023926). Accordingly, utilities of VGAM2352 include diagnosis, prevention and treatment of diseases and clinical conditions associated with FLJ12895. FLJ13150 (Accession NM_024813) is another VGAM2352 host target gene. FLJ13150 BINDING SITE is HOST TARGET binding site found in the 3' untranslated region of mRNA encoded by FLJ13150, corresponding to a HOST TARGET binding site such as BINDING SITE I, BINDING SITE II or BINDING SITE III. Table 2 illustrates the complementarity of the nucleotide sequences of FLJ13150 BINDING SITE, designated SEQ ID:24200, to the nucleotide sequence of VGAM2352 RNA, herein designated VGAM RNA, also designated SEQ ID:5063.

Another function of VGAM2352 is therefore inhibition of FLJ13150 (Accession NM_024813). Accordingly, utilities of VGAM2352 include diagnosis, prevention and treatment of diseases and clinical conditions associated with FLJ13150. FLJ20209 (Accession XM_098142) is another VGAM2352 host target gene. FLJ20209 BINDING SITE1 and FLJ20209 BINDING SITE2 are HOST TARGET binding sites found in untranslated regions of mRNA encoded by FLJ20209, corresponding to HOST TARGET binding sites such as BINDING SITE I, BINDING SITE II or BINDING SITE III. Table 2 illustrates the complementarity of the nucleotide sequences of FLJ20209 BINDING SITE1 and FLJ20209 BINDING SITE2, designated SEQ ID:41402 and SEQ ID:41403 respectively, to the nucleotide sequence of VGAM2352 RNA, herein designated VGAM RNA, also designated SEQ ID:5063.

Another function of VGAM2352 is therefore inhibition of FLJ20209 (Accession XM_098142). Accordingly, utilities of VGAM2352 include diagnosis, prevention and treatment of diseases and clinical conditions associated with FLJ20209. HIG2 (Accession NM_013332) is another VGAM2352 host target gene. HIG2 BINDING SITE is HOST TARGET binding site found in the 3' untranslated region of mRNA encoded by HIG2, corresponding to a HOST TARGET binding site such as BINDING SITE I, BINDING SITE II or BINDING SITE III. Table 2 illustrates the complementarity of the nucleotide sequences of HIG2 BINDING SITE, designated SEQ ID:14977, to the nucleotide sequence of VGAM2352 RNA, herein designated VGAM RNA, also designated SEQ ID:5063.

Another function of VGAM2352 is therefore inhibition of HIG2 (Accession NM_013332). Accordingly, utilities of VGAM2352 include diagnosis, prevention and treatment of diseases and clinical conditions associated with HIG2. KIAA0355 (Accession NM_014686) is another VGAM2352 host target gene. KIAA0355 BINDING SITE is HOST TARGET binding site found in the 3' untranslated region of mRNA encoded by KIAA0355, corresponding to a HOST TARGET binding site such as BINDING SITE I, BINDING SITE II or BINDING SITE III. Table 2 illustrates the complementarity of the nucleotide sequences of KIAA0355 BINDING SITE, designated SEQ ID:16187, to the nucleotide sequence of VGAM2352 RNA, herein designated VGAM RNA, also designated SEQ ID:5063.

Another function of VGAM2352 is therefore inhibition of KIAA0355 (Accession NM_014686). Accordingly, utilities of VGAM2352 include diagnosis, prevention and treatment of diseases and clinical conditions associated with KIAA0355. KIAA0514 (Accession NM_014696) is another VGAM2352 host target gene. KIAA0514 BINDING SITE is HOST TARGET binding site found in the 3' untranslated region of mRNA encoded by KIAA0514, corresponding to a HOST TARGET binding site such as BINDING SITE I, BINDING SITE II or BINDING SITE III. Table 2 illustrates the complementarity of the nucleotide sequences of KIAA0514 BINDING SITE, designated SEQ ID:16200, to the nucleotide sequence of VGAM2352 RNA, herein designated VGAM RNA, also designated SEQ ID:5063.

Another function of VGAM2352 is therefore inhibition of KIAA0514 (Accession NM_014696). Accordingly, utilities of VGAM2352 include diagnosis, prevention and treatment of diseases and clinical conditions associated with KIAA0514. KIAA0545 (Accession XM_032278) is another VGAM2352 host target gene. KIAA0545 BINDING SITE is HOST TARGET binding site found in the 3' untranslated region of mRNA encoded by KIAA0545, corresponding to a HOST TARGET binding site such as BINDING SITE I, BINDING SITE II or BINDING SITE III. Table 2 illustrates the complementarity of the nucleotide sequences of KIAA0545 BINDING SITE, designated SEQ ID:31633, to the nucleotide sequence of VGAM2352 RNA, herein designated VGAM RNA, also designated SEQ ID:5063.

Another function of VGAM2352 is therefore inhibition of KIAA0545 (Accession XM_032278). Accordingly, utilities of VGAM2352 include diagnosis, prevention and treatment of diseases and clinical conditions associated with KIAA0545. KIAA1272 (Accession XM_046600) is another VGAM2352 host target gene. KIAA1272 BINDING SITE is HOST TARGET binding site found in the 3' untranslated region of mRNA encoded by KIAA1272, corresponding to a HOST TARGET binding site such as BINDING SITE I, BINDING SITE II or BINDING SITE III. Table 2 illustrates the complementarity of the nucleotide sequences of KIAA1272 BINDING SITE, designated SEQ ID:34759, to the nucleotide sequence of VGAM2352 RNA, herein designated VGAM RNA, also designated SEQ ID:5063.

Another function of VGAM2352 is therefore inhibition of KIAA1272 (Accession XM_046600). Accordingly, utilities of VGAM2352 include diagnosis, prevention and treatment of diseases and clinical conditions associated with KIAA1272. KIAA1871 (Accession XM_028409) is another VGAM2352 host target gene. KIAA1871 BINDING SITE is HOST TARGET binding site found in the 3' untranslated region of mRNA encoded by KIAA1871, corresponding to a HOST TARGET binding site such as BINDING SITE I, BINDING SITE II or BINDING SITE III. Table 2 illustrates the complementarity of the nucleotide sequences of KIAA1871 BINDING SITE, designated SEQ ID:30702, to the nucleotide sequence of VGAM2352 RNA, herein designated VGAM RNA, also designated SEQ ID:5063.

Another function of VGAM2352 is therefore inhibition of KIAA1871 (Accession XM_028409). Accordingly, utilities of VGAM2352 include diagnosis, prevention and treatment of diseases and clinical conditions associated with KIAA1871. KIAA1879 (Accession XM_056635) is another VGAM2352 host target gene. KIAA1879 BINDING SITE is HOST TARGET binding site found in the 5' untranslated region of mRNA encoded by KIAA1879, corresponding to a HOST TARGET binding site such as BINDING SITE I, BINDING SITE II or BINDING SITE III. Table 2 illustrates the complementarity of the nucleotide sequences of KIAA1879 BINDING SITE, designated SEQ ID:36412, to the nucleotide sequence of VGAM2352 RNA, herein designated VGAM RNA, also designated SEQ ID:5063.

Another function of VGAM2352 is therefore inhibition of KIAA1879 (Accession XM_056635). Accordingly, utilities of VGAM2352 include diagnosis, prevention and treatment of diseases and clinical conditions associated with KIAA1879. Phosphate Cytidylyltransferase 2, Ethanolamine (PCYT2, Accession NM_002861) is another VGAM2352 host target gene. PCYT2 BINDING SITE is HOST TARGET binding site found in the 3' untranslated region of mRNA encoded by PCYT2, corresponding to a HOST TARGET binding site such as BINDING SITE I, BINDING SITE II or BINDING SITE III. Table 2 illustrates the complementarity of the nucleotide sequences of PCYT2 BINDING SITE, designated SEQ ID:8761, to the nucleotide sequence of VGAM2352 RNA, herein designated VGAM RNA, also designated SEQ ID:5063.

Another function of VGAM2352 is therefore inhibition of Phosphate Cytidylyltransferase 2, Ethanolamine (PCYT2, Accession NM_002861). Accordingly, utilities of VGAM2352 include diagnosis, prevention and treatment of diseases and clinical conditions associated with PCYT2. Ubiquitin Specific Protease 22 (USP22, Accession XM_042698) is another VGAM2352 host target gene. USP22 BINDING SITE is HOST TARGET binding site found in the 3' untranslated region of mRNA encoded by USP22, corresponding to a HOST TARGET binding site such as BINDING SITE I, BINDING SITE II or BINDING SITE III. Table 2 illustrates the complementarity of the nucleotide sequences of USP22 BINDING SITE, designated SEQ ID:33750, to the nucleotide sequence of VGAM2352 RNA, herein designated VGAM RNA, also designated SEQ ID:5063.

Another function of VGAM2352 is therefore inhibition of Ubiquitin Specific Protease 22 (USP22, Accession XM_042698). Accordingly, utilities of VGAM2352 include diagnosis, prevention and treatment of diseases and clinical conditions associated with USP22. LOC112476 (Accession NM_145239) is another VGAM2352 host target gene. LOC112476 BINDING SITE is HOST TARGET binding site found in the 3' untranslated region of mRNA encoded by LOC112476, corresponding to a HOST TARGET binding site such as BINDING SITE I, BINDING SITE II or BINDING SITE III. Table 2 illustrates the complementarity of the nucleotide sequences of LOC112476 BINDING SITE, designated SEQ ID:29749, to the nucleotide sequence of VGAM2352 RNA, herein designated VGAM RNA, also designated SEQ ID:5063.

Another function of VGAM2352 is therefore inhibition of LOC112476 (Accession NM_145239). Accordingly, utilities of VGAM2352 include diagnosis, prevention and treatment of diseases and clinical conditions associated with LOC112476. LOC144501 (Accession XM_096612) is another VGAM2352 host target gene. LOC144501 BINDING SITE is HOST TARGET binding site found in the 3' untranslated region of mRNA encoded by LOC144501, corresponding to a HOST TARGET binding site such as BINDING SITE I, BINDING SITE II or BINDING SITE III. Table 2 illustrates the complementarity of the nucleotide sequences of LOC144501 BINDING SITE, designated SEQ ID:40422, to the nucleotide sequence of VGAM2352 RNA, herein designated VGAM RNA, also designated SEQ ID:5063.

Another function of VGAM2352 is therefore inhibition of LOC144501 (Accession XM_096612). Accordingly, utilities of VGAM2352 include diagnosis, prevention and treatment of diseases and clinical conditions associated with LOC144501. LOC150935 (Accession XM_087049) is another VGAM2352 host target gene. LOC150935 BINDING SITE is HOST TARGET binding site found in the 3' untranslated region of mRNA encoded by LOC150935, corresponding to a HOST TARGET binding site such as BINDING SITE I, BINDING SITE II or BINDING SITE III. Table 2 illustrates the complementarity of the nucleotide sequences of LOC150935 BINDING SITE, designated SEQ ID:39018, to the nucleotide sequence of VGAM2352 RNA, herein designated VGAM RNA, also designated SEQ ID:5063.

Another function of VGAM2352 is therefore inhibition of LOC150935 (Accession XM_087049). Accordingly, utilities of VGAM2352 include diagnosis, prevention and treatment of diseases and clinical conditions associated with LOC150935. LOC151178 (Accession XM_087117) is another VGAM2352 host target gene. LOC151178 BINDING SITE is HOST TARGET binding site found in the 5' untranslated region of mRNA encoded by LOC151178, corresponding to a HOST TARGET binding site such as BINDING SITE I, BINDING SITE II or BINDING SITE III. Table 2 illustrates the complementarity of the nucleotide sequences of LOC151178 BINDING SITE, designated SEQ ID:39068, to the nucleotide sequence of VGAM2352 RNA, herein designated VGAM RNA, also designated SEQ ID:5063.

Another function of VGAM2352 is therefore inhibition of LOC151178 (Accession XM_087117). Accordingly, utilities of VGAM2352 include diagnosis, prevention and treatment of diseases and clinical conditions associated with LOC151178. LOC155435 (Accession XM_088257) is another VGAM2352 host target gene. LOC155435 BINDING SITE is HOST TARGET binding site found in the 3' untranslated region of mRNA encoded by LOC155435, corresponding to a HOST TARGET binding site such as BINDING SITE I, BINDING SITE II or BINDING SITE III. Table 2 illustrates the complementarity of the nucleotide sequences of LOC155435 BINDING SITE, designated SEQ ID:39567, to the nucleotide sequence of VGAM2352 RNA, herein designated VGAM RNA, also designated SEQ ID:5063.

Another function of VGAM2352 is therefore inhibition of LOC155435 (Accession XM_088257). Accordingly, utilities of VGAM2352 include diagnosis, prevention and treatment of diseases and clinical conditions associated with LOC155435. LOC163115 (Accession XM_092010) is another VGAM2352 host target gene. LOC163115 BINDING SITE is HOST TARGET binding site found in the 3' untranslated region of mRNA encoded by LOC163115, corresponding to a HOST TARGET binding site such as BINDING SITE I, BINDING SITE II or BINDING SITE III. Table 2 illustrates the complementarity of the nucleotide sequences of LOC163115 BINDING SITE, designated SEQ ID:40088, to the nucleotide sequence of VGAM2352 RNA, herein designated VGAM RNA, also designated SEQ ID:5063.

Another function of VGAM2352 is therefore inhibition of LOC163115 (Accession XM_092010). Accordingly, utilities of VGAM2352 include diagnosis, prevention and treatment of diseases and clinical conditions associated with LOC163115. LOC163682 (Accession XM_099402) is another VGAM2352 host target gene. LOC163682 BINDING SITE is HOST TARGET binding site found in the 5' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42083, to the nucleotide sequence of VGAM2352 RNA, herein designated VGAM RNA, also designated SEQ ID:5063.

Another function of VGAM2352 is therefore inhibition of LOC163682 (Accession XM_099402). Accordingly, utilities of VGAM2352 include diagnosis, prevention and treatment of diseases and clinical conditions associated with LOC163682. LOC197259 (Accession XM_113849) is another VGAM2352 host target gene. LOC197259 BINDING SITE is HOST TARGET binding site found in the 3' untranslated region of mRNA encoded by LOC197259, corresponding to a HOST TARGET binding site such as BINDING SITE I, BINDING SITE II or BINDING SITE III. Table 2 illustrates the complementarity of the nucleotide sequences of LOC197259 BINDING SITE, designated SEQ ID:42471, to the nucleotide sequence of VGAM2352 RNA, herein designated VGAM RNA, also designated SEQ ID:5063.

Another function of VGAM2352 is therefore inhibition of LOC197259 (Accession XM_113849). Accordingly, utilities of VGAM2352 include diagnosis, prevention and treatment of diseases and clinical conditions associated with LOC197259. LOC201895 (Accession XM_114396) is another VGAM2352 host target gene. LOC201895 BINDING SITE is HOST TARGET binding site found in the 5' untranslated region of mRNA encoded by LOC201895, corresponding to a HOST TARGET binding site such as BINDING SITE I, BINDING SITE II or BINDING SITE III. Table 2 illustrates the complementarity of the nucleotide sequences of LOC201895 BINDING SITE, designated SEQ ID:42924, to the nucleotide sequence of VGAM2352 RNA, herein designated VGAM RNA, also designated SEQ ID:5063.

Another function of VGAM2352 is therefore inhibition of LOC201895 (Accession XM_114396). Accordingly, utilities of VGAM2352 include diagnosis, prevention and treatment of diseases and clinical conditions associated with LOC201895. LOC220758 (Accession XM_165466) is another VGAM2352 host target gene. LOC220758 BINDING SITE is HOST TARGET binding site found in the 3' untranslated region of mRNA encoded by LOC220758, corresponding to a HOST TARGET binding site such as BINDING SITE I, BINDING SITE II or BINDING SITE III. Table 2 illustrates the complementarity of the nucleotide sequences of LOC220758 BINDING SITE, designated SEQ ID:43641, to the nucleotide sequence of VGAM2352 RNA, herein designated VGAM RNA, also designated SEQ ID:5063.

Another function of VGAM2352 is therefore inhibition of LOC220758 (Accession XM_165466). Accordingly, utilities of VGAM2352 include diagnosis, prevention and treatment of diseases and clinical conditions associated with LOC220758. LOC221272 (Accession XM_168050) is another VGAM2352 host target gene. LOC221272 BINDING SITE is HOST TARGET binding site found in the 3' untranslated region of mRNA encoded by LOC221272, corresponding to a HOST TARGET binding site such as BINDING SITE I, BINDING SITE II or BINDING SITE III. Table 2 illustrates the complementarity of the nucleotide sequences of LOC221272 BINDING SITE, designated SEQ ID:44961, to the nucleotide sequence of VGAM2352 RNA, herein designated VGAM RNA, also designated SEQ ID:5063.

Another function of VGAM2352 is therefore inhibition of LOC221272 (Accession XM_168050). Accordingly, utilities of VGAM2352 include diagnosis, prevention and treatment of diseases and clinical conditions associated with LOC221272. LOC221584 (Accession XM_168132) is another VGAM2352 host target gene. LOC221584 BINDING SITE is HOST TARGET binding site found in the 5' untranslated region of mRNA encoded by LOC221584, corresponding to a HOST TARGET binding site such as BINDING SITE I, BINDING SITE II or BINDING SITE III. Table 2 illustrates the complementarity of the nucleotide sequences of LOC221584 BINDING SITE, designated SEQ ID:45040, to the nucleotide sequence of VGAM2352 RNA, herein designated VGAM RNA, also designated SEQ ID:5063.

Another function of VGAM2352 is therefore inhibition of LOC221584 (Accession XM_168132). Accordingly, utilities of VGAM2352 include diagnosis, prevention and treatment of diseases and clinical conditions associated with LOC221584. LOC254181 (Accession XM_174526) is another VGAM2352 host target gene. LOC254181 BINDING SITE is HOST TARGET binding site found in the 5' untranslated region of mRNA encoded by LOC254181, corresponding to a HOST TARGET binding site such as BINDING SITE I, BINDING SITE II or BINDING SITE III. Table 2 illustrates the complementarity of the nucleotide sequences of LOC254181 BINDING SITE, designated SEQ ID:46596, to the nucleotide sequence of VGAM2352 RNA, herein designated VGAM RNA, also designated SEQ ID:5063.

Another function of VGAM2352 is therefore inhibition of LOC254181 (Accession XM_174526). Accordingly, utilities of VGAM2352 include diagnosis, prevention and treatment of diseases and clinical conditions associated with LOC254181. LOC51152 (Accession NM_016181) is another VGAM2352 host target gene. LOC51152 BINDING SITE is HOST TARGET binding site found in the 3' untranslated region of mRNA encoded by LOC51152, corresponding to a HOST TARGET binding site such as BINDING SITE I, BINDING SITE II or BINDING SITE III. Table 2 illustrates the complementarity of the nucleotide sequences of LOC51152 BINDING SITE, designated SEQ ID:18282, to the nucleotide sequence of VGAM2352 RNA, herein designated VGAM RNA, also designated SEQ ID:5063.

Another function of VGAM2352 is therefore inhibition of LOC51152 (Accession NM_016181). Accordingly, utilities of VGAM2352 include diagnosis, prevention and treatment of diseases and clinical conditions associated with LOC51152. LOC51580 (Accession NM_015874) is another VGAM2352 host target gene. LOC51580 BINDING SITE is HOST TARGET binding site found in the 3' untranslated region of mRNA encoded by LOC51580, corresponding to a HOST TARGET binding site such as BINDING SITE I, BINDING SITE II or BINDING SITE III. Table 2 illustrates the complementarity of the nucleotide sequences of LOC51580 BINDING SITE, designated SEQ ID:18009, to the nucleotide sequence of VGAM2352 RNA, herein designated VGAM RNA, also designated SEQ ID:5063.

Another function of VGAM2352 is therefore inhibition of LOC51580 (Accession NM_015874). Accordingly, utilities of VGAM2352 include diagnosis, prevention and treatment of diseases and clinical conditions associated with LOC51580. LOC56963 (Accession XM_049372) is another VGAM2352 host target gene. LOC56963 BINDING SITE is HOST TARGET binding site found in the 3' untranslated region of mRNA encoded by LOC56963, corresponding to a HOST TARGET binding site such as BINDING SITE I, BINDING SITE II or BINDING SITE III. Table 2 illustrates the complementarity of the nucleotide sequences of LOC56963 BINDING SITE, designated SEQ ID:35398, to the nucleotide sequence of VGAM2352 RNA, herein designated VGAM RNA, also designated SEQ ID:5063.

Another function of VGAM2352 is therefore inhibition of LOC56963 (Accession XM_049372). Accordingly, utilities of VGAM2352 include diagnosis, prevention and treatment of diseases and clinical conditions associated with LOC56963. LOC90317 (Accession XM_030892) is another VGAM2352 host target gene. LOC90317 BINDING SITE is HOST TARGET binding site found in the 3' untranslated region of mRNA encoded by LOC90317, corresponding to a HOST TARGET binding site such as BINDING SITE I, BINDING SITE II or BINDING SITE III. Table 2 illustrates the complementarity of the nucleotide sequences of LOC90317 BINDING SITE, designated SEQ ID:31205, to the nucleotide sequence of VGAM2352 RNA, herein designated VGAM RNA, also designated SEQ ID:5063.

Another function of VGAM2352 is therefore inhibition of LOC90317 (Accession XM_030892). Accordingly, utilities of VGAM2352 include diagnosis, prevention and treatment of diseases and clinical conditions associated with LOC90317. FIG. 1 further provides a conceptual description of a novel bioinformatically detected viral gene of the present invention, referred to here as Viral Genomic Address Messenger 2353 (VGAM2353) viral gene, which modulates expression of respective host target genes thereof, the function and utility of which host target genes is known in the art.

VGAM2353 is a novel bioinformatically detected regulatory, non protein coding, viral micro RNA (miRNA) gene. The method by which VGAM2353 was detected is described hereinabove with reference to FIGS. 1-8.

VGAM2353 gene, herein designated VGAM GENE, is a viral gene contained in the genome of Equine Herpesvirus 2. VGAM2353 host target gene, herein designated VGAM HOST TARGET GENE, is a human gene contained in the human genome.

VGAM2353 gene encodes a VGAM2353 precursor RNA, herein designated VGAM PRECURSOR RNA. Similar to other miRNA genes, and unlike most ordinary genes, VGAM2353 precursor RNA does not encode a protein. A nucleotide sequence identical or highly similar to the nucleotide sequence of VGAM2353 precursor RNA is designated SEQ ID:2339, and is provided hereinbelow with reference to the sequence listing part. Nucleotide sequence SEQ ID:2339 is located at position 15043 relative to the genome of Equine Herpesvirus 2.

VGAM2353 precursor RNA folds onto itself, forming VGAM2353 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2353 folded precursor RNA into VGAM2353 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 68%) nucleotide sequence of VGAM2353 RNA is designated SEQ ID:5064, and is provided hereinbelow with reference to the sequence listing part.

VGAM2353 host target gene, herein designated VGAM HOST TARGET GENE, encodes a corresponding messenger RNA, VGAM2353 host target RNA, herein designated VGAM HOST TARGET RNA. VGAM2353 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2353 RNA, herein designated VGAM RNA, binds complementarily to one or more host target binding sites located in untranslated regions of VGAM2353 host target RNA, herein designated VGAM HOST TARGET RNA. This complementary binding is due to the fact that the nucleotide sequence of VGAM2353 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2353 RNA, herein designated VGAM RNA, may have a different number of host target binding sites in untranslated regions of a VGAM2353 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2353 RNA, herein designated VGAM RNA, to host target binding sites on VGAM2353 host target RNA, herein designated VGAM HOST TARGET RNA, such as BINDING SITE I, BINDING SITE II and BINDING SITE III, inhibits translation of VGAM2353 host target RNA into VGAM2353 host target protein, herein designated VGAM HOST TARGET PROTEIN. VGAM host target protein is therefore outlined by a broken line.

It is appreciated that VGAM2353 host target gene, herein designated VGAM HOST TARGET GENE, in fact represents a plurality of VGAM2353 host target genes. The mRNA of each one of this plurality of VGAM2353 host target genes comprises one or more host target binding sites, each having a nucleotide sequence which is at least partly complementary to VGAM2353 RNA, herein designated VGAM RNA, and which when bound by VGAM2353 RNA causes inhibition of translation of respective one or more VGAM2353 host target proteins.

It is further appreciated by one skilled in the art that the mode of translational inhibition illustrated by FIG. 1 with specific reference to translational inhibition exerted by VGAM2353 gene, herein designated VGAM GENE, on one or more VGAM2353 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2353 is inhibition of expression of host target genes, as part of a novel viral mechanism of attacking a host. Accordingly, utilities of VGAM2353 include diagnosis, prevention and treatment of viral infection by Equine Herpesvirus 2. Specific functions, and accordingly utilities, of VGAM2353 correlate with, and may be deduced from, the identity of the host target genes which VGAM2353 binds and inhibits, and the function of these host target genes, as elaborated hereinbelow.

Nucleotide sequences of the VGAM2353 precursor RNA, herein designated VGAM PRECURSOR RNA, and of the 'diced' VGAM2353 RNA, herein designated VGAM RNA, and a schematic representation of the secondary folding of VGAM2353 folded precursor RNA, herein designated VGAM FOLDED PRECURSOR RNA, of VGAM2353 are further described hereinbelow with reference to Table 1.

Nucleotide sequences of host target binding sites, such as BINDING SITE-I, BINDING SITE-II and BINDING SITE-III of FIG. 1, found on VGAM2353 host target RNA, and schematic representation of the complementarity of each of these host target binding sites to VGAM2353 RNA, herein designated VGAM RNA, are described hereinbelow with reference to Table 2.

As mentioned hereinabove with reference to FIG. 1, a function of VGAM2353 gene, herein designated VGAM is inhibition of expression of VGAM2353 target genes. It is appreciated that specific functions, and accordingly utilities, of VGAM2353 correlate with, and may be deduced from, the identity of the target genes which VGAM2353 binds and inhibits, and the function of these target genes, as elaborated hereinbelow.

Aristaless-like Homeobox 3 (ALX3, Accession NM_006492) is a VGAM2353 host target gene. ALX3 BINDING SITE is HOST TARGET binding site found in the 3' untranslated region of mRNA encoded by ALX3, corresponding to a HOST TARGET binding site such as BINDING SITE I, BINDING SITE II or BINDING SITE III. Table 2 illustrates the complementarity of the nucleotide sequences of ALX3 BINDING SITE, designated SEQ ID:13223, to the nucleotide sequence of VGAM2353 RNA, herein designated VGAM RNA, also designated SEQ ID:5064.

A function of VGAM2353 is therefore inhibition of Aristaless-like Homeobox 3 (ALX3, Accession NM_006492), a gene which is involved in cell-type differentiation and development. Accordingly, utilities of VGAM2353 include diagnosis, prevention and treatment of diseases and clinical conditions associated with ALX3. The function of ALX3 and its association with various diseases and clinical conditions, has been established by previous studies, as described hereinabove with reference to VGAM55. AT-binding Transcription Factor 1 (ATBF1, Accession NM_006885) is another VGAM2353 host target gene. ATBF1 BINDING SITE is HOST TARGET binding site found in the 5' untranslated region of mRNA encoded by ATBF1, corresponding to a HOST TARGET binding site such as BINDING SITE I, BINDING SITE II or BINDING SITE III. Table 2 illustrates the complementarity of the nucleotide sequences of ATBF1 BINDING SITE, designated SEQ ID:13749, to the nucleotide sequence of VGAM2353 RNA, herein designated VGAM RNA, also designated SEQ ID:5064.

Another function of VGAM2353 is therefore inhibition of AT-binding Transcription Factor 1 (ATBF1, Accession NM_006885). Accordingly, utilities of VGAM2353 include diagnosis, prevention and treatment of diseases and clinical conditions associated with ATBF1. ATPase, Cu++ Transporting, Beta Polypeptide (Wilson disease) (ATP7B, Accession NM_000053) is another VGAM2353 host target gene. ATP7B BINDING SITE is HOST TARGET binding site found in the 3' untranslated region of mRNA encoded by ATP7B, corresponding to a HOST TARGET binding site such as BINDING SITE I, BINDING SITE II or BINDING SITE III. Table 2 illustrates the complementarity of the nucleotide sequences of ATP7B BINDING SITE, designated SEQ ID:5507, to the nucleotide sequence of VGAM2353 RNA, herein designated VGAM RNA, also designated SEQ ID:5064.

Another function of VGAM2353 is therefore inhibition of ATPase, Cu++ Transporting, Beta Polypeptide (Wilson disease) (ATP7B, Accession NM_000053). Accordingly, utilities of VGAM2353 include diagnosis, prevention and treatment of diseases and clinical conditions associated with ATP7B. AXL Receptor Tyrosine Kinase (AXL, Accession NM_001699) is another VGAM2353 host target gene. AXL BINDING SITE1 and AXL BINDING SITE2 are HOST TARGET binding sites found in untranslated regions of mRNA encoded by AXL, corresponding to HOST TARGET binding sites such as BINDING SITE I, BINDING SITE II or BINDING SITE III. Table 2 illustrates the complementarity of the nucleotide sequences of AXL BINDING SITE1 and AXL BINDING SITE2, designated SEQ ID:7424 and SEQ ID:22445 respectively, to the nucleotide sequence of VGAM2353 RNA, herein designated VGAM RNA, also designated SEQ ID:5064.

Another function of VGAM2353 is therefore inhibition of AXL Receptor Tyrosine Kinase (AXL, Accession NM_001699). Accordingly, utilities of VGAM2353 include diagnosis, prevention and treatment of diseases and clinical conditions associated with AXL. Chromosome 1 Open Reading Frame 6 (C1orf6, Accession NM_020131) is another VGAM2353 host target gene. C1orf6 BINDING SITE is HOST TARGET binding site found in the 5' untranslated region of mRNA encoded by C1orf6, corresponding to a HOST TARGET binding site such as BINDING SITE I, BINDING SITE II or BINDING SITE III. Table 2 illustrates the complementarity of the nucleotide sequences of C1orf6 BINDING SITE, designated SEQ ID:21329, to the nucleotide sequence of VGAM2353 RNA, herein designated VGAM RNA, also designated SEQ ID:5064.

Another function of VGAM2353 is therefore inhibition of Chromosome 1 Open Reading Frame 6 (C1orf6, Accession NM_020131), a gene which may link ataxin-1 with the chaperone and ubiquitin/proteasome pathways. Accordingly, utilities of VGAM2353 include diagnosis, prevention and treatment of diseases and clinical conditions associated with C1orf6. The function of C1orf6 and its association with various diseases and clinical conditions, has been established by previous studies, as described hereinabove with reference to VGAM1286. Citron (rho-interacting, serine/threonine kinase 21) (CIT, Accession XM_045786) is another VGAM2353 host target gene. CIT BINDING SITE is HOST TARGET binding site found in the 3' untranslated region of mRNA encoded by CIT, corresponding to a HOST TARGET binding site such as BINDING SITE I, BINDING SITE II or BINDING SITE III. Table 2 illustrates the complementarity of the nucleotide sequences of CIT BINDING SITE, designated SEQ ID:34564, to the nucleotide sequence of VGAM2353 RNA, herein designated VGAM RNA, also designated SEQ ID:5064.

Another function of VGAM2353 is therefore inhibition of Citron (rho-interacting, serine/threonine kinase 21) (CIT, Accession XM_045786), a gene which is increased several-fold by coexpression of constitutively active Rho. Accordingly, utilities of VGAM2353 include diagnosis, prevention and treatment of diseases and clinical conditions associated with CIT. The function of CIT and its association with various diseases and clinical conditions, has been established by previous studies, as described hereinabove with reference to VGAM393. Dopamine Beta-hydroxylase (dopamine beta-monooxygenase) (DBH, Accession NM_000787) is another VGAM2353 host target gene. DBH BINDING SITE is HOST TARGET binding site found in the 3' untranslated region of mRNA encoded by DBH, corresponding to a HOST TARGET binding site such as BINDING SITE I, BINDING SITE II or BINDING SITE III. Table 2 illustrates the complementarity of the nucleotide sequences of DBH BINDING SITE, designated SEQ ID:6440, to the nucleotide sequence of VGAM2353 RNA, herein designated VGAM RNA, also designated SEQ ID:5064.

Another function of VGAM2353 is therefore inhibition of Dopamine Beta-hydroxylase (dopamine beta-monooxygenase) (DBH, Accession NM_000787), a gene which converts dopamine to norepinephrine. Accordingly, utilities of VGAM2353 include diagnosis, prevention and treatment of diseases and clinical conditions associated with DBH. The function of DBH and its association with various diseases and clinical conditions, has been established by previous studies, as described hereinabove with reference to VGAM1189. Forkhead Box E1 (thyroid transcription factor 2) (FOXE1, Accession NM_004473) is another VGAM2353 host target gene. FOXE1 BINDING SITE is HOST TARGET binding site found in the 5' untranslated region of mRNA encoded by FOXE1, corresponding to a HOST TARGET binding site such as BINDING SITE I, BINDING SITE II or BINDING SITE III. Table 2 illustrates the complementarity of the nucleotide sequences of FOXE1 BINDING SITE, designated SEQ ID:10784, to the nucleotide sequence of VGAM2353 RNA, herein designated VGAM RNA, also designated SEQ ID:5064.

Another function of VGAM2353 is therefore inhibition of Forkhead Box E1 (thyroid transcription factor 2) (FOXE1, Accession NM_004473). Accordingly, utilities of VGAM2353 include diagnosis, prevention and treatment of diseases and clinical conditions associated with FOXE1. GRB2-associated Binding Protein 2 (GAB2, Accession NM_080491) is another VGAM2353 host target gene. GAB2 BINDING SITE1 and GAB2 BINDING SITE2 are HOST TARGET binding sites found in untranslated regions of mRNA encoded by GAB2, corresponding to HOST TARGET binding sites such as BINDING SITE I, BINDING SITE II or BINDING SITE III. Table 2 illustrates the complementarity of the nucleotide sequences of GAB2 BINDING SITE1 and GAB2 BINDING SITE2, designated SEQ ID:27849 and SEQ ID:14654 respectively, to the nucleotide sequence of VGAM2353 RNA, herein designated VGAM RNA, also designated SEQ ID:5064.

Another function of VGAM2353 is therefore inhibition of GRB2-associated Binding Protein 2 (GAB2, Accession NM_080491), a gene which act as adapters for transmitting various signals. Accordingly, utilities of VGAM2353 include diagnosis, prevention and treatment of diseases and clinical conditions associated with GAB2. The function of GAB2 and its association with various diseases and clinical conditions, has been established by previous studies, as described hereinabove with reference to VGAM53. Host Cell Factor C1 (VP16-accessory protein) (HCFC1, Accession XM_048390) is another VGAM2353 host target gene. HCFC1 BINDING SITE is HOST TARGET binding site found in the 3' untranslated region of mRNA encoded by HCFC1, corresponding to a HOST TARGET binding site such as BINDING SITE I, BINDING SITE II or BINDING SITE III. Table 2 illustrates the complementarity of the nucleotide sequences of HCFC1 BINDING SITE, designated SEQ ID:35159, to the nucleotide sequence of VGAM2353 RNA, herein designated VGAM RNA, also designated SEQ ID:5064.

Another function of VGAM2353 is therefore inhibition of Host Cell Factor C1 (VP16-accessory protein) (HCFC1, Accession XM_048390), a gene which is a host cell factor, has a role in cell proliferation and can form a complex with HSV VP16. Accordingly, utilities of VGAM2353 include diagnosis, prevention and treatment of diseases and clinical conditions associated with HCFC1. The function of HCFC1 and its association with various diseases and clinical conditions, has been established by previous studies, as described hereinabove with reference to VGAM341. HERV-H LTR-associating 1 (HHLA1, Accession NM_005712) is another VGAM2353 host target gene. HHLA1 BINDING SITE is HOST TARGET binding site found in the 5' untranslated region of mRNA encoded by HHLA1, corresponding to a HOST TARGET binding site such as BINDING SITE I, BINDING SITE II or BINDING SITE III. Table 2 illustrates the complementarity of the nucleotide sequences of HHLA1 BINDING SITE, designated SEQ ID:12263, to the nucleotide sequence of VGAM2353 RNA, herein designated VGAM RNA, also designated SEQ ID:5064.

Another function of VGAM2353 is therefore inhibition of HERV-H LTR-associating 1 (HHLA1, Accession NM_005712), a gene which has unknown function and with low similarity to a region of S. cerevisiae WSC4. Accordingly, utilities of VGAM2353 include diagnosis, prevention and treatment of diseases and clinical conditions associated with HHLA1. The function of HHLA1 and its association with various diseases and clinical conditions, has been established by previous studies, as described hereinabove with reference to VGAM158. Hexokinase 2 (HK2, Accession NM_000189) is another VGAM2353 host target gene. HK2 BINDING SITE is HOST TARGET binding site found in the 5' untranslated region of mRNA encoded by HK2, corresponding to a HOST TARGET binding site such as BINDING SITE I, BINDING SITE II or BINDING SITE III. Table 2 illustrates the complementarity of the nucleotide sequences of HK2 BINDING SITE, designated SEQ ID:5690, to the nucleotide sequence of VGAM2353 RNA, herein designated VGAM RNA, also designated SEQ ID:5064.

Another function of VGAM2353 is therefore inhibition of Hexokinase 2 (HK2, Accession NM_000189), a gene which plays an important role in intracellular glucose metabolism by catalyzing the conversion of glucose to glucose-6-phosphate. Accordingly, utilities of VGAM2353 include diagnosis, prevention and treatment of diseases and clinical conditions associated with HK2. The function of HK2 has been established by previous studies. Hexokinase II is the major hexokinase expressed in skeletal muscle. Insulin has been shown to increase transcription of this gene. Lehto et al. (1993) described the isolation of genomic clones for human hexokinase-2. These clones were isolated by screening a human placental genomic library with a rat hexokinase-2 cDNA clone. A genomic clone derived from this screening was used in fluorescence in situ hybridization studies and was found to map to human chromosome 2p13.1. The human HK2 genomic clones were also screened for dinucleotide repeats. Primers were selected to amplify an approximately 224-bp CA-repeat-rich region. This repeat region was highly polymorphic; the level of heterozygosity was 0.63 in Caucasians and 0.51 in Chinese subjects. Lehto et al. (1993) carried out linkage studies between this HK2 polymorphism and 9 markers on chromosome 2. No recombinants were observed between HK2 and TGFA (OMIM Ref. No. 190170) and D2S45; the most likely map order with respect to several chromosomal markers was determined. The HK2 gene is highly expressed in rapidly growing tumors to facilitate high rates of glucose catabolism. Mathupala et al. (1995) cloned and characterized the promoter of the rat HK2 gene from a highly glycolytic hepatoma cell line (OMIM Ref. No. AS-30D). Mathupala et al. (1997) showed that the HK2 promoter contains functionally active response elements for p53 (OMIM Ref. No. 191170). Using coexpression assays, they showed that overexpression of a mutant p53 gene found in the tumor cell line significantly and reproducibly activated the HK2 promoter and increased HK2 gene expression. Mathupala et al. (1997) stated that theirs was the first report of a possible link between loss of cell cycle control in rapidly growing cells and their high glycolytic rate.

Full details of the abovementioned studies are described in the following publications, the disclosure of which are hereby incorporated by reference:

Lehto, M.; Xiang, K.; Stoffel, M.; Espinosa, R., III; Groop, L. C.; Le Beau, M. M.; Bell, G. I.: Human hexokinase II: localization of the polymorphic gene to chromosome 2. Diabetologia 36:1299-1302, 1993; and Mathupala, S. P.; Heese, C.; Pedersen, P. L.: Glucose catabolism in cancer cells: the type II hexokinase promoter contains functionally active response elements for the tumor suppressor.

Further studies establishing the function and utilities of HK2 are found in John Hopkins OMIM database record ID 601125, and in sited publications numbered 6874-6881 listed in the bibliography section hereinbelow, which are also hereby incorporated by reference. Holocarboxylase Synthetase (biotin-[proprionyl-Coenzyme A-carboxylase (ATP-hydrolysing)] Ligase) (HLCS, Accession NM_000411) is another VGAM2353 host target gene. HLCS BINDING SITE is HOST TARGET binding site found in the 5' untranslated region of mRNA encoded by HLCS, corresponding to a HOST TARGET binding site such as BINDING SITE I, BINDING SITE II or BINDING SITE III. Table 2 illustrates the complementarity of the nucleotide sequences of HLCS BINDING SITE, designated SEQ ID:5991, to the nucleotide sequence of VGAM2353 RNA, herein designated VGAM RNA, also designated SEQ ID:5064.

Another function of VGAM2353 is therefore inhibition of Holocarboxylase Synthetase (biotin-[proprionyl-Coenzyme A-carboxylase (ATP-hydrolysing)] Ligase) (HLCS, Accession NM_000411). Accordingly, utilities of VGAM2353 include diagnosis, prevention and treatment of diseases and clinical conditions associated with HLCS. Insulin Receptor Substrate 1 (IRS1, Accession NM_005544) is another VGAM2353 host target gene. IRS1 BINDING SITE is HOST TARGET binding site found in the 5' untranslated region of mRNA encoded by IRS1, corresponding to a HOST TARGET binding site such as BINDING SITE I, BINDING SITE II or BINDING SITE III. Table 2 illustrates the complementarity of the nucleotide sequences of IRS1 BINDING SITE, designated SEQ ID:12068, to the nucleotide sequence of VGAM2353 RNA, herein designated VGAM RNA, also designated SEQ ID:5064.

Another function of VGAM2353 is therefore inhibition of Insulin Receptor Substrate 1 (IRS1, Accession NM_005544), a gene which may mediate the control of various cellular processes by insulin. Accordingly, utilities of VGAM2353 include diagnosis, prevention and treatment of diseases and clinical conditions associated with IRS1. The function of IRS1 and its association with various diseases and clinical conditions, has been established by previous studies, as described hereinabove with reference to VGAM281. Insulin Receptor Substrate 2 (IRS2, Accession XM_007095) is another VGAM2353 host target gene. IRS2 BINDING SITE is HOST TARGET binding site found in the 5' untranslated region of mRNA encoded by IRS2, corresponding to a HOST TARGET binding site such as BINDING SITE I, BINDING SITE II or BINDING SITE III. Table 2 illustrates the complementarity of the nucleotide sequences of IRS2 BINDING SITE, designated SEQ ID:30031, to the nucleotide sequence of VGAM2353 RNA, herein designated VGAM RNA, also designated SEQ ID:5064.

Another function of VGAM2353 is therefore inhibition of Insulin Receptor Substrate 2 (IRS2, Accession XM_007095), a gene which may mediate the control of various cellular processes by insulin. Accordingly, utilities of VGAM2353 include diagnosis, prevention and treatment of diseases and clinical conditions associated with IRS2. The function of IRS2 and its association with various diseases and clinical conditions, has been established by previous studies, as described hereinabove with reference to VGAM1217. Potassium Voltage-gated Channel, Shaw-related Subfamily, Member 3 (KCNC3, Accession NM_004977) is another VGAM2353 host target gene. KCNC3 BINDING SITE is HOST TARGET binding site found in the 3' untranslated region of mRNA encoded by KCNC3, corresponding to a HOST TARGET binding site such as BINDING SITE I, BINDING SITE II or BINDING SITE III. Table 2 illustrates the complementarity of the nucleotide sequences of KCNC3 BINDING SITE, designated SEQ ID:11421, to the nucleotide sequence of VGAM2353 RNA, herein designated VGAM RNA, also designated SEQ ID:5064.

Another function of VGAM2353 is therefore inhibition of Potassium Voltage-gated Channel, Shaw-related Subfamily, Member 3 (KCNC3, Accession NM_004977), a gene which mediates the voltage-dependent potassium ion permeability of excitable membranes. Accordingly, utilities of VGAM2353 include diagnosis, prevention and treatment of diseases and clinical conditions associated with KCNC3. The function of KCNC3 and its association with various diseases and clinical conditions, has been established by previous studies, as described hereinabove with reference to VGAM476. Potassium Channel, Subfamily K, Member 4 (KCNK4, Accession NM_033310) is another VGAM2353 host target gene. KCNK4 BINDING SITE1 and KCNK4 BINDING SITE2 are HOST TARGET binding sites found in untranslated regions of mRNA encoded by KCNK4, corresponding to HOST TARGET binding sites such as BINDING SITE I, BINDING SITE II or BINDING SITE III. Table 2 illustrates the complementarity of the nucleotide sequences of KCNK4 BINDING SITE1 and KCNK4 BINDING SITE2, designated SEQ ID:27151 and SEQ ID:27152 respectively, to the nucleotide sequence of VGAM2353 RNA, herein designated VGAM RNA, also designated SEQ ID:5064.

Another function of VGAM2353 is therefore inhibition of Potassium Channel, Subfamily K, Member 4 (KCNK4, Accession NM_033310). Accordingly, utilities of VGAM2353 include diagnosis, prevention and treatment of diseases and clinical conditions associated with KCNK4. LIM Domain Only 2 (rhombotin-like 1) (LMO2, Accession NM_005574) is another VGAM2353 host target gene. LMO2 BINDING SITE is HOST TARGET binding site found in the 5' untranslated region of mRNA encoded by LMO2, corresponding to a HOST TARGET binding site such as BINDING SITE I, BINDING SITE II or BINDING SITE III. Table 2 illustrates the complementarity of the nucleotide sequences of LMO2 BINDING SITE, designated SEQ ID:12101, to the nucleotide sequence of VGAM2353 RNA, herein designated VGAM RNA, also designated SEQ ID:5064.

Another function of VGAM2353 is therefore inhibition of LIM Domain Only 2 (rhombotin-like 1) (LMO2, Accession NM_005574). Accordingly, utilities of VGAM2353 include diagnosis, prevention and treatment of diseases and clinical conditions associated with LMO2. LNK (Accession NM_005475) is another VGAM2353 host target gene. LNK BINDING SITE is HOST TARGET binding site found in the 5' untranslated region of mRNA encoded by LNK, corresponding to a HOST TARGET binding site such as BINDING SITE I, BINDING SITE II or BINDING SITE III. Table 2 illustrates the complementarity of the nucleotide sequences of LNK BINDING SITE, designated SEQ ID:11975, to the nucleotide sequence of VGAM2353 RNA, herein designated VGAM RNA, also designated SEQ ID:5064.

Another function of VGAM2353 is therefore inhibition of LNK (Accession NM_005475), a gene which links T-cell receptor activation signal to phospholipase c-gamma-1, grb-2 and phosphatidylinositol 3-kinase (by similarity). Accordingly, utilities of VGAM2353 include diagnosis, prevention and treatment of diseases and clinical conditions associated with LNK. The function of LNK and its association with various diseases and clinical conditions, has been established by previous studies, as described hereinabove with reference to VGAM115. Megakaryocyte-associated Tyrosine Kinase (MATK, Accession NM_139354) is another VGAM2353 host target gene. MATK BINDING SITE is HOST TARGET binding site found in the 5' untranslated region of mRNA encoded by MATK, corresponding to a HOST TARGET binding site such as BINDING SITE I, BINDING SITE II or BINDING SITE III. Table 2 illustrates the complementarity of the nucleotide sequences of MATK BINDING SITE, designated SEQ ID:29304, to the nucleotide sequence of VGAM2353 RNA, herein designated VGAM RNA, also designated SEQ ID:5064.

Another function of VGAM2353 is therefore inhibition of Megakaryocyte-associated Tyrosine Kinase (MATK, Accession NM_139354), a gene which can phosphorylate members of the SRC family of PTKs at the regulatory tyrosine residue. Accordingly, utilities of VGAM2353 include diagnosis, prevention and treatment of diseases and clinical conditions associated with MATK. The function of MATK and its association with various diseases and clinical conditions, has been established by previous studies, as described hereinabove with reference to VGAM2173. Mannosyl (alpha-1,6-)-glycoprotein Beta-1,2-N-acetylglucosaminyltransferase (MGAT2, Accession NM_002408) is another VGAM2353 host target gene. MGAT2 BINDING SITE is HOST TARGET binding site found in the 5' untranslated region of mRNA encoded by MGAT2, corresponding to a HOST TARGET binding site such as BINDING SITE I, BINDING SITE II or BINDING SITE III. Table 2 illustrates the complementarity of the nucleotide sequences of MGAT2 BINDING SITE, designated SEQ ID:8232, to the nucleotide sequence of VGAM2353 RNA, herein designated VGAM RNA, also designated SEQ ID:5064.

Another function of VGAM2353 is therefore inhibition of Mannosyl (alpha-1,6-)-glycoprotein Beta-1,2-N-acetylglucosaminyltransferase (MGAT2, Accession NM_002408). Accordingly, utilities of VGAM2353 include diagnosis, prevention and treatment of diseases and clinical conditions associated with MGAT2. Mucin and Cadherin-like (MUCDHL, Accession XM_113227) is another VGAM2353 host target gene. MUCDHL BINDING SITE1 and MUCDHL BINDING SITE2 are HOST TARGET binding sites found in untranslated regions of mRNA encoded by MUCDHL, corresponding to HOST TARGET binding sites such as BINDING SITE I, BINDING SITE II or BINDING SITE III. Table 2 illustrates the complementarity of the nucleotide sequences of MUCDHL BINDING SITE1 and MUCDHL BINDING SITE2, designated SEQ ID:42209 and SEQ ID:25284 respectively, to the nucleotide sequence of VGAM2353 RNA, herein designated VGAM RNA, also designated SEQ ID:5064.

Another function of VGAM2353 is therefore inhibition of Mucin and Cadherin-like (MUCDHL, Accession XM_113227). Accordingly, utilities of VGAM2353 include diagnosis, prevention and treatment of diseases and clinical conditions associated with MUCDHL. Neurexin 2 (NRXN2, Accession NM_015080) is another VGAM2353 host target gene. NRXN2 BINDING SITE1 and NRXN2 BINDING SITE2 are HOST TARGET binding sites found in untranslated regions of mRNA encoded by NRXN2, corresponding to HOST TARGET binding sites such as BINDING SITE I, BINDING SITE II or BINDING SITE III. Table 2 illustrates the complementarity of the nucleotide sequences of NRXN2 BINDING SITE1 and NRXN2 BINDING SITE2, designated SEQ ID:17469 and SEQ ID:28985 respectively, to the nucleotide sequence of VGAM2353 RNA, herein designated VGAM RNA, also designated SEQ ID:5064.

Another function of VGAM2353 is therefore inhibition of Neurexin 2 (NRXN2, Accession NM_015080), a gene which may be involved in cell recognition, cell adhesion, and may mediate intracellular signaling. Accordingly, utilities of VGAM2353 include diagnosis, prevention and treatment of diseases and clinical conditions associated with NRXN2. The function of NRXN2 and its association with various diseases and clinical conditions, has been established by previous studies, as described hereinabove with reference to VGAM178. Platelet-activating Factor Acetylhydrolase, Isoform Ib, Alpha Subunit 45 kDa (PAFAH1B1, Accession NM_000430) is another VGAM2353 host target gene. PAFAH1B1 BINDING SITE is HOST TARGET binding site found in the 5' untranslated region of mRNA encoded by PAFAH1B1, corresponding to a HOST TARGET binding site such as BINDING SITE I, BINDING SITE II or BINDING SITE III. Table 2 illustrates the complementarity of the nucleotide sequences of PAFAH1B1 BINDING SITE, designated SEQ ID:6011, to the nucleotide sequence of VGAM2353 RNA, herein designated VGAM RNA, also designated SEQ ID:5064.

Another function of VGAM2353 is therefore inhibition of Platelet-activating Factor Acetylhydrolase, Isoform Ib, Alpha Subunit 45 kDa (PAFAH1B1, Accession NM_000430). Accordingly, utilities of VGAM2353 include diagnosis, prevention and treatment of diseases and clinical conditions associated with PAFAH1B1. poly (rC) Binding Protein 1 (PCBP1, Accession NM_006196) is another VGAM2353 host target gene. PCBP1 BINDING SITE is HOST TARGET binding site found in the 5' untranslated region of mRNA encoded by PCBP1, corresponding to a HOST TARGET binding site such as BINDING SITE I, BINDING SITE II or BINDING SITE III. Table 2 illustrates the complementarity of the nucleotide sequences of PCBP1 BINDING SITE, designated SEQ ID:12869, to the nucleotide sequence of VGAM2353 RNA, herein designated VGAM RNA, also designated SEQ ID:5064.

Another function of VGAM2353 is therefore inhibition of poly (rC) Binding Protein 1 (PCBP1, Accession NM_006196), a gene which binds preferentially to oligo dc. Accordingly, utilities of VGAM2353 include diagnosis, prevention and treatment of diseases and clinical conditions associated with PCBP1. The function of PCBP1 has been established by previous studies. Leffers et al. (1995) described the cloning and characterization of 2 cDNAs for poly (rC)-binding proteins, called PCBP1 and PCBP2 (OMIM Ref. No. 601210) by them. The authors analyzed an EST database for sequences that were predicted to encode a protein with K-homologous (KH) domains. The 60- to 70-amino acid KH motifs are found in several putative nucleic acid binding proteins such as FMR1 (OMIM Ref. No. 309550) and HNRNPK (OMIM Ref. No. 600712) and are thought to be involved in RNA binding. Using primers from 1 EST the authors produced a probe that was used to screen a cDNA library of transformed human amnion cells. The cDNA they isolated for PCBP1 encodes a putative 356-amino acid protein that contains 3 KH domains. It is 83% identical to PCBP2 at the DNA level and 90% homologous at the amino acid level. The PCBP1 protein is about 85% similar to the mouse hnRNP-X/mCTBP protein (Hahm et al., 1993). When expressed with a vaccinia virus system in transformed amnion cells, Leffers et al. (1995) found that both PCBP1 and PCBP2 bound poly (rC) when not phosphorylated; phosphorylated protein bound with much lower affinity. Transcripts of both PCBPs were detected in all the human tissues analyzed. Tommerup and Leffers (1996) mapped PCBP1 to 2p13-p12 by fluorescence in situ hybridization.

Full details of the abovementioned studies are described in the following publications, the disclosure of which are hereby incorporated by reference:

Leffers, H.; Dejgaard, K.; Celis, J. E.: Characterisation of two major cellular poly (rC)-binding human proteins, each containing three K-homologous (KH) domains. Europ. J. Biochem. 230:447-453, 1995; and Tommerup, N.; Leffers, H.: Assignment of human KH-box-containing genes by in situ hybridization: HNRNPK maps to 9q21.32-q21.33, PCBP1 to 2p12-p13, and PCBP2 to 12q13.12-q13.13, distal t.

Further studies establishing the function and utilities of PCBP1 are found in John Hopkins OMIM database record ID 601209, and in sited publications numbered 6885-688 and 10050 listed in the bibliography section hereinbelow, which are also hereby incorporated by reference. Protocadherin 9 (PCDH9, Accession XM_096054) is another VGAM2353 host target gene. PCDH9 BINDING SITE is HOST TARGET binding site found in the 5' untranslated region of mRNA encoded by PCDH9, corresponding to a HOST TARGET binding site such as BINDING SITE I, BINDING SITE II or BINDING SITE III. Table 2 illustrates the complementarity of the nucleotide sequences of PCDH9 BINDING SITE, designated SEQ ID:40295, to the nucleotide sequence of VGAM2353 RNA, herein designated VGAM RNA, also designated SEQ ID:5064.

Another function of VGAM2353 is therefore inhibition of Protocadherin 9 (PCDH9, Accession XM_096054). Accordingly, utilities of VGAM2353 include diagnosis, prevention and treatment of diseases and clinical conditions associated with PCDH9. Protein Kinase (cAMP-dependent, catalytic) Inhibitor Alpha (PKIA, Accession NM_006823) is another VGAM2353 host target gene. PKIA BINDING SITE is HOST TARGET binding site found in the 5' untranslated region of mRNA encoded by PKIA, corresponding to a HOST TARGET binding site such as BINDING SITE I, BINDING SITE II or BINDING SITE III. Table 2 illustrates the complementarity of the nucleotide sequences of PKIA BINDING SITE, designated SEQ ID:13701, to the nucleotide sequence of VGAM2353 RNA, herein designated VGAM RNA, also designated SEQ ID:5064.

Another function of VGAM2353 is therefore inhibition of Protein Kinase (cAMP-dependent, catalytic) Inhibitor Alpha (PKIA, Accession NM_006823). Accordingly, utilities of VGAM2353 include diagnosis, prevention and treatment of diseases and clinical conditions associated with PKIA. RAD50 Homolog (S. cerevisiae) (RAD50, Accession NM_005732) is another VGAM2353 host target gene. RAD50 BINDING SITE1 and RAD50 BINDING SITE2 are HOST TARGET binding sites found in untranslated regions of mRNA encoded by RAD50, corresponding to HOST TARGET binding sites such as BINDING SITE I, BINDING SITE II or BINDING SITE III. Table 2 illustrates the complementarity of the nucleotide sequences of RAD50 BINDING SITE1 and RAD50 BINDING SITE2, designated SEQ ID:12295 and SEQ ID:28552 respectively, to the nucleotide sequence of VGAM2353 RNA, herein designated VGAM RNA, also designated SEQ ID:5064.

Another function of VGAM2353 is therefore inhibition of RAD50 Homolog (S. cerevisiae) (RAD50, Accession NM_005732), a gene which is involved in dna double-strand break repair (dsbr). Accordingly, utilities of VGAM2353 include diagnosis, prevention and treatment of diseases and clinical conditions associated with RAD50. The function of RAD50 and its association with various diseases and clinical conditions, has been established by previous studies, as described hereinabove with reference to VGAM132. Solute Carrier Family 22 (extraneuronal monoamine transporter), Member 3 (SLC22A3, Accession NM_021977) is another VGAM2353 host target gene. SLC22A3 BINDING SITE is HOST TARGET binding site found in the 3' untranslated region of mRNA encoded by SLC22A3, corresponding to a HOST TARGET binding site such as BINDING SITE I, BINDING SITE II or BINDING SITE III. Table 2 illustrates the complementarity of the nucleotide sequences of SLC22A3 BINDING SITE, designated SEQ ID:22505, to the nucleotide sequence of VGAM2353 RNA, herein designated VGAM RNA, also designated SEQ ID:5064.

Another function of VGAM2353 is therefore inhibition of Solute Carrier Family 22 (extraneuronal monoamine transporter), Member 3 (SLC22A3, Accession NM_021977), a gene which is a sodium-ion dependent, high affinity carnitine transporter. also transports organic cations without the involvement of sodium. involved in the active cellular uptake of carnitine. Accordingly, utilities of VGAM2353 include diagnosis, prevention and treatment of diseases and clinical conditions associated with SLC22A3. The function of SLC22A3 and its association with various diseases and clinical conditions, has been established by previous studies, as described hereinabove with reference to VGAM2147. SMAC (Accession NM_138930) is another VGAM2353 host target gene. SMAC BINDING SITE is HOST TARGET binding site found in the 5' untranslated region of mRNA encoded by SMAC, corresponding to a HOST TARGET binding site such as BINDING SITE I, BINDING SITE II or BINDING SITE III. Table 2 illustrates the complementarity of the nucleotide sequences of SMAC BINDING SITE, designated SEQ ID:29053, to the nucleotide sequence of VGAM2353 RNA, herein designated VGAM RNA, also designated SEQ ID:5064.

Another function of VGAM2353 is therefore inhibition of SMAC (Accession NM_138930), a gene which promotes apoptosis via caspase activation. Accordingly, utilities of VGAM2353 include diagnosis, prevention and treatment of diseases and clinical conditions associated with SMAC. The function of SMAC and its association with various diseases and clinical conditions, has been established by previous studies, as described hereinabove with reference to VGAM74. SMG1 (Accession NM_015092) is another VGAM2353 host target gene. SMG1 BINDING SITE is HOST TARGET binding site found in the 5' untranslated region of mRNA encoded by SMG1, corresponding to a HOST TARGET binding site such as BINDING SITE I, BINDING SITE II or BINDING SITE III. Table 2 illustrates the complementarity of the nucleotide sequences of SMG1 BINDING SITE, designated SEQ ID:17479, to the nucleotide sequence of VGAM2353 RNA, herein designated VGAM RNA, also designated SEQ ID:5064.

Another function of VGAM2353 is therefore inhibition of SMG1 (Accession NM_015092), a gene which acts as the target for the cell-cycle arrest and immunosuppressive effects. Accordingly, utilities of VGAM2353 include diagnosis, prevention and treatment of diseases and clinical conditions associated with SMG1. The function of SMG1 and its association with various diseases and clinical conditions, has been established by previous studies, as described hereinabove with reference to VGAM419. SRY (sex determining region Y)-box 10 (SOX10, Accession NM_006941) is another VGAM2353 host target gene. SOX10 BINDING SITE is HOST TARGET binding site found in the 5' untranslated region of mRNA encoded by SOX10, corresponding to a HOST TARGET binding site such as BINDING SITE I, BINDING SITE II or BINDING SITE III. Table 2 illustrates the complementarity of the nucleotide sequences of SOX10 BINDING SITE, designated SEQ ID:13824, to the nucleotide sequence of VGAM2353 RNA, herein designated VGAM RNA, also designated SEQ ID:5064.

Another function of VGAM2353 is therefore inhibition of SRY (sex determining region Y)-box 10 (SOX10, Accession NM_006941). Accordingly, utilities of VGAM2353 include diagnosis, prevention and treatment of diseases and clinical conditions associated with SOX10. SRP46 (Accession NM_032102) is another VGAM2353 host target gene. SRP46 BINDING SITE is HOST TARGET binding site found in the 5' untranslated region of mRNA encoded by SRP46, corresponding to a HOST TARGET binding site such as BINDING SITE I, BINDING SITE II or BINDING SITE III. Table 2 illustrates the complementarity of the nucleotide sequences of SRP46 BINDING SITE, designated SEQ ID:25791, to the nucleotide sequence of VGAM2353 RNA, herein designated VGAM RNA, also designated SEQ ID:5064.

Another function of VGAM2353 is therefore inhibition of SRP46 (Accession NM_032102). Accordingly, utilities of VGAM2353 include diagnosis, prevention and treatment of diseases and clinical conditions associated with SRP46. Transforming, Acidic Coiled-coil Containing Protein 1 (TACC1, Accession NM_006283) is another VGAM2353 host target gene. TACC1 BINDING SITE is HOST TARGET binding site found in the 5' untranslated region of mRNA encoded by TACC1, corresponding to a HOST TARGET binding site such as BINDING SITE I, BINDING SITE II or BINDING SITE III. Table 2 illustrates the complementarity of the nucleotide sequences of TACC1 BINDING SITE, designated SEQ ID:12967, to the nucleotide sequence of VGAM2353 RNA, herein designated VGAM RNA, also designated SEQ ID:5064.

Another function of VGAM2353 is therefore inhibition of Transforming, Acidic Coiled-coil Containing Protein 1 (TACC1, Accession NM_006283). Accordingly, utilities of VGAM2353 include diagnosis, prevention and treatment of diseases and clinical conditions associated with TACC1. Thymidine Kinase 1, Soluble (TK1, Accession NM_003258) is another VGAM2353 host target gene. TK1 BINDING SITE is HOST TARGET binding site found in the 3' untranslated region of mRNA encoded by TK1, corresponding to a HOST TARGET binding site such as BINDING SITE I, BINDING SITE II or BINDING SITE III. Table 2 illustrates the complementarity of the nucleotide sequences of TK1 BINDING SITE, designated SEQ ID:9270, to the nucleotide sequence of VGAM2353 RNA, herein designated VGAM RNA, also designated SEQ ID:5064.

Another function of VGAM2353 is therefore inhibition of Thymidine Kinase 1, Soluble (TK1, Accession NM_003258). Accordingly, utilities of VGAM2353 include diagnosis, prevention and treatment of diseases and clinical conditions associated with TK1. Vasoactive Intestinal Peptide Receptor 2 (VIPR2, Accession NM_003382) is another VGAM2353 host target gene. VIPR2 BINDING SITE is HOST TARGET binding site found in the 3' untranslated region of mRNA encoded by VIPR2, corresponding to a HOST TARGET binding site such as BINDING SITE I, BINDING SITE II or BINDING SITE III. Table 2 illustrates the complementarity of the nucleotide sequences of VIPR2 BINDING SITE, designated SEQ ID:9414, to the nucleotide sequence of VGAM2353 RNA, herein designated VGAM RNA, also designated SEQ ID:5064.

Another function of VGAM2353 is therefore inhibition of Vasoactive Intestinal Peptide Receptor 2 (VIPR2, Accession NM_003382). Accordingly, utilities of VGAM2353 include diagnosis, prevention and treatment of diseases and clinical conditions associated with VIPR2. Bruno-like 6, RNA Binding Protein (Drosophila) (BRUNOL6, Accession NM_052840) is another VGAM2353 host target gene. BRUNOL6 BINDING SITE is HOST TARGET binding site found in the 5' untranslated region of mRNA encoded by BRUNOL6, corresponding to a HOST TARGET binding site such as BINDING SITE I, BINDING SITE II or BINDING SITE III. Table 2 illustrates the complementarity of the nucleotide sequences of BRUNOL6 BINDING SITE, designated SEQ ID:27421, to the nucleotide sequence of VGAM2353 RNA, herein designated VGAM RNA, also designated SEQ ID:5064.

Another function of VGAM2353 is therefore inhibition of Bruno-like 6, RNA Binding Protein (Drosophila) (BRUNOL6, Accession NM_052840). Accordingly, utilities of VGAM2353 include diagnosis, prevention and treatment of diseases and clinical conditions associated with BRUNOL6. Chromosome 21 Open Reading Frame 108 (C21orf108, Accession XM_114191) is another VGAM2353 host target gene. C21orf108 BINDING SITE is HOST TARGET binding site found in the 3' untranslated region of mRNA encoded by C21orf108, corresponding to a HOST TARGET binding site such as BINDING SITE I, BINDING SITE II or BINDING SITE III. Table 2 illustrates the complementarity of the nucleotide sequences of C21orf108 BINDING SITE, designated SEQ ID:42771, to the nucleotide sequence of VGAM2353 RNA, herein designated VGAM RNA, also designated SEQ ID:5064.

Another function of VGAM2353 is therefore inhibition of Chromosome 21 Open Reading Frame 108 (C21orf108, Accession XM_114191). Accordingly, utilities of VGAM2353 include diagnosis, prevention and treatment of diseases and clinical conditions associated with C21orf108.

CAPN13 (Accession NM_144575) is another VGAM2353 host target gene. CAPN13 BINDING SITE is HOST TARGET binding site found in the 5' untranslated region of mRNA encoded by CAPN13, corresponding to a HOST TARGET binding site such as BINDING SITE I, BINDING SITE II or BINDING SITE III. Table 2 illustrates the complementarity of the nucleotide sequences of CAPN13 BINDING SITE, designated SEQ ID:29380, to the nucleotide sequence of VGAM2353 RNA, herein designated VGAM RNA, also designated SEQ ID:5064.

Another function of VGAM2353 is therefore inhibition of CAPN13 (Accession NM_144575). Accordingly, utilities of VGAM2353 include diagnosis, prevention and treatment of diseases and clinical conditions associated with CAPN13. CDT1 (Accession XM_085327) is another VGAM2353 host target gene. CDT1 BINDING SITE is HOST TARGET binding site found in the 5' untranslated region of mRNA encoded by CDT1, corresponding to a HOST TARGET binding site such as BINDING SITE I, BINDING SITE II or BINDING SITE III. Table 2 illustrates the complementarity of the nucleotide sequences of CDT1 BINDING SITE, designated SEQ ID:38066, to the nucleotide sequence of VGAM2353 RNA, herein designated VGAM RNA, also designated SEQ ID:5064.

Another function of VGAM2353 is therefore inhibition of CDT1 (Accession XM_085327). Accordingly, utilities of VGAM2353 include diagnosis, prevention and treatment of diseases and clinical conditions associated with CDT1. DKFZP434N1511 (Accession XM_166138) is another VGAM2353 host target gene. DKFZP434N1511 BINDING SITE is HOST TARGET binding site found in the 5' untranslated region of mRNA encoded by DKFZP434N1511, corresponding to a HOST TARGET binding site such as BINDING SITE I, BINDING SITE II or BINDING SITE III. Table 2 illustrates the complementarity of the nucleotide sequences of DKFZP434N1511 BINDING SITE, designated SEQ ID:43939, to the nucleotide sequence of VGAM2353 RNA, herein designated VGAM RNA, also designated SEQ ID:5064.

Another function of VGAM2353 is therefore inhibition of DKFZP434N1511 (Accession XM_166138). Accordingly, utilities of VGAM2353 include diagnosis, prevention and treatment of diseases and clinical conditions associated with DKFZP434N1511. DKFZP586J1624 (Accession NM_015537) is another VGAM2353 host target gene. DKFZP586J1624 BINDING SITE is HOST TARGET binding site found in the 3' untranslated region of mRNA encoded by DKFZP586J1624, corresponding to a HOST TARGET binding site such as BINDING SITE I, BINDING SITE II or BINDING SITE III. Table 2 illustrates the complementarity of the nucleotide sequences of DKFZP586J1624 BINDING SITE, designated SEQ ID:17798, to the nucleotide sequence of VGAM2353 RNA, herein designated VGAM RNA, also designated SEQ ID:5064.

Another function of VGAM2353 is therefore inhibition of DKFZP586J1624 (Accession NM_015537). Accordingly, utilities of VGAM2353 include diagnosis, prevention and treatment of diseases and clinical conditions associated with DKFZP586J1624. DKFZP727G051 (Accession XM_045308) is another VGAM2353 host target gene. DKFZP727G051 BINDING SITE is HOST TARGET binding site found in the 3' untranslated region of mRNA encoded by DKFZP727G051, corresponding to a HOST TARGET binding site such as BINDING SITE I, BINDING SITE II or BINDING SITE III. Table 2 illustrates the complementarity of the nucleotide sequences of DKFZP727G051 BINDING SITE, designated SEQ ID:34430, to the nucleotide sequence of VGAM2353 RNA, herein designated VGAM RNA, also designated SEQ ID:5064.

Another function of VGAM2353 is therefore inhibition of DKFZP727G051 (Accession XM_045308). Accordingly, utilities of VGAM2353 include diagnosis, prevention and treatment of diseases and clinical conditions associated with DKFZP727G051. EHM2 (Accession NM_019114) is another VGAM2353 host target gene. EHM2 BINDING SITE is HOST TARGET binding site found in the 5' untranslated region of mRNA encoded by EHM2, corresponding to a HOST TARGET binding site such as BINDING SITE I, BINDING SITE II or BINDING SITE III. Table 2 illustrates the complementarity of the nucleotide sequences of EHM2 BINDING SITE, designated SEQ ID:21190, to the nucleotide sequence of VGAM2353 RNA, herein designated VGAM RNA, also designated SEQ ID:5064.

Another function of VGAM2353 is therefore inhibition of EHM2 (Accession NM_019114). Accordingly, utilities of VGAM2353 include diagnosis, prevention and treatment of diseases and clinical conditions associated with EHM2. Epsin 2 (EPN2, Accession NM_014964) is another VGAM2353 host target gene. EPN2 BINDING SITE is HOST TARGET binding site found in the 3' untranslated region of mRNA encoded by EPN2, corresponding to a HOST TARGET binding site such as BINDING SITE I, BINDING SITE II or BINDING SITE III. Table 2 illustrates the complementarity of the nucleotide sequences of EPN2 BINDING SITE, designated SEQ ID:17348, to the nucleotide sequence of VGAM2353 RNA, herein designated VGAM RNA, also designated SEQ ID:5064.

Another function of VGAM2353 is therefore inhibition of Epsin 2 (EPN2, Accession NM_014964). Accordingly, utilities of VGAM2353 include diagnosis, prevention and treatment of diseases and clinical conditions associated with EPN2. FLJ00001 (Accession XM_088525) is another VGAM2353 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39780, to the nucleotide sequence of VGAM2353 RNA, herein designated VGAM RNA, also designated SEQ ID:5064.

Another function of VGAM2353 is therefore inhibition of FLJ00001 (Accession XM_088525). Accordingly, utilities of VGAM2353 include diagnosis, prevention and treatment of diseases and clinical conditions associated with FLJ00001. FLJ13441 (Accession NM_023924) is another VGAM2353 host target gene. FLJ13441 BINDING SITE is HOST TARGET binding site found in the 3' untranslated region of mRNA encoded by FLJ13441, corresponding to a HOST TARGET binding site such as BINDING SITE I, BINDING SITE II or BINDING SITE III. Table 2 illustrates the complementarity of the nucleotide sequences of FLJ13441 BINDING SITE, designated SEQ ID:23395, to the nucleotide sequence of VGAM2353 RNA, herein designated VGAM RNA, also designated SEQ ID:5064.

Another function of VGAM2353 is therefore inhibition of FLJ13441 (Accession NM_023924). Accordingly, utilities of VGAM2353 include diagnosis, prevention and treatment of diseases and clinical conditions associated with FLJ13441. FLJ20085 (Accession NM_017660) is another VGAM2353 host target gene. FLJ20085 BINDING SITE is HOST TARGET binding site found in the 3' untranslated region of mRNA encoded by FLJ20085, corresponding to a HOST TARGET binding site such as BINDING SITE I, BINDING SITE II or BINDING SITE III. Table 2 illustrates the complementarity of the nucleotide sequences of FLJ20085 BINDING SITE, designated SEQ ID:19186, to the nucleotide sequence of VGAM2353 RNA, herein designated VGAM RNA, also designated SEQ ID:5064.

Another function of VGAM2353 is therefore inhibition of FLJ20085 (Accession NM_017660). Accordingly, utilities of VGAM2353 include diagnosis, prevention and treatment of diseases and clinical conditions associated with FLJ20085. FLJ20898 (Accession NM_024600) is another VGAM2353 host target gene. FLJ20898 BINDING SITE is HOST TARGET binding site found in the 5' untranslated region of mRNA encoded by FLJ20898, corresponding to a HOST TARGET binding site such as BINDING SITE I, BINDING SITE II or BINDING SITE III. Table 2 illustrates the complementarity of the nucleotide sequences of FLJ20898 BINDING SITE, designated SEQ ID:23851, to the nucleotide sequence of VGAM2353 RNA, herein designated VGAM RNA, also designated SEQ ID:5064.

Another function of VGAM2353 is therefore inhibition of FLJ20898 (Accession NM_024600). Accordingly, utilities of VGAM2353 include diagnosis, prevention and treatment of diseases and clinical conditions associated with FLJ20898. FLJ22246 (Accession NM_025232) is another VGAM2353 host target gene. FLJ22246 BINDING SITE is HOST TARGET binding site found in the 5' untranslated region of mRNA encoded by FLJ22246, corresponding to a HOST TARGET binding site such as BINDING SITE I, BINDING SITE II or BINDING SITE III. Table 2 illustrates the complementarity of the nucleotide sequences of FLJ22246 BINDING SITE, designated SEQ ID:24909, to the nucleotide sequence of VGAM2353 RNA, herein designated VGAM RNA, also designated SEQ ID:5064.

Another function of VGAM2353 is therefore inhibition of FLJ22246 (Accession NM_025232). Accordingly, utilities of VGAM2353 include diagnosis, prevention and treatment of diseases and clinical conditions associated with FLJ22246. FLJ22408 (Accession NM_024794) is another VGAM2353 host target gene. FLJ22408 BINDING SITE is HOST TARGET binding site found in the 5' untranslated region of mRNA encoded by FLJ22408, corresponding to a HOST TARGET binding site such as BINDING SITE I, BINDING SITE II or BINDING SITE III. Table 2 illustrates the complementarity of the nucleotide sequences of FLJ22408 BINDING SITE, designated SEQ ID:24173, to the nucleotide sequence of VGAM2353 RNA, herein designated VGAM RNA, also designated SEQ ID:5064.

Another function of VGAM2353 is therefore inhibition of FLJ22408 (Accession NM_024794). Accordingly, utilities of VGAM2353 include diagnosis, prevention and treatment of diseases and clinical conditions associated with FLJ22408. HRD1 (Accession XM_045498) is another VGAM2353 host target gene. HRD1 BINDING SITE is HOST TARGET binding site found in the 3' untranslated region of mRNA encoded by HRD1, corresponding to a HOST TARGET binding site such as BINDING SITE I, BINDING SITE II or BINDING SITE III. Table 2 illustrates the complementarity of the nucleotide sequences of HRD1 BINDING SITE, designated SEQ ID:34473, to the nucleotide sequence of VGAM2353 RNA, herein designated VGAM RNA, also designated SEQ ID:5064.

Another function of VGAM2353 is therefore inhibition of HRD1 (Accession XM_045498). Accordingly, utilities of VGAM2353 include diagnosis, prevention and treatment of diseases and clinical conditions associated with HRD1. HSPC195 (Accession XM_087785) is another VGAM2353 host target gene. HSPC195 BINDING SITE is HOST TARGET binding site found in the 5' untranslated region of mRNA encoded by HSPC195, corresponding to a HOST TARGET binding site such as BINDING SITE I, BINDING SITE II or BINDING SITE III. Table 2 illustrates the complementarity of the nucleotide sequences of HSPC195 BINDING SITE, designated SEQ ID:39422, to the nucleotide sequence of VGAM2353 RNA, herein designated VGAM RNA, also designated SEQ ID:5064.

Another function of VGAM2353 is therefore inhibition of HSPC195 (Accession XM_087785). Accordingly, utilities of VGAM2353 include diagnosis, prevention and treatment of diseases and clinical conditions associated with HSPC195. KH-type Splicing Regulatory Protein (FUSE binding protein 2) (KHSRP, Accession NM_003685) is another VGAM2353 host target gene. KHSRP BINDING SITE is HOST TARGET binding site found in the 3' untranslated region of mRNA encoded by KHSRP, corresponding to a HOST TARGET binding site such as BINDING SITE I, BINDING SITE II or BINDING SITE III. Table 2 illustrates the complementarity of the nucleotide sequences of KHSRP BINDING SITE, designated SEQ ID:9796, to the nucleotide sequence of VGAM2353 RNA, herein designated VGAM RNA, also designated SEQ ID:5064.

Another function of VGAM2353 is therefore inhibition of KH-type Splicing Regulatory Protein (FUSE binding protein 2) (KHSRP, Accession NM_003685). Accordingly, utilities of VGAM2353 include diagnosis, prevention and treatment of diseases and clinical conditions associated with KHSRP. KIAA0420 (Accession XM_032693) is another VGAM2353 host target gene. KIAA0420 BINDING SITE is HOST TARGET binding site found in the 3' untranslated region of mRNA encoded by KIAA0420, corresponding to a HOST TARGET binding site such as BINDING SITE I, BINDING SITE II or BINDING SITE III. Table 2 illustrates the complementarity of the nucleotide sequences of KIAA0420 BINDING SITE, designated SEQ ID:31728, to the nucleotide sequence of VGAM2353 RNA, herein designated VGAM RNA, also designated SEQ ID:5064.

Another function of VGAM2353 is therefore inhibition of KIAA0420 (Accession XM_032693). Accordingly, utilities of VGAM2353 include diagnosis, prevention and treatment of diseases and clinical conditions associated with KIAA0420. KIAA0513 (Accession NM_014732) is another VGAM2353 host target gene. KIAA0513 BINDING SITE is HOST TARGET binding site found in the 3' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16359, to the nucleotide sequence of VGAM2353 RNA, herein designated VGAM RNA, also designated SEQ ID:5064.

Another function of VGAM2353 is therefore inhibition of KIAA0513 (Accession NM_014732). Accordingly, utilities of VGAM2353 include diagnosis, prevention and treatment of diseases and clinical conditions associated with KIAA0513. KIAA0545 (Accession XM_032278) is another VGAM2353 host target gene. KIAA0545 BINDING SITE is HOST TARGET binding site found in the 3' untranslated region of mRNA encoded by KIAA0545, corresponding to a HOST TARGET binding site such as BINDING SITE I, BINDING SITE II or BINDING SITE III. Table 2 illustrates the complementarity of the nucleotide sequences of KIAA0545 BINDING SITE, designated SEQ ID:31632, to the nucleotide sequence of VGAM2353 RNA, herein designated VGAM RNA, also designated SEQ ID:5064.

Another function of VGAM2353 is therefore inhibition of KIAA0545 (Accession XM_032278). Accordingly, utilities of VGAM2353 include diagnosis, prevention and treatment of diseases and clinical conditions associated with KIAA0545. KIAA0668 (Accession XM_039332) is another VGAM2353 host target gene. KIAA0668 BINDING SITE is HOST TARGET binding site found in the 3' untranslated region of mRNA encoded by KIAA0668, corresponding to a HOST TARGET binding site such as BINDING SITE I, BINDING SITE II or BINDING SITE III. Table 2 illustrates the complementarity of the nucleotide sequences of KIAA0668 BINDING SITE, designated SEQ ID:33050, to the nucleotide sequence of VGAM2353 RNA, herein designated VGAM RNA, also designated SEQ ID:5064.

Another function of VGAM2353 is therefore inhibition of KIAA0668 (Accession XM_039332). Accordingly, utilities of VGAM2353 include diagnosis, prevention and treatment of diseases and clinical conditions associated with KIAA0668. KIAA0672 (Accession NM_014859) is another VGAM2353 host target gene. KIAA0672 BINDING SITE is HOST TARGET binding site found in the 5' untranslated region of mRNA encoded by KIAA0672, corresponding to a HOST TARGET binding site such as BINDING SITE I, BINDING SITE II or BINDING SITE III. Table 2 illustrates the complementarity of the nucleotide sequences of KIAA0672 BINDING SITE, designated SEQ ID:16920, to the nucleotide sequence of VGAM2353 RNA, herein designated VGAM RNA, also designated SEQ ID:5064.

Another function of VGAM2353 is therefore inhibition of KIAA0672 (Accession NM_014859). Accordingly, utilities of VGAM2353 include diagnosis, prevention and treatment of diseases and clinical conditions associated with KIAA0672. KIAA0987 (Accession NM_012307) is another VGAM2353 host target gene. KIAA0987 BINDING SITE is HOST TARGET binding site found in the 3' untranslated region of mRNA encoded by KIAA0987, corresponding to a HOST TARGET binding site such as BINDING SITE I, BINDING SITE II or BINDING SITE III. Table 2 illustrates the complementarity of the nucleotide sequences of KIAA0987 BINDING SITE, designated SEQ ID:14677, to the nucleotide sequence of VGAM2353 RNA, herein designated VGAM RNA, also designated SEQ ID:5064.

Another function of VGAM2353 is therefore inhibition of KIAA0987 (Accession NM_012307). Accordingly, utilities of VGAM2353 include diagnosis, prevention and treatment of diseases and clinical conditions associated with KIAA0987. KIAA1170 (Accession XM_045907) is another VGAM2353 host target gene. KIAA1170 BINDING SITE is HOST TARGET binding site found in the 3' untranslated region of mRNA encoded by KIAA1170, corresponding to a HOST TARGET binding site such as BINDING SITE I, BINDING SITE II or BINDING SITE III. Table 2 illustrates the complementarity of the nucleotide sequences of KIAA1170 BINDING SITE, designated SEQ ID:34612, to the nucleotide sequence of VGAM2353 RNA, herein designated VGAM RNA, also designated SEQ ID:5064.

Another function of VGAM2353 is therefore inhibition of KIAA1170 (Accession XM_045907). Accordingly, utilities of VGAM2353 include diagnosis, prevention and treatment of diseases and clinical conditions associated with KIAA1170. KIAA1867 (Accession XM_170675) is another VGAM2353 host target gene. KIAA1867 BINDING SITE is HOST TARGET binding site found in the 3' untranslated region of mRNA encoded by KIAA1867, corresponding to a HOST TARGET binding site such as BINDING SITE I, BINDING SITE II or BINDING SITE III. Table 2 illustrates the complementarity of the nucleotide sequences of KIAA1867 BINDING SITE, designated SEQ ID:45455, to the nucleotide sequence of VGAM2353 RNA, herein designated VGAM RNA, also designated SEQ ID:5064.

Another function of VGAM2353 is therefore inhibition of KIAA1867 (Accession XM_170675). Accordingly, utilities of VGAM2353 include diagnosis, prevention and treatment of diseases and clinical conditions associated with KIAA1867. KIAA1904 (Accession XM_056282) is another VGAM2353 host target gene. KIAA1904 BINDING SITE is HOST TARGET binding site found in the 3' untranslated region of mRNA encoded by KIAA1904, corresponding to a HOST TARGET binding site such as BINDING SITE I, BINDING SITE II or BINDING SITE III. Table 2 illustrates the complementarity of the nucleotide sequences of KIAA1904 BINDING SITE, designated SEQ ID:36377, to the nucleotide sequence of VGAM2353 RNA, herein designated VGAM RNA, also designated SEQ ID:5064.

Another function of VGAM2353 is therefore inhibition of KIAA1904 (Accession XM_056282). Accordingly, utilities of VGAM2353 include diagnosis, prevention and treatment of diseases and clinical conditions associated with KIAA1904. KIAA1906 (Accession XM_055095) is another VGAM2353 host target gene. KIAA1906 BINDING SITE is HOST TARGET binding site found in the 3' untranslated region of mRNA encoded by KIAA1906, corresponding to a HOST TARGET binding site such as BINDING SITE I, BINDING SITE II or BINDING SITE III. Table 2 illustrates the complementarity of the nucleotide sequences of KIAA1906 BINDING SITE, designated SEQ ID:36231, to the nucleotide sequence of VGAM2353 RNA, herein designated VGAM RNA, also designated SEQ ID:5064.

Another function of VGAM2353 is therefore inhibition of KIAA1906 (Accession XM_055095). Accordingly, utilities of VGAM2353 include diagnosis, prevention and treatment of diseases and clinical conditions associated with KIAA1906. KIAA1924 (Accession XM_057091) is another VGAM2353 host target gene. KIAA1924 BINDING SITE is HOST TARGET binding site found in the 3' untranslated region of mRNA encoded by KIAA1924, corresponding to a HOST TARGET binding site such as BINDING SITE I, BINDING SITE II or BINDING SITE III. Table 2 illustrates the complementarity of the nucleotide sequences of KIAA1924 BINDING SITE, designated SEQ ID:36479, to the nucleotide sequence of VGAM2353 RNA, herein designated VGAM RNA, also designated SEQ ID:5064.

Another function of VGAM2353 is therefore inhibition of KIAA1924 (Accession XM_057091). Accordingly, utilities of VGAM2353 include diagnosis, prevention and treatment of diseases and clinical conditions associated with KIAA1924. LHPP (Accession NM_022126) is another VGAM2353 host target gene. LHPP BINDING SITE is HOST TARGET binding site found in the 3' untranslated region of mRNA encoded by LHPP, corresponding to a HOST TARGET binding site such as BINDING SITE I, BINDING SITE II or BINDING SITE III. Table 2 illustrates the complementarity of the nucleotide sequences of LHPP BINDING SITE, designated SEQ ID:22678, to the nucleotide sequence of VGAM2353 RNA, herein designated VGAM RNA, also designated SEQ ID:5064.

Another function of VGAM2353 is therefore inhibition of LHPP (Accession NM_022126). Accordingly, utilities of VGAM2353 include diagnosis, prevention and treatment of diseases and clinical conditions associated with LHPP. Mannosidase, Beta A, Lysosomal-like (MANBAL, Accession NM_022077) is another VGAM2353 host target gene. MANBAL BINDING SITE is HOST TARGET binding site found in the 3' untranslated region of mRNA encoded by MAN- BAL, corresponding to a HOST TARGET binding site such as BINDING SITE I, BINDING SITE II or BINDING SITE III. Table 2 illustrates the complementarity of the nucleotide sequences of MANBAL BINDING SITE, designated SEQ ID:22620, to the nucleotide sequence of VGAM2353 RNA, herein designated VGAM RNA, also designated SEQ ID:5064.

Another function of VGAM2353 is therefore inhibition of Mannosidase, Beta A, Lysosomal-like (MANBAL, Accession NM_022077). Accordingly, utilities of VGAM2353 include diagnosis, prevention and treatment of diseases and clinical conditions associated with MANBAL. Mitogen-activated Protein Kinase-activated Protein Kinase 2 (MAPKAPK2, Accession NM_004759) is another VGAM2353 host target gene. MAPKAPK2 BINDING SITE1 and MAPKAPK2 BINDING SITE2 are HOST TARGET binding sites found in untranslated regions of mRNA encoded by MAPKAPK2, corresponding to HOST TARGET binding sites such as BINDING SITE I, BINDING SITE II or BINDING SITE III. Table 2 illustrates the complementarity of the nucleotide sequences of MAPKAPK2 BINDING SITE1 and MAPKAPK2 BINDING SITE2, designated SEQ ID:11150 and SEQ ID:26764 respectively, to the nucleotide sequence of VGAM2353 RNA, herein designated VGAM RNA, also designated SEQ ID:5064.

Another function of VGAM2353 is therefore inhibition of Mitogen-activated Protein Kinase-activated Protein Kinase 2 (MAPKAPK2, Accession NM_004759). Accordingly, utilities of VGAM2353 include diagnosis, prevention and treatment of diseases and clinical conditions associated with MAPKAPK2. NS1-BP (Accession XM_051877) is another VGAM2353 host target gene. NS1-BP BINDING SITE is HOST TARGET binding site found in the 5' untranslated region of mRNA encoded by NS1-BP, corresponding to a HOST TARGET binding site such as BINDING SITE I, BINDING SITE II or BINDING SITE III. Table 2 illustrates the complementarity of the nucleotide sequences of NS1-BP BINDING SITE, designated SEQ ID:35913, to the nucleotide sequence of VGAM2353 RNA, herein designated VGAM RNA, also designated SEQ ID:5064.

Another function of VGAM2353 is therefore inhibition of NS1-BP (Accession XM_051877). Accordingly, utilities of VGAM2353 include diagnosis, prevention and treatment of diseases and clinical conditions associated with NS1-BP. OBTP (Accession NM_017601) is another VGAM2353 host target gene. OBTP BINDING SITE is HOST TARGET binding site found in the 3' untranslated region of mRNA encoded by OBTP, corresponding to a HOST TARGET binding site such as BINDING SITE I, BINDING SITE II or BINDING SITE III. Table 2 illustrates the complementarity of the nucleotide sequences of OBTP BINDING SITE, designated SEQ ID:19080, to the nucleotide sequence of VGAM2353 RNA, herein designated VGAM RNA, also designated SEQ ID:5064.

Another function of VGAM2353 is therefore inhibition of OBTP (Accession NM_017601). Accordingly, utilities of VGAM2353 include diagnosis, prevention and treatment of diseases and clinical conditions associated with OBTP. Peptidyl Arginine Deiminase, Type I (PADI1, Accession XM_030498) is another VGAM2353 host target gene. PADI1 BINDING SITE is HOST TARGET binding site found in the 3' untranslated region of mRNA encoded by PADI1, corresponding to a HOST TARGET binding site such as BINDING SITE I, BINDING SITE II or BINDING SITE III. Table 2 illustrates the complementarity of the nucleotide sequences of PADI1 BINDING SITE, designated SEQ ID:31055, to the nucleotide sequence of VGAM2353 RNA, herein designated VGAM RNA, also designated SEQ ID:5064.

Another function of VGAM2353 is therefore inhibition of Peptidyl Arginine Deiminase, Type I (PADI1, Accession XM_030498). Accordingly, utilities of VGAM2353 include diagnosis, prevention and treatment of diseases and clinical conditions associated with PADI1. p21(CDKN1A)-activated Kinase 6 (PAK6, Accession NM_020168) is another VGAM2353 host target gene. PAK6 BINDING SITE is HOST TARGET binding site found in the 3' untranslated region of mRNA encoded by PAK6, corresponding to a HOST TARGET binding site such as BINDING SITE I, BINDING SITE II or BINDING SITE III. Table 2 illustrates the complementarity of the nucleotide sequences of PAK6 BINDING SITE, designated SEQ ID:21391, to the nucleotide sequence of VGAM2353 RNA, herein designated VGAM RNA, also designated SEQ ID:5064.

Another function of VGAM2353 is therefore inhibition of p21(CDKN1A)-activated Kinase 6 (PAK6, Accession NM_020168). Accordingly, utilities of VGAM2353 include diagnosis, prevention and treatment of diseases and clinical conditions associated with PAK6. QKI (Accession XM_037438) is another VGAM2353 host target gene. QKI BINDING SITE is HOST TARGET binding site found in the 5' untranslated region of mRNA encoded by QKI, corresponding to a HOST TARGET binding site such as BINDING SITE I, BINDING SITE II or BINDING SITE III. Table 2 illustrates the complementarity of the nucleotide sequences of QKI BINDING SITE, designated SEQ ID:32619, to the nucleotide sequence of VGAM2353 RNA, herein designated VGAM RNA, also designated SEQ ID:5064.

Another function of VGAM2353 is therefore inhibition of QKI (Accession XM_037438). Accordingly, utilities of VGAM2353 include diagnosis, prevention and treatment of diseases and clinical conditions associated with QKI. RAB3A Interacting Protein (rabin3)-like 1 (RAB3IL1, Accession NM_013401) is another VGAM2353 host target gene. RAB3IL1 BINDING SITE is HOST TARGET binding site found in the 3' untranslated region of mRNA encoded by RAB3IL1, corresponding to a HOST TARGET binding site such as BINDING SITE I, BINDING SITE II or BINDING SITE III. Table 2 illustrates the complementarity of the nucleotide sequences of RAB3IL1 BINDING SITE, designated SEQ ID:15063, to the nucleotide sequence of VGAM2353 RNA, herein designated VGAM RNA, also designated SEQ ID:5064.

Another function of VGAM2353 is therefore inhibition of RAB3A Interacting Protein (rabin3)-like 1 (RAB3IL1, Accession NM_013401). Accordingly, utilities of VGAM2353 include diagnosis, prevention and treatment of diseases and clinical conditions associated with RAB3IL1. RAI (Accession NM_006663) is another VGAM2353 host target gene. RAI BINDING SITE is HOST TARGET binding site found in the 3' untranslated region of mRNA encoded by RAI, corresponding to a HOST TARGET binding site such as BINDING SITE I, BINDING SITE II or BINDING SITE III. Table 2 illustrates the complementarity of the nucleotide sequences of RAI BINDING SITE, designated SEQ ID:13471, to the nucleotide sequence of VGAM2353 RNA, herein designated VGAM RNA, also designated SEQ ID:5064.

Another function of VGAM2353 is therefore inhibition of RAI (Accession NM_006663). Accordingly, utilities of VGAM2353 include diagnosis, prevention and treatment of diseases and clinical conditions associated with RAI. Retinoic Acid Induced 17 (RAI17, Accession XM_166091) is another VGAM2353 host target gene. RAI17 BINDING SITE is HOST TARGET binding site found in the 3' untranslated region of mRNA encoded by RAI17, corresponding to a HOST TARGET binding site such as BINDING SITE I, BINDING SITE II or BINDING SITE III. Table 2 illustrates the complementarity of the nucleotide sequences of RAI17 BINDING SITE, designated SEQ ID:43862, to the nucleotide sequence of VGAM2353 RNA, herein designated VGAM RNA, also designated SEQ ID:5064.

Another function of VGAM2353 is therefore inhibition of Retinoic Acid Induced 17 (RAI17, Accession XM_166091). Accordingly, utilities of VGAM2353 include diagnosis, prevention and treatment of diseases and clinical conditions associated with RAI17. Rho-related BTB Domain Containing 1 (RHOBTB1, Accession XM_166144) is another VGAM2353 host target gene. RHOBTB1 BINDING SITE is HOST TARGET binding site found in the 5' untranslated region of mRNA encoded by RHOBTB1, corresponding to a HOST TARGET binding site such as BINDING SITE I, BINDING SITE II or BINDING SITE III. Table 2 illustrates the complementarity of the nucleotide sequences of RHOBTB1 BINDING SITE, designated SEQ ID:43952, to the nucleotide sequence of VGAM2353 RNA, herein designated VGAM RNA, also designated SEQ ID:5064.

Another function of VGAM2353 is therefore inhibition of Rho-related BTB Domain Containing 1 (RHOBTB1, Accession XM_166144). Accordingly, utilities of VGAM2353 include diagnosis, prevention and treatment of diseases and clinical conditions associated with RHOBTB1. SCAM-1 (Accession NM_005775) is another VGAM2353 host target gene. SCAM-1 BINDING SITE is HOST TARGET binding site found in the 3' untranslated region of mRNA encoded by SCAM-1, corresponding to a HOST TARGET binding site such as BINDING SITE I, BINDING SITE II or BINDING SITE III. Table 2 illustrates the complementarity of the nucleotide sequences of SCAM-1 BINDING SITE, designated SEQ ID:12350, to the nucleotide sequence of VGAM2353 RNA, herein designated VGAM RNA, also designated SEQ ID:5064.

Another function of VGAM2353 is therefore inhibition of SCAM-1 (Accession NM_005775). Accordingly, utilities of VGAM2353 include diagnosis, prevention and treatment of diseases and clinical conditions associated with SCAM-1. Solute Carrier Family 26, Member 10 (SLC26A10, Accession NM_133489) is another VGAM2353 host target gene. SLC26A10 BINDING SITE is HOST TARGET binding site found in the 5' untranslated region of mRNA encoded by SLC26A10, corresponding to a HOST TARGET binding site such as BINDING SITE I, BINDING SITE II or BINDING SITE III. Table 2 illustrates the complementarity of the nucleotide sequences of SLC26A10 BINDING SITE, designated SEQ ID:28560, to the nucleotide sequence of VGAM2353 RNA, herein designated VGAM RNA, also designated SEQ ID:5064.

Another function of VGAM2353 is therefore inhibition of Solute Carrier Family 26, Member 10 (SLC26A10, Accession NM_133489). Accordingly, utilities of VGAM2353 include diagnosis, prevention and treatment of diseases and clinical conditions associated with SLC26A10. T-box 21 (TBX21, Accession NM_013351) is another VGAM2353 host target gene. TBX21 BINDING SITE is HOST TARGET binding site found in the 3' untranslated region of mRNA encoded by TBX21, corresponding to a HOST TARGET binding site such as BINDING SITE I, BINDING SITE II or BINDING SITE III. Table 2 illustrates the complementarity of the nucleotide sequences of TBX21 BINDING SITE, designated SEQ ID:14997, to the nucleotide sequence of VGAM2353 RNA, herein designated VGAM RNA, also designated SEQ ID:5064.

Another function of VGAM2353 is therefore inhibition of T-box 21 (TBX21, Accession NM_013351). Accordingly, utilities of VGAM2353 include diagnosis, prevention and treatment of diseases and clinical conditions associated with TBX21. Testis Expressed Sequence 27 (TEX27, Accession NM_021943) is another VGAM2353 host target gene. TEX27 BINDING SITE is HOST TARGET binding site found in the 3' untranslated region of mRNA encoded by TEX27, corresponding to a HOST TARGET binding site such as BINDING SITE I, BINDING SITE II or BINDING SITE III. Table 2 illustrates the complementarity of the nucleotide sequences of TEX27 BINDING SITE, designated SEQ ID:22460, to the nucleotide sequence of VGAM2353 RNA, herein designated VGAM RNA, also designated SEQ ID:5064.

Another function of VGAM2353 is therefore inhibition of Testis Expressed Sequence 27 (TEX27, Accession NM_021943). Accordingly, utilities of VGAM2353 include diagnosis, prevention and treatment of diseases and clinical conditions associated with TEX27. Tubby Homolog (mouse) (TUB, Accession NM_003320) is another VGAM2353 host target gene. TUB BINDING SITE is HOST TARGET binding site found in the 3' untranslated region of mRNA encoded by TUB, corresponding to a HOST TARGET binding site such as BINDING SITE I, BINDING SITE II or BINDING SITE III. Table 2 illustrates the complementarity of the nucleotide sequences of TUB BINDING SITE, designated SEQ ID:9324, to the nucleotide sequence of VGAM2353 RNA, herein designated VGAM RNA, also designated SEQ ID:5064.

Another function of VGAM2353 is therefore inhibition of Tubby Homolog (mouse) (TUB, Accession NM_003320). Accordingly, utilities of VGAM2353 include diagnosis, prevention and treatment of diseases and clinical conditions associated with TUB. WSB1 (Accession NM_134264) is another VGAM2353 host target gene. WSB1 BINDING SITE1 and WSB1 BINDING SITE2 are HOST TARGET binding sites found in untranslated regions of mRNA encoded by WSB1, corresponding to HOST TARGET binding sites such as BINDING SITE I, BINDING SITE II or BINDING SITE III. Table 2 illustrates the complementarity of the nucleotide sequences of WSB1 BINDING SITE1 and WSB1 BINDING SITE2, designated SEQ ID:28617 and SEQ ID:28623 respectively, to the nucleotide sequence of VGAM2353 RNA, herein designated VGAM RNA, also designated SEQ ID:5064.

Another function of VGAM2353 is therefore inhibition of WSB1 (Accession NM_134264). Accordingly, utilities of VGAM2353 include diagnosis, prevention and treatment of diseases and clinical conditions associated with WSB1. LOC115073 (Accession XM_055193) is another VGAM2353 host target gene. LOC115073 BINDING SITE is HOST TARGET binding site found in the 5' untranslated region of mRNA encoded by LOC115073, corresponding to a HOST TARGET binding site such as BINDING SITE I, BINDING SITE II or BINDING SITE III. Table 2 illustrates the complementarity of the nucleotide sequences of LOC115073 BINDING SITE, designated SEQ ID:36242, to the nucleotide sequence of VGAM2353 RNA, herein designated VGAM RNA, also designated SEQ ID:5064.

Another function of VGAM2353 is therefore inhibition of LOC115073 (Accession XM_055193). Accordingly, utilities of VGAM2353 include diagnosis, prevention and treatment of diseases and clinical conditions associated with LOC115073. LOC126917 (Accession XM_059091) is another VGAM2353 host target gene. LOC126917 BINDING SITE is HOST TARGET binding site found in the 3' untranslated region of mRNA encoded by LOC126917, corresponding to a HOST TARGET binding site such as BINDING SITE I, BINDING SITE II or BINDING SITE III. Table 2 illustrates the complementarity of the nucleotide sequences of LOC126917 BINDING SITE, designated SEQ ID:36871, to the nucleotide sequence of VGAM2353 RNA, herein designated VGAM RNA, also designated SEQ ID:5064.

Another function of VGAM2353 is therefore inhibition of LOC126917 (Accession XM_059091). Accordingly, utilities of VGAM2353 include diagnosis, prevention and treatment of diseases and clinical conditions associated with LOC126917. LOC127702 (Accession XM_060619) is another VGAM2353 host target gene. LOC127702 BINDING SITE is HOST TARGET binding site found in the 3' untranslated region of mRNA encoded by LOC127702, corresponding to a HOST TARGET binding site such as BINDING SITE I, BINDING SITE II or BINDING SITE III. Table 2 illustrates the complementarity of the nucleotide sequences of LOC127702 BINDING SITE, designated SEQ ID:37183, to the nucleotide sequence of VGAM2353 RNA, herein designated VGAM RNA, also designated SEQ ID:5064.

Another function of VGAM2353 is therefore inhibition of LOC127702 (Accession XM_060619). Accordingly, utilities of VGAM2353 include diagnosis, prevention and treatment of diseases and clinical conditions associated with LOC127702. LOC144347 (Accession XM_084832) is another VGAM2353 host target gene. LOC144347 BINDING SITE is HOST TARGET binding site found in the 3' untranslated region of mRNA encoded by LOC144347, corresponding to a HOST TARGET binding site such as BINDING SITE I, BINDING SITE II or BINDING SITE III. Table 2 illustrates the complementarity of the nucleotide sequences of LOC144347 BINDING SITE, designated SEQ ID:37724, to the nucleotide sequence of VGAM2353 RNA, herein designated VGAM RNA, also designated SEQ ID:5064.

Another function of VGAM2353 is therefore inhibition of LOC144347 (Accession XM_084832). Accordingly, utilities of VGAM2353 include diagnosis, prevention and treatment of diseases and clinical conditions associated with LOC144347. LOC145438 (Accession XM_096781) is another VGAM2353 host target gene. LOC145438 BINDING SITE is HOST TARGET binding site found in the 5' untranslated region of mRNA encoded by LOC145438, corresponding to a HOST TARGET binding site such as BINDING SITE I, BINDING SITE II or BINDING SITE III. Table 2 illustrates the complementarity of the nucleotide sequences of LOC145438 BINDING SITE, designated SEQ ID:40537, to the nucleotide sequence of VGAM2353 RNA, herein designated VGAM RNA, also designated SEQ ID:5064.

Another function of VGAM2353 is therefore inhibition of LOC145438 (Accession XM_096781). Accordingly, utilities of VGAM2353 include diagnosis, prevention and treatment of diseases and clinical conditions associated with LOC145438. LOC145980 (Accession XM_096914) is another VGAM2353 host target gene. LOC145980 BINDING SITE is HOST TARGET binding site found in the 5' untranslated region of mRNA encoded by LOC145980, corresponding to a HOST TARGET binding site such as BINDING SITE I, BINDING SITE II or BINDING SITE III. Table 2 illustrates the complementarity of the nucleotide sequences of LOC145980 BINDING SITE, designated SEQ ID:40650, to the nucleotide sequence of VGAM2353 RNA, herein designated VGAM RNA, also designated SEQ ID:5064.

Another function of VGAM2353 is therefore inhibition of LOC145980 (Accession XM_096914). Accordingly, utilities of VGAM2353 include diagnosis, prevention and treatment of diseases and clinical conditions associated with LOC145980. LOC146237 (Accession XM_096954) is another VGAM2353 host target gene. LOC146237 BINDING SITE is HOST TARGET binding site found in the 3' untranslated region of mRNA encoded by LOC146237, corresponding to a HOST TARGET binding site such as BINDING SITE I, BINDING SITE II or BINDING SITE III. Table 2 illustrates the complementarity of the nucleotide sequences of LOC146237 BINDING SITE, designated SEQ ID:40669, to the nucleotide sequence of VGAM2353 RNA, herein designated VGAM RNA, also designated SEQ ID:5064.

Another function of VGAM2353 is therefore inhibition of LOC146237 (Accession XM_096954). Accordingly, utilities of VGAM2353 include diagnosis, prevention and treatment of diseases and clinical conditions associated with LOC146237. LOC148014 (Accession XM_085999) is another VGAM2353 host target gene. LOC148014 BINDING SITE is HOST TARGET binding site found in the 3' untranslated region of mRNA encoded by LOC148014, corresponding to a HOST TARGET binding site such as BINDING SITE I, BINDING SITE II or BINDING SITE III. Table 2 illustrates the complementarity of the nucleotide sequences of LOC148014 BINDING SITE, designated SEQ ID:38440, to the nucleotide sequence of VGAM2353 RNA, herein designated VGAM RNA, also designated SEQ ID:5064.

Another function of VGAM2353 is therefore inhibition of LOC148014 (Accession XM_085999). Accordingly, utilities of VGAM2353 include diagnosis, prevention and treatment of diseases and clinical conditions associated with LOC148014. LOC149182 (Accession XM_097605) is another VGAM2353 host target gene. LOC149182 BINDING SITE is HOST TARGET binding site found in the 5' untranslated region of mRNA encoded by LOC149182, corresponding to a HOST TARGET binding site such as BINDING SITE I, BINDING SITE II or BINDING SITE III. Table 2 illustrates the complementarity of the nucleotide sequences of LOC149182 BINDING SITE, designated SEQ ID:40971, to the nucleotide sequence of VGAM2353 RNA, herein designated VGAM RNA, also designated SEQ ID:5064.

Another function of VGAM2353 is therefore inhibition of LOC149182 (Accession XM_097605). Accordingly, utilities of VGAM2353 include diagnosis, prevention and treatment of diseases and clinical conditions associated with LOC149182. LOC150208 (Accession XM_097841) is another VGAM2353 host target gene. LOC150208 BINDING SITE is HOST TARGET binding site found in the 5' untranslated region of mRNA encoded by LOC150208, corresponding to a HOST TARGET binding site such as BINDING SITE I, BINDING SITE II or BINDING SITE III. Table 2 illustrates the complementarity of the nucleotide sequences of LOC150208 BINDING SITE, designated SEQ ID:41155, to the nucleotide sequence of VGAM2353 RNA, herein designated VGAM RNA, also designated SEQ ID:5064.

Another function of VGAM2353 is therefore inhibition of LOC150208 (Accession XM_097841). Accordingly, utilities of VGAM2353 include diagnosis, prevention and treatment of diseases and clinical conditions associated with LOC150208. LOC151278 (Accession XM_087156) is another VGAM2353 host target gene. LOC151278 BINDING SITE is HOST TARGET binding site found in the 3' untranslated region of mRNA encoded by LOC151278, corresponding to a HOST TARGET binding site such as BINDING SITE I, BINDING SITE II or BINDING SITE III. Table 2 illustrates the complementarity of the nucleotide sequences of LOC151278 BINDING SITE, designated SEQ ID:39096, to the nucleotide sequence of VGAM2353 RNA, herein designated VGAM RNA, also designated SEQ ID:5064.

Another function of VGAM2353 is therefore inhibition of LOC151278 (Accession XM_087156). Accordingly, utilities of VGAM2353 include diagnosis, prevention and treatment of diseases and clinical conditions associated with LOC151278. LOC155064 (Accession XM_088128) is another VGAM2353 host target gene. LOC155064 BINDING SITE is HOST TARGET binding site found in the 5' untranslated region of mRNA encoded by LOC155064, corresponding to a HOST TARGET binding site such as BINDING SITE I, BINDING SITE II or BINDING SITE III. Table 2 illustrates the complementarity of the nucleotide sequences of LOC155064 BINDING SITE, designated SEQ ID:39530, to the nucleotide sequence of VGAM2353 RNA, herein designated VGAM RNA, also designated SEQ ID:5064.

Another function of VGAM2353 is therefore inhibition of LOC155064 (Accession XM_088128). Accordingly, utilities of VGAM2353 include diagnosis, prevention and treatment of diseases and clinical conditions associated with LOC155064. LOC159199 (Accession XM_089441) is another VGAM2353 host target gene. LOC159199 BINDING SITE is HOST TARGET binding site found in the 5' untranslated region of mRNA encoded by LOC159199, corresponding to a HOST TARGET binding site such as BINDING SITE I, BINDING SITE II or BINDING SITE III. Table 2 illustrates the complementarity of the nucleotide sequences of LOC159199 BINDING SITE, designated SEQ ID:39983, to the nucleotide sequence of VGAM2353 RNA, herein designated VGAM RNA, also designated SEQ ID:5064.

Another function of VGAM2353 is therefore inhibition of LOC159199 (Accession XM_089441). Accordingly, utilities of VGAM2353 include diagnosis, prevention and treatment of diseases and clinical conditions associated with LOC159199. LOC170127 (Accession XM_093116) is another VGAM2353 host target gene. LOC170127 BINDING SITE is HOST TARGET binding site found in the 3' untranslated region of mRNA encoded by LOC170127, corresponding to a HOST TARGET binding site such as BINDING SITE I, BINDING SITE II or BINDING SITE III. Table 2 illustrates the complementarity of the nucleotide sequences of LOC170127 BINDING SITE, designated SEQ ID:40176, to the nucleotide sequence of VGAM2353 RNA, herein designated VGAM RNA, also designated SEQ ID:5064.

Another function of VGAM2353 is therefore inhibition of LOC170127 (Accession XM_093116). Accordingly, utilities of VGAM2353 include diagnosis, prevention and treatment of diseases and clinical conditions associated with LOC170127. LOC199786 (Accession XM_114021) is another VGAM2353 host target gene. LOC199786 BINDING SITE is HOST TARGET binding site found in the 3' untranslated region of mRNA encoded by LOC199786, corresponding to a HOST TARGET binding site such as BINDING SITE I, BINDING SITE II or BINDING SITE III. Table 2 illustrates the complementarity of the nucleotide sequences of LOC199786 BINDING SITE, designated SEQ ID:42620, to the nucleotide sequence of VGAM2353 RNA, herein designated VGAM RNA, also designated SEQ ID:5064.

Another function of VGAM2353 is therefore inhibition of LOC199786 (Accession XM_114021). Accordingly, utilities of VGAM2353 include diagnosis, prevention and treatment of diseases and clinical conditions associated with LOC199786. LOC200081 (Accession XM_114110) is another VGAM2353 host target gene. LOC200081 BINDING SITE is HOST TARGET binding site found in the 3' untranslated region of mRNA encoded by LOC200081, corresponding to a HOST TARGET binding site such as BINDING SITE I, BINDING SITE II or BINDING SITE III. Table 2 illustrates the complementarity of the nucleotide sequences of LOC200081 BINDING SITE, designated SEQ ID:42705, to the nucleotide sequence of VGAM2353 RNA, herein designated VGAM RNA, also designated SEQ ID:5064.

Another function of VGAM2353 is therefore inhibition of LOC200081 (Accession XM_114110). Accordingly, utilities of VGAM2353 include diagnosis, prevention and treatment of diseases and clinical conditions associated with LOC200081. LOC200982 (Accession XM_117305) is another VGAM2353 host target gene. LOC200982 BINDING SITE is HOST TARGET binding site found in the 3' untranslated region of mRNA encoded by LOC200982, corresponding to a HOST TARGET binding site such as BINDING SITE I, BINDING SITE II or BINDING SITE III. Table 2 illustrates the complementarity of the nucleotide sequences of LOC200982 BINDING SITE, designated SEQ ID:43376, to the nucleotide sequence of VGAM2353 RNA, herein designated VGAM RNA, also designated SEQ ID:5064.

Another function of VGAM2353 is therefore inhibition of LOC200982 (Accession XM_117305). Accordingly, utilities of VGAM2353 include diagnosis, prevention and treatment of diseases and clinical conditions associated with LOC200982. LOC201229 (Accession XM_113925) is another VGAM2353 host target gene. LOC201229 BINDING SITE is HOST TARGET binding site found in the 3' untranslated region of mRNA encoded by LOC201229, corresponding to a HOST TARGET binding site such as BINDING SITE I, BINDING SITE II or BINDING SITE III. Table 2 illustrates the complementarity of the nucleotide sequences of LOC201229 BINDING SITE, designated SEQ ID:42543, to the nucleotide sequence of VGAM2353 RNA, herein designated VGAM RNA, also designated SEQ ID:5064.

Another function of VGAM2353 is therefore inhibition of LOC201229 (Accession XM_113925). Accordingly, utilities of VGAM2353 include diagnosis, prevention and treatment of diseases and clinical conditions associated with LOC201229. LOC203378 (Accession XM_117541) is another VGAM2353 host target gene. LOC203378 BINDING SITE is HOST TARGET binding site found in the 5' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43555, to the nucleotide sequence of VGAM2353 RNA, herein designated VGAM RNA, also designated SEQ ID:5064.

Another function of VGAM2353 is therefore inhibition of LOC203378 (Accession XM_117541). Accordingly, utilities of VGAM2353 include diagnosis, prevention and treatment of diseases and clinical conditions associated with LOC203378. LOC219920 (Accession XM_167787) is another VGAM2353 host target gene. LOC219920 BINDING SITE is HOST TARGET binding site found in the 5' untranslated region of mRNA encoded by LOC219920, corresponding to a HOST TARGET binding site such as BINDING SITE I, BINDING SITE II or BINDING SITE III. Table 2 illustrates the complementarity of the nucleotide sequences of LOC219920 BINDING SITE, designated SEQ ID:44809, to the nucleotide sequence of VGAM2353 RNA, herein designated VGAM RNA, also designated SEQ ID:5064.

Another function of VGAM2353 is therefore inhibition of LOC219920 (Accession XM_167787). Accordingly, utilities of VGAM2353 include diagnosis, prevention and treatment of diseases and clinical conditions associated with LOC219920. LOC221399 (Accession XM_168134) is another VGAM2353 host target gene. LOC221399 BIND- ING SITE is HOST TARGET binding site found in the 5' untranslated region of mRNA encoded by LOC221399, corresponding to a HOST TARGET binding site such as BINDING SITE I, BINDING SITE II or BINDING SITE III. Table 2 illustrates the complementarity of the nucleotide sequences of LOC221399 BINDING SITE, designated SEQ ID:45052, to the nucleotide sequence of VGAM2353 RNA, herein designated VGAM RNA, also designated SEQ ID:5064.

Another function of VGAM2353 is therefore inhibition of LOC221399 (Accession XM_168134). Accordingly, utilities of VGAM2353 include diagnosis, prevention and treatment of diseases and clinical conditions associated with LOC221399. LOC221424 (Accession XM_168060) is another VGAM2353 host target gene. LOC221424 BINDING SITE is HOST TARGET binding site found in the 5' untranslated region of mRNA encoded by LOC221424, corresponding to a HOST TARGET binding site such as BINDING SITE I, BINDING SITE II or BINDING SITE III. Table 2 illustrates the complementarity of the nucleotide sequences of LOC221424 BINDING SITE, designated SEQ ID:44980, to the nucleotide sequence of VGAM2353 RNA, herein designated VGAM RNA, also designated SEQ ID:5064.

Another function of VGAM2353 is therefore inhibition of LOC221424 (Accession XM_168060). Accordingly, utilities of VGAM2353 include diagnosis, prevention and treatment of diseases and clinical conditions associated with LOC221424. LOC221794 (Accession XM_168214) is another VGAM2353 host target gene. LOC221794 BINDING SITE is HOST TARGET binding site found in the 5' untranslated region of mRNA encoded by LOC221794, corresponding to a HOST TARGET binding site such as BINDING SITE I, BINDING SITE II or BINDING SITE III. Table 2 illustrates the complementarity of the nucleotide sequences of LOC221794 BINDING SITE, designated SEQ ID:45073, to the nucleotide sequence of VGAM2353 RNA, herein designated VGAM RNA, also designated SEQ ID:5064.

Another function of VGAM2353 is therefore inhibition of LOC221794 (Accession XM_168214). Accordingly, utilities of VGAM2353 include diagnosis, prevention and treatment of diseases and clinical conditions associated with LOC221794. LOC254351 (Accession XM_170774) is another VGAM2353 host target gene. LOC254351 BINDING SITE is HOST TARGET binding site found in the 5' untranslated region of mRNA encoded by LOC254351, corresponding to a HOST TARGET binding site such as BINDING SITE I, BINDING SITE II or BINDING SITE III. Table 2 illustrates the complementarity of the nucleotide sequences of LOC254351 BINDING SITE, designated SEQ ID:45542, to the nucleotide sequence of VGAM2353 RNA, herein designated VGAM RNA, also designated SEQ ID:5064.

Another function of VGAM2353 is therefore inhibition of LOC254351 (Accession XM_170774). Accordingly, utilities of VGAM2353 include diagnosis, prevention and treatment of diseases and clinical conditions associated with LOC254351. LOC254617 (Accession XM_173236) is another VGAM2353 host target gene. LOC254617 BINDING SITE is HOST TARGET binding site found in the 5' untranslated region of mRNA encoded by LOC254617, corresponding to a HOST TARGET binding site such as BINDING SITE I, BINDING SITE II or BINDING SITE III. Table 2 illustrates the complementarity of the nucleotide sequences of LOC254617 BINDING SITE, designated SEQ ID:46519, to the nucleotide sequence of VGAM2353 RNA, herein designated VGAM RNA, also designated SEQ ID:5064.

Another function of VGAM2353 is therefore inhibition of LOC254617 (Accession XM_173236). Accordingly, utilities of VGAM2353 include diagnosis, prevention and treatment of diseases and clinical conditions associated with LOC254617. LOC257354 (Accession XM_170810) is another VGAM2353 host target gene. LOC257354 BINDING SITE is HOST TARGET binding site found in the 3' untranslated region of mRNA encoded by LOC257354, corresponding to a HOST TARGET binding site such as BINDING SITE I, BINDING SITE II or BINDING SITE III. Table 2 illustrates the complementarity of the nucleotide sequences of LOC257354 BINDING SITE, designated SEQ ID:45581, to the nucleotide sequence of VGAM2353 RNA, herein designated VGAM RNA, also designated SEQ ID:5064.

Another function of VGAM2353 is therefore inhibition of LOC257354 (Accession XM_170810). Accordingly, utilities of VGAM2353 include diagnosis, prevention and treatment of diseases and clinical conditions associated with LOC257354. LOC51083 (Accession NM_015973) is another VGAM2353 host target gene. LOC51083 BINDING SITE is HOST TARGET binding site found in the 5' untranslated region of mRNA encoded by LOC51083, corresponding to a HOST TARGET binding site such as BINDING SITE I, BINDING SITE II or BINDING SITE III. Table 2 illustrates the complementarity of the nucleotide sequences of LOC51083 BINDING SITE, designated SEQ ID:18070, to the nucleotide sequence of VGAM2353 RNA, herein designated VGAM RNA, also designated SEQ ID:5064.

Another function of VGAM2353 is therefore inhibition of LOC51083 (Accession NM_015973). Accordingly, utilities of VGAM2353 include diagnosis, prevention and treatment of diseases and clinical conditions associated with LOC51083. LOC92078 (Accession XM_042684) is another VGAM2353 host target gene. LOC92078 BINDING SITE is HOST TARGET binding site found in the 3' untranslated region of mRNA encoded by LOC92078, corresponding to a HOST TARGET binding site such as BINDING SITE I, BINDING SITE II or BINDING SITE III. Table 2 illustrates the complementarity of the nucleotide sequences of LOC92078 BINDING SITE, designated SEQ ID:33744, to the nucleotide sequence of VGAM2353 RNA, herein designated VGAM RNA, also designated SEQ ID:5064.

Another function of VGAM2353 is therefore inhibition of LOC92078 (Accession XM_042684). Accordingly, utilities of VGAM2353 include diagnosis, prevention and treatment of diseases and clinical conditions associated with LOC92078. LOC92661 (Accession XM_046465) is another VGAM2353 host target gene. LOC92661 BINDING SITE is HOST TARGET binding site found in the 3' untranslated region of mRNA encoded by LOC92661, corresponding to a HOST TARGET binding site such as BINDING SITE I, BINDING SITE II or BINDING SITE III. Table 2 illustrates the complementarity of the nucleotide sequences of LOC92661 BINDING SITE, designated SEQ ID:34724, to the nucleotide sequence of VGAM2353 RNA, herein designated VGAM RNA, also designated SEQ ID:5064.

Another function of VGAM2353 is therefore inhibition of LOC92661 (Accession XM_046465). Accordingly, utilities of VGAM2353 include diagnosis, prevention and treatment of diseases and clinical conditions associated with LOC92661. FIG. 1 further provides a conceptual description of a novel bioinformatically detected viral gene of the present invention, referred to here as Viral Genomic Address Messenger 2354 (VGAM2354) viral gene, which modulates expression of respective host target genes thereof, the function and utility of which host target genes is known in the art.

VGAM2354 is a novel bioinformatically detected regulatory, non protein coding, viral micro RNA (miRNA) gene. The method by which VGAM2354 was detected is described hereinabove with reference to FIGS. 1-8.

VGAM2354 gene, herein designated VGAM GENE, is a viral gene contained in the genome of Equine Herpesvirus 2. VGAM2354 host target gene, herein designated VGAM HOST TARGET GENE, is a human gene contained in the human genome.

VGAM2354 gene encodes a VGAM2354 precursor RNA, herein designated VGAM PRECURSOR RNA. Similar to other miRNA genes, and unlike most ordinary genes, VGAM2354 precursor RNA does not encode a protein. A nucleotide sequence identical or highly similar to the nucleotide sequence of VGAM2354 precursor RNA is designated SEQ ID:2340, and is provided hereinbelow with reference to the sequence listing part. Nucleotide sequence SEQ ID:2340 is located at position 18623 relative to the genome of Equine Herpesvirus 2.

VGAM2354 precursor RNA folds onto itself, forming VGAM2354 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2354 folded precursor RNA into VGAM2354 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM2354 RNA is designated SEQ ID:5065, and is provided hereinbelow with reference to the sequence listing part.

VGAM2354 host target gene, herein designated VGAM HOST TARGET GENE, encodes a corresponding messenger RNA, VGAM2354 host target RNA, herein designated VGAM HOST TARGET RNA. VGAM2354 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2354 RNA, herein designated VGAM RNA, binds complementarily to one or more host target binding sites located in untranslated regions of VGAM2354 host target RNA, herein designated VGAM HOST TARGET RNA. This complementary binding is due to the fact that the nucleotide sequence of VGAM2354 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2354 RNA, herein designated VGAM RNA, may have a different number of host target binding sites in untranslated regions of a VGAM2354 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2354 RNA, herein designated VGAM RNA, to host target binding sites on VGAM2354 host target RNA, herein designated VGAM HOST TARGET RNA, such as BINDING SITE I, BINDING SITE II and BINDING SITE III, inhibits translation of VGAM2354 host target RNA into VGAM2354 host target protein, herein designated VGAM HOST TARGET PROTEIN. VGAM host target protein is therefore outlined by a broken line.

It is appreciated that VGAM2354 host target gene, herein designated VGAM HOST TARGET GENE, in fact represents a plurality of VGAM2354 host target genes. The mRNA of each one of this plurality of VGAM2354 host target genes comprises one or more host target binding sites, each having a nucleotide sequence which is at least partly complementary to VGAM2354 RNA, herein designated VGAM RNA, and which when bound by VGAM2354 RNA causes inhibition of translation of respective one or more VGAM2354 host target proteins.

It is further appreciated by one skilled in the art that the mode of translational inhibition illustrated by FIG. 1 with specific reference to translational inhibition exerted by VGAM2354 gene, herein designated VGAM GENE, on one or more VGAM2354 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2354 is inhibition of expression of host target genes, as part of a novel viral mechanism of attacking a host. Accordingly, utilities of VGAM2354 include diagnosis, prevention and treatment of viral infection by Equine Herpesvirus 2. Specific functions, and accordingly utilities, of VGAM2354 correlate with, and may be deduced from, the identity of the host target genes which VGAM2354 binds and inhibits, and the function of these host target genes, as elaborated hereinbelow.

Nucleotide sequences of the VGAM2354 precursor RNA, herein designated VGAM PRECURSOR RNA, and of the 'diced' VGAM2354 RNA, herein designated VGAM RNA, and a schematic representation of the secondary folding of VGAM2354 folded precursor RNA, herein designated VGAM FOLDED PRECURSOR RNA, of VGAM2354 are further described hereinbelow with reference to Table 1.

Nucleotide sequences of host target binding sites, such as BINDING SITE-I, BINDING SITE-II and BINDING SITE-III of FIG. 1, found on VGAM2354 host target RNA, and schematic representation of the complementarity of each of these host target binding sites to VGAM2354 RNA, herein designated VGAM RNA, are described hereinbelow with reference to Table 2.

As mentioned hereinabove with reference to FIG. 1, a function of VGAM2354 gene, herein designated VGAM is inhibition of expression of VGAM2354 target genes. It is appreciated that specific functions, and accordingly utilities, of VGAM2354 correlate with, and may be deduced from, the identity of the target genes which VGAM2354 binds and inhibits, and the function of these target genes, as elaborated hereinbelow.

B-cell CLL/lymphoma 7B (BCL7B, Accession NM_001707) is a VGAM2354 host target gene. BCL7B BINDING SITE is HOST TARGET binding site found in the 3' untranslated region of mRNA encoded by BCL7B, corresponding to a HOST TARGET binding site such as BINDING SITE I, BINDING SITE II or BINDING SITE III. Table 2 illustrates the complementarity of the nucleotide sequences of BCL7B BINDING SITE, designated SEQ ID:7433, to the nucleotide sequence of VGAM2354 RNA, herein designated VGAM RNA, also designated SEQ ID:5065.

A function of VGAM2354 is therefore inhibition of B-cell CLL/lymphoma 7B (BCL7B, Accession NM_001707), a gene which is of yet unknown fanction. Accordingly, utilities of VGAM2354 include diagnosis, prevention and treatment of diseases and clinical conditions associated with BCL7B. The function of BCL7B and its association with various diseases and clinical conditions, has been established by previous studies, as described hereinabove with reference to VGAM1189. Centrosomal Protein 1 (CEP1, Accession NM_007018) is another VGAM2354 host target gene. CEP1 BINDING SITE is HOST TARGET binding site found in the 5' untranslated region of mRNA encoded by CEP1, corresponding to a HOST TARGET binding site such as BINDING SITE I, BINDING SITE II or BINDING SITE III. Table 2 illustrates the complementarity of the nucleotide sequences of CEP1 BINDING SITE, designated SEQ ID:13875, to the nucleotide sequence of VGAM2354 RNA, herein designated VGAM RNA, also designated SEQ ID:5065.

Another function of VGAM2354 is therefore inhibition of Centrosomal Protein 1 (CEP1, Accession NM_007018), a gene which mediates actin cytoskeleton reorganization at the plasma membrane. Accordingly, utilities of VGAM2354 include diagnosis, prevention and treatment of diseases and clinical conditions associated with CEP1. The function of CEP1 and its association with various diseases and clinical conditions, has been established by previous studies, as described hereinabove with reference to VGAM1295. EH-domain Containing 4 (EHD4, Accession NM_139265) is another VGAM2354 host target gene. EHD4 BINDING SITE is HOST TARGET binding site found in the 3' untranslated region of mRNA encoded by EHD4, corresponding to a HOST TARGET binding site such as BINDING SITE I, BINDING SITE II or BINDING SITE III. Table 2 illustrates the complementarity of the nucleotide sequences of EHD4 BINDING SITE, designated SEQ ID:29255, to the nucleotide sequence of VGAM2354 RNA, herein designated VGAM RNA, also designated SEQ ID:5065.

Another function of VGAM2354 is therefore inhibition of EH-domain Containing 4 (EHD4, Accession NM_139265). Accordingly, utilities of VGAM2354 include diagnosis, prevention and treatment of diseases and clinical conditions associated with EHD4. Guanine Nucleotide Binding Protein (G protein), Alpha Inhibiting Activity Polypeptide 1 (GNAI1, Accession NM_002069) is another VGAM2354 host target gene. GNAI1 BINDING SITE is HOST TARGET binding site found in the 5' untranslated region of mRNA encoded by GNAI1, corresponding to a HOST TARGET binding site such as BINDING SITE I, BINDING SITE II or BINDING SITE III. Table 2 illustrates the complementarity of the nucleotide sequences of GNAI1 BINDING SITE, designated SEQ ID:7838, to the nucleotide sequence of VGAM2354 RNA, herein designated VGAM RNA, also designated SEQ ID:5065.

Another function of VGAM2354 is therefore inhibition of Guanine Nucleotide Binding Protein (G protein), Alpha Inhibiting Activity Polypeptide 1 (GNAI1, Accession NM_002069), a gene which is involved as modulators or transducers in various transmembrane signaling systems. Accordingly, utilities of VGAM2354 include diagnosis, prevention and treatment of diseases and clinical conditions associated with GNAI1. The function of GNAI1 and its association with various diseases and clinical conditions, has been established by previous studies, as described hereinabove with reference to VGAM57. Histidine Ammonia-lyase (HAL, Accession NM_002108) is another VGAM2354 host target gene. HAL BINDING SITE is HOST TARGET binding site found in the 5" untranslated region of mRNA encoded by HAL, corresponding to a HOST TARGET binding site such as BINDING SITE I, BINDING SITE II or BINDING SITE III. Table 2 illustrates the complementarity of the nucleotide sequences of HAL BINDING SITE, designated SEQ ID:7889, to the nucleotide sequence of VGAM2354 RNA, herein designated VGAM RNA, also designated SEQ ID:5065.

Another function of VGAM2354 is therefore inhibition of Histidine Ammonia-lyase (HAL, Accession NM_002108). Accordingly, utilities of VGAM2354 include diagnosis, prevention and treatment of diseases and clinical conditions associated with HAL. Huntingtin-associated Protein 1 (neuroan 1) (HAP1, Accession NM_003949) is another VGAM2354 host target gene. HAP1 BINDING SITE is HOST TARGET binding site found in the 3' untranslated region of mRNA encoded by HAP1, corresponding to a HOST TARGET binding site such as BINDING SITE I, BINDING SITE II or BINDING SITE III. Table 2 illustrates the complementarity of the nucleotide sequences of HAP1 BINDING SITE, designated SEQ ID:10073, to the nucleotide sequence of VGAM2354 RNA, herein designated VGAM RNA, also designated SEQ ID:5065.

Another function of VGAM2354 is therefore inhibition of Huntingtin-associated Protein 1 (neuroan 1) (HAP1, Accession NM_003949), a gene which functions as an adaptor protein using coiled coils to mediate interactions among cytoskeletal, vascular, and motor proteins. Accordingly, utilities of VGAM2354 include diagnosis, prevention and treatment of diseases and clinical conditions associated with HAP1. The function of HAP1 and its association with various diseases and clinical conditions, has been established by previous studies, as described hereinabove with reference to VGAM126. MAD, Mothers Against Decapentaplegic Homolog 2 (Drosophila) (MADH2, Accession NM_005901) is another VGAM2354 host target gene. MADH2 BINDING SITE is HOST TARGET binding site found in the 3' untranslated region of mRNA encoded by MADH2, corresponding to a HOST TARGET binding site such as BINDING SITE I, BINDING SITE II or BINDING SITE III. Table 2 illustrates the complementarity of the nucleotide sequences of MADH2 BINDING SITE, designated SEQ ID:12521, to the nucleotide sequence of VGAM2354 RNA, herein designated VGAM RNA, also designated SEQ ID:5065.

Another function of VGAM2354 is therefore inhibition of MAD, Mothers Against Decapentaplegic Homolog 2 (Drosophila) (MADH2, Accession NM_005901). Accordingly, utilities of VGAM2354 include diagnosis, prevention and treatment of diseases and clinical conditions associated with MADH2. Phosphoinositide-3-kinase, Regulatory Subunit, Polypeptide 1 (p85 alpha) (PIK3R1, Accession XM_043865) is another VGAM2354 host target gene. PIK3R1 BINDING SITE is HOST TARGET binding site found in the 3' untranslated region of mRNA encoded by PIK3R1, corresponding to a HOST TARGET binding site such as BINDING SITE I, BINDING SITE II or BINDING SITE III. Table 2 illustrates the complementarity of the nucleotide sequences of PIK3R1 BINDING SITE, designated SEQ ID:34035, to the nucleotide sequence of VGAM2354 RNA, herein designated VGAM RNA, also designated SEQ ID:5065.

Another function of VGAM2354 is therefore inhibition of Phosphoinositide-3-kinase, Regulatory Subunit, Polypeptide 1 (p85 alpha) (PIK3R1, Accession XM_043865), a gene which acts as an adapter, for the insulin-stimulated increase in glucose uptake and glycogen synthesis. Accordingly, utilities of VGAM2354 include diagnosis, prevention and treatment of diseases and clinical conditions associated with PIK3R1. The function of PIK3R1 and its association with various diseases and clinical conditions, has been established by previous studies, as described hereinabove with reference to VGAM826. Regulator of G-protein Signalling 9 (RGS9, Accession NM_003835) is another VGAM2354 host target gene. RGS9 BINDING SITE is HOST TARGET binding site found in the 5' untranslated region of mRNA encoded by RGS9, corresponding to a HOST TARGET binding site such as BINDING SITE I, BINDING SITE II or BINDING SITE III. Table 2 illustrates the complementarity of the nucleotide sequences of RGS9 BINDING SITE, designated SEQ ID:9927, to the nucleotide sequence of VGAM2354 RNA, herein designated VGAM RNA, also designated SEQ ID:5065.

Another function of VGAM2354 is therefore inhibition of Regulator of G-protein Signalling 9 (RGS9, Accession NM_003835). Accordingly, utilities of VGAM2354 include diagnosis, prevention and treatment of diseases and clinical conditions associated with RGS9. Short Stature Homeobox 2 (SHOX2, Accession NM_006884) is another VGAM2354 host target gene. SHOX2 BINDING SITE1 and SHOX2 BINDING SITE2 are HOST TARGET binding sites found in untranslated regions of mRNA encoded by SHOX2, corresponding to HOST TARGET binding sites such as BINDING SITE I, BINDING SITE II or BINDING SITE III. Table 2 illustrates the complementarity of the nucleotide sequences of SHOX2 BINDING SITE1 and SHOX2 BINDING SITE2, designated SEQ ID:13747 and SEQ ID:8973 respectively, to the nucleotide sequence of VGAM2354 RNA, herein designated VGAM RNA, also designated SEQ ID:5065.

Another function of VGAM2354 is therefore inhibition of Short Stature Homeobox 2 (SHOX2, Accession NM_006884), a gene which may be a growth regulator and have a role in specifying neural systems. Accordingly, utilities of VGAM2354 include diagnosis, prevention and treatment of diseases and clinical conditions associated with SHOX2. The function of SHOX2 has been established by previous studies. Homeo box genes encode proteins containing a 60-amino acid residue motif that represents a DNA binding domain. They have been characterized extensively as transcriptional regulators involved in pattern formation in both invertebrate and vertebrate species. Embryonic development is mediated through an interactive network created by the overlapping expression patterns of a number of transcription factors including the homeo box gene superfamily. This dynamic scaffold provides positional information for cell determination and differentiation underlying developmental processes from the simple determination of body axis to the formation of complex body structures. This vital function of homeodomain proteins during embryonic development was initially elucidated in lower organisms. Later, several human genetic disorders were shown to be caused by aberrations in human homeo box genes: Waardenburg syndrome (PAX3; 606597), aniridia (PAX6; 607108), synpolydactyly (HOXD13; 142989), schizencephaly (EMX2; 600035), and Rieger syndrome (PITX2; 601542). SHOX (OMIM Ref. No. 312865) is a pseudoautosomal homeo box gene that is thought to be responsible for idiopathic short stature and implicated to play a role in the short stature phenotype of Turner syndrome patients. This gene shows high homology to the murine og12 gene, which was consequently proposed as the putative mouse homolog of SHOX. The homeodomains of SHOX (also called PHOG) and og12 were shown to be identical, suggesting that the 2 proteins bind to equivalent DNA elements and therefore trigger similar physiologic pathways. Blaschke et al. (1998) reported the identification of a SHOX-related human gene, which they designated SHOT (for SHOX homologous gene on chromosome 3), that shows a much higher degree of homology to og12 than SHOX. Two different isoforms were isolated, SHOTa and SHOTb, which have identical homeodomains and share a C-terminal 14-amino acid residue motif characteristic for craniofacially expressed homeodomain proteins. The differences between SHOTa and SHOTb reside within the N-termini and an alternatively spliced exon in the C termini. In situ hybridization of og12 on sections from staged mouse embryos detected highly restricted transcripts in the developmental sinus venosus (aorta), female genitalia, diencephalon, mes- and myelencephalon, nasal capsula, palate, eyelid, and limbs. By fluorescence in situ hybridization (FISH), Blaschke et al. (1998) mapped the human SHOT gene on 3q25-q26. By the same method, De Baere et al. (1998) confirmed the localization of SHOT on 3q25-q26.1. It has been suggested on the basis of chromosomal aberrations that the Cornelia de Lange syndrome (OMIM Ref. No. 122470) maps to 3q26.3. Blaschke et al. (1998) suggested that SHOT is a candidate gene for that disorder. By FISH, Blaschke et al. (1998) mapped the mouse og12 gene to chromosome 3 in a region that shows homology of synteny to human 3q.

Full details of the abovementioned studies are described in the following publications, the disclosure of which are hereby incorporated by reference:

Blaschke, R. J.; Monaghan, A. P.; Schiller, S.; Schechinger, B.; Rao, E.; Padilla-Nash, H.; Ried, T.; Rappold, G. A.: SHOT, a SHOX-related homeobox gene, is implicated in craniofacial, brain, heart, and limb development. Proc. Nat. Acad. Sci. 95:2406-2411, 1998; and Clement-Jones, M.; Schiller, S.; Rao, E.; Blaschke, R. J.; Zuniga, A.; Zeller, R.; Robson, S. C.; Binder, G.; Glass, I.; Strachan, T.; Lindsay, S.; Rappold, G. A.: The short stature homeo.

Further studies establishing the function and utilities of SHOX2 are found in John Hopkins OMIM database record ID 602504, and in sited publications numbered 10624-1062 and 9027 listed in the bibliography section hereinbelow, which are also hereby incorporated by reference. ABLIM (Accession NM_002313) is another VGAM2354 host target gene. ABLIM BINDING SITE1 and ABLIM BINDING SITE2 are HOST TARGET binding sites found in untranslated regions of mRNA encoded by ABLIM, corresponding to HOST TARGET binding sites such as BINDING SITE I, BINDING SITE II or BINDING SITE III. Table 2 illustrates the complementarity of the nucleotide sequences of ABLIM BINDING SITE1 and ABLIM BINDING SITE2, designated SEQ ID:8112 and SEQ ID:13545 respectively, to the nucleotide sequence of VGAM2354 RNA, herein designated VGAM RNA, also designated SEQ ID:5065.

Another function of VGAM2354 is therefore inhibition of ABLIM (Accession NM_002313). Accordingly, utilities of VGAM2354 include diagnosis, prevention and treatment of diseases and clinical conditions associated with ABLIM. AD-020 (Accession XM_002161) is another VGAM2354 host target gene. AD-020 BINDING SITE1 and AD-020 BINDING SITE2 are HOST TARGET binding sites found in untranslated regions of mRNA encoded by AD-020, corresponding to HOST TARGET binding sites such as BINDING SITE I, BINDING SITE II or BINDING SITE III. Table 2 illustrates the complementarity of the nucleotide sequences of AD-020 BINDING SITE1 and AD-020 BINDING SITE2, designated SEQ ID:29868 and SEQ ID:17541 respectively, to the nucleotide sequence of VGAM2354 RNA, herein designated VGAM RNA, also designated SEQ ID:5065.

Another function of VGAM2354 is therefore inhibition of AD-020 (Accession XM_002161). Accordingly, utilities of VGAM2354 include diagnosis, prevention and treatment of diseases and clinical conditions associated with AD-020. DKFZP586M1120 (Accession NM_031294) is another VGAM2354 host target gene. DKFZP586M1120 BINDING SITE is HOST TARGET binding site found in the 3' untranslated region of mRNA encoded by DKFZP586M1120, corresponding to a HOST TARGET binding site such as BINDING SITE I, BINDING SITE II or BINDING SITE III. Table 2 illustrates the complementarity of the nucleotide sequences of DKFZP586M1120 BINDING SITE, designated SEQ ID:25318, to the nucleotide sequence of VGAM2354 RNA, herein designated VGAM RNA, also designated SEQ ID:5065.

Another function of VGAM2354 is therefore inhibition of DKFZP586M1120 (Accession NM_031294). Accordingly, utilities of VGAM2354 include diagnosis, prevention and treatment of diseases and clinical conditions associated with DKFZP586M1120. FLJ10769 (Accession NM_018210) is another VGAM2354 host target gene. FLJ10769 BINDING SITE is HOST TARGET binding site found in the 3' untranslated region of mRNA encoded by FLJ10769, corresponding to a HOST TARGET binding site such as BINDING SITE I, BINDING SITE II or BINDING SITE III. Table 2 illustrates the complementarity of the nucleotide sequences of FLJ10769 BINDING SITE, designated SEQ ID:20111, to the nucleotide sequence of VGAM2354 RNA, herein designated VGAM RNA, also designated SEQ ID:5065.

Another function of VGAM2354 is therefore inhibition of FLJ10769 (Accession NM_018210). Accordingly, utilities of VGAM2354 include diagnosis, prevention and treatment of diseases and clinical conditions associated with FLJ10769. FLJ20015 (Accession NM_018996) is another VGAM2354 host target gene. FLJ20015 BINDING SITE is HOST TARGET binding site found in the 3' untranslated region of mRNA encoded by FLJ20015, corresponding to a HOST TARGET binding site such as BINDING SITE I, BINDING SITE II or BINDING SITE III. Table 2 illustrates the complementarity of the nucleotide sequences of FLJ20015 BINDING SITE, designated SEQ ID:21069, to the nucleotide sequence of VGAM2354 RNA, herein designated VGAM RNA, also designated SEQ ID:5065.

Another function of VGAM2354 is therefore inhibition of FLJ20015 (Accession NM_018996). Accordingly, utilities of VGAM2354 include diagnosis, prevention and treatment of diseases and clinical conditions associated with FLJ20015. FLJ20420 (Accession NM_017812) is another VGAM2354 host target gene. FLJ20420 BINDING SITE is HOST TARGET binding site found in the 3' untranslated region of mRNA encoded by FLJ20420, corresponding to a HOST TARGET binding site such as BINDING SITE I, BINDING SITE II or BINDING SITE III. Table 2 illustrates the complementarity of the nucleotide sequences of FLJ20420 BINDING SITE, designated SEQ ID:19460, to the nucleotide sequence of VGAM2354 RNA, herein designated VGAM RNA, also designated SEQ ID:5065.

Another function of VGAM2354 is therefore inhibition of FLJ20420 (Accession NM_017812). Accordingly, utilities of VGAM2354 include diagnosis, prevention and treatment of diseases and clinical conditions associated with FLJ20420. Heart and Neural Crest Derivatives Expressed 1 (HAND1, Accession NM_004821) is another VGAM2354 host target gene. HAND1 BINDING SITE is HOST TARGET binding site found in the 3' untranslated region of mRNA encoded by HAND1, corresponding to a HOST TARGET binding site such as BINDING SITE I, BINDING SITE II or BINDING SITE III. Table 2 illustrates the complementarity of the nucleotide sequences of HAND1 BINDING SITE, designated SEQ ID:11236, to the nucleotide sequence of VGAM2354 RNA, herein designated VGAM RNA, also designated SEQ ID:5065.

Another function of VGAM2354 is therefore inhibition of Heart and Neural Crest Derivatives Expressed 1 (HAND1, Accession NM_004821). Accordingly, utilities of VGAM2354 include diagnosis, prevention and treatment of diseases and clinical conditions associated with HAND1. KIAA0716 (Accession NM_014705) is another VGAM2354 host target gene. KIAA0716 BINDING SITE is HOST TARGET binding site found in the 3' untranslated region of mRNA encoded by KIAA0716, corresponding to a HOST TARGET binding site such as BINDING SITE I, BINDING SITE II or BINDING SITE III. Table 2 illustrates the complementarity of the nucleotide sequences of KIAA0716 BINDING SITE, designated SEQ ID:16245, to the nucleotide sequence of VGAM2354 RNA, herein designated VGAM RNA, also designated SEQ ID:5065.

Another function of VGAM2354 is therefore inhibition of KIAA0716 (Accession NM_014705). Accordingly, utilities of VGAM2354 include diagnosis, prevention and treatment of diseases and clinical conditions associated with KIAA0716. KIAA1095 (Accession XM_041363) is another VGAM2354 host target gene. KIAA1095 BINDING SITE is HOST TARGET binding site found in the 3' untranslated region of mRNA encoded by KIAA1095, corresponding to a HOST TARGET binding site such as BINDING SITE I, BINDING SITE II or BINDING SITE III. Table 2 illustrates the complementarity of the nucleotide sequences of KIAA1095 BINDING SITE, designated SEQ ID:33505, to the nucleotide sequence of VGAM2354 RNA, herein designated VGAM RNA, also designated SEQ ID:5065.

Another function of VGAM2354 is therefore inhibition of KIAA1095 (Accession XM_041363). Accordingly, utilities of VGAM2354 include diagnosis, prevention and treatment of diseases and clinical conditions associated with KIAA1095. KIAA1416 (Accession XM_098762) is another VGAM2354 host target gene. KIAA1416 BINDING SITE is HOST TARGET binding site found in the 3' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41798, to the nucleotide sequence of VGAM2354 RNA, herein designated VGAM RNA, also designated SEQ ID:5065.

Another function of VGAM2354 is therefore inhibition of KIAA1416 (Accession XM_098762). Accordingly, utilities of VGAM2354 include diagnosis, prevention and treatment of diseases and clinical conditions associated with KIAA1416. KIAA1582 (Accession XM_037262) is another VGAM2354 host target gene. KIAA1582 BINDING SITE is HOST TARGET binding site found in the 3' untranslated region of mRNA encoded by KIAA1582, corresponding to a HOST TARGET binding site such as BINDING SITE I, BINDING SITE II or BINDING SITE III. Table 2 illustrates the complementarity of the nucleotide sequences of KIAA1582 BINDING SITE, designated SEQ ID:32590, to the nucleotide sequence of VGAM2354 RNA, herein designated VGAM RNA, also designated SEQ ID:5065.

Another function of VGAM2354 is therefore inhibition of KIAA1582 (Accession XM_037262). Accordingly, utilities of VGAM2354 include diagnosis, prevention and treatment of diseases and clinical conditions associated with KIAA1582. KIAA1841 (Accession XM_087056) is another VGAM2354 host target gene. KIAA1841 BINDING SITE is HOST TARGET binding site found in the 3' untranslated region of mRNA encoded by KIAA1841, corresponding to a HOST TARGET binding site such as BINDING SITE I, BINDING SITE II or BINDING SITE III. Table 2 illustrates the complementarity of the nucleotide sequences of KIAA1841 BINDING SITE, designated SEQ ID:39024, to the nucleotide sequence of VGAM2354 RNA, herein designated VGAM RNA, also designated SEQ ID:5065.

Another function of VGAM2354 is therefore inhibition of KIAA1841 (Accession XM_087056). Accordingly, utilities of VGAM2354 include diagnosis, prevention and treatment of diseases and clinical conditions associated with KIAA1841. KIAA1889 (Accession XM_056298) is another VGAM2354 host target gene. KIAA1889 BINDING SITE is HOST TARGET binding site found in the 3' untranslated region of mRNA encoded by KIAA1889, corresponding to a HOST TARGET binding site such as BINDING SITE I, BINDING SITE II or BINDING SITE III. Table 2 illustrates the complementarity of the nucleotide sequences of KIAA1889 BINDING SITE, designated SEQ ID:36387, to the nucleotide sequence of VGAM2354 RNA, herein designated VGAM RNA, also designated SEQ ID:5065.

Another function of VGAM2354 is therefore inhibition of KIAA1889 (Accession XM_056298). Accordingly, utilities of VGAM2354 include diagnosis, prevention and treatment of diseases and clinical conditions associated with KIAA1889. MGC13183 (Accession NM_032358) is another VGAM2354 host target gene. MGC13183 BINDING SITE is HOST TARGET binding site found in the 3' untranslated region of mRNA encoded by MGC13183, corresponding to a HOST TARGET binding site such as BINDING SITE I, BINDING SITE II or BINDING SITE III. Table 2 illustrates the complementarity of the nucleotide sequences of MGC13183 BINDING SITE, designated SEQ ID:26144, to the nucleotide sequence of VGAM2354 RNA, herein designated VGAM RNA, also designated SEQ ID:5065.

Another function of VGAM2354 is therefore inhibition of MGC13183 (Accession NM_032358). Accordingly, utilities of VGAM2354 include diagnosis, prevention and treatment of diseases and clinical conditions associated with MGC13183. Olfactomedin 3 (OLFM3, Accession XM_088951) is another VGAM2354 host target gene. OLFM3 BINDING SITE is HOST TARGET binding site found in the 3' untranslated region of mRNA encoded by OLFM3, corresponding to a HOST TARGET binding site such as BINDING SITE I, BINDING SITE II or BINDING SITE III. Table 2 illustrates the complementarity of the nucleotide sequences of OLFM3 BINDING SITE, designated SEQ ID:39958, to the nucleotide sequence of VGAM2354 RNA, herein designated VGAM RNA, also designated SEQ ID:5065.

Another function of VGAM2354 is therefore inhibition of Olfactomedin 3 (OLFM3, Accession XM_088951). Accordingly, utilities of VGAM2354 include diagnosis, prevention and treatment of diseases and clinical conditions associated with OLFM3. Phosphodiesterase 10A (PDE10A, Accession NM_006661) is another VGAM2354 host target gene. PDE10A BINDING SITE is HOST TARGET binding site found in the 3' untranslated region of mRNA encoded by PDE10A, corresponding to a HOST TARGET binding site such as BINDING SITE I, BINDING SITE II or BINDING SITE III. Table 2 illustrates the complementarity of the nucleotide sequences of PDE10A BINDING SITE, designated SEQ ID:13460, to the nucleotide sequence of VGAM2354 RNA, herein designated VGAM RNA, also designated SEQ ID:5065.

Another function of VGAM2354 is therefore inhibition of Phosphodiesterase 10A (PDE10A, Accession NM_006661). Accordingly, utilities of VGAM2354 include diagnosis, prevention and treatment of diseases and clinical conditions associated with PDE10A. Phosphodiesterase 4D Interacting Protein (myomegalin) (PDE4DIP, Accession NM_014644) is another VGAM2354 host target gene. PDE4DIP BINDING SITE is HOST TARGET binding site found in the 3' untranslated region of mRNA encoded by PDE4DIP, corresponding to a HOST TARGET binding site such as BINDING SITE I, BINDING SITE II or BINDING SITE III. Table 2 illustrates the complementarity of the nucleotide sequences of PDE4DIP BINDING SITE, designated SEQ ID:16049, to the nucleotide sequence of VGAM2354 RNA, herein designated VGAM RNA, also designated SEQ ID:5065.

Another function of VGAM2354 is therefore inhibition of Phosphodiesterase 4D Interacting Protein (myomegalin) (PDE4DIP, Accession NM_014644). Accordingly, utilities of VGAM2354 include diagnosis, prevention and treatment of diseases and clinical conditions associated with PDE4DIP. SH3 Domain Binding Glutamic Acid-rich Protein Like (SH3BGRL, Accession XM_030373) is another VGAM2354 host target gene. SH3BGRL BINDING SITE is HOST TARGET binding site found in the 3' untranslated region of mRNA encoded by SH3BGRL, corresponding to a HOST TARGET binding site such as BINDING SITE I, BINDING SITE II or BINDING SITE III. Table 2 illustrates the complementarity of the nucleotide sequences of SH3BGRL BINDING SITE, designated SEQ ID:31023, to the nucleotide sequence of VGAM2354 RNA, herein designated VGAM RNA, also designated SEQ ID:5065.

Another function of VGAM2354 is therefore inhibition of SH3 Domain Binding Glutamic Acid-rich Protein Like (SH3BGRL, Accession XM_030373). Accordingly, utilities of VGAM2354 include diagnosis, prevention and treatment of diseases and clinical conditions associated with SH3BGRL. Solute Carrier Family 31 (copper transporters), Member 2 (SLC31A2, Accession XM_011776) is another VGAM2354 host target gene. SLC31A2 BINDING SITE is HOST TARGET binding site found in the 3" untranslated region of mRNA encoded by SLC31A2, corresponding to a HOST TARGET binding site such as BINDING SITE I, BINDING SITE II or BINDING SITE III. Table 2 illustrates the complementarity of the nucleotide sequences of SLC31A2 BINDING SITE, designated SEQ ID:30192, to the nucleotide sequence of VGAM2354 RNA, herein designated VGAM RNA, also designated SEQ ID:5065.

Another function of VGAM2354 is therefore inhibition of Solute Carrier Family 31 (copper transporters), Member 2 (SLC31A2, Accession XM_011776). Accordingly, utilities of VGAM2354 include diagnosis, prevention and treatment of diseases and clinical conditions associated with SLC31A2. Stanniocalcin 2 (STC2, Accession NM_003714) is another VGAM2354 host target gene. STC2 BINDING SITE is HOST TARGET binding site found in the 3' untranslated region of mRNA encoded by STC2, corresponding to a HOST TARGET binding site such as BINDING SITE I, BINDING SITE II or BINDING SITE III. Table 2 illustrates the complementarity of the nucleotide sequences of STC2 BINDING SITE, designated SEQ ID:9811, to the nucleotide sequence of VGAM2354 RNA, herein designated VGAM RNA, also designated SEQ ID:5065.

Another function of VGAM2354 is therefore inhibition of Stanniocalcin 2 (STC2, Accession NM_003714). Accordingly, utilities of VGAM2354 include diagnosis, prevention and treatment of diseases and clinical conditions associated with STC2. TBLR1 (Accession NM_024665) is another VGAM2354 host target gene. TBLR1 BINDING SITE is HOST TARGET binding site found in the 3' untranslated region of mRNA encoded by TBLR1, corresponding to a HOST TARGET binding site such as BINDING SITE I, BINDING SITE II or BINDING SITE III. Table 2 illustrates the complementarity of the nucleotide sequences of TBLR1 BINDING SITE, designated SEQ ID:23965, to the nucleotide sequence of VGAM2354 RNA, herein designated VGAM RNA, also designated SEQ ID:5065.

Another function of VGAM2354 is therefore inhibition of TBLR1 (Accession NM_024665). Accordingly, utilities of VGAM2354 include diagnosis, prevention and treatment of diseases and clinical conditions associated with TBLR1. Transducer of ERBB2, 2 (TOB2, Accession XM_170995) is another VGAM2354 host target gene. TOB2 BINDING SITE is HOST TARGET binding site found in the 3' untranslated region of mRNA encoded by TOB2, corresponding to a HOST TARGET binding site such as BINDING SITE I, BINDING SITE II or BINDING SITE III. Table 2 illustrates the complementarity of the nucleotide sequences of TOB2 BINDING SITE, designated SEQ ID:45761, to the nucleotide sequence of VGAM2354 RNA, herein designated VGAM RNA, also designated SEQ ID:5065.

Another function of VGAM2354 is therefore inhibition of Transducer of ERBB2, 2 (TOB2, Accession XM_170995). Accordingly, utilities of VGAM2354 include diagnosis, prevention and treatment of diseases and clinical conditions associated with TOB2. Tumor Protein P53 Inducible Nuclear Protein 1 (TP53INP1, Accession XM_053740) is another VGAM2354 host target gene. TP53INP1 BINDING SITE1 and TP53INP1 BINDING SITE2 are HOST TARGET binding sites found in untranslated regions of mRNA encoded by TP53INP1, corresponding to HOST TARGET binding sites such as BINDING SITE I, BINDING SITE II or BINDING SITE III. Table 2 illustrates the complementarity of the nucleotide sequences of TP53INP1 BINDING SITE1 and TP53INP1 BINDING SITE2, designated SEQ ID:36115 and SEQ ID:27104 respectively, to the nucleotide sequence of VGAM2354 RNA, herein designated VGAM RNA, also designated SEQ ID:5065.

Another function of VGAM2354 is therefore inhibition of Tumor Protein P53 Inducible Nuclear Protein 1 (TP53INP1, Accession XM_053740). Accordingly, utilities of VGAM2354 include diagnosis, prevention and treatment of diseases and clinical conditions associated with TP53INP1. LOC115110 (Accession XM_049825) is another VGAM2354 host target gene. LOC115110 BINDING SITE is HOST TARGET binding site found in the 3' untranslated region of mRNA encoded by LOC115110, corresponding to a HOST TARGET binding site such as BINDING SITE I, BINDING SITE II or BINDING SITE III. Table 2 illustrates the complementarity of the nucleotide sequences of LOC115110 BINDING SITE, designated SEQ ID:35504, to the nucleotide sequence of VGAM2354 RNA, herein designated VGAM RNA, also designated SEQ ID:5065.

Another function of VGAM2354 is therefore inhibition of LOC115110 (Accession XM_049825). Accordingly, utilities of VGAM2354 include diagnosis, prevention and treatment of diseases and clinical conditions associated with LOC115110. LOC126669 (Accession XM_060121) is another VGAM2354 host target gene. LOC126669 BINDING SITE is HOST TARGET binding site found in the 3' untranslated region of mRNA encoded by LOC126669, corresponding to a HOST TARGET binding site such as BINDING SITE I, BINDING SITE II or BINDING SITE III. Table 2 illustrates the complementarity of the nucleotide sequences of LOC126669 BINDING SITE, designated SEQ ID:37155, to the nucleotide sequence of VGAM2354 RNA, herein designated VGAM RNA, also designated SEQ ID:5065.

Another function of VGAM2354 is therefore inhibition of LOC126669 (Accession XM_060121). Accordingly, utilities of VGAM2354 include diagnosis, prevention and treatment of diseases and clinical conditions associated with LOC126669. LOC127396 (Accession XM_059139) is another VGAM2354 host target gene. LOC127396 BINDING SITE is HOST TARGET binding site found in the 3' untranslated region of mRNA encoded by LOC127396, corresponding to a HOST TARGET binding site such as BINDING SITE I, BINDING SITE II or BINDING SITE III. Table 2 illustrates the complementarity of the nucleotide sequences of LOC127396 BINDING SITE, designated SEQ ID:36895, to the nucleotide sequence of VGAM2354 RNA, herein designated VGAM RNA, also designated SEQ ID:5065.

Another function of VGAM2354 is therefore inhibition of LOC127396 (Accession XM_059139). Accordingly, utilities of VGAM2354 include diagnosis, prevention and treatment of diseases and clinical conditions associated with LOC127396. LOC147671 (Accession XM_085844) is another VGAM2354 host target gene. LOC147671 BINDING SITE is HOST TARGET binding site found in the 3' untranslated region of mRNA encoded by LOC147671, corresponding to a HOST TARGET binding site such as BINDING SITE I, BINDING SITE II or BINDING SITE III. Table 2 illustrates the complementarity of the nucleotide sequences of LOC147671 BINDING SITE, designated SEQ ID:38375, to the nucleotide sequence of VGAM2354 RNA, herein designated VGAM RNA, also designated SEQ ID:5065.

Another function of VGAM2354 is therefore inhibition of LOC147671 (Accession XM_085844). Accordingly, utilities of VGAM2354 include diagnosis, prevention and treatment of diseases and clinical conditions associated with LOC147671. LOC150185 (Accession XM_097834) is another VGAM2354 host target gene. LOC150185 BINDING SITE is HOST TARGET binding site found in the 3' untranslated region of mRNA encoded by LOC150185, corresponding to a HOST TARGET binding site such as BINDING SITE I, BINDING SITE II or BINDING SITE III. Table 2 illustrates the complementarity of the nucleotide sequences of LOC150185 BINDING SITE, designated SEQ ID:41151, to the nucleotide sequence of VGAM2354 RNA, herein designated VGAM RNA, also designated SEQ ID:5065.

Another function of VGAM2354 is therefore inhibition of LOC150185 (Accession XM_097834). Accordingly, utilities of VGAM2354 include diagnosis, prevention and treatment of diseases and clinical conditions associated with LOC150185. LOC154739 (Accession XM_098602) is another VGAM2354 host target gene. LOC154739 BINDING SITE is HOST TARGET binding site found in the 5' untranslated region of mRNA encoded by LOC154739, corresponding to a HOST TARGET binding site such as BINDING SITE I, BINDING SITE II or BINDING SITE III. Table 2 illustrates the complementarity of the nucleotide sequences of LOC154739 BINDING SITE, designated SEQ ID:41712, to the nucleotide sequence of VGAM2354 RNA, herein designated VGAM RNA, also designated SEQ ID:5065.

Another function of VGAM2354 is therefore inhibition of LOC154739 (Accession XM_098602). Accordingly, utilities of VGAM2354 include diagnosis, prevention and treatment of diseases and clinical conditions associated with LOC154739. LOC160717 (Accession XM_090457) is another VGAM2354 host target gene. LOC160717 BIND- ING SITE is HOST TARGET binding site found in the 5' untranslated region of mRNA encoded by LOC160717, corresponding to a HOST TARGET binding site such as BINDING SITE I, BINDING SITE II or BINDING SITE III. Table 2 illustrates the complementarity of the nucleotide sequences of LOC160717 BINDING SITE, designated SEQ ID:40009, to the nucleotide sequence of VGAM2354 RNA, herein designated VGAM RNA, also designated SEQ ID:5065.

Another function of VGAM2354 is therefore inhibition of LOC160717 (Accession XM_090457). Accordingly, utilities of VGAM2354 include diagnosis, prevention and treatment of diseases and clinical conditions associated with LOC160717. LOC169426 (Accession XM_108739) is another VGAM2354 host target gene. LOC169426 BINDING SITE is HOST TARGET binding site found in the 5' untranslated region of mRNA encoded by LOC169426, corresponding to a HOST TARGET binding site such as BINDING SITE I, BINDING SITE II or BINDING SITE III. Table 2 illustrates the complementarity of the nucleotide sequences of LOC169426 BINDING SITE, designated SEQ ID:42206, to the nucleotide sequence of VGAM2354 RNA, herein designated VGAM RNA, also designated SEQ ID:5065.

Another function of VGAM2354 is therefore inhibition of LOC169426 (Accession XM_108739). Accordingly, utilities of VGAM2354 include diagnosis, prevention and treatment of diseases and clinical conditions associated with LOC169426. LOC200150 (Accession XM_114131) is another VGAM2354 host target gene. LOC200150 BINDING SITE is HOST TARGET binding site found in the 3' untranslated region of mRNA encoded by LOC200150, corresponding to a HOST TARGET binding site such as BINDING SITE I, BINDING SITE II or BINDING SITE III. Table 2 illustrates the complementarity of the nucleotide sequences of LOC200150 BINDING SITE, designated SEQ ID:42712, to the nucleotide sequence of VGAM2354 RNA, herein designated VGAM RNA, also designated SEQ ID:5065.

Another function of VGAM2354 is therefore inhibition of LOC200150 (Accession XM_114131). Accordingly, utilities of VGAM2354 include diagnosis, prevention and treatment of diseases and clinical conditions associated with LOC200150. LOC219731 (Accession XM_167596) is another VGAM2354 host target gene. LOC219731 BINDING SITE is HOST TARGET binding site found in the 5' untranslated region of mRNA encoded by LOC219731, corresponding to a HOST TARGET binding site such as BINDING SITE I, BINDING SITE II or BINDING SITE III. Table 2 illustrates the complementarity of the nucleotide sequences of LOC219731 BINDING SITE, designated SEQ ID:44715, to the nucleotide sequence of VGAM2354 RNA, herein designated VGAM RNA, also designated SEQ ID:5065.

Another function of VGAM2354 is therefore inhibition of LOC219731 (Accession XM_167596). Accordingly, utilities of VGAM2354 include diagnosis, prevention and treatment of diseases and clinical conditions associated with LOC219731. LOC221069 (Accession XM_167676) is another VGAM2354 host target gene. LOC221069 BINDING SITE is HOST TARGET binding site found in the 5' untranslated region of mRNA encoded by LOC221069, corresponding to a HOST TARGET binding site such as BINDING SITE I, BINDING SITE II or BINDING SITE III. Table 2 illustrates the complementarity of the nucleotide sequences of LOC221069 BINDING SITE, designated SEQ ID:44767, to the nucleotide sequence of VGAM2354 RNA, herein designated VGAM RNA, also designated SEQ ID:5065.

Another function of VGAM2354 is therefore inhibition of LOC221069 (Accession XM_167676). Accordingly, utilities of VGAM2354 include diagnosis, prevention and treatment of diseases and clinical conditions associated with LOC221069. LOC221294 (Accession XM_166297) is another VGAM2354 host target gene. LOC221294 BINDING SITE is HOST TARGET binding site found in the 5' untranslated region of mRNA encoded by LOC221294, corresponding to a HOST TARGET binding site such as BINDING SITE I, BINDING SITE II or BINDING SITE III. Table 2 illustrates the complementarity of the nucleotide sequences of LOC221294 BINDING SITE, designated SEQ ID:44112, to the nucleotide sequence of VGAM2354 RNA, herein designated VGAM RNA, also designated SEQ ID:5065.

Another function of VGAM2354 is therefore inhibition of LOC221294 (Accession XM_166297). Accordingly, utilities of VGAM2354 include diagnosis, prevention and treatment of diseases and clinical conditions associated with LOC221294. LOC221550 (Accession XM_166388) is another VGAM2354 host target gene. LOC221550 BINDING SITE is HOST TARGET binding site found in the 5' untranslated region of mRNA encoded by LOC221550, corresponding to a HOST TARGET binding site such as BINDING SITE I, BINDING SITE II or BINDING SITE III. Table 2 illustrates the complementarity of the nucleotide sequences of LOC221550 BINDING SITE, designated SEQ ID:44238, to the nucleotide sequence of VGAM2354 RNA, herein designated VGAM RNA, also designated SEQ ID:5065.

Another function of VGAM2354 is therefore inhibition of LOC221550 (Accession XM_166388). Accordingly, utilities of VGAM2354 include diagnosis, prevention and treatment of diseases and clinical conditions associated with LOC221550. LOC222008 (Accession XM_168361) is another VGAM2354 host target gene. LOC222008 BINDING SITE is HOST TARGET binding site found in the 3' untranslated region of mRNA encoded by LOC222008, corresponding to a HOST TARGET binding site such as BINDING SITE I, BINDING SITE II or BINDING SITE III. Table 2 illustrates the complementarity of the nucleotide sequences of LOC222008 BINDING SITE, designated SEQ ID:45125, to the nucleotide sequence of VGAM2354 RNA, herein designated VGAM RNA, also designated SEQ ID:5065.

Another function of VGAM2354 is therefore inhibition of LOC222008 (Accession XM_168361). Accordingly, utilities of VGAM2354 include diagnosis, prevention and treatment of diseases and clinical conditions associated with LOC222008. LOC222256 (Accession XM_168571) is another VGAM2354 host target gene. LOC222256 BINDING SITE is HOST TARGET binding site found in the 3' untranslated region of mRNA encoded by LOC222256, corresponding to a HOST TARGET binding site such as BINDING SITE I, BINDING SITE II or BINDING SITE III. Table 2 illustrates the complementarity of the nucleotide sequences of LOC222256 BINDING SITE, designated SEQ ID:45247, to the nucleotide sequence of VGAM2354 RNA, herein designated VGAM RNA, also designated SEQ ID:5065.

Another function of VGAM2354 is therefore inhibition of LOC222256 (Accession XM_168571). Accordingly, utilities of VGAM2354 include diagnosis, prevention and treatment of diseases and clinical conditions associated with LOC222256. LOC253263 (Accession XM_173102) is another VGAM2354 host target gene. LOC253263 BINDING SITE is HOST TARGET binding site found in the 3' untranslated region of mRNA encoded by LOC253263, corresponding to a HOST TARGET binding site such as BINDING SITE I, BINDING SITE II or BINDING SITE III. Table 2 illustrates the complementarity of the nucleotide sequences of LOC253263 BINDING SITE, designated SEQ ID:46359, to the nucleotide sequence of VGAM2354 RNA, herein designated VGAM RNA, also designated SEQ ID:5065.

Another function of VGAM2354 is therefore inhibition of LOC253263 (Accession XM_173102). Accordingly, utilities of VGAM2354 include diagnosis, prevention and treatment of diseases and clinical conditions associated with LOC253263. LOC256021 (Accession XM_172884) is another VGAM2354 host target gene. LOC256021 BINDING SITE is HOST TARGET binding site found in the 3' untranslated region of mRNA encoded by LOC256021, corresponding to a HOST TARGET binding site such as BINDING SITE I, BINDING SITE II or BINDING SITE III. Table 2 illustrates the complementarity of the nucleotide sequences of LOC256021 BINDING SITE, designated SEQ ID:46163, to the nucleotide sequence of VGAM2354 RNA, herein designated VGAM RNA, also designated SEQ ID:5065.

Another function of VGAM2354 is therefore inhibition of LOC256021 (Accession XM_172884). Accordingly, utilities of VGAM2354 include diagnosis, prevention and treatment of diseases and clinical conditions associated with LOC256021. LOC256118 (Accession XM_174624) is another VGAM2354 host target gene. LOC256118 BINDING SITE is HOST TARGET binding site found in the 5' untranslated region of mRNA encoded by LOC256118, corresponding to a HOST TARGET binding site such as BINDING SITE I, BINDING SITE II or BINDING SITE III. Table 2 illustrates the complementarity of the nucleotide sequences of LOC256118 BINDING SITE, designated SEQ ID:46601, to the nucleotide sequence of VGAM2354 RNA, herein designated VGAM RNA, also designated SEQ ID:5065.

Another function of VGAM2354 is therefore inhibition of LOC256118 (Accession XM_174624). Accordingly, utilities of VGAM2354 include diagnosis, prevention and treatment of diseases and clinical conditions associated with LOC256118. LOC257495 (Accession XM_175166) is another VGAM2354 host target gene. LOC257495 BINDING SITE is HOST TARGET binding site found in the 5' untranslated region of mRNA encoded by LOC257495, corresponding to a HOST TARGET binding site such as BINDING SITE I, BINDING SITE II or BINDING SITE III. Table 2 illustrates the complementarity of the nucleotide sequences of LOC257495 BINDING SITE, designated SEQ ID:46655, to the nucleotide sequence of VGAM2354 RNA, herein designated VGAM RNA, also designated SEQ ID:5065.

Another function of VGAM2354 is therefore inhibition of LOC257495 (Accession XM_175166). Accordingly, utilities of VGAM2354 include diagnosis, prevention and treatment of diseases and clinical conditions associated with LOC257495. LOC257576 (Accession XM_175254) is another VGAM2354 host target gene. LOC257576 BINDING SITE is HOST TARGET binding site found in the 5' untranslated region of mRNA encoded by LOC257576, corresponding to a HOST TARGET binding site such as BINDING SITE I, BINDING SITE II or BINDING SITE III. Table 2 illustrates the complementarity of the nucleotide sequences of LOC257576 BINDING SITE, designated SEQ ID:46715, to the nucleotide sequence of VGAM2354 RNA, herein designated VGAM RNA, also designated SEQ ID:5065.

Another function of VGAM2354 is therefore inhibition of LOC257576 (Accession XM_175254). Accordingly, utilities of VGAM2354 include diagnosis, prevention and treatment of diseases and clinical conditions associated with LOC257576. LOC92078 (Accession XM_042684) is another VGAM2354 host target gene. LOC92078 BINDING SITE is HOST TARGET binding site found in the 3' untranslated region of mRNA encoded by LOC92078, corresponding to a HOST TARGET binding site such as BINDING SITE I, BINDING SITE II or BINDING SITE III. Table 2 illustrates the complementarity of the nucleotide sequences of LOC92078 BINDING SITE, designated SEQ ID:33740, to the nucleotide sequence of VGAM2354 RNA, herein designated VGAM RNA, also designated SEQ ID:5065.

Another function of VGAM2354 is therefore inhibition of LOC92078 (Accession XM_042684). Accordingly, utilities of VGAM2354 include diagnosis, prevention and treatment of diseases and clinical conditions associated with LOC92078. LOC92303 (Accession XM_044108) is another VGAM2354 host target gene. LOC92303 BINDING SITE is HOST TARGET binding site found in the 3' untranslated region of mRNA encoded by LOC92303, corresponding to a HOST TARGET binding site such as BINDING SITE I, BINDING SITE II or BINDING SITE III. Table 2 illustrates the complementarity of the nucleotide sequences of LOC92303 BINDING SITE, designated SEQ ID:34133, to the nucleotide sequence of VGAM2354 RNA, herein designated VGAM RNA, also designated SEQ ID:5065.

Another function of VGAM2354 is therefore inhibition of LOC92303 (Accession XM_044108). Accordingly, utilities of VGAM2354 include diagnosis, prevention and treatment of diseases and clinical conditions associated with LOC92303. FIG. 1 further provides a conceptual description of a novel bioinformatically detected viral gene of the present invention, referred to here as Viral Genomic Address Messenger 2355 (VGAM2355) viral gene, which modulates expression of respective host target genes thereof, the function and utility of which host target genes is known in the art.

VGAM2355 is a novel bioinformatically detected regulatory, non protein coding, viral micro RNA (miRNA) gene. The method by which VGAM2355 was detected is described hereinabove with reference to FIGS. 1-8.

VGAM2355 gene, herein designated VGAM GENE, is a viral gene contained in the genome of Equine Herpesvirus 2. VGAM2355 host target gene, herein designated VGAM HOST TARGET GENE, is a human gene contained in the human genome.

VGAM2355 gene encodes a VGAM2355 precursor RNA, herein designated VGAM PRECURSOR RNA. Similar to other miRNA genes, and unlike most ordinary genes, VGAM2355 precursor RNA does not encode a protein. A nucleotide sequence identical or highly similar to the nucleotide sequence of VGAM2355 precursor RNA is designated SEQ ID:2341, and is provided hereinbelow with reference to the sequence listing part. Nucleotide sequence SEQ ID:2341 is located at position 39033 relative to the genome of Equine Herpesvirus 2.

VGAM2355 precursor RNA folds onto itself, forming VGAM2355 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2355 folded precursor RNA into VGAM2355 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 41%) nucleotide sequence of VGAM2355 RNA is designated SEQ ID:5066, and is provided hereinbelow with reference to the sequence listing part.

VGAM2355 host target gene, herein designated VGAM HOST TARGET GENE, encodes a corresponding messenger RNA, VGAM2355 host target RNA, herein designated VGAM HOST TARGET RNA. VGAM2355 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2355 RNA, herein designated VGAM RNA, binds complementarily to one or more host target binding sites located in untranslated regions of VGAM2355 host target RNA, herein designated VGAM HOST TARGET RNA. This complementary binding is due to the fact that the nucleotide sequence of VGAM2355 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2355 RNA, herein designated VGAM RNA, may have a different number of host target binding sites in untranslated regions of a VGAM2355 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2355 RNA, herein designated VGAM RNA, to host target binding sites on VGAM2355 host target RNA, herein designated VGAM HOST TARGET RNA, such as BINDING SITE I, BINDING SITE II and BINDING SITE III, inhibits translation of VGAM2355 host target RNA into VGAM2355 host target protein, herein designated VGAM HOST TARGET PROTEIN. VGAM host target protein is therefore outlined by a broken line.

It is appreciated that VGAM2355 host target gene, herein designated VGAM HOST TARGET GENE, in fact represents a plurality of VGAM2355 host target genes. The mRNA of each one of this plurality of VGAM2355 host target genes comprises one or more host target binding sites, each having a nucleotide sequence which is at least partly complementary to VGAM2355 RNA, herein designated VGAM RNA, and which when bound by VGAM2355 RNA causes inhibition of translation of respective one or more VGAM2355 host target proteins.

It is further appreciated by one skilled in the art that the mode of translational inhibition illustrated by FIG. 1 with specific reference to translational inhibition exerted by VGAM2355 gene, herein designated VGAM GENE, on one or more VGAM2355 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2355 is inhibition of expression of host target genes, as part of a novel viral mechanism of attacking a host. Accordingly, utilities of VGAM2355 include diagnosis, prevention and treatment of viral infection by Equine Herpesvirus 2. Specific functions, and accordingly utilities, of VGAM2355 correlate with, and may be deduced from, the identity of the host target genes which VGAM2355 binds and inhibits, and the function of these host target genes, as elaborated hereinbelow.

Nucleotide sequences of the VGAM2355 precursor RNA, herein designated VGAM PRECURSOR RNA, and of the 'diced' VGAM2355 RNA, herein designated VGAM RNA, and a schematic representation of the secondary folding of VGAM2355 folded precursor RNA, herein designated VGAM FOLDED PRECURSOR RNA, of VGAM2355 are further described hereinbelow with reference to Table 1.

Nucleotide sequences of host target binding sites, such as BINDING SITE-I, BINDING SITE-II and BINDING SITE-III of FIG. 1, found on VGAM2355 host target RNA, and schematic representation of the complementarity of each of these host target binding sites to VGAM2355 RNA, herein designated VGAM RNA, are described hereinbelow with reference to Table 2.

As mentioned hereinabove with reference to FIG. 1, a function of VGAM2355 gene, herein designated VGAM is inhibition of expression of VGAM2355 target genes. It is appreciated that specific functions, and accordingly utilities, of VGAM2355 correlate with, and may be deduced from, the identity of the target genes which VGAM2355 binds and inhibits, and the function of these target genes, as elaborated hereinbelow.

Bromodomain Adjacent to Zinc Finger Domain, 2B (BAZ2B, Accession NM_013450) is a VGAM2355 host target gene. BAZ2B BINDING SITE is HOST TARGET binding site found in the 3' untranslated region of mRNA encoded by BAZ2B, corresponding to a HOST TARGET binding site such as BINDING SITE I, BINDING SITE II or BINDING SITE III. Table 2 illustrates the complementarity of the nucleotide sequences of BAZ2B BINDING SITE, designated SEQ ID:15124, to the nucleotide sequence of VGAM2355 RNA, herein designated VGAM RNA, also designated SEQ ID:5066.

A function of VGAM2355 is therefore inhibition of Bromodomain Adjacent to Zinc Finger Domain, 2B (BAZ2B, Accession NM_013450). Accordingly, utilities of VGAM2355 include diagnosis, prevention and treatment of diseases and clinical conditions associated with BAZ2B. G Protein-coupled Receptor 85 (GPR85, Accession NM_018970) is another VGAM2355 host target gene. GPR85 BINDING SITE is HOST TARGET binding site found in the 3' untranslated region of mRNA encoded by GPR85, corresponding to a HOST TARGET binding site such as BINDING SITE I, BINDING SITE II or BINDING SITE III. Table 2 illustrates the complementarity of the nucleotide sequences of GPR85 BINDING SITE, designated SEQ ID:21042, to the nucleotide sequence of VGAM2355 RNA, herein designated VGAM RNA, also designated SEQ ID:5066.

Another function of VGAM2355 is therefore inhibition of G Protein-coupled Receptor 85 (GPR85, Accession NM_018970). Accordingly, utilities of VGAM2355 include diagnosis, prevention and treatment of diseases and clinical conditions associated with GPR85. Neurotrophic Tyrosine Kinase, Receptor, Type 2 (NTRK2, Accession NM_006180) is another VGAM2355 host target gene. NTRK2 BINDING SITE is HOST TARGET binding site found in the 3' untranslated region of mRNA encoded by NTRK2, corresponding to a HOST TARGET binding site such as BINDING SITE I, BINDING SITE II or BINDING SITE III. Table 2 illustrates the complementarity of the nucleotide sequences of NTRK2

BINDING SITE, designated SEQ ID:12845, to the nucleotide sequence of VGAM2355 RNA, herein designated VGAM RNA, also designated SEQ ID:5066.

Another function of VGAM2355 is therefore inhibition of Neurotrophic Tyrosine Kinase, Receptor, Type 2 (NTRK2, Accession NM_006180), a gene which is involved in the development and/or maintenance of the nervous system. Accordingly, utilities of VGAM2355 include diagnosis, prevention and treatment of diseases and clinical conditions associated with NTRK2. The function of NTRK2 and its association with various diseases and clinical conditions, has been established by previous studies, as described hereinabove with reference to VGAM341. Ubiquitin-conjugating Enzyme E2L 3 (UBE2L3, Accession NM_003347) is another VGAM2355 host target gene. UBE2L3 BINDING SITE is HOST TARGET binding site found in the 3' untranslated region of mRNA encoded by UBE2L3, corresponding to a HOST TARGET binding site such as BINDING SITE I, BINDING SITE II or BINDING SITE III. Table 2 illustrates the complementarity of the nucleotide sequences of UBE2L3 BINDING SITE, designated SEQ ID:9360, to the nucleotide sequence of VGAM2355 RNA, herein designated VGAM RNA, also designated SEQ ID:5066.

Another function of VGAM2355 is therefore inhibition of Ubiquitin-conjugating Enzyme E2L 3 (UBE2L3, Accession NM_003347), a gene which catalyzes the covalent attachment of ubiquitin to other proteins. Accordingly, utilities of VGAM2355 include diagnosis, prevention and treatment of diseases and clinical conditions associated with UBE2L3. The function of UBE2L3 and its association with various diseases and clinical conditions, has been established by previous studies, as described hereinabove with reference to VGAM215. DKFZP761G1913 (Accession NM_031474) is another VGAM2355 host target gene. DKFZP761G1913 BINDING SITE is HOST TARGET binding site found in the 3' untranslated region of mRNA encoded by DKFZP761G1913, corresponding to a HOST TARGET binding site such as BINDING SITE I, BINDING SITE II or BINDING SITE III. Table 2 illustrates the complementarity of the nucleotide sequences of DKFZP761G1913 BINDING SITE, designated SEQ ID:25545, to the nucleotide sequence of VGAM2355 RNA, herein designated VGAM RNA, also designated SEQ ID:5066.

Another function of VGAM2355 is therefore inhibition of DKFZP761G1913 (Accession NM_031474). Accordingly, utilities of VGAM2355 include diagnosis, prevention and treatment of diseases and clinical conditions associated with DKFZP761G1913. Eukaryotic Translation Initiation Factor 5 (EIF5, Accession NM_001969) is another VGAM2355 host target gene. EIF5 BINDING SITE is HOST TARGET binding site found in the 3' untranslated region of mRNA encoded by EIF5, corresponding to a HOST TARGET binding site such as BINDING SITE I, BINDING SITE II or BINDING SITE III. Table 2 illustrates the complementarity of the nucleotide sequences of EIF5 BINDING SITE, designated SEQ ID:7698, to the nucleotide sequence of VGAM2355 RNA, herein designated VGAM RNA, also designated SEQ ID:5066.

Another function of VGAM2355 is therefore inhibition of Eukaryotic Translation Initiation Factor 5 (EIF5, Accession NM_001969). Accordingly, utilities of VGAM2355 include diagnosis, prevention and treatment of diseases and clinical conditions associated with EIF5. FLJ12586 (Accession NM_024620) is another VGAM2355 host target gene. FLJ12586 BINDING SITE is HOST TARGET binding site found in the 3' untranslated region of mRNA encoded by FLJ12586, corresponding to a HOST TARGET binding site such as BINDING SITE I, BINDING SITE II or BINDING SITE III. Table 2 illustrates the complementarity of the nucleotide sequences of FLJ12586 BINDING SITE, designated SEQ ID:23881, to the nucleotide sequence of VGAM2355 RNA, herein designated VGAM RNA, also designated SEQ ID:5066.

Another function of VGAM2355 is therefore inhibition of FLJ12586 (Accession NM_024620). Accordingly, utilities of VGAM2355 include diagnosis, prevention and treatment of diseases and clinical conditions associated with FLJ12586. FLJ14494 (Accession XM_165571) is another VGAM2355 host target gene. FLJ14494 BINDING SITE is HOST TARGET binding site found in the 3' untranslated region of mRNA encoded by FLJ14494, corresponding to a HOST TARGET binding site such as BINDING SITE I, BINDING SITE II or BINDING SITE III. Table 2 illustrates the complementarity of the nucleotide sequences of FLJ14494 BINDING SITE, designated SEQ ID:43693, to the nucleotide sequence of VGAM2355 RNA, herein designated VGAM RNA, also designated SEQ ID:5066.

Another function of VGAM2355 is therefore inhibition of FLJ14494 (Accession XM_165571). Accordingly, utilities of VGAM2355 include diagnosis, prevention and treatment of diseases and clinical conditions associated with FLJ14494. HSPC031 (Accession NM_016101) is another VGAM2355 host target gene. HSPC031 BINDING SITE is HOST TARGET binding site found in the 3' untranslated region of mRNA encoded by HSPC031, corresponding to a HOST TARGET binding site such as BINDING SITE I, BINDING SITE II or BINDING SITE III. Table 2 illustrates the complementarity of the nucleotide sequences of HSPC031 BINDING SITE, designated SEQ ID:18184, to the nucleotide sequence of VGAM2355 RNA, herein designated VGAM RNA, also designated SEQ ID:5066.

Another function of VGAM2355 is therefore inhibition of HSPC031 (Accession NM_016101). Accordingly, utilities of VGAM2355 include diagnosis, prevention and treatment of diseases and clinical conditions associated with HSPC031. KIAA1423 (Accession XM_029703) is another VGAM2355 host target gene. KIAA1423 BINDING SITE is HOST TARGET binding site found in the 3' untranslated region of mRNA encoded by KIAA1423, corresponding to a HOST TARGET binding site such as BINDING SITE I, BINDING SITE II or BINDING SITE III. Table 2 illustrates the complementarity of the nucleotide sequences of KIAA1423 BINDING SITE, designated SEQ ID:30919, to the nucleotide sequence of VGAM2355 RNA, herein designated VGAM RNA, also designated SEQ ID:5066.

Another function of VGAM2355 is therefore inhibition of KIAA1423 (Accession XM_029703). Accordingly, utilities of VGAM2355 include diagnosis, prevention and treatment of diseases and clinical conditions associated with KIAA1423. P21 (CDKN1A)-activated Kinase 2 (PAK2, Accession XM_039354) is another VGAM2355 host target gene. PAK2 BINDING SITE is HOST TARGET binding site found in the 5' untranslated region of mRNA encoded by PAK2, corresponding to a HOST TARGET binding site such as BINDING SITE I, BINDING SITE II or BINDING SITE III. Table 2 illustrates the complementarity of the nucleotide sequences of PAK2 BINDING SITE, designated SEQ ID:33062, to the nucleotide sequence of VGAM2355 RNA, herein designated VGAM RNA, also designated SEQ ID:5066.

Another function of VGAM2355 is therefore inhibition of P21 (CDKN1A)-activated Kinase 2 (PAK2, Accession XM_039354). Accordingly, utilities of VGAM2355 include diagnosis, prevention and treatment of diseases and clinical conditions associated with PAK2. Phosphatidylinositol-4-phosphate 5-kinase, Type II, Beta (PIP5K2B, Accession NM_003559) is another VGAM2355 host target gene. PIP5K2B BINDING SITE is HOST TARGET binding site found in the 3' untranslated region of mRNA encoded by PIP5K2B, corresponding to a HOST TARGET binding site such as BINDING SITE I, BINDING SITE II or BINDING SITE III. Table 2 illustrates the complementarity of the nucleotide sequences of PIP5K2B BINDING SITE, designated SEQ ID:9606, to the nucleotide sequence of VGAM2355 RNA, herein designated VGAM RNA, also designated SEQ ID:5066.

Another function of VGAM2355 is therefore inhibition of Phosphatidylinositol-4-phosphate 5-kinase, Type II, Beta (PIP5K2B, Accession NM_003559). Accordingly, utilities of VGAM2355 include diagnosis, prevention and treatment of diseases and clinical conditions associated with PIP5K2B. LOC134265 (Accession XM_059702) is another VGAM2355 host target gene. LOC134265 BINDING SITE is HOST TARGET binding site found in the 3' untranslated region of mRNA encoded by LOC134265, corresponding to a HOST TARGET binding site such as BINDING SITE I, BINDING SITE II or BINDING SITE III. Table 2 illustrates the complementarity of the nucleotide sequences of LOC134265 BINDING SITE, designated SEQ ID:37075, to the nucleotide sequence of VGAM2355 RNA, herein designated VGAM RNA, also designated SEQ ID:5066.

Another function of VGAM2355 is therefore inhibition of LOC134265 (Accession XM_059702). Accordingly, utilities of VGAM2355 include diagnosis, prevention and treatment of diseases and clinical conditions associated with LOC134265. LOC144438 (Accession XM_084860) is another VGAM2355 host target gene. LOC144438 BINDING SITE is HOST TARGET binding site found in the 3' untranslated region of mRNA encoded by LOC144438, corresponding to a HOST TARGET binding site such as BINDING SITE I, BINDING SITE II or BINDING SITE III. Table 2 illustrates the complementarity of the nucleotide sequences of LOC144438 BINDING SITE, designated SEQ ID:37740, to the nucleotide sequence of VGAM2355 RNA, herein designated VGAM RNA, also designated SEQ ID:5066.

Another function of VGAM2355 is therefore inhibition of LOC144438 (Accession XM_084860). Accordingly, utilities of VGAM2355 include diagnosis, prevention and treatment of diseases and clinical conditions associated with LOC144438. LOC147071 (Accession XM_054031) is another VGAM2355 host target gene. LOC147071 BINDING SITE is HOST TARGET binding site found in the 5' untranslated region of mRNA encoded by LOC147071, corresponding to a HOST TARGET binding site such as BINDING SITE I, BINDING SITE II or BINDING SITE III. Table 2 illustrates the complementarity of the nucleotide sequences of LOC147071 BINDING SITE, designated SEQ ID:36133, to the nucleotide sequence of VGAM2355 RNA, herein designated VGAM RNA, also designated SEQ ID:5066.

Another function of VGAM2355 is therefore inhibition of LOC147071 (Accession XM_054031). Accordingly, utilities of VGAM2355 include diagnosis, prevention and treatment of diseases and clinical conditions associated with LOC147071. LOC201173 (Accession XM_113312) is another VGAM2355 host target gene. LOC201173 BINDING SITE is HOST TARGET binding site found in the 5' untranslated region of mRNA encoded by LOC201173, corresponding to a HOST TARGET binding site such as BINDING SITE I, BINDING SITE II or BINDING SITE III. Table 2 illustrates the complementarity of the nucleotide sequences of LOC201173 BINDING SITE, designated SEQ ID:42212, to the nucleotide sequence of VGAM2355 RNA, herein designated VGAM RNA, also designated SEQ ID:5066.

Another function of VGAM2355 is therefore inhibition of LOC201173 (Accession XM_113312). Accordingly, utilities of VGAM2355 include diagnosis, prevention and treatment of diseases and clinical conditions associated with LOC201173. LOC51706 (Accession XM_046746) is another VGAM2355 host target gene. LOC51706 BINDING SITE is HOST TARGET binding site found in the 3' untranslated region of mRNA encoded by LOC51706, corresponding to a HOST TARGET binding site such as BINDING SITE I, BINDING SITE II or BINDING SITE III. Table 2 illustrates the complementarity of the nucleotide sequences of LOC51706 BINDING SITE, designated SEQ ID:34816, to the nucleotide sequence of VGAM2355 RNA, herein designated VGAM RNA, also designated SEQ ID:5066.

Another function of VGAM2355 is therefore inhibition of LOC51706 (Accession XM_046746). Accordingly, utilities of VGAM2355 include diagnosis, prevention and treatment of diseases and clinical conditions associated with LOC51706. LOC91291 (Accession XM_037478) is another VGAM2355 host target gene. LOC91291 BINDING SITE is HOST TARGET binding site found in the 5' untranslated region of mRNA encoded by LOC91291, corresponding to a HOST TARGET binding site such as BINDING SITE I, BINDING SITE II or BINDING SITE III. Table 2 illustrates the complementarity of the nucleotide sequences of LOC91291 BINDING SITE, designated SEQ ID:32629, to the nucleotide sequence of VGAM2355 RNA, herein designated VGAM RNA, also designated SEQ ID:5066.

Another function of VGAM2355 is therefore inhibition of LOC91291 (Accession XM_037478). Accordingly, utilities of VGAM2355 include diagnosis, prevention and treatment of diseases and clinical conditions associated with LOC91291. FIG. 1 further provides a conceptual description of a novel bioinformatically detected viral gene of the present invention, referred to here as Viral Genomic Address Messenger 2356 (VGAM2356) viral gene, which modulates expression of respective host target genes thereof, the function and utility of which host target genes is known in the art.

VGAM2356 is a novel bioinformatically detected regulatory, non protein coding, viral micro RNA (miRNA) gene. The method by which VGAM2356 was detected is described hereinabove with reference to FIGS. 1-8.

VGAM2356 gene, herein designated VGAM GENE, is a viral gene contained in the genome of Equine Herpesvirus 2. VGAM2356 host target gene, herein designated VGAM HOST TARGET GENE, is a human gene contained in the human genome.

VGAM2356 gene encodes a VGAM2356 precursor RNA, herein designated VGAM PRECURSOR RNA. Similar to other miRNA genes, and unlike most ordinary genes, VGAM2356 precursor RNA does not encode a protein. A nucleotide sequence identical or highly similar to the nucleotide sequence of VGAM2356 precursor RNA is designated SEQ ID:2342, and is provided hereinbelow with reference to the sequence listing part. Nucleotide sequence SEQ ID:2342 is located at position 38873 relative to the genome of Equine Herpesvirus 2.

VGAM2356 precursor RNA folds onto itself, forming VGAM2356 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2356 folded precursor RNA into VGAM2356 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2356 RNA is designated SEQ ID:5067, and is provided hereinbelow with reference to the sequence listing part.

VGAM2356 host target gene, herein designated VGAM HOST TARGET GENE, encodes a corresponding messenger RNA, VGAM2356 host target RNA, herein designated VGAM HOST TARGET RNA. VGAM2356 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2356 RNA, herein designated VGAM RNA, binds complementarily to one or more host target binding sites located in untranslated regions of VGAM2356 host target RNA, herein designated VGAM HOST TARGET RNA. This complementary binding is due to the fact that the nucleotide sequence of VGAM2356 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2356 RNA, herein designated VGAM RNA, may have a different number of host target binding sites in untranslated regions of a VGAM2356 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2356 RNA, herein designated VGAM RNA, to host target binding sites on VGAM2356 host target RNA, herein designated VGAM HOST TARGET RNA, such as BINDING SITE I, BINDING SITE II and BINDING SITE III, inhibits translation of VGAM2356 host target RNA into VGAM2356 host target protein, herein designated VGAM HOST TARGET PROTEIN. VGAM host target protein is therefore outlined by a broken line.

It is appreciated that VGAM2356 host target gene, herein designated VGAM HOST TARGET GENE, in fact represents a plurality of VGAM2356 host target genes. The mRNA of each one of this plurality of VGAM2356 host target genes comprises one or more host target binding sites, each having a nucleotide sequence which is at least partly complementary to VGAM2356 RNA, herein designated VGAM RNA, and which when bound by VGAM2356 RNA causes inhibition of translation of respective one or more VGAM2356 host target proteins.

It is further appreciated by one skilled in the art that the mode of translational inhibition illustrated by FIG. 1 with specific reference to translational inhibition exerted by VGAM2356 gene, herein designated VGAM GENE, on one or more VGAM2356 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2356 is inhibition of expression of host target genes, as part of a novel viral mechanism of attacking a host. Accordingly, utilities of VGAM2356 include diagnosis, prevention and treatment of viral infection by Equine Herpesvirus 2. Specific functions, and accordingly utilities, of VGAM2356 correlate with, and may be deduced from, the identity of the host target genes which VGAM2356 binds and inhibits, and the function of these host target genes, as elaborated hereinbelow.

Nucleotide sequences of the VGAM2356 precursor RNA, herein designated VGAM PRECURSOR RNA, and of the 'diced' VGAM2356 RNA, herein designated VGAM RNA, and a schematic representation of the secondary folding of VGAM2356 folded precursor RNA, herein designated VGAM FOLDED PRECURSOR RNA, of VGAM2356 are further described hereinbelow with reference to Table 1.

Nucleotide sequences of host target binding sites, such as BINDING SITE-I, BINDING SITE-II and BINDING SITE-III of FIG. 1, found on VGAM2356 host target RNA, and schematic representation of the complementarity of each of these host target binding sites to VGAM2356 RNA, herein designated VGAM RNA, are described hereinbelow with reference to Table 2.

As mentioned hereinabove with reference to FIG. 1, a function of VGAM2356 gene, herein designated VGAM is inhibition of expression of VGAM2356 target genes. It is appreciated that specific functions, and accordingly utilities, of VGAM2356 correlate with, and may be deduced from, the identity of the target genes which VGAM2356 binds and inhibits, and the function of these target genes, as elaborated hereinbelow.

Dystrophin (muscular dystrophy, Duchenne and Becker types) (DMD, Accession NM_004013) is a VGAM2356 host target gene. DMD BINDING SITE1 through DMD BINDING SITE3 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 through DMD BINDING SITE3, designated SEQ ID:10196, SEQ ID:10223 and SEQ ID:10235 respectively, to the nucleotide sequence of VGAM2356 RNA, herein designated VGAM RNA, also designated SEQ ID:5067.

A function of VGAM2356 is therefore inhibition of Dystrophin (muscular dystrophy, Duchenne and Becker types) (DMD, Accession NM_004013), a gene which muscular dystrophy. Accordingly, utilities of VGAM2356 include diagnosis, prevention and treatment of diseases and clinical conditions associated with DMD. The function of DMD and its association with various diseases and clinical conditions, has been established by previous studies, as described hereinabove with reference to VGAM218. Glucokinase (hexokinase 4, maturity onset diabetes of the young 2) (GCK, Accession NM_033508) is another VGAM2356 host target gene. GCK BINDING SITE is HOST TARGET binding site found in the 5' untranslated region of mRNA encoded by GCK, corresponding to a HOST TARGET binding site such as BINDING SITE I, BINDING SITE II or BINDING SITE III. Table 2 illustrates the complementarity of the nucleotide sequences of GCK BINDING SITE, designated SEQ ID:27285, to the nucleotide sequence of VGAM2356 RNA, herein designated VGAM RNA, also designated SEQ ID:5067.

Another function of VGAM2356 is therefore inhibition of Glucokinase (hexokinase 4, maturity onset diabetes of the young 2) (GCK, Accession NM_033508), a gene which catalyzes the initial step in utilization of glucose by the beta-cell and liver at physiological glucose concentration. Accordingly, utilities of VGAM2356 include diagnosis, prevention and treatment of diseases and clinical conditions associated with GCK. The function of GCK and its association with various diseases and clinical conditions, has been established by previous studies, as described hereinabove with reference to VGAM1781. Holocarboxylase Synthetase (biotin-[proprionyl-Coenzyme A-carboxylase (ATP-hydrolysing)] Ligase) (HLCS, Accession NM_000411) is another VGAM2356 host target gene. HLCS BINDING SITE is HOST TARGET binding site found in the 3' untranslated region of mRNA encoded by HLCS, corresponding to a HOST TARGET binding site such as BINDING SITE I, BINDING SITE II or BINDING SITE III. Table 2 illustrates the complementarity of the nucleotide sequences of HLCS BINDING SITE, designated SEQ ID:5992, to the nucleotide sequence of VGAM2356 RNA, herein designated VGAM RNA, also designated SEQ ID:5067.

Another function of VGAM2356 is therefore inhibition of Holocarboxylase Synthetase (biotin-[proprionyl-Coenzyme A-carboxylase (ATP-hydrolysing)] Ligase) (HLCS, Accession NM_000411). Accordingly, utilities of VGAM2356 include diagnosis, prevention and treatment of diseases and clinical conditions associated with HLCS. Inositol Polyphosphate-5-phosphatase, 75 kDa (INPP5B, Accession XM_170949) is another VGAM2356 host target gene. INPP5B BINDING SITE is HOST TARGET binding site found in the 3' untranslated region of mRNA encoded by INPP5B, corresponding to a HOST TARGET binding site such as BINDING SITE I, BINDING SITE II or BINDING SITE III. Table 2 illustrates the complementarity of the nucleotide sequences of INPP5B BINDING SITE, designated SEQ ID:45736, to the nucleotide sequence of VGAM2356 RNA, herein designated VGAM RNA, also designated SEQ ID:5067.

Another function of VGAM2356 is therefore inhibition of Inositol Polyphosphate-5-phosphatase, 75 kDa (INPP5B, Accession XM_170949), a gene which hydrolyzes the calcium-mobilizing second messenger ins (1,4,5) p3. Accordingly, utilities of VGAM2356 include diagnosis, prevention and treatment of diseases and clinical conditions associated with INPP5B. The function of INPP5B and its association with various diseases and clinical conditions, has been established by previous studies, as described hereinabove with reference to VGAM50. Mitogen-activated Protein Kinase Kinase Kinase 7 Interacting Protein 1 (MAP3K7IP1, Accession NM_006116) is another VGAM2356 host target gene. MAP3K7IP1 BINDING SITE is HOST TARGET binding site found in the 3' untranslated region of mRNA encoded by MAP3K7IP1, corresponding to a HOST TARGET binding site such as BINDING SITE I, BINDING SITE II or BINDING SITE III. Table 2 illustrates the complementarity of the nucleotide sequences of MAP3K7IP1 BINDING SITE, designated SEQ ID:12761, to the nucleotide sequence of VGAM2356 RNA, herein designated VGAM RNA, also designated SEQ ID:5067.

Another function of VGAM2356 is therefore inhibition of Mitogen-activated Protein Kinase Kinase Kinase 7 Interacting Protein 1 (MAP3K7IP1, Accession NM_006116), a gene which may be an important signaling intermediate between tgfb receptors and map3k7/tak1. Accordingly, utilities of VGAM2356 include diagnosis, prevention and treatment of diseases and clinical conditions associated with MAP3K7IP1. The function of MAP3K7IP1 and its association with various diseases and clinical conditions, has been established by previous studies, as described hereinabove with reference to VGAM132. MCF.2 Cell Line Derived Transforming Sequence (MCF2, Accession NM_005369) is another VGAM2356 host target gene. MCF2 BINDING SITE is HOST TARGET binding site found in the 5' untranslated region of mRNA encoded by MCF2, corresponding to a HOST TARGET binding site such as BINDING SITE I, BINDING SITE II or BINDING SITE III. Table 2 illustrates the complementarity of the nucleotide sequences of MCF2 BINDING SITE, designated SEQ ID:11841, to the nucleotide sequence of VGAM2356 RNA, herein designated VGAM RNA, also designated SEQ ID:5067.

Another function of VGAM2356 is therefore inhibition of MCF.2 Cell Line Derived Transforming Sequence (MCF2, Accession NM_005369), a gene which Cytoplasmic oncoprotein similar to vimentin. Accordingly, utilities of VGAM2356 include diagnosis, prevention and treatment of diseases and clinical conditions associated with MCF2. The function of MCF2 and its association with various diseases and clinical conditions, has been established by previous studies, as described hereinabove with reference to VGAM763. Placental Growth Factor, Vascular Endothelial Growth Factor-related Protein (PGF, Accession NM_002632) is another VGAM2356 host target gene. PGF BINDING SITE is HOST TARGET binding site found in the 5' untranslated region of mRNA encoded by PGF, corresponding to a HOST TARGET binding site such as BINDING SITE I, BINDING SITE II or BINDING SITE III. Table 2 illustrates the complementarity of the nucleotide sequences of PGF BINDING SITE, designated SEQ ID:8492, to the nucleotide sequence of VGAM2356 RNA, herein designated VGAM RNA, also designated SEQ ID:5067.

Another function of VGAM2356 is therefore inhibition of Placental Growth Factor, Vascular Endothelial Growth Factor-related Protein (PGF, Accession NM_002632), a gene which is a growth factor active in angiogenesis, and endothelial cell growth, stimulating cell proliferation and migration. it binds to receptor vegfr-1/fl. Accordingly, utilities of VGAM2356 include diagnosis, prevention and treatment of diseases and clinical conditions associated with PGF. The function of PGF and its association with various diseases and clinical conditions, has been established by previous studies, as described hereinabove with reference to VGAM1420. DEAD/H (Asp-Glu-Ala-Asp/His) Box Polypeptide 17, 72 kDa (DDX17, Accession NM_006386) is another VGAM2356 host target gene. DDX17 BINDING SITE is HOST TARGET binding site found in the 5' untranslated region of mRNA encoded by DDX17, corresponding to a HOST TARGET binding site such as BINDING SITE I, BINDING SITE II or BINDING SITE III. Table 2 illustrates the complementarity of the nucleotide sequences of DDX17 BINDING SITE, designated SEQ ID:13090, to the nucleotide sequence of VGAM2356 RNA, herein designated VGAM RNA, also designated SEQ ID:5067.

Another function of VGAM2356 is therefore inhibition of DEAD/H (Asp-Glu-Ala-Asp/His) Box Polypeptide 17, 72 kDa (DDX17, Accession NM_006386). Accordingly, utilities of VGAM2356 include diagnosis, prevention and treatment of diseases and clinical conditions associated with DDX17. FLJ00024 (Accession XM_033361) is another VGAM2356 host target gene. FLJ00024 BINDING SITE is HOST TARGET binding site found in the 5' untranslated region of mRNA encoded by FLJ00024, corresponding to a HOST TARGET binding site such as BINDING SITE I, BINDING SITE II or BINDING SITE III. Table 2 illustrates the complementarity of the nucleotide sequences of FLJ00024 BINDING SITE, designated SEQ ID:31896, to the nucleotide sequence of VGAM2356 RNA, herein designated VGAM RNA, also designated SEQ ID:5067.

Another function of VGAM2356 is therefore inhibition of FLJ00024 (Accession XM_033361). Accordingly, utilities of VGAM2356 include diagnosis, prevention and treatment of diseases and clinical conditions associated with FLJ00024. FLJ14871 (Accession NM_032854) is another VGAM2356 host target gene. FLJ14871 BINDING SITE is HOST TARGET binding site found in the 5' untranslated region of mRNA encoded by FLJ14871, corresponding to a HOST TARGET binding site such as BINDING SITE I, BINDING SITE II or BINDING SITE III. Table 2 illustrates the complementarity of the nucleotide sequences of FLJ14871 BINDING SITE, designated SEQ ID:26652, to the nucleotide sequence of VGAM2356 RNA, herein designated VGAM RNA, also designated SEQ ID:5067.

Another function of VGAM2356 is therefore inhibition of FLJ14871 (Accession NM_032854). Accordingly, utilities of VGAM2356 include diagnosis, prevention and treatment of diseases and clinical conditions associated with FLJ14871. FLJ21687 (Accession NM_024859) is another VGAM2356 host target gene. FLJ21687 BINDING SITE is HOST TARGET binding site found in the 3' untranslated region of mRNA encoded by FLJ21687, corresponding to a HOST TARGET binding site such as BINDING SITE I, BINDING SITE II or BINDING SITE III. Table 2 illustrates the complementarity of the nucleotide sequences of FLJ21687 BINDING SITE, designated SEQ ID:24292, to the nucleotide sequence of VGAM2356 RNA, herein designated VGAM RNA, also designated SEQ ID:5067.

Another function of VGAM2356 is therefore inhibition of FLJ21687 (Accession NM_024859). Accordingly, utilities of VGAM2356 include diagnosis, prevention and treatment of diseases and clinical conditions associated with FLJ21687. KIAA1196 (Accession XM_028968) is another VGAM2356 host target gene. KIAA1196 BINDING SITE is HOST TARGET binding site found in the 3' untranslated region of mRNA encoded by KIAA1196, corresponding to a HOST TARGET binding site such as BINDING SITE I, BINDING SITE II or BINDING SITE III. Table 2 illustrates the complementarity of the nucleotide sequences of KIAA1196 BINDING SITE, designated SEQ ID:30823, to the nucleotide sequence of VGAM2356 RNA, herein designated VGAM RNA, also designated SEQ ID:5067.

Another function of VGAM2356 is therefore inhibition of KIAA1196 (Accession XM_028968). Accordingly, utilities of VGAM2356 include diagnosis, prevention and treatment of diseases and clinical conditions associated with KIAA1196. Neuronal Pentraxin Receptor (NPTXR, Accession NM_058178) is another VGAM2356 host target gene. NPTXR BINDING SITE1 and NPTXR BINDING SITE2 are HOST TARGET binding sites found in untranslated regions of mRNA encoded by NPTXR, corresponding to HOST TARGET binding sites such as BINDING SITE I, BINDING SITE II or BINDING SITE III. Table 2 illustrates the complementarity of the nucleotide sequences of NPTXR BINDING SITE1 and NPTXR BINDING SITE2, designated SEQ ID:27734 and SEQ ID:15586 respectively, to the nucleotide sequence of VGAM2356 RNA, herein designated VGAM RNA, also designated SEQ ID:5067.

Another function of VGAM2356 is therefore inhibition of Neuronal Pentraxin Receptor (NPTXR, Accession NM_058178). Accordingly, utilities of VGAM2356 include diagnosis, prevention and treatment of diseases and clinical conditions associated with NPTXR. LOC256222 (Accession XM_173177) is another VGAM2356 host target gene. LOC256222 BINDING SITE is HOST TARGET binding site found in the 5' untranslated region of mRNA encoded by LOC256222, corresponding to a HOST TARGET binding site such as BINDING SITE I, BINDING SITE II or BINDING SITE III. Table 2 illustrates the complementarity of the nucleotide sequences of LOC256222 BINDING SITE, designated SEQ ID:46428, to the nucleotide sequence of VGAM2356 RNA, herein designated VGAM RNA, also designated SEQ ID:5067.

Another function of VGAM2356 is therefore inhibition of LOC256222 (Accession XM_173177). Accordingly, utilities of VGAM2356 include diagnosis, prevention and treatment of diseases and clinical conditions associated with LOC256222. FIG. 1 further provides a conceptual description of a novel bioinformatically detected viral gene of the present invention, referred to here as Viral Genomic Address Messenger 2357 (VGAM2357) viral gene, which modulates expression of respective host target genes thereof, the function and utility of which host target genes is known in the art.

VGAM2357 is a novel bioinformatically detected regulatory, non protein coding, viral micro RNA (miRNA) gene. The method by which VGAM2357 was detected is described hereinabove with reference to FIGS. 1-8.

VGAM2357 gene, herein designated VGAM GENE, is a viral gene contained in the genome of Equine Herpesvirus 2. VGAM2357 host target gene, herein designated VGAM HOST TARGET GENE, is a human gene contained in the human genome.

VGAM2357 gene encodes a VGAM2357 precursor RNA, herein designated VGAM PRECURSOR RNA. Similar to other miRNA genes, and unlike most ordinary genes, VGAM2357 precursor RNA does not encode a protein. A nucleotide sequence identical or highly similar to the nucleotide sequence of VGAM2357 precursor RNA is designated SEQ ID:2343, and is provided hereinbelow with reference to the sequence listing part. Nucleotide sequence SEQ ID:2343 is located at position 32894 relative to the genome of Equine Herpesvirus 2.

VGAM2357 precursor RNA folds onto itself, forming VGAM2357 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2357 folded precursor RNA into VGAM2357 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2357 RNA is designated SEQ ID:5068, and is provided hereinbelow with reference to the sequence listing part.

VGAM2357 host target gene, herein designated VGAM HOST TARGET GENE, encodes a corresponding messenger RNA, VGAM2357 host target RNA, herein designated VGAM HOST TARGET RNA. VGAM2357 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2357 RNA, herein designated VGAM RNA, binds complementarily to one or more host target binding sites located in untranslated regions of VGAM2357 host target RNA, herein designated VGAM HOST TARGET RNA. This complementary binding is due to the fact that the nucleotide sequence of VGAM2357 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2357 RNA, herein designated VGAM RNA, may have a different number of host target binding sites in untranslated regions of a VGAM2357 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2357 RNA, herein designated VGAM RNA, to host target binding sites on VGAM2357 host target RNA, herein designated VGAM HOST TARGET RNA, such as BINDING SITE I, BINDING SITE II and BINDING SITE III, inhibits translation of VGAM2357 host target RNA into VGAM2357 host target protein, herein designated VGAM HOST TARGET PROTEIN. VGAM host target protein is therefore outlined by a broken line.

It is appreciated that VGAM2357 host target gene, herein designated VGAM HOST TARGET GENE, in fact represents a plurality of VGAM2357 host target genes. The mRNA of each one of this plurality of VGAM2357 host target genes comprises one or more host target binding sites, each having a nucleotide sequence which is at least partly complementary to VGAM2357 RNA, herein designated VGAM RNA, and which when bound by VGAM2357 RNA causes inhibition of translation of respective one or more VGAM2357 host target proteins.

It is further appreciated by one skilled in the art that the mode of translational inhibition illustrated by FIG. 1 with specific reference to translational inhibition exerted by VGAM2357 gene, herein designated VGAM GENE, on one or more VGAM2357 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM2357 is inhibition of expression of host target genes, as part of a novel viral mechanism of attacking a host. Accordingly, utilities of VGAM2357 include diagnosis, prevention and treatment of viral infection by Equine Herpesvirus 2. Specific functions, and accordingly utilities, of VGAM2357 correlate with, and may be deduced from, the identity of the host target genes which VGAM2357 binds and inhibits, and the function of these host target genes, as elaborated hereinbelow.

Nucleotide sequences of the VGAM2357 precursor RNA, herein designated VGAM PRECURSOR RNA, and of the ‘diced’ VGAM2357 RNA, herein designated VGAM RNA, and a schematic representation of the secondary folding of VGAM2357 folded precursor RNA, herein designated VGAM FOLDED PRECURSOR RNA, of VGAM2357 are further described hereinbelow with reference to Table 1.

Nucleotide sequences of host target binding sites, such as BINDING SITE-I, BINDING SITE-II and BINDING SITE-III of FIG. 1, found on VGAM2357 host target RNA, and schematic representation of the complementarity of each of these host target binding sites to VGAM2357 RNA, herein designated VGAM RNA, are described hereinbelow with reference to Table 2.

As mentioned hereinabove with reference to FIG. 1, a function of VGAM2357 gene, herein designated VGAM is inhibition of expression of VGAM2357 target genes. It is appreciated that specific functions, and accordingly utilities, of VGAM2357 correlate with, and may be deduced from, the identity of the target genes which VGAM2357 binds and inhibits, and the function of these target genes, as elaborated hereinbelow.

ATP-binding Cassette, Sub-family E (OABP), Member 1 (ABCE1, Accession XM_003555) is a VGAM2357 host target gene. ABCE1 BINDING SITE is HOST TARGET binding site found in the 3' untranslated region of mRNA encoded by ABCE1, corresponding to a HOST TARGET binding site such as BINDING SITE I, BINDING SITE II or BINDING SITE III. Table 2 illustrates the complementarity of the nucleotide sequences of ABCE1 BINDING SITE, designated SEQ ID:29939, to the nucleotide sequence of VGAM2357 RNA, herein designated VGAM RNA, also designated SEQ ID:5068.

A function of VGAM2357 is therefore inhibition of ATP-binding Cassette, Sub-family E (OABP), Member 1 (ABCE1, Accession XM_003555), a gene which a Ribonuclease L inhibitor. Accordingly, utilities of VGAM2357 include diagnosis, prevention and treatment of diseases and clinical conditions associated with ABCE1. The function of ABCE1 and its association with various diseases and clinical conditions, has been established by previous studies, as described hereinabove with reference to VGAM1924. Procollagen-lysine, 2-oxoglutarate 5-dioxygenase (lysine hydroxylase) 2 (PLOD2, Accession NM_000935) is another VGAM2357 host target gene. PLOD2 BINDING SITE is HOST TARGET binding site found in the 3' untranslated region of mRNA encoded by PLOD2, corresponding to a HOST TARGET binding site such as BINDING SITE I, BINDING SITE II or BINDING SITE III. Table 2 illustrates the complementarity of the nucleotide sequences of PLOD2 BINDING SITE, designated SEQ ID:6640, to the nucleotide sequence of VGAM2357 RNA, herein designated VGAM RNA, also designated SEQ ID:5068.

Another function of VGAM2357 is therefore inhibition of Procollagen-lysine, 2-oxoglutarate 5-dioxygenase (lysine hydroxylase) 2 (PLOD2, Accession NM_000935), a gene which catalyzes the formation of hydroxylysine in collagens. Accordingly, utilities of VGAM2357 include diagnosis, prevention and treatment of diseases and clinical conditions associated with PLOD2. The function of PLOD2 has been established by previous studies. Lysyl hydroxylase (EC 1.14.11.4) catalyzes the hydroxylation of lysyl residues in collagens. The active enzyme is a homodimer consisting of subunits with a molecular weight of about 85,000. Valtavaara et al. (1997) reported the isolation and characterization of cDNA clones for a novel isoform, which they called lysyl hydroxylase-2, symbolized PLOD2. The predicted 737-amino acid polypeptide includes an N-terminal signal peptide and has overall similarity of more than 75% to lysyl hydroxylase-1, or PLOD, from human and chicken. The similarity is even higher in the C-terminal region of the polypeptides. The PLOD2 gene contains 9 cysteines conserved in PLOD, in addition to conserved histidines in the putative active site. By Northern analysis, Valtavaara et al. (1997) detected a 4.2-kb transcript that was highly expressed in pancreas, skeletal muscle, heart, and placenta. Recombinant protein produced from cDNA using a baculovirus expression system yielded enzyme with lysyl hydroxylase activity in vitro. Animal model experiments lend further support to the function of PLOD2. Szpirer et al. (1997) mapped the PLOD2 gene to human chromosome 3 by somatic cell hybrid analysis and to 3q23-q24 by fluorescence in situ hybridization. The rat gene was mapped to chromosome 8 where the genes shared by human chromosome 3 are located. Sipila et al. (2000) mapped the mouse homolog to chromosome 9.

It is appreciated that the abovementioned animal model for PLOD2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Valtavaara, M.; Papponen, H.; Pirttila, A.-M.; Hiltunen, K.; Helander, H.; Myllyla, R.: Cloning and characterization of a novel human lysyl hydroxylase isoform highly expressed in pancreas and muscle. J. Biol. Chem. 272:6831-6834, 1997; and Szpirer, C.; Szpirer, J.; Riviere, M.; Vanvooren, P.; Valtavaara, M.; Myllyla, R.:Localization of the gene encoding a novel isoform of lysyl hydroxylase. Mammalian Genome 8:707-708, 1.

Further studies establishing the function and utilities of PLOD2 are found in John Hopkins OMIM database record ID 601865, and in sited publications numbered 6269-6271 listed in the bibliography section hereinbelow, which are also hereby incorporated by reference. DKFZP586P0123 (Accession XM_170681) is another VGAM2357 host target gene. DKFZP586P0123 BINDING SITE is HOST TARGET binding site found in the 3' untranslated region of mRNA encoded by DKFZP586P0123, corresponding to a HOST TARGET binding site such as BINDING SITE I, BINDING SITE II or BINDING SITE III. Table 2 illustrates the complementarity of the nucleotide sequences of DKFZP586P0123 BINDING SITE, designated SEQ ID:45462, to the nucleotide sequence of VGAM2357 RNA, herein designated VGAM RNA, also designated SEQ ID:5068.

Another function of VGAM2357 is therefore inhibition of DKFZP586P0123 (Accession XM_170681). Accordingly, utilities of VGAM2357 include diagnosis, prevention and treatment of diseases and clinical conditions associated with DKFZP586P0123. Wingless-type MMTV Integration Site Family, Member 2B (WNT2B, Accession NM_004185) is another VGAM2357 host target gene. WNT2B BINDING SITE1 and WNT2B BINDING SITE2 are HOST TARGET binding sites found in untranslated regions of mRNA encoded by WNT2B, corresponding to HOST TARGET binding sites such as BINDING SITE I, BINDING SITE II or BINDING SITE III. Table 2 illustrates the complementarity of the nucleotide sequences of WNT2B BINDING SITE1 and WNT2B BINDING SITE2, designated SEQ ID:10390 and SEQ ID:23691 respectively, to the nucleotide sequence of VGAM2357 RNA, herein designated VGAM RNA, also designated SEQ ID:5068.

Another function of VGAM2357 is therefore inhibition of Wingless-type MMTV Integration Site Family, Member 2B (WNT2B, Accession NM_004185). Accordingly, utilities of VGAM2357 include diagnosis, prevention and treatment of diseases and clinical conditions associated with WNT2B. LOC220672 (Accession XM_017177) is another VGAM2357 host target gene. LOC220672 BINDING SITE is HOST TARGET binding site found in the 3' untranslated region of mRNA encoded by LOC220672, corresponding to a HOST TARGET binding site such as BINDING SITE I, BINDING SITE II or BINDING SITE III. Table 2 illustrates the complementarity of the nucleotide sequences of LOC220672 BINDING SITE, designated SEQ ID:30306, to the nucleotide sequence of VGAM2357 RNA, herein designated VGAM RNA, also designated SEQ ID:5068.

Another function of VGAM2357 is therefore inhibition of LOC220672 (Accession XM_017177). Accordingly, utilities of VGAM2357 include diagnosis, prevention and treatment of diseases and clinical conditions associated with LOC220672. FIG. 1 further provides a conceptual description of a novel bioinformatically detected viral gene of the present invention, referred to here as Viral Genomic Address Messenger 2358 (VGAM2358) viral gene, which modulates expression of respective host target genes thereof, the function and utility of which host target genes is known in the art.

VGAM2358 is a novel bioinformatically detected regulatory, non protein coding, viral micro RNA (miRNA) gene. The method by which VGAM2358 was detected is described hereinabove with reference to FIGS. 1-8.

VGAM2358 gene, herein designated VGAM GENE, is a viral gene contained in the genome of Equine Herpesvirus 2. VGAM2358 host target gene, herein designated VGAM HOST TARGET GENE, is a human gene contained in the human genome.

VGAM2358 gene encodes a VGAM2358 precursor RNA, herein designated VGAM PRECURSOR RNA. Similar to other miRNA genes, and unlike most ordinary genes, VGAM2358 precursor RNA does not encode a protein. A nucleotide sequence identical or highly similar to the nucleotide sequence of VGAM2358 precursor RNA is designated SEQ ID:2344, and is provided hereinbelow with reference to the sequence listing part. Nucleotide sequence SEQ ID:2344 is located at position 44667 relative to the genome of Equine Herpesvirus 2.

VGAM2358 precursor RNA folds onto itself, forming VGAM2358 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2358 folded precursor RNA into VGAM2358 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2358 RNA is designated SEQ ID:5069, and is provided hereinbelow with reference to the sequence listing part.

VGAM2358 host target gene, herein designated VGAM HOST TARGET GENE, encodes a corresponding messenger RNA, VGAM2358 host target RNA, herein designated VGAM HOST TARGET RNA. VGAM2358 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2358 RNA, herein designated VGAM RNA, binds complementarily to one or more host target binding sites located in untranslated regions of VGAM2358 host target RNA, herein designated VGAM HOST TARGET RNA. This complementary binding is due to the fact that the nucleotide sequence of VGAM2358 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2358 RNA, herein designated VGAM RNA, may have a different number of host target binding sites in untranslated regions of a VGAM2358 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2358 RNA, herein designated VGAM RNA, to host target binding sites on VGAM2358 host target RNA, herein designated VGAM HOST TARGET RNA, such as BINDING SITE I, BINDING SITE II and BINDING SITE III, inhibits translation of VGAM2358 host target RNA into VGAM2358 host target protein, herein designated VGAM HOST TARGET PROTEIN. VGAM host target protein is therefore outlined by a broken line.

It is appreciated that VGAM2358 host target gene, herein designated VGAM HOST TARGET GENE, in fact represents a plurality of VGAM2358 host target genes. The mRNA of each one of this plurality of VGAM2358 host target genes comprises one or more host target binding sites, each having a nucleotide sequence which is at least partly complementary to VGAM2358 RNA, herein designated VGAM RNA, and which when bound by VGAM2358 RNA causes inhibition of translation of respective one or more VGAM2358 host target proteins.

It is further appreciated by one skilled in the art that the mode of translational inhibition illustrated by FIG. 1 with specific reference to translational inhibition exerted by VGAM2358 gene, herein designated VGAM GENE, on one or more VGAM2358 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2358 is inhibition of expression of host target genes, as part of a novel viral mechanism of attacking a host. Accordingly, utilities of VGAM2358 include diagnosis, prevention and treatment of viral infection by Equine Herpesvirus 2. Specific functions, and accordingly utilities, of VGAM2358 correlate with, and may be deduced from, the identity of the host target genes which VGAM2358 binds and inhibits, and the function of these host target genes, as elaborated hereinbelow.

Nucleotide sequences of the VGAM2358 precursor RNA, herein designated VGAM PRECURSOR RNA, and of the 'diced' VGAM2358 RNA, herein designated VGAM RNA, and a schematic representation of the secondary folding of VGAM2358 folded precursor RNA, herein designated VGAM FOLDED PRECURSOR RNA, of VGAM2358 are further described hereinbelow with reference to Table 1.

Nucleotide sequences of host target binding sites, such as BINDING SITE-I, BINDING SITE-II and BINDING SITE-III of FIG. 1, found on VGAM2358 host target RNA, and schematic representation of the complementarity of each of these host target binding sites to VGAM2358 RNA, herein designated VGAM RNA, are described hereinbelow with reference to Table 2.

As mentioned hereinabove with reference to FIG. 1, a function of VGAM2358 gene, herein designated VGAM is inhibition of expression of VGAM2358 target genes. It is appreciated that specific functions, and accordingly utilities, of VGAM2358 correlate with, and may be deduced from, the identity of the target genes which VGAM2358 binds and inhibits, and the function of these target genes, as elaborated hereinbelow.

Alcohol Dehydrogenase IB (class I), Beta Polypeptide (ADH1B, Accession XM_052365) is a VGAM2358 host target gene. ADH1B BINDING SITE is HOST TARGET binding site found in the 3' untranslated region of mRNA encoded by ADH1B, corresponding to a HOST TARGET binding site such as BINDING SITE I, BINDING SITE II or BINDING SITE III. Table 2 illustrates the complementarity of the nucleotide sequences of ADH1B BINDING SITE, designated SEQ ID:35962, to the nucleotide sequence of VGAM2358 RNA, herein designated VGAM RNA, also designated SEQ ID:5069.

A function of VGAM2358 is therefore inhibition of Alcohol Dehydrogenase IB (class I), Beta Polypeptide (ADH1B, Accession XM_052365), a gene which Alcohol dehydrogenase 2 (alcohol:NAD+ oxidoreductase) class I beta subunit. Accordingly, utilities of VGAM2358 include diagnosis, prevention and treatment of diseases and clinical conditions associated with ADH1B. The function of ADH1B and its association with various diseases and clinical conditions, has been established by previous studies, as described hereinabove with reference to VGAM1805. Activation-induced Cytidine Deaminase (AICDA, Accession NM_020661) is another VGAM2358 host target gene. AICDA BINDING SITE is HOST TARGET binding site found in the 3' untranslated region of mRNA encoded by AICDA, corresponding to a HOST TARGET binding site such as BINDING SITE I, BINDING SITE II or BINDING SITE III. Table 2 illustrates the complementarity of the nucleotide sequences of AICDA BINDING SITE, designated SEQ ID:21833, to the nucleotide sequence of VGAM2358 RNA, herein designated VGAM RNA, also designated SEQ ID:5069.

Another function of VGAM2358 is therefore inhibition of Activation-induced Cytidine Deaminase (AICDA, Accession NM_020661), a gene which is a member of the cytidine deaminase family. Accordingly, utilities of VGAM2358 include diagnosis, prevention and treatment of diseases and clinical conditions associated with AICDA. The function of AICDA and its association with various diseases and clinical conditions, has been established by previous studies, as described hereinabove with reference to VGAM600. Amyloid Beta Precursor Protein (cytoplasmic tail) Binding Protein 2 (APPBP2, Accession NM_006380) is another VGAM2358 host target gene. APPBP2 BINDING SITE is HOST TARGET binding site found in the 3' untranslated region of mRNA encoded by APPBP2, corresponding to a HOST TARGET binding site such as BINDING SITE I, BINDING SITE II or BINDING SITE III. Table 2 illustrates the complementarity of the nucleotide sequences of APPBP2 BINDING SITE, designated SEQ ID:13085, to the nucleotide sequence of VGAM2358 RNA, herein designated VGAM RNA, also designated SEQ ID:5069.

Another function of VGAM2358 is therefore inhibition of Amyloid Beta Precursor Protein (cytoplasmic tail) Binding Protein 2 (APPBP2, Accession NM_006380), a gene which interacts with the basolateral sorting signal of amyloid precursor protein. Accordingly, utilities of VGAM2358 include diagnosis, prevention and treatment of diseases and clinical conditions associated with APPBP2. The function of APPBP2 and its association with various diseases and clinical conditions, has been established by previous studies, as described hereinabove with reference to VGAM525. ATPase, Ca++ Transporting, Plasma Membrane 4 (ATP2B4, Accession XM_046775) is another VGAM2358 host target gene. ATP2B4 BINDING SITE is HOST TARGET binding site found in the 5' untranslated region of mRNA encoded by ATP2B4, corresponding to a HOST TARGET binding site such as BINDING SITE I, BINDING SITE II or BINDING SITE III. Table 2 illustrates the complementarity of the nucleotide sequences of ATP2B4 BINDING SITE, designated SEQ ID:34825, to the nucleotide sequence of VGAM2358 RNA, herein designated VGAM RNA, also designated SEQ ID:5069.

Another function of VGAM2358 is therefore inhibition of ATPase, Ca++ Transporting, Plasma Membrane 4 (ATP2B4, Accession XM_046775). Accordingly, utilities of VGAM2358 include diagnosis, prevention and treatment of diseases and clinical conditions associated with ATP2B4. BRIP1 (Accession NM_032043) is another VGAM2358 host target gene. BRIP1 BINDING SITE is HOST TARGET binding site found in the 3' untranslated region of mRNA encoded by BRIP1, corresponding to a HOST TARGET binding site such as BINDING SITE I, BINDING SITE II or BINDING SITE III. Table 2 illustrates the complementarity of the nucleotide sequences of BRIP1 BINDING SITE, designated SEQ ID:25758, to the nucleotide sequence of VGAM2358 RNA, herein designated VGAM RNA, also designated SEQ ID:5069.

Another function of VGAM2358 is therefore inhibition of BRIP1 (Accession NM_032043). Accordingly, utilities of VGAM2358 include diagnosis, prevention and treatment of diseases and clinical conditions associated with BRIP1. Caspase 2, Apoptosis-related Cysteine Protease (neural precursor cell expressed, developmentally down-regulated 2) (CASP2, Accession NM_032982) is another VGAM2358 host target gene. CASP2 BINDING SITE1 through CASP2 BINDING SITE4 are HOST TARGET binding sites found in untranslated regions of mRNA encoded by CASP2, corresponding to HOST TARGET binding sites such as BINDING SITE I, BINDING SITE II or BINDING SITE III. Table 2 illustrates the complementarity of the nucleotide sequences of CASP2 BINDING SITE1 through CASP2 BINDING SITE4, designated SEQ ID:26856, SEQ ID:26861, SEQ ID:26866 and SEQ ID:6893 respectively, to the nucleotide sequence of VGAM2358 RNA, herein designated VGAM RNA, also designated SEQ ID:5069.

Another function of VGAM2358 is therefore inhibition of Caspase 2, Apoptosis-related Cysteine Protease (neural precursor cell expressed, developmentally down-regulated 2) (CASP2, Accession NM_032982), a gene which involves in the activation cascade of caspases responsible for apoptosis execution. Accordingly, utilities of VGAM2358 include diagnosis, prevention and treatment of diseases and clinical conditions associated with CASP2. The function of CASP2 and its association with various diseases and clinical conditions, has been established by previous studies, as described hereinabove with reference to VGAM148. Core-binding Factor, Beta Subunit (CBFB, Accession NM_001755) is another VGAM2358 host target gene. CBFB BINDING SITE1 and CBFB BINDING SITE2 are HOST TARGET binding sites found in untranslated regions of mRNA encoded by CBFB, corresponding to HOST TARGET binding sites such as BINDING SITE I, BINDING SITE II or BINDING SITE III. Table 2 illustrates the complementarity of the nucleotide sequences of CBFB BINDING SITE1 and CBFB BINDING SITE2, designated SEQ ID:7508 and SEQ ID:23149 respectively, to the nucleotide sequence of VGAM2358 RNA, herein designated VGAM RNA, also designated SEQ ID:5069.

Another function of VGAM2358 is therefore inhibition of Core-binding Factor, Beta Subunit (CBFB, Accession NM_001755), a gene which is beta subunit of the transcription factor CBF which causes leukemia. Accordingly, utilities of VGAM2358 include diagnosis, prevention and treatment of diseases and clinical conditions associated with CBFB. The function of CBFB and its association with various diseases and clinical conditions, has been established by previous studies, as described hereinabove with reference to VGAM98. Coronin, Actin Binding Protein, 2B (CORO2B, Accession XM_035403) is another VGAM2358 host target gene. CORO2B BINDING SITE is HOST TARGET binding site found in the 5" untranslated region of mRNA encoded by CORO2B, corresponding to a HOST TARGET binding site such as BINDING SITE I, BINDING SITE II or BINDING SITE III. Table 2 illustrates the complementarity of the nucleotide sequences of CORO2B BINDING SITE, designated SEQ ID:32257, to the nucleotide sequence of VGAM2358 RNA, herein designated VGAM RNA, also designated SEQ ID:5069.

Another function of VGAM2358 is therefore inhibition of Coronin, Actin Binding Protein, 2B (CORO2B, Accession XM_035403), a gene which may play a role in the reorganization of neuronal actin structure. Accordingly, utilities of VGAM2358 include diagnosis, prevention and treatment of diseases and clinical conditions associated with CORO2B. The function of CORO2B and its association with various diseases and clinical conditions, has been established by previous studies, as described hereinabove with reference to VGAM923. Eukaryotic Translation Initiation Factor 1A (EIF1A, Accession XM_114147) is another VGAM2358 host target gene. EIF1A BINDING SITE is HOST TARGET binding site found in the 3' untranslated region of mRNA encoded by EIF1A, corresponding to a HOST TARGET binding site such as BINDING SITE I, BINDING SITE II or BINDING SITE III. Table 2 illustrates the complementarity of the nucleotide sequences of EIF1A BINDING SITE, designated SEQ ID:42728, to the nucleotide sequence of VGAM2358 RNA, herein designated VGAM RNA, also designated SEQ ID:5069.

Another function of VGAM2358 is therefore inhibition of Eukaryotic Translation Initiation Factor 1A (EIF1A, Accession XM_114147), a gene which seems to be required for maximal rate of protein biosynthesis. Accordingly, utilities of VGAM2358 include diagnosis, prevention and treatment of diseases and clinical conditions associated with EIF1A. The function of EIF1A and its association with various diseases and clinical conditions, has been established by previous studies, as described hereinabove with reference to VGAM120. Homeo Box B3 (HOXB3, Accession NM_002146) is another VGAM2358 host target gene. HOXB3 BINDING SITE is HOST TARGET binding site found in the 5' untranslated region of mRNA encoded by HOXB3, corresponding to a HOST TARGET binding site such as BINDING SITE I, BINDING SITE II or BINDING SITE III. Table 2 illustrates the complementarity of the nucleotide sequences of HOXB3 BINDING SITE, designated SEQ ID:7923, to the nucleotide sequence of VGAM2358 RNA, herein designated VGAM RNA, also designated SEQ ID:5069.

Another function of VGAM2358 is therefore inhibition of Homeo Box B3 (HOXB3, Accession NM_002146). Accordingly, utilities of VGAM2358 include diagnosis, prevention and treatment of diseases and clinical conditions associated with HOXB3. Immunoglobulin Superfamily Containing Leucine-rich Repeat (ISLR, Accession NM_005545) is another VGAM2358 host target gene. ISLR BINDING SITE is HOST TARGET binding site found in the 3' untranslated region of mRNA encoded by ISLR, corresponding to a HOST TARGET binding site such as BINDING SITE I, BINDING SITE II or BINDING SITE III. Table 2 illustrates the complementarity of the nucleotide sequences of ISLR BINDING SITE, designated SEQ ID:12071, to the nucleotide sequence of VGAM2358 RNA, herein designated VGAM RNA, also designated SEQ ID:5069.

Another function of VGAM2358 is therefore inhibition of Immunoglobulin Superfamily Containing Leucine-rich Repeat (ISLR, Accession NM_005545). Accordingly, utilities of VGAM2358 include diagnosis, prevention and treatment of diseases and clinical conditions associated with ISLR. Melan-A (MLANA, Accession NM_005511) is another VGAM2358 host target gene. MLANA BINDING SITE is HOST TARGET binding site found in the 3' untranslated region of mRNA encoded by MLANA, corresponding to a HOST TARGET binding site such as BINDING SITE I, BINDING SITE II or BINDING SITE III. Table 2 illustrates the complementarity of the nucleotide sequences of MLANA BINDING SITE, designated SEQ ID:12029, to the nucleotide sequence of VGAM2358 RNA, herein designated VGAM RNA, also designated SEQ ID:5069.

Another function of VGAM2358 is therefore inhibition of Melan-A (MLANA, Accession NM_005511). Accordingly, utilities of VGAM2358 include diagnosis, prevention and treatment of diseases and clinical conditions associated with MLANA. V-myc Myelocytomatosis Viral Oncogene Homolog 2 (avian) (MYCL2, Accession NM_005377) is another VGAM2358 host target gene. MYCL2 BINDING SITE is HOST TARGET binding site found in the 3' untranslated region of mRNA encoded by MYCL2, corresponding to a HOST TARGET binding site such as BINDING SITE I, BINDING SITE II or BINDING SITE III. Table 2 illustrates the complementarity of the nucleotide sequences of MYCL2 BINDING SITE, designated SEQ ID:11858, to the nucleotide sequence of VGAM2358 RNA, herein designated VGAM RNA, also designated SEQ ID:5069.

Another function of VGAM2358 is therefore inhibition of V-myc Myelocytomatosis Viral Oncogene Homolog 2 (avian) (MYCL2, Accession NM_005377). Accordingly, utilities of VGAM2358 include diagnosis, prevention and treatment of diseases and clinical conditions associated with MYCL2. Serine (or cysteine) Proteinase Inhibitor, Clade D (heparin cofactor), Member 1 (SERPIND1, Accession NM_000185) is another VGAM2358 host target gene. SERPIND1 BINDING SITE is HOST TARGET binding site found in the 3' untranslated region of mRNA encoded by SERPIND1, corresponding to a HOST TARGET binding site such as BINDING SITE I, BINDING SITE II or BINDING SITE III. Table 2 illustrates the complementarity of the nucleotide sequences of SERPIND1 BINDING SITE, designated SEQ ID:5687, to the nucleotide sequence of VGAM2358 RNA, herein designated VGAM RNA, also designated SEQ ID:5069.

Another function of VGAM2358 is therefore inhibition of Serine (or cysteine) Proteinase Inhibitor, Clade D (heparin cofactor), Member 1 (SERPIND1, Accession NM_000185). Accordingly, utilities of VGAM2358 include diagnosis, prevention and treatment of diseases and clinical conditions associated with SERPIND1. Solute Carrier Family 13 (sodium/sulfate symporters), Member 1 (SLC13A1, Accession NM_022444) is another VGAM2358 host target gene. SLC13A1 BINDING SITE is HOST TARGET binding site found in the 3' untranslated region of mRNA encoded by SLC13A1, corresponding to a HOST TARGET binding site such as BINDING SITE I, BINDING SITE II or BINDING SITE III. Table 2 illustrates the complementarity of the nucleotide sequences of SLC13A1 BINDING SITE, designated SEQ ID:22776, to the nucleotide sequence of VGAM2358 RNA, herein designated VGAM RNA, also designated SEQ ID:5069.

Another function of VGAM2358 is therefore inhibition of Solute Carrier Family 13 (sodium/sulfate symporters), Member 1 (SLC13A1, Accession NM_022444). Accordingly, utilities of VGAM2358 include diagnosis, prevention and treatment of diseases and clinical conditions associated with SLC13A1. Surfeit 5 (SURF5, Accession NM_006752) is another VGAM2358 host target gene. SURF5 BINDING SITE is HOST TARGET binding site found in the 3' untranslated region of mRNA encoded by SURF5, corresponding to a HOST TARGET binding site such as BINDING SITE I, BINDING SITE II or BINDING SITE III. Table 2 illustrates the complementarity of the nucleotide sequences of SURF5 BINDING SITE, designated SEQ ID:13607, to the nucleotide sequence of VGAM2358 RNA, herein designated VGAM RNA, also designated SEQ ID:5069.

Another function of VGAM2358 is therefore inhibition of Surfeit 5 (SURF5, Accession NM_006752). Accordingly, utilities of VGAM2358 include diagnosis, prevention and treatment of diseases and clinical conditions associated with SURF5. TRIM (Accession NM_016388) is another VGAM2358 host target gene. TRIM BINDING SITE is HOST TARGET binding site found in the 3' untranslated region of mRNA encoded by TRIM, corresponding to a HOST TARGET binding site such as BINDING SITE I, BINDING SITE II or BINDING SITE III. Table 2 illustrates the complementarity of the nucleotide sequences of TRIM BINDING SITE, designated SEQ ID:18533, to the nucleotide sequence of VGAM2358 RNA, herein designated VGAM RNA, also designated SEQ ID:5069.

Another function of VGAM2358 is therefore inhibition of TRIM (Accession NM_016388), a gene which plays a role in recruiting signaling proteins to the plasma membrane upon T-cell receptor (TCR) complex activation in T cells. Accordingly, utilities of VGAM2358 include diagnosis, prevention and treatment of diseases and clinical conditions associated with TRIM. The function of TRIM and its association with various diseases and clinical conditions, has been established by previous studies, as described hereinabove with reference to VGAM227. WAS Protein Family, Member 3 (WASF3, Accession NM_006646) is another VGAM2358 host target gene. WASF3 BINDING SITE is HOST TARGET binding site found in the 3' untranslated region of mRNA encoded by WASF3, corresponding to a HOST TARGET binding site such as BINDING SITE I, BINDING SITE II or BINDING SITE III. Table 2 illustrates the complementarity of the nucleotide sequences of WASF3 BINDING SITE, designated SEQ ID:13441, to the nucleotide sequence of VGAM2358 RNA, herein designated VGAM RNA, also designated SEQ ID:5069.

Another function of VGAM2358 is therefore inhibition of WAS Protein Family, Member 3 (WASF3, Accession NM_006646), a gene which stimulates actin polymerization. Accordingly, utilities of VGAM2358 include diagnosis, prevention and treatment of diseases and clinical conditions associated with WASF3. The function of WASF3 and its association with various diseases and clinical conditions, has been established by previous studies, as described hereinabove with reference to VGAM1692. Williams-Beuren Syndrome Chromosome Region 1 (WBSCR1, Accession NM_022170) is another VGAM2358 host target gene. WBSCR1 BINDING SITE1 and WBSCR1 BINDING SITE2 are HOST TARGET binding sites found in untranslated regions of mRNA encoded by WBSCR1, corresponding to HOST TARGET binding sites such as BINDING SITE I, BINDING SITE II or BINDING SITE III. Table 2 illustrates the complementarity of the nucleotide sequences of WBSCR1 BINDING SITE1 and WBSCR1 BINDING SITE2, designated SEQ ID:22727 and SEQ ID:25710 respectively, to the nucleotide sequence of VGAM2358 RNA, herein designated VGAM RNA, also designated SEQ ID:5069.

Another function of VGAM2358 is therefore inhibition of Williams-Beuren Syndrome Chromosome Region 1 (WBSCR1, Accession NM_022170), a gene which stimulates protein translation. Accordingly, utilities of VGAM2358 include diagnosis, prevention and treatment of diseases and clinical conditions associated with WBSCR1. The function of WBSCR1 and its association with various diseases and clinical conditions, has been established by previous studies, as described hereinabove with reference to VGAM110. Collectin Sub-family Member 12 (COLEC12, Accession NM_030781) is another VGAM2358 host target gene. COLEC12 BINDING SITE is HOST TARGET binding site found in the 3' untranslated region of mRNA encoded by COLEC12, corresponding to a HOST TARGET binding site such as BINDING SITE I, BINDING SITE II or BINDING SITE III. Table 2 illustrates the complementarity of the nucleotide sequences of COLEC12 BINDING SITE, designated SEQ ID:25073, to the nucleotide sequence of VGAM2358 RNA, herein designated VGAM RNA, also designated SEQ ID:5069.

Another function of VGAM2358 is therefore inhibition of Collectin Sub-family Member 12 (COLEC12, Accession NM_030781). Accordingly, utilities of VGAM2358 include diagnosis, prevention and treatment of diseases and clinical conditions associated with COLEC12. CRMP5 (Accession NM_020134) is another VGAM2358 host target gene. CRMP5 BINDING SITE is HOST TARGET binding site found in the 3' untranslated region of mRNA encoded by CRMP5, corresponding to a HOST TARGET binding site such as BINDING SITE I, BINDING SITE II or BINDING SITE III. Table 2 illustrates the complementarity of the nucleotide sequences of CRMP5 BINDING SITE, designated SEQ ID:21331, to the nucleotide sequence of VGAM2358 RNA, herein designated VGAM RNA, also designated SEQ ID:5069.

Another function of VGAM2358 is therefore inhibition of CRMP5 (Accession NM_020134). Accordingly, utilities of VGAM2358 include diagnosis, prevention and treatment of diseases and clinical conditions associated with CRMP5. DDM36 (Accession NM_020962) is another VGAM2358 host target gene. DDM36 BINDING SITE is HOST TARGET binding site found in the 3' untranslated region of mRNA encoded by DDM36, corresponding to a HOST TARGET binding site such as BINDING SITE I, BINDING SITE II or BINDING SITE III. Table 2 illustrates the complementarity of the nucleotide sequences of DDM36 BINDING SITE, designated SEQ ID:21957, to the nucleotide sequence of VGAM2358 RNA, herein designated VGAM RNA, also designated SEQ ID:5069.

Another function of VGAM2358 is therefore inhibition of DDM36 (Accession NM_020962). Accordingly, utilities of VGAM2358 include diagnosis, prevention and treatment of diseases and clinical conditions associated with DDM36. FLJ11710 (Accession NM_024846) is another VGAM2358 host target gene. FLJ11710 BINDING SITE is HOST TARGET binding site found in the 3' untranslated region of mRNA encoded by FLJ11710, corresponding to a HOST TARGET binding site such as BINDING SITE I, BINDING SITE II or BINDING SITE III. Table 2 illustrates the complementarity of the nucleotide sequences of FLJ11710 BINDING SITE, designated SEQ ID:24276, to the nucleotide sequence of VGAM2358 RNA, herein designated VGAM RNA, also designated SEQ ID:5069.

Another function of VGAM2358 is therefore inhibition of FLJ11710 (Accession NM_024846). Accordingly, utilities of VGAM2358 include diagnosis, prevention and treatment of diseases and clinical conditions associated with FLJ11710. FLJ12078 (Accession NM_024977) is another VGAM2358 host target gene. FLJ12078 BINDING SITE is HOST TARGET binding site found in the 3' untranslated region of mRNA encoded by FLJ12078, corresponding to a HOST TARGET binding site such as BINDING SITE I, BINDING SITE II or BINDING SITE III. Table 2 illustrates the complementarity of the nucleotide sequences of FLJ12078 BINDING SITE, designated SEQ ID:24535, to the nucleotide sequence of VGAM2358 RNA, herein designated VGAM RNA, also designated SEQ ID:5069.

Another function of VGAM2358 is therefore inhibition of FLJ12078 (Accession NM_024977). Accordingly, utilities of VGAM2358 include diagnosis, prevention and treatment of diseases and clinical conditions associated with FLJ12078. FLJ13910 (Accession NM_022780) is another VGAM2358 host target gene. FLJ13910 BINDING SITE is HOST TARGET binding site found in the 3' untranslated region of mRNA encoded by FLJ13910, corresponding to a HOST TARGET binding site such as BINDING SITE I, BINDING SITE II or BINDING SITE III. Table 2 illustrates the complementarity of the nucleotide sequences of FLJ13910 BINDING SITE, designated SEQ ID:23054, to the nucleotide sequence of VGAM2358 RNA, herein designated VGAM RNA, also designated SEQ ID:5069.

Another function of VGAM2358 is therefore inhibition of FLJ13910 (Accession NM_022780). Accordingly, utilities of VGAM2358 include diagnosis, prevention and treatment of diseases and clinical conditions associated with FLJ13910. FLJ20651 (Accession NM_017919) is another VGAM2358 host target gene. FLJ20651 BINDING SITE is HOST TARGET binding site found in the 3' untranslated region of mRNA encoded by FLJ20651, corresponding to a HOST TARGET binding site such as BINDING SITE I, BINDING SITE II or BINDING SITE III. Table 2 illustrates the complementarity of the nucleotide sequences of FLJ20651 BINDING SITE, designated SEQ ID:19577, to the nucleotide sequence of VGAM2358 RNA, herein designated VGAM RNA, also designated SEQ ID:5069.

Another function of VGAM2358 is therefore inhibition of FLJ20651 (Accession NM_017919). Accordingly, utilities of VGAM2358 include diagnosis, prevention and treatment of diseases and clinical conditions associated with FLJ20651. FLJ20671 (Accession NM_017924) is another VGAM2358 host target gene. FLJ20671 BINDING SITE is HOST TARGET binding site found in the 3' untranslated region of mRNA encoded by FLJ20671, corresponding to a HOST TARGET binding site such as BINDING SITE I, BINDING SITE II or BINDING SITE III. Table 2 illustrates the complementarity of the nucleotide sequences of FLJ20671 BINDING SITE, designated SEQ ID:19593, to the nucleotide sequence of VGAM2358 RNA, herein designated VGAM RNA, also designated SEQ ID:5069.

Another function of VGAM2358 is therefore inhibition of FLJ20671 (Accession NM_017924). Accordingly, utilities of VGAM2358 include diagnosis, prevention and treatment of diseases and clinical conditions associated with FLJ20671. FLJ23024 (Accession NM_024936) is another VGAM2358 host target gene. FLJ23024 BINDING SITE is HOST TARGET binding site found in the 3' untranslated region of mRNA encoded by FLJ23024, corresponding to a HOST TARGET binding site such as BINDING SITE I, BINDING SITE II or BINDING SITE III. Table 2 illustrates the complementarity of the nucleotide sequences of FLJ23024 BINDING SITE, designated SEQ ID:24474, to the nucleotide sequence of VGAM2358 RNA, herein designated VGAM RNA, also designated SEQ ID:5069.

Another function of VGAM2358 is therefore inhibition of FLJ23024 (Accession NM_024936). Accordingly, utilities of VGAM2358 include diagnosis, prevention and treatment of diseases and clinical conditions associated with FLJ23024. FLJ23056 (Accession NM_024582) is another VGAM2358 host target gene. FLJ23056 BINDING SITE is HOST TARGET binding site found in the 3' untranslated region of mRNA encoded by FLJ23056, corresponding to a HOST TARGET binding site such as BINDING SITE I, BINDING SITE II or BINDING SITE III. Table 2 illustrates the complementarity of the nucleotide sequences of FLJ23056 BINDING SITE, designated SEQ ID:23809, to the nucleotide sequence of VGAM2358 RNA, herein designated VGAM RNA, also designated SEQ ID:5069.

Another function of VGAM2358 is therefore inhibition of FLJ23056 (Accession NM_024582). Accordingly, utilities of VGAM2358 include diagnosis, prevention and treatment of diseases and clinical conditions associated with FLJ23056. Frequenin Homolog (Drosophila) (FREQ, Accession NM_014286) is another VGAM2358 host target gene. FREQ BINDING SITE is HOST TARGET binding site found in the 3' untranslated region of mRNA encoded by FREQ, corresponding to a HOST TARGET binding site such as BINDING SITE I, BINDING SITE II or BINDING SITE III. Table 2 illustrates the complementarity of the nucleotide sequences of FREQ BINDING SITE, designated SEQ ID:15562, to the nucleotide sequence of VGAM2358 RNA, herein designated VGAM RNA, also designated SEQ ID:5069.

Another function of VGAM2358 is therefore inhibition of Frequenin Homolog (Drosophila) (FREQ, Accession NM_014286). Accordingly, utilities of VGAM2358 include diagnosis, prevention and treatment of diseases and clinical conditions associated with FREQ. GTP Binding Protein 1 (GTPBP1, Accession NM_004286) is another VGAM2358 host target gene. GTPBP1 BINDING SITE is HOST TARGET binding site found in the 3' untranslated region of mRNA encoded by GTPBP1, corresponding to a HOST TARGET binding site such as BINDING SITE I, BINDING SITE II or BINDING SITE III. Table 2 illustrates the complementarity of the nucleotide sequences of GTPBP1 BINDING SITE, designated SEQ ID:10497, to the nucleotide sequence of VGAM2358 RNA, herein designated VGAM RNA, also designated SEQ ID:5069.

Another function of VGAM2358 is therefore inhibition of GTP Binding Protein 1 (GTPBP1, Accession NM_004286). Accordingly, utilities of VGAM2358 include diagnosis, prevention and treatment of diseases and clinical conditions associated with GTPBP1. JM11 (Accession NM_033626) is another VGAM2358 host target gene. JM11 BINDING SITE is HOST TARGET binding site found in the 3' untranslated region of mRNA encoded by JM11, corresponding to a HOST TARGET binding site such as BINDING SITE I, BINDING SITE II or BINDING SITE III. Table 2 illustrates the complementarity of the nucleotide sequences of JM11 BINDING SITE, designated SEQ ID:27330, to the nucleotide sequence of VGAM2358 RNA, herein designated VGAM RNA, also designated SEQ ID:5069.

Another function of VGAM2358 is therefore inhibition of JM11 (Accession NM_033626). Accordingly, utilities of VGAM2358 include diagnosis, prevention and treatment of diseases and clinical conditions associated with JM11. KIAA0026 (Accession NM_012286) is another VGAM2358 host target gene. KIAA0026 BINDING SITE is HOST TARGET binding site found in the 3' untranslated region of mRNA encoded by KIAA0026, corresponding to a HOST TARGET binding site such as BINDING SITE I, BINDING SITE II or BINDING SITE III. Table 2 illustrates the complementarity of the nucleotide sequences of KIAA0026 BINDING SITE, designated SEQ ID:14616, to the nucleotide sequence of VGAM2358 RNA, herein designated VGAM RNA, also designated SEQ ID:5069.

Another function of VGAM2358 is therefore inhibition of KIAA0026 (Accession NM_012286). Accordingly, utilities of VGAM2358 include diagnosis, prevention and treatment of diseases and clinical conditions associated with KIAA0026. KIAA0152 (Accession NM_014730) is another VGAM2358 host target gene. KIAA0152 BINDING SITE is HOST TARGET binding site found in the 3' untranslated region of mRNA encoded by KIAA0152, corresponding to a HOST TARGET binding site such as BINDING SITE I, BINDING SITE II or BINDING SITE III. Table 2 illustrates the complementarity of the nucleotide sequences of KIAA0152 BINDING SITE, designated SEQ ID:16342, to the nucleotide sequence of VGAM2358 RNA, herein designated VGAM RNA, also designated SEQ ID:5069.

Another function of VGAM2358 is therefore inhibition of KIAA0152 (Accession NM_014730). Accordingly, utilities of VGAM2358 include diagnosis, prevention and treatment of diseases and clinical conditions associated with KIAA0152. KIAA0285 (Accession NM_014807) is another VGAM2358 host target gene. KIAA0285 BINDING SITE is HOST TARGET binding site found in the 3' untranslated region of mRNA encoded by KIAA0285, corresponding to a HOST TARGET binding site such as BINDING SITE I, BINDING SITE II or BINDING SITE III. Table 2 illustrates the complementarity of the nucleotide sequences of KIAA0285 BINDING SITE, designated SEQ ID:16753, to the nucleotide sequence of VGAM2358 RNA, herein designated VGAM RNA, also designated SEQ ID:5069.

Another function of VGAM2358 is therefore inhibition of KIAA0285 (Accession NM_014807). Accordingly, utilities of VGAM2358 include diagnosis, prevention and treatment of diseases and clinical conditions associated with KIAA0285. KIAA0513 (Accession NM_014732) is another VGAM2358 host target gene. KIAA0513 BINDING SITE is HOST TARGET binding site found in the 5' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16365, to the nucleotide sequence of VGAM2358 RNA, herein designated VGAM RNA, also designated SEQ ID:5069.

Another function of VGAM2358 is therefore inhibition of KIAA0513 (Accession NM_014732). Accordingly, utilities of VGAM2358 include diagnosis, prevention and treatment of diseases and clinical conditions associated with KIAA0513. KIAA0767 (Accession XM_027105) is another VGAM2358 host target gene. KIAA0767 BINDING SITE is HOST TARGET binding site found in the 3' untranslated region of mRNA encoded by KIAA0767, corresponding to a HOST TARGET binding site such as BINDING SITE I, BINDING SITE II or BINDING SITE III. Table 2 illustrates the complementarity of the nucleotide sequences of KIAA0767 BINDING SITE, designated SEQ ID:30410, to the nucleotide sequence of VGAM2358 RNA, herein designated VGAM RNA, also designated SEQ ID:5069.

Another function of VGAM2358 is therefore inhibition of KIAA0767 (Accession XM_027105). Accordingly, utilities of VGAM2358 include diagnosis, prevention and treatment of diseases and clinical conditions associated with KIAA0767. KIAA1200 (Accession XM_031054) is another VGAM2358 host target gene. KIAA1200 BINDING SITE is HOST TARGET binding site found in the 3' untranslated region of mRNA encoded by KIAA1200, corresponding to a HOST TARGET binding site such as BINDING SITE I, BINDING SITE II or BINDING SITE III. Table 2 illustrates the complementarity of the nucleotide sequences of KIAA1200 BINDING SITE, designated SEQ ID:31265, to the nucleotide sequence of VGAM2358 RNA, herein designated VGAM RNA, also designated SEQ ID:5069.

Another function of VGAM2358 is therefore inhibition of KIAA1200 (Accession XM_031054). Accordingly, utilities of VGAM2358 include diagnosis, prevention and treatment of diseases and clinical conditions associated with KIAA1200. KIAA1257 (Accession XM_031577) is another VGAM2358 host target gene. KIAA1257 BINDING SITE1 and KIAA1257 BINDING SITE2 are HOST TARGET binding sites found in untranslated regions of mRNA encoded by KIAA1257, corresponding to HOST TARGET binding sites such as BINDING SITE I, BINDING SITE II or BINDING SITE III. Table 2 illustrates the complementarity of the nucleotide sequences of KIAA1257 BINDING SITE1 and KIAA1257 BINDING SITE2, designated SEQ ID:31440 and SEQ ID:31441 respectively, to the nucleotide sequence of VGAM2358 RNA, herein designated VGAM RNA, also designated SEQ ID:5069.

Another function of VGAM2358 is therefore inhibition of KIAA1257 (Accession XM_031577). Accordingly, utilities of VGAM2358 include diagnosis, prevention and treatment of diseases and clinical conditions associated with KIAA1257. KIAA1649 (Accession XM_040095) is another VGAM2358 host target gene. KIAA1649 BINDING SITE1 and KIAA1649 BINDING SITE2 are HOST TARGET binding sites found in untranslated regions of mRNA encoded by KIAA1649, corresponding to HOST TARGET binding sites such as BINDING SITE I, BINDING SITE II or BINDING SITE III. Table 2 illustrates the complementarity of the nucleotide sequences of KIAA1649 BINDING SITE1 and KIAA1649 BINDING SITE2, designated SEQ ID:33259 and SEQ ID:26111 respectively, to the nucleotide sequence of VGAM2358 RNA, herein designated VGAM RNA, also designated SEQ ID:5069.

Another function of VGAM2358 is therefore inhibition of KIAA1649 (Accession XM_040095). Accordingly, utilities of VGAM2358 include diagnosis, prevention and treatment of diseases and clinical conditions associated with KIAA1649. Kruppel-like Factor 12 (KLF12, Accession NM_016285) is another VGAM2358 host target gene. KLF12 BINDING SITE1 and KLF12 BINDING SITE2 are HOST TARGET binding sites found in untranslated regions of mRNA encoded by KLF12, corresponding to HOST TARGET binding sites such as BINDING SITE I, BINDING SITE II or BINDING SITE III. Table 2 illustrates the complementarity of the nucleotide sequences of KLF12 BINDING SITE1 and KLF12 BINDING SITE2, designated SEQ ID:18411 and SEQ ID:14120 respectively, to the nucleotide sequence of VGAM2358 RNA, herein designated VGAM RNA, also designated SEQ ID:5069.

Another function of VGAM2358 is therefore inhibition of Kruppel-like Factor 12 (KLF12, Accession NM_016285). Accordingly, utilities of VGAM2358 include diagnosis, prevention and treatment of diseases and clinical conditions associated with KLF12. Mannosidase, Beta A, Lysosomal-like (MANBAL, Accession NM_022077) is another VGAM2358 host target gene. MANBAL BINDING SITE is HOST TARGET binding site found in the 5' untranslated region of mRNA encoded by MANBAL, corresponding to a HOST TARGET binding site such as BINDING SITE I, BINDING SITE II or BINDING SITE III. Table 2 illustrates the complementarity of the nucleotide sequences of MANBAL BINDING SITE, designated SEQ ID:22622, to the nucleotide sequence of VGAM2358 RNA, herein designated VGAM RNA, also designated SEQ ID:5069.

Another function of VGAM2358 is therefore inhibition of Mannosidase, Beta A, Lysosomal-like (MANBAL, Accession NM_022077). Accordingly, utilities of VGAM2358 include diagnosis, prevention and treatment of diseases and clinical conditions associated with MANBAL. MGC14836 (Accession NM_033412) is another VGAM2358 host target gene. MGC14836 BINDING SITE is HOST TARGET binding site found in the 3' untranslated region of mRNA encoded by MGC14836, corresponding to a HOST TARGET binding site such as BINDING SITE I, BINDING SITE II or BINDING SITE III. Table 2 illustrates the complementarity of the nucleotide sequences of MGC14836 BINDING SITE, designated SEQ ID:27237, to the nucleotide sequence of VGAM2358 RNA, herein designated VGAM RNA, also designated SEQ ID:5069.

Another function of VGAM2358 is therefore inhibition of MGC14836 (Accession NM_033412). Accordingly, utilities of VGAM2358 include diagnosis, prevention and treatment of diseases and clinical conditions associated with MGC14836. MGC3222 (Accession NM_024334) is another VGAM2358 host target gene. MGC3222 BINDING SITE is HOST TARGET binding site found in the 3' untranslated region of mRNA encoded by MGC3222, corresponding to a HOST TARGET binding site such as BINDING SITE I, BINDING SITE II or BINDING SITE III. Table 2 illustrates the complementarity of the nucleotide sequences of MGC3222 BINDING SITE, designated SEQ ID:23642, to the nucleotide sequence of VGAM2358 RNA, herein designated VGAM RNA, also designated SEQ ID:5069.

Another function of VGAM2358 is therefore inhibition of MGC3222 (Accession NM_024334). Accordingly, utilities of VGAM2358 include diagnosis, prevention and treatment of diseases and clinical conditions associated with MGC3222. moblak (Accession NM_130807) is another VGAM2358 host target gene. moblak BINDING SITE is HOST TARGET binding site found in the 3' untranslated region of mRNA encoded by moblak, corresponding to a HOST TARGET binding site such as BINDING SITE I, BINDING SITE II or BINDING SITE III. Table 2 illustrates the complementarity of the nucleotide sequences of moblak BINDING SITE, designated SEQ ID:28313, to the nucleotide sequence of VGAM2358 RNA, herein designated VGAM RNA, also designated SEQ ID:5069.

Another function of VGAM2358 is therefore inhibition of moblak (Accession NM_130807). Accordingly, utilities of VGAM2358 include diagnosis, prevention and treatment of diseases and clinical conditions associated with moblak. NICE-3 (Accession NM_015449) is another VGAM2358 host target gene. NICE-3 BINDING SITE is HOST TARGET binding site found in the 3' untranslated region of mRNA encoded by NICE-3, corresponding to a HOST TARGET binding site such as BINDING SITE I, BINDING SITE II or BINDING SITE III. Table 2 illustrates the complementarity of the nucleotide sequences of NICE-3 BINDING SITE, designated SEQ ID:17735, to the nucleotide sequence of VGAM2358 RNA, herein designated VGAM RNA, also designated SEQ ID:5069.

Another function of VGAM2358 is therefore inhibition of NICE-3 (Accession NM_015449). Accordingly, utilities of VGAM2358 include diagnosis, prevention and treatment of diseases and clinical conditions associated with NICE-3. PILR(ALPHA) (Accession NM_013439) is another VGAM2358 host target gene. PILR(ALPHA) BINDING SITE is HOST TARGET binding site found in the 5' untranslated region of mRNA encoded by PILR(ALPHA), corresponding to a HOST TARGET binding site such as BINDING SITE I, BINDING SITE II or BINDING SITE III. Table 2 illustrates the complementarity of the nucleotide sequences of PILR(ALPHA) BINDING SITE, designated SEQ ID:15103, to the nucleotide sequence of VGAM2358 RNA, herein designated VGAM RNA, also designated SEQ ID:5069.

Another function of VGAM2358 is therefore inhibition of PILR(ALPHA) (Accession NM_013439). Accordingly, utilities of VGAM2358 include diagnosis, prevention and treatment of diseases and clinical conditions associated with PILR (ALPHA). PIP3-E (Accession XM_039749) is another VGAM2358 host target gene. PIP3-E BINDING SITE is HOST TARGET binding site found in the 3' untranslated region of mRNA encoded by PIP3-E, corresponding to a HOST TARGET binding site such as BINDING SITE I, BINDING SITE II or BINDING SITE III. Table 2 illustrates the complementarity of the nucleotide sequences of PIP3-E BINDING SITE, designated SEQ ID:33182, to the nucleotide sequence of VGAM2358 RNA, herein designated VGAM RNA, also designated SEQ ID:5069.

Another function of VGAM2358 is therefore inhibition of PIP3-E (Accession XM_039749). Accordingly, utilities of VGAM2358 include diagnosis, prevention and treatment of diseases and clinical conditions associated with PIP3-E. Quiescin Q6 (QSCN6, Accession NM_002826) is another VGAM2358 host target gene. QSCN6 BINDING SITE is HOST TARGET binding site found in the 3' untranslated region of mRNA encoded by QSCN6, corresponding to a HOST TARGET binding site such as BINDING SITE I, BINDING SITE II or BINDING SITE III. Table 2 illustrates the complementarity of the nucleotide sequences of QSCN6 BINDING SITE, designated SEQ ID:8699, to the nucleotide sequence of VGAM2358 RNA, herein designated VGAM RNA, also designated SEQ ID:5069.

Another function of VGAM2358 is therefore inhibition of Quiescin Q6 (QSCN6, Accession NM_002826). Accordingly, utilities of VGAM2358 include diagnosis, prevention and treatment of diseases and clinical conditions associated with QSCN6. Rpo1-2 (Accession NM_019014) is another VGAM2358 host target gene. Rpo1-2 BINDING SITE1 and Rpo1-2 BINDING SITE2 are HOST TARGET binding sites found in untranslated regions of mRNA encoded by Rpo1-2, corresponding to HOST TARGET binding sites such as BINDING SITE I, BINDING SITE II or BINDING SITE III. Table 2 illustrates the complementarity of the nucleotide sequences of Rpo1-2 BINDING SITE1 and Rpo1-2 BINDING SITE2, designated SEQ ID:21100 and SEQ ID:25933 respectively, to the nucleotide sequence of VGAM2358 RNA, herein designated VGAM RNA, also designated SEQ ID:5069.

Another function of VGAM2358 is therefore inhibition of Rpo1-2 (Accession NM_019014). Accordingly, utilities of VGAM2358 include diagnosis, prevention and treatment of diseases and clinical conditions associated with Rpo1-2. Solute Carrier Family 31 (copper transporters), Member 2 (SLC31A2, Accession XM_011776) is another VGAM2358 host target gene. SLC31A2 BINDING SITE is HOST TARGET binding site found in the 3' untranslated region of mRNA encoded by SLC31A2, corresponding to a HOST TARGET binding site such as BINDING SITE I, BINDING SITE II or BINDING SITE III. Table 2 illustrates the complementarity of the nucleotide sequences of SLC31A2 BINDING SITE, designated SEQ ID:30193, to the nucleotide sequence of VGAM2358 RNA, herein designated VGAM RNA, also designated SEQ ID:5069.

Another function of VGAM2358 is therefore inhibition of Solute Carrier Family 31 (copper transporters), Member 2 (SLC31A2, Accession XM_011776). Accordingly, utilities of VGAM2358 include diagnosis, prevention and treatment of diseases and clinical conditions associated with SLC31A2. Williams Beuren Syndrome Chromosome Region 20A (WBSCR20A, Accession NM_032158) is another VGAM2358 host target gene. WBSCR20A BINDING SITE is HOST TARGET binding site found in the 5' untranslated region of mRNA encoded by WBSCR20A, corresponding to a HOST TARGET binding site such as BINDING SITE I, BINDING SITE II or BINDING SITE III. Table 2 illustrates the complementarity of the nucleotide sequences of WBSCR20A BINDING SITE, designated SEQ ID:25861, to the nucleotide sequence of VGAM2358 RNA, herein designated VGAM RNA, also designated SEQ ID:5069.

Another function of VGAM2358 is therefore inhibition of Williams Beuren Syndrome Chromosome Region 20A (WBSCR20A, Accession NM_032158). Accordingly, utilities of VGAM2358 include diagnosis, prevention and treatment of diseases and clinical conditions associated with WBSCR20A. ZFD25 (Accession NM_016220) is another VGAM2358 host target gene. ZFD25 BINDING SITE is HOST TARGET binding site found in the 5' untranslated region of mRNA encoded by ZFD25, corresponding to a HOST TARGET binding site such as BINDING SITE I, BINDING SITE II or BINDING SITE III. Table 2 illustrates the complementarity of the nucleotide sequences of ZFD25 BINDING SITE, designated SEQ ID:18325, to the nucleotide sequence of VGAM2358 RNA, herein designated VGAM RNA, also designated SEQ ID:5069.

Another function of VGAM2358 is therefore inhibition of ZFD25 (Accession NM_016220). Accordingly, utilities of VGAM2358 include diagnosis, prevention and treatment of diseases and clinical conditions associated with ZFD25. LOC113675 (Accession NM_138432) is another VGAM2358 host target gene. LOC113675 BINDING SITE is HOST TARGET binding site found in the 5' untranslated region of mRNA encoded by LOC113675, corresponding to a HOST TARGET binding site such as BINDING SITE I, BINDING SITE II or BINDING SITE III. Table 2 illustrates the complementarity of the nucleotide sequences of LOC113675 BINDING SITE, designated SEQ ID:28798, to the nucleotide sequence of VGAM2358 RNA, herein designated VGAM RNA, also designated SEQ ID:5069.

Another function of VGAM2358 is therefore inhibition of LOC113675 (Accession NM_138432). Accordingly, utilities of VGAM2358 include diagnosis, prevention and treatment of diseases and clinical conditions associated with LOC113675. LOC115294 (Accession XM_054302) is another VGAM2358 host target gene. LOC115294 BINDING SITE is HOST TARGET binding site found in the 3' untranslated region of mRNA encoded by LOC115294, corresponding to a HOST TARGET binding site such as BINDING SITE I, BINDING SITE II or BINDING SITE III. Table 2 illustrates the complementarity of the nucleotide sequences of LOC115294 BINDING SITE, designated SEQ ID:36147, to the nucleotide sequence of VGAM2358 RNA, herein designated VGAM RNA, also designated SEQ ID:5069.

Another function of VGAM2358 is therefore inhibition of LOC115294 (Accession XM_054302). Accordingly, utilities of VGAM2358 include diagnosis, prevention and treatment of diseases and clinical conditions associated with LOC115294. LOC130813 (Accession XM_065904) is another VGAM2358 host target gene. LOC130813 BINDING SITE is HOST TARGET binding site found in the 3' untranslated region of mRNA encoded by LOC130813, corresponding to a HOST TARGET binding site such as BINDING SITE I, BINDING SITE II or BINDING SITE III. Table 2 illustrates the complementarity of the nucleotide sequences of LOC130813 BINDING SITE, designated SEQ ID:37316, to the nucleotide sequence of VGAM2358 RNA, herein designated VGAM RNA, also designated SEQ ID:5069.

Another function of VGAM2358 is therefore inhibition of LOC130813 (Accession XM_065904). Accordingly, utilities of VGAM2358 include diagnosis, prevention and treatment of diseases and clinical conditions associated with LOC130813. LOC143241 (Accession NM_138812) is another VGAM2358 host target gene. LOC143241 BINDING SITE is HOST TARGET binding site found in the 5' untranslated region of mRNA encoded by LOC143241, corresponding to a HOST TARGET binding site such as BINDING SITE I, BINDING SITE II or BINDING SITE III. Table 2 illustrates the complementarity of the nucleotide sequences of LOC143241 BINDING SITE, designated SEQ ID:29037, to the nucleotide sequence of VGAM2358 RNA, herein designated VGAM RNA, also designated SEQ ID:5069.

Another function of VGAM2358 is therefore inhibition of LOC143241 (Accession NM_138812). Accordingly, utilities of VGAM2358 include diagnosis, prevention and treatment of diseases and clinical conditions associated with LOC143241. LOC144248 (Accession XM_084786) is another VGAM2358 host target gene. LOC144248 BINDING SITE is HOST TARGET binding site found in the 5' untranslated region of mRNA encoded by LOC144248, corresponding to a HOST TARGET binding site such as BINDING SITE I, BINDING SITE II or BINDING SITE III. Table 2 illustrates the complementarity of the nucleotide sequences of LOC144248 BINDING SITE, designated SEQ ID:37701, to the nucleotide sequence of VGAM2358 RNA, herein designated VGAM RNA, also designated SEQ ID:5069.

Another function of VGAM2358 is therefore inhibition of LOC144248 (Accession XM_084786). Accordingly, utilities of VGAM2358 include diagnosis, prevention and treatment of diseases and clinical conditions associated with LOC144248. LOC144453 (Accession XM_084869) is another VGAM2358 host target gene. LOC144453 BINDING SITE is HOST TARGET binding site found in the 3' untranslated region of mRNA encoded by LOC144453, corresponding to a HOST TARGET binding site such as BINDING SITE I, BINDING SITE II or BINDING SITE III. Table 2 illustrates the complementarity of the nucleotide sequences of LOC144453 BINDING SITE, designated SEQ ID:37746, to the nucleotide sequence of VGAM2358 RNA, herein designated VGAM RNA, also designated SEQ ID:5069.

Another function of VGAM2358 is therefore inhibition of LOC144453 (Accession XM_084869). Accordingly, utilities of VGAM2358 include diagnosis, prevention and treatment of diseases and clinical conditions associated with LOC144453. LOC144571 (Accession XM_096630) is another VGAM2358 host target gene. LOC144571 BINDING SITE is HOST TARGET binding site found in the 3' untranslated region of mRNA encoded by LOC144571, corresponding to a HOST TARGET binding site such as BINDING SITE I, BINDING SITE II or BINDING SITE III. Table 2 illustrates the complementarity of the nucleotide sequences of LOC144571 BINDING SITE, designated SEQ ID:40441, to the nucleotide sequence of VGAM2358 RNA, herein designated VGAM RNA, also designated SEQ ID:5069.

Another function of VGAM2358 is therefore inhibition of LOC144571 (Accession XM_096630). Accordingly, utilities of VGAM2358 include diagnosis, prevention and treatment of diseases and clinical conditions associated with LOC144571. LOC144742 (Accession XM_084949) is another VGAM2358 host target gene. LOC144742 BINDING SITE is HOST TARGET binding site found in the 5' untranslated region of mRNA encoded by LOC144742, corresponding to a HOST TARGET binding site such as BINDING SITE I, BINDING SITE II or BINDING SITE III. Table 2 illustrates the complementarity of the nucleotide sequences of LOC144742 BINDING SITE, designated SEQ ID:37781, to the nucleotide sequence of VGAM2358 RNA, herein designated VGAM RNA, also designated SEQ ID:5069.

Another function of VGAM2358 is therefore inhibition of LOC144742 (Accession XM_084949). Accordingly, utilities of VGAM2358 include diagnosis, prevention and treatment of diseases and clinical conditions associated with LOC144742. LOC145216 (Accession XM_096730) is another VGAM2358 host target gene. LOC145216 BINDING SITE is HOST TARGET binding site found in the 3' untranslated region of mRNA encoded by LOC145216, corresponding to a HOST TARGET binding site such as BINDING SITE I, BINDING SITE II or BINDING SITE III. Table 2 illustrates the complementarity of the nucleotide sequences of LOC145216 BINDING SITE, designated SEQ ID:40508, to the nucleotide sequence of VGAM2358 RNA, herein designated VGAM RNA, also designated SEQ ID:5069.

Another function of VGAM2358 is therefore inhibition of LOC145216 (Accession XM_096730). Accordingly, utilities of VGAM2358 include diagnosis, prevention and treatment of diseases and clinical conditions associated with LOC145216. LOC146909 (Accession XM_085634) is another VGAM2358 host target gene. LOC146909 BINDING SITE is HOST TARGET binding site found in the 3' untranslated region of mRNA encoded by LOC146909, corresponding to a HOST TARGET binding site such as BINDING SITE I, BINDING SITE II or BINDING SITE III. Table 2 illustrates the complementarity of the nucleotide sequences of LOC146909 BINDING SITE, designated SEQ ID:38273, to the nucleotide sequence of VGAM2358 RNA, herein designated VGAM RNA, also designated SEQ ID:5069.

Another function of VGAM2358 is therefore inhibition of LOC146909 (Accession XM_085634). Accordingly, utilities of VGAM2358 include diagnosis, prevention and treatment of diseases and clinical conditions associated with LOC146909. LOC148709 (Accession XM_086281) is another VGAM2358 host target gene. LOC148709 BINDING SITE is HOST TARGET binding site found in the 3' untranslated region of mRNA encoded by LOC148709, corresponding to a HOST TARGET binding site such as BINDING SITE I, BINDING SITE II or BINDING SITE III. Table 2 illustrates the complementarity of the nucleotide sequences of LOC148709 BINDING SITE, designated SEQ ID:38585, to the nucleotide sequence of VGAM2358 RNA, herein designated VGAM RNA, also designated SEQ ID:5069.

Another function of VGAM2358 is therefore inhibition of LOC148709 (Accession XM_086281). Accordingly, utilities of VGAM2358 include diagnosis, prevention and treatment of diseases and clinical conditions associated with LOC148709. LOC150054 (Accession XM_097797) is another VGAM2358 host target gene. LOC150054 BINDING SITE is HOST TARGET binding site found in the 5' untranslated region of mRNA encoded by LOC150054, corresponding to a HOST TARGET binding site such as BINDING SITE I, BINDING SITE II or BINDING SITE III. Table 2 illustrates the complementarity of the nucleotide sequences of LOC150054 BINDING SITE, designated SEQ ID:41127, to the nucleotide sequence of VGAM2358 RNA, herein designated VGAM RNA, also designated SEQ ID:5069.

Another function of VGAM2358 is therefore inhibition of LOC150054 (Accession XM_097797). Accordingly, utilities of VGAM2358 include diagnosis, prevention and treatment of diseases and clinical conditions associated with LOC150054. LOC150319 (Accession XM_086816) is another VGAM2358 host target gene. LOC150319 BINDING SITE is HOST TARGET binding site found in the 3' untranslated region of mRNA encoded by LOC150319, corresponding to a HOST TARGET binding site such as BINDING SITE I, BINDING SITE II or BINDING SITE III. Table 2 illustrates the complementarity of the nucleotide sequences of LOC150319 BINDING SITE, designated SEQ ID:38897, to the nucleotide sequence of VGAM2358 RNA, herein designated VGAM RNA, also designated SEQ ID:5069.

Another function of VGAM2358 is therefore inhibition of LOC150319 (Accession XM_086816). Accordingly, utilities of VGAM2358 include diagnosis, prevention and treatment of diseases and clinical conditions associated with LOC150319. LOC151475 (Accession XM_098063) is another VGAM2358 host target gene. LOC151475 BINDING SITE is HOST TARGET binding site found in the 5' untranslated region of mRNA encoded by LOC151475, corresponding to a HOST TARGET binding site such as BINDING SITE I, BINDING SITE II or BINDING SITE III. Table 2 illustrates the complementarity of the nucleotide sequences of LOC151475 BINDING SITE, designated SEQ ID:41361, to the nucleotide sequence of VGAM2358 RNA, herein designated VGAM RNA, also designated SEQ ID:5069.

Another function of VGAM2358 is therefore inhibition of LOC151475 (Accession XM_098063). Accordingly, utilities of VGAM2358 include diagnosis, prevention and treatment of diseases and clinical conditions associated with LOC151475. LOC152445 (Accession XM_098231) is another VGAM2358 host target gene. LOC152445 BINDING SITE is HOST TARGET binding site found in the 3' untranslated region of mRNA encoded by LOC152445, corresponding to a HOST TARGET binding site such as BINDING SITE I, BINDING SITE II or BINDING SITE III. Table 2 illustrates the complementarity of the nucleotide sequences of LOC152445 BINDING SITE, designated SEQ ID:41514, to the nucleotide sequence of VGAM2358 RNA, herein designated VGAM RNA, also designated SEQ ID:5069.

Another function of VGAM2358 is therefore inhibition of LOC152445 (Accession XM_098231). Accordingly, utilities of VGAM2358 include diagnosis, prevention and treatment of diseases and clinical conditions associated with LOC152445. LOC153196 (Accession XM_098323) is another VGAM2358 host target gene. LOC153196 BINDING SITE is HOST TARGET binding site found in the 3' untranslated region of mRNA encoded by LOC153196, corresponding to a HOST TARGET binding site such as BINDING SITE I, BINDING SITE II or BINDING SITE III. Table 2 illustrates the complementarity of the nucleotide sequences of LOC153196 BINDING SITE, designated SEQ ID:41590, to the nucleotide sequence of VGAM2358 RNA, herein designated VGAM RNA, also designated SEQ ID:5069.

Another function of VGAM2358 is therefore inhibition of LOC153196 (Accession XM_098323). Accordingly, utilities of VGAM2358 include diagnosis, prevention and treatment of diseases and clinical conditions associated with LOC153196. LOC158310 (Accession XM_098919) is another VGAM2358 host target gene. LOC158310 BINDING SITE is HOST TARGET binding site found in the 5' untranslated region of mRNA encoded by LOC158310, corresponding to a HOST TARGET binding site such as BINDING SITE I, BINDING SITE II or BINDING SITE III. Table 2 illustrates the complementarity of the nucleotide sequences of LOC158310 BINDING SITE, designated SEQ ID:41951, to the nucleotide sequence of VGAM2358 RNA, herein designated VGAM RNA, also designated SEQ ID:5069.

Another function of VGAM2358 is therefore inhibition of LOC158310 (Accession XM_098919). Accordingly, utilities of VGAM2358 include diagnosis, prevention and treatment of diseases and clinical conditions associated with LOC158310. LOC158382 (Accession XM_098931) is another VGAM2358 host target gene. LOC158382 BINDING SITE is HOST TARGET binding site found in the 3' untranslated region of mRNA encoded by LOC158382, corresponding to a HOST TARGET binding site such as BINDING SITE I, BINDING SITE II or BINDING SITE III. Table 2 illustrates the complementarity of the nucleotide sequences of LOC158382 BINDING SITE, designated SEQ ID:41968, to the nucleotide sequence of VGAM2358 RNA, herein designated VGAM RNA, also designated SEQ ID:5069.

Another function of VGAM2358 is therefore inhibition of LOC158382 (Accession XM_098931). Accordingly, utilities of VGAM2358 include diagnosis, prevention and treatment of diseases and clinical conditions associated with LOC158382. LOC169611 (Accession XM_095809) is another VGAM2358 host target gene. LOC169611 BINDING SITE is HOST TARGET binding site found in the 3' untranslated region of mRNA encoded by LOC169611, corresponding to a HOST TARGET binding site such as BINDING SITE I, BINDING SITE II or BINDING SITE III. Table 2 illustrates the complementarity of the nucleotide sequences of LOC169611 BINDING SITE, designated SEQ ID:40289, to the nucleotide sequence of VGAM2358 RNA, herein designated VGAM RNA, also designated SEQ ID:5069.

Another function of VGAM2358 is therefore inhibition of LOC169611 (Accession XM_095809). Accordingly, utilities of VGAM2358 include diagnosis, prevention and treatment of diseases and clinical conditions associated with LOC169611. LOC170082 (Accession XM_093092) is another VGAM2358 host target gene. LOC170082 BINDING SITE is HOST TARGET binding site found in the 5' untranslated region of mRNA encoded by LOC170082, corresponding to a HOST TARGET binding site such as BINDING SITE I, BINDING SITE II or BINDING SITE III. Table 2 illustrates the complementarity of the nucleotide sequences of LOC170082 BINDING SITE, designated SEQ ID:40172, to the nucleotide sequence of VGAM2358 RNA, herein designated VGAM RNA, also designated SEQ ID:5069.

Another function of VGAM2358 is therefore inhibition of LOC170082 (Accession XM_093092). Accordingly, utilities of VGAM2358 include diagnosis, prevention and treatment of diseases and clinical conditions associated with LOC170082. LOC200059 (Accession XM_114104) is another VGAM2358 host target gene. LOC200059 BINDING SITE is HOST TARGET binding site found in the 3' untranslated region of mRNA encoded by LOC200059, corresponding to a HOST TARGET binding site such as BINDING SITE I, BINDING SITE II or BINDING SITE III. Table 2 illustrates the complementarity of the nucleotide sequences of LOC200059 BINDING SITE, designated SEQ ID:42701, to the nucleotide sequence of VGAM2358 RNA, herein designated VGAM RNA, also designated SEQ ID:5069.

Another function of VGAM2358 is therefore inhibition of LOC200059 (Accession XM_114104). Accordingly, utilities of VGAM2358 include diagnosis, prevention and treatment of diseases and clinical conditions associated with LOC200059. LOC200301 (Accession XM_114197) is another VGAM2358 host target gene. LOC200301 BINDING SITE is HOST TARGET binding site found in the 3' untranslated region of mRNA encoded by LOC200301, corresponding to a HOST TARGET binding site such as BINDING SITE I, BINDING SITE II or BINDING SITE III. Table 2 illustrates the complementarity of the nucleotide sequences of LOC200301 BINDING SITE, designated SEQ ID:42785, to the nucleotide sequence of VGAM2358 RNA, herein designated VGAM RNA, also designated SEQ ID:5069.

Another function of VGAM2358 is therefore inhibition of LOC200301 (Accession XM_114197). Accordingly, utilities of VGAM2358 include diagnosis, prevention and treatment of diseases and clinical conditions associated with LOC200301. LOC220705 (Accession XM_166000) is another VGAM2358 host target gene. LOC220705 BINDING SITE is HOST TARGET binding site found in the 3' untranslated region of mRNA encoded by LOC220705, corresponding to a HOST TARGET binding site such as BINDING SITE I, BINDING SITE II or BINDING SITE III. Table 2 illustrates the complementarity of the nucleotide sequences of LOC220705 BINDING SITE, designated SEQ ID:43836, to the nucleotide sequence of VGAM2358 RNA, herein designated VGAM RNA, also designated SEQ ID:5069.

Another function of VGAM2358 is therefore inhibition of LOC220705 (Accession XM_166000). Accordingly, utilities of VGAM2358 include diagnosis, prevention and treatment of diseases and clinical conditions associated with LOC220705. LOC221354 (Accession XM_166468) is another VGAM2358 host target gene. LOC221354 BINDING SITE is HOST TARGET binding site found in the 3' untranslated region of mRNA encoded by LOC221354, corresponding to a HOST TARGET binding site such as BINDING SITE I, BINDING SITE II or BINDING SITE III. Table 2 illustrates the complementarity of the nucleotide sequences of LOC221354 BINDING SITE, designated SEQ ID:44394, to the nucleotide sequence of VGAM2358 RNA, herein designated VGAM RNA, also designated SEQ ID:5069.

Another function of VGAM2358 is therefore inhibition of LOC221354 (Accession XM_166468). Accordingly, utilities of VGAM2358 include diagnosis, prevention and treatment of diseases and clinical conditions associated with LOC221354. LOC255454 (Accession XM_175124) is another VGAM2358 host target gene. LOC255454 BINDING SITE is HOST TARGET binding site found in the 5' untranslated region of mRNA encoded by LOC255454, corresponding to a HOST TARGET binding site such as BINDING SITE I, BINDING SITE II or BINDING SITE III. Table 2 illustrates the complementarity of the nucleotide sequences of LOC255454 BINDING SITE, designated SEQ ID:46613, to the nucleotide sequence of VGAM2358 RNA, herein designated VGAM RNA, also designated SEQ ID:5069.

Another function of VGAM2358 is therefore inhibition of LOC255454 (Accession XM_175124). Accordingly, utilities of VGAM2358 include diagnosis, prevention and treatment of diseases and clinical conditions associated with LOC255454. LOC255919 (Accession XM_170794) is another VGAM2358 host target gene. LOC255919 BINDING SITE is HOST TARGET binding site found in the 3' untranslated region of mRNA encoded by LOC255919, corresponding to a HOST TARGET binding site such as BINDING SITE I, BINDING SITE II or BINDING SITE III. Table 2 illustrates the complementarity of the nucleotide sequences of LOC255919 BINDING SITE, designated SEQ ID:45558, to the nucleotide sequence of VGAM2358 RNA, herein designated VGAM RNA, also designated SEQ ID:5069.

Another function of VGAM2358 is therefore inhibition of LOC255919 (Accession XM_170794). Accordingly, utilities of VGAM2358 include diagnosis, prevention and treatment of diseases and clinical conditions associated with LOC255919. LOC51008 (Accession NM_015947) is another VGAM2358 host target gene. LOC51008 BINDING SITE is HOST TARGET binding site found in the 5' untranslated region of mRNA encoded by LOC51008, corresponding to a HOST TARGET binding site such as BINDING SITE I, BINDING SITE II or BINDING SITE III. Table 2 illustrates the complementarity of the nucleotide sequences of LOC51008 BINDING SITE, designated SEQ ID:18066, to the nucleotide sequence of VGAM2358 RNA, herein designated VGAM RNA, also designated SEQ ID:5069.

Another function of VGAM2358 is therefore inhibition of LOC51008 (Accession NM_015947). Accordingly, utilities of VGAM2358 include diagnosis, prevention and treatment of diseases and clinical conditions associated with LOC51008. LOC90141 (Accession XM_029373) is another VGAM2358 host target gene. LOC90141 BINDING SITE is HOST TARGET binding site found in the 3' untranslated region of mRNA encoded by LOC90141, corresponding to a HOST TARGET binding site such as BINDING SITE I, BINDING SITE II or BINDING SITE III. Table 2 illustrates the complementarity of the nucleotide sequences of LOC90141 BINDING SITE, designated SEQ ID:30883, to the nucleotide sequence of VGAM2358 RNA, herein designated VGAM RNA, also designated SEQ ID:5069.

Another function of VGAM2358 is therefore inhibition of LOC90141 (Accession XM_029373). Accordingly, utilities of VGAM2358 include diagnosis, prevention and treatment of diseases and clinical conditions associated with LOC90141. LOC90333 (Accession XM_030958) is another VGAM2358 host target gene. LOC90333 BINDING SITE is HOST TARGET binding site found in the 5' untranslated region of mRNA encoded by LOC90333, corresponding to a HOST TARGET binding site such as BINDING SITE I, BINDING SITE II or BINDING SITE III. Table 2 illustrates the complementarity of the nucleotide sequences of LOC90333 BINDING SITE, designated SEQ ID:31229, to the nucleotide sequence of VGAM2358 RNA, herein designated VGAM RNA, also designated SEQ ID:5069.

Another function of VGAM2358 is therefore inhibition of LOC90333 (Accession XM_030958). Accordingly, utilities of VGAM2358 include diagnosis, prevention and treatment of diseases and clinical conditions associated with LOC90333. LOC90371 (Accession XM_031261) is another VGAM2358 host target gene. LOC90371 BINDING SITE is HOST TARGET binding site found in the 5' untranslated region of mRNA encoded by LOC90371, corresponding to a HOST TARGET binding site such as BINDING SITE I, BINDING SITE II or BINDING SITE III. Table 2 illustrates the complementarity of the nucleotide sequences of LOC90371 BINDING SITE, designated SEQ ID:31324, to the nucleotide sequence of VGAM2358 RNA, herein designated VGAM RNA, also designated SEQ ID:5069.

Another function of VGAM2358 is therefore inhibition of LOC90371 (Accession XM_031261). Accordingly, utilities of VGAM2358 include diagnosis, prevention and treatment of diseases and clinical conditions associated with LOC90371. LOC91923 (Accession XM_041526) is another VGAM2358 host target gene. LOC91923 BINDING SITE is HOST TARGET binding site found in the 5' untranslated region of mRNA encoded by LOC91923, corresponding to a HOST TARGET binding site such as BINDING SITE I, BINDING SITE II or BINDING SITE III. Table 2 illustrates the complementarity of the nucleotide sequences of LOC91923 BINDING SITE, designated SEQ ID:33545, to the nucleotide sequence of VGAM2358 RNA, herein designated VGAM RNA, also designated SEQ ID:5069.

Another function of VGAM2358 is therefore inhibition of LOC91923 (Accession XM_041526). Accordingly, utilities of VGAM2358 include diagnosis, prevention and treatment of diseases and clinical conditions associated with LOC91923. FIG. 1 further provides a conceptual description of a novel bioinformatically detected viral gene of the present invention, referred to here as Viral Genomic Address Messenger 2359 (VGAM2359) viral gene, which modulates expression of respective host target genes thereof, the function and utility of which host target genes is known in the art.

VGAM2359 is a novel bioinformatically detected regulatory, non protein coding, viral micro RNA (miRNA) gene. The method by which VGAM2359 was detected is described hereinabove with reference to FIGS. 1-8.

VGAM2359 gene, herein designated VGAM GENE, is a viral gene contained in the genome of Equine Herpesvirus 2. VGAM2359 host target gene, herein designated VGAM HOST TARGET GENE, is a human gene contained in the human genome.

VGAM2359 gene encodes a VGAM2359 precursor RNA, herein designated VGAM PRECURSOR RNA. Similar to other miRNA genes, and unlike most ordinary genes, VGAM2359 precursor RNA does not encode a protein. A nucleotide sequence identical or highly similar to the nucleotide sequence of VGAM2359 precursor RNA is designated SEQ ID:2345, and is provided hereinbelow with reference to the sequence listing part. Nucleotide sequence SEQ ID:2345 is located at position 34353 relative to the genome of Equine Herpesvirus 2.

VGAM2359 precursor RNA folds onto itself, forming VGAM2359 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2359 folded precursor RNA into VGAM2359 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM2359 RNA is designated SEQ ID:5070, and is provided hereinbelow with reference to the sequence listing part.

VGAM2359 host target gene, herein designated VGAM HOST TARGET GENE, encodes a corresponding messenger RNA, VGAM2359 host target RNA, herein designated VGAM HOST TARGET RNA. VGAM2359 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2359 RNA, herein designated VGAM RNA, binds complementarily to one or more host target binding sites located in untranslated regions of VGAM2359 host target RNA, herein designated VGAM HOST TARGET RNA. This complementary binding is due to the fact that the nucleotide sequence of VGAM2359 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2359 RNA, herein designated VGAM RNA, may have a different number of host target binding sites in untranslated regions of a VGAM2359 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2359 RNA, herein designated VGAM RNA, to host target binding sites on VGAM2359 host target RNA, herein designated VGAM HOST TARGET RNA, such as BINDING SITE I, BINDING SITE II and BINDING SITE III, inhibits translation of VGAM2359 host target RNA into VGAM2359 host target protein, herein designated VGAM HOST TARGET PROTEIN. VGAM host target protein is therefore outlined by a broken line.

It is appreciated that VGAM2359 host target gene, herein designated VGAM HOST TARGET GENE, in fact represents a plurality of VGAM2359 host target genes. The mRNA of each one of this plurality of VGAM2359 host target genes comprises one or more host target binding sites, each having a nucleotide sequence which is at least partly complementary to VGAM2359 RNA, herein designated VGAM RNA, and which when bound by VGAM2359 RNA causes inhibition of translation of respective one or more VGAM2359 host target proteins.

It is further appreciated by one skilled in the art that the mode of translational inhibition illustrated by FIG. 1 with specific reference to translational inhibition exerted by VGAM2359 gene, herein designated VGAM GENE, on one or more VGAM2359 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2359 is inhibition of expression of host target genes, as part of a novel viral mechanism of attacking a host. Accordingly, utilities of VGAM2359 include diagnosis, prevention and treatment of viral infection by Equine Herpesvirus 2. Specific functions, and accordingly utilities, of VGAM2359 correlate with, and may be deduced from, the identity of the host target genes which VGAM2359 binds and inhibits, and the function of these host target genes, as elaborated hereinbelow.

Nucleotide sequences of the VGAM2359 precursor RNA, herein designated VGAM PRECURSOR RNA, and of the 'diced' VGAM2359 RNA, herein designated VGAM RNA, and a schematic representation of the secondary folding of VGAM2359 folded precursor RNA, herein designated VGAM FOLDED PRECURSOR RNA, of VGAM2359 are further described hereinbelow with reference to Table 1.

Nucleotide sequences of host target binding sites, such as BINDING SITE-I, BINDING SITE-II and BINDING SITE-III of FIG. 1, found on VGAM2359 host target RNA, and schematic representation of the complementarity of each of these host target binding sites to VGAM2359 RNA, herein designated VGAM RNA, are described hereinbelow with reference to Table 2.

As mentioned hereinabove with reference to FIG. 1, a function of VGAM2359 gene, herein designated VGAM is inhibition of expression of VGAM2359 target genes. It is appreciated that specific functions, and accordingly utilities, of VGAM2359 correlate with, and may be deduced from, the identity of the target genes which VGAM2359 binds and inhibits, and the function of these target genes, as elaborated hereinbelow.

BTG Family, Member 2 (BTG2, Accession NM_006763) is a VGAM2359 host target gene. BTG2 BINDING SITE is HOST TARGET binding site found in the 3' untranslated region of mRNA encoded by BTG2, corresponding to a HOST TARGET binding site such as BINDING SITE I, BINDING SITE II or BINDING SITE III. Table 2 illustrates the complementarity of the nucleotide sequences of BTG2 BINDING SITE, designated SEQ ID:13622, to the nucleotide sequence of VGAM2359 RNA, herein designated VGAM RNA, also designated SEQ ID:5070.

A function of VGAM2359 is therefore inhibition of BTG Family, Member 2 (BTG2, Accession NM_006763). Accordingly, utilities of VGAM2359 include diagnosis, prevention and treatment of diseases and clinical conditions associated with BTG2. Glutamate Receptor, Ionotropic, Kainate 3 (GRIK3, Accession NM_000831) is another VGAM2359 host target gene. GRIK3 BINDING SITE is HOST TARGET binding site found in the 3' untranslated region of mRNA encoded by GRIK3, corresponding to a HOST TARGET binding site such as BINDING SITE I, BINDING SITE II or BINDING SITE III. Table 2 illustrates the complementarity of the nucleotide sequences of GRIK3 BINDING SITE, designated SEQ ID:6486, to the nucleotide sequence of VGAM2359 RNA, herein designated VGAM RNA, also designated SEQ ID:5070.

Another function of VGAM2359 is therefore inhibition of Glutamate Receptor, Ionotropic, Kainate 3 (GRIK3, Accession NM_000831). Accordingly, utilities of VGAM2359 include diagnosis, prevention and treatment of diseases and clinical conditions associated with GRIK3. MLL Sep.in-like Fusion (MSF, Accession XM_113892) is another VGAM2359 host target gene. MSF BINDING SITE is HOST TARGET binding site found in the 3' untranslated region of mRNA encoded by MSF, corresponding to a HOST TARGET binding site such as BINDING SITE I, BINDING SITE II or BINDING SITE III. Table 2 illustrates the complementarity of the nucleotide sequences of MSF BINDING SITE, designated SEQ ID:42522, to the nucleotide sequence of VGAM2359 RNA, herein designated VGAM RNA, also designated SEQ ID:5070.

Another function of VGAM2359 is therefore inhibition of MLL Sep.in-like Fusion (MSF, Accession XM_113892), a gene which plays a role in the cell cycle. Accordingly, utilities of VGAM2359 include diagnosis, prevention and treatment of diseases and clinical conditions associated with MSF. The function of MSF and its association with various diseases and clinical conditions, has been established by previous studies, as described hereinabove with reference to VGAM514. Zinc Finger Protein 36 (KOX 18) (ZNF36, Accession XM_168302) is another VGAM2359 host target gene. ZNF36 BINDING SITE is HOST TARGET binding site found in the 3' untranslated region of mRNA encoded by ZNF36, corresponding to a HOST TARGET binding site such as BINDING SITE I, BINDING SITE II or BINDING SITE III. Table 2 illustrates the complementarity of the nucleotide sequences of ZNF36 BINDING SITE, designated SEQ ID:45105, to the nucleotide sequence of VGAM2359 RNA, herein designated VGAM RNA, also designated SEQ ID:5070.

Another function of VGAM2359 is therefore inhibition of Zinc Finger Protein 36 (KOX 18) (ZNF36, Accession XM_168302), a gene which may be involved in transcriptional regulation. Accordingly, utilities of VGAM2359 include diagnosis, prevention and treatment of diseases and clinical conditions associated with ZNF36. The function of ZNF36 and its association with various diseases and clinical conditions, has been established by previous studies, as described hereinabove with reference to VGAM804. KIAA0469 (Accession NM_014851) is another VGAM2359 host target gene. KIAA0469 BINDING SITE is HOST TARGET binding site found in the 3' untranslated region of mRNA encoded by KIAA0469, corresponding to a HOST TARGET binding site such as BINDING SITE I, BINDING SITE II or BINDING SITE III. Table 2 illustrates the complementarity of the nucleotide sequences of KIAA0469 BINDING SITE, designated SEQ ID:16888, to the nucleotide sequence of VGAM2359 RNA, herein designated VGAM RNA, also designated SEQ ID:5070.

Another function of VGAM2359 is therefore inhibition of KIAA0469 (Accession NM_014851). Accordingly, utilities of VGAM2359 include diagnosis, prevention and treatment of diseases and clinical conditions associated with KIAA0469. SWI/SNF Related, Matrix Associated, Actin Dependent Regulator of Chromatin, Subfamily F, Member 1 (SMARCF1, Accession NM_018450) is another VGAM2359 host target gene. SMARCF1 BINDING SITE is HOST TARGET binding site found in the 3' untranslated region of mRNA encoded by SMARCF1, corresponding to a HOST TARGET binding site such as BINDING SITE I, BINDING SITE II or BINDING SITE III. Table 2 illustrates the complementarity of the nucleotide sequences of SMARCF1 BINDING SITE, designated SEQ ID:20518, to the nucleotide sequence of VGAM2359 RNA, herein designated VGAM RNA, also designated SEQ ID:5070.

Another function of VGAM2359 is therefore inhibition of SWI/SNF Related, Matrix Associated, Actin Dependent Regulator of Chromatin, Subfamily F, Member 1 (SMARCF1, Accession NM_018450). Accordingly, utilities of VGAM2359 include diagnosis, prevention and treatment of diseases and clinical conditions associated with SMARCF1. LOC115708 (Accession XM_056552) is another VGAM2359 host target gene. LOC115708 BINDING SITE is HOST TARGET binding site found in the 3' untranslated region of mRNA encoded by LOC115708, corresponding to a HOST TARGET binding site such as BINDING SITE I, BINDING SITE II or BINDING SITE III. Table 2 illustrates the complementarity of the nucleotide sequences of LOC115708 BINDING SITE, designated SEQ ID:36403, to the nucleotide sequence of VGAM2359 RNA, herein designated VGAM RNA, also designated SEQ ID:5070.

Another function of VGAM2359 is therefore inhibition of LOC115708 (Accession XM_056552). Accordingly, utilities of VGAM2359 include diagnosis, prevention and treatment of diseases and clinical conditions associated with LOC115708. LOC51754 (Accession XM_048528) is another VGAM2359 host target gene. LOC51754 BINDING SITE is HOST TARGET binding site found in the 5' untranslated region of mRNA encoded by LOC51754, corresponding to a HOST TARGET binding site such as BINDING SITE I, BINDING SITE II or BINDING SITE III. Table 2 illustrates the complementarity of the nucleotide sequences of LOC51754 BINDING SITE, designated SEQ ID:35179, to the nucleotide sequence of VGAM2359 RNA, herein designated VGAM RNA, also designated SEQ ID:5070.

Another function of VGAM2359 is therefore inhibition of LOC51754 (Accession XM_048528). Accordingly, utilities of VGAM2359 include diagnosis, prevention and treatment of diseases and clinical conditions associated with LOC51754. FIG. 1 further provides a conceptual description of a novel bioinformatically detected viral gene of the present invention, referred to here as Viral Genomic Address Messenger 2360 (VGAM2360) viral gene, which modulates expression of respective host target genes thereof, the function and utility of which host target genes is known in the art.

VGAM2360 is a novel bioinformatically detected regulatory, non protein coding, viral micro RNA (miRNA) gene. The method by which VGAM2360 was detected is described hereinabove with reference to FIGS. 1-8.

VGAM2360 gene, herein designated VGAM GENE, is a viral gene contained in the genome of Equine Herpesvirus 2. VGAM2360 host target gene, herein designated VGAM HOST TARGET GENE, is a human gene contained in the human genome.

VGAM2360 gene encodes a VGAM2360 precursor RNA, herein designated VGAM PRECURSOR RNA. Similar to other miRNA genes, and unlike most ordinary genes, VGAM2360 precursor RNA does not encode a protein. A nucleotide sequence identical or highly similar to the nucleotide sequence of VGAM2360 precursor RNA is designated SEQ ID:2346, and is provided hereinbelow with reference to the sequence listing part. Nucleotide sequence SEQ ID:2346 is located at position 40669 relative to the genome of Equine Herpesvirus 2.

VGAM2360 precursor RNA folds onto itself, forming VGAM2360 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2360 folded precursor RNA into VGAM2360 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2360 RNA is designated SEQ ID:5071, and is provided hereinbelow with reference to the sequence listing part.

VGAM2360 host target gene, herein designated VGAM HOST TARGET GENE, encodes a corresponding messenger RNA, VGAM2360 host target RNA, herein designated VGAM HOST TARGET RNA. VGAM2360 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2360 RNA, herein designated VGAM RNA, binds complementarily to one or more host target binding sites located in untranslated regions of VGAM2360 host target RNA, herein designated VGAM HOST TARGET RNA. This complementary binding is due to the fact that the nucleotide sequence of VGAM2360 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2360 RNA, herein designated VGAM RNA, may have a different number of host target binding sites in untranslated regions of a VGAM2360 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2360 RNA, herein designated VGAM RNA, to host target binding sites on VGAM2360 host target RNA, herein designated VGAM HOST TARGET RNA, such as BINDING SITE I, BINDING SITE II and BINDING SITE III, inhibits translation of VGAM2360 host target RNA into VGAM2360 host target protein, herein designated VGAM HOST TARGET PROTEIN. VGAM host target protein is therefore outlined by a broken line.

It is appreciated that VGAM2360 host target gene, herein designated VGAM HOST TARGET GENE, in fact represents a plurality of VGAM2360 host target genes. The mRNA of each one of this plurality of VGAM2360 host target genes comprises one or more host target binding sites, each having a nucleotide sequence which is at least partly complementary to VGAM2360 RNA, herein designated VGAM RNA, and which when bound by VGAM2360 RNA causes inhibition of translation of respective one or more VGAM2360 host target proteins.

It is further appreciated by one skilled in the art that the mode of translational inhibition illustrated by FIG. 1 with specific reference to translational inhibition exerted by VGAM2360 gene, herein designated VGAM GENE, on one or more VGAM2360 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2360 is inhibition of expression of host target genes, as part of a novel viral mechanism of attacking a host. Accordingly, utilities of VGAM2360 include diagnosis, prevention and treatment of viral infection by Equine Herpesvirus 2. Specific functions, and accordingly utilities, of VGAM2360 correlate with, and may be deduced from, the identity of the host target genes which VGAM2360 binds and inhibits, and the function of these host target genes, as elaborated hereinbelow.

Nucleotide sequences of the VGAM2360 precursor RNA, herein designated VGAM PRECURSOR RNA, and of the 'diced' VGAM2360 RNA, herein designated VGAM RNA, and a schematic representation of the secondary folding of VGAM2360 folded precursor RNA, herein designated VGAM FOLDED PRECURSOR RNA, of VGAM2360 are further described hereinbelow with reference to Table 1.

Nucleotide sequences of host target binding sites, such as BINDING SITE-I, BINDING SITE-II and BINDING SITE-III of FIG. 1, found on VGAM2360 host target RNA, and schematic representation of the complementarity of each of these host target binding sites to VGAM2360 RNA, herein designated VGAM RNA, are described hereinbelow with reference to Table 2.

As mentioned hereinabove with reference to FIG. 1, a function of VGAM2360 gene, herein designated VGAM is inhibition of expression of VGAM2360 target genes. It is appreciated that specific functions, and accordingly utilities, of VGAM2360 correlate with, and may be deduced from, the identity of the target genes which VGAM2360 binds and inhibits, and the function of these target genes, as elaborated hereinbelow.

General Transcription Factor II, I (GTF2I, Accession NM_032999) is a VGAM2360 host target gene. GTF2I BINDING SITE1 and GTF2I BINDING SITE2 are HOST TARGET binding sites found in untranslated regions of mRNA encoded by GTF2I, corresponding to HOST TARGET binding sites such as BINDING SITE I, BINDING SITE II or BINDING SITE III. Table 2 illustrates the complementarity of the nucleotide sequences of GTF2I BINDING SITE1 and GTF2I BINDING SITE2, designated SEQ ID:26885 and SEQ ID:26889 respectively, to the nucleotide sequence of VGAM2360 RNA, herein designated VGAM RNA, also designated SEQ ID:5071.

A function of VGAM2360 is therefore inhibition of General Transcription Factor II, I (GTF2I, Accession NM_032999), a gene which interacts with the basal transcription machinery by coordinating the formation of a multiprotein complex at the c-fos promoter, and linking specific signal responsive activator complexes. Accordingly, utilities of VGAM2360 include diagnosis, prevention and treatment of diseases and clinical conditions associated with GTF2I. The function of GTF2I and its association with various diseases and clinical conditions, has been established by previous studies, as described hereinabove with reference to VGAM115. FLJ13441 (Accession NM_023924) is another VGAM2360 host target gene. FLJ13441 BINDING SITE1 and FLJ13441 BINDING SITE2 are HOST TARGET binding sites found in untranslated regions of mRNA encoded by FLJ13441, corresponding to HOST TARGET binding sites such as BINDING SITE I, BINDING SITE II or BINDING SITE III. Table 2 illustrates the complementarity of the nucleotide sequences of FLJ13441 BINDING SITE1 and FLJ13441 BINDING SITE2, designated SEQ ID:23397 and SEQ ID:23398 respectively, to the nucleotide sequence of VGAM2360 RNA, herein designated VGAM RNA, also designated SEQ ID:5071.

Another function of VGAM2360 is therefore inhibition of FLJ13441 (Accession NM_023924). Accordingly, utilities of VGAM2360 include diagnosis, prevention and treatment of diseases and clinical conditions associated with FLJ13441. KIAA1904 (Accession XM_056282) is another VGAM2360 host target gene. KIAA1904 BINDING SITE is HOST TARGET binding site found in the 3' untranslated region of mRNA encoded by KIAA1904, corresponding to a HOST TARGET binding site such as BINDING SITE I, BINDING SITE II or BINDING SITE III. Table 2 illustrates the complementarity of the nucleotide sequences of KIAA1904 BINDING SITE, designated SEQ ID:36376, to the nucleotide sequence of VGAM2360 RNA, herein designated VGAM RNA, also designated SEQ ID:5071.

Another function of VGAM2360 is therefore inhibition of KIAA1904 (Accession XM_056282). Accordingly, utilities of VGAM2360 include diagnosis, prevention and treatment of diseases and clinical conditions associated with KIAA1904. POPX1 (Accession NM_014906) is another VGAM2360 host target gene. POPX1 BINDING SITE is HOST TARGET binding site found in the 3' untranslated region of mRNA encoded by POPX1, corresponding to a HOST TARGET binding site such as BINDING SITE I, BINDING SITE II or BINDING SITE III. Table 2 illustrates the complementarity of the nucleotide sequences of POPX1 BINDING SITE, designated SEQ ID:17120, to the nucleotide sequence of VGAM2360 RNA, herein designated VGAM RNA, also designated SEQ ID:5071.

Another function of VGAM2360 is therefore inhibition of POPX1 (Accession NM_014906). Accordingly, utilities of VGAM2360 include diagnosis, prevention and treatment of diseases and clinical conditions associated with POPX1. Solute Carrier Family 1 (glutamate transporter), Member 7 (SLC1A7, Accession NM_006671) is another VGAM2360 host target gene. SLC1A7 BINDING SITE is HOST TARGET binding site found in the 3' untranslated region of mRNA encoded by SLC1A7, corresponding to a HOST TARGET binding site such as BINDING SITE I, BINDING SITE II or BINDING SITE III. Table 2 illustrates the complementarity of the nucleotide sequences of SLC1A7 BINDING SITE, designated SEQ ID:13489, to the nucleotide sequence of VGAM2360 RNA, herein designated VGAM RNA, also designated SEQ ID:5071.

Another function of VGAM2360 is therefore inhibition of Solute Carrier Family 1 (glutamate transporter), Member 7 (SLC1A7, Accession NM_006671). Accordingly, utilities of VGAM2360 include diagnosis, prevention and treatment of diseases and clinical conditions associated with SLC1A7. FIG. 1 further provides a conceptual description of a novel bioinformatically detected viral gene of the present invention, referred to here as Viral Genomic Address Messenger 2361 (VGAM2361) viral gene, which modulates expression of respective host target genes thereof, the function and utility of which host target genes is known in the art.

VGAM2361 is a novel bioinformatically detected regulatory, non protein coding, viral micro RNA (miRNA) gene.

The method by which VGAM2361 was detected is described hereinabove with reference to FIGS. 1-8.

VGAM2361 gene, herein designated VGAM GENE, is a viral gene contained in the genome of Equine Herpesvirus 2. VGAM2361 host target gene, herein designated VGAM HOST TARGET GENE, is a human gene contained in the human genome.

VGAM2361 gene encodes a VGAM2361 precursor RNA, herein designated VGAM PRECURSOR RNA. Similar to other miRNA genes, and unlike most ordinary genes, VGAM2361 precursor RNA does not encode a protein. A nucleotide sequence identical or highly similar to the nucleotide sequence of VGAM2361 precursor RNA is designated SEQ ID:2347, and is provided hereinbelow with reference to the sequence listing part. Nucleotide sequence SEQ ID:2347 is located at position 23557 relative to the genome of Equine Herpesvirus 2.

VGAM2361 precursor RNA folds onto itself, forming VGAM2361 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2361 folded precursor RNA into VGAM2361 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM2361 RNA is designated SEQ ID:5072, and is provided hereinbelow with reference to the sequence listing part.

VGAM2361 host target gene, herein designated VGAM HOST TARGET GENE, encodes a corresponding messenger RNA, VGAM2361 host target RNA, herein designated VGAM HOST TARGET RNA. VGAM2361 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2361 RNA, herein designated VGAM RNA, binds complementarily to one or more host target binding sites located in untranslated regions of VGAM2361 host target RNA, herein designated VGAM HOST TARGET RNA. This complementary binding is due to the fact that the nucleotide sequence of VGAM2361 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2361 RNA, herein designated VGAM RNA, may have a different number of host target binding sites in untranslated regions of a VGAM2361 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2361 RNA, herein designated VGAM RNA, to host target binding sites on VGAM2361 host target RNA, herein designated VGAM HOST TARGET RNA, such as BINDING SITE I, BINDING SITE II and BINDING SITE III, inhibits translation of VGAM2361 host target RNA into VGAM2361 host target protein, herein designated VGAM HOST TARGET PROTEIN. VGAM host target protein is therefore outlined by a broken line.

It is appreciated that VGAM2361 host target gene, herein designated VGAM HOST TARGET GENE, in fact represents a plurality of VGAM2361 host target genes. The mRNA of each one of this plurality of VGAM2361 host target genes comprises one or more host target binding sites, each having a nucleotide sequence which is at least partly complementary to VGAM2361 RNA, herein designated VGAM RNA, and which when bound by VGAM2361 RNA causes inhibition of translation of respective one or more VGAM2361 host target proteins.

It is further appreciated by one skilled in the art that the mode of translational inhibition illustrated by FIG. 1 with specific reference to translational inhibition exerted by VGAM2361 gene, herein designated VGAM GENE, on one or more VGAM2361 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2361 is inhibition of expression of host target genes, as part of a novel viral mechanism of attacking a host. Accordingly, utilities of VGAM2361 include diagnosis, prevention and treatment of viral infection by Equine Herpesvirus 2. Specific functions, and accordingly utilities, of VGAM2361 correlate with, and may be deduced from, the identity of the host target genes which VGAM2361 binds and inhibits, and the function of these host target genes, as elaborated hereinbelow.

Nucleotide sequences of the VGAM2361 precursor RNA, herein designated VGAM PRECURSOR RNA, and of the 'diced' VGAM2361 RNA, herein designated VGAM RNA, and a schematic representation of the secondary folding of VGAM2361 folded precursor RNA, herein designated VGAM FOLDED PRECURSOR RNA, of VGAM2361 are further described hereinbelow with reference to Table 1.

Nucleotide sequences of host target binding sites, such as BINDING SITE-I, BINDING SITE-II and BINDING SITE-III of FIG. 1, found on VGAM2361 host target RNA, and schematic representation of the complementarity of each of these host target binding sites to VGAM2361 RNA, herein designated VGAM RNA, are described hereinbelow with reference to Table 2.

As mentioned hereinabove with reference to FIG. 1, a function of VGAM2361 gene, herein designated VGAM is inhibition of expression of VGAM2361 target genes. It is appreciated that specific functions, and accordingly utilities, of VGAM2361 correlate with, and may be deduced from, the identity of the target genes which VGAM2361 binds and inhibits, and the function of these target genes, as elaborated hereinbelow.

Amyloid Beta (A4) Precursor Protein-binding, Family A, Member 2 (X11-like) (APBA2, Accession NM_005503) is a VGAM2361 host target gene. APBA2 BINDING SITE is HOST TARGET binding site found in the 3' untranslated region of mRNA encoded by APBA2, corresponding to a HOST TARGET binding site such as BINDING SITE I, BINDING SITE II or BINDING SITE III. Table 2 illustrates the complementarity of the nucleotide sequences of APBA2 BINDING SITE, designated SEQ ID:12017, to the nucleotide sequence of VGAM2361 RNA, herein designated VGAM RNA, also designated SEQ ID:5072.

A function of VGAM2361 is therefore inhibition of Amyloid Beta (A4) Precursor Protein-binding, Family A, Member 2 (X11-like) (APBA2, Accession NM_005503), a gene which interacts with and stabilisesthe Alzheimer's disease amyloid precursor protein (APP) and inhibits production of proteolytic APP fragments. Accordingly, utilities of VGAM2361 include diagnosis, prevention and treatment of diseases and clinical conditions associated with APBA2. The function of APBA2 and its association with various diseases and clinical conditions, has been established by previous studies, as described hereinabove with reference to VGAM925. EphA8 (EPHA8, Accession NM_020526) is another VGAM2361 host target gene. EPHA8 BINDING SITE is HOST TARGET binding site found in the 3' untranslated region of mRNA encoded by EPHA8, corresponding to a HOST TARGET binding site such as BINDING SITE I, BINDING SITE II or BINDING SITE III. Table 2 illustrates the complementarity of the nucleotide sequences of EPHA8 BINDING SITE, designated SEQ ID:21747, to the nucleotide sequence of VGAM2361 RNA, herein designated VGAM RNA, also designated SEQ ID:5072.

Another function of VGAM2361 is therefore inhibition of EphA8 (EPHA8, Accession NM_020526), a gene which Eph-related receptor tyrosine kinase A8. Accordingly, utilities of VGAM2361 include diagnosis, prevention and treatment of diseases and clinical conditions associated with EPHA8. The function of EPHA8 and its association with various diseases and clinical conditions, has been established by previous studies, as described hereinabove with reference to VGAM494. Ellis Van Creveld Syndrome (EVC, Accession NM_014556) is another VGAM2361 host target gene. EVC BINDING SITE1 through EVC BINDING SITE8 are HOST TARGET binding sites found in untranslated regions of mRNA encoded by EVC, corresponding to HOST TARGET binding sites such as BINDING SITE I, BINDING SITE II or BINDING SITE III. Table 2 illustrates the complementarity of the nucleotide sequences of EVC BINDING SITE1 through EVC BINDING SITE8, designated SEQ ID:15890, SEQ ID:15891, SEQ ID:15892, SEQ ID:15893, SEQ ID:15888, SEQ ID:15889, SEQ ID:15887 and SEQ ID:15886 respectively, to the nucleotide sequence of VGAM2361 RNA, herein designated VGAM RNA, also designated SEQ ID:5072.

Another function of VGAM2361 is therefore inhibition of Ellis Van Creveld Syndrome (EVC, Accession NM_014556). Accordingly, utilities of VGAM2361 include diagnosis, prevention and treatment of diseases and clinical conditions associated with EVC. Potassium Inwardly-rectifying Channel, Subfamily J, Member 10 (KCNJ10, Accession NM_002241) is another VGAM2361 host target gene. KCNJ10 BINDING SITE is HOST TARGET binding site found in the 5' untranslated region of mRNA encoded by KCNJ10, corresponding to a HOST TARGET binding site such as BINDING SITE I, BINDING SITE II or BINDING SITE III. Table 2 illustrates the complementarity of the nucleotide sequences of KCNJ10 BINDING SITE, designated SEQ ID:8025, to the nucleotide sequence of VGAM2361 RNA, herein designated VGAM RNA, also designated SEQ ID:5072.

Another function of VGAM2361 is therefore inhibition of Potassium Inwardly-rectifying Channel, Subfamily J, Member 10 (KCNJ10, Accession NM_002241), a gene which may be responsible for potassium buffering action of glial cells in the brain. Accordingly, utilities of VGAM2361 include diagnosis, prevention and treatment of diseases and clinical conditions associated with KCNJ10. The function of KCNJ10 and its association with various diseases and clinical conditions, has been established by previous studies, as described hereinabove with reference to VGAM167. Potassium Voltage-gated Channel, KQT-like Subfamily, Member 1 (KCNQ1, Accession NM_000218) is another VGAM2361 host target gene. KCNQ1 BINDING SITE is HOST TARGET binding site found in the 3' untranslated region of mRNA encoded by KCNQ1, corresponding to a HOST TARGET binding site such as BINDING SITE I, BINDING SITE II or BINDING SITE III. Table 2 illustrates the complementarity of the nucleotide sequences of KCNQ1 BINDING SITE, designated SEQ ID:5724, to the nucleotide sequence of VGAM2361 RNA, herein designated VGAM RNA, also designated SEQ ID:5072.

Another function of VGAM2361 is therefore inhibition of Potassium Voltage-gated Channel, KQT-like Subfamily, Member 1 (KCNQ1, Accession NM_000218), a gene which probably important in cardiac repolarization. associates with kcne1 (mink) to form the i (ks) cardiac potassium current. elicits a rapidly activating, k(+)-selective outward current. muscarinic agonist oxotremorine-m strongly suppresses kcnq1/kcne1 current in cho cells in which cloned kcnq1/kcne1 channels were coexpressed with m1 muscarinic receptors. may associate also with kcne3 (mirp2) to form the potassium channel that is important for cyclic amp-stimulated intestinal secretion of chloride io TISSUE:abondantly expressed in heart, pancreas, prostate, kidney, small intestine and peripheral blood leukocytes. less abondant in placenta, lung, spleen, colon, thymus, testis and ovaries. Accordingly, utilities of VGAM2361 include diagnosis, prevention and treatment of diseases and clinical conditions associated with KCNQ1. The function of KCNQ1 and its association with various diseases and clinical conditions, has been established by previous studies, as described hereinabove with reference to VGAM339. Loss of Heterozygosity, 11, Chromosomal Region 2, Gene A (LOH11CR2A, Accession NM_014622) is another VGAM2361 host target gene. LOH11CR2A BINDING SITE is HOST TARGET binding site found in the 5' untranslated region of mRNA encoded by LOH11CR2A, corresponding to a HOST TARGET binding site such as BINDING SITE I, BINDING SITE II or BINDING SITE III. Table 2 illustrates the complementarity of the nucleotide sequences of LOH11CR2A BINDING SITE, designated SEQ ID:15988, to the nucleotide sequence of VGAM2361 RNA, herein designated VGAM RNA, also designated SEQ ID:5072.

Another function of VGAM2361 is therefore inhibition of Loss of Heterozygosity, 11, Chromosomal Region 2, Gene A (LOH11CR2A, Accession NM_014622). Accordingly, utilities of VGAM2361 include diagnosis, prevention and treatment of diseases and clinical conditions associated with LOH11CR2A. Mitogen-activated Protein Kinase Kinase Kinase 14 (MAP3K14, Accession NM_003954) is another VGAM2361 host target gene. MAP3K14 BINDING SITE is HOST TARGET binding site found in the 3' untranslated region of mRNA encoded by MAP3K14, corresponding to a HOST TARGET binding site such as BINDING SITE I, BINDING SITE II or BINDING SITE III. Table 2 illustrates the complementarity of the nucleotide sequences of MAP3K14 BINDING SITE, designated SEQ ID:10091, to the nucleotide sequence of VGAM2361 RNA, herein designated VGAM RNA, also designated SEQ ID:5072.

Another function of VGAM2361 is therefore inhibition of Mitogen-activated Protein Kinase Kinase Kinase 14 (MAP3K14, Accession NM_003954), a gene which is involved in the activation of nf-kappa-b and its transcriptional activity. induces the processing of nf-kappa-b 2/p100. could act in a receptor-selective manner (by similarity). Accordingly, utilities of VGAM2361 include diagnosis, prevention and treatment of diseases and clinical conditions associated with MAP3K14. The function of MAP3K14 and its association with various diseases and clinical conditions, has been established by previous studies, as described hereinabove with reference to VGAM55. Neurotensin Receptor 1 (high affinity) (NTSR1, Accession NM_002531) is another VGAM2361 host target gene. NTSR1 BINDING SITE is HOST TARGET binding site found in the 3' untranslated region of mRNA encoded by NTSR1, corresponding to a HOST TARGET binding site such as BINDING SITE I, BINDING SITE II or BINDING SITE III. Table 2 illustrates the complementarity of the nucleotide sequences of NTSR1 BINDING SITE, designated SEQ ID:8369, to the nucleotide sequence of VGAM2361 RNA, herein designated VGAM RNA, also designated SEQ ID:5072.

Another function of VGAM2361 is therefore inhibition of Neurotensin Receptor 1 (high affinity) (NTSR1, Accession NM_002531), a gene which is associated with g proteins that activate a phosphatidylinositol-calcium second messenger system. Accordingly, utilities of VGAM2361 include diagnosis, prevention and treatment of diseases and clinical conditions associated with NTSR1. The function of NTSR1 and its association with various diseases and clinical conditions, has been established by previous studies, as described hereinabove with reference to VGAM200. SRY (sex determining region Y)-box 10 (SOX10, Accession NM_006941) is another VGAM2361 host target gene. SOX10 BINDING SITE is HOST TARGET binding site found in the 3' untranslated region of mRNA encoded by SOX10, corresponding to a HOST TARGET binding site such as BINDING SITE I, BINDING SITE II or BINDING SITE III. Table 2 illustrates the complementarity of the nucleotide sequences of SOX10 BINDING SITE, designated SEQ ID:13823, to the nucleotide sequence of VGAM2361 RNA, herein designated VGAM RNA, also designated SEQ ID:5072.

Another function of VGAM2361 is therefore inhibition of SRY (sex determining region Y)-box 10 (SOX10, Accession NM_006941). Accordingly, utilities of VGAM2361 include diagnosis, prevention and treatment of diseases and clinical conditions associated with SOX10. Sphingosine Kinase 2 (SPHK2, Accession NM_020126) is another VGAM2361 host target gene. SPHK2 BINDING SITE is HOST TARGET binding site found in the 3' untranslated region of mRNA encoded by SPHK2, corresponding to a HOST TARGET binding site such as BINDING SITE I, BINDING SITE II or BINDING SITE III. Table 2 illustrates the complementarity of the nucleotide sequences of SPHK2 BINDING SITE, designated SEQ ID:21313, to the nucleotide sequence of VGAM2361 RNA, herein designated VGAM RNA, also designated SEQ ID:5072.

Another function of VGAM2361 is therefore inhibition of Sphingosine Kinase 2 (SPHK2, Accession NM_020126). Accordingly, utilities of VGAM2361 include diagnosis, prevention and treatment of diseases and clinical conditions associated with SPHK2. Collectin Sub-family Member 10 (C-type lectin) (COLEC10, Accession NM_006438) is another VGAM2361 host target gene. COLEC10 BINDING SITE is HOST TARGET binding site found in the 3' untranslated region of mRNA encoded by COLEC10, corresponding to a HOST TARGET binding site such as BINDING SITE I, BINDING SITE II or BINDING SITE III. Table 2 illustrates the complementarity of the nucleotide sequences of COLEC10 BINDING SITE, designated SEQ ID:13146, to the nucleotide sequence of VGAM2361 RNA, herein designated VGAM RNA, also designated SEQ ID:5072.

Another function of VGAM2361 is therefore inhibition of Collectin Sub-family Member 10 (C-type lectin) (COLEC10, Accession NM_006438). Accordingly, utilities of VGAM2361 include diagnosis, prevention and treatment of diseases and clinical conditions associated with COLEC10. DKFZP434L0117 (Accession NM_022778) is another VGAM2361 host target gene. DKFZP434L0117 BINDING SITE is HOST TARGET binding site found in the 3' untranslated region of mRNA encoded by DKFZP434L0117, corresponding to a HOST TARGET binding site such as BINDING SITE I, BINDING SITE II or BINDING SITE III. Table 2 illustrates the complementarity of the nucleotide sequences of DKFZP434L0117 BINDING SITE, designated SEQ ID:23051, to the nucleotide sequence of VGAM2361 RNA, herein designated VGAM RNA, also designated SEQ ID:5072.

Another function of VGAM2361 is therefore inhibition of DKFZP434L0117 (Accession NM_022778). Accordingly, utilities of VGAM2361 include diagnosis, prevention and treatment of diseases and clinical conditions associated with DKFZP434L0117. FLJ20123 (Accession NM_017674) is another VGAM2361 host target gene. FLJ20123 BINDING SITE is HOST TARGET binding site found in the 5' untranslated region of mRNA encoded by FLJ20123, corresponding to a HOST TARGET binding site such as BINDING SITE I, BINDING SITE II or BINDING SITE III. Table 2 illustrates the complementarity of the nucleotide sequences of FLJ20123 BINDING SITE, designated SEQ ID:19218, to the nucleotide sequence of VGAM2361 RNA, herein designated VGAM RNA, also designated SEQ ID:5072.

Another function of VGAM2361 is therefore inhibition of FLJ20123 (Accession NM_017674). Accordingly, utilities of VGAM2361 include diagnosis, prevention and treatment of diseases and clinical conditions associated with FLJ20123. FLJ20160 (Accession NM_017694) is another VGAM2361 host target gene. FLJ20160 BINDING SITE is HOST TARGET binding site found in the 3' untranslated region of mRNA encoded by FLJ20160, corresponding to a HOST TARGET binding site such as BINDING SITE I, BINDING SITE II or BINDING SITE III. Table 2 illustrates the complementarity of the nucleotide sequences of FLJ20160 BINDING SITE, designated SEQ ID:19258, to the nucleotide sequence of VGAM2361 RNA, herein designated VGAM RNA, also designated SEQ ID:5072.

Another function of VGAM2361 is therefore inhibition of FLJ20160 (Accession NM_017694). Accordingly, utilities of VGAM2361 include diagnosis, prevention and treatment of diseases and clinical conditions associated with FLJ20160. KIAA0855 (Accession NM_015003) is another VGAM2361 host target gene. KIAA0855 BINDING SITE is HOST TARGET binding site found in the 5' untranslated region of mRNA encoded by KIAA0855, corresponding to a HOST TARGET binding site such as BINDING SITE I, BINDING SITE II or BINDING SITE III. Table 2 illustrates the complementarity of the nucleotide sequences of KIAA0855 BINDING SITE, designated SEQ ID:17372, to the nucleotide sequence of VGAM2361 RNA, herein designated VGAM RNA, also designated SEQ ID:5072.

Another function of VGAM2361 is therefore inhibition of KIAA0855 (Accession NM_015003). Accordingly, utilities of VGAM2361 include diagnosis, prevention and treatment of diseases and clinical conditions associated with KIAA0855. KIAA1086 (Accession XM_047610) is another VGAM2361 host target gene. KIAA1086 BINDING SITE is HOST TARGET binding site found in the 3' untranslated region of mRNA encoded by KIAA1086, corresponding to a HOST TARGET binding site such as BINDING SITE I, BINDING SITE II or BINDING SITE III. Table 2 illustrates the complementarity of the nucleotide sequences of KIAA1086 BINDING SITE, designated SEQ ID:35012, to the nucleotide sequence of VGAM2361 RNA, herein designated VGAM RNA, also designated SEQ ID:5072.

Another function of VGAM2361 is therefore inhibition of KIAA1086 (Accession XM_047610). Accordingly, utilities of VGAM2361 include diagnosis, prevention and treatment of diseases and clinical conditions associated with KIAA1086. Protein Phosphatase 1, Regulatory (inhibitor) Subunit 16B (PPP1R16B, Accession XM_028840) is another VGAM2361 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30775, to the nucleotide sequence of VGAM2361 RNA, herein designated VGAM RNA, also designated SEQ ID:5072.

Another function of VGAM2361 is therefore inhibition of Protein Phosphatase 1, Regulatory (inhibitor) Subunit 16B (PPP1R16B, Accession XM_028840). Accordingly, utilities of VGAM2361 include diagnosis, prevention and treatment of diseases and clinical conditions associated with PPP1R16B. Retinoic Acid Induced 1 (RAI1, Accession XM_016259) is another VGAM2361 host target gene. RAI1 BINDING SITE is HOST TARGET binding site found in the 5' untranslated region of mRNA encoded by RAI1, corresponding to a HOST TARGET binding site such as BINDING SITE I, BINDING SITE II or BINDING SITE III. Table 2 illustrates the complementarity of the nucleotide sequences of RAI1 BINDING SITE, designated SEQ ID:30253, to the nucleotide sequence of VGAM2361 RNA, herein designated VGAM RNA, also designated SEQ ID:5072.

Another function of VGAM2361 is therefore inhibition of Retinoic Acid Induced 1 (RAI1, Accession XM_016259). Accordingly, utilities of VGAM2361 include diagnosis, prevention and treatment of diseases and clinical conditions associated with RAI1. LOC112476 (Accession NM_145239) is another VGAM2361 host target gene. LOC112476 BINDING SITE is HOST TARGET binding site found in the 3' untranslated region of mRNA encoded by LOC112476, corresponding to a HOST TARGET binding site such as BINDING SITE I, BINDING SITE II or BINDING SITE III. Table 2 illustrates the complementarity of the nucleotide sequences of LOC112476 BINDING SITE, designated SEQ ID:29751, to the nucleotide sequence of VGAM2361 RNA, herein designated VGAM RNA, also designated SEQ ID:5072.

Another function of VGAM2361 is therefore inhibition of LOC112476 (Accession NM_145239). Accordingly, utilities of VGAM2361 include diagnosis, prevention and treatment of diseases and clinical conditions associated with LOC112476. LOC149464 (Accession XM_097645) is another VGAM2361 host target gene. LOC149464 BINDING SITE is HOST TARGET binding site found in the 5' untranslated region of mRNA encoded by LOC149464, corresponding to a HOST TARGET binding site such as BINDING SITE I, BINDING SITE II or BINDING SITE III. Table 2 illustrates the complementarity of the nucleotide sequences of LOC149464 BINDING SITE, designated SEQ ID:40993, to the nucleotide sequence of VGAM2361 RNA, herein designated VGAM RNA, also designated SEQ ID:5072.

Another function of VGAM2361 is therefore inhibition of LOC149464 (Accession XM_097645). Accordingly, utilities of VGAM2361 include diagnosis, prevention and treatment of diseases and clinical conditions associated with LOC149464. LOC151959 (Accession XM_098144) is another VGAM2361 host target gene. LOC151959 BINDING SITE is HOST TARGET binding site found in the 5' untranslated region of mRNA encoded by LOC151959, corresponding to a HOST TARGET binding site such as BINDING SITE I, BINDING SITE II or BINDING SITE III. Table 2 illustrates the complementarity of the nucleotide sequences of LOC151959 BINDING SITE, designated SEQ ID:41408, to the nucleotide sequence of VGAM2361 RNA, herein designated VGAM RNA, also designated SEQ ID:5072.

Another function of VGAM2361 is therefore inhibition of LOC151959 (Accession XM_098144). Accordingly, utilities of VGAM2361 include diagnosis, prevention and treatment of diseases and clinical conditions associated with LOC151959. LOC158969 (Accession XM_088728) is another VGAM2361 host target gene. LOC158969 BINDING SITE is HOST TARGET binding site found in the 3' untranslated region of mRNA encoded by LOC158969, corresponding to a HOST TARGET binding site such as BINDING SITE I, BINDING SITE II or BINDING SITE III. Table 2 illustrates the complementarity of the nucleotide sequences of LOC158969 BINDING SITE, designated SEQ ID:39921, to the nucleotide sequence of VGAM2361 RNA, herein designated VGAM RNA, also designated SEQ ID:5072.

Another function of VGAM2361 is therefore inhibition of LOC158969 (Accession XM_088728). Accordingly, utilities of VGAM2361 include diagnosis, prevention and treatment of diseases and clinical conditions associated with LOC158969. LOC166206 (Accession XM_093743) is another VGAM2361 host target gene. LOC166206 BINDING SITE is HOST TARGET binding site found in the 5' untranslated region of mRNA encoded by LOC166206, corresponding to a HOST TARGET binding site such as BINDING SITE I, BINDING SITE II or BINDING SITE III. Table 2 illustrates the complementarity of the nucleotide sequences of LOC166206 BINDING SITE, designated SEQ ID:40208, to the nucleotide sequence of VGAM2361 RNA, herein designated VGAM RNA, also designated SEQ ID:5072.

Another function of VGAM2361 is therefore inhibition of LOC166206 (Accession XM_093743). Accordingly, utilities of VGAM2361 include diagnosis, prevention and treatment of diseases and clinical conditions associated with LOC166206. LOC197196 (Accession XM_117003) is another VGAM2361 host target gene. LOC197196 BINDING SITE is HOST TARGET binding site found in the 3' untranslated region of mRNA encoded by LOC197196, corresponding to a HOST TARGET binding site such as BINDING SITE I, BINDING SITE II or BINDING SITE III. Table 2 illustrates the complementarity of the nucleotide sequences of LOC197196 BINDING SITE, designated SEQ ID:43202, to the nucleotide sequence of VGAM2361 RNA, herein designated VGAM RNA, also designated SEQ ID:5072.

Another function of VGAM2361 is therefore inhibition of LOC197196 (Accession XM_117003). Accordingly, utilities of VGAM2361 include diagnosis, prevention and treatment of diseases and clinical conditions associated with LOC197196. LOC200081 (Accession XM_114110) is another VGAM2361 host target gene. LOC200081 BINDING SITE is HOST TARGET binding site found in the 3' untranslated region of mRNA encoded by LOC200081, corresponding to a HOST TARGET binding site such as BINDING SITE I, BINDING SITE II or BINDING SITE III. Table 2 illustrates the complementarity of the nucleotide sequences of LOC200081 BINDING SITE, designated SEQ ID:42704, to the nucleotide sequence of VGAM2361 RNA, herein designated VGAM RNA, also designated SEQ ID:5072.

Another function of VGAM2361 is therefore inhibition of LOC200081 (Accession XM_114110). Accordingly, utilities of VGAM2361 include diagnosis, prevention and treatment of diseases and clinical conditions associated with LOC200081. LOC220045 (Accession XM_167820) is another VGAM2361 host target gene. LOC220045 BINDING SITE is HOST TARGET binding site found in the 5' untranslated region of mRNA encoded by LOC220045, corresponding to a HOST TARGET binding site such as BINDING SITE I, BINDING SITE II or BINDING SITE III. Table 2 illustrates the complementarity of the nucleotide sequences of LOC220045 BINDING SITE, designated SEQ ID:44860, to the nucleotide sequence of VGAM2361 RNA, herein designated VGAM RNA, also designated SEQ ID:5072.

Another function of VGAM2361 is therefore inhibition of LOC220045 (Accession XM_167820). Accordingly, utilities of VGAM2361 include diagnosis, prevention and treatment of diseases and clinical conditions associated with LOC220045. LOC221042 (Accession XM_167669) is another VGAM2361 host target gene. LOC221042 BINDING SITE is HOST TARGET binding site found in the 3' untranslated region of mRNA encoded by LOC221042, corresponding to a HOST TARGET binding site such as BINDING SITE I, BINDING SITE II or BINDING SITE III. Table 2 illustrates the complementarity of the nucleotide sequences of LOC221042 BINDING SITE, designated SEQ ID:44757, to the nucleotide sequence of VGAM2361 RNA, herein designated VGAM RNA, also designated SEQ ID:5072.

Another function of VGAM2361 is therefore inhibition of LOC221042 (Accession XM_167669). Accordingly, utilities of VGAM2361 include diagnosis, prevention and treatment of diseases and clinical conditions associated with LOC221042. LOC253842 (Accession XM_173230) is another VGAM2361 host target gene. LOC253842 BINDING SITE is HOST TARGET binding site found in the 3' untranslated region of mRNA encoded by LOC253842, corresponding to a HOST TARGET binding site such as BINDING SITE I, BINDING SITE II or BINDING SITE III. Table 2 illustrates the complementarity of the nucleotide sequences of LOC253842 BINDING SITE, designated SEQ ID:46502, to the nucleotide sequence of VGAM2361 RNA, herein designated VGAM RNA, also designated SEQ ID:5072.

Another function of VGAM2361 is therefore inhibition of LOC253842 (Accession XM_173230). Accordingly, utilities of VGAM2361 include diagnosis, prevention and treatment of diseases and clinical conditions associated with LOC253842. LOC257479 (Accession XM_171548) is another VGAM2361 host target gene. LOC257479 BINDING SITE is HOST TARGET binding site found in the 5' untranslated region of mRNA encoded by LOC257479, corresponding to a HOST TARGET binding site such as BINDING SITE I, BINDING SITE II or BINDING SITE III. Table 2 illustrates the complementarity of the nucleotide sequences of LOC257479 BINDING SITE, designated SEQ ID:46051, to the nucleotide sequence of VGAM2361 RNA, herein designated VGAM RNA, also designated SEQ ID:5072.

Another function of VGAM2361 is therefore inhibition of LOC257479 (Accession XM_171548). Accordingly, utilities of VGAM2361 include diagnosis, prevention and treatment of diseases and clinical conditions associated with LOC257479. FIG. 1 further provides a conceptual description of a novel bioinformatically detected viral gene of the present invention, referred to here as Viral Genomic Address Messenger 2362 (VGAM2362) viral gene, which modulates expression of respective host target genes thereof, the function and utility of which host target genes is known in the art.

VGAM2362 is a novel bioinformatically detected regulatory, non protein coding, viral micro RNA (miRNA) gene. The method by which VGAM2362 was detected is described hereinabove with reference to FIGS. 1-8.

VGAM2362 gene, herein designated VGAM GENE, is a viral gene contained in the genome of Equine Herpesvirus 2. VGAM2362 host target gene, herein designated VGAM HOST TARGET GENE, is a human gene contained in the human genome.

VGAM2362 gene encodes a VGAM2362 precursor RNA, herein designated VGAM PRECURSOR RNA. Similar to other miRNA genes, and unlike most ordinary genes, VGAM2362 precursor RNA does not encode a protein. A nucleotide sequence identical or highly similar to the nucleotide sequence of VGAM2362 precursor RNA is designated SEQ ID:2348, and is provided hereinbelow with reference to the sequence listing part. Nucleotide sequence SEQ ID:2348 is located at position 25075 relative to the genome of Equine Herpesvirus 2.

VGAM2362 precursor RNA folds onto itself, forming VGAM2362 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2362 folded precursor RNA into VGAM2362 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2362 RNA is designated SEQ ID:5073, and is provided hereinbelow with reference to the sequence listing part.

VGAM2362 host target gene, herein designated VGAM HOST TARGET GENE, encodes a corresponding messenger RNA, VGAM2362 host target RNA, herein designated VGAM HOST TARGET RNA. VGAM2362 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2362 RNA, herein designated VGAM RNA, binds complementarily to one or more host target binding sites located in untranslated regions of VGAM2362 host target RNA, herein designated VGAM HOST TARGET RNA. This complementary binding is due to the fact that the nucleotide sequence of VGAM2362 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2362 RNA, herein designated VGAM RNA, may have a different number of host target binding sites in untranslated regions of a VGAM2362 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2362 RNA, herein designated VGAM RNA, to host target binding sites on VGAM2362 host target RNA, herein designated VGAM HOST TARGET RNA, such as BINDING SITE I, BINDING SITE II and BINDING SITE III, inhibits translation of VGAM2362 host target RNA into VGAM2362 host target protein, herein designated VGAM HOST TARGET PROTEIN. VGAM host target protein is therefore outlined by a broken line.

It is appreciated that VGAM2362 host target gene, herein designated VGAM HOST TARGET GENE, in fact represents a plurality of VGAM2362 host target genes. The mRNA of each one of this plurality of VGAM2362 host target genes comprises one or more host target binding sites, each having a nucleotide sequence which is at least partly complementary to VGAM2362 RNA, herein designated VGAM RNA, and which when bound by VGAM2362 RNA causes inhibition of translation of respective one or more VGAM2362 host target proteins.

It is further appreciated by one skilled in the art that the mode of translational inhibition illustrated by FIG. 1 with specific reference to translational inhibition exerted by VGAM2362 gene, herein designated VGAM GENE, on one or more VGAM2362 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2362 is inhibition of expression of host target genes, as part of a novel viral mechanism of attacking a host. Accordingly, utilities of VGAM2362 include diagnosis, prevention and treatment of viral infection by Equine Herpesvirus 2. Specific functions, and accordingly utilities, of VGAM2362 correlate with, and may be deduced from, the identity of the host target genes which VGAM2362 binds and inhibits, and the function of these host target genes, as elaborated hereinbelow.

Nucleotide sequences of the VGAM2362 precursor RNA, herein designated VGAM PRECURSOR RNA, and of the 'diced' VGAM2362 RNA, herein designated VGAM RNA, and a schematic representation of the secondary folding of VGAM2362 folded precursor RNA, herein designated VGAM FOLDED PRECURSOR RNA, of VGAM2362 are further described hereinbelow with reference to Table 1.

Nucleotide sequences of host target binding sites, such as BINDING SITE-I, BINDING SITE-II and BINDING SITE-III of FIG. 1, found on VGAM2362 host target RNA, and schematic representation of the complementarity of each of these host target binding sites to VGAM2362 RNA, herein designated VGAM RNA, are described hereinbelow with reference to Table 2.

As mentioned hereinabove with reference to FIG. 1, a function of VGAM2362 gene, herein designated VGAM is inhibition of expression of VGAM2362 target genes. It is appreciated that specific functions, and accordingly utilities, of VGAM2362 correlate with, and may be deduced from, the identity of the target genes which VGAM2362 binds and inhibits, and the function of these target genes, as elaborated hereinbelow.

Dolichyl-diphosphooligosaccharide-protein Glycosyltransferase (DDOST, Accession NM_005216) is a VGAM2362 host target gene. DDOST BINDING SITE is HOST TARGET binding site found in the 3' untranslated region of mRNA encoded by DDOST, corresponding to a HOST TARGET binding site such as BINDING SITE I, BINDING SITE II or BINDING SITE III. Table 2 illustrates the complementarity of the nucleotide sequences of DDOST BINDING SITE, designated SEQ ID:11712, to the nucleotide sequence of VGAM2362 RNA, herein designated VGAM RNA, also designated SEQ ID:5073.

A function of VGAM2362 is therefore inhibition of Dolichyl-diphosphooligosaccharide-protein Glycosyltransferase (DDOST, Accession NM_005216), a gene which transfers high-mannose oligosaccharides to nascent polypeptides. Accordingly, utilities of VGAM2362 include diagnosis, prevention and treatment of diseases and clinical conditions associated with DDOST. The function of DDOST has been established by previous studies. The enzyme oligosaccharyltransferase (dolichyl-diphosphooligosaccharide-protein glycosyltransferase (DDOST); EC 2.4.1.119) catalyzes the transfer of a high-mannose oligosaccharide from a dolichyl-linked oligosaccharide donor onto the asparagine acceptor site in nascent polypeptide chains across the membrane of the rough endoplasmic reticulum. Kelleher et al. (1992) reported that mammalian oligosaccharyltransferase activity is associated with a protein complex composed of ribophorin I (OMIM Ref. No. 180470), ribophorin II (OMIM Ref. No. 180490), and a 48-kD protein, OST48.

Full details of the abovementioned studies are described in the following publications, the disclosure of which are hereby incorporated by reference:

Kelleher, D. J.; Kreibich, G.; Gilmore, R.: Oligosaccharyltransferase activity is associated with a protein complex composed of ribophorins I and II and a 48 kd protein. Cell 69:55-65, 1992; and Yamagata, T.; Tsuru, T.; Momoi, M. Y.; Suwa, K.; Nozaki, Y.; Mukasa, T.; Ohashi, H.; Fukushima, Y.; Momoi, T.: Genome organization of human 48-kDa oligosaccharyltransferase (DDOST). Ge.

Further studies establishing the function and utilities of DDOST are found in John Hopkins OMIM database record ID 602202, and in sited publications numbered 2682 listed in the bibliography section hereinbelow, which are also hereby incorporated by reference. Frizzled Homolog 1 (Drosophila) (FZD1, Accession NM_003505) is another VGAM2362 host target gene. FZD1 BINDING SITE is HOST TARGET binding site found in the 5' untranslated region of mRNA encoded by FZD1, corresponding to a HOST TARGET binding site such as BINDING SITE I, BINDING SITE II or BINDING SITE III. Table 2 illustrates the complementarity of the nucleotide sequences of FZD1 BINDING SITE, designated SEQ ID:9595, to the nucleotide sequence of VGAM2362 RNA, herein designated VGAM RNA, also designated SEQ ID:5073.

Another function of VGAM2362 is therefore inhibition of Frizzled Homolog 1 (Drosophila) (FZD1, Accession NM_003505), a gene which may be involved in bone resorption; strongly similar to rat Fzd. Accordingly, utilities of VGAM2362 include diagnosis, prevention and treatment of diseases and clinical conditions associated with FZD1. The function of FZD1 and its association with various diseases and clinical conditions, has been established by previous studies, as described hereinabove with reference to VGAM432. Histone Deacetylase 4 (HDAC4, Accession NM_006037) is another VGAM2362 host target gene. HDAC4 BINDING SITE is HOST TARGET binding site found in the 3' untranslated region of mRNA encoded by HDAC4, corresponding to a HOST TARGET binding site such as BINDING SITE I, BINDING SITE II or BINDING SITE III. Table 2 illustrates the complementarity of the nucleotide sequences of HDAC4 BINDING SITE, designated SEQ ID:12664, to the nucleotide sequence of VGAM2362 RNA, herein designated VGAM RNA, also designated SEQ ID:5073.

Another function of VGAM2362 is therefore inhibition of Histone Deacetylase 4 (HDAC4, Accession NM_006037), a gene which is responsible for the deacetylation of lysine residues on the n-terminal part of the core histones and may mediate transcriptional regulation. Accordingly, utilities of VGAM2362 include diagnosis, prevention and treatment of diseases and clinical conditions associated with HDAC4. The function of HDAC4 and its association with various diseases and clinical conditions, has been established by previous studies, as described hereinabove with reference to VGAM264. Neuron Navigator 2 (NAV2, Accession XM_012028) is another VGAM2362 host target gene. NAV2 BINDING SITE is HOST TARGET binding site found in the 5' untranslated region of mRNA encoded by NAV2, corresponding to a HOST TARGET binding site such as BINDING SITE I, BINDING SITE II or BINDING SITE III. Table 2 illustrates the complementarity of the nucleotide sequences of NAV2 BINDING SITE, designated SEQ ID:30204, to the nucleotide sequence of VGAM2362 RNA, herein designated VGAM RNA, also designated SEQ ID:5073.

Another function of VGAM2362 is therefore inhibition of Neuron Navigator 2 (NAV2, Accession XM_012028), a gene which plays an important role in neuronal development, including neurite outgrowth. Accordingly, utilities of VGAM2362 include diagnosis, prevention and treatment of diseases and clinical conditions associated with NAV2. The function of NAV2 and its association with various diseases and clinical conditions, has been established by previous studies, as described hereinabove with reference to VGAM481. Peroxisome Biogenesis Factor 10 (PEX10, Accession NM_002617) is another VGAM2362 host target gene. PEX10 BINDING SITE is HOST TARGET binding site found in the 3' untranslated region of mRNA encoded by PEX10, corresponding to a HOST TARGET binding site such as BINDING SITE I, BINDING SITE II or BINDING SITE III. Table 2 illustrates the complementarity of the nucleotide sequences of PEX10 BINDING SITE, designated SEQ ID:8481, to the nucleotide sequence of VGAM2362 RNA, herein designated VGAM RNA, also designated SEQ ID:5073.

Another function of VGAM2362 is therefore inhibition of Peroxisome Biogenesis Factor 10 (PEX10, Accession NM_002617). Accordingly, utilities of VGAM2362 include diagnosis, prevention and treatment of diseases and clinical conditions associated with PEX10. Chromosome 11 Open Reading Frame 11 (C11orf11, Accession XM_167769) is another VGAM2362 host target gene. C11orf11 BINDING SITE is HOST TARGET binding site found in the 3' untranslated region of mRNA encoded by C11orf11, corresponding to a HOST TARGET binding site such as BINDING SITE I, BINDING SITE II or BINDING SITE III. Table 2 illustrates the complementarity of the nucleotide sequences of C11orf11 BINDING SITE, designated SEQ ID:44788, to the nucleotide sequence of VGAM2362 RNA, herein designated VGAM RNA, also designated SEQ ID:5073.

Another function of VGAM2362 is therefore inhibition of Chromosome 11 Open Reading Frame 11 (C11orf11, Accession XM_167769). Accordingly, utilities of VGAM2362 include diagnosis, prevention and treatment of diseases and clinical conditions associated with C11orf11. DKFZp434F1719 (Accession NM_032248) is another VGAM2362 host target gene. DKFZp434F1719 BINDING SITE is HOST TARGET binding site found in the 3' untranslated region of mRNA encoded by DKFZp434F1719, corresponding to a HOST TARGET binding site such as BINDING SITE I, BINDING SITE II or BINDING SITE III. Table 2 illustrates the complementarity of the nucleotide sequences of DKFZp434F1719 BINDING SITE, designated SEQ ID:25990, to the nucleotide sequence of VGAM2362 RNA, herein designated VGAM RNA, also designated SEQ ID:5073.

Another function of VGAM2362 is therefore inhibition of DKFZp434F1719 (Accession NM_032248). Accordingly, utilities of VGAM2362 include diagnosis, prevention and treatment of diseases and clinical conditions associated with DKFZp434F1719. FLJ20013 (Accession NM_017621) is another VGAM2362 host target gene. FLJ20013 BINDING SITE is HOST TARGET binding site found in the 3' untranslated region of mRNA encoded by FLJ20013, corresponding to a HOST TARGET binding site such as BINDING SITE I, BINDING SITE II or BINDING SITE III. Table 2 illustrates the complementarity of the nucleotide sequences of FLJ20013 BINDING SITE, designated SEQ ID:19122, to the nucleotide sequence of VGAM2362 RNA, herein designated VGAM RNA, also designated SEQ ID:5073.

Another function of VGAM2362 is therefore inhibition of FLJ20013 (Accession NM_017621). Accordingly, utilities of VGAM2362 include diagnosis, prevention and treatment of diseases and clinical conditions associated with FLJ20013. G Protein-coupled Receptor Kinase-interactor 2 (GIT2, Accession NM_014776) is another VGAM2362 host target gene. GIT2 BINDING SITE1 through GIT2 BINDING SITE3 are HOST TARGET binding sites found in untranslated regions of mRNA encoded by GIT2, corresponding to HOST TARGET binding sites such as BINDING SITE I, BINDING SITE II or BINDING SITE III. Table 2 illustrates the complementarity of the nucleotide sequences of GIT2 BINDING SITE1 through GIT2 BINDING SITE3, designated SEQ ID:16602, SEQ ID:27684 and SEQ ID:27697 respectively, to the nucleotide sequence of VGAM2362 RNA, herein designated VGAM RNA, also designated SEQ ID:5073.

Another function of VGAM2362 is therefore inhibition of G Protein-coupled Receptor Kinase-interactor 2 (GIT2, Accession NM_014776). Accordingly, utilities of VGAM2362 include diagnosis, prevention and treatment of diseases and clinical conditions associated with GIT2. IDN3 (Accession NM_015384) is another VGAM2362 host target gene. IDN3 BINDING SITE1 and IDN3 BINDING SITE2 are HOST TARGET binding sites found in untranslated regions of mRNA encoded by IDN3, corresponding to HOST TARGET binding sites such as BINDING SITE I, BINDING SITE II or BINDING SITE III. Table 2 illustrates the complementarity of the nucleotide sequences of IDN3 BINDING SITE1 and IDN3 BINDING SITE2, designated SEQ ID:17684 and SEQ ID:26105 respectively, to the nucleotide sequence of VGAM2362 RNA, herein designated VGAM RNA, also designated SEQ ID:5073.

Another function of VGAM2362 is therefore inhibition of IDN3 (Accession NM_015384). Accordingly, utilities of VGAM2362 include diagnosis, prevention and treatment of diseases and clinical conditions associated with IDN3. KIAA1884 (Accession XM_055539) is another VGAM2362 host target gene. KIAA1884 BINDING SITE is HOST TARGET binding site found in the 3' untranslated region of mRNA encoded by KIAA1884, corresponding to a HOST TARGET binding site such as BINDING SITE I, BINDING SITE II or BINDING SITE III. Table 2 illustrates the complementarity of the nucleotide sequences of KIAA1884 BINDING SITE, designated SEQ ID:36297, to the nucleotide sequence of VGAM2362 RNA, herein designated VGAM RNA, also designated SEQ ID:5073.

Another function of VGAM2362 is therefore inhibition of KIAA1884 (Accession XM_055539). Accordingly, utilities of VGAM2362 include diagnosis, prevention and treatment of diseases and clinical conditions associated with KIAA1884. KIAA1944 (Accession XM_062545) is another VGAM2362 host target gene. KIAA1944 BINDING SITE is HOST TARGET binding site found in the 5' untranslated region of mRNA encoded by KIAA1944, corresponding to a HOST TARGET binding site such as BINDING SITE I, BINDING SITE II or BINDING SITE III. Table 2 illustrates the complementarity of the nucleotide sequences of KIAA1944 BINDING SITE, designated SEQ ID:37231, to the nucleotide sequence of VGAM2362 RNA, herein designated VGAM RNA, also designated SEQ ID:5073.

Another function of VGAM2362 is therefore inhibition of KIAA1944 (Accession XM_062545). Accordingly, utilities of VGAM2362 include diagnosis, prevention and treatment of diseases and clinical conditions associated with KIAA1944. LOC151162 (Accession XM_098012) is another VGAM2362 host target gene. LOC151162 BINDING SITE is HOST TARGET binding site found in the 5' untranslated region of mRNA encoded by LOC151162, corresponding to a HOST TARGET binding site such as BINDING SITE I, BINDING SITE II or BINDING SITE III. Table 2 illustrates the complementarity of the nucleotide sequences of LOC151162 BINDING SITE, designated SEQ ID:41306, to the nucleotide sequence of VGAM2362 RNA, herein designated VGAM RNA, also designated SEQ ID:5073.

Another function of VGAM2362 is therefore inhibition of LOC151162 (Accession XM_098012). Accordingly, utilities of VGAM2362 include diagnosis, prevention and treatment of diseases and clinical conditions associated with LOC151162. LOC203377 (Accession XM_117540) is another VGAM2362 host target gene. LOC203377 BINDING SITE is HOST TARGET binding site found in the 5' untranslated region of mRNA encoded by LOC203377, corresponding to a HOST TARGET binding site such as BINDING SITE I, BINDING SITE II or BINDING SITE III. Table 2 illustrates the complementarity of the nucleotide sequences of LOC203377 BINDING SITE, designated SEQ ID:43541, to the nucleotide sequence of VGAM2362 RNA, herein designated VGAM RNA, also designated SEQ ID:5073.

Another function of VGAM2362 is therefore inhibition of LOC203377 (Accession XM_117540). Accordingly, utilities of VGAM2362 include diagnosis, prevention and treatment of diseases and clinical conditions associated with LOC203377. LOC221576 (Accession XM_168088) is another VGAM2362 host target gene. LOC221576 BINDING SITE is HOST TARGET binding site found in the 3' untranslated region of mRNA encoded by LOC221576, corresponding to a HOST TARGET binding site such as BINDING SITE I, BINDING SITE II or BINDING SITE III. Table 2 illustrates the complementarity of the nucleotide sequences of LOC221576 BINDING SITE, designated SEQ ID:45000, to the nucleotide sequence of VGAM2362 RNA, herein designated VGAM RNA, also designated SEQ ID:5073.

Another function of VGAM2362 is therefore inhibition of LOC221576 (Accession XM_168088). Accordingly, utilities of VGAM2362 include diagnosis, prevention and treatment of diseases and clinical conditions associated with LOC221576. LOC253573 (Accession XM_173110) is another VGAM2362 host target gene. LOC253573 BINDING SITE is HOST TARGET binding site found in the 3' untranslated region of mRNA encoded by LOC253573, corresponding to a HOST TARGET binding site such as BINDING SITE I, BINDING SITE II or BINDING SITE III. Table 2 illustrates the complementarity of the nucleotide sequences of LOC253573 BINDING SITE, designated SEQ ID:46366, to the nucleotide sequence of VGAM2362 RNA, herein designated VGAM RNA, also designated SEQ ID:5073.

Another function of VGAM2362 is therefore inhibition of LOC253573 (Accession XM_173110). Accordingly, utilities of VGAM2362 include diagnosis, prevention and treatment of diseases and clinical conditions associated with LOC253573. LOC257515 (Accession XM_175211) is another VGAM2362 host target gene. LOC257515 BINDING SITE is HOST TARGET binding site found in the 3' untranslated region of mRNA encoded by LOC257515, corresponding to a HOST TARGET binding site such as BINDING SITE I, BINDING SITE II or BINDING SITE III. Table 2 illustrates the complementarity of the nucleotide sequences of LOC257515 BINDING SITE, designated SEQ ID:46684, to the nucleotide sequence of VGAM2362 RNA, herein designated VGAM RNA, also designated SEQ ID:5073.

Another function of VGAM2362 is therefore inhibition of LOC257515 (Accession XM_175211). Accordingly, utilities of VGAM2362 include diagnosis, prevention and treatment of diseases and clinical conditions associated with LOC257515. LOC257572 (Accession XM_175294) is another VGAM2362 host target gene. LOC257572 BINDING SITE is HOST TARGET binding site found in the 3' untranslated region of mRNA encoded by LOC257572, corresponding to a HOST TARGET binding site such as BINDING SITE I, BINDING SITE II or BINDING SITE III. Table 2 illustrates the complementarity of the nucleotide sequences of LOC257572 BINDING SITE, designated SEQ ID:46745, to the nucleotide sequence of VGAM2362 RNA, herein designated VGAM RNA, also designated SEQ ID:5073.

Another function of VGAM2362 is therefore inhibition of LOC257572 (Accession XM_175294). Accordingly, utilities of VGAM2362 include diagnosis, prevention and treatment of diseases and clinical conditions associated with LOC257572. FIG. 1 further provides a conceptual description of a novel bioinformatically detected viral gene of the present invention, referred to here as Viral Genomic Address Messenger 2363 (VGAM2363) viral gene, which modulates expression of respective host target genes thereof, the function and utility of which host target genes is known in the art.

VGAM2363 is a novel bioinformatically detected regulatory, non protein coding, viral micro RNA (miRNA) gene. The method by which VGAM2363 was detected is described hereinabove with reference to FIGS. 1-8.

VGAM2363 gene, herein designated VGAM GENE, is a viral gene contained in the genome of Equine Herpesvirus 2. VGAM2363 host target gene, herein designated VGAM HOST TARGET GENE, is a human gene contained in the human genome.

VGAM2363 gene encodes a VGAM2363 precursor RNA, herein designated VGAM PRECURSOR RNA. Similar to other miRNA genes, and unlike most ordinary genes, VGAM2363 precursor RNA does not encode a protein. A nucleotide sequence identical or highly similar to the nucleotide sequence of VGAM2363 precursor RNA is designated SEQ ID:2349, and is provided hereinbelow with reference to the sequence listing part. Nucleotide sequence SEQ ID:2349 is located at position 40183 relative to the genome of Equine Herpesvirus 2.

VGAM2363 precursor RNA folds onto itself, forming VGAM2363 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2363 folded precursor RNA into VGAM2363 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2363 RNA is designated SEQ ID:5074, and is provided hereinbelow with reference to the sequence listing part.

VGAM2363 host target gene, herein designated VGAM HOST TARGET GENE, encodes a corresponding messenger RNA, VGAM2363 host target RNA, herein designated VGAM HOST TARGET RNA. VGAM2363 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2363 RNA, herein designated VGAM RNA, binds complementarily to one or more host target binding sites located in untranslated regions of VGAM2363 host target RNA, herein designated VGAM HOST TARGET RNA. This complementary binding is due to the fact that the nucleotide sequence of VGAM2363 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2363 RNA, herein designated VGAM RNA, may have a different number of host target binding sites in untranslated regions of a VGAM2363 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2363 RNA, herein designated VGAM RNA, to host target binding sites on VGAM2363 host target RNA, herein designated VGAM HOST TARGET RNA, such as BINDING SITE I, BINDING SITE II and BINDING SITE III, inhibits translation of VGAM2363 host target RNA into VGAM2363 host target protein, herein designated VGAM HOST TARGET PROTEIN. VGAM host target protein is therefore outlined by a broken line.

It is appreciated that VGAM2363 host target gene, herein designated VGAM HOST TARGET GENE, in fact represents a plurality of VGAM2363 host target genes. The mRNA of each one of this plurality of VGAM2363 host target genes comprises one or more host target binding sites, each having a nucleotide sequence which is at least partly complementary to VGAM2363 RNA, herein designated VGAM RNA, and which when bound by VGAM2363 RNA causes inhibition of translation of respective one or more VGAM2363 host target proteins.

It is further appreciated by one skilled in the art that the mode of translational inhibition illustrated by FIG. 1 with specific reference to translational inhibition exerted by VGAM2363 gene, herein designated VGAM GENE, on one or more VGAM2363 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2363 is inhibition of expression of host target genes, as part of a novel viral mechanism of attacking a host. Accordingly, utilities of VGAM2363 include diagnosis, prevention and treatment of viral infection by Equine Herpesvirus 2. Specific functions, and accordingly utilities, of VGAM2363 correlate with, and may be deduced from, the identity of the host target genes which VGAM2363 binds and inhibits, and the function of these host target genes, as elaborated hereinbelow.

Nucleotide sequences of the VGAM2363 precursor RNA, herein designated VGAM PRECURSOR RNA, and of the 'diced' VGAM2363 RNA, herein designated VGAM RNA, and a schematic representation of the secondary folding of VGAM2363 folded precursor RNA, herein designated VGAM FOLDED PRECURSOR RNA, of VGAM2363 are further described hereinbelow with reference to Table 1.

Nucleotide sequences of host target binding sites, such as BINDING SITE-I, BINDING SITE-II and BINDING SITE-III of FIG. 1, found on VGAM2363 host target RNA, and schematic representation of the complementarity of each of these host target binding sites to VGAM2363 RNA, herein designated VGAM RNA, are described hereinbelow with reference to Table 2.

As mentioned hereinabove with reference to FIG. 1, a function of VGAM2363 gene, herein designated VGAM is inhibition of expression of VGAM2363 target genes. It is appreciated that specific functions, and accordingly utilities, of VGAM2363 correlate with, and may be deduced from, the identity of the target genes which VGAM2363 binds and inhibits, and the function of these target genes, as elaborated hereinbelow.

Megakaryocyte-associated Tyrosine Kinase (MATK, Accession NM_002378) is a VGAM2363 host target gene. MATK BINDING SITE is HOST TARGET binding site found in the 5' untranslated region of mRNA encoded by MATK, corresponding to a HOST TARGET binding site such as BINDING SITE I, BINDING SITE II or BINDING SITE III. Table 2 illustrates the complementarity of the nucleotide sequences of MATK BINDING SITE, designated SEQ ID:8194, to the nucleotide sequence of VGAM2363 RNA, herein designated VGAM RNA, also designated SEQ ID:5074.

A function of VGAM2363 is therefore inhibition of Megakaryocyte-associated Tyrosine Kinase (MATK, Accession NM_002378), a gene which can phosphorylate members of the SRC family of PTKs at the regulatory tyrosine residue. Accordingly, utilities of VGAM2363 include diagnosis, prevention and treatment of diseases and clinical conditions associated with MATK. The function of MATK and its association with various diseases and clinical conditions, has been established by previous studies, as described hereinabove with reference to VGAM2173. Fatty Acid Desaturase 2 (FADS2, Accession NM_004265) is another VGAM2363 host target gene. FADS2 BINDING SITE is HOST TARGET binding site found in the 3' untranslated region of mRNA encoded by FADS2, corresponding to a HOST TARGET binding site such as BINDING SITE I, BINDING SITE II or BINDING SITE III. Table 2 illustrates the complementarity of the nucleotide sequences of FADS2 BINDING SITE, designated SEQ ID:10469, to the nucleotide sequence of VGAM2363 RNA, herein designated VGAM RNA, also designated SEQ ID:5074.

Another function of VGAM2363 is therefore inhibition of Fatty Acid Desaturase 2 (FADS2, Accession NM_004265). Accordingly, utilities of VGAM2363 include diagnosis, prevention and treatment of diseases and clinical conditions associated with FADS2. FK506 Binding Protein 9, 63 KDa (FKBP9, Accession XM_168403) is another VGAM2363 host target gene. FKBP9 BINDING SITE is HOST TARGET binding site found in the 3' untranslated region of mRNA encoded by FKBP9, corresponding to a HOST TARGET binding site such as BINDING SITE I, BINDING SITE II or BINDING SITE III. Table 2 illustrates the complementarity of the nucleotide sequences of FKBP9 BINDING SITE, designated SEQ ID:45146, to the nucleotide sequence of VGAM2363 RNA, herein designated VGAM RNA, also designated SEQ ID:5074.

Another function of VGAM2363 is therefore inhibition of FK506 Binding Protein 9, 63 KDa (FKBP9, Accession XM_168403). Accordingly, utilities of VGAM2363 include diagnosis, prevention and treatment of diseases and clinical conditions associated with FKBP9. KIAA0318 (Accession XM_044334) is another VGAM2363 host target gene. KIAA0318 BINDING SITE is HOST TARGET binding site found in the 3' untranslated region of mRNA encoded by KIAA0318, corresponding to a HOST TARGET binding site such as BINDING SITE I, BINDING SITE II or BINDING SITE III. Table 2 illustrates the complementarity of the nucleotide sequences of KIAA0318 BINDING SITE, designated SEQ ID:34187, to the nucleotide sequence of VGAM2363 RNA, herein designated VGAM RNA, also designated SEQ ID:5074.

Another function of VGAM2363 is therefore inhibition of KIAA0318 (Accession XM_044334). Accordingly, utilities of VGAM2363 include diagnosis, prevention and treatment of diseases and clinical conditions associated with KIAA0318. KIAA1524 (Accession XM_056015) is another VGAM2363 host target gene. KIAA1524 BINDING SITE is HOST TARGET binding site found in the 5' untranslated region of mRNA encoded by KIAA1524, corresponding to a HOST TARGET binding site such as BINDING SITE I, BINDING SITE II or BINDING SITE III. Table 2 illustrates the complementarity of the nucleotide sequences of KIAA1524 BINDING SITE, designated SEQ ID:36360, to the nucleotide sequence of VGAM2363 RNA, herein designated VGAM RNA, also designated SEQ ID:5074.

Another function of VGAM2363 is therefore inhibition of KIAA1524 (Accession XM_056015). Accordingly, utilities of VGAM2363 include diagnosis, prevention and treatment of diseases and clinical conditions associated with KIAA1524. FIG. 1 further provides a conceptual description of a novel bioinformatically detected viral gene of the present invention, referred to here as Viral Genomic Address Messenger 2364 (VGAM2364) viral gene, which modulates expression of respective host target genes thereof, the function and utility of which host target genes is known in the art.

VGAM2364 is a novel bioinformatically detected regulatory, non protein coding, viral micro RNA (miRNA) gene. The method by which VGAM2364 was detected is described hereinabove with reference to FIGS. 1-8.

VGAM2364 gene, herein designated VGAM GENE, is a viral gene contained in the genome of Equine Herpesvirus 2. VGAM2364 host target gene, herein designated VGAM HOST TARGET GENE, is a human gene contained in the human genome.

VGAM2364 gene encodes a VGAM2364 precursor RNA, herein designated VGAM PRECURSOR RNA. Similar to other miRNA genes, and unlike most ordinary genes, VGAM2364 precursor RNA does not encode a protein. A nucleotide sequence identical or highly similar to the nucleotide sequence of VGAM2364 precursor RNA is designated SEQ ID:2350, and is provided hereinbelow with reference to the sequence listing part. Nucleotide sequence SEQ ID:2350 is located at position 23189 relative to the genome of Equine Herpesvirus 2.

VGAM2364 precursor RNA folds onto itself, forming VGAM2364 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2364 folded precursor RNA into VGAM2364 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM2364 RNA is designated SEQ ID:5075, and is provided hereinbelow with reference to the sequence listing part.

VGAM2364 host target gene, herein designated VGAM HOST TARGET GENE, encodes a corresponding messenger RNA, VGAM2364 host target RNA, herein designated VGAM HOST TARGET RNA. VGAM2364 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2364 RNA, herein designated VGAM RNA, binds complementarily to one or more host target binding sites located in untranslated regions of VGAM2364 host target RNA, herein designated VGAM HOST TARGET RNA. This complementary binding is due to the fact that the nucleotide sequence of VGAM2364 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2364 RNA, herein designated VGAM RNA, may have a different number of host target binding sites in untranslated regions of a VGAM2364 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2364 RNA, herein designated VGAM RNA, to host target binding sites on VGAM2364 host target RNA, herein designated VGAM HOST TARGET RNA, such as BINDING SITE I, BINDING SITE II and BINDING SITE III, inhibits translation of VGAM2364 host target RNA into VGAM2364 host target protein, herein designated VGAM HOST TARGET PROTEIN. VGAM host target protein is therefore outlined by a broken line.

It is appreciated that VGAM2364 host target gene, herein designated VGAM HOST TARGET GENE, in fact represents a plurality of VGAM2364 host target genes. The mRNA of each one of this plurality of VGAM2364 host target genes comprises one or more host target binding sites, each having a nucleotide sequence which is at least partly complementary to VGAM2364 RNA, herein designated VGAM RNA, and which when bound by VGAM2364 RNA causes inhibition of translation of respective one or more VGAM2364 host target proteins.

It is further appreciated by one skilled in the art that the mode of translational inhibition illustrated by FIG. 1 with specific reference to translational inhibition exerted by VGAM2364 gene, herein designated VGAM GENE, on one or more VGAM2364 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2364 is inhibition of expression of host target genes, as part of a novel viral mechanism of attacking a host. Accordingly, utilities of VGAM2364 include diagnosis, prevention and treatment of viral infection by Equine Herpesvirus 2. Specific functions, and accordingly utilities, of VGAM2364 correlate with, and may be deduced from, the identity of the host target genes which VGAM2364 binds and inhibits, and the function of these host target genes, as elaborated hereinbelow.

Nucleotide sequences of the VGAM2364 precursor RNA, herein designated VGAM PRECURSOR RNA, and of the 'diced' VGAM2364 RNA, herein designated VGAM RNA, and a schematic representation of the secondary folding of VGAM2364 folded precursor RNA, herein designated VGAM FOLDED PRECURSOR RNA, of VGAM2364 are further described hereinbelow with reference to Table 1.

Nucleotide sequences of host target binding sites, such as BINDING SITE-I, BINDING SITE-II and BINDING SITE-III of FIG. 1, found on VGAM2364 host target RNA, and schematic representation of the complementarity of each of these host target binding sites to VGAM2364 RNA, herein designated VGAM RNA, are described hereinbelow with reference to Table 2.

As mentioned hereinabove with reference to FIG. 1, a function of VGAM2364 gene, herein designated VGAM is inhibition of expression of VGAM2364 target genes. It is appreciated that specific functions, and accordingly utilities, of VGAM2364 correlate with, and may be deduced from, the identity of the target genes which VGAM2364 binds and inhibits, and the function of these target genes, as elaborated hereinbelow.

ATP-binding Cassette, Sub-family D (ALD), Member 4 (ABCD4, Accession NM_020326) is a VGAM2364 host target gene. ABCD4 BINDING SITE is HOST TARGET binding site found in the 3' untranslated region of mRNA encoded by ABCD4, corresponding to a HOST TARGET binding site such as BINDING SITE I, BINDING SITE II or BINDING SITE III. Table 2 illustrates the complementarity of the nucleotide sequences of ABCD4 BINDING SITE, designated SEQ ID:21590, to the nucleotide sequence of VGAM2364 RNA, herein designated VGAM RNA, also designated SEQ ID:5075.

A function of VGAM2364 is therefore inhibition of ATP-binding Cassette, Sub-family D (ALD), Member 4 (ABCD4, Accession NM_020326), a gene which Putative peroxisomal ATP binding cassette transporter. Accordingly, utilities of VGAM2364 include diagnosis, prevention and treatment of diseases and clinical conditions associated with ABCD4. The function of ABCD4 and its association with various diseases and clinical conditions, has been established by previous studies, as described hereinabove with reference to VGAM1924. Cadherin, EGF LAG Seven-pass G-type Receptor 1 (flamingo homolog, Drosophila) (CELSR1, Accession NM_014246) is another VGAM2364 host target gene. CELSR1 BINDING SITE is HOST TARGET binding site found in the 3' untranslated region of mRNA encoded by CELSR1, corresponding to a HOST TARGET binding site such as BINDING SITE I, BINDING SITE II or BINDING SITE III. Table 2 illustrates the complementarity of the nucleotide sequences of CELSR1 BINDING SITE, designated SEQ ID:15512, to the nucleotide sequence of VGAM2364 RNA, herein designated VGAM RNA, also designated SEQ ID:5075.

Another function of VGAM2364 is therefore inhibition of Cadherin, EGF LAG Seven-pass G-type Receptor 1 (flamingo homolog, Drosophila) (CELSR1, Accession NM_014246), a gene which is involved in contact-mediated communication. Accordingly, utilities of VGAM2364 include diagnosis, prevention and treatment of diseases and clinical conditions associated with CELSR1. The function of CELSR1 and its association with various diseases and clinical conditions, has been established by previous studies, as described hereinabove with reference to VGAM459. Hydroxysteroid (17-beta) Dehydrogenase 1 (HSD17B1, Accession NM_000413) is another VGAM2364 host target gene. HSD17B1 BINDING SITE is HOST TARGET binding site found in the 5' untranslated region of mRNA encoded by HSD17B1, corresponding to a HOST TARGET binding site such as BINDING SITE I, BINDING SITE II or BINDING SITE III. Table 2 illustrates the complementarity of the nucleotide sequences of HSD17B1 BINDING SITE, designated SEQ ID:5995, to the nucleotide sequence of VGAM2364 RNA, herein designated VGAM RNA, also designated SEQ ID:5075.

Another function of VGAM2364 is therefore inhibition of Hydroxysteroid (17-beta) Dehydrogenase 1 (HSD17B1, Accession NM_000413). Accordingly, utilities of VGAM2364 include diagnosis, prevention and treatment of diseases and clinical conditions associated with HSD17B1. Integrin, Alpha 4 (antigen CD49D, alpha 4 subunit of VLA-4 receptor) (ITGA4, Accession NM_000885) is another VGAM2364 host target gene. ITGA4 BINDING SITE is HOST TARGET binding site found in the 5' untranslated region of mRNA encoded by ITGA4, corresponding to a HOST TARGET binding site such as BINDING SITE I, BINDING SITE II or BINDING SITE III. Table 2 illustrates the complementarity of the nucleotide sequences of ITGA4 BINDING SITE, designated SEQ ID:6581, to the nucleotide sequence of VGAM2364 RNA, herein designated VGAM RNA, also designated SEQ ID:5075.

Another function of VGAM2364 is therefore inhibition of Integrin, Alpha 4 (antigen CD49D, alpha 4 subunit of VLA-4 receptor) (ITGA4, Accession NM_000885), a gene which recognizes one or more domains within the alternatively spliced cs-1 and cs-5 regions of fibronectin. Accordingly, utilities of VGAM2364 include diagnosis, prevention and treatment of diseases and clinical conditions associated with ITGA4. The function of ITGA4 and its association with various diseases and clinical conditions, has been established by previous studies, as described hereinabove with reference to VGAM1096. Myelin Basic Protein (MBP, Accession XM_117096) is another VGAM2364 host target gene. MBP BINDING SITE is HOST TARGET binding site found in the 3' untranslated region of mRNA encoded by MBP, corresponding to a HOST TARGET binding site such as BINDING SITE I, BINDING SITE II or BINDING SITE III. Table 2 illustrates the complementarity of the nucleotide sequences of MBP BINDING SITE, designated SEQ ID:43220, to the nucleotide sequence of VGAM2364 RNA, herein designated VGAM RNA, also designated SEQ ID:5075.

Another function of VGAM2364 is therefore inhibition of Myelin Basic Protein (MBP, Accession XM_117096), a gene which Myelin basic protein; a constituent of myelin, plays a role in nerve function. Accordingly, utilities of VGAM2364 include diagnosis, prevention and treatment of diseases and clinical conditions associated with MBP. The function of MBP and its association with various diseases and clinical conditions, has been established by previous studies, as described hereinabove with reference to VGAM1959. PR Domain Containing 2, with ZNF Domain (PRDM2, Accession NM_015866) is another VGAM2364 host target gene. PRDM2 BINDING SITE1 and PRDM2 BINDING SITE2 are HOST TARGET binding sites found in untranslated regions of mRNA encoded by PRDM2, corresponding to HOST TARGET binding sites such as BINDING SITE I, BINDING SITE II or BINDING SITE III. Table 2 illustrates the complementarity of the nucleotide sequences of PRDM2 BINDING SITE1 and PRDM2 BINDING SITE2, designated SEQ ID:18000 and SEQ ID:14532 respectively, to the nucleotide sequence of VGAM2364 RNA, herein designated VGAM RNA, also designated SEQ ID:5075.

Another function of VGAM2364 is therefore inhibition of PR Domain Containing 2, with ZNF Domain (PRDM2, Accession NM_015866), a gene which plays a role in transcriptional regulation during neuronal differentiation and pathogenesis of retinoblastoma. Accordingly, utilities of VGAM2364 include diagnosis, prevention and treatment of diseases and clinical conditions associated with PRDM2. The function of PRDM2 and its association with various diseases and clinical conditions, has been established by previous studies, as described hereinabove with reference to VGAM120. Synaptogyrin 1 (SYNGR1, Accession NM_004711) is another VGAM2364 host target gene. SYNGR1 BINDING SITE is HOST TARGET binding site found in the 3' untranslated region of mRNA encoded by SYNGR1, corresponding to a HOST TARGET binding site such as BINDING SITE I, BINDING SITE II or BINDING SITE III. Table 2 illustrates the complementarity of the nucleotide sequences of SYNGR1 BINDING SITE, designated SEQ ID:11064, to the nucleotide sequence of VGAM2364 RNA, herein designated VGAM RNA, also designated SEQ ID:5075.

Another function of VGAM2364 is therefore inhibition of Synaptogyrin 1 (SYNGR1, Accession NM_004711), a gene which belongs to transmembrane synaptic vesicle protein and may function in membrane recycling. Accordingly, utilities of VGAM2364 include diagnosis, prevention and treatment of diseases and clinical conditions associated with SYNGR1. The function of SYNGR1 and its association with various diseases and clinical conditions, has been established by previous studies, as described hereinabove with reference to VGAM107. FLJ11053 (Accession XM_114194) is another VGAM2364 host target gene. FLJ11053 BINDING SITE is HOST TARGET binding site found in the 5' untranslated region of mRNA encoded by FLJ11053, corresponding to a HOST TARGET binding site such as BINDING SITE I, BINDING SITE II or BINDING SITE III. Table 2 illustrates the complementarity of the nucleotide sequences of FLJ11053 BINDING SITE, designated SEQ ID:42777, to the nucleotide sequence of VGAM2364 RNA, herein designated VGAM RNA, also designated SEQ ID:5075.

Another function of VGAM2364 is therefore inhibition of FLJ11053 (Accession XM_114194). Accordingly, utilities of VGAM2364 include diagnosis, prevention and treatment of diseases and clinical conditions associated with FLJ11053. FLJ11539 (Accession NM_024748) is another VGAM2364 host target gene. FLJ11539 BINDING SITE is HOST TARGET binding site found in the 5' untranslated region of mRNA encoded by FLJ11539, corresponding to a HOST TARGET binding site such as BINDING SITE I, BINDING SITE II or BINDING SITE III. Table 2 illustrates the complementarity of the nucleotide sequences of FLJ11539 BINDING SITE, designated SEQ ID:24087, to the nucleotide sequence of VGAM2364 RNA, herein designated VGAM RNA, also designated SEQ ID:5075.

Another function of VGAM2364 is therefore inhibition of FLJ11539 (Accession NM_024748). Accordingly, utilities of VGAM2364 include diagnosis, prevention and treatment of diseases and clinical conditions associated with FLJ11539. FLJ12505 (Accession NM_024749) is another VGAM2364 host target gene. FLJ12505 BINDING SITE is HOST TARGET binding site found in the 5' untranslated region of mRNA encoded by FLJ12505, corresponding to a HOST TARGET binding site such as BINDING SITE I, BINDING SITE II or BINDING SITE III. Table 2 illustrates the complementarity of the nucleotide sequences of FLJ12505 BINDING SITE, designated SEQ ID:24093, to the nucleotide sequence of VGAM2364 RNA, herein designated VGAM RNA, also designated SEQ ID:5075.

Another function of VGAM2364 is therefore inhibition of FLJ12505 (Accession NM_024749). Accordingly, utilities of VGAM2364 include diagnosis, prevention and treatment of diseases and clinical conditions associated with FLJ12505. FLJ14129 (Accession NM_030895) is another VGAM2364 host target gene. FLJ14129 BINDING SITE is HOST TARGET binding site found in the 3' untranslated region of mRNA encoded by FLJ14129, corresponding to a HOST TARGET binding site such as BINDING SITE I, BINDING SITE II or BINDING SITE III. Table 2 illustrates the complementarity of the nucleotide sequences of FLJ14129 BINDING SITE, designated SEQ ID:25163, to the nucleotide sequence of VGAM2364 RNA, herein designated VGAM RNA, also designated SEQ ID:5075.

Another function of VGAM2364 is therefore inhibition of FLJ14129 (Accession NM_030895). Accordingly, utilities of VGAM2364 include diagnosis, prevention and treatment of diseases and clinical conditions associated with FLJ14129. FLJ20004 (Accession XM_170889) is another VGAM2364 host target gene. FLJ20004 BINDING SITE is HOST TARGET binding site found in the 5' untranslated region of mRNA encoded by FLJ20004, corresponding to a HOST TARGET binding site such as BINDING SITE I, BINDING SITE II or BINDING SITE III. Table 2 illustrates the complementarity of the nucleotide sequences of FLJ20004 BINDING SITE, designated SEQ ID:45644, to the nucleotide sequence of VGAM2364 RNA, herein designated VGAM RNA, also designated SEQ ID:5075.

Another function of VGAM2364 is therefore inhibition of FLJ20004 (Accession XM_170889). Accordingly, utilities of VGAM2364 include diagnosis, prevention and treatment of diseases and clinical conditions associated with FLJ20004. FLJ21709 (Accession XM_085480) is another VGAM2364 host target gene. FLJ21709 BINDING SITE is HOST TARGET binding site found in the 3' untranslated region of mRNA encoded by FLJ21709, corresponding to a HOST TARGET binding site such as BINDING SITE I, BINDING SITE II or BINDING SITE III. Table 2 illustrates the complementarity of the nucleotide sequences of FLJ21709 BINDING SITE, designated SEQ ID:38171, to the nucleotide sequence of VGAM2364 RNA, herein designated VGAM RNA, also designated SEQ ID:5075.

Another function of VGAM2364 is therefore inhibition of FLJ21709 (Accession XM_085480). Accordingly, utilities of VGAM2364 include diagnosis, prevention and treatment of diseases and clinical conditions associated with FLJ21709. KIAA0084 (Accession XM_042841) is another VGAM2364 host target gene. KIAA0084 BINDING SITE is HOST TARGET binding site found in the 3' untranslated region of mRNA encoded by KIAA0084, corresponding to a HOST TARGET binding site such as BINDING SITE I, BINDING SITE II or BINDING SITE III. Table 2 illustrates the complementarity of the nucleotide sequences of KIAA0084 BINDING SITE, designated SEQ ID:33804, to the nucleotide sequence of VGAM2364 RNA, herein designated VGAM RNA, also designated SEQ ID:5075.

Another function of VGAM2364 is therefore inhibition of KIAA0084 (Accession XM_042841). Accordingly, utilities of VGAM2364 include diagnosis, prevention and treatment of diseases and clinical conditions associated with KIAA0084. KIAA0376 (Accession XM_037759) is another VGAM2364 host target gene. KIAA0376 BINDING SITE is HOST TARGET binding site found in the 5' untranslated region of mRNA encoded by KIAA0376, corresponding to a HOST TARGET binding site such as BINDING SITE I, BINDING SITE II or BINDING SITE III. Table 2 illustrates the complementarity of the nucleotide sequences of KIAA0376 BINDING SITE, designated SEQ ID:32673, to the nucleotide sequence of VGAM2364 RNA, herein designated VGAM RNA, also designated SEQ ID:5075.

Another function of VGAM2364 is therefore inhibition of KIAA0376 (Accession XM_037759). Accordingly, utilities of VGAM2364 include diagnosis, prevention and treatment of diseases and clinical conditions associated with KIAA0376. Kruppel-like Factor 5 (intestinal) (KLF5, Accession NM_001730) is another VGAM2364 host target gene. KLF5 BINDING SITE is HOST TARGET binding site found in the 5' untranslated region of mRNA encoded by KLF5, corresponding to a HOST TARGET binding site such as BINDING SITE I, BINDING SITE II or BINDING SITE III. Table 2 illustrates the complementarity of the nucleotide sequences of KLF5 BINDING SITE, designated SEQ ID:7462, to the nucleotide sequence of VGAM2364 RNA, herein designated VGAM RNA, also designated SEQ ID:5075.

Another function of VGAM2364 is therefore inhibition of Kruppel-like Factor 5 (intestinal) (KLF5, Accession NM_001730). Accordingly, utilities of VGAM2364 include diagnosis, prevention and treatment of diseases and clinical conditions associated with KLF5. MGC15631 (Accession NM_032753) is another VGAM2364 host target gene. MGC15631 BINDING SITE is HOST TARGET binding site found in the 3' untranslated region of mRNA encoded by MGC15631, corresponding to a HOST TARGET binding site such as BINDING SITE I, BINDING SITE II or BINDING SITE III. Table 2 illustrates the complementarity of the nucleotide sequences of MGC15631 BINDING SITE, designated SEQ ID:26493, to the nucleotide sequence of VGAM2364 RNA, herein designated VGAM RNA, also designated SEQ ID:5075.

Another function of VGAM2364 is therefore inhibition of MGC15631 (Accession NM_032753). Accordingly, utilities of VGAM2364 include diagnosis, prevention and treatment of diseases and clinical conditions associated with MGC15631. MGC20727 (Accession NM_052853) is another VGAM2364 host target gene. MGC20727 BINDING SITE is HOST TARGET binding site found in the 5' untranslated region of mRNA encoded by MGC20727, corresponding to a HOST TARGET binding site such as BINDING SITE I, BINDING SITE II or BINDING SITE III. Table 2 illustrates the complementarity of the nucleotide sequences of MGC20727 BINDING SITE, designated SEQ ID:27436, to the nucleotide sequence of VGAM2364 RNA, herein designated VGAM RNA, also designated SEQ ID:5075.

Another function of VGAM2364 is therefore inhibition of MGC20727 (Accession NM_052853). Accordingly, utilities of VGAM2364 include diagnosis, prevention and treatment of diseases and clinical conditions associated with MGC20727. MGC2605 (Accession NM_032304) is another VGAM2364 host target gene. MGC2605 BINDING SITE is HOST TARGET binding site found in the 5' untranslated region of mRNA encoded by MGC2605, corresponding to a HOST TARGET binding site such as BINDING SITE I, BINDING SITE II or BINDING SITE III. Table 2 illustrates the complementarity of the nucleotide sequences of MGC2605 BINDING SITE, designated SEQ ID:26086, to the nucleotide sequence of VGAM2364 RNA, herein designated VGAM RNA, also designated SEQ ID:5075.

Another function of VGAM2364 is therefore inhibition of MGC2605 (Accession NM_032304). Accordingly, utilities of VGAM2364 include diagnosis, prevention and treatment of diseases and clinical conditions associated with MGC2605. PP1665 (Accession NM_030792) is another VGAM2364 host target gene. PP1665 BINDING SITE is HOST TARGET binding site found in the 3' untranslated region of mRNA encoded by PP1665, corresponding to a HOST TARGET binding site such as BINDING SITE I, BINDING SITE II or BINDING SITE III. Table 2 illustrates the complementarity of the nucleotide sequences of PP1665 BINDING SITE, designated SEQ ID:25090, to the nucleotide sequence of VGAM2364 RNA, herein designated VGAM RNA, also designated SEQ ID:5075.

Another function of VGAM2364 is therefore inhibition of PP1665 (Accession NM_030792). Accordingly, utilities of VGAM2364 include diagnosis, prevention and treatment of diseases and clinical conditions associated with PP1665.

Phosphatidylserine Synthase 2 (PTDSS2, Accession NM_030783) is another VGAM2364 host target gene. PTDSS2 BINDING SITE is HOST TARGET binding site found in the 5' untranslated region of mRNA encoded by PTDSS2, corresponding to a HOST TARGET binding site such as BINDING SITE I, BINDING SITE II or BINDING SITE III. Table 2 illustrates the complementarity of the nucleotide sequences of PTDSS2 BINDING SITE, designated SEQ ID:25076, to the nucleotide sequence of VGAM2364 RNA, herein designated VGAM RNA, also designated SEQ ID:5075.

Another function of VGAM2364 is therefore inhibition of Phosphatidylserine Synthase 2 (PTDSS2, Accession NM_030783). Accordingly, utilities of VGAM2364 include diagnosis, prevention and treatment of diseases and clinical conditions associated with PTDSS2. SAST (Accession XM_032034) is another VGAM2364 host target gene. SAST BINDING SITE is HOST TARGET binding site found in the 5' untranslated region of mRNA encoded by SAST, corresponding to a HOST TARGET binding site such as BINDING SITE I, BINDING SITE II or BINDING SITE III. Table 2 illustrates the complementarity of the nucleotide sequences of SAST BINDING SITE, designated SEQ ID:31539, to the nucleotide sequence of VGAM2364 RNA, herein designated VGAM RNA, also designated SEQ ID:5075.

Another function of VGAM2364 is therefore inhibition of SAST (Accession XM_032034). Accordingly, utilities of VGAM2364 include diagnosis, prevention and treatment of diseases and clinical conditions associated with SAST. SSH2 (Accession XM_030846) is another VGAM2364 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31179, to the nucleotide sequence of VGAM2364 RNA, herein designated VGAM RNA, also designated SEQ ID:5075.

Another function of VGAM2364 is therefore inhibition of SSH2 (Accession XM_030846). Accordingly, utilities of VGAM2364 include diagnosis, prevention and treatment of diseases and clinical conditions associated with SSH2. U5-116KD (Accession NM_004247) is another VGAM2364 host target gene. U5-116KD BINDING SITE is HOST TARGET binding site found in the 3' untranslated region of mRNA encoded by U5-116KD, corresponding to a HOST TARGET binding site such as BINDING SITE I, BINDING SITE II or BINDING SITE III. Table 2 illustrates the complementarity of the nucleotide sequences of U5-116KD BINDING SITE, designated SEQ ID:10437, to the nucleotide sequence of VGAM2364 RNA, herein designated VGAM RNA, also designated SEQ ID:5075.

Another function of VGAM2364 is therefore inhibition of U5-116KD (Accession NM_004247). Accordingly, utilities of VGAM2364 include diagnosis, prevention and treatment of diseases and clinical conditions associated with U5-116KD. LOC130074 (Accession XM_072228) is another VGAM2364 host target gene. LOC130074 BINDING SITE is HOST TARGET binding site found in the 3' untranslated region of mRNA encoded by LOC130074, corresponding to a HOST TARGET binding site such as BINDING SITE I, BINDING SITE II or BINDING SITE III. Table 2 illustrates the complementarity of the nucleotide sequences of LOC130074 BINDING SITE, designated SEQ ID:37471, to the nucleotide sequence of VGAM2364 RNA, herein designated VGAM RNA, also designated SEQ ID:5075.

Another function of VGAM2364 is therefore inhibition of LOC130074 (Accession XM_072228). Accordingly, utilities of VGAM2364 include diagnosis, prevention and treatment of diseases and clinical conditions associated with LOC130074. LOC146506 (Accession XM_085489) is another VGAM2364 host target gene. LOC146506 BINDING SITE is HOST TARGET binding site found in the 3' untranslated region of mRNA encoded by LOC146506, corresponding to a HOST TARGET binding site such as BINDING SITE I, BINDING SITE II or BINDING SITE III. Table 2 illustrates the complementarity of the nucleotide sequences of LOC146506 BINDING SITE, designated SEQ ID:38179, to the nucleotide sequence of VGAM2364 RNA, herein designated VGAM RNA, also designated SEQ ID:5075.

Another function of VGAM2364 is therefore inhibition of LOC146506 (Accession XM_085489). Accordingly, utilities of VGAM2364 include diagnosis, prevention and treatment of diseases and clinical conditions associated with LOC146506. LOC147229 (Accession XM_085742) is another VGAM2364 host target gene. LOC147229 BINDING SITE is HOST TARGET binding site found in the 5' untranslated region of mRNA encoded by LOC147229, corresponding to a HOST TARGET binding site such as BINDING SITE I, BINDING SITE II or BINDING SITE III. Table 2 illustrates the complementarity of the nucleotide sequences of LOC147229 BINDING SITE, designated SEQ ID:38317, to the nucleotide sequence of VGAM2364 RNA, herein designated VGAM RNA, also designated SEQ ID:5075.

Another function of VGAM2364 is therefore inhibition of LOC147229 (Accession XM_085742). Accordingly, utilities of VGAM2364 include diagnosis, prevention and treatment of diseases and clinical conditions associated with LOC147229. LOC150244 (Accession XM_086856) is another VGAM2364 host target gene. LOC150244 BINDING SITE is HOST TARGET binding site found in the 5' untranslated region of mRNA encoded by LOC150244, corresponding to a HOST TARGET binding site such as BINDING SITE I, BINDING SITE II or BINDING SITE III. Table 2 illustrates the complementarity of the nucleotide sequences of LOC150244 BINDING SITE, designated SEQ ID:38920, to the nucleotide sequence of VGAM2364 RNA, herein designated VGAM RNA, also designated SEQ ID:5075.

Another function of VGAM2364 is therefore inhibition of LOC150244 (Accession XM_086856). Accordingly, utilities of VGAM2364 include diagnosis, prevention and treatment of diseases and clinical conditions associated with LOC150244. LOC257426 (Accession XM_039451) is another VGAM2364 host target gene. LOC257426 BINDING SITE is HOST TARGET binding site found in the 3' untranslated region of mRNA encoded by LOC257426, corresponding to a HOST TARGET binding site such as BINDING SITE I, BINDING SITE II or BINDING SITE III. Table 2 illustrates the complementarity of the nucleotide sequences of LOC257426 BINDING SITE, designated SEQ ID:33099, to the nucleotide sequence of VGAM2364 RNA, herein designated VGAM RNA, also designated SEQ ID:5075.

Another function of VGAM2364 is therefore inhibition of LOC257426 (Accession XM_039451). Accordingly, utilities of VGAM2364 include diagnosis, prevention and treatment of diseases and clinical conditions associated with LOC257426. LOC51608 (Accession XM_033102) is another VGAM2364 host target gene. LOC51608 BINDING SITE is HOST TARGET binding site found in the 3' untranslated region of mRNA encoded by LOC51608, corresponding to a HOST TARGET binding site such as BINDING SITE I, BINDING SITE II or BINDING SITE III. Table 2 illustrates the complementarity of the nucleotide sequences of LOC51608 BINDING SITE, designated SEQ ID:31840, to the nucleotide sequence of VGAM2364 RNA, herein designated VGAM RNA, also designated SEQ ID:5075.

Another function of VGAM2364 is therefore inhibition of LOC51608 (Accession XM_033102). Accordingly, utilities of VGAM2364 include diagnosis, prevention and treatment of diseases and clinical conditions associated with LOC51608. FIG. 1 further provides a conceptual description of a novel bioinformatically detected viral gene of the present invention, referred to here as Viral Genomic Address Messenger 2365 (VGAM2365) viral gene, which modulates expression of respective host target genes thereof, the function and utility of which host target genes is known in the art.

VGAM2365 is a novel bioinformatically detected regulatory, non protein coding, viral micro RNA (miRNA) gene. The method by which VGAM2365 was detected is described hereinabove with reference to FIGS. 1-8.

VGAM2365 gene, herein designated VGAM GENE, is a viral gene contained in the genome of Rat Cytomegalovirus. VGAM2365 host target gene, herein designated VGAM HOST TARGET GENE, is a human gene contained in the human genome.

VGAM2365 gene encodes a VGAM2365 precursor RNA, herein designated VGAM PRECURSOR RNA. Similar to other miRNA genes, and unlike most ordinary genes, VGAM2365 precursor RNA does not encode a protein. A nucleotide sequence identical or highly similar to the nucleotide sequence of VGAM2365 precursor RNA is designated SEQ ID:2351, and is provided hereinbelow with reference to the sequence listing part. Nucleotide sequence SEQ ID:2351 is located at position 185947 relative to the genome of Rat Cytomegalovirus.

VGAM2365 precursor RNA folds onto itself, forming VGAM2365 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2365 folded precursor RNA into VGAM2365 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2365 RNA is designated SEQ ID:5076, and is provided hereinbelow with reference to the sequence listing part.

VGAM2365 host target gene, herein designated VGAM HOST TARGET GENE, encodes a corresponding messenger RNA, VGAM2365 host target RNA, herein designated VGAM HOST TARGET RNA. VGAM2365 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2365 RNA, herein designated VGAM RNA, binds complementarily to one or more host target binding sites located in untranslated regions of VGAM2365 host target RNA, herein designated VGAM HOST TARGET RNA. This complementary binding is due to the fact that the nucleotide sequence of VGAM2365 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2365 RNA, herein designated VGAM RNA, may have a different number of host target binding sites in untranslated regions of a VGAM2365 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2365 RNA, herein designated VGAM RNA, to host target binding sites on VGAM2365 host target RNA, herein designated VGAM HOST TARGET RNA, such as BINDING SITE I, BINDING SITE II and BINDING SITE III, inhibits translation of VGAM2365 host target RNA into VGAM2365 host target protein, herein designated VGAM HOST TARGET PROTEIN. VGAM host target protein is therefore outlined by a broken line.

It is appreciated that VGAM2365 host target gene, herein designated VGAM HOST TARGET GENE, in fact represents a plurality of VGAM2365 host target genes. The mRNA of each one of this plurality of VGAM2365 host target genes comprises one or more host target binding sites, each having a nucleotide sequence which is at least partly complementary to VGAM2365 RNA, herein designated VGAM RNA, and which when bound by VGAM2365 RNA causes inhibition of translation of respective one or more VGAM2365 host target proteins.

It is further appreciated by one skilled in the art that the mode of translational inhibition illustrated by FIG. 1 with specific reference to translational inhibition exerted by VGAM2365 gene, herein designated VGAM GENE, on one or more VGAM2365 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2365 is inhibition of expression of host target genes, as part of a novel viral mechanism of attacking a host. Accordingly, utilities of VGAM2365 include diagnosis, prevention and treatment of viral infection by Rat Cytomegalovirus. Specific functions, and accordingly utilities, of VGAM2365 correlate with, and may be deduced from, the identity of the host target genes which VGAM2365 binds and inhibits, and the function of these host target genes, as elaborated hereinbelow.

Nucleotide sequences of the VGAM2365 precursor RNA, herein designated VGAM PRECURSOR RNA, and of the 'diced' VGAM2365 RNA, herein designated VGAM RNA, and a schematic representation of the secondary folding of VGAM2365 folded precursor RNA, herein designated VGAM FOLDED PRECURSOR RNA, of VGAM2365 are further described hereinbelow with reference to Table 1.

Nucleotide sequences of host target binding sites, such as BINDING SITE-I, BINDING SITE-II and BINDING SITE- III of FIG. 1, found on VGAM2365 host target RNA, and schematic representation of the complementarity of each of these host target binding sites to VGAM2365 RNA, herein designated VGAM RNA, are described hereinbelow with reference to Table 2.

As mentioned hereinabove with reference to FIG. 1, a function of VGAM2365 gene, herein designated VGAM is inhibition of expression of VGAM2365 target genes. It is appreciated that specific functions, and accordingly utilities, of VGAM2365 correlate with, and may be deduced from, the identity of the target genes which VGAM2365 binds and inhibits, and the function of these target genes, as elaborated hereinbelow.

Polycystic Kidney and Hepatic Disease 1 (autosomal recessive) (PKHD1, Accession NM_138694) is a VGAM2365 host target gene. PKHD1 BINDING SITE is HOST TARGET binding site found in the 3' untranslated region of mRNA encoded by PKHD1, corresponding to a HOST TARGET binding site such as BINDING SITE I, BINDING SITE II or BINDING SITE III. Table 2 illustrates the complementarity of the nucleotide sequences of PKHD1 BINDING SITE, designated SEQ ID:28946, to the nucleotide sequence of VGAM2365 RNA, herein designated VGAM RNA, also designated SEQ ID:5076.

A function of VGAM2365 is therefore inhibition of Polycystic Kidney and Hepatic Disease 1 (autosomal recessive) (PKHD1, Accession NM_138694). Accordingly, utilities of VGAM2365 include diagnosis, prevention and treatment of diseases and clinical conditions associated with PKHD1. RAD17 Homolog (S. pombe) (RAD17, Accession NM_133340) is another VGAM2365 host target gene. RAD17 BINDING SITE is HOST TARGET binding site found in the 5' untranslated region of mRNA encoded by RAD17, corresponding to a HOST TARGET binding site such as BINDING SITE I, BINDING SITE II or BINDING SITE III. Table 2 illustrates the complementarity of the nucleotide sequences of RAD17 BINDING SITE, designated SEQ ID:28482, to the nucleotide sequence of VGAM2365 RNA, herein designated VGAM RNA, also designated SEQ ID:5076.

Another function of VGAM2365 is therefore inhibition of RAD17 Homolog (S. pombe) (RAD17, Accession NM_133340), a gene which may have a role in DNA damage-dependent and DNA replication-dependent cell cycle checkpoints. Accordingly, utilities of VGAM2365 include diagnosis, prevention and treatment of diseases and clinical conditions associated with RAD17. The function of RAD17 and its association with various diseases and clinical conditions, has been established by previous studies, as described hereinabove with reference to VGAM209. Solute Carrier Family 25 (mitochondrial carrier; ornithine transporter) Member 15 (SLC25A15, Accession NM_014252) is another VGAM2365 host target gene. SLC25A15 BINDING SITE is HOST TARGET binding site found in the 3' untranslated region of mRNA encoded by SLC25A15, corresponding to a HOST TARGET binding site such as BINDING SITE I, BINDING SITE II or BINDING SITE III. Table 2 illustrates the complementarity of the nucleotide sequences of SLC25A15 BINDING SITE, designated SEQ ID:15524, to the nucleotide sequence of VGAM2365 RNA, herein designated VGAM RNA, also designated SEQ ID:5076.

Another function of VGAM2365 is therefore inhibition of Solute Carrier Family 25 (mitochondrial carrier; ornithine transporter) Member 15 (SLC25A15, Accession NM_014252), a gene which participates theornithine transport across inner mitochondrial membrane, from the cytoplasm to the matrix. Accordingly, utilities of VGAM2365 include diagnosis, prevention and treatment of diseases and clinical conditions associated with SLC25A15. The function of SLC25A15 and its association with various diseases and clinical conditions, has been established by previous studies, as described hereinabove with reference to VGAM172. Solute Carrier Family 38, Member 2 (SLC38A2, Accession NM_018976) is another VGAM2365 host target gene. SLC38A2 BINDING SITE is HOST TARGET binding site found in the 3' untranslated region of mRNA encoded by SLC38A2, corresponding to a HOST TARGET binding site such as BINDING SITE I, BINDING SITE II or BINDING SITE III. Table 2 illustrates the complementarity of the nucleotide sequences of SLC38A2 BINDING SITE, designated SEQ ID:21050, to the nucleotide sequence of VGAM2365 RNA, herein designated VGAM RNA, also designated SEQ ID:5076.

Another function of VGAM2365 is therefore inhibition of Solute Carrier Family 38, Member 2 (SLC38A2, Accession NM_018976), a gene which is an amino acid transporter. Accordingly, utilities of VGAM2365 include diagnosis, prevention and treatment of diseases and clinical conditions associated with SLC38A2. The function of SLC38A2 and its association with various diseases and clinical conditions, has been established by previous studies, as described hereinabove with reference to VGAM200. ARNTL2 (Accession NM_020183) is another VGAM2365 host target gene. ARNTL2 BINDING SITE is HOST TARGET binding site found in the 3' untranslated region of mRNA encoded by ARNTL2, corresponding to a HOST TARGET binding site such as BINDING SITE I, BINDING SITE II or BINDING SITE III. Table 2 illustrates the complementarity of the nucleotide sequences of ARNTL2 BINDING SITE, designated SEQ ID:21410, to the nucleotide sequence of VGAM2365 RNA, herein designated VGAM RNA, also designated SEQ ID:5076.

Another function of VGAM2365 is therefore inhibition of ARNTL2 (Accession NM_020183). Accordingly, utilities of VGAM2365 include diagnosis, prevention and treatment of diseases and clinical conditions associated with ARNTL2. Chromosome 20 Open Reading Frame 7 (C20orf7, Accession NM_024120) is another VGAM2365 host target gene. C20orf7 BINDING SITE is HOST TARGET binding site found in the 3' untranslated region of mRNA encoded by C20orf7, corresponding to a HOST TARGET binding site such as BINDING SITE I, BINDING SITE II or BINDING SITE III. Table 2 illustrates the complementarity of the nucleotide sequences of C20orf7 BINDING SITE, designated SEQ ID:23572, to the nucleotide sequence of VGAM2365 RNA, herein designated VGAM RNA, also designated SEQ ID:5076.

Another function of VGAM2365 is therefore inhibition of Chromosome 20 Open Reading Frame 7 (C20orf7, Accession NM_024120). Accordingly, utilities of VGAM2365 include diagnosis, prevention and treatment of diseases and clinical conditions associated with C20orf7. CDA02 (Accession XM_042168) is another VGAM2365 host target gene. CDA02 BINDING SITE is HOST TARGET binding site found in the 5' untranslated region of mRNA encoded by CDA02, corresponding to a HOST TARGET binding site such as BINDING SITE I, BINDING SITE II or BINDING SITE III. Table 2 illustrates the complementarity of the nucleotide sequences of CDA02 BINDING SITE, designated SEQ ID:33702, to the nucleotide sequence of VGAM2365 RNA, herein designated VGAM RNA, also designated SEQ ID:5076.

Another function of VGAM2365 is therefore inhibition of CDA02 (Accession XM_042168). Accordingly, utilities of VGAM2365 include diagnosis, prevention and treatment of diseases and clinical conditions associated with CDA02. Death-associated Protein Kinase 2 (DAPK2, Accession NM_014326) is another VGAM2365 host target gene. DAPK2 BINDING SITE is HOST TARGET binding site found in the 3' untranslated region of mRNA encoded by DAPK2, corresponding to a HOST TARGET binding site such as BINDING SITE I, BINDING SITE II or BINDING SITE III. Table 2 illustrates the complementarity of the nucleotide sequences of DAPK2 BINDING SITE, designated SEQ ID:15637, to the nucleotide sequence of VGAM2365 RNA, herein designated VGAM RNA, also designated SEQ ID:5076.

Another function of VGAM2365 is therefore inhibition of Death-associated Protein Kinase 2 (DAPK2, Accession NM_014326). Accordingly, utilities of VGAM2365 include diagnosis, prevention and treatment of diseases and clinical conditions associated with DAPK2. DKFZP586I2223 (Accession NM_015438) is another VGAM2365 host target gene. DKFZP586I2223 BINDING SITE is HOST TARGET binding site found in the 3' untranslated region of mRNA encoded by DKFZP586I2223, corresponding to a HOST TARGET binding site such as BINDING SITE I, BINDING SITE II or BINDING SITE III. Table 2 illustrates the complementarity of the nucleotide sequences of DKFZP586I2223 BINDING SITE, designated SEQ ID:17733, to the nucleotide sequence of VGAM2365 RNA, herein designated VGAM RNA, also designated SEQ ID:5076.

Another function of VGAM2365 is therefore inhibition of DKFZP586I2223 (Accession NM_015438). Accordingly, utilities of VGAM2365 include diagnosis, prevention and treatment of diseases and clinical conditions associated with DKFZP586I2223. FLJ10803 (Accession NM_018224) is another VGAM2365 host target gene. FLJ10803 BINDING SITE is HOST TARGET binding site found in the 3' untranslated region of mRNA encoded by FLJ10803, corresponding to a HOST TARGET binding site such as BINDING SITE I, BINDING SITE II or BINDING SITE III. Table 2 illustrates the complementarity of the nucleotide sequences of FLJ10803 BINDING SITE, designated SEQ ID:20157, to the nucleotide sequence of VGAM2365 RNA, herein designated VGAM RNA, also designated SEQ ID:5076.

Another function of VGAM2365 is therefore inhibition of FLJ10803 (Accession NM_018224). Accordingly, utilities of VGAM2365 include diagnosis, prevention and treatment of diseases and clinical conditions associated with FLJ10803. FLJ13031 (Accession NM_024688) is another VGAM2365 host target gene. FLJ13031 BINDING SITE is HOST TARGET binding site found in the 5' untranslated region of mRNA encoded by FLJ13031, corresponding to a HOST TARGET binding site such as BINDING SITE I, BINDING SITE II or BINDING SITE III. Table 2 illustrates the complementarity of the nucleotide sequences of FLJ13031 BINDING SITE, designated SEQ ID:23998, to the nucleotide sequence of VGAM2365 RNA, herein designated VGAM RNA, also designated SEQ ID:5076.

Another function of VGAM2365 is therefore inhibition of FLJ13031 (Accession NM_024688). Accordingly, utilities of VGAM2365 include diagnosis, prevention and treatment of diseases and clinical conditions associated with FLJ13031. FLJ32762 (Accession NM_145023) is another VGAM2365 host target gene. FLJ32762 BINDING SITE is HOST TARGET binding site found in the 3' untranslated region of mRNA encoded by FLJ32762, corresponding to a HOST TARGET binding site such as BINDING SITE I, BINDING SITE II or BINDING SITE III. Table 2 illustrates the complementarity of the nucleotide sequences of FLJ32762 BINDING SITE, designated SEQ ID:29636, to the nucleotide sequence of VGAM2365 RNA, herein designated VGAM RNA, also designated SEQ ID:5076.

Another function of VGAM2365 is therefore inhibition of FLJ32762 (Accession NM_145023). Accordingly, utilities of VGAM2365 include diagnosis, prevention and treatment of diseases and clinical conditions associated with FLJ32762. KIAA1946 (Accession XM_092459) is another VGAM2365 host target gene. KIAA1946 BINDING SITE is HOST TARGET binding site found in the 3' untranslated region of mRNA encoded by KIAA1946, corresponding to a HOST TARGET binding site such as BINDING SITE I, BINDING SITE II or BINDING SITE III. Table 2 illustrates the complementarity of the nucleotide sequences of KIAA1946 BINDING SITE, designated SEQ ID:40119, to the nucleotide sequence of VGAM2365 RNA, herein designated VGAM RNA, also designated SEQ ID:5076.

Another function of VGAM2365 is therefore inhibition of KIAA1946 (Accession XM_092459). Accordingly, utilities of VGAM2365 include diagnosis, prevention and treatment of diseases and clinical conditions associated with KIAA1946. MGC16142 (Accession NM_032763) is another VGAM2365 host target gene. MGC16142 BINDING SITE is HOST TARGET binding site found in the 3' untranslated region of mRNA encoded by MGC16142, corresponding to a HOST TARGET binding site such as BINDING SITE I, BINDING SITE II or BINDING SITE III. Table 2 illustrates the complementarity of the nucleotide sequences of MGC16142 BINDING SITE, designated SEQ ID:26508, to the nucleotide sequence of VGAM2365 RNA, herein designated VGAM RNA, also designated SEQ ID:5076.

Another function of VGAM2365 is therefore inhibition of MGC16142 (Accession NM_032763). Accordingly, utilities of VGAM2365 include diagnosis, prevention and treatment of diseases and clinical conditions associated with MGC16142. Nuclear Receptor Coactivator 2 (NCOA2, Accession NM_006540) is another VGAM2365 host target gene. NCOA2 BINDING SITE is HOST TARGET binding site found in the 3' untranslated region of mRNA encoded by NCOA2, corresponding to a HOST TARGET binding site such as BINDING SITE I, BINDING SITE II or BINDING SITE III. Table 2 illustrates the complementarity of the nucleotide sequences of NCOA2 BINDING SITE, designated SEQ ID:13297, to the nucleotide sequence of VGAM2365 RNA, herein designated VGAM RNA, also designated SEQ ID:5076.

Another function of VGAM2365 is therefore inhibition of Nuclear Receptor Coactivator 2 (NCOA2, Accession NM_006540). Accordingly, utilities of VGAM2365 include diagnosis, prevention and treatment of diseases and clinical conditions associated with NCOA2. Signal Sequence Receptor, Alpha (translocon-associated protein alpha) (SSR1, Accession NM_003144) is another VGAM2365 host target gene. SSR1 BINDING SITE is HOST TARGET binding site found in the 3' untranslated region of mRNA encoded by SSR1, corresponding to a HOST TARGET binding site such as BINDING SITE I, BINDING SITE II or BINDING SITE III. Table 2 illustrates the complementarity of the nucleotide sequences of SSR1 BINDING SITE, designated SEQ ID:9114, to the nucleotide sequence of VGAM2365 RNA, herein designated VGAM RNA, also designated SEQ ID:5076.

Another function of VGAM2365 is therefore inhibition of Signal Sequence Receptor, Alpha (translocon-associated protein alpha) (SSR1, Accession NM_003144). Accordingly, utilities of VGAM2365 include diagnosis, prevention and treatment of diseases and clinical conditions associated with SSR1. Unc-5 Homolog D (C. elegans) (UNC5D, Accession NM_080872) is another VGAM2365 host target gene. UNC5D BINDING SITE is HOST TARGET binding site found in the 3' untranslated region of mRNA encoded by UNC5D, corresponding to a HOST TARGET binding site such as BINDING SITE I, BINDING SITE II or BINDING SITE III. Table 2 illustrates the complementarity of the nucleotide sequences of UNC5D BINDING SITE, designated SEQ ID:28114, to the nucleotide sequence of VGAM2365 RNA, herein designated VGAM RNA, also designated SEQ ID:5076.

Another function of VGAM2365 is therefore inhibition of Unc-5 Homolog D (C. elegans) (UNC5D, Accession NM_080872). Accordingly, utilities of VGAM2365 include diagnosis, prevention and treatment of diseases and clinical conditions associated with UNC5D. LOC203369 (Accession XM_114689) is another VGAM2365 host target gene. LOC203369 BINDING SITE is HOST TARGET binding site found in the 3' untranslated region of mRNA encoded by LOC203369, corresponding to a HOST TARGET binding site such as BINDING SITE I, BINDING SITE II or BINDING SITE III. Table 2 illustrates the complementarity of the nucleotide sequences of LOC203369 BINDING SITE, designated SEQ ID:43033, to the nucleotide sequence of VGAM2365 RNA, herein designated VGAM RNA, also designated SEQ ID:5076.

Another function of VGAM2365 is therefore inhibition of LOC203369 (Accession XM_114689). Accordingly, utilities of VGAM2365 include diagnosis, prevention and treatment of diseases and clinical conditions associated with LOC203369. LOC206480 (Accession XM_121360) is another VGAM2365 host target gene. LOC206480 BINDING SITE is HOST TARGET binding site found in the 5' untranslated region of mRNA encoded by LOC206480, corresponding to a HOST TARGET binding site such as BINDING SITE I, BINDING SITE II or BINDING SITE III. Table 2 illustrates the complementarity of the nucleotide sequences of LOC206480 BINDING SITE, designated SEQ ID:43614, to the nucleotide sequence of VGAM2365 RNA, herein designated VGAM RNA, also designated SEQ ID:5076.

Another function of VGAM2365 is therefore inhibition of LOC206480 (Accession XM_121360). Accordingly, utilities of VGAM2365 include diagnosis, prevention and treatment of diseases and clinical conditions associated with LOC206480. FIG. 1 further provides a conceptual description of a novel bioinformatically detected viral gene of the present invention, referred to here as Viral Genomic Address Messenger 2366 (VGAM2366) viral gene, which modulates expression of respective host target genes thereof, the function and utility of which host target genes is known in the art.

VGAM2366 is a novel bioinformatically detected regulatory, non protein coding, viral micro RNA (miRNA) gene. The method by which VGAM2366 was detected is described hereinabove with reference to FIGS. 1-8.

VGAM2366 gene, herein designated VGAM GENE, is a viral gene contained in the genome of Rat Cytomegalovirus. VGAM2366 host target gene, herein designated VGAM HOST TARGET GENE, is a human gene contained in the human genome.

VGAM2366 gene encodes a VGAM2366 precursor RNA, herein designated VGAM PRECURSOR RNA. Similar to other miRNA genes, and unlike most ordinary genes, VGAM2366 precursor RNA does not encode a protein. A nucleotide sequence identical or highly similar to the nucleotide sequence of VGAM2366 precursor RNA is designated SEQ ID:2352, and is provided hereinbelow with reference to the sequence listing part. Nucleotide sequence SEQ ID:2352 is located at position 183326 relative to the genome of Rat Cytomegalovirus.

VGAM2366 precursor RNA folds onto itself, forming VGAM2366 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2366 folded precursor RNA into VGAM2366 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 40%) nucleotide sequence of VGAM2366 RNA is designated SEQ ID:5077, and is provided hereinbelow with reference to the sequence listing part.

VGAM2366 host target gene, herein designated VGAM HOST TARGET GENE, encodes a corresponding messenger RNA, VGAM2366 host target RNA, herein designated VGAM HOST TARGET RNA. VGAM2366 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2366 RNA, herein designated VGAM RNA, binds complementarily to one or more host target binding sites located in untranslated regions of VGAM2366 host target RNA, herein designated VGAM HOST TARGET RNA. This complementary binding is due to the fact that the nucleotide sequence of VGAM2366 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2366 RNA, herein designated VGAM RNA, may have a different number of host target binding sites in untranslated regions of a VGAM2366 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2366 RNA, herein designated VGAM RNA, to host target binding sites on VGAM2366 host target RNA, herein designated VGAM HOST TARGET RNA, such as BINDING SITE I, BINDING SITE II and BINDING SITE III, inhibits translation of VGAM2366 host target RNA into VGAM2366 host target protein, herein designated VGAM HOST TARGET PROTEIN. VGAM host target protein is therefore outlined by a broken line.

It is appreciated that VGAM2366 host target gene, herein designated VGAM HOST TARGET GENE, in fact represents a plurality of VGAM2366 host target genes. The mRNA of each one of this plurality of VGAM2366 host target genes comprises one or more host target binding sites, each having a nucleotide sequence which is at least partly complementary to VGAM2366 RNA, herein designated VGAM RNA, and which when bound by VGAM2366 RNA causes inhibition of translation of respective one or more VGAM2366 host target proteins.

It is further appreciated by one skilled in the art that the mode of translational inhibition illustrated by FIG. 1 with specific reference to translational inhibition exerted by VGAM2366 gene, herein designated VGAM GENE, on one or more VGAM2366 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2366 is inhibition of expression of host target genes, as part of a novel viral mechanism of attacking a host. Accordingly, utilities of VGAM2366 include diagnosis, prevention and treatment of viral infection by Rat Cytomegalovirus. Specific functions, and accordingly utilities, of VGAM2366 correlate with, and may be deduced from, the identity of the host target genes which VGAM2366 binds and inhibits, and the function of these host target genes, as elaborated hereinbelow.

Nucleotide sequences of the VGAM2366 precursor RNA, herein designated VGAM PRECURSOR RNA, and of the 'diced' VGAM2366 RNA, herein designated VGAM RNA, and a schematic representation of the secondary folding of VGAM2366 folded precursor RNA, herein designated VGAM FOLDED PRECURSOR RNA, of VGAM2366 are further described hereinbelow with reference to Table 1.

Nucleotide sequences of host target binding sites, such as BINDING SITE-I, BINDING SITE-II and BINDING SITE-III of FIG. 1, found on VGAM2366 host target RNA, and schematic representation of the complementarity of each of these host target binding sites to VGAM2366 RNA, herein designated VGAM RNA, are described hereinbelow with reference to Table 2.

As mentioned hereinabove with reference to FIG. 1, a function of VGAM2366 gene, herein designated VGAM is inhibition of expression of VGAM2366 target genes. It is appreciated that specific functions, and accordingly utilities, of VGAM2366 correlate with, and may be deduced from, the identity of the target genes which VGAM2366 binds and inhibits, and the function of these target genes, as elaborated hereinbelow.

ATP-binding Cassette, Sub-family C (CFTR/MRP), Member 5 (ABCC5, Accession NM_005688) is a VGAM2366 host target gene. ABCC5 BINDING SITE is HOST TARGET binding site found in the 3' untranslated region of mRNA encoded by ABCC5, corresponding to a HOST TARGET binding site such as BINDING SITE I, BINDING SITE II or BINDING SITE III. Table 2 illustrates the complementarity of the nucleotide sequences of ABCC5 BINDING SITE, designated SEQ ID:12248, to the nucleotide sequence of VGAM2366 RNA, herein designated VGAM RNA, also designated SEQ ID:5077.

A function of VGAM2366 is therefore inhibition of ATP-binding Cassette, Sub-family C (CFTR/MRP), Member 5 (ABCC5, Accession NM_005688), a gene which acts as a multispecific organic anion pump which can transport nucleotide analogs. Accordingly, utilities of VGAM2366 include diagnosis, prevention and treatment of diseases and clinical conditions associated with ABCC5. The function of ABCC5 and its association with various diseases and clinical conditions, has been established by previous studies, as described hereinabove with reference to VGAM1744. ADP-ribosyltransferase (NAD+; poly (ADP-ribose) Polymerase) (ADPRT, Accession NM_001618) is another VGAM2366 host target gene. ADPRT BINDING SITE is HOST TARGET binding site found in the 5" untranslated region of mRNA encoded by ADPRT, corresponding to a HOST TARGET binding site such as BINDING SITE I, BINDING SITE II or BINDING SITE III. Table 2 illustrates the complementarity of the nucleotide sequences of ADPRT BINDING SITE, designated SEQ ID:7324, to the nucleotide sequence of VGAM2366 RNA, herein designated VGAM RNA, also designated SEQ ID:5077.

Another function of VGAM2366 is therefore inhibition of ADP-ribosyltransferase (NAD+; poly (ADP-ribose) Polymerase) (ADPRT, Accession NM_001618), a gene which catalyzes addition of mono-ADP-ribose to arginine residues of proteins, inhibits Pol II transcription. Accordingly, utilities of VGAM2366 include diagnosis, prevention and treatment of diseases and clinical conditions associated with ADPRT. The function of ADPRT and its association with various diseases and clinical conditions, has been established by previous studies, as described hereinabove with reference to VGAM506. Insulin Receptor Substrate 2 (IRS2, Accession XM_007095) is another VGAM2366 host target gene. IRS2 BINDING SITE is HOST TARGET binding site found in the 3' untranslated region of mRNA encoded by IRS2, corresponding to a HOST TARGET binding site such as BINDING SITE I, BINDING SITE II or BINDING SITE III. Table 2 illustrates the complementarity of the nucleotide sequences of IRS2 BINDING SITE, designated SEQ ID:30029, to the nucleotide sequence of VGAM2366 RNA, herein designated VGAM RNA, also designated SEQ ID:5077.

Another function of VGAM2366 is therefore inhibition of Insulin Receptor Substrate 2 (IRS2, Accession XM_007095), a gene which may mediate the control of various cellular processes by insulin. Accordingly, utilities of VGAM2366 include diagnosis, prevention and treatment of diseases and clinical conditions associated with IRS2. The function of IRS2 and its association with various diseases and clinical conditions, has been established by previous studies, as described hereinabove with reference to VGAM1217. Neuropeptide Y Receptor Y2 (NPY2R, Accession NM_000910) is another VGAM2366 host target gene. NPY2R BINDING SITE is HOST TARGET binding site found in the 5' untranslated region of mRNA encoded by NPY2R, corresponding to a HOST TARGET binding site such as BINDING SITE I, BINDING SITE II or BINDING SITE III. Table 2 illustrates the complementarity of the nucleotide sequences of NPY2R BINDING SITE, designated SEQ ID:6612, to the nucleotide sequence of VGAM2366 RNA, herein designated VGAM RNA, also designated SEQ ID:5077.

Another function of VGAM2366 is therefore inhibition of Neuropeptide Y Receptor Y2 (NPY2R, Accession NM_000910), a gene which stimulates intracellular calcium flux and may modulate psychomotor activity, food intake, endocrine secretion and vasoconstriction. Accordingly, utilities of VGAM2366 include diagnosis, prevention and treatment of diseases and clinical conditions associated with NPY2R. The function of NPY2R and its association with various diseases and clinical conditions, has been established by previous studies, as described hereinabove with reference to VGAM309. Prominin-like 1 (mouse) (PROML1, Accession NM_006017) is another VGAM2366 host target gene. PROML1 BINDING SITE is HOST TARGET binding site found in the 3' untranslated region of mRNA encoded by PROML1, corresponding to a HOST TARGET binding site such as BINDING SITE I, BINDING SITE II or BINDING SITE III. Table 2 illustrates the complementarity of the nucleotide sequences of PROML1 BINDING SITE, designated SEQ ID:12635, to the nucleotide sequence of VGAM2366 RNA, herein designated VGAM RNA, also designated SEQ ID:5077.

Another function of VGAM2366 is therefore inhibition of Prominin-like 1 (mouse) (PROML1, Accession NM_006017), a gene which is a Transmembrane protein. Accordingly, utilities of VGAM2366 include diagnosis, prevention and treatment of diseases and clinical conditions associated with PROML1. The function of PROML1 and its association with various diseases and clinical conditions, has been established by previous studies, as described hereinabove with reference to VGAM905. Transmembrane Protein 2 (TMEM2, Accession NM_013390) is another VGAM2366 host target gene. TMEM2 BINDING SITE is HOST TARGET binding site found in the 3' untranslated region of mRNA encoded by TMEM2, corresponding to a HOST TARGET binding site such as BINDING SITE I, BINDING SITE II or BINDING SITE III. Table 2 illustrates the complementarity of the nucleotide sequences of TMEM2 BINDING SITE, designated SEQ ID:15042, to the nucleotide sequence of VGAM2366 RNA, herein designated VGAM RNA, also designated SEQ ID:5077.

Another function of VGAM2366 is therefore inhibition of Transmembrane Protein 2 (TMEM2, Accession NM_013390). Accordingly, utilities of VGAM2366 include diagnosis, prevention and treatment of diseases and clinical conditions associated with TMEM2. FLJ13491 (Accession NM_024623) is another VGAM2366 host target gene. FLJ13491 BINDING SITE is HOST TARGET binding site found in the 3' untranslated region of mRNA encoded by FLJ13491, corresponding to a HOST TARGET binding site such as BINDING SITE I, BINDING SITE II or BINDING SITE III. Table 2 illustrates the complementarity of the nucleotide sequences of FLJ13491 BINDING SITE, designated SEQ ID:23888, to the nucleotide sequence of VGAM2366 RNA, herein designated VGAM RNA, also designated SEQ ID:5077.

Another function of VGAM2366 is therefore inhibition of FLJ13491 (Accession NM_024623). Accordingly, utilities of VGAM2366 include diagnosis, prevention and treatment of diseases and clinical conditions associated with FLJ13491. KIAA0125 (Accession XM_018203) is another VGAM2366 host target gene. KIAA0125 BINDING SITE1 and KIAA0125 BINDING SITE2 are HOST TARGET binding sites found in untranslated regions of mRNA encoded by KIAA0125, corresponding to HOST TARGET binding sites such as BINDING SITE I, BINDING SITE II or BINDING SITE III. Table 2 illustrates the complementarity of the nucleotide sequences of KIAA0125 BINDING SITE1 and KIAA0125 BINDING SITE2, designated SEQ ID:30347 and SEQ ID:16692 respectively, to the nucleotide sequence of VGAM2366 RNA, herein designated VGAM RNA, also designated SEQ ID:5077.

Another function of VGAM2366 is therefore inhibition of KIAA0125 (Accession XM_018203). Accordingly, utilities of VGAM2366 include diagnosis, prevention and treatment of diseases and clinical conditions associated with KIAA0125. KIAA0469 (Accession NM_014851) is another VGAM2366 host target gene. KIAA0469 BINDING SITE is HOST TARGET binding site found in the 3' untranslated region of mRNA encoded by KIAA0469, corresponding to a HOST TARGET binding site such as BINDING SITE I, BINDING SITE II or BINDING SITE III. Table 2 illustrates the complementarity of the nucleotide sequences of KIAA0469 BINDING SITE, designated SEQ ID:16890, to the nucleotide sequence of VGAM2366 RNA, herein designated VGAM RNA, also designated SEQ ID:5077.

Another function of VGAM2366 is therefore inhibition of KIAA0469 (Accession NM_014851). Accordingly, utilities of VGAM2366 include diagnosis, prevention and treatment of diseases and clinical conditions associated with KIAA0469. KIAA1005 (Accession XM_051197) is another VGAM2366 host target gene. KIAA1005 BINDING SITE is HOST TARGET binding site found in the 3' untranslated region of mRNA encoded by KIAA1005, corresponding to a HOST TARGET binding site such as BINDING SITE I, BINDING SITE II or BINDING SITE III. Table 2 illustrates the complementarity of the nucleotide sequences of KIAA1005 BINDING SITE, designated SEQ ID:35778, to the nucleotide sequence of VGAM2366 RNA, herein designated VGAM RNA, also designated SEQ ID:5077.

Another function of VGAM2366 is therefore inhibition of KIAA1005 (Accession XM_051197). Accordingly, utilities of VGAM2366 include diagnosis, prevention and treatment of diseases and clinical conditions associated with KIAA1005. PP1628 (Accession NM_025201) is another VGAM2366 host target gene. PP1628 BINDING SITE is HOST TARGET binding site found in the 5' untranslated region of mRNA encoded by PP1628, corresponding to a HOST TARGET binding site such as BINDING SITE I, BINDING SITE II or BINDING SITE III. Table 2 illustrates the complementarity of the nucleotide sequences of PP1628 BINDING SITE, designated SEQ ID:24858, to the nucleotide sequence of VGAM2366 RNA, herein designated VGAM RNA, also designated SEQ ID:5077.

Another function of VGAM2366 is therefore inhibition of PP1628 (Accession NM_025201). Accordingly, utilities of VGAM2366 include diagnosis, prevention and treatment of diseases and clinical conditions associated with PP1628. Thioesterase, Adipose Associated (THEA, Accession XM_038922) is another VGAM2366 host target gene. THEA BINDING SITE is HOST TARGET binding site found in the 3' untranslated region of mRNA encoded by THEA, corresponding to a HOST TARGET binding site such as BINDING SITE I, BINDING SITE II or BINDING SITE III. Table 2 illustrates the complementarity of the nucleotide sequences of THEA BINDING SITE, designated SEQ ID:32952, to the nucleotide sequence of VGAM2366 RNA, herein designated VGAM RNA, also designated SEQ ID:5077.

Another function of VGAM2366 is therefore inhibition of Thioesterase, Adipose Associated (THEA, Accession XM_038922). Accordingly, utilities of VGAM2366 include diagnosis, prevention and treatment of diseases and clinical conditions associated with THEA. LOC128338 (Accession XM_059238) is another VGAM2366 host target gene. LOC128338 BINDING SITE is HOST TARGET binding site found in the 3' untranslated region of mRNA encoded by LOC128338, corresponding to a HOST TARGET binding site such as BINDING SITE I, BINDING SITE II or BINDING SITE III. Table 2 illustrates the complementarity of the nucleotide sequences of LOC128338 BINDING SITE, designated SEQ ID:36927, to the nucleotide sequence of VGAM2366 RNA, herein designated VGAM RNA, also designated SEQ ID:5077.

Another function of VGAM2366 is therefore inhibition of LOC128338 (Accession XM_059238). Accordingly, utilities of VGAM2366 include diagnosis, prevention and treatment of diseases and clinical conditions associated with LOC128338. LOC146713 (Accession XM_097071) is another VGAM2366 host target gene. LOC146713 BINDING SITE is HOST TARGET binding site found in the 5' untranslated region of mRNA encoded by LOC146713, corresponding to a HOST TARGET binding site such as BINDING SITE I, BINDING SITE II or BINDING SITE III. Table 2 illustrates the complementarity of the nucleotide sequences of LOC146713 BINDING SITE, designated SEQ ID:40714, to the nucleotide sequence of VGAM2366 RNA, herein designated VGAM RNA, also designated SEQ ID:5077.

Another function of VGAM2366 is therefore inhibition of LOC146713 (Accession XM_097071). Accordingly, utilities of VGAM2366 include diagnosis, prevention and treatment of diseases and clinical conditions associated with LOC146713. LOC220070 (Accession NM_145308) is another VGAM2366 host target gene. LOC220070 BINDING SITE is HOST TARGET binding site found in the 3' untranslated region of mRNA encoded by LOC220070, corresponding to a HOST TARGET binding site such as BINDING SITE I, BINDING SITE II or BINDING SITE III. Table 2 illustrates the complementarity of the nucleotide sequences of LOC220070 BINDING SITE, designated SEQ ID:29820, to the nucleotide sequence of VGAM2366 RNA, herein designated VGAM RNA, also designated SEQ ID:5077.

Another function of VGAM2366 is therefore inhibition of LOC220070 (Accession NM_145308). Accordingly, utilities of VGAM2366 include diagnosis, prevention and treatment of diseases and clinical conditions associated with LOC220070. FIG. 1 further provides a conceptual description of a novel bioinformatically detected viral gene of the present invention, referred to here as Viral Genomic Address Messenger 2367 (VGAM2367) viral gene, which modulates expression of respective host target genes thereof, the function and utility of which host target genes is known in the art.

VGAM2367 is a novel bioinformatically detected regulatory, non protein coding, viral micro RNA (miRNA) gene. The method by which VGAM2367 was detected is described hereinabove with reference to FIGS. 1-8.

VGAM2367 gene, herein designated VGAM GENE, is a viral gene contained in the genome of Rat Cytomegalovirus. VGAM2367 host target gene, herein designated VGAM HOST TARGET GENE, is a human gene contained in the human genome.

VGAM2367 gene encodes a VGAM2367 precursor RNA, herein designated VGAM PRECURSOR RNA. Similar to other miRNA genes, and unlike most ordinary genes, VGAM2367 precursor RNA does not encode a protein. A nucleotide sequence identical or highly similar to the nucleotide sequence of VGAM2367 precursor RNA is designated SEQ ID:2353, and is provided hereinbelow with reference to the sequence listing part. Nucleotide sequence SEQ ID:2353 is located at position 207957 relative to the genome of Rat Cytomegalovirus.

VGAM2367 precursor RNA folds onto itself, forming VGAM2367 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2367 folded precursor RNA into VGAM2367 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2367 RNA is designated SEQ ID:5078, and is provided hereinbelow with reference to the sequence listing part.

VGAM2367 host target gene, herein designated VGAM HOST TARGET GENE, encodes a corresponding messenger RNA, VGAM2367 host target RNA, herein designated VGAM HOST TARGET RNA. VGAM2367 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2367 RNA, herein designated VGAM RNA, binds complementarily to one or more host target binding sites located in untranslated regions of VGAM2367 host target RNA, herein designated VGAM HOST TARGET RNA. This complementary binding is due to the fact that the nucleotide sequence of VGAM2367 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2367 RNA, herein designated VGAM RNA, may have a different number of host target binding sites in untranslated regions of a VGAM2367 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2367 RNA, herein designated VGAM RNA, to host target binding sites on VGAM2367 host target RNA, herein designated VGAM HOST TARGET RNA, such as BINDING SITE I, BINDING SITE II and BINDING SITE III, inhibits translation of VGAM2367 host target RNA into VGAM2367 host target protein, herein designated VGAM HOST TARGET PROTEIN. VGAM host target protein is therefore outlined by a broken line.

It is appreciated that VGAM2367 host target gene, herein designated VGAM HOST TARGET GENE, in fact represents a plurality of VGAM2367 host target genes. The mRNA of each one of this plurality of VGAM2367 host target genes comprises one or more host target binding sites, each having a nucleotide sequence which is at least partly complementary to VGAM2367 RNA, herein designated VGAM RNA, and which when bound by VGAM2367 RNA causes inhibition of translation of respective one or more VGAM2367 host target proteins.

It is further appreciated by one skilled in the art that the mode of translational inhibition illustrated by FIG. 1 with specific reference to translational inhibition exerted by VGAM2367 gene, herein designated VGAM GENE, on one or more VGAM2367 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2367 is inhibition of expression of host target genes, as part of a novel viral mechanism of attacking a host. Accordingly, utilities of VGAM2367 include diagnosis, prevention and treatment of viral infection by Rat Cytomegalovirus. Specific functions, and accordingly utilities, of VGAM2367 correlate with, and may be deduced from, the identity of the host target genes which VGAM2367 binds and inhibits, and the function of these host target genes, as elaborated hereinbelow.

Nucleotide sequences of the VGAM2367 precursor RNA, herein designated VGAM PRECURSOR RNA, and of the 'diced' VGAM2367 RNA, herein designated VGAM RNA, and a schematic representation of the secondary folding of VGAM2367 folded precursor RNA, herein designated VGAM FOLDED PRECURSOR RNA, of VGAM2367 are further described hereinbelow with reference to Table 1.

Nucleotide sequences of host target binding sites, such as BINDING SITE-I, BINDING SITE-II and BINDING SITE-III of FIG. 1, found on VGAM2367 host target RNA, and schematic representation of the complementarity of each of these host target binding sites to VGAM2367 RNA, herein designated VGAM RNA, are described hereinbelow with reference to Table 2.

As mentioned hereinabove with reference to FIG. 1, a function of VGAM2367 gene, herein designated VGAM is inhibition of expression of VGAM2367 target genes. It is appreciated that specific functions, and accordingly utilities, of VGAM2367 correlate with, and may be deduced from, the identity of the target genes which VGAM2367 binds and inhibits, and the function of these target genes, as elaborated hereinbelow.

A Kinase (PRKA) Anchor Protein 2 (AKAP2, Accession NM_007203) is a VGAM2367 host target gene. AKAP2 BINDING SITE is HOST TARGET binding site found in the 3' untranslated region of mRNA encoded by AKAP2, corresponding to a HOST TARGET binding site such as BINDING SITE I, BINDING SITE II or BINDING SITE III. Table 2 illustrates the complementarity of the nucleotide sequences of AKAP2 BINDING SITE, designated SEQ ID:14058, to the nucleotide sequence of VGAM2367 RNA, herein designated VGAM RNA, also designated SEQ ID:5078.

A function of VGAM2367 is therefore inhibition of A Kinase (PRKA) Anchor Protein 2 (AKAP2, Accession NM_007203), a gene which binds to regulatory subunit (rii) of protein kinase a. Accordingly, utilities of VGAM2367 include diagnosis, prevention and treatment of diseases and clinical conditions associated with AKAP2. The function of AKAP2 and its association with various diseases and clinical conditions, has been established by previous studies, as described hereinabove with reference to VGAM18. FIG. 1 further provides a conceptual description of a novel bioinformatically detected viral gene of the present invention, referred to here as Viral Genomic Address Messenger 2368 (VGAM2368) viral gene, which modulates expression of respective host target genes thereof, the function and utility of which host target genes is known in the art.

VGAM2368 is a novel bioinformatically detected regulatory, non protein coding, viral micro RNA (miRNA) gene. The method by which VGAM2368 was detected is described hereinabove with reference to FIGS. 1-8.

VGAM2368 gene, herein designated VGAM GENE, is a viral gene contained in the genome of Rat Cytomegalovirus. VGAM2368 host target gene, herein designated VGAM HOST TARGET GENE, is a human gene contained in the human genome.

VGAM2368 gene encodes a VGAM2368 precursor RNA, herein designated VGAM PRECURSOR RNA. Similar to other miRNA genes, and unlike most ordinary genes, VGAM2368 precursor RNA does not encode a protein. A nucleotide sequence identical or highly similar to the nucleotide sequence of VGAM2368 precursor RNA is designated SEQ ID:2354, and is provided hereinbelow with reference to the sequence listing part. Nucleotide sequence SEQ ID:2354 is located at position 223088 relative to the genome of Rat Cytomegalovirus.

VGAM2368 precursor RNA folds onto itself, forming VGAM2368 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2368 folded precursor RNA into VGAM2368 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2368 RNA is designated SEQ ID:5079, and is provided hereinbelow with reference to the sequence listing part.

VGAM2368 host target gene, herein designated VGAM HOST TARGET GENE, encodes a corresponding messenger RNA, VGAM2368 host target RNA, herein designated VGAM HOST TARGET RNA. VGAM2368 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2368 RNA, herein designated VGAM RNA, binds complementarily to one or more host target binding sites located in untranslated regions of VGAM2368 host target RNA, herein designated VGAM HOST TARGET RNA. This complementary binding is due to the fact that the nucleotide sequence of VGAM2368 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2368 RNA, herein designated VGAM RNA, may have a different number of host target binding sites in untranslated regions of a VGAM2368 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2368 RNA, herein designated VGAM RNA, to host target binding sites on VGAM2368 host target RNA, herein designated VGAM HOST TARGET RNA, such as BINDING SITE I, BINDING SITE II and BINDING SITE III, inhibits translation of VGAM2368 host target RNA into VGAM2368 host target protein, herein designated VGAM HOST TARGET PRO- TEIN. VGAM host target protein is therefore outlined by a broken line.

It is appreciated that VGAM2368 host target gene, herein designated VGAM HOST TARGET GENE, in fact represents a plurality of VGAM2368 host target genes. The mRNA of each one of this plurality of VGAM2368 host target genes comprises one or more host target binding sites, each having a nucleotide sequence which is at least partly complementary to VGAM2368 RNA, herein designated VGAM RNA, and which when bound by VGAM2368 RNA causes inhibition of translation of respective one or more VGAM2368 host target proteins.

It is further appreciated by one skilled in the art that the mode of translational inhibition illustrated by FIG. 1 with specific reference to translational inhibition exerted by VGAM2368 gene, herein designated VGAM GENE, on one or more VGAM2368 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2368 is inhibition of expression of host target genes, as part of a novel viral mechanism of attacking a host. Accordingly, utilities of VGAM2368 include diagnosis, prevention and treatment of viral infection by Rat Cytomegalovirus. Specific functions, and accordingly utilities, of VGAM2368 correlate with, and may be deduced from, the identity of the host target genes which VGAM2368 binds and inhibits, and the function of these host target genes, as elaborated hereinbelow.

Nucleotide sequences of the VGAM2368 precursor RNA, herein designated VGAM PRECURSOR RNA, and of the 'diced' VGAM2368 RNA, herein designated VGAM RNA, and a schematic representation of the secondary folding of VGAM2368 folded precursor RNA, herein designated VGAM FOLDED PRECURSOR RNA, of VGAM2368 are further described hereinbelow with reference to Table 1.

Nucleotide sequences of host target binding sites, such as BINDING SITE-I, BINDING SITE-II and BINDING SITE-III of FIG. 1, found on VGAM2368 host target RNA, and schematic representation of the complementarity of each of these host target binding sites to VGAM2368 RNA, herein designated VGAM RNA, are described hereinbelow with reference to Table 2.

As mentioned hereinabove with reference to FIG. 1, a function of VGAM2368 gene, herein designated VGAM is inhibition of expression of VGAM2368 target genes. It is appreciated that specific functions, and accordingly utilities, of VGAM2368 correlate with, and may be deduced from, the identity of the target genes which VGAM2368 binds and inhibits, and the function of these target genes, as elaborated hereinbelow.

Apolipoprotein L, 6 (APOL6, Accession NM_030641) is a VGAM2368 host target gene. APOL6 BINDING SITE is HOST TARGET binding site found in the 5' untranslated region of mRNA encoded by APOL6, corresponding to a HOST TARGET binding site such as BINDING SITE I, BINDING SITE II or BINDING SITE III. Table 2 illustrates the complementarity of the nucleotide sequences of APOL6 BINDING SITE, designated SEQ ID:24968, to the nucleotide sequence of VGAM2368 RNA, herein designated VGAM RNA, also designated SEQ ID:5079.

A function of VGAM2368 is therefore inhibition of Apolipoprotein L, 6 (APOL6, Accession NM_030641). Accordingly, utilities of VGAM2368 include diagnosis, prevention and treatment of diseases and clinical conditions associated with APOL6. FIG. 1 further provides a conceptual description of a novel bioinformatically detected viral gene of the present invention, referred to here as Viral Genomic Address Messenger 2369 (VGAM2369) viral gene, which modulates expression of respective host target genes thereof, the function and utility of which host target genes is known in the art.

VGAM2369 is a novel bioinformatically detected regulatory, non protein coding, viral micro RNA (miRNA) gene. The method by which VGAM2369 was detected is described hereinabove with reference to FIGS. 1-8.

VGAM2369 gene, herein designated VGAM GENE, is a viral gene contained in the genome of Rat Cytomegalovirus. VGAM2369 host target gene, herein designated VGAM HOST TARGET GENE, is a human gene contained in the human genome.

VGAM2369 gene encodes a VGAM2369 precursor RNA, herein designated VGAM PRECURSOR RNA. Similar to other miRNA genes, and unlike most ordinary genes, VGAM2369 precursor RNA does not encode a protein. A nucleotide sequence identical or highly similar to the nucleotide sequence of VGAM2369 precursor RNA is designated SEQ ID:2355, and is provided hereinbelow with reference to the sequence listing part. Nucleotide sequence SEQ ID:2355 is located at position 208920 relative to the genome of Rat Cytomegalovirus.

VGAM2369 precursor RNA folds onto itself, forming VGAM2369 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2369 folded precursor RNA into VGAM2369 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM2369 RNA is designated SEQ ID:5080, and is provided hereinbelow with reference to the sequence listing part.

VGAM2369 host target gene, herein designated VGAM HOST TARGET GENE, encodes a corresponding messenger RNA, VGAM2369 host target RNA, herein designated VGAM HOST TARGET RNA. VGAM2369 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2369 RNA, herein designated VGAM RNA, binds complementarily to one or more host target binding sites located in untranslated regions of VGAM2369 host target RNA, herein designated VGAM HOST TARGET RNA. This complementary binding is due to the fact that the nucleotide sequence of VGAM2369 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2369 RNA, herein designated VGAM RNA, may have a different number of host target binding sites in untranslated regions of a VGAM2369 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2369 RNA, herein designated VGAM RNA, to host target binding sites on VGAM2369 host target RNA, herein designated VGAM HOST TARGET RNA, such as BINDING SITE I, BINDING SITE II and BINDING SITE III, inhibits translation of VGAM2369 host target RNA into VGAM2369 host target protein, herein designated VGAM HOST TARGET PROTEIN. VGAM host target protein is therefore outlined by a broken line.

It is appreciated that VGAM2369 host target gene, herein designated VGAM HOST TARGET GENE, in fact represents a plurality of VGAM2369 host target genes. The mRNA of each one of this plurality of VGAM2369 host target genes comprises one or more host target binding sites, each having a nucleotide sequence which is at least partly complementary to VGAM2369 RNA, herein designated VGAM RNA, and which when bound by VGAM2369 RNA causes inhibition of translation of respective one or more VGAM2369 host target proteins.

It is further appreciated by one skilled in the art that the mode of translational inhibition illustrated by FIG. 1 with specific reference to translational inhibition exerted by VGAM2369 gene, herein designated VGAM GENE, on one or more VGAM2369 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2369 is inhibition of expression of host target genes, as part of a novel viral mechanism of attacking a host. Accordingly, utilities of VGAM2369 include diagnosis, prevention and treatment of viral infection by Rat Cytomegalovirus. Specific functions, and accordingly utilities, of VGAM2369 correlate with, and may be deduced from, the identity of the host target genes which VGAM2369 binds and inhibits, and the function of these host target genes, as elaborated hereinbelow.

Nucleotide sequences of the VGAM2369 precursor RNA, herein designated VGAM PRECURSOR RNA, and of the 'diced' VGAM2369 RNA, herein designated VGAM RNA, and a schematic representation of the secondary folding of VGAM2369 folded precursor RNA, herein designated VGAM FOLDED PRECURSOR RNA, of VGAM2369 are further described hereinbelow with reference to Table 1.

Nucleotide sequences of host target binding sites, such as BINDING SITE-I, BINDING SITE-II and BINDING SITE-III of FIG. 1, found on VGAM2369 host target RNA, and schematic representation of the complementarity of each of these host target binding sites to VGAM2369 RNA, herein designated VGAM RNA, are described hereinbelow with reference to Table 2.

As mentioned hereinabove with reference to FIG. 1, a function of VGAM2369 gene, herein designated VGAM is inhibition of expression of VGAM2369 target genes. It is appreciated that specific functions, and accordingly utilities, of VGAM2369 correlate with, and may be deduced from, the identity of the target genes which VGAM2369 binds and inhibits, and the function of these target genes, as elaborated hereinbelow.

Numb Homolog (Drosophila) (NUMB, Accession NM_003744) is a VGAM2369 host target gene. NUMB BINDING SITE is HOST TARGET binding site found in the 3' untranslated region of mRNA encoded by NUMB, corresponding to a HOST TARGET binding site such as BINDING SITE I, BINDING SITE II or BINDING SITE III. Table 2 illustrates the complementarity of the nucleotide sequences of NUMB BINDING SITE, designated SEQ ID:9831, to the nucleotide sequence of VGAM2369 RNA, herein designated VGAM RNA, also designated SEQ ID:5080.

A function of VGAM2369 is therefore inhibition of Numb Homolog (Drosophila) (NUMB, Accession NM_003744), a gene which may act in generating asymmetric cell division during neurogenesisand is strongly similar to murine Numb. Accordingly, utilities of VGAM2369 include diagnosis, prevention and treatment of diseases and clinical conditions associated with NUMB. The function of NUMB and its association with various diseases and clinical conditions, has been established by previous studies, as described hereinabove with reference to VGAM2322. Protocadherin Alpha 1 (PCDHA1, Accession NM_018900) is another VGAM2369 host target gene. PCDHA1 BINDING SITE1 and PCDHA1 BINDING SITE2 are HOST TARGET binding sites found in untranslated regions of mRNA encoded by PCDHA1, corresponding to HOST TARGET binding sites such as BINDING SITE I, BINDING SITE II or BINDING SITE III. Table 2 illustrates the complementarity of the nucleotide sequences of PCDHA1 BINDING SITE1 and PCDHA1 BINDING SITE2, designated SEQ ID:20860 and SEQ ID:25379 respectively, to the nucleotide sequence of VGAM2369 RNA, herein designated VGAM RNA, also designated SEQ ID:5080.

Another function of VGAM2369 is therefore inhibition of Protocadherin Alpha 1 (PCDHA1, Accession NM_018900). Accordingly, utilities of VGAM2369 include diagnosis, prevention and treatment of diseases and clinical conditions associated with PCDHA1. Protocadherin Alpha 10 (PCDHA10, Accession NM_018901) is another VGAM2369 host target gene. PCDHA10 BINDING SITE1 and PCDHA10 BINDING SITE2 are HOST TARGET binding sites found in untranslated regions of mRNA encoded by PCDHA10, corresponding to HOST TARGET binding sites such as BINDING SITE I, BINDING SITE II or BINDING SITE III. Table 2 illustrates the complementarity of the nucleotide sequences of PCDHA10 BINDING SITE1 and PCDHA10 BINDING SITE2, designated SEQ ID:20870 and SEQ ID:20880 respectively, to the nucleotide sequence of VGAM2369 RNA, herein designated VGAM RNA, also designated SEQ ID:5080.

Another function of VGAM2369 is therefore inhibition of Protocadherin Alpha 10 (PCDHA10, Accession NM_018901). Accordingly, utilities of VGAM2369 include diagnosis, prevention and treatment of diseases and clinical conditions associated with PCDHA10. Protocadherin Alpha 13 (PCDHA13, Accession NM_018904) is another VGAM2369 host target gene. PCDHA13 BINDING SITE is HOST TARGET binding site found in the 3' untranslated region of mRNA encoded by PCDHA13, corresponding to a HOST TARGET binding site such as BINDING SITE I, BINDING SITE II or BINDING SITE III. Table 2 illustrates the complementarity of the nucleotide sequences of PCDHA13 BINDING SITE, designated SEQ ID:20901, to the nucleotide sequence of VGAM2369 RNA, herein designated VGAM RNA, also designated SEQ ID:5080.

Another function of VGAM2369 is therefore inhibition of Protocadherin Alpha 13 (PCDHA13, Accession NM_018904). Accordingly, utilities of VGAM2369 include diagnosis, prevention and treatment of diseases and clinical conditions associated with PCDHA13. Protocadherin Alpha 2 (PCDHA2, Accession NM_018905) is another VGAM2369 host target gene. PCDHA2 BINDING SITE is HOST TARGET binding site found in the 3' untranslated region of mRNA encoded by PCDHA2, corresponding to a HOST TARGET binding site such as BINDING SITE I, BINDING SITE II or BINDING SITE III. Table 2 illustrates the complementarity of the nucleotide sequences of PCDHA2 BINDING SITE, designated SEQ ID:20911, to the nucleotide sequence of VGAM2369 RNA, herein designated VGAM RNA, also designated SEQ ID:5080.

Another function of VGAM2369 is therefore inhibition of Protocadherin Alpha 2 (PCDHA2, Accession NM_018905). Accordingly, utilities of VGAM2369 include diagnosis, prevention and treatment of diseases and clinical conditions associated with PCDHA2. Protocadherin Alpha 3 (PCDHA3, Accession NM_018906) is another VGAM2369 host target gene. PCDHA3 BINDING SITE is HOST TARGET binding site found in the 3' untranslated region of mRNA encoded by PCDHA3, corresponding to a HOST TARGET binding site such as BINDING SITE I, BINDING SITE II or BINDING SITE III. Table 2 illustrates the complementarity of the nucleotide sequences of PCDHA3 BINDING SITE, designated SEQ ID:20921, to the nucleotide sequence of VGAM2369 RNA, herein designated VGAM RNA, also designated SEQ ID:5080.

Another function of VGAM2369 is therefore inhibition of Protocadherin Alpha 3 (PCDHA3, Accession NM_018906). Accordingly, utilities of VGAM2369 include diagnosis, prevention and treatment of diseases and clinical conditions associated with PCDHA3. Protocadherin Alpha 4 (PCDHA4, Accession NM_018907) is another VGAM2369 host target gene. PCDHA4 BINDING SITE is HOST TARGET binding site found in the 3' untranslated region of mRNA encoded by PCDHA4, corresponding to a HOST TARGET binding site such as BINDING SITE I, BINDING SITE II or BINDING SITE III. Table 2 illustrates the complementarity of the nucleotide sequences of PCDHA4 BINDING SITE, designated SEQ ID:20931, to the nucleotide sequence of VGAM2369 RNA, herein designated VGAM RNA, also designated SEQ ID:5080.

Another function of VGAM2369 is therefore inhibition of Protocadherin Alpha 4 (PCDHA4, Accession NM_018907). Accordingly, utilities of VGAM2369 include diagnosis, prevention and treatment of diseases and clinical conditions associated with PCDHA4. Protocadherin Alpha 5 (PCDHA5, Accession NM_018908) is another VGAM2369 host target gene. PCDHA5 BINDING SITE is HOST TARGET binding site found in the 3' untranslated region of mRNA encoded by PCDHA5, corresponding to a HOST TARGET binding site such as BINDING SITE I, BINDING SITE II or BINDING SITE III. Table 2 illustrates the complementarity of the nucleotide sequences of PCDHA5 BINDING SITE, designated SEQ ID:20941, to the nucleotide sequence of VGAM2369 RNA, herein designated VGAM RNA, also designated SEQ ID:5080.

Another function of VGAM2369 is therefore inhibition of Protocadherin Alpha 5 (PCDHA5, Accession NM_018908). Accordingly, utilities of VGAM2369 include diagnosis, prevention and treatment of diseases and clinical conditions associated with PCDHA5. Protocadherin Alpha 6 (PCDHA6, Accession NM_018909) is another VGAM2369 host target gene. PCDHA6 BINDING SITE1 and PCDHA6 BINDING SITE2 are HOST TARGET binding sites found in untranslated regions of mRNA encoded by PCDHA6, corresponding to HOST TARGET binding sites such as BINDING SITE I, BINDING SITE II or BINDING SITE III. Table 2 illustrates the complementarity of the nucleotide sequences of PCDHA6 BINDING SITE1 and PCDHA6 BINDING SITE2, designated SEQ ID:20951 and SEQ ID:25583 respectively, to the nucleotide sequence of VGAM2369 RNA, herein designated VGAM RNA, also designated SEQ ID:5080.

Another function of VGAM2369 is therefore inhibition of Protocadherin Alpha 6 (PCDHA6, Accession NM_018909). Accordingly, utilities of VGAM2369 include diagnosis, prevention and treatment of diseases and clinical conditions associated with PCDHA6. Protocadherin Alpha 8 (PCDHA8, Accession NM_018911) is another VGAM2369 host target gene. PCDHA8 BINDING SITE is HOST TARGET binding site found in the 3' untranslated region of mRNA encoded by PCDHA8, corresponding to a HOST TARGET binding site such as BINDING SITE I, BINDING SITE II or BINDING SITE III. Table 2 illustrates the complementarity of the nucleotide sequences of PCDHA8 BINDING SITE, designated SEQ ID:20971, to the nucleotide sequence of VGAM2369 RNA, herein designated VGAM RNA, also designated SEQ ID:5080.

Another function of VGAM2369 is therefore inhibition of Protocadherin Alpha 8 (PCDHA8, Accession NM_018911). Accordingly, utilities of VGAM2369 include diagnosis, prevention and treatment of diseases and clinical conditions associated with PCDHA8. Protocadherin Alpha 9 (PCDHA9, Accession NM_031857) is another VGAM2369 host target gene. PCDHA9 BINDING SITE is HOST TARGET binding site found in the 3' untranslated region of mRNA encoded by PCDHA9, corresponding to a HOST TARGET binding site such as BINDING SITE I, BINDING SITE II or BINDING SITE III. Table 2 illustrates the complementarity of the nucleotide sequences of PCDHA9 BINDING SITE, designated SEQ ID:25596, to the nucleotide sequence of VGAM2369 RNA, herein designated VGAM RNA, also designated SEQ ID:5080.

Another function of VGAM2369 is therefore inhibition of Protocadherin Alpha 9 (PCDHA9, Accession NM_031857), a gene which is a calcium-dependent cell-adhesion protein. Accordingly, utilities of VGAM2369 include diagnosis, prevention and treatment of diseases and clinical conditions associated with PCDHA9. The function of PCDHA9 and its association with various diseases and clinical conditions, has been established by previous studies, as described hereinabove with reference to VGAM71. Protocadherin Alpha Subfamily C, 1 (PCDHAC1, Accession NM_018898) is another VGAM2369 host target gene. PCDHAC1 BINDING SITE is HOST TARGET binding site found in the 3' untranslated region of mRNA encoded by PCDHAC1, corresponding to a HOST TARGET binding site such as BINDING SITE I, BINDING SITE II or BINDING SITE III. Table 2 illustrates the complementarity of the nucleotide sequences of PCDHAC1 BINDING SITE, designated SEQ ID:20840, to the nucleotide sequence of VGAM2369 RNA, herein designated VGAM RNA, also designated SEQ ID:5080.

Another function of VGAM2369 is therefore inhibition of Protocadherin Alpha Subfamily C, 1 (PCDHAC1, Accession NM_018898). Accordingly, utilities of VGAM2369 include diagnosis, prevention and treatment of diseases and clinical conditions associated with PCDHAC1. Protocadherin Alpha Subfamily C, 2 (PCDHAC2, Accession NM_018899) is another VGAM2369 host target gene. PCDHAC2 BINDING SITE is HOST TARGET binding site found in the 3' untranslated region of mRNA encoded by PCDHAC2, corresponding to a HOST TARGET binding site such as BINDING SITE I, BINDING SITE II or BINDING SITE III. Table 2 illustrates the complementarity of the nucleotide sequences of PCDHAC2 BINDING SITE, designated SEQ ID:20850, to the nucleotide sequence of VGAM2369 RNA, herein designated VGAM RNA, also designated SEQ ID:5080.

Another function of VGAM2369 is therefore inhibition of Protocadherin Alpha Subfamily C, 2 (PCDHAC2, Accession NM_018899). Accordingly, utilities of VGAM2369 include diagnosis, prevention and treatment of diseases and clinical conditions associated with PCDHAC2. FHR5 (Accession NM_030787) is another VGAM2369 host target gene. FHR5 BINDING SITE is HOST TARGET binding site found in the 3' untranslated region of mRNA encoded by FHR5, corresponding to a HOST TARGET binding site such as BINDING SITE I, BINDING SITE II or BINDING SITE III. Table 2 illustrates the complementarity of the nucleotide sequences of FHR5 BINDING SITE, designated SEQ ID:25082, to the nucleotide sequence of VGAM2369 RNA, herein designated VGAM RNA, also designated SEQ ID:5080.

Another function of VGAM2369 is therefore inhibition of FHR5 (Accession NM_030787). Accordingly, utilities of VGAM2369 include diagnosis, prevention and treatment of diseases and clinical conditions associated with FHR5. FLJ10511 (Accession NM_018120) is another VGAM2369 host target gene. FLJ10511 BINDING SITE is HOST TARGET binding site found in the 3' untranslated region of mRNA encoded by FLJ10511, corresponding to a HOST TARGET binding site such as BINDING SITE I, BINDING SITE II or BINDING SITE III. Table 2 illustrates the complementarity of the nucleotide sequences of FLJ10511 BINDING SITE, designated SEQ ID:19897, to the nucleotide sequence of VGAM2369 RNA, herein designated VGAM RNA, also designated SEQ ID:5080.

Another function of VGAM2369 is therefore inhibition of FLJ10511 (Accession NM_018120). Accordingly, utilities of VGAM2369 include diagnosis, prevention and treatment of diseases and clinical conditions associated with FLJ10511. FLJ13962 (Accession NM_024862) is another VGAM2369 host target gene. FLJ13962 BINDING SITE is HOST TARGET binding site found in the 3' untranslated region of mRNA encoded by FLJ13962, corresponding to a HOST TARGET binding site such as BINDING SITE I, BINDING SITE II or BINDING SITE III. Table 2 illustrates the complementarity of the nucleotide sequences of FLJ13962 BINDING SITE, designated SEQ ID:24296, to the nucleotide sequence of VGAM2369 RNA, herein designated VGAM RNA, also designated SEQ ID:5080.

Another function of VGAM2369 is therefore inhibition of FLJ13962 (Accession NM_024862). Accordingly, utilities of VGAM2369 include diagnosis, prevention and treatment of diseases and clinical conditions associated with FLJ13962. LOC143785 (Accession XM_084635) is another VGAM2369 host target gene. LOC143785 BINDING SITE is HOST TARGET binding site found in the 3' untranslated region of mRNA encoded by LOC143785, corresponding to a HOST TARGET binding site such as BINDING SITE I, BINDING SITE II or BINDING SITE III. Table 2 illustrates the complementarity of the nucleotide sequences of LOC143785 BINDING SITE, designated SEQ ID:37631, to the nucleotide sequence of VGAM2369 RNA, herein designated VGAM RNA, also designated SEQ ID:5080.

Another function of VGAM2369 is therefore inhibition of LOC143785 (Accession XM_084635). Accordingly, utilities of VGAM2369 include diagnosis, prevention and treatment of diseases and clinical conditions associated with LOC143785. LOC152215 (Accession XM_087407) is another VGAM2369 host target gene. LOC152215 BINDING SITE is HOST TARGET binding site found in the 3' untranslated region of mRNA encoded by LOC152215, corresponding to a HOST TARGET binding site such as BINDING SITE I, BINDING SITE II or BINDING SITE III. Table 2 illustrates the complementarity of the nucleotide sequences of LOC152215 BINDING SITE, designated SEQ ID:39224, to the nucleotide sequence of VGAM2369 RNA, herein designated VGAM RNA, also designated SEQ ID:5080.

Another function of VGAM2369 is therefore inhibition of LOC152215 (Accession XM_087407). Accordingly, utilities of VGAM2369 include diagnosis, prevention and treatment of diseases and clinical conditions associated with LOC152215. FIG. 1 further provides a conceptual description of a novel bioinformatically detected viral gene of the present invention, referred to here as Viral Genomic Address Messenger 2370 (VGAM2370) viral gene, which modulates expression of respective host target genes thereof, the function and utility of which host target genes is known in the art.

VGAM2370 is a novel bioinformatically detected regulatory, non protein coding, viral micro RNA (miRNA) gene. The method by which VGAM2370 was detected is described hereinabove with reference to FIGS. 1-8.

VGAM2370 gene, herein designated VGAM GENE, is a viral gene contained in the genome of Rat Cytomegalovirus. VGAM2370 host target gene, herein designated VGAM HOST TARGET GENE, is a human gene contained in the human genome.

VGAM2370 gene encodes a VGAM2370 precursor RNA, herein designated VGAM PRECURSOR RNA. Similar to other miRNA genes, and unlike most ordinary genes, VGAM2370 precursor RNA does not encode a protein. A nucleotide sequence identical or highly similar to the nucleotide sequence of VGAM2370 precursor RNA is designated SEQ ID:2356, and is provided hereinbelow with reference to the sequence listing part. Nucleotide sequence SEQ ID:2356 is located at position 217655 relative to the genome of Rat Cytomegalovirus.

VGAM2370 precursor RNA folds onto itself, forming VGAM2370 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2370 folded precursor RNA into VGAM2370 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2370 RNA is designated SEQ ID:5081, and is provided hereinbelow with reference to the sequence listing part.

VGAM2370 host target gene, herein designated VGAM HOST TARGET GENE, encodes a corresponding messenger RNA, VGAM2370 host target RNA, herein designated VGAM HOST TARGET RNA. VGAM2370 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2370 RNA, herein designated VGAM RNA, binds complementarily to one or more host target binding sites located in untranslated regions of VGAM2370 host target RNA, herein designated VGAM HOST TARGET RNA. This complementary binding is due to the fact that the nucleotide sequence of VGAM2370 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2370 RNA, herein designated VGAM RNA, may have a different number of host target binding sites in untranslated regions of a VGAM2370 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2370 RNA, herein designated VGAM RNA, to host target binding sites on VGAM2370 host target RNA, herein designated VGAM HOST TARGET RNA, such as BINDING SITE I, BINDING SITE II and BINDING SITE III, inhibits translation of VGAM2370 host target RNA into VGAM2370 host target protein, herein designated VGAM HOST TARGET PROTEIN. VGAM host target protein is therefore outlined by a broken line.

It is appreciated that VGAM2370 host target gene, herein designated VGAM HOST TARGET GENE, in fact represents a plurality of VGAM2370 host target genes. The mRNA of each one of this plurality of VGAM2370 host target genes comprises one or more host target binding sites, each having a nucleotide sequence which is at least partly complementary to VGAM2370 RNA, herein designated VGAM RNA, and which when bound by VGAM2370 RNA causes inhibition of translation of respective one or more VGAM2370 host target proteins.

It is further appreciated by one skilled in the art that the mode of translational inhibition illustrated by FIG. 1 with specific reference to translational inhibition exerted by VGAM2370 gene, herein designated VGAM GENE, on one or more VGAM2370 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2370 is inhibition of expression of host target genes, as part of a novel viral mechanism of attacking a host. Accordingly, utilities of VGAM2370 include diagnosis, prevention and treatment of viral infection by Rat Cytomegalovirus. Specific functions, and accordingly utilities, of VGAM2370 correlate with, and may be deduced from, the identity of the host target genes which VGAM2370 binds and inhibits, and the function of these host target genes, as elaborated hereinbelow.

Nucleotide sequences of the VGAM2370 precursor RNA, herein designated VGAM PRECURSOR RNA, and of the 'diced' VGAM2370 RNA, herein designated VGAM RNA, and a schematic representation of the secondary folding of VGAM2370 folded precursor RNA, herein designated VGAM FOLDED PRECURSOR RNA, of VGAM2370 are further described hereinbelow with reference to Table 1.

Nucleotide sequences of host target binding sites, such as BINDING SITE-I, BINDING SITE-II and BINDING SITE-III of FIG. 1, found on VGAM2370 host target RNA, and schematic representation of the complementarity of each of these host target binding sites to VGAM2370 RNA, herein designated VGAM RNA, are described hereinbelow with reference to Table 2.

As mentioned hereinabove with reference to FIG. 1, a function of VGAM2370 gene, herein designated VGAM is inhibition of expression of VGAM2370 target genes. It is appreciated that specific functions, and accordingly utilities, of VGAM2370 correlate with, and may be deduced from, the identity of the target genes which VGAM2370 binds and inhibits, and the function of these target genes, as elaborated hereinbelow.

Collagen, Type IV, Alpha 1 (COL4A1, Accession NM_001845) is a VGAM2370 host target gene. COL4A1 BINDING SITE is HOST TARGET binding site found in the 3' untranslated region of mRNA encoded by COL4A1, corresponding to a HOST TARGET binding site such as BINDING SITE I, BINDING SITE II or BINDING SITE III. Table 2 illustrates the complementarity of the nucleotide sequences of COL4A1 BINDING SITE, designated SEQ ID:7580, to the nucleotide sequence of VGAM2370 RNA, herein designated VGAM RNA, also designated SEQ ID:5081.

A function of VGAM2370 is therefore inhibition of Collagen, Type IV, Alpha 1 (COL4A1, Accession NM_001845), a gene which is a member of a subfamily of collagen extracellular matrix proteins. Accordingly, utilities of VGAM2370 include diagnosis, prevention and treatment of diseases and clinical conditions associated with COL4A1. The function of COL4A1 and its association with various diseases and clinical conditions, has been established by previous studies, as described hereinabove with reference to VGAM1645. Catenin (cadherin-associated protein), Alpha 2 (CTNNA2, Accession NM_004389) is another VGAM2370 host target gene. CTNNA2 BINDING SITE is HOST TARGET binding site found in the 3' untranslated region of mRNA encoded by CTNNA2, corresponding to a HOST TARGET binding site such as BINDING SITE I, BINDING SITE II or BINDING SITE III. Table 2 illustrates the complementarity of the nucleotide sequences of CTNNA2 BINDING SITE, designated SEQ ID:10617, to the nucleotide sequence of VGAM2370 RNA, herein designated VGAM RNA, also designated SEQ ID:5081.

Another function of VGAM2370 is therefore inhibition of Catenin (cadherin-associated protein), Alpha 2 (CTNNA2, Accession NM_004389), a gene which is involved in the cytoplasmic anchorage of cell-cell and cell-substrate adhesion molecules. Accordingly, utilities of VGAM2370 include diagnosis, prevention and treatment of diseases and clinical conditions associated with CTNNA2. The function of CTNNA2 and its association with various diseases and clinical conditions, has been established by previous studies, as described hereinabove with reference to VGAM877. Catenin (cadherin-associated protein), Delta 2 (neural plakophilin-related arm-repeat protein) (CTNND2, Accession NM_001332) is another VGAM2370 host target gene. CTNND2 BINDING SITE is HOST TARGET binding site found in the 3' untranslated region of mRNA encoded by CTNND2, corresponding to a HOST TARGET binding site such as BINDING SITE I, BINDING SITE II or BINDING SITE III. Table 2 illustrates the complementarity of the nucleotide sequences of CTNND2 BINDING SITE, designated SEQ ID:7015, to the nucleotide sequence of VGAM2370 RNA, herein designated VGAM RNA, also designated SEQ ID:5081.

Another function of VGAM2370 is therefore inhibition of Catenin (cadherin-associated protein), Delta 2 (neural plakophilin-related arm-repeat protein) (CTNND2, Accession NM_001332), a gene which interacts with presenilin 1 (PSEN1) and is a member of the plakoglobin/armadillo family. Accordingly, utilities of VGAM2370 include diagnosis, prevention and treatment of diseases and clinical conditions associated with CTNND2. The function of CTNND2 and its association with various diseases and clinical conditions, has been established by previous studies, as described hereinabove with reference to VGAM2235. FKSG28 (Accession NM_030929) is another VGAM2370 host target gene. FKSG28 BINDING SITE is HOST TARGET binding site found in the 3' untranslated region of mRNA encoded by FKSG28, corresponding to a HOST TARGET binding site such as BINDING SITE I, BINDING SITE II or BINDING SITE III. Table 2 illustrates the complementarity of the nucleotide sequences of FKSG28 BINDING SITE, designated SEQ ID:25201, to the nucleotide sequence of VGAM2370 RNA, herein designated VGAM RNA, also designated SEQ ID:5081.

Another function of VGAM2370 is therefore inhibition of FKSG28 (Accession NM_030929). Accordingly, utilities of VGAM2370 include diagnosis, prevention and treatment of diseases and clinical conditions associated with FKSG28. Myristoylated Alanine-rich Protein Kinase C Substrate (MARCKS, Accession NM_002356) is another VGAM2370 host target gene. MARCKS BINDING SITE is HOST TARGET binding site found in the 3' untranslated region of mRNA encoded by MARCKS, corresponding to a HOST TARGET binding site such as BINDING SITE I, BINDING SITE II or BINDING SITE III. Table 2 illustrates the complementarity of the nucleotide sequences of MARCKS BINDING SITE, designated SEQ ID:8169, to the nucleotide sequence of VGAM2370 RNA, herein designated VGAM RNA, also designated SEQ ID:5081.

Another function of VGAM2370 is therefore inhibition of Myristoylated Alanine-rich Protein Kinase C Substrate (MARCKS, Accession NM_002356). Accordingly, utilities of VGAM2370 include diagnosis, prevention and treatment of diseases and clinical conditions associated with MARCKS. NPD009 (Accession XM_170795) is another VGAM2370 host target gene. NPD009 BINDING SITE is HOST TARGET binding site found in the 5' untranslated region of mRNA encoded by NPD009, corresponding to a HOST TARGET binding site such as BINDING SITE I, BINDING SITE II or BINDING SITE III. Table 2 illustrates the complementarity of the nucleotide sequences of NPD009 BINDING SITE, designated SEQ ID:45565, to the nucleotide sequence of VGAM2370 RNA, herein designated VGAM RNA, also designated SEQ ID:5081.

Another function of VGAM2370 is therefore inhibition of NPD009 (Accession XM_170795). Accordingly, utilities of VGAM2370 include diagnosis, prevention and treatment of diseases and clinical conditions associated with NPD009. FIG. 1 further provides a conceptual description of a novel bioinformatically detected viral gene of the present invention, referred to here as Viral Genomic Address Messenger 2371 (VGAM2371) viral gene, which modulates expression of respective host target genes thereof, the function and utility of which host target genes is known in the art.

VGAM2371 is a novel bioinformatically detected regulatory, non protein coding, viral micro RNA (miRNA) gene. The method by which VGAM2371 was detected is described hereinabove with reference to FIGS. 1-8.

VGAM2371 gene, herein designated VGAM GENE, is a viral gene contained in the genome of Rat Cytomegalovirus. VGAM2371 host target gene, herein designated VGAM HOST TARGET GENE, is a human gene contained in the human genome.

VGAM2371 gene encodes a VGAM2371 precursor RNA, herein designated VGAM PRECURSOR RNA. Similar to other miRNA genes, and unlike most ordinary genes, VGAM2371 precursor RNA does not encode a protein. A nucleotide sequence identical or highly similar to the nucleotide sequence of VGAM2371 precursor RNA is designated SEQ ID:2357, and is provided hereinbelow with reference to the sequence listing part. Nucleotide sequence SEQ ID:2357 is located at position 183987 relative to the genome of Rat Cytomegalovirus.

VGAM2371 precursor RNA folds onto itself, forming VGAM2371 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2371 folded precursor RNA into VGAM2371 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 60%) nucleotide sequence of VGAM2371 RNA is designated SEQ ID:5082, and is provided hereinbelow with reference to the sequence listing part.

VGAM2371 host target gene, herein designated VGAM HOST TARGET GENE, encodes a corresponding messenger RNA, VGAM2371 host target RNA, herein designated VGAM HOST TARGET RNA. VGAM2371 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2371 RNA, herein designated VGAM RNA, binds complementarily to one or more host target binding sites located in untranslated regions of VGAM2371 host target RNA, herein designated VGAM HOST TARGET RNA. This complementary binding is due to the fact that the nucleotide sequence of VGAM2371 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2371 RNA, herein designated VGAM RNA, may have a different number of host target binding sites in untranslated regions of a VGAM2371 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2371 RNA, herein designated VGAM RNA, to host target binding sites on VGAM2371 host target RNA, herein designated VGAM HOST TARGET RNA, such as BINDING SITE I, BINDING SITE II and BINDING SITE III, inhibits translation of VGAM2371 host target RNA into VGAM2371 host target protein, herein designated VGAM HOST TARGET PROTEIN. VGAM host target protein is therefore outlined by a broken line.

It is appreciated that VGAM2371 host target gene, herein designated VGAM HOST TARGET GENE, in fact represents a plurality of VGAM2371 host target genes. The mRNA of each one of this plurality of VGAM2371 host target genes comprises one or more host target binding sites, each having a nucleotide sequence which is at least partly complementary to VGAM2371 RNA, herein designated VGAM RNA, and which when bound by VGAM2371 RNA causes inhibition of translation of respective one or more VGAM2371 host target proteins.

It is further appreciated by one skilled in the art that the mode of translational inhibition illustrated by FIG. 1 with specific reference to translational inhibition exerted by VGAM2371 gene, herein designated VGAM GENE, on one or more VGAM2371 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2371 is inhibition of expression of host target genes, as part of a novel viral mechanism of attacking a host. Accordingly, utilities of VGAM2371 include diagnosis, prevention and treatment of viral infection by Rat Cytomegalovirus. Specific functions, and accordingly utilities, of VGAM2371 correlate with, and may be deduced from, the identity of the host target genes which VGAM2371 binds and inhibits, and the function of these host target genes, as elaborated hereinbelow.

Nucleotide sequences of the VGAM2371 precursor RNA, herein designated VGAM PRECURSOR RNA, and of the 'diced' VGAM2371 RNA, herein designated VGAM RNA, and a schematic representation of the secondary folding of VGAM2371 folded precursor RNA, herein designated VGAM FOLDED PRECURSOR RNA, of VGAM2371 are further described hereinbelow with reference to Table 1.

Nucleotide sequences of host target binding sites, such as BINDING SITE-I, BINDING SITE-II and BINDING SITE-III of FIG. 1, found on VGAM2371 host target RNA, and schematic representation of the complementarity of each of these host target binding sites to VGAM2371 RNA, herein designated VGAM RNA, are described hereinbelow with reference to Table 2.

As mentioned hereinabove with reference to FIG. 1, a function of VGAM2371 gene, herein designated VGAM is inhibition of expression of VGAM2371 target genes. It is appreciated that specific functions, and accordingly utilities, of VGAM2371 correlate with, and may be deduced from, the identity of the target genes which VGAM2371 binds and inhibits, and the function of these target genes, as elaborated hereinbelow.

UDP-Gal:betaGlcNAc Beta 1,4-Galactosyltransferase, Polypeptide 1 (B4GALT1, Accession NM_001497) is a VGAM2371 host target gene. B4GALT1 BINDING SITE is HOST TARGET binding site found in the 3' untranslated region of mRNA encoded by B4GALT1, corresponding to a HOST TARGET binding site such as BINDING SITE I, BINDING SITE II or BINDING SITE III. Table 2 illustrates the complementarity of the nucleotide sequences of B4GALT1 BINDING SITE, designated SEQ ID:7246, to the nucleotide sequence of VGAM2371 RNA, herein designated VGAM RNA, also designated SEQ ID:5082.

A function of VGAM2371 is therefore inhibition of UDP-Gal:betaGlcNAc Beta 1,4-Galactosyltransferase, Polypeptide 1 (B4GALT1, Accession NM_001497). Accordingly, utilities of VGAM2371 include diagnosis, prevention and treatment of diseases and clinical conditions associated with B4GALT1. IRTA2 (Accession NM_031281) is another VGAM2371 host target gene. IRTA2 BINDING SITE is HOST TARGET binding site found in the 3' untranslated region of mRNA encoded by IRTA2, corresponding to a HOST TARGET binding site such as BINDING SITE I, BINDING SITE II or BINDING SITE III. Table 2 illustrates the complementarity of the nucleotide sequences of IRTA2 BINDING SITE, designated SEQ ID:25299, to the nucleotide sequence of VGAM2371 RNA, herein designated VGAM RNA, also designated SEQ ID:5082.

Another function of VGAM2371 is therefore inhibition of IRTA2 (Accession NM_031281), a gene which binds to the fc region of immunoglobulins gamma low affinity receptor. Accordingly, utilities of VGAM2371 include diagnosis, prevention and treatment of diseases and clinical conditions associated with IRTA2. The function of IRTA2 and its association with various diseases and clinical conditions, has been established by previous studies, as described hereinabove with reference to VGAM206. KIAA1318 (Accession XM_041080) is another VGAM2371 host target gene. KIAA1318 BINDING SITE is HOST TARGET binding site found in the 3' untranslated region of mRNA encoded by KIAA1318, corresponding to a HOST TARGET binding site such as BINDING SITE I, BINDING SITE II or BINDING SITE III. Table 2 illustrates the complementarity of the nucleotide sequences of KIAA1318 BINDING SITE, designated SEQ ID:33433, to the nucleotide sequence of VGAM2371 RNA, herein designated VGAM RNA, also designated SEQ ID:5082.

Another function of VGAM2371 is therefore inhibition of KIAA1318 (Accession XM_041080). Accordingly, utilities of VGAM2371 include diagnosis, prevention and treatment of diseases and clinical conditions associated with KIAA1318. MOST2 (Accession NM_020250) is another VGAM2371 host target gene. MOST2 BINDING SITE is HOST TARGET binding site found in the 5' untranslated region of mRNA encoded by MOST2, corresponding to a HOST TARGET binding site such as BINDING SITE I, BINDING SITE II or BINDING SITE III. Table 2 illustrates the complementarity of the nucleotide sequences of MOST2 BINDING SITE, designated SEQ ID:21554, to the nucleotide sequence of VGAM2371 RNA, herein designated VGAM RNA, also designated SEQ ID:5082.

Another function of VGAM2371 is therefore inhibition of MOST2 (Accession NM_020250). Accordingly, utilities of VGAM2371 include diagnosis, prevention and treatment of diseases and clinical conditions associated with MOST2. LOC158364 (Accession XM_088546) is another VGAM2371 host target gene. LOC158364 BINDING SITE is HOST TARGET binding site found in the 5' untranslated region of mRNA encoded by LOC158364, corresponding to a HOST TARGET binding site such as BINDING SITE I, BINDING SITE II or BINDING SITE III. Table 2 illustrates the complementarity of the nucleotide sequences of LOC158364 BINDING SITE, designated SEQ ID:39818, to the nucleotide sequence of VGAM2371 RNA, herein designated VGAM RNA, also designated SEQ ID:5082.

Another function of VGAM2371 is therefore inhibition of LOC158364 (Accession XM_088546). Accordingly, utilities of VGAM2371 include diagnosis, prevention and treatment of diseases and clinical conditions associated with LOC158364. FIG. 1 further provides a conceptual description of a novel bioinformatically detected viral gene of the present invention, referred to here as Viral Genomic Address Messenger 2372 (VGAM2372) viral gene, which modulates expression of respective host target genes thereof, the function and utility of which host target genes is known in the art.

VGAM2372 is a novel bioinformatically detected regulatory, non protein coding, viral micro RNA (miRNA) gene. The method by which VGAM2372 was detected is described hereinabove with reference to FIGS. 1-8.

VGAM2372 gene, herein designated VGAM GENE, is a viral gene contained in the genome of Rat Cytomegalovirus. VGAM2372 host target gene, herein designated VGAM HOST TARGET GENE, is a human gene contained in the human genome.

VGAM2372 gene encodes a VGAM2372 precursor RNA, herein designated VGAM PRECURSOR RNA. Similar to other miRNA genes, and unlike most ordinary genes, VGAM2372 precursor RNA does not encode a protein. A nucleotide sequence identical or highly similar to the nucleotide sequence of VGAM2372 precursor RNA is designated SEQ ID:2358, and is provided hereinbelow with reference to the sequence listing part. Nucleotide sequence SEQ ID:2358 is located at position 208652 relative to the genome of Rat Cytomegalovirus.

VGAM2372 precursor RNA folds onto itself, forming VGAM2372 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2372 folded precursor RNA into VGAM2372 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM2372 RNA is designated SEQ ID:5083, and is provided hereinbelow with reference to the sequence listing part.

VGAM2372 host target gene, herein designated VGAM HOST TARGET GENE, encodes a corresponding messenger RNA, VGAM2372 host target RNA, herein designated VGAM HOST TARGET RNA. VGAM2372 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2372 RNA, herein designated VGAM RNA, binds complementarily to one or more host target binding sites located in untranslated regions of VGAM2372 host target RNA, herein designated VGAM HOST TARGET RNA. This complementary binding is due to the fact that the nucleotide sequence of VGAM2372 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2372 RNA, herein designated VGAM RNA, may have a different number of host target binding sites in untranslated regions of a VGAM2372 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2372 RNA, herein designated VGAM RNA, to host target binding sites on VGAM2372 host target RNA, herein designated VGAM HOST TARGET RNA, such as BINDING SITE I, BINDING SITE II and BINDING SITE III, inhibits translation of VGAM2372 host target RNA into VGAM2372 host target protein, herein designated VGAM HOST TARGET PROTEIN. VGAM host target protein is therefore outlined by a broken line.

It is appreciated that VGAM2372 host target gene, herein designated VGAM HOST TARGET GENE, in fact represents a plurality of VGAM2372 host target genes. The mRNA of each one of this plurality of VGAM2372 host target genes comprises one or more host target binding sites, each having a nucleotide sequence which is at least partly complementary to VGAM2372 RNA, herein designated VGAM RNA, and which when bound by VGAM2372 RNA causes inhibition of translation of respective one or more VGAM2372 host target proteins.

It is further appreciated by one skilled in the art that the mode of translational inhibition illustrated by FIG. 1 with specific reference to translational inhibition exerted by VGAM2372 gene, herein designated VGAM GENE, on one or more VGAM2372 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2372 is inhibition of expression of host target genes, as part of a novel viral mechanism of attacking a host. Accordingly, utilities of VGAM2372 include diagnosis, prevention and treatment of viral infection by Rat Cytomegalovirus. Specific functions, and accordingly utilities, of VGAM2372 correlate with, and may be deduced from, the identity of the host target genes which VGAM2372 binds and inhibits, and the function of these host target genes, as elaborated hereinbelow.

Nucleotide sequences of the VGAM2372 precursor RNA, herein designated VGAM PRECURSOR RNA, and of the 'diced' VGAM2372 RNA, herein designated VGAM RNA, and a schematic representation of the secondary folding of VGAM2372 folded precursor RNA, herein designated VGAM FOLDED PRECURSOR RNA, of VGAM2372 are further described hereinbelow with reference to Table 1.

Nucleotide sequences of host target binding sites, such as BINDING SITE-I, BINDING SITE-II and BINDING SITE-III of FIG. 1, found on VGAM2372 host target RNA, and schematic representation of the complementarity of each of these host target binding sites to VGAM2372 RNA, herein designated VGAM RNA, are described hereinbelow with reference to Table 2.

As mentioned hereinabove with reference to FIG. 1, a function of VGAM2372 gene, herein designated VGAM is inhibition of expression of VGAM2372 target genes. It is appreciated that specific functions, and accordingly utilities, of VGAM2372 correlate with, and may be deduced from, the identity of the target genes which VGAM2372 binds and inhibits, and the function of these target genes, as elaborated hereinbelow.

Dystrophin (muscular dystrophy, Duchenne and Becker types) (DMD, Accession NM_000109) is a VGAM2372 host target gene. DMD BINDING SITE1 through DMD BINDING SITE13 are HOST TARGET binding sites found in untranslated regions of mRNA encoded by DMD, corresponding to HOST TARGET binding sites such as BINDING SITE I, BINDING SITE II or BINDING SITE III. Table 2 illustrates the complementarity of the nucleotide sequences of DMD BINDING SITE1 through DMD BINDING SITE13, designated SEQ ID:5573, SEQ ID:10156, SEQ ID:10163, SEQ ID:10209, SEQ ID:10214, SEQ ID:10225, SEQ ID:10169, SEQ ID:10177, SEQ ID:10182, SEQ ID:10187, SEQ ID:10198, SEQ ID:10204 and SEQ ID:10237 respectively, to the nucleotide sequence of VGAM2372 RNA, herein designated VGAM RNA, also designated SEQ ID:5083.

A function of VGAM2372 is therefore inhibition of Dystrophin (muscular dystrophy, Duchenne and Becker types) (DMD, Accession NM_000109), a gene which muscular dystrophy. Accordingly, utilities of VGAM2372 include diagnosis, prevention and treatment of diseases and clinical conditions associated with DMD. The function of DMD and its association with various diseases and clinical conditions, has been established by previous studies, as described hereinabove with reference to VGAM218. Deiodinase, Iodothyronine, Type II (DIO2, Accession NM_000793) is another VGAM2372 host target gene. DIO2 BINDING SITE1 and DIO2 BINDING SITE2 are HOST TARGET binding sites found in untranslated regions of mRNA encoded by DIO2, corresponding to HOST TARGET binding sites such as BINDING SITE I, BINDING SITE II or BINDING SITE III. Table 2 illustrates the complementarity of the nucleotide sequences of DIO2 BINDING SITE1 and DIO2 BINDING SITE2, designated SEQ ID:6462 and SEQ ID:15173 respectively, to the nucleotide sequence of VGAM2372 RNA, herein designated VGAM RNA, also designated SEQ ID:5083.

Another function of VGAM2372 is therefore inhibition of Deiodinase, Iodothyronine, Type II (DIO2, Accession NM_000793). Accordingly, utilities of VGAM2372 include diagnosis, prevention and treatment of diseases and clinical conditions associated with DIO2. FLJ14906 (Accession NM_032859) is another VGAM2372 host target gene. FLJ14906 BINDING SITE is HOST TARGET binding site found in the 3' untranslated region of mRNA encoded by FLJ14906, corresponding to a HOST TARGET binding site such as BINDING SITE I, BINDING SITE II or BINDING SITE III. Table 2 illustrates the complementarity of the nucleotide sequences of FLJ14906 BINDING SITE, designated SEQ ID:26661, to the nucleotide sequence of VGAM2372 RNA, herein designated VGAM RNA, also designated SEQ ID:5083.

Another function of VGAM2372 is therefore inhibition of FLJ14906 (Accession NM_032859). Accordingly, utilities of VGAM2372 include diagnosis, prevention and treatment of diseases and clinical conditions associated with FLJ14906. PRO1584 (Accession NM_018586) is another VGAM2372 host target gene. PRO1584 BINDING SITE is HOST TARGET binding site found in the 5' untranslated region of mRNA encoded by PRO1584, corresponding to a HOST TARGET binding site such as BINDING SITE I, BINDING SITE II or BINDING SITE III. Table 2 illustrates the complementarity of the nucleotide sequences of PRO1584 BINDING SITE, designated SEQ ID:20662, to the nucleotide sequence of VGAM2372 RNA, herein designated VGAM RNA, also designated SEQ ID:5083.

Another function of VGAM2372 is therefore inhibition of PRO1584 (Accession NM_018586). Accordingly, utilities of VGAM2372 include diagnosis, prevention and treatment of diseases and clinical conditions associated with PRO1584. LOC203078 (Accession XM_114625) is another VGAM2372 host target gene. LOC203078 BINDING SITE is HOST TARGET binding site found in the 3' untranslated region of mRNA encoded by LOC203078, corresponding to a HOST TARGET binding site such as BINDING SITE I, BINDING SITE II or BINDING SITE III. Table 2 illustrates the complementarity of the nucleotide sequences of LOC203078 BINDING SITE, designated SEQ ID:43006, to the nucleotide sequence of VGAM2372 RNA, herein designated VGAM RNA, also designated SEQ ID:5083.

Another function of VGAM2372 is therefore inhibition of LOC203078 (Accession XM_114625). Accordingly, utilities of VGAM2372 include diagnosis, prevention and treatment of diseases and clinical conditions associated with LOC203078. FIG. 1 further provides a conceptual description of a novel bioinformatically detected viral gene of the present invention, referred to here as Viral Genomic Address Messenger 2373 (VGAM2373) viral gene, which modulates expression of respective host target genes thereof, the function and utility of which host target genes is known in the art.

VGAM2373 is a novel bioinformatically detected regulatory, non protein coding, viral micro RNA (miRNA) gene. The method by which VGAM2373 was detected is described hereinabove with reference to FIGS. 1-8.

VGAM2373 gene, herein designated VGAM GENE, is a viral gene contained in the genome of Rat Cytomegalovirus. VGAM2373 host target gene, herein designated VGAM HOST TARGET GENE, is a human gene contained in the human genome.

VGAM2373 gene encodes a VGAM2373 precursor RNA, herein designated VGAM PRECURSOR RNA. Similar to other miRNA genes, and unlike most ordinary genes, VGAM2373 precursor RNA does not encode a protein. A nucleotide sequence identical or highly similar to the nucleotide sequence of VGAM2373 precursor RNA is designated SEQ ID:2359, and is provided hereinbelow with reference to the sequence listing part. Nucleotide sequence SEQ ID:2359 is located at position 222910 relative to the genome of Rat Cytomegalovirus.

VGAM2373 precursor RNA folds onto itself, forming VGAM2373 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2373 folded precursor RNA into VGAM2373 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2373 RNA is designated SEQ ID:5084, and is provided hereinbelow with reference to the sequence listing part.

VGAM2373 host target gene, herein designated VGAM HOST TARGET GENE, encodes a corresponding messenger RNA, VGAM2373 host target RNA, herein designated VGAM HOST TARGET RNA. VGAM2373 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2373 RNA, herein designated VGAM RNA, binds complementarily to one or more host target binding sites located in untranslated regions of VGAM2373 host target RNA, herein designated VGAM HOST TARGET RNA. This complementary binding is due to the fact that the nucleotide sequence of VGAM2373 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2373 RNA, herein designated VGAM RNA, may have a different number of host target binding sites in untranslated regions of a VGAM2373 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2373 RNA, herein designated VGAM RNA, to host target binding sites on VGAM2373 host target RNA, herein designated VGAM HOST TARGET RNA, such as BINDING SITE I, BINDING SITE II and BINDING SITE III, inhibits translation of VGAM2373 host target RNA into VGAM2373 host target protein, herein designated VGAM HOST TARGET PROTEIN. VGAM host target protein is therefore outlined by a broken line.

It is appreciated that VGAM2373 host target gene, herein designated VGAM HOST TARGET GENE, in fact represents a plurality of VGAM2373 host target genes. The mRNA of each one of this plurality of VGAM2373 host target genes comprises one or more host target binding sites, each having a nucleotide sequence which is at least partly complementary to VGAM2373 RNA, herein designated VGAM RNA, and which when bound by VGAM2373 RNA causes inhibition of translation of respective one or more VGAM2373 host target proteins.

It is further appreciated by one skilled in the art that the mode of translational inhibition illustrated by FIG. 1 with specific reference to translational inhibition exerted by VGAM2373 gene, herein designated VGAM GENE, on one or more VGAM2373 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2373 is inhibition of expression of host target genes, as part of a novel viral mechanism of attacking a host. Accordingly, utilities of VGAM2373 include diagnosis, prevention and treatment of viral infection by Rat Cytomegalovirus. Specific functions, and accordingly utilities, of VGAM2373 correlate with, and may be deduced from, the identity of the host target genes which VGAM2373 binds and inhibits, and the function of these host target genes, as elaborated hereinbelow.

Nucleotide sequences of the VGAM2373 precursor RNA, herein designated VGAM PRECURSOR RNA, and of the 'diced' VGAM2373 RNA, herein designated VGAM RNA, and a schematic representation of the secondary folding of VGAM2373 folded precursor RNA, herein designated VGAM FOLDED PRECURSOR RNA, of VGAM2373 are further described hereinbelow with reference to Table 1.

Nucleotide sequences of host target binding sites, such as BINDING SITE-I, BINDING SITE-II and BINDING SITE-III of FIG. 1, found on VGAM2373 host target RNA, and schematic representation of the complementarity of each of these host target binding sites to VGAM2373 RNA, herein designated VGAM RNA, are described hereinbelow with reference to Table 2.

As mentioned hereinabove with reference to FIG. 1, a function of VGAM2373 gene, herein designated VGAM is inhibition of expression of VGAM2373 target genes. It is appreciated that specific functions, and accordingly utilities, of VGAM2373 correlate with, and may be deduced from, the identity of the target genes which VGAM2373 binds and inhibits, and the function of these target genes, as elaborated hereinbelow.

LIM Domain Kinase 1 (LIMK1, Accession NM_002314) is a VGAM2373 host target gene. LIMK1 BINDING SITE1 and LIMK1 BINDING SITE2 are HOST TARGET binding sites found in untranslated regions of mRNA encoded by LIMK1, corresponding to HOST TARGET binding sites such as BINDING SITE I, BINDING SITE II or BINDING SITE III. Table 2 illustrates the complementarity of the nucleotide sequences of LIMK1 BINDING SITE1 and LIMK1 BINDING SITE2, designated SEQ ID:8127 and SEQ ID:18804 respectively, to the nucleotide sequence of VGAM2373 RNA, herein designated VGAM RNA, also designated SEQ ID:5084.

A function of VGAM2373 is therefore inhibition of LIM Domain Kinase 1 (LIMK1, Accession NM_002314). Accordingly, utilities of VGAM2373 include diagnosis, prevention and treatment of diseases and clinical conditions associated with LIMK1. FIG. 1 further provides a conceptual description of a novel bioinformatically detected viral gene of the present invention, referred to here as Viral Genomic Address Messenger 2374 (VGAM2374) viral gene, which modulates expression of respective host target genes thereof, the function and utility of which host target genes is known in the art.

VGAM2374 is a novel bioinformatically detected regulatory, non protein coding, viral micro RNA (miRNA) gene. The method by which VGAM2374 was detected is described hereinabove with reference to FIGS. 1-8.

VGAM2374 gene, herein designated VGAM GENE, is a viral gene contained in the genome of Rat Cytomegalovirus. VGAM2374 host target gene, herein designated VGAM HOST TARGET GENE, is a human gene contained in the human genome.

VGAM2374 gene encodes a VGAM2374 precursor RNA, herein designated VGAM PRECURSOR RNA. Similar to other miRNA genes, and unlike most ordinary genes, VGAM2374 precursor RNA does not encode a protein. A nucleotide sequence identical or highly similar to the nucleotide sequence of VGAM2374 precursor RNA is designated SEQ ID:2360, and is provided hereinbelow with reference to the sequence listing part. Nucleotide sequence SEQ ID:2360 is located at position 203878 relative to the genome of Rat Cytomegalovirus.

VGAM2374 precursor RNA folds onto itself, forming VGAM2374 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2374 folded precursor RNA into VGAM2374 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM2374 RNA is designated SEQ ID:5085, and is provided hereinbelow with reference to the sequence listing part.

VGAM2374 host target gene, herein designated VGAM HOST TARGET GENE, encodes a corresponding messenger RNA, VGAM2374 host target RNA, herein designated VGAM HOST TARGET RNA. VGAM2374 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2374 RNA, herein designated VGAM RNA, binds complementarily to one or more host target binding sites located in untranslated regions of VGAM2374 host target RNA, herein designated VGAM HOST TARGET RNA. This complementary binding is due to the fact that the nucleotide sequence of VGAM2374 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2374 RNA, herein designated VGAM RNA, may have a different number of host target binding sites in untranslated regions of a VGAM2374 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2374 RNA, herein designated VGAM RNA, to host target binding sites on VGAM2374 host target RNA, herein designated VGAM HOST TARGET RNA, such as BINDING SITE I, BINDING SITE II and BINDING SITE III, inhibits translation of VGAM2374 host target RNA into VGAM2374 host target protein, herein designated VGAM HOST TARGET PROTEIN. VGAM host target protein is therefore outlined by a broken line.

It is appreciated that VGAM2374 host target gene, herein designated VGAM HOST TARGET GENE, in fact represents a plurality of VGAM2374 host target genes. The mRNA of each one of this plurality of VGAM2374 host target genes comprises one or more host target binding sites, each having a nucleotide sequence which is at least partly complementary to VGAM2374 RNA, herein designated VGAM RNA, and which when bound by VGAM2374 RNA causes inhibition of translation of respective one or more VGAM2374 host target proteins.

It is further appreciated by one skilled in the art that the mode of translational inhibition illustrated by FIG. 1 with specific reference to translational inhibition exerted by VGAM2374 gene, herein designated VGAM GENE, on one or more VGAM2374 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2374 is inhibition of expression of host target genes, as part of a novel viral mechanism of attacking a host. Accordingly, utilities of VGAM2374 include diagnosis, prevention and treatment of viral infection by Rat Cytomegalovirus. Specific functions, and accordingly utilities, of VGAM2374 correlate with, and may be deduced from, the identity of the host target genes which VGAM2374 binds and inhibits, and the function of these host target genes, as elaborated hereinbelow.

Nucleotide sequences of the VGAM2374 precursor RNA, herein designated VGAM PRECURSOR RNA, and of the 'diced' VGAM2374 RNA, herein designated VGAM RNA, and a schematic representation of the secondary folding of VGAM2374 folded precursor RNA, herein designated VGAM FOLDED PRECURSOR RNA, of VGAM2374 are further described hereinbelow with reference to Table 1.

Nucleotide sequences of host target binding sites, such as BINDING SITE-I, BINDING SITE-II and BINDING SITE-III of FIG. 1, found on VGAM2374 host target RNA, and schematic representation of the complementarity of each of these host target binding sites to VGAM2374 RNA, herein designated VGAM RNA, are described hereinbelow with reference to Table 2.

As mentioned hereinabove with reference to FIG. 1, a function of VGAM2374 gene, herein designated VGAM is inhibition of expression of VGAM2374 target genes. It is appreciated that specific functions, and accordingly utilities, of VGAM2374 correlate with, and may be deduced from, the identity of the target genes which VGAM2374 binds and inhibits, and the function of these target genes, as elaborated hereinbelow.

Caspase 10, Apoptosis-related Cysteine Protease (CASP10, Accession NM_032976) is a VGAM2374 host target gene. CASP10 BINDING SITE1 and CASP10 BINDING SITE2 are HOST TARGET binding sites found in untranslated regions of mRNA encoded by CASP10, corresponding to HOST TARGET binding sites such as BINDING SITE I, BINDING SITE II or BINDING SITE III. Table 2 illustrates the complementarity of the nucleotide sequences of CASP10 BINDING SITE1 and CASP10 BINDING SITE2, designated SEQ ID:26832 and SEQ ID:26835 respectively, to the nucleotide sequence of VGAM2374 RNA, herein designated VGAM RNA, also designated SEQ ID:5085.

A function of VGAM2374 is therefore inhibition of Caspase 10, Apoptosis-related Cysteine Protease (CASP10, Accession NM_032976), a gene which is one aspartate-specific cysteine protease and important in death receptor signaling or other cellular processes. Accordingly, utilities of VGAM2374 include diagnosis, prevention and treatment of diseases and clinical conditions associated with CASP10. The function of CASP10 and its association with various diseases and clinical conditions, has been established by previous studies, as described hereinabove with reference to VGAM1959. Protein Kinase, CGMP-dependent, Type I (PRKG1, Accession NM_006258) is another VGAM2374 host target gene. PRKG1 BINDING SITE is HOST TARGET binding site found in the 3' untranslated region of mRNA encoded by PRKG1, corresponding to a HOST TARGET binding site such as BINDING SITE I, BINDING SITE II or BINDING SITE III. Table 2 illustrates the complementarity of the nucleotide sequences of PRKG1 BINDING SITE, designated SEQ ID:12937, to the nucleotide sequence of VGAM2374 RNA, herein designated VGAM RNA, also designated SEQ ID:5085.

Another function of VGAM2374 is therefore inhibition of Protein Kinase, CGMP-dependent, Type I (PRKG1, Accession NM_006258), a gene which relaxes vascular smooth muscle and inhibits platelet aggregation. Accordingly, utilities of VGAM2374 include diagnosis, prevention and treatment of diseases and clinical conditions associated with PRKG1. The function of PRKG1 and its association with various diseases and clinical conditions, has been established by previous studies, as described hereinabove with reference to VGAM1571. TNF Receptor-associated Factor 5 (TRAF5, Accession NM_004619) is another VGAM2374 host target gene. TRAF5 BINDING SITE is HOST TARGET binding site found in the 3' untranslated region of mRNA encoded by TRAF5, corresponding to a HOST TARGET binding site such as BINDING SITE I, BINDING SITE II or BINDING SITE III. Table 2 illustrates the complementarity of the nucleotide sequences of TRAF5 BINDING SITE, designated SEQ ID:10962, to the nucleotide sequence of VGAM2374 RNA, herein designated VGAM RNA, also designated SEQ ID:5085.

Another function of VGAM2374 is therefore inhibition of TNF Receptor-associated Factor 5 (TRAF5, Accession NM_004619), a gene which Member of a family of proteins that interact with TNF receptors; binds the lymphotoxin beta receptor (LTBR). Accordingly, utilities of VGAM2374 include diagnosis, prevention and treatment of diseases and clinical conditions associated with TRAF5. The function of TRAF5 and its association with various diseases and clinical conditions, has been established by previous studies, as described hereinabove with reference to VGAM76. Tyrosine 3-monooxygenase/tryptophan 5-monooxygenase Activation Protein, Gamma Polypeptide (YWHAG, Accession NM_012479) is another VGAM2374 host target gene. YWHAG BINDING SITE is HOST TARGET binding site found in the 3' untranslated region of mRNA encoded by YWHAG, corresponding to a HOST TARGET binding site such as BINDING SITE I, BINDING SITE II or BINDING SITE III. Table 2 illustrates the complementarity of the nucleotide sequences of YWHAG BINDING SITE, designated SEQ ID:14856, to the nucleotide sequence of VGAM2374 RNA, herein designated VGAM RNA, also designated SEQ ID:5085.

Another function of VGAM2374 is therefore inhibition of Tyrosine 3-monooxygenase/tryptophan 5-monooxygenase Activation Protein, Gamma Polypeptide (YWHAG, Accession NM_012479), a gene which mediates mitogenic signals of PDGF in vascular smooth muscle cells. Accordingly, utilities of VGAM2374 include diagnosis, prevention and treatment of diseases and clinical conditions associated with YWHAG. The function of YWHAG and its association with various diseases and clinical conditions, has been established by previous studies, as described hereinabove with reference to VGAM180. FLJ10097 (Accession XM_043653) is another VGAM2374 host target gene. FLJ10097 BINDING SITE is HOST TARGET binding site found in the 3' untranslated region of mRNA encoded by FLJ10097, corresponding to a HOST TARGET binding site such as BINDING SITE I, BINDING SITE II or BINDING SITE III. Table 2 illustrates the complementarity of the nucleotide sequences of FLJ10097 BINDING SITE, designated SEQ ID:33987, to the nucleotide sequence of VGAM2374 RNA, herein designated VGAM RNA, also designated SEQ ID:5085.

Another function of VGAM2374 is therefore inhibition of FLJ10097 (Accession XM_043653). Accordingly, utilities of VGAM2374 include diagnosis, prevention and treatment of diseases and clinical conditions associated with FLJ10097. KIAA0884 (Accession XM_046660) is another VGAM2374 host target gene. KIAA0884 BINDING SITE is HOST TARGET binding site found in the 5' untranslated region of mRNA encoded by KIAA0884, corresponding to a HOST TARGET binding site such as BINDING SITE I, BINDING SITE II or BINDING SITE III. Table 2 illustrates the complementarity of the nucleotide sequences of KIAA0884 BINDING SITE, designated SEQ ID:34777, to the nucleotide sequence of VGAM2374 RNA, herein designated VGAM RNA, also designated SEQ ID:5085.

Another function of VGAM2374 is therefore inhibition of KIAA0884 (Accession XM_046660). Accordingly, utilities of VGAM2374 include diagnosis, prevention and treatment of diseases and clinical conditions associated with KIAA0884. KIAA1058 (Accession XM_090586) is another VGAM2374 host target gene. KIAA1058 BINDING SITE is HOST TARGET binding site found in the 3' untranslated region of mRNA encoded by KIAA1058, corresponding to a HOST TARGET binding site such as BINDING SITE I, BINDING SITE II or BINDING SITE III. Table 2 illustrates the complementarity of the nucleotide sequences of KIAA1058 BINDING SITE, designated SEQ ID:40011, to the nucleotide sequence of VGAM2374 RNA, herein designated VGAM RNA, also designated SEQ ID:5085.

Another function of VGAM2374 is therefore inhibition of KIAA1058 (Accession XM_090586). Accordingly, utilities of VGAM2374 include diagnosis, prevention and treatment of diseases and clinical conditions associated with KIAA1058. LANO (Accession NM_025168) is another VGAM2374 host target gene. LANO BINDING SITE is HOST TARGET binding site found in the 3' untranslated region of mRNA encoded by LANO, corresponding to a HOST TARGET binding site such as BINDING SITE I, BINDING SITE II or BINDING SITE III. Table 2 illustrates the complementarity of the nucleotide sequences of LANO BINDING SITE, designated SEQ ID:24803, to the nucleotide sequence of VGAM2374 RNA, herein designated VGAM RNA, also designated SEQ ID:5085.

Another function of VGAM2374 is therefore inhibition of LANO (Accession NM_025168). Accordingly, utilities of VGAM2374 include diagnosis, prevention and treatment of diseases and clinical conditions associated with LANO. PAIP1 (Accession XM_039946) is another VGAM2374 host target gene. PAIP1 BINDING SITE is HOST TARGET binding site found in the 3' untranslated region of mRNA encoded by PAIP1, corresponding to a HOST TARGET binding site such as BINDING SITE I, BINDING SITE II or BINDING SITE III. Table 2 illustrates the complementarity of the nucleotide sequences of PAIP1 BINDING SITE, designated SEQ ID:33234, to the nucleotide sequence of VGAM2374 RNA, herein designated VGAM RNA, also designated SEQ ID:5085.

Another function of VGAM2374 is therefore inhibition of PAIP1 (Accession XM_039946). Accordingly, utilities of VGAM2374 include diagnosis, prevention and treatment of diseases and clinical conditions associated with PAIP1. Ubiquitin Specific Protease 25 (USP25, Accession NM_013396) is another VGAM2374 host target gene. USP25 BINDING SITE is HOST TARGET binding site found in the 3' untranslated region of mRNA encoded by USP25, corresponding to a HOST TARGET binding site such as BINDING SITE I, BINDING SITE II or BINDING SITE III. Table 2 illustrates the complementarity of the nucleotide sequences of USP25 BINDING SITE, designated SEQ ID:15047, to the nucleotide sequence of VGAM2374 RNA, herein designated VGAM RNA, also designated SEQ ID:5085.

Another function of VGAM2374 is therefore inhibition of Ubiquitin Specific Protease 25 (USP25, Accession NM_013396). Accordingly, utilities of VGAM2374 include diagnosis, prevention and treatment of diseases and clinical conditions associated with USP25. FIG. 1 further provides a conceptual description of a novel bioinformatically detected viral gene of the present invention, referred to here as Viral Genomic Address Messenger 2375 (VGAM2375) viral gene, which modulates expression of respective host target genes thereof, the function and utility of which host target genes is known in the art.

VGAM2375 is a novel bioinformatically detected regulatory, non protein coding, viral micro RNA (miRNA) gene. The method by which VGAM2375 was detected is described hereinabove with reference to FIGS. 1-8.

VGAM2375 gene, herein designated VGAM GENE, is a viral gene contained in the genome of Rat Cytomegalovirus. VGAM2375 host target gene, herein designated VGAM HOST TARGET GENE, is a human gene contained in the human genome.

VGAM2375 gene encodes a VGAM2375 precursor RNA, herein designated VGAM PRECURSOR RNA. Similar to other miRNA genes, and unlike most ordinary genes, VGAM2375 precursor RNA does not encode a protein. A nucleotide sequence identical or highly similar to the nucleotide sequence of VGAM2375 precursor RNA is designated SEQ ID:2361, and is provided hereinbelow with reference to the sequence listing part. Nucleotide sequence SEQ ID:2361 is located at position 217137 relative to the genome of Rat Cytomegalovirus.

VGAM2375 precursor RNA folds onto itself, forming VGAM2375 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2375 folded precursor RNA into VGAM2375 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2375 RNA is designated SEQ ID:5086, and is provided hereinbelow with reference to the sequence listing part.

VGAM2375 host target gene, herein designated VGAM HOST TARGET GENE, encodes a corresponding messenger RNA, VGAM2375 host target RNA, herein designated VGAM HOST TARGET RNA. VGAM2375 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2375 RNA, herein designated VGAM RNA, binds complementarily to one or more host target binding sites located in untranslated regions of VGAM2375 host target RNA, herein designated VGAM HOST TARGET RNA. This complementary binding is due to the fact that the nucleotide sequence of VGAM2375 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2375 RNA, herein designated VGAM RNA, may have a different number of host target binding sites in untranslated regions of a VGAM2375 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2375 RNA, herein designated VGAM RNA, to host target binding sites on VGAM2375 host target RNA, herein designated VGAM HOST TARGET RNA, such as BINDING SITE I, BINDING SITE II and BINDING SITE III, inhibits translation of VGAM2375 host target RNA into VGAM2375 host target protein, herein designated VGAM HOST TARGET PROTEIN. VGAM host target protein is therefore outlined by a broken line.

It is appreciated that VGAM2375 host target gene, herein designated VGAM HOST TARGET GENE, in fact represents a plurality of VGAM2375 host target genes. The mRNA of each one of this plurality of VGAM2375 host target genes comprises one or more host target binding sites, each having a nucleotide sequence which is at least partly complementary to VGAM2375 RNA, herein designated VGAM RNA, and which when bound by VGAM2375 RNA causes inhibition of translation of respective one or more VGAM2375 host target proteins.

It is further appreciated by one skilled in the art that the mode of translational inhibition illustrated by FIG. 1 with specific reference to translational inhibition exerted by VGAM2375 gene, herein designated VGAM GENE, on one or more VGAM2375 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2375 is inhibition of expression of host target genes, as part of a novel viral mechanism of attacking a host. Accordingly, utilities of VGAM2375 include diagnosis, prevention and treatment of viral infection by Rat Cytomegalovirus. Specific functions, and accordingly utilities, of VGAM2375 correlate with, and may be deduced from, the identity of the host target genes which VGAM2375 binds and inhibits, and the function of these host target genes, as elaborated hereinbelow.

Nucleotide sequences of the VGAM2375 precursor RNA, herein designated VGAM PRECURSOR RNA, and of the 'diced' VGAM2375 RNA, herein designated VGAM RNA, and a schematic representation of the secondary folding of VGAM2375 folded precursor RNA, herein designated VGAM FOLDED PRECURSOR RNA, of VGAM2375 are further described hereinbelow with reference to Table 1.

Nucleotide sequences of host target binding sites, such as BINDING SITE-I, BINDING SITE-II and BINDING SITE-III of FIG. 1, found on VGAM2375 host target RNA, and schematic representation of the complementarity of each of these host target binding sites to VGAM2375 RNA, herein designated VGAM RNA, are described hereinbelow with reference to Table 2.

As mentioned hereinabove with reference to FIG. 1, a function of VGAM2375 gene, herein designated VGAM is inhibition of expression of VGAM2375 target genes. It is appreciated that specific functions, and accordingly utilities, of VGAM2375 correlate with, and may be deduced from, the identity of the target genes which VGAM2375 binds and inhibits, and the function of these target genes, as elaborated hereinbelow.

TIRAP (Accession NM_052887) is a VGAM2375 host target gene. TIRAP BINDING SITE is HOST TARGET binding site found in the 3' untranslated region of mRNA encoded by TIRAP, corresponding to a HOST TARGET binding site such as BINDING SITE I, BINDING SITE II or BINDING SITE III. Table 2 illustrates the complementarity of the nucleotide sequences of TIRAP BINDING SITE, designated SEQ ID:27474, to the nucleotide sequence of VGAM2375 RNA, herein designated VGAM RNA, also designated SEQ ID:5086.

A function of VGAM2375 is therefore inhibition of TIRAP (Accession NM_052887), a gene which is a adapter involved in the TLR4 signaling pathway in the innate immune response. Accordingly, utilities of VGAM2375 include diagnosis, prevention and treatment of diseases and clinical conditions associated with TIRAP. The function of TIRAP and its association with various diseases and clinical conditions, has been established by previous studies, as described hereinabove with reference to VGAM189. Chemokine (C-C motif) Receptor 6 (CCR6, Accession NM_004367) is another VGAM2375 host target gene. CCR6 BINDING SITE1 and CCR6 BINDING SITE2 are HOST TARGET binding sites found in untranslated regions of mRNA encoded by CCR6, corresponding to HOST TARGET binding sites such as BINDING SITE I, BINDING SITE II or BINDING SITE III. Table 2 illustrates the complementarity of the nucleotide sequences of CCR6 BINDING SITE1 and CCR6 BINDING SITE2, designated SEQ ID:10575 and SEQ ID:25367 respectively, to the nucleotide sequence of VGAM2375 RNA, herein designated VGAM RNA, also designated SEQ ID:5086.

Another function of VGAM2375 is therefore inhibition of Chemokine (C-C motif) Receptor 6 (CCR6, Accession NM_004367). Accordingly, utilities of VGAM2375 include diagnosis, prevention and treatment of diseases and clinical conditions associated with CCR6. ZIN (Accession NM_013403) is another VGAM2375 host target gene. ZIN BINDING SITE is HOST TARGET binding site found in the 3' untranslated region of mRNA encoded by ZIN, corresponding to a HOST TARGET binding site such as BINDING SITE I, BINDING SITE II or BINDING SITE III. Table 2 illustrates the complementarity of the nucleotide sequences of ZIN BINDING SITE, designated SEQ ID:15070, to the nucleotide sequence of VGAM2375 RNA, herein designated VGAM RNA, also designated SEQ ID:5086.

Another function of VGAM2375 is therefore inhibition of ZIN (Accession NM_013403). Accordingly, utilities of VGAM2375 include diagnosis, prevention and treatment of diseases and clinical conditions associated with ZIN. LOC63928 (Accession NM_022097) is another VGAM2375 host target gene. LOC63928 BINDING SITE is HOST TARGET binding site found in the 3' untranslated region of mRNA encoded by LOC63928, corresponding to a HOST TARGET binding site such as BINDING SITE I, BINDING SITE II or BINDING SITE III. Table 2 illustrates the complementarity of the nucleotide sequences of LOC63928 BINDING SITE, designated SEQ ID:22638, to the nucleotide sequence of VGAM2375 RNA, herein designated VGAM RNA, also designated SEQ ID:5086.

Another function of VGAM2375 is therefore inhibition of LOC63928 (Accession NM_022097). Accordingly, utilities of VGAM2375 include diagnosis, prevention and treatment of diseases and clinical conditions associated with LOC63928. FIG. 1 further provides a conceptual description of a novel bioinformatically detected viral gene of the present invention, referred to here as Viral Genomic Address Messenger 2376 (VGAM2376) viral gene, which modulates expression of respective host target genes thereof, the function and utility of which host target genes is known in the art.

VGAM2376 is a novel bioinformatically detected regulatory, non protein coding, viral micro RNA (miRNA) gene. The method by which VGAM2376 was detected is described hereinabove with reference to FIGS. 1-8.

VGAM2376 gene, herein designated VGAM GENE, is a viral gene contained in the genome of Rat Cytomegalovirus. VGAM2376 host target gene, herein designated VGAM HOST TARGET GENE, is a human gene contained in the human genome.

VGAM2376 gene encodes a VGAM2376 precursor RNA, herein designated VGAM PRECURSOR RNA. Similar to other miRNA genes, and unlike most ordinary genes, VGAM2376 precursor RNA does not encode a protein. A nucleotide sequence identical or highly similar to the nucleotide sequence of VGAM2376 precursor RNA is designated SEQ ID:2362, and is provided hereinbelow with reference to the sequence listing part. Nucleotide sequence SEQ ID:2362 is located at position 188783 relative to the genome of Rat Cytomegalovirus.

VGAM2376 precursor RNA folds onto itself, forming VGAM2376 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2376 folded precursor RNA into VGAM2376 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2376 RNA is designated SEQ ID:5087, and is provided hereinbelow with reference to the sequence listing part.

VGAM2376 host target gene, herein designated VGAM HOST TARGET GENE, encodes a corresponding messenger RNA, VGAM2376 host target RNA, herein designated VGAM HOST TARGET RNA. VGAM2376 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2376 RNA, herein designated VGAM RNA, binds complementarily to one or more host target binding sites located in untranslated regions of VGAM2376 host target RNA, herein designated VGAM HOST TARGET RNA. This complementary binding is due to the fact that the nucleotide sequence of VGAM2376 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2376 RNA, herein designated VGAM RNA, may have a different number of host target binding sites in untranslated regions of a VGAM2376 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2376 RNA, herein designated VGAM RNA, to host target binding sites on VGAM2376 host target RNA, herein designated VGAM HOST TARGET RNA, such as BINDING SITE I, BINDING SITE II and BINDING SITE III, inhibits translation of VGAM2376 host target RNA into VGAM2376 host target protein, herein designated VGAM HOST TARGET PROTEIN. VGAM host target protein is therefore outlined by a broken line.

It is appreciated that VGAM2376 host target gene, herein designated VGAM HOST TARGET GENE, in fact represents a plurality of VGAM2376 host target genes. The mRNA of each one of this plurality of VGAM2376 host target genes comprises one or more host target binding sites, each having a nucleotide sequence which is at least partly complementary to VGAM2376 RNA, herein designated VGAM RNA, and which when bound by VGAM2376 RNA causes inhibition of translation of respective one or more VGAM2376 host target proteins.

It is further appreciated by one skilled in the art that the mode of translational inhibition illustrated by FIG. 1 with specific reference to translational inhibition exerted by VGAM2376 gene, herein designated VGAM GENE, on one or more VGAM2376 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2376 is inhibition of expression of host target genes, as part of a novel viral mechanism of attacking a host. Accordingly, utilities of VGAM2376 include diagnosis, prevention and treatment of viral infection by Rat Cytomegalovirus. Specific functions, and accordingly utilities, of VGAM2376 correlate with, and may be deduced from, the identity of the host target genes which VGAM2376 binds and inhibits, and the function of these host target genes, as elaborated hereinbelow.

Nucleotide sequences of the VGAM2376 precursor RNA, herein designated VGAM PRECURSOR RNA, and of the 'diced' VGAM2376 RNA, herein designated VGAM RNA, and a schematic representation of the secondary folding of VGAM2376 folded precursor RNA, herein designated VGAM FOLDED PRECURSOR RNA, of VGAM2376 are further described hereinbelow with reference to Table 1.

Nucleotide sequences of host target binding sites, such as BINDING SITE-I, BINDING SITE-II and BINDING SITE-III of FIG. 1, found on VGAM2376 host target RNA, and schematic representation of the complementarity of each of these host target binding sites to VGAM2376 RNA, herein designated VGAM RNA, are described hereinbelow with reference to Table 2.

As mentioned hereinabove with reference to FIG. 1, a function of VGAM2376 gene, herein designated VGAM is inhibition of expression of VGAM2376 target genes. It is appreciated that specific functions, and accordingly utilities, of VGAM2376 correlate with, and may be deduced from, the identity of the target genes which VGAM2376 binds and inhibits, and the function of these target genes, as elaborated hereinbelow.

Oligophrenin 1 (OPHN1, Accession NM_002547) is a VGAM2376 host target gene. OPHN1 BINDING SITE is HOST TARGET binding site found in the 3' untranslated region of mRNA encoded by OPHN1, corresponding to a HOST TARGET binding site such as BINDING SITE I, BINDING SITE II or BINDING SITE III. Table 2 illustrates the complementarity of the nucleotide sequences of OPHN1 BINDING SITE, designated SEQ ID:8404, to the nucleotide sequence of VGAM2376 RNA, herein designated VGAM RNA, also designated SEQ ID:5087.

A function of VGAM2376 is therefore inhibition of Oligophrenin 1 (OPHN1, Accession NM_002547). Accordingly, utilities of VGAM2376 include diagnosis, prevention and treatment of diseases and clinical conditions associated with OPHN1. X-prolyl Aminopeptidase (aminopeptidase P) 2, Membrane-bound (XPNPEP2, Accession NM_003399) is another VGAM2376 host target gene. XPNPEP2 BINDING SITE is HOST TARGET binding site found in the 3' untranslated region of mRNA encoded by XPNPEP2, corresponding to a HOST TARGET binding site such as BINDING SITE I, BINDING SITE II or BINDING SITE III. Table 2 illustrates the complementarity of the nucleotide sequences of XPNPEP2 BINDING SITE, designated SEQ ID:9435, to the nucleotide sequence of VGAM2376 RNA, herein designated VGAM RNA, also designated SEQ ID:5087.

Another function of VGAM2376 is therefore inhibition of X-prolyl Aminopeptidase (aminopeptidase P) 2, Membrane-bound (XPNPEP2, Accession NM_003399), a gene which is a membrane-associated X-prolyl metallopeptidase. Accordingly, utilities of VGAM2376 include diagnosis, prevention and treatment of diseases and clinical conditions associated with XPNPEP2. The function of XPNPEP2 and its association with various diseases and clinical conditions, has been established by previous studies, as described hereinabove with reference to VGAM2108. ATIP1 (Accession NM_020749) is another VGAM2376 host target gene. ATIP1 BINDING SITE is HOST TARGET binding site found in the 3' untranslated region of mRNA encoded by ATIP1, corresponding to a HOST TARGET binding site such as BINDING SITE I, BINDING SITE II or BINDING SITE III. Table 2 illustrates the complementarity of the nucleotide sequences of ATIP1 BINDING SITE, designated SEQ ID:21859, to the nucleotide sequence of VGAM2376 RNA, herein designated VGAM RNA, also designated SEQ ID:5087.

Another function of VGAM2376 is therefore inhibition of ATIP1 (Accession NM_020749). Accordingly, utilities of VGAM2376 include diagnosis, prevention and treatment of diseases and clinical conditions associated with ATIP1. Cab45 (Accession NM_016547) is another VGAM2376 host target gene. Cab45 BINDING SITE1 and Cab45 BINDING SITE2 are HOST TARGET binding sites found in untranslated regions of mRNA encoded by Cab45, corresponding to HOST TARGET binding sites such as BINDING SITE I, BINDING SITE II or BINDING SITE III. Table 2 illustrates the complementarity of the nucleotide sequences of Cab45 BINDING SITE1 and Cab45 BINDING SITE2, designated SEQ ID:18619 and SEQ ID:18276 respectively, to the nucleotide sequence of VGAM2376 RNA, herein designated VGAM RNA, also designated SEQ ID:5087.

Another function of VGAM2376 is therefore inhibition of Cab45 (Accession NM_016547). Accordingly, utilities of VGAM2376 include diagnosis, prevention and treatment of diseases and clinical conditions associated with Cab45. LOC151126 (Accession XM_087103) is another VGAM2376 host target gene. LOC151126 BINDING SITE is HOST TARGET binding site found in the 3' untranslated region of mRNA encoded by LOC151126, corresponding to a HOST TARGET binding site such as BINDING SITE I, BINDING SITE II or BINDING SITE III. Table 2 illustrates the complementarity of the nucleotide sequences of LOC151126 BINDING SITE, designated SEQ ID:39056, to the nucleotide sequence of VGAM2376 RNA, herein designated VGAM RNA, also designated SEQ ID:5087.

Another function of VGAM2376 is therefore inhibition of LOC151126 (Accession XM_087103). Accordingly, utilities of VGAM2376 include diagnosis, prevention and treatment of diseases and clinical conditions associated with LOC151126. FIG. 1 further provides a conceptual description of a novel bioinformatically detected viral gene of the present invention, referred to here as Viral Genomic Address Messenger 2377 (VGAM2377) viral gene, which modulates expression of respective host target genes thereof, the function and utility of which host target genes is known in the art.

VGAM2377 is a novel bioinformatically detected regulatory, non protein coding, viral micro RNA (miRNA) gene. The method by which VGAM2377 was detected is described hereinabove with reference to FIGS. 1-8.

VGAM2377 gene, herein designated VGAM GENE, is a viral gene contained in the genome of Rat Cytomegalovirus. VGAM2377 host target gene, herein designated VGAM HOST TARGET GENE, is a human gene contained in the human genome.

VGAM2377 gene encodes a VGAM2377 precursor RNA, herein designated VGAM PRECURSOR RNA. Similar to other miRNA genes, and unlike most ordinary genes, VGAM2377 precursor RNA does not encode a protein. A nucleotide sequence identical or highly similar to the nucleotide sequence of VGAM2377 precursor RNA is designated SEQ ID:2363, and is provided hereinbelow with reference to the sequence listing part. Nucleotide sequence SEQ ID:2363 is located at position 197566 relative to the genome of Rat Cytomegalovirus.

VGAM2377 precursor RNA folds onto itself, forming VGAM2377 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2377 folded precursor RNA into VGAM2377 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 50%) nucleotide sequence of VGAM2377 RNA is designated SEQ ID:5088, and is provided hereinbelow with reference to the sequence listing part.

VGAM2377 host target gene, herein designated VGAM HOST TARGET GENE, encodes a corresponding messenger RNA, VGAM2377 host target RNA, herein designated VGAM HOST TARGET RNA. VGAM2377 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2377 RNA, herein designated VGAM RNA, binds complementarily to one or more host target binding sites located in untranslated regions of VGAM2377 host target RNA, herein designated VGAM HOST TARGET RNA. This complementary binding is due to the fact that the nucleotide sequence of VGAM2377 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2377 RNA, herein designated VGAM RNA, may have a different number of host target binding sites in untranslated regions of a VGAM2377 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2377 RNA, herein designated VGAM RNA, to host target binding sites on VGAM2377 host target RNA, herein designated VGAM HOST TARGET RNA, such as BINDING SITE I, BINDING SITE II and BINDING SITE III, inhibits translation of VGAM2377 host target RNA into VGAM2377 host target protein, herein designated VGAM HOST TARGET PROTEIN. VGAM host target protein is therefore outlined by a broken line.

It is appreciated that VGAM2377 host target gene, herein designated VGAM HOST TARGET GENE, in fact represents a plurality of VGAM2377 host target genes. The mRNA of each one of this plurality of VGAM2377 host target genes comprises one or more host target binding sites, each having a nucleotide sequence which is at least partly complementary to VGAM2377 RNA, herein designated VGAM RNA, and which when bound by VGAM2377 RNA causes inhibition of translation of respective one or more VGAM2377 host target proteins.

It is further appreciated by one skilled in the art that the mode of translational inhibition illustrated by FIG. 1 with specific reference to translational inhibition exerted by VGAM2377 gene, herein designated VGAM GENE, on one or more VGAM2377 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2377 is inhibition of expression of host target genes, as part of a novel viral mechanism of attacking a host. Accordingly, utilities of VGAM2377 include diagnosis, prevention and treatment of viral infection by Rat Cytomegalovirus. Specific functions, and accordingly utilities, of VGAM2377 correlate with, and may be deduced from, the identity of the host target genes which VGAM2377 binds and inhibits, and the function of these host target genes, as elaborated hereinbelow.

Nucleotide sequences of the VGAM2377 precursor RNA, herein designated VGAM PRECURSOR RNA, and of the 'diced' VGAM2377 RNA, herein designated VGAM RNA, and a schematic representation of the secondary folding of VGAM2377 folded precursor RNA, herein designated VGAM FOLDED PRECURSOR RNA, of VGAM2377 are further described hereinbelow with reference to Table 1.

Nucleotide sequences of host target binding sites, such as BINDING SITE-I, BINDING SITE-II and BINDING SITE-III of FIG. 1, found on VGAM2377 host target RNA, and schematic representation of the complementarity of each of these host target binding sites to VGAM2377 RNA, herein designated VGAM RNA, are described hereinbelow with reference to Table 2.

As mentioned hereinabove with reference to FIG. 1, a function of VGAM2377 gene, herein designated VGAM is inhibition of expression of VGAM2377 target genes. It is appreciated that specific functions, and accordingly utilities, of VGAM2377 correlate with, and may be deduced from, the identity of the target genes which VGAM2377 binds and inhibits, and the function of these target genes, as elaborated hereinbelow.

LOC151126 (Accession XM_087103) is a VGAM2377 host target gene. LOC151126 BINDING SITE is HOST TARGET binding site found in the 5' untranslated region of mRNA encoded by LOC151126, corresponding to a HOST TARGET binding site such as BINDING SITE I, BINDING SITE II or BINDING SITE III. Table 2 illustrates the complementarity of the nucleotide sequences of LOC151126 BINDING SITE, designated SEQ ID:39057, to the nucleotide sequence of VGAM2377 RNA, herein designated VGAM RNA, also designated SEQ ID:5088.

A function of VGAM2377 is therefore inhibition of LOC151126 (Accession XM_087103). Accordingly, utilities of VGAM2377 include diagnosis, prevention and treatment of diseases and clinical conditions associated with LOC151126. LOC257407 (Accession XM_173078) is another VGAM2377 host target gene. LOC257407 BINDING SITE is HOST TARGET binding site found in the 5' untranslated region of mRNA encoded by LOC257407, corresponding to a HOST TARGET binding site such as BINDING SITE I, BINDING SITE II or BINDING SITE III. Table 2 illustrates the complementarity of the nucleotide sequences of LOC257407 BINDING SITE, designated SEQ ID:46334, to the nucleotide sequence of VGAM2377 RNA, herein designated VGAM RNA, also designated SEQ ID:5088.

Another function of VGAM2377 is therefore inhibition of LOC257407 (Accession XM_173078). Accordingly, utilities of VGAM2377 include diagnosis, prevention and treatment of diseases and clinical conditions associated with LOC257407. LOC93626 (Accession XM_052635) is another VGAM2377 host target gene. LOC93626 BINDING SITE is HOST TARGET binding site found in the 3' untranslated region of mRNA encoded by LOC93626, corresponding to a HOST TARGET binding site such as BINDING SITE I, BINDING SITE II or BINDING SITE III. Table 2 illustrates the complementarity of the nucleotide sequences of LOC93626 BINDING SITE, designated SEQ ID:36043, to the nucleotide sequence of VGAM2377 RNA, herein designated VGAM RNA, also designated SEQ ID:5088.

Another function of VGAM2377 is therefore inhibition of LOC93626 (Accession XM_052635). Accordingly, utilities of VGAM2377 include diagnosis, prevention and treatment of diseases and clinical conditions associated with LOC93626. FIG. 1 further provides a conceptual description of a novel bioinformatically detected viral gene of the present invention, referred to here as Viral Genomic Address Messenger 2378 (VGAM2378) viral gene, which modulates expression of respective host target genes thereof, the function and utility of which host target genes is known in the art.

VGAM2378 is a novel bioinformatically detected regulatory, non protein coding, viral micro RNA (miRNA) gene. The method by which VGAM2378 was detected is described hereinabove with reference to FIGS. 1-8.

VGAM2378 gene, herein designated VGAM GENE, is a viral gene contained in the genome of Rat Cytomegalovirus. VGAM2378 host target gene, herein designated VGAM HOST TARGET GENE, is a human gene contained in the human genome.

VGAM2378 gene encodes a VGAM2378 precursor RNA, herein designated VGAM PRECURSOR RNA. Similar to other miRNA genes, and unlike most ordinary genes, VGAM2378 precursor RNA does not encode a protein. A nucleotide sequence identical or highly similar to the nucleotide sequence of VGAM2378 precursor RNA is designated SEQ ID:2364, and is provided hereinbelow with reference to the sequence listing part. Nucleotide sequence SEQ ID:2364 is located at position 219131 relative to the genome of Rat Cytomegalovirus.

VGAM2378 precursor RNA folds onto itself, forming VGAM2378 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2378 folded precursor RNA into VGAM2378 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM2378 RNA is designated SEQ ID:5089, and is provided hereinbelow with reference to the sequence listing part.

VGAM2378 host target gene, herein designated VGAM HOST TARGET GENE, encodes a corresponding messenger RNA, VGAM2378 host target RNA, herein designated VGAM HOST TARGET RNA. VGAM2378 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2378 RNA, herein designated VGAM RNA, binds complementarily to one or more host target binding sites located in untranslated regions of VGAM2378 host target RNA, herein designated VGAM HOST TARGET RNA. This complementary binding is due to the fact that the nucleotide sequence of VGAM2378 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2378 RNA, herein designated VGAM RNA, may have a different number of host target binding sites in untranslated regions of a VGAM2378 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2378 RNA, herein designated VGAM RNA, to host target binding sites on VGAM2378 host target RNA, herein designated VGAM HOST TARGET RNA, such as BINDING SITE I, BINDING SITE II and BINDING SITE III, inhibits translation of VGAM2378 host target RNA into VGAM2378 host target protein, herein designated VGAM HOST TARGET PROTEIN. VGAM host target protein is therefore outlined by a broken line.

It is appreciated that VGAM2378 host target gene, herein designated VGAM HOST TARGET GENE, in fact represents a plurality of VGAM2378 host target genes. The mRNA of each one of this plurality of VGAM2378 host target genes comprises one or more host target binding sites, each having a nucleotide sequence which is at least partly complementary to VGAM2378 RNA, herein designated VGAM RNA, and which when bound by VGAM2378 RNA causes inhibition of translation of respective one or more VGAM2378 host target proteins.

It is further appreciated by one skilled in the art that the mode of translational inhibition illustrated by FIG. 1 with specific reference to translational inhibition exerted by VGAM2378 gene, herein designated VGAM GENE, on one or more VGAM2378 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2378 is inhibition of expression of host target genes, as part of a novel viral mechanism of attacking a host. Accordingly, utilities of VGAM2378 include diagnosis, prevention and treatment of viral infection by Rat Cytomegalovirus. Specific functions, and accordingly utilities, of VGAM2378 correlate with, and may be deduced from, the identity of the host target genes which VGAM2378 binds and inhibits, and the function of these host target genes, as elaborated hereinbelow.

Nucleotide sequences of the VGAM2378 precursor RNA, herein designated VGAM PRECURSOR RNA, and of the 'diced' VGAM2378 RNA, herein designated VGAM RNA, and a schematic representation of the secondary folding of VGAM2378 folded precursor RNA, herein designated VGAM FOLDED PRECURSOR RNA, of VGAM2378 are further described hereinbelow with reference to Table 1.

Nucleotide sequences of host target binding sites, such as BINDING SITE-I, BINDING SITE-II and BINDING SITE-III of FIG. 1, found on VGAM2378 host target RNA, and schematic representation of the complementarity of each of these host target binding sites to VGAM2378 RNA, herein designated VGAM RNA, are described hereinbelow with reference to Table 2.

As mentioned hereinabove with reference to FIG. 1, a function of VGAM2378 gene, herein designated VGAM is inhibition of expression of VGAM2378 target genes. It is appreciated that specific functions, and accordingly utilities, of VGAM2378 correlate with, and may be deduced from, the identity of the target genes which VGAM2378 binds and inhibits, and the function of these target genes, as elaborated hereinbelow.

Presenilin 2 (Alzheimer disease 4) (PSEN2, Accession NM_000447) is a VGAM2378 host target gene. PSEN2 BINDING SITE1 and PSEN2 BINDING SITE2 are HOST TARGET binding sites found in untranslated regions of mRNA encoded by PSEN2, corresponding to HOST TARGET binding sites such as BINDING SITE I, BINDING SITE II or BINDING SITE III. Table 2 illustrates the complementarity of the nucleotide sequences of PSEN2 BINDING SITE1 and PSEN2 BINDING SITE2, designated SEQ ID:6035 and SEQ ID:14865 respectively, to the nucleotide sequence of VGAM2378 RNA, herein designated VGAM RNA, also designated SEQ ID:5089.

A function of VGAM2378 is therefore inhibition of Presenilin 2 (Alzheimer disease 4) (PSEN2, Accession NM_000447). Accordingly, utilities of VGAM2378 include diagnosis, prevention and treatment of diseases and clinical conditions associated with PSEN2. Wingless-type MMTV Integration Site Family, Member 5B (WNT5B, Accession NM_032642) is another VGAM2378 host target gene. WNT5B BINDING SITE1 and WNT5B BINDING SITE2 are HOST TARGET binding sites found in untranslated regions of mRNA encoded by WNT5B, corresponding to HOST TARGET binding sites such as BINDING SITE I, BINDING SITE II or BINDING SITE III. Table 2 illustrates the complementarity of the nucleotide sequences of WNT5B BINDING SITE1 and WNT5B BINDING SITE2, designated SEQ ID:26358 and SEQ ID:28693 respectively, to the nucleotide sequence of VGAM2378 RNA, herein designated VGAM RNA, also designated SEQ ID:5089.

Another function of VGAM2378 is therefore inhibition of Wingless-type MMTV Integration Site Family, Member 5B (WNT5B, Accession NM_032642), a gene which is the ligand for members of the frizzled family of seven transmembrane receptors and may be a signaling molecule. Accordingly, utilities of VGAM2378 include diagnosis, prevention and treatment of diseases and clinical conditions associated with WNT5B. The function of WNT5B and its association with various diseases and clinical conditions, has been established by previous studies, as described hereinabove with reference to VGAM1928. KIAA0433 (Accession NM_015216) is another VGAM2378 host target gene. KIAA0433 BINDING SITE is HOST TARGET binding site found in the 3' untranslated region of mRNA encoded by KIAA0433, corresponding to a HOST TARGET binding site such as BINDING SITE I, BINDING SITE II or BINDING SITE III. Table 2 illustrates the complementarity of the nucleotide sequences of KIAA0433 BINDING SITE, designated SEQ ID:17549, to the nucleotide sequence of VGAM2378 RNA, herein designated VGAM RNA, also designated SEQ ID:5089.

Another function of VGAM2378 is therefore inhibition of KIAA0433 (Accession NM_015216). Accordingly, utilities of VGAM2378 include diagnosis, prevention and treatment of diseases and clinical conditions associated with KIAA0433. LOC149606 (Accession XM_086600) is another VGAM2378 host target gene. LOC149606 BINDING SITE is HOST TARGET binding site found in the 5' untranslated region of mRNA encoded by LOC149606, corresponding to a HOST TARGET binding site such as BINDING SITE I, BINDING SITE II or BINDING SITE III. Table 2 illustrates the complementarity of the nucleotide sequences of LOC149606 BINDING SITE, designated SEQ ID:38787, to the nucleotide sequence of VGAM2378 RNA, herein designated VGAM RNA, also designated SEQ ID:5089.

Another function of VGAM2378 is therefore inhibition of LOC149606 (Accession XM_086600). Accordingly, utilities of VGAM2378 include diagnosis, prevention and treatment of diseases and clinical conditions associated with LOC149606. LOC255967 (Accession XM_170737) is another VGAM2378 host target gene. LOC255967 BINDING SITE is HOST TARGET binding site found in the 5' untranslated region of mRNA encoded by LOC255967, corresponding to a HOST TARGET binding site such as BINDING SITE I, BINDING SITE II or BINDING SITE III. Table 2 illustrates the complementarity of the nucleotide sequences of LOC255967 BINDING SITE, designated SEQ ID:45495, to the nucleotide sequence of VGAM2378 RNA, herein designated VGAM RNA, also designated SEQ ID:5089.

Another function of VGAM2378 is therefore inhibition of LOC255967 (Accession XM_170737). Accordingly, utilities of VGAM2378 include diagnosis, prevention and treatment of diseases and clinical conditions associated with LOC255967. LOC84549 (Accession NM_032509) is another VGAM2378 host target gene. LOC84549 BINDING SITE is HOST TARGET binding site found in the 3' untranslated region of mRNA encoded by LOC84549, corresponding to a HOST TARGET binding site such as BINDING SITE I, BINDING SITE II or BINDING SITE III. Table 2 illustrates the complementarity of the nucleotide sequences of LOC84549 BINDING SITE, designated SEQ ID:26262, to the nucleotide sequence of VGAM2378 RNA, herein designated VGAM RNA, also designated SEQ ID:5089.

Another function of VGAM2378 is therefore inhibition of LOC84549 (Accession NM_032509). Accordingly, utilities of VGAM2378 include diagnosis, prevention and treatment of diseases and clinical conditions associated with LOC84549. FIG. 1 further provides a conceptual description of a novel bioinformatically detected viral gene of the present invention, referred to here as Viral Genomic Address Messenger 2379 (VGAM2379) viral gene, which modulates expression of respective host target genes thereof, the function and utility of which host target genes is known in the art.

VGAM2379 is a novel bioinformatically detected regulatory, non protein coding, viral micro RNA (miRNA) gene. The method by which VGAM2379 was detected is described hereinabove with reference to FIGS. 1-8.

VGAM2379 gene, herein designated VGAM GENE, is a viral gene contained in the genome of Rat Cytomegalovirus. VGAM2379 host target gene, herein designated VGAM HOST TARGET GENE, is a human gene contained in the human genome.

VGAM2379 gene encodes a VGAM2379 precursor RNA, herein designated VGAM PRECURSOR RNA. Similar to other miRNA genes, and unlike most ordinary genes, VGAM2379 precursor RNA does not encode a protein. A nucleotide sequence identical or highly similar to the nucleotide sequence of VGAM2379 precursor RNA is designated SEQ ID:2365, and is provided hereinbelow with reference to the sequence listing part. Nucleotide sequence SEQ ID:2365 is located at position 212075 relative to the genome of Rat Cytomegalovirus.

VGAM2379 precursor RNA folds onto itself, forming VGAM2379 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2379 folded precursor RNA into VGAM2379 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM2379 RNA is designated SEQ ID:5090, and is provided hereinbelow with reference to the sequence listing part.

VGAM2379 host target gene, herein designated VGAM HOST TARGET GENE, encodes a corresponding messenger RNA, VGAM2379 host target RNA, herein designated VGAM HOST TARGET RNA. VGAM2379 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2379 RNA, herein designated VGAM RNA, binds complementarily to one or more host target binding sites located in untranslated regions of VGAM2379 host target RNA, herein designated VGAM HOST TARGET RNA. This complementary binding is due to the fact that the nucleotide sequence of VGAM2379 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2379 RNA, herein designated VGAM RNA, may have a different number of host target binding sites in untranslated regions of a VGAM2379 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2379 RNA, herein designated VGAM RNA, to host target binding sites on VGAM2379 host target RNA, herein designated VGAM HOST TARGET RNA, such as BINDING SITE I, BINDING SITE II and BINDING SITE III, inhibits translation of VGAM2379 host target RNA into VGAM2379 host target protein, herein designated VGAM HOST TARGET PROTEIN. VGAM host target protein is therefore outlined by a broken line.

It is appreciated that VGAM2379 host target gene, herein designated VGAM HOST TARGET GENE, in fact represents a plurality of VGAM2379 host target genes. The mRNA of each one of this plurality of VGAM2379 host target genes comprises one or more host target binding sites, each having a nucleotide sequence which is at least partly complementary to VGAM2379 RNA, herein designated VGAM RNA, and which when bound by VGAM2379 RNA causes inhibition of translation of respective one or more VGAM2379 host target proteins.

It is further appreciated by one skilled in the art that the mode of translational inhibition illustrated by FIG. 1 with specific reference to translational inhibition exerted by VGAM2379 gene, herein designated VGAM GENE, on one or more VGAM2379 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2379 is inhibition of expression of host target genes, as part of a novel viral mechanism of attacking a host. Accordingly, utilities of VGAM2379 include diagnosis, prevention and treatment of viral infection by Rat Cytomegalovirus. Specific functions, and accordingly utilities, of VGAM2379 correlate with, and may be deduced from, the identity of the host target genes which VGAM2379 binds and inhibits, and the function of these host target genes, as elaborated hereinbelow.

Nucleotide sequences of the VGAM2379 precursor RNA, herein designated VGAM PRECURSOR RNA, and of the 'diced' VGAM2379 RNA, herein designated VGAM RNA, and a schematic representation of the secondary folding of VGAM2379 folded precursor RNA, herein designated VGAM FOLDED PRECURSOR RNA, of VGAM2379 are further described hereinbelow with reference to Table 1.

Nucleotide sequences of host target binding sites, such as BINDING SITE-I, BINDING SITE-II and BINDING SITE-III of FIG. 1, found on VGAM2379 host target RNA, and schematic representation of the complementarity of each of these host target binding sites to VGAM2379 RNA, herein designated VGAM RNA, are described hereinbelow with reference to Table 2.

As mentioned hereinabove with reference to FIG. 1, a function of VGAM2379 gene, herein designated VGAM is inhibition of expression of VGAM2379 target genes. It is appreciated that specific functions, and accordingly utilities, of VGAM2379 correlate with, and may be deduced from, the identity of the target genes which VGAM2379 binds and inhibits, and the function of these target genes, as elaborated hereinbelow.

ATP-binding Cassette, Sub-family B (MDR/TAP), Member 11 (ABCB11, Accession NM_003742) is a VGAM2379 host target gene. ABCB11 BINDING SITE is HOST TARGET binding site found in the 3' untranslated region of mRNA encoded by ABCB11, corresponding to a HOST TARGET binding site such as BINDING SITE I, BINDING SITE II or BINDING SITE III. Table 2 illustrates the complementarity of the nucleotide sequences of ABCB11 BINDING SITE, designated SEQ ID:9830, to the nucleotide sequence of VGAM2379 RNA, herein designated VGAM RNA, also designated SEQ ID:5090.

A function of VGAM2379 is therefore inhibition of ATP-binding Cassette, Sub-family B (MDR/TAP), Member 11 (ABCB11, Accession NM_003742). Accordingly, utilities of VGAM2379 include diagnosis, prevention and treatment of diseases and clinical conditions associated with ABCB11. ADP-ribosylation Factor 1 (ARF1, Accession XM_047545) is another VGAM2379 host target gene. ARF1 BINDING SITE is HOST TARGET binding site found in the 3' untranslated region of mRNA encoded by ARF1, corresponding to a HOST TARGET binding site such as BINDING SITE I, BINDING SITE II or BINDING SITE III. Table 2 illustrates the complementarity of the nucleotide sequences of ARF1 BINDING SITE, designated SEQ ID:34993, to the nucleotide sequence of VGAM2379 RNA, herein designated VGAM RNA, also designated SEQ ID:5090.

Another function of VGAM2379 is therefore inhibition of ADP-ribosylation Factor 1 (ARF1, Accession XM_047545). Accordingly, utilities of VGAM2379 include diagnosis, prevention and treatment of diseases and clinical conditions associated with ARF1. Rho Guanine Nucleotide Exchange Factor (GEF) 7 (ARHGEF7, Accession NM_003899) is another VGAM2379 host target gene. ARHGEF7 BINDING SITE is HOST TARGET binding site found in the 3' untranslated region of mRNA encoded by ARHGEF7, corresponding to a HOST TARGET binding site such as BINDING SITE I, BINDING SITE II or BINDING SITE III. Table 2 illustrates the complementarity of the nucleotide sequences of ARHGEF7 BINDING SITE, designated SEQ ID:9982, to the nucleotide sequence of VGAM2379 RNA, herein designated VGAM RNA, also designated SEQ ID:5090.

Another function of VGAM2379 is therefore inhibition of Rho Guanine Nucleotide Exchange Factor (GEF) 7 (ARHGEF7, Accession NM_003899), a gene which acts as a rac1 guanine nucleotide exchange factor (gef) and can induce membrane ruffling. Accordingly, utilities of VGAM2379 include diagnosis, prevention and treatment of diseases and clinical conditions associated with ARHGEF7. The function of ARHGEF7 and its association with various diseases and clinical conditions, has been established by previous studies, as described hereinabove with reference to VGAM297. ATPase, Class VI, Type 11A (ATP11A, Accession XM_085028) is another VGAM2379 host target gene. ATP11A BINDING SITE is HOST TARGET binding site found in the 3' untranslated region of mRNA encoded by ATP11A, corresponding to a HOST TARGET binding site such as BINDING SITE I, BINDING SITE II or BINDING SITE III. Table 2 illustrates the complementarity of the nucleotide sequences of ATP11A BINDING SITE, designated SEQ ID:37805, to the nucleotide sequence of VGAM2379 RNA, herein designated VGAM RNA, also designated SEQ ID:5090.

Another function of VGAM2379 is therefore inhibition of ATPase, Class VI, Type 11A (ATP11A, Accession XM_085028). Accordingly, utilities of VGAM2379 include diagnosis, prevention and treatment of diseases and clinical conditions associated with ATP11A. B-cell CLL/lymphoma 2 (BCL2, Accession NM_000633) is another VGAM2379 host target gene. BCL2 BINDING SITE is HOST TARGET binding site found in the 3' untranslated region of mRNA encoded by BCL2, corresponding to a HOST TARGET binding site such as BINDING SITE I, BINDING SITE II or BINDING SITE III. Table 2 illustrates the complementarity of the nucleotide sequences of BCL2 BINDING SITE, designated SEQ ID:6263, to the nucleotide sequence of VGAM2379 RNA, herein designated VGAM RNA, also designated SEQ ID:5090.

Another function of VGAM2379 is therefore inhibition of B-cell CLL/lymphoma 2 (BCL2, Accession NM_000633). Accordingly, utilities of VGAM2379 include diagnosis, prevention and treatment of diseases and clinical conditions associated with BCL2. Chemokine (C-X-C motif) Ligand 16 (CXCL16, Accession NM_022059) is another VGAM2379 host target gene. CXCL16 BINDING SITE is HOST TARGET binding site found in the 3' untranslated region of mRNA encoded by CXCL16, corresponding to a HOST TARGET binding site such as BINDING SITE I, BINDING SITE II or BINDING SITE III. Table 2 illustrates the complementarity of the nucleotide sequences of CXCL16 BINDING SITE, designated SEQ ID:22601, to the nucleotide sequence of VGAM2379 RNA, herein designated VGAM RNA, also designated SEQ ID:5090.

Another function of VGAM2379 is therefore inhibition of Chemokine (C-X-C motif) Ligand 16 (CXCL16, Accession NM_022059), a gene which induces calcium mobilization. Accordingly, utilities of VGAM2379 include diagnosis, prevention and treatment of diseases and clinical conditions associated with CXCL16. The function of CXCL16 and its association with various diseases and clinical conditions, has been established by previous studies, as described hereinabove with reference to VGAM1845. E2F Transcription Factor 3 (E2F3, Accession NM_001949) is another VGAM2379 host target gene. E2F3 BINDING SITE is HOST TARGET binding site found in the 3' untranslated region of mRNA encoded by E2F3, corresponding to a HOST TARGET binding site such as BINDING SITE I, BINDING SITE II or BINDING SITE III. Table 2 illustrates the complementarity of the nucleotide sequences of E2F3 BINDING SITE, designated SEQ ID:7671, to the nucleotide sequence of VGAM2379 RNA, herein designated VGAM RNA, also designated SEQ ID:5090.

Another function of VGAM2379 is therefore inhibition of E2F Transcription Factor 3 (E2F3, Accession NM_001949), a gene which binds dna and controls cell-cycle progression from g1 to s phase. Accordingly, utilities of VGAM2379 include diagnosis, prevention and treatment of diseases and clinical conditions associated with E2F3. The function of E2F3 and its association with various diseases and clinical conditions, has been established by previous studies, as described hereinabove with reference to VGAM475. Frizzled Homolog 4 (Drosophila) (FZD4, Accession NM_012193) is another VGAM2379 host target gene. FZD4 BINDING SITE is HOST TARGET binding site found in the 3' untranslated region of mRNA encoded by FZD4, corresponding to a HOST TARGET binding site such as BINDING SITE I, BINDING SITE II or BINDING SITE III. Table 2 illustrates the complementarity of the nucleotide sequences of FZD4 BINDING SITE, designated SEQ ID:14488, to the nucleotide sequence of VGAM2379 RNA, herein designated VGAM RNA, also designated SEQ ID:5090.

Another function of VGAM2379 is therefore inhibition of Frizzled Homolog 4 (Drosophila) (FZD4, Accession NM_012193), a gene which may function in cell polarity, cell fate specification and cancer; similar to frizzled receptor family, has seven transmembrane domains. Accordingly, utilities of VGAM2379 include diagnosis, prevention and treatment of diseases and clinical conditions associated with FZD4. The function of FZD4 and its association with various diseases and clinical conditions, has been established by previous studies, as described hereinabove with reference to VGAM309. 5-hydroxytryptamine (serotonin) Receptor 4 (HTR4, Accession NM_000870) is another VGAM2379 host target gene. HTR4 BINDING SITE is HOST TARGET binding site found in the 3' untranslated region of mRNA encoded by HTR4, corresponding to a HOST TARGET binding site such as BINDING SITE I, BINDING SITE II or BINDING SITE III. Table 2 illustrates the complementarity of the nucleotide sequences of HTR4 BINDING SITE, designated SEQ ID:6545, to the nucleotide sequence of VGAM2379 RNA, herein designated VGAM RNA, also designated SEQ ID:5090.

Another function of VGAM2379 is therefore inhibition of 5-hydroxytryptamine (serotonin) Receptor 4 (HTR4, Accession NM_000870), a gene which mediates calcium channel currents. Accordingly, utilities of VGAM2379 include diagnosis, prevention and treatment of diseases and clinical conditions associated with HTR4. The function of HTR4 and its association with various diseases and clinical conditions, has been established by previous studies, as described hereinabove with reference to VGAM65. Integrin, Alpha 6 (ITGA6, Accession NM_000210) is another VGAM2379 host target gene. ITGA6 BINDING SITE is HOST TARGET binding site found in the 3' untranslated region of mRNA encoded by ITGA6, corresponding to a HOST TARGET binding site such as BINDING SITE I, BINDING SITE II or BINDING SITE III. Table 2 illustrates the complementarity of the nucleotide sequences of ITGA6 BINDING SITE, designated SEQ ID:5704, to the nucleotide sequence of VGAM2379 RNA, herein designated VGAM RNA, also designated SEQ ID:5090.

Another function of VGAM2379 is therefore inhibition of Integrin, Alpha 6 (ITGA6, Accession NM_000210). Accordingly, utilities of VGAM2379 include diagnosis, prevention and treatment of diseases and clinical conditions associated with ITGA6. Microtubule-associated Protein 2 (MAP2, Accession NM_031846) is another VGAM2379 host target gene. MAP2 BINDING SITE is HOST TARGET binding site found in the 3' untranslated region of mRNA encoded by MAP2, corresponding to a HOST TARGET binding site such as BINDING SITE I, BINDING SITE II or BINDING SITE III. Table 2 illustrates the complementarity of the nucleotide sequences of MAP2 BINDING SITE, designated SEQ ID:25582, to the nucleotide sequence of VGAM2379 RNA, herein designated VGAM RNA, also designated SEQ ID:5090.

Another function of VGAM2379 is therefore inhibition of Microtubule-associated Protein 2 (MAP2, Accession NM_031846), a gene which may act in stabilizing microtubules against depolymerization. Also seems to have a stiffening effect on microtubules. Accordingly, utilities of VGAM2379 include diagnosis, prevention and treatment of diseases and clinical conditions associated with MAP2. The function of MAP2 and its association with various diseases and clinical conditions, has been established by previous studies, as described hereinabove with reference to VGAM1958. C-myc Binding Protein (MYCBP, Accession NM_012333) is another VGAM2379 host target gene. MYCBP BINDING SITE is HOST TARGET binding site found in the 3' untranslated region of mRNA encoded by MYCBP, corresponding to a HOST TARGET binding site such as BINDING SITE I, BINDING SITE II or BINDING SITE III. Table 2 illustrates the complementarity of the nucleotide sequences of MYCBP BINDING SITE, designated SEQ ID:14727, to the nucleotide sequence of VGAM2379 RNA, herein designated VGAM RNA, also designated SEQ ID:5090.

Another function of VGAM2379 is therefore inhibition of C-myc Binding Protein (MYCBP, Accession NM_012333), a gene which binds c-Myc stimulating the activation of E-box-dependent transcription. Accordingly, utilities of VGAM2379 include diagnosis, prevention and treatment of diseases and clinical conditions associated with MYCBP. The function of MYCBP and its association with various diseases and clinical conditions, has been established by previous studies, as described hereinabove with reference to VGAM435. RNA Guanylyltransferase and 5'-phosphatase (RNGTT, Accession NM_003800) is another VGAM2379 host target gene. RNGTT BINDING SITE is HOST TARGET binding site found in the 3" untranslated region of mRNA encoded by RNGTT, corresponding to a HOST TARGET binding site such as BINDING SITE I, BINDING SITE II or BINDING SITE III. Table 2 illustrates the complementarity of the nucleotide sequences of RNGTT BINDING SITE, designated SEQ ID:9897, to the nucleotide sequence of VGAM2379 RNA, herein designated VGAM RNA, also designated SEQ ID:5090.

Another function of VGAM2379 is therefore inhibition of RNA Guanylyltransferase and 5'-phosphatase (RNGTT, Accession NM_003800), a gene which is an MRNA capping enzyme; bifunctional enzyme containing both 5'-triphosphatase and mRNA guanylyltransferase activity. Accordingly, utilities of VGAM2379 include diagnosis, prevention and treatment of diseases and clinical conditions associated with RNGTT. The function of RNGTT and its association with various diseases and clinical conditions, has been established by previous studies, as described hereinabove with reference to VGAM292. Splicing Factor, Arginine/serine-rich 1 (splicing factor 2, alternate splicing factor) (SFRS1, Accession NM_006924) is another VGAM2379 host target gene. SFRS1 BINDING SITE is HOST TARGET binding site found in the 3' untranslated region of mRNA encoded by SFRS1, corresponding to a HOST TARGET binding site such as BINDING SITE I, BINDING SITE II or BINDING SITE III. Table 2 illustrates the complementarity of the nucleotide sequences of SFRS1 BINDING SITE, designated SEQ ID:13802, to the nucleotide sequence of VGAM2379 RNA, herein designated VGAM RNA, also designated SEQ ID:5090.

Another function of VGAM2379 is therefore inhibition of Splicing Factor, Arginine/serine-rich 1 (splicing factor 2, alternate splicing factor) (SFRS1, Accession NM_006924), a gene which plays an essential role in pre-mRNA splicing. Accordingly, utilities of VGAM2379 include diagnosis, prevention and treatment of diseases and clinical conditions associated with SFRS1. The function of SFRS1 and its association with various diseases and clinical conditions, has been established by previous studies, as described hereinabove with reference to VGAM323. Solute Carrier Family 17 (sodium phosphate), Member 4 (SLC17A4, Accession NM_005495) is another VGAM2379 host target gene. SLC17A4 BINDING SITE is HOST TARGET binding site found in the 3' untranslated region of mRNA encoded by SLC17A4, corresponding to a HOST TARGET binding site such as BINDING SITE I, BINDING SITE II or BINDING SITE III. Table 2 illustrates the complementarity of the nucleotide sequences of SLC17A4 BINDING SITE, designated SEQ ID:12000, to the nucleotide sequence of VGAM2379 RNA, herein designated VGAM RNA, also designated SEQ ID:5090.

Another function of VGAM2379 is therefore inhibition of Solute Carrier Family 17 (sodium phosphate), Member 4 (SLC17A4, Accession NM_005495). Accordingly, utilities of VGAM2379 include diagnosis, prevention and treatment of diseases and clinical conditions associated with SLC17A4. Solute Carrier Family 21 (organic anion transporter), Member 3 (SLC21A3, Accession NM_134431) is another VGAM2379 host target gene. SLC21A3 BINDING SITE is HOST TARGET binding site found in the 5' untranslated region of mRNA encoded by SLC21A3, corresponding to a HOST TARGET binding site such as BINDING SITE I, BINDING SITE II or BINDING SITE III. Table 2 illustrates the complementarity of the nucleotide sequences of SLC21A3 BINDING SITE, designated SEQ ID:28674, to the nucleotide sequence of VGAM2379 RNA, herein designated VGAM RNA, also designated SEQ ID:5090.

Another function of VGAM2379 is therefore inhibition of Solute Carrier Family 21 (organic anion transporter), Member 3 (SLC21A3, Accession NM_134431), a gene which mediates the na (+)-independent transport of organic anions such as bsp and conjugated (taurocholate) and unconjugated (cholate) bile acids. Accordingly, utilities of VGAM2379 include diagnosis, prevention and treatment of diseases and clinical conditions associated with SLC21A3. The function of SLC21A3 and its association with various diseases and clinical conditions, has been established by previous studies, as described hereinabove with reference to VGAM1965. SRY (sex determining region Y)-box 13 (SOX13, Accession NM_005686) is another VGAM2379 host target gene. SOX13 BINDING SITE is HOST TARGET binding site found in the 3' untranslated region of mRNA encoded by SOX13, corresponding to a HOST TARGET binding site such as BINDING SITE I, BINDING SITE II or BINDING SITE III. Table 2 illustrates the complementarity of the nucleotide sequences of SOX13 BINDING SITE, designated SEQ ID:12245, to the nucleotide sequence of VGAM2379 RNA, herein designated VGAM RNA, also designated SEQ ID:5090.

Another function of VGAM2379 is therefore inhibition of SRY (sex determining region Y)-box 13 (SOX13, Accession NM_005686). Accordingly, utilities of VGAM2379 include diagnosis, prevention and treatment of diseases and clinical conditions associated with SOX13. Adaptor-related Protein Complex 4, Sigma 1 Subunit (AP4S1, Accession NM_007077) is another VGAM2379 host target gene. AP4S1 BINDING SITE is HOST TARGET binding site found in the 3' untranslated region of mRNA encoded by AP4S1, corresponding to a HOST TARGET binding site such as BIND- ING SITE I, BINDING SITE II or BINDING SITE III. Table 2 illustrates the complementarity of the nucleotide sequences of AP4S1 BINDING SITE, designated SEQ ID:13943, to the nucleotide sequence of VGAM2379 RNA, herein designated VGAM RNA, also designated SEQ ID:5090.

Another function of VGAM2379 is therefore inhibition of Adaptor-related Protein Complex 4, Sigma 1 Subunit (AP4S1, Accession NM_007077). Accordingly, utilities of VGAM2379 include diagnosis, prevention and treatment of diseases and clinical conditions associated with AP4S1. Chromosome 5 Open Reading Frame 5 (C5orf5, Accession NM_016603) is another VGAM2379 host target gene. C5orf5 BINDING SITE is HOST TARGET binding site found in the 3' untranslated region of mRNA encoded by C5orf5, corresponding to a HOST TARGET binding site such as BINDING SITE I, BINDING SITE II or BINDING SITE III. Table 2 illustrates the complementarity of the nucleotide sequences of C5orf5 BINDING SITE, designated SEQ ID:18697, to the nucleotide sequence of VGAM2379 RNA, herein designated VGAM RNA, also designated SEQ ID:5090.

Another function of VGAM2379 is therefore inhibition of Chromosome 5 Open Reading Frame 5 (C5orf5, Accession NM_016603). Accordingly, utilities of VGAM2379 include diagnosis, prevention and treatment of diseases and clinical conditions associated with C5orf5. CGG Triplet Repeat Binding Protein 1 (CGGBP1, Accession NM_003663) is another VGAM2379 host target gene. CGGBP1 BINDING SITE is HOST TARGET binding site found in the 3' untranslated region of mRNA encoded by CGGBP1, corresponding to a HOST TARGET binding site such as BINDING SITE I, BINDING SITE II or BINDING SITE III. Table 2 illustrates the complementarity of the nucleotide sequences of CGGBP1 BINDING SITE, designated SEQ ID:9741, to the nucleotide sequence of VGAM2379 RNA, herein designated VGAM RNA, also designated SEQ ID:5090.

Another function of VGAM2379 is therefore inhibition of CGG Triplet Repeat Binding Protein 1 (CGGBP1, Accession NM_003663). Accordingly, utilities of VGAM2379 include diagnosis, prevention and treatment of diseases and clinical conditions associated with CGGBP1. CMG2 (Accession NM_058172) is another VGAM2379 host target gene. CMG2 BINDING SITE is HOST TARGET binding site found in the 3' untranslated region of mRNA encoded by CMG2, corresponding to a HOST TARGET binding site such as BINDING SITE I, BINDING SITE II or BINDING SITE III. Table 2 illustrates the complementarity of the nucleotide sequences of CMG2 BINDING SITE, designated SEQ ID:27718, to the nucleotide sequence of VGAM2379 RNA, herein designated VGAM RNA, also designated SEQ ID:5090.

Another function of VGAM2379 is therefore inhibition of CMG2 (Accession NM_058172). Accordingly, utilities of VGAM2379 include diagnosis, prevention and treatment of diseases and clinical conditions associated with CMG2. DKFZP727C091 (Accession XM_038689) is another VGAM2379 host target gene. DKFZP727C091 BINDING SITE is HOST TARGET binding site found in the 3' untranslated region of mRNA encoded by DKFZP727C091, corresponding to a HOST TARGET binding site such as BINDING SITE I, BINDING SITE II or BINDING SITE III. Table 2 illustrates the complementarity of the nucleotide sequences of DKFZP727C091 BINDING SITE, designated SEQ ID:32904, to the nucleotide sequence of VGAM2379 RNA, herein designated VGAM RNA, also designated SEQ ID:5090.

Another function of VGAM2379 is therefore inhibition of DKFZP727C091 (Accession XM_038689). Accordingly, utilities of VGAM2379 include diagnosis, prevention and treatment of diseases and clinical conditions associated with DKFZP727C091. ELKS (Accession NM_015064) is another VGAM2379 host target gene. ELKS BINDING SITE is HOST TARGET binding site found in the 3' untranslated region of mRNA encoded by ELKS, corresponding to a HOST TARGET binding site such as BINDING SITE I, BINDING SITE II or BINDING SITE III. Table 2 illustrates the complementarity of the nucleotide sequences of ELKS BINDING SITE, designated SEQ ID:17420, to the nucleotide sequence of VGAM2379 RNA, herein designated VGAM RNA, also designated SEQ ID:5090.

Another function of VGAM2379 is therefore inhibition of ELKS (Accession NM_015064). Accordingly, utilities of VGAM2379 include diagnosis, prevention and treatment of diseases and clinical conditions associated with ELKS. KIAA0179 (Accession XM_035973) is another VGAM2379 host target gene. KIAA0179 BINDING SITE is HOST TARGET binding site found in the 3" untranslated region of mRNA encoded by KIAA0179, corresponding to a HOST TARGET binding site such as BINDING SITE I, BINDING SITE II or BINDING SITE III. Table 2 illustrates the complementarity of the nucleotide sequences of KIAA0179 BINDING SITE, designated SEQ ID:32367, to the nucleotide sequence of VGAM2379 RNA, herein designated VGAM RNA, also designated SEQ ID:5090.

Another function of VGAM2379 is therefore inhibition of KIAA0179 (Accession XM_035973). Accordingly, utilities of VGAM2379 include diagnosis, prevention and treatment of diseases and clinical conditions associated with KIAA0179. KIAA0265 (Accession XM_045954) is another VGAM2379 host target gene. KIAA0265 BINDING SITE is HOST TARGET binding site found in the 3' untranslated region of mRNA encoded by KIAA0265, corresponding to a HOST TARGET binding site such as BINDING SITE I, BINDING SITE II or BINDING SITE III. Table 2 illustrates the complementarity of the nucleotide sequences of KIAA0265 BINDING SITE, designated SEQ ID:34629, to the nucleotide sequence of VGAM2379 RNA, herein designated VGAM RNA, also designated SEQ ID:5090.

Another function of VGAM2379 is therefore inhibition of KIAA0265 (Accession XM_045954). Accordingly, utilities of VGAM2379 include diagnosis, prevention and treatment of diseases and clinical conditions associated with KIAA0265. KIAA0323 (Accession XM_032634) is another VGAM2379 host target gene. KIAA0323 BINDING SITE is HOST TARGET binding site found in the 3' untranslated region of mRNA encoded by KIAA0323, corresponding to a HOST TARGET binding site such as BINDING SITE I, BINDING SITE II or BINDING SITE III. Table 2 illustrates the complementarity of the nucleotide sequences of KIAA0323 BINDING SITE, designated SEQ ID:31697, to the nucleotide sequence of VGAM2379 RNA, herein designated VGAM RNA, also designated SEQ ID:5090.

Another function of VGAM2379 is therefore inhibition of KIAA0323 (Accession XM_032634). Accordingly, utilities of VGAM2379 include diagnosis, prevention and treatment of diseases and clinical conditions associated with KIAA0323. KIAA0352 (Accession NM_014830) is another VGAM2379 host target gene. KIAA0352 BINDING SITE is HOST TARGET binding site found in the 3' untranslated region of mRNA encoded by KIAA0352, corresponding to a HOST TARGET binding site such as BINDING SITE I, BINDING SITE II or BINDING SITE III. Table 2 illustrates the complementarity of the nucleotide sequences of KIAA0352 BINDING SITE, designated SEQ ID:16824, to the nucleotide sequence of VGAM2379 RNA, herein designated VGAM RNA, also designated SEQ ID:5090.

Another function of VGAM2379 is therefore inhibition of KIAA0352 (Accession NM_014830). Accordingly, utilities of VGAM2379 include diagnosis, prevention and treatment of diseases and clinical conditions associated with KIAA0352. KIAA1163 (Accession XM_086231) is another VGAM2379 host target gene. KIAA1163 BINDING SITE is HOST TARGET binding site found in the 3' untranslated region of mRNA encoded by KIAA1163, corresponding to a HOST TARGET binding site such as BINDING SITE I, BINDING SITE II or BINDING SITE III. Table 2 illustrates the complementarity of the nucleotide sequences of KIAA1163 BINDING SITE, designated SEQ ID:38557, to the nucleotide sequence of VGAM2379 RNA, herein designated VGAM RNA, also designated SEQ ID:5090.

Another function of VGAM2379 is therefore inhibition of KIAA1163 (Accession XM_086231). Accordingly, utilities of VGAM2379 include diagnosis, prevention and treatment of diseases and clinical conditions associated with KIAA1163. MGC20235 (Accession NM_145041) is another VGAM2379 host target gene. MGC20235 BINDING SITE is HOST TARGET binding site found in the 3' untranslated region of mRNA encoded by MGC20235, corresponding to a HOST TARGET binding site such as BINDING SITE I, BINDING SITE II or BINDING SITE III. Table 2 illustrates the complementarity of the nucleotide sequences of MGC20235 BINDING SITE, designated SEQ ID:29670, to the nucleotide sequence of VGAM2379 RNA, herein designated VGAM RNA, also designated SEQ ID:5090.

Another function of VGAM2379 is therefore inhibition of MGC20235 (Accession NM_145041). Accordingly, utilities of VGAM2379 include diagnosis, prevention and treatment of diseases and clinical conditions associated with MGC20235. MGC4677 (Accession NM_052871) is another VGAM2379 host target gene. MGC4677 BINDING SITE is HOST TARGET binding site found in the 5' untranslated region of mRNA encoded by MGC4677, corresponding to a HOST TARGET binding site such as BINDING SITE I, BINDING SITE II or BINDING SITE III. Table 2 illustrates the complementarity of the nucleotide sequences of MGC4677 BINDING SITE, designated SEQ ID:27451, to the nucleotide sequence of VGAM2379 RNA, herein designated VGAM RNA, also designated SEQ ID:5090.

Another function of VGAM2379 is therefore inhibition of MGC4677 (Accession NM_052871). Accordingly, utilities of VGAM2379 include diagnosis, prevention and treatment of diseases and clinical conditions associated with MGC4677. NECL1 (Accession NM_021189) is another VGAM2379 host target gene. NECL1 BINDING SITE is HOST TARGET binding site found in the 3' untranslated region of mRNA encoded by NECL1, corresponding to a HOST TARGET binding site such as BINDING SITE I, BINDING SITE II or BINDING SITE III. Table 2 illustrates the complementarity of the nucleotide sequences of NECL1 BINDING SITE, designated SEQ ID:22166, to the nucleotide sequence of VGAM2379 RNA, herein designated VGAM RNA, also designated SEQ ID:5090.

Another function of VGAM2379 is therefore inhibition of NECL1 (Accession NM_021189). Accordingly, utilities of VGAM2379 include diagnosis, prevention and treatment of diseases and clinical conditions associated with NECL1. Placenta-specific 3 (PLAC3, Accession XM_045115) is another VGAM2379 host target gene. PLAC3 BINDING SITE is HOST TARGET binding site found in the 5' untranslated region of mRNA encoded by PLAC3, corresponding to a HOST TARGET binding site such as BINDING SITE I, BINDING SITE II or BINDING SITE III. Table 2 illustrates the complementarity of the nucleotide sequences of PLAC3 BINDING SITE, designated SEQ ID:34368, to the nucleotide sequence of VGAM2379 RNA, herein designated VGAM RNA, also designated SEQ ID:5090.

Another function of VGAM2379 is therefore inhibition of Placenta-specific 3 (PLAC3, Accession XM_045115). Accordingly, utilities of VGAM2379 include diagnosis, prevention and treatment of diseases and clinical conditions associated with PLAC3. LOC149603 (Accession XM_047499) is another VGAM2379 host target gene. LOC149603 BINDING SITE is HOST TARGET binding site found in the 3' untranslated region of mRNA encoded by LOC149603, corresponding to a HOST TARGET binding site such as BINDING SITE I, BINDING SITE II or BINDING SITE III. Table 2 illustrates the complementarity of the nucleotide sequences of LOC149603 BINDING SITE, designated SEQ ID:34972, to the nucleotide sequence of VGAM2379 RNA, herein designated VGAM RNA, also designated SEQ ID:5090.

Another function of VGAM2379 is therefore inhibition of LOC149603 (Accession XM_047499). Accordingly, utilities of VGAM2379 include diagnosis, prevention and treatment of diseases and clinical conditions associated with LOC149603. LOC152445 (Accession XM_098231) is another VGAM2379 host target gene. LOC152445 BINDING SITE is HOST TARGET binding site found in the 3' untranslated region of mRNA encoded by LOC152445, corresponding to a HOST TARGET binding site such as BINDING SITE I, BINDING SITE II or BINDING SITE III. Table 2 illustrates the complementarity of the nucleotide sequences of LOC152445 BINDING SITE, designated SEQ ID:41511, to the nucleotide sequence of VGAM2379 RNA, herein designated VGAM RNA, also designated SEQ ID:5090.

Another function of VGAM2379 is therefore inhibition of LOC152445 (Accession XM_098231). Accordingly, utilities of VGAM2379 include diagnosis, prevention and treatment of diseases and clinical conditions associated with LOC152445. LOC199992 (Accession XM_114082) is another VGAM2379 host target gene. LOC199992 BINDING SITE is HOST TARGET binding site found in the 5' untranslated region of mRNA encoded by LOC199992, corresponding to a HOST TARGET binding site such as BINDING SITE I, BINDING SITE II or BINDING SITE III. Table 2 illustrates the complementarity of the nucleotide sequences of LOC199992 BINDING SITE, designated SEQ ID:42678, to the nucleotide sequence of VGAM2379 RNA, herein designated VGAM RNA, also designated SEQ ID:5090.

Another function of VGAM2379 is therefore inhibition of LOC199992 (Accession XM_114082). Accordingly, utilities of VGAM2379 include diagnosis, prevention and treatment of diseases and clinical conditions associated with LOC199992. LOC90462 (Accession XM_031852) is another VGAM2379 host target gene. LOC90462 BINDING SITE is HOST TARGET binding site found in the 3' untranslated region of mRNA encoded by LOC90462, corresponding to a HOST TARGET binding site such as BINDING SITE I, BINDING SITE II or BINDING SITE III. Table 2 illustrates the complementarity of the nucleotide sequences of LOC90462 BINDING SITE, designated SEQ ID:31504, to the nucleotide sequence of VGAM2379 RNA, herein designated VGAM RNA, also designated SEQ ID:5090.

Another function of VGAM2379 is therefore inhibition of LOC90462 (Accession XM_031852). Accordingly, utilities of VGAM2379 include diagnosis, prevention and treatment of diseases and clinical conditions associated with LOC90462. LOC91496 (Accession XM_038788) is another VGAM2379 host target gene. LOC91496 BINDING SITE is HOST TARGET binding site found in the 5' untranslated region of mRNA encoded by LOC91496, corresponding to a HOST TARGET binding site such as BINDING SITE I, BINDING SITE II or BINDING SITE III. Table 2 illustrates the complementarity of the nucleotide sequences of LOC91496 BINDING SITE, designated SEQ ID:32916, to the nucleotide sequence of VGAM2379 RNA, herein designated VGAM RNA, also designated SEQ ID:5090.

Another function of VGAM2379 is therefore inhibition of LOC91496 (Accession XM_038788). Accordingly, utilities of VGAM2379 include diagnosis, prevention and treatment of diseases and clinical conditions associated with LOC91496. FIG. 1 further provides a conceptual description of a novel bioinformatically detected viral gene of the present invention, referred to here as Viral Genomic Address Messenger 2380 (VGAM2380) viral gene, which modulates expression of respective host target genes thereof, the function and utility of which host target genes is known in the art.

VGAM2380 is a novel bioinformatically detected regulatory, non protein coding, viral micro RNA (miRNA) gene. The method by which VGAM2380 was detected is described hereinabove with reference to FIGS. 1-8.

VGAM2380 gene, herein designated VGAM GENE, is a viral gene contained in the genome of Human Herpesvirus 4. VGAM2380 host target gene, herein designated VGAM HOST TARGET GENE, is a human gene contained in the human genome.

VGAM2380 gene encodes a VGAM2380 precursor RNA, herein designated VGAM PRECURSOR RNA. Similar to other miRNA genes, and unlike most ordinary genes, VGAM2380 precursor RNA does not encode a protein. A nucleotide sequence identical or highly similar to the nucleotide sequence of VGAM2380 precursor RNA is designated SEQ ID:2366, and is provided hereinbelow with reference to the sequence listing part. Nucleotide sequence SEQ ID:2366 is located at position 7588 relative to the genome of Human Herpesvirus 4.

VGAM2380 precursor RNA folds onto itself, forming VGAM2380 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2380 folded precursor RNA into VGAM2380 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 91%) nucleotide sequence of VGAM2380 RNA is designated SEQ ID:5091, and is provided hereinbelow with reference to the sequence listing part.

VGAM2380 host target gene, herein designated VGAM HOST TARGET GENE, encodes a corresponding messenger RNA, VGAM2380 host target RNA, herein designated VGAM HOST TARGET RNA. VGAM2380 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2380 RNA, herein designated VGAM RNA, binds complementarily to one or more host target binding sites located in untranslated regions of VGAM2380 host target RNA, herein designated VGAM HOST TARGET RNA. This complementary binding is due to the fact that the nucleotide sequence of VGAM2380 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2380 RNA, herein designated VGAM RNA, may have a different number of host target binding sites in untranslated regions of a VGAM2380 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2380 RNA, herein designated VGAM RNA, to host target binding sites on VGAM2380 host target RNA, herein designated VGAM HOST TARGET RNA, such as BINDING SITE I, BINDING SITE II and BINDING SITE III, inhibits translation of VGAM2380 host target RNA into VGAM2380 host target protein, herein designated VGAM HOST TARGET PROTEIN. VGAM host target protein is therefore outlined by a broken line.

It is appreciated that VGAM2380 host target gene, herein designated VGAM HOST TARGET GENE, in fact represents a plurality of VGAM2380 host target genes. The mRNA of each one of this plurality of VGAM2380 host target genes comprises one or more host target binding sites, each having a nucleotide sequence which is at least partly complementary to VGAM2380 RNA, herein designated VGAM RNA, and which when bound by VGAM2380 RNA causes inhibition of translation of respective one or more VGAM2380 host target proteins.

It is further appreciated by one skilled in the art that the mode of translational inhibition illustrated by FIG. 1 with specific reference to translational inhibition exerted by VGAM2380 gene, herein designated VGAM GENE, on one or more VGAM2380 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2380 is inhibition of expression of host target genes, as part of a novel viral mechanism of attacking a host. Accordingly, utilities of VGAM2380 include diagnosis, prevention and treatment of viral infection by Human Herpesvirus 4. Specific functions, and accordingly utilities, of VGAM2380 correlate with, and may be deduced from, the identity of the host target genes which VGAM2380 binds and inhibits, and the function of these host target genes, as elaborated hereinbelow.

Nucleotide sequences of the VGAM2380 precursor RNA, herein designated VGAM PRECURSOR RNA, and of the 'diced' VGAM2380 RNA, herein designated VGAM RNA, and a schematic representation of the secondary folding of VGAM2380 folded precursor RNA, herein designated VGAM FOLDED PRECURSOR RNA, of VGAM2380 are further described hereinbelow with reference to Table 1.

Nucleotide sequences of host target binding sites, such as BINDING SITE-I, BINDING SITE-II and BINDING SITE-III of FIG. 1, found on VGAM2380 host target RNA, and schematic representation of the complementarity of each of these host target binding sites to VGAM2380 RNA, herein designated VGAM RNA, are described hereinbelow with reference to Table 2.

As mentioned hereinabove with reference to FIG. 1, a function of VGAM2380 gene, herein designated VGAM is inhibition of expression of VGAM2380 target genes. It is appreciated that specific functions, and accordingly utilities, of VGAM2380 correlate with, and may be deduced from, the identity of the target genes which VGAM2380 binds and inhibits, and the function of these target genes, as elaborated hereinbelow.

Dual-specificity tyrosine-(Y)-phosphorylation Regulated Kinase 2 (DYRK2, Accession NM_003583) is a VGAM2380 host target gene. DYRK2 BINDING SITE1 and DYRK2 BINDING SITE2 are HOST TARGET binding sites found in untranslated regions of mRNA encoded by DYRK2, corresponding to HOST TARGET binding sites such as BINDING SITE I, BINDING SITE II or BINDING SITE III. Table 2 illustrates the complementarity of the nucleotide sequences of DYRK2 BINDING SITE1 and DYRK2 BINDING SITE2, designated SEQ ID:9630 and SEQ ID:13206 respectively, to the nucleotide sequence of VGAM2380 RNA, herein designated VGAM RNA, also designated SEQ ID:5091.

A function of VGAM2380 is therefore inhibition of Dual-specificity tyrosine-(Y)-phosphorylation Regulated Kinase 2 (DYRK2, Accession NM_003583). Accordingly, utilities of VGAM2380 include diagnosis, prevention and treatment of diseases and clinical conditions associated with DYRK2. MGC29891 (Accession NM_144618) is another VGAM2380 host target gene. MGC29891 BINDING SITE is HOST TARGET binding site found in the 3' untranslated region of mRNA encoded by MGC29891, corresponding to a HOST TARGET binding site such as BINDING SITE I, BINDING SITE II or BINDING SITE III. Table 2 illustrates the complementarity of the nucleotide sequences of MGC29891 BINDING SITE, designated SEQ ID:29439, to the nucleotide sequence of VGAM2380 RNA, herein designated VGAM RNA, also designated SEQ ID:5091.

Another function of VGAM2380 is therefore inhibition of MGC29891 (Accession NM_144618). Accordingly, utilities of VGAM2380 include diagnosis, prevention and treatment of diseases and clinical conditions associated with MGC29891. PRO1163 (Accession NM_018576) is another VGAM2380 host target gene. PRO1163 BINDING SITE is HOST TARGET binding site found in the 5' untranslated region of mRNA encoded by PRO1163, corresponding to a HOST TARGET binding site such as BINDING SITE I, BINDING SITE II or BINDING SITE III. Table 2 illustrates the complementarity of the nucleotide sequences of PRO1163 BINDING SITE, designated SEQ ID:20654, to the nucleotide sequence of VGAM2380 RNA, herein designated VGAM RNA, also designated SEQ ID:5091.

Another function of VGAM2380 is therefore inhibition of PRO1163 (Accession NM_018576). Accordingly, utilities of VGAM2380 include diagnosis, prevention and treatment of diseases and clinical conditions associated with PRO1163. Zinc Finger Protein 294 (ZNF294, Accession XM_047829) is another VGAM2380 host target gene. ZNF294 BINDING SITE is HOST TARGET binding site found in the 3' untranslated region of mRNA encoded by ZNF294, corresponding to a HOST TARGET binding site such as BINDING SITE I, BINDING SITE II or BINDING SITE III. Table 2 illustrates the complementarity of the nucleotide sequences of ZNF294 BINDING SITE, designated SEQ ID:35056, to the nucleotide sequence of VGAM2380 RNA, herein designated VGAM RNA, also designated SEQ ID:5091.

Another function of VGAM2380 is therefore inhibition of Zinc Finger Protein 294 (ZNF294, Accession XM_047829). Accordingly, utilities of VGAM2380 include diagnosis, prevention and treatment of diseases and clinical conditions associated with ZNF294. FIG. 1 further provides a conceptual description of a novel bioinformatically detected viral gene of the present invention, referred to here as Viral Genomic Address Messenger 2381 (VGAM2381) viral gene, which modulates expression of respective host target genes thereof, the function and utility of which host target genes is known in the art.

VGAM2381 is a novel bioinformatically detected regulatory, non protein coding, viral micro RNA (miRNA) gene. The method by which VGAM2381 was detected is described hereinabove with reference to FIGS. 1-8.

VGAM2381 gene, herein designated VGAM GENE, is a viral gene contained in the genome of Human Herpesvirus 4. VGAM2381 host target gene, herein designated VGAM HOST TARGET GENE, is a human gene contained in the human genome.

VGAM2381 gene encodes a VGAM2381 precursor RNA, herein designated VGAM PRECURSOR RNA. Similar to other miRNA genes, and unlike most ordinary genes, VGAM2381 precursor RNA does not encode a protein. A nucleotide sequence identical or highly similar to the nucleotide sequence of VGAM2381 precursor RNA is designated SEQ ID:2367, and is provided hereinbelow with reference to the sequence listing part. Nucleotide sequence SEQ ID:2367 is located at position 48597 relative to the genome of Human Herpesvirus 4.

VGAM2381 precursor RNA folds onto itself, forming VGAM2381 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2381 folded precursor RNA into VGAM2381 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 69%) nucleotide sequence of VGAM2381 RNA is designated SEQ ID:5092, and is provided hereinbelow with reference to the sequence listing part.

VGAM2381 host target gene, herein designated VGAM HOST TARGET GENE, encodes a corresponding messenger RNA, VGAM2381 host target RNA, herein designated VGAM HOST TARGET RNA. VGAM2381 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2381 RNA, herein designated VGAM RNA, binds complementarily to one or more host target binding sites located in untranslated regions of VGAM2381 host target RNA, herein designated VGAM HOST TARGET RNA. This complementary binding is due to the fact that the nucleotide sequence of VGAM2381 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2381 RNA, herein designated VGAM RNA, may have a different number of host target binding sites in untranslated regions of a VGAM2381 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2381 RNA, herein designated VGAM RNA, to host target binding sites on VGAM2381 host target RNA, herein designated VGAM HOST TARGET RNA, such as BINDING SITE I, BINDING SITE II and BINDING SITE III, inhibits translation of VGAM2381 host target RNA into VGAM2381 host target protein, herein designated VGAM HOST TARGET PROTEIN. VGAM host target protein is therefore outlined by a broken line.

It is appreciated that VGAM2381 host target gene, herein designated VGAM HOST TARGET GENE, in fact represents a plurality of VGAM2381 host target genes. The mRNA of each one of this plurality of VGAM2381 host target genes comprises one or more host target binding sites, each having a nucleotide sequence which is at least partly complementary to VGAM2381 RNA, herein designated VGAM RNA, and which when bound by VGAM2381 RNA causes inhibition of translation of respective one or more VGAM2381 host target proteins.

It is further appreciated by one skilled in the art that the mode of translational inhibition illustrated by FIG. 1 with specific reference to translational inhibition exerted by VGAM2381 gene, herein designated VGAM GENE, on one or more VGAM2381 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2381 is inhibition of expression of host target genes, as part of a novel viral mechanism of attacking a host. Accordingly, utilities of VGAM2381 include diagnosis, prevention and treatment of viral infection by Human Herpesvirus 4. Specific functions, and accordingly utilities, of VGAM2381 correlate with, and may be deduced from, the identity of the host target genes which VGAM2381 binds and inhibits, and the function of these host target genes, as elaborated hereinbelow.

Nucleotide sequences of the VGAM2381 precursor RNA, herein designated VGAM PRECURSOR RNA, and of the 'diced' VGAM2381 RNA, herein designated VGAM RNA, and a schematic representation of the secondary folding of VGAM2381 folded precursor RNA, herein designated VGAM FOLDED PRECURSOR RNA, of VGAM2381 are further described hereinbelow with reference to Table 1.

Nucleotide sequences of host target binding sites, such as BINDING SITE-I, BINDING SITE-II and BINDING SITE-III of FIG. 1, found on VGAM2381 host target RNA, and schematic representation of the complementarity of each of these host target binding sites to VGAM2381 RNA, herein designated VGAM RNA, are described hereinbelow with reference to Table 2.

As mentioned hereinabove with reference to FIG. 1, a function of VGAM2381 gene, herein designated VGAM is inhibition of expression of VGAM2381 target genes. It is appreciated that specific functions, and accordingly utilities, of VGAM2381 correlate with, and may be deduced from, the identity of the target genes which VGAM2381 binds and inhibits, and the function of these target genes, as elaborated hereinbelow.

Cadherin, EGF LAG Seven-pass G-type Receptor 1 (flamingo homolog, Drosophila) (CELSR1, Accession NM_014246) is a VGAM2381 host target gene. CELSR1 BINDING SITE is HOST TARGET binding site found in the 3' untranslated region of mRNA encoded by CELSR1, corresponding to a HOST TARGET binding site such as BINDING SITE I, BINDING SITE II or BINDING SITE III. Table 2 illustrates the complementarity of the nucleotide sequences of CELSR1 BINDING SITE, designated SEQ ID:15520, to the nucleotide sequence of VGAM2381 RNA, herein designated VGAM RNA, also designated SEQ ID:5092.

A function of VGAM2381 is therefore inhibition of Cadherin, EGF LAG Seven-pass G-type Receptor 1 (flamingo homolog, Drosophila) (CELSR1, Accession NM_014246), a gene which is involved in contact-mediated communication. Accordingly, utilities of VGAM2381 include diagnosis, prevention and treatment of diseases and clinical conditions associated with CELSR1. The function of CELSR1 and its association with various diseases and clinical conditions, has been established by previous studies, as described hereinabove with reference to VGAM459. FLJ10815 (Accession NM_018231) is another VGAM2381 host target gene. FLJ10815 BINDING SITE is HOST TARGET binding site found in the 3' untranslated region of mRNA encoded by FLJ10815, corresponding to a HOST TARGET binding site such as BINDING SITE I, BINDING SITE II or BINDING SITE III. Table 2 illustrates the complementarity of the nucleotide sequences of FLJ10815 BINDING SITE, designated SEQ ID:20170, to the nucleotide sequence of VGAM2381 RNA, herein designated VGAM RNA, also designated SEQ ID:5092.

Another function of VGAM2381 is therefore inhibition of FLJ10815 (Accession NM_018231). Accordingly, utilities of VGAM2381 include diagnosis, prevention and treatment of diseases and clinical conditions associated with FLJ10815. FLJ21290 (Accession NM_025034) is another VGAM2381 host target gene. FLJ21290 BINDING SITE is HOST TARGET binding site found in the 3' untranslated region of mRNA encoded by FLJ21290, corresponding to a HOST TARGET binding site such as BINDING SITE I, BINDING SITE II or BINDING SITE III. Table 2 illustrates the complementarity of the nucleotide sequences of FLJ21290 BINDING SITE, designated SEQ ID:24632, to the nucleotide sequence of VGAM2381 RNA, herein designated VGAM RNA, also designated SEQ ID:5092.

Another function of VGAM2381 is therefore inhibition of FLJ21290 (Accession NM_025034). Accordingly, utilities of VGAM2381 include diagnosis, prevention and treatment of diseases and clinical conditions associated with FLJ21290. LOC122830 (Accession XM_058661) is another VGAM2381 host target gene. LOC122830 BINDING SITE is HOST TARGET binding site found in the 3' untranslated region of mRNA encoded by LOC122830, corresponding to a HOST TARGET binding site such as BINDING SITE I, BINDING SITE II or BINDING SITE III. Table 2 illustrates the complementarity of the nucleotide sequences of LOC122830 BINDING SITE, designated SEQ ID:36702, to the nucleotide sequence of VGAM2381 RNA, herein designated VGAM RNA, also designated SEQ ID:5092.

Another function of VGAM2381 is therefore inhibition of LOC122830 (Accession XM_058661). Accordingly, utilities of VGAM2381 include diagnosis, prevention and treatment of diseases and clinical conditions associated with LOC122830. FIG. 1 further provides a conceptual description of a novel bioinformatically detected viral gene of the present invention, referred to here as Viral Genomic Address Messenger 2382 (VGAM2382) viral gene, which modulates expression of respective host target genes thereof, the function and utility of which host target genes is known in the art.

VGAM2382 is a novel bioinformatically detected regulatory, non protein coding, viral micro RNA (miRNA) gene. The method by which VGAM2382 was detected is described hereinabove with reference to FIGS. 1-8.

VGAM2382 gene, herein designated VGAM GENE, is a viral gene contained in the genome of Human Herpesvirus 4. VGAM2382 host target gene, herein designated VGAM HOST TARGET GENE, is a human gene contained in the human genome.

VGAM2382 gene encodes a VGAM2382 precursor RNA, herein designated VGAM PRECURSOR RNA. Similar to other miRNA genes, and unlike most ordinary genes, VGAM2382 precursor RNA does not encode a protein. A nucleotide sequence identical or highly similar to the nucleotide sequence of VGAM2382 precursor RNA is designated SEQ ID:2368, and is provided hereinbelow with reference to the sequence listing part. Nucleotide sequence SEQ ID:2368 is located at position 54739 relative to the genome of Human Herpesvirus 4.

VGAM2382 precursor RNA folds onto itself, forming VGAM2382 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2382 folded precursor RNA into VGAM2382 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 55%) nucleotide sequence of VGAM2382 RNA is designated SEQ ID:5093, and is provided hereinbelow with reference to the sequence listing part.

VGAM2382 host target gene, herein designated VGAM HOST TARGET GENE, encodes a corresponding messenger RNA, VGAM2382 host target RNA, herein designated VGAM HOST TARGET RNA. VGAM2382 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2382 RNA, herein designated VGAM RNA, binds complementarily to one or more host target binding sites located in untranslated regions of VGAM2382 host target RNA, herein designated VGAM HOST TARGET RNA. This complementary binding is due to the fact that the nucleotide sequence of VGAM2382 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2382 RNA, herein designated VGAM RNA, may have a different number of host target binding sites in untranslated regions of a VGAM2382 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2382 RNA, herein designated VGAM RNA, to host target binding sites on VGAM2382 host target RNA, herein designated VGAM HOST TARGET RNA, such as BINDING SITE I, BINDING SITE II and BINDING SITE III, inhibits translation of VGAM2382 host target RNA into VGAM2382 host target protein, herein designated VGAM HOST TARGET PROTEIN. VGAM host target protein is therefore outlined by a broken line.

It is appreciated that VGAM2382 host target gene, herein designated VGAM HOST TARGET GENE, in fact represents a plurality of VGAM2382 host target genes. The mRNA of each one of this plurality of VGAM2382 host target genes comprises one or more host target binding sites, each having a nucleotide sequence which is at least partly complementary to VGAM2382 RNA, herein designated VGAM RNA, and which when bound by VGAM2382 RNA causes inhibition of translation of respective one or more VGAM2382 host target proteins.

It is further appreciated by one skilled in the art that the mode of translational inhibition illustrated by FIG. 1 with specific reference to translational inhibition exerted by VGAM2382 gene, herein designated VGAM GENE, on one or more VGAM2382 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM2382 is inhibition of expression of host target genes, as part of a novel viral mechanism of attacking a host. Accordingly, utilities of VGAM2382 include diagnosis, prevention and treatment of viral infection by Human Herpesvirus 4. Specific functions, and accordingly utilities, of VGAM2382 correlate with, and may be deduced from, the identity of the host target genes which VGAM2382 binds and inhibits, and the function of these host target genes, as elaborated hereinbelow.

Nucleotide sequences of the VGAM2382 precursor RNA, herein designated VGAM PRECURSOR RNA, and of the 'diced' VGAM2382 RNA, herein designated VGAM RNA, and a schematic representation of the secondary folding of VGAM2382 folded precursor RNA, herein designated VGAM FOLDED PRECURSOR RNA, of VGAM2382 are further described hereinbelow with reference to Table 1.

Nucleotide sequences of host target binding sites, such as BINDING SITE-I, BINDING SITE-II and BINDING SITE-III of FIG. 1, found on VGAM2382 host target RNA, and schematic representation of the complementarity of each of these host target binding sites to VGAM2382 RNA, herein designated VGAM RNA, are described hereinbelow with reference to Table 2.

As mentioned hereinabove with reference to FIG. 1, a function of VGAM2382 gene, herein designated VGAM is inhibition of expression of VGAM2382 target genes. It is appreciated that specific functions, and accordingly utilities, of VGAM2382 correlate with, and may be deduced from, the identity of the target genes which VGAM2382 binds and inhibits, and the function of these target genes, as elaborated hereinbelow.

Paired Mesoderm Homeo Box 1 (PMX1, Accession NM_006902) is a VGAM2382 host target gene. PMX1 BINDING SITE1 and PMX1 BINDING SITE2 are HOST TARGET binding sites found in untranslated regions of mRNA encoded by PMX1, corresponding to HOST TARGET binding sites such as BINDING SITE I, BINDING SITE II or BINDING SITE III. Table 2 illustrates the complementarity of the nucleotide sequences of PMX1 BINDING SITE1 and PMX1 BINDING SITE2, designated SEQ ID:13780 and SEQ ID:22915 respectively, to the nucleotide sequence of VGAM2382 RNA, herein designated VGAM RNA, also designated SEQ ID:5093.

A function of VGAM2382 is therefore inhibition of Paired Mesoderm Homeo Box 1 (PMX1, Accession NM_006902), a gene which acts as a transcriptional regulator of muscle creatine kinase. Accordingly, utilities of VGAM2382 include diagnosis, prevention and treatment of diseases and clinical conditions associated with PMX1. The function of PMX1 and its association with various diseases and clinical conditions, has been established by previous studies, as described hereinabove with reference to VGAM381. FIG. 1 further provides a conceptual description of a novel bioinformatically detected viral gene of the present invention, referred to here as Viral Genomic Address Messenger 2383 (VGAM2383) viral gene, which modulates expression of respective host target genes thereof, the function and utility of which host target genes is known in the art.

VGAM2383 is a novel bioinformatically detected regulatory, non protein coding, viral micro RNA (miRNA) gene. The method by which VGAM2383 was detected is described hereinabove with reference to FIGS. 1-8.

VGAM2383 gene, herein designated VGAM GENE, is a viral gene contained in the genome of Human Herpesvirus 4. VGAM2383 host target gene, herein designated VGAM HOST TARGET GENE, is a human gene contained in the human genome.

VGAM2383 gene encodes a VGAM2383 precursor RNA, herein designated VGAM PRECURSOR RNA. Similar to other miRNA genes, and unlike most ordinary genes, VGAM2383 precursor RNA does not encode a protein. A nucleotide sequence identical or highly similar to the nucleotide sequence of VGAM2383 precursor RNA is designated SEQ ID:2369, and is provided hereinbelow with reference to the sequence listing part. Nucleotide sequence SEQ ID:2369 is located at position 53736 relative to the genome of Human Herpesvirus 4.

VGAM2383 precursor RNA folds onto itself, forming VGAM2383 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2383 folded precursor RNA into VGAM2383 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM2383 RNA is designated SEQ ID:5094, and is provided hereinbelow with reference to the sequence listing part.

VGAM2383 host target gene, herein designated VGAM HOST TARGET GENE, encodes a corresponding messenger RNA, VGAM2383 host target RNA, herein designated VGAM HOST TARGET RNA. VGAM2383 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2383 RNA, herein designated VGAM RNA, binds complementarily to one or more host target binding sites located in untranslated regions of VGAM2383 host target RNA, herein designated VGAM HOST TARGET RNA. This complementary binding is due to the fact that the nucleotide sequence of VGAM2383 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2383 RNA, herein designated VGAM RNA, may have a different number of host target binding sites in untranslated regions of a VGAM2383 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2383 RNA, herein designated VGAM RNA, to host target binding sites on VGAM2383 host target RNA, herein designated VGAM HOST TARGET RNA, such as BINDING SITE I, BINDING SITE II and BINDING SITE III, inhibits translation of VGAM2383 host target RNA into VGAM2383 host target protein, herein designated VGAM HOST TARGET PROTEIN. VGAM host target protein is therefore outlined by a broken line.

It is appreciated that VGAM2383 host target gene, herein designated VGAM HOST TARGET GENE, in fact represents a plurality of VGAM2383 host target genes. The mRNA of each one of this plurality of VGAM2383 host target genes comprises one or more host target binding sites, each having a nucleotide sequence which is at least partly complementary to VGAM2383 RNA, herein designated VGAM RNA, and which when bound by VGAM2383 RNA causes inhibition of translation of respective one or more VGAM2383 host target proteins.

It is further appreciated by one skilled in the art that the mode of translational inhibition illustrated by FIG. 1 with specific reference to translational inhibition exerted by VGAM2383 gene, herein designated VGAM GENE, on one or more VGAM2383 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2383 is inhibition of expression of host target genes, as part of a novel viral mechanism of attacking a host. Accordingly, utilities of VGAM2383 include diagnosis, prevention and treatment of viral infection by Human Herpesvirus 4. Specific functions, and accordingly utilities, of VGAM2383 correlate with, and may be deduced from, the identity of the host target genes which VGAM2383 binds and inhibits, and the function of these host target genes, as elaborated hereinbelow.

Nucleotide sequences of the VGAM2383 precursor RNA, herein designated VGAM PRECURSOR RNA, and of the 'diced' VGAM2383 RNA, herein designated VGAM RNA, and a schematic representation of the secondary folding of VGAM2383 folded precursor RNA, herein designated VGAM FOLDED PRECURSOR RNA, of VGAM2383 are further described hereinbelow with reference to Table 1.

Nucleotide sequences of host target binding sites, such as BINDING SITE-I, BINDING SITE-II and BINDING SITE-III of FIG. 1, found on VGAM2383 host target RNA, and schematic representation of the complementarity of each of these host target binding sites to VGAM2383 RNA, herein designated VGAM RNA, are described hereinbelow with reference to Table 2.

As mentioned hereinabove with reference to FIG. 1, a function of VGAM2383 gene, herein designated VGAM is inhibition of expression of VGAM2383 target genes. It is appreciated that specific functions, and accordingly utilities, of VGAM2383 correlate with, and may be deduced from, the identity of the target genes which VGAM2383 binds and inhibits, and the function of these target genes, as elaborated hereinbelow.

Fucosyltransferase 8 (alpha (1,6) Fucosyltransferase) (FUT8, Accession NM_004480) is a VGAM2383 host target gene. FUT8 BINDING SITE is HOST TARGET binding site found in the 3' untranslated region of mRNA encoded by FUT8, corresponding to a HOST TARGET binding site such as BINDING SITE I, BINDING SITE II or BINDING SITE III. Table 2 illustrates the complementarity of the nucleotide sequences of FUT8 BINDING SITE, designated SEQ ID:10794, to the nucleotide sequence of VGAM2383 RNA, herein designated VGAM RNA, also designated SEQ ID:5094.

A function of VGAM2383 is therefore inhibition of Fucosyltransferase 8 (alpha (1,6) Fucosyltransferase) (FUT8, Accession NM_004480), a gene which transfers fucose to N-linked type complex glycopeptides from GDP-Fuc; functions in asparagine-linked glycoprotein oligosaccharide synthesis. Accordingly, utilities of VGAM2383 include diagnosis, prevention and treatment of diseases and clinical conditions associated with FUT8. The function of FUT8 and its association with various diseases and clinical conditions, has been established by previous studies, as described hereinabove with reference to VGAM64. Leucine-zipper-like Transcriptional Regulator, 1 (LZTR1, Accession NM_006767) is another VGAM2383 host target gene. LZTR1 BINDING SITE is HOST TARGET binding site found in the 5' untranslated region of mRNA encoded by LZTR1, corresponding to a HOST TARGET binding site such as BINDING SITE I, BINDING SITE II or BINDING SITE III. Table 2 illustrates the complementarity of the nucleotide sequences of LZTR1 BINDING SITE, designated SEQ ID:13634, to the nucleotide sequence of VGAM2383 RNA, herein designated VGAM RNA, also designated SEQ ID:5094.

Another function of VGAM2383 is therefore inhibition of Leucine-zipper-like Transcriptional Regulator, 1 (LZTR1, Accession NM_006767). Accordingly, utilities of VGAM2383 include diagnosis, prevention and treatment of diseases and clinical conditions associated with LZTR1. DKFZP434L187 (Accession XM_044070) is another VGAM2383 host target gene. DKFZP434L187 BINDING SITE is HOST TARGET binding site found in the 3' untranslated region of mRNA encoded by DKFZP434L187, corresponding to a HOST TARGET binding site such as BINDING SITE I, BINDING SITE II or BINDING SITE III. Table 2 illustrates the complementarity of the nucleotide sequences of DKFZP434L187 BINDING SITE, designated SEQ ID:34116, to the nucleotide sequence of VGAM2383 RNA, herein designated VGAM RNA, also designated SEQ ID:5094.

Another function of VGAM2383 is therefore inhibition of DKFZP434L187 (Accession XM_044070). Accordingly, utilities of VGAM2383 include diagnosis, prevention and treatment of diseases and clinical conditions associated with DKFZP434L187. FLJ13881 (Accession NM_024729) is another VGAM2383 host target gene. FLJ13881 BINDING SITE is HOST TARGET binding site found in the 3' untranslated region of mRNA encoded by FLJ13881, corresponding to a HOST TARGET binding site such as BINDING SITE I, BINDING SITE II or BINDING SITE III. Table 2 illustrates the complementarity of the nucleotide sequences of FLJ13881 BINDING SITE, designated SEQ ID:24069, to the nucleotide sequence of VGAM2383 RNA, herein designated VGAM RNA, also designated SEQ ID:5094.

Another function of VGAM2383 is therefore inhibition of FLJ13881 (Accession NM_024729). Accordingly, utilities of VGAM2383 include diagnosis, prevention and treatment of diseases and clinical conditions associated with FLJ13881. KIAA0971 (Accession NM_014929) is another VGAM2383 host target gene. KIAA0971 BINDING SITE is HOST TARGET binding site found in the 3' untranslated region of mRNA encoded by KIAA0971, corresponding to a HOST TARGET binding site such as BINDING SITE I, BINDING SITE II or BINDING SITE III. Table 2 illustrates the complementarity of the nucleotide sequences of KIAA0971 BINDING SITE, designated SEQ ID:17223, to the nucleotide sequence of VGAM2383 RNA, herein designated VGAM RNA, also designated SEQ ID:5094.

Another function of VGAM2383 is therefore inhibition of KIAA0971 (Accession NM_014929). Accordingly, utilities of VGAM2383 include diagnosis, prevention and treatment of diseases and clinical conditions associated with KIAA0971. RNA Binding Motif Protein 7 (RBM7, Accession NM_016090) is another VGAM2383 host target gene. RBM7 BINDING SITE is HOST TARGET binding site found in the 3' untranslated region of mRNA encoded by RBM7, corresponding to a HOST TARGET binding site such as BINDING SITE I, BINDING SITE II or BINDING SITE III. Table 2 illustrates the complementarity of the nucleotide sequences of RBM7 BINDING SITE, designated SEQ ID:18177, to the nucleotide sequence of VGAM2383 RNA, herein designated VGAM RNA, also designated SEQ ID:5094.

Another function of VGAM2383 is therefore inhibition of RNA Binding Motif Protein 7 (RBM7, Accession NM_016090). Accordingly, utilities of VGAM2383 include diagnosis, prevention and treatment of diseases and clinical conditions associated with RBM7. LOC151277 (Accession XM_087155) is another VGAM2383 host target gene. LOC151277 BINDING SITE is HOST TARGET binding site found in the 5' untranslated region of mRNA encoded by LOC151277, corresponding to a HOST TARGET binding site such as BINDING SITE I, BINDING SITE II or BINDING SITE III. Table 2 illustrates the complementarity of the nucleotide sequences of LOC151277 BINDING SITE, designated SEQ ID:39093, to the nucleotide sequence of VGAM2383 RNA, herein designated VGAM RNA, also designated SEQ ID:5094.

Another function of VGAM2383 is therefore inhibition of LOC151277 (Accession XM_087155). Accordingly, utilities of VGAM2383 include diagnosis, prevention and treatment of diseases and clinical conditions associated with LOC151277. LOC159199 (Accession XM_089441) is another VGAM2383 host target gene. LOC159199 BINDING SITE is HOST TARGET binding site found in the 5' untranslated region of mRNA encoded by LOC159199, corresponding to a HOST TARGET binding site such as BINDING SITE I, BINDING SITE II or BINDING SITE III. Table 2 illustrates the complementarity of the nucleotide sequences of LOC159199 BINDING SITE, designated SEQ ID:39977, to the nucleotide sequence of VGAM2383 RNA, herein designated VGAM RNA, also designated SEQ ID:5094.

Another function of VGAM2383 is therefore inhibition of LOC159199 (Accession XM_089441). Accordingly, utilities of VGAM2383 include diagnosis, prevention and treatment of diseases and clinical conditions associated with LOC159199. FIG. 1 further provides a conceptual description of a novel bioinformatically detected viral gene of the present invention, referred to here as Viral Genomic Address Messenger 2384 (VGAM2384) viral gene, which modulates expression of respective host target genes thereof, the function and utility of which host target genes is known in the art.

VGAM2384 is a novel bioinformatically detected regulatory, non protein coding, viral micro RNA (miRNA) gene. The method by which VGAM2384 was detected is described hereinabove with reference to FIGS. 1-8.

VGAM2384 gene, herein designated VGAM GENE, is a viral gene contained in the genome of Human Herpesvirus 4. VGAM2384 host target gene, herein designated VGAM HOST TARGET GENE, is a human gene contained in the human genome.

VGAM2384 gene encodes a VGAM2384 precursor RNA, herein designated VGAM PRECURSOR RNA. Similar to other miRNA genes, and unlike most ordinary genes, VGAM2384 precursor RNA does not encode a protein. A nucleotide sequence identical or highly similar to the nucleotide sequence of VGAM2384 precursor RNA is designated SEQ ID:2370, and is provided hereinbelow with reference to the sequence listing part. Nucleotide sequence SEQ ID:2370 is located at position 5198 relative to the genome of Human Herpesvirus 4.

VGAM2384 precursor RNA folds onto itself, forming VGAM2384 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2384 folded precursor RNA into VGAM2384 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2384 RNA is designated SEQ ID:5095, and is provided hereinbelow with reference to the sequence listing part.

VGAM2384 host target gene, herein designated VGAM HOST TARGET GENE, encodes a corresponding messenger RNA, VGAM2384 host target RNA, herein designated VGAM HOST TARGET RNA. VGAM2384 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2384 RNA, herein designated VGAM RNA, binds complementarily to one or more host target binding sites located in untranslated regions of VGAM2384 host target RNA, herein designated VGAM HOST TARGET RNA. This complementary binding is due to the fact that the nucleotide sequence of VGAM2384 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2384 RNA, herein designated VGAM RNA, may have a different number of host target binding sites in untranslated regions of a VGAM2384 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2384 RNA, herein designated VGAM RNA, to host target binding sites on VGAM2384 host target RNA, herein designated VGAM HOST TARGET RNA, such as BINDING SITE I, BINDING SITE II and BINDING SITE III, inhibits translation of VGAM2384 host target RNA into VGAM2384 host target protein, herein designated VGAM HOST TARGET PROTEIN. VGAM host target protein is therefore outlined by a broken line.

It is appreciated that VGAM2384 host target gene, herein designated VGAM HOST TARGET GENE, in fact represents a plurality of VGAM2384 host target genes. The mRNA of each one of this plurality of VGAM2384 host target genes comprises one or more host target binding sites, each having a nucleotide sequence which is at least partly complementary to VGAM2384 RNA, herein designated VGAM RNA, and which when bound by VGAM2384 RNA causes inhibition of translation of respective one or more VGAM2384 host target proteins.

It is further appreciated by one skilled in the art that the mode of translational inhibition illustrated by FIG. 1 with specific reference to translational inhibition exerted by VGAM2384 gene, herein designated VGAM GENE, on one or more VGAM2384 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2384 is inhibition of expression of host target genes, as part of a novel viral mechanism of attacking a host. Accordingly, utilities of VGAM2384 include diagnosis, prevention and treatment of viral infection by Human Herpesvirus 4. Specific functions, and accordingly utilities, of VGAM2384 correlate with, and may be deduced from, the identity of the host target genes which VGAM2384 binds and inhibits, and the function of these host target genes, as elaborated hereinbelow.

Nucleotide sequences of the VGAM2384 precursor RNA, herein designated VGAM PRECURSOR RNA, and of the 'diced' VGAM2384 RNA, herein designated VGAM RNA, and a schematic representation of the secondary folding of VGAM2384 folded precursor RNA, herein designated VGAM FOLDED PRECURSOR RNA, of VGAM2384 are further described hereinbelow with reference to Table 1.

Nucleotide sequences of host target binding sites, such as BINDING SITE-I, BINDING SITE-II and BINDING SITE-III of FIG. 1, found on VGAM2384 host target RNA, and schematic representation of the complementarity of each of these host target binding sites to VGAM2384 RNA, herein designated VGAM RNA, are described hereinbelow with reference to Table 2.

As mentioned hereinabove with reference to FIG. 1, a function of VGAM2384 gene, herein designated VGAM is inhibition of expression of VGAM2384 target genes. It is appreciated that specific functions, and accordingly utilities, of VGAM2384 correlate with, and may be deduced from, the identity of the target genes which VGAM2384 binds and inhibits, and the function of these target genes, as elaborated hereinbelow.

WNT1 Inducible Signaling Pathway Protein 1 (WISP1, Accession NM_003882) is a VGAM2384 host target gene. WISP1 BINDING SITE is HOST TARGET binding site found in the 3' untranslated region of mRNA encoded by WISP1, corresponding to a HOST TARGET binding site such as BINDING SITE I, BINDING SITE II or BINDING SITE III. Table 2 illustrates the complementarity of the nucleotide sequences of WISP1 BINDING SITE, designated SEQ ID:9963, to the nucleotide sequence of VGAM2384 RNA, herein designated VGAM RNA, also designated SEQ ID:5095.

A function of VGAM2384 is therefore inhibition of WNT1 Inducible Signaling Pathway Protein 1 (WISP1, Accession NM_003882), a gene which is a member of connective tissue growth factor family. Accordingly, utilities of VGAM2384 include diagnosis, prevention and treatment of diseases and clinical conditions associated with WISP1. The function of WISP1 and its association with various diseases and clinical conditions, has been established by previous studies, as described hereinabove with reference to VGAM1656. Chromosome 20 Open Reading Frame 121 (C20orf121, Accession NM_024331) is another VGAM2384 host target gene. C20orf121 BINDING SITE is HOST TARGET binding site found in the 5' untranslated region of mRNA encoded by C20orf121, corresponding to a HOST TARGET binding site such as BINDING SITE I, BINDING SITE II or BINDING SITE III. Table 2 illustrates the complementarity of the nucleotide sequences of C20orf121 BINDING SITE, designated SEQ ID:23633, to the nucleotide sequence of VGAM2384 RNA, herein designated VGAM RNA, also designated SEQ ID:5095.

Another function of VGAM2384 is therefore inhibition of Chromosome 20 Open Reading Frame 121 (C20orf121, Accession NM_024331). Accordingly, utilities of VGAM2384 include diagnosis, prevention and treatment of diseases and clinical conditions associated with C20orf121. KIAA0763 (Accession NM_014869) is another VGAM2384 host target gene. KIAA0763 BINDING SITE is HOST TARGET binding site found in the 3' untranslated region of mRNA encoded by KIAA0763, corresponding to a HOST TARGET binding site such as BINDING SITE I, BINDING SITE II or BINDING SITE III. Table 2 illustrates the complementarity of the nucleotide sequences of KIAA0763 BINDING SITE, designated SEQ ID:16969, to the nucleotide sequence of VGAM2384 RNA, herein designated VGAM RNA, also designated SEQ ID:5095.

Another function of VGAM2384 is therefore inhibition of KIAA0763 (Accession NM_014869). Accordingly, utilities of VGAM2384 include diagnosis, prevention and treatment of diseases and clinical conditions associated with KIAA0763. KIAA0820 (Accession XM_044463) is another VGAM2384 host target gene. KIAA0820 BINDING SITE is HOST TARGET binding site found in the 3' untranslated region of mRNA encoded by KIAA0820, corresponding to a HOST TARGET binding site such as BINDING SITE I, BINDING SITE II or BINDING SITE III. Table 2 illustrates the complementarity of the nucleotide sequences of KIAA0820 BINDING SITE, designated SEQ ID:34222, to the nucleotide sequence of VGAM2384 RNA, herein designated VGAM RNA, also designated SEQ ID:5095.

Another function of VGAM2384 is therefore inhibition of KIAA0820 (Accession XM_044463). Accordingly, utilities of VGAM2384 include diagnosis, prevention and treatment of diseases and clinical conditions associated with KIAA0820. Seizure Related 6 Homolog (mouse) (SEZ6, Accession XM_058869) is another VGAM2384 host target gene. SEZ6 BINDING SITE is HOST TARGET binding site found in the 5' untranslated region of mRNA encoded by SEZ6, corresponding to a HOST TARGET binding site such as BINDING SITE I, BINDING SITE II or BINDING SITE III. Table 2 illustrates the complementarity of the nucleotide sequences of SEZ6 BINDING SITE, designated SEQ ID:36775, to the nucleotide sequence of VGAM2384 RNA, herein designated VGAM RNA, also designated SEQ ID:5095.

Another function of VGAM2384 is therefore inhibition of Seizure Related 6 Homolog (mouse) (SEZ6, Accession XM_058869). Accordingly, utilities of VGAM2384 include diagnosis, prevention and treatment of diseases and clinical conditions associated with SEZ6. LOC152359 (Accession XM_098213) is another VGAM2384 host target gene. LOC152359 BINDING SITE is HOST TARGET binding site found in the 3' untranslated region of mRNA encoded by LOC152359, corresponding to a HOST TARGET binding site such as BINDING SITE I, BINDING SITE II or BIND- ING SITE III. Table 2 illustrates the complementarity of the nucleotide sequences of LOC152359 BINDING SITE, designated SEQ ID:41494, to the nucleotide sequence of VGAM2384 RNA, herein designated VGAM RNA, also designated SEQ ID:5095.

Another function of VGAM2384 is therefore inhibition of LOC152359 (Accession XM_098213). Accordingly, utilities of VGAM2384 include diagnosis, prevention and treatment of diseases and clinical conditions associated with LOC152359. LOC161829 (Accession XM_091161) is another VGAM2384 host target gene. LOC161829 BINDING SITE is HOST TARGET binding site found in the 5' untranslated region of mRNA encoded by LOC161829, corresponding to a HOST TARGET binding site such as BINDING SITE I, BINDING SITE II or BINDING SITE III. Table 2 illustrates the complementarity of the nucleotide sequences of LOC161829 BINDING SITE, designated SEQ ID:40038, to the nucleotide sequence of VGAM2384 RNA, herein designated VGAM RNA, also designated SEQ ID:5095.

Another function of VGAM2384 is therefore inhibition of LOC161829 (Accession XM_091161). Accordingly, utilities of VGAM2384 include diagnosis, prevention and treatment of diseases and clinical conditions associated with LOC161829. LOC220739 (Accession XM_167548) is another VGAM2384 host target gene. LOC220739 BINDING SITE is HOST TARGET binding site found in the 3' untranslated region of mRNA encoded by LOC220739, corresponding to a HOST TARGET binding site such as BINDING SITE I, BINDING SITE II or BINDING SITE III. Table 2 illustrates the complementarity of the nucleotide sequences of LOC220739 BINDING SITE, designated SEQ ID:44658, to the nucleotide sequence of VGAM2384 RNA, herein designated VGAM RNA, also designated SEQ ID:5095.

Another function of VGAM2384 is therefore inhibition of LOC220739 (Accession XM_167548). Accordingly, utilities of VGAM2384 include diagnosis, prevention and treatment of diseases and clinical conditions associated with LOC220739. FIG. 1 further provides a conceptual description of a novel bioinformatically detected viral gene of the present invention, referred to here as Viral Genomic Address Messenger 2385 (VGAM2385) viral gene, which modulates expression of respective host target genes thereof, the function and utility of which host target genes is known in the art.

VGAM2385 is a novel bioinformatically detected regulatory, non protein coding, viral micro RNA (miRNA) gene. The method by which VGAM2385 was detected is described hereinabove with reference to FIGS. 1-8.

VGAM2385 gene, herein designated VGAM GENE, is a viral gene contained in the genome of Human Herpesvirus 4. VGAM2385 host target gene, herein designated VGAM HOST TARGET GENE, is a human gene contained in the human genome.

VGAM2385 gene encodes a VGAM2385 precursor RNA, herein designated VGAM PRECURSOR RNA. Similar to other miRNA genes, and unlike most ordinary genes, VGAM2385 precursor RNA does not encode a protein. A nucleotide sequence identical or highly similar to the nucleotide sequence of VGAM2385 precursor RNA is designated SEQ ID:2371, and is provided hereinbelow with reference to the sequence listing part. Nucleotide sequence SEQ ID:2371 is located at position 7899 relative to the genome of Human Herpesvirus 4.

VGAM2385 precursor RNA folds onto itself, forming VGAM2385 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2385 folded precursor RNA into VGAM2385 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 90%) nucleotide sequence of VGAM2385 RNA is designated SEQ ID:5096, and is provided hereinbelow with reference to the sequence listing part.

VGAM2385 host target gene, herein designated VGAM HOST TARGET GENE, encodes a corresponding messenger RNA, VGAM2385 host target RNA, herein designated VGAM HOST TARGET RNA. VGAM2385 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2385 RNA, herein designated VGAM RNA, binds complementarily to one or more host target binding sites located in untranslated regions of VGAM2385 host target RNA, herein designated VGAM HOST TARGET RNA. This complementary binding is due to the fact that the nucleotide sequence of VGAM2385 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2385 RNA, herein designated VGAM RNA, may have a different number of host target binding sites in untranslated regions of a VGAM2385 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2385 RNA, herein designated VGAM RNA, to host target binding sites on VGAM2385 host target RNA, herein designated VGAM HOST TARGET RNA, such as BINDING SITE I, BINDING SITE II and BINDING SITE III, inhibits translation of VGAM2385 host target RNA into VGAM2385 host target protein, herein designated VGAM HOST TARGET PROTEIN. VGAM host target protein is therefore outlined by a broken line.

It is appreciated that VGAM2385 host target gene, herein designated VGAM HOST TARGET GENE, in fact represents a plurality of VGAM2385 host target genes. The mRNA of each one of this plurality of VGAM2385 host target genes comprises one or more host target binding sites, each having a nucleotide sequence which is at least partly complementary to VGAM2385 RNA, herein designated VGAM RNA, and which when bound by VGAM2385 RNA causes inhibition of translation of respective one or more VGAM2385 host target proteins.

It is further appreciated by one skilled in the art that the mode of translational inhibition illustrated by FIG. 1 with specific reference to translational inhibition exerted by VGAM2385 gene, herein designated VGAM GENE, on one or more VGAM2385 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2385 is inhibition of expression of host target genes, as part of a novel viral mechanism of attacking a host. Accordingly, utilities of VGAM2385 include diagnosis, prevention and treatment of viral infection by Human Herpesvirus 4. Specific functions, and accordingly utilities, of VGAM2385 correlate with, and may be deduced from, the identity of the host target genes which VGAM2385 binds and inhibits, and the function of these host target genes, as elaborated hereinbelow.

Nucleotide sequences of the VGAM2385 precursor RNA, herein designated VGAM PRECURSOR RNA, and of the 'diced' VGAM2385 RNA, herein designated VGAM RNA, and a schematic representation of the secondary folding of VGAM2385 folded precursor RNA, herein designated VGAM FOLDED PRECURSOR RNA, of VGAM2385 are further described hereinbelow with reference to Table 1.

Nucleotide sequences of host target binding sites, such as BINDING SITE-I, BINDING SITE-II and BINDING SITE-III of FIG. 1, found on VGAM2385 host target RNA, and schematic representation of the complementarity of each of these host target binding sites to VGAM2385 RNA, herein designated VGAM RNA, are described hereinbelow with reference to Table 2.

As mentioned hereinabove with reference to FIG. 1, a function of VGAM2385 gene, herein designated VGAM is inhibition of expression of VGAM2385 target genes. It is appreciated that specific functions, and accordingly utilities, of VGAM2385 correlate with, and may be deduced from, the identity of the target genes which VGAM2385 binds and inhibits, and the function of these target genes, as elaborated hereinbelow.

Dual-specificity tyrosine-(Y)-phosphorylation Regulated Kinase 2 (DYRK2, Accession NM_003583) is a VGAM2385 host target gene. DYRK2 BINDING SITE1 and DYRK2 BINDING SITE2 are HOST TARGET binding sites found in untranslated regions of mRNA encoded by DYRK2, corresponding to HOST TARGET binding sites such as BINDING SITE I, BINDING SITE II or BINDING SITE III. Table 2 illustrates the complementarity of the nucleotide sequences of DYRK2 BINDING SITE1 and DYRK2 BINDING SITE2, designated SEQ ID:9630 and SEQ ID:13206 respectively, to the nucleotide sequence of VGAM2385 RNA, herein designated VGAM RNA, also designated SEQ ID:5096.

A function of VGAM2385 is therefore inhibition of Dual-specificity tyrosine-(Y)-phosphorylation Regulated Kinase 2 (DYRK2, Accession NM_003583). Accordingly, utilities of VGAM2385 include diagnosis, prevention and treatment of diseases and clinical conditions associated with DYRK2. MGC29891 (Accession NM_144618) is another VGAM2385 host target gene. MGC29891 BINDING SITE is HOST TARGET binding site found in the 3' untranslated region of mRNA encoded by MGC29891, corresponding to a HOST TARGET binding site such as BINDING SITE I, BINDING SITE II or BINDING SITE III. Table 2 illustrates the complementarity of the nucleotide sequences of MGC29891 BINDING SITE, designated SEQ ID:29439, to the nucleotide sequence of VGAM2385 RNA, herein designated VGAM RNA, also designated SEQ ID:5096.

Another function of VGAM2385 is therefore inhibition of MGC29891 (Accession NM_144618). Accordingly, utilities of VGAM2385 include diagnosis, prevention and treatment of diseases and clinical conditions associated with MGC29891. PRO1163 (Accession NM_018576) is another VGAM2385 host target gene. PRO1163 BINDING SITE is HOST TARGET binding site found in the 5' untranslated region of mRNA encoded by PRO1163, corresponding to a HOST TARGET binding site such as BINDING SITE I, BINDING SITE II or BINDING SITE III. Table 2 illustrates the complementarity of the nucleotide sequences of PRO1163 BINDING SITE, designated SEQ ID:20654, to the nucleotide sequence of VGAM2385 RNA, herein designated VGAM RNA, also designated SEQ ID:5096.

Another function of VGAM2385 is therefore inhibition of PRO1163 (Accession NM_018576). Accordingly, utilities of VGAM2385 include diagnosis, prevention and treatment of diseases and clinical conditions associated with PRO1163. Zinc Finger Protein 294 (ZNF294, Accession XM_047829) is another VGAM2385 host target gene. ZNF294 BINDING SITE is HOST TARGET binding site found in the 3' untranslated region of mRNA encoded by ZNF294, corresponding to a HOST TARGET binding site such as BINDING SITE I, BINDING SITE II or BINDING SITE III. Table 2 illustrates the complementarity of the nucleotide sequences of ZNF294 BINDING SITE, designated SEQ ID:35056, to the nucleotide sequence of VGAM2385 RNA, herein designated VGAM RNA, also designated SEQ ID:5096.

Another function of VGAM2385 is therefore inhibition of Zinc Finger Protein 294 (ZNF294, Accession XM_047829). Accordingly, utilities of VGAM2385 include diagnosis, prevention and treatment of diseases and clinical conditions associated with ZNF294. FIG. 1 further provides a conceptual description of a novel bioinformatically detected viral gene of the present invention, referred to here as Viral Genomic Address Messenger 2386 (VGAM2386) viral gene, which modulates expression of respective host target genes thereof, the function and utility of which host target genes is known in the art.

VGAM2386 is a novel bioinformatically detected regulatory, non protein coding, viral micro RNA (miRNA) gene. The method by which VGAM2386 was detected is described hereinabove with reference to FIGS. 1-8.

VGAM2386 gene, herein designated VGAM GENE, is a viral gene contained in the genome of Human Herpesvirus 4. VGAM2386 host target gene, herein designated VGAM HOST TARGET GENE, is a human gene contained in the human genome.

VGAM2386 gene encodes a VGAM2386 precursor RNA, herein designated VGAM PRECURSOR RNA. Similar to other miRNA genes, and unlike most ordinary genes, VGAM2386 precursor RNA does not encode a protein. A nucleotide sequence identical or highly similar to the nucleotide sequence of VGAM2386 precursor RNA is designated SEQ ID:2372, and is provided hereinbelow with reference to the sequence listing part. Nucleotide sequence SEQ ID:2372 is located at position 6848 relative to the genome of Human Herpesvirus 4.

VGAM2386 precursor RNA folds onto itself, forming VGAM2386 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2386 folded precursor RNA into VGAM2386 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2386 RNA is designated SEQ ID:5097, and is provided hereinbelow with reference to the sequence listing part.

VGAM2386 host target gene, herein designated VGAM HOST TARGET GENE, encodes a corresponding messenger RNA, VGAM2386 host target RNA, herein designated VGAM HOST TARGET RNA. VGAM2386 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2386 RNA, herein designated VGAM RNA, binds complementarily to one or more host target binding sites located in untranslated regions of VGAM2386 host target RNA, herein designated VGAM HOST TARGET RNA. This complementary binding is due to the fact that the nucleotide sequence of VGAM2386 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2386 RNA, herein designated VGAM RNA, may have a different number of host target binding sites in untranslated regions of a VGAM2386 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2386 RNA, herein designated VGAM RNA, to host target binding sites on VGAM2386 host target RNA, herein designated VGAM HOST TARGET RNA, such as BINDING SITE I, BINDING SITE II and BINDING SITE III, inhibits translation of VGAM2386 host target RNA into VGAM2386 host target protein, herein designated VGAM HOST TARGET PROTEIN. VGAM host target protein is therefore outlined by a broken line.

It is appreciated that VGAM2386 host target gene, herein designated VGAM HOST TARGET GENE, in fact represents a plurality of VGAM2386 host target genes. The mRNA of each one of this plurality of VGAM2386 host target genes comprises one or more host target binding sites, each having a nucleotide sequence which is at least partly complementary to VGAM2386 RNA, herein designated VGAM RNA, and which when bound by VGAM2386 RNA causes inhibition of translation of respective one or more VGAM2386 host target proteins.

It is further appreciated by one skilled in the art that the mode of translational inhibition illustrated by FIG. 1 with specific reference to translational inhibition exerted by VGAM2386 gene, herein designated VGAM GENE, on one or more VGAM2386 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2386 is inhibition of expression of host target genes, as part of a novel viral mechanism of attacking a host. Accordingly, utilities of VGAM2386 include diagnosis, prevention and treatment of viral infection by Human Herpesvirus 4. Specific functions, and accordingly utilities, of VGAM2386 correlate with, and may be deduced from, the identity of the host target genes which VGAM2386 binds and inhibits, and the function of these host target genes, as elaborated hereinbelow.

Nucleotide sequences of the VGAM2386 precursor RNA, herein designated VGAM PRECURSOR RNA, and of the 'diced' VGAM2386 RNA, herein designated VGAM RNA, and a schematic representation of the secondary folding of VGAM2386 folded precursor RNA, herein designated VGAM FOLDED PRECURSOR RNA, of VGAM2386 are further described hereinbelow with reference to Table 1.

Nucleotide sequences of host target binding sites, such as BINDING SITE-I, BINDING SITE-II and BINDING SITE-III of FIG. 1, found on VGAM2386 host target RNA, and schematic representation of the complementarity of each of these host target binding sites to VGAM2386 RNA, herein designated VGAM RNA, are described hereinbelow with reference to Table 2.

As mentioned hereinabove with reference to FIG. 1, a function of VGAM2386 gene, herein designated VGAM is inhibition of expression of VGAM2386 target genes. It is appreciated that specific functions, and accordingly utilities, of VGAM2386 correlate with, and may be deduced from, the identity of the target genes which VGAM2386 binds and inhibits, and the function of these target genes, as elaborated hereinbelow.

ARGBP2 (Accession NM_003603) is a VGAM2386 host target gene. ARGBP2 BINDING SITE is HOST TARGET binding site found in the 5' untranslated region of mRNA encoded by ARGBP2, corresponding to a HOST TARGET binding site such as BINDING SITE I, BINDING SITE II or BINDING SITE III. Table 2 illustrates the complementarity of the nucleotide sequences of ARGBP2 BINDING SITE, designated SEQ ID:9657, to the nucleotide sequence of VGAM2386 RNA, herein designated VGAM RNA, also designated SEQ ID:5097.

A function of VGAM2386 is therefore inhibition of ARGBP2 (Accession NM_003603). Accordingly, utilities of VGAM2386 include diagnosis, prevention and treatment of diseases and clinical conditions associated with ARGBP2. FLJ00058 (Accession XM_086123) is another VGAM2386 host target gene. FLJ00058 BINDING SITE is HOST TARGET binding site found in the 5' untranslated region of mRNA encoded by FLJ00058, corresponding to a HOST TARGET binding site such as BINDING SITE I, BINDING SITE II or BINDING SITE III. Table 2 illustrates the complementarity of the nucleotide sequences of FLJ00058 BINDING SITE, designated SEQ ID:38511, to the nucleotide sequence of VGAM2386 RNA, herein designated VGAM RNA, also designated SEQ ID:5097.

Another function of VGAM2386 is therefore inhibition of FLJ00058 (Accession XM_086123). Accordingly, utilities of VGAM2386 include diagnosis, prevention and treatment of diseases and clinical conditions associated with FLJ00058. IL22R (Accession NM_021258) is another VGAM2386 host target gene. IL22R BINDING SITE is HOST TARGET binding site found in the 3' untranslated region of mRNA encoded by IL22R, corresponding to a HOST TARGET binding site such as BINDING SITE I, BINDING SITE II or BINDING SITE III. Table 2 illustrates the complementarity of the nucleotide sequences of IL22R BINDING SITE, designated SEQ ID:22234, to the nucleotide sequence of VGAM2386 RNA, herein designated VGAM RNA, also designated SEQ ID:5097.

Another function of VGAM2386 is therefore inhibition of IL22R (Accession NM_021258). Accordingly, utilities of VGAM2386 include diagnosis, prevention and treatment of diseases and clinical conditions associated with IL22R. KIAA0748 (Accession NM_014796) is another VGAM2386 host target gene. KIAA0748 BINDING SITE is HOST TARGET binding site found in the 3' untranslated region of mRNA encoded by KIAA0748, corresponding to a HOST TARGET binding site such as BINDING SITE I, BINDING SITE II or BINDING SITE III. Table 2 illustrates the complementarity of the nucleotide sequences of KIAA0748 BINDING SITE, designated SEQ ID:16704, to the nucleotide sequence of VGAM2386 RNA, herein designated VGAM RNA, also designated SEQ ID:5097.

Another function of VGAM2386 is therefore inhibition of KIAA0748 (Accession NM_014796). Accordingly, utilities of VGAM2386 include diagnosis, prevention and treatment of diseases and clinical conditions associated with KIAA0748. LOC147184 (Accession NM_145274) is another VGAM2386 host target gene. LOC147184 BINDING SITE is HOST TARGET binding site found in the 5' untranslated region of mRNA encoded by LOC147184, corresponding to a HOST TARGET binding site such as BINDING SITE I, BINDING SITE II or BINDING SITE III. Table 2 illustrates the complementarity of the nucleotide sequences of LOC147184 BINDING SITE, designated SEQ ID:29788, to the nucleotide sequence of VGAM2386 RNA, herein designated VGAM RNA, also designated SEQ ID:5097.

Another function of VGAM2386 is therefore inhibition of LOC147184 (Accession NM_145274). Accordingly, utilities of VGAM2386 include diagnosis, prevention and treatment of diseases and clinical conditions associated with LOC147184. FIG. 1 further provides a conceptual description of a novel bioinformatically detected viral gene of the present invention, referred to here as Viral Genomic Address Messenger 2387 (VGAM2387) viral gene, which modulates expression of respective host target genes thereof, the function and utility of which host target genes is known in the art.

VGAM2387 is a novel bioinformatically detected regulatory, non protein coding, viral micro RNA (miRNA) gene. The method by which VGAM2387 was detected is described hereinabove with reference to FIGS. 1-8.

VGAM2387 gene, herein designated VGAM GENE, is a viral gene contained in the genome of Human Herpesvirus 4. VGAM2387 host target gene, herein designated VGAM HOST TARGET GENE, is a human gene contained in the human genome.

VGAM2387 gene encodes a VGAM2387 precursor RNA, herein designated VGAM PRECURSOR RNA. Similar to other miRNA genes, and unlike most ordinary genes, VGAM2387 precursor RNA does not encode a protein. A nucleotide sequence identical or highly similar to the nucleotide sequence of VGAM2387 precursor RNA is designated SEQ ID:2373, and is provided hereinbelow with reference to the sequence listing part. Nucleotide sequence SEQ ID:2373 is located at position 7029 relative to the genome of Human Herpesvirus 4.

VGAM2387 precursor RNA folds onto itself, forming VGAM2387 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2387 folded precursor RNA into VGAM2387 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2387 RNA is designated SEQ ID:5098, and is provided hereinbelow with reference to the sequence listing part.

VGAM2387 host target gene, herein designated VGAM HOST TARGET GENE, encodes a corresponding messenger RNA, VGAM2387 host target RNA, herein designated VGAM HOST TARGET RNA. VGAM2387 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2387 RNA, herein designated VGAM RNA, binds complementarily to one or more host target binding sites located in untranslated regions of VGAM2387 host target RNA, herein designated VGAM HOST TARGET RNA. This complementary binding is due to the fact that the nucleotide sequence of VGAM2387 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2387 RNA, herein designated VGAM RNA, may have a different number of host target binding sites in untranslated regions of a VGAM2387 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2387 RNA, herein designated VGAM RNA, to host target binding sites on VGAM2387 host target RNA, herein designated VGAM HOST TARGET RNA, such as BINDING SITE I, BINDING SITE II and BINDING SITE III, inhibits translation of VGAM2387 host target RNA into VGAM2387 host target protein, herein designated VGAM HOST TARGET PROTEIN. VGAM host target protein is therefore outlined by a broken line.

It is appreciated that VGAM2387 host target gene, herein designated VGAM HOST TARGET GENE, in fact represents a plurality of VGAM2387 host target genes. The mRNA of each one of this plurality of VGAM2387 host target genes comprises one or more host target binding sites, each having a nucleotide sequence which is at least partly complementary to VGAM2387 RNA, herein designated VGAM RNA, and which when bound by VGAM2387 RNA causes inhibition of translation of respective one or more VGAM2387 host target proteins.

It is further appreciated by one skilled in the art that the mode of translational inhibition illustrated by FIG. 1 with specific reference to translational inhibition exerted by VGAM2387 gene, herein designated VGAM GENE, on one or more VGAM2387 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2387 is inhibition of expression of host target genes, as part of a novel viral mechanism of attacking a host. Accordingly, utilities of VGAM2387 include diagnosis, prevention and treatment of viral infection by Human Herpesvirus 4. Specific functions, and accordingly utilities, of VGAM2387 correlate with, and may be deduced from, the identity of the host target genes which VGAM2387 binds and inhibits, and the function of these host target genes, as elaborated hereinbelow.

Nucleotide sequences of the VGAM2387 precursor RNA, herein designated VGAM PRECURSOR RNA, and of the 'diced' VGAM2387 RNA, herein designated VGAM RNA, and a schematic representation of the secondary folding of VGAM2387 folded precursor RNA, herein designated VGAM FOLDED PRECURSOR RNA, of VGAM2387 are further described hereinbelow with reference to Table 1.

Nucleotide sequences of host target binding sites, such as BINDING SITE-I, BINDING SITE-II and BINDING SITE-III of FIG. 1, found on VGAM2387 host target RNA, and schematic representation of the complementarity of each of these host target binding sites to VGAM2387 RNA, herein designated VGAM RNA, are described hereinbelow with reference to Table 2.

As mentioned hereinabove with reference to FIG. 1, a function of VGAM2387 gene, herein designated VGAM is inhibition of expression of VGAM2387 target genes. It is appreciated that specific functions, and accordingly utilities, of VGAM2387 correlate with, and may be deduced from, the identity of the target genes which VGAM2387 binds and inhibits, and the function of these target genes, as elaborated hereinbelow.

ATPase, Ca++ Transporting, Ubiquitous (ATP2A3, Accession NM_005173) is a VGAM2387 host target gene. ATP2A3 BINDING SITE is HOST TARGET binding site found in the 3' untranslated region of mRNA encoded by ATP2A3, corresponding to a HOST TARGET binding site such as BINDING SITE I, BINDING SITE II or BINDING SITE III. Table 2 illustrates the complementarity of the nucleotide sequences of ATP2A3 BINDING SITE, designated SEQ ID:11673, to the nucleotide sequence of VGAM2387 RNA, herein designated VGAM RNA, also designated SEQ ID:5098.

A function of VGAM2387 is therefore inhibition of ATPase, Ca++ Transporting, Ubiquitous (ATP2A3, Accession NM_005173). Accordingly, utilities of VGAM2387 include diagnosis, prevention and treatment of diseases and clinical conditions associated with ATP2A3. Oculocerebrorenal Syndrome of Lowe (OCRL, Accession NM_000276) is another VGAM2387 host target gene. OCRL BINDING SITE1 and OCRL BINDING SITE2 are HOST TARGET binding sites found in untranslated regions of mRNA encoded by OCRL, corresponding to HOST TARGET binding sites such as BINDING SITE I, BINDING SITE II or BINDING SITE III. Table 2 illustrates the complementarity of the nucleotide sequences of OCRL BINDING SITE1 and OCRL BINDING SITE2, designated SEQ ID:5817 and SEQ ID:7304 respectively, to the nucleotide sequence of VGAM2387 RNA, herein designated VGAM RNA, also designated SEQ ID:5098.

Another function of VGAM2387 is therefore inhibition of Oculocerebrorenal Syndrome of Lowe (OCRL, Accession NM_000276). Accordingly, utilities of VGAM2387 include diagnosis, prevention and treatment of diseases and clinical conditions associated with OCRL. Cdc42 Guanine Nucleotide Exchange Factor (GEF) 9 (ARHGEF9, Accession NM_015185) is another VGAM2387 host target gene. ARHGEF9 BINDING SITE is HOST TARGET binding site found in the 5' untranslated region of mRNA encoded by ARHGEF9, corresponding to a HOST TARGET binding site such as BINDING SITE I, BINDING SITE II or BINDING SITE III. Table 2 illustrates the complementarity of the nucleotide sequences of ARHGEF9 BINDING SITE, designated SEQ ID:17538, to the nucleotide sequence of VGAM2387 RNA, herein designated VGAM RNA, also designated SEQ ID:5098.

Another function of VGAM2387 is therefore inhibition of Cdc42 Guanine Nucleotide Exchange Factor (GEF) 9 (ARHGEF9, Accession NM_015185). Accordingly, utilities of VGAM2387 include diagnosis, prevention and treatment of diseases and clinical conditions associated with ARHGEF9. Nudix (nucleoside diphosphate linked moiety X)-type Motif 12 (NUDT12, Accession NM_031438) is another VGAM2387 host target gene. NUDT12 BINDING SITE is HOST TARGET binding site found in the 3' untranslated region of mRNA encoded by NUDT12, corresponding to a HOST TARGET binding site such as BINDING SITE I, BINDING SITE II or BINDING SITE III. Table 2 illustrates the complementarity of the nucleotide sequences of NUDT12 BINDING SITE, designated SEQ ID:25447, to the nucleotide sequence of VGAM2387 RNA, herein designated VGAM RNA, also designated SEQ ID:5098.

Another function of VGAM2387 is therefore inhibition of Nudix (nucleoside diphosphate linked moiety X)-type Motif 12 (NUDT12, Accession NM_031438). Accordingly, utilities of VGAM2387 include diagnosis, prevention and treatment of diseases and clinical conditions associated with NUDT12. UBE3B (Accession XM_084941) is another VGAM2387 host target gene. UBE3B BINDING SITE is HOST TARGET binding site found in the 3" untranslated region of mRNA encoded by UBE3B, corresponding to a HOST TARGET binding site such as BINDING SITE I, BINDING SITE II or BINDING SITE III. Table 2 illustrates the complementarity of the nucleotide sequences of UBE3B BINDING SITE, designated SEQ ID:37772, to the nucleotide sequence of VGAM2387 RNA, herein designated VGAM RNA, also designated SEQ ID:5098.

Another function of VGAM2387 is therefore inhibition of UBE3B (Accession XM_084941). Accordingly, utilities of VGAM2387 include diagnosis, prevention and treatment of diseases and clinical conditions associated with UBE3B. LOC149506 (Accession XM_097661) is another VGAM2387 host target gene. LOC149506 BINDING SITE is HOST TARGET binding site found in the 3' untranslated region of mRNA encoded by LOC149506, corresponding to a HOST TARGET binding site such as BINDING SITE I, BINDING SITE II or BINDING SITE III. Table 2 illustrates the complementarity of the nucleotide sequences of LOC149506 BINDING SITE, designated SEQ ID:41002, to the nucleotide sequence of VGAM2387 RNA, herein designated VGAM RNA, also designated SEQ ID:5098.

Another function of VGAM2387 is therefore inhibition of LOC149506 (Accession XM_097661). Accordingly, utilities of VGAM2387 include diagnosis, prevention and treatment of diseases and clinical conditions associated with LOC149506. LOC153711 (Accession XM_098419) is another VGAM2387 host target gene. LOC153711 BINDING SITE is HOST TARGET binding site found in the 3' untranslated region of mRNA encoded by LOC153711, corresponding to a HOST TARGET binding site such as BINDING SITE I, BINDING SITE II or BINDING SITE III. Table 2 illustrates the complementarity of the nucleotide sequences of LOC153711 BINDING SITE, designated SEQ ID:41666, to the nucleotide sequence of VGAM2387 RNA, herein designated VGAM RNA, also designated SEQ ID:5098.

Another function of VGAM2387 is therefore inhibition of LOC153711 (Accession XM_098419). Accordingly, utilities of VGAM2387 include diagnosis, prevention and treatment of diseases and clinical conditions associated with LOC153711. LOC253912 (Accession XM_173222) is another VGAM2387 host target gene. LOC253912 BINDING SITE is HOST TARGET binding site found in the 3' untranslated region of mRNA encoded by LOC253912, corresponding to a HOST TARGET binding site such as BINDING SITE I, BINDING SITE II or BINDING SITE III. Table 2 illustrates the complementarity of the nucleotide sequences of LOC253912 BINDING SITE, designated SEQ ID:46483, to the nucleotide sequence of VGAM2387 RNA, herein designated VGAM RNA, also designated SEQ ID:5098.

Another function of VGAM2387 is therefore inhibition of LOC253912 (Accession XM_173222). Accordingly, utilities of VGAM2387 include diagnosis, prevention and treatment of diseases and clinical conditions associated with LOC253912. LOC255106 (Accession XM_170805) is another VGAM2387 host target gene. LOC255106 BINDING SITE is HOST TARGET binding site found in the 5' untranslated region of mRNA encoded by LOC255106, corresponding to a HOST TARGET binding site such as BINDING SITE I, BINDING SITE II or BINDING SITE III. Table 2 illustrates the complementarity of the nucleotide sequences of LOC255106 BINDING SITE, designated SEQ ID:45570, to the nucleotide sequence of VGAM2387 RNA, herein designated VGAM RNA, also designated SEQ ID:5098.

Another function of VGAM2387 is therefore inhibition of LOC255106 (Accession XM_170805). Accordingly, utilities of VGAM2387 include diagnosis, prevention and treatment of diseases and clinical conditions associated with LOC255106. LOC90917 (Accession XM_034861) is another VGAM2387 host target gene. LOC90917 BINDING SITE is HOST TARGET binding site found in the 3' untranslated region of mRNA encoded by LOC90917, corresponding to a HOST TARGET binding site such as BINDING SITE I, BINDING SITE II or BINDING SITE III. Table 2 illustrates the complementarity of the nucleotide sequences of LOC90917 BINDING SITE, designated SEQ ID:32163, to the nucleotide sequence of VGAM2387 RNA, herein designated VGAM RNA, also designated SEQ ID:5098.

Another function of VGAM2387 is therefore inhibition of LOC90917 (Accession XM_034861). Accordingly, utilities of VGAM2387 include diagnosis, prevention and treatment of diseases and clinical conditions associated with LOC90917. FIG. 1 further provides a conceptual description of a novel bioinformatically detected viral gene of the present invention, referred to here as Viral Genomic Address Messenger 2388 (VGAM2388) viral gene, which modulates expression of respective host target genes thereof, the function and utility of which host target genes is known in the art.

VGAM2388 is a novel bioinformatically detected regulatory, non protein coding, viral micro RNA (miRNA) gene. The method by which VGAM2388 was detected is described hereinabove with reference to FIGS. 1-8.

VGAM2388 gene, herein designated VGAM GENE, is a viral gene contained in the genome of Human Herpesvirus 4. VGAM2388 host target gene, herein designated VGAM HOST TARGET GENE, is a human gene contained in the human genome.

VGAM2388 gene encodes a VGAM2388 precursor RNA, herein designated VGAM PRECURSOR RNA. Similar to other miRNA genes, and unlike most ordinary genes, VGAM2388 precursor RNA does not encode a protein. A nucleotide sequence identical or highly similar to the nucleotide sequence of VGAM2388 precursor RNA is designated SEQ ID:2374, and is provided hereinbelow with reference to the sequence listing part. Nucleotide sequence SEQ ID:2374 is located at position 55246 relative to the genome of Human Herpesvirus 4.

VGAM2388 precursor RNA folds onto itself, forming VGAM2388 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2388 folded precursor RNA into VGAM2388 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2388 RNA is designated SEQ ID:5099, and is provided hereinbelow with reference to the sequence listing part.

VGAM2388 host target gene, herein designated VGAM HOST TARGET GENE, encodes a corresponding messenger RNA, VGAM2388 host target RNA, herein designated VGAM HOST TARGET RNA. VGAM2388 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2388 RNA, herein designated VGAM RNA, binds complementarily to one or more host target binding sites located in untranslated regions of VGAM2388 host target RNA, herein designated VGAM HOST TARGET RNA. This complementary binding is due to the fact that the nucleotide sequence of VGAM2388 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2388 RNA, herein designated VGAM RNA, may have a different number of host target binding sites in untranslated regions of a VGAM2388 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2388 RNA, herein designated VGAM RNA, to host target binding sites on VGAM2388 host target RNA, herein designated VGAM HOST TARGET RNA, such as BINDING SITE I, BINDING SITE II and BINDING SITE III, inhibits translation of VGAM2388 host target RNA into VGAM2388 host target protein, herein designated VGAM HOST TARGET PROTEIN. VGAM host target protein is therefore outlined by a broken line.

It is appreciated that VGAM2388 host target gene, herein designated VGAM HOST TARGET GENE, in fact represents a plurality of VGAM2388 host target genes. The mRNA of each one of this plurality of VGAM2388 host target genes comprises one or more host target binding sites, each having a nucleotide sequence which is at least partly complementary to VGAM2388 RNA, herein designated VGAM RNA, and which when bound by VGAM2388 RNA causes inhibition of translation of respective one or more VGAM2388 host target proteins.

It is further appreciated by one skilled in the art that the mode of translational inhibition illustrated by FIG. 1 with specific reference to translational inhibition exerted by VGAM2388 gene, herein designated VGAM GENE, on one or more VGAM2388 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2388 is inhibition of expression of host target genes, as part of a novel viral mechanism of attacking a host. Accordingly, utilities of VGAM2388 include diagnosis, prevention and treatment of viral infection by Human Herpesvirus 4. Specific functions, and accordingly utilities, of VGAM2388 correlate with, and may be deduced from, the identity of the host target genes which VGAM2388 binds and inhibits, and the function of these host target genes, as elaborated hereinbelow.

Nucleotide sequences of the VGAM2388 precursor RNA, herein designated VGAM PRECURSOR RNA, and of the 'diced' VGAM2388 RNA, herein designated VGAM RNA, and a schematic representation of the secondary folding of VGAM2388 folded precursor RNA, herein designated VGAM FOLDED PRECURSOR RNA, of VGAM2388 are further described hereinbelow with reference to Table 1.

Nucleotide sequences of host target binding sites, such as BINDING SITE-I, BINDING SITE-II and BINDING SITE-III of FIG. 1, found on VGAM2388 host target RNA, and schematic representation of the complementarity of each of these host target binding sites to VGAM2388 RNA, herein designated VGAM RNA, are described hereinbelow with reference to Table 2.

As mentioned hereinabove with reference to FIG. 1, a function of VGAM2388 gene, herein designated VGAM is inhibition of expression of VGAM2388 target genes. It is appreciated that specific functions, and accordingly utilities, of VGAM2388 correlate with, and may be deduced from, the identity of the target genes which VGAM2388 binds and inhibits, and the function of these target genes, as elaborated hereinbelow.

Stearoyl-CoA Desaturase (delta-9-desaturase) (SCD, Accession NM_005063) is a VGAM2388 host target gene. SCD BINDING SITE is HOST TARGET binding site found in the 3' untranslated region of mRNA encoded by SCD, corresponding to a HOST TARGET binding site such as BINDING SITE I, BINDING SITE II or BINDING SITE III. Table 2 illustrates the complementarity of the nucleotide sequences of SCD BINDING SITE, designated SEQ ID:11492, to the nucleotide sequence of VGAM2388 RNA, herein designated VGAM RNA, also designated SEQ ID:5099.

A function of VGAM2388 is therefore inhibition of Stearoyl-CoA Desaturase (delta-9-desaturase) (SCD, Accession NM_005063), a gene which functions in the synthesis of unsaturated fatty acids. Accordingly, utilities of VGAM2388 include diagnosis, prevention and treatment of diseases and clinical conditions associated with SCD. The function of SCD and its association with various diseases and clinical conditions, has been established by previous studies, as described hereinabove with reference to VGAM314. Tripartite Motif-containing 9 (TRIM9, Accession NM_052978) is another VGAM2388 host target gene. TRIM9 BINDING SITE is HOST TARGET binding site found in the 3' untranslated region of mRNA encoded by TRIM9, corresponding to a HOST TARGET binding site such as BINDING SITE I, BINDING SITE II or BINDING SITE III. Table 2 illustrates the complementarity of the nucleotide sequences of TRIM9 BINDING SITE, designated SEQ ID:27552, to the nucleotide sequence of VGAM2388 RNA, herein designated VGAM RNA, also designated SEQ ID:5099.

Another function of VGAM2388 is therefore inhibition of Tripartite Motif-containing 9 (TRIM9, Accession NM_052978), a gene which may function as a positive regulator for mannosylphosphate transferase and is required to mediate mannosylphosphate transfer in both the core and outer chain portions of n-linked. oligosaccharides. Accordingly, utilities of VGAM2388 include diagnosis, prevention and treatment of diseases and clinical conditions associated with TRIM9. The function of TRIM9 and its association with various diseases and clinical conditions, has been established by previous studies, as described hereinabove with reference to VGAM74. FLJ12604 (Accession XM_035022) is another VGAM2388 host target gene. FLJ12604 BINDING SITE is HOST TARGET binding site found in the 3' untranslated region of mRNA encoded by FLJ12604, corresponding to a HOST TARGET binding site such as BINDING SITE I, BINDING SITE II or BINDING SITE III. Table 2 illustrates the complementarity of the nucleotide sequences of FLJ12604 BINDING SITE, designated SEQ ID:32192, to the nucleotide sequence of VGAM2388 RNA, herein designated VGAM RNA, also designated SEQ ID:5099.

Another function of VGAM2388 is therefore inhibition of FLJ12604 (Accession XM_035022). Accordingly, utilities of VGAM2388 include diagnosis, prevention and treatment of diseases and clinical conditions associated with FLJ12604. FLJ13162 (Accession NM_025002) is another VGAM2388 host target gene. FLJ13162 BINDING SITE is HOST TARGET binding site found in the 3' untranslated region of mRNA encoded by FLJ13162, corresponding to a HOST TARGET binding site such as BINDING SITE I, BINDING SITE II or BINDING SITE III. Table 2 illustrates the complementarity of the nucleotide sequences of FLJ13162 BIND- ING SITE, designated SEQ ID:24574, to the nucleotide sequence of VGAM2388 RNA, herein designated VGAM RNA, also designated SEQ ID:5099.

Another function of VGAM2388 is therefore inhibition of FLJ13162 (Accession NM_025002). Accordingly, utilities of VGAM2388 include diagnosis, prevention and treatment of diseases and clinical conditions associated with FLJ13162. LOC145474 (Accession XM_085147) is another VGAM2388 host target gene. LOC145474 BINDING SITE is HOST TARGET binding site found in the 5' untranslated region of mRNA encoded by LOC145474, corresponding to a HOST TARGET binding site such as BINDING SITE I, BINDING SITE II or BINDING SITE III. Table 2 illustrates the complementarity of the nucleotide sequences of LOC145474 BINDING SITE, designated SEQ ID:37869, to the nucleotide sequence of VGAM2388 RNA, herein designated VGAM RNA, also designated SEQ ID:5099.

Another function of VGAM2388 is therefore inhibition of LOC145474 (Accession XM_085147). Accordingly, utilities of VGAM2388 include diagnosis, prevention and treatment of diseases and clinical conditions associated with LOC145474. FIG. 1 further provides a conceptual description of a novel bioinformatically detected viral gene of the present invention, referred to here as Viral Genomic Address Messenger 2389 (VGAM2389) viral gene, which modulates expression of respective host target genes thereof, the function and utility of which host target genes is known in the art.

VGAM2389 is a novel bioinformatically detected regulatory, non protein coding, viral micro RNA (miRNA) gene. The method by which VGAM2389 was detected is described hereinabove with reference to FIGS. 1-8.

VGAM2389 gene, herein designated VGAM GENE, is a viral gene contained in the genome of Goatpox Virus. VGAM2389 host target gene, herein designated VGAM HOST TARGET GENE, is a human gene contained in the human genome.

VGAM2389 gene encodes a VGAM2389 precursor RNA, herein designated VGAM PRECURSOR RNA. Similar to other miRNA genes, and unlike most ordinary genes, VGAM2389 precursor RNA does not encode a protein. A nucleotide sequence identical or highly similar to the nucleotide sequence of VGAM2389 precursor RNA is designated SEQ ID:2375, and is provided hereinbelow with reference to the sequence listing part. Nucleotide sequence SEQ ID:2375 is located at position 19516 relative to the genome of Goatpox Virus.

VGAM2389 precursor RNA folds onto itself, forming VGAM2389 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2389 folded precursor RNA into VGAM2389 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 41%) nucleotide sequence of VGAM2389 RNA is designated SEQ ID:5100, and is provided hereinbelow with reference to the sequence listing part.

VGAM2389 host target gene, herein designated VGAM HOST TARGET GENE, encodes a corresponding messenger RNA, VGAM2389 host target RNA, herein designated VGAM HOST TARGET RNA. VGAM2389 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2389 RNA, herein designated VGAM RNA, binds complementarily to one or more host target binding sites located in untranslated regions of VGAM2389 host target RNA, herein designated VGAM HOST TARGET RNA. This complementary binding is due to the fact that the nucleotide sequence of VGAM2389 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2389 RNA, herein designated VGAM RNA, may have a different number of host target binding sites in untranslated regions of a VGAM2389 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2389 RNA, herein designated VGAM RNA, to host target binding sites on VGAM2389 host target RNA, herein designated VGAM HOST TARGET RNA, such as BINDING SITE I, BINDING SITE II and BINDING SITE III, inhibits translation of VGAM2389 host target RNA into VGAM2389 host target protein, herein designated VGAM HOST TARGET PROTEIN. VGAM host target protein is therefore outlined by a broken line.

It is appreciated that VGAM2389 host target gene, herein designated VGAM HOST TARGET GENE, in fact represents a plurality of VGAM2389 host target genes. The mRNA of each one of this plurality of VGAM2389 host target genes comprises one or more host target binding sites, each having a nucleotide sequence which is at least partly complementary to VGAM2389 RNA, herein designated VGAM RNA, and which when bound by VGAM2389 RNA causes inhibition of translation of respective one or more VGAM2389 host target proteins.

It is further appreciated by one skilled in the art that the mode of translational inhibition illustrated by FIG. 1 with specific reference to translational inhibition exerted by VGAM2389 gene, herein designated VGAM GENE, on one or more VGAM2389 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM2389 is inhibition of expression of host target genes, as part of a novel viral mechanism of attacking a host. Accordingly, utilities of VGAM2389 include diagnosis, prevention and treatment of viral infection by Goatpox Virus. Specific functions, and accordingly utilities, of VGAM2389 corre region of mRNA encoded by PURG, corresponding to a HOST TARGET binding site such as BINDING SITE I, BINDING SITE II or BINDING SITE III. Table 2 illustrates the complementarity of the nucleotide sequences of PURG BINDING SITE, designated SEQ ID:15005, to the nucleotide sequence of VGAM2389 RNA, herein designated VGAM RNA, also designated SEQ ID:5100.

Another function of VGAM2389 is therefore inhibition of PURG (Accession NM_013357). Accordingly, utilities of VGAM2389 include diagnosis, prevention and treatment of diseases and clinical conditions associated with PURG. LOC137362 (Accession XM_059905) is another VGAM2389 host target gene. LOC137362 BINDING SITE is HOST TARGET binding site found in the 3' untranslated region of mRNA encoded by LOC137362, corresponding to a HOST TARGET binding site such as BINDING SITE I, BINDING SITE II or BINDING SITE III. Table 2 illustrates the complementarity of the nucleotide sequences of LOC137362 BINDING SITE, designated SEQ ID:37104, to the nucleotide sequence of VGAM2389 RNA, herein designated VGAM RNA, also designated SEQ ID:5100.

Another function of VGAM2389 is therefore inhibition of LOC137362 (Accession XM_059905). Accordingly, utilities of VGAM2389 include diagnosis, prevention and treatment of diseases and clinical conditions associated with LOC137362. LOC203025 (Accession XM_114610) is another VGAM2389 host target gene. LOC203025 BINDING SITE is HOST TARGET binding site found in the 3' untranslated region of mRNA encoded by LOC203025, corresponding to a HOST TARGET binding site such as BINDING SITE I, BINDING SITE II or BINDING SITE III. Table 2 illustrates the complementarity of the nucleotide sequences of LOC203025 BINDING SITE, designated SEQ ID:42999, to the nucleotide sequence of VGAM2389 RNA, herein designated VGAM RNA, also designated SEQ ID:5100.

Another function of VGAM2389 is therefore inhibition of LOC203025 (Accession XM_114610). Accordingly, utilities of VGAM2389 include diagnosis, prevention and treatment of diseases and clinical conditions associated with LOC203025. FIG. 1 further provides a conceptual description of a novel bioinformatically detected viral gene of the present invention, referred to here as Viral Genomic Address Messenger 2390 (VGAM2390) viral gene, which modulates expression of respective host target genes thereof, the function and utility of which host target genes is known in the art.

VGAM2390 is a novel bioinformatically detected regulatory, non protein coding, viral micro RNA (miRNA) gene. The method by which VGAM2390 was detected is described hereinabove with reference to FIGS. 1-8.

VGAM2390 gene, herein designated VGAM GENE, is a viral gene contained in the genome of Goatpox Virus. VGAM2390 host target gene, herein designated VGAM HOST TARGET GENE, is a human gene contained in the human genome.

VGAM2390 gene encodes a VGAM2390 precursor RNA, herein designated VGAM PRECURSOR RNA. Similar to other miRNA genes, and unlike most ordinary genes, VGAM2390 precursor RNA does not encode a protein. A nucleotide sequence identical or highly similar to the nucleotide sequence of VGAM2390 precursor RNA is designated SEQ ID:2376, and is provided hereinbelow with reference to the sequence listing part. Nucleotide sequence SEQ ID:2376 is located at position 85371 relative to the genome of Goatpox Virus.

VGAM2390 precursor RNA folds onto itself, forming VGAM2390 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2390 folded precursor RNA into VGAM2390 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2390 RNA is designated SEQ ID:5101, and is provided hereinbelow with reference to the sequence listing part.

VGAM2390 host target gene, herein designated VGAM HOST TARGET GENE, encodes a corresponding messenger RNA, VGAM2390 host target RNA, herein designated VGAM HOST TARGET RNA. VGAM2390 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2390 RNA, herein designated VGAM RNA, binds complementarily to one or more host target binding sites located in untranslated regions of VGAM2390 host target RNA, herein designated VGAM HOST TARGET RNA. This complementary binding is due to the fact that the nucleotide sequence of VGAM2390 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2390 RNA, herein designated VGAM RNA, may have a different number of host target binding sites in untranslated regions of a VGAM2390 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2390 RNA, herein designated VGAM RNA, to host target binding sites on VGAM2390 host target RNA, herein designated VGAM HOST TARGET RNA, such as BINDING SITE I, BINDING SITE II and BINDING SITE III, inhibits translation of VGAM2390 host target RNA into VGAM2390 host target protein, herein designated VGAM HOST TARGET PROTEIN. VGAM host target protein is therefore outlined by a broken line.

It is appreciated that VGAM2390 host target gene, herein designated VGAM HOST TARGET GENE, in fact represents a plurality of VGAM2390 host target genes. The mRNA of each one of this plurality of VGAM2390 host target genes comprises one or more host target binding sites, each having a nucleotide sequence which is at least partly complementary to VGAM2390 RNA, herein designated VGAM RNA, and which when bound by VGAM2390 RNA causes inhibition of translation of respective one or more VGAM2390 host target proteins.

It is further appreciated by one skilled in the art that the mode of translational inhibition illustrated by FIG. 1 with specific reference to translational inhibition exerted by VGAM2390 gene, herein designated VGAM GENE, on one or more VGAM2390 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2390 is inhibition of expression of host target genes, as part of a novel viral mechanism of attacking a host. Accordingly, utilities of VGAM2390 include diagnosis, prevention and treatment of viral infection by Goatpox Virus. Specific functions, and accordingly utilities, of VGAM2390 correlate with, and may be deduced from, the identity of the host target genes which VGAM2390 binds and inhibits, and the function of these host target genes, as elaborated hereinbelow.

Nucleotide sequences of the VGAM2390 precursor RNA, herein designated VGAM PRECURSOR RNA, and of the 'diced' VGAM2390 RNA, herein designated VGAM RNA, and a schematic representation of the secondary folding of VGAM2390 folded precursor RNA, herein designated VGAM FOLDED PRECURSOR RNA, of VGAM2390 are further described hereinbelow with reference to Table 1.

Nucleotide sequences of host target binding sites, such as BINDING SITE-I, BINDING SITE-II and BINDING SITE-III of FIG. 1, found on VGAM2390 host target RNA, and schematic representation of the complementarity of each of these host target binding sites to VGAM2390 RNA, herein designated VGAM RNA, are described hereinbelow with reference to Table 2.

As mentioned hereinabove with reference to FIG. 1, a function of VGAM2390 gene, herein designated VGAM is inhibition of expression of VGAM2390 target genes. It is appreciated that specific functions, and accordingly utilities, of VGAM2390 correlate with, and may be deduced from, the identity of the target genes which VGAM2390 binds and inhibits, and the function of these target genes, as elaborated hereinbelow.

Glutamate Decarboxylase 1 (brain, 67 kDa) (GAD1, Accession NM_000817) is a VGAM2390 host target gene. GAD1 BINDING SITE is HOST TARGET binding site found in the 3' untranslated region of mRNA encoded by GAD1, corresponding to a HOST TARGET binding site such as BINDING SITE I, BINDING SITE II or BINDING SITE III. Table 2 illustrates the complementarity of the nucleotide sequences of GAD1 BINDING SITE, designated SEQ ID:6478, to the nucleotide sequence of VGAM2390 RNA, herein designated VGAM RNA, also designated SEQ ID:5101.

A function of VGAM2390 is therefore inhibition of Glutamate Decarboxylase 1 (brain, 67 kDa) (GAD1, Accession NM_000817), a gene which catalyzes the conversion of glutamic acid to gamma-aminobutyric acid. Accordingly, utilities of VGAM2390 include diagnosis, prevention and treatment of diseases and clinical conditions associated with GAD1. The function of GAD1 and its association with various diseases and clinical conditions, has been established by previous studies, as described hereinabove with reference to VGAM691. UDP-N-acetyl-alpha-D-galactosamine:(N-acetylneuraminyl)-galactosylglucosylceramide N-acetylgalactosaminyltransferase (GalNAc-T) (GALGT, Accession NM_001478) is another VGAM2390 host target gene. GALGT BINDING SITE is HOST TARGET binding site found in the 3' untranslated region of mRNA encoded by GALGT, corresponding to a HOST TARGET binding site such as BINDING SITE I, BINDING SITE II or BINDING SITE III. Table 2 illustrates the complementarity of the nucleotide sequences of GALGT BINDING SITE, designated SEQ ID:7211, to the nucleotide sequence of VGAM2390 RNA, herein designated VGAM RNA, also designated SEQ ID:5101.

Another function of VGAM2390 is therefore inhibition of UDP-N-acetyl-alpha-D-galactosamine:(N-acetylneuraminyl)-galactosylglucosylceramide N-acetylgalactosaminyltransferase (GalNAc-T) (GALGT, Accession NM_001478), a gene which is involved in the biosynthesis of gangliosides gm2, gd2 and ga2. Accordingly, utilities of VGAM2390 include diagnosis, prevention and treatment of diseases and clinical conditions associated with GALGT. The function of GALGT and its association with various diseases and clinical conditions, has been established by previous studies, as described hereinabove with reference to VGAM179. DKFZp761H2121 (Accession NM_138339) is another VGAM2390 host target gene. DKFZp761H2121 BINDING SITE is HOST TARGET binding site found in the 5' untranslated region of mRNA encoded by DKFZp761H2121, corresponding to a HOST TARGET binding site such as BINDING SITE I, BINDING SITE II or BINDING SITE III. Table 2 illustrates the complementarity of the nucleotide sequences of DKFZp761H2121 BINDING SITE, designated SEQ ID:28737, to the nucleotide sequence of VGAM2390 RNA, herein designated VGAM RNA, also designated SEQ ID:5101.

Another function of VGAM2390 is therefore inhibition of DKFZp761H2121 (Accession NM_138339). Accordingly, utilities of VGAM2390 include diagnosis, prevention and treatment of diseases and clinical conditions associated with DKFZp761H2121. EphA7 (EPHA7, Accession NM_004440) is another VGAM2390 host target gene. EPHA7 BINDING SITE is HOST TARGET binding site found in the 3' untranslated region of mRNA encoded by EPHA7, corresponding to a HOST TARGET binding site such as BINDING SITE I, BINDING SITE II or BINDING SITE III. Table 2 illustrates the complementarity of the nucleotide sequences of EPHA7 BINDING SITE, designated SEQ ID:10723, to the nucleotide sequence of VGAM2390 RNA, herein designated VGAM RNA, also designated SEQ ID:5101.

Another function of VGAM2390 is therefore inhibition of EphA7 (EPHA7, Accession NM_004440). Accordingly, utilities of VGAM2390 include diagnosis, prevention and treatment of diseases and clinical conditions associated with EPHA7. KIAA1655 (Accession XM_039442) is another VGAM2390 host target gene. KIAA1655 BINDING SITE is HOST TARGET binding site found in the 5' untranslated region of mRNA encoded by KIAA1655, corresponding to a HOST TARGET binding site such as BINDING SITE I, BINDING SITE II or BINDING SITE III. Table 2 illustrates the complementarity of the nucleotide sequences of KIAA1655 BINDING SITE, designated SEQ ID:33089, to the nucleotide sequence of VGAM2390 RNA, herein designated VGAM RNA, also designated SEQ ID:5101.

Another function of VGAM2390 is therefore inhibition of KIAA1655 (Accession XM_039442). Accordingly, utilities of VGAM2390 include diagnosis, prevention and treatment of diseases and clinical conditions associated with KIAA1655. MGC2541 (Accession NM_080670) is another VGAM2390 host target gene. MGC2541 BINDING SITE is HOST TARGET binding site found in the 3' untranslated region of mRNA encoded by MGC2541, corresponding to a HOST TARGET binding site such as BINDING SITE I, BINDING SITE II or BINDING SITE III. Table 2 illustrates the complementarity of the nucleotide sequences of MGC2541 BINDING SITE, designated SEQ ID:27964, to the nucleotide sequence of VGAM2390 RNA, herein designated VGAM RNA, also designated SEQ ID:5101.

Another function of VGAM2390 is therefore inhibition of MGC2541 (Accession NM_080670). Accordingly, utilities of VGAM2390 include diagnosis, prevention and treatment of diseases and clinical conditions associated with MGC2541. Ring Finger Protein 2 (RNF2, Accession NM_007212) is another VGAM2390 host target gene. RNF2 BINDING SITE is HOST TARGET binding site found in the 3' untranslated region of mRNA encoded by RNF2, corresponding to a HOST TARGET binding site such as BINDING SITE I, BINDING SITE II or BINDING SITE III. Table 2 illustrates the complementarity of the nucleotide sequences of RNF2 BINDING SITE, designated SEQ ID:14076, to the nucleotide sequence of VGAM2390 RNA, herein designated VGAM RNA, also designated SEQ ID:5101.

Another function of VGAM2390 is therefore inhibition of Ring Finger Protein 2 (RNF2, Accession NM_007212). Accordingly, utilities of VGAM2390 include diagnosis, prevention and treatment of diseases and clinical conditions associated with RNF2. LOC139770 (Accession XM_060053) is another VGAM2390 host target gene. LOC139770 BINDING SITE is HOST TARGET binding site found in the 3' untranslated region of mRNA encoded by LOC139770, corresponding to a HOST TARGET binding site such as BINDING SITE I, BINDING SITE II or BINDING SITE III. Table 2 illustrates the complementarity of the nucleotide sequences of LOC139770 BINDING SITE, designated SEQ ID:37145, to the nucleotide sequence of VGAM2390 RNA, herein designated VGAM RNA, also designated SEQ ID:5101.

Another function of VGAM2390 is therefore inhibition of LOC139770 (Accession XM_060053). Accordingly, utilities of VGAM2390 include diagnosis, prevention and treatment of diseases and clinical conditions associated with LOC139770. FIG. 1 further provides a conceptual description of a novel bioinformatically detected viral gene of the present invention, referred to here as Viral Genomic Address Messenger 2391 (VGAM2391) viral gene, which modulates expression of respective host target genes thereof, the function and utility of which host target genes is known in the art.

VGAM2391 is a novel bioinformatically detected regulatory, non protein coding, viral micro RNA (miRNA) gene. The method by which VGAM2391 was detected is described hereinabove with reference to FIGS. 1-8.

VGAM2391 gene, herein designated VGAM GENE, is a viral gene contained in the genome of Goatpox Virus. VGAM2391 host target gene, herein designated VGAM HOST TARGET GENE, is a human gene contained in the human genome.

VGAM2391 gene encodes a VGAM2391 precursor RNA, herein designated VGAM PRECURSOR RNA. Similar to other miRNA genes, and unlike most ordinary genes, VGAM2391 precursor RNA does not encode a protein. A nucleotide sequence identical or highly similar to the nucleotide sequence of VGAM2391 precursor RNA is designated SEQ ID:2377, and is provided hereinbelow with reference to the sequence listing part. Nucleotide sequence SEQ ID:2377 is located at position 22657 relative to the genome of Goatpox Virus.

VGAM2391 precursor RNA folds onto itself, forming VGAM2391 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2391 folded precursor RNA into VGAM2391 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 71%) nucleotide sequence of VGAM2391 RNA is designated SEQ ID:5102, and is provided hereinbelow with reference to the sequence listing part.

VGAM2391 host target gene, herein designated VGAM HOST TARGET GENE, encodes a corresponding messenger RNA, VGAM2391 host target RNA, herein designated VGAM HOST TARGET RNA. VGAM2391 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2391 RNA, herein designated VGAM RNA, binds complementarily to one or more host target binding sites located in untranslated regions of VGAM2391 host target RNA, herein designated VGAM HOST TARGET RNA. This complementary binding is due to the fact that the nucleotide sequence of VGAM2391 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2391 RNA, herein designated VGAM RNA, may have a different number of host target binding sites in untranslated regions of a VGAM2391 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2391 RNA, herein designated VGAM RNA, to host target binding sites on VGAM2391 host target RNA, herein designated VGAM HOST TARGET RNA, such as BINDING SITE I, BINDING SITE II and BINDING SITE III, inhibits translation of VGAM2391 host target RNA into VGAM2391 host target protein, herein designated VGAM HOST TARGET PROTEIN. VGAM host target protein is therefore outlined by a broken line.

It is appreciated that VGAM2391 host target gene, herein designated VGAM HOST TARGET GENE, in fact represents a plurality of VGAM2391 host target genes. The mRNA of each one of this plurality of VGAM2391 host target genes comprises one or more host target binding sites, each having a nucleotide sequence which is at least partly complementary to VGAM2391 RNA, herein designated VGAM RNA, and which when bound by VGAM2391 RNA causes inhibition of translation of respective one or more VGAM2391 host target proteins.

It is further appreciated by one skilled in the art that the mode of translational inhibition illustrated by FIG. 1 with specific reference to translational inhibition exerted by VGAM2391 gene, herein designated VGAM GENE, on one or more VGAM2391 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2391 is inhibition of expression of host target genes, as part of a novel viral mechanism of attacking a host. Accordingly, utilities of VGAM2391 include diagnosis, prevention and treatment of viral infection by Goatpox Virus. Specific functions, and accordingly utilities, of VGAM2391 correlate with, and may be deduced from, the identity of the host target genes which VGAM2391 binds and inhibits, and the function of these host target genes, as elaborated hereinbelow.

Nucleotide sequences of the VGAM2391 precursor RNA, herein designated VGAM PRECURSOR RNA, and of the 'diced' VGAM2391 RNA, herein designated VGAM RNA, and a schematic representation of the secondary folding of VGAM2391 folded precursor RNA, herein designated VGAM FOLDED PRECURSOR RNA, of VGAM2391 are further described hereinbelow with reference to Table 1.

Nucleotide sequences of host target binding sites, such as BINDING SITE-I, BINDING SITE-II and BINDING SITE-III of FIG. 1, found on VGAM2391 host target RNA, and schematic representation of the complementarity of each of these host target binding sites to VGAM2391 RNA, herein designated VGAM RNA, are described hereinbelow with reference to Table 2.

As mentioned hereinabove with reference to FIG. 1, a function of VGAM2391 gene, herein designated VGAM is inhibition of expression of VGAM2391 target genes. It is appreciated that specific functions, and accordingly utilities, of VGAM2391 correlate with, and may be deduced from, the identity of the target genes which VGAM2391 binds and inhibits, and the function of these target genes, as elaborated hereinbelow.

LOC91408 (Accession XM_038290) is a VGAM2391 host target gene. LOC91408 BINDING SITE is HOST TARGET binding site found in the 3' untranslated region of mRNA encoded by LOC91408, corresponding to a HOST TARGET binding site such as BINDING SITE I, BINDING SITE II or BINDING SITE III. Table 2 illustrates the complementarity of the nucleotide sequences of LOC91408 BINDING SITE, designated SEQ ID:32790, to the nucleotide sequence of VGAM2391 RNA, herein designated VGAM RNA, also designated SEQ ID:5102.

A function of VGAM2391 is therefore inhibition of LOC91408 (Accession XM_038290). Accordingly, utilities of VGAM2391 include diagnosis, prevention and treatment of diseases and clinical conditions associated with LOC91408. FIG. 1 further provides a conceptual description of a novel bioinformatically detected viral gene of the present invention, referred to here as Viral Genomic Address Messenger 2392 (VGAM2392) viral gene, which modulates expression of respective host target genes thereof, the function and utility of which host target genes is known in the art.

VGAM2392 is a novel bioinformatically detected regulatory, non protein coding, viral micro RNA (miRNA) gene. The method by which VGAM2392 was detected is described hereinabove with reference to FIGS. 1-8.

VGAM2392 gene, herein designated VGAM GENE, is a viral gene contained in the genome of Goatpox Virus. VGAM2392 host target gene, herein designated VGAM HOST TARGET GENE, is a human gene contained in the human genome.

VGAM2392 gene encodes a VGAM2392 precursor RNA, herein designated VGAM PRECURSOR RNA. Similar to other miRNA genes, and unlike most ordinary genes, VGAM2392 precursor RNA does not encode a protein. A nucleotide sequence identical or highly similar to the nucleotide sequence of VGAM2392 precursor RNA is designated SEQ ID:2378, and is provided hereinbelow with reference to the sequence listing part. Nucleotide sequence SEQ ID:2378 is located at position 9075 relative to the genome of Goatpox Virus.

VGAM2392 precursor RNA folds onto itself, forming VGAM2392 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2392 folded precursor RNA into VGAM2392 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM2392 RNA is designated SEQ ID:5103, and is provided hereinbelow with reference to the sequence listing part.

VGAM2392 host target gene, herein designated VGAM HOST TARGET GENE, encodes a corresponding messenger RNA, VGAM2392 host target RNA, herein designated VGAM HOST TARGET RNA. VGAM2392 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2392 RNA, herein designated VGAM RNA, binds complementarily to one or more host target binding sites located in untranslated regions of VGAM2392 host target RNA, herein designated VGAM HOST TARGET RNA. This complementary binding is due to the fact that the nucleotide sequence of VGAM2392 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2392 RNA, herein designated VGAM RNA, may have a different number of host target binding sites in untranslated regions of a VGAM2392 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2392 RNA, herein designated VGAM RNA, to host target binding sites on VGAM2392 host target RNA, herein designated VGAM HOST TARGET RNA, such as BINDING SITE I, BINDING SITE II and BINDING SITE III, inhibits translation of VGAM2392 host target RNA into VGAM2392 host target protein, herein designated VGAM HOST TARGET PROTEIN. VGAM host target protein is therefore outlined by a broken line.

It is appreciated that VGAM2392 host target gene, herein designated VGAM HOST TARGET GENE, in fact represents a plurality of VGAM2392 host target genes. The mRNA of each one of this plurality of VGAM2392 host target genes comprises one or more host target binding sites, each having a nucleotide sequence which is at least partly complementary to VGAM2392 RNA, herein designated VGAM RNA, and which when bound by VGAM2392 RNA causes inhibition of translation of respective one or more VGAM2392 host target proteins.

It is further appreciated by one skilled in the art that the mode of translational inhibition illustrated by FIG. 1 with specific reference to translational inhibition exerted by VGAM2392 gene, herein designated VGAM GENE, on one or more VGAM2392 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2392 is inhibition of expression of host target genes, as part of a novel viral mechanism of attacking a host. Accordingly, utilities of VGAM2392 include diagnosis, prevention and treatment of viral infection by Goatpox Virus. Specific functions, and accordingly utilities, of VGAM2392 correlate with, and may be deduced from, the identity of the host target genes which VGAM2392 binds and inhibits, and the function of these host target genes, as elaborated hereinbelow.

Nucleotide sequences of the VGAM2392 precursor RNA, herein designated VGAM PRECURSOR RNA, and of the 'diced' VGAM2392 RNA, herein designated VGAM RNA, and a schematic representation of the secondary folding of VGAM2392 folded precursor RNA, herein designated VGAM FOLDED PRECURSOR RNA, of VGAM2392 are further described hereinbelow with reference to Table 1.

Nucleotide sequences of host target binding sites, such as BINDING SITE-I, BINDING SITE-II and BINDING SITE-III of FIG. 1, found on VGAM2392 host target RNA, and schematic representation of the complementarity of each of these host target binding sites to VGAM2392 RNA, herein designated VGAM RNA, are described hereinbelow with reference to Table 2.

As mentioned hereinabove with reference to FIG. 1, a function of VGAM2392 gene, herein designated VGAM is inhibition of expression of VGAM2392 target genes. It is appreciated that specific functions, and accordingly utilities, of VGAM2392 correlate with, and may be deduced from, the identity of the target genes which VGAM2392 binds and inhibits, and the function of these target genes, as elaborated hereinbelow.

Gap Junction Protein, Alpha 1, 43 kDa (connexin 43) (GJA1, Accession NM_000165) is a VGAM2392 host target gene. GJA1 BINDING SITE is HOST TARGET binding site found in the 5' untranslated region of mRNA encoded by GJA1, corresponding to a HOST TARGET binding site such as BINDING SITE I, BINDING SITE II or BINDING SITE III. Table 2 illustrates the complementarity of the nucleotide sequences of GJA1 BINDING SITE, designated SEQ ID:5675, to the nucleotide sequence of VGAM2392 RNA, herein designated VGAM RNA, also designated SEQ ID:5103.

A function of VGAM2392 is therefore inhibition of Gap Junction Protein, Alpha 1, 43 kDa (connexin 43) (GJA1, Accession NM_000165), a gene which may act in synchronizing heart contraction and embryonic development. Accordingly, utilities of VGAM2392 include diagnosis, prevention and treatment of diseases and clinical conditions associated with GJA1. The function of GJA1 and its association with various diseases and clinical conditions, has been established by previous studies, as described hereinabove with reference to VGAM341. Retinoblastoma 1 (including osteosarcoma) (RB1, Accession XM_165641) is another VGAM2392 host target gene. RB1 BINDING SITE is HOST TARGET binding site found in the 3' untranslated region of mRNA encoded by RB1, corresponding to a HOST TARGET binding site such as BINDING SITE I, BINDING SITE II or BINDING SITE III. Table 2 illustrates the complementarity of the nucleotide sequences of RB1 BINDING SITE, designated SEQ ID:43703, to the nucleotide sequence of VGAM2392 RNA, herein designated VGAM RNA, also designated SEQ ID:5103.

Another function of VGAM2392 is therefore inhibition of Retinoblastoma 1 (including osteosarcoma) (RB1, Accession XM_165641), a gene which probably acts as a regulator of other genes. Accordingly, utilities of VGAM2392 include diagnosis, prevention and treatment of diseases and clinical conditions associated with RB1. The function of RB1 and its association with various diseases and clinical conditions, has been established by previous studies, as described hereinabove with reference to VGAM795. Ribulose-5-phosphate-3-epimerase (RPE, Accession XM_030834) is another VGAM2392 host target gene. RPE BINDING SITE is HOST TARGET binding site found in the 3" untranslated region of mRNA encoded by RPE, corresponding to a HOST TARGET binding site such as BINDING SITE I, BINDING SITE II or BINDING SITE III. Table 2 illustrates the complementarity of the nucleotide sequences of RPE BINDING SITE, designated SEQ ID:31155, to the nucleotide sequence of VGAM2392 RNA, herein designated VGAM RNA, also designated SEQ ID:5103.

Another function of VGAM2392 is therefore inhibition of Ribulose-5-phosphate-3-epimerase (RPE, Accession XM_030834). Accordingly, utilities of VGAM2392 include diagnosis, prevention and treatment of diseases and clinical conditions associated with RPE. KIAA1078 (Accession XM_036589) is another VGAM2392 host target gene. KIAA1078 BINDING SITE is HOST TARGET binding site found in the 3' untranslated region of mRNA encoded by KIAA1078, corresponding to a HOST TARGET binding site such as BINDING SITE I, BINDING SITE II or BINDING SITE III. Table 2 illustrates the complementarity of the nucleotide sequences of KIAA1078 BINDING SITE, designated SEQ ID:32469, to the nucleotide sequence of VGAM2392 RNA, herein designated VGAM RNA, also designated SEQ ID:5103.

Another function of VGAM2392 is therefore inhibition of KIAA1078 (Accession XM_036589). Accordingly, utilities of VGAM2392 include diagnosis, prevention and treatment of diseases and clinical conditions associated with KIAA1078. RYK Receptor-like Tyrosine Kinase (RYK, Accession XM_093692) is another VGAM2392 host target gene. RYK BINDING SITE is HOST TARGET binding site found in the 5' untranslated region of mRNA encoded by RYK, corresponding to a HOST TARGET binding site such as BINDING SITE I, BINDING SITE II or BINDING SITE III. Table 2 illustrates the complementarity of the nucleotide sequences of RYK BINDING SITE, designated SEQ ID:40205, to the nucleotide sequence of VGAM2392 RNA, herein designated VGAM RNA, also designated SEQ ID:5103.

Another function of VGAM2392 is therefore inhibition of RYK Receptor-like Tyrosine Kinase (RYK, Accession XM_093692). Accordingly, utilities of VGAM2392 include diagnosis, prevention and treatment of diseases and clinical conditions associated with RYK. TBDN100 (Accession NM_025085) is another VGAM2392 host target gene. TBDN100 BINDING SITE is HOST TARGET binding site found in the 3' untranslated region of mRNA encoded by TBDN100, corresponding to a HOST TARGET binding site such as BINDING SITE I, BINDING SITE II or BINDING SITE III. Table 2 illustrates the complementarity of the nucleotide sequences of TBDN100 BINDING SITE, designated SEQ ID:24694, to the nucleotide sequence of VGAM2392 RNA, herein designated VGAM RNA, also designated SEQ ID:5103.

Another function of VGAM2392 is therefore inhibition of TBDN100 (Accession NM_025085). Accordingly, utilities of VGAM2392 include diagnosis, prevention and treatment of diseases and clinical conditions associated with TBDN100. LOC157627 (Accession XM_088347) is another VGAM2392 host target gene. LOC157627 BINDING SITE is HOST TARGET binding site found in the 3' untranslated region of mRNA encoded by LOC157627, corresponding to a HOST TARGET binding site such as BINDING SITE I, BINDING SITE II or BINDING SITE III. Table 2 illustrates the complementarity of the nucleotide sequences of LOC157627 BINDING SITE, designated SEQ ID:39620, to the nucleotide sequence of VGAM2392 RNA, herein designated VGAM RNA, also designated SEQ ID:5103.

Another function of VGAM2392 is therefore inhibition of LOC157627 (Accession XM_088347). Accordingly, utilities of VGAM2392 include diagnosis, prevention and treatment of diseases and clinical conditions associated with LOC157627. FIG. 1 further provides a conceptual description of a novel bioinformatically detected viral gene of the present invention, referred to here as Viral Genomic Address Messenger 2393 (VGAM2393) viral gene, which modulates expression of respective host target genes thereof, the function and utility of which host target genes is known in the art.

VGAM2393 is a novel bioinformatically detected regulatory, non protein coding, viral micro RNA (miRNA) gene. The method by which VGAM2393 was detected is described hereinabove with reference to FIGS. 1-8.

VGAM2393 gene, herein designated VGAM GENE, is a viral gene contained in the genome of Goatpox Virus. VGAM2393 host target gene, herein designated VGAM HOST TARGET GENE, is a human gene contained in the human genome.

VGAM2393 gene encodes a VGAM2393 precursor RNA, herein designated VGAM PRECURSOR RNA. Similar to other miRNA genes, and unlike most ordinary genes, VGAM2393 precursor RNA does not encode a protein. A nucleotide sequence identical or highly similar to the nucleotide sequence of VGAM2393 precursor RNA is designated SEQ ID:2379, and is provided hereinbelow with reference to the sequence listing part. Nucleotide sequence SEQ ID:2379 is located at position 35069 relative to the genome of Goatpox Virus.

VGAM2393 precursor RNA folds onto itself, forming VGAM2393 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2393 folded precursor RNA into VGAM2393 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM2393 RNA is designated SEQ ID:5104, and is provided hereinbelow with reference to the sequence listing part.

VGAM2393 host target gene, herein designated VGAM HOST TARGET GENE, encodes a corresponding messenger RNA, VGAM2393 host target RNA, herein designated VGAM HOST TARGET RNA. VGAM2393 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2393 RNA, herein designated VGAM RNA, binds complementarily to one or more host target binding sites located in untranslated regions of VGAM2393 host target RNA, herein designated VGAM HOST TARGET RNA. This complementary binding is due to the fact that the nucleotide sequence of VGAM2393 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2393 RNA, herein designated VGAM RNA, may have a different number of host target binding sites in untranslated regions of a VGAM2393 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2393 RNA, herein designated VGAM RNA, to host target binding sites on VGAM2393 host target RNA, herein designated VGAM HOST TARGET RNA, such as BINDING SITE I, BINDING SITE II and BINDING SITE III, inhibits translation of VGAM2393 host target RNA into VGAM2393 host target protein, herein designated VGAM HOST TARGET PROTEIN. VGAM host target protein is therefore outlined by a broken line.

It is appreciated that VGAM2393 host target gene, herein designated VGAM HOST TARGET GENE, in fact represents a plurality of VGAM2393 host target genes. The mRNA of each one of this plurality of VGAM2393 host target genes comprises one or more host target binding sites, each having a nucleotide sequence which is at least partly complementary to VGAM2393 RNA, herein designated VGAM RNA, and which when bound by VGAM2393 RNA causes inhibition of translation of respective one or more VGAM2393 host target proteins.

It is further appreciated by one skilled in the art that the mode of translational inhibition illustrated by FIG. 1 with specific reference to translational inhibition exerted by VGAM2393 gene, herein designated VGAM GENE, on one or more VGAM2393 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2393 is inhibition of expression of host target genes, as part of a novel viral mechanism of attacking a host. Accordingly, utilities of VGAM2393 include diagnosis, prevention and treatment of viral infection by Goatpox Virus. Specific functions, and accordingly utilities, of VGAM2393 correlate with, and may be deduced from, the identity of the host target genes which VGAM2393 binds and inhibits, and the function of these host target genes, as elaborated hereinbelow.

Nucleotide sequences of the VGAM2393 precursor RNA, herein designated VGAM PRECURSOR RNA, and of the 'diced' VGAM2393 RNA, herein designated VGAM RNA, and a schematic representation of the secondary folding of VGAM2393 folded precursor RNA, herein designated VGAM FOLDED PRECURSOR RNA, of VGAM2393 are further described hereinbelow with reference to Table 1.

Nucleotide sequences of host target binding sites, such as BINDING SITE-I, BINDING SITE-II and BINDING SITE-III of FIG. 1, found on VGAM2393 host target RNA, and schematic representation of the complementarity of each of these host target binding sites to VGAM2393 RNA, herein designated VGAM RNA, are described hereinbelow with reference to Table 2.

As mentioned hereinabove with reference to FIG. 1, a function of VGAM2393 gene, herein designated VGAM is inhibition of expression of VGAM2393 target genes. It is appreciated that specific functions, and accordingly utilities, of VGAM2393 correlate with, and may be deduced from, the identity of the target genes which VGAM2393 binds and inhibits, and the function of these target genes, as elaborated hereinbelow.

A Disintegrin-like and Metalloprotease (reprolysin type) with Thrombospondin Type 1 Motif, 5 (aggrecanase-2) (ADAMTS5, Accession NM_007038) is a VGAM2393 host target gene. ADAMTS5 BINDING SITE is HOST TARGET binding site found in the 3' untranslated region of mRNA encoded by ADAMTS5, corresponding to a HOST TARGET binding site such as BINDING SITE I, BINDING SITE II or BINDING SITE III. Table 2 illustrates the complementarity of the nucleotide sequences of ADAMTS5 BINDING SITE, designated SEQ ID:13917, to the nucleotide sequence of VGAM2393 RNA, herein designated VGAM RNA, also designated SEQ ID:5104.

A function of VGAM2393 is therefore inhibition of A Disintegrin-like and Metalloprotease (reprolysin type) with Thrombospondin Type 1 Motif, 5 (aggrecanase-2) (ADAMTS5, Accession NM_007038), a gene which cleaves aggrecan, a cartilage proteoglycan, and may be involved in its turnover. Accordingly, utilities of VGAM2393 include diagnosis, prevention and treatment of diseases and clinical conditions associated with ADAMTS5. The function of ADAMTS5 and its association with various diseases and clinical conditions, has been established by previous studies, as described hereinabove with reference to VGAM35. Synovial Sarcoma, X Breakpoint 3 (SSX3, Accession NM_021014) is another VGAM2393 host target gene. SSX3 BINDING SITE is HOST TARGET binding site found in the 3' untranslated region of mRNA encoded by SSX3, corresponding to a HOST TARGET binding site such as BINDING SITE I, BINDING SITE II or BINDING SITE III. Table 2 illustrates the complementarity of the nucleotide sequences of SSX3 BINDING SITE, designated SEQ ID:22002, to the nucleotide sequence of VGAM2393 RNA, herein designated VGAM RNA, also designated SEQ ID:5104.

Another function of VGAM2393 is therefore inhibition of Synovial Sarcoma, X Breakpoint 3 (SSX3, Accession NM_021014), a gene which could act as a modulator of transcription. Accordingly, utilities of VGAM2393 include diagnosis, prevention and treatment of diseases and clinical conditions associated with SSX3. The function of SSX3 and its association with various diseases and clinical conditions, has been established by previous studies, as described hereinabove with reference to VGAM835. LOC144486 (Accession XM_096608) is another VGAM2393 host target gene. LOC144486 BINDING SITE is HOST TARGET binding site found in the 3' untranslated region of mRNA encoded by LOC144486, corresponding to a HOST TARGET binding site such as BINDING SITE I, BINDING SITE II or BINDING SITE III. Table 2 illustrates the complementarity of the nucleotide sequences of LOC144486 BINDING SITE, designated SEQ ID:40416, to the nucleotide sequence of VGAM2393 RNA, herein designated VGAM RNA, also designated SEQ ID:5104.

Another function of VGAM2393 is therefore inhibition of LOC144486 (Accession XM_096608). Accordingly, utilities of VGAM2393 include diagnosis, prevention and treatment of diseases and clinical conditions associated with LOC144486. FIG. 1 further provides a conceptual description of a novel bioinformatically detected viral gene of the present invention, referred to here as Viral Genomic Address Messenger 2394 (VGAM2394) viral gene, which modulates expression of respective host target genes thereof, the function and utility of which host target genes is known in the art.

VGAM2394 is a novel bioinformatically detected regulatory, non protein coding, viral micro RNA (miRNA) gene. The method by which VGAM2394 was detected is described hereinabove with reference to FIGS. 1-8.

VGAM2394 gene, herein designated VGAM GENE, is a viral gene contained in the genome of Goatpox Virus. VGAM2394 host target gene, herein designated VGAM HOST TARGET GENE, is a human gene contained in the human genome.

VGAM2394 gene encodes a VGAM2394 precursor RNA, herein designated VGAM PRECURSOR RNA. Similar to other miRNA genes, and unlike most ordinary genes, VGAM2394 precursor RNA does not encode a protein. A nucleotide sequence identical or highly similar to the nucleotide sequence of VGAM2394 precursor RNA is designated SEQ ID:2380, and is provided hereinbelow with reference to the sequence listing part. Nucleotide sequence SEQ ID:2380 is located at position 149142 relative to the genome of Goatpox Virus.

VGAM2394 precursor RNA folds onto itself, forming VGAM2394 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2394 folded precursor RNA into VGAM2394 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2394 RNA is designated SEQ ID:5105, and is provided hereinbelow with reference to the sequence listing part.

VGAM2394 host target gene, herein designated VGAM HOST TARGET GENE, encodes a corresponding messenger RNA, VGAM2394 host target RNA, herein designated VGAM HOST TARGET RNA. VGAM2394 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2394 RNA, herein designated VGAM RNA, binds complementarily to one or more host target binding sites located in untranslated regions of VGAM2394 host target RNA, herein designated VGAM HOST TARGET RNA. This complementary binding is due to the fact that the nucleotide sequence of VGAM2394 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2394 RNA, herein designated VGAM RNA, may have a different number of host target binding sites in untranslated regions of a VGAM2394 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2394 RNA, herein designated VGAM RNA, to host target binding sites on VGAM2394 host target RNA, herein designated VGAM HOST TARGET RNA, such as BINDING SITE I, BINDING SITE II and BINDING SITE III, inhibits translation of VGAM2394 host target RNA into VGAM2394 host target protein, herein designated VGAM HOST TARGET PROTEIN. VGAM host target protein is therefore outlined by a broken line.

It is appreciated that VGAM2394 host target gene, herein designated VGAM HOST TARGET GENE, in fact represents a plurality of VGAM2394 host target genes. The mRNA of each one of this plurality of VGAM2394 host target genes comprises one or more host target binding sites, each having a nucleotide sequence which is at least partly complementary to VGAM2394 RNA, herein designated VGAM RNA, and which when bound by VGAM2394 RNA causes inhibition of translation of respective one or more VGAM2394 host target proteins.

It is further appreciated by one skilled in the art that the mode of translational inhibition illustrated by FIG. 1 with specific reference to translational inhibition exerted by VGAM2394 gene, herein designated VGAM GENE, on one or more VGAM2394 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2394 is inhibition of expression of host target genes, as part of a novel viral mechanism of attacking a host. Accordingly, utilities of VGAM2394 include diagnosis, prevention and treatment of viral infection by Goatpox Virus. Specific functions, and accordingly utilities, of VGAM2394 correlate with, and may be deduced from, the identity of the host target genes which VGAM2394 binds and inhibits, and the function of these host target genes, as elaborated hereinbelow.

Nucleotide sequences of the VGAM2394 precursor RNA, herein designated VGAM PRECURSOR RNA, and of the 'diced' VGAM2394 RNA, herein designated VGAM RNA, and a schematic representation of the secondary folding of VGAM2394 folded precursor RNA, herein designated VGAM FOLDED PRECURSOR RNA, of VGAM2394 are further described hereinbelow with reference to Table 1.

Nucleotide sequences of host target binding sites, such as BINDING SITE-I, BINDING SITE-II and BINDING SITE-III of FIG. 1, found on VGAM2394 host target RNA, and schematic representation of the complementarity of each of these host target binding sites to VGAM2394 RNA, herein designated VGAM RNA, are described hereinbelow with reference to Table 2.

As mentioned hereinabove with reference to FIG. 1, a function of VGAM2394 gene, herein designated VGAM is inhibition of expression of VGAM2394 target genes. It is appreciated that specific functions, and accordingly utilities, of VGAM2394 correlate with, and may be deduced from, the identity of the target genes which VGAM2394 binds and inhibits, and the function of these target genes, as elaborated hereinbelow.

Ankyrin 1, Erythrocytic (ANK1, Accession NM_020481) is a VGAM2394 host target gene. ANK1 BINDING SITE1 through ANK1 BINDING SITE3 are HOST TARGET binding sites found in untranslated regions of mRNA encoded by ANK1, corresponding to HOST TARGET binding sites such as BINDING SITE I, BINDING SITE II or BINDING SITE III. Table 2 illustrates the complementarity of the nucleotide sequences of ANK1 BINDING SITE1 through ANK1 BINDING SITE3, designated SEQ ID:21734, SEQ ID:21732 and SEQ ID:21733 respectively, to the nucleotide sequence of VGAM2394 RNA, herein designated VGAM RNA, also designated SEQ ID:5105.

A function of VGAM2394 is therefore inhibition of Ankyrin 1, Erythrocytic (ANK1, Accession NM_020481). Accordingly, utilities of VGAM2394 include diagnosis, prevention and treatment of diseases and clinical conditions associated with ANK1. Doublesex and Mab-3 Related Transcription Factor 1 (DMRT1, Accession NM_021951) is another VGAM2394 host target gene. DMRT1 BINDING SITE is HOST TARGET binding site found in the 3' untranslated region of mRNA encoded by DMRT1, corresponding to a HOST TARGET binding site such as BINDING SITE I, BINDING SITE II or BINDING SITE III. Table 2 illustrates the complementarity of the nucleotide sequences of DMRT1 BINDING SITE, designated SEQ ID:22479, to the nucleotide sequence of VGAM2394 RNA, herein designated VGAM RNA, also designated SEQ ID:5105.

Another function of VGAM2394 is therefore inhibition of Doublesex and Mab-3 Related Transcription Factor 1 (DMRT1, Accession NM_021951), a gene which May be involved in male sexual development. Accordingly, utilities of VGAM2394 include diagnosis, prevention and treatment of diseases and clinical conditions associated with DMRT1. The function of DMRT1 and its association with various diseases and clinical conditions, has been established by previous studies, as described hereinabove with reference to VGAM59. Exostoses (multiple)-like 3 (EXTL3, Accession NM_001440) is another VGAM2394 host target gene. EXTL3 BINDING SITE is HOST TARGET binding site found in the 3' untranslated region of mRNA encoded by EXTL3, corresponding to a HOST TARGET binding site such as BINDING SITE I, BINDING SITE II or BINDING SITE III. Table 2 illustrates the complementarity of the nucleotide sequences of EXTL3 BINDING SITE, designated SEQ ID:7165, to the nucleotide sequence of VGAM2394 RNA, herein designated VGAM RNA, also designated SEQ ID:5105.

Another function of VGAM2394 is therefore inhibition of Exostoses (multiple)-like 3 (EXTL3, Accession NM_001440), a gene which a member of the multiple exostoses gene family. Accordingly, utilities of VGAM2394 include diagnosis, prevention and treatment of diseases and clinical conditions associated with EXTL3. The function of EXTL3 and its association with various diseases and clinical conditions, has been established by previous studies, as described hereinabove with reference to VGAM95. Integrin, Alpha 6 (ITGA6, Accession NM_000210) is another VGAM2394 host target gene. ITGA6 BINDING SITE is HOST TARGET binding site found in the 3' untranslated region of mRNA encoded by ITGA6, corresponding to a HOST TARGET binding site such as BINDING SITE I, BINDING SITE II or BINDING SITE III. Table 2 illustrates the complementarity of the nucleotide sequences of ITGA6 BINDING SITE, designated SEQ ID:5700, to the nucleotide sequence of VGAM2394 RNA, herein designated VGAM RNA, also designated SEQ ID:5105.

Another function of VGAM2394 is therefore inhibition of Integrin, Alpha 6 (ITGA6, Accession NM_000210). Accordingly, utilities of VGAM2394 include diagnosis, prevention and treatment of diseases and clinical conditions associated with ITGA6. NEBL (Accession NM_006393) is another VGAM2394 host target gene. NEBL BINDING SITE is HOST TARGET binding site found in the 3' untranslated region of mRNA encoded by NEBL, corresponding to a HOST TARGET binding site such as BINDING SITE I, BINDING SITE II or BINDING SITE III. Table 2 illustrates the complementarity of the nucleotide sequences of NEBL BINDING SITE, designated SEQ ID:13096, to the nucleotide sequence of VGAM2394 RNA, herein designated VGAM RNA, also designated SEQ ID:5105.

Another function of VGAM2394 is therefore inhibition of NEBL (Accession NM_006393). Accordingly, utilities of VGAM2394 include diagnosis, prevention and treatment of diseases and clinical conditions associated with NEBL. Tumor Necrosis Factor (ligand) Superfamily, Member 10 (TNFSF10, Accession NM_003810) is another VGAM2394 host target gene. TNFSF10 BINDING SITE is HOST TARGET binding site found in the 3' untranslated region of mRNA encoded by TNFSF10, corresponding to a HOST TARGET binding site such as BINDING SITE I, BINDING SITE II or BINDING SITE III. Table 2 illustrates the complementarity of the nucleotide sequences of TNFSF10 BINDING SITE, designated SEQ ID:9900, to the nucleotide sequence of VGAM2394 RNA, herein designated VGAM RNA, also designated SEQ ID:5105.

Another function of VGAM2394 is therefore inhibition of Tumor Necrosis Factor (ligand) Superfamily, Member 10 (TNFSF10, Accession NM_003810), a gene which mediates cell death. Accordingly, utilities of VGAM2394 include diagnosis, prevention and treatment of diseases and clinical conditions associated with TNFSF10. The function of TNFSF10 and its association with various diseases and clinical conditions, has been established by previous studies, as described hereinabove with reference to VGAM637. WAS Protein Family, Member 3 (WASF3, Accession NM_006646) is another VGAM2394 host target gene. WASF3 BINDING SITE is HOST TARGET binding site found in the 3' untranslated region of mRNA encoded by WASF3, corresponding to a HOST TARGET binding site such as BINDING SITE I, BINDING SITE II or BINDING SITE III. Table 2 illustrates the complementarity of the nucleotide sequences of WASF3 BINDING SITE, designated SEQ ID:13439, to the nucleotide sequence of VGAM2394 RNA, herein designated VGAM RNA, also designated SEQ ID:5105.

Another function of VGAM2394 is therefore inhibition of WAS Protein Family, Member 3 (WASF3, Accession NM_006646), a gene which stimulates actin polymerization. Accordingly, utilities of VGAM2394 include diagnosis, prevention and treatment of diseases and clinical conditions associated with WASF3. The function of WASF3 and its association with various diseases and clinical conditions, has been established by previous studies, as described hereinabove with reference to VGAM1692. Chromosome 15 Open Reading Frame 5 (C15orf5, Accession NM_030944) is another VGAM2394 host target gene. C15orf5 BINDING SITE is HOST TARGET binding site found in the 3' untranslated region of mRNA encoded by C15orf5, corresponding to a HOST TARGET binding site such as BINDING SITE I, BINDING SITE II or BINDING SITE III. Table 2 illustrates the complementarity of the nucleotide sequences of C15orf5 BINDING SITE, designated SEQ ID:25212, to the nucleotide sequence of VGAM2394 RNA, herein designated VGAM RNA, also designated SEQ ID:5105.

Another function of VGAM2394 is therefore inhibition of Chromosome 15 Open Reading Frame 5 (C15orf5, Accession NM_030944). Accordingly, utilities of VGAM2394 include diagnosis, prevention and treatment of diseases and clinical conditions associated with C15orf5. Centaurin, Alpha 2 (CENTA2, Accession NM_018404) is another VGAM2394 host target gene. CENTA2 BINDING SITE is HOST TARGET binding site found in the 3' untranslated region of mRNA encoded by CENTA2, corresponding to a HOST TARGET binding site such as BINDING SITE I, BINDING SITE II or BINDING SITE III. Table 2 illustrates the complementarity of the nucleotide sequences of CENTA2 BINDING SITE, designated SEQ ID:20441, to the nucleotide sequence of VGAM2394 RNA, herein designated VGAM RNA, also designated SEQ ID:5105.

Another function of VGAM2394 is therefore inhibition of Centaurin, Alpha 2 (CENTA2, Accession NM_018404). Accordingly, utilities of VGAM2394 include diagnosis, prevention and treatment of diseases and clinical conditions associated with CENTA2. Fatty Acid Desaturase 1 (FADS1, Accession NM_013402) is another VGAM2394 host target gene. FADS1 BINDING SITE is HOST TARGET binding site found in the 3' untranslated region of mRNA encoded by FADS1, corresponding to a HOST TARGET binding site such as BINDING SITE I, BINDING SITE II or BINDING SITE III. Table 2 illustrates the complementarity of the nucleotide sequences of FADS1 BINDING SITE, designated SEQ ID:15066, to the nucleotide sequence of VGAM2394 RNA, herein designated VGAM RNA, also designated SEQ ID:5105.

Another function of VGAM2394 is therefore inhibition of Fatty Acid Desaturase 1 (FADS1, Accession NM_013402). Accordingly, utilities of VGAM2394 include diagnosis, prevention and treatment of diseases and clinical conditions associated with FADS1. FLJ11088 (Accession NM_018318) is another VGAM2394 host target gene. FLJ11088 BINDING SITE is HOST TARGET binding site found in the 3' untranslated region of mRNA encoded by FLJ11088, corresponding to a HOST TARGET binding site such as BINDING SITE I, BINDING SITE II or BINDING SITE III. Table 2 illustrates the complementarity of the nucleotide sequences of FLJ11088 BINDING SITE, designated SEQ ID:20311, to the nucleotide sequence of VGAM2394 RNA, herein designated VGAM RNA, also designated SEQ ID:5105.

Another function of VGAM2394 is therefore inhibition of FLJ11088 (Accession NM_018318). Accordingly, utilities of VGAM2394 include diagnosis, prevention and treatment of diseases and clinical conditions associated with FLJ11088. HSNOV1 (Accession NM_017515) is another VGAM2394 host target gene. HSNOV1 BINDING SITE is HOST TARGET binding site found in the 3' untranslated region of mRNA encoded by HSNOV1, corresponding to a HOST TARGET binding site such as BINDING SITE I, BINDING SITE II or BINDING SITE III. Table 2 illustrates the complementarity of the nucleotide sequences of HSNOV1 BINDING SITE, designated SEQ ID:18963, to the nucleotide sequence of VGAM2394 RNA, herein designated VGAM RNA, also designated SEQ ID:5105.

Another function of VGAM2394 is therefore inhibition of HSNOV1 (Accession NM_017515). Accordingly, utilities of VGAM2394 include diagnosis, prevention and treatment of diseases and clinical conditions associated with HSNOV1. Potassium Voltage-gated Channel, Subfamily H (eag-related), Member 8 (KCNH8, Accession NM_144633) is another VGAM2394 host target gene. KCNH8 BINDING SITE is HOST TARGET binding site found in the 3' untranslated region of mRNA encoded by KCNH8, corresponding to a HOST TARGET binding site such as BINDING SITE I, BINDING SITE II or BINDING SITE III. Table 2 illustrates the complementarity of the nucleotide sequences of KCNH8 BINDING SITE, designated SEQ ID:29453, to the nucleotide sequence of VGAM2394 RNA, herein designated VGAM RNA, also designated SEQ ID:5105.

Another function of VGAM2394 is therefore inhibition of Potassium Voltage-gated Channel, Subfamily H (eag-related), Member 8 (KCNH8, Accession NM_144633). Accordingly, utilities of VGAM2394 include diagnosis, prevention and treatment of diseases and clinical conditions associated with KCNH8. KIAA0087 (Accession NM_014769) is another VGAM2394 host target gene. KIAA0087 BINDING SITE is HOST TARGET binding site found in the 3' untranslated region of mRNA encoded by KIAA0087, corresponding to a HOST TARGET binding site such as BINDING SITE I, BINDING SITE II or BINDING SITE III. Table 2 illustrates the complementarity of the nucleotide sequences of KIAA0087 BINDING SITE, designated SEQ ID:16555, to the nucleotide sequence of VGAM2394 RNA, herein designated VGAM RNA, also designated SEQ ID:5105.

Another function of VGAM2394 is therefore inhibition of KIAA0087 (Accession NM_014769). Accordingly, utilities of VGAM2394 include diagnosis, prevention and treatment of diseases and clinical conditions associated with KIAA0087. KIAA0217 (Accession XM_040265) is another VGAM2394 host target gene. KIAA0217 BINDING SITE is HOST TARGET binding site found in the 3' untranslated region of mRNA encoded by KIAA0217, corresponding to a HOST TARGET binding site such as BINDING SITE I, BINDING SITE II or BINDING SITE III. Table 2 illustrates the complementarity of the nucleotide sequences of KIAA0217 BINDING SITE, designated SEQ ID:33278, to the nucleotide sequence of VGAM2394 RNA, herein designated VGAM RNA, also designated SEQ ID:5105.

Another function of VGAM2394 is therefore inhibition of KIAA0217 (Accession XM_040265). Accordingly, utilities of VGAM2394 include diagnosis, prevention and treatment of diseases and clinical conditions associated with KIAA0217. KIAA0350 (Accession XM_028332) is another VGAM2394 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30657, to the nucleotide sequence of VGAM2394 RNA, herein designated VGAM RNA, also designated SEQ ID:5105.

Another function of VGAM2394 is therefore inhibition of KIAA0350 (Accession XM_028332). Accordingly, utilities of VGAM2394 include diagnosis, prevention and treatment of diseases and clinical conditions associated with KIAA0350. KIAA1128 (Accession XM_043596) is another VGAM2394 host target gene. KIAA1128 BINDING SITE is HOST TARGET binding site found in the 3' untranslated region of mRNA encoded by KIAA1128, corresponding to a HOST TARGET binding site such as BINDING SITE I, BINDING SITE II or BINDING SITE III. Table 2 illustrates the complementarity of the nucleotide sequences of KIAA1128 BINDING SITE, designated SEQ ID:33966, to the nucleotide sequence of VGAM2394 RNA, herein designated VGAM RNA, also designated SEQ ID:5105.

Another function of VGAM2394 is therefore inhibition of KIAA1128 (Accession XM_043596). Accordingly, utilities of VGAM2394 include diagnosis, prevention and treatment of diseases and clinical conditions associated with KIAA1128. Kallikrein 7 (chymotryptic, stratum corneum) (KLK7, Accession NM_005046) is another VGAM2394 host target gene. KLK7 BINDING SITE1 and KLK7 BINDING SITE2 are HOST TARGET binding sites found in untranslated regions of mRNA encoded by KLK7, corresponding to HOST TARGET binding sites such as BINDING SITE I, BINDING SITE II or BINDING SITE III. Table 2 illustrates the complementarity of the nucleotide sequences of KLK7 BINDING SITE1 and KLK7 BINDING SITE2, designated SEQ ID:11475 and SEQ ID:29272 respectively, to the nucleotide sequence of VGAM2394 RNA, herein designated VGAM RNA, also designated SEQ ID:5105.

Another function of VGAM2394 is therefore inhibition of Kallikrein 7 (chymotryptic, stratum corneum) (KLK7, Accession NM_005046). Accordingly, utilities of VGAM2394 include diagnosis, prevention and treatment of diseases and clinical conditions associated with KLK7.

MGC4827 (Accession NM_024114) is another VGAM2394 host target gene. MGC4827 BINDING SITE is HOST TARGET binding site found in the 3' untranslated region of mRNA encoded by MGC4827, corresponding to a HOST TARGET binding site such as BINDING SITE I, BINDING SITE II or BINDING SITE III. Table 2 illustrates the complementarity of the nucleotide sequences of MGC4827 BINDING SITE, designated SEQ ID:23566, to the nucleotide sequence of VGAM2394 RNA, herein designated VGAM RNA, also designated SEQ ID:5105.

Another function of VGAM2394 is therefore inhibition of MGC4827 (Accession NM_024114). Accordingly, utilities of VGAM2394 include diagnosis, prevention and treatment of diseases and clinical conditions associated with MGC4827. MGC4832 (Accession NM_145061) is another VGAM2394 host target gene. MGC4832 BINDING SITE is HOST TARGET binding site found in the 3' untranslated region of mRNA encoded by MGC4832, corresponding to a HOST TARGET binding site such as BINDING SITE I, BINDING SITE II or BINDING SITE III. Table 2 illustrates the complementarity of the nucleotide sequences of MGC4832 BINDING SITE, designated SEQ ID:29698, to the nucleotide sequence of VGAM2394 RNA, herein designated VGAM RNA, also designated SEQ ID:5105.

Another function of VGAM2394 is therefore inhibition of MGC4832 (Accession NM_145061). Accordingly, utilities of VGAM2394 include diagnosis, prevention and treatment of diseases and clinical conditions associated with MGC4832. SNRK (Accession NM_017719) is another VGAM2394 host target gene. SNRK BINDING SITE is HOST TARGET binding site found in the 3' untranslated region of mRNA encoded by SNRK, corresponding to a HOST TARGET binding site such as BINDING SITE I, BINDING SITE II or BINDING SITE III. Table 2 illustrates the complementarity of the nucleotide sequences of SNRK BINDING SITE, designated SEQ ID:19308, to the nucleotide sequence of VGAM2394 RNA, herein designated VGAM RNA, also designated SEQ ID:5105.

Another function of VGAM2394 is therefore inhibition of SNRK (Accession NM_017719). Accordingly, utilities of VGAM2394 include diagnosis, prevention and treatment of diseases and clinical conditions associated with SNRK. LOC145842 (Accession XM_085254) is another VGAM2394 host target gene. LOC145842 BINDING SITE is HOST TARGET binding site found in the 5' untranslated region of mRNA encoded by LOC145842, corresponding to a HOST TARGET binding site such as BINDING SITE I, BINDING SITE II or BINDING SITE III. Table 2 illustrates the complementarity of the nucleotide sequences of LOC145842 BINDING SITE, designated SEQ ID:37995, to the nucleotide sequence of VGAM2394 RNA, herein designated VGAM RNA, also designated SEQ ID:5105.

Another function of VGAM2394 is therefore inhibition of LOC145842 (Accession XM_085254). Accordingly, utilities of VGAM2394 include diagnosis, prevention and treatment of diseases and clinical conditions associated with LOC145842. LOC149111 (Accession XM_086429) is another VGAM2394 host target gene. LOC149111 BINDING SITE is HOST TARGET binding site found in the 3' untranslated region of mRNA encoded by LOC149111, corresponding to a HOST TARGET binding site such as BINDING SITE I, BINDING SITE II or BINDING SITE III. Table 2 illustrates the complementarity of the nucleotide sequences of LOC149111 BINDING SITE, designated SEQ ID:38647, to the nucleotide sequence of VGAM2394 RNA, herein designated VGAM RNA, also designated SEQ ID:5105.

Another function of VGAM2394 is therefore inhibition of LOC149111 (Accession XM_086429). Accordingly, utilities of VGAM2394 include diagnosis, prevention and treatment of diseases and clinical conditions associated with LOC149111. LOC155435 (Accession XM_088257) is another VGAM2394 host target gene. LOC155435 BINDING SITE is HOST TARGET binding site found in the 3' untranslated region of mRNA encoded by LOC155435, corresponding to a HOST TARGET binding site such as BINDING SITE I, BINDING SITE II or BINDING SITE III. Table 2 illustrates the complementarity of the nucleotide sequences of LOC155435 BINDING SITE, designated SEQ ID:39566, to the nucleotide sequence of VGAM2394 RNA, herein designated VGAM RNA, also designated SEQ ID:5105.

Another function of VGAM2394 is therefore inhibition of LOC155435 (Accession XM_088257). Accordingly, utilities of VGAM2394 include diagnosis, prevention and treatment of diseases and clinical conditions associated with LOC155435. LOC201562 (Accession XM_114343) is another VGAM2394 host target gene. LOC201562 BINDING SITE is HOST TARGET binding site found in the 3' untranslated region of mRNA encoded by LOC201562, corresponding to a HOST TARGET binding site such as BINDING SITE I, BINDING SITE II or BINDING SITE III. Table 2 illustrates the complementarity of the nucleotide sequences of LOC201562 BINDING SITE, designated SEQ ID:42882, to the nucleotide sequence of VGAM2394 RNA, herein designated VGAM RNA, also designated SEQ ID:5105.

Another function of VGAM2394 is therefore inhibition of LOC201562 (Accession XM_114343). Accordingly, utilities of VGAM2394 include diagnosis, prevention and treatment of diseases and clinical conditions associated with LOC201562. LOC219401 (Accession XM_166706) is another VGAM2394 host target gene. LOC219401 BINDING SITE is HOST TARGET binding site found in the 3' untranslated region of mRNA encoded by LOC219401, corresponding to a HOST TARGET binding site such as BINDING SITE I, BINDING SITE II or BINDING SITE III. Table 2 illustrates the complementarity of the nucleotide sequences of LOC219401 BINDING SITE, designated SEQ ID:44585, to the nucleotide sequence of VGAM2394 RNA, herein designated VGAM RNA, also designated SEQ ID:5105.

Another function of VGAM2394 is therefore inhibition of LOC219401 (Accession XM_166706). Accordingly, utilities of VGAM2394 include diagnosis, prevention and treatment of diseases and clinical conditions associated with LOC219401. LOC220766 (Accession XM_165471) is another VGAM2394 host target gene. LOC220766 BINDING SITE is HOST TARGET binding site found in the 5' untranslated region of mRNA encoded by LOC220766, corresponding to a HOST TARGET binding site such as BINDING SITE I, BINDING SITE II or BINDING SITE III. Table 2 illustrates the complementarity of the nucleotide sequences of LOC220766 BINDING SITE, designated SEQ ID:43646, to the nucleotide sequence of VGAM2394 RNA, herein designated VGAM RNA, also designated SEQ ID:5105.

Another function of VGAM2394 is therefore inhibition of LOC220766 (Accession XM_165471). Accordingly, utilities of VGAM2394 include diagnosis, prevention and treatment of diseases and clinical conditions associated with LOC220766. LOC221495 (Accession XM_168136) is another VGAM2394 host target gene. LOC221495 BINDING SITE is HOST TARGET binding site found in the 3' untranslated region of mRNA encoded by LOC221495, corresponding to a HOST TARGET binding site such as BINDING SITE I, BINDING SITE II or BINDING SITE III. Table 2 illustrates the complementarity of the nucleotide sequences of LOC221495 BINDING SITE, designated SEQ ID:45056, to the nucleotide sequence of VGAM2394 RNA, herein designated VGAM RNA, also designated SEQ ID:5105.

Another function of VGAM2394 is therefore inhibition of LOC221495 (Accession XM_168136). Accordingly, utilities of VGAM2394 include diagnosis, prevention and treatment of diseases and clinical conditions associated with LOC221495. LOC256112 (Accession XM_172829) is another VGAM2394 host target gene. LOC256112 BINDING SITE is HOST TARGET binding site found in the 3' untranslated region of mRNA encoded by LOC256112, corresponding to a HOST TARGET binding site such as BINDING SITE I, BINDING SITE II or BINDING SITE III. Table 2 illustrates the complementarity of the nucleotide sequences of LOC256112 BINDING SITE, designated SEQ ID:46102, to the nucleotide sequence of VGAM2394 RNA, herein designated VGAM RNA, also designated SEQ ID:5105.

Another function of VGAM2394 is therefore inhibition of LOC256112 (Accession XM_172829). Accordingly, utilities of VGAM2394 include diagnosis, prevention and treatment of diseases and clinical conditions associated with LOC256112. LOC256846 (Accession XM_170921) is another VGAM2394 host target gene. LOC256846 BINDING SITE is HOST TARGET binding site found in the 5' untranslated region of mRNA encoded by LOC256846, corresponding to a HOST TARGET binding site such as BINDING SITE I, BINDING SITE II or BINDING SITE III. Table 2 illustrates the complementarity of the nucleotide sequences of LOC256846 BINDING SITE, designated SEQ ID:45696, to the nucleotide sequence of VGAM2394 RNA, herein designated VGAM RNA, also designated SEQ ID:5105.

Another function of VGAM2394 is therefore inhibition of LOC256846 (Accession XM_170921). Accordingly, utilities of VGAM2394 include diagnosis, prevention and treatment of diseases and clinical conditions associated with LOC256846. LOC86651 (Accession XM_044052) is another VGAM2394 host target gene. LOC86651 BINDING SITE is HOST TARGET binding site found in the 3' untranslated region of mRNA encoded by LOC86651, corresponding to a HOST TARGET binding site such as BINDING SITE I, BINDING SITE II or BINDING SITE III. Table 2 illustrates the complementarity of the nucleotide sequences of LOC86651 BINDING SITE, designated SEQ ID:34096, to the nucleotide sequence of VGAM2394 RNA, herein designated VGAM RNA, also designated SEQ ID:5105.

Another function of VGAM2394 is therefore inhibition of LOC86651 (Accession XM_044052). Accordingly, utilities of VGAM2394 include diagnosis, prevention and treatment of diseases and clinical conditions associated with LOC86651. FIG. 1 further provides a conceptual description of a novel bioinformatically detected viral gene of the present invention, referred to here as Viral Genomic Address Messenger 2395 (VGAM2395) viral gene, which modulates expression of respective host target genes thereof, the function and utility of which host target genes is known in the art.

VGAM2395 is a novel bioinformatically detected regulatory, non protein coding, viral micro RNA (miRNA) gene. The method by which VGAM2395 was detected is described hereinabove with reference to FIGS. 1-8.

VGAM2395 gene, herein designated VGAM GENE, is a viral gene contained in the genome of Goatpox Virus. VGAM2395 host target gene, herein designated VGAM HOST TARGET GENE, is a human gene contained in the human genome.

VGAM2395 gene encodes a VGAM2395 precursor RNA, herein designated VGAM PRECURSOR RNA. Similar to other miRNA genes, and unlike most ordinary genes, VGAM2395 precursor RNA does not encode a protein. A nucleotide sequence identical or highly similar to the nucleotide sequence of VGAM2395 precursor RNA is designated SEQ ID:2381, and is provided hereinbelow with reference to the sequence listing part. Nucleotide sequence SEQ ID:2381 is located at position 120551 relative to the genome of Goatpox Virus.

VGAM2395 precursor RNA folds onto itself, forming VGAM2395 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2395 folded precursor RNA into VGAM2395 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM2395 RNA is designated SEQ ID:5106, and is provided hereinbelow with reference to the sequence listing part.

VGAM2395 host target gene, herein designated VGAM HOST TARGET GENE, encodes a corresponding messenger RNA, VGAM2395 host target RNA, herein designated VGAM HOST TARGET RNA. VGAM2395 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2395 RNA, herein designated VGAM RNA, binds complementarily to one or more host target binding sites located in untranslated regions of VGAM2395 host target RNA, herein designated VGAM HOST TARGET RNA. This complementary binding is due to the fact that the nucleotide sequence of VGAM2395 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2395 RNA, herein designated VGAM RNA, may have a different number of host target binding sites in untranslated regions of a VGAM2395 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2395 RNA, herein designated VGAM RNA, to host target binding sites on VGAM2395 host target RNA, herein designated VGAM HOST TARGET RNA, such as BINDING SITE I, BINDING SITE II and BINDING SITE III, inhibits translation of VGAM2395 host target RNA into VGAM2395 host target protein, herein designated VGAM HOST TARGET PROTEIN. VGAM host target protein is therefore outlined by a broken line.

It is appreciated that VGAM2395 host target gene, herein designated VGAM HOST TARGET GENE, in fact represents a plurality of VGAM2395 host target genes. The mRNA of each one of this plurality of VGAM2395 host target genes comprises one or more host target binding sites, each having a nucleotide sequence which is at least partly complementary to VGAM2395 RNA, herein designated VGAM RNA, and which when bound by VGAM2395 RNA causes inhibition of translation of respective one or more VGAM2395 host target proteins.

It is further appreciated by one skilled in the art that the mode of translational inhibition illustrated by FIG. 1 with specific reference to translational inhibition exerted by VGAM2395 gene, herein designated VGAM GENE, on one or more VGAM2395 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2395 is inhibition of expression of host target genes, as part of a novel viral mechanism of attacking a host. Accordingly, utilities of VGAM2395 include diagnosis, prevention and treatment of viral infection by Goatpox Virus. Specific functions, and accordingly utilities, of VGAM2395 correlate with, and may be deduced from, the identity of the host target genes which VGAM2395 binds and inhibits, and the function of these host target genes, as elaborated hereinbelow.

Nucleotide sequences of the VGAM2395 precursor RNA, herein designated VGAM PRECURSOR RNA, and of the 'diced' VGAM2395 RNA, herein designated VGAM RNA, and a schematic representation of the secondary folding of VGAM2395 folded precursor RNA, herein designated VGAM FOLDED PRECURSOR RNA, of VGAM2395 are further described hereinbelow with reference to Table 1.

Nucleotide sequences of host target binding sites, such as BINDING SITE-I, BINDING SITE-II and BINDING SITE-III of FIG. 1, found on VGAM2395 host target RNA, and schematic representation of the complementarity of each of these host target binding sites to VGAM2395 RNA, herein designated VGAM RNA, are described hereinbelow with reference to Table 2.

As mentioned hereinabove with reference to FIG. 1, a function of VGAM2395 gene, herein designated VGAM is inhibition of expression of VGAM2395 target genes. It is appreciated that specific functions, and accordingly utilities, of VGAM2395 correlate with, and may be deduced from, the identity of the target genes which VGAM2395 binds and inhibits, and the function of these target genes, as elaborated hereinbelow.

MGC4832 (Accession NM_145061) is a VGAM2395 host target gene. MGC4832 BINDING SITE is HOST TARGET binding site found in the 3' untranslated region of mRNA encoded by MGC4832, corresponding to a HOST TARGET binding site such as BINDING SITE I, BINDING SITE II or BINDING SITE III. Table 2 illustrates the complementarity of the nucleotide sequences of MGC4832 BINDING SITE, designated SEQ ID:29702, to the nucleotide sequence of VGAM2395 RNA, herein designated VGAM RNA, also designated SEQ ID:5106.

A function of VGAM2395 is therefore inhibition of MGC4832 (Accession NM_145061). Accordingly, utilities of VGAM2395 include diagnosis, prevention and treatment of diseases and clinical conditions associated with MGC4832. Palmdelphin (PALMD, Accession NM_017734) is another VGAM2395 host target gene. PALMD BINDING SITE is HOST TARGET binding site found in the 3' untranslated region of mRNA encoded by PALMD, corresponding to a HOST TARGET binding site such as BINDING SITE I, BINDING SITE II or BINDING SITE III. Table 2 illustrates the complementarity of the nucleotide sequences of PALMD BINDING SITE, designated SEQ ID:19320, to the nucleotide sequence of VGAM2395 RNA, herein designated VGAM RNA, also designated SEQ ID:5106.

Another function of VGAM2395 is therefore inhibition of Palmdelphin (PALMD, Accession NM_017734). Accordingly, utilities of VGAM2395 include diagnosis, prevention and treatment of diseases and clinical conditions associated with PALMD. LOC151647 (Accession XM_087261) is another VGAM2395 host target gene. LOC151647 BINDING SITE is HOST TARGET binding site found in the 3' untranslated region of mRNA encoded by LOC151647, corresponding to a HOST TARGET binding site such as BINDING SITE I, BINDING SITE II or BINDING SITE III. Table 2 illustrates the complementarity of the nucleotide sequences of LOC151647 BINDING SITE, designated SEQ ID:39160, to the nucleotide sequence of VGAM2395 RNA, herein designated VGAM RNA, also designated SEQ ID:5106.

Another function of VGAM2395 is therefore inhibition of LOC151647 (Accession XM_087261). Accordingly, utilities of VGAM2395 include diagnosis, prevention and treatment of diseases and clinical conditions associated with LOC151647. FIG. 1 further provides a conceptual description of a novel bioinformatically detected viral gene of the present invention, referred to here as Viral Genomic Address Messenger 2396 (VGAM2396) viral gene, which modulates expression of respective host target genes thereof, the function and utility of which host target genes is known in the art.

VGAM2396 is a novel bioinformatically detected regulatory, non protein coding, viral micro RNA (miRNA) gene. The method by which VGAM2396 was detected is described hereinabove with reference to FIGS. 1-8.

VGAM2396 gene, herein designated VGAM GENE, is a viral gene contained in the genome of Goatpox Virus. VGAM2396 host target gene, herein designated VGAM HOST TARGET GENE, is a human gene contained in the human genome.

VGAM2396 gene encodes a VGAM2396 precursor RNA, herein designated VGAM PRECURSOR RNA. Similar to other miRNA genes, and unlike most ordinary genes, VGAM2396 precursor RNA does not encode a protein. A nucleotide sequence identical or highly similar to the nucleotide sequence of VGAM2396 precursor RNA is designated SEQ ID:2382, and is provided hereinbelow with reference to the sequence listing part. Nucleotide sequence SEQ ID:2382 is located at position 93517 relative to the genome of Goatpox Virus.

VGAM2396 precursor RNA folds onto itself, forming VGAM2396 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2396 folded precursor RNA into VGAM2396 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2396 RNA is designated SEQ ID:5107, and is provided hereinbelow with reference to the sequence listing part.

VGAM2396 host target gene, herein designated VGAM HOST TARGET GENE, encodes a corresponding messenger RNA, VGAM2396 host target RNA, herein designated VGAM HOST TARGET RNA. VGAM2396 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2396 RNA, herein designated VGAM RNA, binds complementarily to one or more host target binding sites located in untranslated regions of VGAM2396 host target RNA, herein designated VGAM HOST TARGET RNA. This complementary binding is due to the fact that the nucleotide sequence of VGAM2396 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2396 RNA, herein designated VGAM RNA, may have a different number of host target binding sites in untranslated regions of a VGAM2396 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2396 RNA, herein designated VGAM RNA, to host target binding sites on VGAM2396 host target RNA, herein designated VGAM HOST TARGET RNA, such as BINDING SITE I, BINDING SITE II and BINDING SITE III, inhibits translation of VGAM2396 host target RNA into VGAM2396 host target protein, herein designated VGAM HOST TARGET PROTEIN. VGAM host target protein is therefore outlined by a broken line.

It is appreciated that VGAM2396 host target gene, herein designated VGAM HOST TARGET GENE, in fact represents a plurality of VGAM2396 host target genes. The mRNA of each one of this plurality of VGAM2396 host target genes comprises one or more host target binding sites, each having a nucleotide sequence which is at least partly complementary to VGAM2396 RNA, herein designated VGAM RNA, and which when bound by VGAM2396 RNA causes inhibition of translation of respective one or more VGAM2396 host target proteins.

It is further appreciated by one skilled in the art that the mode of translational inhibition illustrated by FIG. 1 with specific reference to translational inhibition exerted by VGAM2396 gene, herein designated VGAM GENE, on one or more VGAM2396 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2396 is inhibition of expression of host target genes, as part of a novel viral mechanism of attacking a host. Accordingly, utilities of VGAM2396 include diagnosis, prevention and treatment of viral infection by Goatpox Virus. Specific functions, and accordingly utilities, of VGAM2396 correlate with, and may be deduced from, the identity of the host target genes which VGAM2396 binds and inhibits, and the function of these host target genes, as elaborated hereinbelow.

Nucleotide sequences of the VGAM2396 precursor RNA, herein designated VGAM PRECURSOR RNA, and of the 'diced' VGAM2396 RNA, herein designated VGAM RNA, and a schematic representation of the secondary folding of VGAM2396 folded precursor RNA, herein designated VGAM FOLDED PRECURSOR RNA, of VGAM2396 are further described hereinbelow with reference to Table 1.

Nucleotide sequences of host target binding sites, such as BINDING SITE-I, BINDING SITE-II and BINDING SITE-III of FIG. 1, found on VGAM2396 host target RNA, and schematic representation of the complementarity of each of these host target binding sites to VGAM2396 RNA, herein designated VGAM RNA, are described hereinbelow with reference to Table 2.

As mentioned hereinabove with reference to FIG. 1, a function of VGAM2396 gene, herein designated VGAM is inhibition of expression of VGAM2396 target genes. It is appreciated that specific functions, and accordingly utilities, of VGAM2396 correlate with, and may be deduced from, the identity of the target genes which VGAM2396 binds and inhibits, and the function of these target genes, as elaborated hereinbelow.

A Disintegrin and Metalloproteinase Domain 17 (tumor necrosis factor, alpha, converting enzyme) (ADAM17, Accession NM_003183) is a VGAM2396 host target gene. ADAM17 BINDING SITE1 and ADAM17 BINDING SITE2 are HOST TARGET binding sites found in untranslated regions of mRNA encoded by ADAM17, corresponding to HOST TARGET binding sites such as BINDING SITE I, BINDING SITE II or BINDING SITE III. Table 2 illustrates the complementarity of the nucleotide sequences of ADAM17 BINDING SITE1 and ADAM17 BINDING SITE2, designated SEQ ID:9157 and SEQ ID:22410 respectively, to the nucleotide sequence of VGAM2396 RNA, herein designated VGAM RNA, also designated SEQ ID:5107.

A function of VGAM2396 is therefore inhibition of A Disintegrin and Metalloproteinase Domain 17 (tumor necrosis factor, alpha, converting enzyme) (ADAM17, Accession NM_003183), a gene which member of ADAM family of zinc metalloproteases. Accordingly, utilities of VGAM2396 include diagnosis, prevention and treatment of diseases and clinical conditions associated with ADAM17. The function of ADAM17 and its association with various diseases and clinical conditions, has been established by previous studies, as described hereinabove with reference to VGAM264. DKFZP586D2223 (Accession NM_018561) is another VGAM2396 host target gene. DKFZP586D2223 BINDING SITE is HOST TARGET binding site found in the 5' untranslated region of mRNA encoded by DKFZP586D2223, corresponding to a HOST TARGET binding site such as BINDING SITE I, BINDING SITE II or BINDING SITE III. Table 2 illustrates the complementarity of the nucleotide sequences of DKFZP586D2223 BINDING SITE, designated SEQ ID:20643, to the nucleotide sequence of VGAM2396 RNA, herein designated VGAM RNA, also designated SEQ ID:5107.

Another function of VGAM2396 is therefore inhibition of DKFZP586D2223 (Accession NM_018561). Accordingly, utilities of VGAM2396 include diagnosis, prevention and treatment of diseases and clinical conditions associated with DKFZP586D2223. FLJ20276 (Accession NM_017738) is another VGAM2396 host target gene. FLJ20276 BINDING SITE is HOST TARGET binding site found in the 3' untranslated region of mRNA encoded by FLJ20276, corresponding to a HOST TARGET binding site such as BINDING SITE I, BINDING SITE II or BINDING SITE III. Table 2 illustrates the complementarity of the nucleotide sequences of FLJ20276 BINDING SITE, designated SEQ ID:19325, to the nucleotide sequence of VGAM2396 RNA, herein designated VGAM RNA, also designated SEQ ID:5107.

Another function of VGAM2396 is therefore inhibition of FLJ20276 (Accession NM_017738). Accordingly, utilities of VGAM2396 include diagnosis, prevention and treatment of diseases and clinical conditions associated with FLJ20276. LOC150848 (Accession XM_097959) is another VGAM2396 host target gene. LOC150848 BINDING SITE is HOST TARGET binding site found in the 5' untranslated region of mRNA encoded by LOC150848, corresponding to a HOST TARGET binding site such as BINDING SITE I, BINDING SITE II or BINDING SITE III. Table 2 illustrates the complementarity of the nucleotide sequences of LOC150848 BINDING SITE, designated SEQ ID:41255, to the nucleotide sequence of VGAM2396 RNA, herein designated VGAM RNA, also designated SEQ ID:5107.

Another function of VGAM2396 is therefore inhibition of LOC150848 (Accession XM_097959). Accordingly, utilities of VGAM2396 include diagnosis, prevention and treatment of diseases and clinical conditions associated with LOC150848. LOC93206 (Accession XM_049838) is another VGAM2396 host target gene. LOC93206 BINDING SITE is HOST TARGET binding site found in the 3' untranslated region of mRNA encoded by LOC93206, corresponding to a HOST TARGET binding site such as BINDING SITE I, BINDING SITE II or BINDING SITE III. Table 2 illustrates the complementarity of the nucleotide sequences of LOC93206 BINDING SITE, designated SEQ ID:35516, to the nucleotide sequence of VGAM2396 RNA, herein designated VGAM RNA, also designated SEQ ID:5107.

Another function of VGAM2396 is therefore inhibition of LOC93206 (Accession XM_049838). Accordingly, utilities of VGAM2396 include diagnosis, prevention and treatment of diseases and clinical conditions associated with LOC93206. FIG. 1 further provides a conceptual description of a novel bioinformatically detected viral gene of the present invention, referred to here as Viral Genomic Address Messenger 2397 (VGAM2397) viral gene, which modulates expression of respective host target genes thereof, the function and utility of which host target genes is known in the art.

VGAM2397 is a novel bioinformatically detected regulatory, non protein coding, viral micro RNA (miRNA) gene. The method by which VGAM2397 was detected is described hereinabove with reference to FIGS. 1-8.

VGAM2397 gene, herein designated VGAM GENE, is a viral gene contained in the genome of Goatpox Virus. VGAM2397 host target gene, herein designated VGAM HOST TARGET GENE, is a human gene contained in the human genome.

VGAM2397 gene encodes a VGAM2397 precursor RNA, herein designated VGAM PRECURSOR RNA. Similar to other miRNA genes, and unlike most ordinary genes, VGAM2397 precursor RNA does not encode a protein. A nucleotide sequence identical or highly similar to the nucleotide sequence of VGAM2397 precursor RNA is designated SEQ ID:2383, and is provided hereinbelow with reference to the sequence listing part. Nucleotide sequence SEQ ID:2383 is located at position 149485 relative to the genome of Goatpox Virus.

VGAM2397 precursor RNA folds onto itself, forming VGAM2397 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2397 folded precursor RNA into VGAM2397 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2397 RNA is designated SEQ ID:5108, and is provided hereinbelow with reference to the sequence listing part.

VGAM2397 host target gene, herein designated VGAM HOST TARGET GENE, encodes a corresponding messenger RNA, VGAM2397 host target RNA, herein designated VGAM HOST TARGET RNA. VGAM2397 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2397 RNA, herein designated VGAM RNA, binds complementarily to one or more host target binding sites located in untranslated regions of VGAM2397 host target RNA, herein designated VGAM HOST TARGET RNA. This complementary binding is due to the fact that the nucleotide sequence of VGAM2397 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2397 RNA, herein designated VGAM RNA, may have a different number of host target binding sites in untranslated regions of a VGAM2397 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2397 RNA, herein designated VGAM RNA, to host target binding sites on VGAM2397 host target RNA, herein designated VGAM HOST TARGET RNA, such as BINDING SITE I, BINDING SITE II and BINDING SITE III, inhibits translation of VGAM2397 host target RNA into VGAM2397 host target protein, herein designated VGAM HOST TARGET PROTEIN. VGAM host target protein is therefore outlined by a broken line.

It is appreciated that VGAM2397 host target gene, herein designated VGAM HOST TARGET GENE, in fact represents a plurality of VGAM2397 host target genes. The mRNA of each one of this plurality of VGAM2397 host target genes comprises one or more host target binding sites, each having a nucleotide sequence which is at least partly complementary to VGAM2397 RNA, herein designated VGAM RNA, and which when bound by VGAM2397 RNA causes inhibition of translation of respective one or more VGAM2397 host target proteins.

It is further appreciated by one skilled in the art that the mode of translational inhibition illustrated by FIG. 1 with specific reference to translational inhibition exerted by VGAM2397 gene, herein designated VGAM GENE, on one or more VGAM2397 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2397 is inhibition of expression of host target genes, as part of a novel viral mechanism of attacking a host. Accordingly, utilities of VGAM2397 include diagnosis, prevention and treatment of viral infection by Goatpox Virus. Specific functions, and accordingly utilities, of VGAM2397 correlate with, and may be deduced from, the identity of the host target genes which VGAM2397 binds and inhibits, and the function of these host target genes, as elaborated hereinbelow.

Nucleotide sequences of the VGAM2397 precursor RNA, herein designated VGAM PRECURSOR RNA, and of the 'diced' VGAM2397 RNA, herein designated VGAM RNA, and a schematic representation of the secondary folding of VGAM2397 folded precursor RNA, herein designated VGAM FOLDED PRECURSOR RNA, of VGAM2397 are further described hereinbelow with reference to Table 1.

Nucleotide sequences of host target binding sites, such as BINDING SITE-I, BINDING SITE-II and BINDING SITE-III of FIG. 1, found on VGAM2397 host target RNA, and schematic representation of the complementarity of each of these host target binding sites to VGAM2397 RNA, herein designated VGAM RNA, are described hereinbelow with reference to Table 2.

As mentioned hereinabove with reference to FIG. 1, a function of VGAM2397 gene, herein designated VGAM is inhibition of expression of VGAM2397 target genes. It is appreciated that specific functions, and accordingly utilities, of VGAM2397 correlate with, and may be deduced from, the identity of the target genes which VGAM2397 binds and inhibits, and the function of these target genes, as elaborated hereinbelow.

Component of Oligomeric Golgi Complex 3 (COG3, Accession NM_031431) is a VGAM2397 host target gene. COG3 BINDING SITE is HOST TARGET binding site found in the 3' untranslated region of mRNA encoded by COG3, corresponding to a HOST TARGET binding site such as BINDING SITE I, BINDING SITE II or BINDING SITE III. Table 2 illustrates the complementarity of the nucleotide sequences of COG3 BINDING SITE, designated SEQ ID:25426, to the nucleotide sequence of VGAM2397 RNA, herein designated VGAM RNA, also designated SEQ ID:5108.

A function of VGAM2397 is therefore inhibition of Component of Oligomeric Golgi Complex 3 (COG3, Accession NM_031431), a gene which is critical for the structure and function of the Golgi apparatus. Accordingly, utilities of VGAM2397 include diagnosis, prevention and treatment of diseases and clinical conditions associated with COG3. The function of COG3 and its association with various diseases and clinical conditions, has been established by previous studies, as described hereinabove with reference to VGAM2069. Chromobox Homolog 3 (HP1 gamma homolog, Drosophila) (CBX3, Accession NM_016587) is another VGAM2397 host target gene. CBX3 BINDING SITE1 and CBX3 BINDING SITE2 are HOST TARGET binding sites found in untranslated regions of mRNA encoded by CBX3, corresponding to HOST TARGET binding sites such as BINDING SITE I, BINDING SITE II or BINDING SITE III. Table 2 illustrates the complementarity of the nucleotide sequences of CBX3 BINDING SITE1 and CBX3 BINDING SITE2, designated SEQ ID:18659 and SEQ ID:14139 respectively, to the nucleotide sequence of VGAM2397 RNA, herein designated VGAM RNA, also designated SEQ ID:5108.

Another function of VGAM2397 is therefore inhibition of Chromobox Homolog 3 (HP1 gamma homolog, Drosophila) (CBX3, Accession NM_016587). Accordingly, utilities of VGAM2397 include diagnosis, prevention and treatment of diseases and clinical conditions associated with CBX3. FIG. 1 further provides a conceptual description of a novel bioinformatically detected viral gene of the present invention, referred to here as Viral Genomic Address Messenger 2398 (VGAM2398) viral gene, which modulates expression of respective host target genes thereof, the function and utility of which host target genes is known in the art.

VGAM2398 is a novel bioinformatically detected regulatory, non protein coding, viral micro RNA (miRNA) gene. The method by which VGAM2398 was detected is described hereinabove with reference to FIGS. 1-8.

VGAM2398 gene, herein designated VGAM GENE, is a viral gene contained in the genome of Goatpox Virus. VGAM2398 host target gene, herein designated VGAM HOST TARGET GENE, is a human gene contained in the human genome.

VGAM2398 gene encodes a VGAM2398 precursor RNA, herein designated VGAM PRECURSOR RNA. Similar to other miRNA genes, and unlike most ordinary genes, VGAM2398 precursor RNA does not encode a protein. A nucleotide sequence identical or highly similar to the nucleotide sequence of VGAM2398 precursor RNA is designated SEQ ID:2384, and is provided hereinbelow with reference to the sequence listing part. Nucleotide sequence SEQ ID:2384 is located at position 101040 relative to the genome of Goatpox Virus.

VGAM2398 precursor RNA folds onto itself, forming VGAM2398 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2398 folded precursor RNA into VGAM2398 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2398 RNA is designated SEQ ID:5109, and is provided hereinbelow with reference to the sequence listing part.

VGAM2398 host target gene, herein designated VGAM HOST TARGET GENE, encodes a corresponding messenger RNA, VGAM2398 host target RNA, herein designated VGAM HOST TARGET RNA. VGAM2398 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2398 RNA, herein designated VGAM RNA, binds complementarily to one or more host target binding sites located in untranslated regions of VGAM2398 host target RNA, herein designated VGAM HOST TARGET RNA. This complementary binding is due to the fact that the nucleotide sequence of VGAM2398 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2398 RNA, herein designated VGAM RNA, may have a different number of host target binding sites in untranslated regions of a VGAM2398 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2398 RNA, herein designated VGAM RNA, to host target binding sites on VGAM2398 host target RNA, herein designated VGAM HOST TARGET RNA, such as BINDING SITE I, BINDING SITE II and BINDING SITE III, inhibits translation of VGAM2398 host target RNA into VGAM2398 host target protein, herein designated VGAM HOST TARGET PROTEIN. VGAM host target protein is therefore outlined by a broken line.

It is appreciated that VGAM2398 host target gene, herein designated VGAM HOST TARGET GENE, in fact represents a plurality of VGAM2398 host target genes. The mRNA of each one of this plurality of VGAM2398 host target genes comprises one or more host target binding sites, each having a nucleotide sequence which is at least partly complementary to VGAM2398 RNA, herein designated VGAM RNA, and which when bound by VGAM2398 RNA causes inhibition of translation of respective one or more VGAM2398 host target proteins.

It is further appreciated by one skilled in the art that the mode of translational inhibition illustrated by FIG. 1 with specific reference to translational inhibition exerted by VGAM2398 gene, herein designated VGAM GENE, on one or more VGAM2398 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2398 is inhibition of expression of host target genes, as part of a novel viral mechanism of attacking a host. Accordingly, utilities of VGAM2398 include diagnosis, prevention and treatment of viral infection by Goatpox Virus. Specific functions, and accordingly utilities, of VGAM2398 correlate with, and may be deduced from, the identity of the host target genes which VGAM2398 binds and inhibits, and the function of these host target genes, as elaborated hereinbelow.

Nucleotide sequences of the VGAM2398 precursor RNA, herein designated VGAM PRECURSOR RNA, and of the 'diced' VGAM2398 RNA, herein designated VGAM RNA, and a schematic representation of the secondary folding of VGAM2398 folded precursor RNA, herein designated VGAM FOLDED PRECURSOR RNA, of VGAM2398 are further described hereinbelow with reference to Table 1.

Nucleotide sequences of host target binding sites, such as BINDING SITE-I, BINDING SITE-II and BINDING SITE-III of FIG. 1, found on VGAM2398 host target RNA, and schematic representation of the complementarity of each of these host target binding sites to VGAM2398 RNA, herein designated VGAM RNA, are described hereinbelow with reference to Table 2.

As mentioned hereinabove with reference to FIG. 1, a function of VGAM2398 gene, herein designated VGAM is inhibition of expression of VGAM2398 target genes. It is appreciated that specific functions, and accordingly utilities, of VGAM2398 correlate with, and may be deduced from, the identity of the target genes which VGAM2398 binds and inhibits, and the function of these target genes, as elaborated hereinbelow.

Frizzled Homolog 7 (Drosophila) (FZD7, Accession NM_003507) is a VGAM2398 host target gene. FZD7 BINDING SITE is HOST TARGET binding site found in the 3' untranslated region of mRNA encoded by FZD7, corresponding to a HOST TARGET binding site such as BINDING SITE I, BINDING SITE II or BINDING SITE III. Table 2 illustrates the complementarity of the nucleotide sequences of FZD7 BINDING SITE, designated SEQ ID:9598, to the nucleotide sequence of VGAM2398 RNA, herein designated VGAM RNA, also designated SEQ ID:5109.

A function of VGAM2398 is therefore inhibition of Frizzled Homolog 7 (Drosophila) (FZD7, Accession NM_003507), a gene which enhances beta-catenin mediated signaling. Accordingly, utilities of VGAM2398 include diagnosis, prevention and treatment of diseases and clinical conditions associated with FZD7. The function of FZD7 and its association with various diseases and clinical conditions, has been established by previous studies, as described hereinabove with reference to VGAM1063. LEC3 (Accession NM_015236) is another VGAM2398 host target gene. LEC3 BINDING SITE is HOST TARGET binding site found in the 3' untranslated region of mRNA encoded by LEC3, corresponding to a HOST TARGET binding site such as BINDING SITE I, BINDING SITE II or BINDING SITE III. Table 2 illustrates the complementarity of the nucleotide sequences of LEC3 BINDING SITE, designated SEQ ID:17567, to the nucleotide sequence of VGAM2398 RNA, herein designated VGAM RNA, also designated SEQ ID:5109.

Another function of VGAM2398 is therefore inhibition of LEC3 (Accession NM_015236). Accordingly, utilities of VGAM2398 include diagnosis, prevention and treatment of diseases and clinical conditions associated with LEC3. FIG. 1 further provides a conceptual description of a novel bioinformatically detected viral gene of the present invention, referred to here as Viral Genomic Address Messenger 2399 (VGAM2399) viral gene, which modulates expression of respective host target genes thereof, the function and utility of which host target genes is known in the art.

VGAM2399 is a novel bioinformatically detected regulatory, non protein coding, viral micro RNA (miRNA) gene. The method by which VGAM2399 was detected is described hereinabove with reference to FIGS. 1-8.

VGAM2399 gene, herein designated VGAM GENE, is a viral gene contained in the genome of Goatpox Virus. VGAM2399 host target gene, herein designated VGAM HOST TARGET GENE, is a human gene contained in the human genome.

VGAM2399 gene encodes a VGAM2399 precursor RNA, herein designated VGAM PRECURSOR RNA. Similar to other miRNA genes, and unlike most ordinary genes, VGAM2399 precursor RNA does not encode a protein. A nucleotide sequence identical or highly similar to the nucleotide sequence of VGAM2399 precursor RNA is designated SEQ ID:2385, and is provided hereinbelow with reference to the sequence listing part. Nucleotide sequence SEQ ID:2385 is located at position 23504 relative to the genome of Goatpox Virus.

VGAM2399 precursor RNA folds onto itself, forming VGAM2399 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2399 folded precursor RNA into VGAM2399 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2399 RNA is designated SEQ ID:5110, and is provided hereinbelow with reference to the sequence listing part.

VGAM2399 host target gene, herein designated VGAM HOST TARGET GENE, encodes a corresponding messenger RNA, VGAM2399 host target RNA, herein designated VGAM HOST TARGET RNA. VGAM2399 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2399 RNA, herein designated VGAM RNA, binds complementarily to one or more host target binding sites located in untranslated regions of VGAM2399 host target RNA, herein designated VGAM HOST TARGET RNA. This complementary binding is due to the fact that the nucleotide sequence of VGAM2399 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2399 RNA, herein designated VGAM RNA, may have a different number of host target binding sites in untranslated regions of a VGAM2399 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2399 RNA, herein designated VGAM RNA, to host target binding sites on VGAM2399 host target RNA, herein designated VGAM HOST TARGET RNA, such as BINDING SITE I, BINDING SITE II and BINDING SITE III, inhibits translation of VGAM2399 host target RNA into VGAM2399 host target protein, herein designated VGAM HOST TARGET PROTEIN. VGAM host target protein is therefore outlined by a broken line.

It is appreciated that VGAM2399 host target gene, herein designated VGAM HOST TARGET GENE, in fact represents a plurality of VGAM2399 host target genes. The mRNA of each one of this plurality of VGAM2399 host target genes comprises one or more host target binding sites, each having a nucleotide sequence which is at least partly complementary to VGAM2399 RNA, herein designated VGAM RNA, and which when bound by VGAM2399 RNA causes inhibition of translation of respective one or more VGAM2399 host target proteins.

It is further appreciated by one skilled in the art that the mode of translational inhibition illustrated by FIG. 1 with specific reference to translational inhibition exerted by VGAM2399 gene, herein designated VGAM GENE, on one or more VGAM2399 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2399 is inhibition of expression of host target genes, as part of a novel viral mechanism of attacking a host. Accordingly, utilities of VGAM2399 include diagnosis, prevention and treatment of viral infection by Goatpox Virus. Specific functions, and accordingly utilities, of VGAM2399 correlate with, and may be deduced from, the identity of the host target genes which VGAM2399 binds and inhibits, and the function of these host target genes, as elaborated hereinbelow.

Nucleotide sequences of the VGAM2399 precursor RNA, herein designated VGAM PRECURSOR RNA, and of the 'diced' VGAM2399 RNA, herein designated VGAM RNA, and a schematic representation of the secondary folding of VGAM2399 folded precursor RNA, herein designated VGAM FOLDED PRECURSOR RNA, of VGAM2399 are further described hereinbelow with reference to Table 1.

Nucleotide sequences of host target binding sites, such as BINDING SITE-I, BINDING SITE-II and BINDING SITE-III of FIG. 1, found on VGAM2399 host target RNA, and schematic representation of the complementarity of each of these host target binding sites to VGAM2399 RNA, herein designated VGAM RNA, are described hereinbelow with reference to Table 2.

As mentioned hereinabove with reference to FIG. 1, a function of VGAM2399 gene, herein designated VGAM is inhibition of expression of VGAM2399 target genes. It is appreciated that specific functions, and accordingly utilities, of VGAM2399 correlate with, and may be deduced from, the identity of the target genes which VGAM2399 binds and inhibits, and the function of these target genes, as elaborated hereinbelow.

ATPase, Cu++ Transporting, Alpha Polypeptide (Menkes syndrome) (ATP7A, Accession NM_000052) is a VGAM2399 host target gene. ATP7A BINDING SITE is HOST TARGET binding site found in the 3' untranslated region of mRNA encoded by ATP7A, corresponding to a HOST TARGET binding site such as BINDING SITE I, BINDING SITE II or BINDING SITE III. Table 2 illustrates the complementarity of the nucleotide sequences of ATP7A BINDING SITE, designated SEQ ID:5495, to the nucleotide sequence of VGAM2399 RNA, herein designated VGAM RNA, also designated SEQ ID:5110.

A function of VGAM2399 is therefore inhibition of ATPase, Cu++ Transporting, Alpha Polypeptide (Menkes syndrome) (ATP7A, Accession NM_000052). Accordingly, utilities of VGAM2399 include diagnosis, prevention and treatment of diseases and clinical conditions associated with ATP7A. Forkhead Box F2 (FOXF2, Accession NM_001452) is another VGAM2399 host target gene. FOXF2 BINDING SITE is HOST TARGET binding site found in the 3' untranslated region of mRNA encoded by FOXF2, corresponding to a HOST TARGET binding site such as BINDING SITE I, BINDING SITE II or BINDING SITE III. Table 2 illustrates the complementarity of the nucleotide sequences of FOXF2 BINDING SITE, designated SEQ ID:7187, to the nucleotide sequence of VGAM2399 RNA, herein designated VGAM RNA, also designated SEQ ID:5110.

Another function of VGAM2399 is therefore inhibition of Forkhead Box F2 (FOXF2, Accession NM_001452), a gene which is a probable transcription activator for a number of lung- specific genes. Accordingly, utilities of VGAM2399 include diagnosis, prevention and treatment of diseases and clinical conditions associated with FOXF2. The function of FOXF2 and its association with various diseases and clinical conditions, has been established by previous studies, as described hereinabove with reference to VGAM217. FLJ12085 (Accession NM_022771) is another VGAM2399 host target gene. FLJ12085 BINDING SITE is HOST TARGET binding site found in the 3' untranslated region of mRNA encoded by FLJ12085, corresponding to a HOST TARGET binding site such as BINDING SITE I, BINDING SITE II or BINDING SITE III. Table 2 illustrates the complementarity of the nucleotide sequences of FLJ12085 BINDING SITE, designated SEQ ID:23033, to the nucleotide sequence of VGAM2399 RNA, herein designated VGAM RNA, also designated SEQ ID:5110.

Another function of VGAM2399 is therefore inhibition of FLJ12085 (Accession NM_022771). Accordingly, utilities of VGAM2399 include diagnosis, prevention and treatment of diseases and clinical conditions associated with FLJ12085. FLJ20502 (Accession NM_017845) is another VGAM2399 host target gene. FLJ20502 BINDING SITE is HOST TARGET binding site found in the 3' untranslated region of mRNA encoded by FLJ20502, corresponding to a HOST TARGET binding site such as BINDING SITE I, BINDING SITE II or BINDING SITE III. Table 2 illustrates the complementarity of the nucleotide sequences of FLJ20502 BINDING SITE, designated SEQ ID:19508, to the nucleotide sequence of VGAM2399 RNA, herein designated VGAM RNA, also designated SEQ ID:5110.

Another function of VGAM2399 is therefore inhibition of FLJ20502 (Accession NM_017845). Accordingly, utilities of VGAM2399 include diagnosis, prevention and treatment of diseases and clinical conditions associated with FLJ20502. KIAA0826 (Accession XM_093839) is another VGAM2399 host target gene. KIAA0826 BINDING SITE is HOST TARGET binding site found in the 3' untranslated region of mRNA encoded by KIAA0826, corresponding to a HOST TARGET binding site such as BINDING SITE I, BINDING SITE II or BINDING SITE III. Table 2 illustrates the complementarity of the nucleotide sequences of KIAA0826 BINDING SITE, designated SEQ ID:40215, to the nucleotide sequence of VGAM2399 RNA, herein designated VGAM RNA, also designated SEQ ID:5110.

Another function of VGAM2399 is therefore inhibition of KIAA0826 (Accession XM_093839). Accordingly, utilities of VGAM2399 include diagnosis, prevention and treatment of diseases and clinical conditions associated with KIAA0826. KIAA0903 (Accession XM_049251) is another VGAM2399 host target gene. KIAA0903 BINDING SITE is HOST TARGET binding site found in the 5' untranslated region of mRNA encoded by KIAA0903, corresponding to a HOST TARGET binding site such as BINDING SITE I, BINDING SITE II or BINDING SITE III. Table 2 illustrates the complementarity of the nucleotide sequences of KIAA0903 BINDING SITE, designated SEQ ID:35369, to the nucleotide sequence of VGAM2399 RNA, herein designated VGAM RNA, also designated SEQ ID:5110.

Another function of VGAM2399 is therefore inhibition of KIAA0903 (Accession XM_049251). Accordingly, utilities of VGAM2399 include diagnosis, prevention and treatment of diseases and clinical conditions associated with KIAA0903. KIAA1729 (Accession XM_114418) is another VGAM2399 host target gene. KIAA1729 BINDING SITE is HOST TARGET binding site found in the 5' untranslated region of mRNA encoded by KIAA1729, corresponding to a HOST TARGET binding site such as BINDING SITE I, BINDING SITE II or BINDING SITE III. Table 2 illustrates the complementarity of the nucleotide sequences of KIAA1729 BINDING SITE, designated SEQ ID:42945, to the nucleotide sequence of VGAM2399 RNA, herein designated VGAM RNA, also designated SEQ ID:5110.

Another function of VGAM2399 is therefore inhibition of KIAA1729 (Accession XM_114418). Accordingly, utilities of VGAM2399 include diagnosis, prevention and treatment of diseases and clinical conditions associated with KIAA1729. Ligand of Numb-protein X (LNX, Accession NM_032622) is another VGAM2399 host target gene. LNX BINDING SITE is HOST TARGET binding site found in the 3' untranslated region of mRNA encoded by LNX, corresponding to a HOST TARGET binding site such as BINDING SITE I, BINDING SITE II or BINDING SITE III. Table 2 illustrates the complementarity of the nucleotide sequences of LNX BINDING SITE, designated SEQ ID:26338, to the nucleotide sequence of VGAM2399 RNA, herein designated VGAM RNA, also designated SEQ ID:5110.

Another function of VGAM2399 is therefore inhibition of Ligand of Numb-protein X (LNX, Accession NM_032622). Accordingly, utilities of VGAM2399 include diagnosis, prevention and treatment of diseases and clinical conditions associated with LNX. PRO1866 (Accession NM_018510) is another VGAM2399 host target gene. PRO1866 BINDING SITE is HOST TARGET binding site found in the 5' untranslated region of mRNA encoded by PRO1866, corresponding to a HOST TARGET binding site such as BINDING SITE I, BINDING SITE II or BINDING SITE III. Table 2 illustrates the complementarity of the nucleotide sequences of PRO1866 BINDING SITE, designated SEQ ID:20582, to the nucleotide sequence of VGAM2399 RNA, herein designated VGAM RNA, also designated SEQ ID:5110.

Another function of VGAM2399 is therefore inhibition of PRO1866 (Accession NM_018510). Accordingly, utilities of VGAM2399 include diagnosis, prevention and treatment of diseases and clinical conditions associated with PRO1866. LOC122830 (Accession XM_058661) is another VGAM2399 host target gene. LOC122830 BINDING SITE is HOST TARGET binding site found in the 3' untranslated region of mRNA encoded by LOC122830, corresponding to a HOST TARGET binding site such as BINDING SITE I, BINDING SITE II or BINDING SITE III. Table 2 illustrates the complementarity of the nucleotide sequences of LOC122830 BINDING SITE, designated SEQ ID:36703, to the nucleotide sequence of VGAM2399 RNA, herein designated VGAM RNA, also designated SEQ ID:5110.

Another function of VGAM2399 is therefore inhibition of LOC122830 (Accession XM_058661). Accordingly, utilities of VGAM2399 include diagnosis, prevention and treatment of diseases and clinical conditions associated with LOC122830. LOC170372 (Accession XM_084317) is another VGAM2399 host target gene. LOC170372 BINDING SITE is HOST TARGET binding site found in the 5' untranslated region of mRNA encoded by LOC170372, corresponding to a HOST TARGET binding site such as BINDING SITE I, BINDING SITE II or BINDING SITE III. Table 2 illustrates the complementarity of the nucleotide sequences of LOC170372 BINDING SITE, designated SEQ ID:37538, to the nucleotide sequence of VGAM2399 RNA, herein designated VGAM RNA, also designated SEQ ID:5110.

Another function of VGAM2399 is therefore inhibition of LOC170372 (Accession XM_084317). Accordingly, utilities of VGAM2399 include diagnosis, prevention and treatment of diseases and clinical conditions associated with LOC170372. FIG. 1 further provides a conceptual description of a novel bioinformatically detected viral gene of the present invention, referred to here as Viral Genomic Address Messenger 2400 (VGAM2400) viral gene, which modulates expression of respective host target genes thereof, the function and utility of which host target genes is known in the art.

VGAM2400 is a novel bioinformatically detected regulatory, non protein coding, viral micro RNA (miRNA) gene. The method by which VGAM2400 was detected is described hereinabove with reference to FIGS. 1-8.

VGAM2400 gene, herein designated VGAM GENE, is a viral gene contained in the genome of Goatpox Virus. VGAM2400 host target gene, herein designated VGAM HOST TARGET GENE, is a human gene contained in the human genome.

VGAM2400 gene encodes a VGAM2400 precursor RNA, herein designated VGAM PRECURSOR RNA. Similar to other miRNA genes, and unlike most ordinary genes, VGAM2400 precursor RNA does not encode a protein. A nucleotide sequence identical or highly similar to the nucleotide sequence of VGAM2400 precursor RNA is designated SEQ ID:2386, and is provided hereinbelow with reference to the sequence listing part. Nucleotide sequence SEQ ID:2386 is located at position 89837 relative to the genome of Goatpox Virus.

VGAM2400 precursor RNA folds onto itself, forming VGAM2400 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2400 folded precursor RNA into VGAM2400 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2400 RNA is designated SEQ ID:5111, and is provided hereinbelow with reference to the sequence listing part.

VGAM2400 host target gene, herein designated VGAM HOST TARGET GENE, encodes a corresponding messenger RNA, VGAM2400 host target RNA, herein designated VGAM HOST TARGET RNA. VGAM2400 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2400 RNA, herein designated VGAM RNA, binds complementarily to one or more host target binding sites located in untranslated regions of VGAM2400 host target RNA, herein designated VGAM HOST TARGET RNA. This complementary binding is due to the fact that the nucleotide sequence of VGAM2400 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2400 RNA, herein designated VGAM RNA, may have a different number of host target binding sites in untranslated regions of a VGAM2400 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2400 RNA, herein designated VGAM RNA, to host target binding sites on VGAM2400 host target RNA, herein designated VGAM HOST TARGET RNA, such as BINDING SITE I, BINDING SITE II and BINDING SITE III, inhibits translation of VGAM2400 host target RNA into VGAM2400 host target protein, herein designated VGAM HOST TARGET PROTEIN. VGAM host target protein is therefore outlined by a broken line.

It is appreciated that VGAM2400 host target gene, herein designated VGAM HOST TARGET GENE, in fact represents a plurality of VGAM2400 host target genes. The mRNA of each one of this plurality of VGAM2400 host target genes comprises one or more host target binding sites, each having a nucleotide sequence which is at least partly complementary to VGAM2400 RNA, herein designated VGAM RNA, and which when bound by VGAM2400 RNA causes inhibition of translation of respective one or more VGAM2400 host target proteins.

It is further appreciated by one skilled in the art that the mode of translational inhibition illustrated by FIG. 1 with specific reference to translational inhibition exerted by VGAM2400 gene, herein designated VGAM GENE, on one or more VGAM2400 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2400 is inhibition of expression of host target genes, as part of a novel viral mechanism of attacking a host. Accordingly, utilities of VGAM2400 include diagnosis, prevention and treatment of viral infection by Goatpox Virus. Specific functions, and accordingly utilities, of VGAM2400 correlate with, and may be deduced from, the identity of the host target genes which VGAM2400 binds and inhibits, and the function of these host target genes, as elaborated hereinbelow.

Nucleotide sequences of the VGAM2400 precursor RNA, herein designated VGAM PRECURSOR RNA, and of the 'diced' VGAM2400 RNA, herein designated VGAM RNA, and a schematic representation of the secondary folding of VGAM2400 folded precursor RNA, herein designated VGAM FOLDED PRECURSOR RNA, of VGAM2400 are further described hereinbelow with reference to Table 1.

Nucleotide sequences of host target binding sites, such as BINDING SITE-I, BINDING SITE-II and BINDING SITE-III of FIG. 1, found on VGAM2400 host target RNA, and schematic representation of the complementarity of each of these host target binding sites to VGAM2400 RNA, herein designated VGAM RNA, are described hereinbelow with reference to Table 2.

As mentioned hereinabove with reference to FIG. 1, a function of VGAM2400 gene, herein designated VGAM is inhibition of expression of VGAM2400 target genes. It is appreciated that specific functions, and accordingly utilities, of VGAM2400 correlate with, and may be deduced from, the identity of the target genes which VGAM2400 binds and inhibits, and the function of these target genes, as elaborated hereinbelow.

Phosphodiesterase 4D, CAMP-specific (phosphodiesterase E3 dunce homolog, Drosophila) (PDE4D, Accession XM_056815) is a VGAM2400 host target gene. PDE4D BINDING SITE is HOST TARGET binding site found in the 3' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36429, to the nucleotide sequence of VGAM2400 RNA, herein designated VGAM RNA, also designated SEQ ID:5111.

A function of VGAM2400 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM2400 include diagnosis, prevention and treatment of diseases and clinical conditions associated with PDE4D. The function of PDE4D and its association with various diseases and clinical conditions, has been established by previous studies, as described hereinabove with reference to VGAM180. FIG. 1 further provides a conceptual description of a novel bioinformatically detected viral gene of the present invention, referred to here as Viral Genomic Address Messenger 2401 (VGAM2401) viral gene, which modulates expression of respective host target genes thereof, the function and utility of which host target genes is known in the art.

VGAM2401 is a novel bioinformatically detected regulatory, non protein coding, viral micro RNA (miRNA) gene. The method by which VGAM2401 was detected is described hereinabove with reference to FIGS. 1-8.

VGAM2401 gene, herein designated VGAM GENE, is a viral gene contained in the genome of Goatpox Virus. VGAM2401 host target gene, herein designated VGAM HOST TARGET GENE, is a human gene contained in the human genome.

VGAM2401 gene encodes a VGAM2401 precursor RNA, herein designated VGAM PRECURSOR RNA. Similar to other miRNA genes, and unlike most ordinary genes, VGAM2401 precursor RNA does not encode a protein. A nucleotide sequence identical or highly similar to the nucleotide sequence of VGAM2401 precursor RNA is designated SEQ ID:2387, and is provided hereinbelow with reference to the sequence listing part. Nucleotide sequence SEQ ID:2387 is located at position 109414 relative to the genome of Goatpox Virus.

VGAM2401 precursor RNA folds onto itself, forming VGAM2401 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2401 folded precursor RNA into VGAM2401 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM2401 RNA is designated SEQ ID:5112, and is provided hereinbelow with reference to the sequence listing part.

VGAM2401 host target gene, herein designated VGAM HOST TARGET GENE, encodes a corresponding messenger RNA, VGAM2401 host target RNA, herein designated VGAM HOST TARGET RNA. VGAM2401 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2401 RNA, herein designated VGAM RNA, binds complementarily to one or more host target binding sites located in untranslated regions of VGAM2401 host target RNA, herein designated VGAM HOST TARGET RNA. This complementary binding is due to the fact that the nucleotide sequence of VGAM2401 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2401 RNA, herein designated VGAM RNA, may have a different number of host target binding sites in untranslated regions of a VGAM2401 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2401 RNA, herein designated VGAM RNA, to host target binding sites on VGAM2401 host target RNA, herein designated VGAM HOST TARGET RNA, such as BINDING SITE I, BINDING SITE II and BINDING SITE III, inhibits translation of VGAM2401 host target RNA into VGAM2401 host target protein, herein designated VGAM HOST TARGET PROTEIN. VGAM host target protein is therefore outlined by a broken line.

It is appreciated that VGAM2401 host target gene, herein designated VGAM HOST TARGET GENE, in fact represents a plurality of VGAM2401 host target genes. The mRNA of each one of this plurality of VGAM2401 host target genes comprises one or more host target binding sites, each having a nucleotide sequence which is at least partly complementary to VGAM2401 RNA, herein designated VGAM RNA, and which when bound by VGAM2401 RNA causes inhibition of translation of respective one or more VGAM2401 host target proteins.

It is further appreciated by one skilled in the art that the mode of translational inhibition illustrated by FIG. 1 with specific reference to translational inhibition exerted by VGAM2401 gene, herein designated VGAM GENE, on one or more VGAM2401 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2401 is inhibition of expression of host target genes, as part of a novel viral mechanism of attacking a host. Accordingly, utilities of VGAM2401 include diagnosis, prevention and treatment of viral infection by Goatpox Virus. Specific functions, and accordingly utilities, of VGAM2401 correlate with, and may be deduced from, the identity of the host target genes which VGAM2401 binds and inhibits, and the function of these host target genes, as elaborated hereinbelow.

Nucleotide sequences of the VGAM2401 precursor RNA, herein designated VGAM PRECURSOR RNA, and of the 'diced' VGAM2401 RNA, herein designated VGAM RNA, and a schematic representation of the secondary folding of VGAM2401 folded precursor RNA, herein designated VGAM FOLDED PRECURSOR RNA, of VGAM2401 are further described hereinbelow with reference to Table 1.

Nucleotide sequences of host target binding sites, such as BINDING SITE-I, BINDING SITE-II and BINDING SITE-III of FIG. 1, found on VGAM2401 host target RNA, and schematic representation of the complementarity of each of these host target binding sites to VGAM2401 RNA, herein designated VGAM RNA, are described hereinbelow with reference to Table 2.

As mentioned hereinabove with reference to FIG. 1, a function of VGAM2401 gene, herein designated VGAM is inhibition of expression of VGAM2401 target genes. It is appreciated that specific functions, and accordingly utilities, of VGAM2401 correlate with, and may be deduced from, the identity of the target genes which VGAM2401 binds and inhibits, and the function of these target genes, as elaborated hereinbelow.

ATP Synthase, H+ Transporting, Mitochondrial F1 Complex, Beta Polypeptide (ATP5B, Accession XM_006710) is a VGAM2401 host target gene. ATP5B BINDING SITE is HOST TARGET binding site found in the 5' untranslated region of mRNA encoded by ATP5B, corresponding to a HOST TARGET binding site such as BINDING SITE I, BINDING SITE II or BINDING SITE III. Table 2 illustrates the complementarity of the nucleotide sequences of ATP5B BINDING SITE, designated SEQ ID:30006, to the nucleotide sequence of VGAM2401 RNA, herein designated VGAM RNA, also designated SEQ ID:5112.

A function of VGAM2401 is therefore inhibition of ATP Synthase, H+ Transporting, Mitochondrial F1 Complex, Beta Polypeptide (ATP5B, Accession XM_006710). Accordingly, utilities of VGAM2401 include diagnosis, prevention and treatment of diseases and clinical conditions associated with ATP5B. Cadherin, EGF LAG Seven-pass G-type Receptor 3 (flamingo homolog, Drosophila) (CELSR3, Accession NM_001407) is another VGAM2401 host target gene. CELSR3 BINDING SITE is HOST TARGET binding site found in the 3' untranslated region of mRNA encoded by CELSR3, corresponding to a HOST TARGET binding site such as BINDING SITE I, BINDING SITE II or BINDING SITE III. Table 2 illustrates the complementarity of the nucleotide sequences of CELSR3 BINDING SITE, designated SEQ ID:7102, to the nucleotide sequence of VGAM2401 RNA, herein designated VGAM RNA, also designated SEQ ID:5112.

Another function of VGAM2401 is therefore inhibition of Cadherin, EGF LAG Seven-pass G-type Receptor 3 (flamingo homolog, Drosophila) (CELSR3, Accession NM_001407), a gene which interacts in a homophilic manner in connecting cells. Accordingly, utilities of VGAM2401 include diagnosis, prevention and treatment of diseases and clinical conditions associated with CELSR3. The function of CELSR3 and its association with various diseases and clinical conditions, has been established by previous studies, as described hereinabove with reference to VGAM893. Epidermal Growth Factor Receptor Pathway Substrate 15 (EPS15, Accession NM_001981) is another VGAM2401 host target gene. EPS15 BINDING SITE is HOST TARGET binding site found in the 3' untranslated region of mRNA encoded by EPS15, corresponding to a HOST TARGET binding site such as BINDING SITE I, BINDING SITE II or BINDING SITE III. Table 2 illustrates the complementarity of the nucleotide sequences of EPS15 BINDING SITE, designated SEQ ID:7711, to the nucleotide sequence of VGAM2401 RNA, herein designated VGAM RNA, also designated SEQ ID:5112.

Another function of VGAM2401 is therefore inhibition of Epidermal Growth Factor Receptor Pathway Substrate 15 (EPS15, Accession NM_001981), a gene which involved in cell growth regulation. Accordingly, utilities of VGAM2401 include diagnosis, prevention and treatment of diseases and clinical conditions associated with EPS15. The function of EPS15 and its association with various diseases and clinical conditions, has been established by previous studies, as described hereinabove with reference to VGAM1959. Interleukin 4 Receptor (IL4R, Accession NM_000418) is another VGAM2401 host target gene. IL4R BINDING SITE is HOST TARGET binding site found in the 3' untranslated region of mRNA encoded by IL4R, corresponding to a HOST TARGET binding site such as BINDING SITE I, BINDING SITE II or BINDING SITE III. Table 2 illustrates the complementarity of the nucleotide sequences of IL4R BINDING SITE, designated SEQ ID:6000, to the nucleotide sequence of VGAM2401 RNA, herein designated VGAM RNA, also designated SEQ ID:5112.

Another function of VGAM2401 is therefore inhibition of Interleukin 4 Receptor (IL4R, Accession NM_000418), a gene which may represent a regulatory molecule specific for il-4-dependent immune responses. Accordingly, utilities of VGAM2401 include diagnosis, prevention and treatment of diseases and clinical conditions associated with IL4R. The function of IL4R has been established by previous studies. Interleukin-4 (IL4; 147780) plays a major role in immunoglobulin E (IgE) production. Its signal is conferred to effector cells through binding to the alpha chain of the IL4 receptor (IL4RA). Caggana et al. (1999) examined the frequency of the IL4R sequence variants gly551 to arg and ile50 to val in 4 anonymous New York state populations defined by ethnic origin. These variants were studied because they are associated with atopy or atopic asthma, the prevalence of which varies in different populations. Methods were developed to detect both polymorphisms in 855 newborn screening specimens. The arg551 allele was found most frequently in blacks (allele frequency of 68%), whereas the ile50 allele was most common in whites (allele frequency of 87%). Significantly more blacks had chromosomes bearing both of the 'enhanced-signaling' variants (ile50/arg551). Since enhanced IL4R signaling is associated with increased IgE production (atopy), Caggana et al. (1999) interpreted their data as suggesting that African-American populations may be at increased risk for diseases, including asthma, that are associated with atopy. The data pointed to the importance of determining the frequencies of single-nucleotide polymorphisms in different populations before drawing conclusions from allele association studies, since the background allele frequencies may be disparate. A genomewide screen for atopy susceptibility alleles in the Hutterites, a founder population of European origin living mainly in Canada, provided evidence for linkage to 16p (Ober et al., 1999). Ober et al. (2000) examined the IL4RA gene as the 16p-linked susceptibility locus. The Hutterites and outbred white, black, and Hispanic families all showed evidence of association between variants in the IL4RA gene and atopy or asthma; however, the alleles or haplotypes showing the strongest evidence differed between the groups.

Full details of the abovementioned studies are described in the following publications, the disclosure of which are hereby incorporated by reference:

Caggana, M.; Walker, K.; Reilly, A. A.; Conroy, J. M.; Duva, S.; Walsh, A. C.: Population-based studies reveal differences in the allelic frequencies of two functionally significant human interleukin-4 receptor polymorphisms in several ethnic groups. Genet. Med. 1:267-271, 1999; and Ober, C.; Leavitt, S. A.; Tsalenko, A.; Howard, T. D.; Hoki, D. M.; Daniel, R.; Newman, D. L.; Wu, X.; Parry, R.; Lester, L. A.; Solway, J.; Blumenthal, M.; King, R. A.; Xu, J.; Meyers.

Further studies establishing the function and utilities of IL4R are found in John Hopkins OMIM database record ID 147781, and in sited publications numbered 11337-11338, 11595-11596, 688, 11597, 11598, 11599-1160 and 11592 listed in the bibliography section hereinbelow, which are also hereby incorporated by reference. Integrin, Alpha M (complement component receptor 3, alpha; also known as CD11b (p170), Macrophage Antigen Alpha Polypeptide) (IT-GAM, Accession NM_000632) is another VGAM2401 host target gene. ITGAM BINDING SITE is HOST TARGET binding site found in the 3' untranslated region of mRNA encoded by ITGAM, corresponding to a HOST TARGET binding site such as BINDING SITE I, BINDING SITE II or BINDING SITE III. Table 2 illustrates the complementarity of the nucleotide sequences of ITGAM BINDING SITE, designated SEQ ID:6248, to the nucleotide sequence of VGAM2401 RNA, herein designated VGAM RNA, also designated SEQ ID:5112.

Another function of VGAM2401 is therefore inhibition of Integrin, Alpha M (complement component receptor 3, alpha; also known as CD11b (p170), Macrophage Antigen Alpha Polypeptide) (ITGAM, Accession NM_000632), a gene which is invovled in various adhesive interactions of monocytes, macrophages and granulocytes as well as in mediating the uptake of complement-coated particles. Accordingly, utilities of VGAM2401 include diagnosis, prevention and treatment of diseases and clinical conditions associated with ITGAM. The function of ITGAM and its association with various diseases and clinical conditions, has been established by previous studies, as described hereinabove with reference to VGAM1386. SPS2 (Accession NM_012248) is another VGAM2401 host target gene. SPS2 BINDING SITE is HOST TARGET binding site found in the 3' untranslated region of mRNA encoded by SPS2, corresponding to a HOST TARGET binding site such as BINDING SITE I, BINDING SITE II or BINDING SITE III. Table 2 illustrates the complementarity of the nucleotide sequences of SPS2 BINDING SITE, designated SEQ ID:14554, to the nucleotide sequence of VGAM2401 RNA, herein designated VGAM RNA, also designated SEQ ID:5112.

Another function of VGAM2401 is therefore inhibition of SPS2 (Accession NM_012248), a gene which synthesizes selenophosphate from selenide and ATP. Accordingly, utilities of VGAM2401 include diagnosis, prevention and treatment of diseases and clinical conditions associated with SPS2. The function of SPS2 and its association with various diseases and clinical conditions, has been established by previous studies, as described hereinabove with reference to VGAM1754. Stanniocalcin 1 (STC1, Accession NM_003155) is another VGAM2401 host target gene. STC1 BINDING SITE is HOST TARGET binding site found in the 3' untranslated region of mRNA encoded by STC1, corresponding to a HOST TARGET binding site such as BINDING SITE I, BINDING SITE II or BINDING SITE III. Table 2 illustrates the complementarity of the nucleotide sequences of STC1 BINDING SITE, designated SEQ ID:9135, to the nucleotide sequence of VGAM2401 RNA, herein designated VGAM RNA, also designated SEQ ID:5112.

Another function of VGAM2401 is therefore inhibition of Stanniocalcin 1 (STC1, Accession NM_003155), a gene which stimulates renal phosphate reabsorption, and could therefore prevent hypercalcemia. Accordingly, utilities of VGAM2401 include diagnosis, prevention and treatment of diseases and clinical conditions associated with STC1. The function of STC1 and its association with various diseases and clinical conditions, has been established by previous studies, as described hereinabove with reference to VGAM623. T-cell Leukemia Translocation Altered Gene (TCTA, Accession NM_022171) is another VGAM2401 host target gene. TCTA BINDING SITE is HOST TARGET binding site found in the 3" untranslated region of mRNA encoded by TCTA, corresponding to a HOST TARGET binding site such as BINDING SITE I, BINDING SITE II or BINDING SITE III. Table 2 illustrates the complementarity of the nucleotide sequences of TCTA BINDING SITE, designated SEQ ID:22729, to the nucleotide sequence of VGAM2401 RNA, herein designated VGAM RNA, also designated SEQ ID:5112.

Another function of VGAM2401 is therefore inhibition of T-cell Leukemia Translocation Altered Gene (TCTA, Accession NM_022171). Accordingly, utilities of VGAM2401 include diagnosis, prevention and treatment of diseases and clinical conditions associated with TCTA. Triadin (TRDN, Accession NM_006073) is another VGAM2401 host target gene. TRDN BINDING SITE is HOST TARGET binding site found in the 3' untranslated region of mRNA encoded by TRDN, corresponding to a HOST TARGET binding site such as BINDING SITE I, BINDING SITE II or BINDING SITE III. Table 2 illustrates the complementarity of the nucleotide sequences of TRDN BINDING SITE, designated SEQ ID:12717, to the nucleotide sequence of VGAM2401 RNA, herein designated VGAM RNA, also designated SEQ ID:5112.

Another function of VGAM2401 is therefore inhibition of Triadin (TRDN, Accession NM_006073). Accordingly, utilities of VGAM2401 include diagnosis, prevention and treatment of diseases and clinical conditions associated with TRDN. Activin A Receptor, Type II (ACVR2, Accession NM_001616) is another VGAM2401 host target gene. ACVR2 BINDING SITE is HOST TARGET binding site found in the 3' untranslated region of mRNA encoded by ACVR2, corresponding to a HOST TARGET binding site such as BINDING SITE I, BINDING SITE II or BINDING SITE III. Table 2 illustrates the complementarity of the nucleotide sequences of ACVR2 BINDING SITE, designated SEQ ID:7320, to the nucleotide sequence of VGAM2401 RNA, herein designated VGAM RNA, also designated SEQ ID:5112.

Another function of VGAM2401 is therefore inhibition of Activin A Receptor, Type II (ACVR2, Accession NM_001616). Accordingly, utilities of VGAM2401 include diagnosis, prevention and treatment of diseases and clinical conditions associated with ACVR2. A Kinase (PRKA) Anchor Protein (gravin) 12 (AKAP12, Accession NM_005100) is another VGAM2401 host target gene. AKAP12 BINDING SITE1 and AKAP12 BINDING SITE2 are HOST TARGET binding sites found in untranslated regions of mRNA encoded by AKAP12, corresponding to HOST TARGET binding sites such as BINDING SITE I, BINDING SITE II or BINDING SITE III. Table 2 illustrates the complementarity of the nucleotide sequences of AKAP12 BINDING SITE1 and AKAP12 BINDING SITE2, designated SEQ ID:11573 and SEQ ID:29314 respectively, to the nucleotide sequence of VGAM2401 RNA, herein designated VGAM RNA, also designated SEQ ID:5112.

Another function of VGAM2401 is therefore inhibition of A Kinase (PRKA) Anchor Protein (gravin) 12 (AKAP12, Accession NM_005100). Accordingly, utilities of VGAM2401 include diagnosis, prevention and treatment of diseases and clinical conditions associated with AKAP12. FLJ20154 (Accession XM_053688) is another VGAM2401 host target gene. FLJ20154 BINDING SITE is HOST TARGET binding site found in the 5' untranslated region of mRNA encoded by FLJ20154, corresponding to a HOST TARGET binding site such as BINDING SITE I, BINDING SITE II or BINDING SITE III. Table 2 illustrates the complementarity of the nucleotide sequences of FLJ20154 BINDING SITE, designated SEQ ID:36105, to the nucleotide sequence of VGAM2401 RNA, herein designated VGAM RNA, also designated SEQ ID:5112.

Another function of VGAM2401 is therefore inhibition of FLJ20154 (Accession XM_053688). Accordingly, utilities of VGAM2401 include diagnosis, prevention and treatment of diseases and clinical conditions associated with FLJ20154. FLJ21616 (Accession NM_024567) is another VGAM2401 host target gene. FLJ21616 BINDING SITE is HOST TARGET binding site found in the 3' untranslated region of mRNA encoded by FLJ21616, corresponding to a HOST TARGET binding site such as BINDING SITE I, BINDING SITE II or BINDING SITE III. Table 2 illustrates the complementarity of the nucleotide sequences of FLJ21616 BINDING SITE, designated SEQ ID:23794, to the nucleotide sequence of VGAM2401 RNA, herein designated VGAM RNA, also designated SEQ ID:5112.

Another function of VGAM2401 is therefore inhibition of FLJ21616 (Accession NM_024567). Accordingly, utilities of VGAM2401 include diagnosis, prevention and treatment of diseases and clinical conditions associated with FLJ21616. FLJ22009 (Accession XM_015700) is another VGAM2401 host target gene. FLJ22009 BINDING SITE is HOST TARGET binding site found in the 3' untranslated region of mRNA encoded by FLJ22009, corresponding to a HOST TARGET binding site such as BINDING SITE I, BINDING SITE II or BINDING SITE III. Table 2 illustrates the complementarity of the nucleotide sequences of FLJ22009 BINDING SITE, designated SEQ ID:30242, to the nucleotide sequence of VGAM2401 RNA, herein designated VGAM RNA, also designated SEQ ID:5112.

Another function of VGAM2401 is therefore inhibition of FLJ22009 (Accession XM_015700). Accordingly, utilities of VGAM2401 include diagnosis, prevention and treatment of diseases and clinical conditions associated with FLJ22009. GNB4 (Accession NM_021629) is another VGAM2401 host target gene. GNB4 BINDING SITE is HOST TARGET binding site found in the 3' untranslated region of mRNA encoded by GNB4, corresponding to a HOST TARGET binding site such as BINDING SITE I, BINDING SITE II or BINDING SITE III. Table 2 illustrates the complementarity of the nucleotide sequences of GNB4 BINDING SITE, designated SEQ ID:22271, to the nucleotide sequence of VGAM2401 RNA, herein designated VGAM RNA, also designated SEQ ID:5112.

Another function of VGAM2401 is therefore inhibition of GNB4 (Accession NM_021629). Accordingly, utilities of VGAM2401 include diagnosis, prevention and treatment of diseases and clinical conditions associated with GNB4. KIAA0630 (Accession XM_114729) is another VGAM2401 host target gene. KIAA0630 BINDING SITE is HOST TARGET binding site found in the 3' untranslated region of mRNA encoded by KIAA0630, corresponding to a HOST TARGET binding site such as BINDING SITE I, BINDING SITE II or BINDING SITE III. Table 2 illustrates the complementarity of the nucleotide sequences of KIAA0630 BINDING SITE, designated SEQ ID:43066, to the nucleotide sequence of VGAM2401 RNA, herein designated VGAM RNA, also designated SEQ ID:5112.

Another function of VGAM2401 is therefore inhibition of KIAA0630 (Accession XM_114729). Accordingly, utilities of VGAM2401 include diagnosis, prevention and treatment of diseases and clinical conditions associated with KIAA0630. KIAA0680 (Accession NM_014721) is another VGAM2401 host target gene. KIAA0680 BINDING SITE is HOST TARGET binding site found in the 3' untranslated region of mRNA encoded by KIAA0680, corresponding to a HOST TARGET binding site such as BINDING SITE I, BINDING SITE II or BINDING SITE III. Table 2 illustrates the complementarity of the nucleotide sequences of KIAA0680 BINDING SITE, designated SEQ ID:16283, to the nucleotide sequence of VGAM2401 RNA, herein designated VGAM RNA, also designated SEQ ID:5112.

Another function of VGAM2401 is therefore inhibition of KIAA0680 (Accession NM_014721). Accordingly, utilities of VGAM2401 include diagnosis, prevention and treatment of diseases and clinical conditions associated with KIAA0680. KIAA0716 (Accession NM_014705) is another VGAM2401 host target gene. KIAA0716 BINDING SITE is HOST TARGET binding site found in the 3' untranslated region of mRNA encoded by KIAA0716, corresponding to a HOST TARGET binding site such as BINDING SITE I, BINDING SITE II or BINDING SITE III. Table 2 illustrates the complementarity of the nucleotide sequences of KIAA0716 BINDING SITE, designated SEQ ID:16246, to the nucleotide sequence of VGAM2401 RNA, herein designated VGAM RNA, also designated SEQ ID:5112.

Another function of VGAM2401 is therefore inhibition of KIAA0716 (Accession NM_014705). Accordingly, utilities of VGAM2401 include diagnosis, prevention and treatment of diseases and clinical conditions associated with KIAA0716. KIAA0953 (Accession XM_039733) is another VGAM2401 host target gene. KIAA0953 BINDING SITE is HOST TARGET binding site found in the 3' untranslated region of mRNA encoded by KIAA0953, corresponding to a HOST TARGET binding site such as BINDING SITE I, BINDING SITE II or BINDING SITE III. Table 2 illustrates the complementarity of the nucleotide sequences of KIAA0953 BINDING SITE, designated SEQ ID:33171, to the nucleotide sequence of VGAM2401 RNA, herein designated VGAM RNA, also designated SEQ ID:5112.

Another function of VGAM2401 is therefore inhibition of KIAA0953 (Accession XM_039733). Accordingly, utilities of VGAM2401 include diagnosis, prevention and treatment of diseases and clinical conditions associated with KIAA0953. KIAA1319 (Accession NM_020770) is another VGAM2401 host target gene. KIAA1319 BINDING SITE is HOST TARGET binding site found in the 3' untranslated region of mRNA encoded by KIAA1319, corresponding to a HOST TARGET binding site such as BINDING SITE I, BINDING SITE II or BINDING SITE III. Table 2 illustrates the complementarity of the nucleotide sequences of KIAA1319 BINDING SITE, designated SEQ ID:21866, to the nucleotide sequence of VGAM2401 RNA, herein designated VGAM RNA, also designated SEQ ID:5112.

Another function of VGAM2401 is therefore inhibition of KIAA1319 (Accession NM_020770). Accordingly, utilities of VGAM2401 include diagnosis, prevention and treatment of diseases and clinical conditions associated with KIAA1319. KIAA1361 (Accession XM_030845) is another VGAM2401 host target gene. KIAA1361 BINDING SITE is HOST TARGET binding site found in the 3' untranslated region of mRNA encoded by KIAA1361, corresponding to a HOST TARGET binding site such as BINDING SITE I, BINDING SITE II or BINDING SITE III. Table 2 illustrates the complementarity of the nucleotide sequences of KIAA1361 BINDING SITE, designated SEQ ID:31172, to the nucleotide sequence of VGAM2401 RNA, herein designated VGAM RNA, also designated SEQ ID:5112.

Another function of VGAM2401 is therefore inhibition of KIAA1361 (Accession XM_030845). Accordingly, utilities of VGAM2401 include diagnosis, prevention and treatment of diseases and clinical conditions associated with KIAA1361. KIAA1719 (Accession XM_042936) is another VGAM2401 host target gene. KIAA1719 BINDING SITE is HOST TARGET binding site found in the 3' untranslated region of mRNA encoded by KIAA1719, corresponding to a HOST TARGET binding site such as BINDING SITE I, BINDING SITE II or BINDING SITE III. Table 2 illustrates the complementarity of the nucleotide sequences of KIAA1719 BINDING SITE, designated SEQ ID:33825, to the nucleotide sequence of VGAM2401 RNA, herein designated VGAM RNA, also designated SEQ ID:5112.

Another function of VGAM2401 is therefore inhibition of KIAA1719 (Accession XM_042936). Accordingly, utilities of VGAM2401 include diagnosis, prevention and treatment of diseases and clinical conditions associated with KIAA1719. NCK Adaptor Protein 1 (NCK1, Accession NM_006153) is another VGAM2401 host target gene. NCK1 BINDING SITE is HOST TARGET binding site found in the 3' untranslated region of mRNA encoded by NCK1, corresponding to a HOST TARGET binding site such as BINDING SITE I, BINDING SITE II or BINDING SITE III. Table 2 illustrates the complementarity of the nucleotide sequences of NCK1 BINDING SITE, designated SEQ ID:12808, to the nucleotide sequence of VGAM2401 RNA, herein designated VGAM RNA, also designated SEQ ID:5112.

Another function of VGAM2401 is therefore inhibition of NCK Adaptor Protein 1 (NCK1, Accession NM_006153). Accordingly, utilities of VGAM2401 include diagnosis, prevention and treatment of diseases and clinical conditions associated with NCK1. PRO1866 (Accession NM_018510) is another VGAM2401 host target gene. PRO1866 BINDING SITE is HOST TARGET binding site found in the 5' untranslated region of mRNA encoded by PRO1866, corresponding to a HOST TARGET binding site such as BINDING SITE I, BINDING SITE II or BINDING SITE III. Table 2 illustrates the complementarity of the nucleotide sequences of PRO1866 BINDING SITE, designated SEQ ID:20579, to the nucleotide sequence of VGAM2401 RNA, herein designated VGAM RNA, also designated SEQ ID:5112.

Another function of VGAM2401 is therefore inhibition of PRO1866 (Accession NM_018510). Accordingly, utilities of VGAM2401 include diagnosis, prevention and treatment of diseases and clinical conditions associated with PRO1866. LOC148697 (Accession XM_086276) is another VGAM2401 host target gene. LOC148697 BINDING SITE is HOST TARGET binding site found in the 3' untranslated region of mRNA encoded by LOC148697, corresponding to a HOST TARGET binding site such as BINDING SITE I, BINDING SITE II or BINDING SITE III. Table 2 illustrates the complementarity of the nucleotide sequences of LOC148697 BINDING SITE, designated SEQ ID:38575, to the nucleotide sequence of VGAM2401 RNA, herein designated VGAM RNA, also designated SEQ ID:5112.

Another function of VGAM2401 is therefore inhibition of LOC148697 (Accession XM_086276). Accordingly, utilities of VGAM2401 include diagnosis, prevention and treatment of diseases and clinical conditions associated with LOC148697. LOC154215 (Accession XM_087875) is another VGAM2401 host target gene. LOC154215 BINDING SITE is HOST TARGET binding site found in the 3' untranslated region of mRNA encoded by LOC154215, corresponding to a HOST TARGET binding site such as BINDING SITE I, BINDING SITE II or BINDING SITE III. Table 2 illustrates the complementarity of the nucleotide sequences of LOC154215 BINDING SITE, designated SEQ ID:39465, to the nucleotide sequence of VGAM2401 RNA, herein designated VGAM RNA, also designated SEQ ID:5112.

Another function of VGAM2401 is therefore inhibition of LOC154215 (Accession XM_087875). Accordingly, utilities of VGAM2401 include diagnosis, prevention and treatment of diseases and clinical conditions associated with LOC154215. LOC205418 (Accession XM_119792) is another VGAM2401 host target gene. LOC205418 BINDING SITE is HOST TARGET binding site found in the 5' untranslated region of mRNA encoded by LOC205418, corresponding to a HOST TARGET binding site such as BIND- ING SITE I, BINDING SITE II or BINDING SITE III. Table 2 illustrates the complementarity of the nucleotide sequences of LOC205418 BINDING SITE, designated SEQ ID:43597, to the nucleotide sequence of VGAM2401 RNA, herein designated VGAM RNA, also designated SEQ ID:5112.

Another function of VGAM2401 is therefore inhibition of LOC205418 (Accession XM_119792). Accordingly, utilities of VGAM2401 include diagnosis, prevention and treatment of diseases and clinical conditions associated with LOC205418. FIG. 1 further provides a conceptual description of a novel bioinformatically detected viral gene of the present invention, referred to here as Viral Genomic Address Messenger 2402 (VGAM2402) viral gene, which modulates expression of respective host target genes thereof, the function and utility of which host target genes is known in the art.

VGAM2402 is a novel bioinformatically detected regulatory, non protein coding, viral micro RNA (miRNA) gene. The method by which VGAM2402 was detected is described hereinabove with reference to FIGS. 1-8.

VGAM2402 gene, herein designated VGAM GENE, is a viral gene contained in the genome of Goatpox Virus. VGAM2402 host target gene, herein designated VGAM HOST TARGET GENE, is a human gene contained in the human genome.

VGAM2402 gene encodes a VGAM2402 precursor RNA, herein designated VGAM PRECURSOR RNA. Similar to other miRNA genes, and unlike most ordinary genes, VGAM2402 precursor RNA does not encode a protein. A nucleotide sequence identical or highly similar to the nucleotide sequence of VGAM2402 precursor RNA is designated SEQ ID:2388, and is provided hereinbelow with reference to the sequence listing part. Nucleotide sequence SEQ ID:2388 is located at position 702 relative to the genome of Goatpox Virus.

VGAM2402 precursor RNA folds onto itself, forming VGAM2402 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2402 folded precursor RNA into VGAM2402 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2402 RNA is designated SEQ ID:5113, and is provided hereinbelow with reference to the sequence listing part.

VGAM2402 host target gene, herein designated VGAM HOST TARGET GENE, encodes a corresponding messenger RNA, VGAM2402 host target RNA, herein designated VGAM HOST TARGET RNA. VGAM2402 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2402 RNA, herein designated VGAM RNA, binds complementarily to one or more host target binding sites located in untranslated regions of VGAM2402 host target RNA, herein designated VGAM HOST TARGET RNA. This complementary binding is due to the fact that the nucleotide sequence of VGAM2402 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2402 RNA, herein designated VGAM RNA, may have a different number of host target binding sites in untranslated regions of a VGAM2402 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2402 RNA, herein designated VGAM RNA, to host target binding sites on VGAM2402 host target RNA, herein designated VGAM HOST TARGET RNA, such as BINDING SITE I, BINDING SITE II and BINDING SITE III, inhibits translation of VGAM2402 host target RNA into VGAM2402 host target protein, herein designated VGAM HOST TARGET PROTEIN. VGAM host target protein is therefore outlined by a broken line.

It is appreciated that VGAM2402 host target gene, herein designated VGAM HOST TARGET GENE, in fact represents a plurality of VGAM2402 host target genes. The mRNA of each one of this plurality of VGAM2402 host target genes comprises one or more host target binding sites, each having a nucleotide sequence which is at least partly complementary to VGAM2402 RNA, herein designated VGAM RNA, and which when bound by VGAM2402 RNA causes inhibition of translation of respective one or more VGAM2402 host target proteins.

It is further appreciated by one skilled in the art that the mode of translational inhibition illustrated by FIG. 1 with specific reference to translational inhibition exerted by VGAM2402 gene, herein designated VGAM GENE, on one or more VGAM2402 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2402 is inhibition of expression of host target genes, as part of a novel viral mechanism of attacking a host. Accordingly, utilities of VGAM2402 include diagnosis, prevention and treatment of viral infection by Goatpox Virus. Specific functions, and accordingly utilities, of VGAM2402 correlate with, and may be deduced from, the identity of the host target genes which VGAM2402 binds and inhibits, and the function of these host target genes, as elaborated hereinbelow.

Nucleotide sequences of the VGAM2402 precursor RNA, herein designated VGAM PRECURSOR RNA, and of the 'diced' VGAM2402 RNA, herein designated VGAM RNA, and a schematic representation of the secondary folding of VGAM2402 folded precursor RNA, herein designated VGAM FOLDED PRECURSOR RNA, of VGAM2402 are further described hereinbelow with reference to Table 1.

Nucleotide sequences of host target binding sites, such as BINDING SITE-I, BINDING SITE-II and BINDING SITE-III of FIG. 1, found on VGAM2402 host target RNA, and schematic representation of the complementarity of each of these host target binding sites to VGAM2402 RNA, herein designated VGAM RNA, are described hereinbelow with reference to Table 2.

As mentioned hereinabove with reference to FIG. 1, a function of VGAM2402 gene, herein designated VGAM is inhibition of expression of VGAM2402 target genes. It is appreciated that specific functions, and accordingly utilities, of VGAM2402 correlate with, and may be deduced from, the identity of the target genes which VGAM2402 binds and inhibits, and the function of these target genes, as elaborated hereinbelow.

Protocadherin 11 X-linked (PCDH11X, Accession NM_032968) is a VGAM2402 host target gene. PCDH11X BINDING SITE1 and PCDH11X BINDING SITE2 are HOST TARGET binding sites found in untranslated regions of mRNA encoded by PCDH11X, corresponding to HOST TARGET binding sites such as BINDING SITE I, BINDING SITE II or BINDING SITE III. Table 2 illustrates the complementarity of the nucleotide sequences of PCDH11X BINDING SITE1 and PCDH11X BINDING SITE2, designated SEQ ID:26787 and SEQ ID:26802 respectively, to the nucleotide sequence of VGAM2402 RNA, herein designated VGAM RNA, also designated SEQ ID:5113.

A function of VGAM2402 is therefore inhibition of Protocadherin 11 X-linked (PCDH11X, Accession NM_032968), a gene which is thought to play a fundamental role in cell-cell recognition essential for the segmental development and function of the central nervous system. Accordingly, utilities of VGAM2402 include diagnosis, prevention and treatment of diseases and clinical conditions associated with PCDH11X. The function of PCDH11X and its association with various diseases and clinical conditions, has been established by previous studies, as described hereinabove with reference to VGAM433. Solute Carrier Family 25 (mitochondrial carrier; ornithine transporter) Member 15 (SLC25A15, Accession NM_014252) is another VGAM2402 host target gene. SLC25A15 BINDING SITE is HOST TARGET binding site found in the 3' untranslated region of mRNA encoded by SLC25A15, corresponding to a HOST TARGET binding site such as BINDING SITE I, BINDING SITE II or BINDING SITE III. Table 2 illustrates the complementarity of the nucleotide sequences of SLC25A15 BINDING SITE, designated SEQ ID:15525, to the nucleotide sequence of VGAM2402 RNA, herein designated VGAM RNA, also designated SEQ ID:5113.

Another function of VGAM2402 is therefore inhibition of Solute Carrier Family 25 (mitochondrial carrier; ornithine transporter) Member 15 (SLC25A15, Accession NM_014252), a gene which participates theornithine transport across inner mitochondrial membrane, from the cytoplasm to the matrix. Accordingly, utilities of VGAM2402 include diagnosis, prevention and treatment of diseases and clinical conditions associated with SLC25A15. The function of SLC25A15 and its association with various diseases and clinical conditions, has been established by previous studies, as described hereinabove with reference to VGAM172. Baculoviral IAP Repeat-containing 5 (survivin) (BIRC5, Accession NM_001168) is another VGAM2402 host target gene. BIRC5 BINDING SITE is HOST TARGET binding site found in the 3' untranslated region of mRNA encoded by BIRC5, corresponding to a HOST TARGET binding site such as BINDING SITE I, BINDING SITE II or BINDING SITE III. Table 2 illustrates the complementarity of the nucleotide sequences of BIRC5 BINDING SITE, designated SEQ ID:6835, to the nucleotide sequence of VGAM2402 RNA, herein designated VGAM RNA, also designated SEQ ID:5113.

Another function of VGAM2402 is therefore inhibition of Baculoviral IAP Repeat-containing 5 (survivin) (BIRC5, Accession NM_001168). Accordingly, utilities of VGAM2402 include diagnosis, prevention and treatment of diseases and clinical conditions associated with BIRC5. Carbohydrate (chondroitin) Synthase 1 (CHSY1, Accession NM_014918) is another VGAM2402 host target gene. CHSY1 BINDING SITE is HOST TARGET binding site found in the 3' untranslated region of mRNA encoded by CHSY1, corresponding to a HOST TARGET binding site such as BINDING SITE I, BINDING SITE II or BINDING SITE III. Table 2 illustrates the complementarity of the nucleotide sequences of CHSY1 BINDING SITE, designated SEQ ID:17170, to the nucleotide sequence of VGAM2402 RNA, herein designated VGAM RNA, also designated SEQ ID:5113.

Another function of VGAM2402 is therefore inhibition of Carbohydrate (chondroitin) Synthase 1 (CHSY1, Accession NM_014918). Accordingly, utilities of VGAM2402 include diagnosis, prevention and treatment of diseases and clinical conditions associated with CHSY1. DKFZP434P0721 (Accession XM_033181) is another VGAM2402 host target gene. DKFZP434P0721 BINDING SITE is HOST TARGET binding site found in the 3' untranslated region of mRNA encoded by DKFZP434P0721, corresponding to a HOST TARGET binding site such as BINDING SITE I, BINDING SITE II or BINDING SITE III. Table 2 illustrates the complementarity of the nucleotide sequences of DKFZP434P0721 BINDING SITE, designated SEQ ID:31868, to the nucleotide sequence of VGAM2402 RNA, herein designated VGAM RNA, also designated SEQ ID:5113.

Another function of VGAM2402 is therefore inhibition of DKFZP434P0721 (Accession XM_033181). Accordingly, utilities of VGAM2402 include diagnosis, prevention and treatment of diseases and clinical conditions associated with DKFZP434P0721. KIAA1336 (Accession XM_051306) is another VGAM2402 host target gene. KIAA1336 BINDING SITE is HOST TARGET binding site found in the 3' untranslated region of mRNA encoded by KIAA1336, corresponding to a HOST TARGET binding site such as BINDING SITE I, BINDING SITE II or BINDING SITE III. Table 2 illustrates the complementarity of the nucleotide sequences of KIAA1336 BINDING SITE, designated SEQ ID:35800, to the nucleotide sequence of VGAM2402 RNA, herein designated VGAM RNA, also designated SEQ ID:5113.

Another function of VGAM2402 is therefore inhibition of KIAA1336 (Accession XM_051306). Accordingly, utilities of VGAM2402 include diagnosis, prevention and treatment of diseases and clinical conditions associated with KIAA1336. Period Homolog 3 (Drosophila) (PER3, Accession NM_016831) is another VGAM2402 host target gene. PER3 BINDING SITE is HOST TARGET binding site found in the 5' untranslated region of mRNA encoded by PER3, corresponding to a HOST TARGET binding site such as BINDING SITE I, BINDING SITE II or BINDING SITE III. Table 2 illustrates the complementarity of the nucleotide sequences of PER3 BINDING SITE, designated SEQ ID:18821, to the nucleotide sequence of VGAM2402 RNA, herein designated VGAM RNA, also designated SEQ ID:5113.

Another function of VGAM2402 is therefore inhibition of Period Homolog 3 (Drosophila) (PER3, Accession NM_016831). Accordingly, utilities of VGAM2402 include diagnosis, prevention and treatment of diseases and clinical conditions associated with PER3. SS-56 (Accession XM_006063) is another VGAM2402 host target gene. SS-56 BINDING SITE is HOST TARGET binding site found in the 3' untranslated region of mRNA encoded by SS-56, corresponding to a HOST TARGET binding site such as BINDING SITE I, BINDING SITE II or BINDING SITE III. Table 2 illustrates the complementarity of the nucleotide sequences of SS-56 BINDING SITE, designated SEQ ID:29987, to the nucleotide sequence of VGAM2402 RNA, herein designated VGAM RNA, also designated SEQ ID:5113.

Another function of VGAM2402 is therefore inhibition of SS-56 (Accession XM_006063). Accordingly, utilities of VGAM2402 include diagnosis, prevention and treatment of diseases and clinical conditions associated with SS-56. LOC148195 (Accession XM_097419) is another VGAM2402 host target gene. LOC148195 BINDING SITE is HOST TARGET binding site found in the 5' untranslated region of mRNA encoded by LOC148195, corresponding to a HOST TARGET binding site such as BINDING SITE I, BINDING SITE II or BINDING SITE III. Table 2 illustrates the complementarity of the nucleotide sequences of LOC148195 BINDING SITE, designated SEQ ID:40871, to the nucleotide sequence of VGAM2402 RNA, herein designated VGAM RNA, also designated SEQ ID:5113.

Another function of VGAM2402 is therefore inhibition of LOC148195 (Accession XM_097419). Accordingly, utilities of VGAM2402 include diagnosis, prevention and treatment of diseases and clinical conditions associated with LOC148195. LOC152503 (Accession XM_098238) is another VGAM2402 host target gene. LOC152503 BINDING SITE is HOST TARGET binding site found in the 5' untranslated region of mRNA encoded by LOC152503, corresponding to a HOST TARGET binding site such as BINDING SITE I, BINDING SITE II or BINDING SITE III. Table 2 illustrates the complementarity of the nucleotide sequences of LOC152503 BINDING SITE, designated SEQ ID:41515, to the nucleotide sequence of VGAM2402 RNA, herein designated VGAM RNA, also designated SEQ ID:5113.

Another function of VGAM2402 is therefore inhibition of LOC152503 (Accession XM_098238). Accordingly, utilities of VGAM2402 include diagnosis, prevention and treatment of diseases and clinical conditions associated with LOC152503. LOC51580 (Accession NM_015874) is another VGAM2402 host target gene. LOC51580 BINDING SITE is HOST TARGET binding site found in the 3' untranslated region of mRNA encoded by LOC51580, corresponding to a HOST TARGET binding site such as BINDING SITE I, BINDING SITE II or BINDING SITE III. Table 2 illustrates the complementarity of the nucleotide sequences of LOC51580 BINDING SITE, designated SEQ ID:18015, to the nucleotide sequence of VGAM2402 RNA, herein designated VGAM RNA, also designated SEQ ID:5113.

Another function of VGAM2402 is therefore inhibition of LOC51580 (Accession NM_015874). Accordingly, utilities of VGAM2402 include diagnosis, prevention and treatment of diseases and clinical conditions associated with LOC51580. LOC90906 (Accession XM_034809) is another VGAM2402 host target gene. LOC90906 BINDING SITE is HOST TARGET binding site found in the 3' untranslated region of mRNA encoded by LOC90906, corresponding to a HOST TARGET binding site such as BINDING SITE I, BINDING SITE II or BINDING SITE III. Table 2 illustrates the complementarity of the nucleotide sequences of LOC90906 BINDING SITE, designated SEQ ID:32146, to the nucleotide sequence of VGAM2402 RNA, herein designated VGAM RNA, also designated SEQ ID:5113.

Another function of VGAM2402 is therefore inhibition of LOC90906 (Accession XM_034809). Accordingly, utilities of VGAM2402 include diagnosis, prevention and treatment of diseases and clinical conditions associated with LOC90906. FIG. 1 further provides a conceptual description of a novel bioinformatically detected viral gene of the present invention, referred to here as Viral Genomic Address Messenger 2403 (VGAM2403) viral gene, which modulates expression of respective host target genes thereof, the function and utility of which host target genes is known in the art.

VGAM2403 is a novel bioinformatically detected regulatory, non protein coding, viral micro RNA (miRNA) gene. The method by which VGAM2403 was detected is described hereinabove with reference to FIGS. 1-8.

VGAM2403 gene, herein designated VGAM GENE, is a viral gene contained in the genome of Goatpox Virus. VGAM2403 host target gene, herein designated VGAM HOST TARGET GENE, is a human gene contained in the human genome.

VGAM2403 gene encodes a VGAM2403 precursor RNA, herein designated VGAM PRECURSOR RNA. Similar to other miRNA genes, and unlike most ordinary genes, VGAM2403 precursor RNA does not encode a protein. A nucleotide sequence identical or highly similar to the nucleotide sequence of VGAM2403 precursor RNA is designated SEQ ID:2389, and is provided hereinbelow with reference to the sequence listing part. Nucleotide sequence SEQ ID:2389 is located at position 52365 relative to the genome of Goatpox Virus.

VGAM2403 precursor RNA folds onto itself, forming VGAM2403 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2403 folded precursor RNA into VGAM2403 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 85%) nucleotide sequence of VGAM2403 RNA is designated SEQ ID:5114, and is provided hereinbelow with reference to the sequence listing part.

VGAM2403 host target gene, herein designated VGAM HOST TARGET GENE, encodes a corresponding messenger RNA, VGAM2403 host target RNA, herein designated VGAM HOST TARGET RNA. VGAM2403 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2403 RNA, herein designated VGAM RNA, binds complementarily to one or more host target binding sites located in untranslated regions of VGAM2403 host target RNA, herein designated VGAM HOST TARGET RNA. This complementary binding is due to the fact that the nucleotide sequence of VGAM2403 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2403 RNA, herein designated VGAM RNA, may have a different number of host target binding sites in untranslated regions of a VGAM2403 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2403 RNA, herein designated VGAM RNA, to host target binding sites on VGAM2403 host target RNA, herein designated VGAM HOST TARGET RNA, such as BINDING SITE I, BINDING SITE II and BINDING SITE III, inhibits translation of VGAM2403 host target RNA into VGAM2403 host target protein, herein designated VGAM HOST TARGET PROTEIN. VGAM host target protein is therefore outlined by a broken line.

It is appreciated that VGAM2403 host target gene, herein designated VGAM HOST TARGET GENE, in fact represents a plurality of VGAM2403 host target genes. The mRNA of each one of this plurality of VGAM2403 host target genes comprises one or more host target binding sites, each having a nucleotide sequence which is at least partly complementary to VGAM2403 RNA, herein designated VGAM RNA, and which when bound by VGAM2403 RNA causes inhibition of translation of respective one or more VGAM2403 host target proteins.

It is further appreciated by one skilled in the art that the mode of translational inhibition illustrated by FIG. 1 with specific reference to translational inhibition exerted by VGAM2403 gene, herein designated VGAM GENE, on one or more VGAM2403 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2403 is inhibition of expression of host target genes, as part of a novel viral mechanism of attacking a host. Accordingly, utilities of VGAM2403 include diagnosis, prevention and treatment of viral infection by Goatpox Virus. Specific functions, and accordingly utilities, of VGAM2403 correlate with, and may be deduced from, the identity of the host target genes which VGAM2403 binds and inhibits, and the function of these host target genes, as elaborated hereinbelow.

Nucleotide sequences of the VGAM2403 precursor RNA, herein designated VGAM PRECURSOR RNA, and of the 'diced' VGAM2403 RNA, herein designated VGAM RNA, and a schematic representation of the secondary folding of VGAM2403 folded precursor RNA, herein designated VGAM FOLDED PRECURSOR RNA, of VGAM2403 are further described hereinbelow with reference to Table 1.

Nucleotide sequences of host target binding sites, such as BINDING SITE-I, BINDING SITE-II and BINDING SITE-III of FIG. 1, found on VGAM2403 host target RNA, and schematic representation of the complementarity of each of these host target binding sites to VGAM2403 RNA, herein designated VGAM RNA, are described hereinbelow with reference to Table 2.

As mentioned hereinabove with reference to FIG. 1, a function of VGAM2403 gene, herein designated VGAM is inhibition of expression of VGAM2403 target genes. It is appreciated that specific functions, and accordingly utilities, of VGAM2403 correlate with, and may be deduced from, the identity of the target genes which VGAM2403 binds and inhibits, and the function of these target genes, as elaborated hereinbelow.

Solute Carrier Family 6 (neurotransmitter transporter, creatine), Member 8 (SLC6A8, Accession NM_005629) is a VGAM2403 host target gene. SLC6A8 BINDING SITE is HOST TARGET binding site found in the 5' untranslated region of mRNA encoded by SLC6A8, corresponding to a HOST TARGET binding site such as BINDING SITE I, BINDING SITE II or BINDING SITE III. Table 2 illustrates the complementarity of the nucleotide sequences of SLC6A8 BINDING SITE, designated SEQ ID:12145, to the nucleotide sequence of VGAM2403 RNA, herein designated VGAM RNA, also designated SEQ ID:5114.

A function of VGAM2403 is therefore inhibition of Solute Carrier Family 6 (neurotransmitter transporter, creatine), Member 8 (SLC6A8, Accession NM_005629). Accordingly, utilities of VGAM2403 include diagnosis, prevention and treatment of diseases and clinical conditions associated with SLC6A8. FLJ20291 (Accession NM_017748) is another VGAM2403 host target gene. FLJ20291 BINDING SITE is HOST TARGET binding site found in the 3' untranslated region of mRNA encoded by FLJ20291, corresponding to a HOST TARGET binding site such as BINDING SITE I, BINDING SITE II or BINDING SITE III. Table 2 illustrates the complementarity of the nucleotide sequences of FLJ20291 BINDING SITE, designated SEQ ID:19341, to the nucleotide sequence of VGAM2403 RNA, herein designated VGAM RNA, also designated SEQ ID:5114.

Another function of VGAM2403 is therefore inhibition of FLJ20291 (Accession NM_017748). Accordingly, utilities of VGAM2403 include diagnosis, prevention and treatment of diseases and clinical conditions associated with FLJ20291. FIG. 1 further provides a conceptual description of a novel bioinformatically detected viral gene of the present invention, referred to here as Viral Genomic Address Messenger 2404 (VGAM2404) viral gene, which modulates expression of respective host target genes thereof, the function and utility of which host target genes is known in the art.

VGAM2404 is a novel bioinformatically detected regulatory, non protein coding, viral micro RNA (miRNA) gene. The method by which VGAM2404 was detected is described hereinabove with reference to FIGS. 1-8.

VGAM2404 gene, herein designated VGAM GENE, is a viral gene contained in the genome of Goatpox Virus. VGAM2404 host target gene, herein designated VGAM HOST TARGET GENE, is a human gene contained in the human genome.

VGAM2404 gene encodes a VGAM2404 precursor RNA, herein designated VGAM PRECURSOR RNA. Similar to other miRNA genes, and unlike most ordinary genes, VGAM2404 precursor RNA does not encode a protein. A nucleotide sequence identical or highly similar to the nucleotide sequence of VGAM2404 precursor RNA is designated SEQ ID:2390, and is provided hereinbelow with reference to the sequence listing part. Nucleotide sequence SEQ ID:2390 is located at position 65726 relative to the genome of Goatpox Virus.

VGAM2404 precursor RNA folds onto itself, forming VGAM2404 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2404 folded precursor RNA into VGAM2404 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2404 RNA is designated SEQ ID:5115, and is provided hereinbelow with reference to the sequence listing part.

VGAM2404 host target gene, herein designated VGAM HOST TARGET GENE, encodes a corresponding messenger RNA, VGAM2404 host target RNA, herein designated VGAM HOST TARGET RNA. VGAM2404 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2404 RNA, herein designated VGAM RNA, binds complementarily to one or more host target binding sites located in untranslated regions of VGAM2404 host target RNA, herein designated VGAM HOST TARGET RNA. This complementary binding is due to the fact that the nucleotide sequence of VGAM2404 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2404 RNA, herein designated VGAM RNA, may have a different number of host target binding sites in untranslated regions of a VGAM2404 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2404 RNA, herein designated VGAM RNA, to host target binding sites on VGAM2404 host target RNA, herein designated VGAM HOST TARGET RNA, such as BINDING SITE I, BINDING SITE II and BINDING SITE III, inhibits translation of VGAM2404 host target RNA into VGAM2404 host target protein, herein designated VGAM HOST TARGET PROTEIN. VGAM host target protein is therefore outlined by a broken line.

It is appreciated that VGAM2404 host target gene, herein designated VGAM HOST TARGET GENE, in fact represents a plurality of VGAM2404 host target genes. The mRNA of each one of this plurality of VGAM2404 host target genes comprises one or more host target binding sites, each having a nucleotide sequence which is at least partly complementary to VGAM2404 RNA, herein designated VGAM RNA, and which when bound by VGAM2404 RNA causes inhibition of translation of respective one or more VGAM2404 host target proteins.

It is further appreciated by one skilled in the art that the mode of translational inhibition illustrated by FIG. 1 with specific reference to translational inhibition exerted by VGAM2404 gene, herein designated VGAM GENE, on one or more VGAM2404 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2404 is inhibition of expression of host target genes, as part of a novel viral mechanism of attacking a host. Accordingly, utilities of VGAM2404 include diagnosis, prevention and treatment of viral infection by Goatpox Virus. Specific functions, and accordingly utilities, of VGAM2404 correlate with, and may be deduced from, the identity of the host target genes which VGAM2404 binds and inhibits, and the function of these host target genes, as elaborated hereinbelow.

Nucleotide sequences of the VGAM2404 precursor RNA, herein designated VGAM PRECURSOR RNA, and of the 'diced' VGAM2404 RNA, herein designated VGAM RNA, and a schematic representation of the secondary folding of VGAM2404 folded precursor RNA, herein designated VGAM FOLDED PRECURSOR RNA, of VGAM2404 are further described hereinbelow with reference to Table 1.

Nucleotide sequences of host target binding sites, such as BINDING SITE-I, BINDING SITE-II and BINDING SITE-III of FIG. 1, found on VGAM2404 host target RNA, and schematic representation of the complementarity of each of these host target binding sites to VGAM2404 RNA, herein designated VGAM RNA, are described hereinbelow with reference to Table 2.

As mentioned hereinabove with reference to FIG. 1, a function of VGAM2404 gene, herein designated VGAM is inhibition of expression of VGAM2404 target genes. It is appreciated that specific functions, and accordingly utilities, of VGAM2404 correlate with, and may be deduced from, the identity of the target genes which VGAM2404 binds and inhibits, and the function of these target genes, as elaborated hereinbelow.

DEAD/H (Asp-Glu-Ala-Asp/His) Box Polypeptide 20, 103 kDa (DDX20, Accession NM_007204) is a VGAM2404 host target gene. DDX20 BINDING SITE is HOST TARGET binding site found in the 3' untranslated region of mRNA encoded by DDX20, corresponding to a HOST TARGET binding site such as BINDING SITE I, BINDING SITE II or BINDING SITE III. Table 2 illustrates the complementarity of the nucleotide sequences of DDX20 BINDING SITE, designated SEQ ID:14066, to the nucleotide sequence of VGAM2404 RNA, herein designated VGAM RNA, also designated SEQ ID:5115.

A function of VGAM2404 is therefore inhibition of DEAD/H (Asp-Glu-Ala-Asp/His) Box Polypeptide 20, 103 kDa (DDX20, Accession NM_007204), a gene which interacts with SMN and is required for pre-mRNA splicing in the nucleus. Accordingly, utilities of VGAM2404 include diagnosis, prevention and treatment of diseases and clinical conditions associated with DDX20. The function of DDX20 and its association with various diseases and clinical conditions, has been established by previous studies, as described hereinabove with reference to VGAM1929. Transforming, Acidic Coiled-coil Containing Protein 1 (TACC1, Accession NM_006283) is another VGAM2404 host target gene. TACC1 BINDING SITE is HOST TARGET binding site found in the 3' untranslated region of mRNA encoded by TACC1, corresponding to a HOST TARGET binding site such as BINDING SITE I, BINDING SITE II or BINDING SITE III. Table 2 illustrates the complementarity of the nucleotide sequences of TACC1 BINDING SITE, designated SEQ ID:12965, to the nucleotide sequence of VGAM2404 RNA, herein designated VGAM RNA, also designated SEQ ID:5115.

Another function of VGAM2404 is therefore inhibition of Transforming, Acidic Coiled-coil Containing Protein 1 (TACC1, Accession NM_006283). Accordingly, utilities of VGAM2404 include diagnosis, prevention and treatment of diseases and clinical conditions associated with TACC1. DnaJ (Hsp40) Homolog, Subfamily A, Member 2 (DNAJA2, Accession XM_007963) is another VGAM2404 host target gene. DNAJA2 BINDING SITE is HOST TARGET binding site found in the 3' untranslated region of mRNA encoded by DNAJA2, corresponding to a HOST TARGET binding site such as BINDING SITE I, BINDING SITE II or BINDING SITE III. Table 2 illustrates the complementarity of the nucleotide sequences of DNAJA2 BINDING SITE, designated SEQ ID:30068, to the nucleotide sequence of VGAM2404 RNA, herein designated VGAM RNA, also designated SEQ ID:5115.

Another function of VGAM2404 is therefore inhibition of DnaJ (Hsp40) Homolog, Subfamily A, Member 2 (DNAJA2, Accession XM_007963). Accordingly, utilities of VGAM2404 include diagnosis, prevention and treatment of diseases and clinical conditions associated with DNAJA2. FLJ12888 (Accession NM_024945) is another VGAM2404 host target gene. FLJ12888 BINDING SITE is HOST TARGET binding site found in the 3' untranslated region of mRNA encoded by FLJ12888, corresponding to a HOST TARGET binding site such as BINDING SITE I, BINDING SITE II or BINDING SITE III. Table 2 illustrates the complementarity of the nucleotide sequences of FLJ12888 BINDING SITE, designated SEQ ID:24496, to the nucleotide sequence of VGAM2404 RNA, herein designated VGAM RNA, also designated SEQ ID:5115.

Another function of VGAM2404 is therefore inhibition of FLJ12888 (Accession NM_024945). Accordingly, utilities of VGAM2404 include diagnosis, prevention and treatment of diseases and clinical conditions associated with FLJ12888. KIAA0205 (Accession NM_014873) is another VGAM2404 host target gene. KIAA0205 BINDING SITE is HOST TARGET binding site found in the 3' untranslated region of mRNA encoded by KIAA0205, corresponding to a HOST TARGET binding site such as BINDING SITE I, BINDING SITE II or BINDING SITE III. Table 2 illustrates the complementarity of the nucleotide sequences of KIAA0205 BINDING SITE, designated SEQ ID:17007, to the nucleotide sequence of VGAM2404 RNA, herein designated VGAM RNA, also designated SEQ ID:5115.

Another function of VGAM2404 is therefore inhibition of KIAA0205 (Accession NM_014873). Accordingly, utilities of VGAM2404 include diagnosis, prevention and treatment of diseases and clinical conditions associated with KIAA0205. KIAA0332 (Accession XM_031553) is another VGAM2404 host target gene. KIAA0332 BINDING SITE is HOST TARGET binding site found in the 3' untranslated region of mRNA encoded by KIAA0332, corresponding to a HOST TARGET binding site such as BINDING SITE I, BINDING SITE II or BINDING SITE III. Table 2 illustrates the complementarity of the nucleotide sequences of KIAA0332 BINDING SITE, designated SEQ ID:31415, to the nucleotide sequence of VGAM2404 RNA, herein designated VGAM RNA, also designated SEQ ID:5115.

Another function of VGAM2404 is therefore inhibition of KIAA0332 (Accession XM_031553). Accordingly, utilities of VGAM2404 include diagnosis, prevention and treatment of diseases and clinical conditions associated with KIAA0332. Nudix (nucleoside diphosphate linked moiety X)-type Motif 11 (NUDT11, Accession XM_010230) is another VGAM2404 host target gene. NUDT11 BINDING SITE is HOST TARGET binding site found in the 3' untranslated region of mRNA encoded by NUDT11, corresponding to a HOST TARGET binding site such as BINDING SITE I, BINDING SITE II or BINDING SITE III. Table 2 illustrates the complementarity of the nucleotide sequences of NUDT11 BINDING SITE, designated SEQ ID:30142, to the nucleotide sequence of VGAM2404 RNA, herein designated VGAM RNA, also designated SEQ ID:5115.

Another function of VGAM2404 is therefore inhibition of Nudix (nucleoside diphosphate linked moiety X)-type Motif 11 (NUDT11, Accession XM_010230). Accordingly, utilities of VGAM2404 include diagnosis, prevention and treatment of diseases and clinical conditions associated with NUDT11. PI4KII (Accession NM_018425) is another VGAM2404 host target gene. PI4KII BINDING SITE is HOST TARGET binding site found in the 3" untranslated region of mRNA encoded by PI4KII, corresponding to a HOST TARGET binding site such as BINDING SITE I, BINDING SITE II or BINDING SITE III. Table 2 illustrates the complementarity of the nucleotide sequences of PI4KII BINDING SITE, designated SEQ ID:20483, to the nucleotide sequence of VGAM2404 RNA, herein designated VGAM RNA, also designated SEQ ID:5115.

Another function of VGAM2404 is therefore inhibition of PI4KII (Accession NM_018425). Accordingly, utilities of VGAM2404 include diagnosis, prevention and treatment of diseases and clinical conditions associated with PI4KII. LOC152316 (Accession XM_098185) is another VGAM2404 host target gene. LOC152316 BINDING SITE is HOST TARGET binding site found in the 3' untranslated region of mRNA encoded by LOC152316, corresponding to a HOST TARGET binding site such as BINDING SITE I, BINDING SITE II or BINDING SITE III. Table 2 illustrates the complementarity of the nucleotide sequences of LOC152316 BINDING SITE, designated SEQ ID:41456, to the nucleotide sequence of VGAM2404 RNA, herein designated VGAM RNA, also designated SEQ ID:5115.

Another function of VGAM2404 is therefore inhibition of LOC152316 (Accession XM_098185). Accordingly, utilities of VGAM2404 include diagnosis, prevention and treatment of diseases and clinical conditions associated with LOC152316. LOC153259 (Accession XM_098342) is another VGAM2404 host target gene. LOC153259 BINDING SITE is HOST TARGET binding site found in the 5' untranslated region of mRNA encoded by LOC153259, corresponding to a HOST TARGET binding site such as BINDING SITE I, BINDING SITE II or BINDING SITE III. Table 2 illustrates the complementarity of the nucleotide sequences of LOC153259 BINDING SITE, designated SEQ ID:41602, to the nucleotide sequence of VGAM2404 RNA, herein designated VGAM RNA, also designated SEQ ID:5115.

Another function of VGAM2404 is therefore inhibition of LOC153259 (Accession XM_098342). Accordingly, utilities of VGAM2404 include diagnosis, prevention and treatment of diseases and clinical conditions associated with LOC153259. LOC90488 (Accession XM_032129) is another VGAM2404 host target gene. LOC90488 BINDING SITE is HOST TARGET binding site found in the 3' untranslated region of mRNA encoded by LOC90488, corresponding to a HOST TARGET binding site such as BINDING SITE I, BINDING SITE II or BINDING SITE III. Table 2 illustrates the complementarity of the nucleotide sequences of LOC90488 BINDING SITE, designated SEQ ID:31558, to the nucleotide sequence of VGAM2404 RNA, herein designated VGAM RNA, also designated SEQ ID:5115.

Another function of VGAM2404 is therefore inhibition of LOC90488 (Accession XM_032129). Accordingly, utilities of VGAM2404 include diagnosis, prevention and treatment of diseases and clinical conditions associated with LOC90488. LOC90750 (Accession XM_033868) is another VGAM2404 host target gene. LOC90750 BINDING SITE is HOST TARGET binding site found in the 3' untranslated region of mRNA encoded by LOC90750, corresponding to a HOST TARGET binding site such as BINDING SITE I, BINDING SITE II or BINDING SITE III. Table 2 illustrates the complementarity of the nucleotide sequences of LOC90750 BINDING SITE, designated SEQ ID:31968, to the nucleotide sequence of VGAM2404 RNA, herein designated VGAM RNA, also designated SEQ ID:5115.

Another function of VGAM2404 is therefore inhibition of LOC90750 (Accession XM_033868). Accordingly, utilities of VGAM2404 include diagnosis, prevention and treatment of diseases and clinical conditions associated with LOC90750. FIG. 1 further provides a conceptual description of a novel bioinformatically detected viral gene of the present invention, referred to here as Viral Genomic Address Messenger 2405 (VGAM2405) viral gene, which modulates expression of respective host target genes thereof, the function and utility of which host target genes is known in the art.

VGAM2405 is a novel bioinformatically detected regulatory, non protein coding, viral micro RNA (miRNA) gene. The method by which VGAM2405 was detected is described hereinabove with reference to FIGS. 1-8.

VGAM2405 gene, herein designated VGAM GENE, is a viral gene contained in the genome of Goatpox Virus. VGAM2405 host target gene, herein designated VGAM HOST TARGET GENE, is a human gene contained in the human genome.

VGAM2405 gene encodes a VGAM2405 precursor RNA, herein designated VGAM PRECURSOR RNA. Similar to other miRNA genes, and unlike most ordinary genes, VGAM2405 precursor RNA does not encode a protein. A nucleotide sequence identical or highly similar to the nucleotide sequence of VGAM2405 precursor RNA is designated SEQ ID:2391, and is provided hereinbelow with reference to the sequence listing part. Nucleotide sequence SEQ ID:2391 is located at position 127713 relative to the genome of Goatpox Virus.

VGAM2405 precursor RNA folds onto itself, forming VGAM2405 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2405 folded precursor RNA into VGAM2405 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2405 RNA is designated SEQ ID:5116, and is provided hereinbelow with reference to the sequence listing part.

VGAM2405 host target gene, herein designated VGAM HOST TARGET GENE, encodes a corresponding messenger RNA, VGAM2405 host target RNA, herein designated VGAM HOST TARGET RNA. VGAM2405 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2405 RNA, herein designated VGAM RNA, binds complementarily to one or more host target binding sites located in untranslated regions of VGAM2405 host target RNA, herein designated VGAM HOST TARGET RNA. This complementary binding is due to the fact that the nucleotide sequence of VGAM2405 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2405 RNA, herein designated VGAM RNA, may have a different number of host target binding sites in untranslated regions of a VGAM2405 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2405 RNA, herein designated VGAM RNA, to host target binding sites on VGAM2405 host target RNA, herein designated VGAM HOST TARGET RNA, such as BINDING SITE I, BINDING SITE II and BINDING SITE III, inhibits translation of VGAM2405 host target RNA into VGAM2405 host target protein, herein designated VGAM HOST TARGET PROTEIN. VGAM host target protein is therefore outlined by a broken line.

It is appreciated that VGAM2405 host target gene, herein designated VGAM HOST TARGET GENE, in fact represents a plurality of VGAM2405 host target genes. The mRNA of each one of this plurality of VGAM2405 host target genes comprises one or more host target binding sites, each having a nucleotide sequence which is at least partly complementary to VGAM2405 RNA, herein designated VGAM RNA, and which when bound by VGAM2405 RNA causes inhibition of translation of respective one or more VGAM2405 host target proteins.

It is further appreciated by one skilled in the art that the mode of translational inhibition illustrated by FIG. 1 with specific reference to translational inhibition exerted by VGAM2405 gene, herein designated VGAM GENE, on one or more VGAM2405 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2405 is inhibition of expression of host target genes, as part of a novel viral mechanism of attacking a host. Accordingly, utilities of VGAM2405 include diagnosis, prevention and treatment of viral infection by Goatpox Virus. Specific functions, and accordingly utilities, of VGAM2405 correlate with, and may be deduced from, the identity of the host target genes which VGAM2405 binds and inhibits, and the function of these host target genes, as elaborated hereinbelow.

Nucleotide sequences of the VGAM2405 precursor RNA, herein designated VGAM PRECURSOR RNA, and of the 'diced' VGAM2405 RNA, herein designated VGAM RNA, and a schematic representation of the secondary folding of VGAM2405 folded precursor RNA, herein designated VGAM FOLDED PRECURSOR RNA, of VGAM2405 are further described hereinbelow with reference to Table 1.

Nucleotide sequences of host target binding sites, such as BINDING SITE-I, BINDING SITE-II and BINDING SITE-III of FIG. 1, found on VGAM2405 host target RNA, and schematic representation of the complementarity of each of these host target binding sites to VGAM2405 RNA, herein designated VGAM RNA, are described hereinbelow with reference to Table 2.

As mentioned hereinabove with reference to FIG. 1, a function of VGAM2405 gene, herein designated VGAM is inhibition of expression of VGAM2405 target genes. It is appreciated that specific functions, and accordingly utilities, of VGAM2405 correlate with, and may be deduced from, the identity of the target genes which VGAM2405 binds and inhibits, and the function of these target genes, as elaborated hereinbelow.

Carbohydrate Kinase-like (CARKL, Accession NM_013276) is a VGAM2405 host target gene. CARKL BINDING SITE is HOST TARGET binding site found in the 3' untranslated region of mRNA encoded by CARKL, corresponding to a HOST TARGET binding site such as BINDING SITE I, BINDING SITE II or BINDING SITE III. Table 2 illustrates the complementarity of the nucleotide sequences of CARKL BINDING SITE, designated SEQ ID:14939, to the nucleotide sequence of VGAM2405 RNA, herein designated VGAM RNA, also designated SEQ ID:5116.

A function of VGAM2405 is therefore inhibition of Carbohydrate Kinase-like (CARKL, Accession NM_013276), a gene which is a putative carbohydrate kinase and may be a modifier for the cystinosis phenotype. Accordingly, utilities of VGAM2405 include diagnosis, prevention and treatment of diseases and clinical conditions associated with CARKL. The function of CARKL and its association with various diseases and clinical conditions, has been established by previous studies, as described hereinabove with reference to VGAM419. Cell Division Cycle 25B (CDC25B, Accession NM_021873) is another VGAM2405 host target gene. CDC25B BINDING SITE1 and CDC25B BINDING SITE2 are HOST TARGET binding sites found in untranslated regions of mRNA encoded by CDC25B, corresponding to HOST TARGET binding sites such as BINDING SITE I, BINDING SITE II or BINDING SITE III. Table 2 illustrates the complementarity of the nucleotide sequences of CDC25B BINDING SITE1 and CDC25B BINDING SITE2, designated SEQ ID:22414 and SEQ ID:22418 respectively, to the nucleotide sequence of VGAM2405 RNA, herein designated VGAM RNA, also designated SEQ ID:5116.

Another function of VGAM2405 is therefore inhibition of Cell Division Cycle 25B (CDC25B, Accession NM_021873), a gene which is positively activated by dephosphorylation. Accordingly, utilities of VGAM2405 include diagnosis, prevention and treatment of diseases and clinical conditions associated with CDC25B. The function of CDC25B and its association with various diseases and clinical conditions, has been established by previous studies, as described hereinabove with reference to VGAM165. Cytochrome P450, Subfamily XIX (aromatization of androgens) (CYP19, Accession NM_000103) is another VGAM2405 host target gene. CYP19 BINDING SITE1 and CYP19 BINDING SITE2 are HOST TARGET binding sites found in untranslated regions of mRNA encoded by CYP19, corresponding to HOST TARGET binding sites such as BINDING SITE I, BINDING SITE II or BINDING SITE III. Table 2 illustrates the complementarity of the nucleotide sequences of CYP19 BINDING SITE1 and CYP19 BINDING SITE2, designated SEQ ID:5562 and SEQ ID:13531 respectively, to the nucleotide sequence of VGAM2405 RNA, herein designated VGAM RNA, also designated SEQ ID:5116.

Another function of VGAM2405 is therefore inhibition of Cytochrome P450, Subfamily XIX (aromatization of androgens) (CYP19, Accession NM_000103), a gene which catalyzes the last steps of estrogen biosynthesis. Accordingly, utilities of VGAM2405 include diagnosis, prevention and treatment of diseases and clinical conditions associated with CYP19. The function of CYP19 and its association with various diseases and clinical conditions, has been established by previous studies, as described hereinabove with reference to VGAM508. Membrane-spanning 4-domains, Subfamily A, Member 4 (MS4A4A, Accession NM_024021) is another VGAM2405 host target gene. MS4A4A BINDING SITE is HOST TARGET binding site found in the 3' untranslated region of mRNA encoded by MS4A4A, corresponding to a HOST TARGET binding site such as BINDING SITE I, BINDING SITE II or BINDING SITE III. Table 2 illustrates the complementarity of the nucleotide sequences of MS4A4A BINDING SITE, designated SEQ ID:23449, to the nucleotide sequence of VGAM2405 RNA, herein designated VGAM RNA, also designated SEQ ID:5116.

Another function of VGAM2405 is therefore inhibition of Membrane-spanning 4-domains, Subfamily A, Member 4 (MS4A4A, Accession NM_024021), a gene which binds to the fc region of immunoglobulins epsilon. high affinity receptor. initiating the allergic response. Accordingly, utilities of VGAM2405 include diagnosis, prevention and treatment of diseases and clinical conditions associated with MS4A4A. The function of MS4A4A and its association with various diseases and clinical conditions, has been established by previous studies, as described hereinabove with reference to VGAM329. C-myc Binding Protein (MYCBP, Accession NM_012333) is another VGAM2405 host target gene. MYCBP BINDING SITE is HOST TARGET binding site found in the 3' untranslated region of mRNA encoded by MYCBP, corresponding to a HOST TARGET binding site such as BINDING SITE I, BINDING SITE II or BINDING SITE III. Table 2 illustrates the complementarity of the nucleotide sequences of MYCBP BINDING SITE, designated SEQ ID:14726, to the nucleotide sequence of VGAM2405 RNA, herein designated VGAM RNA, also designated SEQ ID:5116.

Another function of VGAM2405 is therefore inhibition of C-myc Binding Protein (MYCBP, Accession NM_012333), a gene which binds c-Myc stimulating the activation of E-box-dependent transcription. Accordingly, utilities of VGAM2405 include diagnosis, prevention and treatment of diseases and clinical conditions associated with MYCBP. The function of MYCBP and its association with various diseases and clinical conditions, has been established by previous studies, as described hereinabove with reference to VGAM435. Phosphoribosylaminoimidazole Carboxylase, Phosphoribosylaminoimidazole Succinocarboxamide Synthetase (PAICS, Accession NM_006452) is another VGAM2405 host target gene. PAICS BINDING SITE is HOST TARGET binding site found in the 3' untranslated region of mRNA encoded by PAICS, corresponding to a HOST TARGET binding site such as BINDING SITE I, BINDING SITE II or BINDING SITE III. Table 2 illustrates the complementarity of the nucleotide sequences of PAICS BINDING SITE, designated SEQ ID:13167, to the nucleotide sequence of VGAM2405 RNA, herein designated VGAM RNA, also designated SEQ ID:5116.

Another function of VGAM2405 is therefore inhibition of Phosphoribosylaminoimidazole Carboxylase, Phosphoribosylaminoimidazole Succinocarboxamide Synthetase (PAICS, Accession NM_006452), a gene which is required for purine biosynthesis. Accordingly, utilities of VGAM2405 include diagnosis, prevention and treatment of diseases and clinical conditions associated with PAICS. The function of PAICS and its association with various diseases and clinical conditions, has been established by previous studies, as described hereinabove with reference to VGAM894. PRV1 (Accession XM_056490) is another VGAM2405 host target gene. PRV1 BINDING SITE is HOST TARGET binding site found in the 3' untranslated region of mRNA encoded by PRV1, corresponding to a HOST TARGET binding site such as BINDING SITE I, BINDING SITE II or BINDING SITE III. Table 2 illustrates the complementarity of the nucleotide sequences of PRV1 BINDING SITE, designated SEQ ID:36397, to the nucleotide sequence of VGAM2405 RNA, herein designated VGAM RNA, also designated SEQ ID:5116.

Another function of VGAM2405 is therefore inhibition of PRV1 (Accession XM_056490), a gene which may function as a hematopoietic receptor. Accordingly, utilities of VGAM2405 include diagnosis, prevention and treatment of diseases and clinical conditions associated with PRV1. The function of PRV1 and its association with various diseases and clinical conditions, has been established by previous studies, as described hereinabove with reference to VGAM778. Visinin-like 1 (VSNL1, Accession NM_003385) is another VGAM2405 host target gene. VSNL1 BINDING SITE is HOST TARGET binding site found in the 3' untranslated region of mRNA encoded by VSNL1, corresponding to a HOST TARGET binding site such as BINDING SITE I, BINDING SITE II or BINDING SITE III. Table 2 illustrates the complementarity of the nucleotide sequences of VSNL1 BINDING SITE, designated SEQ ID:9415, to the nucleotide sequence of VGAM2405 RNA, herein designated VGAM RNA, also designated SEQ ID:5116.

Another function of VGAM2405 is therefore inhibition of Visinin-like 1 (VSNL1, Accession NM_003385). Accordingly, utilities of VGAM2405 include diagnosis, prevention and treatment of diseases and clinical conditions associated with VSNL1. Kell Blood Group Precursor (McLeod phenotype) (XK, Accession NM_021083) is another VGAM2405 host target gene. XK BINDING SITE is HOST TARGET binding site found in the 3' untranslated region of mRNA encoded by XK, corresponding to a HOST TARGET binding site such as BINDING SITE I, BINDING SITE II or BINDING SITE III. Table 2 illustrates the complementarity of the nucleotide sequences of XK BINDING SITE, designated SEQ ID:22055, to the nucleotide sequence of VGAM2405 RNA, herein designated VGAM RNA, also designated SEQ ID:5116.

Another function of VGAM2405 is therefore inhibition of Kell Blood Group Precursor (McLeod phenotype) (XK, Accession NM_021083). Accordingly, utilities of VGAM2405 include diagnosis, prevention and treatment of diseases and clinical conditions associated with XK. Zinc Finger Protein 202 (ZNF202, Accession NM_003455) is another VGAM2405 host target gene. ZNF202 BINDING SITE is HOST TARGET binding site found in the 3' untranslated region of mRNA encoded by ZNF202, corresponding to a HOST TARGET binding site such as BINDING SITE I, BINDING SITE II or BINDING SITE III. Table 2 illustrates the complementarity of the nucleotide sequences of ZNF202 BINDING SITE, designated SEQ ID:9511, to the nucleotide sequence of VGAM2405 RNA, herein designated VGAM RNA, also designated SEQ ID:5116.

Another function of VGAM2405 is therefore inhibition of Zinc Finger Protein 202 (ZNF202, Accession NM_003455). Accordingly, utilities of VGAM2405 include diagnosis, prevention and treatment of diseases and clinical conditions associated with ZNF202. Chromosome 21 Open Reading Frame 42 (C21orf42, Accession NM_058184) is another VGAM2405 host target gene. C21orf42 BINDING SITE is HOST TARGET binding site found in the 3' untranslated region of mRNA encoded by C21orf42, corresponding to a HOST TARGET binding site such as BINDING SITE I, BINDING SITE II or BINDING SITE III. Table 2 illustrates the complementarity of the nucleotide sequences of C21orf42 BINDING SITE, designated SEQ ID:27751, to the nucleotide sequence of VGAM2405 RNA, herein designated VGAM RNA, also designated SEQ ID:5116.

Another function of VGAM2405 is therefore inhibition of Chromosome 21 Open Reading Frame 42 (C21orf42, Accession NM_058184). Accordingly, utilities of VGAM2405 include diagnosis, prevention and treatment of diseases and clinical conditions associated with C21orf42. Cyclin M4 (CNNM4, Accession NM_020184) is another VGAM2405 host target gene. CNNM4 BINDING SITE is HOST TARGET binding site found in the 3' untranslated region of mRNA encoded by CNNM4, corresponding to a HOST TARGET binding site such as BINDING SITE I, BINDING SITE II or BINDING SITE III. Table 2 illustrates the complementarity of the nucleotide sequences of CNNM4 BINDING SITE, designated SEQ ID:21423, to the nucleotide sequence of VGAM2405 RNA, herein designated VGAM RNA, also designated SEQ ID:5116.

Another function of VGAM2405 is therefore inhibition of Cyclin M4 (CNNM4, Accession NM_020184). Accordingly, utilities of VGAM2405 include diagnosis, prevention and treatment of diseases and clinical conditions associated with CNNM4. CPEB1 (Accession NM_030594) is another VGAM2405 host target gene. CPEB1 BINDING SITE is HOST TARGET binding site found in the 5' untranslated region of mRNA encoded by CPEB1, corresponding to a HOST TARGET binding site such as BINDING SITE I, BINDING SITE II or BINDING SITE III. Table 2 illustrates the complementarity of the nucleotide sequences of CPEB1 BINDING SITE, designated SEQ ID:24960, to the nucleotide sequence of VGAM2405 RNA, herein designated VGAM RNA, also designated SEQ ID:5116.

Another function of VGAM2405 is therefore inhibition of CPEB1 (Accession NM_030594). Accordingly, utilities of VGAM2405 include diagnosis, prevention and treatment of diseases and clinical conditions associated with CPEB1. DKFZP434G1415 (Accession NM_031292) is another VGAM2405 host target gene. DKFZP434G1415 BINDING SITE is HOST TARGET binding site found in the 3' untranslated region of mRNA encoded by DKFZP434G1415, corresponding to a HOST TARGET binding site such as BINDING SITE I, BINDING SITE II or BINDING SITE III. Table 2 illustrates the complementarity of the nucleotide sequences of DKFZP434G1415 BINDING SITE, designated SEQ ID:25316, to the nucleotide sequence of VGAM2405 RNA, herein designated VGAM RNA, also designated SEQ ID:5116.

Another function of VGAM2405 is therefore inhibition of DKFZP434G1415 (Accession NM_031292). Accordingly, utilities of VGAM2405 include diagnosis, prevention and treatment of diseases and clinical conditions associated with DKFZP434G1415. DKFZP564D0462 (Accession XM_047080) is another VGAM2405 host target gene. DKFZP564D0462 BINDING SITE is HOST TARGET binding site found in the 3' untranslated region of mRNA encoded by DKFZP564D0462, corresponding to a HOST TARGET binding site such as BINDING SITE I, BINDING SITE II or BINDING SITE III. Table 2 illustrates the complementarity of the nucleotide sequences of DKFZP564D0462 BINDING SITE, designated SEQ ID:34896, to the nucleotide sequence of VGAM2405 RNA, herein designated VGAM RNA, also designated SEQ ID:5116.

Another function of VGAM2405 is therefore inhibition of DKFZP564D0462 (Accession XM_047080). Accordingly, utilities of VGAM2405 include diagnosis, prevention and treatment of diseases and clinical conditions associated with DKFZP564D0462. DKFZp761F2014 (Accession NM_020215) is another VGAM2405 host target gene. DKFZp761F2014 BINDING SITE is HOST TARGET binding site found in the 3' untranslated region of mRNA encoded by DKFZp761F2014, corresponding to a HOST TARGET binding site such as BINDING SITE I, BINDING SITE II or BINDING SITE III. Table 2 illustrates the complementarity of the nucleotide sequences of DKFZp761F2014 BINDING SITE, designated SEQ ID:21461, to the nucleotide sequence of VGAM2405 RNA, herein designated VGAM RNA, also designated SEQ ID:5116.

Another function of VGAM2405 is therefore inhibition of DKFZp761F2014 (Accession NM_020215). Accordingly, utilities of VGAM2405 include diagnosis, prevention and treatment of diseases and clinical conditions associated with DKFZp761F2014. FLJ10830 (Accession NM_018235) is another VGAM2405 host target gene. FLJ10830 BINDING SITE is HOST TARGET binding site found in the 3' untranslated region of mRNA encoded by FLJ10830, corresponding to a HOST TARGET binding site such as BINDING SITE I, BINDING SITE II or BINDING SITE III. Table 2 illustrates the complementarity of the nucleotide sequences of FLJ10830 BINDING SITE, designated SEQ ID:20183, to the nucleotide sequence of VGAM2405 RNA, herein designated VGAM RNA, also designated SEQ ID:5116.

Another function of VGAM2405 is therefore inhibition of FLJ10830 (Accession NM_018235). Accordingly, utilities of VGAM2405 include diagnosis, prevention and treatment of diseases and clinical conditions associated with FLJ10830. FLJ14753 (Accession NM_032558) is another VGAM2405 host target gene. FLJ14753 BINDING SITE is HOST TARGET binding site found in the 3' untranslated region of mRNA encoded by FLJ14753, corresponding to a HOST TARGET binding site such as BINDING SITE I, BINDING SITE II or BINDING SITE III. Table 2 illustrates the complementarity of the nucleotide sequences of FLJ14753 BINDING SITE, designated SEQ ID:26286, to the nucleotide sequence of VGAM2405 RNA, herein designated VGAM RNA, also designated SEQ ID:5116.

Another function of VGAM2405 is therefore inhibition of FLJ14753 (Accession NM_032558). Accordingly, utilities of VGAM2405 include diagnosis, prevention and treatment of diseases and clinical conditions associated with FLJ14753. FLJ20195 (Accession NM_017706) is another VGAM2405 host target gene. FLJ20195 BINDING SITE is HOST TARGET binding site found in the 3' untranslated region of mRNA encoded by FLJ20195, corresponding to a HOST TARGET binding site such as BINDING SITE I, BINDING SITE II or BINDING SITE III. Table 2 illustrates the complementarity of the nucleotide sequences of FLJ20195 BINDING SITE, designated SEQ ID:19282, to the nucleotide sequence of VGAM2405 RNA, herein designated VGAM RNA, also designated SEQ ID:5116.

Another function of VGAM2405 is therefore inhibition of FLJ20195 (Accession NM_017706). Accordingly, utilities of VGAM2405 include diagnosis, prevention and treatment of diseases and clinical conditions associated with FLJ20195. Gamma-aminobutyric Acid (GABA) B Receptor, 1 (GABBR1, Accession NM_001470) is another VGAM2405 host target gene. GABBR1 BINDING SITE1 and GABBR1 BINDING SITE2 are HOST TARGET binding sites found in untranslated regions of mRNA encoded by GABBR1, corresponding to HOST TARGET binding sites such as BINDING SITE I, BINDING SITE II or BINDING SITE III. Table 2 illustrates the complementarity of the nucleotide sequences of GABBR1 BINDING SITE1 and GABBR1 BINDING SITE2, designated SEQ ID:7207 and SEQ ID:22425 respectively, to the nucleotide sequence of VGAM2405 RNA, herein designated VGAM RNA, also designated SEQ ID:5116.

Another function of VGAM2405 is therefore inhibition of Gamma-aminobutyric Acid (GABA) B Receptor, 1 (GABBR1, Accession NM_001470). Accordingly, utilities of VGAM2405 include diagnosis, prevention and treatment of diseases and clinical conditions associated with GABBR1. Syndecan 3 (N-syndecan) (SDC3, Accession NM_014654) is another VGAM2405 host target gene. SDC3 BINDING SITE is HOST TARGET binding site found in the 3' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16092, to the nucleotide sequence of VGAM2405 RNA, herein designated VGAM RNA, also designated SEQ ID:5116.

Another function of VGAM2405 is therefore inhibition of Syndecan 3 (N-syndecan) (SDC3, Accession NM_014654). Accordingly, utilities of VGAM2405 include diagnosis, prevention and treatment of diseases and clinical conditions associated with SDC3. Zinc Finger Protein 297B (ZNF297B, Accession NM_014007) is another VGAM2405 host target gene. ZNF297B BINDING SITE is HOST TARGET binding site found in the 3' untranslated region of mRNA encoded by ZNF297B, corresponding to a HOST TARGET binding site such as BINDING SITE I, BINDING SITE II or BINDING SITE III. Table 2 illustrates the complementarity of the nucleotide sequences of ZNF297B BINDING SITE, designated SEQ ID:15219, to the nucleotide sequence of VGAM2405 RNA, herein designated VGAM RNA, also designated SEQ ID:5116.

Another function of VGAM2405 is therefore inhibition of Zinc Finger Protein 297B (ZNF297B, Accession NM_014007). Accordingly, utilities of VGAM2405 include diagnosis, prevention and treatment of diseases and clinical conditions associated with ZNF297B. LOC133418 (Accession XM_059649) is another VGAM2405 host target gene. LOC133418 BINDING SITE is HOST TARGET binding site found in the 3' untranslated region of mRNA encoded by LOC133418, corresponding to a HOST TARGET binding site such as BINDING SITE I, BINDING SITE II or BINDING SITE III. Table 2 illustrates the complementarity of the nucleotide sequences of LOC133418 BINDING SITE, designated SEQ ID:37042, to the nucleotide sequence of VGAM2405 RNA, herein designated VGAM RNA, also designated SEQ ID:5116.

Another function of VGAM2405 is therefore inhibition of LOC133418 (Accession XM_059649). Accordingly, utilities of VGAM2405 include diagnosis, prevention and treatment of diseases and clinical conditions associated with LOC133418. LOC143173 (Accession XM_016685) is another VGAM2405 host target gene. LOC143173 BINDING SITE is HOST TARGET binding site found in the 5' untranslated region of mRNA encoded by LOC143173, corresponding to a HOST TARGET binding site such as BINDING SITE I, BINDING SITE II or BINDING SITE III. Table 2 illustrates the complementarity of the nucleotide sequences of LOC143173 BINDING SITE, designated SEQ ID:30274, to the nucleotide sequence of VGAM2405 RNA, herein designated VGAM RNA, also designated SEQ ID:5116.

Another function of VGAM2405 is therefore inhibition of LOC143173 (Accession XM_016685). Accordingly, utilities of VGAM2405 include diagnosis, prevention and treatment of diseases and clinical conditions associated with LOC143173. LOC148811 (Accession XM_086326) is another VGAM2405 host target gene. LOC148811 BINDING SITE is HOST TARGET binding site found in the 3' untranslated region of mRNA encoded by LOC148811, corresponding to a HOST TARGET binding site such as BINDING SITE I, BINDING SITE II or BINDING SITE III. Table 2 illustrates the complementarity of the nucleotide sequences of LOC148811 BINDING SITE, designated SEQ ID:38601, to the nucleotide sequence of VGAM2405 RNA, herein designated VGAM RNA, also designated SEQ ID:5116.

Another function of VGAM2405 is therefore inhibition of LOC148811 (Accession XM_086326). Accordingly, utilities of VGAM2405 include diagnosis, prevention and treatment of diseases and clinical conditions associated with LOC148811. LOC152018 (Accession XM_098156) is another VGAM2405 host target gene. LOC152018 BINDING SITE is HOST TARGET binding site found in the 3' untranslated region of mRNA encoded by LOC152018, corresponding to a HOST TARGET binding site such as BINDING SITE I, BINDING SITE II or BINDING SITE III. Table 2 illustrates the complementarity of the nucleotide sequences of LOC152018 BINDING SITE, designated SEQ ID:41422, to the nucleotide sequence of VGAM2405 RNA, herein designated VGAM RNA, also designated SEQ ID:5116.

Another function of VGAM2405 is therefore inhibition of LOC152018 (Accession XM_098156). Accordingly, utilities of VGAM2405 include diagnosis, prevention and treatment of diseases and clinical conditions associated with LOC152018. LOC253639 (Accession XM_171060) is another VGAM2405 host target gene. LOC253639 BINDING SITE is HOST TARGET binding site found in the 3' untranslated region of mRNA encoded by LOC253639, corresponding to a HOST TARGET binding site such as BINDING SITE I, BINDING SITE II or BINDING SITE III. Table 2 illustrates the complementarity of the nucleotide sequences of LOC253639 BINDING SITE, designated SEQ ID:45855, to the nucleotide sequence of VGAM2405 RNA, herein designated VGAM RNA, also designated SEQ ID:5116.

Another function of VGAM2405 is therefore inhibition of LOC253639 (Accession XM_171060). Accordingly, utilities of VGAM2405 include diagnosis, prevention and treatment of diseases and clinical conditions associated with LOC253639. LOC91689 (Accession NM_033318) is another VGAM2405 host target gene. LOC91689 BINDING SITE is HOST TARGET binding site found in the 3' untranslated region of mRNA encoded by LOC91689, corresponding to a HOST TARGET binding site such as BINDING SITE I, BINDING SITE II or BINDING SITE III. Table 2 illustrates the complementarity of the nucleotide sequences of LOC91689 BINDING SITE, designated SEQ ID:27158, to the nucleotide sequence of VGAM2405 RNA, herein designated VGAM RNA, also designated SEQ ID:5116.

Another function of VGAM2405 is therefore inhibition of LOC91689 (Accession NM_033318). Accordingly, utilities of VGAM2405 include diagnosis, prevention and treatment of diseases and clinical conditions associated with LOC91689. FIG. 1 further provides a conceptual description of a novel bioinformatically detected viral gene of the present invention, referred to here as Viral Genomic Address Messenger 2406 (VGAM2406) viral gene, which modulates expression of respective host target genes thereof, the function and utility of which host target genes is known in the art.

VGAM2406 is a novel bioinformatically detected regulatory, non protein coding, viral micro RNA (miRNA) gene. The method by which VGAM2406 was detected is described hereinabove with reference to FIGS. 1-8.

VGAM2406 gene, herein designated VGAM GENE, is a viral gene contained in the genome of Goatpox Virus. VGAM2406 host target gene, herein designated VGAM HOST TARGET GENE, is a human gene contained in the human genome.

VGAM2406 gene encodes a VGAM2406 precursor RNA, herein designated VGAM PRECURSOR RNA. Similar to other miRNA genes, and unlike most ordinary genes, VGAM2406 precursor RNA does not encode a protein. A nucleotide sequence identical or highly similar to the nucleotide sequence of VGAM2406 precursor RNA is designated SEQ ID:2392, and is provided hereinbelow with reference to the sequence listing part. Nucleotide sequence SEQ ID:2392 is located at position 118549 relative to the genome of Goatpox Virus.

VGAM2406 precursor RNA folds onto itself, forming VGAM2406 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2406 folded precursor RNA into VGAM2406 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM2406 RNA is designated SEQ ID:5117, and is provided hereinbelow with reference to the sequence listing part.

VGAM2406 host target gene, herein designated VGAM HOST TARGET GENE, encodes a corresponding messenger RNA, VGAM2406 host target RNA, herein designated VGAM HOST TARGET RNA. VGAM2406 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2406 RNA, herein designated VGAM RNA, binds complementarily to one or more host target binding sites located in untranslated regions of VGAM2406 host target RNA, herein designated VGAM HOST TARGET RNA. This complementary binding is due to the fact that the nucleotide sequence of VGAM2406 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2406 RNA, herein designated VGAM RNA, may have a different number of host target binding sites in untranslated regions of a VGAM2406 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2406 RNA, herein designated VGAM RNA, to host target binding sites on VGAM2406 host target RNA, herein designated VGAM HOST TARGET RNA, such as BINDING SITE I, BINDING SITE II and BINDING SITE III, inhibits translation of VGAM2406 host target RNA into VGAM2406 host target protein, herein designated VGAM HOST TARGET PROTEIN. VGAM host target protein is therefore outlined by a broken line.

It is appreciated that VGAM2406 host target gene, herein designated VGAM HOST TARGET GENE, in fact represents a plurality of VGAM2406 host target genes. The mRNA of each one of this plurality of VGAM2406 host target genes comprises one or more host target binding sites, each having a nucleotide sequence which is at least partly complementary to VGAM2406 RNA, herein designated VGAM RNA, and which when bound by VGAM2406 RNA causes inhibition of translation of respective one or more VGAM2406 host target proteins.

It is further appreciated by one skilled in the art that the mode of translational inhibition illustrated by FIG. 1 with specific reference to translational inhibition exerted by VGAM2406 gene, herein designated VGAM GENE, on one or more VGAM2406 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM2406 is inhibition of expression of host target genes, as part of a novel viral mechanism of attacking a host. Accordingly, utilities of VGAM2406 include diagnosis, prevention and treatment of viral infection by Goatpox Virus. Specific functions, and accordingly utilities, of VGAM2406 correlate with, and may be deduced from, the identity of the host target genes which VGAM2406 binds and inhibits, and the function of these host target genes, as elaborated hereinbelow.

Nucleotide sequences of the VGAM2406 precursor RNA, herein designated VGAM PRECURSOR RNA, and of the ‘diced’ VGAM2406 RNA, herein designated VGAM RNA, and a schematic representation of the secondary folding of VGAM2406 folded precursor RNA, herein designated VGAM FOLDED PRECURSOR RNA, of VGAM2406 are further described hereinbelow with reference to Table 1.

Nucleotide sequences of host target binding sites, such as BINDING SITE-I, BINDING SITE-II and BINDING SITE-III of FIG. 1, found on VGAM2406 host target RNA, and schematic representation of the complementarity of each of these host target binding sites to VGAM2406 RNA, herein designated VGAM RNA, are described hereinbelow with reference to Table 2.

As mentioned hereinabove with reference to FIG. 1, a function of VGAM2406 gene, herein designated VGAM is inhibition of expression of VGAM2406 target genes. It is appreciated that specific functions, and accordingly utilities, of VGAM2406 correlate with, and may be deduced from, the identity of the target genes which VGAM2406 binds and inhibits, and the function of these target genes, as elaborated hereinbelow.

Dishevelled Associated Activator of Morphogenesis 2 (DAAM2, Accession XM_166434) is a VGAM2406 host target gene. DAAM2 BINDING SITE is HOST TARGET binding site found in the 3' untranslated region of mRNA encoded by DAAM2, corresponding to a HOST TARGET binding site such as BINDING SITE I, BINDING SITE II or BINDING SITE III. Table 2 illustrates the complementarity of the nucleotide sequences of DAAM2 BINDING SITE, designated SEQ ID:44333, to the nucleotide sequence of VGAM2406 RNA, herein designated VGAM RNA, also designated SEQ ID:5117.

A function of VGAM2406 is therefore inhibition of Dishevelled Associated Activator of Morphogenesis 2 (DAAM2, Accession XM_166434), a gene which controls cell polarity and movement during development. Accordingly, utilities of VGAM2406 include diagnosis, prevention and treatment of diseases and clinical conditions associated with DAAM2. The function of DAAM2 and its association with various diseases and clinical conditions, has been established by previous studies, as described hereinabove with reference to VGAM247. LOC153711 (Accession XM_098419) is another VGAM2406 host target gene. LOC153711 BINDING SITE is HOST TARGET binding site found in the 3' untranslated region of mRNA encoded by LOC153711, corresponding to a HOST TARGET binding site such as BINDING SITE I, BINDING SITE II or BINDING SITE III. Table 2 illustrates the complementarity of the nucleotide sequences of LOC153711 BINDING SITE, designated SEQ ID:41667, to the nucleotide sequence of VGAM2406 RNA, herein designated VGAM RNA, also designated SEQ ID:5117.

Another function of VGAM2406 is therefore inhibition of LOC153711 (Accession XM_098419). Accordingly, utilities of VGAM2406 include diagnosis, prevention and treatment of diseases and clinical conditions associated with LOC153711. LOC154442 (Accession XM_098536) is another VGAM2406 host target gene. LOC154442 BINDING SITE is HOST TARGET binding site found in the 3' untranslated region of mRNA encoded by LOC154442, corresponding to a HOST TARGET binding site such as BINDING SITE I, BINDING SITE II or BINDING SITE III. Table 2 illustrates the complementarity of the nucleotide sequences of LOC154442 BINDING SITE, designated SEQ ID:41704, to the nucleotide sequence of VGAM2406 RNA, herein designated VGAM RNA, also designated SEQ ID:5117.

Another function of VGAM2406 is therefore inhibition of LOC154442 (Accession XM_098536). Accordingly, utilities of VGAM2406 include diagnosis, prevention and treatment of diseases and clinical conditions associated with LOC154442. FIG. 1 further provides a conceptual description of a novel bioinformatically detected viral gene of the present invention, referred to here as Viral Genomic Address Messenger 2407 (VGAM2407) viral gene, which modulates expression of respective host target genes thereof, the function and utility of which host target genes is known in the art.

VGAM2407 is a novel bioinformatically detected regulatory, non protein coding, viral micro RNA (miRNA) gene. The method by which VGAM2407 was detected is described hereinabove with reference to FIGS. 1-8.

VGAM2407 gene, herein designated VGAM GENE, is a viral gene contained in the genome of Goatpox Virus. VGAM2407 host target gene, herein designated VGAM HOST TARGET GENE, is a human gene contained in the human genome.

VGAM2407 gene encodes a VGAM2407 precursor RNA, herein designated VGAM PRECURSOR RNA. Similar to other miRNA genes, and unlike most ordinary genes, VGAM2407 precursor RNA does not encode a protein. A nucleotide sequence identical or highly similar to the nucleotide sequence of VGAM2407 precursor RNA is designated SEQ ID:2393, and is provided hereinbelow with reference to the sequence listing part. Nucleotide sequence SEQ ID:2393 is located at position 111620 relative to the genome of Goatpox Virus.

VGAM2407 precursor RNA folds onto itself, forming VGAM2407 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2407 folded precursor RNA into VGAM2407 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2407 RNA is designated SEQ ID:5118, and is provided hereinbelow with reference to the sequence listing part.

VGAM2407 host target gene, herein designated VGAM HOST TARGET GENE, encodes a corresponding messenger RNA, VGAM2407 host target RNA, herein designated VGAM HOST TARGET RNA. VGAM2407 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2407 RNA, herein designated VGAM RNA, binds complementarily to one or more host target binding sites located in untranslated regions of VGAM2407 host target RNA, herein designated VGAM HOST TARGET RNA. This complementary binding is due to the fact that the nucleotide sequence of VGAM2407 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2407 RNA, herein designated VGAM RNA, may have a different number of host target binding sites in untranslated regions of a VGAM2407 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2407 RNA, herein designated VGAM RNA, to host target binding sites on VGAM2407 host target RNA, herein designated VGAM HOST TARGET RNA, such as BINDING SITE I, BINDING SITE II and BINDING SITE III, inhibits translation of VGAM2407 host target RNA into VGAM2407 host target protein, herein designated VGAM HOST TARGET PROTEIN. VGAM host target protein is therefore outlined by a broken line.

It is appreciated that VGAM2407 host target gene, herein designated VGAM HOST TARGET GENE, in fact represents a plurality of VGAM2407 host target genes. The mRNA of each one of this plurality of VGAM2407 host target genes comprises one or more host target binding sites, each having a nucleotide sequence which is at least partly complementary to VGAM2407 RNA, herein designated VGAM RNA, and which when bound by VGAM2407 RNA causes inhibition of translation of respective one or more VGAM2407 host target proteins.

It is further appreciated by one skilled in the art that the mode of translational inhibition illustrated by FIG. 1 with specific reference to translational inhibition exerted by VGAM2407 gene, herein designated VGAM GENE, on one or more VGAM2407 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2407 is inhibition of expression of host target genes, as part of a novel viral mechanism of attacking a host. Accordingly, utilities of VGAM2407 include diagnosis, prevention and treatment of viral infection by Goatpox Virus. Specific functions, and accordingly utilities, of VGAM2407 correlate with, and may be deduced from, the identity of the host target genes which VGAM2407 binds and inhibits, and the function of these host target genes, as elaborated hereinbelow.

Nucleotide sequences of the VGAM2407 precursor RNA, herein designated VGAM PRECURSOR RNA, and of the 'diced' VGAM2407 RNA, herein designated VGAM RNA, and a schematic representation of the secondary folding of VGAM2407 folded precursor RNA, herein designated VGAM FOLDED PRECURSOR RNA, of VGAM2407 are further described hereinbelow with reference to Table 1.

Nucleotide sequences of host target binding sites, such as BINDING SITE-I, BINDING SITE-II and BINDING SITE-III of FIG. 1, found on VGAM2407 host target RNA, and schematic representation of the complementarity of each of these host target binding sites to VGAM2407 RNA, herein designated VGAM RNA, are described hereinbelow with reference to Table 2.

As mentioned hereinabove with reference to FIG. 1, a function of VGAM2407 gene, herein designated VGAM is inhibition of expression of VGAM2407 target genes. It is appreciated that specific functions, and accordingly utilities, of VGAM2407 correlate with, and may be deduced from, the identity of the target genes which VGAM2407 binds and inhibits, and the function of these target genes, as elaborated hereinbelow.

DEAD/H (Asp-Glu-Ala-Asp/His) Box Polypeptide 11 (CHL1-like helicase homolog, S. cerevisiae) (DDX11, Accession NM_030655) is a VGAM2407 host target gene. DDX11 BINDING SITE is HOST TARGET binding site found in the 3' untranslated region of mRNA encoded by DDX11, corresponding to a HOST TARGET binding site such as BINDING SITE I, BINDING SITE II or BINDING SITE III. Table 2 illustrates the complementarity of the nucleotide sequences of DDX11 BINDING SITE, designated SEQ ID:24985, to the nucleotide sequence of VGAM2407 RNA, herein designated VGAM RNA, also designated SEQ ID:5118.

A function of VGAM2407 is therefore inhibition of DEAD/H (Asp-Glu-Ala-Asp/His) Box Polypeptide 11 (CHL1-like helicase homolog, S. cerevisiae) (DDX11, Accession NM_030655), a gene which could be an ATP-dependent DNA-binding helicase and may intervene in cell cycle regulation. Accordingly, utilities of VGAM2407 include diagnosis, prevention and treatment of diseases and clinical conditions associated with DDX11. The function of DDX11 and its association with various diseases and clinical conditions, has been established by previous studies, as described hereinabove with reference to VGAM1533. KIAA0836 (Accession XM_035390) is another VGAM2407 host target gene. KIAA0836 BINDING SITE is HOST TARGET binding site found in the 3' untranslated region of mRNA encoded by KIAA0836, corresponding to a HOST TARGET binding site such as BINDING SITE I, BINDING SITE II or BINDING SITE III. Table 2 illustrates the complementarity of the nucleotide sequences of KIAA0836 BINDING SITE, designated SEQ ID:32243, to the nucleotide sequence of VGAM2407 RNA, herein designated VGAM RNA, also designated SEQ ID:5118.

Another function of VGAM2407 is therefore inhibition of KIAA0836 (Accession XM_035390). Accordingly, utilities of VGAM2407 include diagnosis, prevention and treatment of diseases and clinical conditions associated with KIAA0836. MGC2574 (Accession NM_024098) is another VGAM2407 host target gene. MGC2574 BINDING SITE is HOST TARGET binding site found in the 3' untranslated region of mRNA encoded by MGC2574, corresponding to a HOST TARGET binding site such as BINDING SITE I, BINDING SITE II or BINDING SITE III. Table 2 illustrates the complementarity of the nucleotide sequences of MGC2574 BINDING SITE, designated SEQ ID:23537, to the nucleotide sequence of VGAM2407 RNA, herein designated VGAM RNA, also designated SEQ ID:5118.

Another function of VGAM2407 is therefore inhibition of MGC2574 (Accession NM_024098). Accordingly, utilities of VGAM2407 include diagnosis, prevention and treatment of diseases and clinical conditions associated with MGC2574. LOC133362 (Accession XM_068305) is another VGAM2407 host target gene. LOC133362 BINDING SITE is HOST TARGET binding site found in the 5' untranslated region of mRNA encoded by LOC133362, corresponding to a HOST TARGET binding site such as BINDING SITE I, BINDING SITE II or BINDING SITE III. Table 2 illustrates the complementarity of the nucleotide sequences of LOC133362 BINDING SITE, designated SEQ ID:37379, to the nucleotide sequence of VGAM2407 RNA, herein designated VGAM RNA, also designated SEQ ID:5118.

Another function of VGAM2407 is therefore inhibition of LOC133362 (Accession XM_068305). Accordingly, utilities of VGAM2407 include diagnosis, prevention and treatment of diseases and clinical conditions associated with LOC133362. LOC145078 (Accession XM_015840) is another VGAM2407 host target gene. LOC145078 BINDING SITE is HOST TARGET binding site found in the 5' untranslated region of mRNA encoded by LOC145078, corresponding to a HOST TARGET binding site such as BINDING SITE I, BINDING SITE II or BINDING SITE III. Table 2 illustrates the complementarity of the nucleotide sequences of LOC145078 BINDING SITE, designated SEQ ID:30247, to the nucleotide sequence of VGAM2407 RNA, herein designated VGAM RNA, also designated SEQ ID:5118.

Another function of VGAM2407 is therefore inhibition of LOC145078 (Accession XM_015840). Accordingly, utilities of VGAM2407 include diagnosis, prevention and treatment of diseases and clinical conditions associated with LOC145078. LOC145676 (Accession XM_085202) is another VGAM2407 host target gene. LOC145676 BINDING SITE is HOST TARGET binding site found in the 5' untranslated region of mRNA encoded by LOC145676, corresponding to a HOST TARGET binding site such as BINDING SITE I, BINDING SITE II or BINDING SITE III. Table 2 illustrates the complementarity of the nucleotide sequences of LOC145676 BINDING SITE, designated SEQ ID:37920, to the nucleotide sequence of VGAM2407 RNA, herein designated VGAM RNA, also designated SEQ ID:5118.

Another function of VGAM2407 is therefore inhibition of LOC145676 (Accession XM_085202). Accordingly, utilities of VGAM2407 include diagnosis, prevention and treatment of diseases and clinical conditions associated with LOC145676. LOC90459 (Accession XM_031826) is another VGAM2407 host target gene. LOC90459 BINDING SITE is HOST TARGET binding site found in the 3' untranslated region of mRNA encoded by LOC90459, corresponding to a HOST TARGET binding site such as BINDING SITE I, BINDING SITE II or BINDING SITE III. Table 2 illustrates the complementarity of the nucleotide sequences of LOC90459 BINDING SITE, designated SEQ ID:31490, to the nucleotide sequence of VGAM2407 RNA, herein designated VGAM RNA, also designated SEQ ID:5118.

Another function of VGAM2407 is therefore inhibition of LOC90459 (Accession XM_031826). Accordingly, utilities of VGAM2407 include diagnosis, prevention and treatment of diseases and clinical conditions associated with LOC90459. FIG. 1 further provides a conceptual description of a novel bioinformatically detected viral gene of the present invention, referred to here as Viral Genomic Address Messenger 2408 (VGAM2408) viral gene, which modulates expression of respective host target genes thereof, the function and utility of which host target genes is known in the art.

VGAM2408 is a novel bioinformatically detected regulatory, non protein coding, viral micro RNA (miRNA) gene. The method by which VGAM2408 was detected is described hereinabove with reference to FIGS. 1-8.

VGAM2408 gene, herein designated VGAM GENE, is a viral gene contained in the genome of Goatpox Virus. VGAM2408 host target gene, herein designated VGAM HOST TARGET GENE, is a human gene contained in the human genome.

VGAM2408 gene encodes a VGAM2408 precursor RNA, herein designated VGAM PRECURSOR RNA. Similar to other miRNA genes, and unlike most ordinary genes, VGAM2408 precursor RNA does not encode a protein. A nucleotide sequence identical or highly similar to the nucleotide sequence of VGAM2408 precursor RNA is designated SEQ ID:2394, and is provided hereinbelow with reference to the sequence listing part. Nucleotide sequence SEQ ID:2394 is located at position 36819 relative to the genome of Goatpox Virus.

VGAM2408 precursor RNA folds onto itself, forming VGAM2408 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2408 folded precursor RNA into VGAM2408 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM2408 RNA is designated SEQ ID:5119, and is provided hereinbelow with reference to the sequence listing part.

VGAM2408 host target gene, herein designated VGAM HOST TARGET GENE, encodes a corresponding messenger RNA, VGAM2408 host target RNA, herein designated VGAM HOST TARGET RNA. VGAM2408 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2408 RNA, herein designated VGAM RNA, binds complementarily to one or more host target binding sites located in untranslated regions of VGAM2408 host target RNA, herein designated VGAM HOST TARGET RNA. This complementary binding is due to the fact that the nucleotide sequence of VGAM2408 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2408 RNA, herein designated VGAM RNA, may have a different number of host target binding sites in untranslated regions of a VGAM2408 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2408 RNA, herein designated VGAM RNA, to host target binding sites on VGAM2408 host target RNA, herein designated VGAM HOST TARGET RNA, such as BINDING SITE I, BINDING SITE II and BINDING SITE III, inhibits translation of VGAM2408 host target RNA into VGAM2408 host target protein, herein designated VGAM HOST TARGET PROTEIN. VGAM host target protein is therefore outlined by a broken line.

It is appreciated that VGAM2408 host target gene, herein designated VGAM HOST TARGET GENE, in fact represents a plurality of VGAM2408 host target genes. The mRNA of each one of this plurality of VGAM2408 host target genes comprises one or more host target binding sites, each having a nucleotide sequence which is at least partly complementary to VGAM2408 RNA, herein designated VGAM RNA, and which when bound by VGAM2408 RNA causes inhibition of translation of respective one or more VGAM2408 host target proteins.

It is further appreciated by one skilled in the art that the mode of translational inhibition illustrated by FIG. 1 with specific reference to translational inhibition exerted by VGAM2408 gene, herein designated VGAM GENE, on one or more VGAM2408 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2408 is inhibition of expression of host target genes, as part of a novel viral mechanism of attacking a host. Accordingly, utilities of VGAM2408 include diagnosis, prevention and treatment of viral infection by Goatpox Virus. Specific functions, and accordingly utilities, of VGAM2408 correlate with, and may be deduced from, the identity of the host target genes which VGAM2408 binds and inhibits, and the function of these host target genes, as elaborated hereinbelow.

Nucleotide sequences of the VGAM2408 precursor RNA, herein designated VGAM PRECURSOR RNA, and of the 'diced' VGAM2408 RNA, herein designated VGAM RNA, and a schematic representation of the secondary folding of VGAM2408 folded precursor RNA, herein designated VGAM FOLDED PRECURSOR RNA, of VGAM2408 are further described hereinbelow with reference to Table 1.

Nucleotide sequences of host target binding sites, such as BINDING SITE-I, BINDING SITE-II and BINDING SITE-III of FIG. 1, found on VGAM2408 host target RNA, and schematic representation of the complementarity of each of these host target binding sites to VGAM2408 RNA, herein designated VGAM RNA, are described hereinbelow with reference to Table 2.

As mentioned hereinabove with reference to FIG. 1, a function of VGAM2408 gene, herein designated VGAM is inhibition of expression of VGAM2408 target genes. It is appreciated that specific functions, and accordingly utilities, of VGAM2408 correlate with, and may be deduced from, the identity of the target genes which VGAM2408 binds and inhibits, and the function of these target genes, as elaborated hereinbelow.

Myeloma Overexpressed Gene (in a subset of t (11;14) Positive Multiple Myelomas) (MYEOV, Accession NM_138768) is a VGAM2408 host target gene. MYEOV BINDING SITE is HOST TARGET binding site found in the 5' untranslated region of mRNA encoded by MYEOV, corresponding to a HOST TARGET binding site such as BINDING SITE I, BINDING SITE II or BINDING SITE III. Table 2 illustrates the complementarity of the nucleotide sequences of MYEOV BINDING SITE, designated SEQ ID:28998, to the nucleotide sequence of VGAM2408 RNA, herein designated VGAM RNA, also designated SEQ ID:5119.

A function of VGAM2408 is therefore inhibition of Myeloma Overexpressed Gene (in a subset of t (11;14) Positive Multiple Myelomas) (MYEOV, Accession NM_138768), a gene which is encoded by MYELOMA OVEREXPRESSED GENE. Accordingly, utilities of VGAM2408 include diagnosis, prevention and treatment of diseases and clinical conditions associated with MYEOV. The function of MYEOV and its association with various diseases and clinical conditions, has been established by previous studies, as described hereinabove with reference to VGAM471. JDD1 (Accession XM_032515) is another VGAM2408 host target gene. JDD1 BINDING SITE is HOST TARGET binding site found in the 3' untranslated region of mRNA encoded by JDD1, corresponding to a HOST TARGET binding site such as BINDING SITE I, BINDING SITE II or BINDING SITE III. Table 2 illustrates the complementarity of the nucleotide sequences of JDD1 BINDING SITE, designated SEQ ID:31667, to the nucleotide sequence of VGAM2408 RNA, herein designated VGAM RNA, also designated SEQ ID:5119.

Another function of VGAM2408 is therefore inhibition of JDD1 (Accession XM_032515). Accordingly, utilities of VGAM2408 include diagnosis, prevention and treatment of diseases and clinical conditions associated with JDD1. FIG. 1 further provides a conceptual description of a novel bioinformatically detected viral gene of the present invention, referred to here as Viral Genomic Address Messenger 2409 (VGAM2409) viral gene, which modulates expression of respective host target genes thereof, the function and utility of which host target genes is known in the art.

VGAM2409 is a novel bioinformatically detected regulatory, non protein coding, viral micro RNA (miRNA) gene. The method by which VGAM2409 was detected is described hereinabove with reference to FIGS. 1-8.

VGAM2409 gene, herein designated VGAM GENE, is a viral gene contained in the genome of Goatpox Virus. VGAM2409 host target gene, herein designated VGAM HOST TARGET GENE, is a human gene contained in the human genome.

VGAM2409 gene encodes a VGAM2409 precursor RNA, herein designated VGAM PRECURSOR RNA. Similar to other miRNA genes, and unlike most ordinary genes, VGAM2409 precursor RNA does not encode a protein. A nucleotide sequence identical or highly similar to the nucleotide sequence of VGAM2409 precursor RNA is designated SEQ ID:2395, and is provided hereinbelow with reference to the sequence listing part. Nucleotide sequence SEQ ID:2395 is located at position 109177 relative to the genome of Goatpox Virus.

VGAM2409 precursor RNA folds onto itself, forming VGAM2409 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2409 folded precursor RNA into VGAM2409 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM2409 RNA is designated SEQ ID:5120, and is provided hereinbelow with reference to the sequence listing part.

VGAM2409 host target gene, herein designated VGAM HOST TARGET GENE, encodes a corresponding messenger RNA, VGAM2409 host target RNA, herein designated VGAM HOST TARGET RNA. VGAM2409 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2409 RNA, herein designated VGAM RNA, binds complementarily to one or more host target binding sites located in untranslated regions of VGAM2409 host target RNA, herein designated VGAM HOST TARGET RNA. This complementary binding is due to the fact that the nucleotide sequence of VGAM2409 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2409 RNA, herein designated VGAM RNA, may have a different number of host target binding sites in untranslated regions of a VGAM2409 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2409 RNA, herein designated VGAM RNA, to host target binding sites on VGAM2409 host target RNA, herein designated VGAM HOST TARGET RNA, such as BINDING SITE I, BINDING SITE II and BINDING SITE III, inhibits translation of VGAM2409 host target RNA into VGAM2409 host target protein, herein designated VGAM HOST TARGET PROTEIN. VGAM host target protein is therefore outlined by a broken line.

It is appreciated that VGAM2409 host target gene, herein designated VGAM HOST TARGET GENE, in fact represents a plurality of VGAM2409 host target genes. The mRNA of each one of this plurality of VGAM2409 host target genes comprises one or more host target binding sites, each having a nucleotide sequence which is at least partly complementary to VGAM2409 RNA, herein designated VGAM RNA, and which when bound by VGAM2409 RNA causes inhibition of translation of respective one or more VGAM2409 host target proteins.

It is further appreciated by one skilled in the art that the mode of translational inhibition illustrated by FIG. 1 with specific reference to translational inhibition exerted by VGAM2409 gene, herein designated VGAM GENE, on one or more VGAM2409 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2409 is inhibition of expression of host target genes, as part of a novel viral mechanism of attacking a host. Accordingly, utilities of VGAM2409 include diagnosis, prevention and treatment of viral infection by Goatpox Virus. Specific functions, and accordingly utilities, of VGAM2409 correlate with, and may be deduced from, the identity of the host target genes which VGAM2409 binds and inhibits, and the function of these host target genes, as elaborated hereinbelow.

Nucleotide sequences of the VGAM2409 precursor RNA, herein designated VGAM PRECURSOR RNA, and of the 'diced' VGAM2409 RNA, herein designated VGAM RNA, and a schematic representation of the secondary folding of VGAM2409 folded precursor RNA, herein designated VGAM FOLDED PRECURSOR RNA, of VGAM2409 are further described hereinbelow with reference to Table 1.

Nucleotide sequences of host target binding sites, such as BINDING SITE-I, BINDING SITE-II and BINDING SITE-III of FIG. 1, found on VGAM2409 host target RNA, and schematic representation of the complementarity of each of these host target binding sites to VGAM2409 RNA, herein designated VGAM RNA, are described hereinbelow with reference to Table 2.

As mentioned hereinabove with reference to FIG. 1, a function of VGAM2409 gene, herein designated VGAM is inhibition of expression of VGAM2409 target genes. It is appreciated that specific functions, and accordingly utilities, of VGAM2409 correlate with, and may be deduced from, the identity of the target genes which VGAM2409 binds and inhibits, and the function of these target genes, as elaborated hereinbelow.

Tumor Protein P53 Inducible Nuclear Protein 1 (TP53INP1, Accession NM_033285) is a VGAM2409 host target gene. TP53INP1 BINDING SITE1 and TP53INP1 BINDING SITE2 are HOST TARGET binding sites found in untranslated regions of mRNA encoded by TP53INP1, corresponding to HOST TARGET binding sites such as BINDING SITE I, BINDING SITE II or BINDING SITE III. Table 2 illustrates the complementarity of the nucleotide sequences of TP53INP1 BINDING SITE1 and TP53INP1 BINDING SITE2, designated SEQ ID:27105 and SEQ ID:36116 respectively, to the nucleotide sequence of VGAM2409 RNA, herein designated VGAM RNA, also designated SEQ ID:5120.

A function of VGAM2409 is therefore inhibition of Tumor Protein P53 Inducible Nuclear Protein 1 (TP53INP1, Accession NM_033285). Accordingly, utilities of VGAM2409 include diagnosis, prevention and treatment of diseases and clinical conditions associated with TP53INP1. FIG. 1 further provides a conceptual description of a novel bioinformatically detected viral gene of the present invention, referred to here as Viral Genomic Address Messenger 2410 (VGAM2410) viral gene, which modulates expression of respective host target genes thereof, the function and utility of which host target genes is known in the art.

VGAM2410 is a novel bioinformatically detected regulatory, non protein coding, viral micro RNA (miRNA) gene. The method by which VGAM2410 was detected is described hereinabove with reference to FIGS. 1-8.

VGAM2410 gene, herein designated VGAM GENE, is a viral gene contained in the genome of Goatpox Virus. VGAM2410 host target gene, herein designated VGAM HOST TARGET GENE, is a human gene contained in the human genome.

VGAM2410 gene encodes a VGAM2410 precursor RNA, herein designated VGAM PRECURSOR RNA. Similar to other miRNA genes, and unlike most ordinary genes, VGAM2410 precursor RNA does not encode a protein. A nucleotide sequence identical or highly similar to the nucleotide sequence of VGAM2410 precursor RNA is designated SEQ ID:2396, and is provided hereinbelow with reference to the sequence listing part. Nucleotide sequence SEQ ID:2396 is located at position 118894 relative to the genome of Goatpox Virus.

VGAM2410 precursor RNA folds onto itself, forming VGAM2410 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2410 folded precursor RNA into VGAM2410 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2410 RNA is designated SEQ ID:5121, and is provided hereinbelow with reference to the sequence listing part.

VGAM2410 host target gene, herein designated VGAM HOST TARGET GENE, encodes a corresponding messenger RNA, VGAM2410 host target RNA, herein designated VGAM HOST TARGET RNA. VGAM2410 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2410 RNA, herein designated VGAM RNA, binds complementarily to one or more host target binding sites located in untranslated regions of VGAM2410 host target RNA, herein designated VGAM HOST TARGET RNA. This complementary binding is due to the fact that the nucleotide sequence of VGAM2410 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2410 RNA, herein designated VGAM RNA, may have a different number of host target binding sites in untranslated regions of a VGAM2410 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2410 RNA, herein designated VGAM RNA, to host target binding sites on VGAM2410 host target RNA, herein designated VGAM HOST TARGET RNA, such as BINDING SITE I, BINDING SITE II and BINDING SITE III, inhibits translation of VGAM2410 host target RNA into VGAM2410 host target protein, herein designated VGAM HOST TARGET PROTEIN. VGAM host target protein is therefore outlined by a broken line.

It is appreciated that VGAM2410 host target gene, herein designated VGAM HOST TARGET GENE, in fact represents a plurality of VGAM2410 host target genes. The mRNA of each one of this plurality of VGAM2410 host target genes comprises one or more host target binding sites, each having a nucleotide sequence which is at least partly complementary to VGAM2410 RNA, herein designated VGAM RNA, and which when bound by VGAM2410 RNA causes inhibition of translation of respective one or more VGAM2410 host target proteins.

It is further appreciated by one skilled in the art that the mode of translational inhibition illustrated by FIG. 1 with specific reference to translational inhibition exerted by VGAM2410 gene, herein designated VGAM GENE, on one or more VGAM2410 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2410 is inhibition of expression of host target genes, as part of a novel viral mechanism of attacking a host. Accordingly, utilities of VGAM2410 include diagnosis, prevention and treatment of viral infection by Goatpox Virus. Specific functions, and accordingly utilities, of VGAM2410 correlate with, and may be deduced from, the identity of the host target genes which VGAM2410 binds and inhibits, and the function of these host target genes, as elaborated hereinbelow.

Nucleotide sequences of the VGAM2410 precursor RNA, herein designated VGAM PRECURSOR RNA, and of the 'diced' VGAM2410 RNA, herein designated VGAM RNA, and a schematic representation of the secondary folding of VGAM2410 folded precursor RNA, herein designated VGAM FOLDED PRECURSOR RNA, of VGAM2410 are further described hereinbelow with reference to Table 1.

Nucleotide sequences of host target binding sites, such as BINDING SITE-I, BINDING SITE-II and BINDING SITE-III of FIG. 1, found on VGAM2410 host target RNA, and schematic representation of the complementarity of each of these host target binding sites to VGAM2410 RNA, herein designated VGAM RNA, are described hereinbelow with reference to Table 2.

As mentioned hereinabove with reference to FIG. 1, a function of VGAM2410 gene, herein designated VGAM is inhibition of expression of VGAM2410 target genes. It is appreciated that specific functions, and accordingly utilities, of VGAM2410 correlate with, and may be deduced from, the identity of the target genes which VGAM2410 binds and inhibits, and the function of these target genes, as elaborated hereinbelow.

SPF30 (Accession NM_005871) is a VGAM2410 host target gene. SPF30 BINDING SITE is HOST TARGET binding site found in the 3' untranslated region of mRNA encoded by SPF30, corresponding to a HOST TARGET binding site such as BINDING SITE I, BINDING SITE II or BINDING SITE III. Table 2 illustrates the complementarity of the nucleotide sequences of SPF30 BINDING SITE, designated SEQ ID:12490, to the nucleotide sequence of VGAM2410 RNA, herein designated VGAM RNA, also designated SEQ ID:5121.

A function of VGAM2410 is therefore inhibition of SPF30 (Accession NM_005871). Accordingly, utilities of VGAM2410 include diagnosis, prevention and treatment of diseases and clinical conditions associated with SPF30. LOC153339 (Accession XM_098362) is another VGAM2410 host target gene. LOC153339 BINDING SITE is HOST TARGET binding site found in the 3' untranslated region of mRNA encoded by LOC153339, corresponding to a HOST TARGET binding site such as BINDING SITE I, BINDING SITE II or BINDING SITE III. Table 2 illustrates the complementarity of the nucleotide sequences of LOC153339 BINDING SITE, designated SEQ ID:41614, to the nucleotide sequence of VGAM2410 RNA, herein designated VGAM RNA, also designated SEQ ID:5121.

Another function of VGAM2410 is therefore inhibition of LOC153339 (Accession XM_098362). Accordingly, utilities of VGAM2410 include diagnosis, prevention and treatment of diseases and clinical conditions associated with LOC153339. LOC154739 (Accession XM_098602) is another VGAM2410 host target gene. LOC154739 BINDING SITE is HOST TARGET binding site found in the 5' untranslated region of mRNA encoded by LOC154739, corresponding to a HOST TARGET binding site such as BINDING SITE I, BINDING SITE II or BINDING SITE III. Table 2 illustrates the complementarity of the nucleotide sequences of LOC154739 BINDING SITE, designated SEQ ID:41711, to the nucleotide sequence of VGAM2410 RNA, herein designated VGAM RNA, also designated SEQ ID:5121.

Another function of VGAM2410 is therefore inhibition of LOC154739 (Accession XM_098602). Accordingly, utilities of VGAM2410 include diagnosis, prevention and treatment of diseases and clinical conditions associated with LOC154739. LOC92573 (Accession XM_045884) is another VGAM2410 host target gene. LOC92573 BINDING SITE is HOST TARGET binding site found in the 5' untranslated region of mRNA encoded by LOC92573, corresponding to a HOST TARGET binding site such as BINDING SITE I, BINDING SITE II or BINDING SITE III. Table 2 illustrates the complementarity of the nucleotide sequences of LOC92573 BINDING SITE, designated SEQ ID:34596, to the nucleotide sequence of VGAM2410 RNA, herein designated VGAM RNA, also designated SEQ ID:5121.

Another function of VGAM2410 is therefore inhibition of LOC92573 (Accession XM_045884). Accordingly, utilities of VGAM2410 include diagnosis, prevention and treatment of diseases and clinical conditions associated with LOC92573. FIG. 1 further provides a conceptual description of a novel bioinformatically detected viral gene of the present invention, referred to here as Viral Genomic Address Messenger 2411 (VGAM2411) viral gene, which modulates expression of respective host target genes thereof, the function and utility of which host target genes is known in the art.

VGAM2411 is a novel bioinformatically detected regulatory, non protein coding, viral micro RNA (miRNA) gene. The method by which VGAM2411 was detected is described hereinabove with reference to FIGS. 1-8.

VGAM2411 gene, herein designated VGAM GENE, is a viral gene contained in the genome of Goatpox Virus. VGAM2411 host target gene, herein designated VGAM HOST TARGET GENE, is a human gene contained in the human genome.

VGAM2411 gene encodes a VGAM2411 precursor RNA, herein designated VGAM PRECURSOR RNA. Similar to other miRNA genes, and unlike most ordinary genes, VGAM2411 precursor RNA does not encode a protein. A nucleotide sequence identical or highly similar to the nucleotide sequence of VGAM2411 precursor RNA is designated SEQ ID:2397, and is provided hereinbelow with reference to the sequence listing part. Nucleotide sequence SEQ ID:2397 is located at position 74764 relative to the genome of Goatpox Virus.

VGAM2411 precursor RNA folds onto itself, forming VGAM2411 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2411 folded precursor RNA into VGAM2411 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM2411 RNA is designated SEQ ID:5122, and is provided hereinbelow with reference to the sequence listing part.

VGAM2411 host target gene, herein designated VGAM HOST TARGET GENE, encodes a corresponding messenger RNA, VGAM2411 host target RNA, herein designated VGAM HOST TARGET RNA. VGAM2411 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2411 RNA, herein designated VGAM RNA, binds complementarily to one or more host target binding sites located in untranslated regions of VGAM2411 host target RNA, herein designated VGAM HOST TARGET RNA. This complementary binding is due to the fact that the nucleotide sequence of VGAM2411 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2411 RNA, herein designated VGAM RNA, may have a different number of host target binding sites in untranslated regions of a VGAM2411 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2411 RNA, herein designated VGAM RNA, to host target binding sites on VGAM2411 host target RNA, herein designated VGAM HOST TARGET RNA, such as BINDING SITE I, BINDING SITE II and BINDING SITE III, inhibits translation of VGAM2411 host target RNA into VGAM2411 host target protein, herein designated VGAM HOST TARGET PROTEIN. VGAM host target protein is therefore outlined by a broken line.

It is appreciated that VGAM2411 host target gene, herein designated VGAM HOST TARGET GENE, in fact represents a plurality of VGAM2411 host target genes. The mRNA of each one of this plurality of VGAM2411 host target genes comprises one or more host target binding sites, each having a nucleotide sequence which is at least partly complementary to VGAM2411 RNA, herein designated VGAM RNA, and which when bound by VGAM2411 RNA causes inhibition of translation of respective one or more VGAM2411 host target proteins.

It is further appreciated by one skilled in the art that the mode of translational inhibition illustrated by FIG. 1 with specific reference to translational inhibition exerted by VGAM2411 gene, herein designated VGAM GENE, on one or more VGAM2411 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2411 is inhibition of expression of host target genes, as part of a novel viral mechanism of attacking a host. Accordingly, utilities of VGAM2411 include diagnosis, prevention and treatment of viral infection by Goatpox Virus. Specific functions, and accordingly utilities, of VGAM2411 correlate with, and may be deduced from, the identity of the host target genes which VGAM2411 binds and inhibits, and the function of these host target genes, as elaborated hereinbelow.

Nucleotide sequences of the VGAM2411 precursor RNA, herein designated VGAM PRECURSOR RNA, and of the 'diced' VGAM2411 RNA, herein designated VGAM RNA, and a schematic representation of the secondary folding of VGAM2411 folded precursor RNA, herein designated VGAM FOLDED PRECURSOR RNA, of VGAM2411 are further described hereinbelow with reference to Table 1.

Nucleotide sequences of host target binding sites, such as BINDING SITE-I, BINDING SITE-II and BINDING SITE-III of FIG. 1, found on VGAM2411 host target RNA, and schematic representation of the complementarity of each of these host target binding sites to VGAM2411 RNA, herein designated VGAM RNA, are described hereinbelow with reference to Table 2.

As mentioned hereinabove with reference to FIG. 1, a function of VGAM2411 gene, herein designated VGAM is inhibition of expression of VGAM2411 target genes. It is appreciated that specific functions, and accordingly utilities, of VGAM2411 correlate with, and may be deduced from, the identity of the target genes which VGAM2411 binds and inhibits, and the function of these target genes, as elaborated hereinbelow.

Radixin (RDX, Accession NM_002906) is a VGAM2411 host target gene. RDX BINDING SITE is HOST TARGET binding site found in the 3' untranslated region of mRNA encoded by RDX, corresponding to a HOST TARGET binding site such as BINDING SITE I, BINDING SITE II or BINDING SITE III. Table 2 illustrates the complementarity of the nucleotide sequences of RDX BINDING SITE, designated SEQ ID:8806, to the nucleotide sequence of VGAM2411 RNA, herein designated VGAM RNA, also designated SEQ ID:5122.

A function of VGAM2411 is therefore inhibition of Radixin (RDX, Accession NM_002906), a gene which plays a crucial role in the binding of the barbed end of actin filaments to the plasma membrane. Accordingly, utilities of VGAM2411 include diagnosis, prevention and treatment of diseases and clinical conditions associated with RDX. The function of RDX and its association with various diseases and clinical conditions, has been established by previous studies, as described hereinabove with reference to VGAM290. XT3 (Accession NM_020208) is another VGAM2411 host target gene. XT3 BINDING SITE is HOST TARGET binding site found in the 3' untranslated region of mRNA encoded by XT3, corresponding to a HOST TARGET binding site such as BINDING SITE I, BINDING SITE II or BINDING SITE III. Table 2 illustrates the complementarity of the nucleotide sequences of XT3 BINDING SITE, designated SEQ ID:21440, to the nucleotide sequence of VGAM2411 RNA, herein designated VGAM RNA, also designated SEQ ID:5122.

Another function of VGAM2411 is therefore inhibition of XT3 (Accession NM_020208), a gene which is a Kidney-specific orphan transporter. Accordingly, utilities of VGAM2411 include diagnosis, prevention and treatment of diseases and clinical conditions associated with XT3. The function of XT3 and its association with various diseases and clinical conditions, has been established by previous studies, as described hereinabove with reference to VGAM21. FLJ10607 (Accession XM_085119) is another VGAM2411 host target gene. FLJ10607 BINDING SITE is HOST TARGET binding site found in the 3' untranslated region of mRNA encoded by FLJ10607, corresponding to a HOST TARGET binding site such as BINDING SITE I, BINDING SITE II or BINDING SITE III. Table 2 illustrates the complementarity of the nucleotide sequences of FLJ10607 BINDING SITE, designated SEQ ID:37832, to the nucleotide sequence of VGAM2411 RNA, herein designated VGAM RNA, also designated SEQ ID:5122.

Another function of VGAM2411 is therefore inhibition of FLJ10607 (Accession XM_085119). Accordingly, utilities of VGAM2411 include diagnosis, prevention and treatment of diseases and clinical conditions associated with FLJ10607. KIAA1622 (Accession NM_058237) is another VGAM2411 host target gene. KIAA1622 BINDING SITE is HOST TARGET binding site found in the 3' untranslated region of mRNA encoded by KIAA1622, corresponding to a HOST TARGET binding site such as BINDING SITE I, BINDING SITE II or BINDING SITE III. Table 2 illustrates the complementarity of the nucleotide sequences of KIAA1622 BINDING SITE, designated SEQ ID:27762, to the nucleotide sequence of VGAM2411 RNA, herein designated VGAM RNA, also designated SEQ ID:5122.

Another function of VGAM2411 is therefore inhibition of KIAA1622 (Accession NM_058237). Accordingly, utilities of VGAM2411 include diagnosis, prevention and treatment of diseases and clinical conditions associated with KIAA1622. LOC196812 (Accession XM_116868) is another VGAM2411 host target gene. LOC196812 BINDING SITE is HOST TARGET binding site found in the 3' untranslated region of mRNA encoded by LOC196812, corresponding to a HOST TARGET binding site such as BINDING SITE I, BINDING SITE II or BINDING SITE III. Table 2 illustrates the complementarity of the nucleotide sequences of LOC196812 BINDING SITE, designated SEQ ID:43131, to the nucleotide sequence of VGAM2411 RNA, herein designated VGAM RNA, also designated SEQ ID:5122.

Another function of VGAM2411 is therefore inhibition of LOC196812 (Accession XM_116868). Accordingly, utilities of VGAM2411 include diagnosis, prevention and treatment of diseases and clinical conditions associated with LOC196812. FIG. 1 further provides a conceptual description of a novel bioinformatically detected viral gene of the present invention, referred to here as Viral Genomic Address Messenger 2412 (VGAM2412) viral gene, which modulates expression of respective host target genes thereof, the function and utility of which host target genes is known in the art.

VGAM2412 is a novel bioinformatically detected regulatory, non protein coding, viral micro RNA (miRNA) gene. The method by which VGAM2412 was detected is described hereinabove with reference to FIGS. 1-8.

VGAM2412 gene, herein designated VGAM GENE, is a viral gene contained in the genome of Goatpox Virus. VGAM2412 host target gene, herein designated VGAM HOST TARGET GENE, is a human gene contained in the human genome.

VGAM2412 gene encodes a VGAM2412 precursor RNA, herein designated VGAM PRECURSOR RNA. Similar to other miRNA genes, and unlike most ordinary genes, VGAM2412 precursor RNA does not encode a protein. A nucleotide sequence identical or highly similar to the nucleotide sequence of VGAM2412 precursor RNA is designated SEQ ID:2398, and is provided hereinbelow with reference to the sequence listing part. Nucleotide sequence SEQ ID:2398 is located at position 52802 relative to the genome of Goatpox Virus.

VGAM2412 precursor RNA folds onto itself, forming VGAM2412 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2412 folded precursor RNA into VGAM2412 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 67%) nucleotide sequence of VGAM2412 RNA is designated SEQ ID:5123, and is provided hereinbelow with reference to the sequence listing part.

VGAM2412 host target gene, herein designated VGAM HOST TARGET GENE, encodes a corresponding messenger RNA, VGAM2412 host target RNA, herein designated VGAM HOST TARGET RNA. VGAM2412 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2412 RNA, herein designated VGAM RNA, binds complementarily to one or more host target binding sites located in untranslated regions of VGAM2412 host target RNA, herein designated VGAM HOST TARGET RNA. This complementary binding is due to the fact that the nucleotide sequence of VGAM2412 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2412 RNA, herein designated VGAM RNA, may have a different number of host target binding sites in untranslated regions of a VGAM2412 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2412 RNA, herein designated VGAM RNA, to host target binding sites on VGAM2412 host target RNA, herein designated VGAM HOST TARGET RNA, such as BINDING SITE I, BINDING SITE II and BINDING SITE III, inhibits translation of VGAM2412 host target RNA into VGAM2412 host target protein, herein designated VGAM HOST TARGET PROTEIN. VGAM host target protein is therefore outlined by a broken line.

It is appreciated that VGAM2412 host target gene, herein designated VGAM HOST TARGET GENE, in fact represents a plurality of VGAM2412 host target genes. The mRNA of each one of this plurality of VGAM2412 host target genes comprises one or more host target binding sites, each having a nucleotide sequence which is at least partly complementary to VGAM2412 RNA, herein designated VGAM RNA, and which when bound by VGAM2412 RNA causes inhibition of translation of respective one or more VGAM2412 host target proteins.

It is further appreciated by one skilled in the art that the mode of translational inhibition illustrated by FIG. 1 with specific reference to translational inhibition exerted by VGAM2412 gene, herein designated VGAM GENE, on one or more VGAM2412 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2412 is inhibition of expression of host target genes, as part of a novel viral mechanism of attacking a host. Accordingly, utilities of VGAM2412 include diagnosis, prevention and treatment of viral infection by Goatpox Virus. Specific functions, and accordingly utilities, of VGAM2412 correlate with, and may be deduced from, the identity of the host target genes which VGAM2412 binds and inhibits, and the function of these host target genes, as elaborated hereinbelow.

Nucleotide sequences of the VGAM2412 precursor RNA, herein designated VGAM PRECURSOR RNA, and of the 'diced' VGAM2412 RNA, herein designated VGAM RNA, and a schematic representation of the secondary folding of VGAM2412 folded precursor RNA, herein designated VGAM FOLDED PRECURSOR RNA, of VGAM2412 are further described hereinbelow with reference to Table 1.

Nucleotide sequences of host target binding sites, such as BINDING SITE-I, BINDING SITE-II and BINDING SITE-III of FIG. 1, found on VGAM2412 host target RNA, and schematic representation of the complementarity of each of these host target binding sites to VGAM2412 RNA, herein designated VGAM RNA, are described hereinbelow with reference to Table 2.

As mentioned hereinabove with reference to FIG. 1, a function of VGAM2412 gene, herein designated VGAM is inhibition of expression of VGAM2412 target genes. It is appreciated that specific functions, and accordingly utilities, of VGAM2412 correlate with, and may be deduced from, the identity of the target genes which VGAM2412 binds and inhibits, and the function of these target genes, as elaborated hereinbelow.

ATPase, Class VI, Type 11B (ATP11B, Accession XM_087254) is a VGAM2412 host target gene. ATP11B BINDING SITE is HOST TARGET binding site found in the 3' untranslated region of mRNA encoded by ATP11B, corresponding to a HOST TARGET binding site such as BINDING SITE I, BINDING SITE II or BINDING SITE III. Table 2 illustrates the complementarity of the nucleotide sequences of ATP11B BINDING SITE, designated SEQ ID:39145, to the nucleotide sequence of VGAM2412 RNA, herein designated VGAM RNA, also designated SEQ ID:5123.

A function of VGAM2412 is therefore inhibition of ATPase, Class VI, Type 11B (ATP11B, Accession XM_087254), a gene which is phosphorylated in their intermediate state, drives uphill transport of ions across membranes. Accordingly, utilities of VGAM2412 include diagnosis, prevention and treatment of diseases and clinical conditions associated with ATP11B. The function of ATP11B and its association with various diseases and clinical conditions, has been established by previous studies, as described hereinabove with reference to VGAM665. Monoamine Oxidase B (MAOB, Accession XM_010261) is another VGAM2412 host target gene. MAOB BINDING SITE is HOST TARGET binding site found in the 3' untranslated region of mRNA encoded by MAOB, corresponding to a HOST TARGET binding site such as BINDING SITE I, BINDING SITE II or BINDING SITE III. Table 2 illustrates the complementarity of the nucleotide sequences of MAOB BINDING SITE, designated SEQ ID:30148, to the nucleotide sequence of VGAM2412 RNA, herein designated VGAM RNA, also designated SEQ ID:5123.

Another function of VGAM2412 is therefore inhibition of Monoamine Oxidase B (MAOB, Accession XM_010261). Accordingly, utilities of VGAM2412 include diagnosis, prevention and treatment of diseases and clinical conditions associated with MAOB. Usher Syndrome 2A (autosomal recessive, mild) (USH2A, Accession NM_007123) is another VGAM2412 host target gene. USH2A BINDING SITE is HOST TARGET binding site found in the 3' untranslated region of mRNA encoded by USH2A, corresponding to a HOST TARGET binding site such as BINDING SITE I, BINDING SITE II or BINDING SITE III. Table 2 illustrates the complementarity of the nucleotide sequences of USH2A BINDING SITE, designated SEQ ID:13981, to the nucleotide sequence of VGAM2412 RNA, herein designated VGAM RNA, also designated SEQ ID:5123.

Another function of VGAM2412 is therefore inhibition of Usher Syndrome 2A (autosomal recessive, mild) (USH2A, Accession NM_007123). Accordingly, utilities of VGAM2412 include diagnosis, prevention and treatment of diseases and clinical conditions associated with USH2A. Chromosome 3 Open Reading Frame 4 (C3orf4, Accession NM_019895) is another VGAM2412 host target gene. C3orf4 BINDING SITE is HOST TARGET binding site found in the 3' untranslated region of mRNA encoded by C3orf4, corresponding to a HOST TARGET binding site such as BINDING SITE I, BINDING SITE II or BINDING SITE III. Table 2 illustrates the complementarity of the nucleotide sequences of C3orf4 BINDING SITE, designated SEQ ID:21280, to the nucleotide sequence of VGAM2412 RNA, herein designated VGAM RNA, also designated SEQ ID:5123.

Another function of VGAM2412 is therefore inhibition of Chromosome 3 Open Reading Frame 4 (C3orf4, Accession NM_019895). Accordingly, utilities of VGAM2412 include diagnosis, prevention and treatment of diseases and clinical conditions associated with C3orf4. Glia Maturation Factor, Beta (GMFB, Accession NM_004124) is another VGAM2412 host target gene. GMFB BINDING SITE is HOST TARGET binding site found in the 3' untranslated region of mRNA encoded by GMFB, corresponding to a HOST TARGET binding site such as BINDING SITE I, BINDING SITE II or BINDING SITE III. Table 2 illustrates the complementarity of the nucleotide sequences of GMFB BINDING SITE, designated SEQ ID:10328, to the nucleotide sequence of VGAM2412 RNA, herein designated VGAM RNA, also designated SEQ ID:5123.

Another function of VGAM2412 is therefore inhibition of Glia Maturation Factor, Beta (GMFB, Accession NM_004124). Accordingly, utilities of VGAM2412 include diagnosis, prevention and treatment of diseases and clinical conditions associated with GMFB. KIAA0410 (Accession NM_014778) is another VGAM2412 host target gene. KIAA0410 BINDING SITE is HOST TARGET binding site found in the 3' untranslated region of mRNA encoded by KIAA0410, corresponding to a HOST TARGET binding site such as BINDING SITE I, BINDING SITE II or BINDING SITE III. Table 2 illustrates the complementarity of the nucleotide sequences of KIAA0410 BINDING SITE, designated SEQ ID:16616, to the nucleotide sequence of VGAM2412 RNA, herein designated VGAM RNA, also designated SEQ ID:5123.

Another function of VGAM2412 is therefore inhibition of KIAA0410 (Accession NM_014778). Accordingly, utilities of VGAM2412 include diagnosis, prevention and treatment of diseases and clinical conditions associated with KIAA0410. KIAA1493 (Accession XM_034415) is another VGAM2412 host target gene. KIAA1493 BINDING SITE is HOST TARGET binding site found in the 3' untranslated region of mRNA encoded by KIAA1493, corresponding to a HOST TARGET binding site such as BINDING SITE I, BINDING SITE II or BINDING SITE III. Table 2 illustrates the complementarity of the nucleotide sequences of KIAA1493 BINDING SITE, designated SEQ ID:32093, to the nucleotide sequence of VGAM2412 RNA, herein designated VGAM RNA, also designated SEQ ID:5123.

Another function of VGAM2412 is therefore inhibition of KIAA1493 (Accession XM_034415). Accordingly, utilities of VGAM2412 include diagnosis, prevention and treatment of diseases and clinical conditions associated with KIAA1493. Nuclear Transcription Factor, X-box Binding 1 (NFX1, Accession NM_002504) is another VGAM2412 host target gene. NFX1 BINDING SITE is HOST TARGET binding site found in the 3' untranslated region of mRNA encoded by NFX1, corresponding to a HOST TARGET binding site such as BINDING SITE I, BINDING SITE II or BINDING SITE III. Table 2 illustrates the complementarity of the nucleotide sequences of NFX1 BINDING SITE, designated SEQ ID:8327, to the nucleotide sequence of VGAM2412 RNA, herein designated VGAM RNA, also designated SEQ ID:5123.

Another function of VGAM2412 is therefore inhibition of Nuclear Transcription Factor, X-box Binding 1 (NFX1, Accession NM_002504). Accordingly, utilities of VGAM2412 include diagnosis, prevention and treatment of diseases and clinical conditions associated with NFX1. LOC143425 (Accession XM_113695) is another VGAM2412 host target gene. LOC143425 BINDING SITE is HOST TARGET binding site found in the 3' untranslated region of mRNA encoded by LOC143425, corresponding to a HOST TARGET binding site such as BINDING SITE I, BINDING SITE II or BINDING SITE III. Table 2 illustrates the complementarity of the nucleotide sequences of LOC143425 BINDING SITE, designated SEQ ID:42356, to the nucleotide sequence of VGAM2412 RNA, herein designated VGAM RNA, also designated SEQ ID:5123.

Another function of VGAM2412 is therefore inhibition of LOC143425 (Accession XM_113695). Accordingly, utilities of VGAM2412 include diagnosis, prevention and treatment of diseases and clinical conditions associated with LOC143425. LOC221540 (Accession XM_168133) is another VGAM2412 host target gene. LOC221540 BINDING SITE is HOST TARGET binding site found in the 3' untranslated region of mRNA encoded by LOC221540, corresponding to a HOST TARGET binding site such as BINDING SITE I, BINDING SITE II or BINDING SITE III. Table 2 illustrates the complementarity of the nucleotide sequences of LOC221540 BINDING SITE, designated SEQ ID:45046, to the nucleotide sequence of VGAM2412 RNA, herein designated VGAM RNA, also designated SEQ ID:5123.

Another function of VGAM2412 is therefore inhibition of LOC221540 (Accession XM_168133). Accordingly, utilities of VGAM2412 include diagnosis, prevention and treatment of diseases and clinical conditions associated with LOC221540. LOC257545 (Accession XM_175217) is another VGAM2412 host target gene. LOC257545 BINDING SITE is HOST TARGET binding site found in the 3' untranslated region of mRNA encoded by LOC257545, corresponding to a HOST TARGET binding site such as BINDING SITE I, BINDING SITE II or BINDING SITE III. Table 2 illustrates the complementarity of the nucleotide sequences of LOC257545 BINDING SITE, designated SEQ ID:46694, to the nucleotide sequence of VGAM2412 RNA, herein designated VGAM RNA, also designated SEQ ID:5123.

Another function of VGAM2412 is therefore inhibition of LOC257545 (Accession XM_175217). Accordingly, utilities of VGAM2412 include diagnosis, prevention and treatment of diseases and clinical conditions associated with LOC257545. LOC257598 (Accession XM_175295) is another VGAM2412 host target gene. LOC257598 BINDING SITE is HOST TARGET binding site found in the 3' untranslated region of mRNA encoded by LOC257598, corresponding to a HOST TARGET binding site such as BINDING SITE I, BINDING SITE II or BINDING SITE III. Table 2 illustrates the complementarity of the nucleotide sequences of LOC257598 BINDING SITE, designated SEQ ID:46751, to the nucleotide sequence of VGAM2412 RNA, herein designated VGAM RNA, also designated SEQ ID:5123.

Another function of VGAM2412 is therefore inhibition of LOC257598 (Accession XM_175295). Accordingly, utilities of VGAM2412 include diagnosis, prevention and treatment of diseases and clinical conditions associated with LOC257598. FIG. 1 further provides a conceptual description of a novel bioinformatically detected viral gene of the present invention, referred to here as Viral Genomic Address Messenger 2413 (VGAM2413) viral gene, which modulates expression of respective host target genes thereof, the function and utility of which host target genes is known in the art.

VGAM2413 is a novel bioinformatically detected regulatory, non protein coding, viral micro RNA (miRNA) gene. The method by which VGAM2413 was detected is described hereinabove with reference to FIGS. 1-8.

VGAM2413 gene, herein designated VGAM GENE, is a viral gene contained in the genome of Goatpox Virus. VGAM2413 host target gene, herein designated VGAM HOST TARGET GENE, is a human gene contained in the human genome.

VGAM2413 gene encodes a VGAM2413 precursor RNA, herein designated VGAM PRECURSOR RNA. Similar to other miRNA genes, and unlike most ordinary genes, VGAM2413 precursor RNA does not encode a protein. A nucleotide sequence identical or highly similar to the nucleotide sequence of VGAM2413 precursor RNA is designated SEQ ID:2399, and is provided hereinbelow with reference to the sequence listing part. Nucleotide sequence SEQ ID:2399 is located at position 77043 relative to the genome of Goatpox Virus.

VGAM2413 precursor RNA folds onto itself, forming VGAM2413 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2413 folded precursor RNA into VGAM2413 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2413 RNA is designated SEQ ID:5124, and is provided hereinbelow with reference to the sequence listing part.

VGAM2413 host target gene, herein designated VGAM HOST TARGET GENE, encodes a corresponding messenger RNA, VGAM2413 host target RNA, herein designated VGAM HOST TARGET RNA. VGAM2413 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2413 RNA, herein designated VGAM RNA, binds complementarily to one or more host target binding sites located in untranslated regions of VGAM2413 host target RNA, herein designated VGAM HOST TARGET RNA. This complementary binding is due to the fact that the nucleotide sequence of VGAM2413 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2413 RNA, herein designated VGAM RNA, may have a different number of host target binding sites in untranslated regions of a VGAM2413 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2413 RNA, herein designated VGAM RNA, to host target binding sites on VGAM2413 host target RNA, herein designated VGAM HOST TARGET RNA, such as BINDING SITE I, BINDING SITE II and BINDING SITE III, inhibits translation of VGAM2413 host target RNA into VGAM2413 host target protein, herein designated VGAM HOST TARGET PROTEIN. VGAM host target protein is therefore outlined by a broken line.

It is appreciated that VGAM2413 host target gene, herein designated VGAM HOST TARGET GENE, in fact represents a plurality of VGAM2413 host target genes. The mRNA of each one of this plurality of VGAM2413 host target genes comprises one or more host target binding sites, each having a nucleotide sequence which is at least partly complementary to VGAM2413 RNA, herein designated VGAM RNA, and which when bound by VGAM2413 RNA causes inhibition of translation of respective one or more VGAM2413 host target proteins.

It is further appreciated by one skilled in the art that the mode of translational inhibition illustrated by FIG. 1 with specific reference to translational inhibition exerted by VGAM2413 gene, herein designated VGAM GENE, on one or more VGAM2413 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2413 is inhibition of expression of host target genes, as part of a novel viral mechanism of attacking a host. Accordingly, utilities of VGAM2413 include diagnosis, prevention and treatment of viral infection by Goatpox Virus. Specific functions, and accordingly utilities, of VGAM2413 correlate with, and may be deduced from, the identity of the host target genes which VGAM2413 binds and inhibits, and the function of these host target genes, as elaborated hereinbelow.

Nucleotide sequences of the VGAM2413 precursor RNA, herein designated VGAM PRECURSOR RNA, and of the 'diced' VGAM2413 RNA, herein designated VGAM RNA, and a schematic representation of the secondary folding of VGAM2413 folded precursor RNA, herein designated VGAM FOLDED PRECURSOR RNA, of VGAM2413 are further described hereinbelow with reference to Table 1.

Nucleotide sequences of host target binding sites, such as BINDING SITE-I, BINDING SITE-II and BINDING SITE-III of FIG. 1, found on VGAM2413 host target RNA, and schematic representation of the complementarity of each of these host target binding sites to VGAM2413 RNA, herein designated VGAM RNA, are described hereinbelow with reference to Table 2.

As mentioned hereinabove with reference to FIG. 1, a function of VGAM2413 gene, herein designated VGAM is inhibition of expression of VGAM2413 target genes. It is appreciated that specific functions, and accordingly utilities, of VGAM2413 correlate with, and may be deduced from, the identity of the target genes which VGAM2413 binds and inhibits, and the function of these target genes, as elaborated hereinbelow.

KIAA1155 (Accession XM_030864) is a VGAM2413 host target gene. KIAA1155 BINDING SITE is HOST TARGET binding site found in the 3' untranslated region of mRNA encoded by KIAA1155, corresponding to a HOST TARGET binding site such as BINDING SITE I, BINDING SITE II or BINDING SITE III. Table 2 illustrates the complementarity of the nucleotide sequences of KIAA1155 BINDING SITE, designated SEQ ID:31197, to the nucleotide sequence of VGAM2413 RNA, herein designated VGAM RNA, also designated SEQ ID:5124.

A function of VGAM2413 is therefore inhibition of KIAA1155 (Accession XM_030864). Accordingly, utilities of VGAM2413 include diagnosis, prevention and treatment of diseases and clinical conditions associated with KIAA1155. FIG. 1 further provides a conceptual description of a novel bioinformatically detected viral gene of the present invention, referred to here as Viral Genomic Address Messenger 2414 (VGAM2414) viral gene, which modulates expression of respective host target genes thereof, the function and utility of which host target genes is known in the art.

VGAM2414 is a novel bioinformatically detected regulatory, non protein coding, viral micro RNA (miRNA) gene. The method by which VGAM2414 was detected is described hereinabove with reference to FIGS. 1-8.

VGAM2414 gene, herein designated VGAM GENE, is a viral gene contained in the genome of Goatpox Virus. VGAM2414 host target gene, herein designated VGAM HOST TARGET GENE, is a human gene contained in the human genome.

VGAM2414 gene encodes a VGAM2414 precursor RNA, herein designated VGAM PRECURSOR RNA. Similar to other miRNA genes, and unlike most ordinary genes, VGAM2414 precursor RNA does not encode a protein. A nucleotide sequence identical or highly similar to the nucleotide sequence of VGAM2414 precursor RNA is designated SEQ ID:2400, and is provided hereinbelow with reference to the sequence listing part. Nucleotide sequence SEQ ID:2400 is located at position 57820 relative to the genome of Goatpox Virus.

VGAM2414 precursor RNA folds onto itself, forming VGAM2414 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2414 folded precursor RNA into VGAM2414 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2414 RNA is designated SEQ ID:5125, and is provided hereinbelow with reference to the sequence listing part.

VGAM2414 host target gene, herein designated VGAM HOST TARGET GENE, encodes a corresponding messenger RNA, VGAM2414 host target RNA, herein designated VGAM HOST TARGET RNA. VGAM2414 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2414 RNA, herein designated VGAM RNA, binds complementarily to one or more host target binding sites located in untranslated regions of VGAM2414 host target RNA, herein designated VGAM HOST TARGET RNA. This complementary binding is due to the fact that the nucleotide sequence of VGAM2414 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2414 RNA, herein designated VGAM RNA, may have a different number of host target binding sites in untranslated regions of a VGAM2414 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2414 RNA, herein designated VGAM RNA, to host target binding sites on VGAM2414 host target RNA, herein designated VGAM HOST TARGET RNA, such as BINDING SITE I, BINDING SITE II and BINDING SITE III, inhibits translation of VGAM2414 host target RNA into VGAM2414 host target protein, herein designated VGAM HOST TARGET PROTEIN. VGAM host target protein is therefore outlined by a broken line.

It is appreciated that VGAM2414 host target gene, herein designated VGAM HOST TARGET GENE, in fact represents a plurality of VGAM2414 host target genes. The mRNA of each one of this plurality of VGAM2414 host target genes comprises one or more host target binding sites, each having a nucleotide sequence which is at least partly complementary to VGAM2414 RNA, herein designated VGAM RNA, and which when bound by VGAM2414 RNA causes inhibition of translation of respective one or more VGAM2414 host target proteins.

It is further appreciated by one skilled in the art that the mode of translational inhibition illustrated by FIG. 1 with specific reference to translational inhibition exerted by VGAM2414 gene, herein designated VGAM GENE, on one or more VGAM2414 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2414 is inhibition of expression of host target genes, as part of a novel viral mechanism of attacking a host. Accordingly, utilities of VGAM2414 include diagnosis, prevention and treatment of viral infection by Goatpox Virus. Specific functions, and accordingly utilities, of VGAM2414 correlate with, and may be deduced from, the identity of the host target genes which VGAM2414 binds and inhibits, and the function of these host target genes, as elaborated hereinbelow.

Nucleotide sequences of the VGAM2414 precursor RNA, herein designated VGAM PRECURSOR RNA, and of the 'diced' VGAM2414 RNA, herein designated VGAM RNA, and a schematic representation of the secondary folding of VGAM2414 folded precursor RNA, herein designated VGAM FOLDED PRECURSOR RNA, of VGAM2414 are further described hereinbelow with reference to Table 1.

Nucleotide sequences of host target binding sites, such as BINDING SITE-I, BINDING SITE-II and BINDING SITE-III of FIG. 1, found on VGAM2414 host target RNA, and schematic representation of the complementarity of each of these host target binding sites to VGAM2414 RNA, herein designated VGAM RNA, are described hereinbelow with reference to Table 2.

As mentioned hereinabove with reference to FIG. 1, a function of VGAM2414 gene, herein designated VGAM is inhibition of expression of VGAM2414 target genes. It is appreciated that specific functions, and accordingly utilities, of VGAM2414 correlate with, and may be deduced from, the identity of the target genes which VGAM2414 binds and inhibits, and the function of these target genes, as elaborated hereinbelow.

Mannosidase, Alpha, Class 2C, Member 1 (MAN2C1, Accession XM_053585) is a VGAM2414 host target gene. MAN2C1 BINDING SITE is HOST TARGET binding site found in the 5' untranslated region of mRNA encoded by MAN2C1, corresponding to a HOST TARGET binding site such as BINDING SITE I, BINDING SITE II or BINDING SITE III. Table 2 illustrates the complementarity of the nucleotide sequences of MAN2C1 BINDING SITE, designated SEQ ID:36101, to the nucleotide sequence of VGAM2414 RNA, herein designated VGAM RNA, also designated SEQ ID:5125.

A function of VGAM2414 is therefore inhibition of Mannosidase, Alpha, Class 2C, Member 1 (MAN2C1, Accession XM_053585), a gene which is Strongly similar to a region of rat ER alpha-mannosidase. Accordingly, utilities of VGAM2414 include diagnosis, prevention and treatment of diseases and clinical conditions associated with MAN2C1. The function of MAN2C1 and its association with various diseases and clinical conditions, has been established by previous studies, as described hereinabove with reference to VGAM958. Proprotein Convertase Subtilisin/kexin Type 2 (PCSK2, Accession NM_002594) is another VGAM2414 host target gene. PCSK2 BINDING SITE is HOST TARGET binding site found in the 3' untranslated region of mRNA encoded by PCSK2, corresponding to a HOST TARGET binding site such as BINDING SITE I, BINDING SITE II or BINDING SITE III. Table 2 illustrates the complementarity of the nucleotide sequences of PCSK2 BINDING SITE, designated SEQ ID:8455, to the nucleotide sequence of VGAM2414 RNA, herein designated VGAM RNA, also designated SEQ ID:5125.

Another function of VGAM2414 is therefore inhibition of Proprotein Convertase Subtilisin/kexin Type 2 (PCSK2, Accession NM_002594), a gene which is involved in the processing of hormone and other protein precursors at sites comprised of pairs of basic amino acid residues. Accordingly, utilities of VGAM2414 include diagnosis, prevention and treatment of diseases and clinical conditions associated with PCSK2. The function of PCSK2 and its association with various diseases and clinical conditions, has been established by previous studies, as described hereinabove with reference to VGAM1120. Phosphorylase Kinase, Alpha 2 (liver) (PHKA2, Accession NM_000292) is another VGAM2414 host target gene. PHKA2 BINDING SITE is HOST TARGET binding site found in the 3' untranslated region of mRNA encoded by PHKA2, corresponding to a HOST TARGET binding site such as BINDING SITE I, BINDING SITE II or BINDING SITE III. Table 2 illustrates the complementarity of the nucleotide sequences of PHKA2 BINDING SITE, designated SEQ ID:5835, to the nucleotide sequence of VGAM2414 RNA, herein designated VGAM RNA, also designated SEQ ID:5125.

Another function of VGAM2414 is therefore inhibition of Phosphorylase Kinase, Alpha 2 (liver) (PHKA2, Accession NM_000292). Accordingly, utilities of VGAM2414 include diagnosis, prevention and treatment of diseases and clinical conditions associated with PHKA2. KIAA1458 (Accession XM_044434) is another VGAM2414 host target gene. KIAA1458 BINDING SITE is HOST TARGET binding site found in the 3' untranslated region of mRNA encoded by KIAA1458, corresponding to a HOST TARGET binding site such as BINDING SITE I, BINDING SITE II or BINDING SITE III. Table 2 illustrates the complementarity of the nucleotide sequences of KIAA1458 BINDING SITE, designated SEQ ID:34208, to the nucleotide sequence of VGAM2414 RNA, herein designated VGAM RNA, also designated SEQ ID:5125.

Another function of VGAM2414 is therefore inhibition of KIAA1458 (Accession XM_044434). Accordingly, utilities of VGAM2414 include diagnosis, prevention and treatment of diseases and clinical conditions associated with KIAA1458. Rabip4R (Accession NM_017987) is another VGAM2414 host target gene. Rabip4R BINDING SITE is HOST TARGET binding site found in the 3' untranslated region of mRNA encoded by Rabip4R, corresponding to a HOST TARGET binding site such as BINDING SITE I, BINDING SITE II or BINDING SITE III. Table 2 illustrates the complementarity of the nucleotide sequences of Rabip4R BINDING SITE, designated SEQ ID:19715, to the nucleotide sequence of VGAM2414 RNA, herein designated VGAM RNA, also designated SEQ ID:5125.

Another function of VGAM2414 is therefore inhibition of Rabip4R (Accession NM_017987). Accordingly, utilities of VGAM2414 include diagnosis, prevention and treatment of diseases and clinical conditions associated with Rabip4R. Sulfotransferase Family 4A, Member 1 (SULT4A1, Accession XM_043609) is another VGAM2414 host target gene. SULT4A1 BINDING SITE is HOST TARGET binding site found in the 3' untranslated region of mRNA encoded by SULT4A1, corresponding to a HOST TARGET binding site such as BINDING SITE I, BINDING SITE II or BINDING SITE III. Table 2 illustrates the complementarity of the nucleotide sequences of SULT4A1 BINDING SITE, designated SEQ ID:33974, to the nucleotide sequence of VGAM2414 RNA, herein designated VGAM RNA, also designated SEQ ID:5125.

Another function of VGAM2414 is therefore inhibition of Sulfotransferase Family 4A, Member 1 (SULT4A1, Accession XM_043609). Accordingly, utilities of VGAM2414 include diagnosis, prevention and treatment of diseases and clinical conditions associated with SULT4A1. LOC146958 (Accession XM_097142) is another VGAM2414 host target gene. LOC146958 BINDING SITE is HOST TARGET binding site found in the 5' untranslated region of mRNA encoded by LOC146958, corresponding to a HOST TARGET binding site such as BINDING SITE I, BINDING SITE II or BINDING SITE III. Table 2 illustrates the complementarity of the nucleotide sequences of LOC146958 BINDING SITE, designated SEQ ID:40773, to the nucleotide sequence of VGAM2414 RNA, herein designated VGAM RNA, also designated SEQ ID:5125.

Another function of VGAM2414 is therefore inhibition of LOC146958 (Accession XM_097142). Accordingly, utilities of VGAM2414 include diagnosis, prevention and treatment of diseases and clinical conditions associated with LOC146958. LOC257443 (Accession XM_171072) is another VGAM2414 host target gene. LOC257443 BINDING SITE is HOST TARGET binding site found in the 3' untranslated region of mRNA encoded by LOC257443, corresponding to a HOST TARGET binding site such as BINDING SITE I, BINDING SITE II or BINDING SITE III. Table 2 illustrates the complementarity of the nucleotide sequences of LOC257443 BINDING SITE, designated SEQ ID:45876, to the nucleotide sequence of VGAM2414 RNA, herein designated VGAM RNA, also designated SEQ ID:5125.

Another function of VGAM2414 is therefore inhibition of LOC257443 (Accession XM_171072). Accordingly, utilities of VGAM2414 include diagnosis, prevention and treatment of diseases and clinical conditions associated with LOC257443. LOC90643 (Accession XM_033145) is another VGAM2414 host target gene. LOC90643 BINDING SITE is HOST TARGET binding site found in the 3' untranslated region of mRNA encoded by LOC90643, corresponding to a HOST TARGET binding site such as BINDING SITE I, BINDING SITE II or BINDING SITE III. Table 2 illustrates the complementarity of the nucleotide sequences of LOC90643 BINDING SITE, designated SEQ ID:31854, to the nucleotide sequence of VGAM2414 RNA, herein designated VGAM RNA, also designated SEQ ID:5125.

Another function of VGAM2414 is therefore inhibition of LOC90643 (Accession XM_033145). Accordingly, utilities of VGAM2414 include diagnosis, prevention and treatment of diseases and clinical conditions associated with LOC90643. FIG. 1 further provides a conceptual description of a novel bioinformatically detected viral gene of the present invention, referred to here as Viral Genomic Address Messenger 2415 (VGAM2415) viral gene, which modulates expression of respective host target genes thereof, the function and utility of which host target genes is known in the art.

VGAM2415 is a novel bioinformatically detected regulatory, non protein coding, viral micro RNA (miRNA) gene. The method by which VGAM2415 was detected is described hereinabove with reference to FIGS. 1-8.

VGAM2415 gene, herein designated VGAM GENE, is a viral gene contained in the genome of Goatpox Virus. VGAM2415 host target gene, herein designated VGAM HOST TARGET GENE, is a human gene contained in the human genome.

VGAM2415 gene encodes a VGAM2415 precursor RNA, herein designated VGAM PRECURSOR RNA. Similar to other miRNA genes, and unlike most ordinary genes, VGAM2415 precursor RNA does not encode a protein. A nucleotide sequence identical or highly similar to the nucleotide sequence of VGAM2415 precursor RNA is designated SEQ ID:2401, and is provided hereinbelow with reference to the sequence listing part. Nucleotide sequence SEQ ID:2401 is located at position 96068 relative to the genome of Goatpox Virus.

VGAM2415 precursor RNA folds onto itself, forming VGAM2415 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2415 folded precursor RNA into VGAM2415 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2415 RNA is designated SEQ ID:5126, and is provided hereinbelow with reference to the sequence listing part.

VGAM2415 host target gene, herein designated VGAM HOST TARGET GENE, encodes a corresponding messenger RNA, VGAM2415 host target RNA, herein designated VGAM HOST TARGET RNA. VGAM2415 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2415 RNA, herein designated VGAM RNA, binds complementarily to one or more host target binding sites located in untranslated regions of VGAM2415 host target RNA, herein designated VGAM HOST TARGET RNA. This complementary binding is due to the fact that the nucleotide sequence of VGAM2415 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2415 RNA, herein designated VGAM RNA, may have a different number of host target binding sites in untranslated regions of a VGAM2415 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2415 RNA, herein designated VGAM RNA, to host target binding sites on VGAM2415 host target RNA, herein designated VGAM HOST TARGET RNA, such as BINDING SITE I, BINDING SITE II and BINDING SITE III, inhibits translation of VGAM2415 host target RNA into VGAM2415 host target protein, herein designated VGAM HOST TARGET PROTEIN. VGAM host target protein is therefore outlined by a broken line.

It is appreciated that VGAM2415 host target gene, herein designated VGAM HOST TARGET GENE, in fact represents a plurality of VGAM2415 host target genes. The mRNA of each one of this plurality of VGAM2415 host target genes comprises one or more host target binding sites, each having a nucleotide sequence which is at least partly complementary to VGAM2415 RNA, herein designated VGAM RNA, and which when bound by VGAM2415 RNA causes inhibition of translation of respective one or more VGAM2415 host target proteins.

It is further appreciated by one skilled in the art that the mode of translational inhibition illustrated by FIG. 1 with specific reference to translational inhibition exerted by VGAM2415 gene, herein designated VGAM GENE, on one or more VGAM2415 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2415 is inhibition of expression of host target genes, as part of a novel viral mechanism of attacking a host. Accordingly, utilities of VGAM2415 include diagnosis, prevention and treatment of viral infection by Goatpox Virus. Specific functions, and accordingly utilities, of VGAM2415 correlate with, and may be deduced from, the identity of the host target genes which VGAM2415 binds and inhibits, and the function of these host target genes, as elaborated hereinbelow.

Nucleotide sequences of the VGAM2415 precursor RNA, herein designated VGAM PRECURSOR RNA, and of the 'diced' VGAM2415 RNA, herein designated VGAM RNA, and a schematic representation of the secondary folding of VGAM2415 folded precursor RNA, herein designated VGAM FOLDED PRECURSOR RNA, of VGAM2415 are further described hereinbelow with reference to Table 1.

Nucleotide sequences of host target binding sites, such as BINDING SITE-I, BINDING SITE-II and BINDING SITE-III of FIG. 1, found on VGAM2415 host target RNA, and schematic representation of the complementarity of each of these host target binding sites to VGAM2415 RNA, herein designated VGAM RNA, are described hereinbelow with reference to Table 2.

As mentioned hereinabove with reference to FIG. 1, a function of VGAM2415 gene, herein designated VGAM is inhibition of expression of VGAM2415 target genes. It is appreciated that specific functions, and accordingly utilities, of VGAM2415 correlate with, and may be deduced from, the identity of the target genes which VGAM2415 binds and inhibits, and the function of these target genes, as elaborated hereinbelow.

LanC Lantibiotic Synthetase Component C-like 2 (bacterial) (LANCL2, Accession NM_018697) is a VGAM2415 host target gene. LANCL2 BINDING SITE is HOST TARGET binding site found in the 3' untranslated region of mRNA encoded by LANCL2, corresponding to a HOST TARGET binding site such as BINDING SITE I, BINDING SITE II or BINDING SITE III. Table 2 illustrates the complementarity of the nucleotide sequences of LANCL2 BINDING SITE, designated SEQ ID:20779, to the nucleotide sequence of VGAM2415 RNA, herein designated VGAM RNA, also designated SEQ ID:5126.

A function of VGAM2415 is therefore inhibition of LanC Lantibiotic Synthetase Component C-like 2 (bacterial) (LANCL2, Accession NM_018697). Accordingly, utilities of VGAM2415 include diagnosis, prevention and treatment of diseases and clinical conditions associated with LANCL2. Makorin, Ring Finger Protein, 1 (MKRN1, Accession NM_013446) is another VGAM2415 host target gene. MKRN1 BINDING SITE is HOST TARGET binding site found in the 3' untranslated region of mRNA encoded by MKRN1, corresponding to a HOST TARGET binding site such as BINDING SITE I, BINDING SITE II or BINDING SITE III. Table 2 illustrates the complementarity of the nucleotide sequences of MKRN1 BINDING SITE, designated SEQ ID:15114, to the nucleotide sequence of VGAM2415 RNA, herein designated VGAM RNA, also designated SEQ ID:5126.

Another function of VGAM2415 is therefore inhibition of Makorin, Ring Finger Protein, 1 (MKRN1, Accession NM_013446). Accordingly, utilities of VGAM2415 include diagnosis, prevention and treatment of diseases and clinical conditions associated with MKRN1. RTP801 (Accession NM_019058) is another VGAM2415 host target gene. RTP801 BINDING SITE is HOST TARGET binding site found in the 3' untranslated region of mRNA encoded by RTP801, corresponding to a HOST TARGET binding site such as BINDING SITE I, BINDING SITE II or BINDING SITE III. Table 2 illustrates the complementarity of the nucleotide sequences of RTP801 BINDING SITE, designated SEQ ID:21140, to the nucleotide sequence of VGAM2415 RNA, herein designated VGAM RNA, also designated SEQ ID:5126.

Another function of VGAM2415 is therefore inhibition of RTP801 (Accession NM_019058). Accordingly, utilities of VGAM2415 include diagnosis, prevention and treatment of diseases and clinical conditions associated with RTP801. LOC158450 (Accession XM_088580) is another VGAM2415 host target gene. LOC158450 BINDING SITE is HOST TARGET binding site found in the 5' untranslated region of mRNA encoded by LOC158450, corresponding to a HOST TARGET binding site such as BINDING SITE I, BINDING SITE II or BINDING SITE III. Table 2 illustrates the complementarity of the nucleotide sequences of LOC158450 BINDING SITE, designated SEQ ID:39843, to the nucleotide sequence of VGAM2415 RNA, herein designated VGAM RNA, also designated SEQ ID:5126.

Another function of VGAM2415 is therefore inhibition of LOC158450 (Accession XM_088580). Accordingly, utilities of VGAM2415 include diagnosis, prevention and treatment of diseases and clinical conditions associated with LOC158450. LOC158504 (Accession XM_088591) is another VGAM2415 host target gene. LOC158504 BINDING SITE is HOST TARGET binding site found in the 5' untranslated region of mRNA encoded by LOC158504, corresponding to a HOST TARGET binding site such as BINDING SITE I, BINDING SITE II or BINDING SITE III. Table 2 illustrates the complementarity of the nucleotide sequences of LOC158504 BINDING SITE, designated SEQ ID:39854, to the nucleotide sequence of VGAM2415 RNA, herein designated VGAM RNA, also designated SEQ ID:5126.

Another function of VGAM2415 is therefore inhibition of LOC158504 (Accession XM_088591). Accordingly, utilities of VGAM2415 include diagnosis, prevention and treatment of diseases and clinical conditions associated with LOC158504. LOC253613 (Accession XM_171225) is another VGAM2415 host target gene. LOC253613 BINDING SITE is HOST TARGET binding site found in the 3' untranslated region of mRNA encoded by LOC253613, corresponding to a HOST TARGET binding site such as BINDING SITE I, BINDING SITE II or BINDING SITE III. Table 2 illustrates the complementarity of the nucleotide sequences of LOC253613 BINDING SITE, designated SEQ ID:46011, to the nucleotide sequence of VGAM2415 RNA, herein designated VGAM RNA, also designated SEQ ID:5126.

Another function of VGAM2415 is therefore inhibition of LOC253613 (Accession XM_171225). Accordingly, utilities of VGAM2415 include diagnosis, prevention and treatment of diseases and clinical conditions associated with LOC253613. FIG. 1 further provides a conceptual description of a novel bioinformatically detected viral gene of the present invention, referred to here as Viral Genomic Address Messenger 2416 (VGAM2416) viral gene, which modulates expression of respective host target genes thereof, the function and utility of which host target genes is known in the art.

VGAM2416 is a novel bioinformatically detected regulatory, non protein coding, viral micro RNA (miRNA) gene. The method by which VGAM2416 was detected is described hereinabove with reference to FIGS. 1-8.

VGAM2416 gene, herein designated VGAM GENE, is a viral gene contained in the genome of Goatpox Virus. VGAM2416 host target gene, herein designated VGAM HOST TARGET GENE, is a human gene contained in the human genome.

VGAM2416 gene encodes a VGAM2416 precursor RNA, herein designated VGAM PRECURSOR RNA. Similar to other miRNA genes, and unlike most ordinary genes, VGAM2416 precursor RNA does not encode a protein. A nucleotide sequence identical or highly similar to the nucleotide sequence of VGAM2416 precursor RNA is designated SEQ ID:2402, and is provided hereinbelow with reference to the sequence listing part. Nucleotide sequence SEQ ID:2402 is located at position 126030 relative to the genome of Goatpox Virus.

VGAM2416 precursor RNA folds onto itself, forming VGAM2416 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2416 folded precursor RNA into VGAM2416 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2416 RNA is designated SEQ ID:5127, and is provided hereinbelow with reference to the sequence listing part.

VGAM2416 host target gene, herein designated VGAM HOST TARGET GENE, encodes a corresponding messenger RNA, VGAM2416 host target RNA, herein designated VGAM HOST TARGET RNA. VGAM2416 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2416 RNA, herein designated VGAM RNA, binds complementarily to one or more host target binding sites located in untranslated regions of VGAM2416 host target RNA, herein designated VGAM HOST TARGET RNA. This complementary binding is due to the fact that the nucleotide sequence of VGAM2416 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2416 RNA, herein designated VGAM RNA, may have a different number of host target binding sites in untranslated regions of a VGAM2416 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2416 RNA, herein designated VGAM RNA, to host target binding sites on VGAM2416 host target RNA, herein designated VGAM HOST TARGET RNA, such as BINDING SITE I, BINDING SITE II and BINDING SITE III, inhibits translation of VGAM2416 host target RNA into VGAM2416 host target protein, herein designated VGAM HOST TARGET PROTEIN. VGAM host target protein is therefore outlined by a broken line.

It is appreciated that VGAM2416 host target gene, herein designated VGAM HOST TARGET GENE, in fact represents a plurality of VGAM2416 host target genes. The mRNA of each one of this plurality of VGAM2416 host target genes comprises one or more host target binding sites, each having a nucleotide sequence which is at least partly complementary to VGAM2416 RNA, herein designated VGAM RNA, and which when bound by VGAM2416 RNA causes inhibition of translation of respective one or more VGAM2416 host target proteins.

It is further appreciated by one skilled in the art that the mode of translational inhibition illustrated by FIG. 1 with specific reference to translational inhibition exerted by VGAM2416 gene, herein designated VGAM GENE, on one or more VGAM2416 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2416 is inhibition of expression of host target genes, as part of a novel viral mechanism of attacking a host. Accordingly, utilities of VGAM2416 include diagnosis, prevention and treatment of viral infection by Goatpox Virus. Specific functions, and accordingly utilities, of VGAM2416 correlate with, and may be deduced from, the identity of the host target genes which VGAM2416 binds and inhibits, and the function of these host target genes, as elaborated hereinbelow.

Nucleotide sequences of the VGAM2416 precursor RNA, herein designated VGAM PRECURSOR RNA, and of the 'diced' VGAM2416 RNA, herein designated VGAM RNA, and a schematic representation of the secondary folding of VGAM2416 folded precursor RNA, herein designated VGAM FOLDED PRECURSOR RNA, of VGAM2416 are further described hereinbelow with reference to Table 1.

Nucleotide sequences of host target binding sites, such as BINDING SITE-I, BINDING SITE-II and BINDING SITE-III of FIG. 1, found on VGAM2416 host target RNA, and schematic representation of the complementarity of each of these host target binding sites to VGAM2416 RNA, herein designated VGAM RNA, are described hereinbelow with reference to Table 2.

As mentioned hereinabove with reference to FIG. 1, a function of VGAM2416 gene, herein designated VGAM is inhibition of expression of VGAM2416 target genes. It is appreciated that specific functions, and accordingly utilities, of VGAM2416 correlate with, and may be deduced from, the identity of the target genes which VGAM2416 binds and inhibits, and the function of these target genes, as elaborated hereinbelow.

Core-binding Factor, Beta Subunit (CBFB, Accession NM_001755) is a VGAM2416 host target gene. CBFB BINDING SITE1 and CBFB BINDING SITE2 are HOST TARGET binding sites found in untranslated regions of mRNA encoded by CBFB, corresponding to HOST TARGET binding sites such as BINDING SITE I, BINDING SITE II or BINDING SITE III. Table 2 illustrates the complementarity of the nucleotide sequences of CBFB BINDING SITE1 and CBFB BINDING SITE2, designated SEQ ID:7509 and SEQ ID:23150 respectively, to the nucleotide sequence of VGAM2416 RNA, herein designated VGAM RNA, also designated SEQ ID:5127.

A function of VGAM2416 is therefore inhibition of Core-binding Factor, Beta Subunit (CBFB, Accession NM_001755), a gene which is beta subunit of the transcription factor CBF which causes leukemia. Accordingly, utilities of VGAM2416 include diagnosis, prevention and treatment of diseases and clinical conditions associated with CBFB. The function of CBFB and its association with various diseases and clinical conditions, has been established by previous studies, as described hereinabove with reference to VGAM98. Secreted Frizzled-related Protein 1 (SFRP1, Accession NM_003012) is another VGAM2416 host target gene. SFRP1 BINDING SITE is HOST TARGET binding site found in the 3' untranslated region of mRNA encoded by SFRP1, corresponding to a HOST TARGET binding site such as BINDING SITE I, BINDING SITE II or BINDING SITE III. Table 2 illustrates the complementarity of the nucleotide sequences of SFRP1 BINDING SITE, designated SEQ ID:8925, to the nucleotide sequence of VGAM2416 RNA, herein designated VGAM RNA, also designated SEQ ID:5127.

Another function of VGAM2416 is therefore inhibition of Secreted Frizzled-related Protein 1 (SFRP1, Accession NM_003012), a gene which is a receptor for wnt proteins that may have an anti-apoptotic function. Accordingly, utilities of VGAM2416 include diagnosis, prevention and treatment of diseases and clinical conditions associated with SFRP1. The function of SFRP1 and its association with various diseases and clinical conditions, has been established by previous studies, as described hereinabove with reference to VGAM250. Synaptotagmin IV (SYT4, Accession XM_031162) is another VGAM2416 host target gene. SYT4 BINDING SITE is HOST TARGET binding site found in the 3' untranslated region of mRNA encoded by SYT4, corresponding to a HOST TARGET binding site such as BINDING SITE I, BINDING SITE II or BINDING SITE III. Table 2 illustrates the complementarity of the nucleotide sequences of SYT4 BINDING SITE, designated SEQ ID:31294, to the nucleotide sequence of VGAM2416 RNA, herein designated VGAM RNA, also designated SEQ ID:5127.

Another function of VGAM2416 is therefore inhibition of Synaptotagmin IV (SYT4, Accession XM_031162), a gene which may be involved in ca2+-dependent exocytosis of secretory vesicles or may serve as ca2+ sensors in the process of vesicular trafficking and exocytosis. Accordingly, utilities of VGAM2416 include diagnosis, prevention and treatment of diseases and clinical conditions associated with SYT4. The function of SYT4 and its association with various diseases and clinical conditions, has been established by previous studies, as described hereinabove with reference to VGAM200. Transient Receptor Potential Cation Channel, Subfamily C, Member 5 (TRPC5, Accession NM_012471) is another VGAM2416 host target gene. TRPC5 BINDING SITE is HOST TARGET binding site found in the 3' untranslated region of mRNA encoded by TRPC5, corresponding to a HOST TARGET binding site such as BINDING SITE I, BINDING SITE II or BINDING SITE III. Table 2 illustrates the complementarity of the nucleotide sequences of TRPC5 BINDING SITE, designated SEQ ID:14852, to the nucleotide sequence of VGAM2416 RNA, herein designated VGAM RNA, also designated SEQ ID:5127.

Another function of VGAM2416 is therefore inhibition of Transient Receptor Potential Cation Channel, Subfamily C, Member 5 (TRPC5, Accession NM_012471). Accordingly, utilities of VGAM2416 include diagnosis, prevention and treatment of diseases and clinical conditions associated with TRPC5. MIG2 (Accession XM_051693) is another VGAM2416 host target gene. MIG2 BINDING SITE is HOST TARGET binding site found in the 3' untranslated region of mRNA encoded by MIG2, corresponding to a HOST TARGET binding site such as BINDING SITE I, BINDING SITE II or BINDING SITE III. Table 2 illustrates the complementarity of the nucleotide sequences of MIG2 BINDING SITE, designated SEQ ID:35864, to the nucleotide sequence of VGAM2416 RNA, herein designated VGAM RNA, also designated SEQ ID:5127.

Another function of VGAM2416 is therefore inhibition of MIG2 (Accession XM_051693). Accordingly, utilities of VGAM2416 include diagnosis, prevention and treatment of diseases and clinical conditions associated with MIG2. Nudix (nucleoside diphosphate linked moiety X)-type Motif 4 (NUDT4, Accession NM_019094) is another VGAM2416 host target gene. NUDT4 BINDING SITE is HOST TARGET binding site found in the 3' untranslated region of mRNA encoded by NUDT4, corresponding to a HOST TARGET binding site such as BINDING SITE I, BINDING SITE II or BINDING SITE III. Table 2 illustrates the complementarity of the nucleotide sequences of NUDT4 BINDING SITE, designated SEQ ID:21170, to the nucleotide sequence of VGAM2416 RNA, herein designated VGAM RNA, also designated SEQ ID:5127.

Another function of VGAM2416 is therefore inhibition of Nudix (nucleoside diphosphate linked moiety X)-type Motif 4 (NUDT4, Accession NM_019094). Accordingly, utilities of VGAM2416 include diagnosis, prevention and treatment of diseases and clinical conditions associated with NUDT4. PRO2012 (Accession NM_018614) is another VGAM2416 host target gene. PRO2012 BINDING SITE is HOST TARGET binding site found in the 5' untranslated region of mRNA encoded by PRO2012, corresponding to a HOST TARGET binding site such as BINDING SITE I, BINDING SITE II or BINDING SITE III. Table 2 illustrates the complementarity of the nucleotide sequences of PRO2012 BINDING SITE, designated SEQ ID:20682, to the nucleotide sequence of VGAM2416 RNA, herein designated VGAM RNA, also designated SEQ ID:5127.

Another function of VGAM2416 is therefore inhibition of PRO2012 (Accession NM_018614). Accordingly, utilities of VGAM2416 include diagnosis, prevention and treatment of diseases and clinical conditions associated with PRO2012. Synovial Sarcoma Translocation Gene On Chromosome 18-like 1 (SS18L1, Accession XM_037202) is another VGAM2416 host target gene. SS18L1 BINDING SITE is HOST TARGET binding site found in the 3' untranslated region of mRNA encoded by SS18L1, corresponding to a HOST TARGET binding site such as BINDING SITE I, BINDING SITE II or BINDING SITE III. Table 2 illustrates the complementarity of the nucleotide sequences of SS18L1 BINDING SITE, designated SEQ ID:32566, to the nucleotide sequence of VGAM2416 RNA, herein designated VGAM RNA, also designated SEQ ID:5127.

Another function of VGAM2416 is therefore inhibition of Synovial Sarcoma Translocation Gene On Chromosome 18-like 1 (SS18L1, Accession XM_037202). Accordingly, utilities of VGAM2416 include diagnosis, prevention and treatment of diseases and clinical conditions associated with SS18L1. Signal Transducing Adaptor Molecule (SH3 domain and ITAM motif) 2 (STAM2, Accession NM_005843) is another VGAM2416 host target gene. STAM2 BINDING SITE is HOST TARGET binding site found in the 3' untranslated region of mRNA encoded by STAM2, corresponding to a HOST TARGET binding site such as BINDING SITE I, BINDING SITE II or BINDING SITE III. Table 2 illustrates the complementarity of the nucleotide sequences of STAM2 BINDING SITE, designated SEQ ID:12461, to the nucleotide sequence of VGAM2416 RNA, herein designated VGAM RNA, also designated SEQ ID:5127.

Another function of VGAM2416 is therefore inhibition of Signal Transducing Adaptor Molecule (SH3 domain and ITAM motif) 2 (STAM2, Accession NM_005843). Accordingly, utilities of VGAM2416 include diagnosis, prevention and treatment of diseases and clinical conditions associated with STAM2. LOC139221 (Accession XM_066558) is another VGAM2416 host target gene. LOC139221 BINDING SITE is HOST TARGET binding site found in the 3' untranslated region of mRNA encoded by LOC139221, corresponding to a HOST TARGET binding site such as BINDING SITE I, BINDING SITE II or BINDING SITE III. Table 2 illustrates the complementarity of the nucleotide sequences of LOC139221 BINDING SITE, designated SEQ ID:37334, to the nucleotide sequence of VGAM2416 RNA, herein designated VGAM RNA, also designated SEQ ID:5127.

Another function of VGAM2416 is therefore inhibition of LOC139221 (Accession XM_066558). Accordingly, utilities of VGAM2416 include diagnosis, prevention and treatment of diseases and clinical conditions associated with LOC139221. LOC161734 (Accession XM_102109) is another VGAM2416 host target gene. LOC161734 BINDING SITE is HOST TARGET binding site found in the 3' untranslated region of mRNA encoded by LOC161734, corresponding to a HOST TARGET binding site such as BINDING SITE I, BINDING SITE II or BINDING SITE III. Table 2 illustrates the complementarity of the nucleotide sequences of LOC161734 BINDING SITE, designated SEQ ID:42111, to the nucleotide sequence of VGAM2416 RNA, herein designated VGAM RNA, also designated SEQ ID:5127.

Another function of VGAM2416 is therefore inhibition of LOC161734 (Accession XM_102109). Accordingly, utilities of VGAM2416 include diagnosis, prevention and treatment of diseases and clinical conditions associated with LOC161734. FIG. 1 further provides a conceptual description of a novel bioinformatically detected viral gene of the present invention, referred to here as Viral Genomic Address Messenger 2417 (VGAM2417) viral gene, which modulates expression of respective host target genes thereof, the function and utility of which host target genes is known in the art.

VGAM2417 is a novel bioinformatically detected regulatory, non protein coding, viral micro RNA (miRNA) gene. The method by which VGAM2417 was detected is described hereinabove with reference to FIGS. 1-8.

VGAM2417 gene, herein designated VGAM GENE, is a viral gene contained in the genome of Goatpox Virus. VGAM2417 host target gene, herein designated VGAM HOST TARGET GENE, is a human gene contained in the human genome.

VGAM2417 gene encodes a VGAM2417 precursor RNA, herein designated VGAM PRECURSOR RNA. Similar to other miRNA genes, and unlike most ordinary genes, VGAM2417 precursor RNA does not encode a protein. A nucleotide sequence identical or highly similar to the nucleotide sequence of VGAM2417 precursor RNA is designated SEQ ID:2403, and is provided hereinbelow with reference to the sequence listing part. Nucleotide sequence SEQ ID:2403 is located at position 96899 relative to the genome of Goatpox Virus.

VGAM2417 precursor RNA folds onto itself, forming VGAM2417 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2417 folded precursor RNA into VGAM2417 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2417 RNA is designated SEQ ID:5128, and is provided hereinbelow with reference to the sequence listing part.

VGAM2417 host target gene, herein designated VGAM HOST TARGET GENE, encodes a corresponding messenger RNA, VGAM2417 host target RNA, herein designated VGAM HOST TARGET RNA. VGAM2417 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2417 RNA, herein designated VGAM RNA, binds complementarily to one or more host target binding sites located in untranslated regions of VGAM2417 host target RNA, herein designated VGAM HOST TARGET RNA. This complementary binding is due to the fact that the nucleotide sequence of VGAM2417 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2417 RNA, herein designated VGAM RNA, may have a different number of host target binding sites in untranslated regions of a VGAM2417 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2417 RNA, herein designated VGAM RNA, to host target binding sites on VGAM2417 host target RNA, herein designated VGAM HOST TARGET RNA, such as BINDING SITE I, BINDING SITE II and BINDING SITE III, inhibits translation of VGAM2417 host target RNA into VGAM2417 host target protein, herein designated VGAM HOST TARGET PROTEIN. VGAM host target protein is therefore outlined by a broken line.

It is appreciated that VGAM2417 host target gene, herein designated VGAM HOST TARGET GENE, in fact represents a plurality of VGAM2417 host target genes. The mRNA of each one of this plurality of VGAM2417 host target genes comprises one or more host target binding sites, each having a nucleotide sequence which is at least partly complementary to VGAM2417 RNA, herein designated VGAM RNA, and which when bound by VGAM2417 RNA causes inhibition of translation of respective one or more VGAM2417 host target proteins.

It is further appreciated by one skilled in the art that the mode of translational inhibition illustrated by FIG. 1 with specific reference to translational inhibition exerted by VGAM2417 gene, herein designated VGAM GENE, on one or more VGAM2417 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2417 is inhibition of expression of host target genes, as part of a novel viral mechanism of attacking a host. Accordingly, utilities of VGAM2417 include diagnosis, prevention and treatment of viral infection by Goatpox Virus. Specific functions, and accordingly utilities, of VGAM2417 correlate with, and may be deduced from, the identity of the host target genes which VGAM2417 binds and inhibits, and the function of these host target genes, as elaborated hereinbelow.

Nucleotide sequences of the VGAM2417 precursor RNA, herein designated VGAM PRECURSOR RNA, and of the 'diced' VGAM2417 RNA, herein designated VGAM RNA, and a schematic representation of the secondary folding of VGAM2417 folded precursor RNA, herein designated VGAM FOLDED PRECURSOR RNA, of VGAM2417 are further described hereinbelow with reference to Table 1.

Nucleotide sequences of host target binding sites, such as BINDING SITE-I, BINDING SITE-II and BINDING SITE-III of FIG. 1, found on VGAM2417 host target RNA, and schematic representation of the complementarity of each of these host target binding sites to VGAM2417 RNA, herein designated VGAM RNA, are described hereinbelow with reference to Table 2.

As mentioned hereinabove with reference to FIG. 1, a function of VGAM2417 gene, herein designated VGAM is inhibition of expression of VGAM2417 target genes. It is appreciated that specific functions, and accordingly utilities, of VGAM2417 correlate with, and may be deduced from, the identity of the target genes which VGAM2417 binds and inhibits, and the function of these target genes, as elaborated hereinbelow.

Cyclin D1 (PRAD1: parathyroid adenomatosis 1) (CCND1, Accession NM_053056) is a VGAM2417 host target gene. CCND1 BINDING SITE is HOST TARGET binding site found in the 3' untranslated region of mRNA encoded by CCND1, corresponding to a HOST TARGET binding site such as BINDING SITE I, BINDING SITE II or BINDING SITE III. Table 2 illustrates the complementarity of the nucleotide sequences of CCND1 BINDING SITE, designated SEQ ID:27601, to the nucleotide sequence of VGAM2417 RNA, herein designated VGAM RNA, also designated SEQ ID:5128.

A function of VGAM2417 is therefore inhibition of Cyclin D1 (PRAD1: parathyroid adenomatosis 1) (CCND1, Accession NM_053056), a gene which is involved in the control of cell cycle and is required for Schwann cell proliferation to proceed normally during Wallerian degeneration. Accordingly, utilities of VGAM2417 include diagnosis, prevention and treatment of diseases and clinical conditions associated with CCND1. The function of CCND1 and its association with various diseases and clinical conditions, has been established by previous studies, as described hereinabove with reference to VGAM220. CD164 Antigen, Sialomucin (CD164, Accession NM_006016) is another VGAM2417 host target gene. CD164 BINDING SITE is HOST TARGET binding site found in the 3' untranslated region of mRNA encoded by CD164, corresponding to a HOST TARGET binding site such as BINDING SITE I, BINDING SITE II or BINDING SITE III. Table 2 illustrates the complementarity of the nucleotide sequences of CD164 BINDING SITE, designated SEQ ID:12629, to the nucleotide sequence of VGAM2417 RNA, herein designated VGAM RNA, also designated SEQ ID:5128.

Another function of VGAM2417 is therefore inhibition of CD164 Antigen, Sialomucin (CD164, Accession NM_006016), a gene which plays a role in hematopoiesis by facilitating the adhesion of CD34+ cells to bone marrow stroma and negatively regulates CD34+ hematopoietic progenitor cell growth. Accordingly, utilities of VGAM2417 include diagnosis, prevention and treatment of diseases and clinical conditions associated with CD164. The function of CD164 and its association with various diseases and clinical conditions, has been established by previous studies, as described hereinabove with reference to VGAM75. Crystallin, Zeta (quinone reductase) (CRYZ, Accession NM_001889) is another VGAM2417 host target gene. CRYZ BINDING SITE is HOST TARGET binding site found in the 3' untranslated region of mRNA encoded by CRYZ, corresponding to a HOST TARGET binding site such as BINDING SITE I, BINDING SITE II or BINDING SITE III. Table 2 illustrates the complementarity of the nucleotide sequences of CRYZ BINDING SITE, designated SEQ ID:7618, to the nucleotide sequence of VGAM2417 RNA, herein designated VGAM RNA, also designated SEQ ID:5128.

Another function of VGAM2417 is therefore inhibition of Crystallin, Zeta (quinone reductase) (CRYZ, Accession NM_001889), a gene which may act in the detoxification of xenobiotics. Accordingly, utilities of VGAM2417 include diagnosis, prevention and treatment of diseases and clinical conditions associated with CRYZ. The function of CRYZ and its association with various diseases and clinical conditions, has been established by previous studies, as described hereinabove with reference to VGAM323. FLJ12960 (Accession NM_024638) is another VGAM2417 host target gene. FLJ12960 BINDING SITE is HOST TARGET binding site found in the 3' untranslated region of mRNA encoded by FLJ12960, corresponding to a HOST TARGET binding site such as BINDING SITE I, BINDING SITE II or BINDING SITE III. Table 2 illustrates the complementarity of the nucleotide sequences of FLJ12960 BINDING SITE, designated SEQ ID:23919, to the nucleotide sequence of VGAM2417 RNA, herein designated VGAM RNA, also designated SEQ ID:5128.

Another function of VGAM2417 is therefore inhibition of FLJ12960 (Accession NM_024638). Accordingly, utilities of VGAM2417 include diagnosis, prevention and treatment of diseases and clinical conditions associated with FLJ12960. KIAA0478 (Accession NM_014870) is another VGAM2417 host target gene. KIAA0478 BINDING SITE is HOST TARGET binding site found in the 3' untranslated region of mRNA encoded by KIAA0478, corresponding to a HOST TARGET binding site such as BINDING SITE I, BINDING SITE II or BINDING SITE III. Table 2 illustrates the complementarity of the nucleotide sequences of KIAA0478 BINDING SITE, designated SEQ ID:16984, to the nucleotide sequence of VGAM2417 RNA, herein designated VGAM RNA, also designated SEQ ID:5128.

Another function of VGAM2417 is therefore inhibition of KIAA0478 (Accession NM_014870). Accordingly, utilities of VGAM2417 include diagnosis, prevention and treatment of diseases and clinical conditions associated with KIAA0478. KIAA1116 (Accession NM_014892) is another VGAM2417 host target gene. KIAA1116 BINDING SITE is HOST TARGET binding site found in the 3' untranslated region of mRNA encoded by KIAA1116, corresponding to a HOST TARGET binding site such as BINDING SITE I, BINDING SITE II or BINDING SITE III. Table 2 illustrates the complementarity of the nucleotide sequences of KIAA1116 BINDING SITE, designated SEQ ID:17040, to the nucleotide sequence of VGAM2417 RNA, herein designated VGAM RNA, also designated SEQ ID:5128.

Another function of VGAM2417 is therefore inhibition of KIAA1116 (Accession NM_014892). Accordingly, utilities of VGAM2417 include diagnosis, prevention and treatment of diseases and clinical conditions associated with KIAA1116. KIAA1559 (Accession XM_054472) is another VGAM2417 host target gene. KIAA1559 BINDING SITE is HOST TARGET binding site found in the 3' untranslated region of mRNA encoded by KIAA1559, corresponding to a HOST TARGET binding site such as BINDING SITE I, BINDING SITE II or BINDING SITE III. Table 2 illustrates the complementarity of the nucleotide sequences of KIAA1559 BINDING SITE, designated SEQ ID:36165, to the nucleotide sequence of VGAM2417 RNA, herein designated VGAM RNA, also designated SEQ ID:5128.

Another function of VGAM2417 is therefore inhibition of KIAA1559 (Accession XM_054472). Accordingly, utilities of VGAM2417 include diagnosis, prevention and treatment of diseases and clinical conditions associated with KIAA1559. PB1 (Accession NM_018165) is another VGAM2417 host target gene. PB1 BINDING SITE is HOST TARGET binding site found in the 3' untranslated region of mRNA encoded by PB1, corresponding to a HOST TARGET binding site such as BINDING SITE I, BINDING SITE II or BINDING SITE III. Table 2 illustrates the complementarity of the nucleotide sequences of PB1 BINDING SITE, designated SEQ ID:19981, to the nucleotide sequence of VGAM2417 RNA, herein designated VGAM RNA, also designated SEQ ID:5128.

Another function of VGAM2417 is therefore inhibition of PB1 (Accession NM_018165). Accordingly, utilities of VGAM2417 include diagnosis, prevention and treatment of diseases and clinical conditions associated with PB1. PRO0641 (Accession NM_014135) is another VGAM2417 host target gene. PRO0641 BINDING SITE is HOST TARGET binding site found in the 5' untranslated region of mRNA encoded by PRO0641, corresponding to a HOST TARGET binding site such as BINDING SITE I, BINDING SITE II or BINDING SITE III. Table 2 illustrates the complementarity of the nucleotide sequences of PRO0641 BINDING SITE, designated SEQ ID:15402, to the nucleotide sequence of VGAM2417 RNA, herein designated VGAM RNA, also designated SEQ ID:5128.

Another function of VGAM2417 is therefore inhibition of PRO0641 (Accession NM_014135). Accordingly, utilities of VGAM2417 include diagnosis, prevention and treatment of diseases and clinical conditions associated with PRO0641. SH3 Domain Binding Glutamic Acid-rich Protein Like 2 (SH3BGRL2, Accession NM_031469) is another VGAM2417 host target gene. SH3BGRL2 BINDING SITE is HOST TARGET binding site found in the 3' untranslated region of mRNA encoded by SH3BGRL2, corresponding to a HOST TARGET binding site such as BINDING SITE I, BINDING SITE II or BINDING SITE III. Table 2 illustrates the complementarity of the nucleotide sequences of SH3BGRL2 BINDING SITE, designated SEQ ID:25523, to the nucleotide sequence of VGAM2417 RNA, herein designated VGAM RNA, also designated SEQ ID:5128.

Another function of VGAM2417 is therefore inhibition of SH3 Domain Binding Glutamic Acid-rich Protein Like 2 (SH3BGRL2, Accession NM_031469). Accordingly, utilities of VGAM2417 include diagnosis, prevention and treatment of diseases and clinical conditions associated with SH3BGRL2. Signal Sequence Receptor, Gamma (translocon-associated protein gamma) (SSR3, Accession NM_007107) is another VGAM2417 host target gene. SSR3 BINDING SITE is HOST TARGET binding site found in the 3' untranslated region of mRNA encoded by SSR3, corresponding to a HOST TARGET binding site such as BINDING SITE I, BINDING SITE II or BINDING SITE III. Table 2 illustrates the complementarity of the nucleotide sequences of SSR3 BINDING SITE, designated SEQ ID:13972, to the nucleotide sequence of VGAM2417 RNA, herein designated VGAM RNA, also designated SEQ ID:5128.

Another function of VGAM2417 is therefore inhibition of Signal Sequence Receptor, Gamma (translocon-associated protein gamma) (SSR3, Accession NM_007107). Accordingly, utilities of VGAM2417 include diagnosis, prevention and treatment of diseases and clinical conditions associated with SSR3. LOC144871 (Accession XM_096698) is another VGAM2417 host target gene. LOC144871 BINDING SITE is HOST TARGET binding site found in the 3' untranslated region of mRNA encoded by LOC144871, corresponding to a HOST TARGET binding site such as BINDING SITE I, BINDING SITE II or BINDING SITE III. Table 2 illustrates the complementarity of the nucleotide sequences of LOC144871 BINDING SITE, designated SEQ ID:40471, to the nucleotide sequence of VGAM2417 RNA, herein designated VGAM RNA, also designated SEQ ID:5128.

Another function of VGAM2417 is therefore inhibition of LOC144871 (Accession XM_096698). Accordingly, utilities of VGAM2417 include diagnosis, prevention and treatment of diseases and clinical conditions associated with LOC144871. LOC151473 (Accession XM_087215) is another VGAM2417 host target gene. LOC151473 BINDING SITE is HOST TARGET binding site found in the 3' untranslated region of mRNA encoded by LOC151473, corresponding to a HOST TARGET binding site such as BINDING SITE I, BINDING SITE II or BINDING SITE III. Table 2 illustrates the complementarity of the nucleotide sequences of LOC151473 BINDING SITE, designated SEQ ID:39121, to the nucleotide sequence of VGAM2417 RNA, herein designated VGAM RNA, also designated SEQ ID:5128.

Another function of VGAM2417 is therefore inhibition of LOC151473 (Accession XM_087215). Accordingly, utilities of VGAM2417 include diagnosis, prevention and treatment of diseases and clinical conditions associated with LOC151473. LOC158428 (Accession XM_047249) is another VGAM2417 host target gene. LOC158428 BINDING SITE is HOST TARGET binding site found in the 5' untranslated region of mRNA encoded by LOC158428, corresponding to a HOST TARGET binding site such as BINDING SITE I, BINDING SITE II or BINDING SITE III. Table 2 illustrates the complementarity of the nucleotide sequences of LOC158428 BINDING SITE, designated SEQ ID:34922, to the nucleotide sequence of VGAM2417 RNA, herein designated VGAM RNA, also designated SEQ ID:5128.

Another function of VGAM2417 is therefore inhibition of LOC158428 (Accession XM_047249). Accordingly, utilities of VGAM2417 include diagnosis, prevention and treatment of diseases and clinical conditions associated with LOC158428. LOC197287 (Accession XM_027541) is another VGAM2417 host target gene. LOC197287 BINDING SITE is HOST TARGET binding site found in the 3' untranslated region of mRNA encoded by LOC197287, corresponding to a HOST TARGET binding site such as BINDING SITE I, BINDING SITE II or BINDING SITE III. Table 2 illustrates the complementarity of the nucleotide sequences of LOC197287 BINDING SITE, designated SEQ ID:30523, to the nucleotide sequence of VGAM2417 RNA, herein designated VGAM RNA, also designated SEQ ID:5128.

Another function of VGAM2417 is therefore inhibition of LOC197287 (Accession XM_027541). Accordingly, utilities of VGAM2417 include diagnosis, prevention and treatment of diseases and clinical conditions associated with LOC197287. LOC255265 (Accession XM_170902) is another VGAM2417 host target gene. LOC255265 BINDING SITE is HOST TARGET binding site found in the 5' untranslated region of mRNA encoded by LOC255265, corresponding to a HOST TARGET binding site such as BINDING SITE I, BINDING SITE II or BINDING SITE III. Table 2 illustrates the complementarity of the nucleotide sequences of LOC255265 BINDING SITE, designated SEQ ID:45658, to the nucleotide sequence of VGAM2417 RNA, herein designated VGAM RNA, also designated SEQ ID:5128.

Another function of VGAM2417 is therefore inhibition of LOC255265 (Accession XM_170902). Accordingly, utilities of VGAM2417 include diagnosis, prevention and treatment of diseases and clinical conditions associated with LOC255265. FIG. 1 further provides a conceptual description of a novel bioinformatically detected viral gene of the present invention, referred to here as Viral Genomic Address Messenger 2418 (VGAM2418) viral gene, which modulates expression of respective host target genes thereof, the function and utility of which host target genes is known in the art.

VGAM2418 is a novel bioinformatically detected regulatory, non protein coding, viral micro RNA (miRNA) gene. The method by which VGAM2418 was detected is described hereinabove with reference to FIGS. 1-8.

VGAM2418 gene, herein designated VGAM GENE, is a viral gene contained in the genome of Goatpox Virus. VGAM2418 host target gene, herein designated VGAM HOST TARGET GENE, is a human gene contained in the human genome.

VGAM2418 gene encodes a VGAM2418 precursor RNA, herein designated VGAM PRECURSOR RNA. Similar to other miRNA genes, and unlike most ordinary genes, VGAM2418 precursor RNA does not encode a protein. A nucleotide sequence identical or highly similar to the nucleotide sequence of VGAM2418 precursor RNA is designated SEQ ID:2404, and is provided hereinbelow with reference to the sequence listing part. Nucleotide sequence SEQ ID:2404 is located at position 117185 relative to the genome of Goatpox Virus.

VGAM2418 precursor RNA folds onto itself, forming VGAM2418 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2418 folded precursor RNA into VGAM2418 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2418 RNA is designated SEQ ID:5129, and is provided hereinbelow with reference to the sequence listing part.

VGAM2418 host target gene, herein designated VGAM HOST TARGET GENE, encodes a corresponding messenger RNA, VGAM2418 host target RNA, herein designated VGAM HOST TARGET RNA. VGAM2418 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2418 RNA, herein designated VGAM RNA, binds complementarily to one or more host target binding sites located in untranslated regions of VGAM2418 host target RNA, herein designated VGAM HOST TARGET RNA. This complementary binding is due to the fact that the nucleotide sequence of VGAM2418 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2418 RNA, herein designated VGAM RNA, may have a different number of host target binding sites in untranslated regions of a VGAM2418 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2418 RNA, herein designated VGAM RNA, to host target binding sites on VGAM2418 host target RNA, herein designated VGAM HOST TARGET RNA, such as BINDING SITE I, BINDING SITE II and BINDING SITE III, inhibits translation of VGAM2418 host target RNA into VGAM2418 host target protein, herein designated VGAM HOST TARGET PROTEIN. VGAM host target protein is therefore outlined by a broken line.

It is appreciated that VGAM2418 host target gene, herein designated VGAM HOST TARGET GENE, in fact represents a plurality of VGAM2418 host target genes. The mRNA of each one of this plurality of VGAM2418 host target genes comprises one or more host target binding sites, each having a nucleotide sequence which is at least partly complementary to VGAM2418 RNA, herein designated VGAM RNA, and which when bound by VGAM2418 RNA causes inhibition of translation of respective one or more VGAM2418 host target proteins.

It is further appreciated by one skilled in the art that the mode of translational inhibition illustrated by FIG. 1 with specific reference to translational inhibition exerted by VGAM2418 gene, herein designated VGAM GENE, on one or more VGAM2418 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2418 is inhibition of expression of host target genes, as part of a novel viral mechanism of attacking a host. Accordingly, utilities of VGAM2418 include diagnosis, prevention and treatment of viral infection by Goatpox Virus. Specific functions, and accordingly utilities, of VGAM2418 correlate with, and may be deduced from, the identity of the host target genes which VGAM2418 binds and inhibits, and the function of these host target genes, as elaborated hereinbelow.

Nucleotide sequences of the VGAM2418 precursor RNA, herein designated VGAM PRECURSOR RNA, and of the 'diced' VGAM2418 RNA, herein designated VGAM RNA, and a schematic representation of the secondary folding of VGAM2418 folded precursor RNA, herein designated VGAM FOLDED PRECURSOR RNA, of VGAM2418 are further described hereinbelow with reference to Table 1.

Nucleotide sequences of host target binding sites, such as BINDING SITE-I, BINDING SITE-II and BINDING SITE-III of FIG. 1, found on VGAM2418 host target RNA, and schematic representation of the complementarity of each of these host target binding sites to VGAM2418 RNA, herein designated VGAM RNA, are described hereinbelow with reference to Table 2.

As mentioned hereinabove with reference to FIG. 1, a function of VGAM2418 gene, herein designated VGAM is inhibition of expression of VGAM2418 target genes. It is appreciated that specific functions, and accordingly utilities, of VGAM2418 correlate with, and may be deduced from, the identity of the target genes which VGAM2418 binds and inhibits, and the function of these target genes, as elaborated hereinbelow.

Netrin 4 (NTN4, Accession XM_031896) is a VGAM2418 host target gene. NTN4 BINDING SITE is HOST TARGET binding site found in the 3' untranslated region of mRNA encoded by NTN4, corresponding to a HOST TARGET binding site such as BINDING SITE I, BINDING SITE II or BINDING SITE III. Table 2 illustrates the complementarity of the nucleotide sequences of NTN4 BINDING SITE, designated SEQ ID:31508, to the nucleotide sequence of VGAM2418 RNA, herein designated VGAM RNA, also designated SEQ ID:5129.

A function of VGAM2418 is therefore inhibition of Netrin 4 (NTN4, Accession XM_031896). Accordingly, utilities of VGAM2418 include diagnosis, prevention and treatment of diseases and clinical conditions associated with NTN4. FIG. 1 further provides a conceptual description of a novel bioinformatically detected viral gene of the present invention, referred to here as Viral Genomic Address Messenger 2419 (VGAM2419) viral gene, which modulates expression of respective host target genes thereof, the function and utility of which host target genes is known in the art.

VGAM2419 is a novel bioinformatically detected regulatory, non protein coding, viral micro RNA (miRNA) gene. The method by which VGAM2419 was detected is described hereinabove with reference to FIGS. 1-8.

VGAM2419 gene, herein designated VGAM GENE, is a viral gene contained in the genome of Goatpox Virus. VGAM2419 host target gene, herein designated VGAM HOST TARGET GENE, is a human gene contained in the human genome.

VGAM2419 gene encodes a VGAM2419 precursor RNA, herein designated VGAM PRECURSOR RNA. Similar to other miRNA genes, and unlike most ordinary genes, VGAM2419 precursor RNA does not encode a protein. A nucleotide sequence identical or highly similar to the nucleotide sequence of VGAM2419 precursor RNA is designated SEQ ID:2405, and is provided hereinbelow with reference to the sequence listing part. Nucleotide sequence SEQ ID:2405 is located at position 104440 relative to the genome of Goatpox Virus.

VGAM2419 precursor RNA folds onto itself, forming VGAM2419 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2419 folded precursor RNA into VGAM2419 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2419 RNA is designated SEQ ID:5130, and is provided hereinbelow with reference to the sequence listing part.

VGAM2419 host target gene, herein designated VGAM HOST TARGET GENE, encodes a corresponding messenger RNA, VGAM2419 host target RNA, herein designated VGAM HOST TARGET RNA. VGAM2419 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2419 RNA, herein designated VGAM RNA, binds complementarily to one or more host target binding sites located in untranslated regions of VGAM2419 host target RNA, herein designated VGAM HOST TARGET RNA. This complementary binding is due to the fact that the nucleotide sequence of VGAM2419 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2419 RNA, herein designated VGAM RNA, may have a different number of host target binding sites in untranslated regions of a VGAM2419 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2419 RNA, herein designated VGAM RNA, to host target binding sites on VGAM2419 host target RNA, herein designated VGAM HOST TARGET RNA, such as BINDING SITE I, BINDING SITE II and BINDING SITE III, inhibits translation of VGAM2419 host target RNA into VGAM2419 host target protein, herein designated VGAM HOST TARGET PROTEIN. VGAM host target protein is therefore outlined by a broken line.

It is appreciated that VGAM2419 host target gene, herein designated VGAM HOST TARGET GENE, in fact represents a plurality of VGAM2419 host target genes. The mRNA of each one of this plurality of VGAM2419 host target genes comprises one or more host target binding sites, each having a nucleotide sequence which is at least partly complementary to VGAM2419 RNA, herein designated VGAM RNA, and which when bound by VGAM2419 RNA causes inhibition of translation of respective one or more VGAM2419 host target proteins.

It is further appreciated by one skilled in the art that the mode of translational inhibition illustrated by FIG. 1 with specific reference to translational inhibition exerted by VGAM2419 gene, herein designated VGAM GENE, on one or more VGAM2419 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2419 is inhibition of expression of host target genes, as part of a novel viral mechanism of attacking a host. Accordingly, utilities of VGAM2419 include diagnosis, prevention and treatment of viral infection by Goatpox Virus. Specific functions, and accordingly utilities, of VGAM2419 correlate with, and may be deduced from, the identity of the host target genes which VGAM2419 binds and inhibits, and the function of these host target genes, as elaborated hereinbelow.

Nucleotide sequences of the VGAM2419 precursor RNA, herein designated VGAM PRECURSOR RNA, and of the 'diced' VGAM2419 RNA, herein designated VGAM RNA, and a schematic representation of the secondary folding of VGAM2419 folded precursor RNA, herein designated VGAM FOLDED PRECURSOR RNA, of VGAM2419 are further described hereinbelow with reference to Table 1.

Nucleotide sequences of host target binding sites, such as BINDING SITE-I, BINDING SITE-II and BINDING SITE-III of FIG. 1, found on VGAM2419 host target RNA, and schematic representation of the complementarity of each of these host target binding sites to VGAM2419 RNA, herein designated VGAM RNA, are described hereinbelow with reference to Table 2.

As mentioned hereinabove with reference to FIG. 1, a function of VGAM2419 gene, herein designated VGAM is inhibition of expression of VGAM2419 target genes. It is appreciated that specific functions, and accordingly utilities, of VGAM2419 correlate with, and may be deduced from, the identity of the target genes which VGAM2419 binds and inhibits, and the function of these target genes, as elaborated hereinbelow.

Calbindin 1, 28 kDa (CALB1, Accession NM_004929) is a VGAM2419 host target gene. CALB1 BINDING SITE is HOST TARGET binding site found in the 3' untranslated region of mRNA encoded by CALB1, corresponding to a HOST TARGET binding site such as BINDING SITE I, BINDING SITE II or BINDING SITE III. Table 2 illustrates the complementarity of the nucleotide sequences of CALB1 BINDING SITE, designated SEQ ID:11369, to the nucleotide sequence of VGAM2419 RNA, herein designated VGAM RNA, also designated SEQ ID:5130.

A function of VGAM2419 is therefore inhibition of Calbindin 1, 28kDa (CALB1, Accession NM_004929), a gene which buffers cytosolic calcium. Accordingly, utilities of VGAM2419 include diagnosis, prevention and treatment of diseases and clinical conditions associated with CALB1. The function of CALB1 and its association with various diseases and clinical conditions, has been established by previous studies, as described hereinabove with reference to VGAM266. F-box and Leucine-rich Repeat Protein 2 (FBXL2, Accession NM_012157) is another VGAM2419 host target gene. FBXL2 BINDING SITE is HOST TARGET binding site found in the 3' untranslated region of mRNA encoded by FBXL2, corresponding to a HOST TARGET binding site such as BINDING SITE I, BINDING SITE II or BINDING SITE III. Table 2 illustrates the complementarity of the nucleotide sequences of FBXL2 BINDING SITE, designated SEQ ID:14453, to the nucleotide sequence of VGAM2419 RNA, herein designated VGAM RNA, also designated SEQ ID:5130.

Another function of VGAM2419 is therefore inhibition of F-box and Leucine-rich Repeat Protein 2 (FBXL2, Accession NM_012157). Accordingly, utilities of VGAM2419 include diagnosis, prevention and treatment of diseases and clinical conditions associated with FBXL2. SMT3 Suppressor of Mif Two 3 Homolog 1 (yeast) (SMT3H1, Accession XM_009805) is another VGAM2419 host target gene. SMT3H1 BINDING SITE is HOST TARGET binding site found in the 3' untranslated region of mRNA encoded by SMT3H1, corresponding to a HOST TARGET binding site such as BINDING SITE I, BINDING SITE II or BINDING SITE III. Table 2 illustrates the complementarity of the nucleotide sequences of SMT3H1 BINDING SITE, designated SEQ ID:30123, to the nucleotide sequence of VGAM2419 RNA, herein designated VGAM RNA, also designated SEQ ID:5130.

Another function of VGAM2419 is therefore inhibition of SMT3 Suppressor of Mif Two 3 Homolog 1 (yeast) (SMT3H1, Accession XM_009805), a gene which is involved in the function and/or structure of the eukaryotic kinetochore. Accordingly, utilities of VGAM2419 include diagnosis, prevention and treatment of diseases and clinical conditions associated with SMT3H1. The function of SMT3H1 and its association with various diseases and clinical conditions, has been established by previous studies, as described hereinabove with reference to VGAM119. DKFZP434P0721 (Accession XM_033181) is another VGAM2419 host target gene. DKFZP434P0721 BINDING SITE is HOST TARGET binding site found in the 3' untranslated region of mRNA encoded by DKFZP434P0721, corresponding to a HOST TARGET binding site such as BINDING SITE I, BINDING SITE II or BINDING SITE III. Table 2 illustrates the complementarity of the nucleotide sequences of DKFZP434P0721 BINDING SITE, designated SEQ ID:31873, to the nucleotide sequence of VGAM2419 RNA, herein designated VGAM RNA, also designated SEQ ID:5130.

Another function of VGAM2419 is therefore inhibition of DKFZP434P0721 (Accession XM_033181). Accordingly, utilities of VGAM2419 include diagnosis, prevention and treatment of diseases and clinical conditions associated with DKFZP434P0721. KIAA1084 (Accession NM_014910) is another VGAM2419 host target gene. KIAA1084 BINDING SITE is HOST TARGET binding site found in the 3' untranslated region of mRNA encoded by KIAA1084, corresponding to a HOST TARGET binding site such as BINDING SITE I, BINDING SITE II or BINDING SITE III. Table 2 illustrates the complementarity of the nucleotide sequences of KIAA1084 BINDING SITE, designated SEQ ID:17134, to the nucleotide sequence of VGAM2419 RNA, herein designated VGAM RNA, also designated SEQ ID:5130.

Another function of VGAM2419 is therefore inhibition of KIAA1084 (Accession NM_014910). Accordingly, utilities of VGAM2419 include diagnosis, prevention and treatment of diseases and clinical conditions associated with KIAA1084. MGC10911 (Accession NM_032302) is another VGAM2419 host target gene. MGC10911 BINDING SITE is HOST TARGET binding site found in the 5' untranslated region of mRNA encoded by MGC10911, corresponding to a HOST TARGET binding site such as BINDING SITE I, BINDING SITE II or BINDING SITE III. Table 2 illustrates the complementarity of the nucleotide sequences of MGC10911 BINDING SITE, designated SEQ ID:26084, to the nucleotide sequence of VGAM2419 RNA, herein designated VGAM RNA, also designated SEQ ID:5130.

Another function of VGAM2419 is therefore inhibition of MGC10911 (Accession NM_032302). Accordingly, utilities of VGAM2419 include diagnosis, prevention and treatment of diseases and clinical conditions associated with MGC10911. Solute Carrier Family 38, Member 4 (SLC38A4, Accession NM_018018) is another VGAM2419 host target gene. SLC38A4 BINDING SITE is HOST TARGET binding site found in the 3' untranslated region of mRNA encoded by SLC38A4, corresponding to a HOST TARGET binding site such as BINDING SITE I, BINDING SITE II or BINDING SITE III. Table 2 illustrates the complementarity of the nucleotide sequences of SLC38A4 BINDING SITE, designated SEQ ID:19758, to the nucleotide sequence of VGAM2419 RNA, herein designated VGAM RNA, also designated SEQ ID:5130.

Another function of VGAM2419 is therefore inhibition of Solute Carrier Family 38, Member 4 (SLC38A4, Accession NM_018018). Accordingly, utilities of VGAM2419 include diagnosis, prevention and treatment of diseases and clinical conditions associated with SLC38A4. FIG. 1 further provides a conceptual description of a novel bioinformatically detected viral gene of the present invention, referred to here as Viral Genomic Address Messenger 2420 (VGAM2420) viral gene, which modulates expression of respective host target genes thereof, the function and utility of which host target genes is known in the art.

VGAM2420 is a novel bioinformatically detected regulatory, non protein coding, viral micro RNA (miRNA) gene. The method by which VGAM2420 was detected is described hereinabove with reference to FIGS. 1-8.

VGAM2420 gene, herein designated VGAM GENE, is a viral gene contained in the genome of Goatpox Virus. VGAM2420 host target gene, herein designated VGAM HOST TARGET GENE, is a human gene contained in the human genome.

VGAM2420 gene encodes a VGAM2420 precursor RNA, herein designated VGAM PRECURSOR RNA. Similar to other miRNA genes, and unlike most ordinary genes, VGAM2420 precursor RNA does not encode a protein. A nucleotide sequence identical or highly similar to the nucleotide sequence of VGAM2420 precursor RNA is designated SEQ ID:2406, and is provided hereinbelow with reference to the sequence listing part. Nucleotide sequence SEQ ID:2406 is located at position 138753 relative to the genome of Goatpox Virus.

VGAM2420 precursor RNA folds onto itself, forming VGAM2420 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2420 folded precursor RNA into VGAM2420 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2420 RNA is designated SEQ ID:5131, and is provided hereinbelow with reference to the sequence listing part.

VGAM2420 host target gene, herein designated VGAM HOST TARGET GENE, encodes a corresponding messenger RNA, VGAM2420 host target RNA, herein designated VGAM HOST TARGET RNA. VGAM2420 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2420 RNA, herein designated VGAM RNA, binds complementarily to one or more host target binding sites located in untranslated regions of VGAM2420 host target RNA, herein designated VGAM HOST TARGET RNA. This complementary binding is due to the fact that the nucleotide sequence of VGAM2420 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2420 RNA, herein designated VGAM RNA, may have a different number of host target binding sites in untranslated regions of a VGAM2420 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2420 RNA, herein designated VGAM RNA, to host target binding sites on VGAM2420 host target RNA, herein designated VGAM HOST TARGET RNA, such as BINDING SITE I, BINDING SITE II and BINDING SITE III, inhibits translation of VGAM2420 host target RNA into VGAM2420 host target protein, herein designated VGAM HOST TARGET PROTEIN. VGAM host target protein is therefore outlined by a broken line.

It is appreciated that VGAM2420 host target gene, herein designated VGAM HOST TARGET GENE, in fact represents a plurality of VGAM2420 host target genes. The mRNA of each one of this plurality of VGAM2420 host target genes comprises one or more host target binding sites, each having a nucleotide sequence which is at least partly complementary to VGAM2420 RNA, herein designated VGAM RNA, and which when bound by VGAM2420 RNA causes inhibition of translation of respective one or more VGAM2420 host target proteins.

It is further appreciated by one skilled in the art that the mode of translational inhibition illustrated by FIG. 1 with specific reference to translational inhibition exerted by VGAM2420 gene, herein designated VGAM GENE, on one or more VGAM2420 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2420 is inhibition of expression of host target genes, as part of a novel viral mechanism of attacking a host. Accordingly, utilities of VGAM2420 include diagnosis, prevention and treatment of viral infection by Goatpox Virus. Specific functions, and accordingly utilities, of VGAM2420 correlate with, and may be deduced from, the identity of the host target genes which VGAM2420 binds and inhibits, and the function of these host target genes, as elaborated hereinbelow.

Nucleotide sequences of the VGAM2420 precursor RNA, herein designated VGAM PRECURSOR RNA, and of the 'diced' VGAM2420 RNA, herein designated VGAM RNA, and a schematic representation of the secondary folding of VGAM2420 folded precursor RNA, herein designated VGAM FOLDED PRECURSOR RNA, of VGAM2420 are further described hereinbelow with reference to Table 1.

Nucleotide sequences of host target binding sites, such as BINDING SITE-I, BINDING SITE-II and BINDING SITE-III of FIG. 1, found on VGAM2420 host target RNA, and schematic representation of the complementarity of each of these host target binding sites to VGAM2420 RNA, herein designated VGAM RNA, are described hereinbelow with reference to Table 2.

As mentioned hereinabove with reference to FIG. 1, a function of VGAM2420 gene, herein designated VGAM is inhibition of expression of VGAM2420 target genes. It is appreciated that specific functions, and accordingly utilities, of VGAM2420 correlate with, and may be deduced from, the identity of the target genes which VGAM2420 binds and inhibits, and the function of these target genes, as elaborated hereinbelow.

Ankyrin 2, Neuronal (ANK2, Accession NM_001148) is a VGAM2420 host target gene. ANK2 BINDING SITE1 and ANK2 BINDING SITE2 are HOST TARGET binding sites found in untranslated regions of mRNA encoded by ANK2, corresponding to HOST TARGET binding sites such as BINDING SITE I, BINDING SITE II or BINDING SITE III. Table 2 illustrates the complementarity of the nucleotide sequences of ANK2 BINDING SITE1 and ANK2 BINDING SITE2, designated SEQ ID:6819 and SEQ ID:21963 respectively, to the nucleotide sequence of VGAM2420 RNA, herein designated VGAM RNA, also designated SEQ ID:5131.

A function of VGAM2420 is therefore inhibition of Ankyrin 2, Neuronal (ANK2, Accession NM_001148), a gene which attaches integral membrane proteins to cytoskeletal elements. also binds to cytoskeletal proteins. Accordingly, utilities of VGAM2420 include diagnosis, prevention and treatment of diseases and clinical conditions associated with ANK2. The function of ANK2 and its association with various diseases and clinical conditions, has been established by previous studies, as described hereinabove with reference to VGAM769. TEM8 (Accession NM_032208) is another VGAM2420 host target gene. TEM8 BINDING SITE is HOST TARGET binding site found in the 3' untranslated region of mRNA encoded by TEM8, corresponding to a HOST TARGET binding site such as BINDING SITE I, BINDING SITE II or BINDING SITE III. Table 2 illustrates the complementarity of the nucleotide sequences of TEM8 BINDING SITE, designated SEQ ID:25915, to the nucleotide sequence of VGAM2420 RNA, herein designated VGAM RNA, also designated SEQ ID:5131.

Another function of VGAM2420 is therefore inhibition of TEM8 (Accession NM_032208), a gene which is a tumor-specific endothelial marker. Accordingly, utilities of VGAM2420 include diagnosis, prevention and treatment of diseases and clinical conditions associated with TEM8. The function of TEM8 and its association with various diseases and clinical conditions, has been established by previous studies, as described hereinabove with reference to VGAM1489. Zinc Finger Protein 138 (clone pHZ-32) (ZNF138, Accession XM_088081) is another VGAM2420 host target gene. ZNF138 BINDING SITE is HOST TARGET binding site found in the 3' untranslated region of mRNA encoded by ZNF138, corresponding to a HOST TARGET binding site such as BINDING SITE I, BINDING SITE II or BINDING SITE III. Table 2 illustrates the complementarity of the nucleotide sequences of ZNF138 BINDING SITE, designated SEQ ID:39507, to the nucleotide sequence of VGAM2420 RNA, herein designated VGAM RNA, also designated SEQ ID:5131.

Another function of VGAM2420 is therefore inhibition of Zinc Finger Protein 138 (clone pHZ-32) (ZNF138, Accession XM_088081). Accordingly, utilities of VGAM2420 include diagnosis, prevention and treatment of diseases and clinical conditions associated with ZNF138. PB1 (Accession NM_018313) is another VGAM2420 host target gene. PB1 BINDING SITE is HOST TARGET binding site found in the 3' untranslated region of mRNA encoded by PB1, corresponding to a HOST TARGET binding site such as BINDING SITE I, BINDING SITE II or BINDING SITE III. Table 2 illustrates the complementarity of the nucleotide sequences of PB1 BINDING SITE, designated SEQ ID:20306, to the nucleotide sequence of VGAM2420 RNA, herein designated VGAM RNA, also designated SEQ ID:5131.

Another function of VGAM2420 is therefore inhibition of PB1 (Accession NM_018313). Accordingly, utilities of VGAM2420 include diagnosis, prevention and treatment of diseases and clinical conditions associated with PB1. PRO2086 (Accession NM_014111) is another VGAM2420 host target gene. PRO2086 BINDING SITE is HOST TARGET binding site found in the 5' untranslated region of mRNA encoded by PRO2086, corresponding to a HOST TARGET binding site such as BINDING SITE I, BINDING SITE II or BINDING SITE III. Table 2 illustrates the complementarity of the nucleotide sequences of PRO2086 BINDING SITE, designated SEQ ID:15343, to the nucleotide sequence of VGAM2420 RNA, herein designated VGAM RNA, also designated SEQ ID:5131.

Another function of VGAM2420 is therefore inhibition of PRO2086 (Accession NM_014111). Accordingly, utilities of VGAM2420 include diagnosis, prevention and treatment of diseases and clinical conditions associated with PRO2086. LOC154930 (Accession XM_088080) is another VGAM2420 host target gene. LOC154930 BINDING SITE is HOST TARGET binding site found in the 3' untranslated region of mRNA encoded by LOC154930, corresponding to a HOST TARGET binding site such as BINDING SITE I, BINDING SITE II or BINDING SITE III. Table 2 illustrates the complementarity of the nucleotide sequences of LOC154930 BINDING SITE, designated SEQ ID:39504, to the nucleotide sequence of VGAM2420 RNA, herein designated VGAM RNA, also designated SEQ ID:5131.

Another function of VGAM2420 is therefore inhibition of LOC154930 (Accession XM_088080). Accordingly, utilities of VGAM2420 include diagnosis, prevention and treatment of diseases and clinical conditions associated with LOC154930. LOC199775 (Accession XM_114016) is another VGAM2420 host target gene. LOC199775 BINDING SITE is HOST TARGET binding site found in the 5' untranslated region of mRNA encoded by LOC199775, corresponding to a HOST TARGET binding site such as BIND- ING SITE I, BINDING SITE II or BINDING SITE III. Table 2 illustrates the complementarity of the nucleotide sequences of LOC199775 BINDING SITE, designated SEQ ID:42614, to the nucleotide sequence of VGAM2420 RNA, herein designated VGAM RNA, also designated SEQ ID:5131.

Another function of VGAM2420 is therefore inhibition of LOC199775 (Accession XM_114016). Accordingly, utilities of VGAM2420 include diagnosis, prevention and treatment of diseases and clinical conditions associated with LOC199775. LOC51246 (Accession NM_016479) is another VGAM2420 host target gene. LOC51246 BINDING SITE is HOST TARGET binding site found in the 3' untranslated region of mRNA encoded by LOC51246, corresponding to a HOST TARGET binding site such as BINDING SITE I, BINDING SITE II or BINDING SITE III. Table 2 illustrates the complementarity of the nucleotide sequences of LOC51246 BINDING SITE, designated SEQ ID:18577, to the nucleotide sequence of VGAM2420 RNA, herein designated VGAM RNA, also designated SEQ ID:5131.

Another function of VGAM2420 is therefore inhibition of LOC51246 (Accession NM_016479). Accordingly, utilities of VGAM2420 include diagnosis, prevention and treatment of diseases and clinical conditions associated with LOC51246. LOC51652 (Accession NM_016079) is another VGAM2420 host target gene. LOC51652 BINDING SITE is HOST TARGET binding site found in the 3' untranslated region of mRNA encoded by LOC51652, corresponding to a HOST TARGET binding site such as BINDING SITE I, BINDING SITE II or BINDING SITE III. Table 2 illustrates the complementarity of the nucleotide sequences of LOC51652 BINDING SITE, designated SEQ ID:18150, to the nucleotide sequence of VGAM2420 RNA, herein designated VGAM RNA, also designated SEQ ID:5131.

Another function of VGAM2420 is therefore inhibition of LOC51652 (Accession NM_016079). Accordingly, utilities of VGAM2420 include diagnosis, prevention and treatment of diseases and clinical conditions associated with LOC51652. FIG. 1 further provides a conceptual description of a novel bioinformatically detected viral gene of the present invention, referred to here as Viral Genomic Address Messenger 2421 (VGAM2421) viral gene, which modulates expression of respective host target genes thereof, the function and utility of which host target genes is known in the art.

VGAM2421 is a novel bioinformatically detected regulatory, non protein coding, viral micro RNA (miRNA) gene. The method by which VGAM2421 was detected is described hereinabove with reference to FIGS. 1-8.

VGAM2421 gene, herein designated VGAM GENE, is a viral gene contained in the genome of Goatpox Virus. VGAM2421 host target gene, herein designated VGAM HOST TARGET GENE, is a human gene contained in the human genome.

VGAM2421 gene encodes a VGAM2421 precursor RNA, herein designated VGAM PRECURSOR RNA. Similar to other miRNA genes, and unlike most ordinary genes, VGAM2421 precursor RNA does not encode a protein. A nucleotide sequence identical or highly similar to the nucleotide sequence of VGAM2421 precursor RNA is designated SEQ ID:2407, and is provided hereinbelow with reference to the sequence listing part. Nucleotide sequence SEQ ID:2407 is located at position 87501 relative to the genome of Goatpox Virus.

VGAM2421 precursor RNA folds onto itself, forming VGAM2421 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2421 folded precursor RNA into VGAM2421 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2421 RNA is designated SEQ ID:5132, and is provided hereinbelow with reference to the sequence listing part.

VGAM2421 host target gene, herein designated VGAM HOST TARGET GENE, encodes a corresponding messenger RNA, VGAM2421 host target RNA, herein designated VGAM HOST TARGET RNA. VGAM2421 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2421 RNA, herein designated VGAM RNA, binds complementarily to one or more host target binding sites located in untranslated regions of VGAM2421 host target RNA, herein designated VGAM HOST TARGET RNA. This complementary binding is due to the fact that the nucleotide sequence of VGAM2421 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2421 RNA, herein designated VGAM RNA, may have a different number of host target binding sites in untranslated regions of a VGAM2421 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2421 RNA, herein designated VGAM RNA, to host target binding sites on VGAM2421 host target RNA, herein designated VGAM HOST TARGET RNA, such as BINDING SITE I, BINDING SITE II and BINDING SITE III, inhibits translation of VGAM2421 host target RNA into VGAM2421 host target protein, herein designated VGAM HOST TARGET PROTEIN. VGAM host target protein is therefore outlined by a broken line.

It is appreciated that VGAM2421 host target gene, herein designated VGAM HOST TARGET GENE, in fact represents a plurality of VGAM2421 host target genes. The mRNA of each one of this plurality of VGAM2421 host target genes comprises one or more host target binding sites, each having a nucleotide sequence which is at least partly complementary to VGAM2421 RNA, herein designated VGAM RNA, and which when bound by VGAM2421 RNA causes inhibition of translation of respective one or more VGAM2421 host target proteins.

It is further appreciated by one skilled in the art that the mode of translational inhibition illustrated by FIG. 1 with specific reference to translational inhibition exerted by VGAM2421 gene, herein designated VGAM GENE, on one or more VGAM2421 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2421 is inhibition of expression of host target genes, as part of a novel viral mechanism of attacking a host. Accordingly, utilities of VGAM2421 include diagnosis, prevention and treatment of viral infection by Goatpox Virus. Specific functions, and accordingly utilities, of VGAM2421 correlate with, and may be deduced from, the identity of the host target genes which VGAM2421 binds and inhibits, and the function of these host target genes, as elaborated hereinbelow.

Nucleotide sequences of the VGAM2421 precursor RNA, herein designated VGAM PRECURSOR RNA, and of the 'diced' VGAM2421 RNA, herein designated VGAM RNA, and a schematic representation of the secondary folding of VGAM2421 folded precursor RNA, herein designated VGAM FOLDED PRECURSOR RNA, of VGAM2421 are further described hereinbelow with reference to Table 1.

Nucleotide sequences of host target binding sites, such as BINDING SITE-I, BINDING SITE-II and BINDING SITE-III of FIG. 1, found on VGAM2421 host target RNA, and schematic representation of the complementarity of each of these host target binding sites to VGAM2421 RNA, herein designated VGAM RNA, are described hereinbelow with reference to Table 2.

As mentioned hereinabove with reference to FIG. 1, a function of VGAM2421 gene, herein designated VGAM is inhibition of expression of VGAM2421 target genes. It is appreciated that specific functions, and accordingly utilities, of VGAM2421 correlate with, and may be deduced from, the identity of the target genes which VGAM2421 binds and inhibits, and the function of these target genes, as elaborated hereinbelow.

Phosphatidylinositol Glycan, Class H (PIGH, Accession NM_004569) is a VGAM2421 host target gene. PIGH BINDING SITE is HOST TARGET binding site found in the 3' untranslated region of mRNA encoded by PIGH, corresponding to a HOST TARGET binding site such as BINDING SITE I, BINDING SITE II or BINDING SITE III. Table 2 illustrates the complementarity of the nucleotide sequences of PIGH BINDING SITE, designated SEQ ID:10911, to the nucleotide sequence of VGAM2421 RNA, herein designated VGAM RNA, also designated SEQ ID:5132.

A function of VGAM2421 is therefore inhibition of Phosphatidylinositol Glycan, Class H (PIGH, Accession NM_004569), a gene which catalyzes transfer of GlcNAc to PI. Accordingly, utilities of VGAM2421 include diagnosis, prevention and treatment of diseases and clinical conditions associated with PIGH. The function of PIGH has been established by previous studies. The PIGH gene encodes an enzyme involved in the biosynthesis of glycosylphosphatidylinositol anchor; see PIGA (OMIM Ref. No. 311770) and PIGF (OMIM Ref. No. 600153) for other components of the system. Kamitani et al. (1993) isolated cDNA for a human gene that repaired the defect in a complementation class H mutant cell line. They determined that PIGH encodes a predicted protein of 188 amino acids. Ware et al. (1994) demonstrated that the mouse Pigh gene is located on chromosome 12 in a region of homology of synteny with 14q11-q24. Watanabe et al. (1996) demonstrated that the PIGA and PIGH proteins form a protein complex and are subunits of the GPI GlcNAc transferase of the endoplasmic reticulum (ER). They showed that PIGH is a cytoplasmic ER-associated protein. Using immunoprecipitation experiments, Watanabe et al. (1998) demonstrated that PIGQ (OMIM Ref. No. 605754) associates specifically with PIGA, PIGC (OMIM Ref. No. 601730), and PIGH and that all 4 proteins form a complex that has GPI-GlcNAc transferase (GPI-GnT) activity in vitro Full details of the abovementioned studies are described in the following publications, the disclosure of which are hereby incorporated by reference:

Watanabe, R.; Inoue, N.; Westfall, B.; Taron, C. H.; Orlean, P.; Takeda, J.; Kinoshita, T.: The first step of glycosylphosphatidylinositol biosynthesis is mediated by a complex of PIG-A, PIG-H, PIG-C and GPI1. EMBO J. 17:877-885, 1998; and Watanabe, R.; Kinoshita, T.; Masaki, R.; Yamamoto, A.; Takeda, J.; Inoue, N.: PIG-A and PIG-H, which participate in glycosylphosphatidylinositol anchor biosynthesis, form a protein comp.

Further studies establishing the function and utilities of PIGH are found in John Hopkins OMIM database record ID 600154, and in sited publications numbered 133 and 8105-8107 listed in the bibliography section hereinbelow, which are also hereby incorporated by reference. DCMP Deaminase (DCTD, Accession NM_001921) is another VGAM2421 host target gene. DCTD BINDING SITE is HOST TARGET binding site found in the 3' untranslated region of mRNA encoded by DCTD, corresponding to a HOST TARGET binding site such as BINDING SITE I, BINDING SITE II or BINDING SITE III. Table 2 illustrates the complementarity of the nucleotide sequences of DCTD BINDING SITE, designated SEQ ID:7636, to the nucleotide sequence of VGAM2421 RNA, herein designated VGAM RNA, also designated SEQ ID:5132.

Another function of VGAM2421 is therefore inhibition of DCMP Deaminase (DCTD, Accession NM_001921). Accordingly, utilities of VGAM2421 include diagnosis, prevention and treatment of diseases and clinical conditions associated with DCTD. FLJ14906 (Accession NM_032859) is another VGAM2421 host target gene. FLJ14906 BINDING SITE is HOST TARGET binding site found in the 3' untranslated region of mRNA encoded by FLJ14906, corresponding to a HOST TARGET binding site such as BINDING SITE I, BINDING SITE II or BINDING SITE III. Table 2 illustrates the complementarity of the nucleotide sequences of FLJ14906 BINDING SITE, designated SEQ ID:26664, to the nucleotide sequence of VGAM2421 RNA, herein designated VGAM RNA, also designated SEQ ID:5132.

Another function of VGAM2421 is therefore inhibition of FLJ14906 (Accession NM_032859). Accordingly, utilities of VGAM2421 include diagnosis, prevention and treatment of diseases and clinical conditions associated with FLJ14906. LOC138389 (Accession XM_072534) is another VGAM2421 host target gene. LOC138389 BINDING SITE is HOST TARGET binding site found in the 5' untranslated region of mRNA encoded by LOC138389, corresponding to a HOST TARGET binding site such as BINDING SITE I, BINDING SITE II or BINDING SITE III. Table 2 illustrates the complementarity of the nucleotide sequences of LOC138389 BINDING SITE, designated SEQ ID:37503, to the nucleotide sequence of VGAM2421 RNA, herein designated VGAM RNA, also designated SEQ ID:5132.

Another function of VGAM2421 is therefore inhibition of LOC138389 (Accession XM_072534). Accordingly, utilities of VGAM2421 include diagnosis, prevention and treatment of diseases and clinical conditions associated with LOC138389. LOC145622 (Accession XM_085186) is another VGAM2421 host target gene. LOC145622 BINDING SITE is HOST TARGET binding site found in the 3' untranslated region of mRNA encoded by LOC145622, corresponding to a HOST TARGET binding site such as BINDING SITE I, BINDING SITE II or BINDING SITE III. Table 2 illustrates the complementarity of the nucleotide sequences of LOC145622 BINDING SITE, designated SEQ ID:37916, to the nucleotide sequence of VGAM2421 RNA, herein designated VGAM RNA, also designated SEQ ID:5132.

Another function of VGAM2421 is therefore inhibition of LOC145622 (Accession XM_085186). Accordingly, utilities of VGAM2421 include diagnosis, prevention and treatment of diseases and clinical conditions associated with LOC145622. LOC54499 (Accession XM_047479) is another VGAM2421 host target gene. LOC54499 BINDING SITE is HOST TARGET binding site found in the 3' untranslated region of mRNA encoded by LOC54499, corresponding to a HOST TARGET binding site such as BINDING SITE I, BINDING SITE II or BINDING SITE III. Table 2 illustrates the complementarity of the nucleotide sequences of LOC54499 BINDING SITE, designated SEQ ID:34968, to the nucleotide sequence of VGAM2421 RNA, herein designated VGAM RNA, also designated SEQ ID:5132.

Another function of VGAM2421 is therefore inhibition of LOC54499 (Accession XM_047479). Accordingly, utilities of VGAM2421 include diagnosis, prevention and treatment of diseases and clinical conditions associated with LOC54499. FIG. 1 further provides a conceptual description of a novel bioinformatically detected viral gene of the present invention, referred to here as Viral Genomic Address Messenger 2422 (VGAM2422) viral gene, which modulates expression of respective host target genes thereof, the function and utility of which host target genes is known in the art.

VGAM2422 is a novel bioinformatically detected regulatory, non protein coding, viral micro RNA (miRNA) gene. The method by which VGAM2422 was detected is described hereinabove with reference to FIGS. 1-8.

VGAM2422 gene, herein designated VGAM GENE, is a viral gene contained in the genome of Goatpox Virus. VGAM2422 host target gene, herein designated VGAM HOST TARGET GENE, is a human gene contained in the human genome.

VGAM2422 gene encodes a VGAM2422 precursor RNA, herein designated VGAM PRECURSOR RNA. Similar to other miRNA genes, and unlike most ordinary genes, VGAM2422 precursor RNA does not encode a protein. A nucleotide sequence identical or highly similar to the nucleotide sequence of VGAM2422 precursor RNA is designated SEQ ID:2408, and is provided hereinbelow with reference to the sequence listing part. Nucleotide sequence SEQ ID:2408 is located at position 83441 relative to the genome of Goatpox Virus.

VGAM2422 precursor RNA folds onto itself, forming VGAM2422 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2422 folded precursor RNA into VGAM2422 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2422 RNA is designated SEQ ID:5133, and is provided hereinbelow with reference to the sequence listing part.

VGAM2422 host target gene, herein designated VGAM HOST TARGET GENE, encodes a corresponding messenger RNA, VGAM2422 host target RNA, herein designated VGAM HOST TARGET RNA. VGAM2422 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2422 RNA, herein designated VGAM RNA, binds complementarily to one or more host target binding sites located in untranslated regions of VGAM2422 host target RNA, herein designated VGAM HOST TARGET RNA. This complementary binding is due to the fact that the nucleotide sequence of VGAM2422 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2422 RNA, herein designated VGAM RNA, may have a different number of host target binding sites in untranslated regions of a VGAM2422 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2422 RNA, herein designated VGAM RNA, to host target binding sites on VGAM2422 host target RNA, herein designated VGAM HOST TARGET RNA, such as BINDING SITE I, BINDING SITE II and BINDING SITE III, inhibits translation of VGAM2422 host target RNA into VGAM2422 host target protein, herein designated VGAM HOST TARGET PROTEIN. VGAM host target protein is therefore outlined by a broken line.

It is appreciated that VGAM2422 host target gene, herein designated VGAM HOST TARGET GENE, in fact represents a plurality of VGAM2422 host target genes. The mRNA of each one of this plurality of VGAM2422 host target genes comprises one or more host target binding sites, each having a nucleotide sequence which is at least partly complementary to VGAM2422 RNA, herein designated VGAM RNA, and which when bound by VGAM2422 RNA causes inhibition of translation of respective one or more VGAM2422 host target proteins.

It is further appreciated by one skilled in the art that the mode of translational inhibition illustrated by FIG. 1 with specific reference to translational inhibition exerted by VGAM2422 gene, herein designated VGAM GENE, on one or more VGAM2422 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2422 is inhibition of expression of host target genes, as part of a novel viral mechanism of attacking a host. Accordingly, utilities of VGAM2422 include diagnosis, prevention and treatment of viral infection by Goatpox Virus. Specific functions, and accordingly utilities, of VGAM2422 correlate with, and may be deduced from, the identity of the host target genes which VGAM2422 binds and inhibits, and the function of these host target genes, as elaborated hereinbelow.

Nucleotide sequences of the VGAM2422 precursor RNA, herein designated VGAM PRECURSOR RNA, and of the 'diced' VGAM2422 RNA, herein designated VGAM RNA, and a schematic representation of the secondary folding of VGAM2422 folded precursor RNA, herein designated VGAM FOLDED PRECURSOR RNA, of VGAM2422 are further described hereinbelow with reference to Table 1.

Nucleotide sequences of host target binding sites, such as BINDING SITE-I, BINDING SITE-II and BINDING SITE-III of FIG. 1, found on VGAM2422 host target RNA, and schematic representation of the complementarity of each of these host target binding sites to VGAM2422 RNA, herein designated VGAM RNA, are described hereinbelow with reference to Table 2.

As mentioned hereinabove with reference to FIG. 1, a function of VGAM2422 gene, herein designated VGAM is inhibition of expression of VGAM2422 target genes. It is appreciated that specific functions, and accordingly utilities, of VGAM2422 correlate with, and may be deduced from, the identity of the target genes which VGAM2422 binds and inhibits, and the function of these target genes, as elaborated hereinbelow.

N-ethylmaleimide-sensitive Factor Attachment Protein, Beta (NAPB, Accession XM_046652) is a VGAM2422 host target gene. NAPB BINDING SITE is HOST TARGET binding site found in the 3' untranslated region of mRNA encoded by NAPB, corresponding to a HOST TARGET binding site such as BINDING SITE I, BINDING SITE II or BINDING SITE III. Table 2 illustrates the complementarity of the nucleotide sequences of NAPB BINDING SITE, designated SEQ ID:34765, to the nucleotide sequence of VGAM2422 RNA, herein designated VGAM RNA, also designated SEQ ID:5133.

A function of VGAM2422 is therefore inhibition of N-ethylmaleimide-sensitive Factor Attachment Protein, Beta (NAPB, Accession XM_046652). Accordingly, utilities of VGAM2422 include diagnosis, prevention and treatment of diseases and clinical conditions associated with NAPB. NCK-associated Protein 1 (NCKAP1, Accession NM_013436) is another VGAM2422 host target gene. NCKAP1 BINDING SITE is HOST TARGET binding site found in the 3' untranslated region of mRNA encoded by NCKAP1, corresponding to a HOST TARGET binding site such as BINDING SITE I, BINDING SITE II or BINDING SITE III. Table 2 illustrates the complementarity of the nucleotide sequences of NCKAP1 BINDING SITE, designated SEQ ID:15094, to the nucleotide sequence of VGAM2422 RNA, herein designated VGAM RNA, also designated SEQ ID:5133.

Another function of VGAM2422 is therefore inhibition of NCK-associated Protein 1 (NCKAP1, Accession NM_013436). Accordingly, utilities of VGAM2422 include diagnosis, prevention and treatment of diseases and clinical conditions associated with NCKAP1. ATPase, Class V, Type 10D (ATP10D, Accession XM_054907) is another VGAM2422 host target gene. ATP10D BINDING SITE is HOST TARGET binding site found in the 3" untranslated region of mRNA encoded by ATP10D, corresponding to a HOST TARGET binding site such as BINDING SITE I, BINDING SITE II or BINDING SITE III. Table 2 illustrates the complementarity of the nucleotide sequences of ATP10D BINDING SITE, designated SEQ ID:36199, to the nucleotide sequence of VGAM2422 RNA, herein designated VGAM RNA, also designated SEQ ID:5133.

Another function of VGAM2422 is therefore inhibition of ATPase, Class V, Type 10D (ATP10D, Accession XM_054907). Accordingly, utilities of VGAM2422 include diagnosis, prevention and treatment of diseases and clinical conditions associated with ATP10D. FLJ12085 (Accession NM_022771) is another VGAM2422 host target gene. FLJ12085 BINDING SITE is HOST TARGET binding site found in the 3' untranslated region of mRNA encoded by FLJ12085, corresponding to a HOST TARGET binding site such as BINDING SITE I, BINDING SITE II or BINDING SITE III. Table 2 illustrates the complementarity of the nucleotide sequences of FLJ12085 BINDING SITE, designated SEQ ID:23031, to the nucleotide sequence of VGAM2422 RNA, herein designated VGAM RNA, also designated SEQ ID:5133.

Another function of VGAM2422 is therefore inhibition of FLJ12085 (Accession NM_022771). Accordingly, utilities of VGAM2422 include diagnosis, prevention and treatment of diseases and clinical conditions associated with FLJ12085. SCLY (Accession NM_016510) is another VGAM2422 host target gene. SCLY BINDING SITE is HOST TARGET binding site found in the 3' untranslated region of mRNA encoded by SCLY, corresponding to a HOST TARGET binding site such as BINDING SITE I, BINDING SITE II or BINDING SITE III. Table 2 illustrates the complementarity of the nucleotide sequences of SCLY BINDING SITE, designated SEQ ID:18587, to the nucleotide sequence of VGAM2422 RNA, herein designated VGAM RNA, also designated SEQ ID:5133.

Another function of VGAM2422 is therefore inhibition of SCLY (Accession NM_016510). Accordingly, utilities of VGAM2422 include diagnosis, prevention and treatment of diseases and clinical conditions associated with SCLY. LOC143879 (Accession XM_084666) is another VGAM2422 host target gene. LOC143879 BINDING SITE is HOST TARGET binding site found in the 3' untranslated region of mRNA encoded by LOC143879, corresponding to a HOST TARGET binding site such as BINDING SITE I, BINDING SITE II or BINDING SITE III. Table 2 illustrates the complementarity of the nucleotide sequences of LOC143879 BINDING SITE, designated SEQ ID:37657, to the nucleotide sequence of VGAM2422 RNA, herein designated VGAM RNA, also designated SEQ ID:5133.

Another function of VGAM2422 is therefore inhibition of LOC143879 (Accession XM_084666). Accordingly, utilities of VGAM2422 include diagnosis, prevention and treatment of diseases and clinical conditions associated with LOC143879. FIG. 1 further provides a conceptual description of a novel bioinformatically detected viral gene of the present invention, referred to here as Viral Genomic Address Messenger 2423 (VGAM2423) viral gene, which modulates expression of respective host target genes thereof, the function and utility of which host target genes is known in the art.

VGAM2423 is a novel bioinformatically detected regulatory, non protein coding, viral micro RNA (miRNA) gene. The method by which VGAM2423 was detected is described hereinabove with reference to FIGS. 1-8.

VGAM2423 gene, herein designated VGAM GENE, is a viral gene contained in the genome of Goatpox Virus. VGAM2423 host target gene, herein designated VGAM HOST TARGET GENE, is a human gene contained in the human genome.

VGAM2423 gene encodes a VGAM2423 precursor RNA, herein designated VGAM PRECURSOR RNA. Similar to other miRNA genes, and unlike most ordinary genes, VGAM2423 precursor RNA does not encode a protein. A nucleotide sequence identical or highly similar to the nucleotide sequence of VGAM2423 precursor RNA is designated SEQ ID:2409, and is provided hereinbelow with reference to the sequence listing part. Nucleotide sequence SEQ ID:2409 is located at position 74429 relative to the genome of Goatpox Virus.

VGAM2423 precursor RNA folds onto itself, forming VGAM2423 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2423 folded precursor RNA into VGAM2423 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2423 RNA is designated SEQ ID:5134, and is provided hereinbelow with reference to the sequence listing part.

VGAM2423 host target gene, herein designated VGAM HOST TARGET GENE, encodes a corresponding messenger RNA, VGAM2423 host target RNA, herein designated VGAM HOST TARGET RNA. VGAM2423 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2423 RNA, herein designated VGAM RNA, binds complementarily to one or more host target binding sites located in untranslated regions of VGAM2423 host target RNA, herein designated VGAM HOST TARGET RNA. This complementary binding is due to the fact that the nucleotide sequence of VGAM2423 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2423 RNA, herein designated VGAM RNA, may have a different number of host target binding sites in untranslated regions of a VGAM2423 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2423 RNA, herein designated VGAM RNA, to host target binding sites on VGAM2423 host target RNA, herein designated VGAM HOST TARGET RNA, such as BINDING SITE I, BINDING SITE II and BINDING SITE III, inhibits translation of VGAM2423 host target RNA into VGAM2423 host target protein, herein designated VGAM HOST TARGET PROTEIN. VGAM host target protein is therefore outlined by a broken line.

It is appreciated that VGAM2423 host target gene, herein designated VGAM HOST TARGET GENE, in fact represents a plurality of VGAM2423 host target genes. The mRNA of each one of this plurality of VGAM2423 host target genes comprises one or more host target binding sites, each having a nucleotide sequence which is at least partly complementary to VGAM2423 RNA, herein designated VGAM RNA, and which when bound by VGAM2423 RNA causes inhibition of translation of respective one or more VGAM2423 host target proteins.

It is further appreciated by one skilled in the art that the mode of translational inhibition illustrated by FIG. 1 with specific reference to translational inhibition exerted by VGAM2423 gene, herein designated VGAM GENE, on one or more VGAM2423 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2423 is inhibition of expression of host target genes, as part of a novel viral mechanism of attacking a host. Accordingly, utilities of VGAM2423 include diagnosis, prevention and treatment of viral infection by Goatpox Virus. Specific functions, and accordingly utilities, of VGAM2423 correlate with, and may be deduced from, the identity of the host target genes which VGAM2423 binds and inhibits, and the function of these host target genes, as elaborated hereinbelow.

Nucleotide sequences of the VGAM2423 precursor RNA, herein designated VGAM PRECURSOR RNA, and of the 'diced' VGAM2423 RNA, herein designated VGAM RNA, and a schematic representation of the secondary folding of VGAM2423 folded precursor RNA, herein designated VGAM FOLDED PRECURSOR RNA, of VGAM2423 are further described hereinbelow with reference to Table 1.

Nucleotide sequences of host target binding sites, such as BINDING SITE-I, BINDING SITE-II and BINDING SITE-III of FIG. 1, found on VGAM2423 host target RNA, and schematic representation of the complementarity of each of these host target binding sites to VGAM2423 RNA, herein designated VGAM RNA, are described hereinbelow with reference to Table 2.

As mentioned hereinabove with reference to FIG. 1, a function of VGAM2423 gene, herein designated VGAM is inhibition of expression of VGAM2423 target genes. It is appreciated that specific functions, and accordingly utilities, of VGAM2423 correlate with, and may be deduced from, the identity of the target genes which VGAM2423 binds and inhibits, and the function of these target genes, as elaborated hereinbelow.

Interleukin 17 (cytotoxic T-lymphocyte-associated serine esterase 8) (IL17, Accession NM_002190) is a VGAM2423 host target gene. IL17 BINDING SITE is HOST TARGET binding site found in the 3' untranslated region of mRNA encoded by IL17, corresponding to a HOST TARGET binding site such as BINDING SITE I, BINDING SITE II or BINDING SITE III. Table 2 illustrates the complementarity of the nucleotide sequences of IL17 BINDING SITE, designated SEQ ID:7947, to the nucleotide sequence of VGAM2423 RNA, herein designated VGAM RNA, also designated SEQ ID:5134.

A function of VGAM2423 is therefore inhibition of Interleukin 17 (cytotoxic T-lymphocyte-associated serine esterase 8) (IL17, Accession NM_002190), a gene which induces stromal cells to produce proinflammatory and hematopoietic cytokines. Accordingly, utilities of VGAM2423 include diagnosis, prevention and treatment of diseases and clinical conditions associated with IL17. The function of IL17 has been established by previous studies. Rouvier et al. (1993) used subtractive library screening to isolate a novel rodent gene, termed CTLA8, that was expressed specifically in cytotoxic T cells. Although Rouvier et al. (1993) described CTLA8 as a mouse gene, Kennedy et al. (1996) showed that it is actually the rat IL17 homolog. Rouvier et al. (1993) noted that the CTLA8 polypeptide sequence is 56.8% identical to that of the immediate-early gene 13 of Herpesvirus saimiri (OMIM Ref. No. HVS-13). The CTLA8 3-prime untranslated region contains AU-rich repeats typically found in the mRNA of cytokines and growth factors. Yao et al. (1995) cloned a human IL17 cDNA. The cDNA encodes a 155-amino acid polypeptide that contains an N-terminal hydrophobic signal sequence. Northern blot analysis revealed that the gene is expressed as a 1.9-kb mRNA in stimulated, but not resting, T cells; the transcript could not be detected in any human tissues. Expressed recombinant IL17 was secreted in both glycosylated and nonglycosylated forms. IL17 protein applied to fibroblasts induced the production of IL6 (OMIM Ref. No. 147620) and IL8 (OMIM Ref. No. 146930) and enhanced surface expression of intracellular adhesion molecule-1 (ICAM1; 147840).

Full details of the abovementioned studies are described in the following publications, the disclosure of which are hereby incorporated by reference:

Kennedy, J.; Rossi, D. L.; Zurawski, S. M.; Vega, F., JR.: Kastelein, R. A.; Wagner, J. L.; Hannum, C. H.; Zlotnick, A.: Mouse IL-17: a cytokine preferentially expressed by alpha beta TCR + CD4-CD8-T cells. J. Interferon Cytokine Res. 16:611-617, 1996; and Yao, Z.; Painter, S. L.; Fanslow, W. C.; Ulrich, D.; Macduff, B. M.; Spriggs, M. K.; Armitage, R. J.: Human IL-17: a novel cytokine derived from T cells. J. Immun. 155:5483-5486, 1995.

Further studies establishing the function and utilities of IL17 are found in John Hopkins OMIM database record ID 603149, and in sited publications numbered 5428-5431 listed in the bibliography section hereinbelow, which are also hereby incorporated by reference. FK506 Binding Protein 5 (FKBP5, Accession NM_004117) is another VGAM2423 host target gene. FKBP5 BINDING SITE is HOST TARGET binding site found in the 3' untranslated region of mRNA encoded by FKBP5, corresponding to a HOST TARGET binding site such as BINDING SITE I, BINDING SITE II or BINDING SITE III. Table 2 illustrates the complementarity of the nucleotide sequences of FKBP5 BINDING SITE, designated SEQ ID:10326, to the nucleotide sequence of VGAM2423 RNA, herein designated VGAM RNA, also designated SEQ ID:5134.

Another function of VGAM2423 is therefore inhibition of FK506 Binding Protein 5 (FKBP5, Accession NM_004117). Accordingly, utilities of VGAM2423 include diagnosis, prevention and treatment of diseases and clinical conditions associated with FKBP5. KIAA1383 (Accession XM_045859) is another VGAM2423 host target gene. KIAA1383 BINDING SITE is HOST TARGET binding site found in the 3' untranslated region of mRNA encoded by KIAA1383, corresponding to a HOST TARGET binding site such as BINDING SITE I, BINDING SITE II or BINDING SITE III. Table 2 illustrates the complementarity of the nucleotide sequences of KIAA1383 BINDING SITE, designated SEQ ID:34584, to the nucleotide sequence of VGAM2423 RNA, herein designated VGAM RNA, also designated SEQ ID:5134.

Another function of VGAM2423 is therefore inhibition of KIAA1383 (Accession XM_045859). Accordingly, utilities of VGAM2423 include diagnosis, prevention and treatment of diseases and clinical conditions associated with KIAA1383. Phospholipase A2, Group III (PLA2G3, Accession NM_015715) is another VGAM2423 host target gene. PLA2G3 BINDING SITE is HOST TARGET binding site found in the 3' untranslated region of mRNA encoded by PLA2G3, corresponding to a HOST TARGET binding site such as BINDING SITE I, BINDING SITE II or BINDING SITE III. Table 2 illustrates the complementarity of the nucleotide sequences of PLA2G3 BINDING SITE, designated SEQ ID:17929, to the nucleotide sequence of VGAM2423 RNA, herein designated VGAM RNA, also designated SEQ ID:5134.

Another function of VGAM2423 is therefore inhibition of Phospholipase A2, Group III (PLA2G3, Accession NM_015715). Accordingly, utilities of VGAM2423 include diagnosis, prevention and treatment of diseases and clinical conditions associated with PLA2G3. LOC120103 (Accession XM_058449) is another VGAM2423 host target gene. LOC120103 BINDING SITE is HOST TARGET binding site found in the 3' untranslated region of mRNA encoded by LOC120103, corresponding to a HOST TARGET binding site such as BINDING SITE I, BINDING SITE II or BINDING SITE III. Table 2 illustrates the complementarity of the nucleotide sequences of LOC120103 BINDING SITE, designated SEQ ID:36618, to the nucleotide sequence of VGAM2423 RNA, herein designated VGAM RNA, also designated SEQ ID:5134.

Another function of VGAM2423 is therefore inhibition of LOC120103 (Accession XM_058449). Accordingly, utilities of VGAM2423 include diagnosis, prevention and treatment of diseases and clinical conditions associated with LOC120103. FIG. 1 further provides a conceptual description of a novel bioinformatically detected viral gene of the present invention, referred to here as Viral Genomic Address Messenger 2424 (VGAM2424) viral gene, which modulates expression of respective host target genes thereof, the function and utility of which host target genes is known in the art.

VGAM2424 is a novel bioinformatically detected regulatory, non protein coding, viral micro RNA (miRNA) gene. The method by which VGAM2424 was detected is described hereinabove with reference to FIGS. 1-8.

VGAM2424 gene, herein designated VGAM GENE, is a viral gene contained in the genome of Goatpox Virus. VGAM2424 host target gene, herein designated VGAM HOST TARGET GENE, is a human gene contained in the human genome.

VGAM2424 gene encodes a VGAM2424 precursor RNA, herein designated VGAM PRECURSOR RNA. Similar to other miRNA genes, and unlike most ordinary genes, VGAM2424 precursor RNA does not encode a protein. A nucleotide sequence identical or highly similar to the nucleotide sequence of VGAM2424 precursor RNA is designated SEQ ID:2410, and is provided hereinbelow with reference to the sequence listing part. Nucleotide sequence SEQ ID:2410 is located at position 134679 relative to the genome of Goatpox Virus.

VGAM2424 precursor RNA folds onto itself, forming VGAM2424 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2424 folded precursor RNA into VGAM2424 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM2424 RNA is designated SEQ ID:5135, and is provided hereinbelow with reference to the sequence listing part.

VGAM2424 host target gene, herein designated VGAM HOST TARGET GENE, encodes a corresponding messenger RNA, VGAM2424 host target RNA, herein designated VGAM HOST TARGET RNA. VGAM2424 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2424 RNA, herein designated VGAM RNA, binds complementarily to one or more host target binding sites located in untranslated regions of VGAM2424 host target RNA, herein designated VGAM HOST TARGET RNA. This complementary binding is due to the fact that the nucleotide sequence of VGAM2424 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2424 RNA, herein designated VGAM RNA, may have a different number of host target binding sites in untranslated regions of a VGAM2424 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2424 RNA, herein designated VGAM RNA, to host target binding sites on VGAM2424 host target RNA, herein designated VGAM HOST TARGET RNA, such as BINDING SITE I, BINDING SITE II and BINDING SITE III, inhibits translation of VGAM2424 host target RNA into VGAM2424 host target protein, herein designated VGAM HOST TARGET PROTEIN. VGAM host target protein is therefore outlined by a broken line.

It is appreciated that VGAM2424 host target gene, herein designated VGAM HOST TARGET GENE, in fact represents a plurality of VGAM2424 host target genes. The mRNA of each one of this plurality of VGAM2424 host target genes comprises one or more host target binding sites, each having a nucleotide sequence which is at least partly complementary to VGAM2424 RNA, herein designated VGAM RNA, and which when bound by VGAM2424 RNA causes inhibition of translation of respective one or more VGAM2424 host target proteins.

It is further appreciated by one skilled in the art that the mode of translational inhibition illustrated by FIG. 1 with specific reference to translational inhibition exerted by VGAM2424 gene, herein designated VGAM GENE, on one or more VGAM2424 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2424 is inhibition of expression of host target genes, as part of a novel viral mechanism of attacking a host. Accordingly, utilities of VGAM2424 include diagnosis, prevention and treatment of viral infection by Goatpox Virus. Specific functions, and accordingly utilities, of VGAM2424 correlate with, and may be deduced from, the identity of the host target genes which VGAM2424 binds and inhibits, and the function of these host target genes, as elaborated hereinbelow.

Nucleotide sequences of the VGAM2424 precursor RNA, herein designated VGAM PRECURSOR RNA, and of the 'diced' VGAM2424 RNA, herein designated VGAM RNA, and a schematic representation of the secondary folding of VGAM2424 folded precursor RNA, herein designated VGAM FOLDED PRECURSOR RNA, of VGAM2424 are further described hereinbelow with reference to Table 1.

Nucleotide sequences of host target binding sites, such as BINDING SITE-I, BINDING SITE-II and BINDING SITE-III of FIG. 1, found on VGAM2424 host target RNA, and schematic representation of the complementarity of each of these host target binding sites to VGAM2424 RNA, herein designated VGAM RNA, are described hereinbelow with reference to Table 2.

As mentioned hereinabove with reference to FIG. 1, a function of VGAM2424 gene, herein designated VGAM is inhibition of expression of VGAM2424 target genes. It is appreciated that specific functions, and accordingly utilities, of VGAM2424 correlate with, and may be deduced from, the identity of the target genes which VGAM2424 binds and inhibits, and the function of these target genes, as elaborated hereinbelow.

Exostoses (multiple) 2 (EXT2, Accession NM_000401) is a VGAM2424 host target gene. EXT2 BINDING SITE is HOST TARGET binding site found in the 3' untranslated region of mRNA encoded by EXT2, corresponding to a HOST TARGET binding site such as BINDING SITE I, BINDING SITE II or BINDING SITE III. Table 2 illustrates the complementarity of the nucleotide sequences of EXT2 BINDING SITE, designated SEQ ID:5977, to the nucleotide sequence of VGAM2424 RNA, herein designated VGAM RNA, also designated SEQ ID:5135.

A function of VGAM2424 is therefore inhibition of Exostoses (multiple) 2 (EXT2, Accession NM_000401). Accordingly, utilities of VGAM2424 include diagnosis, prevention and treatment of diseases and clinical conditions associated with EXT2. FLJ23047 (Accession NM_024548) is another VGAM2424 host target gene. FLJ23047 BINDING SITE is HOST TARGET binding site found in the 3' untranslated region of mRNA encoded by FLJ23047, corresponding to a HOST TARGET binding site such as BINDING SITE I, BINDING SITE II or BINDING SITE III. Table 2 illustrates the complementarity of the nucleotide sequences of FLJ23047 BINDING SITE, designated SEQ ID:23761, to the nucleotide sequence of VGAM2424 RNA, herein designated VGAM RNA, also designated SEQ ID:5135.

Another function of VGAM2424 is therefore inhibition of FLJ23047 (Accession NM_024548). Accordingly, utilities of VGAM2424 include diagnosis, prevention and treatment of diseases and clinical conditions associated with FLJ23047. Hect Domain and RLD 3 (HERC3, Accession NM_014606) is another VGAM2424 host target gene. HERC3 BINDING SITE is HOST TARGET binding site found in the 3' untranslated region of mRNA encoded by HERC3, corresponding to a HOST TARGET binding site such as BINDING SITE I, BINDING SITE II or BINDING SITE III. Table 2 illustrates the complementarity of the nucleotide sequences of HERC3 BINDING SITE, designated SEQ ID:15970, to the nucleotide sequence of VGAM2424 RNA, herein designated VGAM RNA, also designated SEQ ID:5135.

Another function of VGAM2424 is therefore inhibition of Hect Domain and RLD 3 (HERC3, Accession NM_014606). Accordingly, utilities of VGAM2424 include diagnosis, prevention and treatment of diseases and clinical conditions associated with HERC3. LOC200933 (Accession XM_117294) is another VGAM2424 host target gene. LOC200933 BINDING SITE is HOST TARGET binding site found in the 3' untranslated region of mRNA encoded by LOC200933, corresponding to a HOST TARGET binding site such as BINDING SITE I, BINDING SITE II or BINDING SITE III. Table 2 illustrates the complementarity of the nucleotide sequences of LOC200933 BINDING SITE, designated SEQ ID:43361, to the nucleotide sequence of VGAM2424 RNA, herein designated VGAM RNA, also designated SEQ ID:5135.

Another function of VGAM2424 is therefore inhibition of LOC200933 (Accession XM_117294). Accordingly, utilities of VGAM2424 include diagnosis, prevention and treatment of diseases and clinical conditions associated with LOC200933. FIG. 1 further provides a conceptual description of a novel bioinformatically detected viral gene of the present invention, referred to here as Viral Genomic Address Messenger 2425 (VGAM2425) viral gene, which modulates expression of respective host target genes thereof, the function and utility of which host target genes is known in the art.

VGAM2425 is a novel bioinformatically detected regulatory, non protein coding, viral micro RNA (miRNA) gene. The method by which VGAM2425 was detected is described hereinabove with reference to FIGS. 1-8.

VGAM2425 gene, herein designated VGAM GENE, is a viral gene contained in the genome of Goatpox Virus. VGAM2425 host target gene, herein designated VGAM HOST TARGET GENE, is a human gene contained in the human genome.

VGAM2425 gene encodes a VGAM2425 precursor RNA, herein designated VGAM PRECURSOR RNA. Similar to other miRNA genes, and unlike most ordinary genes, VGAM2425 precursor RNA does not encode a protein. A nucleotide sequence identical or highly similar to the nucleotide sequence of VGAM2425 precursor RNA is designated SEQ ID:2411, and is provided hereinbelow with reference to the sequence listing part. Nucleotide sequence SEQ ID:2411 is located at position 148298 relative to the genome of Goatpox Virus.

VGAM2425 precursor RNA folds onto itself, forming VGAM2425 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2425 folded precursor RNA into VGAM2425 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2425 RNA is designated SEQ ID:5136, and is provided hereinbelow with reference to the sequence listing part.

VGAM2425 host target gene, herein designated VGAM HOST TARGET GENE, encodes a corresponding messenger RNA, VGAM2425 host target RNA, herein designated VGAM HOST TARGET RNA. VGAM2425 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2425 RNA, herein designated VGAM RNA, binds complementarily to one or more host target binding sites located in untranslated regions of VGAM2425 host target RNA, herein designated VGAM HOST TARGET RNA. This complementary binding is due to the fact that the nucleotide sequence of VGAM2425 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2425 RNA, herein designated VGAM RNA, may have a different number of host target binding sites in untranslated regions of a VGAM2425 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2425 RNA, herein designated VGAM RNA, to host target binding sites on VGAM2425 host target RNA, herein designated VGAM HOST TARGET RNA, such as BINDING SITE I, BINDING SITE II and BINDING SITE III, inhibits translation of VGAM2425 host target RNA into VGAM2425 host target protein, herein designated VGAM HOST TARGET PROTEIN. VGAM host target protein is therefore outlined by a broken line.

It is appreciated that VGAM2425 host target gene, herein designated VGAM HOST TARGET GENE, in fact represents a plurality of VGAM2425 host target genes. The mRNA of each one of this plurality of VGAM2425 host target genes comprises one or more host target binding sites, each having a nucleotide sequence which is at least partly complementary to VGAM2425 RNA, herein designated VGAM RNA, and which when bound by VGAM2425 RNA causes inhibition of translation of respective one or more VGAM2425 host target proteins.

It is further appreciated by one skilled in the art that the mode of translational inhibition illustrated by FIG. 1 with specific reference to translational inhibition exerted by VGAM2425 gene, herein designated VGAM GENE, on one or more VGAM2425 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2425 is inhibition of expression of host target genes, as part of a novel viral mechanism of attacking a host. Accordingly, utilities of VGAM2425 include diagnosis, prevention and treatment of viral infection by Goatpox Virus. Specific functions, and accordingly utilities, of VGAM2425 correlate with, and may be deduced from, the identity of the host target genes which VGAM2425 binds and inhibits, and the function of these host target genes, as elaborated hereinbelow.

Nucleotide sequences of the VGAM2425 precursor RNA, herein designated VGAM PRECURSOR RNA, and of the 'diced' VGAM2425 RNA, herein designated VGAM RNA, and a schematic representation of the secondary folding of VGAM2425 folded precursor RNA, herein designated VGAM FOLDED PRECURSOR RNA, of VGAM2425 are further described hereinbelow with reference to Table 1.

Nucleotide sequences of host target binding sites, such as BINDING SITE-I, BINDING SITE-II and BINDING SITE-III of FIG. 1, found on VGAM2425 host target RNA, and schematic representation of the complementarity of each of these host target binding sites to VGAM2425 RNA, herein designated VGAM RNA, are described hereinbelow with reference to Table 2.

As mentioned hereinabove with reference to FIG. 1, a function of VGAM2425 gene, herein designated VGAM is inhibition of expression of VGAM2425 target genes. It is appreciated that specific functions, and accordingly utilities, of VGAM2425 correlate with, and may be deduced from, the identity of the target genes which VGAM2425 binds and inhibits, and the function of these target genes, as elaborated hereinbelow.

Carbonic Anhydrase III, Muscle Specific (CA3, Accession NM_005181) is a VGAM2425 host target gene. CA3 BINDING SITE is HOST TARGET binding site found in the 3' untranslated region of mRNA encoded by CA3, corresponding to a HOST TARGET binding site such as BINDING SITE I, BINDING SITE II or BINDING SITE III. Table 2 illustrates the complementarity of the nucleotide sequences of CA3 BINDING SITE, designated SEQ ID:11679, to the nucleotide sequence of VGAM2425 RNA, herein designated VGAM RNA, also designated SEQ ID:5136.

A function of VGAM2425 is therefore inhibition of Carbonic Anhydrase III, Muscle Specific (CA3, Accession NM_005181), a gene which has a muscle-specific function of reversible hydratation of carbon dioxide. Accordingly, utilities of VGAM2425 include diagnosis, prevention and treatment of diseases and clinical conditions associated with CA3. The function of CA3 and its association with various diseases and clinical conditions, has been established by previous studies, as described hereinabove with reference to VGAM1911. Fas (TNFRSF6)-associated Via Death Domain (FADD, Accession NM_003824) is another VGAM2425 host target gene. FADD BINDING SITE is HOST TARGET binding site found in the 3' untranslated region of mRNA encoded by FADD, corresponding to a HOST TARGET binding site such as BINDING SITE I, BINDING SITE II or BINDING SITE III. Table 2 illustrates the complementarity of the nucleotide sequences of FADD BINDING SITE, designated SEQ ID:9917, to the nucleotide sequence of VGAM2425 RNA, herein designated VGAM RNA, also designated SEQ ID:5136.

Another function of VGAM2425 is therefore inhibition of Fas (TNFRSF6)-associated Via Death Domain (FADD, Accession NM_003824), a gene which may play an important role in the proximal signal transduction of FAS. Accordingly, utilities of VGAM2425 include diagnosis, prevention and treatment of diseases and clinical conditions associated with FADD. The function of FADD and its association with various diseases and clinical conditions, has been established by previous studies, as described hereinabove with reference to VGAM995. DKFZP547E2110 (Accession XM_165676) is another VGAM2425 host target gene. DKFZP547E2110 BINDING SITE is HOST TARGET binding site found in the 3' untranslated region of mRNA encoded by DKFZP547E2110, corresponding to a HOST TARGET binding site such as BINDING SITE I, BINDING SITE II or BINDING SITE III. Table 2 illustrates the complementarity of the nucleotide sequences of DKFZP547E2110 BINDING SITE, designated SEQ ID:43732, to the nucleotide sequence of VGAM2425 RNA, herein designated VGAM RNA, also designated SEQ ID:5136.

Another function of VGAM2425 is therefore inhibition of DKFZP547E2110 (Accession XM_165676). Accordingly, utilities of VGAM2425 include diagnosis, prevention and treatment of diseases and clinical conditions associated with DKFZP547E2110. KIAA0767 (Accession XM_027105) is another VGAM2425 host target gene. KIAA0767 BINDING SITE is HOST TARGET binding site found in the 3' untranslated region of mRNA encoded by KIAA0767, corresponding to a HOST TARGET binding site such as BINDING SITE I, BINDING SITE II or BINDING SITE III. Table 2 illustrates the complementarity of the nucleotide sequences of KIAA0767 BINDING SITE, designated SEQ ID:30409, to the nucleotide sequence of VGAM2425 RNA, herein designated VGAM RNA, also designated SEQ ID:5136.

Another function of VGAM2425 is therefore inhibition of KIAA0767 (Accession XM_027105). Accordingly, utilities of VGAM2425 include diagnosis, prevention and treatment of diseases and clinical conditions associated with KIAA0767. KIAA1464 (Accession XM_043069) is another VGAM2425 host target gene. KIAA1464 BINDING SITE is HOST TARGET binding site found in the 3' untranslated region of mRNA encoded by KIAA1464, corresponding to a HOST TARGET binding site such as BINDING SITE I, BINDING SITE II or BINDING SITE III. Table 2 illustrates the complementarity of the nucleotide sequences of KIAA1464 BINDING SITE, designated SEQ ID:33886, to the nucleotide sequence of VGAM2425 RNA, herein designated VGAM RNA, also designated SEQ ID:5136.

Another function of VGAM2425 is therefore inhibition of KIAA1464 (Accession XM_043069). Accordingly, utilities of VGAM2425 include diagnosis, prevention and treatment of diseases and clinical conditions associated with KIAA1464. LOC122830 (Accession XM_058661) is another VGAM2425 host target gene. LOC122830 BINDING SITE is HOST TARGET binding site found in the 3' untranslated region of mRNA encoded by LOC122830, corresponding to a HOST TARGET binding site such as BINDING SITE I, BINDING SITE II or BINDING SITE III. Table 2 illustrates the complementarity of the nucleotide sequences of LOC122830 BINDING SITE, designated SEQ ID:36709, to the nucleotide sequence of VGAM2425 RNA, herein designated VGAM RNA, also designated SEQ ID:5136.

Another function of VGAM2425 is therefore inhibition of LOC122830 (Accession XM_058661). Accordingly, utilities of VGAM2425 include diagnosis, prevention and treatment of diseases and clinical conditions associated with LOC122830. LOC144481 (Accession XM_096611) is another VGAM2425 host target gene. LOC144481 BINDING SITE is HOST TARGET binding site found in the 3' untranslated region of mRNA encoded by LOC144481, corresponding to a HOST TARGET binding site such as BINDING SITE I, BINDING SITE II or BINDING SITE III. Table 2 illustrates the complementarity of the nucleotide sequences of LOC144481 BINDING SITE, designated SEQ ID:40419, to the nucleotide sequence of VGAM2425 RNA, herein designated VGAM RNA, also designated SEQ ID:5136.

Another function of VGAM2425 is therefore inhibition of LOC144481 (Accession XM_096611). Accordingly, utilities of VGAM2425 include diagnosis, prevention and treatment of diseases and clinical conditions associated with LOC144481. LOC144501 (Accession XM_096612) is another VGAM2425 host target gene. LOC144501 BINDING SITE is HOST TARGET binding site found in the 3' untranslated region of mRNA encoded by LOC144501, corresponding to a HOST TARGET binding site such as BINDING SITE I, BINDING SITE II or BINDING SITE III. Table 2 illustrates the complementarity of the nucleotide sequences of LOC144501 BINDING SITE, designated SEQ ID:40421, to the nucleotide sequence of VGAM2425 RNA, herein designated VGAM RNA, also designated SEQ ID:5136.

Another function of VGAM2425 is therefore inhibition of LOC144501 (Accession XM_096612). Accordingly, utilities of VGAM2425 include diagnosis, prevention and treatment of diseases and clinical conditions associated with LOC144501. LOC168667 (Accession XM_166592) is another VGAM2425 host target gene. LOC168667 BINDING SITE is HOST TARGET binding site found in the 3' untranslated region of mRNA encoded by LOC168667, corresponding to a HOST TARGET binding site such as BINDING SITE I, BINDING SITE II or BINDING SITE III. Table 2 illustrates the complementarity of the nucleotide sequences of LOC168667 BINDING SITE, designated SEQ ID:44564, to the nucleotide sequence of VGAM2425 RNA, herein designated VGAM RNA, also designated SEQ ID:5136.

Another function of VGAM2425 is therefore inhibition of LOC168667 (Accession XM_166592). Accordingly, utilities of VGAM2425 include diagnosis, prevention and treatment of diseases and clinical conditions associated with LOC168667. LOC254045 (Accession XM_172882) is another VGAM2425 host target gene. LOC254045 BINDING SITE is HOST TARGET binding site found in the 3' untranslated region of mRNA encoded by LOC254045, corresponding to a HOST TARGET binding site such as BINDING SITE I, BINDING SITE II or BINDING SITE III. Table 2 illustrates the complementarity of the nucleotide sequences of LOC254045 BINDING SITE, designated SEQ ID:46161, to the nucleotide sequence of VGAM2425 RNA, herein designated VGAM RNA, also designated SEQ ID:5136.

Another function of VGAM2425 is therefore inhibition of LOC254045 (Accession XM_172882). Accordingly, utilities of VGAM2425 include diagnosis, prevention and treatment of diseases and clinical conditions associated with LOC254045. LOC51068 (Accession NM_015938) is another VGAM2425 host target gene. LOC51068 BINDING SITE is HOST TARGET binding site found in the 3' untranslated region of mRNA encoded by LOC51068, corresponding to a HOST TARGET binding site such as BINDING SITE I, BINDING SITE II or BINDING SITE III. Table 2 illustrates the complementarity of the nucleotide sequences of LOC51068 BINDING SITE, designated SEQ ID:18058, to the nucleotide sequence of VGAM2425 RNA, herein designated VGAM RNA, also designated SEQ ID:5136.

Another function of VGAM2425 is therefore inhibition of LOC51068 (Accession NM_015938). Accordingly, utilities of VGAM2425 include diagnosis, prevention and treatment of diseases and clinical conditions associated with LOC51068. FIG. 1 further provides a conceptual description of a novel bioinformatically detected viral gene of the present invention, referred to here as Viral Genomic Address Messenger 2426 (VGAM2426) viral gene, which modulates expression of respective host target genes thereof, the function and utility of which host target genes is known in the art.

VGAM2426 is a novel bioinformatically detected regulatory, non protein coding, viral micro RNA (miRNA) gene. The method by which VGAM2426 was detected is described hereinabove with reference to FIGS. 1-8.

VGAM2426 gene, herein designated VGAM GENE, is a viral gene contained in the genome of Goatpox Virus. VGAM2426 host target gene, herein designated VGAM HOST TARGET GENE, is a human gene contained in the human genome.

VGAM2426 gene encodes a VGAM2426 precursor RNA, herein designated VGAM PRECURSOR RNA. Similar to other miRNA genes, and unlike most ordinary genes, VGAM2426 precursor RNA does not encode a protein. A nucleotide sequence identical or highly similar to the nucleotide sequence of VGAM2426 precursor RNA is designated SEQ ID:2412, and is provided hereinbelow with reference to the sequence listing part. Nucleotide sequence SEQ ID:2412 is located at position 51036 relative to the genome of Goatpox Virus.

VGAM2426 precursor RNA folds onto itself, forming VGAM2426 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2426 folded precursor RNA into VGAM2426 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM2426 RNA is designated SEQ ID:5137, and is provided hereinbelow with reference to the sequence listing part.

VGAM2426 host target gene, herein designated VGAM HOST TARGET GENE, encodes a corresponding messenger RNA, VGAM2426 host target RNA, herein designated VGAM HOST TARGET RNA. VGAM2426 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2426 RNA, herein designated VGAM RNA, binds complementarily to one or more host target binding sites located in untranslated regions of VGAM2426 host target RNA, herein designated VGAM HOST TARGET RNA. This complementary binding is due to the fact that the nucleotide sequence of VGAM2426 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2426 RNA, herein designated VGAM RNA, may have a different number of host target binding sites in untranslated regions of a VGAM2426 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2426 RNA, herein designated VGAM RNA, to host target binding sites on VGAM2426 host target RNA, herein designated VGAM HOST TARGET RNA, such as BINDING SITE I, BINDING SITE II and BINDING SITE III, inhibits translation of VGAM2426 host target RNA into VGAM2426 host target protein, herein designated VGAM HOST TARGET PROTEIN. VGAM host target protein is therefore outlined by a broken line.

It is appreciated that VGAM2426 host target gene, herein designated VGAM HOST TARGET GENE, in fact represents a plurality of VGAM2426 host target genes. The mRNA of each one of this plurality of VGAM2426 host target genes comprises one or more host target binding sites, each having a nucleotide sequence which is at least partly complementary to VGAM2426 RNA, herein designated VGAM RNA, and which when bound by VGAM2426 RNA causes inhibition of translation of respective one or more VGAM2426 host target proteins.

It is further appreciated by one skilled in the art that the mode of translational inhibition illustrated by FIG. 1 with specific reference to translational inhibition exerted by VGAM2426 gene, herein designated VGAM GENE, on one or more VGAM2426 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2426 is inhibition of expression of host target genes, as part of a novel viral mechanism of attacking a host. Accordingly, utilities of VGAM2426 include diagnosis, prevention and treatment of viral infection by Goatpox Virus. Specific functions, and accordingly utilities, of VGAM2426 correlate with, and may be deduced from, the identity of the host target genes which VGAM2426 binds and inhibits, and the function of these host target genes, as elaborated hereinbelow.

Nucleotide sequences of the VGAM2426 precursor RNA, herein designated VGAM PRECURSOR RNA, and of the 'diced' VGAM2426 RNA, herein designated VGAM RNA, and a schematic representation of the secondary folding of VGAM2426 folded precursor RNA, herein designated VGAM FOLDED PRECURSOR RNA, of VGAM2426 are further described hereinbelow with reference to Table 1.

Nucleotide sequences of host target binding sites, such as BINDING SITE-I, BINDING SITE-II and BINDING SITE-III of FIG. 1, found on VGAM2426 host target RNA, and schematic representation of the complementarity of each of these host target binding sites to VGAM2426 RNA, herein designated VGAM RNA, are described hereinbelow with reference to Table 2.

As mentioned hereinabove with reference to FIG. 1, a function of VGAM2426 gene, herein designated VGAM is inhibition of expression of VGAM2426 target genes. It is appreciated that specific functions, and accordingly utilities, of VGAM2426 correlate with, and may be deduced from, the identity of the target genes which VGAM2426 binds and inhibits, and the function of these target genes, as elaborated hereinbelow.

Archain 1 (ARCN1, Accession NM_001655) is a VGAM2426 host target gene. ARCN1 BINDING SITE is HOST TARGET binding site found in the 3' untranslated region of mRNA encoded by ARCN1, corresponding to a HOST TARGET binding site such as BINDING SITE I, BINDING SITE II or BINDING SITE III. Table 2 illustrates the complementarity of the nucleotide sequences of ARCN1 BINDING SITE, designated SEQ ID:7366, to the nucleotide sequence of VGAM2426 RNA, herein designated VGAM RNA, also designated SEQ ID:5137.

A function of VGAM2426 is therefore inhibition of Archain 1 (ARCN1, Accession NM_001655), a gene which plays a fundamental role in eukaryotic cell biology. Accordingly, utilities of VGAM2426 include diagnosis, prevention and treatment of diseases and clinical conditions associated with ARCN1. The function of ARCN1 and its association with various diseases and clinical conditions, has been established by previous studies, as described hereinabove with reference to VGAM1226. Retinoblastoma 1 (including osteosarcoma) (RB1, Accession XM_165641) is another VGAM2426 host target gene. RB1 BINDING SITE is HOST TARGET binding site found in the 3' untranslated region of mRNA encoded by RB1, corresponding to a HOST TARGET binding site such as BINDING SITE I, BINDING SITE II or BINDING SITE III. Table 2 illustrates the complementarity of the nucleotide sequences of RB1 BINDING SITE, designated SEQ ID:43704, to the nucleotide sequence of VGAM2426 RNA, herein designated VGAM RNA, also designated SEQ ID:5137.

Another function of VGAM2426 is therefore inhibition of Retinoblastoma 1 (including osteosarcoma) (RB1, Accession XM_165641), a gene which probably acts as a regulator of other genes. Accordingly, utilities of VGAM2426 include diagnosis, prevention and treatment of diseases and clinical conditions associated with RB1. The function of RB1 and its association with various diseases and clinical conditions, has been established by previous studies, as described hereinabove with reference to VGAM795. MCJ (Accession NM_013238) is another VGAM2426 host target gene. MCJ BINDING SITE is HOST TARGET binding site found in the 5' untranslated region of mRNA encoded by MCJ, corresponding to a HOST TARGET binding site such as BINDING SITE I, BINDING SITE II or BINDING SITE III. Table 2 illustrates the complementarity of the nucleotide sequences of MCJ BINDING SITE, designated SEQ ID:14898, to the nucleotide sequence of VGAM2426 RNA, herein designated VGAM RNA, also designated SEQ ID:5137.

Another function of VGAM2426 is therefore inhibition of MCJ (Accession NM_013238). Accordingly, utilities of VGAM2426 include diagnosis, prevention and treatment of diseases and clinical conditions associated with MCJ. PLU-1 (Accession XM_113375) is another VGAM2426 host target gene. PLU-1 BINDING SITE1 and PLU-1 BINDING SITE2 are HOST TARGET binding sites found in untranslated regions of mRNA encoded by PLU-1, corresponding to HOST TARGET binding sites such as BINDING SITE I, BINDING SITE II or BINDING SITE III. Table 2 illustrates the complementarity of the nucleotide sequences of PLU-1 BINDING SITE1 and PLU-1 BINDING SITE2, designated SEQ ID:42251 and SEQ ID:13402 respectively, to the nucleotide sequence of VGAM2426 RNA, herein designated VGAM RNA, also designated SEQ ID:5137.

Another function of VGAM2426 is therefore inhibition of PLU-1 (Accession XM_113375). Accordingly, utilities of VGAM2426 include diagnosis, prevention and treatment of diseases and clinical conditions associated with PLU-1. FIG. 1 further provides a conceptual description of a novel bioinformatically detected viral gene of the present invention, referred to here as Viral Genomic Address Messenger 2427 (VGAM2427) viral gene, which modulates expression of respective host target genes thereof, the function and utility of which host target genes is known in the art.

VGAM2427 is a novel bioinformatically detected regulatory, non protein coding, viral micro RNA (miRNA) gene. The method by which VGAM2427 was detected is described hereinabove with reference to FIGS. 1-8.

VGAM2427 gene, herein designated VGAM GENE, is a viral gene contained in the genome of Goatpox Virus. VGAM2427 host target gene, herein designated VGAM HOST TARGET GENE, is a human gene contained in the human genome.

VGAM2427 gene encodes a VGAM2427 precursor RNA, herein designated VGAM PRECURSOR RNA. Similar to other miRNA genes, and unlike most ordinary genes, VGAM2427 precursor RNA does not encode a protein. A nucleotide sequence identical or highly similar to the nucleotide sequence of VGAM2427 precursor RNA is designated SEQ ID:2413, and is provided hereinbelow with reference to the sequence listing part. Nucleotide sequence SEQ ID:2413 is located at position 48019 relative to the genome of Goatpox Virus.

VGAM2427 precursor RNA folds onto itself, forming VGAM2427 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2427 folded precursor RNA into VGAM2427 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2427 RNA is designated SEQ ID:5138, and is provided hereinbelow with reference to the sequence listing part.

VGAM2427 host target gene, herein designated VGAM HOST TARGET GENE, encodes a corresponding messenger RNA, VGAM2427 host target RNA, herein designated VGAM HOST TARGET RNA. VGAM2427 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2427 RNA, herein designated VGAM RNA, binds complementarily to one or more host target binding sites located in untranslated regions of VGAM2427 host target RNA, herein designated VGAM HOST TARGET RNA. This complementary binding is due to the fact that the nucleotide sequence of VGAM2427 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2427 RNA, herein designated VGAM RNA, may have a different number of host target binding sites in untranslated regions of a VGAM2427 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2427 RNA, herein designated VGAM RNA, to host target binding sites on VGAM2427 host target RNA, herein designated VGAM HOST TARGET RNA, such as BINDING SITE I, BINDING SITE II and BINDING SITE III, inhibits translation of VGAM2427 host target RNA into VGAM2427 host target protein, herein designated VGAM HOST TARGET PROTEIN. VGAM host target protein is therefore outlined by a broken line.

It is appreciated that VGAM2427 host target gene, herein designated VGAM HOST TARGET GENE, in fact represents a plurality of VGAM2427 host target genes. The mRNA of each one of this plurality of VGAM2427 host target genes comprises one or more host target binding sites, each having a nucleotide sequence which is at least partly complementary to VGAM2427 RNA, herein designated VGAM RNA, and which when bound by VGAM2427 RNA causes inhibition of translation of respective one or more VGAM2427 host target proteins.

It is further appreciated by one skilled in the art that the mode of translational inhibition illustrated by FIG. 1 with specific reference to translational inhibition exerted by VGAM2427 gene, herein designated VGAM GENE, on one or more VGAM2427 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2427 is inhibition of expression of host target genes, as part of a novel viral mechanism of attacking a host. Accordingly, utilities of VGAM2427 include diagnosis, prevention and treatment of viral infection by Goatpox Virus. Specific functions, and accordingly utilities, of VGAM2427 correlate with, and may be deduced from, the identity of the host target genes which VGAM2427 binds and inhibits, and the function of these host target genes, as elaborated hereinbelow.

Nucleotide sequences of the VGAM2427 precursor RNA, herein designated VGAM PRECURSOR RNA, and of the 'diced' VGAM2427 RNA, herein designated VGAM RNA, and a schematic representation of the secondary folding of VGAM2427 folded precursor RNA, herein designated VGAM FOLDED PRECURSOR RNA, of VGAM2427 are further described hereinbelow with reference to Table 1.

Nucleotide sequences of host target binding sites, such as BINDING SITE-I, BINDING SITE-II and BINDING SITE-III of FIG. 1, found on VGAM2427 host target RNA, and schematic representation of the complementarity of each of these host target binding sites to VGAM2427 RNA, herein designated VGAM RNA, are described hereinbelow with reference to Table 2.

As mentioned hereinabove with reference to FIG. 1, a function of VGAM2427 gene, herein designated VGAM is inhibition of expression of VGAM2427 target genes. It is appreciated that specific functions, and accordingly utilities, of VGAM2427 correlate with, and may be deduced from, the identity of the target genes which VGAM2427 binds and inhibits, and the function of these target genes, as elaborated hereinbelow.

ATP-binding Cassette, Sub-family D (ALD), Member 2 (ABCD2, Accession NM_005164) is a VGAM2427 host target gene. ABCD2 BINDING SITE is HOST TARGET binding site found in the 3' untranslated region of mRNA encoded by ABCD2, corresponding to a HOST TARGET binding site such as BINDING SITE I, BINDING SITE II or BINDING SITE III. Table 2 illustrates the complementarity of the nucleotide sequences of ABCD2 BINDING SITE, designated SEQ ID:11658, to the nucleotide sequence of VGAM2427 RNA, herein designated VGAM RNA, also designated SEQ ID:5138.

A function of VGAM2427 is therefore inhibition of ATP-binding Cassette, Sub-family D (ALD), Member 2 (ABCD2, Accession NM_005164), a gene which probable transporter. Accordingly, utilities of VGAM2427 include diagnosis, prevention and treatment of diseases and clinical conditions associated with ABCD2. The function of ABCD2 and its association with various diseases and clinical conditions, has been established by previous studies, as described hereinabove with reference to VGAM229. NAD(P)H Dehydrogenase, Quinone 1 (NQO1, Accession NM_000903) is another VGAM2427 host target gene. NQO1 BINDING SITE is HOST TARGET binding site found in the 3' untranslated region of mRNA encoded by NQO1, corresponding to a HOST TARGET binding site such as BINDING SITE I, BINDING SITE II or BINDING SITE III. Table 2 illustrates the complementarity of the nucleotide sequences of NQO1 BINDING SITE, designated SEQ ID:6606, to the nucleotide sequence of VGAM2427 RNA, herein designated VGAM RNA, also designated SEQ ID:5138.

Another function of VGAM2427 is therefore inhibition of NAD(P)H Dehydrogenase, Quinone 1 (NQO1, Accession NM_000903), a gene which is cytochrome b5 reductase which reduces redox dyes and quinones. Accordingly, utilities of VGAM2427 include diagnosis, prevention and treatment of diseases and clinical conditions associated with NQO1. The function of NQO1 and its association with various diseases and clinical conditions, has been established by previous studies, as described hereinabove with reference to VGAM923. RAB18, Member RAS Oncogene Family (RAB18, Accession NM_021252) is another VGAM2427 host target gene. RAB18 BINDING SITE is HOST TARGET binding site found in the 3' untranslated region of mRNA encoded by RAB18, corresponding to a HOST TARGET binding site such as BINDING SITE I, BINDING SITE II or BINDING SITE III. Table 2 illustrates the complementarity of the nucleotide sequences of RAB18 BINDING SITE, designated SEQ ID:22224, to the nucleotide sequence of VGAM2427 RNA, herein designated VGAM RNA, also designated SEQ ID:5138.

Another function of VGAM2427 is therefore inhibition of RAB18, Member RAS Oncogene Family (RAB18, Accession NM_021252), a gene which plays a role in apical endocytosis/recycling. Accordingly, utilities of VGAM2427 include diagnosis, prevention and treatment of diseases and clinical conditions associated with RAB18. The function of RAB18 and its association with various diseases and clinical conditions, has been established by previous studies, as described hereinabove with reference to VGAM120. RAD23 Homolog B (S. cerevisiae) (RAD23B, Accession NM_002874) is another VGAM2427 host target gene. RAD23B BINDING SITE is HOST TARGET binding site found in the 3' untranslated region of mRNA encoded by RAD23B, corresponding to a HOST TARGET binding site such as BINDING SITE I, BINDING SITE II or BINDING SITE III. Table 2 illustrates the complementarity of the nucleotide sequences of RAD23B BINDING SITE, designated SEQ ID:8785, to the nucleotide sequence of VGAM2427 RNA, herein designated VGAM RNA, also designated SEQ ID:5138.

Another function of VGAM2427 is therefore inhibition of RAD23 Homolog B (S. cerevisiae) (RAD23B, Accession NM_002874), a gene which is involved in dna excision repair. Accordingly, utilities of VGAM2427 include diagnosis, prevention and treatment of diseases and clinical conditions associated with RAD23B. The function of RAD23B and its association with various diseases and clinical conditions, has been established by previous studies, as described hereinabove with reference to VGAM178. REV3-like, Catalytic Subunit of DNA Polymerase Zeta (yeast) (REV3L, Accession NM_002912) is another VGAM2427 host target gene. REV3L BINDING SITE is HOST TARGET binding site found in the 3' untranslated region of mRNA encoded by REV3L, corresponding to a HOST TARGET binding site such as BINDING SITE I, BINDING SITE II or BINDING SITE III. Table 2 illustrates the complementarity of the nucleotide sequences of REV3L BINDING SITE, designated SEQ ID:8816, to the nucleotide sequence of VGAM2427 RNA, herein designated VGAM RNA, also designated SEQ ID:5138.

Another function of VGAM2427 is therefore inhibition of REV3-like, Catalytic Subunit of DNA Polymerase Zeta (yeast) (REV3L, Accession NM_002912), a gene which is a catalytic subunit of DNA polymerase zeta and acts in translation replication and mutagenesis. Accordingly, utilities of VGAM2427 include diagnosis, prevention and treatment of diseases and clinical conditions associated with REV3L. The function of REV3L has been established by previous studies. To get a better understanding of mutagenic mechanisms in human S, Gibbs et al. (1998) cloned and sequenced the human homolog of the Saccharomyces cerevisiae REV3 gene. The yeast gene encodes the catalytic subunit of DNA polymerase zeta, a nonessential enzyme that is thought to carry out translesion replication and is responsible for virtually all DNA damage-induced mutagenesis and the majority of spontaneous mutagenesis. The human gene encodes an expected protein of 3,130 residues, about twice the size of the yeast protein, which has 1,504 amino acids. The 2 proteins are 29% identical in an amino-terminal region of approximately 340 residues, 39% identical in a carboxy-terminal region of approximately 850 residues, and 29% identical in a 55-residue region in the middle of the 2 genes. The sequence of the expected protein strongly predicted that it is the catalytic subunit of a DNA polymerase of the polymerase-zeta type; the carboxy-terminal domain possesses, in the right order, the 6 motifs characteristic of eukaryotic DNA polymerases, most closely resembles yeast polymerase-zeta among all polymerases in the GenBank database, and is different from the human alpha (POLA; 312040), delta (POLD1; 174761), and epsilon (POLE; 174762) enzymes. Human cells expressing high levels of an REV3 antisense RNA fragment grow normally, but show little or no UV-induced mutagenesis and are slightly more sensitive to killing by UV. The human gene therefore appears to carry out a function similar to that of its yeast counterpart. Xiao et al. (1998) identified human cDNA clones from 3 different libraries whose deduced amino acid sequences bore remarkable homology to yeast REV3. By in situ hybridization, they mapped the human REV3 gene to 1p33-p32. The gene encodes an mRNA of more than 10 kb. Its expression varies in different tissues and appeared to be elevated in some but not all of the tumor cell lines examined. In a study of genes involved in tumor suppression from 6q21, Morelli et al. (1998) identified the same sequence as that reported by Gibbs et al. (1998). The REV3L gene contains 33 exons (3 noncoding at the 5-prime end) and spans approximately 200 kb of genomic DNA. The chromosome 6 assignment is the more likely (AFS).

Full details of the abovementioned studies are described in the following publications, the disclosure of which are hereby incorporated by reference:

Gibbs, P. E. M.; McGregor, W. G.; Maher, V. M.; Nisson, P.; Lawrence, C. W.: A human homolog of the Saccharomyces cerevisiae REV3 gene, which encodes the catalytic subunit of DNA polymerase zeta. Proc. Nat. Acad. Sci. 95:6876-6880, 1998; and Xiao, W.; Lechler, T.; Chow, B. L.; Fontanie, T.; Agustus, M.; Carter, K. C.; Wei, Y.-F.: Identification, chromosomal mapping and tissue-specific expression of hREV3 encoding a putativ.

Further studies establishing the function and utilities of REV3L are found in John Hopkins OMIM database record ID 602776, and in sited publications numbered 7650-7652 listed in the bibliography section hereinbelow, which are also hereby incorporated by reference. Tumor Necrosis Factor Receptor Superfamily, Member 9 (TNFRSF9, Accession NM_001561) is another VGAM2427 host target gene. TNFRSF9 BINDING SITE is HOST TARGET binding site found in the 3' untranslated region of mRNA encoded by TNFRSF9, corresponding to a HOST TARGET binding site such as BINDING SITE I, BINDING SITE II or BINDING SITE III. Table 2 illustrates the complementarity of the nucleotide sequences of TNFRSF9 BINDING SITE, designated SEQ ID:7291, to the nucleotide sequence of VGAM2427 RNA, herein designated VGAM RNA, also designated SEQ ID:5138.

Another function of VGAM2427 is therefore inhibition of Tumor Necrosis Factor Receptor Superfamily, Member 9 (TNFRSF9, Accession NM_001561), a gene which inhibits proliferation of activated T lymphocytes. Accordingly, utilities of VGAM2427 include diagnosis, prevention and treatment of diseases and clinical conditions associated with TNFRSF9. The function of TNFRSF9 and its association with various diseases and clinical conditions, has been established by previous studies, as described hereinabove with reference to VGAM1954. Activin A Receptor, Type II (ACVR2, Accession NM_001616) is another VGAM2427 host target gene. ACVR2 BINDING SITE is HOST TARGET binding site found in the 3' untranslated region of mRNA encoded by ACVR2, corresponding to a HOST TARGET binding site such as BINDING SITE I, BINDING SITE II or BINDING SITE III. Table 2 illustrates the complementarity of the nucleotide sequences of ACVR2 BINDING SITE, designated SEQ ID:7322, to the nucleotide sequence of VGAM2427 RNA, herein designated VGAM RNA, also designated SEQ ID:5138.

Another function of VGAM2427 is therefore inhibition of Activin A Receptor, Type II (ACVR2, Accession NM_001616). Accordingly, utilities of VGAM2427 include diagnosis, prevention and treatment of diseases and clinical conditions associated with ACVR2. Chromosome 9 Open Reading Frame 14 (C9orf14, Accession XM_098859) is another VGAM2427 host target gene. C9orf14 BINDING SITE is HOST TARGET binding site found in the 5' untranslated region of mRNA encoded by C9orf14, corresponding to a HOST TARGET binding site such as BINDING SITE I, BINDING SITE II or BINDING SITE III. Table 2 illustrates the complementarity of the nucleotide sequences of C9orf14 BINDING SITE, designated SEQ ID:41913, to the nucleotide sequence of VGAM2427 RNA, herein designated VGAM RNA, also designated SEQ ID:5138.

Another function of VGAM2427 is therefore inhibition of Chromosome 9 Open Reading Frame 14 (C9orf14, Accession XM_098859). Accordingly, utilities of VGAM2427 include diagnosis, prevention and treatment of diseases and clinical conditions associated with C9orf14. DKFZP586M0622 (Accession NM_015583) is another VGAM2427 host target gene. DKFZP586M0622 BINDING SITE is HOST TARGET binding site found in the 5' untranslated region of mRNA encoded by DKFZP586M0622, corresponding to a HOST TARGET binding site such as BINDING SITE I, BINDING SITE II or BINDING SITE III. Table 2 illustrates the complementarity of the nucleotide sequences of DKFZP586M0622 BINDING SITE, designated SEQ ID:17850, to the nucleotide sequence of VGAM2427 RNA, herein designated VGAM RNA, also designated SEQ ID:5138.

Another function of VGAM2427 is therefore inhibition of DKFZP586M0622 (Accession NM_015583). Accordingly, utilities of VGAM2427 include diagnosis, prevention and treatment of diseases and clinical conditions associated with DKFZP586M0622. FLJ10697 (Accession NM_018181) is another VGAM2427 host target gene. FLJ10697 BINDING SITE is HOST TARGET binding site found in the 3' untranslated region of mRNA encoded by FLJ10697, corresponding to a HOST TARGET binding site such as BINDING SITE I, BINDING SITE II or BINDING SITE III. Table 2 illustrates the complementarity of the nucleotide sequences of FLJ10697 BINDING SITE, designated SEQ ID:20017, to the nucleotide sequence of VGAM2427 RNA, herein designated VGAM RNA, also designated SEQ ID:5138.

Another function of VGAM2427 is therefore inhibition of FLJ10697 (Accession NM_018181). Accordingly, utilities of VGAM2427 include diagnosis, prevention and treatment of diseases and clinical conditions associated with FLJ10697. FLJ13057 (Accession XM_171006) is another VGAM2427 host target gene. FLJ13057 BINDING SITE is HOST TARGET binding site found in the 3' untranslated region of mRNA encoded by FLJ13057, corresponding to a HOST TARGET binding site such as BINDING SITE I, BINDING SITE II or BINDING SITE III. Table 2 illustrates the complementarity of the nucleotide sequences of FLJ13057 BINDING SITE, designated SEQ ID:45778, to the nucleotide sequence of VGAM2427 RNA, herein designated VGAM RNA, also designated SEQ ID:5138.

Another function of VGAM2427 is therefore inhibition of FLJ13057 (Accession XM_171006). Accordingly, utilities of VGAM2427 include diagnosis, prevention and treatment of diseases and clinical conditions associated with FLJ13057. KIAA0121 (Accession XM_052386) is another VGAM2427 host target gene. KIAA0121 BINDING SITE is HOST TARGET binding site found in the 3' untranslated region of mRNA encoded by KIAA0121, corresponding to a HOST TARGET binding site such as BINDING SITE I, BINDING SITE II or BINDING SITE III. Table 2 illustrates the complementarity of the nucleotide sequences of KIAA0121 BINDING SITE, designated SEQ ID:35973, to the nucleotide sequence of VGAM2427 RNA, herein designated VGAM RNA, also designated SEQ ID:5138.

Another function of VGAM2427 is therefore inhibition of KIAA0121 (Accession XM_052386). Accordingly, utilities of VGAM2427 include diagnosis, prevention and treatment of diseases and clinical conditions associated with KIAA0121. KIAA0265 (Accession XM_045954) is another VGAM2427 host target gene. KIAA0265 BINDING SITE is HOST TARGET binding site found in the 3' untranslated region of mRNA encoded by KIAA0265, corresponding to a HOST TARGET binding site such as BINDING SITE I, BINDING SITE II or BINDING SITE III. Table 2 illustrates the complementarity of the nucleotide sequences of KIAA0265 BINDING SITE, designated SEQ ID:34622, to the nucleotide sequence of VGAM2427 RNA, herein designated VGAM RNA, also designated SEQ ID:5138.

Another function of VGAM2427 is therefore inhibition of KIAA0265 (Accession XM_045954). Accordingly, utilities of VGAM2427 include diagnosis, prevention and treatment of diseases and clinical conditions associated with KIAA0265. KIAA1948 (Accession XM_091984) is another VGAM2427 host target gene. KIAA1948 BINDING SITE is HOST TARGET binding site found in the 3' untranslated region of mRNA encoded by KIAA1948, corresponding to a HOST TARGET binding site such as BINDING SITE I, BINDING SITE II or BINDING SITE III. Table 2 illustrates the complementarity of the nucleotide sequences of KIAA1948 BINDING SITE, designated SEQ ID:40084, to the nucleotide sequence of VGAM2427 RNA, herein designated VGAM RNA, also designated SEQ ID:5138.

Another function of VGAM2427 is therefore inhibition of KIAA1948 (Accession XM_091984). Accordingly, utilities of VGAM2427 include diagnosis, prevention and treatment of diseases and clinical conditions associated with KIAA1948. KIAA1950 (Accession XM_166532) is another VGAM2427 host target gene. KIAA1950 BINDING SITE is HOST TARGET binding site found in the 3' untranslated region of mRNA encoded by KIAA1950, corresponding to a HOST TARGET binding site such as BINDING SITE I, BINDING SITE II or BINDING SITE III. Table 2 illustrates the complementarity of the nucleotide sequences of KIAA1950 BINDING SITE, designated SEQ ID:44491, to the nucleotide sequence of VGAM2427 RNA, herein designated VGAM RNA, also designated SEQ ID:5138.

Another function of VGAM2427 is therefore inhibition of KIAA1950 (Accession XM_166532). Accordingly, utilities of VGAM2427 include diagnosis, prevention and treatment of diseases and clinical conditions associated with KIAA1950. KIAA1979 (Accession XM_113984) is another VGAM2427 host target gene. KIAA1979 BINDING SITE is HOST TARGET binding site found in the 3' untranslated region of mRNA encoded by KIAA1979, corresponding to a HOST TARGET binding site such as BINDING SITE I, BINDING SITE II or BINDING SITE III. Table 2 illustrates the complementarity of the nucleotide sequences of KIAA1979 BINDING SITE, designated SEQ ID:42592, to the nucleotide sequence of VGAM2427 RNA, herein designated VGAM RNA, also designated SEQ ID:5138.

Another function of VGAM2427 is therefore inhibition of KIAA1979 (Accession XM_113984). Accordingly, utilities of VGAM2427 include diagnosis, prevention and treatment of diseases and clinical conditions associated with KIAA1979. NYD-SP15 (Accession NM_030911) is another VGAM2427 host target gene. NYD-SP15 BINDING SITE is HOST TARGET binding site found in the 3' untranslated region of mRNA encoded by NYD-SP15, corresponding to a HOST TARGET binding site such as BINDING SITE I, BINDING SITE II or BINDING SITE III. Table 2 illustrates the complementarity of the nucleotide sequences of NYD-SP15 BINDING SITE, designated SEQ ID:25178, to the nucleotide sequence of VGAM2427 RNA, herein designated VGAM RNA, also designated SEQ ID:5138.

Another function of VGAM2427 is therefore inhibition of NYD-SP15 (Accession NM_030911). Accordingly, utilities of VGAM2427 include diagnosis, prevention and treatment of diseases and clinical conditions associated with NYD-SP15. Protein Tyrosine Phosphatase, Non-receptor Type Substrate 1 (PTPNS1, Accession NM_080792) is another VGAM2427 host target gene. PTPNS1 BINDING SITE is HOST TARGET binding site found in the 3' untranslated region of mRNA encoded by PTPNS1, corresponding to a HOST TARGET binding site such as BINDING SITE I, BINDING SITE II or BINDING SITE III. Table 2 illustrates the complementarity of the nucleotide sequences of PTPNS1 BINDING SITE, designated SEQ ID:28059, to the nucleotide sequence of VGAM2427 RNA, herein designated VGAM RNA, also designated SEQ ID:5138.

Another function of VGAM2427 is therefore inhibition of Protein Tyrosine Phosphatase, Non-receptor Type Substrate 1 (PTPNS1, Accession NM_080792). Accordingly, utilities of VGAM2427 include diagnosis, prevention and treatment of diseases and clinical conditions associated with PTPNS1. SMAP-5 (Accession NM_030799) is another VGAM2427 host target gene. SMAP-5 BINDING SITE is HOST TARGET binding site found in the 3' untranslated region of mRNA encoded by SMAP-5, corresponding to a HOST TARGET binding site such as BINDING SITE I, BINDING SITE II or BINDING SITE III. Table 2 illustrates the complementarity of the nucleotide sequences of SMAP-5 BINDING SITE, designated SEQ ID:25100, to the nucleotide sequence of VGAM2427 RNA, herein designated VGAM RNA, also designated SEQ ID:5138.

Another function of VGAM2427 is therefore inhibition of SMAP-5 (Accession NM_030799). Accordingly, utilities of VGAM2427 include diagnosis, prevention and treatment of diseases and clinical conditions associated with SMAP-5. LOC112609 (Accession XM_053013) is another VGAM2427 host target gene. LOC112609 BINDING SITE is HOST TARGET binding site found in the 3' untranslated region of mRNA encoded by LOC112609, corresponding to a HOST TARGET binding site such as BINDING SITE I, BINDING SITE II or BINDING SITE III. Table 2 illustrates the complementarity of the nucleotide sequences of LOC112609 BINDING SITE, designated SEQ ID:36059, to the nucleotide sequence of VGAM2427 RNA, herein designated VGAM RNA, also designated SEQ ID:5138.

Another function of VGAM2427 is therefore inhibition of LOC112609 (Accession XM_053013). Accordingly, utilities of VGAM2427 include diagnosis, prevention and treatment of diseases and clinical conditions associated with LOC112609. LOC219540 (Accession XM_168047) is another VGAM2427 host target gene. LOC219540 BINDING SITE is HOST TARGET binding site found in the 5' untranslated region of mRNA encoded by LOC219540, corresponding to a HOST TARGET binding site such as BINDING SITE I, BINDING SITE II or BINDING SITE III. Table 2 illustrates the complementarity of the nucleotide sequences of LOC219540 BINDING SITE, designated SEQ ID:44960, to the nucleotide sequence of VGAM2427 RNA, herein designated VGAM RNA, also designated SEQ ID:5138.

Another function of VGAM2427 is therefore inhibition of LOC219540 (Accession XM_168047). Accordingly, utilities of VGAM2427 include diagnosis, prevention and treatment of diseases and clinical conditions associated with LOC219540. LOC254485 (Accession XM_170782) is another VGAM2427 host target gene. LOC254485 BINDING SITE is HOST TARGET binding site found in the 5' untranslated region of mRNA encoded by LOC254485, corresponding to a HOST TARGET binding site such as BINDING SITE I, BINDING SITE II or BINDING SITE III. Table 2 illustrates the complementarity of the nucleotide sequences of LOC254485 BINDING SITE, designated SEQ ID:45550, to the nucleotide sequence of VGAM2427 RNA, herein designated VGAM RNA, also designated SEQ ID:5138.

Another function of VGAM2427 is therefore inhibition of LOC254485 (Accession XM_170782). Accordingly, utilities of VGAM2427 include diagnosis, prevention and treatment of diseases and clinical conditions associated with LOC254485. LOC256940 (Accession XM_172879) is another VGAM2427 host target gene. LOC256940 BINDING SITE is HOST TARGET binding site found in the 3' untranslated region of mRNA encoded by LOC256940, corresponding to a HOST TARGET binding site such as BINDING SITE I, BINDING SITE II or BINDING SITE III. Table 2 illustrates the complementarity of the nucleotide sequences of LOC256940 BINDING SITE, designated SEQ ID:46156, to the nucleotide sequence of VGAM2427 RNA, herein designated VGAM RNA, also designated SEQ ID:5138.

Another function of VGAM2427 is therefore inhibition of LOC256940 (Accession XM_172879). Accordingly, utilities of VGAM2427 include diagnosis, prevention and treatment of diseases and clinical conditions associated with LOC256940. FIG. 1 further provides a conceptual description of a novel bioinformatically detected viral gene of the present invention, referred to here as Viral Genomic Address Messenger 2428 (VGAM2428) viral gene, which modulates expression of respective host target genes thereof, the function and utility of which host target genes is known in the art.

VGAM2428 is a novel bioinformatically detected regulatory, non protein coding, viral micro RNA (miRNA) gene. The method by which VGAM2428 was detected is described hereinabove with reference to FIGS. 1-8.

VGAM2428 gene, herein designated VGAM GENE, is a viral gene contained in the genome of Goatpox Virus. VGAM2428 host target gene, herein designated VGAM HOST TARGET GENE, is a human gene contained in the human genome.

VGAM2428 gene encodes a VGAM2428 precursor RNA, herein designated VGAM PRECURSOR RNA. Similar to other miRNA genes, and unlike most ordinary genes, VGAM2428 precursor RNA does not encode a protein. A nucleotide sequence identical or highly similar to the nucleotide sequence of VGAM2428 precursor RNA is designated SEQ ID:2414, and is provided hereinbelow with reference to the sequence listing part. Nucleotide sequence SEQ ID:2414 is located at position 91853 relative to the genome of Goatpox Virus.

VGAM2428 precursor RNA folds onto itself, forming VGAM2428 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2428 folded precursor RNA into VGAM2428 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM2428 RNA is designated SEQ ID:5139, and is provided hereinbelow with reference to the sequence listing part.

VGAM2428 host target gene, herein designated VGAM HOST TARGET GENE, encodes a corresponding messenger RNA, VGAM2428 host target RNA, herein designated VGAM HOST TARGET RNA. VGAM2428 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2428 RNA, herein designated VGAM RNA, binds complementarily to one or more host target binding sites located in untranslated regions of VGAM2428 host target RNA, herein designated VGAM HOST TARGET RNA. This complementary binding is due to the fact that the nucleotide sequence of VGAM2428 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2428 RNA, herein designated VGAM RNA, may have a different number of host target binding sites in untranslated regions of a VGAM2428 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2428 RNA, herein designated VGAM RNA, to host target binding sites on VGAM2428 host target RNA, herein designated VGAM HOST TARGET RNA, such as BINDING SITE I, BINDING SITE II and BINDING SITE III, inhibits translation of VGAM2428 host target RNA into VGAM2428 host target protein, herein designated VGAM HOST TARGET PROTEIN. VGAM host target protein is therefore outlined by a broken line.

It is appreciated that VGAM2428 host target gene, herein designated VGAM HOST TARGET GENE, in fact represents a plurality of VGAM2428 host target genes. The mRNA of each one of this plurality of VGAM2428 host target genes comprises one or more host target binding sites, each having a nucleotide sequence which is at least partly complementary to VGAM2428 RNA, herein designated VGAM RNA, and which when bound by VGAM2428 RNA causes inhibition of translation of respective one or more VGAM2428 host target proteins.

It is further appreciated by one skilled in the art that the mode of translational inhibition illustrated by FIG. 1 with specific reference to translational inhibition exerted by VGAM2428 gene, herein designated VGAM GENE, on one or more VGAM2428 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2428 is inhibition of expression of host target genes, as part of a novel viral mechanism of attacking a host. Accordingly, utilities of VGAM2428 include diagnosis, prevention and treatment of viral infection by Goatpox Virus. Specific functions, and accordingly utilities, of VGAM2428 correlate with, and may be deduced from, the identity of the host target genes which VGAM2428 binds and inhibits, and the function of these host target genes, as elaborated hereinbelow.

Nucleotide sequences of the VGAM2428 precursor RNA, herein designated VGAM PRECURSOR RNA, and of the 'diced' VGAM2428 RNA, herein designated VGAM RNA, and a schematic representation of the secondary folding of VGAM2428 folded precursor RNA, herein designated VGAM FOLDED PRECURSOR RNA, of VGAM2428 are further described hereinbelow with reference to Table 1.

Nucleotide sequences of host target binding sites, such as BINDING SITE-I, BINDING SITE-II and BINDING SITE-III of FIG. 1, found on VGAM2428 host target RNA, and schematic representation of the complementarity of each of these host target binding sites to VGAM2428 RNA, herein designated VGAM RNA, are described hereinbelow with reference to Table 2.

As mentioned hereinabove with reference to FIG. 1, a function of VGAM2428 gene, herein designated VGAM is inhibition of expression of VGAM2428 target genes. It is appreciated that specific functions, and accordingly utilities, of VGAM2428 correlate with, and may be deduced from, the identity of the target genes which VGAM2428 binds and inhibits, and the function of these target genes, as elaborated hereinbelow.

Adenosine Deaminase, RNA-specific (ADAR, Accession NM_001111) is a VGAM2428 host target gene. ADAR BINDING SITE1 through ADAR BINDING SITE3 are HOST TARGET binding sites found in untranslated regions of mRNA encoded by ADAR, corresponding to HOST TARGET binding sites such as BINDING SITE I, BINDING SITE II or BINDING SITE III. Table 2 illustrates the complementarity of the nucleotide sequences of ADAR BINDING SITE1 through ADAR BINDING SITE3, designated SEQ ID:6774, SEQ ID:17967 and SEQ ID:17960 respectively, to the nucleotide sequence of VGAM2428 RNA, herein designated VGAM RNA, also designated SEQ ID:5139.

A function of VGAM2428 is therefore inhibition of Adenosine Deaminase, RNA-specific (ADAR, Accession NM_001111), a gene which converts adenosine to inosine in double-stranded RNA. Accordingly, utilities of VGAM2428 include diagnosis, prevention and treatment of diseases and clinical conditions associated with ADAR. The function of ADAR and its association with various diseases and clinical conditions, has been established by previous studies, as described hereinabove with reference to VGAM323. Matrix Metalloproteinase 19 (MMP19, Accession NM_022792) is another VGAM2428 host target gene. MMP19 BINDING SITE1 through MMP19 BINDING SITE4 are HOST TARGET binding sites found in untranslated regions of mRNA encoded by MMP19, corresponding to HOST TARGET binding sites such as BINDING SITE I, BINDING SITE II or BINDING SITE III. Table 2 illustrates the complementarity of the nucleotide sequences of MMP19 BINDING SITE1 through MMP19 BINDING SITE4, designated SEQ ID:23082, SEQ ID:23077, SEQ ID:23079 and SEQ ID:8269 respectively, to the nucleotide sequence of VGAM2428 RNA, herein designated VGAM RNA, also designated SEQ ID:5139.

Another function of VGAM2428 is therefore inhibition of Matrix Metalloproteinase 19 (MMP19, Accession NM_022792). Accordingly, utilities of VGAM2428 include diagnosis, prevention and treatment of diseases and clinical conditions associated with MMP19. FLJ12704 (Accession NM_024998) is another VGAM2428 host target gene. FLJ12704 BINDING SITE is HOST TARGET binding site found in the 3' untranslated region of mRNA encoded by FLJ12704, corresponding to a HOST TARGET binding site such as BINDING SITE I, BINDING SITE II or BINDING SITE III. Table 2 illustrates the complementarity of the nucleotide sequences of FLJ12704 BINDING SITE, designated SEQ ID:24565, to the nucleotide sequence of VGAM2428 RNA, herein designated VGAM RNA, also designated SEQ ID:5139.

Another function of VGAM2428 is therefore inhibition of FLJ12704 (Accession NM_024998). Accordingly, utilities of VGAM2428 include diagnosis, prevention and treatment of diseases and clinical conditions associated with FLJ12704. H326 (Accession NM_015726) is another VGAM2428 host target gene. H326 BINDING SITE is HOST TARGET binding site found in the 3' untranslated region of mRNA encoded by H326, corresponding to a HOST TARGET binding site such as BINDING SITE I, BINDING SITE II or BINDING SITE III. Table 2 illustrates the complementarity of the nucleotide sequences of H326 BINDING SITE, designated SEQ ID:17938, to the nucleotide sequence of VGAM2428 RNA, herein designated VGAM RNA, also designated SEQ ID:5139.

Another function of VGAM2428 is therefore inhibition of H326 (Accession NM_015726). Accordingly, utilities of VGAM2428 include diagnosis, prevention and treatment of diseases and clinical conditions associated with H326. KIAA0594 (Accession XM_036117) is another VGAM2428 host target gene. KIAA0594 BINDING SITE is HOST TARGET binding site found in the 3' untranslated region of mRNA encoded by KIAA0594, corresponding to a HOST TARGET binding site such as BINDING SITE I, BINDING SITE II or BINDING SITE III. Table 2 illustrates the complementarity of the nucleotide sequences of KIAA0594 BINDING SITE, designated SEQ ID:32387, to the nucleotide sequence of VGAM2428 RNA, herein designated VGAM RNA, also designated SEQ ID:5139.

Another function of VGAM2428 is therefore inhibition of KIAA0594 (Accession XM_036117). Accordingly, utilities of VGAM2428 include diagnosis, prevention and treatment of diseases and clinical conditions associated with KIAA0594. KIAA1634 (Accession XM_032749) is another VGAM2428 host target gene. KIAA1634 BINDING SITE is HOST TARGET binding site found in the 3' untranslated region of mRNA encoded by KIAA1634, corresponding to a HOST TARGET binding site such as BINDING SITE I, BINDING SITE II or BINDING SITE III. Table 2 illustrates the complementarity of the nucleotide sequences of KIAA1634 BINDING SITE, designated SEQ ID:31750, to the nucleotide sequence of VGAM2428 RNA, herein designated VGAM RNA, also designated SEQ ID:5139.

Another function of VGAM2428 is therefore inhibition of KIAA1634 (Accession XM_032749). Accordingly, utilities of VGAM2428 include diagnosis, prevention and treatment of diseases and clinical conditions associated with KIAA1634. KIAA1831 (Accession XM_033366) is another VGAM2428 host target gene. KIAA1831 BINDING SITE is HOST TARGET binding site found in the 3' untranslated region of mRNA encoded by KIAA1831, corresponding to a HOST TARGET binding site such as BINDING SITE I, BINDING SITE II or BINDING SITE III. Table 2 illustrates the complementarity of the nucleotide sequences of KIAA1831 BINDING SITE, designated SEQ ID:31905, to the nucleotide sequence of VGAM2428 RNA, herein designated VGAM RNA, also designated SEQ ID:5139.

Another function of VGAM2428 is therefore inhibition of KIAA1831 (Accession XM_033366). Accordingly, utilities of VGAM2428 include diagnosis, prevention and treatment of diseases and clinical conditions associated with KIAA1831. Purinergic Receptor P2X-like 1, Orphan Receptor (P2RXL1, Accession NM_005446) is another VGAM2428 host target gene. P2RXL1 BINDING SITE is HOST TARGET binding site found in the 3' untranslated region of mRNA encoded by P2RXL1, corresponding to a HOST TARGET binding site such as BINDING SITE I, BINDING SITE II or BINDING SITE III. Table 2 illustrates the complementarity of the nucleotide sequences of P2RXL1 BINDING SITE, designated SEQ ID:11932, to the nucleotide sequence of VGAM2428 RNA, herein designated VGAM RNA, also designated SEQ ID:5139.

Another function of VGAM2428 is therefore inhibition of Purinergic Receptor P2X-like 1, Orphan Receptor (P2RXL1, Accession NM_005446). Accordingly, utilities of VGAM2428 include diagnosis, prevention and treatment of diseases and clinical conditions associated with P2RXL1. PRP8 Pre-mRNA Processing Factor 8 Homolog (yeast) (PRPF8, Accession XM_028335) is another VGAM2428 host target gene. PRPF8 BINDING SITE is HOST TARGET binding site found in the 3' untranslated region of mRNA encoded by PRPF8, corresponding to a HOST TARGET binding site such as BINDING SITE I, BINDING SITE II or BINDING SITE III. Table 2 illustrates the complementarity of the nucleotide sequences of PRPF8 BINDING SITE, designated SEQ ID:30680, to the nucleotide sequence of VGAM2428 RNA, herein designated VGAM RNA, also designated SEQ ID:5139.

Another function of VGAM2428 is therefore inhibition of PRP8 Pre-mRNA Processing Factor 8 Homolog (yeast) (PRPF8, Accession XM_028335). Accordingly, utilities of VGAM2428 include diagnosis, prevention and treatment of diseases and clinical conditions associated with PRPF8. LOC120534 (Accession XM_058476) is another VGAM2428 host target gene. LOC120534 BINDING SITE is HOST TARGET binding site found in the 3' untranslated region of mRNA encoded by LOC120534, corresponding to a HOST TARGET binding site such as BINDING SITE I, BINDING SITE II or BINDING SITE III. Table 2 illustrates the complementarity of the nucleotide sequences of LOC120534 BINDING SITE, designated SEQ ID:36626, to the nucleotide sequence of VGAM2428 RNA, herein designated VGAM RNA, also designated SEQ ID:5139.

Another function of VGAM2428 is therefore inhibition of LOC120534 (Accession XM_058476). Accordingly, utilities of VGAM2428 include diagnosis, prevention and treatment of diseases and clinical conditions associated with LOC120534. LOC131870 (Accession XM_059544) is another VGAM2428 host target gene. LOC131870 BINDING SITE is HOST TARGET binding site found in the 3' untranslated region of mRNA encoded by LOC131870, corresponding to a HOST TARGET binding site such as BINDING SITE I, BINDING SITE II or BINDING SITE III. Table 2 illustrates the complementarity of the nucleotide sequences of LOC131870 BINDING SITE, designated SEQ ID:37016, to the nucleotide sequence of VGAM2428 RNA, herein designated VGAM RNA, also designated SEQ ID:5139.

Another function of VGAM2428 is therefore inhibition of LOC131870 (Accession XM_059544). Accordingly, utilities of VGAM2428 include diagnosis, prevention and treatment of diseases and clinical conditions associated with LOC131870. LOC144866 (Accession XM_096699) is another VGAM2428 host target gene. LOC144866 BINDING SITE is HOST TARGET binding site found in the 5' untranslated region of mRNA encoded by LOC144866, corresponding to a HOST TARGET binding site such as BINDING SITE I, BINDING SITE II or BINDING SITE III. Table 2 illustrates the complementarity of the nucleotide sequences of LOC144866 BINDING SITE, designated SEQ ID:40476, to the nucleotide sequence of VGAM2428 RNA, herein designated VGAM RNA, also designated SEQ ID:5139.

Another function of VGAM2428 is therefore inhibition of LOC144866 (Accession XM_096699). Accordingly, utilities of VGAM2428 include diagnosis, prevention and treatment of diseases and clinical conditions associated with LOC144866. LOC146774 (Accession XM_085584) is another VGAM2428 host target gene. LOC146774 BINDING SITE is HOST TARGET binding site found in the 3' untranslated region of mRNA encoded by LOC146774, corresponding to a HOST TARGET binding site such as BINDING SITE I, BINDING SITE II or BINDING SITE III. Table 2 illustrates the complementarity of the nucleotide sequences of LOC146774 BINDING SITE, designated SEQ ID:38234, to the nucleotide sequence of VGAM2428 RNA, herein designated VGAM RNA, also designated SEQ ID:5139.

Another function of VGAM2428 is therefore inhibition of LOC146774 (Accession XM_085584). Accordingly, utilities of VGAM2428 include diagnosis, prevention and treatment of diseases and clinical conditions associated with LOC146774. LOC150848 (Accession XM_097959) is another VGAM2428 host target gene. LOC150848 BINDING SITE is HOST TARGET binding site found in the 5' untranslated region of mRNA encoded by LOC150848, corresponding to a HOST TARGET binding site such as BINDING SITE I, BINDING SITE II or BINDING SITE III. Table 2 illustrates the complementarity of the nucleotide sequences of LOC150848 BINDING SITE, designated SEQ ID:41254, to the nucleotide sequence of VGAM2428 RNA, herein designated VGAM RNA, also designated SEQ ID:5139.

Another function of VGAM2428 is therefore inhibition of LOC150848 (Accession XM_097959). Accordingly, utilities of VGAM2428 include diagnosis, prevention and treatment of diseases and clinical conditions associated with LOC150848. LOC151610 (Accession XM_087245) is another VGAM2428 host target gene. LOC151610 BIND- ING SITE is HOST TARGET binding site found in the 3' untranslated region of mRNA encoded by LOC151610, corresponding to a HOST TARGET binding site such as BINDING SITE I, BINDING SITE II or BINDING SITE III. Table 2 illustrates the complementarity of the nucleotide sequences of LOC151610 BINDING SITE, designated SEQ ID:39134, to the nucleotide sequence of VGAM2428 RNA, herein designated VGAM RNA, also designated SEQ ID:5139.

Another function of VGAM2428 is therefore inhibition of LOC151610 (Accession XM_087245). Accordingly, utilities of VGAM2428 include diagnosis, prevention and treatment of diseases and clinical conditions associated with LOC151610. LOC152317 (Accession XM_098189) is another VGAM2428 host target gene. LOC152317 BINDING SITE is HOST TARGET binding site found in the 5' untranslated region of mRNA encoded by LOC152317, corresponding to a HOST TARGET binding site such as BINDING SITE I, BINDING SITE II or BINDING SITE III. Table 2 illustrates the complementarity of the nucleotide sequences of LOC152317 BINDING SITE, designated SEQ ID:41467, to the nucleotide sequence of VGAM2428 RNA, herein designated VGAM RNA, also designated SEQ ID:5139.

Another function of VGAM2428 is therefore inhibition of LOC152317 (Accession XM_098189). Accordingly, utilities of VGAM2428 include diagnosis, prevention and treatment of diseases and clinical conditions associated with LOC152317. LOC203378 (Accession XM_117541) is another VGAM2428 host target gene. LOC203378 BINDING SITE is HOST TARGET binding site found in the 5' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43558, to the nucleotide sequence of VGAM2428 RNA, herein designated VGAM RNA, also designated SEQ ID:5139.

Another function of VGAM2428 is therefore inhibition of LOC203378 (Accession XM_117541). Accordingly, utilities of VGAM2428 include diagnosis, prevention and treatment of diseases and clinical conditions associated with LOC203378. LOC219347 (Accession XM_167564) is another VGAM2428 host target gene. LOC219347 BINDING SITE is HOST TARGET binding site found in the 3' untranslated region of mRNA encoded by LOC219347, corresponding to a HOST TARGET binding site such as BINDING SITE I, BINDING SITE II or BINDING SITE III. Table 2 illustrates the complementarity of the nucleotide sequences of LOC219347 BINDING SITE, designated SEQ ID:44678, to the nucleotide sequence of VGAM2428 RNA, herein designated VGAM RNA, also designated SEQ ID:5139.

Another function of VGAM2428 is therefore inhibition of LOC219347 (Accession XM_167564). Accordingly, utilities of VGAM2428 include diagnosis, prevention and treatment of diseases and clinical conditions associated with LOC219347. LOC91561 (Accession XM_039218) is another VGAM2428 host target gene. LOC91561 BINDING SITE is HOST TARGET binding site found in the 5' untranslated region of mRNA encoded by LOC91561, corresponding to a HOST TARGET binding site such as BINDING SITE I, BINDING SITE II or BINDING SITE III. Table 2 illustrates the complementarity of the nucleotide sequences of LOC91561 BINDING SITE, designated SEQ ID:33021, to the nucleotide sequence of VGAM2428 RNA, herein designated VGAM RNA, also designated SEQ ID:5139.

Another function of VGAM2428 is therefore inhibition of LOC91561 (Accession XM_039218). Accordingly, utilities of VGAM2428 include diagnosis, prevention and treatment of diseases and clinical conditions associated with LOC91561. FIG. 1 further provides a conceptual description of a novel bioinformatically detected viral gene of the present invention, referred to here as Viral Genomic Address Messenger 2429 (VGAM2429) viral gene, which modulates expression of respective host target genes thereof, the function and utility of which host target genes is known in the art.

VGAM2429 is a novel bioinformatically detected regulatory, non protein coding, viral micro RNA (miRNA) gene. The method by which VGAM2429 was detected is described hereinabove with reference to FIGS. 1-8.

VGAM2429 gene, herein designated VGAM GENE, is a viral gene contained in the genome of Goatpox Virus. VGAM2429 host target gene, herein designated VGAM HOST TARGET GENE, is a human gene contained in the human genome.

VGAM2429 gene encodes a VGAM2429 precursor RNA, herein designated VGAM PRECURSOR RNA. Similar to other miRNA genes, and unlike most ordinary genes, VGAM2429 precursor RNA does not encode a protein. A nucleotide sequence identical or highly similar to the nucleotide sequence of VGAM2429 precursor RNA is designated SEQ ID:2415, and is provided hereinbelow with reference to the sequence listing part. Nucleotide sequence SEQ ID:2415 is located at position 58421 relative to the genome of Goatpox Virus.

VGAM2429 precursor RNA folds onto itself, forming VGAM2429 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2429 folded precursor RNA into VGAM2429 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2429 RNA is designated SEQ ID:5140, and is provided hereinbelow with reference to the sequence listing part.

VGAM2429 host target gene, herein designated VGAM HOST TARGET GENE, encodes a corresponding messenger RNA, VGAM2429 host target RNA, herein designated VGAM HOST TARGET RNA. VGAM2429 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2429 RNA, herein designated VGAM RNA, binds complementarily to one or more host target binding sites located in untranslated regions of VGAM2429 host target RNA, herein designated VGAM HOST TARGET RNA. This complementary binding is due to the fact that the nucleotide sequence of VGAM2429 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2429 RNA, herein designated VGAM RNA, may have a different number of host target binding sites in untranslated regions of a VGAM2429 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2429 RNA, herein designated VGAM RNA, to host target binding sites on VGAM2429 host target RNA, herein designated VGAM HOST TARGET RNA, such as BINDING SITE I, BINDING SITE II and BINDING SITE III, inhibits translation of VGAM2429 host target RNA into VGAM2429 host target protein, herein designated VGAM HOST TARGET PROTEIN. VGAM host target protein is therefore outlined by a broken line.

It is appreciated that VGAM2429 host target gene, herein designated VGAM HOST TARGET GENE, in fact represents a plurality of VGAM2429 host target genes. The mRNA of each one of this plurality of VGAM2429 host target genes comprises one or more host target binding sites, each having a nucleotide sequence which is at least partly complementary to VGAM2429 RNA, herein designated VGAM RNA, and which when bound by VGAM2429 RNA causes inhibition of translation of respective one or more VGAM2429 host target proteins.

It is further appreciated by one skilled in the art that the mode of translational inhibition illustrated by FIG. 1 with specific reference to translational inhibition exerted by VGAM2429 gene, herein designated VGAM GENE, on one or more VGAM2429 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2429 is inhibition of expression of host target genes, as part of a novel viral mechanism of attacking a host. Accordingly, utilities of VGAM2429 include diagnosis, prevention and treatment of viral infection by Goatpox Virus. Specific functions, and accordingly utilities, of VGAM2429 correlate with, and may be deduced from, the identity of the host target genes which VGAM2429 binds and inhibits, and the function of these host target genes, as elaborated hereinbelow.

Nucleotide sequences of the VGAM2429 precursor RNA, herein designated VGAM PRECURSOR RNA, and of the 'diced' VGAM2429 RNA, herein designated VGAM RNA, and a schematic representation of the secondary folding of VGAM2429 folded precursor RNA, herein designated VGAM FOLDED PRECURSOR RNA, of VGAM2429 are further described hereinbelow with reference to Table 1.

Nucleotide sequences of host target binding sites, such as BINDING SITE-I, BINDING SITE-II and BINDING SITE-III of FIG. 1, found on VGAM2429 host target RNA, and schematic representation of the complementarity of each of these host target binding sites to VGAM2429 RNA, herein designated VGAM RNA, are described hereinbelow with reference to Table 2.

As mentioned hereinabove with reference to FIG. 1, a function of VGAM2429 gene, herein designated VGAM is inhibition of expression of VGAM2429 target genes. It is appreciated that specific functions, and accordingly utilities, of VGAM2429 correlate with, and may be deduced from, the identity of the target genes which VGAM2429 binds and inhibits, and the function of these target genes, as elaborated hereinbelow.

Apical Protein-like (Xenopus laevis) (APXL, Accession NM_001649) is a VGAM2429 host target gene. APXL BINDING SITE is HOST TARGET binding site found in the 3' untranslated region of mRNA encoded by APXL, corresponding to a HOST TARGET binding site such as BINDING SITE I, BINDING SITE II or BINDING SITE III. Table 2 illustrates the complementarity of the nucleotide sequences of APXL BINDING SITE, designated SEQ ID:7356, to the nucleotide sequence of VGAM2429 RNA, herein designated VGAM RNA, also designated SEQ ID:5140.

A function of VGAM2429 is therefore inhibition of Apical Protein-like (Xenopus laevis) (APXL, Accession NM_001649), a gene which is implicated in amiloride-sensitive sodium channel activity. Accordingly, utilities of VGAM2429 include diagnosis, prevention and treatment of diseases and clinical conditions associated with APXL. The function of APXL and its association with various diseases and clinical conditions, has been established by previous studies, as described hereinabove with reference to VGAM152. Eukaryotic Translation Initiation Factor 2, Subunit 3 Gamma, 52 kDa (EIF2S3, Accession NM_001415) is another VGAM2429 host target gene. EIF2S3 BINDING SITE is HOST TARGET binding site found in the 3' untranslated region of mRNA encoded by EIF2S3, corresponding to a HOST TARGET binding site such as BINDING SITE I, BINDING SITE II or BINDING SITE III. Table 2 illustrates the complementarity of the nucleotide sequences of EIF2S3 BINDING SITE, designated SEQ ID:7110, to the nucleotide sequence of VGAM2429 RNA, herein designated VGAM RNA, also designated SEQ ID:5140.

Another function of VGAM2429 is therefore inhibition of Eukaryotic Translation Initiation Factor 2, Subunit 3 Gamma, 52 kDa (EIF2S3, Accession NM_001415), a gene which functions in the early steps of protein synthesis. Accordingly, utilities of VGAM2429 include diagnosis, prevention and treatment of diseases and clinical conditions associated with EIF2S3. The function of EIF2S3 and its association with various diseases and clinical conditions, has been established by previous studies, as described hereinabove with reference to VGAM1254. Lumican (LUM, Accession NM_002345) is another VGAM2429 host target gene. LUM BINDING SITE is HOST TARGET binding site found in the 3' untranslated region of mRNA encoded by LUM, corresponding to a HOST TARGET binding site such as BINDING SITE I, BINDING SITE II or BINDING SITE III. Table 2 illustrates the complementarity of the nucleotide sequences of LUM BINDING SITE, designated SEQ ID:8145, to the nucleotide sequence of VGAM2429 RNA, herein designated VGAM RNA, also designated SEQ ID:5140.

Another function of VGAM2429 is therefore inhibition of Lumican (LUM, Accession NM_002345). Accordingly, utilities of VGAM2429 include diagnosis, prevention and treatment of diseases and clinical conditions associated with LUM. ERp44 (Accession XM_088476) is another VGAM2429 host target gene. ERp44 BINDING SITE is HOST TARGET binding site found in the 3' untranslated region of mRNA encoded by ERp44, corresponding to a HOST TARGET binding site such as BINDING SITE I, BINDING SITE II or BINDING SITE III. Table 2 illustrates the complementarity of the nucleotide sequences of ERp44 BINDING SITE, designated SEQ ID:39726, to the nucleotide sequence of VGAM2429 RNA, herein designated VGAM RNA, also designated SEQ ID:5140.

Another function of VGAM2429 is therefore inhibition of ERp44 (Accession XM_088476). Accordingly, utilities of VGAM2429 include diagnosis, prevention and treatment of diseases and clinical conditions associated with ERp44. PNPASE (Accession XM_048088) is another VGAM2429 host target gene. PNPASE BINDING SITE is HOST TARGET binding site found in the 3' untranslated region of mRNA encoded by PNPASE, corresponding to a HOST TARGET binding site such as BINDING SITE I, BINDING SITE II or BINDING SITE III. Table 2 illustrates the complementarity of the nucleotide sequences of PNPASE BINDING SITE, designated SEQ ID:35102, to the nucleotide sequence of VGAM2429 RNA, herein designated VGAM RNA, also designated SEQ ID:5140.

Another function of VGAM2429 is therefore inhibition of PNPASE (Accession XM_048088). Accordingly, utilities of VGAM2429 include diagnosis, prevention and treatment of diseases and clinical conditions associated with PNPASE. LOC115648 (Accession NM_145326) is another VGAM2429 host target gene. LOC115648 BINDING SITE is HOST TARGET binding site found in the 3' untranslated region of mRNA encoded by LOC115648, corresponding to a HOST TARGET binding site such as BINDING SITE I, BINDING SITE II or BINDING SITE III. Table 2 illustrates the complementarity of the nucleotide sequences of LOC115648 BINDING SITE, designated SEQ ID:29829, to the nucleotide sequence of VGAM2429 RNA, herein designated VGAM RNA, also designated SEQ ID:5140.

Another function of VGAM2429 is therefore inhibition of LOC115648 (Accession NM_145326). Accordingly, utilities of VGAM2429 include diagnosis, prevention and treatment of diseases and clinical conditions associated with LOC115648. LOC255308 (Accession XM_170536) is another VGAM2429 host target gene. LOC255308 BINDING SITE is HOST TARGET binding site found in the 3' untranslated region of mRNA encoded by LOC255308, corresponding to a HOST TARGET binding site such as BINDING SITE I, BINDING SITE II or BINDING SITE III. Table 2 illustrates the complementarity of the nucleotide sequences of LOC255308 BINDING SITE, designated SEQ ID:45353, to the nucleotide sequence of VGAM2429 RNA, herein designated VGAM RNA, also designated SEQ ID:5140.

Another function of VGAM2429 is therefore inhibition of LOC255308 (Accession XM_170536). Accordingly, utilities of VGAM2429 include diagnosis, prevention and treatment of diseases and clinical conditions associated with LOC255308. FIG. 1 further provides a conceptual description of a novel bioinformatically detected viral gene of the present invention, referred to here as Viral Genomic Address Messenger 2430 (VGAM2430) viral gene, which modulates expression of respective host target genes thereof, the function and utility of which host target genes is known in the art.

VGAM2430 is a novel bioinformatically detected regulatory, non protein coding, viral micro RNA (miRNA) gene. The method by which VGAM2430 was detected is described hereinabove with reference to FIGS. 1-8.

VGAM2430 gene, herein designated VGAM GENE, is a viral gene contained in the genome of Goatpox Virus. VGAM2430 host target gene, herein designated VGAM HOST TARGET GENE, is a human gene contained in the human genome.

VGAM2430 gene encodes a VGAM2430 precursor RNA, herein designated VGAM PRECURSOR RNA. Similar to other miRNA genes, and unlike most ordinary genes, VGAM2430 precursor RNA does not encode a protein. A nucleotide sequence identical or highly similar to the nucleotide sequence of VGAM2430 precursor RNA is designated SEQ ID:2416, and is provided hereinbelow with reference to the sequence listing part. Nucleotide sequence SEQ ID:2416 is located at position 123911 relative to the genome of Goatpox Virus.

VGAM2430 precursor RNA folds onto itself, forming VGAM2430 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2430 folded precursor RNA into VGAM2430 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM2430 RNA is designated SEQ ID:5141, and is provided hereinbelow with reference to the sequence listing part.

VGAM2430 host target gene, herein designated VGAM HOST TARGET GENE, encodes a corresponding messenger RNA, VGAM2430 host target RNA, herein designated VGAM HOST TARGET RNA. VGAM2430 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2430 RNA, herein designated VGAM RNA, binds complementarily to one or more host target binding sites located in untranslated regions of VGAM2430 host target RNA, herein designated VGAM HOST TARGET RNA. This complementary binding is due to the fact that the nucleotide sequence of VGAM2430 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2430 RNA, herein designated VGAM RNA, may have a different number of host target binding sites in untranslated regions of a VGAM2430 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2430 RNA, herein designated VGAM RNA, to host target binding sites on VGAM2430 host target RNA, herein designated VGAM HOST TARGET RNA, such as BINDING SITE I, BINDING SITE II and BINDING SITE III, inhibits translation of VGAM2430 host target RNA into VGAM2430 host target protein, herein designated VGAM HOST TARGET PROTEIN. VGAM host target protein is therefore outlined by a broken line.

It is appreciated that VGAM2430 host target gene, herein designated VGAM HOST TARGET GENE, in fact represents a plurality of VGAM2430 host target genes. The mRNA of each one of this plurality of VGAM2430 host target genes comprises one or more host target binding sites, each having a nucleotide sequence which is at least partly complementary to VGAM2430 RNA, herein designated VGAM RNA, and which when bound by VGAM2430 RNA causes inhibition of translation of respective one or more VGAM2430 host target proteins.

It is further appreciated by one skilled in the art that the mode of translational inhibition illustrated by FIG. 1 with specific reference to translational inhibition exerted by VGAM2430 gene, herein designated VGAM GENE, on one or more VGAM2430 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2430 is inhibition of expression of host target genes, as part of a novel viral mechanism of attacking a host. Accordingly, utilities of VGAM2430 include diagnosis, prevention and treatment of viral infection by Goatpox Virus. Specific functions, and accordingly utilities, of VGAM2430 correlate with, and may be deduced from, the identity of the host target genes which VGAM2430 binds and inhibits, and the function of these host target genes, as elaborated hereinbelow.

Nucleotide sequences of the VGAM2430 precursor RNA, herein designated VGAM PRECURSOR RNA, and of the 'diced' VGAM2430 RNA, herein designated VGAM RNA, and a schematic representation of the secondary folding of VGAM2430 folded precursor RNA, herein designated VGAM FOLDED PRECURSOR RNA, of VGAM2430 are further described hereinbelow with reference to Table 1.

Nucleotide sequences of host target binding sites, such as BINDING SITE-I, BINDING SITE-II and BINDING SITE-III of FIG. 1, found on VGAM2430 host target RNA, and schematic representation of the complementarity of each of these host target binding sites to VGAM2430 RNA, herein designated VGAM RNA, are described hereinbelow with reference to Table 2.

As mentioned hereinabove with reference to FIG. 1, a function of VGAM2430 gene, herein designated VGAM is inhibition of expression of VGAM2430 target genes. It is appreciated that specific functions, and accordingly utilities, of VGAM2430 correlate with, and may be deduced from, the identity of the target genes which VGAM2430 binds and inhibits, and the function of these target genes, as elaborated hereinbelow.

Ceroid-lipofuscinosis, Neuronal 5 (CLN5, Accession NM_006493) is a VGAM2430 host target gene. CLN5 BINDING SITE is HOST TARGET binding site found in the 3' untranslated region of mRNA encoded by CLN5, corresponding to a HOST TARGET binding site such as BINDING SITE I, BINDING SITE II or BINDING SITE III. Table 2 illustrates the complementarity of the nucleotide sequences of CLN5 BINDING SITE, designated SEQ ID:13230, to the nucleotide sequence of VGAM2430 RNA, herein designated VGAM RNA, also designated SEQ ID:5141.

A function of VGAM2430 is therefore inhibition of Ceroid-lipofuscinosis, Neuronal 5 (CLN5, Accession NM_006493). Accordingly, utilities of VGAM2430 include diagnosis, prevention and treatment of diseases and clinical conditions associated with CLN5. DKFZP434I0714 (Accession XM_098247) is another VGAM2430 host target gene. DKFZP434I0714 BINDING SITE is HOST TARGET binding site found in the 3' untranslated region of mRNA encoded by DKFZP434I0714, corresponding to a HOST TARGET binding site such as BINDING SITE I, BINDING SITE II or BINDING SITE III. Table 2 illustrates the complementarity of the nucleotide sequences of DKFZP434I0714 BINDING SITE, designated SEQ ID:41529, to the nucleotide sequence of VGAM2430 RNA, herein designated VGAM RNA, also designated SEQ ID:5141.

Another function of VGAM2430 is therefore inhibition of DKFZP434I0714 (Accession XM_098247). Accordingly, utilities of VGAM2430 include diagnosis, prevention and treatment of diseases and clinical conditions associated with DKFZP434I0714. DKFZP564F013 (Accession XM_168479) is another VGAM2430 host target gene. DKFZP564F013 BINDING SITE is HOST TARGET binding site found in the 3' untranslated region of mRNA encoded by DKFZP564F013, corresponding to a HOST TARGET binding site such as BINDING SITE I, BINDING SITE II or BINDING SITE III. Table 2 illustrates the complementarity of the nucleotide sequences of DKFZP564F013 BINDING SITE, designated SEQ ID:45200, to the nucleotide sequence of VGAM2430 RNA, herein designated VGAM RNA, also designated SEQ ID:5141.

Another function of VGAM2430 is therefore inhibition of DKFZP564F013 (Accession XM_168479). Accordingly, utilities of VGAM2430 include diagnosis, prevention and treatment of diseases and clinical conditions associated with DKFZP564F013. KIAA1674 (Accession XM_044065) is another VGAM2430 host target gene. KIAA1674 BINDING SITE is HOST TARGET binding site found in the 3' untranslated region of mRNA encoded by KIAA1674, corresponding to a HOST TARGET binding site such as BINDING SITE I, BINDING SITE II or BINDING SITE III. Table 2 illustrates the complementarity of the nucleotide sequences of KIAA1674 BINDING SITE, designated SEQ ID:34111, to the nucleotide sequence of VGAM2430 RNA, herein designated VGAM RNA, also designated SEQ ID:5141.

Another function of VGAM2430 is therefore inhibition of KIAA1674 (Accession XM_044065). Accordingly, utilities of VGAM2430 include diagnosis, prevention and treatment of diseases and clinical conditions associated with KIAA1674. LOC145773 (Accession XM_085237) is another VGAM2430 host target gene. LOC145773 BINDING SITE is HOST TARGET binding site found in the 3' untranslated region of mRNA encoded by LOC145773, corresponding to a HOST TARGET binding site such as BINDING SITE I, BINDING SITE II or BINDING SITE III. Table 2 illustrates the complementarity of the nucleotide sequences of LOC145773 BINDING SITE, designated SEQ ID:37984, to the nucleotide sequence of VGAM2430 RNA, herein designated VGAM RNA, also designated SEQ ID:5141.

Another function of VGAM2430 is therefore inhibition of LOC145773 (Accession XM_085237). Accordingly, utilities of VGAM2430 include diagnosis, prevention and treatment of diseases and clinical conditions associated with LOC145773. FIG. 1 further provides a conceptual description of a novel bioinformatically detected viral gene of the present invention, referred to here as Viral Genomic Address Messenger 2431 (VGAM2431) viral gene, which modulates expression of respective host target genes thereof, the function and utility of which host target genes is known in the art.

VGAM2431 is a novel bioinformatically detected regulatory, non protein coding, viral micro RNA (miRNA) gene. The method by which VGAM2431 was detected is described hereinabove with reference to FIGS. 1-8.

VGAM2431 gene, herein designated VGAM GENE, is a viral gene contained in the genome of Goatpox Virus. VGAM2431 host target gene, herein designated VGAM HOST TARGET GENE, is a human gene contained in the human genome.

VGAM2431 gene encodes a VGAM2431 precursor RNA, herein designated VGAM PRECURSOR RNA. Similar to other miRNA genes, and unlike most ordinary genes, VGAM2431 precursor RNA does not encode a protein. A nucleotide sequence identical or highly similar to the nucleotide sequence of VGAM2431 precursor RNA is designated SEQ ID:2417, and is provided hereinbelow with reference to the sequence listing part. Nucleotide sequence SEQ ID:2417 is located at position 113097 relative to the genome of Goatpox Virus.

VGAM2431 precursor RNA folds onto itself, forming VGAM2431 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2431 folded precursor RNA into VGAM2431 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM2431 RNA is designated SEQ ID:5142, and is provided hereinbelow with reference to the sequence listing part.

VGAM2431 host target gene, herein designated VGAM HOST TARGET GENE, encodes a corresponding messenger RNA, VGAM2431 host target RNA, herein designated VGAM HOST TARGET RNA. VGAM2431 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2431 RNA, herein designated VGAM RNA, binds complementarily to one or more host target binding sites located in untranslated regions of VGAM2431 host target RNA, herein designated VGAM HOST TARGET RNA. This complementary binding is due to the fact that the nucleotide sequence of VGAM2431 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2431 RNA, herein designated VGAM RNA, may have a different number of host target binding sites in untranslated regions of a VGAM2431 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2431 RNA, herein designated VGAM RNA, to host target binding sites on VGAM2431 host target RNA, herein designated VGAM HOST TARGET RNA, such as BINDING SITE I, BINDING SITE II and BINDING SITE III, inhibits translation of VGAM2431 host target RNA into VGAM2431 host target protein, herein designated VGAM HOST TARGET PROTEIN. VGAM host target protein is therefore outlined by a broken line.

It is appreciated that VGAM2431 host target gene, herein designated VGAM HOST TARGET GENE, in fact represents a plurality of VGAM2431 host target genes. The mRNA of each one of this plurality of VGAM2431 host target genes comprises one or more host target binding sites, each having a nucleotide sequence which is at least partly complementary to VGAM2431 RNA, herein designated VGAM RNA, and which when bound by VGAM2431 RNA causes inhibition of translation of respective one or more VGAM2431 host target proteins.

It is further appreciated by one skilled in the art that the mode of translational inhibition illustrated by FIG. 1 with specific reference to translational inhibition exerted by VGAM2431 gene, herein designated VGAM GENE, on one or more VGAM2431 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2431 is inhibition of expression of host target genes, as part of a novel viral mechanism of attacking a host. Accordingly, utilities of VGAM2431 include diagnosis, prevention and treatment of viral infection by Goatpox Virus. Specific functions, and accordingly utilities, of VGAM2431 correlate with, and may be deduced from, the identity of the host target genes which VGAM2431 binds and inhibits, and the function of these host target genes, as elaborated hereinbelow.

Nucleotide sequences of the VGAM2431 precursor RNA, herein designated VGAM PRECURSOR RNA, and of the 'diced' VGAM2431 RNA, herein designated VGAM RNA, and a schematic representation of the secondary folding of VGAM2431 folded precursor RNA, herein designated VGAM FOLDED PRECURSOR RNA, of VGAM2431 are further described hereinbelow with reference to Table 1.

Nucleotide sequences of host target binding sites, such as BINDING SITE-I, BINDING SITE-II and BINDING SITE-III of FIG. 1, found on VGAM2431 host target RNA, and schematic representation of the complementarity of each of these host target binding sites to VGAM2431 RNA, herein designated VGAM RNA, are described hereinbelow with reference to Table 2.

As mentioned hereinabove with reference to FIG. 1, a function of VGAM2431 gene, herein designated VGAM is inhibition of expression of VGAM2431 target genes. It is appreciated that specific functions, and accordingly utilities, of VGAM2431 correlate with, and may be deduced from, the identity of the target genes which VGAM2431 binds and inhibits, and the function of these target genes, as elaborated hereinbelow.

Cyclin F (CCNF, Accession NM_001761) is a VGAM2431 host target gene. CCNF BINDING SITE is HOST TARGET binding site found in the 3' untranslated region of mRNA encoded by CCNF, corresponding to a HOST TARGET binding site such as BINDING SITE I, BINDING SITE II or BINDING SITE III. Table 2 illustrates the complementarity of the nucleotide sequences of CCNF BINDING SITE, designated SEQ ID:7524, to the nucleotide sequence of VGAM2431 RNA, herein designated VGAM RNA, also designated SEQ ID:5142.

A function of VGAM2431 is therefore inhibition of Cyclin F (CCNF, Accession NM_001761), a gene which likely to be involved in the control of the cell cycle during s phase and g2. Accordingly, utilities of VGAM2431 include diagnosis, prevention and treatment of diseases and clinical conditions associated with CCNF. The function of CCNF and its association with various diseases and clinical conditions, has been established by previous studies, as described hereinabove with reference to VGAM367. Mitogen-activated Protein Kinase Kinase Kinase 1 (MAP3K1, Accession XM_042066) is another VGAM2431 host target gene. MAP3K1 BINDING SITE is HOST TARGET binding site found in the 3' untranslated region of mRNA encoded by MAP3K1, corresponding to a HOST TARGET binding site such as BINDING SITE I, BINDING SITE II or BINDING SITE III. Table 2 illustrates the complementarity of the nucleotide sequences of MAP3K1 BINDING SITE, designated SEQ ID:33681, to the nucleotide sequence of VGAM2431 RNA, herein designated VGAM RNA, also designated SEQ ID:5142.

Another function of VGAM2431 is therefore inhibition of Mitogen-activated Protein Kinase Kinase Kinase 1 (MAP3K1, Accession XM_042066), a gene which can phosphorylate and activate mapkk 1 and mapkk 2 (mek1/mek2) which leads to phosphorylation of map kinases. it is also a highly efficient activator of the jnk cascade. Accordingly, utilities of VGAM2431 include diagnosis, prevention and treatment of diseases and clinical conditions associated with MAP3K1. The function of MAP3K1 and its association with various diseases and clinical conditions, has been established by previous studies, as described hereinabove with reference to VGAM469. C6.1A (Accession NM_024332) is another VGAM2431 host target gene. C6.1A BINDING SITE is HOST TARGET binding site found in the 3' untranslated region of mRNA encoded by C6.1A, corresponding to a HOST TARGET binding site such as BINDING SITE I, BINDING SITE II or BINDING SITE III. Table 2 illustrates the complementarity of the nucleotide sequences of C6.1A BINDING SITE, designated SEQ ID:23639, to the nucleotide sequence of VGAM2431 RNA, herein designated VGAM RNA, also designated SEQ ID:5142.

Another function of VGAM2431 is therefore inhibition of C6.1A (Accession NM_024332). Accordingly, utilities of VGAM2431 include diagnosis, prevention and treatment of diseases and clinical conditions associated with C6.1A. KIAA1715 (Accession XM_042834) is another VGAM2431 host target gene. KIAA1715 BINDING SITE is HOST TARGET binding site found in the 3' untranslated region of mRNA encoded by KIAA1715, corresponding to a HOST TARGET binding site such as BINDING SITE I, BINDING SITE II or BINDING SITE III. Table 2 illustrates the complementarity of the nucleotide sequences of KIAA1715 BINDING SITE, designated SEQ ID:33791, to the nucleotide sequence of VGAM2431 RNA, herein designated VGAM RNA, also designated SEQ ID:5142.

Another function of VGAM2431 is therefore inhibition of KIAA1715 (Accession XM_042834). Accordingly, utilities of VGAM2431 include diagnosis, prevention and treatment of diseases and clinical conditions associated with KIAA1715. LOC146839 (Accession XM_097107) is another VGAM2431 host target gene. LOC146839 BINDING SITE is HOST TARGET binding site found in the 5' untranslated region of mRNA encoded by LOC146839, corresponding to a HOST TARGET binding site such as BINDING SITE I, BINDING SITE II or BINDING SITE III. Table 2 illustrates the complementarity of the nucleotide sequences of LOC146839 BINDING SITE, designated SEQ ID:40752, to the nucleotide sequence of VGAM2431 RNA, herein designated VGAM RNA, also designated SEQ ID:5142.

Another function of VGAM2431 is therefore inhibition of LOC146839 (Accession XM_097107). Accordingly, utilities of VGAM2431 include diagnosis, prevention and treatment of diseases and clinical conditions associated with LOC146839. LOC200609 (Accession XM_117256) is another VGAM2431 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43324, to the nucleotide sequence of VGAM2431 RNA, herein designated VGAM RNA, also designated SEQ ID:5142.

Another function of VGAM2431 is therefore inhibition of LOC200609 (Accession XM_117256). Accordingly, utilities of VGAM2431 include diagnosis, prevention and treatment of diseases and clinical conditions associated with LOC200609. FIG. 1 further provides a conceptual description of a novel bioinformatically detected viral gene of the present invention, referred to here as Viral Genomic Address Messenger 2432 (VGAM2432) viral gene, which modulates expression of respective host target genes thereof, the function and utility of which host target genes is known in the art.

VGAM2432 is a novel bioinformatically detected regulatory, non protein coding, viral micro RNA (miRNA) gene. The method by which VGAM2432 was detected is described hereinabove with reference to FIGS. 1-8.

VGAM2432 gene, herein designated VGAM GENE, is a viral gene contained in the genome of Goatpox Virus. VGAM2432 host target gene, herein designated VGAM HOST TARGET GENE, is a human gene contained in the human genome.

VGAM2432 gene encodes a VGAM2432 precursor RNA, herein designated VGAM PRECURSOR RNA. Similar to other miRNA genes, and unlike most ordinary genes, VGAM2432 precursor RNA does not encode a protein. A nucleotide sequence identical or highly similar to the nucleotide sequence of VGAM2432 precursor RNA is designated SEQ ID:2418, and is provided hereinbelow with reference to the sequence listing part. Nucleotide sequence SEQ ID:2418 is located at position 76475 relative to the genome of Goatpox Virus.

VGAM2432 precursor RNA folds onto itself, forming VGAM2432 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2432 folded precursor RNA into VGAM2432 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM2432 RNA is designated SEQ ID:5143, and is provided hereinbelow with reference to the sequence listing part.

VGAM2432 host target gene, herein designated VGAM HOST TARGET GENE, encodes a corresponding messenger RNA, VGAM2432 host target RNA, herein designated VGAM HOST TARGET RNA. VGAM2432 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2432 RNA, herein designated VGAM RNA, binds complementarily to one or more host target binding sites located in untranslated regions of VGAM2432 host target RNA, herein designated VGAM HOST TARGET RNA. This complementary binding is due to the fact that the nucleotide sequence of VGAM2432 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2432 RNA, herein designated VGAM RNA, may have a different number of host target binding sites in untranslated regions of a VGAM2432 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2432 RNA, herein designated VGAM RNA, to host target binding sites on VGAM2432 host target RNA, herein designated VGAM HOST TARGET RNA, such as BINDING SITE I, BINDING SITE II and BINDING SITE III, inhibits translation of VGAM2432 host target RNA into VGAM2432 host target protein, herein designated VGAM HOST TARGET PROTEIN. VGAM host target protein is therefore outlined by a broken line.

It is appreciated that VGAM2432 host target gene, herein designated VGAM HOST TARGET GENE, in fact represents a plurality of VGAM2432 host target genes. The mRNA of each one of this plurality of VGAM2432 host target genes comprises one or more host target binding sites, each having a nucleotide sequence which is at least partly complementary to VGAM2432 RNA, herein designated VGAM RNA, and which when bound by VGAM2432 RNA causes inhibition of translation of respective one or more VGAM2432 host target proteins.

It is further appreciated by one skilled in the art that the mode of translational inhibition illustrated by FIG. 1 with specific reference to translational inhibition exerted by VGAM2432 gene, herein designated VGAM GENE, on one or more VGAM2432 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2432 is inhibition of expression of host target genes, as part of a novel viral mechanism of attacking a host. Accordingly, utilities of VGAM2432 include diagnosis, prevention and treatment of viral infection by Goatpox Virus. Specific functions, and accordingly utilities, of VGAM2432 correlate with, and may be deduced from, the identity of the host target genes which VGAM2432 binds and inhibits, and the function of these host target genes, as elaborated hereinbelow.

Nucleotide sequences of the VGAM2432 precursor RNA, herein designated VGAM PRECURSOR RNA, and of the 'diced' VGAM2432 RNA, herein designated VGAM RNA, and a schematic representation of the secondary folding of VGAM2432 folded precursor RNA, herein designated VGAM FOLDED PRECURSOR RNA, of VGAM2432 are further described hereinbelow with reference to Table 1.

Nucleotide sequences of host target binding sites, such as BINDING SITE-I, BINDING SITE-II and BINDING SITE-III of FIG. 1, found on VGAM2432 host target RNA, and schematic representation of the complementarity of each of these host target binding sites to VGAM2432 RNA, herein designated VGAM RNA, are described hereinbelow with reference to Table 2.

As mentioned hereinabove with reference to FIG. 1, a function of VGAM2432 gene, herein designated VGAM is inhibition of expression of VGAM2432 target genes. It is appreciated that specific functions, and accordingly utilities, of VGAM2432 correlate with, and may be deduced from, the identity of the target genes which VGAM2432 binds and inhibits, and the function of these target genes, as elaborated hereinbelow.

Crystallin, Zeta (quinone reductase) (CRYZ, Accession NM_001889) is a VGAM2432 host target gene. CRYZ BINDING SITE is HOST TARGET binding site found in the 3' untranslated region of mRNA encoded by CRYZ, corresponding to a HOST TARGET binding site such as BINDING SITE I, BINDING SITE II or BINDING SITE III. Table 2 illustrates the complementarity of the nucleotide sequences of CRYZ BINDING SITE, designated SEQ ID:7616, to the nucleotide sequence of VGAM2432 RNA, herein designated VGAM RNA, also designated SEQ ID:5143.

A function of VGAM2432 is therefore inhibition of Crystallin, Zeta (quinone reductase) (CRYZ, Accession NM_001889), a gene which may act in the detoxification of xenobiotics. Accordingly, utilities of VGAM2432 include diagnosis, prevention and treatment of diseases and clinical conditions associated with CRYZ. The function of CRYZ and its association with various diseases and clinical conditions, has been established by previous studies, as described hereinabove with reference to VGAM323. EphA3 (EPHA3, Accession NM_005233) is another VGAM2432 host target gene. EPHA3 BINDING SITE is HOST TARGET binding site found in the 3' untranslated region of mRNA encoded by EPHA3, corresponding to a HOST TARGET binding site such as BINDING SITE I, BINDING SITE II or BINDING SITE III. Table 2 illustrates the complementarity of the nucleotide sequences of EPHA3 BINDING SITE, designated SEQ ID:11738, to the nucleotide sequence of VGAM2432 RNA, herein designated VGAM RNA, also designated SEQ ID:5143.

Another function of VGAM2432 is therefore inhibition of EphA3 (EPHA3, Accession NM_005233), a gene which binds to ephrin-a2, -a3, -a4 and -a5. could play a role in lymphoid function. Accordingly, utilities of VGAM2432 include diagnosis, prevention and treatment of diseases and clinical conditions associated with EPHA3. The function of EPHA3 and its association with various diseases and clinical conditions, has been established by previous studies, as described hereinabove with reference to VGAM164. FLJ20686 (Accession NM_017925) is another VGAM2432 host target gene. FLJ20686 BINDING SITE is HOST TARGET binding site found in the 5' untranslated region of mRNA encoded by FLJ20686, corresponding to a HOST TARGET binding site such as BINDING SITE I, BINDING SITE II or BINDING SITE III. Table 2 illustrates the complementarity of the nucleotide sequences of FLJ20686 BINDING SITE, designated SEQ ID:19595, to the nucleotide sequence of VGAM2432 RNA, herein designated VGAM RNA, also designated SEQ ID:5143.

Another function of VGAM2432 is therefore inhibition of FLJ20686 (Accession NM_017925). Accordingly, utilities of VGAM2432 include diagnosis, prevention and treatment of diseases and clinical conditions associated with FLJ20686. KIAA0089 (Accession XM_046056) is another VGAM2432 host target gene. KIAA0089 BINDING SITE is HOST TARGET binding site found in the 3' untranslated region of mRNA encoded by KIAA0089, corresponding to a HOST TARGET binding site such as BINDING SITE I, BINDING SITE II or BINDING SITE III. Table 2 illustrates the complementarity of the nucleotide sequences of KIAA0089 BINDING SITE, designated SEQ ID:34669, to the nucleotide sequence of VGAM2432 RNA, herein designated VGAM RNA, also designated SEQ ID:5143.

Another function of VGAM2432 is therefore inhibition of KIAA0089 (Accession XM_046056). Accordingly, utilities of VGAM2432 include diagnosis, prevention and treatment of diseases and clinical conditions associated with KIAA0089. KIAA0429 (Accession NM_014751) is another VGAM2432 host target gene. KIAA0429 BINDING SITE is HOST TARGET binding site found in the 3' untranslated region of mRNA encoded by KIAA0429, corresponding to a HOST TARGET binding site such as BINDING SITE I, BINDING SITE II or BINDING SITE III. Table 2 illustrates the complementarity of the nucleotide sequences of KIAA0429 BINDING SITE, designated SEQ ID:16465, to the nucleotide sequence of VGAM2432 RNA, herein designated VGAM RNA, also designated SEQ ID:5143.

Another function of VGAM2432 is therefore inhibition of KIAA0429 (Accession NM_014751). Accordingly, utilities of VGAM2432 include diagnosis, prevention and treatment of diseases and clinical conditions associated with KIAA0429. SEC15L (Accession XM_051147) is another VGAM2432 host target gene. SEC15L BINDING SITE is HOST TARGET binding site found in the 3' untranslated region of mRNA encoded by SEC15L, corresponding to a HOST TARGET binding site such as BINDING SITE I, BINDING SITE II or BINDING SITE III. Table 2 illustrates the complementarity of the nucleotide sequences of SEC15L BINDING SITE, designated SEQ ID:35764, to the nucleotide sequence of VGAM2432 RNA, herein designated VGAM RNA, also designated SEQ ID:5143.

Another function of VGAM2432 is therefore inhibition of SEC15L (Accession XM_051147). Accordingly, utilities of VGAM2432 include diagnosis, prevention and treatment of diseases and clinical conditions associated with SEC15L.

LOC147341 (Accession XM_097223) is another VGAM2432 host target gene. LOC147341 BINDING SITE is HOST TARGET binding site found in the 3' untranslated region of mRNA encoded by LOC147341, corresponding to a HOST TARGET binding site such as BINDING SITE I, BINDING SITE II or BINDING SITE III. Table 2 illustrates the complementarity of the nucleotide sequences of LOC147341 BINDING SITE, designated SEQ ID:40825, to the nucleotide sequence of VGAM2432 RNA, herein designated VGAM RNA, also designated SEQ ID:5143.

Another function of VGAM2432 is therefore inhibition of LOC147341 (Accession XM_097223). Accordingly, utilities of VGAM2432 include diagnosis, prevention and treatment of diseases and clinical conditions associated with LOC147341. LOC256277 (Accession XM_170644) is another VGAM2432 host target gene. LOC256277 BINDING SITE is HOST TARGET binding site found in the 5' untranslated region of mRNA encoded by LOC256277, corresponding to a HOST TARGET binding site such as BINDING SITE I, BINDING SITE II or BINDING SITE III. Table 2 illustrates the complementarity of the nucleotide sequences of LOC256277 BINDING SITE, designated SEQ ID:45425, to the nucleotide sequence of VGAM2432 RNA, herein designated VGAM RNA, also designated SEQ ID:5143.

Another function of VGAM2432 is therefore inhibition of LOC256277 (Accession XM_170644). Accordingly, utilities of VGAM2432 include diagnosis, prevention and treatment of diseases and clinical conditions associated with LOC256277. LOC86651 (Accession XM_044052) is another VGAM2432 host target gene. LOC86651 BINDING SITE is HOST TARGET binding site found in the 3' untranslated region of mRNA encoded by LOC86651, corresponding to a HOST TARGET binding site such as BINDING SITE I, BINDING SITE II or BINDING SITE III. Table 2 illustrates the complementarity of the nucleotide sequences of LOC86651 BINDING SITE, designated SEQ ID:34097, to the nucleotide sequence of VGAM2432 RNA, herein designated VGAM RNA, also designated SEQ ID:5143.

Another function of VGAM2432 is therefore inhibition of LOC86651 (Accession XM_044052). Accordingly, utilities of VGAM2432 include diagnosis, prevention and treatment of diseases and clinical conditions associated with LOC86651. FIG. 1 further provides a conceptual description of a novel bioinformatically detected viral gene of the present invention, referred to here as Viral Genomic Address Messenger 2433 (VGAM2433) viral gene, which modulates expression of respective host target genes thereof, the function and utility of which host target genes is known in the art.

VGAM2433 is a novel bioinformatically detected regulatory, non protein coding, viral micro RNA (miRNA) gene. The method by which VGAM2433 was detected is described hereinabove with reference to FIGS. 1-8.

VGAM2433 gene, herein designated VGAM GENE, is a viral gene contained in the genome of Goatpox Virus. VGAM2433 host target gene, herein designated VGAM HOST TARGET GENE, is a human gene contained in the human genome.

VGAM2433 gene encodes a VGAM2433 precursor RNA, herein designated VGAM PRECURSOR RNA. Similar to other miRNA genes, and unlike most ordinary genes, VGAM2433 precursor RNA does not encode a protein. A nucleotide sequence identical or highly similar to the nucleotide sequence of VGAM2433 precursor RNA is designated SEQ ID:2419, and is provided hereinbelow with reference to the sequence listing part. Nucleotide sequence SEQ ID:2419 is located at position 30434 relative to the genome of Goatpox Virus.

VGAM2433 precursor RNA folds onto itself, forming VGAM2433 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2433 folded precursor RNA into VGAM2433 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 86%) nucleotide sequence of VGAM2433 RNA is designated SEQ ID:5144, and is provided hereinbelow with reference to the sequence listing part.

VGAM2433 host target gene, herein designated VGAM HOST TARGET GENE, encodes a corresponding messenger RNA, VGAM2433 host target RNA, herein designated VGAM HOST TARGET RNA. VGAM2433 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2433 RNA, herein designated VGAM RNA, binds complementarily to one or more host target binding sites located in untranslated regions of VGAM2433 host target RNA, herein designated VGAM HOST TARGET RNA. This complementary binding is due to the fact that the nucleotide sequence of VGAM2433 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2433 RNA, herein designated VGAM RNA, may have a different number of host target binding sites in untranslated regions of a VGAM2433 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2433 RNA, herein designated VGAM RNA, to host target binding sites on VGAM2433 host target RNA, herein designated VGAM HOST TARGET RNA, such as BINDING SITE I, BINDING SITE II and BINDING SITE III, inhibits translation of VGAM2433 host target RNA into VGAM2433 host target protein, herein designated VGAM HOST TARGET PROTEIN. VGAM host target protein is therefore outlined by a broken line.

It is appreciated that VGAM2433 host target gene, herein designated VGAM HOST TARGET GENE, in fact represents a plurality of VGAM2433 host target genes. The mRNA of each one of this plurality of VGAM2433 host target genes comprises one or more host target binding sites, each having a nucleotide sequence which is at least partly complementary to VGAM2433 RNA, herein designated VGAM RNA, and which when bound by VGAM2433 RNA causes inhibition of translation of respective one or more VGAM2433 host target proteins.

It is further appreciated by one skilled in the art that the mode of translational inhibition illustrated by FIG. 1 with specific reference to translational inhibition exerted by VGAM2433 gene, herein designated VGAM GENE, on one or more VGAM2433 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2433 is inhibition of expression of host target genes, as part of a novel viral mechanism of attacking a host. Accordingly, utilities of VGAM2433 include diagnosis, prevention and treatment of viral infection by Goatpox Virus. Specific functions, and accordingly utilities, of VGAM2433 correlate with, and may be deduced from, the identity of the host target genes which VGAM2433 binds and inhibits, and the function of these host target genes, as elaborated hereinbelow.

Nucleotide sequences of the VGAM2433 precursor RNA, herein designated VGAM PRECURSOR RNA, and of the 'diced' VGAM2433 RNA, herein designated VGAM RNA, and a schematic representation of the secondary folding of VGAM2433 folded precursor RNA, herein designated VGAM FOLDED PRECURSOR RNA, of VGAM2433 are further described hereinbelow with reference to Table 1.

Nucleotide sequences of host target binding sites, such as BINDING SITE-I, BINDING SITE-II and BINDING SITE-III of FIG. 1, found on VGAM2433 host target RNA, and schematic representation of the complementarity of each of these host target binding sites to VGAM2433 RNA, herein designated VGAM RNA, are described hereinbelow with reference to Table 2.

As mentioned hereinabove with reference to FIG. 1, a function of VGAM2433 gene, herein designated VGAM is inhibition of expression of VGAM2433 target genes. It is appreciated that specific functions, and accordingly utilities, of VGAM2433 correlate with, and may be deduced from, the identity of the target genes which VGAM2433 binds and inhibits, and the function of these target genes, as elaborated hereinbelow.

B-cell CLL/lymphoma 11B (zinc finger protein) (BCL11B, Accession NM_022898) is a VGAM2433 host target gene. BCL11B BINDING SITE is HOST TARGET binding site found in the 3' untranslated region of mRNA encoded by BCL11B, corresponding to a HOST TARGET binding site such as BINDING SITE I, BINDING SITE II or BINDING SITE III. Table 2 illustrates the complementarity of the nucleotide sequences of BCL11B BINDING SITE, designated SEQ ID:23164, to the nucleotide sequence of VGAM2433 RNA, herein designated VGAM RNA, also designated SEQ ID:5144.

A function of VGAM2433 is therefore inhibition of B-cell CLL/lymphoma 11B (zinc finger protein) (BCL11B, Accession NM_022898). Accordingly, utilities of VGAM2433 include diagnosis, prevention and treatment of diseases and clinical conditions associated with BCL11B. Cystic Fibrosis Transmembrane Conductance Regulator, ATP-binding Cassette (sub-family C, member 7) (CFTR, Accession NM_000492) is another VGAM2433 host target gene. CFTR BINDING SITE is HOST TARGET binding site found in the 3' untranslated region of mRNA encoded by CFTR, corresponding to a HOST TARGET binding site such as BINDING SITE I, BINDING SITE II or BINDING SITE III. Table 2 illustrates the complementarity of the nucleotide sequences of CFTR BINDING SITE, designated SEQ ID:6104, to the nucleotide sequence of VGAM2433 RNA, herein designated VGAM RNA, also designated SEQ ID:5144.

Another function of VGAM2433 is therefore inhibition of Cystic Fibrosis Transmembrane Conductance Regulator, ATP-binding Cassette (sub-family C, member 7) (CFTR, Accession NM_000492). Accordingly, utilities of VGAM2433 include diagnosis, prevention and treatment of diseases and clinical conditions associated with CFTR. COX15 Homolog, Cytochrome C Oxidase Assembly Protein (yeast) (COX15, Accession NM_078470) is another VGAM2433 host target gene. COX15 BINDING SITE is HOST TARGET binding site found in the 3' untranslated region of mRNA encoded by COX15, corresponding to a HOST TARGET binding site such as BINDING SITE I, BINDING SITE II or BINDING SITE III. Table 2 illustrates the complementarity of the nucleotide sequences of COX15 BINDING SITE, designated SEQ ID:27790, to the nucleotide sequence of VGAM2433 RNA, herein designated VGAM RNA, also designated SEQ ID:5144.

Another function of VGAM2433 is therefore inhibition of COX15 Homolog, Cytochrome C Oxidase Assembly Protein (yeast) (COX15, Accession NM_078470). Accordingly, utilities of VGAM2433 include diagnosis, prevention and treatment of diseases and clinical conditions associated with COX15. Replication Protein A3, 14 kDa (RPA3, Accession NM_002947) is another VGAM2433 host target gene. RPA3 BINDING SITE is HOST TARGET binding site found in the 5' untranslated region of mRNA encoded by RPA3, corresponding to a HOST TARGET binding site such as BINDING SITE I, BINDING SITE II or BINDING SITE III. Table 2 illustrates the complementarity of the nucleotide sequences of RPA3 BINDING SITE, designated SEQ ID:8858, to the nucleotide sequence of VGAM2433 RNA, herein designated VGAM RNA, also designated SEQ ID:5144.

Another function of VGAM2433 is therefore inhibition of Replication Protein A3, 14 kDa (RPA3, Accession NM_002947). Accordingly, utilities of VGAM2433 include diagnosis, prevention and treatment of diseases and clinical conditions associated with RPA3. Sodium Channel, Voltage-gated, Type III, Alpha Polypeptide (SCN3A, Accession NM_006922) is another VGAM2433 host target gene. SCN3A BINDING SITE is HOST TARGET binding site found in the 3' untranslated region of mRNA encoded by SCN3A, corresponding to a HOST TARGET binding site such as BINDING SITE I, BINDING SITE II or BINDING SITE III. Table 2 illustrates the complementarity of the nucleotide sequences of SCN3A BINDING SITE, designated SEQ ID:13798, to the nucleotide sequence of VGAM2433 RNA, herein designated VGAM RNA, also designated SEQ ID:5144.

Another function of VGAM2433 is therefore inhibition of Sodium Channel, Voltage-gated, Type III, Alpha Polypeptide (SCN3A, Accession NM_006922), a gene which may be important for maintaining neural membrane excitability. Accordingly, utilities of VGAM2433 include diagnosis, prevention and treatment of diseases and clinical conditions associated with SCN3A. The function of SCN3A and its association with various diseases and clinical conditions, has been established by previous studies, as described hereinabove with reference to VGAM124. FLJ23151 (Accession NM_024772) is another VGAM2433 host target gene. FLJ23151 BINDING SITE is HOST TARGET binding site found in the 3' untranslated region of mRNA encoded by FLJ23151, corresponding to a HOST TARGET binding site such as BINDING SITE I, BINDING SITE II or BINDING SITE III. Table 2 illustrates the complementarity of the nucleotide sequences of FLJ23151 BINDING SITE, designated SEQ ID:24135, to the nucleotide sequence of VGAM2433 RNA, herein designated VGAM RNA, also designated SEQ ID:5144.

Another function of VGAM2433 is therefore inhibition of FLJ23151 (Accession NM_024772). Accordingly, utilities of VGAM2433 include diagnosis, prevention and treatment of diseases and clinical conditions associated with FLJ23151. KIAA1468 (Accession XM_166289) is another VGAM2433 host target gene. KIAA1468 BINDING SITE is HOST TARGET binding site found in the 5' untranslated region of mRNA encoded by KIAA1468, corresponding to a HOST TARGET binding site such as BINDING SITE I, BINDING SITE II or BINDING SITE III. Table 2 illustrates the complementarity of the nucleotide sequences of KIAA1468 BINDING SITE, designated SEQ ID:44102, to the nucleotide sequence of VGAM2433 RNA, herein designated VGAM RNA, also designated SEQ ID:5144.

Another function of VGAM2433 is therefore inhibition of KIAA1468 (Accession XM_166289). Accordingly, utilities of VGAM2433 include diagnosis, prevention and treatment of diseases and clinical conditions associated with KIAA1468. LRP15 (Accession NM_052953) is another VGAM2433 host target gene. LRP15 BINDING SITE is HOST TARGET binding site found in the 5' untranslated region of mRNA encoded by LRP15, corresponding to a HOST TARGET binding site such as BINDING SITE I, BINDING SITE II or BINDING SITE III. Table 2 illustrates the complementarity of the nucleotide sequences of LRP15 BINDING SITE, designated SEQ ID:27510, to the nucleotide sequence of VGAM2433 RNA, herein designated VGAM RNA, also designated SEQ ID:5144.

Another function of VGAM2433 is therefore inhibition of LRP15 (Accession NM_052953). Accordingly, utilities of VGAM2433 include diagnosis, prevention and treatment of diseases and clinical conditions associated with LRP15. LOC121536 (Accession XM_058567) is another VGAM2433 host target gene. LOC121536 BINDING SITE is HOST TARGET binding site found in the 3' untranslated region of mRNA encoded by LOC121536, corresponding to a HOST TARGET binding site such as BINDING SITE I, BINDING SITE II or BINDING SITE III. Table 2 illustrates the complementarity of the nucleotide sequences of LOC121536 BINDING SITE, designated SEQ ID:36666, to the nucleotide sequence of VGAM2433 RNA, herein designated VGAM RNA, also designated SEQ ID:5144.

Another function of VGAM2433 is therefore inhibition of LOC121536 (Accession XM_058567). Accordingly, utilities of VGAM2433 include diagnosis, prevention and treatment of diseases and clinical conditions associated with LOC121536. LOC254251 (Accession XM_171088) is another VGAM2433 host target gene. LOC254251 BINDING SITE is HOST TARGET binding site found in the 3' untranslated region of mRNA encoded by LOC254251, corresponding to a HOST TARGET binding site such as BINDING SITE I, BINDING SITE II or BINDING SITE III. Table 2 illustrates the complementarity of the nucleotide sequences of LOC254251 BINDING SITE, designated SEQ ID:45895, to the nucleotide sequence of VGAM2433 RNA, herein designated VGAM RNA, also designated SEQ ID:5144.

14801

Another function of VGAM2433 is therefore inhibition of LOC254251 (Accession XM_171088). Accordingly, utilities of VGAM2433 include diagnosis, prevention and treatment of diseases and clinical conditions associated with LOC254251. LOC51301 (Accession NM_016591) is another VGAM2433 host target gene. LOC51301 BINDING SITE is HOST TARGET binding site found in the 5' untranslated region of mRNA encoded by LOC51301, corresponding to a HOST TARGET binding site such as BINDING SITE I, BINDING SITE II or BINDING SITE III. Table 2 illustrates the complementarity of the nucleotide sequences of LOC51301 BINDING SITE, designated SEQ ID:18674, to the nucleotide sequence of VGAM2433 RNA, herein designated VGAM RNA, also designated SEQ ID:5144.

Another function of VGAM2433 is therefore inhibition of LOC51301 (Accession NM_016591). Accordingly, utilities of VGAM2433 include diagnosis, prevention and treatment of diseases and clinical conditions associated with LOC51301. FIG. 1 further provides a conceptual description of a novel bioinformatically detected viral gene of the present invention, referred to here as Viral Genomic Address Messenger 2434 (VGAM2434) viral gene, which modulates expression of respective host target genes thereof, the function and utility of which host target genes is known in the art.

VGAM2434 is a novel bioinformatically detected regulatory, non protein coding, viral micro RNA (miRNA) gene. The method by which VGAM2434 was detected is described hereinabove with reference to FIGS. 1-8.

VGAM2434 gene, herein designated VGAM GENE, is a viral gene contained in the genome of Goatpox Virus. VGAM2434 host target gene, herein designated VGAM HOST TARGET GENE, is a human gene contained in the human genome.

VGAM2434 gene encodes a VGAM2434 precursor RNA, herein designated VGAM PRECURSOR RNA. Similar to other miRNA genes, and unlike most ordinary genes, VGAM2434 precursor RNA does not encode a protein. A nucleotide sequence identical or highly similar to the nucleotide sequence of VGAM2434 precursor RNA is designated SEQ ID:2420, and is provided hereinbelow with reference to the sequence listing part. Nucleotide sequence SEQ ID:2420 is located at position 130867 relative to the genome of Goatpox Virus.

VGAM2434 precursor RNA folds onto itself, forming VGAM2434 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2434 folded precursor RNA into VGAM2434 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2434 RNA is designated SEQ ID:5145, and is provided hereinbelow with reference to the sequence listing part.

VGAM2434 host target gene, herein designated VGAM HOST TARGET GENE, encodes a corresponding messenger RNA, VGAM2434 host target RNA, herein designated VGAM HOST TARGET RNA. VGAM2434 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2434 RNA, herein designated VGAM RNA, binds complementarily to one or more host target binding sites located in untranslated regions of VGAM2434 host target RNA, herein designated VGAM HOST TARGET RNA. This complementary binding is due to the fact that the nucleotide sequence of VGAM2434 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2434 RNA, herein designated VGAM RNA, may have a different number of host target binding sites in untranslated regions of a VGAM2434 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2434 RNA, herein designated VGAM RNA, to host target binding sites on VGAM2434 host target RNA, herein designated VGAM HOST TARGET RNA, such as BINDING SITE I, BINDING SITE II and BINDING SITE III, inhibits translation of VGAM2434 host target RNA into VGAM2434 host target protein, herein designated VGAM HOST TARGET PROTEIN. VGAM host target protein is therefore outlined by a broken line.

It is appreciated that VGAM2434 host target gene, herein designated VGAM HOST TARGET GENE, in fact represents a plurality of VGAM2434 host target genes. The mRNA of each one of this plurality of VGAM2434 host target genes comprises one or more host target binding sites, each having a nucleotide sequence which is at least partly complementary to VGAM2434 RNA, herein designated VGAM RNA, and which when bound by VGAM2434 RNA causes inhibition of translation of respective one or more VGAM2434 host target proteins.

It is further appreciated by one skilled in the art that the mode of translational inhibition illustrated by FIG. 1 with specific reference to translational inhibition exerted by VGAM2434 gene, herein designated VGAM GENE, on one or more VGAM2434 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2434 is inhibition of expression of host target genes, as part of a novel viral mechanism of attacking a host. Accordingly, utilities of VGAM2434 include diagnosis, prevention and treatment of viral infection by Goatpox Virus. Specific functions, and accordingly utilities, of VGAM2434 correlate with, and may be deduced from, the identity of the host target genes which VGAM2434 binds and inhibits, and the function of these host target genes, as elaborated hereinbelow.

Nucleotide sequences of the VGAM2434 precursor RNA, herein designated VGAM PRECURSOR RNA, and of the 'diced' VGAM2434 RNA, herein designated VGAM RNA, and a schematic representation of the secondary folding of VGAM2434 folded precursor RNA, herein designated VGAM FOLDED PRECURSOR RNA, of VGAM2434 are further described hereinbelow with reference to Table 1.

Nucleotide sequences of host target binding sites, such as BINDING SITE-I, BINDING SITE-II and BINDING SITE-III of FIG. 1, found on VGAM2434 host target RNA, and schematic representation of the complementarity of each of these host target binding sites to VGAM2434 RNA, herein designated VGAM RNA, are described hereinbelow with reference to Table 2.

As mentioned hereinabove with reference to FIG. 1, a function of VGAM2434 gene, herein designated VGAM is inhibition of expression of VGAM2434 target genes. It is appreciated that specific functions, and accordingly utilities, of VGAM2434 correlate with, and may be deduced from, the identity of the target genes which VGAM2434 binds and inhibits, and the function of these target genes, as elaborated hereinbelow.

Alpha-1-B Glycoprotein (A1BG, Accession NM_130786) is a VGAM2434 host target gene. A1BG BINDING SITE1 and A1BG BINDING SITE2 are HOST TARGET binding sites found in untranslated regions of mRNA encoded by A1BG, corresponding to HOST TARGET binding sites such as BINDING SITE I, BINDING SITE II or BINDING SITE III. Table 2 illustrates the complementarity of the nucleotide sequences of A1BG BINDING SITE1 and A1BG BINDING SITE2, designated SEQ ID:28279 and SEQ ID:28280 respectively, to the nucleotide sequence of VGAM2434 RNA, herein designated VGAM RNA, also designated SEQ ID:5145.

A function of VGAM2434 is therefore inhibition of Alpha-1-B Glycoprotein (A1BG, Accession NM_130786), a gene which a plasma protein of unknown function. Accordingly, utilities of VGAM2434 include diagnosis, prevention and treatment of diseases and clinical conditions associated with A1BG. The function of A1BG and its association with various diseases and clinical conditions, has been established by previous studies, as described hereinabove with reference to VGAM172. Apoptotic Protease Activating Factor (APAF1, Accession NM_001160) is another VGAM2434 host target gene. APAF1 BINDING SITE1 through APAF1 BINDING SITE4 are HOST TARGET binding sites found in untranslated regions of mRNA encoded by APAF1, corresponding to HOST TARGET binding sites such as BINDING SITE I, BINDING SITE II or BINDING SITE III. Table 2 illustrates the complementarity of the nucleotide sequences of APAF1 BINDING SITE1 through APAF1 BINDING SITE4, designated SEQ ID:6830, SEQ ID:6831, SEQ ID:14869 and SEQ ID:14870 respectively, to the nucleotide sequence of VGAM2434 RNA, herein designated VGAM RNA, also designated SEQ ID:5145.

Another function of VGAM2434 is therefore inhibition of Apoptotic Protease Activating Factor (APAF1, Accession NM_001160), a gene which functions in the mitochondrial apoptotic pathway that leads to caspase 9 dependent activation of caspase 3. Accordingly, utilities of VGAM2434 include diagnosis, prevention and treatment of diseases and clinical conditions associated with APAF1. The function of APAF1 and its association with various diseases and clinical conditions, has been established by previous studies, as described hereinabove with reference to VGAM552. Aquaporin 6, Kidney Specific (AQP6, Accession NM_001652) is another VGAM2434 host target gene. AQP6 BINDING SITE1 and AQP6 BINDING SITE2 are HOST TARGET binding sites found in untranslated regions of mRNA encoded by AQP6, corresponding to HOST TARGET binding sites such as BINDING SITE I, BINDING SITE II or BINDING SITE III. Table 2 illustrates the complementarity of the nucleotide sequences of AQP6 BINDING SITE1 and AQP6 BINDING SITE2, designated SEQ ID:7361 and SEQ ID:27619 respectively, to the nucleotide sequence of VGAM2434 RNA, herein designated VGAM RNA, also designated SEQ ID:5145.

Another function of VGAM2434 is therefore inhibition of Aquaporin 6, Kidney Specific (AQP6, Accession NM_001652), a gene which participates in distinct physiologic function such as glomerular filtration, tubular endocytosis, and acid-base metabolism. Accordingly, utilities of VGAM2434 include diagnosis, prevention and treatment of diseases and clinical conditions associated with AQP6. The function of AQP6 and its association with various diseases and clinical conditions, has been established by previous studies, as described hereinabove with reference to VGAM340. ATPase, Na+/K+ Transporting, Beta 2 Polypeptide (ATP1B2, Accession NM_001678) is another VGAM2434 host target gene. ATP1B2 BINDING SITE is HOST TARGET binding site found in the 3' untranslated region of mRNA encoded by ATP1B2, corresponding to a HOST TARGET binding site such as BINDING SITE I, BINDING SITE II or BINDING SITE III. Table 2 illustrates the complementarity of the nucleotide sequences of ATP1B2 BINDING SITE, designated SEQ ID:7393, to the nucleotide sequence of VGAM2434 RNA, herein designated VGAM RNA, also designated SEQ ID:5145.

Another function of VGAM2434 is therefore inhibition of ATPase, Na+/K+ Transporting, Beta 2 Polypeptide (ATP1B2, Accession NM_001678), a gene which catalyzes the hydrolysis of ATP coupled with the exchange of Na +/K+ ions across the plasma membrane. Accordingly, utilities of VGAM2434 include diagnosis, prevention and treatment of diseases and clinical conditions associated with ATP1B2. The function of ATP1B2 and its association with various diseases and clinical conditions, has been established by previous studies, as described hereinabove with reference to VGAM152. ATPase, Class I, Type 8B, Member 2 (ATP8B2, Accession XM_036933) is another VGAM2434 host target gene. ATP8B2 BINDING SITE is HOST TARGET binding site found in the 3' untranslated region of mRNA encoded by ATP8B2, corresponding to a HOST TARGET binding site such as BINDING SITE I, BINDING SITE II or BINDING SITE III. Table 2 illustrates the complementarity of the nucleotide sequences of ATP8B2 BINDING SITE, designated SEQ ID:32517, to the nucleotide sequence of VGAM2434 RNA, herein designated VGAM RNA, also designated SEQ ID:5145.

Another function of VGAM2434 is therefore inhibition of ATPase, Class I, Type 8B, Member 2 (ATP8B2, Accession XM_036933). Accordingly, utilities of VGAM2434 include diagnosis, prevention and treatment of diseases and clinical conditions associated with ATP8B2. BRIP1 (Accession NM_032043) is another VGAM2434 host target gene. BRIP1 BINDING SITE is HOST TARGET binding site found in the 3' untranslated region of mRNA encoded by BRIP1, corresponding to a HOST TARGET binding site such as BINDING SITE I, BINDING SITE II or BINDING SITE III. Table 2 illustrates the complementarity of the nucleotide sequences of BRIP1 BINDING SITE, designated SEQ ID:25757, to the nucleotide sequence of VGAM2434 RNA, herein designated VGAM RNA, also designated SEQ ID:5145.

Another function of VGAM2434 is therefore inhibition of BRIP1 (Accession NM_032043). Accordingly, utilities of VGAM2434 include diagnosis, prevention and treatment of diseases and clinical conditions associated with BRIP1. Chromosome 20 Open Reading Frame 1 (C20orf1, Accession NM_012112) is another VGAM2434 host target gene. C20orf1 BINDING SITE is HOST TARGET binding site found in the 3' untranslated region of mRNA encoded by C20orf1, corresponding to a HOST TARGET binding site such as BINDING SITE I, BINDING SITE II or BINDING SITE III. Table 2 illustrates the complementarity of the nucleotide sequences of C20orf1 BINDING SITE, designated SEQ ID:14428, to the nucleotide sequence of VGAM2434 RNA, herein designated VGAM RNA, also designated SEQ ID:5145.

Another function of VGAM2434 is therefore inhibition of Chromosome 20 Open Reading Frame 1 (C20orf1, Accession NM_012112), a gene which is a nuclear proliferation-associated protein. Accordingly, utilities of VGAM2434 include diagnosis, prevention and treatment of diseases and clinical conditions associated with C20orf1. The function of C20orf1 and its association with various diseases and clinical conditions, has been established by previous studies, as described hereinabove with reference to VGAM381. Cold Autoinflammatory Syndrome 1 (CIAS1, Accession NM_004895) is another VGAM2434 host target gene. CIAS1 BINDING SITE is HOST TARGET binding site found in the 5' untranslated region of mRNA encoded by CIAS1, corresponding to a HOST TARGET binding site such as BINDING SITE I, BINDING SITE II or BINDING SITE III. Table 2 illustrates the complementarity of the nucleotide sequences of CIAS1 BINDING SITE, designated SEQ ID:11322, to the nucleotide sequence of VGAM2434 RNA, herein designated VGAM RNA, also designated SEQ ID:5145.

Another function of VGAM2434 is therefore inhibition of Cold Autoinflammatory Syndrome 1 (CIAS1, Accession NM_004895), a gene which may mediate protein-protein interactions; contains a leucine rich repeat. Accordingly, utilities of VGAM2434 include diagnosis, prevention and treatment of diseases and clinical conditions associated with CIAS1. The function of CIAS1 and its association with various diseases and clinical conditions, has been established by previous studies, as described hereinabove with reference to VGAM316. COX15 Homolog, Cytochrome C Oxidase Assembly Protein (yeast) (COX15, Accession NM_078470) is another VGAM2434 host target gene. COX15 BINDING SITE is HOST TARGET binding site found in the 3' untranslated region of mRNA encoded by COX15, corresponding to a HOST TARGET binding site such as BINDING SITE I, BINDING SITE II or BINDING SITE III. Table 2 illustrates the complementarity of the nucleotide sequences of COX15 BINDING SITE, designated SEQ ID:27789, to the nucleotide sequence of VGAM2434 RNA, herein designated VGAM RNA, also designated SEQ ID:5145.

Another function of VGAM2434 is therefore inhibition of COX15 Homolog, Cytochrome C Oxidase Assembly Protein (yeast) (COX15, Accession NM_078470). Accordingly, utilities of VGAM2434 include diagnosis, prevention and treatment of diseases and clinical conditions associated with COX15. Cartilage Associated Protein (CRTAP, Accession NM_006371) is another VGAM2434 host target gene. CRTAP BINDING SITE is HOST TARGET binding site found in the 3' untranslated region of mRNA encoded by CRTAP, corresponding to a HOST TARGET binding site such as BINDING SITE I, BINDING SITE II or BINDING SITE III. Table 2 illustrates the complementarity of the nucleotide sequences of CRTAP BINDING SITE, designated SEQ ID:13063, to the nucleotide sequence of VGAM2434 RNA, herein designated VGAM RNA, also designated SEQ ID:5145.

Another function of VGAM2434 is therefore inhibition of Cartilage Associated Protein (CRTAP, Accession NM_006371), a gene which is a novel developmentally regulated chick embryo protein. Accordingly, utilities of VGAM2434 include diagnosis, prevention and treatment of diseases and clinical conditions associated with CRTAP. The function of CRTAP and its association with various diseases and clinical conditions, has been established by previous studies, as described hereinabove with reference to VGAM152. Chemokine (C-X-C motif) Ligand 16 (CXCL16, Accession NM_022059) is another VGAM2434 host target gene. CXCL16 BINDING SITE is HOST TARGET binding site found in the 3' untranslated region of mRNA encoded by CXCL16, corresponding to a HOST TARGET binding site such as BINDING SITE I, BINDING SITE II or BINDING SITE III. Table 2 illustrates the complementarity of the nucleotide sequences of CXCL16 BINDING SITE, designated SEQ ID:22598, to the nucleotide sequence of VGAM2434 RNA, herein designated VGAM RNA, also designated SEQ ID:5145.

Another function of VGAM2434 is therefore inhibition of Chemokine (C-X-C motif) Ligand 16 (CXCL16, Accession NM_022059), a gene which induces calcium mobilization. Accordingly, utilities of VGAM2434 include diagnosis, prevention and treatment of diseases and clinical conditions associated with CXCL16. The function of CXCL16 and its association with various diseases and clinical conditions, has been established by previous studies, as described hereinabove with reference to VGAM1845. Cytochrome P450, Subfamily I (aromatic compound-inducible), Polypeptide 2 (CYP1A2, Accession NM_000761) is another VGAM2434 host target gene. CYP1A2 BINDING SITE1 through CYP1A2 BINDING SITE4 are HOST TARGET binding sites found in untranslated regions of mRNA encoded by CYP1A2, corresponding to HOST TARGET binding sites such as BINDING SITE I, BINDING SITE II or BINDING SITE III. Table 2 illustrates the complementarity of the nucleotide sequences of CYP1A2 BINDING SITE1 through CYP1A2 BINDING SITE4, designated SEQ ID:6413, SEQ ID:6411, SEQ ID:34255 and SEQ ID:34257 respectively, to the nucleotide sequence of VGAM2434 RNA, herein designated VGAM RNA, also designated SEQ ID:5145.

Another function of VGAM2434 is therefore inhibition of Cytochrome P450, Subfamily I (aromatic compound-inducible), Polypeptide 2 (CYP1A2, Accession NM_000761), a gene which intervenes in an NADPH-dependent electron transport pathway. Accordingly, utilities of VGAM2434 include diagnosis, prevention and treatment of diseases and clinical conditions associated with CYP1A2. The function of CYP1A2 and its association with various diseases and clinical conditions, has been established by previous studies, as described hereinabove with reference to VGAM74. DNA Fragmentation Factor, 40kDa, Beta Polypeptide (caspase-activated DNase) (DFFB, Accession XM_113366) is another VGAM2434 host target gene. DFFB BINDING SITE is HOST TARGET binding site found in the 3' untranslated region of mRNA encoded by DFFB, corresponding to a HOST TARGET binding site such as BINDING SITE I, BINDING SITE II or BINDING SITE III. Table 2 illustrates the complementarity of the nucleotide sequences of DFFB BINDING SITE, designated SEQ ID:42246, to the nucleotide sequence of VGAM2434 RNA, herein designated VGAM RNA, also designated SEQ ID:5145.

Another function of VGAM2434 is therefore inhibition of DNA Fragmentation Factor, 40 kDa, Beta Polypeptide (caspase-activated DNase) (DFFB, Accession XM_113366), a gene which induces DNA fragmentation and chromatin condensation during apoptosis. Accordingly, utilities of VGAM2434 include diagnosis, prevention and treatment of diseases and clinical conditions associated with DFFB. The function of DFFB and its association with various diseases and clinical conditions, has been established by previous studies, as described hereinabove with reference to VGAM74. Disrupted In Schizophrenia 1 (DISC1, Accession NM_018662) is another VGAM2434 host target gene. DISC1 BINDING SITE is HOST TARGET binding site found in the 3' untranslated region of mRNA encoded by DISC1, corresponding to a HOST TARGET binding site such as BINDING SITE I, BINDING SITE II or BINDING SITE III. Table 2 illustrates the complementarity of the nucleotide sequences of DISC1 BINDING SITE, designated SEQ ID:20740, to the nucleotide sequence of VGAM2434 RNA, herein designated VGAM RNA, also designated SEQ ID:5145.

Another function of VGAM2434 is therefore inhibition of Disrupted In Schizophrenia 1 (DISC1, Accession NM_018662), a gene which has globular N-terminal domain (s) and a helical C-terminal domain. Accordingly, utilities of VGAM2434 include diagnosis, prevention and treatment of diseases and clinical conditions associated with DISC1. The function of DISC1 and its association with various diseases and clinical conditions, has been established by previous studies, as described hereinabove with reference to VGAM74. Down Syndrome Critical Region Gene 3 (DSCR3, Accession NM_006052) is another VGAM2434 host target gene. DSCR3 BINDING SITE is HOST TARGET binding site found in the 3' untranslated region of mRNA encoded by DSCR3, corresponding to a HOST TARGET binding site such as BINDING SITE I, BINDING SITE II or BINDING SITE III. Table 2 illustrates the complementarity of the nucleotide sequences of DSCR3 BINDING SITE, designated SEQ ID:12688, to the nucleotide sequence of VGAM2434 RNA, herein designated VGAM RNA, also designated SEQ ID:5145.

Another function of VGAM2434 is therefore inhibition of Down Syndrome Critical Region Gene 3 (DSCR3, Accession NM_006052). Accordingly, utilities of VGAM2434 include diagnosis, prevention and treatment of diseases and clinical conditions associated with DSCR3. EPB72 (Accession NM_004099) is another VGAM2434 host target gene. EPB72 BINDING SITE is HOST TARGET binding site found in the 3' untranslated region of mRNA encoded by EPB72, corresponding to a HOST TARGET binding site such as BINDING SITE I, BINDING SITE II or BINDING SITE III. Table 2 illustrates the complementarity of the nucleotide sequences of EPB72 BINDING SITE, designated SEQ ID:10307, to the nucleotide sequence of VGAM2434 RNA, herein designated VGAM RNA, also designated SEQ ID:5145.

Another function of VGAM2434 is therefore inhibition of EPB72 (Accession NM_004099), a gene which may regulate cation conductance. Accordingly, utilities of VGAM2434 include diagnosis, prevention and treatment of diseases and clinical conditions associated with EPB72. The function of EPB72 and its association with various diseases and clinical conditions, has been established by previous studies, as described hereinabove with reference to VGAM1560. Ellis Van Creveld Syndrome (EVC, Accession NM_014556) is another VGAM2434 host target gene. EVC BINDING SITE is HOST TARGET binding site found in the 3' untranslated region of mRNA encoded by EVC, corresponding to a HOST TARGET binding site such as BINDING SITE I, BINDING SITE II or BINDING SITE III. Table 2 illustrates the complementarity of the nucleotide sequences of EVC BINDING SITE, designated SEQ ID:15895, to the nucleotide sequence of VGAM2434 RNA, herein designated VGAM RNA, also designated SEQ ID:5145.

Another function of VGAM2434 is therefore inhibition of Ellis Van Creveld Syndrome (EVC, Accession NM_014556). Accordingly, utilities of VGAM2434 include diagnosis, prevention and treatment of diseases and clinical conditions associated with EVC. Fasciculation and Elongation Protein Zeta 1 (zygin I) (FEZ1, Accession NM_022549) is another VGAM2434 host target gene. FEZ1 BINDING SITE is HOST TARGET binding site found in the 3' untranslated region of mRNA encoded by FEZ1, corresponding to a HOST TARGET binding site such as BINDING SITE I, BINDING SITE II or BINDING SITE III. Table 2 illustrates the complementarity of the nucleotide sequences of FEZ1 BINDING SITE, designated SEQ ID:22879, to the nucleotide sequence of VGAM2434 RNA, herein designated VGAM RNA, also designated SEQ ID:5145.

Another function of VGAM2434 is therefore inhibition of Fasciculation and Elongation Protein Zeta 1 (zygin I) (FEZ1, Accession NM_022549), a gene which Zygin 1; may have a role in axonal outgrowth; has similarity to C. elegans UNC-76. Accordingly, utilities of VGAM2434 include diagnosis, prevention and treatment of diseases and clinical conditions associated with FEZ1. The function of FEZ1 and its association with various diseases and clinical conditions, has been established by previous studies, as described hereinabove with reference to VGAM37. Frizzled Homolog 4 (Drosophila) (FZD4, Accession NM_012193) is another VGAM2434 host target gene. FZD4 BINDING SITE is HOST TARGET binding site found in the 3' untranslated region of mRNA encoded by FZD4, corresponding to a HOST TARGET binding site such as BINDING SITE I, BINDING SITE II or BINDING SITE III. Table 2 illustrates the complementarity of the nucleotide sequences of FZD4 BINDING SITE, designated SEQ ID:14484, to the nucleotide sequence of VGAM2434 RNA, herein designated VGAM RNA, also designated SEQ ID:5145.

Another function of VGAM2434 is therefore inhibition of Frizzled Homolog 4 (Drosophila) (FZD4, Accession NM_012193), a gene which may function in cell polarity, cell fate specification and cancer; similar to frizzled receptor family, has seven transmembrane domains. Accordingly, utilities of VGAM2434 include diagnosis, prevention and treatment of diseases and clinical conditions associated with FZD4. The function of FZD4 and its association with various diseases and clinical conditions, has been established by previous studies, as described hereinabove with reference to VGAM309. GM2 Ganglioside Activator Protein (GM2A, Accession XM_041978) is another VGAM2434 host target gene. GM2A BINDING SITE is HOST TARGET binding site found in the 3' untranslated region of mRNA encoded by GM2A, corresponding to a HOST TARGET binding site such as BINDING SITE I, BINDING SITE II or BINDING SITE III. Table 2 illustrates the complementarity of the nucleotide sequences of GM2A BINDING SITE, designated SEQ ID:33662, to the nucleotide sequence of VGAM2434 RNA, herein designated VGAM RNA, also designated SEQ ID:5145.

Another function of VGAM2434 is therefore inhibition of GM2 Ganglioside Activator Protein (GM2A, Accession XM_041978). Accordingly, utilities of VGAM2434 include diagnosis, prevention and treatment of diseases and clinical conditions associated with GM2A. G Protein-coupled Receptor 56 (GPR56, Accession NM_005682) is another VGAM2434 host target gene. GPR56 BINDING SITE is HOST TARGET binding site found in the 5' untranslated region of mRNA encoded by GPR56, corresponding to a HOST TARGET binding site such as BINDING SITE I, BINDING SITE II or BINDING SITE III. Table 2 illustrates the complementarity of the nucleotide sequences of GPR56 BINDING SITE, designated SEQ ID:12239, to the nucleotide sequence of VGAM2434 RNA, herein designated VGAM RNA, also designated SEQ ID:5145.

Another function of VGAM2434 is therefore inhibition of G Protein-coupled Receptor 56 (GPR56, Accession NM_005682), a gene which transduces extracellular signals through heterotrimeric G proteins. Accordingly, utilities of VGAM2434 include diagnosis, prevention and treatment of diseases and clinical conditions associated with GPR56. The function of GPR56 and its association with various diseases and clinical conditions, has been established by previous studies, as described hereinabove with reference to VGAM782. G Protein-coupled Receptor 81 (GPR81, Accession NM_032554) is another VGAM2434 host target gene. GPR81 BINDING SITE is HOST TARGET binding site found in the 3' untranslated region of mRNA encoded by GPR81, corresponding to a HOST TARGET binding site such as BINDING SITE I, BINDING SITE II or BINDING SITE III. Table 2 illustrates the complementarity of the nucleotide sequences of GPR81 BINDING SITE, designated SEQ ID:26281, to the nucleotide sequence of VGAM2434 RNA, herein designated VGAM RNA, also designated SEQ ID:5145.

Another function of VGAM2434 is therefore inhibition of G Protein-coupled Receptor 81 (GPR81, Accession NM_032554). Accordingly, utilities of VGAM2434 include diagnosis, prevention and treatment of diseases and clinical conditions associated with GPR81. GRAF (Accession NM_015071) is another VGAM2434 host target gene. GRAF BINDING SITE is HOST TARGET binding site found in the 3' untranslated region of mRNA encoded by GRAF, corresponding to a HOST TARGET binding site such as BINDING SITE I, BINDING SITE II or BINDING SITE III. Table 2 illustrates the complementarity of the nucleotide sequences of GRAF BINDING SITE, designated SEQ ID:17445, to the nucleotide sequence of VGAM2434 RNA, herein designated VGAM RNA, also designated SEQ ID:5145.

Another function of VGAM2434 is therefore inhibition of GRAF (Accession NM_015071), a gene which ia a GTPase activating protein for p21-rac. Accordingly, utilities of VGAM2434 include diagnosis, prevention and treatment of diseases and clinical conditions associated with GRAF. The function of GRAF and its association with various diseases and clinical conditions, has been established by previous studies, as described hereinabove with reference to VGAM430. HCS (Accession NM_018947) is another VGAM2434 host target gene. HCS BINDING SITE is HOST TARGET binding site found in the 3' untranslated region of mRNA encoded by HCS, corresponding to a HOST TARGET binding site such as BINDING SITE I, BINDING SITE II or BINDING SITE III. Table 2 illustrates the complementarity of the nucleotide sequences of HCS BINDING SITE, designated SEQ ID:21016, to the nucleotide sequence of VGAM2434 RNA, herein designated VGAM RNA, also designated SEQ ID:5145.

Another function of VGAM2434 is therefore inhibition of HCS (Accession NM_018947). Accordingly, utilities of VGAM2434 include diagnosis, prevention and treatment of diseases and clinical conditions associated with HCS. High-mobility Group 20A (HMG20A, Accession NM_018200) is another VGAM2434 host target gene. HMG20A BINDING SITE is HOST TARGET binding site found in the 3' untranslated region of mRNA encoded by HMG20A, corresponding to a HOST TARGET binding site such as BINDING SITE I, BINDING SITE II or BINDING SITE III. Table 2 illustrates the complementarity of the nucleotide sequences of HMG20A BINDING SITE, designated SEQ ID:20074, to the nucleotide sequence of VGAM2434 RNA, herein designated VGAM RNA, also designated SEQ ID:5145.

Another function of VGAM2434 is therefore inhibition of High-mobility Group 20A (HMG20A, Accession NM_018200). Accordingly, utilities of VGAM2434 include diagnosis, prevention and treatment of diseases and clinical conditions associated with HMG20A. Isocitrate Dehydrogenase 3 (NAD+) Alpha (IDH3A, Accession NM_005530) is another VGAM2434 host target gene. IDH3A BINDING SITE is HOST TARGET binding site found in the 3' untranslated region of mRNA encoded by IDH3A, corresponding to a HOST TARGET binding site such as BINDING SITE I, BINDING SITE II or BINDING SITE III. Table 2 illustrates the complementarity of the nucleotide sequences of IDH3A BINDING SITE, designated SEQ ID:12051, to the nucleotide sequence of VGAM2434 RNA, herein designated VGAM RNA, also designated SEQ ID:5145.

Another function of VGAM2434 is therefore inhibition of Isocitrate Dehydrogenase 3 (NAD+) Alpha (IDH3A, Accession NM_005530), a gene which decarboxylates isocitrate into alpha-ketoglutarate in the TCA cycle. Accordingly, utilities of VGAM2434 include diagnosis, prevention and treatment of diseases and clinical conditions associated with IDH3A. The function of IDH3A and its association with various diseases and clinical conditions, has been established by previous studies, as described hereinabove with reference to VGAM349. Integrin, Alpha M (complement component receptor 3, alpha; also known as CD11b (p170), Macrophage Antigen Alpha Polypeptide) (ITGAM, Accession XM_050142) is another VGAM2434 host target gene. ITGAM BINDING SITE is HOST TARGET binding site found in the 3' untranslated region of mRNA encoded by ITGAM, corresponding to a HOST TARGET binding site such as BINDING SITE I, BINDING SITE II or BINDING SITE III. Table 2 illustrates the complementarity of the nucleotide sequences of ITGAM BINDING SITE, designated SEQ ID:35565, to the nucleotide sequence of VGAM2434 RNA, herein designated VGAM RNA, also designated SEQ ID:5145.

Another function of VGAM2434 is therefore inhibition of Integrin, Alpha M (complement component receptor 3, alpha; also known as CD11b (p170), Macrophage Antigen Alpha Polypeptide) (ITGAM, Accession XM_050142), a gene which is invovled in various adhesive interactions of monocytes, macrophages and granulocytes as well as in mediating the uptake of complement-coated particles. Accordingly, utilities of VGAM2434 include diagnosis, prevention and treatment of diseases and clinical conditions associated with ITGAM. The function of ITGAM and its association with various diseases and clinical conditions, has been established by previous studies, as described hereinabove with reference to VGAM1386. Leucine Zipper, Putative Tumor Suppressor 1 (LZTS1, Accession NM_021020) is another VGAM2434 host target gene. LZTS1 BINDING SITE is HOST TARGET binding site found in the 3' untranslated region of mRNA encoded by LZTS1, corresponding to a HOST TARGET binding site such as BINDING SITE I, BINDING SITE II or BINDING SITE III. Table 2 illustrates the complementarity of the nucleotide sequences of LZTS1 BINDING SITE, designated SEQ ID:22007, to the nucleotide sequence of VGAM2434 RNA, herein designated VGAM RNA, also designated SEQ ID:5145.

Another function of VGAM2434 is therefore inhibition of Leucine Zipper, Putative Tumor Suppressor 1 (LZTS1, Accession NM_021020), a gene which Zygin 1; may have a role in axonal outgrowth; has similarity to C. elegans UNC-76. Accordingly, utilities of VGAM2434 include diagnosis, prevention and treatment of diseases and clinical conditions associated with LZTS1. The function of LZTS1 and its association with various diseases and clinical conditions, has been established by previous studies, as described hereinabove with reference to VGAM890. Male Germ Cell-associated Kinase (MAK, Accession NM_005906) is another VGAM2434 host target gene. MAK BINDING SITE is HOST TARGET binding site found in the 3' untranslated region of mRNA encoded by MAK, corresponding to a HOST TARGET binding site such as BINDING SITE I, BINDING SITE II or BINDING SITE III. Table 2 illustrates the complementarity of the nucleotide sequences of MAK BINDING SITE, designated SEQ ID:12531, to the nucleotide sequence of VGAM2434 RNA, herein designated VGAM RNA, also designated SEQ ID:5145.

Another function of VGAM2434 is therefore inhibition of Male Germ Cell-associated Kinase (MAK, Accession NM_005906), a gene which plays an important role in spermatogenesis. Accordingly, utilities of VGAM2434 include diagnosis, prevention and treatment of diseases and clinical conditions associated with MAK. The function of MAK and its association with various diseases and clinical conditions, has been established by previous studies, as described hereinabove with reference to VGAM1322. MADS Box Transcription Enhancer Factor 2, Polypeptide A (myocyte enhancer factor 2A) (MEF2A, Accession NM_005587) is another VGAM2434 host target gene. MEF2A BINDING SITE is HOST TARGET binding site found in the 5' untranslated region of mRNA encoded by MEF2A, corresponding to a HOST TARGET binding site such as BINDING SITE I, BINDING SITE II or BINDING SITE III. Table 2 illustrates the complementarity of the nucleotide sequences of MEF2A BINDING SITE, designated SEQ ID:12118, to the nucleotide sequence of VGAM2434 RNA, herein designated VGAM RNA, also designated SEQ ID:5145.

Another function of VGAM2434 is therefore inhibition of MADS Box Transcription Enhancer Factor 2, Polypeptide A (myocyte enhancer factor 2A) (MEF2A, Accession NM_005587), a gene which binds a consensus sequence that regulates transcription. Accordingly, utilities of VGAM2434 include diagnosis, prevention and treatment of diseases and clinical conditions associated with MEF2A. The function of MEF2A and its association with various diseases and clinical conditions, has been established by previous studies, as described hereinabove with reference to VGAM46. Mediterranean Fever (MEFV, Accession NM_000243) is another VGAM2434 host target gene. MEFV BINDING SITE1 and MEFV BINDING SITE2 are HOST TARGET binding sites found in untranslated regions of mRNA encoded by MEFV, corresponding to HOST TARGET binding sites such as BINDING SITE I, BINDING SITE II or BINDING SITE III. Table 2 illustrates the complementarity of the nucleotide sequences of MEFV BINDING SITE1 and MEFV BINDING SITE2, designated SEQ ID:5772 and SEQ ID:5771 respectively, to the nucleotide sequence of VGAM2434 RNA, herein designated VGAM RNA, also designated SEQ ID:5145.

Another function of VGAM2434 is therefore inhibition of Mediterranean Fever (MEFV, Accession NM_000243). Accordingly, utilities of VGAM2434 include diagnosis, prevention and treatment of diseases and clinical conditions associated with MEFV. MHC Class I Polypeptide-related Sequence B (MICB, Accession NM_005931) is another VGAM2434 host target gene. MICB BINDING SITE is HOST TARGET binding site found in the 3' untranslated region of mRNA encoded by MICB, corresponding to a HOST TARGET binding site such as BINDING SITE I, BINDING SITE II or BINDING SITE III. Table 2 illustrates the complementarity of the nucleotide sequences of MICB BINDING SITE, designated SEQ ID:12564, to the nucleotide sequence of VGAM2434 RNA, herein designated VGAM RNA, also designated SEQ ID:5145.

Another function of VGAM2434 is therefore inhibition of MHC Class I Polypeptide-related Sequence B (MICB, Accession NM_005931), a gene which involved in the presentation of foreign antigens to the immune system. Accordingly, utilities of VGAM2434 include diagnosis, prevention and treatment of diseases and clinical conditions associated with MICB. The function of MICB and its association with various diseases and clinical conditions, has been established by previous studies, as described hereinabove with reference to VGAM74. Melan-A (MLANA, Accession NM_005511) is another VGAM2434 host target gene. MLANA BINDING SITE is HOST TARGET binding site found in the 3' untranslated region of mRNA encoded by MLANA, corresponding to a HOST TARGET binding site such as BINDING SITE I, BINDING SITE II or BINDING SITE III. Table 2 illustrates the complementarity of the nucleotide sequences of MLANA BINDING SITE, designated SEQ ID:12028, to the nucleotide sequence of VGAM2434 RNA, herein designated VGAM RNA, also designated SEQ ID:5145.

Another function of VGAM2434 is therefore inhibition of Melan-A (MLANA, Accession NM_005511). Accordingly, utilities of VGAM2434 include diagnosis, prevention and treatment of diseases and clinical conditions associated with MLANA. Myeloproliferative Leukemia Virus Oncogene (MPL, Accession NM_005373) is another VGAM2434 host target gene. MPL BINDING SITE is HOST TARGET binding site found in the 3' untranslated region of mRNA encoded by MPL, corresponding to a HOST TARGET binding site such as BINDING SITE I, BINDING SITE II or BINDING SITE III. Table 2 illustrates the complementarity of the nucleotide sequences of MPL BINDING SITE, designated SEQ ID:11848, to the nucleotide sequence of VGAM2434 RNA, herein designated VGAM RNA, also designated SEQ ID:5145.

Another function of VGAM2434 is therefore inhibition of Myeloproliferative Leukemia Virus Oncogene (MPL, Accession NM_005373). Accordingly, utilities of VGAM2434 include diagnosis, prevention and treatment of diseases and clinical conditions associated with MPL. V-myc Myelocytomatosis Viral Oncogene Homolog 2 (avian) (MYCL2, Accession NM_005377) is another VGAM2434 host target gene. MYCL2 BINDING SITE is HOST TARGET binding site found in the 3' untranslated region of mRNA encoded by MYCL2, corresponding to a HOST TARGET binding site such as BINDING SITE I, BINDING SITE II or BINDING SITE III. Table 2 illustrates the complementarity of the nucleotide sequences of MYCL2 BINDING SITE, designated SEQ ID:11855, to the nucleotide sequence of VGAM2434 RNA, herein designated VGAM RNA, also designated SEQ ID:5145.

Another function of VGAM2434 is therefore inhibition of V-myc Myelocytomatosis Viral Oncogene Homolog 2

(avian) (MYCL2, Accession NM_005377). Accordingly, utilities of VGAM2434 include diagnosis, prevention and treatment of diseases and clinical conditions associated with MYCL2. Nuclear Receptor Coactivator 6 (NCOA6, Accession NM_014071) is another VGAM2434 host target gene. NCOA6 BINDING SITE is HOST TARGET binding site found in the 5' untranslated region of mRNA encoded by NCOA6, corresponding to a HOST TARGET binding site such as BINDING SITE I, BINDING SITE II or BINDING SITE III. Table 2 illustrates the complementarity of the nucleotide sequences of NCOA6 BINDING SITE, designated SEQ ID:15293, to the nucleotide sequence of VGAM2434 RNA, herein designated VGAM RNA, also designated SEQ ID:5145.

Another function of VGAM2434 is therefore inhibition of Nuclear Receptor Coactivator 6 (NCOA6, Accession NM_014071), a gene which activates gene transcription through ligand-dependent association with coactivators. Accordingly, utilities of VGAM2434 include diagnosis, prevention and treatment of diseases and clinical conditions associated with NCOA6. The function of NCOA6 and its association with various diseases and clinical conditions, has been established by previous studies, as described hereinabove with reference to VGAM25. Non-POU Domain Containing, Octamer-binding (NONO, Accession XM_088688) is another VGAM2434 host target gene. NONO BINDING SITE is HOST TARGET binding site found in the 3' untranslated region of mRNA encoded by NONO, corresponding to a HOST TARGET binding site such as BINDING SITE I, BINDING SITE II or BINDING SITE III. Table 2 illustrates the complementarity of the nucleotide sequences of NONO BINDING SITE, designated SEQ ID:39899, to the nucleotide sequence of VGAM2434 RNA, herein designated VGAM RNA, also designated SEQ ID:5145.

Another function of VGAM2434 is therefore inhibition of Non-POU Domain Containing, Octamer-binding (NONO, Accession XM_088688), a gene which is a nuclear protein which contains RNA recognition motifs. Accordingly, utilities of VGAM2434 include diagnosis, prevention and treatment of diseases and clinical conditions associated with NONO. The function of NONO and its association with various diseases and clinical conditions, has been established by previous studies, as described hereinabove with reference to VGAM95. Protocadherin Beta 9 (PCDHB9, Accession NM_019119) is another VGAM2434 host target gene. PCDHB9 BINDING SITE is HOST TARGET binding site found in the 3' untranslated region of mRNA encoded by PCDHB9, corresponding to a HOST TARGET binding site such as BINDING SITE I, BINDING SITE II or BINDING SITE III. Table 2 illustrates the complementarity of the nucleotide sequences of PCDHB9 BINDING SITE, designated SEQ ID:21206, to the nucleotide sequence of VGAM2434 RNA, herein designated VGAM RNA, also designated SEQ ID:5145.

Another function of VGAM2434 is therefore inhibition of Protocadherin Beta 9 (PCDHB9, Accession NM_019119), a gene which is a potential calcium-dependent cell-adhesion protein. Accordingly, utilities of VGAM2434 include diagnosis, prevention and treatment of diseases and clinical conditions associated with PCDHB9. The function of PCDHB9 and its association with various diseases and clinical conditions, has been established by previous studies, as described hereinabove with reference to VGAM74. Phosducin-like (PDCL, Accession NM_005388) is another VGAM2434 host target gene. PDCL BINDING SITE is HOST TARGET binding site found in the 3' untranslated region of mRNA encoded by PDCL, corresponding to a HOST TARGET binding site such as BINDING SITE I, BINDING SITE II or BINDING SITE III. Table 2 illustrates the complementarity of the nucleotide sequences of PDCL BINDING SITE, designated SEQ ID:11866, to the nucleotide sequence of VGAM2434 RNA, herein designated VGAM RNA, also designated SEQ ID:5145.

Another function of VGAM2434 is therefore inhibition of Phosducin-like (PDCL, Accession NM_005388), a gene which may regulate G-protein signaling and similar to phosducins. Accordingly, utilities of VGAM2434 include diagnosis, prevention and treatment of diseases and clinical conditions associated with PDCL. The function of PDCL and its association with various diseases and clinical conditions, has been established by previous studies, as described hereinabove with reference to VGAM1708. Phosphodiesterase 6B, CGMP-specific, Rod, Beta (congenital stationary night blindness 3, autosomal dominant) (PDE6B, Accession NM_000283) is another VGAM2434 host target gene. PDE6B BINDING SITE is HOST TARGET binding site found in the 3' untranslated region of mRNA encoded by PDE6B, corresponding to a HOST TARGET binding site such as BINDING SITE I, BINDING SITE II or BINDING SITE III. Table 2 illustrates the complementarity of the nucleotide sequences of PDE6B BINDING SITE, designated SEQ ID:5830, to the nucleotide sequence of VGAM2434 RNA, herein designated VGAM RNA, also designated SEQ ID:5145.

Another function of VGAM2434 is therefore inhibition of Phosphodiesterase 6B, CGMP-specific, Rod, Beta (congenital stationary night blindness 3, autosomal dominant) (PDE6B, Accession NM_000283). Accordingly, utilities of VGAM2434 include diagnosis, prevention and treatment of diseases and clinical conditions associated with PDE6B. Period Homolog 2 (Drosophila) (PER2, Accession NM_022817) is another VGAM2434 host target gene. PER2 BINDING SITE is HOST TARGET binding site found in the 3' untranslated region of mRNA encoded by PER2, corresponding to a HOST TARGET binding site such as BINDING SITE I, BINDING SITE II or BINDING SITE III. Table 2 illustrates the complementarity of the nucleotide sequences of PER2 BINDING SITE, designated SEQ ID:23090, to the nucleotide sequence of VGAM2434 RNA, herein designated VGAM RNA, also designated SEQ ID:5145.

Another function of VGAM2434 is therefore inhibition of Period Homolog 2 (Drosophila) (PER2, Accession NM_022817), a gene which Period homolog 2; putative circadian clock protein; has a PAS dimerization domain. Accordingly, utilities of VGAM2434 include diagnosis, prevention and treatment of diseases and clinical conditions associated with PER2. The function of PER2 and its association with various diseases and clinical conditions, has been established by previous studies, as described hereinabove with reference to VGAM74. Phosphoinositide-3-kinase, Catalytic, Delta Polypeptide (PIK3CD, Accession NM_005026) is another VGAM2434 host target gene. PIK3CD BINDING SITE is HOST TARGET binding site found in the 3' untranslated region of mRNA encoded by PIK3CD, corresponding to a HOST TARGET binding site such as BINDING SITE I, BINDING SITE II or BINDING SITE III. Table 2 illustrates the complementarity of the nucleotide sequences of PIK3CD BINDING SITE, designated SEQ ID:11465, to the nucleotide sequence of VGAM2434 RNA, herein designated VGAM RNA, also designated SEQ ID:5145.

Another function of VGAM2434 is therefore inhibition of Phosphoinositide-3-kinase, Catalytic, Delta Polypeptide (PIK3CD, Accession NM_005026), a gene which regulating cell growth. Accordingly, utilities of VGAM2434 include diagnosis, prevention and treatment of diseases and clinical conditions associated with PIK3CD. The function of PIK3CD has been established by previous studies. Vanhaesebroeck et al. (1997) classified p110-delta as a class I PI3K because it displayed broad in vitro lipid substrate specificity. Like p110-alpha and p110-beta, p110-delta binds p85 adaptor proteins and GTP-bound Ras. These 3 class I PI3Ks were indistinguishable at the level of p85 adaptor protein selection or recruitment to activated receptor complexes. However, unlike p110-alpha, p110-delta does not phosphorylate p85, but instead has an autophosphorylation activity Animal model experiments lend further support to the function of PIK3CD. Okkenhaug et al. (2002) generated mice expressing a catalytically inactive form of Pik3cd (asp910 to ala). They observed impaired signaling and attenuated immune responses by antigen receptors of B and T cells from these mice. The presence of Pik3ca and Pik3cb did not compensate for Pik3cd in immune function. The mutant mice also developed inflammatory bowel disease. Since the IBD7 susceptibility locus (OMIM Ref. No. 605225) maps to chromosome 1p36, the authors suggested that PIK3CD may be a candidate susceptibility gene It is appreciated that the abovementioned animal model for PIK3CD is acknowledged by those skilled in the art as a scientifically valid animal model, as can be further appreciated from the publications sited hereinbelow.

Full details of the abovementioned studies are described in the following publications, the disclosure of which are hereby incorporated by reference:

Okkenhaug, K.; Bilancio, A.; Farjot, G.; Priddle, H.; Sancho, S.; Peskett, E.; Pearce, W.; Meek, S. E.; Salpekar, A.; Waterfield, M. D.; Smith, A. J. H.; Vanhaesebroeck, B.: Impaired B and T cell antigen receptor signaling in p110-delta PI 3-kinase mutant mice. Science 297:1031-1034, 2002. ; and Vanhaesebroeck, B.; Welham, M. J.; Kotani, K.; Stein, R.; Warne, P. H.; Zvelebil, M. J.; Higashi, K.; Volinia, S.; Downward, J.; Waterfield, M. D.: p110-delta, a novel phosphoinositide 3.

Further studies establishing the function and utilities of PIK3CD are found in John Hopkins OMIM database record ID 602839, and in sited publications numbered 1127-1130 listed in the bibliography section hereinbelow, which are also hereby incorporated by reference. Procollagen-lysine, 2-oxoglutarate 5-dioxygenase (lysine hydroxylase, Ehlers-Danlos syndrome type VI) (PLOD, Accession NM_000302) is another VGAM2434 host target gene. PLOD BINDING SITE is HOST TARGET binding site found in the 5' untranslated region of mRNA encoded by PLOD, corresponding to a HOST TARGET binding site such as BINDING SITE I, BINDING SITE II or BINDING SITE III. Table 2 illustrates the complementarity of the nucleotide sequences of PLOD BINDING SITE, designated SEQ ID:5845, to the nucleotide sequence of VGAM2434 RNA, herein designated VGAM RNA, also designated SEQ ID:5145.

Another function of VGAM2434 is therefore inhibition of Procollagen-lysine, 2-oxoglutarate 5-dioxygenase (lysine hydroxylase, Ehlers-Danlos syndrome type VI) (PLOD, Accession NM_000302). Accordingly, utilities of VGAM2434 include diagnosis, prevention and treatment of diseases and clinical conditions associated with PLOD. Prostaglandin E Synthase (PTGES, Accession NM_004878) is another VGAM2434 host target gene. PTGES BINDING SITE is HOST TARGET binding site found in the 3' untranslated region of mRNA encoded by PTGES, corresponding to a HOST TARGET binding site such as BINDING SITE I, BINDING SITE II or BINDING SITE III. Table 2 illustrates the complementarity of the nucleotide sequences of PTGES BINDING SITE, designated SEQ ID:11313, to the nucleotide sequence of VGAM2434 RNA, herein designated VGAM RNA, also designated SEQ ID:5145.

Another function of VGAM2434 is therefore inhibition of Prostaglandin E Synthase (PTGES, Accession NM_004878). Accordingly, utilities of VGAM2434 include diagnosis, prevention and treatment of diseases and clinical conditions associated with PTGES. RNA Binding Motif Protein 8A (RBM8A, Accession NM_005105) is another VGAM2434 host target gene. RBM8A BINDING SITE is HOST TARGET binding site found in the 3' untranslated region of mRNA encoded by RBM8A, corresponding to a HOST TARGET binding site such as BINDING SITE I, BINDING SITE II or BINDING SITE III. Table 2 illustrates the complementarity of the nucleotide sequences of RBM8A BINDING SITE, designated SEQ ID:11582, to the nucleotide sequence of VGAM2434 RNA, herein designated VGAM RNA, also designated SEQ ID:5145.

Another function of VGAM2434 is therefore inhibition of RNA Binding Motif Protein 8A (RBM8A, Accession NM_005105), a gene which involves in the pathway of gene expression postsplicing nuclear preexport mRNPs, and newly exported cytoplasmic mRNPs. Accordingly, utilities of VGAM2434 include diagnosis, prevention and treatment of diseases and clinical conditions associated with RBM8A. The function of RBM8A and its association with various diseases and clinical conditions, has been established by previous studies, as described hereinabove with reference to VGAM1864. Rhesus Blood Group, D Antigen (RHD, Accession NM_016225) is another VGAM2434 host target gene. RHD BINDING SITE1 through RHD BINDING SITE4 are HOST TARGET binding sites found in untranslated regions of mRNA encoded by RHD, corresponding to HOST TARGET binding sites such as BINDING SITE I, BINDING SITE II or BINDING SITE III. Table 2 illustrates the complementarity of the nucleotide sequences of RHD BINDING SITE1 through RHD BINDING SITE4, designated SEQ ID:18338, SEQ ID:18339, SEQ ID:18218 and SEQ ID:18219 respectively, to the nucleotide sequence of VGAM2434 RNA, herein designated VGAM RNA, also designated SEQ ID:5145.

Another function of VGAM2434 is therefore inhibition of Rhesus Blood Group, D Antigen (RHD, Accession NM_016225), a gene which Major antigen of the RH system. Accordingly, utilities of VGAM2434 include diagnosis, prevention and treatment of diseases and clinical conditions associated with RHD. The function of RHD and its association with various diseases and clinical conditions, has been established by previous studies, as described hereinabove with reference to VGAM74. Spondyloepiphyseal Dysplasia, Late (SEDL, Accession NM_014563) is another VGAM2434 host target gene. SEDL BINDING SITE1 through SEDL BINDING SITE3 are HOST TARGET binding sites found in untranslated regions of mRNA encoded by SEDL, corresponding to HOST TARGET binding sites such as BINDING SITE I, BINDING SITE II or BINDING SITE III. Table 2 illustrates the complementarity of the nucleotide sequences of SEDL BINDING SITE1 through SEDL BINDING SITE3, designated SEQ ID:15911, SEQ ID:15912 and SEQ ID:15913 respectively, to the nucleotide sequence of VGAM2434 RNA, herein designated VGAM RNA, also designated SEQ ID:5145.

Another function of VGAM2434 is therefore inhibition of Spondyloepiphyseal Dysplasia, Late (SEDL, Accession NM_014563), a gene which may play role in vesicular transport from endoplasmic reticulum to golgi. Accordingly, utilities of VGAM2434 include diagnosis, prevention and treatment of diseases and clinical conditions associated with SEDL. The function of SEDL and its association with various diseases and clinical conditions, has been established by previous studies, as described hereinabove with reference to VGAM74. SHC (Src homology 2 domain containing) Transforming Protein 1 (SHC1, Accession NM_003029) is another VGAM2434 host target gene. SHC1 BINDING SITE is HOST TARGET binding site found in the 3' untranslated region of mRNA encoded by SHC1, corresponding to a HOST TARGET binding site such as BINDING SITE I, BINDING SITE II or BINDING SITE III. Table 2 illustrates the complementarity of the nucleotide sequences of SHC1 BINDING SITE, designated SEQ ID:8969, to the nucleotide sequence of VGAM2434 RNA, herein designated VGAM RNA, also designated SEQ ID:5145.

Another function of VGAM2434 is therefore inhibition of SHC (Src homology 2 domain containing) Transforming Protein 1 (SHC1, Accession NM_003029), a gene which couples activated growth factor receptors to a signaling pathway. Accordingly, utilities of VGAM2434 include diagnosis, prevention and treatment of diseases and clinical conditions associated with SHC1. The function of SHC1 and its association with various diseases and clinical conditions, has been established by previous studies, as described hereinabove with reference to VGAM53. TAL1 (SCL) Interrupting Locus (SIL, Accession NM_003035) is another VGAM2434 host target gene. SIL BINDING SITE is HOST TARGET binding site found in the 3' untranslated region of mRNA encoded by SIL, corresponding to a HOST TARGET binding site such as BINDING SITE I, BINDING SITE II or BINDING SITE III. Table 2 illustrates the complementarity of the nucleotide sequences of SIL BINDING SITE, designated SEQ ID:8984, to the nucleotide sequence of VGAM2434 RNA, herein designated VGAM RNA, also designated SEQ ID:5145.

Another function of VGAM2434 is therefore inhibition of TAL1 (SCL) Interrupting Locus (SIL, Accession NM_003035), a gene which may be required for axial development and left-right specification. Accordingly, utilities of VGAM2434 include diagnosis, prevention and treatment of diseases and clinical conditions associated with SIL. The function of SIL and its association with various diseases and clinical conditions, has been established by previous studies, as described hereinabove with reference to VGAM1316. Solute Carrier Family 14 (urea transporter), Member 2 (SLC14A2, Accession NM_007163) is another VGAM2434 host target gene. SLC14A2 BINDING SITE is HOST TARGET binding site found in the 5' untranslated region of mRNA encoded by SLC14A2, corresponding to a HOST TARGET binding site such as BINDING SITE I, BINDING SITE II or BINDING SITE III. Table 2 illustrates the complementarity of the nucleotide sequences of SLC14A2 BINDING SITE, designated SEQ ID:14012, to the nucleotide sequence of VGAM2434 RNA, herein designated VGAM RNA, also designated SEQ ID:5145.

Another function of VGAM2434 is therefore inhibition of Solute Carrier Family 14 (urea transporter), Member 2 (SLC14A2, Accession NM_007163), a gene which is a renal urea transporter 2. Accordingly, utilities of VGAM2434 include diagnosis, prevention and treatment of diseases and clinical conditions associated with SLC14A2. The function of SLC14A2 and its association with various diseases and clinical conditions, has been established by previous studies, as described hereinabove with reference to VGAM74. Solute Carrier Family 15 (oligopeptide transporter), Member 1 (SLC15A1, Accession NM_005073) is another VGAM2434 host target gene. SLC15A1 BINDING SITE is HOST TARGET binding site found in the 3' untranslated region of mRNA encoded by SLC15A1, corresponding to a HOST TARGET binding site such as BINDING SITE I, BINDING SITE II or BINDING SITE III. Table 2 illustrates the complementarity of the nucleotide sequences of SLC15A1 BINDING SITE, designated SEQ ID:11522, to the nucleotide sequence of VGAM2434 RNA, herein designated VGAM RNA, also designated SEQ ID:5145.

Another function of VGAM2434 is therefore inhibition of Solute Carrier Family 15 (oligopeptide transporter), Member 1 (SLC15A1, Accession NM_005073), a gene which is a H(+)-coupled peptide transporter. Accordingly, utilities of VGAM2434 include diagnosis, prevention and treatment of diseases and clinical conditions associated with SLC15A1. The function of SLC15A1 and its association with various diseases and clinical conditions, has been established by previous studies, as described hereinabove with reference to VGAM74. SMAC (Accession NM_138930) is another VGAM2434 host target gene. SMAC BINDING SITE is HOST TARGET binding site found in the 5' untranslated region of mRNA encoded by SMAC, corresponding to a HOST TARGET binding site such as BINDING SITE I, BINDING SITE II or BINDING SITE III. Table 2 illustrates the complementarity of the nucleotide sequences of SMAC BINDING SITE, designated SEQ ID:29049, to the nucleotide sequence of VGAM2434 RNA, herein designated VGAM RNA, also designated SEQ ID:5145.

Another function of VGAM2434 is therefore inhibition of SMAC (Accession NM_138930), a gene which promotes apoptosis via caspase activation. Accordingly, utilities of VGAM2434 include diagnosis, prevention and treatment of diseases and clinical conditions associated with SMAC. The function of SMAC and its association with various diseases and clinical conditions, has been established by previous studies, as described hereinabove with reference to VGAM74. Sorting Nexin 15 (SNX15, Accession XM_057307) is another VGAM2434 host target gene. SNX15 BINDING SITE is HOST TARGET binding site found in the 3' untranslated region of mRNA encoded by SNX15, corresponding to a HOST TARGET binding site such as BINDING SITE I, BINDING SITE II or BINDING SITE III. Table 2 illustrates the complementarity of the nucleotide sequences of SNX15 BINDING SITE, designated SEQ ID:36506, to the nucleotide sequence of VGAM2434 RNA, herein designated VGAM RNA, also designated SEQ ID:5145.

Another function of VGAM2434 is therefore inhibition of Sorting Nexin 15 (SNX15, Accession XM_057307). Accordingly, utilities of VGAM2434 include diagnosis, prevention and treatment of diseases and clinical conditions associated with SNX15. Synovial Sarcoma Translocation, Chromosome 18 (SS18, Accession NM_005637) is another VGAM2434 host target gene. SS18 BINDING SITE is HOST TARGET binding site found in the 3' untranslated region of mRNA encoded by SS18, corresponding to a HOST TARGET binding site such as BINDING SITE I, BINDING SITE II or BINDING SITE III. Table 2 illustrates the complementarity of the nucleotide sequences of SS18 BINDING SITE, designated SEQ ID:12165, to the nucleotide sequence of VGAM2434 RNA, herein designated VGAM RNA, also designated SEQ ID:5145.

Another function of VGAM2434 is therefore inhibition of Synovial Sarcoma Translocation, Chromosome 18 (SS18, Accession NM_005637), a gene which is a putative transcriptional activator. Accordingly, utilities of VGAM2434 include diagnosis, prevention and treatment of diseases and clinical conditions associated with SS18. The function of SS18 and its association with various diseases and clinical conditions, has been established by previous studies, as described hereinabove with reference to VGAM74. Sulfotransferase Family, Cytosolic, 2B, Member 1 (SULT2B1, Accession NM_004605) is another VGAM2434 host target gene. SULT2B1 BINDING SITE is HOST TARGET binding site found in the 5' untranslated region of mRNA encoded by SULT2B1, corresponding to a HOST TARGET binding site such as BINDING SITE I, BINDING SITE II or BINDING SITE III. Table 2 illustrates the complementarity of the nucleotide sequences of SULT2B1 BINDING SITE, designated SEQ ID:10949, to the nucleotide sequence of VGAM2434 RNA, herein designated VGAM RNA, also designated SEQ ID:5145.

Another function of VGAM2434 is therefore inhibition of Sulfotransferase Family, Cytosolic, 2B, Member 1 (SULT2B1, Accession NM_004605). Accordingly, utilities of VGAM2434 include diagnosis, prevention and treatment of diseases and clinical conditions associated with SULT2B1. TAP Binding Protein (tapasin) (TAPBP, Accession NM_003190) is another VGAM2434 host target gene. TAPBP BINDING SITE is HOST TARGET binding site found in the 3' untranslated region of mRNA encoded by TAPBP, corresponding to a HOST TARGET binding site such as BINDING SITE I, BINDING SITE II or BINDING SITE III. Table 2 illustrates the complementarity of the nucleotide sequences of TAPBP BINDING SITE, designated SEQ ID:9183, to the nucleotide sequence of VGAM2434 RNA, herein designated VGAM RNA, also designated SEQ ID:5145.

Another function of VGAM2434 is therefore inhibition of TAP Binding Protein (tapasin) (TAPBP, Accession NM_003190), a gene which is involved in MHC class I-restricted antigen processing. Accordingly, utilities of VGAM2434 include diagnosis, prevention and treatment of diseases and clinical conditions associated with TAPBP. The function of TAPBP and its association with various diseases and clinical conditions, has been established by previous studies, as described hereinabove with reference to VGAM122. Tyrosine Aminotransferase (TAT, Accession NM_000353) is another VGAM2434 host target gene. TAT BINDING SITE is HOST TARGET binding site found in the 3' untranslated region of mRNA encoded by TAT, corresponding to a HOST TARGET binding site such as BINDING SITE I, BINDING SITE II or BINDING SITE III. Table 2 illustrates the complementarity of the nucleotide sequences of TAT BINDING SITE, designated SEQ ID:5914, to the nucleotide sequence of VGAM2434 RNA, herein designated VGAM RNA, also designated SEQ ID:5145.

Another function of VGAM2434 is therefore inhibition of Tyrosine Aminotransferase (TAT, Accession NM_000353), a gene which is tyrosine aminotransferase and strongly similar to rat Rn.9947, which plays a role in gluconeogenesis. Accordingly, utilities of VGAM2434 include diagnosis, prevention and treatment of diseases and clinical conditions associated with TAT. The function of TAT has been established by previous studies. Richner (1938) and Hanhart (1947) described an oculocutaneous syndrome characterized by herpetiform corneal ulcers and painful punctate keratoses of digits, palms, and soles. Richner (1938) described skin lesions in brother and sister. Only the brother had corneal lesions. Hanhart (1947) reported that the parents of his patient were second cousins. Hanhart (1947) also described associated severe mental and somatic retardation. The pedigree he reported was reproduced by Waardenburg et al. (1961). Waardenburg et al. (1961) described children of a first-cousin marriage, one with the full syndrome and one with only corneal changes. Ventura et al. (1965) described the syndrome in 2 sons of first-cousin parents. Buist (1967) referred to studies of a child with tyrosinemia and tyrosine transaminase deficiency, but normal p-hydroxyphenylpyruvic acid oxidase. Phenylalanine level was normal. Hydroxyphenylpyruvic acid was elevated in the urine. Fellman et al. (1969) reported chemical studies on the same patient. Only the mitochondrial form of tyrosine aminotransferase (TAT) was present in the liver. The soluble form of TAT (EC 2.6.1.5) was lacking. The patient had markedly elevated tyrosine blood levels and an increase in urinary p-hydroxyphenylpyruvate and p-hydroxyphenyllactate. A regulator gene for tyrosine transaminase is X-linked (OMIM Ref. No. 314350). Goldsmith et al. (1973) demonstrated tyrosinemia and phenylaceticacidemia in this disorder. Their patient was the 14-year-old son of consanguineous Italian parents. The urine contained excessive P-hydroxyphenylactic acid. Urinary P-hydroxyphenylpyruvic acid was normal. Clinical and biochemical improvement accompanied low phenylalanine-low tyrosine diet. They suggested that soluble TAT may be deficient. Mitochondrial tyrosine transaminase is normal. Beinfang et al. (1976) described the ophthalmologic findings in the patient reported by Goldsmith et al. (1973). This condition is also known as tyrosinemia with palmar and plantar keratosis and keratitis. Garibaldi et al. (1977) observed this disorder, which they called oculocutaneous tyrosinosis, in a 42-month-old girl and her maternal aunt. The parents of the maternal aunt were first cousins. They emphasized the importance of early diagnosis in order to prevent mental retardation by means of a diet restricted in phenylalanine and tyrosine. Hunziker (1980) reported brother and sister with unusually late onset (about age 15). Their patients' skin lesions were improved with a diet restricted in phenylalanine and tyrosine. In a consanguineous sibship, Rehak et al. (1981) reported 4 cases of Richner-Hanhart syndrome. Cutaneous manifestations were typical but the eyes were not involved, suggesting heterogeneity in this disorder. Bohnert and Anton-Lamprecht (1982) reported unique ultrastructural changes: thickening of the granular layer and increased synthesis of tonofibrils and keratohyalin; in the ridged palmar or plantar skin, large numbers of microtubules and unusually tight packing of tonofibrillar masses, which contained tubular channels or inclusions of microtubules. The authors assumed that increased cohesion and tight packing of tonofilaments prevent normal spreading of keratohyalin and result in its globular appearance. Further, they suggested that excessive amounts of intracellular tyrosine enhance crosslinks between aggregated tonofilaments. In an Ashkenazi Jewish family, Chitayat et al. (1992) observed 2 adult sibs, offspring of a first-cousin marriage, with persistent hypertyrosinemia. A curious feature was that the affected female sib, aged 41 years, had hypertyrosinemia and characteristic oculocutaneous signs; the brother, aged 39 years, had hypertyrosinemia but no oculocutaneous disease. Both sibs had 2 children; none had signs of metabolic fetopathy.

Full details of the abovementioned studies are described in the following publications, the disclosure of which are hereby incorporated by reference:

Goldsmith, L. A.; Kang, E. S.; Bienfang, D. C.; Jimbow, K.; Gerald, P. S.; Baden, H. P.: Tyrosinemia with plantar and palmar keratosis and keratitis. J. Pediat. 83:798-805, 1973; and Hunziker, N.: Richner-Hanhart syndrome and tyrosinemia type II. Dermatologica 160:180-189, 1980.

Further studies establishing the function and utilities of TAT are found in John Hopkins OMIM database record ID 276600, and in sited publications numbered 8715-8728, 908 and 9088-9097 listed in the bibliography section hereinbelow, which are also hereby incorporated by reference. Thromboxane A2 Receptor (TBXA2R, Accession NM_001060) is another VGAM2434 host target gene. TBXA2R BINDING SITE1 and TBXA2R BINDING SITE2 are HOST TARGET binding sites found in untranslated regions of mRNA encoded by TBXA2R, corresponding to HOST TARGET binding sites such as BINDING SITE I, BINDING SITE II or BINDING SITE III. Table 2 illustrates the complementarity of the nucleotide sequences of TBXA2R BINDING SITE1 and TBXA2R BINDING SITE2, designated SEQ ID:6729 and SEQ ID:6730 respectively, to the nucleotide sequence of VGAM2434 RNA, herein designated VGAM RNA, also designated SEQ ID:5145.

Another function of VGAM2434 is therefore inhibition of Thromboxane A2 Receptor (TBXA2R, Accession NM_001060), a gene which activates Ca2+-activated chloride channels; stimulates platelet aggregation and smooth muscle constriction. Accordingly, utilities of VGAM2434 include diagnosis, prevention and treatment of diseases and clinical conditions associated with TBXA2R. The function of TBXA2R and its association with various diseases and clinical conditions, has been established by previous studies, as described hereinabove with reference to VGAM433. Tumor Necrosis Factor Receptor Superfamily, Member 10b (TNFRSF10B, Accession NM_003842) is another VGAM2434 host target gene. TNFRSF10B BINDING SITE is HOST TARGET binding site found in the 3' untranslated region of mRNA encoded by TNFRSF10B, corresponding to a HOST TARGET binding site such as BINDING SITE I, BINDING SITE II or BINDING SITE III. Table 2 illustrates the complementarity of the nucleotide sequences of TNFRSF10B BINDING SITE, designated SEQ ID:9940, to the nucleotide sequence of VGAM2434 RNA, herein designated VGAM RNA, also designated SEQ ID:5145.

Another function of VGAM2434 is therefore inhibition of Tumor Necrosis Factor Receptor Superfamily, Member 10b (TNFRSF10B, Accession NM_003842), a gene which forms complex that induces apoptosis. Accordingly, utilities of VGAM2434 include diagnosis, prevention and treatment of diseases and clinical conditions associated with TNFRSF10B. The function of TNFRSF10B and its association with various diseases and clinical conditions, has been established by previous studies, as described hereinabove with reference to VGAM400. Tumor Necrosis Factor Receptor Superfamily, Member 9 (TNFRSF9, Accession NM_001561) is another VGAM2434 host target gene. TNFRSF9 BINDING SITE is HOST TARGET binding site found in the 3' untranslated region of mRNA encoded by TNFRSF9, corresponding to a HOST TARGET binding site such as BINDING SITE I, BINDING SITE II or BINDING SITE III. Table 2 illustrates the complementarity of the nucleotide sequences of TNFRSF9 BINDING SITE, designated SEQ ID:7289, to the nucleotide sequence of VGAM2434 RNA, herein designated VGAM RNA, also designated SEQ ID:5145.

Another function of VGAM2434 is therefore inhibition of Tumor Necrosis Factor Receptor Superfamily, Member 9 (TNFRSF9, Accession NM_001561), a gene which inhibits proliferation of activated T lymphocytes. Accordingly, utilities of VGAM2434 include diagnosis, prevention and treatment of diseases and clinical conditions associated with TNFRSF9. The function of TNFRSF9 and its association with various diseases and clinical conditions, has been established by previous studies, as described hereinabove with reference to VGAM1954. Tripartite Motif-containing 9 (TRIM9, Accession NM_015163) is another VGAM2434 host target gene. TRIM9 BINDING SITE is HOST TARGET binding site found in the 5' untranslated region of mRNA encoded by TRIM9, corresponding to a HOST TARGET binding site such as BINDING SITE I, BINDING SITE II or BINDING SITE III. Table 2 illustrates the complementarity of the nucleotide sequences of TRIM9 BINDING SITE, designated SEQ ID:17519, to the nucleotide sequence of VGAM2434 RNA, herein designated VGAM RNA, also designated SEQ ID:5145.

Another function of VGAM2434 is therefore inhibition of Tripartite Motif-containing 9 (TRIM9, Accession NM_015163), a gene which may function as a positive regulator for mannosylphosphate transferase and is required to mediate mannosylphosphate transfer in both the core and outer chain portions of n-linked. oligosaccharides. Accordingly, utilities of VGAM2434 include diagnosis, prevention and treatment of diseases and clinical conditions associated with TRIM9. The function of TRIM9 and its association with various diseases and clinical conditions, has been established by previous studies, as described hereinabove with reference to VGAM74. Transient Receptor Potential Cation Channel, Subfamily V, Member 1 (TRPV1, Accession NM_018727) is another VGAM2434 host target gene. TRPV1 BINDING SITE1 through TRPV1 BINDING SITE4 are HOST TARGET binding sites found in untranslated regions of mRNA encoded by TRPV1, corresponding to HOST TARGET binding sites such as BINDING SITE I, BINDING SITE II or BINDING SITE III. Table 2 illustrates the complementarity of the nucleotide sequences of TRPV1 BINDING SITE1 through TRPV1 BINDING SITE4, designated SEQ ID:20814, SEQ ID:27994, SEQ ID:28002 and SEQ ID:28010 respectively, to the nucleotide sequence of VGAM2434 RNA, herein designated VGAM RNA, also designated SEQ ID:5145.

Another function of VGAM2434 is therefore inhibition of Transient Receptor Potential Cation Channel, Subfamily V, Member 1 (TRPV1, Accession NM_018727), a gene which functions as a receptor for capsaicin. Accordingly, utilities of VGAM2434 include diagnosis, prevention and treatment of diseases and clinical conditions associated with TRPV1. The function of TRPV1 and its association with various diseases and clinical conditions, has been established by previous studies, as described hereinabove with reference to VGAM146. X-ray Repair Complementing Defective Repair In Chinese Hamster Cells 2 (XRCC2, Accession NM_005431) is another VGAM2434 host target gene. XRCC2 BINDING SITE is HOST TARGET binding site found in the 3' untranslated region of mRNA encoded by XRCC2, corresponding to a HOST TARGET binding site such as BINDING SITE I, BINDING SITE II or BINDING SITE III. Table 2 illustrates the complementarity of the nucleotide sequences of XRCC2 BINDING SITE, designated SEQ ID:11901, to the nucleotide sequence of VGAM2434 RNA, herein designated VGAM RNA, also designated SEQ ID:5145.

Another function of VGAM2434 is therefore inhibition of X-ray Repair Complementing Defective Repair In Chinese Hamster Cells 2 (XRCC2, Accession NM_005431), a gene which involves in the homologous recombination repair (hrr) pathway of double-stranded dna. Accordingly, utilities of VGAM2434 include diagnosis, prevention and treatment of diseases and clinical conditions associated with XRCC2. The function of XRCC2 and its association with various diseases and clinical conditions, has been established by previous studies, as described hereinabove with reference to VGAM241. Zinc Finger Protein 22 (KOX 15) (ZNF22, Accession XM_166153) is another VGAM2434 host target gene. ZNF22 BINDING SITE is HOST TARGET binding site found in the 3' untranslated region of mRNA encoded by ZNF22, corresponding to a HOST TARGET binding site such as BINDING SITE I, BINDING SITE II or BINDING SITE III. Table 2 illustrates the complementarity of the nucleotide sequences of ZNF22 BINDING SITE, designated SEQ ID:43971, to the nucleotide sequence of VGAM2434 RNA, herein designated VGAM RNA, also designated SEQ ID:5145.

Another function of VGAM2434 is therefore inhibition of Zinc Finger Protein 22 (KOX 15) (ZNF22, Accession XM_166153). Accordingly, utilities of VGAM2434 include diagnosis, prevention and treatment of diseases and clinical conditions associated with ZNF22. Zinc Finger Protein 264 (ZNF264, Accession NM_003417) is another VGAM2434 host target gene. ZNF264 BINDING SITE1 and ZNF264 BINDING SITE2 are HOST TARGET binding sites found in untranslated regions of mRNA encoded by ZNF264, corresponding to HOST TARGET binding sites such as BINDING SITE I, BINDING SITE II or BINDING SITE III. Table 2 illustrates the complementarity of the nucleotide sequences of ZNF264 BINDING SITE1 and ZNF264 BINDING SITE2, designated SEQ ID:9455 and SEQ ID:9460 respectively, to the nucleotide sequence of VGAM2434 RNA, herein designated VGAM RNA, also designated SEQ ID:5145.

Another function of VGAM2434 is therefore inhibition of Zinc Finger Protein 264 (ZNF264, Accession NM_003417). Accordingly, utilities of VGAM2434 include diagnosis, prevention and treatment of diseases and clinical conditions associated with ZNF264. Ankyrin Repeat and SOCS Box-containing 16 (ASB16, Accession XM_046024) is another VGAM2434 host target gene. ASB16 BINDING SITE is HOST TARGET binding site found in the 5' untranslated region of mRNA encoded by ASB16, corresponding to a HOST TARGET binding site such as BINDING SITE I, BINDING SITE II or BINDING SITE III. Table 2 illustrates the complementarity of the nucleotide sequences of ASB16 BINDING SITE, designated SEQ ID:34655, to the nucleotide sequence of VGAM2434 RNA, herein designated VGAM RNA, also designated SEQ ID:5145.

Another function of VGAM2434 is therefore inhibition of Ankyrin Repeat and SOCS Box-containing 16 (ASB16, Accession XM_046024). Accordingly, utilities of VGAM2434 include diagnosis, prevention and treatment of diseases and clinical conditions associated with ASB16. BA108L7.2 (Accession NM_030971) is another VGAM2434 host target gene. BA108L7.2 BINDING SITE is HOST TARGET binding site found in the 3" untranslated region of mRNA encoded by BA108L7.2, corresponding to a HOST TARGET binding site such as BINDING SITE I, BINDING SITE II or BINDING SITE III. Table 2 illustrates the complementarity of the nucleotide sequences of BA108L7.2 BINDING SITE, designated SEQ ID:25237, to the nucleotide sequence of VGAM2434 RNA, herein designated VGAM RNA, also designated SEQ ID:5145.

Another function of VGAM2434 is therefore inhibition of BA108L7.2 (Accession NM_030971). Accordingly, utilities of VGAM2434 include diagnosis, prevention and treatment of diseases and clinical conditions associated with BA108L7.2. BCL2-associated Athanogene 5 (BAG5, Accession NM_004873) is another VGAM2434 host target gene. BAG5 BINDING SITE is HOST TARGET binding site found in the 3' untranslated region of mRNA encoded by BAG5, corresponding to a HOST TARGET binding site such as BINDING SITE I, BINDING SITE II or BINDING SITE III.

Table 2 illustrates the complementarity of the nucleotide sequences of BAG5 BINDING SITE, designated SEQ ID:11309, to the nucleotide sequence of VGAM2434 RNA, herein designated VGAM RNA, also designated SEQ ID:5145.

Another function of VGAM2434 is therefore inhibition of BCL2-associated Athanogene 5 (BAG5, Accession NM_004873). Accordingly, utilities of VGAM2434 include diagnosis, prevention and treatment of diseases and clinical conditions associated with BAG5. Butyrophilin, Subfamily 3, Member A1 (BTN3A1, Accession NM_007048) is another VGAM2434 host target gene. BTN3A1 BINDING SITE is HOST TARGET binding site found in the 3' untranslated region of mRNA encoded by BTN3A1, corresponding to a HOST TARGET binding site such as BINDING SITE I, BINDING SITE II or BINDING SITE III. Table 2 illustrates the complementarity of the nucleotide sequences of BTN3A1 BINDING SITE, designated SEQ ID:13921, to the nucleotide sequence of VGAM2434 RNA, herein designated VGAM RNA, also designated SEQ ID:5145.

Another function of VGAM2434 is therefore inhibition of Butyrophilin, Subfamily 3, Member A1 (BTN3A1, Accession NM_007048). Accordingly, utilities of VGAM2434 include diagnosis, prevention and treatment of diseases and clinical conditions associated with BTN3A1. C1q and Tumor Necrosis Factor Related Protein 6 (C1QTNF6, Accession NM_031910) is another VGAM2434 host target gene. C1QTNF6 BINDING SITE is HOST TARGET binding site found in the 3' untranslated region of mRNA encoded by C1QTNF6, corresponding to a HOST TARGET binding site such as BINDING SITE I, BINDING SITE II or BINDING SITE III. Table 2 illustrates the complementarity of the nucleotide sequences of C1QTNF6 BINDING SITE, designated SEQ ID:25656, to the nucleotide sequence of VGAM2434 RNA, herein designated VGAM RNA, also designated SEQ ID:5145.

Another function of VGAM2434 is therefore inhibition of C1q and Tumor Necrosis Factor Related Protein 6 (C1QTNF6, Accession NM_031910). Accordingly, utilities of VGAM2434 include diagnosis, prevention and treatment of diseases and clinical conditions associated with C1QTNF6. C3F (Accession NM_005768) is another VGAM2434 host target gene. C3F BINDING SITE is HOST TARGET binding site found in the 3' untranslated region of mRNA encoded by C3F, corresponding to a HOST TARGET binding site such as BINDING SITE I, BINDING SITE II or BINDING SITE III. Table 2 illustrates the complementarity of the nucleotide sequences of C3F BINDING SITE, designated SEQ ID:12331, to the nucleotide sequence of VGAM2434 RNA, herein designated VGAM RNA, also designated SEQ ID:5145.

Another function of VGAM2434 is therefore inhibition of C3F (Accession NM_005768). Accordingly, utilities of VGAM2434 include diagnosis, prevention and treatment of diseases and clinical conditions associated with C3F. C6orf5 (Accession NM_015524) is another VGAM2434 host target gene. C6orf5 BINDING SITE is HOST TARGET binding site found in the 3' untranslated region of mRNA encoded by C6orf5, corresponding to a HOST TARGET binding site such as BINDING SITE I, BINDING SITE II or BINDING SITE III. Table 2 illustrates the complementarity of the nucleotide sequences of C6orf5 BINDING SITE, designated SEQ ID:17780, to the nucleotide sequence of VGAM2434 RNA, herein designated VGAM RNA, also designated SEQ ID:5145.

Another function of VGAM2434 is therefore inhibition of C6orf5 (Accession NM_015524). Accordingly, utilities of VGAM2434 include diagnosis, prevention and treatment of diseases and clinical conditions associated with C6orf5. Chromosome 9 Open Reading Frame 9 (C9orf9, Accession NM_018956) is another VGAM2434 host target gene. C9orf9 BINDING SITE is HOST TARGET binding site found in the 3' untranslated region of mRNA encoded by C9orf9, corresponding to a HOST TARGET binding site such as BINDING SITE I, BINDING SITE II or BINDING SITE III. Table 2 illustrates the complementarity of the nucleotide sequences of C9orf9 BINDING SITE, designated SEQ ID:21029, to the nucleotide sequence of VGAM2434 RNA, herein designated VGAM RNA, also designated SEQ ID:5145.

Another function of VGAM2434 is therefore inhibition of Chromosome 9 Open Reading Frame 9 (C9orf9, Accession NM_018956). Accordingly, utilities of VGAM2434 include diagnosis, prevention and treatment of diseases and clinical conditions associated with C9orf9. CDC14 Cell Division Cycle 14 Homolog B (S. cerevisiae) (CDC14B, Accession NM_033332) is another VGAM2434 host target gene. CDC14B BINDING SITE is HOST TARGET binding site found in the 3' untranslated region of mRNA encoded by CDC14B, corresponding to a HOST TARGET binding site such as BINDING SITE I, BINDING SITE II or BINDING SITE III. Table 2 illustrates the complementarity of the nucleotide sequences of CDC14B BINDING SITE, designated SEQ ID:27174, to the nucleotide sequence of VGAM2434 RNA, herein designated VGAM RNA, also designated SEQ ID:5145.

Another function of VGAM2434 is therefore inhibition of CDC14 Cell Division Cycle 14 Homolog B (S. cerevisiae) (CDC14B, Accession NM_033332). Accordingly, utilities of VGAM2434 include diagnosis, prevention and treatment of diseases and clinical conditions associated with CDC14B. Cat Eye Syndrome Chromosome Region, Candidate 1 (CECR1, Accession NM_017424) is another VGAM2434 host target gene. CECR1 BINDING SITE is HOST TARGET binding site found in the 3' untranslated region of mRNA encoded by CECR1, corresponding to a HOST TARGET binding site such as BINDING SITE I, BINDING SITE II or BINDING SITE III. Table 2 illustrates the complementarity of the nucleotide sequences of CECR1 BINDING SITE, designated SEQ ID:18884, to the nucleotide sequence of VGAM2434 RNA, herein designated VGAM RNA, also designated SEQ ID:5145.

Another function of VGAM2434 is therefore inhibition of Cat Eye Syndrome Chromosome Region, Candidate 1 (CECR1, Accession NM_017424). Accordingly, utilities of VGAM2434 include diagnosis, prevention and treatment of diseases and clinical conditions associated with CECR1. Chromatin Accessibility Complex 1 (CHRAC1, Accession NM_017444) is another VGAM2434 host target gene. CHRAC1 BINDING SITE is HOST TARGET binding site found in the 3' untranslated region of mRNA encoded by CHRAC1, corresponding to a HOST TARGET binding site such as BINDING SITE I, BINDING SITE II or BINDING SITE III. Table 2 illustrates the complementarity of the nucleotide sequences of CHRAC1 BINDING SITE, designated SEQ ID:18908, to the nucleotide sequence of VGAM2434 RNA, herein designated VGAM RNA, also designated SEQ ID:5145.

Another function of VGAM2434 is therefore inhibition of Chromatin Accessibility Complex 1 (CHRAC1, Accession NM_017444). Accordingly, utilities of VGAM2434 include diagnosis, prevention and treatment of diseases and clinical conditions associated with CHRAC1. CIP29 (Accession NM_032364) is another VGAM2434 host target gene. CIP29 BINDING SITE is HOST TARGET binding site found in the 3' untranslated region of mRNA encoded by CIP29, corresponding to a HOST TARGET binding site such as BINDING SITE I, BINDING SITE II or BINDING SITE III. Table 2 illustrates the complementarity of the nucleotide sequences of CIP29 BINDING SITE, designated SEQ ID:26148, to the nucleotide sequence of VGAM2434 RNA, herein designated VGAM RNA, also designated SEQ ID:5145.

Another function of VGAM2434 is therefore inhibition of CIP29 (Accession NM_032364). Accordingly, utilities of VGAM2434 include diagnosis, prevention and treatment of diseases and clinical conditions associated with CIP29. Cleavage and Polyadenylation Specific Factor 2, 100 kDa (CPSF2, Accession XM_029311) is another VGAM2434 host target gene. CPSF2 BINDING SITE is HOST TARGET binding site found in the 3' untranslated region of mRNA encoded by CPSF2, corresponding to a HOST TARGET binding site such as BINDING SITE I, BINDING SITE II or BINDING SITE III. Table 2 illustrates the complementarity of the nucleotide sequences of CPSF2 BINDING SITE, designated SEQ ID:30862, to the nucleotide sequence of VGAM2434 RNA, herein designated VGAM RNA, also designated SEQ ID:5145.

Another function of VGAM2434 is therefore inhibition of Cleavage and Polyadenylation Specific Factor 2, 100 kDa (CPSF2, Accession XM_029311). Accordingly, utilities of VGAM2434 include diagnosis, prevention and treatment of diseases and clinical conditions associated with CPSF2. Cylicin, Basic Protein of Sperm Head Cytoskeleton 2 (CYLC2, Accession NM_001340) is another VGAM2434 host target gene. CYLC2 BINDING SITE is HOST TARGET binding site found in the 3' untranslated region of mRNA encoded by CYLC2, corresponding to a HOST TARGET binding site such as BINDING SITE I, BINDING SITE II or BINDING SITE III. Table 2 illustrates the complementarity of the nucleotide sequences of CYLC2 BINDING SITE, designated SEQ ID:7020, to the nucleotide sequence of VGAM2434 RNA, herein designated VGAM RNA, also designated SEQ ID:5145.

Another function of VGAM2434 is therefore inhibition of Cylicin, Basic Protein of Sperm Head Cytoskeleton 2 (CYLC2, Accession NM_001340). Accordingly, utilities of VGAM2434 include diagnosis, prevention and treatment of diseases and clinical conditions associated with CYLC2. DKFZP434D146 (Accession NM_015595) is another VGAM2434 host target gene. DKFZP434D146 BINDING SITE is HOST TARGET binding site found in the 3' untranslated region of mRNA encoded by DKFZP434D146, corresponding to a HOST TARGET binding site such as BINDING SITE I, BINDING SITE II or BINDING SITE III. Table 2 illustrates the complementarity of the nucleotide sequences of DKFZP434D146 BINDING SITE, designated SEQ ID:17871, to the nucleotide sequence of VGAM2434 RNA, herein designated VGAM RNA, also designated SEQ ID:5145.

Another function of VGAM2434 is therefore inhibition of DKFZP434D146 (Accession NM_015595). Accordingly, utilities of VGAM2434 include diagnosis, prevention and treatment of diseases and clinical conditions associated with DKFZP434D146. DKFZp434E2220 (Accession NM_017612) is another VGAM2434 host target gene. DKFZp434E2220 BINDING SITE is HOST TARGET binding site found in the 5' untranslated region of mRNA encoded by DKFZp434E2220, corresponding to a HOST TARGET binding site such as BINDING SITE I, BINDING SITE II or BINDING SITE III. Table 2 illustrates the complementarity of the nucleotide sequences of DKFZp434E2220 BINDING SITE, designated SEQ ID:19111, to the nucleotide sequence of VGAM2434 RNA, herein designated VGAM RNA, also designated SEQ ID:5145.

Another function of VGAM2434 is therefore inhibition of DKFZp434E2220 (Accession NM_017612). Accordingly, utilities of VGAM2434 include diagnosis, prevention and treatment of diseases and clinical conditions associated with DKFZp434E2220. DKFZP434F0318 (Accession NM_030817) is another VGAM2434 host target gene. DKFZP434F0318 BINDING SITE is HOST TARGET binding site found in the 3' untranslated region of mRNA encoded by DKFZP434F0318, corresponding to a HOST TARGET binding site such as BINDING SITE I, BINDING SITE II or BINDING SITE III. Table 2 illustrates the complementarity of the nucleotide sequences of DKFZP434F0318 BINDING SITE, designated SEQ ID:25143, to the nucleotide sequence of VGAM2434 RNA, herein designated VGAM RNA, also designated SEQ ID:5145.

Another function of VGAM2434 is therefore inhibition of DKFZP434F0318 (Accession NM_030817). Accordingly, utilities of VGAM2434 include diagnosis, prevention and treatment of diseases and clinical conditions associated with DKFZP434F0318. DKFZP434J037 (Accession NM_030952) is another VGAM2434 host target gene. DKFZP434J037 BINDING SITE is HOST TARGET binding site found in the 3' untranslated region of mRNA encoded by DKFZP434J037, corresponding to a HOST TARGET binding site such as BINDING SITE I, BINDING SITE II or BINDING SITE III. Table 2 illustrates the complementarity of the nucleotide sequences of DKFZP434J037 BINDING SITE, designated SEQ ID:25220, to the nucleotide sequence of VGAM2434 RNA, herein designated VGAM RNA, also designated SEQ ID:5145.

Another function of VGAM2434 is therefore inhibition of DKFZP434J037 (Accession NM_030952). Accordingly, utilities of VGAM2434 include diagnosis, prevention and treatment of diseases and clinical conditions associated with DKFZP434J037. DKFZp547H025 (Accession NM_020161) is another VGAM2434 host target gene. DKFZp547H025 BINDING SITE is HOST TARGET binding site found in the 3' untranslated region of mRNA encoded by DKFZp547H025, corresponding to a HOST TARGET binding site such as BINDING SITE I, BINDING SITE II or BINDING SITE III. Table 2 illustrates the complementarity of the nucleotide sequences of DKFZp547H025 BINDING SITE, designated SEQ ID:21375, to the nucleotide sequence of VGAM2434 RNA, herein designated VGAM RNA, also designated SEQ ID:5145.

Another function of VGAM2434 is therefore inhibition of DKFZp547H025 (Accession NM_020161). Accordingly, utilities of VGAM2434 include diagnosis, prevention and treatment of diseases and clinical conditions associated with DKFZp547H025. DKFZP564O0523 (Accession NM_032120) is another VGAM2434 host target gene. DKFZP564O0523 BINDING SITE is HOST TARGET binding site found in the 3' untranslated region of mRNA encoded by DKFZP564O0523, corresponding to a HOST TARGET binding site such as BINDING SITE I, BINDING SITE II or BINDING SITE III. Table 2 illustrates the complementarity of the nucleotide sequences of DKFZP564O0523 BINDING SITE, designated SEQ ID:25805, to the nucleotide sequence of VGAM2434 RNA, herein designated VGAM RNA, also designated SEQ ID:5145.

Another function of VGAM2434 is therefore inhibition of DKFZP564O0523 (Accession NM_032120). Accordingly, utilities of VGAM2434 include diagnosis, prevention and treatment of diseases and clinical conditions associated with DKFZP564O0523. DKFZp762L0311 (Accession NM_018719) is another VGAM2434 host target gene. DKFZp762L0311 BINDING SITE is HOST TARGET binding site found in the 3' untranslated region of mRNA encoded by DKFZp762L0311, corresponding to a HOST TARGET binding site such as BINDING SITE I, BINDING SITE II or BINDING SITE III. Table 2 illustrates the complementarity of the nucleotide sequences of DKFZp762L0311 BINDING SITE, designated SEQ ID:20799, to the nucleotide sequence of VGAM2434 RNA, herein designated VGAM RNA, also designated SEQ ID:5145.

Another function of VGAM2434 is therefore inhibition of DKFZp762L0311 (Accession NM_018719). Accordingly, utilities of VGAM2434 include diagnosis, prevention and treatment of diseases and clinical conditions associated with DKFZp762L0311. Ecotropic Viral Integration Site 5 (EVI5, Accession NM_005665) is another VGAM2434 host target gene. EVI5 BINDING SITE is HOST TARGET binding site found in the 3' untranslated region of mRNA encoded by EVI5, corresponding to a HOST TARGET binding site such as BINDING SITE I, BINDING SITE II or BINDING SITE III. Table 2 illustrates the complementarity of the nucleotide sequences of EVI5 BINDING SITE, designated SEQ ID:12215, to the nucleotide sequence of VGAM2434 RNA, herein designated VGAM RNA, also designated SEQ ID:5145.

Another function of VGAM2434 is therefore inhibition of Ecotropic Viral Integration Site 5 (EVI5, Accession NM_005665). Accordingly, utilities of VGAM2434 include diagnosis, prevention and treatment of diseases and clinical conditions associated with EVI5. Fer-1-like 4 (C. elegans) (FER1L4, Accession NM_025206) is another VGAM2434 host target gene. FER1L4 BINDING SITE1 and FER1L4 BINDING SITE2 are HOST TARGET binding sites found in untranslated regions of mRNA encoded by FER1L4, corresponding to HOST TARGET binding sites such as BINDING SITE I, BINDING SITE II or BINDING SITE III. Table 2 illustrates the complementarity of the nucleotide sequences of FER1L4 BINDING SITE1 and FER1L4 BINDING SITE2, designated SEQ ID:24875 and SEQ ID:24876 respectively, to the nucleotide sequence of VGAM2434 RNA, herein designated VGAM RNA, also designated SEQ ID:5145.

Another function of VGAM2434 is therefore inhibition of Fer-1-like 4 (C. elegans) (FER1L4, Accession NM_025206). Accordingly, utilities of VGAM2434 include diagnosis, prevention and treatment of diseases and clinical conditions associated with FER1L4. FLJ10232 (Accession NM_018033) is another VGAM2434 host target gene. FLJ10232 BINDING SITE is HOST TARGET binding site found in the 3' untranslated region of mRNA encoded by FLJ10232, corresponding to a HOST TARGET binding site such as BINDING SITE I, BINDING SITE II or BINDING SITE III. Table 2 illustrates the complementarity of the nucleotide sequences of FLJ10232 BINDING SITE, designated SEQ ID:19774, to the nucleotide sequence of VGAM2434 RNA, herein designated VGAM RNA, also designated SEQ ID:5145.

Another function of VGAM2434 is therefore inhibition of FLJ10232 (Accession NM_018033). Accordingly, utilities of VGAM2434 include diagnosis, prevention and treatment of diseases and clinical conditions associated with FLJ10232. FLJ10298 (Accession NM_018050) is another VGAM2434 host target gene. FLJ10298 BINDING SITE is HOST TARGET binding site found in the 3' untranslated region of mRNA encoded by FLJ10298, corresponding to a HOST TARGET binding site such as BINDING SITE I, BINDING SITE II or BINDING SITE III. Table 2 illustrates the complementarity of the nucleotide sequences of FLJ10298 BINDING SITE, designated SEQ ID:19809, to the nucleotide sequence of VGAM2434 RNA, herein designated VGAM RNA, also designated SEQ ID:5145.

Another function of VGAM2434 is therefore inhibition of FLJ10298 (Accession NM_018050). Accordingly, utilities of VGAM2434 include diagnosis, prevention and treatment of diseases and clinical conditions associated with FLJ10298.

FLJ10535 (Accession NM_018129) is another VGAM2434 host target gene. FLJ10535 BINDING SITE is HOST TARGET binding site found in the 3' untranslated region of mRNA encoded by FLJ10535, corresponding to a HOST TARGET binding site such as BINDING SITE I, BINDING SITE II or BINDING SITE III. Table 2 illustrates the complementarity of the nucleotide sequences of FLJ10535 BINDING SITE, designated SEQ ID:19917, to the nucleotide sequence of VGAM2434 RNA, herein designated VGAM RNA, also designated SEQ ID:5145.

Another function of VGAM2434 is therefore inhibition of FLJ10535 (Accession NM_018129). Accordingly, utilities of VGAM2434 include diagnosis, prevention and treatment of diseases and clinical conditions associated with FLJ10535.

FLJ10713 (Accession NM_018189) is another VGAM2434 host target gene. FLJ10713 BINDING SITE is HOST TARGET binding site found in the 3' untranslated region of mRNA encoded by FLJ10713, corresponding to a HOST TARGET binding site such as BINDING SITE I, BINDING SITE II or BINDING SITE III. Table 2 illustrates the complementarity of the nucleotide sequences of FLJ10713 BINDING SITE, designated SEQ ID:20043, to the nucleotide sequence of VGAM2434 RNA, herein designated VGAM RNA, also designated SEQ ID:5145.

Another function of VGAM2434 is therefore inhibition of FLJ10713 (Accession NM_018189). Accordingly, utilities of VGAM2434 include diagnosis, prevention and treatment of diseases and clinical conditions associated with FLJ10713.

FLJ10901 (Accession NM_018265) is another VGAM2434 host target gene. FLJ10901 BINDING SITE is HOST TARGET binding site found in the 3' untranslated region of mRNA encoded by FLJ10901, corresponding to a HOST TARGET binding site such as BINDING SITE I, BINDING SITE II or BINDING SITE III. Table 2 illustrates the complementarity of the nucleotide sequences of FLJ10901 BINDING SITE, designated SEQ ID:20229, to the nucleotide sequence of VGAM2434 RNA, herein designated VGAM RNA, also designated SEQ ID:5145.

Another function of VGAM2434 is therefore inhibition of FLJ10901 (Accession NM_018265). Accordingly, utilities of VGAM2434 include diagnosis, prevention and treatment of diseases and clinical conditions associated with FLJ10901.

FLJ11004 (Accession NM_018296) is another VGAM2434 host target gene. FLJ11004 BINDING SITE is HOST TARGET binding site found in the 5' untranslated region of mRNA encoded by FLJ11004, corresponding to a HOST TARGET binding site such as BINDING SITE I, BINDING SITE II or BINDING SITE III. Table 2 illustrates the complementarity of the nucleotide sequences of FLJ11004 BINDING SITE, designated SEQ ID:20289, to the nucleotide sequence of VGAM2434 RNA, herein designated VGAM RNA, also designated SEQ ID:5145.

Another function of VGAM2434 is therefore inhibition of FLJ11004 (Accession NM_018296). Accordingly, utilities of VGAM2434 include diagnosis, prevention and treatment of diseases and clinical conditions associated with FLJ11004.

FLJ11710 (Accession NM_024846) is another VGAM2434 host target gene. FLJ11710 BINDING SITE is HOST TARGET binding site found in the 3' untranslated region of mRNA encoded by FLJ11710, corresponding to a HOST TARGET binding site such as BINDING SITE I, BINDING SITE II or BINDING SITE III. Table 2 illustrates the complementarity of the nucleotide sequences of FLJ11710 BINDING SITE, designated SEQ ID:24275, to the nucleotide sequence of VGAM2434 RNA, herein designated VGAM RNA, also designated SEQ ID:5145.

Another function of VGAM2434 is therefore inhibition of FLJ11710 (Accession NM_024846). Accordingly, utilities of VGAM2434 include diagnosis, prevention and treatment of diseases and clinical conditions associated with FLJ11710.

FLJ12572 (Accession NM_022905) is another VGAM2434 host target gene. FLJ12572 BINDING SITE is HOST TARGET binding site found in the 5' untranslated region of mRNA encoded by FLJ12572, corresponding to a HOST TARGET binding site such as BINDING SITE I, BINDING SITE II or BINDING SITE III. Table 2 illustrates the complementarity of the nucleotide sequences of FLJ12572 BINDING SITE, designated SEQ ID:23197, to the nucleotide sequence of VGAM2434 RNA, herein designated VGAM RNA, also designated SEQ ID:5145.

Another function of VGAM2434 is therefore inhibition of FLJ12572 (Accession NM_022905). Accordingly, utilities of VGAM2434 include diagnosis, prevention and treatment of diseases and clinical conditions associated with FLJ12572.

FLJ12586 (Accession NM_024620) is another VGAM2434 host target gene. FLJ12586 BINDING SITE is HOST TARGET binding site found in the 3' untranslated region of mRNA encoded by FLJ12586, corresponding to a HOST TARGET binding site such as BINDING SITE I, BINDING SITE II or BINDING SITE III. Table 2 illustrates the complementarity of the nucleotide sequences of FLJ12586 BINDING SITE, designated SEQ ID:23883, to the nucleotide sequence of VGAM2434 RNA, herein designated VGAM RNA, also designated SEQ ID:5145.

Another function of VGAM2434 is therefore inhibition of FLJ12586 (Accession NM_024620). Accordingly, utilities of VGAM2434 include diagnosis, prevention and treatment of diseases and clinical conditions associated with FLJ12586.

FLJ12687 (Accession NM_024917) is another VGAM2434 host target gene. FLJ12687 BINDING SITE is HOST TARGET binding site found in the 3' untranslated region of mRNA encoded by FLJ12687, corresponding to a HOST TARGET binding site such as BINDING SITE I, BINDING SITE II or BINDING SITE III. Table 2 illustrates the complementarity of the nucleotide sequences of FLJ12687 BINDING SITE, designated SEQ ID:24447, to the nucleotide sequence of VGAM2434 RNA, herein designated VGAM RNA, also designated SEQ ID:5145.

Another function of VGAM2434 is therefore inhibition of FLJ12687 (Accession NM_024917). Accordingly, utilities of VGAM2434 include diagnosis, prevention and treatment of diseases and clinical conditions associated with FLJ12687.

FLJ12903 (Accession NM_022753) is another VGAM2434 host target gene. FLJ12903 BINDING SITE is HOST TARGET binding site found in the 3' untranslated region of mRNA encoded by FLJ12903, corresponding to a HOST TARGET binding site such as BINDING SITE I, BINDING SITE II or BINDING SITE III. Table 2 illustrates the complementarity of the nucleotide sequences of FLJ12903 BINDING SITE, designated SEQ ID:22983, to the nucleotide sequence of VGAM2434 RNA, herein designated VGAM RNA, also designated SEQ ID:5145.

Another function of VGAM2434 is therefore inhibition of FLJ12903 (Accession NM_022753). Accordingly, utilities of VGAM2434 include diagnosis, prevention and treatment of diseases and clinical conditions associated with FLJ12903. FLJ12973 (Accession NM_024908) is another VGAM2434 host target gene. FLJ12973 BINDING SITE is HOST TARGET binding site found in the 3' untranslated region of mRNA encoded by FLJ12973, corresponding to a HOST TARGET binding site such as BINDING SITE I, BINDING SITE II or BINDING SITE III. Table 2 illustrates the complementarity of the nucleotide sequences of FLJ12973 BINDING SITE, designated SEQ ID:24408, to the nucleotide sequence of VGAM2434 RNA, herein designated VGAM RNA, also designated SEQ ID:5145.

Another function of VGAM2434 is therefore inhibition of FLJ12973 (Accession NM_024908). Accordingly, utilities of VGAM2434 include diagnosis, prevention and treatment of diseases and clinical conditions associated with FLJ12973. FLJ13193 (Accession NM_032177) is another VGAM2434 host target gene. FLJ13193 BINDING SITE is HOST TARGET binding site found in the 3' untranslated region of mRNA encoded by FLJ13193, corresponding to a HOST TARGET binding site such as BINDING SITE I, BINDING SITE II or BINDING SITE III. Table 2 illustrates the complementarity of the nucleotide sequences of FLJ13193 BINDING SITE, designated SEQ ID:25891, to the nucleotide sequence of VGAM2434 RNA, herein designated VGAM RNA, also designated SEQ ID:5145.

Another function of VGAM2434 is therefore inhibition of FLJ13193 (Accession NM_032177). Accordingly, utilities of VGAM2434 include diagnosis, prevention and treatment of diseases and clinical conditions associated with FLJ13193. FLJ14950 (Accession NM_032865) is another VGAM2434 host target gene. FLJ14950 BINDING SITE is HOST TARGET binding site found in the 3' untranslated region of mRNA encoded by FLJ14950, corresponding to a HOST TARGET binding site such as BINDING SITE I, BINDING SITE II or BINDING SITE III. Table 2 illustrates the complementarity of the nucleotide sequences of FLJ14950 BINDING SITE, designated SEQ ID:26675, to the nucleotide sequence of VGAM2434 RNA, herein designated VGAM RNA, also designated SEQ ID:5145.

Another function of VGAM2434 is therefore inhibition of FLJ14950 (Accession NM_032865). Accordingly, utilities of VGAM2434 include diagnosis, prevention and treatment of diseases and clinical conditions associated with FLJ14950. FLJ20034 (Accession NM_017630) is another VGAM2434 host target gene. FLJ20034 BINDING SITE is HOST TARGET binding site found in the 3' untranslated region of mRNA encoded by FLJ20034, corresponding to a HOST TARGET binding site such as BINDING SITE I, BINDING SITE II or BINDING SITE III. Table 2 illustrates the complementarity of the nucleotide sequences of FLJ20034 BINDING SITE, designated SEQ ID:19132, to the nucleotide sequence of VGAM2434 RNA, herein designated VGAM RNA, also designated SEQ ID:5145.

Another function of VGAM2434 is therefore inhibition of FLJ20034 (Accession NM_017630). Accordingly, utilities of VGAM2434 include diagnosis, prevention and treatment of diseases and clinical conditions associated with FLJ20034. FLJ20136 (Accession NM_017684) is another VGAM2434 host target gene. FLJ20136 BINDING SITE is HOST TARGET binding site found in the 3' untranslated region of mRNA encoded by FLJ20136, corresponding to a HOST TARGET binding site such as BINDING SITE I, BINDING SITE II or BINDING SITE III. Table 2 illustrates the complementarity of the nucleotide sequences of FLJ20136 BINDING SITE, designated SEQ ID:19232, to the nucleotide sequence of VGAM2434 RNA, herein designated VGAM RNA, also designated SEQ ID:5145.

Another function of VGAM2434 is therefore inhibition of FLJ20136 (Accession NM_017684). Accordingly, utilities of VGAM2434 include diagnosis, prevention and treatment of diseases and clinical conditions associated with FLJ20136. FLJ20342 (Accession NM_017774) is another VGAM2434 host target gene. FLJ20342 BINDING SITE is HOST TARGET binding site found in the 3' untranslated region of mRNA encoded by FLJ20342, corresponding to a HOST TARGET binding site such as BINDING SITE I, BINDING SITE II or BINDING SITE III. Table 2 illustrates the complementarity of the nucleotide sequences of FLJ20342 BINDING SITE, designated SEQ ID:19398, to the nucleotide sequence of VGAM2434 RNA, herein designated VGAM RNA, also designated SEQ ID:5145.

Another function of VGAM2434 is therefore inhibition of FLJ20342 (Accession NM_017774). Accordingly, utilities of VGAM2434 include diagnosis, prevention and treatment of diseases and clinical conditions associated with FLJ20342. FLJ20344 (Accession NM_017776) is another VGAM2434 host target gene. FLJ20344 BINDING SITE is HOST TARGET binding site found in the 3' untranslated region of mRNA encoded by FLJ20344, corresponding to a HOST TARGET binding site such as BINDING SITE I, BINDING SITE II or BINDING SITE III. Table 2 illustrates the complementarity of the nucleotide sequences of FLJ20344 BINDING SITE, designated SEQ ID:19405, to the nucleotide sequence of VGAM2434 RNA, herein designated VGAM RNA, also designated SEQ ID:5145.

Another function of VGAM2434 is therefore inhibition of FLJ20344 (Accession NM_017776). Accordingly, utilities of VGAM2434 include diagnosis, prevention and treatment of diseases and clinical conditions associated with FLJ20344. FLJ20507 (Accession NM_017849) is another VGAM2434 host target gene. FLJ20507 BINDING SITE1 and FLJ20507 BINDING SITE2 are HOST TARGET binding sites found in untranslated regions of mRNA encoded by FLJ20507, corresponding to HOST TARGET binding sites such as BINDING SITE I, BINDING SITE II or BINDING SITE III. Table 2 illustrates the complementarity of the nucleotide sequences of FLJ20507 BINDING SITE1 and FLJ20507 BINDING SITE2, designated SEQ ID:19510 and SEQ ID:30218 respectively, to the nucleotide sequence of VGAM2434 RNA, herein designated VGAM RNA, also designated SEQ ID:5145.

Another function of VGAM2434 is therefore inhibition of FLJ20507 (Accession NM_017849). Accordingly, utilities of VGAM2434 include diagnosis, prevention and treatment of diseases and clinical conditions associated with FLJ20507. FLJ22002 (Accession NM_024838) is another VGAM2434 host target gene. FLJ22002 BINDING SITE is HOST TARGET binding site found in the 3' untranslated region of mRNA encoded by FLJ22002, corresponding to a HOST TARGET binding site such as BINDING SITE I, BINDING SITE II or BINDING SITE III. Table 2 illustrates the complementarity of the nucleotide sequences of FLJ22002 BINDING SITE, designated SEQ ID:24249, to the nucleotide sequence of VGAM2434 RNA, herein designated VGAM RNA, also designated SEQ ID:5145.

Another function of VGAM2434 is therefore inhibition of FLJ22002 (Accession NM_024838). Accordingly, utilities of VGAM2434 include diagnosis, prevention and treatment of diseases and clinical conditions associated with FLJ22002. FLJ22531 (Accession NM_024650) is another VGAM2434 host target gene. FLJ22531 BINDING SITE is HOST TARGET binding site found in the 5' untranslated region of mRNA encoded by FLJ22531, corresponding to a HOST TARGET binding site such as BINDING SITE I, BINDING SITE II or BINDING SITE III. Table 2 illustrates the complementarity of the nucleotide sequences of FLJ22531 BINDING SITE, designated SEQ ID:23946, to the nucleotide sequence of VGAM2434 RNA, herein designated VGAM RNA, also designated SEQ ID:5145.

Another function of VGAM2434 is therefore inhibition of FLJ22531 (Accession NM_024650). Accordingly, utilities of VGAM2434 include diagnosis, prevention and treatment of diseases and clinical conditions associated with FLJ22531. FLJ22794 (Accession XM_166220) is another VGAM2434 host target gene. FLJ22794 BINDING SITE is HOST TARGET binding site found in the 3' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44037, to the nucleotide sequence of VGAM2434 RNA, herein designated VGAM RNA, also designated SEQ ID:5145.

Another function of VGAM2434 is therefore inhibition of FLJ22794 (Accession XM_166220). Accordingly, utilities of VGAM2434 include diagnosis, prevention and treatment of diseases and clinical conditions associated with FLJ22794. FLJ23024 (Accession NM_024936) is another VGAM2434 host target gene. FLJ23024 BINDING SITE is HOST TARGET binding site found in the 3' untranslated region of mRNA encoded by FLJ23024, corresponding to a HOST TARGET binding site such as BINDING SITE I, BINDING SITE II or BINDING SITE III. Table 2 illustrates the complementarity of the nucleotide sequences of FLJ23024 BINDING SITE, designated SEQ ID:24472, to the nucleotide sequence of VGAM2434 RNA, herein designated VGAM RNA, also designated SEQ ID:5145.

Another function of VGAM2434 is therefore inhibition of FLJ23024 (Accession NM_024936). Accordingly, utilities of VGAM2434 include diagnosis, prevention and treatment of diseases and clinical conditions associated with FLJ23024. FLJ23356 (Accession NM_032237) is another VGAM2434 host target gene. FLJ23356 BINDING SITE is HOST TARGET binding site found in the 3' untranslated region of mRNA encoded by FLJ23356, corresponding to a HOST TARGET binding site such as BINDING SITE I, BINDING SITE II or BINDING SITE III. Table 2 illustrates the complementarity of the nucleotide sequences of FLJ23356 BINDING SITE, designated SEQ ID:25958, to the nucleotide sequence of VGAM2434 RNA, herein designated VGAM RNA, also designated SEQ ID:5145.

Another function of VGAM2434 is therefore inhibition of FLJ23356 (Accession NM_032237). Accordingly, utilities of VGAM2434 include diagnosis, prevention and treatment of diseases and clinical conditions associated with FLJ23356. FLJ23392 (Accession NM_024784) is another VGAM2434 host target gene. FLJ23392 BINDING SITE is HOST TARGET binding site found in the 3' untranslated region of mRNA encoded by FLJ23392, corresponding to a HOST TARGET binding site such as BINDING SITE I, BINDING SITE II or BINDING SITE III. Table 2 illustrates the complementarity of the nucleotide sequences of FLJ23392 BINDING SITE, designated SEQ ID:24160, to the nucleotide sequence of VGAM2434 RNA, herein designated VGAM RNA, also designated SEQ ID:5145.

Another function of VGAM2434 is therefore inhibition of FLJ23392 (Accession NM_024784). Accordingly, utilities of VGAM2434 include diagnosis, prevention and treatment of diseases and clinical conditions associated with FLJ23392. FLJ23563 (Accession XM_041701) is another VGAM2434 host target gene. FLJ23563 BINDING SITE is HOST TARGET binding site found in the 3' untranslated region of mRNA encoded by FLJ23563, corresponding to a HOST TARGET binding site such as BINDING SITE I, BINDING SITE II or BINDING SITE III. Table 2 illustrates the complementarity of the nucleotide sequences of FLJ23563 BINDING SITE, designated SEQ ID:33562, to the nucleotide sequence of VGAM2434 RNA, herein designated VGAM RNA, also designated SEQ ID:5145.

Another function of VGAM2434 is therefore inhibition of FLJ23563 (Accession XM_041701). Accordingly, utilities of VGAM2434 include diagnosis, prevention and treatment of diseases and clinical conditions associated with FLJ23563. FLJ25416 (Accession NM_145018) is another VGAM2434 host target gene. FLJ25416 BINDING SITE is HOST TARGET binding site found in the 5' untranslated region of mRNA encoded by FLJ25416, corresponding to a HOST TARGET binding site such as BINDING SITE I, BINDING SITE II or BINDING SITE III. Table 2 illustrates the complementarity of the nucleotide sequences of FLJ25416 BINDING SITE, designated SEQ ID:29627, to the nucleotide sequence of VGAM2434 RNA, herein designated VGAM RNA, also designated SEQ ID:5145.

Another function of VGAM2434 is therefore inhibition of FLJ25416 (Accession NM_145018). Accordingly, utilities of VGAM2434 include diagnosis, prevention and treatment of diseases and clinical conditions associated with FLJ25416. FLJ30532 (Accession NM_144724) is another VGAM2434 host target gene. FLJ30532 BINDING SITE is HOST TARGET binding site found in the 3' untranslated region of mRNA encoded by FLJ30532, corresponding to a HOST TARGET binding site such as BINDING SITE I, BINDING SITE II or BINDING SITE III. Table 2 illustrates the complementarity of the nucleotide sequences of FLJ30532 BINDING SITE, designated SEQ ID:29549, to the nucleotide sequence of VGAM2434 RNA, herein designated VGAM RNA, also designated SEQ ID:5145.

Another function of VGAM2434 is therefore inhibition of FLJ30532 (Accession NM_144724). Accordingly, utilities of VGAM2434 include diagnosis, prevention and treatment of diseases and clinical conditions associated with FLJ30532. FLJ32865 (Accession NM_144613) is another VGAM2434 host target gene. FLJ32865 BINDING SITE is HOST TARGET binding site found in the 3' untranslated region of mRNA encoded by FLJ32865, corresponding to a HOST TARGET binding site such as BINDING SITE I, BINDING SITE II or BINDING SITE III. Table 2 illustrates the complementarity of the nucleotide sequences of FLJ32865 BINDING SITE, designated SEQ ID:29426, to the nucleotide sequence of VGAM2434 RNA, herein designated VGAM RNA, also designated SEQ ID:5145.

Another function of VGAM2434 is therefore inhibition of FLJ32865 (Accession NM_144613). Accordingly, utilities of VGAM2434 include diagnosis, prevention and treatment of diseases and clinical conditions associated with FLJ32865. GAL3ST-4 (Accession NM_024637) is another VGAM2434 host target gene. GAL3ST-4 BINDING SITE is HOST TARGET binding site found in the 3' untranslated region of mRNA encoded by GAL3ST-4, corresponding to a HOST TARGET binding site such as BINDING SITE I, BINDING SITE II or BINDING SITE III. Table 2 illustrates the complementarity of the nucleotide sequences of GAL3ST-4 BINDING SITE, designated SEQ ID:23910, to the nucleotide sequence of VGAM2434 RNA, herein designated VGAM RNA, also designated SEQ ID:5145.

Another function of VGAM2434 is therefore inhibition of GAL3ST-4 (Accession NM_024637). Accordingly, utilities of VGAM2434 include diagnosis, prevention and treatment of diseases and clinical conditions associated with GAL3ST-4. GMPPB (Accession XM_171044) is another VGAM2434 host target gene. GMPPB BINDING SITE is HOST TARGET binding site found in the 5' untranslated region of mRNA encoded by GMPPB, corresponding to a HOST TARGET binding site such as BINDING SITE I, BINDING SITE II or BINDING SITE III. Table 2 illustrates the complementarity of the nucleotide sequences of GMPPB BINDING SITE, designated SEQ ID:45819, to the nucleotide sequence of VGAM2434 RNA, herein designated VGAM RNA, also designated SEQ ID:5145.

Another function of VGAM2434 is therefore inhibition of GMPPB (Accession XM_171044). Accordingly, utilities of VGAM2434 include diagnosis, prevention and treatment of diseases and clinical conditions associated with GMPPB. Guanine Nucleotide Binding Protein (G protein), Gamma 4 (GNG4, Accession NM_004485) is another VGAM2434 host target gene. GNG4 BINDING SITE is HOST TARGET binding site found in the 3' untranslated region of mRNA encoded by GNG4, corresponding to a HOST TARGET binding site such as BINDING SITE I, BINDING SITE II or BINDING SITE III. Table 2 illustrates the complementarity of the nucleotide sequences of GNG4 BINDING SITE, designated SEQ ID:10813, to the nucleotide sequence of VGAM2434 RNA, herein designated VGAM RNA, also designated SEQ ID:5145.

Another function of VGAM2434 is therefore inhibition of Guanine Nucleotide Binding Protein (G protein), Gamma 4 (GNG4, Accession NM_004485). Accordingly, utilities of VGAM2434 include diagnosis, prevention and treatment of diseases and clinical conditions associated with GNG4. Glycoprotein V (platelet) (GP5, Accession NM_004488) is another VGAM2434 host target gene. GP5 BINDING SITE is HOST TARGET binding site found in the 3' untranslated region of mRNA encoded by GP5, corresponding to a HOST TARGET binding site such as BINDING SITE I, BINDING SITE II or BINDING SITE III. Table 2 illustrates the complementarity of the nucleotide sequences of GP5 BINDING SITE, designated SEQ ID:10819, to the nucleotide sequence of VGAM2434 RNA, herein designated VGAM RNA, also designated SEQ ID:5145.

Another function of VGAM2434 is therefore inhibition of Glycoprotein V (platelet) (GP5, Accession NM_004488). Accordingly, utilities of VGAM2434 include diagnosis, prevention and treatment of diseases and clinical conditions associated with GP5. GREB1 (Accession NM_014668) is another VGAM2434 host target gene. GREB1 BINDING SITE is HOST TARGET binding site found in the 3' untranslated region of mRNA encoded by GREB1, corresponding to a HOST TARGET binding site such as BINDING SITE I, BINDING SITE II or BINDING SITE III. Table 2 illustrates the complementarity of the nucleotide sequences of GREB1 BINDING SITE, designated SEQ ID:16124, to the nucleotide sequence of VGAM2434 RNA, herein designated VGAM RNA, also designated SEQ ID:5145.

Another function of VGAM2434 is therefore inhibition of GREB1 (Accession NM_014668). Accordingly, utilities of VGAM2434 include diagnosis, prevention and treatment of diseases and clinical conditions associated with GREB1. General Transcription Factor IIE, Polypeptide 1, Alpha 56 kDa (GTF2E1, Accession NM_005513) is another VGAM2434 host target gene. GTF2E1 BINDING SITE is HOST TARGET binding site found in the 3' untranslated region of mRNA encoded by GTF2E1, corresponding to a HOST TARGET binding site such as BINDING SITE I, BINDING SITE II or BINDING SITE III. Table 2 illustrates the complementarity of the nucleotide sequences of GTF2E1 BINDING SITE, designated SEQ ID:12036, to the nucleotide sequence of VGAM2434 RNA, herein designated VGAM RNA, also designated SEQ ID:5145.

Another function of VGAM2434 is therefore inhibition of General Transcription Factor IIE, Polypeptide 1, Alpha 56 kDa (GTF2E1, Accession NM_005513). Accordingly, utilities of VGAM2434 include diagnosis, prevention and treatment of diseases and clinical conditions associated with GTF2E1. GTPBG3 (Accession NM_032620) is another VGAM2434 host target gene. GTPBG3 BINDING SITE is HOST TARGET binding site found in the 3' untranslated region of mRNA encoded by GTPBG3, corresponding to a HOST TARGET binding site such as BINDING SITE I, BINDING SITE II or BINDING SITE III. Table 2 illustrates the complementarity of the nucleotide sequences of GTPBG3 BINDING SITE, designated SEQ ID:26335, to the nucleotide sequence of VGAM2434 RNA, herein designated VGAM RNA, also designated SEQ ID:5145.

Another function of VGAM2434 is therefore inhibition of GTPBG3 (Accession NM_032620). Accordingly, utilities of VGAM2434 include diagnosis, prevention and treatment of diseases and clinical conditions associated with GTPBG3. H-plk (Accession NM_015852) is another VGAM2434 host target gene. H-plk BINDING SITE is HOST TARGET binding site found in the 5' untranslated region of mRNA encoded by H-plk, corresponding to a HOST TARGET binding site such as BINDING SITE I, BINDING SITE II or BINDING SITE III. Table 2 illustrates the complementarity of the nucleotide sequences of H-plk BINDING SITE, designated SEQ ID:17986, to the nucleotide sequence of VGAM2434 RNA, herein designated VGAM RNA, also designated SEQ ID:5145.

Another function of VGAM2434 is therefore inhibition of H-plk (Accession NM_015852). Accordingly, utilities of VGAM2434 include diagnosis, prevention and treatment of diseases and clinical conditions associated with H-plk. Histamine Receptor H4 (HRH4, Accession NM_021624) is another VGAM2434 host target gene. HRH4 BINDING SITE is HOST TARGET binding site found in the 3' untranslated region of mRNA encoded by HRH4, corresponding to a HOST TARGET binding site such as BINDING SITE I, BINDING SITE II or BINDING SITE III. Table 2 illustrates the complementarity of the nucleotide sequences of HRH4 BINDING SITE, designated SEQ ID:22258, to the nucleotide sequence of VGAM2434 RNA, herein designated VGAM RNA, also designated SEQ ID:5145.

Another function of VGAM2434 is therefore inhibition of Histamine Receptor H4 (HRH4, Accession NM_021624). Accordingly, utilities of VGAM2434 include diagnosis, prevention and treatment of diseases and clinical conditions associated with HRH4. ICK (Accession NM_014920) is another VGAM2434 host target gene. ICK BINDING SITE is HOST TARGET binding site found in the 3' untranslated region of mRNA encoded by ICK, corresponding to a HOST TARGET binding site such as BINDING SITE I, BINDING SITE II or BINDING SITE III. Table 2 illustrates the complementarity of the nucleotide sequences of ICK BINDING SITE, designated SEQ ID:17196, to the nucleotide sequence of VGAM2434 RNA, herein designated VGAM RNA, also designated SEQ ID:5145.

Another function of VGAM2434 is therefore inhibition of ICK (Accession NM_014920). Accordingly, utilities of VGAM2434 include diagnosis, prevention and treatment of diseases and clinical conditions associated with ICK. Junctional Adhesion Molecule 1 (JAM1, Accession NM_144502) is another VGAM2434 host target gene. JAM1 BINDING SITE1 through JAM1 BINDING SITE4 are HOST TARGET binding sites found in untranslated regions of mRNA encoded by JAM1, corresponding to HOST TARGET binding sites such as BINDING SITE I, BINDING SITE II or BINDING SITE III. Table 2 illustrates the complementarity of the nucleotide sequences of JAM1 BINDING SITE1 through JAM1 BINDING SITE4, designated SEQ ID:29331, SEQ ID:29342, SEQ ID:29352 and SEQ ID:18864 respectively, to the nucleotide sequence of VGAM2434 RNA, herein designated VGAM RNA, also designated SEQ ID:5145.

Another function of VGAM2434 is therefore inhibition of Junctional Adhesion Molecule 1 (JAM1, Accession NM_144502). Accordingly, utilities of VGAM2434 include diagnosis, prevention and treatment of diseases and clinical conditions associated with JAM1. KIAA0391 (Accession NM_014672) is another VGAM2434 host target gene. KIAA0391 BINDING SITE is HOST TARGET binding site found in the 3' untranslated region of mRNA encoded by KIAA0391, corresponding to a HOST TARGET binding site such as BINDING SITE I, BINDING SITE II or BINDING SITE III. Table 2 illustrates the complementarity of the nucleotide sequences of KIAA0391 BINDING SITE, designated SEQ ID:16136, to the nucleotide sequence of VGAM2434 RNA, herein designated VGAM RNA, also designated SEQ ID:5145.

Another function of VGAM2434 is therefore inhibition of KIAA0391 (Accession NM_014672). Accordingly, utilities of VGAM2434 include diagnosis, prevention and treatment of diseases and clinical conditions associated with KIAA0391. KIAA0426 (Accession NM_014724) is another VGAM2434 host target gene. KIAA0426 BINDING SITE is HOST TARGET binding site found in the 3' untranslated region of mRNA encoded by KIAA0426, corresponding to a HOST TARGET binding site such as BINDING SITE I, BINDING SITE II or BINDING SITE III. Table 2 illustrates the complementarity of the nucleotide sequences of KIAA0426 BINDING SITE, designated SEQ ID:16312, to the nucleotide sequence of VGAM2434 RNA, herein designated VGAM RNA, also designated SEQ ID:5145.

Another function of VGAM2434 is therefore inhibition of KIAA0426 (Accession NM_014724). Accordingly, utilities of VGAM2434 include diagnosis, prevention and treatment of diseases and clinical conditions associated with KIAA0426. KIAA0459 (Accession XM_027862) is another VGAM2434 host target gene. KIAA0459 BINDING SITE is HOST TARGET binding site found in the 3' untranslated region of mRNA encoded by KIAA0459, corresponding to a HOST TARGET binding site such as BINDING SITE I, BINDING SITE II or BINDING SITE III. Table 2 illustrates the complementarity of the nucleotide sequences of KIAA0459 BINDING SITE, designated SEQ ID:30578, to the nucleotide sequence of VGAM2434 RNA, herein designated VGAM RNA, also designated SEQ ID:5145.

Another function of VGAM2434 is therefore inhibition of KIAA0459 (Accession XM_027862). Accordingly, utilities of VGAM2434 include diagnosis, prevention and treatment of diseases and clinical conditions associated with KIAA0459. KIAA0475 (Accession NM_014864) is another VGAM2434 host target gene. KIAA0475 BINDING SITE is HOST TARGET binding site found in the 3' untranslated region of mRNA encoded by KIAA0475, corresponding to a HOST TARGET binding site such as BINDING SITE I, BINDING SITE II or BINDING SITE III. Table 2 illustrates the complementarity of the nucleotide sequences of KIAA0475 BINDING SITE, designated SEQ ID:16951, to the nucleotide sequence of VGAM2434 RNA, herein designated VGAM RNA, also designated SEQ ID:5145.

Another function of VGAM2434 is therefore inhibition of KIAA0475 (Accession NM_014864). Accordingly, utilities of VGAM2434 include diagnosis, prevention and treatment of diseases and clinical conditions associated with KIAA0475. KIAA0495 (Accession XM_031397) is another VGAM2434 host target gene. KIAA0495 BINDING SITE is HOST TARGET binding site found in the 3' untranslated region of mRNA encoded by KIAA0495, corresponding to a HOST TARGET binding site such as BINDING SITE I, BINDING SITE II or BINDING SITE III. Table 2 illustrates the complementarity of the nucleotide sequences of KIAA0495 BINDING SITE, designated SEQ ID:31364, to the nucleotide sequence of VGAM2434 RNA, herein designated VGAM RNA, also designated SEQ ID:5145.

Another function of VGAM2434 is therefore inhibition of KIAA0495 (Accession XM_031397). Accordingly, utilities of VGAM2434 include diagnosis, prevention and treatment of diseases and clinical conditions associated with KIAA0495. KIAA0513 (Accession NM_014732) is another VGAM2434 host target gene. KIAA0513 BINDING SITE is HOST TARGET binding site found in the 3' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16361, to the nucleotide sequence of VGAM2434 RNA, herein designated VGAM RNA, also designated SEQ ID:5145.

Another function of VGAM2434 is therefore inhibition of KIAA0513 (Accession NM_014732). Accordingly, utilities of VGAM2434 include diagnosis, prevention and treatment of diseases and clinical conditions associated with KIAA0513. KIAA0544 (Accession XM_048119) is another VGAM2434 host target gene. KIAA0544 BINDING SITE is HOST TARGET binding site found in the 3' untranslated region of mRNA encoded by KIAA0544, corresponding to a HOST TARGET binding site such as BINDING SITE I, BINDING SITE II or BINDING SITE III. Table 2 illustrates the complementarity of the nucleotide sequences of KIAA0544 BINDING SITE, designated SEQ ID:35117, to the nucleotide sequence of VGAM2434 RNA, herein designated VGAM RNA, also designated SEQ ID:5145.

Another function of VGAM2434 is therefore inhibition of KIAA0544 (Accession XM_048119). Accordingly, utilities of VGAM2434 include diagnosis, prevention and treatment of diseases and clinical conditions associated with KIAA0544. KIAA0557 (Accession XM_085507) is another VGAM2434 host target gene. KIAA0557 BINDING SITE is HOST TARGET binding site found in the 3' untranslated region of mRNA encoded by KIAA0557, corresponding to a HOST TARGET binding site such as BINDING SITE I, BINDING SITE II or BINDING SITE III. Table 2 illustrates the complementarity of the nucleotide sequences of KIAA0557 BINDING SITE, designated SEQ ID:38212, to the nucleotide sequence of VGAM2434 RNA, herein designated VGAM RNA, also designated SEQ ID:5145.

Another function of VGAM2434 is therefore inhibition of KIAA0557 (Accession XM_085507). Accordingly, utilities of VGAM2434 include diagnosis, prevention and treatment of diseases and clinical conditions associated with KIAA0557. KIAA0563 (Accession NM_014834) is another VGAM2434 host target gene. KIAA0563 BINDING SITE is HOST TARGET binding site found in the 5' untranslated region of mRNA encoded by KIAA0563, corresponding to a HOST TARGET binding site such as BINDING SITE I, BINDING SITE II or BINDING SITE III. Table 2 illustrates the complementarity of the nucleotide sequences of KIAA0563 BINDING SITE, designated SEQ ID:16841, to the nucleotide sequence of VGAM2434 RNA, herein designated VGAM RNA, also designated SEQ ID:5145.

Another function of VGAM2434 is therefore inhibition of KIAA0563 (Accession NM_014834). Accordingly, utilities of VGAM2434 include diagnosis, prevention and treatment of diseases and clinical conditions associated with KIAA0563. KIAA0594 (Accession XM_036117) is another VGAM2434 host target gene. KIAA0594 BINDING SITE is HOST TARGET binding site found in the 3' untranslated region of mRNA encoded by KIAA0594, corresponding to a HOST TARGET binding site such as BINDING SITE I, BINDING SITE II or BINDING SITE III. Table 2 illustrates the complementarity of the nucleotide sequences of KIAA0594 BINDING SITE, designated SEQ ID:32390, to the nucleotide sequence of VGAM2434 RNA, herein designated VGAM RNA, also designated SEQ ID:5145.

Another function of VGAM2434 is therefore inhibition of KIAA0594 (Accession XM_036117). Accordingly, utilities of VGAM2434 include diagnosis, prevention and treatment of diseases and clinical conditions associated with KIAA0594. KIAA0599 (Accession XM_085127) is another VGAM2434 host target gene. KIAA0599 BINDING SITE is HOST TARGET binding site found in the 3' untranslated region of mRNA encoded by KIAA0599, corresponding to a HOST TARGET binding site such as BINDING SITE I, BINDING SITE II or BINDING SITE III. Table 2 illustrates the complementarity of the nucleotide sequences of KIAA0599 BINDING SITE, designated SEQ ID:37859, to the nucleotide sequence of VGAM2434 RNA, herein designated VGAM RNA, also designated SEQ ID:5145.

Another function of VGAM2434 is therefore inhibition of KIAA0599 (Accession XM_085127). Accordingly, utilities of VGAM2434 include diagnosis, prevention and treatment of diseases and clinical conditions associated with KIAA0599. KIAA0650 (Accession XM_113962) is another VGAM2434 host target gene. KIAA0650 BINDING SITE is HOST TARGET binding site found in the 3' untranslated region of mRNA encoded by KIAA0650, corresponding to a HOST TARGET binding site such as BINDING SITE I, BINDING SITE II or BINDING SITE III. Table 2 illustrates the complementarity of the nucleotide sequences of KIAA0650 BINDING SITE, designated SEQ ID:42571, to the nucleotide sequence of VGAM2434 RNA, herein designated VGAM RNA, also designated SEQ ID:5145.

Another function of VGAM2434 is therefore inhibition of KIAA0650 (Accession XM_113962). Accordingly, utilities of VGAM2434 include diagnosis, prevention and treatment of diseases and clinical conditions associated with KIAA0650. KIAA0663 (Accession NM_014827) is another VGAM2434 host target gene. KIAA0663 BINDING SITE is HOST TARGET binding site found in the 5' untranslated region of mRNA encoded by KIAA0663, corresponding to a HOST TARGET binding site such as BINDING SITE I, BINDING SITE II or BINDING SITE III. Table 2 illustrates the complementarity of the nucleotide sequences of KIAA0663 BINDING SITE, designated SEQ ID:16814, to the nucleotide sequence of VGAM2434 RNA, herein designated VGAM RNA, also designated SEQ ID:5145.

Another function of VGAM2434 is therefore inhibition of KIAA0663 (Accession NM_014827). Accordingly, utilities of VGAM2434 include diagnosis, prevention and treatment of diseases and clinical conditions associated with KIAA0663. KIAA0676 (Accession NM_015043) is another VGAM2434 host target gene. KIAA0676 BINDING SITE is HOST TARGET binding site found in the 3' untranslated region of mRNA encoded by KIAA0676, corresponding to a HOST TARGET binding site such as BINDING SITE I, BINDING SITE II or BINDING SITE III. Table 2 illustrates the complementarity of the nucleotide sequences of KIAA0676 BINDING SITE, designated SEQ ID:17395, to the nucleotide sequence of VGAM2434 RNA, herein designated VGAM RNA, also designated SEQ ID:5145.

Another function of VGAM2434 is therefore inhibition of KIAA0676 (Accession NM_015043). Accordingly, utilities of VGAM2434 include diagnosis, prevention and treatment of diseases and clinical conditions associated with KIAA0676. KIAA0720 (Accession XM_030970) is another VGAM2434 host target gene. KIAA0720 BINDING SITE is HOST TARGET binding site found in the 3' untranslated region of mRNA encoded by KIAA0720, corresponding to a HOST TARGET binding site such as BINDING SITE I, BINDING SITE II or BINDING SITE III. Table 2 illustrates the complementarity of the nucleotide sequences of KIAA0720 BINDING SITE, designated SEQ ID:31232, to the nucleotide sequence of VGAM2434 RNA, herein designated VGAM RNA, also designated SEQ ID:5145.

Another function of VGAM2434 is therefore inhibition of KIAA0720 (Accession XM_030970). Accordingly, utilities of VGAM2434 include diagnosis, prevention and treatment of diseases and clinical conditions associated with KIAA0720. KIAA0841 (Accession XM_049237) is another VGAM2434 host target gene. KIAA0841 BINDING SITE is HOST TARGET binding site found in the 3' untranslated region of mRNA encoded by KIAA0841, corresponding to a HOST TARGET binding site such as BINDING SITE I, BINDING SITE II or BINDING SITE III. Table 2 illustrates the complementarity of the nucleotide sequences of KIAA0841 BINDING SITE, designated SEQ ID:35363, to the nucleotide sequence of VGAM2434 RNA, herein designated VGAM RNA, also designated SEQ ID:5145.

Another function of VGAM2434 is therefore inhibition of KIAA0841 (Accession XM_049237). Accordingly, utilities of VGAM2434 include diagnosis, prevention and treatment of diseases and clinical conditions associated with KIAA0841. KIAA0889 (Accession NM_015377) is another VGAM2434 host target gene. KIAA0889 BINDING SITE is HOST TARGET binding site found in the 3' untranslated region of mRNA encoded by KIAA0889, corresponding to a HOST TARGET binding site such as BINDING SITE I, BINDING SITE II or BINDING SITE III. Table 2 illustrates the complementarity of the nucleotide sequences of KIAA0889 BINDING SITE, designated SEQ ID:17680, to the nucleotide sequence of VGAM2434 RNA, herein designated VGAM RNA, also designated SEQ ID:5145.

Another function of VGAM2434 is therefore inhibition of KIAA0889 (Accession NM_015377). Accordingly, utilities of VGAM2434 include diagnosis, prevention and treatment of diseases and clinical conditions associated with KIAA0889. KIAA0924 (Accession NM_014897) is another VGAM2434 host target gene. KIAA0924 BINDING SITE is HOST TARGET binding site found in the 3' untranslated region of mRNA encoded by KIAA0924, corresponding to a HOST TARGET binding site such as BINDING SITE I, BINDING SITE II or BINDING SITE III. Table 2 illustrates the complementarity of the nucleotide sequences of KIAA0924 BINDING SITE, designated SEQ ID:17067, to the nucleotide sequence of VGAM2434 RNA, herein designated VGAM RNA, also designated SEQ ID:5145.

Another function of VGAM2434 is therefore inhibition of KIAA0924 (Accession NM_014897). Accordingly, utilities of VGAM2434 include diagnosis, prevention and treatment of diseases and clinical conditions associated with KIAA0924. KIAA1028 (Accession XM_166324) is another VGAM2434 host target gene. KIAA1028 BINDING SITE is HOST TARGET binding site found in the 3' untranslated region of mRNA encoded by KIAA1028, corresponding to a HOST TARGET binding site such as BINDING SITE I, BINDING SITE II or BINDING SITE III. Table 2 illustrates the complementarity of the nucleotide sequences of KIAA1028 BINDING SITE, designated SEQ ID:44164, to the nucleotide sequence of VGAM2434 RNA, herein designated VGAM RNA, also designated SEQ ID:5145.

Another function of VGAM2434 is therefore inhibition of KIAA1028 (Accession XM_166324). Accordingly, utilities of VGAM2434 include diagnosis, prevention and treatment of diseases and clinical conditions associated with KIAA1028. KIAA1041 (Accession NM_014947) is another VGAM2434 host target gene. KIAA1041 BINDING SITE is HOST TARGET binding site found in the 3' untranslated region of mRNA encoded by KIAA1041, corresponding to a HOST TARGET binding site such as BINDING SITE I, BINDING SITE II or BINDING SITE III. Table 2 illustrates the complementarity of the nucleotide sequences of KIAA1041 BINDING SITE, designated SEQ ID:17266, to the nucleotide sequence of VGAM2434 RNA, herein designated VGAM RNA, also designated SEQ ID:5145.

Another function of VGAM2434 is therefore inhibition of KIAA1041 (Accession NM_014947). Accordingly, utilities of VGAM2434 include diagnosis, prevention and treatment of diseases and clinical conditions associated with KIAA1041. KIAA1054 (Accession XM_043493) is another VGAM2434 host target gene. KIAA1054 BINDING SITE is HOST TARGET binding site found in the 3' untranslated region of mRNA encoded by KIAA1054, corresponding to a HOST TARGET binding site such as BINDING SITE I, BINDING SITE II or BINDING SITE III. Table 2 illustrates the complementarity of the nucleotide sequences of KIAA1054 BINDING SITE, designated SEQ ID:33957, to the nucleotide sequence of VGAM2434 RNA, herein designated VGAM RNA, also designated SEQ ID:5145.

Another function of VGAM2434 is therefore inhibition of KIAA1054 (Accession XM_043493). Accordingly, utilities of VGAM2434 include diagnosis, prevention and treatment of diseases and clinical conditions associated with KIAA1054. KIAA1165 (Accession XM_041162) is another VGAM2434 host target gene. KIAA1165 BINDING SITE is HOST TARGET binding site found in the 3' untranslated region of mRNA encoded by KIAA1165, corresponding to a HOST TARGET binding site such as BINDING SITE I, BINDING SITE II or BINDING SITE III. Table 2 illustrates the complementarity of the nucleotide sequences of KIAA1165 BINDING SITE, designated SEQ ID:33478, to the nucleotide sequence of VGAM2434 RNA, herein designated VGAM RNA, also designated SEQ ID:5145.

Another function of VGAM2434 is therefore inhibition of KIAA1165 (Accession XM_041162). Accordingly, utilities of VGAM2434 include diagnosis, prevention and treatment of diseases and clinical conditions associated with KIAA1165. KIAA1170 (Accession XM_045907) is another VGAM2434 host target gene. KIAA1170 BINDING SITE is HOST TARGET binding site found in the 3' untranslated region of mRNA encoded by KIAA1170, corresponding to a HOST TARGET binding site such as BINDING SITE I, BINDING SITE II or BINDING SITE III. Table 2 illustrates the complementarity of the nucleotide sequences of KIAA1170 BINDING SITE, designated SEQ ID:34613, to the nucleotide sequence of VGAM2434 RNA, herein designated VGAM RNA, also designated SEQ ID:5145.

Another function of VGAM2434 is therefore inhibition of KIAA1170 (Accession XM_045907). Accordingly, utilities of VGAM2434 include diagnosis, prevention and treatment of diseases and clinical conditions associated with KIAA1170. KIAA1185 (Accession XM_031399) is another VGAM2434 host target gene. KIAA1185 BINDING SITE is HOST TARGET binding site found in the 3' untranslated region of mRNA encoded by KIAA1185, corresponding to a HOST TARGET binding site such as BINDING SITE I, BINDING SITE II or BINDING SITE III. Table 2 illustrates the complementarity of the nucleotide sequences of KIAA1185 BINDING SITE, designated SEQ ID:31369, to the nucleotide sequence of VGAM2434 RNA, herein designated VGAM RNA, also designated SEQ ID:5145.

Another function of VGAM2434 is therefore inhibition of KIAA1185 (Accession XM_031399). Accordingly, utilities of VGAM2434 include diagnosis, prevention and treatment of diseases and clinical conditions associated with KIAA1185. KIAA1198 (Accession XM_032674) is another VGAM2434 host target gene. KIAA1198 BINDING SITE1 and KIAA1198 BINDING SITE2 are HOST TARGET binding sites found in untranslated regions of mRNA encoded by KIAA1198, corresponding to HOST TARGET binding sites such as BINDING SITE I, BINDING SITE II or BINDING SITE III. Table 2 illustrates the complementarity of the nucleotide sequences of KIAA1198 BINDING SITE1 and KIAA1198 BINDING SITE2, designated SEQ ID:31716 and SEQ ID:31718 respectively, to the nucleotide sequence of VGAM2434 RNA, herein designated VGAM RNA, also designated SEQ ID:5145.

Another function of VGAM2434 is therefore inhibition of KIAA1198 (Accession XM_032674). Accordingly, utilities of VGAM2434 include diagnosis, prevention and treatment of diseases and clinical conditions associated with KIAA1198. KIAA1320 (Accession XM_045095) is another VGAM2434 host target gene. KIAA1320 BINDING SITE is HOST TARGET binding site found in the 5' untranslated region of mRNA encoded by KIAA1320, corresponding to a HOST TARGET binding site such as BINDING SITE I, BINDING SITE II or BINDING SITE III. Table 2 illustrates the complementarity of the nucleotide sequences of KIAA1320 BINDING SITE, designated SEQ ID:34356, to the nucleotide sequence of VGAM2434 RNA, herein designated VGAM RNA, also designated SEQ ID:5145.

Another function of VGAM2434 is therefore inhibition of KIAA1320 (Accession XM_045095). Accordingly, utilities of VGAM2434 include diagnosis, prevention and treatment of diseases and clinical conditions associated with KIAA1320. KIAA1373 (Accession XM_048195) is another VGAM2434 host target gene. KIAA1373 BINDING SITE is HOST TARGET binding site found in the 3' untranslated region of mRNA encoded by KIAA1373, corresponding to a HOST TARGET binding site such as BINDING SITE I, BINDING SITE II or BINDING SITE III. Table 2 illustrates the complementarity of the nucleotide sequences of KIAA1373 BINDING SITE, designated SEQ ID:35128, to the nucleotide sequence of VGAM2434 RNA, herein designated VGAM RNA, also designated SEQ ID:5145.

Another function of VGAM2434 is therefore inhibition of KIAA1373 (Accession XM_048195). Accordingly, utilities of VGAM2434 include diagnosis, prevention and treatment of diseases and clinical conditions associated with KIAA1373. KIAA1467 (Accession XM_049605) is another VGAM2434 host target gene. KIAA1467 BINDING SITE is HOST TARGET binding site found in the 3' untranslated region of mRNA encoded by KIAA1467, corresponding to a HOST TARGET binding site such as BINDING SITE I, BINDING SITE II or BINDING SITE III. Table 2 illustrates the complementarity of the nucleotide sequences of KIAA1467 BINDING SITE, designated SEQ ID:35454, to the nucleotide sequence of VGAM2434 RNA, herein designated VGAM RNA, also designated SEQ ID:5145.

Another function of VGAM2434 is therefore inhibition of KIAA1467 (Accession XM_049605). Accordingly, utilities of VGAM2434 include diagnosis, prevention and treatment of diseases and clinical conditions associated with KIAA1467. KIAA1497 (Accession XM_041431) is another VGAM2434 host target gene. KIAA1497 BINDING SITE is HOST TARGET binding site found in the 5' untranslated region of mRNA encoded by KIAA1497, corresponding to a HOST TARGET binding site such as BINDING SITE I, BINDING SITE II or BINDING SITE III. Table 2 illustrates the complementarity of the nucleotide sequences of KIAA1497 BINDING SITE, designated SEQ ID:33527, to the nucleotide sequence of VGAM2434 RNA, herein designated VGAM RNA, also designated SEQ ID:5145.

Another function of VGAM2434 is therefore inhibition of KIAA1497 (Accession XM_041431). Accordingly, utilities of VGAM2434 include diagnosis, prevention and treatment of diseases and clinical conditions associated with KIAA1497. KIAA1571 (Accession XM_027744) is another VGAM2434 host target gene. KIAA1571 BINDING SITE is HOST TARGET binding site found in the 3' untranslated region of mRNA encoded by KIAA1571, corresponding to a HOST TARGET binding site such as BINDING SITE I, BINDING SITE II or BINDING SITE III. Table 2 illustrates the complementarity of the nucleotide sequences of KIAA1571 BINDING SITE, designated SEQ ID:30566, to the nucleotide sequence of VGAM2434 RNA, herein designated VGAM RNA, also designated SEQ ID:5145.

Another function of VGAM2434 is therefore inhibition of KIAA1571 (Accession XM_027744). Accordingly, utilities of VGAM2434 include diagnosis, prevention and treatment of diseases and clinical conditions associated with KIAA1571. KIAA1615 (Accession XM_044021) is another VGAM2434 host target gene. KIAA1615 BINDING SITE1 and KIAA1615 BINDING SITE2 are HOST TARGET binding sites found in untranslated regions of mRNA encoded by KIAA1615, corresponding to HOST TARGET binding sites such as BINDING SITE I, BINDING SITE II or BINDING SITE III. Table 2 illustrates the complementarity of the nucleotide sequences of KIAA1615 BINDING SITE1 and KIAA1615 BINDING SITE2, designated SEQ ID:34082 and SEQ ID:34088 respectively, to the nucleotide sequence of VGAM2434 RNA, herein designated VGAM RNA, also designated SEQ ID:5145.

Another function of VGAM2434 is therefore inhibition of KIAA1615 (Accession XM_044021). Accordingly, utilities of VGAM2434 include diagnosis, prevention and treatment of diseases and clinical conditions associated with KIAA1615. KIAA1737 (Accession XM_041115) is another VGAM2434 host target gene. KIAA1737 BINDING SITE is HOST TARGET binding site found in the 3' untranslated region of mRNA encoded by KIAA1737, corresponding to a HOST TARGET binding site such as BINDING SITE I, BINDING SITE II or BINDING SITE III. Table 2 illustrates the complementarity of the nucleotide sequences of KIAA1737 BINDING SITE, designated SEQ ID:33448, to the nucleotide sequence of VGAM2434 RNA, herein designated VGAM RNA, also designated SEQ ID:5145.

Another function of VGAM2434 is therefore inhibition of KIAA1737 (Accession XM_041115). Accordingly, utilities of VGAM2434 include diagnosis, prevention and treatment of diseases and clinical conditions associated with KIAA1737. KIAA1784 (Accession XM_036660) is another VGAM2434 host target gene. KIAA1784 BINDING SITE is HOST TARGET binding site found in the 3' untranslated region of mRNA encoded by KIAA1784, corresponding to a HOST TARGET binding site such as BINDING SITE I, BINDING SITE II or BINDING SITE III. Table 2 illustrates the complementarity of the nucleotide sequences of KIAA1784 BINDING SITE, designated SEQ ID:32486, to the nucleotide sequence of VGAM2434 RNA, herein designated VGAM RNA, also designated SEQ ID:5145.

Another function of VGAM2434 is therefore inhibition of KIAA1784 (Accession XM_036660). Accordingly, utilities of VGAM2434 include diagnosis, prevention and treatment of diseases and clinical conditions associated with KIAA1784. KIAA1829 (Accession XM_030378) is another VGAM2434 host target gene. KIAA1829 BINDING SITE is HOST TARGET binding site found in the 3' untranslated region of mRNA encoded by KIAA1829, corresponding to a HOST TARGET binding site such as BINDING SITE I, BINDING SITE II or BINDING SITE III. Table 2 illustrates the complementarity of the nucleotide sequences of KIAA1829 BINDING SITE, designated SEQ ID:31031, to the nucleotide sequence of VGAM2434 RNA, herein designated VGAM RNA, also designated SEQ ID:5145.

Another function of VGAM2434 is therefore inhibition of KIAA1829 (Accession XM_030378). Accordingly, utilities of VGAM2434 include diagnosis, prevention and treatment of diseases and clinical conditions associated with KIAA1829. KIAA1854 (Accession XM_049884) is another VGAM2434 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35537, to the nucleotide sequence of VGAM2434 RNA, herein designated VGAM RNA, also designated SEQ ID:5145.

Another function of VGAM2434 is therefore inhibition of KIAA1854 (Accession XM_049884). Accordingly, utilities of VGAM2434 include diagnosis, prevention and treatment of diseases and clinical conditions associated with KIAA1854. KIAA1922 (Accession XM_057040) is another VGAM2434 host target gene. KIAA1922 BINDING SITE is HOST TARGET binding site found in the 5' untranslated region of mRNA encoded by KIAA1922, corresponding to a HOST TARGET binding site such as BINDING SITE I, BINDING SITE II or BINDING SITE III. Table 2 illustrates the complementarity of the nucleotide sequences of KIAA1922 BINDING SITE, designated SEQ ID:36460, to the nucleotide sequence of VGAM2434 RNA, herein designated VGAM RNA, also designated SEQ ID:5145.

Another function of VGAM2434 is therefore inhibition of KIAA1922 (Accession XM_057040). Accordingly, utilities of VGAM2434 include diagnosis, prevention and treatment of diseases and clinical conditions associated with KIAA1922. KIAA1971 (Accession XM_058720) is another VGAM2434 host target gene. KIAA1971 BINDING SITE is HOST TARGET binding site found in the 3' untranslated region of mRNA encoded by KIAA1971, corresponding to a HOST TARGET binding site such as BINDING SITE I, BINDING SITE II or BINDING SITE III. Table 2 illustrates the complementarity of the nucleotide sequences of KIAA1971 BINDING SITE, designated SEQ ID:36731, to the nucleotide sequence of VGAM2434 RNA, herein designated VGAM RNA, also designated SEQ ID:5145.

Another function of VGAM2434 is therefore inhibition of KIAA1971 (Accession XM_058720). Accordingly, utilities of VGAM2434 include diagnosis, prevention and treatment of diseases and clinical conditions associated with KIAA1971. KIAA1987 (Accession XM_113870) is another VGAM2434 host target gene. KIAA1987 BINDING SITE is HOST TARGET binding site found in the 5' untranslated region of mRNA encoded by KIAA1987, corresponding to a HOST TARGET binding site such as BINDING SITE I, BINDING SITE II or BINDING SITE III. Table 2 illustrates the complementarity of the nucleotide sequences of KIAA1987 BINDING SITE, designated SEQ ID:42500, to the nucleotide sequence of VGAM2434 RNA, herein designated VGAM RNA, also designated SEQ ID:5145.

Another function of VGAM2434 is therefore inhibition of KIAA1987 (Accession XM_113870). Accordingly, utilities of VGAM2434 include diagnosis, prevention and treatment of diseases and clinical conditions associated with KIAA1987. Kallikrein 7 (chymotryptic, stratum corneum) (KLK7, Accession NM_139277) is another VGAM2434 host target gene. KLK7 BINDING SITE1 and KLK7 BINDING SITE2 are HOST TARGET binding sites found in untranslated regions of mRNA encoded by KLK7, corresponding to HOST TARGET binding sites such as BINDING SITE I, BINDING SITE II or BINDING SITE III. Table 2 illustrates the complementarity of the nucleotide sequences of KLK7 BINDING SITE1 and KLK7 BINDING SITE2, designated SEQ ID:29274 and SEQ ID:11477 respectively, to the nucleotide sequence of VGAM2434 RNA, herein designated VGAM RNA, also designated SEQ ID:5145.

Another function of VGAM2434 is therefore inhibition of Kallikrein 7 (chymotryptic, stratum corneum) (KLK7, Accession NM_139277). Accordingly, utilities of VGAM2434 include diagnosis, prevention and treatment of diseases and clinical conditions associated with KLK7. LIECG3 (Accession XM_113371) is another VGAM2434 host target gene. LIECG3 BINDING SITE is HOST TARGET binding site found in the 3' untranslated region of mRNA encoded by LIECG3, corresponding to a HOST TARGET binding site such as BINDING SITE I, BINDING SITE II or BINDING SITE III. Table 2 illustrates the complementarity of the nucleotide sequences of LIECG3 BINDING SITE, designated SEQ ID:42248, to the nucleotide sequence of VGAM2434 RNA, herein designated VGAM RNA, also designated SEQ ID:5145.

Another function of VGAM2434 is therefore inhibition of LIECG3 (Accession XM_113371). Accordingly, utilities of VGAM2434 include diagnosis, prevention and treatment of diseases and clinical conditions associated with LIECG3. Lymphocyte Antigen 75 (LY75, Accession NM_002349) is another VGAM2434 host target gene. LY75 BINDING SITE is HOST TARGET binding site found in the 3' untranslated region of mRNA encoded by LY75, corresponding to a HOST TARGET binding site such as BINDING SITE I, BINDING SITE II or BINDING SITE III. Table 2 illustrates the complementarity of the nucleotide sequences of LY75 BINDING SITE, designated SEQ ID:8151, to the nucleotide sequence of VGAM2434 RNA, herein designated VGAM RNA, also designated SEQ ID:5145.

Another function of VGAM2434 is therefore inhibition of Lymphocyte Antigen 75 (LY75, Accession NM_002349). Accordingly, utilities of VGAM2434 include diagnosis, prevention and treatment of diseases and clinical conditions associated with LY75. MCLC (Accession NM_015127) is another VGAM2434 host target gene. MCLC BINDING SITE is HOST TARGET binding site found in the 3' untranslated region of mRNA encoded by MCLC, corresponding to a HOST TARGET binding site such as BINDING SITE I, BINDING SITE II or BINDING SITE III. Table 2 illustrates the complementarity of the nucleotide sequences of MCLC BINDING SITE, designated SEQ ID:17493, to the nucleotide sequence of VGAM2434 RNA, herein designated VGAM RNA, also designated SEQ ID:5145.

Another function of VGAM2434 is therefore inhibition of MCLC (Accession NM_015127). Accordingly, utilities of VGAM2434 include diagnosis, prevention and treatment of diseases and clinical conditions associated with MCLC. MGC1842 (Accession XM_037797) is another VGAM2434 host target gene. MGC1842 BINDING SITE is HOST TARGET binding site found in the 3" untranslated region of mRNA encoded by MGC1842, corresponding to a HOST TARGET binding site such as BINDING SITE I, BINDING SITE II or BINDING SITE III. Table 2 illustrates the complementarity of the nucleotide sequences of MGC1842 BINDING SITE, designated SEQ ID:32689, to the nucleotide sequence of VGAM2434 RNA, herein designated VGAM RNA, also designated SEQ ID:5145.

Another function of VGAM2434 is therefore inhibition of MGC1842 (Accession XM_037797). Accordingly, utilities of VGAM2434 include diagnosis, prevention and treatment of diseases and clinical conditions associated with MGC1842. MGC4638 (Accession NM_031479) is another VGAM2434 host target gene. MGC4638 BINDING SITE is HOST TARGET binding site found in the 3' untranslated region of mRNA encoded by MGC4638, corresponding to a HOST TARGET binding site such as BINDING SITE I, BINDING SITE II or BINDING SITE III. Table 2 illustrates the complementarity of the nucleotide sequences of MGC4638 BINDING SITE, designated SEQ ID:25559, to the nucleotide sequence of VGAM2434 RNA, herein designated VGAM RNA, also designated SEQ ID:5145.

Another function of VGAM2434 is therefore inhibition of MGC4638 (Accession NM_031479). Accordingly, utilities of VGAM2434 include diagnosis, prevention and treatment of diseases and clinical conditions associated with MGC4638. MGC5149 (Accession XM_051200) is another VGAM2434 host target gene. MGC5149 BINDING SITE is HOST TARGET binding site found in the 3' untranslated region of mRNA encoded by MGC5149, corresponding to a HOST TARGET binding site such as BINDING SITE I, BINDING SITE II or BINDING SITE III. Table 2 illustrates the complementarity of the nucleotide sequences of MGC5149 BINDING SITE, designated SEQ ID:35783, to the nucleotide sequence of VGAM2434 RNA, herein designated VGAM RNA, also designated SEQ ID:5145.

Another function of VGAM2434 is therefore inhibition of MGC5149 (Accession XM_051200). Accordingly, utilities of VGAM2434 include diagnosis, prevention and treatment of diseases and clinical conditions associated with MGC5149. Melanoma-derived Leucine Zipper, Extra-nuclear Factor (MLZE, Accession NM_031415) is another VGAM2434 host target gene. MLZE BINDING SITE is HOST TARGET binding site found in the 5' untranslated region of mRNA encoded by MLZE, corresponding to a HOST TARGET binding site such as BINDING SITE I, BINDING SITE II or BINDING SITE III. Table 2 illustrates the complementarity of the nucleotide sequences of MLZE BINDING SITE, designated SEQ ID:25394, to the nucleotide sequence of VGAM2434 RNA, herein designated VGAM RNA, also designated SEQ ID:5145.

Another function of VGAM2434 is therefore inhibition of Melanoma-derived Leucine Zipper, Extra-nuclear Factor (MLZE, Accession NM_031415). Accordingly, utilities of VGAM2434 include diagnosis, prevention and treatment of diseases and clinical conditions associated with MLZE. Matrix Metalloproteinase-like 1 (MMPL1, Accession NM_004142) is another VGAM2434 host target gene.

MMPL1 BINDING SITE is HOST TARGET binding site found in the 3' untranslated region of mRNA encoded by MMPL1, corresponding to a HOST TARGET binding site such as BINDING SITE I, BINDING SITE II or BINDING SITE III. Table 2 illustrates the complementarity of the nucleotide sequences of MMPL1 BINDING SITE, designated SEQ ID:10349, to the nucleotide sequence of VGAM2434 RNA, herein designated VGAM RNA, also designated SEQ ID:5145.

Another function of VGAM2434 is therefore inhibition of Matrix Metalloproteinase-like 1 (MMPL1, Accession NM_004142). Accordingly, utilities of VGAM2434 include diagnosis, prevention and treatment of diseases and clinical conditions associated with MMPL1. Molybdenum Cofactor Synthesis 3 (MOCS3, Accession NM_014484) is another VGAM2434 host target gene. MOCS3 BINDING SITE is HOST TARGET binding site found in the 3' untranslated region of mRNA encoded by MOCS3, corresponding to a HOST TARGET binding site such as BINDING SITE I, BINDING SITE II or BINDING SITE III. Table 2 illustrates the complementarity of the nucleotide sequences of MOCS3 BINDING SITE, designated SEQ ID:15831, to the nucleotide sequence of VGAM2434 RNA, herein designated VGAM RNA, also designated SEQ ID:5145.

Another function of VGAM2434 is therefore inhibition of Molybdenum Cofactor Synthesis 3 (MOCS3, Accession NM_014484). Accordingly, utilities of VGAM2434 include diagnosis, prevention and treatment of diseases and clinical conditions associated with MOCS3. Mitochondrial Ribosomal Protein L44 (MRPL44, Accession NM_022915) is another VGAM2434 host target gene. MRPL44 BINDING SITE is HOST TARGET binding site found in the 3' untranslated region of mRNA encoded by MRPL44, corresponding to a HOST TARGET binding site such as BINDING SITE I, BINDING SITE II or BINDING SITE III. Table 2 illustrates the complementarity of the nucleotide sequences of MRPL44 BINDING SITE, designated SEQ ID:23227, to the nucleotide sequence of VGAM2434 RNA, herein designated VGAM RNA, also designated SEQ ID:5145.

Another function of VGAM2434 is therefore inhibition of Mitochondrial Ribosomal Protein L44 (MRPL44, Accession NM_022915). Accordingly, utilities of VGAM2434 include diagnosis, prevention and treatment of diseases and clinical conditions associated with MRPL44. Mitochondrial Ribosomal Protein S27 (MRPS27, Accession NM_015084) is another VGAM2434 host target gene. MRPS27 BINDING SITE is HOST TARGET binding site found in the 3' untranslated region of mRNA encoded by MRPS27, corresponding to a HOST TARGET binding site such as BINDING SITE I, BINDING SITE II or BINDING SITE III. Table 2 illustrates the complementarity of the nucleotide sequences of MRPS27 BINDING SITE, designated SEQ ID:17476, to the nucleotide sequence of VGAM2434 RNA, herein designated VGAM RNA, also designated SEQ ID:5145.

Another function of VGAM2434 is therefore inhibition of Mitochondrial Ribosomal Protein S27 (MRPS27, Accession NM_015084). Accordingly, utilities of VGAM2434 include diagnosis, prevention and treatment of diseases and clinical conditions associated with MRPS27. NDP52 (Accession NM_005831) is another VGAM2434 host target gene. NDP52 BINDING SITE is HOST TARGET binding site found in the 3' untranslated region of mRNA encoded by NDP52, corresponding to a HOST TARGET binding site such as BINDING SITE I, BINDING SITE II or BINDING SITE III. Table 2 illustrates the complementarity of the nucleotide sequences of NDP52 BINDING SITE, designated SEQ ID:12443, to the nucleotide sequence of VGAM2434 RNA, herein designated VGAM RNA, also designated SEQ ID:5145.

Another function of VGAM2434 is therefore inhibition of NDP52 (Accession NM_005831). Accordingly, utilities of VGAM2434 include diagnosis, prevention and treatment of diseases and clinical conditions associated with NDP52. NADH Dehydrogenase (ubiquinone) 1, Subcomplex Unknown, 2, 14.5 kDa (NDUFC2, Accession NM_004549) is another VGAM2434 host target gene. NDUFC2 BINDING SITE is HOST TARGET binding site found in the 3' untranslated region of mRNA encoded by NDUFC2, corresponding to a HOST TARGET binding site such as BINDING SITE I, BINDING SITE II or BINDING SITE III. Table 2 illustrates the complementarity of the nucleotide sequences of NDUFC2 BINDING SITE, designated SEQ ID:10895, to the nucleotide sequence of VGAM2434 RNA, herein designated VGAM RNA, also designated SEQ ID:5145.

Another function of VGAM2434 is therefore inhibition of NADH Dehydrogenase (ubiquinone) 1, Subcomplex Unknown, 2, 14.5 kDa (NDUFC2, Accession NM_004549). Accordingly, utilities of VGAM2434 include diagnosis, prevention and treatment of diseases and clinical conditions associated with NDUFC2. Ninjurin 2 (NINJ2, Accession NM_016533) is another VGAM2434 host target gene. NINJ2 BINDING SITE is HOST TARGET binding site found in the 3' untranslated region of mRNA encoded by NINJ2, corresponding to a HOST TARGET binding site such as BINDING SITE I, BINDING SITE II or BINDING SITE III. Table 2 illustrates the complementarity of the nucleotide sequences of NINJ2 BINDING SITE, designated SEQ ID:18605, to the nucleotide sequence of VGAM2434 RNA, herein designated VGAM RNA, also designated SEQ ID:5145.

Another function of VGAM2434 is therefore inhibition of Ninjurin 2 (NINJ2, Accession NM_016533). Accordingly, utilities of VGAM2434 include diagnosis, prevention and treatment of diseases and clinical conditions associated with NINJ2. Nup43 (Accession NM_024647) is another VGAM2434 host target gene. Nup43 BINDING SITE is HOST TARGET binding site found in the 3' untranslated region of mRNA encoded by Nup43, corresponding to a HOST TARGET binding site such as BINDING SITE I, BINDING SITE II or BINDING SITE III. Table 2 illustrates the complementarity of the nucleotide sequences of Nup43 BINDING SITE, designated SEQ ID:23936, to the nucleotide sequence of VGAM2434 RNA, herein designated VGAM RNA, also designated SEQ ID:5145.

Another function of VGAM2434 is therefore inhibition of Nup43 (Accession NM_024647). Accordingly, utilities of VGAM2434 include diagnosis, prevention and treatment of diseases and clinical conditions associated with Nup43. Oxysterol Binding Protein-like 2 (OSBPL2, Accession NM_014835) is another VGAM2434 host target gene. OSBPL2 BINDING SITE1 and OSBPL2 BINDING SITE2 are HOST TARGET binding sites found in untranslated regions of mRNA encoded by OSBPL2, corresponding to HOST TARGET binding sites such as BINDING SITE I, BINDING SITE II or BINDING SITE III. Table 2 illustrates the complementarity of the nucleotide sequences of OSBPL2 BINDING SITE1 and OSBPL2 BINDING SITE2, designated SEQ ID:16852 and SEQ ID:29320 respectively, to the nucleotide sequence of VGAM2434 RNA, herein designated VGAM RNA, also designated SEQ ID:5145.

Another function of VGAM2434 is therefore inhibition of Oxysterol Binding Protein-like 2 (OSBPL2, Accession NM_014835). Accordingly, utilities of VGAM2434 include diagnosis, prevention and treatment of diseases and clinical conditions associated with OSBPL2. PRO0365 (Accession NM_014126) is another VGAM2434 host target gene. PRO0365 BINDING SITE is HOST TARGET binding site found in the 5' untranslated region of mRNA encoded by PRO0365, corresponding to a HOST TARGET binding site such as BINDING SITE I, BINDING SITE II or BINDING SITE III. Table 2 illustrates the complementarity of the nucleotide sequences of PRO0365 BINDING SITE, designated SEQ ID:15386, to the nucleotide sequence of VGAM2434 RNA, herein designated VGAM RNA, also designated SEQ ID:5145.

Another function of VGAM2434 is therefore inhibition of PRO0365 (Accession NM_014126). Accordingly, utilities of VGAM2434 include diagnosis, prevention and treatment of diseases and clinical conditions associated with PRO0365. PRO1992 (Accession NM_014107) is another VGAM2434 host target gene. PRO1992 BINDING SITE is HOST TARGET binding site found in the 5' untranslated region of mRNA encoded by PRO1992, corresponding to a HOST TARGET binding site such as BINDING SITE I, BINDING SITE II or BINDING SITE III. Table 2 illustrates the complementarity of the nucleotide sequences of PRO1992 BINDING SITE, designated SEQ ID:15333, to the nucleotide sequence of VGAM2434 RNA, herein designated VGAM RNA, also designated SEQ ID:5145.

Another function of VGAM2434 is therefore inhibition of PRO1992 (Accession NM_014107). Accordingly, utilities of VGAM2434 include diagnosis, prevention and treatment of diseases and clinical conditions associated with PRO1992. PRO2955 (Accession NM_018545) is another VGAM2434 host target gene. PRO2955 BINDING SITE is HOST TARGET binding site found in the 3' untranslated region of mRNA encoded by PRO2955, corresponding to a HOST TARGET binding site such as BINDING SITE I, BINDING SITE II or BINDING SITE III. Table 2 illustrates the complementarity of the nucleotide sequences of PRO2955 BINDING SITE, designated SEQ ID:20621, to the nucleotide sequence of VGAM2434 RNA, herein designated VGAM RNA, also designated SEQ ID:5145.

Another function of VGAM2434 is therefore inhibition of PRO2955 (Accession NM_018545). Accordingly, utilities of VGAM2434 include diagnosis, prevention and treatment of diseases and clinical conditions associated with PRO2955. Proline-serine-threonine Phosphatase Interacting Protein 2 (PSTPIP2, Accession NM_024430) is another VGAM2434 host target gene. PSTPIP2 BINDING SITE is HOST TARGET binding site found in the 3' untranslated region of mRNA encoded by PSTPIP2, corresponding to a HOST TARGET binding site such as BINDING SITE I, BINDING SITE II or BINDING SITE III. Table 2 illustrates the complementarity of the nucleotide sequences of PSTPIP2 BINDING SITE, designated SEQ ID:23680, to the nucleotide sequence of VGAM2434 RNA, herein designated VGAM RNA, also designated SEQ ID:5145.

Another function of VGAM2434 is therefore inhibition of Proline-serine-threonine Phosphatase Interacting Protein 2 (PSTPIP2, Accession NM_024430). Accordingly, utilities of VGAM2434 include diagnosis, prevention and treatment of diseases and clinical conditions associated with PSTPIP2. RAB33B, Member RAS Oncogene Family (RAB33B, Accession NM_031296) is another VGAM2434 host target gene. RAB33B BINDING SITE is HOST TARGET binding site found in the 3' untranslated region of mRNA encoded by RAB33B, corresponding to a HOST TARGET binding site such as BINDING SITE I, BINDING SITE II or BINDING SITE III. Table 2 illustrates the complementarity of the nucleotide sequences of RAB33B BINDING SITE, designated SEQ ID:25331, to the nucleotide sequence of VGAM2434 RNA, herein designated VGAM RNA, also designated SEQ ID:5145.

Another function of VGAM2434 is therefore inhibition of RAB33B, Member RAS Oncogene Family (RAB33B, Accession NM_031296). Accordingly, utilities of VGAM2434 include diagnosis, prevention and treatment of diseases and clinical conditions associated with RAB33B. RAI (Accession NM_006663) is another VGAM2434 host target gene. RAI BINDING SITE is HOST TARGET binding site found in the 5' untranslated region of mRNA encoded by RAI, corresponding to a HOST TARGET binding site such as BINDING SITE I, BINDING SITE II or BINDING SITE III. Table 2 illustrates the complementarity of the nucleotide sequences of RAI BINDING SITE, designated SEQ ID:13472, to the nucleotide sequence of VGAM2434 RNA, herein designated VGAM RNA, also designated SEQ ID:5145.

Another function of VGAM2434 is therefore inhibition of RAI (Accession NM_006663). Accordingly, utilities of VGAM2434 include diagnosis, prevention and treatment of diseases and clinical conditions associated with RAI. RES4-25 (Accession XM_035572) is another VGAM2434 host target gene. RES4-25 BINDING SITE is HOST TARGET binding site found in the 3' untranslated region of mRNA encoded by RES4-25, corresponding to a HOST TARGET binding site such as BINDING SITE I, BINDING SITE II or BINDING SITE III. Table 2 illustrates the complementarity of the nucleotide sequences of RES4-25 BINDING SITE, designated SEQ ID:32287, to the nucleotide sequence of VGAM2434 RNA, herein designated VGAM RNA, also designated SEQ ID:5145.

Another function of VGAM2434 is therefore inhibition of RES4-25 (Accession XM_035572). Accordingly, utilities of VGAM2434 include diagnosis, prevention and treatment of diseases and clinical conditions associated with RES4-25. SEC24 Related Gene Family, Member A (S. cerevisiae) (SEC24A, Accession XM_094581) is another VGAM2434 host target gene. SEC24A BINDING SITE is HOST TARGET binding site found in the 3' untranslated region of mRNA encoded by SEC24A, corresponding to a HOST TARGET binding site such as BINDING SITE I, BINDING SITE II or BINDING SITE III. Table 2 illustrates the complementarity of the nucleotide sequences of SEC24A BINDING SITE, designated SEQ ID:40235, to the nucleotide sequence of VGAM2434 RNA, herein designated VGAM RNA, also designated SEQ ID:5145.

Another function of VGAM2434 is therefore inhibition of SEC24 Related Gene Family, Member A (S. cerevisiae) (SEC24A, Accession XM_094581). Accordingly, utilities of VGAM2434 include diagnosis, prevention and treatment of diseases and clinical conditions associated with SEC24A. Small EDRK-rich Factor 1B (centromeric) (SERF1B, Accession NM_022978) is another VGAM2434 host target gene. SERF1B BINDING SITE1 and SERF1B BINDING SITE2 are HOST TARGET binding sites found in untranslated regions of mRNA encoded by SERF1B, corresponding to HOST TARGET binding sites such as BINDING SITE I, BINDING SITE II or BINDING SITE III. Table 2 illustrates the complementarity of the nucleotide sequences of SERF1B BINDING SITE1 and SERF1B BINDING SITE2, designated SEQ ID:23258 and SEQ ID:23259 respectively, to the nucleotide sequence of VGAM2434 RNA, herein designated VGAM RNA, also designated SEQ ID:5145.

Another function of VGAM2434 is therefore inhibition of Small EDRK-rich Factor 1B (centromeric) (SERF1B, Accession NM_022978). Accordingly, utilities of VGAM2434 include diagnosis, prevention and treatment of diseases and clinical conditions associated with SERF1B. STAF65 (gamma) (Accession NM_014860) is another VGAM2434 host target gene. STAF65(gamma) BINDING SITE is HOST TARGET binding site found in the 3' untranslated region of mRNA encoded by STAF65(gamma), corresponding to a HOST TARGET binding site such as BINDING SITE I, BINDING SITE II or BINDING SITE III. Table 2 illustrates the complementarity of the nucleotide sequences of STAF65 (gamma) BINDING SITE, designated SEQ ID:16923, to the nucleotide sequence of VGAM2434 RNA, herein designated VGAM RNA, also designated SEQ ID:5145.

Another function of VGAM2434 is therefore inhibition of STAF65(gamma) (Accession NM_014860). Accordingly, utilities of VGAM2434 include diagnosis, prevention and treatment of diseases and clinical conditions associated with STAF65(gamma). Tripartite Motif-containing 6 (TRIM6, Accession NM_058166) is another VGAM2434 host target gene. TRIM6 BINDING SITE is HOST TARGET binding site found in the 3' untranslated region of mRNA encoded by TRIM6, corresponding to a HOST TARGET binding site such as BINDING SITE I, BINDING SITE II or BINDING SITE III. Table 2 illustrates the complementarity of the nucleotide sequences of TRIM6 BINDING SITE, designated SEQ ID:27712, to the nucleotide sequence of VGAM2434 RNA, herein designated VGAM RNA, also designated SEQ ID:5145.

Another function of VGAM2434 is therefore inhibition of Tripartite Motif-containing 6 (TRIM6, Accession NM_058166). Accordingly, utilities of VGAM2434 include diagnosis, prevention and treatment of diseases and clinical conditions associated with TRIM6. TU12B1-TY (Accession NM_016575) is another VGAM2434 host target gene. TU12B1-TY BINDING SITE1 through TU12B1-TY BINDING SITE3 are HOST TARGET binding sites found in untranslated regions of mRNA encoded by TU12B1-TY, corresponding to HOST TARGET binding sites such as BINDING SITE I, BINDING SITE II or BINDING SITE III. Table 2 illustrates the complementarity of the nucleotide sequences of TU12B1-TY BINDING SITE1 through TU12B1-TY BINDING SITE3, designated SEQ ID:18646, SEQ ID:18647 and SEQ ID:18651 respectively, to the nucleotide sequence of VGAM2434 RNA, herein designated VGAM RNA, also designated SEQ ID:5145.

Another function of VGAM2434 is therefore inhibition of TU12B1-TY (Accession NM_016575). Accordingly, utilities of VGAM2434 include diagnosis, prevention and treatment of diseases and clinical conditions associated with TU12B1-TY. VDU1 (Accession NM_015017) is another VGAM2434 host target gene. VDU1 BINDING SITE is HOST TARGET binding site found in the 3' untranslated region of mRNA encoded by VDU1, corresponding to a HOST TARGET binding site such as BINDING SITE I, BINDING SITE II or BINDING SITE III. Table 2 illustrates the complementarity of the nucleotide sequences of VDU1 BINDING SITE, designated SEQ ID:17382, to the nucleotide sequence of VGAM2434 RNA, herein designated VGAM RNA, also designated SEQ ID:5145.

Another function of VGAM2434 is therefore inhibition of VDU1 (Accession NM_015017). Accordingly, utilities of VGAM2434 include diagnosis, prevention and treatment of diseases and clinical conditions associated with VDU1. Vacuolar Protein Sorting 33A (yeast) (VPS33A, Accession NM_022916) is another VGAM2434 host target gene. VPS33A BINDING SITE is HOST TARGET binding site found in the 3' untranslated region of mRNA encoded by VPS33A, corresponding to a HOST TARGET binding site such as BINDING SITE I, BINDING SITE II or BINDING SITE III. Table 2 illustrates the complementarity of the nucleotide sequences of VPS33A BINDING SITE, designated SEQ ID:23232, to the nucleotide sequence of VGAM2434 RNA, herein designated VGAM RNA, also designated SEQ ID:5145.

Another function of VGAM2434 is therefore inhibition of Vacuolar Protein Sorting 33A (yeast) (VPS33A, Accession NM_022916). Accordingly, utilities of VGAM2434 include diagnosis, prevention and treatment of diseases and clinical conditions associated with VPS33A. Williams Beuren Syndrome Chromosome Region 20A (WBSCR20A, Accession NM_032158) is another VGAM2434 host target gene. WBSCR20A BINDING SITE is HOST TARGET binding site found in the 5' untranslated region of mRNA encoded by WBSCR20A, corresponding to a HOST TARGET binding site such as BINDING SITE I, BINDING SITE II or BINDING SITE III. Table 2 illustrates the complementarity of the nucleotide sequences of WBSCR20A BINDING SITE, designated SEQ ID:25859, to the nucleotide sequence of VGAM2434 RNA, herein designated VGAM RNA, also designated SEQ ID:5145.

Another function of VGAM2434 is therefore inhibition of Williams Beuren Syndrome Chromosome Region 20A (WBSCR20A, Accession NM_032158). Accordingly, utilities of VGAM2434 include diagnosis, prevention and treatment of diseases and clinical conditions associated with WBSCR20A. Williams-Beuren Syndrome Chromosome Region 23 (WBSCR23, Accession NM_025042) is another VGAM2434 host target gene. WBSCR23 BINDING SITE is HOST TARGET binding site found in the 3' untranslated region of mRNA encoded by WBSCR23, corresponding to a HOST TARGET binding site such as BINDING SITE I, BINDING SITE II or BINDING SITE III. Table 2 illustrates the complementarity of the nucleotide sequences of WBSCR23 BINDING SITE, designated SEQ ID:24641, to the nucleotide sequence of VGAM2434 RNA, herein designated VGAM RNA, also designated SEQ ID:5145.

Another function of VGAM2434 is therefore inhibition of Williams-Beuren Syndrome Chromosome Region 23 (WBSCR23, Accession NM_025042). Accordingly, utilities of VGAM2434 include diagnosis, prevention and treatment of diseases and clinical conditions associated with WBSCR23. Zinc Finger Protein 185 (LIM domain) (ZNF185, Accession NM_007150) is another VGAM2434 host target gene. ZNF185 BINDING SITE is HOST TARGET binding site found in the 3' untranslated region of mRNA encoded by ZNF185, corresponding to a HOST TARGET binding site such as BINDING SITE I, BINDING SITE II or BINDING SITE III. Table 2 illustrates the complementarity of the nucleotide sequences of ZNF185 BINDING SITE, designated SEQ ID:14004, to the nucleotide sequence of VGAM2434 RNA, herein designated VGAM RNA, also designated SEQ ID:5145.

Another function of VGAM2434 is therefore inhibition of Zinc Finger Protein 185 (LIM domain) (ZNF185, Accession NM_007150). Accordingly, utilities of VGAM2434 include diagnosis, prevention and treatment of diseases and clinical conditions associated with ZNF185. Zinc Finger Protein 338 (ZNF338, Accession NM_022088) is another VGAM2434 host target gene. ZNF338 BINDING SITE is HOST TARGET binding site found in the 3' untranslated region of mRNA encoded by ZNF338, corresponding to a HOST TARGET binding site such as BINDING SITE I, BINDING SITE II or BINDING SITE III. Table 2 illustrates the complementarity of the nucleotide sequences of ZNF338 BINDING SITE, designated SEQ ID:22633, to the nucleotide sequence of VGAM2434 RNA, herein designated VGAM RNA, also designated SEQ ID:5145.

Another function of VGAM2434 is therefore inhibition of Zinc Finger Protein 338 (ZNF338, Accession NM_022088). Accordingly, utilities of VGAM2434 include diagnosis, prevention and treatment of diseases and clinical conditions associated with ZNF338. ZTL1 (Accession NM_024055) is another VGAM2434 host target gene. ZTL1 BINDING SITE is HOST TARGET binding site found in the 3' untranslated region of mRNA encoded by ZTL1, corresponding to a HOST TARGET binding site such as BINDING SITE I, BINDING SITE II or BINDING SITE III. Table 2 illustrates the complementarity of the nucleotide sequences of ZTL1 BINDING SITE, designated SEQ ID:23491, to the nucleotide sequence of VGAM2434 RNA, herein designated VGAM RNA, also designated SEQ ID:5145.

Another function of VGAM2434 is therefore inhibition of ZTL1 (Accession NM_024055). Accordingly, utilities of VGAM2434 include diagnosis, prevention and treatment of diseases and clinical conditions associated with ZTL1. LOC112817 (Accession NM_138413) is another VGAM2434 host target gene. LOC112817 BINDING SITE is HOST TARGET binding site found in the 3' untranslated region of mRNA encoded by LOC112817, corresponding to a HOST TARGET binding site such as BINDING SITE I, BINDING SITE II or BINDING SITE III. Table 2 illustrates the complementarity of the nucleotide sequences of LOC112817 BINDING SITE, designated SEQ ID:28782, to the nucleotide sequence of VGAM2434 RNA, herein designated VGAM RNA, also designated SEQ ID:5145.

Another function of VGAM2434 is therefore inhibition of LOC112817 (Accession NM_138413). Accordingly, utilities of VGAM2434 include diagnosis, prevention and treatment of diseases and clinical conditions associated with LOC112817. LOC113675 (Accession NM_138432) is another VGAM2434 host target gene. LOC113675 BINDING SITE is HOST TARGET binding site found in the 5' untranslated region of mRNA encoded by LOC113675, corresponding to a HOST TARGET binding site such as BINDING SITE I, BINDING SITE II or BINDING SITE III. Table 2 illustrates the complementarity of the nucleotide sequences of LOC113675 BINDING SITE, designated SEQ ID:28797, to the nucleotide sequence of VGAM2434 RNA, herein designated VGAM RNA, also designated SEQ ID:5145.

Another function of VGAM2434 is therefore inhibition of LOC113675 (Accession NM_138432). Accordingly, utilities of VGAM2434 include diagnosis, prevention and treatment of diseases and clinical conditions associated with LOC113675. LOC115219 (Accession XM_055499) is another VGAM2434 host target gene. LOC115219 BINDING SITE is HOST TARGET binding site found in the 5' untranslated region of mRNA encoded by LOC115219, corresponding to a HOST TARGET binding site such as BINDING SITE I, BINDING SITE II or BINDING SITE III. Table 2 illustrates the complementarity of the nucleotide sequences of LOC115219 BINDING SITE, designated SEQ ID:36282, to the nucleotide sequence of VGAM2434 RNA, herein designated VGAM RNA, also designated SEQ ID:5145.

Another function of VGAM2434 is therefore inhibition of LOC115219 (Accession XM_055499). Accordingly, utilities of VGAM2434 include diagnosis, prevention and treatment of diseases and clinical conditions associated with LOC115219. LOC120114 (Accession XM_061871) is another VGAM2434 host target gene. LOC120114 BINDING SITE is HOST TARGET binding site found in the 3' untranslated region of mRNA encoded by LOC120114, corresponding to a HOST TARGET binding site such as BINDING SITE I, BINDING SITE II or BINDING SITE III. Table 2 illustrates the complementarity of the nucleotide sequences of LOC120114 BINDING SITE, designated SEQ ID:37213, to the nucleotide sequence of VGAM2434 RNA, herein designated VGAM RNA, also designated SEQ ID:5145.

Another function of VGAM2434 is therefore inhibition of LOC120114 (Accession XM_061871). Accordingly, utilities of VGAM2434 include diagnosis, prevention and treatment of diseases and clinical conditions associated with LOC120114. LOC126364 (Accession XM_065047) is another VGAM2434 host target gene. LOC126364 BINDING SITE is HOST TARGET binding site found in the 3' untranslated region of mRNA encoded by LOC126364, corresponding to a HOST TARGET binding site such as BINDING SITE I, BINDING SITE II or BINDING SITE III. Table 2 illustrates the complementarity of the nucleotide sequences of LOC126364 BINDING SITE, designated SEQ ID:37273, to the nucleotide sequence of VGAM2434 RNA, herein designated VGAM RNA, also designated SEQ ID:5145.

Another function of VGAM2434 is therefore inhibition of LOC126364 (Accession XM_065047). Accordingly, utilities of VGAM2434 include diagnosis, prevention and treatment of diseases and clinical conditions associated with LOC126364. LOC126661 (Accession XM_059061) is another VGAM2434 host target gene. LOC126661 BINDING SITE is HOST TARGET binding site found in the 3' untranslated region of mRNA encoded by LOC126661, corresponding to a HOST TARGET binding site such as BINDING SITE I, BINDING SITE II or BINDING SITE III. Table 2 illustrates the complementarity of the nucleotide sequences of LOC126661 BINDING SITE, designated SEQ ID:36856, to the nucleotide sequence of VGAM2434 RNA, herein designated VGAM RNA, also designated SEQ ID:5145.

Another function of VGAM2434 is therefore inhibition of LOC126661 (Accession XM_059061). Accordingly, utilities of VGAM2434 include diagnosis, prevention and treatment of diseases and clinical conditions associated with LOC126661. LOC126669 (Accession XM_060121) is another VGAM2434 host target gene. LOC126669 BINDING SITE is HOST TARGET binding site found in the 3' untranslated region of mRNA encoded by LOC126669, corresponding to a HOST TARGET binding site such as BINDING SITE I, BINDING SITE II or BINDING SITE III. Table 2 illustrates the complementarity of the nucleotide sequences of LOC126669 BINDING SITE, designated SEQ ID:37157, to the nucleotide sequence of VGAM2434 RNA, herein designated VGAM RNA, also designated SEQ ID:5145.

Another function of VGAM2434 is therefore inhibition of LOC126669 (Accession XM_060121). Accordingly, utilities of VGAM2434 include diagnosis, prevention and treatment of diseases and clinical conditions associated with LOC126669. LOC132625 (Accession XM_067946) is another VGAM2434 host target gene. LOC132625 BINDING SITE is HOST TARGET binding site found in the 3' untranslated region of mRNA encoded by LOC132625, corresponding to a HOST TARGET binding site such as BINDING SITE I, BINDING SITE II or BINDING SITE III. Table 2 illustrates the complementarity of the nucleotide sequences of LOC132625 BINDING SITE, designated SEQ ID:37374, to the nucleotide sequence of VGAM2434 RNA, herein designated VGAM RNA, also designated SEQ ID:5145.

Another function of VGAM2434 is therefore inhibition of LOC132625 (Accession XM_067946). Accordingly, utilities of VGAM2434 include diagnosis, prevention and treatment of diseases and clinical conditions associated with LOC132625. LOC133686 (Accession XM_059667) is another VGAM2434 host target gene. LOC133686 BIND- ING SITE is HOST TARGET binding site found in the 3' untranslated region of mRNA encoded by LOC133686, corresponding to a HOST TARGET binding site such as BINDING SITE I, BINDING SITE II or BINDING SITE III. Table 2 illustrates the complementarity of the nucleotide sequences of LOC133686 BINDING SITE, designated SEQ ID:37054, to the nucleotide sequence of VGAM2434 RNA, herein designated VGAM RNA, also designated SEQ ID:5145.

Another function of VGAM2434 is therefore inhibition of LOC133686 (Accession XM_059667). Accordingly, utilities of VGAM2434 include diagnosis, prevention and treatment of diseases and clinical conditions associated with LOC133686. LOC135293 (Accession XM_072402) is another VGAM2434 host target gene. LOC135293 BINDING SITE is HOST TARGET binding site found in the 3' untranslated region of mRNA encoded by LOC135293, corresponding to a HOST TARGET binding site such as BINDING SITE I, BINDING SITE II or BINDING SITE III. Table 2 illustrates the complementarity of the nucleotide sequences of LOC135293 BINDING SITE, designated SEQ ID:37492, to the nucleotide sequence of VGAM2434 RNA, herein designated VGAM RNA, also designated SEQ ID:5145.

Another function of VGAM2434 is therefore inhibition of LOC135293 (Accession XM_072402). Accordingly, utilities of VGAM2434 include diagnosis, prevention and treatment of diseases and clinical conditions associated with LOC135293. LOC135763 (Accession NM_138572) is another VGAM2434 host target gene. LOC135763 BINDING SITE is HOST TARGET binding site found in the 3' untranslated region of mRNA encoded by LOC135763, corresponding to a HOST TARGET binding site such as BINDING SITE I, BINDING SITE II or BINDING SITE III. Table 2 illustrates the complementarity of the nucleotide sequences of LOC135763 BINDING SITE, designated SEQ ID:28884, to the nucleotide sequence of VGAM2434 RNA, herein designated VGAM RNA, also designated SEQ ID:5145.

Another function of VGAM2434 is therefore inhibition of LOC135763 (Accession NM_138572). Accordingly, utilities of VGAM2434 include diagnosis, prevention and treatment of diseases and clinical conditions associated with LOC135763. LOC135818 (Accession XM_059804) is another VGAM2434 host target gene. LOC135818 BINDING SITE is HOST TARGET binding site found in the 3' untranslated region of mRNA encoded by LOC135818, corresponding to a HOST TARGET binding site such as BINDING SITE I, BINDING SITE II or BINDING SITE III. Table 2 illustrates the complementarity of the nucleotide sequences of LOC135818 BINDING SITE, designated SEQ ID:37095, to the nucleotide sequence of VGAM2434 RNA, herein designated VGAM RNA, also designated SEQ ID:5145.

Another function of VGAM2434 is therefore inhibition of LOC135818 (Accession XM_059804). Accordingly, utilities of VGAM2434 include diagnosis, prevention and treatment of diseases and clinical conditions associated with LOC135818. LOC143241 (Accession NM_138812) is another VGAM2434 host target gene. LOC143241 BINDING SITE is HOST TARGET binding site found in the 5' untranslated region of mRNA encoded by LOC143241, corresponding to a HOST TARGET binding site such as BINDING SITE I, BINDING SITE II or BINDING SITE III. Table 2 illustrates the complementarity of the nucleotide sequences of LOC143241 BINDING SITE, designated SEQ ID:29035, to the nucleotide sequence of VGAM2434 RNA, herein designated VGAM RNA, also designated SEQ ID:5145.

Another function of VGAM2434 is therefore inhibition of LOC143241 (Accession NM_138812). Accordingly, utilities of VGAM2434 include diagnosis, prevention and treatment of diseases and clinical conditions associated with LOC143241. LOC145757 (Accession XM_085227) is another VGAM2434 host target gene. LOC145757 BINDING SITE is HOST TARGET binding site found in the 5' untranslated region of mRNA encoded by LOC145757, corresponding to a HOST TARGET binding site such as BINDING SITE I, BINDING SITE II or BINDING SITE III. Table 2 illustrates the complementarity of the nucleotide sequences of LOC145757 BINDING SITE, designated SEQ ID:37973, to the nucleotide sequence of VGAM2434 RNA, herein designated VGAM RNA, also designated SEQ ID:5145.

Another function of VGAM2434 is therefore inhibition of LOC145757 (Accession XM_085227). Accordingly, utilities of VGAM2434 include diagnosis, prevention and treatment of diseases and clinical conditions associated with LOC145757. LOC146229 (Accession XM_085387) is another VGAM2434 host target gene. LOC146229 BINDING SITE is HOST TARGET binding site found in the 3' untranslated region of mRNA encoded by LOC146229, corresponding to a HOST TARGET binding site such as BINDING SITE I, BINDING SITE II or BINDING SITE III. Table 2 illustrates the complementarity of the nucleotide sequences of LOC146229 BINDING SITE, designated SEQ ID:38116, to the nucleotide sequence of VGAM2434 RNA, herein designated VGAM RNA, also designated SEQ ID:5145.

Another function of VGAM2434 is therefore inhibition of LOC146229 (Accession XM_085387). Accordingly, utilities of VGAM2434 include diagnosis, prevention and treatment of diseases and clinical conditions associated with LOC146229. LOC146336 (Accession XM_085421) is another VGAM2434 host target gene. LOC146336 BINDING SITE is HOST TARGET binding site found in the 3' untranslated region of mRNA encoded by LOC146336, corresponding to a HOST TARGET binding site such as BINDING SITE I, BINDING SITE II or BINDING SITE III. Table 2 illustrates the complementarity of the nucleotide sequences of LOC146336 BINDING SITE, designated SEQ ID:38133, to the nucleotide sequence of VGAM2434 RNA, herein designated VGAM RNA, also designated SEQ ID:5145.

Another function of VGAM2434 is therefore inhibition of LOC146336 (Accession XM_085421). Accordingly, utilities of VGAM2434 include diagnosis, prevention and treatment of diseases and clinical conditions associated with LOC146336. LOC146346 (Accession XM_085430) is another VGAM2434 host target gene. LOC146346 BINDING SITE is HOST TARGET binding site found in the 5' untranslated region of mRNA encoded by LOC146346, corresponding to a HOST TARGET binding site such as BINDING SITE I, BINDING SITE II or BINDING SITE III. Table 2 illustrates the complementarity of the nucleotide sequences of LOC146346 BINDING SITE, designated SEQ ID:38136, to the nucleotide sequence of VGAM2434 RNA, herein designated VGAM RNA, also designated SEQ ID:5145.

Another function of VGAM2434 is therefore inhibition of LOC146346 (Accession XM_085430). Accordingly, utilities of VGAM2434 include diagnosis, prevention and treatment of diseases and clinical conditions associated with LOC146346. LOC146455 (Accession XM_085471) is another VGAM2434 host target gene. LOC146455 BINDING SITE is HOST TARGET binding site found in the 3' untranslated region of mRNA encoded by LOC146455, corresponding to a HOST TARGET binding site such as BINDING SITE I, BINDING SITE II or BINDING SITE III. Table 2 illustrates the complementarity of the nucleotide sequences of LOC146455 BINDING SITE, designated SEQ ID:38159, to the nucleotide sequence of VGAM2434 RNA, herein designated VGAM RNA, also designated SEQ ID:5145.

Another function of VGAM2434 is therefore inhibition of LOC146455 (Accession XM_085471). Accordingly, utilities of VGAM2434 include diagnosis, prevention and treatment of diseases and clinical conditions associated with LOC146455. LOC146784 (Accession XM_085588) is another VGAM2434 host target gene. LOC146784 BINDING SITE is HOST TARGET binding site found in the 5' untranslated region of mRNA encoded by LOC146784, corresponding to a HOST TARGET binding site such as BINDING SITE I, BINDING SITE II or BINDING SITE III. Table 2 illustrates the complementarity of the nucleotide sequences of LOC146784 BINDING SITE, designated SEQ ID:38240, to the nucleotide sequence of VGAM2434 RNA, herein designated VGAM RNA, also designated SEQ ID:5145.

Another function of VGAM2434 is therefore inhibition of LOC146784 (Accession XM_085588). Accordingly, utilities of VGAM2434 include diagnosis, prevention and treatment of diseases and clinical conditions associated with LOC146784. LOC146895 (Accession XM_097120) is another VGAM2434 host target gene. LOC146895 BINDING SITE is HOST TARGET binding site found in the 5' untranslated region of mRNA encoded by LOC146895, corresponding to a HOST TARGET binding site such as BINDING SITE I, BINDING SITE II or BINDING SITE III. Table 2 illustrates the complementarity of the nucleotide sequences of LOC146895 BINDING SITE, designated SEQ ID:40760, to the nucleotide sequence of VGAM2434 RNA, herein designated VGAM RNA, also designated SEQ ID:5145.

Another function of VGAM2434 is therefore inhibition of LOC146895 (Accession XM_097120). Accordingly, utilities of VGAM2434 include diagnosis, prevention and treatment of diseases and clinical conditions associated with LOC146895. LOC146909 (Accession XM_085634) is another VGAM2434 host target gene. LOC146909 BINDING SITE is HOST TARGET binding site found in the 3' untranslated region of mRNA encoded by LOC146909, corresponding to a HOST TARGET binding site such as BINDING SITE I, BINDING SITE II or BINDING SITE III. Table 2 illustrates the complementarity of the nucleotide sequences of LOC146909 BINDING SITE, designated SEQ ID:38268, to the nucleotide sequence of VGAM2434 RNA, herein designated VGAM RNA, also designated SEQ ID:5145.

Another function of VGAM2434 is therefore inhibition of LOC146909 (Accession XM_085634). Accordingly, utilities of VGAM2434 include diagnosis, prevention and treatment of diseases and clinical conditions associated with LOC146909. LOC146952 (Accession XM_097138) is another VGAM2434 host target gene. LOC146952 BINDING SITE is HOST TARGET binding site found in the 5' untranslated region of mRNA encoded by LOC146952, corresponding to a HOST TARGET binding site such as BINDING SITE I, BINDING SITE II or BINDING SITE III. Table 2 illustrates the complementarity of the nucleotide sequences of LOC146952 BINDING SITE, designated SEQ ID:40769, to the nucleotide sequence of VGAM2434 RNA, herein designated VGAM RNA, also designated SEQ ID:5145.

Another function of VGAM2434 is therefore inhibition of LOC146952 (Accession XM_097138). Accordingly, utilities of VGAM2434 include diagnosis, prevention and treatment of diseases and clinical conditions associated with LOC146952. LOC147071 (Accession XM_054031) is another VGAM2434 host target gene. LOC147071 BINDING SITE is HOST TARGET binding site found in the 5' untranslated region of mRNA encoded by LOC147071, corresponding to a HOST TARGET binding site such as BINDING SITE I, BINDING SITE II or BINDING SITE III. Table 2 illustrates the complementarity of the nucleotide sequences of LOC147071 BINDING SITE, designated SEQ ID:36135, to the nucleotide sequence of VGAM2434 RNA, herein designated VGAM RNA, also designated SEQ ID:5145.

Another function of VGAM2434 is therefore inhibition of LOC147071 (Accession XM_054031). Accordingly, utilities of VGAM2434 include diagnosis, prevention and treatment of diseases and clinical conditions associated with LOC147071. LOC147093 (Accession XM_097184) is another VGAM2434 host target gene. LOC147093 BINDING SITE is HOST TARGET binding site found in the 3' untranslated region of mRNA encoded by LOC147093, corresponding to a HOST TARGET binding site such as BINDING SITE I, BINDING SITE II or BINDING SITE III. Table 2 illustrates the complementarity of the nucleotide sequences of LOC147093 BINDING SITE, designated SEQ ID:40806, to the nucleotide sequence of VGAM2434 RNA, herein designated VGAM RNA, also designated SEQ ID:5145.

Another function of VGAM2434 is therefore inhibition of LOC147093 (Accession XM_097184). Accordingly, utilities of VGAM2434 include diagnosis, prevention and treatment of diseases and clinical conditions associated with LOC147093. LOC147429 (Accession XM_085793) is another VGAM2434 host target gene. LOC147429 BINDING SITE is HOST TARGET binding site found in the 5' untranslated region of mRNA encoded by LOC147429, corresponding to a HOST TARGET binding site such as BINDING SITE I, BINDING SITE II or BINDING SITE III. Table 2 illustrates the complementarity of the nucleotide sequences of LOC147429 BINDING SITE, designated SEQ ID:38338, to the nucleotide sequence of VGAM2434 RNA, herein designated VGAM RNA, also designated SEQ ID:5145.

Another function of VGAM2434 is therefore inhibition of LOC147429 (Accession XM_085793). Accordingly, utilities of VGAM2434 include diagnosis, prevention and treatment of diseases and clinical conditions associated with LOC147429. LOC147660 (Accession XM_085825) is another VGAM2434 host target gene. LOC147660 BINDING SITE is HOST TARGET binding site found in the 3' untranslated region of mRNA encoded by LOC147660, corresponding to a HOST TARGET binding site such as BINDING SITE I, BINDING SITE II or BINDING SITE III. Table 2 illustrates the complementarity of the nucleotide sequences of LOC147660 BINDING SITE, designated SEQ ID:38350, to the nucleotide sequence of VGAM2434 RNA, herein designated VGAM RNA, also designated SEQ ID:5145.

Another function of VGAM2434 is therefore inhibition of LOC147660 (Accession XM_085825). Accordingly, utilities of VGAM2434 include diagnosis, prevention and treatment of diseases and clinical conditions associated with LOC147660. LOC147817 (Accession XM_085903) is another VGAM2434 host target gene. LOC147817 BINDING SITE is HOST TARGET binding site found in the 3' untranslated region of mRNA encoded by LOC147817, corresponding to a HOST TARGET binding site such as BINDING SITE I, BINDING SITE II or BINDING SITE III. Table 2 illustrates the complementarity of the nucleotide sequences of LOC147817 BINDING SITE, designated SEQ ID:38389, to the nucleotide sequence of VGAM2434 RNA, herein designated VGAM RNA, also designated SEQ ID:5145.

Another function of VGAM2434 is therefore inhibition of LOC147817 (Accession XM_085903). Accordingly, utilities of VGAM2434 include diagnosis, prevention and treatment of diseases and clinical conditions associated with LOC147817. LOC148137 (Accession NM_144692) is another VGAM2434 host target gene. LOC148137 BINDING SITE is HOST TARGET binding site found in the 3' untranslated region of mRNA encoded by LOC148137, corresponding to a HOST TARGET binding site such as BINDING SITE I, BINDING SITE II or BINDING SITE III. Table 2 illustrates the complementarity of the nucleotide sequences of LOC148137 BINDING SITE, designated SEQ ID:29519, to the nucleotide sequence of VGAM2434 RNA, herein designated VGAM RNA, also designated SEQ ID:5145.

Another function of VGAM2434 is therefore inhibition of LOC148137 (Accession NM_144692). Accordingly, utilities of VGAM2434 include diagnosis, prevention and treatment of diseases and clinical conditions associated with LOC148137. LOC148189 (Accession XM_086087) is another VGAM2434 host target gene. LOC148189 BINDING SITE is HOST TARGET binding site found in the 5' untranslated region of mRNA encoded by LOC148189, corresponding to a HOST TARGET binding site such as BINDING SITE I, BINDING SITE II or BINDING SITE III. Table 2 illustrates the complementarity of the nucleotide sequences of LOC148189 BINDING SITE, designated SEQ ID:38486, to the nucleotide sequence of VGAM2434 RNA, herein designated VGAM RNA, also designated SEQ ID:5145.

Another function of VGAM2434 is therefore inhibition of LOC148189 (Accession XM_086087). Accordingly, utilities of VGAM2434 include diagnosis, prevention and treatment of diseases and clinical conditions associated with LOC148189. LOC149506 (Accession XM_097661) is another VGAM2434 host target gene. LOC149506 BINDING SITE is HOST TARGET binding site found in the 3' untranslated region of mRNA encoded by LOC149506, corresponding to a HOST TARGET binding site such as BINDING SITE I, BINDING SITE II or BINDING SITE III. Table 2 illustrates the complementarity of the nucleotide sequences of LOC149506 BINDING SITE, designated SEQ ID:41006, to the nucleotide sequence of VGAM2434 RNA, herein designated VGAM RNA, also designated SEQ ID:5145.

Another function of VGAM2434 is therefore inhibition of LOC149506 (Accession XM_097661). Accordingly, utilities of VGAM2434 include diagnosis, prevention and treatment of diseases and clinical conditions associated with LOC149506. LOC149577 (Accession XM_097675) is another VGAM2434 host target gene. LOC149577 BINDING SITE is HOST TARGET binding site found in the 3' untranslated region of mRNA encoded by LOC149577, corresponding to a HOST TARGET binding site such as BINDING SITE I, BINDING SITE II or BINDING SITE III. Table 2 illustrates the complementarity of the nucleotide sequences of LOC149577 BINDING SITE, designated SEQ ID:41025, to the nucleotide sequence of VGAM2434 RNA, herein designated VGAM RNA, also designated SEQ ID:5145.

Another function of VGAM2434 is therefore inhibition of LOC149577 (Accession XM_097675). Accordingly, utilities of VGAM2434 include diagnosis, prevention and treatment of diseases and clinical conditions associated with LOC149577. LOC149703 (Accession XM_097719) is another VGAM2434 host target gene. LOC149703 BINDING SITE is HOST TARGET binding site found in the 5' untranslated region of mRNA encoded by LOC149703, corresponding to a HOST TARGET binding site such as BINDING SITE I, BINDING SITE II or BINDING SITE III. Table 2 illustrates the complementarity of the nucleotide sequences of LOC149703 BINDING SITE, designated SEQ ID:41064, to the nucleotide sequence of VGAM2434 RNA, herein designated VGAM RNA, also designated SEQ ID:5145.

Another function of VGAM2434 is therefore inhibition of LOC149703 (Accession XM_097719). Accordingly, utilities of VGAM2434 include diagnosis, prevention and treatment of diseases and clinical conditions associated with LOC149703. LOC150397 (Accession XM_086907) is another VGAM2434 host target gene. LOC150397 BINDING SITE is HOST TARGET binding site found in the 3' untranslated region of mRNA encoded by LOC150397, corresponding to a HOST TARGET binding site such as BINDING SITE I, BINDING SITE II or BINDING SITE III. Table 2 illustrates the complementarity of the nucleotide sequences of LOC150397 BINDING SITE, designated SEQ ID:38962, to the nucleotide sequence of VGAM2434 RNA, herein designated VGAM RNA, also designated SEQ ID:5145.

Another function of VGAM2434 is therefore inhibition of LOC150397 (Accession XM_086907). Accordingly, utilities of VGAM2434 include diagnosis, prevention and treatment of diseases and clinical conditions associated with LOC150397. LOC150960 (Accession XM_087059) is another VGAM2434 host target gene. LOC150960 BINDING SITE is HOST TARGET binding site found in the 3' untranslated region of mRNA encoded by LOC150960, corresponding to a HOST TARGET binding site such as BINDING SITE I, BINDING SITE II or BINDING SITE III. Table 2 illustrates the complementarity of the nucleotide sequences of LOC150960 BINDING SITE, designated SEQ ID:39031, to the nucleotide sequence of VGAM2434 RNA, herein designated VGAM RNA, also designated SEQ ID:5145.

Another function of VGAM2434 is therefore inhibition of LOC150960 (Accession XM_087059). Accordingly, utilities of VGAM2434 include diagnosis, prevention and treatment of diseases and clinical conditions associated with LOC150960. LOC151057 (Accession XM_097998) is another VGAM2434 host target gene. LOC151057 BINDING SITE is HOST TARGET binding site found in the 3' untranslated region of mRNA encoded by LOC151057, corresponding to a HOST TARGET binding site such as BINDING SITE I, BINDING SITE II or BINDING SITE III. Table 2 illustrates the complementarity of the nucleotide sequences of LOC151057 BINDING SITE, designated SEQ ID:41293, to the nucleotide sequence of VGAM2434 RNA, herein designated VGAM RNA, also designated SEQ ID:5145.

Another function of VGAM2434 is therefore inhibition of LOC151057 (Accession XM_097998). Accordingly, utilities of VGAM2434 include diagnosis, prevention and treatment of diseases and clinical conditions associated with LOC151057. LOC151475 (Accession XM_098063) is another VGAM2434 host target gene. LOC151475 BINDING SITE1 and LOC151475 BINDING SITE2 are HOST TARGET binding sites found in untranslated regions of mRNA encoded by LOC151475, corresponding to HOST TARGET binding sites such as BINDING SITE I, BINDING SITE II or BINDING SITE III. Table 2 illustrates the complementarity of the nucleotide sequences of LOC151475 BINDING SITE1 and LOC151475 BINDING SITE2, designated SEQ ID:41354 and SEQ ID:41360 respectively, to the nucleotide sequence of VGAM2434 RNA, herein designated VGAM RNA, also designated SEQ ID:5145.

Another function of VGAM2434 is therefore inhibition of LOC151475 (Accession XM_098063). Accordingly, utilities of VGAM2434 include diagnosis, prevention and treatment of diseases and clinical conditions associated with LOC151475. LOC151826 (Accession XM_087312) is another VGAM2434 host target gene. LOC151826 BINDING SITE is HOST TARGET binding site found in the 3' untranslated region of mRNA encoded by LOC151826, corresponding to a HOST TARGET binding site such as BINDING SITE I, BINDING SITE II or BINDING SITE III. Table 2 illustrates the complementarity of the nucleotide sequences of LOC151826 BINDING SITE, designated SEQ ID:39166, to the nucleotide sequence of VGAM2434 RNA, herein designated VGAM RNA, also designated SEQ ID:5145.

Another function of VGAM2434 is therefore inhibition of LOC151826 (Accession XM_087312). Accordingly, utilities of VGAM2434 include diagnosis, prevention and treatment of diseases and clinical conditions associated with LOC151826. LOC152343 (Accession XM_087441) is another VGAM2434 host target gene. LOC152343 BINDING SITE is HOST TARGET binding site found in the 3' untranslated region of mRNA encoded by LOC152343, corresponding to a HOST TARGET binding site such as BINDING SITE I, BINDING SITE II or BINDING SITE III. Table 2 illustrates the complementarity of the nucleotide sequences of LOC152343 BINDING SITE, designated SEQ ID:39264, to the nucleotide sequence of VGAM2434 RNA, herein designated VGAM RNA, also designated SEQ ID:5145.

Another function of VGAM2434 is therefore inhibition of LOC152343 (Accession XM_087441). Accordingly, utilities of VGAM2434 include diagnosis, prevention and treatment of diseases and clinical conditions associated with LOC152343. LOC152445 (Accession XM_098231) is another VGAM2434 host target gene. LOC152445 BINDING SITE1 and LOC152445 BINDING SITE2 are HOST TARGET binding sites found in untranslated regions of mRNA encoded by LOC152445, corresponding to HOST TARGET binding sites such as BINDING SITE I, BINDING SITE II or BINDING SITE III. Table 2 illustrates the complementarity of the nucleotide sequences of LOC152445 BINDING SITE1 and LOC152445 BINDING SITE2, designated SEQ ID:41509 and SEQ ID:41513 respectively, to the nucleotide sequence of VGAM2434 RNA, herein designated VGAM RNA, also designated SEQ ID:5145.

Another function of VGAM2434 is therefore inhibition of LOC152445 (Accession XM_098231). Accordingly, utilities of VGAM2434 include diagnosis, prevention and treatment of diseases and clinical conditions associated with LOC152445. LOC152794 (Accession XM_087525) is another VGAM2434 host target gene. LOC152794 BINDING SITE is HOST TARGET binding site found in the 5' untranslated region of mRNA encoded by LOC152794, corresponding to a HOST TARGET binding site such as BINDING SITE I, BINDING SITE II or BINDING SITE III. Table 2 illustrates the complementarity of the nucleotide sequences of LOC152794 BINDING SITE, designated SEQ ID:39321, to the nucleotide sequence of VGAM2434 RNA, herein designated VGAM RNA, also designated SEQ ID:5145.

Another function of VGAM2434 is therefore inhibition of LOC152794 (Accession XM_087525). Accordingly, utilities of VGAM2434 include diagnosis, prevention and treatment of diseases and clinical conditions associated with LOC152794. LOC152925 (Accession XM_087559) is another VGAM2434 host target gene. LOC152925 BINDING SITE is HOST TARGET binding site found in the 3' untranslated region of mRNA encoded by LOC152925, corresponding to a HOST TARGET binding site such as BINDING SITE I, BINDING SITE II or BINDING SITE III. Table 2 illustrates the complementarity of the nucleotide sequences of LOC152925 BINDING SITE, designated SEQ ID:39331, to the nucleotide sequence of VGAM2434 RNA, herein designated VGAM RNA, also designated SEQ ID:5145.

Another function of VGAM2434 is therefore inhibition of LOC152925 (Accession XM_087559). Accordingly, utilities of VGAM2434 include diagnosis, prevention and treatment of diseases and clinical conditions associated with LOC152925. LOC153077 (Accession XM_098307) is another VGAM2434 host target gene. LOC153077 BINDING SITE is HOST TARGET binding site found in the 3' untranslated region of mRNA encoded by LOC153077, corresponding to a HOST TARGET binding site such as BINDING SITE I, BINDING SITE II or BINDING SITE III. Table 2 illustrates the complementarity of the nucleotide sequences of LOC153077 BINDING SITE, designated SEQ ID:41570, to the nucleotide sequence of VGAM2434 RNA, herein designated VGAM RNA, also designated SEQ ID:5145.

Another function of VGAM2434 is therefore inhibition of LOC153077 (Accession XM_098307). Accordingly, utilities of VGAM2434 include diagnosis, prevention and treatment of diseases and clinical conditions associated with LOC153077. LOC153883 (Accession XM_087798) is another VGAM2434 host target gene. LOC153883 BINDING SITE is HOST TARGET binding site found in the 5' untranslated region of mRNA encoded by LOC153883, corresponding to a HOST TARGET binding site such as BINDING SITE I, BINDING SITE II or BINDING SITE III. Table 2 illustrates the complementarity of the nucleotide sequences of LOC153883 BINDING SITE, designated SEQ ID:39431, to the nucleotide sequence of VGAM2434 RNA, herein designated VGAM RNA, also designated SEQ ID:5145.

Another function of VGAM2434 is therefore inhibition of LOC153883 (Accession XM_087798). Accordingly, utilities of VGAM2434 include diagnosis, prevention and treatment of diseases and clinical conditions associated with LOC153883. LOC154282 (Accession XM_098505) is another VGAM2434 host target gene. LOC154282 BINDING SITE is HOST TARGET binding site found in the 5' untranslated region of mRNA encoded by LOC154282, corresponding to a HOST TARGET binding site such as BINDING SITE I, BINDING SITE II or BINDING SITE III. Table 2 illustrates the complementarity of the nucleotide sequences of LOC154282 BINDING SITE, designated SEQ ID:41701, to the nucleotide sequence of VGAM2434 RNA, herein designated VGAM RNA, also designated SEQ ID:5145.

Another function of VGAM2434 is therefore inhibition of LOC154282 (Accession XM_098505). Accordingly, utilities of VGAM2434 include diagnosis, prevention and treatment of diseases and clinical conditions associated with LOC154282. LOC154726 (Accession XM_088024) is another VGAM2434 host target gene. LOC154726 BINDING SITE is HOST TARGET binding site found in the 5' untranslated region of mRNA encoded by LOC154726, corresponding to a HOST TARGET binding site such as BINDING SITE I, BINDING SITE II or BINDING SITE III. Table 2 illustrates the complementarity of the nucleotide sequences of LOC154726 BINDING SITE, designated SEQ ID:39478, to the nucleotide sequence of VGAM2434 RNA, herein designated VGAM RNA, also designated SEQ ID:5145.

Another function of VGAM2434 is therefore inhibition of LOC154726 (Accession XM_088024). Accordingly, utilities of VGAM2434 include diagnosis, prevention and treatment of diseases and clinical conditions associated with LOC154726. LOC154877 (Accession XM_098626) is another VGAM2434 host target gene. LOC154877 BINDING SITE is HOST TARGET binding site found in the 3' untranslated region of mRNA encoded by LOC154877, corresponding to a HOST TARGET binding site such as BINDING SITE I, BINDING SITE II or BINDING SITE III. Table 2 illustrates the complementarity of the nucleotide sequences of LOC154877 BINDING SITE, designated SEQ ID:41746, to the nucleotide sequence of VGAM2434 RNA, herein designated VGAM RNA, also designated SEQ ID:5145.

Another function of VGAM2434 is therefore inhibition of LOC154877 (Accession XM_098626). Accordingly, utilities of VGAM2434 include diagnosis, prevention and treatment of diseases and clinical conditions associated with LOC154877. LOC154930 (Accession XM_088080) is another VGAM2434 host target gene. LOC154930 BIND- ING SITE is HOST TARGET binding site found in the 3' untranslated region of mRNA encoded by LOC154930, corresponding to a HOST TARGET binding site such as BINDING SITE I, BINDING SITE II or BINDING SITE III. Table 2 illustrates the complementarity of the nucleotide sequences of LOC154930 BINDING SITE, designated SEQ ID:39505, to the nucleotide sequence of VGAM2434 RNA, herein designated VGAM RNA, also designated SEQ ID:5145.

Another function of VGAM2434 is therefore inhibition of LOC154930 (Accession XM_088080). Accordingly, utilities of VGAM2434 include diagnosis, prevention and treatment of diseases and clinical conditions associated with LOC154930. LOC157798 (Accession XM_098827) is another VGAM2434 host target gene. LOC157798 BINDING SITE is HOST TARGET binding site found in the 5' untranslated region of mRNA encoded by LOC157798, corresponding to a HOST TARGET binding site such as BINDING SITE I, BINDING SITE II or BINDING SITE III. Table 2 illustrates the complementarity of the nucleotide sequences of LOC157798 BINDING SITE, designated SEQ ID:41852, to the nucleotide sequence of VGAM2434 RNA, herein designated VGAM RNA, also designated SEQ ID:5145.

Another function of VGAM2434 is therefore inhibition of LOC157798 (Accession XM_098827). Accordingly, utilities of VGAM2434 include diagnosis, prevention and treatment of diseases and clinical conditions associated with LOC157798. LOC158549 (Accession XM_098963) is another VGAM2434 host target gene. LOC158549 BINDING SITE is HOST TARGET binding site found in the 5' untranslated region of mRNA encoded by LOC158549, corresponding to a HOST TARGET binding site such as BINDING SITE I, BINDING SITE II or BINDING SITE III. Table 2 illustrates the complementarity of the nucleotide sequences of LOC158549 BINDING SITE, designated SEQ ID:42011, to the nucleotide sequence of VGAM2434 RNA, herein designated VGAM RNA, also designated SEQ ID:5145.

Another function of VGAM2434 is therefore inhibition of LOC158549 (Accession XM_098963). Accordingly, utilities of VGAM2434 include diagnosis, prevention and treatment of diseases and clinical conditions associated with LOC158549. LOC158668 (Accession XM_045161) is another VGAM2434 host target gene. LOC158668 BINDING SITE is HOST TARGET binding site found in the 3' untranslated region of mRNA encoded by LOC158668, corresponding to a HOST TARGET binding site such as BINDING SITE I, BINDING SITE II or BINDING SITE III. Table 2 illustrates the complementarity of the nucleotide sequences of LOC158668 BINDING SITE, designated SEQ ID:34379, to the nucleotide sequence of VGAM2434 RNA, herein designated VGAM RNA, also designated SEQ ID:5145.

Another function of VGAM2434 is therefore inhibition of LOC158668 (Accession XM_045161). Accordingly, utilities of VGAM2434 include diagnosis, prevention and treatment of diseases and clinical conditions associated with LOC158668. LOC158865 (Accession XM_099000) is another VGAM2434 host target gene. LOC158865 BINDING SITE is HOST TARGET binding site found in the 5' untranslated region of mRNA encoded by LOC158865, corresponding to a HOST TARGET binding site such as BINDING SITE I, BINDING SITE II or BINDING SITE III. Table 2 illustrates the complementarity of the nucleotide sequences of LOC158865 BINDING SITE, designated SEQ ID:42038, to the nucleotide sequence of VGAM2434 RNA, herein designated VGAM RNA, also designated SEQ ID:5145.

Another function of VGAM2434 is therefore inhibition of LOC158865 (Accession XM_099000). Accordingly, utilities of VGAM2434 include diagnosis, prevention and treatment of diseases and clinical conditions associated with LOC158865. LOC160646 (Accession XM_090413) is another VGAM2434 host target gene. LOC160646 BINDING SITE is HOST TARGET binding site found in the 3' untranslated region of mRNA encoded by LOC160646, corresponding to a HOST TARGET binding site such as BINDING SITE I, BINDING SITE II or BINDING SITE III. Table 2 illustrates the complementarity of the nucleotide sequences of LOC160646 BINDING SITE, designated SEQ ID:40005, to the nucleotide sequence of VGAM2434 RNA, herein designated VGAM RNA, also designated SEQ ID:5145.

Another function of VGAM2434 is therefore inhibition of LOC160646 (Accession XM_090413). Accordingly, utilities of VGAM2434 include diagnosis, prevention and treatment of diseases and clinical conditions associated with LOC160646. LOC161829 (Accession XM_091161) is another VGAM2434 host target gene. LOC161829 BINDING SITE is HOST TARGET binding site found in the 3' untranslated region of mRNA encoded by LOC161829, corresponding to a HOST TARGET binding site such as BINDING SITE I, BINDING SITE II or BINDING SITE III. Table 2 illustrates the complementarity of the nucleotide sequences of LOC161829 BINDING SITE, designated SEQ ID:40040, to the nucleotide sequence of VGAM2434 RNA, herein designated VGAM RNA, also designated SEQ ID:5145.

Another function of VGAM2434 is therefore inhibition of LOC161829 (Accession XM_091161). Accordingly, utilities of VGAM2434 include diagnosis, prevention and treatment of diseases and clinical conditions associated with LOC161829. LOC169611 (Accession XM_095809) is another VGAM2434 host target gene. LOC169611 BINDING SITE is HOST TARGET binding site found in the 3' untranslated region of mRNA encoded by LOC169611, corresponding to a HOST TARGET binding site such as BINDING SITE I, BINDING SITE II or BINDING SITE III. Table 2 illustrates the complementarity of the nucleotide sequences of LOC169611 BINDING SITE, designated SEQ ID:40287, to the nucleotide sequence of VGAM2434 RNA, herein designated VGAM RNA, also designated SEQ ID:5145.

Another function of VGAM2434 is therefore inhibition of LOC169611 (Accession XM_095809). Accordingly, utilities of VGAM2434 include diagnosis, prevention and treatment of diseases and clinical conditions associated with LOC169611. LOC196047 (Accession XM_116883) is another VGAM2434 host target gene. LOC196047 BINDING SITE is HOST TARGET binding site found in the 5' untranslated region of mRNA encoded by LOC196047, corresponding to a HOST TARGET binding site such as BINDING SITE I, BINDING SITE II or BINDING SITE III. Table 2 illustrates the complementarity of the nucleotide sequences of LOC196047 BINDING SITE, designated SEQ ID:43147, to the nucleotide sequence of VGAM2434 RNA, herein designated VGAM RNA, also designated SEQ ID:5145.

Another function of VGAM2434 is therefore inhibition of LOC196047 (Accession XM_116883). Accordingly, utilities of VGAM2434 include diagnosis, prevention and treatment of diseases and clinical conditions associated with LOC196047. LOC196264 (Accession XM_113683) is another VGAM2434 host target gene. LOC196264 BINDING SITE is HOST TARGET binding site found in the 3' untranslated region of mRNA encoded by LOC196264, corresponding to a HOST TARGET binding site such as BINDING SITE I, BINDING SITE II or BINDING SITE III. Table 2 illustrates the complementarity of the nucleotide sequences of LOC196264 BINDING SITE, designated SEQ ID:42334, to the nucleotide sequence of VGAM2434 RNA, herein designated VGAM RNA, also designated SEQ ID:5145.

Another function of VGAM2434 is therefore inhibition of LOC196264 (Accession XM_113683). Accordingly, utilities of VGAM2434 include diagnosis, prevention and treatment of diseases and clinical conditions associated with LOC196264. LOC196411 (Accession XM_113714) is another VGAM2434 host target gene. LOC196411 BINDING SITE is HOST TARGET binding site found in the 3' untranslated region of mRNA encoded by LOC196411, corresponding to a HOST TARGET binding site such as BINDING SITE I, BINDING SITE II or BINDING SITE III. Table 2 illustrates the complementarity of the nucleotide sequences of LOC196411 BINDING SITE, designated SEQ ID:42366, to the nucleotide sequence of VGAM2434 RNA, herein designated VGAM RNA, also designated SEQ ID:5145.

Another function of VGAM2434 is therefore inhibition of LOC196411 (Accession XM_113714). Accordingly, utilities of VGAM2434 include diagnosis, prevention and treatment of diseases and clinical conditions associated with LOC196411. LOC196529 (Accession XM_113746) is another VGAM2434 host target gene. LOC196529 BINDING SITE is HOST TARGET binding site found in the 3' untranslated region of mRNA encoded by LOC196529, corresponding to a HOST TARGET binding site such as BINDING SITE I, BINDING SITE II or BINDING SITE III. Table 2 illustrates the complementarity of the nucleotide sequences of LOC196529 BINDING SITE, designated SEQ ID:42411, to the nucleotide sequence of VGAM2434 RNA, herein designated VGAM RNA, also designated SEQ ID:5145.

Another function of VGAM2434 is therefore inhibition of LOC196529 (Accession XM_113746). Accordingly, utilities of VGAM2434 include diagnosis, prevention and treatment of diseases and clinical conditions associated with LOC196529. LOC199786 (Accession XM_114021) is another VGAM2434 host target gene. LOC199786 BINDING SITE is HOST TARGET binding site found in the 3' untranslated region of mRNA encoded by LOC199786, corresponding to a HOST TARGET binding site such as BINDING SITE I, BINDING SITE II or BINDING SITE III. Table 2 illustrates the complementarity of the nucleotide sequences of LOC199786 BINDING SITE, designated SEQ ID:42621, to the nucleotide sequence of VGAM2434 RNA, herein designated VGAM RNA, also designated SEQ ID:5145.

Another function of VGAM2434 is therefore inhibition of LOC199786 (Accession XM_114021). Accordingly, utilities of VGAM2434 include diagnosis, prevention and treatment of diseases and clinical conditions associated with LOC199786. LOC200169 (Accession XM_117200) is another VGAM2434 host target gene. LOC200169 BINDING SITE is HOST TARGET binding site found in the 5' untranslated region of mRNA encoded by LOC200169, corresponding to a HOST TARGET binding site such as BINDING SITE I, BINDING SITE II or BINDING SITE III. Table 2 illustrates the complementarity of the nucleotide sequences of LOC200169 BINDING SITE, designated SEQ ID:43284, to the nucleotide sequence of VGAM2434 RNA, herein designated VGAM RNA, also designated SEQ ID:5145.

Another function of VGAM2434 is therefore inhibition of LOC200169 (Accession XM_117200). Accordingly, utilities of VGAM2434 include diagnosis, prevention and treatment of diseases and clinical conditions associated with LOC200169. LOC200310 (Accession XM_037840) is another VGAM2434 host target gene. LOC200310 BINDING SITE is HOST TARGET binding site found in the 3' untranslated region of mRNA encoded by LOC200310, corresponding to a HOST TARGET binding site such as BINDING SITE I, BINDING SITE II or BINDING SITE III. Table 2 illustrates the complementarity of the nucleotide sequences of LOC200310 BINDING SITE, designated SEQ ID:32706, to the nucleotide sequence of VGAM2434 RNA, herein designated VGAM RNA, also designated SEQ ID:5145.

Another function of VGAM2434 is therefore inhibition of LOC200310 (Accession XM_037840). Accordingly, utilities of VGAM2434 include diagnosis, prevention and treatment of diseases and clinical conditions associated with LOC200310. LOC200314 (Accession XM_117225) is another VGAM2434 host target gene. LOC200314 BINDING SITE is HOST TARGET binding site found in the 3' untranslated region of mRNA encoded by LOC200314, corresponding to a HOST TARGET binding site such as BINDING SITE I, BINDING SITE II or BINDING SITE III. Table 2 illustrates the complementarity of the nucleotide sequences of LOC200314 BINDING SITE, designated SEQ ID:43295, to the nucleotide sequence of VGAM2434 RNA, herein designated VGAM RNA, also designated SEQ ID:5145.

Another function of VGAM2434 is therefore inhibition of LOC200314 (Accession XM_117225). Accordingly, utilities of VGAM2434 include diagnosis, prevention and treatment of diseases and clinical conditions associated with LOC200314. LOC200845 (Accession XM_114305) is another VGAM2434 host target gene. LOC200845 BINDING SITE is HOST TARGET binding site found in the 5' untranslated region of mRNA encoded by LOC200845, corresponding to a HOST TARGET binding site such as BINDING SITE I, BINDING SITE II or BINDING SITE III. Table 2 illustrates the complementarity of the nucleotide sequences of LOC200845 BINDING SITE, designated SEQ ID:42864, to the nucleotide sequence of VGAM2434 RNA, herein designated VGAM RNA, also designated SEQ ID:5145.

Another function of VGAM2434 is therefore inhibition of LOC200845 (Accession XM_114305). Accordingly, utilities of VGAM2434 include diagnosis, prevention and treatment of diseases and clinical conditions associated with LOC200845. LOC200860 (Accession XM_117289) is another VGAM2434 host target gene. LOC200860 BINDING SITE is HOST TARGET binding site found in the 3' untranslated region of mRNA encoded by LOC200860, corresponding to a HOST TARGET binding site such as BINDING SITE I, BINDING SITE II or BINDING SITE III. Table 2 illustrates the complementarity of the nucleotide sequences of LOC200860 BINDING SITE, designated SEQ ID:43357, to the nucleotide sequence of VGAM2434 RNA, herein designated VGAM RNA, also designated SEQ ID:5145.

Another function of VGAM2434 is therefore inhibition of LOC200860 (Accession XM_117289). Accordingly, utilities of VGAM2434 include diagnosis, prevention and treatment of diseases and clinical conditions associated with LOC200860. LOC201173 (Accession XM_113312) is another VGAM2434 host target gene. LOC201173 BINDING SITE is HOST TARGET binding site found in the 5' untranslated region of mRNA encoded by LOC201173, corresponding to a HOST TARGET binding site such as BINDING SITE I, BINDING SITE II or BINDING SITE III. Table 2 illustrates the complementarity of the nucleotide sequences of LOC201173 BINDING SITE, designated SEQ ID:42214, to the nucleotide sequence of VGAM2434 RNA, herein designated VGAM RNA, also designated SEQ ID:5145.

Another function of VGAM2434 is therefore inhibition of LOC201173 (Accession XM_113312). Accordingly, utilities of VGAM2434 include diagnosis, prevention and treatment of diseases and clinical conditions associated with LOC201173. LOC201220 (Accession XM_113321) is another VGAM2434 host target gene. LOC201220 BINDING SITE is HOST TARGET binding site found in the 5' untranslated region of mRNA encoded by LOC201220, corresponding to a HOST TARGET binding site such as BINDING SITE I, BINDING SITE II or BINDING SITE III. Table 2 illustrates the complementarity of the nucleotide sequences of LOC201220 BINDING SITE, designated SEQ ID:42221, to the nucleotide sequence of VGAM2434 RNA, herein designated VGAM RNA, also designated SEQ ID:5145.

Another function of VGAM2434 is therefore inhibition of LOC201220 (Accession XM_113321). Accordingly, utilities of VGAM2434 include diagnosis, prevention and treatment of diseases and clinical conditions associated with LOC201220. LOC201294 (Accession XM_113950) is another VGAM2434 host target gene. LOC201294 BINDING SITE is HOST TARGET binding site found in the 3' untranslated region of mRNA encoded by LOC201294, corresponding to a HOST TARGET binding site such as BINDING SITE I, BINDING SITE II or BINDING SITE III. Table 2 illustrates the complementarity of the nucleotide sequences of LOC201294 BINDING SITE, designated SEQ ID:42569, to the nucleotide sequence of VGAM2434 RNA, herein designated VGAM RNA, also designated SEQ ID:5145.

Another function of VGAM2434 is therefore inhibition of LOC201294 (Accession XM_113950). Accordingly, utilities of VGAM2434 include diagnosis, prevention and treatment of diseases and clinical conditions associated with LOC201294. LOC201411 (Accession XM_031946) is another VGAM2434 host target gene. LOC201411 BINDING SITE is HOST TARGET binding site found in the 3' untranslated region of mRNA encoded by LOC201411, corresponding to a HOST TARGET binding site such as BINDING SITE I, BINDING SITE II or BINDING SITE III. Table 2 illustrates the complementarity of the nucleotide sequences of LOC201411 BINDING SITE, designated SEQ ID:31527, to the nucleotide sequence of VGAM2434 RNA, herein designated VGAM RNA, also designated SEQ ID:5145.

Another function of VGAM2434 is therefore inhibition of LOC201411 (Accession XM_031946). Accordingly, utilities of VGAM2434 include diagnosis, prevention and treatment of diseases and clinical conditions associated with LOC201411. LOC201696 (Accession XM_032269) is another VGAM2434 host target gene. LOC201696 BINDING SITE is HOST TARGET binding site found in the 3' untranslated region of mRNA encoded by LOC201696, corresponding to a HOST TARGET binding site such as BINDING SITE I, BINDING SITE II or BINDING SITE III. Table 2 illustrates the complementarity of the nucleotide sequences of LOC201696 BINDING SITE, designated SEQ ID:31621, to the nucleotide sequence of VGAM2434 RNA, herein designated VGAM RNA, also designated SEQ ID:5145.

Another function of VGAM2434 is therefore inhibition of LOC201696 (Accession XM_032269). Accordingly, utilities of VGAM2434 include diagnosis, prevention and treatment of diseases and clinical conditions associated with LOC201696. LOC201702 (Accession XM_114365) is another VGAM2434 host target gene. LOC201702 BINDING SITE is HOST TARGET binding site found in the 5' untranslated region of mRNA encoded by LOC201702, corresponding to a HOST TARGET binding site such as BINDING SITE I, BINDING SITE II or BINDING SITE III. Table 2 illustrates the complementarity of the nucleotide sequences of LOC201702 BINDING SITE, designated SEQ ID:42900, to the nucleotide sequence of VGAM2434 RNA, herein designated VGAM RNA, also designated SEQ ID:5145.

Another function of VGAM2434 is therefore inhibition of LOC201702 (Accession XM_114365). Accordingly, utilities of VGAM2434 include diagnosis, prevention and treatment of diseases and clinical conditions associated with LOC201702. LOC202025 (Accession XM_117353) is another VGAM2434 host target gene. LOC202025 BINDING SITE is HOST TARGET binding site found in the 3' untranslated region of mRNA encoded by LOC202025, corresponding to a HOST TARGET binding site such as BINDING SITE I, BINDING SITE II or BINDING SITE III. Table 2 illustrates the complementarity of the nucleotide sequences of LOC202025 BINDING SITE, designated SEQ ID:43405, to the nucleotide sequence of VGAM2434 RNA, herein designated VGAM RNA, also designated SEQ ID:5145.

Another function of VGAM2434 is therefore inhibition of LOC202025 (Accession XM_117353). Accordingly, utilities of VGAM2434 include diagnosis, prevention and treatment of diseases and clinical conditions associated with LOC202025. LOC202934 (Accession XM_117486) is another VGAM2434 host target gene. LOC202934 BINDING SITE is HOST TARGET binding site found in the 3' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43456, to the nucleotide sequence of VGAM2434 RNA, herein designated VGAM RNA, also designated SEQ ID:5145.

Another function of VGAM2434 is therefore inhibition of LOC202934 (Accession XM_117486). Accordingly, utilities of VGAM2434 include diagnosis, prevention and treatment of diseases and clinical conditions associated with LOC202934. LOC203297 (Accession XM_059986) is another VGAM2434 host target gene. LOC203297 BINDING SITE is HOST TARGET binding site found in the 5' untranslated region of mRNA encoded by LOC203297, corresponding to a HOST TARGET binding site such as BINDING SITE I, BINDING SITE II or BINDING SITE III. Table 2 illustrates the complementarity of the nucleotide sequences of LOC203297 BINDING SITE, designated SEQ ID:37135, to the nucleotide sequence of VGAM2434 RNA, herein designated VGAM RNA, also designated SEQ ID:5145.

Another function of VGAM2434 is therefore inhibition of LOC203297 (Accession XM_059986). Accordingly, utilities of VGAM2434 include diagnosis, prevention and treatment of diseases and clinical conditions associated with LOC203297. LOC203339 (Accession XM_117534) is another VGAM2434 host target gene. LOC203339 BINDING SITE is HOST TARGET binding site found in the 3' untranslated region of mRNA encoded by LOC203339, corresponding to a HOST TARGET binding site such as BINDING SITE I, BINDING SITE II or BINDING SITE III. Table 2 illustrates the complementarity of the nucleotide sequences of LOC203339 BINDING SITE, designated SEQ ID:43524, to the nucleotide sequence of VGAM2434 RNA, herein designated VGAM RNA, also designated SEQ ID:5145.

Another function of VGAM2434 is therefore inhibition of LOC203339 (Accession XM_117534). Accordingly, utilities of VGAM2434 include diagnosis, prevention and treatment of diseases and clinical conditions associated with LOC203339. LOC203350 (Accession XM_117536) is another VGAM2434 host target gene. LOC203350 BINDING SITE is HOST TARGET binding site found in the 3' untranslated region of mRNA encoded by LOC203350, corresponding to a HOST TARGET binding site such as BINDING SITE I, BINDING SITE II or BINDING SITE III. Table 2 illustrates the complementarity of the nucleotide sequences of LOC203350 BINDING SITE, designated SEQ ID:43538, to the nucleotide sequence of VGAM2434 RNA, herein designated VGAM RNA, also designated SEQ ID:5145.

Another function of VGAM2434 is therefore inhibition of LOC203350 (Accession XM_117536). Accordingly, utilities of VGAM2434 include diagnosis, prevention and treatment of diseases and clinical conditions associated with LOC203350. LOC203378 (Accession XM_117541) is another VGAM2434 host target gene. LOC203378 BINDING SITE is HOST TARGET binding site found in the 3' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43551, to the nucleotide sequence of VGAM2434 RNA, herein designated VGAM RNA, also designated SEQ ID:5145.

Another function of VGAM2434 is therefore inhibition of LOC203378 (Accession XM_117541). Accordingly, utilities of VGAM2434 include diagnosis, prevention and treatment of diseases and clinical conditions associated with LOC203378. LOC219673 (Accession XM_167567) is another VGAM2434 host target gene. LOC219673 BINDING SITE is HOST TARGET binding site found in the 5' untranslated region of mRNA encoded by LOC219673, corresponding to a HOST TARGET binding site such as BINDING SITE I, BINDING SITE II or BINDING SITE III. Table 2 illustrates the complementarity of the nucleotide sequences of LOC219673 BINDING SITE, designated SEQ ID:44692, to the nucleotide sequence of VGAM2434 RNA, herein designated VGAM RNA, also designated SEQ ID:5145.

Another function of VGAM2434 is therefore inhibition of LOC219673 (Accession XM_167567). Accordingly, utilities of VGAM2434 include diagnosis, prevention and treatment of diseases and clinical conditions associated with LOC219673. LOC220662 (Accession XM_165978) is another VGAM2434 host target gene. LOC220662 BINDING SITE is HOST TARGET binding site found in the 3' untranslated region of mRNA encoded by LOC220662, corresponding to a HOST TARGET binding site such as BINDING SITE I, BINDING SITE II or BINDING SITE III. Table 2 illustrates the complementarity of the nucleotide sequences of LOC220662 BINDING SITE, designated SEQ ID:43825, to the nucleotide sequence of VGAM2434 RNA, herein designated VGAM RNA, also designated SEQ ID:5145.

Another function of VGAM2434 is therefore inhibition of LOC220662 (Accession XM_165978). Accordingly, utilities of VGAM2434 include diagnosis, prevention and treatment of diseases and clinical conditions associated with LOC220662. LOC221296 (Accession XM_166325) is another VGAM2434 host target gene. LOC221296 BINDING SITE is HOST TARGET binding site found in the 3' untranslated region of mRNA encoded by LOC221296, corresponding to a HOST TARGET binding site such as BINDING SITE I, BINDING SITE II or BINDING SITE III. Table 2 illustrates the complementarity of the nucleotide sequences of LOC221296 BINDING SITE, designated SEQ ID:44171, to the nucleotide sequence of VGAM2434 RNA, herein designated VGAM RNA, also designated SEQ ID:5145.

Another function of VGAM2434 is therefore inhibition of LOC221296 (Accession XM_166325). Accordingly, utilities of VGAM2434 include diagnosis, prevention and treatment of diseases and clinical conditions associated with LOC221296. LOC221773 (Accession XM_165802) is another VGAM2434 host target gene. LOC221773 BINDING SITE is HOST TARGET binding site found in the 3' untranslated region of mRNA encoded by LOC221773, corresponding to a HOST TARGET binding site such as BINDING SITE I, BINDING SITE II or BINDING SITE III. Table 2 illustrates the complementarity of the nucleotide sequences of LOC221773 BINDING SITE, designated SEQ ID:43767, to the nucleotide sequence of VGAM2434 RNA, herein designated VGAM RNA, also designated SEQ ID:5145.

Another function of VGAM2434 is therefore inhibition of LOC221773 (Accession XM_165802). Accordingly, utilities of VGAM2434 include diagnosis, prevention and treatment of diseases and clinical conditions associated with LOC221773. LOC222031 (Accession XM_168371) is another VGAM2434 host target gene. LOC222031 BINDING SITE is HOST TARGET binding site found in the 3' untranslated region of mRNA encoded by LOC222031, corresponding to a HOST TARGET binding site such as BINDING SITE I, BINDING SITE II or BINDING SITE III. Table 2 illustrates the complementarity of the nucleotide sequences of LOC222031 BINDING SITE, designated SEQ ID:45137, to the nucleotide sequence of VGAM2434 RNA, herein designated VGAM RNA, also designated SEQ ID:5145.

Another function of VGAM2434 is therefore inhibition of LOC222031 (Accession XM_168371). Accordingly, utilities of VGAM2434 include diagnosis, prevention and treatment of diseases and clinical conditions associated with LOC222031. LOC222070 (Accession XM_168433) is another VGAM2434 host target gene. LOC222070 BINDING SITE is HOST TARGET binding site found in the 5' untranslated region of mRNA encoded by LOC222070, corresponding to a HOST TARGET binding site such as BINDING SITE I, BINDING SITE II or BINDING SITE III. Table 2 illustrates the complementarity of the nucleotide sequences of LOC222070 BINDING SITE, designated SEQ ID:45180, to the nucleotide sequence of VGAM2434 RNA, herein designated VGAM RNA, also designated SEQ ID:5145.

Another function of VGAM2434 is therefore inhibition of LOC222070 (Accession XM_168433). Accordingly, utilities of VGAM2434 include diagnosis, prevention and treatment of diseases and clinical conditions associated with LOC222070. LOC245771 (Accession XM_167366) is another VGAM2434 host target gene. LOC245771 BINDING SITE is HOST TARGET binding site found in the 5' untranslated region of mRNA encoded by LOC245771, corresponding to a HOST TARGET binding site such as BINDING SITE I, BINDING SITE II or BINDING SITE III. Table 2 illustrates the complementarity of the nucleotide sequences of LOC245771 BINDING SITE, designated SEQ ID:44634, to the nucleotide sequence of VGAM2434 RNA, herein designated VGAM RNA, also designated SEQ ID:5145.

Another function of VGAM2434 is therefore inhibition of LOC245771 (Accession XM_167366). Accordingly, utilities of VGAM2434 include diagnosis, prevention and treatment of diseases and clinical conditions associated with LOC245771. LOC253664 (Accession XM_170673) is another VGAM2434 host target gene. LOC253664 BINDING SITE is HOST TARGET binding site found in the 3' untranslated region of mRNA encoded by LOC253664, corresponding to a HOST TARGET binding site such as BINDING SITE I, BINDING SITE II or BINDING SITE III. Table 2 illustrates the complementarity of the nucleotide sequences of LOC253664 BINDING SITE, designated SEQ ID:45448, to the nucleotide sequence of VGAM2434 RNA, herein designated VGAM RNA, also designated SEQ ID:5145.

Another function of VGAM2434 is therefore inhibition of LOC253664 (Accession XM_170673). Accordingly, utilities of VGAM2434 include diagnosis, prevention and treatment of diseases and clinical conditions associated with LOC253664. LOC253666 (Accession XM_170799) is another VGAM2434 host target gene. LOC253666 BINDING SITE is HOST TARGET binding site found in the 5' untranslated region of mRNA encoded by LOC253666, corresponding to a HOST TARGET binding site such as BIND- ING SITE I, BINDING SITE II or BINDING SITE III. Table 2 illustrates the complementarity of the nucleotide sequences of LOC253666 BINDING SITE, designated SEQ ID:45569, to the nucleotide sequence of VGAM2434 RNA, herein designated VGAM RNA, also designated SEQ ID:5145.

Another function of VGAM2434 is therefore inhibition of LOC253666 (Accession XM_170799). Accordingly, utilities of VGAM2434 include diagnosis, prevention and treatment of diseases and clinical conditions associated with LOC253666. LOC254778 (Accession XM_171193) is another VGAM2434 host target gene. LOC254778 BINDING SITE is HOST TARGET binding site found in the 3' untranslated region of mRNA encoded by LOC254778, corresponding to a HOST TARGET binding site such as BINDING SITE I, BINDING SITE II or BINDING SITE III. Table 2 illustrates the complementarity of the nucleotide sequences of LOC254778 BINDING SITE, designated SEQ ID:45979, to the nucleotide sequence of VGAM2434 RNA, herein designated VGAM RNA, also designated SEQ ID:5145.

Another function of VGAM2434 is therefore inhibition of LOC254778 (Accession XM_171193). Accordingly, utilities of VGAM2434 include diagnosis, prevention and treatment of diseases and clinical conditions associated with LOC254778. LOC255177 (Accession XM_172941) is another VGAM2434 host target gene. LOC255177 BINDING SITE is HOST TARGET binding site found in the 3' untranslated region of mRNA encoded by LOC255177, corresponding to a HOST TARGET binding site such as BINDING SITE I, BINDING SITE II or BINDING SITE III. Table 2 illustrates the complementarity of the nucleotide sequences of LOC255177 BINDING SITE, designated SEQ ID:46203, to the nucleotide sequence of VGAM2434 RNA, herein designated VGAM RNA, also designated SEQ ID:5145.

Another function of VGAM2434 is therefore inhibition of LOC255177 (Accession XM_172941). Accordingly, utilities of VGAM2434 include diagnosis, prevention and treatment of diseases and clinical conditions associated with LOC255177. LOC255308 (Accession XM_170536) is another VGAM2434 host target gene. LOC255308 BINDING SITE is HOST TARGET binding site found in the 3' untranslated region of mRNA encoded by LOC255308, corresponding to a HOST TARGET binding site such as BINDING SITE I, BINDING SITE II or BINDING SITE III. Table 2 illustrates the complementarity of the nucleotide sequences of LOC255308 BINDING SITE, designated SEQ ID:45357, to the nucleotide sequence of VGAM2434 RNA, herein designated VGAM RNA, also designated SEQ ID:5145.

Another function of VGAM2434 is therefore inhibition of LOC255308 (Accession XM_170536). Accordingly, utilities of VGAM2434 include diagnosis, prevention and treatment of diseases and clinical conditions associated with LOC255308. LOC255919 (Accession XM_170794) is another VGAM2434 host target gene. LOC255919 BINDING SITE is HOST TARGET binding site found in the 3' untranslated region of mRNA encoded by LOC255919, corresponding to a HOST TARGET binding site such as BINDING SITE I, BINDING SITE II or BINDING SITE III. Table 2 illustrates the complementarity of the nucleotide sequences of LOC255919 BINDING SITE, designated SEQ ID:45555, to the nucleotide sequence of VGAM2434 RNA, herein designated VGAM RNA, also designated SEQ ID:5145.

Another function of VGAM2434 is therefore inhibition of LOC255919 (Accession XM_170794). Accordingly, utilities of VGAM2434 include diagnosis, prevention and treatment of diseases and clinical conditions associated with LOC255919. LOC256360 (Accession XM_172918) is another VGAM2434 host target gene. LOC256360 BINDING SITE is HOST TARGET binding site found in the 5' untranslated region of mRNA encoded by LOC256360, corresponding to a HOST TARGET binding site such as BINDING SITE I, BINDING SITE II or BINDING SITE III. Table 2 illustrates the complementarity of the nucleotide sequences of LOC256360 BINDING SITE, designated SEQ ID:46176, to the nucleotide sequence of VGAM2434 RNA, herein designated VGAM RNA, also designated SEQ ID:5145.

Another function of VGAM2434 is therefore inhibition of LOC256360 (Accession XM_172918). Accordingly, utilities of VGAM2434 include diagnosis, prevention and treatment of diseases and clinical conditions associated with LOC256360. LOC257463 (Accession XM_048605) is another VGAM2434 host target gene. LOC257463 BINDING SITE is HOST TARGET binding site found in the 3' untranslated region of mRNA encoded by LOC257463, corresponding to a HOST TARGET binding site such as BINDING SITE I, BINDING SITE II or BINDING SITE III. Table 2 illustrates the complementarity of the nucleotide sequences of LOC257463 BINDING SITE, designated SEQ ID:35212, to the nucleotide sequence of VGAM2434 RNA, herein designated VGAM RNA, also designated SEQ ID:5145.

Another function of VGAM2434 is therefore inhibition of LOC257463 (Accession XM_048605). Accordingly, utilities of VGAM2434 include diagnosis, prevention and treatment of diseases and clinical conditions associated with LOC257463. LOC51200 (Accession NM_016352) is another VGAM2434 host target gene. LOC51200 BINDING SITE is HOST TARGET binding site found in the 3' untranslated region of mRNA encoded by LOC51200, corresponding to a HOST TARGET binding site such as BINDING SITE I, BINDING SITE II or BINDING SITE III. Table 2 illustrates the complementarity of the nucleotide sequences of LOC51200 BINDING SITE, designated SEQ ID:18481, to the nucleotide sequence of VGAM2434 RNA, herein designated VGAM RNA, also designated SEQ ID:5145.

Another function of VGAM2434 is therefore inhibition of LOC51200 (Accession NM_016352). Accordingly, utilities of VGAM2434 include diagnosis, prevention and treatment of diseases and clinical conditions associated with LOC51200. LOC57107 (Accession NM_020381) is another VGAM2434 host target gene. LOC57107 BINDING SITE is HOST TARGET binding site found in the 3' untranslated region of mRNA encoded by LOC57107, corresponding to a HOST TARGET binding site such as BINDING SITE I, BINDING SITE II or BINDING SITE III. Table 2 illustrates the complementarity of the nucleotide sequences of LOC57107 BINDING SITE, designated SEQ ID:21653, to the nucleotide sequence of VGAM2434 RNA, herein designated VGAM RNA, also designated SEQ ID:5145.

Another function of VGAM2434 is therefore inhibition of LOC57107 (Accession NM_020381). Accordingly, utilities of VGAM2434 include diagnosis, prevention and treatment of diseases and clinical conditions associated with LOC57107. LOC57146 (Accession NM_020422) is another VGAM2434 host target gene. LOC57146 BINDING SITE is HOST TARGET binding site found in the 3' untranslated region of mRNA encoded by LOC57146, corresponding to a HOST TARGET binding site such as BINDING SITE I, BINDING SITE II or BINDING SITE III. Table 2 illustrates the complementarity of the nucleotide sequences of LOC57146 BINDING SITE, designated SEQ ID:21680, to the nucleotide sequence of VGAM2434 RNA, herein designated VGAM RNA, also designated SEQ ID:5145.

Another function of VGAM2434 is therefore inhibition of LOC57146 (Accession NM_020422). Accordingly, utilities of VGAM2434 include diagnosis, prevention and treatment of diseases and clinical conditions associated with LOC57146. LOC63929 (Accession NM_022098) is another VGAM2434 host target gene. LOC63929 BINDING SITE is HOST TARGET binding site found in the 3' untranslated region of mRNA encoded by LOC63929, corresponding to a HOST TARGET binding site such as BINDING SITE I, BINDING SITE II or BINDING SITE III. Table 2 illustrates the complementarity of the nucleotide sequences of LOC63929 BINDING SITE, designated SEQ ID:22640, to the nucleotide sequence of VGAM2434 RNA, herein designated VGAM RNA, also designated SEQ ID:5145.

Another function of VGAM2434 is therefore inhibition of LOC63929 (Accession NM_022098). Accordingly, utilities of VGAM2434 include diagnosis, prevention and treatment of diseases and clinical conditions associated with LOC63929. LOC89932 (Accession XM_027341) is another VGAM2434 host target gene. LOC89932 BINDING SITE is HOST TARGET binding site found in the 3' untranslated region of mRNA encoded by LOC89932, corresponding to a HOST TARGET binding site such as BINDING SITE I, BINDING SITE II or BINDING SITE III. Table 2 illustrates the complementarity of the nucleotide sequences of LOC89932 BINDING SITE, designated SEQ ID:30494, to the nucleotide sequence of VGAM2434 RNA, herein designated VGAM RNA, also designated SEQ ID:5145.

Another function of VGAM2434 is therefore inhibition of LOC89932 (Accession XM_027341). Accordingly, utilities of VGAM2434 include diagnosis, prevention and treatment of diseases and clinical conditions associated with LOC89932. LOC90288 (Accession XM_030669) is another VGAM2434 host target gene. LOC90288 BINDING SITE is HOST TARGET binding site found in the 3' untranslated region of mRNA encoded by LOC90288, corresponding to a HOST TARGET binding site such as BINDING SITE I, BINDING SITE II or BINDING SITE III. Table 2 illustrates the complementarity of the nucleotide sequences of LOC90288 BINDING SITE, designated SEQ ID:31116, to the nucleotide sequence of VGAM2434 RNA, herein designated VGAM RNA, also designated SEQ ID:5145.

Another function of VGAM2434 is therefore inhibition of LOC90288 (Accession XM_030669). Accordingly, utilities of VGAM2434 include diagnosis, prevention and treatment of diseases and clinical conditions associated with LOC90288. LOC90333 (Accession XM_030958) is another VGAM2434 host target gene. LOC90333 BINDING SITE is HOST TARGET binding site found in the 5' untranslated region of mRNA encoded by LOC90333, corresponding to a HOST TARGET binding site such as BINDING SITE I, BINDING SITE II or BINDING SITE III. Table 2 illustrates the complementarity of the nucleotide sequences of LOC90333 BINDING SITE, designated SEQ ID:31226, to the nucleotide sequence of VGAM2434 RNA, herein designated VGAM RNA, also designated SEQ ID:5145.

Another function of VGAM2434 is therefore inhibition of LOC90333 (Accession XM_030958). Accordingly, utilities of VGAM2434 include diagnosis, prevention and treatment of diseases and clinical conditions associated with LOC90333. LOC90371 (Accession XM_031261) is another VGAM2434 host target gene. LOC90371 BINDING SITE is HOST TARGET binding site found in the 5' untranslated region of mRNA encoded by LOC90371, corresponding to a HOST TARGET binding site such as BINDING SITE I, BINDING SITE II or BINDING SITE III. Table 2 illustrates the complementarity of the nucleotide sequences of LOC90371 BINDING SITE, designated SEQ ID:31323, to the nucleotide sequence of VGAM2434 RNA, herein designated VGAM RNA, also designated SEQ ID:5145.

Another function of VGAM2434 is therefore inhibition of LOC90371 (Accession XM_031261). Accordingly, utilities of VGAM2434 include diagnosis, prevention and treatment of diseases and clinical conditions associated with LOC90371. LOC90408 (Accession XM_031517) is another VGAM2434 host target gene. LOC90408 BINDING SITE is HOST TARGET binding site found in the 5' untranslated region of mRNA encoded by LOC90408, corresponding to a HOST TARGET binding site such as BINDING SITE I, BINDING SITE II or BINDING SITE III. Table 2 illustrates the complementarity of the nucleotide sequences of LOC90408 BINDING SITE, designated SEQ ID:31399, to the nucleotide sequence of VGAM2434 RNA, herein designated VGAM RNA, also designated SEQ ID:5145.

Another function of VGAM2434 is therefore inhibition of LOC90408 (Accession XM_031517). Accordingly, utilities of VGAM2434 include diagnosis, prevention and treatment of diseases and clinical conditions associated with LOC90408. LOC90485 (Accession XM_032059) is another VGAM2434 host target gene. LOC90485 BINDING SITE is HOST TARGET binding site found in the 3' untranslated region of mRNA encoded by LOC90485, corresponding to a HOST TARGET binding site such as BINDING SITE I, BINDING SITE II or BINDING SITE III. Table 2 illustrates the complementarity of the nucleotide sequences of LOC90485 BINDING SITE, designated SEQ ID:31555, to the nucleotide sequence of VGAM2434 RNA, herein designated VGAM RNA, also designated SEQ ID:5145.

Another function of VGAM2434 is therefore inhibition of LOC90485 (Accession XM_032059). Accordingly, utilities of VGAM2434 include diagnosis, prevention and treatment of diseases and clinical conditions associated with LOC90485. LOC91115 (Accession XM_036218) is another VGAM2434 host target gene. LOC91115 BINDING SITE is HOST TARGET binding site found in the 3' untranslated region of mRNA encoded by LOC91115, corresponding to a HOST TARGET binding site such as BINDING SITE I, BINDING SITE II or BINDING SITE III. Table 2 illustrates the complementarity of the nucleotide sequences of LOC91115 BINDING SITE, designated SEQ ID:32402, to the nucleotide sequence of VGAM2434 RNA, herein designated VGAM RNA, also designated SEQ ID:5145.

Another function of VGAM2434 is therefore inhibition of LOC91115 (Accession XM_036218). Accordingly, utilities of VGAM2434 include diagnosis, prevention and treatment of diseases and clinical conditions associated with LOC91115. LOC91308 (Accession XM_037600) is another VGAM2434 host target gene. LOC91308 BINDING SITE is HOST TARGET binding site found in the 3' untranslated region of mRNA encoded by LOC91308, corresponding to a HOST TARGET binding site such as BINDING SITE I, BINDING SITE II or BINDING SITE III. Table 2 illustrates the complementarity of the nucleotide sequences of LOC91308 BINDING SITE, designated SEQ ID:32658, to the nucleotide sequence of VGAM2434 RNA, herein designated VGAM RNA, also designated SEQ ID:5145.

Another function of VGAM2434 is therefore inhibition of LOC91308 (Accession XM_037600). Accordingly, utilities of VGAM2434 include diagnosis, prevention and treatment of diseases and clinical conditions associated with LOC91308. LOC92267 (Accession XM_043979) is another VGAM2434 host target gene. LOC92267 BINDING SITE is HOST TARGET binding site found in the 3' untranslated region of mRNA encoded by LOC92267, corresponding to a HOST TARGET binding site such as BINDING SITE I, BINDING SITE II or BINDING SITE III. Table 2 illustrates the complementarity of the nucleotide sequences of LOC92267 BINDING SITE, designated SEQ ID:34058, to the nucleotide sequence of VGAM2434 RNA, herein designated VGAM RNA, also designated SEQ ID:5145.

Another function of VGAM2434 is therefore inhibition of LOC92267 (Accession XM_043979). Accordingly, utilities of VGAM2434 include diagnosis, prevention and treatment of diseases and clinical conditions associated with LOC92267. LOC92303 (Accession XM_044108) is another VGAM2434 host target gene. LOC92303 BINDING SITE is HOST TARGET binding site found in the 3' untranslated region of mRNA encoded by LOC92303, corresponding to a HOST TARGET binding site such as BINDING SITE I, BINDING SITE II or BINDING SITE III. Table 2 illustrates the complementarity of the nucleotide sequences of LOC92303 BINDING SITE, designated SEQ ID:34136, to the nucleotide sequence of VGAM2434 RNA, herein designated VGAM RNA, also designated SEQ ID:5145.

Another function of VGAM2434 is therefore inhibition of LOC92303 (Accession XM_044108). Accordingly, utilities of VGAM2434 include diagnosis, prevention and treatment of diseases and clinical conditions associated with LOC92303. LOC92689 (Accession XM_046663) is another VGAM2434 host target gene. LOC92689 BINDING SITE is HOST TARGET binding site found in the 3' untranslated region of mRNA encoded by LOC92689, corresponding to a HOST TARGET binding site such as BINDING SITE I, BINDING SITE II or BINDING SITE III. Table 2 illustrates the complementarity of the nucleotide sequences of LOC92689 BINDING SITE, designated SEQ ID:34784, to the nucleotide sequence of VGAM2434 RNA, herein designated VGAM RNA, also designated SEQ ID:5145.

Another function of VGAM2434 is therefore inhibition of LOC92689 (Accession XM_046663). Accordingly, utilities of VGAM2434 include diagnosis, prevention and treatment of diseases and clinical conditions associated with LOC92689. LOC92697 (Accession XM_046715) is another VGAM2434 host target gene. LOC92697 BINDING SITE is HOST TARGET binding site found in the 5' untranslated region of mRNA encoded by LOC92697, corresponding to a HOST TARGET binding site such as BINDING SITE I, BINDING SITE II or BINDING SITE III. Table 2 illustrates the complementarity of the nucleotide sequences of LOC92697 BINDING SITE, designated SEQ ID:34805, to the nucleotide sequence of VGAM2434 RNA, herein designated VGAM RNA, also designated SEQ ID:5145.

Another function of VGAM2434 is therefore inhibition of LOC92697 (Accession XM_046715). Accordingly, utilities of VGAM2434 include diagnosis, prevention and treatment of diseases and clinical conditions associated with LOC92697. LOC93132 (Accession XM_049396) is another VGAM2434 host target gene. LOC93132 BINDING SITE is HOST TARGET binding site found in the 5' untranslated region of mRNA encoded by LOC93132, corresponding to a HOST TARGET binding site such as BINDING SITE I, BINDING SITE II or BINDING SITE III. Table 2 illustrates the complementarity of the nucleotide sequences of LOC93132 BINDING SITE, designated SEQ ID:35410, to the nucleotide sequence of VGAM2434 RNA, herein designated VGAM RNA, also designated SEQ ID:5145.

Another function of VGAM2434 is therefore inhibition of LOC93132 (Accession XM_049396). Accordingly, utilities of VGAM2434 include diagnosis, prevention and treatment of diseases and clinical conditions associated with LOC93132. FIG. 1 further provides a conceptual description of a novel bioinformatically detected viral gene of the present invention, referred to here as Viral Genomic Address Messenger 2435 (VGAM2435) viral gene, which modulates expression of respective host target genes thereof, the function and utility of which host target genes is known in the art.

VGAM2435 is a novel bioinformatically detected regulatory, non protein coding, viral micro RNA (miRNA) gene. The method by which VGAM2435 was detected is described hereinabove with reference to FIGS. 1-8.

VGAM2435 gene, herein designated VGAM GENE, is a viral gene contained in the genome of Goatpox Virus. VGAM2435 host target gene, herein designated VGAM HOST TARGET GENE, is a human gene contained in the human genome.

VGAM2435 gene encodes a VGAM2435 precursor RNA, herein designated VGAM PRECURSOR RNA. Similar to other miRNA genes, and unlike most ordinary genes, VGAM2435 precursor RNA does not encode a protein. A nucleotide sequence identical or highly similar to the nucleotide sequence of VGAM2435 precursor RNA is designated SEQ ID:2421, and is provided hereinbelow with reference to the sequence listing part. Nucleotide sequence SEQ ID:2421 is located at position 35753 relative to the genome of Goatpox Virus.

VGAM2435 precursor RNA folds onto itself, forming VGAM2435 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2435 folded precursor RNA into VGAM2435 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 59%) nucleotide sequence of VGAM2435 RNA is designated SEQ ID:5146, and is provided hereinbelow with reference to the sequence listing part.

VGAM2435 host target gene, herein designated VGAM HOST TARGET GENE, encodes a corresponding messenger RNA, VGAM2435 host target RNA, herein designated VGAM HOST TARGET RNA. VGAM2435 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2435 RNA, herein designated VGAM RNA, binds complementarily to one or more host target binding sites located in untranslated regions of VGAM2435 host target RNA, herein designated VGAM HOST TARGET RNA. This complementary binding is due to the fact that the nucleotide sequence of VGAM2435 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2435 RNA, herein designated VGAM RNA, may have a different number of host target binding sites in untranslated regions of a VGAM2435 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2435 RNA, herein designated VGAM RNA, to host target binding sites on VGAM2435 host target RNA, herein designated VGAM HOST TARGET RNA, such as BINDING SITE I, BINDING SITE II and BINDING SITE III, inhibits translation of VGAM2435 host target RNA into VGAM2435 host target protein, herein designated VGAM HOST TARGET PROTEIN. VGAM host target protein is therefore outlined by a broken line.

It is appreciated that VGAM2435 host target gene, herein designated VGAM HOST TARGET GENE, in fact represents a plurality of VGAM2435 host target genes. The mRNA of each one of this plurality of VGAM2435 host target genes comprises one or more host target binding sites, each having a nucleotide sequence which is at least partly complementary to VGAM2435 RNA, herein designated VGAM RNA, and which when bound by VGAM2435 RNA causes inhibition of translation of respective one or more VGAM2435 host target proteins.

It is further appreciated by one skilled in the art that the mode of translational inhibition illustrated by FIG. 1 with specific reference to translational inhibition exerted by VGAM2435 gene, herein designated VGAM GENE, on one or more VGAM2435 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2435 is inhibition of expression of host target genes, as part of a novel viral mechanism of attacking a host. Accordingly, utilities of VGAM2435 include diagnosis, prevention and treatment of viral infection by Goatpox Virus. Specific functions, and accordingly utilities, of VGAM2435 correlate with, and may be deduced from, the identity of the host target genes which VGAM2435 binds and inhibits, and the function of these host target genes, as elaborated hereinbelow.

Nucleotide sequences of the VGAM2435 precursor RNA, herein designated VGAM PRECURSOR RNA, and of the 'diced' VGAM2435 RNA, herein designated VGAM RNA, and a schematic representation of the secondary folding of VGAM2435 folded precursor RNA, herein designated VGAM FOLDED PRECURSOR RNA, of VGAM2435 are further described hereinbelow with reference to Table 1.

Nucleotide sequences of host target binding sites, such as BINDING SITE-I, BINDING SITE-II and BINDING SITE-III of FIG. 1, found on VGAM2435 host target RNA, and schematic representation of the complementarity of each of these host target binding sites to VGAM2435 RNA, herein designated VGAM RNA, are described hereinbelow with reference to Table 2.

As mentioned hereinabove with reference to FIG. 1, a function of VGAM2435 gene, herein designated VGAM is inhibition of expression of VGAM2435 target genes. It is appreciated that specific functions, and accordingly utilities, of VGAM2435 correlate with, and may be deduced from, the identity of the target genes which VGAM2435 binds and inhibits, and the function of these target genes, as elaborated hereinbelow.

Parkinson Disease (autosomal recessive, juvenile) 2, Parkin (PARK2, Accession NM_013987) is a VGAM2435 host target gene. PARK2 BINDING SITE1 through PARK2 BINDING SITE3 are HOST TARGET binding sites found in untranslated regions of mRNA encoded by PARK2, corresponding to HOST TARGET binding sites such as BINDING SITE I, BINDING SITE II or BINDING SITE III. Table 2 illustrates the complementarity of the nucleotide sequences of PARK2 BINDING SITE1 through PARK2 BINDING SITE3, designated SEQ ID:15150, SEQ ID:10903 and SEQ ID:15157 respectively, to the nucleotide sequence of VGAM2435 RNA, herein designated VGAM RNA, also designated SEQ ID:5146.

A function of VGAM2435 is therefore inhibition of Parkinson Disease (autosomal recessive, juvenile) 2, Parkin (PARK2, Accession NM_013987). Accordingly, utilities of VGAM2435 include diagnosis, prevention and treatment of diseases and clinical conditions associated with PARK2. DKFZP564G092 (Accession NM_015601) is another VGAM2435 host target gene. DKFZP564G092 BINDING SITE is HOST TARGET binding site found in the 5' untranslated region of mRNA encoded by DKFZP564G092, corresponding to a HOST TARGET binding site such as BINDING SITE I, BINDING SITE II or BINDING SITE III. Table 2 illustrates the complementarity of the nucleotide sequences of DKFZP564G092 BINDING SITE, designated SEQ ID:17875, to the nucleotide sequence of VGAM2435 RNA, herein designated VGAM RNA, also designated SEQ ID:5146.

Another function of VGAM2435 is therefore inhibition of DKFZP564G092 (Accession NM_015601). Accordingly, utilities of VGAM2435 include diagnosis, prevention and treatment of diseases and clinical conditions associated with DKFZP564G092. KIAA1271 (Accession XM_045472) is another VGAM2435 host target gene. KIAA1271 BINDING SITE is HOST TARGET binding site found in the 3' untranslated region of mRNA encoded by KIAA1271, corresponding to a HOST TARGET binding site such as BINDING SITE I, BINDING SITE II or BINDING SITE III. Table 2 illustrates the complementarity of the nucleotide sequences of KIAA1271 BINDING SITE, designated SEQ ID:34467, to the nucleotide sequence of VGAM2435 RNA, herein designated VGAM RNA, also designated SEQ ID:5146.

Another function of VGAM2435 is therefore inhibition of KIAA1271 (Accession XM_045472). Accordingly, utilities of VGAM2435 include diagnosis, prevention and treatment of diseases and clinical conditions associated with KIAA1271. LOC150333 (Accession XM_097874) is another VGAM2435 host target gene. LOC150333 BINDING SITE is HOST TARGET binding site found in the 5' untranslated region of mRNA encoded by LOC150333, corresponding to a HOST TARGET binding site such as BINDING SITE I, BINDING SITE II or BINDING SITE III. Table 2 illustrates the complementarity of the nucleotide sequences of LOC150333 BINDING SITE, designated SEQ ID:41195, to the nucleotide sequence of VGAM2435 RNA, herein designated VGAM RNA, also designated SEQ ID:5146.

Another function of VGAM2435 is therefore inhibition of LOC150333 (Accession XM_097874). Accordingly, utilities of VGAM2435 include diagnosis, prevention and treatment of diseases and clinical conditions associated with LOC150333. LOC254778 (Accession XM_171193) is another VGAM2435 host target gene. LOC254778 BINDING SITE is HOST TARGET binding site found in the 3' untranslated region of mRNA encoded by LOC254778, corresponding to a HOST TARGET binding site such as BINDING SITE I, BINDING SITE II or BINDING SITE III. Table 2 illustrates the complementarity of the nucleotide sequences of LOC254778 BINDING SITE, designated SEQ ID:45980, to the nucleotide sequence of VGAM2435 RNA, herein designated VGAM RNA, also designated SEQ ID:5146.

Another function of VGAM2435 is therefore inhibition of LOC254778 (Accession XM_171193). Accordingly, utilities of VGAM2435 include diagnosis, prevention and treatment of diseases and clinical conditions associated with LOC254778. FIG. 1 further provides a conceptual description of a novel bioinformatically detected viral gene of the present invention, referred to here as Viral Genomic Address Messenger 2436 (VGAM2436) viral gene, which modulates expression of respective host target genes thereof, the function and utility of which host target genes is known in the art.

VGAM2436 is a novel bioinformatically detected regulatory, non protein coding, viral micro RNA (miRNA) gene. The method by which VGAM2436 was detected is described hereinabove with reference to FIGS. 1-8.

VGAM2436 gene, herein designated VGAM GENE, is a viral gene contained in the genome of Goatpox Virus. VGAM2436 host target gene, herein designated VGAM HOST TARGET GENE, is a human gene contained in the human genome.

VGAM2436 gene encodes a VGAM2436 precursor RNA, herein designated VGAM PRECURSOR RNA. Similar to other miRNA genes, and unlike most ordinary genes, VGAM2436 precursor RNA does not encode a protein. A nucleotide sequence identical or highly similar to the nucleotide sequence of VGAM2436 precursor RNA is designated SEQ ID:2422, and is provided hereinbelow with reference to the sequence listing part. Nucleotide sequence SEQ ID:2422 is located at position 79755 relative to the genome of Goatpox Virus.

VGAM2436 precursor RNA folds onto itself, forming VGAM2436 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2436 folded precursor RNA into VGAM2436 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 66%) nucleotide sequence of VGAM2436 RNA is designated SEQ ID:5147, and is provided hereinbelow with reference to the sequence listing part.

VGAM2436 host target gene, herein designated VGAM HOST TARGET GENE, encodes a corresponding messenger RNA, VGAM2436 host target RNA, herein designated VGAM HOST TARGET RNA. VGAM2436 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2436 RNA, herein designated VGAM RNA, binds complementarily to one or more host target binding sites located in untranslated regions of VGAM2436 host target RNA, herein designated VGAM HOST TARGET RNA. This complementary binding is due to the fact that the nucleotide sequence of VGAM2436 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2436 RNA, herein designated VGAM RNA, may have a different number of host target binding sites in untranslated regions of a VGAM2436 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2436 RNA, herein designated VGAM RNA, to host target binding sites on VGAM2436 host target RNA, herein designated VGAM HOST TARGET RNA, such as BINDING SITE I, BINDING SITE II and BINDING SITE III, inhibits translation of VGAM2436 host target RNA into VGAM2436 host target protein, herein designated VGAM HOST TARGET PROTEIN. VGAM host target protein is therefore outlined by a broken line.

It is appreciated that VGAM2436 host target gene, herein designated VGAM HOST TARGET GENE, in fact represents a plurality of VGAM2436 host target genes. The mRNA of each one of this plurality of VGAM2436 host target genes comprises one or more host target binding sites, each having a nucleotide sequence which is at least partly complementary to VGAM2436 RNA, herein designated VGAM RNA, and which when bound by VGAM2436 RNA causes inhibition of translation of respective one or more VGAM2436 host target proteins.

It is further appreciated by one skilled in the art that the mode of translational inhibition illustrated by FIG. 1 with specific reference to translational inhibition exerted by VGAM2436 gene, herein designated VGAM GENE, on one or more VGAM2436 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2436 is inhibition of expression of host target genes, as part of a novel viral mechanism of attacking a host. Accordingly, utilities of VGAM2436 include diagnosis, prevention and treatment of viral infection by Goatpox Virus. Specific functions, and accordingly utilities, of VGAM2436 correlate with, and may be deduced from, the identity of the host target genes which VGAM2436 binds and inhibits, and the function of these host target genes, as elaborated hereinbelow.

Nucleotide sequences of the VGAM2436 precursor RNA, herein designated VGAM PRECURSOR RNA, and of the 'diced' VGAM2436 RNA, herein designated VGAM RNA, and a schematic representation of the secondary folding of VGAM2436 folded precursor RNA, herein designated VGAM FOLDED PRECURSOR RNA, of VGAM2436 are further described hereinbelow with reference to Table 1.

Nucleotide sequences of host target binding sites, such as BINDING SITE-I, BINDING SITE-II and BINDING SITE-III of FIG. 1, found on VGAM2436 host target RNA, and schematic representation of the complementarity of each of these host target binding sites to VGAM2436 RNA, herein designated VGAM RNA, are described hereinbelow with reference to Table 2.

As mentioned hereinabove with reference to FIG. 1, a function of VGAM2436 gene, herein designated VGAM is inhibition of expression of VGAM2436 target genes. It is appreciated that specific functions, and accordingly utilities, of VGAM2436 correlate with, and may be deduced from, the identity of the target genes which VGAM2436 binds and inhibits, and the function of these target genes, as elaborated hereinbelow.

Glutamate Receptor, Metabotropic 1 (GRM1, Accession NM_000838) is a VGAM2436 host target gene. GRM1 BINDING SITE is HOST TARGET binding site found in the 3' untranslated region of mRNA encoded by GRM1, corresponding to a HOST TARGET binding site such as BINDING SITE I, BINDING SITE II or BINDING SITE III. Table 2 illustrates the complementarity of the nucleotide sequences of GRM1 BINDING SITE, designated SEQ ID:6499, to the nucleotide sequence of VGAM2436 RNA, herein designated VGAM RNA, also designated SEQ ID:5147.

A function of VGAM2436 is therefore inhibition of Glutamate Receptor, Metabotropic 1 (GRM1, Accession NM_000838), a gene which promotes phosphoinositide hydrolysis. Accordingly, utilities of VGAM2436 include diagnosis, prevention and treatment of diseases and clinical conditions associated with GRM1. The function of GRM1 and its association with various diseases and clinical conditions, has been established by previous studies, as described hereinabove with reference to VGAM786. Inositol Hexaphosphate Kinase 3 (IHPK3, Accession NM_054111) is another VGAM2436 host target gene. IHPK3 BINDING SITE is HOST TARGET binding site found in the 5' untranslated region of mRNA encoded by IHPK3, corresponding to a HOST TARGET binding site such as BINDING SITE I, BINDING SITE II or BINDING SITE III. Table 2 illustrates the complementarity of the nucleotide sequences of IHPK3 BINDING SITE, designated SEQ ID:27660, to the nucleotide sequence of VGAM2436 RNA, herein designated VGAM RNA, also designated SEQ ID:5147.

Another function of VGAM2436 is therefore inhibition of Inositol Hexaphosphate Kinase 3 (IHPK3, Accession NM_054111). Accordingly, utilities of VGAM2436 include diagnosis, prevention and treatment of diseases and clinical conditions associated with IHPK3. Paired-like Homeodomain Transcription Factor 2 (PITX2, Accession NM_000325) is another VGAM2436 host target gene. PITX2 BINDING SITE is HOST TARGET binding site found in the 3' untranslated region of mRNA encoded by PITX2, corresponding to a HOST TARGET binding site such as BINDING SITE I, BINDING SITE II or BINDING SITE III. Table 2 illustrates the complementarity of the nucleotide sequences of PITX2 BINDING SITE, designated SEQ ID:5868, to the nucleotide sequence of VGAM2436 RNA, herein designated VGAM RNA, also designated SEQ ID:5147.

Another function of VGAM2436 is therefore inhibition of Paired-like Homeodomain Transcription Factor 2 (PITX2, Accession NM_000325). Accordingly, utilities of VGAM2436 include diagnosis, prevention and treatment of diseases and clinical conditions associated with PITX2. CEP3 (Accession NM_006449) is another VGAM2436 host target gene. CEP3 BINDING SITE is HOST TARGET binding site found in the 3' untranslated region of mRNA encoded by CEP3, corresponding to a HOST TARGET binding site such as BINDING SITE I, BINDING SITE II or BINDING SITE III. Table 2 illustrates the complementarity of the nucleotide sequences of CEP3 BINDING SITE, designated SEQ ID:13157, to the nucleotide sequence of VGAM2436 RNA, herein designated VGAM RNA, also designated SEQ ID:5147.

Another function of VGAM2436 is therefore inhibition of CEP3 (Accession NM_006449). Accordingly, utilities of VGAM2436 include diagnosis, prevention and treatment of diseases and clinical conditions associated with CEP3. CCR4-NOT Transcription Complex, Subunit 7 (CNOT7, Accession NM_013354) is another VGAM2436 host target gene. CNOT7 BINDING SITE is HOST TARGET binding site found in the 3' untranslated region of mRNA encoded by CNOT7, corresponding to a HOST TARGET binding site such as BINDING SITE I, BINDING SITE II or BINDING SITE III. Table 2 illustrates the complementarity of the nucleotide sequences of CNOT7 BINDING SITE, designated SEQ ID:15000, to the nucleotide sequence of VGAM2436 RNA, herein designated VGAM RNA, also designated SEQ ID:5147.

Another function of VGAM2436 is therefore inhibition of CCR4-NOT Transcription Complex, Subunit 7 (CNOT7, Accession NM_013354). Accordingly, utilities of VGAM2436 include diagnosis, prevention and treatment of diseases and clinical conditions associated with CNOT7. FLJ14440 (Accession NM_032784) is another VGAM2436 host target gene. FLJ14440 BINDING SITE is HOST TARGET binding site found in the 3' untranslated region of mRNA encoded by FLJ14440, corresponding to a HOST TARGET binding site such as BINDING SITE I, BINDING SITE II or BINDING SITE III. Table 2 illustrates the complementarity of the nucleotide sequences of FLJ14440 BINDING SITE, designated SEQ ID:26531, to the nucleotide sequence of VGAM2436 RNA, herein designated VGAM RNA, also designated SEQ ID:5147.

Another function of VGAM2436 is therefore inhibition of FLJ14440 (Accession NM_032784). Accordingly, utilities of VGAM2436 include diagnosis, prevention and treatment of diseases and clinical conditions associated with FLJ14440. GT650 (Accession NM_052851) is another VGAM2436 host target gene. GT650 BINDING SITE is HOST TARGET binding site found in the 3' untranslated region of mRNA encoded by GT650, corresponding to a HOST TARGET binding site such as BINDING SITE I, BINDING SITE II or BINDING SITE III. Table 2 illustrates the complementarity of the nucleotide sequences of GT650 BINDING SITE, designated SEQ ID:27432, to the nucleotide sequence of VGAM2436 RNA, herein designated VGAM RNA, also designated SEQ ID:5147.

Another function of VGAM2436 is therefore inhibition of GT650 (Accession NM_052851). Accordingly, utilities of VGAM2436 include diagnosis, prevention and treatment of diseases and clinical conditions associated with GT650. KIAA0332 (Accession XM_031553) is another VGAM2436 host target gene. KIAA0332 BINDING SITE is HOST TARGET binding site found in the 3' untranslated region of mRNA encoded by KIAA0332, corresponding to a HOST TARGET binding site such as BINDING SITE I, BINDING SITE II or BINDING SITE III. Table 2 illustrates the complementarity of the nucleotide sequences of KIAA0332 BINDING SITE, designated SEQ ID:31422, to the nucleotide sequence of VGAM2436 RNA, herein designated VGAM RNA, also designated SEQ ID:5147.

Another function of VGAM2436 is therefore inhibition of KIAA0332 (Accession XM_031553). Accordingly, utilities of VGAM2436 include diagnosis, prevention and treatment of diseases and clinical conditions associated with KIAA0332. KIAA1458 (Accession XM_044434) is another VGAM2436 host target gene. KIAA1458 BINDING SITE is HOST TARGET binding site found in the 3' untranslated region of mRNA encoded by KIAA1458, corresponding to a HOST TARGET binding site such as BINDING SITE I, BINDING SITE II or BINDING SITE III. Table 2 illustrates the complementarity of the nucleotide sequences of KIAA1458 BINDING SITE, designated SEQ ID:34205, to the nucleotide sequence of VGAM2436 RNA, herein designated VGAM RNA, also designated SEQ ID:5147.

Another function of VGAM2436 is therefore inhibition of KIAA1458 (Accession XM_044434). Accordingly, utilities of VGAM2436 include diagnosis, prevention and treatment of diseases and clinical conditions associated with KIAA1458. KIAA1813 (Accession XM_046743) is another VGAM2436 host target gene. KIAA1813 BINDING SITE is HOST TARGET binding site found in the 5' untranslated region of mRNA encoded by KIAA1813, corresponding to a HOST TARGET binding site such as BINDING SITE I, BINDING SITE II or BINDING SITE III. Table 2 illustrates the complementarity of the nucleotide sequences of KIAA1813 BINDING SITE, designated SEQ ID:34814, to the nucleotide sequence of VGAM2436 RNA, herein designated VGAM RNA, also designated SEQ ID:5147.

Another function of VGAM2436 is therefore inhibition of KIAA1813 (Accession XM_046743). Accordingly, utilities of VGAM2436 include diagnosis, prevention and treatment of diseases and clinical conditions associated with KIAA1813. MGC16703 (Accession XM_054591) is another VGAM2436 host target gene. MGC16703 BINDING SITE is HOST TARGET binding site found in the 3' untranslated region of mRNA encoded by MGC16703, corresponding to a HOST TARGET binding site such as BINDING SITE I, BINDING SITE II or BINDING SITE III. Table 2 illustrates the complementarity of the nucleotide sequences of MGC16703 BINDING SITE, designated SEQ ID:36180, to the nucleotide sequence of VGAM2436 RNA, herein designated VGAM RNA, also designated SEQ ID:5147.

Another function of VGAM2436 is therefore inhibition of MGC16703 (Accession XM_054591). Accordingly, utilities of VGAM2436 include diagnosis, prevention and treatment of diseases and clinical conditions associated with MGC16703. PRO0255 (Accession NM_014124) is another VGAM2436 host target gene. PRO0255 BINDING SITE is HOST TARGET binding site found in the 3' untranslated region of mRNA encoded by PRO0255, corresponding to a HOST TARGET binding site such as BINDING SITE I, BINDING SITE II or BINDING SITE III. Table 2 illustrates the complementarity of the nucleotide sequences of PRO0255 BINDING SITE, designated SEQ ID:15383, to the nucleotide sequence of VGAM2436 RNA, herein designated VGAM RNA, also designated SEQ ID:5147.

Another function of VGAM2436 is therefore inhibition of PRO0255 (Accession NM_014124). Accordingly, utilities of VGAM2436 include diagnosis, prevention and treatment of diseases and clinical conditions associated with PRO0255. LOC162239 (Accession XM_091439) is another VGAM2436 host target gene. LOC162239 BINDING SITE is HOST TARGET binding site found in the 3' untranslated region of mRNA encoded by LOC162239, corresponding to a HOST TARGET binding site such as BINDING SITE I, BINDING SITE II or BINDING SITE III. Table 2 illustrates the complementarity of the nucleotide sequences of LOC162239 BINDING SITE, designated SEQ ID:40054, to the nucleotide sequence of VGAM2436 RNA, herein designated VGAM RNA, also designated SEQ ID:5147.

Another function of VGAM2436 is therefore inhibition of LOC162239 (Accession XM_091439). Accordingly, utilities of VGAM2436 include diagnosis, prevention and treatment of diseases and clinical conditions associated with LOC162239. LOC254848 (Accession XM_173133) is another VGAM2436 host target gene. LOC254848 BINDING SITE is HOST TARGET binding site found in the 5' untranslated region of mRNA encoded by LOC254848, corresponding to a HOST TARGET binding site such as BINDING SITE I, BINDING SITE II or BINDING SITE III. Table 2 illustrates the complementarity of the nucleotide sequences of LOC254848 BINDING SITE, designated SEQ ID:46383, to the nucleotide sequence of VGAM2436 RNA, herein designated VGAM RNA, also designated SEQ ID:5147.

Another function of VGAM2436 is therefore inhibition of LOC254848 (Accession XM_173133). Accordingly, utilities of VGAM2436 include diagnosis, prevention and treatment of diseases and clinical conditions associated with LOC254848. LOC257443 (Accession XM_171072) is another VGAM2436 host target gene. LOC257443 BINDING SITE is HOST TARGET binding site found in the 3' untranslated region of mRNA encoded by LOC257443, corresponding to a HOST TARGET binding site such as BINDING SITE I, BINDING SITE II or BINDING SITE III. Table 2 illustrates the complementarity of the nucleotide sequences of LOC257443 BINDING SITE, designated SEQ ID:45873, to the nucleotide sequence of VGAM2436 RNA, herein designated VGAM RNA, also designated SEQ ID:5147.

Another function of VGAM2436 is therefore inhibition of LOC257443 (Accession XM_171072). Accordingly, utilities of VGAM2436 include diagnosis, prevention and treatment of diseases and clinical conditions associated with LOC257443. FIG. 1 further provides a conceptual description of a novel bioinformatically detected viral gene of the present invention, referred to here as Viral Genomic Address Messenger 2437 (VGAM2437) viral gene, which modulates expression of respective host target genes thereof, the function and utility of which host target genes is known in the art.

VGAM2437 is a novel bioinformatically detected regulatory, non protein coding, viral micro RNA (miRNA) gene. The method by which VGAM2437 was detected is described hereinabove with reference to FIGS. 1-8.

VGAM2437 gene, herein designated VGAM GENE, is a viral gene contained in the genome of Goatpox Virus. VGAM2437 host target gene, herein designated VGAM HOST TARGET GENE, is a human gene contained in the human genome.

VGAM2437 gene encodes a VGAM2437 precursor RNA, herein designated VGAM PRECURSOR RNA. Similar to other miRNA genes, and unlike most ordinary genes, VGAM2437 precursor RNA does not encode a protein. A nucleotide sequence identical or highly similar to the nucleotide sequence of VGAM2437 precursor RNA is designated SEQ ID:2423, and is provided hereinbelow with reference to the sequence listing part. Nucleotide sequence SEQ ID:2423 is located at position 32976 relative to the genome of Goatpox Virus.

VGAM2437 precursor RNA folds onto itself, forming VGAM2437 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2437 folded precursor RNA into VGAM2437 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2437 RNA is designated SEQ ID:5148, and is provided hereinbelow with reference to the sequence listing part.

VGAM2437 host target gene, herein designated VGAM HOST TARGET GENE, encodes a corresponding messenger RNA, VGAM2437 host target RNA, herein designated VGAM HOST TARGET RNA. VGAM2437 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2437 RNA, herein designated VGAM RNA, binds complementarily to one or more host target binding sites located in untranslated regions of VGAM2437 host target RNA, herein designated VGAM HOST TARGET RNA. This complementary binding is due to the fact that the nucleotide sequence of VGAM2437 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2437 RNA, herein designated VGAM RNA, may have a different number of host target binding sites in untranslated regions of a VGAM2437 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2437 RNA, herein designated VGAM RNA, to host target binding sites on VGAM2437 host target RNA, herein designated VGAM HOST TARGET RNA, such as BINDING SITE I, BINDING SITE II and BINDING SITE III, inhibits translation of VGAM2437 host target RNA into VGAM2437 host target protein, herein designated VGAM HOST TARGET PROTEIN. VGAM host target protein is therefore outlined by a broken line.

It is appreciated that VGAM2437 host target gene, herein designated VGAM HOST TARGET GENE, in fact represents a plurality of VGAM2437 host target genes. The mRNA of each one of this plurality of VGAM2437 host target genes comprises one or more host target binding sites, each having a nucleotide sequence which is at least partly complementary to VGAM2437 RNA, herein designated VGAM RNA, and which when bound by VGAM2437 RNA causes inhibition of translation of respective one or more VGAM2437 host target proteins.

It is further appreciated by one skilled in the art that the mode of translational inhibition illustrated by FIG. 1 with specific reference to translational inhibition exerted by VGAM2437 gene, herein designated VGAM GENE, on one or more VGAM2437 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2437 is inhibition of expression of host target genes, as part of a novel viral mechanism of attacking a host. Accordingly, utilities of VGAM2437 include diagnosis, prevention and treatment of viral infection by Goatpox Virus. Specific functions, and accordingly utilities, of VGAM2437 correlate with, and may be deduced from, the identity of the host target genes which VGAM2437 binds and inhibits, and the function of these host target genes, as elaborated hereinbelow.

Nucleotide sequences of the VGAM2437 precursor RNA, herein designated VGAM PRECURSOR RNA, and of the 'diced' VGAM2437 RNA, herein designated VGAM RNA, and a schematic representation of the secondary folding of VGAM2437 folded precursor RNA, herein designated VGAM FOLDED PRECURSOR RNA, of VGAM2437 are further described hereinbelow with reference to Table 1.

Nucleotide sequences of host target binding sites, such as BINDING SITE-I, BINDING SITE-II and BINDING SITE-III of FIG. 1, found on VGAM2437 host target RNA, and schematic representation of the complementarity of each of these host target binding sites to VGAM2437 RNA, herein designated VGAM RNA, are described hereinbelow with reference to Table 2.

As mentioned hereinabove with reference to FIG. 1, a function of VGAM2437 gene, herein designated VGAM is inhibition of expression of VGAM2437 target genes. It is appreciated that specific functions, and accordingly utilities, of VGAM2437 correlate with, and may be deduced from, the identity of the target genes which VGAM2437 binds and inhibits, and the function of these target genes, as elaborated hereinbelow.

FLJ23189 (Accession NM_025057) is a VGAM2437 host target gene. FLJ23189 BINDING SITE is HOST TARGET binding site found in the 3' untranslated region of mRNA encoded by FLJ23189, corresponding to a HOST TARGET binding site such as BINDING SITE I, BINDING SITE II or BINDING SITE III. Table 2 illustrates the complementarity of the nucleotide sequences of FLJ23189 BINDING SITE, designated SEQ ID:24658, to the nucleotide sequence of VGAM2437 RNA, herein designated VGAM RNA, also designated SEQ ID:5148.

A function of VGAM2437 is therefore inhibition of FLJ23189 (Accession NM_025057). Accordingly, utilities of VGAM2437 include diagnosis, prevention and treatment of diseases and clinical conditions associated with FLJ23189. PC4 (Accession NM_006713) is another VGAM2437 host target gene. PC4 BINDING SITE is HOST TARGET binding site found in the 3' untranslated region of mRNA encoded by PC4, corresponding to a HOST TARGET binding site such as BINDING SITE I, BINDING SITE II or BINDING SITE III. Table 2 illustrates the complementarity of the nucleotide sequences of PC4 BINDING SITE, designated SEQ ID:13540, to the nucleotide sequence of VGAM2437 RNA, herein designated VGAM RNA, also designated SEQ ID:5148.

Another function of VGAM2437 is therefore inhibition of PC4 (Accession NM_006713). Accordingly, utilities of VGAM2437 include diagnosis, prevention and treatment of diseases and clinical conditions associated with PC4. FIG. 1 further provides a conceptual description of a novel bioinformatically detected viral gene of the present invention, referred to here as Viral Genomic Address Messenger 2438 (VGAM2438) viral gene, which modulates expression of respective host target genes thereof, the function and utility of which host target genes is known in the art.

VGAM2438 is a novel bioinformatically detected regulatory, non protein coding, viral micro RNA (miRNA) gene. The method by which VGAM2438 was detected is described hereinabove with reference to FIGS. 1-8.

VGAM2438 gene, herein designated VGAM GENE, is a viral gene contained in the genome of Goatpox Virus. VGAM2438 host target gene, herein designated VGAM HOST TARGET GENE, is a human gene contained in the human genome.

VGAM2438 gene encodes a VGAM2438 precursor RNA, herein designated VGAM PRECURSOR RNA. Similar to other miRNA genes, and unlike most ordinary genes, VGAM2438 precursor RNA does not encode a protein. A nucleotide sequence identical or highly similar to the nucleotide sequence of VGAM2438 precursor RNA is designated SEQ ID:2424, and is provided hereinbelow with reference to the sequence listing part. Nucleotide sequence SEQ ID:2424 is located at position 88305 relative to the genome of Goatpox Virus.

VGAM2438 precursor RNA folds onto itself, forming VGAM2438 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2438 folded precursor RNA into VGAM2438 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2438 RNA is designated SEQ ID:5149, and is provided hereinbelow with reference to the sequence listing part.

VGAM2438 host target gene, herein designated VGAM HOST TARGET GENE, encodes a corresponding messenger RNA, VGAM2438 host target RNA, herein designated VGAM HOST TARGET RNA. VGAM2438 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2438 RNA, herein designated VGAM RNA, binds complementarily to one or more host target binding sites located in untranslated regions of VGAM2438 host target RNA, herein designated VGAM HOST TARGET RNA. This complementary binding is due to the fact that the nucleotide sequence of VGAM2438 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2438 RNA, herein designated VGAM RNA, may have a different number of host target binding sites in untranslated regions of a VGAM2438 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2438 RNA, herein designated VGAM RNA, to host target binding sites on VGAM2438 host target RNA, herein designated VGAM HOST TARGET RNA, such as BINDING SITE I, BINDING SITE II and BINDING SITE III, inhibits translation of VGAM2438 host target RNA into VGAM2438 host target protein, herein designated VGAM HOST TARGET PROTEIN. VGAM host target protein is therefore outlined by a broken line.

It is appreciated that VGAM2438 host target gene, herein designated VGAM HOST TARGET GENE, in fact represents a plurality of VGAM2438 host target genes. The mRNA of each one of this plurality of VGAM2438 host target genes comprises one or more host target binding sites, each having a nucleotide sequence which is at least partly complementary to VGAM2438 RNA, herein designated VGAM RNA, and which when bound by VGAM2438 RNA causes inhibition of translation of respective one or more VGAM2438 host target proteins.

It is further appreciated by one skilled in the art that the mode of translational inhibition illustrated by FIG. 1 with specific reference to translational inhibition exerted by VGAM2438 gene, herein designated VGAM GENE, on one or more VGAM2438 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2438 is inhibition of expression of host target genes, as part of a novel viral mechanism of attacking a host. Accordingly, utilities of VGAM2438 include diagnosis, prevention and treatment of viral infection by Goatpox Virus. Specific functions, and accordingly utilities, of VGAM2438 correlate with, and may be deduced from, the identity of the host target genes which VGAM2438 binds and inhibits, and the function of these host target genes, as elaborated hereinbelow.

Nucleotide sequences of the VGAM2438 precursor RNA, herein designated VGAM PRECURSOR RNA, and of the 'diced' VGAM2438 RNA, herein designated VGAM RNA, and a schematic representation of the secondary folding of VGAM2438 folded precursor RNA, herein designated VGAM FOLDED PRECURSOR RNA, of VGAM2438 are further described hereinbelow with reference to Table 1.

Nucleotide sequences of host target binding sites, such as BINDING SITE-I, BINDING SITE-II and BINDING SITE-III of FIG. 1, found on VGAM2438 host target RNA, and schematic representation of the complementarity of each of these host target binding sites to VGAM2438 RNA, herein designated VGAM RNA, are described hereinbelow with reference to Table 2.

As mentioned hereinabove with reference to FIG. 1, a function of VGAM2438 gene, herein designated VGAM is inhibition of expression of VGAM2438 target genes. It is appreciated that specific functions, and accordingly utilities, of VGAM2438 correlate with, and may be deduced from, the identity of the target genes which VGAM2438 binds and inhibits, and the function of these target genes, as elaborated hereinbelow.

Calcium Channel, Voltage-dependent, L Type, Alpha 1C Subunit (CACNA1C, Accession NM_000719) is a VGAM2438 host target gene. CACNA1C BINDING SITE is HOST TARGET binding site found in the 5' untranslated region of mRNA encoded by CACNA1C, corresponding to a HOST TARGET binding site such as BINDING SITE I, BINDING SITE II or BINDING SITE III. Table 2 illustrates the complementarity of the nucleotide sequences of CACNA1C BINDING SITE, designated SEQ ID:6379, to the nucleotide sequence of VGAM2438 RNA, herein designated VGAM RNA, also designated SEQ ID:5149.

A function of VGAM2438 is therefore inhibition of Calcium Channel, Voltage-dependent, L Type, Alpha 1C Subunit (CACNA1C, Accession NM_000719), a gene which is alpha-1 subunit of DHP-sensitive calcium channels from cardiac muscle and the brain. Accordingly, utilities of VGAM2438 include diagnosis, prevention and treatment of diseases and clinical conditions associated with CACNA1C. The function of CACNA1C and its association with various diseases and clinical conditions, has been established by previous studies, as described hereinabove with reference to VGAM182. CREBBP/EP300 Inhibitory Protein 1 (CRI1, Accession NM_014335) is another VGAM2438 host target gene. CRI1 BINDING SITE is HOST TARGET binding site found in the 3' untranslated region of mRNA encoded by CRI1, corresponding to a HOST TARGET binding site such as BINDING SITE I, BINDING SITE II or BINDING SITE III. Table 2 illustrates the complementarity of the nucleotide sequences of CRI1 BINDING SITE, designated SEQ ID:15648, to the nucleotide sequence of VGAM2438 RNA, herein designated VGAM RNA, also designated SEQ ID:5149.

Another function of VGAM2438 is therefore inhibition of CREBBP/EP300 Inhibitory Protein 1 (CRI1, Accession NM_014335), a gene which regulates cell cycle as well as tissue-specific transcription and differentiation. Accordingly, utilities of VGAM2438 include diagnosis, prevention and treatment of diseases and clinical conditions associated with CRI1. The function of CRI1 and its association with various diseases and clinical conditions, has been established by previous studies, as described hereinabove with reference to VGAM122. Fibroblast Growth Factor 7 (keratinocyte growth factor) (FGF7, Accession NM_002009) is another VGAM2438 host target gene. FGF7 BINDING SITE is HOST TARGET binding site found in the 3' untranslated region of mRNA encoded by FGF7, corresponding to a HOST TARGET binding site such as BINDING SITE I, BINDING SITE II or BINDING SITE III. Table 2 illustrates the complementarity of the nucleotide sequences of FGF7 BINDING SITE, designated SEQ ID:7749, to the nucleotide sequence of VGAM2438 RNA, herein designated VGAM RNA, also designated SEQ ID:5149.

Another function of VGAM2438 is therefore inhibition of Fibroblast Growth Factor 7 (keratinocyte growth factor) (FGF7, Accession NM_002009), a gene which growth factor active on keratinocytes. Accordingly, utilities of VGAM2438 include diagnosis, prevention and treatment of diseases and clinical conditions associated with FGF7. The function of FGF7 and its association with various diseases and clinical conditions, has been established by previous studies, as described hereinabove with reference to VGAM678. Stearoyl-CoA Desaturase (delta-9-desaturase) (SCD, Accession NM_005063) is another VGAM2438 host target gene. SCD BINDING SITE is HOST TARGET binding site found in the 3' untranslated region of mRNA encoded by SCD, corresponding to a HOST TARGET binding site such as BINDING SITE I, BINDING SITE II or BINDING SITE III. Table 2 illustrates the complementarity of the nucleotide sequences of SCD BINDING SITE, designated SEQ ID:11488, to the nucleotide sequence of VGAM2438 RNA, herein designated VGAM RNA, also designated SEQ ID:5149.

Another function of VGAM2438 is therefore inhibition of Stearoyl-CoA Desaturase (delta-9-desaturase) (SCD, Accession NM_005063), a gene which functions in the synthesis of unsaturated fatty acids. Accordingly, utilities of VGAM2438 include diagnosis, prevention and treatment of diseases and clinical conditions associated with SCD. The function of SCD and its association with various diseases and clinical conditions, has been established by previous studies, as described hereinabove with reference to VGAM314. FLJ10508 (Accession NM_018118) is another VGAM2438 host target gene. FLJ10508 BINDING SITE is HOST TARGET binding site found in the 5' untranslated region of mRNA encoded by FLJ10508, corresponding to a HOST TARGET binding site such as BINDING SITE I, BINDING SITE II or BINDING SITE III. Table 2 illustrates the complementarity of the nucleotide sequences of FLJ10508 BINDING SITE, designated SEQ ID:19892, to the nucleotide sequence of VGAM2438 RNA, herein designated VGAM RNA, also designated SEQ ID:5149.

Another function of VGAM2438 is therefore inhibition of FLJ10508 (Accession NM_018118). Accordingly, utilities of VGAM2438 include diagnosis, prevention and treatment of diseases and clinical conditions associated with FLJ10508. FLJ21106 (Accession NM_025097) is another VGAM2438 host target gene. FLJ21106 BINDING SITE is HOST TARGET binding site found in the 5' untranslated region of mRNA encoded by FLJ21106, corresponding to a HOST TARGET binding site such as BINDING SITE I, BINDING SITE II or BINDING SITE III. Table 2 illustrates the complementarity of the nucleotide sequences of FLJ21106 BINDING SITE, designated SEQ ID:24735, to the nucleotide sequence of VGAM2438 RNA, herein designated VGAM RNA, also designated SEQ ID:5149.

Another function of VGAM2438 is therefore inhibition of FLJ21106 (Accession NM_025097). Accordingly, utilities of VGAM2438 include diagnosis, prevention and treatment of diseases and clinical conditions associated with FLJ21106. KIAA0918 (Accession XM_054869) is another VGAM2438 host target gene. KIAA0918 BINDING SITE is HOST TARGET binding site found in the 3' untranslated region of mRNA encoded by KIAA0918, corresponding to a HOST TARGET binding site such as BINDING SITE I, BINDING SITE II or BINDING SITE III. Table 2 illustrates the complementarity of the nucleotide sequences of KIAA0918 BINDING SITE, designated SEQ ID:36197, to the nucleotide sequence of VGAM2438 RNA, herein designated VGAM RNA, also designated SEQ ID:5149.

Another function of VGAM2438 is therefore inhibition of KIAA0918 (Accession XM_054869). Accordingly, utilities of VGAM2438 include diagnosis, prevention and treatment of diseases and clinical conditions associated with KIAA0918. KIAA1750 (Accession XM_043067) is another VGAM2438 host target gene. KIAA1750 BINDING SITE is HOST TARGET binding site found in the 3' untranslated region of mRNA encoded by KIAA1750, corresponding to a HOST TARGET binding site such as BINDING SITE I, BINDING SITE II or BINDING SITE III. Table 2 illustrates the complementarity of the nucleotide sequences of KIAA1750 BINDING SITE, designated SEQ ID:33872, to the nucleotide sequence of VGAM2438 RNA, herein designated VGAM RNA, also designated SEQ ID:5149.

Another function of VGAM2438 is therefore inhibition of KIAA1750 (Accession XM_043067). Accordingly, utilities of VGAM2438 include diagnosis, prevention and treatment of diseases and clinical conditions associated with KIAA1750. PC326 (Accession NM_018442) is another VGAM2438 host target gene. PC326 BINDING SITE is HOST TARGET binding site found in the 5' untranslated region of mRNA encoded by PC326, corresponding to a HOST TARGET binding site such as BINDING SITE I, BINDING SITE II or BINDING SITE III. Table 2 illustrates the complementarity of the nucleotide sequences of PC326 BINDING SITE, designated SEQ ID:20513, to the nucleotide sequence of VGAM2438 RNA, herein designated VGAM RNA, also designated SEQ ID:5149.

Another function of VGAM2438 is therefore inhibition of PC326 (Accession NM_018442). Accordingly, utilities of VGAM2438 include diagnosis, prevention and treatment of diseases and clinical conditions associated with PC326. Signal Transducing Adaptor Molecule (SH3 domain and ITAM motif) 2 (STAM2, Accession NM_005843) is another VGAM2438 host target gene. STAM2 BINDING SITE is HOST TARGET binding site found in the 3' untranslated region of mRNA encoded by STAM2, corresponding to a HOST TARGET binding site such as BINDING SITE I, BINDING SITE II or BINDING SITE III. Table 2 illustrates the complementarity of the nucleotide sequences of STAM2 BINDING SITE, designated SEQ ID:12458, to the nucleotide sequence of VGAM2438 RNA, herein designated VGAM RNA, also designated SEQ ID:5149.

Another function of VGAM2438 is therefore inhibition of Signal Transducing Adaptor Molecule (SH3 domain and ITAM motif) 2 (STAM2, Accession NM_005843). Accordingly, utilities of VGAM2438 include diagnosis, prevention and treatment of diseases and clinical conditions associated with STAM2. LOC122830 (Accession XM_058661) is another VGAM2438 host target gene. LOC122830 BINDING SITE is HOST TARGET binding site found in the 3' untranslated region of mRNA encoded by LOC122830, corresponding to a HOST TARGET binding site such as BINDING SITE I, BINDING SITE II or BINDING SITE III. Table 2 illustrates the complementarity of the nucleotide sequences of LOC122830 BINDING SITE, designated SEQ ID:36704, to the nucleotide sequence of VGAM2438 RNA, herein designated VGAM RNA, also designated SEQ ID:5149.

Another function of VGAM2438 is therefore inhibition of LOC122830 (Accession XM_058661). Accordingly, utilities of VGAM2438 include diagnosis, prevention and treatment of diseases and clinical conditions associated with LOC122830. LOC147649 (Accession XM_085830) is another VGAM2438 host target gene. LOC147649 BINDING SITE is HOST TARGET binding site found in the 3' untranslated region of mRNA encoded by LOC147649, corresponding to a HOST TARGET binding site such as BINDING SITE I, BINDING SITE II or BINDING SITE III. Table 2 illustrates the complementarity of the nucleotide sequences of LOC147649 BINDING SITE, designated SEQ ID:38355, to the nucleotide sequence of VGAM2438 RNA, herein designated VGAM RNA, also designated SEQ ID:5149.

Another function of VGAM2438 is therefore inhibition of LOC147649 (Accession XM_085830). Accordingly, utilities of VGAM2438 include diagnosis, prevention and treatment of diseases and clinical conditions associated with LOC147649. LOC158116 (Accession XM_016240) is another VGAM2438 host target gene. LOC158116 BINDING SITE is HOST TARGET binding site found in the 3' untranslated region of mRNA encoded by LOC158116, corresponding to a HOST TARGET binding site such as BINDING SITE I, BINDING SITE II or BINDING SITE III. Table 2 illustrates the complementarity of the nucleotide sequences of LOC158116 BINDING SITE, designated SEQ ID:30252, to the nucleotide sequence of VGAM2438 RNA, herein designated VGAM RNA, also designated SEQ ID:5149.

Another function of VGAM2438 is therefore inhibition of LOC158116 (Accession XM_016240). Accordingly, utilities of VGAM2438 include diagnosis, prevention and treatment of diseases and clinical conditions associated with LOC158116. LOC257464 (Accession XM_116972) is another VGAM2438 host target gene. LOC257464 BINDING SITE is HOST TARGET binding site found in the 3' untranslated region of mRNA encoded by LOC257464, corresponding to a HOST TARGET binding site such as BINDING SITE I, BINDING SITE II or BINDING SITE III. Table 2 illustrates the complementarity of the nucleotide sequences of LOC257464 BINDING SITE, designated SEQ ID:43164, to the nucleotide sequence of VGAM2438 RNA, herein designated VGAM RNA, also designated SEQ ID:5149.

Another function of VGAM2438 is therefore inhibition of LOC257464 (Accession XM_116972). Accordingly, utilities of VGAM2438 include diagnosis, prevention and treatment of diseases and clinical conditions associated with LOC257464. LOC90092 (Accession XM_028862) is another VGAM2438 host target gene. LOC90092 BINDING SITE is HOST TARGET binding site found in the 5' untranslated region of mRNA encoded by LOC90092, corresponding to a HOST TARGET binding site such as BINDING SITE I, BINDING SITE II or BINDING SITE III. Table 2 illustrates the complementarity of the nucleotide sequences of LOC90092 BINDING SITE, designated SEQ ID:30785, to the nucleotide sequence of VGAM2438 RNA, herein designated VGAM RNA, also designated SEQ ID:5149.

Another function of VGAM2438 is therefore inhibition of LOC90092 (Accession XM_028862). Accordingly, utilities of VGAM2438 include diagnosis, prevention and treatment of diseases and clinical conditions associated with LOC90092. FIG. 1 further provides a conceptual description of a novel bioinformatically detected viral gene of the present invention, referred to here as Viral Genomic Address Messenger 2439 (VGAM2439) viral gene, which modulates expression of respective host target genes thereof, the function and utility of which host target genes is known in the art.

VGAM2439 is a novel bioinformatically detected regulatory, non protein coding, viral micro RNA (miRNA) gene. The method by which VGAM2439 was detected is described hereinabove with reference to FIGS. 1-8.

VGAM2439 gene, herein designated VGAM GENE, is a viral gene contained in the genome of Goatpox Virus. VGAM2439 host target gene, herein designated VGAM HOST TARGET GENE, is a human gene contained in the human genome.

VGAM2439 gene encodes a VGAM2439 precursor RNA, herein designated VGAM PRECURSOR RNA. Similar to other miRNA genes, and unlike most ordinary genes, VGAM2439 precursor RNA does not encode a protein. A nucleotide sequence identical or highly similar to the nucleotide sequence of VGAM2439 precursor RNA is designated SEQ ID:2425, and is provided hereinbelow with reference to the sequence listing part. Nucleotide sequence SEQ ID:2425 is located at position 129653 relative to the genome of Goatpox Virus.

VGAM2439 precursor RNA folds onto itself, forming VGAM2439 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2439 folded precursor RNA into VGAM2439 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2439 RNA is designated SEQ ID:5150, and is provided hereinbelow with reference to the sequence listing part.

VGAM2439 host target gene, herein designated VGAM HOST TARGET GENE, encodes a corresponding messenger RNA, VGAM2439 host target RNA, herein designated VGAM HOST TARGET RNA. VGAM2439 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2439 RNA, herein designated VGAM RNA, binds complementarily to one or more host target binding sites located in untranslated regions of VGAM2439 host target RNA, herein designated VGAM HOST TARGET RNA. This complementary binding is due to the fact that the nucleotide sequence of VGAM2439 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2439 RNA, herein designated VGAM RNA, may have a different number of host target binding sites in untranslated regions of a VGAM2439 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2439 RNA, herein designated VGAM RNA, to host target binding sites on VGAM2439 host target RNA, herein designated VGAM HOST TARGET RNA, such as BINDING SITE I, BINDING SITE II and BINDING SITE III, inhibits translation of VGAM2439 host target RNA into VGAM2439 host target protein, herein designated VGAM HOST TARGET PROTEIN. VGAM host target protein is therefore outlined by a broken line.

It is appreciated that VGAM2439 host target gene, herein designated VGAM HOST TARGET GENE, in fact represents a plurality of VGAM2439 host target genes. The mRNA of each one of this plurality of VGAM2439 host target genes comprises one or more host target binding sites, each having a nucleotide sequence which is at least partly complementary to VGAM2439 RNA, herein designated VGAM RNA, and which when bound by VGAM2439 RNA causes inhibition of translation of respective one or more VGAM2439 host target proteins.

It is further appreciated by one skilled in the art that the mode of translational inhibition illustrated by FIG. 1 with specific reference to translational inhibition exerted by VGAM2439 gene, herein designated VGAM GENE, on one or more VGAM2439 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2439 is inhibition of expression of host target genes, as part of a novel viral mechanism of attacking a host. Accordingly, utilities of VGAM2439 include diagnosis, prevention and treatment of viral infection by Goatpox Virus. Specific functions, and accordingly utilities, of VGAM2439 correlate with, and may be deduced from, the identity of the host target genes which VGAM2439 binds and inhibits, and the function of these host target genes, as elaborated hereinbelow.

Nucleotide sequences of the VGAM2439 precursor RNA, herein designated VGAM PRECURSOR RNA, and of the 'diced' VGAM2439 RNA, herein designated VGAM RNA, and a schematic representation of the secondary folding of VGAM2439 folded precursor RNA, herein designated VGAM FOLDED PRECURSOR RNA, of VGAM2439 are further described hereinbelow with reference to Table 1.

Nucleotide sequences of host target binding sites, such as BINDING SITE-I, BINDING SITE-II and BINDING SITE-III of FIG. 1, found on VGAM2439 host target RNA, and schematic representation of the complementarity of each of these host target binding sites to VGAM2439 RNA, herein designated VGAM RNA, are described hereinbelow with reference to Table 2.

As mentioned hereinabove with reference to FIG. 1, a function of VGAM2439 gene, herein designated VGAM is inhibition of expression of VGAM2439 target genes. It is appreciated that specific functions, and accordingly utilities, of VGAM2439 correlate with, and may be deduced from, the identity of the target genes which VGAM2439 binds and inhibits, and the function of these target genes, as elaborated hereinbelow.

FK506 Binding Protein 12-rapamycin Associated Protein 1 (FRAP1, Accession NM_004958) is a VGAM2439 host target gene. FRAP1 BINDING SITE is HOST TARGET binding site found in the 3' untranslated region of mRNA encoded by FRAP1, corresponding to a HOST TARGET binding site such as BINDING SITE I, BINDING SITE II or BINDING SITE III. Table 2 illustrates the complementarity of the nucleotide sequences of FRAP1 BINDING SITE, designated SEQ ID:11405, to the nucleotide sequence of VGAM2439 RNA, herein designated VGAM RNA, also designated SEQ ID:5150.

A function of VGAM2439 is therefore inhibition of FK506 Binding Protein 12-rapamycin Associated Protein 1 (FRAP1, Accession NM_004958), a gene which acts as the target for the cell-cycle arrest and immunosuppressive effects of the fkbp12-rapamycin complex. Accordingly, utilities of VGAM2439 include diagnosis, prevention and treatment of diseases and clinical conditions associated with FRAP1. The function of FRAP1 and its association with various diseases and clinical conditions, has been established by previous studies, as described hereinabove with reference to VGAM496. Maltase-glucoamylase (alpha-glucosidase) (MGAM, Accession XM_051351) is another VGAM2439 host target gene. MGAM BINDING SITE is HOST TARGET binding site found in the 3' untranslated region of mRNA encoded by MGAM, corresponding to a HOST TARGET binding site such as BINDING SITE I, BINDING SITE II or BINDING SITE III. Table 2 illustrates the complementarity of the nucleotide sequences of MGAM BINDING SITE, designated SEQ ID:35826, to the nucleotide sequence of VGAM2439 RNA, herein designated VGAM RNA, also designated SEQ ID:5150.

Another function of VGAM2439 is therefore inhibition of Maltase-glucoamylase (alpha-glucosidase) (MGAM, Accession XM_051351), a gene which plays a role in the final steps of digestion of starch. Accordingly, utilities of VGAM2439 include diagnosis, prevention and treatment of diseases and clinical conditions associated with MGAM. The function of MGAM and its association with various diseases and clinical conditions, has been established by previous studies, as described hereinabove with reference to VGAM791. Origin Recognition Complex, Subunit 4-like (yeast) (ORC4L, Accession XM_030582) is another VGAM2439 host target gene. ORC4L BINDING SITE is HOST TARGET binding site found in the 3' untranslated region of mRNA encoded by ORC4L, corresponding to a HOST TARGET binding site such as BINDING SITE I, BINDING SITE II or BINDING SITE III. Table 2 illustrates the complementarity of the nucleotide sequences of ORC4L BINDING SITE, designated SEQ ID:31090, to the nucleotide sequence of VGAM2439 RNA, herein designated VGAM RNA, also designated SEQ ID:5150.

Another function of VGAM2439 is therefore inhibition of Origin Recognition Complex, Subunit 4-like (yeast) (ORC4L, Accession XM_030582), a gene which may be required for initiation of DNA replication and has a putative nucleotide triphosphate binding motif. Accordingly, utilities of VGAM2439 include diagnosis, prevention and treatment of diseases and clinical conditions associated with ORC4L. The function of ORC4L and its association with various diseases and clinical conditions, has been established by previous studies, as described hereinabove with reference to VGAM599. 6-phosphofructo-2-kinase/fructose-2,6-biphosphatase 4 (PFKFB4, Accession NM_004567) is another VGAM2439 host target gene. PFKFB4 BINDING SITE is HOST TARGET binding site found in the 3' untranslated region of mRNA encoded by PFKFB4, corresponding to a HOST TARGET binding site such as BINDING SITE I, BINDING SITE II or BINDING SITE III. Table 2 illustrates the complementarity of the nucleotide sequences of PFKFB4 BINDING SITE, designated SEQ ID:10908, to the nucleotide sequence of VGAM2439 RNA, herein designated VGAM RNA, also designated SEQ ID:5150.

Another function of VGAM2439 is therefore inhibition of 6-phosphofructo-2-kinase/fructose-2,6-biphosphatase 4 (PFKFB4, Accession NM_004567), a gene which catalyzes synthesis and degradation of fructose 2,6-bisphosphate. Accordingly, utilities of VGAM2439 include diagnosis, prevention and treatment of diseases and clinical conditions associated with PFKFB4. The function of PFKFB4 and its association with various diseases and clinical conditions, has been established by previous studies, as described hereinabove with reference to VGAM1316. RIG (Accession NM_006394) is another VGAM2439 host target gene. RIG BINDING SITE is HOST TARGET binding site found in the 3' untranslated region of mRNA encoded by RIG, corresponding to a HOST TARGET binding site such as BINDING SITE I, BINDING SITE II or BINDING SITE III. Table 2 illustrates the complementarity of the nucleotide sequences of RIG BINDING SITE, designated SEQ ID:13104, to the nucleotide sequence of VGAM2439 RNA, herein designated VGAM RNA, also designated SEQ ID:5150.

Another function of VGAM2439 is therefore inhibition of RIG (Accession NM_006394), a gene which is ribosomal protein S15. Accordingly, utilities of VGAM2439 include diagnosis, prevention and treatment of diseases and clinical conditions associated with RIG. The function of RIG and its association with various diseases and clinical conditions, has been established by previous studies, as described hereinabove with reference to VGAM206. ATP-binding Cassette, Sub-family C (CFTR/MRP), Member 13 (ABCC13, Accession NM_138726) is another VGAM2439 host target gene. ABCC13 BINDING SITE is HOST TARGET binding site found in the 3' untranslated region of mRNA encoded by ABCC13, corresponding to a HOST TARGET binding site such as BINDING SITE I, BINDING SITE II or BINDING SITE III. Table 2 illustrates the complementarity of the nucleotide sequences of ABCC13 BINDING SITE, designated SEQ ID:28971, to the nucleotide sequence of VGAM2439 RNA, herein designated VGAM RNA, also designated SEQ ID:5150.

Another function of VGAM2439 is therefore inhibition of ATP-binding Cassette, Sub-family C (CFTR/MRP), Member 13 (ABCC13, Accession NM_138726). Accordingly, utilities of VGAM2439 include diagnosis, prevention and treatment of diseases and clinical conditions associated with ABCC13. PRO1048 (Accession NM_018497) is another VGAM2439 host target gene. PRO1048 BINDING SITE is HOST TARGET binding site found in the 3" untranslated region of mRNA encoded by PRO1048, corresponding to a HOST TARGET binding site such as BINDING SITE I, BINDING SITE II or BINDING SITE III. Table 2 illustrates the complementarity of the nucleotide sequences of PRO1048 BINDING SITE, designated SEQ ID:20560, to the nucleotide sequence of VGAM2439 RNA, herein designated VGAM RNA, also designated SEQ ID:5150.

Another function of VGAM2439 is therefore inhibition of PRO1048 (Accession NM_018497). Accordingly, utilities of VGAM2439 include diagnosis, prevention and treatment of diseases and clinical conditions associated with PRO1048. LOC81537 (Accession NM_030791) is another VGAM2439 host target gene. LOC81537 BINDING SITE is HOST TARGET binding site found in the 3' untranslated region of mRNA encoded by LOC81537, corresponding to a HOST TARGET binding site such as BINDING SITE I, BINDING SITE II or BINDING SITE III. Table 2 illustrates the complementarity of the nucleotide sequences of LOC81537 BINDING SITE, designated SEQ ID:25088, to the nucleotide sequence of VGAM2439 RNA, herein designated VGAM RNA, also designated SEQ ID:5150.

Another function of VGAM2439 is therefore inhibition of LOC81537 (Accession NM_030791). Accordingly, utilities of VGAM2439 include diagnosis, prevention and treatment of diseases and clinical conditions associated with LOC81537. FIG. 1 further provides a conceptual description of a novel bioinformatically detected viral gene of the present invention, referred to here as Viral Genomic Address Messenger 2440 (VGAM2440) viral gene, which modulates expression of respective host target genes thereof, the function and utility of which host target genes is known in the art.

VGAM2440 is a novel bioinformatically detected regulatory, non protein coding, viral micro RNA (miRNA) gene. The method by which VGAM2440 was detected is described hereinabove with reference to FIGS. 1-8.

VGAM2440 gene, herein designated VGAM GENE, is a viral gene contained in the genome of Goatpox Virus. VGAM2440 host target gene, herein designated VGAM HOST TARGET GENE, is a human gene contained in the human genome.

VGAM2440 gene encodes a VGAM2440 precursor RNA, herein designated VGAM PRECURSOR RNA. Similar to other miRNA genes, and unlike most ordinary genes, VGAM2440 precursor RNA does not encode a protein. A nucleotide sequence identical or highly similar to the nucleotide sequence of VGAM2440 precursor RNA is designated SEQ ID:2426, and is provided hereinbelow with reference to the sequence listing part. Nucleotide sequence SEQ ID:2426 is located at position 54822 relative to the genome of Goatpox Virus.

VGAM2440 precursor RNA folds onto itself, forming VGAM2440 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2440 folded precursor RNA into VGAM2440 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2440 RNA is designated SEQ ID:5151, and is provided hereinbelow with reference to the sequence listing part.

VGAM2440 host target gene, herein designated VGAM HOST TARGET GENE, encodes a corresponding messenger RNA, VGAM2440 host target RNA, herein designated VGAM HOST TARGET RNA. VGAM2440 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2440 RNA, herein designated VGAM RNA, binds complementarily to one or more host target binding sites located in untranslated regions of VGAM2440 host target RNA, herein designated VGAM HOST TARGET RNA. This complementary binding is due to the fact that the nucleotide sequence of VGAM2440 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2440 RNA, herein designated VGAM RNA, may have a different number of host target binding sites in untranslated regions of a VGAM2440 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2440 RNA, herein designated VGAM RNA, to host target binding sites on VGAM2440 host target RNA, herein designated VGAM HOST TARGET RNA, such as BINDING SITE I, BINDING SITE II and BINDING SITE III, inhibits translation of VGAM2440 host target RNA into VGAM2440 host target protein, herein designated VGAM HOST TARGET PROTEIN. VGAM host target protein is therefore outlined by a broken line.

It is appreciated that VGAM2440 host target gene, herein designated VGAM HOST TARGET GENE, in fact represents a plurality of VGAM2440 host target genes. The mRNA of each one of this plurality of VGAM2440 host target genes comprises one or more host target binding sites, each having a nucleotide sequence which is at least partly complementary to VGAM2440 RNA, herein designated VGAM RNA, and which when bound by VGAM2440 RNA causes inhibition of translation of respective one or more VGAM2440 host target proteins.

It is further appreciated by one skilled in the art that the mode of translational inhibition illustrated by FIG. 1 with specific reference to translational inhibition exerted by VGAM2440 gene, herein designated VGAM GENE, on one or more VGAM2440 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2440 is inhibition of expression of host target genes, as part of a novel viral mechanism of attacking a host. Accordingly, utilities of VGAM2440 include diagnosis, prevention and treatment of viral infection by Goatpox Virus. Specific functions, and accordingly utilities, of VGAM2440 correlate with, and may be deduced from, the identity of the host target genes which VGAM2440 binds and inhibits, and the function of these host target genes, as elaborated hereinbelow.

Nucleotide sequences of the VGAM2440 precursor RNA, herein designated VGAM PRECURSOR RNA, and of the 'diced' VGAM2440 RNA, herein designated VGAM RNA, and a schematic representation of the secondary folding of VGAM2440 folded precursor RNA, herein designated VGAM FOLDED PRECURSOR RNA, of VGAM2440 are further described hereinbelow with reference to Table 1.

Nucleotide sequences of host target binding sites, such as BINDING SITE-I, BINDING SITE-II and BINDING SITE-III of FIG. 1, found on VGAM2440 host target RNA, and schematic representation of the complementarity of each of these host target binding sites to VGAM2440 RNA, herein designated VGAM RNA, are described hereinbelow with reference to Table 2.

As mentioned hereinabove with reference to FIG. 1, a function of VGAM2440 gene, herein designated VGAM is inhibition of expression of VGAM2440 target genes. It is appreciated that specific functions, and accordingly utilities, of VGAM2440 correlate with, and may be deduced from, the identity of the target genes which VGAM2440 binds and inhibits, and the function of these target genes, as elaborated hereinbelow.

Kruppel-like Factor 5 (intestinal) (KLF5, Accession NM_001730) is a VGAM2440 host target gene. KLF5 BINDING SITE is HOST TARGET binding site found in the 3' untranslated region of mRNA encoded by KLF5, corresponding to a HOST TARGET binding site such as BINDING SITE I, BINDING SITE II or BINDING SITE III. Table 2 illustrates the complementarity of the nucleotide sequences of KLF5 BINDING SITE, designated SEQ ID:7461, to the nucleotide sequence of VGAM2440 RNA, herein designated VGAM RNA, also designated SEQ ID:5151.

A function of VGAM2440 is therefore inhibition of Kruppel-like Factor 5 (intestinal) (KLF5, Accession NM_001730). Accordingly, utilities of VGAM2440 include diagnosis, prevention and treatment of diseases and clinical conditions associated with KLF5. MAP Kinase-interacting Serine/threonine Kinase 1 (MKNK1, Accession NM_003684) is another VGAM2440 host target gene. MKNK1 BINDING SITE is HOST TARGET binding site found in the 3' untranslated region of mRNA encoded by MKNK1, corresponding to a HOST TARGET binding site such as BINDING SITE I, BINDING SITE II or BINDING SITE III. Table 2 illustrates the complementarity of the nucleotide sequences of MKNK1 BINDING SITE, designated SEQ ID:9791, to the nucleotide sequence of VGAM2440 RNA, herein designated VGAM RNA, also designated SEQ ID:5151.

Another function of VGAM2440 is therefore inhibition of MAP Kinase-interacting Serine/threonine Kinase 1 (MKNK1, Accession NM_003684). Accordingly, utilities of VGAM2440 include diagnosis, prevention and treatment of diseases and clinical conditions associated with MKNK1. Musculin (activated B-cell factor-1) (MSC, Accession XM_084266) is another VGAM2440 host target gene. MSC BINDING SITE is HOST TARGET binding site found in the 3' untranslated region of mRNA encoded by MSC, corresponding to a HOST TARGET binding site such as BINDING SITE I, BINDING SITE II or BINDING SITE III. Table 2 illustrates the complementarity of the nucleotide sequences of MSC BINDING SITE, designated SEQ ID:37534, to the nucleotide sequence of VGAM2440 RNA, herein designated VGAM RNA, also designated SEQ ID:5151.

Another function of VGAM2440 is therefore inhibition of Musculin (activated B-cell factor-1) (MSC, Accession XM_084266). Accordingly, utilities of VGAM2440 include diagnosis, prevention and treatment of diseases and clinical conditions associated with MSC. FIG. 1 further provides a conceptual description of a novel bioinformatically detected viral gene of the present invention, referred to here as Viral Genomic Address Messenger 2441 (VGAM2441) viral gene, which modulates expression of respective host target genes thereof, the function and utility of which host target genes is known in the art.

VGAM2441 is a novel bioinformatically detected regulatory, non protein coding, viral micro RNA (miRNA) gene. The method by which VGAM2441 was detected is described hereinabove with reference to FIGS. 1-8.

VGAM2441 gene, herein designated VGAM GENE, is a viral gene contained in the genome of Goatpox Virus. VGAM2441 host target gene, herein designated VGAM HOST TARGET GENE, is a human gene contained in the human genome.

VGAM2441 gene encodes a VGAM2441 precursor RNA, herein designated VGAM PRECURSOR RNA. Similar to other miRNA genes, and unlike most ordinary genes, VGAM2441 precursor RNA does not encode a protein. A nucleotide sequence identical or highly similar to the nucleotide sequence of VGAM2441 precursor RNA is designated SEQ ID:2427, and is provided hereinbelow with reference to the sequence listing part. Nucleotide sequence SEQ ID:2427 is located at position 482 relative to the genome of Goatpox Virus.

VGAM2441 precursor RNA folds onto itself, forming VGAM2441 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2441 folded precursor RNA into VGAM2441 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM2441 RNA is designated SEQ ID:5152, and is provided hereinbelow with reference to the sequence listing part.

VGAM2441 host target gene, herein designated VGAM HOST TARGET GENE, encodes a corresponding messenger RNA, VGAM2441 host target RNA, herein designated VGAM HOST TARGET RNA. VGAM2441 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2441 RNA, herein designated VGAM RNA, binds complementarily to one or more host target binding sites located in untranslated regions of VGAM2441 host target RNA, herein designated VGAM HOST TARGET RNA. This complementary binding is due to the fact that the nucleotide sequence of VGAM2441 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2441 RNA, herein designated VGAM RNA, may have a different number of host target binding sites in untranslated regions of a VGAM2441 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2441 RNA, herein designated VGAM RNA, to host target binding sites on VGAM2441 host target RNA, herein designated VGAM HOST TARGET RNA, such as BINDING SITE I, BINDING SITE II and BINDING SITE III, inhibits translation of VGAM2441 host target RNA into VGAM2441 host target protein, herein designated VGAM HOST TARGET PROTEIN. VGAM host target protein is therefore outlined by a broken line.

It is appreciated that VGAM2441 host target gene, herein designated VGAM HOST TARGET GENE, in fact represents a plurality of VGAM2441 host target genes. The mRNA of each one of this plurality of VGAM2441 host target genes comprises one or more host target binding sites, each having a nucleotide sequence which is at least partly complementary to VGAM2441 RNA, herein designated VGAM RNA, and which when bound by VGAM2441 RNA causes inhibition of translation of respective one or more VGAM2441 host target proteins.

It is further appreciated by one skilled in the art that the mode of translational inhibition illustrated by FIG. 1 with specific reference to translational inhibition exerted by VGAM2441 gene, herein designated VGAM GENE, on one or more VGAM2441 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2441 is inhibition of expression of host target genes, as part of a novel viral mechanism of attacking a host. Accordingly, utilities of VGAM2441 include diagnosis, prevention and treatment of viral infection by Goatpox Virus. Specific functions, and accordingly utilities, of VGAM2441 correlate with, and may be deduced from, the identity of the host target genes which VGAM2441 binds and inhibits, and the function of these host target genes, as elaborated hereinbelow.

Nucleotide sequences of the VGAM2441 precursor RNA, herein designated VGAM PRECURSOR RNA, and of the 'diced' VGAM2441 RNA, herein designated VGAM RNA, and a schematic representation of the secondary folding of VGAM2441 folded precursor RNA, herein designated VGAM FOLDED PRECURSOR RNA, of VGAM2441 are further described hereinbelow with reference to Table 1.

Nucleotide sequences of host target binding sites, such as BINDING SITE-I, BINDING SITE-II and BINDING SITE-III of FIG. 1, found on VGAM2441 host target RNA, and schematic representation of the complementarity of each of these host target binding sites to VGAM2441 RNA, herein designated VGAM RNA, are described hereinbelow with reference to Table 2.

As mentioned hereinabove with reference to FIG. 1, a function of VGAM2441 gene, herein designated VGAM is inhibition of expression of VGAM2441 target genes. It is appreciated that specific functions, and accordingly utilities, of VGAM2441 correlate with, and may be deduced from, the identity of the target genes which VGAM2441 binds and inhibits, and the function of these target genes, as elaborated hereinbelow.

Cartilage Associated Protein (CRTAP, Accession NM_006371) is a VGAM2441 host target gene. CRTAP BINDING SITE is HOST TARGET binding site found in the 3' untranslated region of mRNA encoded by CRTAP, corresponding to a HOST TARGET binding site such as BINDING SITE I, BINDING SITE II or BINDING SITE III. Table 2 illustrates the complementarity of the nucleotide sequences of CRTAP BINDING SITE, designated SEQ ID:13058, to the nucleotide sequence of VGAM2441 RNA, herein designated VGAM RNA, also designated SEQ ID:5152.

A function of VGAM2441 is therefore inhibition of Cartilage Associated Protein (CRTAP, Accession NM_006371), a gene which is a novel developmentally regulated chick embryo protein. Accordingly, utilities of VGAM2441 include diagnosis, prevention and treatment of diseases and clinical conditions associated with CRTAP. The function of CRTAP and its association with various diseases and clinical conditions, has been established by previous studies, as described hereinabove with reference to VGAM152. Hippocalcin-like 1 (HPCAL1, Accession NM_134421) is another VGAM2441 host target gene. HPCAL1 BINDING SITE1 and HPCAL1 BINDING SITE2 are HOST TARGET binding sites found in untranslated regions of mRNA encoded by HPCAL1, corresponding to HOST TARGET binding sites such as BINDING SITE I, BINDING SITE II or BINDING SITE III. Table 2 illustrates the complementarity of the nucleotide sequences of HPCAL1 BINDING SITE1 and HPCAL1 BINDING SITE2, designated SEQ ID:28636 and SEQ ID:7929 respectively, to the nucleotide sequence of VGAM2441 RNA, herein designated VGAM RNA, also designated SEQ ID:5152.

Another function of VGAM2441 is therefore inhibition of Hippocalcin-like 1 (HPCAL1, Accession NM_134421). Accordingly, utilities of VGAM2441 include diagnosis, prevention and treatment of diseases and clinical conditions associated with HPCAL1. Aminopeptidase Puromycin Sensitive (NPEPPS, Accession NM_006310) is another VGAM2441 host target gene. NPEPPS BINDING SITE is HOST TARGET binding site found in the 3' untranslated region of mRNA encoded by NPEPPS, corresponding to a HOST TARGET binding site such as BINDING SITE I, BINDING SITE II or BINDING SITE III. Table 2 illustrates the complementarity of the nucleotide sequences of NPEPPS BINDING SITE, designated SEQ ID:13000, to the nucleotide sequence of VGAM2441 RNA, herein designated VGAM RNA, also designated SEQ ID:5152.

Another function of VGAM2441 is therefore inhibition of Aminopeptidase Puromycin Sensitive (NPEPPS, Accession NM_006310), a gene which is puromycin-sensitive aminopeptidase and has metallopeptidase activity. Accordingly, utilities of VGAM2441 include diagnosis, prevention and treatment of diseases and clinical conditions associated with NPEPPS. The function of NPEPPS and its association with various diseases and clinical conditions, has been established by previous studies, as described hereinabove with reference to VGAM83. Protocadherin 9 (PCDH9, Accession XM_096054) is another VGAM2441 host target gene. PCDH9 BINDING SITE is HOST TARGET binding site found in the 5' untranslated region of mRNA encoded by PCDH9, corresponding to a HOST TARGET binding site such as BINDING SITE I, BINDING SITE II or BINDING SITE III. Table 2 illustrates the complementarity of the nucleotide sequences of PCDH9 BINDING SITE, designated SEQ ID:40292, to the nucleotide sequence of VGAM2441 RNA, herein designated VGAM RNA, also designated SEQ ID:5152.

Another function of VGAM2441 is therefore inhibition of Protocadherin 9 (PCDH9, Accession XM_096054). Accordingly, utilities of VGAM2441 include diagnosis, prevention and treatment of diseases and clinical conditions associated with PCDH9. Single-minded Homolog 1 (Drosophila) (SIM1, Accession NM_005068) is another VGAM2441 host target gene. SIM1 BINDING SITE is HOST TARGET binding site found in the 5' untranslated region of mRNA encoded by SIM1, corresponding to a HOST TARGET binding site such as BINDING SITE I, BINDING SITE II or BINDING SITE III. Table 2 illustrates the complementarity of the nucleotide sequences of SIM1 BINDING SITE, designated SEQ ID:11506, to the nucleotide sequence of VGAM2441 RNA, herein designated VGAM RNA, also designated SEQ ID:5152.

Another function of VGAM2441 is therefore inhibition of Single-minded Homolog 1 (Drosophila) (SIM1, Accession NM_005068), a gene which may have pleiotropic effects during embryogenesis and in the adult. Accordingly, utilities of VGAM2441 include diagnosis, prevention and treatment of diseases and clinical conditions associated with SIM1. The function of SIM1 and its association with various diseases and clinical conditions, has been established by previous studies, as described hereinabove with reference to VGAM665. Transforming Growth Factor, Alpha (TGFA, Accession NM_003236) is another VGAM2441 host target gene. TGFA BINDING SITE is HOST TARGET binding site found in the 3' untranslated region of mRNA encoded by TGFA, corresponding to a HOST TARGET binding site such as BINDING SITE I, BINDING SITE II or BINDING SITE III. Table 2 illustrates the complementarity of the nucleotide sequences of TGFA BINDING SITE, designated SEQ ID:9228, to the nucleotide sequence of VGAM2441 RNA, herein designated VGAM RNA, also designated SEQ ID:5152.

Another function of VGAM2441 is therefore inhibition of Transforming Growth Factor, Alpha (TGFA, Accession NM_003236), a gene which is able to bind to the egf receptor and to act synergistically with tgf beta to promote anchorage-independent cell proliferation in soft agar. Accordingly, utilities of VGAM2441 include diagnosis, prevention and treatment of diseases and clinical conditions associated with TGFA. The function of TGFA and its association with various diseases and clinical conditions, has been established by previous studies, as described hereinabove with reference to VGAM328. Zinc Finger Protein 265 (ZNF265, Accession NM_005455) is another VGAM2441 host target gene. ZNF265 BINDING SITE is HOST TARGET binding site found in the 3' untranslated region of mRNA encoded by ZNF265, corresponding to a HOST TARGET binding site such as BINDING SITE I, BINDING SITE II or BINDING SITE III. Table 2 illustrates the complementarity of the nucleotide sequences of ZNF265 BINDING SITE, designated SEQ ID:11938, to the nucleotide sequence of VGAM2441 RNA, herein designated VGAM RNA, also designated SEQ ID:5152.

Another function of VGAM2441 is therefore inhibition of Zinc Finger Protein 265 (ZNF265, Accession NM_005455). Accordingly, utilities of VGAM2441 include diagnosis, prevention and treatment of diseases and clinical conditions associated with ZNF265. FLJ11618 (Accession NM_022452) is another VGAM2441 host target gene. FLJ11618 BINDING SITE is HOST TARGET binding site found in the 3' untranslated region of mRNA encoded by FLJ11618, corresponding to a HOST TARGET binding site such as BINDING SITE I, BINDING SITE II or BINDING SITE III. Table 2 illustrates the complementarity of the nucleotide sequences of FLJ11618 BINDING SITE, designated SEQ ID:22789, to the nucleotide sequence of VGAM2441 RNA, herein designated VGAM RNA, also designated SEQ ID:5152.

Another function of VGAM2441 is therefore inhibition of FLJ11618 (Accession NM_022452). Accordingly, utilities of VGAM2441 include diagnosis, prevention and treatment of diseases and clinical conditions associated with FLJ11618. FLJ20651 (Accession NM_017919) is another VGAM2441 host target gene. FLJ20651 BINDING SITE is HOST TARGET binding site found in the 3' untranslated region of mRNA encoded by FLJ20651, corresponding to a HOST TARGET binding site such as BINDING SITE I, BINDING SITE II or BINDING SITE III. Table 2 illustrates the complementarity of the nucleotide sequences of FLJ20651 BINDING SITE, designated SEQ ID:19572, to the nucleotide sequence of VGAM2441 RNA, herein designated VGAM RNA, also designated SEQ ID:5152.

Another function of VGAM2441 is therefore inhibition of FLJ20651 (Accession NM_017919). Accordingly, utilities of VGAM2441 include diagnosis, prevention and treatment of diseases and clinical conditions associated with FLJ20651. KIAA0379 (Accession XM_042860) is another VGAM2441 host target gene. KIAA0379 BINDING SITE is HOST TARGET binding site found in the 3' untranslated region of mRNA encoded by KIAA0379, corresponding to a HOST TARGET binding site such as BINDING SITE I, BINDING SITE II or BINDING SITE III. Table 2 illustrates the complementarity of the nucleotide sequences of KIAA0379 BINDING SITE, designated SEQ ID:33809, to the nucleotide sequence of VGAM2441 RNA, herein designated VGAM RNA, also designated SEQ ID:5152.

Another function of VGAM2441 is therefore inhibition of KIAA0379 (Accession XM_042860). Accordingly, utilities of VGAM2441 include diagnosis, prevention and treatment of diseases and clinical conditions associated with KIAA0379. KIAA1610 (Accession XM_040622) is another VGAM2441 host target gene. KIAA1610 BINDING SITE is HOST TARGET binding site found in the 3' untranslated region of mRNA encoded by KIAA1610, corresponding to a HOST TARGET binding site such as BINDING SITE I, BINDING SITE II or BINDING SITE III. Table 2 illustrates the complementarity of the nucleotide sequences of KIAA1610 BINDING SITE, designated SEQ ID:33341, to the nucleotide sequence of VGAM2441 RNA, herein designated VGAM RNA, also designated SEQ ID:5152.

Another function of VGAM2441 is therefore inhibition of KIAA1610 (Accession XM_040622). Accordingly, utilities of VGAM2441 include diagnosis, prevention and treatment of diseases and clinical conditions associated with KIAA1610. PRO1048 (Accession NM_018497) is another VGAM2441 host target gene. PRO1048 BINDING SITE is HOST TARGET binding site found in the 3' untranslated region of mRNA encoded by PRO1048, corresponding to a HOST TARGET binding site such as BINDING SITE I, BINDING SITE II or BINDING SITE III. Table 2 illustrates the complementarity of the nucleotide sequences of PRO1048 BINDING SITE, designated SEQ ID:20555, to the nucleotide sequence of VGAM2441 RNA, herein designated VGAM RNA, also designated SEQ ID:5152.

Another function of VGAM2441 is therefore inhibition of PRO1048 (Accession NM_018497). Accordingly, utilities of VGAM2441 include diagnosis, prevention and treatment of diseases and clinical conditions associated with PRO1048. LOC197319 (Accession XM_113862) is another VGAM2441 host target gene. LOC197319 BINDING SITE is HOST TARGET binding site found in the 3' untranslated region of mRNA encoded by LOC197319, corresponding to a HOST TARGET binding site such as BINDING SITE I, BINDING SITE II or BINDING SITE III. Table 2 illustrates the complementarity of the nucleotide sequences of LOC197319 BINDING SITE, designated SEQ ID:42473, to the nucleotide sequence of VGAM2441 RNA, herein designated VGAM RNA, also designated SEQ ID:5152.

Another function of VGAM2441 is therefore inhibition of LOC197319 (Accession XM_113862). Accordingly, utilities of VGAM2441 include diagnosis, prevention and treatment of diseases and clinical conditions associated with LOC197319. LOC90591 (Accession XM_032811) is another VGAM2441 host target gene. LOC90591 BINDING SITE is HOST TARGET binding site found in the 3' untranslated region of mRNA encoded by LOC90591, corresponding to a HOST TARGET binding site such as BINDING SITE I, BINDING SITE II or BINDING SITE III. Table 2 illustrates the complementarity of the nucleotide sequences of LOC90591 BINDING SITE, designated SEQ ID:31757, to the nucleotide sequence of VGAM2441 RNA, herein designated VGAM RNA, also designated SEQ ID:5152.

Another function of VGAM2441 is therefore inhibition of LOC90591 (Accession XM_032811). Accordingly, utilities of VGAM2441 include diagnosis, prevention and treatment of diseases and clinical conditions associated with LOC90591. FIG. 1 further provides a conceptual description of a novel bioinformatically detected viral gene of the present invention, referred to here as Viral Genomic Address Messenger 2442 (VGAM2442) viral gene, which modulates expression of respective host target genes thereof, the function and utility of which host target genes is known in the art.

VGAM2442 is a novel bioinformatically detected regulatory, non protein coding, viral micro RNA (miRNA) gene. The method by which VGAM2442 was detected is described hereinabove with reference to FIGS. 1-8.

VGAM2442 gene, herein designated VGAM GENE, is a viral gene contained in the genome of Goatpox Virus. VGAM2442 host target gene, herein designated VGAM HOST TARGET GENE, is a human gene contained in the human genome.

VGAM2442 gene encodes a VGAM2442 precursor RNA, herein designated VGAM PRECURSOR RNA. Similar to other miRNA genes, and unlike most ordinary genes, VGAM2442 precursor RNA does not encode a protein. A nucleotide sequence identical or highly similar to the nucleotide sequence of VGAM2442 precursor RNA is designated SEQ ID:2428, and is provided hereinbelow with reference to the sequence listing part. Nucleotide sequence SEQ ID:2428 is located at position 110320 relative to the genome of Goatpox Virus.

VGAM2442 precursor RNA folds onto itself, forming VGAM2442 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2442 folded precursor RNA into VGAM2442 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2442 RNA is designated SEQ ID:5153, and is provided hereinbelow with reference to the sequence listing part.

VGAM2442 host target gene, herein designated VGAM HOST TARGET GENE, encodes a corresponding messenger RNA, VGAM2442 host target RNA, herein designated VGAM HOST TARGET RNA. VGAM2442 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2442 RNA, herein designated VGAM RNA, binds complementarily to one or more host target binding sites located in untranslated regions of VGAM2442 host target RNA, herein designated VGAM HOST TARGET RNA. This complementary binding is due to the fact that the nucleotide sequence of VGAM2442 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2442 RNA, herein designated VGAM RNA, may have a different number of host target binding sites in untranslated regions of a VGAM2442 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2442 RNA, herein designated VGAM RNA, to host target binding sites on VGAM2442 host target RNA, herein designated VGAM HOST TARGET RNA, such as BINDING SITE I, BINDING SITE II and BINDING SITE III, inhibits translation of VGAM2442 host target RNA into VGAM2442 host target protein, herein designated VGAM HOST TARGET PROTEIN. VGAM host target protein is therefore outlined by a broken line.

It is appreciated that VGAM2442 host target gene, herein designated VGAM HOST TARGET GENE, in fact represents a plurality of VGAM2442 host target genes. The mRNA of each one of this plurality of VGAM2442 host target genes comprises one or more host target binding sites, each having a nucleotide sequence which is at least partly complementary to VGAM2442 RNA, herein designated VGAM RNA, and which when bound by VGAM2442 RNA causes inhibition of translation of respective one or more VGAM2442 host target proteins.

It is further appreciated by one skilled in the art that the mode of translational inhibition illustrated by FIG. 1 with specific reference to translational inhibition exerted by VGAM2442 gene, herein designated VGAM GENE, on one or more VGAM2442 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2442 is inhibition of expression of host target genes, as part of a novel viral mechanism of attacking a host. Accordingly, utilities of VGAM2442 include diagnosis, prevention and treatment of viral infection by Goatpox Virus. Specific functions, and accordingly utilities, of VGAM2442 correlate with, and may be deduced from, the identity of the host target genes which VGAM2442 binds and inhibits, and the function of these host target genes, as elaborated hereinbelow.

Nucleotide sequences of the VGAM2442 precursor RNA, herein designated VGAM PRECURSOR RNA, and of the 'diced' VGAM2442 RNA, herein designated VGAM RNA, and a schematic representation of the secondary folding of VGAM2442 folded precursor RNA, herein designated VGAM FOLDED PRECURSOR RNA, of VGAM2442 are further described hereinbelow with reference to Table 1.

Nucleotide sequences of host target binding sites, such as BINDING SITE-I, BINDING SITE-II and BINDING SITE-III of FIG. 1, found on VGAM2442 host target RNA, and schematic representation of the complementarity of each of these host target binding sites to VGAM2442 RNA, herein designated VGAM RNA, are described hereinbelow with reference to Table 2.

As mentioned hereinabove with reference to FIG. 1, a function of VGAM2442 gene, herein designated VGAM is inhibition of expression of VGAM2442 target genes. It is appreciated that specific functions, and accordingly utilities, of VGAM2442 correlate with, and may be deduced from, the identity of the target genes which VGAM2442 binds and inhibits, and the function of these target genes, as elaborated hereinbelow.

DKFZp434A2417 (Accession XM_038526) is a VGAM2442 host target gene. DKFZp434A2417 BINDING SITE is HOST TARGET binding site found in the 3' untranslated region of mRNA encoded by DKFZp434A2417, corresponding to a HOST TARGET binding site such as BINDING SITE I, BINDING SITE II or BINDING SITE III. Table 2 illustrates the complementarity of the nucleotide sequences of DKFZp434A2417 BINDING SITE, designated SEQ ID:32861, to the nucleotide sequence of VGAM2442 RNA, herein designated VGAM RNA, also designated SEQ ID:5153.

A function of VGAM2442 is therefore inhibition of DKFZp434A2417 (Accession XM_038526). Accordingly, utilities of VGAM2442 include diagnosis, prevention and treatment of diseases and clinical conditions associated with DKFZp434A2417. MacGAP (Accession NM_033515) is another VGAM2442 host target gene. MacGAP BINDING SITE is HOST TARGET binding site found in the 3' untranslated region of mRNA encoded by MacGAP, corresponding to a HOST TARGET binding site such as BINDING SITE I, BINDING SITE II or BINDING SITE III. Table 2 illustrates the complementarity of the nucleotide sequences of MacGAP BINDING SITE, designated SEQ ID:27287, to the nucleotide sequence of VGAM2442 RNA, herein designated VGAM RNA, also designated SEQ ID:5153.

Another function of VGAM2442 is therefore inhibition of MacGAP (Accession NM_033515). Accordingly, utilities of VGAM2442 include diagnosis, prevention and treatment of diseases and clinical conditions associated with MacGAP. PYGO1 (Accession XM_090986) is another VGAM2442 host target gene. PYGO1 BINDING SITE is HOST TARGET binding site found in the 5' untranslated region of mRNA encoded by PYGO1, corresponding to a HOST TARGET binding site such as BINDING SITE I, BINDING SITE II or BINDING SITE III. Table 2 illustrates the complementarity of the nucleotide sequences of PYGO1 BINDING SITE, designated SEQ ID:40022, to the nucleotide sequence of VGAM2442 RNA, herein designated VGAM RNA, also designated SEQ ID:5153.

Another function of VGAM2442 is therefore inhibition of PYGO1 (Accession XM_090986). Accordingly, utilities of VGAM2442 include diagnosis, prevention and treatment of diseases and clinical conditions associated with PYGO1.

FIG. 1 further provides a conceptual description of a novel bioinformatically detected viral gene of the present invention, referred to here as Viral Genomic Address Messenger 2443 (VGAM2443) viral gene, which modulates expression of respective host target genes thereof, the function and utility of which host target genes is known in the art.

VGAM2443 is a novel bioinformatically detected regulatory, non protein coding, viral micro RNA (miRNA) gene. The method by which VGAM2443 was detected is described hereinabove with reference to FIGS. 1-8.

VGAM2443 gene, herein designated VGAM GENE, is a viral gene contained in the genome of Mouse Cytomegalovirus 1. VGAM2443 host target gene, herein designated VGAM HOST TARGET GENE, is a human gene contained in the human genome.

VGAM2443 gene encodes a VGAM2443 precursor RNA, herein designated VGAM PRECURSOR RNA. Similar to other miRNA genes, and unlike most ordinary genes, VGAM2443 precursor RNA does not encode a protein. A nucleotide sequence identical or highly similar to the nucleotide sequence of VGAM2443 precursor RNA is designated SEQ ID:2429, and is provided hereinbelow with reference to the sequence listing part. Nucleotide sequence SEQ ID:2429 is located at position 167632 relative to the genome of Mouse Cytomegalovirus 1.

VGAM2443 precursor RNA folds onto itself, forming VGAM2443 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2443 folded precursor RNA into VGAM2443 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM2443 RNA is designated SEQ ID:5154, and is provided hereinbelow with reference to the sequence listing part.

VGAM2443 host target gene, herein designated VGAM HOST TARGET GENE, encodes a corresponding messenger RNA, VGAM2443 host target RNA, herein designated VGAM HOST TARGET RNA. VGAM2443 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2443 RNA, herein designated VGAM RNA, binds complementarily to one or more host target binding sites located in untranslated regions of VGAM2443 host target RNA, herein designated VGAM HOST TARGET RNA. This complementary binding is due to the fact that the nucleotide sequence of VGAM2443 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2443 RNA, herein designated VGAM RNA, may have a different number of host target binding sites in untranslated regions of a VGAM2443 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2443 RNA, herein designated VGAM RNA, to host target binding sites on VGAM2443 host target RNA, herein designated VGAM HOST TARGET RNA, such as BINDING SITE I, BINDING SITE II and BINDING SITE III, inhibits translation of VGAM2443 host target RNA into VGAM2443 host target protein, herein designated VGAM HOST TARGET PROTEIN. VGAM host target protein is therefore outlined by a broken line.

It is appreciated that VGAM2443 host target gene, herein designated VGAM HOST TARGET GENE, in fact represents a plurality of VGAM2443 host target genes. The mRNA of each one of this plurality of VGAM2443 host target genes comprises one or more host target binding sites, each having a nucleotide sequence which is at least partly complementary to VGAM2443 RNA, herein designated VGAM RNA, and which when bound by VGAM2443 RNA causes inhibition of translation of respective one or more VGAM2443 host target proteins.

It is further appreciated by one skilled in the art that the mode of translational inhibition illustrated by FIG. 1 with specific reference to translational inhibition exerted by VGAM2443 gene, herein designated VGAM GENE, on one or more VGAM2443 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2443 is inhibition of expression of host target genes, as part of a novel viral mechanism of attacking a host. Accordingly, utilities of VGAM2443 include diagnosis, prevention and treatment of viral infection by Mouse Cytomegalovirus 1. Specific functions, and accordingly utilities, of VGAM2443 correlate with, and may be deduced from, the identity of the host target genes which VGAM2443 binds and inhibits, and the function of these host target genes, as elaborated hereinbelow.

Nucleotide sequences of the VGAM2443 precursor RNA, herein designated VGAM PRECURSOR RNA, and of the 'diced' VGAM2443 RNA, herein designated VGAM RNA, and a schematic representation of the secondary folding of VGAM2443 folded precursor RNA, herein designated VGAM FOLDED PRECURSOR RNA, of VGAM2443 are further described hereinbelow with reference to Table 1.

Nucleotide sequences of host target binding sites, such as BINDING SITE-I, BINDING SITE-II and BINDING SITE-III of FIG. 1, found on VGAM2443 host target RNA, and schematic representation of the complementarity of each of these host target binding sites to VGAM2443 RNA, herein designated VGAM RNA, are described hereinbelow with reference to Table 2.

As mentioned hereinabove with reference to FIG. 1, a function of VGAM2443 gene, herein designated VGAM is inhibition of expression of VGAM2443 target genes. It is appreciated that specific functions, and accordingly utilities, of VGAM2443 correlate with, and may be deduced from, the identity of the target genes which VGAM2443 binds and inhibits, and the function of these target genes, as elaborated hereinbelow.

EGF-like-domain, Multiple 5 (EGFL5, Accession XM_098838) is a VGAM2443 host target gene. EGFL5 BINDING SITE is HOST TARGET binding site found in the 5' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41880, to the nucleotide sequence of VGAM2443 RNA, herein designated VGAM RNA, also designated SEQ ID:5154.

A function of VGAM2443 is therefore inhibition of EGF-like-domain, Multiple 5 (EGFL5, Accession XM_098838). Accordingly, utilities of VGAM2443 include diagnosis, prevention and treatment of diseases and clinical conditions associated with EGFL5. Eukaryotic Translation Initiation Factor 2C, 1 (EIF2C1, Accession NM_012199) is another VGAM2443 host target gene. EIF2C1 BINDING SITE is HOST TARGET binding site found in the 3' untranslated region of mRNA encoded by EIF2C1, corresponding to a HOST TARGET binding site such as BINDING SITE I, BINDING SITE II or BINDING SITE III. Table 2 illustrates the complementarity of the nucleotide sequences of EIF2C1 BINDING SITE, designated SEQ ID:14501, to the nucleotide sequence of VGAM2443 RNA, herein designated VGAM RNA, also designated SEQ ID:5154.

Another function of VGAM2443 is therefore inhibition of Eukaryotic Translation Initiation Factor 2C, 1 (EIF2C1, Accession NM_012199), a gene which plays an important role in the eukaryotic peptide chain initiation process. Accordingly, utilities of VGAM2443 include diagnosis, prevention and treatment of diseases and clinical conditions associated with EIF2C1. The function of EIF2C1 and its association with various diseases and clinical conditions, has been established by previous studies, as described hereinabove with reference to VGAM118. Insulin Receptor Substrate 2 (IRS2, Accession XM_007095) is another VGAM2443 host target gene. IRS2 BINDING SITE is HOST TARGET binding site found in the 5' untranslated region of mRNA encoded by IRS2, corresponding to a HOST TARGET binding site such as BINDING SITE I, BINDING SITE II or BINDING SITE III. Table 2 illustrates the complementarity of the nucleotide sequences of IRS2 BINDING SITE, designated SEQ ID:30030, to the nucleotide sequence of VGAM2443 RNA, herein designated VGAM RNA, also designated SEQ ID:5154.

Another function of VGAM2443 is therefore inhibition of Insulin Receptor Substrate 2 (IRS2, Accession XM_007095), a gene which may mediate the control of various cellular processes by insulin. Accordingly, utilities of VGAM2443 include diagnosis, prevention and treatment of diseases and clinical conditions associated with IRS2. The function of IRS2 and its association with various diseases and clinical conditions, has been established by previous studies, as described hereinabove with reference to VGAM1217. Potassium Inwardly-rectifying Channel, Subfamily J, Member 6 (KCNJ6, Accession NM_002240) is another VGAM2443 host target gene. KCNJ6 BINDING SITE is HOST TARGET binding site found in the 3' untranslated region of mRNA encoded by KCNJ6, corresponding to a HOST TARGET binding site such as BINDING SITE I, BINDING SITE II or BINDING SITE III. Table 2 illustrates the complementarity of the nucleotide sequences of KCNJ6 BINDING SITE, designated SEQ ID:8022, to the nucleotide sequence of VGAM2443 RNA, herein designated VGAM RNA, also designated SEQ ID:5154.

Another function of VGAM2443 is therefore inhibition of Potassium Inwardly-rectifying Channel, Subfamily J, Member 6 (KCNJ6, Accession NM_002240), a gene which may be involved in the regulation of insulin secretion by glucose and/or neurotransmitters. Accordingly, utilities of VGAM2443 include diagnosis, prevention and treatment of diseases and clinical conditions associated with KCNJ6. The function of KCNJ6 and its association with various diseases and clinical conditions, has been established by previous studies, as described hereinabove with reference to VGAM2155. Mitogen-activated Protein Kinase Kinase Kinase 7 Interacting Protein 2 (MAP3K7IP2, Accession NM_015093) is another VGAM2443 host target gene. MAP3K7IP2 BINDING SITE is HOST TARGET binding site found in the 3' untranslated region of mRNA encoded by MAP3K7IP2, corresponding to a HOST TARGET binding site such as BINDING SITE I, BINDING SITE II or BINDING SITE III. Table 2 illustrates the complementarity of the nucleotide sequences of MAP3K7IP2 BINDING SITE, designated SEQ ID:17484, to the nucleotide sequence of VGAM2443 RNA, herein designated VGAM RNA, also designated SEQ ID:5154.

Another function of VGAM2443 is therefore inhibition of Mitogen-activated Protein Kinase Kinase Kinase 7 Interacting Protein 2 (MAP3K7IP2, Accession NM_015093). Accordingly, utilities of VGAM2443 include diagnosis, prevention and treatment of diseases and clinical conditions associated with MAP3K7IP2. Retinoic Acid Induced 3 (RAI3, Accession NM_003979) is another VGAM2443 host target gene. RAI3 BINDING SITE is HOST TARGET binding site found in the 3' untranslated region of mRNA encoded by RAI3, corresponding to a HOST TARGET binding site such as BINDING SITE I, BINDING SITE II or BINDING SITE III. Table 2 illustrates the complementarity of the nucleotide sequences of RAI3 BINDING SITE, designated SEQ ID:10112, to the nucleotide sequence of VGAM2443 RNA, herein designated VGAM RNA, also designated SEQ ID:5154.

Another function of VGAM2443 is therefore inhibition of Retinoic Acid Induced 3 (RAI3, Accession NM_003979). Accordingly, utilities of VGAM2443 include diagnosis, prevention and treatment of diseases and clinical conditions associated with RAI3. Stanniocalcin 1 (STC1, Accession NM_003155) is another VGAM2443 host target gene. STC1 BINDING SITE is HOST TARGET binding site found in the 3' untranslated region of mRNA encoded by STC1, corresponding to a HOST TARGET binding site such as BINDING SITE I, BINDING SITE II or BINDING SITE III. Table 2 illustrates the complementarity of the nucleotide sequences of STC1 BINDING SITE, designated SEQ ID:9132, to the nucleotide sequence of VGAM2443 RNA, herein designated VGAM RNA, also designated SEQ ID:5154.

Another function of VGAM2443 is therefore inhibition of Stanniocalcin 1 (STC1, Accession NM_003155), a gene which stimulates renal phosphate reabsorption, and could therefore prevent hypercalcemia. Accordingly, utilities of VGAM2443 include diagnosis, prevention and treatment of diseases and clinical conditions associated with STC1. The function of STC1 and its association with various diseases and clinical conditions, has been established by previous studies, as described hereinabove with reference to VGAM623. Angiomotin (AMOT, Accession NM_133265) is another VGAM2443 host target gene. AMOT BINDING SITE1 and AMOT BINDING SITE2 are HOST TARGET binding sites found in untranslated regions of mRNA encoded by AMOT, corresponding to HOST TARGET binding sites such as BINDING SITE I, BINDING SITE II or BINDING SITE III. Table 2 illustrates the complementarity of the nucleotide sequences of AMOT BINDING SITE1 and AMOT BINDING SITE2, designated SEQ ID:28408 and SEQ ID:28409 respectively, to the nucleotide sequence of VGAM2443 RNA, herein designated VGAM RNA, also designated SEQ ID:5154.

Another function of VGAM2443 is therefore inhibition of Angiomotin (AMOT, Accession NM_133265). Accordingly, utilities of VGAM2443 include diagnosis, prevention and treatment of diseases and clinical conditions associated with AMOT. DKFZP434J046 (Accession XM_048258) is another VGAM2443 host target gene. DKFZP434J046 BINDING SITE is HOST TARGET binding site found in the 5' untranslated region of mRNA encoded by DKFZP434J046, corresponding to a HOST TARGET binding site such as BINDING SITE I, BINDING SITE II or BINDING SITE III. Table 2 illustrates the complementarity of the nucleotide sequences of DKFZP434J046 BINDING SITE, designated SEQ ID:35151, to the nucleotide sequence of VGAM2443 RNA, herein designated VGAM RNA, also designated SEQ ID:5154.

Another function of VGAM2443 is therefore inhibition of DKFZP434J046 (Accession XM_048258). Accordingly, utilities of VGAM2443 include diagnosis, prevention and treatment of diseases and clinical conditions associated with DKFZP434J046. FLJ12505 (Accession NM_024749) is another VGAM2443 host target gene. FLJ12505 BINDING SITE is HOST TARGET binding site found in the 5' untranslated region of mRNA encoded by FLJ12505, corresponding to a HOST TARGET binding site such as BINDING SITE I, BINDING SITE II or BINDING SITE III. Table 2 illustrates the complementarity of the nucleotide sequences of FLJ12505 BINDING SITE, designated SEQ ID:24092, to the nucleotide sequence of VGAM2443 RNA, herein designated VGAM RNA, also designated SEQ ID:5154.

Another function of VGAM2443 is therefore inhibition of FLJ12505 (Accession NM_024749). Accordingly, utilities of VGAM2443 include diagnosis, prevention and treatment of diseases and clinical conditions associated with FLJ12505. KIAA0182 (Accession XM_050495) is another VGAM2443 host target gene. KIAA0182 BINDING SITE is HOST TARGET binding site found in the 3' untranslated region of mRNA encoded by KIAA0182, corresponding to a HOST TARGET binding site such as BINDING SITE I, BINDING SITE II or BINDING SITE III. Table 2 illustrates the complementarity of the nucleotide sequences of KIAA0182 BINDING SITE, designated SEQ ID:35644, to the nucleotide sequence of VGAM2443 RNA, herein designated VGAM RNA, also designated SEQ ID:5154.

Another function of VGAM2443 is therefore inhibition of KIAA0182 (Accession XM_050495). Accordingly, utilities of VGAM2443 include diagnosis, prevention and treatment of diseases and clinical conditions associated with KIAA0182. KIAA1028 (Accession XM_166324) is another VGAM2443 host target gene. KIAA1028 BINDING SITE is HOST TARGET binding site found in the 3' untranslated region of mRNA encoded by KIAA1028, corresponding to a HOST TARGET binding site such as BINDING SITE I, BINDING SITE II or BINDING SITE III. Table 2 illustrates the complementarity of the nucleotide sequences of KIAA1028 BINDING SITE, designated SEQ ID:44159, to the nucleotide sequence of VGAM2443 RNA, herein designated VGAM RNA, also designated SEQ ID:5154.

Another function of VGAM2443 is therefore inhibition of KIAA1028 (Accession XM_166324). Accordingly, utilities of VGAM2443 include diagnosis, prevention and treatment of diseases and clinical conditions associated with KIAA1028. KIAA1416 (Accession XM_098762) is another VGAM2443 host target gene. KIAA1416 BINDING SITE is HOST TARGET binding site found in the 5' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41800, to the nucleotide sequence of VGAM2443 RNA, herein designated VGAM RNA, also designated SEQ ID:5154.

Another function of VGAM2443 is therefore inhibition of KIAA1416 (Accession XM_098762). Accordingly, utilities of VGAM2443 include diagnosis, prevention and treatment of diseases and clinical conditions associated with KIAA1416. Mitogen-activated Protein Kinase-activated Protein Kinase 2 (MAPKAPK2, Accession NM_004759) is another VGAM2443 host target gene. MAPKAPK2 BINDING SITE is HOST TARGET binding site found in the 3' untranslated region of mRNA encoded by MAPKAPK2, corresponding to a HOST TARGET binding site such as BINDING SITE I, BINDING SITE II or BINDING SITE III. Table 2 illustrates the complementarity of the nucleotide sequences of MAPKAPK2 BINDING SITE, designated SEQ ID:11149, to the nucleotide sequence of VGAM2443 RNA, herein designated VGAM RNA, also designated SEQ ID:5154.

Another function of VGAM2443 is therefore inhibition of Mitogen-activated Protein Kinase-activated Protein Kinase 2 (MAPKAPK2, Accession NM_004759). Accordingly, utilities of VGAM2443 include diagnosis, prevention and treatment of diseases and clinical conditions associated with MAPKAPK2. SP329 (Accession NM_030793) is another VGAM2443 host target gene. SP329 BINDING SITE is HOST TARGET binding site found in the 5' untranslated region of mRNA encoded by SP329, corresponding to a HOST TARGET binding site such as BINDING SITE I, BINDING SITE II or BINDING SITE III. Table 2 illustrates the complementarity of the nucleotide sequences of SP329 BINDING SITE, designated SEQ ID:25095, to the nucleotide sequence of VGAM2443 RNA, herein designated VGAM RNA, also designated SEQ ID:5154.

Another function of VGAM2443 is therefore inhibition of SP329 (Accession NM_030793). Accordingly, utilities of VGAM2443 include diagnosis, prevention and treatment of diseases and clinical conditions associated with SP329. Three Prime Repair Exonuclease 1 (TREX1, Accession NM_033627) is another VGAM2443 host target gene. TREX1 BINDING SITE1 and TREX1 BINDING SITE2 are HOST TARGET binding sites found in untranslated regions of mRNA encoded by TREX1, corresponding to HOST TARGET binding sites such as BINDING SITE I, BINDING SITE II or BINDING SITE III. Table 2 illustrates the complementarity of the nucleotide sequences of TREX1 BINDING SITE1 and TREX1 BINDING SITE2, designated SEQ ID:27337 and SEQ ID:27346 respectively, to the nucleotide sequence of VGAM2443 RNA, herein designated VGAM RNA, also designated SEQ ID:5154.

Another function of VGAM2443 is therefore inhibition of Three Prime Repair Exonuclease 1 (TREX1, Accession NM_033627). Accordingly, utilities of VGAM2443 include diagnosis, prevention and treatment of diseases and clinical conditions associated with TREX1. LOC150197 (Accession XM_086801) is another VGAM2443 host target gene. LOC150197 BINDING SITE is HOST TARGET binding site found in the 3' untranslated region of mRNA encoded by LOC150197, corresponding to a HOST TARGET binding site such as BINDING SITE I, BINDING SITE II or BINDING SITE III. Table 2 illustrates the complementarity of the nucleotide sequences of LOC150197 BINDING SITE, designated SEQ ID:38865, to the nucleotide sequence of VGAM2443 RNA, herein designated VGAM RNA, also designated SEQ ID:5154.

Another function of VGAM2443 is therefore inhibition of LOC150197 (Accession XM_086801). Accordingly, utilities of VGAM2443 include diagnosis, prevention and treatment of diseases and clinical conditions associated with LOC150197. LOC219894 (Accession XM_167782) is another VGAM2443 host target gene. LOC219894 BINDING SITE is HOST TARGET binding site found in the 3' untranslated region of mRNA encoded by LOC219894, corresponding to a HOST TARGET binding site such as BINDING SITE I, BINDING SITE II or BINDING SITE III. Table 2 illustrates the complementarity of the nucleotide sequences of LOC219894 BINDING SITE, designated SEQ ID:44795, to the nucleotide sequence of VGAM2443 RNA, herein designated VGAM RNA, also designated SEQ ID:5154.

Another function of VGAM2443 is therefore inhibition of LOC219894 (Accession XM_167782). Accordingly, utilities of VGAM2443 include diagnosis, prevention and treatment of diseases and clinical conditions associated with LOC219894. LOC222484 (Accession XM_169424) is another VGAM2443 host target gene. LOC222484 BINDING SITE is HOST TARGET binding site found in the 3' untranslated region of mRNA encoded by LOC222484, corresponding to a HOST TARGET binding site such as BINDING SITE I, BINDING SITE II or BINDING SITE III. Table 2 illustrates the complementarity of the nucleotide sequences of LOC222484 BINDING SITE, designated SEQ ID:45298, to the nucleotide sequence of VGAM2443 RNA, herein designated VGAM RNA, also designated SEQ ID:5154.

Another function of VGAM2443 is therefore inhibition of LOC222484 (Accession XM_169424). Accordingly, utilities of VGAM2443 include diagnosis, prevention and treatment of diseases and clinical conditions associated with LOC222484. FIG. 1 further provides a conceptual description of a novel bioinformatically detected viral gene of the present invention, referred to here as Viral Genomic Address Messenger 2444 (VGAM2444) viral gene, which modulates expression of respective host target genes thereof, the function and utility of which host target genes is known in the art.

VGAM2444 is a novel bioinformatically detected regulatory, non protein coding, viral micro RNA (miRNA) gene. The method by which VGAM2444 was detected is described hereinabove with reference to FIGS. 1-8.

VGAM2444 gene, herein designated VGAM GENE, is a viral gene contained in the genome of Mouse Cytomegalovirus 1. VGAM2444 host target gene, herein designated VGAM HOST TARGET GENE, is a human gene contained in the human genome.

VGAM2444 gene encodes a VGAM2444 precursor RNA, herein designated VGAM PRECURSOR RNA. Similar to other miRNA genes, and unlike most ordinary genes, VGAM2444 precursor RNA does not encode a protein. A nucleotide sequence identical or highly similar to the nucleotide sequence of VGAM2444 precursor RNA is designated SEQ ID:2430, and is provided hereinbelow with reference to the sequence listing part. Nucleotide sequence SEQ ID:2430 is located at position 180574 relative to the genome of Mouse Cytomegalovirus 1.

VGAM2444 precursor RNA folds onto itself, forming VGAM2444 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2444 folded precursor RNA into VGAM2444 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM2444 RNA is designated SEQ ID:5155, and is provided hereinbelow with reference to the sequence listing part.

VGAM2444 host target gene, herein designated VGAM HOST TARGET GENE, encodes a corresponding messenger RNA, VGAM2444 host target RNA, herein designated VGAM HOST TARGET RNA. VGAM2444 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2444 RNA, herein designated VGAM RNA, binds complementarily to one or more host target binding sites located in untranslated regions of VGAM2444 host target RNA, herein designated VGAM HOST TARGET RNA. This complementary binding is due to the fact that the nucleotide sequence of VGAM2444 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2444 RNA, herein designated VGAM RNA, may have a different number of host target binding sites in untranslated regions of a VGAM2444 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2444 RNA, herein designated VGAM RNA, to host target binding sites on VGAM2444 host target RNA, herein designated VGAM HOST TARGET RNA, such as BINDING SITE I, BINDING SITE II and BINDING SITE III, inhibits translation of VGAM2444 host target RNA into VGAM2444 host target protein, herein designated VGAM HOST TARGET PROTEIN. VGAM host target protein is therefore outlined by a broken line.

It is appreciated that VGAM2444 host target gene, herein designated VGAM HOST TARGET GENE, in fact represents a plurality of VGAM2444 host target genes. The mRNA of each one of this plurality of VGAM2444 host target genes comprises one or more host target binding sites, each having a nucleotide sequence which is at least partly complementary to VGAM2444 RNA, herein designated VGAM RNA, and which when bound by VGAM2444 RNA causes inhibition of translation of respective one or more VGAM2444 host target proteins.

It is further appreciated by one skilled in the art that the mode of translational inhibition illustrated by FIG. 1 with specific reference to translational inhibition exerted by VGAM2444 gene, herein designated VGAM GENE, on one or more VGAM2444 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2444 is inhibition of expression of host target genes, as part of a novel viral mechanism of attacking a host. Accordingly, utilities of VGAM2444 include diagnosis, prevention and treatment of viral infection by Mouse Cytomegalovirus 1. Specific functions, and accordingly utilities, of VGAM2444 correlate with, and may be deduced from, the identity of the host target genes which VGAM2444 binds and inhibits, and the function of these host target genes, as elaborated hereinbelow.

Nucleotide sequences of the VGAM2444 precursor RNA, herein designated VGAM PRECURSOR RNA, and of the 'diced' VGAM2444 RNA, herein designated VGAM RNA, and a schematic representation of the secondary folding of VGAM2444 folded precursor RNA, herein designated VGAM FOLDED PRECURSOR RNA, of VGAM2444 are further described hereinbelow with reference to Table 1.

Nucleotide sequences of host target binding sites, such as BINDING SITE-I, BINDING SITE-II and BINDING SITE-III of FIG. 1, found on VGAM2444 host target RNA, and schematic representation of the complementarity of each of these host target binding sites to VGAM2444 RNA, herein designated VGAM RNA, are described hereinbelow with reference to Table 2.

As mentioned hereinabove with reference to FIG. 1, a function of VGAM2444 gene, herein designated VGAM is inhibition of expression of VGAM2444 target genes. It is appreciated that specific functions, and accordingly utilities, of VGAM2444 correlate with, and may be deduced from, the identity of the target genes which VGAM2444 binds and inhibits, and the function of these target genes, as elaborated hereinbelow.

Dual Specificity Phosphatase 1 (DUSP1, Accession NM_004417) is a VGAM2444 host target gene. DUSP1 BINDING SITE is HOST TARGET binding site found in the 3' untranslated region of mRNA encoded by DUSP1, corresponding to a HOST TARGET binding site such as BINDING SITE I, BINDING SITE II or BINDING SITE III. Table 2 illustrates the complementarity of the nucleotide sequences of DUSP1 BINDING SITE, designated SEQ ID:10681, to the nucleotide sequence of VGAM2444 RNA, herein designated VGAM RNA, also designated SEQ ID:5155.

A function of VGAM2444 is therefore inhibition of Dual Specificity Phosphatase 1 (DUSP1, Accession NM_004417), a gene which is a dual specificity phosphatase. Accordingly, utilities of VGAM2444 include diagnosis, prevention and treatment of diseases and clinical conditions associated with DUSP1. The function of DUSP1 and its association with various diseases and clinical conditions, has been established by previous studies, as described hereinabove with reference to VGAM881. DKFZP572C163 (Accession XM_028314) is another VGAM2444 host target gene. DKFZP572C163 BINDING SITE is HOST TARGET binding site found in the 5' untranslated region of mRNA encoded by DKFZP572C163, corresponding to a HOST TARGET binding site such as BINDING SITE I, BINDING SITE II or BINDING SITE III. Table 2 illustrates the complementarity of the nucleotide sequences of DKFZP572C163 BINDING SITE, designated SEQ ID:30656, to the nucleotide sequence of VGAM2444 RNA, herein designated VGAM RNA, also designated SEQ ID:5155.

Another function of VGAM2444 is therefore inhibition of DKFZP572C163 (Accession XM_028314). Accordingly, utilities of VGAM2444 include diagnosis, prevention and treatment of diseases and clinical conditions associated with DKFZP572C163. EFA6R (Accession NM_015310) is another VGAM2444 host target gene. EFA6R BINDING SITE is HOST TARGET binding site found in the 3' untranslated region of mRNA encoded by EFA6R, corresponding to a HOST TARGET binding site such as BINDING SITE I, BINDING SITE II or BINDING SITE III. Table 2 illustrates the complementarity of the nucleotide sequences of EFA6R BINDING SITE, designated SEQ ID:17620, to the nucleotide sequence of VGAM2444 RNA, herein designated VGAM RNA, also designated SEQ ID:5155.

Another function of VGAM2444 is therefore inhibition of EFA6R (Accession NM_015310). Accordingly, utilities of VGAM2444 include diagnosis, prevention and treatment of diseases and clinical conditions associated with EFA6R. ERAP140 (Accession XM_059748) is another VGAM2444 host target gene. ERAP140 BINDING SITE is HOST TARGET binding site found in the 3' untranslated region of mRNA encoded by ERAP140, corresponding to a HOST TARGET binding site such as BINDING SITE I, BINDING SITE II or BINDING SITE III. Table 2 illustrates the complementarity of the nucleotide sequences of ERAP140 BINDING SITE, designated SEQ ID:37081, to the nucleotide sequence of VGAM2444 RNA, herein designated VGAM RNA, also designated SEQ ID:5155.

Another function of VGAM2444 is therefore inhibition of ERAP140 (Accession XM_059748). Accordingly, utilities of VGAM2444 include diagnosis, prevention and treatment of diseases and clinical conditions associated with ERAP140. FLJ20413 (Accession NM_017808) is another VGAM2444 host target gene. FLJ20413 BINDING SITE is HOST TARGET binding site found in the 3' untranslated region of mRNA encoded by FLJ20413, corresponding to a HOST TARGET binding site such as BINDING SITE I, BINDING SITE II or BINDING SITE III. Table 2 illustrates the complementarity of the nucleotide sequences of FLJ20413 BINDING SITE, designated SEQ ID:19450, to the nucleotide sequence of VGAM2444 RNA, herein designated VGAM RNA, also designated SEQ ID:5155.

Another function of VGAM2444 is therefore inhibition of FLJ20413 (Accession NM_017808). Accordingly, utilities of VGAM2444 include diagnosis, prevention and treatment of diseases and clinical conditions associated with FLJ20413. LOC160156 (Accession XM_090047) is another VGAM2444 host target gene. LOC160156 BINDING SITE is HOST TARGET binding site found in the 5' untranslated region of mRNA encoded by LOC160156, corresponding to a HOST TARGET binding site such as BINDING SITE I, BINDING SITE II or BINDING SITE III. Table 2 illustrates the complementarity of the nucleotide sequences of LOC160156 BINDING SITE, designated SEQ ID:39989, to the nucleotide sequence of VGAM2444 RNA, herein designated VGAM RNA, also designated SEQ ID:5155.

Another function of VGAM2444 is therefore inhibition of LOC160156 (Accession XM_090047). Accordingly, utilities of VGAM2444 include diagnosis, prevention and treatment of diseases and clinical conditions associated with LOC160156. LOC169966 (Accession XM_093010) is another VGAM2444 host target gene. LOC169966 BINDING SITE is HOST TARGET binding site found in the 3' untranslated region of mRNA encoded by LOC169966, corresponding to a HOST TARGET binding site such as BINDING SITE I, BINDING SITE II or BINDING SITE III. Table 2 illustrates the complementarity of the nucleotide sequences of LOC169966 BINDING SITE, designated SEQ ID:40164, to the nucleotide sequence of VGAM2444 RNA, herein designated VGAM RNA, also designated SEQ ID:5155.

Another function of VGAM2444 is therefore inhibition of LOC169966 (Accession XM_093010). Accordingly, utilities of VGAM2444 include diagnosis, prevention and treatment of diseases and clinical conditions associated with LOC169966. FIG. 1 further provides a conceptual description of a novel bioinformatically detected viral gene of the present invention, referred to here as Viral Genomic Address Messenger 2445 (VGAM2445) viral gene, which modulates expression of respective host target genes thereof, the function and utility of which host target genes is known in the art.

VGAM2445 is a novel bioinformatically detected regulatory, non protein coding, viral micro RNA (miRNA) gene. The method by which VGAM2445 was detected is described hereinabove with reference to FIGS. 1-8.

VGAM2445 gene, herein designated VGAM GENE, is a viral gene contained in the genome of Mouse Cytomegalovirus 1. VGAM2445 host target gene, herein designated VGAM HOST TARGET GENE, is a human gene contained in the human genome.

VGAM2445 gene encodes a VGAM2445 precursor RNA, herein designated VGAM PRECURSOR RNA. Similar to other miRNA genes, and unlike most ordinary genes, VGAM2445 precursor RNA does not encode a protein. A nucleotide sequence identical or highly similar to the nucleotide sequence of VGAM2445 precursor RNA is designated SEQ ID:2431, and is provided hereinbelow with reference to the sequence listing part. Nucleotide sequence SEQ ID:2431 is located at position 13050 relative to the genome of Mouse Cytomegalovirus 1.

VGAM2445 precursor RNA folds onto itself, forming VGAM2445 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2445 folded precursor RNA into VGAM2445 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2445 RNA is designated SEQ ID:5156, and is provided hereinbelow with reference to the sequence listing part.

VGAM2445 host target gene, herein designated VGAM HOST TARGET GENE, encodes a corresponding messenger RNA, VGAM2445 host target RNA, herein designated VGAM HOST TARGET RNA. VGAM2445 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2445 RNA, herein designated VGAM RNA, binds complementarily to one or more host target binding sites located in untranslated regions of VGAM2445 host target RNA, herein designated VGAM HOST TARGET RNA. This complementary binding is due to the fact that the nucleotide sequence of VGAM2445 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2445 RNA, herein designated VGAM RNA, may have a different number of host target binding sites in untranslated regions of a VGAM2445 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2445 RNA, herein designated VGAM RNA, to host target binding sites on VGAM2445 host target RNA, herein designated VGAM HOST TARGET RNA, such as BINDING SITE I, BINDING SITE II and BINDING SITE III, inhibits translation of VGAM2445 host target RNA into VGAM2445 host target protein, herein designated VGAM HOST TARGET PROTEIN. VGAM host target protein is therefore outlined by a broken line.

It is appreciated that VGAM2445 host target gene, herein designated VGAM HOST TARGET GENE, in fact represents a plurality of VGAM2445 host target genes. The mRNA of each one of this plurality of VGAM2445 host target genes comprises one or more host target binding sites, each having a nucleotide sequence which is at least partly complementary to VGAM2445 RNA, herein designated VGAM RNA, and which when bound by VGAM2445 RNA causes inhibition of translation of respective one or more VGAM2445 host target proteins.

It is further appreciated by one skilled in the art that the mode of translational inhibition illustrated by FIG. 1 with specific reference to translational inhibition exerted by VGAM2445 gene, herein designated VGAM GENE, on one or more VGAM2445 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2445 is inhibition of expression of host target genes, as part of a novel viral mechanism of attacking a host. Accordingly, utilities of VGAM2445 include diagnosis, prevention and treatment of viral infection by Mouse Cytomegalovirus 1. Specific functions, and accordingly utilities, of VGAM2445 correlate with, and may be deduced from, the identity of the host target genes which VGAM2445 binds and inhibits, and the function of these host target genes, as elaborated hereinbelow.

Nucleotide sequences of the VGAM2445 precursor RNA, herein designated VGAM PRECURSOR RNA, and of the 'diced' VGAM2445 RNA, herein designated VGAM RNA, and a schematic representation of the secondary folding of VGAM2445 folded precursor RNA, herein designated VGAM FOLDED PRECURSOR RNA, of VGAM2445 are further described hereinbelow with reference to Table 1.

Nucleotide sequences of host target binding sites, such as BINDING SITE-I, BINDING SITE-II and BINDING SITE-III of FIG. 1, found on VGAM2445 host target RNA, and schematic representation of the complementarity of each of these host target binding sites to VGAM2445 RNA, herein designated VGAM RNA, are described hereinbelow with reference to Table 2.

As mentioned hereinabove with reference to FIG. 1, a function of VGAM2445 gene, herein designated VGAM is inhibition of expression of VGAM2445 target genes. It is appreciated that specific functions, and accordingly utilities, of VGAM2445 correlate with, and may be deduced from, the identity of the target genes which VGAM2445 binds and inhibits, and the function of these target genes, as elaborated hereinbelow.

RAP1A, Member of RAS Oncogene Family (RAP1A, Accession NM_002884) is a VGAM2445 host target gene. RAP1A BINDING SITE is HOST TARGET binding site found in the 3' untranslated region of mRNA encoded by RAP1A, corresponding to a HOST TARGET binding site such as BINDING SITE I, BINDING SITE II or BINDING SITE III. Table 2 illustrates the complementarity of the nucleotide sequences of RAP1A BINDING SITE, designated SEQ ID:8791, to the nucleotide sequence of VGAM2445 RNA, herein designated VGAM RNA, also designated SEQ ID:5156.

A function of VGAM2445 is therefore inhibition of RAP1A, Member of RAS Oncogene Family (RAP1A, Accession NM_002884), a gene which induces morphological reversion of a cell line transformed by a ras oncogene. Accordingly, utilities of VGAM2445 include diagnosis, prevention and treatment of diseases and clinical conditions associated with RAP1A. The function of RAP1A and its association with various diseases and clinical conditions, has been established by previous studies, as described hereinabove with reference to VGAM993. KIAA1033 (Accession XM_035313) is another VGAM2445 host target gene. KIAA1033 BINDING SITE is HOST TARGET binding site found in the 3' untranslated region of mRNA encoded by KIAA1033, corresponding to a HOST TARGET binding site such as BINDING SITE I, BINDING SITE II or BINDING SITE III. Table 2 illustrates the complementarity of the nucleotide sequences of KIAA1033 BINDING SITE, designated SEQ ID:32228, to the nucleotide sequence of VGAM2445 RNA, herein designated VGAM RNA, also designated SEQ ID:5156.

Another function of VGAM2445 is therefore inhibition of KIAA1033 (Accession XM_035313). Accordingly, utilities of VGAM2445 include diagnosis, prevention and treatment of diseases and clinical conditions associated with KIAA1033. Protein Phosphatase 1, Regulatory (inhibitor) Subunit 16B (PPP1R16B, Accession XM_028840) is another VGAM2445 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30762, to the nucleotide sequence of VGAM2445 RNA, herein designated VGAM RNA, also designated SEQ ID:5156.

Another function of VGAM2445 is therefore inhibition of Protein Phosphatase 1, Regulatory (inhibitor) Subunit 16B (PPP1R16B, Accession XM_028840). Accordingly, utilities of VGAM2445 include diagnosis, prevention and treatment of diseases and clinical conditions associated with PPP1R16B. FIG. 1 further provides a conceptual description of a novel bioinformatically detected viral gene of the present invention, referred to here as Viral Genomic Address Messenger 2446 (VGAM2446) viral gene, which modulates expression of respective host target genes thereof, the function and utility of which host target genes is known in the art.

VGAM2446 is a novel bioinformatically detected regulatory, non protein coding, viral micro RNA (miRNA) gene. The method by which VGAM2446 was detected is described hereinabove with reference to FIGS. 1-8.

VGAM2446 gene, herein designated VGAM GENE, is a viral gene contained in the genome of Mouse Cytomegalovirus 1. VGAM2446 host target gene, herein designated VGAM HOST TARGET GENE, is a human gene contained in the human genome.

VGAM2446 gene encodes a VGAM2446 precursor RNA, herein designated VGAM PRECURSOR RNA. Similar to other miRNA genes, and unlike most ordinary genes, VGAM2446 precursor RNA does not encode a protein. A nucleotide sequence identical or highly similar to the nucleotide sequence of VGAM2446 precursor RNA is designated SEQ ID:2432, and is provided hereinbelow with reference to the sequence listing part. Nucleotide sequence SEQ ID:2432 is located at position 159425 relative to the genome of Mouse Cytomegalovirus 1.

VGAM2446 precursor RNA folds onto itself, forming VGAM2446 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2446 folded precursor RNA into VGAM2446 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM2446 RNA is designated SEQ ID:5157, and is provided hereinbelow with reference to the sequence listing part.

VGAM2446 host target gene, herein designated VGAM HOST TARGET GENE, encodes a corresponding messenger RNA, VGAM2446 host target RNA, herein designated VGAM HOST TARGET RNA. VGAM2446 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2446 RNA, herein designated VGAM RNA, binds complementarily to one or more host target binding sites located in untranslated regions of VGAM2446 host target RNA, herein designated VGAM HOST TARGET RNA. This complementary binding is due to the fact that the nucleotide sequence of VGAM2446 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2446 RNA, herein designated VGAM RNA, may have a different number of host target binding sites in untranslated regions of a VGAM2446 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2446 RNA, herein designated VGAM RNA, to host target binding sites on VGAM2446 host target RNA, herein designated VGAM HOST TARGET RNA, such as BINDING SITE I, BINDING SITE II and BINDING SITE III, inhibits translation of VGAM2446 host target RNA into VGAM2446 host target protein, herein designated VGAM HOST TARGET PROTEIN. VGAM host target protein is therefore outlined by a broken line.

It is appreciated that VGAM2446 host target gene, herein designated VGAM HOST TARGET GENE, in fact represents a plurality of VGAM2446 host target genes. The mRNA of each one of this plurality of VGAM2446 host target genes comprises one or more host target binding sites, each having a nucleotide sequence which is at least partly complementary to VGAM2446 RNA, herein designated VGAM RNA, and which when bound by VGAM2446 RNA causes inhibition of translation of respective one or more VGAM2446 host target proteins.

It is further appreciated by one skilled in the art that the mode of translational inhibition illustrated by FIG. 1 with specific reference to translational inhibition exerted by VGAM2446 gene, herein designated VGAM GENE, on one or more VGAM2446 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2446 is inhibition of expression of host target genes, as part of a novel viral mechanism of attacking a host. Accordingly, utilities of VGAM2446 include diagnosis, prevention and treatment of viral infection by Mouse Cytomegalovirus 1. Specific functions, and accordingly utilities, of VGAM2446 correlate with, and may be deduced from, the identity of the host target genes which VGAM2446 binds and inhibits, and the function of these host target genes, as elaborated hereinbelow.

Nucleotide sequences of the VGAM2446 precursor RNA, herein designated VGAM PRECURSOR RNA, and of the 'diced' VGAM2446 RNA, herein designated VGAM RNA, and a schematic representation of the secondary folding of VGAM2446 folded precursor RNA, herein designated VGAM FOLDED PRECURSOR RNA, of VGAM2446 are further described hereinbelow with reference to Table 1.

Nucleotide sequences of host target binding sites, such as BINDING SITE-I, BINDING SITE-II and BINDING SITE-III of FIG. 1, found on VGAM2446 host target RNA, and schematic representation of the complementarity of each of these host target binding sites to VGAM2446 RNA, herein designated VGAM RNA, are described hereinbelow with reference to Table 2.

As mentioned hereinabove with reference to FIG. 1, a function of VGAM2446 gene, herein designated VGAM is inhibition of expression of VGAM2446 target genes. It is appreciated that specific functions, and accordingly utilities, of VGAM2446 correlate with, and may be deduced from, the identity of the target genes which VGAM2446 binds and inhibits, and the function of these target genes, as elaborated hereinbelow.

Contactin Associated Protein-like 2 (CNTNAP2, Accession NM_014141) is a VGAM2446 host target gene. CNTNAP2 BINDING SITE is HOST TARGET binding site found in the 3' untranslated region of mRNA encoded by CNTNAP2, corresponding to a HOST TARGET binding site such as BINDING SITE I, BINDING SITE II or BINDING SITE III. Table 2 illustrates the complementarity of the nucleotide sequences of CNTNAP2 BINDING SITE, designated SEQ ID:15416, to the nucleotide sequence of VGAM2446 RNA, herein designated VGAM RNA, also designated SEQ ID:5157.

A function of VGAM2446 is therefore inhibition of Contactin Associated Protein-like 2 (CNTNAP2, Accession NM_014141). Accordingly, utilities of VGAM2446 include diagnosis, prevention and treatment of diseases and clinical conditions associated with CNTNAP2. DKFZP566B183 (Accession NM_015509) is another VGAM2446 host target gene. DKFZP566B183 BINDING SITE is HOST TARGET binding site found in the 3' untranslated region of mRNA encoded by DKFZP566B183, corresponding to a HOST TARGET binding site such as BINDING SITE I, BINDING SITE II or BINDING SITE III. Table 2 illustrates the complementarity of the nucleotide sequences of DKFZP566B183 BINDING SITE, designated SEQ ID:17768, to the nucleotide sequence of VGAM2446 RNA, herein designated VGAM RNA, also designated SEQ ID:5157.

Another function of VGAM2446 is therefore inhibition of DKFZP566B183 (Accession NM_015509). Accordingly, utilities of VGAM2446 include diagnosis, prevention and treatment of diseases and clinical conditions associated with DKFZP566B183. FLJ10511 (Accession NM_018120) is another VGAM2446 host target gene. FLJ10511 BINDING SITE is HOST TARGET binding site found in the 3' untranslated region of mRNA encoded by FLJ10511, corresponding to a HOST TARGET binding site such as BINDING SITE I, BINDING SITE II or BINDING SITE III. Table 2 illustrates the complementarity of the nucleotide sequences of FLJ10511 BINDING SITE, designated SEQ ID:19898, to the nucleotide sequence of VGAM2446 RNA, herein designated VGAM RNA, also designated SEQ ID:5157.

Another function of VGAM2446 is therefore inhibition of FLJ10511 (Accession NM_018120). Accordingly, utilities of VGAM2446 include diagnosis, prevention and treatment of diseases and clinical conditions associated with FLJ10511. FLJ13842 (Accession NM_024645) is another VGAM2446 host target gene. FLJ13842 BINDING SITE is HOST TARGET binding site found in the 3' untranslated region of mRNA encoded by FLJ13842, corresponding to a HOST TARGET binding site such as BINDING SITE I, BINDING SITE II or BINDING SITE III. Table 2 illustrates the complementarity of the nucleotide sequences of FLJ13842 BINDING SITE, designated SEQ ID:23929, to the nucleotide sequence of VGAM2446 RNA, herein designated VGAM RNA, also designated SEQ ID:5157.

Another function of VGAM2446 is therefore inhibition of FLJ13842 (Accession NM_024645). Accordingly, utilities of VGAM2446 include diagnosis, prevention and treatment of diseases and clinical conditions associated with FLJ13842. Retinoblastoma Binding Protein 7 (RBBP7, Accession XM_010272) is another VGAM2446 host target gene. RBBP7 BINDING SITE is HOST TARGET binding site found in the 3' untranslated region of mRNA encoded by RBBP7, corresponding to a HOST TARGET binding site such as BINDING SITE I, BINDING SITE II or BINDING SITE III. Table 2 illustrates the complementarity of the nucleotide sequences of RBBP7 BINDING SITE, designated SEQ ID:30150, to the nucleotide sequence of VGAM2446 RNA, herein designated VGAM RNA, also designated SEQ ID:5157.

Another function of VGAM2446 is therefore inhibition of Retinoblastoma Binding Protein 7 (RBBP7, Accession XM_010272). Accordingly, utilities of VGAM2446 include diagnosis, prevention and treatment of diseases and clinical conditions associated with RBBP7. LOC219654 (Accession XM_166095) is another VGAM2446 host target gene. LOC219654 BINDING SITE is HOST TARGET binding site found in the 3' untranslated region of mRNA encoded by LOC219654, corresponding to a HOST TARGET binding site such as BINDING SITE I, BINDING SITE II or BINDING SITE III. Table 2 illustrates the complementarity of the nucleotide sequences of LOC219654 BINDING SITE, designated SEQ ID:43872, to the nucleotide sequence of VGAM2446 RNA, herein designated VGAM RNA, also designated SEQ ID:5157.

Another function of VGAM2446 is therefore inhibition of LOC219654 (Accession XM_166095). Accordingly, utilities of VGAM2446 include diagnosis, prevention and treatment of diseases and clinical conditions associated with LOC219654. LOC221271 (Accession XM_166307) is another VGAM2446 host target gene. LOC221271 BINDING SITE is HOST TARGET binding site found in the 3' untranslated region of mRNA encoded by LOC221271, corresponding to a HOST TARGET binding site such as BINDING SITE I, BINDING SITE II or BINDING SITE III. Table 2 illustrates the complementarity of the nucleotide sequences of LOC221271 BINDING SITE, designated SEQ ID:44126, to the nucleotide sequence of VGAM2446 RNA, herein designated VGAM RNA, also designated SEQ ID:5157.

Another function of VGAM2446 is therefore inhibition of LOC221271 (Accession XM_166307). Accordingly, utilities of VGAM2446 include diagnosis, prevention and treatment of diseases and clinical conditions associated with LOC221271. FIG. 1 further provides a conceptual description of a novel bioinformatically detected viral gene of the present invention, referred to here as Viral Genomic Address Messenger 2447 (VGAM2447) viral gene, which modulates expression of respective host target genes thereof, the function and utility of which host target genes is known in the art.

VGAM2447 is a novel bioinformatically detected regulatory, non protein coding, viral micro RNA (miRNA) gene. The method by which VGAM2447 was detected is described hereinabove with reference to FIGS. 1-8.

VGAM2447 gene, herein designated VGAM GENE, is a viral gene contained in the genome of Mouse Cytomegalovirus 1. VGAM2447 host target gene, herein designated VGAM HOST TARGET GENE, is a human gene contained in the human genome.

VGAM2447 gene encodes a VGAM2447 precursor RNA, herein designated VGAM PRECURSOR RNA. Similar to other miRNA genes, and unlike most ordinary genes, VGAM2447 precursor RNA does not encode a protein. A nucleotide sequence identical or highly similar to the nucleotide sequence of VGAM2447 precursor RNA is designated SEQ ID:2433, and is provided hereinbelow with reference to the sequence listing part. Nucleotide sequence SEQ ID:2433 is located at position 2867 relative to the genome of Mouse Cytomegalovirus 1.

VGAM2447 precursor RNA folds onto itself, forming VGAM2447 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2447 folded precursor RNA into VGAM2447 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM2447 RNA is designated SEQ ID:5158, and is provided hereinbelow with reference to the sequence listing part.

VGAM2447 host target gene, herein designated VGAM HOST TARGET GENE, encodes a corresponding messenger RNA, VGAM2447 host target RNA, herein designated VGAM HOST TARGET RNA. VGAM2447 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2447 RNA, herein designated VGAM RNA, binds complementarily to one or more host target binding sites located in untranslated regions of VGAM2447 host target RNA, herein designated VGAM HOST TARGET RNA. This complementary binding is due to the fact that the nucleotide sequence of VGAM2447 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2447 RNA, herein designated VGAM RNA, may have a different number of host target binding sites in untranslated regions of a VGAM2447 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2447 RNA, herein designated VGAM RNA, to host target binding sites on VGAM2447 host target RNA, herein designated VGAM HOST TARGET RNA, such as BINDING SITE I, BINDING SITE II and BINDING SITE III, inhibits translation of VGAM2447 host target RNA into VGAM2447 host target protein, herein designated VGAM HOST TARGET PROTEIN. VGAM host target protein is therefore outlined by a broken line.

It is appreciated that VGAM2447 host target gene, herein designated VGAM HOST TARGET GENE, in fact represents a plurality of VGAM2447 host target genes. The mRNA of each one of this plurality of VGAM2447 host target genes comprises one or more host target binding sites, each having a nucleotide sequence which is at least partly complementary to VGAM2447 RNA, herein designated VGAM RNA, and which when bound by VGAM2447 RNA causes inhibition of translation of respective one or more VGAM2447 host target proteins.

It is further appreciated by one skilled in the art that the mode of translational inhibition illustrated by FIG. 1 with specific reference to translational inhibition exerted by VGAM2447 gene, herein designated VGAM GENE, on one or more VGAM2447 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2447 is inhibition of expression of host target genes, as part of a novel viral mechanism of attacking a host. Accordingly, utilities of VGAM2447 include diagnosis, prevention and treatment of viral infection by Mouse Cytomegalovirus 1. Specific functions, and accordingly utilities, of VGAM2447 correlate with, and may be deduced from, the identity of the host target genes which VGAM2447 binds and inhibits, and the function of these host target genes, as elaborated hereinbelow.

Nucleotide sequences of the VGAM2447 precursor RNA, herein designated VGAM PRECURSOR RNA, and of the 'diced' VGAM2447 RNA, herein designated VGAM RNA, and a schematic representation of the secondary folding of VGAM2447 folded precursor RNA, herein designated VGAM FOLDED PRECURSOR RNA, of VGAM2447 are further described hereinbelow with reference to Table 1.

Nucleotide sequences of host target binding sites, such as BINDING SITE-I, BINDING SITE-II and BINDING SITE-III of FIG. 1, found on VGAM2447 host target RNA, and schematic representation of the complementarity of each of these host target binding sites to VGAM2447 RNA, herein designated VGAM RNA, are described hereinbelow with reference to Table 2.

As mentioned hereinabove with reference to FIG. 1, a function of VGAM2447 gene, herein designated VGAM is inhibition of expression of VGAM2447 target genes. It is appreciated that specific functions, and accordingly utilities, of VGAM2447 correlate with, and may be deduced from, the identity of the target genes which VGAM2447 binds and inhibits, and the function of these target genes, as elaborated hereinbelow.

EphB2 (EPHB2, Accession NM_004442) is a VGAM2447 host target gene. EPHB2 BINDING SITE is HOST TARGET binding site found in the 3' untranslated region of mRNA encoded by EPHB2, corresponding to a HOST TARGET binding site such as BINDING SITE I, BINDING SITE II or BINDING SITE III. Table 2 illustrates the complementarity of the nucleotide sequences of EPHB2 BINDING SITE, designated SEQ ID:10730, to the nucleotide sequence of VGAM2447 RNA, herein designated VGAM RNA, also designated SEQ ID:5158.

A function of VGAM2447 is therefore inhibition of EphB2 (EPHB2, Accession NM_004442), a gene which Eph-related receptor tyrosine kinase B2; may have a role in neurogenesis. Accordingly, utilities of VGAM2447 include diagnosis, prevention and treatment of diseases and clinical conditions associated with EPHB2. The function of EPHB2 and its association with various diseases and clinical conditions, has been established by previous studies, as described hereinabove with reference to VGAM533. G Protein-coupled Receptor 23 (GPR23, Accession XM_018505) is another VGAM2447 host target gene. GPR23 BINDING SITE is HOST TARGET binding site found in the 3' untranslated region of mRNA encoded by GPR23, corresponding to a HOST TARGET binding site such as BINDING SITE I, BINDING SITE II or BINDING SITE III. Table 2 illustrates the complementarity of the nucleotide sequences of GPR23 BINDING SITE, designated SEQ ID:30364, to the nucleotide sequence of VGAM2447 RNA, herein designated VGAM RNA, also designated SEQ ID:5158.

Another function of VGAM2447 is therefore inhibition of G Protein-coupled Receptor 23 (GPR23, Accession XM_018505), a gene which is a member of the G protein-coupled receptor family. Accordingly, utilities of VGAM2447 include diagnosis, prevention and treatment of diseases and clinical conditions associated with GPR23. The function of GPR23 and its association with various diseases and clinical conditions, has been established by previous studies, as described hereinabove with reference to VGAM1125. KIAA1209 (Accession XM_027307) is another VGAM2447 host target gene. KIAA1209 BINDING SITE is HOST TARGET binding site found in the 3' untranslated region of mRNA encoded by KIAA1209, corresponding to a HOST TARGET binding site such as BINDING SITE I, BINDING SITE II or BINDING SITE III. Table 2 illustrates the complementarity of the nucleotide sequences of KIAA1209 BINDING SITE, designated SEQ ID:30469, to the nucleotide sequence of VGAM2447 RNA, herein designated VGAM RNA, also designated SEQ ID:5158.

Another function of VGAM2447 is therefore inhibition of KIAA1209 (Accession XM_027307). Accordingly, utilities of VGAM2447 include diagnosis, prevention and treatment of diseases and clinical conditions associated with KIAA1209. FIG. 1 further provides a conceptual description of a novel bioinformatically detected viral gene of the present invention, referred to here as Viral Genomic Address Messenger 2448 (VGAM2448) viral gene, which modulates expression of respective host target genes thereof, the function and utility of which host target genes is known in the art.

VGAM2448 is a novel bioinformatically detected regulatory, non protein coding, viral micro RNA (miRNA) gene. The method by which VGAM2448 was detected is described hereinabove with reference to FIGS. 1-8.

VGAM2448 gene, herein designated VGAM GENE, is a viral gene contained in the genome of Mouse Cytomegalovirus 1. VGAM2448 host target gene, herein designated VGAM HOST TARGET GENE, is a human gene contained in the human genome.

VGAM2448 gene encodes a VGAM2448 precursor RNA, herein designated VGAM PRECURSOR RNA. Similar to other miRNA genes, and unlike most ordinary genes, VGAM2448 precursor RNA does not encode a protein. A nucleotide sequence identical or highly similar to the nucleotide sequence of VGAM2448 precursor RNA is designated SEQ ID:2434, and is provided hereinbelow with reference to the sequence listing part. Nucleotide sequence SEQ ID:2434 is located at position 134478 relative to the genome of Mouse Cytomegalovirus 1.

VGAM2448 precursor RNA folds onto itself, forming VGAM2448 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2448 folded precursor RNA into VGAM2448 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2448 RNA is designated SEQ ID:5159, and is provided hereinbelow with reference to the sequence listing part.

VGAM2448 host target gene, herein designated VGAM HOST TARGET GENE, encodes a corresponding messenger RNA, VGAM2448 host target RNA, herein designated VGAM HOST TARGET RNA. VGAM2448 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2448 RNA, herein designated VGAM RNA, binds complementarily to one or more host target binding sites located in untranslated regions of VGAM2448 host target RNA, herein designated VGAM HOST TARGET RNA. This complementary binding is due to the fact that the nucleotide sequence of VGAM2448 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2448 RNA, herein designated VGAM RNA, may have a different number of host target binding sites in untranslated regions of a VGAM2448 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2448 RNA, herein designated VGAM RNA, to host target binding sites on VGAM2448 host target RNA, herein designated VGAM HOST TARGET RNA, such as BINDING SITE I, BINDING SITE II and BINDING SITE III, inhibits translation of VGAM2448 host target RNA into VGAM2448 host target protein, herein designated VGAM HOST TARGET PROTEIN. VGAM host target protein is therefore outlined by a broken line.

It is appreciated that VGAM2448 host target gene, herein designated VGAM HOST TARGET GENE, in fact represents a plurality of VGAM2448 host target genes. The mRNA of each one of this plurality of VGAM2448 host target genes comprises one or more host target binding sites, each having a nucleotide sequence which is at least partly complementary to VGAM2448 RNA, herein designated VGAM RNA, and which when bound by VGAM2448 RNA causes inhibition of translation of respective one or more VGAM2448 host target proteins.

It is further appreciated by one skilled in the art that the mode of translational inhibition illustrated by FIG. 1 with specific reference to translational inhibition exerted by VGAM2448 gene, herein designated VGAM GENE, on one or more VGAM2448 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2448 is inhibition of expression of host target genes, as part of a novel viral mechanism of attacking a host. Accordingly, utilities of VGAM2448 include diagnosis, prevention and treatment of viral infection by Mouse Cytomegalovirus 1. Specific functions, and accordingly utilities, of VGAM2448 correlate with, and may be deduced from, the identity of the host target genes which VGAM2448 binds and inhibits, and the function of these host target genes, as elaborated hereinbelow.

Nucleotide sequences of the VGAM2448 precursor RNA, herein designated VGAM PRECURSOR RNA, and of the 'diced' VGAM2448 RNA, herein designated VGAM RNA, and a schematic representation of the secondary folding of VGAM2448 folded precursor RNA, herein designated VGAM FOLDED PRECURSOR RNA, of VGAM2448 are further described hereinbelow with reference to Table 1.

Nucleotide sequences of host target binding sites, such as BINDING SITE-I, BINDING SITE-II and BINDING SITE-III of FIG. 1, found on VGAM2448 host target RNA, and schematic representation of the complementarity of each of these host target binding sites to VGAM2448 RNA, herein designated VGAM RNA, are described hereinbelow with reference to Table 2.

As mentioned hereinabove with reference to FIG. 1, a function of VGAM2448 gene, herein designated VGAM is inhibition of expression of VGAM2448 target genes. It is appreciated that specific functions, and accordingly utilities, of VGAM2448 correlate with, and may be deduced from, the identity of the target genes which VGAM2448 binds and inhibits, and the function of these target genes, as elaborated hereinbelow.

Mitogen-activated Protein Kinase 4 (MAPK4, Accession NM_002747) is a VGAM2448 host target gene. MAPK4 BINDING SITE is HOST TARGET binding site found in the 3' untranslated region of mRNA encoded by MAPK4, corresponding to a HOST TARGET binding site such as BINDING SITE I, BINDING SITE II or BINDING SITE III. Table 2 illustrates the complementarity of the nucleotide sequences of MAPK4 BINDING SITE, designated SEQ ID:8621, to the nucleotide sequence of VGAM2448 RNA, herein designated VGAM RNA, also designated SEQ ID:5159.

A function of VGAM2448 is therefore inhibition of Mitogen-activated Protein Kinase 4 (MAPK4, Accession NM_002747), a gene which phosphorylates microtubule-associated protein-2 may promote entry into the cell cycle. Accordingly, utilities of VGAM2448 include diagnosis, prevention and treatment of diseases and clinical conditions associated with MAPK4. The function of MAPK4 and its association with various diseases and clinical conditions, has been established by previous studies, as described hereinabove with reference to VGAM655. FLJ10008 (Accession NM_017970) is another VGAM2448 host target gene. FLJ10008 BINDING SITE is HOST TARGET binding site found in the 3' untranslated region of mRNA encoded by FLJ10008, corresponding to a HOST TARGET binding site such as BINDING SITE I, BINDING SITE II or BINDING SITE III. Table 2 illustrates the complementarity of the nucleotide sequences of FLJ10008 BINDING SITE, designated SEQ ID:19691, to the nucleotide sequence of VGAM2448 RNA, herein designated VGAM RNA, also designated SEQ ID:5159.

Another function of VGAM2448 is therefore inhibition of FLJ10008 (Accession NM_017970). Accordingly, utilities of VGAM2448 include diagnosis, prevention and treatment of diseases and clinical conditions associated with FLJ10008. FIG. 1 further provides a conceptual description of a novel bioinformatically detected viral gene of the present invention, referred to here as Viral Genomic Address Messenger 2449 (VGAM2449) viral gene, which modulates expression of respective host target genes thereof, the function and utility of which host target genes is known in the art.

VGAM2449 is a novel bioinformatically detected regulatory, non protein coding, viral micro RNA (miRNA) gene. The method by which VGAM2449 was detected is described hereinabove with reference to FIGS. 1-8.

VGAM2449 gene, herein designated VGAM GENE, is a viral gene contained in the genome of Mouse Cytomegalovirus 1. VGAM2449 host target gene, herein designated VGAM HOST TARGET GENE, is a human gene contained in the human genome.

VGAM2449 gene encodes a VGAM2449 precursor RNA, herein designated VGAM PRECURSOR RNA. Similar to other miRNA genes, and unlike most ordinary genes, VGAM2449 precursor RNA does not encode a protein. A nucleotide sequence identical or highly similar to the nucleotide sequence of VGAM2449 precursor RNA is designated SEQ ID:2435, and is provided hereinbelow with reference to the sequence listing part. Nucleotide sequence SEQ ID:2435 is located at position 53100 relative to the genome of Mouse Cytomegalovirus 1.

VGAM2449 precursor RNA folds onto itself, forming VGAM2449 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2449 folded precursor RNA into VGAM2449 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2449 RNA is designated SEQ ID:5160, and is provided hereinbelow with reference to the sequence listing part.

VGAM2449 host target gene, herein designated VGAM HOST TARGET GENE, encodes a corresponding messenger RNA, VGAM2449 host target RNA, herein designated VGAM HOST TARGET RNA. VGAM2449 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2449 RNA, herein designated VGAM RNA, binds complementarily to one or more host target binding sites located in untranslated regions of VGAM2449 host target RNA, herein designated VGAM HOST TARGET RNA. This complementary binding is due to the fact that the nucleotide sequence of VGAM2449 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2449 RNA, herein designated VGAM RNA, may have a different number of host target binding sites in untranslated regions of a VGAM2449 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2449 RNA, herein designated VGAM RNA, to host target binding sites on VGAM2449 host target RNA, herein designated VGAM HOST TARGET RNA, such as BINDING SITE I, BINDING SITE II and BINDING SITE III, inhibits translation of VGAM2449 host target RNA into VGAM2449 host target protein, herein designated VGAM HOST TARGET PROTEIN. VGAM host target protein is therefore outlined by a broken line.

It is appreciated that VGAM2449 host target gene, herein designated VGAM HOST TARGET GENE, in fact represents a plurality of VGAM2449 host target genes. The mRNA of each one of this plurality of VGAM2449 host target genes comprises one or more host target binding sites, each having a nucleotide sequence which is at least partly complementary to VGAM2449 RNA, herein designated VGAM RNA, and which when bound by VGAM2449 RNA causes inhibition of translation of respective one or more VGAM2449 host target proteins.

It is further appreciated by one skilled in the art that the mode of translational inhibition illustrated by FIG. 1 with specific reference to translational inhibition exerted by VGAM2449 gene, herein designated VGAM GENE, on one or more VGAM2449 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2449 is inhibition of expression of host target genes, as part of a novel viral mechanism of attacking a host. Accordingly, utilities of VGAM2449 include diagnosis, prevention and treatment of viral infection by Mouse Cytomegalovirus 1. Specific functions, and accordingly utilities, of VGAM2449 correlate with, and may be deduced from, the identity of the host target genes which VGAM2449 binds and inhibits, and the function of these host target genes, as elaborated hereinbelow.

Nucleotide sequences of the VGAM2449 precursor RNA, herein designated VGAM PRECURSOR RNA, and of the 'diced' VGAM2449 RNA, herein designated VGAM RNA, and a schematic representation of the secondary folding of VGAM2449 folded precursor RNA, herein designated VGAM FOLDED PRECURSOR RNA, of VGAM2449 are further described hereinbelow with reference to Table 1.

Nucleotide sequences of host target binding sites, such as BINDING SITE-I, BINDING SITE-II and BINDING SITE-III of FIG. 1, found on VGAM2449 host target RNA, and schematic representation of the complementarity of each of these host target binding sites to VGAM2449 RNA, herein designated VGAM RNA, are described hereinbelow with reference to Table 2.

As mentioned hereinabove with reference to FIG. 1, a function of VGAM2449 gene, herein designated VGAM is inhibition of expression of VGAM2449 target genes. It is appreciated that specific functions, and accordingly utilities, of VGAM2449 correlate with, and may be deduced from, the identity of the target genes which VGAM2449 binds and inhibits, and the function of these target genes, as elaborated hereinbelow.

EGF-like-domain, Multiple 5 (EGFL5, Accession XM_098838) is a VGAM2449 host target gene. EGFL5 BINDING SITE is HOST TARGET binding site found in the 3' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41878, to the nucleotide sequence of VGAM2449 RNA, herein designated VGAM RNA, also designated SEQ ID:5160.

A function of VGAM2449 is therefore inhibition of EGF-like-domain, Multiple 5 (EGFL5, Accession XM_098838). Accordingly, utilities of VGAM2449 include diagnosis, prevention and treatment of diseases and clinical conditions associated with EGFL5. Natriuretic Peptide Receptor A/guanylate Cyclase A (atrionatriuretic peptide receptor A) (NPR1, Accession XM_113360) is another VGAM2449 host target gene. NPR1 BINDING SITE is HOST TARGET binding site found in the 5' untranslated region of mRNA encoded by NPR1, corresponding to a HOST TARGET binding site such as BINDING SITE I, BINDING SITE II or BINDING SITE III. Table 2 illustrates the complementarity of the nucleotide sequences of NPR1 BINDING SITE, designated SEQ ID:42232, to the nucleotide sequence of VGAM2449 RNA, herein designated VGAM RNA, also designated SEQ ID:5160.

Another function of VGAM2449 is therefore inhibition of Natriuretic Peptide Receptor A/guanylate Cyclase A (atrionatriuretic peptide receptor A) (NPR1, Accession XM_113360), a gene which has guanylate cyclase activity on binding of anf. Accordingly, utilities of VGAM2449 include diagnosis, prevention and treatment of diseases and clinical conditions associated with NPR1. The function of NPR1 and its association with various diseases and clinical conditions, has been established by previous studies, as described hereinabove with reference to VGAM719. Zinc Finger Protein 80 (pT17) (ZNF80, Accession NM_007136) is another VGAM2449 host target gene. ZNF80 BINDING SITE is HOST TARGET binding site found in the 5' untranslated region of mRNA encoded by ZNF80, corresponding to a HOST TARGET binding site such as BINDING SITE I, BINDING SITE II or BINDING SITE III. Table 2 illustrates the complementarity of the nucleotide sequences of ZNF80 BINDING SITE, designated SEQ ID:13985, to the nucleotide sequence of VGAM2449 RNA, herein designated VGAM RNA, also designated SEQ ID:5160.

Another function of VGAM2449 is therefore inhibition of Zinc Finger Protein 80 (pT17) (ZNF80, Accession NM_007136). Accordingly, utilities of VGAM2449 include diagnosis, prevention and treatment of diseases and clinical conditions associated with ZNF80. 13CDNA73 (Accession NM_023037) is another VGAM2449 host target gene.

13CDNA73 BINDING SITE is HOST TARGET binding site found in the 5' untranslated region of mRNA encoded by 13CDNA73, corresponding to a HOST TARGET binding site such as BINDING SITE I, BINDING SITE II or BINDING SITE III. Table 2 illustrates the complementarity of the nucleotide sequences of 13CDNA73 BINDING SITE, designated SEQ ID:23320, to the nucleotide sequence of VGAM2449 RNA, herein designated VGAM RNA, also designated SEQ ID:5160.

Another function of VGAM2449 is therefore inhibition of 13CDNA73 (Accession NM_023037). Accordingly, utilities of VGAM2449 include diagnosis, prevention and treatment of diseases and clinical conditions associated with 13CDNA73. Artemin (ARTN, Accession NM_003976) is another VGAM2449 host target gene. ARTN BINDING SITE is HOST TARGET binding site found in the 5' untranslated region of mRNA encoded by ARTN, corresponding to a HOST TARGET binding site such as BINDING SITE I, BINDING SITE II or BINDING SITE III. Table 2 illustrates the complementarity of the nucleotide sequences of ARTN BINDING SITE, designated SEQ ID:10109, to the nucleotide sequence of VGAM2449 RNA, herein designated VGAM RNA, also designated SEQ ID:5160.

Another function of VGAM2449 is therefore inhibition of Artemin (ARTN, Accession NM_003976). Accordingly, utilities of VGAM2449 include diagnosis, prevention and treatment of diseases and clinical conditions associated with ARTN. Chromobox Homolog 6 (CBX6, Accession NM_014292) is another VGAM2449 host target gene. CBX6 BINDING SITE is HOST TARGET binding site found in the 3' untranslated region of mRNA encoded by CBX6, corresponding to a HOST TARGET binding site such as BINDING SITE I, BINDING SITE II or BINDING SITE III. Table 2 illustrates the complementarity of the nucleotide sequences of CBX6 BINDING SITE, designated SEQ ID:15573, to the nucleotide sequence of VGAM2449 RNA, herein designated VGAM RNA, also designated SEQ ID:5160.

Another function of VGAM2449 is therefore inhibition of Chromobox Homolog 6 (CBX6, Accession NM_014292). Accordingly, utilities of VGAM2449 include diagnosis, prevention and treatment of diseases and clinical conditions associated with CBX6. GNB4 (Accession NM_021629) is another VGAM2449 host target gene. GNB4 BINDING SITE is HOST TARGET binding site found in the 3' untranslated region of mRNA encoded by GNB4, corresponding to a HOST TARGET binding site such as BINDING SITE I, BINDING SITE II or BINDING SITE III. Table 2 illustrates the complementarity of the nucleotide sequences of GNB4 BINDING SITE, designated SEQ ID:22268, to the nucleotide sequence of VGAM2449 RNA, herein designated VGAM RNA, also designated SEQ ID:5160.

Another function of VGAM2449 is therefore inhibition of GNB4 (Accession NM_021629). Accordingly, utilities of VGAM2449 include diagnosis, prevention and treatment of diseases and clinical conditions associated with GNB4. MAD, Mothers Against Decapentaplegic Homolog (Drosophila) Interacting Protein, Receptor Activation Anchor (MADHIP, Accession NM_007324) is another VGAM2449 host target gene. MADHIP BINDING SITE is HOST TARGET binding site found in the 3' untranslated region of mRNA encoded by MADHIP, corresponding to a HOST TARGET binding site such as BINDING SITE I, BINDING SITE II or BINDING SITE III. Table 2 illustrates the complementarity of the nucleotide sequences of MADHIP BINDING SITE, designated SEQ ID:14242, to the nucleotide sequence of VGAM2449 RNA, herein designated VGAM RNA, also designated SEQ ID:5160.

Another function of VGAM2449 is therefore inhibition of MAD, Mothers Against Decapentaplegic Homolog (Drosophila) Interacting Protein, Receptor Activation Anchor (MADHIP, Accession NM_007324). Accordingly, utilities of VGAM2449 include diagnosis, prevention and treatment of diseases and clinical conditions associated with MADHIP. Splicing Factor, Arginine/serine-rich 12 (SFRS12, Accession NM_139168) is another VGAM2449 host target gene. SFRS12 BINDING SITE is HOST TARGET binding site found in the 3' untranslated region of mRNA encoded by SFRS12, corresponding to a HOST TARGET binding site such as BINDING SITE I, BINDING SITE II or BINDING SITE III. Table 2 illustrates the complementarity of the nucleotide sequences of SFRS12 BINDING SITE, designated SEQ ID:29174, to the nucleotide sequence of VGAM2449 RNA, herein designated VGAM RNA, also designated SEQ ID:5160.

Another function of VGAM2449 is therefore inhibition of Splicing Factor, Arginine/serine-rich 12 (SFRS12, Accession NM_139168). Accordingly, utilities of VGAM2449 include diagnosis, prevention and treatment of diseases and clinical conditions associated with SFRS12. SPEC1 (Accession NM_020239) is another VGAM2449 host target gene. SPEC1 BINDING SITE is HOST TARGET binding site found in the 3' untranslated region of mRNA encoded by SPEC1, corresponding to a HOST TARGET binding site such as BINDING SITE I, BINDING SITE II or BINDING SITE III. Table 2 illustrates the complementarity of the nucleotide sequences of SPEC1 BINDING SITE, designated SEQ ID:21508, to the nucleotide sequence of VGAM2449 RNA, herein designated VGAM RNA, also designated SEQ ID:5160.

Another function of VGAM2449 is therefore inhibition of SPEC1 (Accession NM_020239). Accordingly, utilities of VGAM2449 include diagnosis, prevention and treatment of diseases and clinical conditions associated with SPEC1. Testis-specific Transcript, Y-linked 9 (TTTY9, Accession NM_031927) is another VGAM2449 host target gene. TTTY9 BINDING SITE is HOST TARGET binding site found in the 5' untranslated region of mRNA encoded by TTTY9, corresponding to a HOST TARGET binding site such as BINDING SITE I, BINDING SITE II or BINDING SITE III. Table 2 illustrates the complementarity of the nucleotide sequences of TTTY9 BINDING SITE, designated SEQ ID:25675, to the nucleotide sequence of VGAM2449 RNA, herein designated VGAM RNA, also designated SEQ ID:5160.

Another function of VGAM2449 is therefore inhibition of Testis-specific Transcript, Y-linked 9 (TTTY9, Accession NM_031927). Accordingly, utilities of VGAM2449 include diagnosis, prevention and treatment of diseases and clinical conditions associated with TTTY9. LOC126432 (Accession XM_059046) is another VGAM2449 host target gene. LOC126432 BINDING SITE is HOST TARGET binding site found in the 5' untranslated region of mRNA encoded by LOC126432, corresponding to a HOST TARGET binding site such as BINDING SITE I, BINDING SITE II or BINDING SITE III. Table 2 illustrates the complementarity of the nucleotide sequences of LOC126432 BINDING SITE, designated SEQ ID:36839, to the nucleotide sequence of VGAM2449 RNA, herein designated VGAM RNA, also designated SEQ ID:5160.

Another function of VGAM2449 is therefore inhibition of LOC126432 (Accession XM_059046). Accordingly, utilities of VGAM2449 include diagnosis, prevention and treatment of diseases and clinical conditions associated with LOC126432. LOC257239 (Accession XM_173125) is another VGAM2449 host target gene. LOC257239 BINDING SITE is HOST TARGET binding site found in the 5' untranslated region of mRNA encoded by LOC257239, corresponding to a HOST TARGET binding site such as BINDING SITE I, BINDING SITE II or BINDING SITE III. Table 2 illustrates the complementarity of the nucleotide sequences of LOC257239 BINDING SITE, designated SEQ ID:46373, to the nucleotide sequence of VGAM2449 RNA, herein designated VGAM RNA, also designated SEQ ID:5160.

Another function of VGAM2449 is therefore inhibition of LOC257239 (Accession XM_173125). Accordingly, utilities of VGAM2449 include diagnosis, prevention and treatment of diseases and clinical conditions associated with LOC257239. FIG. 1 further provides a conceptual description of a novel bioinformatically detected viral gene of the present invention, referred to here as Viral Genomic Address Messenger 2450 (VGAM2450) viral gene, which modulates expression of respective host target genes thereof, the function and utility of which host target genes is known in the art.

VGAM2450 is a novel bioinformatically detected regulatory, non protein coding, viral micro RNA (miRNA) gene. The method by which VGAM2450 was detected is described hereinabove with reference to FIGS. 1-8.

VGAM2450 gene, herein designated VGAM GENE, is a viral gene contained in the genome of Mouse Cytomegalovirus 1. VGAM2450 host target gene, herein designated VGAM HOST TARGET GENE, is a human gene contained in the human genome.

VGAM2450 gene encodes a VGAM2450 precursor RNA, herein designated VGAM PRECURSOR RNA. Similar to other miRNA genes, and unlike most ordinary genes, VGAM2450 precursor RNA does not encode a protein. A nucleotide sequence identical or highly similar to the nucleotide sequence of VGAM2450 precursor RNA is designated SEQ ID:2436, and is provided hereinbelow with reference to the sequence listing part. Nucleotide sequence SEQ ID:2436 is located at position 39437 relative to the genome of Mouse Cytomegalovirus 1.

VGAM2450 precursor RNA folds onto itself, forming VGAM2450 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2450 folded precursor RNA into VGAM2450 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2450 RNA is designated SEQ ID:5161, and is provided hereinbelow with reference to the sequence listing part.

VGAM2450 host target gene, herein designated VGAM HOST TARGET GENE, encodes a corresponding messenger RNA, VGAM2450 host target RNA, herein designated VGAM HOST TARGET RNA. VGAM2450 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2450 RNA, herein designated VGAM RNA, binds complementarily to one or more host target binding sites located in untranslated regions of VGAM2450 host target RNA, herein designated VGAM HOST TARGET RNA. This complementary binding is due to the fact that the nucleotide sequence of VGAM2450 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2450 RNA, herein designated VGAM RNA, may have a different number of host target binding sites in untranslated regions of a VGAM2450 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2450 RNA, herein designated VGAM RNA, to host target binding sites on VGAM2450 host target RNA, herein designated VGAM HOST TARGET RNA, such as BINDING SITE I, BINDING SITE II and BINDING SITE III, inhibits translation of VGAM2450 host target RNA into VGAM2450 host target protein, herein designated VGAM HOST TARGET PROTEIN. VGAM host target protein is therefore outlined by a broken line.

It is appreciated that VGAM2450 host target gene, herein designated VGAM HOST TARGET GENE, in fact represents a plurality of VGAM2450 host target genes. The mRNA of each one of this plurality of VGAM2450 host target genes comprises one or more host target binding sites, each having a nucleotide sequence which is at least partly complementary to VGAM2450 RNA, herein designated VGAM RNA, and which when bound by VGAM2450 RNA causes inhibition of translation of respective one or more VGAM2450 host target proteins.

It is further appreciated by one skilled in the art that the mode of translational inhibition illustrated by FIG. 1 with specific reference to translational inhibition exerted by VGAM2450 gene, herein designated VGAM GENE, on one or more VGAM2450 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2450 is inhibition of expression of host target genes, as part of a novel viral mechanism of attacking a host. Accordingly, utilities of VGAM2450 include diagnosis, prevention and treatment of viral infection by Mouse Cytomegalovirus 1. Specific functions, and accordingly utilities, of VGAM2450 correlate with, and may be deduced from, the identity of the host target genes which VGAM2450 binds and inhibits, and the function of these host target genes, as elaborated hereinbelow.

Nucleotide sequences of the VGAM2450 precursor RNA, herein designated VGAM PRECURSOR RNA, and of the 'diced' VGAM2450 RNA, herein designated VGAM RNA, and a schematic representation of the secondary folding of VGAM2450 folded precursor RNA, herein designated VGAM FOLDED PRECURSOR RNA, of VGAM2450 are further described hereinbelow with reference to Table 1.

Nucleotide sequences of host target binding sites, such as BINDING SITE-I, BINDING SITE-II and BINDING SITE-III of FIG. 1, found on VGAM2450 host target RNA, and schematic representation of the complementarity of each of these host target binding sites to VGAM2450 RNA, herein designated VGAM RNA, are described hereinbelow with reference to Table 2.

As mentioned hereinabove with reference to FIG. 1, a function of VGAM2450 gene, herein designated VGAM is inhibition of expression of VGAM2450 target genes. It is appreciated that specific functions, and accordingly utilities, of VGAM2450 correlate with, and may be deduced from, the identity of the target genes which VGAM2450 binds and inhibits, and the function of these target genes, as elaborated hereinbelow.

Chromosome 20 Open Reading Frame 162 (C20orf162, Accession NM_080603) is a VGAM2450 host target gene. C20orf162 BINDING SITE is HOST TARGET binding site found in the 5' untranslated region of mRNA encoded by C20orf162, corresponding to a HOST TARGET binding site such as BINDING SITE I, BINDING SITE II or BINDING SITE III. Table 2 illustrates the complementarity of the nucleotide sequences of C20orf162 BINDING SITE, designated SEQ ID:27914, to the nucleotide sequence of VGAM2450 RNA, herein designated VGAM RNA, also designated SEQ ID:5161.

A function of VGAM2450 is therefore inhibition of Chromosome 20 Open Reading Frame 162 (C20orf162, Accession NM_080603). Accordingly, utilities of VGAM2450 include diagnosis, prevention and treatment of diseases and clinical conditions associated with C20orf162. HRIHFB2436 (Accession NM_014345) is another VGAM2450 host target gene. HRIHFB2436 BINDING SITE is HOST TARGET binding site found in the 5' untranslated region of mRNA encoded by HRIHFB2436, corresponding to a HOST TARGET binding site such as BINDING SITE I, BINDING SITE II or BINDING SITE III. Table 2 illustrates the complementarity of the nucleotide sequences of HRIHFB2436 BINDING SITE, designated SEQ ID:15666, to the nucleotide sequence of VGAM2450 RNA, herein designated VGAM RNA, also designated SEQ ID:5161.

Another function of VGAM2450 is therefore inhibition of HRIHFB2436 (Accession NM_014345). Accordingly, utilities of VGAM2450 include diagnosis, prevention and treatment of diseases and clinical conditions associated with HRIHFB2436. LOC145988 (Accession XM_085290) is another VGAM2450 host target gene. LOC145988 BINDING SITE is HOST TARGET binding site found in the 5' untranslated region of mRNA encoded by LOC145988, corresponding to a HOST TARGET binding site such as BINDING SITE I, BINDING SITE II or BINDING SITE III. Table 2 illustrates the complementarity of the nucleotide sequences of LOC145988 BINDING SITE, designated SEQ ID:38036, to the nucleotide sequence of VGAM2450 RNA, herein designated VGAM RNA, also designated SEQ ID:5161.

Another function of VGAM2450 is therefore inhibition of LOC145988 (Accession XM_085290). Accordingly, utilities of VGAM2450 include diagnosis, prevention and treatment of diseases and clinical conditions associated with LOC145988. LOC220110 (Accession XM_167882) is another VGAM2450 host target gene. LOC220110 BINDING SITE is HOST TARGET binding site found in the 5' untranslated region of mRNA encoded by LOC220110, corresponding to a HOST TARGET binding site such as BINDING SITE I, BINDING SITE II or BINDING SITE III. Table 2 illustrates the complementarity of the nucleotide sequences of LOC220110 BINDING SITE, designated SEQ ID:44893, to the nucleotide sequence of VGAM2450 RNA, herein designated VGAM RNA, also designated SEQ ID:5161.

Another function of VGAM2450 is therefore inhibition of LOC220110 (Accession XM_167882). Accordingly, utilities of VGAM2450 include diagnosis, prevention and treatment of diseases and clinical conditions associated with LOC220110. LOC221943 (Accession XM_168343) is another VGAM2450 host target gene. LOC221943 BINDING SITE is HOST TARGET binding site found in the 5' untranslated region of mRNA encoded by LOC221943, corresponding to a HOST TARGET binding site such as BINDING SITE I, BINDING SITE II or BINDING SITE III. Table 2 illustrates the complementarity of the nucleotide sequences of LOC221943 BINDING SITE, designated SEQ ID:45116, to the nucleotide sequence of VGAM2450 RNA, herein designated VGAM RNA, also designated SEQ ID:5161.

Another function of VGAM2450 is therefore inhibition of LOC221943 (Accession XM_168343). Accordingly, utilities of VGAM2450 include diagnosis, prevention and treatment of diseases and clinical conditions associated with LOC221943. FIG. 1 further provides a conceptual description of a novel bioinformatically detected viral gene of the present invention, referred to here as Viral Genomic Address Messenger 2451 (VGAM2451) viral gene, which modulates expression of respective host target genes thereof, the function and utility of which host target genes is known in the art.

VGAM2451 is a novel bioinformatically detected regulatory, non protein coding, viral micro RNA (miRNA) gene. The method by which VGAM2451 was detected is described hereinabove with reference to FIGS. 1-8.

VGAM2451 gene, herein designated VGAM GENE, is a viral gene contained in the genome of Mouse Cytomegalovirus 1. VGAM2451 host target gene, herein designated VGAM HOST TARGET GENE, is a human gene contained in the human genome.

VGAM2451 gene encodes a VGAM2451 precursor RNA, herein designated VGAM PRECURSOR RNA. Similar to other miRNA genes, and unlike most ordinary genes, VGAM2451 precursor RNA does not encode a protein. A nucleotide sequence identical or highly similar to the nucleotide sequence of VGAM2451 precursor RNA is designated SEQ ID:2437, and is provided hereinbelow with reference to the sequence listing part. Nucleotide sequence SEQ ID:2437 is located at position 43825 relative to the genome of Mouse Cytomegalovirus 1.

VGAM2451 precursor RNA folds onto itself, forming VGAM2451 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2451 folded precursor RNA into VGAM2451 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2451 RNA is designated SEQ ID:5162, and is provided hereinbelow with reference to the sequence listing part.

VGAM2451 host target gene, herein designated VGAM HOST TARGET GENE, encodes a corresponding messenger RNA, VGAM2451 host target RNA, herein designated VGAM HOST TARGET RNA. VGAM2451 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2451 RNA, herein designated VGAM RNA, binds complementarily to one or more host target binding sites located in untranslated regions of VGAM2451 host target RNA, herein designated VGAM HOST TARGET RNA. This complementary binding is due to the fact that the nucleotide sequence of VGAM2451 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2451 RNA, herein designated VGAM RNA, may have a different number of host target binding sites in untranslated regions of a VGAM2451 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2451 RNA, herein designated VGAM RNA, to host target binding sites on VGAM2451 host target RNA, herein designated VGAM HOST TARGET RNA, such as BINDING SITE I, BINDING SITE II and BINDING SITE III, inhibits translation of VGAM2451 host target RNA into VGAM2451 host target protein, herein designated VGAM HOST TARGET PROTEIN. VGAM host target protein is therefore outlined by a broken line.

It is appreciated that VGAM2451 host target gene, herein designated VGAM HOST TARGET GENE, in fact represents a plurality of VGAM2451 host target genes. The mRNA of each one of this plurality of VGAM2451 host target genes comprises one or more host target binding sites, each having a nucleotide sequence which is at least partly complementary to VGAM2451 RNA, herein designated VGAM RNA, and which when bound by VGAM2451 RNA causes inhibition of translation of respective one or more VGAM2451 host target proteins.

It is further appreciated by one skilled in the art that the mode of translational inhibition illustrated by FIG. 1 with specific reference to translational inhibition exerted by VGAM2451 gene, herein designated VGAM GENE, on one or more VGAM2451 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2451 is inhibition of expression of host target genes, as part of a novel viral mechanism of attacking a host. Accordingly, utilities of VGAM2451 include diagnosis, prevention and treatment of viral infection by Mouse Cytomegalovirus 1. Specific functions, and accordingly utilities, of VGAM2451 correlate with, and may be deduced from, the identity of the host target genes which VGAM2451 binds and inhibits, and the function of these host target genes, as elaborated hereinbelow.

Nucleotide sequences of the VGAM2451 precursor RNA, herein designated VGAM PRECURSOR RNA, and of the 'diced' VGAM2451 RNA, herein designated VGAM RNA, and a schematic representation of the secondary folding of VGAM2451 folded precursor RNA, herein designated VGAM FOLDED PRECURSOR RNA, of VGAM2451 are further described hereinbelow with reference to Table 1.

Nucleotide sequences of host target binding sites, such as BINDING SITE-I, BINDING SITE-II and BINDING SITE-III of FIG. 1, found on VGAM2451 host target RNA, and schematic representation of the complementarity of each of these host target binding sites to VGAM2451 RNA, herein designated VGAM RNA, are described hereinbelow with reference to Table 2.

As mentioned hereinabove with reference to FIG. 1, a function of VGAM2451 gene, herein designated VGAM is inhibition of expression of VGAM2451 target genes. It is appreciated that specific functions, and accordingly utilities, of VGAM2451 correlate with, and may be deduced from, the identity of the target genes which VGAM2451 binds and inhibits, and the function of these target genes, as elaborated hereinbelow.

KIAA1384 (Accession XM_035405) is a VGAM2451 host target gene. KIAA1384 BINDING SITE is HOST TARGET binding site found in the 3' untranslated region of mRNA encoded by KIAA1384, corresponding to a HOST TARGET binding site such as BINDING SITE I, BINDING SITE II or BINDING SITE III. Table 2 illustrates the complementarity of the nucleotide sequences of KIAA1384 BINDING SITE, designated SEQ ID:32258, to the nucleotide sequence of VGAM2451 RNA, herein designated VGAM RNA, also designated SEQ ID:5162.

A function of VGAM2451 is therefore inhibition of KIAA1384 (Accession XM_035405). Accordingly, utilities of VGAM2451 include diagnosis, prevention and treatment of diseases and clinical conditions associated with KIAA1384. FIG. 1 further provides a conceptual description of a novel bioinformatically detected viral gene of the present invention, referred to here as Viral Genomic Address Messenger 2452 (VGAM2452) viral gene, which modulates expression of respective host target genes thereof, the function and utility of which host target genes is known in the art.

VGAM2452 is a novel bioinformatically detected regulatory, non protein coding, viral micro RNA (miRNA) gene. The method by which VGAM2452 was detected is described hereinabove with reference to FIGS. 1-8.

VGAM2452 gene, herein designated VGAM GENE, is a viral gene contained in the genome of Mouse Cytomegalovirus 1. VGAM2452 host target gene, herein designated VGAM HOST TARGET GENE, is a human gene contained in the human genome.

VGAM2452 gene encodes a VGAM2452 precursor RNA, herein designated VGAM PRECURSOR RNA. Similar to other miRNA genes, and unlike most ordinary genes, VGAM2452 precursor RNA does not encode a protein. A nucleotide sequence identical or highly similar to the nucleotide sequence of VGAM2452 precursor RNA is designated SEQ ID:2438, and is provided hereinbelow with reference to the sequence listing part. Nucleotide sequence SEQ ID:2438 is located at position 150242 relative to the genome of Mouse Cytomegalovirus 1.

VGAM2452 precursor RNA folds onto itself, forming VGAM2452 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2452 folded precursor RNA into VGAM2452 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2452 RNA is designated SEQ ID:5163, and is provided hereinbelow with reference to the sequence listing part.

VGAM2452 host target gene, herein designated VGAM HOST TARGET GENE, encodes a corresponding messenger RNA, VGAM2452 host target RNA, herein designated VGAM HOST TARGET RNA. VGAM2452 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2452 RNA, herein designated VGAM RNA, binds complementarily to one or more host target binding sites located in untranslated regions of VGAM2452 host target RNA, herein designated VGAM HOST TARGET RNA. This complementary binding is due to the fact that the nucleotide sequence of VGAM2452 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2452 RNA, herein designated VGAM RNA, may have a different number of host target binding sites in untranslated regions of a VGAM2452 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2452 RNA, herein designated VGAM RNA, to host target binding sites on VGAM2452 host target RNA, herein designated VGAM HOST TARGET RNA, such as BINDING SITE I, BINDING SITE II and BINDING SITE III, inhibits translation of VGAM2452 host target RNA into VGAM2452 host target protein, herein designated VGAM HOST TARGET PROTEIN. VGAM host target protein is therefore outlined by a broken line.

It is appreciated that VGAM2452 host target gene, herein designated VGAM HOST TARGET GENE, in fact represents a plurality of VGAM2452 host target genes. The mRNA of each one of this plurality of VGAM2452 host target genes comprises one or more host target binding sites, each having a nucleotide sequence which is at least partly complementary to VGAM2452 RNA, herein designated VGAM RNA, and which when bound by VGAM2452 RNA causes inhibition of translation of respective one or more VGAM2452 host target proteins.

It is further appreciated by one skilled in the art that the mode of translational inhibition illustrated by FIG. 1 with specific reference to translational inhibition exerted by VGAM2452 gene, herein designated VGAM GENE, on one or more VGAM2452 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2452 is inhibition of expression of host target genes, as part of a novel viral mechanism of attacking a host. Accordingly, utilities of VGAM2452 include diagnosis, prevention and treatment of viral infection by Mouse Cytomegalovirus 1. Specific functions, and accordingly utilities, of VGAM2452 correlate with, and may be deduced from, the identity of the host target genes which VGAM2452 binds and inhibits, and the function of these host target genes, as elaborated hereinbelow.

Nucleotide sequences of the VGAM2452 precursor RNA, herein designated VGAM PRECURSOR RNA, and of the 'diced' VGAM2452 RNA, herein designated VGAM RNA, and a schematic representation of the secondary folding of VGAM2452 folded precursor RNA, herein designated VGAM FOLDED PRECURSOR RNA, of VGAM2452 are further described hereinbelow with reference to Table 1.

Nucleotide sequences of host target binding sites, such as BINDING SITE-I, BINDING SITE-II and BINDING SITE-III of FIG. 1, found on VGAM2452 host target RNA, and schematic representation of the complementarity of each of these host target binding sites to VGAM2452 RNA, herein designated VGAM RNA, are described hereinbelow with reference to Table 2.

As mentioned hereinabove with reference to FIG. 1, a function of VGAM2452 gene, herein designated VGAM is inhibition of expression of VGAM2452 target genes. It is appreciated that specific functions, and accordingly utilities, of VGAM2452 correlate with, and may be deduced from, the identity of the target genes which VGAM2452 binds and inhibits, and the function of these target genes, as elaborated hereinbelow.

Flavin Containing Monooxygenase 4 (FMO4, Accession NM_002022) is a VGAM2452 host target gene. FMO4 BINDING SITE is HOST TARGET binding site found in the 5' untranslated region of mRNA encoded by FMO4, corresponding to a HOST TARGET binding site such as BINDING SITE I, BINDING SITE II or BINDING SITE III. Table 2 illustrates the complementarity of the nucleotide sequences of FMO4 BINDING SITE, designated SEQ ID:7768, to the nucleotide sequence of VGAM2452 RNA, herein designated VGAM RNA, also designated SEQ ID:5163.

A function of VGAM2452 is therefore inhibition of Flavin Containing Monooxygenase 4 (FMO4, Accession NM_002022). Accordingly, utilities of VGAM2452 include diagnosis, prevention and treatment of diseases and clinical conditions associated with FMO4. Jerky Homolog (mouse) (JRK, Accession XM_098818) is another VGAM2452 host target gene. JRK BINDING SITE is HOST TARGET binding site found in the 3' untranslated region of mRNA encoded by JRK, corresponding to a HOST TARGET binding site such as BINDING SITE I, BINDING SITE II or BINDING SITE III. Table 2 illustrates the complementarity of the nucleotide sequences of JRK BINDING SITE, designated SEQ ID:41836, to the nucleotide sequence of VGAM2452 RNA, herein designated VGAM RNA, also designated SEQ ID:5163.

Another function of VGAM2452 is therefore inhibition of Jerky Homolog (mouse) (JRK, Accession XM_098818), a gene which might function as a DNA-binding protein. Accordingly, utilities of VGAM2452 include diagnosis, prevention and treatment of diseases and clinical conditions associated with JRK. The function of JRK and its association with various diseases and clinical conditions, has been established by previous studies, as described hereinabove with reference to VGAM210. Melanoma Antigen, Family A, 3 (MAGEA3, Accession NM_005362) is another VGAM2452 host target gene. MAGEA3 BINDING SITE is HOST TARGET binding site found in the 5' untranslated region of mRNA encoded by MAGEA3, corresponding to a HOST TARGET binding site such as BINDING SITE I, BINDING SITE II or BINDING SITE III. Table 2 illustrates the complementarity of the nucleotide sequences of MAGEA3 BINDING SITE, designated SEQ ID:11839, to the nucleotide sequence of VGAM2452 RNA, herein designated VGAM RNA, also designated SEQ ID:5163.

Another function of VGAM2452 is therefore inhibition of Melanoma Antigen, Family A, 3 (MAGEA3, Accession NM_005362), a gene which may play a role in embryonal development and tumor transformation or aspects of tumor progression. antigen recognized on a melanoma by autologous cytolytic t lymphocytes. Accordingly, utilities of VGAM2452 include diagnosis, prevention and treatment of diseases and clinical conditions associated with MAGEA3. The function of MAGEA3 has been established by previous studies. Genes of the MAGE family direct the expression of tumor antigens that are recognized on a human melanoma by autologous cytolytic T lymphocytes. Family A (see OMIM Ref. No. 300016) is clustered at Xq28 and family B is clustered at Xp21.3 (see OMIM Ref. No. 300097). De Plaen et al. (1994) identified 12 family A MAGE genes. MAGE3 cDNA was cloned from a melanoma cell cDNA library. The MAGE3 gene comprises 3 exons, with the last exon containing the entire coding sequence. The gene encodes a 314-amino acid polypeptide. RT-PCR revealed that MAGE2 is expressed in a variety of cancer cell lines, but among normal tissues only in testis and placenta. De Plaen et al. (1994) used human/rodent cell hybrids to map the MAGE family A cluster to Xq26-qter. Rogner et al. (1995) refined the mapping of the MAGE family A cluster to Xq28. The 12 genes are arranged in 3 clusters within 3.5 Mb.

Full details of the abovementioned studies are described in the following publications, the disclosure of which are hereby incorporated by reference:

De Plaen, E.; Arden, K.; Traversari, C.; Gaforio, J. J.; Szikora, J.-P.; De Smet, C.; Brasseur, F.; van der Bruggen, P.; Lethe, B.; Lurquin, C.; Brasseur, R.; Chomez, P.; De Backer, O.; Cavenee, W.; Boon, T.: Structure, chromosomal localization, and expression of 12 genes of the MAGE family. Immunogenetics 40:360-369, 1994; and Rogner, U. C.; Wilke, K.; Steck, E.; Korn, B.; Poustka, A.: The melanoma antigen gene (MAGE) family is clustered in the chromosomal band Xq28. Genomics 29:725-731, 1995.

Further studies establishing the function and utilities of MAGEA3 are found in John Hopkins OMIM database record ID 300174, and in sited publications numbered 7228-7229 listed in the bibliography section hereinbelow, which are also hereby incorporated by reference. Chromosome 5 Open Reading Frame 4 (C5orf4, Accession NM_032385) is another VGAM2452 host target gene. C5orf4 BINDING SITE is HOST TARGET binding site found in the 3' untranslated region of mRNA encoded by C5orf4, corresponding to a HOST TARGET binding site such as BINDING SITE I, BINDING SITE II or BINDING SITE III. Table 2 illustrates the complementarity of the nucleotide sequences of C5orf4 BINDING SITE, designated SEQ ID:26185, to the nucleotide sequence of VGAM2452 RNA, herein designated VGAM RNA, also designated SEQ ID:5163.

Another function of VGAM2452 is therefore inhibition of Chromosome 5 Open Reading Frame 4 (C5orf4, Accession NM_032385). Accordingly, utilities of VGAM2452 include diagnosis, prevention and treatment of diseases and clinical conditions associated with C5orf4. Cleavage and Polyadenylation Specific Factor 2, 100 kDa (CPSF2, Accession XM_029311) is another VGAM2452 host target gene. CPSF2 BINDING SITE is HOST TARGET binding site found in the 3' untranslated region of mRNA encoded by CPSF2, corresponding to a HOST TARGET binding site such as BINDING SITE I, BINDING SITE II or BINDING SITE III. Table 2 illustrates the complementarity of the nucleotide sequences of CPSF2 BINDING SITE, designated SEQ ID:30864, to the nucleotide sequence of VGAM2452 RNA, herein designated VGAM RNA, also designated SEQ ID:5163.

Another function of VGAM2452 is therefore inhibition of Cleavage and Polyadenylation Specific Factor 2, 100 kDa (CPSF2, Accession XM_029311). Accordingly, utilities of VGAM2452 include diagnosis, prevention and treatment of diseases and clinical conditions associated with CPSF2. KIAA1024 (Accession XM_044580) is another VGAM2452 host target gene. KIAA1024 BINDING SITE is HOST TARGET binding site found in the 3' untranslated region of mRNA encoded by KIAA1024, corresponding to a HOST TARGET binding site such as BINDING SITE I, BINDING SITE II or BINDING SITE III. Table 2 illustrates the complementarity of the nucleotide sequences of KIAA1024 BINDING SITE, designated SEQ ID:34234, to the nucleotide sequence of VGAM2452 RNA, herein designated VGAM RNA, also designated SEQ ID:5163.

Another function of VGAM2452 is therefore inhibition of KIAA1024 (Accession XM_044580). Accordingly, utilities of VGAM2452 include diagnosis, prevention and treatment of diseases and clinical conditions associated with KIAA1024. MAGE-E1 (Accession NM_030801) is another VGAM2452 host target gene. MAGE-E1 BINDING SITE is HOST TARGET binding site found in the 3' untranslated region of mRNA encoded by MAGE-E1, corresponding to a HOST TARGET binding site such as BINDING SITE I, BINDING SITE II or BINDING SITE III. Table 2 illustrates the complementarity of the nucleotide sequences of MAGE-E1 BINDING SITE, designated SEQ ID:25106, to the nucleotide sequence of VGAM2452 RNA, herein designated VGAM RNA, also designated SEQ ID:5163.

Another function of VGAM2452 is therefore inhibition of MAGE-E1 (Accession NM_030801). Accordingly, utilities of VGAM2452 include diagnosis, prevention and treatment of diseases and clinical conditions associated with MAGE-E1. LOC128259 (Accession XM_059228) is another VGAM2452 host target gene. LOC128259 BINDING SITE is HOST TARGET binding site found in the 5' untranslated region of mRNA encoded by LOC128259, corresponding to a HOST TARGET binding site such as BINDING SITE I, BINDING SITE II or BINDING SITE III. Table 2 illustrates the complementarity of the nucleotide sequences of LOC128259 BINDING SITE, designated SEQ ID:36920, to the nucleotide sequence of VGAM2452 RNA, herein designated VGAM RNA, also designated SEQ ID:5163.

Another function of VGAM2452 is therefore inhibition of LOC128259 (Accession XM_059228). Accordingly, utilities of VGAM2452 include diagnosis, prevention and treatment of diseases and clinical conditions associated with LOC128259. LOC155036 (Accession XM_098651) is another VGAM2452 host target gene. LOC155036 BINDING SITE is HOST TARGET binding site found in the 5' untranslated region of mRNA encoded by LOC155036, corresponding to a HOST TARGET binding site such as BINDING SITE I, BINDING SITE II or BINDING SITE III. Table 2 illustrates the complementarity of the nucleotide sequences of LOC155036 BINDING SITE, designated SEQ ID:41752, to the nucleotide sequence of VGAM2452 RNA, herein designated VGAM RNA, also designated SEQ ID:5163.

Another function of VGAM2452 is therefore inhibition of LOC155036 (Accession XM_098651). Accordingly, utilities of VGAM2452 include diagnosis, prevention and treatment of diseases and clinical conditions associated with LOC155036. LOC158510 (Accession XM_088592) is another VGAM2452 host target gene. LOC158510 BINDING SITE is HOST TARGET binding site found in the 5' untranslated region of mRNA encoded by LOC158510, corresponding to a HOST TARGET binding site such as BINDING SITE I, BINDING SITE II or BINDING SITE III. Table 2 illustrates the complementarity of the nucleotide sequences of LOC158510 BINDING SITE, designated SEQ ID:39858, to the nucleotide sequence of VGAM2452 RNA, herein designated VGAM RNA, also designated SEQ ID:5163.

Another function of VGAM2452 is therefore inhibition of LOC158510 (Accession XM_088592). Accordingly, utilities of VGAM2452 include diagnosis, prevention and treatment of diseases and clinical conditions associated with LOC158510. LOC199991 (Accession XM_117169) is another VGAM2452 host target gene. LOC199991 BINDING SITE is HOST TARGET binding site found in the 5' untranslated region of mRNA encoded by LOC199991, corresponding to a HOST TARGET binding site such as BINDING SITE I, BINDING SITE II or BINDING SITE III. Table 2 illustrates the complementarity of the nucleotide sequences of LOC199991 BINDING SITE, designated SEQ ID:43275, to the nucleotide sequence of VGAM2452 RNA, herein designated VGAM RNA, also designated SEQ ID:5163.

Another function of VGAM2452 is therefore inhibition of LOC199991 (Accession XM_117169). Accordingly, utilities of VGAM2452 include diagnosis, prevention and treatment of diseases and clinical conditions associated with LOC199991. LOC201229 (Accession XM_113925) is another VGAM2452 host target gene. LOC201229 BINDING SITE is HOST TARGET binding site found in the 3' untranslated region of mRNA encoded by LOC201229, corresponding to a HOST TARGET binding site such as BINDING SITE I, BINDING SITE II or BINDING SITE III. Table 2 illustrates the complementarity of the nucleotide sequences of LOC201229 BINDING SITE, designated SEQ ID:42541, to the nucleotide sequence of VGAM2452 RNA, herein designated VGAM RNA, also designated SEQ ID:5163.

Another function of VGAM2452 is therefore inhibition of LOC201229 (Accession XM_113925). Accordingly, utilities of VGAM2452 include diagnosis, prevention and treatment of diseases and clinical conditions associated with LOC201229. LOC222681 (Accession XM_167116) is another VGAM2452 host target gene. LOC222681 BINDING SITE is HOST TARGET binding site found in the 5' untranslated region of mRNA encoded by LOC222681, corresponding to a HOST TARGET binding site such as BINDING SITE I, BINDING SITE II or BINDING SITE III. Table 2 illustrates the complementarity of the nucleotide sequences of LOC222681 BINDING SITE, designated SEQ ID:44617, to the nucleotide sequence of VGAM2452 RNA, herein designated VGAM RNA, also designated SEQ ID:5163.

Another function of VGAM2452 is therefore inhibition of LOC222681 (Accession XM_167116). Accordingly, utilities of VGAM2452 include diagnosis, prevention and treatment of diseases and clinical conditions associated with LOC222681. LOC257507 (Accession XM_175204) is another VGAM2452 host target gene. LOC257507 BINDING SITE is HOST TARGET binding site found in the 5' untranslated region of mRNA encoded by LOC257507, corresponding to a HOST TARGET binding site such as BINDING SITE I, BINDING SITE II or BINDING SITE III. Table 2 illustrates the complementarity of the nucleotide sequences of LOC257507 BINDING SITE, designated SEQ ID:46683, to the nucleotide sequence of VGAM2452 RNA, herein designated VGAM RNA, also designated SEQ ID:5163.

Another function of VGAM2452 is therefore inhibition of LOC257507 (Accession XM_175204). Accordingly, utilities of VGAM2452 include diagnosis, prevention and treatment of diseases and clinical conditions associated with LOC257507. LOC257625 (Accession XM_175267) is another VGAM2452 host target gene. LOC257625 BINDING SITE is HOST TARGET binding site found in the 5' untranslated region of mRNA encoded by LOC257625, corresponding to a HOST TARGET binding site such as BINDING SITE I, BINDING SITE II or BINDING SITE III. Table 2 illustrates the complementarity of the nucleotide sequences of LOC257625 BINDING SITE, designated SEQ ID:46739, to the nucleotide sequence of VGAM2452 RNA, herein designated VGAM RNA, also designated SEQ ID:5163.

Another function of VGAM2452 is therefore inhibition of LOC257625 (Accession XM_175267). Accordingly, utilities of VGAM2452 include diagnosis, prevention and treatment of diseases and clinical conditions associated with LOC257625. FIG. 1 further provides a conceptual description of a novel bioinformatically detected viral gene of the present invention, referred to here as Viral Genomic Address Messenger 2453 (VGAM2453) viral gene, which modulates expression of respective host target genes thereof, the function and utility of which host target genes is known in the art.

VGAM2453 is a novel bioinformatically detected regulatory, non protein coding, viral micro RNA (miRNA) gene. The method by which VGAM2453 was detected is described hereinabove with reference to FIGS. 1-8.

VGAM2453 gene, herein designated VGAM GENE, is a viral gene contained in the genome of Mouse Cytomegalovirus 1. VGAM2453 host target gene, herein designated VGAM HOST TARGET GENE, is a human gene contained in the human genome.

VGAM2453 gene encodes a VGAM2453 precursor RNA, herein designated VGAM PRECURSOR RNA. Similar to other miRNA genes, and unlike most ordinary genes, VGAM2453 precursor RNA does not encode a protein. A nucleotide sequence identical or highly similar to the nucleotide sequence of VGAM2453 precursor RNA is designated SEQ ID:2439, and is provided hereinbelow with reference to the sequence listing part. Nucleotide sequence SEQ ID:2439 is located at position 45147 relative to the genome of Mouse Cytomegalovirus 1.

VGAM2453 precursor RNA folds onto itself, forming VGAM2453 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2453 folded precursor RNA into VGAM2453 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM2453 RNA is designated SEQ ID:5164, and is provided hereinbelow with reference to the sequence listing part.

VGAM2453 host target gene, herein designated VGAM HOST TARGET GENE, encodes a corresponding messenger RNA, VGAM2453 host target RNA, herein designated VGAM HOST TARGET RNA. VGAM2453 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2453 RNA, herein designated VGAM RNA, binds complementarily to one or more host target binding sites located in untranslated regions of VGAM2453 host target RNA, herein designated VGAM HOST TARGET RNA. This complementary binding is due to the fact that the nucleotide sequence of VGAM2453 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2453 RNA, herein designated VGAM RNA, may have a different number of host target binding sites in untranslated regions of a VGAM2453 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2453 RNA, herein designated VGAM RNA, to host target binding sites on VGAM2453 host target RNA, herein designated VGAM HOST TARGET RNA, such as BINDING SITE I, BINDING SITE II and BINDING SITE III, inhibits translation of VGAM2453 host target RNA into VGAM2453 host target protein, herein designated VGAM HOST TARGET PROTEIN. VGAM host target protein is therefore outlined by a broken line.

It is appreciated that VGAM2453 host target gene, herein designated VGAM HOST TARGET GENE, in fact represents a plurality of VGAM2453 host target genes. The mRNA of each one of this plurality of VGAM2453 host target genes comprises one or more host target binding sites, each having a nucleotide sequence which is at least partly complementary to VGAM2453 RNA, herein designated VGAM RNA, and which when bound by VGAM2453 RNA causes inhibition of translation of respective one or more VGAM2453 host target proteins.

It is further appreciated by one skilled in the art that the mode of translational inhibition illustrated by FIG. 1 with specific reference to translational inhibition exerted by VGAM2453 gene, herein designated VGAM GENE, on one or more VGAM2453 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2453 is inhibition of expression of host target genes, as part of a novel viral mechanism of attacking a host. Accordingly, utilities of VGAM2453 include diagnosis, prevention and treatment of viral infection by Mouse Cytomegalovirus 1. Specific functions, and accordingly utilities, of VGAM2453 correlate with, and may be deduced from, the identity of the host target genes which VGAM2453 binds and inhibits, and the function of these host target genes, as elaborated hereinbelow.

Nucleotide sequences of the VGAM2453 precursor RNA, herein designated VGAM PRECURSOR RNA, and of the 'diced' VGAM2453 RNA, herein designated VGAM RNA, and a schematic representation of the secondary folding of VGAM2453 folded precursor RNA, herein designated VGAM FOLDED PRECURSOR RNA, of VGAM2453 are further described hereinbelow with reference to Table 1.

Nucleotide sequences of host target binding sites, such as BINDING SITE-I, BINDING SITE-II and BINDING SITE-III of FIG. 1, found on VGAM2453 host target RNA, and schematic representation of the complementarity of each of these host target binding sites to VGAM2453 RNA, herein designated VGAM RNA, are described hereinbelow with reference to Table 2.

As mentioned hereinabove with reference to FIG. 1, a function of VGAM2453 gene, herein designated VGAM is inhibition of expression of VGAM2453 target genes. It is appreciated that specific functions, and accordingly utilities, of VGAM2453 correlate with, and may be deduced from, the identity of the target genes which VGAM2453 binds and inhibits, and the function of these target genes, as elaborated hereinbelow.

Chromosome 20 Open Reading Frame 44 (C20orf44, Accession NM_018244) is a VGAM2453 host target gene. C20orf44 BINDING SITE is HOST TARGET binding site found in the 3' untranslated region of mRNA encoded by C20orf44, corresponding to a HOST TARGET binding site such as BINDING SITE I, BINDING SITE II or BINDING SITE III. Table 2 illustrates the complementarity of the nucleotide sequences of C20orf44 BINDING SITE, designated SEQ ID:20208, to the nucleotide sequence of VGAM2453 RNA, herein designated VGAM RNA, also designated SEQ ID:5164.

A function of VGAM2453 is therefore inhibition of Chromosome 20 Open Reading Frame 44 (C20orf44, Accession NM_018244). Accordingly, utilities of VGAM2453 include diagnosis, prevention and treatment of diseases and clinical conditions associated with C20orf44. FIG. 1 further provides a conceptual description of a novel bioinformatically detected viral gene of the present invention, referred to here as Viral Genomic Address Messenger 2454 (VGAM2454) viral gene, which modulates expression of respective host target genes thereof, the function and utility of which host target genes is known in the art.

VGAM2454 is a novel bioinformatically detected regulatory, non protein coding, viral micro RNA (miRNA) gene. The method by which VGAM2454 was detected is described hereinabove with reference to FIGS. 1-8.

VGAM2454 gene, herein designated VGAM GENE, is a viral gene contained in the genome of Mouse Cytomegalovirus 1. VGAM2454 host target gene, herein designated VGAM HOST TARGET GENE, is a human gene contained in the human genome.

VGAM2454 gene encodes a VGAM2454 precursor RNA, herein designated VGAM PRECURSOR RNA. Similar to other miRNA genes, and unlike most ordinary genes, VGAM2454 precursor RNA does not encode a protein. A nucleotide sequence identical or highly similar to the nucleotide sequence of VGAM2454 precursor RNA is designated SEQ ID:2440, and is provided hereinbelow with reference to the sequence listing part. Nucleotide sequence SEQ ID:2440 is located at position 170592 relative to the genome of Mouse Cytomegalovirus 1.

VGAM2454 precursor RNA folds onto itself, forming VGAM2454 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2454 folded precursor RNA into VGAM2454 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM2454 RNA is designated SEQ ID:5165, and is provided hereinbelow with reference to the sequence listing part.

VGAM2454 host target gene, herein designated VGAM HOST TARGET GENE, encodes a corresponding messenger RNA, VGAM2454 host target RNA, herein designated VGAM HOST TARGET RNA. VGAM2454 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2454 RNA, herein designated VGAM RNA, binds complementarily to one or more host target binding sites located in untranslated regions of VGAM2454 host target RNA, herein designated VGAM HOST TARGET RNA. This complementary binding is due to the fact that the nucleotide sequence of VGAM2454 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2454 RNA, herein designated VGAM RNA, may have a different number of host target binding sites in untranslated regions of a VGAM2454 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2454 RNA, herein designated VGAM RNA, to host target binding sites on VGAM2454 host target RNA, herein designated VGAM HOST TARGET RNA, such as BINDING SITE I, BINDING SITE II and BINDING SITE III, inhibits translation of VGAM2454 host target RNA into VGAM2454 host target protein, herein designated VGAM HOST TARGET PROTEIN. VGAM host target protein is therefore outlined by a broken line.

It is appreciated that VGAM2454 host target gene, herein designated VGAM HOST TARGET GENE, in fact represents a plurality of VGAM2454 host target genes. The mRNA of each one of this plurality of VGAM2454 host target genes comprises one or more host target binding sites, each having a nucleotide sequence which is at least partly complementary to VGAM2454 RNA, herein designated VGAM RNA, and which when bound by VGAM2454 RNA causes inhibition of translation of respective one or more VGAM2454 host target proteins.

It is further appreciated by one skilled in the art that the mode of translational inhibition illustrated by FIG. 1 with specific reference to translational inhibition exerted by VGAM2454 gene, herein designated VGAM GENE, on one or more VGAM2454 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2454 is inhibition of expression of host target genes, as part of a novel viral mechanism of attacking a host. Accordingly, utilities of VGAM2454 include diagnosis, prevention and treatment of viral infection by Mouse Cytomegalovirus 1. Specific functions, and accordingly utilities, of VGAM2454 correlate with, and may be deduced from, the identity of the host target genes which VGAM2454 binds and inhibits, and the function of these host target genes, as elaborated hereinbelow.

Nucleotide sequences of the VGAM2454 precursor RNA, herein designated VGAM PRECURSOR RNA, and of the 'diced' VGAM2454 RNA, herein designated VGAM RNA, and a schematic representation of the secondary folding of VGAM2454 folded precursor RNA, herein designated VGAM FOLDED PRECURSOR RNA, of VGAM2454 are further described hereinbelow with reference to Table 1.

Nucleotide sequences of host target binding sites, such as BINDING SITE-I, BINDING SITE-II and BINDING SITE-III of FIG. 1, found on VGAM2454 host target RNA, and schematic representation of the complementarity of each of these host target binding sites to VGAM2454 RNA, herein designated VGAM RNA, are described hereinbelow with reference to Table 2.

As mentioned hereinabove with reference to FIG. 1, a function of VGAM2454 gene, herein designated VGAM is inhibition of expression of VGAM2454 target genes. It is appreciated that specific functions, and accordingly utilities, of VGAM2454 correlate with, and may be deduced from, the identity of the target genes which VGAM2454 binds and inhibits, and the function of these target genes, as elaborated hereinbelow.

Actinin, Alpha 2 (ACTN2, Accession NM_001103) is a VGAM2454 host target gene. ACTN2 BINDING SITE is HOST TARGET binding site found in the 5' untranslated region of mRNA encoded by ACTN2, corresponding to a HOST TARGET binding site such as BINDING SITE I, BINDING SITE II or BINDING SITE III. Table 2 illustrates the complementarity of the nucleotide sequences of ACTN2 BINDING SITE, designated SEQ ID:6756, to the nucleotide sequence of VGAM2454 RNA, herein designated VGAM RNA, also designated SEQ ID:5165.

A function of VGAM2454 is therefore inhibition of Actinin, Alpha 2 (ACTN2, Accession NM_001103), a gene which an actin-binding protein with multiple roles in different cell types. Accordingly, utilities of VGAM2454 include diagnosis, prevention and treatment of diseases and clinical conditions associated with ACTN2. The function of ACTN2 and its association with various diseases and clinical conditions, has been established by previous studies, as described hereinabove with reference to VGAM88. Rho Guanine Nucleotide Exchange Factor (GEF) 7 (ARHGEF7, Accession NM_003899) is another VGAM2454 host target gene. ARHGEF7 BINDING SITE is HOST TARGET binding site found in the 3' untranslated region of mRNA encoded by ARHGEF7, corresponding to a HOST TARGET binding site such as BINDING SITE I, BINDING SITE II or BINDING SITE III. Table 2 illustrates the complementarity of the nucleotide sequences of ARHGEF7 BINDING SITE, designated SEQ ID:9985, to the nucleotide sequence of VGAM2454 RNA, herein designated VGAM RNA, also designated SEQ ID:5165.

Another function of VGAM2454 is therefore inhibition of Rho Guanine Nucleotide Exchange Factor (GEF) 7 (ARHGEF7, Accession NM_003899), a gene which acts as a rac1 guanine nucleotide exchange factor (gef) and can induce membrane ruffling. Accordingly, utilities of VGAM2454 include diagnosis, prevention and treatment of diseases and clinical conditions associated with ARHGEF7. The function of ARHGEF7 and its association with various diseases and clinical conditions, has been established by previous studies, as described hereinabove with reference to VGAM297. Brain-specific Angiogenesis Inhibitor 2 (BAI2, Accession NM_001703) is another VGAM2454 host target gene. BAI2 BINDING SITE is HOST TARGET binding site found in the 5' untranslated region of mRNA encoded by BAI2, corresponding to a HOST TARGET binding site such as BINDING SITE I, BINDING SITE II or BINDING SITE III. Table 2 illustrates the complementarity of the nucleotide sequences of BAI2 BINDING SITE, designated SEQ ID:7426, to the nucleotide sequence of VGAM2454 RNA, herein designated VGAM RNA, also designated SEQ ID:5165.

Another function of VGAM2454 is therefore inhibition of Brain-specific Angiogenesis Inhibitor 2 (BAI2, Accession NM_001703). Accordingly, utilities of VGAM2454 include diagnosis, prevention and treatment of diseases and clinical conditions associated with BAI2. Core-binding Factor, Runt Domain, Alpha Subunit 2; Translocated To, 3 (CBFA2T3, Accession NM_005187) is another VGAM2454 host target gene. CBFA2T3 BINDING SITE is HOST TARGET binding site found in the 3' untranslated region of mRNA encoded by CBFA2T3, corresponding to a HOST TARGET binding site such as BINDING SITE I, BINDING SITE II or BINDING SITE III. Table 2 illustrates the complementarity of the nucleotide sequences of CBFA2T3 BINDING SITE, designated SEQ ID:11687, to the nucleotide sequence of VGAM2454 RNA, herein designated VGAM RNA, also designated SEQ ID:5165.

Another function of VGAM2454 is therefore inhibition of Core-binding Factor, Runt Domain, Alpha Subunit 2; Translocated To, 3 (CBFA2T3, Accession NM_005187). Accordingly, utilities of VGAM2454 include diagnosis, prevention and treatment of diseases and clinical conditions associated with CBFA2T3. Filamin A, Alpha (actin binding protein 280) (FLNA, Accession NM_001456) is another VGAM2454 host target gene. FLNA BINDING SITE is HOST TARGET binding site found in the 5' untranslated region of mRNA encoded by FLNA, corresponding to a HOST TARGET binding site such as BINDING SITE I, BINDING SITE II or BINDING SITE III. Table 2 illustrates the complementarity of the nucleotide sequences of FLNA BINDING SITE, designated SEQ ID:7192, to the nucleotide sequence of VGAM2454 RNA, herein designated VGAM RNA, also designated SEQ ID:5165.

Another function of VGAM2454 is therefore inhibition of Filamin A, Alpha (actin binding protein 280) (FLNA, Accession NM_001456), a gene which promotes orthogonal branching of actin filaments and links actin filaments to membrane glycoproteins. Accordingly, utilities of VGAM2454 include diagnosis, prevention and treatment of diseases and clinical conditions associated with FLNA. The function of FLNA has been established by previous studies. Actin-binding protein, or filamin, is a 280-kD protein that crosslinks actin filaments into orthogonal networks in cortical cytoplasm and participates in the anchoring of membrane proteins for the actin cytoskeleton. By analysis of the native ABP protein and cloning of the human endothelial ABP cDNA, Gorlin et al. (1990) demonstrated that ABP is a 2,647-amino acid protein with 3 functional domains: an N-terminal filamentous actin-binding domain, a C-terminal self-association domain, and a membrane glycoprotein-binding domain. The N-terminal actin-binding domain of ABP280 displays strong structural and functional similarity to the N-terminal domains of dystrophin (OMIM Ref. No. 300377), alpha-actinin (OMIM Ref. No. 102575), and beta-spectrin (OMIM Ref. No. 182870). Periventricular heterotopia (OMIM Ref. No. 300049) is an X-linked dominant disorder in which many neurons fail to migrate to the cerebral cortex and persist as nodules lining the ventricular surface. Heterozygous females with the disorder present with epilepsy and other signs, including patent ductus arteriosus and coagulopathy, whereas hemizygous affected males die embryonically. Fox et al. (1998) identified the cause as mutations in the FLN1 gene, which is required for locomotion of many cell types. They demonstrated a previously unrecognized high level of expression of FLN1 in the developing cortex. Their studies demonstrated that FLN1 is required for neuronal migration to the cortex and is essential for embryogenesis. In identifying filamin-1 as the gene mutant in periventricular heterotopia, Fox et al. (1998) first narrowed the map location to an interval approximately 1 cM between marker DXS15 and the pseudoautosomal region of Xq28 by the study of additional markers. Subsequent analysis of a large duplication of Xq28 in a male patient with periventricular heterotopia (Fink et al., 1997) with a severe, albeit nonlethal, phenotype allowed the candidate interval to be refined even further. They defined the exact centromeric boundary of the duplicated segment of Xq28 as base 3377 of 3,395 bases in intron 1 of the isocitrate dehydrogenase gene (IDH3G; 300089), approximately 600 kb distal to DXS15. However, none of the genes identified at the breakpoints or insertion site of the duplication harbored independent mutations in other patients with periventricular heterotopia. Therefore, Fox et al. (1998) concluded that the duplication itself was responsible for the disorder in this patient. Fox et al. (1998) studied the pattern of X inactivation in females with FLN1 mutations in nucleated peripheral blood cells. No evidence of preferential lyonization in these cells was found, suggesting that FLN1 is not required in a cell-autonomous fashion for survival of mixed peripheral white blood cells. However, an essential cell-autonomous role for FLN1 in a subset of nucleated cells or nonnucleated cells (e.g., platelets) could not be excluded. Sheen et al. (2001) performed SSCP analysis of FLN1 throughout its entire coding region in 6 periventricular heterotopia pedigrees, 31 sporadic female patients, and 24 sporadic male periventricular heterotopia patients. The authors detected FLN1 mutations in 83% of periventricular heterotopia pedigrees and 19% of sporadic females with periventricular heterotopia. Moreover, 0 of 7 females with periventricular heterotopia with atypical radiographic features showed FLN1 mutations, suggesting that other genes may cause atypical periventricular heterotopia. Two of 24 males analyzed with periventricular heterotopia (9%) also carried FLN1 mutations. Whereas FLN1 mutations in periventricular heterotopia pedigrees caused severe predicted loss of FLN1 protein function, both male FLN1 mutations were consistent with partial loss of function of the protein. Moreover, sporadic female FLN1 mutations associated with periventricular heterotopia appear to cause either severe or partial loss of function. In the largest reported pedigree with periventricular heterotopia (OMIM Ref. No. 300049) (Huttenlocher et al., 1994), Fox et al. (1998) found a C-to-T substitution in exon 3 of the FLN1 gene, which converted a CAG (gln) to a TAG (stop) codon and truncated the FLN1 protein at amino acid residue 182 of the 2,647 total amino acids in the normal protein.

Full details of the abovementioned studies are described in the following publications, the disclosure of which are hereby incorporated by reference:

Sheen, V. L.; Dixon, P. H.; Fox, J. W.; Hong, S. E.; Kinton, L.; Sisodiya, S. M.; Duncan, J. S.; Dubeau, F.; Scheffer, I. E.; Schachter, S. C.; Wilner, A.; Henchy, R.; and 18 others. Mutations in the X-linked filamin 1 gene cause periventricular nodular heterotopia in males as well as in females. Hum. Molec. Genet. 10:1775-1783, 2001; and Fox, J. W.; Lamperti, E. D.; Eksioglu, Y. Z.; Hong, S. E.; Feng, Y.; Graham, D. A.; Scheffer, I. E.; Dobyns, W. B.; Hirsch, B. A.; Radtke, R. A.; Berkovic, S. F.; Huttenlocher, P. R.; W.

Further studies establishing the function and utilities of FLNA are found in John Hopkins OMIM database record ID 300017, and in sited publications numbered 7230-7233, 7255-726 and 9435-7264 listed in the bibliography section hereinbelow, which are also hereby incorporated by reference. V-maf Musculoaponeurotic Fibrosarcoma Oncogene Homolog (avian) (MAF, Accession NM_005360) is another VGAM2454 host target gene. MAF BINDING SITE is HOST TARGET binding site found in the 5' untranslated region of mRNA encoded by MAF, corresponding to a HOST TARGET binding site such as BINDING SITE I, BINDING SITE II or BINDING SITE III. Table 2 illustrates the complementarity of the nucleotide sequences of MAF BINDING SITE, designated SEQ ID:11836, to the nucleotide sequence of VGAM2454 RNA, herein designated VGAM RNA, also designated SEQ ID:5165.

Another function of VGAM2454 is therefore inhibition of V-maf Musculoaponeurotic Fibrosarcoma Oncogene Homolog (avian) (MAF, Accession NM_005360), a gene which is a transcription factor; contains a leucine zipper motif. Accordingly, utilities of VGAM2454 include diagnosis, prevention and treatment of diseases and clinical conditions associated with MAF. The function of MAF and its association with various diseases and clinical conditions, has been established by previous studies, as described hereinabove with reference to VGAM822. MYC-associated Zinc Finger Protein (purine-binding transcription factor) (MAZ, Accession XM_055771) is another VGAM2454 host target gene. MAZ BINDING SITE is HOST TARGET binding site found in the 5' untranslated region of mRNA encoded by MAZ, corresponding to a HOST TARGET binding site such as BINDING SITE I, BINDING SITE II or BINDING SITE III. Table 2 illustrates the complementarity of the nucleotide sequences of MAZ BINDING SITE, designated SEQ ID:36324, to the nucleotide sequence of VGAM2454 RNA, herein designated VGAM RNA, also designated SEQ ID:5165.

Another function of VGAM2454 is therefore inhibition of MYC-associated Zinc Finger Protein (purine-binding transcription factor) (MAZ, Accession XM_055771). Accordingly, utilities of VGAM2454 include diagnosis, prevention and treatment of diseases and clinical conditions associated with MAZ. Regulating Synaptic Membrane Exocytosis 1 (RIMS1, Accession XM_052206) is another VGAM2454 host target gene. RIMS1 BINDING SITE is HOST TARGET binding site found in the 5' untranslated region of mRNA encoded by RIMS1, corresponding to a HOST TARGET binding site such as BINDING SITE I, BINDING SITE II or BINDING SITE III. Table 2 illustrates the complementarity of the nucleotide sequences of RIMS1 BINDING SITE, designated SEQ ID:35956, to the nucleotide sequence of VGAM2454 RNA, herein designated VGAM RNA, also designated SEQ ID:5165.

Another function of VGAM2454 is therefore inhibition of Regulating Synaptic Membrane Exocytosis 1 (RIMS1, Accession XM_052206), a gene which may have a regulatory role in the membrane interactions during trafficking of synaptic vesicles. Accordingly, utilities of VGAM2454 include diagnosis, prevention and treatment of diseases and clinical conditions associated with RIMS1. The function of RIMS1 has been established by previous studies. Coppola et al. (2001) obtained 6 isoforms of human RIM that differ from each other in the distance between their 2 C2 domains. Binding analysis showed that the C2 domains of RIM interact in a calcium-independent manner with N-type calcium channels. They also interact weakly with SNAP25 (OMIM Ref. No. 600322) and strongly with synaptotagmin-1 (SYT1; 185605). In the presence of calcium, the interaction with SYT1 increases and that with SNAP25 decreases. Coppola et al. (2001) concluded that RIM1 is a scaffold protein that interacts with multiple binding partners and coordinates different stages of the secretory process. Animal model experiments lend further support to the function of RIMS1. Long-term potentiation (LTP) is involved in learning and memory. One form of LTP requires activation of postsynaptic NMDA receptors (e.g., GRIN2B; 138252), while the other form, mossy fiber LTP (mfLTP), occurs in the presynaptic areas and requires Rab3a and activation of protein kinase A (PKA; OMIM Ref. No. 176911). RIM1 is a PKA substrate. Castillo et al. (2002) showed that in Rim1-deficient mice, mfLTP was abolished in the hippocampus and cerebellum. They localized the expression of mfLTP to the interface between synaptic vesicles and the active zone and showed that the vesicle protein Rab3a and the active zone protein Rim1 are required.

It is appreciated that the abovementioned animal model for RIMS1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Coppola, T.; Magnin-Luthi, S.; Perret-Menoud, V.; Gattesco, S.; Schiavo, G.; Regazzi, R.: Direct interaction of the Rab3 effector RIM with Ca (2+) channels, SNAP-25, and synaptotagmin. J. Biol. Chem. 276:32756-32762, 2001; and Castillo, P. E.; Schoch, S.; Schmitz, F.; Sudhof, T. C.; Malenka, R. C.: RIM1-alpha is required for presynaptic long-term potentiation. Nature 415:327-330, 2002.

Further studies establishing the function and utilities of RIMS1 are found in John Hopkins OMIM database record ID 606629, and in sited publications numbered 6113-6115, 95 and 6116-6117 listed in the bibliography section hereinbelow, which are also hereby incorporated by reference. Complexin 1 (CPLX1, Accession NM_006651) is another VGAM2454 host target gene. CPLX1 BINDING SITE is HOST TARGET binding site found in the 5' untranslated region of mRNA encoded by CPLX1, corresponding to a HOST TARGET binding site such as BINDING SITE I, BINDING SITE II or BINDING SITE III. Table 2 illustrates the complementarity of the nucleotide sequences of CPLX1 BINDING SITE, designated SEQ ID:13448, to the nucleotide sequence of VGAM2454 RNA, herein designated VGAM RNA, also designated SEQ ID:5165.

Another function of VGAM2454 is therefore inhibition of Complexin 1 (CPLX1, Accession NM_006651). Accordingly, utilities of VGAM2454 include diagnosis, prevention and treatment of diseases and clinical conditions associated with CPLX1. GC20 (Accession XM_044184) is another VGAM2454 host target gene. GC20 BINDING SITE is HOST TARGET binding site found in the 5' untranslated region of mRNA encoded by GC20, corresponding to a HOST TARGET binding site such as BINDING SITE I, BINDING SITE II or BINDING SITE III. Table 2 illustrates the complementarity of the nucleotide sequences of GC20 BINDING SITE, designated SEQ ID:34167, to the nucleotide sequence of VGAM2454 RNA, herein designated VGAM RNA, also designated SEQ ID:5165.

Another function of VGAM2454 is therefore inhibition of GC20 (Accession XM_044184). Accordingly, utilities of VGAM2454 include diagnosis, prevention and treatment of diseases and clinical conditions associated with GC20. MGC14386 (Accession NM_033544) is another VGAM2454 host target gene. MGC14386 BINDING SITE is HOST TARGET binding site found in the 5' untranslated region of mRNA encoded by MGC14386, corresponding to a HOST TARGET binding site such as BINDING SITE I, BINDING SITE II or BINDING SITE III. Table 2 illustrates the complementarity of the nucleotide sequences of MGC14386 BINDING SITE, designated SEQ ID:27306, to the nucleotide sequence of VGAM2454 RNA, herein designated VGAM RNA, also designated SEQ ID:5165.

Another function of VGAM2454 is therefore inhibition of MGC14386 (Accession NM_033544). Accordingly, utilities of VGAM2454 include diagnosis, prevention and treatment of diseases and clinical conditions associated with MGC14386. PRO1048 (Accession NM_018497) is another VGAM2454 host target gene. PRO1048 BINDING SITE is HOST TARGET binding site found in the 3' untranslated region of mRNA encoded by PRO1048, corresponding to a HOST TARGET binding site such as BINDING SITE I, BINDING SITE II or BINDING SITE III. Table 2 illustrates the complementarity of the nucleotide sequences of PRO1048 BINDING SITE, designated SEQ ID:20563, to the nucleotide sequence of VGAM2454 RNA, herein designated VGAM RNA, also designated SEQ ID:5165.

Another function of VGAM2454 is therefore inhibition of PRO1048 (Accession NM_018497). Accordingly, utilities of VGAM2454 include diagnosis, prevention and treatment of diseases and clinical conditions associated with PRO1048. Regulator of G-protein Signalling 19 (RGS19, Accession NM_005873) is another VGAM2454 host target gene. RGS19 BINDING SITE is HOST TARGET binding site found in the 3' untranslated region of mRNA encoded by RGS19, corresponding to a HOST TARGET binding site such as BINDING SITE I, BINDING SITE II or BINDING SITE III. Table 2 illustrates the complementarity of the nucleotide sequences of RGS19 BINDING SITE, designated SEQ ID:12491, to the nucleotide sequence of VGAM2454 RNA, herein designated VGAM RNA, also designated SEQ ID:5165.

Another function of VGAM2454 is therefore inhibition of Regulator of G-protein Signalling 19 (RGS19, Accession NM_005873). Accordingly, utilities of VGAM2454 include diagnosis, prevention and treatment of diseases and clinical conditions associated with RGS19. SCYD1 (Accession XM_165650) is another VGAM2454 host target gene. SCYD1 BINDING SITE is HOST TARGET binding site found in the 3' untranslated region of mRNA encoded by SCYD1, corresponding to a HOST TARGET binding site such as BINDING SITE I, BINDING SITE II or BINDING SITE III. Table 2 illustrates the complementarity of the nucleotide sequences of SCYD1 BINDING SITE, designated SEQ ID:43709, to the nucleotide sequence of VGAM2454 RNA, herein designated VGAM RNA, also designated SEQ ID:5165.

Another function of VGAM2454 is therefore inhibition of SCYD1 (Accession XM_165650). Accordingly, utilities of VGAM2454 include diagnosis, prevention and treatment of diseases and clinical conditions associated with SCYD1. LOC128977 (Accession XM_059313) is another VGAM2454 host target gene. LOC128977 BINDING SITE is HOST TARGET binding site found in the 5' untranslated region of mRNA encoded by LOC128977, corresponding to a HOST TARGET binding site such as BINDING SITE I, BINDING SITE II or BINDING SITE III. Table 2 illustrates the complementarity of the nucleotide sequences of LOC128977 BINDING SITE, designated SEQ ID:36949, to the nucleotide sequence of VGAM2454 RNA, herein designated VGAM RNA, also designated SEQ ID:5165.

Another function of VGAM2454 is therefore inhibition of LOC128977 (Accession XM_059313). Accordingly, utilities of VGAM2454 include diagnosis, prevention and treatment of diseases and clinical conditions associated with LOC128977. FIG. 1 further provides a conceptual description of a novel bioinformatically detected viral gene of the present invention, referred to here as Viral Genomic Address Messenger 2455 (VGAM2455) viral gene, which modulates expression of respective host target genes thereof, the function and utility of which host target genes is known in the art.

VGAM2455 is a novel bioinformatically detected regulatory, non protein coding, viral micro RNA (miRNA) gene. The method by which VGAM2455 was detected is described hereinabove with reference to FIGS. 1-8.

VGAM2455 gene, herein designated VGAM GENE, is a viral gene contained in the genome of Mouse Cytomegalovirus 1. VGAM2455 host target gene, herein designated VGAM HOST TARGET GENE, is a human gene contained in the human genome.

VGAM2455 gene encodes a VGAM2455 precursor RNA, herein designated VGAM PRECURSOR RNA. Similar to other miRNA genes, and unlike most ordinary genes, VGAM2455 precursor RNA does not encode a protein. A nucleotide sequence identical or highly similar to the nucleotide sequence of VGAM2455 precursor RNA is designated SEQ ID:2441, and is provided hereinbelow with reference to the sequence listing part. Nucleotide sequence SEQ ID:2441 is located at position 3102 relative to the genome of Mouse Cytomegalovirus 1.

VGAM2455 precursor RNA folds onto itself, forming VGAM2455 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2455 folded precursor RNA into VGAM2455 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2455 RNA is designated SEQ ID:5166, and is provided hereinbelow with reference to the sequence listing part.

VGAM2455 host target gene, herein designated VGAM HOST TARGET GENE, encodes a corresponding messenger RNA, VGAM2455 host target RNA, herein designated VGAM HOST TARGET RNA. VGAM2455 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2455 RNA, herein designated VGAM RNA, binds complementarily to one or more host target binding sites located in untranslated regions of VGAM2455 host target RNA, herein designated VGAM HOST TARGET RNA. This complementary binding is due to the fact that the nucleotide sequence of VGAM2455 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2455 RNA, herein designated VGAM RNA, may have a different number of host target binding sites in untranslated regions of a VGAM2455 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2455 RNA, herein designated VGAM RNA, to host target binding sites on VGAM2455 host target RNA, herein designated VGAM HOST TARGET RNA, such as BINDING SITE I, BINDING SITE II and BINDING SITE III, inhibits translation of VGAM2455 host target RNA into VGAM2455 host target protein, herein designated VGAM HOST TARGET PROTEIN. VGAM host target protein is therefore outlined by a broken line.

It is appreciated that VGAM2455 host target gene, herein designated VGAM HOST TARGET GENE, in fact represents a plurality of VGAM2455 host target genes. The mRNA of each one of this plurality of VGAM2455 host target genes comprises one or more host target binding sites, each having a nucleotide sequence which is at least partly complementary to VGAM2455 RNA, herein designated VGAM RNA, and which when bound by VGAM2455 RNA causes inhibition of translation of respective one or more VGAM2455 host target proteins.

It is further appreciated by one skilled in the art that the mode of translational inhibition illustrated by FIG. 1 with specific reference to translational inhibition exerted by VGAM2455 gene, herein designated VGAM GENE, on one or more VGAM2455 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2455 is inhibition of expression of host target genes, as part of a novel viral mechanism of attacking a host. Accordingly, utilities of VGAM2455 include diagnosis, prevention and treatment of viral infection by Mouse Cytomegalovirus 1. Specific functions, and accordingly utilities, of VGAM2455 correlate with, and may be deduced from, the identity of the host target genes which VGAM2455 binds and inhibits, and the function of these host target genes, as elaborated hereinbelow.

Nucleotide sequences of the VGAM2455 precursor RNA, herein designated VGAM PRECURSOR RNA, and of the 'diced' VGAM2455 RNA, herein designated VGAM RNA, and a schematic representation of the secondary folding of VGAM2455 folded precursor RNA, herein designated VGAM FOLDED PRECURSOR RNA, of VGAM2455 are further described hereinbelow with reference to Table 1.

Nucleotide sequences of host target binding sites, such as BINDING SITE-I, BINDING SITE-II and BINDING SITE-III of FIG. 1, found on VGAM2455 host target RNA, and schematic representation of the complementarity of each of these host target binding sites to VGAM2455 RNA, herein designated VGAM RNA, are described hereinbelow with reference to Table 2.

As mentioned hereinabove with reference to FIG. 1, a function of VGAM2455 gene, herein designated VGAM is inhibition of expression of VGAM2455 target genes. It is appreciated that specific functions, and accordingly utilities, of VGAM2455 correlate with, and may be deduced from, the identity of the target genes which VGAM2455 binds and inhibits, and the function of these target genes, as elaborated hereinbelow.

DKFZP434J214 (Accession XM_027639) is a VGAM2455 host target gene. DKFZP434J214 BINDING SITE is HOST TARGET binding site found in the 3' untranslated region of mRNA encoded by DKFZP434J214, corresponding to a HOST TARGET binding site such as BINDING SITE I, BINDING SITE II or BINDING SITE III. Table 2 illustrates the complementarity of the nucleotide sequences of DKFZP434J214 BINDING SITE, designated SEQ ID:30549, to the nucleotide sequence of VGAM2455 RNA, herein designated VGAM RNA, also designated SEQ ID:5166.

A function of VGAM2455 is therefore inhibition of DKFZP434J214 (Accession XM_027639). Accordingly, utilities of VGAM2455 include diagnosis, prevention and treatment of diseases and clinical conditions associated with DKFZP434J214. KIAA1708 (Accession XM_040211) is another VGAM2455 host target gene. KIAA1708 BINDING SITE is HOST TARGET binding site found in the 3' untranslated region of mRNA encoded by KIAA1708, corresponding to a HOST TARGET binding site such as BINDING SITE I, BINDING SITE II or BINDING SITE III. Table 2 illustrates the complementarity of the nucleotide sequences of KIAA1708 BINDING SITE, designated SEQ ID:33274, to the nucleotide sequence of VGAM2455 RNA, herein designated VGAM RNA, also designated SEQ ID:5166.

Another function of VGAM2455 is therefore inhibition of KIAA1708 (Accession XM_040211). Accordingly, utilities of VGAM2455 include diagnosis, prevention and treatment of diseases and clinical conditions associated with KIAA1708. MGC20235 (Accession NM_145041) is another VGAM2455 host target gene. MGC20235 BINDING SITE is HOST TARGET binding site found in the 3' untranslated region of mRNA encoded by MGC20235, corresponding to a HOST TARGET binding site such as BINDING SITE I, BINDING SITE II or BINDING SITE III. Table 2 illustrates the complementarity of the nucleotide sequences of MGC20235 BINDING SITE, designated SEQ ID:29669, to the nucleotide sequence of VGAM2455 RNA, herein designated VGAM RNA, also designated SEQ ID:5166.

Another function of VGAM2455 is therefore inhibition of MGC20235 (Accession NM_145041). Accordingly, utilities of VGAM2455 include diagnosis, prevention and treatment of diseases and clinical conditions associated with MGC20235. LOC147949 (Accession XM_085973) is another VGAM2455 host target gene. LOC147949 BINDING SITE is HOST TARGET binding site found in the 3' untranslated region of mRNA encoded by LOC147949, corresponding to a HOST TARGET binding site such as BINDING SITE I, BINDING SITE II or BINDING SITE III. Table 2 illustrates the complementarity of the nucleotide sequences of LOC147949 BINDING SITE, designated SEQ ID:38423, to the nucleotide sequence of VGAM2455 RNA, herein designated VGAM RNA, also designated SEQ ID:5166.

Another function of VGAM2455 is therefore inhibition of LOC147949 (Accession XM_085973). Accordingly, utilities of VGAM2455 include diagnosis, prevention and treatment of diseases and clinical conditions associated with LOC147949. LOC147990 (Accession XM_097358) is another VGAM2455 host target gene. LOC147990 BINDING SITE is HOST TARGET binding site found in the 3' untranslated region of mRNA encoded by LOC147990, corresponding to a HOST TARGET binding site such as BINDING SITE I, BINDING SITE II or BINDING SITE III. Table 2 illustrates the complementarity of the nucleotide sequences of LOC147990 BINDING SITE, designated SEQ ID:40864, to the nucleotide sequence of VGAM2455 RNA, herein designated VGAM RNA, also designated SEQ ID:5166.

Another function of VGAM2455 is therefore inhibition of LOC147990 (Accession XM_097358). Accordingly, utilities of VGAM2455 include diagnosis, prevention and treatment of diseases and clinical conditions associated with LOC147990. LOC163115 (Accession XM_092010) is another VGAM2455 host target gene. LOC163115 BINDING SITE is HOST TARGET binding site found in the 3' untranslated region of mRNA encoded by LOC163115, corresponding to a HOST TARGET binding site such as BINDING SITE I, BINDING SITE II or BINDING SITE III. Table 2 illustrates the complementarity of the nucleotide sequences of LOC163115 BINDING SITE, designated SEQ ID:40089, to the nucleotide sequence of VGAM2455 RNA, herein designated VGAM RNA, also designated SEQ ID:5166.

Another function of VGAM2455 is therefore inhibition of LOC163115 (Accession XM_092010). Accordingly, utilities of VGAM2455 include diagnosis, prevention and treatment of diseases and clinical conditions associated with LOC163115. LOC92697 (Accession XM_046715) is another VGAM2455 host target gene. LOC92697 BINDING SITE is HOST TARGET binding site found in the 5' untranslated region of mRNA encoded by LOC92697, corresponding to a HOST TARGET binding site such as BINDING SITE I, BINDING SITE II or BINDING SITE III. Table 2 illustrates the complementarity of the nucleotide sequences of LOC92697 BINDING SITE, designated SEQ ID:34799, to the nucleotide sequence of VGAM2455 RNA, herein designated VGAM RNA, also designated SEQ ID:5166.

Another function of VGAM2455 is therefore inhibition of LOC92697 (Accession XM_046715). Accordingly, utilities of VGAM2455 include diagnosis, prevention and treatment of diseases and clinical conditions associated with LOC92697. FIG. 1 further provides a conceptual description of a novel bioinformatically detected viral gene of the present invention, referred to here as Viral Genomic Address Messenger 2456 (VGAM2456) viral gene, which modulates expression of respective host target genes thereof, the function and utility of which host target genes is known in the art.

VGAM2456 is a novel bioinformatically detected regulatory, non protein coding, viral micro RNA (miRNA) gene. The method by which VGAM2456 was detected is described hereinabove with reference to FIGS. 1-8.

VGAM2456 gene, herein designated VGAM GENE, is a viral gene contained in the genome of Mouse Cytomegalovirus 1. VGAM2456 host target gene, herein designated VGAM HOST TARGET GENE, is a human gene contained in the human genome.

VGAM2456 gene encodes a VGAM2456 precursor RNA, herein designated VGAM PRECURSOR RNA. Similar to other miRNA genes, and unlike most ordinary genes, VGAM2456 precursor RNA does not encode a protein. A nucleotide sequence identical or highly similar to the nucleotide sequence of VGAM2456 precursor RNA is designated SEQ ID:2442, and is provided hereinbelow with reference to the sequence listing part. Nucleotide sequence SEQ ID:2442 is located at position 166990 relative to the genome of Mouse Cytomegalovirus 1.

VGAM2456 precursor RNA folds onto itself, forming VGAM2456 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2456 folded precursor RNA into VGAM2456 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2456 RNA is designated SEQ ID:5167, and is provided hereinbelow with reference to the sequence listing part.

VGAM2456 host target gene, herein designated VGAM HOST TARGET GENE, encodes a corresponding messenger RNA, VGAM2456 host target RNA, herein designated VGAM HOST TARGET RNA. VGAM2456 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2456 RNA, herein designated VGAM RNA, binds complementarily to one or more host target binding sites located in untranslated regions of VGAM2456 host target RNA, herein designated VGAM HOST TARGET RNA. This complementary binding is due to the fact that the nucleotide sequence of VGAM2456 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2456 RNA, herein designated VGAM RNA, may have a different number of host target binding sites in untranslated regions of a VGAM2456 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2456 RNA, herein designated VGAM RNA, to host target binding sites on VGAM2456 host target RNA, herein designated VGAM HOST TARGET RNA, such as BINDING SITE I, BINDING SITE II and BINDING SITE III, inhibits translation of VGAM2456 host target RNA into VGAM2456 host target protein, herein designated VGAM HOST TARGET PROTEIN. VGAM host target protein is therefore outlined by a broken line.

It is appreciated that VGAM2456 host target gene, herein designated VGAM HOST TARGET GENE, in fact represents a plurality of VGAM2456 host target genes. The mRNA of each one of this plurality of VGAM2456 host target genes comprises one or more host target binding sites, each having a nucleotide sequence which is at least partly complementary to VGAM2456 RNA, herein designated VGAM RNA, and which when bound by VGAM2456 RNA causes inhibition of translation of respective one or more VGAM2456 host target proteins.

It is further appreciated by one skilled in the art that the mode of translational inhibition illustrated by FIG. 1 with specific reference to translational inhibition exerted by VGAM2456 gene, herein designated VGAM GENE, on one or more VGAM2456 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2456 is inhibition of expression of host target genes, as part of a novel viral mechanism of attacking a host. Accordingly, utilities of VGAM2456 include diagnosis, prevention and treatment of viral infection by Mouse Cytomegalovirus 1. Specific functions, and accordingly utilities, of VGAM2456 correlate with, and may be deduced from, the identity of the host target genes which VGAM2456 binds and inhibits, and the function of these host target genes, as elaborated hereinbelow.

Nucleotide sequences of the VGAM2456 precursor RNA, herein designated VGAM PRECURSOR RNA, and of the 'diced' VGAM2456 RNA, herein designated VGAM RNA, and a schematic representation of the secondary folding of VGAM2456 folded precursor RNA, herein designated VGAM FOLDED PRECURSOR RNA, of VGAM2456 are further described hereinbelow with reference to Table 1.

Nucleotide sequences of host target binding sites, such as BINDING SITE-I, BINDING SITE-II and BINDING SITE-III of FIG. 1, found on VGAM2456 host target RNA, and schematic representation of the complementarity of each of these host target binding sites to VGAM2456 RNA, herein designated VGAM RNA, are described hereinbelow with reference to Table 2.

As mentioned hereinabove with reference to FIG. 1, a function of VGAM2456 gene, herein designated VGAM is inhibition of expression of VGAM2456 target genes. It is appreciated that specific functions, and accordingly utilities, of VGAM2456 correlate with, and may be deduced from, the identity of the target genes which VGAM2456 binds and inhibits, and the function of these target genes, as elaborated hereinbelow.

Caspase Recruitment Domain Family, Member 4 (CARD4, Accession NM_006092) is a VGAM2456 host target gene. CARD4 BINDING SITE is HOST TARGET binding site found in the 3' untranslated region of mRNA encoded by CARD4, corresponding to a HOST TARGET binding site such as BINDING SITE I, BINDING SITE II or BINDING SITE III. Table 2 illustrates the complementarity of the nucleotide sequences of CARD4 BINDING SITE, designated SEQ ID:12739, to the nucleotide sequence of VGAM2456 RNA, herein designated VGAM RNA, also designated SEQ ID:5167.

A function of VGAM2456 is therefore inhibition of Caspase Recruitment Domain Family, Member 4 (CARD4, Accession NM_006092), a gene which Activates CASP9 to induce apoptosis, regulates activation of NF-kappaB. Accordingly, utilities of VGAM2456 include diagnosis, prevention and treatment of diseases and clinical conditions associated with CARD4. The function of CARD4 and its association with various diseases and clinical conditions, has been established by previous studies, as described hereinabove with reference to VGAM492. FIG. 1 further provides a conceptual description of a novel bioinformatically detected viral gene of the present invention, referred to here as Viral Genomic Address Messenger 2457 (VGAM2457) viral gene, which modulates expression of respective host target genes thereof, the function and utility of which host target genes is known in the art.

VGAM2457 is a novel bioinformatically detected regulatory, non protein coding, viral micro RNA (miRNA) gene. The method by which VGAM2457 was detected is described hereinabove with reference to FIGS. 1-8.

VGAM2457 gene, herein designated VGAM GENE, is a viral gene contained in the genome of Mouse Cytomegalovirus 1. VGAM2457 host target gene, herein designated VGAM HOST TARGET GENE, is a human gene contained in the human genome.

VGAM2457 gene encodes a VGAM2457 precursor RNA, herein designated VGAM PRECURSOR RNA. Similar to other miRNA genes, and unlike most ordinary genes, VGAM2457 precursor RNA does not encode a protein. A nucleotide sequence identical or highly similar to the nucleotide sequence of VGAM2457 precursor RNA is designated SEQ ID:2443, and is provided hereinbelow with reference to the sequence listing part. Nucleotide sequence SEQ ID:2443 is located at position 49086 relative to the genome of Mouse Cytomegalovirus 1.

VGAM2457 precursor RNA folds onto itself, forming VGAM2457 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2457 folded precursor RNA into VGAM2457 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2457 RNA is designated SEQ ID:5168, and is provided hereinbelow with reference to the sequence listing part.

VGAM2457 host target gene, herein designated VGAM HOST TARGET GENE, encodes a corresponding messenger RNA, VGAM2457 host target RNA, herein designated VGAM HOST TARGET RNA. VGAM2457 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2457 RNA, herein designated VGAM RNA, binds complementarily to one or more host target binding sites located in untranslated regions of VGAM2457 host target RNA, herein designated VGAM HOST TARGET RNA. This complementary binding is due to the fact that the nucleotide sequence of VGAM2457 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2457 RNA, herein designated VGAM RNA, may have a different number of host target binding sites in untranslated regions of a VGAM2457 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2457 RNA, herein designated VGAM RNA, to host target binding sites on VGAM2457 host target RNA, herein designated VGAM HOST TARGET RNA, such as BINDING SITE I, BINDING SITE II and BINDING SITE III, inhibits translation of VGAM2457 host target RNA into VGAM2457 host target protein, herein designated VGAM HOST TARGET PROTEIN. VGAM host target protein is therefore outlined by a broken line.

It is appreciated that VGAM2457 host target gene, herein designated VGAM HOST TARGET GENE, in fact represents a plurality of VGAM2457 host target genes. The mRNA of each one of this plurality of VGAM2457 host target genes comprises one or more host target binding sites, each having a nucleotide sequence which is at least partly complementary to VGAM2457 RNA, herein designated VGAM RNA, and which when bound by VGAM2457 RNA causes inhibition of translation of respective one or more VGAM2457 host target proteins.

It is further appreciated by one skilled in the art that the mode of translational inhibition illustrated by FIG. 1 with specific reference to translational inhibition exerted by VGAM2457 gene, herein designated VGAM GENE, on one or more VGAM2457 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2457 is inhibition of expression of host target genes, as part of a novel viral mechanism of attacking a host. Accordingly, utilities of VGAM2457 include diagnosis, prevention and treatment of viral infection by Mouse Cytomegalovirus 1. Specific functions, and accordingly utilities, of VGAM2457 correlate with, and may be deduced from, the identity of the host target genes which VGAM2457 binds and inhibits, and the function of these host target genes, as elaborated hereinbelow.

Nucleotide sequences of the VGAM2457 precursor RNA, herein designated VGAM PRECURSOR RNA, and of the 'diced' VGAM2457 RNA, herein designated VGAM RNA, and a schematic representation of the secondary folding of VGAM2457 folded precursor RNA, herein designated VGAM FOLDED PRECURSOR RNA, of VGAM2457 are further described hereinbelow with reference to Table 1.

Nucleotide sequences of host target binding sites, such as BINDING SITE-I, BINDING SITE-II and BINDING SITE-III of FIG. 1, found on VGAM2457 host target RNA, and schematic representation of the complementarity of each of these host target binding sites to VGAM2457 RNA, herein designated VGAM RNA, are described hereinbelow with reference to Table 2.

As mentioned hereinabove with reference to FIG. 1, a function of VGAM2457 gene, herein designated VGAM is inhibition of expression of VGAM2457 target genes. It is appreciated that specific functions, and accordingly utilities, of VGAM2457 correlate with, and may be deduced from, the identity of the target genes which VGAM2457 binds and inhibits, and the function of these target genes, as elaborated hereinbelow.

APM1 (Accession NM_004797) is a VGAM2457 host target gene. APM1 BINDING SITE is HOST TARGET binding site found in the 3' untranslated region of mRNA encoded by APM1, corresponding to a HOST TARGET binding site such as BINDING SITE I, BINDING SITE II or BINDING SITE III. Table 2 illustrates the complementarity of the nucleotide sequences of APM1 BINDING SITE, designated SEQ ID:11210, to the nucleotide sequence of VGAM2457 RNA, herein designated VGAM RNA, also designated SEQ ID:5168.

A function of VGAM2457 is therefore inhibition of APM1 (Accession NM_004797). Accordingly, utilities of VGAM2457 include diagnosis, prevention and treatment of diseases and clinical conditions associated with APM1.

ATPase, Aminophospholipid Transporter-like, Class I, Type 8A, Member 2 (ATP8A2, Accession XM_167916) is another VGAM2457 host target gene. ATP8A2 BINDING SITE is HOST TARGET binding site found in the 3' untranslated region of mRNA encoded by ATP8A2, corresponding to a HOST TARGET binding site such as BINDING SITE I, BINDING SITE II or BINDING SITE III. Table 2 illustrates the complementarity of the nucleotide sequences of ATP8A2 BINDING SITE, designated SEQ ID:44913, to the nucleotide sequence of VGAM2457 RNA, herein designated VGAM RNA, also designated SEQ ID:5168.

Another function of VGAM2457 is therefore inhibition of ATPase, Aminophospholipid Transporter-like, Class I, Type 8A, Member 2 (ATP8A2, Accession XM_167916). Accordingly, utilities of VGAM2457 include diagnosis, prevention and treatment of diseases and clinical conditions associated with ATP8A2. Chromosome 14 Open Reading Frame 1 (C14orf1, Accession NM_007176) is another VGAM2457 host target gene. C14orf1 BINDING SITE is HOST TARGET binding site found in the 3' untranslated region of mRNA encoded by C14orf1, corresponding to a HOST TARGET binding site such as BINDING SITE I, BINDING SITE II or BINDING SITE III. Table 2 illustrates the complementarity of the nucleotide sequences of C14orf1 BINDING SITE, designated SEQ ID:14029, to the nucleotide sequence of VGAM2457 RNA, herein designated VGAM RNA, also designated SEQ ID:5168.

Another function of VGAM2457 is therefore inhibition of Chromosome 14 Open Reading Frame 1 (C14orf1, Accession NM_007176). Accordingly, utilities of VGAM2457 include diagnosis, prevention and treatment of diseases and clinical conditions associated with C14orf1. EphA8 (EPHA8, Accession NM_020526) is another VGAM2457 host target gene. EPHA8 BINDING SITE is HOST TARGET binding site found in the 3' untranslated region of mRNA encoded by EPHA8, corresponding to a HOST TARGET binding site such as BINDING SITE I, BINDING SITE II or BINDING SITE III. Table 2 illustrates the complementarity of the nucleotide sequences of EPHA8 BINDING SITE, designated SEQ ID:21741, to the nucleotide sequence of VGAM2457 RNA, herein designated VGAM RNA, also designated SEQ ID:5168.

Another function of VGAM2457 is therefore inhibition of EphA8 (EPHA8, Accession NM_020526), a gene which Eph-related receptor tyrosine kinase A8. Accordingly, utilities of VGAM2457 include diagnosis, prevention and treatment of diseases and clinical conditions associated with EPHA8. The function of EPHA8 and its association with various diseases and clinical conditions, has been established by previous studies, as described hereinabove with reference to VGAM494. Ellis Van Creveld Syndrome (EVC, Accession NM_014556) is another VGAM2457 host target gene. EVC BINDING SITE is HOST TARGET binding site found in the 3' untranslated region of mRNA encoded by EVC, corresponding to a HOST TARGET binding site such as BINDING SITE I, BINDING SITE II or BINDING SITE III. Table 2 illustrates the complementarity of the nucleotide sequences of EVC BINDING SITE, designated SEQ ID:15884, to the nucleotide sequence of VGAM2457 RNA, herein designated VGAM RNA, also designated SEQ ID:5168.

Another function of VGAM2457 is therefore inhibition of Ellis Van Creveld Syndrome (EVC, Accession NM_014556). Accordingly, utilities of VGAM2457 include diagnosis, prevention and treatment of diseases and clinical conditions associated with EVC. Fanconi Anemia, Complementation Group F (FANCF, Accession NM_022725) is another VGAM2457 host target gene. FANCF BINDING SITE is HOST TARGET binding site found in the 3' untranslated region of mRNA encoded by FANCF, corresponding to a HOST TARGET binding site such as BINDING SITE I, BINDING SITE II or BINDING SITE III. Table 2 illustrates the complementarity of the nucleotide sequences of FANCF BINDING SITE, designated SEQ ID:22923, to the nucleotide sequence of VGAM2457 RNA, herein designated VGAM RNA, also designated SEQ ID:5168.

Another function of VGAM2457 is therefore inhibition of Fanconi Anemia, Complementation Group F (FANCF, Accession NM_022725). Accordingly, utilities of VGAM2457 include diagnosis, prevention and treatment of diseases and clinical conditions associated with FANCF. IMP (inosine monophosphate) Dehydrogenase 1 (IMPDH1, Accession NM_000883) is another VGAM2457 host target gene. IMPDH1 BINDING SITE is HOST TARGET binding site found in the 5' untranslated region of mRNA encoded by IMPDH1, corresponding to a HOST TARGET binding site such as BINDING SITE I, BINDING SITE II or BINDING SITE III. Table 2 illustrates the complementarity of the nucleotide sequences of IMPDH1 BINDING SITE, designated SEQ ID:6579, to the nucleotide sequence of VGAM2457 RNA, herein designated VGAM RNA, also designated SEQ ID:5168.

Another function of VGAM2457 is therefore inhibition of IMP (inosine monophosphate) Dehydrogenase 1 (IMPDH1, Accession NM_000883). Accordingly, utilities of VGAM2457 include diagnosis, prevention and treatment of diseases and clinical conditions associated with IMPDH1. Tripartite Motif-containing 9 (TRIM9, Accession NM_015163) is another VGAM2457 host target gene. TRIM9 BINDING SITE is HOST TARGET binding site found in the 5' untranslated region of mRNA encoded by TRIM9, corresponding to a HOST TARGET binding site such as BINDING SITE I, BINDING SITE II or BINDING SITE III. Table 2 illustrates the complementarity of the nucleotide sequences of TRIM9 BINDING SITE, designated SEQ ID:17517, to the nucleotide sequence of VGAM2457 RNA, herein designated VGAM RNA, also designated SEQ ID:5168.

Another function of VGAM2457 is therefore inhibition of Tripartite Motif-containing 9 (TRIM9, Accession NM_015163), a gene which may function as a positive regulator for mannosylphosphate transferase and is required to mediate mannosylphosphate transfer in both the core and outer chain portions of n-linked. oligosaccharides. Accordingly, utilities of VGAM2457 include diagnosis, prevention and treatment of diseases and clinical conditions associated with TRIM9. The function of TRIM9 and its association with various diseases and clinical conditions, has been established by previous studies, as described hereinabove with reference to VGAM74. Ankyrin Repeat and SOCS Box-containing 16 (ASB16, Accession XM_046024) is another VGAM2457 host target gene. ASB16 BINDING SITE is HOST TARGET binding site found in the 5' untranslated region of mRNA encoded by ASB16, corresponding to a HOST TARGET binding site such as BINDING SITE I, BINDING SITE II or BINDING SITE III. Table 2 illustrates the complementarity of the nucleotide sequences of ASB16 BINDING SITE, designated SEQ ID:34653, to the nucleotide sequence of VGAM2457 RNA, herein designated VGAM RNA, also designated SEQ ID:5168.

Another function of VGAM2457 is therefore inhibition of Ankyrin Repeat and SOCS Box-containing 16 (ASB16, Accession XM_046024). Accordingly, utilities of VGAM2457 include diagnosis, prevention and treatment of diseases and clinical conditions associated with ASB16.

FLJ20897 (Accession NM_032378) is another VGAM2457 host target gene. FLJ20897 BINDING SITE is HOST TARGET binding site found in the 5' untranslated region of mRNA encoded by FLJ20897, corresponding to a HOST TARGET binding site such as BINDING SITE I, BINDING SITE II or BINDING SITE III. Table 2 illustrates the complementarity of the nucleotide sequences of FLJ20897 BINDING SITE, designated SEQ ID:26173, to the nucleotide sequence of VGAM2457 RNA, herein designated VGAM RNA, also designated SEQ ID:5168.

Another function of VGAM2457 is therefore inhibition of FLJ20897 (Accession NM_032378). Accordingly, utilities of VGAM2457 include diagnosis, prevention and treatment of diseases and clinical conditions associated with FLJ20897. KIAA0441 (Accession NM_014797) is another VGAM2457 host target gene. KIAA0441 BINDING SITE is HOST TARGET binding site found in the 3' untranslated region of mRNA encoded by KIAA0441, corresponding to a HOST TARGET binding site such as BINDING SITE I, BINDING SITE II or BINDING SITE III. Table 2 illustrates the complementarity of the nucleotide sequences of KIAA0441 BINDING SITE, designated SEQ ID:16710, to the nucleotide sequence of VGAM2457 RNA, herein designated VGAM RNA, also designated SEQ ID:5168.

Another function of VGAM2457 is therefore inhibition of KIAA0441 (Accession NM_014797). Accordingly, utilities of VGAM2457 include diagnosis, prevention and treatment of diseases and clinical conditions associated with KIAA0441. MGC14697 (Accession NM_032747) is another VGAM2457 host target gene. MGC14697 BINDING SITE is HOST TARGET binding site found in the 5' untranslated region of mRNA encoded by MGC14697, corresponding to a HOST TARGET binding site such as BINDING SITE I, BINDING SITE II or BINDING SITE III. Table 2 illustrates the complementarity of the nucleotide sequences of MGC14697 BINDING SITE, designated SEQ ID:26484, to the nucleotide sequence of VGAM2457 RNA, herein designated VGAM RNA, also designated SEQ ID:5168.

Another function of VGAM2457 is therefore inhibition of MGC14697 (Accession NM_032747). Accordingly, utilities of VGAM2457 include diagnosis, prevention and treatment of diseases and clinical conditions associated with MGC14697. Sideroflexin 2 (SFXN2, Accession XM_058359) is another VGAM2457 host target gene. SFXN2 BINDING SITE is HOST TARGET binding site found in the 3' untranslated region of mRNA encoded by SFXN2, corresponding to a HOST TARGET binding site such as BINDING SITE I, BINDING SITE II or BINDING SITE III. Table 2 illustrates the complementarity of the nucleotide sequences of SFXN2 BINDING SITE, designated SEQ ID:36603, to the nucleotide sequence of VGAM2457 RNA, herein designated VGAM RNA, also designated SEQ ID:5168.

Another function of VGAM2457 is therefore inhibition of Sideroflexin 2 (SFXN2, Accession XM_058359). Accordingly, utilities of VGAM2457 include diagnosis, prevention and treatment of diseases and clinical conditions associated with SFXN2. SKRP1 (Accession NM_080876) is another VGAM2457 host target gene. SKRP1 BINDING SITE is HOST TARGET binding site found in the 5' untranslated region of mRNA encoded by SKRP1, corresponding to a HOST TARGET binding site such as BINDING SITE I, BINDING SITE II or BINDING SITE III. Table 2 illustrates the complementarity of the nucleotide sequences of SKRP1 BINDING SITE, designated SEQ ID:28120, to the nucleotide sequence of VGAM2457 RNA, herein designated VGAM RNA, also designated SEQ ID:5168.

Another function of VGAM2457 is therefore inhibition of SKRP1 (Accession NM_080876). Accordingly, utilities of VGAM2457 include diagnosis, prevention and treatment of diseases and clinical conditions associated with SKRP1. Syntaxin 4A (placental) (STX4A, Accession NM_004604) is another VGAM2457 host target gene. STX4A BINDING SITE is HOST TARGET binding site found in the 5' untranslated region of mRNA encoded by STX4A, corresponding to a HOST TARGET binding site such as BINDING SITE I, BINDING SITE II or BINDING SITE III. Table 2 illustrates the complementarity of the nucleotide sequences of STX4A BINDING SITE, designated SEQ ID:10947, to the nucleotide sequence of VGAM2457 RNA, herein designated VGAM RNA, also designated SEQ ID:5168.

Another function of VGAM2457 is therefore inhibition of Syntaxin 4A (placental) (STX4A, Accession NM_004604). Accordingly, utilities of VGAM2457 include diagnosis, prevention and treatment of diseases and clinical conditions associated with STX4A. Vacuolar Protein Sorting 4A (yeast) (VPS4A, Accession NM_013245) is another VGAM2457 host target gene. VPS4A BINDING SITE is HOST TARGET binding site found in the 3' untranslated region of mRNA encoded by VPS4A, corresponding to a HOST TARGET binding site such as BINDING SITE I, BINDING SITE II or BINDING SITE III. Table 2 illustrates the complementarity of the nucleotide sequences of VPS4A BINDING SITE, designated SEQ ID:14906, to the nucleotide sequence of VGAM2457 RNA, herein designated VGAM RNA, also designated SEQ ID:5168.

Another function of VGAM2457 is therefore inhibition of Vacuolar Protein Sorting 4A (yeast) (VPS4A, Accession NM_013245). Accordingly, utilities of VGAM2457 include diagnosis, prevention and treatment of diseases and clinical conditions associated with VPS4A. LOC160646 (Accession XM_090413) is another VGAM2457 host target gene. LOC160646 BINDING SITE is HOST TARGET binding site found in the 3' untranslated region of mRNA encoded by LOC160646, corresponding to a HOST TARGET binding site such as BINDING SITE I, BINDING SITE II or BINDING SITE III. Table 2 illustrates the complementarity of the nucleotide sequences of LOC160646 BINDING SITE, designated SEQ ID:40002, to the nucleotide sequence of VGAM2457 RNA, herein designated VGAM RNA, also designated SEQ ID:5168.

Another function of VGAM2457 is therefore inhibition of LOC160646 (Accession XM_090413). Accordingly, utilities of VGAM2457 include diagnosis, prevention and treatment of diseases and clinical conditions associated with LOC160646. LOC221296 (Accession XM_166325) is another VGAM2457 host target gene. LOC221296 BINDING SITE is HOST TARGET binding site found in the 3' untranslated region of mRNA encoded by LOC221296, corresponding to a HOST TARGET binding site such as BINDING SITE I, BINDING SITE II or BINDING SITE III. Table 2 illustrates the complementarity of the nucleotide sequences of LOC221296 BINDING SITE, designated SEQ ID:44169, to the nucleotide sequence of VGAM2457 RNA, herein designated VGAM RNA, also designated SEQ ID:5168.

Another function of VGAM2457 is therefore inhibition of LOC221296 (Accession XM_166325). Accordingly, utilities of VGAM2457 include diagnosis, prevention and treatment of diseases and clinical conditions associated with LOC221296. LOC255308 (Accession XM_170536) is another VGAM2457 host target gene. LOC255308 BINDING SITE is HOST TARGET binding site found in the 3' untranslated region of mRNA encoded by LOC255308, corresponding to a HOST TARGET binding site such as BIND- ING SITE I, BINDING SITE II or BINDING SITE III. Table 2 illustrates the complementarity of the nucleotide sequences of LOC255308 BINDING SITE, designated SEQ ID:45355, to the nucleotide sequence of VGAM2457 RNA, herein designated VGAM RNA, also designated SEQ ID:5168.

Another function of VGAM2457 is therefore inhibition of LOC255308 (Accession XM_170536). Accordingly, utilities of VGAM2457 include diagnosis, prevention and treatment of diseases and clinical conditions associated with LOC255308. LOC56963 (Accession XM_049372) is another VGAM2457 host target gene. LOC56963 BINDING SITE is HOST TARGET binding site found in the 5' untranslated region of mRNA encoded by LOC56963, corresponding to a HOST TARGET binding site such as BINDING SITE I, BINDING SITE II or BINDING SITE III. Table 2 illustrates the complementarity of the nucleotide sequences of LOC56963 BINDING SITE, designated SEQ ID:35399, to the nucleotide sequence of VGAM2457 RNA, herein designated VGAM RNA, also designated SEQ ID:5168.

Another function of VGAM2457 is therefore inhibition of LOC56963 (Accession XM_049372). Accordingly, utilities of VGAM2457 include diagnosis, prevention and treatment of diseases and clinical conditions associated with LOC56963. FIG. 1 further provides a conceptual description of a novel bioinformatically detected viral gene of the present invention, referred to here as Viral Genomic Address Messenger 2458 (VGAM2458) viral gene, which modulates expression of respective host target genes thereof, the function and utility of which host target genes is known in the art.

VGAM2458 is a novel bioinformatically detected regulatory, non protein coding, viral micro RNA (miRNA) gene. The method by which VGAM2458 was detected is described hereinabove with reference to FIGS. 1-8.

VGAM2458 gene, herein designated VGAM GENE, is a viral gene contained in the genome of Mouse Cytomegalovirus 1. VGAM2458 host target gene, herein designated VGAM HOST TARGET GENE, is a human gene contained in the human genome.

VGAM2458 gene encodes a VGAM2458 precursor RNA, herein designated VGAM PRECURSOR RNA. Similar to other miRNA genes, and unlike most ordinary genes, VGAM2458 precursor RNA does not encode a protein. A nucleotide sequence identical or highly similar to the nucleotide sequence of VGAM2458 precursor RNA is designated SEQ ID:2444, and is provided hereinbelow with reference to the sequence listing part. Nucleotide sequence SEQ ID:2444 is located at position 183475 relative to the genome of Mouse Cytomegalovirus 1.

VGAM2458 precursor RNA folds onto itself, forming VGAM2458 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2458 folded precursor RNA into VGAM2458 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 65%) nucleotide sequence of VGAM2458 RNA is designated SEQ ID:5169, and is provided hereinbelow with reference to the sequence listing part.

VGAM2458 host target gene, herein designated VGAM HOST TARGET GENE, encodes a corresponding messenger RNA, VGAM2458 host target RNA, herein designated VGAM HOST TARGET RNA. VGAM2458 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2458 RNA, herein designated VGAM RNA, binds complementarily to one or more host target binding sites located in untranslated regions of VGAM2458 host target RNA, herein designated VGAM HOST TARGET RNA. This complementary binding is due to the fact that the nucleotide sequence of VGAM2458 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2458 RNA, herein designated VGAM RNA, may have a different number of host target binding sites in untranslated regions of a VGAM2458 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2458 RNA, herein designated VGAM RNA, to host target binding sites on VGAM2458 host target RNA, herein designated VGAM HOST TARGET RNA, such as BINDING SITE I, BINDING SITE II and BINDING SITE III, inhibits translation of VGAM2458 host target RNA into VGAM2458 host target protein, herein designated VGAM HOST TARGET PROTEIN. VGAM host target protein is therefore outlined by a broken line.

It is appreciated that VGAM2458 host target gene, herein designated VGAM HOST TARGET GENE, in fact represents a plurality of VGAM2458 host target genes. The mRNA of each one of this plurality of VGAM2458 host target genes comprises one or more host target binding sites, each having a nucleotide sequence which is at least partly complementary to VGAM2458 RNA, herein designated VGAM RNA, and which when bound by VGAM2458 RNA causes inhibition of translation of respective one or more VGAM2458 host target proteins.

It is further appreciated by one skilled in the art that the mode of translational inhibition illustrated by FIG. 1 with specific reference to translational inhibition exerted by VGAM2458 gene, herein designated VGAM GENE, on one or more VGAM2458 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM2458 is inhibition of expression of host target genes, as part of a novel viral mechanism of attacking a host. Accordingly, utilities of VGAM2458 include diagnosis, prevention and treatment of viral infection by Mouse Cytomegalovirus 1. Specific functions, and accordingly utilities, of VGAM2458 correlate with, and may be deduced from, the identity of the host target genes which VGAM2458 binds and inhibits, and the function of these host target genes, as elaborated hereinbelow.

Nucleotide sequences of the VGAM2458 precursor RNA, herein designated VGAM PRECURSOR RNA, and of the 'diced' VGAM2458 RNA, herein designated VGAM RNA, and a schematic representation of the secondary folding of VGAM2458 folded precursor RNA, herein designated VGAM FOLDED PRECURSOR RNA, of VGAM2458 are further described hereinbelow with reference to Table 1.

Nucleotide sequences of host target binding sites, such as BINDING SITE-I, BINDING SITE-II and BINDING SITE-III of FIG. 1, found on VGAM2458 host target RNA, and schematic representation of the complementarity of each of these host target binding sites to VGAM2458 RNA, herein designated VGAM RNA, are described hereinbelow with reference to Table 2.

As mentioned hereinabove with reference to FIG. 1, a function of VGAM2458 gene, herein designated VGAM is inhibition of expression of VGAM2458 target genes. It is appreciated that specific functions, and accordingly utilities, of VGAM2458 correlate with, and may be deduced from, the identity of the target genes which VGAM2458 binds and inhibits, and the function of these target genes, as elaborated hereinbelow.

Male Germ Cell-associated Kinase (MAK, Accession NM_005906) is a VGAM2458 host target gene. MAK BINDING SITE is HOST TARGET binding site found in the 3' untranslated region of mRNA encoded by MAK, corresponding to a HOST TARGET binding site such as BINDING SITE I, BINDING SITE II or BINDING SITE III. Table 2 illustrates the complementarity of the nucleotide sequences of MAK BINDING SITE, designated SEQ ID:12528, to the nucleotide sequence of VGAM2458 RNA, herein designated VGAM RNA, also designated SEQ ID:5169.

A function of VGAM2458 is therefore inhibition of Male Germ Cell-associated Kinase (MAK, Accession NM_005906), a gene which plays an important role in spermatogenesis. Accordingly, utilities of VGAM2458 include diagnosis, prevention and treatment of diseases and clinical conditions associated with MAK. The function of MAK and its association with various diseases and clinical conditions, has been established by previous studies, as described hereinabove with reference to VGAM1322. Prominin-like 1 (mouse) (PROML1, Accession NM_006017) is another VGAM2458 host target gene. PROML1 BINDING SITE is HOST TARGET binding site found in the 3' untranslated region of mRNA encoded by PROML1, corresponding to a HOST TARGET binding site such as BINDING SITE I, BINDING SITE II or BINDING SITE III. Table 2 illustrates the complementarity of the nucleotide sequences of PROML1 BINDING SITE, designated SEQ ID:12636, to the nucleotide sequence of VGAM2458 RNA, herein designated VGAM RNA, also designated SEQ ID:5169.

Another function of VGAM2458 is therefore inhibition of Prominin-like 1 (mouse) (PROML1, Accession NM_006017), a gene which is a Transmembrane protein. Accordingly, utilities of VGAM2458 include diagnosis, prevention and treatment of diseases and clinical conditions associated with PROML1. The function of PROML1 and its association with various diseases and clinical conditions, has been established by previous studies, as described hereinabove with reference to VGAM905. RAD9 Homolog (S. pombe) (RAD9, Accession NM_004584) is another VGAM2458 host target gene. RAD9 BINDING SITE is HOST TARGET binding site found in the 3' untranslated region of mRNA encoded by RAD9, corresponding to a HOST TARGET binding site such as BINDING SITE I, BINDING SITE II or BINDING SITE III. Table 2 illustrates the complementarity of the nucleotide sequences of RAD9 BINDING SITE, designated SEQ ID:10931, to the nucleotide sequence of VGAM2458 RNA, herein designated VGAM RNA, also designated SEQ ID:5169.

Another function of VGAM2458 is therefore inhibition of RAD9 Homolog (S. pombe) (RAD9, Accession NM_004584), a gene which may function as a cell cycle checkpoint protein. Accordingly, utilities of VGAM2458 include diagnosis, prevention and treatment of diseases and clinical conditions associated with RAD9. The function of RAD9 and its association with various diseases and clinical conditions, has been established by previous studies, as described hereinabove with reference to VGAM1959. DKFZp434J0617 (Accession NM_032246) is another VGAM2458 host target gene. DKFZp434J0617 BINDING SITE is HOST TARGET binding site found in the 3' untranslated region of mRNA encoded by DKFZp434J0617, corresponding to a HOST TARGET binding site such as BINDING SITE I, BINDING SITE II or BINDING SITE III. Table 2 illustrates the complementarity of the nucleotide sequences of DKFZp434J0617 BINDING SITE, designated SEQ ID:25981, to the nucleotide sequence of VGAM2458 RNA, herein designated VGAM RNA, also designated SEQ ID:5169.

Another function of VGAM2458 is therefore inhibition of DKFZp434J0617 (Accession NM_032246). Accordingly, utilities of VGAM2458 include diagnosis, prevention and treatment of diseases and clinical conditions associated with DKFZp434J0617. HT012 (Accession NM_018473) is another VGAM2458 host target gene. HT012 BINDING SITE is HOST TARGET binding site found in the 5' untranslated region of mRNA encoded by HT012, corresponding to a HOST TARGET binding site such as BINDING SITE I, BINDING SITE II or BINDING SITE III. Table 2 illustrates the complementarity of the nucleotide sequences of HT012 BINDING SITE, designated SEQ ID:20540, to the nucleotide sequence of VGAM2458 RNA, herein designated VGAM RNA, also designated SEQ ID:5169.

Another function of VGAM2458 is therefore inhibition of HT012 (Accession NM_018473). Accordingly, utilities of VGAM2458 include diagnosis, prevention and treatment of diseases and clinical conditions associated with HT012. KIAA0945 (Accession NM_014952) is another VGAM2458 host target gene. KIAA0945 BINDING SITE is HOST TARGET binding site found in the 5' untranslated region of mRNA encoded by KIAA0945, corresponding to a HOST TARGET binding site such as BINDING SITE I, BINDING SITE II or BINDING SITE III. Table 2 illustrates the complementarity of the nucleotide sequences of KIAA0945 BINDING SITE, designated SEQ ID:17288, to the nucleotide sequence of VGAM2458 RNA, herein designated VGAM RNA, also designated SEQ ID:5169.

Another function of VGAM2458 is therefore inhibition of KIAA0945 (Accession NM_014952). Accordingly, utilities of VGAM2458 include diagnosis, prevention and treatment of diseases and clinical conditions associated with KIAA0945. Signal-regulatory Protein Beta 1 (SIRPB1, Accession NM_006065) is another VGAM2458 host target gene. SIRPB1 BINDING SITE is HOST TARGET binding site found in the 3' untranslated region of mRNA encoded by SIRPB1, corresponding to a HOST TARGET binding site such as BINDING SITE I, BINDING SITE II or BINDING SITE III. Table 2 illustrates the complementarity of the nucleotide sequences of SIRPB1 BINDING SITE, designated SEQ ID:12707, to the nucleotide sequence of VGAM2458 RNA, herein designated VGAM RNA, also designated SEQ ID:5169.

Another function of VGAM2458 is therefore inhibition of Signal-regulatory Protein Beta 1 (SIRPB1, Accession NM_006065). Accordingly, utilities of VGAM2458 include diagnosis, prevention and treatment of diseases and clinical conditions associated with SIRPB1. LOC154834 (Accession XM_098621) is another VGAM2458 host target gene. LOC154834 BINDING SITE is HOST TARGET binding site found in the 3' untranslated region of mRNA encoded by LOC154834, corresponding to a HOST TARGET binding site such as BINDING SITE I, BINDING SITE II or BINDING SITE III. Table 2 illustrates the complementarity of the nucleotide sequences of LOC154834 BINDING SITE, designated SEQ ID:41731, to the nucleotide sequence of VGAM2458 RNA, herein designated VGAM RNA, also designated SEQ ID:5169.

Another function of VGAM2458 is therefore inhibition of LOC154834 (Accession XM_098621). Accordingly, utilities of VGAM2458 include diagnosis, prevention and treatment of diseases and clinical conditions associated with LOC154834. LOC51094 (Accession NM_015999) is another VGAM2458 host target gene. LOC51094 BINDING SITE is HOST TARGET binding site found in the 3' untranslated region of mRNA encoded by LOC51094, corresponding to a HOST TARGET binding site such as BINDING SITE I, BINDING SITE II or BINDING SITE III. Table 2 illustrates the complementarity of the nucleotide sequences of LOC51094 BINDING SITE, designated SEQ ID:18089, to the nucleotide sequence of VGAM2458 RNA, herein designated VGAM RNA, also designated SEQ ID:5169.

Another function of VGAM2458 is therefore inhibition of LOC51094 (Accession NM_015999). Accordingly, utilities of VGAM2458 include diagnosis, prevention and treatment of diseases and clinical conditions associated with LOC51094. FIG. 1 further provides a conceptual description of a novel bioinformatically detected viral gene of the present invention, referred to here as Viral Genomic Address Messenger 2459 (VGAM2459) viral gene, which modulates expression of respective host target genes thereof, the function and utility of which host target genes is known in the art.

VGAM2459 is a novel bioinformatically detected regulatory, non protein coding, viral micro RNA (miRNA) gene. The method by which VGAM2459 was detected is described hereinabove with reference to FIGS. 1-8.

VGAM2459 gene, herein designated VGAM GENE, is a viral gene contained in the genome of Mouse Cytomegalovirus 1. VGAM2459 host target gene, herein designated VGAM HOST TARGET GENE, is a human gene contained in the human genome.

VGAM2459 gene encodes a VGAM2459 precursor RNA, herein designated VGAM PRECURSOR RNA. Similar to other miRNA genes, and unlike most ordinary genes, VGAM2459 precursor RNA does not encode a protein. A nucleotide sequence identical or highly similar to the nucleotide sequence of VGAM2459 precursor RNA is designated SEQ ID:2445, and is provided hereinbelow with reference to the sequence listing part. Nucleotide sequence SEQ ID:2445 is located at position 121309 relative to the genome of Mouse Cytomegalovirus 1.

VGAM2459 precursor RNA folds onto itself, forming VGAM2459 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2459 folded precursor RNA into VGAM2459 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM2459 RNA is designated SEQ ID:5170, and is provided hereinbelow with reference to the sequence listing part.

VGAM2459 host target gene, herein designated VGAM HOST TARGET GENE, encodes a corresponding messenger RNA, VGAM2459 host target RNA, herein designated VGAM HOST TARGET RNA. VGAM2459 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2459 RNA, herein designated VGAM RNA, binds complementarily to one or more host target binding sites located in untranslated regions of VGAM2459 host target RNA, herein designated VGAM HOST TARGET RNA. This complementary binding is due to the fact that the nucleotide sequence of VGAM2459 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2459 RNA, herein designated VGAM RNA, may have a different number of host target binding sites in untranslated regions of a VGAM2459 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2459 RNA, herein designated VGAM RNA, to host target binding sites on VGAM2459 host target RNA, herein designated VGAM HOST TARGET RNA, such as BINDING SITE I, BINDING SITE II and BINDING SITE III, inhibits translation of VGAM2459 host target RNA into VGAM2459 host target protein, herein designated VGAM HOST TARGET PROTEIN. VGAM host target protein is therefore outlined by a broken line.

It is appreciated that VGAM2459 host target gene, herein designated VGAM HOST TARGET GENE, in fact represents a plurality of VGAM2459 host target genes. The mRNA of each one of this plurality of VGAM2459 host target genes comprises one or more host target binding sites, each having a nucleotide sequence which is at least partly complementary to VGAM2459 RNA, herein designated VGAM RNA, and which when bound by VGAM2459 RNA causes inhibition of translation of respective one or more VGAM2459 host target proteins.

It is further appreciated by one skilled in the art that the mode of translational inhibition illustrated by FIG. 1 with specific reference to translational inhibition exerted by VGAM2459 gene, herein designated VGAM GENE, on one or more VGAM2459 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2459 is inhibition of expression of host target genes, as part of a novel viral mechanism of attacking a host. Accordingly, utilities of VGAM2459 include diagnosis, prevention and treatment of viral infection by Mouse Cytomegalovirus 1. Specific functions, and accordingly utilities, of VGAM2459 correlate with, and may be deduced from, the identity of the host target genes which VGAM2459 binds and inhibits, and the function of these host target genes, as elaborated hereinbelow.

Nucleotide sequences of the VGAM2459 precursor RNA, herein designated VGAM PRECURSOR RNA, and of the 'diced' VGAM2459 RNA, herein designated VGAM RNA, and a schematic representation of the secondary folding of VGAM2459 folded precursor RNA, herein designated VGAM FOLDED PRECURSOR RNA, of VGAM2459 are further described hereinbelow with reference to Table 1.

Nucleotide sequences of host target binding sites, such as BINDING SITE-I, BINDING SITE-II and BINDING SITE-III of FIG. 1, found on VGAM2459 host target RNA, and schematic representation of the complementarity of each of these host target binding sites to VGAM2459 RNA, herein designated VGAM RNA, are described hereinbelow with reference to Table 2.

As mentioned hereinabove with reference to FIG. 1, a function of VGAM2459 gene, herein designated VGAM is inhibition of expression of VGAM2459 target genes. It is appreciated that specific functions, and accordingly utilities, of VGAM2459 correlate with, and may be deduced from, the identity of the target genes which VGAM2459 binds and inhibits, and the function of these target genes, as elaborated hereinbelow.

Gamma-glutamyltransferase 2 (GGT2, Accession XM_057166) is a VGAM2459 host target gene. GGT2 BINDING SITE is HOST TARGET binding site found in the 5' untranslated region of mRNA encoded by GGT2, corresponding to a HOST TARGET binding site such as BINDING SITE I, BINDING SITE II or BINDING SITE III. Table 2 illustrates the complementarity of the nucleotide sequences of GGT2 BINDING SITE, designated SEQ ID:36489, to the nucleotide sequence of VGAM2459 RNA, herein designated VGAM RNA, also designated SEQ ID:5170.

A function of VGAM2459 is therefore inhibition of Gamma-glutamyltransferase 2 (GGT2, Accession XM_057166). Accordingly, utilities of VGAM2459 include diagnosis, prevention and treatment of diseases and clinical conditions associated with GGT2. Interleukin-1 Receptor-associated Kinase 4 (IRAK4, Accession XM_028349) is another VGAM2459 host target gene. IRAK4 BINDING SITE is HOST TARGET binding site found in the 3' untranslated region of mRNA encoded by IRAK4, corresponding to a HOST TARGET binding site such as BINDING SITE I, BINDING SITE II or BINDING SITE III. Table 2 illustrates the complementarity of the nucleotide sequences of IRAK4 BINDING SITE, designated SEQ ID:30692, to the nucleotide sequence of VGAM2459 RNA, herein designated VGAM RNA, also designated SEQ ID:5170.

Another function of VGAM2459 is therefore inhibition of Interleukin-1 Receptor-associated Kinase 4 (IRAK4, Accession XM_028349), a gene which may function as an IRAK1 kinase, triggering a cascade of phosphorylation events. Accordingly, utilities of VGAM2459 include diagnosis, prevention and treatment of diseases and clinical conditions associated with IRAK4. The function of IRAK4 and its association with various diseases and clinical conditions, has been established by previous studies, as described hereinabove with reference to VGAM1291. Potassium Intermediate/small Conductance Calcium-activated Channel, Subfamily N, Member 4 (KCNN4, Accession NM_002250) is another VGAM2459 host target gene. KCNN4 BINDING SITE is HOST TARGET binding site found in the 5' untranslated region of mRNA encoded by KCNN4, corresponding to a HOST TARGET binding site such as BINDING SITE I, BINDING SITE II or BINDING SITE III. Table 2 illustrates the complementarity of the nucleotide sequences of KCNN4 BINDING SITE, designated SEQ ID:8038, to the nucleotide sequence of VGAM2459 RNA, herein designated VGAM RNA, also designated SEQ ID:5170.

Another function of VGAM2459 is therefore inhibition of Potassium Intermediate/small Conductance Calcium-activated Channel, Subfamily N, Member 4 (KCNN4, Accession NM_002250), a gene which forms a voltage-independent potassium channel that is activated by intracellular calcium. Accordingly, utilities of VGAM2459 include diagnosis, prevention and treatment of diseases and clinical conditions associated with KCNN4. The function of KCNN4 and its association with various diseases and clinical conditions, has been established by previous studies, as described hereinabove with reference to VGAM152. Paired Box Gene 7 (PAX7, Accession NM_002584) is another VGAM2459 host target gene. PAX7 BINDING SITE1 and PAX7 BINDING SITE2 are HOST TARGET binding sites found in untranslated regions of mRNA encoded by PAX7, corresponding to HOST TARGET binding sites such as BINDING SITE I, BINDING SITE II or BINDING SITE III. Table 2 illustrates the complementarity of the nucleotide sequences of PAX7 BINDING SITE1 and PAX7 BINDING SITE2, designated SEQ ID:8446 and SEQ ID:15134 respectively, to the nucleotide sequence of VGAM2459 RNA, herein designated VGAM RNA, also designated SEQ ID:5170.

Another function of VGAM2459 is therefore inhibition of Paired Box Gene 7 (PAX7, Accession NM_002584), a gene which involves in myogenesis. Accordingly, utilities of VGAM2459 include diagnosis, prevention and treatment of diseases and clinical conditions associated with PAX7. The function of PAX7 and its association with various diseases and clinical conditions, has been established by previous studies, as described hereinabove with reference to VGAM304. Ribosomal Protein S6 Kinase, 90 kDa, Polypeptide 1 (RPS6KA1, Accession XM_001416) is another VGAM2459 host target gene. RPS6KA1 BINDING SITE is HOST TARGET binding site found in the 5' untranslated region of mRNA encoded by RPS6KA1, corresponding to a HOST TARGET binding site such as BINDING SITE I, BINDING SITE II or BINDING SITE III. Table 2 illustrates the complementarity of the nucleotide sequences of RPS6KA1 BINDING SITE, designated SEQ ID:29836, to the nucleotide sequence of VGAM2459 RNA, herein designated VGAM RNA, also designated SEQ ID:5170.

Another function of VGAM2459 is therefore inhibition of Ribosomal Protein S6 Kinase, 90 kDa, Polypeptide 1 (RPS6KA1, Accession XM_001416). Accordingly, utilities of VGAM2459 include diagnosis, prevention and treatment of diseases and clinical conditions associated with RPS6KA1. ARS2 (Accession NM_015908) is another VGAM2459 host target gene. ARS2 BINDING SITE is HOST TARGET binding site found in the 5' untranslated region of mRNA encoded by ARS2, corresponding to a HOST TARGET binding site such as BINDING SITE I, BINDING SITE II or BINDING SITE III. Table 2 illustrates the complementarity of the nucleotide sequences of ARS2 BINDING SITE, designated SEQ ID:18045, to the nucleotide sequence of VGAM2459 RNA, herein designated VGAM RNA, also designated SEQ ID:5170.

Another function of VGAM2459 is therefore inhibition of ARS2 (Accession NM_015908). Accordingly, utilities of VGAM2459 include diagnosis, prevention and treatment of diseases and clinical conditions associated with ARS2. Cerebellin 1 Precursor (CBLN1, Accession NM_004352) is another VGAM2459 host target gene. CBLN1 BINDING SITE is HOST TARGET binding site found in the 5' untranslated region of mRNA encoded by CBLN1, corresponding to a HOST TARGET binding site such as BINDING SITE I, BINDING SITE II or BINDING SITE III. Table 2 illustrates the complementarity of the nucleotide sequences of CBLN1 BINDING SITE, designated SEQ ID:10557, to the nucleotide sequence of VGAM2459 RNA, herein designated VGAM RNA, also designated SEQ ID:5170.

Another function of VGAM2459 is therefore inhibition of Cerebellin 1 Precursor (CBLN1, Accession NM_004352). Accordingly, utilities of VGAM2459 include diagnosis, prevention and treatment of diseases and clinical conditions associated with CBLN1. DKFZP566F2124 (Accession NM_015630) is another VGAM2459 host target gene. DKFZP566F2124 BINDING SITE is HOST TARGET binding site found in the 5' untranslated region of mRNA encoded by DKFZP566F2124, corresponding to a HOST TARGET binding site such as BINDING SITE I, BINDING SITE II or BINDING SITE III. Table 2 illustrates the complementarity of the nucleotide sequences of DKFZP566F2124 BINDING SITE, designated SEQ ID:17887, to the nucleotide sequence of VGAM2459 RNA, herein designated VGAM RNA, also designated SEQ ID:5170.

Another function of VGAM2459 is therefore inhibition of DKFZP566F2124 (Accession NM_015630). Accordingly, utilities of VGAM2459 include diagnosis, prevention and treatment of diseases and clinical conditions associated with DKFZP566F2124. FLJ11712 (Accession NM_024570) is another VGAM2459 host target gene. FLJ11712 BINDING SITE is HOST TARGET binding site found in the 5' untranslated region of mRNA encoded by FLJ11712, corresponding to a HOST TARGET binding site such as BINDING SITE I, BINDING SITE II or BINDING SITE III. Table 2 illustrates the complementarity of the nucleotide sequences of FLJ11712 BINDING SITE, designated SEQ ID:23796, to the nucleotide sequence of VGAM2459 RNA, herein designated VGAM RNA, also designated SEQ ID:5170.

Another function of VGAM2459 is therefore inhibition of FLJ11712 (Accession NM_024570). Accordingly, utilities of VGAM2459 include diagnosis, prevention and treatment of diseases and clinical conditions associated with FLJ11712. FLJ32468 (Accession NM_145115) is another VGAM2459 host target gene. FLJ32468 BINDING SITE is HOST TARGET binding site found in the 5' untranslated region of mRNA encoded by FLJ32468, corresponding to a HOST TARGET binding site such as BINDING SITE I, BINDING SITE II or BINDING SITE III. Table 2 illustrates the complementarity of the nucleotide sequences of FLJ32468 BINDING SITE, designated SEQ ID:29721, to the nucleotide sequence of VGAM2459 RNA, herein designated VGAM RNA, also designated SEQ ID:5170.

Another function of VGAM2459 is therefore inhibition of FLJ32468 (Accession NM_145115). Accordingly, utilities of VGAM2459 include diagnosis, prevention and treatment of diseases and clinical conditions associated with FLJ32468. KIAA0469 (Accession NM_014851) is another VGAM2459 host target gene. KIAA0469 BINDING SITE is HOST TARGET binding site found in the 5' untranslated region of mRNA encoded by KIAA0469, corresponding to a HOST TARGET binding site such as BINDING SITE I, BINDING SITE II or BINDING SITE III. Table 2 illustrates the complementarity of the nucleotide sequences of KIAA0469 BINDING SITE, designated SEQ ID:16893, to the nucleotide sequence of VGAM2459 RNA, herein designated VGAM RNA, also designated SEQ ID:5170.

Another function of VGAM2459 is therefore inhibition of KIAA0469 (Accession NM_014851). Accordingly, utilities of VGAM2459 include diagnosis, prevention and treatment of diseases and clinical conditions associated with KIAA0469. KIAA0662 (Accession XM_088539) is another VGAM2459 host target gene. KIAA0662 BINDING SITE is HOST TARGET binding site found in the 3' untranslated region of mRNA encoded by KIAA0662, corresponding to a HOST TARGET binding site such as BINDING SITE I, BINDING SITE II or BINDING SITE III. Table 2 illustrates the complementarity of the nucleotide sequences of KIAA0662 BINDING SITE, designated SEQ ID:39803, to the nucleotide sequence of VGAM2459 RNA, herein designated VGAM RNA, also designated SEQ ID:5170.

Another function of VGAM2459 is therefore inhibition of KIAA0662 (Accession XM_088539). Accordingly, utilities of VGAM2459 include diagnosis, prevention and treatment of diseases and clinical conditions associated with KIAA0662. KIAA1530 (Accession XM_042661) is another VGAM2459 host target gene. KIAA1530 BINDING SITE is HOST TARGET binding site found in the 5' untranslated region of mRNA encoded by KIAA1530, corresponding to a HOST TARGET binding site such as BINDING SITE I, BINDING SITE II or BINDING SITE III. Table 2 illustrates the complementarity of the nucleotide sequences of KIAA1530 BINDING SITE, designated SEQ ID:33733, to the nucleotide sequence of VGAM2459 RNA, herein designated VGAM RNA, also designated SEQ ID:5170.

Another function of VGAM2459 is therefore inhibition of KIAA1530 (Accession XM_042661). Accordingly, utilities of VGAM2459 include diagnosis, prevention and treatment of diseases and clinical conditions associated with KIAA1530. LOC161635 (Accession XM_172921) is another VGAM2459 host target gene. LOC161635 BINDING SITE is HOST TARGET binding site found in the 5' untranslated region of mRNA encoded by LOC161635, corresponding to a HOST TARGET binding site such as BINDING SITE I, BINDING SITE II or BINDING SITE III. Table 2 illustrates the complementarity of the nucleotide sequences of LOC161635 BINDING SITE, designated SEQ ID:46184, to the nucleotide sequence of VGAM2459 RNA, herein designated VGAM RNA, also designated SEQ ID:5170.

Another function of VGAM2459 is therefore inhibition of LOC161635 (Accession XM_172921). Accordingly, utilities of VGAM2459 include diagnosis, prevention and treatment of diseases and clinical conditions associated with LOC161635. LOC254057 (Accession XM_173085) is another VGAM2459 host target gene. LOC254057 BINDING SITE is HOST TARGET binding site found in the 5' untranslated region of mRNA encoded by LOC254057, corresponding to a HOST TARGET binding site such as BINDING SITE I, BINDING SITE II or BINDING SITE III. Table 2 illustrates the complementarity of the nucleotide sequences of LOC254057 BINDING SITE, designated SEQ ID:46347, to the nucleotide sequence of VGAM2459 RNA, herein designated VGAM RNA, also designated SEQ ID:5170.

Another function of VGAM2459 is therefore inhibition of LOC254057 (Accession XM_173085). Accordingly, utilities of VGAM2459 include diagnosis, prevention and treatment of diseases and clinical conditions associated with LOC254057. LOC83693 (Accession NM_031463) is another VGAM2459 host target gene. LOC83693 BINDING SITE is HOST TARGET binding site found in the 5' untranslated region of mRNA encoded by LOC83693, corresponding to a HOST TARGET binding site such as BINDING SITE I, BINDING SITE II or BINDING SITE III. Table 2 illustrates the complementarity of the nucleotide sequences of LOC83693 BINDING SITE, designated SEQ ID:25495, to the nucleotide sequence of VGAM2459 RNA, herein designated VGAM RNA, also designated SEQ ID:5170.

Another function of VGAM2459 is therefore inhibition of LOC83693 (Accession NM_031463). Accordingly, utilities of VGAM2459 include diagnosis, prevention and treatment of diseases and clinical conditions associated with LOC83693. LOC90288 (Accession XM_030669) is another VGAM2459 host target gene. LOC90288 BINDING SITE is HOST TARGET binding site found in the 5' untranslated region of mRNA encoded by LOC90288, corresponding to a HOST TARGET binding site such as BINDING SITE I, BINDING SITE II or BINDING SITE III. Table 2 illustrates the complementarity of the nucleotide sequences of LOC90288 BINDING SITE, designated SEQ ID:31105, to the nucleotide sequence of VGAM2459 RNA, herein designated VGAM RNA, also designated SEQ ID:5170.

Another function of VGAM2459 is therefore inhibition of LOC90288 (Accession XM_030669). Accordingly, utilities of VGAM2459 include diagnosis, prevention and treatment of diseases and clinical conditions associated with LOC90288. FIG. 1 further provides a conceptual description of a novel bioinformatically detected viral gene of the present invention, referred to here as Viral Genomic Address Messenger 2460 (VGAM2460) viral gene, which modulates expression of respective host target genes thereof, the function and utility of which host target genes is known in the art.

VGAM2460 is a novel bioinformatically detected regulatory, non protein coding, viral micro RNA (miRNA) gene. The method by which VGAM2460 was detected is described hereinabove with reference to FIGS. 1-8.

VGAM2460 gene, herein designated VGAM GENE, is a viral gene contained in the genome of Mouse Cytomegalovirus 1. VGAM2460 host target gene, herein designated VGAM HOST TARGET GENE, is a human gene contained in the human genome.

VGAM2460 gene encodes a VGAM2460 precursor RNA, herein designated VGAM PRECURSOR RNA. Similar to other miRNA genes, and unlike most ordinary genes, VGAM2460 precursor RNA does not encode a protein. A nucleotide sequence identical or highly similar to the nucleotide sequence of VGAM2460 precursor RNA is designated SEQ ID:2446, and is provided hereinbelow with reference to the sequence listing part. Nucleotide sequence SEQ ID:2446 is located at position 17895 relative to the genome of Mouse Cytomegalovirus 1.

VGAM2460 precursor RNA folds onto itself, forming VGAM2460 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2460 folded precursor RNA into VGAM2460 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2460 RNA is designated SEQ ID:5171, and is provided hereinbelow with reference to the sequence listing part.

VGAM2460 host target gene, herein designated VGAM HOST TARGET GENE, encodes a corresponding messenger RNA, VGAM2460 host target RNA, herein designated VGAM HOST TARGET RNA. VGAM2460 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2460 RNA, herein designated VGAM RNA, binds complementarily to one or more host target binding sites located in untranslated regions of VGAM2460 host target RNA, herein designated VGAM HOST TARGET RNA. This complementary binding is due to the fact that the nucleotide sequence of VGAM2460 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2460 RNA, herein designated VGAM RNA, may have a different number of host target binding sites in untranslated regions of a VGAM2460 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2460 RNA, herein designated VGAM RNA, to host target binding sites on VGAM2460 host target RNA, herein designated VGAM HOST TARGET RNA, such as BINDING SITE I, BINDING SITE II and BINDING SITE III, inhibits translation of VGAM2460 host target RNA into VGAM2460 host target protein, herein designated VGAM HOST TARGET PROTEIN. VGAM host target protein is therefore outlined by a broken line.

It is appreciated that VGAM2460 host target gene, herein designated VGAM HOST TARGET GENE, in fact represents a plurality of VGAM2460 host target genes. The mRNA of each one of this plurality of VGAM2460 host target genes comprises one or more host target binding sites, each having a nucleotide sequence which is at least partly complementary to VGAM2460 RNA, herein designated VGAM RNA, and which when bound by VGAM2460 RNA causes inhibition of translation of respective one or more VGAM2460 host target proteins.

It is further appreciated by one skilled in the art that the mode of translational inhibition illustrated by FIG. 1 with specific reference to translational inhibition exerted by VGAM2460 gene, herein designated VGAM GENE, on one or more VGAM2460 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2460 is inhibition of expression of host target genes, as part of a novel viral mechanism of attacking a host. Accordingly, utilities of VGAM2460 include diagnosis, prevention and treatment of viral infection by Mouse Cytomegalovirus 1. Specific functions, and accordingly utilities, of VGAM2460 correlate with, and may be deduced from, the identity of the host target genes which VGAM2460 binds and inhibits, and the function of these host target genes, as elaborated hereinbelow.

Nucleotide sequences of the VGAM2460 precursor RNA, herein designated VGAM PRECURSOR RNA, and of the 'diced' VGAM2460 RNA, herein designated VGAM RNA, and a schematic representation of the secondary folding of VGAM2460 folded precursor RNA, herein designated VGAM FOLDED PRECURSOR RNA, of VGAM2460 are further described hereinbelow with reference to Table 1.

Nucleotide sequences of host target binding sites, such as BINDING SITE-I, BINDING SITE-II and BINDING SITE-III of FIG. 1, found on VGAM2460 host target RNA, and schematic representation of the complementarity of each of these host target binding sites to VGAM2460 RNA, herein designated VGAM RNA, are described hereinbelow with reference to Table 2.

As mentioned hereinabove with reference to FIG. 1, a function of VGAM2460 gene, herein designated VGAM is inhibition of expression of VGAM2460 target genes. It is appreciated that specific functions, and accordingly utilities, of VGAM2460 correlate with, and may be deduced from, the identity of the target genes which VGAM2460 binds and inhibits, and the function of these target genes, as elaborated hereinbelow.

CAP350 (Accession NM_014810) is a VGAM2460 host target gene. CAP350 BINDING SITE is HOST TARGET binding site found in the 5' untranslated region of mRNA encoded by CAP350, corresponding to a HOST TARGET binding site such as BINDING SITE I, BINDING SITE II or BINDING SITE III. Table 2 illustrates the complementarity of the nucleotide sequences of CAP350 BINDING SITE, designated SEQ ID:16771, to the nucleotide sequence of VGAM2460 RNA, herein designated VGAM RNA, also designated SEQ ID:5171.

A function of VGAM2460 is therefore inhibition of CAP350 (Accession NM_014810). Accordingly, utilities of VGAM2460 include diagnosis, prevention and treatment of diseases and clinical conditions associated with CAP350. KIAA0350 (Accession XM_028332) is another VGAM2460 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30663, to the nucleotide sequence of VGAM2460 RNA, herein designated VGAM RNA, also designated SEQ ID:5171.

Another function of VGAM2460 is therefore inhibition of KIAA0350 (Accession XM_028332). Accordingly, utilities of VGAM2460 include diagnosis, prevention and treatment of diseases and clinical conditions associated with KIAA0350. KIAA1944 (Accession XM_062545) is another VGAM2460 host target gene. KIAA1944 BINDING SITE is HOST TARGET binding site found in the 3' untranslated region of mRNA encoded by KIAA1944, corresponding to a HOST TARGET binding site such as BINDING SITE I, BINDING SITE II or BINDING SITE III. Table 2 illustrates the complementarity of the nucleotide sequences of KIAA1944 BINDING SITE, designated SEQ ID:37229, to the nucleotide sequence of VGAM2460 RNA, herein designated VGAM RNA, also designated SEQ ID:5171.

Another function of VGAM2460 is therefore inhibition of KIAA1944 (Accession XM_062545). Accordingly, utilities of VGAM2460 include diagnosis, prevention and treatment of diseases and clinical conditions associated with KIAA1944. LOC152579 (Accession XM_087489) is another VGAM2460 host target gene. LOC152579 BINDING SITE is HOST TARGET binding site found in the 3' untranslated region of mRNA encoded by LOC152579, corresponding to a HOST TARGET binding site such as BINDING SITE I, BINDING SITE II or BINDING SITE III. Table 2 illustrates the complementarity of the nucleotide sequences of LOC152579 BINDING SITE, designated SEQ ID:39290, to the nucleotide sequence of VGAM2460 RNA, herein designated VGAM RNA, also designated SEQ ID:5171.

Another function of VGAM2460 is therefore inhibition of LOC152579 (Accession XM_087489). Accordingly, utilities of VGAM2460 include diagnosis, prevention and treatment of diseases and clinical conditions associated with LOC152579. LOC158654 (Accession XM_088632) is another VGAM2460 host target gene. LOC158654 BINDING SITE is HOST TARGET binding site found in the 3' untranslated region of mRNA encoded by LOC158654, corresponding to a HOST TARGET binding site such as BINDING SITE I, BINDING SITE II or BINDING SITE III. Table 2 illustrates the complementarity of the nucleotide sequences of LOC158654 BINDING SITE, designated SEQ ID:39876, to the nucleotide sequence of VGAM2460 RNA, herein designated VGAM RNA, also designated SEQ ID:5171.

Another function of VGAM2460 is therefore inhibition of LOC158654 (Accession XM_088632). Accordingly, utilities of VGAM2460 include diagnosis, prevention and treatment of diseases and clinical conditions associated with LOC158654. LOC200448 (Accession XM_114234) is another VGAM2460 host target gene. LOC200448 BINDING SITE is HOST TARGET binding site found in the 5' untranslated region of mRNA encoded by LOC200448, corresponding to a HOST TARGET binding site such as BINDING SITE I, BINDING SITE II or BINDING SITE III. Table 2 illustrates the complementarity of the nucleotide sequences of LOC200448 BINDING SITE, designated SEQ ID:42816, to the nucleotide sequence of VGAM2460 RNA, herein designated VGAM RNA, also designated SEQ ID:5171.

Another function of VGAM2460 is therefore inhibition of LOC200448 (Accession XM_114234). Accordingly, utilities of VGAM2460 include diagnosis, prevention and treatment of diseases and clinical conditions associated with LOC200448. LOC222166 (Accession XM_168425) is another VGAM2460 host target gene. LOC222166 BINDING SITE is HOST TARGET binding site found in the 3' untranslated region of mRNA encoded by LOC222166, corresponding to a HOST TARGET binding site such as BINDING SITE I, BINDING SITE II or BINDING SITE III. Table 2 illustrates the complementarity of the nucleotide sequences of LOC222166 BINDING SITE, designated SEQ ID:45150, to the nucleotide sequence of VGAM2460 RNA, herein designated VGAM RNA, also designated SEQ ID:5171.

Another function of VGAM2460 is therefore inhibition of LOC222166 (Accession XM_168425). Accordingly, utilities of VGAM2460 include diagnosis, prevention and treatment of diseases and clinical conditions associated with LOC222166. FIG. 1 further provides a conceptual description of a novel bioinformatically detected viral gene of the present invention, referred to here as Viral Genomic Address Messenger 2461 (VGAM2461) viral gene, which modulates expression of respective host target genes thereof, the function and utility of which host target genes is known in the art.

VGAM2461 is a novel bioinformatically detected regulatory, non protein coding, viral micro RNA (miRNA) gene. The method by which VGAM2461 was detected is described hereinabove with reference to FIGS. 1-8.

VGAM2461 gene, herein designated VGAM GENE, is a viral gene contained in the genome of Mouse Cytomegalovirus 1. VGAM2461 host target gene, herein designated VGAM HOST TARGET GENE, is a human gene contained in the human genome.

VGAM2461 gene encodes a VGAM2461 precursor RNA, herein designated VGAM PRECURSOR RNA. Similar to other miRNA genes, and unlike most ordinary genes, VGAM2461 precursor RNA does not encode a protein. A nucleotide sequence identical or highly similar to the nucleotide sequence of VGAM2461 precursor RNA is designated SEQ ID:2447, and is provided hereinbelow with reference to the sequence listing part. Nucleotide sequence SEQ ID:2447 is located at position 219567 relative to the genome of Mouse Cytomegalovirus 1.

VGAM2461 precursor RNA folds onto itself, forming VGAM2461 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2461 folded precursor RNA into VGAM2461 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2461 RNA is designated SEQ ID:5172, and is provided hereinbelow with reference to the sequence listing part.

VGAM2461 host target gene, herein designated VGAM HOST TARGET GENE, encodes a corresponding messenger RNA, VGAM2461 host target RNA, herein designated VGAM HOST TARGET RNA. VGAM2461 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2461 RNA, herein designated VGAM RNA, binds complementarily to one or more host target binding sites located in untranslated regions of VGAM2461 host target RNA, herein designated VGAM HOST TARGET RNA. This complementary binding is due to the fact that the nucleotide sequence of VGAM2461 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2461 RNA, herein designated VGAM RNA, may have a different number of host target binding sites in untranslated regions of a VGAM2461 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2461 RNA, herein designated VGAM RNA, to host target binding sites on VGAM2461 host target RNA, herein designated VGAM HOST TARGET RNA, such as BINDING SITE I, BINDING SITE II and BINDING SITE III, inhibits translation of VGAM2461 host target RNA into VGAM2461 host target protein, herein designated VGAM HOST TARGET PROTEIN. VGAM host target protein is therefore outlined by a broken line.

It is appreciated that VGAM2461 host target gene, herein designated VGAM HOST TARGET GENE, in fact represents a plurality of VGAM2461 host target genes. The mRNA of each one of this plurality of VGAM2461 host target genes comprises one or more host target binding sites, each having a nucleotide sequence which is at least partly complementary to VGAM2461 RNA, herein designated VGAM RNA, and which when bound by VGAM2461 RNA causes inhibition of translation of respective one or more VGAM2461 host target proteins.

It is further appreciated by one skilled in the art that the mode of translational inhibition illustrated by FIG. 1 with specific reference to translational inhibition exerted by VGAM2461 gene, herein designated VGAM GENE, on one or more VGAM2461 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2461 is inhibition of expression of host target genes, as part of a novel viral mechanism of attacking a host. Accordingly, utilities of VGAM2461 include diagnosis, prevention and treatment of viral infection by Mouse Cytomegalovirus 1. Specific functions, and accordingly utilities, of VGAM2461 correlate with, and may be deduced from, the identity of the host target genes which VGAM2461 binds and inhibits, and the function of these host target genes, as elaborated hereinbelow.

Nucleotide sequences of the VGAM2461 precursor RNA, herein designated VGAM PRECURSOR RNA, and of the 'diced' VGAM2461 RNA, herein designated VGAM RNA, and a schematic representation of the secondary folding of VGAM2461 folded precursor RNA, herein designated VGAM FOLDED PRECURSOR RNA, of VGAM2461 are further described hereinbelow with reference to Table 1.

Nucleotide sequences of host target binding sites, such as BINDING SITE-I, BINDING SITE-II and BINDING SITE-III of FIG. 1, found on VGAM2461 host target RNA, and schematic representation of the complementarity of each of these host target binding sites to VGAM2461 RNA, herein designated VGAM RNA, are described hereinbelow with reference to Table 2.

As mentioned hereinabove with reference to FIG. 1, a function of VGAM2461 gene, herein designated VGAM is inhibition of expression of VGAM2461 target genes. It is appreciated that specific functions, and accordingly utilities, of VGAM2461 correlate with, and may be deduced from, the identity of the target genes which VGAM2461 binds and inhibits, and the function of these target genes, as elaborated hereinbelow.

Cyclin-dependent Kinase 2 (CDK2, Accession NM_001798) is a VGAM2461 host target gene. CDK2 BINDING SITE is HOST TARGET binding site found in the 3' untranslated region of mRNA encoded by CDK2, corresponding to a HOST TARGET binding site such as BINDING SITE I, BINDING SITE II or BINDING SITE III. Table 2 illustrates the complementarity of the nucleotide sequences of CDK2 BINDING SITE, designated SEQ ID:7552, to the nucleotide sequence of VGAM2461 RNA, herein designated VGAM RNA, also designated SEQ ID:5172.

A function of VGAM2461 is therefore inhibition of Cyclin-dependent Kinase 2 (CDK2, Accession NM_001798), a gene which plays a unique role in cell cycle regulation of vertebrate cells. Accordingly, utilities of VGAM2461 include diagnosis, prevention and treatment of diseases and clinical conditions associated with CDK2. The function of CDK2 and its association with various diseases and clinical conditions, has been established by previous studies, as described hereinabove with reference to VGAM1467. Cytochrome P450, Subfamily VIIIB (sterol 12-alpha-hydroxylase), Polypeptide 1 (CYP8B1, Accession NM_004391) is another VGAM2461 host target gene. CYP8B1 BINDING SITE is HOST TARGET binding site found in the 3' untranslated region of mRNA encoded by CYP8B1, corresponding to a HOST TARGET binding site such as BINDING SITE I, BINDING SITE II or BINDING SITE III. Table 2 illustrates the complementarity of the nucleotide sequences of CYP8B1 BINDING SITE, designated SEQ ID:10625, to the nucleotide sequence of VGAM2461 RNA, herein designated VGAM RNA, also designated SEQ ID:5172.

Another function of VGAM2461 is therefore inhibition of Cytochrome P450, Subfamily VIIIB (sterol 12-alpha-hydroxylase), Polypeptide 1 (CYP8B1, Accession NM_004391), a gene which functions in bile acid biosynthesis. Accordingly, utilities of VGAM2461 include diagnosis, prevention and treatment of diseases and clinical conditions associated with CYP8B1. The function of CYP8B1 and its association with various diseases and clinical conditions, has been established by previous studies, as described hereinabove with reference to VGAM923. High-mobility Group Nucleosomal Binding Domain 2 (HMGN2, Accession NM_005517) is another VGAM2461 host target gene. HMGN2 BINDING SITE is HOST TARGET binding site found in the 3' untranslated region of mRNA encoded by HMGN2, corresponding to a HOST TARGET binding site such as BINDING SITE I, BINDING SITE II or BINDING SITE III. Table 2 illustrates the complementarity of the nucleotide sequences of HMGN2 BINDING SITE, designated SEQ ID:12040, to the nucleotide sequence of VGAM2461 RNA, herein designated VGAM RNA, also designated SEQ ID:5172.

Another function of VGAM2461 is therefore inhibition of High-mobility Group Nucleosomal Binding Domain 2 (HMGN2, Accession NM_005517), a gene which binds HMG proteins and may confer specific conformations to transcriptionally active regions of chromatin. Accordingly, utilities of VGAM2461 include diagnosis, prevention and treatment of diseases and clinical conditions associated with HMGN2. The function of HMGN2 has been established by previous studies. Chromosomal proteins HMG-17 and HMG-14 are among the most abundant, ubiquitous, and evolutionarily conserved nonhistone proteins found in the nuclei of higher eukaryotes. The large number of retropseudogenes are scattered over several chromosomes. Landsman and Bustin (1986) showed that the nonhistone chromosomal proteins HMG-14 (OMIM Ref. No. 163920) and HMG-17 are encoded by distinct genes, each of which is part of a separate multigene family. These families may have evolved independently from similar genetic elements or from a shared ancestral gene in which the nucleotide sequence coding for the DNA-binding domain of the protein is the most conserved region. The structural differences between the molecules and the differences in their DNA-binding domains suggest that the proteins may be involved in distinguishable cellular functions. They may confer specific conformations to transcriptionally active regions of chromatin. (HMG stands for 'high mobility group.') Landsman and Bustin (1986) and Landsman et al. (1986) isolated and sequenced full-length cDNAs for human HMG-14 and HMG-17. The sequences indicate that these are both functional genes. Porkka et al. (2002) reported a cDNA that encodes a fragment of HMG17 (referred to as HMGN2 by them), a highly conserved nucleosomal protein thought to be involved in unfolding higher-order chromatin structure and facilitating the transcriptional activation of mammalian genes (Bustin, 1999). Porkka et al. (2002) derived a 31-amino acid synthetic peptide from this HMG17 fragment which, when injected intravenously, accumulates in the nuclei of tumor endothelial cells and tumor cells, carrying a payload to a tumor and into the cell nuclei in the tumor. They suggested that the peptide may be suitable for targeting cytotoxic drugs and gene therapy vectors into tumors.

Full details of the abovementioned studies are described in the following publications, the disclosure of which are hereby incorporated by reference:

Landsman, D.; Bustin, M.: Chromosomal proteins HMG-14 and HMG-17: distinct multigene families coding for similar types of transcripts. J. Biol. Chem. 261:16087-16091, 1986; and Porkka, K.; Laakkonen, P.; Hoffman, J. A.; Bernasconi, M.; Ruoslahti, E.: A fragment of the HMGN2 protein homes to the nuclei of tumor cells and tumor endothelial cells in vivo. Proc. N.

Further studies establishing the function and utilities of HMGN2 are found in John Hopkins OMIM database record ID 163910, and in sited publications numbered 3011-3018 listed in the bibliography section hereinbelow, which are also hereby incorporated by reference. RAD1 Homolog (S. pombe) (RAD1, Accession NM_133377) is another VGAM2461 host target gene. RAD1 BINDING SITE is HOST TARGET binding site found in the 5' untranslated region of mRNA encoded by RAD1, corresponding to a HOST TARGET binding site such as BINDING SITE I, BINDING SITE II or BINDING SITE III. Table 2 illustrates the complementarity of the nucleotide sequences of RAD1 BINDING SITE, designated SEQ ID:28500, to the nucleotide sequence of VGAM2461 RNA, herein designated VGAM RNA, also designated SEQ ID:5172.

Another function of VGAM2461 is therefore inhibition of RAD1 Homolog (S. pombe) (RAD1, Accession NM_133377), a gene which has important roles in DNA damage-activated mitotic and meiotic cell cycle checkpoints. Accordingly, utilities of VGAM2461 include diagnosis, prevention and treatment of diseases and clinical conditions associated with RAD1. The function of RAD1 and its association with various diseases and clinical conditions, has been established by previous studies, as described hereinabove with reference to VGAM922. RNA (guanine-7-) Methyltransferase (RNMT, Accession NM_003799) is another VGAM2461 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9888, to the nucleotide sequence of VGAM2461 RNA, herein designated VGAM RNA, also designated SEQ ID:5172.

Another function of VGAM2461 is therefore inhibition of RNA (guanine-7-) Methyltransferase (RNMT, Accession NM_003799), a gene which catalyzes the methylation of GpppN- at the guanine N7 position. Accordingly, utilities of VGAM2461 include diagnosis, prevention and treatment of diseases and clinical conditions associated with RNMT. The function of RNMT and its association with various diseases and clinical conditions, has been established by previous studies, as described hereinabove with reference to VGAM178. WW45 (Accession NM_021818) is another VGAM2461 host target gene. WW45 BINDING SITE is HOST TARGET binding site found in the 3' untranslated region of mRNA encoded by WW45, corresponding to a HOST TARGET binding site such as BINDING SITE I, BINDING SITE II or BINDING SITE III. Table 2 illustrates the complementarity of the nucleotide sequences of WW45 BINDING SITE, designated SEQ ID:22397, to the nucleotide sequence of VGAM2461 RNA, herein designated VGAM RNA, also designated SEQ ID:5172.

Another function of VGAM2461 is therefore inhibition of WW45 (Accession NM_021818), a gene which is required for ubiquitination and therefore degradation of several cell surface proteins like gap1, fur4, mal61 and ste2. also acts on rbp1. Accordingly, utilities of VGAM2461 include diagnosis, prevention and treatment of diseases and clinical conditions associated with WW45. The function of WW45 and its association with various diseases and clinical conditions, has been established by previous studies, as described hereinabove with reference to VGAM1646. CXYorf1 (Accession XM_088704) is another VGAM2461 host target gene. CXYorf1 BINDING SITE is HOST TARGET binding site found in the 3' untranslated region of mRNA encoded by CXYorf1, corresponding to a HOST TARGET binding site such as BINDING SITE I, BINDING SITE II or BINDING SITE III. Table 2 illustrates the complementarity of the nucleotide sequences of CXYorf1 BINDING SITE, designated SEQ ID:39910, to the nucleotide sequence of VGAM2461 RNA, herein designated VGAM RNA, also designated SEQ ID:5172.

Another function of VGAM2461 is therefore inhibition of CXYorf1 (Accession XM_088704). Accordingly, utilities of VGAM2461 include diagnosis, prevention and treatment of diseases and clinical conditions associated with CXYorf1. KIAA1393 (Accession XM_050793) is another VGAM2461 host target gene. KIAA1393 BINDING SITE is HOST TARGET binding site found in the 3' untranslated region of mRNA encoded by KIAA1393, corresponding to a HOST TARGET binding site such as BINDING SITE I, BINDING SITE II or BINDING SITE III. Table 2 illustrates the complementarity of the nucleotide sequences of KIAA1393 BINDING SITE, designated SEQ ID:35684, to the nucleotide sequence of VGAM2461 RNA, herein designated VGAM RNA, also designated SEQ ID:5172.

Another function of VGAM2461 is therefore inhibition of KIAA1393 (Accession XM_050793). Accordingly, utilities of VGAM2461 include diagnosis, prevention and treatment of diseases and clinical conditions associated with KIAA1393. PRO0902 (Accession NM_053057) is another VGAM2461 host target gene. PRO0902 BINDING SITE is HOST TARGET binding site found in the 5' untranslated region of mRNA encoded by PRO0902, corresponding to a HOST TARGET binding site such as BINDING SITE I, BINDING SITE II or BINDING SITE III. Table 2 illustrates the complementarity of the nucleotide sequences of PRO0902 BINDING SITE, designated SEQ ID:27606, to the nucleotide sequence of VGAM2461 RNA, herein designated VGAM RNA, also designated SEQ ID:5172.

Another function of VGAM2461 is therefore inhibition of PRO0902 (Accession NM_053057). Accordingly, utilities of VGAM2461 include diagnosis, prevention and treatment of diseases and clinical conditions associated with PRO0902. TU3A (Accession NM_007177) is another VGAM2461 host target gene. TU3A BINDING SITE is HOST TARGET binding site found in the 5' untranslated region of mRNA encoded by TU3A, corresponding to a HOST TARGET binding site such as BINDING SITE I, BINDING SITE II or BINDING SITE III. Table 2 illustrates the complementarity of the nucleotide sequences of TU3A BINDING SITE, designated SEQ ID:14034, to the nucleotide sequence of VGAM2461 RNA, herein designated VGAM RNA, also designated SEQ ID:5172.

Another function of VGAM2461 is therefore inhibition of TU3A (Accession NM_007177). Accordingly, utilities of VGAM2461 include diagnosis, prevention and treatment of diseases and clinical conditions associated with TU3A. LOC152267 (Accession XM_017070) is another VGAM2461 host target gene. LOC152267 BINDING SITE is HOST TARGET binding site found in the 3' untranslated region of mRNA encoded by LOC152267, corresponding to a HOST TARGET binding site such as BINDING SITE I, BINDING SITE II or BINDING SITE III. Table 2 illustrates the complementarity of the nucleotide sequences of LOC152267 BINDING SITE, designated SEQ ID:30294, to the nucleotide sequence of VGAM2461 RNA, herein designated VGAM RNA, also designated SEQ ID:5172.

Another function of VGAM2461 is therefore inhibition of LOC152267 (Accession XM_017070). Accordingly, utilities of VGAM2461 include diagnosis, prevention and treatment of diseases and clinical conditions associated with LOC152267. LOC200093 (Accession XM_032184) is another VGAM2461 host target gene. LOC200093 BINDING SITE is HOST TARGET binding site found in the 3' untranslated region of mRNA encoded by LOC200093, corresponding to a HOST TARGET binding site such as BINDING SITE I, BINDING SITE II or BINDING SITE III. Table 2 illustrates the complementarity of the nucleotide sequences of LOC200093 BINDING SITE, designated SEQ ID:31602, to the nucleotide sequence of VGAM2461 RNA, herein designated VGAM RNA, also designated SEQ ID:5172.

Another function of VGAM2461 is therefore inhibition of LOC200093 (Accession XM_032184). Accordingly, utilities of VGAM2461 include diagnosis, prevention and treatment of diseases and clinical conditions associated with LOC200093. LOC204084 (Accession XM_115181) is another VGAM2461 host target gene. LOC204084 BINDING SITE is HOST TARGET binding site found in the 3' untranslated region of mRNA encoded by LOC204084, corresponding to a HOST TARGET binding site such as BINDING SITE I, BINDING SITE II or BINDING SITE III. Table 2 illustrates the complementarity of the nucleotide sequences of LOC204084 BINDING SITE, designated SEQ ID:43086, to the nucleotide sequence of VGAM2461 RNA, herein designated VGAM RNA, also designated SEQ ID:5172.

Another function of VGAM2461 is therefore inhibition of LOC204084 (Accession XM_115181). Accordingly, utilities of VGAM2461 include diagnosis, prevention and treatment of diseases and clinical conditions associated with LOC204084. LOC221463 (Accession XM_166374) is another VGAM2461 host target gene. LOC221463 BINDING SITE is HOST TARGET binding site found in the 3' untranslated region of mRNA encoded by LOC221463, corresponding to a HOST TARGET binding site such as BINDING SITE I, BINDING SITE II or BINDING SITE III. Table 2 illustrates the complementarity of the nucleotide sequences of LOC221463 BINDING SITE, designated SEQ ID:44202, to the nucleotide sequence of VGAM2461 RNA, herein designated VGAM RNA, also designated SEQ ID:5172.

Another function of VGAM2461 is therefore inhibition of LOC221463 (Accession XM_166374). Accordingly, utilities of VGAM2461 include diagnosis, prevention and treatment of diseases and clinical conditions associated with LOC221463. LOC91040 (Accession XM_035641) is another VGAM2461 host target gene. LOC91040 BINDING SITE is HOST TARGET binding site found in the 3' untranslated region of mRNA encoded by LOC91040, corresponding to a HOST TARGET binding site such as BINDING SITE I, BINDING SITE II or BINDING SITE III. Table 2 illustrates the complementarity of the nucleotide sequences of LOC91040 BINDING SITE, designated SEQ ID:32319, to the nucleotide sequence of VGAM2461 RNA, herein designated VGAM RNA, also designated SEQ ID:5172.

Another function of VGAM2461 is therefore inhibition of LOC91040 (Accession XM_035641). Accordingly, utilities of VGAM2461 include diagnosis, prevention and treatment of diseases and clinical conditions associated with LOC91040. FIG. 1 further provides a conceptual description of a novel bioinformatically detected viral gene of the present invention, referred to here as Viral Genomic Address Messenger 2462 (VGAM2462) viral gene, which modulates expression of respective host target genes thereof, the function and utility of which host target genes is known in the art.

VGAM2462 is a novel bioinformatically detected regulatory, non protein coding, viral micro RNA (miRNA) gene. The method by which VGAM2462 was detected is described hereinabove with reference to FIGS. 1-8.

VGAM2462 gene, herein designated VGAM GENE, is a viral gene contained in the genome of Mouse Cytomegalovirus 1. VGAM2462 host target gene, herein designated VGAM HOST TARGET GENE, is a human gene contained in the human genome.

VGAM2462 gene encodes a VGAM2462 precursor RNA, herein designated VGAM PRECURSOR RNA. Similar to other miRNA genes, and unlike most ordinary genes, VGAM2462 precursor RNA does not encode a protein. A nucleotide sequence identical or highly similar to the nucleotide sequence of VGAM2462 precursor RNA is designated SEQ ID:2448, and is provided hereinbelow with reference to the sequence listing part. Nucleotide sequence SEQ ID:2448 is located at position 164 relative to the genome of Mouse Cytomegalovirus 1.

VGAM2462 precursor RNA folds onto itself, forming VGAM2462 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2462 folded precursor RNA into VGAM2462 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM2462 RNA is designated SEQ ID:5173, and is provided hereinbelow with reference to the sequence listing part.

VGAM2462 host target gene, herein designated VGAM HOST TARGET GENE, encodes a corresponding messenger RNA, VGAM2462 host target RNA, herein designated VGAM HOST TARGET RNA. VGAM2462 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2462 RNA, herein designated VGAM RNA, binds complementarily to one or more host target binding sites located in untranslated regions of VGAM2462 host target RNA, herein designated VGAM HOST TARGET RNA. This complementary binding is due to the fact that the nucleotide sequence of VGAM2462 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2462 RNA, herein designated VGAM RNA, may have a different number of host target binding sites in untranslated regions of a VGAM2462 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2462 RNA, herein designated VGAM RNA, to host target binding sites on VGAM2462 host target RNA, herein designated VGAM HOST TARGET RNA, such as BINDING SITE I, BINDING SITE II and BINDING SITE III, inhibits translation of VGAM2462 host target RNA into VGAM2462 host target protein, herein designated VGAM HOST TARGET PROTEIN. VGAM host target protein is therefore outlined by a broken line.

It is appreciated that VGAM2462 host target gene, herein designated VGAM HOST TARGET GENE, in fact represents a plurality of VGAM2462 host target genes. The mRNA of each one of this plurality of VGAM2462 host target genes comprises one or more host target binding sites, each having a nucleotide sequence which is at least partly complementary to VGAM2462 RNA, herein designated VGAM RNA, and which when bound by VGAM2462 RNA causes inhibition of translation of respective one or more VGAM2462 host target proteins.

It is further appreciated by one skilled in the art that the mode of translational inhibition illustrated by FIG. 1 with specific reference to translational inhibition exerted by VGAM2462 gene, herein designated VGAM GENE, on one or more VGAM2462 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2462 is inhibition of expression of host target genes, as part of a novel viral mechanism of attacking a host. Accordingly, utilities of VGAM2462 include diagnosis, prevention and treatment of viral infection by Mouse Cytomegalovirus 1. Specific functions, and accordingly utilities, of VGAM2462 correlate with, and may be deduced from, the identity of the host target genes which VGAM2462 binds and inhibits, and the function of these host target genes, as elaborated hereinbelow.

Nucleotide sequences of the VGAM2462 precursor RNA, herein designated VGAM PRECURSOR RNA, and of the 'diced' VGAM2462 RNA, herein designated VGAM RNA, and a schematic representation of the secondary folding of VGAM2462 folded precursor RNA, herein designated VGAM FOLDED PRECURSOR RNA, of VGAM2462 are further described hereinbelow with reference to Table 1.

Nucleotide sequences of host target binding sites, such as BINDING SITE-I, BINDING SITE-II and BINDING SITE-III of FIG. 1, found on VGAM2462 host target RNA, and schematic representation of the complementarity of each of these host target binding sites to VGAM2462 RNA, herein designated VGAM RNA, are described hereinbelow with reference to Table 2.

As mentioned hereinabove with reference to FIG. 1, a function of VGAM2462 gene, herein designated VGAM is inhibition of expression of VGAM2462 target genes. It is appreciated that specific functions, and accordingly utilities, of VGAM2462 correlate with, and may be deduced from, the identity of the target genes which VGAM2462 binds and inhibits, and the function of these target genes, as elaborated hereinbelow.

CARPX (Accession NM_020178) is a VGAM2462 host target gene. CARPX BINDING SITE is HOST TARGET binding site found in the 5' untranslated region of mRNA encoded by CARPX, corresponding to a HOST TARGET binding site such as BINDING SITE I, BINDING SITE II or BINDING SITE III. Table 2 illustrates the complementarity of the nucleotide sequences of CARPX BINDING SITE, designated SEQ ID:21397, to the nucleotide sequence of VGAM2462 RNA, herein designated VGAM RNA, also designated SEQ ID:5173.

A function of VGAM2462 is therefore inhibition of CARPX (Accession NM_020178), a gene which is alpha-carbonic anhydrases-related protein. Accordingly, utilities of VGAM2462 include diagnosis, prevention and treatment of diseases and clinical conditions associated with CARPX. The function of CARPX and its association with various diseases and clinical conditions, has been established by previous studies, as described hereinabove with reference to VGAM904. Neural Retina Leucine Zipper (NRL, Accession NM_006177) is another VGAM2462 host target gene. NRL BINDING SITE is HOST TARGET binding site found in the 3" untranslated region of mRNA encoded by NRL, corresponding to a HOST TARGET binding site such as BINDING SITE I, BINDING SITE II or BINDING SITE III. Table 2 illustrates the complementarity of the nucleotide sequences of NRL BINDING SITE, designated SEQ ID:12837, to the nucleotide sequence of VGAM2462 RNA, herein designated VGAM RNA, also designated SEQ ID:5173.

Another function of VGAM2462 is therefore inhibition of Neural Retina Leucine Zipper (NRL, Accession NM_006177), a gene which has a basic motif and a leucine zipper domain similar to jun and fos. Accordingly, utilities of VGAM2462 include diagnosis, prevention and treatment of diseases and clinical conditions associated with NRL. The function of NRL and its association with various diseases and clinical conditions, has been established by previous studies, as described hereinabove with reference to VGAM419. Retinoic Acid Receptor, Beta (RARB, Accession NM_016152) is another VGAM2462 host target gene. RARB BINDING SITE1 and RARB BINDING SITE2 are HOST TARGET binding sites found in untranslated regions of mRNA encoded by RARB, corresponding to HOST TARGET binding sites such as BINDING SITE I, BINDING SITE II or BINDING SITE III. Table 2 illustrates the complementarity of the nucleotide sequences of RARB BINDING SITE1 and RARB BINDING SITE2, designated SEQ ID:18235 and SEQ ID:6691 respectively, to the nucleotide sequence of VGAM2462 RNA, herein designated VGAM RNA, also designated SEQ ID:5173.

Another function of VGAM2462 is therefore inhibition of Retinoic Acid Receptor, Beta (RARB, Accession NM_016152), a gene which is one member of the steroid/thyroid hormone receptor family of ligand-activated transcription factors. Accordingly, utilities of VGAM2462 include diagnosis, prevention and treatment of diseases and clinical conditions associated with RARB. The function of RARB and its association with various diseases and clinical conditions, has been established by previous studies, as described hereinabove with reference to VGAM179. TEM7 (Accession NM_020405) is another VGAM2462 host target gene. TEM7 BINDING SITE is HOST TARGET binding site found in the 3' untranslated region of mRNA encoded by TEM7, corresponding to a HOST TARGET binding site such as BINDING SITE I, BINDING SITE II or BINDING SITE III. Table 2 illustrates the complementarity of the nucleotide sequences of TEM7 BINDING SITE, designated SEQ ID:21673, to the nucleotide sequence of VGAM2462 RNA, herein designated VGAM RNA, also designated SEQ ID:5173.

Another function of VGAM2462 is therefore inhibition of TEM7 (Accession NM_020405), a gene which involves in angiogenesis. Accordingly, utilities of VGAM2462 include diagnosis, prevention and treatment of diseases and clinical conditions associated with TEM7. The function of TEM7 and its association with various diseases and clinical conditions, has been established by previous studies, as described hereinabove with reference to VGAM23. KIAA1340 (Accession XM_044836) is another VGAM2462 host target gene. KIAA1340 BINDING SITE is HOST TARGET binding site found in the 3' untranslated region of mRNA encoded by KIAA1340, corresponding to a HOST TARGET binding site such as BINDING SITE I, BINDING SITE II or BINDING SITE III. Table 2 illustrates the complementarity of the nucleotide sequences of KIAA1340 BINDING SITE, designated SEQ ID:34299, to the nucleotide sequence of VGAM2462 RNA, herein designated VGAM RNA, also designated SEQ ID:5173.

Another function of VGAM2462 is therefore inhibition of KIAA1340 (Accession XM_044836). Accordingly, utilities of VGAM2462 include diagnosis, prevention and treatment of diseases and clinical conditions associated with KIAA1340. PRO1331 (Accession NM_030778) is another VGAM2462 host target gene. PRO1331 BINDING SITE is HOST TARGET binding site found in the 5' untranslated region of mRNA encoded by PRO1331, corresponding to a HOST TARGET binding site such as BINDING SITE I, BINDING SITE II or BINDING SITE III. Table 2 illustrates the complementarity of the nucleotide sequences of PRO1331 BINDING SITE, designated SEQ ID:25066, to the nucleotide sequence of VGAM2462 RNA, herein designated VGAM RNA, also designated SEQ ID:5173.

Another function of VGAM2462 is therefore inhibition of PRO1331 (Accession NM_030778). Accordingly, utilities of VGAM2462 include diagnosis, prevention and treatment of diseases and clinical conditions associated with PRO1331. LOC201696 (Accession XM_032269) is another VGAM2462 host target gene. LOC201696 BINDING SITE is HOST TARGET binding site found in the 3' untranslated region of mRNA encoded by LOC201696, corresponding to a HOST TARGET binding site such as BINDING SITE I, BINDING SITE II or BINDING SITE III. Table 2 illustrates the complementarity of the nucleotide sequences of LOC201696 BINDING SITE, designated SEQ ID:31625, to the nucleotide sequence of VGAM2462 RNA, herein designated VGAM RNA, also designated SEQ ID:5173.

Another function of VGAM2462 is therefore inhibition of LOC201696 (Accession XM_032269). Accordingly, utilities of VGAM2462 include diagnosis, prevention and treatment of diseases and clinical conditions associated with LOC201696. LOC221092 (Accession XM_167749) is another VGAM2462 host target gene. LOC221092 BINDING SITE is HOST TARGET binding site found in the 5' untranslated region of mRNA encoded by LOC221092, corresponding to a HOST TARGET binding site such as BINDING SITE I, BINDING SITE II or BINDING SITE III. Table 2 illustrates the complementarity of the nucleotide sequences of LOC221092 BINDING SITE, designated SEQ ID:44774, to the nucleotide sequence of VGAM2462 RNA, herein designated VGAM RNA, also designated SEQ ID:5173.

Another function of VGAM2462 is therefore inhibition of LOC221092 (Accession XM_167749). Accordingly, utilities of VGAM2462 include diagnosis, prevention and treatment of diseases and clinical conditions associated with LOC221092. FIG. 1 further provides a conceptual description of a novel bioinformatically detected viral gene of the present invention, referred to here as Viral Genomic Address Messenger 2463 (VGAM2463) viral gene, which modulates expression of respective host target genes thereof, the function and utility of which host target genes is known in the art.

VGAM2463 is a novel bioinformatically detected regulatory, non protein coding, viral micro RNA (miRNA) gene. The method by which VGAM2463 was detected is described hereinabove with reference to FIGS. 1-8.

VGAM2463 gene, herein designated VGAM GENE, is a viral gene contained in the genome of Mouse Cytomegalovirus 1. VGAM2463 host target gene, herein designated VGAM HOST TARGET GENE, is a human gene contained in the human genome.

VGAM2463 gene encodes a VGAM2463 precursor RNA, herein designated VGAM PRECURSOR RNA. Similar to other miRNA genes, and unlike most ordinary genes, VGAM2463 precursor RNA does not encode a protein. A nucleotide sequence identical or highly similar to the nucleotide sequence of VGAM2463 precursor RNA is designated SEQ ID:2449, and is provided hereinbelow with reference to the sequence listing part. Nucleotide sequence SEQ ID:2449 is located at position 225478 relative to the genome of Mouse Cytomegalovirus 1.

VGAM2463 precursor RNA folds onto itself, forming VGAM2463 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2463 folded precursor RNA into VGAM2463 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2463 RNA is designated SEQ ID:5174, and is provided hereinbelow with reference to the sequence listing part.

VGAM2463 host target gene, herein designated VGAM HOST TARGET GENE, encodes a corresponding messenger RNA, VGAM2463 host target RNA, herein designated VGAM HOST TARGET RNA. VGAM2463 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2463 RNA, herein designated VGAM RNA, binds complementarily to one or more host target binding sites located in untranslated regions of VGAM2463 host target RNA, herein designated VGAM HOST TARGET RNA. This complementary binding is due to the fact that the nucleotide sequence of VGAM2463 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2463 RNA, herein designated VGAM RNA, may have a different number of host target binding sites in untranslated regions of a VGAM2463 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2463 RNA, herein designated VGAM RNA, to host target binding sites on VGAM2463 host target RNA, herein designated VGAM HOST TARGET RNA, such as BINDING SITE I, BINDING SITE II and BINDING SITE III, inhibits translation of VGAM2463 host target RNA into VGAM2463 host target protein, herein designated VGAM HOST TARGET PRO- TEIN. VGAM host target protein is therefore outlined by a broken line.

It is appreciated that VGAM2463 host target gene, herein designated VGAM HOST TARGET GENE, in fact represents a plurality of VGAM2463 host target genes. The mRNA of each one of this plurality of VGAM2463 host target genes comprises one or more host target binding sites, each having a nucleotide sequence which is at least partly complementary to VGAM2463 RNA, herein designated VGAM RNA, and which when bound by VGAM2463 RNA causes inhibition of translation of respective one or more VGAM2463 host target proteins.

It is further appreciated by one skilled in the art that the mode of translational inhibition illustrated by FIG. 1 with specific reference to translational inhibition exerted by VGAM2463 gene, herein designated VGAM GENE, on one or more VGAM2463 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2463 is inhibition of expression of host target genes, as part of a novel viral mechanism of attacking a host. Accordingly, utilities of VGAM2463 include diagnosis, prevention and treatment of viral infection by Mouse Cytomegalovirus 1. Specific functions, and accordingly utilities, of VGAM2463 correlate with, and may be deduced from, the identity of the host target genes which VGAM2463 binds and inhibits, and the function of these host target genes, as elaborated hereinbelow.

Nucleotide sequences of the VGAM2463 precursor RNA, herein designated VGAM PRECURSOR RNA, and of the 'diced' VGAM2463 RNA, herein designated VGAM RNA, and a schematic representation of the secondary folding of VGAM2463 folded precursor RNA, herein designated VGAM FOLDED PRECURSOR RNA, of VGAM2463 are further described hereinbelow with reference to Table 1.

Nucleotide sequences of host target binding sites, such as BINDING SITE-I, BINDING SITE-II and BINDING SITE-III of FIG. 1, found on VGAM2463 host target RNA, and schematic representation of the complementarity of each of these host target binding sites to VGAM2463 RNA, herein designated VGAM RNA, are described hereinbelow with reference to Table 2.

As mentioned hereinabove with reference to FIG. 1, a function of VGAM2463 gene, herein designated VGAM is inhibition of expression of VGAM2463 target genes. It is appreciated that specific functions, and accordingly utilities, of VGAM2463 correlate with, and may be deduced from, the identity of the target genes which VGAM2463 binds and inhibits, and the function of these target genes, as elaborated hereinbelow.

Active BCR-related Gene (ABR, Accession NM_001092) is a VGAM2463 host target gene. ABR BINDING SITE1 and ABR BINDING SITE2 are HOST TARGET binding sites found in untranslated regions of mRNA encoded by ABR, corresponding to HOST TARGET binding sites such as BINDING SITE I, BINDING SITE II or BINDING SITE III. Table 2 illustrates the complementarity of the nucleotide sequences of ABR BINDING SITE1 and ABR BINDING SITE2, designated SEQ ID:6750 and SEQ ID:22495 respectively, to the nucleotide sequence of VGAM2463 RNA, herein designated VGAM RNA, also designated SEQ ID:5174.

A function of VGAM2463 is therefore inhibition of Active BCR-related Gene (ABR, Accession NM_001092), a gene which gtpase-activating protein for rac and cdc42. Accordingly, utilities of VGAM2463 include diagnosis, prevention and treatment of diseases and clinical conditions associated with ABR. The function of ABR and its association with various diseases and clinical conditions, has been established by previous studies, as described hereinabove with reference to VGAM489. ADP-ribosylation Factor 3 (ARF3, Accession NM_001659) is another VGAM2463 host target gene. ARF3 BINDING SITE is HOST TARGET binding site found in the 3' untranslated region of mRNA encoded by ARF3, corresponding to a HOST TARGET binding site such as BINDING SITE I, BINDING SITE II or BINDING SITE III. Table 2 illustrates the complementarity of the nucleotide sequences of ARF3 BINDING SITE, designated SEQ ID:7379, to the nucleotide sequence of VGAM2463 RNA, herein designated VGAM RNA, also designated SEQ ID:5174.

Another function of VGAM2463 is therefore inhibition of ADP-ribosylation Factor 3 (ARF3, Accession NM_001659). Accordingly, utilities of VGAM2463 include diagnosis, prevention and treatment of diseases and clinical conditions associated with ARF3. Asialoglycoprotein Receptor 2 (ASGR2, Accession NM_001181) is another VGAM2463 host target gene. ASGR2 BINDING SITE1 through ASGR2 BINDING SITE3 are HOST TARGET binding sites found in untranslated regions of mRNA encoded by ASGR2, corresponding to HOST TARGET binding sites such as BINDING SITE I, BINDING SITE II or BINDING SITE III. Table 2 illustrates the complementarity of the nucleotide sequences of ASGR2 BINDING SITE1 through ASGR2 BINDING SITE3, designated SEQ ID:6852, SEQ ID:28132 and SEQ ID:28131 respectively, to the nucleotide sequence of VGAM2463 RNA, herein designated VGAM RNA, also designated SEQ ID:5174.

Another function of VGAM2463 is therefore inhibition of Asialoglycoprotein Receptor 2 (ASGR2, Accession NM_001181). Accordingly, utilities of VGAM2463 include diagnosis, prevention and treatment of diseases and clinical conditions associated with ASGR2. B-cell CLL/lymphoma 9 (BCL9, Accession NM_004326) is another VGAM2463 host target gene. BCL9 BINDING SITE is HOST TARGET binding site found in the 3' untranslated region of mRNA encoded by BCL9, corresponding to a HOST TARGET binding site such as BINDING SITE I, BINDING SITE II or BINDING SITE III. Table 2 illustrates the complementarity of the nucleotide sequences of BCL9 BINDING SITE, designated SEQ ID:10523, to the nucleotide sequence of VGAM2463 RNA, herein designated VGAM RNA, also designated SEQ ID:5174.

Another function of VGAM2463 is therefore inhibition of B-cell CLL/lymphoma 9 (BCL9, Accession NM_004326), a gene which recruits of PYGO to the nuclear beta-catenin-TCF complex in Wnt/Wingless signaling. Accordingly, utilities of VGAM2463 include diagnosis, prevention and treatment of diseases and clinical conditions associated with BCL9. The function of BCL9 and its association with various diseases and clinical conditions, has been established by previous studies, as described hereinabove with reference to VGAM74. BRIP1 (Accession NM_032043) is another VGAM2463 host target gene. BRIP1 BINDING SITE is HOST TARGET binding site found in the 3' untranslated region of mRNA encoded by BRIP1, corresponding to a HOST TARGET binding site such as BINDING SITE I, BINDING SITE II or BINDING SITE III. Table 2 illustrates the complementarity of the nucleotide sequences of BRIP1 BINDING SITE, designated SEQ ID:25755, to the nucleotide sequence of VGAM2463 RNA, herein designated VGAM RNA, also designated SEQ ID:5174.

Another function of VGAM2463 is therefore inhibition of BRIP1 (Accession NM_032043). Accordingly, utilities of VGAM2463 include diagnosis, prevention and treatment of diseases and clinical conditions associated with BRIP1. Calcium Channel, Voltage-dependent, Gamma Subunit 7 (CACNG7, Accession NM_031896) is another VGAM2463 host target gene. CACNG7 BINDING SITE1 and CACNG7 BINDING SITE2 are HOST TARGET binding sites found in untranslated regions of mRNA encoded by CACNG7, corresponding to HOST TARGET binding sites such as BINDING SITE I, BINDING SITE II or BINDING SITE III. Table 2 illustrates the complementarity of the nucleotide sequences of CACNG7 BINDING SITE1 and CACNG7 BINDING SITE2, designated SEQ ID:25639 and SEQ ID:25640 respectively, to the nucleotide sequence of VGAM2463 RNA, herein designated VGAM RNA, also designated SEQ ID:5174.

Another function of VGAM2463 is therefore inhibition of Calcium Channel, Voltage-dependent, Gamma Subunit 7 (CACNG7, Accession NM_031896), a gene which may stabilize the calcium channel in an inactivated (closed) state. Accordingly, utilities of VGAM2463 include diagnosis, prevention and treatment of diseases and clinical conditions associated with CACNG7. The function of CACNG7 and its association with various diseases and clinical conditions, has been established by previous studies, as described hereinabove with reference to VGAM2228. Cholinergic Receptor, Nicotinic, Alpha Polypeptide 5 (CHRNA5, Accession XM_007577) is another VGAM2463 host target gene. CHRNA5 BINDING SITE is HOST TARGET binding site found in the 5' untranslated region of mRNA encoded by CHRNA5, corresponding to a HOST TARGET binding site such as BINDING SITE I, BINDING SITE II or BINDING SITE III. Table 2 illustrates the complementarity of the nucleotide sequences of CHRNA5 BINDING SITE, designated SEQ ID:30058, to the nucleotide sequence of VGAM2463 RNA, herein designated VGAM RNA, also designated SEQ ID:5174.

Another function of VGAM2463 is therefore inhibition of Cholinergic Receptor, Nicotinic, Alpha Polypeptide 5 (CHRNA5, Accession XM_007577). Accordingly, utilities of VGAM2463 include diagnosis, prevention and treatment of diseases and clinical conditions associated with CHRNA5. Cholinergic Receptor, Nicotinic, Beta Polypeptide 1 (muscle) (CHRNB1, Accession XM_018451) is another VGAM2463 host target gene. CHRNB1 BINDING SITE is HOST TARGET binding site found in the 3' untranslated region of mRNA encoded by CHRNB1, corresponding to a HOST TARGET binding site such as BINDING SITE I, BINDING SITE II or BINDING SITE III. Table 2 illustrates the complementarity of the nucleotide sequences of CHRNB1 BINDING SITE, designated SEQ ID:30359, to the nucleotide sequence of VGAM2463 RNA, herein designated VGAM RNA, also designated SEQ ID:5174.

Another function of VGAM2463 is therefore inhibition of Cholinergic Receptor, Nicotinic, Beta Polypeptide 1 (muscle) (CHRNB1, Accession XM_018451). Accordingly, utilities of VGAM2463 include diagnosis, prevention and treatment of diseases and clinical conditions associated with CHRNB1. Ceroid-lipofuscinosis, Neuronal 6, Late Infantile, Variant (CLN6, Accession NM_017882) is another VGAM2463 host target gene. CLN6 BINDING SITE is HOST TARGET binding site found in the 3' untranslated region of mRNA encoded by CLN6, corresponding to a HOST TARGET binding site such as BINDING SITE I, BINDING SITE II or BINDING SITE III. Table 2 illustrates the complementarity of the nucleotide sequences of CLN6 BINDING SITE, designated SEQ ID:19550, to the nucleotide sequence of VGAM2463 RNA, herein designated VGAM RNA, also designated SEQ ID:5174.

Another function of VGAM2463 is therefore inhibition of Ceroid-lipofuscinosis, Neuronal 6, Late Infantile, Variant (CLN6, Accession NM_017882). Accordingly, utilities of VGAM2463 include diagnosis, prevention and treatment of diseases and clinical conditions associated with CLN6. Collagen, Type I, Alpha 1 (COL1A1, Accession NM_000088) is another VGAM2463 host target gene. COL1A1 BINDING SITE is HOST TARGET binding site found in the 3' untranslated region of mRNA encoded by COL1A1, corresponding to a HOST TARGET binding site such as BINDING SITE I, BINDING SITE II or BINDING SITE III. Table 2 illustrates the complementarity of the nucleotide sequences of COL1A1 BINDING SITE, designated SEQ ID:5538, to the nucleotide sequence of VGAM2463 RNA, herein designated VGAM RNA, also designated SEQ ID:5174.

Another function of VGAM2463 is therefore inhibition of Collagen, Type I, Alpha 1 (COL1A1, Accession NM_000088). Accordingly, utilities of VGAM2463 include diagnosis, prevention and treatment of diseases and clinical conditions associated with COL1A1. Corticotropin Releasing Hormone Receptor 2 (CRHR2, Accession NM_001883) is another VGAM2463 host target gene. CRHR2 BINDING SITE is HOST TARGET binding site found in the 3' untranslated region of mRNA encoded by CRHR2, corresponding to a HOST TARGET binding site such as BINDING SITE I, BINDING SITE II or BINDING SITE III. Table 2 illustrates the complementarity of the nucleotide sequences of CRHR2 BINDING SITE, designated SEQ ID:7612, to the nucleotide sequence of VGAM2463 RNA, herein designated VGAM RNA, also designated SEQ ID:5174.

Another function of VGAM2463 is therefore inhibition of Corticotropin Releasing Hormone Receptor 2 (CRHR2, Accession NM_001883), a gene which is a corticotropin releasing factor receptor type II. Accordingly, utilities of VGAM2463 include diagnosis, prevention and treatment of diseases and clinical conditions associated with CRHR2. The function of CRHR2 and its association with various diseases and clinical conditions, has been established by previous studies, as described hereinabove with reference to VGAM737. Cytochrome B-561 (CYB561, Accession NM_001915) is another VGAM2463 host target gene. CYB561 BINDING SITE is HOST TARGET binding site found in the 5' untranslated region of mRNA encoded by CYB561, corresponding to a HOST TARGET binding site such as BINDING SITE I, BINDING SITE II or BINDING SITE III. Table 2 illustrates the complementarity of the nucleotide sequences of CYB561 BINDING SITE, designated SEQ ID:7630, to the nucleotide sequence of VGAM2463 RNA, herein designated VGAM RNA, also designated SEQ ID:5174.

Another function of VGAM2463 is therefore inhibition of Cytochrome B-561 (CYB561, Accession NM_001915), a gene which is a secretory vesicle-specific electron transport protein. Accordingly, utilities of VGAM2463 include diagnosis, prevention and treatment of diseases and clinical conditions associated with CYB561. The function of CYB561 and its association with various diseases and clinical conditions, has been established by previous studies, as described hereinabove with reference to VGAM1929. Damage-specific DNA Binding Protein 1, 127 kDa (DDB1, Accession NM_001923) is another VGAM2463 host target gene. DDB1 BINDING SITE is HOST TARGET binding site found in the 3' untranslated region of mRNA encoded by DDB1, corresponding to a HOST TARGET binding site such as BINDING SITE I, BINDING SITE II or BINDING SITE III. Table 2 illustrates the complementarity of the nucleotide sequences of DDB1 BINDING SITE, designated SEQ ID:7639, to the nucleotide sequence of VGAM2463 RNA, herein designated VGAM RNA, also designated SEQ ID:5174.

Another function of VGAM2463 is therefore inhibition of Damage-specific DNA Binding Protein 1, 127 kDa (DDB1, Accession NM_001923). Accordingly, utilities of VGAM2463 include diagnosis, prevention and treatment of diseases and clinical conditions associated with DDB1. Dihydrolipoamide S-succinyltransferase (E2 component of 2-oxo-glutarate complex) (DLST, Accession NM_001933) is another VGAM2463 host target gene. DLST BINDING SITE is HOST TARGET binding site found in the 3' untranslated region of mRNA encoded by DLST, corresponding to a HOST TARGET binding site such as BINDING SITE I, BINDING SITE II or BINDING SITE III. Table 2 illustrates the complementarity of the nucleotide sequences of DLST BINDING SITE, designated SEQ ID:7643, to the nucleotide sequence of VGAM2463 RNA, herein designated VGAM RNA, also designated SEQ ID:5174.

Another function of VGAM2463 is therefore inhibition of Dihydrolipoamide S-succinyltransferase (E2 component of 2-oxo-glutarate complex) (DLST, Accession NM_001933), a gene which catalyzes the oxidative decarboxylation of alpha-keto acids. Accordingly, utilities of VGAM2463 include diagnosis, prevention and treatment of diseases and clinical conditions associated with DLST. The function of DLST and its association with various diseases and clinical conditions, has been established by previous studies, as described hereinabove with reference to VGAM656. Ectodermal Dysplasia 1, Anhidrotic (ED1, Accession NM_001399) is another VGAM2463 host target gene. ED1 BINDING SITE is HOST TARGET binding site found in the 5' untranslated region of mRNA encoded by ED1, corresponding to a HOST TARGET binding site such as BINDING SITE I, BINDING SITE II or BINDING SITE III. Table 2 illustrates the complementarity of the nucleotide sequences of ED1 BINDING SITE, designated SEQ ID:7097, to the nucleotide sequence of VGAM2463 RNA, herein designated VGAM RNA, also designated SEQ ID:5174.

Another function of VGAM2463 is therefore inhibition of Ectodermal Dysplasia 1, Anhidrotic (ED1, Accession NM_001399). Accordingly, utilities of VGAM2463 include diagnosis, prevention and treatment of diseases and clinical conditions associated with ED1. EH-domain Containing 3 (EHD3, Accession NM_014600) is another VGAM2463 host target gene. EHD3 BINDING SITE is HOST TARGET binding site found in the 3' untranslated region of mRNA encoded by EHD3, corresponding to a HOST TARGET binding site such as BINDING SITE I, BINDING SITE II or BINDING SITE III. Table 2 illustrates the complementarity of the nucleotide sequences of EHD3 BINDING SITE, designated SEQ ID:15957, to the nucleotide sequence of VGAM2463 RNA, herein designated VGAM RNA, also designated SEQ ID:5174.

Another function of VGAM2463 is therefore inhibition of EH-domain Containing 3 (EHD3, Accession NM_014600). Accordingly, utilities of VGAM2463 include diagnosis, prevention and treatment of diseases and clinical conditions associated with EHD3. Empty Spiracles Homolog 2 (Drosophila) (EMX2, Accession XM_113640) is another VGAM2463 host target gene. EMX2 BINDING SITE is HOST TARGET binding site found in the 5' untranslated region of mRNA encoded by EMX2, corresponding to a HOST TARGET binding site such as BINDING SITE I, BINDING SITE II or BINDING SITE III. Table 2 illustrates the complementarity of the nucleotide sequences of EMX2 BINDING SITE, designated SEQ ID:42316, to the nucleotide sequence of VGAM2463 RNA, herein designated VGAM RNA, also designated SEQ ID:5174.

Another function of VGAM2463 is therefore inhibition of Empty Spiracles Homolog 2 (Drosophila) (EMX2, Accession XM_113640), a gene which may function in combinations with otx1/2 to specify cell fates in the developing central nervous system. Accordingly, utilities of VGAM2463 include diagnosis, prevention and treatment of diseases and clinical conditions associated with EMX2. The function of EMX2 and its association with various diseases and clinical conditions, has been established by previous studies, as described hereinabove with reference to VGAM510. Eyes Absent Homolog 4 (Drosophila) (EYA4, Accession NM_004100) is another VGAM2463 host target gene. EYA4 BINDING SITE is HOST TARGET binding site found in the 5' untranslated region of mRNA encoded by EYA4, corresponding to a HOST TARGET binding site such as BINDING SITE I, BINDING SITE II or BINDING SITE III. Table 2 illustrates the complementarity of the nucleotide sequences of EYA4 BINDING SITE, designated SEQ ID:10309, to the nucleotide sequence of VGAM2463 RNA, herein designated VGAM RNA, also designated SEQ ID:5174.

Another function of VGAM2463 is therefore inhibition of Eyes Absent Homolog 4 (Drosophila) (EYA4, Accession NM_004100), a gene which may be involved in development of the eye (by similarity). Accordingly, utilities of VGAM2463 include diagnosis, prevention and treatment of diseases and clinical conditions associated with EYA4. The function of EYA4 and its association with various diseases and clinical conditions, has been established by previous studies, as described hereinabove with reference to VGAM707. Fanconi Anemia, Complementation Group C (FANCC, Accession XM_047190) is another VGAM2463 host target gene. FANCC BINDING SITE is HOST TARGET binding site found in the 3' untranslated region of mRNA encoded by FANCC, corresponding to a HOST TARGET binding site such as BINDING SITE I, BINDING SITE II or BINDING SITE III. Table 2 illustrates the complementarity of the nucleotide sequences of FANCC BINDING SITE, designated SEQ ID:34906, to the nucleotide sequence of VGAM2463 RNA, herein designated VGAM RNA, also designated SEQ ID:5174.

Another function of VGAM2463 is therefore inhibition of Fanconi Anemia, Complementation Group C (FANCC, Accession XM_047190). Accordingly, utilities of VGAM2463 include diagnosis, prevention and treatment of diseases and clinical conditions associated with FANCC. F-box and Leucine-rich Repeat Protein 4 (FBXL4, Accession NM_012160) is another VGAM2463 host target gene. FBXL4 BINDING SITE is HOST TARGET binding site found in the 5' untranslated region of mRNA encoded by FBXL4, corresponding to a HOST TARGET binding site such as BINDING SITE I, BINDING SITE II or BINDING SITE III. Table 2 illustrates the complementarity of the nucleotide sequences of FBXL4 BINDING SITE, designated SEQ ID:14459, to the nucleotide sequence of VGAM2463 RNA, herein designated VGAM RNA, also designated SEQ ID:5174.

Another function of VGAM2463 is therefore inhibition of F-box and Leucine-rich Repeat Protein 4 (FBXL4, Accession NM_012160), a gene which may degrade regulatory proteins by recruiting them for ubiquitin conjugating enzymes. Accordingly, utilities of VGAM2463 include diagnosis, prevention and treatment of diseases and clinical conditions associated with FBXL4. The function of FBXL4 has been established by previous studies. The F box, named after cyclin F (CCNF; 600227), in which it was originally observed, is an approximately 40-amino acid motif that binds SKP1 (OMIM Ref. No. 601434). F-box proteins are components of modular E3 ubiquitin protein ligases called SCFs (SKP1, OMIM Ref. No. 603134), F-box proteins), which function in phosphorylation-dependent ubiquitination. Using a yeast 2-hybrid screen with SKP1 as bait, followed by searching sequence databases, Winston et al. (1999) and Cenciarelli et al. (1999) identified 33 mammalian and 26 human F-box proteins, respectively. These contained C termini with leucine-rich repeats (FBXLs, e.g., SKP2 (OMIM Ref. No. 601436)), WD40 domains (FBXWs, e.g., BTRCP (OMIM Ref. No. 603482)), or no recognizable motifs (FBXOs, e.g., CCNF). Using RT-PCR analysis, Winston et al. (1999) detected FBXL4 expression in heart, kidney, liver, lung, pancreas, and placenta, but not in skeletal muscle. Immunofluorescence microscopy demonstrated both nuclear and cytoplasmic expression. By searching sequence databases, Ilyin et al. (2000) identified a cDNA encoding FBXL4, which they referred to as FBL5. The deduced 621-amino acid protein contains at least 9 leucine-rich repeats. Based on its inclusion within a mapped clone, Ilyin et al. (2000) mapped the FBXL4 gene to 6q16.1-q16.3.

Full details of the abovementioned studies are described in the following publications, the disclosure of which are hereby incorporated by reference:

Cenciarelli, C.; Chiaur, D. S.; Guardavaccaro, D.; Parks, W.; Vidal, M.; Pagano, M.: Identification of a family of human F-box proteins. Curr. Biol. 9:1177-1179, 1999; and Ilyin, G. P.; Rialland, M.; Pigeon, C.; Guguen-Guillouzo, C.: cDNA cloning and expression analysis of new members of the mammalian F-box protein family. Genomics 67:40-47, 2000.

Further studies establishing the function and utilities of FBXL4 are found in John Hopkins OMIM database record ID 605654, and in sited publications numbered 40 and 8278 listed in the bibliography section hereinbelow, which are also hereby incorporated by reference. Fragile Histidine Triad Gene (FHIT, Accession NM_002012) is another VGAM2463 host target gene. FHIT BINDING SITE is HOST TARGET binding site found in the 5' untranslated region of mRNA encoded by FHIT, corresponding to a HOST TARGET binding site such as BINDING SITE I, BINDING SITE II or BINDING SITE III. Table 2 illustrates the complementarity of the nucleotide sequences of FHIT BINDING SITE, designated SEQ ID:7753, to the nucleotide sequence of VGAM2463 RNA, herein designated VGAM RNA, also designated SEQ ID:5174.

Another function of VGAM2463 is therefore inhibition of Fragile Histidine Triad Gene (FHIT, Accession NM_002012), a gene which cleaves a-5'-ppp-5'a to yield amp and adp. possible tumor suppressor for specific tissues. Accordingly, utilities of VGAM2463 include diagnosis, prevention and treatment of diseases and clinical conditions associated with FHIT. The function of FHIT has been established by previous studies. Cohen et al. (1979) observed a constitutional reciprocal t (3;8) translocation associated with early onset, bilateral, and multifocal clear cell renal carcinoma (OMIM Ref. No. 144700). Wang and Perkins (1984) demonstrated that the site of the break on chromosome 3 is at 3p14.2. Another cytogenetic landmark in the 3p14.2 region is the most common of the constitutive aphidicolin-inducible fragile sites, FRA3B (Markkanen et al., 1982). A 200 to 300 kb region of 3p14.2, including the fragile site locus FRA3B, is homozygously deleted in multiple tumor-derived cell lines. By exon amplification from cosmids covering this deleted region, Ohta et al. (1996) identified a human gene they designated FHIT for 'fragile histidine triad' gene. The FHIT gene, a member of the histidine triad gene family, encodes a protein similar to the aph1 gene in S. pombe. The gene is composed of 10 exons distributed over at least 500 kb, with three 5-prime untranslated exons centromeric to the renal carcinoma-associated 3p14.2 breakpoint, the remaining exons telomeric to this translocation breakpoint, and exon 5 within the homozygously deleted fragile region. Aberrant transcripts of the FHIT locus were found in approximately 50% of esophageal, stomach, and colon carcinomas. Sozzi et al. (1996) analyzed the FHIT gene structure and transcription in a large series of lung cancers of the small cell (SCLC) and nonsmall cell (NSCLC) type. FHIT transcripts from tumors and normal tissues were studied by RT-PCR. In 11 of 14 SCLC tumors, abnormal-sized transcripts were found. Both normal- and abnormal-sized transcripts were present in 9 of these cases. In 18 of 25 NSCLC tumors, abnormal transcripts were found; in these tumors, there were 1 or 2 abnormal-sized bands which were always accompanied by a normal-sized transcript. The authors postulated that the normal-sized transcripts reflected the presence of normal cells within the tumors. Sozzi et al. (1996) reported loss of heterozygosity for microsatellite markers internal to and flanking the FHIT locus. Eleven of 12 informative tumors that exhibited abnormal FHIT transcripts showed allelic loss at one or more of the loci tested. The authors postulated that in these tumors inactivation of the FHIT gene occurred by a mechanism of loss of one allele and altered expression of the remaining allele. They further postulated that loss of function of the FHIT gene could result in the constitutive accumulation of high levels of intracellular diadenosine tetraphosphate and the stimulation of DNA synthesis and proliferation. Sozzi et al. (1996) proposed that breakage in a fragile site-containing gene may occur as a consequence of physical, chemical, and biologic agents. Virgilio et al. (1996) noted that head and neck cancers (HNSCC; 601400) represent 3% of all cancer in Western countries. In some geographic areas such as India, the proportion of cancer represented by these cancers is as high as 45%; 90 to 95% of head and neck cancers are of the squamous cell type. Tobacco and alcohol have been recognized as etiologic factors in these carcinomas. Several regions of loss of heterozygosity (LOH) have been identified in HNSCC. The 9p region presents the highest rate of genetic alteration (75%) and LOH has been related to the CDKN2 (OMIM Ref. No. 600160) tumor suppressor gene. The second most frequent alteration involves 3p (45 to 55%). Virgilio et al. (1996) examined 26 HNSCC cell lines for deletions within the FHIT locus by Southern analysis, for allelic loss of specific exons of FHIT by fluorescence in situ hybridization, and for integrity of FHIT transcripts. Three of the 26 cell lines exhibited homozygous deletions within the FHIT gene, 55% (15 of 25) showed aberrant transcripts, and 65% (13 of 20) showed multiple cell populations with losses of different portions of the FHIT alleles. When the data were combined, 22 of 26 cell lines showed alterations of at least 1 allele of the FHIT gene. Thus, Virgilio et al. (1996) concluded that loss of FHIT function may be important in the development and/or progression of head and neck cancers. Animal model experiments lend further support to the function of FHIT. To investigate the role of the Fhit gene in carcinogen induction of neoplasia, Fong et al. (2000) inactivated 1 Fhit allele in mouse embryonic stem cells to produce F1 mice with an inactivated Fhit allele (+/-). Fhit +/+ and +/- mice were treated intragastrically with nitrosomethylbenzylamine and observed for 10 weeks posttreatment. In 25% of the +/+ mice, adenoma or papilloma of the forestomach developed, whereas 100% of the +/- mice developed multiple tumors that were a mixture of adenomas, squamous papillomas, and invasive carcinomas of the forestomach, as well as tumors of sebaceous glands. The visceral and sebaceous tumors, which lacked Fhit protein, were similar to those characteristic of the Muir-Torre familial cancer syndrome (OMIM Ref. No. 158320).

It is appreciated that the abovementioned animal model for FHIT is acknowledged by those skilled in the art as a scientifically valid animal model, as can be further appreciated from the publications sited hereinbelow.

Full details of the abovementioned studies are described in the following publications, the disclosure of which are hereby incorporated by reference:

Sozzi, G.; Veronese, M. L.; Negrini, M.; Baffa, R.; Cotticelli, M. G.; Inoue, H.; Tornielli, S.; Pilotti, S.; De Gregorio, L.; Pastorino, U.; Pierotti, M. A.; Ohta, M.; Huebner, K.; Croce, C. M.: The FHIT gene at 3p14.2 is abnormal in lung cancer. Cell 85:17-26, 1996; and Virgilio, L.; Shuster, M.; Gollin, S. M.; Veronese, M. L.; Ohta, M.; Huebner, K.; Croce, C. M.: FHIT gene alterations in head and neck squamous cell carcinomas. Proc. Nat. Acad. Sci. 9.

Further studies establishing the function and utilities of FHIT are found in John Hopkins OMIM database record ID 601153, and in sited publications numbered 7544-7545, 12515, 11542, 12516, 2857, 7857-7859, 2858, 9369-9375, 169 and 9376-9378 listed in the bibliography section hereinbelow, which are also hereby incorporated by reference. FK506 Binding Protein 1A, 12 kDa (FKBP1A, Accession NM_000801) is another VGAM2463 host target gene. FKBP1A BINDING SITE is HOST TARGET binding site found in the 3' untranslated region of mRNA encoded by FKBP1A, corresponding to a HOST TARGET binding site such as BINDING SITE I, BINDING SITE II or BINDING SITE III. Table 2 illustrates the complementarity of the nucleotide sequences of FKBP1A BINDING SITE, designated SEQ ID:6474, to the nucleotide sequence of VGAM2463 RNA, herein designated VGAM RNA, also designated SEQ ID:5174.

Another function of VGAM2463 is therefore inhibition of FK506 Binding Protein 1A, 12 kDa (FKBP1A, Accession NM_000801), a gene which FK506-binding protein 1A. Accordingly, utilities of VGAM2463 include diagnosis, prevention and treatment of diseases and clinical conditions associated with FKBP1A. The function of FKBP1A and its association with various diseases and clinical conditions, has been established by previous studies, as described hereinabove with reference to VGAM57. Fibronectin 1 (FN1, Accession NM_002026) is another VGAM2463 host target gene. FN1 BINDING SITE1 and FN1 BINDING SITE2 are HOST TARGET binding sites found in untranslated regions of mRNA encoded by FN1, corresponding to HOST TARGET binding sites such as BINDING SITE I, BINDING SITE II or BINDING SITE III. Table 2 illustrates the complementarity of the nucleotide sequences of FN1 BINDING SITE1 and FN1 BINDING SITE2, designated SEQ ID:7779 and SEQ ID:27645 respectively, to the nucleotide sequence of VGAM2463 RNA, herein designated VGAM RNA, also designated SEQ ID:5174.

Another function of VGAM2463 is therefore inhibition of Fibronectin 1 (FN1, Accession NM_002026), a gene which binds cell surfaces and various compounds including collagen, fibrin, heparin, dna, and actin. Accordingly, utilities of VGAM2463 include diagnosis, prevention and treatment of diseases and clinical conditions associated with FN1. The function of FN1 and its association with various diseases and clinical conditions, has been established by previous studies, as described hereinabove with reference to VGAM1063. FXYD Domain Containing Ion Transport Regulator 6 (FXYD6, Accession NM_022003) is another VGAM2463 host target gene. FXYD6 BINDING SITE is HOST TARGET binding site found in the 3' untranslated region of mRNA encoded by FXYD6, corresponding to a HOST TARGET binding site such as BINDING SITE I, BINDING SITE II or BINDING SITE III. Table 2 illustrates the complementarity of the nucleotide sequences of FXYD6 BINDING SITE, designated SEQ ID:22552, to the nucleotide sequence of VGAM2463 RNA, herein designated VGAM RNA, also designated SEQ ID:5174.

Another function of VGAM2463 is therefore inhibition of FXYD Domain Containing Ion Transport Regulator 6 (FXYD6, Accession NM_022003). Accordingly, utilities of VGAM2463 include diagnosis, prevention and treatment of diseases and clinical conditions associated with FXYD6. Frizzled Homolog 7 (Drosophila) (FZD7, Accession NM_003507) is another VGAM2463 host target gene. FZD7 BINDING SITE is HOST TARGET binding site found in the 3' untranslated region of mRNA encoded by FZD7, corresponding to a HOST TARGET binding site such as BINDING SITE I, BINDING SITE II or BINDING SITE III. Table 2 illustrates the complementarity of the nucleotide sequences of FZD7 BINDING SITE, designated SEQ ID:9600, to the nucleotide sequence of VGAM2463 RNA, herein designated VGAM RNA, also designated SEQ ID:5174.

Another function of VGAM2463 is therefore inhibition of Frizzled Homolog 7 (Drosophila) (FZD7, Accession NM_003507), a gene which enhances beta-catenin mediated signaling. Accordingly, utilities of VGAM2463 include diagnosis, prevention and treatment of diseases and clinical conditions associated with FZD7. The function of FZD7 and its association with various diseases and clinical conditions, has been established by previous studies, as described hereinabove with reference to VGAM1063. UDP-N-acetyl-alpha-D-galactosamine:polypeptide N-acetylgalactosaminyltransferase 2 (GalNAc-T2) (GALNT2, Accession NM_004481) is another VGAM2463 host target gene. GALNT2 BINDING SITE is HOST TARGET binding site found in the 3' untranslated region of mRNA encoded by GALNT2, corresponding to a HOST TARGET binding site such as BINDING SITE I, BINDING SITE II or BINDING SITE III. Table 2 illustrates the complementarity of the nucleotide sequences of GALNT2 BINDING SITE, designated SEQ ID:10799, to the nucleotide sequence of VGAM2463 RNA, herein designated VGAM RNA, also designated SEQ ID:5174.

Another function of VGAM2463 is therefore inhibition of UDP-N-acetyl-alpha-D-galactosamine:polypeptide N-acetylgalactosaminyltransferase 2 (GalNAc-T2) (GALNT2, Accession NM_004481), a gene which catalyzes the initial reaction in o-linked oligosaccharide biosynthesis. Accordingly, utilities of VGAM2463 include diagnosis, prevention and treatment of diseases and clinical conditions associated with GALNT2. The function of GALNT2 and its association with various diseases and clinical conditions, has been established by previous studies, as described hereinabove with reference to VGAM187. UDP-N-acetyl-alpha-D-galactosamine:polypeptide N-acetylgalactosaminyltransferase 7 (GalNAc-T7) (GALNT7, Accession NM_054110) is another VGAM2463 host target gene. GALNT7 BINDING SITE is HOST TARGET binding site found in the 3' untranslated region of mRNA encoded by GALNT7, corresponding to a HOST TARGET binding site such as BINDING SITE I, BINDING SITE II or BINDING SITE III. Table 2 illustrates the complementarity of the nucleotide sequences of GALNT7 BINDING SITE, designated SEQ ID:27651, to the nucleotide sequence of VGAM2463 RNA, herein designated VGAM RNA, also designated SEQ ID:5174.

Another function of VGAM2463 is therefore inhibition of UDP-N-acetyl-alpha-D-galactosamine:polypeptide N-acetylgalactosaminyltransferase 7 (GalNAc-T7) (GALNT7, Accession NM_054110). Accordingly, utilities of VGAM2463 include diagnosis, prevention and treatment of diseases and clinical conditions associated with GALNT7. Glial Fibrillary Acidic Protein (GFAP, Accession NM_002055) is another VGAM2463 host target gene. GFAP BINDING SITE is HOST TARGET binding site found in the 3' untranslated region of mRNA encoded by GFAP, corresponding to a HOST TARGET binding site such as BINDING SITE I, BINDING SITE II or BINDING SITE III. Table 2 illustrates the complementarity of the nucleotide sequences of GFAP BINDING SITE, designated SEQ ID:7815, to the nucleotide sequence of VGAM2463 RNA, herein designated VGAM RNA, also designated SEQ ID:5174.

Another function of VGAM2463 is therefore inhibition of Glial Fibrillary Acidic Protein (GFAP, Accession NM_002055). Accordingly, utilities of VGAM2463 include diagnosis, prevention and treatment of diseases and clinical conditions associated with GFAP. Guanine Nucleotide Binding Protein (G protein), Alpha 11 (Gq class) (GNA11, Accession XM_072009) is another VGAM2463 host target gene. GNA11 BINDING SITE is HOST TARGET binding site found in the 5' untranslated region of mRNA encoded by GNA11, corresponding to a HOST TARGET binding site such as BINDING SITE I, BINDING SITE II or BINDING SITE III. Table 2 illustrates the complementarity of the nucleotide sequences of GNA11 BINDING SITE, designated SEQ ID:37454, to the nucleotide sequence of VGAM2463 RNA, herein designated VGAM RNA, also designated SEQ ID:5174.

Another function of VGAM2463 is therefore inhibition of Guanine Nucleotide Binding Protein (G protein), Alpha 11 (Gq class) (GNA11, Accession XM_072009), a gene which acts as an activator of phospholipase c. Accordingly, utilities of VGAM2463 include diagnosis, prevention and treatment of diseases and clinical conditions associated with GNA11. The function of GNA11 and its association with various diseases and clinical conditions, has been established by previous studies, as described hereinabove with reference to VGAM1956. Guanine Nucleotide Binding Protein (G protein), Alpha Activating Activity Polypeptide O (GNAO1, Accession XM_165653) is another VGAM2463 host target gene. GNAO1 BINDING SITE is HOST TARGET binding site found in the 3' untranslated region of mRNA encoded by GNAO1, corresponding to a HOST TARGET binding site such as BINDING SITE I, BINDING SITE II or BINDING SITE III. Table 2 illustrates the complementarity of the nucleotide sequences of GNAO1 BINDING SITE, designated SEQ ID:43721, to the nucleotide sequence of VGAM2463 RNA, herein designated VGAM RNA, also designated SEQ ID:5174.

Another function of VGAM2463 is therefore inhibition of Guanine Nucleotide Binding Protein (G protein), Alpha Activating Activity Polypeptide O (GNAO1, Accession XM_165653), a gene which functions as modulators or transducers in various transmembrane signaling systems. Accordingly, utilities of VGAM2463 include diagnosis, prevention and treatment of diseases and clinical conditions associated with GNAO1. The function of GNAO1 and its association with various diseases and clinical conditions, has been established by previous studies, as described hereinabove with reference to VGAM665. GNAS Complex Locus (GNAS, Accession NM_016592) is another VGAM2463 host target gene. GNAS BINDING SITE is HOST TARGET binding site found in the 5' untranslated region of mRNA encoded by GNAS, corresponding to a HOST TARGET binding site such as BINDING SITE I, BINDING SITE II or BINDING SITE III. Table 2 illustrates the complementarity of the nucleotide sequences of GNAS BINDING SITE, designated SEQ ID:18679, to the nucleotide sequence of VGAM2463 RNA, herein designated VGAM RNA, also designated SEQ ID:5174.

Another function of VGAM2463 is therefore inhibition of GNAS Complex Locus (GNAS, Accession NM_016592), a gene which transduces signals from G protein-coupled receptors and activates adenylyl cyclase. Accordingly, utilities of VGAM2463 include diagnosis, prevention and treatment of diseases and clinical conditions associated with GNAS. The function of GNAS and its association with various diseases and clinical conditions, has been established by previous studies, as described hereinabove with reference to VGAM1205. Glutamate Receptor, Metabotropic 4 (GRM4, Accession NM_000841) is another VGAM2463 host target gene. GRM4 BINDING SITE is HOST TARGET binding site found in the 3' untranslated region of mRNA encoded by GRM4, corresponding to a HOST TARGET binding site such as BINDING SITE I, BINDING SITE II or BINDING SITE III. Table 2 illustrates the complementarity of the nucleotide sequences of GRM4 BINDING SITE, designated SEQ ID:6504, to the nucleotide sequence of VGAM2463 RNA, herein designated VGAM RNA, also designated SEQ ID:5174.

Another function of VGAM2463 is therefore inhibition of Glutamate Receptor, Metabotropic 4 (GRM4, Accession NM_000841), a gene which is mediated by a g-protein that inhibits adenylate cyclase activity. Accordingly, utilities of VGAM2463 include diagnosis, prevention and treatment of diseases and clinical conditions associated with GRM4. The function of GRM4 and its association with various diseases and clinical conditions, has been established by previous studies, as described hereinabove with reference to VGAM1052. Glutamate Receptor, Metabotropic 6 (GRM6, Accession NM_000843) is another VGAM2463 host target gene. GRM6 BINDING SITE is HOST TARGET binding site found in the 5' untranslated region of mRNA encoded by GRM6, corresponding to a HOST TARGET binding site such as BINDING SITE I, BINDING SITE II or BINDING SITE III. Table 2 illustrates the complementarity of the nucleotide sequences of GRM6 BINDING SITE, designated SEQ ID:6508, to the nucleotide sequence of VGAM2463 RNA, herein designated VGAM RNA, also designated SEQ ID:5174.

Another function of VGAM2463 is therefore inhibition of Glutamate Receptor, Metabotropic 6 (GRM6, Accession NM_000843). Accordingly, utilities of VGAM2463 include diagnosis, prevention and treatment of diseases and clinical conditions associated with GRM6. GTF2I Repeat Domain Containing 1 (GTF2IRD1, Accession NM_016328) is another VGAM2463 host target gene. GTF2IRD1 BINDING SITE is HOST TARGET binding site found in the 5' untranslated region of mRNA encoded by GTF2IRD1, corresponding to a HOST TARGET binding site such as BINDING SITE I, BINDING SITE II or BINDING SITE III. Table 2 illustrates the complementarity of the nucleotide sequences of GTF2IRD1 BINDING SITE, designated SEQ ID:18452, to the nucleotide sequence of VGAM2463 RNA, herein designated VGAM RNA, also designated SEQ ID:5174.

Another function of VGAM2463 is therefore inhibition of GTF2I Repeat Domain Containing 1 (GTF2IRD1, Accession NM_016328). Accordingly, utilities of VGAM2463 include diagnosis, prevention and treatment of diseases and clinical conditions associated with GTF2IRD1. Huntingtin-associated Protein 1 (neuroan 1) (HAP1, Accession NM_003949) is another VGAM2463 host target gene. HAP1 BINDING SITE is HOST TARGET binding site found in the 3' untranslated region of mRNA encoded by HAP1, corresponding to a HOST TARGET binding site such as BINDING SITE I, BINDING SITE II or BINDING SITE III. Table 2 illustrates the complementarity of the nucleotide sequences of HAP1 BINDING SITE, designated SEQ ID:10076, to the nucleotide sequence of VGAM2463 RNA, herein designated VGAM RNA, also designated SEQ ID:5174.

Another function of VGAM2463 is therefore inhibition of Huntingtin-associated Protein 1 (neuroan 1) (HAP1, Accession NM_003949), a gene which functions as an adaptor protein using coiled coils to mediate interactions among cytoskeletal, vascular, and motor proteins. Accordingly, utilities of VGAM2463 include diagnosis, prevention and treatment of diseases and clinical conditions associated with HAP1. The function of HAP1 and its association with various diseases and clinical conditions, has been established by previous studies, as described hereinabove with reference to VGAM126. Host Cell Factor C1 (VP16-accessory protein) (HCFC1, Accession XM_048390) is another VGAM2463 host target gene. HCFC1 BINDING SITE is HOST TARGET binding site found in the 3' untranslated region of mRNA encoded by HCFC1, corresponding to a HOST TARGET binding site such as BINDING SITE I, BINDING SITE II or BINDING SITE III. Table 2 illustrates the complementarity of the nucleotide sequences of HCFC1 BINDING SITE, designated SEQ ID:35157, to the nucleotide sequence of VGAM2463 RNA, herein designated VGAM RNA, also designated SEQ ID:5174.

Another function of VGAM2463 is therefore inhibition of Host Cell Factor C1 (VP16-accessory protein) (HCFC1, Accession XM_048390), a gene which is a host cell factor, has a role in cell proliferation and can form a complex with HSV VP16. Accordingly, utilities of VGAM2463 include diagnosis, prevention and treatment of diseases and clinical conditions associated with HCFC1. The function of HCFC1 and its association with various diseases and clinical conditions, has been established by previous studies, as described hereinabove with reference to VGAM341. High Mobility Group AT-hook 2 (HMGA2, Accession NM_003483) is another VGAM2463 host target gene. HMGA2 BINDING SITE is HOST TARGET binding site found in the 5' untranslated region of mRNA encoded by HMGA2, corresponding to a HOST TARGET binding site such as BINDING SITE I, BINDING SITE II or BINDING SITE III. Table 2 illustrates the complementarity of the nucleotide sequences of HMGA2 BINDING SITE, designated SEQ ID:9572, to the nucleotide sequence of VGAM2463 RNA, herein designated VGAM RNA, also designated SEQ ID:5174.

Another function of VGAM2463 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM2463 include diagnosis, prevention and treatment of diseases and clinical conditions associated with HMGA2. The function of HMGA2 and its association with various diseases and clinical conditions, has been established by previous studies, as described hereinabove with reference to VGAM552. HTRA3 (Accession XM_114416) is another VGAM2463 host target gene. HTRA3 BINDING SITE is HOST TARGET binding site found in the 3' untranslated region of mRNA encoded by HTRA3, corresponding to a HOST TARGET binding site such as BINDING SITE I, BINDING SITE II or BINDING SITE III. Table 2 illustrates the complementarity of the nucleotide sequences of HTRA3 BINDING SITE, designated SEQ ID:42940, to the nucleotide sequence of VGAM2463 RNA, herein designated VGAM RNA, also designated SEQ ID:5174.

Another function of VGAM2463 is therefore inhibition of HTRA3 (Accession XM_114416). Accordingly, utilities of VGAM2463 include diagnosis, prevention and treatment of diseases and clinical conditions associated with HTRA3. Inositol 1,4,5-trisphosphate 3-kinase B (ITPKB, Accession NM_002221) is another VGAM2463 host target gene. ITPKB BINDING SITE is HOST TARGET binding site found in the 3' untranslated region of mRNA encoded by ITPKB, corresponding to a HOST TARGET binding site such as BINDING SITE I, BINDING SITE II or BINDING SITE III. Table 2 illustrates the complementarity of the nucleotide sequences of ITPKB BINDING SITE, designated SEQ ID:7982, to the nucleotide sequence of VGAM2463 RNA, herein designated VGAM RNA, also designated SEQ ID:5174.

Another function of VGAM2463 is therefore inhibition of Inositol 1,4,5-trisphosphate 3-kinase B (ITPKB, Accession NM_002221), a gene which is a type B inositol 1,4,5-triphosphate 3 kinase. Accordingly, utilities of VGAM2463 include diagnosis, prevention and treatment of diseases and clinical conditions associated with ITPKB. The function of ITPKB and its association with various diseases and clinical conditions, has been established by previous studies, as described hereinabove with reference to VGAM1252. Potassium Voltage-gated Channel, Shaker-related Subfamily, Beta Member 2 (KCNAB2, Accession NM_003636) is another VGAM2463 host target gene. KCNAB2 BINDING SITE1 and KCNAB2 BINDING SITE2 are HOST TARGET binding sites found in untranslated regions of mRNA encoded by KCNAB2, corresponding to HOST TARGET binding sites such as BINDING SITE I, BINDING SITE II or BINDING SITE III. Table 2 illustrates the complementarity of the nucleotide sequences of KCNAB2 BINDING SITE1 and KCNAB2 BINDING SITE2, designated SEQ ID:9707 and SEQ ID:9708 respectively, to the nucleotide sequence of VGAM2463 RNA, herein designated VGAM RNA, also designated SEQ ID:5174.

Another function of VGAM2463 is therefore inhibition of Potassium Voltage-gated Channel, Shaker-related Subfamily, Beta Member 2 (KCNAB2, Accession NM_003636), a gene which is the beta subunit of shaker voltage-gated potassium channels. Accordingly, utilities of VGAM2463 include diagnosis, prevention and treatment of diseases and clinical conditions associated with KCNAB2. The function of KCNAB2 and its association with various diseases and clinical conditions, has been established by previous studies, as described hereinabove with reference to VGAM659. LIM Domain Kinase 1 (LIMK1, Accession NM_016735) is another VGAM2463 host target gene. LIMK1 BINDING SITE1 through LIMK1 BINDING SITE4 are HOST TARGET binding sites found in untranslated regions of mRNA encoded by LIMK1, corresponding to HOST TARGET binding sites such as BINDING SITE I, BINDING SITE II or BINDING SITE III. Table 2 illustrates the complementarity of the nucleotide sequences of LIMK1 BINDING SITE1 through LIMK1 BINDING SITE4, designated SEQ ID:18801, SEQ ID:18803, SEQ ID:8125 and SEQ ID:8126 respectively, to the nucleotide sequence of VGAM2463 RNA, herein designated VGAM RNA, also designated SEQ ID:5174.

Another function of VGAM2463 is therefore inhibition of LIM Domain Kinase 1 (LIMK1, Accession NM_016735). Accordingly, utilities of VGAM2463 include diagnosis, prevention and treatment of diseases and clinical conditions associated with LIMK1. V-maf Musculoaponeurotic Fibrosarcoma Oncogene Homolog (avian) (MAF, Accession NM_005360) is another VGAM2463 host target gene. MAF BINDING SITE is HOST TARGET binding site found in the 5" untranslated region of mRNA encoded by MAF, corresponding to a HOST TARGET binding site such as BINDING SITE I, BINDING SITE II or BINDING SITE III. Table 2 illustrates the complementarity of the nucleotide sequences of MAF BINDING SITE, designated SEQ ID:11837, to the nucleotide sequence of VGAM2463 RNA, herein designated VGAM RNA, also designated SEQ ID:5174.

Another function of VGAM2463 is therefore inhibition of V-maf Musculoaponeurotic Fibrosarcoma Oncogene Homolog (avian) (MAF, Accession NM_005360), a gene which is a transcription factor; contains a leucine zipper motif. Accordingly, utilities of VGAM2463 include diagnosis, prevention and treatment of diseases and clinical conditions associated with MAF. The function of MAF and its association with various diseases and clinical conditions, has been established by previous studies, as described hereinabove with reference to VGAM822. MAP/microtubule Affinity-regulating Kinase 3 (MARK3, Accession NM_002376) is another VGAM2463 host target gene. MARK3 BINDING SITE is HOST TARGET binding site found in the 5' untranslated region of mRNA encoded by MARK3, corresponding to a HOST TARGET binding site such as BINDING SITE I, BINDING SITE II or BINDING SITE III. Table 2 illustrates the complementarity of the nucleotide sequences of MARK3 BINDING SITE, designated SEQ ID:8190, to the nucleotide sequence of VGAM2463 RNA, herein designated VGAM RNA, also designated SEQ ID:5174.

Another function of VGAM2463 is therefore inhibition of MAP/microtubule Affinity-regulating Kinase 3 (MARK3, Accession NM_002376), a gene which may be involved in cell cycle regulation. Accordingly, utilities of VGAM2463 include diagnosis, prevention and treatment of diseases and clinical conditions associated with MARK3. The function of MARK3 and its association with various diseases and clinical conditions, has been established by previous studies, as described hereinabove with reference to VGAM964. Meningioma (disrupted in balanced translocation) 1 (MN1, Accession NM_002430) is another VGAM2463 host target gene. MN1 BINDING SITE is HOST TARGET binding site found in the 5' untranslated region of mRNA encoded by MN1, corresponding to a HOST TARGET binding site such as BINDING SITE I, BINDING SITE II or BINDING SITE III. Table 2 illustrates the complementarity of the nucleotide sequences of MN1 BINDING SITE, designated SEQ ID:8273, to the nucleotide sequence of VGAM2463 RNA, herein designated VGAM RNA, also designated SEQ ID:5174.

Another function of VGAM2463 is therefore inhibition of Meningioma (disrupted in balanced translocation) 1 (MN1, Accession NM_002430). Accordingly, utilities of VGAM2463 include diagnosis, prevention and treatment of diseases and clinical conditions associated with MN1. MAX Binding Protein (MNT, Accession NM_020310) is another VGAM2463 host target gene. MNT BINDING SITE is HOST TARGET binding site found in the 3' untranslated region of mRNA encoded by MNT, corresponding to a HOST TARGET binding site such as BINDING SITE I, BINDING SITE II or BINDING SITE III. Table 2 illustrates the complementarity of the nucleotide sequences of MNT BINDING SITE, designated SEQ ID:21563, to the nucleotide sequence of VGAM2463 RNA, herein designated VGAM RNA, also designated SEQ ID:5174.

Another function of VGAM2463 is therefore inhibition of MAX Binding Protein (MNT, Accession NM_020310). Accordingly, utilities of VGAM2463 include diagnosis, prevention and treatment of diseases and clinical conditions associated with MNT. NESH (Accession NM_016428) is another VGAM2463 host target gene. NESH BINDING SITE is HOST TARGET binding site found in the 5' untranslated region of mRNA encoded by NESH, corresponding to a HOST TARGET binding site such as BINDING SITE I, BINDING SITE II or BINDING SITE III. Table 2 illustrates the complementarity of the nucleotide sequences of NESH BINDING SITE, designated SEQ ID:18548, to the nucleotide sequence of VGAM2463 RNA, herein designated VGAM RNA, also designated SEQ ID:5174.

Another function of VGAM2463 is therefore inhibition of NESH (Accession NM_016428), a gene which plays a role in cell growth signalling. Accordingly, utilities of VGAM2463 include diagnosis, prevention and treatment of diseases and clinical conditions associated with NESH. The function of NESH has been established by previous studies. By screening a hepatocellular cDNA library using PCR with degenerate primers corresponding to p53 (OMIM Ref. No. 191170)/p73 (OMIM Ref. No. 601990) exon domains, followed by probing a placenta cDNA library, Miyazaki et al. (2000) obtained a cDNA encoding an SH3-containing protein they designated NESH (new molecule including SH3). SH3 domains contain about 50 amino acids that bind to proline-rich sequences and often play a role in cell growth signalling. Sequence analysis predicted that the 366-amino acid NESH protein, which is most homologous to SSH3BP1 (OMIM Ref. No. 603050), has a central serine-rich region followed by a proline-rich region and a C-terminal SH3 domain. RT-PCR analysis detected variable expression of NESH in all tissues tested. Miyazaki et al. (2000) suggested that the similarity of NESH to SSH3BP1, an EPS8 (OMIM Ref. No. 600206)-binding protein, indicates that its SH3 domain may interact with other proteins in signal transduction. GENE FUNCTION Using the yeast 2-hybrid system, Matsuda et al. (2001) identified TARSH (OMIM Ref. No. 606279) as a binding partner of NESH.

Full details of the abovementioned studies are described in the following publications, the disclosure of which are hereby incorporated by reference:

Matsuda, S.; Iriyama, C.; Yokozaki, S.; Ichigotani, Y.; Shirafuji, N.; Yamaki, K.; Hayakawa, T.; Hamaguchi, M.: Cloning and sequencing of a novel human gene that encodes a putative target protein of Nesh-SH3. J. Hum. Genet. 46:483-486, 2001; and Miyazaki, K.; Matsuda, S.; Ichigotani, Y.; Takenouchi, Y.; Hayashi, K.; Fukuda, Y.; Nimura, Y.; Hamaguchi, M.: Isolation and characterization of a novel human gene (NESH) which encode.

Further studies establishing the function and utilities of NESH are found in John Hopkins OMIM database record ID 606363, and in sited publications numbered 451 and 6175 listed in the bibliography section hereinbelow, which are also hereby incorporated by reference. Nitric Oxide Synthase 1 (neuronal) (NOS1, Accession NM_000620) is another VGAM2463 host target gene. NOS1 BINDING SITE is HOST TARGET binding site found in the 3' untranslated region of mRNA encoded by NOS1, corresponding to a HOST TARGET binding site such as BINDING SITE I, BINDING SITE II or BINDING SITE III. Table 2 illustrates the complementarity of the nucleotide sequences of NOS1 BINDING SITE, designated SEQ ID:6231, to the nucleotide sequence of VGAM2463 RNA, herein designated VGAM RNA, also designated SEQ ID:5174.

Another function of VGAM2463 is therefore inhibition of Nitric Oxide Synthase 1 (neuronal) (NOS1, Accession NM_000620), a gene which produces nitric oxide (no) which is a messenger molecule with diverse functions throughout the body. Accordingly, utilities of VGAM2463 include diagnosis, prevention and treatment of diseases and clinical conditions associated with NOS1. The function of NOS1 and its association with various diseases and clinical conditions, has been established by previous studies, as described hereinabove with reference to VGAM323. Neurexin 1 (NRXN1, Accession NM_138735) is another VGAM2463 host target gene. NRXN1 BINDING SITE is HOST TARGET binding site found in the 5' untranslated region of mRNA encoded by NRXN1, corresponding to a HOST TARGET binding site such as BINDING SITE I, BINDING SITE II or BINDING SITE III. Table 2 illustrates the complementarity of the nucleotide sequences of NRXN1 BINDING SITE, designated SEQ ID:28996, to the nucleotide sequence of VGAM2463 RNA, herein designated VGAM RNA, also designated SEQ ID:5174.

Another function of VGAM2463 is therefore inhibition of Neurexin 1 (NRXN1, Accession NM_138735), a gene which may be involved in cell recognition, cell adhesion, and mediate intracellular signaling. Accordingly, utilities of VGAM2463 include diagnosis, prevention and treatment of diseases and clinical conditions associated with NRXN1. The function of NRXN1 and its association with various diseases and clinical conditions, has been established by previous studies, as described hereinabove with reference to VGAM191. Occludin (OCLN, Accession NM_002538) is another VGAM2463 host target gene. OCLN BINDING SITE is HOST TARGET binding site found in the 5' untranslated region of mRNA encoded by OCLN, corresponding to a HOST TARGET binding site such as BINDING SITE I, BINDING SITE II or BINDING SITE III. Table 2 illustrates the complementarity of the nucleotide sequences of OCLN BINDING SITE, designated SEQ ID:8381, to the nucleotide sequence of VGAM2463 RNA, herein designated VGAM RNA, also designated SEQ ID:5174.

Another function of VGAM2463 is therefore inhibition of Occludin (OCLN, Accession NM_002538). Accordingly, utilities of VGAM2463 include diagnosis, prevention and treatment of diseases and clinical conditions associated with OCLN. Paired Box Gene 2 (PAX2, Accession NM_003987) is another VGAM2463 host target gene. PAX2 BINDING SITE1 through PAX2 BINDING SITE6 are HOST TARGET binding sites found in untranslated regions of mRNA encoded by PAX2, corresponding to HOST TARGET binding sites such as BINDING SITE I, BINDING SITE II or BINDING SITE III. Table 2 illustrates the complementarity of the nucleotide sequences of PAX2 BINDING SITE1 through PAX2 BINDING SITE6, designated SEQ ID:10138, SEQ ID:10140, SEQ ID:10141, SEQ ID:10144, SEQ ID:10146 and SEQ ID:10147 respectively, to the nucleotide sequence of VGAM2463 RNA, herein designated VGAM RNA, also designated SEQ ID:5174.

Another function of VGAM2463 is therefore inhibition of Paired Box Gene 2 (PAX2, Accession NM_003987), a gene which involves in kidney cell differentiation. Accordingly, utilities of VGAM2463 include diagnosis, prevention and treatment of diseases and clinical conditions associated with PAX2. The function of PAX2 and its association with various diseases and clinical conditions, has been established by previous studies, as described hereinabove with reference to VGAM407. Polycystic Kidney Disease 2-like 1 (PKD2L1, Accession NM_016112) is another VGAM2463 host target gene. PKD2L1 BINDING SITE is HOST TARGET binding site found in the 5' untranslated region of mRNA encoded by PKD2L1, corresponding to a HOST TARGET binding site such as BINDING SITE I, BINDING SITE II or BINDING SITE III. Table 2 illustrates the complementarity of the nucleotide sequences of PKD2L1 BINDING SITE, designated SEQ ID:18192, to the nucleotide sequence of VGAM2463 RNA, herein designated VGAM RNA, also designated SEQ ID:5174.

Another function of VGAM2463 is therefore inhibition of Polycystic Kidney Disease 2-like 1 (PKD2L1, Accession NM_016112). Accordingly, utilities of VGAM2463 include diagnosis, prevention and treatment of diseases and clinical conditions associated with PKD2L1. Pleckstrin (PLEK, Accession NM_002664) is another VGAM2463 host target gene. PLEK BINDING SITE is HOST TARGET binding site found in the 3' untranslated region of mRNA encoded by PLEK, corresponding to a HOST TARGET binding site such as BINDING SITE I, BINDING SITE II or BINDING SITE III. Table 2 illustrates the complementarity of the nucleotide sequences of PLEK BINDING SITE, designated SEQ ID:8534, to the nucleotide sequence of VGAM2463 RNA, herein designated VGAM RNA, also designated SEQ ID:5174.

Another function of VGAM2463 is therefore inhibition of Pleckstrin (PLEK, Accession NM_002664), a gene which is the major protein kinase c substrate of platelets. Accordingly, utilities of VGAM2463 include diagnosis, prevention and treatment of diseases and clinical conditions associated with PLEK. The function of PLEK and its association with various diseases and clinical conditions, has been established by previous studies, as described hereinabove with reference to VGAM200. Paired Mesoderm Homeo Box 1 (PMX1, Accession NM_022716) is another VGAM2463 host target gene. PMX1 BINDING SITE1 and PMX1 BINDING SITE2 are HOST TARGET binding sites found in untranslated regions of mRNA encoded by PMX1, corresponding to HOST TARGET binding sites such as BINDING SITE I, BINDING SITE II or BINDING SITE III. Table 2 illustrates the complementarity of the nucleotide sequences of PMX1 BINDING SITE1 and PMX1 BINDING SITE2, designated SEQ ID:22916 and SEQ ID:13781 respectively, to the nucleotide sequence of VGAM2463 RNA, herein designated VGAM RNA, also designated SEQ ID:5174.

Another function of VGAM2463 is therefore inhibition of Paired Mesoderm Homeo Box 1 (PMX1, Accession NM_022716), a gene which acts as a transcriptional regulator of muscle creatine kinase. Accordingly, utilities of VGAM2463 include diagnosis, prevention and treatment of diseases and clinical conditions associated with PMX1. The function of PMX1 and its association with various diseases and clinical conditions, has been established by previous studies, as described hereinabove with reference to VGAM381. Protein Phosphatase 2A, Regulatory Subunit B' (PR 53) (PPP2R4, Accession XM_026944) is another VGAM2463 host target gene. PPP2R4 BINDING SITE is HOST TARGET binding site found in the 3' untranslated region of mRNA encoded by PPP2R4, corresponding to a HOST TARGET binding site such as BINDING SITE I, BINDING SITE II or BINDING SITE III. Table 2 illustrates the complementarity of the nucleotide sequences of PPP2R4 BINDING SITE, designated SEQ ID:30376, to the nucleotide sequence of VGAM2463 RNA, herein designated VGAM RNA, also designated SEQ ID:5174.

Another function of VGAM2463 is therefore inhibition of Protein Phosphatase 2A, Regulatory Subunit B' (PR 53) (PPP2R4, Accession XM_026944), a gene which is a regulatory subunit of protein phosphatase 2A. Accordingly, utilities of VGAM2463 include diagnosis, prevention and treatment of diseases and clinical conditions associated with PPP2R4. The function of PPP2R4 and its association with various diseases and clinical conditions, has been established by previous studies, as described hereinabove with reference to VGAM435. Periaxin (PRX, Accession NM_020956) is another VGAM2463 host target gene. PRX BINDING SITE1 and PRX BINDING SITE2 are HOST TARGET binding sites found in untranslated regions of mRNA encoded by PRX, corresponding to HOST TARGET binding sites such as BINDING SITE I, BINDING SITE II or BINDING SITE III. Table 2 illustrates the complementarity of the nucleotide sequences of PRX BINDING SITE1 and PRX BINDING SITE2, designated SEQ ID:21935 and SEQ ID:21940 respectively, to the nucleotide sequence of VGAM2463 RNA, herein designated VGAM RNA, also designated SEQ ID:5174.

Another function of VGAM2463 is therefore inhibition of Periaxin (PRX, Accession NM_020956), a gene which seems to be required for maintenance of peripheral nerve myelin sheath. may have a role in axon-glial interactions, possibly by interacting with the cytoplasmic domains of integral membrane proteins such as myelin-associated glycoprotein in the periaxonal regions of the schwann cell plasma membrane. may have a role in the early phases of myelin deposition. Accordingly, utilities of VGAM2463 include diagnosis, prevention and treatment of diseases and clinical conditions associated with PRX. The function of PRX and its association with various diseases and clinical conditions, has been established by previous studies, as described hereinabove with reference to VGAM476. Prostaglandin-endoperoxide Synthase 1 (prostaglandin G/H synthase and cyclooxygenase) (PTGS1, Accession NM_000962) is another VGAM2463 host target gene. PTGS1 BINDING SITE1 and PTGS1 BINDING SITE2 are HOST TARGET binding sites found in untranslated regions of mRNA encoded by PTGS1, corresponding to HOST TARGET binding sites such as BINDING SITE I, BINDING SITE II or BINDING SITE III. Table 2 illustrates the complementarity of the nucleotide sequences of PTGS1 BINDING SITE1 and PTGS1 BINDING SITE2, designated SEQ ID:6673 and SEQ ID:8744 respectively, to the nucleotide sequence of VGAM2463 RNA, herein designated VGAM RNA, also designated SEQ ID:5174.

Another function of VGAM2463 is therefore inhibition of Prostaglandin-endoperoxide Synthase 1 (prostaglandin G/H synthase and cyclooxygenase) (PTGS1, Accession NM_000962), a gene which may play an important role in regulating or promoting cell proliferation in some normal and neoplastically transformed cells. Accordingly, utilities of VGAM2463 include diagnosis, prevention and treatment of diseases and clinical conditions associated with PTGS1. The function of PTGS1 and its association with various diseases and clinical conditions, has been established by previous studies, as described hereinabove with reference to VGAM1224. Protein Tyrosine Phosphatase, Receptor Type, S (PTPRS, Accession NM_130853) is another VGAM2463 host target gene. PTPRS BINDING SITE1 through PTPRS BINDING SITE4 are HOST TARGET binding sites found in untranslated regions of mRNA encoded by PTPRS, corresponding to HOST TARGET binding sites such as BINDING SITE I, BINDING SITE II or BINDING SITE III. Table 2 illustrates the complementarity of the nucleotide sequences of PTPRS BINDING SITE1 through PTPRS BINDING SITE4, designated SEQ ID:28390, SEQ ID:28391, SEQ ID:8767 and SEQ ID:12130 respectively, to the nucleotide sequence of VGAM2463 RNA, herein designated VGAM RNA, also designated SEQ ID:5174.

Another function of VGAM2463 is therefore inhibition of Protein Tyrosine Phosphatase, Receptor Type, S (PTPRS, Accession NM_130853), a gene which controls motor axon guidance and may be a cell adhesion receptor. Accordingly, utilities of VGAM2463 include diagnosis, prevention and treatment of diseases and clinical conditions associated with PTPRS. The function of PTPRS has been established by previous studies. Protein-tyrosine phosphatase sigma (PTPRS) is a receptor type protein-tyrosine phosphatase that has been cloned and identified in mouse, in rat, and in human (Pulido et al., 1995). PTPRS is a member of a subfamily of receptor type PTPases that includes LAR (OMIM Ref. No. 179590) and PTP-delta. Wagner et al. (1996) noted that this subfamily of cell surface glycoproteins is characterized by the presence of an extracellular cell adhesion molecule-like motif and 2 intracellular phosphatase domains. Transcripts of these genes are subject to RNA processing, resulting in several distinct isoforms. These proteins share a high overall degree of sequence similarity, especially in the second intracellular catalytic domain, which is thought to interact with the same molecule. Analysis of the expression pattern of PTPRS suggests that it may be involved in the development of the nervous system. Batt et al. (2002) examined the role of PTP on pituitary, pancreas, and enteroendocrine cytodifferentiation, hormone production, and development. The adenohypophyses of PTPRS-null mice were small and exhibited reduced GH (see OMIM Ref. No. 139250) and PRL (OMIM Ref. No. 176760) immunoreactivity. Cells containing TSH (see OMIM Ref. No. 188530), LH (see OMIM Ref. No. 152780), FSH (see OMIM Ref. No. 136530), ACTH, pituitary-specific POU homeodomain factor (Pit1; 173110), estrogen receptor (see OMIM Ref. No. 133430), and steroidogenic factor-1 (OMIM Ref. No. 184757) were found in normal proportions and distributions. The diminished expression of GH and PRL was not associated with apoptosis of somatotrophs or lactotrophs. In the knockout mice, pancreatic islets were hypoplastic with reduced insulin immunoreactivity, and there was also variable expression of gut hormones. Functionally, the GH deficiency was associated with hypoglycemia and death in the PTPRS-null neonates, and accordingly, intraperitoneal administration of GH rescued the PTPRS-null neonates and normalized the blood glucose. The authors concluded that PTP-sigma plays a major role in differentiation and development of the neuroendocrine system. Animal model experiments lend further support to the function of PTPRS. On the basis of its expression and homology with the Drosophila melanogaster orthologs, which have roles in the targeting of axonal growth cones, Elchebly et al. (1999) hypothesized that PTP-sigma may also have a modulating function in cell-cell interactions, as well as in axon guidance during mammalian embryogenesis. To investigate its function in vivo, they generated Ptprs-deficient mice. The resulting Ptprs -/- animals displayed retarded growth, increased neonatal mortality, hyposmia, and hypofecundity. Anatomic and histologic analyses showed a decrease in overall brain size with severe depletion of luteinizing hormone-releasing hormone (OMIM Ref. No. 152760)-immunoreactive cells in the hypothalamus of the Ptprs -/- mice. These mice also had an enlarged intermediate pituitary lobe, but smaller anterior and posterior lobes. These results suggested that tyrosine phosphorylation-dependent signaling pathways regulated by PTP-sigma influence the proliferation and/or adhesiveness of various cell types in the developing hypothalamopituitary axis.

It is appreciated that the abovementioned animal model for PTPRS is acknowledged by those skilled in the art as a scientifically valid animal model, as can be further appreciated from the publications sited hereinbelow.

Full details of the abovementioned studies are described in the following publications, the disclosure of which are hereby incorporated by reference:

Batt, J.; Asa, S.; Fladd, C.; Rotin, D.: Pituitary, pancreatic and gut neuroendocrine defects in protein tyrosine phosphatase-sigma-deficient mice. Molec. Endocr. 16:155-169, 2002; and Elchebly, M.; Wagner, J.; Kennedy, T. E.; Lanctot, C.; Michaliszyn, E.; Itie, A.; Drouin, J.; Tremblay, M. L.: Neuroendocrine dysplasia in mice lacking protein tyrosine phosphatase sig.

Further studies establishing the function and utilities of PTPRS are found in John Hopkins OMIM database record ID 601576, and in sited publications numbered 6677-6681 listed in the bibliography section hereinbelow, which are also hereby incorporated by reference. Radical Fringe Homolog (Drosophila) (RFNG, Accession XM_113942) is another VGAM2463 host target gene. RFNG BINDING SITE is HOST TARGET binding site found in the 3' untranslated region of mRNA encoded by RFNG, corresponding to a HOST TARGET binding site such as BINDING SITE I, BINDING SITE II or BINDING SITE III. Table 2 illustrates the complementarity of the nucleotide sequences of RFNG BINDING SITE, designated SEQ ID:42558, to the nucleotide sequence of VGAM2463 RNA, herein designated VGAM RNA, also designated SEQ ID:5174.

Another function of VGAM2463 is therefore inhibition of Radical Fringe Homolog (Drosophila) (RFNG, Accession XM_113942), a gene which controls activation of the Notch signal transduction pathway;. Accordingly, utilities of VGAM2463 include diagnosis, prevention and treatment of diseases and clinical conditions associated with RFNG. The function of RFNG has been established by previous studies. Fringe proteins can positively and negatively modulate the ability of Notch ligands to activate the Notch receptor. Moloney et al. (2000) established the biochemical mechanism of Fringe action. Drosophila and mammalian Fringe proteins possess a fucose-specific beta-1,3 N-acetylglucosaminyl-transferase activity that initiates elongation of O-linked fucose residues attached to epidermal growth factor (EGF; 131530)-like sequence repeats of Notch. They obtained biologic evidence that Fringe-dependent elongation of O-linked fucose on Notch modulates Notch signaling by using coculture assays in mammalian cells and by expression of an enzymatically inactive Fringe mutant in Drosophila. Bruckner et al. (2000) showed that Fringe acts in the Golgi as a glycosyl-transferase enzyme that modifies the EGF modules of Notch and alters the ability of Notch to bind its ligand Delta (OMIM Ref. No. 602768). The authors demonstrated that Fringe catalyzes the addition of N-acetylglucosamine to fucose, which is consistent with a role in the elongation of O-linked fucose O-glycosylation that is associated with EGF repeats. Vertebrate limb outgrowth requires a structure called the apical ectodermal ridge (AER), formation of which relies on the previous establishment of the dorsoventral limb axis. The AER of the vertebrate limb bud lies at the junction of the dorsal and ventral ectoderm and directs patterning of the growing limb outgrowth. Rfng is expressed in the dorsal ectoderm before the ridge appears, and is repressed by Engrailed-1 (OMIM Ref. No. 131290), which is expressed in the ventral ectoderm. Rodriguez-Esteban et al. (1997) found that misexpression of these genes results in a ridge being formed wherever there is a boundary between cells expressing and not expressing Rfng. Thus, as in Drosophila, Rfng positions the ridge at the dorsoventral limb boundary. The results of Laufer et al. (1997) supported the hypothesis that the AER forms at the juxtaposition of Rfng-expressing and nonexpressing cells, and furthermore dissociate the molecular control of AER formation from that of dorsoventral tissue specification. Laufer et al. (1997) also found that Rfng expression in chick limb dorsal ectoderm is established in part through repression by Engrailed-1 in the ventral ectoderm.

Full details of the abovementioned studies are described in the following publications, the disclosure of which are hereby incorporated by reference:

Moloney, D. J.; Panin, V. M.; Johnston, S. H.; Chen, J.; Shao, L.; Wilson, R.; Wang, Y.; Stanley, P.; Irvine, K. D.; Haltiwanger, R. S.; Vogt, T. F.: Fringe is a glycosyltransferase that modifies Notch. Nature 406:369-375, 2000; and Laufer, E.; Dahn, R.; Orozco, O. E.; Yeo, C.-Y.; Pisenti, J.; Henrique, D.; Abbott, U. K.; Fallon, J. F.; Tabin, C.: Expression of Radical fringe in limb-bud ectoderm regulates apical.

Further studies establishing the function and utilities of RFNG are found in John Hopkins OMIM database record ID 602578, and in sited publications numbered 5746, 7964, 7966, 1235 and 7967 listed in the bibliography section hereinbelow, which are also hereby incorporated by reference. Ret Finger Protein (RFP, Accession NM_006510) is another VGAM2463 host target gene. RFP BINDING SITE is HOST TARGET binding site found in the 3" untranslated region of mRNA encoded by RFP, corresponding to a HOST TARGET binding site such as BINDING SITE I, BINDING SITE II or BINDING SITE III. Table 2 illustrates the complementarity of the nucleotide sequences of RFP BINDING SITE, designated SEQ ID:13260, to the nucleotide sequence of VGAM2463 RNA, herein designated VGAM RNA, also designated SEQ ID:5174.

Another function of VGAM2463 is therefore inhibition of Ret Finger Protein (RFP, Accession NM_006510), a gene which involvels in transcriptional regulation and may act in male germ cell development. Accordingly, utilities of VGAM2463 include diagnosis, prevention and treatment of diseases and clinical conditions associated with RFP. The function of RFP and its association with various diseases and clinical conditions, has been established by previous studies, as described hereinabove with reference to VGAM302. Retinoschisis (X-linked, juvenile) 1 (RS1, Accession NM_000330) is another VGAM2463 host target gene. RS1 BINDING SITE is HOST TARGET binding site found in the 3" untranslated region of mRNA encoded by RS1, corresponding to a HOST TARGET binding site such as BINDING SITE I, BINDING SITE II or BINDING SITE III. Table 2 illustrates the complementarity of the nucleotide sequences of RS1 BINDING SITE, designated SEQ ID:5878, to the nucleotide sequence of VGAM2463 RNA, herein designated VGAM RNA, also designated SEQ ID:5174.

Another function of VGAM2463 is therefore inhibition of Retinoschisis (X-linked, juvenile) 1 (RS1, Accession NM_000330). Accordingly, utilities of VGAM2463 include diagnosis, prevention and treatment of diseases and clinical conditions associated with RS1. Retinoid X Receptor, Alpha (RXRA, Accession NM_002957) is another VGAM2463 host target gene. RXRA BINDING SITE is HOST TARGET binding site found in the 3' untranslated region of mRNA encoded by RXRA, corresponding to a HOST TARGET binding site such as BINDING SITE I, BINDING SITE II or BINDING SITE III. Table 2 illustrates the complementarity of the nucleotide sequences of RXRA BINDING SITE, designated SEQ ID:8869, to the nucleotide sequence of VGAM2463 RNA, herein designated VGAM RNA, also designated SEQ ID:5174.

Another function of VGAM2463 is therefore inhibition of Retinoid X Receptor, Alpha (RXRA, Accession NM_002957), a gene which activates genes required for vitamin A metabolism, binds 9-cis retinoic acid. Accordingly, utilities of VGAM2463 include diagnosis, prevention and treatment of diseases and clinical conditions associated with RXRA. The function of RXRA and its association with various diseases and clinical conditions, has been established by previous studies, as described hereinabove with reference to VGAM349. Syndecan 4 (amphiglycan, ryudocan) (SDC4, Accession NM_002999) is another VGAM2463 host target gene. SDC4 BINDING SITE is HOST TARGET binding site found in the 3' untranslated region of mRNA encoded by SDC4, corresponding to a HOST TARGET binding site such as BINDING SITE I, BINDING SITE II or BINDING SITE III. Table 2 illustrates the complementarity of the nucleotide sequences of SDC4 BINDING SITE, designated SEQ ID:8891, to the nucleotide sequence of VGAM2463 RNA, herein designated VGAM RNA, also designated SEQ ID:5174.

Another function of VGAM2463 is therefore inhibition of Syndecan 4 (amphiglycan, ryudocan) (SDC4, Accession NM_002999), a gene which is a cell surface proteoglycan. Accordingly, utilities of VGAM2463 include diagnosis, prevention and treatment of diseases and clinical conditions associated with SDC4. The function of SDC4 and its association with various diseases and clinical conditions, has been established by previous studies, as described hereinabove with reference to VGAM552. SET7 (Accession NM_030648) is another VGAM2463 host target gene. SET7 BINDING SITE1 and SET7 BINDING SITE2 are HOST TARGET binding sites found in untranslated regions of mRNA encoded by SET7, corresponding to HOST TARGET binding sites such as BINDING SITE I, BINDING SITE II or BINDING SITE III. Table 2 illustrates the complementarity of the nucleotide sequences of SET7 BINDING SITE1 and SET7 BINDING SITE2, designated SEQ ID:24981 and SEQ ID:24982 respectively, to the nucleotide sequence of VGAM2463 RNA, herein designated VGAM RNA, also designated SEQ ID:5174.

Another function of VGAM2463 is therefore inhibition of SET7 (Accession NM_030648). Accordingly, utilities of VGAM2463 include diagnosis, prevention and treatment of diseases and clinical conditions associated with SET7. Sine Oculis Homeobox Homolog 3 (Drosophila) (SIX3, Accession NM_005413) is another VGAM2463 host target gene. SIX3 BINDING SITE is HOST TARGET binding site found in the 5' untranslated region of mRNA encoded by SIX3, corresponding to a HOST TARGET binding site such as BINDING SITE I, BINDING SITE II or BINDING SITE III. Table 2 illustrates the complementarity of the nucleotide sequences of SIX3 BINDING SITE, designated SEQ ID:11882, to the nucleotide sequence of VGAM2463 RNA, herein designated VGAM RNA, also designated SEQ ID:5174.

Another function of VGAM2463 is therefore inhibition of Sine Oculis Homeobox Homolog 3 (Drosophila) (SIX3, Accession NM_005413), a gene which may be involved in visual system development. Accordingly, utilities of VGAM2463 include diagnosis, prevention and treatment of diseases and clinical conditions associated with SIX3. The function of SIX3 has been established by previous studies. Holoprosencephaly (HPE) is a common, severe malformation of the brain that involves separation of the central nervous system into left and right halves. Mild HPE can consist of signs such as a single central incisor, hypotelorism, microcephaly, or other craniofacial findings that can be present with or without associated brain malformations. The etiology of HPE is highly heterogeneous, with the proposed participation of a minimum of 12 HPE-associated genetic loci as well as the causal involvement of specific teratogens acting at the earliest stages of neurulation (Roessler and Muenke, 1998). Schell et al. (1996) mapped the HPE2 (OMIM Ref. No. 157170) locus to a 1-Mb interval on 2p21 and defined a minimal critical region by a set of 6 overlapping deletions and 3 clustered translocations in HPE patients. Wallis et al. (1999) described the isolation and characterization of the homeo box-containing SIX3 gene from the HPE2 minimal critical region. They showed that at least 2 of the HPE-associated translocation breakpoints in 2p21 are less than 200 kb from the 5-prime end of SIX3. Mutational analysis identified 4 different mutations in the homeodomain of SIX3 that were predicted to interfere with transcriptional activation and were associated with HPE. Wallis et al. (1999) proposed that SIX3 is the HPE2 gene, essential for the development of the anterior neural plate and eyes in human S.

Full details of the abovementioned studies are described in the following publications, the disclosure of which are hereby incorporated by reference:

Roessler, E.; Muenke, M.: Holoprosencephaly: a paradigm for the complex genetics of brain development. J. Inherit. Metab. Dis. 21:481-497, 1998; and Wallis, D. E.; Roessler, E.; Hehr, U.; Nanni, L.; Wiltshire, T.; Richieri-Costa, A.; Gillessen-Kaesbach, G.; Zackai, E. H.; Rommens, J.; Muenke, M.: Mutations in the homeodomain of t.

Further studies establishing the function and utilities of SIX3 are found in John Hopkins OMIM database record ID 603714, and in sited publications numbered 5287-529 and 11447 listed in the bibliography section hereinbelow, which are also hereby incorporated by reference. Solute Carrier Family 16 (monocarboxylic acid transporters), Member 2 (putative transporter) (SLC16A2, Accession NM_006517) is another VGAM2463 host target gene. SLC16A2 BINDING SITE is HOST TARGET binding site found in the 3' untranslated region of mRNA encoded by SLC16A2, corresponding to a HOST TARGET binding site such as BINDING SITE I, BINDING SITE II or BINDING SITE III. Table 2 illustrates the complementarity of the nucleotide sequences of SLC16A2 BINDING SITE, designated SEQ ID:13269, to the nucleotide sequence of VGAM2463 RNA, herein designated VGAM RNA, also designated SEQ ID:5174.

Another function of VGAM2463 is therefore inhibition of Solute Carrier Family 16 (monocarboxylic acid transporters), Member 2 (putative transporter) (SLC16A2, Accession NM_006517). Accordingly, utilities of VGAM2463 include diagnosis, prevention and treatment of diseases and clinical conditions associated with SLC16A2. Solute Carrier Family 6 (neurotransmitter transporter, creatine), Member 8 (SLC6A8, Accession NM_005629) is another VGAM2463 host target gene. SLC6A8 BINDING SITE is HOST TARGET binding site found in the 3' untranslated region of mRNA encoded by SLC6A8, corresponding to a HOST TARGET binding site such as BINDING SITE I, BINDING SITE II or BINDING SITE III. Table 2 illustrates the complementarity of the nucleotide sequences of SLC6A8 BINDING SITE, designated SEQ ID:12150, to the nucleotide sequence of VGAM2463 RNA, herein designated VGAM RNA, also designated SEQ ID:5174.

Another function of VGAM2463 is therefore inhibition of Solute Carrier Family 6 (neurotransmitter transporter, creatine), Member 8 (SLC6A8, Accession NM_005629). Accordingly, utilities of VGAM2463 include diagnosis, prevention and treatment of diseases and clinical conditions associated with SLC6A8. Solute Carrier Family 9 (sodium/hydrogen exchanger), Isoform 5 (SLC9A5, Accession NM_004594) is another VGAM2463 host target gene. SLC9A5 BINDING SITE1 and SLC9A5 BINDING SITE2 are HOST TARGET binding sites found in untranslated regions of mRNA encoded by SLC9A5, corresponding to HOST TARGET binding sites such as BINDING SITE I, BINDING SITE II or BINDING SITE III. Table 2 illustrates the complementarity of the nucleotide sequences of SLC9A5 BINDING SITE1 and SLC9A5 BINDING SITE2, designated SEQ ID:10936 and SEQ ID:30065 respectively, to the nucleotide sequence of VGAM2463 RNA, herein designated VGAM RNA, also designated SEQ ID:5174.

Another function of VGAM2463 is therefore inhibition of Solute Carrier Family 9 (sodium/hydrogen exchanger), Isoform 5 (SLC9A5, Accession NM_004594). Accordingly, utilities of VGAM2463 include diagnosis, prevention and treatment of diseases and clinical conditions associated with SLC9A5. Stanniocalcin 1 (STC1, Accession NM_003155) is another VGAM2463 host target gene. STC1 BINDING SITE is HOST TARGET binding site found in the 3' untranslated region of mRNA encoded by STC1, corresponding to a HOST TARGET binding site such as BINDING SITE I, BINDING SITE II or BINDING SITE III. Table 2 illustrates the complementarity of the nucleotide sequences of STC1 BINDING SITE, designated SEQ ID:9134, to the nucleotide sequence of VGAM2463 RNA, herein designated VGAM RNA, also designated SEQ ID:5174.

Another function of VGAM2463 is therefore inhibition of Stanniocalcin 1 (STC1, Accession NM_003155), a gene which stimulates renal phosphate reabsorption, and could therefore prevent hypercalcemia. Accordingly, utilities of VGAM2463 include diagnosis, prevention and treatment of diseases and clinical conditions associated with STC1. The function of STC1 and its association with various diseases and clinical conditions, has been established by previous studies, as described hereinabove with reference to VGAM623. Serine/threonine Kinase 13 (aurora/IPL1-like) (STK13, Accession NM_003160) is another VGAM2463 host target gene. STK13 BINDING SITE is HOST TARGET binding site found in the 5' untranslated region of mRNA encoded by STK13, corresponding to a HOST TARGET binding site such as BINDING SITE I, BINDING SITE II or BINDING SITE III. Table 2 illustrates the complementarity of the nucleotide sequences of STK13 BINDING SITE, designated SEQ ID:9139, to the nucleotide sequence of VGAM2463 RNA, herein designated VGAM RNA, also designated SEQ ID:5174.

Another function of VGAM2463 is therefore inhibition of Serine/threonine Kinase 13 (aurora/IPL1-like) (STK13, Accession NM_003160), a gene which is a testis-specific serine/threonine kinase. Accordingly, utilities of VGAM2463 include diagnosis, prevention and treatment of diseases and clinical conditions associated with STK13. The function of STK13 has been established by previous studies. The Drosophila 'Aurora' and S. cerevisiae Ipl1 protein kinases are involved in mitotic events such as centrosome separation and chromosome segregation. By screening a human placenta library with Xenopus Eg2 (an Aurora/Ipl1-related kinase) cDNA, Bernard et al. (1998) isolated a partial STK13 cDNA. They obtained a full-length cDNA using RACE on testis mRNA. The catalytic domain of the predicted 275-amino acid protein shares 80% and 68% identity with those of AURORA2 (OMIM Ref. No. 603072) and AIK (OMIM Ref. No. 602687), respectively. Independently, Tseng et al. (1998) isolated cDNAs encoding 2 novel protein kinases, mouse Aie1 (Aurora/Ipl1/EG2-1) and human STK13, which they designated AIE2. Both Aie1 and AIE2 contain a central serine/threonine kinase domain. The authors reported that AIE2 contains 309 amino acids. Northern blot analysis detected expression of a 1.35-kb AIE2 mRNA only in testis. Full-grown Xenopus oocytes arrest at the G2/M border of meiosis I. Progesterone breaks this arrest, leading to the resumption of the meiotic cell cycles and maturation of the oocyte into a fertilizable egg. In these oocytes, progesterone interacts with an unidentified surface-associated receptor, which induces a nontranscriptional signaling pathway that stimulates the translation of dormant c-mos mRNA. The translational recruitment of c-mos and several other mRNAs is regulated by cytoplasmic polyadenylation, a process that requires two 3-prime untranslated regions, the cytoplasmic polyadenylation element (CPE) and the polyadenylation hexanucleotide AAUAAA. Mendez et al. (2000) demonstrated that an early site-specific phosphorylation of CPEB (the CPE binding factor) is essential for the polyadenylation of c-mos mRNA and its subsequent translation, and for oocyte maturation. In addition, they showed that this selective, early phosphorylation of CPEB is catalyzed by Eg2.

Full details of the abovementioned studies are described in the following publications, the disclosure of which are hereby incorporated by reference:

Bernard, M.; Sanseau, P.; Henry, C.; Couturier, A.; Prigent, C.: Cloning of STK13, a third human protein kinase related to Drosophila Aurora and budding yeast Ipl1 that maps on chromosome 19q13.3-ter. Genomics 53:406-409, 1998; and Mendez, R.; Hake, L. E.; Andresson, T.; Littlepage, L. E.; Ruderman, J. V.; Richter, J. D.: Phosphorylation of CPE binding factor by Eg2 regulates translation of c-mos mRNA. Nature 404.

Further studies establishing the function and utilities of STK13 are found in John Hopkins OMIM database record ID 603495, and in sited publications numbered 851 and 10269 listed in the bibliography section hereinbelow, which are also hereby incorporated by reference. Suppressor of Fused Homolog (Drosophila) (SUFU, Accession NM_016169) is another VGAM2463 host target gene. SUFU BINDING SITE is HOST TARGET binding site found in the 3' untranslated region of mRNA encoded by SUFU, corresponding to a HOST TARGET binding site such as BINDING SITE I, BINDING SITE II or BINDING SITE III. Table 2 illustrates the complementarity of the nucleotide sequences of SUFU BINDING SITE, designated SEQ ID:18257, to the nucleotide sequence of VGAM2463 RNA, herein designated VGAM RNA, also designated SEQ ID:5174.

Another function of VGAM2463 is therefore inhibition of Suppressor of Fused Homolog (Drosophila) (SUFU, Accession NM_016169). Accordingly, utilities of VGAM2463 include diagnosis, prevention and treatment of diseases and clinical conditions associated with SUFU. Suppressor of Ty 6 Homolog (S. cerevisiae) (SUPT6H, Accession XM_017037) is another VGAM2463 host target gene. SUPT6H BINDING SITE is HOST TARGET binding site found in the 3" untranslated region of mRNA encoded by SUPT6H, corresponding to a HOST TARGET binding site such as BINDING SITE I, BINDING SITE II or BINDING SITE III. Table 2 illustrates the complementarity of the nucleotide sequences of SUPT6H BINDING SITE, designated SEQ ID:30292, to the nucleotide sequence of VGAM2463 RNA, herein designated VGAM RNA, also designated SEQ ID:5174.

Another function of VGAM2463 is therefore inhibition of Suppressor of Ty 6 Homolog (S. cerevisiae) (SUPT6H, Accession XM_017037), a gene which may normally act to repress transcription at a variety of loci, and also plays a role in chromatin structure or assembly. Accordingly, utilities of VGAM2463 include diagnosis, prevention and treatment of diseases and clinical conditions associated with SUPT6H. The function of SUPT6H and its association with various diseases and clinical conditions, has been established by previous studies, as described hereinabove with reference to VGAM1959. Transforming, Acidic Coiled-coil Containing Protein 1 (TACC1, Accession NM_006283) is another VGAM2463 host target gene. TACC1 BINDING SITE is HOST TARGET binding site found in the 3' untranslated region of mRNA encoded by TACC1, corresponding to a HOST TARGET binding site such as BINDING SITE I, BINDING SITE II or BINDING SITE III. Table 2 illustrates the complementarity of the nucleotide sequences of TACC1 BINDING SITE, designated SEQ ID:12964, to the nucleotide sequence of VGAM2463 RNA, herein designated VGAM RNA, also designated SEQ ID:5174.

Another function of VGAM2463 is therefore inhibition of Transforming, Acidic Coiled-coil Containing Protein 1 (TACC1, Accession NM_006283). Accordingly, utilities of VGAM2463 include diagnosis, prevention and treatment of diseases and clinical conditions associated with TACC1. Tafazzin (cardiomyopathy, dilated 3A (X-linked); Endocardial Fibroelastosis 2; Barth Syndrome) (TAZ, Accession NM_000116) is another VGAM2463 host target gene. TAZ BINDING SITE is HOST TARGET binding site found in the 3' untranslated region of mRNA encoded by TAZ, corresponding to a HOST TARGET binding site such as BINDING SITE I, BINDING SITE II or BINDING SITE III. Table 2 illustrates the complementarity of the nucleotide sequences of TAZ BINDING SITE, designated SEQ ID:5585, to the nucleotide sequence of VGAM2463 RNA, herein designated VGAM RNA, also designated SEQ ID:5174.

Another function of VGAM2463 is therefore inhibition of Tafazzin (cardiomyopathy, dilated 3A (X-linked); Endocardial Fibroelastosis 2; Barth Syndrome) (TAZ, Accession NM_000116). Accordingly, utilities of VGAM2463 include diagnosis, prevention and treatment of diseases and clinical conditions associated with TAZ. Telomeric Repeat Binding Factor 2 (TERF2, Accession NM_005652) is another VGAM2463 host target gene. TERF2 BINDING SITE is HOST TARGET binding site found in the 3' untranslated region of mRNA encoded by TERF2, corresponding to a HOST TARGET binding site such as BINDING SITE I, BINDING SITE II or BINDING SITE III. Table 2 illustrates the complementarity of the nucleotide sequences of TERF2 BINDING SITE, designated SEQ ID:12189, to the nucleotide sequence of VGAM2463 RNA, herein designated VGAM RNA, also designated SEQ ID:5174.

Another function of VGAM2463 is therefore inhibition of Telomeric Repeat Binding Factor 2 (TERF2, Accession NM_005652), a gene which plays a key role in the protective activity of telomeres. Accordingly, utilities of VGAM2463 include diagnosis, prevention and treatment of diseases and clinical conditions associated with TERF2. The function of TERF2 and its association with various diseases and clinical conditions, has been established by previous studies, as described hereinabove with reference to VGAM1689. TIRAP (Accession NM_052887) is another VGAM2463 host target gene. TIRAP BINDING SITE is HOST TARGET binding site found in the 3' untranslated region of mRNA encoded by TIRAP, corresponding to a HOST TARGET binding site such as BINDING SITE I, BINDING SITE II or BINDING SITE III. Table 2 illustrates the complementarity of the nucleotide sequences of TIRAP BINDING SITE, designated SEQ ID:27477, to the nucleotide sequence of VGAM2463 RNA, herein designated VGAM RNA, also designated SEQ ID:5174.

Another function of VGAM2463 is therefore inhibition of TIRAP (Accession NM_052887), a gene which is a adapter involved in theTLR4 signaling pathway in the innate immune response. Accordingly, utilities of VGAM2463 include diagnosis, prevention and treatment of diseases and clinical conditions associated with TIRAP. The function of TIRAP and its association with various diseases and clinical conditions, has been established by previous studies, as described hereinabove with reference to VGAM189. Thiopurine S-methyltransferase (TPMT, Accession NM_000367) is another VGAM2463 host target gene. TPMT BINDING SITE is HOST TARGET binding site found in the 3' untranslated region of mRNA encoded by TPMT, corresponding to a HOST TARGET binding site such as BINDING SITE I, BINDING SITE II or BINDING SITE III. Table 2 illustrates the complementarity of the nucleotide sequences of TPMT BINDING SITE, designated SEQ ID:5939, to the nucleotide sequence of VGAM2463 RNA, herein designated VGAM RNA, also designated SEQ ID:5174.

Another function of VGAM2463 is therefore inhibition of Thiopurine S-methyltransferase (TPMT, Accession NM_000367), a gene which catalyzes the s-methylation of thiopurine drugs such as 6-mercaptopurine. Accordingly, utilities of VGAM2463 include diagnosis, prevention and treatment of diseases and clinical conditions associated with TPMT. The function of TPMT and its association with various diseases and clinical conditions, has been established by previous studies, as described hereinabove with reference to VGAM682. Unc-5 Homolog B (C. elegans) (UNC5C, Accession NM_003728) is another VGAM2463 host target gene. UNC5C BINDING SITE is HOST TARGET binding site found in the 5' untranslated region of mRNA encoded by UNC5C, corresponding to a HOST TARGET binding site such as BINDING SITE I, BINDING SITE II or BINDING SITE III. Table 2 illustrates the complementarity of the nucleotide sequences of UNC5C BINDING SITE, designated SEQ ID:9819, to the nucleotide sequence of VGAM2463 RNA, herein designated VGAM RNA, also designated SEQ ID:5174.

Another function of VGAM2463 is therefore inhibition of Unc-5 Homolog B (C. elegans) (UNC5C, Accession NM_003728), a gene which is a putative receptor for netrin, which is involved in axon guidance. Accordingly, utilities of VGAM2463 include diagnosis, prevention and treatment of diseases and clinical conditions associated with UNC5C. The function of UNC5C and its association with various diseases and clinical conditions, has been established by previous studies, as described hereinabove with reference to VGAM298. Vasodilator-stimulated Phosphoprotein (VASP, Accession NM_003370) is another VGAM2463 host target gene. VASP BINDING SITE is HOST TARGET binding site found in the 3' untranslated region of mRNA encoded by VASP, corresponding to a HOST TARGET binding site such as BINDING SITE I, BINDING SITE II or BINDING SITE III. Table 2 illustrates the complementarity of the nucleotide sequences of VASP BINDING SITE, designated SEQ ID:9397, to the nucleotide sequence of VGAM2463 RNA, herein designated VGAM RNA, also designated SEQ ID:5174.

Another function of VGAM2463 is therefore inhibition of Vasodilator-stimulated Phosphoprotein (VASP, Accession NM_003370), a gene which may act in concert with profilin to convey signal transduction to actin filament production. Accordingly, utilities of VGAM2463 include diagnosis, prevention and treatment of diseases and clinical conditions associated with VASP. The function of VASP has been established by previous studies. Human platelet activation is inhibited by agents such as prostaglandins and NO donors, which elevate cAMP or cGMP levels. The vasodilator-stimulated phosphoprotein (VASP) is phosphorylated in human platelets in response to both cAMP- and cGMP-elevating agents, and its phosphorylation correlates with platelet inhibition. Haffner et al. (1995) cloned the VASP gene from human and canine cells and showed that VASP is a 380-amino acid protein with a predicted molecular mass of 39.8 kD. Brindle et al. (1996) showed that VASP binds to the proline-rich domain of vinculin (OMIM Ref. No. 193065). They suggested that this interaction is important for actin-filament assembly and focal adhesion stability. Zimmer et al. (1996) cloned human and mouse VASP from genomic cosmid libraries. They determined that the human and mouse VASP genes are 89% identical at the amino acid level and are both assembled of 13 exons and span a genomic DNA region of approximately 20 kb. They mapped human VASP to chromosome 19q13.2-q13.3 using fluorescence in situ hybridization. They noted that VASP is located about 92 kb distal to ERCC1 (OMIM Ref. No. 126380) and about 300 kb proximal to the myotonic dystrophy protein kinase gene (OMIM Ref. No. 160900).

Full details of the abovementioned studies are described in the following publications, the disclosure of which are hereby incorporated by reference:

Brindle, N. P. J.; Holt, M. R.; Davies, J. E.; Price, C. J.; Critchley, D. R.: The focal-adhesion vasodilator-stimulated phosphoprotein (VASP) binds to the proline-rich domain in vinculin. Biochem. J. 318:753-757, 1996; and Zimmer, M.; Fink, T.; Fischer, L.; Hauser, W.; Scherer, K.; Lichter, P.; Walter, U.: Cloning of the VASP (vasodilator-stimulated phosphoprotein) genes in human and mouse: structure, seque.

Further studies establishing the function and utilities of VASP are found in John Hopkins OMIM database record ID 601703, and in sited publications numbered 2862-2864 listed in the bibliography section hereinbelow, which are also hereby incorporated by reference. Wingless-type MMTV Integration Site Family, Member 1 (WNT1, Accession NM_005430) is another VGAM2463 host target gene. WNT1 BINDING SITE is HOST TARGET binding site found in the 3' untranslated region of mRNA encoded by WNT1, corresponding to a HOST TARGET binding site such as BINDING SITE I, BINDING SITE II or BINDING SITE III. Table 2 illustrates the complementarity of the nucleotide sequences of WNT1 BINDING SITE, designated SEQ ID:11897, to the nucleotide sequence of VGAM2463 RNA, herein designated VGAM RNA, also designated SEQ ID:5174.

Another function of VGAM2463 is therefore inhibition of Wingless-type MMTV Integration Site Family, Member 1 (WNT1, Accession NM_005430), a gene which may have a role in development of the central nervous system. Accordingly, utilities of VGAM2463 include diagnosis, prevention and treatment of diseases and clinical conditions associated with WNT1. The function of WNT1 and its association with various diseases and clinical conditions, has been established by previous studies, as described hereinabove with reference to VGAM381. Wingless-type MMTV Integration Site Family, Member 5B (WNT5B, Accession NM_032642) is another VGAM2463 host target gene. WNT5B BINDING SITE1 and WNT5B BINDING SITE2 are HOST TARGET binding sites found in untranslated regions of mRNA encoded by WNT5B, corresponding to HOST TARGET binding sites such as BINDING SITE I, BINDING SITE II or BINDING SITE III. Table 2 illustrates the complementarity of the nucleotide sequences of WNT5B BINDING SITE1 and WNT5B BINDING SITE2, designated SEQ ID:26360 and SEQ ID:25058 respectively, to the nucleotide sequence of VGAM2463 RNA, herein designated VGAM RNA, also designated SEQ ID:5174.

Another function of VGAM2463 is therefore inhibition of Wingless-type MMTV Integration Site Family, Member 5B (WNT5B, Accession NM_032642), a gene which is the ligand for members of the frizzled family of seven transmembrane receptors and may be a signaling molecule. Accordingly, utilities of VGAM2463 include diagnosis, prevention and treatment of diseases and clinical conditions associated with WNT5B. The function of WNT5B and its association with various diseases and clinical conditions, has been established by previous studies, as described hereinabove with reference to VGAM1928. A Kinase (PRKA) Anchor Protein 11 (AKAP11, Accession NM_016248) is another VGAM2463 host target gene. AKAP11 BINDING SITE is HOST TARGET binding site found in the 3' untranslated region of mRNA encoded by AKAP11, corresponding to a HOST TARGET binding site such as BINDING SITE I, BINDING SITE II or BINDING SITE III. Table 2 illustrates the complementarity of the nucleotide sequences of AKAP11 BINDING SITE, designated SEQ ID:18375, to the nucleotide sequence of VGAM2463 RNA, herein designated VGAM RNA, also designated SEQ ID:5174.

Another function of VGAM2463 is therefore inhibition of A Kinase (PRKA) Anchor Protein 11 (AKAP11, Accession NM_016248). Accordingly, utilities of VGAM2463 include diagnosis, prevention and treatment of diseases and clinical conditions associated with AKAP11. Angiomotin (AMOT, Accession NM_133265) is another VGAM2463 host target gene. AMOT BINDING SITE is HOST TARGET binding site found in the 5' untranslated region of mRNA encoded by AMOT, corresponding to a HOST TARGET binding site such as BINDING SITE I, BINDING SITE II or BINDING SITE III. Table 2 illustrates the complementarity of the nucleotide sequences of AMOT BINDING SITE, designated SEQ ID:28419, to the nucleotide sequence of VGAM2463 RNA, herein designated VGAM RNA, also designated SEQ ID:5174.

Another function of VGAM2463 is therefore inhibition of Angiomotin (AMOT, Accession NM_133265). Accordingly, utilities of VGAM2463 include diagnosis, prevention and treatment of diseases and clinical conditions associated with AMOT. BA108L7.2 (Accession NM_030971) is another VGAM2463 host target gene. BA108L7.2 BINDING SITE is HOST TARGET binding site found in the 3' untranslated region of mRNA encoded by BA108L7.2, corresponding to a HOST TARGET binding site such as BINDING SITE I, BINDING SITE II or BINDING SITE III. Table 2 illustrates the complementarity of the nucleotide sequences of BA108L7.2 BINDING SITE, designated SEQ ID:25238, to the nucleotide sequence of VGAM2463 RNA, herein designated VGAM RNA, also designated SEQ ID:5174.

Another function of VGAM2463 is therefore inhibition of BA108L7.2 (Accession NM_030971). Accordingly, utilities of VGAM2463 include diagnosis, prevention and treatment of diseases and clinical conditions associated with BA108L7.2. Bifunctional Apoptosis Regulator (BFAR, Accession XM_027311) is another VGAM2463 host target gene. BFAR BINDING SITE is HOST TARGET binding site found in the 5' untranslated region of mRNA encoded by BFAR, corresponding to a HOST TARGET binding site such as BINDING SITE I, BINDING SITE II or BINDING SITE III. Table 2 illustrates the complementarity of the nucleotide sequences of BFAR BINDING SITE, designated SEQ ID:30479, to the nucleotide sequence of VGAM2463 RNA, herein designated VGAM RNA, also designated SEQ ID:5174.

Another function of VGAM2463 is therefore inhibition of Bifunctional Apoptosis Regulator (BFAR, Accession XM_027311). Accordingly, utilities of VGAM2463 include diagnosis, prevention and treatment of diseases and clinical conditions associated with BFAR. Chromosome 11 Open Reading Frame 11 (C11orf11, Accession XM_167769) is another VGAM2463 host target gene. C11orf11 BINDING SITE is HOST TARGET binding site found in the 3' untranslated region of mRNA encoded by C11orf11, corresponding to a HOST TARGET binding site such as BINDING SITE I, BINDING SITE II or BINDING SITE III. Table 2 illustrates the complementarity of the nucleotide sequences of C11orf11 BINDING SITE, designated SEQ ID:44787, to the nucleotide sequence of VGAM2463 RNA, herein designated VGAM RNA, also designated SEQ ID:5174.

Another function of VGAM2463 is therefore inhibition of Chromosome 11 Open Reading Frame 11 (C11orf11, Accession XM_167769). Accordingly, utilities of VGAM2463 include diagnosis, prevention and treatment of diseases and clinical conditions associated with C11orf11. Chromosome 17 Open Reading Frame 31 (C17orf31, Accession NM_017575) is another VGAM2463 host target gene. C17orf31 BINDING SITE is HOST TARGET binding site found in the 5' untranslated region of mRNA encoded by C17orf31, corresponding to a HOST TARGET binding site such as BINDING SITE I, BINDING SITE II or BINDING SITE III. Table 2 illustrates the complementarity of the nucleotide sequences of C17orf31 BINDING SITE, designated SEQ ID:19004, to the nucleotide sequence of VGAM2463 RNA, herein designated VGAM RNA, also designated SEQ ID:5174.

Another function of VGAM2463 is therefore inhibition of Chromosome 17 Open Reading Frame 31 (C17orf31, Accession NM_017575). Accordingly, utilities of VGAM2463 include diagnosis, prevention and treatment of diseases and clinical conditions associated with C17orf31. C1q and Tumor Necrosis Factor Related Protein 2 (C1QTNF2, Accession NM_031908) is another VGAM2463 host target gene. C1QTNF2 BINDING SITE is HOST TARGET binding site found in the 3" untranslated region of mRNA encoded by C1QTNF2, corresponding to a HOST TARGET binding site such as BINDING SITE I, BINDING SITE II or BINDING SITE III. Table 2 illustrates the complementarity of the nucleotide sequences of C1QTNF2 BINDING SITE, designated SEQ ID:25651, to the nucleotide sequence of VGAM2463 RNA, herein designated VGAM RNA, also designated SEQ ID:5174.

Another function of VGAM2463 is therefore inhibition of C1q and Tumor Necrosis Factor Related Protein 2 (C1QTNF2, Accession NM_031908). Accordingly, utilities of VGAM2463 include diagnosis, prevention and treatment of diseases and clinical conditions associated with C1QTNF2. Chromosome 20 Open Reading Frame 142 (C20orf142, Accession XM_059257) is another VGAM2463 host target gene. C20orf142 BINDING SITE is HOST TARGET binding site found in the 3" untranslated region of mRNA encoded by C20orf142, corresponding to a HOST TARGET binding site such as BINDING SITE I, BINDING SITE II or BINDING SITE III. Table 2 illustrates the complementarity of the nucleotide sequences of C20orf142 BINDING SITE, designated SEQ ID:36930, to the nucleotide sequence of VGAM2463 RNA, herein designated VGAM RNA, also designated SEQ ID:5174.

Another function of VGAM2463 is therefore inhibition of Chromosome 20 Open Reading Frame 142 (C20orf142, Accession XM_059257). Accordingly, utilities of VGAM2463 include diagnosis, prevention and treatment of diseases and clinical conditions associated with C20orf142. Chromosome 22 Open Reading Frame 4 (C22orf4, Accession XM_027143) is another VGAM2463 host target gene. C22orf4 BINDING SITE1 and C22orf4 BINDING SITE2 are HOST TARGET binding sites found in untranslated regions of mRNA encoded by C22orf4, corresponding to HOST TARGET binding sites such as BINDING SITE I, BINDING SITE II or BINDING SITE III. Table 2 illustrates the complementarity of the nucleotide sequences of C22orf4 BINDING SITE1 and C22orf4 BINDING SITE2, designated SEQ ID:30422 and SEQ ID:30423 respectively, to the nucleotide sequence of VGAM2463 RNA, herein designated VGAM RNA, also designated SEQ ID:5174.

Another function of VGAM2463 is therefore inhibition of Chromosome 22 Open Reading Frame 4 (C22orf4, Accession XM_027143). Accordingly, utilities of VGAM2463 include diagnosis, prevention and treatment of diseases and clinical conditions associated with C22orf4. Calcium/calmodulin-dependent Protein Kinase Kinase 2, Beta (CAMKK2, Accession NM_006549) is another VGAM2463 host target gene. CAMKK2 BINDING SITE is HOST TARGET binding site found in the 3' untranslated region of mRNA encoded by CAMKK2, corresponding to a HOST TARGET binding site such as BINDING SITE I, BINDING SITE II or BINDING SITE III. Table 2 illustrates the complementarity of the nucleotide sequences of CAMKK2 BINDING SITE, designated SEQ ID:13311, to the nucleotide sequence of VGAM2463 RNA, herein designated VGAM RNA, also designated SEQ ID:5174.

Another function of VGAM2463 is therefore inhibition of Calcium/calmodulin-dependent Protein Kinase Kinase 2, Beta (CAMKK2, Accession NM_006549). Accordingly, utilities of VGAM2463 include diagnosis, prevention and treatment of diseases and clinical conditions associated with CAMKK2. CDP-diacylglycerol--inositol 3-phosphatidyltransferase (phosphatidylinositol synthase) (CDIPT, Accession NM_006319) is another VGAM2463 host target gene. CDIPT BINDING SITE is HOST TARGET binding site found in the 3' untranslated region of mRNA encoded by CDIPT, corresponding to a HOST TARGET binding site such as BINDING SITE I, BINDING SITE II or BINDING SITE III. Table 2 illustrates the complementarity of the nucleotide sequences of CDIPT BINDING SITE, designated SEQ ID:13009, to the nucleotide sequence of VGAM2463 RNA, herein designated VGAM RNA, also designated SEQ ID:5174.

Another function of VGAM2463 is therefore inhibition of CDP-diacylglycerol--inositol 3-phosphatidyltransferase (phosphatidylinositol synthase) (CDIPT, Accession NM_006319). Accordingly, utilities of VGAM2463 include diagnosis, prevention and treatment of diseases and clinical conditions associated with CDIPT. Cat Eye Syndrome Chromosome Region, Candidate 6 (CECR6, Accession NM_031890) is another VGAM2463 host target gene. CECR6 BINDING SITE is HOST TARGET binding site found in the 3' untranslated region of mRNA encoded by CECR6, corresponding to a HOST TARGET binding site such as BINDING SITE I, BINDING SITE II or BINDING SITE III. Table 2 illustrates the complementarity of the nucleotide sequences of CECR6 BINDING SITE, designated SEQ ID:25637, to the nucleotide sequence of VGAM2463 RNA, herein designated VGAM RNA, also designated SEQ ID:5174.

Another function of VGAM2463 is therefore inhibition of Cat Eye Syndrome Chromosome Region, Candidate 6 (CECR6, Accession NM_031890). Accordingly, utilities of VGAM2463 include diagnosis, prevention and treatment of diseases and clinical conditions associated with CECR6. Choline Kinase (CHK, Accession NM_001277) is another VGAM2463 host target gene. CHK BINDING SITE is HOST TARGET binding site found in the 3' untranslated region of mRNA encoded by CHK, corresponding to a HOST TARGET binding site such as BINDING SITE I, BINDING SITE II or BINDING SITE III. Table 2 illustrates the complementarity of the nucleotide sequences of CHK BINDING SITE, designated SEQ ID:6945, to the nucleotide sequence of VGAM2463 RNA, herein designated VGAM RNA, also designated SEQ ID:5174.

Another function of VGAM2463 is therefore inhibition of Choline Kinase (CHK, Accession NM_001277). Accordingly, utilities of VGAM2463 include diagnosis, prevention and treatment of diseases and clinical conditions associated with CHK. Calsyntenin 3 (CLSTN3, Accession NM_014718) is another VGAM2463 host target gene. CLSTN3 BINDING SITE1 and CLSTN3 BINDING SITE2 are HOST TARGET binding sites found in untranslated regions of mRNA encoded by CLSTN3, corresponding to HOST TARGET binding sites such as BINDING SITE I, BINDING SITE II or BINDING SITE III. Table 2 illustrates the complementarity of the nucleotide sequences of CLSTN3 BINDING SITE1 and CLSTN3 BINDING SITE2, designated SEQ ID:16274 and SEQ ID:16275 respectively, to the nucleotide sequence of VGAM2463 RNA, herein designated VGAM RNA, also designated SEQ ID:5174.

Another function of VGAM2463 is therefore inhibition of Calsyntenin 3 (CLSTN3, Accession NM_014718). Accordingly, utilities of VGAM2463 include diagnosis, prevention and treatment of diseases and clinical conditions associated with CLSTN3. Cyclin M3 (CNNM3, Accession NM_017623) is another VGAM2463 host target gene. CNNM3 BINDING SITE is HOST TARGET binding site found in the 3' untranslated region of mRNA encoded by CNNM3, corresponding to a HOST TARGET binding site such as BINDING SITE I, BINDING SITE II or BINDING SITE III. Table 2 illustrates the complementarity of the nucleotide sequences of CNNM3 BINDING SITE, designated SEQ ID:19124, to the nucleotide sequence of VGAM2463 RNA, herein designated VGAM RNA, also designated SEQ ID:5174.

Another function of VGAM2463 is therefore inhibition of Cyclin M3 (CNNM3, Accession NM_017623). Accordingly, utilities of VGAM2463 include diagnosis, prevention and treatment of diseases and clinical conditions associated with CNNM3. DCNP1 (Accession NM_130848) is another VGAM2463 host target gene. DCNP1 BINDING SITE is HOST TARGET binding site found in the 3' untranslated region of mRNA encoded by DCNP1, corresponding to a HOST TARGET binding site such as BINDING SITE I, BINDING SITE II or BINDING SITE III. Table 2 illustrates the complementarity of the nucleotide sequences of DCNP1 BINDING SITE, designated SEQ ID:28384, to the nucleotide sequence of VGAM2463 RNA, herein designated VGAM RNA, also designated SEQ ID:5174.

Another function of VGAM2463 is therefore inhibition of DCNP1 (Accession NM_130848). Accordingly, utilities of VGAM2463 include diagnosis, prevention and treatment of diseases and clinical conditions associated with DCNP1. Diacylglycerol Kinase, Delta 130 kDa (DGKD, Accession XM_002384) is another VGAM2463 host target gene. DGKD BINDING SITE1 and DGKD BINDING SITE2 are HOST TARGET binding sites found in untranslated regions of mRNA encoded by DGKD, corresponding to HOST TARGET binding sites such as BINDING SITE I, BINDING SITE II or BINDING SITE III. Table 2 illustrates the complementarity of the nucleotide sequences of DGKD BINDING SITE1 and DGKD BINDING SITE2, designated SEQ ID:29880 and SEQ ID:29882 respectively, to the nucleotide sequence of VGAM2463 RNA, herein designated VGAM RNA, also designated SEQ ID:5174.

Another function of VGAM2463 is therefore inhibition of Diacylglycerol Kinase, Delta 130 kDa (DGKD, Accession XM_002384). Accordingly, utilities of VGAM2463 include diagnosis, prevention and treatment of diseases and clinical conditions associated with DGKD. DKFZP434N178 (Accession XM_050278) is another VGAM2463 host target gene. DKFZP434N178 BINDING SITE is HOST TARGET binding site found in the 5' untranslated region of mRNA encoded by DKFZP434N178, corresponding to a HOST TARGET binding site such as BINDING SITE I, BINDING SITE II or BINDING SITE III. Table 2 illustrates the complementarity of the nucleotide sequences of DKFZP434N178 BINDING SITE, designated SEQ ID:35596, to the nucleotide sequence of VGAM2463 RNA, herein designated VGAM RNA, also designated SEQ ID:5174.

Another function of VGAM2463 is therefore inhibition of DKFZP434N178 (Accession XM_050278). Accordingly, utilities of VGAM2463 include diagnosis, prevention and treatment of diseases and clinical conditions associated with DKFZP434N178. DKFZp547I094 (Accession NM_032155) is another VGAM2463 host target gene. DKFZp547I094 BINDING SITE is HOST TARGET binding site found in the 5' untranslated region of mRNA encoded by DKFZp547I094, corresponding to a HOST TARGET binding site such as BINDING SITE I, BINDING SITE II or BINDING SITE III. Table 2 illustrates the complementarity of the nucleotide sequences of DKFZp547I094 BINDING SITE, designated SEQ ID:25856, to the nucleotide sequence of VGAM2463 RNA, herein designated VGAM RNA, also designated SEQ ID:5174.

Another function of VGAM2463 is therefore inhibition of DKFZp547I094 (Accession NM_032155). Accordingly, utilities of VGAM2463 include diagnosis, prevention and treatment of diseases and clinical conditions associated with DKFZp547I094. DKFZp547M072 (Accession XM_028067) is another VGAM2463 host target gene. DKFZp547M072 BINDING SITE1 and DKFZp547M072 BINDING SITE2 are HOST TARGET binding sites found in untranslated regions of mRNA encoded by DKFZp547M072, corresponding to HOST TARGET binding sites such as BINDING SITE I, BINDING SITE II or BINDING SITE III. Table 2 illustrates the complementarity of the nucleotide sequences of DKFZp547M072 BINDING SITE1 and DKFZp547M072 BINDING SITE2, designated SEQ ID:30617 and SEQ ID:30618 respectively, to the nucleotide sequence of VGAM2463 RNA, herein designated VGAM RNA, also designated SEQ ID:5174.

Another function of VGAM2463 is therefore inhibition of DKFZp547M072 (Accession XM_028067). Accordingly, utilities of VGAM2463 include diagnosis, prevention and treatment of diseases and clinical conditions associated with DKFZp547M072. DKFZP586M1120 (Accession NM_031294) is another VGAM2463 host target gene. DKFZP586M1120 BINDING SITE is HOST TARGET binding site found in the 3' untranslated region of mRNA encoded by DKFZP586M1120, corresponding to a HOST TARGET binding site such as BINDING SITE I, BINDING SITE II or BINDING SITE III. Table 2 illustrates the complementarity of the nucleotide sequences of DKFZP586M1120 BINDING SITE, designated SEQ ID:25321, to the nucleotide sequence of VGAM2463 RNA, herein designated VGAM RNA, also designated SEQ ID:5174.

Another function of VGAM2463 is therefore inhibition of DKFZP586M1120 (Accession NM_031294). Accordingly, utilities of VGAM2463 include diagnosis, prevention and treatment of diseases and clinical conditions associated with DKFZP586M1120. DKFZp762A227 (Accession NM_014096) is another VGAM2463 host target gene. DKFZp762A227 BINDING SITE is HOST TARGET binding site found in the 5' untranslated region of mRNA encoded by DKFZp762A227, corresponding to a HOST TARGET binding site such as BINDING SITE I, BINDING SITE II or BINDING SITE III. Table 2 illustrates the complementarity of the nucleotide sequences of DKFZp762A227 BINDING SITE, designated SEQ ID:15319, to the nucleotide sequence of VGAM2463 RNA, herein designated VGAM RNA, also designated SEQ ID:5174.

Another function of VGAM2463 is therefore inhibition of DKFZp762A227 (Accession NM_014096). Accordingly, utilities of VGAM2463 include diagnosis, prevention and treatment of diseases and clinical conditions associated with DKFZp762A227. EFS2 (Accession NM_005864) is another VGAM2463 host target gene. EFS2 BINDING SITE is HOST TARGET binding site found in the 3' untranslated region of mRNA encoded by EFS2, corresponding to a HOST TARGET binding site such as BINDING SITE I, BINDING SITE II or BINDING SITE III. Table 2 illustrates the complementarity of the nucleotide sequences of EFS2 BINDING SITE, designated SEQ ID:12477, to the nucleotide sequence of VGAM2463 RNA, herein designated VGAM RNA, also designated SEQ ID:5174.

Another function of VGAM2463 is therefore inhibition of EFS2 (Accession NM_005864). Accordingly, utilities of VGAM2463 include diagnosis, prevention and treatment of diseases and clinical conditions associated with EFS2. Ets2 Repressor Factor (ERF, Accession NM_006494) is another VGAM2463 host target gene. ERF BINDING SITE is HOST TARGET binding site found in the 3' untranslated region of mRNA encoded by ERF, corresponding to a HOST TARGET binding site such as BINDING SITE I, BINDING SITE II or BINDING SITE III. Table 2 illustrates the complementarity of the nucleotide sequences of ERF BINDING SITE, designated SEQ ID:13235, to the nucleotide sequence of VGAM2463 RNA, herein designated VGAM RNA, also designated SEQ ID:5174.

Another function of VGAM2463 is therefore inhibition of Ets2 Repressor Factor (ERF, Accession NM_006494). Accordingly, utilities of VGAM2463 include diagnosis, prevention and treatment of diseases and clinical conditions associated with ERF. Fem-1 Homolog B (C. elegans) (FEM1B, Accession NM_015322) is another VGAM2463 host target gene. FEM1B BINDING SITE is HOST TARGET binding site found in the 5' untranslated region of mRNA encoded by FEM1B, corresponding to a HOST TARGET binding site such as BINDING SITE I, BINDING SITE II or BINDING SITE III. Table 2 illustrates the complementarity of the nucleotide sequences of FEM1B BINDING SITE, designated SEQ ID:17641, to the nucleotide sequence of VGAM2463 RNA, herein designated VGAM RNA, also designated SEQ ID:5174.

Another function of VGAM2463 is therefore inhibition of Fem-1 Homolog B (C. elegans) (FEM1B, Accession NM_015322). Accordingly, utilities of VGAM2463 include diagnosis, prevention and treatment of diseases and clinical conditions associated with FEM1B. FHX (Accession NM_018416) is another VGAM2463 host target gene. FHX BINDING SITE is HOST TARGET binding site found in the 5' untranslated region of mRNA encoded by FHX, corresponding to a HOST TARGET binding site such as BINDING SITE I, BINDING SITE II or BINDING SITE III. Table 2 illustrates the complementarity of the nucleotide sequences of FHX BINDING SITE, designated SEQ ID:20458, to the nucleotide sequence of VGAM2463 RNA, herein designated VGAM RNA, also designated SEQ ID:5174.

Another function of VGAM2463 is therefore inhibition of FHX (Accession NM_018416). Accordingly, utilities of VGAM2463 include diagnosis, prevention and treatment of diseases and clinical conditions associated with FHX. FLJ00024 (Accession XM_033361) is another VGAM2463 host target gene. FLJ00024 BINDING SITE is HOST TARGET binding site found in the 3' untranslated region of mRNA encoded by FLJ00024, corresponding to a HOST TARGET binding site such as BINDING SITE I, BINDING SITE II or BINDING SITE III. Table 2 illustrates the complementarity of the nucleotide sequences of FLJ00024 BINDING SITE, designated SEQ ID:31890, to the nucleotide sequence of VGAM2463 RNA, herein designated VGAM RNA, also designated SEQ ID:5174.

Another function of VGAM2463 is therefore inhibition of FLJ00024 (Accession XM_033361). Accordingly, utilities of VGAM2463 include diagnosis, prevention and treatment of diseases and clinical conditions associated with FLJ00024. FLJ00058 (Accession XM_086123) is another VGAM2463 host target gene. FLJ00058 BINDING SITE is HOST TARGET binding site found in the 5' untranslated region of mRNA encoded by FLJ00058, corresponding to a HOST TARGET binding site such as BINDING SITE I, BINDING SITE II or BINDING SITE III. Table 2 illustrates the complementarity of the nucleotide sequences of FLJ00058 BINDING SITE, designated SEQ ID:38510, to the nucleotide sequence of VGAM2463 RNA, herein designated VGAM RNA, also designated SEQ ID:5174.

Another function of VGAM2463 is therefore inhibition of FLJ00058 (Accession XM_086123). Accordingly, utilities of VGAM2463 include diagnosis, prevention and treatment of diseases and clinical conditions associated with FLJ00058. FLJ10276 (Accession NM_018045) is another VGAM2463 host target gene. FLJ10276 BINDING SITE is HOST TARGET binding site found in the 3' untranslated region of mRNA encoded by FLJ10276, corresponding to a HOST TARGET binding site such as BINDING SITE I, BINDING SITE II or BINDING SITE III. Table 2 illustrates the complementarity of the nucleotide sequences of FLJ10276 BINDING SITE, designated SEQ ID:19792, to the nucleotide sequence of VGAM2463 RNA, herein designated VGAM RNA, also designated SEQ ID:5174.

Another function of VGAM2463 is therefore inhibition of FLJ10276 (Accession NM_018045). Accordingly, utilities of VGAM2463 include diagnosis, prevention and treatment of diseases and clinical conditions associated with FLJ10276. FLJ10769 (Accession NM_018210) is another VGAM2463 host target gene. FLJ10769 BINDING SITE is HOST TARGET binding site found in the 3' untranslated region of mRNA encoded by FLJ10769, corresponding to a HOST TARGET binding site such as BINDING SITE I, BINDING SITE II or BINDING SITE III. Table 2 illustrates the complementarity of the nucleotide sequences of FLJ10769 BIND- ING SITE, designated SEQ ID:20113, to the nucleotide sequence of VGAM2463 RNA, herein designated VGAM RNA, also designated SEQ ID:5174.

Another function of VGAM2463 is therefore inhibition of FLJ10769 (Accession NM_018210). Accordingly, utilities of VGAM2463 include diagnosis, prevention and treatment of diseases and clinical conditions associated with FLJ10769. FLJ11807 (Accession NM_024954) is another VGAM2463 host target gene. FLJ11807 BINDING SITE is HOST TARGET binding site found in the 3' untranslated region of mRNA encoded by FLJ11807, corresponding to a HOST TARGET binding site such as BINDING SITE I, BINDING SITE II or BINDING SITE III. Table 2 illustrates the complementarity of the nucleotide sequences of FLJ11807 BINDING SITE, designated SEQ ID:24512, to the nucleotide sequence of VGAM2463 RNA, herein designated VGAM RNA, also designated SEQ ID:5174.

Another function of VGAM2463 is therefore inhibition of FLJ11807 (Accession NM_024954). Accordingly, utilities of VGAM2463 include diagnosis, prevention and treatment of diseases and clinical conditions associated with FLJ11807. FLJ13114 (Accession NM_024541) is another VGAM2463 host target gene. FLJ13114 BINDING SITE is HOST TARGET binding site found in the 3' untranslated region of mRNA encoded by FLJ13114, corresponding to a HOST TARGET binding site such as BINDING SITE I, BINDING SITE II or BINDING SITE III. Table 2 illustrates the complementarity of the nucleotide sequences of FLJ13114 BINDING SITE, designated SEQ ID:23752, to the nucleotide sequence of VGAM2463 RNA, herein designated VGAM RNA, also designated SEQ ID:5174.

Another function of VGAM2463 is therefore inhibition of FLJ13114 (Accession NM_024541). Accordingly, utilities of VGAM2463 include diagnosis, prevention and treatment of diseases and clinical conditions associated with FLJ13114. FLJ13154 (Accession NM_024598) is another VGAM2463 host target gene. FLJ13154 BINDING SITE is HOST TARGET binding site found in the 3' untranslated region of mRNA encoded by FLJ13154, corresponding to a HOST TARGET binding site such as BINDING SITE I, BINDING SITE II or BINDING SITE III. Table 2 illustrates the complementarity of the nucleotide sequences of FLJ13154 BINDING SITE, designated SEQ ID:23844, to the nucleotide sequence of VGAM2463 RNA, herein designated VGAM RNA, also designated SEQ ID:5174.

Another function of VGAM2463 is therefore inhibition of FLJ13154 (Accession NM_024598). Accordingly, utilities of VGAM2463 include diagnosis, prevention and treatment of diseases and clinical conditions associated with FLJ13154. FLJ13158 (Accession NM_024909) is another VGAM2463 host target gene. FLJ13158 BINDING SITE is HOST TARGET binding site found in the 3' untranslated region of mRNA encoded by FLJ13158, corresponding to a HOST TARGET binding site such as BINDING SITE I, BINDING SITE II or BINDING SITE III. Table 2 illustrates the complementarity of the nucleotide sequences of FLJ13158 BINDING SITE, designated SEQ ID:24410, to the nucleotide sequence of VGAM2463 RNA, herein designated VGAM RNA, also designated SEQ ID:5174.

Another function of VGAM2463 is therefore inhibition of FLJ13158 (Accession NM_024909). Accordingly, utilities of VGAM2463 include diagnosis, prevention and treatment of diseases and clinical conditions associated with FLJ13158. FLJ13189 (Accession NM_024882) is another VGAM2463 host target gene. FLJ13189 BINDING SITE is HOST TARGET binding site found in the 5' untranslated region of mRNA encoded by FLJ13189, corresponding to a HOST TARGET binding site such as BINDING SITE I, BINDING SITE II or BINDING SITE III. Table 2 illustrates the complementarity of the nucleotide sequences of FLJ13189 BINDING SITE, designated SEQ ID:24332, to the nucleotide sequence of VGAM2463 RNA, herein designated VGAM RNA, also designated SEQ ID:5174.

Another function of VGAM2463 is therefore inhibition of FLJ13189 (Accession NM_024882). Accordingly, utilities of VGAM2463 include diagnosis, prevention and treatment of diseases and clinical conditions associated with FLJ13189. FLJ13193 (Accession NM_032177) is another VGAM2463 host target gene. FLJ13193 BINDING SITE is HOST TARGET binding site found in the 3' untranslated region of mRNA encoded by FLJ13193, corresponding to a HOST TARGET binding site such as BINDING SITE I, BINDING SITE II or BINDING SITE III. Table 2 illustrates the complementarity of the nucleotide sequences of FLJ13193 BINDING SITE, designated SEQ ID:25892, to the nucleotide sequence of VGAM2463 RNA, herein designated VGAM RNA, also designated SEQ ID:5174.

Another function of VGAM2463 is therefore inhibition of FLJ13193 (Accession NM_032177). Accordingly, utilities of VGAM2463 include diagnosis, prevention and treatment of diseases and clinical conditions associated with FLJ13193. FLJ13612 (Accession NM_025202) is another VGAM2463 host target gene. FLJ13612 BINDING SITE1 and FLJ13612 BINDING SITE2 are HOST TARGET binding sites found in untranslated regions of mRNA encoded by FLJ13612, corresponding to HOST TARGET binding sites such as BINDING SITE I, BINDING SITE II or BINDING SITE III. Table 2 illustrates the complementarity of the nucleotide sequences of FLJ13612 BINDING SITE1 and FLJ13612 BINDING SITE2, designated SEQ ID:24861 and SEQ ID:24862 respectively, to the nucleotide sequence of VGAM2463 RNA, herein designated VGAM RNA, also designated SEQ ID:5174.

Another function of VGAM2463 is therefore inhibition of FLJ13612 (Accession NM_025202). Accordingly, utilities of VGAM2463 include diagnosis, prevention and treatment of diseases and clinical conditions associated with FLJ13612. FLJ14154 (Accession NM_024845) is another VGAM2463 host target gene. FLJ14154 BINDING SITE is HOST TARGET binding site found in the 3' untranslated region of mRNA encoded by FLJ14154, corresponding to a HOST TARGET binding site such as BINDING SITE I, BINDING SITE II or BINDING SITE III. Table 2 illustrates the complementarity of the nucleotide sequences of FLJ14154 BINDING SITE, designated SEQ ID:24271, to the nucleotide sequence of VGAM2463 RNA, herein designated VGAM RNA, also designated SEQ ID:5174.

Another function of VGAM2463 is therefore inhibition of FLJ14154 (Accession NM_024845). Accordingly, utilities of VGAM2463 include diagnosis, prevention and treatment of diseases and clinical conditions associated with FLJ14154. FLJ14249 (Accession NM_106552) is another VGAM2463 host target gene. FLJ14249 BINDING SITE1 and FLJ14249 BINDING SITE2 are HOST TARGET binding sites found in untranslated regions of mRNA encoded by FLJ14249, corresponding to HOST TARGET binding sites such as BINDING SITE I, BINDING SITE II or BINDING SITE III. Table 2 illustrates the complementarity of the nucleotide sequences of FLJ14249 BINDING SITE1 and FLJ14249 BINDING SITE2, designated SEQ ID:28170 and SEQ ID:22800 respectively, to the nucleotide sequence of VGAM2463 RNA, herein designated VGAM RNA, also designated SEQ ID:5174.

Another function of VGAM2463 is therefore inhibition of FLJ14249 (Accession NM_106552). Accordingly, utilities of VGAM2463 include diagnosis, prevention and treatment of diseases and clinical conditions associated with FLJ14249.

FLJ14442 (Accession NM_032785) is another VGAM2463 host target gene. FLJ14442 BINDING SITE is HOST TARGET binding site found in the 3' untranslated region of mRNA encoded by FLJ14442, corresponding to a HOST TARGET binding site such as BINDING SITE I, BINDING SITE II or BINDING SITE III. Table 2 illustrates the complementarity of the nucleotide sequences of FLJ14442 BINDING SITE, designated SEQ ID:26537, to the nucleotide sequence of VGAM2463 RNA, herein designated VGAM RNA, also designated SEQ ID:5174.

Another function of VGAM2463 is therefore inhibition of FLJ14442 (Accession NM_032785). Accordingly, utilities of VGAM2463 include diagnosis, prevention and treatment of diseases and clinical conditions associated with FLJ14442.

FLJ20378 (Accession NM_017795) is another VGAM2463 host target gene. FLJ20378 BINDING SITE is HOST TARGET binding site found in the 3' untranslated region of mRNA encoded by FLJ20378, corresponding to a HOST TARGET binding site such as BINDING SITE I, BINDING SITE II or BINDING SITE III. Table 2 illustrates the complementarity of the nucleotide sequences of FLJ20378 BINDING SITE, designated SEQ ID:19436, to the nucleotide sequence of VGAM2463 RNA, herein designated VGAM RNA, also designated SEQ ID:5174.

Another function of VGAM2463 is therefore inhibition of FLJ20378 (Accession NM_017795). Accordingly, utilities of VGAM2463 include diagnosis, prevention and treatment of diseases and clinical conditions associated with FLJ20378.

FLJ20651 (Accession NM_017919) is another VGAM2463 host target gene. FLJ20651 BINDING SITE is HOST TARGET binding site found in the 3' untranslated region of mRNA encoded by FLJ20651, corresponding to a HOST TARGET binding site such as BINDING SITE I, BINDING SITE II or BINDING SITE III. Table 2 illustrates the complementarity of the nucleotide sequences of FLJ20651 BINDING SITE, designated SEQ ID:19575, to the nucleotide sequence of VGAM2463 RNA, herein designated VGAM RNA, also designated SEQ ID:5174.

Another function of VGAM2463 is therefore inhibition of FLJ20651 (Accession NM_017919). Accordingly, utilities of VGAM2463 include diagnosis, prevention and treatment of diseases and clinical conditions associated with FLJ20651.

FLJ20694 (Accession NM_017928) is another VGAM2463 host target gene. FLJ20694 BINDING SITE is HOST TARGET binding site found in the 3' untranslated region of mRNA encoded by FLJ20694, corresponding to a HOST TARGET binding site such as BINDING SITE I, BINDING SITE II or BINDING SITE III. Table 2 illustrates the complementarity of the nucleotide sequences of FLJ20694 BINDING SITE, designated SEQ ID:19608, to the nucleotide sequence of VGAM2463 RNA, herein designated VGAM RNA, also designated SEQ ID:5174.

Another function of VGAM2463 is therefore inhibition of FLJ20694 (Accession NM_017928). Accordingly, utilities of VGAM2463 include diagnosis, prevention and treatment of diseases and clinical conditions associated with FLJ20694.

FLJ21596 (Accession NM_024823) is another VGAM2463 host target gene. FLJ21596 BINDING SITE is HOST TARGET binding site found in the 3' untranslated region of mRNA encoded by FLJ21596, corresponding to a HOST TARGET binding site such as BINDING SITE I, BINDING SITE II or BINDING SITE III. Table 2 illustrates the complementarity of the nucleotide sequences of FLJ21596 BINDING SITE, designated SEQ ID:24212, to the nucleotide sequence of VGAM2463 RNA, herein designated VGAM RNA, also designated SEQ ID:5174.

Another function of VGAM2463 is therefore inhibition of FLJ21596 (Accession NM_024823). Accordingly, utilities of VGAM2463 include diagnosis, prevention and treatment of diseases and clinical conditions associated with FLJ21596.

FLJ22551 (Accession NM_024708) is another VGAM2463 host target gene. FLJ22551 BINDING SITE is HOST TARGET binding site found in the 5' untranslated region of mRNA encoded by FLJ22551, corresponding to a HOST TARGET binding site such as BINDING SITE I, BINDING SITE II or BINDING SITE III. Table 2 illustrates the complementarity of the nucleotide sequences of FLJ22551 BINDING SITE, designated SEQ ID:24027, to the nucleotide sequence of VGAM2463 RNA, herein designated VGAM RNA, also designated SEQ ID:5174.

Another function of VGAM2463 is therefore inhibition of FLJ22551 (Accession NM_024708). Accordingly, utilities of VGAM2463 include diagnosis, prevention and treatment of diseases and clinical conditions associated with FLJ22551.

FLJ22679 (Accession NM_032227) is another VGAM2463 host target gene. FLJ22679 BINDING SITE1 and FLJ22679 BINDING SITE2 are HOST TARGET binding sites found in untranslated regions of mRNA encoded by FLJ22679, corresponding to HOST TARGET binding sites such as BINDING SITE I, BINDING SITE II or BINDING SITE III. Table 2 illustrates the complementarity of the nucleotide sequences of FLJ22679 BINDING SITE1 and FLJ22679 BINDING SITE2, designated SEQ ID:25951 and SEQ ID:19264 respectively, to the nucleotide sequence of VGAM2463 RNA, herein designated VGAM RNA, also designated SEQ ID:5174.

Another function of VGAM2463 is therefore inhibition of FLJ22679 (Accession NM_032227). Accordingly, utilities of VGAM2463 include diagnosis, prevention and treatment of diseases and clinical conditions associated with FLJ22679.

FLJ23537 (Accession NM_024889) is another VGAM2463 host target gene. FLJ23537 BINDING SITE is HOST TARGET binding site found in the 3' untranslated region of mRNA encoded by FLJ23537, corresponding to a HOST TARGET binding site such as BINDING SITE I, BINDING SITE II or BINDING SITE III. Table 2 illustrates the complementarity of the nucleotide sequences of FLJ23537 BINDING SITE, designated SEQ ID:24364, to the nucleotide sequence of VGAM2463 RNA, herein designated VGAM RNA, also designated SEQ ID:5174.

Another function of VGAM2463 is therefore inhibition of FLJ23537 (Accession NM_024889). Accordingly, utilities of VGAM2463 include diagnosis, prevention and treatment of diseases and clinical conditions associated with FLJ23537.

FLJ23563 (Accession XM_041701) is another VGAM2463 host target gene. FLJ23563 BINDING SITE is HOST TARGET binding site found in the 5' untranslated region of mRNA encoded by FLJ23563, corresponding to a HOST TARGET binding site such as BINDING SITE I, BINDING SITE II or BINDING SITE III. Table 2 illustrates the complementarity of the nucleotide sequences of FLJ23563 BINDING SITE, designated SEQ ID:33564, to the nucleotide sequence of VGAM2463 RNA, herein designated VGAM RNA, also designated SEQ ID:5174.

Another function of VGAM2463 is therefore inhibition of FLJ23563 (Accession XM_041701). Accordingly, utilities of VGAM2463 include diagnosis, prevention and treatment of diseases and clinical conditions associated with FLJ23563.

FLJ31952 (Accession NM_144682) is another VGAM2463 host target gene. FLJ31952 BINDING SITE is HOST TAR- GET binding site found in the 3' untranslated region of mRNA encoded by FLJ31952, corresponding to a HOST TARGET binding site such as BINDING SITE I, BINDING SITE II or BINDING SITE III. Table 2 illustrates the complementarity of the nucleotide sequences of FLJ31952 BINDING SITE, designated SEQ ID:29499, to the nucleotide sequence of VGAM2463 RNA, herein designated VGAM RNA, also designated SEQ ID:5174.

Another function of VGAM2463 is therefore inhibition of FLJ31952 (Accession NM_144682). Accordingly, utilities of VGAM2463 include diagnosis, prevention and treatment of diseases and clinical conditions associated with FLJ31952. FLJ32389 (Accession NM_144617) is another VGAM2463 host target gene. FLJ32389 BINDING SITE is HOST TARGET binding site found in the 3' untranslated region of mRNA encoded by FLJ32389, corresponding to a HOST TARGET binding site such as BINDING SITE I, BINDING SITE II or BINDING SITE III. Table 2 illustrates the complementarity of the nucleotide sequences of FLJ32389 BINDING SITE, designated SEQ ID:29434, to the nucleotide sequence of VGAM2463 RNA, herein designated VGAM RNA, also designated SEQ ID:5174.

Another function of VGAM2463 is therefore inhibition of FLJ32389 (Accession NM_144617). Accordingly, utilities of VGAM2463 include diagnosis, prevention and treatment of diseases and clinical conditions associated with FLJ32389. FLJ32884 (Accession NM_144702) is another VGAM2463 host target gene. FLJ32884 BINDING SITE is HOST TARGET binding site found in the 5' untranslated region of mRNA encoded by FLJ32884, corresponding to a HOST TARGET binding site such as BINDING SITE I, BINDING SITE II or BINDING SITE III. Table 2 illustrates the complementarity of the nucleotide sequences of FLJ32884 BINDING SITE, designated SEQ ID:29527, to the nucleotide sequence of VGAM2463 RNA, herein designated VGAM RNA, also designated SEQ ID:5174.

Another function of VGAM2463 is therefore inhibition of FLJ32884 (Accession NM_144702). Accordingly, utilities of VGAM2463 include diagnosis, prevention and treatment of diseases and clinical conditions associated with FLJ32884. Frequenin Homolog (Drosophila) (FREQ, Accession NM_014286) is another VGAM2463 host target gene. FREQ BINDING SITE is HOST TARGET binding site found in the 3' untranslated region of mRNA encoded by FREQ, corresponding to a HOST TARGET binding site such as BINDING SITE I, BINDING SITE II or BINDING SITE III. Table 2 illustrates the complementarity of the nucleotide sequences of FREQ BINDING SITE, designated SEQ ID:15563, to the nucleotide sequence of VGAM2463 RNA, herein designated VGAM RNA, also designated SEQ ID:5174.

Another function of VGAM2463 is therefore inhibition of Frequenin Homolog (Drosophila) (FREQ, Accession NM_014286). Accordingly, utilities of VGAM2463 include diagnosis, prevention and treatment of diseases and clinical conditions associated with FREQ. GABA(A) Receptors Associated Protein Like 3 (GABARAPL3, Accession NM_032568) is another VGAM2463 host target gene. GABARAPL3 BINDING SITE is HOST TARGET binding site found in the 5' untranslated region of mRNA encoded by GABARAPL3, corresponding to a HOST TARGET binding site such as BINDING SITE I, BINDING SITE II or BINDING SITE III. Table 2 illustrates the complementarity of the nucleotide sequences of GABARAPL3 BINDING SITE, designated SEQ ID:26299, to the nucleotide sequence of VGAM2463 RNA, herein designated VGAM RNA, also designated SEQ ID:5174.

Another function of VGAM2463 is therefore inhibition of GABA(A) Receptors Associated Protein Like 3 (GABARAPL3, Accession NM_032568). Accordingly, utilities of VGAM2463 include diagnosis, prevention and treatment of diseases and clinical conditions associated with GABARAPL3. Gamma-aminobutyric Acid (GABA) B Receptor, 1 (GABBR1, Accession NM_001470) is another VGAM2463 host target gene. GABBR1 BINDING SITE1 and GABBR1 BINDING SITE2 are HOST TARGET binding sites found in untranslated regions of mRNA encoded by GABBR1, corresponding to HOST TARGET binding sites such as BINDING SITE I, BINDING SITE II or BINDING SITE III. Table 2 illustrates the complementarity of the nucleotide sequences of GABBR1 BINDING SITE1 and GABBR1 BINDING SITE2, designated SEQ ID:7205 and SEQ ID:22422 respectively, to the nucleotide sequence of VGAM2463 RNA, herein designated VGAM RNA, also designated SEQ ID:5174.

Another function of VGAM2463 is therefore inhibition of Gamma-aminobutyric Acid (GABA) B Receptor, 1 (GABBR1, Accession NM_001470). Accordingly, utilities of VGAM2463 include diagnosis, prevention and treatment of diseases and clinical conditions associated with GABBR1. G Protein Pathway Suppressor 2 (GPS2, Accession XM_102749) is another VGAM2463 host target gene. GPS2 BINDING SITE1 and GPS2 BINDING SITE2 are HOST TARGET binding sites found in untranslated regions of mRNA encoded by GPS2, corresponding to HOST TARGET binding sites such as BINDING SITE I, BINDING SITE II or BINDING SITE III. Table 2 illustrates the complementarity of the nucleotide sequences of GPS2 BINDING SITE1 and GPS2 BINDING SITE2, designated SEQ ID:42148 and SEQ ID:10826 respectively, to the nucleotide sequence of VGAM2463 RNA, herein designated VGAM RNA, also designated SEQ ID:5174.

Another function of VGAM2463 is therefore inhibition of G Protein Pathway Suppressor 2 (GPS2, Accession XM_102749). Accordingly, utilities of VGAM2463 include diagnosis, prevention and treatment of diseases and clinical conditions associated with GPS2. GS3955 (Accession NM_021643) is another VGAM2463 host target gene. GS3955 BINDING SITE is HOST TARGET binding site found in the 5' untranslated region of mRNA encoded by GS3955, corresponding to a HOST TARGET binding site such as BINDING SITE I, BINDING SITE II or BINDING SITE III. Table 2 illustrates the complementarity of the nucleotide sequences of GS3955 BINDING SITE, designated SEQ ID:22302, to the nucleotide sequence of VGAM2463 RNA, herein designated VGAM RNA, also designated SEQ ID:5174.

Another function of VGAM2463 is therefore inhibition of GS3955 (Accession NM_021643). Accordingly, utilities of VGAM2463 include diagnosis, prevention and treatment of diseases and clinical conditions associated with GS3955. Histidyl-tRNA Synthetase 2 (HARS2, Accession NM_080820) is another VGAM2463 host target gene. HARS2 BINDING SITE is HOST TARGET binding site found in the 3' untranslated region of mRNA encoded by HARS2, corresponding to a HOST TARGET binding site such as BINDING SITE I, BINDING SITE II or BINDING SITE III. Table 2 illustrates the complementarity of the nucleotide sequences of HARS2 BINDING SITE, designated SEQ ID:28079, to the nucleotide sequence of VGAM2463 RNA, herein designated VGAM RNA, also designated SEQ ID:5174.

Another function of VGAM2463 is therefore inhibition of Histidyl-tRNA Synthetase 2 (HARS2, Accession NM_080820). Accordingly, utilities of VGAM2463 include diagnosis, prevention and treatment of diseases and clinical conditions associated with HARS2. Hypocretin (orexin) Receptor 1 (HCRTR1, Accession NM_001525) is another VGAM2463 host target gene. HCRTR1 BINDING SITE is HOST TARGET binding site found in the 5' untranslated region of mRNA encoded by HCRTR1, corresponding to a HOST TARGET binding site such as BINDING SITE I, BINDING SITE II or BINDING SITE III. Table 2 illustrates the complementarity of the nucleotide sequences of HCRTR1 BINDING SITE, designated SEQ ID:7263, to the nucleotide sequence of VGAM2463 RNA, herein designated VGAM RNA, also designated SEQ ID:5174.

Another function of VGAM2463 is therefore inhibition of Hypocretin (orexin) Receptor 1 (HCRTR1, Accession NM_001525). Accordingly, utilities of VGAM2463 include diagnosis, prevention and treatment of diseases and clinical conditions associated with HCRTR1. Hect Domain and RLD 3 (HERC3, Accession NM_014606) is another VGAM2463 host target gene. HERC3 BINDING SITE is HOST TARGET binding site found in the 3' untranslated region of mRNA encoded by HERC3, corresponding to a HOST TARGET binding site such as BINDING SITE I, BINDING SITE II or BINDING SITE III. Table 2 illustrates the complementarity of the nucleotide sequences of HERC3 BINDING SITE, designated SEQ ID:15972, to the nucleotide sequence of VGAM2463 RNA, herein designated VGAM RNA, also designated SEQ ID:5174.

Another function of VGAM2463 is therefore inhibition of Hect Domain and RLD 3 (HERC3, Accession NM_014606). Accordingly, utilities of VGAM2463 include diagnosis, prevention and treatment of diseases and clinical conditions associated with HERC3. Hairy/enhancer-of-split Related with YRPW Motif-like (HEYL, Accession NM_014571) is another VGAM2463 host target gene. HEYL BINDING SITE is HOST TARGET binding site found in the 3' untranslated region of mRNA encoded by HEYL, corresponding to a HOST TARGET binding site such as BINDING SITE I, BINDING SITE II or BINDING SITE III. Table 2 illustrates the complementarity of the nucleotide sequences of HEYL BINDING SITE, designated SEQ ID:15930, to the nucleotide sequence of VGAM2463 RNA, herein designated VGAM RNA, also designated SEQ ID:5174.

Another function of VGAM2463 is therefore inhibition of Hairy/enhancer-of-split Related with YRPW Motif-like (HEYL, Accession NM_014571). Accordingly, utilities of VGAM2463 include diagnosis, prevention and treatment of diseases and clinical conditions associated with HEYL. HNT (Accession NM_016522) is another VGAM2463 host target gene. HNT BINDING SITE is HOST TARGET binding site found in the 5' untranslated region of mRNA encoded by HNT, corresponding to a HOST TARGET binding site such as BINDING SITE I, BINDING SITE II or BINDING SITE III. Table 2 illustrates the complementarity of the nucleotide sequences of HNT BINDING SITE, designated SEQ ID:18594, to the nucleotide sequence of VGAM2463 RNA, herein designated VGAM RNA, also designated SEQ ID:5174.

Another function of VGAM2463 is therefore inhibition of HNT (Accession NM_016522). Accordingly, utilities of VGAM2463 include diagnosis, prevention and treatment of diseases and clinical conditions associated with HNT. HRIHFB2122 (Accession NM_007032) is another VGAM2463 host target gene. HRIHFB2122 BINDING SITE is HOST TARGET binding site found in the 3' untranslated region of mRNA encoded by HRIHFB2122, corresponding to a HOST TARGET binding site such as BINDING SITE I, BINDING SITE II or BINDING SITE III. Table 2 illustrates the complementarity of the nucleotide sequences of HRIHFB2122 BINDING SITE, designated SEQ ID:13900, to the nucleotide sequence of VGAM2463 RNA, herein designated VGAM RNA, also designated SEQ ID:5174.

Another function of VGAM2463 is therefore inhibition of HRIHFB2122 (Accession NM_007032). Accordingly, utilities of VGAM2463 include diagnosis, prevention and treatment of diseases and clinical conditions associated with HRIHFB2122. Integrin, Alpha 10 (ITGA10, Accession XM_002097) is another VGAM2463 host target gene. ITGA10 BINDING SITE is HOST TARGET binding site found in the 3' untranslated region of mRNA encoded by ITGA10, corresponding to a HOST TARGET binding site such as BINDING SITE I, BINDING SITE II or BINDING SITE III. Table 2 illustrates the complementarity of the nucleotide sequences of ITGA10 BINDING SITE, designated SEQ ID:29862, to the nucleotide sequence of VGAM2463 RNA, herein designated VGAM RNA, also designated SEQ ID:5174.

Another function of VGAM2463 is therefore inhibition of Integrin, Alpha 10 (ITGA10, Accession XM_002097). Accordingly, utilities of VGAM2463 include diagnosis, prevention and treatment of diseases and clinical conditions associated with ITGA10. KIAA0152 (Accession NM_014730) is another VGAM2463 host target gene. KIAA0152 BINDING SITE is HOST TARGET binding site found in the 3' untranslated region of mRNA encoded by KIAA0152, corresponding to a HOST TARGET binding site such as BINDING SITE I, BINDING SITE II or BINDING SITE III. Table 2 illustrates the complementarity of the nucleotide sequences of KIAA0152 BINDING SITE, designated SEQ ID:16336, to the nucleotide sequence of VGAM2463 RNA, herein designated VGAM RNA, also designated SEQ ID:5174.

Another function of VGAM2463 is therefore inhibition of KIAA0152 (Accession NM_014730). Accordingly, utilities of VGAM2463 include diagnosis, prevention and treatment of diseases and clinical conditions associated with KIAA0152. KIAA0237 (Accession NM_014747) is another VGAM2463 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16451, to the nucleotide sequence of VGAM2463 RNA, herein designated VGAM RNA, also designated SEQ ID:5174.

Another function of VGAM2463 is therefore inhibition of KIAA0237 (Accession NM_014747). Accordingly, utilities of VGAM2463 include diagnosis, prevention and treatment of diseases and clinical conditions associated with KIAA0237. KIAA0247 (Accession NM_014734) is another VGAM2463 host target gene. KIAA0247 BINDING SITE is HOST TARGET binding site found in the 3' untranslated region of mRNA encoded by KIAA0247, corresponding to a HOST TARGET binding site such as BINDING SITE I, BINDING SITE II or BINDING SITE III. Table 2 illustrates the complementarity of the nucleotide sequences of KIAA0247 BINDING SITE, designated SEQ ID:16377, to the nucleotide sequence of VGAM2463 RNA, herein designated VGAM RNA, also designated SEQ ID:5174.

Another function of VGAM2463 is therefore inhibition of KIAA0247 (Accession NM_014734). Accordingly, utilities of VGAM2463 include diagnosis, prevention and treatment of diseases and clinical conditions associated with KIAA0247. KIAA0256 (Accession XM_034905) is another VGAM2463 host target gene. KIAA0256 BINDING SITE is HOST TARGET binding site found in the 3' untranslated region of mRNA encoded by KIAA0256, corresponding to a HOST TARGET binding site such as BINDING SITE I, BINDING SITE II or BINDING SITE III. Table 2 illustrates the complementarity of the nucleotide sequences of KIAA0256 BINDING SITE, designated SEQ ID:32185, to the nucleotide sequence of VGAM2463 RNA, herein designated VGAM RNA, also designated SEQ ID:5174.

Another function of VGAM2463 is therefore inhibition of KIAA0256 (Accession XM_034905). Accordingly, utilities of VGAM2463 include diagnosis, prevention and treatment of diseases and clinical conditions associated with KIAA0256. KIAA0284 (Accession XM_032235) is another VGAM2463 host target gene. KIAA0284 BINDING SITE is HOST TARGET binding site found in the 3' untranslated region of mRNA encoded by KIAA0284, corresponding to a HOST TARGET binding site such as BINDING SITE I, BINDING SITE II or BINDING SITE III. Table 2 illustrates the complementarity of the nucleotide sequences of KIAA0284 BINDING SITE, designated SEQ ID:31619, to the nucleotide sequence of VGAM2463 RNA, herein designated VGAM RNA, also designated SEQ ID:5174.

Another function of VGAM2463 is therefore inhibition of KIAA0284 (Accession XM_032235). Accordingly, utilities of VGAM2463 include diagnosis, prevention and treatment of diseases and clinical conditions associated with KIAA0284. KIAA0321 (Accession XM_031077) is another VGAM2463 host target gene. KIAA0321 BINDING SITE1 and KIAA0321 BINDING SITE2 are HOST TARGET binding sites found in untranslated regions of mRNA encoded by KIAA0321, corresponding to HOST TARGET binding sites such as BINDING SITE I, BINDING SITE II or BINDING SITE III. Table 2 illustrates the complementarity of the nucleotide sequences of KIAA0321 BINDING SITE1 and KIAA0321 BINDING SITE2, designated SEQ ID:31267 and SEQ ID:31268 respectively, to the nucleotide sequence of VGAM2463 RNA, herein designated VGAM RNA, also designated SEQ ID:5174.

Another function of VGAM2463 is therefore inhibition of KIAA0321 (Accession XM_031077). Accordingly, utilities of VGAM2463 include diagnosis, prevention and treatment of diseases and clinical conditions associated with KIAA0321. KIAA0450 (Accession NM_014638) is another VGAM2463 host target gene. KIAA0450 BINDING SITE is HOST TARGET binding site found in the 3' untranslated region of mRNA encoded by KIAA0450, corresponding to a HOST TARGET binding site such as BINDING SITE I, BINDING SITE II or BINDING SITE III. Table 2 illustrates the complementarity of the nucleotide sequences of KIAA0450 BINDING SITE, designated SEQ ID:16031, to the nucleotide sequence of VGAM2463 RNA, herein designated VGAM RNA, also designated SEQ ID:5174.

Another function of VGAM2463 is therefore inhibition of KIAA0450 (Accession NM_014638). Accordingly, utilities of VGAM2463 include diagnosis, prevention and treatment of diseases and clinical conditions associated with KIAA0450. KIAA0451 (Accession NM_014826) is another VGAM2463 host target gene. KIAA0451 BINDING SITE1 and KIAA0451 BINDING SITE2 are HOST TARGET binding sites found in untranslated regions of mRNA encoded by KIAA0451, corresponding to HOST TARGET binding sites such as BINDING SITE I, BINDING SITE II or BINDING SITE III. Table 2 illustrates the complementarity of the nucleotide sequences of KIAA0451 BINDING SITE1 and KIAA0451 BINDING SITE2, designated SEQ ID:16805 and SEQ ID:16810 respectively, to the nucleotide sequence of VGAM2463 RNA, herein designated VGAM RNA, also designated SEQ ID:5174.

Another function of VGAM2463 is therefore inhibition of KIAA0451 (Accession NM_014826). Accordingly, utilities of VGAM2463 include diagnosis, prevention and treatment of diseases and clinical conditions associated with KIAA0451. KIAA0720 (Accession XM_030970) is another VGAM2463 host target gene. KIAA0720 BINDING SITE is HOST TARGET binding site found in the 3' untranslated region of mRNA encoded by KIAA0720, corresponding to a HOST TARGET binding site such as BINDING SITE I, BINDING SITE II or BINDING SITE III. Table 2 illustrates the complementarity of the nucleotide sequences of KIAA0720 BINDING SITE, designated SEQ ID:31238, to the nucleotide sequence of VGAM2463 RNA, herein designated VGAM RNA, also designated SEQ ID:5174.

Another function of VGAM2463 is therefore inhibition of KIAA0720 (Accession XM_030970). Accordingly, utilities of VGAM2463 include diagnosis, prevention and treatment of diseases and clinical conditions associated with KIAA0720. KIAA0775 (Accession NM_014726) is another VGAM2463 host target gene. KIAA0775 BINDING SITE is HOST TARGET binding site found in the 3' untranslated region of mRNA encoded by KIAA0775, corresponding to a HOST TARGET binding site such as BINDING SITE I, BINDING SITE II or BINDING SITE III. Table 2 illustrates the complementarity of the nucleotide sequences of KIAA0775 BINDING SITE, designated SEQ ID:16322, to the nucleotide sequence of VGAM2463 RNA, herein designated VGAM RNA, also designated SEQ ID:5174.

Another function of VGAM2463 is therefore inhibition of KIAA0775 (Accession NM_014726). Accordingly, utilities of VGAM2463 include diagnosis, prevention and treatment of diseases and clinical conditions associated with KIAA0775. KIAA0794 (Accession XM_087353) is another VGAM2463 host target gene. KIAA0794 BINDING SITE is HOST TARGET binding site found in the 3' untranslated region of mRNA encoded by KIAA0794, corresponding to a HOST TARGET binding site such as BINDING SITE I, BINDING SITE II or BINDING SITE III. Table 2 illustrates the complementarity of the nucleotide sequences of KIAA0794 BINDING SITE, designated SEQ ID:39180, to the nucleotide sequence of VGAM2463 RNA, herein designated VGAM RNA, also designated SEQ ID:5174.

Another function of VGAM2463 is therefore inhibition of KIAA0794 (Accession XM_087353). Accordingly, utilities of VGAM2463 include diagnosis, prevention and treatment of diseases and clinical conditions associated with KIAA0794. KIAA0889 (Accession NM_015377) is another VGAM2463 host target gene. KIAA0889 BINDING SITE is HOST TARGET binding site found in the 3' untranslated region of mRNA encoded by KIAA0889, corresponding to a HOST TARGET binding site such as BINDING SITE I, BINDING SITE II or BINDING SITE III. Table 2 illustrates the complementarity of the nucleotide sequences of KIAA0889 BINDING SITE, designated SEQ ID:17679, to the nucleotide sequence of VGAM2463 RNA, herein designated VGAM RNA, also designated SEQ ID:5174.

Another function of VGAM2463 is therefore inhibition of KIAA0889 (Accession NM_015377). Accordingly, utilities of VGAM2463 include diagnosis, prevention and treatment of diseases and clinical conditions associated with KIAA0889. KIAA0937 (Accession XM_166213) is another VGAM2463 host target gene. KIAA0937 BINDING SITE is HOST TARGET binding site found in the 3' untranslated region of mRNA encoded by KIAA0937, corresponding to a HOST TARGET binding site such as BINDING SITE I, BINDING SITE II or BINDING SITE III. Table 2 illustrates the complementarity of the nucleotide sequences of KIAA0937 BINDING SITE, designated SEQ ID:44017, to the nucleotide sequence of VGAM2463 RNA, herein designated VGAM RNA, also designated SEQ ID:5174.

Another function of VGAM2463 is therefore inhibition of KIAA0937 (Accession XM_166213). Accordingly, utilities of VGAM2463 include diagnosis, prevention and treatment of diseases and clinical conditions associated with KIAA0937. KIAA0939 (Accession XM_030524) is another VGAM2463 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31062, to the nucleotide sequence of VGAM2463 RNA, herein designated VGAM RNA, also designated SEQ ID:5174.

Another function of VGAM2463 is therefore inhibition of KIAA0939 (Accession XM_030524). Accordingly, utilities of VGAM2463 include diagnosis, prevention and treatment of diseases and clinical conditions associated with KIAA0939. KIAA1042 (Accession NM_014965) is another VGAM2463 host target gene. KIAA1042 BINDING SITE is HOST TARGET binding site found in the 3' untranslated region of mRNA encoded by KIAA1042, corresponding to a HOST TARGET binding site such as BINDING SITE I, BINDING SITE II or BINDING SITE III. Table 2 illustrates the complementarity of the nucleotide sequences of KIAA1042 BINDING SITE, designated SEQ ID:17351, to the nucleotide sequence of VGAM2463 RNA, herein designated VGAM RNA, also designated SEQ ID:5174.

Another function of VGAM2463 is therefore inhibition of KIAA1042 (Accession NM_014965). Accordingly, utilities of VGAM2463 include diagnosis, prevention and treatment of diseases and clinical conditions associated with KIAA1042. KIAA1076 (Accession XM_037523) is another VGAM2463 host target gene. KIAA1076 BINDING SITE is HOST TARGET binding site found in the 3' untranslated region of mRNA encoded by KIAA1076, corresponding to a HOST TARGET binding site such as BINDING SITE I, BINDING SITE II or BINDING SITE III. Table 2 illustrates the complementarity of the nucleotide sequences of KIAA1076 BINDING SITE, designated SEQ ID:32640, to the nucleotide sequence of VGAM2463 RNA, herein designated VGAM RNA, also designated SEQ ID:5174.

Another function of VGAM2463 is therefore inhibition of KIAA1076 (Accession XM_037523). Accordingly, utilities of VGAM2463 include diagnosis, prevention and treatment of diseases and clinical conditions associated with KIAA1076. KIAA1138 (Accession XM_030721) is another VGAM2463 host target gene. KIAA1138 BINDING SITE is HOST TARGET binding site found in the 3' untranslated region of mRNA encoded by KIAA1138, corresponding to a HOST TARGET binding site such as BINDING SITE I, BINDING SITE II or BINDING SITE III. Table 2 illustrates the complementarity of the nucleotide sequences of KIAA1138 BINDING SITE, designated SEQ ID:31127, to the nucleotide sequence of VGAM2463 RNA, herein designated VGAM RNA, also designated SEQ ID:5174.

Another function of VGAM2463 is therefore inhibition of KIAA1138 (Accession XM_030721). Accordingly, utilities of VGAM2463 include diagnosis, prevention and treatment of diseases and clinical conditions associated with KIAA1138. KIAA1172 (Accession XM_047889) is another VGAM2463 host target gene. KIAA1172 BINDING SITE is HOST TARGET binding site found in the 5' untranslated region of mRNA encoded by KIAA1172, corresponding to a HOST TARGET binding site such as BINDING SITE I, BINDING SITE II or BINDING SITE III. Table 2 illustrates the complementarity of the nucleotide sequences of KIAA1172 BINDING SITE, designated SEQ ID:35077, to the nucleotide sequence of VGAM2463 RNA, herein designated VGAM RNA, also designated SEQ ID:5174.

Another function of VGAM2463 is therefore inhibition of KIAA1172 (Accession XM_047889). Accordingly, utilities of VGAM2463 include diagnosis, prevention and treatment of diseases and clinical conditions associated with KIAA1172. KIAA1185 (Accession XM_031399) is another VGAM2463 host target gene. KIAA1185 BINDING SITE is HOST TARGET binding site found in the 3' untranslated region of mRNA encoded by KIAA1185, corresponding to a HOST TARGET binding site such as BINDING SITE I, BINDING SITE II or BINDING SITE III. Table 2 illustrates the complementarity of the nucleotide sequences of KIAA1185 BINDING SITE, designated SEQ ID:31371, to the nucleotide sequence of VGAM2463 RNA, herein designated VGAM RNA, also designated SEQ ID:5174.

Another function of VGAM2463 is therefore inhibition of KIAA1185 (Accession XM_031399). Accordingly, utilities of VGAM2463 include diagnosis, prevention and treatment of diseases and clinical conditions associated with KIAA1185. KIAA1193 (Accession XM_041843) is another VGAM2463 host target gene. KIAA1193 BINDING SITE is HOST TARGET binding site found in the 3' untranslated region of mRNA encoded by KIAA1193, corresponding to a HOST TARGET binding site such as BINDING SITE I, BINDING SITE II or BINDING SITE III. Table 2 illustrates the complementarity of the nucleotide sequences of KIAA1193 BINDING SITE, designated SEQ ID:33582, to the nucleotide sequence of VGAM2463 RNA, herein designated VGAM RNA, also designated SEQ ID:5174.

Another function of VGAM2463 is therefore inhibition of KIAA1193 (Accession XM_041843). Accordingly, utilities of VGAM2463 include diagnosis, prevention and treatment of diseases and clinical conditions associated with KIAA1193. KIAA1434 (Accession XM_045585) is another VGAM2463 host target gene. KIAA1434 BINDING SITE is HOST TARGET binding site found in the 3' untranslated region of mRNA encoded by KIAA1434, corresponding to a HOST TARGET binding site such as BINDING SITE I, BINDING SITE II or BINDING SITE III. Table 2 illustrates the complementarity of the nucleotide sequences of KIAA1434 BINDING SITE, designated SEQ ID:34489, to the nucleotide sequence of VGAM2463 RNA, herein designated VGAM RNA, also designated SEQ ID:5174.

Another function of VGAM2463 is therefore inhibition of KIAA1434 (Accession XM_045585). Accordingly, utilities of VGAM2463 include diagnosis, prevention and treatment of diseases and clinical conditions associated with KIAA1434. KIAA1538 (Accession XM_049474) is another VGAM2463 host target gene. KIAA1538 BINDING SITE1 through KIAA1538 BINDING SITE3 are HOST TARGET binding sites found in untranslated regions of mRNA encoded by KIAA1538, corresponding to HOST TARGET binding sites such as BINDING SITE I, BINDING SITE II or BINDING SITE III. Table 2 illustrates the complementarity of the nucleotide sequences of KIAA1538 BINDING SITE1 through KIAA1538 BINDING SITE3, designated SEQ ID:35426, SEQ ID:35427 and SEQ ID:35428 respectively, to the nucleotide sequence of VGAM2463 RNA, herein designated VGAM RNA, also designated SEQ ID:5174.

Another function of VGAM2463 is therefore inhibition of KIAA1538 (Accession XM_049474). Accordingly, utilities of VGAM2463 include diagnosis, prevention and treatment of diseases and clinical conditions associated with KIAA1538. KIAA1656 (Accession XM_038022) is another VGAM2463 host target gene. KIAA1656 BINDING SITE1 and KIAA1656 BINDING SITE2 are HOST TARGET binding sites found in untranslated regions of mRNA encoded by KIAA1656, corresponding to HOST TARGET binding sites such as BINDING SITE I, BINDING SITE II or BINDING SITE III. Table 2 illustrates the complementarity of the nucleotide sequences of KIAA1656 BINDING SITE1 and KIAA1656 BINDING SITE2, designated SEQ ID:32730 and SEQ ID:32731 respectively, to the nucleotide sequence of VGAM2463 RNA, herein designated VGAM RNA, also designated SEQ ID:5174.

Another function of VGAM2463 is therefore inhibition of KIAA1656 (Accession XM_038022). Accordingly, utilities of VGAM2463 include diagnosis, prevention and treatment of diseases and clinical conditions associated with KIAA1656. KIAA1775 (Accession NM_033100) is another VGAM2463 host target gene. KIAA1775 BINDING SITE is HOST TARGET binding site found in the 3' untranslated region of mRNA encoded by KIAA1775, corresponding to a HOST TARGET binding site such as BINDING SITE I, BINDING SITE II or BINDING SITE III. Table 2 illustrates the complementarity of the nucleotide sequences of KIAA1775 BINDING SITE, designated SEQ ID:26944, to the nucleotide sequence of VGAM2463 RNA, herein designated VGAM RNA, also designated SEQ ID:5174.

Another function of VGAM2463 is therefore inhibition of KIAA1775 (Accession NM_033100). Accordingly, utilities of VGAM2463 include diagnosis, prevention and treatment of diseases and clinical conditions associated with KIAA1775. KIAA1831 (Accession XM_033366) is another VGAM2463 host target gene. KIAA1831 BINDING SITE is HOST TARGET binding site found in the 5' untranslated region of mRNA encoded by KIAA1831, corresponding to a HOST TARGET binding site such as BINDING SITE I, BINDING SITE II or BINDING SITE III. Table 2 illustrates the complementarity of the nucleotide sequences of KIAA1831 BINDING SITE, designated SEQ ID:31904, to the nucleotide sequence of VGAM2463 RNA, herein designated VGAM RNA, also designated SEQ ID:5174.

Another function of VGAM2463 is therefore inhibition of KIAA1831 (Accession XM_033366). Accordingly, utilities of VGAM2463 include diagnosis, prevention and treatment of diseases and clinical conditions associated with KIAA1831. KIAA1855 (Accession XM_166453) is another VGAM2463 host target gene. KIAA1855 BINDING SITE is HOST TARGET binding site found in the 3' untranslated region of mRNA encoded by KIAA1855, corresponding to a HOST TARGET binding site such as BINDING SITE I, BINDING SITE II or BINDING SITE III. Table 2 illustrates the complementarity of the nucleotide sequences of KIAA1855 BINDING SITE, designated SEQ ID:44361, to the nucleotide sequence of VGAM2463 RNA, herein designated VGAM RNA, also designated SEQ ID:5174.

Another function of VGAM2463 is therefore inhibition of KIAA1855 (Accession XM_166453). Accordingly, utilities of VGAM2463 include diagnosis, prevention and treatment of diseases and clinical conditions associated with KIAA1855. KIAA1862 (Accession XM_044212) is another VGAM2463 host target gene. KIAA1862 BINDING SITE is HOST TARGET binding site found in the 3' untranslated region of mRNA encoded by KIAA1862, corresponding to a HOST TARGET binding site such as BINDING SITE I, BINDING SITE II or BINDING SITE III. Table 2 illustrates the complementarity of the nucleotide sequences of KIAA1862 BINDING SITE, designated SEQ ID:34175, to the nucleotide sequence of VGAM2463 RNA, herein designated VGAM RNA, also designated SEQ ID:5174.

Another function of VGAM2463 is therefore inhibition of KIAA1862 (Accession XM_044212). Accordingly, utilities of VGAM2463 include diagnosis, prevention and treatment of diseases and clinical conditions associated with KIAA1862. KIAA1904 (Accession XM_056282) is another VGAM2463 host target gene. KIAA1904 BINDING SITE is HOST TARGET binding site found in the 3' untranslated region of mRNA encoded by KIAA1904, corresponding to a HOST TARGET binding site such as BINDING SITE I, BINDING SITE II or BINDING SITE III. Table 2 illustrates the complementarity of the nucleotide sequences of KIAA1904 BINDING SITE, designated SEQ ID:36381, to the nucleotide sequence of VGAM2463 RNA, herein designated VGAM RNA, also designated SEQ ID:5174.

Another function of VGAM2463 is therefore inhibition of KIAA1904 (Accession XM_056282). Accordingly, utilities of VGAM2463 include diagnosis, prevention and treatment of diseases and clinical conditions associated with KIAA1904. KIAA1938 (Accession XM_166407) is another VGAM2463 host target gene. KIAA1938 BINDING SITE is HOST TARGET binding site found in the 3' untranslated region of mRNA encoded by KIAA1938, corresponding to a HOST TARGET binding site such as BINDING SITE I, BINDING SITE II or BINDING SITE III. Table 2 illustrates the complementarity of the nucleotide sequences of KIAA1938 BINDING SITE, designated SEQ ID:44280, to the nucleotide sequence of VGAM2463 RNA, herein designated VGAM RNA, also designated SEQ ID:5174.

Another function of VGAM2463 is therefore inhibition of KIAA1938 (Accession XM_166407). Accordingly, utilities of VGAM2463 include diagnosis, prevention and treatment of diseases and clinical conditions associated with KIAA1938. KIAA1949 (Accession XM_175173) is another VGAM2463 host target gene. KIAA1949 BINDING SITE1 through KIAA1949 BINDING SITE3 are HOST TARGET binding sites found in untranslated regions of mRNA encoded by KIAA1949, corresponding to HOST TARGET binding sites such as BINDING SITE I, BINDING SITE II or BINDING SITE III. Table 2 illustrates the complementarity of the nucleotide sequences of KIAA1949 BINDING SITE1 through KIAA1949 BINDING SITE3, designated SEQ ID:46669, SEQ ID:46714 and SEQ ID:44210 respectively, to the nucleotide sequence of VGAM2463 RNA, herein designated VGAM RNA, also designated SEQ ID:5174.

Another function of VGAM2463 is therefore inhibition of KIAA1949 (Accession XM_175173). Accordingly, utilities of VGAM2463 include diagnosis, prevention and treatment of diseases and clinical conditions associated with KIAA1949. Leucine-rich Repeat LGI Family, Member 2 (LGI2, Accession NM_018176) is another VGAM2463 host target gene. LGI2 BINDING SITE is HOST TARGET binding site found in the 3' untranslated region of mRNA encoded by LGI2, corresponding to a HOST TARGET binding site such as BINDING SITE I, BINDING SITE II or BINDING SITE III. Table 2 illustrates the complementarity of the nucleotide sequences of LGI2 BINDING SITE, designated SEQ ID:20001, to the nucleotide sequence of VGAM2463 RNA, herein designated VGAM RNA, also designated SEQ ID:5174.

Another function of VGAM2463 is therefore inhibition of Leucine-rich Repeat LGI Family, Member 2 (LGI2, Accession NM_018176). Accordingly, utilities of VGAM2463 include diagnosis, prevention and treatment of diseases and clinical conditions associated with LGI2. LHPP (Accession NM_022126) is another VGAM2463 host target gene. LHPP BINDING SITE1 through LHPP BINDING SITE4 are HOST TARGET binding sites found in untranslated regions of mRNA encoded by LHPP, corresponding to HOST TARGET binding sites such as BINDING SITE I, BINDING SITE II or BINDING SITE III. Table 2 illustrates the complementarity of the nucleotide sequences of LHPP BINDING SITE1 through LHPP BINDING SITE4, designated SEQ ID:22675, SEQ ID:22676, SEQ ID:22677 and SEQ ID:22679 respectively, to the nucleotide sequence of VGAM2463 RNA, herein designated VGAM RNA, also designated SEQ ID:5174.

Another function of VGAM2463 is therefore inhibition of LHPP (Accession NM_022126). Accordingly, utilities of VGAM2463 include diagnosis, prevention and treatment of diseases and clinical conditions associated with LHPP. MGC10812 (Accession NM_031425) is another VGAM2463 host target gene. MGC10812 BINDING SITE is HOST TARGET binding site found in the 3' untranslated region of mRNA encoded by MGC10812, corresponding to a HOST TARGET binding site such as BINDING SITE I, BINDING SITE II or BINDING SITE III. Table 2 illustrates the complementarity of the nucleotide sequences of MGC10812 BINDING SITE, designated SEQ ID:25414, to the nucleotide sequence of VGAM2463 RNA, herein designated VGAM RNA, also designated SEQ ID:5174.

Another function of VGAM2463 is therefore inhibition of MGC10812 (Accession NM_031425). Accordingly, utilities of VGAM2463 include diagnosis, prevention and treatment of diseases and clinical conditions associated with MGC10812. MGC10986 (Accession NM_030576) is another VGAM2463 host target gene. MGC10986 BINDING SITE is HOST TARGET binding site found in the 3' untranslated region of mRNA encoded by MGC10986, corresponding to a HOST TARGET binding site such as BINDING SITE I, BINDING SITE II or BINDING SITE III. Table 2 illustrates the complementarity of the nucleotide sequences of MGC10986 BINDING SITE, designated SEQ ID:24951, to the nucleotide sequence of VGAM2463 RNA, herein designated VGAM RNA, also designated SEQ ID:5174.

Another function of VGAM2463 is therefore inhibition of MGC10986 (Accession NM_030576). Accordingly, utilities of VGAM2463 include diagnosis, prevention and treatment of diseases and clinical conditions associated with MGC10986. MGC15854 (Accession NM_145029) is another VGAM2463 host target gene. MGC15854 BINDING SITE is HOST TARGET binding site found in the 5' untranslated region of mRNA encoded by MGC15854, corresponding to a HOST TARGET binding site such as BINDING SITE I, BINDING SITE II or BINDING SITE III. Table 2 illustrates the complementarity of the nucleotide sequences of MGC15854 BINDING SITE, designated SEQ ID:29643, to the nucleotide sequence of VGAM2463 RNA, herein designated VGAM RNA, also designated SEQ ID:5174.

Another function of VGAM2463 is therefore inhibition of MGC15854 (Accession NM_145029). Accordingly, utilities of VGAM2463 include diagnosis, prevention and treatment of diseases and clinical conditions associated with MGC15854. MGC16824 (Accession NM_020314) is another VGAM2463 host target gene. MGC16824 BINDING SITE is HOST TARGET binding site found in the 5' untranslated region of mRNA encoded by MGC16824, corresponding to a HOST TARGET binding site such as BINDING SITE I, BINDING SITE II or BINDING SITE III. Table 2 illustrates the complementarity of the nucleotide sequences of MGC16824 BINDING SITE, designated SEQ ID:21572, to the nucleotide sequence of VGAM2463 RNA, herein designated VGAM RNA, also designated SEQ ID:5174.

Another function of VGAM2463 is therefore inhibition of MGC16824 (Accession NM_020314). Accordingly, utilities of VGAM2463 include diagnosis, prevention and treatment of diseases and clinical conditions associated with MGC16824. MGC20255 (Accession NM_052848) is another VGAM2463 host target gene. MGC20255 BINDING SITE is HOST TARGET binding site found in the 3' untranslated region of mRNA encoded by MGC20255, corresponding to a HOST TARGET binding site such as BINDING SITE I, BINDING SITE II or BINDING SITE III. Table 2 illustrates the complementarity of the nucleotide sequences of MGC20255 BINDING SITE, designated SEQ ID:27429, to the nucleotide sequence of VGAM2463 RNA, herein designated VGAM RNA, also designated SEQ ID:5174.

Another function of VGAM2463 is therefore inhibition of MGC20255 (Accession NM_052848). Accordingly, utilities of VGAM2463 include diagnosis, prevention and treatment of diseases and clinical conditions associated with MGC20255. MGC21621 (Accession NM_145015) is another VGAM2463 host target gene. MGC21621 BINDING SITE is HOST TARGET binding site found in the 3' untranslated region of mRNA encoded by MGC21621, corresponding to a HOST TARGET binding site such as BINDING SITE I, BINDING SITE II or BINDING SITE III. Table 2 illustrates the complementarity of the nucleotide sequences of MGC21621 BINDING SITE, designated SEQ ID:29621, to the nucleotide sequence of VGAM2463 RNA, herein designated VGAM RNA, also designated SEQ ID:5174.

Another function of VGAM2463 is therefore inhibition of MGC21621 (Accession NM_145015). Accordingly, utilities of VGAM2463 include diagnosis, prevention and treatment of diseases and clinical conditions associated with MGC21621. MGC2574 (Accession NM_024098) is another VGAM2463 host target gene. MGC2574 BINDING SITE is HOST TARGET binding site found in the 3' untranslated region of mRNA encoded by MGC2574, corresponding to a HOST TARGET binding site such as BINDING SITE I, BINDING SITE II or BINDING SITE III. Table 2 illustrates the complementarity of the nucleotide sequences of MGC2574 BINDING SITE, designated SEQ ID:23536, to the nucleotide sequence of VGAM2463 RNA, herein designated VGAM RNA, also designated SEQ ID:5174.

Another function of VGAM2463 is therefore inhibition of MGC2574 (Accession NM_024098). Accordingly, utilities of VGAM2463 include diagnosis, prevention and treatment of diseases and clinical conditions associated with MGC2574. MGC2817 (Accession XM_046613) is another VGAM2463 host target gene. MGC2817 BINDING SITE is HOST TARGET binding site found in the 5' untranslated region of mRNA encoded by MGC2817, corresponding to a HOST TARGET binding site such as BINDING SITE I, BINDING SITE II or BINDING SITE III. Table 2 illustrates the complementarity of the nucleotide sequences of MGC2817 BINDING SITE, designated SEQ ID:34763, to the nucleotide sequence of VGAM2463 RNA, herein designated VGAM RNA, also designated SEQ ID:5174.

Another function of VGAM2463 is therefore inhibition of MGC2817 (Accession XM_046613). Accordingly, utilities of VGAM2463 include diagnosis, prevention and treatment of diseases and clinical conditions associated with MGC2817. MGC4342 (Accession NM_024329) is another VGAM2463 host target gene. MGC4342 BINDING SITE is HOST TARGET binding site found in the 3' untranslated region of mRNA encoded by MGC4342, corresponding to a HOST TARGET binding site such as BINDING SITE I, BINDING SITE II or BINDING SITE III. Table 2 illustrates the complementarity of the nucleotide sequences of MGC4342 BINDING SITE, designated SEQ ID:23624, to the nucleotide sequence of VGAM2463 RNA, herein designated VGAM RNA, also designated SEQ ID:5174.

Another function of VGAM2463 is therefore inhibition of MGC4342 (Accession NM_024329). Accordingly, utilities of VGAM2463 include diagnosis, prevention and treatment of diseases and clinical conditions associated with MGC4342. Neuroblastoma, Suppression of Tumorigenicity 1 (NBL1, Accession XM_001434) is another VGAM2463 host target gene. NBL1 BINDING SITE is HOST TARGET binding site found in the 3' untranslated region of mRNA encoded by NBL1, corresponding to a HOST TARGET binding site such as BINDING SITE I, BINDING SITE II or BINDING SITE III. Table 2 illustrates the complementarity of the nucleotide sequences of NBL1 BINDING SITE, designated SEQ ID:29839, to the nucleotide sequence of VGAM2463 RNA, herein designated VGAM RNA, also designated SEQ ID:5174.

Another function of VGAM2463 is therefore inhibition of Neuroblastoma, Suppression of Tumorigenicity 1 (NBL1, Accession XM_001434). Accordingly, utilities of VGAM2463 include diagnosis, prevention and treatment of diseases and clinical conditions associated with NBL1. NFASC (Accession XM_046808) is another VGAM2463 host target gene. NFASC BINDING SITE is HOST TARGET binding site found in the 3' untranslated region of mRNA encoded by NFASC, corresponding to a HOST TARGET binding site such as BINDING SITE I, BINDING SITE II or BINDING SITE III. Table 2 illustrates the complementarity of the nucleotide sequences of NFASC BINDING SITE, designated SEQ ID:34831, to the nucleotide sequence of VGAM2463 RNA, herein designated VGAM RNA, also designated SEQ ID:5174.

Another function of VGAM2463 is therefore inhibition of NFASC (Accession XM_046808). Accordingly, utilities of VGAM2463 include diagnosis, prevention and treatment of diseases and clinical conditions associated with NFASC. Nuclear Factor of Activated T-cells 5, Tonicity-responsive (NFAT5, Accession NM_138714) is another VGAM2463 host target gene. NFAT5 BINDING SITE1 and NFAT5 BINDING SITE2 are HOST TARGET binding sites found in untranslated regions of mRNA encoded by NFAT5, corresponding to HOST TARGET binding sites such as BINDING SITE I, BINDING SITE II or BINDING SITE III. Table 2 illustrates the complementarity of the nucleotide sequences of NFAT5 BINDING SITE1 and NFAT5 BINDING SITE2, designated SEQ ID:28954 and SEQ ID:28958 respectively, to the nucleotide sequence of VGAM2463 RNA, herein designated VGAM RNA, also designated SEQ ID:5174.

Another function of VGAM2463 is therefore inhibition of Nuclear Factor of Activated T-cells 5, Tonicity-responsive (NFAT5, Accession NM_138714). Accordingly, utilities of VGAM2463 include diagnosis, prevention and treatment of diseases and clinical conditions associated with NFAT5. NTT73 (Accession NM_018057) is another VGAM2463 host target gene. NTT73 BINDING SITE is HOST TARGET binding site found in the 5' untranslated region of mRNA encoded by NTT73, corresponding to a HOST TARGET binding site such as BINDING SITE I, BINDING SITE II or BINDING SITE III. Table 2 illustrates the complementarity of the nucleotide sequences of NTT73 BINDING SITE, designated SEQ ID:19825, to the nucleotide sequence of VGAM2463 RNA, herein designated VGAM RNA, also designated SEQ ID:5174.

Another function of VGAM2463 is therefore inhibition of NTT73 (Accession NM_018057). Accordingly, utilities of VGAM2463 include diagnosis, prevention and treatment of diseases and clinical conditions associated with NTT73. Nucleoredoxin (NXN, Accession NM_022463) is another VGAM2463 host target gene. NXN BINDING SITE is HOST TARGET binding site found in the 3' untranslated region of mRNA encoded by NXN, corresponding to a HOST TARGET binding site such as BINDING SITE I, BINDING SITE II or BINDING SITE III. Table 2 illustrates the complementarity of the nucleotide sequences of NXN BINDING SITE, designated SEQ ID:22809, to the nucleotide sequence of VGAM2463 RNA, herein designated VGAM RNA, also designated SEQ ID:5174.

Another function of VGAM2463 is therefore inhibition of Nucleoredoxin (NXN, Accession NM_022463). Accordingly, utilities of VGAM2463 include diagnosis, prevention and treatment of diseases and clinical conditions associated with NXN. Ornithine Decarboxylase Antizyme 3 (OAZ3, Accession NM_016178) is another VGAM2463 host target gene. OAZ3 BINDING SITE is HOST TARGET binding site found in the 5' untranslated region of mRNA encoded by OAZ3, corresponding to a HOST TARGET binding site such as BINDING SITE I, BINDING SITE II or BINDING SITE III. Table 2 illustrates the complementarity of the nucleotide sequences of OAZ3 BINDING SITE, designated SEQ ID:18280, to the nucleotide sequence of VGAM2463 RNA, herein designated VGAM RNA, also designated SEQ ID:5174.

Another function of VGAM2463 is therefore inhibition of Ornithine Decarboxylase Antizyme 3 (OAZ3, Accession NM_016178). Accordingly, utilities of VGAM2463 include diagnosis, prevention and treatment of diseases and clinical conditions associated with OAZ3. Prefoldin 1 (PFDN1, Accession NM_002622) is another VGAM2463 host target gene. PFDN1 BINDING SITE is HOST TARGET binding site found in the 3' untranslated region of mRNA encoded by PFDN1, corresponding to a HOST TARGET binding site such as BINDING SITE I, BINDING SITE II or BINDING SITE III. Table 2 illustrates the complementarity of the nucleotide sequences of PFDN1 BINDING SITE, designated SEQ ID:8483, to the nucleotide sequence of VGAM2463 RNA, herein designated VGAM RNA, also designated SEQ ID:5174.

Another function of VGAM2463 is therefore inhibition of Prefoldin 1 (PFDN1, Accession NM_002622). Accordingly, utilities of VGAM2463 include diagnosis, prevention and treatment of diseases and clinical conditions associated with PFDN1. PIF1 (Accession XM_027898) is another VGAM2463 host target gene. PIF1 BINDING SITE is HOST TARGET binding site found in the 3' untranslated region of mRNA encoded by PIF1, corresponding to a HOST TARGET binding site such as BINDING SITE I, BINDING SITE II or BINDING SITE III. Table 2 illustrates the complementarity of the nucleotide sequences of PIF1 BINDING SITE, designated SEQ ID:30586, to the nucleotide sequence of VGAM2463 RNA, herein designated VGAM RNA, also designated SEQ ID:5174.

Another function of VGAM2463 is therefore inhibition of PIF1 (Accession XM_027898). Accordingly, utilities of VGAM2463 include diagnosis, prevention and treatment of diseases and clinical conditions associated with PIF1. Phospholipase A2, Group III (PLA2G3, Accession NM_015715) is another VGAM2463 host target gene. PLA2G3 BINDING SITE is HOST TARGET binding site found in the 5' untranslated region of mRNA encoded by PLA2G3, corresponding to a HOST TARGET binding site such as BINDING SITE I, BINDING SITE II or BINDING SITE III. Table 2 illustrates the complementarity of the nucleotide sequences of PLA2G3 BINDING SITE, designated SEQ ID:17928, to the nucleotide sequence of VGAM2463 RNA, herein designated VGAM RNA, also designated SEQ ID:5174.

Another function of VGAM2463 is therefore inhibition of Phospholipase A2, Group III (PLA2G3, Accession NM_015715). Accordingly, utilities of VGAM2463 include diagnosis, prevention and treatment of diseases and clinical conditions associated with PLA2G3. POLD3 (Accession XM_166243) is another VGAM2463 host target gene. POLD3 BINDING SITE is HOST TARGET binding site found in the 3' untranslated region of mRNA encoded by POLD3, corresponding to a HOST TARGET binding site such as BINDING SITE I, BINDING SITE II or BINDING SITE III. Table 2 illustrates the complementarity of the nucleotide sequences of POLD3 BINDING SITE, designated SEQ ID:44056, to the nucleotide sequence of VGAM2463 RNA, herein designated VGAM RNA, also designated SEQ ID:5174.

Another function of VGAM2463 is therefore inhibition of POLD3 (Accession XM_166243). Accordingly, utilities of VGAM2463 include diagnosis, prevention and treatment of diseases and clinical conditions associated with POLD3. PP3501 (Accession NM_021731) is another VGAM2463 host target gene. PP3501 BINDING SITE is HOST TARGET binding site found in the 3' untranslated region of mRNA encoded by PP3501, corresponding to a HOST TARGET binding site such as BINDING SITE I, BINDING SITE II or BINDING SITE III. Table 2 illustrates the complementarity of the nucleotide sequences of PP3501 BINDING SITE, designated SEQ ID:22332, to the nucleotide sequence of VGAM2463 RNA, herein designated VGAM RNA, also designated SEQ ID:5174.

Another function of VGAM2463 is therefore inhibition of PP3501 (Accession NM_021731). Accordingly, utilities of VGAM2463 include diagnosis, prevention and treatment of diseases and clinical conditions associated with PP3501. PR Domain Containing 11 (PRDM11, Accession NM_020229) is another VGAM2463 host target gene. PRDM11 BINDING SITE is HOST TARGET binding site found in the 5' untranslated region of mRNA encoded by PRDM11, corresponding to a HOST TARGET binding site such as BINDING SITE I, BINDING SITE II or BINDING SITE III. Table 2 illustrates the complementarity of the nucleotide sequences of PRDM11 BINDING SITE, designated SEQ ID:21501, to the nucleotide sequence of VGAM2463 RNA, herein designated VGAM RNA, also designated SEQ ID:5174.

Another function of VGAM2463 is therefore inhibition of PR Domain Containing 11 (PRDM11, Accession NM_020229). Accordingly, utilities of VGAM2463 include diagnosis, prevention and treatment of diseases and clinical conditions associated with PRDM11. PR Domain Containing 7 (PRDM7, Accession NM_052996) is another VGAM2463 host target gene. PRDM7 BINDING SITE is HOST TARGET binding site found in the 3' untranslated region of mRNA encoded by PRDM7, corresponding to a HOST TARGET binding site such as BINDING SITE I, BINDING SITE II or BINDING SITE III. Table 2 illustrates the complementarity of the nucleotide sequences of PRDM7 BINDING SITE, designated SEQ ID:27569, to the nucleotide sequence of VGAM2463 RNA, herein designated VGAM RNA, also designated SEQ ID:5174.

Another function of VGAM2463 is therefore inhibition of PR Domain Containing 7 (PRDM7, Accession NM_052996). Accordingly, utilities of VGAM2463 include diagnosis, prevention and treatment of diseases and clinical conditions associated with PRDM7. PRO0233 (Accession NM_014121) is another VGAM2463 host target gene. PRO0233 BINDING SITE is HOST TARGET binding site found in the 3' untranslated region of mRNA encoded by PRO0233, corresponding to a HOST TARGET binding site such as BINDING SITE I, BINDING SITE II or BINDING SITE III. Table 2 illustrates the complementarity of the nucleotide sequences of PRO0233 BINDING SITE, designated SEQ ID:15373, to the nucleotide sequence of VGAM2463 RNA, herein designated VGAM RNA, also designated SEQ ID:5174.

Another function of VGAM2463 is therefore inhibition of PRO0233 (Accession NM_014121). Accordingly, utilities of VGAM2463 include diagnosis, prevention and treatment of diseases and clinical conditions associated with PRO0233. PRO1048 (Accession NM_018497) is another VGAM2463 host target gene. PRO1048 BINDING SITE is HOST TARGET binding site found in the 3' untranslated region of mRNA encoded by PRO1048, corresponding to a HOST TARGET binding site such as BINDING SITE I, BINDING SITE II or BINDING SITE III. Table 2 illustrates the complementarity of the nucleotide sequences of PRO1048 BINDING SITE, designated SEQ ID:20557, to the nucleotide sequence of VGAM2463 RNA, herein designated VGAM RNA, also designated SEQ ID:5174.

Another function of VGAM2463 is therefore inhibition of PRO1048 (Accession NM_018497). Accordingly, utilities of VGAM2463 include diagnosis, prevention and treatment of diseases and clinical conditions associated with PRO1048. Protein Tyrosine Phosphatase, Non-receptor Type 3 (PTPN3, Accession NM_002829) is another VGAM2463 host target gene. PTPN3 BINDING SITE is HOST TARGET binding site found in the 3' untranslated region of mRNA encoded by PTPN3, corresponding to a HOST TARGET binding site such as BINDING SITE I, BINDING SITE II or BINDING SITE III. Table 2 illustrates the complementarity of the nucleotide sequences of PTPN3 BINDING SITE, designated SEQ ID:8706, to the nucleotide sequence of VGAM2463 RNA, herein designated VGAM RNA, also designated SEQ ID:5174.

Another function of VGAM2463 is therefore inhibition of Protein Tyrosine Phosphatase, Non-receptor Type 3 (PTPN3, Accession NM_002829). Accordingly, utilities of VGAM2463 include diagnosis, prevention and treatment of diseases and clinical conditions associated with PTPN3. RAB40C, Member RAS Oncogene Family (RAB40C, Accession NM_021168) is another VGAM2463 host target gene. RAB40C BINDING SITE is HOST TARGET binding site found in the 3' untranslated region of mRNA encoded by RAB40C, corresponding to a HOST TARGET binding site such as BINDING SITE I, BINDING SITE II or BINDING SITE III. Table 2 illustrates the complementarity of the nucleotide sequences of RAB40C BINDING SITE, designated SEQ ID:22147, to the nucleotide sequence of VGAM2463 RNA, herein designated VGAM RNA, also designated SEQ ID:5174.

Another function of VGAM2463 is therefore inhibition of RAB40C, Member RAS Oncogene Family (RAB40C, Accession NM_021168). Accordingly, utilities of VGAM2463 include diagnosis, prevention and treatment of diseases and clinical conditions associated with RAB40C. RAB6B, Member RAS Oncogene Family (RAB6B, Accession NM_016577) is another VGAM2463 host target gene. RAB6B BINDING SITE1 and RAB6B BINDING SITE2 are HOST TARGET binding sites found in untranslated regions of mRNA encoded by RAB6B, corresponding to HOST TARGET binding sites such as BINDING SITE I, BINDING SITE II or BINDING SITE III. Table 2 illustrates the complementarity of the nucleotide sequences of RAB6B BINDING SITE1 and RAB6B BINDING SITE2, designated SEQ ID:18653 and SEQ ID:18654 respectively, to the nucleotide sequence of VGAM2463 RNA, herein designated VGAM RNA, also designated SEQ ID:5174.

Another function of VGAM2463 is therefore inhibition of RAB6B, Member RAS Oncogene Family (RAB6B, Accession NM_016577). Accordingly, utilities of VGAM2463 include diagnosis, prevention and treatment of diseases and clinical conditions associated with RAB6B. RBPMS (Accession NM_006867) is another VGAM2463 host target gene. RBPMS BINDING SITE1 and RBPMS BINDING SITE2 are HOST TARGET binding sites found in untranslated regions of mRNA encoded by RBPMS, corresponding to HOST TARGET binding sites such as BINDING SITE I, BINDING SITE II or BINDING SITE III. Table 2 illustrates the complementarity of the nucleotide sequences of RBPMS BINDING SITE1 and RBPMS BINDING SITE2, designated SEQ ID:13738 and SEQ ID:8824 respectively, to the nucleotide sequence of VGAM2463 RNA, herein designated VGAM RNA, also designated SEQ ID:5174.

Another function of VGAM2463 is therefore inhibition of RBPMS (Accession NM_006867). Accordingly, utilities of VGAM2463 include diagnosis, prevention and treatment of diseases and clinical conditions associated with RBPMS. SAE1 (Accession NM_005500) is another VGAM2463 host target gene. SAE1 BINDING SITE is HOST TARGET binding site found in the 3' untranslated region of mRNA encoded by SAE1, corresponding to a HOST TARGET binding site such as BINDING SITE I, BINDING SITE II or BINDING SITE III. Table 2 illustrates the complementarity of the nucleotide sequences of SAE1 BINDING SITE, designated SEQ ID:12004, to the nucleotide sequence of VGAM2463 RNA, herein designated VGAM RNA, also designated SEQ ID:5174.

Another function of VGAM2463 is therefore inhibition of SAE1 (Accession NM_005500). Accordingly, utilities of VGAM2463 include diagnosis, prevention and treatment of diseases and clinical conditions associated with SAE1. SARM (Accession NM_015077) is another VGAM2463 host target gene. SARM BINDING SITE is HOST TARGET binding site found in the 3' untranslated region of mRNA encoded by SARM, corresponding to a HOST TARGET binding site such as BINDING SITE I, BINDING SITE II or BINDING SITE III. Table 2 illustrates the complementarity of the nucleotide sequences of SARM BINDING SITE, designated SEQ ID:17458, to the nucleotide sequence of VGAM2463 RNA, herein designated VGAM RNA, also designated SEQ ID:5174.

Another function of VGAM2463 is therefore inhibition of SARM (Accession NM_015077). Accordingly, utilities of VGAM2463 include diagnosis, prevention and treatment of diseases and clinical conditions associated with SARM. SCAMP5 (Accession NM_138967) is another VGAM2463 host target gene. SCAMP5 BINDING SITE is HOST TARGET binding site found in the 3' untranslated region of mRNA encoded by SCAMP5, corresponding to a HOST TARGET binding site such as BINDING SITE I, BINDING SITE II or BINDING SITE III. Table 2 illustrates the complementarity of the nucleotide sequences of SCAMP5 BINDING SITE, designated SEQ ID:29075, to the nucleotide sequence of VGAM2463 RNA, herein designated VGAM RNA, also designated SEQ ID:5174.

Another function of VGAM2463 is therefore inhibition of SCAMP5 (Accession NM_138967). Accordingly, utilities of VGAM2463 include diagnosis, prevention and treatment of diseases and clinical conditions associated with SCAMP5. SCYA22 (Accession XM_165651) is another VGAM2463 host target gene. SCYA22 BINDING SITE is HOST TARGET binding site found in the 3' untranslated region of mRNA encoded by SCYA22, corresponding to a HOST TARGET binding site such as BINDING SITE I, BINDING SITE II or BINDING SITE III. Table 2 illustrates the complementarity of the nucleotide sequences of SCYA22 BINDING SITE, designated SEQ ID:43715, to the nucleotide sequence of VGAM2463 RNA, herein designated VGAM RNA, also designated SEQ ID:5174.

Another function of VGAM2463 is therefore inhibition of SCYA22 (Accession XM_165651). Accordingly, utilities of VGAM2463 include diagnosis, prevention and treatment of diseases and clinical conditions associated with SCYA22. Solute Carrier Family 38, Member 5 (SLC38A5, Accession NM_033518) is another VGAM2463 host target gene. SLC38A5 BINDING SITE is HOST TARGET binding site found in the 5' untranslated region of mRNA encoded by SLC38A5, corresponding to a HOST TARGET binding site such as BINDING SITE I, BINDING SITE II or BINDING SITE III. Table 2 illustrates the complementarity of the nucleotide sequences of SLC38A5 BINDING SITE, designated SEQ ID:27298, to the nucleotide sequence of VGAM2463 RNA, herein designated VGAM RNA, also designated SEQ ID:5174.

Another function of VGAM2463 is therefore inhibition of Solute Carrier Family 38, Member 5 (SLC38A5, Accession NM_033518). Accordingly, utilities of VGAM2463 include diagnosis, prevention and treatment of diseases and clinical conditions associated with SLC38A5. Syntaphilin (SNPH, Accession NM_014723) is another VGAM2463 host target gene. SNPH BINDING SITE1 through SNPH BINDING SITE3 are HOST TARGET binding sites found in untranslated regions of mRNA encoded by SNPH, corresponding to HOST TARGET binding sites such as BINDING SITE I, BINDING SITE II or BINDING SITE III. Table 2 illustrates the complementarity of the nucleotide sequences of SNPH BINDING SITE1 through SNPH BINDING SITE3, designated SEQ ID:16294, SEQ ID:16297 and SEQ ID:16298 respectively, to the nucleotide sequence of VGAM2463 RNA, herein designated VGAM RNA, also designated SEQ ID:5174.

Another function of VGAM2463 is therefore inhibition of Syntaphilin (SNPH, Accession NM_014723). Accordingly, utilities of VGAM2463 include diagnosis, prevention and treatment of diseases and clinical conditions associated with SNPH. SPBPBP (Accession NM_006692) is another VGAM2463 host target gene. SPBPBP BINDING SITE is HOST TARGET binding site found in the 5' untranslated region of mRNA encoded by SPBPBP, corresponding to a HOST TARGET binding site such as BINDING SITE I, BINDING SITE II or BINDING SITE III. Table 2 illustrates the complementarity of the nucleotide sequences of SPBPBP BINDING SITE, designated SEQ ID:13510, to the nucleotide sequence of VGAM2463 RNA, herein designated VGAM RNA, also designated SEQ ID:5174.

Another function of VGAM2463 is therefore inhibition of SPBPBP (Accession NM_006692). Accordingly, utilities of VGAM2463 include diagnosis, prevention and treatment of diseases and clinical conditions associated with SPBPBP. SPEC1 (Accession NM_020239) is another VGAM2463 host target gene. SPEC1 BINDING SITE is HOST TARGET binding site found in the 3' untranslated region of mRNA encoded by SPEC1, corresponding to a HOST TARGET binding site such as BINDING SITE I, BINDING SITE II or BINDING SITE III. Table 2 illustrates the complementarity of the nucleotide sequences of SPEC1 BINDING SITE, designated SEQ ID:21516, to the nucleotide sequence of VGAM2463 RNA, herein designated VGAM RNA, also designated SEQ ID:5174.

Another function of VGAM2463 is therefore inhibition of SPEC1 (Accession NM_020239). Accordingly, utilities of VGAM2463 include diagnosis, prevention and treatment of diseases and clinical conditions associated with SPEC1. Serine Protease Inhibitor, Kunitz Type 1 (SPINT1, Accession XM_031510) is another VGAM2463 host target gene. SPINT1 BINDING SITE is HOST TARGET binding site found in the 3' untranslated region of mRNA encoded by SPINT1, corresponding to a HOST TARGET binding site such as BINDING SITE I, BINDING SITE II or BINDING SITE III. Table 2 illustrates the complementarity of the nucleotide sequences of SPINT1 BINDING SITE, designated SEQ ID:31392, to the nucleotide sequence of VGAM2463 RNA, herein designated VGAM RNA, also designated SEQ ID:5174.

Another function of VGAM2463 is therefore inhibition of Serine Protease Inhibitor, Kunitz Type 1 (SPINT1, Accession XM_031510). Accordingly, utilities of VGAM2463 include diagnosis, prevention and treatment of diseases and clinical conditions associated with SPINT1. SSH2 (Accession XM_030846) is another VGAM2463 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31182, to the nucleotide sequence of VGAM2463 RNA, herein designated VGAM RNA, also designated SEQ ID:5174.

Another function of VGAM2463 is therefore inhibition of SSH2 (Accession XM_030846). Accordingly, utilities of VGAM2463 include diagnosis, prevention and treatment of diseases and clinical conditions associated with SSH2. TCF-3 (Accession NM_031283) is another VGAM2463 host target gene. TCF-3 BINDING SITE is HOST TARGET binding site found in the 3' untranslated region of mRNA encoded by TCF-3, corresponding to a HOST TARGET binding site such as BINDING SITE I, BINDING SITE II or BINDING SITE III. Table 2 illustrates the complementarity of the nucleotide sequences of TCF-3 BINDING SITE, designated SEQ ID:25306, to the nucleotide sequence of VGAM2463 RNA, herein designated VGAM RNA, also designated SEQ ID:5174.

Another function of VGAM2463 is therefore inhibition of TCF-3 (Accession NM_031283). Accordingly, utilities of VGAM2463 include diagnosis, prevention and treatment of diseases and clinical conditions associated with TCF-3. Translocation Protein 1 (TLOC1, Accession NM_003262) is another VGAM2463 host target gene. TLOC1 BINDING SITE is HOST TARGET binding site found in the 5' untranslated region of mRNA encoded by TLOC1, corresponding to a HOST TARGET binding site such as BINDING SITE I, BINDING SITE II or BINDING SITE III. Table 2 illustrates the complementarity of the nucleotide sequences of TLOC1 BINDING SITE, designated SEQ ID:9273, to the nucleotide sequence of VGAM2463 RNA, herein designated VGAM RNA, also designated SEQ ID:5174.

Another function of VGAM2463 is therefore inhibition of Translocation Protein 1 (TLOC1, Accession NM_003262). Accordingly, utilities of VGAM2463 include diagnosis, prevention and treatment of diseases and clinical conditions associated with TLOC1. Tankyrase 1 Binding Protein 1, 182 kDa (TNKS1BP1, Accession NM_033396) is another VGAM2463 host target gene. TNKS1BP1 BINDING SITE is HOST TARGET binding site found in the 5' untranslated region of mRNA encoded by TNKS1BP1, corresponding to a HOST TARGET binding site such as BINDING SITE I, BINDING SITE II or BINDING SITE III. Table 2 illustrates the complementarity of the nucleotide sequences of TNKS1BP1 BINDING SITE, designated SEQ ID:27224, to the nucleotide sequence of VGAM2463 RNA, herein designated VGAM RNA, also designated SEQ ID:5174.

Another function of VGAM2463 is therefore inhibition of Tankyrase 1 Binding Protein 1, 182 kDa (TNKS1BP1, Accession NM_033396). Accordingly, utilities of VGAM2463 include diagnosis, prevention and treatment of diseases and clinical conditions associated with TNKS1BP1. Trinucleotide Repeat Containing 4 (TNRC4, Accession NM_007185) is another VGAM2463 host target gene. TNRC4 BINDING SITE is HOST TARGET binding site found in the 3' untranslated region of mRNA encoded by TNRC4, corresponding to a HOST TARGET binding site such as BINDING SITE I, BINDING SITE II or BINDING SITE III. Table 2 illustrates the complementarity of the nucleotide sequences of TNRC4 BINDING SITE, designated SEQ ID:14041, to the nucleotide sequence of VGAM2463 RNA, herein designated VGAM RNA, also designated SEQ ID:5174.

Another function of VGAM2463 is therefore inhibition of Trinucleotide Repeat Containing 4 (TNRC4, Accession NM_007185). Accordingly, utilities of VGAM2463 include diagnosis, prevention and treatment of diseases and clinical conditions associated with TNRC4. TOLLIP (Accession NM_019009) is another VGAM2463 host target gene. TOLLIP BINDING SITE is HOST TARGET binding site found in the 3' untranslated region of mRNA encoded by TOLLIP, corresponding to a HOST TARGET binding site such as BINDING SITE I, BINDING SITE II or BINDING SITE III. Table 2 illustrates the complementarity of the nucleotide sequences of TOLLIP BINDING SITE, designated SEQ ID:21092, to the nucleotide sequence of VGAM2463 RNA, herein designated VGAM RNA, also designated SEQ ID:5174.

Another function of VGAM2463 is therefore inhibition of TOLLIP (Accession NM_019009). Accordingly, utilities of VGAM2463 include diagnosis, prevention and treatment of diseases and clinical conditions associated with TOLLIP. Target of Myb1 (chicken) (TOM1, Accession NM_005488) is another VGAM2463 host target gene. TOM1 BINDING SITE is HOST TARGET binding site found in the 3' untranslated region of mRNA encoded by TOM1, corresponding to a HOST TARGET binding site such as BINDING SITE I, BINDING SITE II or BINDING SITE III. Table 2 illustrates the complementarity of the nucleotide sequences of TOM1 BINDING SITE, designated SEQ ID:11986, to the nucleotide sequence of VGAM2463 RNA, herein designated VGAM RNA, also designated SEQ ID:5174.

Another function of VGAM2463 is therefore inhibition of Target of Myb1 (chicken) (TOM1, Accession NM_005488). Accordingly, utilities of VGAM2463 include diagnosis, prevention and treatment of diseases and clinical conditions associated with TOM1. Torsin Family 2, Member A (TOR2A, Accession NM_130459) is another VGAM2463 host target gene. TOR2A BINDING SITE is HOST TARGET binding site found in the 3' untranslated region of mRNA encoded by TOR2A, corresponding to a HOST TARGET binding site such as BINDING SITE I, BINDING SITE II or BINDING SITE III. Table 2 illustrates the complementarity of the nucleotide sequences of TOR2A BINDING SITE, designated SEQ ID:28221, to the nucleotide sequence of VGAM2463 RNA, herein designated VGAM RNA, also designated SEQ ID:5174.

Another function of VGAM2463 is therefore inhibition of Torsin Family 2, Member A (TOR2A, Accession NM_130459). Accordingly, utilities of VGAM2463 include diagnosis, prevention and treatment of diseases and clinical conditions associated with TOR2A. TSC22 (Accession NM_006022) is another VGAM2463 host target gene. TSC22 BINDING SITE is HOST TARGET binding site found in the 3' untranslated region of mRNA encoded by TSC22, corresponding to a HOST TARGET binding site such as BINDING SITE I, BINDING SITE II or BINDING SITE III. Table 2 illustrates the complementarity of the nucleotide sequences of TSC22 BINDING SITE, designated SEQ ID:12640, to the nucleotide sequence of VGAM2463 RNA, herein designated VGAM RNA, also designated SEQ ID:5174.

Another function of VGAM2463 is therefore inhibition of TSC22 (Accession NM_006022). Accordingly, utilities of VGAM2463 include diagnosis, prevention and treatment of diseases and clinical conditions associated with TSC22. Tweety Homolog 2 (Drosophila) (TTYH2, Accession NM_032646) is another VGAM2463 host target gene. TTYH2 BINDING SITE is HOST TARGET binding site found in the 3' untranslated region of mRNA encoded by TTYH2, corresponding to a HOST TARGET binding site such as BINDING SITE I, BINDING SITE II or BINDING SITE III. Table 2 illustrates the complementarity of the nucleotide sequences of TTYH2 BINDING SITE, designated SEQ ID:26378, to the nucleotide sequence of VGAM2463 RNA, herein designated VGAM RNA, also designated SEQ ID:5174.

Another function of VGAM2463 is therefore inhibition of Tweety Homolog 2 (Drosophila) (TTYH2, Accession NM_032646). Accordingly, utilities of VGAM2463 include diagnosis, prevention and treatment of diseases and clinical conditions associated with TTYH2. TUSP (Accession NM_020245) is another VGAM2463 host target gene. TUSP BINDING SITE is HOST TARGET binding site found in the 3' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21528, to the nucleotide sequence of VGAM2463 RNA, herein designated VGAM RNA, also designated SEQ ID:5174.

Another function of VGAM2463 is therefore inhibition of TUSP (Accession NM_020245). Accordingly, utilities of VGAM2463 include diagnosis, prevention and treatment of diseases and clinical conditions associated with TUSP. Vav 3 Oncogene (VAV3, Accession NM_006113) is another VGAM2463 host target gene. VAV3 BINDING SITE is HOST TARGET binding site found in the 3' untranslated region of mRNA encoded by VAV3, corresponding to a HOST TARGET binding site such as BINDING SITE I, BINDING SITE II or BINDING SITE III. Table 2 illustrates the complementarity of the nucleotide sequences of VAV3 BINDING SITE, designated SEQ ID:12760, to the nucleotide sequence of VGAM2463 RNA, herein designated VGAM RNA, also designated SEQ ID:5174.

Another function of VGAM2463 is therefore inhibition of Vav 3 Oncogene (VAV3, Accession NM_006113). Accordingly, utilities of VGAM2463 include diagnosis, prevention and treatment of diseases and clinical conditions associated with VAV3. Zinc Finger Protein 95 Homolog (mouse) (ZFP95, Accession NM_014569) is another VGAM2463 host target gene. ZFP95 BINDING SITE1 and ZFP95 BINDING SITE2 are HOST TARGET binding sites found in untranslated regions of mRNA encoded by ZFP95, corresponding to HOST TARGET binding sites such as BINDING SITE I, BINDING SITE II or BINDING SITE III. Table 2 illustrates the complementarity of the nucleotide sequences of ZFP95 BINDING SITE1 and ZFP95 BINDING SITE2, designated SEQ ID:15921 and SEQ ID:29711 respectively, to the nucleotide sequence of VGAM2463 RNA, herein designated VGAM RNA, also designated SEQ ID:5174.

Another function of VGAM2463 is therefore inhibition of Zinc Finger Protein 95 Homolog (mouse) (ZFP95, Accession NM_014569). Accordingly, utilities of VGAM2463 include diagnosis, prevention and treatment of diseases and clinical conditions associated with ZFP95. LOC115509 (Accession XM_056092) is another VGAM2463 host target gene. LOC115509 BINDING SITE is HOST TARGET binding site found in the 3' untranslated region of mRNA encoded by LOC115509, corresponding to a HOST TARGET binding site such as BINDING SITE I, BINDING SITE II or BINDING SITE III. Table 2 illustrates the complementarity of the nucleotide sequences of LOC115509 BINDING SITE, designated SEQ ID:36363, to the nucleotide sequence of VGAM2463 RNA, herein designated VGAM RNA, also designated SEQ ID:5174.

Another function of VGAM2463 is therefore inhibition of LOC115509 (Accession XM_056092). Accordingly, utilities of VGAM2463 include diagnosis, prevention and treatment of diseases and clinical conditions associated with LOC115509. LOC123242 (Accession XM_063548) is another VGAM2463 host target gene. LOC123242 BINDING SITE is HOST TARGET binding site found in the 5' untranslated region of mRNA encoded by LOC123242, corresponding to a HOST TARGET binding site such as BINDING SITE I, BINDING SITE II or BINDING SITE III. Table 2 illustrates the complementarity of the nucleotide sequences of LOC123242 BINDING SITE, designated SEQ ID:37244, to the nucleotide sequence of VGAM2463 RNA, herein designated VGAM RNA, also designated SEQ ID:5174.

Another function of VGAM2463 is therefore inhibition of LOC123242 (Accession XM_063548). Accordingly, utilities of VGAM2463 include diagnosis, prevention and treatment of diseases and clinical conditions associated with LOC123242. LOC124753 (Accession XM_058837) is another VGAM2463 host target gene. LOC124753 BINDING SITE is HOST TARGET binding site found in the 5' untranslated region of mRNA encoded by LOC124753, corresponding to a HOST TARGET binding site such as BINDING SITE I, BINDING SITE II or BINDING SITE III. Table 2 illustrates the complementarity of the nucleotide sequences of LOC124753 BINDING SITE, designated SEQ ID:36761, to the nucleotide sequence of VGAM2463 RNA, herein designated VGAM RNA, also designated SEQ ID:5174.

Another function of VGAM2463 is therefore inhibition of LOC124753 (Accession XM_058837). Accordingly, utilities of VGAM2463 include diagnosis, prevention and treatment of diseases and clinical conditions associated with LOC124753. LOC126208 (Accession XM_058999) is another VGAM2463 host target gene. LOC126208 BINDING SITE is HOST TARGET binding site found in the 3' untranslated region of mRNA encoded by LOC126208, corresponding to a HOST TARGET binding site such as BINDING SITE I, BINDING SITE II or BINDING SITE III. Table 2 illustrates the complementarity of the nucleotide sequences of LOC126208 BINDING SITE, designated SEQ ID:36815, to the nucleotide sequence of VGAM2463 RNA, herein designated VGAM RNA, also designated SEQ ID:5174.

Another function of VGAM2463 is therefore inhibition of LOC126208 (Accession XM_058999). Accordingly, utilities of VGAM2463 include diagnosis, prevention and treatment of diseases and clinical conditions associated with LOC126208. LOC127703 (Accession XM_059172) is another VGAM2463 host target gene. LOC127703 BINDING SITE is HOST TARGET binding site found in the 3' untranslated region of mRNA encoded by LOC127703, corresponding to a HOST TARGET binding site such as BINDING SITE I, BINDING SITE II or BINDING SITE III. Table 2 illustrates the complementarity of the nucleotide sequences of LOC127703 BINDING SITE, designated SEQ ID:36907, to the nucleotide sequence of VGAM2463 RNA, herein designated VGAM RNA, also designated SEQ ID:5174.

Another function of VGAM2463 is therefore inhibition of LOC127703 (Accession XM_059172). Accordingly, utilities of VGAM2463 include diagnosis, prevention and treatment of diseases and clinical conditions associated with LOC127703. LOC128077 (Accession XM_059208) is another VGAM2463 host target gene. LOC128077 BINDING SITE is HOST TARGET binding site found in the 3' untranslated region of mRNA encoded by LOC128077, corresponding to a HOST TARGET binding site such as BINDING SITE I, BINDING SITE II or BINDING SITE III. Table 2 illustrates the complementarity of the nucleotide sequences of LOC128077 BINDING SITE, designated SEQ ID:36918, to the nucleotide sequence of VGAM2463 RNA, herein designated VGAM RNA, also designated SEQ ID:5174.

Another function of VGAM2463 is therefore inhibition of LOC128077 (Accession XM_059208). Accordingly, utilities of VGAM2463 include diagnosis, prevention and treatment of diseases and clinical conditions associated with LOC128077. LOC132671 (Accession NM_145263) is another VGAM2463 host target gene. LOC132671 BINDING SITE is HOST TARGET binding site found in the 3' untranslated region of mRNA encoded by LOC132671, corresponding to a HOST TARGET binding site such as BINDING SITE I, BINDING SITE II or BINDING SITE III. Table 2 illustrates the complementarity of the nucleotide sequences of LOC132671 BINDING SITE, designated SEQ ID:29777, to the nucleotide sequence of VGAM2463 RNA, herein designated VGAM RNA, also designated SEQ ID:5174.

Another function of VGAM2463 is therefore inhibition of LOC132671 (Accession NM_145263). Accordingly, utilities of VGAM2463 include diagnosis, prevention and treatment of diseases and clinical conditions associated with LOC132671. LOC136288 (Accession XM_059832) is another VGAM2463 host target gene. LOC136288 BINDING SITE is HOST TARGET binding site found in the 3' untranslated region of mRNA encoded by LOC136288, corresponding to a HOST TARGET binding site such as BINDING SITE I, BINDING SITE II or BINDING SITE III. Table 2 illustrates the complementarity of the nucleotide sequences of LOC136288 BINDING SITE, designated SEQ ID:37099, to the nucleotide sequence of VGAM2463 RNA, herein designated VGAM RNA, also designated SEQ ID:5174.

Another function of VGAM2463 is therefore inhibition of LOC136288 (Accession XM_059832). Accordingly, utilities of VGAM2463 include diagnosis, prevention and treatment of diseases and clinical conditions associated with LOC136288. LOC145371 (Accession XM_085123) is another VGAM2463 host target gene. LOC145371 BINDING SITE is HOST TARGET binding site found in the 3' untranslated region of mRNA encoded by LOC145371, corresponding to a HOST TARGET binding site such as BINDING SITE I, BINDING SITE II or BINDING SITE III. Table 2 illustrates the complementarity of the nucleotide sequences of LOC145371 BINDING SITE, designated SEQ ID:37846, to the nucleotide sequence of VGAM2463 RNA, herein designated VGAM RNA, also designated SEQ ID:5174.

Another function of VGAM2463 is therefore inhibition of LOC145371 (Accession XM_085123). Accordingly, utilities of VGAM2463 include diagnosis, prevention and treatment of diseases and clinical conditions associated with LOC145371. LOC145988 (Accession XM_085290) is another VGAM2463 host target gene. LOC145988 BINDING SITE is HOST TARGET binding site found in the 5' untranslated region of mRNA encoded by LOC145988, corresponding to a HOST TARGET binding site such as BINDING SITE I, BINDING SITE II or BINDING SITE III. Table 2 illustrates the complementarity of the nucleotide sequences of LOC145988 BINDING SITE, designated SEQ ID:38042, to the nucleotide sequence of VGAM2463 RNA, herein designated VGAM RNA, also designated SEQ ID:5174.

Another function of VGAM2463 is therefore inhibition of LOC145988 (Accession XM_085290). Accordingly, utilities of VGAM2463 include diagnosis, prevention and treatment of diseases and clinical conditions associated with LOC145988. LOC146237 (Accession XM_096954) is another VGAM2463 host target gene. LOC146237 BINDING SITE is HOST TARGET binding site found in the 3' untranslated region of mRNA encoded by LOC146237, corresponding to a HOST TARGET binding site such as BINDING SITE I, BINDING SITE II or BINDING SITE III. Table 2 illustrates the complementarity of the nucleotide sequences of LOC146237 BINDING SITE, designated SEQ ID:40666, to the nucleotide sequence of VGAM2463 RNA, herein designated VGAM RNA, also designated SEQ ID:5174.

Another function of VGAM2463 is therefore inhibition of LOC146237 (Accession XM_096954). Accordingly, utilities of VGAM2463 include diagnosis, prevention and treatment of diseases and clinical conditions associated with LOC146237. LOC146488 (Accession XM_047748) is another VGAM2463 host target gene. LOC146488 BINDING SITE is HOST TARGET binding site found in the 3' untranslated region of mRNA encoded by LOC146488, corresponding to a HOST TARGET binding site such as BINDING SITE I, BINDING SITE II or BINDING SITE III. Table 2 illustrates the complementarity of the nucleotide sequences of LOC146488 BINDING SITE, designated SEQ ID:35046, to the nucleotide sequence of VGAM2463 RNA, herein designated VGAM RNA, also designated SEQ ID:5174.

Another function of VGAM2463 is therefore inhibition of LOC146488 (Accession XM_047748). Accordingly, utilities of VGAM2463 include diagnosis, prevention and treatment of diseases and clinical conditions associated with LOC146488. LOC146780 (Accession XM_097086) is another VGAM2463 host target gene. LOC146780 BINDING SITE is HOST TARGET binding site found in the 5' untranslated region of mRNA encoded by LOC146780, corresponding to a HOST TARGET binding site such as BINDING SITE I, BINDING SITE II or BINDING SITE III. Table 2 illustrates the complementarity of the nucleotide sequences of LOC146780 BINDING SITE, designated SEQ ID:40741, to the nucleotide sequence of VGAM2463 RNA, herein designated VGAM RNA, also designated SEQ ID:5174.

Another function of VGAM2463 is therefore inhibition of LOC146780 (Accession XM_097086). Accordingly, utilities of VGAM2463 include diagnosis, prevention and treatment of diseases and clinical conditions associated with LOC146780. LOC146957 (Accession XM_085652) is another VGAM2463 host target gene. LOC146957 BINDING SITE1 and LOC146957 BINDING SITE2 are HOST TARGET binding sites found in untranslated regions of mRNA encoded by LOC146957, corresponding to HOST TARGET binding sites such as BINDING SITE I, BINDING SITE II or BINDING SITE III. Table 2 illustrates the complementarity of the nucleotide sequences of LOC146957 BINDING SITE1 and LOC146957 BINDING SITE2, designated SEQ ID:38278 and SEQ ID:38279 respectively, to the nucleotide sequence of VGAM2463 RNA, herein designated VGAM RNA, also designated SEQ ID:5174.

Another function of VGAM2463 is therefore inhibition of LOC146957 (Accession XM_085652). Accordingly, utilities of VGAM2463 include diagnosis, prevention and treatment of diseases and clinical conditions associated with LOC146957. LOC148946 (Accession XM_097557) is another VGAM2463 host target gene. LOC148946 BINDING SITE is HOST TARGET binding site found in the 3' untranslated region of mRNA encoded by LOC148946, corresponding to a HOST TARGET binding site such as BINDING SITE I, BINDING SITE II or BINDING SITE III. Table 2 illustrates the complementarity of the nucleotide sequences of LOC148946 BINDING SITE, designated SEQ ID:40939, to the nucleotide sequence of VGAM2463 RNA, herein designated VGAM RNA, also designated SEQ ID:5174.

Another function of VGAM2463 is therefore inhibition of LOC148946 (Accession XM_097557). Accordingly, utilities of VGAM2463 include diagnosis, prevention and treatment of diseases and clinical conditions associated with LOC148946. LOC149684 (Accession XM_097710) is another VGAM2463 host target gene. LOC149684 BINDING SITE is HOST TARGET binding site found in the 5' untranslated region of mRNA encoded by LOC149684, corresponding to a HOST TARGET binding site such as BINDING SITE I, BINDING SITE II or BINDING SITE III. Table 2 illustrates the complementarity of the nucleotide sequences of LOC149684 BINDING SITE, designated SEQ ID:41048, to the nucleotide sequence of VGAM2463 RNA, herein designated VGAM RNA, also designated SEQ ID:5174.

Another function of VGAM2463 is therefore inhibition of LOC149684 (Accession XM_097710). Accordingly, utilities of VGAM2463 include diagnosis, prevention and treatment of diseases and clinical conditions associated with LOC149684. LOC149912 (Accession XM_097743) is another VGAM2463 host target gene. LOC149912 BINDING SITE is HOST TARGET binding site found in the 5' untranslated region of mRNA encoded by LOC149912, corresponding to a HOST TARGET binding site such as BINDING SITE I, BINDING SITE II or BINDING SITE III. Table 2 illustrates the complementarity of the nucleotide sequences of LOC149912 BINDING SITE, designated SEQ ID:41086, to the nucleotide sequence of VGAM2463 RNA, herein designated VGAM RNA, also designated SEQ ID:5174.

Another function of VGAM2463 is therefore inhibition of LOC149912 (Accession XM_097743). Accordingly, utilities of VGAM2463 include diagnosis, prevention and treatment of diseases and clinical conditions associated with LOC149912. LOC151174 (Accession XM_098013) is another VGAM2463 host target gene. LOC151174 BINDING SITE is HOST TARGET binding site found in the 5' untranslated region of mRNA encoded by LOC151174, corresponding to a HOST TARGET binding site such as BINDING SITE I, BINDING SITE II or BINDING SITE III. Table 2 illustrates the complementarity of the nucleotide sequences of LOC151174 BINDING SITE, designated SEQ ID:41312, to the nucleotide sequence of VGAM2463 RNA, herein designated VGAM RNA, also designated SEQ ID:5174.

Another function of VGAM2463 is therefore inhibition of LOC151174 (Accession XM_098013). Accordingly, utilities of VGAM2463 include diagnosis, prevention and treatment of diseases and clinical conditions associated with LOC151174. LOC151201 (Accession XM_098021) is another VGAM2463 host target gene. LOC151201 BINDING SITE is HOST TARGET binding site found in the 3' untranslated region of mRNA encoded by LOC151201, corresponding to a HOST TARGET binding site such as BINDING SITE I, BINDING SITE II or BINDING SITE III. Table 2 illustrates the complementarity of the nucleotide sequences of LOC151201 BINDING SITE, designated SEQ ID:41328, to the nucleotide sequence of VGAM2463 RNA, herein designated VGAM RNA, also designated SEQ ID:5174.

Another function of VGAM2463 is therefore inhibition of LOC151201 (Accession XM_098021). Accordingly, utilities of VGAM2463 include diagnosis, prevention and treatment of diseases and clinical conditions associated with LOC151201. LOC151473 (Accession XM_087215) is another VGAM2463 host target gene. LOC151473 BINDING SITE is HOST TARGET binding site found in the 3' untranslated region of mRNA encoded by LOC151473, corresponding to a HOST TARGET binding site such as BINDING SITE I, BINDING SITE II or BINDING SITE III. Table 2 illustrates the complementarity of the nucleotide sequences of LOC151473 BINDING SITE, designated SEQ ID:39119, to the nucleotide sequence of VGAM2463 RNA, herein designated VGAM RNA, also designated SEQ ID:5174.

Another function of VGAM2463 is therefore inhibition of LOC151473 (Accession XM_087215). Accordingly, utilities of VGAM2463 include diagnosis, prevention and treatment of diseases and clinical conditions associated with LOC151473. LOC151516 (Accession XM_087229) is another VGAM2463 host target gene. LOC151516 BINDING SITE is HOST TARGET binding site found in the 5' untranslated region of mRNA encoded by LOC151516, corresponding to a HOST TARGET binding site such as BINDING SITE I, BINDING SITE II or BINDING SITE III. Table 2 illustrates the complementarity of the nucleotide sequences of LOC151516 BINDING SITE, designated SEQ ID:39128, to the nucleotide sequence of VGAM2463 RNA, herein designated VGAM RNA, also designated SEQ ID:5174.

Another function of VGAM2463 is therefore inhibition of LOC151516 (Accession XM_087229). Accordingly, utilities of VGAM2463 include diagnosis, prevention and treatment of diseases and clinical conditions associated with LOC151516. LOC151657 (Accession XM_098100) is another VGAM2463 host target gene. LOC151657 BINDING SITE is HOST TARGET binding site found in the 3' untranslated region of mRNA encoded by LOC151657, corresponding to a HOST TARGET binding site such as BINDING SITE I, BINDING SITE II or BINDING SITE III. Table 2 illustrates the complementarity of the nucleotide sequences of LOC151657 BINDING SITE, designated SEQ ID:41382, to the nucleotide sequence of VGAM2463 RNA, herein designated VGAM RNA, also designated SEQ ID:5174.

Another function of VGAM2463 is therefore inhibition of LOC151657 (Accession XM_098100). Accordingly, utilities of VGAM2463 include diagnosis, prevention and treatment of diseases and clinical conditions associated with LOC151657. LOC151904 (Accession XM_087334) is another VGAM2463 host target gene. LOC151904 BINDING SITE is HOST TARGET binding site found in the 5' untranslated region of mRNA encoded by LOC151904, corresponding to a HOST TARGET binding site such as BINDING SITE I, BINDING SITE II or BINDING SITE III. Table 2 illustrates the complementarity of the nucleotide sequences of LOC151904 BINDING SITE, designated SEQ ID:39173, to the nucleotide sequence of VGAM2463 RNA, herein designated VGAM RNA, also designated SEQ ID:5174.

Another function of VGAM2463 is therefore inhibition of LOC151904 (Accession XM_087334). Accordingly, utilities of VGAM2463 include diagnosis, prevention and treatment of diseases and clinical conditions associated with LOC151904. LOC153688 (Accession XM_098416) is another VGAM2463 host target gene. LOC153688 BINDING SITE is HOST TARGET binding site found in the 3' untranslated region of mRNA encoded by LOC153688, corresponding to a HOST TARGET binding site such as BINDING SITE I, BINDING SITE II or BINDING SITE III. Table 2 illustrates the complementarity of the nucleotide sequences of LOC153688 BINDING SITE, designated SEQ ID:41659, to the nucleotide sequence of VGAM2463 RNA, herein designated VGAM RNA, also designated SEQ ID:5174.

Another function of VGAM2463 is therefore inhibition of LOC153688 (Accession XM_098416). Accordingly, utilities of VGAM2463 include diagnosis, prevention and treatment of diseases and clinical conditions associated with LOC153688. LOC154877 (Accession XM_098626) is another VGAM2463 host target gene. LOC154877 BINDING SITE is HOST TARGET binding site found in the 3' untranslated region of mRNA encoded by LOC154877, corresponding to a HOST TARGET binding site such as BINDING SITE I, BINDING SITE II or BINDING SITE III. Table 2 illustrates the complementarity of the nucleotide sequences of LOC154877 BINDING SITE, designated SEQ ID:41743, to the nucleotide sequence of VGAM2463 RNA, herein designated VGAM RNA, also designated SEQ ID:5174.

Another function of VGAM2463 is therefore inhibition of LOC154877 (Accession XM_098626). Accordingly, utilities of VGAM2463 include diagnosis, prevention and treatment of diseases and clinical conditions associated with LOC154877. LOC157349 (Accession XM_088298) is another VGAM2463 host target gene. LOC157349 BINDING SITE1 and LOC157349 BINDING SITE2 are HOST TARGET binding sites found in untranslated regions of mRNA encoded by LOC157349, corresponding to HOST TARGET binding sites such as BINDING SITE I, BINDING SITE II or BINDING SITE III. Table 2 illustrates the complementarity of the nucleotide sequences of LOC157349 BINDING SITE1 and LOC157349 BINDING SITE2, designated SEQ ID:39593 and SEQ ID:39595 respectively, to the nucleotide sequence of VGAM2463 RNA, herein designated VGAM RNA, also designated SEQ ID:5174.

Another function of VGAM2463 is therefore inhibition of LOC157349 (Accession XM_088298). Accordingly, utilities of VGAM2463 include diagnosis, prevention and treatment of diseases and clinical conditions associated with LOC157349. LOC157918 (Accession XM_098842) is another VGAM2463 host target gene. LOC157918 BINDING SITE is HOST TARGET binding site found in the 3' untranslated region of mRNA encoded by LOC157918, corresponding to a HOST TARGET binding site such as BINDING SITE I, BINDING SITE II or BINDING SITE III. Table 2 illustrates the complementarity of the nucleotide sequences of LOC157918 BINDING SITE, designated SEQ ID:41896, to the nucleotide sequence of VGAM2463 RNA, herein designated VGAM RNA, also designated SEQ ID:5174.

Another function of VGAM2463 is therefore inhibition of LOC157918 (Accession XM_098842). Accordingly, utilities of VGAM2463 include diagnosis, prevention and treatment of diseases and clinical conditions associated with LOC157918. LOC157919 (Accession XM_088420) is another VGAM2463 host target gene. LOC157919 BINDING SITE is HOST TARGET binding site found in the 5' untranslated region of mRNA encoded by LOC157919, corresponding to a HOST TARGET binding site such as BINDING SITE I, BINDING SITE II or BINDING SITE III. Table 2 illustrates the complementarity of the nucleotide sequences of LOC157919 BINDING SITE, designated SEQ ID:39683, to the nucleotide sequence of VGAM2463 RNA, herein designated VGAM RNA, also designated SEQ ID:5174.

Another function of VGAM2463 is therefore inhibition of LOC157919 (Accession XM_088420). Accordingly, utilities of VGAM2463 include diagnosis, prevention and treatment of diseases and clinical conditions associated with LOC157919. LOC158187 (Accession XM_098892) is another VGAM2463 host target gene. LOC158187 BINDING SITE is HOST TARGET binding site found in the 3' untranslated region of mRNA encoded by LOC158187, corresponding to a HOST TARGET binding site such as BINDING SITE I, BINDING SITE II or BINDING SITE III. Table 2 illustrates the complementarity of the nucleotide sequences of LOC158187 BINDING SITE, designated SEQ ID:41923, to the nucleotide sequence of VGAM2463 RNA, herein designated VGAM RNA, also designated SEQ ID:5174.

Another function of VGAM2463 is therefore inhibition of LOC158187 (Accession XM_098892). Accordingly, utilities of VGAM2463 include diagnosis, prevention and treatment of diseases and clinical conditions associated with LOC158187. LOC158235 (Accession XM_098897) is another VGAM2463 host target gene. LOC158235 BINDING SITE is HOST TARGET binding site found in the 5' untranslated region of mRNA encoded by LOC158235, corresponding to a HOST TARGET binding site such as BINDING SITE I, BINDING SITE II or BINDING SITE III. Table 2 illustrates the complementarity of the nucleotide sequences of LOC158235 BINDING SITE, designated SEQ ID:41924, to the nucleotide sequence of VGAM2463 RNA, herein designated VGAM RNA, also designated SEQ ID:5174.

Another function of VGAM2463 is therefore inhibition of LOC158235 (Accession XM_098897). Accordingly, utilities of VGAM2463 include diagnosis, prevention and treatment of diseases and clinical conditions associated with LOC158235. LOC158288 (Accession XM_098912) is another VGAM2463 host target gene. LOC158288 BINDING SITE is HOST TARGET binding site found in the 5' untranslated region of mRNA encoded by LOC158288, corresponding to a HOST TARGET binding site such as BINDING SITE I, BINDING SITE II or BINDING SITE III. Table 2 illustrates the complementarity of the nucleotide sequences of LOC158288 BINDING SITE, designated SEQ ID:41929, to the nucleotide sequence of VGAM2463 RNA, herein designated VGAM RNA, also designated SEQ ID:5174.

Another function of VGAM2463 is therefore inhibition of LOC158288 (Accession XM_098912). Accordingly, utilities of VGAM2463 include diagnosis, prevention and treatment of diseases and clinical conditions associated with LOC158288. LOC165721 (Accession XM_093388) is another VGAM2463 host target gene. LOC165721 BINDING SITE is HOST TARGET binding site found in the 5' untranslated region of mRNA encoded by LOC165721, corresponding to a HOST TARGET binding site such as BINDING SITE I, BINDING SITE II or BINDING SITE III. Table 2 illustrates the complementarity of the nucleotide sequences of LOC165721 BINDING SITE, designated SEQ ID:40191, to the nucleotide sequence of VGAM2463 RNA, herein designated VGAM RNA, also designated SEQ ID:5174.

Another function of VGAM2463 is therefore inhibition of LOC165721 (Accession XM_093388). Accordingly, utilities of VGAM2463 include diagnosis, prevention and treatment of diseases and clinical conditions associated with LOC165721. LOC165741 (Accession XM_105272) is another VGAM2463 host target gene. LOC165741 BINDING SITE is HOST TARGET binding site found in the 3' untranslated region of mRNA encoded by LOC165741, corresponding to a HOST TARGET binding site such as BIND- ING SITE I, BINDING SITE II or BINDING SITE III. Table 2 illustrates the complementarity of the nucleotide sequences of LOC165741 BINDING SITE, designated SEQ ID:42191, to the nucleotide sequence of VGAM2463 RNA, herein designated VGAM RNA, also designated SEQ ID:5174.

Another function of VGAM2463 is therefore inhibition of LOC165741 (Accession XM_105272). Accordingly, utilities of VGAM2463 include diagnosis, prevention and treatment of diseases and clinical conditions associated with LOC165741. LOC196463 (Accession XM_113725) is another VGAM2463 host target gene. LOC196463 BINDING SITE is HOST TARGET binding site found in the 3' untranslated region of mRNA encoded by LOC196463, corresponding to a HOST TARGET binding site such as BINDING SITE I, BINDING SITE II or BINDING SITE III. Table 2 illustrates the complementarity of the nucleotide sequences of LOC196463 BINDING SITE, designated SEQ ID:42374, to the nucleotide sequence of VGAM2463 RNA, herein designated VGAM RNA, also designated SEQ ID:5174.

Another function of VGAM2463 is therefore inhibition of LOC196463 (Accession XM_113725). Accordingly, utilities of VGAM2463 include diagnosis, prevention and treatment of diseases and clinical conditions associated with LOC196463. LOC196955 (Accession XM_085210) is another VGAM2463 host target gene. LOC196955 BINDING SITE is HOST TARGET binding site found in the 5' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37936, to the nucleotide sequence of VGAM2463 RNA, herein designated VGAM RNA, also designated SEQ ID:5174.

Another function of VGAM2463 is therefore inhibition of LOC196955 (Accession XM_085210). Accordingly, utilities of VGAM2463 include diagnosis, prevention and treatment of diseases and clinical conditions associated with LOC196955. LOC200010 (Accession XM_117174) is another VGAM2463 host target gene. LOC200010 BINDING SITE is HOST TARGET binding site found in the 3' untranslated region of mRNA encoded by LOC200010, corresponding to a HOST TARGET binding site such as BINDING SITE I, BINDING SITE II or BINDING SITE III. Table 2 illustrates the complementarity of the nucleotide sequences of LOC200010 BINDING SITE, designated SEQ ID:43278, to the nucleotide sequence of VGAM2463 RNA, herein designated VGAM RNA, also designated SEQ ID:5174.

Another function of VGAM2463 is therefore inhibition of LOC200010 (Accession XM_117174). Accordingly, utilities of VGAM2463 include diagnosis, prevention and treatment of diseases and clinical conditions associated with LOC200010. LOC200269 (Accession XM_114175) is another VGAM2463 host target gene. LOC200269 BINDING SITE is HOST TARGET binding site found in the 3' untranslated region of mRNA encoded by LOC200269, corresponding to a HOST TARGET binding site such as BINDING SITE I, BINDING SITE II or BINDING SITE III. Table 2 illustrates the complementarity of the nucleotide sequences of LOC200269 BINDING SITE, designated SEQ ID:42760, to the nucleotide sequence of VGAM2463 RNA, herein designated VGAM RNA, also designated SEQ ID:5174.

Another function of VGAM2463 is therefore inhibition of LOC200269 (Accession XM_114175). Accordingly, utilities of VGAM2463 include diagnosis, prevention and treatment of diseases and clinical conditions associated with LOC200269. LOC201245 (Accession XM_113326) is another VGAM2463 host target gene. LOC201245 BINDING SITE is HOST TARGET binding site found in the 5' untranslated region of mRNA encoded by LOC201245, corresponding to a HOST TARGET binding site such as BINDING SITE I, BINDING SITE II or BINDING SITE III. Table 2 illustrates the complementarity of the nucleotide sequences of LOC201245 BINDING SITE, designated SEQ ID:42230, to the nucleotide sequence of VGAM2463 RNA, herein designated VGAM RNA, also designated SEQ ID:5174.

Another function of VGAM2463 is therefore inhibition of LOC201245 (Accession XM_113326). Accordingly, utilities of VGAM2463 include diagnosis, prevention and treatment of diseases and clinical conditions associated with LOC201245. LOC201294 (Accession XM_113950) is another VGAM2463 host target gene. LOC201294 BINDING SITE is HOST TARGET binding site found in the 3' untranslated region of mRNA encoded by LOC201294, corresponding to a HOST TARGET binding site such as BINDING SITE I, BINDING SITE II or BINDING SITE III. Table 2 illustrates the complementarity of the nucleotide sequences of LOC201294 BINDING SITE, designated SEQ ID:42567, to the nucleotide sequence of VGAM2463 RNA, herein designated VGAM RNA, also designated SEQ ID:5174.

Another function of VGAM2463 is therefore inhibition of LOC201294 (Accession XM_113950). Accordingly, utilities of VGAM2463 include diagnosis, prevention and treatment of diseases and clinical conditions associated with LOC201294. LOC201562 (Accession XM_114343) is another VGAM2463 host target gene. LOC201562 BINDING SITE is HOST TARGET binding site found in the 3' untranslated region of mRNA encoded by LOC201562, corresponding to a HOST TARGET binding site such as BINDING SITE I, BINDING SITE II or BINDING SITE III. Table 2 illustrates the complementarity of the nucleotide sequences of LOC201562 BINDING SITE, designated SEQ ID:42883, to the nucleotide sequence of VGAM2463 RNA, herein designated VGAM RNA, also designated SEQ ID:5174.

Another function of VGAM2463 is therefore inhibition of LOC201562 (Accession XM_114343). Accordingly, utilities of VGAM2463 include diagnosis, prevention and treatment of diseases and clinical conditions associated with LOC201562. LOC201702 (Accession XM_114365) is another VGAM2463 host target gene. LOC201702 BINDING SITE is HOST TARGET binding site found in the 5' untranslated region of mRNA encoded by LOC201702, corresponding to a HOST TARGET binding site such as BINDING SITE I, BINDING SITE II or BINDING SITE III. Table 2 illustrates the complementarity of the nucleotide sequences of LOC201702 BINDING SITE, designated SEQ ID:42901, to the nucleotide sequence of VGAM2463 RNA, herein designated VGAM RNA, also designated SEQ ID:5174.

Another function of VGAM2463 is therefore inhibition of LOC201702 (Accession XM_114365). Accordingly, utilities of VGAM2463 include diagnosis, prevention and treatment of diseases and clinical conditions associated with LOC201702. LOC203248 (Accession XM_114659) is another VGAM2463 host target gene. LOC203248 BINDING SITE is HOST TARGET binding site found in the 3' untranslated region of mRNA encoded by LOC203248, corresponding to a HOST TARGET binding site such as BINDING SITE I, BINDING SITE II or BINDING SITE III. Table 2 illustrates the complementarity of the nucleotide sequences of LOC203248 BINDING SITE, designated SEQ ID:43020, to the nucleotide sequence of VGAM2463 RNA, herein designated VGAM RNA, also designated SEQ ID:5174.

Another function of VGAM2463 is therefore inhibition of LOC203248 (Accession XM_114659). Accordingly, utilities of VGAM2463 include diagnosis, prevention and treatment of diseases and clinical conditions associated with LOC203248. LOC203504 (Accession XM_117550) is another VGAM2463 host target gene. LOC203504 BINDING SITE is HOST TARGET binding site found in the 3' untranslated region of mRNA encoded by LOC203504, corresponding to a HOST TARGET binding site such as BINDING SITE I, BINDING SITE II or BINDING SITE III. Table 2 illustrates the complementarity of the nucleotide sequences of LOC203504 BINDING SITE, designated SEQ ID:43571, to the nucleotide sequence of VGAM2463 RNA, herein designated VGAM RNA, also designated SEQ ID:5174.

Another function of VGAM2463 is therefore inhibition of LOC203504 (Accession XM_117550). Accordingly, utilities of VGAM2463 include diagnosis, prevention and treatment of diseases and clinical conditions associated with LOC203504. LOC219540 (Accession XM_168047) is another VGAM2463 host target gene. LOC219540 BINDING SITE is HOST TARGET binding site found in the 3' untranslated region of mRNA encoded by LOC219540, corresponding to a HOST TARGET binding site such as BINDING SITE I, BINDING SITE II or BINDING SITE III. Table 2 illustrates the complementarity of the nucleotide sequences of LOC219540 BINDING SITE, designated SEQ ID:44958, to the nucleotide sequence of VGAM2463 RNA, herein designated VGAM RNA, also designated SEQ ID:5174.

Another function of VGAM2463 is therefore inhibition of LOC219540 (Accession XM_168047). Accordingly, utilities of VGAM2463 include diagnosis, prevention and treatment of diseases and clinical conditions associated with LOC219540. LOC219654 (Accession XM_166095) is another VGAM2463 host target gene. LOC219654 BINDING SITE1 and LOC219654 BINDING SITE2 are HOST TARGET binding sites found in untranslated regions of mRNA encoded by LOC219654, corresponding to HOST TARGET binding sites such as BINDING SITE I, BINDING SITE II or BINDING SITE III. Table 2 illustrates the complementarity of the nucleotide sequences of LOC219654 BINDING SITE1 and LOC219654 BINDING SITE2, designated SEQ ID:43875 and SEQ ID:43877 respectively, to the nucleotide sequence of VGAM2463 RNA, herein designated VGAM RNA, also designated SEQ ID:5174.

Another function of VGAM2463 is therefore inhibition of LOC219654 (Accession XM_166095). Accordingly, utilities of VGAM2463 include diagnosis, prevention and treatment of diseases and clinical conditions associated with LOC219654. LOC219688 (Accession XM_167568) is another VGAM2463 host target gene. LOC219688 BINDING SITE1 and LOC219688 BINDING SITE2 are HOST TARGET binding sites found in untranslated regions of mRNA encoded by LOC219688, corresponding to HOST TARGET binding sites such as BINDING SITE I, BINDING SITE II or BINDING SITE III. Table 2 illustrates the complementarity of the nucleotide sequences of LOC219688 BINDING SITE1 and LOC219688 BINDING SITE2, designated SEQ ID:44699 and SEQ ID:43984 respectively, to the nucleotide sequence of VGAM2463 RNA, herein designated VGAM RNA, also designated SEQ ID:5174.

Another function of VGAM2463 is therefore inhibition of LOC219688 (Accession XM_167568). Accordingly, utilities of VGAM2463 include diagnosis, prevention and treatment of diseases and clinical conditions associated with LOC219688. LOC221042 (Accession XM_167669) is another VGAM2463 host target gene. LOC221042 BINDING SITE is HOST TARGET binding site found in the 3' untranslated region of mRNA encoded by LOC221042, corresponding to a HOST TARGET binding site such as BINDING SITE I, BINDING SITE II or BINDING SITE III. Table 2 illustrates the complementarity of the nucleotide sequences of LOC221042 BINDING SITE, designated SEQ ID:44756, to the nucleotide sequence of VGAM2463 RNA, herein designated VGAM RNA, also designated SEQ ID:5174.

Another function of VGAM2463 is therefore inhibition of LOC221042 (Accession XM_167669). Accordingly, utilities of VGAM2463 include diagnosis, prevention and treatment of diseases and clinical conditions associated with LOC221042. LOC221474 (Accession XM_166464) is another VGAM2463 host target gene. LOC221474 BINDING SITE is HOST TARGET binding site found in the 5' untranslated region of mRNA encoded by LOC221474, corresponding to a HOST TARGET binding site such as BINDING SITE I, BINDING SITE II or BINDING SITE III. Table 2 illustrates the complementarity of the nucleotide sequences of LOC221474 BINDING SITE, designated SEQ ID:44380, to the nucleotide sequence of VGAM2463 RNA, herein designated VGAM RNA, also designated SEQ ID:5174.

Another function of VGAM2463 is therefore inhibition of LOC221474 (Accession XM_166464). Accordingly, utilities of VGAM2463 include diagnosis, prevention and treatment of diseases and clinical conditions associated with LOC221474. LOC221683 (Accession XM_168089) is another VGAM2463 host target gene. LOC221683 BINDING SITE is HOST TARGET binding site found in the 5' untranslated region of mRNA encoded by LOC221683, corresponding to a HOST TARGET binding site such as BINDING SITE I, BINDING SITE II or BINDING SITE III. Table 2 illustrates the complementarity of the nucleotide sequences of LOC221683 BINDING SITE, designated SEQ ID:45004, to the nucleotide sequence of VGAM2463 RNA, herein designated VGAM RNA, also designated SEQ ID:5174.

Another function of VGAM2463 is therefore inhibition of LOC221683 (Accession XM_168089). Accordingly, utilities of VGAM2463 include diagnosis, prevention and treatment of diseases and clinical conditions associated with LOC221683. LOC221922 (Accession XM_166555) is another VGAM2463 host target gene. LOC221922 BINDING SITE is HOST TARGET binding site found in the 5' untranslated region of mRNA encoded by LOC221922, corresponding to a HOST TARGET binding site such as BINDING SITE I, BINDING SITE II or BINDING SITE III. Table 2 illustrates the complementarity of the nucleotide sequences of LOC221922 BINDING SITE, designated SEQ ID:44534, to the nucleotide sequence of VGAM2463 RNA, herein designated VGAM RNA, also designated SEQ ID:5174.

Another function of VGAM2463 is therefore inhibition of LOC221922 (Accession XM_166555). Accordingly, utilities of VGAM2463 include diagnosis, prevention and treatment of diseases and clinical conditions associated with LOC221922. LOC253216 (Accession XM_170765) is another VGAM2463 host target gene. LOC253216 BINDING SITE is HOST TARGET binding site found in the 3' untranslated region of mRNA encoded by LOC253216, corresponding to a HOST TARGET binding site such as BINDING SITE I, BINDING SITE II or BINDING SITE III. Table 2 illustrates the complementarity of the nucleotide sequences of LOC253216 BINDING SITE, designated SEQ ID:45520, to the nucleotide sequence of VGAM2463 RNA, herein designated VGAM RNA, also designated SEQ ID:5174.

Another function of VGAM2463 is therefore inhibition of LOC253216 (Accession XM_170765). Accordingly, utilities of VGAM2463 include diagnosis, prevention and treatment of diseases and clinical conditions associated with LOC253216. LOC253609 (Accession XM_172986) is another VGAM2463 host target gene. LOC253609 BINDING SITE is HOST TARGET binding site found in the 5' untranslated region of mRNA encoded by LOC253609, corresponding to a HOST TARGET binding site such as BINDING SITE I, BINDING SITE II or BINDING SITE III. Table 2 illustrates the complementarity of the nucleotide sequences of LOC253609 BINDING SITE, designated SEQ ID:46259, to the nucleotide sequence of VGAM2463 RNA, herein designated VGAM RNA, also designated SEQ ID:5174.

Another function of VGAM2463 is therefore inhibition of LOC253609 (Accession XM_172986). Accordingly, utilities of VGAM2463 include diagnosis, prevention and treatment of diseases and clinical conditions associated with LOC253609. LOC253715 (Accession XM_173053) is another VGAM2463 host target gene. LOC253715 BINDING SITE is HOST TARGET binding site found in the 5' untranslated region of mRNA encoded by LOC253715, corresponding to a HOST TARGET binding site such as BINDING SITE I, BINDING SITE II or BINDING SITE III. Table 2 illustrates the complementarity of the nucleotide sequences of LOC253715 BINDING SITE, designated SEQ ID:46311, to the nucleotide sequence of VGAM2463 RNA, herein designated VGAM RNA, also designated SEQ ID:5174.

Another function of VGAM2463 is therefore inhibition of LOC253715 (Accession XM_173053). Accordingly, utilities of VGAM2463 include diagnosis, prevention and treatment of diseases and clinical conditions associated with LOC253715. LOC253805 (Accession XM_172854) is another VGAM2463 host target gene. LOC253805 BINDING SITE is HOST TARGET binding site found in the 5' untranslated region of mRNA encoded by LOC253805, corresponding to a HOST TARGET binding site such as BINDING SITE I, BINDING SITE II or BINDING SITE III. Table 2 illustrates the complementarity of the nucleotide sequences of LOC253805 BINDING SITE, designated SEQ ID:46136, to the nucleotide sequence of VGAM2463 RNA, herein designated VGAM RNA, also designated SEQ ID:5174.

Another function of VGAM2463 is therefore inhibition of LOC253805 (Accession XM_172854). Accordingly, utilities of VGAM2463 include diagnosis, prevention and treatment of diseases and clinical conditions associated with LOC253805. LOC254057 (Accession XM_173085) is another VGAM2463 host target gene. LOC254057 BINDING SITE is HOST TARGET binding site found in the 3' untranslated region of mRNA encoded by LOC254057, corresponding to a HOST TARGET binding site such as BINDING SITE I, BINDING SITE II or BINDING SITE III. Table 2 illustrates the complementarity of the nucleotide sequences of LOC254057 BINDING SITE, designated SEQ ID:46348, to the nucleotide sequence of VGAM2463 RNA, herein designated VGAM RNA, also designated SEQ ID:5174.

Another function of VGAM2463 is therefore inhibition of LOC254057 (Accession XM_173085). Accordingly, utilities of VGAM2463 include diagnosis, prevention and treatment of diseases and clinical conditions associated with LOC254057. LOC254532 (Accession XM_172961) is another VGAM2463 host target gene. LOC254532 BINDING SITE is HOST TARGET binding site found in the 5' untranslated region of mRNA encoded by LOC254532, corresponding to a HOST TARGET binding site such as BINDING SITE I, BINDING SITE II or BINDING SITE III. Table 2 illustrates the complementarity of the nucleotide sequences of LOC254532 BINDING SITE, designated SEQ ID:46210, to the nucleotide sequence of VGAM2463 RNA, herein designated VGAM RNA, also designated SEQ ID:5174.

Another function of VGAM2463 is therefore inhibition of LOC254532 (Accession XM_172961). Accordingly, utilities of VGAM2463 include diagnosis, prevention and treatment of diseases and clinical conditions associated with LOC254532. LOC255040 (Accession XM_172837) is another VGAM2463 host target gene. LOC255040 BINDING SITE is HOST TARGET binding site found in the 3' untranslated region of mRNA encoded by LOC255040, corresponding to a HOST TARGET binding site such as BINDING SITE I, BINDING SITE II or BINDING SITE III. Table 2 illustrates the complementarity of the nucleotide sequences of LOC255040 BINDING SITE, designated SEQ ID:46109, to the nucleotide sequence of VGAM2463 RNA, herein designated VGAM RNA, also designated SEQ ID:5174.

Another function of VGAM2463 is therefore inhibition of LOC255040 (Accession XM_172837). Accordingly, utilities of VGAM2463 include diagnosis, prevention and treatment of diseases and clinical conditions associated with LOC255040. LOC255041 (Accession XM_172838) is another VGAM2463 host target gene. LOC255041 BINDING SITE is HOST TARGET binding site found in the 3' untranslated region of mRNA encoded by LOC255041, corresponding to a HOST TARGET binding site such as BINDING SITE I, BINDING SITE II or BINDING SITE III. Table 2 illustrates the complementarity of the nucleotide sequences of LOC255041 BINDING SITE, designated SEQ ID:46112, to the nucleotide sequence of VGAM2463 RNA, herein designated VGAM RNA, also designated SEQ ID:5174.

Another function of VGAM2463 is therefore inhibition of LOC255041 (Accession XM_172838). Accordingly, utilities of VGAM2463 include diagnosis, prevention and treatment of diseases and clinical conditions associated with LOC255041. LOC256267 (Accession XM_173007) is another VGAM2463 host target gene. LOC256267 BINDING SITE is HOST TARGET binding site found in the 3' untranslated region of mRNA encoded by LOC256267, corresponding to a HOST TARGET binding site such as BINDING SITE I, BINDING SITE II or BINDING SITE III. Table 2 illustrates the complementarity of the nucleotide sequences of LOC256267 BINDING SITE, designated SEQ ID:46278, to the nucleotide sequence of VGAM2463 RNA, herein designated VGAM RNA, also designated SEQ ID:5174.

Another function of VGAM2463 is therefore inhibition of LOC256267 (Accession XM_173007). Accordingly, utilities of VGAM2463 include diagnosis, prevention and treatment of diseases and clinical conditions associated with LOC256267. LOC256846 (Accession XM_170921) is another VGAM2463 host target gene. LOC256846 BINDING SITE is HOST TARGET binding site found in the 5' untranslated region of mRNA encoded by LOC256846, corresponding to a HOST TARGET binding site such as BINDING SITE I, BINDING SITE II or BINDING SITE III. Table 2 illustrates the complementarity of the nucleotide sequences of LOC256846 BINDING SITE, designated SEQ ID:45697, to the nucleotide sequence of VGAM2463 RNA, herein designated VGAM RNA, also designated SEQ ID:5174.

Another function of VGAM2463 is therefore inhibition of LOC256846 (Accession XM_170921). Accordingly, utilities of VGAM2463 include diagnosis, prevention and treatment of diseases and clinical conditions associated with LOC256846. LOC257106 (Accession XM_170910) is another VGAM2463 host target gene. LOC257106 BINDING SITE is HOST TARGET binding site found in the 3' untranslated region of mRNA encoded by LOC257106, corresponding to a HOST TARGET binding site such as BINDING SITE I, BINDING SITE II or BINDING SITE III. Table 2 illustrates the complementarity of the nucleotide sequences of LOC257106 BINDING SITE, designated SEQ ID:45677, to the nucleotide sequence of VGAM2463 RNA, herein designated VGAM RNA, also designated SEQ ID:5174.

Another function of VGAM2463 is therefore inhibition of LOC257106 (Accession XM_170910). Accordingly, utilities of VGAM2463 include diagnosis, prevention and treatment of diseases and clinical conditions associated with LOC257106. LOC51236 (Accession NM_016458) is another VGAM2463 host target gene. LOC51236 BINDING SITE is HOST TARGET binding site found in the 3' untranslated region of mRNA encoded by LOC51236, corresponding to a HOST TARGET binding site such as BINDING SITE I, BINDING SITE II or BINDING SITE III. Table 2 illustrates the complementarity of the nucleotide sequences of LOC51236 BINDING SITE, designated SEQ ID:18572, to the nucleotide sequence of VGAM2463 RNA, herein designated VGAM RNA, also designated SEQ ID:5174.

Another function of VGAM2463 is therefore inhibition of LOC51236 (Accession NM_016458). Accordingly, utilities of VGAM2463 include diagnosis, prevention and treatment of diseases and clinical conditions associated with LOC51236. LOC51337 (Accession NM_016647) is another VGAM2463 host target gene. LOC51337 BINDING SITE is HOST TARGET binding site found in the 3' untranslated region of mRNA encoded by LOC51337, corresponding to a HOST TARGET binding site such as BINDING SITE I, BINDING SITE II or BINDING SITE III. Table 2 illustrates the complementarity of the nucleotide sequences of LOC51337 BINDING SITE, designated SEQ ID:18763, to the nucleotide sequence of VGAM2463 RNA, herein designated VGAM RNA, also designated SEQ ID:5174.

Another function of VGAM2463 is therefore inhibition of LOC51337 (Accession NM_016647). Accordingly, utilities of VGAM2463 include diagnosis, prevention and treatment of diseases and clinical conditions associated with LOC51337. LOC57105 (Accession NM_020377) is another VGAM2463 host target gene. LOC57105 BINDING SITE1 and LOC57105 BINDING SITE2 are HOST TARGET binding sites found in untranslated regions of mRNA encoded by LOC57105, corresponding to HOST TARGET binding sites such as BINDING SITE I, BINDING SITE II or BINDING SITE III. Table 2 illustrates the complementarity of the nucleotide sequences of LOC57105 BINDING SITE1 and LOC57105 BINDING SITE2, designated SEQ ID:21640 and SEQ ID:21642 respectively, to the nucleotide sequence of VGAM2463 RNA, herein designated VGAM RNA, also designated SEQ ID:5174.

Another function of VGAM2463 is therefore inhibition of LOC57105 (Accession NM_020377). Accordingly, utilities of VGAM2463 include diagnosis, prevention and treatment of diseases and clinical conditions associated with LOC57105. LOC84548 (Accession XM_048904) is another VGAM2463 host target gene. LOC84548 BINDING SITE is HOST TARGET binding site found in the 3' untranslated region of mRNA encoded by LOC84548, corresponding to a HOST TARGET binding site such as BINDING SITE I, BINDING SITE II or BINDING SITE III. Table 2 illustrates the complementarity of the nucleotide sequences of LOC84548 BINDING SITE, designated SEQ ID:35299, to the nucleotide sequence of VGAM2463 RNA, herein designated VGAM RNA, also designated SEQ ID:5174.

Another function of VGAM2463 is therefore inhibition of LOC84548 (Accession XM_048904). Accordingly, utilities of VGAM2463 include diagnosis, prevention and treatment of diseases and clinical conditions associated with LOC84548. LOC90072 (Accession XM_028702) is another VGAM2463 host target gene. LOC90072 BINDING SITE is HOST TARGET binding site found in the 3' untranslated region of mRNA encoded by LOC90072, corresponding to a HOST TARGET binding site such as BINDING SITE I, BINDING SITE II or BINDING SITE III. Table 2 illustrates the complementarity of the nucleotide sequences of LOC90072 BINDING SITE, designated SEQ ID:30729, to the nucleotide sequence of VGAM2463 RNA, herein designated VGAM RNA, also designated SEQ ID:5174.

Another function of VGAM2463 is therefore inhibition of LOC90072 (Accession XM_028702). Accordingly, utilities of VGAM2463 include diagnosis, prevention and treatment of diseases and clinical conditions associated with LOC90072. LOC90288 (Accession XM_030669) is another VGAM2463 host target gene. LOC90288 BINDING SITE is HOST TARGET binding site found in the 3' untranslated region of mRNA encoded by LOC90288, corresponding to a HOST TARGET binding site such as BINDING SITE I, BINDING SITE II or BINDING SITE III. Table 2 illustrates the complementarity of the nucleotide sequences of LOC90288 BINDING SITE, designated SEQ ID:31118, to the nucleotide sequence of VGAM2463 RNA, herein designated VGAM RNA, also designated SEQ ID:5174.

Another function of VGAM2463 is therefore inhibition of LOC90288 (Accession XM_030669). Accordingly, utilities of VGAM2463 include diagnosis, prevention and treatment of diseases and clinical conditions associated with LOC90288. LOC90550 (Accession XM_054582) is another VGAM2463 host target gene. LOC90550 BINDING SITE is HOST TARGET binding site found in the 3' untranslated region of mRNA encoded by LOC90550, corresponding to a HOST TARGET binding site such as BINDING SITE I, BINDING SITE II or BINDING SITE III. Table 2 illustrates the complementarity of the nucleotide sequences of LOC90550 BINDING SITE, designated SEQ ID:36178, to the nucleotide sequence of VGAM2463 RNA, herein designated VGAM RNA, also designated SEQ ID:5174.

Another function of VGAM2463 is therefore inhibition of LOC90550 (Accession XM_054582). Accordingly, utilities of VGAM2463 include diagnosis, prevention and treatment of diseases and clinical conditions associated with LOC90550. LOC90736 (Accession XM_033811) is another VGAM2463 host target gene. LOC90736 BINDING SITE is HOST TARGET binding site found in the 3' untranslated region of mRNA encoded by LOC90736, corresponding to a HOST TARGET binding site such as BINDING SITE I, BINDING SITE II or BINDING SITE III. Table 2 illustrates the complementarity of the nucleotide sequences of LOC90736 BINDING SITE, designated SEQ ID:31957, to the nucleotide sequence of VGAM2463 RNA, herein designated VGAM RNA, also designated SEQ ID:5174.

Another function of VGAM2463 is therefore inhibition of LOC90736 (Accession XM_033811). Accordingly, utilities of VGAM2463 include diagnosis, prevention and treatment of diseases and clinical conditions associated with LOC90736. LOC90917 (Accession XM_034861) is another VGAM2463 host target gene. LOC90917 BINDING SITE is HOST TARGET binding site found in the 3' untranslated region of mRNA encoded by LOC90917, corresponding to a HOST TARGET binding site such as BINDING SITE I, BINDING SITE II or BINDING SITE III. Table 2 illustrates the complementarity of the nucleotide sequences of LOC90917 BINDING SITE, designated SEQ ID:32166, to the nucleotide sequence of VGAM2463 RNA, herein designated VGAM RNA, also designated SEQ ID:5174.

Another function of VGAM2463 is therefore inhibition of LOC90917 (Accession XM_034861). Accordingly, utilities of VGAM2463 include diagnosis, prevention and treatment of diseases and clinical conditions associated with LOC90917. LOC91397 (Accession XM_038219) is another VGAM2463 host target gene. LOC91397 BINDING SITE is HOST TARGET binding site found in the 5' untranslated region of mRNA encoded by LOC91397, corresponding to a HOST TARGET binding site such as BINDING SITE I, BINDING SITE II or BINDING SITE III. Table 2 illustrates the complementarity of the nucleotide sequences of LOC91397 BINDING SITE, designated SEQ ID:32780, to the nucleotide sequence of VGAM2463 RNA, herein designated VGAM RNA, also designated SEQ ID:5174.

Another function of VGAM2463 is therefore inhibition of LOC91397 (Accession XM_038219). Accordingly, utilities of VGAM2463 include diagnosis, prevention and treatment of diseases and clinical conditions associated with LOC91397. LOC91960 (Accession XM_041872) is another VGAM2463 host target gene. LOC91960 BINDING SITE is HOST TARGET binding site found in the 3' untranslated region of mRNA encoded by LOC91960, corresponding to a HOST TARGET binding site such as BINDING SITE I, BINDING SITE II or BINDING SITE III. Table 2 illustrates the complementarity of the nucleotide sequences of LOC91960 BINDING SITE, designated SEQ ID:33613, to the nucleotide sequence of VGAM2463 RNA, herein designated VGAM RNA, also designated SEQ ID:5174.

Another function of VGAM2463 is therefore inhibition of LOC91960 (Accession XM_041872). Accordingly, utilities of VGAM2463 include diagnosis, prevention and treatment of diseases and clinical conditions associated with LOC91960. LOC92230 (Accession XM_043733) is another VGAM2463 host target gene. LOC92230 BINDING SITE is HOST TARGET binding site found in the 5' untranslated region of mRNA encoded by LOC92230, corresponding to a HOST TARGET binding site such as BINDING SITE I, BINDING SITE II or BINDING SITE III. Table 2 illustrates the complementarity of the nucleotide sequences of LOC92230 BINDING SITE, designated SEQ ID:34008, to the nucleotide sequence of VGAM2463 RNA, herein designated VGAM RNA, also designated SEQ ID:5174.

Another function of VGAM2463 is therefore inhibition of LOC92230 (Accession XM_043733). Accordingly, utilities of VGAM2463 include diagnosis, prevention and treatment of diseases and clinical conditions associated with LOC92230. LOC92405 (Accession XM_044914) is another VGAM2463 host target gene. LOC92405 BINDING SITE is HOST TARGET binding site found in the 3' untranslated region of mRNA encoded by LOC92405, corresponding to a HOST TARGET binding site such as BINDING SITE I, BINDING SITE II or BINDING SITE III. Table 2 illustrates the complementarity of the nucleotide sequences of LOC92405 BINDING SITE, designated SEQ ID:34304, to the nucleotide sequence of VGAM2463 RNA, herein designated VGAM RNA, also designated SEQ ID:5174.

Another function of VGAM2463 is therefore inhibition of LOC92405 (Accession XM_044914). Accordingly, utilities of VGAM2463 include diagnosis, prevention and treatment of diseases and clinical conditions associated with LOC92405. LOC92466 (Accession XM_045251) is another VGAM2463 host target gene. LOC92466 BINDING SITE is HOST TARGET binding site found in the 3' untranslated region of mRNA encoded by LOC92466, corresponding to a HOST TARGET binding site such as BINDING SITE I, BINDING SITE II or BINDING SITE III. Table 2 illustrates the complementarity of the nucleotide sequences of LOC92466 BINDING SITE, designated SEQ ID:34397, to the nucleotide sequence of VGAM2463 RNA, herein designated VGAM RNA, also designated SEQ ID:5174.

Another function of VGAM2463 is therefore inhibition of LOC92466 (Accession XM_045251). Accordingly, utilities of VGAM2463 include diagnosis, prevention and treatment of diseases and clinical conditions associated with LOC92466. LOC92710 (Accession XM_046811) is another VGAM2463 host target gene. LOC92710 BINDING SITE is HOST TARGET binding site found in the 5' untranslated region of mRNA encoded by LOC92710, corresponding to a HOST TARGET binding site such as BINDING SITE I, BINDING SITE II or BINDING SITE III. Table 2 illustrates the complementarity of the nucleotide sequences of LOC92710 BINDING SITE, designated SEQ ID:34835, to the nucleotide sequence of VGAM2463 RNA, herein designated VGAM RNA, also designated SEQ ID:5174.

Another function of VGAM2463 is therefore inhibition of LOC92710 (Accession XM_046811). Accordingly, utilities of VGAM2463 include diagnosis, prevention and treatment of diseases and clinical conditions associated with LOC92710. LOC95702 (Accession XM_031446) is another VGAM2463 host target gene. LOC95702 BINDING SITE is HOST TARGET binding site found in the 5' untranslated region of mRNA encoded by LOC95702, corresponding to a HOST TARGET binding site such as BINDING SITE I, BINDING SITE II or BINDING SITE III. Table 2 illustrates the complementarity of the nucleotide sequences of LOC95702 BINDING SITE, designated SEQ ID:31383, to the nucleotide sequence of VGAM2463 RNA, herein designated VGAM RNA, also designated SEQ ID:5174.

Another function of VGAM2463 is therefore inhibition of LOC95702 (Accession XM_031446). Accordingly, utilities of VGAM2463 include diagnosis, prevention and treatment of diseases and clinical conditions associated with LOC95702. FIG. 1 further provides a conceptual description of a novel bioinformatically detected viral gene of the present invention, referred to here as Viral Genomic Address Messenger 2464 (VGAM2464) viral gene, which modulates expression of respective host target genes thereof, the function and utility of which host target genes is known in the art.

VGAM2464 is a novel bioinformatically detected regulatory, non protein coding, viral micro RNA (miRNA) gene. The method by which VGAM2464 was detected is described hereinabove with reference to FIGS. 1-8.

VGAM2464 gene, herein designated VGAM GENE, is a viral gene contained in the genome of Mouse Cytomegalovirus 1. VGAM2464 host target gene, herein designated VGAM HOST TARGET GENE, is a human gene contained in the human genome.

VGAM2464 gene encodes a VGAM2464 precursor RNA, herein designated VGAM PRECURSOR RNA. Similar to other miRNA genes, and unlike most ordinary genes, VGAM2464 precursor RNA does not encode a protein. A nucleotide sequence identical or highly similar to the nucleotide sequence of VGAM2464 precursor RNA is designated SEQ ID:2450, and is provided hereinbelow with reference to the sequence listing part. Nucleotide sequence SEQ ID:2450 is located at position 225307 relative to the genome of Mouse Cytomegalovirus 1.

VGAM2464 precursor RNA folds onto itself, forming VGAM2464 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2464 folded precursor RNA into VGAM2464 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2464 RNA is designated SEQ ID:5175, and is provided hereinbelow with reference to the sequence listing part.

VGAM2464 host target gene, herein designated VGAM HOST TARGET GENE, encodes a corresponding messenger RNA, VGAM2464 host target RNA, herein designated VGAM HOST TARGET RNA. VGAM2464 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2464 RNA, herein designated VGAM RNA, binds complementarily to one or more host target binding sites located in untranslated regions of VGAM2464 host target RNA, herein designated VGAM HOST TARGET RNA. This complementary binding is due to the fact that the nucleotide sequence of VGAM2464 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2464 RNA, herein designated VGAM RNA, may have a different number of host target binding sites in untranslated regions of a VGAM2464 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2464 RNA, herein designated VGAM RNA, to host target binding sites on VGAM2464 host target RNA, herein designated VGAM HOST TARGET RNA, such as BINDING SITE I, BINDING SITE II and BINDING SITE III, inhibits translation of VGAM2464 host target RNA into VGAM2464 host target protein, herein designated VGAM HOST TARGET PROTEIN. VGAM host target protein is therefore outlined by a broken line.

It is appreciated that VGAM2464 host target gene, herein designated VGAM HOST TARGET GENE, in fact represents a plurality of VGAM2464 host target genes. The mRNA of each one of this plurality of VGAM2464 host target genes comprises one or more host target binding sites, each having a nucleotide sequence which is at least partly complementary to VGAM2464 RNA, herein designated VGAM RNA, and which when bound by VGAM2464 RNA causes inhibition of translation of respective one or more VGAM2464 host target proteins.

It is further appreciated by one skilled in the art that the mode of translational inhibition illustrated by FIG. 1 with specific reference to translational inhibition exerted by VGAM2464 gene, herein designated VGAM GENE, on one or more VGAM2464 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2464 is inhibition of expression of host target genes, as part of a novel viral mechanism of attacking a host. Accordingly, utilities of VGAM2464 include diagnosis, prevention and treatment of viral infection by Mouse Cytomegalovirus 1. Specific functions, and accordingly utilities, of VGAM2464 correlate with, and may be deduced from, the identity of the host target genes which VGAM2464 binds and inhibits, and the function of these host target genes, as elaborated hereinbelow.

Nucleotide sequences of the VGAM2464 precursor RNA, herein designated VGAM PRECURSOR RNA, and of the 'diced' VGAM2464 RNA, herein designated VGAM RNA, and a schematic representation of the secondary folding of VGAM2464 folded precursor RNA, herein designated VGAM FOLDED PRECURSOR RNA, of VGAM2464 are further described hereinbelow with reference to Table 1.

Nucleotide sequences of host target binding sites, such as BINDING SITE-I, BINDING SITE-II and BINDING SITE-III of FIG. 1, found on VGAM2464 host target RNA, and schematic representation of the complementarity of each of these host target binding sites to VGAM2464 RNA, herein designated VGAM RNA, are described hereinbelow with reference to Table 2.

As mentioned hereinabove with reference to FIG. 1, a function of VGAM2464 gene, herein designated VGAM is inhibition of expression of VGAM2464 target genes. It is appreciated that specific functions, and accordingly utilities, of VGAM2464 correlate with, and may be deduced from, the identity of the target genes which VGAM2464 binds and inhibits, and the function of these target genes, as elaborated hereinbelow.

B-cell CLL/lymphoma 7A (BCL7A, Accession NM_020993) is a VGAM2464 host target gene. BCL7A BINDING SITE is HOST TARGET binding site found in the 3' untranslated region of mRNA encoded by BCL7A, corresponding to a HOST TARGET binding site such as BINDING SITE I, BINDING SITE II or BINDING SITE III. Table 2 illustrates the complementarity of the nucleotide sequences of BCL7A BINDING SITE, designated SEQ ID:21986, to the nucleotide sequence of VGAM2464 RNA, herein designated VGAM RNA, also designated SEQ ID:5175.

A function of VGAM2464 is therefore inhibition of B-cell CLL/lymphoma 7A (BCL7A, Accession NM_020993). Accordingly, utilities of VGAM2464 include diagnosis, prevention and treatment of diseases and clinical conditions associated with BCL7A. Hect Domain and RLD 2 (HERC2, Accession NM_004667) is another VGAM2464 host target gene. HERC2 BINDING SITE is HOST TARGET binding site found in the 3' untranslated region of mRNA encoded by HERC2, corresponding to a HOST TARGET binding site such as BINDING SITE I, BINDING SITE II or BINDING SITE III. Table 2 illustrates the complementarity of the nucleotide sequences of HERC2 BINDING SITE, designated SEQ ID:11042, to the nucleotide sequence of VGAM2464 RNA, herein designated VGAM RNA, also designated SEQ ID:5175.

Another function of VGAM2464 is therefore inhibition of Hect Domain and RLD 2 (HERC2, Accession NM_004667), a gene which may be a guanine nucleotide exchange factor involved in intracellular protein transport. Accordingly, utilities of VGAM2464 include diagnosis, prevention and treatment of diseases and clinical conditions associated with HERC2. The function of HERC2 has been established by previous studies. Prader-Willi syndrome (PWS; 176270) and Angelman syndrome (AS; 105830) result from deletions and loss of function of oppositely imprinted genes located within the proximal 2 Mb of the 15q11-q13 region. Low-copy repeat elements have been identified in the vicinity of the 3 deletion breakpoint hotspots using molecular and cytologic methods. Using positional cloning from low-copy repeats flanking 15q11-q13, genomic sequence analysis, EST database searching, PCR, and long-range RT-PCR, Ji et al. (1999) obtained a cDNA encoding HERC2, which is identical to a partial cDNA, KIAA0393, identified by Nagase et al. (1997). Sequence analysis predicted that the 4,834-amino acid protein, which is 95% identical and 99% similar to the mouse protein, contains 3 RCC1-like domains (RLDs); a putative ZZ-type zinc finger motif with 6 conserved cysteines and 2 outlying histidine residues; a C-terminal HECT or E3 ubiquitin ligase (see OMIM Ref. No. UBE3A; 601623) domain; and several potential phosphorylation sites. The overall structure is similar to that of HERC1, although HERC1 has only 2 RLDs and no zinc finger motif. The C-terminal region of HERC2 resembles that of HERC3 (OMIM Ref. No. 605200). Northern blot analysis revealed ubiquitous expression of a 15.5-kb HERC2 transcript, with high levels in fetal tissues and adult skeletal muscle, heart, ovary, testis, and brain. Animal model experiments lend further support to the function of HERC2. The mouse Herc2 gene is located in the jdf2 (juvenile development and fertility-2) interval of chromosome 7C. Ji et al. (1999) identified splice junction mutations in the Herc2 gene in chemically-induced jdf2 mutant alleles. The mutations led to exon skipping and premature termination, resulting in neuromuscular secretory vesicle defects, sperm acrosome defects, and juvenile lethality in jdf2 mice.

It is appreciated that the abovementioned animal model for HERC2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Ji, Y.; Walkowicz, M. J.; Buiting, K.; Johnson, D. K.; Tarvin, R. E.; Rinchik, E. M.; Horsthemke, B.; Stubbs, L.; Nicholls, R. D.: The ancestral gene for transcribed, low-copy repeats in the Prader-Willi/Angelman region encodes a large protein implicated in protein trafficking, which is deficient in mice with neuromuscular and spermiogenic abnormalities. Hum. Molec. Genet. 8:533-542, 1999; and Nagase, T.; Ishikawa, K.; Nakajima, D.; Ohira, M.; Seki, N.; Miyajima, N.; Tanaka, A.; Kotani, H.; Nomura, N.; Ohara, O.: Prediction of the coding sequences of unidentified human genes.

Further studies establishing the function and utilities of HERC2 are found in John Hopkins OMIM database record ID 605837, and in sited publications numbered 6435 listed in the bibliography section hereinbelow, which are also hereby incorporated by reference. Integral Membrane Protein 2B (ITM2B, Accession NM_021999) is another VGAM2464 host target gene. ITM2B BINDING SITE is HOST TARGET binding site found in the 5' untranslated region of mRNA encoded by ITM2B, corresponding to a HOST TARGET binding site such as BINDING SITE I, BINDING SITE II or BINDING SITE III. Table 2 illustrates the complementarity of the nucleotide sequences of ITM2B BINDING SITE, designated SEQ ID:22538, to the nucleotide sequence of VGAM2464 RNA, herein designated VGAM RNA, also designated SEQ ID:5175.

Another function of VGAM2464 is therefore inhibition of Integral Membrane Protein 2B (ITM2B, Accession NM_021999), a gene which is a member of the type II integral membrane protein family. Accordingly, utilities of VGAM2464 include diagnosis, prevention and treatment of diseases and clinical conditions associated with ITM2B. The function of ITM2B and its association with various diseases and clinical conditions, has been established by previous studies, as described hereinabove with reference to VGAM458. DKFZp586I021 (Accession NM_032271) is another VGAM2464 host target gene. DKFZp586I021 BINDING SITE is HOST TARGET binding site found in the 3' untranslated region of mRNA encoded by DKFZp586I021, corresponding to a HOST TARGET binding site such as BINDING SITE I, BINDING SITE II or BINDING SITE III. Table 2 illustrates the complementarity of the nucleotide sequences of DKFZp586I021 BINDING SITE, designated SEQ ID:26017, to the nucleotide sequence of VGAM2464 RNA, herein designated VGAM RNA, also designated SEQ ID:5175.

Another function of VGAM2464 is therefore inhibition of DKFZp586I021 (Accession NM_032271). Accordingly, utilities of VGAM2464 include diagnosis, prevention and treatment of diseases and clinical conditions associated with DKFZp586I021. KIAA1649 (Accession NM_032311) is another VGAM2464 host target gene. KIAA1649 BINDING SITE is HOST TARGET binding site found in the 3' untranslated region of mRNA encoded by KIAA1649, corresponding to a HOST TARGET binding site such as BINDING SITE I, BINDING SITE II or BINDING SITE III. Table 2 illustrates the complementarity of the nucleotide sequences of KIAA1649 BINDING SITE, designated SEQ ID:26108, to the nucleotide sequence of VGAM2464 RNA, herein designated VGAM RNA, also designated SEQ ID:5175.

Another function of VGAM2464 is therefore inhibition of KIAA1649 (Accession NM_032311). Accordingly, utilities of VGAM2464 include diagnosis, prevention and treatment of diseases and clinical conditions associated with KIAA1649. KIAA1856 (Accession XM_166549) is another VGAM2464 host target gene. KIAA1856 BINDING SITE is HOST TARGET binding site found in the 3' untranslated region of mRNA encoded by KIAA1856, corresponding to a HOST TARGET binding site such as BINDING SITE I, BINDING SITE II or BINDING SITE III. Table 2 illustrates the complementarity of the nucleotide sequences of KIAA1856 BINDING SITE, designated SEQ ID:44525, to the nucleotide sequence of VGAM2464 RNA, herein designated VGAM RNA, also designated SEQ ID:5175.

Another function of VGAM2464 is therefore inhibition of KIAA1856 (Accession XM_166549). Accordingly, utilities of VGAM2464 include diagnosis, prevention and treatment of diseases and clinical conditions associated with KIAA1856. MCF.2 Cell Line Derived Transforming Sequence-like (MCF2L, Accession XM_027516) is another VGAM2464 host target gene. MCF2L BINDING SITE is HOST TARGET binding site found in the 3' untranslated region of mRNA encoded by MCF2L, corresponding to a HOST TARGET binding site such as BINDING SITE I, BINDING SITE II or BINDING SITE III. Table 2 illustrates the complementarity of the nucleotide sequences of MCF2L BINDING SITE, designated SEQ ID:30508, to the nucleotide sequence of VGAM2464 RNA, herein designated VGAM RNA, also designated SEQ ID:5175.

Another function of VGAM2464 is therefore inhibition of MCF.2 Cell Line Derived Transforming Sequence-like (MCF2L, Accession XM_027516). Accordingly, utilities of VGAM2464 include diagnosis, prevention and treatment of diseases and clinical conditions associated with MCF2L. MGC20235 (Accession NM_145041) is another VGAM2464 host target gene. MGC20235 BINDING SITE is HOST TARGET binding site found in the 3' untranslated region of mRNA encoded by MGC20235, corresponding to a HOST TARGET binding site such as BINDING SITE I, BINDING SITE II or BINDING SITE III. Table 2 illustrates the complementarity of the nucleotide sequences of MGC20235 BINDING SITE, designated SEQ ID:29668, to the nucleotide sequence of VGAM2464 RNA, herein designated VGAM RNA, also designated SEQ ID:5175.

Another function of VGAM2464 is therefore inhibition of MGC20235 (Accession NM_145041). Accordingly, utilities of VGAM2464 include diagnosis, prevention and treatment of diseases and clinical conditions associated with MGC20235. WIT-1 (Accession NM_015855) is another VGAM2464 host target gene. WIT-1 BINDING SITE is HOST TARGET binding site found in the 3' untranslated region of mRNA encoded by WIT-1, corresponding to a HOST TARGET binding site such as BINDING SITE I, BINDING SITE II or BINDING SITE III. Table 2 illustrates the complementarity of the nucleotide sequences of WIT-1 BINDING SITE, designated SEQ ID:17990, to the nucleotide sequence of VGAM2464 RNA, herein designated VGAM RNA, also designated SEQ ID:5175.

Another function of VGAM2464 is therefore inhibition of WIT-1 (Accession NM_015855). Accordingly, utilities of VGAM2464 include diagnosis, prevention and treatment of diseases and clinical conditions associated with WIT-1. LOC143888 (Accession XM_084669) is another VGAM2464 host target gene. LOC143888 BINDING SITE is HOST TARGET binding site found in the 3' untranslated region of mRNA encoded by LOC143888, corresponding to a HOST TARGET binding site such as BINDING SITE I, BINDING SITE II or BINDING SITE III. Table 2 illustrates the complementarity of the nucleotide sequences of LOC143888 BINDING SITE, designated SEQ ID:37670, to the nucleotide sequence of VGAM2464 RNA, herein designated VGAM RNA, also designated SEQ ID:5175.

Another function of VGAM2464 is therefore inhibition of LOC143888 (Accession XM_084669). Accordingly, utilities of VGAM2464 include diagnosis, prevention and treatment of diseases and clinical conditions associated with LOC143888. LOC147463 (Accession XM_085799) is another VGAM2464 host target gene. LOC147463 BINDING SITE is HOST TARGET binding site found in the 5' untranslated region of mRNA encoded by LOC147463, corresponding to a HOST TARGET binding site such as BINDING SITE I, BINDING SITE II or BINDING SITE III. Table 2 illustrates the complementarity of the nucleotide sequences of LOC147463 BINDING SITE, designated SEQ ID:38340, to the nucleotide sequence of VGAM2464 RNA, herein designated VGAM RNA, also designated SEQ ID:5175.

Another function of VGAM2464 is therefore inhibition of LOC147463 (Accession XM_085799). Accordingly, utilities of VGAM2464 include diagnosis, prevention and treatment of diseases and clinical conditions associated with LOC147463. LOC91695 (Accession XM_040084) is another VGAM2464 host target gene. LOC91695 BINDING SITE is HOST TARGET binding site found in the 5' untranslated region of mRNA encoded by LOC91695, corresponding to a HOST TARGET binding site such as BINDING SITE I, BINDING SITE II or BINDING SITE III. Table 2 illustrates the complementarity of the nucleotide sequences of LOC91695 BINDING SITE, designated SEQ ID:33252, to the nucleotide sequence of VGAM2464 RNA, herein designated VGAM RNA, also designated SEQ ID:5175.

Another function of VGAM2464 is therefore inhibition of LOC91695 (Accession XM_040084). Accordingly, utilities of VGAM2464 include diagnosis, prevention and treatment of diseases and clinical conditions associated with LOC91695. FIG. 1 further provides a conceptual description of a novel bioinformatically detected viral gene of the present invention, referred to here as Viral Genomic Address Messenger 2465 (VGAM2465) viral gene, which modulates expression of respective host target genes thereof, the function and utility of which host target genes is known in the art.

VGAM2465 is a novel bioinformatically detected regulatory, non protein coding, viral micro RNA (miRNA) gene. The method by which VGAM2465 was detected is described hereinabove with reference to FIGS. 1-8.

VGAM2465 gene, herein designated VGAM GENE, is a viral gene contained in the genome of Mouse Cytomegalovirus 1. VGAM2465 host target gene, herein designated VGAM HOST TARGET GENE, is a human gene contained in the human genome.

VGAM2465 gene encodes a VGAM2465 precursor RNA, herein designated VGAM PRECURSOR RNA. Similar to other miRNA genes, and unlike most ordinary genes, VGAM2465 precursor RNA does not encode a protein. A nucleotide sequence identical or highly similar to the nucleotide sequence of VGAM2465 precursor RNA is designated SEQ ID:2451, and is provided hereinbelow with reference to the sequence listing part. Nucleotide sequence SEQ ID:2451 is located at position 161125 relative to the genome of Mouse Cytomegalovirus 1.

VGAM2465 precursor RNA folds onto itself, forming VGAM2465 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2465 folded precursor RNA into VGAM2465 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2465 RNA is designated SEQ ID:5176, and is provided hereinbelow with reference to the sequence listing part.

VGAM2465 host target gene, herein designated VGAM HOST TARGET GENE, encodes a corresponding messenger RNA, VGAM2465 host target RNA, herein designated VGAM HOST TARGET RNA. VGAM2465 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2465 RNA, herein designated VGAM RNA, binds complementarily to one or more host target binding sites located in untranslated regions of VGAM2465 host target RNA, herein designated VGAM HOST TARGET RNA. This complementary binding is due to the fact that the nucleotide sequence of VGAM2465 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2465 RNA, herein designated VGAM RNA, may have a different number of host target binding sites in untranslated regions of a VGAM2465 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2465 RNA, herein designated VGAM RNA, to host target binding sites on VGAM2465 host target RNA, herein designated VGAM HOST TARGET RNA, such as BINDING SITE I, BINDING SITE II and BINDING SITE III, inhibits translation of VGAM2465 host target RNA into VGAM2465 host target protein, herein designated VGAM HOST TARGET PROTEIN. VGAM host target protein is therefore outlined by a broken line.

It is appreciated that VGAM2465 host target gene, herein designated VGAM HOST TARGET GENE, in fact represents a plurality of VGAM2465 host target genes. The mRNA of each one of this plurality of VGAM2465 host target genes comprises one or more host target binding sites, each having a nucleotide sequence which is at least partly complementary to VGAM2465 RNA, herein designated VGAM RNA, and which when bound by VGAM2465 RNA causes inhibition of translation of respective one or more VGAM2465 host target proteins.

It is further appreciated by one skilled in the art that the mode of translational inhibition illustrated by FIG. 1 with specific reference to translational inhibition exerted by VGAM2465 gene, herein designated VGAM GENE, on one or more VGAM2465 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2465 is inhibition of expression of host target genes, as part of a novel viral mechanism of attacking a host. Accordingly, utilities of VGAM2465 include diagnosis, prevention and treatment of viral infection by Mouse Cytomegalovirus 1. Specific functions, and accordingly utilities, of VGAM2465 correlate with, and may be deduced from, the identity of the host target genes which VGAM2465 binds and inhibits, and the function of these host target genes, as elaborated hereinbelow.

Nucleotide sequences of the VGAM2465 precursor RNA, herein designated VGAM PRECURSOR RNA, and of the 'diced' VGAM2465 RNA, herein designated VGAM RNA, and a schematic representation of the secondary folding of VGAM2465 folded precursor RNA, herein designated VGAM FOLDED PRECURSOR RNA, of VGAM2465 are further described hereinbelow with reference to Table 1.

Nucleotide sequences of host target binding sites, such as BINDING SITE-I, BINDING SITE-II and BINDING SITE-III of FIG. 1, found on VGAM2465 host target RNA, and schematic representation of the complementarity of each of these host target binding sites to VGAM2465 RNA, herein designated VGAM RNA, are described hereinbelow with reference to Table 2.

As mentioned hereinabove with reference to FIG. 1, a function of VGAM2465 gene, herein designated VGAM is inhibition of expression of VGAM2465 target genes. It is appreciated that specific functions, and accordingly utilities, of VGAM2465 correlate with, and may be deduced from, the identity of the target genes which VGAM2465 binds and inhibits, and the function of these target genes, as elaborated hereinbelow.

Proteoglycan 1, Secretory Granule (PRG1, Accession NM_002727) is a VGAM2465 host target gene. PRG1 BINDING SITE is HOST TARGET binding site found in the 3' untranslated region of mRNA encoded by PRG1, corresponding to a HOST TARGET binding site such as BINDING SITE I, BINDING SITE II or BINDING SITE III. Table 2 illustrates the complementarity of the nucleotide sequences of PRG1 BINDING SITE, designated SEQ ID:8590, to the nucleotide sequence of VGAM2465 RNA, herein designated VGAM RNA, also designated SEQ ID:5176.

A function of VGAM2465 is therefore inhibition of Proteoglycan 1, Secretory Granule (PRG1, Accession NM_002727), a gene which protects cells from apoptosis induced by FAS or TNFA. Accordingly, utilities of VGAM2465 include diagnosis, prevention and treatment of diseases and clinical conditions associated with PRG1. The function of PRG1 has been established by previous studies. Transcription factors of the nuclear factor-kappa-B/rel (NF-kappa-B) family (OMIM Ref. No. 164011) may be important in cell survival by regulating unidentified, anti-apoptotic genes. Charles et al. (1993) cloned gly96, a mouse immediate-early gene inducible by serum growth factors. Schafer et al. (1996) cloned the rat homolog, PRG1, which was induced in response to the pituitary adenylate cyclase-activating polypeptide (PACAP; 102980). Kondratyev et al. (1996) cloned the human immediate-early gene IEX1. The cDNA encodes 156-amino acid polypeptide containing a single predicted transmembrane domain. On Northern blots, they observed a 1.2-kb mRNA whose expression could be induced by ionizing radiation, 12-O-tetradecanoylphorbol-13-acetate (TPA), okadaic acid, and TNF-alpha (OMIM Ref. No. 191160); these agents are all activators of the protein kinase C (PKC; OMIM Ref. No. 176960) pathway. Pietzsch et al. (1997) cloned the same human gene, which they termed DIF2. The expression of the DIF2 mRNA is downregulated during differentiation of macrophages and upregulated by lipopolysaccharide (LPS) stimulation of monocytes. Northern blot analysis revealed that DIF2 is expressed most abundantly in monocytes, lymphocytes, and keratinocytes, and at a lesser level in several other human tissues and cell lines. Wu et al. (1998) described a gene that protects cells from apoptosis induced by FAS (OMIM Ref. No. 134637) or TNFA. The gene appeared to be the same as the immediate-early response gene IEX1 reported by Kondratyev et al. (1996), Charles et al. (1993), and Schafer et al. (1996), except that it had an in-frame insertion of 111 nucleotides at position 211 of the coding region of IEX1, and could encode a longer polypeptide with a 37-amino acid insertion relative to IEX1. The longer IEX1 (referred to as IEX1L; the original IEX1 was referred to as IEX1S) was found to be generated from IEX1 in the absence of RNA splicing as it contained the entire intron sequence of IEX1. The transcription of IEX1L induced by TNF was decreased in cells with defective NF-kappa-B activation, rendering them sensitive to TNF-induced apoptosis, which was abolished by transfection with IEX1L. In support, overexpression of antisense IEX1L partially blocked TNF-induced expression of IEX1L and sensitized normal cells to killing. This study demonstrated a key role of IEX1L in cellular resistance to TNF-induced apoptosis. Pietzsch et al.

(1998) cloned the genomic DNA of the DIF2 gene. They found that the gene consists of 2 exons and a single small intron. The 5-prime flanking region of the gene contains binding sites for transcription factors including NF-kappa-B, CEBP (OMIM Ref. No. 116897), and SP1 (OMIM Ref. No. 189906). Pietzsch et al. (1998) used fluorescence in situ hybridization to map the IER3 gene to human chromosome 6p21.3.

Full details of the abovementioned studies are described in the following publications, the disclosure of which are hereby incorporated by reference:

Pietzsch, A.; Buchler, C.; Schmitz, G.: Genomic organization, promoter cloning, and chromosomal localization of the Dif-2 gene. Biochem. Biophys. Res. Commun. 245:651-657, 1998; and Wu, M. X.; Ao, Z.; Prasad, K. V. S.; Wu, R.; Schlossman, S. F.: IEX-1L, an apoptosis inhibitor involved in NF-kappa-B-mediated cell survival. Science 281: 998-1001, 1998.

Further studies establishing the function and utilities of PRG1 are found in John Hopkins OMIM database record ID 602996, and in sited publications numbered 5412-5417 listed in the bibliography section hereinbelow, which are also hereby incorporated by reference. BSPECV (Accession NM_016642) is another VGAM2465 host target gene. BSPECV BINDING SITE is HOST TARGET binding site found in the 5' untranslated region of mRNA encoded by BSPECV, corresponding to a HOST TARGET binding site such as BINDING SITE I, BINDING SITE II or BINDING SITE III. Table 2 illustrates the complementarity of the nucleotide sequences of BSPECV BINDING SITE, designated SEQ ID:18747, to the nucleotide sequence of VGAM2465 RNA, herein designated VGAM RNA, also designated SEQ ID:5176.

Another function of VGAM2465 is therefore inhibition of BSPECV (Accession NM_016642). Accordingly, utilities of VGAM2465 include diagnosis, prevention and treatment of diseases and clinical conditions associated with BSPECV. FIG. 1 further provides a conceptual description of a novel bioinformatically detected viral gene of the present invention, referred to here as Viral Genomic Address Messenger 2466 (VGAM2466) viral gene, which modulates expression of respective host target genes thereof, the function and utility of which host target genes is known in the art.

VGAM2466 is a novel bioinformatically detected regulatory, non protein coding, viral micro RNA (miRNA) gene. The method by which VGAM2466 was detected is described hereinabove with reference to FIGS. 1-8.

VGAM2466 gene, herein designated VGAM GENE, is a viral gene contained in the genome of Mouse Cytomegalovirus 1. VGAM2466 host target gene, herein designated VGAM HOST TARGET GENE, is a human gene contained in the human genome.

VGAM2466 gene encodes a VGAM2466 precursor RNA, herein designated VGAM PRECURSOR RNA. Similar to other miRNA genes, and unlike most ordinary genes, VGAM2466 precursor RNA does not encode a protein. A nucleotide sequence identical or highly similar to the nucleotide sequence of VGAM2466 precursor RNA is designated SEQ ID:2452, and is provided hereinbelow with reference to the sequence listing part. Nucleotide sequence SEQ ID:2452 is located at position 94468 relative to the genome of Mouse Cytomegalovirus 1.

VGAM2466 precursor RNA folds onto itself, forming VGAM2466 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2466 folded precursor RNA into VGAM2466 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2466 RNA is designated SEQ ID:5177, and is provided hereinbelow with reference to the sequence listing part.

VGAM2466 host target gene, herein designated VGAM HOST TARGET GENE, encodes a corresponding messenger RNA, VGAM2466 host target RNA, herein designated VGAM HOST TARGET RNA. VGAM2466 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2466 RNA, herein designated VGAM RNA, binds complementarily to one or more host target binding sites located in untranslated regions of VGAM2466 host target RNA, herein designated VGAM HOST TARGET RNA. This complementary binding is due to the fact that the nucleotide sequence of VGAM2466 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2466 RNA, herein designated VGAM RNA, may have a different number of host target binding sites in untranslated regions of a VGAM2466 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2466 RNA, herein designated VGAM RNA, to host target binding sites on VGAM2466 host target RNA, herein designated VGAM HOST TARGET RNA, such as BINDING SITE I, BINDING SITE II and BINDING SITE III, inhibits translation of VGAM2466 host target RNA into VGAM2466 host target protein, herein designated VGAM HOST TARGET PROTEIN. VGAM host target protein is therefore outlined by a broken line.

It is appreciated that VGAM2466 host target gene, herein designated VGAM HOST TARGET GENE, in fact represents a plurality of VGAM2466 host target genes. The mRNA of each one of this plurality of VGAM2466 host target genes comprises one or more host target binding sites, each having a nucleotide sequence which is at least partly complementary to VGAM2466 RNA, herein designated VGAM RNA, and which when bound by VGAM2466 RNA causes inhibition of translation of respective one or more VGAM2466 host target proteins.

It is further appreciated by one skilled in the art that the mode of translational inhibition illustrated by FIG. 1 with specific reference to translational inhibition exerted by VGAM2466 gene, herein designated VGAM GENE, on one or more VGAM2466 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2466 is inhibition of expression of host target genes, as part of a novel viral mechanism of attacking a host. Accordingly, utilities of VGAM2466 include diagnosis, prevention and treatment of viral infection by Mouse Cytomegalovirus 1. Specific functions, and accordingly utilities, of VGAM2466 correlate with, and may be deduced from, the identity of the host target genes which VGAM2466 binds and inhibits, and the function of these host target genes, as elaborated hereinbelow.

Nucleotide sequences of the VGAM2466 precursor RNA, herein designated VGAM PRECURSOR RNA, and of the 'diced' VGAM2466 RNA, herein designated VGAM RNA, and a schematic representation of the secondary folding of VGAM2466 folded precursor RNA, herein designated VGAM FOLDED PRECURSOR RNA, of VGAM2466 are further described hereinbelow with reference to Table 1.

Nucleotide sequences of host target binding sites, such as BINDING SITE-I, BINDING SITE-II and BINDING SITE-III of FIG. 1, found on VGAM2466 host target RNA, and schematic representation of the complementarity of each of these host target binding sites to VGAM2466 RNA, herein designated VGAM RNA, are described hereinbelow with reference to Table 2.

As mentioned hereinabove with reference to FIG. 1, a function of VGAM2466 gene, herein designated VGAM is inhibition of expression of VGAM2466 target genes. It is appreciated that specific functions, and accordingly utilities, of VGAM2466 correlate with, and may be deduced from, the identity of the target genes which VGAM2466 binds and inhibits, and the function of these target genes, as elaborated hereinbelow.

Rho GTPase Activating Protein 6 (ARHGAP6, Accession NM_001174) is a VGAM2466 host target gene. ARHGAP6 BINDING SITE1 and ARHGAP6 BINDING SITE2 are HOST TARGET binding sites found in untranslated regions of mRNA encoded by ARHGAP6, corresponding to HOST TARGET binding sites such as BINDING SITE I, BINDING SITE II or BINDING SITE III. Table 2 illustrates the complementarity of the nucleotide sequences of ARHGAP6 BINDING SITE1 and ARHGAP6 BINDING SITE2, designated SEQ ID:6842 and SEQ ID:15084 respectively, to the nucleotide sequence of VGAM2466 RNA, herein designated VGAM RNA, also designated SEQ ID:5177.

A function of VGAM2466 is therefore inhibition of Rho GTPase Activating Protein 6 (ARHGAP6, Accession NM_001174), a gene which activates the rho-type GTPases by converting them to an inactive GTP-bound state. Accordingly, utilities of VGAM2466 include diagnosis, prevention and treatment of diseases and clinical conditions associated with ARHGAP6. The function of ARHGAP6 and its association with various diseases and clinical conditions, has been established by previous studies, as described hereinabove with reference to VGAM55. Dimethylarginine Dimethylaminohydrolase 2 (DDAH2, Accession NM_013974) is another VGAM2466 host target gene. DDAH2 BINDING SITE is HOST TARGET binding site found in the 5' untranslated region of mRNA encoded by DDAH2, corresponding to a HOST TARGET binding site such as BINDING SITE I, BINDING SITE II or BINDING SITE III. Table 2 illustrates the complementarity of the nucleotide sequences of DDAH2 BINDING SITE, designated SEQ ID:15142, to the nucleotide sequence of VGAM2466 RNA, herein designated VGAM RNA, also designated SEQ ID:5177.

Another function of VGAM2466 is therefore inhibition of Dimethylarginine Dimethylaminohydrolase 2 (DDAH2, Accession NM_013974), a gene which regulates cellular methylarginine concentrations. Accordingly, utilities of VGAM2466 include diagnosis, prevention and treatment of diseases and clinical conditions associated with DDAH2. The function of DDAH2 has been established by previous studies. Dimethylarginine dimethylaminohydrolase (DDAH; EC 3.5.3.18) regulates cellular methylarginine concentrations, which in turn inhibit nitric oxide synthase (see OMIM Ref. No. 163728) activity. Leiper et al. (1999) isolated a cDNA encoding DDAHI (OMIM Ref. No. 604743) and, by screening a database of translated open reading frames with the deduced DDAHI peptide sequence, identified DDAHII. Both DDAHI and DDAHII cDNAs encode 285-amino acid proteins. The DDAHII amino acid sequence shares 98% identity with that of its mouse homolog and 62% identity with the sequence of DDAHI. Northern blot analysis detected a 2.0-kb DDAHII transcript expressed at highest levels in heart, kidney, and placenta. Leiper et al. (1999) expressed a histidine-tagged DDAHII clone in E. coli and assayed the cell lysate for DDAH activity. Recombinant DDAHII metabolized ADMA and L-NMMA, but not SDMA or L-arginine, demonstrating that DDAHII is a functional homolog of DDAHI. By RNA dot blot analysis, Tran et al. (2000) determined that DDAH2 expression predominates in more highly vascularized tissues and in immune tissues, while DDAH1 expression predominates in tissues that also express the neuronal isoform of NOS (OMIM Ref. No. 163731). Genomic sequence analysis indicated that DDAH2 contains 8 exons with 3 transcription start sites that generate alternatively spliced transcripts.

Full details of the abovementioned studies are described in the following publications, the disclosure of which are hereby incorporated by reference:

Leiper, J. M.; Santa Maria, J.; Chubb, A.; MacAllister, R. J.; Charles, I. G.; Whitley, G. S.; Vallance, P.: Identification of two human dimethylarginine dimethylaminohydrolases with distinct tissue distributions and homology with microbial arginine deiminases. Biochem. J. 343:209-214, 1999; and Tran, C. T. L.; Fox, M. F.; Vallance, P.; Leiper, J. M.: Chromosomal localization, gene structure, and expression pattern of DDAH1: comparison with DDAH2 and implications for evolutio.

Further studies establishing the function and utilities of DDAH2 are found in John Hopkins OMIM database record ID 604744, and in sited publications numbered 6747-6748 listed in the bibliography section hereinbelow, which are also hereby incorporated by reference. Diacylglycerol Kinase, Gamma 90 kDa (DGKG, Accession NM_001346) is another VGAM2466 host target gene. DGKG BINDING SITE is HOST TARGET binding site found in the 5' untranslated region of mRNA encoded by DGKG, corresponding to a HOST TARGET binding site such as BINDING SITE I, BINDING SITE II or BINDING SITE III. Table 2 illustrates the complementarity of the nucleotide sequences of DGKG BINDING SITE, designated SEQ ID:7026, to the nucleotide sequence of VGAM2466 RNA, herein designated VGAM RNA, also designated SEQ ID:5177.

Another function of VGAM2466 is therefore inhibition of Diacylglycerol Kinase, Gamma 90 kDa (DGKG, Accession NM_001346), a gene which may convert diacylglycerol to phosphatidic acid. Accordingly, utilities of VGAM2466 include diagnosis, prevention and treatment of diseases and clinical conditions associated with DGKG. The function of DGKG and its association with various diseases and clinical conditions, has been established by previous studies, as described hereinabove with reference to VGAM451. Homeo Box B3 (HOXB3, Accession NM_002146) is another VGAM2466 host target gene. HOXB3 BINDING SITE is HOST TARGET binding site found in the 5' untranslated region of mRNA encoded by HOXB3, corresponding to a HOST TARGET binding site such as BINDING SITE I, BINDING SITE II or BINDING SITE III. Table 2 illustrates the complementarity of the nucleotide sequences of HOXB3 BINDING SITE, designated SEQ ID:7921, to the nucleotide sequence of VGAM2466 RNA, herein designated VGAM RNA, also designated SEQ ID:5177.

Another function of VGAM2466 is therefore inhibition of Homeo Box B3 (HOXB3, Accession NM_002146). Accordingly, utilities of VGAM2466 include diagnosis, prevention and treatment of diseases and clinical conditions associated with HOXB3. Oxytocin Receptor (OXTR, Accession NM_000916) is another VGAM2466 host target gene. OXTR BINDING SITE is HOST TARGET binding site found in the 5' untranslated region of mRNA encoded by OXTR, corresponding to a HOST TARGET binding site such as BINDING SITE I, BINDING SITE II or BINDING SITE III. Table 2 illustrates the complementarity of the nucleotide sequences of OXTR BINDING SITE, designated SEQ ID:6619, to the nucleotide sequence of VGAM2466 RNA, herein designated VGAM RNA, also designated SEQ ID:5177.

Another function of VGAM2466 is therefore inhibition of Oxytocin Receptor (OXTR, Accession NM_000916), a gene which induces inward ion currents. Accordingly, utilities of VGAM2466 include diagnosis, prevention and treatment of diseases and clinical conditions associated with OXTR. The function of OXTR and its association with various diseases and clinical conditions, has been established by previous studies, as described hereinabove with reference to VGAM636. ENDO180 (Accession NM_006039) is another VGAM2466 host target gene. ENDO180 BINDING SITE is HOST TARGET binding site found in the 3' untranslated region of mRNA encoded by ENDO180, corresponding to a HOST TARGET binding site such as BINDING SITE I, BINDING SITE II or BINDING SITE III. Table 2 illustrates the complementarity of the nucleotide sequences of ENDO180 BINDING SITE, designated SEQ ID:12675, to the nucleotide sequence of VGAM2466 RNA, herein designated VGAM RNA, also designated SEQ ID:5177.

Another function of VGAM2466 is therefore inhibition of ENDO180 (Accession NM_006039). Accordingly, utilities of VGAM2466 include diagnosis, prevention and treatment of diseases and clinical conditions associated with ENDO180. FLJ14490 (Accession NM_032793) is another VGAM2466 host target gene. FLJ14490 BINDING SITE is HOST TARGET binding site found in the 3' untranslated region of mRNA encoded by FLJ14490, corresponding to a HOST TARGET binding site such as BINDING SITE I, BINDING SITE II or BINDING SITE III. Table 2 illustrates the complementarity of the nucleotide sequences of FLJ14490 BINDING SITE, designated SEQ ID:26545, to the nucleotide sequence of VGAM2466 RNA, herein designated VGAM RNA, also designated SEQ ID:5177.

Another function of VGAM2466 is therefore inhibition of FLJ14490 (Accession NM_032793). Accordingly, utilities of VGAM2466 include diagnosis, prevention and treatment of diseases and clinical conditions associated with FLJ14490. FLJ20435 (Accession NM_017821) is another VGAM2466 host target gene. FLJ20435 BINDING SITE is HOST TARGET binding site found in the 3' untranslated region of mRNA encoded by FLJ20435, corresponding to a HOST TARGET binding site such as BINDING SITE I, BINDING SITE II or BINDING SITE III. Table 2 illustrates the complementarity of the nucleotide sequences of FLJ20435 BINDING SITE, designated SEQ ID:19467, to the nucleotide sequence of VGAM2466 RNA, herein designated VGAM RNA, also designated SEQ ID:5177.

Another function of VGAM2466 is therefore inhibition of FLJ20435 (Accession NM_017821). Accordingly, utilities of VGAM2466 include diagnosis, prevention and treatment of diseases and clinical conditions associated with FLJ20435. FLJ22202 (Accession NM_024883) is another VGAM2466 host target gene. FLJ22202 BINDING SITE is HOST TARGET binding site found in the 3' untranslated region of mRNA encoded by FLJ22202, corresponding to a HOST TARGET binding site such as BINDING SITE I, BINDING SITE II or BINDING SITE III. Table 2 illustrates the complementarity of the nucleotide sequences of FLJ22202 BINDING SITE, designated SEQ ID:24336, to the nucleotide sequence of VGAM2466 RNA, herein designated VGAM RNA, also designated SEQ ID:5177.

Another function of VGAM2466 is therefore inhibition of FLJ22202 (Accession NM_024883). Accordingly, utilities of VGAM2466 include diagnosis, prevention and treatment of diseases and clinical conditions associated with FLJ22202. KIAA0555 (Accession XM_011347) is another VGAM2466 host target gene. KIAA0555 BINDING SITE is HOST TARGET binding site found in the 5' untranslated region of mRNA encoded by KIAA0555, corresponding to a HOST TARGET binding site such as BINDING SITE I, BINDING SITE II or BINDING SITE III. Table 2 illustrates the complementarity of the nucleotide sequences of KIAA0555 BINDING SITE, designated SEQ ID:30187, to the nucleotide sequence of VGAM2466 RNA, herein designated VGAM RNA, also designated SEQ ID:5177.

Another function of VGAM2466 is therefore inhibition of KIAA0555 (Accession XM_011347). Accordingly, utilities of VGAM2466 include diagnosis, prevention and treatment of diseases and clinical conditions associated with KIAA0555. MGC4766 (Accession NM_031451) is another VGAM2466 host target gene. MGC4766 BINDING SITE is HOST TARGET binding site found in the 5' untranslated region of mRNA encoded by MGC4766, corresponding to a HOST TARGET binding site such as BINDING SITE I, BINDING SITE II or BINDING SITE III. Table 2 illustrates the complementarity of the nucleotide sequences of MGC4766 BINDING SITE, designated SEQ ID:25465, to the nucleotide sequence of VGAM2466 RNA, herein designated VGAM RNA, also designated SEQ ID:5177.

Another function of VGAM2466 is therefore inhibition of MGC4766 (Accession NM_031451). Accordingly, utilities of VGAM2466 include diagnosis, prevention and treatment of diseases and clinical conditions associated with MGC4766. Nucleoredoxin (NXN, Accession NM_022463) is another VGAM2466 host target gene. NXN BINDING SITE is HOST TARGET binding site found in the 3' untranslated region of mRNA encoded by NXN, corresponding to a HOST TARGET binding site such as BINDING SITE I, BINDING SITE II or BINDING SITE III. Table 2 illustrates the complementarity of the nucleotide sequences of NXN BINDING SITE, designated SEQ ID:22805, to the nucleotide sequence of VGAM2466 RNA, herein designated VGAM RNA, also designated SEQ ID:5177.

Another function of VGAM2466 is therefore inhibition of Nucleoredoxin (NXN, Accession NM_022463). Accordingly, utilities of VGAM2466 include diagnosis, prevention and treatment of diseases and clinical conditions associated with NXN. LOC93349 (Accession NM_138402) is another VGAM2466 host target gene. LOC93349 BINDING SITE is HOST TARGET binding site found in the 3' untranslated region of mRNA encoded by LOC93349, corresponding to a HOST TARGET binding site such as BINDING SITE I, BINDING SITE II or BINDING SITE III. Table 2 illustrates the complementarity of the nucleotide sequences of LOC93349 BINDING SITE, designated SEQ ID:28768, to the nucleotide sequence of VGAM2466 RNA, herein designated VGAM RNA, also designated SEQ ID:5177.

Another function of VGAM2466 is therefore inhibition of LOC93349 (Accession NM_138402). Accordingly, utilities of VGAM2466 include diagnosis, prevention and treatment of diseases and clinical conditions associated with LOC93349. FIG. 1 further provides a conceptual description of a novel bioinformatically detected viral gene of the present invention, referred to here as Viral Genomic Address Messenger 2467 (VGAM2467) viral gene, which modulates expression of respective host target genes thereof, the function and utility of which host target genes is known in the art.

VGAM2467 is a novel bioinformatically detected regulatory, non protein coding, viral micro RNA (miRNA) gene. The method by which VGAM2467 was detected is described hereinabove with reference to FIGS. 1-8.

VGAM2467 gene, herein designated VGAM GENE, is a viral gene contained in the genome of Mouse Cytomegalovirus 1. VGAM2467 host target gene, herein designated VGAM HOST TARGET GENE, is a human gene contained in the human genome.

VGAM2467 gene encodes a VGAM2467 precursor RNA, herein designated VGAM PRECURSOR RNA. Similar to other miRNA genes, and unlike most ordinary genes, VGAM2467 precursor RNA does not encode a protein. A nucleotide sequence identical or highly similar to the nucleotide sequence of VGAM2467 precursor RNA is designated SEQ ID:2453, and is provided hereinbelow with reference to the sequence listing part. Nucleotide sequence SEQ ID:2453 is located at position 175100 relative to the genome of Mouse Cytomegalovirus 1.

VGAM2467 precursor RNA folds onto itself, forming VGAM2467 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2467 folded precursor RNA into VGAM2467 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2467 RNA is designated SEQ ID:5178, and is provided hereinbelow with reference to the sequence listing part.

VGAM2467 host target gene, herein designated VGAM HOST TARGET GENE, encodes a corresponding messenger RNA, VGAM2467 host target RNA, herein designated VGAM HOST TARGET RNA. VGAM2467 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2467 RNA, herein designated VGAM RNA, binds complementarily to one or more host target binding sites located in untranslated regions of VGAM2467 host target RNA, herein designated VGAM HOST TARGET RNA. This complementary binding is due to the fact that the nucleotide sequence of VGAM2467 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2467 RNA, herein designated VGAM RNA, may have a different number of host target binding sites in untranslated regions of a VGAM2467 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2467 RNA, herein designated VGAM RNA, to host target binding sites on VGAM2467 host target RNA, herein designated VGAM HOST TARGET RNA, such as BINDING SITE I, BINDING SITE II and BINDING SITE III, inhibits translation of VGAM2467 host target RNA into VGAM2467 host target protein, herein designated VGAM HOST TARGET PROTEIN. VGAM host target protein is therefore outlined by a broken line.

It is appreciated that VGAM2467 host target gene, herein designated VGAM HOST TARGET GENE, in fact represents a plurality of VGAM2467 host target genes. The mRNA of each one of this plurality of VGAM2467 host target genes comprises one or more host target binding sites, each having a nucleotide sequence which is at least partly complementary to VGAM2467 RNA, herein designated VGAM RNA, and which when bound by VGAM2467 RNA causes inhibition of translation of respective one or more VGAM2467 host target proteins.

It is further appreciated by one skilled in the art that the mode of translational inhibition illustrated by FIG. 1 with specific reference to translational inhibition exerted by VGAM2467 gene, herein designated VGAM GENE, on one or more VGAM2467 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2467 is inhibition of expression of host target genes, as part of a novel viral mechanism of attacking a host. Accordingly, utilities of VGAM2467 include diagnosis, prevention and treatment of viral infection by Mouse Cytomegalovirus 1. Specific functions, and accordingly utilities, of VGAM2467 correlate with, and may be deduced from, the identity of the host target genes which VGAM2467 binds and inhibits, and the function of these host target genes, as elaborated hereinbelow.

Nucleotide sequences of the VGAM2467 precursor RNA, herein designated VGAM PRECURSOR RNA, and of the 'diced' VGAM2467 RNA, herein designated VGAM RNA, and a schematic representation of the secondary folding of VGAM2467 folded precursor RNA, herein designated VGAM FOLDED PRECURSOR RNA, of VGAM2467 are further described hereinbelow with reference to Table 1.

Nucleotide sequences of host target binding sites, such as BINDING SITE-I, BINDING SITE-II and BINDING SITE-III of FIG. 1, found on VGAM2467 host target RNA, and schematic representation of the complementarity of each of these host target binding sites to VGAM2467 RNA, herein designated VGAM RNA, are described hereinbelow with reference to Table 2.

As mentioned hereinabove with reference to FIG. 1, a function of VGAM2467 gene, herein designated VGAM is inhibition of expression of VGAM2467 target genes. It is appreciated that specific functions, and accordingly utilities, of VGAM2467 correlate with, and may be deduced from, the identity of the target genes which VGAM2467 binds and inhibits, and the function of these target genes, as elaborated hereinbelow.

LOC154043 (Accession XM_087831) is a VGAM2467 host target gene. LOC154043 BINDING SITE is HOST TARGET binding site found in the 5' untranslated region of mRNA encoded by LOC154043, corresponding to a HOST TARGET binding site such as BINDING SITE I, BINDING SITE II or BINDING SITE III. Table 2 illustrates the complementarity of the nucleotide sequences of LOC154043 BINDING SITE, designated SEQ ID:39458, to the nucleotide sequence of VGAM2467 RNA, herein designated VGAM RNA, also designated SEQ ID:5178.

A function of VGAM2467 is therefore inhibition of LOC154043 (Accession XM_087831). Accordingly, utilities of VGAM2467 include diagnosis, prevention and treatment of diseases and clinical conditions associated with LOC154043. FIG. 1 further provides a conceptual description of a novel bioinformatically detected viral gene of the present invention, referred to here as Viral Genomic Address Messenger 2468 (VGAM2468) viral gene, which modulates expression of respective host target genes thereof, the function and utility of which host target genes is known in the art.

VGAM2468 is a novel bioinformatically detected regulatory, non protein coding, viral micro RNA (miRNA) gene. The method by which VGAM2468 was detected is described hereinabove with reference to FIGS. 1-8.

VGAM2468 gene, herein designated VGAM GENE, is a viral gene contained in the genome of Mouse Cytomegalovirus 1. VGAM2468 host target gene, herein designated VGAM HOST TARGET GENE, is a human gene contained in the human genome.

VGAM2468 gene encodes a VGAM2468 precursor RNA, herein designated VGAM PRECURSOR RNA. Similar to other miRNA genes, and unlike most ordinary genes, VGAM2468 precursor RNA does not encode a protein. A nucleotide sequence identical or highly similar to the nucleotide sequence of VGAM2468 precursor RNA is designated SEQ ID:2454, and is provided hereinbelow with reference to the sequence listing part. Nucleotide sequence SEQ ID:2454 is located at position 64210 relative to the genome of Mouse Cytomegalovirus 1.

VGAM2468 precursor RNA folds onto itself, forming VGAM2468 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2468 folded precursor RNA into VGAM2468 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2468 RNA is designated SEQ ID:5179, and is provided hereinbelow with reference to the sequence listing part.

VGAM2468 host target gene, herein designated VGAM HOST TARGET GENE, encodes a corresponding messenger RNA, VGAM2468 host target RNA, herein designated VGAM HOST TARGET RNA. VGAM2468 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2468 RNA, herein designated VGAM RNA, binds complementarily to one or more host target binding sites located in untranslated regions of VGAM2468 host target RNA, herein designated VGAM HOST TARGET RNA. This complementary binding is due to the fact that the nucleotide sequence of VGAM2468 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2468 RNA, herein designated VGAM RNA, may have a different number of host target binding sites in untranslated regions of a VGAM2468 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2468 RNA, herein designated VGAM RNA, to host target binding sites on VGAM2468 host target RNA, herein designated VGAM HOST TARGET RNA, such as BINDING SITE I, BINDING SITE II and BINDING SITE III, inhibits translation of VGAM2468 host target RNA into VGAM2468 host target protein, herein designated VGAM HOST TARGET PROTEIN. VGAM host target protein is therefore outlined by a broken line.

It is appreciated that VGAM2468 host target gene, herein designated VGAM HOST TARGET GENE, in fact represents a plurality of VGAM2468 host target genes. The mRNA of each one of this plurality of VGAM2468 host target genes comprises one or more host target binding sites, each having a nucleotide sequence which is at least partly complementary to VGAM2468 RNA, herein designated VGAM RNA, and which when bound by VGAM2468 RNA causes inhibition of translation of respective one or more VGAM2468 host target proteins.

It is further appreciated by one skilled in the art that the mode of translational inhibition illustrated by FIG. 1 with specific reference to translational inhibition exerted by VGAM2468 gene, herein designated VGAM GENE, on one or more VGAM2468 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2468 is inhibition of expression of host target genes, as part of a novel viral mechanism of attacking a host. Accordingly, utilities of VGAM2468 include diagnosis, prevention and treatment of viral infection by Mouse Cytomegalovirus 1. Specific functions, and accordingly utilities, of VGAM2468 correlate with, and may be deduced from, the identity of the host target genes which VGAM2468 binds and inhibits, and the function of these host target genes, as elaborated hereinbelow.

Nucleotide sequences of the VGAM2468 precursor RNA, herein designated VGAM PRECURSOR RNA, and of the 'diced' VGAM2468 RNA, herein designated VGAM RNA, and a schematic representation of the secondary folding of VGAM2468 folded precursor RNA, herein designated VGAM FOLDED PRECURSOR RNA, of VGAM2468 are further described hereinbelow with reference to Table 1.

Nucleotide sequences of host target binding sites, such as BINDING SITE-I, BINDING SITE-II and BINDING SITE-III of FIG. 1, found on VGAM2468 host target RNA, and schematic representation of the complementarity of each of these host target binding sites to VGAM2468 RNA, herein designated VGAM RNA, are described hereinbelow with reference to Table 2.

As mentioned hereinabove with reference to FIG. 1, a function of VGAM2468 gene, herein designated VGAM is inhibition of expression of VGAM2468 target genes. It is appreciated that specific functions, and accordingly utilities, of VGAM2468 correlate with, and may be deduced from, the identity of the target genes which VGAM2468 binds and inhibits, and the function of these target genes, as elaborated hereinbelow.

Glycyl-tRNA Synthetase (GARS, Accession NM_002047) is a VGAM2468 host target gene. GARS BINDING SITE is HOST TARGET binding site found in the 5' untranslated region of mRNA encoded by GARS, corresponding to a HOST TARGET binding site such as BINDING SITE I, BINDING SITE II or BINDING SITE III. Table 2 illustrates the complementarity of the nucleotide sequences of GARS BINDING SITE, designated SEQ ID:7795, to the nucleotide sequence of VGAM2468 RNA, herein designated VGAM RNA, also designated SEQ ID:5179.

A function of VGAM2468 is therefore inhibition of Glycyl-tRNA Synthetase (GARS, Accession NM_002047), a gene which functions in protein biosynthesis. Accordingly, utilities of VGAM2468 include diagnosis, prevention and treatment of diseases and clinical conditions associated with GARS. The function of GARS and its association with various diseases and clinical conditions, has been established by previous studies, as described hereinabove with reference to VGAM113. MAP/microtubule Affinity-regulating Kinase 3 (MARK3, Accession NM_002376) is another VGAM2468 host target gene. MARK3 BINDING SITE is HOST TARGET binding site found in the 5' untranslated region of mRNA encoded by MARK3, corresponding to a HOST TARGET binding site such as BINDING SITE I, BINDING SITE II or BINDING SITE III. Table 2 illustrates the complementarity of the nucleotide sequences of MARK3 BINDING SITE, designated SEQ ID:8188, to the nucleotide sequence of VGAM2468 RNA, herein designated VGAM RNA, also designated SEQ ID:5179.

Another function of VGAM2468 is therefore inhibition of MAP/microtubule Affinity-regulating Kinase 3 (MARK3, Accession NM_002376), a gene which may be involved in cell cycle regulation. Accordingly, utilities of VGAM2468 include diagnosis, prevention and treatment of diseases and clinical conditions associated with MARK3. The function of MARK3 and its association with various diseases and clinical conditions, has been established by previous studies, as described hereinabove with reference to VGAM964. Ret Finger Protein 2 (RFP2, Accession NM_052811) is another VGAM2468 host target gene. RFP2 BINDING SITE is HOST TARGET binding site found in the 5' untranslated region of mRNA encoded by RFP2, corresponding to a HOST TARGET binding site such as BINDING SITE I, BINDING SITE II or BINDING SITE III. Table 2 illustrates the complementarity of the nucleotide sequences of RFP2 BINDING SITE, designated SEQ ID:27399, to the nucleotide sequence of VGAM2468 RNA, herein designated VGAM RNA, also designated SEQ ID:5179.

Another function of VGAM2468 is therefore inhibition of Ret Finger Protein 2 (RFP2, Accession NM_052811), a gene which may act as a tumor suppressor. Accordingly, utilities of VGAM2468 include diagnosis, prevention and treatment of diseases and clinical conditions associated with RFP2. The function of RFP2 has been established by previous studies. B-cell chronic lymphocytic leukemia is often associated with the loss of a region on chromosome 13q14 between the retinoblastoma gene (RB1; 180200) and locus D13S25 (Liu et al., 1993; Liu et al., 1995), suggesting that a tumor suppressor gene may be located in this region. By constructing a cosmid contig corresponding to the minimally deleted region and screening a pre-B lymphocyte cDNA library, Kapanadze et al. (1998) isolated several clones, one of which contained an ORF encoding a deduced 407-amino acid protein, RFP2, which they called LEU5. RFP2 contains a zinc finger domain of the RING type and shares significant homology with the RET finger protein (RFP; 602165) and the tumor suppressor gene BRCA1 (OMIM Ref. No. 113705). Kapanadze et al. (1998) mapped the RFP2 gene close to D13S272, bordering the minimally deleted region.

Full details of the abovementioned studies are described in the following publications, the disclosure of which are hereby incorporated by reference:

Kapanadze, B.; Kashuba, V.; Baranova, A.; Rasool, O.; van Everdink, W.; Liu, Y.; Syomova, A.; Corcoran, M.; Poltaraus, A.; Brodyansky, V.; Syomova, N.; Kazakov, A.; Ibbotson, R.; van den Berg, A.; Gizatullin, R.; Fedorova, L.; Sulimova, G.; Zelenin, A.; Deaven, L.; Lehrach, H.; Grander, D.; Buys, C.; Oscier, D.; Zabarovsky, E. R.; Einhorn, S.; Yankovsky, N.: A cosmid and cDNA fine physical map of a human chromosome 13q14 region frequently lost in B-cell chronic lymphocytic leukemia and identification of a new putative tumor suppressor gene, Leu5. FEBS Lett. 426:266-270, 1998; and Liu, Y.; Hermanson, M.; Grander, D.; Merup, M.; Wu, X.; Heyman, M.; Rasool, O.; Juliusson, G.; Gahrton, G.; Detlofsson, R.:13q deletions in lymphoid malignancies. Blood 86:1911-1915.

Further studies establishing the function and utilities of RFP2 are found in John Hopkins OMIM database record ID 605661, and in sited publications numbered 6409-6411 listed in the bibliography section hereinbelow, which are also hereby incorporated by reference. DKFZP434H204 (Accession XM_039153) is another VGAM2468 host target gene. DKFZP434H204 BINDING SITE is HOST TARGET binding site found in the 5' untranslated region of mRNA encoded by DKFZP434H204, corresponding to a HOST TARGET binding site such as BINDING SITE I, BINDING SITE II or BINDING SITE III. Table 2 illustrates the complementarity of the nucleotide sequences of DKFZP434H204 BINDING SITE, designated SEQ ID:33016, to the nucleotide sequence of VGAM2468 RNA, herein designated VGAM RNA, also designated SEQ ID:5179.

Another function of VGAM2468 is therefore inhibition of DKFZP434H204 (Accession XM_039153). Accordingly, utilities of VGAM2468 include diagnosis, prevention and treatment of diseases and clinical conditions associated with DKFZP434H204. F-box Only Protein 26 (FBXO26, Accession NM_024907) is another VGAM2468 host target gene. FBXO26 BINDING SITE is HOST TARGET binding site found in the 5' untranslated region of mRNA encoded by FBXO26, corresponding to a HOST TARGET binding site such as BINDING SITE I, BINDING SITE II or BINDING SITE III. Table 2 illustrates the complementarity of the nucleotide sequences of FBXO26 BINDING SITE, designated SEQ ID:24405, to the nucleotide sequence of VGAM2468 RNA, herein designated VGAM RNA, also designated SEQ ID:5179.

Another function of VGAM2468 is therefore inhibition of F-box Only Protein 26 (FBXO26, Accession NM_024907). Accordingly, utilities of VGAM2468 include diagnosis, prevention and treatment of diseases and clinical conditions associated with FBXO26. FLJ12089 (Accession NM_024552) is another VGAM2468 host target gene. FLJ12089 BINDING SITE is HOST TARGET binding site found in the 5' untranslated region of mRNA encoded by FLJ12089, corresponding to a HOST TARGET binding site such as BINDING SITE I, BINDING SITE II or BINDING SITE III. Table 2 illustrates the complementarity of the nucleotide sequences of FLJ12089 BINDING SITE, designated SEQ ID:23771, to the nucleotide sequence of VGAM2468 RNA, herein designated VGAM RNA, also designated SEQ ID:5179.

Another function of VGAM2468 is therefore inhibition of FLJ12089 (Accession NM_024552). Accordingly, utilities of VGAM2468 include diagnosis, prevention and treatment of diseases and clinical conditions associated with FLJ12089. FLJ32919 (Accession NM_144588) is another VGAM2468 host target gene. FLJ32919 BINDING SITE is HOST TARGET binding site found in the 5' untranslated region of mRNA encoded by FLJ32919, corresponding to a HOST TARGET binding site such as BINDING SITE I, BINDING SITE II or BINDING SITE III. Table 2 illustrates the complementarity of the nucleotide sequences of FLJ32919 BINDING SITE, designated SEQ ID:29408, to the nucleotide sequence of VGAM2468 RNA, herein designated VGAM RNA, also designated SEQ ID:5179.

Another function of VGAM2468 is therefore inhibition of FLJ32919 (Accession NM_144588). Accordingly, utilities of VGAM2468 include diagnosis, prevention and treatment of diseases and clinical conditions associated with FLJ32919. KIAA0963 (Accession NM_014963) is another VGAM2468 host target gene. KIAA0963 BINDING SITE is HOST TARGET binding site found in the 5' untranslated region of mRNA encoded by KIAA0963, corresponding to a HOST TARGET binding site such as BINDING SITE I, BINDING SITE II or BINDING SITE III. Table 2 illustrates the complementarity of the nucleotide sequences of KIAA0963 BINDING SITE, designated SEQ ID:17343, to the nucleotide sequence of VGAM2468 RNA, herein designated VGAM RNA, also designated SEQ ID:5179.

Another function of VGAM2468 is therefore inhibition of KIAA0963 (Accession NM_014963). Accordingly, utilities of VGAM2468 include diagnosis, prevention and treatment of diseases and clinical conditions associated with KIAA0963. UDP-N-acteylglucosamine Pyrophosphorylase 1 (UAP1, Accession NM_003115) is another VGAM2468 host target gene. UAP1 BINDING SITE is HOST TARGET binding site found in the 5' untranslated region of mRNA encoded by UAP1, corresponding to a HOST TARGET binding site such as BINDING SITE I, BINDING SITE II or BINDING SITE III. Table 2 illustrates the complementarity of the nucleotide sequences of UAP1 BINDING SITE, designated SEQ ID:9087, to the nucleotide sequence of VGAM2468 RNA, herein designated VGAM RNA, also designated SEQ ID:5179.

Another function of VGAM2468 is therefore inhibition of UDP-N-acteylglucosamine Pyrophosphorylase 1 (UAP1, Accession NM_003115). Accordingly, utilities of VGAM2468 include diagnosis, prevention and treatment of diseases and clinical conditions associated with UAP1. XPO5 (Accession XM_166042) is another VGAM2468 host target gene. XPO5 BINDING SITE is HOST TARGET binding site found in the 5' untranslated region of mRNA encoded by XPO5, corresponding to a HOST TARGET binding site such as BINDING SITE I, BINDING SITE II or BINDING SITE III. Table 2 illustrates the complementarity of the nucleotide sequences of XPO5 BINDING SITE, designated SEQ ID:43840, to the nucleotide sequence of VGAM2468 RNA, herein designated VGAM RNA, also designated SEQ ID:5179.

Another function of VGAM2468 is therefore inhibition of XPO5 (Accession XM_166042). Accordingly, utilities of VGAM2468 include diagnosis, prevention and treatment of diseases and clinical conditions associated with XPO5. LOC128402 (Accession XM_066002) is another VGAM2468 host target gene. LOC128402 BINDING SITE is HOST TARGET binding site found in the 3' untranslated region of mRNA encoded by LOC128402, corresponding to a HOST TARGET binding site such as BINDING SITE I, BINDING SITE II or BINDING SITE III. Table 2 illustrates the complementarity of the nucleotide sequences of LOC128402 BINDING SITE, designated SEQ ID:37317, to the nucleotide sequence of VGAM2468 RNA, herein designated VGAM RNA, also designated SEQ ID:5179.

Another function of VGAM2468 is therefore inhibition of LOC128402 (Accession XM_066002). Accordingly, utilities of VGAM2468 include diagnosis, prevention and treatment of diseases and clinical conditions associated with LOC128402. LOC146243 (Accession XM_096956) is another VGAM2468 host target gene. LOC146243 BINDING SITE is HOST TARGET binding site found in the 5' untranslated region of mRNA encoded by LOC146243, corresponding to a HOST TARGET binding site such as BINDING SITE I, BINDING SITE II or BINDING SITE III. Table 2 illustrates the complementarity of the nucleotide sequences of LOC146243 BINDING SITE, designated SEQ ID:40676, to the nucleotide sequence of VGAM2468 RNA, herein designated VGAM RNA, also designated SEQ ID:5179.

Another function of VGAM2468 is therefore inhibition of LOC146243 (Accession XM_096956). Accordingly, utilities of VGAM2468 include diagnosis, prevention and treatment of diseases and clinical conditions associated with LOC146243. LOC153811 (Accession XM_087779) is another VGAM2468 host target gene. LOC153811 BINDING SITE is HOST TARGET binding site found in the 3' untranslated region of mRNA encoded by LOC153811, corresponding to a HOST TARGET binding site such as BINDING SITE I, BINDING SITE II or BINDING SITE III. Table 2 illustrates the complementarity of the nucleotide sequences of LOC153811 BINDING SITE, designated SEQ ID:39414, to the nucleotide sequence of VGAM2468 RNA, herein designated VGAM RNA, also designated SEQ ID:5179.

Another function of VGAM2468 is therefore inhibition of LOC153811 (Accession XM_087779). Accordingly, utilities of VGAM2468 include diagnosis, prevention and treatment of diseases and clinical conditions associated with LOC153811. LOC157226 (Accession XM_033876) is another VGAM2468 host target gene. LOC157226 BINDING SITE is HOST TARGET binding site found in the 5' untranslated region of mRNA encoded by LOC157226, corresponding to a HOST TARGET binding site such as BINDING SITE I, BINDING SITE II or BINDING SITE III. Table 2 illustrates the complementarity of the nucleotide sequences of LOC157226 BINDING SITE, designated SEQ ID:31975, to the nucleotide sequence of VGAM2468 RNA, herein designated VGAM RNA, also designated SEQ ID:5179.

Another function of VGAM2468 is therefore inhibition of LOC157226 (Accession XM_033876). Accordingly, utilities of VGAM2468 include diagnosis, prevention and treatment of diseases and clinical conditions associated with LOC157226. LOC222166 (Accession XM_168425) is another VGAM2468 host target gene. LOC222166 BINDING SITE is HOST TARGET binding site found in the 5' untranslated region of mRNA encoded by LOC222166, corresponding to a HOST TARGET binding site such as BINDING SITE I, BINDING SITE II or BINDING SITE III. Table 2 illustrates the complementarity of the nucleotide sequences of LOC222166 BINDING SITE, designated SEQ ID:45153, to the nucleotide sequence of VGAM2468 RNA, herein designated VGAM RNA, also designated SEQ ID:5179.

Another function of VGAM2468 is therefore inhibition of LOC222166 (Accession XM_168425). Accordingly, utilities of VGAM2468 include diagnosis, prevention and treatment of diseases and clinical conditions associated with LOC222166. LOC93017 (Accession XM_048772) is another VGAM2468 host target gene. LOC93017 BINDING SITE is HOST TARGET binding site found in the 5' untranslated region of mRNA encoded by LOC93017, corresponding to a HOST TARGET binding site such as BINDING SITE I, BINDING SITE II or BINDING SITE III. Table 2 illustrates the complementarity of the nucleotide sequences of LOC93017 BINDING SITE, designated SEQ ID:35254, to the nucleotide sequence of VGAM2468 RNA, herein designated VGAM RNA, also designated SEQ ID:5179.

Another function of VGAM2468 is therefore inhibition of LOC93017 (Accession XM_048772). Accordingly, utilities of VGAM2468 include diagnosis, prevention and treatment of diseases and clinical conditions associated with LOC93017. FIG. 1 further provides a conceptual description of a novel bioinformatically detected viral gene of the present invention, referred to here as Viral Genomic Address Messenger 2469 (VGAM2469) viral gene, which modulates expression of respective host target genes thereof, the function and utility of which host target genes is known in the art.

VGAM2469 is a novel bioinformatically detected regulatory, non protein coding, viral micro RNA (miRNA) gene. The method by which VGAM2469 was detected is described hereinabove with reference to FIGS. 1-8.

VGAM2469 gene, herein designated VGAM GENE, is a viral gene contained in the genome of Mouse Cytomegalovirus 1. VGAM2469 host target gene, herein designated VGAM HOST TARGET GENE, is a human gene contained in the human genome.

VGAM2469 gene encodes a VGAM2469 precursor RNA, herein designated VGAM PRECURSOR RNA. Similar to other miRNA genes, and unlike most ordinary genes, VGAM2469 precursor RNA does not encode a protein. A nucleotide sequence identical or highly similar to the nucleotide sequence of VGAM2469 precursor RNA is designated SEQ ID:2455, and is provided hereinbelow with reference to the sequence listing part. Nucleotide sequence SEQ ID:2455 is located at position 226054 relative to the genome of Mouse Cytomegalovirus 1.

VGAM2469 precursor RNA folds onto itself, forming VGAM2469 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2469 folded precursor RNA into VGAM2469 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2469 RNA is designated SEQ ID:5180, and is provided hereinbelow with reference to the sequence listing part.

VGAM2469 host target gene, herein designated VGAM HOST TARGET GENE, encodes a corresponding messenger RNA, VGAM2469 host target RNA, herein designated VGAM HOST TARGET RNA. VGAM2469 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2469 RNA, herein designated VGAM RNA, binds complementarily to one or more host target binding sites located in untranslated regions of VGAM2469 host target RNA, herein designated VGAM HOST TARGET RNA. This complementary binding is due to the fact that the nucleotide sequence of VGAM2469 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2469 RNA, herein designated VGAM RNA, may have a different number of host target binding sites in untranslated regions of a VGAM2469 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2469 RNA, herein designated VGAM RNA, to host target binding sites on VGAM2469 host target RNA, herein designated VGAM HOST TARGET RNA, such as BINDING SITE I, BINDING SITE II and BINDING SITE III, inhibits translation of VGAM2469 host target RNA into VGAM2469 host target protein, herein designated VGAM HOST TARGET PROTEIN. VGAM host target protein is therefore outlined by a broken line.

It is appreciated that VGAM2469 host target gene, herein designated VGAM HOST TARGET GENE, in fact represents a plurality of VGAM2469 host target genes. The mRNA of each one of this plurality of VGAM2469 host target genes comprises one or more host target binding sites, each having a nucleotide sequence which is at least partly complementary to VGAM2469 RNA, herein designated VGAM RNA, and which when bound by VGAM2469 RNA causes inhibition of translation of respective one or more VGAM2469 host target proteins.

It is further appreciated by one skilled in the art that the mode of translational inhibition illustrated by FIG. 1 with specific reference to translational inhibition exerted by VGAM2469 gene, herein designated VGAM GENE, on one or more VGAM2469 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2469 is inhibition of expression of host target genes, as part of a novel viral mechanism of attacking a host. Accordingly, utilities of VGAM2469 include diagnosis, prevention and treatment of viral infection by Mouse Cytomegalovirus 1. Specific functions, and accordingly utilities, of VGAM2469 correlate with, and may be deduced from, the identity of the host target genes which VGAM2469 binds and inhibits, and the function of these host target genes, as elaborated hereinbelow.

Nucleotide sequences of the VGAM2469 precursor RNA, herein designated VGAM PRECURSOR RNA, and of the 'diced' VGAM2469 RNA, herein designated VGAM RNA, and a schematic representation of the secondary folding of VGAM2469 folded precursor RNA, herein designated VGAM FOLDED PRECURSOR RNA, of VGAM2469 are further described hereinbelow with reference to Table 1.

Nucleotide sequences of host target binding sites, such as BINDING SITE-I, BINDING SITE-II and BINDING SITE-III of FIG. 1, found on VGAM2469 host target RNA, and schematic representation of the complementarity of each of these host target binding sites to VGAM2469 RNA, herein designated VGAM RNA, are described hereinbelow with reference to Table 2.

As mentioned hereinabove with reference to FIG. 1, a function of VGAM2469 gene, herein designated VGAM is inhibition of expression of VGAM2469 target genes. It is appreciated that specific functions, and accordingly utilities, of VGAM2469 correlate with, and may be deduced from, the identity of the target genes which VGAM2469 binds and inhibits, and the function of these target genes, as elaborated hereinbelow.

Diaphorase (NADH) (cytochrome b-5 reductase) (DIA1, Accession NM_007326) is a VGAM2469 host target gene. DIA1 BINDING SITE is HOST TARGET binding site found in the 5' untranslated region of mRNA encoded by DIA1, corresponding to a HOST TARGET binding site such as BINDING SITE I, BINDING SITE II or BINDING SITE III. Table 2 illustrates the complementarity of the nucleotide sequences of DIA1 BINDING SITE, designated SEQ ID:14245, to the nucleotide sequence of VGAM2469 RNA, herein designated VGAM RNA, also designated SEQ ID:5180.

A function of VGAM2469 is therefore inhibition of Diaphorase (NADH) (cytochrome b-5 reductase) (DIA1, Accession NM_007326). Accordingly, utilities of VGAM2469 include diagnosis, prevention and treatment of diseases and clinical conditions associated with DIA1. Deleted In Lung and Esophageal Cancer 1 (DLEC1, Accession NM_007338) is another VGAM2469 host target gene. DLEC1 BINDING SITE1 and DLEC1 BINDING SITE2 are HOST TARGET binding sites found in untranslated regions of mRNA encoded by DLEC1, corresponding to HOST TARGET binding sites such as BINDING SITE I, BINDING SITE II or BINDING SITE III. Table 2 illustrates the complementarity of the nucleotide sequences of DLEC1 BINDING SITE1 and DLEC1 BINDING SITE2, designated SEQ ID:14268 and SEQ ID:14262 respectively, to the nucleotide sequence of VGAM2469 RNA, herein designated VGAM RNA, also designated SEQ ID:5180.

Another function of VGAM2469 is therefore inhibition of Deleted In Lung and Esophageal Cancer 1 (DLEC1, Accession NM_007338). Accordingly, utilities of VGAM2469 include diagnosis, prevention and treatment of diseases and clinical conditions associated with DLEC1. Neurotensin Receptor 1 (high affinity) (NTSR1, Accession NM_002531) is another VGAM2469 host target gene. NTSR1 BINDING SITE is HOST TARGET binding site found in the 3' untranslated region of mRNA encoded by NTSR1, corresponding to a HOST TARGET binding site such as BINDING SITE I, BINDING SITE II or BINDING SITE III. Table 2 illustrates the complementarity of the nucleotide sequences of NTSR1 BINDING SITE, designated SEQ ID:8365, to the nucleotide sequence of VGAM2469 RNA, herein designated VGAM RNA, also designated SEQ ID:5180.

Another function of VGAM2469 is therefore inhibition of Neurotensin Receptor 1 (high affinity) (NTSR1, Accession NM_002531), a gene which is associated with g proteins that activate a phosphatidylinositol- calcium second messenger system. Accordingly, utilities of VGAM2469 include diagnosis, prevention and treatment of diseases and clinical conditions associated with NTSR1. The function of NTSR1 and its association with various diseases and clinical conditions, has been established by previous studies, as described hereinabove with reference to VGAM200. Golgi Autoantigen, Golgin Subfamily A, 1 (GOLGA1, Accession NM_002077) is another VGAM2469 host target gene. GOLGA1 BINDING SITE is HOST TARGET binding site found in the 3' untranslated region of mRNA encoded by GOLGA1, corresponding to a HOST TARGET binding site such as BINDING SITE I, BINDING SITE II or BINDING SITE III. Table 2 illustrates the complementarity of the nucleotide sequences of GOLGA1 BINDING SITE, designated SEQ ID:7858, to the nucleotide sequence of VGAM2469 RNA, herein designated VGAM RNA, also designated SEQ ID:5180.

Another function of VGAM2469 is therefore inhibition of Golgi Autoantigen, Golgin Subfamily A, 1 (GOLGA1, Accession NM_002077). Accordingly, utilities of VGAM2469 include diagnosis, prevention and treatment of diseases and clinical conditions associated with GOLGA1. LOC149566 (Accession XM_097670) is another VGAM2469 host target gene. LOC149566 BINDING SITE is HOST TARGET binding site found in the 3' untranslated region of mRNA encoded by LOC149566, corresponding to a HOST TARGET binding site such as BINDING SITE I, BINDING SITE II or BINDING SITE III. Table 2 illustrates the complementarity of the nucleotide sequences of LOC149566 BINDING SITE, designated SEQ ID:41014, to the nucleotide sequence of VGAM2469 RNA, herein designated VGAM RNA, also designated SEQ ID:5180.

Another function of VGAM2469 is therefore inhibition of LOC149566 (Accession XM_097670). Accordingly, utilities of VGAM2469 include diagnosis, prevention and treatment of diseases and clinical conditions associated with LOC149566. LOC150967 (Accession XM_087060) is another VGAM2469 host target gene. LOC150967 BINDING SITE is HOST TARGET binding site found in the 5' untranslated region of mRNA encoded by LOC150967, corresponding to a HOST TARGET binding site such as BINDING SITE I, BINDING SITE II or BINDING SITE III. Table 2 illustrates the complementarity of the nucleotide sequences of LOC150967 BINDING SITE, designated SEQ ID:39033, to the nucleotide sequence of VGAM2469 RNA, herein designated VGAM RNA, also designated SEQ ID:5180.

Another function of VGAM2469 is therefore inhibition of LOC150967 (Accession XM_087060). Accordingly, utilities of VGAM2469 include diagnosis, prevention and treatment of diseases and clinical conditions associated with LOC150967. LOC151124 (Accession XM_098006) is another VGAM2469 host target gene. LOC151124 BINDING SITE is HOST TARGET binding site found in the 5' untranslated region of mRNA encoded by LOC151124, corresponding to a HOST TARGET binding site such as BINDING SITE I, BINDING SITE II or BINDING SITE III. Table 2 illustrates the complementarity of the nucleotide sequences of LOC151124 BINDING SITE, designated SEQ ID:41300, to the nucleotide sequence of VGAM2469 RNA, herein designated VGAM RNA, also designated SEQ ID:5180.

Another function of VGAM2469 is therefore inhibition of LOC151124 (Accession XM_098006). Accordingly, utilities of VGAM2469 include diagnosis, prevention and treatment of diseases and clinical conditions associated with LOC151124. FIG. 1 further provides a conceptual description of a novel bioinformatically detected viral gene of the present invention, referred to here as Viral Genomic Address Messenger 2470 (VGAM2470) viral gene, which modulates expression of respective host target genes thereof, the function and utility of which host target genes is known in the art.

VGAM2470 is a novel bioinformatically detected regulatory, non protein coding, viral micro RNA (miRNA) gene. The method by which VGAM2470 was detected is described hereinabove with reference to FIGS. 1-8.

VGAM2470 gene, herein designated VGAM GENE, is a viral gene contained in the genome of Mouse Cytomegalovirus 1. VGAM2470 host target gene, herein designated VGAM HOST TARGET GENE, is a human gene contained in the human genome.

VGAM2470 gene encodes a VGAM2470 precursor RNA, herein designated VGAM PRECURSOR RNA. Similar to other miRNA genes, and unlike most ordinary genes, VGAM2470 precursor RNA does not encode a protein. A nucleotide sequence identical or highly similar to the nucleotide sequence of VGAM2470 precursor RNA is designated SEQ ID:2456, and is provided hereinbelow with reference to the sequence listing part. Nucleotide sequence SEQ ID:2456 is located at position 195573 relative to the genome of Mouse Cytomegalovirus 1.

VGAM2470 precursor RNA folds onto itself, forming VGAM2470 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2470 folded precursor RNA into VGAM2470 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2470 RNA is designated SEQ ID:5181, and is provided hereinbelow with reference to the sequence listing part.

VGAM2470 host target gene, herein designated VGAM HOST TARGET GENE, encodes a corresponding messenger RNA, VGAM2470 host target RNA, herein designated VGAM HOST TARGET RNA. VGAM2470 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2470 RNA, herein designated VGAM RNA, binds complementarily to one or more host target binding sites located in untranslated regions of VGAM2470 host target RNA, herein designated VGAM HOST TARGET RNA. This complementary binding is due to the fact that the nucleotide sequence of VGAM2470 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2470 RNA, herein designated VGAM RNA, may have a different number of host target binding sites in untranslated regions of a VGAM2470 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2470 RNA, herein designated VGAM RNA, to host target binding sites on VGAM2470 host target RNA, herein designated VGAM HOST TARGET RNA, such as BINDING SITE I, BINDING SITE II and BINDING SITE III, inhibits translation of VGAM2470 host target RNA into VGAM2470 host target protein, herein designated VGAM HOST TARGET PROTEIN. VGAM host target protein is therefore outlined by a broken line.

It is appreciated that VGAM2470 host target gene, herein designated VGAM HOST TARGET GENE, in fact represents a plurality of VGAM2470 host target genes. The mRNA of each one of this plurality of VGAM2470 host target genes comprises one or more host target binding sites, each having a nucleotide sequence which is at least partly complementary to VGAM2470 RNA, herein designated VGAM RNA, and which when bound by VGAM2470 RNA causes inhibition of translation of respective one or more VGAM2470 host target proteins.

It is further appreciated by one skilled in the art that the mode of translational inhibition illustrated by FIG. 1 with specific reference to translational inhibition exerted by VGAM2470 gene, herein designated VGAM GENE, on one or more VGAM2470 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2470 is inhibition of expression of host target genes, as part of a novel viral mechanism of attacking a host. Accordingly, utilities of VGAM2470 include diagnosis, prevention and treatment of viral infection by Mouse Cytomegalovirus 1. Specific functions, and accordingly utilities, of VGAM2470 correlate with, and may be deduced from, the identity of the host target genes which VGAM2470 binds and inhibits, and the function of these host target genes, as elaborated hereinbelow.

Nucleotide sequences of the VGAM2470 precursor RNA, herein designated VGAM PRECURSOR RNA, and of the 'diced' VGAM2470 RNA, herein designated VGAM RNA, and a schematic representation of the secondary folding of VGAM2470 folded precursor RNA, herein designated VGAM FOLDED PRECURSOR RNA, of VGAM2470 are further described hereinbelow with reference to Table 1.

Nucleotide sequences of host target binding sites, such as BINDING SITE-I, BINDING SITE-II and BINDING SITE-III of FIG. 1, found on VGAM2470 host target RNA, and schematic representation of the complementarity of each of these host target binding sites to VGAM2470 RNA, herein designated VGAM RNA, are described hereinbelow with reference to Table 2.

As mentioned hereinabove with reference to FIG. 1, a function of VGAM2470 gene, herein designated VGAM is inhibition of expression of VGAM2470 target genes. It is appreciated that specific functions, and accordingly utilities, of VGAM2470 correlate with, and may be deduced from, the identity of the target genes which VGAM2470 binds and inhibits, and the function of these target genes, as elaborated hereinbelow.

Epithelial Membrane Protein 1 (EMP1, Accession NM_001423) is a VGAM2470 host target gene. EMP1 BINDING SITE is HOST TARGET binding site found in the 3' untranslated region of mRNA encoded by EMP1, corresponding to a HOST TARGET binding site such as BINDING SITE I, BINDING SITE II or BINDING SITE III. Table 2 illustrates the complementarity of the nucleotide sequences of EMP1 BINDING SITE, designated SEQ ID:7130, to the nucleotide sequence of VGAM2470 RNA, herein designated VGAM RNA, also designated SEQ ID:5181.

A function of VGAM2470 is therefore inhibition of Epithelial Membrane Protein 1 (EMP1, Accession NM_001423), a gene which plays a role in squamous cell differentiation; member of the PMP22/EMP/MP20 family of membrane glycoproteins. Accordingly, utilities of VGAM2470 include diagnosis, prevention and treatment of diseases and clinical conditions associated with EMP1. The function of EMP1 and its association with various diseases and clinical conditions, has been established by previous studies, as described hereinabove with reference to VGAM107. FIG. 1 further provides a conceptual description of a novel bioinformatically detected viral gene of the present invention, referred to here as Viral Genomic Address Messenger 2471 (VGAM2471) viral gene, which modulates expression of respective host target genes thereof, the function and utility of which host target genes is known in the art.

VGAM2471 is a novel bioinformatically detected regulatory, non protein coding, viral micro RNA (miRNA) gene. The method by which VGAM2471 was detected is described hereinabove with reference to FIGS. 1-8.

VGAM2471 gene, herein designated VGAM GENE, is a viral gene contained in the genome of Mouse Cytomegalovirus 1. VGAM2471 host target gene, herein designated VGAM HOST TARGET GENE, is a human gene contained in the human genome.

VGAM2471 gene encodes a VGAM2471 precursor RNA, herein designated VGAM PRECURSOR RNA. Similar to other miRNA genes, and unlike most ordinary genes, VGAM2471 precursor RNA does not encode a protein. A nucleotide sequence identical or highly similar to the nucleotide sequence of VGAM2471 precursor RNA is designated SEQ ID:2457, and is provided hereinbelow with reference to the sequence listing part. Nucleotide sequence SEQ ID:2457 is located at position 2006 relative to the genome of Mouse Cytomegalovirus 1.

VGAM2471 precursor RNA folds onto itself, forming VGAM2471 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2471 folded precursor RNA into VGAM2471 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2471 RNA is designated SEQ ID:5182, and is provided hereinbelow with reference to the sequence listing part.

VGAM2471 host target gene, herein designated VGAM HOST TARGET GENE, encodes a corresponding messenger RNA, VGAM2471 host target RNA, herein designated VGAM HOST TARGET RNA. VGAM2471 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2471 RNA, herein designated VGAM RNA, binds complementarily to one or more host target binding sites located in untranslated regions of VGAM2471 host target RNA, herein designated VGAM HOST TARGET RNA. This complementary binding is due to the fact that the nucleotide sequence of VGAM2471 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2471 RNA, herein designated VGAM RNA, may have a different number of host target binding sites in untranslated regions of a VGAM2471 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2471 RNA, herein designated VGAM RNA, to host target binding sites on VGAM2471 host target RNA, herein designated VGAM HOST TARGET RNA, such as BINDING SITE I, BINDING SITE II and BINDING SITE III, inhibits translation of VGAM2471 host target RNA into VGAM2471 host target protein, herein designated VGAM HOST TARGET PROTEIN. VGAM host target protein is therefore outlined by a broken line.

It is appreciated that VGAM2471 host target gene, herein designated VGAM HOST TARGET GENE, in fact represents a plurality of VGAM2471 host target genes. The mRNA of each one of this plurality of VGAM2471 host target genes comprises one or more host target binding sites, each having a nucleotide sequence which is at least partly complementary to VGAM2471 RNA, herein designated VGAM RNA, and which when bound by VGAM2471 RNA causes inhibition of translation of respective one or more VGAM2471 host target proteins.

It is further appreciated by one skilled in the art that the mode of translational inhibition illustrated by FIG. 1 with specific reference to translational inhibition exerted by VGAM2471 gene, herein designated VGAM GENE, on one or more VGAM2471 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2471 is inhibition of expression of host target genes, as part of a novel viral mechanism of attacking a host. Accordingly, utilities of VGAM2471 include diagnosis, prevention and treatment of viral infection by Mouse Cytomegalovirus 1. Specific functions, and accordingly utilities, of VGAM2471 correlate with, and may be deduced from, the identity of the host target genes which VGAM2471 binds and inhibits, and the function of these target genes, as elaborated hereinbelow.

Nucleotide sequences of the VGAM2471 precursor RNA, herein designated VGAM PRECURSOR RNA, and of the 'diced' VGAM2471 RNA, herein designated VGAM RNA, and a schematic representation of the secondary folding of VGAM2471 folded precursor RNA, herein designated VGAM FOLDED PRECURSOR RNA, of VGAM2471 are further described hereinbelow with reference to Table 1.

Nucleotide sequences of host target binding sites, such as BINDING SITE-I, BINDING SITE-II and BINDING SITE-III of FIG. 1, found on VGAM2471 host target RNA, and schematic representation of the complementarity of each of these host target binding sites to VGAM2471 RNA, herein designated VGAM RNA, are described hereinbelow with reference to Table 2.

As mentioned hereinabove with reference to FIG. 1, a function of VGAM2471 gene, herein designated VGAM is inhibition of expression of VGAM2471 target genes. It is appreciated that specific functions, and accordingly utilities, of VGAM2471 correlate with, and may be deduced from, the identity of the target genes which VGAM2471 binds and inhibits, and the function of these target genes, as elaborated hereinbelow.

Neuro-oncological Ventral Antigen 1 (NOVA1, Accession NM_002515) is a VGAM2471 host target gene. NOVA1 BINDING SITE1 and NOVA1 BINDING SITE2 are HOST TARGET binding sites found in untranslated regions of mRNA encoded by NOVA1, corresponding to HOST TARGET binding sites such as BINDING SITE I, BINDING SITE II or BINDING SITE III. Table 2 illustrates the complementarity of the nucleotide sequences of NOVA1 BINDING SITE1 and NOVA1 BINDING SITE2, designated SEQ ID:8349 and SEQ ID:13218 respectively, to the nucleotide sequence of VGAM2471 RNA, herein designated VGAM RNA, also designated SEQ ID:5182.

A function of VGAM2471 is therefore inhibition of Neuro-oncological Ventral Antigen 1 (NOVA1, Accession NM_002515), a gene which may regulate rna splicing or metabolism in a specific subset of developing neurons. Accordingly, utilities of VGAM2471 include diagnosis, prevention and treatment of diseases and clinical conditions associated with NOVA1. The function of NOVA1 and its association with various diseases and clinical conditions, has been established by previous studies, as described hereinabove with reference to VGAM521. KIAA0446 (Accession XM_044155) is another VGAM2471 host target gene. KIAA0446 BINDING SITE is HOST TARGET binding site found in the 3' untranslated region of mRNA encoded by KIAA0446, corresponding to a HOST TARGET binding site such as BINDING SITE I, BINDING SITE II or BINDING SITE III. Table 2 illustrates the complementarity of the nucleotide sequences of KIAA0446 BINDING SITE, designated SEQ ID:34144, to the nucleotide sequence of VGAM2471 RNA, herein designated VGAM RNA, also designated SEQ ID:5182.

Another function of VGAM2471 is therefore inhibition of KIAA0446 (Accession XM_044155). Accordingly, utilities of VGAM2471 include diagnosis, prevention and treatment of diseases and clinical conditions associated with KIAA0446. FIG. 1 further provides a conceptual description of a novel bioinformatically detected viral gene of the present invention, referred to here as Viral Genomic Address Messenger 2472 (VGAM2472) viral gene, which modulates expression of respective host target genes thereof, the function and utility of which host target genes is known in the art.

VGAM2472 is a novel bioinformatically detected regulatory, non protein coding, viral micro RNA (miRNA) gene. The method by which VGAM2472 was detected is described hereinabove with reference to FIGS. 1-8.

VGAM2472 gene, herein designated VGAM GENE, is a viral gene contained in the genome of Mouse Cytomegalovirus 1. VGAM2472 host target gene, herein designated VGAM HOST TARGET GENE, is a human gene contained in the human genome.

VGAM2472 gene encodes a VGAM2472 precursor RNA, herein designated VGAM PRECURSOR RNA. Similar to other miRNA genes, and unlike most ordinary genes, VGAM2472 precursor RNA does not encode a protein. A nucleotide sequence identical or highly similar to the nucleotide sequence of VGAM2472 precursor RNA is designated SEQ ID:2458, and is provided hereinbelow with reference to the sequence listing part. Nucleotide sequence SEQ ID:2458 is located at position 116628 relative to the genome of Mouse Cytomegalovirus 1.

VGAM2472 precursor RNA folds onto itself, forming VGAM2472 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2472 folded precursor RNA into VGAM2472 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2472 RNA is designated SEQ ID:5183, and is provided hereinbelow with reference to the sequence listing part.

VGAM2472 host target gene, herein designated VGAM HOST TARGET GENE, encodes a corresponding messenger RNA, VGAM2472 host target RNA, herein designated VGAM HOST TARGET RNA. VGAM2472 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2472 RNA, herein designated VGAM RNA, binds complementarily to one or more host target binding sites located in untranslated regions of VGAM2472 host target RNA, herein designated VGAM HOST TARGET RNA. This complementary binding is due to the fact that the nucleotide sequence of VGAM2472 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2472 RNA, herein designated VGAM RNA, may have a different number of host target binding sites in untranslated regions of a VGAM2472 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2472 RNA, herein designated VGAM RNA, to host target binding sites on VGAM2472 host target RNA, herein designated VGAM HOST TARGET RNA, such as BINDING SITE I, BINDING SITE II and BINDING SITE III, inhibits translation of VGAM2472 host target RNA into VGAM2472 host target protein, herein designated VGAM HOST TARGET PROTEIN. VGAM host target protein is therefore outlined by a broken line.

It is appreciated that VGAM2472 host target gene, herein designated VGAM HOST TARGET GENE, in fact represents a plurality of VGAM2472 host target genes. The mRNA of each one of this plurality of VGAM2472 host target genes comprises one or more host target binding sites, each having a nucleotide sequence which is at least partly complementary to VGAM2472 RNA, herein designated VGAM RNA, and which when bound by VGAM2472 RNA causes inhibition of translation of respective one or more VGAM2472 host target proteins.

It is further appreciated by one skilled in the art that the mode of translational inhibition illustrated by FIG. 1 with specific reference to translational inhibition exerted by VGAM2472 gene, herein designated VGAM GENE, on one or more VGAM2472 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2472 is inhibition of expression of host target genes, as part of a novel viral mechanism of attacking a host. Accordingly, utilities of VGAM2472 include diagnosis, prevention and treatment of viral infection by Mouse Cytomegalovirus 1. Specific functions, and accordingly utilities, of VGAM2472 correlate with, and may be deduced from, the identity of the host target genes which VGAM2472 binds and inhibits, and the function of these host target genes, as elaborated hereinbelow.

Nucleotide sequences of the VGAM2472 precursor RNA, herein designated VGAM PRECURSOR RNA, and of the 'diced' VGAM2472 RNA, herein designated VGAM RNA, and a schematic representation of the secondary folding of VGAM2472 folded precursor RNA, herein designated VGAM FOLDED PRECURSOR RNA, of VGAM2472 are further described hereinbelow with reference to Table 1.

Nucleotide sequences of host target binding sites, such as BINDING SITE-I, BINDING SITE-II and BINDING SITE-III of FIG. 1, found on VGAM2472 host target RNA, and schematic representation of the complementarity of each of these host target binding sites to VGAM2472 RNA, herein designated VGAM RNA, are described hereinbelow with reference to Table 2.

As mentioned hereinabove with reference to FIG. 1, a function of VGAM2472 gene, herein designated VGAM is inhibition of expression of VGAM2472 target genes. It is appreciated that specific functions, and accordingly utilities, of VGAM2472 correlate with, and may be deduced from, the identity of the target genes which VGAM2472 binds and inhibits, and the function of these target genes, as elaborated hereinbelow.

Integrin, Alpha 11 (ITGA11, Accession NM_012211) is a VGAM2472 host target gene. ITGA11 BINDING SITE is HOST TARGET binding site found in the 3' untranslated region of mRNA encoded by ITGA11, corresponding to a HOST TARGET binding site such as BINDING SITE I, BINDING SITE II or BINDING SITE III. Table 2 illustrates the complementarity of the nucleotide sequences of ITGA11 BINDING SITE, designated SEQ ID:14515, to the nucleotide sequence of VGAM2472 RNA, herein designated VGAM RNA, also designated SEQ ID:5183.

A function of VGAM2472 is therefore inhibition of Integrin, Alpha 11 (ITGA11, Accession NM_012211), a gene which acts as a collagen I receptor. Accordingly, utilities of VGAM2472 include diagnosis, prevention and treatment of diseases and clinical conditions associated with ITGA11. The function of ITGA11 and its association with various diseases and clinical conditions, has been established by previous studies, as described hereinabove with reference to VGAM206. Surfactant, Pulmonary-associated Protein A2 (SFTPA2, Accession NM_006926) is another VGAM2472 host target gene. SFTPA2 BINDING SITE is HOST TARGET binding site found in the 3' untranslated region of mRNA encoded by SFTPA2, corresponding to a HOST TARGET binding site such as BINDING SITE I, BINDING SITE II or BINDING SITE III. Table 2 illustrates the complementarity of the nucleotide sequences of SFTPA2 BINDING SITE, designated SEQ ID:13809, to the nucleotide sequence of VGAM2472 RNA, herein designated VGAM RNA, also designated SEQ ID:5183.

Another function of VGAM2472 is therefore inhibition of Surfactant, Pulmonary-associated Protein A2 (SFTPA2, Accession NM_006926), a gene which plays a role in innate host defense in the lung. Accordingly, utilities of VGAM2472 include diagnosis, prevention and treatment of diseases and clinical conditions associated with SFTPA2. The function of SFTPA2 and its association with various diseases and clinical conditions, has been established by previous studies, as described hereinabove with reference to VGAM148. Serine/arginine Repetitive Matrix 1 (SRRM1, Accession NM_005839) is another VGAM2472 host target gene. SRRM1 BINDING SITE is HOST TARGET binding site found in the 3' untranslated region of mRNA encoded by SRRM1, corresponding to a HOST TARGET binding site such as BINDING SITE I, BINDING SITE II or BINDING SITE III. Table 2 illustrates the complementarity of the nucleotide sequences of SRRM1 BINDING SITE, designated SEQ ID:12450, to the nucleotide sequence of VGAM2472 RNA, herein designated VGAM RNA, also designated SEQ ID:5183.

Another function of VGAM2472 is therefore inhibition of Serine/arginine Repetitive Matrix 1 (SRRM1, Accession NM_005839). Accordingly, utilities of VGAM2472 include diagnosis, prevention and treatment of diseases and clinical conditions associated with SRRM1. GREB1 (Accession XM_051545) is another VGAM2472 host target gene. GREB1 BINDING SITE is HOST TARGET binding site found in the 3' untranslated region of mRNA encoded by GREB1, corresponding to a HOST TARGET binding site such as BINDING SITE I, BINDING SITE II or BINDING SITE III. Table 2 illustrates the complementarity of the nucleotide sequences of GREB1 BINDING SITE, designated SEQ ID:35853, to the nucleotide sequence of VGAM2472 RNA, herein designated VGAM RNA, also designated SEQ ID:5183.

Another function of VGAM2472 is therefore inhibition of GREB1 (Accession XM_051545). Accordingly, utilities of VGAM2472 include diagnosis, prevention and treatment of diseases and clinical conditions associated with GREB1. KIAA0537 (Accession NM_014840) is another VGAM2472 host target gene. KIAA0537 BINDING SITE is HOST TARGET binding site found in the 5' untranslated region of mRNA encoded by KIAA0537, corresponding to a HOST TARGET binding site such as BINDING SITE I, BINDING SITE II or BINDING SITE III. Table 2 illustrates the complementarity of the nucleotide sequences of KIAA0537 BINDING SITE, designated SEQ ID:16868, to the nucleotide sequence of VGAM2472 RNA, herein designated VGAM RNA, also designated SEQ ID:5183.

Another function of VGAM2472 is therefore inhibition of KIAA0537 (Accession NM_014840). Accordingly, utilities of VGAM2472 include diagnosis, prevention and treatment of diseases and clinical conditions associated with KIAA0537. MGC4504 (Accession NM_024111) is another VGAM2472 host target gene. MGC4504 BINDING SITE is HOST TARGET binding site found in the 3' untranslated region of mRNA encoded by MGC4504, corresponding to a HOST TARGET binding site such as BINDING SITE I, BINDING SITE II or BINDING SITE III. Table 2 illustrates the complementarity of the nucleotide sequences of MGC4504 BINDING SITE, designated SEQ ID:23558, to the nucleotide sequence of VGAM2472 RNA, herein designated VGAM RNA, also designated SEQ ID:5183.

Another function of VGAM2472 is therefore inhibition of MGC4504 (Accession NM_024111). Accordingly, utilities of VGAM2472 include diagnosis, prevention and treatment of diseases and clinical conditions associated with MGC4504. Purinergic Receptor P2X, Ligand-gated Ion Channel, 5 (P2RX5, Accession NM_002561) is another VGAM2472 host target gene. P2RX5 BINDING SITE is HOST TARGET binding site found in the 3' untranslated region of mRNA encoded by P2RX5, corresponding to a HOST TARGET binding site such as BINDING SITE I, BINDING SITE II or BINDING SITE III. Table 2 illustrates the complementarity of the nucleotide sequences of P2RX5 BINDING SITE, designated SEQ ID:8410, to the nucleotide sequence of VGAM2472 RNA, herein designated VGAM RNA, also designated SEQ ID:5183.

Another function of VGAM2472 is therefore inhibition of Purinergic Receptor P2X, Ligand-gated Ion Channel, 5 (P2RX5, Accession NM_002561). Accordingly, utilities of VGAM2472 include diagnosis, prevention and treatment of diseases and clinical conditions associated with P2RX5. LOC148918 (Accession XM_086361) is another VGAM2472 host target gene. LOC148918 BINDING SITE is HOST TARGET binding site found in the 5' untranslated region of mRNA encoded by LOC148918, corresponding to a HOST TARGET binding site such as BINDING SITE I, BINDING SITE II or BINDING SITE III. Table 2 illustrates the complementarity of the nucleotide sequences of LOC148918 BINDING SITE, designated SEQ ID:38615, to the nucleotide sequence of VGAM2472 RNA, herein designated VGAM RNA, also designated SEQ ID:5183.

Another function of VGAM2472 is therefore inhibition of LOC148918 (Accession XM_086361). Accordingly, utilities of VGAM2472 include diagnosis, prevention and treatment of diseases and clinical conditions associated with LOC148918. FIG. 1 further provides a conceptual description of a novel bioinformatically detected viral gene of the present invention, referred to here as Viral Genomic Address Messenger 2473 (VGAM2473) viral gene, which modulates expression of respective host target genes thereof, the function and utility of which host target genes is known in the art.

VGAM2473 is a novel bioinformatically detected regulatory, non protein coding, viral micro RNA (miRNA) gene. The method by which VGAM2473 was detected is described hereinabove with reference to FIGS. 1-8.

VGAM2473 gene, herein designated VGAM GENE, is a viral gene contained in the genome of Mouse Cytomegalovirus 1. VGAM2473 host target gene, herein designated VGAM HOST TARGET GENE, is a human gene contained in the human genome.

VGAM2473 gene encodes a VGAM2473 precursor RNA, herein designated VGAM PRECURSOR RNA. Similar to other miRNA genes, and unlike most ordinary genes, VGAM2473 precursor RNA does not encode a protein. A nucleotide sequence identical or highly similar to the nucleotide sequence of VGAM2473 precursor RNA is designated SEQ ID:2459, and is provided hereinbelow with reference to the sequence listing part. Nucleotide sequence SEQ ID:2459 is located at position 101492 relative to the genome of Mouse Cytomegalovirus 1.

VGAM2473 precursor RNA folds onto itself, forming VGAM2473 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2473 folded precursor RNA into VGAM2473 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2473 RNA is designated SEQ ID:5184, and is provided hereinbelow with reference to the sequence listing part.

VGAM2473 host target gene, herein designated VGAM HOST TARGET GENE, encodes a corresponding messenger RNA, VGAM2473 host target RNA, herein designated VGAM HOST TARGET RNA. VGAM2473 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2473 RNA, herein designated VGAM RNA, binds complementarily to one or more host target binding sites located in untranslated regions of VGAM2473 host target RNA, herein designated VGAM HOST TARGET RNA. This complementary binding is due to the fact that the nucleotide sequence of VGAM2473 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2473 RNA, herein designated VGAM RNA, may have a different number of host target binding sites in untranslated regions of a VGAM2473 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2473 RNA, herein designated VGAM RNA, to host target binding sites on VGAM2473 host target RNA, herein designated VGAM HOST TARGET RNA, such as BINDING SITE I, BINDING SITE II and BINDING SITE III, inhibits translation of VGAM2473 host target RNA into VGAM2473 host target protein, herein designated VGAM HOST TARGET PROTEIN. VGAM host target protein is therefore outlined by a broken line.

It is appreciated that VGAM2473 host target gene, herein designated VGAM HOST TARGET GENE, in fact represents a plurality of VGAM2473 host target genes. The mRNA of each one of this plurality of VGAM2473 host target genes comprises one or more host target binding sites, each having a nucleotide sequence which is at least partly complementary to VGAM2473 RNA, herein designated VGAM RNA, and which when bound by VGAM2473 RNA causes inhibition of translation of respective one or more VGAM2473 host target proteins.

It is further appreciated by one skilled in the art that the mode of translational inhibition illustrated by FIG. 1 with specific reference to translational inhibition exerted by VGAM2473 gene, herein designated VGAM GENE, on one or more VGAM2473 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2473 is inhibition of expression of host target genes, as part of a novel viral mechanism of attacking a host. Accordingly, utilities of VGAM2473 include diagnosis, prevention and treatment of viral infection by Mouse Cytomegalovirus 1. Specific functions, and accordingly utilities, of VGAM2473 correlate with, and may be deduced from, the identity of the host target genes which VGAM2473 binds and inhibits, and the function of these host target genes, as elaborated hereinbelow.

Nucleotide sequences of the VGAM2473 precursor RNA, herein designated VGAM PRECURSOR RNA, and of the 'diced' VGAM2473 RNA, herein designated VGAM RNA, and a schematic representation of the secondary folding of VGAM2473 folded precursor RNA, herein designated VGAM FOLDED PRECURSOR RNA, of VGAM2473 are further described hereinbelow with reference to Table 1.

Nucleotide sequences of host target binding sites, such as BINDING SITE-I, BINDING SITE-II and BINDING SITE-III of FIG. 1, found on VGAM2473 host target RNA, and schematic representation of the complementarity of each of these host target binding sites to VGAM2473 RNA, herein designated VGAM RNA, are described hereinbelow with reference to Table 2.

As mentioned hereinabove with reference to FIG. 1, a function of VGAM2473 gene, herein designated VGAM is inhibition of expression of VGAM2473 target genes. It is appreciated that specific functions, and accordingly utilities, of VGAM2473 correlate with, and may be deduced from, the identity of the target genes which VGAM2473 binds and inhibits, and the function of these target genes, as elaborated hereinbelow.

Cyclin-dependent Kinase Inhibitor 1C (p57, Kip2) (CDKN1C, Accession NM_000076) is a VGAM2473 host target gene. CDKN1C BINDING SITE is HOST TARGET binding site found in the 5' untranslated region of mRNA encoded by CDKN1C, corresponding to a HOST TARGET binding site such as BINDING SITE I, BINDING SITE II or BINDING SITE III. Table 2 illustrates the complementarity of the nucleotide sequences of CDKN1C BINDING SITE, designated SEQ ID:5521, to the nucleotide sequence of VGAM2473 RNA, herein designated VGAM RNA, also designated SEQ ID:5184.

A function of VGAM2473 is therefore inhibition of Cyclin-dependent Kinase Inhibitor 1C (p57, Kip2) (CDKN1C, Accession NM_000076). Accordingly, utilities of VGAM2473 include diagnosis, prevention and treatment of diseases and clinical conditions associated with CDKN1C. Dystrobrevin, Alpha (DTNA, Accession NM_001391) is another VGAM2473 host target gene. DTNA BINDING SITE1 through DTNA BINDING SITE4 are HOST TARGET binding sites found in untranslated regions of mRNA encoded by DTNA, corresponding to HOST TARGET binding sites such as BINDING SITE I, BINDING SITE II or BINDING SITE III. Table 2 illustrates the complementarity of the nucleotide sequences of DTNA BINDING SITE1 through DTNA BINDING SITE4, designated SEQ ID:7083, SEQ ID:26840, SEQ ID:26845 and SEQ ID:26850 respectively, to the nucleotide sequence of VGAM2473 RNA, herein designated VGAM RNA, also designated SEQ ID:5184.

Another function of VGAM2473 is therefore inhibition of Dystrobrevin, Alpha (DTNA, Accession NM_001391), a gene which may be involved in the formation and stability of synapses. Accordingly, utilities of VGAM2473 include diagnosis, prevention and treatment of diseases and clinical conditions associated with DTNA. The function of DTNA and its association with various diseases and clinical conditions, has been established by previous studies, as described hereinabove with reference to VGAM1021. Nucleolar Protein 4 (NOL4, Accession NM_003787) is another VGAM2473 host target gene. NOL4 BINDING SITE is HOST TARGET binding site found in the 5' untranslated region of mRNA encoded by NOL4, corresponding to a HOST TARGET binding site such as BINDING SITE I, BINDING SITE II or BINDING SITE III. Table 2 illustrates the complementarity of the nucleotide sequences of NOL4 BINDING SITE, designated SEQ ID:9875, to the nucleotide sequence of VGAM2473 RNA, herein designated VGAM RNA, also designated SEQ ID:5184.

Another function of VGAM2473 is therefore inhibition of Nucleolar Protein 4 (NOL4, Accession NM_003787). Accordingly, utilities of VGAM2473 include diagnosis, prevention and treatment of diseases and clinical conditions associated with NOL4. SC65 (Accession NM_006455) is another VGAM2473 host target gene. SC65 BINDING SITE is HOST TARGET binding site found in the 3' untranslated region of mRNA encoded by SC65, corresponding to a HOST TARGET binding site such as BINDING SITE I, BINDING SITE II or BINDING SITE III. Table 2 illustrates the complementarity of the nucleotide sequences of SC65 BINDING SITE, designated SEQ ID:13173, to the nucleotide sequence of VGAM2473 RNA, herein designated VGAM RNA, also designated SEQ ID:5184.

Another function of VGAM2473 is therefore inhibition of SC65 (Accession NM_006455). Accordingly, utilities of VGAM2473 include diagnosis, prevention and treatment of diseases and clinical conditions associated with SC65. FIG. 1 further provides a conceptual description of a novel bioinformatically detected viral gene of the present invention, referred to here as Viral Genomic Address Messenger 2474 (VGAM2474) viral gene, which modulates expression of respective host target genes thereof, the function and utility of which host target genes is known in the art.

VGAM2474 is a novel bioinformatically detected regulatory, non protein coding, viral micro RNA (miRNA) gene. The method by which VGAM2474 was detected is described hereinabove with reference to FIGS. 1-8.

VGAM2474 gene, herein designated VGAM GENE, is a viral gene contained in the genome of Mouse Cytomegalovirus 1. VGAM2474 host target gene, herein designated VGAM HOST TARGET GENE, is a human gene contained in the human genome.

VGAM2474 gene encodes a VGAM2474 precursor RNA, herein designated VGAM PRECURSOR RNA. Similar to other miRNA genes, and unlike most ordinary genes, VGAM2474 precursor RNA does not encode a protein. A nucleotide sequence identical or highly similar to the nucleotide sequence of VGAM2474 precursor RNA is designated SEQ ID:2460, and is provided hereinbelow with reference to the sequence listing part. Nucleotide sequence SEQ ID:2460 is located at position 82294 relative to the genome of Mouse Cytomegalovirus 1.

VGAM2474 precursor RNA folds onto itself, forming VGAM2474 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2474 folded precursor RNA into VGAM2474 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2474 RNA is designated SEQ ID:5185, and is provided hereinbelow with reference to the sequence listing part.

VGAM2474 host target gene, herein designated VGAM HOST TARGET GENE, encodes a corresponding messenger RNA, VGAM2474 host target RNA, herein designated VGAM HOST TARGET RNA. VGAM2474 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2474 RNA, herein designated VGAM RNA, binds complementarily to one or more host target binding sites located in untranslated regions of VGAM2474 host target RNA, herein designated VGAM HOST TARGET RNA. This complementary binding is due to the fact that the nucleotide sequence of VGAM2474 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2474 RNA, herein designated VGAM RNA, may have a different number of host target binding sites in untranslated regions of a VGAM2474 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2474 RNA, herein designated VGAM RNA, to host target binding sites on VGAM2474 host target RNA, herein designated VGAM HOST TARGET RNA, such as BINDING SITE I, BINDING SITE II and BINDING SITE III, inhibits translation of VGAM2474 host target RNA into VGAM2474 host target protein, herein designated VGAM HOST TARGET PROTEIN. VGAM host target protein is therefore outlined by a broken line.

It is appreciated that VGAM2474 host target gene, herein designated VGAM HOST TARGET GENE, in fact represents a plurality of VGAM2474 host target genes. The mRNA of each one of this plurality of VGAM2474 host target genes comprises one or more host target binding sites, each having a nucleotide sequence which is at least partly complementary to VGAM2474 RNA, herein designated VGAM RNA, and which when bound by VGAM2474 RNA causes inhibition of translation of respective one or more VGAM2474 host target proteins.

It is further appreciated by one skilled in the art that the mode of translational inhibition illustrated by FIG. 1 with specific reference to translational inhibition exerted by VGAM2474 gene, herein designated VGAM GENE, on one or more VGAM2474 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2474 is inhibition of expression of host target genes, as part of a novel viral mechanism of attacking a host. Accordingly, utilities of VGAM2474 include diagnosis, prevention and treatment of viral infection by Mouse Cytomegalovirus 1. Specific functions, and accordingly utilities, of VGAM2474 correlate with, and may be deduced from, the identity of the host target genes which VGAM2474 binds and inhibits, and the function of these host target genes, as elaborated hereinbelow.

Nucleotide sequences of the VGAM2474 precursor RNA, herein designated VGAM PRECURSOR RNA, and of the 'diced' VGAM2474 RNA, herein designated VGAM RNA, and a schematic representation of the secondary folding of VGAM2474 folded precursor RNA, herein designated VGAM FOLDED PRECURSOR RNA, of VGAM2474 are further described hereinbelow with reference to Table 1.

Nucleotide sequences of host target binding sites, such as BINDING SITE-I, BINDING SITE-II and BINDING SITE-III of FIG. 1, found on VGAM2474 host target RNA, and schematic representation of the complementarity of each of these host target binding sites to VGAM2474 RNA, herein designated VGAM RNA, are described hereinbelow with reference to Table 2.

As mentioned hereinabove with reference to FIG. 1, a function of VGAM2474 gene, herein designated VGAM is inhibition of expression of VGAM2474 target genes. It is appreciated that specific functions, and accordingly utilities, of VGAM2474 correlate with, and may be deduced from, the identity of the target genes which VGAM2474 binds and inhibits, and the function of these target genes, as elaborated hereinbelow.

KIAA0475 (Accession NM_014864) is a VGAM2474 host target gene. KIAA0475 BINDING SITE is HOST TARGET binding site found in the 5' untranslated region of mRNA encoded by KIAA0475, corresponding to a HOST TARGET binding site such as BINDING SITE I, BINDING SITE II or BINDING SITE III. Table 2 illustrates the complementarity of the nucleotide sequences of KIAA0475 BINDING SITE, designated SEQ ID:16945, to the nucleotide sequence of VGAM2474 RNA, herein designated VGAM RNA, also designated SEQ ID:5185.

A function of VGAM2474 is therefore inhibition of KIAA0475 (Accession NM_014864). Accordingly, utilities of VGAM2474 include diagnosis, prevention and treatment of diseases and clinical conditions associated with KIAA0475. LOC257482 (Accession XM_168544) is another VGAM2474 host target gene. LOC257482 BINDING SITE is HOST TARGET binding site found in the 3' untranslated region of mRNA encoded by LOC257482, corresponding to a HOST TARGET binding site such as BINDING SITE I, BINDING SITE II or BINDING SITE III. Table 2 illustrates the complementarity of the nucleotide sequences of LOC257482 BINDING SITE, designated SEQ ID:45234, to the nucleotide sequence of VGAM2474 RNA, herein designated VGAM RNA, also designated SEQ ID:5185.

Another function of VGAM2474 is therefore inhibition of LOC257482 (Accession XM_168544). Accordingly, utilities of VGAM2474 include diagnosis, prevention and treatment of diseases and clinical conditions associated with LOC257482. FIG. 1 further provides a conceptual description of a novel bioinformatically detected viral gene of the present invention, referred to here as Viral Genomic Address Messenger 2475 (VGAM2475) viral gene, which modulates expression of respective host target genes thereof, the function and utility of which host target genes is known in the art.

VGAM2475 is a novel bioinformatically detected regulatory, non protein coding, viral micro RNA (miRNA) gene. The method by which VGAM2475 was detected is described hereinabove with reference to FIGS. 1-8.

VGAM2475 gene, herein designated VGAM GENE, is a viral gene contained in the genome of Mouse Cytomegalovirus 1. VGAM2475 host target gene, herein designated VGAM HOST TARGET GENE, is a human gene contained in the human genome.

VGAM2475 gene encodes a VGAM2475 precursor RNA, herein designated VGAM PRECURSOR RNA. Similar to other miRNA genes, and unlike most ordinary genes, VGAM2475 precursor RNA does not encode a protein. A nucleotide sequence identical or highly similar to the nucleotide sequence of VGAM2475 precursor RNA is designated SEQ ID:2461, and is provided hereinbelow with reference to the sequence listing part. Nucleotide sequence SEQ ID:2461 is located at position 190173 relative to the genome of Mouse Cytomegalovirus 1.

VGAM2475 precursor RNA folds onto itself, forming VGAM2475 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2475 folded precursor RNA into VGAM2475 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2475 RNA is designated SEQ ID:5186, and is provided hereinbelow with reference to the sequence listing part.

VGAM2475 host target gene, herein designated VGAM HOST TARGET GENE, encodes a corresponding messenger RNA, VGAM2475 host target RNA, herein designated VGAM HOST TARGET RNA. VGAM2475 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2475 RNA, herein designated VGAM RNA, binds complementarily to one or more host target binding sites located in untranslated regions of VGAM2475 host target RNA, herein designated VGAM HOST TARGET RNA. This complementary binding is due to the fact that the nucleotide sequence of VGAM2475 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2475 RNA, herein designated VGAM RNA, may have a different number of host target binding sites in untranslated regions of a VGAM2475 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2475 RNA, herein designated VGAM RNA, to host target binding sites on VGAM2475 host target RNA, herein designated VGAM HOST TARGET RNA, such as BINDING SITE I, BINDING SITE II and BINDING SITE III, inhibits translation of VGAM2475 host target RNA into VGAM2475 host target protein, herein designated VGAM HOST TARGET PROTEIN. VGAM host target protein is therefore outlined by a broken line.

It is appreciated that VGAM2475 host target gene, herein designated VGAM HOST TARGET GENE, in fact represents a plurality of VGAM2475 host target genes. The mRNA of each one of this plurality of VGAM2475 host target genes comprises one or more host target binding sites, each having a nucleotide sequence which is at least partly complementary to VGAM2475 RNA, herein designated VGAM RNA, and which when bound by VGAM2475 RNA causes inhibition of translation of respective one or more VGAM2475 host target proteins.

It is further appreciated by one skilled in the art that the mode of translational inhibition illustrated by FIG. 1 with specific reference to translational inhibition exerted by VGAM2475 gene, herein designated VGAM GENE, on one or more VGAM2475 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2475 is inhibition of expression of host target genes, as part of a novel viral mechanism of attacking a host. Accordingly, utilities of VGAM2475 include diagnosis, prevention and treatment of viral infection by Mouse Cytomegalovirus 1. Specific functions, and accordingly utilities, of VGAM2475 correlate with, and may be deduced from, the identity of the host target genes which VGAM2475 binds and inhibits, and the function of these host target genes, as elaborated hereinbelow.

Nucleotide sequences of the VGAM2475 precursor RNA, herein designated VGAM PRECURSOR RNA, and of the 'diced' VGAM2475 RNA, herein designated VGAM RNA, and a schematic representation of the secondary folding of VGAM2475 folded precursor RNA, herein designated VGAM FOLDED PRECURSOR RNA, of VGAM2475 are further described hereinbelow with reference to Table 1.

Nucleotide sequences of host target binding sites, such as BINDING SITE-I, BINDING SITE-II and BINDING SITE-III of FIG. 1, found on VGAM2475 host target RNA, and schematic representation of the complementarity of each of these host target binding sites to VGAM2475 RNA, herein designated VGAM RNA, are described hereinbelow with reference to Table 2.

As mentioned hereinabove with reference to FIG. 1, a function of VGAM2475 gene, herein designated VGAM is inhibition of expression of VGAM2475 target genes. It is appreciated that specific functions, and accordingly utilities, of VGAM2475 correlate with, and may be deduced from, the identity of the target genes which VGAM2475 binds and inhibits, and the function of these target genes, as elaborated hereinbelow.

Adenylate Kinase 1 (AK1, Accession NM_000476) is a VGAM2475 host target gene. AK1 BINDING SITE is HOST TARGET binding site found in the 3' untranslated region of mRNA encoded by AK1, corresponding to a HOST TARGET binding site such as BINDING SITE I, BINDING SITE II or BINDING SITE III. Table 2 illustrates the complementarity of the nucleotide sequences of AK1 BINDING SITE, designated SEQ ID:6084, to the nucleotide sequence of VGAM2475 RNA, herein designated VGAM RNA, also designated SEQ ID:5186.

A function of VGAM2475 is therefore inhibition of Adenylate Kinase 1 (AK1, Accession NM_000476). Accordingly, utilities of VGAM2475 include diagnosis, prevention and treatment of diseases and clinical conditions associated with AK1. Cyclin-dependent Kinase 5, Regulatory Subunit 2 (p39) (CDK5R2, Accession NM_003936) is another VGAM2475 host target gene. CDK5R2 BINDING SITE is HOST TARGET binding site found in the 3' untranslated region of mRNA encoded by CDK5R2, corresponding to a HOST TARGET binding site such as BINDING SITE I, BINDING SITE II or BINDING SITE III. Table 2 illustrates the complementarity of the nucleotide sequences of CDK5R2 BINDING SITE, designated SEQ ID:10040, to the nucleotide sequence of VGAM2475 RNA, herein designated VGAM RNA, also designated SEQ ID:5186.

Another function of VGAM2475 is therefore inhibition of Cyclin-dependent Kinase 5, Regulatory Subunit 2 (p39) (CDK5R2, Accession NM_003936), a gene which acts as a regulatory subunit for the cyclin-dependent CDK5. Accordingly, utilities of VGAM2475 include diagnosis, prevention and treatment of diseases and clinical conditions associated with CDK5R2. The function of CDK5R2 and its association with various diseases and clinical conditions, has been established by previous studies, as described hereinabove with reference to VGAM403. Early Growth Response 2 (Krox-20 homolog, Drosophila) (EGR2, Accession NM_000399) is another VGAM2475 host target gene. EGR2 BINDING SITE is HOST TARGET binding site found in the 3' untranslated region of mRNA encoded by EGR2, corresponding to a HOST TARGET binding site such as BINDING SITE I, BINDING SITE II or BINDING SITE III. Table 2 illustrates the complementarity of the nucleotide sequences of EGR2 BINDING SITE, designated SEQ ID:5969, to the nucleotide sequence of VGAM2475 RNA, herein designated VGAM RNA, also designated SEQ ID:5186.

Another function of VGAM2475 is therefore inhibition of Early Growth Response 2 (Krox-20 homolog, Drosophila) (EGR2, Accession NM_000399), a gene which binds to two specific dna sites located in the promoter region of hox-1.4. Accordingly, utilities of VGAM2475 include diagnosis, prevention and treatment of diseases and clinical conditions associated with EGR2. The function of EGR2 and its association with various diseases and clinical conditions, has been established by previous studies, as described hereinabove with reference to VGAM234. Fragile X Mental Retardation, Autosomal Homolog 2 (FXR2, Accession NM_004860) is another VGAM2475 host target gene. FXR2 BINDING SITE is HOST TARGET binding site found in the 3' untranslated region of mRNA encoded by FXR2, corresponding to a HOST TARGET binding site such as BINDING SITE I, BINDING SITE II or BINDING SITE III. Table 2 illustrates the complementarity of the nucleotide sequences of FXR2 BINDING SITE, designated SEQ ID:11269, to the nucleotide sequence of VGAM2475 RNA, herein designated VGAM RNA, also designated SEQ ID:5186.

Another function of VGAM2475 is therefore inhibition of Fragile X Mental Retardation, Autosomal Homolog 2 (FXR2, Accession NM_004860), a gene which is a rna-binding protein. interacts with fmr1 and fxr1. Accordingly, utilities of VGAM2475 include diagnosis, prevention and treatment of diseases and clinical conditions associated with FXR2. The function of FXR2 has been established by previous studies. Fragile X mental retardation is directly associated with the FMR1 gene at Xq27.3 (OMIM Ref. No. 309550). FMR1 is an RNA-binding protein, and mutations in the gene are believed to result in the absence or reduced expression of the protein or a functionally impaired mutant protein. FMR1 protein and the fragile X-related proteins 1 and 2 (FXR1; 600819 and FXR2) form a family with functional similarities, such as RNA binding, polyribosomal association, and nucleocytoplasmic shuttling. Animal model experiments lend further support to the function of FXR2. Bontekoe et al. (2002) generated an Fxr2 knockout mouse model. No pathologic differences between knockout and wildtype mice were found in brain or testis; however, their behaviors were distinctive. Fxr2 knockout mice were hyperactive (i.e., traveled a greater distance, spent more time moving, and moved faster) in the open-field test, were impaired on the rotarod test, had reduced levels of prepulse inhibition, displayed less contextual conditioned fear, were impaired at locating the hidden platform in the Morris water task, and were less sensitive to a heat stimulus. The authors implicated a role for Fxr2 in central nervous system function.

It is appreciated that the abovementioned animal model for FXR2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Bontekoe, C. J. M.; McIlwain, K. L.; Nieuwenhuizen, I. M.; Yuva-Paylor, L. A.; Nellis, A.; Willemsen, R.; Fang, Z.; Kirkpatrick, L.; Bakker, C. E.; McAninch, R.; Cheng, N. C.; Merriweather, M.; Hoogeveen, A. T.; Nelson, D.; Paylor, R.; Oostra, B. A.: Knockout mouse model for Fxr2: a model for mental retardation. Hum. Molec. Genet. 11:487-498, 2002; and Tamanini, F.; Bontekoe, C.; Bakker, C. E.; van Unen, L.; Anar, B.; Willemsen, R.; Yoshida, M.; Galjaard, H.; Oostra, B. A.; Hoogeveen, A. T.: Different targets for the fragile X-relate.

Further studies establishing the function and utilities of FXR2 are found in John Hopkins OMIM database record ID 605339, and in sited publications numbered 2308, 7527-752 and 2309-2310 listed in the bibliography section hereinbelow, which are also hereby incorporated by reference. Integrin, Alpha 3 (antigen CD49C, alpha 3 subunit of VLA-3 receptor) (ITGA3, Accession NM_002204) is another VGAM2475 host target gene. ITGA3 BINDING SITE1 and ITGA3 BINDING SITE2 are HOST TARGET binding sites found in untranslated regions of mRNA encoded by ITGA3, corresponding to HOST TARGET binding sites such as BINDING SITE I, BINDING SITE II or BINDING SITE III. Table 2 illustrates the complementarity of the nucleotide sequences of ITGA3 BINDING SITE1 and ITGA3 BINDING SITE2, designated SEQ ID:7967 and SEQ ID:12010 respectively, to the nucleotide sequence of VGAM2475 RNA, herein designated VGAM RNA, also designated SEQ ID:5186.

Another function of VGAM2475 is therefore inhibition of Integrin, Alpha 3 (antigen CD49C, alpha 3 subunit of VLA-3 receptor) (ITGA3, Accession NM_002204), a gene which is a receptor for fibronectin, laminin, collagen, epiligrin and thrombospondin. Accordingly, utilities of VGAM2475 include diagnosis, prevention and treatment of diseases and clinical conditions associated with ITGA3. The function of ITGA3 and its association with various diseases and clinical conditions, has been established by previous studies, as described hereinabove with reference to VGAM1020. Nyctalopin (NYX, Accession NM_022567) is another VGAM2475 host target gene. NYX BINDING SITE is HOST TARGET binding site found in the 3' untranslated region of mRNA encoded by NYX, corresponding to a HOST TARGET binding site such as BINDING SITE I, BINDING SITE II or BINDING SITE III. Table 2 illustrates the complementarity of the nucleotide sequences of NYX BINDING SITE, designated SEQ ID:22886, to the nucleotide sequence of VGAM2475 RNA, herein designated VGAM RNA, also designated SEQ ID:5186.

Another function of VGAM2475 is therefore inhibition of Nyctalopin (NYX, Accession NM_022567), a gene which functions as the von willebrand factor receptor and mediates von willebrand factor-dependent platelet adhesion to blood vessels. the adhesion of platelets to injured vascular surfaces in the arterial circulation is a critical initiating event in hemostasis (by similarity). Accordingly, utilities of VGAM2475 include diagnosis, prevention and treatment of diseases and clinical conditions associated with NYX. The function of NYX and its association with various diseases and clinical conditions, has been established by previous studies, as described hereinabove with reference to VGAM206. Protein Kinase C and Casein Kinase Substrate In Neurons 1 (PACSIN1, Accession XM_166424) is another VGAM2475 host target gene. PACSIN1 BINDING SITE is HOST TARGET binding site found in the 3' untranslated region of mRNA encoded by PACSIN1, corresponding to a HOST TARGET binding site such as BINDING SITE I, BINDING SITE II or BINDING SITE III. Table 2 illustrates the complementarity of the nucleotide sequences of PACSIN1 BINDING SITE, designated SEQ ID:44311, to the nucleotide sequence of VGAM2475 RNA, herein designated VGAM RNA, also designated SEQ ID:5186.

Another function of VGAM2475 is therefore inhibition of Protein Kinase C and Casein Kinase Substrate In Neurons 1 (PACSIN1, Accession XM_166424). Accordingly, utilities of VGAM2475 include diagnosis, prevention and treatment of diseases and clinical conditions associated with PACSIN1. p21(CDKN1A)-activated Kinase 4 (PAK4, Accession NM_005884) is another VGAM2475 host target gene. PAK4 BINDING SITE is HOST TARGET binding site found in the 3' untranslated region of mRNA encoded by PAK4, corresponding to a HOST TARGET binding site such as BINDING SITE I, BINDING SITE II or BINDING SITE III. Table 2 illustrates the complementarity of the nucleotide sequences of PAK4 BINDING SITE, designated SEQ ID:12506, to the nucleotide sequence of VGAM2475 RNA, herein designated VGAM RNA, also designated SEQ ID:5186.

Another function of VGAM2475 is therefore inhibition of p21(CDKN1A)-activated Kinase 4 (PAK4, Accession NM_005884). Accordingly, utilities of VGAM2475 include diagnosis, prevention and treatment of diseases and clinical conditions associated with PAK4. Protein Phosphatase 2, Regulatory Subunit B (B56), Alpha Isoform (PPP2R5A, Accession NM_006243) is another VGAM2475 host target gene. PPP2R5A BINDING SITE is HOST TARGET binding site found in the 3' untranslated region of mRNA encoded by PPP2R5A, corresponding to a HOST TARGET binding site such as BINDING SITE I, BINDING SITE II or BINDING SITE III. Table 2 illustrates the complementarity of the nucleotide sequences of PPP2R5A BINDING SITE, designated SEQ ID:12911, to the nucleotide sequence of VGAM2475 RNA, herein designated VGAM RNA, also designated SEQ ID:5186.

Another function of VGAM2475 is therefore inhibition of Protein Phosphatase 2, Regulatory Subunit B (B56), Alpha Isoform (PPP2R5A, Accession NM_006243), a gene which is a regulatory subunit of protein phosphatase 2A. Accordingly, utilities of VGAM2475 include diagnosis, prevention and treatment of diseases and clinical conditions associated with PPP2R5A. The function of PPP2R5A and its association with various diseases and clinical conditions, has been established by previous studies, as described hereinabove with reference to VGAM675. Protein Kinase, CAMP-dependent, Catalytic, Alpha (PRKACA, Accession NM_002730) is another VGAM2475 host target gene. PRKACA BINDING SITE is HOST TARGET binding site found in the 3' untranslated region of mRNA encoded by PRKACA, corresponding to a HOST TARGET binding site such as BINDING SITE I, BINDING SITE II or BINDING SITE III. Table 2 illustrates the complementarity of the nucleotide sequences of PRKACA BINDING SITE, designated SEQ ID:8596, to the nucleotide sequence of VGAM2475 RNA, herein designated VGAM RNA, also designated SEQ ID:5186.

Another function of VGAM2475 is therefore inhibition of Protein Kinase, CAMP-dependent, Catalytic, Alpha (PRKACA, Accession NM_002730), a gene which phosphorylates target proteins on serine or threonine residues. Accordingly, utilities of VGAM2475 include diagnosis, prevention and treatment of diseases and clinical conditions associated with PRKACA. The function of PRKACA and its association with various diseases and clinical conditions, has been established by previous studies, as described hereinabove with reference to VGAM175. Runt-related Transcription Factor 3 (RUNX3, Accession NM_004350) is another VGAM2475 host target gene. RUNX3 BINDING SITE is HOST TARGET binding site found in the 3' untranslated region of mRNA encoded by RUNX3, corresponding to a HOST TARGET binding site such as BINDING SITE I, BINDING SITE II or BINDING SITE III. Table 2 illustrates the complementarity of the nucleotide sequences of RUNX3 BINDING SITE, designated SEQ ID:10547, to the nucleotide sequence of VGAM2475 RNA, herein designated VGAM RNA, also designated SEQ ID:5186.

Another function of VGAM2475 is therefore inhibition of Runt-related Transcription Factor 3 (RUNX3, Accession NM_004350), a gene which binds to the core site, 5'-pygpyggt-3', of a number of enhancers and promoters. Accordingly, utilities of VGAM2475 include diagnosis, prevention and treatment of diseases and clinical conditions associated with RUNX3. The function of RUNX3 and its association with various diseases and clinical conditions, has been established by previous studies, as described hereinabove with reference to VGAM1151. Secreted and Transmembrane 1 (SECTM1, Accession NM_003004) is another VGAM2475 host target gene. SECTM1 BINDING SITE is HOST TARGET binding site found in the 3' untranslated region of mRNA encoded by SECTM1, corresponding to a HOST TARGET binding site such as BINDING SITE I, BINDING SITE II or BINDING SITE III. Table 2 illustrates the complementarity of the nucleotide sequences of SECTM1 BINDING SITE, designated SEQ ID:8909, to the nucleotide sequence of VGAM2475 RNA, herein designated VGAM RNA, also designated SEQ ID:5186.

Another function of VGAM2475 is therefore inhibition of Secreted and Transmembrane 1 (SECTM1, Accession NM_003004). Accordingly, utilities of VGAM2475 include diagnosis, prevention and treatment of diseases and clinical conditions associated with SECTM1. SH3-domain GRB2-like 1 (SH3GL1, Accession NM_003025) is another VGAM2475 host target gene. SH3GL1 BINDING SITE is HOST TARGET binding site found in the 3' untranslated region of mRNA encoded by SH3GL1, corresponding to a HOST TARGET binding site such as BINDING SITE I, BINDING SITE II or BINDING SITE III. Table 2 illustrates the complementarity of the nucleotide sequences of SH3GL1 BINDING SITE, designated SEQ ID:8963, to the nucleotide sequence of VGAM2475 RNA, herein designated VGAM RNA, also designated SEQ ID:5186.

Another function of VGAM2475 is therefore inhibition of SH3-domain GRB2-like 1 (SH3GL1, Accession NM_003025). Accordingly, utilities of VGAM2475 include diagnosis, prevention and treatment of diseases and clinical conditions associated with SH3GL1. SORCS1 (Accession NM_052918) is another VGAM2475 host target gene. SORCS1 BINDING SITE is HOST TARGET binding site found in the 3' untranslated region of mRNA encoded by SORCS1, corresponding to a HOST TARGET binding site such as BINDING SITE I, BINDING SITE II or BINDING SITE III. Table 2 illustrates the complementarity of the nucleotide sequences of SORCS1 BINDING SITE, designated SEQ ID:27482, to the nucleotide sequence of VGAM2475 RNA, herein designated VGAM RNA, also designated SEQ ID:5186.

Another function of VGAM2475 is therefore inhibition of SORCS1 (Accession NM_052918). Accordingly, utilities of VGAM2475 include diagnosis, prevention and treatment of diseases and clinical conditions associated with SORCS1. SRY (sex determining region Y)-box 4 (SOX4, Accession NM_003107) is another VGAM2475 host target gene. SOX4 BINDING SITE is HOST TARGET binding site found in the 3' untranslated region of mRNA encoded by SOX4, corresponding to a HOST TARGET binding site such as BINDING SITE I, BINDING SITE II or BINDING SITE III. Table 2 illustrates the complementarity of the nucleotide sequences of SOX4 BINDING SITE, designated SEQ ID:9071, to the nucleotide sequence of VGAM2475 RNA, herein designated VGAM RNA, also designated SEQ ID:5186.

Another function of VGAM2475 is therefore inhibition of SRY (sex determining region Y)-box 4 (SOX4, Accession NM_003107), a gene which binds with high affinity to the t-cell enhancer motif 5'-aacaaag-3' motif. Accordingly, utilities of VGAM2475 include diagnosis, prevention and treatment of diseases and clinical conditions associated with SOX4. The function of SOX4 and its association with various diseases and clinical conditions, has been established by previous studies, as described hereinabove with reference to VGAM409. T-cell Acute Lymphocytic Leukemia 1 (TAL1, Accession NM_003189) is another VGAM2475 host target gene. TAL1 BINDING SITE is HOST TARGET binding site found in the 3' untranslated region of mRNA encoded by TAL1, corresponding to a HOST TARGET binding site such as BINDING SITE I, BINDING SITE II or BINDING SITE III. Table 2 illustrates the complementarity of the nucleotide sequences of TAL1 BINDING SITE, designated SEQ ID:9168, to the nucleotide sequence of VGAM2475 RNA, herein designated VGAM RNA, also designated SEQ ID:5186.

Another function of VGAM2475 is therefore inhibition of T-cell Acute Lymphocytic Leukemia 1 (TAL1, Accession NM_003189), a gene which may help control cell growth and differentiation. Accordingly, utilities of VGAM2475 include diagnosis, prevention and treatment of diseases and clinical conditions associated with TAL1. The function of TAL1 and its association with various diseases and clinical conditions, has been established by previous studies, as described hereinabove with reference to VGAM172. 20D7-FC4 (Accession XM_027578) is another VGAM2475 host target gene. 20D7-FC4 BINDING SITE is HOST TARGET binding site found in the 3' untranslated region of mRNA encoded by 20D7-FC4, corresponding to a HOST TARGET binding site such as BINDING SITE I, BINDING SITE II or BINDING SITE III. Table 2 illustrates the complementarity of the nucleotide sequences of 20D7-FC4 BINDING SITE, designated SEQ ID:30536, to the nucleotide sequence of VGAM2475 RNA, herein designated VGAM RNA, also designated SEQ ID:5186.

Another function of VGAM2475 is therefore inhibition of 20D7-FC4 (Accession XM_027578). Accordingly, utilities of VGAM2475 include diagnosis, prevention and treatment of diseases and clinical conditions associated with 20D7-FC4. Chromosome 5 Open Reading Frame 5 (C5orf5, Accession NM_016603) is another VGAM2475 host target gene. C5orf5 BINDING SITE is HOST TARGET binding site found in the 3' untranslated region of mRNA encoded by C5orf5, corresponding to a HOST TARGET binding site such as BINDING SITE I, BINDING SITE II or BINDING SITE III. Table 2 illustrates the complementarity of the nucleotide sequences of C5orf5 BINDING SITE, designated SEQ ID:18695, to the nucleotide sequence of VGAM2475 RNA, herein designated VGAM RNA, also designated SEQ ID:5186.

Another function of VGAM2475 is therefore inhibition of Chromosome 5 Open Reading Frame 5 (C5orf5, Accession NM_016603). Accordingly, utilities of VGAM2475 include diagnosis, prevention and treatment of diseases and clinical conditions associated with C5orf5. dJ309H15.1 (Accession NM_138574) is another VGAM2475 host target gene. dJ309H15.1 BINDING SITE is HOST TARGET binding site found in the 3' untranslated region of mRNA encoded by dJ309H15.1, corresponding to a HOST TARGET binding site such as BINDING SITE I, BINDING SITE II or BINDING SITE III. Table 2 illustrates the complementarity of the nucleotide sequences of dJ309H15.1 BINDING SITE, designated SEQ ID:28886, to the nucleotide sequence of VGAM2475 RNA, herein designated VGAM RNA, also designated SEQ ID:5186.

Another function of VGAM2475 is therefore inhibition of dJ309H15.1 (Accession NM_138574). Accordingly, utilities of VGAM2475 include diagnosis, prevention and treatment of diseases and clinical conditions associated with dJ309H15.1. DKFZP566K1924 (Accession XM_057469) is another VGAM2475 host target gene. DKFZP566K1924 BINDING SITE is HOST TARGET binding site found in the 5' untranslated region of mRNA encoded by DKFZP566K1924, corresponding to a HOST TARGET binding site such as BINDING SITE I, BINDING SITE II or BINDING SITE III. Table 2 illustrates the complementarity of the nucleotide sequences of DKFZP566K1924 BINDING SITE, designated SEQ ID:36518, to the nucleotide sequence of VGAM2475 RNA, herein designated VGAM RNA, also designated SEQ ID:5186.

Another function of VGAM2475 is therefore inhibition of DKFZP566K1924 (Accession XM_057469). Accordingly, utilities of VGAM2475 include diagnosis, prevention and treatment of diseases and clinical conditions associated with DKFZP566K1924. FLJ11767 (Accession NM_024593) is another VGAM2475 host target gene. FLJ11767 BINDING SITE is HOST TARGET binding site found in the 3' untranslated region of mRNA encoded by FLJ11767, corresponding to a HOST TARGET binding site such as BINDING SITE I, BINDING SITE II or BINDING SITE III. Table 2 illustrates the complementarity of the nucleotide sequences of FLJ11767 BINDING SITE, designated SEQ ID:23829, to the nucleotide sequence of VGAM2475 RNA, herein designated VGAM RNA, also designated SEQ ID:5186.

Another function of VGAM2475 is therefore inhibition of FLJ11767 (Accession NM_024593). Accordingly, utilities of VGAM2475 include diagnosis, prevention and treatment of diseases and clinical conditions associated with FLJ11767. FLJ14596 (Accession NM_032809) is another VGAM2475 host target gene. FLJ14596 BINDING SITE is HOST TARGET binding site found in the 3' untranslated region of mRNA encoded by FLJ14596, corresponding to a HOST TARGET binding site such as BINDING SITE I, BINDING SITE II or BINDING SITE III. Table 2 illustrates the complementarity of the nucleotide sequences of FLJ14596 BINDING SITE, designated SEQ ID:26570, to the nucleotide sequence of VGAM2475 RNA, herein designated VGAM RNA, also designated SEQ ID:5186.

Another function of VGAM2475 is therefore inhibition of FLJ14596 (Accession NM_032809). Accordingly, utilities of VGAM2475 include diagnosis, prevention and treatment of diseases and clinical conditions associated with FLJ14596. FLJ20375 (Accession NM_017794) is another VGAM2475 host target gene. FLJ20375 BINDING SITE is HOST TARGET binding site found in the 3' untranslated region of mRNA encoded by FLJ20375, corresponding to a HOST TARGET binding site such as BINDING SITE I, BINDING SITE II or BINDING SITE III. Table 2 illustrates the complementarity of the nucleotide sequences of FLJ20375 BINDING SITE, designated SEQ ID:19431, to the nucleotide sequence of VGAM2475 RNA, herein designated VGAM RNA, also designated SEQ ID:5186.

Another function of VGAM2475 is therefore inhibition of FLJ20375 (Accession NM_017794). Accordingly, utilities of VGAM2475 include diagnosis, prevention and treatment of diseases and clinical conditions associated with FLJ20375. KIAA0450 (Accession NM_014638) is another VGAM2475 host target gene. KIAA0450 BINDING SITE is HOST TARGET binding site found in the 5' untranslated region of mRNA encoded by KIAA0450, corresponding to a HOST TARGET binding site such as BINDING SITE I, BINDING SITE II or BINDING SITE III. Table 2 illustrates the complementarity of the nucleotide sequences of KIAA0450 BINDING SITE, designated SEQ ID:16026, to the nucleotide sequence of VGAM2475 RNA, herein designated VGAM RNA, also designated SEQ ID:5186.

Another function of VGAM2475 is therefore inhibition of KIAA0450 (Accession NM_014638). Accordingly, utilities of VGAM2475 include diagnosis, prevention and treatment of diseases and clinical conditions associated with KIAA0450. KIAA1030 (Accession XM_167789) is another VGAM2475 host target gene. KIAA1030 BINDING SITE is HOST TARGET binding site found in the 3' untranslated region of mRNA encoded by KIAA1030, corresponding to a HOST TARGET binding site such as BINDING SITE I, BINDING SITE II or BINDING SITE III. Table 2 illustrates the complementarity of the nucleotide sequences of KIAA1030 BINDING SITE, designated SEQ ID:44817, to the nucleotide sequence of VGAM2475 RNA, herein designated VGAM RNA, also designated SEQ ID:5186.

Another function of VGAM2475 is therefore inhibition of KIAA1030 (Accession XM_167789). Accordingly, utilities of VGAM2475 include diagnosis, prevention and treatment of diseases and clinical conditions associated with KIAA1030. KIAA1045 (Accession XM_048592) is another VGAM2475 host target gene. KIAA1045 BINDING SITE is HOST TARGET binding site found in the 3' untranslated region of mRNA encoded by KIAA1045, corresponding to a HOST TARGET binding site such as BINDING SITE I, BINDING SITE II or BINDING SITE III. Table 2 illustrates the complementarity of the nucleotide sequences of KIAA1045 BINDING SITE, designated SEQ ID:35191, to the nucleotide sequence of VGAM2475 RNA, herein designated VGAM RNA, also designated SEQ ID:5186.

Another function of VGAM2475 is therefore inhibition of KIAA1045 (Accession XM_048592). Accordingly, utilities of VGAM2475 include diagnosis, prevention and treatment of diseases and clinical conditions associated with KIAA1045. KIAA1536 (Accession NM_020898) is another VGAM2475 host target gene. KIAA1536 BINDING SITE is HOST TARGET binding site found in the 3' untranslated region of mRNA encoded by KIAA1536, corresponding to a HOST TARGET binding site such as BINDING SITE I, BINDING SITE II or BINDING SITE III. Table 2 illustrates the complementarity of the nucleotide sequences of KIAA1536 BINDING SITE, designated SEQ ID:21922, to the nucleotide sequence of VGAM2475 RNA, herein designated VGAM RNA, also designated SEQ ID:5186.

Another function of VGAM2475 is therefore inhibition of KIAA1536 (Accession NM_020898). Accordingly, utilities of VGAM2475 include diagnosis, prevention and treatment of diseases and clinical conditions associated with KIAA1536. KIAA1538 (Accession XM_049474) is another VGAM2475 host target gene. KIAA1538 BINDING SITE is HOST TARGET binding site found in the 5' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35419, to the nucleotide sequence of VGAM2475 RNA, herein designated VGAM RNA, also designated SEQ ID:5186.

Another function of VGAM2475 is therefore inhibition of KIAA1538 (Accession XM_049474). Accordingly, utilities of VGAM2475 include diagnosis, prevention and treatment of diseases and clinical conditions associated with KIAA1538. KIAA1600 (Accession XM_049351) is another VGAM2475 host target gene. KIAA1600 BINDING SITE is HOST TARGET binding site found in the 3' untranslated region of mRNA encoded by KIAA1600, corresponding to a HOST TARGET binding site such as BINDING SITE I, BINDING SITE II or BINDING SITE III. Table 2 illustrates the complementarity of the nucleotide sequences of KIAA1600 BINDING SITE, designated SEQ ID:35389, to the nucleotide sequence of VGAM2475 RNA, herein designated VGAM RNA, also designated SEQ ID:5186.

Another function of VGAM2475 is therefore inhibition of KIAA1600 (Accession XM_049351). Accordingly, utilities of VGAM2475 include diagnosis, prevention and treatment of diseases and clinical conditions associated with KIAA1600. KIAA1643 (Accession XM_035371) is another VGAM2475 host target gene. KIAA1643 BINDING SITE is HOST TARGET binding site found in the 3' untranslated region of mRNA encoded by KIAA1643, corresponding to a HOST TARGET binding site such as BINDING SITE I, BINDING SITE II or BINDING SITE III. Table 2 illustrates the complementarity of the nucleotide sequences of KIAA1643 BINDING SITE, designated SEQ ID:32239, to the nucleotide sequence of VGAM2475 RNA, herein designated VGAM RNA, also designated SEQ ID:5186.

Another function of VGAM2475 is therefore inhibition of KIAA1643 (Accession XM_035371). Accordingly, utilities of VGAM2475 include diagnosis, prevention and treatment of diseases and clinical conditions associated with KIAA1643. MOST2 (Accession NM_020250) is another VGAM2475 host target gene. MOST2 BINDING SITE is HOST TARGET binding site found in the 5' untranslated region of mRNA encoded by MOST2, corresponding to a HOST TARGET binding site such as BINDING SITE I, BINDING SITE II or BINDING SITE III. Table 2 illustrates the complementarity of the nucleotide sequences of MOST2 BINDING SITE, designated SEQ ID:21553, to the nucleotide sequence of VGAM2475 RNA, herein designated VGAM RNA, also designated SEQ ID:5186.

Another function of VGAM2475 is therefore inhibition of MOST2 (Accession NM_020250). Accordingly, utilities of VGAM2475 include diagnosis, prevention and treatment of diseases and clinical conditions associated with MOST2. Phytanoyl-CoA Hydroxylase Interacting Protein (PHYHIP, Accession NM_014759) is another VGAM2475 host target gene. PHYHIP BINDING SITE is HOST TARGET binding site found in the 3' untranslated region of mRNA encoded by PHYHIP, corresponding to a HOST TARGET binding site such as BINDING SITE I, BINDING SITE II or BINDING SITE III. Table 2 illustrates the complementarity of the nucleotide sequences of PHYHIP BINDING SITE, designated SEQ ID:16508, to the nucleotide sequence of VGAM2475 RNA, herein designated VGAM RNA, also designated SEQ ID:5186.

Another function of VGAM2475 is therefore inhibition of Phytanoyl-CoA Hydroxylase Interacting Protein (PHYHIP, Accession NM_014759). Accordingly, utilities of VGAM2475 include diagnosis, prevention and treatment of diseases and clinical conditions associated with PHYHIP. PR Domain Containing 8 (PRDM8, Accession NM_020226) is another VGAM2475 host target gene. PRDM8 BINDING SITE is HOST TARGET binding site found in the 5' untranslated region of mRNA encoded by PRDM8, corresponding to a HOST TARGET binding site such as BINDING SITE I, BINDING SITE II or BINDING SITE III. Table 2 illustrates the complementarity of the nucleotide sequences of PRDM8 BINDING SITE, designated SEQ ID:21491, to the nucleotide sequence of VGAM2475 RNA, herein designated VGAM RNA, also designated SEQ ID:5186.

Another function of VGAM2475 is therefore inhibition of PR Domain Containing 8 (PRDM8, Accession NM_020226). Accordingly, utilities of VGAM2475 include diagnosis, prevention and treatment of diseases and clinical conditions associated with PRDM8. SBB103 (Accession NM_005785) is another VGAM2475 host target gene. SBB103 BINDING SITE is HOST TARGET binding site found in the 3' untranslated region of mRNA encoded by SBB103, corresponding to a HOST TARGET binding site such as BINDING SITE I, BINDING SITE II or BINDING SITE III. Table 2 illustrates the complementarity of the nucleotide sequences of SBB103

BINDING SITE, designated SEQ ID:12364, to the nucleotide sequence of VGAM2475 RNA, herein designated VGAM RNA, also designated SEQ ID:5186.

Another function of VGAM2475 is therefore inhibition of SBB103 (Accession NM_005785). Accordingly, utilities of VGAM2475 include diagnosis, prevention and treatment of diseases and clinical conditions associated with SBB103. Stathmin-like 3 (STMN3, Accession NM_015894) is another VGAM2475 host target gene. STMN3 BINDING SITE is HOST TARGET binding site found in the 3' untranslated region of mRNA encoded by STMN3, corresponding to a HOST TARGET binding site such as BINDING SITE I, BINDING SITE II or BINDING SITE III. Table 2 illustrates the complementarity of the nucleotide sequences of STMN3 BINDING SITE, designated SEQ ID:18036, to the nucleotide sequence of VGAM2475 RNA, herein designated VGAM RNA, also designated SEQ ID:5186.

Another function of VGAM2475 is therefore inhibition of Stathmin-like 3 (STMN3, Accession NM_015894). Accordingly, utilities of VGAM2475 include diagnosis, prevention and treatment of diseases and clinical conditions associated with STMN3. Tigger Transposable Element Derived 1 (TIGD1, Accession XM_114293) is another VGAM2475 host target gene. TIGD1 BINDING SITE is HOST TARGET binding site found in the 5' untranslated region of mRNA encoded by TIGD1, corresponding to a HOST TARGET binding site such as BINDING SITE I, BINDING SITE II or BINDING SITE III. Table 2 illustrates the complementarity of the nucleotide sequences of TIGD1 BINDING SITE, designated SEQ ID:42846, to the nucleotide sequence of VGAM2475 RNA, herein designated VGAM RNA, also designated SEQ ID:5186.

Another function of VGAM2475 is therefore inhibition of Tigger Transposable Element Derived 1 (TIGD1, Accession XM_114293). Accordingly, utilities of VGAM2475 include diagnosis, prevention and treatment of diseases and clinical conditions associated with TIGD1. LOC143677 (Accession XM_096471) is another VGAM2475 host target gene. LOC143677 BINDING SITE is HOST TARGET binding site found in the 3' untranslated region of mRNA encoded by LOC143677, corresponding to a HOST TARGET binding site such as BINDING SITE I, BINDING SITE II or BINDING SITE III. Table 2 illustrates the complementarity of the nucleotide sequences of LOC143677 BINDING SITE, designated SEQ ID:40373, to the nucleotide sequence of VGAM2475 RNA, herein designated VGAM RNA, also designated SEQ ID:5186.

Another function of VGAM2475 is therefore inhibition of LOC143677 (Accession XM_096471). Accordingly, utilities of VGAM2475 include diagnosis, prevention and treatment of diseases and clinical conditions associated with LOC143677. LOC154222 (Accession XM_098497) is another VGAM2475 host target gene. LOC154222 BINDING SITE is HOST TARGET binding site found in the 3' untranslated region of mRNA encoded by LOC154222, corresponding to a HOST TARGET binding site such as BINDING SITE I, BINDING SITE II or BINDING SITE III. Table 2 illustrates the complementarity of the nucleotide sequences of LOC154222 BINDING SITE, designated SEQ ID:41690, to the nucleotide sequence of VGAM2475 RNA, herein designated VGAM RNA, also designated SEQ ID:5186.

Another function of VGAM2475 is therefore inhibition of LOC154222 (Accession XM_098497). Accordingly, utilities of VGAM2475 include diagnosis, prevention and treatment of diseases and clinical conditions associated with LOC154222. LOC159090 (Accession XM_088749) is another VGAM2475 host target gene. LOC159090 BINDING SITE is HOST TARGET binding site found in the 5' untranslated region of mRNA encoded by LOC159090, corresponding to a HOST TARGET binding site such as BINDING SITE I, BINDING SITE II or BINDING SITE III. Table 2 illustrates the complementarity of the nucleotide sequences of LOC159090 BINDING SITE, designated SEQ ID:39938, to the nucleotide sequence of VGAM2475 RNA, herein designated VGAM RNA, also designated SEQ ID:5186.

Another function of VGAM2475 is therefore inhibition of LOC159090 (Accession XM_088749). Accordingly, utilities of VGAM2475 include diagnosis, prevention and treatment of diseases and clinical conditions associated with LOC159090. LOC221100 (Accession XM_167753) is another VGAM2475 host target gene. LOC221100 BINDING SITE is HOST TARGET binding site found in the 5' untranslated region of mRNA encoded by LOC221100, corresponding to a HOST TARGET binding site such as BINDING SITE I, BINDING SITE II or BINDING SITE III. Table 2 illustrates the complementarity of the nucleotide sequences of LOC221100 BINDING SITE, designated SEQ ID:44776, to the nucleotide sequence of VGAM2475 RNA, herein designated VGAM RNA, also designated SEQ ID:5186.

Another function of VGAM2475 is therefore inhibition of LOC221100 (Accession XM_167753). Accordingly, utilities of VGAM2475 include diagnosis, prevention and treatment of diseases and clinical conditions associated with LOC221100. LOC221935 (Accession XM_166537) is another VGAM2475 host target gene. LOC221935 BINDING SITE is HOST TARGET binding site found in the 3' untranslated region of mRNA encoded by LOC221935, corresponding to a HOST TARGET binding site such as BINDING SITE I, BINDING SITE II or BINDING SITE III. Table 2 illustrates the complementarity of the nucleotide sequences of LOC221935 BINDING SITE, designated SEQ ID:44498, to the nucleotide sequence of VGAM2475 RNA, herein designated VGAM RNA, also designated SEQ ID:5186.

Another function of VGAM2475 is therefore inhibition of LOC221935 (Accession XM_166537). Accordingly, utilities of VGAM2475 include diagnosis, prevention and treatment of diseases and clinical conditions associated with LOC221935. LOC256942 (Accession XM_170544) is another VGAM2475 host target gene. LOC256942 BINDING SITE is HOST TARGET binding site found in the 3' untranslated region of mRNA encoded by LOC256942, corresponding to a HOST TARGET binding site such as BINDING SITE I, BINDING SITE II or BINDING SITE III. Table 2 illustrates the complementarity of the nucleotide sequences of LOC256942 BINDING SITE, designated SEQ ID:45363, to the nucleotide sequence of VGAM2475 RNA, herein designated VGAM RNA, also designated SEQ ID:5186.

Another function of VGAM2475 is therefore inhibition of LOC256942 (Accession XM_170544). Accordingly, utilities of VGAM2475 include diagnosis, prevention and treatment of diseases and clinical conditions associated with LOC256942. LOC91397 (Accession XM_038219) is another VGAM2475 host target gene. LOC91397 BINDING SITE is HOST TARGET binding site found in the 5' untranslated region of mRNA encoded by LOC91397, corresponding to a HOST TARGET binding site such as BINDING SITE I, BINDING SITE II or BINDING SITE III. Table 2 illustrates the complementarity of the nucleotide sequences of LOC91397 BINDING SITE, designated SEQ ID:32779, to the nucleotide sequence of VGAM2475 RNA, herein designated VGAM RNA, also designated SEQ ID:5186.

Another function of VGAM2475 is therefore inhibition of LOC91397 (Accession XM_038219). Accordingly, utilities of VGAM2475 include diagnosis, prevention and treatment of diseases and clinical conditions associated with LOC91397. FIG. 1 further provides a conceptual description of a novel bioinformatically detected viral gene of the present invention, referred to here as Viral Genomic Address Messenger 2476 (VGAM2476) viral gene, which modulates expression of respective host target genes thereof, the function and utility of which host target genes is known in the art.

VGAM2476 is a novel bioinformatically detected regulatory, non protein coding, viral micro RNA (miRNA) gene. The method by which VGAM2476 was detected is described hereinabove with reference to FIGS. 1-8.

VGAM2476 gene, herein designated VGAM GENE, is a viral gene contained in the genome of Mouse Cytomegalovirus 1. VGAM2476 host target gene, herein designated VGAM HOST TARGET GENE, is a human gene contained in the human genome.

VGAM2476 gene encodes a VGAM2476 precursor RNA, herein designated VGAM PRECURSOR RNA. Similar to other miRNA genes, and unlike most ordinary genes, VGAM2476 precursor RNA does not encode a protein. A nucleotide sequence identical or highly similar to the nucleotide sequence of VGAM2476 precursor RNA is designated SEQ ID:2462, and is provided hereinbelow with reference to the sequence listing part. Nucleotide sequence SEQ ID:2462 is located at position 136488 relative to the genome of Mouse Cytomegalovirus 1.

VGAM2476 precursor RNA folds onto itself, forming VGAM2476 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2476 folded precursor RNA into VGAM2476 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2476 RNA is designated SEQ ID:5187, and is provided hereinbelow with reference to the sequence listing part.

VGAM2476 host target gene, herein designated VGAM HOST TARGET GENE, encodes a corresponding messenger RNA, VGAM2476 host target RNA, herein designated VGAM HOST TARGET RNA. VGAM2476 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2476 RNA, herein designated VGAM RNA, binds complementarily to one or more host target binding sites located in untranslated regions of VGAM2476 host target RNA, herein designated VGAM HOST TARGET RNA. This complementary binding is due to the fact that the nucleotide sequence of VGAM2476 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2476 RNA, herein designated VGAM RNA, may have a different number of host target binding sites in untranslated regions of a VGAM2476 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2476 RNA, herein designated VGAM RNA, to host target binding sites on VGAM2476 host target RNA, herein designated VGAM HOST TARGET RNA, such as BINDING SITE I, BINDING SITE II and BINDING SITE III, inhibits translation of VGAM2476 host target RNA into VGAM2476 host target protein, herein designated VGAM HOST TARGET PROTEIN. VGAM host target protein is therefore outlined by a broken line.

It is appreciated that VGAM2476 host target gene, herein designated VGAM HOST TARGET GENE, in fact represents a plurality of VGAM2476 host target genes. The mRNA of each one of this plurality of VGAM2476 host target genes comprises one or more host target binding sites, each having a nucleotide sequence which is at least partly complementary to VGAM2476 RNA, herein designated VGAM RNA, and which when bound by VGAM2476 RNA causes inhibition of translation of respective one or more VGAM2476 host target proteins.

It is further appreciated by one skilled in the art that the mode of translational inhibition illustrated by FIG. 1 with specific reference to translational inhibition exerted by VGAM2476 gene, herein designated VGAM GENE, on one or more VGAM2476 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2476 is inhibition of expression of host target genes, as part of a novel viral mechanism of attacking a host. Accordingly, utilities of VGAM2476 include diagnosis, prevention and treatment of viral infection by Mouse Cytomegalovirus 1. Specific functions, and accordingly utilities, of VGAM2476 correlate with, and may be deduced from, the identity of the host target genes which VGAM2476 binds and inhibits, and the function of these host target genes, as elaborated hereinbelow.

Nucleotide sequences of the VGAM2476 precursor RNA, herein designated VGAM PRECURSOR RNA, and of the 'diced' VGAM2476 RNA, herein designated VGAM RNA, and a schematic representation of the secondary folding of VGAM2476 folded precursor RNA, herein designated VGAM FOLDED PRECURSOR RNA, of VGAM2476 are further described hereinbelow with reference to Table 1.

Nucleotide sequences of host target binding sites, such as BINDING SITE-I, BINDING SITE-II and BINDING SITE-III of FIG. 1, found on VGAM2476 host target RNA, and schematic representation of the complementarity of each of these host target binding sites to VGAM2476 RNA, herein designated VGAM RNA, are described hereinbelow with reference to Table 2.

As mentioned hereinabove with reference to FIG. 1, a function of VGAM2476 gene, herein designated VGAM is inhibition of expression of VGAM2476 target genes. It is appreciated that specific functions, and accordingly utilities, of VGAM2476 correlate with, and may be deduced from, the identity of the target genes which VGAM2476 binds and inhibits, and the function of these target genes, as elaborated hereinbelow.

Paired-like Homeodomain Transcription Factor 2 (PITX2, Accession NM_000325) is a VGAM2476 host target gene. PITX2 BINDING SITE is HOST TARGET binding site found in the 5' untranslated region of mRNA encoded by PITX2, corresponding to a HOST TARGET binding site such as BINDING SITE I, BINDING SITE II or BINDING SITE III. Table 2 illustrates the complementarity of the nucleotide sequences of PITX2 BINDING SITE, designated SEQ ID:5867, to the nucleotide sequence of VGAM2476 RNA, herein designated VGAM RNA, also designated SEQ ID:5187.

A function of VGAM2476 is therefore inhibition of Paired-like Homeodomain Transcription Factor 2 (PITX2, Accession NM_000325). Accordingly, utilities of VGAM2476 include diagnosis, prevention and treatment of diseases and clinical conditions associated with PITX2. Fer-1-like 4 (C. elegans) (FER1L4, Accession NM_025206) is another VGAM2476 host target gene. FER1L4 BINDING SITE is HOST TARGET binding site found in the 3' untranslated region of mRNA encoded by FER1L4, corresponding to a HOST TARGET binding site such as BINDING SITE I, BINDING SITE II or BINDING SITE III. Table 2 illustrates the complementarity of the nucleotide sequences of FER1L4 BINDING SITE, designated SEQ ID:24874, to the nucleotide sequence of VGAM2476 RNA, herein designated VGAM RNA, also designated SEQ ID:5187.

Another function of VGAM2476 is therefore inhibition of Fer-1-like 4 (C. elegans) (FER1L4, Accession NM_025206). Accordingly, utilities of VGAM2476 include diagnosis, prevention and treatment of diseases and clinical conditions associated with FER1L4. KIAA0876 (Accession XM_035625) is another VGAM2476 host target gene. KIAA0876 BINDING SITE is HOST TARGET binding site found in the 3' untranslated region of mRNA encoded by KIAA0876, corresponding to a HOST TARGET binding site such as BINDING SITE I, BINDING SITE II or BINDING SITE III. Table 2 illustrates the complementarity of the nucleotide sequences of KIAA0876 BINDING SITE, designated SEQ ID:32297, to the nucleotide sequence of VGAM2476 RNA, herein designated VGAM RNA, also designated SEQ ID:5187.

Another function of VGAM2476 is therefore inhibition of KIAA0876 (Accession XM_035625). Accordingly, utilities of VGAM2476 include diagnosis, prevention and treatment of diseases and clinical conditions associated with KIAA0876. KIAA1608 (Accession NM_024820) is another VGAM2476 host target gene. KIAA1608 BINDING SITE is HOST TARGET binding site found in the 5' untranslated region of mRNA encoded by KIAA1608, corresponding to a HOST TARGET binding site such as BINDING SITE I, BINDING SITE II or BINDING SITE III. Table 2 illustrates the complementarity of the nucleotide sequences of KIAA1608 BINDING SITE, designated SEQ ID:24210, to the nucleotide sequence of VGAM2476 RNA, herein designated VGAM RNA, also designated SEQ ID:5187.

Another function of VGAM2476 is therefore inhibition of KIAA1608 (Accession NM_024820). Accordingly, utilities of VGAM2476 include diagnosis, prevention and treatment of diseases and clinical conditions associated with KIAA1608. LOC151124 (Accession XM_098006) is another VGAM2476 host target gene. LOC151124 BINDING SITE is HOST TARGET binding site found in the 5' untranslated region of mRNA encoded by LOC151124, corresponding to a HOST TARGET binding site such as BINDING SITE I, BINDING SITE II or BINDING SITE III. Table 2 illustrates the complementarity of the nucleotide sequences of LOC151124 BINDING SITE, designated SEQ ID:41302, to the nucleotide sequence of VGAM2476 RNA, herein designated VGAM RNA, also designated SEQ ID:5187.

Another function of VGAM2476 is therefore inhibition of LOC151124 (Accession XM_098006). Accordingly, utilities of VGAM2476 include diagnosis, prevention and treatment of diseases and clinical conditions associated with LOC151124. FIG. 1 further provides a conceptual description of a novel bioinformatically detected viral gene of the present invention, referred to here as Viral Genomic Address Messenger 2477 (VGAM2477) viral gene, which modulates expression of respective host target genes thereof, the function and utility of which host target genes is known in the art.

VGAM2477 is a novel bioinformatically detected regulatory, non protein coding, viral micro RNA (miRNA) gene. The method by which VGAM2477 was detected is described hereinabove with reference to FIGS. 1-8.

VGAM2477 gene, herein designated VGAM GENE, is a viral gene contained in the genome of Mouse Cytomegalovirus 1. VGAM2477 host target gene, herein designated VGAM HOST TARGET GENE, is a human gene contained in the human genome.

VGAM2477 gene encodes a VGAM2477 precursor RNA, herein designated VGAM PRECURSOR RNA. Similar to other miRNA genes, and unlike most ordinary genes, VGAM2477 precursor RNA does not encode a protein. A nucleotide sequence identical or highly similar to the nucleotide sequence of VGAM2477 precursor RNA is designated SEQ ID:2463, and is provided hereinbelow with reference to the sequence listing part. Nucleotide sequence SEQ ID:2463 is located at position 205607 relative to the genome of Mouse Cytomegalovirus 1.

VGAM2477 precursor RNA folds onto itself, forming VGAM2477 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2477 folded precursor RNA into VGAM2477 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2477 RNA is designated SEQ ID:5188, and is provided hereinbelow with reference to the sequence listing part.

VGAM2477 host target gene, herein designated VGAM HOST TARGET GENE, encodes a corresponding messenger RNA, VGAM2477 host target RNA, herein designated VGAM HOST TARGET RNA. VGAM2477 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2477 RNA, herein designated VGAM RNA, binds complementarily to one or more host target binding sites located in untranslated regions of VGAM2477 host target RNA, herein designated VGAM HOST TARGET RNA. This complementary binding is due to the fact that the nucleotide sequence of VGAM2477 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2477 RNA, herein designated VGAM RNA, may have a different number of host target binding sites in untranslated regions of a VGAM2477 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2477 RNA, herein designated VGAM RNA, to host target binding sites on VGAM2477 host target RNA, herein designated VGAM HOST TARGET RNA, such as BINDING SITE I, BINDING SITE II and BINDING SITE III, inhibits translation of VGAM2477 host target RNA into VGAM2477 host target protein, herein designated VGAM HOST TARGET PROTEIN. VGAM host target protein is therefore outlined by a broken line.

It is appreciated that VGAM2477 host target gene, herein designated VGAM HOST TARGET GENE, in fact represents a plurality of VGAM2477 host target genes. The mRNA of each one of this plurality of VGAM2477 host target genes comprises one or more host target binding sites, each having a nucleotide sequence which is at least partly complementary to VGAM2477 RNA, herein designated VGAM RNA, and which when bound by VGAM2477 RNA causes inhibition of translation of respective one or more VGAM2477 host target proteins.

It is further appreciated by one skilled in the art that the mode of translational inhibition illustrated by FIG. 1 with specific reference to translational inhibition exerted by VGAM2477 gene, herein designated VGAM GENE, on one or more VGAM2477 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2477 is inhibition of expression of host target genes, as part of a novel viral mechanism of attacking a host. Accordingly, utilities of VGAM2477 include diagnosis, prevention and treatment of viral infection by Mouse Cytomegalovirus 1. Specific functions, and accordingly utilities, of VGAM2477 correlate with, and may be deduced from, the identity of the host target genes which VGAM2477 binds and inhibits, and the function of these host target genes, as elaborated hereinbelow.

Nucleotide sequences of the VGAM2477 precursor RNA, herein designated VGAM PRECURSOR RNA, and of the 'diced' VGAM2477 RNA, herein designated VGAM RNA, and a schematic representation of the secondary folding of VGAM2477 folded precursor RNA, herein designated VGAM FOLDED PRECURSOR RNA, of VGAM2477 are further described hereinbelow with reference to Table 1.

Nucleotide sequences of host target binding sites, such as BINDING SITE-I, BINDING SITE-II and BINDING SITE-III of FIG. 1, found on VGAM2477 host target RNA, and schematic representation of the complementarity of each of these host target binding sites to VGAM2477 RNA, herein designated VGAM RNA, are described hereinbelow with reference to Table 2.

As mentioned hereinabove with reference to FIG. 1, a function of VGAM2477 gene, herein designated VGAM is inhibition of expression of VGAM2477 target genes. It is appreciated that specific functions, and accordingly utilities, of VGAM2477 correlate with, and may be deduced from, the identity of the target genes which VGAM2477 binds and inhibits, and the function of these target genes, as elaborated hereinbelow.

Inositol Polyphosphate Phosphatase-like 1 (INPPL1, Accession NM_001567) is a VGAM2477 host target gene. INPPL1 BINDING SITE is HOST TARGET binding site found in the 3' untranslated region of mRNA encoded by INPPL1, corresponding to a HOST TARGET binding site such as BINDING SITE I, BINDING SITE II or BINDING SITE III. Table 2 illustrates the complementarity of the nucleotide sequences of INPPL1 BINDING SITE, designated SEQ ID:7296, to the nucleotide sequence of VGAM2477 RNA, herein designated VGAM RNA, also designated SEQ ID:5188.

A function of VGAM2477 is therefore inhibition of Inositol Polyphosphate Phosphatase-like 1 (INPPL1, Accession NM_001567), a gene which hydrolyzes Ins (1,3,4,5)P4 and PtdIns (3,4,5)P3; contains an SH2-domain. Accordingly, utilities of VGAM2477 include diagnosis, prevention and treatment of diseases and clinical conditions associated with INPPL1. The function of INPPL1 has been established by previous studies. Habib et al. (1998) raised antibodies against SHIP2 to examine the effects of growth factors and insulin (OMIM Ref. No. 176730) on the metabolism of this protein. Immunoblot analysis revealed that SHIP2 was widely expressed in fibroblast and nonhematopoietic tumor cell lines, unlike the SHIP protein (OMIM Ref. No. 601582), which was found only in cell lines of hematopoietic origin. The SHIP2 antiserum precipitated a protein of approximately 145 kD, along with an activity which hydrolyzed phosphatidylinositol 3,4,5-triphosphate to phosphatidylinositol 3,4-bisphosphate. Tyrosine phosphorylation of SHIP2 occurred in response to treatment of cells with EGF, platelet-derived growth factor (PDGF; OMIM Ref. No. 190040), nerve growth factor (NGF; 162030), insulin-like growth factor-1 (IGF1; 147440), or insulin. EGF and PDGF induced transient tyrosine phosphorylation of SHIP2, while treatment of cells with NGF, IGF1, or insulin resulted in prolonged tyrosine phosphorylation of SHIP2. Habib et al. (1998) concluded that their data suggests that SHIP2 may play a significant role in regulation of phosphatidylinositol 3-prime-kinase signaling by growth factors and insulin. By PCR using primers from the INPPL1 cDNA sequence, Hejna et al. (1995) screened an NIGMS human/rodent somatic cell hybrid mapping panel and assigned the INPPL1 gene to chromosome 11. They narrowed the localization to 11q23 using a chromosome 11-specific deletion panel Animal model experiments lend further support to the function of INPPL1. Clement et al. (2001) generated mice lacking the Ship2 gene. Loss of Ship2 led to increased sensitivity to insulin, which was characterized by severe neonatal hypoglycemia, deregulated expression of the genes involved in gluconeogenesis, and perinatal death. Adult mice that were heterozygous for the Ship2 mutation had increased glucose tolerance and insulin sensitivity associated with an increased recruitment of the GLUT4 glucose transporter (OMIM Ref. No. 138190) and increased glycogen synthesis in skeletal muscles. Clement et al. (2001) suggested that the results show that SHIP2 is a potent negative regulator of insulin signaling and insulin sensitivity in vivo.

It is appreciated that the abovementioned animal model for INPPL1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Habib, T.; Hejna, J. A.; Moses, R. E.; Decker, S. J.: Growth factors and insulin stimulate tyrosine phosphorylation of the 51C/SHIP2 protein. J. Biol. Chem. 273:18605-18609, 1998; and Clement, S.; Krause, U.; Desmedt, F.; Tanti, J.-F.; Behrends, J.; Pesesse, X.; Sasaki, T.; Penninger, J.; Doherty, M.; Malaisse, W.; Dumont, J. E.; Le Marchand-Brustel, Y.; Erneux, C.; H.

Further studies establishing the function and utilities of INPPL1 are found in John Hopkins OMIM database record ID 600829, and in sited publications numbered 7783-7787 listed in the bibliography section hereinbelow, which are also hereby incorporated by reference. Jerky Homolog-like (mouse) (JRKL, Accession NM_003772) is another VGAM2477 host target gene. JRKL BINDING SITE is HOST TARGET binding site found in the 3' untranslated region of mRNA encoded by JRKL, corresponding to a HOST TARGET binding site such as BINDING SITE I, BINDING SITE II or BINDING SITE III. Table 2 illustrates the complementarity of the nucleotide sequences of JRKL BINDING SITE, designated SEQ ID:9856, to the nucleotide sequence of VGAM2477 RNA, herein designated VGAM RNA, also designated SEQ ID:5188.

Another function of VGAM2477 is therefore inhibition of Jerky Homolog-like (mouse) (JRKL, Accession NM_003772), a gene which is a Jerky-related protein and similar to centromere binding protein-B and other nuclear regulators. Accordingly, utilities of VGAM2477 include diagnosis, prevention and treatment of diseases and clinical conditions associated with JRKL. The function of JRKL and its association with various diseases and clinical conditions, has been established by previous studies, as described hereinabove with reference to VGAM1546. Neurexin 2 (NRXN2, Accession NM_015080) is another VGAM2477 host target gene. NRXN2 BINDING SITE1 through NRXN2 BINDING SITE3 are HOST TARGET binding sites found in untranslated regions of mRNA encoded by NRXN2, corresponding to HOST TARGET binding sites such as BINDING SITE I, BINDING SITE II or BINDING SITE III. Table 2 illustrates the complementarity of the nucleotide sequences of NRXN2 BINDING SITE1 through NRXN2 BINDING SITE3, designated SEQ ID:17470, SEQ ID:28986 and SEQ ID:28991 respectively, to the nucleotide sequence of VGAM2477 RNA, herein designated VGAM RNA, also designated SEQ ID:5188.

Another function of VGAM2477 is therefore inhibition of Neurexin 2 (NRXN2, Accession NM_015080), a gene which may be involved in cell recognition, cell adhesion, and may mediate intracellular signaling. Accordingly, utilities of VGAM2477 include diagnosis, prevention and treatment of diseases and clinical conditions associated with NRXN2. The function of NRXN2 and its association with various diseases and clinical conditions, has been established by previous studies, as described hereinabove with reference to VGAM178. UC28 (Accession NM_021635) is another VGAM2477 host target gene. UC28 BINDING SITE is HOST TARGET binding site found in the 3' untranslated region of mRNA encoded by UC28, corresponding to a HOST TARGET binding site such as BINDING SITE I, BINDING SITE II or BINDING SITE III. Table 2 illustrates the complementarity of the nucleotide sequences of UC28 BINDING SITE, designated SEQ ID:22280, to the nucleotide sequence of VGAM2477 RNA, herein designated VGAM RNA, also designated SEQ ID:5188.

Another function of VGAM2477 is therefore inhibition of UC28 (Accession NM_021635). Accordingly, utilities of VGAM2477 include diagnosis, prevention and treatment of diseases and clinical conditions associated with UC28. Chromosome 9 Open Reading Frame 5 (C9orf5, Accession NM_032012) is another VGAM2477 host target gene. C9orf5 BINDING SITE is HOST TARGET binding site found in the 3' untranslated region of mRNA encoded by C9orf5, corresponding to a HOST TARGET binding site such as BINDING SITE I, BINDING SITE II or BINDING SITE III. Table 2 illustrates the complementarity of the nucleotide sequences of C9orf5 BINDING SITE, designated SEQ ID:25716, to the nucleotide sequence of VGAM2477 RNA, herein designated VGAM RNA, also designated SEQ ID:5188.

Another function of VGAM2477 is therefore inhibition of Chromosome 9 Open Reading Frame 5 (C9orf5, Accession NM_032012). Accordingly, utilities of VGAM2477 include diagnosis, prevention and treatment of diseases and clinical conditions associated with C9orf5. FLJ12542 (Accession NM_024899) is another VGAM2477 host target gene. FLJ12542 BINDING SITE is HOST TARGET binding site found in the 3' untranslated region of mRNA encoded by FLJ12542, corresponding to a HOST TARGET binding site such as BINDING SITE I, BINDING SITE II or BINDING SITE III. Table 2 illustrates the complementarity of the nucleotide sequences of FLJ12542 BINDING SITE, designated SEQ ID:24383, to the nucleotide sequence of VGAM2477 RNA, herein designated VGAM RNA, also designated SEQ ID:5188.

Another function of VGAM2477 is therefore inhibition of FLJ12542 (Accession NM_024899). Accordingly, utilities of VGAM2477 include diagnosis, prevention and treatment of diseases and clinical conditions associated with FLJ12542. Golgi Phosphoprotein 2 (GOLPH2, Accession NM_016548) is another VGAM2477 host target gene. GOLPH2 BINDING SITE is HOST TARGET binding site found in the 3' untranslated region of mRNA encoded by GOLPH2, corresponding to a HOST TARGET binding site such as BINDING SITE I, BINDING SITE II or BINDING SITE III. Table 2 illustrates the complementarity of the nucleotide sequences of GOLPH2 BINDING SITE, designated SEQ ID:18625, to the nucleotide sequence of VGAM2477 RNA, herein designated VGAM RNA, also designated SEQ ID:5188.

Another function of VGAM2477 is therefore inhibition of Golgi Phosphoprotein 2 (GOLPH2, Accession NM_016548). Accordingly, utilities of VGAM2477 include diagnosis, prevention and treatment of diseases and clinical conditions associated with GOLPH2. HTEX4 (Accession XM_175165) is another VGAM2477 host target gene. HTEX4 BINDING SITE1 through HTEX4 BINDING SITE3 are HOST TARGET binding sites found in untranslated regions of mRNA encoded by HTEX4, corresponding to HOST TARGET binding sites such as BINDING SITE I, BINDING SITE II or BINDING SITE III. Table 2 illustrates the complementarity of the nucleotide sequences of HTEX4 BINDING SITE1 through HTEX4 BINDING SITE3, designated SEQ ID:46653, SEQ ID:46722 and SEQ ID:44217 respectively, to the nucleotide sequence of VGAM2477 RNA, herein designated VGAM RNA, also designated SEQ ID:5188.

Another function of VGAM2477 is therefore inhibition of HTEX4 (Accession XM_175165). Accordingly, utilities of VGAM2477 include diagnosis, prevention and treatment of diseases and clinical conditions associated with HTEX4. KIAA0557 (Accession XM_085507) is another VGAM2477 host target gene. KIAA0557 BINDING SITE is HOST TARGET binding site found in the 3' untranslated region of mRNA encoded by KIAA0557, corresponding to a HOST TARGET binding site such as BINDING SITE I, BINDING SITE II or BINDING SITE III. Table 2 illustrates the complementarity of the nucleotide sequences of KIAA0557 BINDING SITE, designated SEQ ID:38209, to the nucleotide sequence of VGAM2477 RNA, herein designated VGAM RNA, also designated SEQ ID:5188.

Another function of VGAM2477 is therefore inhibition of KIAA0557 (Accession XM_085507). Accordingly, utilities of VGAM2477 include diagnosis, prevention and treatment of diseases and clinical conditions associated with KIAA0557. KIAA0783 (Accession NM_014660) is another VGAM2477 host target gene. KIAA0783 BINDING SITE is HOST TARGET binding site found in the 3' untranslated region of mRNA encoded by KIAA0783, corresponding to a HOST TARGET binding site such as BINDING SITE I, BINDING SITE II or BINDING SITE III. Table 2 illustrates the complementarity of the nucleotide sequences of KIAA0783 BINDING SITE, designated SEQ ID:16105, to the nucleotide sequence of VGAM2477 RNA, herein designated VGAM RNA, also designated SEQ ID:5188.

Another function of VGAM2477 is therefore inhibition of KIAA0783 (Accession NM_014660). Accordingly, utilities of VGAM2477 include diagnosis, prevention and treatment of diseases and clinical conditions associated with KIAA0783. KIAA1143 (Accession XM_044014) is another VGAM2477 host target gene. KIAA1143 BINDING SITE is HOST TARGET binding site found in the 3' untranslated region of mRNA encoded by KIAA1143, corresponding to a HOST TARGET binding site such as BINDING SITE I, BINDING SITE II or BINDING SITE III. Table 2 illustrates the complementarity of the nucleotide sequences of KIAA1143 BINDING SITE, designated SEQ ID:34076, to the nucleotide sequence of VGAM2477 RNA, herein designated VGAM RNA, also designated SEQ ID:5188.

Another function of VGAM2477 is therefore inhibition of KIAA1143 (Accession XM_044014). Accordingly, utilities of VGAM2477 include diagnosis, prevention and treatment of diseases and clinical conditions associated with KIAA1143. KIAA1432 (Accession XM_039698) is another VGAM2477 host target gene. KIAA1432 BINDING SITE is HOST TARGET binding site found in the 5' untranslated region of mRNA encoded by KIAA1432, corresponding to a HOST TARGET binding site such as BINDING SITE I, BINDING SITE II or BINDING SITE III. Table 2 illustrates the complementarity of the nucleotide sequences of KIAA1432 BINDING SITE, designated SEQ ID:33152, to the nucleotide sequence of VGAM2477 RNA, herein designated VGAM RNA, also designated SEQ ID:5188.

Another function of VGAM2477 is therefore inhibition of KIAA1432 (Accession XM_039698). Accordingly, utilities of VGAM2477 include diagnosis, prevention and treatment of diseases and clinical conditions associated with KIAA1432. Protocadherin 20 (PCDH20, Accession NM_022843) is another VGAM2477 host target gene. PCDH20 BINDING SITE is HOST TARGET binding site found in the 3' untranslated region of mRNA encoded by PCDH20, corresponding to a HOST TARGET binding site such as BINDING SITE I, BINDING SITE II or BINDING SITE III. Table 2 illustrates the complementarity of the nucleotide sequences of PCDH20 BINDING SITE, designated SEQ ID:23137, to the nucleotide sequence of VGAM2477 RNA, herein designated VGAM RNA, also designated SEQ ID:5188.

Another function of VGAM2477 is therefore inhibition of Protocadherin 20 (PCDH20, Accession NM_022843). Accordingly, utilities of VGAM2477 include diagnosis, prevention and treatment of diseases and clinical conditions associated with PCDH20. PRO2533 (Accession NM_018629) is another VGAM2477 host target gene. PRO2533 BINDING SITE is HOST TARGET binding site found in the 3' untranslated region of mRNA encoded by PRO2533, corresponding to a HOST TARGET binding site such as BINDING SITE I, BINDING SITE II or BINDING SITE III. Table 2 illustrates the complementarity of the nucleotide sequences of PRO2533 BINDING SITE, designated SEQ ID:20704, to the nucleotide sequence of VGAM2477 RNA, herein designated VGAM RNA, also designated SEQ ID:5188.

Another function of VGAM2477 is therefore inhibition of PRO2533 (Accession NM_018629). Accordingly, utilities of VGAM2477 include diagnosis, prevention and treatment of diseases and clinical conditions associated with PRO2533. LOC118851 (Accession XM_061180) is another VGAM2477 host target gene. LOC118851 BINDING SITE is HOST TARGET binding site found in the 3' untranslated region of mRNA encoded by LOC118851, corresponding to a HOST TARGET binding site such as BINDING SITE I, BINDING SITE II or BINDING SITE III. Table 2 illustrates the complementarity of the nucleotide sequences of LOC118851 BINDING SITE, designated SEQ ID:37203, to the nucleotide sequence of VGAM2477 RNA, herein designated VGAM RNA, also designated SEQ ID:5188.

Another function of VGAM2477 is therefore inhibition of LOC118851 (Accession XM_061180). Accordingly, utilities of VGAM2477 include diagnosis, prevention and treatment of diseases and clinical conditions associated with LOC118851. LOC127943 (Accession XM_059195) is another VGAM2477 host target gene. LOC127943 BINDING SITE is HOST TARGET binding site found in the 3' untranslated region of mRNA encoded by LOC127943, corresponding to a HOST TARGET binding site such as BINDING SITE I, BINDING SITE II or BINDING SITE III. Table 2 illustrates the complementarity of the nucleotide sequences of LOC127943 BINDING SITE, designated SEQ ID:36914, to the nucleotide sequence of VGAM2477 RNA, herein designated VGAM RNA, also designated SEQ ID:5188.

Another function of VGAM2477 is therefore inhibition of LOC127943 (Accession XM_059195). Accordingly, utilities of VGAM2477 include diagnosis, prevention and treatment of diseases and clinical conditions associated with LOC127943. LOC143154 (Accession XM_084441) is another VGAM2477 host target gene. LOC143154 BINDING SITE is HOST TARGET binding site found in the 3' untranslated region of mRNA encoded by LOC143154, corresponding to a HOST TARGET binding site such as BINDING SITE I, BINDING SITE II or BINDING SITE III. Table 2 illustrates the complementarity of the nucleotide sequences of LOC143154 BINDING SITE, designated SEQ ID:37590, to the nucleotide sequence of VGAM2477 RNA, herein designated VGAM RNA, also designated SEQ ID:5188.

Another function of VGAM2477 is therefore inhibition of LOC143154 (Accession XM_084441). Accordingly, utilities of VGAM2477 include diagnosis, prevention and treatment of diseases and clinical conditions associated with LOC143154. LOC169966 (Accession XM_093010) is another VGAM2477 host target gene. LOC169966 BINDING SITE is HOST TARGET binding site found in the 3' untranslated region of mRNA encoded by LOC169966, corresponding to a HOST TARGET binding site such as BINDING SITE I, BINDING SITE II or BINDING SITE III. Table 2 illustrates the complementarity of the nucleotide sequences of LOC169966 BINDING SITE, designated SEQ ID:40167, to the nucleotide sequence of VGAM2477 RNA, herein designated VGAM RNA, also designated SEQ ID:5188.

Another function of VGAM2477 is therefore inhibition of LOC169966 (Accession XM_093010). Accordingly, utilities of VGAM2477 include diagnosis, prevention and treatment of diseases and clinical conditions associated with LOC169966. LOC219294 (Accession XM_167566) is another VGAM2477 host target gene. LOC219294 BINDING SITE is HOST TARGET binding site found in the 3' untranslated region of mRNA encoded by LOC219294, corresponding to a HOST TARGET binding site such as BINDING SITE I, BINDING SITE II or BINDING SITE III. Table 2 illustrates the complementarity of the nucleotide sequences of LOC219294 BINDING SITE, designated SEQ ID:44690, to the nucleotide sequence of VGAM2477 RNA, herein designated VGAM RNA, also designated SEQ ID:5188.

Another function of VGAM2477 is therefore inhibition of LOC219294 (Accession XM_167566). Accordingly, utilities of VGAM2477 include diagnosis, prevention and treatment of diseases and clinical conditions associated with LOC219294. FIG. 1 further provides a conceptual description of a novel bioinformatically detected viral gene of the present invention, referred to here as Viral Genomic Address Messenger 2478 (VGAM2478) viral gene, which modulates expression of respective host target genes thereof, the function and utility of which host target genes is known in the art.

VGAM2478 is a novel bioinformatically detected regulatory, non protein coding, viral micro RNA (miRNA) gene. The method by which VGAM2478 was detected is described hereinabove with reference to FIGS. 1-8.

VGAM2478 gene, herein designated VGAM GENE, is a viral gene contained in the genome of Mouse Cytomegalovirus 1. VGAM2478 host target gene, herein designated VGAM HOST TARGET GENE, is a human gene contained in the human genome.

VGAM2478 gene encodes a VGAM2478 precursor RNA, herein designated VGAM PRECURSOR RNA. Similar to other miRNA genes, and unlike most ordinary genes, VGAM2478 precursor RNA does not encode a protein. A nucleotide sequence identical or highly similar to the nucleotide sequence of VGAM2478 precursor RNA is designated SEQ ID:2464, and is provided hereinbelow with reference to the sequence listing part. Nucleotide sequence SEQ ID:2464 is located at position 55947 relative to the genome of Mouse Cytomegalovirus 1.

VGAM2478 precursor RNA folds onto itself, forming VGAM2478 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2478 folded precursor RNA into VGAM2478 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2478 RNA is designated SEQ ID:5189, and is provided hereinbelow with reference to the sequence listing part.

VGAM2478 host target gene, herein designated VGAM HOST TARGET GENE, encodes a corresponding messenger RNA, VGAM2478 host target RNA, herein designated VGAM HOST TARGET RNA. VGAM2478 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2478 RNA, herein designated VGAM RNA, binds complementarily to one or more host target binding sites located in untranslated regions of VGAM2478 host target RNA, herein designated VGAM HOST TARGET RNA. This complementary binding is due to the fact that the nucleotide sequence of VGAM2478 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2478 RNA, herein designated VGAM RNA, may have a different number of host target binding sites in untranslated regions of a VGAM2478 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2478 RNA, herein designated VGAM RNA, to host target binding sites on VGAM2478 host target RNA, herein designated VGAM HOST TARGET RNA, such as BINDING SITE I, BINDING SITE II and BINDING SITE III, inhibits translation of VGAM2478 host target RNA into VGAM2478 host target protein, herein designated VGAM HOST TARGET PROTEIN. VGAM host target protein is therefore outlined by a broken line.

It is appreciated that VGAM2478 host target gene, herein designated VGAM HOST TARGET GENE, in fact represents a plurality of VGAM2478 host target genes. The mRNA of each one of this plurality of VGAM2478 host target genes comprises one or more host target binding sites, each having a nucleotide sequence which is at least partly complementary to VGAM2478 RNA, herein designated VGAM RNA, and which when bound by VGAM2478 RNA causes inhibition of translation of respective one or more VGAM2478 host target proteins.

It is further appreciated by one skilled in the art that the mode of translational inhibition illustrated by FIG. 1 with specific reference to translational inhibition exerted by VGAM2478 gene, herein designated VGAM GENE, on one or more VGAM2478 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2478 is inhibition of expression of host target genes, as part of a novel viral mechanism of attacking a host. Accordingly, utilities of VGAM2478 include diagnosis, prevention and treatment of viral infection by Mouse Cytomegalovirus 1. Specific functions, and accordingly utilities, of VGAM2478 correlate with, and may be deduced from, the identity of the host target genes which VGAM2478 binds and inhibits, and the function of these target genes, as elaborated hereinbelow.

Nucleotide sequences of the VGAM2478 precursor RNA, herein designated VGAM PRECURSOR RNA, and of the 'diced' VGAM2478 RNA, herein designated VGAM RNA, and a schematic representation of the secondary folding of VGAM2478 folded precursor RNA, herein designated VGAM FOLDED PRECURSOR RNA, of VGAM2478 are further described hereinbelow with reference to Table 1.

Nucleotide sequences of host target binding sites, such as BINDING SITE-I, BINDING SITE-II and BINDING SITE-III of FIG. 1, found on VGAM2478 host target RNA, and schematic representation of the complementarity of each of these host target binding sites to VGAM2478 RNA, herein designated VGAM RNA, are described hereinbelow with reference to Table 2.

As mentioned hereinabove with reference to FIG. 1, a function of VGAM2478 gene, herein designated VGAM is inhibition of expression of VGAM2478 target genes. It is appreciated that specific functions, and accordingly utilities, of VGAM2478 correlate with, and may be deduced from, the identity of the target genes which VGAM2478 binds and inhibits, and the function of these target genes, as elaborated hereinbelow.

Ras Homolog Gene Family, Member H (ARHH, Accession NM_004310) is a VGAM2478 host target gene. ARHH BINDING SITE is HOST TARGET binding site found in the 5' untranslated region of mRNA encoded by ARHH, corresponding to a HOST TARGET binding site such as BINDING SITE I, BINDING SITE II or BINDING SITE III. Table 2 illustrates the complementarity of the nucleotide sequences of ARHH BINDING SITE, designated SEQ ID:10516, to the nucleotide sequence of VGAM2478 RNA, herein designated VGAM RNA, also designated SEQ ID:5189.

A function of VGAM2478 is therefore inhibition of Ras Homolog Gene Family, Member H (ARHH, Accession NM_004310), a gene which is a member of the Ras superfamily of small GTPases. Accordingly, utilities of VGAM2478 include diagnosis, prevention and treatment of diseases and clinical conditions associated with ARHH. The function of ARHH has been established by previous studies. Non-Hodgkin lymphoma (NHL; OMIM Ref. No. 605027) is associated with several translocations between the LAZ3 (OMIM Ref. No. 109565) oncogene at 3q27 and other unrelated genes. Dallery et al. (1995) stated that translocations involving band 3q27 and the immunoglobulin (Ig) genes are the third most common specific abnormality associated with NHL. LAZ3 rearrangements also occur in several NHLs without the involvement of Ig genes, as in the translocation t (3;4)(q27; p11) observed in the B-cell line VAL. Dallery et al. (1995) demonstrated that the consequence of this translocation is the expression of a chimeric transcript of LAZ3 and a new gene, which they termed TTF for 'translocation three four,' encoding a small G-like protein. Analysis of a full-length TTF cDNA revealed that the gene encodes a 191-amino acid polypeptide with similarity to members of the Ras superfamily (see OMIM Ref. No. 139150). The highest degree of identity was found with the Rho-like CDC42 protein (OMIM Ref. No. 116952). Dallery et al. (1995) reported that the sequence contains residues normally associated with binding and hydrolysis of guanosine triphosphate. Northern blot analysis showed that TTF is expressed in hemopoietic cell lines only. Dallery-Prudhomme et al. (1997) examined the genomic organization of the RhoH/TTF gene and demonstrated that it is encoded on 2 exons spanning 35 kb of the genome. The entire coding region resides on the second exon. Dallery-Prudhomme et al. (1997) used fluorescence in situ hybridization to map the gene to chromosome 4p13. See also ARHA (OMIM Ref. No. 165390). In addition to immunoglobulin V genes, the 5-prime sequences of BCL6 (OMIM Ref. No. 109565) and FAS (TNFRSF6; 134637) are mutated in normal germinal center B lymphocytes. Genomic instability promotes tumorigenesis through defective chromosome segregation and DNA mismatch repair inactivation. By screening 18 loci for mutations, Pasqualucci et al. (2001) identified changes in the germline sequences of PIM1 (OMIM Ref. No. 164960), MYC (OMIM Ref. No. 190080), ARHH, and/or PAX5 (OMIM Ref. No. 167414), in addition to BCL6, in a majority of diffuse large-cell lymphomas (DLCLs; OMIM Ref. No. 601889). No mutations in PIM1, MYC, ARHH, and PAX5 were detected in germinal-center lymphocytes, naive B cells, or B-cell malignancies other than DLCLs. ARHH mutations, which were observed in 46% of DLCLs, resided within noncoding sequences, suggesting an effect on regulation of ARHH expression. FISH analysis indicated that hypermutation in these genes is not due to chromosomal translocation, as seen in Burkitt lymphoma (OMIM Ref. No. 113970). Chromosomal translocation, however, may be an outcome of hypermutation. Specific features of the hypermutation process, including the predominance of single nucleotide substitutions with occasional deletions or duplications, a preference for transitions over transversions, and a specific motif targeting RGYW, were recognizable in each of the hypermutated loci. Pasqualucci et al. (2001) proposed that aberrant hypermutation of regulatory and coding sequences of genes that do not represent physiologic targets may provide the basis for DLCL pathogenesis and explain its phenotypic and clinical heterogeneity. This hypermutation malfunction is unlikely to be due to defective DNA mismatch repair and does not appear to involve activation-induced deaminase (AICDA; 605257)

Full details of the abovementioned studies are described in the following publications, the disclosure of which are hereby incorporated by reference:

Dallery, E.; Galiegue-Zouitina, S.; Collyn-d'Hooghe, M.; Quief, S.; Denis, C.; Hildebrand, M.-P.; Lantoine, D.; Deweindt, C.; Tilly, H.; Bastard, C.; Kerckaert, J.-P. : TTF, a gene encoding a novel small G protein, fuses to the lymphoma-associated LAZ3 gene by t (3;4) chromosomal translocation. Oncogene 10: 2171-2178, 1995; and Pasqualucci, L.; Neumeister, P.; Goossens, T.; Nanjangud, G.; Chaganti, R. S. K.; Kuppers, R.; Dalla-Favera, R.: Hypermutation of multiple proto-oncogenes in B-cell diffuse large-cell.

Further studies establishing the function and utilities of ARHH are found in John Hopkins OMIM database record ID 602037, and in sited publications numbered 951-95 and 11110 listed in the bibliography section hereinbelow, which are also hereby incorporated by reference. Myxovirus (influenza virus) Resistance 1, Interferon-inducible Protein P78 (mouse) (MX1, Accession NM_002462) is another VGAM2478 host target gene. MX1 BINDING SITE is HOST TARGET binding site found in the 5' untranslated region of mRNA encoded by MX1, corresponding to a HOST TARGET binding site such as BINDING SITE I, BINDING SITE II or BINDING SITE III. Table 2 illustrates the complementarity of the nucleotide sequences of MX1 BINDING SITE, designated SEQ ID:8293, to the nucleotide sequence of VGAM2478 RNA, herein designated VGAM RNA, also designated SEQ ID:5189.

Another function of VGAM2478 is therefore inhibition of Myxovirus (influenza virus) Resistance 1, Interferon-inducible Protein P78 (mouse) (MX1, Accession NM_002462), a gene which is responsible for a specific antiviral state against influenza virus infection. Accordingly, utilities of VGAM2478 include diagnosis, prevention and treatment of diseases and clinical conditions associated with MX1. The function of MX1 and its association with various diseases and clinical conditions, has been established by previous studies, as described hereinabove with reference to VGAM973. V-myb Myeloblastosis Viral Oncogene Homolog (avian)-like 1 (MYBL1, Accession XM_034274) is another VGAM2478 host target gene. MYBL1 BINDING SITE is HOST TARGET binding site found in the 5' untranslated region of mRNA encoded by MYBL1, corresponding to a HOST TARGET binding site such as BINDING SITE I, BINDING SITE II or BINDING SITE III. Table 2 illustrates the complementarity of the nucleotide sequences of MYBL1 BINDING SITE, designated SEQ ID:32043, to the nucleotide sequence of VGAM2478 RNA, herein designated VGAM RNA, also designated SEQ ID:5189.

Another function of VGAM2478 is therefore inhibition of V-myb Myeloblastosis Viral Oncogene Homolog (avian)-like 1 (MYBL1, Accession XM_034274), a gene which could have a role in the proliferation and/or differentiation of neurogenic, spermatogenic and b-lymphoid cells. Accordingly, utilities of VGAM2478 include diagnosis, prevention and treatment of diseases and clinical conditions associated with MYBL1. The function of MYBL1 and its association with various diseases and clinical conditions, has been established by previous studies, as described hereinabove with reference to VGAM184. Synaptogyrin 3 (SYNGR3, Accession NM_004209) is another VGAM2478 host target gene. SYNGR3 BINDING SITE is HOST TARGET binding site found in the 3' untranslated region of mRNA encoded by SYNGR3, corresponding to a HOST TARGET binding site such as BINDING SITE I, BINDING SITE II or BINDING SITE III. Table 2 illustrates the complementarity of the nucleotide sequences of SYNGR3 BINDING SITE, designated SEQ ID:10408, to the nucleotide sequence of VGAM2478 RNA, herein designated VGAM RNA, also designated SEQ ID:5189.

Another function of VGAM2478 is therefore inhibition of Synaptogyrin 3 (SYNGR3, Accession NM_004209). Accordingly, utilities of VGAM2478 include diagnosis, prevention and treatment of diseases and clinical conditions associated with SYNGR3. Cyclin M2 (CNNM2, Accession NM_017649) is another VGAM2478 host target gene. CNNM2 BINDING SITE is HOST TARGET binding site found in the 3' untranslated region of mRNA encoded by CNNM2, corresponding to a HOST TARGET binding site such as BINDING SITE I, BINDING SITE II or BINDING SITE III. Table 2 illustrates the complementarity of the nucleotide sequences of CNNM2 BINDING SITE, designated SEQ ID:19154, to the nucleotide sequence of VGAM2478 RNA, herein designated VGAM RNA, also designated SEQ ID:5189.

Another function of VGAM2478 is therefore inhibition of Cyclin M2 (CNNM2, Accession NM_017649). Accordingly, utilities of VGAM2478 include diagnosis, prevention and treatment of diseases and clinical conditions associated with CNNM2. FLJ10759 (Accession NM_018207) is another VGAM2478 host target gene. FLJ10759 BINDING SITE is HOST TARGET binding site found in the 5' untranslated region of mRNA encoded by FLJ10759, corresponding to a HOST TARGET binding site such as BINDING SITE I, BINDING SITE II or BINDING SITE III. Table 2 illustrates the complementarity of the nucleotide sequences of FLJ10759 BINDING SITE, designated SEQ ID:20102, to the nucleotide sequence of VGAM2478 RNA, herein designated VGAM RNA, also designated SEQ ID:5189.

Another function of VGAM2478 is therefore inhibition of FLJ10759 (Accession NM_018207). Accordingly, utilities of VGAM2478 include diagnosis, prevention and treatment of diseases and clinical conditions associated with FLJ10759. FLJ20507 (Accession XM_012558) is another VGAM2478 host target gene. FLJ20507 BINDING SITE1 and FLJ20507 BINDING SITE2 are HOST TARGET binding sites found in untranslated regions of mRNA encoded by FLJ20507, corresponding to HOST TARGET binding sites such as BINDING SITE I, BINDING SITE II or BINDING SITE III. Table 2 illustrates the complementarity of the nucleotide sequences of FLJ20507 BINDING SITE1 and FLJ20507 BINDING SITE2, designated SEQ ID:30219 and SEQ ID:19511 respectively, to the nucleotide sequence of VGAM2478 RNA, herein designated VGAM RNA, also designated SEQ ID:5189.

Another function of VGAM2478 is therefore inhibition of FLJ20507 (Accession XM_012558). Accordingly, utilities of VGAM2478 include diagnosis, prevention and treatment of diseases and clinical conditions associated with FLJ20507. KIAA1656 (Accession XM_038022) is another VGAM2478 host target gene. KIAA1656 BINDING SITE is HOST TARGET binding site found in the 3' untranslated region of mRNA encoded by KIAA1656, corresponding to a HOST TARGET binding site such as BINDING SITE I, BINDING SITE II or BINDING SITE III. Table 2 illustrates the complementarity of the nucleotide sequences of KIAA1656 BINDING SITE, designated SEQ ID:32734, to the nucleotide sequence of VGAM2478 RNA, herein designated VGAM RNA, also designated SEQ ID:5189.

Another function of VGAM2478 is therefore inhibition of KIAA1656 (Accession XM_038022). Accordingly, utilities of VGAM2478 include diagnosis, prevention and treatment of diseases and clinical conditions associated with KIAA1656. KIAA1912 (Accession XM_055636) is another VGAM2478 host target gene. KIAA1912 BINDING SITE is HOST TARGET binding site found in the 5' untranslated region of mRNA encoded by KIAA1912, corresponding to a HOST TARGET binding site such as BINDING SITE I, BINDING SITE II or BINDING SITE III. Table 2 illustrates the complementarity of the nucleotide sequences of KIAA1912 BINDING SITE, designated SEQ ID:36312, to the nucleotide sequence of VGAM2478 RNA, herein designated VGAM RNA, also designated SEQ ID:5189.

Another function of VGAM2478 is therefore inhibition of KIAA1912 (Accession XM_055636). Accordingly, utilities of VGAM2478 include diagnosis, prevention and treatment of diseases and clinical conditions associated with KIAA1912. KIAA1940 (Accession XM_086981) is another VGAM2478 host target gene. KIAA1940 BINDING SITE is HOST TARGET binding site found in the 5' untranslated region of mRNA encoded by KIAA1940, corresponding to a HOST TARGET binding site such as BINDING SITE I, BINDING SITE II or BINDING SITE III. Table 2 illustrates the complementarity of the nucleotide sequences of KIAA1940 BINDING SITE, designated SEQ ID:39006, to the nucleotide sequence of VGAM2478 RNA, herein designated VGAM RNA, also designated SEQ ID:5189.

Another function of VGAM2478 is therefore inhibition of KIAA1940 (Accession XM_086981). Accordingly, utilities of VGAM2478 include diagnosis, prevention and treatment of diseases and clinical conditions associated with KIAA1940. MGC4309 (Accession NM_024115) is another VGAM2478 host target gene. MGC4309 BINDING SITE is HOST TARGET binding site found in the 3' untranslated region of mRNA encoded by MGC4309, corresponding to a HOST TARGET binding site such as BINDING SITE I, BINDING SITE II or BINDING SITE III. Table 2 illustrates the complementarity of the nucleotide sequences of MGC4309 BINDING SITE, designated SEQ ID:23568, to the nucleotide sequence of VGAM2478 RNA, herein designated VGAM RNA, also designated SEQ ID:5189.

Another function of VGAM2478 is therefore inhibition of MGC4309 (Accession NM_024115). Accordingly, utilities of VGAM2478 include diagnosis, prevention and treatment of diseases and clinical conditions associated with MGC4309. MAP Kinase-interacting Serine/threonine Kinase 1 (MKNK1, Accession NM_003684) is another VGAM2478 host target gene. MKNK1 BINDING SITE is HOST TARGET binding site found in the 3' untranslated region of mRNA encoded by MKNK1, corresponding to a HOST TARGET binding site such as BINDING SITE I, BINDING SITE II or BINDING SITE III. Table 2 illustrates the complementarity of the nucleotide sequences of MKNK1 BINDING SITE, designated SEQ ID:9793, to the nucleotide sequence of VGAM2478 RNA, herein designated VGAM RNA, also designated SEQ ID:5189.

Another function of VGAM2478 is therefore inhibition of MAP Kinase-interacting Serine/threonine Kinase 1 (MKNK1, Accession NM_003684). Accordingly, utilities of VGAM2478 include diagnosis, prevention and treatment of diseases and clinical conditions associated with MKNK1. poly (A) Binding Protein, Cytoplasmic 5 (PABPC5, Accession NM_080832) is another VGAM2478 host target gene. PABPC5 BINDING SITE is HOST TARGET binding site found in the 5' untranslated region of mRNA encoded by PABPC5, corresponding to a HOST TARGET binding site such as BINDING SITE I, BINDING SITE II or BINDING SITE III. Table 2 illustrates the complementarity of the nucleotide sequences of PABPC5 BINDING SITE, designated SEQ ID:28097, to the nucleotide sequence of VGAM2478 RNA, herein designated VGAM RNA, also designated SEQ ID:5189.

Another function of VGAM2478 is therefore inhibition of poly (A) Binding Protein, Cytoplasmic 5 (PABPC5, Accession NM_080832). Accordingly, utilities of VGAM2478 include diagnosis, prevention and treatment of diseases and clinical conditions associated with PABPC5. Phosphatidylinositol-4-phosphate 5-kinase, Type II, Beta (PIP5K2B, Accession NM_003559) is another VGAM2478 host target gene. PIP5K2B BINDING SITE is HOST TARGET binding site found in the 3' untranslated region of mRNA encoded by PIP5K2B, corresponding to a HOST TARGET binding site such as BINDING SITE I, BINDING SITE II or BINDING SITE III. Table 2 illustrates the complementarity of the nucleotide sequences of PIP5K2B BINDING SITE, designated SEQ ID:9612, to the nucleotide sequence of VGAM2478 RNA, herein designated VGAM RNA, also designated SEQ ID:5189.

Another function of VGAM2478 is therefore inhibition of Phosphatidylinositol-4-phosphate 5-kinase, Type II, Beta (PIP5K2B, Accession NM_003559). Accordingly, utilities of VGAM2478 include diagnosis, prevention and treatment of diseases and clinical conditions associated with PIP5K2B. SCYD1 (Accession XM_165650) is another VGAM2478 host target gene. SCYD1 BINDING SITE is HOST TARGET binding site found in the 3' untranslated region of mRNA encoded by SCYD1, corresponding to a HOST TARGET binding site such as BINDING SITE I, BINDING SITE II or BINDING SITE III. Table 2 illustrates the complementarity of the nucleotide sequences of SCYD1 BINDING SITE, designated SEQ ID:43710, to the nucleotide sequence of VGAM2478 RNA, herein designated VGAM RNA, also designated SEQ ID:5189.

Another function of VGAM2478 is therefore inhibition of SCYD1 (Accession XM_165650). Accordingly, utilities of VGAM2478 include diagnosis, prevention and treatment of diseases and clinical conditions associated with SCYD1. SEC14-like 1 (S. cerevisiae) (SEC14L1, Accession NM_003003) is another VGAM2478 host target gene. SEC14L1 BINDING SITE is HOST TARGET binding site found in the 3' untranslated region of mRNA encoded by SEC14L1, corresponding to a HOST TARGET binding site such as BINDING SITE I, BINDING SITE II or BINDING SITE III. Table 2 illustrates the complementarity of the nucleotide sequences of SEC14L1 BINDING SITE, designated SEQ ID:8904, to the nucleotide sequence of VGAM2478 RNA, herein designated VGAM RNA, also designated SEQ ID:5189.

Another function of VGAM2478 is therefore inhibition of SEC14-like 1 (S. cerevisiae) (SEC14L1, Accession NM_003003). Accordingly, utilities of VGAM2478 include diagnosis, prevention and treatment of diseases and clinical conditions associated with SEC14L1. SMURF2 (Accession NM_022739) is another VGAM2478 host target gene. SMURF2 BINDING SITE is HOST TARGET binding site found in the 5' untranslated region of mRNA encoded by SMURF2, corresponding to a HOST TARGET binding site such as BINDING SITE I, BINDING SITE II or BINDING SITE III. Table 2 illustrates the complementarity of the nucleotide sequences of SMURF2 BINDING SITE, designated SEQ ID:22946, to the nucleotide sequence of VGAM2478 RNA, herein designated VGAM RNA, also designated SEQ ID:5189.

Another function of VGAM2478 is therefore inhibition of SMURF2 (Accession NM_022739). Accordingly, utilities of VGAM2478 include diagnosis, prevention and treatment of diseases and clinical conditions associated with SMURF2. LOC115704 (Accession XM_056533) is another VGAM2478 host target gene. LOC115704 BINDING SITE is HOST TARGET binding site found in the 3' untranslated region of mRNA encoded by LOC115704, corresponding to a HOST TARGET binding site such as BINDING SITE I, BINDING SITE II or BINDING SITE III. Table 2 illustrates the complementarity of the nucleotide sequences of LOC115704 BINDING SITE, designated SEQ ID:36402, to the nucleotide sequence of VGAM2478 RNA, herein designated VGAM RNA, also designated SEQ ID:5189.

Another function of VGAM2478 is therefore inhibition of LOC115704 (Accession XM_056533). Accordingly, utilities of VGAM2478 include diagnosis, prevention and treatment of diseases and clinical conditions associated with LOC115704. LOC124602 (Accession XM_058829) is another VGAM2478 host target gene. LOC124602 BIND- ING SITE is HOST TARGET binding site found in the 3' untranslated region of mRNA encoded by LOC124602, corresponding to a HOST TARGET binding site such as BINDING SITE I, BINDING SITE II or BINDING SITE III. Table 2 illustrates the complementarity of the nucleotide sequences of LOC124602 BINDING SITE, designated SEQ ID:36760, to the nucleotide sequence of VGAM2478 RNA, herein designated VGAM RNA, also designated SEQ ID:5189.

Another function of VGAM2478 is therefore inhibition of LOC124602 (Accession XM_058829). Accordingly, utilities of VGAM2478 include diagnosis, prevention and treatment of diseases and clinical conditions associated with LOC124602. LOC147299 (Accession XM_085763) is another VGAM2478 host target gene. LOC147299 BINDING SITE is HOST TARGET binding site found in the 3' untranslated region of mRNA encoded by LOC147299, corresponding to a HOST TARGET binding site such as BINDING SITE I, BINDING SITE II or BINDING SITE III. Table 2 illustrates the complementarity of the nucleotide sequences of LOC147299 BINDING SITE, designated SEQ ID:38332, to the nucleotide sequence of VGAM2478 RNA, herein designated VGAM RNA, also designated SEQ ID:5189.

Another function of VGAM2478 is therefore inhibition of LOC147299 (Accession XM_085763). Accordingly, utilities of VGAM2478 include diagnosis, prevention and treatment of diseases and clinical conditions associated with LOC147299. LOC149194 (Accession XM_086458) is another VGAM2478 host target gene. LOC149194 BINDING SITE is HOST TARGET binding site found in the 5' untranslated region of mRNA encoded by LOC149194, corresponding to a HOST TARGET binding site such as BINDING SITE I, BINDING SITE II or BINDING SITE III. Table 2 illustrates the complementarity of the nucleotide sequences of LOC149194 BINDING SITE, designated SEQ ID:38671, to the nucleotide sequence of VGAM2478 RNA, herein designated VGAM RNA, also designated SEQ ID:5189.

Another function of VGAM2478 is therefore inhibition of LOC149194 (Accession XM_086458). Accordingly, utilities of VGAM2478 include diagnosis, prevention and treatment of diseases and clinical conditions associated with LOC149194. LOC151521 (Accession XM_098076) is another VGAM2478 host target gene. LOC151521 BINDING SITE is HOST TARGET binding site found in the 3' untranslated region of mRNA encoded by LOC151521, corresponding to a HOST TARGET binding site such as BINDING SITE I, BINDING SITE II or BINDING SITE III. Table 2 illustrates the complementarity of the nucleotide sequences of LOC151521 BINDING SITE, designated SEQ ID:41367, to the nucleotide sequence of VGAM2478 RNA, herein designated VGAM RNA, also designated SEQ ID:5189.

Another function of VGAM2478 is therefore inhibition of LOC151521 (Accession XM_098076). Accordingly, utilities of VGAM2478 include diagnosis, prevention and treatment of diseases and clinical conditions associated with LOC151521. LOC157349 (Accession XM_088298) is another VGAM2478 host target gene. LOC157349 BINDING SITE1 through LOC157349 BINDING SITE3 are HOST TARGET binding sites found in untranslated regions of mRNA encoded by LOC157349, corresponding to HOST TARGET binding sites such as BINDING SITE I, BINDING SITE II or BINDING SITE III. Table 2 illustrates the complementarity of the nucleotide sequences of LOC157349 BINDING SITE1 through LOC157349 BINDING SITE3, designated SEQ ID:39590, SEQ ID:39591 and SEQ ID:39592 respectively, to the nucleotide sequence of VGAM2478 RNA, herein designated VGAM RNA, also designated SEQ ID:5189.

Another function of VGAM2478 is therefore inhibition of LOC157349 (Accession XM_088298). Accordingly, utilities of VGAM2478 include diagnosis, prevention and treatment of diseases and clinical conditions associated with LOC157349. LOC220110 (Accession XM_167882) is another VGAM2478 host target gene. LOC220110 BINDING SITE is HOST TARGET binding site found in the 5' untranslated region of mRNA encoded by LOC220110, corresponding to a HOST TARGET binding site such as BINDING SITE I, BINDING SITE II or BINDING SITE III. Table 2 illustrates the complementarity of the nucleotide sequences of LOC220110 BINDING SITE, designated SEQ ID:44894, to the nucleotide sequence of VGAM2478 RNA, herein designated VGAM RNA, also designated SEQ ID:5189.

Another function of VGAM2478 is therefore inhibition of LOC220110 (Accession XM_167882). Accordingly, utilities of VGAM2478 include diagnosis, prevention and treatment of diseases and clinical conditions associated with LOC220110. LOC222031 (Accession XM_168371) is another VGAM2478 host target gene. LOC222031 BINDING SITE is HOST TARGET binding site found in the 3' untranslated region of mRNA encoded by LOC222031, corresponding to a HOST TARGET binding site such as BINDING SITE I, BINDING SITE II or BINDING SITE III. Table 2 illustrates the complementarity of the nucleotide sequences of LOC222031 BINDING SITE, designated SEQ ID:45133, to the nucleotide sequence of VGAM2478 RNA, herein designated VGAM RNA, also designated SEQ ID:5189.

Another function of VGAM2478 is therefore inhibition of LOC222031 (Accession XM_168371). Accordingly, utilities of VGAM2478 include diagnosis, prevention and treatment of diseases and clinical conditions associated with LOC222031. LOC92578 (Accession XM_045900) is another VGAM2478 host target gene. LOC92578 BINDING SITE is HOST TARGET binding site found in the 5' untranslated region of mRNA encoded by LOC92578, corresponding to a HOST TARGET binding site such as BINDING SITE I, BINDING SITE II or BINDING SITE III. Table 2 illustrates the complementarity of the nucleotide sequences of LOC92578 BINDING SITE, designated SEQ ID:34607, to the nucleotide sequence of VGAM2478 RNA, herein designated VGAM RNA, also designated SEQ ID:5189.

Another function of VGAM2478 is therefore inhibition of LOC92578 (Accession XM_045900). Accordingly, utilities of VGAM2478 include diagnosis, prevention and treatment of diseases and clinical conditions associated with LOC92578. FIG. 1 further provides a conceptual description of a novel bioinformatically detected viral gene of the present invention, referred to here as Viral Genomic Address Messenger 2479 (VGAM2479) viral gene, which modulates expression of respective host target genes thereof, the function and utility of which host target genes is known in the art.

VGAM2479 is a novel bioinformatically detected regulatory, non protein coding, viral micro RNA (miRNA) gene. The method by which VGAM2479 was detected is described hereinabove with reference to FIGS. 1-8.

VGAM2479 gene, herein designated VGAM GENE, is a viral gene contained in the genome of Mouse Cytomegalovirus 1. VGAM2479 host target gene, herein designated VGAM HOST TARGET GENE, is a human gene contained in the human genome.

VGAM2479 gene encodes a VGAM2479 precursor RNA, herein designated VGAM PRECURSOR RNA. Similar to other miRNA genes, and unlike most ordinary genes, VGAM2479 precursor RNA does not encode a protein. A nucleotide sequence identical or highly similar to the nucleotide sequence of VGAM2479 precursor RNA is designated SEQ ID:2465, and is provided hereinbelow with reference to the sequence listing part. Nucleotide sequence SEQ ID:2465 is located at position 167759 relative to the genome of Mouse Cytomegalovirus 1.

VGAM2479 precursor RNA folds onto itself, forming VGAM2479 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2479 folded precursor RNA into VGAM2479 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2479 RNA is designated SEQ ID:5190, and is provided hereinbelow with reference to the sequence listing part.

VGAM2479 host target gene, herein designated VGAM HOST TARGET GENE, encodes a corresponding messenger RNA, VGAM2479 host target RNA, herein designated VGAM HOST TARGET RNA. VGAM2479 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2479 RNA, herein designated VGAM RNA, binds complementarily to one or more host target binding sites located in untranslated regions of VGAM2479 host target RNA, herein designated VGAM HOST TARGET RNA. This complementary binding is due to the fact that the nucleotide sequence of VGAM2479 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2479 RNA, herein designated VGAM RNA, may have a different number of host target binding sites in untranslated regions of a VGAM2479 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2479 RNA, herein designated VGAM RNA, to host target binding sites on VGAM2479 host target RNA, herein designated VGAM HOST TARGET RNA, such as BINDING SITE I, BINDING SITE II and BINDING SITE III, inhibits translation of VGAM2479 host target RNA into VGAM2479 host target protein, herein designated VGAM HOST TARGET PROTEIN. VGAM host target protein is therefore outlined by a broken line.

It is appreciated that VGAM2479 host target gene, herein designated VGAM HOST TARGET GENE, in fact represents a plurality of VGAM2479 host target genes. The mRNA of each one of this plurality of VGAM2479 host target genes comprises one or more host target binding sites, each having a nucleotide sequence which is at least partly complementary to VGAM2479 RNA, herein designated VGAM RNA, and which when bound by VGAM2479 RNA causes inhibition of translation of respective one or more VGAM2479 host target proteins.

It is further appreciated by one skilled in the art that the mode of translational inhibition illustrated by FIG. 1 with specific reference to translational inhibition exerted by VGAM2479 gene, herein designated VGAM GENE, on one or more VGAM2479 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2479 is inhibition of expression of host target genes, as part of a novel viral mechanism of attacking a host. Accordingly, utilities of VGAM2479 include diagnosis, prevention and treatment of viral infection by Mouse Cytomegalovirus 1. Specific functions, and accordingly utilities, of VGAM2479 correlate with, and may be deduced from, the identity of the host target genes which VGAM2479 binds and inhibits, and the function of these host target genes, as elaborated hereinbelow.

Nucleotide sequences of the VGAM2479 precursor RNA, herein designated VGAM PRECURSOR RNA, and of the 'diced' VGAM2479 RNA, herein designated VGAM RNA, and a schematic representation of the secondary folding of VGAM2479 folded precursor RNA, herein designated VGAM FOLDED PRECURSOR RNA, of VGAM2479 are further described hereinbelow with reference to Table 1.

Nucleotide sequences of host target binding sites, such as BINDING SITE-I, BINDING SITE-II and BINDING SITE-III of FIG. 1, found on VGAM2479 host target RNA, and schematic representation of the complementarity of each of these host target binding sites to VGAM2479 RNA, herein designated VGAM RNA, are described hereinbelow with reference to Table 2.

As mentioned hereinabove with reference to FIG. 1, a function of VGAM2479 gene, herein designated VGAM is inhibition of expression of VGAM2479 target genes. It is appreciated that specific functions, and accordingly utilities, of VGAM2479 correlate with, and may be deduced from, the identity of the target genes which VGAM2479 binds and inhibits, and the function of these target genes, as elaborated hereinbelow.

Vasoactive Intestinal Peptide Receptor 1 (VIPR1, Accession NM_004624) is a VGAM2479 host target gene. VIPR1 BINDING SITE is HOST TARGET binding site found in the 3' untranslated region of mRNA encoded by VIPR1, corresponding to a HOST TARGET binding site such as BINDING SITE I, BINDING SITE II or BINDING SITE III. Table 2 illustrates the complementarity of the nucleotide sequences of VIPR1 BINDING SITE, designated SEQ ID:10994, to the nucleotide sequence of VGAM2479 RNA, herein designated VGAM RNA, also designated SEQ ID:5190.

A function of VGAM2479 is therefore inhibition of Vasoactive Intestinal Peptide Receptor 1 (VIPR1, Accession NM_004624), a gene which binds vip and is mediated by g proteins which activate adenylyl cyclase. Accordingly, utilities of VGAM2479 include diagnosis, prevention and treatment of diseases and clinical conditions associated with VIPR1. The function of VIPR1 and its association with various diseases and clinical conditions, has been established by previous studies, as described hereinabove with reference to VGAM548. DKFZp762E1511 (Accession XM_003460) is another VGAM2479 host target gene. DKFZp762E1511 BINDING SITE is HOST TARGET binding site found in the 3' untranslated region of mRNA encoded by DKFZp762E1511, corresponding to a HOST TARGET binding site such as BINDING SITE I, BINDING SITE II or BINDING SITE III. Table 2 illustrates the complementarity of the nucleotide sequences of DKFZp762E1511 BINDING SITE, designated SEQ ID:29931, to the nucleotide sequence of VGAM2479 RNA, herein designated VGAM RNA, also designated SEQ ID:5190.

Another function of VGAM2479 is therefore inhibition of DKFZp762E1511 (Accession XM_003460). Accordingly, utilities of VGAM2479 include diagnosis, prevention and treatment of diseases and clinical conditions associated with DKFZp762E1511. LOC123242 (Accession XM_063548) is another VGAM2479 host target gene. LOC123242 BINDING SITE is HOST TARGET binding site found in the 5' untranslated region of mRNA encoded by LOC123242, corresponding to a HOST TARGET binding site such as BINDING SITE I, BINDING SITE II or BINDING SITE III. Table 2 illustrates the complementarity of the nucleotide sequences of LOC123242 BINDING SITE, designated SEQ ID:37245, to the nucleotide sequence of VGAM2479 RNA, herein designated VGAM RNA, also designated SEQ ID:5190.

Another function of VGAM2479 is therefore inhibition of LOC123242 (Accession XM_063548). Accordingly, utilities of VGAM2479 include diagnosis, prevention and treatment of diseases and clinical conditions associated with LOC123242. LOC139248 (Accession XM_066582) is another VGAM2479 host target gene. LOC139248 BINDING SITE is HOST TARGET binding site found in the 5' untranslated region of mRNA encoded by LOC139248, corresponding to a HOST TARGET binding site such as BINDING SITE I, BINDING SITE II or BINDING SITE III. Table 2 illustrates the complementarity of the nucleotide sequences of LOC139248 BINDING SITE, designated SEQ ID:37337, to the nucleotide sequence of VGAM2479 RNA, herein designated VGAM RNA, also designated SEQ ID:5190.

Another function of VGAM2479 is therefore inhibition of LOC139248 (Accession XM_066582). Accordingly, utilities of VGAM2479 include diagnosis, prevention and treatment of diseases and clinical conditions associated with LOC139248. LOC196955 (Accession XM_085210) is another VGAM2479 host target gene. LOC196955 BINDING SITE is HOST TARGET binding site found in the 5' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37937, to the nucleotide sequence of VGAM2479 RNA, herein designated VGAM RNA, also designated SEQ ID:5190.

Another function of VGAM2479 is therefore inhibition of LOC196955 (Accession XM_085210). Accordingly, utilities of VGAM2479 include diagnosis, prevention and treatment of diseases and clinical conditions associated with LOC196955. LOC253216 (Accession XM_170765) is another VGAM2479 host target gene. LOC253216 BINDING SITE is HOST TARGET binding site found in the 3' untranslated region of mRNA encoded by LOC253216, corresponding to a HOST TARGET binding site such as BINDING SITE I, BINDING SITE II or BINDING SITE III. Table 2 illustrates the complementarity of the nucleotide sequences of LOC253216 BINDING SITE, designated SEQ ID:45516, to the nucleotide sequence of VGAM2479 RNA, herein designated VGAM RNA, also designated SEQ ID:5190.

Another function of VGAM2479 is therefore inhibition of LOC253216 (Accession XM_170765). Accordingly, utilities of VGAM2479 include diagnosis, prevention and treatment of diseases and clinical conditions associated with LOC253216. FIG. 1 further provides a conceptual description of a novel bioinformatically detected viral gene of the present invention, referred to here as Viral Genomic Address Messenger 2480 (VGAM2480) viral gene, which modulates expression of respective host target genes thereof, the function and utility of which host target genes is known in the art.

VGAM2480 is a novel bioinformatically detected regulatory, non protein coding, viral micro RNA (miRNA) gene. The method by which VGAM2480 was detected is described hereinabove with reference to FIGS. 1-8.

VGAM2480 gene, herein designated VGAM GENE, is a viral gene contained in the genome of Mouse Cytomegalovirus 1. VGAM2480 host target gene, herein designated VGAM HOST TARGET GENE, is a human gene contained in the human genome.

VGAM2480 gene encodes a VGAM2480 precursor RNA, herein designated VGAM PRECURSOR RNA. Similar to other miRNA genes, and unlike most ordinary genes, VGAM2480 precursor RNA does not encode a protein. A nucleotide sequence identical or highly similar to the nucleotide sequence of VGAM2480 precursor RNA is designated SEQ ID:2466, and is provided hereinbelow with reference to the sequence listing part. Nucleotide sequence SEQ ID:2466 is located at position 131305 relative to the genome of Mouse Cytomegalovirus 1.

VGAM2480 precursor RNA folds onto itself, forming VGAM2480 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2480 folded precursor RNA into VGAM2480 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2480 RNA is designated SEQ ID:5191, and is provided hereinbelow with reference to the sequence listing part.

VGAM2480 host target gene, herein designated VGAM HOST TARGET GENE, encodes a corresponding messenger RNA, VGAM2480 host target RNA, herein designated VGAM HOST TARGET RNA. VGAM2480 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2480 RNA, herein designated VGAM RNA, binds complementarily to one or more host target binding sites located in untranslated regions of VGAM2480 host target RNA, herein designated VGAM HOST TARGET RNA. This complementary binding is due to the fact that the nucleotide sequence of VGAM2480 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2480 RNA, herein designated VGAM RNA, may have a different number of host target binding sites in untranslated regions of a VGAM2480 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2480 RNA, herein designated VGAM RNA, to host target binding sites on VGAM2480 host target RNA, herein designated VGAM HOST TARGET RNA, such as BINDING SITE I, BINDING SITE II and BINDING SITE III, inhibits translation of VGAM2480 host target RNA into VGAM2480 host target protein, herein designated VGAM HOST TARGET PROTEIN. VGAM host target protein is therefore outlined by a broken line.

It is appreciated that VGAM2480 host target gene, herein designated VGAM HOST TARGET GENE, in fact represents a plurality of VGAM2480 host target genes. The mRNA of each one of this plurality of VGAM2480 host target genes comprises one or more host target binding sites, each having a nucleotide sequence which is at least partly complementary to VGAM2480 RNA, herein designated VGAM RNA, and which when bound by VGAM2480 RNA causes inhibition of translation of respective one or more VGAM2480 host target proteins.

It is further appreciated by one skilled in the art that the mode of translational inhibition illustrated by FIG. 1 with specific reference to translational inhibition exerted by VGAM2480 gene, herein designated VGAM GENE, on one or more VGAM2480 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2480 is inhibition of expression of host target genes, as part of a novel viral mechanism of attacking a host. Accordingly, utilities of VGAM2480 include diagnosis, prevention and treatment of viral infection by Mouse Cytomegalovirus 1. Specific functions, and accordingly utilities, of VGAM2480 correlate with, and may be deduced from, the identity of the host target genes which VGAM2480 binds and inhibits, and the function of these host target genes, as elaborated hereinbelow.

Nucleotide sequences of the VGAM2480 precursor RNA, herein designated VGAM PRECURSOR RNA, and of the 'diced' VGAM2480 RNA, herein designated VGAM RNA, and a schematic representation of the secondary folding of VGAM2480 folded precursor RNA, herein designated VGAM FOLDED PRECURSOR RNA, of VGAM2480 are further described hereinbelow with reference to Table 1.

Nucleotide sequences of host target binding sites, such as BINDING SITE-I, BINDING SITE-II and BINDING SITE-III of FIG. 1, found on VGAM2480 host target RNA, and schematic representation of the complementarity of each of these host target binding sites to VGAM2480 RNA, herein designated VGAM RNA, are described hereinbelow with reference to Table 2.

As mentioned hereinabove with reference to FIG. 1, a function of VGAM2480 gene, herein designated VGAM is inhibition of expression of VGAM2480 target genes. It is appreciated that specific functions, and accordingly utilities, of VGAM2480 correlate with, and may be deduced from, the identity of the target genes which VGAM2480 binds and inhibits, and the function of these target genes, as elaborated hereinbelow.

LOC155376 (Accession XM_088240) is a VGAM2480 host target gene. LOC155376 BINDING SITE is HOST TARGET binding site found in the 5' untranslated region of mRNA encoded by LOC155376, corresponding to a HOST TARGET binding site such as BINDING SITE I, BINDING SITE II or BINDING SITE III. Table 2 illustrates the complementarity of the nucleotide sequences of LOC155376 BINDING SITE, designated SEQ ID:39563, to the nucleotide sequence of VGAM2480 RNA, herein designated VGAM RNA, also designated SEQ ID:5191.

A function of VGAM2480 is therefore inhibition of LOC155376 (Accession XM_088240). Accordingly, utilities of VGAM2480 include diagnosis, prevention and treatment of diseases and clinical conditions associated with LOC155376. LOC219513 (Accession XM_169166) is another VGAM2480 host target gene. LOC219513 BINDING SITE is HOST TARGET binding site found in the 3' untranslated region of mRNA encoded by LOC219513, corresponding to a HOST TARGET binding site such as BINDING SITE I, BINDING SITE II or BINDING SITE III. Table 2 illustrates the complementarity of the nucleotide sequences of LOC219513 BINDING SITE, designated SEQ ID:45289, to the nucleotide sequence of VGAM2480 RNA, herein designated VGAM RNA, also designated SEQ ID:5191.

Another function of VGAM2480 is therefore inhibition of LOC219513 (Accession XM_169166). Accordingly, utilities of VGAM2480 include diagnosis, prevention and treatment of diseases and clinical conditions associated with LOC219513. LOC222233 (Accession XM_168560) is another VGAM2480 host target gene. LOC222233 BINDING SITE is HOST TARGET binding site found in the 5' untranslated region of mRNA encoded by LOC222233, corresponding to a HOST TARGET binding site such as BINDING SITE I, BINDING SITE II or BINDING SITE III. Table 2 illustrates the complementarity of the nucleotide sequences of LOC222233 BINDING SITE, designated SEQ ID:45241, to the nucleotide sequence of VGAM2480 RNA, herein designated VGAM RNA, also designated SEQ ID:5191.

Another function of VGAM2480 is therefore inhibition of LOC222233 (Accession XM_168560). Accordingly, utilities of VGAM2480 include diagnosis, prevention and treatment of diseases and clinical conditions associated with LOC222233. LOC253532 (Accession XM_171152) is another VGAM2480 host target gene. LOC253532 BINDING SITE is HOST TARGET binding site found in the 5' untranslated region of mRNA encoded by LOC253532, corresponding to a HOST TARGET binding site such as BINDING SITE I, BINDING SITE II or BINDING SITE III. Table 2 illustrates the complementarity of the nucleotide sequences of LOC253532 BINDING SITE, designated SEQ ID:45949, to the nucleotide sequence of VGAM2480 RNA, herein designated VGAM RNA, also designated SEQ ID:5191.

Another function of VGAM2480 is therefore inhibition of LOC253532 (Accession XM_171152). Accordingly, utilities of VGAM2480 include diagnosis, prevention and treatment of diseases and clinical conditions associated with LOC253532. LOC254875 (Accession XM_171170) is another VGAM2480 host target gene. LOC254875 BINDING SITE is HOST TARGET binding site found in the 5' untranslated region of mRNA encoded by LOC254875, corresponding to a HOST TARGET binding site such as BINDING SITE I, BINDING SITE II or BINDING SITE III. Table 2 illustrates the complementarity of the nucleotide sequences of LOC254875 BINDING SITE, designated SEQ ID:45953, to the nucleotide sequence of VGAM2480 RNA, herein designated VGAM RNA, also designated SEQ ID:5191.

Another function of VGAM2480 is therefore inhibition of LOC254875 (Accession XM_171170). Accordingly, utilities of VGAM2480 include diagnosis, prevention and treatment of diseases and clinical conditions associated with LOC254875. FIG. 1 further provides a conceptual description of a novel bioinformatically detected viral gene of the present invention, referred to here as Viral Genomic Address Messenger 2481 (VGAM2481) viral gene, which modulates expression of respective host target genes thereof, the function and utility of which host target genes is known in the art.

VGAM2481 is a novel bioinformatically detected regulatory, non protein coding, viral micro RNA (miRNA) gene. The method by which VGAM2481 was detected is described hereinabove with reference to FIGS. 1-8.

VGAM2481 gene, herein designated VGAM GENE, is a viral gene contained in the genome of Mouse Cytomegalovirus 1. VGAM2481 host target gene, herein designated VGAM HOST TARGET GENE, is a human gene contained in the human genome.

VGAM2481 gene encodes a VGAM2481 precursor RNA, herein designated VGAM PRECURSOR RNA. Similar to other miRNA genes, and unlike most ordinary genes, VGAM2481 precursor RNA does not encode a protein. A nucleotide sequence identical or highly similar to the nucleotide sequence of VGAM2481 precursor RNA is designated SEQ ID:2467, and is provided hereinbelow with reference to the sequence listing part. Nucleotide sequence SEQ ID:2467 is located at position 96988 relative to the genome of Mouse Cytomegalovirus 1.

VGAM2481 precursor RNA folds onto itself, forming VGAM2481 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2481 folded precursor RNA into VGAM2481 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 68%) nucleotide sequence of VGAM2481 RNA is designated SEQ ID:5192, and is provided hereinbelow with reference to the sequence listing part.

VGAM2481 host target gene, herein designated VGAM HOST TARGET GENE, encodes a corresponding messenger RNA, VGAM2481 host target RNA, herein designated VGAM HOST TARGET RNA. VGAM2481 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2481 RNA, herein designated VGAM RNA, binds complementarily to one or more host target binding sites located in untranslated regions of VGAM2481 host target RNA, herein designated VGAM HOST TARGET RNA. This complementary binding is due to the fact that the nucleotide sequence of VGAM2481 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2481 RNA, herein designated VGAM RNA, may have a different number of host target binding sites in untranslated regions of a VGAM2481 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2481 RNA, herein designated VGAM RNA, to host target binding sites on VGAM2481 host target RNA, herein designated VGAM HOST TARGET RNA, such as BINDING SITE I, BINDING SITE II and BINDING SITE III, inhibits translation of VGAM2481 host target RNA into VGAM2481 host target protein, herein designated VGAM HOST TARGET PROTEIN. VGAM host target protein is therefore outlined by a broken line.

It is appreciated that VGAM2481 host target gene, herein designated VGAM HOST TARGET GENE, in fact represents a plurality of VGAM2481 host target genes. The mRNA of each one of this plurality of VGAM2481 host target genes comprises one or more host target binding sites, each having a nucleotide sequence which is at least partly complementary to VGAM2481 RNA, herein designated VGAM RNA, and which when bound by VGAM2481 RNA causes inhibition of translation of respective one or more VGAM2481 host target proteins.

It is further appreciated by one skilled in the art that the mode of translational inhibition illustrated by FIG. 1 with specific reference to translational inhibition exerted by VGAM2481 gene, herein designated VGAM GENE, on one or more VGAM2481 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2481 is inhibition of expression of host target genes, as part of a novel viral mechanism of attacking a host. Accordingly, utilities of VGAM2481 include diagnosis, prevention and treatment of viral infection by Mouse Cytomegalovirus 1. Specific functions, and accordingly utilities, of VGAM2481 correlate with, and may be deduced from, the identity of the host target genes which VGAM2481 binds and inhibits, and the function of these host target genes, as elaborated hereinbelow.

Nucleotide sequences of the VGAM2481 precursor RNA, herein designated VGAM PRECURSOR RNA, and of the 'diced' VGAM2481 RNA, herein designated VGAM RNA, and a schematic representation of the secondary folding of VGAM2481 folded precursor RNA, herein designated VGAM FOLDED PRECURSOR RNA, of VGAM2481 are further described hereinbelow with reference to Table 1.

Nucleotide sequences of host target binding sites, such as BINDING SITE-I, BINDING SITE-II and BINDING SITE-III of FIG. 1, found on VGAM2481 host target RNA, and schematic representation of the complementarity of each of these host target binding sites to VGAM2481 RNA, herein designated VGAM RNA, are described hereinbelow with reference to Table 2.

As mentioned hereinabove with reference to FIG. 1, a function of VGAM2481 gene, herein designated VGAM is inhibition of expression of VGAM2481 target genes. It is appreciated that specific functions, and accordingly utilities, of VGAM2481 correlate with, and may be deduced from, the identity of the target genes which VGAM2481 binds and inhibits, and the function of these target genes, as elaborated hereinbelow.

EH-domain Containing 2 (EHD2, Accession NM_014601) is a VGAM2481 host target gene. EHD2 BINDING SITE is HOST TARGET binding site found in the 3' untranslated region of mRNA encoded by EHD2, corresponding to a HOST TARGET binding site such as BINDING SITE I, BINDING SITE II or BINDING SITE III. Table 2 illustrates the complementarity of the nucleotide sequences of EHD2 BINDING SITE, designated SEQ ID:15961, to the nucleotide sequence of VGAM2481 RNA, herein designated VGAM RNA, also designated SEQ ID:5192.

A function of VGAM2481 is therefore inhibition of EH-domain Containing 2 (EHD2, Accession NM_014601). Accordingly, utilities of VGAM2481 include diagnosis, prevention and treatment of diseases and clinical conditions associated with EHD2. NORE1 (Accession NM_031437) is another VGAM2481 host target gene. NORE1 BINDING SITE is HOST TARGET binding site found in the 3' untranslated region of mRNA encoded by NORE1, corresponding to a HOST TARGET binding site such as BINDING SITE I, BINDING SITE II or BINDING SITE III. Table 2 illustrates the complementarity of the nucleotide sequences of NORE1 BINDING SITE, designated SEQ ID:25442, to the nucleotide sequence of VGAM2481 RNA, herein designated VGAM RNA, also designated SEQ ID:5192.

Another function of VGAM2481 is therefore inhibition of NORE1 (Accession NM_031437), a gene which may modulate intracellular signal transduction pathways. Accordingly, utilities of VGAM2481 include diagnosis, prevention and treatment of diseases and clinical conditions associated with NORE1. The function of NORE1 and its association with various diseases and clinical conditions, has been established by previous studies, as described hereinabove with reference to VGAM276. Nuclear Receptor Subfamily 5, Group A, Member 2 (NR5A2, Accession NM_003822) is another VGAM2481 host target gene. NR5A2 BINDING SITE is HOST TARGET binding site found in the 3' untranslated region of mRNA encoded by NR5A2, corresponding to a HOST TARGET binding site such as BINDING SITE I, BINDING SITE II or BINDING SITE III. Table 2 illustrates the complementarity of the nucleotide sequences of NR5A2 BINDING SITE, designated SEQ ID:9913, to the nucleotide sequence of VGAM2481 RNA, herein designated VGAM RNA, also designated SEQ ID:5192.

Another function of VGAM2481 is therefore inhibition of Nuclear Receptor Subfamily 5, Group A, Member 2 (NR5A2, Accession NM_003822), a gene which is a member of nuclear receptor superfamily of trancriptional activators and activates the hepatitis B virus (HBV) promoter. Accordingly, utilities of VGAM2481 include diagnosis, prevention and treatment of diseases and clinical conditions associated with NR5A2. The function of NR5A2 and its association with various diseases and clinical conditions, has been established by previous studies, as described hereinabove with reference to VGAM375. DKFZP566H073 (Accession NM_015528) is another VGAM2481 host target gene. DKFZP566H073 BINDING SITE is HOST TARGET binding site found in the 5' untranslated region of mRNA encoded by DKFZP566H073, corresponding to a HOST TARGET binding site such as BINDING SITE I, BINDING SITE II or BINDING SITE III. Table 2 illustrates the complementarity of the nucleotide sequences of DKFZP566H073 BINDING SITE, designated SEQ ID:17796, to the nucleotide sequence of VGAM2481 RNA, herein designated VGAM RNA, also designated SEQ ID:5192.

Another function of VGAM2481 is therefore inhibition of DKFZP566H073 (Accession NM_015528). Accordingly, utilities of VGAM2481 include diagnosis, prevention and treatment of diseases and clinical conditions associated with DKFZP566H073. FLJ20514 (Accession NM_017856) is another VGAM2481 host target gene. FLJ20514 BINDING SITE is HOST TARGET binding site found in the 5' untranslated region of mRNA encoded by FLJ20514, corresponding to a HOST TARGET binding site such as BINDING SITE I, BINDING SITE II or BINDING SITE III. Table 2 illustrates the complementarity of the nucleotide sequences of FLJ20514 BINDING SITE, designated SEQ ID:19533, to the nucleotide sequence of VGAM2481 RNA, herein designated VGAM RNA, also designated SEQ ID:5192.

Another function of VGAM2481 is therefore inhibition of FLJ20514 (Accession NM_017856). Accordingly, utilities of VGAM2481 include diagnosis, prevention and treatment of diseases and clinical conditions associated with FLJ20514. KIAA1879 (Accession XM_056635) is another VGAM2481 host target gene. KIAA1879 BINDING SITE is HOST TARGET binding site found in the 3' untranslated region of mRNA encoded by KIAA1879, corresponding to a HOST TARGET binding site such as BINDING SITE I, BINDING SITE II or BINDING SITE III. Table 2 illustrates the complementarity of the nucleotide sequences of KIAA1879 BINDING SITE, designated SEQ ID:36413, to the nucleotide sequence of VGAM2481 RNA, herein designated VGAM RNA, also designated SEQ ID:5192.

Another function of VGAM2481 is therefore inhibition of KIAA1879 (Accession XM_056635). Accordingly, utilities of VGAM2481 include diagnosis, prevention and treatment of diseases and clinical conditions associated with KIAA1879. Protein Tyrosine Phosphatase, Non-receptor Type Substrate 1 (PTPNS1, Accession NM_080792) is another VGAM2481 host target gene. PTPNS1 BINDING SITE is HOST TARGET binding site found in the 3' untranslated region of mRNA encoded by PTPNS1, corresponding to a HOST TARGET binding site such as BINDING SITE I, BINDING SITE II or BINDING SITE III. Table 2 illustrates the complementarity of the nucleotide sequences of PTPNS1 BINDING SITE, designated SEQ ID:28053, to the nucleotide sequence of VGAM2481 RNA, herein designated VGAM RNA, also designated SEQ ID:5192.

Another function of VGAM2481 is therefore inhibition of Protein Tyrosine Phosphatase, Non-receptor Type Substrate 1 (PTPNS1, Accession NM_080792). Accordingly, utilities of VGAM2481 include diagnosis, prevention and treatment of diseases and clinical conditions associated with PTPNS1. LOC124930 (Accession XM_058867) is another VGAM2481 host target gene. LOC124930 BINDING SITE is HOST TARGET binding site found in the 5' untranslated region of mRNA encoded by LOC124930, corresponding to a HOST TARGET binding site such as BINDING SITE I, BINDING SITE II or BINDING SITE III. Table 2 illustrates the complementarity of the nucleotide sequences of LOC124930 BINDING SITE, designated SEQ ID:36768, to the nucleotide sequence of VGAM2481 RNA, herein designated VGAM RNA, also designated SEQ ID:5192.

Another function of VGAM2481 is therefore inhibition of LOC124930 (Accession XM_058867). Accordingly, utilities of VGAM2481 include diagnosis, prevention and treatment of diseases and clinical conditions associated with LOC124930. LOC147160 (Accession XM_097202) is another VGAM2481 host target gene. LOC147160 BINDING SITE is HOST TARGET binding site found in the 5' untranslated region of mRNA encoded by LOC147160, corresponding to a HOST TARGET binding site such as BINDING SITE I, BINDING SITE II or BINDING SITE III. Table 2 illustrates the complementarity of the nucleotide sequences of LOC147160 BINDING SITE, designated SEQ ID:40808, to the nucleotide sequence of VGAM2481 RNA, herein designated VGAM RNA, also designated SEQ ID:5192.

Another function of VGAM2481 is therefore inhibition of LOC147160 (Accession XM_097202). Accordingly, utilities of VGAM2481 include diagnosis, prevention and treatment of diseases and clinical conditions associated with LOC147160. LOC147669 (Accession XM_097262) is another VGAM2481 host target gene. LOC147669 BINDING SITE is HOST TARGET binding site found in the 5' untranslated region of mRNA encoded by LOC147669, corresponding to a HOST TARGET binding site such as BINDING SITE I, BINDING SITE II or BINDING SITE III. Table 2 illustrates the complementarity of the nucleotide sequences of LOC147669 BINDING SITE, designated SEQ ID:40854, to the nucleotide sequence of VGAM2481 RNA, herein designated VGAM RNA, also designated SEQ ID:5192.

Another function of VGAM2481 is therefore inhibition of LOC147669 (Accession XM_097262). Accordingly, utilities of VGAM2481 include diagnosis, prevention and treatment of diseases and clinical conditions associated with LOC147669. LOC163682 (Accession XM_099402) is another VGAM2481 host target gene. LOC163682 BINDING SITE is HOST TARGET binding site found in the 3' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42094, to the nucleotide sequence of VGAM2481 RNA, herein designated VGAM RNA, also designated SEQ ID:5192.

Another function of VGAM2481 is therefore inhibition of LOC163682 (Accession XM_099402). Accordingly, utilities of VGAM2481 include diagnosis, prevention and treatment of diseases and clinical conditions associated with LOC163682. LOC90342 (Accession XM_031009) is another VGAM2481 host target gene. LOC90342 BINDING SITE is HOST TARGET binding site found in the 5' untranslated region of mRNA encoded by LOC90342, corresponding to a HOST TARGET binding site such as BINDING SITE I, BINDING SITE II or BINDING SITE III. Table 2 illustrates the complementarity of the nucleotide sequences of LOC90342 BINDING SITE, designated SEQ ID:31250, to the nucleotide sequence of VGAM2481 RNA, herein designated VGAM RNA, also designated SEQ ID:5192.

Another function of VGAM2481 is therefore inhibition of LOC90342 (Accession XM_031009). Accordingly, utilities of VGAM2481 include diagnosis, prevention and treatment of diseases and clinical conditions associated with LOC90342. FIG. 1 further provides a conceptual description of a novel bioinformatically detected viral gene of the present invention, referred to here as Viral Genomic Address Messenger 2482 (VGAM2482) viral gene, which modulates expression of respective host target genes thereof, the function and utility of which host target genes is known in the art.

VGAM2482 is a novel bioinformatically detected regulatory, non protein coding, viral micro RNA (miRNA) gene. The method by which VGAM2482 was detected is described hereinabove with reference to FIGS. 1-8.

VGAM2482 gene, herein designated VGAM GENE, is a viral gene contained in the genome of Mouse Cytomegalovirus 1. VGAM2482 host target gene, herein designated VGAM HOST TARGET GENE, is a human gene contained in the human genome.

VGAM2482 gene encodes a VGAM2482 precursor RNA, herein designated VGAM PRECURSOR RNA. Similar to other miRNA genes, and unlike most ordinary genes, VGAM2482 precursor RNA does not encode a protein. A nucleotide sequence identical or highly similar to the nucleotide sequence of VGAM2482 precursor RNA is designated SEQ ID:2468, and is provided hereinbelow with reference to the sequence listing part. Nucleotide sequence SEQ ID:2468 is located at position 182861 relative to the genome of Mouse Cytomegalovirus 1.

VGAM2482 precursor RNA folds onto itself, forming VGAM2482 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2482 folded precursor RNA into VGAM2482 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2482 RNA is designated SEQ ID:5193, and is provided hereinbelow with reference to the sequence listing part.

VGAM2482 host target gene, herein designated VGAM HOST TARGET GENE, encodes a corresponding messenger RNA, VGAM2482 host target RNA, herein designated VGAM HOST TARGET RNA. VGAM2482 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2482 RNA, herein designated VGAM RNA, binds complementarily to one or more host target binding sites located in untranslated regions of VGAM2482 host target RNA, herein designated VGAM HOST TARGET RNA. This complementary binding is due to the fact that the nucleotide sequence of VGAM2482 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2482 RNA, herein designated VGAM RNA, may have a different number of host target binding sites in untranslated regions of a VGAM2482 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2482 RNA, herein designated VGAM RNA, to host target binding sites on VGAM2482 host target RNA, herein designated VGAM HOST TARGET RNA, such as BINDING SITE I, BINDING SITE II and BINDING SITE III, inhibits translation of VGAM2482 host target RNA into VGAM2482 host target protein, herein designated VGAM HOST TARGET PROTEIN. VGAM host target protein is therefore outlined by a broken line.

It is appreciated that VGAM2482 host target gene, herein designated VGAM HOST TARGET GENE, in fact represents a plurality of VGAM2482 host target genes. The mRNA of each one of this plurality of VGAM2482 host target genes comprises one or more host target binding sites, each having a nucleotide sequence which is at least partly complementary to VGAM2482 RNA, herein designated VGAM RNA, and which when bound by VGAM2482 RNA causes inhibition of translation of respective one or more VGAM2482 host target proteins.

It is further appreciated by one skilled in the art that the mode of translational inhibition illustrated by FIG. 1 with specific reference to translational inhibition exerted by VGAM2482 gene, herein designated VGAM GENE, on one or more VGAM2482 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2482 is inhibition of expression of host target genes, as part of a novel viral mechanism of attacking a host. Accordingly, utilities of VGAM2482 include diagnosis, prevention and treatment of viral infection by Mouse Cytomegalovirus 1. Specific functions, and accordingly utilities, of VGAM2482 correlate with, and may be deduced from, the identity of the host target genes which VGAM2482 binds and inhibits, and the function of these host target genes, as elaborated hereinbelow.

Nucleotide sequences of the VGAM2482 precursor RNA, herein designated VGAM PRECURSOR RNA, and of the 'diced' VGAM2482 RNA, herein designated VGAM RNA, and a schematic representation of the secondary folding of VGAM2482 folded precursor RNA, herein designated VGAM FOLDED PRECURSOR RNA, of VGAM2482 are further described hereinbelow with reference to Table 1.

Nucleotide sequences of host target binding sites, such as BINDING SITE-I, BINDING SITE-II and BINDING SITE-III of FIG. 1, found on VGAM2482 host target RNA, and schematic representation of the complementarity of each of these host target binding sites to VGAM2482 RNA, herein designated VGAM RNA, are described hereinbelow with reference to Table 2.

As mentioned hereinabove with reference to FIG. 1, a function of VGAM2482 gene, herein designated VGAM is inhibition of expression of VGAM2482 target genes. It is appreciated that specific functions, and accordingly utilities, of VGAM2482 correlate with, and may be deduced from, the identity of the target genes which VGAM2482 binds and inhibits, and the function of these target genes, as elaborated hereinbelow.

DiGeorge Syndrome Critical Region Gene 2 (DGCR2, Accession NM_005137) is a VGAM2482 host target gene. DGCR2 BINDING SITE is HOST TARGET binding site found in the 3' untranslated region of mRNA encoded by DGCR2, corresponding to a HOST TARGET binding site such as BINDING SITE I, BINDING SITE II or BINDING SITE III. Table 2 illustrates the complementarity of the nucleotide sequences of DGCR2 BINDING SITE, designated SEQ ID:11614, to the nucleotide sequence of VGAM2482 RNA, herein designated VGAM RNA, also designated SEQ ID:5193.

A function of VGAM2482 is therefore inhibition of DiGeorge Syndrome Critical Region Gene 2 (DGCR2, Accession NM_005137), a gene which could intervene in cell-cell or cell-matrix interactions. Accordingly, utilities of VGAM2482 include diagnosis, prevention and treatment of diseases and clinical conditions associated with DGCR2. The function of DGCR2 and its association with various diseases and clinical conditions, has been established by previous studies, as described hereinabove with reference to VGAM1485. Arginyl Aminopeptidase (aminopeptidase B)-like 1 (RNPEPL1, Accession NM_018226) is another VGAM2482 host target gene. RNPEPL1 BINDING SITE is HOST TARGET binding site found in the 3' untranslated region of mRNA encoded by RNPEPL1, corresponding to a HOST TARGET binding site such as BINDING SITE I, BINDING SITE II or BINDING SITE III. Table 2 illustrates the complementarity of the nucleotide sequences of RNPEPL1 BINDING SITE, designated SEQ ID:20161, to the nucleotide sequence of VGAM2482 RNA, herein designated VGAM RNA, also designated SEQ ID:5193.

Another function of VGAM2482 is therefore inhibition of Arginyl Aminopeptidase (aminopeptidase B)-like 1 (RNPEPL1, Accession NM_018226). Accordingly, utilities of VGAM2482 include diagnosis, prevention and treatment of diseases and clinical conditions associated with RNPEPL1. Cyclin M1 (CNNM1, Accession NM_020348) is another VGAM2482 host target gene. CNNM1 BINDING SITE is HOST TARGET binding site found in the 3' untranslated region of mRNA encoded by CNNM1, corresponding to a HOST TARGET binding site such as BINDING SITE I, BINDING SITE II or BINDING SITE III. Table 2 illustrates the complementarity of the nucleotide sequences of CNNM1 BINDING SITE, designated SEQ ID:21608, to the nucleotide sequence of VGAM2482 RNA, herein designated VGAM RNA, also designated SEQ ID:5193.

Another function of VGAM2482 is therefore inhibition of Cyclin M1 (CNNM1, Accession NM_020348). Accordingly, utilities of VGAM2482 include diagnosis, prevention and treatment of diseases and clinical conditions associated with CNNM1. DKFZP564D166 (Accession NM_030658) is another VGAM2482 host target gene. DKFZP564D166 BINDING SITE is HOST TARGET binding site found in the 3' untranslated region of mRNA encoded by DKFZP564D166, corresponding to a HOST TARGET binding site such as BINDING SITE I, BINDING SITE II or BINDING SITE III. Table 2 illustrates the complementarity of the nucleotide sequences of DKFZP564D166 BINDING SITE, designated SEQ ID:24991, to the nucleotide sequence of VGAM2482 RNA, herein designated VGAM RNA, also designated SEQ ID:5193.

Another function of VGAM2482 is therefore inhibition of DKFZP564D166 (Accession NM_030658). Accordingly, utilities of VGAM2482 include diagnosis, prevention and treatment of diseases and clinical conditions associated with DKFZP564D166. FLJ12057 (Accession NM_024768) is another VGAM2482 host target gene. FLJ12057 BINDING SITE is HOST TARGET binding site found in the 3' untranslated region of mRNA encoded by FLJ12057, corresponding to a HOST TARGET binding site such as BINDING SITE I, BINDING SITE II or BINDING SITE III. Table 2 illustrates the complementarity of the nucleotide sequences of FLJ12057 BINDING SITE, designated SEQ ID:24125, to the nucleotide sequence of VGAM2482 RNA, herein designated VGAM RNA, also designated SEQ ID:5193.

Another function of VGAM2482 is therefore inhibition of FLJ12057 (Accession NM_024768). Accordingly, utilities of VGAM2482 include diagnosis, prevention and treatment of diseases and clinical conditions associated with FLJ12057. SS-56 (Accession XM_006063) is another VGAM2482 host target gene. SS-56 BINDING SITE is HOST TARGET binding site found in the 3' untranslated region of mRNA encoded by SS-56, corresponding to a HOST TARGET binding site such as BINDING SITE I, BINDING SITE II or BINDING SITE III. Table 2 illustrates the complementarity of the nucleotide sequences of SS-56 BINDING SITE, designated SEQ ID:29989, to the nucleotide sequence of VGAM2482 RNA, herein designated VGAM RNA, also designated SEQ ID:5193.

Another function of VGAM2482 is therefore inhibition of SS-56 (Accession XM_006063). Accordingly, utilities of VGAM2482 include diagnosis, prevention and treatment of diseases and clinical conditions associated with SS-56. LOC147515 (Accession XM_097243) is another VGAM2482 host target gene. LOC147515 BINDING SITE is HOST TARGET binding site found in the 5' untranslated region of mRNA encoded by LOC147515, corresponding to a HOST TARGET binding site such as BINDING SITE I, BINDING SITE II or BINDING SITE III. Table 2 illustrates the complementarity of the nucleotide sequences of LOC147515 BINDING SITE, designated SEQ ID:40842, to the nucleotide sequence of VGAM2482 RNA, herein designated VGAM RNA, also designated SEQ ID:5193.

Another function of VGAM2482 is therefore inhibition of LOC147515 (Accession XM_097243). Accordingly, utilities of VGAM2482 include diagnosis, prevention and treatment of diseases and clinical conditions associated with LOC147515. LOC92841 (Accession XM_047583) is another VGAM2482 host target gene. LOC92841 BINDING SITE is HOST TARGET binding site found in the 5' untranslated region of mRNA encoded by LOC92841, corresponding to a HOST TARGET binding site such as BINDING SITE I, BINDING SITE II or BINDING SITE III. Table 2 illustrates the complementarity of the nucleotide sequences of LOC92841 BINDING SITE, designated SEQ ID:35003, to the nucleotide sequence of VGAM2482 RNA, herein designated VGAM RNA, also designated SEQ ID:5193.

Another function of VGAM2482 is therefore inhibition of LOC92841 (Accession XM_047583). Accordingly, utilities of VGAM2482 include diagnosis, prevention and treatment of diseases and clinical conditions associated with LOC92841. FIG. 1 further provides a conceptual description of a novel bioinformatically detected viral gene of the present invention, referred to here as Viral Genomic Address Messenger 2483 (VGAM2483) viral gene, which modulates expression of respective host target genes thereof, the function and utility of which host target genes is known in the art.

VGAM2483 is a novel bioinformatically detected regulatory, non protein coding, viral micro RNA (miRNA) gene. The method by which VGAM2483 was detected is described hereinabove with reference to FIGS. 1-8.

VGAM2483 gene, herein designated VGAM GENE, is a viral gene contained in the genome of Mouse Cytomegalovirus 1. VGAM2483 host target gene, herein designated VGAM HOST TARGET GENE, is a human gene contained in the human genome.

VGAM2483 gene encodes a VGAM2483 precursor RNA, herein designated VGAM PRECURSOR RNA. Similar to other miRNA genes, and unlike most ordinary genes, VGAM2483 precursor RNA does not encode a protein. A nucleotide sequence identical or highly similar to the nucleotide sequence of VGAM2483 precursor RNA is designated SEQ ID:2469, and is provided hereinbelow with reference to the sequence listing part. Nucleotide sequence SEQ ID:2469 is located at position 166603 relative to the genome of Mouse Cytomegalovirus 1.

VGAM2483 precursor RNA folds onto itself, forming VGAM2483 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2483 folded precursor RNA into VGAM2483 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2483 RNA is designated SEQ ID:5194, and is provided hereinbelow with reference to the sequence listing part.

VGAM2483 host target gene, herein designated VGAM HOST TARGET GENE, encodes a corresponding messenger RNA, VGAM2483 host target RNA, herein designated VGAM HOST TARGET RNA. VGAM2483 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2483 RNA, herein designated VGAM RNA, binds complementarily to one or more host target binding sites located in untranslated regions of VGAM2483 host target RNA, herein designated VGAM HOST TARGET RNA. This complementary binding is due to the fact that the nucleotide sequence of VGAM2483 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2483 RNA, herein designated VGAM RNA, may have a different number of host target binding sites in untranslated regions of a VGAM2483 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2483 RNA, herein designated VGAM RNA, to host target binding sites on VGAM2483 host target RNA, herein designated VGAM HOST TARGET RNA, such as BINDING SITE I, BINDING SITE II and BINDING SITE III, inhibits translation of VGAM2483 host target RNA into VGAM2483 host target protein, herein designated VGAM HOST TARGET PROTEIN. VGAM host target protein is therefore outlined by a broken line.

It is appreciated that VGAM2483 host target gene, herein designated VGAM HOST TARGET GENE, in fact represents a plurality of VGAM2483 host target genes. The mRNA of each one of this plurality of VGAM2483 host target genes comprises one or more host target binding sites, each having a nucleotide sequence which is at least partly complementary to VGAM2483 RNA, herein designated VGAM RNA, and which when bound by VGAM2483 RNA causes inhibition of translation of respective one or more VGAM2483 host target proteins.

It is further appreciated by one skilled in the art that the mode of translational inhibition illustrated by FIG. 1 with specific reference to translational inhibition exerted by VGAM2483 gene, herein designated VGAM GENE, on one or more VGAM2483 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2483 is inhibition of expression of host target genes, as part of a novel viral mechanism of attacking a host. Accordingly, utilities of VGAM2483 include diagnosis, prevention and treatment of viral infection by Mouse Cytomegalovirus 1. Specific functions, and accordingly utilities, of VGAM2483 correlate with, and may be deduced from, the identity of the host target genes which VGAM2483 binds and inhibits, and the function of these host target genes, as elaborated hereinbelow.

Nucleotide sequences of the VGAM2483 precursor RNA, herein designated VGAM PRECURSOR RNA, and of the 'diced' VGAM2483 RNA, herein designated VGAM RNA, and a schematic representation of the secondary folding of VGAM2483 folded precursor RNA, herein designated VGAM FOLDED PRECURSOR RNA, of VGAM2483 are further described hereinbelow with reference to Table 1.

Nucleotide sequences of host target binding sites, such as BINDING SITE-I, BINDING SITE-II and BINDING SITE-III of FIG. 1, found on VGAM2483 host target RNA, and schematic representation of the complementarity of each of these host target binding sites to VGAM2483 RNA, herein designated VGAM RNA, are described hereinbelow with reference to Table 2.

As mentioned hereinabove with reference to FIG. 1, a function of VGAM2483 gene, herein designated VGAM is inhibition of expression of VGAM2483 target genes. It is appreciated that specific functions, and accordingly utilities, of VGAM2483 correlate with, and may be deduced from, the identity of the target genes which VGAM2483 binds and inhibits, and the function of these target genes, as elaborated hereinbelow.

BTG Family, Member 2 (BTG2, Accession NM_006763) is a VGAM2483 host target gene. BTG2 BINDING SITE is HOST TARGET binding site found in the 3' untranslated region of mRNA encoded by BTG2, corresponding to a HOST TARGET binding site such as BINDING SITE I, BINDING SITE II or BINDING SITE III. Table 2 illustrates the complementarity of the nucleotide sequences of BTG2 BINDING SITE, designated SEQ ID:13628, to the nucleotide sequence of VGAM2483 RNA, herein designated VGAM RNA, also designated SEQ ID:5194.

A function of VGAM2483 is therefore inhibition of BTG Family, Member 2 (BTG2, Accession NM_006763). Accordingly, utilities of VGAM2483 include diagnosis, prevention and treatment of diseases and clinical conditions associated with BTG2. CDP-diacylglycerol Synthase (phosphatidate cytidylyltransferase) 2 (CDS2, Accession NM_003818) is another VGAM2483 host target gene. CDS2 BINDING SITE is HOST TARGET binding site found in the 3' untranslated region of mRNA encoded by CDS2, corresponding to a HOST TARGET binding site such as BINDING SITE I, BINDING SITE II or BINDING SITE III. Table 2 illustrates the complementarity of the nucleotide sequences of CDS2 BINDING SITE, designated SEQ ID:9911, to the nucleotide sequence of VGAM2483 RNA, herein designated VGAM RNA, also designated SEQ ID:5194.

Another function of VGAM2483 is therefore inhibition of CDP-diacylglycerol Synthase (phosphatidate cytidylyltransferase) 2 (CDS2, Accession NM_003818), a gene which is a key regulator of the amount of PIP2 available for signaling. Accordingly, utilities of VGAM2483 include diagnosis, prevention and treatment of diseases and clinical conditions associated with CDS2. The function of CDS2 and its association with various diseases and clinical conditions, has been established by previous studies, as described hereinabove with reference to VGAM900. Fibulin 1 (FBLN1, Accession NM_006485) is another VGAM2483 host target gene. FBLN1 BINDING SITE is HOST TARGET binding site found in the 3' untranslated region of mRNA encoded by FBLN1, corresponding to a HOST TARGET binding site such as BINDING SITE I, BINDING SITE II or BINDING SITE III. Table 2 illustrates the complementarity of the nucleotide sequences of FBLN1 BINDING SITE, designated SEQ ID:13212, to the nucleotide sequence of VGAM2483 RNA, herein designated VGAM RNA, also designated SEQ ID:5194.

Another function of VGAM2483 is therefore inhibition of Fibulin 1 (FBLN1, Accession NM_006485), a gene which secreted glycoprotein; has EGF-like repeats, similar to anaphylatoxins C3a, C4a, and C5a. Accordingly, utilities of VGAM2483 include diagnosis, prevention and treatment of diseases and clinical conditions associated with FBLN1. The function of FBLN1 and its association with various diseases and clinical conditions, has been established by previous studies, as described hereinabove with reference to VGAM1770. Glycyl-tRNA Synthetase (GARS, Accession NM_002047) is another VGAM2483 host target gene. GARS BINDING SITE is HOST TARGET binding site found in the 5' untranslated region of mRNA encoded by GARS, corresponding to a HOST TARGET binding site such as BINDING SITE I, BINDING SITE II or BINDING SITE III. Table 2 illustrates the complementarity of the nucleotide sequences of GARS BINDING SITE, designated SEQ ID:7797, to the nucleotide sequence of VGAM2483 RNA, herein designated VGAM RNA, also designated SEQ ID:5194.

Another function of VGAM2483 is therefore inhibition of Glycyl-tRNA Synthetase (GARS, Accession NM_002047), a gene which functions in protein biosynthesis. Accordingly, utilities of VGAM2483 include diagnosis, prevention and treatment of diseases and clinical conditions associated with GARS. The function of GARS and its association with various diseases and clinical conditions, has been established by previous studies, as described hereinabove with reference to VGAM113. Glyoxalase I (GLO1, Accession NM_006708) is another VGAM2483 host target gene. GLO1 BINDING SITE is HOST TARGET binding site found in the 3' untranslated region of mRNA encoded by GLO1, corresponding to a HOST TARGET binding site such as BINDING SITE I, BINDING SITE II or BINDING SITE III. Table 2 illustrates the complementarity of the nucleotide sequences of GLO1 BINDING SITE, designated SEQ ID:13532, to the nucleotide sequence of VGAM2483 RNA, herein designated VGAM RNA, also designated SEQ ID:5194.

Another function of VGAM2483 is therefore inhibition of Glyoxalase I (GLO1, Accession NM_006708), a gene which converts methylglyoxal and glutathione to S-lactoylglutathione. Accordingly, utilities of VGAM2483 include diagnosis, prevention and treatment of diseases and clinical conditions associated with GLO1. The function of GLO1 and its association with various diseases and clinical conditions, has been established by previous studies, as described hereinabove with reference to VGAM786. Matrilin 1, Cartilage Matrix Protein (MATN1, Accession NM_002379) is another VGAM2483 host target gene. MATN1 BINDING SITE is HOST TARGET binding site found in the 5' untranslated region of mRNA encoded by MATN1, corresponding to a HOST TARGET binding site such as BINDING SITE I, BINDING SITE II or BINDING SITE III. Table 2 illustrates the complementarity of the nucleotide sequences of MATN1 BINDING SITE, designated SEQ ID:8195, to the nucleotide sequence of VGAM2483 RNA, herein designated VGAM RNA, also designated SEQ ID:5194.

Another function of VGAM2483 is therefore inhibition of Matrilin 1, Cartilage Matrix Protein (MATN1, Accession NM_002379), a gene which a major component of the extracellular matrix of nonarticular cartilage. Accordingly, utilities of VGAM2483 include diagnosis, prevention and treatment of diseases and clinical conditions associated with MATN1. The function of MATN1 has been established by previous studies. Cartilage matrix protein is a major component of the extracellular matrix of nonarticular cartilage. Jenkins et al. (1990) used a partial chicken CMP cDNA probe to isolate 3 overlapping human genomic clones. From one of these clones, a probe containing 2 human CMP exons was isolated and used to map the gene to 1p35 by a combination of Southern blot analysis of somatic cell hybrids and in situ chromosomal hybridization. The genomic probe was also used to screen a human retina cDNA library. The protein sequence predicted by the cDNA clones has 496 amino acids, including a 22-residue signal peptide. The structure of the CMP gene (also symbolized CRTM) and polypeptide were strikingly similar in the chicken and in the human. The human gene spans 12 kb and has 8 exons and 7 introns. By linkage studies, Loughlin et al. (1994) demonstrated that the CRTM gene segregated independently of several heritable chondrodysplasias: hypochondroplasia, achondroplasia, autosomal dominant SED tarda, and multiple epiphyseal dysplasia. CMP was alternatively named matrilin-1 by Deak et al. (1997) when they discovered matrilin-2 (OMIM Ref. No. 602108). Wagener et al. (1997) found that matrilin-1 is a trimer of identical ellipsoid subunits assembled via their C-terminal extension domains in a coiled-coil alpha-helix. The matrilins, including matrilin-2 and matrilin-3 (OMIM Ref. No. 602109), represent a subfamily of extracellular matrix proteins containing the von Willebrand factor type A (vWFA)-like domain. (The vWFA-like domain was first described in von Willebrand factor (OMIM Ref. No. 193400) where it plays a key role in promoting platelet adhesion to the subendothelin. Several vWFA-like domains have been implicated in interactions with collagen.) In some patients with rheumatoid arthritis (RA; 180300) and relapsing polychondritis (RP), an immune response against cartilage collagen II can be detected. However, study of responses against noncollagenous components of cartilage are limited. If an autoimmune response to cartilage proteins is involved in RA and RP, the different patterns of the affected tissues can best be explained if the respective targets are proteins with specific tissue distributions. Whereas RA preferentially affects diarthrodial joints, RP is characterized by inflammatory attacks on cartilage in different organs, and, preferentially, in the perichondrial layer of cartilage. The inflammatory infiltrates consist of neutrophils, lymphocytes, macrophages, and plasma cells. In early lesions, eosinophils can be observed close to the affected cartilage. A classic appearance of the patient with RP is 'saddle nose,' caused by erosive inflammation of the nasal septum. Another typical symptom is an inflamed external ear (89% of cases), which in some instances leads to ossified ear cartilages (OMIM Ref. No. 165670). Occasionally, joints are affected as a seronegative nonerosive arthritis. The most serious complication of RP is the involvement of the laryngotracheal cartilage, sometimes leading to lethal breathing difficulties. Early signs of airway involvement are cough, dysphonia, and tenderness over the thyroid cartilage. Remarkably, RP is associated with the same HLA haplotype (DR4) as RA, which carries with it approximately the same relative risk (Zeuner et al., 1997; Lang et al., 1993). To investigate whether the tissue distribution of relapsing polychondritis may be explained by a specific immune response, Hansson et al. (1999) immunized rats with matrilin-1, which is expressed predominantly in tracheal cartilage. After 2 to 3 weeks, some rats developed severe inspiratory stridor. They had swollen noses and/or epistaxis, but showed neither joint nor outer ear affection. The inflammatory lesions involved chronic active erosions of cartilage. Female rats were more susceptible than males. The disease susceptibility was controlled by MHC genes, some haplotypes being high responders and others resistant, and by non-MHC genes as well, as indicated by strain differences (the LEW strain was susceptible, and the DA strain resistant). All strains mounted a pronounced IgG response to matrilin-1. The findings suggested that different cartilage proteins are involved in pathogenic models of RP and RA.

Full details of the abovementioned studies are described in the following publications, the disclosure of which are hereby incorporated by reference:

Jenkins, R. N.; Osborne-Lawrence, S. L.; Sinclair, A. K.; Eddy, R. L., Jr.; Byers, M. G.; Shows, T. B.; Duby, A. D.: Structure and chromosomal location of the human gene encoding cartilage matrix protein. J. Biol. Chem. 265:19624-19631, 1990; and Deak, F.; Piecha, D.; Bachrati, C.; Paulsson, M.; Kiss, I.: Primary structure and expression of matrilin-2, the closest relative of cartilage matrix protein within the von Willebrand fa.

Further studies establishing the function and utilities of MATN1 are found in John Hopkins OMIM database record ID 115437, and in sited publications numbered 12587-12591, 1258 and 12592-12594 listed in the bibliography section hereinbelow, which are also hereby incorporated by reference. Proteoglycan 1, Secretory Granule (PRG1, Accession NM_002727) is another VGAM2483 host target gene. PRG1 BINDING SITE is HOST TARGET binding site found in the 3' untranslated region of mRNA encoded by PRG1, corresponding to a HOST TARGET binding site such as BINDING SITE I, BINDING SITE II or BINDING SITE III. Table 2 illustrates the complementarity of the nucleotide sequences of PRG1 BINDING SITE, designated SEQ ID:8591, to the nucleotide sequence of VGAM2483 RNA, herein designated VGAM RNA, also designated SEQ ID:5194.

Another function of VGAM2483 is therefore inhibition of Proteoglycan 1, Secretory Granule (PRG1, Accession NM_002727), a gene which protects cells from apoptosis induced by FAS or TNFA. Accordingly, utilities of VGAM2483 include diagnosis, prevention and treatment of diseases and clinical conditions associated with PRG1. The function of PRG1 and its association with various diseases and clinical conditions, has been established by previous studies, as described hereinabove with reference to VGAM2465. Pituitary Tumor-transforming 1 Interacting Protein (PTTG1IP, Accession NM_004339) is another VGAM2483 host target gene. PTTG1IP BINDING SITE is HOST TARGET binding site found in the 3' untranslated region of mRNA encoded by PTTG1IP, corresponding to a HOST TARGET binding site such as BINDING SITE I, BINDING SITE II or BINDING SITE III. Table 2 illustrates the complementarity of the nucleotide sequences of PTTG1IP BINDING SITE, designated SEQ ID:10536, to the nucleotide sequence of VGAM2483 RNA, herein designated VGAM RNA, also designated SEQ ID:5194.

Another function of VGAM2483 is therefore inhibition of Pituitary Tumor-transforming 1 Interacting Protein (PTTG1IP, Accession NM_004339), a gene which facilitates the translocation of PTTG to the nucleus. Accordingly, utilities of VGAM2483 include diagnosis, prevention and treatment of diseases and clinical conditions associated with PTTG1IP. The function of PTTG1IP and its association with various diseases and clinical conditions, has been established by previous studies, as described hereinabove with reference to VGAM131. WTAP (Accession NM_004906) is another VGAM2483 host target gene. WTAP BINDING SITE is HOST TARGET binding site found in the 3' untranslated region of mRNA encoded by WTAP, corresponding to a HOST TARGET binding site such as BINDING SITE I, BINDING SITE II or BINDING SITE III. Table 2 illustrates the complementarity of the nucleotide sequences of WTAP BINDING SITE, designated SEQ ID:11345, to the nucleotide sequence of VGAM2483 RNA, herein designated VGAM RNA, also designated SEQ ID:5194.

Another function of VGAM2483 is therefore inhibition of WTAP (Accession NM_004906), a gene which plays a role in both transcriptional and posttranscriptional regulation of certain cellular genes. Accordingly, utilities of VGAM2483 include diagnosis, prevention and treatment of diseases and clinical conditions associated with WTAP. The function of WTAP and its association with various diseases and clinical conditions, has been established by previous studies, as described hereinabove with reference to VGAM874. Cystatin F (leukocystatin) (CST7, Accession NM_003650) is another VGAM2483 host target gene. CST7 BINDING SITE is HOST TARGET binding site found in the 5' untranslated region of mRNA encoded by CST7, corresponding to a HOST TARGET binding site such as BINDING SITE I, BINDING SITE II or BINDING SITE III. Table 2 illustrates the complementarity of the nucleotide sequences of CST7 BINDING SITE, designated SEQ ID:9726, to the nucleotide sequence of VGAM2483 RNA, herein designated VGAM RNA, also designated SEQ ID:5194.

Another function of VGAM2483 is therefore inhibition of Cystatin F (leukocystatin) (CST7, Accession NM_003650). Accordingly, utilities of VGAM2483 include diagnosis, prevention and treatment of diseases and clinical conditions associated with CST7. Cytochrome P450, Subfamily IIS, Polypeptide 1 (CYP2S1, Accession NM_030622) is another VGAM2483 host target gene. CYP2S1 BINDING SITE is HOST TARGET binding site found in the 3' untranslated region of mRNA encoded by CYP2S1, corresponding to a HOST TARGET binding site such as BINDING SITE I, BINDING SITE II or BINDING SITE III. Table 2 illustrates the complementarity of the nucleotide sequences of CYP2S1 BINDING SITE, designated SEQ ID:24965, to the nucleotide sequence of VGAM2483 RNA, herein designated VGAM RNA, also designated SEQ ID:5194.

Another function of VGAM2483 is therefore inhibition of Cytochrome P450, Subfamily IIS, Polypeptide 1 (CYP2S1, Accession NM_030622). Accordingly, utilities of VGAM2483 include diagnosis, prevention and treatment of diseases and clinical conditions associated with CYP2S1. DKFZP564I0422 (Accession NM_031435) is another VGAM2483 host target gene. DKFZP564I0422 BINDING SITE is HOST TARGET binding site found in the 3' untranslated region of mRNA encoded by DKFZP564I0422, corresponding to a HOST TARGET binding site such as BINDING SITE I, BINDING SITE II or BINDING SITE III. Table 2 illustrates the complementarity of the nucleotide sequences of DKFZP564I0422 BINDING SITE, designated SEQ ID:25436, to the nucleotide sequence of VGAM2483 RNA, herein designated VGAM RNA, also designated SEQ ID:5194.

Another function of VGAM2483 is therefore inhibition of DKFZP564I0422 (Accession NM_031435). Accordingly, utilities of VGAM2483 include diagnosis, prevention and treatment of diseases and clinical conditions associated with DKFZP564I0422. Dedicator of Cyto-kinesis 3 (DOCK3, Accession XM_039259) is another VGAM2483 host target gene. DOCK3 BINDING SITE is HOST TARGET binding site found in the 3' untranslated region of mRNA encoded by DOCK3, corresponding to a HOST TARGET binding site such as BINDING SITE I, BINDING SITE II or BINDING SITE III. Table 2 illustrates the complementarity of the nucleotide sequences of DOCK3 BINDING SITE, designated SEQ ID:33037, to the nucleotide sequence of VGAM2483 RNA, herein designated VGAM RNA, also designated SEQ ID:5194.

Another function of VGAM2483 is therefore inhibition of Dedicator of Cyto-kinesis 3 (DOCK3, Accession XM_039259). Accordingly, utilities of VGAM2483 include diagnosis, prevention and treatment of diseases and clinical conditions associated with DOCK3. FLJ11259 (Accession NM_018370) is another VGAM2483 host target gene. FLJ11259 BINDING SITE is HOST TARGET binding site found in the 3' untranslated region of mRNA encoded by FLJ11259, corresponding to a HOST TARGET binding site such as BINDING SITE I, BINDING SITE II or BINDING SITE III. Table 2 illustrates the complementarity of the nucleotide sequences of FLJ11259 BINDING SITE, designated SEQ ID:20385, to the nucleotide sequence of VGAM2483 RNA, herein designated VGAM RNA, also designated SEQ ID:5194.

Another function of VGAM2483 is therefore inhibition of FLJ11259 (Accession NM_018370). Accordingly, utilities of VGAM2483 include diagnosis, prevention and treatment of diseases and clinical conditions associated with FLJ11259.

FLJ13197 (Accession NM_024614) is another VGAM2483 host target gene. FLJ13197 BINDING SITE is HOST TARGET binding site found in the 3' untranslated region of mRNA encoded by FLJ13197, corresponding to a HOST TARGET binding site such as BINDING SITE I, BINDING SITE II or BINDING SITE III. Table 2 illustrates the complementarity of the nucleotide sequences of FLJ13197 BINDING SITE, designated SEQ ID:23874, to the nucleotide sequence of VGAM2483 RNA, herein designated VGAM RNA, also designated SEQ ID:5194.

Another function of VGAM2483 is therefore inhibition of FLJ13197 (Accession NM_024614). Accordingly, utilities of VGAM2483 include diagnosis, prevention and treatment of diseases and clinical conditions associated with FLJ13197. KIAA0226 (Accession XM_032901) is another VGAM2483 host target gene. KIAA0226 BINDING SITE is HOST TARGET binding site found in the 3' untranslated region of mRNA encoded by KIAA0226, corresponding to a HOST TARGET binding site such as BINDING SITE I, BINDING SITE II or BINDING SITE III. Table 2 illustrates the complementarity of the nucleotide sequences of KIAA0226 BINDING SITE, designated SEQ ID:31788, to the nucleotide sequence of VGAM2483 RNA, herein designated VGAM RNA, also designated SEQ ID:5194.

Another function of VGAM2483 is therefore inhibition of KIAA0226 (Accession XM_032901). Accordingly, utilities of VGAM2483 include diagnosis, prevention and treatment of diseases and clinical conditions associated with KIAA0226. KIAA1432 (Accession XM_039698) is another VGAM2483 host target gene. KIAA1432 BINDING SITE is HOST TARGET binding site found in the 5' untranslated region of mRNA encoded by KIAA1432, corresponding to a HOST TARGET binding site such as BINDING SITE I, BINDING SITE II or BINDING SITE III. Table 2 illustrates the complementarity of the nucleotide sequences of KIAA1432 BINDING SITE, designated SEQ ID:33150, to the nucleotide sequence of VGAM2483 RNA, herein designated VGAM RNA, also designated SEQ ID:5194.

Another function of VGAM2483 is therefore inhibition of KIAA1432 (Accession XM_039698). Accordingly, utilities of VGAM2483 include diagnosis, prevention and treatment of diseases and clinical conditions associated with KIAA1432. KIAA1530 (Accession XM_042661) is another VGAM2483 host target gene. KIAA1530 BINDING SITE is HOST TARGET binding site found in the 3' untranslated region of mRNA encoded by KIAA1530, corresponding to a HOST TARGET binding site such as BINDING SITE I, BINDING SITE II or BINDING SITE III. Table 2 illustrates the complementarity of the nucleotide sequences of KIAA1530 BINDING SITE, designated SEQ ID:33736, to the nucleotide sequence of VGAM2483 RNA, herein designated VGAM RNA, also designated SEQ ID:5194.

Another function of VGAM2483 is therefore inhibition of KIAA1530 (Accession XM_042661). Accordingly, utilities of VGAM2483 include diagnosis, prevention and treatment of diseases and clinical conditions associated with KIAA1530. MGC23445 (Accession NM_144606) is another VGAM2483 host target gene. MGC23445 BINDING SITE is HOST TARGET binding site found in the 5' untranslated region of mRNA encoded by MGC23445, corresponding to a HOST TARGET binding site such as BINDING SITE I, BINDING SITE II or BINDING SITE III. Table 2 illustrates the complementarity of the nucleotide sequences of MGC23445 BINDING SITE, designated SEQ ID:29420, to the nucleotide sequence of VGAM2483 RNA, herein designated VGAM RNA, also designated SEQ ID:5194.

Another function of VGAM2483 is therefore inhibition of MGC23445 (Accession NM_144606). Accordingly, utilities of VGAM2483 include diagnosis, prevention and treatment of diseases and clinical conditions associated with MGC23445. Phosphatase, Orphan 1 (phospho1, Accession XM_091572) is another VGAM2483 host target gene. phospho1 BINDING SITE is HOST TARGET binding site found in the 3' untranslated region of mRNA encoded by phospho1, corresponding to a HOST TARGET binding site such as BINDING SITE I, BINDING SITE II or BINDING SITE III. Table 2 illustrates the complementarity of the nucleotide sequences of phospho1 BINDING SITE, designated SEQ ID:40064, to the nucleotide sequence of VGAM2483 RNA, herein designated VGAM RNA, also designated SEQ ID:5194.

Another function of VGAM2483 is therefore inhibition of Phosphatase, Orphan 1 (phospho1, Accession XM_091572). Accordingly, utilities of VGAM2483 include diagnosis, prevention and treatment of diseases and clinical conditions associated with phospho1. SARM (Accession NM_015077) is another VGAM2483 host target gene. SARM BINDING SITE is HOST TARGET binding site found in the 3' untranslated region of mRNA encoded by SARM, corresponding to a HOST TARGET binding site such as BINDING SITE I, BINDING SITE II or BINDING SITE III. Table 2 illustrates the complementarity of the nucleotide sequences of SARM BINDING SITE, designated SEQ ID:17464, to the nucleotide sequence of VGAM2483 RNA, herein designated VGAM RNA, also designated SEQ ID:5194.

Another function of VGAM2483 is therefore inhibition of SARM (Accession NM_015077). Accordingly, utilities of VGAM2483 include diagnosis, prevention and treatment of diseases and clinical conditions associated with SARM. SSB-4 (Accession NM_080862) is another VGAM2483 host target gene. SSB-4 BINDING SITE is HOST TARGET binding site found in the 3' untranslated region of mRNA encoded by SSB-4, corresponding to a HOST TARGET binding site such as BINDING SITE I, BINDING SITE II or BINDING SITE III. Table 2 illustrates the complementarity of the nucleotide sequences of SSB-4 BINDING SITE, designated SEQ ID:28106, to the nucleotide sequence of VGAM2483 RNA, herein designated VGAM RNA, also designated SEQ ID:5194.

Another function of VGAM2483 is therefore inhibition of SSB-4 (Accession NM_080862). Accordingly, utilities of VGAM2483 include diagnosis, prevention and treatment of diseases and clinical conditions associated with SSB-4. LOC145694 (Accession XM_096838) is another VGAM2483 host target gene. LOC145694 BINDING SITE is HOST TARGET binding site found in the 5' untranslated region of mRNA encoded by LOC145694, corresponding to a HOST TARGET binding site such as BINDING SITE I, BINDING SITE II or BINDING SITE III. Table 2 illustrates the complementarity of the nucleotide sequences of LOC145694 BINDING SITE, designated SEQ ID:40558, to the nucleotide sequence of VGAM2483 RNA, herein designated VGAM RNA, also designated SEQ ID:5194.

Another function of VGAM2483 is therefore inhibition of LOC145694 (Accession XM_096838). Accordingly, utilities of VGAM2483 include diagnosis, prevention and treatment of diseases and clinical conditions associated with LOC145694. LOC256158 (Accession XM_175125) is another VGAM2483 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46629, to the nucleotide sequence of VGAM2483 RNA, herein designated VGAM RNA, also designated SEQ ID:5194.

Another function of VGAM2483 is therefore inhibition of LOC256158 (Accession XM_175125). Accordingly, utilities of VGAM2483 include diagnosis, prevention and treatment of diseases and clinical conditions associated with LOC256158. LOC57106 (Accession XM_034377) is another VGAM2483 host target gene. LOC57106 BINDING SITE is HOST TARGET binding site found in the 3' untranslated region of mRNA encoded by LOC57106, corresponding to a HOST TARGET binding site such as BINDING SITE I, BINDING SITE II or BINDING SITE III. Table 2 illustrates the complementarity of the nucleotide sequences of LOC57106 BINDING SITE, designated SEQ ID:32074, to the nucleotide sequence of VGAM2483 RNA, herein designated VGAM RNA, also designated SEQ ID:5194.

Another function of VGAM2483 is therefore inhibition of LOC57106 (Accession XM_034377). Accordingly, utilities of VGAM2483 include diagnosis, prevention and treatment of diseases and clinical conditions associated with LOC57106. LOC90133 (Accession XM_029323) is another VGAM2483 host target gene. LOC90133 BINDING SITE is HOST TARGET binding site found in the 3' untranslated region of mRNA encoded by LOC90133, corresponding to a HOST TARGET binding site such as BINDING SITE I, BINDING SITE II or BINDING SITE III. Table 2 illustrates the complementarity of the nucleotide sequences of LOC90133 BINDING SITE, designated SEQ ID:30869, to the nucleotide sequence of VGAM2483 RNA, herein designated VGAM RNA, also designated SEQ ID:5194.

Another function of VGAM2483 is therefore inhibition of LOC90133 (Accession XM_029323). Accordingly, utilities of VGAM2483 include diagnosis, prevention and treatment of diseases and clinical conditions associated with LOC90133. LOC91689 (Accession NM_033318) is another VGAM2483 host target gene. LOC91689 BINDING SITE is HOST TARGET binding site found in the 3' untranslated region of mRNA encoded by LOC91689, corresponding to a HOST TARGET binding site such as BINDING SITE I, BINDING SITE II or BINDING SITE III. Table 2 illustrates the complementarity of the nucleotide sequences of LOC91689 BINDING SITE, designated SEQ ID:27157, to the nucleotide sequence of VGAM2483 RNA, herein designated VGAM RNA, also designated SEQ ID:5194.

Another function of VGAM2483 is therefore inhibition of LOC91689 (Accession NM_033318). Accordingly, utilities of VGAM2483 include diagnosis, prevention and treatment of diseases and clinical conditions associated with LOC91689. LOC91974 (Accession XM_041974) is another VGAM2483 host target gene. LOC91974 BINDING SITE is HOST TARGET binding site found in the 5' untranslated region of mRNA encoded by LOC91974, corresponding to a HOST TARGET binding site such as BINDING SITE I, BINDING SITE II or BINDING SITE III. Table 2 illustrates the complementarity of the nucleotide sequences of LOC91974 BINDING SITE, designated SEQ ID:33655, to the nucleotide sequence of VGAM2483 RNA, herein designated VGAM RNA, also designated SEQ ID:5194.

Another function of VGAM2483 is therefore inhibition of LOC91974 (Accession XM_041974). Accordingly, utilities of VGAM2483 include diagnosis, prevention and treatment of diseases and clinical conditions associated with LOC91974. FIG. 1 further provides a conceptual description of a novel bioinformatically detected viral gene of the present invention, referred to here as Viral Genomic Address Messenger 2484 (VGAM2484) viral gene, which modulates expression of respective host target genes thereof, the function and utility of which host target genes is known in the art.

VGAM2484 is a novel bioinformatically detected regulatory, non protein coding, viral micro RNA (miRNA) gene. The method by which VGAM2484 was detected is described hereinabove with reference to FIGS. 1-8.

VGAM2484 gene, herein designated VGAM GENE, is a viral gene contained in the genome of Mouse Cytomegalovirus 1. VGAM2484 host target gene, herein designated VGAM HOST TARGET GENE, is a human gene contained in the human genome.

VGAM2484 gene encodes a VGAM2484 precursor RNA, herein designated VGAM PRECURSOR RNA. Similar to other miRNA genes, and unlike most ordinary genes, VGAM2484 precursor RNA does not encode a protein. A nucleotide sequence identical or highly similar to the nucleotide sequence of VGAM2484 precursor RNA is designated SEQ ID:2470, and is provided hereinbelow with reference to the sequence listing part. Nucleotide sequence SEQ ID:2470 is located at position 183727 relative to the genome of Mouse Cytomegalovirus 1.

VGAM2484 precursor RNA folds onto itself, forming VGAM2484 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2484 folded precursor RNA into VGAM2484 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2484 RNA is designated SEQ ID:5195, and is provided hereinbelow with reference to the sequence listing part.

VGAM2484 host target gene, herein designated VGAM HOST TARGET GENE, encodes a corresponding messenger RNA, VGAM2484 host target RNA, herein designated VGAM HOST TARGET RNA. VGAM2484 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2484 RNA, herein designated VGAM RNA, binds complementarily to one or more host target binding sites located in untranslated regions of VGAM2484 host target RNA, herein designated VGAM HOST TARGET RNA. This complementary binding is due to the fact that the nucleotide sequence of VGAM2484 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2484 RNA, herein designated VGAM RNA, may have a different number of host target binding sites in untranslated regions of a VGAM2484 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2484 RNA, herein designated VGAM RNA, to host target binding sites on VGAM2484 host target RNA, herein designated VGAM HOST TARGET RNA, such as BINDING SITE I, BINDING SITE II and BINDING SITE III, inhibits translation of VGAM2484 host target RNA into VGAM2484 host target protein, herein designated VGAM HOST TARGET PROTEIN. VGAM host target protein is therefore outlined by a broken line.

It is appreciated that VGAM2484 host target gene, herein designated VGAM HOST TARGET GENE, in fact represents a plurality of VGAM2484 host target genes. The mRNA of each one of this plurality of VGAM2484 host target genes comprises one or more host target binding sites, each having a nucleotide sequence which is at least partly complementary to VGAM2484 RNA, herein designated VGAM RNA, and which when bound by VGAM2484 RNA causes inhibition of translation of respective one or more VGAM2484 host target proteins.

It is further appreciated by one skilled in the art that the mode of translational inhibition illustrated by FIG. 1 with specific reference to translational inhibition exerted by VGAM2484 gene, herein designated VGAM GENE, on one or more VGAM2484 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2484 is inhibition of expression of host target genes, as part of a novel viral mechanism of attacking a host. Accordingly, utilities of VGAM2484 include diagnosis, prevention and treatment of viral infection by Mouse Cytomegalovirus 1. Specific functions, and accordingly utilities, of VGAM2484 correlate with, and may be deduced from, the identity of the host target genes which VGAM2484 binds and inhibits, and the function of these host target genes, as elaborated hereinbelow.

Nucleotide sequences of the VGAM2484 precursor RNA, herein designated VGAM PRECURSOR RNA, and of the 'diced' VGAM2484 RNA, herein designated VGAM RNA, and a schematic representation of the secondary folding of VGAM2484 folded precursor RNA, herein designated VGAM FOLDED PRECURSOR RNA, of VGAM2484 are further described hereinbelow with reference to Table 1.

Nucleotide sequences of host target binding sites, such as BINDING SITE-I, BINDING SITE-II and BINDING SITE-III of FIG. 1, found on VGAM2484 host target RNA, and schematic representation of the complementarity of each of these host target binding sites to VGAM2484 RNA, herein designated VGAM RNA, are described hereinbelow with reference to Table 2.

As mentioned hereinabove with reference to FIG. 1, a function of VGAM2484 gene, herein designated VGAM is inhibition of expression of VGAM2484 target genes. It is appreciated that specific functions, and accordingly utilities, of VGAM2484 correlate with, and may be deduced from, the identity of the target genes which VGAM2484 binds and inhibits, and the function of these target genes, as elaborated hereinbelow.

FLJ10565 (Accession NM_018140) is a VGAM2484 host target gene. FLJ10565 BINDING SITE is HOST TARGET binding site found in the 5' untranslated region of mRNA encoded by FLJ10565, corresponding to a HOST TARGET binding site such as BINDING SITE I, BINDING SITE II or BINDING SITE III. Table 2 illustrates the complementarity of the nucleotide sequences of FLJ10565 BINDING SITE, designated SEQ ID:19938, to the nucleotide sequence of VGAM2484 RNA, herein designated VGAM RNA, also designated SEQ ID:5195.

A function of VGAM2484 is therefore inhibition of FLJ10565 (Accession NM_018140). Accordingly, utilities of VGAM2484 include diagnosis, prevention and treatment of diseases and clinical conditions associated with FLJ10565. Neurexophilin 3 (NXPH3, Accession XM_037847) is another VGAM2484 host target gene. NXPH3 BINDING SITE is HOST TARGET binding site found in the 3' untranslated region of mRNA encoded by NXPH3, corresponding to a HOST TARGET binding site such as BINDING SITE I, BINDING SITE II or BINDING SITE III. Table 2 illustrates the complementarity of the nucleotide sequences of NXPH3 BINDING SITE, designated SEQ ID:32712, to the nucleotide sequence of VGAM2484 RNA, herein designated VGAM RNA, also designated SEQ ID:5195.

Another function of VGAM2484 is therefore inhibition of Neurexophilin 3 (NXPH3, Accession XM_037847). Accordingly, utilities of VGAM2484 include diagnosis, prevention and treatment of diseases and clinical conditions associated with NXPH3. FIG. 1 further provides a conceptual description of a novel bioinformatically detected viral gene of the present invention, referred to here as Viral Genomic Address Messenger 2485 (VGAM2485) viral gene, which modulates expression of respective host target genes thereof, the function and utility of which host target genes is known in the art.

VGAM2485 is a novel bioinformatically detected regulatory, non protein coding, viral micro RNA (miRNA) gene. The method by which VGAM2485 was detected is described hereinabove with reference to FIGS. 1-8.

VGAM2485 gene, herein designated VGAM GENE, is a viral gene contained in the genome of Mouse Cytomegalovirus 1. VGAM2485 host target gene, herein designated VGAM HOST TARGET GENE, is a human gene contained in the human genome.

VGAM2485 gene encodes a VGAM2485 precursor RNA, herein designated VGAM PRECURSOR RNA. Similar to other miRNA genes, and unlike most ordinary genes, VGAM2485 precursor RNA does not encode a protein. A nucleotide sequence identical or highly similar to the nucleotide sequence of VGAM2485 precursor RNA is designated SEQ ID:2471, and is provided hereinbelow with reference to the sequence listing part. Nucleotide sequence SEQ ID:2471 is located at position 214191 relative to the genome of Mouse Cytomegalovirus 1.

VGAM2485 precursor RNA folds onto itself, forming VGAM2485 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2485 folded precursor RNA into VGAM2485 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM2485 RNA is designated SEQ ID:5196, and is provided hereinbelow with reference to the sequence listing part.

VGAM2485 host target gene, herein designated VGAM HOST TARGET GENE, encodes a corresponding messenger RNA, VGAM2485 host target RNA, herein designated VGAM HOST TARGET RNA. VGAM2485 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2485 RNA, herein designated VGAM RNA, binds complementarily to one or more host target binding sites located in untranslated regions of VGAM2485 host target RNA, herein designated VGAM HOST TARGET RNA. This complementary binding is due to the fact that the nucleotide sequence of VGAM2485 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2485 RNA, herein designated VGAM RNA, may have a different number of host target binding sites in untranslated regions of a VGAM2485 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2485 RNA, herein designated VGAM RNA, to host target binding sites on VGAM2485 host target RNA, herein designated VGAM HOST TARGET RNA, such as BINDING SITE I, BINDING SITE II and BINDING SITE III, inhibits translation of VGAM2485 host target RNA into VGAM2485 host target protein, herein designated VGAM HOST TARGET PROTEIN. VGAM host target protein is therefore outlined by a broken line.

It is appreciated that VGAM2485 host target gene, herein designated VGAM HOST TARGET GENE, in fact represents a plurality of VGAM2485 host target genes. The mRNA of each one of this plurality of VGAM2485 host target genes comprises one or more host target binding sites, each having a nucleotide sequence which is at least partly complementary to VGAM2485 RNA, herein designated VGAM RNA, and which when bound by VGAM2485 RNA causes inhibition of translation of respective one or more VGAM2485 host target proteins.

It is further appreciated by one skilled in the art that the mode of translational inhibition illustrated by FIG. 1 with specific reference to translational inhibition exerted by VGAM2485 gene, herein designated VGAM GENE, on one or more VGAM2485 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2485 is inhibition of expression of host target genes, as part of a novel viral mechanism of attacking a host. Accordingly, utilities of VGAM2485 include diagnosis, prevention and treatment of viral infection by Mouse Cytomegalovirus 1. Specific functions, and accordingly utilities, of VGAM2485 correlate with, and may be deduced from, the identity of the host target genes which VGAM2485 binds and inhibits, and the function of these host target genes, as elaborated hereinbelow.

Nucleotide sequences of the VGAM2485 precursor RNA, herein designated VGAM PRECURSOR RNA, and of the 'diced' VGAM2485 RNA, herein designated VGAM RNA, and a schematic representation of the secondary folding of VGAM2485 folded precursor RNA, herein designated VGAM FOLDED PRECURSOR RNA, of VGAM2485 are further described hereinbelow with reference to Table 1.

Nucleotide sequences of host target binding sites, such as BINDING SITE-I, BINDING SITE-II and BINDING SITE-III of FIG. 1, found on VGAM2485 host target RNA, and schematic representation of the complementarity of each of these host target binding sites to VGAM2485 RNA, herein designated VGAM RNA, are described hereinbelow with reference to Table 2.

As mentioned hereinabove with reference to FIG. 1, a function of VGAM2485 gene, herein designated VGAM is inhibition of expression of VGAM2485 target genes. It is appreciated that specific functions, and accordingly utilities, of VGAM2485 correlate with, and may be deduced from, the identity of the target genes which VGAM2485 binds and inhibits, and the function of these target genes, as elaborated hereinbelow.

Rho GDP Dissociation Inhibitor (GDI) Alpha (ARHGDIA, Accession NM_004309) is a VGAM2485 host target gene. ARHGDIA BINDING SITE is HOST TARGET binding site found in the 3' untranslated region of mRNA encoded by ARHGDIA, corresponding to a HOST TARGET binding site such as BINDING SITE I, BINDING SITE II or BINDING SITE III. Table 2 illustrates the complementarity of the nucleotide sequences of ARHGDIA BINDING SITE, designated SEQ ID:10513, to the nucleotide sequence of VGAM2485 RNA, herein designated VGAM RNA, also designated SEQ ID:5196.

A function of VGAM2485 is therefore inhibition of Rho GDP Dissociation Inhibitor (GDI) Alpha (ARHGDIA, Accession NM_004309), a gene which is a small guanine nucleotide exchange (GTP/GDP) factor. Accordingly, utilities of VGAM2485 include diagnosis, prevention and treatment of diseases and clinical conditions associated with ARHGDIA. The function of ARHGDIA and its association with various diseases and clinical conditions, has been established by previous studies, as described hereinabove with reference to VGAM435. Solute Carrier Family 20 (phosphate transporter), Member 2 (SLC20A2, Accession NM_006749) is another VGAM2485 host target gene. SLC20A2 BINDING SITE is HOST TARGET binding site found in the 5' untranslated region of mRNA encoded by SLC20A2, corresponding to a HOST TARGET binding site such as BINDING SITE I, BINDING SITE II or BINDING SITE III. Table 2 illustrates the complementarity of the nucleotide sequences of SLC20A2 BINDING SITE, designated SEQ ID:13600, to the nucleotide sequence of VGAM2485 RNA, herein designated VGAM RNA, also designated SEQ ID:5196.

Another function of VGAM2485 is therefore inhibition of Solute Carrier Family 20 (phosphate transporter), Member 2 (SLC20A2, Accession NM_006749), a gene which is a sodium-phosphate symporter. Accordingly, utilities of VGAM2485 include diagnosis, prevention and treatment of diseases and clinical conditions associated with SLC20A2. The function of SLC20A2 and its association with various diseases and clinical conditions, has been established by previous studies, as described hereinabove with reference to VGAM232. Chemokine (C-C motif) Receptor 5 (CCR5, Accession NM_000579) is another VGAM2485 host target gene. CCR5 BINDING SITE is HOST TARGET binding site found in the 3' untranslated region of mRNA encoded by CCR5, corresponding to a HOST TARGET binding site such as BINDING SITE I, BINDING SITE II or BINDING SITE III. Table 2 illustrates the complementarity of the nucleotide sequences of CCR5 BINDING SITE, designated SEQ ID:6185, to the nucleotide sequence of VGAM2485 RNA, herein designated VGAM RNA, also designated SEQ ID:5196.

Another function of VGAM2485 is therefore inhibition of Chemokine (C-C motif) Receptor 5 (CCR5, Accession NM_000579). Accordingly, utilities of VGAM2485 include diagnosis, prevention and treatment of diseases and clinical conditions associated with CCR5. FLJ10826 (Accession NM_018233) is another VGAM2485 host target gene. FLJ10826 BINDING SITE is HOST TARGET binding site found in the 3' untranslated region of mRNA encoded by FLJ10826, corresponding to a HOST TARGET binding site such as BINDING SITE I, BINDING SITE II or BINDING SITE III. Table 2 illustrates the complementarity of the nucleotide sequences of FLJ10826 BINDING SITE, designated SEQ ID:20175, to the nucleotide sequence of VGAM2485 RNA, herein designated VGAM RNA, also designated SEQ ID:5196.

Another function of VGAM2485 is therefore inhibition of FLJ10826 (Accession NM_018233). Accordingly, utilities of VGAM2485 include diagnosis, prevention and treatment of diseases and clinical conditions associated with FLJ10826. LOC142941 (Accession XM_096363) is another VGAM2485 host target gene. LOC142941 BINDING SITE is HOST TARGET binding site found in the 3' untranslated region of mRNA encoded by LOC142941, corresponding to a HOST TARGET binding site such as BINDING SITE I, BINDING SITE II or BINDING SITE III. Table 2 illustrates the complementarity of the nucleotide sequences of LOC142941 BINDING SITE, designated SEQ ID:40324, to the nucleotide sequence of VGAM2485 RNA, herein designated VGAM RNA, also designated SEQ ID:5196.

Another function of VGAM2485 is therefore inhibition of LOC142941 (Accession XM_096363). Accordingly, utilities of VGAM2485 include diagnosis, prevention and treatment of diseases and clinical conditions associated with LOC142941. LOC150279 (Accession XM_086820) is another VGAM2485 host target gene. LOC150279 BINDING SITE is HOST TARGET binding site found in the 3' untranslated region of mRNA encoded by LOC150279, corresponding to a HOST TARGET binding site such as BINDING SITE I, BINDING SITE II or BINDING SITE III. Table 2 illustrates the complementarity of the nucleotide sequences of LOC150279 BINDING SITE, designated SEQ ID:38901, to the nucleotide sequence of VGAM2485 RNA, herein designated VGAM RNA, also designated SEQ ID:5196.

Another function of VGAM2485 is therefore inhibition of LOC150279 (Accession XM_086820). Accordingly, utilities of VGAM2485 include diagnosis, prevention and treatment of diseases and clinical conditions associated with LOC150279. LOC152992 (Accession XM_087575) is another VGAM2485 host target gene. LOC152992 BINDING SITE is HOST TARGET binding site found in the 3' untranslated region of mRNA encoded by LOC152992, corresponding to a HOST TARGET binding site such as BINDING SITE I, BINDING SITE II or BINDING SITE III. Table 2 illustrates the complementarity of the nucleotide sequences of LOC152992 BINDING SITE, designated SEQ ID:39347, to the nucleotide sequence of VGAM2485 RNA, herein designated VGAM RNA, also designated SEQ ID:5196.

Another function of VGAM2485 is therefore inhibition of LOC152992 (Accession XM_087575). Accordingly, utilities of VGAM2485 include diagnosis, prevention and treatment of diseases and clinical conditions associated with LOC152992. LOC158863 (Accession XM_098999) is another VGAM2485 host target gene. LOC158863 BINDING SITE is HOST TARGET binding site found in the 3' untranslated region of mRNA encoded by LOC158863, corresponding to a HOST TARGET binding site such as BINDING SITE I, BINDING SITE II or BINDING SITE III. Table 2 illustrates the complementarity of the nucleotide sequences of LOC158863 BINDING SITE, designated SEQ ID:42036, to the nucleotide sequence of VGAM2485 RNA, herein designated VGAM RNA, also designated SEQ ID:5196.

Another function of VGAM2485 is therefore inhibition of LOC158863 (Accession XM_098999). Accordingly, utilities of VGAM2485 include diagnosis, prevention and treatment of diseases and clinical conditions associated with LOC158863. LOC221954 (Accession XM_168349) is another VGAM2485 host target gene. LOC221954 BINDING SITE is HOST TARGET binding site found in the 5' untranslated region of mRNA encoded by LOC221954, corresponding to a HOST TARGET binding site such as BINDING SITE I, BINDING SITE II or BINDING SITE III. Table 2 illustrates the complementarity of the nucleotide sequences of LOC221954 BINDING SITE, designated SEQ ID:45121, to the nucleotide sequence of VGAM2485 RNA, herein designated VGAM RNA, also designated SEQ ID:5196.

Another function of VGAM2485 is therefore inhibition of LOC221954 (Accession XM_168349). Accordingly, utilities of VGAM2485 include diagnosis, prevention and treatment of diseases and clinical conditions associated with LOC221954. FIG. 1 further provides a conceptual description of a novel bioinformatically detected viral gene of the present invention, referred to here as Viral Genomic Address Messenger 2486 (VGAM2486) viral gene, which modulates expression of respective host target genes thereof, the function and utility of which host target genes is known in the art.

VGAM2486 is a novel bioinformatically detected regulatory, non protein coding, viral micro RNA (miRNA) gene. The method by which VGAM2486 was detected is described hereinabove with reference to FIGS. 1-8.

VGAM2486 gene, herein designated VGAM GENE, is a viral gene contained in the genome of Mouse Cytomegalovirus 1. VGAM2486 host target gene, herein designated VGAM HOST TARGET GENE, is a human gene contained in the human genome.

VGAM2486 gene encodes a VGAM2486 precursor RNA, herein designated VGAM PRECURSOR RNA. Similar to other miRNA genes, and unlike most ordinary genes, VGAM2486 precursor RNA does not encode a protein. A nucleotide sequence identical or highly similar to the nucleotide sequence of VGAM2486 precursor RNA is designated SEQ ID:2472, and is provided hereinbelow with reference to the sequence listing part. Nucleotide sequence SEQ ID:2472 is located at position 54581 relative to the genome of Mouse Cytomegalovirus 1.

VGAM2486 precursor RNA folds onto itself, forming VGAM2486 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2486 folded precursor RNA into VGAM2486 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2486 RNA is designated SEQ ID:5197, and is provided hereinbelow with reference to the sequence listing part.

VGAM2486 host target gene, herein designated VGAM HOST TARGET GENE, encodes a corresponding messenger RNA, VGAM2486 host target RNA, herein designated VGAM HOST TARGET RNA. VGAM2486 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2486 RNA, herein designated VGAM RNA, binds complementarily to one or more host target binding sites located in untranslated regions of VGAM2486 host target RNA, herein designated VGAM HOST TARGET RNA. This complementary binding is due to the fact that the nucleotide sequence of VGAM2486 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2486 RNA, herein designated VGAM RNA, may have a different number of host target binding sites in untranslated regions of a VGAM2486 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2486 RNA, herein designated VGAM RNA, to host target binding sites on VGAM2486 host target RNA, herein designated VGAM HOST TARGET RNA, such as BINDING SITE I, BINDING SITE II and BINDING SITE III, inhibits translation of VGAM2486 host target RNA into VGAM2486 host target protein, herein designated VGAM HOST TARGET PROTEIN. VGAM host target protein is therefore outlined by a broken line.

It is appreciated that VGAM2486 host target gene, herein designated VGAM HOST TARGET GENE, in fact represents a plurality of VGAM2486 host target genes. The mRNA of each one of this plurality of VGAM2486 host target genes comprises one or more host target binding sites, each having a nucleotide sequence which is at least partly complementary to VGAM2486 RNA, herein designated VGAM RNA, and which when bound by VGAM2486 RNA causes inhibition of translation of respective one or more VGAM2486 host target proteins.

It is further appreciated by one skilled in the art that the mode of translational inhibition illustrated by FIG. 1 with specific reference to translational inhibition exerted by VGAM2486 gene, herein designated VGAM GENE, on one or more VGAM2486 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2486 is inhibition of expression of host target genes, as part of a novel viral mechanism of attacking a host. Accordingly, utilities of VGAM2486 include diagnosis, prevention and treatment of viral infection by Mouse Cytomegalovirus 1. Specific functions, and accordingly utilities, of VGAM2486 correlate with, and may be deduced from, the identity of the host target genes which VGAM2486 binds and inhibits, and the function of these host target genes, as elaborated hereinbelow.

Nucleotide sequences of the VGAM2486 precursor RNA, herein designated VGAM PRECURSOR RNA, and of the 'diced' VGAM2486 RNA, herein designated VGAM RNA, and a schematic representation of the secondary folding of VGAM2486 folded precursor RNA, herein designated VGAM FOLDED PRECURSOR RNA, of VGAM2486 are further described hereinbelow with reference to Table 1.

Nucleotide sequences of host target binding sites, such as BINDING SITE-I, BINDING SITE-II and BINDING SITE-III of FIG. 1, found on VGAM2486 host target RNA, and schematic representation of the complementarity of each of these host target binding sites to VGAM2486 RNA, herein designated VGAM RNA, are described hereinbelow with reference to Table 2.

As mentioned hereinabove with reference to FIG. 1, a function of VGAM2486 gene, herein designated VGAM is inhibition of expression of VGAM2486 target genes. It is appreciated that specific functions, and accordingly utilities, of VGAM2486 correlate with, and may be deduced from, the identity of the target genes which VGAM2486 binds and inhibits, and the function of these target genes, as elaborated hereinbelow.

Cytoplasmic Linker 2 (CYLN2, Accession NM_003388) is a VGAM2486 host target gene. CYLN2 BINDING SITE is HOST TARGET binding site found in the 3' untranslated region of mRNA encoded by CYLN2, corresponding to a HOST TARGET binding site such as BINDING SITE I, BINDING SITE II or BINDING SITE III. Table 2 illustrates the complementarity of the nucleotide sequences of CYLN2 BINDING SITE, designated SEQ ID:9420, to the nucleotide sequence of VGAM2486 RNA, herein designated VGAM RNA, also designated SEQ ID:5197.

A function of VGAM2486 is therefore inhibition of Cytoplasmic Linker 2 (CYLN2, Accession NM_003388), a gene which associates with microtubules and dendritic lamellar bodies. Accordingly, utilities of VGAM2486 include diagnosis, prevention and treatment of diseases and clinical conditions associated with CYLN2. The function of CYLN2 and its association with various diseases and clinical conditions, has been established by previous studies, as described hereinabove with reference to VGAM94. Galanin Receptor 1 (GALR1, Accession NM_001480) is another VGAM2486 host target gene. GALR1 BINDING SITE is HOST TARGET binding site found in the 5' untranslated region of mRNA encoded by GALR1, corresponding to a HOST TARGET binding site such as BINDING SITE I, BINDING SITE II or BINDING SITE III. Table 2 illustrates the complementarity of the nucleotide sequences of GALR1 BINDING SITE, designated SEQ ID:7216, to the nucleotide sequence of VGAM2486 RNA, herein designated VGAM RNA, also designated SEQ ID:5197.

Another function of VGAM2486 is therefore inhibition of Galanin Receptor 1 (GALR1, Accession NM_001480), a gene which plays a role in regulating ion transport. Accordingly, utilities of VGAM2486 include diagnosis, prevention and treatment of diseases and clinical conditions associated with GALR1. The function of GALR1 and its association with various diseases and clinical conditions, has been established by previous studies, as described hereinabove with reference to VGAM1245. Heparanase (HPSE, Accession NM_006665) is another VGAM2486 host target gene. HPSE BINDING SITE is HOST TARGET binding site found in the 3' untranslated region of mRNA encoded by HPSE, corresponding to a HOST TARGET binding site such as BINDING SITE I, BINDING SITE II or BINDING SITE III. Table 2 illustrates the complementarity of the nucleotide sequences of HPSE BINDING SITE, designated SEQ ID:13477, to the nucleotide sequence of VGAM2486 RNA, herein designated VGAM RNA, also designated SEQ ID:5197.

Another function of VGAM2486 is therefore inhibition of Heparanase (HPSE, Accession NM_006665), a gene which is an endoglycosidase that cleaves heparan sulfate. Accordingly, utilities of VGAM2486 include diagnosis, prevention and treatment of diseases and clinical conditions associated with HPSE. The function of HPSE and its association with various diseases and clinical conditions, has been established by previous studies, as described hereinabove with reference to VGAM374. Interleukin 17 Receptor (IL17R, Accession NM_014339) is another VGAM2486 host target gene. IL17R BINDING SITE is HOST TARGET binding site found in the 3' untranslated region of mRNA encoded by IL17R, corresponding to a HOST TARGET binding site such as BINDING SITE I, BINDING SITE II or BINDING SITE III. Table 2 illustrates the complementarity of the nucleotide sequences of IL17R BINDING SITE, designated SEQ ID:15660, to the nucleotide sequence of VGAM2486 RNA, herein designated VGAM RNA, also designated SEQ ID:5197.

Another function of VGAM2486 is therefore inhibition of Interleukin 17 Receptor (IL17R, Accession NM_014339). Accordingly, utilities of VGAM2486 include diagnosis, prevention and treatment of diseases and clinical conditions associated with IL17R. 2'-5'-oligoadenylate Synthetase 3, 100 kDa (OAS3, Accession NM_006187) is another VGAM2486 host target gene. OAS3 BINDING SITE is HOST TARGET binding site found in the 3' untranslated region of mRNA encoded by OAS3, corresponding to a HOST TARGET binding site such as BINDING SITE I, BINDING SITE II or BINDING SITE III. Table 2 illustrates the complementarity of the nucleotide sequences of OAS3 BINDING SITE, designated SEQ ID:12862, to the nucleotide sequence of VGAM2486 RNA, herein designated VGAM RNA, also designated SEQ ID:5197.

Another function of VGAM2486 is therefore inhibition of 2'-5'-oligoadenylate Synthetase 3, 100 kDa (OAS3, Accession NM_006187), a gene which may play a role in mediating resistance to virus infection, control of cell growth, differentiation, and apoptosis. Accordingly, utilities of VGAM2486 include diagnosis, prevention and treatment of diseases and clinical conditions associated with OAS3. The function of OAS3 and its association with various diseases and clinical conditions, has been established by previous studies, as described hereinabove with reference to VGAM309. Protocadherin 11 X-linked (PCDH11X, Accession NM_032967) is another VGAM2486 host target gene. PCDH11X BINDING SITE is HOST TARGET binding site found in the 3' untranslated region of mRNA encoded by PCDH11X, corresponding to a HOST TARGET binding site such as BINDING SITE I, BINDING SITE II or BINDING SITE III. Table 2 illustrates the complementarity of the nucleotide sequences of PCDH11X BINDING SITE, designated SEQ ID:26781, to the nucleotide sequence of VGAM2486 RNA, herein designated VGAM RNA, also designated SEQ ID:5197.

Another function of VGAM2486 is therefore inhibition of Protocadherin 11 X-linked (PCDH11X, Accession NM_032967), a gene which is thought to play a fundamental role in cell-cell recognition essential for the segmental development and function of the central nervous system. Accordingly, utilities of VGAM2486 include diagnosis, prevention and treatment of diseases and clinical conditions associated with PCDH11X. The function of PCDH11X and its association with various diseases and clinical conditions, has been established by previous studies, as described hereinabove with reference to VGAM433. Protocadherin 11 Y-linked (PCDH11Y, Accession NM_032971) is another VGAM2486 host target gene. PCDH11Y BINDING SITE1 and PCDH11Y BINDING SITE2 are HOST TARGET binding sites found in untranslated regions of mRNA encoded by PCDH11Y, corresponding to HOST TARGET binding sites such as BINDING SITE I, BINDING SITE II or BINDING SITE III. Table 2 illustrates the complementarity of the nucleotide sequences of PCDH11Y BINDING SITE1 and PCDH11Y BINDING SITE2, designated SEQ ID:26814 and SEQ ID:26816 respectively, to the nucleotide sequence of VGAM2486 RNA, herein designated VGAM RNA, also designated SEQ ID:5197.

Another function of VGAM2486 is therefore inhibition of Protocadherin 11 Y-linked (PCDH11Y, Accession NM_032971). Accordingly, utilities of VGAM2486 include diagnosis, prevention and treatment of diseases and clinical conditions associated with PCDH11Y. Solute Carrier Family 2 (facilitated glucose transporter), Member 6 (SLC2A6, Accession NM_017585) is another VGAM2486 host target gene. SLC2A6 BINDING SITE is HOST TARGET binding site found in the 3' untranslated region of mRNA encoded by SLC2A6, corresponding to a HOST TARGET binding site such as BINDING SITE I, BINDING SITE II or BINDING SITE III. Table 2 illustrates the complementarity of the nucleotide sequences of SLC2A6 BINDING SITE, designated SEQ ID:19031, to the nucleotide sequence of VGAM2486 RNA, herein designated VGAM RNA, also designated SEQ ID:5197.

Another function of VGAM2486 is therefore inhibition of Solute Carrier Family 2 (facilitated glucose transporter), Member 6 (SLC2A6, Accession NM_017585). Accordingly, utilities of VGAM2486 include diagnosis, prevention and treatment of diseases and clinical conditions associated with SLC2A6. SMG1 (Accession NM_015092) is another VGAM2486 host target gene. SMG1 BINDING SITE is HOST TARGET binding site found in the 3' untranslated region of mRNA encoded by SMG1, corresponding to a HOST TARGET binding site such as BINDING SITE I, BINDING SITE II or BINDING SITE III. Table 2 illustrates the complementarity of the nucleotide sequences of SMG1

BINDING SITE, designated SEQ ID:17480, to the nucleotide sequence of VGAM2486 RNA, herein designated VGAM RNA, also designated SEQ ID:5197.

Another function of VGAM2486 is therefore inhibition of SMG1 (Accession NM_015092), a gene which acts as the target for the cell-cycle arrest and immunosuppressive effects. Accordingly, utilities of VGAM2486 include diagnosis, prevention and treatment of diseases and clinical conditions associated with SMG1. The function of SMG1 and its association with various diseases and clinical conditions, has been established by previous studies, as described hereinabove with reference to VGAM419. Surfeit 5 (SURF5, Accession NM_006752) is another VGAM2486 host target gene. SURF5 BINDING SITE is HOST TARGET binding site found in the 3' untranslated region of mRNA encoded by SURF5, corresponding to a HOST TARGET binding site such as BINDING SITE I, BINDING SITE II or BINDING SITE III. Table 2 illustrates the complementarity of the nucleotide sequences of SURF5 BINDING SITE, designated SEQ ID:13604, to the nucleotide sequence of VGAM2486 RNA, herein designated VGAM RNA, also designated SEQ ID:5197.

Another function of VGAM2486 is therefore inhibition of Surfeit 5 (SURF5, Accession NM_006752). Accordingly, utilities of VGAM2486 include diagnosis, prevention and treatment of diseases and clinical conditions associated with SURF5. Rho Guanine Nucleotide Exchange Factor (GEF) 15 (ARHGEF15, Accession NM_014958) is another VGAM2486 host target gene. ARHGEF15 BINDING SITE is HOST TARGET binding site found in the 3' untranslated region of mRNA encoded by ARHGEF15, corresponding to a HOST TARGET binding site such as BINDING SITE I, BINDING SITE II or BINDING SITE III. Table 2 illustrates the complementarity of the nucleotide sequences of ARHGEF15 BINDING SITE, designated SEQ ID:17318, to the nucleotide sequence of VGAM2486 RNA, herein designated VGAM RNA, also designated SEQ ID:5197.

Another function of VGAM2486 is therefore inhibition of Rho Guanine Nucleotide Exchange Factor (GEF) 15 (ARHGEF15, Accession NM_014958). Accordingly, utilities of VGAM2486 include diagnosis, prevention and treatment of diseases and clinical conditions associated with ARHGEF15. Fidgetin (FIGN, Accession XM_171005) is another VGAM2486 host target gene. FIGN BINDING SITE is HOST TARGET binding site found in the 3' untranslated region of mRNA encoded by FIGN, corresponding to a HOST TARGET binding site such as BINDING SITE I, BINDING SITE II or BINDING SITE III. Table 2 illustrates the complementarity of the nucleotide sequences of FIGN BINDING SITE, designated SEQ ID:45774, to the nucleotide sequence of VGAM2486 RNA, herein designated VGAM RNA, also designated SEQ ID:5197.

Another function of VGAM2486 is therefore inhibition of Fidgetin (FIGN, Accession XM_171005). Accordingly, utilities of VGAM2486 include diagnosis, prevention and treatment of diseases and clinical conditions associated with FIGN. FLJ10738 (Accession NM_018199) is another VGAM2486 host target gene. FLJ10738 BINDING SITE is HOST TARGET binding site found in the 3' untranslated region of mRNA encoded by FLJ10738, corresponding to a HOST TARGET binding site such as BINDING SITE I, BINDING SITE II or BINDING SITE III. Table 2 illustrates the complementarity of the nucleotide sequences of FLJ10738 BINDING SITE, designated SEQ ID:20070, to the nucleotide sequence of VGAM2486 RNA, herein designated VGAM RNA, also designated SEQ ID:5197.

Another function of VGAM2486 is therefore inhibition of FLJ10738 (Accession NM_018199). Accordingly, utilities of VGAM2486 include diagnosis, prevention and treatment of diseases and clinical conditions associated with FLJ10738. FLJ12443 (Accession NM_024830) is another VGAM2486 host target gene. FLJ12443 BINDING SITE is HOST TARGET binding site found in the 5' untranslated region of mRNA encoded by FLJ12443, corresponding to a HOST TARGET binding site such as BINDING SITE I, BINDING SITE II or BINDING SITE III. Table 2 illustrates the complementarity of the nucleotide sequences of FLJ12443 BINDING SITE, designated SEQ ID:24222, to the nucleotide sequence of VGAM2486 RNA, herein designated VGAM RNA, also designated SEQ ID:5197.

Another function of VGAM2486 is therefore inhibition of FLJ12443 (Accession NM_024830). Accordingly, utilities of VGAM2486 include diagnosis, prevention and treatment of diseases and clinical conditions associated with FLJ12443. FLJ12684 (Accession NM_024534) is another VGAM2486 host target gene. FLJ12684 BINDING SITE is HOST TARGET binding site found in the 5' untranslated region of mRNA encoded by FLJ12684, corresponding to a HOST TARGET binding site such as BINDING SITE I, BINDING SITE II or BINDING SITE III. Table 2 illustrates the complementarity of the nucleotide sequences of FLJ12684 BINDING SITE, designated SEQ ID:23745, to the nucleotide sequence of VGAM2486 RNA, herein designated VGAM RNA, also designated SEQ ID:5197.

Another function of VGAM2486 is therefore inhibition of FLJ12684 (Accession NM_024534). Accordingly, utilities of VGAM2486 include diagnosis, prevention and treatment of diseases and clinical conditions associated with FLJ12684. FLJ20139 (Accession NM_017685) is another VGAM2486 host target gene. FLJ20139 BINDING SITE is HOST TARGET binding site found in the 3' untranslated region of mRNA encoded by FLJ20139, corresponding to a HOST TARGET binding site such as BINDING SITE I, BINDING SITE II or BINDING SITE III. Table 2 illustrates the complementarity of the nucleotide sequences of FLJ20139 BINDING SITE, designated SEQ ID:19238, to the nucleotide sequence of VGAM2486 RNA, herein designated VGAM RNA, also designated SEQ ID:5197.

Another function of VGAM2486 is therefore inhibition of FLJ20139 (Accession NM_017685). Accordingly, utilities of VGAM2486 include diagnosis, prevention and treatment of diseases and clinical conditions associated with FLJ20139. FLJ23042 (Accession NM_025157) is another VGAM2486 host target gene. FLJ23042 BINDING SITE is HOST TARGET binding site found in the 3' untranslated region of mRNA encoded by FLJ23042, corresponding to a HOST TARGET binding site such as BINDING SITE I, BINDING SITE II or BINDING SITE III. Table 2 illustrates the complementarity of the nucleotide sequences of FLJ23042 BINDING SITE, designated SEQ ID:24796, to the nucleotide sequence of VGAM2486 RNA, herein designated VGAM RNA, also designated SEQ ID:5197.

Another function of VGAM2486 is therefore inhibition of FLJ23042 (Accession NM_025157). Accordingly, utilities of VGAM2486 include diagnosis, prevention and treatment of diseases and clinical conditions associated with FLJ23042. FLJ23403 (Accession NM_022068) is another VGAM2486 host target gene. FLJ23403 BINDING SITE is HOST TARGET binding site found in the 3' untranslated region of mRNA encoded by FLJ23403, corresponding to a HOST TARGET binding site such as BINDING SITE I, BINDING SITE II or BINDING SITE III. Table 2 illustrates the complementarity of the nucleotide sequences of FLJ23403 BIND- ING SITE, designated SEQ ID:22612, to the nucleotide sequence of VGAM2486 RNA, herein designated VGAM RNA, also designated SEQ ID:5197.

Another function of VGAM2486 is therefore inhibition of FLJ23403 (Accession NM_022068). Accordingly, utilities of VGAM2486 include diagnosis, prevention and treatment of diseases and clinical conditions associated with FLJ23403. G2 (Accession XM_039515) is another VGAM2486 host target gene. G2 BINDING SITE is HOST TARGET binding site found in the 5' untranslated region of mRNA encoded by G2, corresponding to a HOST TARGET binding site such as BINDING SITE I, BINDING SITE II or BINDING SITE III. Table 2 illustrates the complementarity of the nucleotide sequences of G2 BINDING SITE, designated SEQ ID:33110, to the nucleotide sequence of VGAM2486 RNA, herein designated VGAM RNA, also designated SEQ ID:5197.

Another function of VGAM2486 is therefore inhibition of G2 (Accession XM_039515). Accordingly, utilities of VGAM2486 include diagnosis, prevention and treatment of diseases and clinical conditions associated with G2. HOMER-2B (Accession NM_004839) is another VGAM2486 host target gene. HOMER-2B BINDING SITE is HOST TARGET binding site found in the 3' untranslated region of mRNA encoded by HOMER-2B, corresponding to a HOST TARGET binding site such as BINDING SITE I, BINDING SITE II or BINDING SITE III. Table 2 illustrates the complementarity of the nucleotide sequences of HOMER-2B BINDING SITE, designated SEQ ID:11248, to the nucleotide sequence of VGAM2486 RNA, herein designated VGAM RNA, also designated SEQ ID:5197.

Another function of VGAM2486 is therefore inhibition of HOMER-2B (Accession NM_004839). Accordingly, utilities of VGAM2486 include diagnosis, prevention and treatment of diseases and clinical conditions associated with HOMER-2B. KIAA0889 (Accession NM_015377) is another VGAM2486 host target gene. KIAA0889 BINDING SITE is HOST TARGET binding site found in the 3' untranslated region of mRNA encoded by KIAA0889, corresponding to a HOST TARGET binding site such as BINDING SITE I, BINDING SITE II or BINDING SITE III. Table 2 illustrates the complementarity of the nucleotide sequences of KIAA0889 BINDING SITE, designated SEQ ID:17678, to the nucleotide sequence of VGAM2486 RNA, herein designated VGAM RNA, also designated SEQ ID:5197.

Another function of VGAM2486 is therefore inhibition of KIAA0889 (Accession NM_015377). Accordingly, utilities of VGAM2486 include diagnosis, prevention and treatment of diseases and clinical conditions associated with KIAA0889. KIAA1786 (Accession XM_038436) is another VGAM2486 host target gene. KIAA1786 BINDING SITE is HOST TARGET binding site found in the 3' untranslated region of mRNA encoded by KIAA1786, corresponding to a HOST TARGET binding site such as BINDING SITE I, BINDING SITE II or BINDING SITE III. Table 2 illustrates the complementarity of the nucleotide sequences of KIAA1786 BINDING SITE, designated SEQ ID:32845, to the nucleotide sequence of VGAM2486 RNA, herein designated VGAM RNA, also designated SEQ ID:5197.

Another function of VGAM2486 is therefore inhibition of KIAA1786 (Accession XM_038436). Accordingly, utilities of VGAM2486 include diagnosis, prevention and treatment of diseases and clinical conditions associated with KIAA1786. Testis-specific Transcript, Y-linked 2 (TTTY2, Accession XM_099029) is another VGAM2486 host target gene. TTTY2 BINDING SITE is HOST TARGET binding site found in the 5' untranslated region of mRNA encoded by TTTY2, corresponding to a HOST TARGET binding site such as BINDING SITE I, BINDING SITE II or BINDING SITE III. Table 2 illustrates the complementarity of the nucleotide sequences of TTTY2 BINDING SITE, designated SEQ ID:42068, to the nucleotide sequence of VGAM2486 RNA, herein designated VGAM RNA, also designated SEQ ID:5197.

Another function of VGAM2486 is therefore inhibition of Testis-specific Transcript, Y-linked 2 (TTTY2, Accession XM_099029). Accordingly, utilities of VGAM2486 include diagnosis, prevention and treatment of diseases and clinical conditions associated with TTTY2. Zinc Finger Protein 384 (ZNF384, Accession NM_133476) is another VGAM2486 host target gene. ZNF384 BINDING SITE is HOST TARGET binding site found in the 5' untranslated region of mRNA encoded by ZNF384, corresponding to a HOST TARGET binding site such as BINDING SITE I, BINDING SITE II or BINDING SITE III. Table 2 illustrates the complementarity of the nucleotide sequences of ZNF384 BINDING SITE, designated SEQ ID:28543, to the nucleotide sequence of VGAM2486 RNA, herein designated VGAM RNA, also designated SEQ ID:5197.

Another function of VGAM2486 is therefore inhibition of Zinc Finger Protein 384 (ZNF384, Accession NM_133476). Accordingly, utilities of VGAM2486 include diagnosis, prevention and treatment of diseases and clinical conditions associated with ZNF384. LOC126917 (Accession XM_059091) is another VGAM2486 host target gene. LOC126917 BINDING SITE is HOST TARGET binding site found in the 3' untranslated region of mRNA encoded by LOC126917, corresponding to a HOST TARGET binding site such as BINDING SITE I, BINDING SITE II or BINDING SITE III. Table 2 illustrates the complementarity of the nucleotide sequences of LOC126917 BINDING SITE, designated SEQ ID:36873, to the nucleotide sequence of VGAM2486 RNA, herein designated VGAM RNA, also designated SEQ ID:5197.

Another function of VGAM2486 is therefore inhibition of LOC126917 (Accession XM_059091). Accordingly, utilities of VGAM2486 include diagnosis, prevention and treatment of diseases and clinical conditions associated with LOC126917. LOC145945 (Accession XM_096908) is another VGAM2486 host target gene. LOC145945 BINDING SITE is HOST TARGET binding site found in the 5' untranslated region of mRNA encoded by LOC145945, corresponding to a HOST TARGET binding site such as BINDING SITE I, BINDING SITE II or BINDING SITE III. Table 2 illustrates the complementarity of the nucleotide sequences of LOC145945 BINDING SITE, designated SEQ ID:40628, to the nucleotide sequence of VGAM2486 RNA, herein designated VGAM RNA, also designated SEQ ID:5197.

Another function of VGAM2486 is therefore inhibition of LOC145945 (Accession XM_096908). Accordingly, utilities of VGAM2486 include diagnosis, prevention and treatment of diseases and clinical conditions associated with LOC145945. LOC149320 (Accession XM_047557) is another VGAM2486 host target gene. LOC149320 BINDING SITE is HOST TARGET binding site found in the 3' untranslated region of mRNA encoded by LOC149320, corresponding to a HOST TARGET binding site such as BINDING SITE I, BINDING SITE II or BINDING SITE III. Table 2 illustrates the complementarity of the nucleotide sequences of LOC149320 BINDING SITE, designated SEQ ID:35001, to the nucleotide sequence of VGAM2486 RNA, herein designated VGAM RNA, also designated SEQ ID:5197.

Another function of VGAM2486 is therefore inhibition of LOC149320 (Accession XM_047557). Accordingly, utilities of VGAM2486 include diagnosis, prevention and treatment of diseases and clinical conditions associated with LOC149320. LOC152926 (Accession XM_087562) is another VGAM2486 host target gene. LOC152926 BINDING SITE is HOST TARGET binding site found in the 5' untranslated region of mRNA encoded by LOC152926, corresponding to a HOST TARGET binding site such as BINDING SITE I, BINDING SITE II or BINDING SITE III. Table 2 illustrates the complementarity of the nucleotide sequences of LOC152926 BINDING SITE, designated SEQ ID:39339, to the nucleotide sequence of VGAM2486 RNA, herein designated VGAM RNA, also designated SEQ ID:5197.

Another function of VGAM2486 is therefore inhibition of LOC152926 (Accession XM_087562). Accordingly, utilities of VGAM2486 include diagnosis, prevention and treatment of diseases and clinical conditions associated with LOC152926. LOC159148 (Accession XM_099030) is another VGAM2486 host target gene. LOC159148 BINDING SITE is HOST TARGET binding site found in the 5' untranslated region of mRNA encoded by LOC159148, corresponding to a HOST TARGET binding site such as BINDING SITE I, BINDING SITE II or BINDING SITE III. Table 2 illustrates the complementarity of the nucleotide sequences of LOC159148 BINDING SITE, designated SEQ ID:42075, to the nucleotide sequence of VGAM2486 RNA, herein designated VGAM RNA, also designated SEQ ID:5197.

Another function of VGAM2486 is therefore inhibition of LOC159148 (Accession XM_099030). Accordingly, utilities of VGAM2486 include diagnosis, prevention and treatment of diseases and clinical conditions associated with LOC159148. LOC255196 (Accession XM_173157) is another VGAM2486 host target gene. LOC255196 BINDING SITE is HOST TARGET binding site found in the 5' untranslated region of mRNA encoded by LOC255196, corresponding to a HOST TARGET binding site such as BINDING SITE I, BINDING SITE II or BINDING SITE III. Table 2 illustrates the complementarity of the nucleotide sequences of LOC255196 BINDING SITE, designated SEQ ID:46412, to the nucleotide sequence of VGAM2486 RNA, herein designated VGAM RNA, also designated SEQ ID:5197.

Another function of VGAM2486 is therefore inhibition of LOC255196 (Accession XM_173157). Accordingly, utilities of VGAM2486 include diagnosis, prevention and treatment of diseases and clinical conditions associated with LOC255196. LOC93613 (Accession XM_052568) is another VGAM2486 host target gene. LOC93613 BINDING SITE is HOST TARGET binding site found in the 3' untranslated region of mRNA encoded by LOC93613, corresponding to a HOST TARGET binding site such as BINDING SITE I, BINDING SITE II or BINDING SITE III. Table 2 illustrates the complementarity of the nucleotide sequences of LOC93613 BINDING SITE, designated SEQ ID:35997, to the nucleotide sequence of VGAM2486 RNA, herein designated VGAM RNA, also designated SEQ ID:5197.

Another function of VGAM2486 is therefore inhibition of LOC93613 (Accession XM_052568). Accordingly, utilities of VGAM2486 include diagnosis, prevention and treatment of diseases and clinical conditions associated with LOC93613. FIG. 1 further provides a conceptual description of a novel bioinformatically detected viral gene of the present invention, referred to here as Viral Genomic Address Messenger 2487 (VGAM2487) viral gene, which modulates expression of respective host target genes thereof, the function and utility of which host target genes is known in the art.

VGAM2487 is a novel bioinformatically detected regulatory, non protein coding, viral micro RNA (miRNA) gene. The method by which VGAM2487 was detected is described hereinabove with reference to FIGS. 1-8.

VGAM2487 gene, herein designated VGAM GENE, is a viral gene contained in the genome of Mouse Cytomegalovirus 1. VGAM2487 host target gene, herein designated VGAM HOST TARGET GENE, is a human gene contained in the human genome.

VGAM2487 gene encodes a VGAM2487 precursor RNA, herein designated VGAM PRECURSOR RNA. Similar to other miRNA genes, and unlike most ordinary genes, VGAM2487 precursor RNA does not encode a protein. A nucleotide sequence identical or highly similar to the nucleotide sequence of VGAM2487 precursor RNA is designated SEQ ID:2473, and is provided hereinbelow with reference to the sequence listing part. Nucleotide sequence SEQ ID:2473 is located at position 105519 relative to the genome of Mouse Cytomegalovirus 1.

VGAM2487 precursor RNA folds onto itself, forming VGAM2487 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2487 folded precursor RNA into VGAM2487 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2487 RNA is designated SEQ ID:5198, and is provided hereinbelow with reference to the sequence listing part.

VGAM2487 host target gene, herein designated VGAM HOST TARGET GENE, encodes a corresponding messenger RNA, VGAM2487 host target RNA, herein designated VGAM HOST TARGET RNA. VGAM2487 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2487 RNA, herein designated VGAM RNA, binds complementarily to one or more host target binding sites located in untranslated regions of VGAM2487 host target RNA, herein designated VGAM HOST TARGET RNA. This complementary binding is due to the fact that the nucleotide sequence of VGAM2487 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2487 RNA, herein designated VGAM RNA, may have a different number of host target binding sites in untranslated regions of a VGAM2487 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2487 RNA, herein designated VGAM RNA, to host target binding sites on VGAM2487 host target RNA, herein designated VGAM HOST TARGET RNA, such as BINDING SITE I, BINDING SITE II and BINDING SITE III, inhibits translation of VGAM2487 host target RNA into VGAM2487 host target protein, herein designated VGAM HOST TARGET PROTEIN. VGAM host target protein is therefore outlined by a broken line.

It is appreciated that VGAM2487 host target gene, herein designated VGAM HOST TARGET GENE, in fact represents a plurality of VGAM2487 host target genes. The mRNA of each one of this plurality of VGAM2487 host target genes comprises one or more host target binding sites, each having a nucleotide sequence which is at least partly complementary to VGAM2487 RNA, herein designated VGAM RNA, and which when bound by VGAM2487 RNA causes inhibition of translation of respective one or more VGAM2487 host target proteins.

It is further appreciated by one skilled in the art that the mode of translational inhibition illustrated by FIG. 1 with specific reference to translational inhibition exerted by VGAM2487 gene, herein designated VGAM GENE, on one or more VGAM2487 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2487 is inhibition of expression of host target genes, as part of a novel viral mechanism of attacking a host. Accordingly, utilities of VGAM2487 include diagnosis, prevention and treatment of viral infection by Mouse Cytomegalovirus 1. Specific functions, and accordingly utilities, of VGAM2487 correlate with, and may be deduced from, the identity of the host target genes which VGAM2487 binds and inhibits, and the function of these host target genes, as elaborated hereinbelow.

Nucleotide sequences of the VGAM2487 precursor RNA, herein designated VGAM PRECURSOR RNA, and of the 'diced' VGAM2487 RNA, herein designated VGAM RNA, and a schematic representation of the secondary folding of VGAM2487 folded precursor RNA, herein designated VGAM FOLDED PRECURSOR RNA, of VGAM2487 are further described hereinbelow with reference to Table 1.

Nucleotide sequences of host target binding sites, such as BINDING SITE-I, BINDING SITE-II and BINDING SITE-III of FIG. 1, found on VGAM2487 host target RNA, and schematic representation of the complementarity of each of these host target binding sites to VGAM2487 RNA, herein designated VGAM RNA, are described hereinbelow with reference to Table 2.

As mentioned hereinabove with reference to FIG. 1, a function of VGAM2487 gene, herein designated VGAM is inhibition of expression of VGAM2487 target genes. It is appreciated that specific functions, and accordingly utilities, of VGAM2487 correlate with, and may be deduced from, the identity of the target genes which VGAM2487 binds and inhibits, and the function of these target genes, as elaborated hereinbelow.

Giant Axonal Neuropathy (gigaxonin) (GAN, Accession NM_022041) is a VGAM2487 host target gene. GAN BINDING SITE is HOST TARGET binding site found in the 3' untranslated region of mRNA encoded by GAN, corresponding to a HOST TARGET binding site such as BINDING SITE I, BINDING SITE II or BINDING SITE III. Table 2 illustrates the complementarity of the nucleotide sequences of GAN BINDING SITE, designated SEQ ID:22564, to the nucleotide sequence of VGAM2487 RNA, herein designated VGAM RNA, also designated SEQ ID:5198.

A function of VGAM2487 is therefore inhibition of Giant Axonal Neuropathy (gigaxonin) (GAN, Accession NM_022041), a gene which plays an important role in neurofilament architecture. Accordingly, utilities of VGAM2487 include diagnosis, prevention and treatment of diseases and clinical conditions associated with GAN. The function of GAN and its association with various diseases and clinical conditions, has been established by previous studies, as described hereinabove with reference to VGAM606. FLJ20174 (Accession NM_017699) is another VGAM2487 host target gene. FLJ20174 BINDING SITE is HOST TARGET binding site found in the 3' untranslated region of mRNA encoded by FLJ20174, corresponding to a HOST TARGET binding site such as BINDING SITE I, BINDING SITE II or BINDING SITE III. Table 2 illustrates the complementarity of the nucleotide sequences of FLJ20174 BINDING SITE, designated SEQ ID:19269, to the nucleotide sequence of VGAM2487 RNA, herein designated VGAM RNA, also designated SEQ ID:5198.

Another function of VGAM2487 is therefore inhibition of FLJ20174 (Accession NM_017699). Accordingly, utilities of VGAM2487 include diagnosis, prevention and treatment of diseases and clinical conditions associated with FLJ20174. KIAA0286 (Accession XM_043118) is another VGAM2487 host target gene. KIAA0286 BINDING SITE is HOST TARGET binding site found in the 3' untranslated region of mRNA encoded by KIAA0286, corresponding to a HOST TARGET binding site such as BINDING SITE I, BINDING SITE II or BINDING SITE III. Table 2 illustrates the complementarity of the nucleotide sequences of KIAA0286 BINDING SITE, designated SEQ ID:33902, to the nucleotide sequence of VGAM2487 RNA, herein designated VGAM RNA, also designated SEQ ID:5198.

Another function of VGAM2487 is therefore inhibition of KIAA0286 (Accession XM_043118). Accordingly, utilities of VGAM2487 include diagnosis, prevention and treatment of diseases and clinical conditions associated with KIAA0286. KIAA0930 (Accession XM_047214) is another VGAM2487 host target gene. KIAA0930 BINDING SITE is HOST TARGET binding site found in the 3' untranslated region of mRNA encoded by KIAA0930, corresponding to a HOST TARGET binding site such as BINDING SITE I, BINDING SITE II or BINDING SITE III. Table 2 illustrates the complementarity of the nucleotide sequences of KIAA0930 BINDING SITE, designated SEQ ID:34911, to the nucleotide sequence of VGAM2487 RNA, herein designated VGAM RNA, also designated SEQ ID:5198.

Another function of VGAM2487 is therefore inhibition of KIAA0930 (Accession XM_047214). Accordingly, utilities of VGAM2487 include diagnosis, prevention and treatment of diseases and clinical conditions associated with KIAA0930. Myosin 5C (MYO5C, Accession NM_018728) is another VGAM2487 host target gene. MYO5C BINDING SITE is HOST TARGET binding site found in the 3' untranslated region of mRNA encoded by MYO5C, corresponding to a HOST TARGET binding site such as BINDING SITE I, BINDING SITE II or BINDING SITE III. Table 2 illustrates the complementarity of the nucleotide sequences of MYO5C BINDING SITE, designated SEQ ID:20817, to the nucleotide sequence of VGAM2487 RNA, herein designated VGAM RNA, also designated SEQ ID:5198.

Another function of VGAM2487 is therefore inhibition of Myosin 5C (MYO5C, Accession NM_018728). Accordingly, utilities of VGAM2487 include diagnosis, prevention and treatment of diseases and clinical conditions associated with MYO5C. LOC144600 (Accession XM_096639) is another VGAM2487 host target gene. LOC144600 BINDING SITE is HOST TARGET binding site found in the 3' untranslated region of mRNA encoded by LOC144600, corresponding to a HOST TARGET binding site such as BINDING SITE I, BINDING SITE II or BINDING SITE III. Table 2 illustrates the complementarity of the nucleotide sequences of LOC144600 BINDING SITE, designated SEQ ID:40445, to the nucleotide sequence of VGAM2487 RNA, herein designated VGAM RNA, also designated SEQ ID:5198.

Another function of VGAM2487 is therefore inhibition of LOC144600 (Accession XM_096639). Accordingly, utilities of VGAM2487 include diagnosis, prevention and treatment of diseases and clinical conditions associated with LOC144600. LOC90768 (Accession XM_033986) is another VGAM2487 host target gene. LOC90768 BINDING SITE is HOST TARGET binding site found in the 3' untranslated region of mRNA encoded by LOC90768, corresponding to a HOST TARGET binding site such as BINDING SITE I, BINDING SITE II or BINDING SITE III. Table 2 illustrates the complementarity of the nucleotide sequences of LOC90768 BINDING SITE, designated SEQ ID:31987, to the nucleotide sequence of VGAM2487 RNA, herein designated VGAM RNA, also designated SEQ ID:5198.

Another function of VGAM2487 is therefore inhibition of LOC90768 (Accession XM_033986). Accordingly, utilities of VGAM2487 include diagnosis, prevention and treatment of diseases and clinical conditions associated with LOC90768. FIG. 1 further provides a conceptual description of a novel bioinformatically detected viral gene of the present invention, referred to here as Viral Genomic Address Messenger 2488 (VGAM2488) viral gene, which modulates expression of respective host target genes thereof, the function and utility of which host target genes is known in the art.

VGAM2488 is a novel bioinformatically detected regulatory, non protein coding, viral micro RNA (miRNA) gene. The method by which VGAM2488 was detected is described hereinabove with reference to FIGS. 1-8.

VGAM2488 gene, herein designated VGAM GENE, is a viral gene contained in the genome of Mouse Cytomegalovirus 1. VGAM2488 host target gene, herein designated VGAM HOST TARGET GENE, is a human gene contained in the human genome.

VGAM2488 gene encodes a VGAM2488 precursor RNA, herein designated VGAM PRECURSOR RNA. Similar to other miRNA genes, and unlike most ordinary genes, VGAM2488 precursor RNA does not encode a protein. A nucleotide sequence identical or highly similar to the nucleotide sequence of VGAM2488 precursor RNA is designated SEQ ID:2474, and is provided hereinbelow with reference to the sequence listing part. Nucleotide sequence SEQ ID:2474 is located at position 77638 relative to the genome of Mouse Cytomegalovirus 1.

VGAM2488 precursor RNA folds onto itself, forming VGAM2488 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2488 folded precursor RNA into VGAM2488 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2488 RNA is designated SEQ ID:5199, and is provided hereinbelow with reference to the sequence listing part.

VGAM2488 host target gene, herein designated VGAM HOST TARGET GENE, encodes a corresponding messenger RNA, VGAM2488 host target RNA, herein designated VGAM HOST TARGET RNA. VGAM2488 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2488 RNA, herein designated VGAM RNA, binds complementarily to one or more host target binding sites located in untranslated regions of VGAM2488 host target RNA, herein designated VGAM HOST TARGET RNA. This complementary binding is due to the fact that the nucleotide sequence of VGAM2488 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2488 RNA, herein designated VGAM RNA, may have a different number of host target binding sites in untranslated regions of a VGAM2488 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2488 RNA, herein designated VGAM RNA, to host target binding sites on VGAM2488 host target RNA, herein designated VGAM HOST TARGET RNA, such as BINDING SITE I, BINDING SITE II and BINDING SITE III, inhibits translation of VGAM2488 host target RNA into VGAM2488 host target protein, herein designated VGAM HOST TARGET PROTEIN. VGAM host target protein is therefore outlined by a broken line.

It is appreciated that VGAM2488 host target gene, herein designated VGAM HOST TARGET GENE, in fact represents a plurality of VGAM2488 host target genes. The mRNA of each one of this plurality of VGAM2488 host target genes comprises one or more host target binding sites, each having a nucleotide sequence which is at least partly complementary to VGAM2488 RNA, herein designated VGAM RNA, and which when bound by VGAM2488 RNA causes inhibition of translation of respective one or more VGAM2488 host target proteins.

It is further appreciated by one skilled in the art that the mode of translational inhibition illustrated by FIG. 1 with specific reference to translational inhibition exerted by VGAM2488 gene, herein designated VGAM GENE, on one or more VGAM2488 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2488 is inhibition of expression of host target genes, as part of a novel viral mechanism of attacking a host. Accordingly, utilities of VGAM2488 include diagnosis, prevention and treatment of viral infection by Mouse Cytomegalovirus 1. Specific functions, and accordingly utilities, of VGAM2488 correlate with, and may be deduced from, the identity of the host target genes which VGAM2488 binds and inhibits, and the function of these host target genes, as elaborated hereinbelow.

Nucleotide sequences of the VGAM2488 precursor RNA, herein designated VGAM PRECURSOR RNA, and of the 'diced' VGAM2488 RNA, herein designated VGAM RNA, and a schematic representation of the secondary folding of VGAM2488 folded precursor RNA, herein designated VGAM FOLDED PRECURSOR RNA, of VGAM2488 are further described hereinbelow with reference to Table 1.

Nucleotide sequences of host target binding sites, such as BINDING SITE-I, BINDING SITE-II and BINDING SITE-III of FIG. 1, found on VGAM2488 host target RNA, and schematic representation of the complementarity of each of these host target binding sites to VGAM2488 RNA, herein designated VGAM RNA, are described hereinbelow with reference to Table 2.

As mentioned hereinabove with reference to FIG. 1, a function of VGAM2488 gene, herein designated VGAM is inhibition of expression of VGAM2488 target genes. It is appreciated that specific functions, and accordingly utilities, of VGAM2488 correlate with, and may be deduced from, the identity of the target genes which VGAM2488 binds and inhibits, and the function of these target genes, as elaborated hereinbelow.

ATP-binding Cassette, Sub-family B (MDR/TAP), Member 1 (ABCB1, Accession NM_000927) is a VGAM2488 host target gene. ABCB1 BINDING SITE is HOST TARGET binding site found in the 5' untranslated region of mRNA encoded by ABCB1, corresponding to a HOST TARGET binding site such as BINDING SITE I, BINDING SITE II or BINDING SITE III. Table 2 illustrates the complementarity of the nucleotide sequences of ABCB1 BINDING SITE, designated SEQ ID:6637, to the nucleotide sequence of VGAM2488 RNA, herein designated VGAM RNA, also designated SEQ ID:5199.

A function of VGAM2488 is therefore inhibition of ATP-binding Cassette, Sub-family B (MDR/TAP), Member 1 (ABCB1, Accession NM_000927), a gene which energy-dependent efflux pump responsible for decreased drug accumulation in multidrug-resistant cells. Accordingly, utilities of VGAM2488 include diagnosis, prevention and treatment of diseases and clinical conditions associated with ABCB1. The function of ABCB1 has been established by previous studies. MDR1 encodes a large transmembrane protein that is an integral part of the blood-brain barrier and functions as a drug-transport pump transporting a variety of drugs from the brain back into the blood. The development of simultaneous resistance to multiple structurally unrelated drugs is a major impediment to cancer chemotherapy. Shen et al. (1986) showed that multidrug resistance in human KB carcinoma cells selected in colchicine, vinblastine, or Adriamycin is associated with amplification of specific DNA sequences termed the multidrug resistance locus (MDR1). Increased expression and amplification of MDR1 sequences were also found in multidrug-resistant sublines of human leukemia and ovarian carcinoma cells. Overexpression of P-glycoprotein-1 appears to be a consistent feature of mammalian cells displaying resistance to multiple anticancer drugs and has been postulated to mediate resistance (Kartner et al., 1985; Riordan et al., 1985). Roninson et al. (1986) found that multidrug resistance correlated with amplification of 2 related DNA sequences, designated MDR1 and MDR2 (MDR2 OMIM Ref. No. 171060). These sequences were isolated through their homology with the Chinese hamster mdr gene. MDR1 encodes a 4.5-kb mRNA and was amplified or overexpressed in all multidrug-resistant human cell lines analyzed. No mRNA corresponding to MDR2 was detected. MDR2 DNA sequences are coamplified with MDR1 in some but not all multidrug-resistant cell lines. Some specific subgroups of mice and dogs are exquisitely sensitive to the neurologic actions of ivermectin. Studying a subpopulation of collie dogs, Mealey et al. (2001) found that a deletion mutation of the MDR1 gene is associated with ivermectin sensitivity. The 4-bp deletion resulted in a frameshift, generating several stop codons that prematurely terminate the P-glycoprotein gene product. The homozygous normal or heterozygous animals did not display increased sensitivity. Animal model experiments lend further support to the function of ABCB1. Schinkel et al. (1994) generated mice homozygous for a disruption of the mdr1a gene. The mice were viable and fertile and appeared phenotypically normal, but they displayed an increased sensitivity to the centrally neurotoxic pesticide ivermectin (100-fold) and to the carcinostatic drug vinblastine (OMIM Ref. No. 3-fold). By comparison of the homozygous null mice with wildtype mice, they found that the mdr1a P-glycoprotein is the major P-glycoprotein in the blood-brain barrier and that its absence results in elevated drug levels in many tissues, especially in brain, and in decreased drug elimination.

It is appreciated that the abovementioned animal model for ABCB1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Mealey, K. L.; Bentjen, S. A.; Gay, J. M.; Cantor, G. H.: Ivermectin sensitivity in collies is associated with a deletion mutation of the mdr1 gene. Pharmacogenetics 11:727-733, 2001; and Shen, D.-W.; Fojo, A.; Chin, J. E.; Roninson, I. B.; Richert, N.; Pastan, I.; Gottesman, M. M.: Human multidrug-resistant cell lines: increased mdr1 expression can precede gene amplif.

Further studies establishing the function and utilities of ABCB1 are found in John Hopkins OMIM database record ID 171050, and in sited publications numbered 11172-11181, 10830-10831, 2291-2292, 383 and 3865-3892 listed in the bibliography section hereinbelow, which are also hereby incorporated by reference. ACN (Accession NM_014977) is another VGAM2488 host target gene. ACN BINDING SITE is HOST TARGET binding site found in the 5' untranslated region of mRNA encoded by ACN, corresponding to a HOST TARGET binding site such as BINDING SITE I, BINDING SITE II or BINDING SITE III. Table 2 illustrates the complementarity of the nucleotide sequences of ACN BINDING SITE, designated SEQ ID:17362, to the nucleotide sequence of VGAM2488 RNA, herein designated VGAM RNA, also designated SEQ ID:5199.

Another function of VGAM2488 is therefore inhibition of ACN (Accession NM_014977), a gene which is essential for apoptotic chromatin condensation in vitro. Accordingly, utilities of VGAM2488 include diagnosis, prevention and treatment of diseases and clinical conditions associated with ACN. The function of ACN has been established by previous studies. Apoptosis is defined by several unique morphologic nuclear changes, including chromatin condensation and nuclear fragmentation. These changes are triggered by the activation of a family of cysteine proteases called caspases (see OMIM Ref. No. 147678), and caspase-activated DNase (CAD/DFF40; 601883) and lamin protease (see OMIM Ref. No. 150330) have been implicated in some of these changes. CAD/DFF40 induces chromatin condensation in purified nuclei, but distinct caspase-activated factor (s) may be responsible for chromatin condensation. Sahara et al. (1999) used an in vitro system to purify a nuclear factor which induces apoptotic chromatin condensation after cleavage by caspase-3 (OMIM Ref. No. 600636) without inducing DNA fragmentation from bovine thymus lysate. The name of the factor, 'acinus,' is both an acronym for 'apoptotic chromatin condensation inducer in the nucleus' and the Latin word for 'grape' or 'berry,' denotive of the grape-like appearance of the condensed chromatin. Immunodepletion experiments showed that acinus is essential for apoptotic chromatin condensation in vitro, and an antisense study revealed that acinus is also important in the induction of apoptotic chromatin condensation in cells. Ishikawa et al. (1998) found that KIAA0670 is ubiquitously expressed. Using the KIAA0670 clone, Sahara et al. (1999) obtained 3 isoforms of human acinus cDNA, the L, S, and S-prime forms, which they stated had probably been generated by alternative splicing.

Full details of the abovementioned studies are described in the following publications, the disclosure of which are hereby incorporated by reference:

Ishikawa, K.; Nagase, T.; Suyama, M.; Miyajima, N.; Tanaka, A.; Kotani, H.; Nomura, N.; Ohara, O.: Prediction of coding sequences of unidentified human genes. X. The complete sequences of 100 new cDNA clones from brain which can code for large proteins in vitro. DNA Res. 5:169-176, 1998; and Sahara, S.; Aoto, M.; Eguchi, Y.; Imamoto, N.; Yoneda, Y.; Tsujimoto, Y.: Acinus is a caspase-3-activated protein required for apoptotic chromatin condensation. Nature 401: 168-173, 19.

Further studies establishing the function and utilities of ACN are found in John Hopkins OMIM database record ID 604562, and in sited publications numbered 8473 listed in the bibliography section hereinbelow, which are also hereby incorporated by reference. Rho GTPase Activating Protein 6 (ARHGAP6, Accession NM_006125) is another VGAM2488 host target gene. ARHGAP6 BINDING SITE1 and ARHGAP6 BINDING SITE2 are HOST TARGET binding sites found in untranslated regions of mRNA encoded by ARHGAP6, corresponding to HOST TARGET binding sites such as BINDING SITE I, BINDING SITE II or BINDING SITE III. Table 2 illustrates the complementarity of the nucleotide sequences of ARHGAP6 BINDING SITE1 and ARHGAP6 BINDING SITE2, designated SEQ ID:12767 and SEQ ID:6845 respectively, to the nucleotide sequence of VGAM2488 RNA, herein designated VGAM RNA, also designated SEQ ID:5199.

Another function of VGAM2488 is therefore inhibition of Rho GTPase Activating Protein 6 (ARHGAP6, Accession NM_006125), a gene which activates the rho-type GTPases by converting them to an inactive GTP-bound state. Accordingly, utilities of VGAM2488 include diagnosis, prevention and treatment of diseases and clinical conditions associated with ARHGAP6. The function of ARHGAP6 and its association with various diseases and clinical conditions, has been established by previous studies, as described hereinabove with reference to VGAM55. Dachshund Homolog (Drosophila) (DACH, Accession NM_080759) is another VGAM2488 host target gene. DACH BINDING SITE is HOST TARGET binding site found in the 5' untranslated region of mRNA encoded by DACH, corresponding to a HOST TARGET binding site such as BINDING SITE I, BINDING SITE II or BINDING SITE III. Table 2 illustrates the complementarity of the nucleotide sequences of DACH BINDING SITE, designated SEQ ID:28039, to the nucleotide sequence of VGAM2488 RNA, herein designated VGAM RNA, also designated SEQ ID:5199.

Another function of VGAM2488 is therefore inhibition of Dachshund Homolog (Drosophila) (DACH, Accession NM_080759), a gene which regulates early progenitor cell proliferation during retinogenesis and pituitary development. Accordingly, utilities of VGAM2488 include diagnosis, prevention and treatment of diseases and clinical conditions associated with DACH. The function of DACH and its association with various diseases and clinical conditions, has been established by previous studies, as described hereinabove with reference to VGAM260. Deleted In Liver Cancer 1 (DLC1, Accession NM_006094) is another VGAM2488 host target gene. DLC1 BINDING SITE is HOST TARGET binding site found in the 5' untranslated region of mRNA encoded by DLC1, corresponding to a HOST TARGET binding site such as BINDING SITE I, BINDING SITE II or BINDING SITE III. Table 2 illustrates the complementarity of the nucleotide sequences of DLC1 BINDING SITE, designated SEQ ID:12743, to the nucleotide sequence of VGAM2488 RNA, herein designated VGAM RNA, also designated SEQ ID:5199.

Another function of VGAM2488 is therefore inhibition of Deleted In Liver Cancer 1 (DLC1, Accession NM_006094), a gene which is a candidate tumor suppressor gene for human cancer. Accordingly, utilities of VGAM2488 include diagnosis, prevention and treatment of diseases and clinical conditions associated with DLC1. The function of DLC1 has been established by previous studies. To identify genes involved in hepatocellular carcinoma (HCC; 114550), Yuan et al. (1998) applied representational difference analysis (RDA), a PCR-based subtractive hybridization technique, to DNA derived from a primary HCC and adjacent noncancerous tissue from the same patient. They identified the novel gene DLC1 as a fragment that was deleted in the primary tumor. Seven of 16 primary HCCs and 10 of 11 HCC cell lines showed loss of heterozygosity (LOH) for the DLC1 gene. Northern blot analysis detected a major 7.5- and a minor 4.5-kb DLC1 transcript in all human tissues examined, including liver, but did not find DLC1 expression in 4 of 14 HCC cell lines. The authors isolated a full-length DLC1 cDNA encoding a deduced 1,091-amino acid protein. The DLC1 gene shares high sequence similarity with the rat p122 RhoGap gene (see OMIM Ref. No. 602680). By FISH, Yuan et al. (1998) mapped the DLC1 gene to 8p22-p21.3, a region frequently deleted in solid tumors. The authors suggested that DLC1 is a candidate tumor suppressor gene for human liver cancer, as well as for prostate, lung, colorectal, and breast cancers. Wilson et al. (2000) delineated the structure of the DLC1 gene and used SSCP analysis to look for sequence variants in 126 colorectal and 33 ovarian primary tumors and cell lines. One exonic missense mutation and 3 intronic insertions/deletions were identified in primary colorectal tumors, as well as many polymorphisms present in germline DNAs. The rarity of exonic missense mutations, and the absence of protein-truncating mutations, indicated that DLC1 is not the target of the LOH frequently observed on 8p in colorectal and ovarian tumors. The delineation of gene structure allows mutation analysis of DLC1 in other tumor types for which it remains a candidate tumor suppressor gene based on its location and homology to RHOGAP (OMIM Ref. No. 602732).

Full details of the abovementioned studies are described in the following publications, the disclosure of which are hereby incorporated by reference:

Wilson, P. J.; McGlinn, E.; Marsh, A.; Evans, T.; Arnold, J.; Wright, K.; Biden, K.; Young, J.; Wainwright, B.; Wicking, C.; Chenevix-Trench, G.: Sequence variants of DLC1 in colorectal and ovarian tumours. Hum. Mutat. 15:156-165, 2000; and Yuan, B.-Z.; Miller, M. J.; Keck, C. L.; Zimonjic, D. B.; Thorgeirsson, S. S.; Popescu, N. C.: Cloning, characterization, and chromosomal localization of a gene frequently deleted in.

Further studies establishing the function and utilities of DLC1 are found in John Hopkins OMIM database record ID 604258, and in sited publications numbered 7069-7071 listed in the bibliography section hereinbelow, which are also hereby incorporated by reference. Mutated In Colorectal Cancers (MCC, Accession NM_002387) is another VGAM2488 host target gene. MCC BINDING SITE is HOST TARGET binding site found in the 3' untranslated region of mRNA encoded by MCC, corresponding to a HOST TARGET binding site such as BINDING SITE I, BINDING SITE II or BINDING SITE III. Table 2 illustrates the complementarity of the nucleotide sequences of MCC BINDING SITE, designated SEQ ID:8203, to the nucleotide sequence of VGAM2488 RNA, herein designated VGAM RNA, also designated SEQ ID:5199.

Another function of VGAM2488 is therefore inhibition of Mutated In Colorectal Cancers (MCC, Accession NM_002387). Accordingly, utilities of VGAM2488 include diagnosis, prevention and treatment of diseases and clinical conditions associated with MCC. Phosphoglycerate Mutase 1 (brain) (PGAM1, Accession XM_083842) is another VGAM2488 host target gene. PGAM1 BINDING SITE is HOST TARGET binding site found in the 3' untranslated region of mRNA encoded by PGAM1, corresponding to a HOST TARGET binding site such as BINDING SITE I, BINDING SITE II or BINDING SITE III. Table 2 illustrates the complementarity of the nucleotide sequences of PGAM1 BINDING SITE, designated SEQ ID:37518, to the nucleotide sequence of VGAM2488 RNA, herein designated VGAM RNA, also designated SEQ ID:5199.

Another function of VGAM2488 is therefore inhibition of Phosphoglycerate Mutase 1 (brain) (PGAM1, Accession XM_083842). Accordingly, utilities of VGAM2488 include diagnosis, prevention and treatment of diseases and clinical conditions associated with PGAM1. Phospholipase A2, Group X (PLA2G10, Accession NM_003561) is another VGAM2488 host target gene. PLA2G10 BINDING SITE is HOST TARGET binding site found in the 5' untranslated region of mRNA encoded by PLA2G10, corresponding to a HOST TARGET binding site such as BINDING SITE I, BINDING SITE II or BINDING SITE III. Table 2 illustrates the complementarity of the nucleotide sequences of PLA2G10 BINDING SITE, designated SEQ ID:9618, to the nucleotide sequence of VGAM2488 RNA, herein designated VGAM RNA, also designated SEQ ID:5199.

Another function of VGAM2488 is therefore inhibition of Phospholipase A2, Group X (PLA2G10, Accession NM_003561). Accordingly, utilities of VGAM2488 include diagnosis, prevention and treatment of diseases and clinical conditions associated with PLA2G10. Pleckstrin and Sec7 Domain Protein (PSD, Accession NM_002779) is another VGAM2488 host target gene. PSD BINDING SITE is HOST TARGET binding site found in the 5" untranslated region of mRNA encoded by PSD, corresponding to a HOST TARGET binding site such as BINDING SITE I, BINDING SITE II or BINDING SITE III. Table 2 illustrates the complementarity of the nucleotide sequences of PSD BINDING SITE, designated SEQ ID:8666, to the nucleotide sequence of VGAM2488 RNA, herein designated VGAM RNA, also designated SEQ ID:5199.

Another function of VGAM2488 is therefore inhibition of Pleckstrin and Sec7 Domain Protein (PSD, Accession NM_002779), a gene which promotes guanine-nucleotide exchange on arf6. Accordingly, utilities of VGAM2488 include diagnosis, prevention and treatment of diseases and clinical conditions associated with PSD. The function of PSD and its association with various diseases and clinical conditions, has been established by previous studies, as described hereinabove with reference to VGAM261. SRY (sex determining region Y)-box 9 (campomelic dysplasia, autosomal sex-reversal) (SOX9, Accession NM_000346) is another VGAM2488 host target gene. SOX9 BINDING SITE is HOST TARGET binding site found in the 5' untranslated region of mRNA encoded by SOX9, corresponding to a HOST TARGET binding site such as BINDING SITE I, BINDING SITE II or BINDING SITE III. Table 2 illustrates the complementarity of the nucleotide sequences of SOX9 BINDING SITE, designated SEQ ID:5898, to the nucleotide sequence of VGAM2488 RNA, herein designated VGAM RNA, also designated SEQ ID:5199.

Another function of VGAM2488 is therefore inhibition of SRY (sex determining region Y)-box 9 (campomelic dysplasia, autosomal sex-reversal) (SOX9, Accession NM_000346), a gene which regulates the expression of other genes involved in chondrogenesis. Accordingly, utilities of VGAM2488 include diagnosis, prevention and treatment of diseases and clinical conditions associated with SOX9. The function of SOX9 and its association with various diseases and clinical conditions, has been established by previous studies, as described hereinabove with reference to VGAM329. Thromboxane A2 Receptor (TBXA2R, Accession NM_001060) is another VGAM2488 host target gene. TBXA2R BINDING SITE is HOST TARGET binding site found in the 3' untranslated region of mRNA encoded by TBXA2R, corresponding to a HOST TARGET binding site such as BINDING SITE I, BINDING SITE II or BINDING SITE III. Table 2 illustrates the complementarity of the nucleotide sequences of TBXA2R BINDING SITE, designated SEQ ID:6724, to the nucleotide sequence of VGAM2488 RNA, herein designated VGAM RNA, also designated SEQ ID:5199.

Another function of VGAM2488 is therefore inhibition of Thromboxane A2 Receptor (TBXA2R, Accession NM_001060), a gene which activates Ca2+-activated chloride channels; stimulates platelet aggregation and smooth muscle constriction. Accordingly, utilities of VGAM2488 include diagnosis, prevention and treatment of diseases and clinical conditions associated with TBXA2R. The function of TBXA2R and its association with various diseases and clinical conditions, has been established by previous studies, as described hereinabove with reference to VGAM433. Transcription Factor 1, Hepatic; LF-B1, Hepatic Nuclear Factor (HNF1), Albumin Proximal Factor (TCF1, Accession NM_000545) is another VGAM2488 host target gene. TCF1 BINDING SITE is HOST TARGET binding site found in the 3' untranslated region of mRNA encoded by TCF1, corresponding to a HOST TARGET binding site such as BINDING SITE I, BINDING SITE II or BINDING SITE III. Table 2 illustrates the complementarity of the nucleotide sequences of TCF1 BINDING SITE, designated SEQ ID:6150, to the nucleotide sequence of VGAM2488 RNA, herein designated VGAM RNA, also designated SEQ ID:5199.

Another function of VGAM2488 is therefore inhibition of Transcription Factor 1, Hepatic; LF-B1, Hepatic Nuclear Factor (HNF1), Albumin Proximal Factor (TCF1, Accession NM_000545), a gene which is required for the expression of several liver specific genes. binds to the inverted palindrome 5'-gttaatnattaac-3'. Accordingly, utilities of VGAM2488 include diagnosis, prevention and treatment of diseases and clinical conditions associated with TCF1. The function of TCF1 and its association with various diseases and clinical conditions, has been established by previous studies, as described hereinabove with reference to VGAM1189. Translocase of Inner Mitochondrial Membrane 23 Homolog (yeast) (TIMM23, Accession XM_011891) is another VGAM2488 host target gene. TIMM23 BINDING SITE is HOST TARGET binding site found in the 3' untranslated region of mRNA encoded by TIMM23, corresponding to a HOST TARGET binding site such as BINDING SITE I, BINDING SITE II or BINDING SITE III. Table 2 illustrates the complementarity of the nucleotide sequences of TIMM23 BINDING SITE, designated SEQ ID:30198, to the nucleotide sequence of VGAM2488 RNA, herein designated VGAM RNA, also designated SEQ ID:5199.

Another function of VGAM2488 is therefore inhibition of Translocase of Inner Mitochondrial Membrane 23 Homolog (yeast) (TIMM23, Accession XM_011891), a gene which translocates nuclear-encoded proteins into the mitochondrion. Accordingly, utilities of VGAM2488 include diagnosis, prevention and treatment of diseases and clinical conditions associated with TIMM23. The function of TIMM23 and its association with various diseases and clinical conditions, has been established by previous studies, as described hereinabove with reference to VGAM1958. Diacylglycerol Kinase, Zeta 104 kDa (DGKZ, Accession NM_003646) is another VGAM2488 host target gene. DGKZ BINDING SITE is HOST TARGET binding site found in the 3' untranslated region of mRNA encoded by DGKZ, corresponding to a HOST TARGET binding site such as BINDING SITE I, BINDING SITE II or BINDING SITE III. Table 2 illustrates the complementarity of the nucleotide sequences of DGKZ BINDING SITE, designated SEQ ID:9723, to the nucleotide sequence of VGAM2488 RNA, herein designated VGAM RNA, also designated SEQ ID:5199.

Another function of VGAM2488 is therefore inhibition of Diacylglycerol Kinase, Zeta 104 kDa (DGKZ, Accession NM_003646). Accordingly, utilities of VGAM2488 include diagnosis, prevention and treatment of diseases and clinical conditions associated with DGKZ. FLJ14009 (Accession NM_024760) is another VGAM2488 host target gene. FLJ14009 BINDING SITE is HOST TARGET binding site found in the 5' untranslated region of mRNA encoded by FLJ14009, corresponding to a HOST TARGET binding site such as BINDING SITE I, BINDING SITE II or BINDING SITE III. Table 2 illustrates the complementarity of the nucleotide sequences of FLJ14009 BINDING SITE, designated SEQ ID:24111, to the nucleotide sequence of VGAM2488 RNA, herein designated VGAM RNA, also designated SEQ ID:5199.

Another function of VGAM2488 is therefore inhibition of FLJ14009 (Accession NM_024760). Accordingly, utilities of VGAM2488 include diagnosis, prevention and treatment of diseases and clinical conditions associated with FLJ14009. FLJ20085 (Accession NM_017660) is another VGAM2488 host target gene. FLJ20085 BINDING SITE is HOST TARGET binding site found in the 3' untranslated region of mRNA encoded by FLJ20085, corresponding to a HOST TARGET binding site such as BINDING SITE I, BINDING SITE II or BINDING SITE III. Table 2 illustrates the complementarity of the nucleotide sequences of FLJ20085 BINDING SITE, designated SEQ ID:19183, to the nucleotide sequence of VGAM2488 RNA, herein designated VGAM RNA, also designated SEQ ID:5199.

Another function of VGAM2488 is therefore inhibition of FLJ20085 (Accession NM_017660). Accordingly, utilities of VGAM2488 include diagnosis, prevention and treatment of diseases and clinical conditions associated with FLJ20085. FLJ20359 (Accession NM_017781) is another VGAM2488 host target gene. FLJ20359 BINDING SITE is HOST TARGET binding site found in the 3' untranslated region of mRNA encoded by FLJ20359, corresponding to a HOST TARGET binding site such as BINDING SITE I, BINDING SITE II or BINDING SITE III. Table 2 illustrates the complementarity of the nucleotide sequences of FLJ20359 BINDING SITE, designated SEQ ID:19413, to the nucleotide sequence of VGAM2488 RNA, herein designated VGAM RNA, also designated SEQ ID:5199.

Another function of VGAM2488 is therefore inhibition of FLJ20359 (Accession NM_017781). Accordingly, utilities of VGAM2488 include diagnosis, prevention and treatment of diseases and clinical conditions associated with FLJ20359. FLJ22056 (Accession NM_022489) is another VGAM2488 host target gene. FLJ22056 BINDING SITE is HOST TARGET binding site found in the 5' untranslated region of mRNA encoded by FLJ22056, corresponding to a HOST TARGET binding site such as BINDING SITE I, BINDING SITE II or BINDING SITE III. Table 2 illustrates the complementarity of the nucleotide sequences of FLJ22056 BINDING SITE, designated SEQ ID:22869, to the nucleotide sequence of VGAM2488 RNA, herein designated VGAM RNA, also designated SEQ ID:5199.

Another function of VGAM2488 is therefore inhibition of FLJ22056 (Accession NM_022489). Accordingly, utilities of VGAM2488 include diagnosis, prevention and treatment of diseases and clinical conditions associated with FLJ22056. HCA4 (Accession XM_085287) is another VGAM2488 host target gene. HCA4 BINDING SITE is HOST TARGET binding site found in the 5' untranslated region of mRNA encoded by HCA4, corresponding to a HOST TARGET binding site such as BINDING SITE I, BINDING SITE II or BINDING SITE III. Table 2 illustrates the complementarity of the nucleotide sequences of HCA4 BINDING SITE, designated SEQ ID:38019, to the nucleotide sequence of VGAM2488 RNA, herein designated VGAM RNA, also designated SEQ ID:5199.

Another function of VGAM2488 is therefore inhibition of HCA4 (Accession XM_085287). Accordingly, utilities of VGAM2488 include diagnosis, prevention and treatment of diseases and clinical conditions associated with HCA4. KIAA1576 (Accession XM_038186) is another VGAM2488 host target gene. KIAA1576 BINDING SITE is HOST TARGET binding site found in the 3' untranslated region of mRNA encoded by KIAA1576, corresponding to a HOST TARGET binding site such as BINDING SITE I, BINDING SITE II or BINDING SITE III. Table 2 illustrates the complementarity of the nucleotide sequences of KIAA1576 BINDING SITE, designated SEQ ID:32770, to the nucleotide sequence of VGAM2488 RNA, herein designated VGAM RNA, also designated SEQ ID:5199.

Another function of VGAM2488 is therefore inhibition of KIAA1576 (Accession XM_038186). Accordingly, utilities of VGAM2488 include diagnosis, prevention and treatment of diseases and clinical conditions associated with KIAA1576. KIAA1727 (Accession XM_034262) is another VGAM2488 host target gene. KIAA1727 BINDING SITE is HOST TARGET binding site found in the 3' untranslated region of mRNA encoded by KIAA1727, corresponding to a HOST TARGET binding site such as BINDING SITE I, BINDING SITE II or BINDING SITE III. Table 2 illustrates the complementarity of the nucleotide sequences of KIAA1727 BINDING SITE, designated SEQ ID:32034, to the nucleotide sequence of VGAM2488 RNA, herein designated VGAM RNA, also designated SEQ ID:5199.

Another function of VGAM2488 is therefore inhibition of KIAA1727 (Accession XM_034262). Accordingly, utilities of VGAM2488 include diagnosis, prevention and treatment of diseases and clinical conditions associated with KIAA1727. MGC11115 (Accession NM_032310) is another VGAM2488 host target gene. MGC11115 BINDING SITE is HOST TARGET binding site found in the 3' untranslated region of mRNA encoded by MGC11115, corresponding to a HOST TARGET binding site such as BINDING SITE I, BINDING SITE II or BINDING SITE III. Table 2 illustrates the complementarity of the nucleotide sequences of MGC11115 BINDING SITE, designated SEQ ID:26092, to the nucleotide sequence of VGAM2488 RNA, herein designated VGAM RNA, also designated SEQ ID:5199.

Another function of VGAM2488 is therefore inhibition of MGC11115 (Accession NM_032310). Accordingly, utilities of VGAM2488 include diagnosis, prevention and treatment of diseases and clinical conditions associated with MGC11115. MGC16703 (Accession XM_054591) is another VGAM2488 host target gene. MGC16703 BINDING SITE is HOST TARGET binding site found in the 5' untranslated region of mRNA encoded by MGC16703, corresponding to a HOST TARGET binding site such as BINDING SITE I, BINDING SITE II or BINDING SITE III. Table 2 illustrates the complementarity of the nucleotide sequences of MGC16703 BINDING SITE, designated SEQ ID:36181, to the nucleotide sequence of VGAM2488 RNA, herein designated VGAM RNA, also designated SEQ ID:5199.

Another function of VGAM2488 is therefore inhibition of MGC16703 (Accession XM_054591). Accordingly, utilities of VGAM2488 include diagnosis, prevention and treatment of diseases and clinical conditions associated with MGC16703. MGC3047 (Accession NM_032348) is another VGAM2488 host target gene. MGC3047 BINDING SITE is HOST TARGET binding site found in the 3' untranslated region of mRNA encoded by MGC3047, corresponding to a HOST TARGET binding site such as BINDING SITE I, BINDING SITE II or BINDING SITE III. Table 2 illustrates the complementarity of the nucleotide sequences of MGC3047 BINDING SITE, designated SEQ ID:26137, to the nucleotide sequence of VGAM2488 RNA, herein designated VGAM RNA, also designated SEQ ID:5199.

Another function of VGAM2488 is therefore inhibition of MGC3047 (Accession NM_032348). Accordingly, utilities of VGAM2488 include diagnosis, prevention and treatment of diseases and clinical conditions associated with MGC3047. PP1665 (Accession NM_030792) is another VGAM2488 host target gene. PP1665 BINDING SITE is HOST TARGET binding site found in the 5' untranslated region of mRNA encoded by PP1665, corresponding to a HOST TARGET binding site such as BINDING SITE I, BINDING SITE II or BINDING SITE III. Table 2 illustrates the complementarity of the nucleotide sequences of PP1665 BINDING SITE, designated SEQ ID:25091, to the nucleotide sequence of VGAM2488 RNA, herein designated VGAM RNA, also designated SEQ ID:5199.

Another function of VGAM2488 is therefore inhibition of PP1665 (Accession NM_030792). Accordingly, utilities of VGAM2488 include diagnosis, prevention and treatment of diseases and clinical conditions associated with PP1665. SAST (Accession XM_032034) is another VGAM2488 host target gene. SAST BINDING SITE is HOST TARGET binding site found in the 5' untranslated region of mRNA encoded by SAST, corresponding to a HOST TARGET binding site such as BINDING SITE I, BINDING SITE II or BINDING SITE III. Table 2 illustrates the complementarity of the nucleotide sequences of SAST BINDING SITE, designated SEQ ID:31540, to the nucleotide sequence of VGAM2488 RNA, herein designated VGAM RNA, also designated SEQ ID:5199.

Another function of VGAM2488 is therefore inhibition of SAST (Accession XM_032034). Accordingly, utilities of VGAM2488 include diagnosis, prevention and treatment of diseases and clinical conditions associated with SAST. URG4 (Accession NM_017920) is another VGAM2488 host target gene. URG4 BINDING SITE is HOST TARGET binding site found in the 3' untranslated region of mRNA encoded by URG4, corresponding to a HOST TARGET binding site such as BINDING SITE I, BINDING SITE II or BINDING SITE III. Table 2 illustrates the complementarity of the nucleotide sequences of URG4 BINDING SITE, designated SEQ ID:19578, to the nucleotide sequence of VGAM2488 RNA, herein designated VGAM RNA, also designated SEQ ID:5199.

Another function of VGAM2488 is therefore inhibition of URG4 (Accession NM_017920). Accordingly, utilities of VGAM2488 include diagnosis, prevention and treatment of diseases and clinical conditions associated with URG4. LOC124460 (Accession XM_071892) is another VGAM2488 host target gene. LOC124460 BINDING SITE is HOST TARGET binding site found in the 3' untranslated region of mRNA encoded by LOC124460, corresponding to a HOST TARGET binding site such as BINDING SITE I, BINDING SITE II or BINDING SITE III. Table 2 illustrates the complementarity of the nucleotide sequences of LOC124460 BINDING SITE, designated SEQ ID:37442, to the nucleotide sequence of VGAM2488 RNA, herein designated VGAM RNA, also designated SEQ ID:5199.

Another function of VGAM2488 is therefore inhibition of LOC124460 (Accession XM_071892). Accordingly, utilities of VGAM2488 include diagnosis, prevention and treatment of diseases and clinical conditions associated with LOC124460. LOC144483 (Accession XM_012219) is another VGAM2488 host target gene. LOC144483 BINDING SITE is HOST TARGET binding site found in the 3' untranslated region of mRNA encoded by LOC144483, corresponding to a HOST TARGET binding site such as BINDING SITE I, BINDING SITE II or BINDING SITE III. Table 2 illustrates the complementarity of the nucleotide sequences of LOC144483 BINDING SITE, designated SEQ ID:30211, to the nucleotide sequence of VGAM2488 RNA, herein designated VGAM RNA, also designated SEQ ID:5199.

Another function of VGAM2488 is therefore inhibition of LOC144483 (Accession XM_012219). Accordingly, utilities of VGAM2488 include diagnosis, prevention and treatment of diseases and clinical conditions associated with LOC144483. LOC145447 (Accession XM_085133) is another VGAM2488 host target gene. LOC145447 BINDING SITE is HOST TARGET binding site found in the 3' untranslated region of mRNA encoded by LOC145447, corresponding to a HOST TARGET binding site such as BINDING SITE I, BINDING SITE II or BINDING SITE III. Table 2 illustrates the complementarity of the nucleotide sequences of LOC145447 BINDING SITE, designated SEQ ID:37862, to the nucleotide sequence of VGAM2488 RNA, herein designated VGAM RNA, also designated SEQ ID:5199.

Another function of VGAM2488 is therefore inhibition of LOC145447 (Accession XM_085133). Accordingly, utilities of VGAM2488 include diagnosis, prevention and treatment of diseases and clinical conditions associated with LOC145447. LOC149706 (Accession XM_097718) is another VGAM2488 host target gene. LOC149706 BINDING SITE is HOST TARGET binding site found in the 5' untranslated region of mRNA encoded by LOC149706, corresponding to a HOST TARGET binding site such as BINDING SITE I, BINDING SITE II or BINDING SITE III. Table 2 illustrates the complementarity of the nucleotide sequences of LOC149706 BINDING SITE, designated SEQ ID:41060, to the nucleotide sequence of VGAM2488 RNA, herein designated VGAM RNA, also designated SEQ ID:5199.

Another function of VGAM2488 is therefore inhibition of LOC149706 (Accession XM_097718). Accordingly, utilities of VGAM2488 include diagnosis, prevention and treatment of diseases and clinical conditions associated with LOC149706. LOC151178 (Accession XM_087117) is another VGAM2488 host target gene. LOC151178 BINDING SITE is HOST TARGET binding site found in the 5' untranslated region of mRNA encoded by LOC151178, corresponding to a HOST TARGET binding site such as BINDING SITE I, BINDING SITE II or BINDING SITE III. Table 2 illustrates the complementarity of the nucleotide sequences of LOC151178 BINDING SITE, designated SEQ ID:39069, to the nucleotide sequence of VGAM2488 RNA, herein designated VGAM RNA, also designated SEQ ID:5199.

Another function of VGAM2488 is therefore inhibition of LOC151178 (Accession XM_087117). Accordingly, utilities of VGAM2488 include diagnosis, prevention and treatment of diseases and clinical conditions associated with LOC151178. LOC155061 (Accession XM_088139) is another VGAM2488 host target gene. LOC155061 BINDING SITE is HOST TARGET binding site found in the 3' untranslated region of mRNA encoded by LOC155061, corresponding to a HOST TARGET binding site such as BINDING SITE I, BINDING SITE II or BINDING SITE III. Table 2 illustrates the complementarity of the nucleotide sequences of LOC155061 BINDING SITE, designated SEQ ID:39537, to the nucleotide sequence of VGAM2488 RNA, herein designated VGAM RNA, also designated SEQ ID:5199.

Another function of VGAM2488 is therefore inhibition of LOC155061 (Accession XM_088139). Accordingly, utilities of VGAM2488 include diagnosis, prevention and treatment of diseases and clinical conditions associated with LOC155061. LOC155340 (Accession XM_055725) is another VGAM2488 host target gene. LOC155340 BINDING SITE is HOST TARGET binding site found in the 5' untranslated region of mRNA encoded by LOC155340, corresponding to a HOST TARGET binding site such as BINDING SITE I, BINDING SITE II or BINDING SITE III. Table 2 illustrates the complementarity of the nucleotide sequences of LOC155340 BINDING SITE, designated SEQ ID:36317, to the nucleotide sequence of VGAM2488 RNA, herein designated VGAM RNA, also designated SEQ ID:5199.

Another function of VGAM2488 is therefore inhibition of LOC155340 (Accession XM_055725). Accordingly, utilities of VGAM2488 include diagnosis, prevention and treatment of diseases and clinical conditions associated with LOC155340. LOC157349 (Accession XM_088298) is another VGAM2488 host target gene. LOC157349 BINDING SITE is HOST TARGET binding site found in the 5' untranslated region of mRNA encoded by LOC157349, corresponding to a HOST TARGET binding site such as BINDING SITE I, BINDING SITE II or BINDING SITE III. Table 2 illustrates the complementarity of the nucleotide sequences of LOC157349 BINDING SITE, designated SEQ ID:39596, to the nucleotide sequence of VGAM2488 RNA, herein designated VGAM RNA, also designated SEQ ID:5199.

Another function of VGAM2488 is therefore inhibition of LOC157349 (Accession XM_088298). Accordingly, utilities of VGAM2488 include diagnosis, prevention and treatment of diseases and clinical conditions associated with LOC157349. LOC196759 (Accession XM_113601) is another VGAM2488 host target gene. LOC196759 BINDING SITE is HOST TARGET binding site found in the 3' untranslated region of mRNA encoded by LOC196759, corresponding to a HOST TARGET binding site such as BINDING SITE I, BINDING SITE II or BINDING SITE III. Table 2 illustrates the complementarity of the nucleotide sequences of LOC196759 BINDING SITE, designated SEQ ID:42292, to the nucleotide sequence of VGAM2488 RNA, herein designated VGAM RNA, also designated SEQ ID:5199.

Another function of VGAM2488 is therefore inhibition of LOC196759 (Accession XM_113601). Accordingly, utilities of VGAM2488 include diagnosis, prevention and treatment of diseases and clinical conditions associated with LOC196759. LOC199899 (Accession XM_117153) is another VGAM2488 host target gene. LOC199899 BINDING SITE is HOST TARGET binding site found in the 5' untranslated region of mRNA encoded by LOC199899, corresponding to a HOST TARGET binding site such as BINDING SITE I, BINDING SITE II or BINDING SITE III. Table 2 illustrates the complementarity of the nucleotide sequences of LOC199899 BINDING SITE, designated SEQ ID:43257, to the nucleotide sequence of VGAM2488 RNA, herein designated VGAM RNA, also designated SEQ ID:5199.

Another function of VGAM2488 is therefore inhibition of LOC199899 (Accession XM_117153). Accordingly, utilities of VGAM2488 include diagnosis, prevention and treatment of diseases and clinical conditions associated with LOC199899. LOC221495 (Accession XM_168136) is another VGAM2488 host target gene. LOC221495 BINDING SITE is HOST TARGET binding site found in the 3' untranslated region of mRNA encoded by LOC221495, corresponding to a HOST TARGET binding site such as BINDING SITE I, BINDING SITE II or BINDING SITE III. Table 2 illustrates the complementarity of the nucleotide sequences of LOC221495 BINDING SITE, designated SEQ ID:45062, to the nucleotide sequence of VGAM2488 RNA, herein designated VGAM RNA, also designated SEQ ID:5199.

Another function of VGAM2488 is therefore inhibition of LOC221495 (Accession XM_168136). Accordingly, utilities of VGAM2488 include diagnosis, prevention and treatment of diseases and clinical conditions associated with LOC221495. LOC256598 (Accession XM_172816) is another VGAM2488 host target gene. LOC256598 BINDING SITE is HOST TARGET binding site found in the 5' untranslated region of mRNA encoded by LOC256598, corresponding to a HOST TARGET binding site such as BINDING SITE I, BINDING SITE II or BINDING SITE III. Table 2 illustrates the complementarity of the nucleotide sequences of LOC256598 BINDING SITE, designated SEQ ID:46098, to the nucleotide sequence of VGAM2488 RNA, herein designated VGAM RNA, also designated SEQ ID:5199.

Another function of VGAM2488 is therefore inhibition of LOC256598 (Accession XM_172816). Accordingly, utilities of VGAM2488 include diagnosis, prevention and treatment of diseases and clinical conditions associated with LOC256598. LOC256867 (Accession XM_170694) is another VGAM2488 host target gene. LOC256867 BINDING SITE is HOST TARGET binding site found in the 5' untranslated region of mRNA encoded by LOC256867, corresponding to a HOST TARGET binding site such as BINDING SITE I, BINDING SITE II or BINDING SITE III. Table 2 illustrates the complementarity of the nucleotide sequences of LOC256867 BINDING SITE, designated SEQ ID:45474, to the nucleotide sequence of VGAM2488 RNA, herein designated VGAM RNA, also designated SEQ ID:5199.

Another function of VGAM2488 is therefore inhibition of LOC256867 (Accession XM_170694). Accordingly, utilities of VGAM2488 include diagnosis, prevention and treatment of diseases and clinical conditions associated with LOC256867. LOC257054 (Accession XM_171010) is another VGAM2488 host target gene. LOC257054 BINDING SITE is HOST TARGET binding site found in the 3' untranslated region of mRNA encoded by LOC257054, corresponding to a HOST TARGET binding site such as BINDING SITE I, BINDING SITE II or BINDING SITE III. Table 2 illustrates the complementarity of the nucleotide sequences of LOC257054 BINDING SITE, designated SEQ ID:45781, to the nucleotide sequence of VGAM2488 RNA, herein designated VGAM RNA, also designated SEQ ID:5199.

Another function of VGAM2488 is therefore inhibition of LOC257054 (Accession XM_171010). Accordingly, utilities of VGAM2488 include diagnosis, prevention and treatment of diseases and clinical conditions associated with LOC257054. LOC64744 (Accession XM_029830) is another VGAM2488 host target gene. LOC64744 BINDING SITE is HOST TARGET binding site found in the 3' untranslated region of mRNA encoded by LOC64744, corresponding to a HOST TARGET binding site such as BINDING SITE I, BINDING SITE II or BINDING SITE III. Table 2 illustrates the complementarity of the nucleotide sequences of LOC64744 BINDING SITE, designated SEQ ID:30953, to the nucleotide sequence of VGAM2488 RNA, herein designated VGAM RNA, also designated SEQ ID:5199.

Another function of VGAM2488 is therefore inhibition of LOC64744 (Accession XM_029830). Accordingly, utilities of VGAM2488 include diagnosis, prevention and treatment of diseases and clinical conditions associated with LOC64744. LOC90288 (Accession XM_030669) is another VGAM2488 host target gene. LOC90288 BINDING SITE is HOST TARGET binding site found in the 5' untranslated region of mRNA encoded by LOC90288, corresponding to a HOST TARGET binding site such as BINDING SITE I, BINDING SITE II or BINDING SITE III. Table 2 illustrates the complementarity of the nucleotide sequences of LOC90288 BINDING SITE, designated SEQ ID:31108, to the nucleotide sequence of VGAM2488 RNA, herein designated VGAM RNA, also designated SEQ ID:5199.

Another function of VGAM2488 is therefore inhibition of LOC90288 (Accession XM_030669). Accordingly, utilities of VGAM2488 include diagnosis, prevention and treatment of diseases and clinical conditions associated with LOC90288. LOC92080 (Accession XM_042704) is another VGAM2488 host target gene. LOC92080 BINDING SITE is HOST TARGET binding site found in the 3' untranslated region of mRNA encoded by LOC92080, corresponding to a HOST TARGET binding site such as BINDING SITE I, BINDING SITE II or BINDING SITE III. Table 2 illustrates the complementarity of the nucleotide sequences of LOC92080 BINDING SITE, designated SEQ ID:33759, to the nucleotide sequence of VGAM2488 RNA, herein designated VGAM RNA, also designated SEQ ID:5199.

Another function of VGAM2488 is therefore inhibition of LOC92080 (Accession XM_042704). Accordingly, utilities of VGAM2488 include diagnosis, prevention and treatment of diseases and clinical conditions associated with LOC92080. FIG. 1 further provides a conceptual description of a novel bioinformatically detected viral gene of the present invention, referred to here as Viral Genomic Address Messenger 2489 (VGAM2489) viral gene, which modulates expression of respective host target genes thereof, the function and utility of which host target genes is known in the art.

VGAM2489 is a novel bioinformatically detected regulatory, non protein coding, viral micro RNA (miRNA) gene. The method by which VGAM2489 was detected is described hereinabove with reference to FIGS. 1-8.

VGAM2489 gene, herein designated VGAM GENE, is a viral gene contained in the genome of Mouse Cytomegalovirus 1. VGAM2489 host target gene, herein designated VGAM HOST TARGET GENE, is a human gene contained in the human genome.

VGAM2489 gene encodes a VGAM2489 precursor RNA, herein designated VGAM PRECURSOR RNA. Similar to other miRNA genes, and unlike most ordinary genes, VGAM2489 precursor RNA does not encode a protein. A nucleotide sequence identical or highly similar to the nucleotide sequence of VGAM2489 precursor RNA is designated SEQ ID:2475, and is provided hereinbelow with reference to the sequence listing part. Nucleotide sequence SEQ ID:2475 is located at position 131589 relative to the genome of Mouse Cytomegalovirus 1.

VGAM2489 precursor RNA folds onto itself, forming VGAM2489 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2489 folded precursor RNA into VGAM2489 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2489 RNA is designated SEQ ID:5200, and is provided hereinbelow with reference to the sequence listing part.

VGAM2489 host target gene, herein designated VGAM HOST TARGET GENE, encodes a corresponding messenger RNA, VGAM2489 host target RNA, herein designated VGAM HOST TARGET RNA. VGAM2489 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2489 RNA, herein designated VGAM RNA, binds complementarily to one or more host target binding sites located in untranslated regions of VGAM2489 host target RNA, herein designated VGAM HOST TARGET RNA. This complementary binding is due to the fact that the nucleotide sequence of VGAM2489 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2489 RNA, herein designated VGAM RNA, may have a different number of host target binding sites in untranslated regions of a VGAM2489 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2489 RNA, herein designated VGAM RNA, to host target binding sites on VGAM2489 host target RNA, herein designated VGAM HOST TARGET RNA, such as BINDING SITE I, BINDING SITE II and BINDING SITE III, inhibits translation of VGAM2489 host target RNA into VGAM2489 host target protein, herein designated VGAM HOST TARGET PROTEIN. VGAM host target protein is therefore outlined by a broken line.

It is appreciated that VGAM2489 host target gene, herein designated VGAM HOST TARGET GENE, in fact represents a plurality of VGAM2489 host target genes. The mRNA of each one of this plurality of VGAM2489 host target genes comprises one or more host target binding sites, each having a nucleotide sequence which is at least partly complementary to VGAM2489 RNA, herein designated VGAM RNA, and which when bound by VGAM2489 RNA causes inhibition of translation of respective one or more VGAM2489 host target proteins.

It is further appreciated by one skilled in the art that the mode of translational inhibition illustrated by FIG. 1 with specific reference to translational inhibition exerted by VGAM2489 gene, herein designated VGAM GENE, on one or more VGAM2489 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2489 is inhibition of expression of host target genes, as part of a novel viral mechanism of attacking a host. Accordingly, utilities of VGAM2489 include diagnosis, prevention and treatment of viral infection by Mouse Cytomegalovirus 1. Specific functions, and accordingly utilities, of VGAM2489 correlate with, and may be deduced from, the identity of the host target genes which VGAM2489 binds and inhibits, and the function of these host target genes, as elaborated hereinbelow.

Nucleotide sequences of the VGAM2489 precursor RNA, herein designated VGAM PRECURSOR RNA, and of the 'diced' VGAM2489 RNA, herein designated VGAM RNA, and a schematic representation of the secondary folding of VGAM2489 folded precursor RNA, herein designated VGAM FOLDED PRECURSOR RNA, of VGAM2489 are further described hereinbelow with reference to Table 1.

Nucleotide sequences of host target binding sites, such as BINDING SITE-I, BINDING SITE-II and BINDING SITE-III of FIG. 1, found on VGAM2489 host target RNA, and schematic representation of the complementarity of each of these host target binding sites to VGAM2489 RNA, herein designated VGAM RNA, are described hereinbelow with reference to Table 2.

As mentioned hereinabove with reference to FIG. 1, a function of VGAM2489 gene, herein designated VGAM is inhibition of expression of VGAM2489 target genes. It is appreciated that specific functions, and accordingly utilities, of VGAM2489 correlate with, and may be deduced from, the identity of the target genes which VGAM2489 binds and inhibits, and the function of these target genes, as elaborated hereinbelow.

Cadherin 1, Type 1, E-cadherin (epithelial) (CDH1, Accession NM_004360) is a VGAM2489 host target gene. CDH1 BINDING SITE is HOST TARGET binding site found in the 3' untranslated region of mRNA encoded by CDH1, corresponding to a HOST TARGET binding site such as BINDING SITE I, BINDING SITE II or BINDING SITE III. Table 2 illustrates the complementarity of the nucleotide sequences of CDH1 BINDING SITE, designated SEQ ID:10567, to the nucleotide sequence of VGAM2489 RNA, herein designated VGAM RNA, also designated SEQ ID:5200.

A function of VGAM2489 is therefore inhibition of Cadherin 1, Type 1, E-cadherin (epithelial) (CDH1, Accession NM_004360). Accordingly, utilities of VGAM2489 include diagnosis, prevention and treatment of diseases and clinical conditions associated with CDH1. Retinoblastoma Binding Protein 9 (RBBP9, Accession XM_046553) is another VGAM2489 host target gene. RBBP9 BINDING SITE is HOST TARGET binding site found in the 3' untranslated region of mRNA encoded by RBBP9, corresponding to a HOST TARGET binding site such as BINDING SITE I, BINDING SITE II or BINDING SITE III. Table 2 illustrates the complementarity of the nucleotide sequences of RBBP9 BINDING SITE, designated SEQ ID:34744, to the nucleotide sequence of VGAM2489 RNA, herein designated VGAM RNA, also designated SEQ ID:5200.

Another function of VGAM2489 is therefore inhibition of Retinoblastoma Binding Protein 9 (RBBP9, Accession XM_046553). Accordingly, utilities of VGAM2489 include diagnosis, prevention and treatment of diseases and clinical conditions associated with RBBP9. BRCA2 and CDKN1A Interacting Protein (BCCIP, Accession NM_078469) is another VGAM2489 host target gene. BCCIP BINDING SITE is HOST TARGET binding site found in the 3' untranslated region of mRNA encoded by BCCIP, corresponding to a HOST TARGET binding site such as BINDING SITE I, BINDING SITE II or BINDING SITE III. Table 2 illustrates the complementarity of the nucleotide sequences of BCCIP BINDING SITE, designated SEQ ID:27785, to the nucleotide sequence of VGAM2489 RNA, herein designated VGAM RNA, also designated SEQ ID:5200.

Another function of VGAM2489 is therefore inhibition of BRCA2 and CDKN1A Interacting Protein (BCCIP, Accession NM_078469). Accordingly, utilities of VGAM2489 include diagnosis, prevention and treatment of diseases and clinical conditions associated with BCCIP. FIG. 1 further provides a conceptual description of a novel bioinformatically detected viral gene of the present invention, referred to here as Viral Genomic Address Messenger 2490 (VGAM2490) viral gene, which modulates expression of respective host target genes thereof, the function and utility of which host target genes is known in the art.

VGAM2490 is a novel bioinformatically detected regulatory, non protein coding, viral micro RNA (miRNA) gene. The method by which VGAM2490 was detected is described hereinabove with reference to FIGS. 1-8.

VGAM2490 gene, herein designated VGAM GENE, is a viral gene contained in the genome of Mouse Cytomegalovirus 1. VGAM2490 host target gene, herein designated VGAM HOST TARGET GENE, is a human gene contained in the human genome.

VGAM2490 gene encodes a VGAM2490 precursor RNA, herein designated VGAM PRECURSOR RNA. Similar to other miRNA genes, and unlike most ordinary genes, VGAM2490 precursor RNA does not encode a protein. A nucleotide sequence identical or highly similar to the nucleotide sequence of VGAM2490 precursor RNA is designated SEQ ID:2476, and is provided hereinbelow with reference to the sequence listing part. Nucleotide sequence SEQ ID:2476 is located at position 47693 relative to the genome of Mouse Cytomegalovirus 1.

VGAM2490 precursor RNA folds onto itself, forming VGAM2490 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2490 folded precursor RNA into VGAM2490 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2490 RNA is designated SEQ ID:5201, and is provided hereinbelow with reference to the sequence listing part.

VGAM2490 host target gene, herein designated VGAM HOST TARGET GENE, encodes a corresponding messenger RNA, VGAM2490 host target RNA, herein designated VGAM HOST TARGET RNA. VGAM2490 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2490 RNA, herein designated VGAM RNA, binds complementarily to one or more host target binding sites located in untranslated regions of VGAM2490 host target RNA, herein designated VGAM HOST TARGET RNA. This complementary binding is due to the fact that the nucleotide sequence of VGAM2490 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2490 RNA, herein designated VGAM RNA, may have a different number of host target binding sites in untranslated regions of a VGAM2490 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2490 RNA, herein designated VGAM RNA, to host target binding sites on VGAM2490 host target RNA, herein designated VGAM HOST TARGET RNA, such as BINDING SITE I, BINDING SITE II and BINDING SITE III, inhibits translation of VGAM2490 host target RNA into VGAM2490 host target protein, herein designated VGAM HOST TARGET PROTEIN. VGAM host target protein is therefore outlined by a broken line.

It is appreciated that VGAM2490 host target gene, herein designated VGAM HOST TARGET GENE, in fact represents a plurality of VGAM2490 host target genes. The mRNA of each one of this plurality of VGAM2490 host target genes comprises one or more host target binding sites, each having a nucleotide sequence which is at least partly complementary to VGAM2490 RNA, herein designated VGAM RNA, and which when bound by VGAM2490 RNA causes inhibition of translation of respective one or more VGAM2490 host target proteins.

It is further appreciated by one skilled in the art that the mode of translational inhibition illustrated by FIG. 1 with specific reference to translational inhibition exerted by VGAM2490 gene, herein designated VGAM GENE, on one or more VGAM2490 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2490 is inhibition of expression of host target genes, as part of a novel viral mechanism of attacking a host. Accordingly, utilities of VGAM2490 include diagnosis, prevention and treatment of viral infection by Mouse Cytomegalovirus 1. Specific functions, and accordingly utilities, of VGAM2490 correlate with, and may be deduced from, the identity of the host target genes which VGAM2490 binds and inhibits, and the function of these host target genes, as elaborated hereinbelow.

Nucleotide sequences of the VGAM2490 precursor RNA, herein designated VGAM PRECURSOR RNA, and of the 'diced' VGAM2490 RNA, herein designated VGAM RNA, and a schematic representation of the secondary folding of VGAM2490 folded precursor RNA, herein designated VGAM FOLDED PRECURSOR RNA, of VGAM2490 are further described hereinbelow with reference to Table 1.

Nucleotide sequences of host target binding sites, such as BINDING SITE-I, BINDING SITE-II and BINDING SITE-III of FIG. 1, found on VGAM2490 host target RNA, and schematic representation of the complementarity of each of these host target binding sites to VGAM2490 RNA, herein designated VGAM RNA, are described hereinbelow with reference to Table 2.

As mentioned hereinabove with reference to FIG. 1, a function of VGAM2490 gene, herein designated VGAM is inhibition of expression of VGAM2490 target genes. It is appreciated that specific functions, and accordingly utilities, of VGAM2490 correlate with, and may be deduced from, the identity of the target genes which VGAM2490 binds and inhibits, and the function of these target genes, as elaborated hereinbelow.

Keratin 16 (focal non-epidermolytic palmoplantar keratoderma) (KRT16, Accession XM_170845) is a VGAM2490 host target gene. KRT16 BINDING SITE is HOST TARGET binding site found in the 5' untranslated region of mRNA encoded by KRT16, corresponding to a HOST TARGET binding site such as BINDING SITE I, BINDING SITE II or BINDING SITE III. Table 2 illustrates the complementarity of the nucleotide sequences of KRT16 BINDING SITE, designated SEQ ID:45629, to the nucleotide sequence of VGAM2490 RNA, herein designated VGAM RNA, also designated SEQ ID:5201.

A function of VGAM2490 is therefore inhibition of Keratin 16 (focal non-epidermolytic palmoplantar keratoderma) (KRT16, Accession XM_170845). Accordingly, utilities of VGAM2490 include diagnosis, prevention and treatment of diseases and clinical conditions associated with KRT16. Nescient Helix Loop Helix 1 (NHLH1, Accession NM_005598) is another VGAM2490 host target gene. NHLH1 BINDING SITE is HOST TARGET binding site found in the 3' untranslated region of mRNA encoded by NHLH1, corresponding to a HOST TARGET binding site such as BINDING SITE I, BINDING SITE II or BINDING SITE III. Table 2 illustrates the complementarity of the nucleotide sequences of NHLH1 BINDING SITE, designated SEQ ID:12124, to the nucleotide sequence of VGAM2490 RNA, herein designated VGAM RNA, also designated SEQ ID:5201.

Another function of VGAM2490 is therefore inhibition of Nescient Helix Loop Helix 1 (NHLH1, Accession NM_005598), a gene which may have a role in development of the nervous system. Accordingly, utilities of VGAM2490 include diagnosis, prevention and treatment of diseases and clinical conditions associated with NHLH1. The function of NHLH1 and its association with various diseases and clinical conditions, has been established by previous studies, as described hereinabove with reference to VGAM1923. Purinergic Receptor P2Y, G-protein Coupled, 2 (P2RY2, Accession NM_002564) is another VGAM2490 host target gene. P2RY2 BINDING SITE is HOST TARGET binding site found in the 5' untranslated region of mRNA encoded by P2RY2, corresponding to a HOST TARGET binding site such as BINDING SITE I, BINDING SITE II or BINDING SITE III. Table 2 illustrates the complementarity of the nucleotide sequences of P2RY2 BINDING SITE, designated SEQ ID:8414, to the nucleotide sequence of VGAM2490 RNA, herein designated VGAM RNA, also designated SEQ ID:5201.

Another function of VGAM2490 is therefore inhibition of Purinergic Receptor P2Y, G-protein Coupled, 2 (P2RY2, Accession NM_002564), a gene which mediates cellular responses to ATP. Accordingly, utilities of VGAM2490 include diagnosis, prevention and treatment of diseases and clinical conditions associated with P2RY2. The function of P2RY2 and its association with various diseases and clinical conditions, has been established by previous studies, as described hereinabove with reference to VGAM1259. Proprotein Convertase Subtilisin/kexin Type 2 (PCSK2, Accession NM_002594) is another VGAM2490 host target gene. PCSK2 BINDING SITE is HOST TARGET binding site found in the 3' untranslated region of mRNA encoded by PCSK2, corresponding to a HOST TARGET binding site such as BINDING SITE I, BINDING SITE II or BINDING SITE III. Table 2 illustrates the complementarity of the nucleotide sequences of PCSK2 BINDING SITE, designated SEQ ID:8454, to the nucleotide sequence of VGAM2490 RNA, herein designated VGAM RNA, also designated SEQ ID:5201.

Another function of VGAM2490 is therefore inhibition of Proprotein Convertase Subtilisin/kexin Type 2 (PCSK2, Accession NM_002594), a gene which is involved in the processing of hormone and other protein precursors at sites comprised of pairs of basic amino acid residues. Accordingly, utilities of VGAM2490 include diagnosis, prevention and treatment of diseases and clinical conditions associated with PCSK2. The function of PCSK2 and its association with various diseases and clinical conditions, has been established by previous studies, as described hereinabove with reference to VGAM1120. FLJ22009 (Accession XM_015700) is another VGAM2490 host target gene. FLJ22009 BINDING SITE is HOST TARGET binding site found in the 3' untranslated region of mRNA encoded by FLJ22009, corresponding to a HOST TARGET binding site such as BINDING SITE I, BINDING SITE II or BINDING SITE III. Table 2 illustrates the complementarity of the nucleotide sequences of FLJ22009 BINDING SITE, designated SEQ ID:30241, to the nucleotide sequence of VGAM2490 RNA, herein designated VGAM RNA, also designated SEQ ID:5201.

Another function of VGAM2490 is therefore inhibition of FLJ22009 (Accession XM_015700). Accordingly, utilities of VGAM2490 include diagnosis, prevention and treatment of diseases and clinical conditions associated with FLJ22009. Interferon Regulatory Factor 7 (IRF7, Accession NM_004030) is another VGAM2490 host target gene. IRF7 BINDING SITE is HOST TARGET binding site found in the 3' untranslated region of mRNA encoded by IRF7, corresponding to a HOST TARGET binding site such as BINDING SITE I, BINDING SITE II or BINDING SITE III. Table 2 illustrates the complementarity of the nucleotide sequences of IRF7 BINDING SITE, designated SEQ ID:10249, to the nucleotide sequence of VGAM2490 RNA, herein designated VGAM RNA, also designated SEQ ID:5201.

Another function of VGAM2490 is therefore inhibition of Interferon Regulatory Factor 7 (IRF7, Accession NM_004030). Accordingly, utilities of VGAM2490 include diagnosis, prevention and treatment of diseases and clinical conditions associated with IRF7. NRF (Accession NM_017544) is another VGAM2490 host target gene. NRF BINDING SITE is HOST TARGET binding site found in the 3' untranslated region of mRNA encoded by NRF, corresponding to a HOST TARGET binding site such as BINDING SITE I, BINDING SITE II or BINDING SITE III. Table 2 illustrates the complementarity of the nucleotide sequences of NRF BINDING SITE, designated SEQ ID:18985, to the nucleotide sequence of VGAM2490 RNA, herein designated VGAM RNA, also designated SEQ ID:5201.

Another function of VGAM2490 is therefore inhibition of NRF (Accession NM_017544). Accordingly, utilities of VGAM2490 include diagnosis, prevention and treatment of diseases and clinical conditions associated with NRF. LOC200317 (Accession XM_114208) is another VGAM2490 host target gene. LOC200317 BINDING SITE is HOST TARGET binding site found in the 3' untranslated region of mRNA encoded by LOC200317, corresponding to a HOST TARGET binding site such as BINDING SITE I, BINDING SITE II or BINDING SITE III. Table 2 illustrates the complementarity of the nucleotide sequences of LOC200317 BINDING SITE, designated SEQ ID:42801, to the nucleotide sequence of VGAM2490 RNA, herein designated VGAM RNA, also designated SEQ ID:5201.

Another function of VGAM2490 is therefore inhibition of LOC200317 (Accession XM_114208). Accordingly, utilities of VGAM2490 include diagnosis, prevention and treatment of diseases and clinical conditions associated with LOC200317. LOC91408 (Accession XM_038290) is another VGAM2490 host target gene. LOC91408 BINDING SITE is HOST TARGET binding site found in the 5' untranslated region of mRNA encoded by LOC91408, corresponding to a HOST TARGET binding site such as BINDING SITE I, BINDING SITE II or BINDING SITE III. Table 2 illustrates the complementarity of the nucleotide sequences of LOC91408 BINDING SITE, designated SEQ ID:32791, to the nucleotide sequence of VGAM2490 RNA, herein designated VGAM RNA, also designated SEQ ID:5201.

Another function of VGAM2490 is therefore inhibition of LOC91408 (Accession XM_038290). Accordingly, utilities of VGAM2490 include diagnosis, prevention and treatment of diseases and clinical conditions associated with LOC91408. FIG. 1 further provides a conceptual description of a novel bioinformatically detected viral gene of the present invention, referred to here as Viral Genomic Address Messenger 2491 (VGAM2491) viral gene, which modulates expression of respective host target genes thereof, the function and utility of which host target genes is known in the art.

VGAM2491 is a novel bioinformatically detected regulatory, non protein coding, viral micro RNA (miRNA) gene. The method by which VGAM2491 was detected is described hereinabove with reference to FIGS. 1-8.

VGAM2491 gene, herein designated VGAM GENE, is a viral gene contained in the genome of Mouse Cytomegalovirus 1. VGAM2491 host target gene, herein designated VGAM HOST TARGET GENE, is a human gene contained in the human genome.

VGAM2491 gene encodes a VGAM2491 precursor RNA, herein designated VGAM PRECURSOR RNA. Similar to other miRNA genes, and unlike most ordinary genes, VGAM2491 precursor RNA does not encode a protein. A nucleotide sequence identical or highly similar to the nucleotide sequence of VGAM2491 precursor RNA is designated SEQ ID:2477, and is provided hereinbelow with reference to the sequence listing part. Nucleotide sequence SEQ ID:2477 is located at position 198448 relative to the genome of Mouse Cytomegalovirus 1.

VGAM2491 precursor RNA folds onto itself, forming VGAM2491 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2491 folded precursor RNA into VGAM2491 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2491 RNA is designated SEQ ID:5202, and is provided hereinbelow with reference to the sequence listing part.

VGAM2491 host target gene, herein designated VGAM HOST TARGET GENE, encodes a corresponding messenger RNA, VGAM2491 host target RNA, herein designated VGAM HOST TARGET RNA. VGAM2491 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2491 RNA, herein designated VGAM RNA, binds complementarily to one or more host target binding sites located in untranslated regions of VGAM2491 host target RNA, herein designated VGAM HOST TARGET RNA. This complementary binding is due to the fact that the nucleotide sequence of VGAM2491 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2491 RNA, herein designated VGAM RNA, may have a different number of host target binding sites in untranslated regions of a VGAM2491 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2491 RNA, herein designated VGAM RNA, to host target binding sites on VGAM2491 host target RNA, herein designated VGAM HOST TARGET RNA, such as BINDING SITE I, BINDING SITE II and BINDING SITE III, inhibits translation of VGAM2491 host target RNA into VGAM2491 host target protein, herein designated VGAM HOST TARGET PROTEIN. VGAM host target protein is therefore outlined by a broken line.

It is appreciated that VGAM2491 host target gene, herein designated VGAM HOST TARGET GENE, in fact represents a plurality of VGAM2491 host target genes. The mRNA of each one of this plurality of VGAM2491 host target genes comprises one or more host target binding sites, each having a nucleotide sequence which is at least partly complementary to VGAM2491 RNA, herein designated VGAM RNA, and which when bound by VGAM2491 RNA causes inhibition of translation of respective one or more VGAM2491 host target proteins.

It is further appreciated by one skilled in the art that the mode of translational inhibition illustrated by FIG. 1 with specific reference to translational inhibition exerted by VGAM2491 gene, herein designated VGAM GENE, on one or more VGAM2491 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2491 is inhibition of expression of host target genes, as part of a novel viral mechanism of attacking a host. Accordingly, utilities of VGAM2491 include diagnosis, prevention and treatment of viral infection by Mouse Cytomegalovirus 1. Specific functions, and accordingly utilities, of VGAM2491 correlate with, and may be deduced from, the identity of the host target genes which VGAM2491 binds and inhibits, and the function of these host target genes, as elaborated hereinbelow.

Nucleotide sequences of the VGAM2491 precursor RNA, herein designated VGAM PRECURSOR RNA, and of the 'diced' VGAM2491 RNA, herein designated VGAM RNA, and a schematic representation of the secondary folding of VGAM2491 folded precursor RNA, herein designated VGAM FOLDED PRECURSOR RNA, of VGAM2491 are further described hereinbelow with reference to Table 1.

Nucleotide sequences of host target binding sites, such as BINDING SITE-I, BINDING SITE-II and BINDING SITE-III of FIG. 1, found on VGAM2491 host target RNA, and schematic representation of the complementarity of each of these host target binding sites to VGAM2491 RNA, herein designated VGAM RNA, are described hereinbelow with reference to Table 2.

As mentioned hereinabove with reference to FIG. 1, a function of VGAM2491 gene, herein designated VGAM is inhibition of expression of VGAM2491 target genes. It is appreciated that specific functions, and accordingly utilities, of VGAM2491 correlate with, and may be deduced from, the identity of the target genes which VGAM2491 binds and inhibits, and the function of these target genes, as elaborated hereinbelow.

Collagen, Type VI, Alpha 2 (COL6A2, Accession NM_058175) is a VGAM2491 host target gene. COL6A2 BINDING SITE is HOST TARGET binding site found in the 3' untranslated region of mRNA encoded by COL6A2, corresponding to a HOST TARGET binding site such as BINDING SITE I, BINDING SITE II or BINDING SITE III. Table 2 illustrates the complementarity of the nucleotide sequences of COL6A2 BINDING SITE, designated SEQ ID:27725, to the nucleotide sequence of VGAM2491 RNA, herein designated VGAM RNA, also designated SEQ ID:5202.

A function of VGAM2491 is therefore inhibition of Collagen, Type VI, Alpha 2 (COL6A2, Accession NM_058175). Accordingly, utilities of VGAM2491 include diagnosis, prevention and treatment of diseases and clinical conditions associated with COL6A2. Glucose-6-phosphate Dehydrogenase (G6PD, Accession NM_000402) is another VGAM2491 host target gene. G6PD BINDING SITE is HOST TARGET binding site found in the 3' untranslated region of mRNA encoded by G6PD, corresponding to a HOST TARGET binding site such as BINDING SITE I, BINDING SITE II or BINDING SITE III. Table 2 illustrates the complementarity of the nucleotide sequences of G6PD BINDING SITE, designated SEQ ID:5980, to the nucleotide sequence of VGAM2491 RNA, herein designated VGAM RNA, also designated SEQ ID:5202.

Another function of VGAM2491 is therefore inhibition of Glucose-6-phosphate Dehydrogenase (G6PD, Accession NM_000402), a gene which produces pentose sugars for nucleic acid synthesis and main producer of nadph reducing power. Accordingly, utilities of VGAM2491 include diagnosis, prevention and treatment of diseases and clinical conditions associated with G6PD. The function of G6PD and its association with various diseases and clinical conditions, has been established by previous studies, as described hereinabove with reference to VGAM1027. DQX1 (Accession NM_133637) is another VGAM2491 host target gene. DQX1 BINDING SITE is HOST TARGET binding site found in the 5' untranslated region of mRNA encoded by DQX1, corresponding to a HOST TARGET binding site such as BINDING SITE I, BINDING SITE II or BINDING SITE III. Table 2 illustrates the complementarity of the nucleotide sequences of DQX1 BINDING SITE, designated SEQ ID:28596, to the nucleotide sequence of VGAM2491 RNA, herein designated VGAM RNA, also designated SEQ ID:5202.

Another function of VGAM2491 is therefore inhibition of DQX1 (Accession NM_133637). Accordingly, utilities of VGAM2491 include diagnosis, prevention and treatment of diseases and clinical conditions associated with DQX1. ETR101 (Accession XM_051364) is another VGAM2491 host target gene. ETR101 BINDING SITE is HOST TARGET binding site found in the 3' untranslated region of mRNA encoded by ETR101, corresponding to a HOST TARGET binding site such as BINDING SITE I, BINDING SITE II or BINDING SITE III. Table 2 illustrates the complementarity of the nucleotide sequences of ETR101 BINDING SITE, designated SEQ ID:35830, to the nucleotide sequence of VGAM2491 RNA, herein designated VGAM RNA, also designated SEQ ID:5202.

Another function of VGAM2491 is therefore inhibition of ETR101 (Accession XM_051364). Accordingly, utilities of VGAM2491 include diagnosis, prevention and treatment of diseases and clinical conditions associated with ETR101. FLJ14054 (Accession NM_024563) is another VGAM2491 host target gene. FLJ14054 BINDING SITE is HOST TARGET binding site found in the 3' untranslated region of mRNA encoded by FLJ14054, corresponding to a HOST TARGET binding site such as BINDING SITE I, BINDING SITE II or BINDING SITE III. Table 2 illustrates the complementarity of the nucleotide sequences of FLJ14054 BINDING SITE, designated SEQ ID:23781, to the nucleotide sequence of VGAM2491 RNA, herein designated VGAM RNA, also designated SEQ ID:5202.

Another function of VGAM2491 is therefore inhibition of FLJ14054 (Accession NM_024563). Accordingly, utilities of VGAM2491 include diagnosis, prevention and treatment of diseases and clinical conditions associated with FLJ14054. KIAA1884 (Accession XM_055539) is another VGAM2491 host target gene. KIAA1884 BINDING SITE is HOST TARGET binding site found in the 3' untranslated region of mRNA encoded by KIAA1884, corresponding to a HOST TARGET binding site such as BINDING SITE I, BINDING SITE II or BINDING SITE III. Table 2 illustrates the complementarity of the nucleotide sequences of KIAA1884 BINDING SITE, designated SEQ ID:36296, to the nucleotide sequence of VGAM2491 RNA, herein designated VGAM RNA, also designated SEQ ID:5202.

Another function of VGAM2491 is therefore inhibition of KIAA1884 (Accession XM_055539). Accordingly, utilities of VGAM2491 include diagnosis, prevention and treatment of diseases and clinical conditions associated with KIAA1884. SEC14-like 2 (S. cerevisiae) (SEC14L2, Accession NM_012429) is another VGAM2491 host target gene. SEC14L2 BINDING SITE is HOST TARGET binding site found in the 3' untranslated region of mRNA encoded by SEC14L2, corresponding to a HOST TARGET binding site such as BINDING SITE I, BINDING SITE II or BINDING SITE III. Table 2 illustrates the complementarity of the nucleotide sequences of SEC14L2 BINDING SITE, designated SEQ ID:14804, to the nucleotide sequence of VGAM2491 RNA, herein designated VGAM RNA, also designated SEQ ID:5202.

Another function of VGAM2491 is therefore inhibition of SEC14-like 2 (S. cerevisiae) (SEC14L2, Accession NM_012429). Accordingly, utilities of VGAM2491 include diagnosis, prevention and treatment of diseases and clinical conditions associated with SEC14L2. LOC122769 (Accession XM_058657) is another VGAM2491 host target gene. LOC122769 BINDING SITE is HOST TARGET binding site found in the 5' untranslated region of mRNA encoded by LOC122769, corresponding to a HOST TARGET binding site such as BINDING SITE I, BINDING SITE II or BINDING SITE III. Table 2 illustrates the complementarity of the nucleotide sequences of LOC122769 BINDING SITE, designated SEQ ID:36695, to the nucleotide sequence of VGAM2491 RNA, herein designated VGAM RNA, also designated SEQ ID:5202.

Another function of VGAM2491 is therefore inhibition of LOC122769 (Accession XM_058657). Accordingly, utilities of VGAM2491 include diagnosis, prevention and treatment of diseases and clinical conditions associated with LOC122769. LOC151124 (Accession XM_098006) is another VGAM2491 host target gene. LOC151124 BINDING SITE is HOST TARGET binding site found in the 5' untranslated region of mRNA encoded by LOC151124, corresponding to a HOST TARGET binding site such as BINDING SITE I, BINDING SITE II or BINDING SITE III. Table 2 illustrates the complementarity of the nucleotide sequences of LOC151124 BINDING SITE, designated SEQ ID:41299, to the nucleotide sequence of VGAM2491 RNA, herein designated VGAM RNA, also designated SEQ ID:5202.

Another function of VGAM2491 is therefore inhibition of LOC151124 (Accession XM_098006). Accordingly, utilities of VGAM2491 include diagnosis, prevention and treatment of diseases and clinical conditions associated with LOC151124. LOC254016 (Accession XM_173050) is another VGAM2491 host target gene. LOC254016 BINDING SITE is HOST TARGET binding site found in the 5' untranslated region of mRNA encoded by LOC254016, corresponding to a HOST TARGET binding site such as BINDING SITE I, BINDING SITE II or BINDING SITE III. Table 2 illustrates the complementarity of the nucleotide sequences of LOC254016 BINDING SITE, designated SEQ ID:46309, to the nucleotide sequence of VGAM2491 RNA, herein designated VGAM RNA, also designated SEQ ID:5202.

Another function of VGAM2491 is therefore inhibition of LOC254016 (Accession XM_173050). Accordingly, utilities of VGAM2491 include diagnosis, prevention and treatment of diseases and clinical conditions associated with LOC254016. LOC58509 (Accession XM_114002) is another VGAM2491 host target gene. LOC58509 BINDING SITE is HOST TARGET binding site found in the 5' untranslated region of mRNA encoded by LOC58509, corresponding to a HOST TARGET binding site such as BINDING SITE I, BINDING SITE II or BINDING SITE III. Table 2 illustrates the complementarity of the nucleotide sequences of LOC58509 BINDING SITE, designated SEQ ID:42612, to the nucleotide sequence of VGAM2491 RNA, herein designated VGAM RNA, also designated SEQ ID:5202.

Another function of VGAM2491 is therefore inhibition of LOC58509 (Accession XM_114002). Accordingly, utilities of VGAM2491 include diagnosis, prevention and treatment of diseases and clinical conditions associated with LOC58509. LOC64150 (Accession XM_040993) is another VGAM2491 host target gene. LOC64150 BINDING SITE is HOST TARGET binding site found in the 5' untranslated region of mRNA encoded by LOC64150, corresponding to a HOST TARGET binding site such as BINDING SITE I, BINDING SITE II or BINDING SITE III. Table 2 illustrates the complementarity of the nucleotide sequences of LOC64150 BINDING SITE, designated SEQ ID:33411, to the nucleotide sequence of VGAM2491 RNA, herein designated VGAM RNA, also designated SEQ ID:5202.

Another function of VGAM2491 is therefore inhibition of LOC64150 (Accession XM_040993). Accordingly, utilities of VGAM2491 include diagnosis, prevention and treatment of diseases and clinical conditions associated with LOC64150. FIG. 1 further provides a conceptual description of a novel bioinformatically detected viral gene of the present invention, referred to here as Viral Genomic Address Messenger 2492 (VGAM2492) viral gene, which modulates expression of respective host target genes thereof, the function and utility of which host target genes is known in the art.

VGAM2492 is a novel bioinformatically detected regulatory, non protein coding, viral micro RNA (miRNA) gene. The method by which VGAM2492 was detected is described hereinabove with reference to FIGS. 1-8.

VGAM2492 gene, herein designated VGAM GENE, is a viral gene contained in the genome of Mouse Cytomegalovirus 1. VGAM2492 host target gene, herein designated VGAM HOST TARGET GENE, is a human gene contained in the human genome.

VGAM2492 gene encodes a VGAM2492 precursor RNA, herein designated VGAM PRECURSOR RNA. Similar to other miRNA genes, and unlike most ordinary genes, VGAM2492 precursor RNA does not encode a protein. A nucleotide sequence identical or highly similar to the nucleotide sequence of VGAM2492 precursor RNA is designated SEQ ID:2478, and is provided hereinbelow with reference to the sequence listing part. Nucleotide sequence SEQ ID:2478 is located at position 124024 relative to the genome of Mouse Cytomegalovirus 1.

VGAM2492 precursor RNA folds onto itself, forming VGAM2492 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2492 folded precursor RNA into VGAM2492 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM2492 RNA is designated SEQ ID:5203, and is provided hereinbelow with reference to the sequence listing part.

VGAM2492 host target gene, herein designated VGAM HOST TARGET GENE, encodes a corresponding messenger RNA, VGAM2492 host target RNA, herein designated VGAM HOST TARGET RNA. VGAM2492 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2492 RNA, herein designated VGAM RNA, binds complementarily to one or more host target binding sites located in untranslated regions of VGAM2492 host target RNA, herein designated VGAM HOST TARGET RNA. This complementary binding is due to the fact that the nucleotide sequence of VGAM2492 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2492 RNA, herein designated VGAM RNA, may have a different number of host target binding sites in untranslated regions of a VGAM2492 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2492 RNA, herein designated VGAM RNA, to host target binding sites on VGAM2492 host target RNA, herein designated VGAM HOST TARGET RNA, such as BINDING SITE I, BINDING SITE II and BINDING SITE III, inhibits translation of VGAM2492 host target RNA into VGAM2492 host target protein, herein designated VGAM HOST TARGET PROTEIN. VGAM host target protein is therefore outlined by a broken line.

It is appreciated that VGAM2492 host target gene, herein designated VGAM HOST TARGET GENE, in fact represents a plurality of VGAM2492 host target genes. The mRNA of each one of this plurality of VGAM2492 host target genes comprises one or more host target binding sites, each having a nucleotide sequence which is at least partly complementary to VGAM2492 RNA, herein designated VGAM RNA, and which when bound by VGAM2492 RNA causes inhibition of translation of respective one or more VGAM2492 host target proteins.

It is further appreciated by one skilled in the art that the mode of translational inhibition illustrated by FIG. 1 with specific reference to translational inhibition exerted by VGAM2492 gene, herein designated VGAM GENE, on one or more VGAM2492 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2492 is inhibition of expression of host target genes, as part of a novel viral mechanism of attacking a host. Accordingly, utilities of VGAM2492 include diagnosis, prevention and treatment of viral infection by Mouse Cytomegalovirus 1. Specific functions, and accordingly utilities, of VGAM2492 correlate with, and may be deduced from, the identity of the host target genes which VGAM2492 binds and inhibits, and the function of these host target genes, as elaborated hereinbelow.

Nucleotide sequences of the VGAM2492 precursor RNA, herein designated VGAM PRECURSOR RNA, and of the 'diced' VGAM2492 RNA, herein designated VGAM RNA, and a schematic representation of the secondary folding of VGAM2492 folded precursor RNA, herein designated VGAM FOLDED PRECURSOR RNA, of VGAM2492 are further described hereinbelow with reference to Table 1.

Nucleotide sequences of host target binding sites, such as BINDING SITE-I, BINDING SITE-II and BINDING SITE-III of FIG. 1, found on VGAM2492 host target RNA, and schematic representation of the complementarity of each of these host target binding sites to VGAM2492 RNA, herein designated VGAM RNA, are described hereinbelow with reference to Table 2.

As mentioned hereinabove with reference to FIG. 1, a function of VGAM2492 gene, herein designated VGAM is inhibition of expression of VGAM2492 target genes. It is appreciated that specific functions, and accordingly utilities, of VGAM2492 correlate with, and may be deduced from, the identity of the target genes which VGAM2492 binds and inhibits, and the function of these target genes, as elaborated hereinbelow.

AXL Receptor Tyrosine Kinase (AXL, Accession NM_001699) is a VGAM2492 host target gene. AXL BINDING SITE1 and AXL BINDING SITE2 are HOST TARGET binding sites found in untranslated regions of mRNA encoded by AXL, corresponding to HOST TARGET binding sites such as BINDING SITE I, BINDING SITE II or BINDING SITE III. Table 2 illustrates the complementarity of the nucleotide sequences of AXL BINDING SITE1 and AXL BINDING SITE2, designated SEQ ID:7419 and SEQ ID:22440 respectively, to the nucleotide sequence of VGAM2492 RNA, herein designated VGAM RNA, also designated SEQ ID:5203.

A function of VGAM2492 is therefore inhibition of AXL Receptor Tyrosine Kinase (AXL, Accession NM_001699). Accordingly, utilities of VGAM2492 include diagnosis, prevention and treatment of diseases and clinical conditions associated with AXL. EMILIN-2 (Accession NM_032048) is another VGAM2492 host target gene. EMILIN-2 BINDING SITE is HOST TARGET binding site found in the 3' untranslated region of mRNA encoded by EMILIN-2, corresponding to a HOST TARGET binding site such as BINDING SITE I, BINDING SITE II or BINDING SITE III. Table 2 illustrates the complementarity of the nucleotide sequences of EMILIN-2 BINDING SITE, designated SEQ ID:25766, to the nucleotide sequence of VGAM2492 RNA, herein designated VGAM RNA, also designated SEQ ID:5203.

Another function of VGAM2492 is therefore inhibition of EMILIN-2 (Accession NM_032048). Accordingly, utilities of VGAM2492 include diagnosis, prevention and treatment of diseases and clinical conditions associated with EMILIN-2. FLJ21742 (Accession NM_032207) is another VGAM2492 host target gene. FLJ21742 BINDING SITE is HOST TARGET binding site found in the 3' untranslated region of mRNA encoded by FLJ21742, corresponding to a HOST TARGET binding site such as BINDING SITE I, BINDING SITE II or BINDING SITE III. Table 2 illustrates the complementarity of the nucleotide sequences of FLJ21742 BINDING SITE, designated SEQ ID:25912, to the nucleotide sequence of VGAM2492 RNA, herein designated VGAM RNA, also designated SEQ ID:5203.

Another function of VGAM2492 is therefore inhibition of FLJ21742 (Accession NM_032207). Accordingly, utilities of VGAM2492 include diagnosis, prevention and treatment of diseases and clinical conditions associated with FLJ21742. Ring Finger Protein 24 (RNF24, Accession NM_007219) is another VGAM2492 host target gene. RNF24 BINDING SITE is HOST TARGET binding site found in the 3' untranslated region of mRNA encoded by RNF24, corresponding to a HOST TARGET binding site such as BINDING SITE I, BINDING SITE II or BINDING SITE III. Table 2 illustrates the complementarity of the nucleotide sequences of RNF24 BINDING SITE, designated SEQ ID:14083, to the nucleotide sequence of VGAM2492 RNA, herein designated VGAM RNA, also designated SEQ ID:5203.

Another function of VGAM2492 is therefore inhibition of Ring Finger Protein 24 (RNF24, Accession NM_007219). Accordingly, utilities of VGAM2492 include diagnosis, prevention and treatment of diseases and clinical conditions associated with RNF24. LOC153577 (Accession XM_098394) is another VGAM2492 host target gene. LOC153577 BINDING SITE is HOST TARGET binding site found in the 5' untranslated region of mRNA encoded by LOC153577, corresponding to a HOST TARGET binding site such as BINDING SITE I, BINDING SITE II or BINDING SITE III. Table 2 illustrates the complementarity of the nucleotide sequences of LOC153577 BINDING SITE, designated SEQ ID:41641, to the nucleotide sequence of VGAM2492 RNA, herein designated VGAM RNA, also designated SEQ ID:5203.

Another function of VGAM2492 is therefore inhibition of LOC153577 (Accession XM_098394). Accordingly, utilities of VGAM2492 include diagnosis, prevention and treatment of diseases and clinical conditions associated with LOC153577. LOC165140 (Accession XM_092406) is another VGAM2492 host target gene. LOC165140 BINDING SITE is HOST TARGET binding site found in the 5' untranslated region of mRNA encoded by LOC165140, corresponding to a HOST TARGET binding site such as BINDING SITE I, BINDING SITE II or BINDING SITE III. Table 2 illustrates the complementarity of the nucleotide sequences of LOC165140 BINDING SITE, designated SEQ ID:40116, to the nucleotide sequence of VGAM2492 RNA, herein designated VGAM RNA, also designated SEQ ID:5203.

Another function of VGAM2492 is therefore inhibition of LOC165140 (Accession XM_092406). Accordingly, utilities of VGAM2492 include diagnosis, prevention and treatment of diseases and clinical conditions associated with LOC165140. FIG. 1 further provides a conceptual description of a novel bioinformatically detected viral gene of the present invention, referred to here as Viral Genomic Address Messenger 2493 (VGAM2493) viral gene, which modulates expression of respective host target genes thereof, the function and utility of which host target genes is known in the art.

VGAM2493 is a novel bioinformatically detected regulatory, non protein coding, viral micro RNA (miRNA) gene. The method by which VGAM2493 was detected is described hereinabove with reference to FIGS. 1-8.

VGAM2493 gene, herein designated VGAM GENE, is a viral gene contained in the genome of Mouse Cytomegalovirus 1. VGAM2493 host target gene, herein designated VGAM HOST TARGET GENE, is a human gene contained in the human genome.

VGAM2493 gene encodes a VGAM2493 precursor RNA, herein designated VGAM PRECURSOR RNA. Similar to other miRNA genes, and unlike most ordinary genes, VGAM2493 precursor RNA does not encode a protein. A nucleotide sequence identical or highly similar to the nucleotide sequence of VGAM2493 precursor RNA is designated SEQ ID:2479, and is provided hereinbelow with reference to the sequence listing part. Nucleotide sequence SEQ ID:2479 is located at position 160440 relative to the genome of Mouse Cytomegalovirus 1.

VGAM2493 precursor RNA folds onto itself, forming VGAM2493 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2493 folded precursor RNA into VGAM2493 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2493 RNA is designated SEQ ID:5204, and is provided hereinbelow with reference to the sequence listing part.

VGAM2493 host target gene, herein designated VGAM HOST TARGET GENE, encodes a corresponding messenger RNA, VGAM2493 host target RNA, herein designated VGAM HOST TARGET RNA. VGAM2493 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2493 RNA, herein designated VGAM RNA, binds complementarily to one or more host target binding sites located in untranslated regions of VGAM2493 host target RNA, herein designated VGAM HOST TARGET RNA. This complementary binding is due to the fact that the nucleotide sequence of VGAM2493 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2493 RNA, herein designated VGAM RNA, may have a different number of host target binding sites in untranslated regions of a VGAM2493 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2493 RNA, herein designated VGAM RNA, to host target binding sites on VGAM2493 host target RNA, herein designated VGAM HOST TARGET RNA, such as BINDING SITE I, BINDING SITE II and BINDING SITE III, inhibits translation of VGAM2493 host target RNA into VGAM2493 host target protein, herein designated VGAM HOST TARGET PROTEIN. VGAM host target protein is therefore outlined by a broken line.

It is appreciated that VGAM2493 host target gene, herein designated VGAM HOST TARGET GENE, in fact represents a plurality of VGAM2493 host target genes. The mRNA of each one of this plurality of VGAM2493 host target genes comprises one or more host target binding sites, each having a nucleotide sequence which is at least partly complementary to VGAM2493 RNA, herein designated VGAM RNA, and which when bound by VGAM2493 RNA causes inhibition of translation of respective one or more VGAM2493 host target proteins.

It is further appreciated by one skilled in the art that the mode of translational inhibition illustrated by FIG. 1 with specific reference to translational inhibition exerted by VGAM2493 gene, herein designated VGAM GENE, on one or more VGAM2493 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2493 is inhibition of expression of host target genes, as part of a novel viral mechanism of attacking a host. Accordingly, utilities of VGAM2493 include diagnosis, prevention and treatment of viral infection by Mouse Cytomegalovirus 1. Specific functions, and accordingly utilities, of VGAM2493 correlate with, and may be deduced from, the identity of the host target genes which VGAM2493 binds and inhibits, and the function of these host target genes, as elaborated hereinbelow.

Nucleotide sequences of the VGAM2493 precursor RNA, herein designated VGAM PRECURSOR RNA, and of the 'diced' VGAM2493 RNA, herein designated VGAM RNA, and a schematic representation of the secondary folding of VGAM2493 folded precursor RNA, herein designated VGAM FOLDED PRECURSOR RNA, of VGAM2493 are further described hereinbelow with reference to Table 1.

Nucleotide sequences of host target binding sites, such as BINDING SITE-I, BINDING SITE-II and BINDING SITE-III of FIG. 1, found on VGAM2493 host target RNA, and schematic representation of the complementarity of each of these host target binding sites to VGAM2493 RNA, herein designated VGAM RNA, are described hereinbelow with reference to Table 2.

As mentioned hereinabove with reference to FIG. 1, a function of VGAM2493 gene, herein designated VGAM is inhibition of expression of VGAM2493 target genes. It is appreciated that specific functions, and accordingly utilities, of VGAM2493 correlate with, and may be deduced from, the identity of the target genes which VGAM2493 binds and inhibits, and the function of these target genes, as elaborated hereinbelow.

Attractin (ATRN, Accession NM_139321) is a VGAM2493 host target gene. ATRN BINDING SITE is HOST TARGET binding site found in the 3' untranslated region of mRNA encoded by ATRN, corresponding to a HOST TARGET binding site such as BINDING SITE I, BINDING SITE II or BINDING SITE III. Table 2 illustrates the complementarity of the nucleotide sequences of ATRN BINDING SITE, designated SEQ ID:29297, to the nucleotide sequence of VGAM2493 RNA, herein designated VGAM RNA, also designated SEQ ID:5204.

A function of VGAM2493 is therefore inhibition of Attractin (ATRN, Accession NM_139321), a gene which is involved in the initial immune cell clustering during inflammatory response. Accordingly, utilities of VGAM2493 include diagnosis, prevention and treatment of diseases and clinical conditions associated with ATRN. The function of ATRN and its association with various diseases and clinical conditions, has been established by previous studies, as described hereinabove with reference to VGAM53. Cytochrome P450, Subfamily IIIA, Polypeptide 43 (CYP3A43, Accession NM_057096) is another VGAM2493 host target gene. CYP3A43 BINDING SITE is HOST TARGET binding site found in the 3' untranslated region of mRNA encoded by CYP3A43, corresponding to a HOST TARGET binding site such as BINDING SITE I, BINDING SITE II or BINDING SITE III. Table 2 illustrates the complementarity of the nucleotide sequences of CYP3A43 BINDING SITE, designated SEQ ID:27662, to the nucleotide sequence of VGAM2493 RNA, herein designated VGAM RNA, also designated SEQ ID:5204.

Another function of VGAM2493 is therefore inhibition of Cytochrome P450, Subfamily IIIA, Polypeptide 43 (CYP3A43, Accession NM_057096), a gene which may be involved in the metabolism of insect hormones and in the breakdown of synthetic insecticides. Accordingly, utilities of VGAM2493 include diagnosis, prevention and treatment of diseases and clinical conditions associated with CYP3A43. The function of CYP3A43 and its association with various diseases and clinical conditions, has been established by previous studies, as described hereinabove with reference to VGAM1216. Potassium Voltage-gated Channel, Shal-related Subfamily, Member 2 (KCND2, Accession NM_012281) is another VGAM2493 host target gene. KCND2 BINDING SITE is HOST TARGET binding site found in the 3' untranslated region of mRNA encoded by KCND2, corresponding to a HOST TARGET binding site such as BINDING SITE I, BINDING SITE II or BINDING SITE III. Table 2 illustrates the complementarity of the nucleotide sequences of KCND2 BINDING SITE, designated SEQ ID:14610, to the nucleotide sequence of VGAM2493 RNA, herein designated VGAM RNA, also designated SEQ ID:5204.

Another function of VGAM2493 is therefore inhibition of Potassium Voltage-gated Channel, Shal-related Subfamily, Member 2 (KCND2, Accession NM_012281), a gene which is prominent in the repolarization phase of the action potential. Accordingly, utilities of VGAM2493 include diagnosis, prevention and treatment of diseases and clinical conditions associated with KCND2. The function of KCND2 and its association with various diseases and clinical conditions, has been established by previous studies, as described hereinabove with reference to VGAM449. Solute Carrier Family 22 (organic cation transporter), Member 5 (SLC22A5, Accession NM_003060) is another VGAM2493 host target gene. SLC22A5 BINDING SITE is HOST TARGET binding site found in the 3' untranslated region of mRNA encoded by SLC22A5, corresponding to a HOST TARGET binding site such as BINDING SITE I, BINDING SITE II or BINDING SITE III. Table 2 illustrates the complementarity of the nucleotide sequences of SLC22A5 BINDING SITE, designated SEQ ID:9028, to the nucleotide sequence of VGAM2493 RNA, herein designated VGAM RNA, also designated SEQ ID:5204.

Another function of VGAM2493 is therefore inhibition of Solute Carrier Family 22 (organic cation transporter), Member 5 (SLC22A5, Accession NM_003060). Accordingly, utilities of VGAM2493 include diagnosis, prevention and treatment of diseases and clinical conditions associated with SLC22A5. Transcription Factor 12 (HTF4, helix-loop-helix transcription factors 4) (TCF12, Accession NM_003205) is another VGAM2493 host target gene. TCF12 BINDING SITE is HOST TARGET binding site found in the 3' untranslated region of mRNA encoded by TCF12, corresponding to a HOST TARGET binding site such as BINDING SITE I, BINDING SITE II or BINDING SITE III. Table 2 illustrates the complementarity of the nucleotide sequences of TCF12 BINDING SITE, designated SEQ ID:9203, to the nucleotide sequence of VGAM2493 RNA, herein designated VGAM RNA, also designated SEQ ID:5204.

Another function of VGAM2493 is therefore inhibition of Transcription Factor 12 (HTF4, helix-loop-helix transcription factors 4) (TCF12, Accession NM_003205), a gene which may play important roles during development of the nervous system as well as in other organ systems. Accordingly, utilities of VGAM2493 include diagnosis, prevention and treatment of diseases and clinical conditions associated with TCF12. The function of TCF12 and its association with various diseases and clinical conditions, has been established by previous studies, as described hereinabove with reference to VGAM308. Tumor Protein P53 (Li-Fraumeni syndrome) (TP53, Accession NM_000546) is another VGAM2493 host target gene. TP53 BINDING SITE is HOST TARGET binding site found in the 3' untranslated region of mRNA encoded by TP53, corresponding to a HOST TARGET binding site such as BINDING SITE I, BINDING SITE II or BINDING SITE III. Table 2 illustrates the complementarity of the nucleotide sequences of TP53 BINDING SITE, designated SEQ ID:6152, to the nucleotide sequence of VGAM2493 RNA, herein designated VGAM RNA, also designated SEQ ID:5204.

Another function of VGAM2493 is therefore inhibition of Tumor Protein P53 (Li-Fraumeni syndrome) (TP53, Accession NM_000546). Accordingly, utilities of VGAM2493 include diagnosis, prevention and treatment of diseases and clinical conditions associated with TP53. MGC4172 (Accession NM_024308) is another VGAM2493 host target gene. MGC4172 BINDING SITE is HOST TARGET binding site found in the 5' untranslated region of mRNA encoded by MGC4172, corresponding to a HOST TARGET binding site such as BINDING SITE I, BINDING SITE II or BINDING SITE III. Table 2 illustrates the complementarity of the nucleotide sequences of MGC4172 BINDING SITE, designated SEQ ID:23600, to the nucleotide sequence of VGAM2493 RNA, herein designated VGAM RNA, also designated SEQ ID:5204.

Another function of VGAM2493 is therefore inhibition of MGC4172 (Accession NM_024308). Accordingly, utilities of VGAM2493 include diagnosis, prevention and treatment of diseases and clinical conditions associated with MGC4172. PDZ Domain Containing 2 (PDZD2, Accession XM_087705) is another VGAM2493 host target gene. PDZD2 BINDING SITE is HOST TARGET binding site found in the 5' untranslated region of mRNA encoded by PDZD2, corresponding to a HOST TARGET binding site such as BINDING SITE I, BINDING SITE II or BINDING SITE III. Table 2 illustrates the complementarity of the nucleotide sequences of PDZD2 BINDING SITE, designated SEQ ID:39387, to the nucleotide sequence of VGAM2493 RNA, herein designated VGAM RNA, also designated SEQ ID:5204.

Another function of VGAM2493 is therefore inhibition of PDZ Domain Containing 2 (PDZD2, Accession XM_087705). Accordingly, utilities of VGAM2493 include diagnosis, prevention and treatment of diseases and clinical conditions associated with PDZD2. RRN3 (Accession NM_018427) is another VGAM2493 host target gene. RRN3 BINDING SITE is HOST TARGET binding site found in the 3' untranslated region of mRNA encoded by RRN3, corresponding to a HOST TARGET binding site such as BINDING SITE I, BINDING SITE II or BINDING SITE III. Table 2 illustrates the complementarity of the nucleotide sequences of RRN3 BINDING SITE, designated SEQ ID:20491, to the nucleotide sequence of VGAM2493 RNA, herein designated VGAM RNA, also designated SEQ ID:5204.

Another function of VGAM2493 is therefore inhibition of RRN3 (Accession NM_018427). Accordingly, utilities of VGAM2493 include diagnosis, prevention and treatment of diseases and clinical conditions associated with RRN3. LOC150951 (Accession XM_097975) is another VGAM2493 host target gene. LOC150951 BINDING SITE is HOST TARGET binding site found in the 5' untranslated region of mRNA encoded by LOC150951, corresponding to a HOST TARGET binding site such as BINDING SITE I, BINDING SITE II or BINDING SITE III. Table 2 illustrates the complementarity of the nucleotide sequences of LOC150951 BINDING SITE, designated SEQ ID:41276, to the nucleotide sequence of VGAM2493 RNA, herein designated VGAM RNA, also designated SEQ ID:5204.

Another function of VGAM2493 is therefore inhibition of LOC150951 (Accession XM_097975). Accordingly, utilities of VGAM2493 include diagnosis, prevention and treatment of diseases and clinical conditions associated with LOC150951. LOC152274 (Accession XM_087418) is another VGAM2493 host target gene. LOC152274 BINDING SITE is HOST TARGET binding site found in the 3' untranslated region of mRNA encoded by LOC152274, corresponding to a HOST TARGET binding site such as BINDING SITE I, BINDING SITE II or BINDING SITE III. Table 2 illustrates the complementarity of the nucleotide sequences of LOC152274 BINDING SITE, designated SEQ ID:39233, to the nucleotide sequence of VGAM2493 RNA, herein designated VGAM RNA, also designated SEQ ID:5204.

Another function of VGAM2493 is therefore inhibition of LOC152274 (Accession XM_087418). Accordingly, utilities of VGAM2493 include diagnosis, prevention and treatment of diseases and clinical conditions associated with LOC152274. FIG. 1 further provides a conceptual description of a novel bioinformatically detected viral gene of the present invention, referred to here as Viral Genomic Address Messenger 2494 (VGAM2494) viral gene, which modulates expression of respective host target genes thereof, the function and utility of which host target genes is known in the art.

VGAM2494 is a novel bioinformatically detected regulatory, non protein coding, viral micro RNA (miRNA) gene. The method by which VGAM2494 was detected is described hereinabove with reference to FIGS. 1-8.

VGAM2494 gene, herein designated VGAM GENE, is a viral gene contained in the genome of Mouse Cytomegalovirus 1. VGAM2494 host target gene, herein designated VGAM HOST TARGET GENE, is a human gene contained in the human genome.

VGAM2494 gene encodes a VGAM2494 precursor RNA, herein designated VGAM PRECURSOR RNA. Similar to other miRNA genes, and unlike most ordinary genes, VGAM2494 precursor RNA does not encode a protein. A nucleotide sequence identical or highly similar to the nucleotide sequence of VGAM2494 precursor RNA is designated SEQ ID:2480, and is provided hereinbelow with reference to the sequence listing part. Nucleotide sequence SEQ ID:2480 is located at position 208377 relative to the genome of Mouse Cytomegalovirus 1.

VGAM2494 precursor RNA folds onto itself, forming VGAM2494 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2494 folded precursor RNA into VGAM2494 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2494 RNA is designated SEQ ID:5205, and is provided hereinbelow with reference to the sequence listing part.

VGAM2494 host target gene, herein designated VGAM HOST TARGET GENE, encodes a corresponding messenger RNA, VGAM2494 host target RNA, herein designated VGAM HOST TARGET RNA. VGAM2494 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2494 RNA, herein designated VGAM RNA, binds complementarily to one or more host target binding sites located in untranslated regions of VGAM2494 host target RNA, herein designated VGAM HOST TARGET RNA. This complementary binding is due to the fact that the nucleotide sequence of VGAM2494 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2494 RNA, herein designated VGAM RNA, may have a different number of host target binding sites in untranslated regions of a VGAM2494 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2494 RNA, herein designated VGAM RNA, to host target binding sites on VGAM2494 host target RNA, herein designated VGAM HOST TARGET RNA, such as BINDING SITE I, BINDING SITE II and BINDING SITE III, inhibits translation of VGAM2494 host target RNA into VGAM2494 host target protein, herein designated VGAM HOST TARGET PROTEIN. VGAM host target protein is therefore outlined by a broken line.

It is appreciated that VGAM2494 host target gene, herein designated VGAM HOST TARGET GENE, in fact represents a plurality of VGAM2494 host target genes. The mRNA of each one of this plurality of VGAM2494 host target genes comprises one or more host target binding sites, each having a nucleotide sequence which is at least partly complementary to VGAM2494 RNA, herein designated VGAM RNA, and which when bound by VGAM2494 RNA causes inhibition of translation of respective one or more VGAM2494 host target proteins.

It is further appreciated by one skilled in the art that the mode of translational inhibition illustrated by FIG. 1 with specific reference to translational inhibition exerted by VGAM2494 gene, herein designated VGAM GENE, on one or more VGAM2494 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2494 is inhibition of expression of host target genes, as part of a novel viral mechanism of attacking a host. Accordingly, utilities of VGAM2494 include diagnosis, prevention and treatment of viral infection by Mouse Cytomegalovirus 1. Specific functions, and accordingly utilities, of VGAM2494 correlate with, and may be deduced from, the identity of the host target genes which VGAM2494 binds and inhibits, and the function of these host target genes, as elaborated hereinbelow.

Nucleotide sequences of the VGAM2494 precursor RNA, herein designated VGAM PRECURSOR RNA, and of the 'diced' VGAM2494 RNA, herein designated VGAM RNA, and a schematic representation of the secondary folding of VGAM2494 folded precursor RNA, herein designated VGAM FOLDED PRECURSOR RNA, of VGAM2494 are further described hereinbelow with reference to Table 1.

Nucleotide sequences of host target binding sites, such as BINDING SITE-I, BINDING SITE-II and BINDING SITE-III of FIG. 1, found on VGAM2494 host target RNA, and schematic representation of the complementarity of each of these host target binding sites to VGAM2494 RNA, herein designated VGAM RNA, are described hereinbelow with reference to Table 2.

As mentioned hereinabove with reference to FIG. 1, a function of VGAM2494 gene, herein designated VGAM is inhibition of expression of VGAM2494 target genes. It is appreciated that specific functions, and accordingly utilities, of VGAM2494 correlate with, and may be deduced from, the identity of the target genes which VGAM2494 binds and inhibits, and the function of these target genes, as elaborated hereinbelow.

V-raf Murine Sarcoma 3611 Viral Oncogene Homolog 1 (ARAF1, Accession XM_033884) is a VGAM2494 host target gene. ARAF1 BINDING SITE is HOST TARGET binding site found in the 5' untranslated region of mRNA encoded by ARAF1, corresponding to a HOST TARGET binding site such as BINDING SITE I, BINDING SITE II or BINDING SITE III. Table 2 illustrates the complementarity of the nucleotide sequences of ARAF1 BINDING SITE, designated SEQ ID:31981, to the nucleotide sequence of VGAM2494 RNA, herein designated VGAM RNA, also designated SEQ ID:5205.

A function of VGAM2494 is therefore inhibition of V-raf Murine Sarcoma 3611 Viral Oncogene Homolog 1 (ARAF1, Accession XM_033884), a gene which may play a critical role in cell growth and development. Accordingly, utilities of VGAM2494 include diagnosis, prevention and treatment of diseases and clinical conditions associated with ARAF1. The function of ARAF1 and its association with various diseases and clinical conditions, has been established by previous studies, as described hereinabove with reference to VGAM996. Calcium/calmodulin-dependent Protein Kinase IV (CAMK4, Accession NM_001744) is another VGAM2494 host target gene. CAMK4 BINDING SITE is HOST TARGET binding site found in the 3' untranslated region of mRNA encoded by CAMK4, corresponding to a HOST TARGET binding site such as BINDING SITE I, BINDING SITE II or BINDING SITE III. Table 2 illustrates the complementarity of the nucleotide sequences of CAMK4 BINDING SITE, designated SEQ ID:7481, to the nucleotide sequence of VGAM2494 RNA, herein designated VGAM RNA, also designated SEQ ID:5205.

Another function of VGAM2494 is therefore inhibition of Calcium/calmodulin-dependent Protein Kinase IV (CAMK4, Accession NM_001744), a gene which is a heat-stable, acidic, calmodulin-binding protein. Accordingly, utilities of VGAM2494 include diagnosis, prevention and treatment of diseases and clinical conditions associated with CAMK4. The function of CAMK4 and its association with various diseases and clinical conditions, has been established by previous studies, as described hereinabove with reference to VGAM578. CD34 Antigen (CD34, Accession NM_001773) is another VGAM2494 host target gene. CD34 BINDING SITE is HOST TARGET binding site found in the 3' untranslated region of mRNA encoded by CD34, corresponding to a HOST TARGET binding site such as BINDING SITE I, BINDING SITE II or BINDING SITE III. Table 2 illustrates the complementarity of the nucleotide sequences of CD34 BINDING SITE, designated SEQ ID:7535, to the nucleotide sequence of VGAM2494 RNA, herein designated VGAM RNA, also designated SEQ ID:5205.

Another function of VGAM2494 is therefore inhibition of CD34 Antigen (CD34, Accession NM_001773), a gene which is a monomeric cell surface antigen that is selectively expressed on human hematopoietic progenitor cells. Accordingly, utilities of VGAM2494 include diagnosis, prevention and treatment of diseases and clinical conditions associated with CD34. The function of CD34 and its association with various diseases and clinical conditions, has been established by previous studies, as described hereinabove with reference to VGAM55. Fibroblast Growth Factor 2 (basic) (FGF2, Accession NM_002006) is another VGAM2494 host target gene. FGF2 BINDING SITE is HOST TARGET binding site found in the 5' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7737, to the nucleotide sequence of VGAM2494 RNA, herein designated VGAM RNA, also designated SEQ ID:5205.

Another function of VGAM2494 is therefore inhibition of Fibroblast Growth Factor 2 (basic) (FGF2, Accession NM_002006), a gene which probably involved in nervous system development and function. Accordingly, utilities of VGAM2494 include diagnosis, prevention and treatment of diseases and clinical conditions associated with FGF2. The function of FGF2 and its association with various diseases and clinical conditions, has been established by previous studies, as described hereinabove with reference to VGAM51. Frizzled Homolog 4 (Drosophila) (FZD4, Accession NM_012193) is another VGAM2494 host target gene. FZD4 BINDING SITE is HOST TARGET binding site found in the 3' untranslated region of mRNA encoded by FZD4, corresponding to a HOST TARGET binding site such as BINDING SITE I, BINDING SITE II or BINDING SITE III. Table 2 illustrates the complementarity of the nucleotide sequences of FZD4 BINDING SITE, designated SEQ ID:14486, to the nucleotide sequence of VGAM2494 RNA, herein designated VGAM RNA, also designated SEQ ID:5205.

Another function of VGAM2494 is therefore inhibition of Frizzled Homolog 4 (Drosophila) (FZD4, Accession NM_012193), a gene which may function in cell polarity, cell fate specification and cancer; similar to frizzled receptor family, has seven transmembrane domains. Accordingly, utilities of VGAM2494 include diagnosis, prevention and treatment of diseases and clinical conditions associated with FZD4. The function of FZD4 and its association with various diseases and clinical conditions, has been established by previous studies, as described hereinabove with reference to VGAM309. Maltase-glucoamylase (alpha-glucosidase) (MGAM, Accession XM_051351) is another VGAM2494 host target gene. MGAM BINDING SITE is HOST TARGET binding site found in the 3' untranslated region of mRNA encoded by MGAM, corresponding to a HOST TARGET binding site such as BINDING SITE I, BINDING SITE II or BINDING SITE III. Table 2 illustrates the complementarity of the nucleotide sequences of MGAM BINDING SITE, designated SEQ ID:35824, to the nucleotide sequence of VGAM2494 RNA, herein designated VGAM RNA, also designated SEQ ID:5205.

Another function of VGAM2494 is therefore inhibition of Maltase-glucoamylase (alpha-glucosidase) (MGAM, Accession XM_051351), a gene which plays a role in the final steps of digestion of starch. Accordingly, utilities of VGAM2494 include diagnosis, prevention and treatment of diseases and clinical conditions associated with MGAM. The function of MGAM and its association with various diseases and clinical conditions, has been established by previous studies, as described hereinabove with reference to VGAM791. Serine (or cysteine) Proteinase Inhibitor, Clade B (ovalbumin), Member 13 (SERPINB13, Accession NM_012397) is another VGAM2494 host target gene. SERPINB13 BINDING SITE is HOST TARGET binding site found in the 3' untranslated region of mRNA encoded by SERPINB13, corresponding to a HOST TARGET binding site such as BINDING SITE I, BINDING SITE II or BINDING SITE III. Table 2 illustrates the complementarity of the nucleotide sequences of SERPINB13 BINDING SITE, designated SEQ ID:14763, to the nucleotide sequence of VGAM2494 RNA, herein designated VGAM RNA, also designated SEQ ID:5205.

Another function of VGAM2494 is therefore inhibition of Serine (or cysteine) Proteinase Inhibitor, Clade B (ovalbumin), Member 13 (SERPINB13, Accession NM_012397), a gene which plays a role in the proliferation or differentiation of keratinocytes. Accordingly, utilities of VGAM2494 include diagnosis, prevention and treatment of diseases and clinical conditions associated with SERPINB13. The function of SERPINB13 and its association with various diseases and clinical conditions, has been established by previous studies, as described hereinabove with reference to VGAM1924. Sarcoglycan, Gamma (35 kDa dystrophin-associated glycoprotein) (SGCG, Accession NM_000231) is another VGAM2494 host target gene. SGCG BINDING SITE is HOST TARGET binding site found in the 3' untranslated region of mRNA encoded by SGCG, corresponding to a HOST TARGET binding site such as BINDING SITE I, BINDING SITE II or BINDING SITE III. Table 2 illustrates the complementarity of the nucleotide sequences of SGCG BINDING SITE, designated SEQ ID:5742, to the nucleotide sequence of VGAM2494 RNA, herein designated VGAM RNA, also designated SEQ ID:5205.

Another function of VGAM2494 is therefore inhibition of Sarcoglycan, Gamma (35 kDa dystrophin-associated glycoprotein) (SGCG, Accession NM_000231). Accordingly, utilities of VGAM2494 include diagnosis, prevention and treatment of diseases and clinical conditions associated with SGCG. VENT-like Homeobox 2 (VENTX2, Accession NM_014468) is another VGAM2494 host target gene. VENTX2 BINDING SITE is HOST TARGET binding site found in the 3' untranslated region of mRNA encoded by VENTX2, corresponding to a HOST TARGET binding site such as BINDING SITE I, BINDING SITE II or BINDING SITE III. Table 2 illustrates the complementarity of the nucleotide sequences of VENTX2 BINDING SITE, designated SEQ ID:15816, to the nucleotide sequence of VGAM2494 RNA, herein designated VGAM RNA, also designated SEQ ID:5205.

Another function of VGAM2494 is therefore inhibition of VENT-like Homeobox 2 (VENTX2, Accession NM_014468). Accordingly, utilities of VGAM2494 include diagnosis, prevention and treatment of diseases and clinical conditions associated with VENTX2. Echinoderm Microtubule Associated Protein Like 4 (EML4, Accession NM_019063) is another VGAM2494 host target gene. EML4 BINDING SITE is HOST TARGET binding site found in the 5' untranslated region of mRNA encoded by EML4, corresponding to a HOST TARGET binding site such as BINDING SITE I, BINDING SITE II or BINDING SITE III. Table 2 illustrates the complementarity of the nucleotide sequences of EML4 BINDING SITE, designated SEQ ID:21144, to the nucleotide sequence of VGAM2494 RNA, herein designated VGAM RNA, also designated SEQ ID:5205.

Another function of VGAM2494 is therefore inhibition of Echinoderm Microtubule Associated Protein Like 4 (EML4, Accession NM_019063). Accordingly, utilities of VGAM2494 include diagnosis, prevention and treatment of diseases and clinical conditions associated with EML4. FLJ10936 (Accession NM_018279) is another VGAM2494 host target gene. FLJ10936 BINDING SITE is HOST TARGET binding site found in the 5' untranslated region of mRNA encoded by FLJ10936, corresponding to a HOST TARGET binding site such as BINDING SITE I, BINDING SITE II or BINDING SITE III. Table 2 illustrates the complementarity of the nucleotide sequences of FLJ10936 BINDING SITE, designated SEQ ID:20270, to the nucleotide sequence of VGAM2494 RNA, herein designated VGAM RNA, also designated SEQ ID:5205.

Another function of VGAM2494 is therefore inhibition of FLJ10936 (Accession NM_018279). Accordingly, utilities of VGAM2494 include diagnosis, prevention and treatment of diseases and clinical conditions associated with FLJ10936. KIAA0763 (Accession NM_014869) is another VGAM2494 host target gene. KIAA0763 BINDING SITE is HOST TARGET binding site found in the 3' untranslated region of mRNA encoded by KIAA0763, corresponding to a HOST TARGET binding site such as BINDING SITE I, BINDING SITE II or BINDING SITE III. Table 2 illustrates the complementarity of the nucleotide sequences of KIAA0763 BINDING SITE, designated SEQ ID:16970, to the nucleotide sequence of VGAM2494 RNA, herein designated VGAM RNA, also designated SEQ ID:5205.

Another function of VGAM2494 is therefore inhibition of KIAA0763 (Accession NM_014869). Accordingly, utilities of VGAM2494 include diagnosis, prevention and treatment of diseases and clinical conditions associated with KIAA0763. KIAA1297 (Accession XM_051005) is another VGAM2494 host target gene. KIAA1297 BINDING SITE1 and KIAA1297 BINDING SITE2 are HOST TARGET binding sites found in untranslated regions of mRNA encoded by KIAA1297, corresponding to HOST TARGET binding sites such as BINDING SITE I, BINDING SITE II or BINDING SITE III. Table 2 illustrates the complementarity of the nucleotide sequences of KIAA1297 BINDING SITE1 and KIAA1297 BINDING SITE2, designated SEQ ID:35716 and SEQ ID:35717 respectively, to the nucleotide sequence of VGAM2494 RNA, herein designated VGAM RNA, also designated SEQ ID:5205.

Another function of VGAM2494 is therefore inhibition of KIAA1297 (Accession XM_051005). Accordingly, utilities of VGAM2494 include diagnosis, prevention and treatment of diseases and clinical conditions associated with KIAA1297. MGC2865 (Accession NM_032375) is another VGAM2494 host target gene. MGC2865 BINDING SITE is HOST TARGET binding site found in the 5' untranslated region of mRNA encoded by MGC2865, corresponding to a HOST TARGET binding site such as BINDING SITE I, BINDING SITE II or BINDING SITE III. Table 2 illustrates the complementarity of the nucleotide sequences of MGC2865 BINDING SITE, designated SEQ ID:26167, to the nucleotide sequence of VGAM2494 RNA, herein designated VGAM RNA, also designated SEQ ID:5205.

Another function of VGAM2494 is therefore inhibition of MGC2865 (Accession NM_032375). Accordingly, utilities of VGAM2494 include diagnosis, prevention and treatment of diseases and clinical conditions associated with MGC2865. MGC9753 (Accession NM_033419) is another VGAM2494 host target gene. MGC9753 BINDING SITE is HOST TARGET binding site found in the 5' untranslated region of mRNA encoded by MGC9753, corresponding to a HOST TARGET binding site such as BINDING SITE I, BINDING SITE II or BINDING SITE III. Table 2 illustrates the complementarity of the nucleotide sequences of MGC9753 BINDING SITE, designated SEQ ID:27242, to the nucleotide sequence of VGAM2494 RNA, herein designated VGAM RNA, also designated SEQ ID:5205.

Another function of VGAM2494 is therefore inhibition of MGC9753 (Accession NM_033419). Accordingly, utilities of VGAM2494 include diagnosis, prevention and treatment of diseases and clinical conditions associated with MGC9753. Methionine Sulfoxide Reductase A (MSRA, Accession NM_012331) is another VGAM2494 host target gene. MSRA BINDING SITE is HOST TARGET binding site found in the 5' untranslated region of mRNA encoded by MSRA, corresponding to a HOST TARGET binding site such as BINDING SITE I, BINDING SITE II or BINDING SITE III. Table 2 illustrates the complementarity of the nucleotide sequences of MSRA BINDING SITE, designated SEQ ID:14721, to the nucleotide sequence of VGAM2494 RNA, herein designated VGAM RNA, also designated SEQ ID:5205.

Another function of VGAM2494 is therefore inhibition of Methionine Sulfoxide Reductase A (MSRA, Accession NM_012331). Accordingly, utilities of VGAM2494 include diagnosis, prevention and treatment of diseases and clinical conditions associated with MSRA. Nuclear Factor of Activated T-cells 5, Tonicity-responsive (NFAT5, Accession NM_138714) is another VGAM2494 host target gene. NFAT5 BINDING SITE is HOST TARGET binding site found in the 5' untranslated region of mRNA encoded by NFAT5, corresponding to a HOST TARGET binding site such as BINDING SITE I, BINDING SITE II or BINDING SITE III. Table 2 illustrates the complementarity of the nucleotide sequences of NFAT5 BINDING SITE, designated SEQ ID:28957, to the nucleotide sequence of VGAM2494 RNA, herein designated VGAM RNA, also designated SEQ ID:5205.

Another function of VGAM2494 is therefore inhibition of Nuclear Factor of Activated T-cells 5, Tonicity-responsive (NFAT5, Accession NM_138714). Accordingly, utilities of VGAM2494 include diagnosis, prevention and treatment of diseases and clinical conditions associated with NFAT5. PR Domain Containing 13 (PRDM13, Accession NM_021620) is another VGAM2494 host target gene. PRDM13 BINDING SITE is HOST TARGET binding site found in the 5' untranslated region of mRNA encoded by PRDM13, corresponding to a HOST TARGET binding site such as BINDING SITE I, BINDING SITE II or BINDING SITE III. Table 2 illustrates the complementarity of the nucleotide sequences of PRDM13 BINDING SITE, designated SEQ ID:22255, to the nucleotide sequence of VGAM2494 RNA, herein designated VGAM RNA, also designated SEQ ID:5205.

Another function of VGAM2494 is therefore inhibition of PR Domain Containing 13 (PRDM13, Accession NM_021620). Accordingly, utilities of VGAM2494 include diagnosis, prevention and treatment of diseases and clinical conditions associated with PRDM13. PSR (Accession XM_036784) is another VGAM2494 host target gene. PSR BINDING SITE is HOST TARGET binding site found in the 3' untranslated region of mRNA encoded by PSR, corresponding to a HOST TARGET binding site such as BINDING SITE I, BINDING SITE II or BINDING SITE III. Table 2 illustrates the complementarity of the nucleotide sequences of PSR BINDING SITE, designated SEQ ID:32501, to the nucleotide sequence of VGAM2494 RNA, herein designated VGAM RNA, also designated SEQ ID:5205.

Another function of VGAM2494 is therefore inhibition of PSR (Accession XM_036784). Accordingly, utilities of VGAM2494 include diagnosis, prevention and treatment of diseases and clinical conditions associated with PSR. LOC134689 (Accession XM_068963) is another VGAM2494 host target gene. LOC134689 BINDING SITE is HOST TARGET binding site found in the 5' untranslated region of mRNA encoded by LOC134689, corresponding to a HOST TARGET binding site such as BINDING SITE I, BINDING SITE II or BINDING SITE III. Table 2 illustrates the complementarity of the nucleotide sequences of LOC134689 BINDING SITE, designated SEQ ID:37383, to the nucleotide sequence of VGAM2494 RNA, herein designated VGAM RNA, also designated SEQ ID:5205.

Another function of VGAM2494 is therefore inhibition of LOC134689 (Accession XM_068963). Accordingly, utilities of VGAM2494 include diagnosis, prevention and treatment of diseases and clinical conditions associated with LOC134689. LOC151507 (Accession XM_087225) is another VGAM2494 host target gene. LOC151507 BINDING SITE is HOST TARGET binding site found in the 3' untranslated region of mRNA encoded by LOC151507, corresponding to a HOST TARGET binding site such as BINDING SITE I, BINDING SITE II or BINDING SITE III. Table 2 illustrates the complementarity of the nucleotide sequences of LOC151507 BINDING SITE, designated SEQ ID:39126, to the nucleotide sequence of VGAM2494 RNA, herein designated VGAM RNA, also designated SEQ ID:5205.

Another function of VGAM2494 is therefore inhibition of LOC151507 (Accession XM_087225). Accordingly, utilities of VGAM2494 include diagnosis, prevention and treatment of diseases and clinical conditions associated with LOC151507. LOC164295 (Accession XM_092767) is another VGAM2494 host target gene. LOC164295 BINDING SITE is HOST TARGET binding site found in the 5' untranslated region of mRNA encoded by LOC164295, corresponding to a HOST TARGET binding site such as BINDING SITE I, BINDING SITE II or BINDING SITE III. Table 2 illustrates the complementarity of the nucleotide sequences of LOC164295 BINDING SITE, designated SEQ ID:40142, to the nucleotide sequence of VGAM2494 RNA, herein designated VGAM RNA, also designated SEQ ID:5205.

Another function of VGAM2494 is therefore inhibition of LOC164295 (Accession XM_092767). Accordingly, utilities of VGAM2494 include diagnosis, prevention and treatment of diseases and clinical conditions associated with LOC164295. LOC219513 (Accession XM_169166) is another VGAM2494 host target gene. LOC219513 BINDING SITE is HOST TARGET binding site found in the 3' untranslated region of mRNA encoded by LOC219513, corresponding to a HOST TARGET binding site such as BINDING SITE I, BINDING SITE II or BINDING SITE III. Table 2 illustrates the complementarity of the nucleotide sequences of LOC219513 BINDING SITE, designated SEQ ID:45295, to the nucleotide sequence of VGAM2494 RNA, herein designated VGAM RNA, also designated SEQ ID:5205.

Another function of VGAM2494 is therefore inhibition of LOC219513 (Accession XM_169166). Accordingly, utilities of VGAM2494 include diagnosis, prevention and treatment of diseases and clinical conditions associated with LOC219513. LOC253737 (Accession XM_171409) is another VGAM2494 host target gene. LOC253737 BINDING SITE is HOST TARGET binding site found in the 5' untranslated region of mRNA encoded by LOC253737, corresponding to a HOST TARGET binding site such as BINDING SITE I, BINDING SITE II or BINDING SITE III. Table 2 illustrates the complementarity of the nucleotide sequences of LOC253737 BINDING SITE, designated SEQ ID:46046, to the nucleotide sequence of VGAM2494 RNA, herein designated VGAM RNA, also designated SEQ ID:5205.

Another function of VGAM2494 is therefore inhibition of LOC253737 (Accession XM_171409). Accordingly, utilities of VGAM2494 include diagnosis, prevention and treatment of diseases and clinical conditions associated with LOC253737. LOC51631 (Accession XM_042779) is another VGAM2494 host target gene. LOC51631 BINDING SITE is HOST TARGET binding site found in the 3' untranslated region of mRNA encoded by LOC51631, corresponding to a HOST TARGET binding site such as BINDING SITE I, BINDING SITE II or BINDING SITE III. Table 2 illustrates the complementarity of the nucleotide sequences of LOC51631 BINDING SITE, designated SEQ ID:33768, to the nucleotide sequence of VGAM2494 RNA, herein designated VGAM RNA, also designated SEQ ID:5205.

Another function of VGAM2494 is therefore inhibition of LOC51631 (Accession XM_042779). Accordingly, utilities of VGAM2494 include diagnosis, prevention and treatment of diseases and clinical conditions associated with LOC51631. LOC58509 (Accession XM_114002) is another VGAM2494 host target gene. LOC58509 BINDING SITE is HOST TARGET binding site found in the 5' untranslated region of mRNA encoded by LOC58509, corresponding to a HOST TARGET binding site such as BINDING SITE I, BINDING SITE II or BINDING SITE III. Table 2 illustrates the complementarity of the nucleotide sequences of LOC58509 BINDING SITE, designated SEQ ID:42613, to the nucleotide sequence of VGAM2494 RNA, herein designated VGAM RNA, also designated SEQ ID:5205.

Another function of VGAM2494 is therefore inhibition of LOC58509 (Accession XM_114002). Accordingly, utilities of VGAM2494 include diagnosis, prevention and treatment of diseases and clinical conditions associated with LOC58509. LOC93070 (Accession XM_049046) is another VGAM2494 host target gene. LOC93070 BINDING SITE is HOST TARGET binding site found in the 5' untranslated region of mRNA encoded by LOC93070, corresponding to a HOST TARGET binding site such as BINDING SITE I, BINDING SITE II or BINDING SITE III. Table 2 illustrates the complementarity of the nucleotide sequences of LOC93070 BINDING SITE, designated SEQ ID:35325, to the nucleotide sequence of VGAM2494 RNA, herein designated VGAM RNA, also designated SEQ ID:5205.

Another function of VGAM2494 is therefore inhibition of LOC93070 (Accession XM_049046). Accordingly, utilities of VGAM2494 include diagnosis, prevention and treatment of diseases and clinical conditions associated with LOC93070. FIG. 1 further provides a conceptual description of a novel bioinformatically detected viral gene of the present invention, referred to here as Viral Genomic Address Messenger 2495 (VGAM2495) viral gene, which modulates expression of respective host target genes thereof, the function and utility of which host target genes is known in the art.

VGAM2495 is a novel bioinformatically detected regulatory, non protein coding, viral micro RNA (miRNA) gene. The method by which VGAM2495 was detected is described hereinabove with reference to FIGS. 1-8.

VGAM2495 gene, herein designated VGAM GENE, is a viral gene contained in the genome of Mouse Cytomegalovirus 1. VGAM2495 host target gene, herein designated VGAM HOST TARGET GENE, is a human gene contained in the human genome.

VGAM2495 gene encodes a VGAM2495 precursor RNA, herein designated VGAM PRECURSOR RNA. Similar to other miRNA genes, and unlike most ordinary genes, VGAM2495 precursor RNA does not encode a protein. A nucleotide sequence identical or highly similar to the nucleotide sequence of VGAM2495 precursor RNA is designated SEQ ID:2481, and is provided hereinbelow with reference to the sequence listing part. Nucleotide sequence SEQ ID:2481 is located at position 106389 relative to the genome of Mouse Cytomegalovirus 1.

VGAM2495 precursor RNA folds onto itself, forming VGAM2495 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2495 folded precursor RNA into VGAM2495 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2495 RNA is designated SEQ ID:5206, and is provided hereinbelow with reference to the sequence listing part.

VGAM2495 host target gene, herein designated VGAM HOST TARGET GENE, encodes a corresponding messenger RNA, VGAM2495 host target RNA, herein designated VGAM HOST TARGET RNA. VGAM2495 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2495 RNA, herein designated VGAM RNA, binds complementarily to one or more host target binding sites located in untranslated regions of VGAM2495 host target RNA, herein designated VGAM HOST TARGET RNA. This complementary binding is due to the fact that the nucleotide sequence of VGAM2495 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2495 RNA, herein designated VGAM RNA, may have a different number of host target binding sites in untranslated regions of a VGAM2495 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2495 RNA, herein designated VGAM RNA, to host target binding sites on VGAM2495 host target RNA, herein designated VGAM HOST TARGET RNA, such as BINDING SITE I, BINDING SITE II and BINDING SITE III, inhibits translation of VGAM2495 host target RNA into VGAM2495 host target protein, herein designated VGAM HOST TARGET PROTEIN. VGAM host target protein is therefore outlined by a broken line.

It is appreciated that VGAM2495 host target gene, herein designated VGAM HOST TARGET GENE, in fact represents a plurality of VGAM2495 host target genes. The mRNA of each one of this plurality of VGAM2495 host target genes comprises one or more host target binding sites, each having a nucleotide sequence which is at least partly complementary to VGAM2495 RNA, herein designated VGAM RNA, and which when bound by VGAM2495 RNA causes inhibition of translation of respective one or more VGAM2495 host target proteins.

It is further appreciated by one skilled in the art that the mode of translational inhibition illustrated by FIG. 1 with specific reference to translational inhibition exerted by VGAM2495 gene, herein designated VGAM GENE, on one or more VGAM2495 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2495 is inhibition of expression of host target genes, as part of a novel viral mechanism of attacking a host. Accordingly, utilities of VGAM2495 include diagnosis, prevention and treatment of viral infection by Mouse Cytomegalovirus 1. Specific functions, and accordingly utilities, of VGAM2495 correlate with, and may be deduced from, the identity of the host target genes which VGAM2495 binds and inhibits, and the function of these host target genes, as elaborated hereinbelow.

Nucleotide sequences of the VGAM2495 precursor RNA, herein designated VGAM PRECURSOR RNA, and of the 'diced' VGAM2495 RNA, herein designated VGAM RNA, and a schematic representation of the secondary folding of VGAM2495 folded precursor RNA, herein designated VGAM FOLDED PRECURSOR RNA, of VGAM2495 are further described hereinbelow with reference to Table 1.

Nucleotide sequences of host target binding sites, such as BINDING SITE-I, BINDING SITE-II and BINDING SITE-III of FIG. 1, found on VGAM2495 host target RNA, and schematic representation of the complementarity of each of these host target binding sites to VGAM2495 RNA, herein designated VGAM RNA, are described hereinbelow with reference to Table 2.

As mentioned hereinabove with reference to FIG. 1, a function of VGAM2495 gene, herein designated VGAM is inhibition of expression of VGAM2495 target genes. It is appreciated that specific functions, and accordingly utilities, of VGAM2495 correlate with, and may be deduced from, the identity of the target genes which VGAM2495 binds and inhibits, and the function of these target genes, as elaborated hereinbelow.

HRIHFB2436 (Accession NM_014345) is a VGAM2495 host target gene. HRIHFB2436 BINDING SITE is HOST TARGET binding site found in the 5' untranslated region of mRNA encoded by HRIHFB2436, corresponding to a HOST TARGET binding site such as BINDING SITE I, BINDING SITE II or BINDING SITE III. Table 2 illustrates the complementarity of the nucleotide sequences of HRIHFB2436 BINDING SITE, designated SEQ ID:15665, to the nucleotide sequence of VGAM2495 RNA, herein designated VGAM RNA, also designated SEQ ID:5206.

A function of VGAM2495 is therefore inhibition of HRIHFB2436 (Accession NM_014345). Accordingly, utilities of VGAM2495 include diagnosis, prevention and treatment of diseases and clinical conditions associated with HRIHFB2436. MGC12921 (Accession XM_033362) is another VGAM2495 host target gene. MGC12921 BINDING SITE is HOST TARGET binding site found in the 3' untranslated region of mRNA encoded by MGC12921, corresponding to a HOST TARGET binding site such as BINDING SITE I, BINDING SITE II or BINDING SITE III. Table 2 illustrates the complementarity of the nucleotide sequences of MGC12921 BINDING SITE, designated SEQ ID:31899, to the nucleotide sequence of VGAM2495 RNA, herein designated VGAM RNA, also designated SEQ ID:5206.

Another function of VGAM2495 is therefore inhibition of MGC12921 (Accession XM_033362). Accordingly, utilities of VGAM2495 include diagnosis, prevention and treatment of diseases and clinical conditions associated with MGC12921. LOC153579 (Accession XM_087714) is another VGAM2495 host target gene. LOC153579 BINDING SITE is HOST TARGET binding site found in the 3' untranslated region of mRNA encoded by LOC153579, corresponding to a HOST TARGET binding site such as BINDING SITE I, BINDING SITE II or BINDING SITE III. Table 2 illustrates the complementarity of the nucleotide sequences of LOC153579 BINDING SITE, designated SEQ ID:39405, to the nucleotide sequence of VGAM2495 RNA, herein designated VGAM RNA, also designated SEQ ID:5206.

Another function of VGAM2495 is therefore inhibition of LOC153579 (Accession XM_087714). Accordingly, utilities of VGAM2495 include diagnosis, prevention and treatment of diseases and clinical conditions associated with LOC153579. FIG. 1 further provides a conceptual description of a novel bioinformatically detected viral gene of the present invention, referred to here as Viral Genomic Address Messenger 2496 (VGAM2496) viral gene, which modulates expression of respective host target genes thereof, the function and utility of which host target genes is known in the art.

VGAM2496 is a novel bioinformatically detected regulatory, non protein coding, viral micro RNA (miRNA) gene. The method by which VGAM2496 was detected is described hereinabove with reference to FIGS. 1-8.

VGAM2496 gene, herein designated VGAM GENE, is a viral gene contained in the genome of Mouse Cytomegalovirus 1. VGAM2496 host target gene, herein designated VGAM HOST TARGET GENE, is a human gene contained in the human genome.

VGAM2496 gene encodes a VGAM2496 precursor RNA, herein designated VGAM PRECURSOR RNA. Similar to other miRNA genes, and unlike most ordinary genes, VGAM2496 precursor RNA does not encode a protein. A nucleotide sequence identical or highly similar to the nucleotide sequence of VGAM2496 precursor RNA is designated SEQ ID:2482, and is provided hereinbelow with reference to the sequence listing part. Nucleotide sequence SEQ ID:2482 is located at position 186483 relative to the genome of Mouse Cytomegalovirus 1.

VGAM2496 precursor RNA folds onto itself, forming VGAM2496 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2496 folded precursor RNA into VGAM2496 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2496 RNA is designated SEQ ID:5207, and is provided hereinbelow with reference to the sequence listing part.

VGAM2496 host target gene, herein designated VGAM HOST TARGET GENE, encodes a corresponding messenger RNA, VGAM2496 host target RNA, herein designated VGAM HOST TARGET RNA. VGAM2496 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2496 RNA, herein designated VGAM RNA, binds complementarily to one or more host target binding sites located in untranslated regions of VGAM2496 host target RNA, herein designated VGAM HOST TARGET RNA. This complementary binding is due to the fact that the nucleotide sequence of VGAM2496 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2496 RNA, herein designated VGAM RNA, may have a different number of host target binding sites in untranslated regions of a VGAM2496 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2496 RNA, herein designated VGAM RNA, to host target binding sites on VGAM2496 host target RNA, herein designated VGAM HOST TARGET RNA, such as BINDING SITE I, BINDING SITE II and BINDING SITE III, inhibits translation of VGAM2496 host target RNA into VGAM2496 host target protein, herein designated VGAM HOST TARGET PROTEIN. VGAM host target protein is therefore outlined by a broken line.

It is appreciated that VGAM2496 host target gene, herein designated VGAM HOST TARGET GENE, in fact represents a plurality of VGAM2496 host target genes. The mRNA of each one of this plurality of VGAM2496 host target genes comprises one or more host target binding sites, each having a nucleotide sequence which is at least partly complementary to VGAM2496 RNA, herein designated VGAM RNA, and which when bound by VGAM2496 RNA causes inhibition of translation of respective one or more VGAM2496 host target proteins.

It is further appreciated by one skilled in the art that the mode of translational inhibition illustrated by FIG. 1 with specific reference to translational inhibition exerted by VGAM2496 gene, herein designated VGAM GENE, on one or more VGAM2496 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2496 is inhibition of expression of host target genes, as part of a novel viral mechanism of attacking a host. Accordingly, utilities of VGAM2496 include diagnosis, prevention and treatment of viral infection by Mouse Cytomegalovirus 1. Specific functions, and accordingly utilities, of VGAM2496 correlate with, and may be deduced from, the identity of the host target genes which VGAM2496 binds and inhibits, and the function of these host target genes, as elaborated hereinbelow.

Nucleotide sequences of the VGAM2496 precursor RNA, herein designated VGAM PRECURSOR RNA, and of the 'diced' VGAM2496 RNA, herein designated VGAM RNA, and a schematic representation of the secondary folding of VGAM2496 folded precursor RNA, herein designated VGAM FOLDED PRECURSOR RNA, of VGAM2496 are further described hereinbelow with reference to Table 1.

Nucleotide sequences of host target binding sites, such as BINDING SITE-I, BINDING SITE-II and BINDING SITE-III of FIG. 1, found on VGAM2496 host target RNA, and schematic representation of the complementarity of each of these host target binding sites to VGAM2496 RNA, herein designated VGAM RNA, are described hereinbelow with reference to Table 2.

As mentioned hereinabove with reference to FIG. 1, a function of VGAM2496 gene, herein designated VGAM is inhibition of expression of VGAM2496 target genes. It is appreciated that specific functions, and accordingly utilities, of VGAM2496 correlate with, and may be deduced from, the identity of the target genes which VGAM2496 binds and inhibits, and the function of these target genes, as elaborated hereinbelow.

Podocalyxin-like (PODXL, Accession NM_005397) is a VGAM2496 host target gene. PODXL BINDING SITE is HOST TARGET binding site found in the 3" untranslated region of mRNA encoded by PODXL, corresponding to a HOST TARGET binding site such as BINDING SITE I, BINDING SITE II or BINDING SITE III. Table 2 illustrates the complementarity of the nucleotide sequences of PODXL BINDING SITE, designated SEQ ID:11874, to the nucleotide sequence of VGAM2496 RNA, herein designated VGAM RNA, also designated SEQ ID:5207.

A function of VGAM2496 is therefore inhibition of Podocalyxin-like (PODXL, Accession NM_005397), a gene which is an antiadhesin. Accordingly, utilities of VGAM2496 include diagnosis, prevention and treatment of diseases and clinical conditions associated with PODXL. The function of PODXL and its association with various diseases and clinical conditions, has been established by previous studies, as described hereinabove with reference to VGAM247. Artemin (ARTN, Accession NM_003976) is another VGAM2496 host target gene. ARTN BINDING SITE is HOST TARGET binding site found in the 5' untranslated region of mRNA encoded by ARTN, corresponding to a HOST TARGET binding site such as BINDING SITE I, BINDING SITE II or BINDING SITE III. Table 2 illustrates the complementarity of the nucleotide sequences of ARTN BINDING SITE, designated SEQ ID:10110, to the nucleotide sequence of VGAM2496 RNA, herein designated VGAM RNA, also designated SEQ ID:5207.

Another function of VGAM2496 is therefore inhibition of Artemin (ARTN, Accession NM_003976). Accordingly, utilities of VGAM2496 include diagnosis, prevention and treatment of diseases and clinical conditions associated with ARTN. FLJ23191 (Accession NM_024574) is another VGAM2496 host target gene. FLJ23191 BINDING SITE is HOST TARGET binding site found in the 5' untranslated region of mRNA encoded by FLJ23191, corresponding to a HOST TARGET binding site such as BINDING SITE I, BINDING SITE II or BINDING SITE III. Table 2 illustrates the complementarity of the nucleotide sequences of FLJ23191 BINDING SITE, designated SEQ ID:23804, to the nucleotide sequence of VGAM2496 RNA, herein designated VGAM RNA, also designated SEQ ID:5207.

Another function of VGAM2496 is therefore inhibition of FLJ23191 (Accession NM_024574). Accordingly, utilities of VGAM2496 include diagnosis, prevention and treatment of diseases and clinical conditions associated with FLJ23191. FLJ23323 (Accession NM_024654) is another VGAM2496 host target gene. FLJ23323 BINDING SITE is HOST TARGET binding site found in the 3' untranslated region of mRNA encoded by FLJ23323, corresponding to a HOST TARGET binding site such as BINDING SITE I, BINDING SITE II or BINDING SITE III. Table 2 illustrates the complementarity of the nucleotide sequences of FLJ23323 BINDING SITE, designated SEQ ID:23955, to the nucleotide sequence of VGAM2496 RNA, herein designated VGAM RNA, also designated SEQ ID:5207.

Another function of VGAM2496 is therefore inhibition of FLJ23323 (Accession NM_024654). Accordingly, utilities of VGAM2496 include diagnosis, prevention and treatment of diseases and clinical conditions associated with FLJ23323. Neuron Navigator 3 (NAV3, Accession NM_014903) is another VGAM2496 host target gene. NAV3 BINDING SITE is HOST TARGET binding site found in the 3' untranslated region of mRNA encoded by NAV3, corresponding to a HOST TARGET binding site such as BINDING SITE I, BINDING SITE II or BINDING SITE III. Table 2 illustrates the complementarity of the nucleotide sequences of NAV3 BINDING SITE, designated SEQ ID:17091, to the nucleotide sequence of VGAM2496 RNA, herein designated VGAM RNA, also designated SEQ ID:5207.

Another function of VGAM2496 is therefore inhibition of Neuron Navigator 3 (NAV3, Accession NM_014903). Accordingly, utilities of VGAM2496 include diagnosis, prevention and treatment of diseases and clinical conditions associated with NAV3. FIG. 1 further provides a conceptual description of a novel bioinformatically detected viral gene of the present invention, referred to here as Viral Genomic Address Messenger 2497 (VGAM2497) viral gene, which modulates expression of respective host target genes thereof, the function and utility of which host target genes is known in the art.

VGAM2497 is a novel bioinformatically detected regulatory, non protein coding, viral micro RNA (miRNA) gene. The method by which VGAM2497 was detected is described hereinabove with reference to FIGS. 1-8.

VGAM2497 gene, herein designated VGAM GENE, is a viral gene contained in the genome of Mouse Cytomegalovirus 1. VGAM2497 host target gene, herein designated VGAM HOST TARGET GENE, is a human gene contained in the human genome.

VGAM2497 gene encodes a VGAM2497 precursor RNA, herein designated VGAM PRECURSOR RNA. Similar to other miRNA genes, and unlike most ordinary genes, VGAM2497 precursor RNA does not encode a protein. A nucleotide sequence identical or highly similar to the nucleotide sequence of VGAM2497 precursor RNA is designated SEQ ID:2483, and is provided hereinbelow with reference to the sequence listing part. Nucleotide sequence SEQ ID:2483 is located at position 212016 relative to the genome of Mouse Cytomegalovirus 1.

VGAM2497 precursor RNA folds onto itself, forming VGAM2497 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2497 folded precursor RNA into VGAM2497 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2497 RNA is designated SEQ ID:5208, and is provided hereinbelow with reference to the sequence listing part.

VGAM2497 host target gene, herein designated VGAM HOST TARGET GENE, encodes a corresponding messenger RNA, VGAM2497 host target RNA, herein designated VGAM HOST TARGET RNA. VGAM2497 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2497 RNA, herein designated VGAM RNA, binds complementarily to one or more host target binding sites located in untranslated regions of VGAM2497 host target RNA, herein designated VGAM HOST TARGET RNA. This complementary binding is due to the fact that the nucleotide sequence of VGAM2497 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2497 RNA, herein designated VGAM RNA, may have a different number of host target binding sites in untranslated regions of a VGAM2497 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2497 RNA, herein designated VGAM RNA, to host target binding sites on VGAM2497 host target RNA, herein designated VGAM HOST TARGET RNA, such as BINDING SITE I, BINDING SITE II and BINDING SITE III, inhibits translation of VGAM2497 host target RNA into VGAM2497 host target protein, herein designated VGAM HOST TARGET PROTEIN. VGAM host target protein is therefore outlined by a broken line.

It is appreciated that VGAM2497 host target gene, herein designated VGAM HOST TARGET GENE, in fact represents a plurality of VGAM2497 host target genes. The mRNA of each one of this plurality of VGAM2497 host target genes comprises one or more host target binding sites, each having a nucleotide sequence which is at least partly complementary to VGAM2497 RNA, herein designated VGAM RNA, and which when bound by VGAM2497 RNA causes inhibition of translation of respective one or more VGAM2497 host target proteins.

It is further appreciated by one skilled in the art that the mode of translational inhibition illustrated by FIG. 1 with specific reference to translational inhibition exerted by VGAM2497 gene, herein designated VGAM GENE, on one or more VGAM2497 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2497 is inhibition of expression of host target genes, as part of a novel viral mechanism of attacking a host. Accordingly, utilities of VGAM2497 include diagnosis, prevention and treatment of viral infection by Mouse Cytomegalovirus 1. Specific functions, and accordingly utilities, of VGAM2497 correlate with, and may be deduced from, the identity of the host target genes which VGAM2497 binds and inhibits, and the function of these host target genes, as elaborated hereinbelow.

Nucleotide sequences of the VGAM2497 precursor RNA, herein designated VGAM PRECURSOR RNA, and of the 'diced' VGAM2497 RNA, herein designated VGAM RNA, and a schematic representation of the secondary folding of VGAM2497 folded precursor RNA, herein designated VGAM FOLDED PRECURSOR RNA, of VGAM2497 are further described hereinbelow with reference to Table 1.

Nucleotide sequences of host target binding sites, such as BINDING SITE-I, BINDING SITE-II and BINDING SITE-III of FIG. 1, found on VGAM2497 host target RNA, and schematic representation of the complementarity of each of these host target binding sites to VGAM2497 RNA, herein designated VGAM RNA, are described hereinbelow with reference to Table 2.

As mentioned hereinabove with reference to FIG. 1, a function of VGAM2497 gene, herein designated VGAM is inhibition of expression of VGAM2497 target genes. It is appreciated that specific functions, and accordingly utilities, of VGAM2497 correlate with, and may be deduced from, the identity of the target genes which VGAM2497 binds and inhibits, and the function of these target genes, as elaborated hereinbelow.

Fanconi Anemia, Complementation Group A (FANCA, Accession NM_000135) is a VGAM2497 host target gene. FANCA BINDING SITE is HOST TARGET binding site found in the 3' untranslated region of mRNA encoded by FANCA, corresponding to a HOST TARGET binding site such as BINDING SITE I, BINDING SITE II or BINDING SITE III. Table 2 illustrates the complementarity of the nucleotide sequences of FANCA BINDING SITE, designated SEQ ID:5629, to the nucleotide sequence of VGAM2497 RNA, herein designated VGAM RNA, also designated SEQ ID:5208.

A function of VGAM2497 is therefore inhibition of Fanconi Anemia, Complementation Group A (FANCA, Accession NM_000135). Accordingly, utilities of VGAM2497 include diagnosis, prevention and treatment of diseases and clinical conditions associated with FANCA. Myelin Basic Protein (MBP, Accession XM_117096) is another VGAM2497 host target gene. MBP BINDING SITE is HOST TARGET binding site found in the 5' untranslated region of mRNA encoded by MBP, corresponding to a HOST TARGET binding site such as BINDING SITE I, BINDING SITE II or BINDING SITE III. Table 2 illustrates the complementarity of the nucleotide sequences of MBP BINDING SITE, designated SEQ ID:43222, to the nucleotide sequence of VGAM2497 RNA, herein designated VGAM RNA, also designated SEQ ID:5208.

Another function of VGAM2497 is therefore inhibition of Myelin Basic Protein (MBP, Accession XM_117096), a gene which Myelin basic protein; a constituent of myelin, plays a role in nerve function. Accordingly, utilities of VGAM2497 include diagnosis, prevention and treatment of diseases and clinical conditions associated with MBP. The function of MBP and its association with various diseases and clinical conditions, has been established by previous studies, as described hereinabove with reference to VGAM1959. Myosin ID (MYO1D, Accession XM_050041) is another VGAM2497 host target gene. MYO1D BINDING SITE is HOST TARGET binding site found in the 5' untranslated region of mRNA encoded by MYO1D, corresponding to a HOST TARGET binding site such as BINDING SITE I, BINDING SITE II or BINDING SITE III. Table 2 illustrates the complementarity of the nucleotide sequences of MYO1D BINDING SITE, designated SEQ ID:35549, to the nucleotide sequence of VGAM2497 RNA, herein designated VGAM RNA, also designated SEQ ID:5208.

Another function of VGAM2497 is therefore inhibition of Myosin ID (MYO1D, Accession XM_050041), a gene which is an unconventional myosin. Accordingly, utilities of VGAM2497 include diagnosis, prevention and treatment of diseases and clinical conditions associated with MYO1D. The function of MYO1D and its association with various diseases and clinical conditions, has been established by previous studies, as described hereinabove with reference to VGAM126. MGC2817 (Accession XM_046613) is another VGAM2497 host target gene. MGC2817 BINDING SITE is HOST TARGET binding site found in the 5' untranslated region of mRNA encoded by MGC2817, corresponding to a HOST TARGET binding site such as BINDING SITE I, BINDING SITE II or BINDING SITE III. Table 2 illustrates the complementarity of the nucleotide sequences of MGC2817 BINDING SITE, designated SEQ ID:34764, to the nucleotide sequence of VGAM2497 RNA, herein designated VGAM RNA, also designated SEQ ID:5208.

Another function of VGAM2497 is therefore inhibition of MGC2817 (Accession XM_046613). Accordingly, utilities of VGAM2497 include diagnosis, prevention and treatment of diseases and clinical conditions associated with MGC2817. SEC24 Related Gene Family, Member D (S. cerevisiae) (SEC24D, Accession NM_014822) is another VGAM2497 host target gene. SEC24D BINDING SITE is HOST TARGET binding site found in the 5' untranslated region of mRNA encoded by SEC24D, corresponding to a HOST TARGET binding site such as BINDING SITE I, BINDING SITE II or BINDING SITE III. Table 2 illustrates the complementarity of the nucleotide sequences of SEC24D BINDING SITE, designated SEQ ID:16799, to the nucleotide sequence of VGAM2497 RNA, herein designated VGAM RNA, also designated SEQ ID:5208.

Another function of VGAM2497 is therefore inhibition of SEC24 Related Gene Family, Member D (S. cerevisiae) (SEC24D, Accession NM_014822) is another VGAM2497 include diagnosis, prevention and treatment of diseases and clinical conditions associated with SEC24D. Ubiquitin Specific Protease 2 (USP2, Accession NM_004205) is another VGAM2497 host target gene. USP2 BINDING SITE is HOST TARGET binding site found in the 5' untranslated region of mRNA encoded by USP2, corresponding to a HOST TARGET binding site such as BINDING SITE I, BINDING SITE II or BINDING SITE III. Table 2 illustrates the complementarity of the nucleotide sequences of USP2 BINDING SITE, designated SEQ ID:10402, to the nucleotide sequence of VGAM2497 RNA, herein designated VGAM RNA, also designated SEQ ID:5208.

Another function of VGAM2497 is therefore inhibition of Ubiquitin Specific Protease 2 (USP2, Accession NM_004205). Accordingly, utilities of VGAM2497 include diagnosis, prevention and treatment of diseases and clinical conditions associated with USP2. XPO5 (Accession XM_166042) is another VGAM2497 host target gene. XPO5 BINDING SITE is HOST TARGET binding site found in the 5' untranslated region of mRNA encoded by XPO5, corresponding to a HOST TARGET binding site such as BINDING SITE I, BINDING SITE II or BINDING SITE III. Table 2 illustrates the complementarity of the nucleotide sequences of XPO5 BINDING SITE, designated SEQ ID:43841, to the nucleotide sequence of VGAM2497 RNA, herein designated VGAM RNA, also designated SEQ ID:5208.

Another function of VGAM2497 is therefore inhibition of XPO5 (Accession XM_166042). Accordingly, utilities of VGAM2497 include diagnosis, prevention and treatment of diseases and clinical conditions associated with XPO5. LOC153603 (Accession XM_087715) is another VGAM2497 host target gene. LOC153603 BINDING SITE is HOST TARGET binding site found in the 5' untranslated region of mRNA encoded by LOC153603, corresponding to a HOST TARGET binding site such as BINDING SITE I, BINDING SITE II or BINDING SITE III. Table 2 illustrates the complementarity of the nucleotide sequences of LOC153603 BINDING SITE, designated SEQ ID:39406, to the nucleotide sequence of VGAM2497 RNA, herein designated VGAM RNA, also designated SEQ ID:5208.

Another function of VGAM2497 is therefore inhibition of LOC153603 (Accession XM_087715). Accordingly, utilities of VGAM2497 include diagnosis, prevention and treatment of diseases and clinical conditions associated with LOC153603. LOC164714 (Accession XM_104657) is another VGAM2497 host target gene. LOC164714 BINDING SITE is HOST TARGET binding site found in the 3' untranslated region of mRNA encoded by LOC164714, corresponding to a HOST TARGET binding site such as BINDING SITE I, BINDING SITE II or BINDING SITE III. Table 2 illustrates the complementarity of the nucleotide sequences of LOC164714 BINDING SITE, designated SEQ ID:42178, to the nucleotide sequence of VGAM2497 RNA, herein designated VGAM RNA, also designated SEQ ID:5208.

Another function of VGAM2497 is therefore inhibition of LOC164714 (Accession XM_104657). Accordingly, utilities of VGAM2497 include diagnosis, prevention and treatment of diseases and clinical conditions associated with LOC164714. FIG. 1 further provides a conceptual description of a novel bioinformatically detected viral gene of the present invention, referred to here as Viral Genomic Address Messenger 2498 (VGAM2498) viral gene, which modulates expression of respective host target genes thereof, the function and utility of which host target genes is known in the art.

VGAM2498 is a novel bioinformatically detected regulatory, non protein coding, viral micro RNA (miRNA) gene. The method by which VGAM2498 was detected is described hereinabove with reference to FIGS. 1-8.

VGAM2498 gene, herein designated VGAM GENE, is a viral gene contained in the genome of Mouse Cytomegalovirus 1. VGAM2498 host target gene, herein designated VGAM HOST TARGET GENE, is a human gene contained in the human genome.

VGAM2498 gene encodes a VGAM2498 precursor RNA, herein designated VGAM PRECURSOR RNA. Similar to other miRNA genes, and unlike most ordinary genes, VGAM2498 precursor RNA does not encode a protein. A nucleotide sequence identical or highly similar to the nucleotide sequence of VGAM2498 precursor RNA is designated SEQ ID:2484, and is provided hereinbelow with reference to the sequence listing part. Nucleotide sequence SEQ ID:2484 is located at position 211848 relative to the genome of Mouse Cytomegalovirus 1.

VGAM2498 precursor RNA folds onto itself, forming VGAM2498 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2498 folded precursor RNA into VGAM2498 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM2498 RNA is designated SEQ ID:5209, and is provided hereinbelow with reference to the sequence listing part.

VGAM2498 host target gene, herein designated VGAM HOST TARGET GENE, encodes a corresponding messenger RNA, VGAM2498 host target RNA, herein designated VGAM HOST TARGET RNA. VGAM2498 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2498 RNA, herein designated VGAM RNA, binds complementarily to one or more host target binding sites located in untranslated regions of VGAM2498 host target RNA, herein designated VGAM HOST TARGET RNA. This complementary binding is due to the fact that the nucleotide sequence of VGAM2498 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2498 RNA, herein designated VGAM RNA, may have a different number of host target binding sites in untranslated regions of a VGAM2498 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2498 RNA, herein designated VGAM RNA, to host target binding sites on VGAM2498 host target RNA, herein designated VGAM HOST TARGET RNA, such as BINDING SITE I, BINDING SITE II and BINDING SITE III, inhibits translation of VGAM2498 host target RNA into VGAM2498 host target protein, herein designated VGAM HOST TARGET PROTEIN. VGAM host target protein is therefore outlined by a broken line.

It is appreciated that VGAM2498 host target gene, herein designated VGAM HOST TARGET GENE, in fact represents a plurality of VGAM2498 host target genes. The mRNA of each one of this plurality of VGAM2498 host target genes comprises one or more host target binding sites, each having a nucleotide sequence which is at least partly complementary to VGAM2498 RNA, herein designated VGAM RNA, and which when bound by VGAM2498 RNA causes inhibition of translation of respective one or more VGAM2498 host target proteins.

It is further appreciated by one skilled in the art that the mode of translational inhibition illustrated by FIG. 1 with specific reference to translational inhibition exerted by VGAM2498 gene, herein designated VGAM GENE, on one or more VGAM2498 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2498 is inhibition of expression of host target genes, as part of a novel viral mechanism of attacking a host. Accordingly, utilities of VGAM2498 include diagnosis, prevention and treatment of viral infection by Mouse Cytomegalovirus 1. Specific functions, and accordingly utilities, of VGAM2498 correlate with, and may be deduced from, the identity of the host target genes which VGAM2498 binds and inhibits, and the function of these host target genes, as elaborated hereinbelow.

Nucleotide sequences of the VGAM2498 precursor RNA, herein designated VGAM PRECURSOR RNA, and of the 'diced' VGAM2498 RNA, herein designated VGAM RNA, and a schematic representation of the secondary folding of VGAM2498 folded precursor RNA, herein designated VGAM FOLDED PRECURSOR RNA, of VGAM2498 are further described hereinbelow with reference to Table 1.

Nucleotide sequences of host target binding sites, such as BINDING SITE-I, BINDING SITE-II and BINDING SITE-III of FIG. 1, found on VGAM2498 host target RNA, and schematic representation of the complementarity of each of these host target binding sites to VGAM2498 RNA, herein designated VGAM RNA, are described hereinbelow with reference to Table 2.

As mentioned hereinabove with reference to FIG. 1, a function of VGAM2498 gene, herein designated VGAM is inhibition of expression of VGAM2498 target genes. It is appreciated that specific functions, and accordingly utilities, of VGAM2498 correlate with, and may be deduced from, the identity of the target genes which VGAM2498 binds and inhibits, and the function of these target genes, as elaborated hereinbelow.

Cas-Br-M (murine) Ecotropic Retroviral Transforming Sequence B (CBLB, Accession NM_004351) is a VGAM2498 host target gene. CBLB BINDING SITE is HOST TARGET binding site found in the 3' untranslated region of mRNA encoded by CBLB, corresponding to a HOST TARGET binding site such as BINDING SITE I, BINDING SITE II or BINDING SITE III. Table 2 illustrates the complementarity of the nucleotide sequences of CBLB BINDING SITE, designated SEQ ID:10552, to the nucleotide sequence of VGAM2498 RNA, herein designated VGAM RNA, also designated SEQ ID:5209.

A function of VGAM2498 is therefore inhibition of Cas-Br-M (murine) Ecotropic Retroviral Transforming Sequence B (CBLB, Accession NM_004351), a gene which SH3 binding protein with similarity to human CBL; interacts and regulates signal transduction proteins. Accordingly, utilities of VGAM2498 include diagnosis, prevention and treatment of diseases and clinical conditions associated with CBLB. The function of CBLB and its association with various diseases and clinical conditions, has been established by previous studies, as described hereinabove with reference to VGAM401. Cadherin, EGF LAG Seven-pass G-type Receptor 1 (flamingo homolog, Drosophila) (CELSR1, Accession NM_014246) is another VGAM2498 host target gene. CELSR1 BINDING SITE is HOST TARGET binding site found in the 3' untranslated region of mRNA encoded by CELSR1, corresponding to a HOST TARGET binding site such as BINDING SITE I, BINDING SITE II or BINDING SITE III. Table 2 illustrates the complementarity of the nucleotide sequences of CELSR1 BINDING SITE, designated SEQ ID:15515, to the nucleotide sequence of VGAM2498 RNA, herein designated VGAM RNA, also designated SEQ ID:5209.

Another function of VGAM2498 is therefore inhibition of Cadherin, EGF LAG Seven-pass G-type Receptor 1 (flamingo homolog, Drosophila) (CELSR1, Accession NM_014246), a gene which is involved in contact-mediated communication. Accordingly, utilities of VGAM2498 include diagnosis, prevention and treatment of diseases and clinical conditions associated with CELSR1. The function of CELSR1 and its association with various diseases and clinical conditions, has been established by previous studies, as described hereinabove with reference to VGAM459. Protein Kinase C, Eta (PRKCH, Accession NM_006255) is another VGAM2498 host target gene. PRKCH BINDING SITE is HOST TARGET binding site found in the 5' untranslated region of mRNA encoded by PRKCH, corresponding to a HOST TARGET binding site such as BINDING SITE I, BINDING SITE II or BINDING SITE III. Table 2 illustrates the complementarity of the nucleotide sequences of PRKCH BINDING SITE, designated SEQ ID:12934, to the nucleotide sequence of VGAM2498 RNA, herein designated VGAM RNA, also designated SEQ ID:5209.

Another function of VGAM2498 is therefore inhibition of Protein Kinase C, Eta (PRKCH, Accession NM_006255), a gene which is calcium-independent, phospholipid-dependent, serine- and threonine-specific enzyme. Accordingly, utilities of VGAM2498 include diagnosis, prevention and treatment of diseases and clinical conditions associated with PRKCH. The function of PRKCH has been established by previous studies. Protein kinase C (PKC) is involved in one of the major signal transduction systems, which is activated upon external stimulation of cells by various ligands. For further background information on the PKC family, see PRKCA (OMIM Ref. No. 176960). By screening a human keratinocyte cDNA library using PRKCA fragments as probes, Bacher et al. (1991) isolated a cDNA encoding PRKCH, which they called PKCL. The predicted PRKCH protein contains 680 amino acids and shows highest homology with PRKCE (OMIM Ref. No. 176975). PRKCH has a consensus ATP-binding site, a catalytic kinase domain, and a conserved cysteine-rich domain. Northern blot analysis of rat tissues detected a 4.2-kb transcript at highest levels in lung, with lower levels in heart and skin. The PRKCH transcript was also detected in the human skin carcinoma cell line SCL-1, the human epidermoid carcinoma cell line A431, and in HaCaT human skin keratinocytes. Transfection of COS cells with a PRKCH expression vector determined that this protein has phorbol ester-binding ability and kinase activity. By FISH, Quan and Fisher (1999) mapped the PRKCH gene to 14q22-q23

Full details of the abovementioned studies are described in the following publications, the disclosure of which are hereby incorporated by reference:

Bacher, N.; Zisman, Y.; Berent, E.; Livneh, E.: Isolation and characterization of PKC-L, a new member of the protein kinase C-related gene family specifically expressed in lung, skin, and heart. Molec. Cell. Biol. 11:126-133, 1991; and Quan, T.; Fisher, G. J.: Cloning and characterization of the human protein kinase C-eta promoter. J. Biol. Chem. 274: 28566-28574, 1999.

Further studies establishing the function and utilities of PRKCH are found in John Hopkins OMIM database record ID 605437, and in sited publications numbered 4429-4430 listed in the bibliography section hereinbelow, which are also hereby incorporated by reference. Retinoid X Receptor, Alpha (RXRA, Accession NM_002957) is another VGAM2498 host target gene. RXRA BINDING SITE is HOST TARGET binding site found in the 3' untranslated region of mRNA encoded by RXRA, corresponding to a HOST TARGET binding site such as BINDING SITE I, BINDING SITE II or BINDING SITE III. Table 2 illustrates the complementarity of the nucleotide sequences of RXRA BINDING SITE, designated SEQ ID:8870, to the nucleotide sequence of VGAM2498 RNA, herein designated VGAM RNA, also designated SEQ ID:5209.

Another function of VGAM2498 is therefore inhibition of Retinoid X Receptor, Alpha (RXRA, Accession NM_002957), a gene which activates genes required for vitamin A metabolism, binds 9-cis retinoic acid. Accordingly, utilities of VGAM2498 include diagnosis, prevention and treatment of diseases and clinical conditions associated with RXRA. The function of RXRA and its association with various diseases and clinical conditions, has been established by previous studies, as described hereinabove with reference to VGAM349. A Kinase (PRKA) Anchor Protein (gravin) 12 (AKAP12, Accession NM_144497) is another VGAM2498 host target gene. AKAP12 BINDING SITE is HOST TARGET binding site found in the 5' untranslated region of mRNA encoded by AKAP12, corresponding to a HOST TARGET binding site such as BINDING SITE I, BINDING SITE II or BINDING SITE III. Table 2 illustrates the complementarity of the nucleotide sequences of AKAP12 BINDING SITE, designated SEQ ID:29313, to the nucleotide sequence of VGAM2498 RNA, herein designated VGAM RNA, also designated SEQ ID:5209.

Another function of VGAM2498 is therefore inhibition of A Kinase (PRKA) Anchor Protein (gravin) 12 (AKAP12, Accession NM_144497). Accordingly, utilities of VGAM2498 include diagnosis, prevention and treatment of diseases and clinical conditions associated with AKAP12. KIAA0644 (Accession NM_014817) is another VGAM2498 host target gene. KIAA0644 BINDING SITE is HOST TARGET binding site found in the 3' untranslated region of mRNA encoded by KIAA0644, corresponding to a HOST TARGET binding site such as BINDING SITE I, BINDING SITE II or BINDING SITE III. Table 2 illustrates the complementarity of the nucleotide sequences of KIAA0644 BINDING SITE, designated SEQ ID:16784, to the nucleotide sequence of VGAM2498 RNA, herein designated VGAM RNA, also designated SEQ ID:5209.

Another function of VGAM2498 is therefore inhibition of KIAA0644 (Accession NM_014817). Accordingly, utilities of VGAM2498 include diagnosis, prevention and treatment of diseases and clinical conditions associated with KIAA0644. LOC152345 (Accession XM_087442) is another VGAM2498 host target gene. LOC152345 BINDING SITE is HOST TARGET binding site found in the 3' untranslated region of mRNA encoded by LOC152345, corresponding to a HOST TARGET binding site such as BINDING SITE I, BINDING SITE II or BINDING SITE III. Table 2 illustrates the complementarity of the nucleotide sequences of LOC152345 BINDING SITE, designated SEQ ID:39266, to the nucleotide sequence of VGAM2498 RNA, herein designated VGAM RNA, also designated SEQ ID:5209.

Another function of VGAM2498 is therefore inhibition of LOC152345 (Accession XM_087442). Accordingly, utilities of VGAM2498 include diagnosis, prevention and treatment of diseases and clinical conditions associated with LOC152345. FIG. 1 further provides a conceptual description of a novel bioinformatically detected viral gene of the present invention, referred to here as Viral Genomic Address Messenger 2499 (VGAM2499) viral gene, which modulates expression of respective host target genes thereof, the function and utility of which host target genes is known in the art.

VGAM2499 is a novel bioinformatically detected regulatory, non protein coding, viral micro RNA (miRNA) gene. The method by which VGAM2499 was detected is described hereinabove with reference to FIGS. 1-8.

VGAM2499 gene, herein designated VGAM GENE, is a viral gene contained in the genome of Mouse Cytomegalovirus 1. VGAM2499 host target gene, herein designated VGAM HOST TARGET GENE, is a human gene contained in the human genome.

VGAM2499 gene encodes a VGAM2499 precursor RNA, herein designated VGAM PRECURSOR RNA. Similar to other miRNA genes, and unlike most ordinary genes, VGAM2499 precursor RNA does not encode a protein. A nucleotide sequence identical or highly similar to the nucleotide sequence of VGAM2499 precursor RNA is designated SEQ ID:2485, and is provided hereinbelow with reference to the sequence listing part. Nucleotide sequence SEQ ID:2485 is located at position 88282 relative to the genome of Mouse Cytomegalovirus 1.

VGAM2499 precursor RNA folds onto itself, forming VGAM2499 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2499 folded precursor RNA into VGAM2499 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2499 RNA is designated SEQ ID:5210, and is provided hereinbelow with reference to the sequence listing part.

VGAM2499 host target gene, herein designated VGAM HOST TARGET GENE, encodes a corresponding messenger RNA, VGAM2499 host target RNA, herein designated VGAM HOST TARGET RNA. VGAM2499 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2499 RNA, herein designated VGAM RNA, binds complementarily to one or more host target binding sites located in untranslated regions of VGAM2499 host target RNA, herein designated VGAM HOST TARGET RNA. This complementary binding is due to the fact that the nucleotide sequence of VGAM2499 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2499 RNA, herein designated VGAM RNA, may have a different number of host target binding sites in untranslated regions of a VGAM2499 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2499 RNA, herein designated VGAM RNA, to host target binding sites on VGAM2499 host target RNA, herein designated VGAM HOST TARGET RNA, such as BINDING SITE I, BINDING SITE II and BINDING SITE III, inhibits translation of VGAM2499 host target RNA into VGAM2499 host target protein, herein designated VGAM HOST TARGET PROTEIN. VGAM host target protein is therefore outlined by a broken line.

It is appreciated that VGAM2499 host target gene, herein designated VGAM HOST TARGET GENE, in fact represents a plurality of VGAM2499 host target genes. The mRNA of each one of this plurality of VGAM2499 host target genes comprises one or more host target binding sites, each having a nucleotide sequence which is at least partly complementary to VGAM2499 RNA, herein designated VGAM RNA, and which when bound by VGAM2499 RNA causes inhibition of translation of respective one or more VGAM2499 host target proteins.

It is further appreciated by one skilled in the art that the mode of translational inhibition illustrated by FIG. 1 with specific reference to translational inhibition exerted by VGAM2499 gene, herein designated VGAM GENE, on one or more VGAM2499 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2499 is inhibition of expression of host target genes, as part of a novel viral mechanism of attacking a host. Accordingly, utilities of VGAM2499 include diagnosis, prevention and treatment of viral infection by Mouse Cytomegalovirus 1. Specific functions, and accordingly utilities, of VGAM2499 correlate with, and may be deduced from, the identity of the host target genes which VGAM2499 binds and inhibits, and the function of these host target genes, as elaborated hereinbelow.

Nucleotide sequences of the VGAM2499 precursor RNA, herein designated VGAM PRECURSOR RNA, and of the 'diced' VGAM2499 RNA, herein designated VGAM RNA, and a schematic representation of the secondary folding of VGAM2499 folded precursor RNA, herein designated VGAM FOLDED PRECURSOR RNA, of VGAM2499 are further described hereinbelow with reference to Table 1.

Nucleotide sequences of host target binding sites, such as BINDING SITE-I, BINDING SITE-II and BINDING SITE-III of FIG. 1, found on VGAM2499 host target RNA, and schematic representation of the complementarity of each of these host target binding sites to VGAM2499 RNA, herein designated VGAM RNA, are described hereinbelow with reference to Table 2.

As mentioned hereinabove with reference to FIG. 1, a function of VGAM2499 gene, herein designated VGAM is inhibition of expression of VGAM2499 target genes. It is appreciated that specific functions, and accordingly utilities, of VGAM2499 correlate with, and may be deduced from, the identity of the target genes which VGAM2499 binds and inhibits, and the function of these target genes, as elaborated hereinbelow.

GASC1 (Accession XM_034624) is a VGAM2499 host target gene. GASC1 BINDING SITE is HOST TARGET binding site found in the 5' untranslated region of mRNA encoded by GASC1, corresponding to a HOST TARGET binding site such as BINDING SITE I, BINDING SITE II or BINDING SITE III. Table 2 illustrates the complementarity of the nucleotide sequences of GASC1 BINDING SITE, designated SEQ ID:32124, to the nucleotide sequence of VGAM2499 RNA, herein designated VGAM RNA, also designated SEQ ID:5210.

A function of VGAM2499 is therefore inhibition of GASC1 (Accession XM_034624), a gene which may play an important role in the development and/or progression of various types of cancer. Accordingly, utilities of VGAM2499 include diagnosis, prevention and treatment of diseases and clinical conditions associated with GASC1. The function of GASC1 and its association with various diseases and clinical conditions, has been established by previous studies, as described hereinabove with reference to VGAM1671. Insulinoma-associated 1 (INSM1, Accession NM_002196) is another VGAM2499 host target gene. INSM1 BINDING SITE is HOST TARGET binding site found in the 3' untranslated region of mRNA encoded by INSM1, corresponding to a HOST TARGET binding site such as BINDING SITE I, BINDING SITE II or BINDING SITE III. Table 2 illustrates the complementarity of the nucleotide sequences of INSM1 BINDING SITE, designated SEQ ID:7951, to the nucleotide sequence of VGAM2499 RNA, herein designated VGAM RNA, also designated SEQ ID:5210.

Another function of VGAM2499 is therefore inhibition of Insulinoma-associated 1 (INSM1, Accession NM_002196). Accordingly, utilities of VGAM2499 include diagnosis, prevention and treatment of diseases and clinical conditions associated with INSM1. Chromosome 17 Open Reading Frame 26 (C17orf26, Accession NM_139177) is another VGAM2499 host target gene. C17orf26 BINDING SITE is HOST TARGET binding site found in the 3' untranslated region of mRNA encoded by C17orf26, corresponding to a HOST TARGET binding site such as BINDING SITE I, BINDING SITE II or BINDING SITE III. Table 2 illustrates the complementarity of the nucleotide sequences of C17orf26 BINDING SITE, designated SEQ ID:29187, to the nucleotide sequence of VGAM2499 RNA, herein designated VGAM RNA, also designated SEQ ID:5210.

Another function of VGAM2499 is therefore inhibition of Chromosome 17 Open Reading Frame 26 (C17orf26, Accession NM_139177). Accordingly, utilities of VGAM2499 include diagnosis, prevention and treatment of diseases and clinical conditions associated with C17orf26. KIAA0416 (Accession NM_015564) is another VGAM2499 host target gene. KIAA0416 BINDING SITE is HOST TARGET binding site found in the 3' untranslated region of mRNA encoded by KIAA0416, corresponding to a HOST TARGET binding site such as BINDING SITE I, BINDING SITE II or BINDING SITE III. Table 2 illustrates the complementarity of the nucleotide sequences of KIAA0416 BINDING SITE, designated SEQ ID:17836, to the nucleotide sequence of VGAM2499 RNA, herein designated VGAM RNA, also designated SEQ ID:5210.

Another function of VGAM2499 is therefore inhibition of KIAA0416 (Accession NM_015564). Accordingly, utilities of VGAM2499 include diagnosis, prevention and treatment of diseases and clinical conditions associated with KIAA0416. LOC255082 (Accession XM_172843) is another VGAM2499 host target gene. LOC255082 BINDING SITE is HOST TARGET binding site found in the 5' untranslated region of mRNA encoded by LOC255082, corresponding to a HOST TARGET binding site such as BINDING SITE I, BINDING SITE II or BINDING SITE III. Table 2 illustrates the complementarity of the nucleotide sequences of LOC255082 BINDING SITE, designated SEQ ID:46119, to the nucleotide sequence of VGAM2499 RNA, herein designated VGAM RNA, also designated SEQ ID:5210.

Another function of VGAM2499 is therefore inhibition of LOC255082 (Accession XM_172843). Accordingly, utilities of VGAM2499 include diagnosis, prevention and treatment of diseases and clinical conditions associated with LOC255082. FIG. 1 further provides a conceptual description of a novel bioinformatically detected viral gene of the present invention, referred to here as Viral Genomic Address Messenger 2500 (VGAM2500) viral gene, which modulates expression of respective host target genes thereof, the function and utility of which host target genes is known in the art.

VGAM2500 is a novel bioinformatically detected regulatory, non protein coding, viral micro RNA (miRNA) gene. The method by which VGAM2500 was detected is described hereinbelow with reference to FIGS. 1-8.

VGAM2500 gene, herein designated VGAM GENE, is a viral gene contained in the genome of Mouse Cytomegalovirus 1. VGAM2500 host target gene, herein designated VGAM HOST TARGET GENE, is a human gene contained in the human genome.

VGAM2500 gene encodes a VGAM2500 precursor RNA, herein designated VGAM PRECURSOR RNA. Similar to other miRNA genes, and unlike most ordinary genes, VGAM2500 precursor RNA does not encode a protein. A nucleotide sequence identical or highly similar to the nucleotide sequence of VGAM2500 precursor RNA is designated SEQ ID:2486, and is provided hereinbelow with reference to the sequence listing part. Nucleotide sequence SEQ ID:2486 is located at position 173739 relative to the genome of Mouse Cytomegalovirus 1.

VGAM2500 precursor RNA folds onto itself, forming VGAM2500 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2500 folded precursor RNA into VGAM2500 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM2500 RNA is designated SEQ ID:5211, and is provided hereinbelow with reference to the sequence listing part.

VGAM2500 host target gene, herein designated VGAM HOST TARGET GENE, encodes a corresponding messenger RNA, VGAM2500 host target RNA, herein designated VGAM HOST TARGET RNA. VGAM2500 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2500 RNA, herein designated VGAM RNA, binds complementarily to one or more host target binding sites located in untranslated regions of VGAM2500 host target RNA, herein designated VGAM HOST TARGET RNA. This complementary binding is due to the fact that the nucleotide sequence of VGAM2500 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2500 RNA, herein designated VGAM RNA, may have a different number of host target binding sites in untranslated regions of a VGAM2500 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2500 RNA, herein designated VGAM RNA, to host target binding sites on VGAM2500 host target RNA, herein designated VGAM HOST TARGET RNA, such as BINDING SITE I, BINDING SITE II and BINDING SITE III, inhibits translation of VGAM2500 host target RNA into VGAM2500 host target protein, herein designated VGAM HOST TARGET PROTEIN. VGAM host target protein is therefore outlined by a broken line.

It is appreciated that VGAM2500 host target gene, herein designated VGAM HOST TARGET GENE, in fact represents a plurality of VGAM2500 host target genes. The mRNA of each one of this plurality of VGAM2500 host target genes comprises one or more host target binding sites, each having a nucleotide sequence which is at least partly complementary to VGAM2500 RNA, herein designated VGAM RNA, and which when bound by VGAM2500 RNA causes inhibition of translation of respective one or more VGAM2500 host target proteins.

It is further appreciated by one skilled in the art that the mode of translational inhibition illustrated by FIG. 1 with specific reference to translational inhibition exerted by VGAM2500 gene, herein designated VGAM GENE, on one or more VGAM2500 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2500 is inhibition of expression of host target genes, as part of a novel viral mechanism of attacking a host. Accordingly, utilities of VGAM2500 include diagnosis, prevention and treatment of viral infection by Mouse Cytomegalovirus 1. Specific functions, and accordingly utilities, of VGAM2500 correlate with, and may be deduced from, the identity of the host target genes which VGAM2500 binds and inhibits, and the function of these host target genes, as elaborated hereinbelow.

Nucleotide sequences of the VGAM2500 precursor RNA, herein designated VGAM PRECURSOR RNA, and of the 'diced' VGAM2500 RNA, herein designated VGAM RNA, and a schematic representation of the secondary folding of VGAM2500 folded precursor RNA, herein designated VGAM FOLDED PRECURSOR RNA, of VGAM2500 are further described hereinbelow with reference to Table 1.

Nucleotide sequences of host target binding sites, such as BINDING SITE-I, BINDING SITE-II and BINDING SITE-III of FIG. 1, found on VGAM2500 host target RNA, and schematic representation of the complementarity of each of these host target binding sites to VGAM2500 RNA, herein designated VGAM RNA, are described hereinbelow with reference to Table 2.

As mentioned hereinabove with reference to FIG. 1, a function of VGAM2500 gene, herein designated VGAM is inhibition of expression of VGAM2500 target genes. It is appreciated that specific functions, and accordingly utilities, of VGAM2500 correlate with, and may be deduced from, the identity of the target genes which VGAM2500 binds and inhibits, and the function of these target genes, as elaborated hereinbelow.

CAAX Box 1 (CXX1, Accession NM_003928) is a VGAM2500 host target gene. CXX1 BINDING SITE is HOST TARGET binding site found in the 5' untranslated region of mRNA encoded by CXX1, corresponding to a HOST TARGET binding site such as BINDING SITE I, BINDING SITE II or BINDING SITE III. Table 2 illustrates the complementarity of the nucleotide sequences of CXX1 BINDING SITE, designated SEQ ID:10025, to the nucleotide sequence of VGAM2500 RNA, herein designated VGAM RNA, also designated SEQ ID:5211.

A function of VGAM2500 is therefore inhibition of CAAX Box 1 (CXX1, Accession NM_003928). Accordingly, utilities of VGAM2500 include diagnosis, prevention and treatment of diseases and clinical conditions associated with CXX1. Solute Carrier Family 25 (mitochondrial carrier; ornithine transporter) Member 15 (SLC25A15, Accession NM_014252) is another VGAM2500 host target gene. SLC25A15 BINDING SITE is HOST TARGET binding site found in the 3' untranslated region of mRNA encoded by SLC25A15, corresponding to a HOST TARGET binding site such as BINDING SITE I, BINDING SITE II or BINDING SITE III. Table 2 illustrates the complementarity of the nucleotide sequences of SLC25A15 BINDING SITE, designated SEQ ID:15529, to the nucleotide sequence of VGAM2500 RNA, herein designated VGAM RNA, also designated SEQ ID:5211.

Another function of VGAM2500 is therefore inhibition of Solute Carrier Family 25 (mitochondrial carrier; ornithine transporter) Member 15 (SLC25A15, Accession NM_014252), a gene which participates theornithine transport across inner mitochondrial membrane, from the cytoplasm to the matrix. Accordingly, utilities of VGAM2500 include diagnosis, prevention and treatment of diseases and clinical conditions associated with SLC25A15. The function of SLC25A15 and its association with various diseases and clinical conditions, has been established by previous studies, as described hereinabove with reference to VGAM172. DKFZP564B147 (Accession XM_088745) is another VGAM2500 host target gene. DKFZP564B147 BINDING SITE is HOST TARGET binding site found in the 5' untranslated region of mRNA encoded by DKFZP564B147, corresponding to a HOST TARGET binding site such as BINDING SITE I, BINDING SITE II or BINDING SITE III. Table 2 illustrates the complementarity of the nucleotide sequences of DKFZP564B147 BINDING SITE, designated SEQ ID:39936, to the nucleotide sequence of VGAM2500 RNA, herein designated VGAM RNA, also designated SEQ ID:5211.

Another function of VGAM2500 is therefore inhibition of DKFZP564B147 (Accession XM_088745). Accordingly, utilities of VGAM2500 include diagnosis, prevention and treatment of diseases and clinical conditions associated with DKFZP564B147. KIAA1856 (Accession XM_166549) is another VGAM2500 host target gene. KIAA1856 BINDING SITE is HOST TARGET binding site found in the 3' untranslated region of mRNA encoded by KIAA1856, corresponding to a HOST TARGET binding site such as BINDING SITE I, BINDING SITE II or BINDING SITE III. Table 2 illustrates the complementarity of the nucleotide sequences of KIAA1856 BINDING SITE, designated SEQ ID:44527, to the nucleotide sequence of VGAM2500 RNA, herein designated VGAM RNA, also designated SEQ ID:5211.

Another function of VGAM2500 is therefore inhibition of KIAA1856 (Accession XM_166549). Accordingly, utilities of VGAM2500 include diagnosis, prevention and treatment of diseases and clinical conditions associated with KIAA1856. Serum/glucocorticoid Regulated Kinase-like (SGKL, Accession NM_013257) is another VGAM2500 host target gene. SGKL BINDING SITE is HOST TARGET binding site found in the 3' untranslated region of mRNA encoded by SGKL, corresponding to a HOST TARGET binding site such as BINDING SITE I, BINDING SITE II or BINDING SITE III. Table 2 illustrates the complementarity of the nucleotide sequences of SGKL BINDING SITE, designated SEQ ID:14928, to the nucleotide sequence of VGAM2500 RNA, herein designated VGAM RNA, also designated SEQ ID:5211.

Another function of VGAM2500 is therefore inhibition of Serum/glucocorticoid Regulated Kinase-like (SGKL, Accession NM_013257). Accordingly, utilities of VGAM2500 include diagnosis, prevention and treatment of diseases and clinical conditions associated with SGKL. LOC165246 (Accession XM_092473) is another VGAM2500 host target gene. LOC165246 BINDING SITE is HOST TARGET binding site found in the 5' untranslated region of mRNA encoded by LOC165246, corresponding to a HOST TARGET binding site such as BINDING SITE I, BINDING SITE II or BINDING SITE III. Table 2 illustrates the complementarity of the nucleotide sequences of LOC165246 BINDING SITE, designated SEQ ID:40127, to the nucleotide sequence of VGAM2500 RNA, herein designated VGAM RNA, also designated SEQ ID:5211.

Another function of VGAM2500 is therefore inhibition of LOC165246 (Accession XM_092473). Accordingly, utilities of VGAM2500 include diagnosis, prevention and treatment of diseases and clinical conditions associated with LOC165246. LOC196337 (Accession XM_113696) is another VGAM2500 host target gene. LOC196337 BINDING SITE is HOST TARGET binding site found in the 5' untranslated region of mRNA encoded by LOC196337, corresponding to a HOST TARGET binding site such as BINDING SITE I, BINDING SITE II or BINDING SITE III. Table 2 illustrates the complementarity of the nucleotide sequences of LOC196337 BINDING SITE, designated SEQ ID:42357, to the nucleotide sequence of VGAM2500 RNA, herein designated VGAM RNA, also designated SEQ ID:5211.

Another function of VGAM2500 is therefore inhibition of LOC196337 (Accession XM_113696). Accordingly, utilities of VGAM2500 include diagnosis, prevention and treatment of diseases and clinical conditions associated with LOC196337. FIG. 1 further provides a conceptual description of a novel bioinformatically detected viral gene of the present invention, referred to here as Viral Genomic Address Messenger 2501 (VGAM2501) viral gene, which modulates expression of respective host target genes thereof, the function and utility of which host target genes is known in the art.

VGAM2501 is a novel bioinformatically detected regulatory, non protein coding, viral micro RNA (miRNA) gene. The method by which VGAM2501 was detected is described hereinabove with reference to FIGS. 1-8.

VGAM2501 gene, herein designated VGAM GENE, is a viral gene contained in the genome of Mouse Cytomegalovirus 1. VGAM2501 host target gene, herein designated VGAM HOST TARGET GENE, is a human gene contained in the human genome.

VGAM2501 gene encodes a VGAM2501 precursor RNA, herein designated VGAM PRECURSOR RNA. Similar to other miRNA genes, and unlike most ordinary genes, VGAM2501 precursor RNA does not encode a protein. A nucleotide sequence identical or highly similar to the nucleotide sequence of VGAM2501 precursor RNA is designated SEQ ID:2487, and is provided hereinbelow with reference to the sequence listing part. Nucleotide sequence SEQ ID:2487 is located at position 72060 relative to the genome of Mouse Cytomegalovirus 1.

VGAM2501 precursor RNA folds onto itself, forming VGAM2501 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2501 folded precursor RNA into VGAM2501 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM2501 RNA is designated SEQ ID:5212, and is provided hereinbelow with reference to the sequence listing part.

VGAM2501 host target gene, herein designated VGAM HOST TARGET GENE, encodes a corresponding messenger RNA, VGAM2501 host target RNA, herein designated VGAM HOST TARGET RNA. VGAM2501 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2501 RNA, herein designated VGAM RNA, binds complementarily to one or more host target binding sites located in untranslated regions of VGAM2501 host target RNA, herein designated VGAM HOST TARGET RNA. This complementary binding is due to the fact that the nucleotide sequence of VGAM2501 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2501 RNA, herein designated VGAM RNA, may have a different number of host target binding sites in untranslated regions of a VGAM2501 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2501 RNA, herein designated VGAM RNA, to host target binding sites on VGAM2501 host target RNA, herein designated VGAM HOST TARGET RNA, such as BINDING SITE I, BINDING SITE II and BINDING SITE III, inhibits translation of VGAM2501 host target RNA into VGAM2501 host target protein, herein designated VGAM HOST TARGET PROTEIN. VGAM host target protein is therefore outlined by a broken line.

It is appreciated that VGAM2501 host target gene, herein designated VGAM HOST TARGET GENE, in fact represents a plurality of VGAM2501 host target genes. The mRNA of each one of this plurality of VGAM2501 host target genes comprises one or more host target binding sites, each having a nucleotide sequence which is at least partly complementary to VGAM2501 RNA, herein designated VGAM RNA, and which when bound by VGAM2501 RNA causes inhibition of translation of respective one or more VGAM2501 host target proteins.

It is further appreciated by one skilled in the art that the mode of translational inhibition illustrated by FIG. 1 with specific reference to translational inhibition exerted by VGAM2501 gene, herein designated VGAM GENE, on one or more VGAM2501 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2501 is inhibition of expression of host target genes, as part of a novel viral mechanism of attacking a host. Accordingly, utilities of VGAM2501 include diagnosis, prevention and treatment of viral infection by Mouse Cytomegalovirus 1. Specific functions, and accordingly utilities, of VGAM2501 correlate with, and may be deduced from, the identity of the host target genes which VGAM2501 binds and inhibits, and the function of these host target genes, as elaborated hereinbelow.

Nucleotide sequences of the VGAM2501 precursor RNA, herein designated VGAM PRECURSOR RNA, and of the 'diced' VGAM2501 RNA, herein designated VGAM RNA, and a schematic representation of the secondary folding of VGAM2501 folded precursor RNA, herein designated VGAM FOLDED PRECURSOR RNA, of VGAM2501 are further described hereinbelow with reference to Table 1.

Nucleotide sequences of host target binding sites, such as BINDING SITE-I, BINDING SITE-II and BINDING SITE-III of FIG. 1, found on VGAM2501 host target RNA, and schematic representation of the complementarity of each of these host target binding sites to VGAM2501 RNA, herein designated VGAM RNA, are described hereinbelow with reference to Table 2.

As mentioned hereinabove with reference to FIG. 1, a function of VGAM2501 gene, herein designated VGAM is inhibition of expression of VGAM2501 target genes. It is appreciated that specific functions, and accordingly utilities, of VGAM2501 correlate with, and may be deduced from, the identity of the target genes which VGAM2501 binds and inhibits, and the function of these target genes, as elaborated hereinbelow.

UDP-Gal:betaGlcNAc Beta 1,4-Galactosyltransferase, Polypeptide 5 (B4GALT5, Accession NM_004776) is a VGAM2501 host target gene. B4GALT5 BINDING SITE is HOST TARGET binding site found in the 3' untranslated region of mRNA encoded by B4GALT5, corresponding to a HOST TARGET binding site such as BINDING SITE I, BINDING SITE II or BINDING SITE III. Table 2 illustrates the complementarity of the nucleotide sequences of B4GALT5 BINDING SITE, designated SEQ ID:11168, to the nucleotide sequence of VGAM2501 RNA, herein designated VGAM RNA, also designated SEQ ID:5212.

A function of VGAM2501 is therefore inhibition of UDP-Gal:betaGlcNAc Beta 1,4-Galactosyltransferase, Polypeptide 5 (B4GALT5, Accession NM_004776). Accordingly, utilities of VGAM2501 include diagnosis, prevention and treatment of diseases and clinical conditions associated with B4GALT5. Growth Factor Receptor-bound Protein 10 (GRB10, Accession NM_005311) is another VGAM2501 host target gene. GRB10 BINDING SITE is HOST TARGET binding site found in the 5' untranslated region of mRNA encoded by GRB10, corresponding to a HOST TARGET binding site such as BINDING SITE I, BINDING SITE II or BINDING SITE III. Table 2 illustrates the complementarity of the nucleotide sequences of GRB10 BINDING SITE, designated SEQ ID:11787, to the nucleotide sequence of VGAM2501 RNA, herein designated VGAM RNA, also designated SEQ ID:5212.

Another function of VGAM2501 is therefore inhibition of Growth Factor Receptor-bound Protein 10 (GRB10, Accession NM_005311), a gene which plays a functional role in insulin and IGF-I signaling. Accordingly, utilities of VGAM2501 include diagnosis, prevention and treatment of diseases and clinical conditions associated with GRB10. The function of GRB10 and its association with various diseases and clinical conditions, has been established by previous studies, as described hereinabove with reference to VGAM441. LIM Domain Binding 2 (LDB2, Accession NM_001290) is another VGAM2501 host target gene. LDB2 BINDING SITE is HOST TARGET binding site found in the 3' untranslated region of mRNA encoded by LDB2, corresponding to a HOST TARGET binding site such as BINDING SITE I, BINDING SITE II or BINDING SITE III. Table 2 illustrates the complementarity of the nucleotide sequences of LDB2 BINDING SITE, designated SEQ ID:6970, to the nucleotide sequence of VGAM2501 RNA, herein designated VGAM RNA, also designated SEQ ID:5212.

Another function of VGAM2501 is therefore inhibition of LIM Domain Binding 2 (LDB2, Accession NM_001290), a gene which physically interacts with the LIM domains of nuclear proteins. Accordingly, utilities of VGAM2501 include diagnosis, prevention and treatment of diseases and clinical conditions associated with LDB2. The function of LDB2 and its association with various diseases and clinical conditions, has been established by previous studies, as described hereinabove with reference to VGAM2325. Pregnancy-associated Plasma Protein A (PAPPA, Accession NM_002581) is another VGAM2501 host target gene. PAPPA BINDING SITE is HOST TARGET binding site found in the 5' untranslated region of mRNA encoded by PAPPA, corresponding to a HOST TARGET binding site such as BINDING SITE I, BINDING SITE II or BINDING SITE III. Table 2 illustrates the complementarity of the nucleotide sequences of PAPPA BINDING SITE, designated SEQ ID:8442, to the nucleotide sequence of VGAM2501 RNA, herein designated VGAM RNA, also designated SEQ ID:5212.

Another function of VGAM2501 is therefore inhibition of Pregnancy-associated Plasma Protein A (PAPPA, Accession NM_002581), a gene which is a putative metalloprotease. Accordingly, utilities of VGAM2501 include diagnosis, prevention and treatment of diseases and clinical conditions associated with PAPPA. The function of PAPPA and its association with various diseases and clinical conditions, has been established by previous studies, as described hereinabove with reference to VGAM1324. Protocadherin 11 X-linked (PCDH11X, Accession NM_032968) is another VGAM2501 host target gene. PCDH11X BINDING SITE1 and PCDH11X BINDING SITE2 are HOST TARGET binding sites found in untranslated regions of mRNA encoded by PCDH11X, corresponding to HOST TARGET binding sites such as BINDING SITE I, BINDING SITE II or BINDING SITE III. Table 2 illustrates the complementarity of the nucleotide sequences of PCDH11X BINDING SITE1 and PCDH11X BINDING SITE2, designated SEQ ID:26791 and SEQ ID:26806 respectively, to the nucleotide sequence of VGAM2501 RNA, herein designated VGAM RNA, also designated SEQ ID:5212.

Another function of VGAM2501 is therefore inhibition of Protocadherin 11 X-linked (PCDH11X, Accession NM_032968), a gene which is thought to play a fundamental role in cell-cell recognition essential for the segmental development and function of the central nervous system. Accordingly, utilities of VGAM2501 include diagnosis, prevention and treatment of diseases and clinical conditions associated with PCDH11X. The function of PCDH11X and its association with various diseases and clinical conditions, has been established by previous studies, as described hereinabove with reference to VGAM433. Retina and Anterior Neural Fold Homeobox (RAX, Accession NM_013435) is another VGAM2501 host target gene. RAX BINDING SITE is HOST TARGET binding site found in the 5' untranslated region of mRNA encoded by RAX, corresponding to a HOST TARGET binding site such as BINDING SITE I, BINDING SITE II or BINDING SITE III. Table 2 illustrates the complementarity of the nucleotide sequences of RAX BINDING SITE, designated SEQ ID:15093, to the nucleotide sequence of VGAM2501 RNA, herein designated VGAM RNA, also designated SEQ ID:5212.

Another function of VGAM2501 is therefore inhibition of Retina and Anterior Neural Fold Homeobox (RAX, Accession NM_013435), a gene which activates PKR in a dsRNA-independent manner. Accordingly, utilities of VGAM2501 include diagnosis, prevention and treatment of diseases and clinical conditions associated with RAX. The function of RAX has been established by previous studies. The double-stranded RNA (dsRNA)-activated protein kinase PKR (OMIM Ref. No. 176871) is a mediator of the effects of interferon (see OMIM Ref. No. 107470), particularly its antiviral activities. PKR has also been implicated in the onset of differentiation. Based on its interaction with PKR, Patel and Sen (1998) cloned PACT cDNA. The PACT cDNA encodes a deduced 313-amino acid polypeptide that contains 3 motifs resembling the dimerization motifs present in PKR and other dsRNA-binding proteins. Northern blot analysis revealed that PACT is expressed as a 2.0-kb mRNA in a variety of human cell lines. Ito et al. (1999) cloned the mouse homolog, which they called RAX, from a mouse Il3 (OMIM Ref. No. 147740)-dependent cell cDNA library using the yeast 2-hybrid interactive cloning system. They showed that the mouse and human sequences share 98% identity. Northern blot analysis detected expression of RAX in all tissues tested. Western blot analysis showed a 35-kD protein expressed in cell lines derived from several mammalian species.

Full details of the abovementioned studies are described in the following publications, the disclosure of which are hereby incorporated by reference:

Patel, R. C.; Sen, G. C.: PACT, a protein activator of the interferon-induced protein kinase, PKR. EMBO J. 17:4379-4390, 1998; and Ito, T.; Yang, M.; May, W. S.: RAX, a cellular activator for double-stranded RNA-dependent protein kinase during stress signaling. J. Biol. Chem. 274: 15427-15432, 1999.

Further studies establishing the function and utilities of RAX are found in John Hopkins OMIM database record ID 603424, and in sited publications numbered 8188-8190 listed in the bibliography section hereinbelow, which are also hereby incorporated by reference. Short Stature Homeobox (SHOX, Accession NM_000451) is another VGAM2501 host target gene. SHOX BINDING SITE is HOST TARGET binding site found in the 3' untranslated region of mRNA encoded by SHOX, corresponding to a HOST TARGET binding site such as BINDING SITE I, BINDING SITE II or BINDING SITE III. Table 2 illustrates the complementarity of the nucleotide sequences of SHOX BINDING SITE, designated SEQ ID:6056, to the nucleotide sequence of VGAM2501 RNA, herein designated VGAM RNA, also designated SEQ ID:5212.

Another function of VGAM2501 is therefore inhibition of Short Stature Homeobox (SHOX, Accession NM_000451). Accordingly, utilities of VGAM2501 include diagnosis, prevention and treatment of diseases and clinical conditions associated with SHOX. Solute Carrier Family 6 (neurotransmitter transporter, dopamine), Member 3 (SLC6A3, Accession NM_001044) is another VGAM2501 host target gene. SLC6A3 BINDING SITE1 through SLC6A3 BINDING SITE5 are HOST TARGET binding sites found in untranslated regions of mRNA encoded by SLC6A3, corresponding to HOST TARGET binding sites such as BINDING SITE I, BINDING SITE II or BINDING SITE III. Table 2 illustrates the complementarity of the nucleotide sequences of SLC6A3 BINDING SITE1 through SLC6A3 BINDING SITE5, designated SEQ ID:6710, SEQ ID:6709, SEQ ID:6708, SEQ ID:6711 and SEQ ID:6707 respectively, to the nucleotide sequence of VGAM2501 RNA, herein designated VGAM RNA, also designated SEQ ID:5212.

Another function of VGAM2501 is therefore inhibition of Solute Carrier Family 6 (neurotransmitter transporter, dopamine), Member 3 (SLC6A3, Accession NM_001044), a gene which terminates the action of dopamine by its high affinity sodium-dependent reuptake into presynaptic terminals. Accordingly, utilities of VGAM2501 include diagnosis, prevention and treatment of diseases and clinical conditions associated with SLC6A3. The function of SLC6A3 and its association with various diseases and clinical conditions, has been established by previous studies, as described hereinabove with reference to VGAM1753. Chromosome 17 Open Reading Frame 31 (C17orf31, Accession NM_017575) is another VGAM2501 host target gene. C17orf31 BINDING SITE is HOST TARGET binding site found in the 5' untranslated region of mRNA encoded by C17orf31, corresponding to a HOST TARGET binding site such as BINDING SITE I, BINDING SITE II or BINDING SITE III. Table 2 illustrates the complementarity of the nucleotide sequences of C17orf31 BINDING SITE, designated SEQ ID:19005, to the nucleotide sequence of VGAM2501 RNA, herein designated VGAM RNA, also designated SEQ ID:5212.

Another function of VGAM2501 is therefore inhibition of Chromosome 17 Open Reading Frame 31 (C17orf31, Accession NM_017575). Accordingly, utilities of VGAM2501 include diagnosis, prevention and treatment of diseases and clinical conditions associated with C17orf31. Frequently Rearranged In Advanced T-cell Lymphomas (FRAT1, Accession NM_005479) is another VGAM2501 host target gene. FRAT1 BINDING SITE is HOST TARGET binding site found in the 5' untranslated region of mRNA encoded by FRAT1, corresponding to a HOST TARGET binding site such as BINDING SITE I, BINDING SITE II or BINDING SITE III. Table 2 illustrates the complementarity of the nucleotide sequences of FRAT1 BINDING SITE, designated SEQ ID:11981, to the nucleotide sequence of VGAM2501 RNA, herein designated VGAM RNA, also designated SEQ ID:5212.

Another function of VGAM2501 is therefore inhibition of Frequently Rearranged In Advanced T-cell Lymphomas (FRAT1, Accession NM_005479). Accordingly, utilities of VGAM2501 include diagnosis, prevention and treatment of diseases and clinical conditions associated with FRAT1. KIAA0153 (Accession NM_015140) is another VGAM2501 host target gene. KIAA0153 BINDING SITE is HOST TARGET binding site found in the 3' untranslated region of mRNA encoded by KIAA0153, corresponding to a HOST TARGET binding site such as BINDING SITE I, BINDING SITE II or BINDING SITE III. Table 2 illustrates the complementarity of the nucleotide sequences of KIAA0153 BINDING SITE, designated SEQ ID:17499, to the nucleotide sequence of VGAM2501 RNA, herein designated VGAM RNA, also designated SEQ ID:5212.

Another function of VGAM2501 is therefore inhibition of KIAA0153 (Accession NM_015140). Accordingly, utilities of VGAM2501 include diagnosis, prevention and treatment of diseases and clinical conditions associated with KIAA0153. KIAA0469 (Accession NM_014851) is another VGAM2501 host target gene. KIAA0469 BINDING SITE is HOST TARGET binding site found in the 3' untranslated region of mRNA encoded by KIAA0469, corresponding to a HOST TARGET binding site such as BINDING SITE I, BINDING SITE II or BINDING SITE III. Table 2 illustrates the complementarity of the nucleotide sequences of KIAA0469 BINDING SITE, designated SEQ ID:16894, to the nucleotide sequence of VGAM2501 RNA, herein designated VGAM RNA, also designated SEQ ID:5212.

Another function of VGAM2501 is therefore inhibition of KIAA0469 (Accession NM_014851). Accordingly, utilities of VGAM2501 include diagnosis, prevention and treatment of diseases and clinical conditions associated with KIAA0469. KIAA1363 (Accession XM_045056) is another VGAM2501 host target gene. KIAA1363 BINDING SITE is HOST TARGET binding site found in the 3' untranslated region of mRNA encoded by KIAA1363, corresponding to a HOST TARGET binding site such as BINDING SITE I, BINDING SITE II or BINDING SITE III. Table 2 illustrates the complementarity of the nucleotide sequences of KIAA1363 BINDING SITE, designated SEQ ID:34334, to the nucleotide sequence of VGAM2501 RNA, herein designated VGAM RNA, also designated SEQ ID:5212.

Another function of VGAM2501 is therefore inhibition of KIAA1363 (Accession XM_045056). Accordingly, utilities of VGAM2501 include diagnosis, prevention and treatment of diseases and clinical conditions associated with KIAA1363. KIAA1951 (Accession XM_057401) is another VGAM2501 host target gene. KIAA1951 BINDING SITE is HOST TARGET binding site found in the 3' untranslated region of mRNA encoded by KIAA1951, corresponding to a HOST TARGET binding site such as BINDING SITE I, BINDING SITE II or BINDING SITE III. Table 2 illustrates the complementarity of the nucleotide sequences of KIAA1951 BINDING SITE, designated SEQ ID:36512, to the nucleotide sequence of VGAM2501 RNA, herein designated VGAM RNA, also designated SEQ ID:5212.

Another function of VGAM2501 is therefore inhibition of KIAA1951 (Accession XM_057401). Accordingly, utilities of VGAM2501 include diagnosis, prevention and treatment of diseases and clinical conditions associated with KIAA1951. Paternally Expressed 10 (PEG10, Accession NM_015068) is another VGAM2501 host target gene. PEG10 BINDING SITE is HOST TARGET binding site found in the 3' untranslated region of mRNA encoded by PEG10, corresponding to a HOST TARGET binding site such as BINDING SITE I, BINDING SITE II or BINDING SITE III. Table 2 illustrates the complementarity of the nucleotide sequences of PEG10 BINDING SITE, designated SEQ ID:17430, to the nucleotide sequence of VGAM2501 RNA, herein designated VGAM RNA, also designated SEQ ID:5212.

Another function of VGAM2501 is therefore inhibition of Paternally Expressed 10 (PEG10, Accession NM_015068). Accordingly, utilities of VGAM2501 include diagnosis, prevention and treatment of diseases and clinical conditions associated with PEG10. LOC128989 (Accession XM_059310) is another VGAM2501 host target gene. LOC128989 BINDING SITE is HOST TARGET binding site found in the 3' untranslated region of mRNA encoded by LOC128989, corresponding to a HOST TARGET binding site such as BINDING SITE I, BINDING SITE II or BINDING SITE III. Table 2 illustrates the complementarity of the nucleotide sequences of LOC128989 BINDING SITE, designated SEQ ID:36944, to the nucleotide sequence of VGAM2501 RNA, herein designated VGAM RNA, also designated SEQ ID:5212.

Another function of VGAM2501 is therefore inhibition of LOC128989 (Accession XM_059310). Accordingly, utilities of VGAM2501 include diagnosis, prevention and treatment of diseases and clinical conditions associated with LOC128989. LOC137964 (Accession XM_059933) is another VGAM2501 host target gene. LOC137964 BINDING SITE is HOST TARGET binding site found in the 3' untranslated region of mRNA encoded by LOC137964, corresponding to a HOST TARGET binding site such as BINDING SITE I, BINDING SITE II or BINDING SITE III. Table 2 illustrates the complementarity of the nucleotide sequences of LOC137964 BINDING SITE, designated SEQ ID:37112, to the nucleotide sequence of VGAM2501 RNA, herein designated VGAM RNA, also designated SEQ ID:5212.

Another function of VGAM2501 is therefore inhibition of LOC137964 (Accession XM_059933). Accordingly, utilities of VGAM2501 include diagnosis, prevention and treatment of diseases and clinical conditions associated with LOC137964. LOC148397 (Accession XM_086171) is another VGAM2501 host target gene. LOC148397 BINDING SITE is HOST TARGET binding site found in the 3' untranslated region of mRNA encoded by LOC148397, corresponding to a HOST TARGET binding site such as BINDING SITE I, BINDING SITE II or BINDING SITE III. Table 2 illustrates the complementarity of the nucleotide sequences of LOC148397 BINDING SITE, designated SEQ ID:38529, to the nucleotide sequence of VGAM2501 RNA, herein designated VGAM RNA, also designated SEQ ID:5212.

Another function of VGAM2501 is therefore inhibition of LOC148397 (Accession XM_086171). Accordingly, utilities of VGAM2501 include diagnosis, prevention and treatment of diseases and clinical conditions associated with LOC148397. LOC149127 (Accession XM_097584) is another VGAM2501 host target gene. LOC149127 BINDING SITE is HOST TARGET binding site found in the 3' untranslated region of mRNA encoded by LOC149127, corresponding to a HOST TARGET binding site such as BINDING SITE I, BINDING SITE II or BINDING SITE III. Table 2 illustrates the complementarity of the nucleotide sequences of LOC149127 BINDING SITE, designated SEQ ID:40948, to the nucleotide sequence of VGAM2501 RNA, herein designated VGAM RNA, also designated SEQ ID:5212.

Another function of VGAM2501 is therefore inhibition of LOC149127 (Accession XM_097584). Accordingly, utilities of VGAM2501 include diagnosis, prevention and treatment of diseases and clinical conditions associated with LOC149127. LOC152860 (Accession XM_087539) is another VGAM2501 host target gene. LOC152860 BINDING SITE is HOST TARGET binding site found in the 5' untranslated region of mRNA encoded by LOC152860, corresponding to a HOST TARGET binding site such as BINDING SITE I, BINDING SITE II or BINDING SITE III. Table 2 illustrates the complementarity of the nucleotide sequences of LOC152860 BINDING SITE, designated SEQ ID:39324, to the nucleotide sequence of VGAM2501 RNA, herein designated VGAM RNA, also designated SEQ ID:5212.

Another function of VGAM2501 is therefore inhibition of LOC152860 (Accession XM_087539). Accordingly, utilities of VGAM2501 include diagnosis, prevention and treatment of diseases and clinical conditions associated with LOC152860. LOC197408 (Accession XM_117031) is another VGAM2501 host target gene. LOC197408 BINDING SITE is HOST TARGET binding site found in the 5' untranslated region of mRNA encoded by LOC197408, corresponding to a HOST TARGET binding site such as BINDING SITE I, BINDING SITE II or BINDING SITE III. Table 2 illustrates the complementarity of the nucleotide sequences of LOC197408 BINDING SITE, designated SEQ ID:43207, to the nucleotide sequence of VGAM2501 RNA, herein designated VGAM RNA, also designated SEQ ID:5212.

Another function of VGAM2501 is therefore inhibition of LOC197408 (Accession XM_117031). Accordingly, utilities of VGAM2501 include diagnosis, prevention and treatment of diseases and clinical conditions associated with LOC197408. LOC205095 (Accession XM_119820) is another VGAM2501 host target gene. LOC205095 BINDING SITE is HOST TARGET binding site found in the 3' untranslated region of mRNA encoded by LOC205095, corresponding to a HOST TARGET binding site such as BINDING SITE I, BINDING SITE II or BINDING SITE III. Table 2 illustrates the complementarity of the nucleotide sequences of LOC205095 BINDING SITE, designated SEQ ID:43604, to the nucleotide sequence of VGAM2501 RNA, herein designated VGAM RNA, also designated SEQ ID:5212.

Another function of VGAM2501 is therefore inhibition of LOC205095 (Accession XM_119820). Accordingly, utilities of VGAM2501 include diagnosis, prevention and treatment of diseases and clinical conditions associated with LOC205095. LOC219688 (Accession XM_167568) is another VGAM2501 host target gene. LOC219688 BINDING SITE is HOST TARGET binding site found in the 5' untranslated region of mRNA encoded by LOC219688, corresponding to a HOST TARGET binding site such as BINDING SITE I, BINDING SITE II or BINDING SITE III. Table 2 illustrates the complementarity of the nucleotide sequences of LOC219688 BINDING SITE, designated SEQ ID:44700, to the nucleotide sequence of VGAM2501 RNA, herein designated VGAM RNA, also designated SEQ ID:5212.

Another function of VGAM2501 is therefore inhibition of LOC219688 (Accession XM_167568). Accordingly, utilities of VGAM2501 include diagnosis, prevention and treatment of diseases and clinical conditions associated with LOC219688. LOC253897 (Accession XM_171187) is another VGAM2501 host target gene. LOC253897 BINDING SITE is HOST TARGET binding site found in the 3' untranslated region of mRNA encoded by LOC253897, corresponding to a HOST TARGET binding site such as BINDING SITE I, BINDING SITE II or BINDING SITE III. Table 2 illustrates the complementarity of the nucleotide sequences of LOC253897 BINDING SITE, designated SEQ ID:45968, to the nucleotide sequence of VGAM2501 RNA, herein designated VGAM RNA, also designated SEQ ID:5212.

Another function of VGAM2501 is therefore inhibition of LOC253897 (Accession XM_171187). Accordingly, utilities of VGAM2501 include diagnosis, prevention and treatment of diseases and clinical conditions associated with LOC253897. LOC255423 (Accession XM_174498) is another VGAM2501 host target gene. LOC255423 BINDING SITE is HOST TARGET binding site found in the 5' untranslated region of mRNA encoded by LOC255423, corresponding to a HOST TARGET binding site such as BINDING SITE I, BINDING SITE II or BINDING SITE III. Table 2 illustrates the complementarity of the nucleotide sequences of LOC255423 BINDING SITE, designated SEQ ID:46594, to the nucleotide sequence of VGAM2501 RNA, herein designated VGAM RNA, also designated SEQ ID:5212.

Another function of VGAM2501 is therefore inhibition of LOC255423 (Accession XM_174498). Accordingly, utilities of VGAM2501 include diagnosis, prevention and treatment of diseases and clinical conditions associated with LOC255423. LOC256222 (Accession XM_173177) is another VGAM2501 host target gene. LOC256222 BINDING SITE is HOST TARGET binding site found in the 5' untranslated region of mRNA encoded by LOC256222, corresponding to a HOST TARGET binding site such as BINDING SITE I, BINDING SITE II or BINDING SITE III. Table 2 illustrates the complementarity of the nucleotide sequences of LOC256222 BINDING SITE, designated SEQ ID:46427, to the nucleotide sequence of VGAM2501 RNA, herein designated VGAM RNA, also designated SEQ ID:5212.

Another function of VGAM2501 is therefore inhibition of LOC256222 (Accession XM_173177). Accordingly, utilities of VGAM2501 include diagnosis, prevention and treatment of diseases and clinical conditions associated with LOC256222. FIG. 1 further provides a conceptual description of a novel bioinformatically detected viral gene of the present invention, referred to here as Viral Genomic Address Messenger 2502 (VGAM2502) viral gene, which modulates expression of respective host target genes thereof, the function and utility of which host target genes is known in the art.

VGAM2502 is a novel bioinformatically detected regulatory, non protein coding, viral micro RNA (miRNA) gene. The method by which VGAM2502 was detected is described hereinabove with reference to FIGS. 1-8.

VGAM2502 gene, herein designated VGAM GENE, is a viral gene contained in the genome of Mouse Cytomegalovirus 1. VGAM2502 host target gene, herein designated VGAM HOST TARGET GENE, is a human gene contained in the human genome.

VGAM2502 gene encodes a VGAM2502 precursor RNA, herein designated VGAM PRECURSOR RNA. Similar to other miRNA genes, and unlike most ordinary genes, VGAM2502 precursor RNA does not encode a protein. A nucleotide sequence identical or highly similar to the nucleotide sequence of VGAM2502 precursor RNA is designated SEQ ID:2488, and is provided hereinbelow with reference to the sequence listing part. Nucleotide sequence SEQ ID:2488 is located at position 192021 relative to the genome of Mouse Cytomegalovirus 1.

VGAM2502 precursor RNA folds onto itself, forming VGAM2502 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2502 folded precursor RNA into VGAM2502 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2502 RNA is designated SEQ ID:5213, and is provided hereinbelow with reference to the sequence listing part.

VGAM2502 host target gene, herein designated VGAM HOST TARGET GENE, encodes a corresponding messenger RNA, VGAM2502 host target RNA, herein designated VGAM HOST TARGET RNA. VGAM2502 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2502 RNA, herein designated VGAM RNA, binds complementarily to one or more host target binding sites located in untranslated regions of VGAM2502 host target RNA, herein designated VGAM HOST TARGET RNA. This complementary binding is due to the fact that the nucleotide sequence of VGAM2502 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2502 RNA, herein designated VGAM RNA, may have a different number of host target binding sites in untranslated regions of a VGAM2502 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2502 RNA, herein designated VGAM RNA, to host target binding sites on VGAM2502 host target RNA, herein designated VGAM HOST TARGET RNA, such as BINDING SITE I, BINDING SITE II and BINDING SITE III, inhibits translation of VGAM2502 host target RNA into VGAM2502 host target protein, herein designated VGAM HOST TARGET PROTEIN. VGAM host target protein is therefore outlined by a broken line.

It is appreciated that VGAM2502 host target gene, herein designated VGAM HOST TARGET GENE, in fact represents a plurality of VGAM2502 host target genes. The mRNA of each one of this plurality of VGAM2502 host target genes comprises one or more host target binding sites, each having a nucleotide sequence which is at least partly complementary to VGAM2502 RNA, herein designated VGAM RNA, and which when bound by VGAM2502 RNA causes inhibition of translation of respective one or more VGAM2502 host target proteins.

It is further appreciated by one skilled in the art that the mode of translational inhibition illustrated by FIG. 1 with specific reference to translational inhibition exerted by VGAM2502 gene, herein designated VGAM GENE, on one or more VGAM2502 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2502 is inhibition of expression of host target genes, as part of a novel viral mechanism of attacking a host. Accordingly, utilities of VGAM2502 include diagnosis, prevention and treatment of viral infection by Mouse Cytomegalovirus 1. Specific functions, and accordingly utilities, of VGAM2502 correlate with, and may be deduced from, the identity of the host target genes which VGAM2502 binds and inhibits, and the function of these host target genes, as elaborated hereinbelow.

Nucleotide sequences of the VGAM2502 precursor RNA, herein designated VGAM PRECURSOR RNA, and of the 'diced' VGAM2502 RNA, herein designated VGAM RNA, and a schematic representation of the secondary folding of VGAM2502 folded precursor RNA, herein designated VGAM FOLDED PRECURSOR RNA, of VGAM2502 are further described hereinbelow with reference to Table 1.

Nucleotide sequences of host target binding sites, such as BINDING SITE-I, BINDING SITE-II and BINDING SITE-III of FIG. 1, found on VGAM2502 host target RNA, and schematic representation of the complementarity of each of these host target binding sites to VGAM2502 RNA, herein designated VGAM RNA, are described hereinbelow with reference to Table 2.

As mentioned hereinabove with reference to FIG. 1, a function of VGAM2502 gene, herein designated VGAM is inhibition of expression of VGAM2502 target genes. It is appreciated that specific functions, and accordingly utilities, of VGAM2502 correlate with, and may be deduced from, the identity of the target genes which VGAM2502 binds and inhibits, and the function of these target genes, as elaborated hereinbelow.

Dual Specificity Phosphatase 7 (DUSP7, Accession XM_037430) is a VGAM2502 host target gene. DUSP7 BINDING SITE is HOST TARGET binding site found in the 5' untranslated region of mRNA encoded by DUSP7, corresponding to a HOST TARGET binding site such as BINDING SITE I, BINDING SITE II or BINDING SITE III. Table 2 illustrates the complementarity of the nucleotide sequences of DUSP7 BINDING SITE, designated SEQ ID:32614, to the nucleotide sequence of VGAM2502 RNA, herein designated VGAM RNA, also designated SEQ ID:5213.

A function of VGAM2502 is therefore inhibition of Dual Specificity Phosphatase 7 (DUSP7, Accession XM_037430), a gene which is a member of the dual specificity protein phosphatase family. Accordingly, utilities of VGAM2502 include diagnosis, prevention and treatment of diseases and clinical conditions associated with DUSP7. The function of DUSP7 has been established by previous studies. Members of the mitogen-activated protein (MAP) kinase family play a pivotal role in cellular signal transduction. The dual-specificity phosphatases can reverse MAP kinase activation by dephosphorylating critical phosphotyrosine and phosphothreonine residues. Muda et al. (1996) identified rat superior cervical ganglion cDNAs encoding 2 dual-specificity phosphatases that they designated MKP3 (OMIM Ref. No. 602748) and MKPX. The predicted 280-amino acid sequence of the partial MKPX cDNA was 76% identical to that of MKP3. Groom et al. (1996) identified cDNAs encoding the human MKP3 and MKPX homologs, which they called PYST1 and PYST2, respectively. The predicted amino acid sequence of the partial PYST2 cDNA was 73% identical to that of PYST1. Northern analysis revealed that the 3.5-kb PYST2 mRNA was expressed at low levels in several tissues. In liver, Groom et al. (1996) observed strong expression of a 2.5-kb transcript and much weaker expression of a 5-kb transcript.

Full details of the abovementioned studies are described in the following publications, the disclosure of which are hereby incorporated by reference:

Groom, L. A.; Sneddon, A. A.; Alessi, D. R.; Dowd, S.; Keyse, S. M.: Differential regulation of the MAP, SAP and Rk/p38 kinases by Pyst1, a novel cytosolic dual-specificity phosphatase. EMBO J. 15:3621-3632, 1996; and Muda, M.; Boschert, U.; Dickinson, R.; Martinou, J.-C.; Martinou, I.; Camps, M.; Schlegel, W.; Arkinstall, S.: MKP-3, a novel cytosolic protein-tyrosine phosphatase that exemplifies a.

Further studies establishing the function and utilities of DUSP7 are found in John Hopkins OMIM database record ID 602749, and in sited publications numbered 2411-2413 listed in the bibliography section hereinbelow, which are also hereby incorporated by reference. Myeloid/lymphoid Or Mixed-lineage Leukemia (trithorax homolog, Drosophila); Translocated To, 2 (MLLT2, Accession NM_005935) is another VGAM2502 host target gene. MLLT2 BINDING SITE is HOST TARGET binding site found in the 5' untranslated region of mRNA encoded by MLLT2, corresponding to a HOST TARGET binding site such as BINDING SITE I, BINDING SITE II or BINDING SITE III. Table 2 illustrates the complementarity of the nucleotide sequences of MLLT2 BINDING SITE, designated SEQ ID:12567, to the nucleotide sequence of VGAM2502 RNA, herein designated VGAM RNA, also designated SEQ ID:5213.

Another function of VGAM2502 is therefore inhibition of Myeloid/lymphoid Or Mixed-lineage Leukemia (trithorax homolog, Drosophila); Translocated To, 2 (MLLT2, Accession NM_005935), a gene which is a Putative transcription factor. Accordingly, utilities of VGAM2502 include diagnosis, prevention and treatment of diseases and clinical conditions associated with MLLT2. The function of MLLT2 and its association with various diseases and clinical conditions, has been established by previous studies, as described hereinabove with reference to VGAM57. FLJ12132 (Accession NM_024980) is another VGAM2502 host target gene. FLJ12132 BINDING SITE is HOST TARGET binding site found in the 5' untranslated region of mRNA encoded by FLJ12132, corresponding to a HOST TARGET binding site such as BINDING SITE I, BINDING SITE II or BINDING SITE III. Table 2 illustrates the complementarity of the nucleotide sequences of FLJ12132 BINDING SITE, designated SEQ ID:24541, to the nucleotide sequence of VGAM2502 RNA, herein designated VGAM RNA, also designated SEQ ID:5213.

Another function of VGAM2502 is therefore inhibition of FLJ12132 (Accession NM_024980). Accordingly, utilities of VGAM2502 include diagnosis, prevention and treatment of diseases and clinical conditions associated with FLJ12132. FLJ20306 (Accession NM_017756) is another VGAM2502 host target gene. FLJ20306 BINDING SITE is HOST TARGET binding site found in the 3' untranslated region of mRNA encoded by FLJ20306, corresponding to a HOST TARGET binding site such as BINDING SITE I, BINDING SITE II or BINDING SITE III. Table 2 illustrates the complementarity of the nucleotide sequences of FLJ20306 BINDING SITE, designated SEQ ID:19367, to the nucleotide sequence of VGAM2502 RNA, herein designated VGAM RNA, also designated SEQ ID:5213.

Another function of VGAM2502 is therefore inhibition of FLJ20306 (Accession NM_017756). Accordingly, utilities of VGAM2502 include diagnosis, prevention and treatment of diseases and clinical conditions associated with FLJ20306. FIG. 1 further provides a conceptual description of a novel bioinformatically detected viral gene of the present invention, referred to here as Viral Genomic Address Messenger 2503 (VGAM2503) viral gene, which modulates expression of respective host target genes thereof, the function and utility of which host target genes is known in the art.

VGAM2503 is a novel bioinformatically detected regulatory, non protein coding, viral micro RNA (miRNA) gene. The method by which VGAM2503 was detected is described hereinabove with reference to FIGS. 1-8.

VGAM2503 gene, herein designated VGAM GENE, is a viral gene contained in the genome of Mouse Cytomegalovirus 1. VGAM2503 host target gene, herein designated VGAM HOST TARGET GENE, is a human gene contained in the human genome.

VGAM2503 gene encodes a VGAM2503 precursor RNA, herein designated VGAM PRECURSOR RNA. Similar to other miRNA genes, and unlike most ordinary genes, VGAM2503 precursor RNA does not encode a protein. A nucleotide sequence identical or highly similar to the nucleotide sequence of VGAM2503 precursor RNA is designated SEQ ID:2489, and is provided hereinbelow with reference to the sequence listing part. Nucleotide sequence SEQ ID:2489 is located at position 125983 relative to the genome of Mouse Cytomegalovirus 1.

VGAM2503 precursor RNA folds onto itself, forming VGAM2503 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2503 folded precursor RNA into VGAM2503 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM2503 RNA is designated SEQ ID:5214, and is provided hereinbelow with reference to the sequence listing part.

VGAM2503 host target gene, herein designated VGAM HOST TARGET GENE, encodes a corresponding messenger RNA, VGAM2503 host target RNA, herein designated VGAM HOST TARGET RNA. VGAM2503 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2503 RNA, herein designated VGAM RNA, binds complementarily to one or more host target binding sites located in untranslated regions of VGAM2503 host target RNA, herein designated VGAM HOST TARGET RNA. This complementary binding is due to the fact that the nucleotide sequence of VGAM2503 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2503 RNA, herein designated VGAM RNA, may have a different number of host target binding sites in untranslated regions of a VGAM2503 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2503 RNA, herein designated VGAM RNA, to host target binding sites on VGAM2503 host target RNA, herein designated VGAM HOST TARGET RNA, such as BINDING SITE I, BINDING SITE II and BINDING SITE III, inhibits translation of VGAM2503 host target RNA into VGAM2503 host target protein, herein designated VGAM HOST TARGET PROTEIN. VGAM host target protein is therefore outlined by a broken line.

It is appreciated that VGAM2503 host target gene, herein designated VGAM HOST TARGET GENE, in fact represents a plurality of VGAM2503 host target genes. The mRNA of each one of this plurality of VGAM2503 host target genes comprises one or more host target binding sites, each having a nucleotide sequence which is at least partly complementary to VGAM2503 RNA, herein designated VGAM RNA, and which when bound by VGAM2503 RNA causes inhibition of translation of respective one or more VGAM2503 host target proteins.

It is further appreciated by one skilled in the art that the mode of translational inhibition illustrated by FIG. 1 with specific reference to translational inhibition exerted by VGAM2503 gene, herein designated VGAM GENE, on one or more VGAM2503 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2503 is inhibition of expression of host target genes, as part of a novel viral mechanism of attacking a host. Accordingly, utilities of VGAM2503 include diagnosis, prevention and treatment of viral infection by Mouse Cytomegalovirus 1. Specific functions, and accordingly utilities, of VGAM2503 correlate with, and may be deduced from, the identity of the host target genes which VGAM2503 binds and inhibits, and the function of these host target genes, as elaborated hereinbelow.

Nucleotide sequences of the VGAM2503 precursor RNA, herein designated VGAM PRECURSOR RNA, and of the 'diced' VGAM2503 RNA, herein designated VGAM RNA, and a schematic representation of the secondary folding of VGAM2503 folded precursor RNA, herein designated VGAM FOLDED PRECURSOR RNA, of VGAM2503 are further described hereinbelow with reference to Table 1.

Nucleotide sequences of host target binding sites, such as BINDING SITE-I, BINDING SITE-II and BINDING SITE-III of FIG. 1, found on VGAM2503 host target RNA, and schematic representation of the complementarity of each of these host target binding sites to VGAM2503 RNA, herein designated VGAM RNA, are described hereinbelow with reference to Table 2.

As mentioned hereinabove with reference to FIG. 1, a function of VGAM2503 gene, herein designated VGAM is inhibition of expression of VGAM2503 target genes. It is appreciated that specific functions, and accordingly utilities, of VGAM2503 correlate with, and may be deduced from, the identity of the target genes which VGAM2503 binds and inhibits, and the function of these target genes, as elaborated hereinbelow.

Carboxyl Ester Lipase-like (bile salt-stimulated lipase-like) (CELL, Accession NM_001808) is a VGAM2503 host target gene. CELL BINDING SITE is HOST TARGET binding site found in the 3' untranslated region of mRNA encoded by CELL, corresponding to a HOST TARGET binding site such as BINDING SITE I, BINDING SITE II or BINDING SITE III. Table 2 illustrates the complementarity of the nucleotide sequences of CELL BINDING SITE, designated SEQ ID:7558, to the nucleotide sequence of VGAM2503 RNA, herein designated VGAM RNA, also designated SEQ ID:5214.

A function of VGAM2503 is therefore inhibition of Carboxyl Ester Lipase-like (bile salt-stimulated lipase-like) (CELL, Accession NM_001808), a gene which is a Carboxyl ester lipase-like protein. Accordingly, utilities of VGAM2503 include diagnosis, prevention and treatment of diseases and clinical conditions associated with CELL. The function of CELL has been established by previous studies. The human lactating mammary gland and pancreas produce a lipolytic enzyme, carboxyl ester lipase (CEL; 114840), earlier called bile salt-stimulated lipase. The enzyme exerts its function in duodenal juice, is activated when mixed with bile salts, and plays an important role in the digestion of milk fat in newborn infants. Lidberg et al. (1992) described the genomic organization of the CEL gene and proposed the presence of a transcribed pseudogene, designated carboxyl ester lipase-like gene (CELL). The existence of the CELL gene was confirmed by Kumar et al. (1992). The main difference between CEL and CELL is that the latter lacks a 4.8-kb fragment, including exons 2-7. Furthermore, in the coding sequence, several differences are found in exons 10 and 11. The remaining coding regions are identical in the 2 genes. The intron sequences of the genes show a 97.5% homology. The CELL gene does not include exon 5, in which the active serine is located, indicating that the product of this gene cannot be a lipase. Nilsson et al. (1993) found that in contrast to the CEL gene, CELL is expressed in low amounts in all tissues analyzed. They found that the average length of the cDNA for CELL is 1,214 bases. This sequence includes several termination codons in all 3 reading frames. The longest open reading frame with the same start of translation as that of the CEL transcript could encode a 59-amino acid-long peptide, presumably without any function. The CELL gene may have arisen as a result of gene duplication of the CEL gene followed by deletions and point mutations. A hypervariable region was characterized in the last exon of the CELL gene. Nilsson et al. (1993) suggested that this polymorphism would be useful for linkage analysis. Taylor et al. (1991) suggested that the CEL gene contains a hypervariable region, according to results obtained by Southern blotting. Most processed pseudogenes (Vanin, 1985) are transcriptionally silent; transcribed pseudogenes are rare because once the coding information of a particular gene is inactivated by a mutational event, further mutation of promoter sequences would not be selected against. Two known pseudogenes that retained their ability to be transcribed are the high-affinity dopamine receptor pseudogene (Weinshank et al., 1991) and the murine glyceraldhyde-3-phosphate dehydrogenase pseudogene (Galland et al., 1990). These genes may have arisen through gene duplication followed by several mutations. Thus, even though these genes are expressed, they will not give rise to functional protein. Nilsson et al. (1993) stated that 'the CEL gene and the CELL gene were mapped to the same region of chromosome 9,' namely, 9q34.3.

Full details of the abovementioned studies are described in the following publications, the disclosure of which are hereby incorporated by reference:

Lidberg, U.; Nilsson, J.; Stromberg, K.; Stenman, G.; Sahlin, P.; Enerback, S.; Bjursell, G.: Genomic organization, sequence analysis, and chromosomal localization of the human carboxyl ester lipase (CEL) gene and a CEL-like (CELL) gene. Genomics 13:630-640, 1992; and Lidmer, A.-S.; Kannius, M.; Lundberg, L.; Bjursell, G.; Nilsson, J.: Molecular cloning and characterization of the mouse carboxyl ester lipase gene and evidence for expression in the l.

Further studies establishing the function and utilities of CELL are found in John Hopkins OMIM database record ID 114841, and in sited publications numbered 4230-4229, 4231-423 and 2037 listed in the bibliography section hereinbelow, which are also hereby incorporated by reference. Lamin A/C (LMNA, Accession NM_005572) is another VGAM2503 host target gene. LMNA BINDING SITE is HOST TARGET binding site found in the 5' untranslated region of mRNA encoded by LMNA, corresponding to a HOST TARGET binding site such as BINDING SITE I, BINDING SITE II or BINDING SITE III. Table 2 illustrates the complementarity of the nucleotide sequences of LMNA BINDING SITE, designated SEQ ID:12099, to the nucleotide sequence of VGAM2503 RNA, herein designated VGAM RNA, also designated SEQ ID:5214.

Another function of VGAM2503 is therefore inhibition of Lamin A/C (LMNA, Accession NM_005572), a gene which is thought to provide a framework for the nuclear envelope and may also interact with chromatin. Accordingly, utilities of VGAM2503 include diagnosis, prevention and treatment of diseases and clinical conditions associated with LMNA. The function of LMNA has been established by previous studies. The nuclear lamina is a proteinaceous layer apposed to the inner nuclear membrane. It is composed of a family of polypeptides, the lamins, highly conserved in evolution (Krohne and Benavente, 1986). In mammals, 3 lamins, A, B, and C, have been described, with molecular weights ranging from 60,000 to 78,000. Lamins A and C but not lamin B have close sequence homology. During mitosis, the lamina meshwork is reversibly disassembled in parallel with phosphorylation of the lamins. Lamins can be classified with the intermediate filament (IF) polypeptides. Guilly et al. (1987) demonstrated that lamin B was the only lamin present in T lymphoblasts. The mRNAs of lamins A and C were detected in HeLa cells. The transport of newly-synthesized proteins from the cytoplasm into the nucleus differs from the transport of proteins into other organelles such as mitochondria by 1 important feature: sequences are not cleaved but remain a permanent feature of the mature polypeptide. One exception to this rule, however, appears to be lamin A. Lebel and Raymond (1987) concluded that lamin A is not synthesized as a large precursor polypeptide Complementary DNA cloning and sequencing showed that human lamins A and C are identical for the first 566 amino acids (McKeon et al., 1986; Fisher et al., 1986). Pre-lamin A, from which the last 18 amino acids are proteolytically removed to yield lamin A, has 98 unique carboxy-terminal amino acids. Lamin C has 6 unique carboxy-terminal amino acids. Because pre-lamin A contains a CAAX (cysteine-aliphatic-aliphatic-any amino acid) box at its carboxyl terminus, it can be modified by farnesylation, whereas lamin C cannot. The sequence similarities and data obtained from Southern blotting (McKeon et al., 1986) suggested that lamin A and lamin C arise from 1 gene by alternative splicing. Lin and Worman (1993) demonstrated that the coding region of the lamin A/C gene spans approximately 24 kb and contains 12 exons. Alternative splicing within exon 10 gives rise to 2 different mRNAs that code for pre-lamin A and lamin C Full details of the abovementioned studies are described in the following publications, the disclosure of which are hereby incorporated by reference:

Lebel, S.; Raymond, Y.: Lamin A is not synthesized as a larger precursor polypeptide. Biochem. Biophys. Res. Commun. 149:417-423, 1987; and Lin, F.; Worman, H. J.: Structural organization of the human gene encoding nuclear lamin A and nuclear lamin C. J. Biol. Chem. 268:16321-16326, 1993.

Further studies establishing the function and utilities of LMNA are found in John Hopkins OMIM database record ID 150330, and in sited publications numbered 3843, 12466-1248 and 12699 listed in the bibliography section hereinbelow, which are also hereby incorporated by reference. NHP2 Non-histone Chromosome Protein 2-like 1 (S. cerevisiae) (NHP2L1, Accession NM_005008) is another VGAM2503 host target gene. NHP2L1 BINDING SITE is HOST TARGET binding site found in the 3' untranslated region of mRNA encoded by NHP2L1, corresponding to a HOST TARGET binding site such as BINDING SITE I, BINDING SITE II or BINDING SITE III. Table 2 illustrates the complementarity of the nucleotide sequences of NHP2L1 BINDING SITE, designated SEQ ID:11444, to the nucleotide sequence of VGAM2503 RNA, herein designated VGAM RNA, also designated SEQ ID:5214.

Another function of VGAM2503 is therefore inhibition of NHP2 Non-histone Chromosome Protein 2-like 1 (S. cerevisiae) (NHP2L1, Accession NM_005008), a gene which may play a role in the late stage of spliceosome assembly. Accordingly, utilities of VGAM2503 include diagnosis, prevention and treatment of diseases and clinical conditions associated with NHP2L1. The function of NHP2L1 and its association with various diseases and clinical conditions, has been established by previous studies, as described hereinabove with reference to VGAM1923. RAN Binding Protein 3 (RANBP3, Accession NM_003624) is another VGAM2503 host target gene. RANBP3 BINDING SITE is HOST TARGET binding site found in the 3' untranslated region of mRNA encoded by RANBP3, corresponding to a HOST TARGET binding site such as BINDING SITE I, BINDING SITE II or BINDING SITE III. Table 2 illustrates the complementarity of the nucleotide sequences of RANBP3 BINDING SITE, designated SEQ ID:9689, to the nucleotide sequence of VGAM2503 RNA, herein designated VGAM RNA, also designated SEQ ID:5214.

Another function of VGAM2503 is therefore inhibition of RAN Binding Protein 3 (RANBP3, Accession NM_003624). Accordingly, utilities of VGAM2503 include diagnosis, prevention and treatment of diseases and clinical conditions associated with RANBP3. Usher Syndrome 3A (USH3A, Accession NM_052995) is another VGAM2503 host target gene. USH3A BINDING SITE is HOST TARGET binding site found in the 5' untranslated region of mRNA encoded by USH3A, corresponding to a HOST TARGET binding site such as BINDING SITE I, BINDING SITE II or BINDING SITE III. Table 2 illustrates the complementarity of the nucleotide sequences of USH3A BINDING SITE, designated SEQ ID:27564, to the nucleotide sequence of VGAM2503 RNA, herein designated VGAM RNA, also designated SEQ ID:5214.

Another function of VGAM2503 is therefore inhibition of Usher Syndrome 3A (USH3A, Accession NM_052995). Accordingly, utilities of VGAM2503 include diagnosis, prevention and treatment of diseases and clinical conditions associated with USH3A. Chromosome 20 Open Reading Frame 121 (C20orf121, Accession NM_024331) is another VGAM2503 host target gene. C20orf121 BINDING SITE is HOST TARGET binding site found in the 5' untranslated region of mRNA encoded by C20orf121, corresponding to a HOST TARGET binding site such as BINDING SITE I, BINDING SITE II or BINDING SITE III. Table 2 illustrates the complementarity of the nucleotide sequences of C20orf121 BINDING SITE, designated SEQ ID:23634, to the nucleotide sequence of VGAM2503 RNA, herein designated VGAM RNA, also designated SEQ ID:5214.

Another function of VGAM2503 is therefore inhibition of Chromosome 20 Open Reading Frame 121 (C20orf121, Accession NM_024331). Accordingly, utilities of VGAM2503 include diagnosis, prevention and treatment of diseases and clinical conditions associated with C20orf121. DKFZP434K028 (Accession XM_167745) is another VGAM2503 host target gene. DKFZP434K028 BINDING SITE is HOST TARGET binding site found in the 3' untranslated region of mRNA encoded by DKFZP434K028, corresponding to a HOST TARGET binding site such as BINDING SITE I, BINDING SITE II or BINDING SITE III. Table 2 illustrates the complementarity of the nucleotide sequences of DKFZP434K028 BINDING SITE, designated SEQ ID:44772, to the nucleotide sequence of VGAM2503 RNA, herein designated VGAM RNA, also designated SEQ ID:5214.

Another function of VGAM2503 is therefore inhibition of DKFZP434K028 (Accession XM_167745). Accordingly, utilities of VGAM2503 include diagnosis, prevention and treatment of diseases and clinical conditions associated with DKFZP434K028. FLJ10847 (Accession NM_018242) is another VGAM2503 host target gene. FLJ10847 BINDING SITE is HOST TARGET binding site found in the 3' untranslated region of mRNA encoded by FLJ10847, corresponding to a HOST TARGET binding site such as BINDING SITE I, BINDING SITE II or BINDING SITE III. Table 2 illustrates the complementarity of the nucleotide sequences of FLJ10847 BINDING SITE, designated SEQ ID:20202, to the nucleotide sequence of VGAM2503 RNA, herein designated VGAM RNA, also designated SEQ ID:5214.

Another function of VGAM2503 is therefore inhibition of FLJ10847 (Accession NM_018242). Accordingly, utilities of VGAM2503 include diagnosis, prevention and treatment of diseases and clinical conditions associated with FLJ10847. FLJ13490 (Accession NM_024942) is another VGAM2503 host target gene. FLJ13490 BINDING SITE is HOST TARGET binding site found in the 3' untranslated region of mRNA encoded by FLJ13490, corresponding to a HOST TARGET binding site such as BINDING SITE I, BINDING SITE II or BINDING SITE III. Table 2 illustrates the complementarity of the nucleotide sequences of FLJ13490 BINDING SITE, designated SEQ ID:24487, to the nucleotide sequence of VGAM2503 RNA, herein designated VGAM RNA, also designated SEQ ID:5214.

Another function of VGAM2503 is therefore inhibition of FLJ13490 (Accession NM_024942). Accordingly, utilities of VGAM2503 include diagnosis, prevention and treatment of diseases and clinical conditions associated with FLJ13490. MDS006 (Accession NM_020233) is another VGAM2503 host target gene. MDS006 BINDING SITE is HOST TARGET binding site found in the 3' untranslated region of mRNA encoded by MDS006, corresponding to a HOST TARGET binding site such as BINDING SITE I, BINDING SITE II or BINDING SITE III. Table 2 illustrates the complementarity of the nucleotide sequences of MDS006 BINDING SITE, designated SEQ ID:21503, to the nucleotide sequence of VGAM2503 RNA, herein designated VGAM RNA, also designated SEQ ID:5214.

Another function of VGAM2503 is therefore inhibition of MDS006 (Accession NM_020233). Accordingly, utilities of VGAM2503 include diagnosis, prevention and treatment of diseases and clinical conditions associated with MDS006. MGC15873 (Accession NM_032920) is another VGAM2503 host target gene. MGC15873 BINDING SITE is HOST TARGET binding site found in the 3' untranslated region of mRNA encoded by MGC15873, corresponding to a HOST TARGET binding site such as BINDING SITE I, BINDING SITE II or BINDING SITE III. Table 2 illustrates the complementarity of the nucleotide sequences of MGC15873 BINDING SITE, designated SEQ ID:26743, to the nucleotide sequence of VGAM2503 RNA, herein designated VGAM RNA, also designated SEQ ID:5214.

Another function of VGAM2503 is therefore inhibition of MGC15873 (Accession NM_032920). Accordingly, utilities of VGAM2503 include diagnosis, prevention and treatment of diseases and clinical conditions associated with MGC15873. SCAM-1 (Accession NM_005775) is another VGAM2503 host target gene. SCAM-1 BINDING SITE is HOST TARGET binding site found in the 3' untranslated region of mRNA encoded by SCAM-1, corresponding to a HOST TARGET binding site such as BINDING SITE I, BINDING SITE II or BINDING SITE III. Table 2 illustrates the complementarity of the nucleotide sequences of SCAM-1 BINDING SITE, designated SEQ ID:12351, to the nucleotide sequence of VGAM2503 RNA, herein designated VGAM RNA, also designated SEQ ID:5214.

Another function of VGAM2503 is therefore inhibition of SCAM-1 (Accession NM_005775). Accordingly, utilities of VGAM2503 include diagnosis, prevention and treatment of diseases and clinical conditions associated with SCAM-1. SMOC2 (Accession XM_051452) is another VGAM2503 host target gene. SMOC2 BINDING SITE is HOST TARGET binding site found in the 3' untranslated region of mRNA encoded by SMOC2, corresponding to a HOST TARGET binding site such as BINDING SITE I, BINDING SITE II or BINDING SITE III. Table 2 illustrates the complementarity of the nucleotide sequences of SMOC2 BINDING SITE, designated SEQ ID:35837, to the nucleotide sequence of VGAM2503 RNA, herein designated VGAM RNA, also designated SEQ ID:5214.

Another function of VGAM2503 is therefore inhibition of SMOC2 (Accession XM_051452). Accordingly, utilities of VGAM2503 include diagnosis, prevention and treatment of diseases and clinical conditions associated with SMOC2. Tousled-like Kinase 2 (TLK2, Accession XM_085650) is another VGAM2503 host target gene. TLK2 BINDING SITE is HOST TARGET binding site found in the 5' untranslated region of mRNA encoded by TLK2, corresponding to a HOST TARGET binding site such as BINDING SITE I, BINDING SITE II or BINDING SITE III. Table 2 illustrates the complementarity of the nucleotide sequences of TLK2 BINDING SITE, designated SEQ ID:38275, to the nucleotide sequence of VGAM2503 RNA, herein designated VGAM RNA, also designated SEQ ID:5214.

Another function of VGAM2503 is therefore inhibition of Tousled-like Kinase 2 (TLK2, Accession XM_085650). Accordingly, utilities of VGAM2503 include diagnosis, prevention and treatment of diseases and clinical conditions associated with TLK2. LOC144587 (Accession XM_040195) is another VGAM2503 host target gene. LOC144587 BINDING SITE is HOST TARGET binding site found in the 5' untranslated region of mRNA encoded by LOC144587, corresponding to a HOST TARGET binding site such as BINDING SITE I, BINDING SITE II or BINDING SITE III. Table 2 illustrates the complementarity of the nucleotide sequences of LOC144587 BINDING SITE, designated SEQ ID:33270, to the nucleotide sequence of VGAM2503 RNA, herein designated VGAM RNA, also designated SEQ ID:5214.

Another function of VGAM2503 is therefore inhibition of LOC144587 (Accession XM_040195). Accordingly, utilities of VGAM2503 include diagnosis, prevention and treatment of diseases and clinical conditions associated with LOC144587. LOC146802 (Accession XM_085595) is another VGAM2503 host target gene. LOC146802 BINDING SITE is HOST TARGET binding site found in the 3' untranslated region of mRNA encoded by LOC146802, corresponding to a HOST TARGET binding site such as BINDING SITE I, BINDING SITE II or BINDING SITE III. Table 2 illustrates the complementarity of the nucleotide sequences of LOC146802 BINDING SITE, designated SEQ ID:38247, to the nucleotide sequence of VGAM2503 RNA, herein designated VGAM RNA, also designated SEQ ID:5214.

Another function of VGAM2503 is therefore inhibition of LOC146802 (Accession XM_085595). Accordingly, utilities of VGAM2503 include diagnosis, prevention and treatment of diseases and clinical conditions associated with LOC146802. LOC147841 (Accession XM_085924) is another VGAM2503 host target gene. LOC147841 BINDING SITE is HOST TARGET binding site found in the 5' untranslated region of mRNA encoded by LOC147841, corresponding to a HOST TARGET binding site such as BINDING SITE I, BINDING SITE II or BINDING SITE III. Table 2 illustrates the complementarity of the nucleotide sequences of LOC147841 BINDING SITE, designated SEQ ID:38398, to the nucleotide sequence of VGAM2503 RNA, herein designated VGAM RNA, also designated SEQ ID:5214.

Another function of VGAM2503 is therefore inhibition of LOC147841 (Accession XM_085924). Accordingly, utilities of VGAM2503 include diagnosis, prevention and treatment of diseases and clinical conditions associated with LOC147841. LOC202986 (Accession XM_117489) is another VGAM2503 host target gene. LOC202986 BINDING SITE is HOST TARGET binding site found in the 5' untranslated region of mRNA encoded by LOC202986, corresponding to a HOST TARGET binding site such as BINDING SITE I, BINDING SITE II or BINDING SITE III. Table 2 illustrates the complementarity of the nucleotide sequences of LOC202986 BINDING SITE, designated SEQ ID:43471, to the nucleotide sequence of VGAM2503 RNA, herein designated VGAM RNA, also designated SEQ ID:5214.

Another function of VGAM2503 is therefore inhibition of LOC202986 (Accession XM_117489). Accordingly, utilities of VGAM2503 include diagnosis, prevention and treatment of diseases and clinical conditions associated with LOC202986. LOC221474 (Accession XM_166464) is another VGAM2503 host target gene. LOC221474 BINDING SITE is HOST TARGET binding site found in the 5' untranslated region of mRNA encoded by LOC221474, corresponding to a HOST TARGET binding site such as BINDING SITE I, BINDING SITE II or BINDING SITE III. Table 2 illustrates the complementarity of the nucleotide sequences of LOC221474 BINDING SITE, designated SEQ ID:44377, to the nucleotide sequence of VGAM2503 RNA, herein designated VGAM RNA, also designated SEQ ID:5214.

Another function of VGAM2503 is therefore inhibition of LOC221474 (Accession XM_166464). Accordingly, utilities of VGAM2503 include diagnosis, prevention and treatment of diseases and clinical conditions associated with LOC221474. FIG. 1 further provides a conceptual description of a novel bioinformatically detected viral gene of the present invention, referred to here as Viral Genomic Address Messenger 2504 (VGAM2504) viral gene, which modulates expression of respective host target genes thereof, the function and utility of which host target genes is known in the art.

VGAM2504 is a novel bioinformatically detected regulatory, non protein coding, viral micro RNA (miRNA) gene. The method by which VGAM2504 was detected is described hereinabove with reference to FIGS. 1-8.

VGAM2504 gene, herein designated VGAM GENE, is a viral gene contained in the genome of Mouse Cytomegalovirus 1. VGAM2504 host target gene, herein designated VGAM HOST TARGET GENE, is a human gene contained in the human genome.

VGAM2504 gene encodes a VGAM2504 precursor RNA, herein designated VGAM PRECURSOR RNA. Similar to other miRNA genes, and unlike most ordinary genes, VGAM2504 precursor RNA does not encode a protein. A nucleotide sequence identical or highly similar to the nucleotide sequence of VGAM2504 precursor RNA is designated SEQ ID:2490, and is provided hereinbelow with reference to the sequence listing part. Nucleotide sequence SEQ ID:2490 is located at position 179418 relative to the genome of Mouse Cytomegalovirus 1.

VGAM2504 precursor RNA folds onto itself, forming VGAM2504 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2504 folded precursor RNA into VGAM2504 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2504 RNA is designated SEQ ID:5215, and is provided hereinbelow with reference to the sequence listing part.

VGAM2504 host target gene, herein designated VGAM HOST TARGET GENE, encodes a corresponding messenger RNA, VGAM2504 host target RNA, herein designated VGAM HOST TARGET RNA. VGAM2504 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2504 RNA, herein designated VGAM RNA, binds complementarily to one or more host target binding sites located in untranslated regions of VGAM2504 host target RNA, herein designated VGAM HOST TARGET RNA. This complementary binding is due to the fact that the nucleotide sequence of VGAM2504 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2504 RNA, herein designated VGAM RNA, may have a different number of host target binding sites in untranslated regions of a VGAM2504 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2504 RNA, herein designated VGAM RNA, to host target binding sites on VGAM2504 host target RNA, herein designated VGAM HOST TARGET RNA, such as BINDING SITE I, BINDING SITE II and BINDING SITE III, inhibits translation of VGAM2504 host target RNA into VGAM2504 host target protein, herein designated VGAM HOST TARGET PROTEIN. VGAM host target protein is therefore outlined by a broken line.

It is appreciated that VGAM2504 host target gene, herein designated VGAM HOST TARGET GENE, in fact represents a plurality of VGAM2504 host target genes. The mRNA of each one of this plurality of VGAM2504 host target genes comprises one or more host target binding sites, each having a nucleotide sequence which is at least partly complementary to VGAM2504 RNA, herein designated VGAM RNA, and which when bound by VGAM2504 RNA causes inhibition of translation of respective one or more VGAM2504 host target proteins.

It is further appreciated by one skilled in the art that the mode of translational inhibition illustrated by FIG. 1 with specific reference to translational inhibition exerted by VGAM2504 gene, herein designated VGAM GENE, on one or more VGAM2504 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2504 is inhibition of expression of host target genes, as part of a novel viral mechanism of attacking a host. Accordingly, utilities of VGAM2504 include diagnosis, prevention and treatment of viral infection by Mouse Cytomegalovirus 1. Specific functions, and accordingly utilities, of VGAM2504 correlate with, and may be deduced from, the identity of the host target genes which VGAM2504 binds and inhibits, and the function of these host target genes, as elaborated hereinbelow.

Nucleotide sequences of the VGAM2504 precursor RNA, herein designated VGAM PRECURSOR RNA, and of the 'diced' VGAM2504 RNA, herein designated VGAM RNA, and a schematic representation of the secondary folding of VGAM2504 folded precursor RNA, herein designated VGAM FOLDED PRECURSOR RNA, of VGAM2504 are further described hereinbelow with reference to Table 1.

Nucleotide sequences of host target binding sites, such as BINDING SITE-I, BINDING SITE-II and BINDING SITE-III of FIG. 1, found on VGAM2504 host target RNA, and schematic representation of the complementarity of each of these host target binding sites to VGAM2504 RNA, herein designated VGAM RNA, are described hereinbelow with reference to Table 2.

As mentioned hereinabove with reference to FIG. 1, a function of VGAM2504 gene, herein designated VGAM is inhibition of expression of VGAM2504 target genes. It is appreciated that specific functions, and accordingly utilities, of VGAM2504 correlate with, and may be deduced from, the identity of the target genes which VGAM2504 binds and inhibits, and the function of these target genes, as elaborated hereinbelow.

ATPase, Cu++ Transporting, Alpha Polypeptide (Menkes syndrome) (ATP7A, Accession NM_000052) is a VGAM2504 host target gene. ATP7A BINDING SITE is HOST TARGET binding site found in the 3' untranslated region of mRNA encoded by ATP7A, corresponding to a HOST TARGET binding site such as BINDING SITE I, BINDING SITE II or BINDING SITE III. Table 2 illustrates the complementarity of the nucleotide sequences of ATP7A BINDING SITE, designated SEQ ID:5500, to the nucleotide sequence of VGAM2504 RNA, herein designated VGAM RNA, also designated SEQ ID:5215.

A function of VGAM2504 is therefore inhibition of ATPase, Cu++ Transporting, Alpha Polypeptide (Menkes syndrome) (ATP7A, Accession NM_000052). Accordingly, utilities of VGAM2504 include diagnosis, prevention and treatment of diseases and clinical conditions associated with ATP7A. Dipeptidylpeptidase VI (DPP6, Accession NM_130797) is another VGAM2504 host target gene. DPP6

BINDING SITE is HOST TARGET binding site found in the 3' untranslated region of mRNA encoded by DPP6, corresponding to a HOST TARGET binding site such as BINDING SITE I, BINDING SITE II or BINDING SITE III. Table 2 illustrates the complementarity of the nucleotide sequences of DPP6 BINDING SITE, designated SEQ ID:28283, to the nucleotide sequence of VGAM2504 RNA, herein designated VGAM RNA, also designated SEQ ID:5215.

Another function of VGAM2504 is therefore inhibition of Dipeptidylpeptidase VI (DPP6, Accession NM_130797), a gene which may be involved in the physiological processes of brain function. Accordingly, utilities of VGAM2504 include diagnosis, prevention and treatment of diseases and clinical conditions associated with DPP6. The function of DPP6 has been established by previous studies. Wada et al. (1992) isolated cDNA clones for a dipeptidyl peptidase IV-related protein from bovine and rat brain libraries. Unlike dipeptidyl peptidase IV (OMIM Ref. No. 102720) which belongs to a family in which a serine, an aspartate, and a histidine form a catalytic triad, the DPPIV-related protein does not show the first serine residue. Yokotani et al. (1993) isolated the human homolog. Using a fragment of the bovine DPPX clone as a probe, Yokotani et al. (1993) mapped the human DPP6 gene to chromosome 7 by PCR analysis of somatic cell hybrids. Wada et al. (1993) showed that the mouse Dpp6 gene is linked to markers in the proximal end of chromosome 5 in a region of conserved synteny.

Full details of the abovementioned studies are described in the following publications, the disclosure of which are hereby incorporated by reference:

Wada, K.; Yokotani, N.; Hunter, C.; Doi, K.; Wenthold, R. J.; Shimasaki, S.: Differential expression of two distinct forms of mRNA encoding members of a dipeptidyl aminopeptidase family. Proc. Nat. Acad. Sci. 89:197-201, 1992; and Yokotani, N.; Doi, K.; Wenthold, R. J.; Wada, K.: Non-conservation of a catalytic residue in a depeptidyl aminopeptidase IV-related protein encoded by a gene on human chromosome 7. Hum.

Further studies establishing the function and utilities of DPP6 are found in John Hopkins OMIM database record ID 126141, and in sited publications numbered 4320-4322 listed in the bibliography section hereinbelow, which are also hereby incorporated by reference. EphA8 (EPHA8, Accession NM_020526) is another VGAM2504 host target gene. EPHA8 BINDING SITE is HOST TARGET binding site found in the 3' untranslated region of mRNA encoded by EPHA8, corresponding to a HOST TARGET binding site such as BINDING SITE I, BINDING SITE II or BINDING SITE III. Table 2 illustrates the complementarity of the nucleotide sequences of EPHA8 BINDING SITE, designated SEQ ID:21748, to the nucleotide sequence of VGAM2504 RNA, herein designated VGAM RNA, also designated SEQ ID:5215.

Another function of VGAM2504 is therefore inhibition of EphA8 (EPHA8, Accession NM_020526), a gene which Eph-related receptor tyrosine kinase A8. Accordingly, utilities of VGAM2504 include diagnosis, prevention and treatment of diseases and clinical conditions associated with EPHA8. The function of EPHA8 and its association with various diseases and clinical conditions, has been established by previous studies, as described hereinabove with reference to VGAM494. Huntingtin (Huntington disease) (HD, Accession NM_002111) is another VGAM2504 host target gene. HD BINDING SITE is HOST TARGET binding site found in the 3' untranslated region of mRNA encoded by HD, corresponding to a HOST TARGET binding site such as BINDING SITE I, BINDING SITE II or BINDING SITE III. Table 2 illustrates the complementarity of the nucleotide sequences of HD BINDING SITE, designated SEQ ID:7890, to the nucleotide sequence of VGAM2504 RNA, herein designated VGAM RNA, also designated SEQ ID:5215.

Another function of VGAM2504 is therefore inhibition of Huntingtin (Huntington disease) (HD, Accession NM_002111). Accordingly, utilities of VGAM2504 include diagnosis, prevention and treatment of diseases and clinical conditions associated with HD. MAX Interacting Protein 1 (MXI1, Accession NM_005962) is another VGAM2504 host target gene. MXI1 BINDING SITE1 and MXI1 BINDING SITE2 are HOST TARGET binding sites found in untranslated regions of mRNA encoded by MXI1, corresponding to HOST TARGET binding sites such as BINDING SITE I, BINDING SITE II or BINDING SITE III. Table 2 illustrates the complementarity of the nucleotide sequences of MXI1 BINDING SITE1 and MXI1 BINDING SITE2, designated SEQ ID:12583 and SEQ ID:28193 respectively, to the nucleotide sequence of VGAM2504 RNA, herein designated VGAM RNA, also designated SEQ ID:5215.

Another function of VGAM2504 is therefore inhibition of MAX Interacting Protein 1 (MXI1, Accession NM_005962), a gene which acts as a tumor suppressor in vivo, engages the MYC network in a functionally relevant manner. Accordingly, utilities of VGAM2504 include diagnosis, prevention and treatment of diseases and clinical conditions associated with MXI1. The function of MXI1 and its association with various diseases and clinical conditions, has been established by previous studies, as described hereinabove with reference to VGAM128. ARP1 Actin-related Protein 1 Homolog A, Centractin Alpha (yeast) (ACTR1A, Accession XM_031949) is another VGAM2504 host target gene. ACTR1A BINDING SITE is HOST TARGET binding site found in the 3" untranslated region of mRNA encoded by ACTR1A, corresponding to a HOST TARGET binding site such as BINDING SITE I, BINDING SITE II or BINDING SITE III. Table 2 illustrates the complementarity of the nucleotide sequences of ACTR1A BINDING SITE, designated SEQ ID:31530, to the nucleotide sequence of VGAM2504 RNA, herein designated VGAM RNA, also designated SEQ ID:5215.

Another function of VGAM2504 is therefore inhibition of ARP1 Actin-related Protein 1 Homolog A, Centractin Alpha (yeast) (ACTR1A, Accession XM_031949). Accordingly, utilities of VGAM2504 include diagnosis, prevention and treatment of diseases and clinical conditions associated with ACTR1A. Chemokine (C-C motif) Receptor 8 (CCR8, Accession NM_005201) is another VGAM2504 host target gene. CCR8 BINDING SITE is HOST TARGET binding site found in the 3' untranslated region of mRNA encoded by CCR8, corresponding to a HOST TARGET binding site such as BINDING SITE I, BINDING SITE II or BINDING SITE III. Table 2 illustrates the complementarity of the nucleotide sequences of CCR8 BINDING SITE, designated SEQ ID:11701, to the nucleotide sequence of VGAM2504 RNA, herein designated VGAM RNA, also designated SEQ ID:5215.

Another function of VGAM2504 is therefore inhibition of Chemokine (C-C motif) Receptor 8 (CCR8, Accession NM_005201). Accordingly, utilities of VGAM2504 include diagnosis, prevention and treatment of diseases and clinical conditions associated with CCR8. CIZ1 (Accession NM_012127) is another VGAM2504 host target gene. CIZ1 BINDING SITE is HOST TARGET binding site found in the 5' untranslated region of mRNA encoded by CIZ1, corresponding to a HOST TARGET binding site such as BINDING SITE I, BINDING SITE II or BINDING SITE III. Table 2 illustrates the complementarity of the nucleotide sequences of CIZ1 BINDING SITE, designated SEQ ID:14442, to the nucleotide sequence of VGAM2504 RNA, herein designated VGAM RNA, also designated SEQ ID:5215.

Another function of VGAM2504 is therefore inhibition of CIZ1 (Accession NM_012127). Accordingly, utilities of VGAM2504 include diagnosis, prevention and treatment of diseases and clinical conditions associated with CIZ1. Dedicator of Cyto-kinesis 3 (DOCK3, Accession XM_039259) is another VGAM2504 host target gene. DOCK3 BINDING SITE is HOST TARGET binding site found in the 3' untranslated region of mRNA encoded by DOCK3, corresponding to a HOST TARGET binding site such as BINDING SITE I, BINDING SITE II or BINDING SITE III. Table 2 illustrates the complementarity of the nucleotide sequences of DOCK3 BINDING SITE, designated SEQ ID:33040, to the nucleotide sequence of VGAM2504 RNA, herein designated VGAM RNA, also designated SEQ ID:5215.

Another function of VGAM2504 is therefore inhibition of Dedicator of Cyto-kinesis 3 (DOCK3, Accession XM_039259). Accordingly, utilities of VGAM2504 include diagnosis, prevention and treatment of diseases and clinical conditions associated with DOCK3. KIAA0894 (Accession NM_014896) is another VGAM2504 host target gene. KIAA0894 BINDING SITE is HOST TARGET binding site found in the 3' untranslated region of mRNA encoded by KIAA0894, corresponding to a HOST TARGET binding site such as BINDING SITE I, BINDING SITE II or BINDING SITE III. Table 2 illustrates the complementarity of the nucleotide sequences of KIAA0894 BINDING SITE, designated SEQ ID:17053, to the nucleotide sequence of VGAM2504 RNA, herein designated VGAM RNA, also designated SEQ ID:5215.

Another function of VGAM2504 is therefore inhibition of KIAA0894 (Accession NM_014896). Accordingly, utilities of VGAM2504 include diagnosis, prevention and treatment of diseases and clinical conditions associated with KIAA0894. KIAA1364 (Accession XM_032997) is another VGAM2504 host target gene. KIAA1364 BINDING SITE is HOST TARGET binding site found in the 3' untranslated region of mRNA encoded by KIAA1364, corresponding to a HOST TARGET binding site such as BINDING SITE I, BINDING SITE II or BINDING SITE III. Table 2 illustrates the complementarity of the nucleotide sequences of KIAA1364 BINDING SITE, designated SEQ ID:31811, to the nucleotide sequence of VGAM2504 RNA, herein designated VGAM RNA, also designated SEQ ID:5215.

Another function of VGAM2504 is therefore inhibition of KIAA1364 (Accession XM_032997). Accordingly, utilities of VGAM2504 include diagnosis, prevention and treatment of diseases and clinical conditions associated with KIAA1364. KIAA1416 (Accession XM_098762) is another VGAM2504 host target gene. KIAA1416 BINDING SITE is HOST TARGET binding site found in the 3' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41809, to the nucleotide sequence of VGAM2504 RNA, herein designated VGAM RNA, also designated SEQ ID:5215.

Another function of VGAM2504 is therefore inhibition of KIAA1416 (Accession XM_098762). Accordingly, utilities of VGAM2504 include diagnosis, prevention and treatment of diseases and clinical conditions associated with KIAA1416. MGC21675 (Accession NM_052861) is another VGAM2504 host target gene. MGC21675 BINDING SITE is HOST TARGET binding site found in the 3' untranslated region of mRNA encoded by MGC21675, corresponding to a HOST TARGET binding site such as BINDING SITE I, BINDING SITE II or BINDING SITE III. Table 2 illustrates the complementarity of the nucleotide sequences of MGC21675 BINDING SITE, designated SEQ ID:27445, to the nucleotide sequence of VGAM2504 RNA, herein designated VGAM RNA, also designated SEQ ID:5215.

Another function of VGAM2504 is therefore inhibition of MGC21675 (Accession NM_052861). Accordingly, utilities of VGAM2504 include diagnosis, prevention and treatment of diseases and clinical conditions associated with MGC21675. PIPPIN (Accession XM_086825) is another VGAM2504 host target gene. PIPPIN BINDING SITE is HOST TARGET binding site found in the 3' untranslated region of mRNA encoded by PIPPIN, corresponding to a HOST TARGET binding site such as BINDING SITE I, BINDING SITE II or BINDING SITE III. Table 2 illustrates the complementarity of the nucleotide sequences of PIPPIN BINDING SITE, designated SEQ ID:38910, to the nucleotide sequence of VGAM2504 RNA, herein designated VGAM RNA, also designated SEQ ID:5215.

Another function of VGAM2504 is therefore inhibition of PIPPIN (Accession XM_086825). Accordingly, utilities of VGAM2504 include diagnosis, prevention and treatment of diseases and clinical conditions associated with PIPPIN. LOC150685 (Accession XM_103563) is another VGAM2504 host target gene. LOC150685 BINDING SITE is HOST TARGET binding site found in the 5' untranslated region of mRNA encoded by LOC150685, corresponding to a HOST TARGET binding site such as BINDING SITE I, BINDING SITE II or BINDING SITE III. Table 2 illustrates the complementarity of the nucleotide sequences of LOC150685 BINDING SITE, designated SEQ ID:42154, to the nucleotide sequence of VGAM2504 RNA, herein designated VGAM RNA, also designated SEQ ID:5215.

Another function of VGAM2504 is therefore inhibition of LOC150685 (Accession XM_103563). Accordingly, utilities of VGAM2504 include diagnosis, prevention and treatment of diseases and clinical conditions associated with LOC150685. LOC201522 (Accession XM_113978) is another VGAM2504 host target gene. LOC201522 BINDING SITE is HOST TARGET binding site found in the 3' untranslated region of mRNA encoded by LOC201522, corresponding to a HOST TARGET binding site such as BINDING SITE I, BINDING SITE II or BINDING SITE III. Table 2 illustrates the complementarity of the nucleotide sequences of LOC201522 BINDING SITE, designated SEQ ID:42584, to the nucleotide sequence of VGAM2504 RNA, herein designated VGAM RNA, also designated SEQ ID:5215.

Another function of VGAM2504 is therefore inhibition of LOC201522 (Accession XM_113978). Accordingly, utilities of VGAM2504 include diagnosis, prevention and treatment of diseases and clinical conditions associated with LOC201522. LOC221398 (Accession XM_165762) is another VGAM2504 host target gene. LOC221398 BINDING SITE is HOST TARGET binding site found in the 3' untranslated region of mRNA encoded by LOC221398, corresponding to a HOST TARGET binding site such as BINDING SITE I, BINDING SITE II or BINDING SITE III. Table 2 illustrates the complementarity of the nucleotide sequences of LOC221398 BINDING SITE, designated SEQ ID:43748, to the nucleotide sequence of VGAM2504 RNA, herein designated VGAM RNA, also designated SEQ ID:5215.

Another function of VGAM2504 is therefore inhibition of LOC221398 (Accession XM_165762). Accordingly, utilities of VGAM2504 include diagnosis, prevention and treatment of diseases and clinical conditions associated with LOC221398. LOC256250 (Accession XM_173171) is another VGAM2504 host target gene. LOC256250 BINDING SITE is HOST TARGET binding site found in the 5' untranslated region of mRNA encoded by LOC256250, corresponding to a HOST TARGET binding site such as BINDING SITE I, BINDING SITE II or BINDING SITE III. Table 2 illustrates the complementarity of the nucleotide sequences of LOC256250 BINDING SITE, designated SEQ ID:46424, to the nucleotide sequence of VGAM2504 RNA, herein designated VGAM RNA, also designated SEQ ID:5215.

Another function of VGAM2504 is therefore inhibition of LOC256250 (Accession XM_173171). Accordingly, utilities of VGAM2504 include diagnosis, prevention and treatment of diseases and clinical conditions associated with LOC256250. LOC91040 (Accession XM_035641) is another VGAM2504 host target gene. LOC91040 BINDING SITE is HOST TARGET binding site found in the 5' untranslated region of mRNA encoded by LOC91040, corresponding to a HOST TARGET binding site such as BINDING SITE I, BINDING SITE II or BINDING SITE III. Table 2 illustrates the complementarity of the nucleotide sequences of LOC91040 BINDING SITE, designated SEQ ID:32313, to the nucleotide sequence of VGAM2504 RNA, herein designated VGAM RNA, also designated SEQ ID:5215.

Another function of VGAM2504 is therefore inhibition of LOC91040 (Accession XM_035641). Accordingly, utilities of VGAM2504 include diagnosis, prevention and treatment of diseases and clinical conditions associated with LOC91040. FIG. 1 further provides a conceptual description of a novel bioinformatically detected viral gene of the present invention, referred to here as Viral Genomic Address Messenger 2505 (VGAM2505) viral gene, which modulates expression of respective host target genes thereof, the function and utility of which host target genes is known in the art.

VGAM2505 is a novel bioinformatically detected regulatory, non protein coding, viral micro RNA (miRNA) gene. The method by which VGAM2505 was detected is described hereinabove with reference to FIGS. 1-8.

VGAM2505 gene, herein designated VGAM GENE, is a viral gene contained in the genome of Mouse Cytomegalovirus 1. VGAM2505 host target gene, herein designated VGAM HOST TARGET GENE, is a human gene contained in the human genome.

VGAM2505 gene encodes a VGAM2505 precursor RNA, herein designated VGAM PRECURSOR RNA. Similar to other miRNA genes, and unlike most ordinary genes, VGAM2505 precursor RNA does not encode a protein. A nucleotide sequence identical or highly similar to the nucleotide sequence of VGAM2505 precursor RNA is designated SEQ ID:2491, and is provided hereinbelow with reference to the sequence listing part. Nucleotide sequence SEQ ID:2491 is located at position 75695 relative to the genome of Mouse Cytomegalovirus 1.

VGAM2505 precursor RNA folds onto itself, forming VGAM2505 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2505 folded precursor RNA into VGAM2505 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2505 RNA is designated SEQ ID:5216, and is provided hereinbelow with reference to the sequence listing part.

VGAM2505 host target gene, herein designated VGAM HOST TARGET GENE, encodes a corresponding messenger RNA, VGAM2505 host target RNA, herein designated VGAM HOST TARGET RNA. VGAM2505 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2505 RNA, herein designated VGAM RNA, binds complementarily to one or more host target binding sites located in untranslated regions of VGAM2505 host target RNA, herein designated VGAM HOST TARGET RNA. This complementary binding is due to the fact that the nucleotide sequence of VGAM2505 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2505 RNA, herein designated VGAM RNA, may have a different number of host target binding sites in untranslated regions of a VGAM2505 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2505 RNA, herein designated VGAM RNA, to host target binding sites on VGAM2505 host target RNA, herein designated VGAM HOST TARGET RNA, such as BINDING SITE I, BINDING SITE II and BINDING SITE III, inhibits translation of VGAM2505 host target RNA into VGAM2505 host target protein, herein designated VGAM HOST TARGET PROTEIN. VGAM host target protein is therefore outlined by a broken line.

It is appreciated that VGAM2505 host target gene, herein designated VGAM HOST TARGET GENE, in fact represents a plurality of VGAM2505 host target genes. The mRNA of each one of this plurality of VGAM2505 host target genes comprises one or more host target binding sites, each having a nucleotide sequence which is at least partly complementary to VGAM2505 RNA, herein designated VGAM RNA, and which when bound by VGAM2505 RNA causes inhibition of translation of respective one or more VGAM2505 host target proteins.

It is further appreciated by one skilled in the art that the mode of translational inhibition illustrated by FIG. 1 with specific reference to translational inhibition exerted by VGAM2505 gene, herein designated VGAM GENE, on one or more VGAM2505 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2505 is inhibition of expression of host target genes, as part of a novel viral mechanism of attacking a host. Accordingly, utilities of VGAM2505 include diagnosis, prevention and treatment of viral infection by Mouse Cytomegalovirus 1. Specific functions, and accordingly utilities, of VGAM2505 correlate with, and may be deduced from, the identity of the host target genes which VGAM2505 binds and inhibits, and the function of these host target genes, as elaborated hereinbelow.

Nucleotide sequences of the VGAM2505 precursor RNA, herein designated VGAM PRECURSOR RNA, and of the 'diced' VGAM2505 RNA, herein designated VGAM RNA, and a schematic representation of the secondary folding of VGAM2505 folded precursor RNA, herein designated VGAM FOLDED PRECURSOR RNA, of VGAM2505 are further described hereinbelow with reference to Table 1.

Nucleotide sequences of host target binding sites, such as BINDING SITE-I, BINDING SITE-II and BINDING SITE-III of FIG. 1, found on VGAM2505 host target RNA, and schematic representation of the complementarity of each of these host target binding sites to VGAM2505 RNA, herein designated VGAM RNA, are described hereinbelow with reference to Table 2.

As mentioned hereinabove with reference to FIG. 1, a function of VGAM2505 gene, herein designated VGAM is inhibition of expression of VGAM2505 target genes. It is appreciated that specific functions, and accordingly utilities, of VGAM2505 correlate with, and may be deduced from, the identity of the target genes which VGAM2505 binds and inhibits, and the function of these target genes, as elaborated hereinbelow.

Adrenergic, Beta, Receptor Kinase 1 (ADRBK1, Accession NM_001619) is a VGAM2505 host target gene. ADRBK1 BINDING SITE is HOST TARGET binding site found in the 3' untranslated region of mRNA encoded by ADRBK1, corresponding to a HOST TARGET binding site such as BINDING SITE I, BINDING SITE II or BINDING SITE III. Table 2 illustrates the complementarity of the nucleotide sequences of ADRBK1 BINDING SITE, designated SEQ ID:7329, to the nucleotide sequence of VGAM2505 RNA, herein designated VGAM RNA, also designated SEQ ID:5216.

A function of VGAM2505 is therefore inhibition of Adrenergic, Beta, Receptor Kinase 1 (ADRBK1, Accession NM_001619), a gene which regulates desensitization of b-adrenergic receptors and related GPCRs. Accordingly, utilities of VGAM2505 include diagnosis, prevention and treatment of diseases and clinical conditions associated with ADRBK1. The function of ADRBK1 and its association with various diseases and clinical conditions, has been established by previous studies, as described hereinabove with reference to VGAM626. Ras Homolog Gene Family, Member C (ARHC, Accession NM_005167) is another VGAM2505 host target gene. ARHC BINDING SITE is HOST TARGET binding site found in the 5' untranslated region of mRNA encoded by ARHC, corresponding to a HOST TARGET binding site such as BINDING SITE I, BINDING SITE II or BINDING SITE III. Table 2 illustrates the complementarity of the nucleotide sequences of ARHC BINDING SITE, designated SEQ ID:11662, to the nucleotide sequence of VGAM2505 RNA, herein designated VGAM RNA, also designated SEQ ID:5216.

Another function of VGAM2505 is therefore inhibition of Ras Homolog Gene Family, Member C (ARHC, Accession NM_005167), a gene which remodels of the actin cytoskeleton during cell morphogenesis and motility. Accordingly, utilities of VGAM2505 include diagnosis, prevention and treatment of diseases and clinical conditions associated with ARHC. The function of ARHC and its association with various diseases and clinical conditions, has been established by previous studies, as described hereinabove with reference to VGAM885. ATPase, Na+/K+ Transporting, Alpha 2 (+) Polypeptide (ATP1A2, Accession NM_000702) is another VGAM2505 host target gene. ATP1A2 BINDING SITE is HOST TARGET binding site found in the 3' untranslated region of mRNA encoded by ATP1A2, corresponding to a HOST TARGET binding site such as BINDING SITE I, BINDING SITE II or BINDING SITE III. Table 2 illustrates the complementarity of the nucleotide sequences of ATP1A2 BINDING SITE, designated SEQ ID:6364, to the nucleotide sequence of VGAM2505 RNA, herein designated VGAM RNA, also designated SEQ ID:5216.

Another function of VGAM2505 is therefore inhibition of ATPase, Na+/K+ Transporting, Alpha 2 (+) Polypeptide (ATP1A2, Accession NM_000702). Accordingly, utilities of VGAM2505 include diagnosis, prevention and treatment of diseases and clinical conditions associated with ATP1A2. ATPase, Class I, Type 8B, Member 2 (ATP8B2, Accession XM_036933) is another VGAM2505 host target gene. ATP8B2 BINDING SITE is HOST TARGET binding site found in the 3' untranslated region of mRNA encoded by ATP8B2, corresponding to a HOST TARGET binding site such as BINDING SITE I, BINDING SITE II or BINDING SITE III. Table 2 illustrates the complementarity of the nucleotide sequences of ATP8B2 BINDING SITE, designated SEQ ID:32513, to the nucleotide sequence of VGAM2505 RNA, herein designated VGAM RNA, also designated SEQ ID:5216.

Another function of VGAM2505 is therefore inhibition of ATPase, Class I, Type 8B, Member 2 (ATP8B2, Accession XM_036933). Accordingly, utilities of VGAM2505 include diagnosis, prevention and treatment of diseases and clinical conditions associated with ATP8B2. Basigin (OK blood group) (BSG, Accession XM_042018) is another VGAM2505 host target gene. BSG BINDING SITE1 and BSG BINDING SITE2 are HOST TARGET binding sites found in untranslated regions of mRNA encoded by BSG, corresponding to HOST TARGET binding sites such as BINDING SITE I, BINDING SITE II or BINDING SITE III. Table 2 illustrates the complementarity of the nucleotide sequences of BSG BINDING SITE1 and BSG BINDING SITE2, designated SEQ ID:33668 and SEQ ID:7457 respectively, to the nucleotide sequence of VGAM2505 RNA, herein designated VGAM RNA, also designated SEQ ID:5216.

Another function of VGAM2505 is therefore inhibition of Basigin (OK blood group) (BSG, Accession XM_042018), a gene which is a LEUKOCYTE ACTIVATION ANTIGEN and a member of the immunoglobulin superfamily. Accordingly, utilities of VGAM2505 include diagnosis, prevention and treatment of diseases and clinical conditions associated with BSG. The function of BSG and its association with various diseases and clinical conditions, has been established by previous studies, as described hereinabove with reference to VGAM958. Calcium Channel, Voltage-dependent, Alpha 2/delta Subunit 2 (CACNA2D2, Accession NM_006030) is another VGAM2505 host target gene. CACNA2D2 BINDING SITE1 through CACNA2D2 BINDING SITE3 are HOST TARGET binding sites found in untranslated regions of mRNA encoded by CACNA2D2, corresponding to HOST TARGET binding sites such as BINDING SITE I, BINDING SITE II or BINDING SITE III. Table 2 illustrates the complementarity of the nucleotide sequences of CACNA2D2 BINDING SITE1 through CACNA2D2 BINDING SITE3, designated SEQ ID:12652, SEQ ID:12649 and SEQ ID:12650 respectively, to the nucleotide sequence of VGAM2505 RNA, herein designated VGAM RNA, also designated SEQ ID:5216.

Another function of VGAM2505 is therefore inhibition of Calcium Channel, Voltage-dependent, Alpha 2/delta Subunit 2 (CACNA2D2, Accession NM_006030), a gene which is a calcium channel protein which plays an important role in excitation-contraction coupling. Accordingly, utilities of VGAM2505 include diagnosis, prevention and treatment of diseases and clinical conditions associated with CACNA2D2. The function of CACNA2D2 and its association with various diseases and clinical conditions, has been established by previous studies, as described hereinabove with reference to VGAM203. Cadherin 5, Type 2, VE-cadherin (vascular epithelium) (CDH5, Accession NM_001795) is another VGAM2505 host target gene. CDH5 BINDING SITE is HOST TARGET binding site found in the 3' untranslated region of mRNA encoded by CDH5, corresponding to a HOST TARGET binding site such as BINDING SITE I, BINDING SITE II or BINDING SITE III. Table 2 illustrates the complementarity of the nucleotide sequences of CDH5 BINDING SITE, designated SEQ ID:7546, to the nucleotide sequence of VGAM2505 RNA, herein designated VGAM RNA, also designated SEQ ID:5216.

Another function of VGAM2505 is therefore inhibition of Cadherin 5, Type 2, VE-cadherin (vascular epithelium) (CDH5, Accession NM_001795), a gene which associates with alpha-catenin forming a link to the cytoskeleton. Accordingly, utilities of VGAM2505 include diagnosis, prevention and treatment of diseases and clinical conditions associated with CDH5. The function of CDH5 and its association with various diseases and clinical conditions, has been established by previous studies, as described hereinabove with reference to VGAM1342. CCAAT/enhancer Binding Protein (C/EBP), Alpha (CEBPA, Accession NM_004364) is another VGAM2505 host target gene. CEBPA BINDING SITE is HOST TARGET binding site found in the 3' untranslated region of mRNA encoded by CEBPA, corresponding to a HOST TARGET binding site such as BINDING SITE I, BINDING SITE II or BINDING SITE III. Table 2 illustrates the complementarity of the nucleotide sequences of CEBPA BINDING SITE, designated SEQ ID:10572, to the nucleotide sequence of VGAM2505 RNA, herein designated VGAM RNA, also designated SEQ ID:5216.

Another function of VGAM2505 is therefore inhibition of CCAAT/enhancer Binding Protein (C/EBP), Alpha (CEBPA, Accession NM_004364). Accordingly, utilities of VGAM2505 include diagnosis, prevention and treatment of diseases and clinical conditions associated with CEBPA. C-type (calcium dependent, carbohydrate-recognition domain) Lectin, Superfamily Member 12 (CLECSF12, Accession XM_084768) is another VGAM2505 host target gene. CLECSF12 BINDING SITE is HOST TARGET binding site found in the 3' untranslated region of mRNA encoded by CLECSF12, corresponding to a HOST TARGET binding site such as BINDING SITE I, BINDING SITE II or BINDING SITE III. Table 2 illustrates the complementarity of the nucleotide sequences of CLECSF12 BINDING SITE, designated SEQ ID:37684, to the nucleotide sequence of VGAM2505 RNA, herein designated VGAM RNA, also designated SEQ ID:5216.

Another function of VGAM2505 is therefore inhibition of C-type (calcium dependent, carbohydrate-recognition domain) Lectin, Superfamily Member 12 (CLECSF12, Accession XM_084768), a gene which is a pattern-recognition receptor. Accordingly, utilities of VGAM2505 include diagnosis, prevention and treatment of diseases and clinical conditions associated with CLECSF12. The function of CLECSF12 and its association with various diseases and clinical conditions, has been established by previous studies, as described hereinabove with reference to VGAM121. Collagen, Type V, Alpha 3 (COL5A3, Accession NM_015719) is another VGAM2505 host target gene. COL5A3 BINDING SITE is HOST TARGET binding site found in the 3' untranslated region of mRNA encoded by COL5A3, corresponding to a HOST TARGET binding site such as BINDING SITE I, BINDING SITE II or BINDING SITE III. Table 2 illustrates the complementarity of the nucleotide sequences of COL5A3 BINDING SITE, designated SEQ ID:17933, to the nucleotide sequence of VGAM2505 RNA, herein designated VGAM RNA, also designated SEQ ID:5216.

Another function of VGAM2505 is therefore inhibition of Collagen, Type V, Alpha 3 (COL5A3, Accession NM_015719). Accordingly, utilities of VGAM2505 include diagnosis, prevention and treatment of diseases and clinical conditions associated with COL5A3. Casein Kinase 2, Alpha Prime Polypeptide (CSNK2A2, Accession NM_001896) is another VGAM2505 host target gene. CSNK2A2 BINDING SITE is HOST TARGET binding site found in the 5' untranslated region of mRNA encoded by CSNK2A2, corresponding to a HOST TARGET binding site such as BINDING SITE I, BINDING SITE II or BINDING SITE III. Table 2 illustrates the complementarity of the nucleotide sequences of CSNK2A2 BINDING SITE, designated SEQ ID:7623, to the nucleotide sequence of VGAM2505 RNA, herein designated VGAM RNA, also designated SEQ ID:5216.

Another function of VGAM2505 is therefore inhibition of Casein Kinase 2, Alpha Prime Polypeptide (CSNK2A2, Accession NM_001896), a gene which catalyzes the phosphorylation of serine or threonine residues in proteins. Accordingly, utilities of VGAM2505 include diagnosis, prevention and treatment of diseases and clinical conditions associated with CSNK2A2. The function of CSNK2A2 has been established by previous studies. Phosphorylation of the human p53 protein (OMIM Ref. No. 191170) at ser392 is responsive to ultraviolet (UV) but not gamma irradiation. Keller et al. (2001) identified and purified a mammalian UV-activated protein kinase complex that phosphorylates ser392 in vitro. This kinase complex contains CK2 and the chromatin transcriptional elongation factor FACT, a heterodimer of SPT16 (OMIM Ref. No. 605012) and SSRP1 (OMIM Ref. No. 604328). In vitro studies showed that FACT alters the specificity of CK2 in the complex such that it selectively phosphorylates p53 over other substrates, including casein. In addition, phosphorylation by the kinase complex was found to enhance p53 activity. These results provided a potential mechanism for p53 activation by UV irradiation Doray et al. (2002) demonstrated that the Golgi-localized, gamma-ear-containing adenosine diphosphate ribosylation factor-binding proteins (GGA1, 606004 and GGA3, 606006) and the coat protein adaptor protein-1 (AP-1) complex (see OMIM Ref. No. AP1G2, 603534) colocalize in clathrin-coated buds of the trans-Golgi networks of mouse L cells and human HeLa cells. Binding studies revealed a direct interaction between the hinge domains of the GGAs and the gamma-ear domain of AP-1. Further, AP-1 contained bound casein kinase-2 that phosphorylated GGA1 and GGA3, thereby causing autoinhibition. Doray et al. (2002) demonstrated that this autoinhibition could induce the directed transfer of mannose 6-phosphate receptors (see OMIM Ref. No. 154540) from the GGAs to AP-1. Mannose 6-phosphate receptors that were defective in binding to GGAs were poorly incorporated into adaptor protein complex containing clathrin coated vesicles. Thus, Doray et al. (2002) concluded that GGAs and the AP-1 complex interact to package mannose 6-phosphate receptors into AP-1-containing coated vesicles Animal model experiments lend further support to the function of CSNK2A2. To determine the functional and developmental role of protein kinase casein kinase II, Xu et al. (1999) used homologous recombination to disrupt the gene encoding Csnk2a2 in transgenic mice. They found that Csnk2a2 is preferentially expressed in late stages of spermatogenesis, and male mice in which Csnk2a2 has been disrupted are infertile, with oligospermia and globozoospermia ('round-headed spermatozoa'). This was the first demonstration of the unique role for a Ck2 isoform in development. The primary spermatogenic defect in the Csnk2a2 -/- testis is a specific abnormality of anterior head shaping of elongating spermatids; this is the first defined gene that regulates sperm head morphogenesis. As the germ cells differentiate, they are capable of undergoing chromatin condensation, although many abnormal cells are deleted through apoptosis or Sertoli cell phagocytosis. The few that survived to populate the epididymis exhibited head abnormalities similar to those described in human globozoospermia; thus, Csnk2a2 may be a candidate gene for inherited abnormalities of sperm morphogenesis It is appreciated that the abovementioned animal model for CSNK2A2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Doray, B.; Ghosh, P.; Griffith, J.; Geuze, H. J.; Kornfeld, S.: Cooperation of GGAs and AP-1 in packaging MPRs at the trans-Golgi network. Science 297: 1700-1703, 2002; and Xu, X.; Toselli, P. A.; Russell, L. D.; Seldin, D. C.: Globozoospermia in mice lacking the casein kinase II alpha-prime catalytic subunit. Nature Genet. 23: 118-121, 1999.

Further studies establishing the function and utilities of CSNK2A2 are found in John Hopkins OMIM database record ID 115442, and in sited publications numbered 12596, 12601-12602, 87 and 12600 listed in the bibliography section hereinbelow, which are also hereby incorporated by reference. Cytochrome P450, Subfamily IIB (phenobarbital-inducible), Polypeptide 6 (CYP2B6, Accession NM_000767) is another VGAM2505 host target gene. CYP2B6 BINDING SITE is HOST TARGET binding site found in the 3' untranslated region of mRNA encoded by CYP2B6, corresponding to a HOST TARGET binding site such as BINDING SITE I, BINDING SITE II or BINDING SITE III. Table 2 illustrates the complementarity of the nucleotide sequences of CYP2B6 BINDING SITE, designated SEQ ID:6416, to the nucleotide sequence of VGAM2505 RNA, herein designated VGAM RNA, also designated SEQ ID:5216.

Another function of VGAM2505 is therefore inhibition of Cytochrome P450, Subfamily IIB (phenobarbital-inducible), Polypeptide 6 (CYP2B6, Accession NM_000767), a gene which oxidizes a variety of structurally unrelated compounds, including steroids, fatty acids, and xenobiotics. Accordingly, utilities of VGAM2505 include diagnosis, prevention and treatment of diseases and clinical conditions associated with CYP2B6. The function of CYP2B6 and its association with various diseases and clinical conditions, has been established by previous studies, as described hereinabove with reference to VGAM1924. Deleted In Lung and Esophageal Cancer 1 (DLEC1, Accession NM_007336) is another VGAM2505 host target gene. DLEC1 BINDING SITE1 and DLEC1 BINDING SITE2 are HOST TARGET binding sites found in untranslated regions of mRNA encoded by DLEC1, corresponding to HOST TARGET binding sites such as BINDING SITE I, BINDING SITE II or BINDING SITE III. Table 2 illustrates the complementarity of the nucleotide sequences of DLEC1 BINDING SITE1 and DLEC1 BINDING SITE2, designated SEQ ID:14265 and SEQ ID:14272 respectively, to the nucleotide sequence of VGAM2505 RNA, herein designated VGAM RNA, also designated SEQ ID:5216.

Another function of VGAM2505 is therefore inhibition of Deleted In Lung and Esophageal Cancer 1 (DLEC1, Accession NM_007336). Accordingly, utilities of VGAM2505 include diagnosis, prevention and treatment of diseases and clinical conditions associated with DLEC1. Dystonia 1, Torsion (autosomal dominant; torsin A) (DYT1, Accession NM_000113) is another VGAM2505 host target gene. DYT1 BINDING SITE1 and DYT1 BINDING SITE2 are HOST TARGET binding sites found in untranslated regions of mRNA encoded by DYT1, corresponding to HOST TARGET binding sites such as BINDING SITE I, BINDING SITE II or BINDING SITE III. Table 2 illustrates the complementarity of the nucleotide sequences of DYT1 BINDING SITE1 and DYT1 BINDING SITE2, designated SEQ ID:5578 and SEQ ID:5579 respectively, to the nucleotide sequence of VGAM2505 RNA, herein designated VGAM RNA, also designated SEQ ID:5216.

Another function of VGAM2505 is therefore inhibition of Dystonia 1, Torsion (autosomal dominant; torsin A) (DYT1, Accession NM_000113). Accordingly, utilities of VGAM2505 include diagnosis, prevention and treatment of diseases and clinical conditions associated with DYT1. ELK1, Member of ETS Oncogene Family (ELK1, Accession NM_005229) is another VGAM2505 host target gene. ELK1 BINDING SITE1 and ELK1 BINDING SITE2 are HOST TARGET binding sites found in untranslated regions of mRNA encoded by ELK1, corresponding to HOST TARGET binding sites such as BINDING SITE I, BINDING SITE II or BINDING SITE III. Table 2 illustrates the complementarity of the nucleotide sequences of ELK1 BINDING SITE1 and ELK1 BINDING SITE2, designated SEQ ID:11730 and SEQ ID:11731 respectively, to the nucleotide sequence of VGAM2505 RNA, herein designated VGAM RNA, also designated SEQ ID:5216.

Another function of VGAM2505 is therefore inhibition of ELK1, Member of ETS Oncogene Family (ELK1, Accession NM_005229), a gene which stimulates transcription. can form a ternary complex with the serum response factor and the ets and srf motifs of the fos serum response element. Accordingly, utilities of VGAM2505 include diagnosis, prevention and treatment of diseases and clinical conditions associated with ELK1. The function of ELK1 and its association with various diseases and clinical conditions, has been established by previous studies, as described hereinabove with reference to VGAM178. Fasciculation and Elongation Protein Zeta 1 (zygin I) (FEZ1, Accession NM_022549) is another VGAM2505 host target gene. FEZ1 BINDING SITE is HOST TARGET binding site found in the 3' untranslated region of mRNA encoded by FEZ1, corresponding to a HOST TARGET binding site such as BINDING SITE I, BINDING SITE II or BINDING SITE III. Table 2 illustrates the complementarity of the nucleotide sequences of FEZ1 BINDING SITE, designated SEQ ID:22876, to the nucleotide sequence of VGAM2505 RNA, herein designated VGAM RNA, also designated SEQ ID:5216.

Another function of VGAM2505 is therefore inhibition of Fasciculation and Elongation Protein Zeta 1 (zygin I) (FEZ1, Accession NM_022549), a gene which Zygin 1; may have a role in axonal outgrowth; has similarity to C. elegans UNC-76. Accordingly, utilities of VGAM2505 include diagnosis, prevention and treatment of diseases and clinical conditions associated with FEZ1. The function of FEZ1 and its association with various diseases and clinical conditions, has been established by previous studies, as described hereinabove with reference to VGAM37. Fibroblast Growth Factor Receptor 1 (fms-related tyrosine kinase 2, Pfeiffer syndrome) (FGFR1, Accession NM_023109) is another VGAM2505 host target gene. FGFR1 BINDING SITE1 through FGFR1 BINDING SITE3 are HOST TARGET binding sites found in untranslated regions of mRNA encoded by FGFR1, corresponding to HOST TARGET binding sites such as BINDING SITE I, BINDING SITE II or BINDING SITE III. Table 2 illustrates the complementarity of the nucleotide sequences of FGFR1 BINDING SITE1 through FGFR1 BINDING SITE3, designated SEQ ID:23369, SEQ ID:17975 and SEQ ID:6204 respectively, to the nucleotide sequence of VGAM2505 RNA, herein designated VGAM RNA, also designated SEQ ID:5216.

Another function of VGAM2505 is therefore inhibition of Fibroblast Growth Factor Receptor 1 (fms-related tyrosine kinase 2, Pfeiffer syndrome) (FGFR1, Accession NM_023109). Accordingly, utilities of VGAM2505 include diagnosis, prevention and treatment of diseases and clinical conditions associated with FGFR1. Hypoxia-inducible Factor 1, Alpha Subunit (basic helix-loop-helix transcription factor) (HIF1A, Accession NM_001530) is another VGAM2505 host target gene. HIF1A BINDING SITE is HOST TARGET binding site found in the 5' untranslated region of mRNA encoded by HIF1A, corresponding to a HOST TARGET binding site such as BINDING SITE I, BINDING SITE II or BINDING SITE III. Table 2 illustrates the complementarity of the nucleotide sequences of HIF1A BINDING SITE, designated SEQ ID:7265, to the nucleotide sequence of VGAM2505 RNA, herein designated VGAM RNA, also designated SEQ ID:5216.

Another function of VGAM2505 is therefore inhibition of Hypoxia-inducible Factor 1, Alpha Subunit (basic helix-loop-helix transcription factor) (HIF1A, Accession NM_001530), a gene which is a basic helix-loop-helix transcription factor and mediates transcriptional responses to hypoxia and dioxin-signaling. Accordingly, utilities of VGAM2505 include diagnosis, prevention and treatment of diseases and clinical conditions associated with HIF1A. The function of HIF1A and its association with various diseases and clinical conditions, has been established by previous studies, as described hereinabove with reference to VGAM229. High Mobility Group AT-hook 2 (HMGA2, Accession NM_003483) is another VGAM2505 host target gene. HMGA2 BINDING SITE1 through HMGA2 BINDING SITE3 are HOST TARGET binding sites found in untranslated regions of mRNA encoded by HMGA2, corresponding to HOST TARGET binding sites such as BINDING SITE I, BINDING SITE II or BINDING SITE III. Table 2 illustrates the complementarity of the nucleotide sequences of HMGA2 BINDING SITE1 through HMGA2 BINDING SITE3, designated SEQ ID:9562, SEQ ID:9564 and SEQ ID:9565 respectively, to the nucleotide sequence of VGAM2505 RNA, herein designated VGAM RNA, also designated SEQ ID:5216.

Another function of VGAM2505 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM2505 include diagnosis, prevention and treatment of diseases and clinical conditions associated with HMGA2. The function of HMGA2 and its association with various diseases and clinical conditions, has been established by previous studies, as described hereinabove with reference to VGAM552. Heparan Sulfate (glucosamine) 3-O-sulfotransferase 4 (HS3ST4, Accession XM_056254) is another VGAM2505 host target gene. HS3ST4 BINDING SITE is HOST TARGET binding site found in the 3' untranslated region of mRNA encoded by HS3ST4, corresponding to a HOST TARGET binding site such as BINDING SITE I, BINDING SITE II or BINDING SITE III. Table 2 illustrates the complementarity of the nucleotide sequences of HS3ST4 BINDING SITE, designated SEQ ID:36370, to the nucleotide sequence of VGAM2505 RNA, herein designated VGAM RNA, also designated SEQ ID:5216.

Another function of VGAM2505 is therefore inhibition of Heparan Sulfate (glucosamine) 3-O-sulfotransferase 4 (HS3ST4, Accession XM_056254). Accordingly, utilities of VGAM2505 include diagnosis, prevention and treatment of diseases and clinical conditions associated with HS3ST4. Hormonally Upregulated Neu-associated Kinase (HUNK, Accession NM_014586) is another VGAM2505 host target gene. HUNK BINDING SITE is HOST TARGET binding site found in the 3' untranslated region of mRNA encoded by HUNK, corresponding to a HOST TARGET binding site such as BINDING SITE I, BINDING SITE II or BINDING SITE III. Table 2 illustrates the complementarity of the nucleotide sequences of HUNK BINDING SITE, designated SEQ ID:15953, to the nucleotide sequence of VGAM2505 RNA, herein designated VGAM RNA, also designated SEQ ID:5216.

Another function of VGAM2505 is therefore inhibition of Hormonally Upregulated Neu-associated Kinase (HUNK, Accession NM_014586). Accordingly, utilities of VGAM2505 include diagnosis, prevention and treatment of diseases and clinical conditions associated with HUNK. Hypoxia Up-regulated 1 (HYOU1, Accession XM_006464) is another VGAM2505 host target gene. HYOU1 BINDING SITE is HOST TARGET binding site found in the 3' untranslated region of mRNA encoded by HYOU1, corresponding to a HOST TARGET binding site such as BINDING SITE I, BINDING SITE II or BINDING SITE III. Table 2 illustrates the complementarity of the nucleotide sequences of HYOU1 BINDING SITE, designated SEQ ID:30001, to the nucleotide sequence of VGAM2505 RNA, herein designated VGAM RNA, also designated SEQ ID:5216.

Another function of VGAM2505 is therefore inhibition of Hypoxia Up-regulated 1 (HYOU1, Accession XM_006464). Accordingly, utilities of VGAM2505 include diagnosis, prevention and treatment of diseases and clinical conditions associated with HYOU1. Potassium Voltage-gated Channel, Isk-related Family, Member 1-like (KCNE1L, Accession NM_012282) is another VGAM2505 host target gene. KCNE1L BINDING SITE is HOST TARGET binding site found in the 3' untranslated region of mRNA encoded by KCNE1L, corresponding to a HOST TARGET binding site such as BINDING SITE I, BINDING SITE II or BINDING SITE III. Table 2 illustrates the complementarity of the nucleotide sequences of KCNE1L BINDING SITE, designated SEQ ID:14613, to the nucleotide sequence of VGAM2505

RNA, herein designated VGAM RNA, also designated SEQ ID:5216.

Another function of VGAM2505 is therefore inhibition of Potassium Voltage-gated Channel, Isk-related Family, Member 1-like (KCNE1L, Accession NM_012282), a gene which is a potassium voltage-gated channel. Accordingly, utilities of VGAM2505 include diagnosis, prevention and treatment of diseases and clinical conditions associated with KCNE1L. The function of KCNE1L and its association with various diseases and clinical conditions, has been established by previous studies, as described hereinabove with reference to VGAM1864. Lymphocyte-activation Gene 3 (LAG3, Accession NM_002286) is another VGAM2505 host target gene. LAG3 BINDING SITE is HOST TARGET binding site found in the 5' untranslated region of mRNA encoded by LAG3, corresponding to a HOST TARGET binding site such as BINDING SITE I, BINDING SITE II or BINDING SITE III. Table 2 illustrates the complementarity of the nucleotide sequences of LAG3 BINDING SITE, designated SEQ ID:8066, to the nucleotide sequence of VGAM2505 RNA, herein designated VGAM RNA, also designated SEQ ID:5216.

Another function of VGAM2505 is therefore inhibition of Lymphocyte-activation Gene 3 (LAG3, Accession NM_002286), a gene which is involved in lymphocyte activation. binds to hla class-ii antigens. Accordingly, utilities of VGAM2505 include diagnosis, prevention and treatment of diseases and clinical conditions associated with LAG3. The function of LAG3 and its association with various diseases and clinical conditions, has been established by previous studies, as described hereinabove with reference to VGAM2353. LFG (Accession XM_084780) is another VGAM2505 host target gene. LFG BINDING SITE is HOST TARGET binding site found in the 3' untranslated region of mRNA encoded by LFG, corresponding to a HOST TARGET binding site such as BINDING SITE I, BINDING SITE II or BINDING SITE III. Table 2 illustrates the complementarity of the nucleotide sequences of LFG BINDING SITE, designated SEQ ID:37692, to the nucleotide sequence of VGAM2505 RNA, herein designated VGAM RNA, also designated SEQ ID:5216.

Another function of VGAM2505 is therefore inhibition of LFG (Accession XM_084780). Accordingly, utilities of VGAM2505 include diagnosis, prevention and treatment of diseases and clinical conditions associated with LFG. Low Density Lipoprotein-related Protein 1 (alpha-2-macroglobulin receptor) (LRP1, Accession NM_002332) is another VGAM2505 host target gene. LRP1 BINDING SITE is HOST TARGET binding site found in the 5' untranslated region of mRNA encoded by LRP1, corresponding to a HOST TARGET binding site such as BINDING SITE I, BINDING SITE II or BINDING SITE III. Table 2 illustrates the complementarity of the nucleotide sequences of LRP1 BINDING SITE, designated SEQ ID:8136, to the nucleotide sequence of VGAM2505 RNA, herein designated VGAM RNA, also designated SEQ ID:5216.

Another function of VGAM2505 is therefore inhibition of Low Density Lipoprotein-related Protein 1 (alpha-2-macroglobulin receptor) (LRP1, Accession NM_002332), a gene which is a recycling lipoprotein receptor with possible growth-modulating effects. Accordingly, utilities of VGAM2505 include diagnosis, prevention and treatment of diseases and clinical conditions associated with LRP1. The function of LRP1 and its association with various diseases and clinical conditions, has been established by previous studies, as described hereinabove with reference to VGAM885. Lysozyme (renal amyloidosis) (LYZ, Accession NM_000239) is another VGAM2505 host target gene. LYZ BINDING SITE is HOST TARGET binding site found in the 3' untranslated region of mRNA encoded by LYZ, corresponding to a HOST TARGET binding site such as BINDING SITE I, BINDING SITE II or BINDING SITE III. Table 2 illustrates the complementarity of the nucleotide sequences of LYZ BINDING SITE, designated SEQ ID:5757, to the nucleotide sequence of VGAM2505 RNA, herein designated VGAM RNA, also designated SEQ ID:5216.

Another function of VGAM2505 is therefore inhibition of Lysozyme (renal amyloidosis) (LYZ, Accession NM_000239), a gene which a bacteriolytic enzyme. Accordingly, utilities of VGAM2505 include diagnosis, prevention and treatment of diseases and clinical conditions associated with LYZ. The function of LYZ and its association with various diseases and clinical conditions, has been established by previous studies, as described hereinabove with reference to VGAM929. Mediterranean Fever (MEFV, Accession NM_000243) is another VGAM2505 host target gene. MEFV BINDING SITE is HOST TARGET binding site found in the 3' untranslated region of mRNA encoded by MEFV, corresponding to a HOST TARGET binding site such as BINDING SITE I, BINDING SITE II or BINDING SITE III. Table 2 illustrates the complementarity of the nucleotide sequences of MEFV BINDING SITE, designated SEQ ID:5768, to the nucleotide sequence of VGAM2505 RNA, herein designated VGAM RNA, also designated SEQ ID:5216.

Another function of VGAM2505 is therefore inhibition of Mediterranean Fever (MEFV, Accession NM_000243). Accordingly, utilities of VGAM2505 include diagnosis, prevention and treatment of diseases and clinical conditions associated with MEFV. Matrix Metalloproteinase 15 (membrane-inserted) (MMP15, Accession NM_002428) is another VGAM2505 host target gene. MMP15 BINDING SITE is HOST TARGET binding site found in the 3' untranslated region of mRNA encoded by MMP15, corresponding to a HOST TARGET binding site such as BINDING SITE I, BINDING SITE II or BINDING SITE III. Table 2 illustrates the complementarity of the nucleotide sequences of MMP15 BINDING SITE, designated SEQ ID:8264, to the nucleotide sequence of VGAM2505 RNA, herein designated VGAM RNA, also designated SEQ ID:5216.

Another function of VGAM2505 is therefore inhibition of Matrix Metalloproteinase 15 (membrane-inserted) (MMP15, Accession NM_002428). Accordingly, utilities of VGAM2505 include diagnosis, prevention and treatment of diseases and clinical conditions associated with MMP15. Myeloproliferative Leukemia Virus Oncogene (MPL, Accession NM_005373) is another VGAM2505 host target gene. MPL BINDING SITE is HOST TARGET binding site found in the 3' untranslated region of mRNA encoded by MPL, corresponding to a HOST TARGET binding site such as BINDING SITE I, BINDING SITE II or BINDING SITE III. Table 2 illustrates the complementarity of the nucleotide sequences of MPL BINDING SITE, designated SEQ ID:11849, to the nucleotide sequence of VGAM2505 RNA, herein designated VGAM RNA, also designated SEQ ID:5216.

Another function of VGAM2505 is therefore inhibition of Myeloproliferative Leukemia Virus Oncogene (MPL, Accession NM_005373). Accordingly, utilities of VGAM2505 include diagnosis, prevention and treatment of diseases and clinical conditions associated with MPL. Membrane Protein, Palmitoylated 3 (MAGUK p55 subfamily member 3) (MPP3, Accession NM_001932) is another VGAM2505 host target gene. MPP3 BINDING SITE is HOST TARGET binding site found in the 5' untranslated region of mRNA encoded by MPP3, corresponding to a HOST TARGET binding site such as BINDING SITE I, BINDING SITE II or BINDING SITE III. Table 2 illustrates the complementarity of the nucleotide sequences of MPP3 BINDING SITE, designated SEQ ID:7642, to the nucleotide sequence of VGAM2505 RNA, herein designated VGAM RNA, also designated SEQ ID:5216.

Another function of VGAM2505 is therefore inhibition of Membrane Protein, Palmitoylated 3 (MAGUK p55 subfamily member 3) (MPP3, Accession NM_001932). Accordingly, utilities of VGAM2505 include diagnosis, prevention and treatment of diseases and clinical conditions associated with MPP3. Nipsnap Homolog 1 (C. elegans) (NIPSNAP1, Accession NM_003634) is another VGAM2505 host target gene. NIPSNAP1 BINDING SITE is HOST TARGET binding site found in the 3' untranslated region of mRNA encoded by NIPSNAP1, corresponding to a HOST TARGET binding site such as BINDING SITE I, BINDING SITE II or BINDING SITE III. Table 2 illustrates the complementarity of the nucleotide sequences of NIPSNAP1 BINDING SITE, designated SEQ ID:9702, to the nucleotide sequence of VGAM2505 RNA, herein designated VGAM RNA, also designated SEQ ID:5216.

Another function of VGAM2505 is therefore inhibition of Nipsnap Homolog 1 (C. elegans) (NIPSNAP1, Accession NM_003634). Accordingly, utilities of VGAM2505 include diagnosis, prevention and treatment of diseases and clinical conditions associated with NIPSNAP1. Notch Homolog 3 (Drosophila) (NOTCH3, Accession NM_000435) is another VGAM2505 host target gene. NOTCH3 BINDING SITE is HOST TARGET binding site found in the 3' untranslated region of mRNA encoded by NOTCH3, corresponding to a HOST TARGET binding site such as BINDING SITE I, BINDING SITE II or BINDING SITE III. Table 2 illustrates the complementarity of the nucleotide sequences of NOTCH3 BINDING SITE, designated SEQ ID:6017, to the nucleotide sequence of VGAM2505 RNA, herein designated VGAM RNA, also designated SEQ ID:5216.

Another function of VGAM2505 is therefore inhibition of Notch Homolog 3 (Drosophila) (NOTCH3, Accession NM_000435), a gene which may function in cell fate specification during development. Accordingly, utilities of VGAM2505 include diagnosis, prevention and treatment of diseases and clinical conditions associated with NOTCH3. The function of NOTCH3 and its association with various diseases and clinical conditions, has been established by previous studies, as described hereinabove with reference to VGAM128. Protocadherin Beta 11 (PCDHB11, Accession NM_018931) is another VGAM2505 host target gene. PCDHB11 BINDING SITE is HOST TARGET binding site found in the 3' untranslated region of mRNA encoded by PCDHB11, corresponding to a HOST TARGET binding site such as BINDING SITE I, BINDING SITE II or BINDING SITE III. Table 2 illustrates the complementarity of the nucleotide sequences of PCDHB11 BINDING SITE, designated SEQ ID:21001, to the nucleotide sequence of VGAM2505 RNA, herein designated VGAM RNA, also designated SEQ ID:5216.

Another function of VGAM2505 is therefore inhibition of Protocadherin Beta 11 (PCDHB11, Accession NM_018931). Accordingly, utilities of VGAM2505 include diagnosis, prevention and treatment of diseases and clinical conditions associated with PCDHB11. Phosducin-like (PDCL, Accession NM_005388) is another VGAM2505 host target gene. PDCL BINDING SITE is HOST TARGET binding site found in the 3' untranslated region of mRNA encoded by PDCL, corresponding to a HOST TARGET binding site such as BINDING SITE I, BINDING SITE II or BINDING SITE III. Table 2 illustrates the complementarity of the nucleotide sequences of PDCL BINDING SITE, designated SEQ ID:11865, to the nucleotide sequence of VGAM2505 RNA, herein designated VGAM RNA, also designated SEQ ID:5216.

Another function of VGAM2505 is therefore inhibition of Phosducin-like (PDCL, Accession NM_005388), a gene which may regulate G-protein signaling and similar to phosducins. Accordingly, utilities of VGAM2505 include diagnosis, prevention and treatment of diseases and clinical conditions associated with PDCL. The function of PDCL and its association with various diseases and clinical conditions, has been established by previous studies, as described hereinabove with reference to VGAM1708. Phosphodiesterase 6B, CGMP-specific, Rod, Beta (congenital stationary night blindness 3, autosomal dominant) (PDE6B, Accession NM_000283) is another VGAM2505 host target gene. PDE6B BINDING SITE is HOST TARGET binding site found in the 3' untranslated region of mRNA encoded by PDE6B, corresponding to a HOST TARGET binding site such as BINDING SITE I, BINDING SITE II or BINDING SITE III. Table 2 illustrates the complementarity of the nucleotide sequences of PDE6B BINDING SITE, designated SEQ ID:5827, to the nucleotide sequence of VGAM2505 RNA, herein designated VGAM RNA, also designated SEQ ID:5216.

Another function of VGAM2505 is therefore inhibition of Phosphodiesterase 6B, CGMP-specific, Rod, Beta (congenital stationary night blindness 3, autosomal dominant) (PDE6B, Accession NM_000283). Accordingly, utilities of VGAM2505 include diagnosis, prevention and treatment of diseases and clinical conditions associated with PDE6B. Plexin A1 (PLXNA1, Accession XM_051261) is another VGAM2505 host target gene. PLXNA1 BINDING SITE is HOST TARGET binding site found in the 3' untranslated region of mRNA encoded by PLXNA1, corresponding to a HOST TARGET binding site such as BINDING SITE I, BINDING SITE II or BINDING SITE III. Table 2 illustrates the complementarity of the nucleotide sequences of PLXNA1 BINDING SITE, designated SEQ ID:35791, to the nucleotide sequence of VGAM2505 RNA, herein designated VGAM RNA, also designated SEQ ID:5216.

Another function of VGAM2505 is therefore inhibition of Plexin A1 (PLXNA1, Accession XM_051261). Accordingly, utilities of VGAM2505 include diagnosis, prevention and treatment of diseases and clinical conditions associated with PLXNA1. Prostaglandin I2 (prostacyclin) Synthase (PTGIS, Accession NM_000961) is another VGAM2505 host target gene. PTGIS BINDING SITE is HOST TARGET binding site found in the 3' untranslated region of mRNA encoded by PTGIS, corresponding to a HOST TARGET binding site such as BINDING SITE I, BINDING SITE II or BINDING SITE III. Table 2 illustrates the complementarity of the nucleotide sequences of PTGIS BINDING SITE, designated SEQ ID:6670, to the nucleotide sequence of VGAM2505 RNA, herein designated VGAM RNA, also designated SEQ ID:5216.

Another function of VGAM2505 is therefore inhibition of Prostaglandin I2 (prostacyclin) Synthase (PTGIS, Accession NM_000961), a gene which catalyzes the isomerization of prostaglandin h2 to prostacyclin (= prostaglandin i2). Accordingly, utilities of VGAM2505 include diagnosis, prevention and treatment of diseases and clinical conditions associated with PTGIS. The function of PTGIS and its association with various diseases and clinical conditions, has been established by previous studies, as described hereinabove with reference to VGAM206. Protein Tyrosine Phosphatase, Non-receptor Type 7 (PTPN7, Accession NM_002832) is another VGAM2505 host target gene. PTPN7 BINDING SITE1 through PTPN7 BINDING SITE3 are HOST TARGET binding sites found in untranslated regions of mRNA encoded by PTPN7, corresponding to HOST TARGET binding sites such as BINDING SITE I, BINDING SITE II or BINDING SITE III. Table 2 illustrates the complementarity of the nucleotide sequences of PTPN7 BINDING SITE1 through PTPN7 BINDING SITE3, designated SEQ ID:8710, SEQ ID:27888 and SEQ ID:27891 respectively, to the nucleotide sequence of VGAM2505 RNA, herein designated VGAM RNA, also designated SEQ ID:5216.

Another function of VGAM2505 is therefore inhibition of Protein Tyrosine Phosphatase, Non-receptor Type 7 (PTPN7, Accession NM_002832). Accordingly, utilities of VGAM2505 include diagnosis, prevention and treatment of diseases and clinical conditions associated with PTPN7. Retinoic Acid Receptor, Beta (RARB, Accession NM_016152) is another VGAM2505 host target gene. RARB BINDING SITE is HOST TARGET binding site found in the 5' untranslated region of mRNA encoded by RARB, corresponding to a HOST TARGET binding site such as BINDING SITE I, BINDING SITE II or BINDING SITE III. Table 2 illustrates the complementarity of the nucleotide sequences of RARB BINDING SITE, designated SEQ ID:18237, to the nucleotide sequence of VGAM2505 RNA, herein designated VGAM RNA, also designated SEQ ID:5216.

Another function of VGAM2505 is therefore inhibition of Retinoic Acid Receptor, Beta (RARB, Accession NM_016152), a gene which is one member of the steroid/thyroid hormone receptor family of ligand-activated transcription factors. Accordingly, utilities of VGAM2505 include diagnosis, prevention and treatment of diseases and clinical conditions associated with RARB. The function of RARB and its association with various diseases and clinical conditions, has been established by previous studies, as described hereinabove with reference to VGAM179. Rabphilin 3A-like (without C2 domains) (RPH3AL, Accession NM_006987) is another VGAM2505 host target gene. RPH3AL BINDING SITE is HOST TARGET binding site found in the 3' untranslated region of mRNA encoded by RPH3AL, corresponding to a HOST TARGET binding site such as BINDING SITE I, BINDING SITE II or BINDING SITE III. Table 2 illustrates the complementarity of the nucleotide sequences of RPH3AL BINDING SITE, designated SEQ ID:13848, to the nucleotide sequence of VGAM2505 RNA, herein designated VGAM RNA, also designated SEQ ID:5216.

Another function of VGAM2505 is therefore inhibition of Rabphilin 3A-like (without C2 domains) (RPH3AL, Accession NM_006987), a gene which is a protein transporter. could play a role in neurotransmitter release by regulating membrane flow in the nerve terminal. Accordingly, utilities of VGAM2505 include diagnosis, prevention and treatment of diseases and clinical conditions associated with RPH3AL. The function of RPH3AL and its association with various diseases and clinical conditions, has been established by previous studies, as described hereinabove with reference to VGAM923. Spondyloepiphyseal Dysplasia, Late (SEDL, Accession NM_014563) is another VGAM2505 host target gene. SEDL BINDING SITE1 and SEDL BINDING SITE2 are HOST TARGET binding sites found in untranslated regions of mRNA encoded by SEDL, corresponding to HOST TARGET binding sites such as BINDING SITE I, BINDING SITE II or BINDING SITE III. Table 2 illustrates the complementarity of the nucleotide sequences of SEDL BINDING SITE1 and SEDL BINDING SITE2, designated SEQ ID:15907 and SEQ ID:15908 respectively, to the nucleotide sequence of VGAM2505 RNA, herein designated VGAM RNA, also designated SEQ ID:5216.

Another function of VGAM2505 is therefore inhibition of Spondyloepiphyseal Dysplasia, Late (SEDL, Accession NM_014563), a gene which may play role in vesicular transport from endoplasmic reticulum to golgi. Accordingly, utilities of VGAM2505 include diagnosis, prevention and treatment of diseases and clinical conditions associated with SEDL. The function of SEDL and its association with various diseases and clinical conditions, has been established by previous studies, as described hereinabove with reference to VGAM74. Solute Carrier Family 14 (urea transporter), Member 2 (SLC14A2, Accession NM_007163) is another VGAM2505 host target gene. SLC14A2 BINDING SITE is HOST TARGET binding site found in the 5' untranslated region of mRNA encoded by SLC14A2, corresponding to a HOST TARGET binding site such as BINDING SITE I, BINDING SITE II or BINDING SITE III. Table 2 illustrates the complementarity of the nucleotide sequences of SLC14A2 BINDING SITE, designated SEQ ID:14008, to the nucleotide sequence of VGAM2505 RNA, herein designated VGAM RNA, also designated SEQ ID:5216.

Another function of VGAM2505 is therefore inhibition of Solute Carrier Family 14 (urea transporter), Member 2 (SLC14A2, Accession NM_007163), a gene which is a renal urea transporter 2. Accordingly, utilities of VGAM2505 include diagnosis, prevention and treatment of diseases and clinical conditions associated with SLC14A2. The function of SLC14A2 and its association with various diseases and clinical conditions, has been established by previous studies, as described hereinabove with reference to VGAM74. Sorting Nexin 15 (SNX15, Accession XM_057307) is another VGAM2505 host target gene. SNX15 BINDING SITE is HOST TARGET binding site found in the 3' untranslated region of mRNA encoded by SNX15, corresponding to a HOST TARGET binding site such as BINDING SITE I, BINDING SITE II or BINDING SITE III. Table 2 illustrates the complementarity of the nucleotide sequences of SNX15 BINDING SITE, designated SEQ ID:36504, to the nucleotide sequence of VGAM2505 RNA, herein designated VGAM RNA, also designated SEQ ID:5216.

Another function of VGAM2505 is therefore inhibition of Sorting Nexin 15 (SNX15, Accession XM_057307). Accordingly, utilities of VGAM2505 include diagnosis, prevention and treatment of diseases and clinical conditions associated with SNX15. Sp4 Transcription Factor (SP4, Accession NM_003112) is another VGAM2505 host target gene. SP4 BINDING SITE1 and SP4 BINDING SITE2 are HOST TARGET binding sites found in untranslated regions of mRNA encoded by SP4, corresponding to HOST TARGET binding sites such as BINDING SITE I, BINDING SITE II or BINDING SITE III. Table 2 illustrates the complementarity of the nucleotide sequences of SP4 BINDING SITE1 and SP4 BINDING SITE2, designated SEQ ID:9082 and SEQ ID:9083 respectively, to the nucleotide sequence of VGAM2505 RNA, herein designated VGAM RNA, also designated SEQ ID:5216.

Another function of VGAM2505 is therefore inhibition of Sp4 Transcription Factor (SP4, Accession NM_003112), a gene which binds to gt and gc boxes promoters elements. Accordingly, utilities of VGAM2505 include diagnosis, prevention and treatment of diseases and clinical conditions associated with SP4. The function of SP4 has been established by previous studies. Hagen et al. (1992) performed recognition site screening for factors which bind to the uteroglobin promoter sequence GT box and cloned cDNAs encoding the DNA-binding proteins SP3 (OMIM Ref. No. 601804) and SP4, thus revealing the existence of a multigene family of SP proteins. They found that SP1, SP3, and SP4 exhibit similar structural features: all contain DNA-binding domains composed of 3 zinc fingers of the Cys2/His2 type near the C terminus, and all recognize GC- and GT-box sequences. Additionally, the N termini of all 3 proteins are composed of long serine/threonine- and glutamine-rich regions that have been identified in SP1 as transactivation domains. Hagen et al. (1992) showed by Northern blot analysis that SP4 is abundantly expressed as a 7.5-kb message in brain, but barely detectable in other human cell lines. Hagen et al. (1995) used cotransfection experiments to show that SP4 is an activator protein like SP1. However, in contrast to SP1, they found that SP4 is not able to act synergistically through adjacent binding sites. Animal model experiments lend further support to the function of SP4. Gollner et al. (2001) found that Sp4 knockout mice, with a complete absence of Sp4 expression due to targeted deletion of the exons encoding the N-terminal activation domains, showed a complex phenotype. They developed until birth without obvious abnormalities. After birth, two-thirds died within 4 weeks. Surviving mice were growth retarded. Males homozygous for the null mutation did not breed; the reason for this remained obscure since they showed complete spermatogenesis, and pheromone receptor genes in the vomeronasal organ appeared unaffected. Female null mice had a smaller thymus, spleen, and uterus and exhibited a pronounced delay in sexual maturation. Thus, the phenotype of the Sp4-null mice differed significantly from those described for the Sp1- and Sp3-null mice. The authors concluded that the structural similarities, the common recognition motif, and the overlapping expression pattern of these 3 transcription factors do not reflect similar physiologic functions.

It is appreciated that the abovementioned animal model for SP4 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Gollner, H.; Bouwman, P.; Mangold, M.; Karis, A.; Braun, H.; Rohner, I.; Del Rey, A.; Besedovsky, H.-O.; Meinhardt, A.; van den Broek, M.; Cutforth, T.; Grosveld, F.; Philipsen, S.; Suske, G.: Complex phenotype of mice homozygous for a null mutation in the Sp4 transcription factor gene. Genes Cells 6:689-697, 2001; and Hagen, G.; Dennig, J.; Preiss, M.; Beato, M.; Suske, G.: Functional analyses of the transcription factor Sp4 reveal properties distinct from Sp1 and Sp3. J. Biol. Chem. 270: 24989-24994.

Further studies establishing the function and utilities of SP4 are found in John Hopkins OMIM database record ID 600540, and in sited publications numbered 7687-7691 listed in the bibliography section hereinbelow, which are also hereby incorporated by reference. Tyrosine Aminotransferase (TAT, Accession NM_000353) is another VGAM2505 host target gene. TAT BINDING SITE is HOST TARGET binding site found in the 3' untranslated region of mRNA encoded by TAT, corresponding to a HOST TARGET binding site such as BINDING SITE I, BINDING SITE II or BINDING SITE III. Table 2 illustrates the complementarity of the nucleotide sequences of TAT BINDING SITE, designated SEQ ID:5913, to the nucleotide sequence of VGAM2505 RNA, herein designated VGAM RNA, also designated SEQ ID:5216.

Another function of VGAM2505 is therefore inhibition of Tyrosine Aminotransferase (TAT, Accession NM_000353), a gene which is tyrosine aminotransferase and strongly similar to rat Rn.9947, which plays a role in gluconeogenesis. Accordingly, utilities of VGAM2505 include diagnosis, prevention and treatment of diseases and clinical conditions associated with TAT. The function of TAT and its association with various diseases and clinical conditions, has been established by previous studies, as described hereinabove with reference to VGAM2434. Thromboxane A2 Receptor (TBXA2R, Accession NM_001060) is another VGAM2505 host target gene. TBXA2R BINDING SITE is HOST TARGET binding site found in the 3' untranslated region of mRNA encoded by TBXA2R, corresponding to a HOST TARGET binding site such as BINDING SITE I, BINDING SITE II or BINDING SITE III. Table 2 illustrates the complementarity of the nucleotide sequences of TBXA2R BINDING SITE, designated SEQ ID:6725, to the nucleotide sequence of VGAM2505 RNA, herein designated VGAM RNA, also designated SEQ ID:5216.

Another function of VGAM2505 is therefore inhibition of Thromboxane A2 Receptor (TBXA2R, Accession NM_001060), a gene which activates Ca2+-activated chloride channels; stimulates platelet aggregation and smooth muscle constriction. Accordingly, utilities of VGAM2505 include diagnosis, prevention and treatment of diseases and clinical conditions associated with TBXA2R. The function of TBXA2R and its association with various diseases and clinical conditions, has been established by previous studies, as described hereinabove with reference to VGAM433. Tumor Necrosis Factor (ligand) Superfamily, Member 9 (TNFSF9, Accession NM_003811) is another VGAM2505 host target gene. TNFSF9 BINDING SITE is HOST TARGET binding site found in the 3' untranslated region of mRNA encoded by TNFSF9, corresponding to a HOST TARGET binding site such as BINDING SITE I, BINDING SITE II or BINDING SITE III. Table 2 illustrates the complementarity of the nucleotide sequences of TNFSF9 BINDING SITE, designated SEQ ID:9903, to the nucleotide sequence of VGAM2505 RNA, herein designated VGAM RNA, also designated SEQ ID:5216.

Another function of VGAM2505 is therefore inhibition of Tumor Necrosis Factor (ligand) Superfamily, Member 9 (TNFSF9, Accession NM_003811). Accordingly, utilities of VGAM2505 include diagnosis, prevention and treatment of diseases and clinical conditions associated with TNFSF9. Tensin (TNS, Accession NM_022648) is another VGAM2505 host target gene. TNS BINDING SITE is HOST TARGET binding site found in the 5' untranslated region of mRNA encoded by TNS, corresponding to a HOST TARGET binding site such as BINDING SITE I, BINDING SITE II or BINDING SITE III. Table 2 illustrates the complementarity of the nucleotide sequences of TNS BINDING SITE, designated SEQ ID:22900, to the nucleotide sequence of VGAM2505 RNA, herein designated VGAM RNA, also designated SEQ ID:5216.

Another function of VGAM2505 is therefore inhibition of Tensin (TNS, Accession NM_022648). Accordingly, utilities of VGAM2505 include diagnosis, prevention and treatment of diseases and clinical conditions associated with TNS. TZFP (Accession NM_014383) is another VGAM2505 host target gene. TZFP BINDING SITE is HOST TARGET binding site found in the 5' untranslated region of mRNA encoded by TZFP, corresponding to a HOST TARGET binding site such as BINDING SITE I, BINDING SITE II or BINDING SITE III. Table 2 illustrates the complementarity of the nucleotide sequences of TZFP BINDING SITE, designated SEQ ID:15719, to the nucleotide sequence of VGAM2505 RNA, herein designated VGAM RNA, also designated SEQ ID:5216.

Another function of VGAM2505 is therefore inhibition of TZFP (Accession NM_014383), a gene which is probably a transcription factor. Accordingly, utilities of VGAM2505 include diagnosis, prevention and treatment of diseases and clinical conditions associated with TZFP. The function of TZFP has been established by previous studies. Fanconi anemia (FA) is a genetically heterogeneous disorder composed of at least 8 different complementation groups identified by somatic cell hybrid analysis. However, because FA patients have similar clinical phenotypes (e.g., predisposition to cancer) and cellular phenotypes (hypersensitivity to DNA crosslinking agents), a common molecular pathway has been hypothesized. FANCC (OMIM Ref. No. 227645) has been detected in both the cytoplasm and nucleus and has been shown to interact with other cellular proteins, including FANCA (OMIM Ref. No. 227650). Using a yeast 2-hybrid screen of a B-cell cDNA library with N-terminal sequences of FANCC as bait, and by confirming the interactions using GST pull-down assays, followed by RT-PCR, Hoatlin et al. (1999) isolated a cDNA encoding FAZF. Sequence analysis predicted that the 487-amino acid protein, which is similar to PLZF (OMIM Ref. No. 176797), contains an N-terminal POZ/BTB domain and 3 zinc fingers. Northern blot analysis detected weak expression of a 1.4-kb transcript in most tissues tested except peripheral blood leukocytes, where strong expression was detected, and testis, where strong expression of 2.0-, 2.7-, and 4.4-kb transcripts was detected. Coimmunoprecipitation analysis showed that FAZF associates with FANCC independent of the BTB/POZ domain. Indirect immunofluorescence and confocal microscopy demonstrated almost entirely nuclear expression for FAZF and colocalization with FANCC, which Hoatlin et al. (1999) confirmed is also expressed in cytoplasm in some cells; FANCC and PLZF did not colocalize. EMSA analysis suggested that PLZF and FAZF bind to CpG islands, interact with each other through the POZ domain of PLZF, and repress transcription by a similar mechanism. By database searching, genomic analysis, RT-PCR, and yeast 2-hybrid screening, Lin et al. (1999) cloned FAZF, which they termed TZFP. Genomic sequence analysis determined that the TZFP gene contains 5 exons. Northern blot analysis detected expression of 3 transcripts only in testis.

Full details of the abovementioned studies are described in the following publications, the disclosure of which are hereby incorporated by reference:

Hoatlin, M. E.; Zhi, Y.; Ball, H.; Silvery, K.; Melnick, A.; Stone, S.; Arai, S.; Hawe, N.; Owen, G.; Zelent, A.; Licht, J. D.: A novel BTB/POZ transcriptional repressor protein interacts with the Fanconi anemia group C protein and PLZF. Blood 94: 3737-3747, 1999; and Lin, W.; Lai, C.-H.; Tang, C.-J. C.; Huang, C.-J.; Tang, T. K.: Identification and gene structure of a novel human PLZF-related transcription factor gene, TZFP. Biochem. Biophys. Res. Com.

Further studies establishing the function and utilities of TZFP are found in John Hopkins OMIM database record ID 605859, and in sited publications numbered 6782-6783 listed in the bibliography section hereinbelow, which are also hereby incorporated by reference. Zinc Finger Protein 133 (clone pHZ-13) (ZNF133, Accession NM_003434) is another VGAM2505 host target gene. ZNF133 BINDING SITE is HOST TARGET binding site found in the 5' untranslated region of mRNA encoded by ZNF133, corresponding to a HOST TARGET binding site such as BINDING SITE I, BINDING SITE II or BINDING SITE III. Table 2 illustrates the complementarity of the nucleotide sequences of ZNF133 BINDING SITE, designated SEQ ID:9486, to the nucleotide sequence of VGAM2505 RNA, herein designated VGAM RNA, also designated SEQ ID:5216.

Another function of VGAM2505 is therefore inhibition of Zinc Finger Protein 133 (clone pHZ-13) (ZNF133, Accession NM_003434). Accordingly, utilities of VGAM2505 include diagnosis, prevention and treatment of diseases and clinical conditions associated with ZNF133. Zinc Finger Protein 42 (myeloid-specific retinoic acid- responsive) (ZNF42, Accession NM_003422) is another VGAM2505 host target gene. ZNF42 BINDING SITE is HOST TARGET binding site found in the 5' untranslated region of mRNA encoded by ZNF42, corresponding to a HOST TARGET binding site such as BINDING SITE I, BINDING SITE II or BINDING SITE III. Table 2 illustrates the complementarity of the nucleotide sequences of ZNF42 BINDING SITE, designated SEQ ID:9469, to the nucleotide sequence of VGAM2505 RNA, herein designated VGAM RNA, also designated SEQ ID:5216.

Another function of VGAM2505 is therefore inhibition of Zinc Finger Protein 42 (myeloid-specific retinoic acid-responsive) (ZNF42, Accession NM_003422), a gene which may be one regulator of transcriptional events during hemopoietic development. Accordingly, utilities of VGAM2505 include diagnosis, prevention and treatment of diseases and clinical conditions associated with ZNF42. The function of ZNF42 and its association with various diseases and clinical conditions, has been established by previous studies, as described hereinabove with reference to VGAM173.1-acylglycerol-3-phosphate O-acyltransferase 1 (lysophosphatidic acid acyltransferase, alpha) (AGPAT1, Accession NM_006411) is another VGAM2505 host target gene. AGPAT1 BINDING SITE is HOST TARGET binding site found in the 5' untranslated region of mRNA encoded by AGPAT1, corresponding to a HOST TARGET binding site such as BINDING SITE I, BINDING SITE II or BINDING SITE III. Table 2 illustrates the complementarity of the nucleotide sequences of AGPAT1 BINDING SITE, designated SEQ ID:13115, to the nucleotide sequence of VGAM2505 RNA, herein designated VGAM RNA, also designated SEQ ID:5216.

Another function of VGAM2505 is therefore inhibition of 1-acylglycerol-3-phosphate O-acyltransferase 1 (lysophosphatidic acid acyltransferase, alpha) (AGPAT1, Accession NM_006411). Accordingly, utilities of VGAM2505 include diagnosis, prevention and treatment of diseases and clinical conditions associated with AGPAT1. Adenylate Kinase 5 (AK5, Accession NM_012093) is another VGAM2505 host target gene. AK5 BINDING SITE is HOST TARGET binding site found in the 3' untranslated region of mRNA encoded by AK5, corresponding to a HOST TARGET binding site such as BINDING SITE I, BINDING SITE II or BINDING SITE III. Table 2 illustrates the complementarity of the nucleotide sequences of AK5 BINDING SITE, designated SEQ ID:14393, to the nucleotide sequence of VGAM2505 RNA, herein designated VGAM RNA, also designated SEQ ID:5216.

Another function of VGAM2505 is therefore inhibition of Adenylate Kinase 5 (AK5, Accession NM_012093). Accordingly, utilities of VGAM2505 include diagnosis, prevention and treatment of diseases and clinical conditions associated with AK5. APCL (Accession NM_005883) is another VGAM2505 host target gene. APCL BINDING SITE is HOST TARGET binding site found in the 3' untranslated region of mRNA encoded by APCL, corresponding to a HOST TARGET binding site such as BINDING SITE I, BINDING SITE II or BINDING SITE III. Table 2 illustrates the complementarity of the nucleotide sequences of APCL BINDING SITE, designated SEQ ID:12498, to the nucleotide sequence of VGAM2505 RNA, herein designated VGAM RNA, also designated SEQ ID:5216.

Another function of VGAM2505 is therefore inhibition of APCL (Accession NM_005883). Accordingly, utilities of VGAM2505 include diagnosis, prevention and treatment of diseases and clinical conditions associated with APCL. Rho GTPase Activating Protein 5 (ARHGAP5, Accession XM_085082) is another VGAM2505 host target gene. ARHGAP5 BINDING SITE is HOST TARGET binding site found in the 5' untranslated region of mRNA encoded by ARHGAP5, corresponding to a HOST TARGET binding site such as BINDING SITE I, BINDING SITE II or BINDING SITE III. Table 2 illustrates the complementarity of the nucleotide sequences of ARHGAP5 BINDING SITE, designated SEQ ID:37816, to the nucleotide sequence of VGAM2505 RNA, herein designated VGAM RNA, also designated SEQ ID:5216.

Another function of VGAM2505 is therefore inhibition of Rho GTPase Activating Protein 5 (ARHGAP5, Accession XM_085082). Accordingly, utilities of VGAM2505 include diagnosis, prevention and treatment of diseases and clinical conditions associated with ARHGAP5. ATPase, (Na+)/K+ Transporting, Beta 4 Polypeptide (ATP1B4, Accession NM_012069) is another VGAM2505 host target gene. ATP1B4 BINDING SITE is HOST TARGET binding site found in the 3' untranslated region of mRNA encoded by ATP1B4, corresponding to a HOST TARGET binding site such as BINDING SITE I, BINDING SITE II or BINDING SITE III. Table 2 illustrates the complementarity of the nucleotide sequences of ATP1B4 BINDING SITE, designated SEQ ID:14323, to the nucleotide sequence of VGAM2505 RNA, herein designated VGAM RNA, also designated SEQ ID:5216.

Another function of VGAM2505 is therefore inhibition of ATPase, (Na+)/K+ Transporting, Beta 4 Polypeptide (ATP1B4, Accession NM_012069). Accordingly, utilities of VGAM2505 include diagnosis, prevention and treatment of diseases and clinical conditions associated with ATP1B4. BA108L7.2 (Accession NM_030971) is another VGAM2505 host target gene. BA108L7.2 BINDING SITE is HOST TARGET binding site found in the 3' untranslated region of mRNA encoded by BA108L7.2, corresponding to a HOST TARGET binding site such as BINDING SITE I, BINDING SITE II or BINDING SITE III. Table 2 illustrates the complementarity of the nucleotide sequences of BA108L7.2 BINDING SITE, designated SEQ ID:25239, to the nucleotide sequence of VGAM2505 RNA, herein designated VGAM RNA, also designated SEQ ID:5216.

Another function of VGAM2505 is therefore inhibition of BA108L7.2 (Accession NM_030971). Accordingly, utilities of VGAM2505 include diagnosis, prevention and treatment of diseases and clinical conditions associated with BA108L7.2. BCL2-associated Athanogene 5 (BAG5, Accession NM_004873) is another VGAM2505 host target gene. BAG5 BINDING SITE is HOST TARGET binding site found in the 3' untranslated region of mRNA encoded by BAG5, corresponding to a HOST TARGET binding site such as BINDING SITE I, BINDING SITE II or BINDING SITE III. Table 2 illustrates the complementarity of the nucleotide sequences of BAG5 BINDING SITE, designated SEQ ID:11302, to the nucleotide sequence of VGAM2505 RNA, herein designated VGAM RNA, also designated SEQ ID:5216.

Another function of VGAM2505 is therefore inhibition of BCL2-associated Athanogene 5 (BAG5, Accession NM_004873). Accordingly, utilities of VGAM2505 include diagnosis, prevention and treatment of diseases and clinical conditions associated with BAG5. BMF (Accession NM_033503) is another VGAM2505 host target gene. BMF BINDING SITE1 and BMF BINDING SITE2 are HOST TARGET binding sites found in untranslated regions of mRNA encoded by BMF, corresponding to HOST TARGET binding sites such as BINDING SITE I, BINDING SITE II or BINDING SITE III. Table 2 illustrates the complementarity of the nucleotide sequences of BMF BINDING SITE1 and BMF BINDING SITE2, designated SEQ ID:27276 and SEQ ID:27280 respectively, to the nucleotide sequence of VGAM2505 RNA, herein designated VGAM RNA, also designated SEQ ID:5216.

Another function of VGAM2505 is therefore inhibition of BMF (Accession NM_033503). Accordingly, utilities of VGAM2505 include diagnosis, prevention and treatment of diseases and clinical conditions associated with BMF. Chromosome 9 Open Reading Frame 9 (C9orf9, Accession NM_018956) is another VGAM2505 host target gene. C9orf9 BINDING SITE is HOST TARGET binding site found in the 3' untranslated region of mRNA encoded by C9orf9, corresponding to a HOST TARGET binding site such as BINDING SITE I, BINDING SITE II or BINDING SITE III. Table 2 illustrates the complementarity of the nucleotide sequences of C9orf9 BINDING SITE, designated SEQ ID:21026, to the nucleotide sequence of VGAM2505 RNA, herein designated VGAM RNA, also designated SEQ ID:5216.

Another function of VGAM2505 is therefore inhibition of Chromosome 9 Open Reading Frame 9 (C9orf9, Accession NM_018956). Accordingly, utilities of VGAM2505 include diagnosis, prevention and treatment of diseases and clinical conditions associated with C9orf9. Centaurin, Alpha 1 (CENTA1, Accession NM_006869) is another VGAM2505 host target gene. CENTA1 BINDING SITE is HOST TARGET binding site found in the 3' untranslated region of mRNA encoded by CENTA1, corresponding to a HOST TARGET binding site such as BINDING SITE I, BINDING SITE II or BINDING SITE III. Table 2 illustrates the complementarity of the nucleotide sequences of CENTA1 BINDING SITE, designated SEQ ID:13739, to the nucleotide sequence of VGAM2505 RNA, herein designated VGAM RNA, also designated SEQ ID:5216.

Another function of VGAM2505 is therefore inhibition of Centaurin, Alpha 1 (CENTA1, Accession NM_006869). Accordingly, utilities of VGAM2505 include diagnosis, prevention and treatment of diseases and clinical conditions associated with CENTA1. Claudin 6 (CLDN6, Accession NM_021195) is another VGAM2505 host target gene. CLDN6 BINDING SITE is HOST TARGET binding site found in the 3' untranslated region of mRNA encoded by CLDN6, corresponding to a HOST TARGET binding site such as BINDING SITE I, BINDING SITE II or BINDING SITE III. Table 2 illustrates the complementarity of the nucleotide sequences of CLDN6 BINDING SITE, designated SEQ ID:22171, to the nucleotide sequence of VGAM2505 RNA, herein designated VGAM RNA, also designated SEQ ID:5216.

Another function of VGAM2505 is therefore inhibition of Claudin 6 (CLDN6, Accession NM_021195). Accordingly, utilities of VGAM2505 include diagnosis, prevention and treatment of diseases and clinical conditions associated with CLDN6. Calsenilin, Presenilin Binding Protein, EF Hand Transcription Factor (CSEN, Accession NM_013434) is another VGAM2505 host target gene. CSEN BINDING SITE is HOST TARGET binding site found in the 3' untranslated region of mRNA encoded by CSEN, corresponding to a HOST TARGET binding site such as BINDING SITE I, BINDING SITE II or BINDING SITE III. Table 2 illustrates the complementarity of the nucleotide sequences of CSEN BINDING SITE, designated SEQ ID:15087, to the nucleotide sequence of VGAM2505 RNA, herein designated VGAM RNA, also designated SEQ ID:5216.

Another function of VGAM2505 is therefore inhibition of Calsenilin, Presenilin Binding Protein, EF Hand Transcription Factor (CSEN, Accession NM_013434). Accordingly, utilities of VGAM2505 include diagnosis, prevention and treatment of diseases and clinical conditions associated with CSEN. Diacylglycerol Kinase, Zeta 104 kDa (DGKZ, Accession NM_003646) is another VGAM2505 host target gene. DGKZ BINDING SITE is HOST TARGET binding site found in the 3' untranslated region of mRNA encoded by DGKZ, corresponding to a HOST TARGET binding site such as BINDING SITE I, BINDING SITE II or BINDING SITE III. Table 2 illustrates the complementarity of the nucleotide sequences of DGKZ BINDING SITE, designated SEQ ID:9721, to the nucleotide sequence of VGAM2505 RNA, herein designated VGAM RNA, also designated SEQ ID:5216.

Another function of VGAM2505 is therefore inhibition of Diacylglycerol Kinase, Zeta 104 kDa (DGKZ, Accession NM_003646). Accordingly, utilities of VGAM2505 include diagnosis, prevention and treatment of diseases and clinical conditions associated with DGKZ. DKFZp434A2417 (Accession XM_038526) is another VGAM2505 host target gene. DKFZp434A2417 BINDING SITE is HOST TARGET binding site found in the 3' untranslated region of mRNA encoded by DKFZp434A2417, corresponding to a HOST TARGET binding site such as BINDING SITE I, BINDING SITE II or BINDING SITE III. Table 2 illustrates the complementarity of the nucleotide sequences of DKFZp434A2417 BINDING SITE, designated SEQ ID:32860, to the nucleotide sequence of VGAM2505 RNA, herein designated VGAM RNA, also designated SEQ ID:5216.

Another function of VGAM2505 is therefore inhibition of DKFZp434A2417 (Accession XM_038526). Accordingly, utilities of VGAM2505 include diagnosis, prevention and treatment of diseases and clinical conditions associated with DKFZp434A2417. DKFZP434C212 (Accession XM_044196) is another VGAM2505 host target gene. DKFZP434C212 BINDING SITE is HOST TARGET binding site found in the 3' untranslated region of mRNA encoded by DKFZP434C212, corresponding to a HOST TARGET binding site such as BINDING SITE I, BINDING SITE II or BINDING SITE III. Table 2 illustrates the complementarity of the nucleotide sequences of DKFZP434C212 BINDING SITE, designated SEQ ID:34168, to the nucleotide sequence of VGAM2505 RNA, herein designated VGAM RNA, also designated SEQ ID:5216.

Another function of VGAM2505 is therefore inhibition of DKFZP434C212 (Accession XM_044196). Accordingly, utilities of VGAM2505 include diagnosis, prevention and treatment of diseases and clinical conditions associated with DKFZP434C212. DKFZp434J0226 (Accession XM_051327) is another VGAM2505 host target gene. DKFZp434J0226 BINDING SITE is HOST TARGET binding site found in the 5' untranslated region of mRNA encoded by DKFZp434J0226, corresponding to a HOST TARGET binding site such as BINDING SITE I, BINDING SITE II or BINDING SITE III. Table 2 illustrates the complementarity of the nucleotide sequences of DKFZp434J0226 BINDING SITE, designated SEQ ID:35805, to the nucleotide sequence of VGAM2505 RNA, herein designated VGAM RNA, also designated SEQ ID:5216.

Another function of VGAM2505 is therefore inhibition of DKFZp434J0226 (Accession XM_051327). Accordingly, utilities of VGAM2505 include diagnosis, prevention and treatment of diseases and clinical conditions associated with DKFZp434J0226. DKFZP434L187 (Accession XM_044070) is another VGAM2505 host target gene. DKFZP434L187 BINDING SITE is HOST TARGET binding site found in the 5' untranslated region of mRNA encoded by DKFZP434L187, corresponding to a HOST TARGET binding site such as BINDING SITE I, BINDING SITE II or BINDING SITE III. Table 2 illustrates the complementarity of the nucleotide sequences of DKFZP434L187 BINDING SITE, designated SEQ ID:34123, to the nucleotide sequence of VGAM2505 RNA, herein designated VGAM RNA, also designated SEQ ID:5216.

Another function of VGAM2505 is therefore inhibition of DKFZP434L187 (Accession XM_044070). Accordingly, utilities of VGAM2505 include diagnosis, prevention and treatment of diseases and clinical conditions associated with DKFZP434L187. DKFZp547H025 (Accession NM_020161) is another VGAM2505 host target gene. DKFZp547H025 BINDING SITE is HOST TARGET binding site found in the 3' untranslated region of mRNA encoded by DKFZp547H025, corresponding to a HOST TARGET binding site such as BINDING SITE I, BINDING SITE II or BINDING SITE III. Table 2 illustrates the complementarity of the nucleotide sequences of DKFZp547H025 BINDING SITE, designated SEQ ID:21369, to the nucleotide sequence of VGAM2505 RNA, herein designated VGAM RNA, also designated SEQ ID:5216.

Another function of VGAM2505 is therefore inhibition of DKFZp547H025 (Accession NM_020161). Accordingly, utilities of VGAM2505 include diagnosis, prevention and treatment of diseases and clinical conditions associated with DKFZp547H025. DKFZP564O0523 (Accession NM_032120) is another VGAM2505 host target gene. DKFZP564O0523 BINDING SITE is HOST TARGET binding site found in the 3' untranslated region of mRNA encoded by DKFZP564O0523, corresponding to a HOST TARGET binding site such as BINDING SITE I, BINDING SITE II or BINDING SITE III. Table 2 illustrates the complementarity of the nucleotide sequences of DKFZP564O0523 BINDING SITE, designated SEQ ID:25804, to the nucleotide sequence of VGAM2505 RNA, herein designated VGAM RNA, also designated SEQ ID:5216.

Another function of VGAM2505 is therefore inhibition of DKFZP564O0523 (Accession NM_032120). Accordingly, utilities of VGAM2505 include diagnosis, prevention and treatment of diseases and clinical conditions associated with DKFZP564O0523. Dystrophia Myotonica-containing WD Repeat Motif (DMWD, Accession XM_027569) is another VGAM2505 host target gene. DMWD BINDING SITE is HOST TARGET binding site found in the 3' untranslated region of mRNA encoded by DMWD, corresponding to a HOST TARGET binding site such as BINDING SITE I, BINDING SITE II or BINDING SITE III. Table 2 illustrates the complementarity of the nucleotide sequences of DMWD BINDING SITE, designated SEQ ID:30531, to the nucleotide sequence of VGAM2505 RNA, herein designated VGAM RNA, also designated SEQ ID:5216.

Another function of VGAM2505 is therefore inhibition of Dystrophia Myotonica-containing WD Repeat Motif (DMWD, Accession XM_027569). Accordingly, utilities of VGAM2505 include diagnosis, prevention and treatment of diseases and clinical conditions associated with DMWD. FBP17 (Accession XM_052666) is another VGAM2505 host target gene. FBP17 BINDING SITE is HOST TARGET binding site found in the 3' untranslated region of mRNA encoded by FBP17, corresponding to a HOST TARGET binding site such as BINDING SITE I, BINDING SITE II or BINDING SITE III. Table 2 illustrates the complementarity of the nucleotide sequences of FBP17 BINDING SITE, designated SEQ ID:36048, to the nucleotide sequence of VGAM2505 RNA, herein designated VGAM RNA, also designated SEQ ID:5216.

Another function of VGAM2505 is therefore inhibition of FBP17 (Accession XM_052666). Accordingly, utilities of VGAM2505 include diagnosis, prevention and treatment of diseases and clinical conditions associated with FBP17. FLJ00007 (Accession XM_048928) is another VGAM2505 host target gene. FLJ00007 BINDING SITE is HOST TARGET binding site found in the 3' untranslated region of mRNA encoded by FLJ00007, corresponding to a HOST TARGET binding site such as BINDING SITE I, BINDING SITE II or BINDING SITE III. Table 2 illustrates the complementarity of the nucleotide sequences of FLJ00007 BINDING SITE, designated SEQ ID:35313, to the nucleotide sequence of VGAM2505 RNA, herein designated VGAM RNA, also designated SEQ ID:5216.

Another function of VGAM2505 is therefore inhibition of FLJ00007 (Accession XM_048928). Accordingly, utilities of VGAM2505 include diagnosis, prevention and treatment of diseases and clinical conditions associated with FLJ00007. FLJ10748 (Accession NM_018203) is another VGAM2505 host target gene. FLJ10748 BINDING SITE is HOST TARGET binding site found in the 3' untranslated region of mRNA encoded by FLJ10748, corresponding to a HOST TARGET binding site such as BINDING SITE I, BINDING SITE II or BINDING SITE III. Table 2 illustrates the complementarity of the nucleotide sequences of FLJ10748 BINDING SITE, designated SEQ ID:20085, to the nucleotide sequence of VGAM2505 RNA, herein designated VGAM RNA, also designated SEQ ID:5216.

Another function of VGAM2505 is therefore inhibition of FLJ10748 (Accession NM_018203). Accordingly, utilities of VGAM2505 include diagnosis, prevention and treatment of diseases and clinical conditions associated with FLJ10748. FLJ12363 (Accession NM_032167) is another VGAM2505 host target gene. FLJ12363 BINDING SITE is HOST TARGET binding site found in the 3' untranslated region of mRNA encoded by FLJ12363, corresponding to a HOST TARGET binding site such as BINDING SITE I, BINDING SITE II or BINDING SITE III. Table 2 illustrates the complementarity of the nucleotide sequences of FLJ12363 BINDING SITE, designated SEQ ID:25866, to the nucleotide sequence of VGAM2505 RNA, herein designated VGAM RNA, also designated SEQ ID:5216.

Another function of VGAM2505 is therefore inhibition of FLJ12363 (Accession NM_032167). Accordingly, utilities of VGAM2505 include diagnosis, prevention and treatment of diseases and clinical conditions associated with FLJ12363. FLJ12529 (Accession NM_024811) is another VGAM2505 host target gene. FLJ12529 BINDING SITE is HOST TARGET binding site found in the 3' untranslated region of mRNA encoded by FLJ12529, corresponding to a HOST TARGET binding site such as BINDING SITE I, BINDING SITE II or BINDING SITE III. Table 2 illustrates the complementarity of the nucleotide sequences of FLJ12529 BINDING SITE, designated SEQ ID:24191, to the nucleotide sequence of VGAM2505 RNA, herein designated VGAM RNA, also designated SEQ ID:5216.

Another function of VGAM2505 is therefore inhibition of FLJ12529 (Accession NM_024811). Accordingly, utilities of VGAM2505 include diagnosis, prevention and treatment of diseases and clinical conditions associated with FLJ12529. FLJ12903 (Accession NM_022753) is another VGAM2505 host target gene. FLJ12903 BINDING SITE is HOST TARGET binding site found in the 3' untranslated region of mRNA encoded by FLJ12903, corresponding to a HOST TARGET binding site such as BINDING SITE I, BINDING SITE II or BINDING SITE III. Table 2 illustrates the complementarity of the nucleotide sequences of FLJ12903 BINDING SITE, designated SEQ ID:22978, to the nucleotide sequence of VGAM2505 RNA, herein designated VGAM RNA, also designated SEQ ID:5216.

Another function of VGAM2505 is therefore inhibition of FLJ12903 (Accession NM_022753). Accordingly, utilities of VGAM2505 include diagnosis, prevention and treatment of diseases and clinical conditions associated with FLJ12903. FLJ12973 (Accession NM_024908) is another VGAM2505 host target gene. FLJ12973 BINDING SITE is HOST TARGET binding site found in the 3' untranslated region of mRNA encoded by FLJ12973, corresponding to a HOST TARGET binding site such as BINDING SITE I, BINDING SITE II or BINDING SITE III. Table 2 illustrates the complementarity of the nucleotide sequences of FLJ12973 BINDING SITE, designated SEQ ID:24406, to the nucleotide sequence of VGAM2505 RNA, herein designated VGAM RNA, also designated SEQ ID:5216.

Another function of VGAM2505 is therefore inhibition of FLJ12973 (Accession NM_024908). Accordingly, utilities of VGAM2505 include diagnosis, prevention and treatment of diseases and clinical conditions associated with FLJ12973. FLJ14950 (Accession NM_032865) is another VGAM2505 host target gene. FLJ14950 BINDING SITE is HOST TARGET binding site found in the 3' untranslated region of mRNA encoded by FLJ14950, corresponding to a HOST TARGET binding site such as BINDING SITE I, BINDING SITE II or BINDING SITE III. Table 2 illustrates the complementarity of the nucleotide sequences of FLJ14950 BINDING SITE, designated SEQ ID:26672, to the nucleotide sequence of VGAM2505 RNA, herein designated VGAM RNA, also designated SEQ ID:5216.

Another function of VGAM2505 is therefore inhibition of FLJ14950 (Accession NM_032865). Accordingly, utilities of VGAM2505 include diagnosis, prevention and treatment of diseases and clinical conditions associated with FLJ14950. FLJ20079 (Accession NM_017656) is another VGAM2505 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19176, to the nucleotide sequence of VGAM2505 RNA, herein designated VGAM RNA, also designated SEQ ID:5216.

Another function of VGAM2505 is therefore inhibition of FLJ20079 (Accession NM_017656). Accordingly, utilities of VGAM2505 include diagnosis, prevention and treatment of diseases and clinical conditions associated with FLJ20079. FLJ20113 (Accession NM_017670) is another VGAM2505 host target gene. FLJ20113 BINDING SITE is HOST TARGET binding site found in the 3' untranslated region of mRNA encoded by FLJ20113, corresponding to a HOST TARGET binding site such as BINDING SITE I, BINDING SITE II or BINDING SITE III. Table 2 illustrates the complementarity of the nucleotide sequences of FLJ20113 BIND- ING SITE, designated SEQ ID:19211, to the nucleotide sequence of VGAM2505 RNA, herein designated VGAM RNA, also designated SEQ ID:5216.

Another function of VGAM2505 is therefore inhibition of FLJ20113 (Accession NM_017670). Accordingly, utilities of VGAM2505 include diagnosis, prevention and treatment of diseases and clinical conditions associated with FLJ20113. FLJ21709 (Accession XM_085480) is another VGAM2505 host target gene. FLJ21709 BINDING SITE is HOST TARGET binding site found in the 3' untranslated region of mRNA encoded by FLJ21709, corresponding to a HOST TARGET binding site such as BINDING SITE I, BINDING SITE II or BINDING SITE III. Table 2 illustrates the complementarity of the nucleotide sequences of FLJ21709 BINDING SITE, designated SEQ ID:38167, to the nucleotide sequence of VGAM2505 RNA, herein designated VGAM RNA, also designated SEQ ID:5216.

Another function of VGAM2505 is therefore inhibition of FLJ21709 (Accession XM_085480). Accordingly, utilities of VGAM2505 include diagnosis, prevention and treatment of diseases and clinical conditions associated with FLJ21709. FLJ22002 (Accession NM_024838) is another VGAM2505 host target gene. FLJ22002 BINDING SITE is HOST TARGET binding site found in the 3' untranslated region of mRNA encoded by FLJ22002, corresponding to a HOST TARGET binding site such as BINDING SITE I, BINDING SITE II or BINDING SITE III. Table 2 illustrates the complementarity of the nucleotide sequences of FLJ22002 BINDING SITE, designated SEQ ID:24245, to the nucleotide sequence of VGAM2505 RNA, herein designated VGAM RNA, also designated SEQ ID:5216.

Another function of VGAM2505 is therefore inhibition of FLJ22002 (Accession NM_024838). Accordingly, utilities of VGAM2505 include diagnosis, prevention and treatment of diseases and clinical conditions associated with FLJ22002. FLJ22531 (Accession NM_024650) is another VGAM2505 host target gene. FLJ22531 BINDING SITE is HOST TARGET binding site found in the 5' untranslated region of mRNA encoded by FLJ22531, corresponding to a HOST TARGET binding site such as BINDING SITE I, BINDING SITE II or BINDING SITE III. Table 2 illustrates the complementarity of the nucleotide sequences of FLJ22531 BINDING SITE, designated SEQ ID:23944, to the nucleotide sequence of VGAM2505 RNA, herein designated VGAM RNA, also designated SEQ ID:5216.

Another function of VGAM2505 is therefore inhibition of FLJ22531 (Accession NM_024650). Accordingly, utilities of VGAM2505 include diagnosis, prevention and treatment of diseases and clinical conditions associated with FLJ22531. FLJ22794 (Accession XM_166220) is another VGAM2505 host target gene. FLJ22794 BINDING SITE is HOST TARGET binding site found in the 3' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44023, to the nucleotide sequence of VGAM2505 RNA, herein designated VGAM RNA, also designated SEQ ID:5216.

Another function of VGAM2505 is therefore inhibition of FLJ22794 (Accession XM_166220). Accordingly, utilities of VGAM2505 include diagnosis, prevention and treatment of diseases and clinical conditions associated with FLJ22794. GMPPB (Accession XM_171044) is another VGAM2505 host target gene. GMPPB BINDING SITE is HOST TARGET binding site found in the 5' untranslated region of mRNA encoded by GMPPB, corresponding to a HOST TARGET binding site such as BINDING SITE I, BINDING SITE II or BINDING SITE III. Table 2 illustrates the complementarity of the nucleotide sequences of GMPPB BINDING SITE, designated SEQ ID:45812, to the nucleotide sequence of VGAM2505 RNA, herein designated VGAM RNA, also designated SEQ ID:5216.

Another function of VGAM2505 is therefore inhibition of GMPPB (Accession XM_171044). Accordingly, utilities of VGAM2505 include diagnosis, prevention and treatment of diseases and clinical conditions associated with GMPPB. H-plk (Accession NM_015852) is another VGAM2505 host target gene. H-plk BINDING SITE is HOST TARGET binding site found in the 5' untranslated region of mRNA encoded by H-plk, corresponding to a HOST TARGET binding site such as BINDING SITE I, BINDING SITE II or BINDING SITE III. Table 2 illustrates the complementarity of the nucleotide sequences of H-plk BINDING SITE, designated SEQ ID:17984, to the nucleotide sequence of VGAM2505 RNA, herein designated VGAM RNA, also designated SEQ ID:5216.

Another function of VGAM2505 is therefore inhibition of H-plk (Accession NM_015852). Accordingly, utilities of VGAM2505 include diagnosis, prevention and treatment of diseases and clinical conditions associated with H-plk. ICK (Accession NM_014920) is another VGAM2505 host target gene. ICK BINDING SITE is HOST TARGET binding site found in the 3' untranslated region of mRNA encoded by ICK, corresponding to a HOST TARGET binding site such as BINDING SITE I, BINDING SITE II or BINDING SITE III. Table 2 illustrates the complementarity of the nucleotide sequences of ICK BINDING SITE, designated SEQ ID:17195, to the nucleotide sequence of VGAM2505 RNA, herein designated VGAM RNA, also designated SEQ ID:5216.

Another function of VGAM2505 is therefore inhibition of ICK (Accession NM_014920). Accordingly, utilities of VGAM2505 include diagnosis, prevention and treatment of diseases and clinical conditions associated with ICK. KIAA0063 (Accession NM_014876) is another VGAM2505 host target gene. KIAA0063 BINDING SITE is HOST TARGET binding site found in the 3" untranslated region of mRNA encoded by KIAA0063, corresponding to a HOST TARGET binding site such as BINDING SITE I, BINDING SITE II or BINDING SITE III. Table 2 illustrates the complementarity of the nucleotide sequences of KIAA0063 BINDING SITE, designated SEQ ID:17016, to the nucleotide sequence of VGAM2505 RNA, herein designated VGAM RNA, also designated SEQ ID:5216.

Another function of VGAM2505 is therefore inhibition of KIAA0063 (Accession NM_014876). Accordingly, utilities of VGAM2505 include diagnosis, prevention and treatment of diseases and clinical conditions associated with KIAA0063. KIAA0429 (Accession NM_014751) is another VGAM2505 host target gene. KIAA0429 BINDING SITE is HOST TARGET binding site found in the 5' untranslated region of mRNA encoded by KIAA0429, corresponding to a HOST TARGET binding site such as BINDING SITE I, BINDING SITE II or BINDING SITE III. Table 2 illustrates the complementarity of the nucleotide sequences of KIAA0429 BINDING SITE, designated SEQ ID:16471, to the nucleotide sequence of VGAM2505 RNA, herein designated VGAM RNA, also designated SEQ ID:5216.

Another function of VGAM2505 is therefore inhibition of KIAA0429 (Accession NM_014751). Accordingly, utilities of VGAM2505 include diagnosis, prevention and treatment of diseases and clinical conditions associated with KIAA0429. KIAA0450 (Accession NM_014638) is another VGAM2505 host target gene. KIAA0450 BINDING SITE is HOST TARGET binding site found in the 3' untranslated region of mRNA encoded by KIAA0450, corresponding to a HOST TARGET binding site such as BINDING SITE I, BINDING SITE II or BINDING SITE III. Table 2 illustrates the complementarity of the nucleotide sequences of KIAA0450 BINDING SITE, designated SEQ ID:16028, to the nucleotide sequence of VGAM2505 RNA, herein designated VGAM RNA, also designated SEQ ID:5216.

Another function of VGAM2505 is therefore inhibition of KIAA0450 (Accession NM_014638). Accordingly, utilities of VGAM2505 include diagnosis, prevention and treatment of diseases and clinical conditions associated with KIAA0450. KIAA0459 (Accession XM_027862) is another VGAM2505 host target gene. KIAA0459 BINDING SITE is HOST TARGET binding site found in the 3' untranslated region of mRNA encoded by KIAA0459, corresponding to a HOST TARGET binding site such as BINDING SITE I, BINDING SITE II or BINDING SITE III. Table 2 illustrates the complementarity of the nucleotide sequences of KIAA0459 BINDING SITE, designated SEQ ID:30574, to the nucleotide sequence of VGAM2505 RNA, herein designated VGAM RNA, also designated SEQ ID:5216.

Another function of VGAM2505 is therefore inhibition of KIAA0459 (Accession XM_027862). Accordingly, utilities of VGAM2505 include diagnosis, prevention and treatment of diseases and clinical conditions associated with KIAA0459. KIAA0513 (Accession NM_014732) is another VGAM2505 host target gene. KIAA0513 BINDING SITE is HOST TARGET binding site found in the 3' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16354, to the nucleotide sequence of VGAM2505 RNA, herein designated VGAM RNA, also designated SEQ ID:5216.

Another function of VGAM2505 is therefore inhibition of KIAA0513 (Accession NM_014732). Accordingly, utilities of VGAM2505 include diagnosis, prevention and treatment of diseases and clinical conditions associated with KIAA0513. KIAA0532 (Accession XM_047659) is another VGAM2505 host target gene. KIAA0532 BINDING SITE is HOST TARGET binding site found in the 3' untranslated region of mRNA encoded by KIAA0532, corresponding to a HOST TARGET binding site such as BINDING SITE I, BINDING SITE II or BINDING SITE III. Table 2 illustrates the complementarity of the nucleotide sequences of KIAA0532 BINDING SITE, designated SEQ ID:35024, to the nucleotide sequence of VGAM2505 RNA, herein designated VGAM RNA, also designated SEQ ID:5216.

Another function of VGAM2505 is therefore inhibition of KIAA0532 (Accession XM_047659). Accordingly, utilities of VGAM2505 include diagnosis, prevention and treatment of diseases and clinical conditions associated with KIAA0532. KIAA0557 (Accession XM_085507) is another VGAM2505 host target gene. KIAA0557 BINDING SITE is HOST TARGET binding site found in the 3' untranslated region of mRNA encoded by KIAA0557, corresponding to a HOST TARGET binding site such as BINDING SITE I, BINDING SITE II or BINDING SITE III. Table 2 illustrates the complementarity of the nucleotide sequences of KIAA0557 BINDING SITE, designated SEQ ID:38211, to the nucleotide sequence of VGAM2505 RNA, herein designated VGAM RNA, also designated SEQ ID:5216.

Another function of VGAM2505 is therefore inhibition of KIAA0557 (Accession XM_085507). Accordingly, utilities of VGAM2505 include diagnosis, prevention and treatment of diseases and clinical conditions associated with KIAA0557. KIAA0562 (Accession NM_014704) is another VGAM2505 host target gene. KIAA0562 BINDING SITE is HOST TARGET binding site found in the 3' untranslated region of mRNA encoded by KIAA0562, corresponding to a HOST TARGET binding site such as BINDING SITE I, BINDING SITE II or BINDING SITE III. Table 2 illustrates the complementarity of the nucleotide sequences of KIAA0562 BINDING SITE, designated SEQ ID:16242, to the nucleotide sequence of VGAM2505 RNA, herein designated VGAM RNA, also designated SEQ ID:5216.

Another function of VGAM2505 is therefore inhibition of KIAA0562 (Accession NM_014704). Accordingly, utilities of VGAM2505 include diagnosis, prevention and treatment of diseases and clinical conditions associated with KIAA0562. KIAA0841 (Accession XM_049237) is another VGAM2505 host target gene. KIAA0841 BINDING SITE is HOST TARGET binding site found in the 3' untranslated region of mRNA encoded by KIAA0841, corresponding to a HOST TARGET binding site such as BINDING SITE I, BINDING SITE II or BINDING SITE III. Table 2 illustrates the complementarity of the nucleotide sequences of KIAA0841 BINDING SITE, designated SEQ ID:35362, to the nucleotide sequence of VGAM2505 RNA, herein designated VGAM RNA, also designated SEQ ID:5216.

Another function of VGAM2505 is therefore inhibition of KIAA0841 (Accession XM_049237). Accordingly, utilities of VGAM2505 include diagnosis, prevention and treatment of diseases and clinical conditions associated with KIAA0841. KIAA1196 (Accession XM_028968) is another VGAM2505 host target gene. KIAA1196 BINDING SITE is HOST TARGET binding site found in the 3' untranslated region of mRNA encoded by KIAA1196, corresponding to a HOST TARGET binding site such as BINDING SITE I, BINDING SITE II or BINDING SITE III. Table 2 illustrates the complementarity of the nucleotide sequences of KIAA1196 BINDING SITE, designated SEQ ID:30816, to the nucleotide sequence of VGAM2505 RNA, herein designated VGAM RNA, also designated SEQ ID:5216.

Another function of VGAM2505 is therefore inhibition of KIAA1196 (Accession XM_028968). Accordingly, utilities of VGAM2505 include diagnosis, prevention and treatment of diseases and clinical conditions associated with KIAA1196. KIAA1198 (Accession XM_032674) is another VGAM2505 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31706, to the nucleotide sequence of VGAM2505 RNA, herein designated VGAM RNA, also designated SEQ ID:5216.

Another function of VGAM2505 is therefore inhibition of KIAA1198 (Accession XM_032674). Accordingly, utilities of VGAM2505 include diagnosis, prevention and treatment of diseases and clinical conditions associated with KIAA1198. KIAA1257 (Accession XM_031577) is another VGAM2505 host target gene. KIAA1257 BINDING SITE is HOST TARGET binding site found in the 3' untranslated region of mRNA encoded by KIAA1257, corresponding to a HOST TARGET binding site such as BINDING SITE I, BINDING SITE II or BINDING SITE III. Table 2 illustrates the complementarity of the nucleotide sequences of KIAA1257 BINDING SITE, designated SEQ ID:31431, to the nucleotide sequence of VGAM2505 RNA, herein designated VGAM RNA, also designated SEQ ID:5216.

Another function of VGAM2505 is therefore inhibition of KIAA1257 (Accession XM_031577). Accordingly, utilities of VGAM2505 include diagnosis, prevention and treatment of diseases and clinical conditions associated with KIAA1257. KIAA1373 (Accession XM_048195) is another VGAM2505 host target gene. KIAA1373 BINDING SITE is HOST TARGET binding site found in the 3' untranslated region of mRNA encoded by KIAA1373, corresponding to a HOST TARGET binding site such as BINDING SITE I, BINDING SITE II or BINDING SITE III. Table 2 illustrates the complementarity of the nucleotide sequences of KIAA1373 BINDING SITE, designated SEQ ID:35126, to the nucleotide sequence of VGAM2505 RNA, herein designated VGAM RNA, also designated SEQ ID:5216.

Another function of VGAM2505 is therefore inhibition of KIAA1373 (Accession XM_048195). Accordingly, utilities of VGAM2505 include diagnosis, prevention and treatment of diseases and clinical conditions associated with KIAA1373. KIAA1416 (Accession XM_098762) is another VGAM2505 host target gene. KIAA1416 BINDING SITE is HOST TARGET binding site found in the 5' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41802, to the nucleotide sequence of VGAM2505 RNA, herein designated VGAM RNA, also designated SEQ ID:5216.

Another function of VGAM2505 is therefore inhibition of KIAA1416 (Accession XM_098762). Accordingly, utilities of VGAM2505 include diagnosis, prevention and treatment of diseases and clinical conditions associated with KIAA1416. KIAA1554 (Accession XM_170834) is another VGAM2505 host target gene. KIAA1554 BINDING SITE is HOST TARGET binding site found in the 3' untranslated region of mRNA encoded by KIAA1554, corresponding to a HOST TARGET binding site such as BINDING SITE I, BINDING SITE II or BINDING SITE III. Table 2 illustrates the complementarity of the nucleotide sequences of KIAA1554 BINDING SITE, designated SEQ ID:45614, to the nucleotide sequence of VGAM2505 RNA, herein designated VGAM RNA, also designated SEQ ID:5216.

Another function of VGAM2505 is therefore inhibition of KIAA1554 (Accession XM_170834). Accordingly, utilities of VGAM2505 include diagnosis, prevention and treatment of diseases and clinical conditions associated with KIAA1554. KIAA1571 (Accession XM_027744) is another VGAM2505 host target gene. KIAA1571 BINDING SITE is HOST TARGET binding site found in the 3' untranslated region of mRNA encoded by KIAA1571, corresponding to a HOST TARGET binding site such as BINDING SITE I, BINDING SITE II or BINDING SITE III. Table 2 illustrates the complementarity of the nucleotide sequences of KIAA1571 BINDING SITE, designated SEQ ID:30565, to the nucleotide sequence of VGAM2505 RNA, herein designated VGAM RNA, also designated SEQ ID:5216.

Another function of VGAM2505 is therefore inhibition of KIAA1571 (Accession XM_027744). Accordingly, utilities of VGAM2505 include diagnosis, prevention and treatment of diseases and clinical conditions associated with KIAA1571. KIAA1610 (Accession XM_040622) is another VGAM2505 host target gene. KIAA1610 BINDING SITE is HOST TARGET binding site found in the 3' untranslated region of mRNA encoded by KIAA1610, corresponding to a HOST TARGET binding site such as BINDING SITE I, BINDING SITE II or BINDING SITE III. Table 2 illustrates the complementarity of the nucleotide sequences of KIAA1610 BINDING SITE, designated SEQ ID:33338, to the nucleotide sequence of VGAM2505 RNA, herein designated VGAM RNA, also designated SEQ ID:5216.

Another function of VGAM2505 is therefore inhibition of KIAA1610 (Accession XM_040622). Accordingly, utilities of VGAM2505 include diagnosis, prevention and treatment of diseases and clinical conditions associated with KIAA1610. KIAA1615 (Accession XM_044021) is another VGAM2505 host target gene. KIAA1615 BINDING SITE is HOST TARGET binding site found in the 3' untranslated region of mRNA encoded by KIAA1615, corresponding to a HOST TARGET binding site such as BINDING SITE I, BINDING SITE II or BINDING SITE III. Table 2 illustrates the complementarity of the nucleotide sequences of KIAA1615 BINDING SITE, designated SEQ ID:34083, to the nucleotide sequence of VGAM2505 RNA, herein designated VGAM RNA, also designated SEQ ID:5216.

Another function of VGAM2505 is therefore inhibition of KIAA1615 (Accession XM_044021). Accordingly, utilities of VGAM2505 include diagnosis, prevention and treatment of diseases and clinical conditions associated with KIAA1615. KIAA1719 (Accession XM_042936) is another VGAM2505 host target gene. KIAA1719 BINDING SITE is HOST TARGET binding site found in the 3' untranslated region of mRNA encoded by KIAA1719, corresponding to a HOST TARGET binding site such as BINDING SITE I, BINDING SITE II or BINDING SITE III. Table 2 illustrates the complementarity of the nucleotide sequences of KIAA1719 BINDING SITE, designated SEQ ID:33821, to the nucleotide sequence of VGAM2505 RNA, herein designated VGAM RNA, also designated SEQ ID:5216.

Another function of VGAM2505 is therefore inhibition of KIAA1719 (Accession XM_042936). Accordingly, utilities of VGAM2505 include diagnosis, prevention and treatment of diseases and clinical conditions associated with KIAA1719. KIAA1904 (Accession XM_056282) is another VGAM2505 host target gene. KIAA1904 BINDING SITE is HOST TARGET binding site found in the 3' untranslated region of mRNA encoded by KIAA1904, corresponding to a HOST TARGET binding site such as BINDING SITE I, BINDING SITE II or BINDING SITE III. Table 2 illustrates the complementarity of the nucleotide sequences of KIAA1904 BINDING SITE, designated SEQ ID:36375, to the nucleotide sequence of VGAM2505 RNA, herein designated VGAM RNA, also designated SEQ ID:5216.

Another function of VGAM2505 is therefore inhibition of KIAA1904 (Accession XM_056282). Accordingly, utilities of VGAM2505 include diagnosis, prevention and treatment of diseases and clinical conditions associated with KIAA1904. KIAA1910 (Accession XM_055514) is another VGAM2505 host target gene. KIAA1910 BINDING SITE is HOST TARGET binding site found in the 3' untranslated region of mRNA encoded by KIAA1910, corresponding to a HOST TARGET binding site such as BINDING SITE I, BINDING SITE II or BINDING SITE III. Table 2 illustrates the complementarity of the nucleotide sequences of KIAA1910 BINDING SITE, designated SEQ ID:36286, to the nucleotide sequence of VGAM2505 RNA, herein designated VGAM RNA, also designated SEQ ID:5216.

Another function of VGAM2505 is therefore inhibition of KIAA1910 (Accession XM_055514). Accordingly, utilities of VGAM2505 include diagnosis, prevention and treatment of diseases and clinical conditions associated with KIAA1910. KIAA1938 (Accession XM_166407) is another VGAM2505 host target gene. KIAA1938 BINDING SITE is HOST TARGET binding site found in the 3' untranslated region of mRNA encoded by KIAA1938, corresponding to a HOST TARGET binding site such as BINDING SITE I, BINDING SITE II or BINDING SITE III. Table 2 illustrates the complementarity of the nucleotide sequences of KIAA1938 BINDING SITE, designated SEQ ID:44277, to the nucleotide sequence of VGAM2505 RNA, herein designated VGAM RNA, also designated SEQ ID:5216.

Another function of VGAM2505 is therefore inhibition of KIAA1938 (Accession XM_166407). Accordingly, utilities of VGAM2505 include diagnosis, prevention and treatment of diseases and clinical conditions associated with KIAA1938. Karyopherin Alpha 6 (importin alpha 7) (KPNA6, Accession NM_012316) is another VGAM2505 host target gene. KPNA6 BINDING SITE is HOST TARGET binding site found in the 3' untranslated region of mRNA encoded by KPNA6, corresponding to a HOST TARGET binding site such as BINDING SITE I, BINDING SITE II or BINDING SITE III. Table 2 illustrates the complementarity of the nucleotide sequences of KPNA6 BINDING SITE, designated SEQ ID:14687, to the nucleotide sequence of VGAM2505 RNA, herein designated VGAM RNA, also designated SEQ ID:5216.

Another function of VGAM2505 is therefore inhibition of Karyopherin Alpha 6 (importin alpha 7) (KPNA6, Accession NM_012316). Accordingly, utilities of VGAM2505 include diagnosis, prevention and treatment of diseases and clinical conditions associated with KPNA6. MCLC (Accession NM_015127) is another VGAM2505 host target gene. MCLC BINDING SITE is HOST TARGET binding site found in the 3' untranslated region of mRNA encoded by MCLC, corresponding to a HOST TARGET binding site such as BINDING SITE I, BINDING SITE II or BINDING SITE III. Table 2 illustrates the complementarity of the nucleotide sequences of MCLC BINDING SITE, designated SEQ ID:17490, to the nucleotide sequence of VGAM2505 RNA, herein designated VGAM RNA, also designated SEQ ID:5216.

Another function of VGAM2505 is therefore inhibition of MCLC (Accession NM_015127). Accordingly, utilities of VGAM2505 include diagnosis, prevention and treatment of diseases and clinical conditions associated with MCLC. Meis1, Myeloid Ecotropic Viral Integration Site 1 Homolog 3 (mouse) (MEIS3, Accession XM_085721) is another VGAM2505 host target gene. MEIS3 BINDING SITE is HOST TARGET binding site found in the 3' untranslated region of mRNA encoded by MEIS3, corresponding to a HOST TARGET binding site such as BINDING SITE I, BINDING SITE II or BINDING SITE III. Table 2 illustrates the complementarity of the nucleotide sequences of MEIS3 BINDING SITE, designated SEQ ID:38311, to the nucleotide sequence of VGAM2505 RNA, herein designated VGAM RNA, also designated SEQ ID:5216.

Another function of VGAM2505 is therefore inhibition of Meis1, Myeloid Ecotropic Viral Integration Site 1 Homolog 3 (mouse) (MEIS3, Accession XM_085721). Accordingly, utilities of VGAM2505 include diagnosis, prevention and treatment of diseases and clinical conditions associated with MEIS3. MGC10924 (Accession NM_030571) is another VGAM2505 host target gene. MGC10924 BINDING SITE is HOST TARGET binding site found in the 3' untranslated region of mRNA encoded by MGC10924, corresponding to a HOST TARGET binding site such as BINDING SITE I, BINDING SITE II or BINDING SITE III. Table 2 illustrates the complementarity of the nucleotide sequences of MGC10924 BINDING SITE, designated SEQ ID:24945, to the nucleotide sequence of VGAM2505 RNA, herein designated VGAM RNA, also designated SEQ ID:5216.

Another function of VGAM2505 is therefore inhibition of MGC10924 (Accession NM_030571). Accordingly, utilities of VGAM2505 include diagnosis, prevention and treatment of diseases and clinical conditions associated with MGC10924. MGC14376 (Accession NM_032895) is another VGAM2505 host target gene. MGC14376 BINDING SITE is HOST TARGET binding site found in the 3' untranslated region of mRNA encoded by MGC14376, corresponding to a HOST TARGET binding site such as BINDING SITE I, BINDING SITE II or BINDING SITE III. Table 2 illustrates the complementarity of the nucleotide sequences of MGC14376 BINDING SITE, designated SEQ ID:26722, to the nucleotide sequence of VGAM2505 RNA, herein designated VGAM RNA, also designated SEQ ID:5216.

Another function of VGAM2505 is therefore inhibition of MGC14376 (Accession NM_032895). Accordingly, utilities of VGAM2505 include diagnosis, prevention and treatment of diseases and clinical conditions associated with MGC14376. MGC15730 (Accession NM_032880) is another VGAM2505 host target gene. MGC15730 BINDING SITE is HOST TARGET binding site found in the 5' untranslated region of mRNA encoded by MGC15730, corresponding to a HOST TARGET binding site such as BINDING SITE I, BINDING SITE II or BINDING SITE III. Table 2 illustrates the complementarity of the nucleotide sequences of MGC15730 BINDING SITE, designated SEQ ID:26700, to the nucleotide sequence of VGAM2505 RNA, herein designated VGAM RNA, also designated SEQ ID:5216.

Another function of VGAM2505 is therefore inhibition of MGC15730 (Accession NM_032880). Accordingly, utilities of VGAM2505 include diagnosis, prevention and treatment of diseases and clinical conditions associated with MGC15730. MGC16703 (Accession XM_054591) is another VGAM2505 host target gene. MGC16703 BINDING SITE is HOST TARGET binding site found in the 3' untranslated region of mRNA encoded by MGC16703, corresponding to a HOST TARGET binding site such as BINDING SITE I, BINDING SITE II or BINDING SITE III. Table 2 illustrates the complementarity of the nucleotide sequences of MGC16703 BINDING SITE, designated SEQ ID:36179, to the nucleotide sequence of VGAM2505 RNA, herein designated VGAM RNA, also designated SEQ ID:5216.

Another function of VGAM2505 is therefore inhibition of MGC16703 (Accession XM_054591). Accordingly, utilities of VGAM2505 include diagnosis, prevention and treatment of diseases and clinical conditions associated with MGC16703. MGC2474 (Accession NM_023931) is another VGAM2505 host target gene. MGC2474 BINDING SITE is HOST TARGET binding site found in the 3' untranslated region of mRNA encoded by MGC2474, corresponding to a HOST TARGET binding site such as BINDING SITE I, BINDING SITE II or BINDING SITE III. Table 2 illustrates the complementarity of the nucleotide sequences of MGC2474 BINDING SITE, designated SEQ ID:23414, to the nucleotide sequence of VGAM2505 RNA, herein designated VGAM RNA, also designated SEQ ID:5216.

Another function of VGAM2505 is therefore inhibition of MGC2474 (Accession NM_023931). Accordingly, utilities of VGAM2505 include diagnosis, prevention and treatment of diseases and clinical conditions associated with MGC2474. MGC9912 (Accession NM_080664) is another VGAM2505 host target gene. MGC9912 BINDING SITE is HOST TARGET binding site found in the 3' untranslated region of mRNA encoded by MGC9912, corresponding to a HOST TARGET binding site such as BINDING SITE I, BINDING SITE II or BINDING SITE III. Table 2 illustrates the complementarity of the nucleotide sequences of MGC9912 BINDING SITE, designated SEQ ID:27951, to the nucleotide sequence of VGAM2505 RNA, herein designated VGAM RNA, also designated SEQ ID:5216.

Another function of VGAM2505 is therefore inhibition of MGC9912 (Accession NM_080664). Accordingly, utilities of VGAM2505 include diagnosis, prevention and treatment of diseases and clinical conditions associated with MGC9912. NADH Dehydrogenase (ubiquinone) 1, Subcomplex Unknown, 2, 14.5 kDa (NDUFC2, Accession NM_004549) is another VGAM2505 host target gene. NDUFC2 BINDING SITE is HOST TARGET binding site found in the 3' untranslated region of mRNA encoded by NDUFC2, corresponding to a HOST TARGET binding site such as BINDING SITE I, BINDING SITE II or BINDING SITE III. Table 2 illustrates the complementarity of the nucleotide sequences of NDUFC2 BINDING SITE, designated SEQ ID:10894, to the nucleotide sequence of VGAM2505 RNA, herein designated VGAM RNA, also designated SEQ ID:5216.

Another function of VGAM2505 is therefore inhibition of NADH Dehydrogenase (ubiquinone) 1, Subcomplex Unknown, 2, 14.5 kDa (NDUFC2, Accession NM_004549). Accordingly, utilities of VGAM2505 include diagnosis, prevention and treatment of diseases and clinical conditions associated with NDUFC2. Nup43 (Accession NM_024647) is another VGAM2505 host target gene. Nup43 BINDING SITE is HOST TARGET binding site found in the 3' untranslated region of mRNA encoded by Nup43, corresponding to a HOST TARGET binding site such as BINDING SITE I, BINDING SITE II or BINDING SITE III. Table 2 illustrates the complementarity of the nucleotide sequences of Nup43 BINDING SITE, designated SEQ ID:23934, to the nucleotide sequence of VGAM2505 RNA, herein designated VGAM RNA, also designated SEQ ID:5216.

Another function of VGAM2505 is therefore inhibition of Nup43 (Accession NM_024647). Accordingly, utilities of VGAM2505 include diagnosis, prevention and treatment of diseases and clinical conditions associated with Nup43. OBTP (Accession NM_017601) is another VGAM2505 host target gene. OBTP BINDING SITE is HOST TARGET binding site found in the 3' untranslated region of mRNA encoded by OBTP, corresponding to a HOST TARGET binding site such as BINDING SITE I, BINDING SITE II or BINDING SITE III. Table 2 illustrates the complementarity of the nucleotide sequences of OBTP BINDING SITE, designated SEQ ID:19079, to the nucleotide sequence of VGAM2505 RNA, herein designated VGAM RNA, also designated SEQ ID:5216.

Another function of VGAM2505 is therefore inhibition of OBTP (Accession NM_017601). Accordingly, utilities of VGAM2505 include diagnosis, prevention and treatment of diseases and clinical conditions associated with OBTP. Oxysterol Binding Protein-like 2 (OSBPL2, Accession NM_144498) is another VGAM2505 host target gene. OSBPL2 BINDING SITE1 and OSBPL2 BINDING SITE2 are HOST TARGET binding sites found in untranslated regions of mRNA encoded by OSBPL2, corresponding to HOST TARGET binding sites such as BINDING SITE I, BINDING SITE II or BINDING SITE III. Table 2 illustrates the complementarity of the nucleotide sequences of OSBPL2 BINDING SITE1 and OSBPL2 BINDING SITE2, designated SEQ ID:29318 and SEQ ID:16850 respectively, to the nucleotide sequence of VGAM2505 RNA, herein designated VGAM RNA, also designated SEQ ID:5216.

Another function of VGAM2505 is therefore inhibition of Oxysterol Binding Protein-like 2 (OSBPL2, Accession NM_144498). Accordingly, utilities of VGAM2505 include diagnosis, prevention and treatment of diseases and clinical conditions associated with OSBPL2. Platelet Derived Growth Factor C (PDGFC, Accession NM_016205) is another VGAM2505 host target gene. PDGFC BINDING SITE is HOST TARGET binding site found in the 5' untranslated region of mRNA encoded by PDGFC, corresponding to a HOST TARGET binding site such as BINDING SITE I, BINDING SITE II or BINDING SITE III. Table 2 illustrates the complementarity of the nucleotide sequences of PDGFC BINDING SITE, designated SEQ ID:18302, to the nucleotide sequence of VGAM2505 RNA, herein designated VGAM RNA, also designated SEQ ID:5216.

Another function of VGAM2505 is therefore inhibition of Platelet Derived Growth Factor C (PDGFC, Accession NM_016205). Accordingly, utilities of VGAM2505 include diagnosis, prevention and treatment of diseases and clinical conditions associated with PDGFC. Phosphatidylinositol-4-phosphate 5-kinase, Type I, Gamma (PIP5K1C, Accession XM_047620) is another VGAM2505 host target gene. PIP5K1C BINDING SITE is HOST TARGET binding site found in the 3' untranslated region of mRNA encoded by PIP5K1C, corresponding to a HOST TARGET binding site such as BINDING SITE I, BINDING SITE II or BINDING SITE III. Table 2 illustrates the complementarity of the nucleotide sequences of PIP5K1C BINDING SITE, designated SEQ ID:35016, to the nucleotide sequence of VGAM2505 RNA, herein designated VGAM RNA, also designated SEQ ID:5216.

Another function of VGAM2505 is therefore inhibition of Phosphatidylinositol-4-phosphate 5-kinase, Type I, Gamma (PIP5K1C, Accession XM_047620). Accordingly, utilities of VGAM2505 include diagnosis, prevention and treatment of diseases and clinical conditions associated with PIP5K1C. Pleiomorphic Adenoma Gene-like 2 (PLAGL2, Accession XM_047007) is another VGAM2505 host target gene. PLAGL2 BINDING SITE is HOST TARGET binding site found in the 3' untranslated region of mRNA encoded by PLAGL2, corresponding to a HOST TARGET binding site such as BINDING SITE I, BINDING SITE II or BINDING SITE III. Table 2 illustrates the complementarity of the nucleotide sequences of PLAGL2 BINDING SITE, designated SEQ ID:34877, to the nucleotide sequence of VGAM2505 RNA, herein designated VGAM RNA, also designated SEQ ID:5216.

Another function of VGAM2505 is therefore inhibition of Pleiomorphic Adenoma Gene-like 2 (PLAGL2, Accession XM_047007). Accordingly, utilities of VGAM2505 include diagnosis, prevention and treatment of diseases and clinical conditions associated with PLAGL2. PP3501 (Accession NM_021731) is another VGAM2505 host target gene. PP3501 BINDING SITE is HOST TARGET binding site found in the 3' untranslated region of mRNA encoded by PP3501, corresponding to a HOST TARGET binding site such as BINDING SITE I, BINDING SITE II or BINDING SITE III. Table 2 illustrates the complementarity of the nucleotide sequences of PP3501 BINDING SITE, designated SEQ ID:22331, to the nucleotide sequence of VGAM2505 RNA, herein designated VGAM RNA, also designated SEQ ID:5216.

Another function of VGAM2505 is therefore inhibition of PP3501 (Accession NM_021731). Accordingly, utilities of VGAM2505 include diagnosis, prevention and treatment of diseases and clinical conditions associated with PP3501. Protein Phosphatase 1, Regulatory (inhibitor) Subunit 16B (PPP1R16B, Accession XM_028840) is another VGAM2505 host target gene. PPP1R16B BINDING SITE1 and PPP1R16B BINDING SITE2 are HOST TARGET binding sites found in untranslated regions of mRNA encoded by PPP1R16B, corresponding to HOST TARGET binding sites such as BINDING SITE I, BINDING SITE II or BINDING SITE III. Table 2 illustrates the complementarity of the nucleotide sequences of PPP1R16B BINDING SITE1 and PPP1R16B BINDING SITE2, designated SEQ ID:30773 and SEQ ID:30769 respectively, to the nucleotide sequence of VGAM2505 RNA, herein designated VGAM RNA, also designated SEQ ID:5216.

Another function of VGAM2505 is therefore inhibition of Protein Phosphatase 1, Regulatory (inhibitor) Subunit 16B (PPP1R16B, Accession XM_028840). Accordingly, utilities of VGAM2505 include diagnosis, prevention and treatment of diseases and clinical conditions associated with PPP1R16B. RASD Family, Member 2 (RASD2, Accession NM_014310) is another VGAM2505 host target gene. RASD2 BINDING SITE is HOST TARGET binding site found in the 3' untranslated region of mRNA encoded by RASD2, corresponding to a HOST TARGET binding site such as BINDING SITE I, BINDING SITE II or BINDING SITE III. Table 2 illustrates the complementarity of the nucleotide sequences of RASD2 BINDING SITE, designated SEQ ID:15600, to the nucleotide sequence of VGAM2505 RNA, herein designated VGAM RNA, also designated SEQ ID:5216.

Another function of VGAM2505 is therefore inhibition of RASD Family, Member 2 (RASD2, Accession NM_014310). Accordingly, utilities of VGAM2505 include diagnosis, prevention and treatment of diseases and clinical conditions associated with RASD2. Ring Finger Protein (C3HC4 type) 8 (RNF8, Accession NM_003958) is another VGAM2505 host target gene. RNF8 BINDING SITE is HOST TARGET binding site found in the 3' untranslated region of mRNA encoded by RNF8, corresponding to a HOST TARGET binding site such as BINDING SITE I, BINDING SITE II or BINDING SITE III. Table 2 illustrates the complementarity of the nucleotide sequences of RNF8 BINDING SITE, designated SEQ ID:10095, to the nucleotide sequence of VGAM2505 RNA, herein designated VGAM RNA, also designated SEQ ID:5216.

Another function of VGAM2505 is therefore inhibition of Ring Finger Protein (C3HC4 type) 8 (RNF8, Accession NM_003958). Accordingly, utilities of VGAM2505 include diagnosis, prevention and treatment of diseases and clinical conditions associated with RNF8. SCAMP5 (Accession NM_138967) is another VGAM2505 host target gene. SCAMP5 BINDING SITE is HOST TARGET binding site found in the 3' untranslated region of mRNA encoded by SCAMP5, corresponding to a HOST TARGET binding site such as BINDING SITE I, BINDING SITE II or BINDING SITE III. Table 2 illustrates the complementarity of the nucleotide sequences of SCAMP5 BINDING SITE, designated SEQ ID:29074, to the nucleotide sequence of VGAM2505 RNA, herein designated VGAM RNA, also designated SEQ ID:5216.

Another function of VGAM2505 is therefore inhibition of SCAMP5 (Accession NM_138967). Accordingly, utilities of VGAM2505 include diagnosis, prevention and treatment of diseases and clinical conditions associated with SCAMP5. Sema Domain, Immunoglobulin Domain (Ig), Transmembrane Domain (TM) and Short Cytoplasmic Domain, (semaphorin) 4G (SEMA4G, Accession NM_017893) is another VGAM2505 host target gene. SEMA4G BINDING SITE1 and SEMA4G BINDING SITE2 are HOST TARGET binding sites found in untranslated regions of mRNA encoded by SEMA4G, corresponding to HOST TARGET binding sites such as BINDING SITE I, BINDING SITE II or BINDING SITE III. Table 2 illustrates the complementarity of the nucleotide sequences of SEMA4G BINDING SITE1 and SEMA4G BINDING SITE2, designated SEQ ID:19564 and SEQ ID:45413 respectively, to the nucleotide sequence of VGAM2505 RNA, herein designated VGAM RNA, also designated SEQ ID:5216.

Another function of VGAM2505 is therefore inhibition of Sema Domain, Immunoglobulin Domain (Ig), Transmembrane Domain (TM) and Short Cytoplasmic Domain, (semaphorin) 4G (SEMA4G, Accession NM_017893). Accordingly, utilities of VGAM2505 include diagnosis, prevention and treatment of diseases and clinical conditions associated with SEMA4G. Trinucleotide Repeat Containing 4 (TNRC4, Accession NM_007185) is another VGAM2505 host target gene. TNRC4 BINDING SITE is HOST TARGET binding site found in the 3' untranslated region of mRNA encoded by TNRC4, corresponding to a HOST TARGET binding site such as BINDING SITE I, BINDING SITE II or BINDING SITE III. Table 2 illustrates the complementarity of the nucleotide sequences of TNRC4 BINDING SITE, designated SEQ ID:14040, to the nucleotide sequence of VGAM2505 RNA, herein designated VGAM RNA, also designated SEQ ID:5216.

Another function of VGAM2505 is therefore inhibition of Trinucleotide Repeat Containing 4 (TNRC4, Accession NM_007185). Accordingly, utilities of VGAM2505 include diagnosis, prevention and treatment of diseases and clinical conditions associated with TNRC4. Tubby Homolog (mouse) (TUB, Accession NM_003320) is another VGAM2505 host target gene. TUB BINDING SITE is HOST TARGET binding site found in the 3' untranslated region of mRNA encoded by TUB, corresponding to a HOST TARGET binding site such as BINDING SITE I, BINDING SITE II or BINDING SITE III. Table 2 illustrates the complementarity of the nucleotide sequences of TUB BINDING SITE, designated SEQ ID:9323, to the nucleotide sequence of VGAM2505 RNA, herein designated VGAM RNA, also designated SEQ ID:5216.

Another function of VGAM2505 is therefore inhibition of Tubby Homolog (mouse) (TUB, Accession NM_003320). Accordingly, utilities of VGAM2505 include diagnosis, prevention and treatment of diseases and clinical conditions associated with TUB. Ubiquitin Specific Protease 22 (USP22, Accession XM_042698) is another VGAM2505 host target gene. USP22 BINDING SITE is HOST TARGET binding site found in the 3' untranslated region of mRNA encoded by USP22, corresponding to a HOST TARGET binding site such as BINDING SITE I, BINDING SITE II or BINDING SITE III. Table 2 illustrates the complementarity of the nucleotide sequences of USP22 BINDING SITE, designated SEQ ID:33751, to the nucleotide sequence of VGAM2505 RNA, herein designated VGAM RNA, also designated SEQ ID:5216.

Another function of VGAM2505 is therefore inhibition of Ubiquitin Specific Protease 22 (USP22, Accession XM_042698). Accordingly, utilities of VGAM2505 include diagnosis, prevention and treatment of diseases and clinical conditions associated with USP22. Vacuolar Protein Sorting 33A (yeast) (VPS33A, Accession NM_022916) is another VGAM2505 host target gene. VPS33A BINDING SITE is HOST TARGET binding site found in the 3' untranslated region of mRNA encoded by VPS33A, corresponding to a HOST TARGET binding site such as BINDING SITE I, BINDING SITE II or BINDING SITE III. Table 2 illustrates the complementarity of the nucleotide sequences of VPS33A BINDING SITE, designated SEQ ID:23231, to the nucleotide sequence of VGAM2505 RNA, herein designated VGAM RNA, also designated SEQ ID:5216.

Another function of VGAM2505 is therefore inhibition of Vacuolar Protein Sorting 33A (yeast) (VPS33A, Accession NM_022916). Accordingly, utilities of VGAM2505 include diagnosis, prevention and treatment of diseases and clinical conditions associated with VPS33A. Williams-Beuren Syndrome Chromosome Region 23 (WBSCR23, Accession NM_025042) is another VGAM2505 host target gene. WBSCR23 BINDING SITE is HOST TARGET binding site found in the 3' untranslated region of mRNA encoded by WBSCR23, corresponding to a HOST TARGET binding site such as BINDING SITE I, BINDING SITE II or BINDING SITE III. Table 2 illustrates the complementarity of the nucleotide sequences of WBSCR23 BINDING SITE, designated SEQ ID:24637, to the nucleotide sequence of VGAM2505 RNA, herein designated VGAM RNA, also designated SEQ ID:5216.

Another function of VGAM2505 is therefore inhibition of Williams-Beuren Syndrome Chromosome Region 23 (WBSCR23, Accession NM_025042). Accordingly, utilities of VGAM2505 include diagnosis, prevention and treatment of diseases and clinical conditions associated with WBSCR23. LOC112724 (Accession NM_138412) is another VGAM2505 host target gene. LOC112724 BINDING SITE is HOST TARGET binding site found in the 5' untranslated region of mRNA encoded by LOC112724, corresponding to a HOST TARGET binding site such as BINDING SITE I, BINDING SITE II or BINDING SITE III. Table 2 illustrates the complementarity of the nucleotide sequences of LOC112724 BINDING SITE, designated SEQ ID:28777, to the nucleotide sequence of VGAM2505 RNA, herein designated VGAM RNA, also designated SEQ ID:5216.

Another function of VGAM2505 is therefore inhibition of LOC112724 (Accession NM_138412). Accordingly, utilities of VGAM2505 include diagnosis, prevention and treatment of diseases and clinical conditions associated with LOC112724. LOC115399 (Accession XM_055874) is another VGAM2505 host target gene. LOC115399 BINDING SITE is HOST TARGET binding site found in the 3' untranslated region of mRNA encoded by LOC115399, corresponding to a HOST TARGET binding site such as BINDING SITE I, BINDING SITE II or BINDING SITE III. Table 2 illustrates the complementarity of the nucleotide sequences of LOC115399 BINDING SITE, designated SEQ ID:36346, to the nucleotide sequence of VGAM2505 RNA, herein designated VGAM RNA, also designated SEQ ID:5216.

Another function of VGAM2505 is therefore inhibition of LOC115399 (Accession XM_055874). Accordingly, utilities of VGAM2505 include diagnosis, prevention and treatment of diseases and clinical conditions associated with LOC115399. LOC116113 (Accession XM_166413) is another VGAM2505 host target gene. LOC116113 BINDING SITE is HOST TARGET binding site found in the 3' untranslated region of mRNA encoded by LOC116113, corresponding to a HOST TARGET binding site such as BINDING SITE I, BINDING SITE II or BINDING SITE III. Table 2 illustrates the complementarity of the nucleotide sequences of LOC116113 BINDING SITE, designated SEQ ID:44284, to the nucleotide sequence of VGAM2505 RNA, herein designated VGAM RNA, also designated SEQ ID:5216.

Another function of VGAM2505 is therefore inhibition of LOC116113 (Accession XM_166413). Accordingly, utilities of VGAM2505 include diagnosis, prevention and treatment of diseases and clinical conditions associated with LOC116113. LOC116411 (Accession XM_058095) is another VGAM2505 host target gene. LOC116411 BINDING SITE is HOST TARGET binding site found in the 5' untranslated region of mRNA encoded by LOC116411, corresponding to a HOST TARGET binding site such as BINDING SITE I, BINDING SITE II or BINDING SITE III. Table 2 illustrates the complementarity of the nucleotide sequences of LOC116411 BINDING SITE, designated SEQ ID:36568, to the nucleotide sequence of VGAM2505 RNA, herein designated VGAM RNA, also designated SEQ ID:5216.

Another function of VGAM2505 is therefore inhibition of LOC116411 (Accession XM_058095). Accordingly, utilities of VGAM2505 include diagnosis, prevention and treatment of diseases and clinical conditions associated with LOC116411. LOC124976 (Accession XM_058879) is another VGAM2505 host target gene. LOC124976 BINDING SITE is HOST TARGET binding site found in the 3' untranslated region of mRNA encoded by LOC124976, corresponding to a HOST TARGET binding site such as BINDING SITE I, BINDING SITE II or BINDING SITE III. Table 2 illustrates the complementarity of the nucleotide sequences of LOC124976 BINDING SITE, designated SEQ ID:36783, to the nucleotide sequence of VGAM2505 RNA, herein designated VGAM RNA, also designated SEQ ID:5216.

Another function of VGAM2505 is therefore inhibition of LOC124976 (Accession XM_058879). Accordingly, utilities of VGAM2505 include diagnosis, prevention and treatment of diseases and clinical conditions associated with LOC124976. LOC130813 (Accession XM_065904) is another VGAM2505 host target gene. LOC130813 BINDING SITE is HOST TARGET binding site found in the 3' untranslated region of mRNA encoded by LOC130813, corresponding to a HOST TARGET binding site such as BINDING SITE I, BINDING SITE II or BINDING SITE III. Table 2 illustrates the complementarity of the nucleotide sequences of LOC130813 BINDING SITE, designated SEQ ID:37310, to the nucleotide sequence of VGAM2505 RNA, herein designated VGAM RNA, also designated SEQ ID:5216.

Another function of VGAM2505 is therefore inhibition of LOC130813 (Accession XM_065904). Accordingly, utilities of VGAM2505 include diagnosis, prevention and treatment of diseases and clinical conditions associated with LOC130813. LOC132625 (Accession XM_067946) is another VGAM2505 host target gene. LOC132625 BINDING SITE is HOST TARGET binding site found in the 3' untranslated region of mRNA encoded by LOC132625, corresponding to a HOST TARGET binding site such as BINDING SITE I, BINDING SITE II or BINDING SITE III. Table 2 illustrates the complementarity of the nucleotide sequences of LOC132625 BINDING SITE, designated SEQ ID:37373, to the nucleotide sequence of VGAM2505 RNA, herein designated VGAM RNA, also designated SEQ ID:5216.

Another function of VGAM2505 is therefore inhibition of LOC132625 (Accession XM_067946). Accordingly, utilities of VGAM2505 include diagnosis, prevention and treatment of diseases and clinical conditions associated with LOC132625. LOC135818 (Accession XM_059804) is another VGAM2505 host target gene. LOC135818 BINDING SITE is HOST TARGET binding site found in the 3' untranslated region of mRNA encoded by LOC135818, corresponding to a HOST TARGET binding site such as BINDING SITE I, BINDING SITE II or BINDING SITE III. Table 2 illustrates the complementarity of the nucleotide sequences of LOC135818 BINDING SITE, designated SEQ ID:37093, to the nucleotide sequence of VGAM2505 RNA, herein designated VGAM RNA, also designated SEQ ID:5216.

Another function of VGAM2505 is therefore inhibition of LOC135818 (Accession XM_059804). Accordingly, utilities of VGAM2505 include diagnosis, prevention and treatment of diseases and clinical conditions associated with LOC135818. LOC143187 (Accession NM_145206) is another VGAM2505 host target gene. LOC143187 BINDING SITE is HOST TARGET binding site found in the 3' untranslated region of mRNA encoded by LOC143187, corresponding to a HOST TARGET binding site such as BINDING SITE I, BINDING SITE II or BINDING SITE III. Table 2 illustrates the complementarity of the nucleotide sequences of LOC143187 BINDING SITE, designated SEQ ID:29744, to the nucleotide sequence of VGAM2505 RNA, herein designated VGAM RNA, also designated SEQ ID:5216.

Another function of VGAM2505 is therefore inhibition of LOC143187 (Accession NM_145206). Accordingly, utilities of VGAM2505 include diagnosis, prevention and treatment of diseases and clinical conditions associated with LOC143187. LOC144248 (Accession XM_084786) is another VGAM2505 host target gene. LOC144248 BINDING SITE is HOST TARGET binding site found in the 5' untranslated region of mRNA encoded by LOC144248, corresponding to a HOST TARGET binding site such as BINDING SITE I, BINDING SITE II or BINDING SITE III. Table 2 illustrates the complementarity of the nucleotide sequences of LOC144248 BINDING SITE, designated SEQ ID:37700, to the nucleotide sequence of VGAM2505 RNA, herein designated VGAM RNA, also designated SEQ ID:5216.

Another function of VGAM2505 is therefore inhibition of LOC144248 (Accession XM_084786). Accordingly, utilities of VGAM2505 include diagnosis, prevention and treatment of diseases and clinical conditions associated with LOC144248. LOC144524 (Accession XM_096624) is another VGAM2505 host target gene. LOC144524 BINDING SITE is HOST TARGET binding site found in the 5' untranslated region of mRNA encoded by LOC144524, corresponding to a HOST TARGET binding site such as BINDING SITE I, BINDING SITE II or BINDING SITE III. Table 2 illustrates the complementarity of the nucleotide sequences of LOC144524 BINDING SITE, designated SEQ ID:40433, to the nucleotide sequence of VGAM2505 RNA, herein designated VGAM RNA, also designated SEQ ID:5216.

Another function of VGAM2505 is therefore inhibition of LOC144524 (Accession XM_096624). Accordingly, utilities of VGAM2505 include diagnosis, prevention and treatment of diseases and clinical conditions associated with LOC144524. LOC145468 (Accession XM_057874) is another VGAM2505 host target gene. LOC145468 BINDING SITE1 and LOC145468 BINDING SITE2 are HOST TARGET binding sites found in untranslated regions of mRNA encoded by LOC145468, corresponding to HOST TARGET binding sites such as BINDING SITE I, BINDING SITE II or BINDING SITE III. Table 2 illustrates the complementarity of the nucleotide sequences of LOC145468 BINDING SITE1 and LOC145468 BINDING SITE2, designated SEQ ID:36545 and SEQ ID:36546 respectively, to the nucleotide sequence of VGAM2505 RNA, herein designated VGAM RNA, also designated SEQ ID:5216.

Another function of VGAM2505 is therefore inhibition of LOC145468 (Accession XM_057874). Accordingly, utilities of VGAM2505 include diagnosis, prevention and treatment of diseases and clinical conditions associated with LOC145468. LOC145693 (Accession XM_085205) is another VGAM2505 host target gene. LOC145693 BINDING SITE1 and LOC145693 BINDING SITE2 are HOST TARGET binding sites found in untranslated regions of mRNA encoded by LOC145693, corresponding to HOST TARGET binding sites such as BINDING SITE I, BINDING SITE II or BINDING SITE III. Table 2 illustrates the complementarity of the nucleotide sequences of LOC145693 BINDING SITE1 and LOC145693 BINDING SITE2, designated SEQ ID:37924 and SEQ ID:38031 respectively, to the nucleotide sequence of VGAM2505 RNA, herein designated VGAM RNA, also designated SEQ ID:5216.

Another function of VGAM2505 is therefore inhibition of LOC145693 (Accession XM_085205). Accordingly, utilities of VGAM2505 include diagnosis, prevention and treatment of diseases and clinical conditions associated with LOC145693. LOC146733 (Accession XM_097076) is another VGAM2505 host target gene. LOC146733 BINDING SITE is HOST TARGET binding site found in the 5' untranslated region of mRNA encoded by LOC146733, corresponding to a HOST TARGET binding site such as BINDING SITE I, BINDING SITE II or BINDING SITE III. Table 2 illustrates the complementarity of the nucleotide sequences of LOC146733 BINDING SITE, designated SEQ ID:40729, to the nucleotide sequence of VGAM2505 RNA, herein designated VGAM RNA, also designated SEQ ID:5216.

Another function of VGAM2505 is therefore inhibition of LOC146733 (Accession XM_097076). Accordingly, utilities of VGAM2505 include diagnosis, prevention and treatment of diseases and clinical conditions associated with LOC146733. LOC146784 (Accession XM_085588) is another VGAM2505 host target gene. LOC146784 BINDING SITE is HOST TARGET binding site found in the 5' untranslated region of mRNA encoded by LOC146784, corresponding to a HOST TARGET binding site such as BINDING SITE I, BINDING SITE II or BINDING SITE III. Table 2 illustrates the complementarity of the nucleotide sequences of LOC146784 BINDING SITE, designated SEQ ID:38237, to the nucleotide sequence of VGAM2505 RNA, herein designated VGAM RNA, also designated SEQ ID:5216.

Another function of VGAM2505 is therefore inhibition of LOC146784 (Accession XM_085588). Accordingly, utilities of VGAM2505 include diagnosis, prevention and treatment of diseases and clinical conditions associated with LOC146784. LOC146839 (Accession XM_097107) is another VGAM2505 host target gene. LOC146839 BINDING SITE is HOST TARGET binding site found in the 3' untranslated region of mRNA encoded by LOC146839, corresponding to a HOST TARGET binding site such as BINDING SITE I, BINDING SITE II or BINDING SITE III. Table 2 illustrates the complementarity of the nucleotide sequences of LOC146839 BINDING SITE, designated SEQ ID:40753, to the nucleotide sequence of VGAM2505 RNA, herein designated VGAM RNA, also designated SEQ ID:5216.

Another function of VGAM2505 is therefore inhibition of LOC146839 (Accession XM_097107). Accordingly, utilities of VGAM2505 include diagnosis, prevention and treatment of diseases and clinical conditions associated with LOC146839. LOC146957 (Accession XM_085652) is another VGAM2505 host target gene. LOC146957 BINDING SITE is HOST TARGET binding site found in the 3' untranslated region of mRNA encoded by LOC146957, corresponding to a HOST TARGET binding site such as BINDING SITE I, BINDING SITE II or BINDING SITE III. Table 2 illustrates the complementarity of the nucleotide sequences of LOC146957 BINDING SITE, designated SEQ ID:38284, to the nucleotide sequence of VGAM2505 RNA, herein designated VGAM RNA, also designated SEQ ID:5216.

Another function of VGAM2505 is therefore inhibition of LOC146957 (Accession XM_085652). Accordingly, utilities of VGAM2505 include diagnosis, prevention and treatment of diseases and clinical conditions associated with LOC146957. LOC147817 (Accession XM_085903) is another VGAM2505 host target gene. LOC147817 BINDING SITE is HOST TARGET binding site found in the 3' untranslated region of mRNA encoded by LOC147817, corresponding to a HOST TARGET binding site such as BINDING SITE I, BINDING SITE II or BINDING SITE III. Table 2 illustrates the complementarity of the nucleotide sequences of LOC147817 BINDING SITE, designated SEQ ID:38384, to the nucleotide sequence of VGAM2505 RNA, herein designated VGAM RNA, also designated SEQ ID:5216.

Another function of VGAM2505 is therefore inhibition of LOC147817 (Accession XM_085903). Accordingly, utilities of VGAM2505 include diagnosis, prevention and treatment of diseases and clinical conditions associated with LOC147817. LOC147958 (Accession XM_103258) is another VGAM2505 host target gene. LOC147958 BINDING SITE is HOST TARGET binding site found in the 3' untranslated region of mRNA encoded by LOC147958, corresponding to a HOST TARGET binding site such as BINDING SITE I, BINDING SITE II or BINDING SITE III. Table 2 illustrates the complementarity of the nucleotide sequences of LOC147958 BINDING SITE, designated SEQ ID:42152, to the nucleotide sequence of VGAM2505 RNA, herein designated VGAM RNA, also designated SEQ ID:5216.

Another function of VGAM2505 is therefore inhibition of LOC147958 (Accession XM_103258). Accordingly, utilities of VGAM2505 include diagnosis, prevention and treatment of diseases and clinical conditions associated with LOC147958. LOC148137 (Accession NM_144692) is another VGAM2505 host target gene. LOC148137 BINDING SITE1 and LOC148137 BINDING SITE2 are HOST TARGET binding sites found in untranslated regions of mRNA encoded by LOC148137, corresponding to HOST TARGET binding sites such as BINDING SITE I, BINDING SITE II or BINDING SITE III. Table 2 illustrates the complementarity of the nucleotide sequences of LOC148137 BINDING SITE1 and LOC148137 BINDING SITE2, designated SEQ ID:29514 and SEQ ID:29515 respectively, to the nucleotide sequence of VGAM2505 RNA, herein designated VGAM RNA, also designated SEQ ID:5216.

Another function of VGAM2505 is therefore inhibition of LOC148137 (Accession NM_144692). Accordingly, utilities of VGAM2505 include diagnosis, prevention and treatment of diseases and clinical conditions associated with LOC148137. LOC149506 (Accession XM_097661) is another VGAM2505 host target gene. LOC149506 BINDING SITE is HOST TARGET binding site found in the 3' untranslated region of mRNA encoded by LOC149506, corresponding to a HOST TARGET binding site such as BINDING SITE I, BINDING SITE II or BINDING SITE III. Table 2 illustrates the complementarity of the nucleotide sequences of LOC149506 BINDING SITE, designated SEQ ID:41000, to the nucleotide sequence of VGAM2505 RNA, herein designated VGAM RNA, also designated SEQ ID:5216.

Another function of VGAM2505 is therefore inhibition of LOC149506 (Accession XM_097661). Accordingly, utilities of VGAM2505 include diagnosis, prevention and treatment of diseases and clinical conditions associated with LOC149506. LOC149577 (Accession XM_097675) is another VGAM2505 host target gene. LOC149577 BINDING SITE is HOST TARGET binding site found in the 3' untranslated region of mRNA encoded by LOC149577, corresponding to a HOST TARGET binding site such as BINDING SITE I, BINDING SITE II or BINDING SITE III. Table 2 illustrates the complementarity of the nucleotide sequences of LOC149577 BINDING SITE, designated SEQ ID:41024, to the nucleotide sequence of VGAM2505 RNA, herein designated VGAM RNA, also designated SEQ ID:5216.

Another function of VGAM2505 is therefore inhibition of LOC149577 (Accession XM_097675). Accordingly, utilities of VGAM2505 include diagnosis, prevention and treatment of diseases and clinical conditions associated with LOC149577. LOC150155 (Accession XM_047977) is another VGAM2505 host target gene. LOC150155 BINDING SITE1 and LOC150155 BINDING SITE2 are HOST TARGET binding sites found in untranslated regions of mRNA encoded by LOC150155, corresponding to HOST TARGET binding sites such as BINDING SITE I, BINDING SITE II or BINDING SITE III. Table 2 illustrates the complementarity of the nucleotide sequences of LOC150155 BINDING SITE1 and LOC150155 BINDING SITE2, designated SEQ ID:35086 and SEQ ID:35087 respectively, to the nucleotide sequence of VGAM2505 RNA, herein designated VGAM RNA, also designated SEQ ID:5216.

Another function of VGAM2505 is therefore inhibition of LOC150155 (Accession XM_047977). Accordingly, utilities of VGAM2505 include diagnosis, prevention and treatment of diseases and clinical conditions associated with LOC150155. LOC151201 (Accession XM_098021) is another VGAM2505 host target gene. LOC151201 BINDING SITE is HOST TARGET binding site found in the 3' untranslated region of mRNA encoded by LOC151201, corresponding to a HOST TARGET binding site such as BINDING SITE I, BINDING SITE II or BINDING SITE III. Table 2 illustrates the complementarity of the nucleotide sequences of LOC151201 BINDING SITE, designated SEQ ID:41321, to the nucleotide sequence of VGAM2505 RNA, herein designated VGAM RNA, also designated SEQ ID:5216.

Another function of VGAM2505 is therefore inhibition of LOC151201 (Accession XM_098021). Accordingly, utilities of VGAM2505 include diagnosis, prevention and treatment of diseases and clinical conditions associated with LOC151201. LOC151475 (Accession XM_098063) is another VGAM2505 host target gene. LOC151475 BINDING SITE is HOST TARGET binding site found in the 5' untranslated region of mRNA encoded by LOC151475, corresponding to a HOST TARGET binding site such as BINDING SITE I, BINDING SITE II or BINDING SITE III. Table 2 illustrates the complementarity of the nucleotide sequences of LOC151475 BINDING SITE, designated SEQ ID:41355, to the nucleotide sequence of VGAM2505 RNA, herein designated VGAM RNA, also designated SEQ ID:5216.

Another function of VGAM2505 is therefore inhibition of LOC151475 (Accession XM_098063). Accordingly, utilities of VGAM2505 include diagnosis, prevention and treatment of diseases and clinical conditions associated with LOC151475. LOC153525 (Accession XM_098383) is another VGAM2505 host target gene. LOC153525 BINDING SITE is HOST TARGET binding site found in the 5' untranslated region of mRNA encoded by LOC153525, corresponding to a HOST TARGET binding site such as BINDING SITE I, BINDING SITE II or BINDING SITE III. Table 2 illustrates the complementarity of the nucleotide sequences of LOC153525 BINDING SITE, designated SEQ ID:41638, to the nucleotide sequence of VGAM2505 RNA, herein designated VGAM RNA, also designated SEQ ID:5216.

Another function of VGAM2505 is therefore inhibition of LOC153525 (Accession XM_098383). Accordingly, utilities of VGAM2505 include diagnosis, prevention and treatment of diseases and clinical conditions associated with LOC153525. LOC153688 (Accession XM_098416) is another VGAM2505 host target gene. LOC153688 BINDING SITE is HOST TARGET binding site found in the 3' untranslated region of mRNA encoded by LOC153688, corresponding to a HOST TARGET binding site such as BINDING SITE I, BINDING SITE II or BINDING SITE III. Table 2 illustrates the complementarity of the nucleotide sequences of LOC153688 BINDING SITE, designated SEQ ID:41658, to the nucleotide sequence of VGAM2505 RNA, herein designated VGAM RNA, also designated SEQ ID:5216.

Another function of VGAM2505 is therefore inhibition of LOC153688 (Accession XM_098416). Accordingly, utilities of VGAM2505 include diagnosis, prevention and treatment of diseases and clinical conditions associated with LOC153688. LOC154282 (Accession XM_098505) is another VGAM2505 host target gene. LOC154282 BINDING SITE is HOST TARGET binding site found in the 5' untranslated region of mRNA encoded by LOC154282, corresponding to a HOST TARGET binding site such as BINDING SITE I, BINDING SITE II or BINDING SITE III. Table 2 illustrates the complementarity of the nucleotide sequences of LOC154282 BINDING SITE, designated SEQ ID:41698, to the nucleotide sequence of VGAM2505 RNA, herein designated VGAM RNA, also designated SEQ ID:5216.

Another function of VGAM2505 is therefore inhibition of LOC154282 (Accession XM_098505). Accordingly, utilities of VGAM2505 include diagnosis, prevention and treatment of diseases and clinical conditions associated with LOC154282. LOC154726 (Accession XM_088024) is another VGAM2505 host target gene. LOC154726 BINDING SITE is HOST TARGET binding site found in the 5' untranslated region of mRNA encoded by LOC154726, corresponding to a HOST TARGET binding site such as BINDING SITE I, BINDING SITE II or BINDING SITE III. Table 2 illustrates the complementarity of the nucleotide sequences of LOC154726 BINDING SITE, designated SEQ ID:39477, to the nucleotide sequence of VGAM2505 RNA, herein designated VGAM RNA, also designated SEQ ID:5216.

Another function of VGAM2505 is therefore inhibition of LOC154726 (Accession XM_088024). Accordingly, utilities of VGAM2505 include diagnosis, prevention and treatment of diseases and clinical conditions associated with LOC154726. LOC155006 (Accession XM_088117) is another VGAM2505 host target gene. LOC155006 BINDING SITE is HOST TARGET binding site found in the 3' untranslated region of mRNA encoded by LOC155006, corresponding to a HOST TARGET binding site such as BINDING SITE I, BINDING SITE II or BINDING SITE III. Table 2 illustrates the complementarity of the nucleotide sequences of LOC155006 BINDING SITE, designated SEQ ID:39523, to the nucleotide sequence of VGAM2505 RNA, herein designated VGAM RNA, also designated SEQ ID:5216.

Another function of VGAM2505 is therefore inhibition of LOC155006 (Accession XM_088117). Accordingly, utilities of VGAM2505 include diagnosis, prevention and treatment of diseases and clinical conditions associated with LOC155006. LOC157247 (Accession XM_088275) is another VGAM2505 host target gene. LOC157247 BINDING SITE is HOST TARGET binding site found in the 5' untranslated region of mRNA encoded by LOC157247, corresponding to a HOST TARGET binding site such as BINDING SITE I, BINDING SITE II or BINDING SITE III. Table 2 illustrates the complementarity of the nucleotide sequences of LOC157247 BINDING SITE, designated SEQ ID:39576, to the nucleotide sequence of VGAM2505 RNA, herein designated VGAM RNA, also designated SEQ ID:5216.

Another function of VGAM2505 is therefore inhibition of LOC157247 (Accession XM_088275). Accordingly, utilities of VGAM2505 include diagnosis, prevention and treatment of diseases and clinical conditions associated with LOC157247. LOC195977 (Accession XM_113625) is another VGAM2505 host target gene. LOC195977 BINDING SITE is HOST TARGET binding site found in the 3' untranslated region of mRNA encoded by LOC195977, corresponding to a HOST TARGET binding site such as BINDING SITE I, BINDING SITE II or BINDING SITE III. Table 2 illustrates the complementarity of the nucleotide sequences of LOC195977 BINDING SITE, designated SEQ ID:42300, to the nucleotide sequence of VGAM2505 RNA, herein designated VGAM RNA, also designated SEQ ID:5216.

Another function of VGAM2505 is therefore inhibition of LOC195977 (Accession XM_113625). Accordingly, utilities of VGAM2505 include diagnosis, prevention and treatment of diseases and clinical conditions associated with LOC195977. LOC200014 (Accession XM_114087) is another VGAM2505 host target gene. LOC200014 BINDING SITE is HOST TARGET binding site found in the 3' untranslated region of mRNA encoded by LOC200014, corresponding to a HOST TARGET binding site such as BINDING SITE I, BINDING SITE II or BINDING SITE III. Table 2 illustrates the complementarity of the nucleotide sequences of LOC200014 BINDING SITE, designated SEQ ID:42689, to the nucleotide sequence of VGAM2505 RNA, herein designated VGAM RNA, also designated SEQ ID:5216.

Another function of VGAM2505 is therefore inhibition of LOC200014 (Accession XM_114087). Accordingly, utilities of VGAM2505 include diagnosis, prevention and treatment of diseases and clinical conditions associated with LOC200014. LOC200314 (Accession XM_117225) is another VGAM2505 host target gene. LOC200314 BINDING SITE is HOST TARGET binding site found in the 3' untranslated region of mRNA encoded by LOC200314, corresponding to a HOST TARGET binding site such as BINDING SITE I, BINDING SITE II or BINDING SITE III. Table 2 illustrates the complementarity of the nucleotide sequences of LOC200314 BINDING SITE, designated SEQ ID:43293, to the nucleotide sequence of VGAM2505 RNA, herein designated VGAM RNA, also designated SEQ ID:5216.

Another function of VGAM2505 is therefore inhibition of LOC200314 (Accession XM_117225). Accordingly, utilities of VGAM2505 include diagnosis, prevention and treatment of diseases and clinical conditions associated with LOC200314. LOC200860 (Accession XM_117289) is another VGAM2505 host target gene. LOC200860 BINDING SITE is HOST TARGET binding site found in the 3' untranslated region of mRNA encoded by LOC200860, corresponding to a HOST TARGET binding site such as BINDING SITE I, BINDING SITE II or BINDING SITE III. Table 2 illustrates the complementarity of the nucleotide sequences of LOC200860 BINDING SITE, designated SEQ ID:43353, to the nucleotide sequence of VGAM2505 RNA, herein designated VGAM RNA, also designated SEQ ID:5216.

Another function of VGAM2505 is therefore inhibition of LOC200860 (Accession XM_117289). Accordingly, utilities of VGAM2505 include diagnosis, prevention and treatment of diseases and clinical conditions associated with LOC200860. LOC204804 (Accession XM_115599) is another VGAM2505 host target gene. LOC204804 BINDING SITE is HOST TARGET binding site found in the 3' untranslated region of mRNA encoded by LOC204804, corresponding to a HOST TARGET binding site such as BINDING SITE I, BINDING SITE II or BINDING SITE III. Table 2 illustrates the complementarity of the nucleotide sequences of LOC204804 BINDING SITE, designated SEQ ID:43097, to the nucleotide sequence of VGAM2505 RNA, herein designated VGAM RNA, also designated SEQ ID:5216.

Another function of VGAM2505 is therefore inhibition of LOC204804 (Accession XM_115599). Accordingly, utilities of VGAM2505 include diagnosis, prevention and treatment of diseases and clinical conditions associated with LOC204804. LOC219653 (Accession XM_166093) is another VGAM2505 host target gene. LOC219653 BINDING SITE is HOST TARGET binding site found in the 3' untranslated region of mRNA encoded by LOC219653, corresponding to a HOST TARGET binding site such as BINDING SITE I, BINDING SITE II or BINDING SITE III. Table 2 illustrates the complementarity of the nucleotide sequences of LOC219653 BINDING SITE, designated SEQ ID:43869, to the nucleotide sequence of VGAM2505 RNA, herein designated VGAM RNA, also designated SEQ ID:5216.

Another function of VGAM2505 is therefore inhibition of LOC219653 (Accession XM_166093). Accordingly, utilities of VGAM2505 include diagnosis, prevention and treatment of diseases and clinical conditions associated with LOC219653. LOC219920 (Accession XM_167787) is another VGAM2505 host target gene. LOC219920 BINDING SITE is HOST TARGET binding site found in the 5' untranslated region of mRNA encoded by LOC219920, corresponding to a HOST TARGET binding site such as BINDING SITE I, BINDING SITE II or BINDING SITE III. Table 2 illustrates the complementarity of the nucleotide sequences of LOC219920 BINDING SITE, designated SEQ ID:44804, to the nucleotide sequence of VGAM2505 RNA, herein designated VGAM RNA, also designated SEQ ID:5216.

Another function of VGAM2505 is therefore inhibition of LOC219920 (Accession XM_167787). Accordingly, utilities of VGAM2505 include diagnosis, prevention and treatment of diseases and clinical conditions associated with LOC219920. LOC220662 (Accession XM_165978) is another VGAM2505 host target gene. LOC220662 BINDING SITE is HOST TARGET binding site found in the 3' untranslated region of mRNA encoded by LOC220662, corresponding to a HOST TARGET binding site such as BINDING SITE I, BINDING SITE II or BINDING SITE III. Table 2 illustrates the complementarity of the nucleotide sequences of LOC220662 BINDING SITE, designated SEQ ID:43822, to the nucleotide sequence of VGAM2505 RNA, herein designated VGAM RNA, also designated SEQ ID:5216.

Another function of VGAM2505 is therefore inhibition of LOC220662 (Accession XM_165978). Accordingly, utilities of VGAM2505 include diagnosis, prevention and treatment of diseases and clinical conditions associated with LOC220662. LOC221250 (Accession XM_166301) is another VGAM2505 host target gene. LOC221250 BINDING SITE is HOST TARGET binding site found in the 5' untranslated region of mRNA encoded by LOC221250, corresponding to a HOST TARGET binding site such as BINDING SITE I, BINDING SITE II or BINDING SITE III. Table 2 illustrates the complementarity of the nucleotide sequences of LOC221250 BINDING SITE, designated SEQ ID:44117, to the nucleotide sequence of VGAM2505 RNA, herein designated VGAM RNA, also designated SEQ ID:5216.

Another function of VGAM2505 is therefore inhibition of LOC221250 (Accession XM_166301). Accordingly, utilities of VGAM2505 include diagnosis, prevention and treatment of diseases and clinical conditions associated with LOC221250. LOC221296 (Accession XM_166325) is another VGAM2505 host target gene. LOC221296 BINDING SITE is HOST TARGET binding site found in the 3' untranslated region of mRNA encoded by LOC221296, corresponding to a HOST TARGET binding site such as BINDING SITE I, BINDING SITE II or BINDING SITE III. Table 2 illustrates the complementarity of the nucleotide sequences of LOC221296 BINDING SITE, designated SEQ ID:44167, to the nucleotide sequence of VGAM2505 RNA, herein designated VGAM RNA, also designated SEQ ID:5216.

Another function of VGAM2505 is therefore inhibition of LOC221296 (Accession XM_166325). Accordingly, utilities of VGAM2505 include diagnosis, prevention and treatment of diseases and clinical conditions associated with LOC221296. LOC221336 (Accession XM_166427) is another VGAM2505 host target gene. LOC221336 BINDING SITE is HOST TARGET binding site found in the 5' untranslated region of mRNA encoded by LOC221336, corresponding to a HOST TARGET binding site such as BINDING SITE I, BINDING SITE II or BINDING SITE III. Table 2 illustrates the complementarity of the nucleotide sequences of LOC221336 BINDING SITE, designated SEQ ID:44319, to the nucleotide sequence of VGAM2505 RNA, herein designated VGAM RNA, also designated SEQ ID:5216.

Another function of VGAM2505 is therefore inhibition of LOC221336 (Accession XM_166427). Accordingly, utilities of VGAM2505 include diagnosis, prevention and treatment of diseases and clinical conditions associated with LOC221336. LOC221424 (Accession XM_168060) is another VGAM2505 host target gene. LOC221424 BINDING SITE is HOST TARGET binding site found in the 5' untranslated region of mRNA encoded by LOC221424, corresponding to a HOST TARGET binding site such as BINDING SITE I, BINDING SITE II or BINDING SITE III. Table 2 illustrates the complementarity of the nucleotide sequences of LOC221424 BINDING SITE, designated SEQ ID:44978, to the nucleotide sequence of VGAM2505 RNA, herein designated VGAM RNA, also designated SEQ ID:5216.

Another function of VGAM2505 is therefore inhibition of LOC221424 (Accession XM_168060). Accordingly, utilities of VGAM2505 include diagnosis, prevention and treatment of diseases and clinical conditions associated with LOC221424. LOC221663 (Accession XM_168131) is another VGAM2505 host target gene. LOC221663 BINDING SITE is HOST TARGET binding site found in the 5' untranslated region of mRNA encoded by LOC221663, corresponding to a HOST TARGET binding site such as BINDING SITE I, BINDING SITE II or BINDING SITE III. Table 2 illustrates the complementarity of the nucleotide sequences of LOC221663 BINDING SITE, designated SEQ ID:45039, to the nucleotide sequence of VGAM2505 RNA, herein designated VGAM RNA, also designated SEQ ID:5216.

Another function of VGAM2505 is therefore inhibition of LOC221663 (Accession XM_168131). Accordingly, utilities of VGAM2505 include diagnosis, prevention and treatment of diseases and clinical conditions associated with LOC221663. LOC253092 (Accession XM_173583) is another VGAM2505 host target gene. LOC253092 BINDING SITE is HOST TARGET binding site found in the 5' untranslated region of mRNA encoded by LOC253092, corresponding to a HOST TARGET binding site such as BINDING SITE I, BINDING SITE II or BINDING SITE III. Table 2 illustrates the complementarity of the nucleotide sequences of LOC253092 BINDING SITE, designated SEQ ID:46549, to the nucleotide sequence of VGAM2505 RNA, herein designated VGAM RNA, also designated SEQ ID:5216.

Another function of VGAM2505 is therefore inhibition of LOC253092 (Accession XM_173583). Accordingly, utilities of VGAM2505 include diagnosis, prevention and treatment of diseases and clinical conditions associated with LOC253092. LOC254428 (Accession XM_170932) is another VGAM2505 host target gene. LOC254428 BINDING SITE is HOST TARGET binding site found in the 3' untranslated region of mRNA encoded by LOC254428, corresponding to a HOST TARGET binding site such as BINDING SITE I, BINDING SITE II or BINDING SITE III. Table 2 illustrates the complementarity of the nucleotide sequences of LOC254428 BINDING SITE, designated SEQ ID:45716, to the nucleotide sequence of VGAM2505 RNA, herein designated VGAM RNA, also designated SEQ ID:5216.

Another function of VGAM2505 is therefore inhibition of LOC254428 (Accession XM_170932). Accordingly, utilities of VGAM2505 include diagnosis, prevention and treatment of diseases and clinical conditions associated with LOC254428. LOC255177 (Accession XM_172941) is another VGAM2505 host target gene. LOC255177 BINDING SITE is HOST TARGET binding site found in the 3' untranslated region of mRNA encoded by LOC255177, corresponding to a HOST TARGET binding site such as BINDING SITE I, BINDING SITE II or BINDING SITE III. Table 2 illustrates the complementarity of the nucleotide sequences of LOC255177 BINDING SITE, designated SEQ ID:46201, to the nucleotide sequence of VGAM2505 RNA, herein designated VGAM RNA, also designated SEQ ID:5216.

Another function of VGAM2505 is therefore inhibition of LOC255177 (Accession XM_172941). Accordingly, utilities of VGAM2505 include diagnosis, prevention and treatment of diseases and clinical conditions associated with LOC255177. LOC256306 (Accession XM_172976) is another VGAM2505 host target gene. LOC256306 BINDING SITE is HOST TARGET binding site found in the 3' untranslated region of mRNA encoded by LOC256306, corresponding to a HOST TARGET binding site such as BINDING SITE I, BINDING SITE II or BINDING SITE III. Table 2 illustrates the complementarity of the nucleotide sequences of LOC256306 BINDING SITE, designated SEQ ID:46236, to the nucleotide sequence of VGAM2505 RNA, herein designated VGAM RNA, also designated SEQ ID:5216.

Another function of VGAM2505 is therefore inhibition of LOC256306 (Accession XM_172976). Accordingly, utilities of VGAM2505 include diagnosis, prevention and treatment of diseases and clinical conditions associated with LOC256306. LOC257468 (Accession XM_170838) is another VGAM2505 host target gene. LOC257468 BINDING SITE is HOST TARGET binding site found in the 3' untranslated region of mRNA encoded by LOC257468, corresponding to a HOST TARGET binding site such as BINDING SITE I, BINDING SITE II or BINDING SITE III. Table 2 illustrates the complementarity of the nucleotide sequences of LOC257468 BINDING SITE, designated SEQ ID:45626, to the nucleotide sequence of VGAM2505 RNA, herein designated VGAM RNA, also designated SEQ ID:5216.

Another function of VGAM2505 is therefore inhibition of LOC257468 (Accession XM_170838). Accordingly, utilities of VGAM2505 include diagnosis, prevention and treatment of diseases and clinical conditions associated with LOC257468. LOC51193 (Accession NM_016331) is another VGAM2505 host target gene. LOC51193 BINDING SITE is HOST TARGET binding site found in the 5' untranslated region of mRNA encoded by LOC51193, corresponding to a HOST TARGET binding site such as BINDING SITE I, BINDING SITE II or BINDING SITE III. Table 2 illustrates the complementarity of the nucleotide sequences of LOC51193 BINDING SITE, designated SEQ ID:18455, to the nucleotide sequence of VGAM2505 RNA, herein designated VGAM RNA, also designated SEQ ID:5216.

Another function of VGAM2505 is therefore inhibition of LOC51193 (Accession NM_016331). Accordingly, utilities of VGAM2505 include diagnosis, prevention and treatment of diseases and clinical conditions associated with LOC51193. LOC51219 (Accession NM_016418) is another VGAM2505 host target gene. LOC51219 BINDING SITE is HOST TARGET binding site found in the 5' untranslated region of mRNA encoded by LOC51219, corresponding to a HOST TARGET binding site such as BINDING SITE I, BINDING SITE II or BINDING SITE III. Table 2 illustrates the complementarity of the nucleotide sequences of LOC51219 BINDING SITE, designated SEQ ID:18544, to the nucleotide sequence of VGAM2505 RNA, herein designated VGAM RNA, also designated SEQ ID:5216.

Another function of VGAM2505 is therefore inhibition of LOC51219 (Accession NM_016418). Accordingly, utilities of VGAM2505 include diagnosis, prevention and treatment of diseases and clinical conditions associated with LOC51219. LOC81034 (Accession NM_030780) is another VGAM2505 host target gene. LOC81034 BINDING SITE is HOST TARGET binding site found in the 3' untranslated region of mRNA encoded by LOC81034, corresponding to a HOST TARGET binding site such as BINDING SITE I, BINDING SITE II or BINDING SITE III. Table 2 illustrates the complementarity of the nucleotide sequences of LOC81034 BINDING SITE, designated SEQ ID:25069, to the nucleotide sequence of VGAM2505 RNA, herein designated VGAM RNA, also designated SEQ ID:5216.

Another function of VGAM2505 is therefore inhibition of LOC81034 (Accession NM_030780). Accordingly, utilities of VGAM2505 include diagnosis, prevention and treatment of diseases and clinical conditions associated with LOC81034. LOC89932 (Accession XM_027341) is another VGAM2505 host target gene. LOC89932 BINDING SITE is HOST TARGET binding site found in the 3' untranslated region of mRNA encoded by LOC89932, corresponding to a HOST TARGET binding site such as BINDING SITE I, BINDING SITE II or BINDING SITE III. Table 2 illustrates the complementarity of the nucleotide sequences of LOC89932 BINDING SITE, designated SEQ ID:30488, to the nucleotide sequence of VGAM2505 RNA, herein designated VGAM RNA, also designated SEQ ID:5216.

Another function of VGAM2505 is therefore inhibition of LOC89932 (Accession XM_027341). Accordingly, utilities of VGAM2505 include diagnosis, prevention and treatment of diseases and clinical conditions associated with LOC89932. LOC90288 (Accession XM_030669) is another VGAM2505 host target gene. LOC90288 BINDING SITE is HOST TARGET binding site found in the 3' untranslated region of mRNA encoded by LOC90288, corresponding to a HOST TARGET binding site such as BINDING SITE I, BINDING SITE II or BINDING SITE III. Table 2 illustrates the complementarity of the nucleotide sequences of LOC90288 BINDING SITE, designated SEQ ID:31106, to the nucleotide sequence of VGAM2505 RNA, herein designated VGAM RNA, also designated SEQ ID:5216.

Another function of VGAM2505 is therefore inhibition of LOC90288 (Accession XM_030669). Accordingly, utilities of VGAM2505 include diagnosis, prevention and treatment of diseases and clinical conditions associated with LOC90288. LOC90371 (Accession XM_031261) is another VGAM2505 host target gene. LOC90371 BINDING SITE is HOST TARGET binding site found in the 5' untranslated region of mRNA encoded by LOC90371, corresponding to a HOST TARGET binding site such as BINDING SITE I, BINDING SITE II or BINDING SITE III. Table 2 illustrates the complementarity of the nucleotide sequences of LOC90371 BINDING SITE, designated SEQ ID:31320, to the nucleotide sequence of VGAM2505 RNA, herein designated VGAM RNA, also designated SEQ ID:5216.

Another function of VGAM2505 is therefore inhibition of LOC90371 (Accession XM_031261). Accordingly, utilities of VGAM2505 include diagnosis, prevention and treatment of diseases and clinical conditions associated with LOC90371. LOC90591 (Accession XM_032811) is another VGAM2505 host target gene. LOC90591 BINDING SITE is HOST TARGET binding site found in the 3' untranslated region of mRNA encoded by LOC90591, corresponding to a HOST TARGET binding site such as BINDING SITE I, BINDING SITE II or BINDING SITE III. Table 2 illustrates the complementarity of the nucleotide sequences of LOC90591 BINDING SITE, designated SEQ ID:31756, to the nucleotide sequence of VGAM2505 RNA, herein designated VGAM RNA, also designated SEQ ID:5216.

Another function of VGAM2505 is therefore inhibition of LOC90591 (Accession XM_032811). Accordingly, utilities of VGAM2505 include diagnosis, prevention and treatment of diseases and clinical conditions associated with LOC90591. LOC91115 (Accession XM_036218) is another VGAM2505 host target gene. LOC91115 BINDING SITE is HOST TARGET binding site found in the 3' untranslated region of mRNA encoded by LOC91115, corresponding to a HOST TARGET binding site such as BINDING SITE I, BINDING SITE II or BINDING SITE III. Table 2 illustrates the complementarity of the nucleotide sequences of LOC91115 BINDING SITE, designated SEQ ID:32394, to the nucleotide sequence of VGAM2505 RNA, herein designated VGAM RNA, also designated SEQ ID:5216.

Another function of VGAM2505 is therefore inhibition of LOC91115 (Accession XM_036218). Accordingly, utilities of VGAM2505 include diagnosis, prevention and treatment of diseases and clinical conditions associated with LOC91115. LOC91252 (Accession XM_037173) is another VGAM2505 host target gene. LOC91252 BINDING SITE is HOST TARGET binding site found in the 3' untranslated region of mRNA encoded by LOC91252, corresponding to a HOST TARGET binding site such as BINDING SITE I, BINDING SITE II or BINDING SITE III. Table 2 illustrates the complementarity of the nucleotide sequences of LOC91252 BINDING SITE, designated SEQ ID:32552, to the nucleotide sequence of VGAM2505 RNA, herein designated VGAM RNA, also designated SEQ ID:5216.

Another function of VGAM2505 is therefore inhibition of LOC91252 (Accession XM_037173). Accordingly, utilities of VGAM2505 include diagnosis, prevention and treatment of diseases and clinical conditions associated with LOC91252. LOC92267 (Accession XM_043979) is another VGAM2505 host target gene. LOC92267 BINDING SITE is HOST TARGET binding site found in the 3' untranslated region of mRNA encoded by LOC92267, corresponding to a HOST TARGET binding site such as BINDING SITE I, BINDING SITE II or BINDING SITE III. Table 2 illustrates the complementarity of the nucleotide sequences of LOC92267 BINDING SITE, designated SEQ ID:34054, to the nucleotide sequence of VGAM2505 RNA, herein designated VGAM RNA, also designated SEQ ID:5216.

Another function of VGAM2505 is therefore inhibition of LOC92267 (Accession XM_043979). Accordingly, utilities of VGAM2505 include diagnosis, prevention and treatment of diseases and clinical conditions associated with LOC92267. LOC92697 (Accession XM_046715) is another VGAM2505 host target gene. LOC92697 BINDING SITE1 and LOC92697 BINDING SITE2 are HOST TARGET binding sites found in untranslated regions of mRNA encoded by LOC92697, corresponding to HOST TARGET binding sites such as BINDING SITE I, BINDING SITE II or BINDING SITE III. Table 2 illustrates the complementarity of the nucleotide sequences of LOC92697 BINDING SITE1 and LOC92697 BINDING SITE2, designated SEQ ID:34800 and SEQ ID:34801 respectively, to the nucleotide sequence of VGAM2505 RNA, herein designated VGAM RNA, also designated SEQ ID:5216.

Another function of VGAM2505 is therefore inhibition of LOC92697 (Accession XM_046715). Accordingly, utilities of VGAM2505 include diagnosis, prevention and treatment of diseases and clinical conditions associated with LOC92697. Protocadherin 11 X-linked (PCDH11X, Accession NM_032968) is another VGAM2506 host target gene. PCDH11X BINDING SITE1 and PCDH11X BINDING SITE2 are HOST TARGET binding sites found in untranslated regions of mRNA encoded by PCDH11X, corresponding to HOST TARGET binding sites such as BINDING SITE I, BINDING SITE II or BINDING SITE III. Table 2 illustrates the complementarity of the nucleotide sequences of PCDH11X BINDING SITE1 and PCDH11X BINDING SITE2, designated SEQ ID:26785 and SEQ ID:26800 respectively, to the nucleotide sequence of VGAM2506 RNA, herein designated VGAM RNA, also designated SEQ ID:5217.

Another function of VGAM2506 is therefore inhibition of Protocadherin 11 X-linked (PCDH11X, Accession NM_032968), a gene which is thought to play a fundamental role in cell-cell recognition essential for the segmental development and function of the central nervous system. Accordingly, utilities of VGAM2506 include diagnosis, prevention and treatment of diseases and clinical conditions associated with PCDH11X. The function of PCDH11X and its association with various diseases and clinical conditions, has been established by previous studies, as described hereinabove with reference to VGAM433. LOC124602 (Accession XM_058829) is another VGAM2506 host target gene. LOC124602 BINDING SITE is HOST TARGET binding site found in the 3' untranslated region of mRNA encoded by LOC124602, corresponding to a HOST TARGET binding site such as BINDING SITE I, BINDING SITE II or BINDING SITE III. Table 2 illustrates the complementarity of the nucleotide sequences of LOC124602 BINDING SITE, designated SEQ ID:36759, to the nucleotide sequence of VGAM2506 RNA, herein designated VGAM RNA, also designated SEQ ID:5217.

Another function of VGAM2506 is therefore inhibition of LOC124602 (Accession XM_058829). Accordingly, utilities of VGAM2506 include diagnosis, prevention and treatment of diseases and clinical conditions associated with LOC124602. LOC201229 (Accession XM_113925) is another VGAM2506 host target gene. LOC201229 BINDING SITE is HOST TARGET binding site found in the 3' untranslated region of mRNA encoded by LOC201229, corresponding to a HOST TARGET binding site such as BINDING SITE I, BINDING SITE II or BINDING SITE III. Table 2 illustrates the complementarity of the nucleotide sequences of LOC201229 BINDING SITE, designated SEQ ID:42540, to the nucleotide sequence of VGAM2506 RNA, herein designated VGAM RNA, also designated SEQ ID:5217.

Another function of VGAM2506 is therefore inhibition of LOC201229 (Accession XM_113925). Accordingly, utilities of VGAM2506 include diagnosis, prevention and treatment of diseases and clinical conditions associated with LOC201229. LOC203397 (Accession XM_114695) is another VGAM2506 host target gene. LOC203397 BINDING SITE is HOST TARGET binding site found in the 3' untranslated region of mRNA encoded by LOC203397, corresponding to a HOST TARGET binding site such as BINDING SITE I, BINDING SITE II or BINDING SITE III. Table 2 illustrates the complementarity of the nucleotide sequences of LOC203397 BINDING SITE, designated SEQ ID:43039, to the nucleotide sequence of VGAM2506 RNA, herein designated VGAM RNA, also designated SEQ ID:5217.

Another function of VGAM2506 is therefore inhibition of LOC203397 (Accession XM_114695). Accordingly, utilities of VGAM2506 include diagnosis, prevention and treatment of diseases and clinical conditions associated with LOC203397. FIG. 1 further provides a conceptual description of a novel bioinformatically detected viral gene of the present invention, referred to here as Viral Genomic Address Messenger 2507 (VGAM2507) viral gene, which modulates expression of respective host target genes thereof, the function and utility of which host target genes is known in the art.

VGAM2507 is a novel bioinformatically detected regulatory, non protein coding, viral micro RNA (miRNA) gene. The method by which VGAM2507 was detected is described hereinabove with reference to FIGS. 1-8.

VGAM2507 gene, herein designated VGAM GENE, is a viral gene contained in the genome of Mouse Cytomegalovirus 1. VGAM2507 host target gene, herein designated VGAM HOST TARGET GENE, is a human gene contained in the human genome.

VGAM2507 gene encodes a VGAM2507 precursor RNA, herein designated VGAM PRECURSOR RNA. Similar to other miRNA genes, and unlike most ordinary genes, VGAM2507 precursor RNA does not encode a protein. A nucleotide sequence identical or highly similar to the nucleotide sequence of VGAM2507 precursor RNA is designated SEQ ID:2493, and is provided hereinbelow with reference to the sequence listing part. Nucleotide sequence SEQ ID:2493 is located at position 38544 relative to the genome of Mouse Cytomegalovirus 1.

VGAM2507 precursor RNA folds onto itself, forming VGAM2507 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2507 folded precursor RNA into VGAM2507 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2507 RNA is designated SEQ ID:5218, and is provided hereinbelow with reference to the sequence listing part.

VGAM2507 host target gene, herein designated VGAM HOST TARGET GENE, encodes a corresponding messenger RNA, VGAM2507 host target RNA, herein designated VGAM HOST TARGET RNA. VGAM2507 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2507 RNA, herein designated VGAM RNA, binds complementarily to one or more host target binding sites located in untranslated regions of VGAM2507 host target RNA, herein designated VGAM HOST TARGET RNA. This complementary binding is due to the fact that the nucleotide sequence of VGAM2507 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2507 RNA, herein designated VGAM RNA, may have a different number of host target binding sites in untranslated regions of a VGAM2507 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2507 RNA, herein designated VGAM RNA, to host target binding sites on VGAM2507 host target RNA, herein designated VGAM HOST TARGET RNA, such as BINDING SITE I, BINDING SITE II and BINDING SITE III, inhibits translation of VGAM2507 host target RNA into VGAM2507 host target protein, herein designated VGAM HOST TARGET PROTEIN. VGAM host target protein is therefore outlined by a broken line.

It is appreciated that VGAM2507 host target gene, herein designated VGAM HOST TARGET GENE, in fact represents a plurality of VGAM2507 host target genes. The mRNA of each one of this plurality of VGAM2507 host target genes comprises one or more host target binding sites, each having a nucleotide sequence which is at least partly complementary to VGAM2507 RNA, herein designated VGAM RNA, and which when bound by VGAM2507 RNA causes inhibition of translation of respective one or more VGAM2507 host target proteins.

It is further appreciated by one skilled in the art that the mode of translational inhibition illustrated by FIG. 1 with specific reference to translational inhibition exerted by VGAM2507 gene, herein designated VGAM GENE, on one or more VGAM2507 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2507 is inhibition of expression of host target genes, as part of a novel viral mechanism of attacking a host. Accordingly, utilities of VGAM2507 include diagnosis, prevention and treatment of viral infection by Mouse Cytomegalovirus 1. Specific functions, and accordingly utilities, of VGAM2507 correlate with, and may be deduced from, the identity of the host target genes which VGAM2507 binds and inhibits, and the function of these host target genes, as elaborated hereinbelow.

Nucleotide sequences of the VGAM2507 precursor RNA, herein designated VGAM PRECURSOR RNA, and of the 'diced' VGAM2507 RNA, herein designated VGAM RNA, and a schematic representation of the secondary folding of VGAM2507 folded precursor RNA, herein designated VGAM FOLDED PRECURSOR RNA, of VGAM2507 are further described hereinbelow with reference to Table 1.

Nucleotide sequences of host target binding sites, such as BINDING SITE-I, BINDING SITE-II and BINDING SITE-III of FIG. 1, found on VGAM2507 host target RNA, and schematic representation of the complementarity of each of these host target binding sites to VGAM2507 RNA, herein designated VGAM RNA, are described hereinbelow with reference to Table 2.

As mentioned hereinabove with reference to FIG. 1, a function of VGAM2507 gene, herein designated VGAM is inhibition of expression of VGAM2507 target genes. It is appreciated that specific functions, and accordingly utilities, of VGAM2507 correlate with, and may be deduced from, the identity of the target genes which VGAM2507 binds and inhibits, and the function of these target genes, as elaborated hereinbelow.

BCL2-like 2 (BCL2L2, Accession NM_004050) is a VGAM2507 host target gene. BCL2L2 BINDING SITE is HOST TARGET binding site found in the 3' untranslated region of mRNA encoded by BCL2L2, corresponding to a HOST TARGET binding site such as BINDING SITE I, BINDING SITE II or BINDING SITE III. Table 2 illustrates the complementarity of the nucleotide sequences of BCL2L2 BINDING SITE, designated SEQ ID:10258, to the nucleotide sequence of VGAM2507 RNA, herein designated VGAM RNA, also designated SEQ ID:5218.

A function of VGAM2507 is therefore inhibition of BCL2-like 2 (BCL2L2, Accession NM_004050), a gene which promotes cell survival. Accordingly, utilities of VGAM2507 include diagnosis, prevention and treatment of diseases and clinical conditions associated with BCL2L2. The function of BCL2L2 and its association with various diseases and clinical conditions, has been established by previous studies, as described hereinabove with reference to VGAM431. Solute Carrier Family 16 (monocarboxylic acid transporters), Member 2 (putative transporter) (SLC16A2, Accession NM_006517) is another VGAM2507 host target gene. SLC16A2 BINDING SITE is HOST TARGET binding site found in the 3' untranslated region of mRNA encoded by SLC16A2, corresponding to a HOST TARGET binding site such as BINDING SITE I, BINDING SITE II or BINDING SITE III. Table 2 illustrates the complementarity of the nucleotide sequences of SLC16A2 BINDING SITE, designated SEQ ID:13268, to the nucleotide sequence of VGAM2507 RNA, herein designated VGAM RNA, also designated SEQ ID:5218.

Another function of VGAM2507 is therefore inhibition of Solute Carrier Family 16 (monocarboxylic acid transporters), Member 2 (putative transporter) (SLC16A2, Accession NM_006517). Accordingly, utilities of VGAM2507 include diagnosis, prevention and treatment of diseases and clinical conditions associated with SLC16A2. FLJ14525 (Accession NM_032800) is another VGAM2507 host target gene. FLJ14525 BINDING SITE is HOST TARGET binding site found in the 3' untranslated region of mRNA encoded by FLJ14525, corresponding to a HOST TARGET binding site such as BINDING SITE I, BINDING SITE II or BINDING SITE III. Table 2 illustrates the complementarity of the nucleotide sequences of FLJ14525 BINDING SITE, designated SEQ ID:26548, to the nucleotide sequence of VGAM2507 RNA, herein designated VGAM RNA, also designated SEQ ID:5218.

Another function of VGAM2507 is therefore inhibition of FLJ14525 (Accession NM_032800). Accordingly, utilities of VGAM2507 include diagnosis, prevention and treatment of diseases and clinical conditions associated with FLJ14525. FLJ20378 (Accession NM_017795) is another VGAM2507 host target gene. FLJ20378 BINDING SITE is HOST TARGET binding site found in the 5' untranslated region of mRNA encoded by FLJ20378, corresponding to a HOST TARGET binding site such as BINDING SITE I, BINDING SITE II or BINDING SITE III. Table 2 illustrates the complementarity of the nucleotide sequences of FLJ20378 BINDING SITE, designated SEQ ID:19435, to the nucleotide sequence of VGAM2507 RNA, herein designated VGAM RNA, also designated SEQ ID:5218.

Another function of VGAM2507 is therefore inhibition of FLJ20378 (Accession NM_017795). Accordingly, utilities of VGAM2507 include diagnosis, prevention and treatment of diseases and clinical conditions associated with FLJ20378. Thyroid Hormone Receptor Interactor 13 (TRIP13, Accession NM_004237) is another VGAM2507 host target gene. TRIP13 BINDING SITE is HOST TARGET binding site found in the 3' untranslated region of mRNA encoded by TRIP13, corresponding to a HOST TARGET binding site such as BINDING SITE I, BINDING SITE II or BINDING SITE III. Table 2 illustrates the complementarity of the nucleotide sequences of TRIP13 BINDING SITE, designated SEQ ID:10434, to the nucleotide sequence of VGAM2507 RNA, herein designated VGAM RNA, also designated SEQ ID:5218.

Another function of VGAM2507 is therefore inhibition of Thyroid Hormone Receptor Interactor 13 (TRIP13, Accession NM_004237). Accordingly, utilities of VGAM2507 include diagnosis, prevention and treatment of diseases and clinical conditions associated with TRIP13. LOC120939 (Accession XM_073688) is another VGAM2507 host target gene. LOC120939 BINDING SITE is HOST TARGET binding site found in the 5' untranslated region of mRNA encoded by LOC120939, corresponding to a HOST TARGET binding site such as BINDING SITE I, BINDING SITE II or BINDING SITE III. Table 2 illustrates the complementarity of the nucleotide sequences of LOC120939 BINDING SITE, designated SEQ ID:37513, to the nucleotide sequence of VGAM2507 RNA, herein designated VGAM RNA, also designated SEQ ID:5218.

Another function of VGAM2507 is therefore inhibition of LOC120939 (Accession XM_073688). Accordingly, utilities of VGAM2507 include diagnosis, prevention and treatment of diseases and clinical conditions associated with LOC120939. LOC152200 (Accession XM_098174) is another VGAM2507 host target gene. LOC152200 BINDING SITE is HOST TARGET binding site found in the 3' untranslated region of mRNA encoded by LOC152200, corresponding to a HOST TARGET binding site such as BINDING SITE I, BINDING SITE II or BINDING SITE III. Table 2 illustrates the complementarity of the nucleotide sequences of LOC152200 BINDING SITE, designated SEQ ID:41438, to the nucleotide sequence of VGAM2507 RNA, herein designated VGAM RNA, also designated SEQ ID:5218.

Another function of VGAM2507 is therefore inhibition of LOC152200 (Accession XM_098174). Accordingly, utilities of VGAM2507 include diagnosis, prevention and treatment of diseases and clinical conditions associated with LOC152200. LOC203276 (Accession XM_117523) is another VGAM2507 host target gene. LOC203276 BINDING SITE is HOST TARGET binding site found in the 3' untranslated region of mRNA encoded by LOC203276, corresponding to a HOST TARGET binding site such as BINDING SITE I, BINDING SITE II or BINDING SITE III. Table 2 illustrates the complementarity of the nucleotide sequences of LOC203276 BINDING SITE, designated SEQ ID:43488, to the nucleotide sequence of VGAM2507 RNA, herein designated VGAM RNA, also designated SEQ ID:5218.

Another function of VGAM2507 is therefore inhibition of LOC203276 (Accession XM_117523). Accordingly, utilities of VGAM2507 include diagnosis, prevention and treatment of diseases and clinical conditions associated with LOC203276. LOC203305 (Accession XM_117529) is another VGAM2507 host target gene. LOC203305 BINDING SITE is HOST TARGET binding site found in the 3' untranslated region of mRNA encoded by LOC203305, corresponding to a HOST TARGET binding site such as BINDING SITE I, BINDING SITE II or BINDING SITE III. Table 2 illustrates the complementarity of the nucleotide sequences of LOC203305 BINDING SITE, designated SEQ ID:43512, to the nucleotide sequence of VGAM2507 RNA, herein designated VGAM RNA, also designated SEQ ID:5218.

Another function of VGAM2507 is therefore inhibition of LOC203305 (Accession XM_117529). Accordingly, utilities of VGAM2507 include diagnosis, prevention and treatment of diseases and clinical conditions associated with LOC203305. LOC255696 (Accession XM_173933) is another VGAM2507 host target gene. LOC255696 BINDING SITE is HOST TARGET binding site found in the 5' untranslated region of mRNA encoded by LOC255696, corresponding to a HOST TARGET binding site such as BINDING SITE I, BINDING SITE II or BINDING SITE III. Table 2 illustrates the complementarity of the nucleotide sequences of LOC255696 BINDING SITE, designated SEQ ID:46567, to the nucleotide sequence of VGAM2507 RNA, herein designated VGAM RNA, also designated SEQ ID:5218.

Another function of VGAM2507 is therefore inhibition of LOC255696 (Accession XM_173933). Accordingly, utilities of VGAM2507 include diagnosis, prevention and treatment of diseases and clinical conditions associated with LOC255696. LOC90019 (Accession NM_138567) is another VGAM2507 host target gene. LOC90019 BINDING SITE is HOST TARGET binding site found in the 3' untranslated region of mRNA encoded by LOC90019, corresponding to a HOST TARGET binding site such as BINDING SITE I, BINDING SITE II or BINDING SITE III. Table 2 illustrates the complementarity of the nucleotide sequences of LOC90019 BINDING SITE, designated SEQ ID:28870, to the nucleotide sequence of VGAM2507 RNA, herein designated VGAM RNA, also designated SEQ ID:5218.

Another function of VGAM2507 is therefore inhibition of LOC90019 (Accession NM_138567). Accordingly, utilities of VGAM2507 include diagnosis, prevention and treatment of diseases and clinical conditions associated with LOC90019. FIG. 1 further provides a conceptual description of a novel bioinformatically detected viral gene of the present invention, referred to here as Viral Genomic Address Messenger 2508 (VGAM2508) viral gene, which modulates expression of respective host target genes thereof, the function and utility of which host target genes is known in the art.

VGAM2508 is a novel bioinformatically detected regulatory, non protein coding, viral micro RNA (miRNA) gene. The method by which VGAM2508 was detected is described hereinabove with reference to FIGS. 1-8.

VGAM2508 gene, herein designated VGAM GENE, is a viral gene contained in the genome of Mouse Cytomegalovirus 1. VGAM2508 host target gene, herein designated VGAM HOST TARGET GENE, is a human gene contained in the human genome.

VGAM2508 gene encodes a VGAM2508 precursor RNA, herein designated VGAM PRECURSOR RNA. Similar to other miRNA genes, and unlike most ordinary genes, VGAM2508 precursor RNA does not encode a protein. A nucleotide sequence identical or highly similar to the nucleotide sequence of VGAM2508 precursor RNA is designated SEQ ID:2494, and is provided hereinbelow with reference to the sequence listing part. Nucleotide sequence SEQ ID:2494 is located at position 168766 relative to the genome of Mouse Cytomegalovirus 1.

VGAM2508 precursor RNA folds onto itself, forming VGAM2508 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2508 folded precursor RNA into VGAM2508 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2508 RNA is designated SEQ ID:5219, and is provided hereinbelow with reference to the sequence listing part.

VGAM2508 host target gene, herein designated VGAM HOST TARGET GENE, encodes a corresponding messenger RNA, VGAM2508 host target RNA, herein designated VGAM HOST TARGET RNA. VGAM2508 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2508 RNA, herein designated VGAM RNA, binds complementarily to one or more host target binding sites located in untranslated regions of VGAM2508 host target RNA, herein designated VGAM HOST TARGET RNA. This complementary binding is due to the fact that the nucleotide sequence of VGAM2508 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2508 RNA, herein designated VGAM RNA, may have a different number of host target binding sites in untranslated regions of a VGAM2508 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2508 RNA, herein designated VGAM RNA, to host target binding sites on VGAM2508 host target RNA, herein designated VGAM HOST TARGET RNA, such as BINDING SITE I, BINDING SITE II and BINDING SITE III, inhibits translation of VGAM2508 host target RNA into VGAM2508 host target protein, herein designated VGAM HOST TARGET PROTEIN. VGAM host target protein is therefore outlined by a broken line.

It is appreciated that VGAM2508 host target gene, herein designated VGAM HOST TARGET GENE, in fact represents a plurality of VGAM2508 host target genes. The mRNA of each one of this plurality of VGAM2508 host target genes comprises one or more host target binding sites, each having a nucleotide sequence which is at least partly complementary to VGAM2508 RNA, herein designated VGAM RNA, and which when bound by VGAM2508 RNA causes inhibition of translation of respective one or more VGAM2508 host target proteins.

It is further appreciated by one skilled in the art that the mode of translational inhibition illustrated by FIG. 1 with specific reference to translational inhibition exerted by VGAM2508 gene, herein designated VGAM GENE, on one or more VGAM2508 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2508 is inhibition of expression of host target genes, as part of a novel viral mechanism of attacking a host. Accordingly, utilities of VGAM2508 include diagnosis, prevention and treatment of viral infection by Mouse Cytomegalovirus 1. Specific functions, and accordingly utilities, of VGAM2508 correlate with, and may be deduced from, the identity of the host target genes which VGAM2508 binds and inhibits, and the function of these host target genes, as elaborated hereinbelow.

Nucleotide sequences of the VGAM2508 precursor RNA, herein designated VGAM PRECURSOR RNA, and of the 'diced' VGAM2508 RNA, herein designated VGAM RNA, and a schematic representation of the secondary folding of VGAM2508 folded precursor RNA, herein designated VGAM FOLDED PRECURSOR RNA, of VGAM2508 are further described hereinbelow with reference to Table 1.

Nucleotide sequences of host target binding sites, such as BINDING SITE-I, BINDING SITE-II and BINDING SITE-III of FIG. 1, found on VGAM2508 host target RNA, and schematic representation of the complementarity of each of these host target binding sites to VGAM2508 RNA, herein designated VGAM RNA, are described hereinbelow with reference to Table 2.

As mentioned hereinabove with reference to FIG. 1, a function of VGAM2508 gene, herein designated VGAM is inhibition of expression of VGAM2508 target genes. It is appreciated that specific functions, and accordingly utilities, of VGAM2508 correlate with, and may be deduced from, the identity of the target genes which VGAM2508 binds and inhibits, and the function of these target genes, as elaborated hereinbelow.

Aristaless-like Homeobox 3 (ALX3, Accession NM_006492) is a VGAM2508 host target gene. ALX3 BINDING SITE is HOST TARGET binding site found in the 3' untranslated region of mRNA encoded by ALX3, corresponding to a HOST TARGET binding site such as BINDING SITE I, BINDING SITE II or BINDING SITE III. Table 2 illustrates the complementarity of the nucleotide sequences of ALX3 BINDING SITE, designated SEQ ID:13222, to the nucleotide sequence of VGAM2508 RNA, herein designated VGAM RNA, also designated SEQ ID:5219.

A function of VGAM2508 is therefore inhibition of Aristaless-like Homeobox 3 (ALX3, Accession NM_006492), a gene which is involved in cell-type differentiation and development. Accordingly, utilities of VGAM2508 include diagnosis, prevention and treatment of diseases and clinical conditions associated with ALX3. The function of ALX3 and its association with various diseases and clinical conditions, has been established by previous studies, as described hereinabove with reference to VGAM55. Amyloid Beta (A4) Precursor Protein-binding, Family A, Member 2 (X11-like) (APBA2, Accession NM_005503) is another VGAM2508 host target gene. APBA2 BINDING SITE is HOST TARGET binding site found in the 3' untranslated region of mRNA encoded by APBA2, corresponding to a HOST TARGET binding site such as BINDING SITE I, BINDING SITE II or BINDING SITE III. Table 2 illustrates the complementarity of the nucleotide sequences of APBA2 BINDING SITE, designated SEQ ID:12018, to the nucleotide sequence of VGAM2508 RNA, herein designated VGAM RNA, also designated SEQ ID:5219.

Another function of VGAM2508 is therefore inhibition of Amyloid Beta (A4) Precursor Protein-binding, Family A, Member 2 (X11-like) (APBA2, Accession NM_005503), a gene which interacts with and stabilisesthe Alzheimer's disease amyloid precursor protein (APP) and inhibits production of proteolytic APP fragments. Accordingly, utilities of VGAM2508 include diagnosis, prevention and treatment of diseases and clinical conditions associated with APBA2. The function of APBA2 and its association with various diseases and clinical conditions, has been established by previous studies, as described hereinabove with reference to VGAM925. Bone Morphogenetic Protein 1 (BMP1, Accession NM_006131) is another VGAM2508 host target gene. BMP1 BINDING SITE is HOST TARGET binding site found in the 3' untranslated region of mRNA encoded by BMP1, corresponding to a HOST TARGET binding site such as BINDING SITE I, BINDING SITE II or BINDING SITE III. Table 2 illustrates the complementarity of the nucleotide sequences of BMP1 BINDING SITE, designated SEQ ID:12768, to the nucleotide sequence of VGAM2508 RNA, herein designated VGAM RNA, also designated SEQ ID:5219.

Another function of VGAM2508 is therefore inhibition of Bone Morphogenetic Protein 1 (BMP1, Accession NM_006131), a gene which cleaves procollagens leading to formation of extracellular matrix. Accordingly, utilities of VGAM2508 include diagnosis, prevention and treatment of diseases and clinical conditions associated with BMP1. The function of BMP1 and its association with various diseases and clinical conditions, has been established by previous studies, as described hereinabove with reference to VGAM247. Core-binding Factor, Runt Domain, Alpha Subunit 2; Translocated To, 1; Cyclin D-related (CBFA2T1, Accession NM_004349) is another VGAM2508 host target gene. CBFA2T1 BINDING SITE is HOST TARGET binding site found in the 5' untranslated region of mRNA encoded by CBFA2T1, corresponding to a HOST TARGET binding site such as BINDING SITE I, BINDING SITE II or BINDING SITE III. Table 2 illustrates the complementarity of the nucleotide sequences of CBFA2T1 BINDING SITE, designated SEQ ID:10543, to the nucleotide sequence of VGAM2508 RNA, herein designated VGAM RNA, also designated SEQ ID:5219.

Another function of VGAM2508 is therefore inhibition of Core-binding Factor, Runt Domain, Alpha Subunit 2; Translocated To, 1; Cyclin D-related (CBFA2T1, Accession NM_004349), a gene which produces a chimeric gene made up of the 5-prime region of the AML1 gene fused to the 3-prime region of the ETO gene through translocation. Accordingly, utilities of VGAM2508 include diagnosis, prevention and treatment of diseases and clinical conditions associated with CBFA2T1. The function of CBFA2T1 and its association with various diseases and clinical conditions, has been established by previous studies, as described hereinabove with reference to VGAM113. Cell Division Cycle 25B (CDC25B, Accession NM_021874) is another VGAM2508 host target gene. CDC25B BINDING SITE1 and CDC25B BINDING SITE2 are HOST TARGET binding sites found in untranslated regions of mRNA encoded by CDC25B, corresponding to HOST TARGET binding sites such as BINDING SITE I, BINDING SITE II or BINDING SITE III. Table 2 illustrates the complementarity of the nucleotide sequences of CDC25B BINDING SITE1 and CDC25B BINDING SITE2, designated SEQ ID:22417 and SEQ ID:22413 respectively, to the nucleotide sequence of VGAM2508 RNA, herein designated VGAM RNA, also designated SEQ ID:5219.

Another function of VGAM2508 is therefore inhibition of Cell Division Cycle 25B (CDC25B, Accession NM_021874), a gene which is positively activated by dephosphorylation. Accordingly, utilities of VGAM2508 include diagnosis, prevention and treatment of diseases and clinical conditions associated with CDC25B. The function of CDC25B and its association with various diseases and clinical conditions, has been established by previous studies, as described hereinabove with reference to VGAM165. EPB72 (Accession NM_004099) is another VGAM2508 host target gene. EPB72 BINDING SITE is HOST TARGET binding site found in the 3' untranslated region of mRNA encoded by EPB72, corresponding to a HOST TARGET binding site such as BINDING SITE I, BINDING SITE II or BINDING SITE III. Table 2 illustrates the complementarity of the nucleotide sequences of EPB72 BINDING SITE, designated SEQ ID:10304, to the nucleotide sequence of VGAM2508 RNA, herein designated VGAM RNA, also designated SEQ ID:5219.

Another function of VGAM2508 is therefore inhibition of EPB72 (Accession NM_004099), a gene which may regulate cation conductance. Accordingly, utilities of VGAM2508 include diagnosis, prevention and treatment of diseases and clinical conditions associated with EPB72. The function of EPB72 and its association with various diseases and clinical conditions, has been established by previous studies, as described hereinabove with reference to VGAM1560. Epilepsy, Progressive Myoclonus Type 2, Lafora Disease (laforin) (EPM2A, Accession NM_005670) is another VGAM2508 host target gene. EPM2A BINDING SITE is HOST TARGET binding site found in the 3' untranslated region of mRNA encoded by EPM2A, corresponding to a HOST TARGET binding site such as BINDING SITE I, BINDING SITE II or BINDING SITE III. Table 2 illustrates the complementarity of the nucleotide sequences of EPM2A BINDING SITE, designated SEQ ID:12227, to the nucleotide sequence of VGAM2508 RNA, herein designated VGAM RNA, also designated SEQ ID:5219.

Another function of VGAM2508 is therefore inhibition of Epilepsy, Progressive Myoclonus Type 2, Lafora Disease (laforin) (EPM2A, Accession NM_005670), a gene which Laforin; protein tyrosine phosphatase that may have role in glycogen metabolism. Accordingly, utilities of VGAM2508 include diagnosis, prevention and treatment of diseases and clinical conditions associated with EPM2A. The function of EPM2A and its association with various diseases and clinical conditions, has been established by previous studies, as described hereinabove with reference to VGAM470. Farnesyltransferase, CAAX Box, Beta (FNTB, Accession NM_002028) is another VGAM2508 host target gene. FNTB BINDING SITE is HOST TARGET binding site found in the 3' untranslated region of mRNA encoded by FNTB, corresponding to a HOST TARGET binding site such as BINDING SITE I, BINDING SITE II or BINDING SITE III. Table 2 illustrates the complementarity of the nucleotide sequences of FNTB BINDING SITE, designated SEQ ID:7781, to the nucleotide sequence of VGAM2508 RNA, herein designated VGAM RNA, also designated SEQ ID:5219.

Another function of VGAM2508 is therefore inhibition of Farnesyltransferase, CAAX Box, Beta (FNTB, Accession NM_002028), a gene which transfers farnesyl groups to proteins. Accordingly, utilities of VGAM2508 include diagnosis, prevention and treatment of diseases and clinical conditions associated with FNTB. The function of FNTB and its association with various diseases and clinical conditions, has been established by previous studies, as described hereinabove with reference to VGAM615. Guanine Nucleotide-releasing Factor 2 (specific for crk proto-oncogene) (GRF2, Accession NM_005312) is another VGAM2508 host target gene. GRF2 BINDING SITE is HOST TARGET binding site found in the 3' untranslated region of mRNA encoded by GRF2, corresponding to a HOST TARGET binding site such as BINDING SITE I, BINDING SITE II or BINDING SITE III. Table 2 illustrates the complementarity of the nucleotide sequences of GRF2 BINDING SITE, designated SEQ ID:11790, to the nucleotide sequence of VGAM2508 RNA, herein designated VGAM RNA, also designated SEQ ID:5219.

Another function of VGAM2508 is therefore inhibition of Guanine Nucleotide-releasing Factor 2 (specific for crk proto-oncogene) (GRF2, Accession NM_005312), a gene which promotes the exchange of ras-bound gdp by gtp. Accordingly, utilities of VGAM2508 include diagnosis, prevention and treatment of diseases and clinical conditions associated with GRF2. The function of GRF2 and its association with various diseases and clinical conditions, has been established by previous studies, as described hereinabove with reference to VGAM1958. Hepsin (transmembrane protease, serine 1) (HPN, Accession NM_002151) is another VGAM2508 host target gene. HPN BINDING SITE is HOST TARGET binding site found in the 5' untranslated region of mRNA encoded by HPN, corresponding to a HOST TARGET binding site such as BINDING SITE I, BINDING SITE II or BINDING SITE III. Table 2 illustrates the complementarity of the nucleotide sequences of HPN BINDING SITE, designated SEQ ID:7932, to the nucleotide sequence of VGAM2508 RNA, herein designated VGAM RNA, also designated SEQ ID:5219.

Another function of VGAM2508 is therefore inhibition of Hepsin (transmembrane protease, serine 1) (HPN, Accession NM_002151), a gene which is a cell surface serine protease. Accordingly, utilities of VGAM2508 include diagnosis, prevention and treatment of diseases and clinical conditions associated with HPN. The function of HPN has been established by previous studies. Hepsin is a cell surface serine protease. From cDNA libraries prepared from human liver and hepatoma cell line mRNA, Leytus et al. (1988) isolated cDNA clones coding for a serine protease called hepsin. The proteolytic enzymes of the serine protease family exist as single- or 2-chain zymogenes that are activated by a specific and limited proteolytic cleavage. They contain 3 principal active-site amino acids, his, asp, and ser, that participate in peptide bond hydrolysis. Among the best-studied serine proteases are those found in plasma. These enzymes are involved in processes such as blood coagulation, fibrinolysis, and complement activation. Tsuji et al. (1991) showed that the hepsin mRNA is 1.85 kb in size and present in most tissues, with the highest level in liver. It is present in the plasma membrane in a molecular orientation of type II membrane-associated proteins, with its catalytic subunit (C-terminal half) at the cell surface and its N terminus facing the cytosol. Hepsin is not found in cytosol. See also TMPRSS2 (OMIM Ref. No. 602060), a related serine protease. Animal model experiments lend further support to the function of HPN. To determine the functional importance of hepsin, Wu et al. (1998) generated hepsin-deficient mice by homologous recombination. The homozygous deficient mice were viable and fertile, and grew normally. In functional assays, including tail bleeding time, plasma clotting times, and tissue factor- or LPS-induced disseminated intravascular coagulation models, no significant difference was found between hepsin -/- and wildtype littermates. Liver weight and serum concentrations of liver-derived proteins and enzymes were similar. Serum concentrations of bone-derived alkaline phosphatase were approximately 2-fold higher in hepsin -/- mice of both sexes when compared with wildtype littermates. No obvious abnormalities were found in major organs in hepsin -/- mice on histologic examination. The results indicated that hepsin is not essential for embryonic development and normal hemostasis.

It is appreciated that the abovementioned animal model for HPN is acknowledged by those skilled in the art as a scientifically valid animal model, as can be further appreciated from the publications sited hereinbelow.

Full details of the abovementioned studies are described in the following publications, the disclosure of which are hereby incorporated by reference:

Leytus, S. P.; Loeb, K. R.; Hagen, F. S.; Kurachi, K.; Davie, E. W.: A novel trypsin-like serine protease (hepsin) with a putative transmembrane domain expressed by human liver and hepatoma cells. Biochemistry 27:1067-1074, 1988; and Tsuji, A.; Torres-Rosado, A.; Arai, T.; Le Beau, M. M.; Lemons, R. S.; Chou, S.-H.; Kurachi, K.: Hepsin, a cell membrane-associated protease: characterization, tissue distribution, and.

Further studies establishing the function and utilities of HPN are found in John Hopkins OMIM database record ID 142440, and in sited publications numbered 11565-11568 listed in the bibliography section hereinbelow, which are also hereby incorporated by reference. Integral Membrane Protein 2B (ITM2B, Accession NM_021999) is another VGAM2508 host target gene. ITM2B BINDING SITE is HOST TARGET binding site found in the 5' untranslated region of mRNA encoded by ITM2B, corresponding to a HOST TARGET binding site such as BINDING SITE I, BINDING SITE II or BINDING SITE III. Table 2 illustrates the complementarity of the nucleotide sequences of ITM2B BINDING SITE, designated SEQ ID:22539, to the nucleotide sequence of VGAM2508 RNA, herein designated VGAM RNA, also designated SEQ ID:5219.

Another function of VGAM2508 is therefore inhibition of Integral Membrane Protein 2B (ITM2B, Accession NM_021999), a gene which is a member of the type II integral membrane protein family. Accordingly, utilities of VGAM2508 include diagnosis, prevention and treatment of diseases and clinical conditions associated with ITM2B. The function of ITM2B and its association with various diseases and clinical conditions, has been established by previous studies, as described hereinabove with reference to VGAM458. Membrane Protein, Palmitoylated 2 (MAGUK p55 subfamily member 2) (MPP2, Accession XM_008355) is another VGAM2508 host target gene. MPP2 BINDING SITE is HOST TARGET binding site found in the 3' untranslated region of mRNA encoded by MPP2, corresponding to a HOST TARGET binding site such as BINDING SITE I, BINDING SITE II or BINDING SITE III. Table 2 illustrates the complementarity of the nucleotide sequences of MPP2 BINDING SITE, designated SEQ ID:30083, to the nucleotide sequence of VGAM2508 RNA, herein designated VGAM RNA, also designated SEQ ID:5219.

Another function of VGAM2508 is therefore inhibition of Membrane Protein, Palmitoylated 2 (MAGUK p55 subfamily member 2) (MPP2, Accession XM_008355). Accordingly, utilities of VGAM2508 include diagnosis, prevention and treatment of diseases and clinical conditions associated with MPP2. Mucin and Cadherin-like (MUCDHL, Accession NM_031265) is another VGAM2508 host target gene. MUCDHL BINDING SITE is HOST TARGET binding site found in the 3' untranslated region of mRNA encoded by MUCDHL, corresponding to a HOST TARGET binding site such as BINDING SITE I, BINDING SITE II or BINDING SITE III. Table 2 illustrates the complementarity of the nucleotide sequences of MUCDHL BINDING SITE, designated SEQ ID:25283, to the nucleotide sequence of VGAM2508 RNA, herein designated VGAM RNA, also designated SEQ ID:5219.

Another function of VGAM2508 is therefore inhibition of Mucin and Cadherin-like (MUCDHL, Accession NM_031265). Accordingly, utilities of VGAM2508 include diagnosis, prevention and treatment of diseases and clinical conditions associated with MUCDHL. Nuclear Receptor Co-repressor 2 (NCOR2, Accession NM_006312) is another VGAM2508 host target gene. NCOR2 BINDING SITE is HOST TARGET binding site found in the 3' untranslated region of mRNA encoded by NCOR2, corresponding to a HOST TARGET binding site such as BINDING SITE I, BINDING SITE II or BINDING SITE III. Table 2 illustrates the complementarity of the nucleotide sequences of NCOR2 BINDING SITE, designated SEQ ID:13003, to the nucleotide sequence of VGAM2508 RNA, herein designated VGAM RNA, also designated SEQ ID:5219.

Another function of VGAM2508 is therefore inhibition of Nuclear Receptor Co-repressor 2 (NCOR2, Accession NM_006312), a gene which mediates the transcriptional repression activity of some nuclear receptors by promoting chromatin condensation, thus preventing access of the basal transcription. Accordingly, utilities of VGAM2508 include diagnosis, prevention and treatment of diseases and clinical conditions associated with NCOR2. The function of NCOR2 and its association with various diseases and clinical conditions, has been established by previous studies, as described hereinabove with reference to VGAM2346. Nuclear Factor I/A (NFIA, Accession XM_046827) is another VGAM2508 host target gene. NFIA BINDING SITE is HOST TARGET binding site found in the 5' untranslated region of mRNA encoded by NFIA, corresponding to a HOST TARGET binding site such as BINDING SITE I, BINDING SITE II or BINDING SITE III. Table 2 illustrates the complementarity of the nucleotide sequences of NFIA BINDING SITE, designated SEQ ID:34842, to the nucleotide sequence of VGAM2508 RNA, herein designated VGAM RNA, also designated SEQ ID:5219.

Another function of VGAM2508 is therefore inhibition of Nuclear Factor I/A (NFIA, Accession XM_046827). Accordingly, utilities of VGAM2508 include diagnosis, prevention and treatment of diseases and clinical conditions associated with NFIA. Ninjurin 1 (NINJ1, Accession NM_004148) is another VGAM2508 host target gene. NINJ1 BINDING SITE is HOST TARGET binding site found in the 3' untranslated region of mRNA encoded by NINJ1, corresponding to a HOST TARGET binding site such as BINDING SITE I, BINDING SITE II or BINDING SITE III. Table 2 illustrates the complementarity of the nucleotide sequences of NINJ1 BINDING SITE, designated SEQ ID:10351, to the nucleotide sequence of VGAM2508 RNA, herein designated VGAM RNA, also designated SEQ ID:5219.

Another function of VGAM2508 is therefore inhibition of Ninjurin 1 (NINJ1, Accession NM_004148), a gene which may play a role in nerve regeneration and in the formation and function of other tissues. Accordingly, utilities of VGAM2508 include diagnosis, prevention and treatment of diseases and clinical conditions associated with NINJ1. The function of NINJ1 and its association with various diseases and clinical conditions, has been established by previous studies, as described hereinabove with reference to VGAM1927. Neuronal Pentraxin I (NPTX1, Accession NM_002522) is another VGAM2508 host target gene. NPTX1 BINDING SITE is HOST TARGET binding site found in the 3' untranslated region of mRNA encoded by NPTX1, corresponding to a HOST TARGET binding site such as BINDING SITE I, BINDING SITE II or BINDING SITE III. Table 2 illustrates the complementarity of the nucleotide sequences of NPTX1 BINDING SITE, designated SEQ ID:8355, to the nucleotide sequence of VGAM2508 RNA, herein designated VGAM RNA, also designated SEQ ID:5219.

Another function of VGAM2508 is therefore inhibition of Neuronal Pentraxin I (NPTX1, Accession NM_002522), a gene which may be involved in synaptic uptake of extracellular material and is very strongly similar to rat NP1. Accordingly, utilities of VGAM2508 include diagnosis, prevention and treatment of diseases and clinical conditions associated with NPTX1. The function of NPTX1 and its association with various diseases and clinical conditions, has been established by previous studies, as described hereinabove with reference to VGAM111. Paired Basic Amino Acid Cleaving System 4 (PACE4, Accession NM_002570) is another VGAM2508 host target gene. PACE4 BINDING SITE1 through PACE4 BINDING SITE6 are HOST TARGET binding sites found in untranslated regions of mRNA encoded by PACE4, corresponding to HOST TARGET binding sites such as BINDING SITE I, BINDING SITE II or BINDING SITE III. Table 2 illustrates the complementarity of the nucleotide sequences of PACE4 BINDING SITE1 through PACE4 BINDING SITE6, designated SEQ ID:8430, SEQ ID:28723, SEQ ID:28724, SEQ ID:28725, SEQ ID:28719 and SEQ ID:28722 respectively, to the nucleotide sequence of VGAM2508 RNA, herein designated VGAM RNA, also designated SEQ ID:5219.

Another function of VGAM2508 is therefore inhibition of Paired Basic Amino Acid Cleaving System 4 (PACE4, Accession NM_002570), a gene which processes hormone precursors by cleaving paired basic amino acids. Accordingly, utilities of VGAM2508 include diagnosis, prevention and treatment of diseases and clinical conditions associated with PACE4. The function of PACE4 and its association with various diseases and clinical conditions, has been established by previous studies, as described hereinabove with reference to VGAM1194. Plexin B2 (PLXNB2, Accession NM_012401) is another VGAM2508 host target gene. PLXNB2 BINDING SITE is HOST TARGET binding site found in the 3' untranslated region of mRNA encoded by PLXNB2, corresponding to a HOST TARGET binding site such as BINDING SITE I, BINDING SITE II or BINDING SITE III. Table 2 illustrates the complementarity of the nucleotide sequences of PLXNB2 BINDING SITE, designated SEQ ID:14777, to the nucleotide sequence of VGAM2508 RNA, herein designated VGAM RNA, also designated SEQ ID:5219.

Another function of VGAM2508 is therefore inhibition of Plexin B2 (PLXNB2, Accession NM_012401), a gene which is a novel member of the plexin family. Accordingly, utilities of VGAM2508 include diagnosis, prevention and treatment of diseases and clinical conditions associated with PLXNB2. The function of PLXNB2 and its association with various diseases and clinical conditions, has been established by previous studies, as described hereinabove with reference to VGAM87. Retinoic Acid Induced 14 (RAI14, Accession NM_015577) is another VGAM2508 host target gene. RAI14 BINDING SITE is HOST TARGET binding site found in the 3' untranslated region of mRNA encoded by RAI14, corresponding to a HOST TARGET binding site such as BINDING SITE I, BINDING SITE II or BINDING SITE III. Table 2 illustrates the complementarity of the nucleotide sequences of RAI14 BINDING SITE, designated SEQ ID:17845, to the nucleotide sequence of VGAM2508 RNA, herein designated VGAM RNA, also designated SEQ ID:5219.

Another function of VGAM2508 is therefore inhibition of Retinoic Acid Induced 14 (RAI14, Accession NM_015577), a gene which is required for protein transport from the er to the golgi complex. Accordingly, utilities of VGAM2508 include diagnosis, prevention and treatment of diseases and clinical conditions associated with RAI14. The function of RAI14 and its association with various diseases and clinical conditions, has been established by previous studies, as described hereinabove with reference to VGAM1036. Sialic Acid Binding Ig-like Lectin 11 (SIGLEC11, Accession NM_052884) is another VGAM2508 host target gene. SIGLEC11 BINDING SITE is HOST TARGET binding site found in the 3' untranslated region of mRNA encoded by SIGLEC11, corresponding to a HOST TARGET binding site such as BINDING SITE I, BINDING SITE II or BINDING SITE III. Table 2 illustrates the complementarity of the nucleotide sequences of SIGLEC11 BINDING SITE, designated SEQ ID:27465, to the nucleotide sequence of VGAM2508 RNA, herein designated VGAM RNA, also designated SEQ ID:5219.

Another function of VGAM2508 is therefore inhibition of Sialic Acid Binding Ig-like Lectin 11 (SIGLEC11, Accession NM_052884). Accordingly, utilities of VGAM2508 include diagnosis, prevention and treatment of diseases and clinical conditions associated with SIGLEC11. Zinc Finger Protein 205 (ZNF205, Accession NM_003456) is another VGAM2508 host target gene. ZNF205 BINDING SITE is HOST TARGET binding site found in the 5' untranslated region of mRNA encoded by ZNF205, corresponding to a HOST TARGET binding site such as BINDING SITE I, BINDING SITE II or BINDING SITE III. Table 2 illustrates the complementarity of the nucleotide sequences of ZNF205 BINDING SITE, designated SEQ ID:9513, to the nucleotide sequence of VGAM2508 RNA, herein designated VGAM RNA, also designated SEQ ID:5219.

Another function of VGAM2508 is therefore inhibition of Zinc Finger Protein 205 (ZNF205, Accession NM_003456). Accordingly, utilities of VGAM2508 include diagnosis, prevention and treatment of diseases and clinical conditions associated with ZNF205. DKFZp434E2220 (Accession NM_017612) is another VGAM2508 host target gene. DKFZp434E2220 BINDING SITE is HOST TARGET binding site found in the 5' untranslated region of mRNA encoded by DKFZp434E2220, corresponding to a HOST TARGET binding site such as BINDING SITE I, BINDING SITE II or BINDING SITE III. Table 2 illustrates the complementarity of the nucleotide sequences of DKFZp434E2220 BINDING SITE, designated SEQ ID:19110, to the nucleotide sequence of VGAM2508 RNA, herein designated VGAM RNA, also designated SEQ ID:5219.

Another function of VGAM2508 is therefore inhibition of DKFZp434E2220 (Accession NM_017612). Accordingly, utilities of VGAM2508 include diagnosis, prevention and treatment of diseases and clinical conditions associated with DKFZp434E2220. Ets2 Repressor Factor (ERF, Accession NM_006494) is another VGAM2508 host target gene. ERF BINDING SITE is HOST TARGET binding site found in the 3' untranslated region of mRNA encoded by ERF, corresponding to a HOST TARGET binding site such as BINDING SITE I, BINDING SITE II or BINDING SITE III. Table 2 illustrates the complementarity of the nucleotide sequences of ERF BINDING SITE, designated SEQ ID:13236, to the nucleotide sequence of VGAM2508 RNA, herein designated VGAM RNA, also designated SEQ ID:5219.

Another function of VGAM2508 is therefore inhibition of Ets2 Repressor Factor (ERF, Accession NM_006494). Accordingly, utilities of VGAM2508 include diagnosis, prevention and treatment of diseases and clinical conditions associated with ERF. Fer-1-like 4 (C. elegans) (FER1L4, Accession NM_025206) is another VGAM2508 host target gene. FER1L4 BINDING SITE is HOST TARGET binding site found in the 3' untranslated region of mRNA encoded by FER1L4, corresponding to a HOST TARGET binding site such as BINDING SITE I, BINDING SITE II or BINDING SITE III. Table 2 illustrates the complementarity of the nucleotide sequences of FER1L4 BINDING SITE, designated SEQ ID:24873, to the nucleotide sequence of VGAM2508 RNA, herein designated VGAM RNA, also designated SEQ ID:5219.

Another function of VGAM2508 is therefore inhibition of Fer-1-like 4 (C. elegans) (FER1L4, Accession NM_025206). Accordingly, utilities of VGAM2508 include diagnosis, prevention and treatment of diseases and clinical conditions associated with FER1L4. FLJ10709 (Accession NM_018188) is another VGAM2508 host target gene. FLJ10709 BINDING SITE is HOST TARGET binding site found in the 3' untranslated region of mRNA encoded by FLJ10709, corresponding to a HOST TARGET binding site such as BINDING SITE I, BINDING SITE II or BINDING SITE III. Table 2 illustrates the complementarity of the nucleotide sequences of FLJ10709 BINDING SITE, designated SEQ ID:20038, to the nucleotide sequence of VGAM2508 RNA, herein designated VGAM RNA, also designated SEQ ID:5219.

Another function of VGAM2508 is therefore inhibition of FLJ10709 (Accession NM_018188). Accordingly, utilities of VGAM2508 include diagnosis, prevention and treatment of diseases and clinical conditions associated with FLJ10709. FLJ10743 (Accession NM_018201) is another VGAM2508 host target gene. FLJ10743 BINDING SITE is HOST TARGET binding site found in the 3' untranslated region of mRNA encoded by FLJ10743, corresponding to a HOST TARGET binding site such as BINDING SITE I, BINDING SITE II or BINDING SITE III. Table 2 illustrates the complementarity of the nucleotide sequences of FLJ10743 BINDING SITE, designated SEQ ID:20078, to the nucleotide sequence of VGAM2508 RNA, herein designated VGAM RNA, also designated SEQ ID:5219.

Another function of VGAM2508 is therefore inhibition of FLJ10743 (Accession NM_018201). Accordingly, utilities of VGAM2508 include diagnosis, prevention and treatment of diseases and clinical conditions associated with FLJ10743. FLJ12586 (Accession NM_024620) is another VGAM2508 host target gene. FLJ12586 BINDING SITE is HOST TARGET binding site found in the 3' untranslated region of mRNA encoded by FLJ12586, corresponding to a HOST TARGET binding site such as BINDING SITE I, BINDING SITE II or BINDING SITE III. Table 2 illustrates the complementarity of the nucleotide sequences of FLJ12586 BINDING SITE, designated SEQ ID:23882, to the nucleotide sequence of VGAM2508 RNA, herein designated VGAM RNA, also designated SEQ ID:5219.

Another function of VGAM2508 is therefore inhibition of FLJ12586 (Accession NM_024620). Accordingly, utilities of VGAM2508 include diagnosis, prevention and treatment of diseases and clinical conditions associated with FLJ12586. FLJ13710 (Accession NM_024817) is another VGAM2508 host target gene. FLJ13710 BINDING SITE is HOST TARGET binding site found in the 3' untranslated region of mRNA encoded by FLJ13710, corresponding to a HOST TARGET binding site such as BINDING SITE I, BINDING SITE II or BINDING SITE III. Table 2 illustrates the complementarity of the nucleotide sequences of FLJ13710 BINDING SITE, designated SEQ ID:24207, to the nucleotide sequence of VGAM2508 RNA, herein designated VGAM RNA, also designated SEQ ID:5219.

Another function of VGAM2508 is therefore inhibition of FLJ13710 (Accession NM_024817). Accordingly, utilities of VGAM2508 include diagnosis, prevention and treatment of diseases and clinical conditions associated with FLJ13710. FLJ14327 (Accession NM_024912) is another VGAM2508 host target gene. FLJ14327 BINDING SITE is HOST TARGET binding site found in the 3' untranslated region of mRNA encoded by FLJ14327, corresponding to a HOST TARGET binding site such as BINDING SITE I, BINDING SITE II or BINDING SITE III. Table 2 illustrates the complementarity of the nucleotide sequences of FLJ14327 BINDING SITE, designated SEQ ID:24426, to the nucleotide sequence of VGAM2508 RNA, herein designated VGAM RNA, also designated SEQ ID:5219.

Another function of VGAM2508 is therefore inhibition of FLJ14327 (Accession NM_024912). Accordingly, utilities of VGAM2508 include diagnosis, prevention and treatment of diseases and clinical conditions associated with FLJ14327. FLJ14351 (Accession NM_024732) is another VGAM2508 host target gene. FLJ14351 BINDING SITE is HOST TARGET binding site found in the 3' untranslated region of mRNA encoded by FLJ14351, corresponding to a HOST TARGET binding site such as BINDING SITE I, BINDING SITE II or BINDING SITE III. Table 2 illustrates the complementarity of the nucleotide sequences of FLJ14351 BINDING SITE, designated SEQ ID:24070, to the nucleotide sequence of VGAM2508 RNA, herein designated VGAM RNA, also designated SEQ ID:5219.

Another function of VGAM2508 is therefore inhibition of FLJ14351 (Accession NM_024732). Accordingly, utilities of VGAM2508 include diagnosis, prevention and treatment of diseases and clinical conditions associated with FLJ14351. FLJ20647 (Accession NM_017918) is another VGAM2508 host target gene. FLJ20647 BINDING SITE is HOST TARGET binding site found in the 5' untranslated region of mRNA encoded by FLJ20647, corresponding to a HOST TARGET binding site such as BINDING SITE I, BINDING SITE II or BINDING SITE III. Table 2 illustrates the complementarity of the nucleotide sequences of FLJ20647 BINDING SITE, designated SEQ ID:19571, to the nucleotide sequence of VGAM2508 RNA, herein designated VGAM RNA, also designated SEQ ID:5219.

Another function of VGAM2508 is therefore inhibition of FLJ20647 (Accession NM_017918). Accordingly, utilities of VGAM2508 include diagnosis, prevention and treatment of diseases and clinical conditions associated with FLJ20647. FLJ21736 (Accession NM_024922) is another VGAM2508 host target gene. FLJ21736 BINDING SITE is HOST TARGET binding site found in the 3' untranslated region of mRNA encoded by FLJ21736, corresponding to a HOST TARGET binding site such as BINDING SITE I, BINDING SITE II or BINDING SITE III. Table 2 illustrates the complementarity of the nucleotide sequences of FLJ21736 BINDING SITE, designated SEQ ID:24461, to the nucleotide sequence of VGAM2508 RNA, herein designated VGAM RNA, also designated SEQ ID:5219.

Another function of VGAM2508 is therefore inhibition of FLJ21736 (Accession NM_024922). Accordingly, utilities of VGAM2508 include diagnosis, prevention and treatment of diseases and clinical conditions associated with FLJ21736. FLJ32884 (Accession NM_144702) is another VGAM2508 host target gene. FLJ32884 BINDING SITE is HOST TARGET binding site found in the 5' untranslated region of mRNA encoded by FLJ32884, corresponding to a HOST TARGET binding site such as BINDING SITE I, BINDING SITE II or BINDING SITE III. Table 2 illustrates the complementarity of the nucleotide sequences of FLJ32884 BINDING SITE, designated SEQ ID:29528, to the nucleotide sequence of VGAM2508 RNA, herein designated VGAM RNA, also designated SEQ ID:5219.

Another function of VGAM2508 is therefore inhibition of FLJ32884 (Accession NM_144702). Accordingly, utilities of VGAM2508 include diagnosis, prevention and treatment of diseases and clinical conditions associated with FLJ32884. FXYD Domain Containing Ion Transport Regulator 3 (FXYD3, Accession NM_021910) is another VGAM2508 host target gene. FXYD3 BINDING SITE1 and FXYD3 BINDING SITE2 are HOST TARGET binding sites found in untranslated regions of mRNA encoded by FXYD3, corresponding to HOST TARGET binding sites such as BINDING SITE I, BINDING SITE II or BINDING SITE III. Table 2 illustrates the complementarity of the nucleotide sequences of FXYD3 BINDING SITE1 and FXYD3 BINDING SITE2, designated SEQ ID:22436 and SEQ ID:12593 respectively, to the nucleotide sequence of VGAM2508 RNA, herein designated VGAM RNA, also designated SEQ ID:5219.

Another function of VGAM2508 is therefore inhibition of FXYD Domain Containing Ion Transport Regulator 3 (FXYD3, Accession NM_021910). Accordingly, utilities of VGAM2508 include diagnosis, prevention and treatment of diseases and clinical conditions associated with FXYD3. KIAA0481 (Accession XM_050144) is another VGAM2508 host target gene. KIAA0481 BINDING SITE is HOST TARGET binding site found in the 3" untranslated region of mRNA encoded by KIAA0481, corresponding to a HOST TARGET binding site such as BINDING SITE I, BINDING SITE II or BINDING SITE III. Table 2 illustrates the complementarity of the nucleotide sequences of KIAA0481 BINDING SITE, designated SEQ ID:35568, to the nucleotide sequence of VGAM2508 RNA, herein designated VGAM RNA, also designated SEQ ID:5219.

Another function of VGAM2508 is therefore inhibition of KIAA0481 (Accession XM_050144). Accordingly, utilities of VGAM2508 include diagnosis, prevention and treatment of diseases and clinical conditions associated with KIAA0481. KIAA1026 (Accession XM_048825) is another VGAM2508 host target gene. KIAA1026 BINDING SITE is HOST TARGET binding site found in the 3' untranslated region of mRNA encoded by KIAA1026, corresponding to a HOST TARGET binding site such as BINDING SITE I, BINDING SITE II or BINDING SITE III. Table 2 illustrates the complementarity of the nucleotide sequences of KIAA1026 BINDING SITE, designated SEQ ID:35275, to the nucleotide sequence of VGAM2508 RNA, herein designated VGAM RNA, also designated SEQ ID:5219.

Another function of VGAM2508 is therefore inhibition of KIAA1026 (Accession XM_048825). Accordingly, utilities of VGAM2508 include diagnosis, prevention and treatment of diseases and clinical conditions associated with KIAA1026. KIAA1126 (Accession XM_050325) is another VGAM2508 host target gene. KIAA1126 BINDING SITE is HOST TARGET binding site found in the 3' untranslated region of mRNA encoded by KIAA1126, corresponding to a HOST TARGET binding site such as BINDING SITE I, BINDING SITE II or BINDING SITE III. Table 2 illustrates the complementarity of the nucleotide sequences of KIAA1126 BINDING SITE, designated SEQ ID:35607, to the nucleotide sequence of VGAM2508 RNA, herein designated VGAM RNA, also designated SEQ ID:5219.

Another function of VGAM2508 is therefore inhibition of KIAA1126 (Accession XM_050325). Accordingly, utilities of VGAM2508 include diagnosis, prevention and treatment of diseases and clinical conditions associated with KIAA1126. KIAA1344 (Accession XM_051699) is another VGAM2508 host target gene. KIAA1344 BINDING SITE is HOST TARGET binding site found in the 5' untranslated region of mRNA encoded by KIAA1344, corresponding to a HOST TARGET binding site such as BINDING SITE I, BINDING SITE II or BINDING SITE III. Table 2 illustrates the complementarity of the nucleotide sequences of KIAA1344 BINDING SITE, designated SEQ ID:35870, to the nucleotide sequence of VGAM2508 RNA, herein designated VGAM RNA, also designated SEQ ID:5219.

Another function of VGAM2508 is therefore inhibition of KIAA1344 (Accession XM_051699). Accordingly, utilities of VGAM2508 include diagnosis, prevention and treatment of diseases and clinical conditions associated with KIAA1344. KIAA1416 (Accession XM_098762) is another VGAM2508 host target gene. KIAA1416 BINDING SITE is HOST TARGET binding site found in the 5' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41808, to the nucleotide sequence of VGAM2508 RNA, herein designated VGAM RNA, also designated SEQ ID:5219.

Another function of VGAM2508 is therefore inhibition of KIAA1416 (Accession XM_098762). Accordingly, utilities of VGAM2508 include diagnosis, prevention and treatment of diseases and clinical conditions associated with KIAA1416. KIAA1538 (Accession XM_049474) is another VGAM2508 host target gene. KIAA1538 BINDING SITE is HOST TARGET binding site found in the 5' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35424, to the nucleotide sequence of VGAM2508 RNA, herein designated VGAM RNA, also designated SEQ ID:5219.

Another function of VGAM2508 is therefore inhibition of KIAA1538 (Accession XM_049474). Accordingly, utilities of VGAM2508 include diagnosis, prevention and treatment of diseases and clinical conditions associated with KIAA1538. KIAA1854 (Accession XM_049884) is another VGAM2508 host target gene. KIAA1854 BINDING SITE is HOST TARGET binding site found in the 3' untranslated region of mRNA encoded by KIAA1854, corresponding to a HOST TARGET binding site such as BINDING SITE I, BINDING SITE II or BINDING SITE III. Table 2 illustrates the complementarity of the nucleotide sequences of KIAA1854 BINDING SITE, designated SEQ ID:35533, to the nucleotide sequence of VGAM2508 RNA, herein designated VGAM RNA, also designated SEQ ID:5219.

Another function of VGAM2508 is therefore inhibition of KIAA1854 (Accession XM_049884). Accordingly, utilities of VGAM2508 include diagnosis, prevention and treatment of diseases and clinical conditions associated with KIAA1854. KIAA1889 (Accession XM_056298) is another VGAM2508 host target gene. KIAA1889 BINDING SITE is HOST TARGET binding site found in the 5' untranslated region of mRNA encoded by KIAA1889, corresponding to a HOST TARGET binding site such as BINDING SITE I, BINDING SITE II or BINDING SITE III. Table 2 illustrates the complementarity of the nucleotide sequences of KIAA1889 BINDING SITE, designated SEQ ID:36388, to the nucleotide sequence of VGAM2508 RNA, herein designated VGAM RNA, also designated SEQ ID:5219.

Another function of VGAM2508 is therefore inhibition of KIAA1889 (Accession XM_056298). Accordingly, utilities of VGAM2508 include diagnosis, prevention and treatment of diseases and clinical conditions associated with KIAA1889. MGC13057 (Accession NM_032321) is another VGAM2508 host target gene. MGC13057 BINDING SITE is HOST TARGET binding site found in the 5' untranslated region of mRNA encoded by MGC13057, corresponding to a HOST TARGET binding site such as BINDING SITE I, BINDING SITE II or BINDING SITE III. Table 2 illustrates the complementarity of the nucleotide sequences of MGC13057 BINDING SITE, designated SEQ ID:26124, to the nucleotide sequence of VGAM2508 RNA, herein designated VGAM RNA, also designated SEQ ID:5219.

Another function of VGAM2508 is therefore inhibition of MGC13057 (Accession NM_032321). Accordingly, utilities of VGAM2508 include diagnosis, prevention and treatment of diseases and clinical conditions associated with MGC13057. MGC21621 (Accession NM_145015) is another VGAM2508 host target gene. MGC21621 BINDING SITE is HOST TARGET binding site found in the 3' untranslated region of mRNA encoded by MGC21621, corresponding to a HOST TARGET binding site such as BINDING SITE I, BINDING SITE II or BINDING SITE III. Table 2 illustrates the complementarity of the nucleotide sequences of MGC21621 BINDING SITE, designated SEQ ID:29622, to the nucleotide sequence of VGAM2508 RNA, herein designated VGAM RNA, also designated SEQ ID:5219.

Another function of VGAM2508 is therefore inhibition of MGC21621 (Accession NM_145015). Accordingly, utilities of VGAM2508 include diagnosis, prevention and treatment of diseases and clinical conditions associated with MGC21621. MGC2474 (Accession NM_023931) is another VGAM2508 host target gene. MGC2474 BINDING SITE is HOST TARGET binding site found in the 3' untranslated region of mRNA encoded by MGC2474, corresponding to a HOST TARGET binding site such as BINDING SITE I, BINDING SITE II or BINDING SITE III. Table 2 illustrates the complementarity of the nucleotide sequences of MGC2474 BINDING SITE, designated SEQ ID:23416, to the nucleotide sequence of VGAM2508 RNA, herein designated VGAM RNA, also designated SEQ ID:5219.

Another function of VGAM2508 is therefore inhibition of MGC2474 (Accession NM_023931). Accordingly, utilities of VGAM2508 include diagnosis, prevention and treatment of diseases and clinical conditions associated with MGC2474. MGC2555 (Accession NM_032772) is another VGAM2508 host target gene. MGC2555 BINDING SITE is HOST TARGET binding site found in the 5' untranslated region of mRNA encoded by MGC2555, corresponding to a HOST TARGET binding site such as BINDING SITE I, BINDING SITE II or BINDING SITE III. Table 2 illustrates the complementarity of the nucleotide sequences of MGC2555 BINDING SITE, designated SEQ ID:26519, to the nucleotide sequence of VGAM2508 RNA, herein designated VGAM RNA, also designated SEQ ID:5219.

Another function of VGAM2508 is therefore inhibition of MGC2555 (Accession NM_032772). Accordingly, utilities of VGAM2508 include diagnosis, prevention and treatment of diseases and clinical conditions associated with MGC2555. moblak (Accession NM_130807) is another VGAM2508 host target gene. moblak BINDING SITE is HOST TARGET binding site found in the 3' untranslated region of mRNA encoded by moblak, corresponding to a HOST TARGET binding site such as BINDING SITE I, BINDING SITE II or BINDING SITE III. Table 2 illustrates the complementarity of the nucleotide sequences of moblak BINDING SITE, designated SEQ ID:28304, to the nucleotide sequence of VGAM2508 RNA, herein designated VGAM RNA, also designated SEQ ID:5219.

Another function of VGAM2508 is therefore inhibition of moblak (Accession NM_130807). Accordingly, utilities of VGAM2508 include diagnosis, prevention and treatment of diseases and clinical conditions associated with moblak. QKI (Accession XM_037438) is another VGAM2508 host target gene. QKI BINDING SITE is HOST TARGET binding site found in the 5' untranslated region of mRNA encoded by QKI, corresponding to a HOST TARGET binding site such as BINDING SITE I, BINDING SITE II or BINDING SITE III. Table 2 illustrates the complementarity of the nucleotide sequences of QKI BINDING SITE, designated SEQ ID:32618, to the nucleotide sequence of VGAM2508 RNA, herein designated VGAM RNA, also designated SEQ ID:5219.

Another function of VGAM2508 is therefore inhibition of QKI (Accession XM_037438). Accordingly, utilities of VGAM2508 include diagnosis, prevention and treatment of diseases and clinical conditions associated with QKI. RoXaN (Accession NM_025013) is another VGAM2508 host target gene. RoXaN BINDING SITE is HOST TARGET binding site found in the 3' untranslated region of mRNA encoded by RoXaN, corresponding to a HOST TARGET binding site such as BINDING SITE I, BINDING SITE II or BINDING SITE III. Table 2 illustrates the complementarity of the nucleotide sequences of RoXaN BINDING SITE, designated SEQ ID:24602, to the nucleotide sequence of VGAM2508 RNA, herein designated VGAM RNA, also designated SEQ ID:5219.

Another function of VGAM2508 is therefore inhibition of RoXaN (Accession NM_025013). Accordingly, utilities of VGAM2508 include diagnosis, prevention and treatment of diseases and clinical conditions associated with RoXaN. SES2 (Accession NM_031459) is another VGAM2508 host target gene. SES2 BINDING SITE is HOST TARGET binding site found in the 3' untranslated region of mRNA encoded by SES2, corresponding to a HOST TARGET binding site such as BINDING SITE I, BINDING SITE II or BINDING SITE III. Table 2 illustrates the complementarity of the nucleotide sequences of SES2 BINDING SITE, designated SEQ ID:25482, to the nucleotide sequence of VGAM2508 RNA, herein designated VGAM RNA, also designated SEQ ID:5219.

Another function of VGAM2508 is therefore inhibition of SES2 (Accession NM_031459). Accordingly, utilities of VGAM2508 include diagnosis, prevention and treatment of diseases and clinical conditions associated with SES2. Serum Response Factor (c-fos serum response element-binding transcription factor) (SRF, Accession NM_003131) is another VGAM2508 host target gene. SRF BINDING SITE is HOST TARGET binding site found in the 5" untranslated region of mRNA encoded by SRF, corresponding to a HOST TARGET binding site such as BINDING SITE I, BINDING SITE II or BINDING SITE III. Table 2 illustrates the complementarity of the nucleotide sequences of SRF BINDING SITE, designated SEQ ID:9099, to the nucleotide sequence of VGAM2508 RNA, herein designated VGAM RNA, also designated SEQ ID:5219.

Another function of VGAM2508 is therefore inhibition of Serum Response Factor (c-fos serum response element-binding transcription factor) (SRF, Accession NM_003131). Accordingly, utilities of VGAM2508 include diagnosis, prevention and treatment of diseases and clinical conditions associated with SRF. Upstream Binding Protein 1 (LBP-1a) (UBP1, Accession NM_014517) is another VGAM2508 host target gene. UBP1 BINDING SITE is HOST TARGET binding site found in the 5' untranslated region of mRNA encoded by UBP1, corresponding to a HOST TARGET binding site such as BINDING SITE I, BINDING SITE II or BINDING SITE III. Table 2 illustrates the complementarity of the nucleotide sequences of UBP1 BINDING SITE, designated SEQ ID:15850, to the nucleotide sequence of VGAM2508 RNA, herein designated VGAM RNA, also designated SEQ ID:5219.

Another function of VGAM2508 is therefore inhibition of Upstream Binding Protein 1 (LBP-1a) (UBP1, Accession NM_014517). Accordingly, utilities of VGAM2508 include diagnosis, prevention and treatment of diseases and clinical conditions associated with UBP1. Zinc Finger Protein 145 (Kruppel-like, expressed in promyelocytic leukemia) (ZNF145, Accession NM_006006) is another VGAM2508 host target gene. ZNF145 BINDING SITE is HOST TARGET binding site found in the 5' untranslated region of mRNA encoded by ZNF145, corresponding to a HOST TARGET binding site such as BINDING SITE I, BINDING SITE II or BINDING SITE III. Table 2 illustrates the complementarity of the nucleotide sequences of ZNF145 BINDING SITE, designated SEQ ID:12618, to the nucleotide sequence of VGAM2508 RNA, herein designated VGAM RNA, also designated SEQ ID:5219.

Another function of VGAM2508 is therefore inhibition of Zinc Finger Protein 145 (Kruppel-like, expressed in promyelocytic leukemia) (ZNF145, Accession NM_006006). Accordingly, utilities of VGAM2508 include diagnosis, prevention and treatment of diseases and clinical conditions associated with ZNF145. LOC124842 (Accession XM_064333) is another VGAM2508 host target gene. LOC124842 BINDING SITE is HOST TARGET binding site found in the 3' untranslated region of mRNA encoded by LOC124842, corresponding to a HOST TARGET binding site such as BINDING SITE I, BINDING SITE II or BINDING SITE III. Table 2 illustrates the complementarity of the nucleotide sequences of LOC124842 BINDING SITE, designated SEQ ID:37260, to the nucleotide sequence of VGAM2508 RNA, herein designated VGAM RNA, also designated SEQ ID:5219.

Another function of VGAM2508 is therefore inhibition of LOC124842 (Accession XM_064333). Accordingly, utilities of VGAM2508 include diagnosis, prevention and treatment of diseases and clinical conditions associated with LOC124842. LOC145481 (Accession XM_085163) is another VGAM2508 host target gene. LOC145481 BINDING SITE is HOST TARGET binding site found in the 5' untranslated region of mRNA encoded by LOC145481, corresponding to a HOST TARGET binding site such as BINDING SITE I, BINDING SITE II or BINDING SITE III. Table 2 illustrates the complementarity of the nucleotide sequences of LOC145481 BINDING SITE, designated SEQ ID:37889, to the nucleotide sequence of VGAM2508 RNA, herein designated VGAM RNA, also designated SEQ ID:5219.

Another function of VGAM2508 is therefore inhibition of LOC145481 (Accession XM_085163). Accordingly, utilities of VGAM2508 include diagnosis, prevention and treatment of diseases and clinical conditions associated with LOC145481. LOC147341 (Accession XM_097223) is another VGAM2508 host target gene. LOC147341 BINDING SITE is HOST TARGET binding site found in the 5' untranslated region of mRNA encoded by LOC147341, corresponding to a HOST TARGET binding site such as BINDING SITE I, BINDING SITE II or BINDING SITE III. Table 2 illustrates the complementarity of the nucleotide sequences of LOC147341 BINDING SITE, designated SEQ ID:40827, to the nucleotide sequence of VGAM2508 RNA, herein designated VGAM RNA, also designated SEQ ID:5219.

Another function of VGAM2508 is therefore inhibition of LOC147341 (Accession XM_097223). Accordingly, utilities of VGAM2508 include diagnosis, prevention and treatment of diseases and clinical conditions associated with LOC147341. LOC148809 (Accession XM_086325) is another VGAM2508 host target gene. LOC148809 BINDING SITE is HOST TARGET binding site found in the 3' untranslated region of mRNA encoded by LOC148809, corresponding to a HOST TARGET binding site such as BINDING SITE I, BINDING SITE II or BINDING SITE III. Table 2 illustrates the complementarity of the nucleotide sequences of LOC148809 BINDING SITE, designated SEQ ID:38594, to the nucleotide sequence of VGAM2508 RNA, herein designated VGAM RNA, also designated SEQ ID:5219.

Another function of VGAM2508 is therefore inhibition of LOC148809 (Accession XM_086325). Accordingly, utilities of VGAM2508 include diagnosis, prevention and treatment of diseases and clinical conditions associated with LOC148809. LOC150319 (Accession XM_086816) is another VGAM2508 host target gene. LOC150319 BINDING SITE1 and LOC150319 BINDING SITE2 are HOST TARGET binding sites found in untranslated regions of mRNA encoded by LOC150319, corresponding to HOST TARGET binding sites such as BINDING SITE I, BINDING SITE II or BINDING SITE III. Table 2 illustrates the complementarity of the nucleotide sequences of LOC150319 BINDING SITE1 and LOC150319 BINDING SITE2, designated SEQ ID:38893 and SEQ ID:38896 respectively, to the nucleotide sequence of VGAM2508 RNA, herein designated VGAM RNA, also designated SEQ ID:5219.

Another function of VGAM2508 is therefore inhibition of LOC150319 (Accession XM_086816). Accordingly, utilities of VGAM2508 include diagnosis, prevention and treatment of diseases and clinical conditions associated with LOC150319. LOC157349 (Accession XM_088298) is another VGAM2508 host target gene. LOC157349 BINDING SITE is HOST TARGET binding site found in the 5' untranslated region of mRNA encoded by LOC157349, corresponding to a HOST TARGET binding site such as BINDING SITE I, BINDING SITE II or BINDING SITE III. Table 2 illustrates the complementarity of the nucleotide sequences of LOC157349 BINDING SITE, designated SEQ ID:39588, to the nucleotide sequence of VGAM2508 RNA, herein designated VGAM RNA, also designated SEQ ID:5219.

Another function of VGAM2508 is therefore inhibition of LOC157349 (Accession XM_088298). Accordingly, utilities of VGAM2508 include diagnosis, prevention and treatment of diseases and clinical conditions associated with LOC157349. LOC157737 (Accession XM_098819) is another VGAM2508 host target gene. LOC157737 BINDING SITE is HOST TARGET binding site found in the 5' untranslated region of mRNA encoded by LOC157737, corresponding to a HOST TARGET binding site such as BINDING SITE I, BINDING SITE II or BINDING SITE III. Table 2 illustrates the complementarity of the nucleotide sequences of LOC157737 BINDING SITE, designated SEQ ID:41843, to the nucleotide sequence of VGAM2508 RNA, herein designated VGAM RNA, also designated SEQ ID:5219.

Another function of VGAM2508 is therefore inhibition of LOC157737 (Accession XM_098819). Accordingly, utilities of VGAM2508 include diagnosis, prevention and treatment of diseases and clinical conditions associated with LOC157737. LOC166879 (Accession XM_106298) is another VGAM2508 host target gene. LOC166879 BINDING SITE is HOST TARGET binding site found in the 5' untranslated region of mRNA encoded by LOC166879, corresponding to a HOST TARGET binding site such as BINDING SITE I, BINDING SITE II or BINDING SITE III. Table 2 illustrates the complementarity of the nucleotide sequences of LOC166879 BINDING SITE, designated SEQ ID:42197, to the nucleotide sequence of VGAM2508 RNA, herein designated VGAM RNA, also designated SEQ ID:5219.

Another function of VGAM2508 is therefore inhibition of LOC166879 (Accession XM_106298). Accordingly, utilities of VGAM2508 include diagnosis, prevention and treatment of diseases and clinical conditions associated with LOC166879. LOC196746 (Accession XM_113595) is another VGAM2508 host target gene. LOC196746 BINDING SITE is HOST TARGET binding site found in the 3' untranslated region of mRNA encoded by LOC196746, corresponding to a HOST TARGET binding site such as BINDING SITE I, BINDING SITE II or BINDING SITE III. Table 2 illustrates the complementarity of the nucleotide sequences of LOC196746 BINDING SITE, designated SEQ ID:42288, to the nucleotide sequence of VGAM2508 RNA, herein designated VGAM RNA, also designated SEQ ID:5219.

Another function of VGAM2508 is therefore inhibition of LOC196746 (Accession XM_113595). Accordingly, utilities of VGAM2508 include diagnosis, prevention and treatment of diseases and clinical conditions associated with LOC196746. LOC197196 (Accession XM_117003) is another VGAM2508 host target gene. LOC197196 BINDING SITE is HOST TARGET binding site found in the 3' untranslated region of mRNA encoded by LOC197196, corresponding to a HOST TARGET binding site such as BINDING SITE I, BINDING SITE II or BINDING SITE III. Table 2 illustrates the complementarity of the nucleotide sequences of LOC197196 BINDING SITE, designated SEQ ID:43201, to the nucleotide sequence of VGAM2508 RNA, herein designated VGAM RNA, also designated SEQ ID:5219.

Another function of VGAM2508 is therefore inhibition of LOC197196 (Accession XM_117003). Accordingly, utilities of VGAM2508 include diagnosis, prevention and treatment of diseases and clinical conditions associated with LOC197196. LOC199863 (Accession XM_117147) is another VGAM2508 host target gene. LOC199863 BINDING SITE is HOST TARGET binding site found in the 5' untranslated region of mRNA encoded by LOC199863, corresponding to a HOST TARGET binding site such as BINDING SITE I, BINDING SITE II or BINDING SITE III. Table 2 illustrates the complementarity of the nucleotide sequences of LOC199863 BINDING SITE, designated SEQ ID:43256, to the nucleotide sequence of VGAM2508 RNA, herein designated VGAM RNA, also designated SEQ ID:5219.

Another function of VGAM2508 is therefore inhibition of LOC199863 (Accession XM_117147). Accordingly, utilities of VGAM2508 include diagnosis, prevention and treatment of diseases and clinical conditions associated with LOC199863. LOC203260 (Accession XM_114661) is another VGAM2508 host target gene. LOC203260 BINDING SITE is HOST TARGET binding site found in the 3' untranslated region of mRNA encoded by LOC203260, corresponding to a HOST TARGET binding site such as BINDING SITE I, BINDING SITE II or BINDING SITE III. Table 2 illustrates the complementarity of the nucleotide sequences of LOC203260 BINDING SITE, designated SEQ ID:43022, to the nucleotide sequence of VGAM2508 RNA, herein designated VGAM RNA, also designated SEQ ID:5219.

Another function of VGAM2508 is therefore inhibition of LOC203260 (Accession XM_114661). Accordingly, utilities of VGAM2508 include diagnosis, prevention and treatment of diseases and clinical conditions associated with LOC203260. LOC203378 (Accession XM_117541) is another VGAM2508 host target gene. LOC203378 BINDING SITE is HOST TARGET binding site found in the 3' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43552, to the nucleotide sequence of VGAM2508 RNA, herein designated VGAM RNA, also designated SEQ ID:5219.

Another function of VGAM2508 is therefore inhibition of LOC203378 (Accession XM_117541). Accordingly, utilities of VGAM2508 include diagnosis, prevention and treatment of diseases and clinical conditions associated with LOC203378. LOC220021 (Accession XM_167814) is another VGAM2508 host target gene. LOC220021 BINDING SITE is HOST TARGET binding site found in the 3' untranslated region of mRNA encoded by LOC220021, corresponding to a HOST TARGET binding site such as BINDING SITE I, BINDING SITE II or BINDING SITE III. Table 2 illustrates the complementarity of the nucleotide sequences of LOC220021 BINDING SITE, designated SEQ ID:44850, to the nucleotide sequence of VGAM2508 RNA, herein designated VGAM RNA, also designated SEQ ID:5219.

Another function of VGAM2508 is therefore inhibition of LOC220021 (Accession XM_167814). Accordingly, utilities of VGAM2508 include diagnosis, prevention and treatment of diseases and clinical conditions associated with LOC220021. LOC220776 (Accession XM_043388) is another VGAM2508 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33934, to the nucleotide sequence of VGAM2508 RNA, herein designated VGAM RNA, also designated SEQ ID:5219.

Another function of VGAM2508 is therefore inhibition of LOC220776 (Accession XM_043388). Accordingly, utilities of VGAM2508 include diagnosis, prevention and treatment of diseases and clinical conditions associated with LOC220776. LOC254936 (Accession XM_170770) is another VGAM2508 host target gene. LOC254936 BINDING SITE is HOST TARGET binding site found in the 5' untranslated region of mRNA encoded by LOC254936, corresponding to a HOST TARGET binding site such as BINDING SITE I, BINDING SITE II or BINDING SITE III. Table 2 illustrates the complementarity of the nucleotide sequences of LOC254936 BINDING SITE, designated SEQ ID:45528, to the nucleotide sequence of VGAM2508 RNA, herein designated VGAM RNA, also designated SEQ ID:5219.

Another function of VGAM2508 is therefore inhibition of LOC254936 (Accession XM_170770). Accordingly, utilities of VGAM2508 include diagnosis, prevention and treatment of diseases and clinical conditions associated with LOC254936. LOC255271 (Accession XM_170945) is another VGAM2508 host target gene. LOC255271 BINDING SITE is HOST TARGET binding site found in the 5' untranslated region of mRNA encoded by LOC255271, corresponding to a HOST TARGET binding site such as BINDING SITE I, BINDING SITE II or BINDING SITE III. Table 2 illustrates the complementarity of the nucleotide sequences of LOC255271 BINDING SITE, designated SEQ ID:45727, to the nucleotide sequence of VGAM2508 RNA, herein designated VGAM RNA, also designated SEQ ID:5219.

Another function of VGAM2508 is therefore inhibition of LOC255271 (Accession XM_170945). Accordingly, utilities of VGAM2508 include diagnosis, prevention and treatment of diseases and clinical conditions associated with LOC255271. LOC51008 (Accession NM_015947) is another VGAM2508 host target gene. LOC51008 BINDING SITE is HOST TARGET binding site found in the 5' untranslated region of mRNA encoded by LOC51008, corresponding to a HOST TARGET binding site such as BINDING SITE I, BINDING SITE II or BINDING SITE III. Table 2 illustrates the complementarity of the nucleotide sequences of LOC51008 BINDING SITE, designated SEQ ID:18062, to the nucleotide sequence of VGAM2508 RNA, herein designated VGAM RNA, also designated SEQ ID:5219.

Another function of VGAM2508 is therefore inhibition of LOC51008 (Accession NM_015947). Accordingly, utilities of VGAM2508 include diagnosis, prevention and treatment of diseases and clinical conditions associated with LOC51008. LOC81569 (Accession XM_030465) is another VGAM2508 host target gene. LOC81569 BINDING SITE is HOST TARGET binding site found in the 5' untranslated region of mRNA encoded by LOC81569, corresponding to a HOST TARGET binding site such as BINDING SITE I, BINDING SITE II or BINDING SITE III. Table 2 illustrates the complementarity of the nucleotide sequences of LOC81569 BINDING SITE, designated SEQ ID:31046, to the nucleotide sequence of VGAM2508 RNA, herein designated VGAM RNA, also designated SEQ ID:5219.

Another function of VGAM2508 is therefore inhibition of LOC81569 (Accession XM_030465). Accordingly, utilities of VGAM2508 include diagnosis, prevention and treatment of diseases and clinical conditions associated with LOC81569. LOC89919 (Accession XM_027244) is another VGAM2508 host target gene. LOC89919 BINDING SITE is HOST TARGET binding site found in the 5' untranslated region of mRNA encoded by LOC89919, corresponding to a HOST TARGET binding site such as BINDING SITE I, BINDING SITE II or BINDING SITE III. Table 2 illustrates the complementarity of the nucleotide sequences of LOC89919 BINDING SITE, designated SEQ ID:30462, to the nucleotide sequence of VGAM2508 RNA, herein designated VGAM RNA, also designated SEQ ID:5219.

Another function of VGAM2508 is therefore inhibition of LOC89919 (Accession XM_027244). Accordingly, utilities of VGAM2508 include diagnosis, prevention and treatment of diseases and clinical conditions associated with LOC89919. LOC90019 (Accession NM_138567) is another VGAM2508 host target gene. LOC90019 BINDING SITE is HOST TARGET binding site found in the 3' untranslated region of mRNA encoded by LOC90019, corresponding to a HOST TARGET binding site such as BINDING SITE I, BINDING SITE II or BINDING SITE III. Table 2 illustrates the complementarity of the nucleotide sequences of LOC90019 BINDING SITE, designated SEQ ID:28873, to the nucleotide sequence of VGAM2508 RNA, herein designated VGAM RNA, also designated SEQ ID:5219.

Another function of VGAM2508 is therefore inhibition of LOC90019 (Accession NM_138567). Accordingly, utilities of VGAM2508 include diagnosis, prevention and treatment of diseases and clinical conditions associated with LOC90019. LOC90355 (Accession NM_033211) is another VGAM2508 host target gene. LOC90355 BINDING SITE is HOST TARGET binding site found in the 5' untranslated region of mRNA encoded by LOC90355, corresponding to a HOST TARGET binding site such as BINDING SITE I, BINDING SITE II or BINDING SITE III. Table 2 illustrates the complementarity of the nucleotide sequences of LOC90355 BINDING SITE, designated SEQ ID:27063, to the nucleotide sequence of VGAM2508 RNA, herein designated VGAM RNA, also designated SEQ ID:5219.

Another function of VGAM2508 is therefore inhibition of LOC90355 (Accession NM_033211). Accordingly, utilities of VGAM2508 include diagnosis, prevention and treatment of diseases and clinical conditions associated with LOC90355. LOC91252 (Accession XM_037173) is another VGAM2508 host target gene. LOC91252 BINDING SITE is HOST TARGET binding site found in the 3' untranslated region of mRNA encoded by LOC91252, corresponding to a HOST TARGET binding site such as BINDING SITE I, BINDING SITE II or BINDING SITE III. Table 2 illustrates the complementarity of the nucleotide sequences of LOC91252 BINDING SITE, designated SEQ ID:32554, to the nucleotide sequence of VGAM2508 RNA, herein designated VGAM RNA, also designated SEQ ID:5219.

Another function of VGAM2508 is therefore inhibition of LOC91252 (Accession XM_037173). Accordingly, utilities of VGAM2508 include diagnosis, prevention and treatment of diseases and clinical conditions associated with LOC91252. FIG. 1 further provides a conceptual description of a novel bioinformatically detected viral gene of the present invention, referred to here as Viral Genomic Address Messenger 2509 (VGAM2509) viral gene, which modulates expression of respective host target genes thereof, the function and utility of which host target genes is known in the art.

VGAM2509 is a novel bioinformatically detected regulatory, non protein coding, viral micro RNA (miRNA) gene. The method by which VGAM2509 was detected is described hereinabove with reference to FIGS. 1-8.

VGAM2509 gene, herein designated VGAM GENE, is a viral gene contained in the genome of Mouse Cytomegalovirus 1. VGAM2509 host target gene, herein designated VGAM HOST TARGET GENE, is a human gene contained in the human genome.

VGAM2509 gene encodes a VGAM2509 precursor RNA, herein designated VGAM PRECURSOR RNA. Similar to other miRNA genes, and unlike most ordinary genes, VGAM2509 precursor RNA does not encode a protein. A nucleotide sequence identical or highly similar to the nucleotide sequence of VGAM2509 precursor RNA is designated SEQ ID:2495, and is provided hereinbelow with reference to the sequence listing part. Nucleotide sequence SEQ ID:2495 is located at position 220001 relative to the genome of Mouse Cytomegalovirus 1.

VGAM2509 precursor RNA folds onto itself, forming VGAM2509 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2509 folded precursor RNA into VGAM2509 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2509 RNA is designated SEQ ID:5220, and is provided hereinbelow with reference to the sequence listing part.

VGAM2509 host target gene, herein designated VGAM HOST TARGET GENE, encodes a corresponding messenger RNA, VGAM2509 host target RNA, herein designated VGAM HOST TARGET RNA. VGAM2509 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2509 RNA, herein designated VGAM RNA, binds complementarily to one or more host target binding sites located in untranslated regions of VGAM2509 host target RNA, herein designated VGAM HOST TARGET RNA. This complementary binding is due to the fact that the nucleotide sequence of VGAM2509 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2509 RNA, herein designated VGAM RNA, may have a different number of host target binding sites in untranslated regions of a VGAM2509 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2509 RNA, herein designated VGAM RNA, to host target binding sites on VGAM2509 host target RNA, herein designated VGAM HOST TARGET RNA, such as BINDING SITE I, BINDING SITE II and BINDING SITE III, inhibits translation of VGAM2509 host target RNA into VGAM2509 host target protein, herein designated VGAM HOST TARGET PROTEIN. VGAM host target protein is therefore outlined by a broken line.

It is appreciated that VGAM2509 host target gene, herein designated VGAM HOST TARGET GENE, in fact represents a plurality of VGAM2509 host target genes. The mRNA of each one of this plurality of VGAM2509 host target genes comprises one or more host target binding sites, each having a nucleotide sequence which is at least partly complementary to VGAM2509 RNA, herein designated VGAM RNA, and which when bound by VGAM2509 RNA causes inhibition of translation of respective one or more VGAM2509 host target proteins.

It is further appreciated by one skilled in the art that the mode of translational inhibition illustrated by FIG. 1 with specific reference to translational inhibition exerted by VGAM2509 gene, herein designated VGAM GENE, on one or more VGAM2509 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2509 is inhibition of expression of host target genes, as part of a novel viral mechanism of attacking a host. Accordingly, utilities of VGAM2509 include diagnosis, prevention and treatment of viral infection by Mouse Cytomegalovirus 1. Specific functions, and accordingly utilities, of VGAM2509 correlate with, and may be deduced from, the identity of the host target genes which VGAM2509 binds and inhibits, and the function of these host target genes, as elaborated hereinbelow.

Nucleotide sequences of the VGAM2509 precursor RNA, herein designated VGAM PRECURSOR RNA, and of the 'diced' VGAM2509 RNA, herein designated VGAM RNA, and a schematic representation of the secondary folding of VGAM2509 folded precursor RNA, herein designated VGAM FOLDED PRECURSOR RNA, of VGAM2509 are further described hereinbelow with reference to Table 1.

Nucleotide sequences of host target binding sites, such as BINDING SITE-I, BINDING SITE-II and BINDING SITE-III of FIG. 1, found on VGAM2509 host target RNA, and schematic representation of the complementarity of each of these host target binding sites to VGAM2509 RNA, herein designated VGAM RNA, are described hereinbelow with reference to Table 2.

As mentioned hereinabove with reference to FIG. 1, a function of VGAM2509 gene, herein designated VGAM is inhibition of expression of VGAM2509 target genes. It is appreciated that specific functions, and accordingly utilities, of VGAM2509 correlate with, and may be deduced from, the identity of the target genes which VGAM2509 binds and inhibits, and the function of these target genes, as elaborated hereinbelow.

S-adenosylmethionine Decarboxylase 1 (AMD1, Accession NM_001634) is a VGAM2509 host target gene. AMD1 BINDING SITE is HOST TARGET binding site found in the 3' untranslated region of mRNA encoded by AMD1, corresponding to a HOST TARGET binding site such as BINDING SITE I, BINDING SITE II or BINDING SITE III. Table 2 illustrates the complementarity of the nucleotide sequences of AMD1 BINDING SITE, designated SEQ ID:7347, to the nucleotide sequence of VGAM2509 RNA, herein designated VGAM RNA, also designated SEQ ID:5220.

A function of VGAM2509 is therefore inhibition of S-adenosylmethionine Decarboxylase 1 (AMD1, Accession NM_001634), a gene which catalyzes the removal of the carboxylate group of S-adenosylmethionine in the polyamine biosynthesis pathway. Accordingly, utilities of VGAM2509 include diagnosis, prevention and treatment of diseases and clinical conditions associated with AMD1. The function of AMD1 and its association with various diseases and clinical conditions, has been established by previous studies, as described hereinabove with reference to VGAM1016. B-cell CLL/lymphoma 9 (BCL9, Accession NM_004326) is another VGAM2509 host target gene. BCL9 BINDING SITE is HOST TARGET binding site found in the 5' untranslated region of mRNA encoded by BCL9, corresponding to a HOST TARGET binding site such as BINDING SITE I, BINDING SITE II or BINDING SITE III. Table 2 illustrates the complementarity of the nucleotide sequences of BCL9 BINDING SITE, designated SEQ ID:10524, to the nucleotide sequence of VGAM2509 RNA, herein designated VGAM RNA, also designated SEQ ID:5220.

Another function of VGAM2509 is therefore inhibition of B-cell CLL/lymphoma 9 (BCL9, Accession NM_004326), a gene which recruits of PYGO to the nuclear beta-catenin-TCF complex in Wnt/Wingless signaling. Accordingly, utilities of VGAM2509 include diagnosis, prevention and treatment of diseases and clinical conditions associated with BCL9. The function of BCL9 and its association with various diseases and clinical conditions, has been established by previous studies, as described hereinabove with reference to VGAM74. Carbonic Anhydrase III, Muscle Specific (CA3, Accession NM_005181) is another VGAM2509 host target gene. CA3 BINDING SITE is HOST TARGET binding site found in the 3' untranslated region of mRNA encoded by CA3, corresponding to a HOST TARGET binding site such as BINDING SITE I, BINDING SITE II or BINDING SITE III. Table 2 illustrates the complementarity of the nucleotide sequences of CA3 BINDING SITE, designated SEQ ID:11681, to the nucleotide sequence of VGAM2509 RNA, herein designated VGAM RNA, also designated SEQ ID:5220.

Another function of VGAM2509 is therefore inhibition of Carbonic Anhydrase III, Muscle Specific (CA3, Accession NM_005181), a gene which has a muscle-specific function of reversible hydratation of carbon dioxide. Accordingly, utilities of VGAM2509 include diagnosis, prevention and treatment of diseases and clinical conditions associated with CA3. The function of CA3 and its association with various diseases and clinical conditions, has been established by previous studies, as described hereinabove with reference to VGAM1911. Capping Protein (actin filament) Muscle Z-line, Alpha 1 (CAPZA1, Accession XM_052116) is another VGAM2509 host target gene. CAPZA1 BINDING SITE is HOST TARGET binding site found in the 3' untranslated region of mRNA encoded by CAPZA1, corresponding to a HOST TARGET binding site such as BINDING SITE I, BINDING SITE II or BINDING SITE III. Table 2 illustrates the complementarity of the nucleotide sequences of CAPZA1 BINDING SITE, designated SEQ ID:35950, to the nucleotide sequence of VGAM2509 RNA, herein designated VGAM RNA, also designated SEQ ID:5220.

Another function of VGAM2509 is therefore inhibition of Capping Protein (actin filament) Muscle Z-line, Alpha 1 (CAPZA1, Accession XM_052116), a gene which is alpha 1 subunit of actin filament capping protein; binds actin, has roles in cell motility and actin assembly. Accordingly, utilities of VGAM2509 include diagnosis, prevention and treatment of diseases and clinical conditions associated with CAPZA1. The function of CAPZA1 and its association with various diseases and clinical conditions, has been established by previous studies, as described hereinabove with reference to VGAM547. Caspase Recruitment Domain Family, Member 15 (CARD15, Accession NM_022162) is another VGAM2509 host target gene. CARD15 BINDING SITE is HOST TARGET binding site found in the 3' untranslated region of mRNA encoded by CARD15, corresponding to a HOST TARGET binding site such as BINDING SITE I, BINDING SITE II or BINDING SITE III. Table 2 illustrates the complementarity of the nucleotide sequences of CARD15 BINDING SITE, designated SEQ ID:22718, to the nucleotide sequence of VGAM2509 RNA, herein designated VGAM RNA, also designated SEQ ID:5220.

Another function of VGAM2509 is therefore inhibition of Caspase Recruitment Domain Family, Member 15 (CARD15, Accession NM_022162), a gene which serves as an intracellular receptor for bacterial products in monocytes and transduces signals leading to NFKB activation. Accordingly, utilities of VGAM2509 include diagnosis, prevention and treatment of diseases and clinical conditions associated with CARD15. The function of CARD15 and its association with various diseases and clinical conditions, has been established by previous studies, as described hereinabove with reference to VGAM126. Chemokine (C-C motif) Receptor 2 (CCR2, Accession NM_000647) is another VGAM2509 host target gene. CCR2 BINDING SITE is HOST TARGET binding site found in the 3' untranslated region of mRNA encoded by CCR2, corresponding to a HOST TARGET binding site such as BINDING SITE I, BINDING SITE II or BINDING SITE III. Table 2 illustrates the complementarity of the nucleotide sequences of CCR2 BINDING SITE, designated SEQ ID:6309, to the nucleotide sequence of VGAM2509 RNA, herein designated VGAM RNA, also designated SEQ ID:5220.

Another function of VGAM2509 is therefore inhibition of Chemokine (C-C motif) Receptor 2 (CCR2, Accession NM_000647), a gene which binds chemokines and transduces a signal by increasing the intracellular calcium ions level. Accordingly, utilities of VGAM2509 include diagnosis, prevention and treatment of diseases and clinical conditions associated with CCR2. The function of CCR2 and its association with various diseases and clinical conditions, has been established by previous studies, as described hereinabove with reference to VGAM206. Cytochrome P450, Subfamily XXIV (vitamin D 24-hydroxylase) (CYP24, Accession NM_000782) is another VGAM2509 host target gene. CYP24 BINDING SITE is HOST TARGET binding site found in the 5' untranslated region of mRNA encoded by CYP24, corresponding to a HOST TARGET binding site such as BINDING SITE I, BINDING SITE II or BINDING SITE III. Table 2 illustrates the complementarity of the nucleotide sequences of CYP24 BINDING SITE, designated SEQ ID:6425, to the nucleotide sequence of VGAM2509 RNA, herein designated VGAM RNA, also designated SEQ ID:5220.

Another function of VGAM2509 is therefore inhibition of Cytochrome P450, Subfamily XXIV (vitamin D 24-hydroxylase) (CYP24, Accession NM_000782), a gene which induces the differentiation of promyelocytes into monocytes/macrophages. Accordingly, utilities of VGAM2509 include diagnosis, prevention and treatment of diseases and clinical conditions associated with CYP24. The function of CYP24 and its association with various diseases and clinical conditions, has been established by previous studies, as described hereinabove with reference to VGAM1204. Desmoglein 1 (DSG1, Accession NM_001942) is another VGAM2509 host target gene. DSG1 BINDING SITE is HOST TARGET binding site found in the 3' untranslated region of mRNA encoded by DSG1, corresponding to a HOST TARGET binding site such as BINDING SITE I, BINDING SITE II or BINDING SITE III. Table 2 illustrates the complementarity of the nucleotide sequences of DSG1 BINDING SITE, designated SEQ ID:7657, to the nucleotide sequence of VGAM2509 RNA, herein designated VGAM RNA, also designated SEQ ID:5220.

Another function of VGAM2509 is therefore inhibition of Desmoglein 1 (DSG1, Accession NM_001942). Accordingly, utilities of VGAM2509 include diagnosis, prevention and treatment of diseases and clinical conditions associated with DSG1. Ets Homologous Factor (EHF, Accession NM_012153) is another VGAM2509 host target gene. EHF BINDING SITE is HOST TARGET binding site found in the 3' untranslated region of mRNA encoded by EHF, corresponding to a HOST TARGET binding site such as BINDING SITE I, BINDING SITE II or BINDING SITE III. Table 2 illustrates the complementarity of the nucleotide sequences of EHF BINDING SITE, designated SEQ ID:14452, to the nucleotide sequence of VGAM2509 RNA, herein designated VGAM RNA, also designated SEQ ID:5220.

Another function of VGAM2509 is therefore inhibition of Ets Homologous Factor (EHF, Accession NM_012153), a gene which is Member of the ESE subfamily of Ets transcription factors. Accordingly, utilities of VGAM2509 include diagnosis, prevention and treatment of diseases and clinical conditions associated with EHF. The function of EHF and its association with various diseases and clinical conditions, has been established by previous studies, as described hereinabove with reference to VGAM855. Integrin, Beta 1 (fibronectin receptor, beta polypeptide, antigen CD29 includes MDF2, MSK12) (ITGB1, Accession NM_033666) is another VGAM2509 host target gene. ITGB1 BINDING SITE is HOST TARGET binding site found in the 3' untranslated region of mRNA encoded by ITGB1, corresponding to a HOST TARGET binding site such as BINDING SITE I, BINDING SITE II or BINDING SITE III. Table 2 illustrates the complementarity of the nucleotide sequences of ITGB1 BINDING SITE, designated SEQ ID:27395, to the nucleotide sequence of VGAM2509 RNA, herein designated VGAM RNA, also designated SEQ ID:5220.

Another function of VGAM2509 is therefore inhibition of Integrin, Beta 1 (fibronectin receptor, beta polypeptide, antigen CD29 includes MDF2, MSK12) (ITGB1, Accession NM_033666), a gene which acts as a fibronectin receptor. Accordingly, utilities of VGAM2509 include diagnosis, prevention and treatment of diseases and clinical conditions associated with ITGB1. The function of ITGB1 and its association with various diseases and clinical conditions, has been established by previous studies, as described hereinabove with reference to VGAM427. Meningioma Expressed Antigen 5 (hyaluronidase) (MGEA5, Accession NM_012215) is another VGAM2509 host target gene. MGEA5 BINDING SITE is HOST TARGET binding site found in the 5' untranslated region of mRNA encoded by MGEA5, corresponding to a HOST TARGET binding site such as BINDING SITE I, BINDING SITE II or BINDING SITE III. Table 2 illustrates the complementarity of the nucleotide sequences of MGEA5 BINDING SITE, designated SEQ ID:14519, to the nucleotide sequence of VGAM2509 RNA, herein designated VGAM RNA, also designated SEQ ID:5220.

Another function of VGAM2509 is therefore inhibition of Meningioma Expressed Antigen 5 (hyaluronidase) (MGEA5, Accession NM_012215), a gene which has a hyaluronidase activity. Accordingly, utilities of VGAM2509 include diagnosis, prevention and treatment of diseases and clinical conditions associated with MGEA5. The function of MGEA5 and its association with various diseases and clinical conditions, has been established by previous studies, as described hereinabove with reference to VGAM801. Mature T-cell Proliferation 1 (MTCP1, Accession NM_014221) is another VGAM2509 host target gene. MTCP1 BINDING SITE is HOST TARGET binding site found in the 5' untranslated region of mRNA encoded by MTCP1, corresponding to a HOST TARGET binding site such as BINDING SITE I, BINDING SITE II or BINDING SITE III. Table 2 illustrates the complementarity of the nucleotide sequences of MTCP1 BINDING SITE, designated SEQ ID:15490, to the nucleotide sequence of VGAM2509 RNA, herein designated VGAM RNA, also designated SEQ ID:5220.

Another function of VGAM2509 is therefore inhibition of Mature T-cell Proliferation 1 (MTCP1, Accession NM_014221). Accordingly, utilities of VGAM2509 include diagnosis, prevention and treatment of diseases and clinical conditions associated with MTCP1. poly (A) Binding Protein, Nuclear 1 (PABPN1, Accession NM_004643) is another VGAM2509 host target gene. PABPN1 BINDING SITE is HOST TARGET binding site found in the 5' untranslated region of mRNA encoded by PABPN1, corresponding to a HOST TARGET binding site such as BINDING SITE I, BINDING SITE II or BINDING SITE III. Table 2 illustrates the complementarity of the nucleotide sequences of PABPN1 BINDING SITE, designated SEQ ID:11019, to the nucleotide sequence of VGAM2509 RNA, herein designated VGAM RNA, also designated SEQ ID:5220.

Another function of VGAM2509 is therefore inhibition of poly (A) Binding Protein, Nuclear 1 (PABPN1, Accession NM_004643), a gene which binds to Poly (A). Accordingly, utilities of VGAM2509 include diagnosis, prevention and treatment of diseases and clinical conditions associated with PABPN1. The function of PABPN1 and its association with various diseases and clinical conditions, has been established by previous studies, as described hereinabove with reference to VGAM1968. Proteasome (prosome, macropain) Activator Subunit 3 (PA28 gamma; Ki) (PSME3, Accession NM_005789) is another VGAM2509 host target gene. PSME3 BINDING SITE is HOST TARGET binding site found in the 5' untranslated region of mRNA encoded by PSME3, corresponding to a HOST TARGET binding site such as BINDING SITE I, BINDING SITE II or BINDING SITE III. Table 2 illustrates the complementarity of the nucleotide sequences of PSME3 BINDING SITE, designated SEQ ID:12373, to the nucleotide sequence of VGAM2509 RNA, herein designated VGAM RNA, also designated SEQ ID:5220.

Another function of VGAM2509 is therefore inhibition of Proteasome (prosome, macropain) Activator Subunit 3 (PA28 gamma; Ki) (PSME3, Accession NM_005789), a gene which is the activator subunit of the proteasome (prosome macropain). Accordingly, utilities of VGAM2509 include diagnosis, prevention and treatment of diseases and clinical conditions associated with PSME3. The function of PSME3 and its association with various diseases and clinical conditions, has been established by previous studies, as described hereinabove with reference to VGAM1498. Spastic Paraplegia 3A (autosomal dominant) (SPG3A, Accession NM_015915) is another VGAM2509 host target gene. SPG3A BINDING SITE is HOST TARGET binding site found in the 3' untranslated region of mRNA encoded by SPG3A, corresponding to a HOST TARGET binding site such as BINDING SITE I, BINDING SITE II or BINDING SITE III. Table 2 illustrates the complementarity of the nucleotide sequences of SPG3A BINDING SITE, designated SEQ ID:18047, to the nucleotide sequence of VGAM2509 RNA, herein designated VGAM RNA, also designated SEQ ID:5220.

Another function of VGAM2509 is therefore inhibition of Spastic Paraplegia 3A (autosomal dominant) (SPG3A, Accession NM_015915). Accordingly, utilities of VGAM2509 include diagnosis, prevention and treatment of diseases and clinical conditions associated with SPG3A. Structure Specific Recognition Protein 1 (SSRP1, Accession NM_003146) is another VGAM2509 host target gene. SSRP1 BINDING SITE is HOST TARGET binding site found in the 5' untranslated region of mRNA encoded by SSRP1, corresponding to a HOST TARGET binding site such as BINDING SITE I, BINDING SITE II or BINDING SITE III. Table 2 illustrates the complementarity of the nucleotide sequences of SSRP1 BINDING SITE, designated SEQ ID:9116, to the nucleotide sequence of VGAM2509 RNA, herein designated VGAM RNA, also designated SEQ ID:5220.

Another function of VGAM2509 is therefore inhibition of Structure Specific Recognition Protein 1 (SSRP1, Accession NM_003146), a gene which has specific affinity for DNA modified with cisplatin and has a region of homology to HMG-box DNA binding proteins. Accordingly, utilities of VGAM2509 include diagnosis, prevention and treatment of diseases and clinical conditions associated with SSRP1. The function of SSRP1 has been established by previous studies. Members of the high mobility group (HMG) protein family (see OMIM Ref. No. HMG1, 163905) recognize specific DNA structures. By expression screening of a human B cell cDNA library, Bruhn et al. (1992) isolated cDNAs encoding a structure-specific recognition protein, SSRP1, that binds specifically to DNA structurally modified by the antitumor drug cisplatin. The SSRP1 cDNA predicts a 709-amino acid protein with M(r) 81,068. The protein has a high percentage (36%) of charged residues grouped into several highly charged domains. SSRP1 has an HMG box located between amino acids 539-614. The SSRP1 protein shows homology to HMG1 and HMG2 (OMIM Ref. No. 163906) proteins from several species and to a transcription factor, UBF (OMIM Ref. No. 600673), which also has an HMG-box domain. Northern blot analysis identified a 2.8-kb transcript in all tissues examined. Northern blot analysis of mRNA from testicular and bladder cancer cell lines showed no correlation between SSRP1 mRNA levels and antitumor activity of cisplatin for these tissues. SSRP1 mRNA was not inducible by cisplatin in HeLa cells. Transcription of naked DNA in eukaryotic cells minimally requires the general transcription factors (see OMIM Ref. No. GTF2E1; 189962) and RNA polymerase II (see OMIM Ref. No. POLR2A; 180660). This minimal set of factors is not sufficient for transcription by RNA polymerase II in vivo, where DNA is packaged into chromatin by histone octamers (see OMIM Ref. No. 142711). One set of accessory factors involved in chromatin remodeling is the SWI/SNF complex (see OMIM Ref. No. SMARCC1; 601732). By sequential chromatography, Orphanides et al. (1998) purified FACT (facilitates chromatin remodeling), an accessory factor required for transcript elongation after chromatin remodeling, from HeLa cell nuclear extracts. After the initiation of transcription, FACT acts to release RNA polymerase II from a nucleosome-induced block to allow productive transcription. SDS-PAGE and chromatographic analyses showed that FACT activity is present in an approximately 230-kD protein composed of 140 -kD (FACTP140, or SPT16; 605012) and 80-kD (FACTp80) subunits.

Full details of the abovementioned studies are described in the following publications, the disclosure of which are hereby incorporated by reference:

Bruhn, S. L.; Pil, P. M.; Essigmann, J. M.; Housman, D. E.; Lippard, S. J.: Isolation and characterization of human cDNA clones encoding a high mobility group box protein that recognizes structural distortions to DNA caused by binding of the anticancer agent cisplatin. Proc. Nat. Acad. Sci. 89:2307-2311, 1992; and Orphanides, G.; LeRoy, G.; Chang, C.-H.; Luse, D. S.; Reinberg, D.: FACT, a factor that facilitates transcript elongation through nucleosomes. Cell 92:105-116, 1998.

Further studies establishing the function and utilities of SSRP1 are found in John Hopkins OMIM database record ID 604328, and in sited publications numbered 7468, 1035 and 7469 listed in the bibliography section hereinbelow, which are also hereby incorporated by reference. T-box 3 (ulnar mammary syndrome) (TBX3, Accession NM_016569) is another VGAM2509 host target gene. TBX3 BINDING SITE is HOST TARGET binding site found in the 3' untranslated region of mRNA encoded by TBX3, corresponding to a HOST TARGET binding site such as BINDING SITE I, BINDING SITE II or BINDING SITE III. Table 2 illustrates the complementarity of the nucleotide sequences of TBX3 BINDING SITE, designated SEQ ID:18641, to the nucleotide sequence of VGAM2509 RNA, herein designated VGAM RNA, also designated SEQ ID:5220.

Another function of VGAM2509 is therefore inhibition of T-box 3 (ulnar mammary syndrome) (TBX3, Accession NM_016569). Accordingly, utilities of VGAM2509 include diagnosis, prevention and treatment of diseases and clinical conditions associated with TBX3. Tumor Necrosis Factor Receptor Superfamily, Member 1B (TNFRSF1B, Accession NM_001066) is another VGAM2509 host target gene. TNFRSF1B BINDING SITE is HOST TARGET binding site found in the 3' untranslated region of mRNA encoded by TNFRSF1B, corresponding to a HOST TARGET binding site such as BINDING SITE I, BINDING SITE II or BINDING SITE III. Table 2 illustrates the complementarity of the nucleotide sequences of TNFRSF1B BINDING SITE, designated SEQ ID:6735, to the nucleotide sequence of VGAM2509 RNA, herein designated VGAM RNA, also designated SEQ ID:5220.

Another function of VGAM2509 is therefore inhibition of Tumor Necrosis Factor Receptor Superfamily, Member 1B (TNFRSF1B, Accession NM_001066), a gene which mediates proinflammatory cellular responses. Accordingly, utilities of VGAM2509 include diagnosis, prevention and treatment of diseases and clinical conditions associated with TNFRSF1B. The function of TNFRSF1B and its association with various diseases and clinical conditions, has been established by previous studies, as described hereinabove with reference to VGAM939. Tripartite Motif-containing 37 (TRIM37, Accession NM_015294) is another VGAM2509 host target gene. TRIM37 BINDING SITE is HOST TARGET binding site found in the 3' untranslated region of mRNA encoded by TRIM37, corresponding to a HOST TARGET binding site such as BINDING SITE I, BINDING SITE II or BINDING SITE III. Table 2 illustrates the complementarity of the nucleotide sequences of TRIM37 BINDING SITE, designated SEQ ID:17617, to the nucleotide sequence of VGAM2509 RNA, herein designated VGAM RNA, also designated SEQ ID:5220.

Another function of VGAM2509 is therefore inhibition of Tripartite Motif-containing 37 (TRIM37, Accession NM_015294). Accordingly, utilities of VGAM2509 include diagnosis, prevention and treatment of diseases and clinical conditions associated with TRIM37. TSLP (Accession NM_138551) is another VGAM2509 host target gene. TSLP BINDING SITE is HOST TARGET binding site found in the 5' untranslated region of mRNA encoded by TSLP, corresponding to a HOST TARGET binding site such as BINDING SITE I, BINDING SITE II or BINDING SITE III. Table 2 illustrates the complementarity of the nucleotide sequences of TSLP BINDING SITE, designated SEQ ID:28850, to the nucleotide sequence of VGAM2509 RNA, herein designated VGAM RNA, also designated SEQ ID:5220.

Another function of VGAM2509 is therefore inhibition of TSLP (Accession NM_138551), a gene which may contribute directly to the activation of Langerhans cells and inhibit apoptosis. Accordingly, utilities of VGAM2509 include diagnosis, prevention and treatment of diseases and clinical conditions associated with TSLP. The function of TSLP and its association with various diseases and clinical conditions, has been established by previous studies, as described hereinabove with reference to VGAM558. Adaptor-related Protein Complex 4, Mu 1 Subunit (AP4M1, Accession NM_004722) is another VGAM2509 host target gene. AP4M1 BINDING SITE is HOST TARGET binding site found in the 5' untranslated region of mRNA encoded by AP4M1, corresponding to a HOST TARGET binding site such as BINDING SITE I, BINDING SITE II or BINDING SITE III. Table 2 illustrates the complementarity of the nucleotide sequences of AP4M1 BINDING SITE, designated SEQ ID:11088, to the nucleotide sequence of VGAM2509 RNA, herein designated VGAM RNA, also designated SEQ ID:5220.

Another function of VGAM2509 is therefore inhibition of Adaptor-related Protein Complex 4, Mu 1 Subunit (AP4M1, Accession NM_004722). Accordingly, utilities of VGAM2509 include diagnosis, prevention and treatment of diseases and clinical conditions associated with AP4M1. ATPase, (Na+)/K+ Transporting, Beta 4 Polypeptide (ATP1B4, Accession NM_012069) is another VGAM2509 host target gene. ATP1B4 BINDING SITE is HOST TARGET binding site found in the 3' untranslated region of mRNA encoded by ATP1B4, corresponding to a HOST TARGET binding site such as BINDING SITE I, BINDING SITE II or BINDING SITE III. Table 2 illustrates the complementarity of the nucleotide sequences of ATP1B4 BINDING SITE, designated SEQ ID:14328, to the nucleotide sequence of VGAM2509 RNA, herein designated VGAM RNA, also designated SEQ ID:5220.

Another function of VGAM2509 is therefore inhibition of ATPase, (Na+)/K+ Transporting, Beta 4 Polypeptide (ATP1B4, Accession NM_012069). Accordingly, utilities of VGAM2509 include diagnosis, prevention and treatment of diseases and clinical conditions associated with ATP1B4. Basic Helix-loop-helix Domain Containing, Class B, 2 (BHLHB2, Accession NM_003670) is another VGAM2509 host target gene. BHLHB2 BINDING SITE is HOST TARGET binding site found in the 3' untranslated region of mRNA encoded by BHLHB2, corresponding to a HOST TARGET binding site such as BINDING SITE I, BINDING SITE II or BINDING SITE III. Table 2 illustrates the complementarity of the nucleotide sequences of BHLHB2 BINDING SITE, designated SEQ ID:9756, to the nucleotide sequence of VGAM2509 RNA, herein designated VGAM RNA, also designated SEQ ID:5220.

Another function of VGAM2509 is therefore inhibition of Basic Helix-loop-helix Domain Containing, Class B, 2 (BHLHB2, Accession NM_003670). Accordingly, utilities of VGAM2509 include diagnosis, prevention and treatment of diseases and clinical conditions associated with BHLHB2. Chromosome 7 Open Reading Frame 13 (C7orf13, Accession NM_032625) is another VGAM2509 host target gene. C7orf13 BINDING SITE is HOST TARGET binding site found in the 5' untranslated region of mRNA encoded by C7orf13, corresponding to a HOST TARGET binding site such as BINDING SITE I, BINDING SITE II or BINDING SITE III. Table 2 illustrates the complementarity of the nucleotide sequences of C7orf13 BINDING SITE, designated SEQ ID:26343, to the nucleotide sequence of VGAM2509 RNA, herein designated VGAM RNA, also designated SEQ ID:5220.

Another function of VGAM2509 is therefore inhibition of Chromosome 7 Open Reading Frame 13 (C7orf13, Accession NM_032625). Accordingly, utilities of VGAM2509 include diagnosis, prevention and treatment of diseases and clinical conditions associated with C7orf13. DCOHM (Accession NM_032151) is another VGAM2509 host target gene. DCOHM BINDING SITE is HOST TARGET binding site found in the 3' untranslated region of mRNA encoded by DCOHM, corresponding to a HOST TARGET binding site such as BINDING SITE I, BINDING SITE II or BINDING SITE III. Table 2 illustrates the complementarity of the nucleotide sequences of DCOHM BINDING SITE, designated SEQ ID:25847, to the nucleotide sequence of VGAM2509 RNA, herein designated VGAM RNA, also designated SEQ ID:5220.

Another function of VGAM2509 is therefore inhibition of DCOHM (Accession NM_032151). Accordingly, utilities of VGAM2509 include diagnosis, prevention and treatment of diseases and clinical conditions associated with DCOHM. DKFZp762A227 (Accession NM_014096) is another VGAM2509 host target gene. DKFZp762A227 BINDING SITE is HOST TARGET binding site found in the 5' untranslated region of mRNA encoded by DKFZp762A227, corresponding to a HOST TARGET binding site such as BINDING SITE I, BINDING SITE II or BINDING SITE III. Table 2 illustrates the complementarity of the nucleotide sequences of DKFZp762A227 BINDING SITE, designated SEQ ID:15321, to the nucleotide sequence of VGAM2509 RNA, herein designated VGAM RNA, also designated SEQ ID:5220.

Another function of VGAM2509 is therefore inhibition of DKFZp762A227 (Accession NM_014096). Accordingly, utilities of VGAM2509 include diagnosis, prevention and treatment of diseases and clinical conditions associated with DKFZp762A227. Cyclin D Binding Myb-like Transcription Factor 1 (DMTF1, Accession NM_021145) is another VGAM2509 host target gene. DMTF1 BINDING SITE is HOST TARGET binding site found in the 5' untranslated region of mRNA encoded by DMTF1, corresponding to a HOST TARGET binding site such as BINDING SITE I, BINDING SITE II or BINDING SITE III. Table 2 illustrates the complementarity of the nucleotide sequences of DMTF1 BINDING SITE, designated SEQ ID:22117, to the nucleotide sequence of VGAM2509 RNA, herein designated VGAM RNA, also designated SEQ ID:5220.

Another function of VGAM2509 is therefore inhibition of Cyclin D Binding Myb-like Transcription Factor 1 (DMTF1, Accession NM_021145). Accordingly, utilities of VGAM2509 include diagnosis, prevention and treatment of diseases and clinical conditions associated with DMTF1. Extra Spindle Poles Like 1 (S. cerevisiae) (ESPL1, Accession NM_012291) is another VGAM2509 host target gene. ESPL1 BINDING SITE is HOST TARGET binding site found in the 5' untranslated region of mRNA encoded by ESPL1, corresponding to a HOST TARGET binding site such as BINDING SITE I, BINDING SITE II or BINDING SITE III. Table 2 illustrates the complementarity of the nucleotide sequences of ESPL1 BINDING SITE, designated SEQ ID:14631, to the nucleotide sequence of VGAM2509 RNA, herein designated VGAM RNA, also designated SEQ ID:5220.

Another function of VGAM2509 is therefore inhibition of Extra Spindle Poles Like 1 (S. cerevisiae) (ESPL1, Accession NM_012291). Accordingly, utilities of VGAM2509 include diagnosis, prevention and treatment of diseases and clinical conditions associated with ESPL1. FLJ00060 (Accession XM_028154) is another VGAM2509 host target gene. FLJ00060 BINDING SITE is HOST TARGET binding site found in the 3' untranslated region of mRNA encoded by FLJ00060, corresponding to a HOST TARGET binding site such as BINDING SITE I, BINDING SITE II or BINDING SITE III. Table 2 illustrates the complementarity of the nucleotide sequences of FLJ00060 BINDING SITE, designated SEQ ID:30630, to the nucleotide sequence of VGAM2509 RNA, herein designated VGAM RNA, also designated SEQ ID:5220.

Another function of VGAM2509 is therefore inhibition of FLJ00060 (Accession XM_028154). Accordingly, utilities of VGAM2509 include diagnosis, prevention and treatment of diseases and clinical conditions associated with FLJ00060. FLJ12484 (Accession XM_045681) is another VGAM2509 host target gene. FLJ12484 BINDING SITE1 and FLJ12484 BINDING SITE2 are HOST TARGET binding sites found in untranslated regions of mRNA encoded by FLJ12484, corresponding to HOST TARGET binding sites such as BINDING SITE I, BINDING SITE II or BINDING SITE III. Table 2 illustrates the complementarity of the nucleotide sequences of FLJ12484 BINDING SITE1 and FLJ12484 BINDING SITE2, designated SEQ ID:34517 and SEQ ID:23019 respectively, to the nucleotide sequence of VGAM2509 RNA, herein designated VGAM RNA, also designated SEQ ID:5220.

Another function of VGAM2509 is therefore inhibition of FLJ12484 (Accession XM_045681). Accordingly, utilities of VGAM2509 include diagnosis, prevention and treatment of diseases and clinical conditions associated with FLJ12484. FLJ12875 (Accession NM_024544) is another VGAM2509 host target gene. FLJ12875 BINDING SITE is HOST TARGET binding site found in the 3' untranslated region of mRNA encoded by FLJ12875, corresponding to a HOST TARGET binding site such as BINDING SITE I, BINDING SITE II or BINDING SITE III. Table 2 illustrates the complementarity of the nucleotide sequences of FLJ12875 BINDING SITE, designated SEQ ID:23756, to the nucleotide sequence of VGAM2509 RNA, herein designated VGAM RNA, also designated SEQ ID:5220.

Another function of VGAM2509 is therefore inhibition of FLJ12875 (Accession NM_024544). Accordingly, utilities of VGAM2509 include diagnosis, prevention and treatment of diseases and clinical conditions associated with FLJ12875. FLJ12975 (Accession XM_045522) is another VGAM2509 host target gene. FLJ12975 BINDING SITE is HOST TARGET binding site found in the 3' untranslated region of mRNA encoded by FLJ12975, corresponding to a HOST TARGET binding site such as BINDING SITE I, BINDING SITE II or BINDING SITE III. Table 2 illustrates the complementarity of the nucleotide sequences of FLJ12975 BINDING SITE, designated SEQ ID:34481, to the nucleotide sequence of VGAM2509 RNA, herein designated VGAM RNA, also designated SEQ ID:5220.

Another function of VGAM2509 is therefore inhibition of FLJ12975 (Accession XM_045522). Accordingly, utilities of VGAM2509 include diagnosis, prevention and treatment of diseases and clinical conditions associated with FLJ12975. FLJ13081 (Accession NM_024834) is another VGAM2509 host target gene. FLJ13081 BINDING SITE is HOST TARGET binding site found in the 3' untranslated region of mRNA encoded by FLJ13081, corresponding to a HOST TARGET binding site such as BINDING SITE I, BINDING SITE II or BINDING SITE III. Table 2 illustrates the complementarity of the nucleotide sequences of FLJ13081 BINDING SITE, designated SEQ ID:24237, to the nucleotide sequence of VGAM2509 RNA, herein designated VGAM RNA, also designated SEQ ID:5220.

Another function of VGAM2509 is therefore inhibition of FLJ13081 (Accession NM_024834). Accordingly, utilities of VGAM2509 include diagnosis, prevention and treatment of diseases and clinical conditions associated with FLJ13081. HHGP (Accession NM_020200) is another VGAM2509 host target gene. HHGP BINDING SITE is HOST TARGET binding site found in the 3' untranslated region of mRNA encoded by HHGP, corresponding to a HOST TARGET binding site such as BINDING SITE I, BINDING SITE II or BINDING SITE III. Table 2 illustrates the complementarity of the nucleotide sequences of HHGP BINDING SITE, designated SEQ ID:21435, to the nucleotide sequence of VGAM2509 RNA, herein designated VGAM RNA, also designated SEQ ID:5220.

Another function of VGAM2509 is therefore inhibition of HHGP (Accession NM_020200). Accordingly, utilities of VGAM2509 include diagnosis, prevention and treatment of diseases and clinical conditions associated with HHGP. KIAA1204 (Accession XM_045011) is another VGAM2509 host target gene. KIAA1204 BINDING SITE is HOST TARGET binding site found in the 5" untranslated region of mRNA encoded by KIAA1204, corresponding to a HOST TARGET binding site such as BINDING SITE I, BINDING SITE II or BINDING SITE III. Table 2 illustrates the complementarity of the nucleotide sequences of KIAA1204 BINDING SITE, designated SEQ ID:34317, to the nucleotide sequence of VGAM2509 RNA, herein designated VGAM RNA, also designated SEQ ID:5220.

Another function of VGAM2509 is therefore inhibition of KIAA1204 (Accession XM_045011). Accordingly, utilities of VGAM2509 include diagnosis, prevention and treatment of diseases and clinical conditions associated with KIAA1204. KIAA1463 (Accession XM_051160) is another VGAM2509 host target gene. KIAA1463 BINDING SITE is HOST TARGET binding site found in the 3' untranslated region of mRNA encoded by KIAA1463, corresponding to a HOST TARGET binding site such as BINDING SITE I, BINDING SITE II or BINDING SITE III. Table 2 illustrates the complementarity of the nucleotide sequences of KIAA1463 BINDING SITE, designated SEQ ID:35772, to the nucleotide sequence of VGAM2509 RNA, herein designated VGAM RNA, also designated SEQ ID:5220.

Another function of VGAM2509 is therefore inhibition of KIAA1463 (Accession XM_051160). Accordingly, utilities of VGAM2509 include diagnosis, prevention and treatment of diseases and clinical conditions associated with KIAA1463. KIAA1549 (Accession XM_045127) is another VGAM2509 host target gene. KIAA1549 BINDING SITE is HOST TARGET binding site found in the 3' untranslated region of mRNA encoded by KIAA1549, corresponding to a HOST TARGET binding site such as BINDING SITE I, BINDING SITE II or BINDING SITE III. Table 2 illustrates the complementarity of the nucleotide sequences of KIAA1549 BINDING SITE, designated SEQ ID:34371, to the nucleotide sequence of VGAM2509 RNA, herein designated VGAM RNA, also designated SEQ ID:5220.

Another function of VGAM2509 is therefore inhibition of KIAA1549 (Accession XM_045127). Accordingly, utilities of VGAM2509 include diagnosis, prevention and treatment of diseases and clinical conditions associated with KIAA1549. KIAA1576 (Accession XM_038186) is another VGAM2509 host target gene. KIAA1576 BINDING SITE is HOST TARGET binding site found in the 3' untranslated region of mRNA encoded by KIAA1576, corresponding to a HOST TARGET binding site such as BINDING SITE I, BINDING SITE II or BINDING SITE III. Table 2 illustrates the complementarity of the nucleotide sequences of KIAA1576 BINDING SITE, designated SEQ ID:32776, to the nucleotide sequence of VGAM2509 RNA, herein designated VGAM RNA, also designated SEQ ID:5220.

Another function of VGAM2509 is therefore inhibition of KIAA1576 (Accession XM_038186). Accordingly, utilities of VGAM2509 include diagnosis, prevention and treatment of diseases and clinical conditions associated with KIAA1576. KIAA1908 (Accession XM_055834) is another VGAM2509 host target gene. KIAA1908 BINDING SITE is HOST TARGET binding site found in the 3' untranslated region of mRNA encoded by KIAA1908, corresponding to a HOST TARGET binding site such as BINDING SITE I, BINDING SITE II or BINDING SITE III. Table 2 illustrates the complementarity of the nucleotide sequences of KIAA1908 BINDING SITE, designated SEQ ID:36341, to the nucleotide sequence of VGAM2509 RNA, herein designated VGAM RNA, also designated SEQ ID:5220.

Another function of VGAM2509 is therefore inhibition of KIAA1908 (Accession XM_055834). Accordingly, utilities of VGAM2509 include diagnosis, prevention and treatment of diseases and clinical conditions associated with KIAA1908. MGC22014 (Accession XM_035307) is another VGAM2509 host target gene. MGC22014 BINDING SITE is HOST TARGET binding site found in the 3' untranslated region of mRNA encoded by MGC22014, corresponding to a HOST TARGET binding site such as BINDING SITE I, BINDING SITE II or BINDING SITE III. Table 2 illustrates the complementarity of the nucleotide sequences of MGC22014 BINDING SITE, designated SEQ ID:32221, to the nucleotide sequence of VGAM2509 RNA, herein designated VGAM RNA, also designated SEQ ID:5220.

Another function of VGAM2509 is therefore inhibition of MGC22014 (Accession XM_035307). Accordingly, utilities of VGAM2509 include diagnosis, prevention and treatment of diseases and clinical conditions associated with MGC22014. MGC32043 (Accession NM_144582) is another VGAM2509 host target gene. MGC32043 BINDING SITE is HOST TARGET binding site found in the 3' untranslated region of mRNA encoded by MGC32043, corresponding to a HOST TARGET binding site such as BINDING SITE I, BINDING SITE II or BINDING SITE III. Table 2 illustrates the complementarity of the nucleotide sequences of MGC32043 BINDING SITE, designated SEQ ID:29393, to the nucleotide sequence of VGAM2509 RNA, herein designated VGAM RNA, also designated SEQ ID:5220.

Another function of VGAM2509 is therefore inhibition of MGC32043 (Accession NM_144582). Accordingly, utilities of VGAM2509 include diagnosis, prevention and treatment of diseases and clinical conditions associated with MGC32043. Neuronal Pentraxin Receptor (NPTXR, Accession NM_058178) is another VGAM2509 host target gene. NPTXR BINDING SITE1 and NPTXR BINDING SITE2 are HOST TARGET binding sites found in untranslated regions of mRNA encoded by NPTXR, corresponding to HOST TARGET binding sites such as BINDING SITE I, BINDING SITE II or BINDING SITE III. Table 2 illustrates the complementarity of the nucleotide sequences of NPTXR BINDING SITE1 and NPTXR BINDING SITE2, designated SEQ ID:27735 and SEQ ID:15587 respectively, to the nucleotide sequence of VGAM2509 RNA, herein designated VGAM RNA, also designated SEQ ID:5220.

Another function of VGAM2509 is therefore inhibition of Neuronal Pentraxin Receptor (NPTXR, Accession NM_058178). Accordingly, utilities of VGAM2509 include diagnosis, prevention and treatment of diseases and clinical conditions associated with NPTXR. Smith-Magenis Syndrome Chromosome Region, Candidate 8 (SMCR8, Accession NM_144775) is another VGAM2509 host target gene. SMCR8 BINDING SITE is HOST TARGET binding site found in the 5' untranslated region of mRNA encoded by SMCR8, corresponding to a HOST TARGET binding site such as BINDING SITE I, BINDING SITE II or BINDING SITE III. Table 2 illustrates the complementarity of the nucleotide sequences of SMCR8 BINDING SITE, designated SEQ ID:29567, to the nucleotide sequence of VGAM2509 RNA, herein designated VGAM RNA, also designated SEQ ID:5220.

Another function of VGAM2509 is therefore inhibition of Smith-Magenis Syndrome Chromosome Region, Candidate 8 (SMCR8, Accession NM_144775). Accordingly, utilities of VGAM2509 include diagnosis, prevention and treatment of diseases and clinical conditions associated with SMCR8. LOC126302 (Accession XM_059020) is another VGAM2509 host target gene. LOC126302 BINDING SITE is HOST TARGET binding site found in the 5' untranslated region of mRNA encoded by LOC126302, corresponding to a HOST TARGET binding site such as BINDING SITE I, BINDING SITE II or BINDING SITE III. Table 2 illustrates the complementarity of the nucleotide sequences of LOC126302 BINDING SITE, designated SEQ ID:36827, to the nucleotide sequence of VGAM2509 RNA, herein designated VGAM RNA, also designated SEQ ID:5220.

Another function of VGAM2509 is therefore inhibition of LOC126302 (Accession XM_059020). Accordingly, utilities of VGAM2509 include diagnosis, prevention and treatment of diseases and clinical conditions associated with LOC126302. LOC126353 (Accession XM_059034) is another VGAM2509 host target gene. LOC126353 BINDING SITE is HOST TARGET binding site found in the 3' untranslated region of mRNA encoded by LOC126353, corresponding to a HOST TARGET binding site such as BINDING SITE I, BINDING SITE II or BINDING SITE III. Table 2 illustrates the complementarity of the nucleotide sequences of LOC126353 BINDING SITE, designated SEQ ID:36831, to the nucleotide sequence of VGAM2509 RNA, herein designated VGAM RNA, also designated SEQ ID:5220.

Another function of VGAM2509 is therefore inhibition of LOC126353 (Accession XM_059034). Accordingly, utilities of VGAM2509 include diagnosis, prevention and treatment of diseases and clinical conditions associated with LOC126353. LOC130535 (Accession XM_072244) is another VGAM2509 host target gene. LOC130535 BINDING SITE is HOST TARGET binding site found in the 3' untranslated region of mRNA encoded by LOC130535, corresponding to a HOST TARGET binding site such as BINDING SITE I, BINDING SITE II or BINDING SITE III. Table 2 illustrates the complementarity of the nucleotide sequences of LOC130535 BINDING SITE, designated SEQ ID:37477, to the nucleotide sequence of VGAM2509 RNA, herein designated VGAM RNA, also designated SEQ ID:5220.

Another function of VGAM2509 is therefore inhibition of LOC130535 (Accession XM_072244). Accordingly, utilities of VGAM2509 include diagnosis, prevention and treatment of diseases and clinical conditions associated with LOC130535. LOC144363 (Accession XM_084843) is another VGAM2509 host target gene. LOC144363 BINDING SITE is HOST TARGET binding site found in the 5' untranslated region of mRNA encoded by LOC144363, corresponding to a HOST TARGET binding site such as BINDING SITE I, BINDING SITE II or BINDING SITE III. Table 2 illustrates the complementarity of the nucleotide sequences of LOC144363 BINDING SITE, designated SEQ ID:37730, to the nucleotide sequence of VGAM2509 RNA, herein designated VGAM RNA, also designated SEQ ID:5220.

Another function of VGAM2509 is therefore inhibition of LOC144363 (Accession XM_084843). Accordingly, utilities of VGAM2509 include diagnosis, prevention and treatment of diseases and clinical conditions associated with LOC144363. LOC146229 (Accession XM_085387) is another VGAM2509 host target gene. LOC146229 BIND- ING SITE is HOST TARGET binding site found in the 3' untranslated region of mRNA encoded by LOC146229, corresponding to a HOST TARGET binding site such as BINDING SITE I, BINDING SITE II or BINDING SITE III. Table 2 illustrates the complementarity of the nucleotide sequences of LOC146229 BINDING SITE, designated SEQ ID:38113, to the nucleotide sequence of VGAM2509 RNA, herein designated VGAM RNA, also designated SEQ ID:5220.

Another function of VGAM2509 is therefore inhibition of LOC146229 (Accession XM_085387). Accordingly, utilities of VGAM2509 include diagnosis, prevention and treatment of diseases and clinical conditions associated with LOC146229. LOC147976 (Accession XM_085980) is another VGAM2509 host target gene. LOC147976 BINDING SITE is HOST TARGET binding site found in the 3' untranslated region of mRNA encoded by LOC147976, corresponding to a HOST TARGET binding site such as BINDING SITE I, BINDING SITE II or BINDING SITE III. Table 2 illustrates the complementarity of the nucleotide sequences of LOC147976 BINDING SITE, designated SEQ ID:38430, to the nucleotide sequence of VGAM2509 RNA, herein designated VGAM RNA, also designated SEQ ID:5220.

Another function of VGAM2509 is therefore inhibition of LOC147976 (Accession XM_085980). Accordingly, utilities of VGAM2509 include diagnosis, prevention and treatment of diseases and clinical conditions associated with LOC147976. LOC150095 (Accession XM_097805) is another VGAM2509 host target gene. LOC150095 BINDING SITE is HOST TARGET binding site found in the 5' untranslated region of mRNA encoded by LOC150095, corresponding to a HOST TARGET binding site such as BINDING SITE I, BINDING SITE II or BINDING SITE III. Table 2 illustrates the complementarity of the nucleotide sequences of LOC150095 BINDING SITE, designated SEQ ID:41132, to the nucleotide sequence of VGAM2509 RNA, herein designated VGAM RNA, also designated SEQ ID:5220.

Another function of VGAM2509 is therefore inhibition of LOC150095 (Accession XM_097805). Accordingly, utilities of VGAM2509 include diagnosis, prevention and treatment of diseases and clinical conditions associated with LOC150095. LOC157753 (Accession XM_088381) is another VGAM2509 host target gene. LOC157753 BINDING SITE is HOST TARGET binding site found in the 3' untranslated region of mRNA encoded by LOC157753, corresponding to a HOST TARGET binding site such as BINDING SITE I, BINDING SITE II or BINDING SITE III. Table 2 illustrates the complementarity of the nucleotide sequences of LOC157753 BINDING SITE, designated SEQ ID:39663, to the nucleotide sequence of VGAM2509 RNA, herein designated VGAM RNA, also designated SEQ ID:5220.

Another function of VGAM2509 is therefore inhibition of LOC157753 (Accession XM_088381). Accordingly, utilities of VGAM2509 include diagnosis, prevention and treatment of diseases and clinical conditions associated with LOC157753. LOC157858 (Accession XM_098833) is another VGAM2509 host target gene. LOC157858 BINDING SITE is HOST TARGET binding site found in the 5' untranslated region of mRNA encoded by LOC157858, corresponding to a HOST TARGET binding site such as BINDING SITE I, BINDING SITE II or BINDING SITE III. Table 2 illustrates the complementarity of the nucleotide sequences of LOC157858 BINDING SITE, designated SEQ ID:41870, to the nucleotide sequence of VGAM2509 RNA, herein designated VGAM RNA, also designated SEQ ID:5220.

Another function of VGAM2509 is therefore inhibition of LOC157858 (Accession XM_098833). Accordingly, utilities of VGAM2509 include diagnosis, prevention and treatment of diseases and clinical conditions associated with LOC157858. LOC163882 (Accession XM_089211) is another VGAM2509 host target gene. LOC163882 BINDING SITE is HOST TARGET binding site found in the 3' untranslated region of mRNA encoded by LOC163882, corresponding to a HOST TARGET binding site such as BINDING SITE I, BINDING SITE II or BINDING SITE III. Table 2 illustrates the complementarity of the nucleotide sequences of LOC163882 BINDING SITE, designated SEQ ID:39974, to the nucleotide sequence of VGAM2509 RNA, herein designated VGAM RNA, also designated SEQ ID:5220.

Another function of VGAM2509 is therefore inhibition of LOC163882 (Accession XM_089211). Accordingly, utilities of VGAM2509 include diagnosis, prevention and treatment of diseases and clinical conditions associated with LOC163882. LOC196205 (Accession XM_113676) is another VGAM2509 host target gene. LOC196205 BINDING SITE is HOST TARGET binding site found in the 3' untranslated region of mRNA encoded by LOC196205, corresponding to a HOST TARGET binding site such as BINDING SITE I, BINDING SITE II or BINDING SITE III. Table 2 illustrates the complementarity of the nucleotide sequences of LOC196205 BINDING SITE, designated SEQ ID:42326, to the nucleotide sequence of VGAM2509 RNA, herein designated VGAM RNA, also designated SEQ ID:5220.

Another function of VGAM2509 is therefore inhibition of LOC196205 (Accession XM_113676). Accordingly, utilities of VGAM2509 include diagnosis, prevention and treatment of diseases and clinical conditions associated with LOC196205. LOC200339 (Accession XM_117226) is another VGAM2509 host target gene. LOC200339 BINDING SITE is HOST TARGET binding site found in the 3' untranslated region of mRNA encoded by LOC200339, corresponding to a HOST TARGET binding site such as BINDING SITE I, BINDING SITE II or BINDING SITE III. Table 2 illustrates the complementarity of the nucleotide sequences of LOC200339 BINDING SITE, designated SEQ ID:43300, to the nucleotide sequence of VGAM2509 RNA, herein designated VGAM RNA, also designated SEQ ID:5220.

Another function of VGAM2509 is therefore inhibition of LOC200339 (Accession XM_117226). Accordingly, utilities of VGAM2509 include diagnosis, prevention and treatment of diseases and clinical conditions associated with LOC200339. LOC201245 (Accession XM_113326) is another VGAM2509 host target gene. LOC201245 BINDING SITE is HOST TARGET binding site found in the 5' untranslated region of mRNA encoded by LOC201245, corresponding to a HOST TARGET binding site such as BINDING SITE I, BINDING SITE II or BINDING SITE III. Table 2 illustrates the complementarity of the nucleotide sequences of LOC201245 BINDING SITE, designated SEQ ID:42231, to the nucleotide sequence of VGAM2509 RNA, herein designated VGAM RNA, also designated SEQ ID:5220.

Another function of VGAM2509 is therefore inhibition of LOC201245 (Accession XM_113326). Accordingly, utilities of VGAM2509 include diagnosis, prevention and treatment of diseases and clinical conditions associated with LOC201245. LOC202934 (Accession XM_117486) is another VGAM2509 host target gene. LOC202934 BINDING SITE is HOST TARGET binding site found in the 3' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43465, to the nucleotide sequence of VGAM2509 RNA, herein designated VGAM RNA, also designated SEQ ID:5220.

Another function of VGAM2509 is therefore inhibition of LOC202934 (Accession XM_117486). Accordingly, utilities of VGAM2509 include diagnosis, prevention and treatment of diseases and clinical conditions associated with LOC202934. LOC255465 (Accession XM_173206) is another VGAM2509 host target gene. LOC255465 BINDING SITE is HOST TARGET binding site found in the 3' untranslated region of mRNA encoded by LOC255465, corresponding to a HOST TARGET binding site such as BINDING SITE I, BINDING SITE II or BINDING SITE III. Table 2 illustrates the complementarity of the nucleotide sequences of LOC255465 BINDING SITE, designated SEQ ID:46457, to the nucleotide sequence of VGAM2509 RNA, herein designated VGAM RNA, also designated SEQ ID:5220.

Another function of VGAM2509 is therefore inhibition of LOC255465 (Accession XM_173206). Accordingly, utilities of VGAM2509 include diagnosis, prevention and treatment of diseases and clinical conditions associated with LOC255465. FIG. 1 further provides a conceptual description of a novel bioinformatically detected viral gene of the present invention, referred to here as Viral Genomic Address Messenger 2510 (VGAM2510) viral gene, which modulates expression of respective host target genes thereof, the function and utility of which host target genes is known in the art.

VGAM2510 is a novel bioinformatically detected regulatory, non protein coding, viral micro RNA (miRNA) gene. The method by which VGAM2510 was detected is described hereinabove with reference to FIGS. 1-8.

VGAM2510 gene, herein designated VGAM GENE, is a viral gene contained in the genome of Mouse Cytomegalovirus 1. VGAM2510 host target gene, herein designated VGAM HOST TARGET GENE, is a human gene contained in the human genome.

VGAM2510 gene encodes a VGAM2510 precursor RNA, herein designated VGAM PRECURSOR RNA. Similar to other miRNA genes, and unlike most ordinary genes, VGAM2510 precursor RNA does not encode a protein. A nucleotide sequence identical or highly similar to the nucleotide sequence of VGAM2510 precursor RNA is designated SEQ ID:2496, and is provided hereinbelow with reference to the sequence listing part. Nucleotide sequence SEQ ID:2496 is located at position 226893 relative to the genome of Mouse Cytomegalovirus 1.

VGAM2510 precursor RNA folds onto itself, forming VGAM2510 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2510 folded precursor RNA into VGAM2510 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2510 RNA is designated SEQ ID:5221, and is provided hereinbelow with reference to the sequence listing part.

VGAM2510 host target gene, herein designated VGAM HOST TARGET GENE, encodes a corresponding messenger RNA, VGAM2510 host target RNA, herein designated VGAM HOST TARGET RNA. VGAM2510 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2510 RNA, herein designated VGAM RNA, binds complementarily to one or more host target binding sites located in untranslated regions of VGAM2510 host target RNA, herein designated VGAM HOST TARGET RNA. This complementary binding is due to the fact that the nucleotide sequence of VGAM2510 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2510 RNA, herein designated VGAM RNA, may have a different number of host target binding sites in untranslated regions of a VGAM2510 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2510 RNA, herein designated VGAM RNA, to host target binding sites on VGAM2510 host target RNA, herein designated VGAM HOST TARGET RNA, such as BINDING SITE I, BINDING SITE II and BINDING SITE III, inhibits translation of VGAM2510 host target RNA into VGAM2510 host target protein, herein designated VGAM HOST TARGET PROTEIN. VGAM host target protein is therefore outlined by a broken line.

It is appreciated that VGAM2510 host target gene, herein designated VGAM HOST TARGET GENE, in fact represents a plurality of VGAM2510 host target genes. The mRNA of each one of this plurality of VGAM2510 host target genes comprises one or more host target binding sites, each having a nucleotide sequence which is at least partly complementary to VGAM2510 RNA, herein designated VGAM RNA, and which when bound by VGAM2510 RNA causes inhibition of translation of respective one or more VGAM2510 host target proteins.

It is further appreciated by one skilled in the art that the mode of translational inhibition illustrated by FIG. 1 with specific reference to translational inhibition exerted by VGAM2510 gene, herein designated VGAM GENE, on one or more VGAM2510 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2510 is inhibition of expression of host target genes, as part of a novel viral mechanism of attacking a host. Accordingly, utilities of VGAM2510 include diagnosis, prevention and treatment of viral infection by Mouse Cytomegalovirus 1. Specific functions, and accordingly utilities, of VGAM2510 correlate with, and may be deduced from, the identity of the host target genes which VGAM2510 binds and inhibits, and the function of these host target genes, as elaborated hereinbelow.

Nucleotide sequences of the VGAM2510 precursor RNA, herein designated VGAM PRECURSOR RNA, and of the 'diced' VGAM2510 RNA, herein designated VGAM RNA, and a schematic representation of the secondary folding of VGAM2510 folded precursor RNA, herein designated VGAM FOLDED PRECURSOR RNA, of VGAM2510 are further described hereinbelow with reference to Table 1.

Nucleotide sequences of host target binding sites, such as BINDING SITE-I, BINDING SITE-II and BINDING SITE-III of FIG. 1, found on VGAM2510 host target RNA, and schematic representation of the complementarity of each of these host target binding sites to VGAM2510 RNA, herein designated VGAM RNA, are described hereinbelow with reference to Table 2.

As mentioned hereinabove with reference to FIG. 1, a function of VGAM2510 gene, herein designated VGAM is inhibition of expression of VGAM2510 target genes. It is appreciated that specific functions, and accordingly utilities, of VGAM2510 correlate with, and may be deduced from, the identity of the target genes which VGAM2510 binds and inhibits, and the function of these target genes, as elaborated hereinbelow.

Ephrin-B1 (EFNB1, Accession NM_004429) is a VGAM2510 host target gene. EFNB1 BINDING SITE is HOST TARGET binding site found in the 5' untranslated region of mRNA encoded by EFNB1, corresponding to a HOST TARGET binding site such as BINDING SITE I, BINDING SITE II or BINDING SITE III. Table 2 illustrates the complementarity of the nucleotide sequences of EFNB1 BINDING SITE, designated SEQ ID:10704, to the nucleotide sequence of VGAM2510 RNA, herein designated VGAM RNA, also designated SEQ ID:5221.

A function of VGAM2510 is therefore inhibition of Ephrin-B1 (EFNB1, Accession NM_004429), a gene which is a transmembrane ligand of Eph-related receptor tyrosine kinases, has a role in cell adhesion. Accordingly, utilities of VGAM2510 include diagnosis, prevention and treatment of diseases and clinical conditions associated with EFNB1. The function of EFNB1 and its association with various diseases and clinical conditions, has been established by previous studies, as described hereinabove with reference to VGAM390. Cleavage Stimulation Factor, 3' Pre-RNA, Subunit 1, 50 kDa (CSTF1, Accession NM_001324) is another VGAM2510 host target gene. CSTF1 BINDING SITE is HOST TARGET binding site found in the 5' untranslated region of mRNA encoded by CSTF1, corresponding to a HOST TARGET binding site such as BINDING SITE I, BINDING SITE II or BINDING SITE III. Table 2 illustrates the complementarity of the nucleotide sequences of CSTF1 BINDING SITE, designated SEQ ID:7008, to the nucleotide sequence of VGAM2510 RNA, herein designated VGAM RNA, also designated SEQ ID:5221.

Another function of VGAM2510 is therefore inhibition of Cleavage Stimulation Factor, 3' Pre-RNA, Subunit 1, 50 kDa (CSTF1, Accession NM_001324). Accordingly, utilities of VGAM2510 include diagnosis, prevention and treatment of diseases and clinical conditions associated with CSTF1. FLJ22794 (Accession XM_166220) is another VGAM2510 host target gene. FLJ22794 BINDING SITE is HOST TARGET binding site found in the 5' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44022, to the nucleotide sequence of VGAM2510 RNA, herein designated VGAM RNA, also designated SEQ ID:5221.

Another function of VGAM2510 is therefore inhibition of FLJ22794 (Accession XM_166220). Accordingly, utilities of VGAM2510 include diagnosis, prevention and treatment of diseases and clinical conditions associated with FLJ22794. KIAA1977 (Accession XM_058800) is another VGAM2510 host target gene. KIAA1977 BINDING SITE is HOST TARGET binding site found in the 5' untranslated region of mRNA encoded by KIAA1977, corresponding to a HOST TARGET binding site such as BINDING SITE I, BINDING SITE II or BINDING SITE III. Table 2 illustrates the complementarity of the nucleotide sequences of KIAA1977 BINDING SITE, designated SEQ ID:36744, to the nucleotide sequence of VGAM2510 RNA, herein designated VGAM RNA, also designated SEQ ID:5221.

Another function of VGAM2510 is therefore inhibition of KIAA1977 (Accession XM_058800). Accordingly, utilities of VGAM2510 include diagnosis, prevention and treatment of diseases and clinical conditions associated with KIAA1977. FIG. 1 further provides a conceptual description of a novel bioinformatically detected viral gene of the present invention, referred to here as Viral Genomic Address Messenger 2511 (VGAM2511) viral gene, which modulates expression of respective host target genes thereof, the function and utility of which host target genes is known in the art.

VGAM2511 is a novel bioinformatically detected regulatory, non protein coding, viral micro RNA (miRNA) gene. The method by which VGAM2511 was detected is described hereinabove with reference to FIGS. 1-8.

VGAM2511 gene, herein designated VGAM GENE, is a viral gene contained in the genome of Mouse Cytomegalovirus 1. VGAM2511 host target gene, herein designated VGAM HOST TARGET GENE, is a human gene contained in the human genome.

VGAM2511 gene encodes a VGAM2511 precursor RNA, herein designated VGAM PRECURSOR RNA. Similar to other miRNA genes, and unlike most ordinary genes, VGAM2511 precursor RNA does not encode a protein. A nucleotide sequence identical or highly similar to the nucleotide sequence of VGAM2511 precursor RNA is designated SEQ ID:2497, and is provided hereinbelow with reference to the sequence listing part. Nucleotide sequence SEQ ID:2497 is located at position 36653 relative to the genome of Mouse Cytomegalovirus 1.

VGAM2511 precursor RNA folds onto itself, forming VGAM2511 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2511 folded precursor RNA into VGAM2511 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2511 RNA is designated SEQ ID:5222, and is provided hereinbelow with reference to the sequence listing part.

VGAM2511 host target gene, herein designated VGAM HOST TARGET GENE, encodes a corresponding messenger RNA, VGAM2511 host target RNA, herein designated VGAM HOST TARGET RNA. VGAM2511 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2511 RNA, herein designated VGAM RNA, binds complementarily to one or more host target binding sites located in untranslated regions of VGAM2511 host target RNA, herein designated VGAM HOST TARGET RNA. This complementary binding is due to the fact that the nucleotide sequence of VGAM2511 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2511 RNA, herein designated VGAM RNA, may have a different number of host target binding sites in untranslated regions of a VGAM2511 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2511 RNA, herein designated VGAM RNA, to host target binding sites on VGAM2511 host target RNA, herein designated VGAM HOST TARGET RNA, such as BINDING SITE I, BINDING SITE II and BINDING SITE III, inhibits translation of VGAM2511 host target RNA into VGAM2511 host target protein, herein designated VGAM HOST TARGET PROTEIN. VGAM host target protein is therefore outlined by a broken line.

It is appreciated that VGAM2511 host target gene, herein designated VGAM HOST TARGET GENE, in fact represents a plurality of VGAM2511 host target genes. The mRNA of each one of this plurality of VGAM2511 host target genes comprises one or more host target binding sites, each having a nucleotide sequence which is at least partly complementary to VGAM2511 RNA, herein designated VGAM RNA, and which when bound by VGAM2511 RNA causes inhibition of translation of respective one or more VGAM2511 host target proteins.

It is further appreciated by one skilled in the art that the mode of translational inhibition illustrated by FIG. 1 with specific reference to translational inhibition exerted by VGAM2511 gene, herein designated VGAM GENE, on one or more VGAM2511 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2511 is inhibition of expression of host target genes, as part of a novel viral mechanism of attacking a host. Accordingly, utilities of VGAM2511 include diagnosis, prevention and treatment of viral infection by Mouse Cytomegalovirus 1. Specific functions, and accordingly utilities, of VGAM2511 correlate with, and may be deduced from, the identity of the host target genes which VGAM2511 binds and inhibits, and the function of these host target genes, as elaborated hereinbelow.

Nucleotide sequences of the VGAM2511 precursor RNA, herein designated VGAM PRECURSOR RNA, and of the 'diced' VGAM2511 RNA, herein designated VGAM RNA, and a schematic representation of the secondary folding of VGAM2511 folded precursor RNA, herein designated VGAM FOLDED PRECURSOR RNA, of VGAM2511 are further described hereinbelow with reference to Table 1.

Nucleotide sequences of host target binding sites, such as BINDING SITE-I, BINDING SITE-II and BINDING SITE-III of FIG. 1, found on VGAM2511 host target RNA, and schematic representation of the complementarity of each of these host target binding sites to VGAM2511 RNA, herein designated VGAM RNA, are described hereinbelow with reference to Table 2.

As mentioned hereinabove with reference to FIG. 1, a function of VGAM2511 gene, herein designated VGAM is inhibition of expression of VGAM2511 target genes. It is appreciated that specific functions, and accordingly utilities, of VGAM2511 correlate with, and may be deduced from, the identity of the target genes which VGAM2511 binds and inhibits, and the function of these target genes, as elaborated hereinbelow.

APACD (Accession NM_005783) is a VGAM2511 host target gene. APACD BINDING SITE is HOST TARGET binding site found in the 3' untranslated region of mRNA encoded by APACD, corresponding to a HOST TARGET binding site such as BINDING SITE I, BINDING SITE II or BINDING SITE III. Table 2 illustrates the complementarity of the nucleotide sequences of APACD BINDING SITE, designated SEQ ID:12363, to the nucleotide sequence of VGAM2511 RNA, herein designated VGAM RNA, also designated SEQ ID:5222.

A function of VGAM2511 is therefore inhibition of APACD (Accession NM_005783). Accordingly, utilities of VGAM2511 include diagnosis, prevention and treatment of diseases and clinical conditions associated with APACD. COP9 Constitutive Photomorphogenic Homolog Subunit 7A (Arabidopsis) (COPS7A, Accession NM_016319) is another VGAM2511 host target gene. COPS7A BINDING SITE is HOST TARGET binding site found in the 3' untranslated region of mRNA encoded by COPS7A, corresponding to a HOST TARGET binding site such as BINDING SITE I, BINDING SITE II or BINDING SITE III. Table 2 illustrates the complementarity of the nucleotide sequences of COPS7A BINDING SITE, designated SEQ ID:18437, to the nucleotide sequence of VGAM2511 RNA, herein designated VGAM RNA, also designated SEQ ID:5222.

Another function of VGAM2511 is therefore inhibition of COP9 Constitutive Photomorphogenic Homolog Subunit 7A (Arabidopsis) (COPS7A, Accession NM_016319). Accordingly, utilities of VGAM2511 include diagnosis, prevention and treatment of diseases and clinical conditions associated with COPS7A. FLJ10702 (Accession NM_018184) is another VGAM2511 host target gene. FLJ10702 BINDING SITE is HOST TARGET binding site found in the 3' untranslated region of mRNA encoded by FLJ10702, corresponding to a HOST TARGET binding site such as BINDING SITE I, BINDING SITE II or BINDING SITE III. Table 2 illustrates the complementarity of the nucleotide sequences of FLJ10702 BINDING SITE, designated SEQ ID:20028, to the nucleotide sequence of VGAM2511 RNA, herein designated VGAM RNA, also designated SEQ ID:5222.

Another function of VGAM2511 is therefore inhibition of FLJ10702 (Accession NM_018184). Accordingly, utilities of VGAM2511 include diagnosis, prevention and treatment of diseases and clinical conditions associated with FLJ10702. Sphingomyelin Phosphodiesterase 2, Neutral Membrane (neutral sphingomyelinase) (SMPD2, Accession NM_003080) is another VGAM2511 host target gene. SMPD2 BINDING SITE is HOST TARGET binding site found in the 5' untranslated region of mRNA encoded by SMPD2, corresponding to a HOST TARGET binding site such as BINDING SITE I, BINDING SITE II or BINDING SITE III. Table 2 illustrates the complementarity of the nucleotide sequences of SMPD2 BINDING SITE, designated SEQ ID:9053, to the nucleotide sequence of VGAM2511 RNA, herein designated VGAM RNA, also designated SEQ ID:5222.

Another function of VGAM2511 is therefore inhibition of Sphingomyelin Phosphodiesterase 2, Neutral Membrane (neutral sphingomyelinase) (SMPD2, Accession NM_003080). Accordingly, utilities of VGAM2511 include diagnosis, prevention and treatment of diseases and clinical conditions associated with SMPD2. LOC254251 (Accession XM_171088) is another VGAM2511 host target gene. LOC254251 BINDING SITE is HOST TARGET binding site found in the 3' untranslated region of mRNA encoded by LOC254251, corresponding to a HOST TARGET binding site such as BINDING SITE I, BINDING SITE II or BINDING SITE III. Table 2 illustrates the complementarity of the nucleotide sequences of LOC254251 BINDING SITE, designated SEQ ID:45898, to the nucleotide sequence of VGAM2511 RNA, herein designated VGAM RNA, also designated SEQ ID:5222.

Another function of VGAM2511 is therefore inhibition of LOC254251 (Accession XM_171088). Accordingly, utilities of VGAM2511 include diagnosis, prevention and treatment of diseases and clinical conditions associated with LOC254251. FIG. 1 further provides a conceptual description of a novel bioinformatically detected viral gene of the present invention, referred to here as Viral Genomic Address Messenger 2512 (VGAM2512) viral gene, which modulates expression of respective host target genes thereof, the function and utility of which host target genes is known in the art.

VGAM2512 is a novel bioinformatically detected regulatory, non protein coding, viral micro RNA (miRNA) gene. The method by which VGAM2512 was detected is described hereinabove with reference to FIGS. 1-8.

VGAM2512 gene, herein designated VGAM GENE, is a viral gene contained in the genome of Mouse Cytomegalovirus 1. VGAM2512 host target gene, herein designated VGAM HOST TARGET GENE, is a human gene contained in the human genome.

VGAM2512 gene encodes a VGAM2512 precursor RNA, herein designated VGAM PRECURSOR RNA. Similar to other miRNA genes, and unlike most ordinary genes, VGAM2512 precursor RNA does not encode a protein. A nucleotide sequence identical or highly similar to the nucleotide sequence of VGAM2512 precursor RNA is designated SEQ ID:2498, and is provided hereinbelow with reference to the sequence listing part. Nucleotide sequence SEQ ID:2498 is located at position 84643 relative to the genome of Mouse Cytomegalovirus 1.

VGAM2512 precursor RNA folds onto itself, forming VGAM2512 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2512 folded precursor RNA into VGAM2512 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2512 RNA is designated SEQ ID:5223, and is provided hereinbelow with reference to the sequence listing part.

VGAM2512 host target gene, herein designated VGAM HOST TARGET GENE, encodes a corresponding messenger RNA, VGAM2512 host target RNA, herein designated VGAM HOST TARGET RNA. VGAM2512 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2512 RNA, herein designated VGAM RNA, binds complementarily to one or more host target binding sites located in untranslated regions of VGAM2512 host target RNA, herein designated VGAM HOST TARGET RNA. This complementary binding is due to the fact that the nucleotide sequence of VGAM2512 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2512 RNA, herein designated VGAM RNA, may have a different number of host target binding sites in untranslated regions of a VGAM2512 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2512 RNA, herein designated VGAM RNA, to host target binding sites on VGAM2512 host target RNA, herein designated VGAM HOST TARGET RNA, such as BINDING SITE I, BINDING SITE II and BINDING SITE III, inhibits translation of VGAM2512 host target RNA into VGAM2512 host target protein, herein designated VGAM HOST TARGET PROTEIN. VGAM host target protein is therefore outlined by a broken line.

It is appreciated that VGAM2512 host target gene, herein designated VGAM HOST TARGET GENE, in fact represents a plurality of VGAM2512 host target genes. The mRNA of each one of this plurality of VGAM2512 host target genes comprises one or more host target binding sites, each having a nucleotide sequence which is at least partly complementary to VGAM2512 RNA, herein designated VGAM RNA, and which when bound by VGAM2512 RNA causes inhibition of translation of respective one or more VGAM2512 host target proteins.

It is further appreciated by one skilled in the art that the mode of translational inhibition illustrated by FIG. 1 with specific reference to translational inhibition exerted by VGAM2512 gene, herein designated VGAM GENE, on one or more VGAM2512 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2512 is inhibition of expression of host target genes, as part of a novel viral mechanism of attacking a host. Accordingly, utilities of VGAM2512 include diagnosis, prevention and treatment of viral infection by Mouse Cytomegalovirus 1. Specific functions, and accordingly utilities, of VGAM2512 correlate with, and may be deduced from, the identity of the host target genes which VGAM2512 binds and inhibits, and the function of these host target genes, as elaborated hereinbelow.

Nucleotide sequences of the VGAM2512 precursor RNA, herein designated VGAM PRECURSOR RNA, and of the 'diced' VGAM2512 RNA, herein designated VGAM RNA, and a schematic representation of the secondary folding of VGAM2512 folded precursor RNA, herein designated VGAM FOLDED PRECURSOR RNA, of VGAM2512 are further described hereinbelow with reference to Table 1.

Nucleotide sequences of host target binding sites, such as BINDING SITE-I, BINDING SITE-II and BINDING SITE-III of FIG. 1, found on VGAM2512 host target RNA, and schematic representation of the complementarity of each of these host target binding sites to VGAM2512 RNA, herein designated VGAM RNA, are described hereinbelow with reference to Table 2.

As mentioned hereinabove with reference to FIG. 1, a function of VGAM2512 gene, herein designated VGAM is inhibition of expression of VGAM2512 target genes. It is appreciated that specific functions, and accordingly utilities, of VGAM2512 correlate with, and may be deduced from, the identity of the target genes which VGAM2512 binds and inhibits, and the function of these target genes, as elaborated hereinbelow.

ATPase, Aminophospholipid Transporter-like, Class I, Type 8A, Member 2 (ATP8A2, Accession XM_167916) is a VGAM2512 host target gene. ATP8A2 BINDING SITE is HOST TARGET binding site found in the 3' untranslated region of mRNA encoded by ATP8A2, corresponding to a HOST TARGET binding site such as BINDING SITE I, BINDING SITE II or BINDING SITE III. Table 2 illustrates the complementarity of the nucleotide sequences of ATP8A2 BINDING SITE, designated SEQ ID:44914, to the nucleotide sequence of VGAM2512 RNA, herein designated VGAM RNA, also designated SEQ ID:5223.

A function of VGAM2512 is therefore inhibition of ATPase, Aminophospholipid Transporter-like, Class I, Type 8A, Member 2 (ATP8A2, Accession XM_167916). Accordingly, utilities of VGAM2512 include diagnosis, prevention and treatment of diseases and clinical conditions associated with ATP8A2. DMC1 Dosage Suppressor of Mck1 Homolog, Meiosis-specific Homologous Recombination (yeast) (DMC1, Accession NM_007068) is another VGAM2512 host target gene. DMC1 BINDING SITE is HOST TARGET binding site found in the 3' untranslated region of mRNA encoded by DMC1, corresponding to a HOST TARGET binding site such as BINDING SITE I, BINDING SITE II or BINDING SITE III. Table 2 illustrates the complementarity of the nucleotide sequences of DMC1 BINDING SITE, designated SEQ ID:13932, to the nucleotide sequence of VGAM2512 RNA, herein designated VGAM RNA, also designated SEQ ID:5223.

Another function of VGAM2512 is therefore inhibition of DMC1 Dosage Suppressor of Mck1 Homolog, Meiosis-specific Homologous Recombination (yeast) (DMC1, Accession NM_007068). Accordingly, utilities of VGAM2512 include diagnosis, prevention and treatment of diseases and clinical conditions associated with DMC1. Glutamate Receptor, Metabotropic 7 (GRM7, Accession NM_000844) is another VGAM2512 host target gene. GRM7 BINDING SITE is HOST TARGET binding site found in the 3' untranslated region of mRNA encoded by GRM7, corresponding to a HOST TARGET binding site such as BINDING SITE I, BINDING SITE II or BINDING SITE III. Table 2 illustrates the complementarity of the nucleotide sequences of GRM7 BINDING SITE, designated SEQ ID:6515, to the nucleotide sequence of VGAM2512 RNA, herein designated VGAM RNA, also designated SEQ ID:5223.

Another function of VGAM2512 is therefore inhibition of Glutamate Receptor, Metabotropic 7 (GRM7, Accession NM_000844), a gene which is mediated by a g-protein that inhibits adenylate cyclase activity. Accordingly, utilities of VGAM2512 include diagnosis, prevention and treatment of diseases and clinical conditions associated with GRM7. The function of GRM7 and its association with various diseases and clinical conditions, has been established by previous studies, as described hereinabove with reference to VGAM746. Potassium Inwardly-rectifying Channel, Subfamily J, Member 1 (KCNJ1, Accession NM_000220) is another VGAM2512 host target gene. KCNJ1 BINDING SITE is HOST TARGET binding site found in the 5' untranslated region of mRNA encoded by KCNJ1, corresponding to a HOST TARGET binding site such as BINDING SITE I, BINDING SITE II or BINDING SITE III. Table 2 illustrates the complementarity of the nucleotide sequences of KCNJ1 BINDING SITE, designated SEQ ID:5728, to the nucleotide sequence of VGAM2512 RNA, herein designated VGAM RNA, also designated SEQ ID:5223.

Another function of VGAM2512 is therefore inhibition of Potassium Inwardly-rectifying Channel, Subfamily J, Member 1 (KCNJ1, Accession NM_000220). Accordingly, utilities of VGAM2512 include diagnosis, prevention and treatment of diseases and clinical conditions associated with KCNJ1. Solute Carrier Family 11 (proton-coupled divalent metal ion transporters), Member 3 (SLC11A3, Accession NM_014585) is another VGAM2512 host target gene. SLC11A3 BINDING SITE is HOST TARGET binding site found in the 3' untranslated region of mRNA encoded by SLC11A3, corresponding to a HOST TARGET binding site such as BINDING SITE I, BINDING SITE II or BINDING SITE III. Table 2 illustrates the complementarity of the nucleotide sequences of SLC11A3 BINDING SITE, designated SEQ ID:15941, to the nucleotide sequence of VGAM2512 RNA, herein designated VGAM RNA, also designated SEQ ID:5223.

Another function of VGAM2512 is therefore inhibition of Solute Carrier Family 11 (proton-coupled divalent metal ion transporters), Member 3 (SLC11A3, Accession NM_014585). Accordingly, utilities of VGAM2512 include diagnosis, prevention and treatment of diseases and clinical conditions associated with SLC11A3. DKFZP586F1318 (Accession NM_015677) is another VGAM2512 host target gene. DKFZP586F1318 BINDING SITE is HOST TARGET binding site found in the 3' untranslated region of mRNA encoded by DKFZP586F1318, corresponding to a HOST TARGET binding site such as BINDING SITE I, BINDING SITE II or BINDING SITE III. Table 2 illustrates the complementarity of the nucleotide sequences of DKFZP586F1318 BINDING SITE, designated SEQ ID:17903, to the nucleotide sequence of VGAM2512 RNA, herein designated VGAM RNA, also designated SEQ ID:5223.

Another function of VGAM2512 is therefore inhibition of DKFZP586F1318 (Accession NM_015677). Accordingly, utilities of VGAM2512 include diagnosis, prevention and treatment of diseases and clinical conditions associated with DKFZP586F1318. DKFZp761N1114 (Accession XM_086327) is another VGAM2512 host target gene. DKFZp761N1114 BINDING SITE is HOST TARGET binding site found in the 3' untranslated region of mRNA encoded by DKFZp761N1114, corresponding to a HOST TARGET binding site such as BINDING SITE I, BINDING SITE II or BINDING SITE III. Table 2 illustrates the complementarity of the nucleotide sequences of DKFZp761N1114 BINDING SITE, designated SEQ ID:38607, to the nucleotide sequence of VGAM2512 RNA, herein designated VGAM RNA, also designated SEQ ID:5223.

Another function of VGAM2512 is therefore inhibition of DKFZp761N1114 (Accession XM_086327). Accordingly, utilities of VGAM2512 include diagnosis, prevention and treatment of diseases and clinical conditions associated with DKFZp761N1114. FLJ32784 (Accession NM_144623) is another VGAM2512 host target gene. FLJ32784 BINDING SITE is HOST TARGET binding site found in the 3' untranslated region of mRNA encoded by FLJ32784, corresponding to a HOST TARGET binding site such as BINDING SITE I, BINDING SITE II or BINDING SITE III. Table 2 illustrates the complementarity of the nucleotide sequences of FLJ32784 BINDING SITE, designated SEQ ID:29442, to the nucleotide sequence of VGAM2512 RNA, herein designated VGAM RNA, also designated SEQ ID:5223.

Another function of VGAM2512 is therefore inhibition of FLJ32784 (Accession NM_144623). Accordingly, utilities of VGAM2512 include diagnosis, prevention and treatment of diseases and clinical conditions associated with FLJ32784. INSM2 (Accession NM_032594) is another VGAM2512 host target gene. INSM2 BINDING SITE is HOST TARGET binding site found in the 3' untranslated region of mRNA encoded by INSM2, corresponding to a HOST TARGET binding site such as BINDING SITE I, BINDING SITE II or BINDING SITE III. Table 2 illustrates the complementarity of the nucleotide sequences of INSM2 BINDING SITE, designated SEQ ID:26327, to the nucleotide sequence of VGAM2512 RNA, herein designated VGAM RNA, also designated SEQ ID:5223.

Another function of VGAM2512 is therefore inhibition of INSM2 (Accession NM_032594). Accordingly, utilities of VGAM2512 include diagnosis, prevention and treatment of diseases and clinical conditions associated with INSM2. KIAA0332 (Accession XM_031553) is another VGAM2512 host target gene. KIAA0332 BINDING SITE is HOST TARGET binding site found in the 3' untranslated region of mRNA encoded by KIAA0332, corresponding to a HOST TARGET binding site such as BINDING SITE I, BINDING SITE II or BINDING SITE III. Table 2 illustrates the complementarity of the nucleotide sequences of KIAA0332 BINDING SITE, designated SEQ ID:31420, to the nucleotide sequence of VGAM2512 RNA, herein designated VGAM RNA, also designated SEQ ID:5223.

Another function of VGAM2512 is therefore inhibition of KIAA0332 (Accession XM_031553). Accordingly, utilities of VGAM2512 include diagnosis, prevention and treatment of diseases and clinical conditions associated with KIAA0332. KIAA0376 (Accession XM_037759) is another VGAM2512 host target gene. KIAA0376 BINDING SITE is HOST TARGET binding site found in the 3' untranslated region of mRNA encoded by KIAA0376, corresponding to a HOST TARGET binding site such as BINDING SITE I, BINDING SITE II or BINDING SITE III. Table 2 illustrates the complementarity of the nucleotide sequences of KIAA0376 BINDING SITE, designated SEQ ID:32671, to the nucleotide sequence of VGAM2512 RNA, herein designated VGAM RNA, also designated SEQ ID:5223.

Another function of VGAM2512 is therefore inhibition of KIAA0376 (Accession XM_037759). Accordingly, utilities of VGAM2512 include diagnosis, prevention and treatment of diseases and clinical conditions associated with KIAA0376. KIAA0788 (Accession XM_049108) is another VGAM2512 host target gene. KIAA0788 BINDING SITE is HOST TARGET binding site found in the 3' untranslated region of mRNA encoded by KIAA0788, corresponding to a HOST TARGET binding site such as BINDING SITE I, BINDING SITE II or BINDING SITE III. Table 2 illustrates the complementarity of the nucleotide sequences of KIAA0788 BINDING SITE, designated SEQ ID:35343, to the nucleotide sequence of VGAM2512 RNA, herein designated VGAM RNA, also designated SEQ ID:5223.

Another function of VGAM2512 is therefore inhibition of KIAA0788 (Accession XM_049108). Accordingly, utilities of VGAM2512 include diagnosis, prevention and treatment of diseases and clinical conditions associated with KIAA0788. Suppression of Tumorigenicity 7 Like (ST7L, Accession NM_138727) is another VGAM2512 host target gene. ST7L BINDING SITE1 through ST7L BINDING SITE3 are HOST TARGET binding sites found in untranslated regions of mRNA encoded by ST7L, corresponding to HOST TARGET binding sites such as BINDING SITE I, BINDING SITE II or BINDING SITE III. Table 2 illustrates the complementarity of the nucleotide sequences of ST7L BINDING SITE1 through ST7L BINDING SITE3, designated SEQ ID:28978, SEQ ID:29208 and SEQ ID:19336 respectively, to the nucleotide sequence of VGAM2512 RNA, herein designated VGAM RNA, also designated SEQ ID:5223.

Another function of VGAM2512 is therefore inhibition of Suppression of Tumorigenicity 7 Like (ST7L, Accession NM_138727). Accordingly, utilities of VGAM2512 include diagnosis, prevention and treatment of diseases and clinical conditions associated with ST7L. Serine/threonine Kinase 38 Like (STK38L, Accession XM_044823) is another VGAM2512 host target gene. STK38L BINDING SITE is HOST TARGET binding site found in the 3' untranslated region of mRNA encoded by STK38L, corresponding to a HOST TARGET binding site such as BINDING SITE I, BINDING SITE II or BINDING SITE III. Table 2 illustrates the complementarity of the nucleotide sequences of STK38L BINDING SITE, designated SEQ ID:34292, to the nucleotide sequence of VGAM2512 RNA, herein designated VGAM RNA, also designated SEQ ID:5223.

Another function of VGAM2512 is therefore inhibition of Serine/threonine Kinase 38 Like (STK38L, Accession XM_044823). Accordingly, utilities of VGAM2512 include diagnosis, prevention and treatment of diseases and clinical conditions associated with STK38L. Succinate-CoA Ligase, GDP-forming, Beta Subunit (SUCLG2, Accession XM_037772) is another VGAM2512 host target gene. SUCLG2 BINDING SITE is HOST TARGET binding site found in the 3' untranslated region of mRNA encoded by SUCLG2, corresponding to a HOST TARGET binding site such as BINDING SITE I, BINDING SITE II or BINDING SITE III. Table 2 illustrates the complementarity of the nucleotide sequences of SUCLG2 BINDING SITE, designated SEQ ID:32677, to the nucleotide sequence of VGAM2512 RNA, herein designated VGAM RNA, also designated SEQ ID:5223.

Another function of VGAM2512 is therefore inhibition of Succinate-CoA Ligase, GDP-forming, Beta Subunit (SUCLG2, Accession XM_037772). Accordingly, utilities of VGAM2512 include diagnosis, prevention and treatment of diseases and clinical conditions associated with SUCLG2. Tripartite Motif-containing 2 (TRIM2, Accession NM_015271) is another VGAM2512 host target gene. TRIM2 BINDING SITE is HOST TARGET binding site found in the 3' untranslated region of mRNA encoded by TRIM2, corresponding to a HOST TARGET binding site such as BINDING SITE I, BINDING SITE II or BINDING SITE III. Table 2 illustrates the complementarity of the nucleotide sequences of TRIM2 BINDING SITE, designated SEQ ID:17602, to the nucleotide sequence of VGAM2512 RNA, herein designated VGAM RNA, also designated SEQ ID:5223.

Another function of VGAM2512 is therefore inhibition of Tripartite Motif-containing 2 (TRIM2, Accession NM_015271). Accordingly, utilities of VGAM2512 include diagnosis, prevention and treatment of diseases and clinical conditions associated with TRIM2. LOC149506 (Accession XM_097661) is another VGAM2512 host target gene. LOC149506 BINDING SITE is HOST TARGET binding site found in the 3' untranslated region of mRNA encoded by LOC149506, corresponding to a HOST TARGET binding site such as BINDING SITE I, BINDING SITE II or BINDING SITE III. Table 2 illustrates the complementarity of the nucleotide sequences of LOC149506 BINDING SITE, designated SEQ ID:40999, to the nucleotide sequence of VGAM2512 RNA, herein designated VGAM RNA, also designated SEQ ID:5223.

Another function of VGAM2512 is therefore inhibition of LOC149506 (Accession XM_097661). Accordingly, utilities of VGAM2512 include diagnosis, prevention and treatment of diseases and clinical conditions associated with LOC149506. LOC153914 (Accession XM_087799) is another VGAM2512 host target gene. LOC153914 BINDING SITE1 and LOC153914 BINDING SITE2 are HOST TARGET binding sites found in untranslated regions of mRNA encoded by LOC153914, corresponding to HOST TARGET binding sites such as BINDING SITE I, BINDING SITE II or BINDING SITE III. Table 2 illustrates the complementarity of the nucleotide sequences of LOC153914 BINDING SITE1 and LOC153914 BINDING SITE2, designated SEQ ID:39437 and SEQ ID:39435 respectively, to the nucleotide sequence of VGAM2512 RNA, herein designated VGAM RNA, also designated SEQ ID:5223.

Another function of VGAM2512 is therefore inhibition of LOC153914 (Accession XM_087799). Accordingly, utilities of VGAM2512 include diagnosis, prevention and treatment of diseases and clinical conditions associated with LOC153914. LOC222031 (Accession XM_168371) is another VGAM2512 host target gene. LOC222031 BINDING SITE is HOST TARGET binding site found in the 3' untranslated region of mRNA encoded by LOC222031, corresponding to a HOST TARGET binding site such as BINDING SITE I, BINDING SITE II or BINDING SITE III. Table 2 illustrates the complementarity of the nucleotide sequences of LOC222031 BINDING SITE, designated SEQ ID:45129, to the nucleotide sequence of VGAM2512 RNA, herein designated VGAM RNA, also designated SEQ ID:5223.

Another function of VGAM2512 is therefore inhibition of LOC222031 (Accession XM_168371). Accordingly, utilities of VGAM2512 include diagnosis, prevention and treatment of diseases and clinical conditions associated with LOC222031. FIG. 1 further provides a conceptual description of a novel bioinformatically detected viral gene of the present invention, referred to here as Viral Genomic Address Messenger 2513 (VGAM2513) viral gene, which modulates expression of respective host target genes thereof, the function and utility of which host target genes is known in the art.

VGAM2513 is a novel bioinformatically detected regulatory, non protein coding, viral micro RNA (miRNA) gene. The method by which VGAM2513 was detected is described hereinabove with reference to FIGS. 1-8.

VGAM2513 gene, herein designated VGAM GENE, is a viral gene contained in the genome of Mouse Cytomegalovirus 1. VGAM2513 host target gene, herein designated VGAM HOST TARGET GENE, is a human gene contained in the human genome.

VGAM2513 gene encodes a VGAM2513 precursor RNA, herein designated VGAM PRECURSOR RNA. Similar to other miRNA genes, and unlike most ordinary genes, VGAM2513 precursor RNA does not encode a protein. A nucleotide sequence identical or highly similar to the nucleotide sequence of VGAM2513 precursor RNA is designated SEQ ID:2499, and is provided hereinbelow with reference to the sequence listing part. Nucleotide sequence SEQ ID:2499 is located at position 157900 relative to the genome of Mouse Cytomegalovirus 1.

VGAM2513 precursor RNA folds onto itself, forming VGAM2513 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2513 folded precursor RNA into VGAM2513 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2513 RNA is designated SEQ ID:5224, and is provided hereinbelow with reference to the sequence listing part.

VGAM2513 host target gene, herein designated VGAM HOST TARGET GENE, encodes a corresponding messenger RNA, VGAM2513 host target RNA, herein designated VGAM HOST TARGET RNA. VGAM2513 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2513 RNA, herein designated VGAM RNA, binds complementarily to one or more host target binding sites located in untranslated regions of VGAM2513 host target RNA, herein designated VGAM HOST TARGET RNA. This complementary binding is due to the fact that the nucleotide sequence of VGAM2513 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2513 RNA, herein designated VGAM RNA, may have a different number of host target binding sites in untranslated regions of a VGAM2513 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2513 RNA, herein designated VGAM RNA, to host target binding sites on VGAM2513 host target RNA, herein designated VGAM HOST TARGET RNA, such as BINDING SITE I, BINDING SITE II and BINDING SITE III, inhibits translation of VGAM2513 host target RNA into VGAM2513 host target protein, herein designated VGAM HOST TARGET PROTEIN. VGAM host target protein is therefore outlined by a broken line.

It is appreciated that VGAM2513 host target gene, herein designated VGAM HOST TARGET GENE, in fact represents a plurality of VGAM2513 host target genes. The mRNA of each one of this plurality of VGAM2513 host target genes comprises one or more host target binding sites, each having a nucleotide sequence which is at least partly complementary to VGAM2513 RNA, herein designated VGAM RNA, and which when bound by VGAM2513 RNA causes inhibition of translation of respective one or more VGAM2513 host target proteins.

It is further appreciated by one skilled in the art that the mode of translational inhibition illustrated by FIG. 1 with specific reference to translational inhibition exerted by VGAM2513 gene, herein designated VGAM GENE, on one or more VGAM2513 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2513 is inhibition of expression of host target genes, as part of a novel viral mechanism of attacking a host. Accordingly, utilities of VGAM2513 include diagnosis, prevention and treatment of viral infection by Mouse Cytomegalovirus 1. Specific functions, and accordingly utilities, of VGAM2513 correlate with, and may be deduced from, the identity of the host target genes which VGAM2513 binds and inhibits, and the function of these host target genes, as elaborated hereinbelow.

Nucleotide sequences of the VGAM2513 precursor RNA, herein designated VGAM PRECURSOR RNA, and of the 'diced' VGAM2513 RNA, herein designated VGAM RNA, and a schematic representation of the secondary folding of VGAM2513 folded precursor RNA, herein designated VGAM FOLDED PRECURSOR RNA, of VGAM2513 are further described hereinbelow with reference to Table 1.

Nucleotide sequences of host target binding sites, such as BINDING SITE-I, BINDING SITE-II and BINDING SITE-III of FIG. 1, found on VGAM2513 host target RNA, and schematic representation of the complementarity of each of these host target binding sites to VGAM2513 RNA, herein designated VGAM RNA, are described hereinbelow with reference to Table 2.

As mentioned hereinabove with reference to FIG. 1, a function of VGAM2513 gene, herein designated VGAM is inhibition of expression of VGAM2513 target genes. It is appreciated that specific functions, and accordingly utilities, of VGAM2513 correlate with, and may be deduced from, the identity of the target genes which VGAM2513 binds and inhibits, and the function of these target genes, as elaborated hereinbelow.

Stromal Interaction Molecule 1 (STIM1, Accession XM_011967) is a VGAM2513 host target gene. STIM1 BINDING SITE is HOST TARGET binding site found in the 3' untranslated region of mRNA encoded by STIM1, corresponding to a HOST TARGET binding site such as BINDING SITE I, BINDING SITE II or BINDING SITE III. Table 2 illustrates the complementarity of the nucleotide sequences of STIM1 BINDING SITE, designated SEQ ID:30202, to the nucleotide sequence of VGAM2513 RNA, herein designated VGAM RNA, also designated SEQ ID:5224.

A function of VGAM2513 is therefore inhibition of Stromal Interaction Molecule 1 (STIM1, Accession XM_011967), a gene which is very strongly similar to murine Stim1 and may be a transmembrane stromal cell protein. Accordingly, utilities of VGAM2513 include diagnosis, prevention and treatment of diseases and clinical conditions associated with STIM1. The function of STIM1 and its association with various diseases and clinical conditions, has been established by previous studies, as described hereinabove with reference to VGAM1191. CAT56 (Accession NM_025263) is another VGAM2513 host target gene. CAT56 BINDING SITE is HOST TARGET binding site found in the 3' untranslated region of mRNA encoded by CAT56, corresponding to a HOST TARGET binding site such as BINDING SITE I, BINDING SITE II or BINDING SITE III. Table 2 illustrates the complementarity of the nucleotide sequences of CAT56 BINDING SITE, designated SEQ ID:24930, to the nucleotide sequence of VGAM2513 RNA, herein designated VGAM RNA, also designated SEQ ID:5224.

Another function of VGAM2513 is therefore inhibition of CAT56 (Accession NM_025263). Accordingly, utilities of VGAM2513 include diagnosis, prevention and treatment of diseases and clinical conditions associated with CAT56. FLJ23598 (Accession NM_024783) is another VGAM2513 host target gene. FLJ23598 BINDING SITE is HOST TARGET binding site found in the 5' untranslated region of mRNA encoded by FLJ23598, corresponding to a HOST TARGET binding site such as BINDING SITE I, BINDING SITE II or BINDING SITE III. Table 2 illustrates the complementarity of the nucleotide sequences of FLJ23598 BINDING SITE, designated SEQ ID:24155, to the nucleotide sequence of VGAM2513 RNA, herein designated VGAM RNA, also designated SEQ ID:5224.

Another function of VGAM2513 is therefore inhibition of FLJ23598 (Accession NM_024783). Accordingly, utilities of VGAM2513 include diagnosis, prevention and treatment of diseases and clinical conditions associated with FLJ23598. FLJ32332 (Accession NM_144641) is another VGAM2513 host target gene. FLJ32332 BINDING SITE is HOST TARGET binding site found in the 3' untranslated region of mRNA encoded by FLJ32332, corresponding to a HOST TARGET binding site such as BINDING SITE I, BINDING SITE II or BINDING SITE III. Table 2 illustrates the complementarity of the nucleotide sequences of FLJ32332 BINDING SITE, designated SEQ ID:29469, to the nucleotide sequence of VGAM2513 RNA, herein designated VGAM RNA, also designated SEQ ID:5224.

Another function of VGAM2513 is therefore inhibition of FLJ32332 (Accession NM_144641). Accordingly, utilities of VGAM2513 include diagnosis, prevention and treatment of diseases and clinical conditions associated with FLJ32332. KIAA0022 (Accession NM_014880) is another VGAM2513 host target gene. KIAA0022 BINDING SITE is HOST TARGET binding site found in the 3' untranslated region of mRNA encoded by KIAA0022, corresponding to a HOST TARGET binding site such as BINDING SITE I, BINDING SITE II or BINDING SITE III. Table 2 illustrates the complementarity of the nucleotide sequences of KIAA0022 BINDING SITE, designated SEQ ID:17029, to the nucleotide sequence of VGAM2513 RNA, herein designated VGAM RNA, also designated SEQ ID:5224.

Another function of VGAM2513 is therefore inhibition of KIAA0022 (Accession NM_014880). Accordingly, utilities of VGAM2513 include diagnosis, prevention and treatment of diseases and clinical conditions associated with KIAA0022. KIAA1211 (Accession XM_044178) is another VGAM2513 host target gene. KIAA1211 BINDING SITE is HOST TARGET binding site found in the 3' untranslated region of mRNA encoded by KIAA1211, corresponding to a HOST TARGET binding site such as BINDING SITE I, BINDING SITE II or BINDING SITE III. Table 2 illustrates the complementarity of the nucleotide sequences of KIAA1211 BINDING SITE, designated SEQ ID:34162, to the nucleotide sequence of VGAM2513 RNA, herein designated VGAM RNA, also designated SEQ ID:5224.

Another function of VGAM2513 is therefore inhibition of KIAA1211 (Accession XM_044178). Accordingly, utilities of VGAM2513 include diagnosis, prevention and treatment of diseases and clinical conditions associated with KIAA1211. KIAA1522 (Accession XM_036299) is another VGAM2513 host target gene. KIAA1522 BINDING SITE is HOST TARGET binding site found in the 3' untranslated region of mRNA encoded by KIAA1522, corresponding to a HOST TARGET binding site such as BINDING SITE I, BINDING SITE II or BINDING SITE III. Table 2 illustrates the complementarity of the nucleotide sequences of KIAA1522 BINDING SITE, designated SEQ ID:32414, to the nucleotide sequence of VGAM2513 RNA, herein designated VGAM RNA, also designated SEQ ID:5224.

Another function of VGAM2513 is therefore inhibition of KIAA1522 (Accession XM_036299). Accordingly, utilities of VGAM2513 include diagnosis, prevention and treatment of diseases and clinical conditions associated with KIAA1522. KIAA1866 (Accession XM_027658) is another VGAM2513 host target gene. KIAA1866 BINDING SITE is HOST TARGET binding site found in the 3' untranslated region of mRNA encoded by KIAA1866, corresponding to a HOST TARGET binding site such as BINDING SITE I, BINDING SITE II or BINDING SITE III. Table 2 illustrates the complementarity of the nucleotide sequences of KIAA1866 BINDING SITE, designated SEQ ID:30552, to the nucleotide sequence of VGAM2513 RNA, herein designated VGAM RNA, also designated SEQ ID:5224.

Another function of VGAM2513 is therefore inhibition of KIAA1866 (Accession XM_027658). Accordingly, utilities of VGAM2513 include diagnosis, prevention and treatment of diseases and clinical conditions associated with KIAA1866. Purinergic Receptor P2X, Ligand-gated Ion Channel, 1 (P2RX1, Accession XM_040635) is another VGAM2513 host target gene. P2RX1 BINDING SITE is HOST TARGET binding site found in the 3' untranslated region of mRNA encoded by P2RX1, corresponding to a HOST TARGET binding site such as BINDING SITE I, BINDING SITE II or BINDING SITE III. Table 2 illustrates the complementarity of the nucleotide sequences of P2RX1 BINDING SITE, designated SEQ ID:33350, to the nucleotide sequence of VGAM2513 RNA, herein designated VGAM RNA, also designated SEQ ID:5224.

Another function of VGAM2513 is therefore inhibition of Purinergic Receptor P2X, Ligand-gated Ion Channel, 1 (P2RX1, Accession XM_040635). Accordingly, utilities of VGAM2513 include diagnosis, prevention and treatment of diseases and clinical conditions associated with P2RX1. Pleiomorphic Adenoma Gene-like 2 (PLAGL2, Accession XM_047007) is another VGAM2513 host target gene. PLAGL2 BINDING SITE is HOST TARGET binding site found in the 3' untranslated region of mRNA encoded by PLAGL2, corresponding to a HOST TARGET binding site such as BINDING SITE I, BINDING SITE II or BINDING SITE III. Table 2 illustrates the complementarity of the nucleotide sequences of PLAGL2 BINDING SITE, designated SEQ ID:34876, to the nucleotide sequence of VGAM2513 RNA, herein designated VGAM RNA, also designated SEQ ID:5224.

Another function of VGAM2513 is therefore inhibition of Pleiomorphic Adenoma Gene-like 2 (PLAGL2, Accession XM_047007). Accordingly, utilities of VGAM2513 include diagnosis, prevention and treatment of diseases and clinical conditions associated with PLAGL2. Transient Receptor Potential Cation Channel, Subfamily V, Member 5 (TRPV5, Accession NM_019841) is another VGAM2513 host target gene. TRPV5 BINDING SITE is HOST TARGET binding site found in the 5' untranslated region of mRNA encoded by TRPV5, corresponding to a HOST TARGET binding site such as BINDING SITE I, BINDING SITE II or BINDING SITE III. Table 2 illustrates the complementarity of the nucleotide sequences of TRPV5 BINDING SITE, designated SEQ ID:21247, to the nucleotide sequence of VGAM2513 RNA, herein designated VGAM RNA, also designated SEQ ID:5224.

Another function of VGAM2513 is therefore inhibition of Transient Receptor Potential Cation Channel, Subfamily V, Member 5 (TRPV5, Accession NM_019841). Accordingly, utilities of VGAM2513 include diagnosis, prevention and treatment of diseases and clinical conditions associated with TRPV5. LOC219397 (Accession XM_167889) is another VGAM2513 host target gene. LOC219397 BINDING SITE is HOST TARGET binding site found in the 3' untranslated region of mRNA encoded by LOC219397, corresponding to a HOST TARGET binding site such as BINDING SITE I, BINDING SITE II or BINDING SITE III. Table 2 illustrates the complementarity of the nucleotide sequences of LOC219397 BINDING SITE, designated SEQ ID:44897, to the nucleotide sequence of VGAM2513 RNA, herein designated VGAM RNA, also designated SEQ ID:5224.

Another function of VGAM2513 is therefore inhibition of LOC219397 (Accession XM_167889). Accordingly, utilities of VGAM2513 include diagnosis, prevention and treatment of diseases and clinical conditions associated with LOC219397. LOC221322 (Accession XM_166323) is another VGAM2513 host target gene. LOC221322 BINDING SITE is HOST TARGET binding site found in the 5' untranslated region of mRNA encoded by LOC221322, corresponding to a HOST TARGET binding site such as BINDING SITE I, BINDING SITE II or BINDING SITE III. Table 2 illustrates the complementarity of the nucleotide sequences of LOC221322 BINDING SITE, designated SEQ ID:44151, to the nucleotide sequence of VGAM2513 RNA, herein designated VGAM RNA, also designated SEQ ID:5224.

Another function of VGAM2513 is therefore inhibition of LOC221322 (Accession XM_166323). Accordingly, utilities of VGAM2513 include diagnosis, prevention and treatment of diseases and clinical conditions associated with LOC221322. LOC222060 (Accession XM_168427) is another VGAM2513 host target gene. LOC222060 BINDING SITE is HOST TARGET binding site found in the 5' untranslated region of mRNA encoded by LOC222060, corresponding to a HOST TARGET binding site such as BINDING SITE I, BINDING SITE II or BINDING SITE III. Table 2 illustrates the complementarity of the nucleotide sequences of LOC222060 BINDING SITE, designated SEQ ID:45158, to the nucleotide sequence of VGAM2513 RNA, herein designated VGAM RNA, also designated SEQ ID:5224.

Another function of VGAM2513 is therefore inhibition of LOC222060 (Accession XM_168427). Accordingly, utilities of VGAM2513 include diagnosis, prevention and treatment of diseases and clinical conditions associated with LOC222060. FIG. 1 further provides a conceptual description of a novel bioinformatically detected viral gene of the present invention, referred to here as Viral Genomic Address Messenger 2514 (VGAM2514) viral gene, which modulates expression of respective host target genes thereof, the function and utility of which host target genes is known in the art.

VGAM2514 is a novel bioinformatically detected regulatory, non protein coding, viral micro RNA (miRNA) gene. The method by which VGAM2514 was detected is described hereinabove with reference to FIGS. 1-8.

VGAM2514 gene, herein designated VGAM GENE, is a viral gene contained in the genome of Mouse Cytomegalovirus 1. VGAM2514 host target gene, herein designated VGAM HOST TARGET GENE, is a human gene contained in the human genome.

VGAM2514 gene encodes a VGAM2514 precursor RNA, herein designated VGAM PRECURSOR RNA. Similar to other miRNA genes, and unlike most ordinary genes, VGAM2514 precursor RNA does not encode a protein. A nucleotide sequence identical or highly similar to the nucleotide sequence of VGAM2514 precursor RNA is designated SEQ ID:2500, and is provided hereinbelow with reference to the sequence listing part. Nucleotide sequence SEQ ID:2500 is located at position 127106 relative to the genome of Mouse Cytomegalovirus 1.

VGAM2514 precursor RNA folds onto itself, forming VGAM2514 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2514 folded precursor RNA into VGAM2514 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2514 RNA is designated SEQ ID:5225, and is provided hereinbelow with reference to the sequence listing part.

VGAM2514 host target gene, herein designated VGAM HOST TARGET GENE, encodes a corresponding messenger RNA, VGAM2514 host target RNA, herein designated VGAM HOST TARGET RNA. VGAM2514 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2514 RNA, herein designated VGAM RNA, binds complementarily to one or more host target binding sites located in untranslated regions of VGAM2514 host target RNA, herein designated VGAM HOST TARGET RNA. This complementary binding is due to the fact that the nucleotide sequence of VGAM2514 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2514 RNA, herein designated VGAM RNA, may have a different number of host target binding sites in untranslated regions of a VGAM2514 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2514 RNA, herein designated VGAM RNA, to host target binding sites on VGAM2514 host target RNA, herein designated VGAM HOST TARGET RNA, such as BINDING SITE I, BINDING SITE II and BINDING SITE III, inhibits translation of VGAM2514 host target RNA into VGAM2514 host target protein, herein designated VGAM HOST TARGET PROTEIN. VGAM host target protein is therefore outlined by a broken line.

It is appreciated that VGAM2514 host target gene, herein designated VGAM HOST TARGET GENE, in fact represents a plurality of VGAM2514 host target genes. The mRNA of each one of this plurality of VGAM2514 host target genes comprises one or more host target binding sites, each having a nucleotide sequence which is at least partly complementary to VGAM2514 RNA, herein designated VGAM RNA, and which when bound by VGAM2514 RNA causes inhibition of translation of respective one or more VGAM2514 host target proteins.

It is further appreciated by one skilled in the art that the mode of translational inhibition illustrated by FIG. 1 with specific reference to translational inhibition exerted by VGAM2514 gene, herein designated VGAM GENE, on one or more VGAM2514 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2514 is inhibition of expression of host target genes, as part of a novel viral mechanism of attacking a host. Accordingly, utilities of VGAM2514 include diagnosis, prevention and treatment of viral infection by Mouse Cytomegalovirus 1. Specific functions, and accordingly utilities, of VGAM2514 correlate with, and may be deduced from, the identity of the host target genes which VGAM2514 binds and inhibits, and the function of these host target genes, as elaborated hereinbelow.

Nucleotide sequences of the VGAM2514 precursor RNA, herein designated VGAM PRECURSOR RNA, and of the 'diced' VGAM2514 RNA, herein designated VGAM RNA, and a schematic representation of the secondary folding of VGAM2514 folded precursor RNA, herein designated VGAM FOLDED PRECURSOR RNA, of VGAM2514 are further described hereinbelow with reference to Table 1.

Nucleotide sequences of host target binding sites, such as BINDING SITE-I, BINDING SITE-II and BINDING SITE-III of FIG. 1, found on VGAM2514 host target RNA, and schematic representation of the complementarity of each of these host target binding sites to VGAM2514 RNA, herein designated VGAM RNA, are described hereinbelow with reference to Table 2.

As mentioned hereinabove with reference to FIG. 1, a function of VGAM2514 gene, herein designated VGAM is inhibition of expression of VGAM2514 target genes. It is appreciated that specific functions, and accordingly utilities, of VGAM2514 correlate with, and may be deduced from, the identity of the target genes which VGAM2514 binds and inhibits, and the function of these target genes, as elaborated hereinbelow.

Aryl Hydrocarbon Receptor (AHR, Accession NM_001621) is a VGAM2514 host target gene. AHR BINDING SITE is HOST TARGET binding site found in the 5' untranslated region of mRNA encoded by AHR, corresponding to a HOST TARGET binding site such as BINDING SITE I, BINDING SITE II or BINDING SITE III. Table 2 illustrates the complementarity of the nucleotide sequences of AHR BINDING SITE, designated SEQ ID:7332, to the nucleotide sequence of VGAM2514 RNA, herein designated VGAM RNA, also designated SEQ ID:5225.

A function of VGAM2514 is therefore inhibition of Aryl Hydrocarbon Receptor (AHR, Accession NM_001621), a gene which plays a role in modulating carcinogenesis through the induction of xenobiotic-metabolizing enzymes. Accordingly, utilities of VGAM2514 include diagnosis, prevention and treatment of diseases and clinical conditions associated with AHR. The function of AHR and its association with various diseases and clinical conditions, has been established by previous studies, as described hereinabove with reference to VGAM368. Ectodysplasin 1, Anhidrotic Receptor (EDAR, Accession NM_022336) is another VGAM2514 host target gene. EDAR BINDING SITE is HOST TARGET binding site found in the 3' untranslated region of mRNA encoded by EDAR, corresponding to a HOST TARGET binding site such as BINDING SITE I, BINDING SITE II or BINDING SITE III. Table 2 illustrates the complementarity of the nucleotide sequences of EDAR BINDING SITE, designated SEQ ID:22745, to the nucleotide sequence of VGAM2514 RNA, herein designated VGAM RNA, also designated SEQ ID:5225.

Another function of VGAM2514 is therefore inhibition of Ectodysplasin 1, Anhidrotic Receptor (EDAR, Accession NM_022336). Accordingly, utilities of VGAM2514 include diagnosis, prevention and treatment of diseases and clinical conditions associated with EDAR. Fibulin 5 (FBLN5, Accession NM_006329) is another VGAM2514 host target gene. FBLN5 BINDING SITE is HOST TARGET binding site found in the 3' untranslated region of mRNA encoded by FBLN5, corresponding to a HOST TARGET binding site such as BINDING SITE I, BINDING SITE II or BINDING SITE III. Table 2 illustrates the complementarity of the nucleotide sequences of FBLN5 BINDING SITE, designated SEQ ID:13026, to the nucleotide sequence of VGAM2514 RNA, herein designated VGAM RNA, also designated SEQ ID:5225.

Another function of VGAM2514 is therefore inhibition of Fibulin 5 (FBLN5, Accession NM_006329), a gene which promotes adhesion of endothelial cells through interaction of integrins and the rgd motif. Accordingly, utilities of VGAM2514 include diagnosis, prevention and treatment of diseases and clinical conditions associated with FBLN5. The function of FBLN5 and its association with various diseases and clinical conditions, has been established by previous studies, as described hereinabove with reference to VGAM1127. Gamma-aminobutyric Acid (GABA) A Receptor, Epsilon (GABRE, Accession NM_021990) is another VGAM2514 host target gene. GABRE BINDING SITE1 through GABRE BINDING SITE4 are HOST TARGET binding sites found in untranslated regions of mRNA encoded by GABRE, corresponding to HOST TARGET binding sites such as BINDING SITE I, BINDING SITE II or BINDING SITE III. Table 2 illustrates the complementarity of the nucleotide sequences of GABRE BINDING SITE1 through GABRE BINDING SITE4, designated SEQ ID:22528, SEQ ID:22513, SEQ ID:22509 and SEQ ID:11407 respectively, to the nucleotide sequence of VGAM2514 RNA, herein designated VGAM RNA, also designated SEQ ID:5225.

Another function of VGAM2514 is therefore inhibition of Gamma-aminobutyric Acid (GABA) A Receptor, Epsilon (GABRE, Accession NM_021990), a gene which mediates neuronal inhibition by binding to the gaba/benzodiazepine receptor and opening an integral chloride channel. Accordingly, utilities of VGAM2514 include diagnosis, prevention and treatment of diseases and clinical conditions associated with GABRE. The function of GABRE and its association with various diseases and clinical conditions, has been established by previous studies, as described hereinabove with reference to VGAM259. Nephronophthisis 1 (juvenile) (NPHP1, Accession XM_031236) is another VGAM2514 host target gene. NPHP1 BINDING SITE is HOST TARGET binding site found in the 3' untranslated region of mRNA encoded by NPHP1, corresponding to a HOST TARGET binding site such as BINDING SITE I, BINDING SITE II or BINDING SITE III. Table 2 illustrates the complementarity of the nucleotide sequences of NPHP1 BINDING SITE, designated SEQ ID:31315, to the nucleotide sequence of VGAM2514 RNA, herein designated VGAM RNA, also designated SEQ ID:5225.

Another function of VGAM2514 is therefore inhibition of Nephronophthisis 1 (juvenile) (NPHP1, Accession XM_031236). Accordingly, utilities of VGAM2514 include diagnosis, prevention and treatment of diseases and clinical conditions associated with NPHP1. Vang-like 2 (van gogh, Drosophila) (VANGL2, Accession XM_049695) is another VGAM2514 host target gene. VANGL2 BINDING SITE is HOST TARGET binding site found in the 3' untranslated region of mRNA encoded by VANGL2, corresponding to a HOST TARGET binding site such as BINDING SITE I, BINDING SITE II or BINDING SITE III. Table 2 illustrates the complementarity of the nucleotide sequences of VANGL2 BINDING SITE, designated SEQ ID:35477, to the nucleotide sequence of VGAM2514 RNA, herein designated VGAM RNA, also designated SEQ ID:5225.

Another function of VGAM2514 is therefore inhibition of Vang-like 2 (van gogh, Drosophila) (VANGL2, Accession XM_049695), a gene which may take part in defining the lateral boundary of floorplate differentiation. Accordingly, utilities of VGAM2514 include diagnosis, prevention and treatment of diseases and clinical conditions associated with VANGL2. The function of VANGL2 and its association with various diseases and clinical conditions, has been established by previous studies, as described hereinabove with reference to VGAM111. CHFR (Accession NM_018223) is another VGAM2514 host target gene. CHFR BINDING SITE is HOST TARGET binding site found in the 3' untranslated region of mRNA encoded by CHFR, corresponding to a HOST TARGET binding site such as BINDING SITE I, BINDING SITE II or BINDING SITE III. Table 2 illustrates the complementarity of the nucleotide sequences of CHFR BINDING SITE, designated SEQ ID:20149, to the nucleotide sequence of VGAM2514 RNA, herein designated VGAM RNA, also designated SEQ ID:5225.

Another function of VGAM2514 is therefore inhibition of CHFR (Accession NM_018223). Accordingly, utilities of VGAM2514 include diagnosis, prevention and treatment of diseases and clinical conditions associated with CHFR. DKFZp586I021 (Accession NM_032271) is another VGAM2514 host target gene. DKFZp586I021 BINDING SITE is HOST TARGET binding site found in the 3' untranslated region of mRNA encoded by DKFZp586I021, corresponding to a HOST TARGET binding site such as BINDING SITE I, BINDING SITE II or BINDING SITE III. Table 2 illustrates the complementarity of the nucleotide sequences of DKFZp586I021 BINDING SITE, designated SEQ ID:26020, to the nucleotide sequence of VGAM2514 RNA, herein designated VGAM RNA, also designated SEQ ID:5225.

Another function of VGAM2514 is therefore inhibition of DKFZp586I021 (Accession NM_032271). Accordingly, utilities of VGAM2514 include diagnosis, prevention and treatment of diseases and clinical conditions associated with DKFZp586I021. DKFZP761I2123 (Accession NM_031449) is another VGAM2514 host target gene. DKFZP761I2123 BINDING SITE is HOST TARGET binding site found in the 3' untranslated region of mRNA encoded by DKFZP761I2123, corresponding to a HOST TARGET binding site such as BINDING SITE I, BINDING SITE II or BINDING SITE III. Table 2 illustrates the complementarity of the nucleotide sequences of DKFZP761I2123 BINDING SITE, designated SEQ ID:25463, to the nucleotide sequence of VGAM2514 RNA, herein designated VGAM RNA, also designated SEQ ID:5225.

Another function of VGAM2514 is therefore inhibition of DKFZP761I2123 (Accession NM_031449). Accordingly, utilities of VGAM2514 include diagnosis, prevention and treatment of diseases and clinical conditions associated with DKFZP761I2123. FLJ14855 (Accession NM_033210) is another VGAM2514 host target gene. FLJ14855 BINDING SITE is HOST TARGET binding site found in the 3' untranslated region of mRNA encoded by FLJ14855, corresponding to a HOST TARGET binding site such as BINDING SITE I, BINDING SITE II or BINDING SITE III. Table 2 illustrates the complementarity of the nucleotide sequences of FLJ14855 BINDING SITE, designated SEQ ID:27060, to the nucleotide sequence of VGAM2514 RNA, herein designated VGAM RNA, also designated SEQ ID:5225.

Another function of VGAM2514 is therefore inhibition of FLJ14855 (Accession NM_033210). Accordingly, utilities of VGAM2514 include diagnosis, prevention and treatment of diseases and clinical conditions associated with FLJ14855. FLJ20069 (Accession NM_017651) is another VGAM2514 host target gene. FLJ20069 BINDING SITE is HOST TARGET binding site found in the 3' untranslated region of mRNA encoded by FLJ20069, corresponding to a HOST TARGET binding site such as BINDING SITE I, BINDING SITE II or BINDING SITE III. Table 2 illustrates the complementarity of the nucleotide sequences of FLJ20069 BINDING SITE, designated SEQ ID:19157, to the nucleotide sequence of VGAM2514 RNA, herein designated VGAM RNA, also designated SEQ ID:5225.

Another function of VGAM2514 is therefore inhibition of FLJ20069 (Accession NM_017651). Accordingly, utilities of VGAM2514 include diagnosis, prevention and treatment of diseases and clinical conditions associated with FLJ20069. FLJ21140 (Accession NM_024776) is another VGAM2514 host target gene. FLJ21140 BINDING SITE is HOST TARGET binding site found in the 3' untranslated region of mRNA encoded by FLJ21140, corresponding to a HOST TARGET binding site such as BINDING SITE I, BINDING SITE II or BINDING SITE III. Table 2 illustrates the complementarity of the nucleotide sequences of FLJ21140 BINDING SITE, designated SEQ ID:24140, to the nucleotide sequence of VGAM2514 RNA, herein designated VGAM RNA, also designated SEQ ID:5225.

Another function of VGAM2514 is therefore inhibition of FLJ21140 (Accession NM_024776). Accordingly, utilities of VGAM2514 include diagnosis, prevention and treatment of diseases and clinical conditions associated with FLJ21140. PNPASE (Accession XM_048088) is another VGAM2514 host target gene. PNPASE BINDING SITE is HOST TARGET binding site found in the 3' untranslated region of mRNA encoded by PNPASE, corresponding to a HOST TARGET binding site such as BINDING SITE I, BINDING SITE II or BINDING SITE III. Table 2 illustrates the complementarity of the nucleotide sequences of PNPASE BINDING SITE, designated SEQ ID:35101, to the nucleotide sequence of VGAM2514 RNA, herein designated VGAM RNA, also designated SEQ ID:5225.

Another function of VGAM2514 is therefore inhibition of PNPASE (Accession XM_048088). Accordingly, utilities of VGAM2514 include diagnosis, prevention and treatment of diseases and clinical conditions associated with PNPASE. PRO1914 (Accession NM_014106) is another VGAM2514 host target gene. PRO1914 BINDING SITE is HOST TARGET binding site found in the 5' untranslated region of mRNA encoded by PRO1914, corresponding to a HOST TARGET binding site such as BINDING SITE I, BINDING SITE II or BINDING SITE III. Table 2 illustrates the complementarity of the nucleotide sequences of PRO1914 BINDING SITE, designated SEQ ID:15328, to the nucleotide sequence of VGAM2514 RNA, herein designated VGAM RNA, also designated SEQ ID:5225.

Another function of VGAM2514 is therefore inhibition of PRO1914 (Accession NM_014106). Accordingly, utilities of VGAM2514 include diagnosis, prevention and treatment of diseases and clinical conditions associated with PRO1914. TERA (Accession NM_021238) is another VGAM2514 host target gene. TERA BINDING SITE is HOST TARGET binding site found in the 3' untranslated region of mRNA encoded by TERA, corresponding to a HOST TARGET binding site such as BINDING SITE I, BINDING SITE II or BINDING SITE III. Table 2 illustrates the complementarity of the nucleotide sequences of TERA BINDING SITE, designated SEQ ID:22206, to the nucleotide sequence of VGAM2514 RNA, herein designated VGAM RNA, also designated SEQ ID:5225.

Another function of VGAM2514 is therefore inhibition of TERA (Accession NM_021238). Accordingly, utilities of VGAM2514 include diagnosis, prevention and treatment of diseases and clinical conditions associated with TERA. LOC196283 (Accession XM_113684) is another VGAM2514 host target gene. LOC196283 BINDING SITE is HOST TARGET binding site found in the 3' untranslated region of mRNA encoded by LOC196283, corresponding to a HOST TARGET binding site such as BINDING SITE I, BINDING SITE II or BINDING SITE III. Table 2 illustrates the complementarity of the nucleotide sequences of LOC196283 BINDING SITE, designated SEQ ID:42340, to the nucleotide sequence of VGAM2514 RNA, herein designated VGAM RNA, also designated SEQ ID:5225.

Another function of VGAM2514 is therefore inhibition of LOC196283 (Accession XM_113684). Accordingly, utilities of VGAM2514 include diagnosis, prevention and treatment of diseases and clinical conditions associated with LOC196283. LOC202451 (Accession XM_117401) is another VGAM2514 host target gene. LOC202451 BINDING SITE is HOST TARGET binding site found in the 5' untranslated region of mRNA encoded by LOC202451, corresponding to a HOST TARGET binding site such as BINDING SITE I, BINDING SITE II or BINDING SITE III. Table 2 illustrates the complementarity of the nucleotide sequences of LOC202451 BINDING SITE, designated SEQ ID:43436, to the nucleotide sequence of VGAM2514 RNA, herein designated VGAM RNA, also designated SEQ ID:5225.

Another function of VGAM2514 is therefore inhibition of LOC202451 (Accession XM_117401). Accordingly, utilities of VGAM2514 include diagnosis, prevention and treatment of diseases and clinical conditions associated with LOC202451. FIG. 1 further provides a conceptual description of a novel bioinformatically detected viral gene of the present invention, referred to here as Viral Genomic Address Messenger 2515 (VGAM2515) viral gene, which modulates expression of respective host target genes thereof, the function and utility of which host target genes is known in the art.

VGAM2515 is a novel bioinformatically detected regulatory, non protein coding, viral micro RNA (miRNA) gene. The method by which VGAM2515 was detected is described hereinabove with reference to FIGS. 1-8.

VGAM2515 gene, herein designated VGAM GENE, is a viral gene contained in the genome of Mouse Cytomegalovirus 1. VGAM2515 host target gene, herein designated VGAM HOST TARGET GENE, is a human gene contained in the human genome.

VGAM2515 gene encodes a VGAM2515 precursor RNA, herein designated VGAM PRECURSOR RNA. Similar to other miRNA genes, and unlike most ordinary genes, VGAM2515 precursor RNA does not encode a protein. A nucleotide sequence identical or highly similar to the nucleotide sequence of VGAM2515 precursor RNA is designated SEQ ID:2501, and is provided hereinbelow with reference to the sequence listing part. Nucleotide sequence SEQ ID:2501 is located at position 35144 relative to the genome of Mouse Cytomegalovirus 1.

VGAM2515 precursor RNA folds onto itself, forming VGAM2515 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2515 folded precursor RNA into VGAM2515 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2515 RNA is designated SEQ ID:5226, and is provided hereinbelow with reference to the sequence listing part.

VGAM2515 host target gene, herein designated VGAM HOST TARGET GENE, encodes a corresponding messenger RNA, VGAM2515 host target RNA, herein designated VGAM HOST TARGET RNA. VGAM2515 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2515 RNA, herein designated VGAM RNA, binds complementarily to one or more host target binding sites located in untranslated regions of VGAM2515 host target RNA, herein designated VGAM HOST TARGET RNA. This complementary binding is due to the fact that the nucleotide sequence of VGAM2515 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2515 RNA, herein designated VGAM RNA, may have a different number of host target binding sites in untranslated regions of a VGAM2515 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2515 RNA, herein designated VGAM RNA, to host target binding sites on VGAM2515 host target RNA, herein designated VGAM HOST TARGET RNA, such as BINDING SITE I, BINDING SITE II and BINDING SITE III, inhibits translation of VGAM2515 host target RNA into VGAM2515 host target protein, herein designated VGAM HOST TARGET PROTEIN. VGAM host target protein is therefore outlined by a broken line.

It is appreciated that VGAM2515 host target gene, herein designated VGAM HOST TARGET GENE, in fact represents a plurality of VGAM2515 host target genes. The mRNA of each one of this plurality of VGAM2515 host target genes comprises one or more host target binding sites, each having a nucleotide sequence which is at least partly complementary to VGAM2515 RNA, herein designated VGAM RNA, and which when bound by VGAM2515 RNA causes inhibition of translation of respective one or more VGAM2515 host target proteins.

It is further appreciated by one skilled in the art that the mode of translational inhibition illustrated by FIG. 1 with specific reference to translational inhibition exerted by VGAM2515 gene, herein designated VGAM GENE, on one or more VGAM2515 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2515 is inhibition of expression of host target genes, as part of a novel viral mechanism of attacking a host. Accordingly, utilities of VGAM2515 include diagnosis, prevention and treatment of viral infection by Mouse Cytomegalovirus 1. Specific functions, and accordingly utilities, of VGAM2515 correlate with, and may be deduced from, the identity of the host target genes which VGAM2515 binds and inhibits, and the function of these host target genes, as elaborated hereinbelow.

Nucleotide sequences of the VGAM2515 precursor RNA, herein designated VGAM PRECURSOR RNA, and of the 'diced' VGAM2515 RNA, herein designated VGAM RNA, and a schematic representation of the secondary folding of VGAM2515 folded precursor RNA, herein designated VGAM FOLDED PRECURSOR RNA, of VGAM2515 are further described hereinbelow with reference to Table 1.

Nucleotide sequences of host target binding sites, such as BINDING SITE-I, BINDING SITE-II and BINDING SITE-III of FIG. 1, found on VGAM2515 host target RNA, and schematic representation of the complementarity of each of these host target binding sites to VGAM2515 RNA, herein designated VGAM RNA, are described hereinbelow with reference to Table 2.

As mentioned hereinabove with reference to FIG. 1, a function of VGAM2515 gene, herein designated VGAM is inhibition of expression of VGAM2515 target genes. It is appreciated that specific functions, and accordingly utilities, of VGAM2515 correlate with, and may be deduced from, the identity of the target genes which VGAM2515 binds and inhibits, and the function of these target genes, as elaborated hereinbelow.

Protein Tyrosine Phosphatase, Non-receptor Type 1 (PTPN1, Accession NM_002827) is a VGAM2515 host target gene. PTPN1 BINDING SITE is HOST TARGET binding site found in the 3' untranslated region of mRNA encoded by PTPN1, corresponding to a HOST TARGET binding site such as BINDING SITE I, BINDING SITE II or BINDING SITE III. Table 2 illustrates the complementarity of the nucleotide sequences of PTPN1 BINDING SITE, designated SEQ ID:8703, to the nucleotide sequence of VGAM2515 RNA, herein designated VGAM RNA, also designated SEQ ID:5226.

A function of VGAM2515 is therefore inhibition of Protein Tyrosine Phosphatase, Non-receptor Type 1 (PTPN1, Accession NM_002827), a gene which is a non-receptor type 1 protein tyrosine phosphatase and inhibits insulin signaling. Accordingly, utilities of VGAM2515 include diagnosis, prevention and treatment of diseases and clinical conditions associated with PTPN1. The function of PTPN1 and its association with various diseases and clinical conditions, has been established by previous studies, as described hereinabove with reference to VGAM327. Zinc Finger Protein 2 (A1-5) (ZNF2, Accession NM_021088) is another VGAM2515 host target gene. ZNF2 BINDING SITE is HOST TARGET binding site found in the 5' untranslated region of mRNA encoded by ZNF2, corresponding to a HOST TARGET binding site such as BINDING SITE I, BINDING SITE II or BINDING SITE III. Table 2 illustrates the complementarity of the nucleotide sequences of ZNF2 BINDING SITE, designated SEQ ID:22070, to the nucleotide sequence of VGAM2515 RNA, herein designated VGAM RNA, also designated SEQ ID:5226.

Another function of VGAM2515 is therefore inhibition of Zinc Finger Protein 2 (A1-5) (ZNF2, Accession NM_021088). Accordingly, utilities of VGAM2515 include diagnosis, prevention and treatment of diseases and clinical conditions associated with ZNF2. D2S448 (Accession XM_056455) is another VGAM2515 host target gene. D2S448 BINDING SITE is HOST TARGET binding site found in the 3' untranslated region of mRNA encoded by D2S448, corresponding to a HOST TARGET binding site such as BINDING SITE I, BINDING SITE II or BINDING SITE III. Table 2 illustrates the complementarity of the nucleotide sequences of D2S448 BINDING SITE, designated SEQ ID:36396, to the nucleotide sequence of VGAM2515 RNA, herein designated VGAM RNA, also designated SEQ ID:5226.

Another function of VGAM2515 is therefore inhibition of D2S448 (Accession XM_056455). Accordingly, utilities of VGAM2515 include diagnosis, prevention and treatment of diseases and clinical conditions associated with D2S448. FLJ13102 (Accession NM_024887) is another VGAM2515 host target gene. FLJ13102 BINDING SITE is HOST TARGET binding site found in the 3' untranslated region of mRNA encoded by FLJ13102, corresponding to a HOST TARGET binding site such as BINDING SITE I, BINDING SITE II or BINDING SITE III. Table 2 illustrates the complementarity of the nucleotide sequences of FLJ13102 BINDING SITE, designated SEQ ID:24345, to the nucleotide sequence of VGAM2515 RNA, herein designated VGAM RNA, also designated SEQ ID:5226.

Another function of VGAM2515 is therefore inhibition of FLJ13102 (Accession NM_024887). Accordingly, utilities of VGAM2515 include diagnosis, prevention and treatment of diseases and clinical conditions associated with FLJ13102. KIAA0418 (Accession NM_014631) is another VGAM2515 host target gene. KIAA0418 BINDING SITE is HOST TARGET binding site found in the 3' untranslated region of mRNA encoded by KIAA0418, corresponding to a HOST TARGET binding site such as BINDING SITE I, BINDING SITE II or BINDING SITE III. Table 2 illustrates the complementarity of the nucleotide sequences of KIAA0418 BINDING SITE, designated SEQ ID:15998, to the nucleotide sequence of VGAM2515 RNA, herein designated VGAM RNA, also designated SEQ ID:5226.

Another function of VGAM2515 is therefore inhibition of KIAA0418 (Accession NM_014631). Accordingly, utilities of VGAM2515 include diagnosis, prevention and treatment of diseases and clinical conditions associated with KIAA0418. MAGE-E1 (Accession NM_030801) is another VGAM2515 host target gene. MAGE-E1 BINDING SITE is HOST TARGET binding site found in the 3' untranslated region of mRNA encoded by MAGE-E1, corresponding to a HOST TARGET binding site such as BINDING SITE I, BINDING SITE II or BINDING SITE III. Table 2 illustrates the complementarity of the nucleotide sequences of MAGE-E1 BINDING SITE, designated SEQ ID:25107, to the nucleotide sequence of VGAM2515 RNA, herein designated VGAM RNA, also designated SEQ ID:5226.

Another function of VGAM2515 is therefore inhibition of MAGE-E1 (Accession NM_030801). Accordingly, utilities of VGAM2515 include diagnosis, prevention and treatment of diseases and clinical conditions associated with MAGE-E1. Melanoma Antigen, Family E, 1, Cancer/testis Specific (MAGEE1, Accession NM_016249) is another VGAM2515 host target gene. MAGEE1 BINDING SITE is HOST TARGET binding site found in the 5' untranslated region of mRNA encoded by MAGEE1, corresponding to a HOST TARGET binding site such as BINDING SITE I, BINDING SITE II or BINDING SITE III. Table 2 illustrates the complementarity of the nucleotide sequences of MAGEE1 BINDING SITE, designated SEQ ID:18377, to the nucleotide sequence of VGAM2515 RNA, herein designated VGAM RNA, also designated SEQ ID:5226.

Another function of VGAM2515 is therefore inhibition of Melanoma Antigen, Family E, 1, Cancer/testis Specific (MAGEE1, Accession NM_016249). Accordingly, utilities of VGAM2515 include diagnosis, prevention and treatment of diseases and clinical conditions associated with MAGEE1. Mesoderm Development Candidate 1 (MESDC1, Accession NM_022566) is another VGAM2515 host target gene. MESDC1 BINDING SITE is HOST TARGET binding site found in the 5' untranslated region of mRNA encoded by MESDC1, corresponding to a HOST TARGET binding site such as BINDING SITE I, BINDING SITE II or BINDING SITE III. Table 2 illustrates the complementarity of the nucleotide sequences of MESDC1 BINDING SITE, designated SEQ ID:22884, to the nucleotide sequence of VGAM2515 RNA, herein designated VGAM RNA, also designated SEQ ID:5226.

Another function of VGAM2515 is therefore inhibition of Mesoderm Development Candidate 1 (MESDC1, Accession NM_022566). Accordingly, utilities of VGAM2515 include diagnosis, prevention and treatment of diseases and clinical conditions associated with MESDC1. MGC11335 (Accession NM_030819) is another VGAM2515 host target gene. MGC11335 BINDING SITE is HOST TARGET binding site found in the 5' untranslated region of mRNA encoded by MGC11335, corresponding to a HOST TARGET binding site such as BINDING SITE I, BINDING SITE II or BINDING SITE III. Table 2 illustrates the complementarity of the nucleotide sequences of MGC11335 BINDING SITE, designated SEQ ID:25148, to the nucleotide sequence of VGAM2515 RNA, herein designated VGAM RNA, also designated SEQ ID:5226.

Another function of VGAM2515 is therefore inhibition of MGC11335 (Accession NM_030819). Accordingly, utilities of VGAM2515 include diagnosis, prevention and treatment of diseases and clinical conditions associated with MGC11335. OS4 (Accession NM_005730) is another VGAM2515 host target gene. OS4 BINDING SITE is HOST TARGET binding site found in the 3' untranslated region of mRNA encoded by OS4, corresponding to a HOST TARGET binding site such as BINDING SITE I, BINDING SITE II or BINDING SITE III. Table 2 illustrates the complementarity of the nucleotide sequences of OS4 BINDING SITE, designated SEQ ID:12291, to the nucleotide sequence of VGAM2515 RNA, herein designated VGAM RNA, also designated SEQ ID:5226.

Another function of VGAM2515 is therefore inhibition of OS4 (Accession NM_005730). Accordingly, utilities of VGAM2515 include diagnosis, prevention and treatment of diseases and clinical conditions associated with OS4. PP1665 (Accession NM_030792) is another VGAM2515 host target gene. PP1665 BINDING SITE is HOST TARGET binding site found in the 3' untranslated region of mRNA encoded by PP1665, corresponding to a HOST TARGET binding site such as BINDING SITE I, BINDING SITE II or BINDING SITE III. Table 2 illustrates the complementarity of the nucleotide sequences of PP1665 BINDING SITE, designated SEQ ID:25092, to the nucleotide sequence of VGAM2515 RNA, herein designated VGAM RNA, also designated SEQ ID:5226.

Another function of VGAM2515 is therefore inhibition of PP1665 (Accession NM_030792). Accordingly, utilities of VGAM2515 include diagnosis, prevention and treatment of diseases and clinical conditions associated with PP1665. Protein Phosphatase 1, Regulatory (inhibitor) Subunit 16B (PPP1R16B, Accession XM_028840) is another VGAM2515 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30778, to the nucleotide sequence of VGAM2515 RNA, herein designated VGAM RNA, also designated SEQ ID:5226.

Another function of VGAM2515 is therefore inhibition of Protein Phosphatase 1, Regulatory (inhibitor) Subunit 16B (PPP1R16B, Accession XM_028840). Accordingly, utilities of VGAM2515 include diagnosis, prevention and treatment of diseases and clinical conditions associated with PPP1R16B. FIG. 1 further provides a conceptual description of a novel bioinformatically detected viral gene of the present invention, referred to here as Viral Genomic Address Messenger 2516 (VGAM2516) viral gene, which modulates expression of respective host target genes thereof, the function and utility of which host target genes is known in the art.

VGAM2516 is a novel bioinformatically detected regulatory, non protein coding, viral micro RNA (miRNA) gene. The method by which VGAM2516 was detected is described hereinabove with reference to FIGS. 1-8.

VGAM2516 gene, herein designated VGAM GENE, is a viral gene contained in the genome of Mouse Cytomegalovirus 1. VGAM2516 host target gene, herein designated VGAM HOST TARGET GENE, is a human gene contained in the human genome.

VGAM2516 gene encodes a VGAM2516 precursor RNA, herein designated VGAM PRECURSOR RNA. Similar to other miRNA genes, and unlike most ordinary genes, VGAM2516 precursor RNA does not encode a protein. A nucleotide sequence identical or highly similar to the nucleotide sequence of VGAM2516 precursor RNA is designated SEQ ID:2502, and is provided hereinbelow with reference to the sequence listing part. Nucleotide sequence SEQ ID:2502 is located at position 84255 relative to the genome of Mouse Cytomegalovirus 1.

VGAM2516 precursor RNA folds onto itself, forming VGAM2516 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2516 folded precursor RNA into VGAM2516 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2516 RNA is designated SEQ ID:5227, and is provided hereinbelow with reference to the sequence listing part.

VGAM2516 host target gene, herein designated VGAM HOST TARGET GENE, encodes a corresponding messenger RNA, VGAM2516 host target RNA, herein designated VGAM HOST TARGET RNA. VGAM2516 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2516 RNA, herein designated VGAM RNA, binds complementarily to one or more host target binding sites located in untranslated regions of VGAM2516 host target RNA, herein designated VGAM HOST TARGET RNA. This complementary binding is due to the fact that the nucleotide sequence of VGAM2516 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2516 RNA, herein designated VGAM RNA, may have a different number of host target binding sites in untranslated regions of a VGAM2516 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2516 RNA, herein designated VGAM RNA, to host target binding sites on VGAM2516 host target RNA, herein designated VGAM HOST TARGET RNA, such as BINDING SITE I, BINDING SITE II and BINDING SITE III, inhibits translation of VGAM2516 host target RNA into VGAM2516 host target protein, herein designated VGAM HOST TARGET PROTEIN. VGAM host target protein is therefore outlined by a broken line.

It is appreciated that VGAM2516 host target gene, herein designated VGAM HOST TARGET GENE, in fact represents a plurality of VGAM2516 host target genes. The mRNA of each one of this plurality of VGAM2516 host target genes comprises one or more host target binding sites, each having a nucleotide sequence which is at least partly complementary to VGAM2516 RNA, herein designated VGAM RNA, and which when bound by VGAM2516 RNA causes inhibition of translation of respective one or more VGAM2516 host target proteins.

It is further appreciated by one skilled in the art that the mode of translational inhibition illustrated by FIG. 1 with specific reference to translational inhibition exerted by VGAM2516 gene, herein designated VGAM GENE, on one or more VGAM2516 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2516 is inhibition of expression of host target genes, as part of a novel viral mechanism of attacking a host. Accordingly, utilities of VGAM2516 include diagnosis, prevention and treatment of viral infection by Mouse Cytomegalovirus 1. Specific functions, and accordingly utilities, of VGAM2516 correlate with, and may be deduced from, the identity of the host target genes which VGAM2516 binds and inhibits, and the function of these host target genes, as elaborated hereinbelow.

Nucleotide sequences of the VGAM2516 precursor RNA, herein designated VGAM PRECURSOR RNA, and of the 'diced' VGAM2516 RNA, herein designated VGAM RNA, and a schematic representation of the secondary folding of VGAM2516 folded precursor RNA, herein designated VGAM FOLDED PRECURSOR RNA, of VGAM2516 are further described hereinbelow with reference to Table 1.

Nucleotide sequences of host target binding sites, such as BINDING SITE-I, BINDING SITE-II and BINDING SITE-III of FIG. 1, found on VGAM2516 host target RNA, and schematic representation of the complementarity of each of these host target binding sites to VGAM2516 RNA, herein designated VGAM RNA, are described hereinbelow with reference to Table 2.

As mentioned hereinabove with reference to FIG. 1, a function of VGAM2516 gene, herein designated VGAM is inhibition of expression of VGAM2516 target genes. It is appreciated that specific functions, and accordingly utilities, of VGAM2516 correlate with, and may be deduced from, the identity of the target genes which VGAM2516 binds and inhibits, and the function of these target genes, as elaborated hereinbelow.

FLJ14442 (Accession NM_032785) is a VGAM2516 host target gene. FLJ14442 BINDING SITE is HOST TARGET binding site found in the 3' untranslated region of mRNA encoded by FLJ14442, corresponding to a HOST TARGET binding site such as BINDING SITE I, BINDING SITE II or BINDING SITE III. Table 2 illustrates the complementarity of the nucleotide sequences of FLJ14442 BINDING SITE, designated SEQ ID:26534, to the nucleotide sequence of VGAM2516 RNA, herein designated VGAM RNA, also designated SEQ ID:5227.

A function of VGAM2516 is therefore inhibition of FLJ14442 (Accession NM_032785). Accordingly, utilities of VGAM2516 include diagnosis, prevention and treatment of diseases and clinical conditions associated with FLJ14442. ISL2 Transcription Factor, LIM/homeodomain, (islet-2) (ISL2, Accession XM_047951) is another VGAM2516 host target gene. ISL2 BINDING SITE is HOST TARGET binding site found in the 3' untranslated region of mRNA encoded by ISL2, corresponding to a HOST TARGET binding site such as BINDING SITE I, BINDING SITE II or BINDING SITE III. Table 2 illustrates the complementarity of the nucleotide sequences of ISL2 BINDING SITE, designated SEQ ID:35081, to the nucleotide sequence of VGAM2516 RNA, herein designated VGAM RNA, also designated SEQ ID:5227.

Another function of VGAM2516 is therefore inhibition of ISL2 Transcription Factor, LIM/homeodomain, (islet-2) (ISL2, Accession XM_047951). Accordingly, utilities of VGAM2516 include diagnosis, prevention and treatment of diseases and clinical conditions associated with ISL2. KIAA1915 (Accession XM_055481) is another VGAM2516 host target gene. KIAA1915 BINDING SITE is HOST TARGET binding site found in the 3' untranslated region of mRNA encoded by KIAA1915, corresponding to a HOST TARGET binding site such as BINDING SITE I, BINDING SITE II or BINDING SITE III. Table 2 illustrates the complementarity of the nucleotide sequences of KIAA1915 BINDING SITE, designated SEQ ID:36273, to the nucleotide sequence of VGAM2516 RNA, herein designated VGAM RNA, also designated SEQ ID:5227.

Another function of VGAM2516 is therefore inhibition of KIAA1915 (Accession XM_055481). Accordingly, utilities of VGAM2516 include diagnosis, prevention and treatment of diseases and clinical conditions associated with KIAA1915. PLPL (Accession NM_020181) is another VGAM2516 host target gene. PLPL BINDING SITE is HOST TARGET binding site found in the 3' untranslated region of mRNA encoded by PLPL, corresponding to a HOST TARGET binding site such as BINDING SITE I, BINDING SITE II or BINDING SITE III. Table 2 illustrates the complementarity of the nucleotide sequences of PLPL BINDING SITE, designated SEQ ID:21400, to the nucleotide sequence of VGAM2516 RNA, herein designated VGAM RNA, also designated SEQ ID:5227.

Another function of VGAM2516 is therefore inhibition of PLPL (Accession NM_020181). Accordingly, utilities of VGAM2516 include diagnosis, prevention and treatment of diseases and clinical conditions associated with PLPL. LOC256639 (Accession XM_171241) is another VGAM2516 host target gene. LOC256639 BINDING SITE is HOST TARGET binding site found in the 5' untranslated region of mRNA encoded by LOC256639, corresponding to a HOST TARGET binding site such as BINDING SITE I, BINDING SITE II or BINDING SITE III. Table 2 illustrates the complementarity of the nucleotide sequences of LOC256639 BINDING SITE, designated SEQ ID:46029, to the nucleotide sequence of VGAM2516 RNA, herein designated VGAM RNA, also designated SEQ ID:5227.

Another function of VGAM2516 is therefore inhibition of LOC256639 (Accession XM_171241). Accordingly, utilities of VGAM2516 include diagnosis, prevention and treatment of diseases and clinical conditions associated with LOC256639. FIG. 1 further provides a conceptual description of a novel bioinformatically detected viral gene of the present invention, referred to here as Viral Genomic Address Messenger 2517 (VGAM2517) viral gene, which modulates expression of respective host target genes thereof, the function and utility of which host target genes is known in the art.

VGAM2517 is a novel bioinformatically detected regulatory, non protein coding, viral micro RNA (miRNA) gene. The method by which VGAM2517 was detected is described hereinabove with reference to FIGS. 1-8.

VGAM2517 gene, herein designated VGAM GENE, is a viral gene contained in the genome of Mouse Cytomegalovirus 1. VGAM2517 host target gene, herein designated VGAM HOST TARGET GENE, is a human gene contained in the human genome.

VGAM2517 gene encodes a VGAM2517 precursor RNA, herein designated VGAM PRECURSOR RNA. Similar to other miRNA genes, and unlike most ordinary genes, VGAM2517 precursor RNA does not encode a protein. A nucleotide sequence identical or highly similar to the nucleotide sequence of VGAM2517 precursor RNA is designated SEQ ID:2503, and is provided hereinbelow with reference to the sequence listing part. Nucleotide sequence SEQ ID:2503 is located at position 158132 relative to the genome of Mouse Cytomegalovirus 1.

VGAM2517 precursor RNA folds onto itself, forming VGAM2517 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2517 folded precursor RNA into VGAM2517 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 61%) nucleotide sequence of VGAM2517 RNA is designated SEQ ID:5228, and is provided hereinbelow with reference to the sequence listing part.

VGAM2517 host target gene, herein designated VGAM HOST TARGET GENE, encodes a corresponding messenger RNA, VGAM2517 host target RNA, herein designated VGAM HOST TARGET RNA. VGAM2517 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2517 RNA, herein designated VGAM RNA, binds complementarily to one or more host target binding sites located in untranslated regions of VGAM2517 host target RNA, herein designated VGAM HOST TARGET RNA. This complementary binding is due to the fact that the nucleotide sequence of VGAM2517 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2517 RNA, herein designated VGAM RNA, may have a different number of host target binding sites in untranslated regions of a VGAM2517 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2517 RNA, herein designated VGAM RNA, to host target binding sites on VGAM2517 host target RNA, herein designated VGAM HOST TARGET RNA, such as BINDING SITE I, BINDING SITE II and BINDING SITE III, inhibits translation of VGAM2517 host target RNA into VGAM2517 host target protein, herein designated VGAM HOST TARGET PROTEIN. VGAM host target protein is therefore outlined by a broken line.

It is appreciated that VGAM2517 host target gene, herein designated VGAM HOST TARGET GENE, in fact represents a plurality of VGAM2517 host target genes. The mRNA of each one of this plurality of VGAM2517 host target genes comprises one or more host target binding sites, each having a nucleotide sequence which is at least partly complementary to VGAM2517 RNA, herein designated VGAM RNA, and which when bound by VGAM2517 RNA causes inhibition of translation of respective one or more VGAM2517 host target proteins.

It is further appreciated by one skilled in the art that the mode of translational inhibition illustrated by FIG. 1 with specific reference to translational inhibition exerted by VGAM2517 gene, herein designated VGAM GENE, on one or more VGAM2517 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2517 is inhibition of expression of host target genes, as part of a novel viral mechanism of attacking a host. Accordingly, utilities of VGAM2517 include diagnosis, prevention and treatment of viral infection by Mouse Cytomegalovirus 1. Specific functions, and accordingly utilities, of VGAM2517 correlate with, and may be deduced from, the identity of the host target genes which VGAM2517 binds and inhibits, and the function of these host target genes, as elaborated hereinbelow.

Nucleotide sequences of the VGAM2517 precursor RNA, herein designated VGAM PRECURSOR RNA, and of the 'diced' VGAM2517 RNA, herein designated VGAM RNA, and a schematic representation of the secondary folding of VGAM2517 folded precursor RNA, herein designated VGAM FOLDED PRECURSOR RNA, of VGAM2517 are further described hereinbelow with reference to Table 1.

Nucleotide sequences of host target binding sites, such as BINDING SITE-I, BINDING SITE-II and BINDING SITE-III of FIG. 1, found on VGAM2517 host target RNA, and schematic representation of the complementarity of each of these host target binding sites to VGAM2517 RNA, herein designated VGAM RNA, are described hereinbelow with reference to Table 2.

As mentioned hereinabove with reference to FIG. 1, a function of VGAM2517 gene, herein designated VGAM is inhibition of expression of VGAM2517 target genes. It is appreciated that specific functions, and accordingly utilities, of VGAM2517 correlate with, and may be deduced from, the identity of the target genes which VGAM2517 binds and inhibits, and the function of these target genes, as elaborated hereinbelow.

Complement Component 5 Receptor 1 (C5a ligand) (C5R1, Accession NM_001736) is a VGAM2517 host target gene. C5R1 BINDING SITE is HOST TARGET binding site found in the 3' untranslated region of mRNA encoded by C5R1, corresponding to a HOST TARGET binding site such as BINDING SITE I, BINDING SITE II or BINDING SITE III. Table 2 illustrates the complementarity of the nucleotide sequences of C5R1 BINDING SITE, designated SEQ ID:7472, to the nucleotide sequence of VGAM2517 RNA, herein designated VGAM RNA, also designated SEQ ID:5228.

A function of VGAM2517 is therefore inhibition of Complement Component 5 Receptor 1 (C5a ligand) (C5R1, Accession NM_001736), a gene which has a nonredundant function and is required for mucosal host cell defense in the lung. Accordingly, utilities of VGAM2517 include diagnosis, prevention and treatment of diseases and clinical conditions associated with C5R1. The function of C5R1 and its association with various diseases and clinical conditions, has been established by previous studies, as described hereinabove with reference to VGAM484. Phosphoenolpyruvate Carboxykinase 1 (soluble) (PCK1, Accession XM_009672) is another VGAM2517 host target gene. PCK1 BINDING SITE is HOST TARGET binding site found in the 3' untranslated region of mRNA encoded by PCK1, corresponding to a HOST TARGET binding site such as BINDING SITE I, BINDING SITE II or BINDING SITE III. Table 2 illustrates the complementarity of the nucleotide sequences of PCK1 BINDING SITE, designated SEQ ID:30117, to the nucleotide sequence of VGAM2517 RNA, herein designated VGAM RNA, also designated SEQ ID:5228.

Another function of VGAM2517 is therefore inhibition of Phosphoenolpyruvate Carboxykinase 1 (soluble) (PCK1, Accession XM_009672), a gene which forms phosphoenolpyruvate by decarboxylation of oxaloacetate. Accordingly, utilities of VGAM2517 include diagnosis, prevention and treatment of diseases and clinical conditions associated with PCK1. The function of PCK1 and its association with various diseases and clinical conditions, has been established by previous studies, as described hereinabove with reference to VGAM2341. HERV-H LTR-associating 2 (HHLA2, Accession NM_007072) is another VGAM2517 host target gene. HHLA2 BINDING SITE is HOST TARGET binding site found in the 3' untranslated region of mRNA encoded by HHLA2, corresponding to a HOST TARGET binding site such as BINDING SITE I, BINDING SITE II or BINDING SITE III. Table 2 illustrates the complementarity of the nucleotide sequences of HHLA2 BINDING SITE, designated SEQ ID:13936, to the nucleotide sequence of VGAM2517 RNA, herein designated VGAM RNA, also designated SEQ ID:5228.

Another function of VGAM2517 is therefore inhibition of HERV-H LTR-associating 2 (HHLA2, Accession NM_007072). Accordingly, utilities of VGAM2517 include diagnosis, prevention and treatment of diseases and clinical conditions associated with HHLA2. KIAA1559 (Accession XM_054472) is another VGAM2517 host target gene. KIAA1559 BINDING SITE is HOST TARGET binding site found in the 3' untranslated region of mRNA encoded by KIAA1559, corresponding to a HOST TARGET binding site such as BINDING SITE I, BINDING SITE II or BINDING SITE III. Table 2 illustrates the complementarity of the nucleotide sequences of KIAA1559 BINDING SITE, designated SEQ ID:36161, to the nucleotide sequence of VGAM2517 RNA, herein designated VGAM RNA, also designated SEQ ID:5228.

Another function of VGAM2517 is therefore inhibition of KIAA1559 (Accession XM_054472). Accordingly, utilities of VGAM2517 include diagnosis, prevention and treatment of diseases and clinical conditions associated with KIAA1559. Ras Protein-specific Guanine Nucleotide-releasing Factor 2 (RASGRF2, Accession XM_027943) is another VGAM2517 host target gene. RASGRF2 BINDING SITE is HOST TARGET binding site found in the 3' untranslated region of mRNA encoded by RASGRF2, corresponding to a HOST TARGET binding site such as BINDING SITE I, BINDING SITE II or BINDING SITE III. Table 2 illustrates the complementarity of the nucleotide sequences of RASGRF2 BINDING SITE, designated SEQ ID:30598, to the nucleotide sequence of VGAM2517 RNA, herein designated VGAM RNA, also designated SEQ ID:5228.

Another function of VGAM2517 is therefore inhibition of Ras Protein-specific Guanine Nucleotide-releasing Factor 2 (RASGRF2, Accession XM_027943). Accordingly, utilities of VGAM2517 include diagnosis, prevention and treatment of diseases and clinical conditions associated with RASGRF2. LOC124460 (Accession XM_071892) is another VGAM2517 host target gene. LOC124460 BINDING SITE is HOST TARGET binding site found in the 3' untranslated region of mRNA encoded by LOC124460, corresponding to a HOST TARGET binding site such as BINDING SITE I, BINDING SITE II or BINDING SITE III. Table 2 illustrates the complementarity of the nucleotide sequences of LOC124460 BINDING SITE, designated SEQ ID:37443, to the nucleotide sequence of VGAM2517 RNA, herein designated VGAM RNA, also designated SEQ ID:5228.

Another function of VGAM2517 is therefore inhibition of LOC124460 (Accession XM_071892). Accordingly, utilities of VGAM2517 include diagnosis, prevention and treatment of diseases and clinical conditions associated with LOC124460. LOC147817 (Accession XM_085903) is another VGAM2517 host target gene. LOC147817 BINDING SITE is HOST TARGET binding site found in the 5' untranslated region of mRNA encoded by LOC147817, corresponding to a HOST TARGET binding site such as BINDING SITE I, BINDING SITE II or BINDING SITE III. Table 2 illustrates the complementarity of the nucleotide sequences of LOC147817 BINDING SITE, designated SEQ ID:38383, to the nucleotide sequence of VGAM2517 RNA, herein designated VGAM RNA, also designated SEQ ID:5228.

Another function of VGAM2517 is therefore inhibition of LOC147817 (Accession XM_085903). Accordingly, utilities of VGAM2517 include diagnosis, prevention and treatment of diseases and clinical conditions associated with LOC147817. LOC164397 (Accession XM_092780) is another VGAM2517 host target gene. LOC164397 BINDING SITE is HOST TARGET binding site found in the 5' untranslated region of mRNA encoded by LOC164397, corresponding to a HOST TARGET binding site such as BINDING SITE I, BINDING SITE II or BINDING SITE III. Table 2 illustrates the complementarity of the nucleotide sequences of LOC164397 BINDING SITE, designated SEQ ID:40152, to the nucleotide sequence of VGAM2517 RNA, herein designated VGAM RNA, also designated SEQ ID:5228.

Another function of VGAM2517 is therefore inhibition of LOC164397 (Accession XM_092780). Accordingly, utilities of VGAM2517 include diagnosis, prevention and treatment of diseases and clinical conditions associated with LOC164397. LOC201294 (Accession XM_113950) is another VGAM2517 host target gene. LOC201294 BINDING SITE is HOST TARGET binding site found in the 3' untranslated region of mRNA encoded by LOC201294, corresponding to a HOST TARGET binding site such as BINDING SITE I, BINDING SITE II or BINDING SITE III. Table 2 illustrates the complementarity of the nucleotide sequences of LOC201294 BINDING SITE, designated SEQ ID:42566, to the nucleotide sequence of VGAM2517 RNA, herein designated VGAM RNA, also designated SEQ ID:5228.

Another function of VGAM2517 is therefore inhibition of LOC201294 (Accession XM_113950). Accordingly, utilities of VGAM2517 include diagnosis, prevention and treatment of diseases and clinical conditions associated with LOC201294. LOC245728 (Accession XM_165922) is another VGAM2517 host target gene. LOC245728 BINDING SITE is HOST TARGET binding site found in the 5' untranslated region of mRNA encoded by LOC245728, corresponding to a HOST TARGET binding site such as BINDING SITE I, BINDING SITE II or BINDING SITE III. Table 2 illustrates the complementarity of the nucleotide sequences of LOC245728 BINDING SITE, designated SEQ ID:43801, to the nucleotide sequence of VGAM2517 RNA, herein designated VGAM RNA, also designated SEQ ID:5228.

Another function of VGAM2517 is therefore inhibition of LOC245728 (Accession XM_165922). Accordingly, utilities of VGAM2517 include diagnosis, prevention and treatment of diseases and clinical conditions associated with LOC245728. LOC253038 (Accession XM_174524) is another VGAM2517 host target gene. LOC253038 BINDING SITE is HOST TARGET binding site found in the 5' untranslated region of mRNA encoded by LOC253038, corresponding to a HOST TARGET binding site such as BINDING SITE I, BINDING SITE II or BINDING SITE III. Table 2 illustrates the complementarity of the nucleotide sequences of LOC253038 BINDING SITE, designated SEQ ID:46595, to the nucleotide sequence of VGAM2517 RNA, herein designated VGAM RNA, also designated SEQ ID:5228.

Another function of VGAM2517 is therefore inhibition of LOC253038 (Accession XM_174524). Accordingly, utilities of VGAM2517 include diagnosis, prevention and treatment of diseases and clinical conditions associated with LOC253038. LOC253776 (Accession XM_173240) is another VGAM2517 host target gene. LOC253776 BINDING SITE is HOST TARGET binding site found in the 3' untranslated region of mRNA encoded by LOC253776, corresponding to a HOST TARGET binding site such as BINDING SITE I, BINDING SITE II or BINDING SITE III. Table 2 illustrates the complementarity of the nucleotide sequences of LOC253776 BINDING SITE, designated SEQ ID:46525, to the nucleotide sequence of VGAM2517 RNA, herein designated VGAM RNA, also designated SEQ ID:5228.

Another function of VGAM2517 is therefore inhibition of LOC253776 (Accession XM_173240). Accordingly, utilities of VGAM2517 include diagnosis, prevention and treatment of diseases and clinical conditions associated with LOC253776. FIG. 1 further provides a conceptual description of a novel bioinformatically detected viral gene of the present invention, referred to here as Viral Genomic Address Messenger 2518 (VGAM2518) viral gene, which modulates expression of respective host target genes thereof, the function and utility of which host target genes is known in the art.

VGAM2518 is a novel bioinformatically detected regulatory, non protein coding, viral micro RNA (miRNA) gene. The method by which VGAM2518 was detected is described hereinabove with reference to FIGS. 1-8.

VGAM2518 gene, herein designated VGAM GENE, is a viral gene contained in the genome of Mouse Cytomegalovirus 1. VGAM2518 host target gene, herein designated VGAM HOST TARGET GENE, is a human gene contained in the human genome.

VGAM2518 gene encodes a VGAM2518 precursor RNA, herein designated VGAM PRECURSOR RNA. Similar to other miRNA genes, and unlike most ordinary genes, VGAM2518 precursor RNA does not encode a protein. A nucleotide sequence identical or highly similar to the nucleotide sequence of VGAM2518 precursor RNA is designated SEQ ID:2504, and is provided hereinbelow with reference to the sequence listing part. Nucleotide sequence SEQ ID:2504 is located at position 3872 relative to the genome of Mouse Cytomegalovirus 1.

VGAM2518 precursor RNA folds onto itself, forming VGAM2518 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2518 folded precursor RNA into VGAM2518 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2518 RNA is designated SEQ ID:5229, and is provided hereinbelow with reference to the sequence listing part.

VGAM2518 host target gene, herein designated VGAM HOST TARGET GENE, encodes a corresponding messenger RNA, VGAM2518 host target RNA, herein designated VGAM HOST TARGET RNA. VGAM2518 host target RNA comprises three regions, as is typical of mRNA of a protein coding gene: a 5' untranslated region, a protein coding region and a 3' untranslated region, designated 5"UTR, PROTEIN CODING and 3'UTR respectively.

15415

VGAM2518 RNA, herein designated VGAM RNA, binds complementarily to one or more host target binding sites located in untranslated regions of VGAM2518 host target RNA, herein designated VGAM HOST TARGET RNA. This complementary binding is due to the fact that the nucleotide sequence of VGAM2518 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2518 RNA, herein designated VGAM RNA, may have a different number of host target binding sites in untranslated regions of a VGAM2518 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2518 RNA, herein designated VGAM RNA, to host target binding sites on VGAM2518 host target RNA, herein designated VGAM HOST TARGET RNA, such as BINDING SITE I, BINDING SITE II and BINDING SITE III, inhibits translation of VGAM2518 host target RNA into VGAM2518 host target protein, herein designated VGAM HOST TARGET PROTEIN. VGAM host target protein is therefore outlined by a broken line.

It is appreciated that VGAM2518 host target gene, herein designated VGAM HOST TARGET GENE, in fact represents a plurality of VGAM2518 host target genes. The mRNA of each one of this plurality of VGAM2518 host target genes comprises one or more host target binding sites, each having a nucleotide sequence which is at least partly complementary to VGAM2518 RNA, herein designated VGAM RNA, and which when bound by VGAM2518 RNA causes inhibition of translation of respective one or more VGAM2518 host target proteins.

It is further appreciated by one skilled in the art that the mode of translational inhibition illustrated by FIG. 1 with specific reference to translational inhibition exerted by VGAM2518 gene, herein designated VGAM GENE, on one or more VGAM2518 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2518 is inhibition of expression of host target genes, as part of a novel viral mechanism of attacking a host. Accordingly, utilities of VGAM2518 include diagnosis, prevention and treatment of viral infection by Mouse Cytomegalovirus 1. Specific functions, and accordingly utilities, of VGAM2518 correlate with, and may be deduced from, the identity of the host target genes which VGAM2518 binds and inhibits, and the function of these host target genes, as elaborated hereinbelow.

Nucleotide sequences of the VGAM2518 precursor RNA, herein designated VGAM PRECURSOR RNA, and of the 'diced' VGAM2518 RNA, herein designated VGAM RNA, and a schematic representation of the secondary folding of VGAM2518 folded precursor RNA, herein designated VGAM FOLDED PRECURSOR RNA, of VGAM2518 are further described hereinbelow with reference to Table 1.

Nucleotide sequences of host target binding sites, such as BINDING SITE-I, BINDING SITE-II and BINDING SITE-III of FIG. 1, found on VGAM2518 host target RNA, and schematic representation of the complementarity of each of these host target binding sites to VGAM2518 RNA, herein designated VGAM RNA, are described hereinbelow with reference to Table 2.

As mentioned hereinabove with reference to FIG. 1, a function of VGAM2518 gene, herein designated VGAM is inhibition of expression of VGAM2518 target genes. It is appreciated that specific functions, and accordingly utilities, of VGAM2518 correlate with, and may be deduced from, the identity of the target genes which VGAM2518 binds and inhibits, and the function of these target genes, as elaborated hereinbelow.

Kallmann Syndrome 1 Sequence (KAL1, Accession NM_000216) is a VGAM2518 host target gene. KAL1 BINDING SITE is HOST TARGET binding site found in the 3' untranslated region of mRNA encoded by KAL1, corresponding to a HOST TARGET binding site such as BINDING SITE I, BINDING SITE II or BINDING SITE III. Table 2 illustrates the complementarity of the nucleotide sequences of KAL1 BINDING SITE, designated SEQ ID:5718, to the nucleotide sequence of VGAM2518 RNA, herein designated VGAM RNA, also designated SEQ ID:5229.

A function of VGAM2518 is therefore inhibition of Kallmann Syndrome 1 Sequence (KAL1, Accession NM_000216). Accordingly, utilities of VGAM2518 include diagnosis, prevention and treatment of diseases and clinical conditions associated with KAL1. Basic, Immunoglobulin-like Variable Motif Containing (BIVM, Accession NM_017693) is another VGAM2518 host target gene. BIVM BINDING SITE is HOST TARGET binding site found in the 5' untranslated region of mRNA encoded by BIVM, corresponding to a HOST TARGET binding site such as BINDING SITE I, BINDING SITE II or BINDING SITE III. Table 2 illustrates the complementarity of the nucleotide sequences of BIVM BINDING SITE, designated SEQ ID:19251, to the nucleotide sequence of VGAM2518 RNA, herein designated VGAM RNA, also designated SEQ ID:5229.

Another function of VGAM2518 is therefore inhibition of Basic, Immunoglobulin-like Variable Motif Containing (BIVM, Accession NM_017693). Accordingly, utilities of VGAM2518 include diagnosis, prevention and treatment of diseases and clinical conditions associated with BIVM. BOP (Accession XM_097915) is another VGAM2518 host target gene. BOP BINDING SITE is HOST TARGET binding site found in the 5' untranslated region of mRNA encoded by BOP, corresponding to a HOST TARGET binding site such as BINDING SITE I, BINDING SITE II or BINDING SITE III. Table 2 illustrates the complementarity of the nucleotide sequences of BOP BINDING SITE, designated SEQ ID:41208, to the nucleotide sequence of VGAM2518 RNA, herein designated VGAM RNA, also designated SEQ ID:5229.

Another function of VGAM2518 is therefore inhibition of BOP (Accession XM_097915). Accordingly, utilities of VGAM2518 include diagnosis, prevention and treatment of diseases and clinical conditions associated with BOP. KIAA1458 (Accession XM_044434) is another VGAM2518 host target gene. KIAA1458 BINDING SITE is HOST TARGET binding site found in the 3" untranslated region of mRNA encoded by KIAA1458, corresponding to a HOST TARGET binding site such as BINDING SITE I, BINDING SITE II or BINDING SITE III. Table 2 illustrates the complementarity of the nucleotide sequences of KIAA1458 BINDING SITE, designated SEQ ID:34207, to the nucleotide sequence of VGAM2518 RNA, herein designated VGAM RNA, also designated SEQ ID:5229.

Another function of VGAM2518 is therefore inhibition of KIAA1458 (Accession XM_044434). Accordingly, utilities of VGAM2518 include diagnosis, prevention and treatment of diseases and clinical conditions associated with KIAA1458. KIAA1829 (Accession XM_030378) is another VGAM2518 host target gene. KIAA1829 BINDING SITE is HOST TARGET binding site found in the 3' untranslated region of mRNA encoded by KIAA1829, corresponding to a HOST TARGET binding site such as BINDING SITE I, BINDING SITE II or BINDING SITE III. Table 2 illustrates the complementarity of the nucleotide sequences of KIAA1829 BINDING SITE, designated SEQ ID:31035, to the nucleotide sequence of VGAM2518 RNA, herein designated VGAM RNA, also designated SEQ ID:5229.

Another function of VGAM2518 is therefore inhibition of KIAA1829 (Accession XM_030378). Accordingly, utilities of VGAM2518 include diagnosis, prevention and treatment of diseases and clinical conditions associated with KIAA1829. MGC11082 (Accession NM_032691) is another VGAM2518 host target gene. MGC11082 BINDING SITE is HOST TARGET binding site found in the 5' untranslated region of mRNA encoded by MGC11082, corresponding to a HOST TARGET binding site such as BINDING SITE I, BINDING SITE II or BINDING SITE III. Table 2 illustrates the complementarity of the nucleotide sequences of MGC11082 BINDING SITE, designated SEQ ID:26412, to the nucleotide sequence of VGAM2518 RNA, herein designated VGAM RNA, also designated SEQ ID:5229.

Another function of VGAM2518 is therefore inhibition of MGC11082 (Accession NM_032691). Accordingly, utilities of VGAM2518 include diagnosis, prevention and treatment of diseases and clinical conditions associated with MGC11082. MGC4663 (Accession NM_024514) is another VGAM2518 host target gene. MGC4663 BINDING SITE is HOST TARGET binding site found in the 3' untranslated region of mRNA encoded by MGC4663, corresponding to a HOST TARGET binding site such as BINDING SITE I, BINDING SITE II or BINDING SITE III. Table 2 illustrates the complementarity of the nucleotide sequences of MGC4663 BINDING SITE, designated SEQ ID:23718, to the nucleotide sequence of VGAM2518 RNA, herein designated VGAM RNA, also designated SEQ ID:5229.

Another function of VGAM2518 is therefore inhibition of MGC4663 (Accession NM_024514). Accordingly, utilities of VGAM2518 include diagnosis, prevention and treatment of diseases and clinical conditions associated with MGC4663. Phosphodiesterase 4D Interacting Protein (myomegalin) (PDE4DIP, Accession NM_014644) is another VGAM2518 host target gene. PDE4DIP BINDING SITE is HOST TARGET binding site found in the 3' untranslated region of mRNA encoded by PDE4DIP, corresponding to a HOST TARGET binding site such as BINDING SITE I, BINDING SITE II or BINDING SITE III. Table 2 illustrates the complementarity of the nucleotide sequences of PDE4DIP BINDING SITE, designated SEQ ID:16050, to the nucleotide sequence of VGAM2518 RNA, herein designated VGAM RNA, also designated SEQ ID:5229.

Another function of VGAM2518 is therefore inhibition of Phosphodiesterase 4D Interacting Protein (myomegalin) (PDE4DIP, Accession NM_014644). Accordingly, utilities of VGAM2518 include diagnosis, prevention and treatment of diseases and clinical conditions associated with PDE4DIP. LOC120227 (Accession XM_058459) is another VGAM2518 host target gene. LOC120227 BINDING SITE is HOST TARGET binding site found in the 5' untranslated region of mRNA encoded by LOC120227, corresponding to a HOST TARGET binding site such as BINDING SITE I, BINDING SITE II or BINDING SITE III. Table 2 illustrates the complementarity of the nucleotide sequences of LOC120227 BINDING SITE, designated SEQ ID:36620, to the nucleotide sequence of VGAM2518 RNA, herein designated VGAM RNA, also designated SEQ ID:5229.

Another function of VGAM2518 is therefore inhibition of LOC120227 (Accession XM_058459). Accordingly, utilities of VGAM2518 include diagnosis, prevention and treatment of diseases and clinical conditions associated with LOC120227. LOC158318 (Accession XM_098925) is another VGAM2518 host target gene. LOC158318 BINDING SITE is HOST TARGET binding site found in the 5' untranslated region of mRNA encoded by LOC158318, corresponding to a HOST TARGET binding site such as BINDING SITE I, BINDING SITE II or BINDING SITE III. Table 2 illustrates the complementarity of the nucleotide sequences of LOC158318 BINDING SITE, designated SEQ ID:41957, to the nucleotide sequence of VGAM2518 RNA, herein designated VGAM RNA, also designated SEQ ID:5229.

Another function of VGAM2518 is therefore inhibition of LOC158318 (Accession XM_098925). Accordingly, utilities of VGAM2518 include diagnosis, prevention and treatment of diseases and clinical conditions associated with LOC158318. LOC158857 (Accession XM_098997) is another VGAM2518 host target gene. LOC158857 BINDING SITE is HOST TARGET binding site found in the 5' untranslated region of mRNA encoded by LOC158857, corresponding to a HOST TARGET binding site such as BINDING SITE I, BINDING SITE II or BINDING SITE III. Table 2 illustrates the complementarity of the nucleotide sequences of LOC158857 BINDING SITE, designated SEQ ID:42031, to the nucleotide sequence of VGAM2518 RNA, herein designated VGAM RNA, also designated SEQ ID:5229.

Another function of VGAM2518 is therefore inhibition of LOC158857 (Accession XM_098997). Accordingly, utilities of VGAM2518 include diagnosis, prevention and treatment of diseases and clinical conditions associated with LOC158857. LOC159049 (Accession XM_099020) is another VGAM2518 host target gene. LOC159049 BINDING SITE is HOST TARGET binding site found in the 5' untranslated region of mRNA encoded by LOC159049, corresponding to a HOST TARGET binding site such as BINDING SITE I, BINDING SITE II or BINDING SITE III. Table 2 illustrates the complementarity of the nucleotide sequences of LOC159049 BINDING SITE, designated SEQ ID:42057, to the nucleotide sequence of VGAM2518 RNA, herein designated VGAM RNA, also designated SEQ ID:5229.

Another function of VGAM2518 is therefore inhibition of LOC159049 (Accession XM_099020). Accordingly, utilities of VGAM2518 include diagnosis, prevention and treatment of diseases and clinical conditions associated with LOC159049. LOC200310 (Accession XM_037840) is another VGAM2518 host target gene. LOC200310 BINDING SITE is HOST TARGET binding site found in the 3' untranslated region of mRNA encoded by LOC200310, corresponding to a HOST TARGET binding site such as BINDING SITE I, BINDING SITE II or BINDING SITE III. Table 2 illustrates the complementarity of the nucleotide sequences of LOC200310 BINDING SITE, designated SEQ ID:32710, to the nucleotide sequence of VGAM2518 RNA, herein designated VGAM RNA, also designated SEQ ID:5229.

Another function of VGAM2518 is therefore inhibition of LOC200310 (Accession XM_037840). Accordingly, utilities of VGAM2518 include diagnosis, prevention and treatment of diseases and clinical conditions associated with LOC200310. LOC257443 (Accession XM_171072) is another VGAM2518 host target gene. LOC257443 BINDING SITE is HOST TARGET binding site found in the 3' untranslated region of mRNA encoded by LOC257443, corresponding to a HOST TARGET binding site such as BINDING SITE I, BINDING SITE II or BINDING SITE III. Table 2 illustrates the complementarity of the nucleotide sequences of LOC257443 BINDING SITE, designated SEQ ID:45875, to the nucleotide sequence of VGAM2518 RNA, herein designated VGAM RNA, also designated SEQ ID:5229.

Another function of VGAM2518 is therefore inhibition of LOC257443 (Accession XM_171072). Accordingly, utilities of VGAM2518 include diagnosis, prevention and treatment of diseases and clinical conditions associated with LOC257443. FIG. 1 further provides a conceptual description of a novel bioinformatically detected viral gene of the present invention, referred to here as Viral Genomic Address Messenger 2519 (VGAM2519) viral gene, which modulates expression of respective host target genes thereof, the function and utility of which host target genes is known in the art.

VGAM2519 is a novel bioinformatically detected regulatory, non protein coding, viral micro RNA (miRNA) gene. The method by which VGAM2519 was detected is described hereinabove with reference to FIGS. 1-8.

VGAM2519 gene, herein designated VGAM GENE, is a viral gene contained in the genome of Mouse Cytomegalovirus 1. VGAM2519 host target gene, herein designated VGAM HOST TARGET GENE, is a human gene contained in the human genome.

VGAM2519 gene encodes a VGAM2519 precursor RNA, herein designated VGAM PRECURSOR RNA. Similar to other miRNA genes, and unlike most ordinary genes, VGAM2519 precursor RNA does not encode a protein. A nucleotide sequence identical or highly similar to the nucleotide sequence of VGAM2519 precursor RNA is designated SEQ ID:2505, and is provided hereinbelow with reference to the sequence listing part. Nucleotide sequence SEQ ID:2505 is located at position 59910 relative to the genome of Mouse Cytomegalovirus 1.

VGAM2519 precursor RNA folds onto itself, forming VGAM2519 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2519 folded precursor RNA into VGAM2519 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM2519 RNA is designated SEQ ID:5230, and is provided hereinbelow with reference to the sequence listing part.

VGAM2519 host target gene, herein designated VGAM HOST TARGET GENE, encodes a corresponding messenger RNA, VGAM2519 host target RNA, herein designated VGAM HOST TARGET RNA. VGAM2519 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2519 RNA, herein designated VGAM RNA, binds complementarily to one or more host target binding sites located in untranslated regions of VGAM2519 host target RNA, herein designated VGAM HOST TARGET RNA. This complementary binding is due to the fact that the nucleotide sequence of VGAM2519 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2519 RNA, herein designated VGAM RNA, may have a different number of host target binding sites in untranslated regions of a VGAM2519 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2519 RNA, herein designated VGAM RNA, to host target binding sites on VGAM2519 host target RNA, herein designated VGAM HOST TARGET RNA, such as BINDING SITE I, BINDING SITE II and BINDING SITE III, inhibits translation of VGAM2519 host target RNA into VGAM2519 host target protein, herein designated VGAM HOST TARGET PROTEIN. VGAM host target protein is therefore outlined by a broken line.

It is appreciated that VGAM2519 host target gene, herein designated VGAM HOST TARGET GENE, in fact represents a plurality of VGAM2519 host target genes. The mRNA of each one of this plurality of VGAM2519 host target genes comprises one or more host target binding sites, each having a nucleotide sequence which is at least partly complementary to VGAM2519 RNA, herein designated VGAM RNA, and which when bound by VGAM2519 RNA causes inhibition of translation of respective one or more VGAM2519 host target proteins.

It is further appreciated by one skilled in the art that the mode of translational inhibition illustrated by FIG. 1 with specific reference to translational inhibition exerted by VGAM2519 gene, herein designated VGAM GENE, on one or more VGAM2519 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2519 is inhibition of expression of host target genes, as part of a novel viral mechanism of attacking a host. Accordingly, utilities of VGAM2519 include diagnosis, prevention and treatment of viral infection by Mouse Cytomegalovirus 1. Specific functions, and accordingly utilities, of VGAM2519 correlate with, and may be deduced from, the identity of the host target genes which VGAM2519 binds and inhibits, and the function of these host target genes, as elaborated hereinbelow.

Nucleotide sequences of the VGAM2519 precursor RNA, herein designated VGAM PRECURSOR RNA, and of the 'diced' VGAM2519 RNA, herein designated VGAM RNA, and a schematic representation of the secondary folding of VGAM2519 folded precursor RNA, herein designated VGAM FOLDED PRECURSOR RNA, of VGAM2519 are further described hereinbelow with reference to Table 1.

Nucleotide sequences of host target binding sites, such as BINDING SITE-I, BINDING SITE-II and BINDING SITE-III of FIG. 1, found on VGAM2519 host target RNA, and schematic representation of the complementarity of each of these host target binding sites to VGAM2519 RNA, herein designated VGAM RNA, are described hereinbelow with reference to Table 2.

As mentioned hereinabove with reference to FIG. 1, a function of VGAM2519 gene, herein designated VGAM is inhibition of expression of VGAM2519 target genes. It is appreciated that specific functions, and accordingly utilities, of VGAM2519 correlate with, and may be deduced from, the identity of the target genes which VGAM2519 binds and inhibits, and the function of these target genes, as elaborated hereinbelow.

KIAA0356 (Accession XM_038655) is a VGAM2519 host target gene. KIAA0356 BINDING SITE is HOST TARGET binding site found in the 3' untranslated region of mRNA encoded by KIAA0356, corresponding to a HOST TARGET binding site such as BINDING SITE I, BINDING SITE II or BINDING SITE III. Table 2 illustrates the complementarity of the nucleotide sequences of KIAA0356 BINDING SITE, designated SEQ ID:32892, to the nucleotide sequence of VGAM2519 RNA, herein designated VGAM RNA, also designated SEQ ID:5230.

A function of VGAM2519 is therefore inhibition of KIAA0356 (Accession XM_038655). Accordingly, utilities of VGAM2519 include diagnosis, prevention and treatment of diseases and clinical conditions associated with KIAA0356. LOC150295 (Accession XM_097868) is another VGAM2519 host target gene. LOC150295 BINDING SITE is HOST TARGET binding site found in the 3' untranslated region of mRNA encoded by LOC150295, corresponding to a HOST TARGET binding site such as BINDING SITE I, BINDING SITE II or BINDING SITE III. Table 2 illustrates the complementarity of the nucleotide sequences of LOC150295 BINDING SITE, designated SEQ ID:41178, to the nucleotide sequence of VGAM2519 RNA, herein designated VGAM RNA, also designated SEQ ID:5230.

Another function of VGAM2519 is therefore inhibition of LOC150295 (Accession XM_097868). Accordingly, utilities of VGAM2519 include diagnosis, prevention and treatment of diseases and clinical conditions associated with LOC150295. LOC219513 (Accession XM_169166) is another VGAM2519 host target gene. LOC219513 BINDING SITE is HOST TARGET binding site found in the 3' untranslated region of mRNA encoded by LOC219513, corresponding to a HOST TARGET binding site such as BINDING SITE I, BINDING SITE II or BINDING SITE III. Table 2 illustrates the complementarity of the nucleotide sequences of LOC219513 BINDING SITE, designated SEQ ID:45292, to the nucleotide sequence of VGAM2519 RNA, herein designated VGAM RNA, also designated SEQ ID:5230.

Another function of VGAM2519 is therefore inhibition of LOC219513 (Accession XM_169166). Accordingly, utilities of VGAM2519 include diagnosis, prevention and treatment of diseases and clinical conditions associated with LOC219513. FIG. 1 further provides a conceptual description of a novel bioinformatically detected viral gene of the present invention, referred to here as Viral Genomic Address Messenger 2520 (VGAM2520) viral gene, which modulates expression of respective host target genes thereof, the function and utility of which host target genes is known in the art.

VGAM2520 is a novel bioinformatically detected regulatory, non protein coding, viral micro RNA (miRNA) gene. The method by which VGAM2520 was detected is described hereinabove with reference to FIGS. 1-8.

VGAM2520 gene, herein designated VGAM GENE, is a viral gene contained in the genome of Mouse Cytomegalovirus 1. VGAM2520 host target gene, herein designated VGAM HOST TARGET GENE, is a human gene contained in the human genome.

VGAM2520 gene encodes a VGAM2520 precursor RNA, herein designated VGAM PRECURSOR RNA. Similar to other miRNA genes, and unlike most ordinary genes, VGAM2520 precursor RNA does not encode a protein. A nucleotide sequence identical or highly similar to the nucleotide sequence of VGAM2520 precursor RNA is designated SEQ ID:2506, and is provided hereinbelow with reference to the sequence listing part. Nucleotide sequence SEQ ID:2506 is located at position 173931 relative to the genome of Mouse Cytomegalovirus 1.

VGAM2520 precursor RNA folds onto itself, forming VGAM2520 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2520 folded precursor RNA into VGAM2520 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2520 RNA is designated SEQ ID:5231, and is provided hereinbelow with reference to the sequence listing part.

VGAM2520 host target gene, herein designated VGAM HOST TARGET GENE, encodes a corresponding messenger RNA, VGAM2520 host target RNA, herein designated VGAM HOST TARGET RNA. VGAM2520 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2520 RNA, herein designated VGAM RNA, binds complementarily to one or more host target binding sites located in untranslated regions of VGAM2520 host target RNA, herein designated VGAM HOST TARGET RNA. This complementary binding is due to the fact that the nucleotide sequence of VGAM2520 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2520 RNA, herein designated VGAM RNA, may have a different number of host target binding sites in untranslated regions of a VGAM2520 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2520 RNA, herein designated VGAM RNA, to host target binding sites on VGAM2520 host target RNA, herein designated VGAM HOST TARGET RNA, such as BINDING SITE I, BINDING SITE II and BINDING SITE III, inhibits translation of VGAM2520 host target RNA into VGAM2520 host target protein, herein designated VGAM HOST TARGET PROTEIN. VGAM host target protein is therefore outlined by a broken line.

It is appreciated that VGAM2520 host target gene, herein designated VGAM HOST TARGET GENE, in fact represents a plurality of VGAM2520 host target genes. The mRNA of each one of this plurality of VGAM2520 host target genes comprises one or more host target binding sites, each having a nucleotide sequence which is at least partly complementary to VGAM2520 RNA, herein designated VGAM RNA, and which when bound by VGAM2520 RNA causes inhibition of translation of respective one or more VGAM2520 host target proteins.

It is further appreciated by one skilled in the art that the mode of translational inhibition illustrated by FIG. 1 with specific reference to translational inhibition exerted by VGAM2520 gene, herein designated VGAM GENE, on one or more VGAM2520 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2520 is inhibition of expression of host target genes, as part of a novel viral mechanism of attacking a host. Accordingly, utilities of VGAM2520 include diagnosis, prevention and treatment of viral infection by Mouse Cytomegalovirus 1. Specific functions, and accordingly utilities, of VGAM2520 correlate with, and may be deduced from, the identity of the host target genes which VGAM2520 binds and inhibits, and the function of these target genes, as elaborated hereinbelow.

Nucleotide sequences of the VGAM2520 precursor RNA, herein designated VGAM PRECURSOR RNA, and of the 'diced' VGAM2520 RNA, herein designated VGAM RNA, and a schematic representation of the secondary folding of VGAM2520 folded precursor RNA, herein designated VGAM FOLDED PRECURSOR RNA, of VGAM2520 are further described hereinbelow with reference to Table 1.

Nucleotide sequences of host target binding sites, such as BINDING SITE-I, BINDING SITE-II and BINDING SITE-III of FIG. 1, found on VGAM2520 host target RNA, and schematic representation of the complementarity of each of these host target binding sites to VGAM2520 RNA, herein designated VGAM RNA, are described hereinbelow with reference to Table 2.

As mentioned hereinabove with reference to FIG. 1, a function of VGAM2520 gene, herein designated VGAM is inhibition of expression of VGAM2520 target genes. It is appreciated that specific functions, and accordingly utilities, of VGAM2520 correlate with, and may be deduced from, the identity of the target genes which VGAM2520 binds and inhibits, and the function of these target genes, as elaborated hereinbelow.

Breast Cancer 1, Early Onset (BRCA1, Accession NM_007295) is a VGAM2520 host target gene. BRCA1 BINDING SITE1 through BRCA1 BINDING SITE10 are HOST TARGET binding sites found in untranslated regions of mRNA encoded by BRCA1, corresponding to HOST TARGET binding sites such as BINDING SITE I, BINDING SITE II or BINDING SITE III. Table 2 illustrates the complementarity of the nucleotide sequences of BRCA1 BINDING SITE1 through BRCA1 BINDING SITE10, designated SEQ ID:14171, SEQ ID:14177, SEQ ID:14184, SEQ ID:14190, SEQ ID:14196, SEQ ID:14204, SEQ ID:14210, SEQ ID:14216, SEQ ID:14222 and SEQ ID:14165 respectively, to the nucleotide sequence of VGAM2520 RNA, herein designated VGAM RNA, also designated SEQ ID:5231.

A function of VGAM2520 is therefore inhibition of Breast Cancer 1, Early Onset (BRCA1, Accession NM_007295). Accordingly, utilities of VGAM2520 include diagnosis, prevention and treatment of diseases and clinical conditions associated with BRCA1. Heat Shock 70 kDa Protein 4 (HSPA4, Accession XM_114482) is another VGAM2520 host target gene. HSPA4 BINDING SITE is HOST TARGET binding site found in the 5' untranslated region of mRNA encoded by HSPA4, corresponding to a HOST TARGET binding site such as BINDING SITE I, BINDING SITE II or BINDING SITE III. Table 2 illustrates the complementarity of the nucleotide sequences of HSPA4 BINDING SITE, designated SEQ ID:42978, to the nucleotide sequence of VGAM2520 RNA, herein designated VGAM RNA, also designated SEQ ID:5231.

Another function of VGAM2520 is therefore inhibition of Heat Shock 70kDa Protein 4 (HSPA4, Accession XM_114482). Accordingly, utilities of VGAM2520 include diagnosis, prevention and treatment of diseases and clinical conditions associated with HSPA4. Regulatory Factor X, 5 (influences HLA class II expression) (RFX5, Accession NM_000449) is another VGAM2520 host target gene. RFX5 BINDING SITE is HOST TARGET binding site found in the 3' untranslated region of mRNA encoded by RFX5, corresponding to a HOST TARGET binding site such as BINDING SITE I, BINDING SITE II or BINDING SITE III. Table 2 illustrates the complementarity of the nucleotide sequences of RFX5 BINDING SITE, designated SEQ ID:6044, to the nucleotide sequence of VGAM2520 RNA, herein designated VGAM RNA, also designated SEQ ID:5231.

Another function of VGAM2520 is therefore inhibition of Regulatory Factor X, 5 (influences HLA class II expression) (RFX5, Accession NM_000449), a gene which activates transcription from class ii mhc promoters. Accordingly, utilities of VGAM2520 include diagnosis, prevention and treatment of diseases and clinical conditions associated with RFX5. The function of RFX5 and its association with various diseases and clinical conditions, has been established by previous studies, as described hereinabove with reference to VGAM55. Reticulon 3 (RTN3, Accession XM_058207) is another VGAM2520 host target gene. RTN3 BINDING SITE is HOST TARGET binding site found in the 3' untranslated region of mRNA encoded by RTN3, corresponding to a HOST TARGET binding site such as BINDING SITE I, BINDING SITE II or BINDING SITE III. Table 2 illustrates the complementarity of the nucleotide sequences of RTN3 BINDING SITE, designated SEQ ID:36585, to the nucleotide sequence of VGAM2520 RNA, herein designated VGAM RNA, also designated SEQ ID:5231.

Another function of VGAM2520 is therefore inhibition of Reticulon 3 (RTN3, Accession XM_058207), a gene which is a member of the reticulon (neuroendocrine-specific, NSP) family. Accordingly, utilities of VGAM2520 include diagnosis, prevention and treatment of diseases and clinical conditions associated with RTN3. The function of RTN3 and its association with various diseases and clinical conditions, has been established by previous studies, as described hereinabove with reference to VGAM596. Solute Carrier Family 7 (cationic amino acid transporter, y+ system), Member 5 (SLC7A5, Accession NM_003486) is another VGAM2520 host target gene. SLC7A5 BINDING SITE is HOST TARGET binding site found in the 3' untranslated region of mRNA encoded by SLC7A5, corresponding to a HOST TARGET binding site such as BINDING SITE I, BINDING SITE II or BINDING SITE III. Table 2 illustrates the complementarity of the nucleotide sequences of SLC7A5 BINDING SITE, designated SEQ ID:9578, to the nucleotide sequence of VGAM2520 RNA, herein designated VGAM RNA, also designated SEQ ID:5231.

Another function of VGAM2520 is therefore inhibition of Solute Carrier Family 7 (cationic amino acid transporter, y+ system), Member 5 (SLC7A5, Accession NM_003486), a gene which mediates transport of large and small neutral amino acids. Accordingly, utilities of VGAM2520 include diagnosis, prevention and treatment of diseases and clinical conditions associated with SLC7A5. The function of SLC7A5 and its association with various diseases and clinical conditions, has been established by previous studies, as described hereinabove with reference to VGAM430. Mitogen-activated Protein Kinase Kinase 5 (MAP2K5, Accession NM_002757) is another VGAM2520 host target gene. MAP2K5 BINDING SITE is HOST TARGET binding site found in the 5' untranslated region of mRNA encoded by MAP2K5, corresponding to a HOST TARGET binding site such as BINDING SITE I, BINDING SITE II or BINDING SITE III. Table 2 illustrates the complementarity of the nucleotide sequences of MAP2K5 BINDING SITE, designated SEQ ID:8638, to the nucleotide sequence of VGAM2520 RNA, herein designated VGAM RNA, also designated SEQ ID:5231.

Another function of VGAM2520 is therefore inhibition of Mitogen-activated Protein Kinase Kinase 5 (MAP2K5, Accession NM_002757). Accordingly, utilities of VGAM2520 include diagnosis, prevention and treatment of diseases and clinical conditions associated with MAP2K5. LOC132001 (Accession NM_138807) is another VGAM2520 host target gene. LOC132001 BINDING SITE is HOST TARGET binding site found in the 5' untranslated region of mRNA encoded by LOC132001, corresponding to a HOST TARGET binding site such as BINDING SITE I, BINDING SITE II or BINDING SITE III. Table 2 illustrates the complementarity of the nucleotide sequences of LOC132001 BINDING SITE, designated SEQ ID:29030, to the nucleotide sequence of VGAM2520 RNA, herein designated VGAM RNA, also designated SEQ ID:5231.

Another function of VGAM2520 is therefore inhibition of LOC132001 (Accession NM_138807). Accordingly, utilities of VGAM2520 include diagnosis, prevention and treatment of diseases and clinical conditions associated with LOC132001. LOC138050 (Accession XM_059937) is another VGAM2520 host target gene. LOC138050 BINDING SITE is HOST TARGET binding site found in the 5' untranslated region of mRNA encoded by LOC138050, corresponding to a HOST TARGET binding site such as BINDING SITE I, BINDING SITE II or BINDING SITE III. Table 2 illustrates the complementarity of the nucleotide sequences of LOC138050 BINDING SITE, designated SEQ ID:37116, to the nucleotide sequence of VGAM2520 RNA, herein designated VGAM RNA, also designated SEQ ID:5231.

Another function of VGAM2520 is therefore inhibition of LOC138050 (Accession XM_059937). Accordingly, utilities of VGAM2520 include diagnosis, prevention and treatment of diseases and clinical conditions associated with LOC138050. LOC146901 (Accession XM_097121) is another VGAM2520 host target gene. LOC146901 BINDING SITE is HOST TARGET binding site found in the 5' untranslated region of mRNA encoded by LOC146901, corresponding to a HOST TARGET binding site such as BINDING SITE I, BINDING SITE II or BINDING SITE III. Table 2 illustrates the complementarity of the nucleotide sequences of LOC146901 BINDING SITE, designated SEQ ID:40762, to the nucleotide sequence of VGAM2520 RNA, herein designated VGAM RNA, also designated SEQ ID:5231.

Another function of VGAM2520 is therefore inhibition of LOC146901 (Accession XM_097121). Accordingly, utilities of VGAM2520 include diagnosis, prevention and treatment of diseases and clinical conditions associated with LOC146901. LOC151516 (Accession XM_087229) is another VGAM2520 host target gene. LOC151516 BINDING SITE is HOST TARGET binding site found in the 5' untranslated region of mRNA encoded by LOC151516, corresponding to a HOST TARGET binding site such as BINDING SITE I, BINDING SITE II or BINDING SITE III. Table 2 illustrates the complementarity of the nucleotide sequences of LOC151516 BINDING SITE, designated SEQ ID:39130, to the nucleotide sequence of VGAM2520 RNA, herein designated VGAM RNA, also designated SEQ ID:5231.

Another function of VGAM2520 is therefore inhibition of LOC151516 (Accession XM_087229). Accordingly, utilities of VGAM2520 include diagnosis, prevention and treatment of diseases and clinical conditions associated with LOC151516. LOC165741 (Accession XM_105272) is another VGAM2520 host target gene. LOC165741 BINDING SITE is HOST TARGET binding site found in the 3' untranslated region of mRNA encoded by LOC165741, corresponding to a HOST TARGET binding site such as BINDING SITE I, BINDING SITE II or BINDING SITE III. Table 2 illustrates the complementarity of the nucleotide sequences of LOC165741 BINDING SITE, designated SEQ ID:42190, to the nucleotide sequence of VGAM2520 RNA, herein designated VGAM RNA, also designated SEQ ID:5231.

Another function of VGAM2520 is therefore inhibition of LOC165741 (Accession XM_105272). Accordingly, utilities of VGAM2520 include diagnosis, prevention and treatment of diseases and clinical conditions associated with LOC165741. LOC222008 (Accession XM_168361) is another VGAM2520 host target gene. LOC222008 BINDING SITE is HOST TARGET binding site found in the 3' untranslated region of mRNA encoded by LOC222008, corresponding to a HOST TARGET binding site such as BINDING SITE I, BINDING SITE II or BINDING SITE III. Table 2 illustrates the complementarity of the nucleotide sequences of LOC222008 BINDING SITE, designated SEQ ID:45124, to the nucleotide sequence of VGAM2520 RNA, herein designated VGAM RNA, also designated SEQ ID:5231.

Another function of VGAM2520 is therefore inhibition of LOC222008 (Accession XM_168361). Accordingly, utilities of VGAM2520 include diagnosis, prevention and treatment of diseases and clinical conditions associated with LOC222008. LOC253461 (Accession XM_172341) is another VGAM2520 host target gene. LOC253461 BINDING SITE is HOST TARGET binding site found in the 3' untranslated region of mRNA encoded by LOC253461, corresponding to a HOST TARGET binding site such as BINDING SITE I, BINDING SITE II or BINDING SITE III. Table 2 illustrates the complementarity of the nucleotide sequences of LOC253461 BINDING SITE, designated SEQ ID:46074, to the nucleotide sequence of VGAM2520 RNA, herein designated VGAM RNA, also designated SEQ ID:5231.

Another function of VGAM2520 is therefore inhibition of LOC253461 (Accession XM_172341). Accordingly, utilities of VGAM2520 include diagnosis, prevention and treatment of diseases and clinical conditions associated with LOC253461. FIG. 1 further provides a conceptual description of a novel bioinformatically detected viral gene of the present invention, referred to here as Viral Genomic Address Messenger 2521 (VGAM2521) viral gene, which modulates expression of respective host target genes thereof, the function and utility of which host target genes is known in the art.

VGAM2521 is a novel bioinformatically detected regulatory, non protein coding, viral micro RNA (miRNA) gene. The method by which VGAM2521 was detected is described hereinabove with reference to FIGS. 1-8.

VGAM2521 gene, herein designated VGAM GENE, is a viral gene contained in the genome of Mouse Cytomegalovirus 1. VGAM2521 host target gene, herein designated VGAM HOST TARGET GENE, is a human gene contained in the human genome.

VGAM2521 gene encodes a VGAM2521 precursor RNA, herein designated VGAM PRECURSOR RNA. Similar to other miRNA genes, and unlike most ordinary genes, VGAM2521 precursor RNA does not encode a protein. A nucleotide sequence identical or highly similar to the nucleotide sequence of VGAM2521 precursor RNA is designated SEQ ID:2507, and is provided hereinbelow with reference to the sequence listing part. Nucleotide sequence SEQ ID:2507 is located at position 9443 relative to the genome of Mouse Cytomegalovirus 1.

VGAM2521 precursor RNA folds onto itself, forming VGAM2521 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2521 folded precursor RNA into VGAM2521 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2521 RNA is designated SEQ ID:5232, and is provided hereinbelow with reference to the sequence listing part.

VGAM2521 host target gene, herein designated VGAM HOST TARGET GENE, encodes a corresponding messenger RNA, VGAM2521 host target RNA, herein designated VGAM HOST TARGET RNA. VGAM2521 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2521 RNA, herein designated VGAM RNA, binds complementarily to one or more host target binding sites located in untranslated regions of VGAM2521 host target RNA, herein designated VGAM HOST TARGET RNA. This complementary binding is due to the fact that the nucleotide sequence of VGAM2521 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2521 RNA, herein designated VGAM RNA, may have a different number of host target binding sites in untranslated regions of a VGAM2521 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2521 RNA, herein designated VGAM RNA, to host target binding sites on VGAM2521 host target RNA, herein designated VGAM HOST TARGET RNA, such as BINDING SITE I, BINDING SITE II and BINDING SITE III, inhibits translation of VGAM2521 host target RNA into VGAM2521 host target protein, herein designated VGAM HOST TARGET PROTEIN. VGAM host target protein is therefore outlined by a broken line.

It is appreciated that VGAM2521 host target gene, herein designated VGAM HOST TARGET GENE, in fact represents a plurality of VGAM2521 host target genes. The mRNA of each one of this plurality of VGAM2521 host target genes comprises one or more host target binding sites, each having a nucleotide sequence which is at least partly complementary to VGAM2521 RNA, herein designated VGAM RNA, and which when bound by VGAM2521 RNA causes inhibition of translation of respective one or more VGAM2521 host target proteins.

It is further appreciated by one skilled in the art that the mode of translational inhibition illustrated by FIG. 1 with specific reference to translational inhibition exerted by VGAM2521 gene, herein designated VGAM GENE, on one or more VGAM2521 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2521 is inhibition of expression of host target genes, as part of a novel viral mechanism of attacking a host. Accordingly, utilities of VGAM2521 include diagnosis, prevention and treatment of viral infection by Mouse Cytomegalovirus 1. Specific functions, and accordingly utilities, of VGAM2521 correlate with, and may be deduced from, the identity of the host target genes which VGAM2521 binds and inhibits, and the function of these host target genes, as elaborated hereinbelow.

Nucleotide sequences of the VGAM2521 precursor RNA, herein designated VGAM PRECURSOR RNA, and of the 'diced' VGAM2521 RNA, herein designated VGAM RNA, and a schematic representation of the secondary folding of VGAM2521 folded precursor RNA, herein designated VGAM FOLDED PRECURSOR RNA, of VGAM2521 are further described hereinbelow with reference to Table 1.

Nucleotide sequences of host target binding sites, such as BINDING SITE-I, BINDING SITE-II and BINDING SITE-III of FIG. 1, found on VGAM2521 host target RNA, and schematic representation of the complementarity of each of these host target binding sites to VGAM2521 RNA, herein designated VGAM RNA, are described hereinbelow with reference to Table 2.

As mentioned hereinabove with reference to FIG. 1, a function of VGAM2521 gene, herein designated VGAM is inhibition of expression of VGAM2521 target genes. It is appreciated that specific functions, and accordingly utilities, of VGAM2521 correlate with, and may be deduced from, the identity of the target genes which VGAM2521 binds and inhibits, and the function of these target genes, as elaborated hereinbelow.

SEC22 Vesicle Trafficking Protein-like 1 (S. cerevisiae) (SEC22L1, Accession NM_004892) is a VGAM2521 host target gene. SEC22L1 BINDING SITE is HOST TARGET binding site found in the 3' untranslated region of mRNA encoded by SEC22L1, corresponding to a HOST TARGET binding site such as BINDING SITE I, BINDING SITE II or BINDING SITE III. Table 2 illustrates the complementarity of the nucleotide sequences of SEC22L1 BINDING SITE, designated SEQ ID:11319, to the nucleotide sequence of VGAM2521 RNA, herein designated VGAM RNA, also designated SEQ ID:5232.

A function of VGAM2521 is therefore inhibition of SEC22 Vesicle Trafficking Protein-like 1 (S. cerevisiae) (SEC22L1, Accession NM_004892), a gene which may be involved in vesicle docking during transport between the ER and the Golgi apparatus. Accordingly, utilities of VGAM2521 include diagnosis, prevention and treatment of diseases and clinical conditions associated with SEC22L1. The function of SEC22L1 has been established by previous studies. In S. cerevisiae, the vesicle trafficking protein complexes directing transport between the endoplasmic reticulum (ER) and Golgi appear to include Sed5 (see OMIM Ref. No. syntaxin-5; 603189), proposed to be a cis-Golgi receptor protein, and Sec22 and Bet1 (OMIM Ref. No. 605456), potential Sed5 docking partners localized on ER-derived vesicles. The Sly1 protein may bind to and regulate the activity of Sed5 for docking with ER-derived vesicle proteins. See membrin (GOSR2; 604027). Hay et al. (1997) isolated a rat liver protein complex representing an intermediate in ER-to-Golgi transfer reactions. The complex contained syntaxin-5, GOS28 (OMIM Ref. No. 604026), the rat homologs of Bet1 and Sly1, and 2 novel proteins, rat sec22b and membrin. The authors isolated mouse sec22b cDNAs and determined that the sec22b protein is distinct from the previously identified rat sec22a protein. Sequence analysis revealed that mouse sec22b is a cytoplasmically oriented, C-terminally anchored integral membrane protein. By immunofluorescence of mammalian cells expressing epitope-tagged sec22b, Hay et al. (1997) found that sec22b and membrin accumulated primarily at the ER. Other members of the complex localized to Golgi membranes, indicating that the complex recapitulates vesicle docking between distinct organelles in the ER/Golgi transport cycle. Expression of recombinant membrin and sec22b disrupted normal trafficking, demonstrating that these proteins regulate ER-to-Golgi trafficking. Mao et al. (1998) identified an umbilical cord blood CD34-positive cell cDNA encoding the human homolog of sec22b. The predicted human protein contains 215 amino acids. To fuse transport vesicles with target membranes, proteins of the SNARE complex must be located on both the vesicle and the target membrane. In yeast, 4 integral membrane proteins, Sed5, Bos1, Sec22, and Bet1 each are believed to contribute a single helix to form the SNARE complex that is needed for transport from endoplasmic reticulum to Golgi. This generates a 4-helix bundle, which ultimately mediates the actual fusion event. Parlati et al. (2000) explored how the anchoring arrangement of the 4 helices affects their ability to mediate fusion. Parlati et al. (2000) reconstituted 2 populations of phospholipid bilayer vesicles, with the individual SNARE proteins distributed in all possible combinations between them. Of the 8 nonredundant permutations of 4 subunits distributed over 2 vesicle populations, only 1 resulted in membrane fusion. Fusion occurred only when the v-SNARE Bet1 is on 1 membrane and the syntaxin heavy chain Sed5 and its 2 light chains, Bos1 and Sec22, are on the other membrane, where they form a functional t-SNARE. Thus, each SNARE protein is topologically restricted by design to function either as a v-SNARE or as part of a t-SNARE complex.

Full details of the abovementioned studies are described in the following publications, the disclosure of which are hereby incorporated by reference:

Mao, M.; Fu, G.; Wu, J.-S.; Zhang, Q.-H.; Zhou, J.; Kan, L.-X.; Huang, Q.-H.; He, K.-L.; Gu, B.-W.; Han, Z.-G.; Shen, Y.; Gu, J.; Yu, Y.-P.; Xu, S.-H.; Wang, Y.-X.; Chen, S.-J.; Chen, Z.: Identification of genes expressed in human CD34+ hematopoietic stem/progenitor cells by expressed sequence tags and efficient full-length cDNA cloning. Proc. Nat. Acad. Sci. 95:8175-8180, 1998; and Parlati, F.; McNew, J. A.; Fukuda, R.; Miller, R.; Sollner, T. H.; Rothman, J. E.: Topological restriction of SNARE-dependent membrane fusion. Nature 407:194-198, 2000.

Further studies establishing the function and utilities of SEC22L1 are found in John Hopkins OMIM database record ID 604029, and in sited publications numbered 763 and 8801 listed in the bibliography section hereinbelow, which are also hereby incorporated by reference. KIAA0189 (Accession NM_014725) is another VGAM2521 host target gene. KIAA0189 BINDING SITE is HOST TARGET binding site found in the 3' untranslated region of mRNA encoded by KIAA0189, corresponding to a HOST TARGET binding site such as BINDING SITE I, BINDING SITE II or BINDING SITE III. Table 2 illustrates the complementarity of the nucleotide sequences of KIAA0189 BINDING SITE, designated SEQ ID:16315, to the nucleotide sequence of VGAM2521 RNA, herein designated VGAM RNA, also designated SEQ ID:5232.

Another function of VGAM2521 is therefore inhibition of KIAA0189 (Accession NM_014725). Accordingly, utilities of VGAM2521 include diagnosis, prevention and treatment of diseases and clinical conditions associated with KIAA0189. PRO1598 (Accession NM_018503) is another VGAM2521 host target gene. PRO1598 BINDING SITE is HOST TARGET binding site found in the 5' untranslated region of mRNA encoded by PRO1598, corresponding to a HOST TARGET binding site such as BINDING SITE I, BINDING SITE II or BINDING SITE III. Table 2 illustrates the complementarity of the nucleotide sequences of PRO1598 BINDING SITE, designated SEQ ID:20570, to the nucleotide sequence of VGAM2521 RNA, herein designated VGAM RNA, also designated SEQ ID:5232.

Another function of VGAM2521 is therefore inhibition of PRO1598 (Accession NM_018503). Accordingly, utilities of VGAM2521 include diagnosis, prevention and treatment of diseases and clinical conditions associated with PRO1598.

FIG. 1 further provides a conceptual description of a novel bioinformatically detected viral gene of the present invention, referred to here as Viral Genomic Address Messenger 2522 (VGAM2522) viral gene, which modulates expression of respective host target genes thereof, the function and utility of which host target genes is known in the art.

VGAM2522 is a novel bioinformatically detected regulatory, non protein coding, viral micro RNA (miRNA) gene. The method by which VGAM2522 was detected is described hereinabove with reference to FIGS. 1-8.

VGAM2522 gene, herein designated VGAM GENE, is a viral gene contained in the genome of Mouse Cytomegalovirus 1. VGAM2522 host target gene, herein designated VGAM HOST TARGET GENE, is a human gene contained in the human genome.

VGAM2522 gene encodes a VGAM2522 precursor RNA, herein designated VGAM PRECURSOR RNA. Similar to other miRNA genes, and unlike most ordinary genes, VGAM2522 precursor RNA does not encode a protein. A nucleotide sequence identical or highly similar to the nucleotide sequence of VGAM2522 precursor RNA is designated SEQ ID:2508, and is provided hereinbelow with reference to the sequence listing part. Nucleotide sequence SEQ ID:2508 is located at position 116189 relative to the genome of Mouse Cytomegalovirus 1.

VGAM2522 precursor RNA folds onto itself, forming VGAM2522 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2522 folded precursor RNA into VGAM2522 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2522 RNA is designated SEQ ID:5233, and is provided hereinbelow with reference to the sequence listing part.

VGAM2522 host target gene, herein designated VGAM HOST TARGET GENE, encodes a corresponding messenger RNA, VGAM2522 host target RNA, herein designated VGAM HOST TARGET RNA. VGAM2522 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2522 RNA, herein designated VGAM RNA, binds complementarily to one or more host target binding sites located in untranslated regions of VGAM2522 host target RNA, herein designated VGAM HOST TARGET RNA. This complementary binding is due to the fact that the nucleotide sequence of VGAM2522 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2522 RNA, herein designated VGAM RNA, may have a different number of host target binding sites in untranslated regions of a VGAM2522 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2522 RNA, herein designated VGAM RNA, to host target binding sites on VGAM2522 host target RNA, herein designated VGAM HOST TARGET RNA, such as BINDING SITE I, BINDING SITE II and BINDING SITE III, inhibits translation of VGAM2522 host target RNA into VGAM2522 host target protein, herein designated VGAM HOST TARGET PROTEIN. VGAM host target protein is therefore outlined by a broken line.

It is appreciated that VGAM2522 host target gene, herein designated VGAM HOST TARGET GENE, in fact represents a plurality of VGAM2522 host target genes. The mRNA of each one of this plurality of VGAM2522 host target genes comprises one or more host target binding sites, each having a nucleotide sequence which is at least partly complementary to VGAM2522 RNA, herein designated VGAM RNA, and which when bound by VGAM2522 RNA causes inhibition of translation of respective one or more VGAM2522 host target proteins.

It is further appreciated by one skilled in the art that the mode of translational inhibition illustrated by FIG. 1 with specific reference to translational inhibition exerted by VGAM2522 gene, herein designated VGAM GENE, on one or more VGAM2522 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2522 is inhibition of expression of host target genes, as part of a novel viral mechanism of attacking a host. Accordingly, utilities of VGAM2522 include diagnosis, prevention and treatment of viral infection by Mouse Cytomegalovirus 1. Specific functions, and accordingly utilities, of VGAM2522 correlate with, and may be deduced from, the identity of the host target genes which VGAM2522 binds and inhibits, and the function of these host target genes, as elaborated hereinbelow.

Nucleotide sequences of the VGAM2522 precursor RNA, herein designated VGAM PRECURSOR RNA, and of the 'diced' VGAM2522 RNA, herein designated VGAM RNA, and a schematic representation of the secondary folding of VGAM2522 folded precursor RNA, herein designated VGAM FOLDED PRECURSOR RNA, of VGAM2522 are further described hereinbelow with reference to Table 1.

Nucleotide sequences of host target binding sites, such as BINDING SITE-I, BINDING SITE-II and BINDING SITE-III of FIG. 1, found on VGAM2522 host target RNA, and schematic representation of the complementarity of each of these host target binding sites to VGAM2522 RNA, herein designated VGAM RNA, are described hereinbelow with reference to Table 2.

As mentioned hereinabove with reference to FIG. 1, a function of VGAM2522 gene, herein designated VGAM is inhibition of expression of VGAM2522 target genes. It is appreciated that specific functions, and accordingly utilities, of VGAM2522 correlate with, and may be deduced from, the identity of the target genes which VGAM2522 binds and inhibits, and the function of these target genes, as elaborated hereinbelow.

Cullin 4B (CUL4B, Accession NM_003588) is a VGAM2522 host target gene. CUL4B BINDING SITE is HOST TARGET binding site found in the 3' untranslated region of mRNA encoded by CUL4B, corresponding to a HOST TARGET binding site such as BINDING SITE I, BINDING SITE II or BINDING SITE III. Table 2 illustrates the complementarity of the nucleotide sequences of CUL4B BINDING SITE, designated SEQ ID:9641, to the nucleotide sequence of VGAM2522 RNA, herein designated VGAM RNA, also designated SEQ ID:5233.

A function of VGAM2522 is therefore inhibition of Cullin 4B (CUL4B, Accession NM_003588), a gene which is a negative regulator of the cell cycle in C. elegans. Accordingly, utilities of VGAM2522 include diagnosis, prevention and treatment of diseases and clinical conditions associated with CUL4B. The function of CUL4B and its association with various diseases and clinical conditions, has been established by previous studies, as described hereinabove with reference to VGAM140. Protein Tyrosine Phosphatase, Non-receptor Type 9 (PTPN9, Accession NM_002833) is another VGAM2522 host target gene. PTPN9 BINDING SITE is HOST TARGET binding site found in the 3' untranslated region of mRNA encoded by PTPN9, corresponding to a HOST TARGET binding site such as BINDING SITE I, BINDING SITE II or BINDING SITE III. Table 2 illustrates the complementarity of the nucleotide sequences of PTPN9 BINDING SITE, designated SEQ ID:8711, to the nucleotide sequence of VGAM2522 RNA, herein designated VGAM RNA, also designated SEQ ID:5233.

Another function of VGAM2522 is therefore inhibition of Protein Tyrosine Phosphatase, Non-receptor Type 9 (PTPN9, Accession NM_002833). Accordingly, utilities of VGAM2522 include diagnosis, prevention and treatment of diseases and clinical conditions associated with PTPN9. Synaptosomal-associated Protein, 29 kDa (SNAP29, Accession NM_004782) is another VGAM2522 host target gene. SNAP29 BINDING SITE is HOST TARGET binding site found in the 3' untranslated region of mRNA encoded by SNAP29, corresponding to a HOST TARGET binding site such as BINDING SITE I, BINDING SITE II or BINDING SITE III. Table 2 illustrates the complementarity of the nucleotide sequences of SNAP29 BINDING SITE, designated SEQ ID:11184, to the nucleotide sequence of VGAM2522 RNA, herein designated VGAM RNA, also designated SEQ ID:5233.

Another function of VGAM2522 is therefore inhibition of Synaptosomal-associated Protein, 29 kDa (SNAP29, Accession NM_004782). Accordingly, utilities of VGAM2522 include diagnosis, prevention and treatment of diseases and clinical conditions associated with SNAP29. LOC254559 (Accession XM_172931) is another VGAM2522 host target gene. LOC254559 BINDING SITE is HOST TARGET binding site found in the 5' untranslated region of mRNA encoded by LOC254559, corresponding to a HOST TARGET binding site such as BINDING SITE I, BINDING SITE II or BINDING SITE III. Table 2 illustrates the complementarity of the nucleotide sequences of LOC254559 BINDING SITE, designated SEQ ID:46196, to the nucleotide sequence of VGAM2522 RNA, herein designated VGAM RNA, also designated SEQ ID:5233.

Another function of VGAM2522 is therefore inhibition of LOC254559 (Accession XM_172931). Accordingly, utilities of VGAM2522 include diagnosis, prevention and treatment of diseases and clinical conditions associated with LOC254559. FIG. 1 further provides a conceptual description of a novel bioinformatically detected viral gene of the present invention, referred to here as Viral Genomic Address Messenger 2523 (VGAM2523) viral gene, which modulates expression of respective host target genes thereof, the function and utility of which host target genes is known in the art.

VGAM2523 is a novel bioinformatically detected regulatory, non protein coding, viral micro RNA (miRNA) gene. The method by which VGAM2523 was detected is described hereinabove with reference to FIGS. 1-8.

VGAM2523 gene, herein designated VGAM GENE, is a viral gene contained in the genome of Mouse Cytomegalovirus 1. VGAM2523 host target gene, herein designated VGAM HOST TARGET GENE, is a human gene contained in the human genome.

VGAM2523 gene encodes a VGAM2523 precursor RNA, herein designated VGAM PRECURSOR RNA. Similar to other miRNA genes, and unlike most ordinary genes, VGAM2523 precursor RNA does not encode a protein. A nucleotide sequence identical or highly similar to the nucleotide sequence of VGAM2523 precursor RNA is designated SEQ ID:2509, and is provided hereinbelow with reference to the sequence listing part. Nucleotide sequence SEQ ID:2509 is located at position 122311 relative to the genome of Mouse Cytomegalovirus 1.

VGAM2523 precursor RNA folds onto itself, forming VGAM2523 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2523 folded precursor RNA into VGAM2523 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM2523 RNA is designated SEQ ID:5234, and is provided hereinbelow with reference to the sequence listing part.

VGAM2523 host target gene, herein designated VGAM HOST TARGET GENE, encodes a corresponding messenger RNA, VGAM2523 host target RNA, herein designated VGAM HOST TARGET RNA. VGAM2523 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2523 RNA, herein designated VGAM RNA, binds complementarily to one or more host target binding sites located in untranslated regions of VGAM2523 host target RNA, herein designated VGAM HOST TARGET RNA. This complementary binding is due to the fact that the nucleotide sequence of VGAM2523 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2523 RNA, herein designated VGAM RNA, may have a different number of host target binding sites in untranslated regions of a VGAM2523 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2523 RNA, herein designated VGAM RNA, to host target binding sites on VGAM2523 host target RNA, herein designated VGAM HOST TARGET RNA, such as BINDING SITE I, BINDING SITE II and BINDING SITE III, inhibits translation of VGAM2523 host target RNA into VGAM2523 host target protein, herein designated VGAM HOST TARGET PROTEIN. VGAM host target protein is therefore outlined by a broken line.

It is appreciated that VGAM2523 host target gene, herein designated VGAM HOST TARGET GENE, in fact represents a plurality of VGAM2523 host target genes. The mRNA of each one of this plurality of VGAM2523 host target genes comprises one or more host target binding sites, each having a nucleotide sequence which is at least partly complementary to VGAM2523 RNA, herein designated VGAM RNA, and which when bound by VGAM2523 RNA causes inhibition of translation of respective one or more VGAM2523 host target proteins.

It is further appreciated by one skilled in the art that the mode of translational inhibition illustrated by FIG. 1 with specific reference to translational inhibition exerted by VGAM2523 gene, herein designated VGAM GENE, on one or more VGAM2523 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2523 is inhibition of expression of host target genes, as part of a novel viral mechanism of attacking a host. Accordingly, utilities of VGAM2523 include diagnosis, prevention and treatment of viral infection by Mouse Cytomegalovirus 1. Specific functions, and accordingly utilities, of VGAM2523 correlate with, and may be deduced from, the identity of the host target genes which VGAM2523 binds and inhibits, and the function of these host target genes, as elaborated hereinbelow.

Nucleotide sequences of the VGAM2523 precursor RNA, herein designated VGAM PRECURSOR RNA, and of the 'diced' VGAM2523 RNA, herein designated VGAM RNA, and a schematic representation of the secondary folding of VGAM2523 folded precursor RNA, herein designated VGAM FOLDED PRECURSOR RNA, of VGAM2523 are further described hereinbelow with reference to Table 1.

Nucleotide sequences of host target binding sites, such as BINDING SITE-I, BINDING SITE-II and BINDING SITE-III of FIG. 1, found on VGAM2523 host target RNA, and schematic representation of the complementarity of each of these host target binding sites to VGAM2523 RNA, herein designated VGAM RNA, are described hereinbelow with reference to Table 2.

As mentioned hereinabove with reference to FIG. 1, a function of VGAM2523 gene, herein designated VGAM is inhibition of expression of VGAM2523 target genes. It is appreciated that specific functions, and accordingly utilities, of VGAM2523 correlate with, and may be deduced from, the identity of the target genes which VGAM2523 binds and inhibits, and the function of these target genes, as elaborated hereinbelow.

Proteoglycan 2, Bone Marrow (natural killer cell activator, eosinophil granule major basic protein) (PRG2, Accession NM_002728) is a VGAM2523 host target gene. PRG2 BINDING SITE is HOST TARGET binding site found in the 5' untranslated region of mRNA encoded by PRG2, corresponding to a HOST TARGET binding site such as BINDING SITE I, BINDING SITE II or BINDING SITE III. Table 2 illustrates the complementarity of the nucleotide sequences of PRG2 BINDING SITE, designated SEQ ID:8593, to the nucleotide sequence of VGAM2523 RNA, herein designated VGAM RNA, also designated SEQ ID:5234.

A function of VGAM2523 is therefore inhibition of Proteoglycan 2, Bone Marrow (natural killer cell activator, eosinophil granule major basic protein) (PRG2, Accession NM_002728), a gene which Myelin basic protein; a constituent of myelin, plays a role in nerve function. Accordingly, utilities of VGAM2523 include diagnosis, prevention and treatment of diseases and clinical conditions associated with PRG2. The function of PRG2 and its association with various diseases and clinical conditions, has been established by previous studies, as described hereinabove with reference to VGAM1845. FIG. 1 further provides a conceptual description of a novel bioinformatically detected viral gene of the present invention, referred to here as Viral Genomic Address Messenger 2524 (VGAM2524) viral gene, which modulates expression of respective host target genes thereof, the function and utility of which host target genes is known in the art.

VGAM2524 is a novel bioinformatically detected regulatory, non protein coding, viral micro RNA (miRNA) gene. The method by which VGAM2524 was detected is described hereinabove with reference to FIGS. 1-8.

VGAM2524 gene, herein designated VGAM GENE, is a viral gene contained in the genome of Mouse Cytomegalovirus 1. VGAM2524 host target gene, herein designated VGAM HOST TARGET GENE, is a human gene contained in the human genome.

VGAM2524 gene encodes a VGAM2524 precursor RNA, herein designated VGAM PRECURSOR RNA. Similar to other miRNA genes, and unlike most ordinary genes, VGAM2524 precursor RNA does not encode a protein. A nucleotide sequence identical or highly similar to the nucleotide sequence of VGAM2524 precursor RNA is designated SEQ ID:2510, and is provided hereinbelow with reference to the sequence listing part. Nucleotide sequence SEQ ID:2510 is located at position 180093 relative to the genome of Mouse Cytomegalovirus 1.

VGAM2524 precursor RNA folds onto itself, forming VGAM2524 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2524 folded precursor RNA into VGAM2524 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2524 RNA is designated SEQ ID:5235, and is provided hereinbelow with reference to the sequence listing part.

VGAM2524 host target gene, herein designated VGAM HOST TARGET GENE, encodes a corresponding messenger RNA, VGAM2524 host target RNA, herein designated VGAM HOST TARGET RNA. VGAM2524 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2524 RNA, herein designated VGAM RNA, binds complementarily to one or more host target binding sites located in untranslated regions of VGAM2524 host target RNA, herein designated VGAM HOST TARGET RNA. This complementary binding is due to the fact that the nucleotide sequence of VGAM2524 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2524 RNA, herein designated VGAM RNA, may have a different number of host target binding sites in untranslated regions of a VGAM2524 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2524 RNA, herein designated VGAM RNA, to host target binding sites on VGAM2524 host target RNA, herein designated VGAM HOST TARGET RNA, such as BINDING SITE I, BINDING SITE II and BINDING SITE III, inhibits translation of VGAM2524 host target RNA into VGAM2524 host target protein, herein designated VGAM HOST TARGET PROTEIN. VGAM host target protein is therefore outlined by a broken line.

It is appreciated that VGAM2524 host target gene, herein designated VGAM HOST TARGET GENE, in fact represents a plurality of VGAM2524 host target genes. The mRNA of each one of this plurality of VGAM2524 host target genes comprises one or more host target binding sites, each having a nucleotide sequence which is at least partly complementary to VGAM2524 RNA, herein designated VGAM RNA, and which when bound by VGAM2524 RNA causes inhibition of translation of respective one or more VGAM2524 host target proteins.

It is further appreciated by one skilled in the art that the mode of translational inhibition illustrated by FIG. 1 with specific reference to translational inhibition exerted by VGAM2524 gene, herein designated VGAM GENE, on one or more VGAM2524 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2524 is inhibition of expression of host target genes, as part of a novel viral mechanism of attacking a host. Accordingly, utilities of VGAM2524 include diagnosis, prevention and treatment of viral infection by Mouse Cytomegalovirus 1. Specific functions, and accordingly utilities, of VGAM2524 correlate with, and may be deduced from, the identity of the host target genes which VGAM2524 binds and inhibits, and the function of these host target genes, as elaborated hereinbelow.

Nucleotide sequences of the VGAM2524 precursor RNA, herein designated VGAM PRECURSOR RNA, and of the 'diced' VGAM2524 RNA, herein designated VGAM RNA, and a schematic representation of the secondary folding of VGAM2524 folded precursor RNA, herein designated VGAM FOLDED PRECURSOR RNA, of VGAM2524 are further described hereinbelow with reference to Table 1.

Nucleotide sequences of host target binding sites, such as BINDING SITE-I, BINDING SITE-II and BINDING SITE-III of FIG. 1, found on VGAM2524 host target RNA, and schematic representation of the complementarity of each of these host target binding sites to VGAM2524 RNA, herein designated VGAM RNA, are described hereinbelow with reference to Table 2.

As mentioned hereinabove with reference to FIG. 1, a function of VGAM2524 gene, herein designated VGAM is inhibition of expression of VGAM2524 target genes. It is appreciated that specific functions, and accordingly utilities, of VGAM2524 correlate with, and may be deduced from, the identity of the target genes which VGAM2524 binds and inhibits, and the function of these target genes, as elaborated hereinbelow.

Collagen, Type XIX, Alpha 1 (COL19A1, Accession NM_001858) is a VGAM2524 host target gene. COL19A1 BINDING SITE is HOST TARGET binding site found in the 3' untranslated region of mRNA encoded by COL19A1, corresponding to a HOST TARGET binding site such as BINDING SITE I, BINDING SITE II or BINDING SITE III. Table 2 illustrates the complementarity of the nucleotide sequences of COL19A1 BINDING SITE, designated SEQ ID:7597, to the nucleotide sequence of VGAM2524 RNA, herein designated VGAM RNA, also designated SEQ ID:5235.

A function of VGAM2524 is therefore inhibition of Collagen, Type XIX, Alpha 1 (COL19A1, Accession NM_001858), a gene which may act as a cross-bridge between fibrils and other extracellular matrix molecules. Accordingly, utilities of VGAM2524 include diagnosis, prevention and treatment of diseases and clinical conditions associated with COL19A1. The function of COL19A1 and its association with various diseases and clinical conditions, has been established by previous studies, as described hereinabove with reference to VGAM19. Endoglin (Osler-Rendu-Weber syndrome 1) (ENG, Accession NM_000118) is another VGAM2524 host target gene. ENG BINDING SITE is HOST TARGET binding site found in the 3' untranslated region of mRNA encoded by ENG, corresponding to a HOST TARGET binding site such as BINDING SITE I, BINDING SITE II or BINDING SITE III. Table 2 illustrates the complementarity of the nucleotide sequences of ENG BINDING SITE, designated SEQ ID:5595, to the nucleotide sequence of VGAM2524 RNA, herein designated VGAM RNA, also designated SEQ ID:5235.

Another function of VGAM2524 is therefore inhibition of Endoglin (Osler-Rendu-Weber syndrome 1) (ENG, Accession NM_000118). Accordingly, utilities of VGAM2524 include diagnosis, prevention and treatment of diseases and clinical conditions associated with ENG. High-mobility Group Nucleosomal Binding Domain 2 (HMGN2, Accession NM_005517) is another VGAM2524 host target gene. HMGN2 BINDING SITE is HOST TARGET binding site found in the 3' untranslated region of mRNA encoded by HMGN2, corresponding to a HOST TARGET binding site such as BINDING SITE I, BINDING SITE II or BINDING SITE III. Table 2 illustrates the complementarity of the nucleotide sequences of HMGN2 BINDING SITE, designated SEQ ID:12041, to the nucleotide sequence of VGAM2524 RNA, herein designated VGAM RNA, also designated SEQ ID:5235.

Another function of VGAM2524 is therefore inhibition of High-mobility Group Nucleosomal Binding Domain 2 (HMGN2, Accession NM_005517), a gene which binds HMG proteins and may confer specific conformations to transcriptionally active regions of chromatin. Accordingly, utilities of VGAM2524 include diagnosis, prevention and treatment of diseases and clinical conditions associated with HMGN2. The function of HMGN2 and its association with various diseases and clinical conditions, has been established by previous studies, as described hereinabove with reference to VGAM2461. Interleukin 1 Family, Member 5 (delta) (IL1F5, Accession NM_012275) is another VGAM2524 host target gene. IL1F5 BINDING SITE1 and IL1F5 BINDING SITE2 are HOST TARGET binding sites found in untranslated regions of mRNA encoded by IL1F5, corresponding to HOST TARGET binding sites such as BINDING SITE I, BINDING SITE II or BINDING SITE III. Table 2 illustrates the complementarity of the nucleotide sequences of IL1F5 BINDING SITE1 and IL1F5 BINDING SITE2, designated SEQ ID:14601 and SEQ ID:14602 respectively, to the nucleotide sequence of VGAM2524 RNA, herein designated VGAM RNA, also designated SEQ ID:5235.

Another function of VGAM2524 is therefore inhibition of Interleukin 1 Family, Member 5 (delta) (IL1F5, Accession NM_012275), a gene which is a novel interleukin-1 receptor antagonist gene. Accordingly, utilities of VGAM2524 include diagnosis, prevention and treatment of diseases and clinical conditions associated with IL1F5. The function of IL1F5 and its association with various diseases and clinical conditions, has been established by previous studies, as described hereinabove with reference to VGAM263. Activator of Basal Transcription 1 (ABT1, Accession NM_013375) is another VGAM2524 host target gene. ABT1 BINDING SITE is HOST TARGET binding site found in the 3' untranslated region of mRNA encoded by ABT1, corresponding to a HOST TARGET binding site such as BINDING SITE I, BINDING SITE II or BINDING SITE III. Table 2 illustrates the complementarity of the nucleotide sequences of ABT1 BINDING SITE, designated SEQ ID:15030, to the nucleotide sequence of VGAM2524 RNA, herein designated VGAM RNA, also designated SEQ ID:5235.

Another function of VGAM2524 is therefore inhibition of Activator of Basal Transcription 1 (ABT1, Accession NM_013375). Accordingly, utilities of VGAM2524 include diagnosis, prevention and treatment of diseases and clinical conditions associated with ABT1. DKFZP434K1421 (Accession NM_032141) is another VGAM2524 host target gene. DKFZP434K1421 BINDING SITE is HOST TARGET binding site found in the 3' untranslated region of mRNA encoded by DKFZP434K1421, corresponding to a HOST TARGET binding site such as BINDING SITE I, BINDING SITE II or BINDING SITE III. Table 2 illustrates the complementarity of the nucleotide sequences of DKFZP434K1421 BINDING SITE, designated SEQ ID:25823, to the nucleotide sequence of VGAM2524 RNA, herein designated VGAM RNA, also designated SEQ ID:5235.

Another function of VGAM2524 is therefore inhibition of DKFZP434K1421 (Accession NM_032141). Accordingly, utilities of VGAM2524 include diagnosis, prevention and treatment of diseases and clinical conditions associated with DKFZP434K1421. DKFZP761F241 (Accession NM_031455) is another VGAM2524 host target gene. DKFZP761F241 BINDING SITE is HOST TARGET binding site found in the 3' untranslated region of mRNA encoded by DKFZP761F241, corresponding to a HOST TARGET binding site such as BINDING SITE I, BINDING SITE II or BINDING SITE III. Table 2 illustrates the complementarity of the nucleotide sequences of DKFZP761F241 BINDING SITE, designated SEQ ID:25477, to the nucleotide sequence of VGAM2524 RNA, herein designated VGAM RNA, also designated SEQ ID:5235.

Another function of VGAM2524 is therefore inhibition of DKFZP761F241 (Accession NM_031455). Accordingly, utilities of VGAM2524 include diagnosis, prevention and treatment of diseases and clinical conditions associated with DKFZP761F241. FLJ12903 (Accession NM_022753) is another VGAM2524 host target gene. FLJ12903 BINDING SITE is HOST TARGET binding site found in the 3' untranslated region of mRNA encoded by FLJ12903, corresponding to a HOST TARGET binding site such as BINDING SITE I, BINDING SITE II or BINDING SITE III. Table 2 illustrates the complementarity of the nucleotide sequences of FLJ12903 BINDING SITE, designated SEQ ID:22980, to the nucleotide sequence of VGAM2524 RNA, herein designated VGAM RNA, also designated SEQ ID:5235.

Another function of VGAM2524 is therefore inhibition of FLJ12903 (Accession NM_022753). Accordingly, utilities of VGAM2524 include diagnosis, prevention and treatment of diseases and clinical conditions associated with FLJ12903. KIAA0430 (Accession NM_019081) is another VGAM2524 host target gene. KIAA0430 BINDING SITE is HOST TARGET binding site found in the 3' untranslated region of mRNA encoded by KIAA0430, corresponding to a HOST TARGET binding site such as BINDING SITE I, BINDING SITE II or BINDING SITE III. Table 2 illustrates the complementarity of the nucleotide sequences of KIAA0430 BINDING SITE, designated SEQ ID:21149, to the nucleotide sequence of VGAM2524 RNA, herein designated VGAM RNA, also designated SEQ ID:5235.

Another function of VGAM2524 is therefore inhibition of KIAA0430 (Accession NM_019081). Accordingly, utilities of VGAM2524 include diagnosis, prevention and treatment of diseases and clinical conditions associated with KIAA0430. KIAA0676 (Accession NM_015043) is another VGAM2524 host target gene. KIAA0676 BINDING SITE is HOST TARGET binding site found in the 3' untranslated region of mRNA encoded by KIAA0676, corresponding to a HOST TARGET binding site such as BINDING SITE I, BINDING SITE II or BINDING SITE III. Table 2 illustrates the complementarity of the nucleotide sequences of KIAA0676 BINDING SITE, designated SEQ ID:17393, to the nucleotide sequence of VGAM2524 RNA, herein designated VGAM RNA, also designated SEQ ID:5235.

Another function of VGAM2524 is therefore inhibition of KIAA0676 (Accession NM_015043). Accordingly, utilities of VGAM2524 include diagnosis, prevention and treatment of diseases and clinical conditions associated with KIAA0676. KIAA1036 (Accession NM_014909) is another VGAM2524 host target gene. KIAA1036 BINDING SITE is HOST TARGET binding site found in the 3' untranslated region of mRNA encoded by KIAA1036, corresponding to a HOST TARGET binding site such as BINDING SITE I, BINDING SITE II or BINDING SITE III. Table 2 illustrates the complementarity of the nucleotide sequences of KIAA1036 BINDING SITE, designated SEQ ID:17132, to the nucleotide sequence of VGAM2524 RNA, herein designated VGAM RNA, also designated SEQ ID:5235.

Another function of VGAM2524 is therefore inhibition of KIAA1036 (Accession NM_014909). Accordingly, utilities of VGAM2524 include diagnosis, prevention and treatment of diseases and clinical conditions associated with KIAA1036. KIAA1393 (Accession XM_050793) is another VGAM2524 host target gene. KIAA1393 BINDING SITE is HOST TARGET binding site found in the 3' untranslated region of mRNA encoded by KIAA1393, corresponding to a HOST TARGET binding site such as BINDING SITE I, BINDING SITE II or BINDING SITE III. Table 2 illustrates the complementarity of the nucleotide sequences of KIAA1393 BINDING SITE, designated SEQ ID:35688, to the nucleotide sequence of VGAM2524 RNA, herein designated VGAM RNA, also designated SEQ ID:5235.

Another function of VGAM2524 is therefore inhibition of KIAA1393 (Accession XM_050793). Accordingly, utilities of VGAM2524 include diagnosis, prevention and treatment of diseases and clinical conditions associated with KIAA1393. Postmeiotic Segregation Increased 2-like 3 (PMS2L3, Accession XM_049100) is another VGAM2524 host target gene. PMS2L3 BINDING SITE is HOST TARGET binding site found in the 5' untranslated region of mRNA encoded by PMS2L3, corresponding to a HOST TARGET binding site such as BINDING SITE I, BINDING SITE II or BINDING SITE III. Table 2 illustrates the complementarity of the nucleotide sequences of PMS2L3 BINDING SITE, designated SEQ ID:35342, to the nucleotide sequence of VGAM2524 RNA, herein designated VGAM RNA, also designated SEQ ID:5235.

Another function of VGAM2524 is therefore inhibition of Postmeiotic Segregation Increased 2-like 3 (PMS2L3, Accession XM_049100). Accordingly, utilities of VGAM2524 include diagnosis, prevention and treatment of diseases and clinical conditions associated with PMS2L3. Uronyl-2-sulfotransferase (UST, Accession NM_005715) is another VGAM2524 host target gene. UST BINDING SITE is HOST TARGET binding site found in the 3' untranslated region of mRNA encoded by UST, corresponding to a HOST TARGET binding site such as BINDING SITE I, BINDING SITE II or BINDING SITE III. Table 2 illustrates the complementarity of the nucleotide sequences of UST BINDING SITE, designated SEQ ID:12271, to the nucleotide sequence of VGAM2524 RNA, herein designated VGAM RNA, also designated SEQ ID:5235.

Another function of VGAM2524 is therefore inhibition of Uronyl-2-sulfotransferase (UST, Accession NM_005715). Accordingly, utilities of VGAM2524 include diagnosis, prevention and treatment of diseases and clinical conditions associated with UST. LOC115343 (Accession XM_050640) is another VGAM2524 host target gene. LOC115343 BINDING SITE is HOST TARGET binding site found in the 5' untranslated region of mRNA encoded by LOC115343, corresponding to a HOST TARGET binding site such as BINDING SITE I, BINDING SITE II or BINDING SITE III. Table 2 illustrates the complementarity of the nucleotide sequences of LOC115343 BINDING SITE, designated SEQ ID:35667, to the nucleotide sequence of VGAM2524 RNA, herein designated VGAM RNA, also designated SEQ ID:5235.

Another function of VGAM2524 is therefore inhibition of LOC115343 (Accession XM_050640). Accordingly, utilities of VGAM2524 include diagnosis, prevention and treatment of diseases and clinical conditions associated with LOC115343. LOC145268 (Accession XM_085072) is another VGAM2524 host target gene. LOC145268 BINDING SITE is HOST TARGET binding site found in the 5' untranslated region of mRNA encoded by LOC145268, corresponding to a HOST TARGET binding site such as BINDING SITE I, BINDING SITE II or BINDING SITE III. Table 2 illustrates the complementarity of the nucleotide sequences of LOC145268 BINDING SITE, designated SEQ ID:37811, to the nucleotide sequence of VGAM2524 RNA, herein designated VGAM RNA, also designated SEQ ID:5235.

Another function of VGAM2524 is therefore inhibition of LOC145268 (Accession XM_085072). Accordingly, utilities of VGAM2524 include diagnosis, prevention and treatment of diseases and clinical conditions associated with LOC145268. LOC152212 (Accession XM_096198) is another VGAM2524 host target gene. LOC152212 BINDING SITE is HOST TARGET binding site found in the 3' untranslated region of mRNA encoded by LOC152212, corresponding to a HOST TARGET binding site such as BINDING SITE I, BINDING SITE II or BINDING SITE III. Table 2 illustrates the complementarity of the nucleotide sequences of LOC152212 BINDING SITE, designated SEQ ID:40308, to the nucleotide sequence of VGAM2524 RNA, herein designated VGAM RNA, also designated SEQ ID:5235.

Another function of VGAM2524 is therefore inhibition of LOC152212 (Accession XM_096198). Accordingly, utilities of VGAM2524 include diagnosis, prevention and treatment of diseases and clinical conditions associated with LOC152212. LOC152267 (Accession XM_017070) is another VGAM2524 host target gene. LOC152267 BINDING SITE is HOST TARGET binding site found in the 3' untranslated region of mRNA encoded by LOC152267, corresponding to a HOST TARGET binding site such as BINDING SITE I, BINDING SITE II or BINDING SITE III. Table 2 illustrates the complementarity of the nucleotide sequences of LOC152267 BINDING SITE, designated SEQ ID:30295, to the nucleotide sequence of VGAM2524 RNA, herein designated VGAM RNA, also designated SEQ ID:5235.

Another function of VGAM2524 is therefore inhibition of LOC152267 (Accession XM_017070). Accordingly, utilities of VGAM2524 include diagnosis, prevention and treatment of diseases and clinical conditions associated with LOC152267. LOC158382 (Accession XM_098931) is another VGAM2524 host target gene. LOC158382 BINDING SITE is HOST TARGET binding site found in the 3' untranslated region of mRNA encoded by LOC158382, corresponding to a HOST TARGET binding site such as BINDING SITE I, BINDING SITE II or BINDING SITE III. Table 2 illustrates the complementarity of the nucleotide sequences of LOC158382 BINDING SITE, designated SEQ ID:41963, to the nucleotide sequence of VGAM2524 RNA, herein designated VGAM RNA, also designated SEQ ID:5235.

Another function of VGAM2524 is therefore inhibition of LOC158382 (Accession XM_098931). Accordingly, utilities of VGAM2524 include diagnosis, prevention and treatment of diseases and clinical conditions associated with LOC158382. LOC220926 (Accession XM_166128) is another VGAM2524 host target gene. LOC220926 BINDING SITE is HOST TARGET binding site found in the 5' untranslated region of mRNA encoded by LOC220926, corresponding to a HOST TARGET binding site such as BINDING SITE I, BINDING SITE II or BINDING SITE III. Table 2 illustrates the complementarity of the nucleotide sequences of LOC220926 BINDING SITE, designated SEQ ID:43917, to the nucleotide sequence of VGAM2524 RNA, herein designated VGAM RNA, also designated SEQ ID:5235.

Another function of VGAM2524 is therefore inhibition of LOC220926 (Accession XM_166128). Accordingly, utilities of VGAM2524 include diagnosis, prevention and treatment of diseases and clinical conditions associated with LOC220926. LOC222189 (Accession XM_168447) is another VGAM2524 host target gene. LOC222189 BINDING SITE is HOST TARGET binding site found in the 5' untranslated region of mRNA encoded by LOC222189, corresponding to a HOST TARGET binding site such as BINDING SITE I, BINDING SITE II or BINDING SITE III. Table 2 illustrates the complementarity of the nucleotide sequences of LOC222189 BINDING SITE, designated SEQ ID:45188, to the nucleotide sequence of VGAM2524 RNA, herein designated VGAM RNA, also designated SEQ ID:5235.

Another function of VGAM2524 is therefore inhibition of LOC222189 (Accession XM_168447). Accordingly, utilities of VGAM2524 include diagnosis, prevention and treatment of diseases and clinical conditions associated with LOC222189. LOC90371 (Accession XM_031261) is another VGAM2524 host target gene. LOC90371 BINDING SITE is HOST TARGET binding site found in the 3' untranslated region of mRNA encoded by LOC90371, corresponding to a HOST TARGET binding site such as BINDING SITE I, BINDING SITE II or BINDING SITE III. Table 2 illustrates the complementarity of the nucleotide sequences of LOC90371 BINDING SITE, designated SEQ ID:31322, to the nucleotide sequence of VGAM2524 RNA, herein designated VGAM RNA, also designated SEQ ID:5235.

Another function of VGAM2524 is therefore inhibition of LOC90371 (Accession XM_031261). Accordingly, utilities of VGAM2524 include diagnosis, prevention and treatment of diseases and clinical conditions associated with LOC90371. FIG. 1 further provides a conceptual description of a novel bioinformatically detected viral gene of the present invention, referred to here as Viral Genomic Address Messenger 2525 (VGAM2525) viral gene, which modulates expression of respective host target genes thereof, the function and utility of which host target genes is known in the art.

VGAM2525 is a novel bioinformatically detected regulatory, non protein coding, viral micro RNA (miRNA) gene. The method by which VGAM2525 was detected is described hereinabove with reference to FIGS. 1-8.

VGAM2525 gene, herein designated VGAM GENE, is a viral gene contained in the genome of Mouse Cytomegalovirus 1. VGAM2525 host target gene, herein designated VGAM HOST TARGET GENE, is a human gene contained in the human genome.

VGAM2525 gene encodes a VGAM2525 precursor RNA, herein designated VGAM PRECURSOR RNA. Similar to other miRNA genes, and unlike most ordinary genes, VGAM2525 precursor RNA does not encode a protein. A nucleotide sequence identical or highly similar to the nucleotide sequence of VGAM2525 precursor RNA is designated SEQ ID:2511, and is provided hereinbelow with reference to the sequence listing part. Nucleotide sequence SEQ ID:2511 is located at position 213327 relative to the genome of Mouse Cytomegalovirus 1.

VGAM2525 precursor RNA folds onto itself, forming VGAM2525 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2525 folded precursor RNA into VGAM2525 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2525 RNA is designated SEQ ID:5236, and is provided hereinbelow with reference to the sequence listing part.

VGAM2525 host target gene, herein designated VGAM HOST TARGET GENE, encodes a corresponding messenger RNA, VGAM2525 host target RNA, herein designated VGAM HOST TARGET RNA. VGAM2525 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2525 RNA, herein designated VGAM RNA, binds complementarily to one or more host target binding sites located in untranslated regions of VGAM2525 host target RNA, herein designated VGAM HOST TARGET RNA. This complementary binding is due to the fact that the nucleotide sequence of VGAM2525 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2525 RNA, herein designated VGAM RNA, may have a different number of host target binding sites in untranslated regions of a VGAM2525 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2525 RNA, herein designated VGAM RNA, to host target binding sites on VGAM2525 host target RNA, herein designated VGAM HOST TARGET RNA, such as BINDING SITE I, BINDING SITE II and BINDING SITE III, inhibits translation of VGAM2525 host target RNA into VGAM2525 host target protein, herein designated VGAM HOST TARGET PROTEIN. VGAM host target protein is therefore outlined by a broken line.

It is appreciated that VGAM2525 host target gene, herein designated VGAM HOST TARGET GENE, in fact represents a plurality of VGAM2525 host target genes. The mRNA of each one of this plurality of VGAM2525 host target genes comprises one or more host target binding sites, each having a nucleotide sequence which is at least partly complementary to VGAM2525 RNA, herein designated VGAM RNA, and which when bound by VGAM2525 RNA causes inhibition of translation of respective one or more VGAM2525 host target proteins.

It is further appreciated by one skilled in the art that the mode of translational inhibition illustrated by FIG. 1 with specific reference to translational inhibition exerted by VGAM2525 gene, herein designated VGAM GENE, on one or more VGAM2525 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2525 is inhibition of expression of host target genes, as part of a novel viral mechanism of attacking a host. Accordingly, utilities of VGAM2525 include diagnosis, prevention and treatment of viral infection by Mouse Cytomegalovirus 1. Specific functions, and accordingly utilities, of VGAM2525 correlate with, and may be deduced from, the identity of the host target genes which VGAM2525 binds and inhibits, and the function of these host target genes, as elaborated hereinbelow.

Nucleotide sequences of the VGAM2525 precursor RNA, herein designated VGAM PRECURSOR RNA, and of the 'diced' VGAM2525 RNA, herein designated VGAM RNA, and a schematic representation of the secondary folding of VGAM2525 folded precursor RNA, herein designated VGAM FOLDED PRECURSOR RNA, of VGAM2525 are further described hereinbelow with reference to Table 1.

Nucleotide sequences of host target binding sites, such as BINDING SITE-I, BINDING SITE-II and BINDING SITE-III of FIG. 1, found on VGAM2525 host target RNA, and schematic representation of the complementarity of each of these host target binding sites to VGAM2525 RNA, herein designated VGAM RNA, are described hereinbelow with reference to Table 2.

As mentioned hereinabove with reference to FIG. 1, a function of VGAM2525 gene, herein designated VGAM is inhibition of expression of VGAM2525 target genes. It is appreciated that specific functions, and accordingly utilities, of VGAM2525 correlate with, and may be deduced from, the identity of the target genes which VGAM2525 binds and inhibits, and the function of these target genes, as elaborated hereinbelow.

Dystroglycan 1 (dystrophin-associated glycoprotein 1) (DAG1, Accession NM_004393) is a VGAM2525 host target gene. DAG1 BINDING SITE is HOST TARGET binding site found in the 3' untranslated region of mRNA encoded by DAG1, corresponding to a HOST TARGET binding site such as BINDING SITE I, BINDING SITE II or BINDING SITE III. Table 2 illustrates the complementarity of the nucleotide sequences of DAG1 BINDING SITE, designated SEQ ID:10631, to the nucleotide sequence of VGAM2525 RNA, herein designated VGAM RNA, also designated SEQ ID:5236.

A function of VGAM2525 is therefore inhibition of Dystroglycan 1 (dystrophin-associated glycoprotein 1) (DAG1, Accession NM_004393), a gene which may provide linkage between the sarcolemma and extracellular matrix (ECM). Accordingly, utilities of VGAM2525 include diagnosis, prevention and treatment of diseases and clinical conditions associated with DAG1. The function of DAG1 and its association with various diseases and clinical conditions, has been established by previous studies, as described hereinabove with reference to VGAM1095. Diacylglycerol Kinase, Delta 130 kDa (DGKD, Accession XM_002384) is another VGAM2525 host target gene. DGKD BINDING SITE is HOST TARGET binding site found in the 3' untranslated region of mRNA encoded by DGKD, corresponding to a HOST TARGET binding site such as BINDING SITE I, BINDING SITE II or BINDING SITE III. Table 2 illustrates the complementarity of the nucleotide sequences of DGKD BINDING SITE, designated SEQ ID:29876, to the nucleotide sequence of VGAM2525 RNA, herein designated VGAM RNA, also designated SEQ ID:5236.

Another function of VGAM2525 is therefore inhibition of Diacylglycerol Kinase, Delta 130 kDa (DGKD, Accession XM_002384). Accordingly, utilities of VGAM2525 include diagnosis, prevention and treatment of diseases and clinical conditions associated with DGKD. KIAA0746 (Accession XM_045277) is another VGAM2525 host target gene. KIAA0746 BINDING SITE is HOST TARGET binding site found in the 5' untranslated region of mRNA encoded by KIAA0746, corresponding to a HOST TARGET binding site such as BINDING SITE I, BINDING SITE II or BINDING SITE III. Table 2 illustrates the complementarity of the nucleotide sequences of KIAA0746 BINDING SITE, designated SEQ ID:34413, to the nucleotide sequence of VGAM2525 RNA, herein designated VGAM RNA, also designated SEQ ID:5236.

Another function of VGAM2525 is therefore inhibition of KIAA0746 (Accession XM_045277). Accordingly, utilities of VGAM2525 include diagnosis, prevention and treatment of diseases and clinical conditions associated with KIAA0746. FIG. 1 further provides a conceptual description of a novel bioinformatically detected viral gene of the present invention, referred to here as Viral Genomic Address Messenger 2526 (VGAM2526) viral gene, which modulates expression of respective host target genes thereof, the function and utility of which host target genes is known in the art.

VGAM2526 is a novel bioinformatically detected regulatory, non protein coding, viral micro RNA (miRNA) gene. The method by which VGAM2526 was detected is described hereinabove with reference to FIGS. 1-8.

VGAM2526 gene, herein designated VGAM GENE, is a viral gene contained in the genome of Mouse Cytomegalovirus 1. VGAM2526 host target gene, herein designated VGAM HOST TARGET GENE, is a human gene contained in the human genome.

VGAM2526 gene encodes a VGAM2526 precursor RNA, herein designated VGAM PRECURSOR RNA. Similar to other miRNA genes, and unlike most ordinary genes, VGAM2526 precursor RNA does not encode a protein. A nucleotide sequence identical or highly similar to the nucleotide sequence of VGAM2526 precursor RNA is designated SEQ ID:2512, and is provided hereinbelow with reference to the sequence listing part. Nucleotide sequence SEQ ID:2512 is located at position 85449 relative to the genome of Mouse Cytomegalovirus 1.

VGAM2526 precursor RNA folds onto itself, forming VGAM2526 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2526 folded precursor RNA into VGAM2526 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2526 RNA is designated SEQ ID:5237, and is provided hereinbelow with reference to the sequence listing part.

VGAM2526 host target gene, herein designated VGAM HOST TARGET GENE, encodes a corresponding messenger RNA, VGAM2526 host target RNA, herein designated VGAM HOST TARGET RNA. VGAM2526 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2526 RNA, herein designated VGAM RNA, binds complementarily to one or more host target binding sites located in untranslated regions of VGAM2526 host target RNA, herein designated VGAM HOST TARGET RNA. This complementary binding is due to the fact that the nucleotide sequence of VGAM2526 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2526 RNA, herein designated VGAM RNA, may have a different number of host target binding sites in untranslated regions of a VGAM2526 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2526 RNA, herein designated VGAM RNA, to host target binding sites on VGAM2526 host target RNA, herein designated VGAM HOST TARGET RNA, such as BINDING SITE I, BINDING SITE II and BINDING SITE III, inhibits translation of VGAM2526 host target RNA into VGAM2526 host target protein, herein designated VGAM HOST TARGET PROTEIN. VGAM host target protein is therefore outlined by a broken line.

It is appreciated that VGAM2526 host target gene, herein designated VGAM HOST TARGET GENE, in fact represents a plurality of VGAM2526 host target genes. The mRNA of each one of this plurality of VGAM2526 host target genes comprises one or more host target binding sites, each having a nucleotide sequence which is at least partly complementary to VGAM2526 RNA, herein designated VGAM RNA, and which when bound by VGAM2526 RNA causes inhibition of translation of respective one or more VGAM2526 host target proteins.

It is further appreciated by one skilled in the art that the mode of translational inhibition illustrated by FIG. 1 with specific reference to translational inhibition exerted by VGAM2526 gene, herein designated VGAM GENE, on one or more VGAM2526 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2526 is inhibition of expression of host target genes, as part of a novel viral mechanism of attacking a host. Accordingly, utilities of VGAM2526 include diagnosis, prevention and treatment of viral infection by Mouse Cytomegalovirus 1. Specific functions, and accordingly utilities, of VGAM2526 correlate with, and may be deduced from, the identity of the host target genes which VGAM2526 binds and inhibits, and the function of these host target genes, as elaborated hereinbelow.

Nucleotide sequences of the VGAM2526 precursor RNA, herein designated VGAM PRECURSOR RNA, and of the 'diced' VGAM2526 RNA, herein designated VGAM RNA, and a schematic representation of the secondary folding of VGAM2526 folded precursor RNA, herein designated VGAM FOLDED PRECURSOR RNA, of VGAM2526 are further described hereinbelow with reference to Table 1.

Nucleotide sequences of host target binding sites, such as BINDING SITE-I, BINDING SITE-II and BINDING SITE-III of FIG. 1, found on VGAM2526 host target RNA, and schematic representation of the complementarity of each of these host target binding sites to VGAM2526 RNA, herein designated VGAM RNA, are described hereinbelow with reference to Table 2.

As mentioned hereinabove with reference to FIG. 1, a function of VGAM2526 gene, herein designated VGAM is inhibition of expression of VGAM2526 target genes. It is appreciated that specific functions, and accordingly utilities, of VGAM2526 correlate with, and may be deduced from, the identity of the target genes which VGAM2526 binds and inhibits, and the function of these target genes, as elaborated hereinbelow.

Myeloid/lymphoid Or Mixed-lineage Leukemia (trithorax homolog, Drosophila); Translocated To, 2 (MLLT2, Accession NM_005935) is a VGAM2526 host target gene. MLLT2 BINDING SITE is HOST TARGET binding site found in the 3' untranslated region of mRNA encoded by MLLT2, corresponding to a HOST TARGET binding site such as BINDING SITE I, BINDING SITE II or BINDING SITE III. Table 2 illustrates the complementarity of the nucleotide sequences of MLLT2 BINDING SITE, designated SEQ ID:12566, to the nucleotide sequence of VGAM2526 RNA, herein designated VGAM RNA, also designated SEQ ID:5237.

A function of VGAM2526 is therefore inhibition of Myeloid/lymphoid Or Mixed-lineage Leukemia (trithorax homolog, Drosophila); Translocated To, 2 (MLLT2, Accession NM_005935), a gene which is a Putative transcription factor. Accordingly, utilities of VGAM2526 include diagnosis, prevention and treatment of diseases and clinical conditions associated with MLLT2. The function of MLLT2 and its association with various diseases and clinical conditions, has been established by previous studies, as described hereinabove with reference to VGAM57. SH3-domain GRB2-like 1 (SH3GL1, Accession NM_003025) is another VGAM2526 host target gene. SH3GL1 BINDING SITE is HOST TARGET binding site found in the 3' untranslated region of mRNA encoded by SH3GL1, corresponding to a HOST TARGET binding site such as BINDING SITE I, BINDING SITE II or BINDING SITE III. Table 2 illustrates the complementarity of the nucleotide sequences of SH3GL1 BINDING SITE, designated SEQ ID:8959, to the nucleotide sequence of VGAM2526 RNA, herein designated VGAM RNA, also designated SEQ ID:5237.

Another function of VGAM2526 is therefore inhibition of SH3-domain GRB2-like 1 (SH3GL1, Accession NM_003025). Accordingly, utilities of VGAM2526 include diagnosis, prevention and treatment of diseases and clinical conditions associated with SH3GL1. FLJ13576 (Accession NM_022484) is another VGAM2526 host target gene. FLJ13576 BINDING SITE is HOST TARGET binding site found in the 5' untranslated region of mRNA encoded by FLJ13576, corresponding to a HOST TARGET binding site such as BINDING SITE I, BINDING SITE II or BINDING SITE III. Table 2 illustrates the complementarity of the nucleotide sequences of FLJ13576 BINDING SITE, designated SEQ ID:22860, to the nucleotide sequence of VGAM2526 RNA, herein designated VGAM RNA, also designated SEQ ID:5237.

Another function of VGAM2526 is therefore inhibition of FLJ13576 (Accession NM_022484). Accordingly, utilities of VGAM2526 include diagnosis, prevention and treatment of diseases and clinical conditions associated with FLJ13576. FLJ13769 (Accession NM_025012) is another VGAM2526 host target gene. FLJ13769 BINDING SITE is HOST TARGET binding site found in the 3' untranslated region of mRNA encoded by FLJ13769, corresponding to a HOST TARGET binding site such as BINDING SITE I, BINDING SITE II or BINDING SITE III. Table 2 illustrates the complementarity of the nucleotide sequences of FLJ13769 BINDING SITE, designated SEQ ID:24594, to the nucleotide sequence of VGAM2526 RNA, herein designated VGAM RNA, also designated SEQ ID:5237.

Another function of VGAM2526 is therefore inhibition of FLJ13769 (Accession NM_025012). Accordingly, utilities of VGAM2526 include diagnosis, prevention and treatment of diseases and clinical conditions associated with FLJ13769. PRO2964 (Accession NM_018547) is another VGAM2526 host target gene. PRO2964 BINDING SITE is HOST TARGET binding site found in the 3' untranslated region of mRNA encoded by PRO2964, corresponding to a HOST TARGET binding site such as BINDING SITE I, BINDING SITE II or BINDING SITE III. Table 2 illustrates the complementarity of the nucleotide sequences of PRO2964 BINDING SITE, designated SEQ ID:20629, to the nucleotide sequence of VGAM2526 RNA, herein designated VGAM RNA, also designated SEQ ID:5237.

Another function of VGAM2526 is therefore inhibition of PRO2964 (Accession NM_018547). Accordingly, utilities of VGAM2526 include diagnosis, prevention and treatment of diseases and clinical conditions associated with PRO2964. LOC145368 (Accession XM_085112) is another VGAM2526 host target gene. LOC145368 BINDING SITE is HOST TARGET binding site found in the 3' untranslated region of mRNA encoded by LOC145368, corresponding to a HOST TARGET binding site such as BINDING SITE I, BINDING SITE II or BINDING SITE III. Table 2 illustrates the complementarity of the nucleotide sequences of LOC145368 BINDING SITE, designated SEQ ID:37825, to the nucleotide sequence of VGAM2526 RNA, herein designated VGAM RNA, also designated SEQ ID:5237.

Another function of VGAM2526 is therefore inhibition of LOC145368 (Accession XM_085112). Accordingly, utilities of VGAM2526 include diagnosis, prevention and treatment of diseases and clinical conditions associated with LOC145368. LOC150423 (Accession XM_086912) is another VGAM2526 host target gene. LOC150423 BINDING SITE is HOST TARGET binding site found in the 3' untranslated region of mRNA encoded by LOC150423, corresponding to a HOST TARGET binding site such as BINDING SITE I, BINDING SITE II or BINDING SITE III. Table 2 illustrates the complementarity of the nucleotide sequences of LOC150423 BINDING SITE, designated SEQ ID:38966, to the nucleotide sequence of VGAM2526 RNA, herein designated VGAM RNA, also designated SEQ ID:5237.

Another function of VGAM2526 is therefore inhibition of LOC150423 (Accession XM_086912). Accordingly, utilities of VGAM2526 include diagnosis, prevention and treatment of diseases and clinical conditions associated with LOC150423. LOC158055 (Accession XM_088453) is another VGAM2526 host target gene. LOC158055 BINDING SITE is HOST TARGET binding site found in the 3' untranslated region of mRNA encoded by LOC158055, corresponding to a HOST TARGET binding site such as BINDING SITE I, BINDING SITE II or BINDING SITE III. Table 2 illustrates the complementarity of the nucleotide sequences of LOC158055 BINDING SITE, designated SEQ ID:39701, to the nucleotide sequence of VGAM2526 RNA, herein designated VGAM RNA, also designated SEQ ID:5237.

Another function of VGAM2526 is therefore inhibition of LOC158055 (Accession XM_088453). Accordingly, utilities of VGAM2526 include diagnosis, prevention and treatment of diseases and clinical conditions associated with LOC158055. LOC197117 (Accession XM_116989) is another VGAM2526 host target gene. LOC197117 BINDING SITE is HOST TARGET binding site found in the 3' untranslated region of mRNA encoded by LOC197117, corresponding to a HOST TARGET binding site such as BINDING SITE I, BINDING SITE II or BINDING SITE III. Table 2 illustrates the complementarity of the nucleotide sequences of LOC197117 BINDING SITE, designated SEQ ID:43191, to the nucleotide sequence of VGAM2526 RNA, herein designated VGAM RNA, also designated SEQ ID:5237.

Another function of VGAM2526 is therefore inhibition of LOC197117 (Accession XM_116989). Accordingly, utilities of VGAM2526 include diagnosis, prevention and treatment of diseases and clinical conditions associated with LOC197117. LOC220164 (Accession XM_166294) is another VGAM2526 host target gene. LOC220164 BINDING SITE is HOST TARGET binding site found in the 3' untranslated region of mRNA encoded by LOC220164, corresponding to a HOST TARGET binding site such as BINDING SITE I, BINDING SITE II or BINDING SITE III. Table 2 illustrates the complementarity of the nucleotide sequences of LOC220164 BINDING SITE, designated SEQ ID:44108, to the nucleotide sequence of VGAM2526 RNA, herein designated VGAM RNA, also designated SEQ ID:5237.

Another function of VGAM2526 is therefore inhibition of LOC220164 (Accession XM_166294). Accordingly, utilities of VGAM2526 include diagnosis, prevention and treatment of diseases and clinical conditions associated with LOC220164. LOC255481 (Accession XM_170489) is another VGAM2526 host target gene. LOC255481 BINDING SITE is HOST TARGET binding site found in the 3' untranslated region of mRNA encoded by LOC255481, corresponding to a HOST TARGET binding site such as BINDING SITE I, BINDING SITE II or BINDING SITE III. Table 2 illustrates the complementarity of the nucleotide sequences of LOC255481 BINDING SITE, designated SEQ ID:45331, to the nucleotide sequence of VGAM2526 RNA, herein designated VGAM RNA, also designated SEQ ID:5237.

Another function of VGAM2526 is therefore inhibition of LOC255481 (Accession XM_170489). Accordingly, utilities of VGAM2526 include diagnosis, prevention and treatment of diseases and clinical conditions associated with LOC255481. FIG. 1 further provides a conceptual description of a novel bioinformatically detected viral gene of the present invention, referred to here as Viral Genomic Address Messenger 2527 (VGAM2527) viral gene, which modulates expression of respective host target genes thereof, the function and utility of which host target genes is known in the art.

VGAM2527 is a novel bioinformatically detected regulatory, non protein coding, viral micro RNA (miRNA) gene. The method by which VGAM2527 was detected is described hereinabove with reference to FIGS. 1-8.

VGAM2527 gene, herein designated VGAM GENE, is a viral gene contained in the genome of Mouse Cytomegalovirus 1. VGAM2527 host target gene, herein designated VGAM HOST TARGET GENE, is a human gene contained in the human genome.

VGAM2527 gene encodes a VGAM2527 precursor RNA, herein designated VGAM PRECURSOR RNA. Similar to other miRNA genes, and unlike most ordinary genes, VGAM2527 precursor RNA does not encode a protein. A nucleotide sequence identical or highly similar to the nucleotide sequence of VGAM2527 precursor RNA is designated SEQ ID:2513, and is provided hereinbelow with reference to the sequence listing part. Nucleotide sequence SEQ ID:2513 is located at position 157147 relative to the genome of Mouse Cytomegalovirus 1.

VGAM2527 precursor RNA folds onto itself, forming VGAM2527 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2527 folded precursor RNA into VGAM2527 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2527 RNA is designated SEQ ID:5238, and is provided hereinbelow with reference to the sequence listing part.

VGAM2527 host target gene, herein designated VGAM HOST TARGET GENE, encodes a corresponding messenger RNA, VGAM2527 host target RNA, herein designated VGAM HOST TARGET RNA. VGAM2527 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2527 RNA, herein designated VGAM RNA, binds complementarily to one or more host target binding sites located in untranslated regions of VGAM2527 host target RNA, herein designated VGAM HOST TARGET RNA. This complementary binding is due to the fact that the nucleotide sequence of VGAM2527 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2527 RNA, herein designated VGAM RNA, may have a different number of host target binding sites in untranslated regions of a VGAM2527 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2527 RNA, herein designated VGAM RNA, to host target binding sites on VGAM2527 host target RNA, herein designated VGAM HOST TARGET RNA, such as BINDING SITE I, BINDING SITE II and BINDING SITE III, inhibits translation of VGAM2527 host target RNA into VGAM2527 host target protein, herein designated VGAM HOST TARGET PROTEIN. VGAM host target protein is therefore outlined by a broken line.

It is appreciated that VGAM2527 host target gene, herein designated VGAM HOST TARGET GENE, in fact represents a plurality of VGAM2527 host target genes. The mRNA of each one of this plurality of VGAM2527 host target genes comprises one or more host target binding sites, each having a nucleotide sequence which is at least partly complementary to VGAM2527 RNA, herein designated VGAM RNA, and which when bound by VGAM2527 RNA causes inhibition of translation of respective one or more VGAM2527 host target proteins.

It is further appreciated by one skilled in the art that the mode of translational inhibition illustrated by FIG. 1 with specific reference to translational inhibition exerted by VGAM2527 gene, herein designated VGAM GENE, on one or more VGAM2527 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2527 is inhibition of expression of host target genes, as part of a novel viral mechanism of attacking a host. Accordingly, utilities of VGAM2527 include diagnosis, prevention and treatment of viral infection by Mouse Cytomegalovirus 1. Specific functions, and accordingly utilities, of VGAM2527 correlate with, and may be deduced from, the identity of the host target genes which VGAM2527 binds and inhibits, and the function of these host target genes, as elaborated hereinbelow.

Nucleotide sequences of the VGAM2527 precursor RNA, herein designated VGAM PRECURSOR RNA, and of the 'diced' VGAM2527 RNA, herein designated VGAM RNA, and a schematic representation of the secondary folding of VGAM2527 folded precursor RNA, herein designated VGAM FOLDED PRECURSOR RNA, of VGAM2527 are further described hereinbelow with reference to Table 1.

Nucleotide sequences of host target binding sites, such as BINDING SITE-I, BINDING SITE-II and BINDING SITE-III of FIG. 1, found on VGAM2527 host target RNA, and schematic representation of the complementarity of each of these host target binding sites to VGAM2527 RNA, herein designated VGAM RNA, are described hereinbelow with reference to Table 2.

As mentioned hereinabove with reference to FIG. 1, a function of VGAM2527 gene, herein designated VGAM is inhibition of expression of VGAM2527 target genes. It is appreciated that specific functions, and accordingly utilities, of VGAM2527 correlate with, and may be deduced from, the identity of the target genes which VGAM2527 binds and inhibits, and the function of these target genes, as elaborated hereinbelow.

Leucine-zipper-like Transcriptional Regulator, 1 (LZTR1, Accession NM_006767) is a VGAM2527 host target gene. LZTR1 BINDING SITE is HOST TARGET binding site found in the 3' untranslated region of mRNA encoded by LZTR1, corresponding to a HOST TARGET binding site such as BINDING SITE I, BINDING SITE II or BINDING SITE III. Table 2 illustrates the complementarity of the nucleotide sequences of LZTR1 BINDING SITE, designated SEQ ID:13638, to the nucleotide sequence of VGAM2527 RNA, herein designated VGAM RNA, also designated SEQ ID:5238.

A function of VGAM2527 is therefore inhibition of Leucine-zipper-like Transcriptional Regulator, 1 (LZTR1, Accession NM_006767). Accordingly, utilities of VGAM2527 include diagnosis, prevention and treatment of diseases and clinical conditions associated with LZTR1. KIAA1643 (Accession XM_035371) is another VGAM2527 host target gene. KIAA1643 BINDING SITE is HOST TARGET binding site found in the 3' untranslated region of mRNA encoded by KIAA1643, corresponding to a HOST TARGET binding site such as BINDING SITE I, BINDING SITE II or BINDING SITE III. Table 2 illustrates the complementarity of the nucleotide sequences of KIAA1643 BINDING SITE, designated SEQ ID:32241, to the nucleotide sequence of VGAM2527 RNA, herein designated VGAM RNA, also designated SEQ ID:5238.

Another function of VGAM2527 is therefore inhibition of KIAA1643 (Accession XM_035371). Accordingly, utilities of VGAM2527 include diagnosis, prevention and treatment of diseases and clinical conditions associated with KIAA1643. LOC164395 (Accession XM_092778) is another VGAM2527 host target gene. LOC164395 BINDING SITE is HOST TARGET binding site found in the 5' untranslated region of mRNA encoded by LOC164395, corresponding to a HOST TARGET binding site such as BINDING SITE I, BINDING SITE II or BINDING SITE III. Table 2 illustrates the complementarity of the nucleotide sequences of LOC164395 BINDING SITE, designated SEQ ID:40144, to the nucleotide sequence of VGAM2527 RNA, herein designated VGAM RNA, also designated SEQ ID:5238.

Another function of VGAM2527 is therefore inhibition of LOC164395 (Accession XM_092778). Accordingly, utilities of VGAM2527 include diagnosis, prevention and treatment of diseases and clinical conditions associated with LOC164395. LOC255177 (Accession XM_172941) is another VGAM2527 host target gene. LOC255177 BINDING SITE is HOST TARGET binding site found in the 3' untranslated region of mRNA encoded by LOC255177, corresponding to a HOST TARGET binding site such as BINDING SITE I, BINDING SITE II or BINDING SITE III. Table 2 illustrates the complementarity of the nucleotide sequences of LOC255177 BINDING SITE, designated SEQ ID:46200, to the nucleotide sequence of VGAM2527 RNA, herein designated VGAM RNA, also designated SEQ ID:5238.

Another function of VGAM2527 is therefore inhibition of LOC255177 (Accession XM_172941). Accordingly, utilities of VGAM2527 include diagnosis, prevention and treatment of diseases and clinical conditions associated with LOC255177. FIG. 1 further provides a conceptual description of a novel bioinformatically detected viral gene of the present invention, referred to here as Viral Genomic Address Messenger 2528 (VGAM2528) viral gene, which modulates expression of respective host target genes thereof, the function and utility of which host target genes is known in the art.

VGAM2528 is a novel bioinformatically detected regulatory, non protein coding, viral micro RNA (miRNA) gene. The method by which VGAM2528 was detected is described hereinabove with reference to FIGS. 1-8.

VGAM2528 gene, herein designated VGAM GENE, is a viral gene contained in the genome of Cowpox Virus. VGAM2528 host target gene, herein designated VGAM HOST TARGET GENE, is a human gene contained in the human genome.

VGAM2528 gene encodes a VGAM2528 precursor RNA, herein designated VGAM PRECURSOR RNA. Similar to other miRNA genes, and unlike most ordinary genes, VGAM2528 precursor RNA does not encode a protein. A nucleotide sequence identical or highly similar to the nucleotide sequence of VGAM2528 precursor RNA is designated SEQ ID:2514, and is provided hereinbelow with reference to the sequence listing part. Nucleotide sequence SEQ ID:2514 is located at position 17101 relative to the genome of Cowpox Virus.

VGAM2528 precursor RNA folds onto itself, forming VGAM2528 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2528 folded precursor RNA into VGAM2528 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM2528 RNA is designated SEQ ID:5239, and is provided hereinbelow with reference to the sequence listing part.

VGAM2528 host target gene, herein designated VGAM HOST TARGET GENE, encodes a corresponding messenger RNA, VGAM2528 host target RNA, herein designated VGAM HOST TARGET RNA. VGAM2528 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2528 RNA, herein designated VGAM RNA, binds complementarily to one or more host target binding sites located in untranslated regions of VGAM2528 host target RNA, herein designated VGAM HOST TARGET RNA. This complementary binding is due to the fact that the nucleotide sequence of VGAM2528 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2528 RNA, herein designated VGAM RNA, may have a different number of host target binding sites in untranslated regions of a VGAM2528 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2528 RNA, herein designated VGAM RNA, to host target binding sites on VGAM2528 host target RNA, herein designated VGAM HOST TARGET RNA, such as BINDING SITE I, BINDING SITE II and BINDING SITE III, inhibits translation of VGAM2528 host target RNA into VGAM2528 host target protein, herein designated VGAM HOST TARGET PROTEIN. VGAM host target protein is therefore outlined by a broken line.

It is appreciated that VGAM2528 host target gene, herein designated VGAM HOST TARGET GENE, in fact represents a plurality of VGAM2528 host target genes. The mRNA of each one of this plurality of VGAM2528 host target genes comprises one or more host target binding sites, each having a nucleotide sequence which is at least partly complementary to VGAM2528 RNA, herein designated VGAM RNA, and which when bound by VGAM2528 RNA causes inhibition of translation of respective one or more VGAM2528 host target proteins.

It is further appreciated by one skilled in the art that the mode of translational inhibition illustrated by FIG. 1 with specific reference to translational inhibition exerted by VGAM2528 gene, herein designated VGAM GENE, on one or more VGAM2528 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2528 is inhibition of expression of host target genes, as part of a novel viral mechanism of attacking a host. Accordingly, utilities of VGAM2528 include diagnosis, prevention and treatment of viral infection by Cowpox Virus. Specific functions, and accordingly utilities, of VGAM2528 correlate with, and may be deduced from, the identity of the host target genes which VGAM2528 binds and inhibits, and the function of these host target genes, as elaborated hereinbelow.

Nucleotide sequences of the VGAM2528 precursor RNA, herein designated VGAM PRECURSOR RNA, and of the 'diced' VGAM2528 RNA, herein designated VGAM RNA, and a schematic representation of the secondary folding of VGAM2528 folded precursor RNA, herein designated VGAM FOLDED PRECURSOR RNA, of VGAM2528 are further described hereinbelow with reference to Table 1.

Nucleotide sequences of host target binding sites, such as BINDING SITE-I, BINDING SITE-II and BINDING SITE-III of FIG. 1, found on VGAM2528 host target RNA, and schematic representation of the complementarity of each of these host target binding sites to VGAM2528 RNA, herein designated VGAM RNA, are described hereinbelow with reference to Table 2.

As mentioned hereinabove with reference to FIG. 1, a function of VGAM2528 gene, herein designated VGAM is inhibition of expression of VGAM2528 target genes. It is appreciated that specific functions, and accordingly utilities, of VGAM2528 correlate with, and may be deduced from, the identity of the target genes which VGAM2528 binds and inhibits, and the function of these target genes, as elaborated hereinbelow.

Chloride Channel 6 (CLCN6, Accession NM_001286) is a VGAM2528 host target gene. CLCN6 BINDING SITE1 through CLCN6 BINDING SITE3 are HOST TARGET binding sites found in untranslated regions of mRNA encoded by CLCN6, corresponding to HOST TARGET binding sites such as BINDING SITE I, BINDING SITE II or BINDING SITE III. Table 2 illustrates the complementarity of the nucleotide sequences of CLCN6 BINDING SITE1 through CLCN6 BINDING SITE3, designated SEQ ID:6960, SEQ ID:22342 and SEQ ID:22337 respectively, to the nucleotide sequence of VGAM2528 RNA, herein designated VGAM RNA, also designated SEQ ID:5239.

A function of VGAM2528 is therefore inhibition of Chloride Channel 6 (CLCN6, Accession NM_001286), a gene which is a voltage-gated chloride channel. Accordingly, utilities of VGAM2528 include diagnosis, prevention and treatment of diseases and clinical conditions associated with CLCN6. The function of CLCN6 and its association with various diseases and clinical conditions, has been established by previous studies, as described hereinabove with reference to VGAM599. KIAA0319 (Accession NM_014809) is another VGAM2528 host target gene. KIAA0319 BINDING SITE is HOST TARGET binding site found in the 3' untranslated region of mRNA encoded by KIAA0319, corresponding to a HOST TARGET binding site such as BINDING SITE I, BINDING SITE II or BINDING SITE III. Table 2 illustrates the complementarity of the nucleotide sequences of KIAA0319 BINDING SITE, designated SEQ ID:16761, to the nucleotide sequence of VGAM2528 RNA, herein designated VGAM RNA, also designated SEQ ID:5239.

Another function of VGAM2528 is therefore inhibition of KIAA0319 (Accession NM_014809). Accordingly, utilities of VGAM2528 include diagnosis, prevention and treatment of diseases and clinical conditions associated with KIAA0319. RAB40A, Member RAS Oncogene Family (RAB40A, Accession XM_088733) is another VGAM2528 host target gene. RAB40A BINDING SITE is HOST TARGET binding site found in the 5' untranslated region of mRNA encoded by RAB40A, corresponding to a HOST TARGET binding site such as BINDING SITE I, BINDING SITE II or BINDING SITE III. Table 2 illustrates the complementarity of the nucleotide sequences of RAB40A BINDING SITE, designated SEQ ID:39930, to the nucleotide sequence of VGAM2528 RNA, herein designated VGAM RNA, also designated SEQ ID:5239.

Another function of VGAM2528 is therefore inhibition of RAB40A, Member RAS Oncogene Family (RAB40A, Accession XM_088733). Accordingly, utilities of VGAM2528 include diagnosis, prevention and treatment of diseases and clinical conditions associated with RAB40A. LOC123264 (Accession XM_058693) is another VGAM2528 host target gene. LOC123264 BINDING SITE is HOST TARGET binding site found in the 5' untranslated region of mRNA encoded by LOC123264, corresponding to a HOST TARGET binding site such as BINDING SITE I, BINDING SITE II or BINDING SITE III. Table 2 illustrates the complementarity of the nucleotide sequences of LOC123264 BINDING SITE, designated SEQ ID:36723, to the nucleotide sequence of VGAM2528 RNA, herein designated VGAM RNA, also designated SEQ ID:5239.

Another function of VGAM2528 is therefore inhibition of LOC123264 (Accession XM_058693). Accordingly, utilities of VGAM2528 include diagnosis, prevention and treatment of diseases and clinical conditions associated with LOC123264. FIG. 1 further provides a conceptual description of a novel bioinformatically detected viral gene of the present invention, referred to here as Viral Genomic Address Messenger 2529 (VGAM2529) viral gene, which modulates expression of respective host target genes thereof, the function and utility of which host target genes is known in the art.

VGAM2529 is a novel bioinformatically detected regulatory, non protein coding, viral micro RNA (miRNA) gene. The method by which VGAM2529 was detected is described hereinabove with reference to FIGS. 1-8.

VGAM2529 gene, herein designated VGAM GENE, is a viral gene contained in the genome of Pepper Ringspot Virus. VGAM2529 host target gene, herein designated VGAM HOST TARGET GENE, is a human gene contained in the human genome.

VGAM2529 gene encodes a VGAM2529 precursor RNA, herein designated VGAM PRECURSOR RNA. Similar to other miRNA genes, and unlike most ordinary genes, VGAM2529 precursor RNA does not encode a protein. A nucleotide sequence identical or highly similar to the nucleotide sequence of VGAM2529 precursor RNA is designated SEQ ID:2515, and is provided hereinbelow with reference to the sequence listing part. Nucleotide sequence SEQ ID:2515 is located at position 4230 relative to the genome of Pepper Ringspot Virus.

VGAM2529 precursor RNA folds onto itself, forming VGAM2529 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2529 folded precursor RNA into VGAM2529 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM2529 RNA is designated SEQ ID:5240, and is provided hereinbelow with reference to the sequence listing part.

VGAM2529 host target gene, herein designated VGAM HOST TARGET GENE, encodes a corresponding messenger RNA, VGAM2529 host target RNA, herein designated VGAM HOST TARGET RNA. VGAM2529 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2529 RNA, herein designated VGAM RNA, binds complementarily to one or more host target binding sites located in untranslated regions of VGAM2529 host target RNA, herein designated VGAM HOST TARGET RNA. This complementary binding is due to the fact that the nucleotide sequence of VGAM2529 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2529 RNA, herein designated VGAM RNA, may have a different number of host target binding sites in untranslated regions of a VGAM2529 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2529 RNA, herein designated VGAM RNA, to host target binding sites on VGAM2529 host target RNA, herein designated VGAM HOST TARGET RNA, such as BINDING SITE I, BINDING SITE II and BINDING SITE III, inhibits translation of VGAM2529 host target RNA into VGAM2529 host target protein, herein designated VGAM HOST TARGET PROTEIN. VGAM host target protein is therefore outlined by a broken line.

It is appreciated that VGAM2529 host target gene, herein designated VGAM HOST TARGET GENE, in fact represents a plurality of VGAM2529 host target genes. The mRNA of each one of this plurality of VGAM2529 host target genes comprises one or more host target binding sites, each having a nucleotide sequence which is at least partly complementary to VGAM2529 RNA, herein designated VGAM RNA, and which when bound by VGAM2529 RNA causes inhibition of translation of respective one or more VGAM2529 host target proteins.

It is further appreciated by one skilled in the art that the mode of translational inhibition illustrated by FIG. 1 with specific reference to translational inhibition exerted by VGAM2529 gene, herein designated VGAM GENE, on one or more VGAM2529 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2529 is inhibition of expression of host target genes, as part of a novel viral mechanism of attacking a host. Accordingly, utilities of VGAM2529 include diagnosis, prevention and treatment of viral infection by Pepper Ringspot Virus. Specific functions, and accordingly utilities, of VGAM2529 correlate with, and may be deduced from, the identity of the host target genes which VGAM2529 binds and inhibits, and the function of these host target genes, as elaborated hereinbelow.

Nucleotide sequences of the VGAM2529 precursor RNA, herein designated VGAM PRECURSOR RNA, and of the 'diced' VGAM2529 RNA, herein designated VGAM RNA, and a schematic representation of the secondary folding of VGAM2529 folded precursor RNA, herein designated VGAM FOLDED PRECURSOR RNA, of VGAM2529 are further described hereinbelow with reference to Table 1.

Nucleotide sequences of host target binding sites, such as BINDING SITE-I, BINDING SITE-II and BINDING SITE-III of FIG. 1, found on VGAM2529 host target RNA, and schematic representation of the complementarity of each of these host target binding sites to VGAM2529 RNA, herein designated VGAM RNA, are described hereinbelow with reference to Table 2.

As mentioned hereinabove with reference to FIG. 1, a function of VGAM2529 gene, herein designated VGAM is inhibition of expression of VGAM2529 target genes. It is appreciated that specific functions, and accordingly utilities, of VGAM2529 correlate with, and may be deduced from, the identity of the target genes which VGAM2529 binds and inhibits, and the function of these target genes, as elaborated hereinbelow.

SH2 Domain Containing Phosphatase Anchor Protein 1 (SPAP1, Accession NM_030764) is a VGAM2529 host target gene. SPAP1 BINDING SITE is HOST TARGET binding site found in the 3' untranslated region of mRNA encoded by SPAP1, corresponding to a HOST TARGET binding site such as BINDING SITE I, BINDING SITE II or BINDING SITE III. Table 2 illustrates the complementarity of the nucleotide sequences of SPAP1 BINDING SITE, designated SEQ ID:25048, to the nucleotide sequence of VGAM2529 RNA, herein designated VGAM RNA, also designated SEQ ID:5240.

A function of VGAM2529 is therefore inhibition of SH2 Domain Containing Phosphatase Anchor Protein 1 (SPAP1, Accession NM_030764), a gene which regulation of immunologic function. Accordingly, utilities of VGAM2529 include diagnosis, prevention and treatment of diseases and clinical conditions associated with SPAP1. The function of SPAP1 and its association with various diseases and clinical conditions, has been established by previous studies, as described hereinabove with reference to VGAM672. FIG. 1 further provides a conceptual description of a novel bioinformatically detected viral gene of the present invention, referred to here as Viral Genomic Address Messenger 2530 (VGAM2530) viral gene, which modulates expression of respective host target genes thereof, the function and utility of which host target genes is known in the art.

VGAM2530 is a novel bioinformatically detected regulatory, non protein coding, viral micro RNA (miRNA) gene. The method by which VGAM2530 was detected is described hereinabove with reference to FIGS. 1-8.

VGAM2530 gene, herein designated VGAM GENE, is a viral gene contained in the genome of Pepper Ringspot Virus. VGAM2530 host target gene, herein designated VGAM HOST TARGET GENE, is a human gene contained in the human genome.

VGAM2530 gene encodes a VGAM2530 precursor RNA, herein designated VGAM PRECURSOR RNA. Similar to other miRNA genes, and unlike most ordinary genes, VGAM2530 precursor RNA does not encode a protein. A nucleotide sequence identical or highly similar to the nucleotide sequence of VGAM2530 precursor RNA is designated SEQ ID:2516, and is provided hereinbelow with reference to the sequence listing part. Nucleotide sequence SEQ ID:2516 is located at position 1886 relative to the genome of Pepper Ringspot Virus.

VGAM2530 precursor RNA folds onto itself, forming VGAM2530 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2530 folded precursor RNA into VGAM2530 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2530 RNA is designated SEQ ID:5241, and is provided hereinbelow with reference to the sequence listing part.

VGAM2530 host target gene, herein designated VGAM HOST TARGET GENE, encodes a corresponding messenger RNA, VGAM2530 host target RNA, herein designated VGAM HOST TARGET RNA. VGAM2530 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2530 RNA, herein designated VGAM RNA, binds complementarily to one or more host target binding sites located in untranslated regions of VGAM2530 host target RNA, herein designated VGAM HOST TARGET RNA. This complementary binding is due to the fact that the nucleotide sequence of VGAM2530 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2530 RNA, herein designated VGAM RNA, may have a different number of host target binding sites in untranslated regions of a VGAM2530 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2530 RNA, herein designated VGAM RNA, to host target binding sites on VGAM2530 host target RNA, herein designated VGAM HOST TARGET RNA, such as BINDING SITE I, BINDING SITE II and BINDING SITE III, inhibits translation of VGAM2530 host target RNA into VGAM2530 host target protein, herein designated VGAM HOST TARGET PROTEIN. VGAM host target protein is therefore outlined by a broken line.

It is appreciated that VGAM2530 host target gene, herein designated VGAM HOST TARGET GENE, in fact represents a plurality of VGAM2530 host target genes. The mRNA of each one of this plurality of VGAM2530 host target genes comprises one or more host target binding sites, each having a nucleotide sequence which is at least partly complementary to VGAM2530 RNA, herein designated VGAM RNA, and which when bound by VGAM2530 RNA causes inhibition of translation of respective one or more VGAM2530 host target proteins.

It is further appreciated by one skilled in the art that the mode of translational inhibition illustrated by FIG. 1 with specific reference to translational inhibition exerted by VGAM2530 gene, herein designated VGAM GENE, on one or more VGAM2530 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2530 is inhibition of expression of host target genes, as part of a novel viral mechanism of attacking a host. Accordingly, utilities of VGAM2530 include diagnosis, prevention and treatment of viral infection by Pepper Ringspot Virus. Specific functions, and accordingly utilities, of VGAM2530 correlate with, and may be deduced from, the identity of the host target genes which VGAM2530 binds and inhibits, and the function of these host target genes, as elaborated hereinbelow.

Nucleotide sequences of the VGAM2530 precursor RNA, herein designated VGAM PRECURSOR RNA, and of the 'diced' VGAM2530 RNA, herein designated VGAM RNA, and a schematic representation of the secondary folding of VGAM2530 folded precursor RNA, herein designated VGAM FOLDED PRECURSOR RNA, of VGAM2530 are further described hereinbelow with reference to Table 1.

Nucleotide sequences of host target binding sites, such as BINDING SITE-I, BINDING SITE-II and BINDING SITE-III of FIG. 1, found on VGAM2530 host target RNA, and schematic representation of the complementarity of each of these host target binding sites to VGAM2530 RNA, herein designated VGAM RNA, are described hereinbelow with reference to Table 2.

As mentioned hereinabove with reference to FIG. 1, a function of VGAM2530 gene, herein designated VGAM is inhibition of expression of VGAM2530 target genes. It is appreciated that specific functions, and accordingly utilities, of VGAM2530 correlate with, and may be deduced from, the identity of the target genes which VGAM2530 binds and inhibits, and the function of these target genes, as elaborated hereinbelow.

B-cell CLL/lymphoma 9 (BCL9, Accession NM_004326) is a VGAM2530 host target gene. BCL9 BINDING SITE is HOST TARGET binding site found in the 3' untranslated region of mRNA encoded by BCL9, corresponding to a HOST TARGET binding site such as BINDING SITE I, BINDING SITE II or BINDING SITE III. Table 2 illustrates the complementarity of the nucleotide sequences of BCL9 BINDING SITE, designated SEQ ID:10525, to the nucleotide sequence of VGAM2530 RNA, herein designated VGAM RNA, also designated SEQ ID:5241.

A function of VGAM2530 is therefore inhibition of B-cell CLL/lymphoma 9 (BCL9, Accession NM_004326), a gene which recruits of PYGO to the nuclear beta-catenin-TCF complex in Wnt/Wingless signaling. Accordingly, utilities of VGAM2530 include diagnosis, prevention and treatment of diseases and clinical conditions associated with BCL9. The function of BCL9 and its association with various diseases and clinical conditions, has been established by previous studies, as described hereinabove with reference to VGAM74. Calpain 10 (CAPN10, Accession NM_023089) is another VGAM2530 host target gene. CAPN10 BINDING SITE is HOST TARGET binding site found in the 3' untranslated region of mRNA encoded by CAPN10, corresponding to a HOST TARGET binding site such as BINDING SITE I, BINDING SITE II or BINDING SITE III. Table 2 illustrates the complementarity of the nucleotide sequences of CAPN10 BINDING SITE, designated SEQ ID:23359, to the nucleotide sequence of VGAM2530 RNA, herein designated VGAM RNA, also designated SEQ ID:5241.

Another function of VGAM2530 is therefore inhibition of Calpain 10 (CAPN10, Accession NM_023089), a gene which catalyzes limited proteolysis of substrates involved in cytoskeletal remodelling and signal tranduction. Accordingly, utilities of VGAM2530 include diagnosis, prevention and treatment of diseases and clinical conditions associated with CAPN10. The function of CAPN10 and its association with various diseases and clinical conditions, has been established by previous studies, as described hereinabove with reference to VGAM247. Coproporphyrinogen Oxidase (coproporphyria, harderoporphyria) (CPO, Accession NM_000097) is another VGAM2530 host target gene. CPO BINDING SITE is HOST TARGET binding site found in the 3' untranslated region of mRNA encoded by CPO, corresponding to a HOST TARGET binding site such as BINDING SITE I, BINDING SITE II or BINDING SITE III. Table 2 illustrates the complementarity of the nucleotide sequences of CPO BINDING SITE, designated SEQ ID:5557, to the nucleotide sequence of VGAM2530 RNA, herein designated VGAM RNA, also designated SEQ ID:5241.

Another function of VGAM2530 is therefore inhibition of Coproporphyrinogen Oxidase (coproporphyria, harderoporphyria) (CPO, Accession NM_000097), a gene which Coproporphyrinogen; catalyzes oxidative decarboxylation in sixth step of heme biosynthesis. Accordingly, utilities of VGAM2530 include diagnosis, prevention and treatment of diseases and clinical conditions associated with CPO. The function of CPO has been established by previous studies. Brewer et al. (1999) presented clinical, cytogenetic, molecular, and statistical evidence for the existence of a novel locus for isolated CP at 2q32. They studied 2 unrelated children with strikingly similar clinical features, in whom there were apparently balanced, de novo cytogenetic rearrangements involving the same region of 2q. Both children had cleft palate, facial dysmorphism, and mild learning disability. Molecular cytogenetic analyses localized both translocation breakpoints between markers D2S311 and D2S116 on chromosome 2. This suggested that the true location of these breakpoints was 2q32 rather than 2q33, as had been suggested on cytogenetic grounds alone. To obtain independent support for the existence of a CP locus at 2q32, the authors performed a detailed statistical analysis for all cases in the human cytogenetics database of nonmosaic, single, contiguous autosomal deletions associated with orofacial clefting; see Brewer et al. (1998). This analysis showed 2q32 to be 1 of only 3 chromosomal regions in which haploinsufficiency is significantly associated with isolated CP. Thus, the data provided strong evidence for the existence at 2q32 of a gene that is critical for the development of the secondary palate. The close proximity of the 2 translocation breakpoints should allow rapid progress toward positional cloning of this CP gene Van den Boogaard et al. (2000) identified a stop codon in the MSX1 gene (142983.0002) in a 3-generation Dutch family with tooth agenesis and combinations of cleft palate only and cleft lip and cleft palate, providing further evidence for this gene in orofacial clefting.

Full details of the abovementioned studies are described in the following publications, the disclosure of which are hereby incorporated by reference:

Brewer, C. M.; Leek, J. P.; Green, A. J.; Holloway, S.; Bonthron, D. T.; Markham, A. F.; FitzPatrick, D. R.: A locus for isolated cleft palate, located on human chromosome 2q32. Am. J. Hum. Genet. 65:387-396, 1999; and van den Boogaard, M.-J. H.; Dorland, M.; Beemer, F. A.; Ploos van Amstel, H. K.: MSX1 mutation is associated with orofacial clefting and tooth agenesis in human S. (Letter) Nature Gene.

Further studies establishing the function and utilities of CPO are found in John Hopkins OMIM database record ID 119540, and in sited publications numbered 3721-3725, 3584, 3728, 3778-3779, 372 and 11320 listed in the bibliography section hereinbelow, which are also hereby incorporated by reference. Cardiotrophin 1 (CTF1, Accession NM_001330) is another VGAM2530 host target gene. CTF1

BINDING SITE is HOST TARGET binding site found in the 3' untranslated region of mRNA encoded by CTF1, corresponding to a HOST TARGET binding site such as BINDING SITE I, BINDING SITE II or BINDING SITE III. Table 2 illustrates the complementarity of the nucleotide sequences of CTF1 BINDING SITE, designated SEQ ID:7013, to the nucleotide sequence of VGAM2530 RNA, herein designated VGAM RNA, also designated SEQ ID:5241.

Another function of VGAM2530 is therefore inhibition of Cardiotrophin 1 (CTF1, Accession NM_001330), a gene which may play a role in cardiac hypertrophy. Accordingly, utilities of VGAM2530 include diagnosis, prevention and treatment of diseases and clinical conditions associated with CTF1. The function of CTF1 and its association with various diseases and clinical conditions, has been established by previous studies, as described hereinabove with reference to VGAM71. Cystathionase (cystathionine gamma-lyase) (CTH, Accession NM_001902) is another VGAM2530 host target gene. CTH BINDING SITE is HOST TARGET binding site found in the 5' untranslated region of mRNA encoded by CTH, corresponding to a HOST TARGET binding site such as BINDING SITE I, BINDING SITE II or BINDING SITE III. Table 2 illustrates the complementarity of the nucleotide sequences of CTH BINDING SITE, designated SEQ ID:7626, to the nucleotide sequence of VGAM2530 RNA, herein designated VGAM RNA, also designated SEQ ID:5241.

Another function of VGAM2530 is therefore inhibition of Cystathionase (cystathionine gamma-lyase) (CTH, Accession NM_001902), a gene which catalyzes removal of ammonia, cleaves cystathionine to yield free cys. Accordingly, utilities of VGAM2530 include diagnosis, prevention and treatment of diseases and clinical conditions associated with CTH. The function of CTH has been established by previous studies. The rate of glutathione synthesis in the liver is limited by the availability of cysteine which is provided either in the diet or by the trans-sulfuration pathway in which cystathionine derived from methionine is transformed into cysteine by cystathionase (cystathionine gamma-lyase; EC 4.4.1.1). Lu et al. (1992) found and sequenced a 1,083-bp cDNA encoding the human liver cystathionine gamma-lyase. The human sequence presented a deletion of 132 bases (44 amino acids) compared to the cystathionase sequence reported for the rat, and a deletion of 135 bases (45 amino acids) compared to the sequence reported for yeast. After realignment for the missing nucleotides, the human cDNA sequence showed significant amino acid homology to the rat (85%) and yeast (50%) enzymes. Using the polymerase chain reaction, Lu et al. (1992) isolated a second clone which contained the missing 132 bases. Flanking nucleotides in the latter clone were identical to those in the cDNA clone containing the deletion. Alternative splicing as the basis of the 2 forms of cystathionase is plausible During a survey by paper chromatography of amino acids in the urine of patients in an institution for mental defectives, Harris et al. (1959) discovered a case with abnormal excretion of cystathionine. An inborn error involving the cleavage of cystathionine to give cysteine and homoserine was suggested. The subject was a severely retarded female, aged 64 years at the time of study. Another case was studied at The New York Hospital. Other clinical manifestations have been clubfoot, developmental defects about the ears, convulsions, and thrombocytopenia. Urinary lithiasis also occurs. Frimpter (1965) has shown that the defect involves cystathionase that does not properly bind its coenzyme, pyridoxal phosphate. In vitro studies suggested that high pyridoxine would be therapeutically beneficial. Mongeau et al. (1967) described the case of a 2-year-old boy with normal mentality, thrombocytopenia, and urinary calculi. The relation of the latter two features to the metabolic defect was problematical. Both parents (who were apparently unrelated) showed cystathioninuria after methionine loading test. With administration of pyridoxine, cystathioninuria was diminished in the proband. Schneiderman (1967) studied 2 mentally retarded brothers who excreted large amounts of cystathionine after methionine ingestion. The mother and another brother excreted lesser but abnormal amounts after methionine loading. The father was not tested. Perry et al. (1968) discovered cystathioninuria in a brother and sister when the brother's urine was by chance subjected to 2-dimensional paper chromatography for amino acids. Both children were normal. The parents excreted cystathionine only after methionine loading. The authors suggested that mental defect and other disorders reported in association with cystathioninuria may have been coincidental. Whelan and Scriver (1968) also found cystathioninuria as an apparently benign inborn error. The case of Tada et al. (1968) did not respond to vitamin Full details of the abovementioned studies are described in the following publications, the disclosure of which are hereby incorporated by reference:

Lu, Y.; O'Dowd, B. F.; Orrego, H.; Israel, Y.: Cloning and nucleotide sequence of human liver cDNA encoding for cystathionine gamma-lyase. Biochem. Biophys. Res. Commun. 189:749-758, 1992; and Whelan, D. T.; Scriver, C. R.: Cystathioninuria and renal iminoglycinuria in a pedigree: a perspective on counseling. New Eng. J. Med. 278:924-927, 1968.

Further studies establishing the function and utilities of CTH are found in John Hopkins OMIM database record ID 219500, and in sited publications numbered 9352-9366 listed in the bibliography section hereinbelow, which are also hereby incorporated by reference. Diaphanous Homolog 2 (Drosophila) (DIAPH2, Accession NM_006729) is another VGAM2530 host target gene. DIAPH2 BINDING SITE is HOST TARGET binding site found in the 3' untranslated region of mRNA encoded by DIAPH2, corresponding to a HOST TARGET binding site such as BINDING SITE I, BINDING SITE II or BINDING SITE III. Table 2 illustrates the complementarity of the nucleotide sequences of DIAPH2 BINDING SITE, designated SEQ ID:13562, to the nucleotide sequence of VGAM2530 RNA, herein designated VGAM RNA, also designated SEQ ID:5241.

Another function of VGAM2530 is therefore inhibition of Diaphanous Homolog 2 (Drosophila) (DIAPH2, Accession NM_006729), a gene which may affect in oogenesis. Accordingly, utilities of VGAM2530 include diagnosis, prevention and treatment of diseases and clinical conditions associated with DIAPH2. The function of DIAPH2 and its association with various diseases and clinical conditions, has been established by previous studies, as described hereinabove with reference to VGAM129. Deoxyribonuclease I (DNASE1, Accession NM_005223) is another VGAM2530 host target gene. DNASE1 BINDING SITE is HOST TARGET binding site found in the 5' untranslated region of mRNA encoded by DNASE1, corresponding to a HOST TARGET binding site such as BINDING SITE I, BINDING SITE II or BINDING SITE III. Table 2 illustrates the complementarity of the nucleotide sequences of DNASE1 BINDING SITE, designated SEQ ID:11713, to the nucleotide sequence of VGAM2530 RNA, herein designated VGAM RNA, also designated SEQ ID:5241.

Another function of VGAM2530 is therefore inhibition of Deoxyribonuclease I (DNASE1, Accession NM_005223), a gene which seems to be involved in cell death. Accordingly, utilities of VGAM2530 include diagnosis, prevention and treatment of diseases and clinical conditions associated with DNASE1. The function of DNASE1 and its association with various diseases and clinical conditions, has been established by previous studies, as described hereinabove with reference to VGAM492. Fatty-acid-Coenzyme A Ligase, Long-chain 5 (FACL5, Accession XM_034424) is another VGAM2530 host target gene. FACL5 BINDING SITE is HOST TARGET binding site found in the 3' untranslated region of mRNA encoded by FACL5, corresponding to a HOST TARGET binding site such as BINDING SITE I, BINDING SITE II or BINDING SITE III. Table 2 illustrates the complementarity of the nucleotide sequences of FACL5 BINDING SITE, designated SEQ ID:32107, to the nucleotide sequence of VGAM2530 RNA, herein designated VGAM RNA, also designated SEQ ID:5241.

Another function of VGAM2530 is therefore inhibition of Fatty-acid-Coenzyme A Ligase, Long-chain 5 (FACL5, Accession XM_034424), a gene which may be involved in fatty acid metabolism; contains an AMP-binding domain. Accordingly, utilities of VGAM2530 include diagnosis, prevention and treatment of diseases and clinical conditions associated with FACL5. The function of FACL5 and its association with various diseases and clinical conditions, has been established by previous studies, as described hereinabove with reference to VGAM357. Flap Structure-specific Endonuclease 1 (FEN1, Accession NM_004111) is another VGAM2530 host target gene. FEN1 BINDING SITE is HOST TARGET binding site found in the 3' untranslated region of mRNA encoded by FEN1, corresponding to a HOST TARGET binding site such as BINDING SITE I, BINDING SITE II or BINDING SITE III. Table 2 illustrates the complementarity of the nucleotide sequences of FEN1 BINDING SITE, designated SEQ ID:10321, to the nucleotide sequence of VGAM2530 RNA, herein designated VGAM RNA, also designated SEQ ID:5241.

Another function of VGAM2530 is therefore inhibition of Flap Structure-specific Endonuclease 1 (FEN1, Accession NM_004111), a gene which Flap endonuclease; double-stranded DNA 5'-3' exonuclease. Accordingly, utilities of VGAM2530 include diagnosis, prevention and treatment of diseases and clinical conditions associated with FEN1. The function of FEN1 and its association with various diseases and clinical conditions, has been established by previous studies, as described hereinabove with reference to VGAM1217. Farnesyltransferase, CAAX Box, Beta (FNTB, Accession NM_002028) is another VGAM2530 host target gene. FNTB BINDING SITE is HOST TARGET binding site found in the 3' untranslated region of mRNA encoded by FNTB, corresponding to a HOST TARGET binding site such as BINDING SITE I, BINDING SITE II or BINDING SITE III. Table 2 illustrates the complementarity of the nucleotide sequences of FNTB BINDING SITE, designated SEQ ID:7784, to the nucleotide sequence of VGAM2530 RNA, herein designated VGAM RNA, also designated SEQ ID:5241.

Another function of VGAM2530 is therefore inhibition of Farnesyltransferase, CAAX Box, Beta (FNTB, Accession NM_002028), a gene which transfers farnesyl groups to proteins. Accordingly, utilities of VGAM2530 include diagnosis, prevention and treatment of diseases and clinical conditions associated with FNTB. The function of FNTB and its association with various diseases and clinical conditions, has been established by previous studies, as described hereinabove with reference to VGAM615. Glycine Receptor, Alpha 3 (GLRA3, Accession XM_011092) is another VGAM2530 host target gene. GLRA3 BINDING SITE is HOST TARGET binding site found in the 5' untranslated region of mRNA encoded by GLRA3, corresponding to a HOST TARGET binding site such as BINDING SITE I, BINDING SITE II or BINDING SITE III. Table 2 illustrates the complementarity of the nucleotide sequences of GLRA3 BINDING SITE, designated SEQ ID:30169, to the nucleotide sequence of VGAM2530 RNA, herein designated VGAM RNA, also designated SEQ ID:5241.

Another function of VGAM2530 is therefore inhibition of Glycine Receptor, Alpha 3 (GLRA3, Accession XM_011092), a gene which increases the chloride conductance and thus produces hyperpolarization (inhibition of neuronal firing). Accordingly, utilities of VGAM2530 include diagnosis, prevention and treatment of diseases and clinical conditions associated with GLRA3. The function of GLRA3 and its association with various diseases and clinical conditions, has been established by previous studies, as described hereinabove with reference to VGAM602. GSBS (Accession XM_165869) is another VGAM2530 host target gene. GSBS BINDING SITE is HOST TARGET binding site found in the 3' untranslated region of mRNA encoded by GSBS, corresponding to a HOST TARGET binding site such as BINDING SITE I, BINDING SITE II or BINDING SITE III. Table 2 illustrates the complementarity of the nucleotide sequences of GSBS BINDING SITE, designated SEQ ID:43787, to the nucleotide sequence of VGAM2530 RNA, herein designated VGAM RNA, also designated SEQ ID:5241.

Another function of VGAM2530 is therefore inhibition of GSBS (Accession XM_165869). Accordingly, utilities of VGAM2530 include diagnosis, prevention and treatment of diseases and clinical conditions associated with GSBS. Huntingtin-associated Protein 1 (neuroan 1) (HAP1, Accession NM_003949) is another VGAM2530 host target gene. HAP1 BINDING SITE is HOST TARGET binding site found in the 3' untranslated region of mRNA encoded by HAP1, corresponding to a HOST TARGET binding site such as BINDING SITE I, BINDING SITE II or BINDING SITE III. Table 2 illustrates the complementarity of the nucleotide sequences of HAP1 BINDING SITE, designated SEQ ID:10077, to the nucleotide sequence of VGAM2530 RNA, herein designated VGAM RNA, also designated SEQ ID:5241.

Another function of VGAM2530 is therefore inhibition of Huntingtin-associated Protein 1 (neuroan 1) (HAP1, Accession NM_003949), a gene which functions as an adaptor protein using coiled coils to mediate interactions among cytoskeletal, vascular, and motor proteins. Accordingly, utilities of VGAM2530 include diagnosis, prevention and treatment of diseases and clinical conditions associated with HAP1. The function of HAP1 and its association with various diseases and clinical conditions, has been established by previous studies, as described hereinabove with reference to VGAM126. Heterogeneous Nuclear Ribonucleoprotein D-like (HNRPDL, Accession NM_005463) is another VGAM2530 host target gene. HNRPDL BINDING SITE is HOST TARGET binding site found in the 3' untranslated region of mRNA encoded by HNRPDL, corresponding to a HOST TARGET binding site such as BINDING SITE I, BINDING SITE II or BINDING SITE III. Table 2 illustrates the complementarity of the nucleotide sequences of HNRPDL BINDING SITE, designated SEQ ID:11953, to the nucleotide sequence of VGAM2530 RNA, herein designated VGAM RNA, also designated SEQ ID:5241.

Another function of VGAM2530 is therefore inhibition of Heterogeneous Nuclear Ribonucleoprotein D-like (HNRPDL, Accession NM_005463), a gene which binds to rna molecules that contain au-rich elements. Accordingly, utilities of VGAM2530 include diagnosis, prevention and treatment of diseases and clinical conditions associated with HNRPDL. The function of HNRPDL and its association with various diseases and clinical conditions, has been established by previous studies, as described hereinabove with reference to VGAM144. NGFI-A Binding Protein 1 (EGR1 binding protein 1) (NAB1, Accession NM_005966) is another VGAM2530 host target gene. NAB1 BINDING SITE is HOST TARGET binding site found in the 3' untranslated region of mRNA encoded by NAB1, corresponding to a HOST TARGET binding site such as BINDING SITE I, BINDING SITE II or BINDING SITE III. Table 2 illustrates the complementarity of the nucleotide sequences of NAB1 BINDING SITE, designated SEQ ID:12588, to the nucleotide sequence of VGAM2530 RNA, herein designated VGAM RNA, also designated SEQ ID:5241.

Another function of VGAM2530 is therefore inhibition of NGFI-A Binding Protein 1 (EGR1 binding protein 1) (NAB1, Accession NM_005966), a gene which acts as a transcriptional repressor for zinc finger transcription factors egr1 and egr2 (by similarity). Accordingly, utilities of VGAM2530 include diagnosis, prevention and treatment of diseases and clinical conditions associated with NAB1. The function of NAB1 and its association with various diseases and clinical conditions, has been established by previous studies, as described hereinabove with reference to VGAM1074. Orthopedia Homolog (Drosophila) (OTP, Accession NM_032109) is another VGAM2530 host target gene. OTP BINDING SITE is HOST TARGET binding site found in the 3" untranslated region of mRNA encoded by OTP, corresponding to a HOST TARGET binding site such as BINDING SITE I, BINDING SITE II or BINDING SITE III. Table 2 illustrates the complementarity of the nucleotide sequences of OTP BINDING SITE, designated SEQ ID:25802, to the nucleotide sequence of VGAM2530 RNA, herein designated VGAM RNA, also designated SEQ ID:5241.

Another function of VGAM2530 is therefore inhibition of Orthopedia Homolog (Drosophila) (OTP, Accession NM_032109), a gene which involves in the development of the forebrain and spinal cord. Accordingly, utilities of VGAM2530 include diagnosis, prevention and treatment of diseases and clinical conditions associated with OTP. The function of OTP and its association with various diseases and clinical conditions, has been established by previous studies, as described hereinabove with reference to VGAM183. P53AIP1 (Accession NM_022112) is another VGAM2530 host target gene. P53AIP1 BINDING SITE is HOST TARGET binding site found in the 3' untranslated region of mRNA encoded by P53AIP1, corresponding to a HOST TARGET binding site such as BINDING SITE I, BINDING SITE II or BINDING SITE III. Table 2 illustrates the complementarity of the nucleotide sequences of P53AIP1 BINDING SITE, designated SEQ ID:22660, to the nucleotide sequence of VGAM2530 RNA, herein designated VGAM RNA, also designated SEQ ID:5241.

Another function of VGAM2530 is therefore inhibition of P53AIP1 (Accession NM_022112). Accordingly, utilities of VGAM2530 include diagnosis, prevention and treatment of diseases and clinical conditions associated with P53AIP1. Phosphoinositide-3-kinase, Regulatory Subunit, Polypeptide 2 (p85 beta) (PIK3R2, Accession NM_005027) is another VGAM2530 host target gene. PIK3R2 BINDING SITE is HOST TARGET binding site found in the 3' untranslated region of mRNA encoded by PIK3R2, corresponding to a HOST TARGET binding site such as BINDING SITE I, BINDING SITE II or BINDING SITE III. Table 2 illustrates the complementarity of the nucleotide sequences of PIK3R2 BINDING SITE, designated SEQ ID:11467, to the nucleotide sequence of VGAM2530 RNA, herein designated VGAM RNA, also designated SEQ ID:5241.

Another function of VGAM2530 is therefore inhibition of Phosphoinositide-3-kinase, Regulatory Subunit, Polypeptide 2 (p85 beta) (PIK3R2, Accession NM_005027), a gene which acts as an adapter and is regulatory subunit (p85 beta) of phosphatidylinositol 3-kinase. Accordingly, utilities of VGAM2530 include diagnosis, prevention and treatment of diseases and clinical conditions associated with PIK3R2. The function of PIK3R2 and its association with various diseases and clinical conditions, has been established by previous studies, as described hereinabove with reference to VGAM647. Protein Phosphatase 1, Regulatory (inhibitor) Subunit 12B (PPP1R12B, Accession NM_032104) is another VGAM2530 host target gene. PPP1R12B BINDING SITE is HOST TARGET binding site found in the 3' untranslated region of mRNA encoded by PPP1R12B, corresponding to a HOST TARGET binding site such as BINDING SITE I, BINDING SITE II or BINDING SITE III. Table 2 illustrates the complementarity of the nucleotide sequences of PPP1R12B BINDING SITE, designated SEQ ID:25798, to the nucleotide sequence of VGAM2530 RNA, herein designated VGAM RNA, also designated SEQ ID:5241.

Another function of VGAM2530 is therefore inhibition of Protein Phosphatase 1, Regulatory (inhibitor) Subunit 12B (PPP1R12B, Accession NM_032104). Accordingly, utilities of VGAM2530 include diagnosis, prevention and treatment of diseases and clinical conditions associated with PPP1R12B. RIG (Accession NM_006394) is another VGAM2530 host target gene. RIG BINDING SITE is HOST TARGET binding site found in the 3' untranslated region of mRNA encoded by RIG, corresponding to a HOST TARGET binding site such as BINDING SITE I, BINDING SITE II or BINDING SITE III. Table 2 illustrates the complementarity of the nucleotide sequences of RIG BINDING SITE, designated SEQ ID:13109, to the nucleotide sequence of VGAM2530 RNA, herein designated VGAM RNA, also designated SEQ ID:5241.

Another function of VGAM2530 is therefore inhibition of RIG (Accession NM_006394), a gene which is ribosomal protein S15. Accordingly, utilities of VGAM2530 include diagnosis, prevention and treatment of diseases and clinical conditions associated with RIG. The function of RIG and its association with various diseases and clinical conditions, has been established by previous studies, as described hereinabove with reference to VGAM206. Sine Oculis Homeobox Homolog 2 (Drosophila) (SIX2, Accession NM_016932) is another VGAM2530 host target gene. SIX2 BINDING SITE is HOST TARGET binding site found in the 3' untranslated region of mRNA encoded by SIX2, corresponding to a HOST TARGET binding site such as BINDING SITE I, BINDING SITE II or BINDING SITE III. Table 2 illustrates the complementarity of the nucleotide sequences of SIX2 BINDING SITE, designated SEQ ID:18851, to the nucleotide sequence of VGAM2530 RNA, herein designated VGAM RNA, also designated SEQ ID:5241.

Another function of VGAM2530 is therefore inhibition of Sine Oculis Homeobox Homolog 2 (Drosophila) (SIX2, Accession NM_016932), a gene which may be involved in limb tendon and ligament development (by similarity). Accordingly, utilities of VGAM2530 include diagnosis, prevention and treatment of diseases and clinical conditions associated with SIX2. The function of SIX2 and its association with various diseases and clinical conditions, has been established by previous studies, as described hereinabove with reference to VGAM1151. SRY (sex determining region Y)-box 13 (SOX13, Accession NM_005686) is another VGAM2530 host target gene. SOX13 BINDING SITE is HOST TARGET binding site found in the 3' untranslated region of mRNA encoded by SOX13, corresponding to a HOST TARGET binding site such as BINDING SITE I, BINDING SITE II or BINDING SITE III. Table 2 illustrates the complementarity of the nucleotide sequences of SOX13 BINDING SITE, designated SEQ ID:12246, to the nucleotide sequence of VGAM2530 RNA, herein designated VGAM RNA, also designated SEQ ID:5241.

Another function of VGAM2530 is therefore inhibition of SRY (sex determining region Y)-box 13 (SOX13, Accession NM_005686). Accordingly, utilities of VGAM2530 include diagnosis, prevention and treatment of diseases and clinical conditions associated with SOX13. Transgelin 2 (TAGLN2, Accession NM_003564) is another VGAM2530 host target gene. TAGLN2 BINDING SITE is HOST TARGET binding site found in the 3' untranslated region of mRNA encoded by TAGLN2, corresponding to a HOST TARGET binding site such as BINDING SITE I, BINDING SITE II or BINDING SITE III. Table 2 illustrates the complementarity of the nucleotide sequences of TAGLN2 BINDING SITE, designated SEQ ID:9621, to the nucleotide sequence of VGAM2530 RNA, herein designated VGAM RNA, also designated SEQ ID:5241.

Another function of VGAM2530 is therefore inhibition of Transgelin 2 (TAGLN2, Accession NM_003564), a gene which is similar to transgelins and may be an actin-binding proteins. Accordingly, utilities of VGAM2530 include diagnosis, prevention and treatment of diseases and clinical conditions associated with TAGLN2. The function of TAGLN2 and its association with various diseases and clinical conditions, has been established by previous studies, as described hereinabove with reference to VGAM144. Transporter 2, ATP-binding Cassette, Sub-family B (MDR/TAP) (TAP2, Accession NM_000544) is another VGAM2530 host target gene. TAP2 BINDING SITE is HOST TARGET binding site found in the 3' untranslated region of mRNA encoded by TAP2, corresponding to a HOST TARGET binding site such as BINDING SITE I, BINDING SITE II or BINDING SITE III. Table 2 illustrates the complementarity of the nucleotide sequences of TAP2 BINDING SITE, designated SEQ ID:6144, to the nucleotide sequence of VGAM2530 RNA, herein designated VGAM RNA, also designated SEQ ID:5241.

Another function of VGAM2530 is therefore inhibition of Transporter 2, ATP-binding Cassette, Sub-family B (MDR/TAP) (TAP2, Accession NM_000544), a gene which is involved in the transport of antigens from the cytoplasm to a membrane-bound compartment for association with mhc class i molecules. Accordingly, utilities of VGAM2530 include diagnosis, prevention and treatment of diseases and clinical conditions associated with TAP2. The function of TAP2 and its association with various diseases and clinical conditions, has been established by previous studies, as described hereinabove with reference to VGAM55. Transforming Growth Factor, Beta Receptor III (betaglycan, 300 kDa) (TGFBR3, Accession NM_003243) is another VGAM2530 host target gene. TGFBR3 BINDING SITE is HOST TARGET binding site found in the 3' untranslated region of mRNA encoded by TGFBR3, corresponding to a HOST TARGET binding site such as BINDING SITE I, BINDING SITE II or BINDING SITE III. Table 2 illustrates the complementarity of the nucleotide sequences of TGFBR3 BINDING SITE, designated SEQ ID:9250, to the nucleotide sequence of VGAM2530 RNA, herein designated VGAM RNA, also designated SEQ ID:5241.

Another function of VGAM2530 is therefore inhibition of Transforming Growth Factor, Beta Receptor III (betaglycan, 300 kDa) (TGFBR3, Accession NM_003243), a gene which involves in capturing and retaining TGF-beta for presentation to the signaling receptors. Accordingly, utilities of VGAM2530 include diagnosis, prevention and treatment of diseases and clinical conditions associated with TGFBR3. The function of TGFBR3 and its association with various diseases and clinical conditions, has been established by previous studies, as described hereinabove with reference to VGAM139. Wingless-type MMTV Integration Site Family, Member 1 (WNT1, Accession NM_005430) is another VGAM2530 host target gene. WNT1 BINDING SITE is HOST TARGET binding site found in the 3' untranslated region of mRNA encoded by WNT1, corresponding to a HOST TARGET binding site such as BINDING SITE I, BINDING SITE II or BINDING SITE III. Table 2 illustrates the complementarity of the nucleotide sequences of WNT1 BINDING SITE, designated SEQ ID:11898, to the nucleotide sequence of VGAM2530 RNA, herein designated VGAM RNA, also designated SEQ ID:5241.

Another function of VGAM2530 is therefore inhibition of Wingless-type MMTV Integration Site Family, Member 1 (WNT1, Accession NM_005430), a gene which may have a role in development of the central nervous system. Accordingly, utilities of VGAM2530 include diagnosis, prevention and treatment of diseases and clinical conditions associated with WNT1. The function of WNT1 and its association with various diseases and clinical conditions, has been established by previous studies, as described hereinabove with reference to VGAM381. Zinc Finger Protein 137 (clone pHZ-30) (ZNF137, Accession NM_003438) is another VGAM2530 host target gene. ZNF137 BINDING SITE is HOST TARGET binding site found in the 3' untranslated region of mRNA encoded by ZNF137, corresponding to a HOST TARGET binding site such as BINDING SITE I, BINDING SITE II or BINDING SITE III. Table 2 illustrates the complementarity of the nucleotide sequences of ZNF137 BINDING SITE, designated SEQ ID:9494, to the nucleotide sequence of VGAM2530 RNA, herein designated VGAM RNA, also designated SEQ ID:5241.

Another function of VGAM2530 is therefore inhibition of Zinc Finger Protein 137 (clone pHZ-30) (ZNF137, Accession NM_003438). Accordingly, utilities of VGAM2530 include diagnosis, prevention and treatment of diseases and clinical conditions associated with ZNF137. Arachidonate Lipoxygenase 3 (ALOXE3, Accession NM_021628) is another VGAM2530 host target gene. ALOXE3 BINDING SITE is HOST TARGET binding site found in the 3' untranslated region of mRNA encoded by ALOXE3, corresponding to a HOST TARGET binding site such as BINDING SITE I, BINDING SITE II or BINDING SITE III. Table 2 illustrates the complementarity of the nucleotide sequences of ALOXE3 BINDING SITE, designated SEQ ID:22266, to the nucleotide sequence of VGAM2530 RNA, herein designated VGAM RNA, also designated SEQ ID:5241.

Another function of VGAM2530 is therefore inhibition of Arachidonate Lipoxygenase 3 (ALOXE3, Accession NM_021628). Accordingly, utilities of VGAM2530 include diagnosis, prevention and treatment of diseases and clinical conditions associated with ALOXE3. Chromosome 11 Open Reading Frame 25 (C11orf25, Accession NM_031418) is another VGAM2530 host target gene. C11orf25 BINDING SITE is HOST TARGET binding site found in the 3' untranslated region of mRNA encoded by C11orf25, corresponding to a HOST TARGET binding site such as BINDING SITE I, BINDING SITE II or BINDING SITE III. Table 2 illustrates the complementarity of the nucleotide sequences of C11orf25 BINDING SITE, designated SEQ ID:25402, to the nucleotide sequence of VGAM2530 RNA, herein designated VGAM RNA, also designated SEQ ID:5241.

Another function of VGAM2530 is therefore inhibition of Chromosome 11 Open Reading Frame 25 (C11orf25, Accession NM_031418). Accordingly, utilities of VGAM2530 include diagnosis, prevention and treatment of diseases and clinical conditions associated with C11orf25. DKFZp434K2435 (Accession NM_032256) is another VGAM2530 host target gene. DKFZp434K2435 BINDING SITE is HOST TARGET binding site found in the 3' untranslated region of mRNA encoded by DKFZp434K2435, corresponding to a HOST TARGET binding site such as BINDING SITE I, BINDING SITE II or BINDING SITE III. Table 2 illustrates the complementarity of the nucleotide sequences of DKFZp434K2435 BINDING SITE, designated SEQ ID:25999, to the nucleotide sequence of VGAM2530 RNA, herein designated VGAM RNA, also designated SEQ ID:5241.

Another function of VGAM2530 is therefore inhibition of DKFZp434K2435 (Accession NM_032256). Accordingly, utilities of VGAM2530 include diagnosis, prevention and treatment of diseases and clinical conditions associated with DKFZp434K2435. DKFZp761D0614 (Accession XM_113634) is another VGAM2530 host target gene. DKFZp761D0614 BINDING SITE is HOST TARGET binding site found in the 3' untranslated region of mRNA encoded by DKFZp761D0614, corresponding to a HOST TARGET binding site such as BINDING SITE I, BINDING SITE II or BINDING SITE III. Table 2 illustrates the complementarity of the nucleotide sequences of DKFZp761D0614 BINDING SITE, designated SEQ ID:42312, to the nucleotide sequence of VGAM2530 RNA, herein designated VGAM RNA, also designated SEQ ID:5241.

Another function of VGAM2530 is therefore inhibition of DKFZp761D0614 (Accession XM_113634). Accordingly, utilities of VGAM2530 include diagnosis, prevention and treatment of diseases and clinical conditions associated with DKFZp761D0614. Dynamin 1-like (DNM1L, Accession NM_012062) is another VGAM2530 host target gene. DNM1L BINDING SITE is HOST TARGET binding site found in the 3' untranslated region of mRNA encoded by DNM1L, corresponding to a HOST TARGET binding site such as BINDING SITE I, BINDING SITE II or BINDING SITE III. Table 2 illustrates the complementarity of the nucleotide sequences of DNM1L BINDING SITE, designated SEQ ID:14318, to the nucleotide sequence of VGAM2530 RNA, herein designated VGAM RNA, also designated SEQ ID:5241.

Another function of VGAM2530 is therefore inhibition of Dynamin 1-like (DNM1L, Accession NM_012062). Accordingly, utilities of VGAM2530 include diagnosis, prevention and treatment of diseases and clinical conditions associated with DNM1L. FLJ10482 (Accession NM_018107) is another VGAM2530 host target gene. FLJ10482 BINDING SITE is HOST TARGET binding site found in the 3' untranslated region of mRNA encoded by FLJ10482, corresponding to a HOST TARGET binding site such as BINDING SITE I, BINDING SITE II or BINDING SITE III. Table 2 illustrates the complementarity of the nucleotide sequences of FLJ10482 BINDING SITE, designated SEQ ID:19877, to the nucleotide sequence of VGAM2530 RNA, herein designated VGAM RNA, also designated SEQ ID:5241.

Another function of VGAM2530 is therefore inhibition of FLJ10482 (Accession NM_018107). Accordingly, utilities of VGAM2530 include diagnosis, prevention and treatment of diseases and clinical conditions associated with FLJ10482. FLJ11142 (Accession NM_018338) is another VGAM2530 host target gene. FLJ11142 BINDING SITE is HOST TARGET binding site found in the 3' untranslated region of mRNA encoded by FLJ11142, corresponding to a HOST TARGET binding site such as BINDING SITE I, BINDING SITE II or BINDING SITE III. Table 2 illustrates the complementarity of the nucleotide sequences of FLJ11142 BINDING SITE, designated SEQ ID:20345, to the nucleotide sequence of VGAM2530 RNA, herein designated VGAM RNA, also designated SEQ ID:5241.

Another function of VGAM2530 is therefore inhibition of FLJ11142 (Accession NM_018338). Accordingly, utilities of VGAM2530 include diagnosis, prevention and treatment of diseases and clinical conditions associated with FLJ11142. FLJ11722 (Accession NM_024970) is another VGAM2530 host target gene. FLJ11722 BINDING SITE is HOST TARGET binding site found in the 3' untranslated region of mRNA encoded by FLJ11722, corresponding to a HOST TARGET binding site such as BINDING SITE I, BINDING SITE II or BINDING SITE III. Table 2 illustrates the complementarity of the nucleotide sequences of FLJ11722 BINDING SITE, designated SEQ ID:24520, to the nucleotide sequence of VGAM2530 RNA, herein designated VGAM RNA, also designated SEQ ID:5241.

Another function of VGAM2530 is therefore inhibition of FLJ11722 (Accession NM_024970). Accordingly, utilities of VGAM2530 include diagnosis, prevention and treatment of diseases and clinical conditions associated with FLJ11722. FLJ23322 (Accession XM_114207) is another VGAM2530 host target gene. FLJ23322 BINDING SITE is HOST TARGET binding site found in the 3' untranslated region of mRNA encoded by FLJ23322, corresponding to a HOST TARGET binding site such as BINDING SITE I, BINDING SITE II or BINDING SITE III. Table 2 illustrates the complementarity of the nucleotide sequences of FLJ23322 BINDING SITE, designated SEQ ID:42800, to the nucleotide sequence of VGAM2530 RNA, herein designated VGAM RNA, also designated SEQ ID:5241.

Another function of VGAM2530 is therefore inhibition of FLJ23322 (Accession XM_114207). Accordingly, utilities of VGAM2530 include diagnosis, prevention and treatment of diseases and clinical conditions associated with FLJ23322. FLJ32356 (Accession NM_144671) is another VGAM2530 host target gene. FLJ32356 BINDING SITE is HOST TARGET binding site found in the 3' untranslated region of mRNA encoded by FLJ32356, corresponding to a HOST TARGET binding site such as BINDING SITE I, BINDING SITE II or BINDING SITE III. Table 2 illustrates the complementarity of the nucleotide sequences of FLJ32356 BINDING SITE, designated SEQ ID:29494, to the nucleotide sequence of VGAM2530 RNA, herein designated VGAM RNA, also designated SEQ ID:5241.

Another function of VGAM2530 is therefore inhibition of FLJ32356 (Accession NM_144671). Accordingly, utilities of VGAM2530 include diagnosis, prevention and treatment of diseases and clinical conditions associated with FLJ32356. Forkhead Box O3A (FOXO3A, Accession NM_001455) is another VGAM2530 host target gene. FOXO3A BINDING SITE is HOST TARGET binding site found in the 5' untranslated region of mRNA encoded by FOXO3A, corresponding to a HOST TARGET binding site such as BINDING SITE I, BINDING SITE II or BINDING SITE III. Table 2 illustrates the complementarity of the nucleotide sequences of FOXO3A BINDING SITE, designated SEQ ID:7191, to the nucleotide sequence of VGAM2530 RNA, herein designated VGAM RNA, also designated SEQ ID:5241.

Another function of VGAM2530 is therefore inhibition of Forkhead Box O3A (FOXO3A, Accession NM_001455). Accordingly, utilities of VGAM2530 include diagnosis, prevention and treatment of diseases and clinical conditions associated with FOXO3A. GREB1 (Accession XM_051545) is another VGAM2530 host target gene. GREB1 BINDING SITE is HOST TARGET binding site found in the 3' untranslated region of mRNA encoded by GREB1, corresponding to a HOST TARGET binding site such as BINDING SITE I, BINDING SITE II or BINDING SITE III. Table 2 illustrates the complementarity of the nucleotide sequences of GREB1 BINDING SITE, designated SEQ ID:35854, to the nucleotide sequence of VGAM2530 RNA, herein designated VGAM RNA, also designated SEQ ID:5241.

Another function of VGAM2530 is therefore inhibition of GREB1 (Accession XM_051545). Accordingly, utilities of VGAM2530 include diagnosis, prevention and treatment of diseases and clinical conditions associated with GREB1. H11 (Accession NM_014365) is another VGAM2530 host target gene. H11 BINDING SITE is HOST TARGET binding site found in the 5' untranslated region of mRNA encoded by H11, corresponding to a HOST TARGET binding site such as BINDING SITE I, BINDING SITE II or BINDING SITE III. Table 2 illustrates the complementarity of the nucleotide sequences of H11 BINDING SITE, designated SEQ ID:15694, to the nucleotide sequence of VGAM2530 RNA, herein designated VGAM RNA, also designated SEQ ID:5241.

Another function of VGAM2530 is therefore inhibition of H11 (Accession NM_014365). Accordingly, utilities of VGAM2530 include diagnosis, prevention and treatment of diseases and clinical conditions associated with H11. HERV-H LTR-associating 2 (HHLA2, Accession NM_007072) is another VGAM2530 host target gene. HHLA2 BINDING SITE is HOST TARGET binding site found in the 3' untranslated region of mRNA encoded by HHLA2, corresponding to a HOST TARGET binding site such as BINDING SITE I, BINDING SITE II or BINDING SITE III. Table 2 illustrates the complementarity of the nucleotide sequences of HHLA2 BINDING SITE, designated SEQ ID:13940, to the nucleotide sequence of VGAM2530 RNA, herein designated VGAM RNA, also designated SEQ ID:5241.

Another function of VGAM2530 is therefore inhibition of HERV-H LTR-associating 2 (HHLA2, Accession NM_007072). Accordingly, utilities of VGAM2530 include diagnosis, prevention and treatment of diseases and clinical conditions associated with HHLA2. HSGP25L2G (Accession XM_030771) is another VGAM2530 host target gene. HSGP25L2G BINDING SITE is HOST TARGET binding site found in the 3' untranslated region of mRNA encoded by HSGP25L2G, corresponding to a HOST TARGET binding site such as BINDING SITE I, BINDING SITE II or BINDING SITE III. Table 2 illustrates the complementarity of the nucleotide sequences of HSGP25L2G BINDING SITE, designated SEQ ID:31136, to the nucleotide sequence of VGAM2530 RNA, herein designated VGAM RNA, also designated SEQ ID:5241.

Another function of VGAM2530 is therefore inhibition of HSGP25L2G (Accession XM_030771). Accordingly, utilities of VGAM2530 include diagnosis, prevention and treatment of diseases and clinical conditions associated with HSGP25L2G. Potassium Voltage-gated Channel, Delayed-rectifier, Subfamily S, Member 1 (KCNS1, Accession NM_002251) is another VGAM2530 host target gene. KCNS1 BINDING SITE is HOST TARGET binding site found in the 3' untranslated region of mRNA encoded by KCNS1, corresponding to a HOST TARGET binding site such as BINDING SITE I, BINDING SITE II or BINDING SITE III. Table 2 illustrates the complementarity of the nucleotide sequences of KCNS1 BINDING SITE, designated SEQ ID:8046, to the nucleotide sequence of VGAM2530 RNA, herein designated VGAM RNA, also designated SEQ ID:5241.

Another function of VGAM2530 is therefore inhibition of Potassium Voltage-gated Channel, Delayed-rectifier, Subfamily S, Member 1 (KCNS1, Accession NM_002251). Accordingly, utilities of VGAM2530 include diagnosis, prevention and treatment of diseases and clinical conditions associated with KCNS1. KIAA0747 (Accession NM_015292) is another VGAM2530 host target gene. KIAA0747 BINDING SITE is HOST TARGET binding site found in the 3' untranslated region of mRNA encoded by KIAA0747, corresponding to a HOST TARGET binding site such as BINDING SITE I, BINDING SITE II or BINDING SITE III. Table 2 illustrates the complementarity of the nucleotide sequences of KIAA0747 BINDING SITE, designated SEQ ID:17613, to the nucleotide sequence of VGAM2530 RNA, herein designated VGAM RNA, also designated SEQ ID:5241.

Another function of VGAM2530 is therefore inhibition of KIAA0747 (Accession NM_015292). Accordingly, utilities of VGAM2530 include diagnosis, prevention and treatment of diseases and clinical conditions associated with KIAA0747. KIAA1190 (Accession XM_048695) is another VGAM2530 host target gene. KIAA1190 BINDING SITE is HOST TARGET binding site found in the 3' untranslated region of mRNA encoded by KIAA1190, corresponding to a HOST TARGET binding site such as BINDING SITE I, BINDING SITE II or BINDING SITE III. Table 2 illustrates the complementarity of the nucleotide sequences of KIAA1190 BINDING SITE, designated SEQ ID:35225, to the nucleotide sequence of VGAM2530 RNA, herein designated VGAM RNA, also designated SEQ ID:5241.

Another function of VGAM2530 is therefore inhibition of KIAA1190 (Accession XM_048695). Accordingly, utilities of VGAM2530 include diagnosis, prevention and treatment of diseases and clinical conditions associated with KIAA1190. KIAA1456 (Accession XM_040100) is another VGAM2530 host target gene. KIAA1456 BINDING SITE is HOST TARGET binding site found in the 3' untranslated region of mRNA encoded by KIAA1456, corresponding to a HOST TARGET binding site such as BINDING SITE I, BINDING SITE II or BINDING SITE III. Table 2 illustrates the complementarity of the nucleotide sequences of KIAA1456 BINDING SITE, designated SEQ ID:33265, to the nucleotide sequence of VGAM2530 RNA, herein designated VGAM RNA, also designated SEQ ID:5241.

Another function of VGAM2530 is therefore inhibition of KIAA1456 (Accession XM_040100). Accordingly, utilities of VGAM2530 include diagnosis, prevention and treatment of diseases and clinical conditions associated with KIAA1456. KIAA1813 (Accession XM_046743) is another VGAM2530 host target gene. KIAA1813 BINDING SITE is HOST TARGET binding site found in the 5' untranslated region of mRNA encoded by KIAA1813, corresponding to a HOST TARGET binding site such as BINDING SITE I, BINDING SITE II or BINDING SITE III. Table 2 illustrates the complementarity of the nucleotide sequences of KIAA1813 BINDING SITE, designated SEQ ID:34812, to the nucleotide sequence of VGAM2530 RNA, herein designated VGAM RNA, also designated SEQ ID:5241.

Another function of VGAM2530 is therefore inhibition of KIAA1813 (Accession XM_046743). Accordingly, utilities of VGAM2530 include diagnosis, prevention and treatment of diseases and clinical conditions associated with KIAA1813. MGC20255 (Accession NM_052848) is another VGAM2530 host target gene. MGC20255 BINDING SITE1 and MGC20255 BINDING SITE2 are HOST TARGET binding sites found in untranslated regions of mRNA encoded by MGC20255, corresponding to HOST TARGET binding sites such as BINDING SITE I, BINDING SITE II or BINDING SITE III. Table 2 illustrates the complementarity of the nucleotide sequences of MGC20255 BINDING SITE1 and MGC20255 BINDING SITE2, designated SEQ ID:27431 and SEQ ID:27430 respectively, to the nucleotide sequence of VGAM2530 RNA, herein designated VGAM RNA, also designated SEQ ID:5241.

Another function of VGAM2530 is therefore inhibition of MGC20255 (Accession NM_052848). Accordingly, utilities of VGAM2530 include diagnosis, prevention and treatment of diseases and clinical conditions associated with MGC20255. MGC5590 (Accession NM_024058) is another VGAM2530 host target gene. MGC5590 BINDING SITE is HOST TARGET binding site found in the 5' untranslated region of mRNA encoded by MGC5590, corresponding to a HOST TARGET binding site such as BINDING SITE I, BINDING SITE II or BINDING SITE III. Table 2 illustrates the complementarity of the nucleotide sequences of MGC5590 BINDING SITE, designated SEQ ID:23496, to the nucleotide sequence of VGAM2530 RNA, herein designated VGAM RNA, also designated SEQ ID:5241.

Another function of VGAM2530 is therefore inhibition of MGC5590 (Accession NM_024058). Accordingly, utilities of VGAM2530 include diagnosis, prevention and treatment of diseases and clinical conditions associated with MGC5590. NK4 (Accession NM_004221) is another VGAM2530 host target gene. NK4 BINDING SITE is HOST TARGET binding site found in the 5' untranslated region of mRNA encoded by NK4, corresponding to a HOST TARGET binding site such as BINDING SITE I, BINDING SITE II or BINDING SITE III. Table 2 illustrates the complementarity of the nucleotide sequences of NK4 BINDING SITE, designated SEQ ID:10418, to the nucleotide sequence of VGAM2530 RNA, herein designated VGAM RNA, also designated SEQ ID:5241.

Another function of VGAM2530 is therefore inhibition of NK4 (Accession NM_004221). Accordingly, utilities of VGAM2530 include diagnosis, prevention and treatment of diseases and clinical conditions associated with NK4. PB1 (Accession NM_018165) is another VGAM2530 host target gene. PB1 BINDING SITE is HOST TARGET binding site found in the 3' untranslated region of mRNA encoded by PB1, corresponding to a HOST TARGET binding site such as BINDING SITE I, BINDING SITE II or BINDING SITE III. Table 2 illustrates the complementarity of the nucleotide sequences of PB1 BINDING SITE, designated SEQ ID:19979, to the nucleotide sequence of VGAM2530 RNA, herein designated VGAM RNA, also designated SEQ ID:5241.

Another function of VGAM2530 is therefore inhibition of PB1 (Accession NM_018165). Accordingly, utilities of VGAM2530 include diagnosis, prevention and treatment of diseases and clinical conditions associated with PB1. PP3501 (Accession NM_021731) is another VGAM2530 host target gene. PP3501 BINDING SITE is HOST TARGET binding site found in the 3' untranslated region of mRNA encoded by PP3501, corresponding to a HOST TARGET binding site such as BINDING SITE I, BINDING SITE II or BINDING SITE III. Table 2 illustrates the complementarity of the nucleotide sequences of PP3501 BINDING SITE, designated SEQ ID:22334, to the nucleotide sequence of VGAM2530 RNA, herein designated VGAM RNA, also designated SEQ ID:5241.

Another function of VGAM2530 is therefore inhibition of PP3501 (Accession NM_021731). Accordingly, utilities of VGAM2530 include diagnosis, prevention and treatment of diseases and clinical conditions associated with PP3501. PRO0659 (Accession NM_014138) is another VGAM2530 host target gene. PRO0659 BINDING SITE is HOST TARGET binding site found in the 3' untranslated region of mRNA encoded by PRO0659, corresponding to a HOST TARGET binding site such as BINDING SITE I, BINDING SITE II or BINDING SITE III. Table 2 illustrates the complementarity of the nucleotide sequences of PRO0659 BINDING SITE, designated SEQ ID:15406, to the nucleotide sequence of VGAM2530 RNA, herein designated VGAM RNA, also designated SEQ ID:5241.

Another function of VGAM2530 is therefore inhibition of PRO0659 (Accession NM_014138). Accordingly, utilities of VGAM2530 include diagnosis, prevention and treatment of diseases and clinical conditions associated with PRO0659. R3H Domain (binds single-stranded nucleic acids) Containing (R3HDM, Accession NM_015361) is another VGAM2530 host target gene. R3HDM BINDING SITE is HOST TARGET binding site found in the 3' untranslated region of mRNA encoded by R3HDM, corresponding to a HOST TARGET binding site such as BINDING SITE I, BINDING SITE II or BINDING SITE III. Table 2 illustrates the complementarity of the nucleotide sequences of R3HDM BINDING SITE, designated SEQ ID:17661, to the nucleotide sequence of VGAM2530 RNA, herein designated VGAM RNA, also designated SEQ ID:5241.

Another function of VGAM2530 is therefore inhibition of R3H Domain (binds single-stranded nucleic acids) Containing (R3HDM, Accession NM_015361). Accordingly, utilities of VGAM2530 include diagnosis, prevention and treatment of diseases and clinical conditions associated with R3HDM. RBT1 (Accession NM_013368) is another VGAM2530 host target gene. RBT1 BINDING SITE is HOST TARGET binding site found in the 3' untranslated region of mRNA encoded by RBT1, corresponding to a HOST TARGET binding site such as BINDING SITE I, BINDING SITE II or BINDING SITE III. Table 2 illustrates the complementarity of the nucleotide sequences of RBT1 BINDING SITE, designated SEQ ID:15013, to the nucleotide sequence of VGAM2530 RNA, herein designated VGAM RNA, also designated SEQ ID:5241.

Another function of VGAM2530 is therefore inhibition of RBT1 (Accession NM_013368). Accordingly, utilities of VGAM2530 include diagnosis, prevention and treatment of diseases and clinical conditions associated with RBT1. RoXaN (Accession NM_025013) is another VGAM2530 host target gene. RoXaN BINDING SITE is HOST TARGET binding site found in the 3' untranslated region of mRNA encoded by RoXaN, corresponding to a HOST TARGET binding site such as BINDING SITE I, BINDING SITE II or BINDING SITE III. Table 2 illustrates the complementarity of the nucleotide sequences of RoXaN BINDING SITE, designated SEQ ID:24604, to the nucleotide sequence of VGAM2530 RNA, herein designated VGAM RNA, also designated SEQ ID:5241.

Another function of VGAM2530 is therefore inhibition of RoXaN (Accession NM_025013). Accordingly, utilities of VGAM2530 include diagnosis, prevention and treatment of diseases and clinical conditions associated with RoXaN. U5-100K (Accession XM_006784) is another VGAM2530 host target gene. U5-100K BINDING SITE is HOST TAR- GET binding site found in the 3' untranslated region of mRNA encoded by U5-100K, corresponding to a HOST TARGET binding site such as BINDING SITE I, BINDING SITE II or BINDING SITE III. Table 2 illustrates the complementarity of the nucleotide sequences of U5-100K BINDING SITE, designated SEQ ID:30012, to the nucleotide sequence of VGAM2530 RNA, herein designated VGAM RNA, also designated SEQ ID:5241.

Another function of VGAM2530 is therefore inhibition of U5-100K (Accession XM_006784). Accordingly, utilities of VGAM2530 include diagnosis, prevention and treatment of diseases and clinical conditions associated with U5-100K. ZAK (Accession NM_133646) is another VGAM2530 host target gene. ZAK BINDING SITE is HOST TARGET binding site found in the 3' untranslated region of mRNA encoded by ZAK, corresponding to a HOST TARGET binding site such as BINDING SITE I, BINDING SITE II or BINDING SITE III. Table 2 illustrates the complementarity of the nucleotide sequences of ZAK BINDING SITE, designated SEQ ID:28607, to the nucleotide sequence of VGAM2530 RNA, herein designated VGAM RNA, also designated SEQ ID:5241.

Another function of VGAM2530 is therefore inhibition of ZAK (Accession NM_133646). Accordingly, utilities of VGAM2530 include diagnosis, prevention and treatment of diseases and clinical conditions associated with ZAK. ZER6 (Accession XM_032742) is another VGAM2530 host target gene. ZER6 BINDING SITE is HOST TARGET binding site found in the 3' untranslated region of mRNA encoded by ZER6, corresponding to a HOST TARGET binding site such as BINDING SITE I, BINDING SITE II or BINDING SITE III. Table 2 illustrates the complementarity of the nucleotide sequences of ZER6 BINDING SITE, designated SEQ ID:31745, to the nucleotide sequence of VGAM2530 RNA, herein designated VGAM RNA, also designated SEQ ID:5241.

Another function of VGAM2530 is therefore inhibition of ZER6 (Accession XM_032742). Accordingly, utilities of VGAM2530 include diagnosis, prevention and treatment of diseases and clinical conditions associated with ZER6. LOC138389 (Accession XM_072534) is another VGAM2530 host target gene. LOC138389 BINDING SITE is HOST TARGET binding site found in the 5' untranslated region of mRNA encoded by LOC138389, corresponding to a HOST TARGET binding site such as BINDING SITE I, BINDING SITE II or BINDING SITE III. Table 2 illustrates the complementarity of the nucleotide sequences of LOC138389 BINDING SITE, designated SEQ ID:37508, to the nucleotide sequence of VGAM2530 RNA, herein designated VGAM RNA, also designated SEQ ID:5241.

Another function of VGAM2530 is therefore inhibition of LOC138389 (Accession XM_072534). Accordingly, utilities of VGAM2530 include diagnosis, prevention and treatment of diseases and clinical conditions associated with LOC138389. LOC145900 (Accession XM_085276) is another VGAM2530 host target gene. LOC145900 BINDING SITE is HOST TARGET binding site found in the 5' untranslated region of mRNA encoded by LOC145900, corresponding to a HOST TARGET binding site such as BINDING SITE I, BINDING SITE II or BINDING SITE III. Table 2 illustrates the complementarity of the nucleotide sequences of LOC145900 BINDING SITE, designated SEQ ID:38014, to the nucleotide sequence of VGAM2530 RNA, herein designated VGAM RNA, also designated SEQ ID:5241.

Another function of VGAM2530 is therefore inhibition of LOC145900 (Accession XM_085276). Accordingly, utilities of VGAM2530 include diagnosis, prevention and treatment of diseases and clinical conditions associated with LOC145900. LOC148137 (Accession NM_144692) is another VGAM2530 host target gene. LOC148137 BINDING SITE is HOST TARGET binding site found in the 3' untranslated region of mRNA encoded by LOC148137, corresponding to a HOST TARGET binding site such as BINDING SITE I, BINDING SITE II or BINDING SITE III. Table 2 illustrates the complementarity of the nucleotide sequences of LOC148137 BINDING SITE, designated SEQ ID:29520, to the nucleotide sequence of VGAM2530 RNA, herein designated VGAM RNA, also designated SEQ ID:5241.

Another function of VGAM2530 is therefore inhibition of LOC148137 (Accession NM_144692). Accordingly, utilities of VGAM2530 include diagnosis, prevention and treatment of diseases and clinical conditions associated with LOC148137. LOC148508 (Accession XM_097478) is another VGAM2530 host target gene. LOC148508 BINDING SITE is HOST TARGET binding site found in the 3' untranslated region of mRNA encoded by LOC148508, corresponding to a HOST TARGET binding site such as BINDING SITE I, BINDING SITE II or BINDING SITE III. Table 2 illustrates the complementarity of the nucleotide sequences of LOC148508 BINDING SITE, designated SEQ ID:40885, to the nucleotide sequence of VGAM2530 RNA, herein designated VGAM RNA, also designated SEQ ID:5241.

Another function of VGAM2530 is therefore inhibition of LOC148508 (Accession XM_097478). Accordingly, utilities of VGAM2530 include diagnosis, prevention and treatment of diseases and clinical conditions associated with LOC148508. LOC148534 (Accession XM_086222) is another VGAM2530 host target gene. LOC148534 BINDING SITE is HOST TARGET binding site found in the 3' untranslated region of mRNA encoded by LOC148534, corresponding to a HOST TARGET binding site such as BINDING SITE I, BINDING SITE II or BINDING SITE III. Table 2 illustrates the complementarity of the nucleotide sequences of LOC148534 BINDING SITE, designated SEQ ID:38551, to the nucleotide sequence of VGAM2530 RNA, herein designated VGAM RNA, also designated SEQ ID:5241.

Another function of VGAM2530 is therefore inhibition of LOC148534 (Accession XM_086222). Accordingly, utilities of VGAM2530 include diagnosis, prevention and treatment of diseases and clinical conditions associated with LOC148534. LOC148930 (Accession XM_086369) is another VGAM2530 host target gene. LOC148930 BINDING SITE is HOST TARGET binding site found in the 3' untranslated region of mRNA encoded by LOC148930, corresponding to a HOST TARGET binding site such as BINDING SITE I, BINDING SITE II or BINDING SITE III. Table 2 illustrates the complementarity of the nucleotide sequences of LOC148930 BINDING SITE, designated SEQ ID:38620, to the nucleotide sequence of VGAM2530 RNA, herein designated VGAM RNA, also designated SEQ ID:5241.

Another function of VGAM2530 is therefore inhibition of LOC148930 (Accession XM_086369). Accordingly, utilities of VGAM2530 include diagnosis, prevention and treatment of diseases and clinical conditions associated with LOC148930. LOC149721 (Accession XM_086649) is another VGAM2530 host target gene. LOC149721 BINDING SITE is HOST TARGET binding site found in the 3' untranslated region of mRNA encoded by LOC149721, corresponding to a HOST TARGET binding site such as BINDING SITE I, BINDING SITE II or BINDING SITE III. Table 2 illustrates the complementarity of the nucleotide sequences of LOC149721 BINDING SITE, designated SEQ ID:38814, to the nucleotide sequence of VGAM2530 RNA, herein designated VGAM RNA, also designated SEQ ID:5241.

Another function of VGAM2530 is therefore inhibition of LOC149721 (Accession XM_086649). Accordingly, utilities of VGAM2530 include diagnosis, prevention and treatment of diseases and clinical conditions associated with LOC149721. LOC150157 (Accession XM_097823) is another VGAM2530 host target gene. LOC150157 BINDING SITE is HOST TARGET binding site found in the 3' untranslated region of mRNA encoded by LOC150157, corresponding to a HOST TARGET binding site such as BINDING SITE I, BINDING SITE II or BINDING SITE III. Table 2 illustrates the complementarity of the nucleotide sequences of LOC150157 BINDING SITE, designated SEQ ID:41143, to the nucleotide sequence of VGAM2530 RNA, herein designated VGAM RNA, also designated SEQ ID:5241.

Another function of VGAM2530 is therefore inhibition of LOC150157 (Accession XM_097823). Accordingly, utilities of VGAM2530 include diagnosis, prevention and treatment of diseases and clinical conditions associated with LOC150157. LOC152972 (Accession XM_087572) is another VGAM2530 host target gene. LOC152972 BINDING SITE is HOST TARGET binding site found in the 5' untranslated region of mRNA encoded by LOC152972, corresponding to a HOST TARGET binding site such as BINDING SITE I, BINDING SITE II or BINDING SITE III. Table 2 illustrates the complementarity of the nucleotide sequences of LOC152972 BINDING SITE, designated SEQ ID:39346, to the nucleotide sequence of VGAM2530 RNA, herein designated VGAM RNA, also designated SEQ ID:5241.

Another function of VGAM2530 is therefore inhibition of LOC152972 (Accession XM_087572). Accordingly, utilities of VGAM2530 include diagnosis, prevention and treatment of diseases and clinical conditions associated with LOC152972. LOC196890 (Accession XM_116951) is another VGAM2530 host target gene. LOC196890 BINDING SITE is HOST TARGET binding site found in the 3' untranslated region of mRNA encoded by LOC196890, corresponding to a HOST TARGET binding site such as BINDING SITE I, BINDING SITE II or BINDING SITE III. Table 2 illustrates the complementarity of the nucleotide sequences of LOC196890 BINDING SITE, designated SEQ ID:43155, to the nucleotide sequence of VGAM2530 RNA, herein designated VGAM RNA, also designated SEQ ID:5241.

Another function of VGAM2530 is therefore inhibition of LOC196890 (Accession XM_116951). Accordingly, utilities of VGAM2530 include diagnosis, prevention and treatment of diseases and clinical conditions associated with LOC196890. LOC200014 (Accession XM_114087) is another VGAM2530 host target gene. LOC200014 BINDING SITE is HOST TARGET binding site found in the 3' untranslated region of mRNA encoded by LOC200014, corresponding to a HOST TARGET binding site such as BINDING SITE I, BINDING SITE II or BINDING SITE III. Table 2 illustrates the complementarity of the nucleotide sequences of LOC200014 BINDING SITE, designated SEQ ID:42696, to the nucleotide sequence of VGAM2530 RNA, herein designated VGAM RNA, also designated SEQ ID:5241.

Another function of VGAM2530 is therefore inhibition of LOC200014 (Accession XM_114087). Accordingly, utilities of VGAM2530 include diagnosis, prevention and treatment of diseases and clinical conditions associated with LOC200014. LOC200853 (Accession XM_114308) is another VGAM2530 host target gene. LOC200853 BINDING SITE is HOST TARGET binding site found in the 3' untranslated region of mRNA encoded by LOC200853, corresponding to a HOST TARGET binding site such as BINDING SITE I, BINDING SITE II or BINDING SITE III. Table 2 illustrates the complementarity of the nucleotide sequences of LOC200853 BINDING SITE, designated SEQ ID:42869, to the nucleotide sequence of VGAM2530 RNA, herein designated VGAM RNA, also designated SEQ ID:5241.

Another function of VGAM2530 is therefore inhibition of LOC200853 (Accession XM_114308). Accordingly, utilities of VGAM2530 include diagnosis, prevention and treatment of diseases and clinical conditions associated with LOC200853. LOC253805 (Accession XM_172854) is another VGAM2530 host target gene. LOC253805 BINDING SITE is HOST TARGET binding site found in the 3' untranslated region of mRNA encoded by LOC253805, corresponding to a HOST TARGET binding site such as BINDING SITE I, BINDING SITE II or BINDING SITE III. Table 2 illustrates the complementarity of the nucleotide sequences of LOC253805 BINDING SITE, designated SEQ ID:46139, to the nucleotide sequence of VGAM2530 RNA, herein designated VGAM RNA, also designated SEQ ID:5241.

Another function of VGAM2530 is therefore inhibition of LOC253805 (Accession XM_172854). Accordingly, utilities of VGAM2530 include diagnosis, prevention and treatment of diseases and clinical conditions associated with LOC253805. LOC90593 (Accession XM_032815) is another VGAM2530 host target gene. LOC90593 BINDING SITE is HOST TARGET binding site found in the 3' untranslated region of mRNA encoded by LOC90593, corresponding to a HOST TARGET binding site such as BINDING SITE I, BINDING SITE II or BINDING SITE III. Table 2 illustrates the complementarity of the nucleotide sequences of LOC90593 BINDING SITE, designated SEQ ID:31767, to the nucleotide sequence of VGAM2530 RNA, herein designated VGAM RNA, also designated SEQ ID:5241.

Another function of VGAM2530 is therefore inhibition of LOC90593 (Accession XM_032815). Accordingly, utilities of VGAM2530 include diagnosis, prevention and treatment of diseases and clinical conditions associated with LOC90593. LOC91516 (Accession XM_038924) is another VGAM2530 host target gene. LOC91516 BINDING SITE is HOST TARGET binding site found in the 5' untranslated region of mRNA encoded by LOC91516, corresponding to a HOST TARGET binding site such as BINDING SITE I, BINDING SITE II or BINDING SITE III. Table 2 illustrates the complementarity of the nucleotide sequences of LOC91516 BINDING SITE, designated SEQ ID:32957, to the nucleotide sequence of VGAM2530 RNA, herein designated VGAM RNA, also designated SEQ ID:5241.

Another function of VGAM2530 is therefore inhibition of LOC91516 (Accession XM_038924). Accordingly, utilities of VGAM2530 include diagnosis, prevention and treatment of diseases and clinical conditions associated with LOC91516. LOC92539 (Accession XM_045632) is another VGAM2530 host target gene. LOC92539 BINDING SITE is HOST TARGET binding site found in the 5' untranslated region of mRNA encoded by LOC92539, corresponding to a HOST TARGET binding site such as BINDING SITE I, BINDING SITE II or BINDING SITE III. Table 2 illustrates the complementarity of the nucleotide sequences of LOC92539 BINDING SITE, designated SEQ ID:34506, to the nucleotide sequence of VGAM2530 RNA, herein designated VGAM RNA, also designated SEQ ID:5241.

Another function of VGAM2530 is therefore inhibition of LOC92539 (Accession XM_045632). Accordingly, utilities of VGAM2530 include diagnosis, prevention and treatment of diseases and clinical conditions associated with LOC92539. FIG. 1 further provides a conceptual description of a novel bioinformatically detected viral gene of the present invention, referred to here as Viral Genomic Address Messenger 2531 (VGAM2531) viral gene, which modulates expression of respective host target genes thereof, the function and utility of which host target genes is known in the art.

VGAM2531 is a novel bioinformatically detected regulatory, non protein coding, viral micro RNA (miRNA) gene. The method by which VGAM2531 was detected is described hereinabove with reference to FIGS. 1-8.

VGAM2531 gene, herein designated VGAM GENE, is a viral gene contained in the genome of Pepper Ringspot Virus. VGAM2531 host target gene, herein designated VGAM HOST TARGET GENE, is a human gene contained in the human genome.

VGAM2531 gene encodes a VGAM2531 precursor RNA, herein designated VGAM PRECURSOR RNA. Similar to other miRNA genes, and unlike most ordinary genes, VGAM2531 precursor RNA does not encode a protein. A nucleotide sequence identical or highly similar to the nucleotide sequence of VGAM2531 precursor RNA is designated SEQ ID:2517, and is provided hereinbelow with reference to the sequence listing part. Nucleotide sequence SEQ ID:2517 is located at position 2562 relative to the genome of Pepper Ringspot Virus.

VGAM2531 precursor RNA folds onto itself, forming VGAM2531 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2531 folded precursor RNA into VGAM2531 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM2531 RNA is designated SEQ ID:5242, and is provided hereinbelow with reference to the sequence listing part.

VGAM2531 host target gene, herein designated VGAM HOST TARGET GENE, encodes a corresponding messenger RNA, VGAM2531 host target RNA, herein designated VGAM HOST TARGET RNA. VGAM2531 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2531 RNA, herein designated VGAM RNA, binds complementarily to one or more host target binding sites located in untranslated regions of VGAM2531 host target RNA, herein designated VGAM HOST TARGET RNA. This complementary binding is due to the fact that the nucleotide sequence of VGAM2531 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2531 RNA, herein designated VGAM RNA, may have a different number of host target binding sites in untranslated regions of a VGAM2531 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2531 RNA, herein designated VGAM RNA, to host target binding sites on VGAM2531 host target RNA, herein designated VGAM HOST TARGET RNA, such as BINDING SITE I, BINDING SITE II and BINDING SITE III, inhibits translation of VGAM2531 host target RNA into VGAM2531 host target protein, herein designated VGAM HOST TARGET PROTEIN. VGAM host target protein is therefore outlined by a broken line.

It is appreciated that VGAM2531 host target gene, herein designated VGAM HOST TARGET GENE, in fact represents a plurality of VGAM2531 host target genes. The mRNA of each one of this plurality of VGAM2531 host target genes comprises one or more host target binding sites, each having a nucleotide sequence which is at least partly complementary to VGAM2531 RNA, herein designated VGAM RNA, and which when bound by VGAM2531 RNA causes inhibition of translation of respective one or more VGAM2531 host target proteins.

It is further appreciated by one skilled in the art that the mode of translational inhibition illustrated by FIG. 1 with specific reference to translational inhibition exerted by VGAM2531 gene, herein designated VGAM GENE, on one or more VGAM2531 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2531 is inhibition of expression of host target genes, as part of a novel viral mechanism of attacking a host. Accordingly, utilities of VGAM2531 include diagnosis, prevention and treatment of viral infection by Pepper Ringspot Virus. Specific functions, and accordingly utilities, of VGAM2531 correlate with, and may be deduced from, the identity of the host target genes which VGAM2531 binds and inhibits, and the function of these host target genes, as elaborated hereinbelow.

Nucleotide sequences of the VGAM2531 precursor RNA, herein designated VGAM PRECURSOR RNA, and of the 'diced' VGAM2531 RNA, herein designated VGAM RNA, and a schematic representation of the secondary folding of VGAM2531 folded precursor RNA, herein designated VGAM FOLDED PRECURSOR RNA, of VGAM2531 are further described hereinbelow with reference to Table 1.

Nucleotide sequences of host target binding sites, such as BINDING SITE-I, BINDING SITE-II and BINDING SITE-III of FIG. 1, found on VGAM2531 host target RNA, and schematic representation of the complementarity of each of these host target binding sites to VGAM2531 RNA, herein designated VGAM RNA, are described hereinbelow with reference to Table 2.

As mentioned hereinabove with reference to FIG. 1, a function of VGAM2531 gene, herein designated VGAM is inhibition of expression of VGAM2531 target genes. It is appreciated that specific functions, and accordingly utilities, of VGAM2531 correlate with, and may be deduced from, the identity of the target genes which VGAM2531 binds and inhibits, and the function of these target genes, as elaborated hereinbelow.

Diacylglycerol O-acyltransferase Homolog 2 (mouse) (DGAT2, Accession NM_032564) is a VGAM2531 host target gene. DGAT2 BINDING SITE is HOST TARGET binding site found in the 3' untranslated region of mRNA encoded by DGAT2, corresponding to a HOST TARGET binding site such as BINDING SITE I, BINDING SITE II or BINDING SITE III. Table 2 illustrates the complementarity of the nucleotide sequences of DGAT2 BINDING SITE, designated SEQ ID:26288, to the nucleotide sequence of VGAM2531 RNA, herein designated VGAM RNA, also designated SEQ ID:5242.

A function of VGAM2531 is therefore inhibition of Diacylglycerol O-acyltransferase Homolog 2 (mouse) (DGAT2, Accession NM_032564). Accordingly, utilities of VGAM2531 include diagnosis, prevention and treatment of diseases and clinical conditions associated with DGAT2. Major Histocompatibility Complex, Class II, DQ Alpha 1 (HLA-DQA1, Accession XM_175260) is another VGAM2531 host target gene. HLA-DQA1 BINDING SITE is HOST TARGET binding site found in the 3' untranslated region of mRNA encoded by HLA-DQA1, corresponding to a HOST TARGET binding site such as BINDING SITE I, BINDING SITE II or BINDING SITE III. Table 2 illustrates the complementarity of the nucleotide sequences of HLA-DQA1 BINDING SITE, designated SEQ ID:46725, to the nucleotide sequence of VGAM2531 RNA, herein designated VGAM RNA, also designated SEQ ID:5242.

Another function of VGAM2531 is therefore inhibition of Major Histocompatibility Complex, Class II, DQ Alpha 1 (HLA-DQA1, Accession XM_175260), a gene which is alpha 1 chain of HLA-DQ1 class II molecule (Ia antigen) which binds peptides and presents them to CD4+ T lymphocytes. Accordingly, utilities of VGAM2531 include diagnosis, prevention and treatment of diseases and clinical conditions associated with HLA-DQA1. The function of HLA-DQA1 and its association with various diseases and clinical conditions, has been established by previous studies, as described hereinabove with reference to VGAM132. FLJ00001 (Accession XM_088525) is another VGAM2531 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39788, to the nucleotide sequence of VGAM2531 RNA, herein designated VGAM RNA, also designated SEQ ID:5242.

Another function of VGAM2531 is therefore inhibition of FLJ00001 (Accession XM_088525). Accordingly, utilities of VGAM2531 include diagnosis, prevention and treatment of diseases and clinical conditions associated with FLJ00001. LOC255042 (Accession XM_170896) is another VGAM2531 host target gene. LOC255042 BINDING SITE is HOST TARGET binding site found in the 3' untranslated region of mRNA encoded by LOC255042, corresponding to a HOST TARGET binding site such as BINDING SITE I, BINDING SITE II or BINDING SITE III. Table 2 illustrates the complementarity of the nucleotide sequences of LOC255042 BINDING SITE, designated SEQ ID:45647, to the nucleotide sequence of VGAM2531 RNA, herein designated VGAM RNA, also designated SEQ ID:5242.

Another function of VGAM2531 is therefore inhibition of LOC255042 (Accession XM_170896). Accordingly, utilities of VGAM2531 include diagnosis, prevention and treatment of diseases and clinical conditions associated with LOC255042. FIG. 1 further provides a conceptual description of a novel bioinformatically detected viral gene of the present invention, referred to here as Viral Genomic Address Messenger 2532 (VGAM2532) viral gene, which modulates expression of respective host target genes thereof, the function and utility of which host target genes is known in the art.

VGAM2532 is a novel bioinformatically detected regulatory, non protein coding, viral micro RNA (miRNA) gene. The method by which VGAM2532 was detected is described hereinabove with reference to FIGS. 1-8.

VGAM2532 gene, herein designated VGAM GENE, is a viral gene contained in the genome of Rio Bravo Virus. VGAM2532 host target gene, herein designated VGAM HOST TARGET GENE, is a human gene contained in the human genome.

VGAM2532 gene encodes a VGAM2532 precursor RNA, herein designated VGAM PRECURSOR RNA. Similar to other miRNA genes, and unlike most ordinary genes, VGAM2532 precursor RNA does not encode a protein. A nucleotide sequence identical or highly similar to the nucleotide sequence of VGAM2532 precursor RNA is designated SEQ ID:2518, and is provided hereinbelow with reference to the sequence listing part. Nucleotide sequence SEQ ID:2518 is located at position 643 relative to the genome of Rio Bravo Virus.

VGAM2532 precursor RNA folds onto itself, forming VGAM2532 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2532 folded precursor RNA into VGAM2532 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2532 RNA is designated SEQ ID:5243, and is provided hereinbelow with reference to the sequence listing part.

VGAM2532 host target gene, herein designated VGAM HOST TARGET GENE, encodes a corresponding messenger RNA, VGAM2532 host target RNA, herein designated VGAM HOST TARGET RNA. VGAM2532 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2532 RNA, herein designated VGAM RNA, binds complementarily to one or more host target binding sites located in untranslated regions of VGAM2532 host target RNA, herein designated VGAM HOST TARGET RNA. This complementary binding is due to the fact that the nucleotide sequence of VGAM2532 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2532 RNA, herein designated VGAM RNA, may have a different number of host target binding sites in untranslated regions of a VGAM2532 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2532 RNA, herein designated VGAM RNA, to host target binding sites on VGAM2532 host target RNA, herein designated VGAM HOST TARGET RNA, such as BINDING SITE I, BINDING SITE II and BINDING SITE III, inhibits translation of VGAM2532 host target RNA into VGAM2532 host target protein, herein designated VGAM HOST TARGET PROTEIN. VGAM host target protein is therefore outlined by a broken line.

It is appreciated that VGAM2532 host target gene, herein designated VGAM HOST TARGET GENE, in fact represents a plurality of VGAM2532 host target genes. The mRNA of each one of this plurality of VGAM2532 host target genes comprises one or more host target binding sites, each having a nucleotide sequence which is at least partly complementary to VGAM2532 RNA, herein designated VGAM RNA, and which when bound by VGAM2532 RNA causes inhibition of translation of respective one or more VGAM2532 host target proteins.

It is further appreciated by one skilled in the art that the mode of translational inhibition illustrated by FIG. 1 with specific reference to translational inhibition exerted by VGAM2532 gene, herein designated VGAM GENE, on one or more VGAM2532 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2532 is inhibition of expression of host target genes, as part of a novel viral mechanism of attacking a host. Accordingly, utilities of VGAM2532 include diagnosis, prevention and treatment of viral infection by Rio Bravo Virus. Specific functions, and accordingly utilities, of VGAM2532 correlate with, and may be deduced from, the identity of the host target genes which VGAM2532 binds and inhibits, and the function of these host target genes, as elaborated hereinbelow.

Nucleotide sequences of the VGAM2532 precursor RNA, herein designated VGAM PRECURSOR RNA, and of the 'diced' VGAM2532 RNA, herein designated VGAM RNA, and a schematic representation of the secondary folding of VGAM2532 folded precursor RNA, herein designated VGAM FOLDED PRECURSOR RNA, of VGAM2532 are further described hereinbelow with reference to Table 1.

Nucleotide sequences of host target binding sites, such as BINDING SITE-I, BINDING SITE-II and BINDING SITE-III of FIG. 1, found on VGAM2532 host target RNA, and schematic representation of the complementarity of each of these host target binding sites to VGAM2532 RNA, herein designated VGAM RNA, are described hereinbelow with reference to Table 2.

As mentioned hereinabove with reference to FIG. 1, a function of VGAM2532 gene, herein designated VGAM is inhibition of expression of VGAM2532 target genes. It is appreciated that specific functions, and accordingly utilities, of VGAM2532 correlate with, and may be deduced from, the identity of the target genes which VGAM2532 binds and inhibits, and the function of these target genes, as elaborated hereinbelow.

BRAG (Accession NM_014863) is a VGAM2532 host target gene. BRAG BINDING SITE is HOST TARGET binding site found in the 3' untranslated region of mRNA encoded by BRAG, corresponding to a HOST TARGET binding site such as BINDING SITE I, BINDING SITE II or BINDING SITE III. Table 2 illustrates the complementarity of the nucleotide sequences of BRAG BINDING SITE, designated SEQ ID:16939, to the nucleotide sequence of VGAM2532 RNA, herein designated VGAM RNA, also designated SEQ ID:5243.

A function of VGAM2532 is therefore inhibition of BRAG (Accession NM_014863). Accordingly, utilities of VGAM2532 include diagnosis, prevention and treatment of diseases and clinical conditions associated with BRAG. FIG. 1 further provides a conceptual description of a novel bioinformatically detected viral gene of the present invention, referred to here as Viral Genomic Address Messenger 2533 (VGAM2533) viral gene, which modulates expression of respective host target genes thereof, the function and utility of which host target genes is known in the art.

VGAM2533 is a novel bioinformatically detected regulatory, non protein coding, viral micro RNA (miRNA) gene. The method by which VGAM2533 was detected is described hereinabove with reference to FIGS. 1-8.

VGAM2533 gene, herein designated VGAM GENE, is a viral gene contained in the genome of Rio Bravo Virus. VGAM2533 host target gene, herein designated VGAM HOST TARGET GENE, is a human gene contained in the human genome.

VGAM2533 gene encodes a VGAM2533 precursor RNA, herein designated VGAM PRECURSOR RNA. Similar to other miRNA genes, and unlike most ordinary genes, VGAM2533 precursor RNA does not encode a protein. A nucleotide sequence identical or highly similar to the nucleotide sequence of VGAM2533 precursor RNA is designated SEQ ID:2519, and is provided hereinbelow with reference to the sequence listing part. Nucleotide sequence SEQ ID:2519 is located at position 3063 relative to the genome of Rio Bravo Virus.

VGAM2533 precursor RNA folds onto itself, forming VGAM2533 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2533 folded precursor RNA into VGAM2533 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2533 RNA is designated SEQ ID:5244, and is provided hereinbelow with reference to the sequence listing part.

VGAM2533 host target gene, herein designated VGAM HOST TARGET GENE, encodes a corresponding messenger RNA, VGAM2533 host target RNA, herein designated VGAM HOST TARGET RNA. VGAM2533 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2533 RNA, herein designated VGAM RNA, binds complementarily to one or more host target binding sites located in untranslated regions of VGAM2533 host target RNA, herein designated VGAM HOST TARGET RNA. This complementary binding is due to the fact that the nucleotide sequence of VGAM2533 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2533 RNA, herein designated VGAM RNA, may have a different number of host target binding sites in untranslated regions of a VGAM2533 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2533 RNA, herein designated VGAM RNA, to host target binding sites on VGAM2533 host target RNA, herein designated VGAM HOST TARGET RNA, such as BINDING SITE I, BINDING SITE II and BINDING SITE III, inhibits translation of VGAM2533 host target RNA into VGAM2533 host target protein, herein designated VGAM HOST TARGET PROTEIN. VGAM host target protein is therefore outlined by a broken line.

It is appreciated that VGAM2533 host target gene, herein designated VGAM HOST TARGET GENE, in fact represents a plurality of VGAM2533 host target genes. The mRNA of each one of this plurality of VGAM2533 host target genes comprises one or more host target binding sites, each having a nucleotide sequence which is at least partly complementary to VGAM2533 RNA, herein designated VGAM RNA, and which when bound by VGAM2533 RNA causes inhibition of translation of respective one or more VGAM2533 host target proteins.

It is further appreciated by one skilled in the art that the mode of translational inhibition illustrated by FIG. 1 with specific reference to translational inhibition exerted by VGAM2533 gene, herein designated VGAM GENE, on one or more VGAM2533 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2533 is inhibition of expression of host target genes, as part of a novel viral mechanism of attacking a host. Accordingly, utilities of VGAM2533 include diagnosis, prevention and treatment of viral infection by Rio Bravo Virus. Specific functions, and accordingly utilities, of VGAM2533 correlate with, and may be deduced from, the identity of the host target genes which VGAM2533 binds and inhibits, and the function of these host target genes, as elaborated hereinbelow.

Nucleotide sequences of the VGAM2533 precursor RNA, herein designated VGAM PRECURSOR RNA, and of the 'diced' VGAM2533 RNA, herein designated VGAM RNA, and a schematic representation of the secondary folding of VGAM2533 folded precursor RNA, herein designated VGAM FOLDED PRECURSOR RNA, of VGAM2533 are further described hereinbelow with reference to Table 1.

Nucleotide sequences of host target binding sites, such as BINDING SITE-I, BINDING SITE-II and BINDING SITE-III of FIG. 1, found on VGAM2533 host target RNA, and schematic representation of the complementarity of each of these host target binding sites to VGAM2533 RNA, herein designated VGAM RNA, are described hereinbelow with reference to Table 2.

As mentioned hereinabove with reference to FIG. 1, a function of VGAM2533 gene, herein designated VGAM is inhibition of expression of VGAM2533 target genes. It is appreciated that specific functions, and accordingly utilities, of VGAM2533 correlate with, and may be deduced from, the identity of the target genes which VGAM2533 binds and inhibits, and the function of these target genes, as elaborated hereinbelow.

CRACC (Accession NM_021181) is a VGAM2533 host target gene. CRACC BINDING SITE is HOST TARGET binding site found in the 3' untranslated region of mRNA encoded by CRACC, corresponding to a HOST TARGET binding site such as BINDING SITE I, BINDING SITE II or BINDING SITE III. Table 2 illustrates the complementarity of the nucleotide sequences of CRACC BINDING SITE, designated SEQ ID:22153, to the nucleotide sequence of VGAM2533 RNA, herein designated VGAM RNA, also designated SEQ ID:5244.

A function of VGAM2533 is therefore inhibition of CRACC (Accession NM_021181), a gene which may participate in adhesion reactions between t lymphocytes and accessory cells. Accordingly, utilities of VGAM2533 include diagnosis, prevention and treatment of diseases and clinical conditions associated with CRACC. The function of CRACC and its association with various diseases and clinical conditions, has been established by previous studies, as described hereinabove with reference to VGAM26. Inositol 1,4,5-triphosphate Receptor, Type 3 (ITPR3, Accession NM_002224) is another VGAM2533 host target gene. ITPR3 BINDING SITE is HOST TARGET binding site found in the 3' untranslated region of mRNA encoded by ITPR3, corresponding to a HOST TARGET binding site such as BINDING SITE I, BINDING SITE II or BINDING SITE III. Table 2 illustrates the complementarity of the nucleotide sequences of ITPR3 BINDING SITE, designated SEQ ID:7997, to the nucleotide sequence of VGAM2533 RNA, herein designated VGAM RNA, also designated SEQ ID:5244.

Another function of VGAM2533 is therefore inhibition of Inositol 1,4,5-triphosphate Receptor, Type 3 (ITPR3, Accession NM_002224), a gene which may be responsible for calcium release from intracellular stores. Accordingly, utilities of VGAM2533 include diagnosis, prevention and treatment of diseases and clinical conditions associated with ITPR3. The function of ITPR3 and its association with various diseases and clinical conditions, has been established by previous studies, as described hereinabove with reference to VGAM310. Laminin, Gamma 1 (formerly LAMB2)

(LAMC1, Accession NM_002293) is another VGAM2533 host target gene. LAMC1 BINDING SITE is HOST TARGET binding site found in the 3' untranslated region of mRNA encoded by LAMC1, corresponding to a HOST TARGET binding site such as BINDING SITE I, BINDING SITE II or BINDING SITE III. Table 2 illustrates the complementarity of the nucleotide sequences of LAMC1 BINDING SITE, designated SEQ ID:8079, to the nucleotide sequence of VGAM2533 RNA, herein designated VGAM RNA, also designated SEQ ID:5244.

Another function of VGAM2533 is therefore inhibition of Laminin, Gamma 1 (formerly LAMB2) (LAMC1, Accession NM_002293), a gene which may mediate the attachment, migration, and organization of cells into tissues. Accordingly, utilities of VGAM2533 include diagnosis, prevention and treatment of diseases and clinical conditions associated with LAMC1. The function of LAMC1 and its association with various diseases and clinical conditions, has been established by previous studies, as described hereinabove with reference to VGAM812. LFG (Accession XM_084780) is another VGAM2533 host target gene. LFG BINDING SITE is HOST TARGET binding site found in the 3' untranslated region of mRNA encoded by LFG, corresponding to a HOST TARGET binding site such as BINDING SITE I, BINDING SITE II or BINDING SITE III. Table 2 illustrates the complementarity of the nucleotide sequences of LFG BINDING SITE, designated SEQ ID:37688, to the nucleotide sequence of VGAM2533 RNA, herein designated VGAM RNA, also designated SEQ ID:5244.

Another function of VGAM2533 is therefore inhibition of LFG (Accession XM_084780). Accordingly, utilities of VGAM2533 include diagnosis, prevention and treatment of diseases and clinical conditions associated with LFG. Protein Tyrosine Phosphatase, Receptor Type, N (PTPRN, Accession NM_002846) is another VGAM2533 host target gene. PTPRN BINDING SITE is HOST TARGET binding site found in the 3' untranslated region of mRNA encoded by PTPRN, corresponding to a HOST TARGET binding site such as BINDING SITE I, BINDING SITE II or BINDING SITE III. Table 2 illustrates the complementarity of the nucleotide sequences of PTPRN BINDING SITE, designated SEQ ID:8734, to the nucleotide sequence of VGAM2533 RNA, herein designated VGAM RNA, also designated SEQ ID:5244.

Another function of VGAM2533 is therefore inhibition of Protein Tyrosine Phosphatase, Receptor Type, N (PTPRN, Accession NM_002846). Accordingly, utilities of VGAM2533 include diagnosis, prevention and treatment of diseases and clinical conditions associated with PTPRN. Retinoblastoma Binding Protein 9 (RBBP9, Accession XM_046553) is another VGAM2533 host target gene. RBBP9 BINDING SITE is HOST TARGET binding site found in the 3' untranslated region of mRNA encoded by RBBP9, corresponding to a HOST TARGET binding site such as BINDING SITE I, BINDING SITE II or BINDING SITE III. Table 2 illustrates the complementarity of the nucleotide sequences of RBBP9 BINDING SITE, designated SEQ ID:34741, to the nucleotide sequence of VGAM2533 RNA, herein designated VGAM RNA, also designated SEQ ID:5244.

Another function of VGAM2533 is therefore inhibition of Retinoblastoma Binding Protein 9 (RBBP9, Accession XM_046553). Accordingly, utilities of VGAM2533 include diagnosis, prevention and treatment of diseases and clinical conditions associated with RBBP9. Transducin (beta)-like 1X-linked (TBL1X, Accession NM_005647) is another VGAM2533 host target gene. TBL1X BINDING SITE is HOST TARGET binding site found in the 3' untranslated region of mRNA encoded by TBL1X, corresponding to a HOST TARGET binding site such as BINDING SITE I, BINDING SITE II or BINDING SITE III. Table 2 illustrates the complementarity of the nucleotide sequences of TBL1X BINDING SITE, designated SEQ ID:12182, to the nucleotide sequence of VGAM2533 RNA, herein designated VGAM RNA, also designated SEQ ID:5244.

Another function of VGAM2533 is therefore inhibition of Transducin (beta)-like 1X-linked (TBL1X, Accession NM_005647), a gene which activates latent HDAC3 activity. Accordingly, utilities of VGAM2533 include diagnosis, prevention and treatment of diseases and clinical conditions associated with TBL1X. The function of TBL1X and its association with various diseases and clinical conditions, has been established by previous studies, as described hereinabove with reference to VGAM1151. Telomeric Repeat Binding Factor (NIMA-interacting) 1 (TERF1, Accession NM_017489) is another VGAM2533 host target gene. TERF1 BINDING SITE is HOST TARGET binding site found in the 3' untranslated region of mRNA encoded by TERF1, corresponding to a HOST TARGET binding site such as BINDING SITE I, BINDING SITE II or BINDING SITE III. Table 2 illustrates the complementarity of the nucleotide sequences of TERF1 BINDING SITE, designated SEQ ID:18951, to the nucleotide sequence of VGAM2533 RNA, herein designated VGAM RNA, also designated SEQ ID:5244.

Another function of VGAM2533 is therefore inhibition of Telomeric Repeat Binding Factor (NIMA-interacting) 1 (TERF1, Accession NM_017489), a gene which negatively regulates telomere length, involves in regulation of the mitotic spindle. Accordingly, utilities of VGAM2533 include diagnosis, prevention and treatment of diseases and clinical conditions associated with TERF1. The function of TERF1 and its association with various diseases and clinical conditions, has been established by previous studies, as described hereinabove with reference to VGAM189. Trichorhinophalangeal Syndrome I (TRPS1, Accession NM_014112) is another VGAM2533 host target gene. TRPS1 BINDING SITE is HOST TARGET binding site found in the 3' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15360, to the nucleotide sequence of VGAM2533 RNA, herein designated VGAM RNA, also designated SEQ ID:5244.

Another function of VGAM2533 is therefore inhibition of Trichorhinophalangeal Syndrome I (TRPS1, Accession NM_014112), a gene which may function as a transcriptional activator protein. Accordingly, utilities of VGAM2533 include diagnosis, prevention and treatment of diseases and clinical conditions associated with TRPS1. The function of TRPS1 and its association with various diseases and clinical conditions, has been established by previous studies, as described hereinabove with reference to VGAM172. Williams-Beuren Syndrome Chromosome Region 1 (WBSCR1, Accession NM_022170) is another VGAM2533 host target gene. WBSCR1 BINDING SITE1 and WBSCR1 BINDING SITE2 are HOST TARGET binding sites found in untranslated regions of mRNA encoded by WBSCR1, corresponding to HOST TARGET binding sites such as BINDING SITE I, BINDING SITE II or BINDING SITE III. Table 2 illustrates the complementarity of the nucleotide sequences of WBSCR1 BINDING SITE1 and WBSCR1 BINDING SITE2, designated SEQ ID:22724 and SEQ ID:25707 respectively, to the nucleotide sequence of VGAM2533 RNA, herein designated VGAM RNA, also designated SEQ ID:5244.

Another function of VGAM2533 is therefore inhibition of Williams-Beuren Syndrome Chromosome Region 1 (WBSCR1, Accession NM_022170), a gene which stimulates protein translation. Accordingly, utilities of VGAM2533 include diagnosis, prevention and treatment of diseases and clinical conditions associated with WBSCR1. The function of WBSCR1 and its association with various diseases and clinical conditions, has been established by previous studies, as described hereinabove with reference to VGAM110. Cytoskeleton Associated Protein 2 (CKAP2, Accession NM_018204) is another VGAM2533 host target gene. CKAP2 BINDING SITE is HOST TARGET binding site found in the 3' untranslated region of mRNA encoded by CKAP2, corresponding to a HOST TARGET binding site such as BINDING SITE I, BINDING SITE II or BINDING SITE III. Table 2 illustrates the complementarity of the nucleotide sequences of CKAP2 BINDING SITE, designated SEQ ID:20089, to the nucleotide sequence of VGAM2533 RNA, herein designated VGAM RNA, also designated SEQ ID:5244.

Another function of VGAM2533 is therefore inhibition of Cytoskeleton Associated Protein 2 (CKAP2, Accession NM_018204). Accordingly, utilities of VGAM2533 include diagnosis, prevention and treatment of diseases and clinical conditions associated with CKAP2. Deiodinase, Iodothyronine, Type II (DIO2, Accession NM_013989) is another VGAM2533 host target gene. DIO2 BINDING SITE1 and DIO2 BINDING SITE2 are HOST TARGET binding sites found in untranslated regions of mRNA encoded by DIO2, corresponding to HOST TARGET binding sites such as BINDING SITE I, BINDING SITE II or BINDING SITE III. Table 2 illustrates the complementarity of the nucleotide sequences of DIO2 BINDING SITE1 and DIO2 BINDING SITE2, designated SEQ ID:15169 and SEQ ID:6458 respectively, to the nucleotide sequence of VGAM2533 RNA, herein designated VGAM RNA, also designated SEQ ID:5244.

Another function of VGAM2533 is therefore inhibition of Deiodinase, Iodothyronine, Type II (DIO2, Accession NM_013989). Accordingly, utilities of VGAM2533 include diagnosis, prevention and treatment of diseases and clinical conditions associated with DIO2. FLJ10702 (Accession NM_018184) is another VGAM2533 host target gene. FLJ10702 BINDING SITE is HOST TARGET binding site found in the 3' untranslated region of mRNA encoded by FLJ10702, corresponding to a HOST TARGET binding site such as BINDING SITE I, BINDING SITE II or BINDING SITE III. Table 2 illustrates the complementarity of the nucleotide sequences of FLJ10702 BINDING SITE, designated SEQ ID:20026, to the nucleotide sequence of VGAM2533 RNA, herein designated VGAM RNA, also designated SEQ ID:5244.

Another function of VGAM2533 is therefore inhibition of FLJ10702 (Accession NM_018184). Accordingly, utilities of VGAM2533 include diagnosis, prevention and treatment of diseases and clinical conditions associated with FLJ10702. FLJ11117 (Accession NM_018329) is another VGAM2533 host target gene. FLJ11117 BINDING SITE is HOST TARGET binding site found in the 3' untranslated region of mRNA encoded by FLJ11117, corresponding to a HOST TARGET binding site such as BINDING SITE I, BINDING SITE II or BINDING SITE III. Table 2 illustrates the complementarity of the nucleotide sequences of FLJ11117 BINDING SITE, designated SEQ ID:20326, to the nucleotide sequence of VGAM2533 RNA, herein designated VGAM RNA, also designated SEQ ID:5244.

Another function of VGAM2533 is therefore inhibition of FLJ11117 (Accession NM_018329). Accordingly, utilities of VGAM2533 include diagnosis, prevention and treatment of diseases and clinical conditions associated with FLJ11117. KIAA0295 (Accession XM_042833) is another VGAM2533 host target gene. KIAA0295 BINDING SITE is HOST TARGET binding site found in the 3' untranslated region of mRNA encoded by KIAA0295, corresponding to a HOST TARGET binding site such as BINDING SITE I, BINDING SITE II or BINDING SITE III. Table 2 illustrates the complementarity of the nucleotide sequences of KIAA0295 BINDING SITE, designated SEQ ID:33781, to the nucleotide sequence of VGAM2533 RNA, herein designated VGAM RNA, also designated SEQ ID:5244.

Another function of VGAM2533 is therefore inhibition of KIAA0295 (Accession XM_042833). Accordingly, utilities of VGAM2533 include diagnosis, prevention and treatment of diseases and clinical conditions associated with KIAA0295. KIAA0836 (Accession XM_035390) is another VGAM2533 host target gene. KIAA0836 BINDING SITE is HOST TARGET binding site found in the 3' untranslated region of mRNA encoded by KIAA0836, corresponding to a HOST TARGET binding site such as BINDING SITE I, BINDING SITE II or BINDING SITE III. Table 2 illustrates the complementarity of the nucleotide sequences of KIAA0836 BINDING SITE, designated SEQ ID:32249, to the nucleotide sequence of VGAM2533 RNA, herein designated VGAM RNA, also designated SEQ ID:5244.

Another function of VGAM2533 is therefore inhibition of KIAA0836 (Accession XM_035390). Accordingly, utilities of VGAM2533 include diagnosis, prevention and treatment of diseases and clinical conditions associated with KIAA0836. Leucine Rich Repeat (in FLII) Interacting Protein 2 (LRRFIP2, Accession NM_017724) is another VGAM2533 host target gene. LRRFIP2 BINDING SITE is HOST TARGET binding site found in the 3' untranslated region of mRNA encoded by LRRFIP2, corresponding to a HOST TARGET binding site such as BINDING SITE I, BINDING SITE II or BINDING SITE III. Table 2 illustrates the complementarity of the nucleotide sequences of LRRFIP2 BINDING SITE, designated SEQ ID:19314, to the nucleotide sequence of VGAM2533 RNA, herein designated VGAM RNA, also designated SEQ ID:5244.

Another function of VGAM2533 is therefore inhibition of Leucine Rich Repeat (in FLII) Interacting Protein 2 (LRRFIP2, Accession NM_017724). Accordingly, utilities of VGAM2533 include diagnosis, prevention and treatment of diseases and clinical conditions associated with LRRFIP2. PGS1 (Accession NM_024419) is another VGAM2533 host target gene. PGS1 BINDING SITE is HOST TARGET binding site found in the 5' untranslated region of mRNA encoded by PGS1, corresponding to a HOST TARGET binding site such as BINDING SITE I, BINDING SITE II or BINDING SITE III. Table 2 illustrates the complementarity of the nucleotide sequences of PGS1 BINDING SITE, designated SEQ ID:23658, to the nucleotide sequence of VGAM2533 RNA, herein designated VGAM RNA, also designated SEQ ID:5244.

Another function of VGAM2533 is therefore inhibition of PGS1 (Accession NM_024419). Accordingly, utilities of VGAM2533 include diagnosis, prevention and treatment of diseases and clinical conditions associated with PGS1. Stathmin-like 3 (STMN3, Accession NM_015894) is another VGAM2533 host target gene. STMN3 BINDING SITE is HOST TARGET binding site found in the 3' untranslated region of mRNA encoded by STMN3, corresponding to a HOST TARGET binding site such as BINDING SITE I, BINDING SITE II or BINDING SITE III. Table 2 illustrates the complementarity of the nucleotide sequences of STMN3 BINDING SITE, designated SEQ ID:18040, to the nucleotide sequence of VGAM2533 RNA, herein designated VGAM RNA, also designated SEQ ID:5244.

Another function of VGAM2533 is therefore inhibition of Stathmin-like 3 (STMN3, Accession NM_015894). Accordingly, utilities of VGAM2533 include diagnosis, prevention and treatment of diseases and clinical conditions associated with STMN3. TACTILE (Accession NM_005816) is another VGAM2533 host target gene. TACTILE BINDING SITE is HOST TARGET binding site found in the 3' untranslated region of mRNA encoded by TACTILE, corresponding to a HOST TARGET binding site such as BINDING SITE I, BINDING SITE II or BINDING SITE III. Table 2 illustrates the complementarity of the nucleotide sequences of TACTILE BINDING SITE, designated SEQ ID:12415, to the nucleotide sequence of VGAM2533 RNA, herein designated VGAM RNA, also designated SEQ ID:5244.

Another function of VGAM2533 is therefore inhibition of TACTILE (Accession NM_005816). Accordingly, utilities of VGAM2533 include diagnosis, prevention and treatment of diseases and clinical conditions associated with TACTILE. T-cell Leukemia/lymphoma 6 (TCL6, Accession NM_020553) is another VGAM2533 host target gene. TCL6 BINDING SITE1 and TCL6 BINDING SITE2 are HOST TARGET binding sites found in untranslated regions of mRNA encoded by TCL6, corresponding to HOST TARGET binding sites such as BINDING SITE I, BINDING SITE II or BINDING SITE III. Table 2 illustrates the complementarity of the nucleotide sequences of TCL6 BINDING SITE1 and TCL6 BINDING SITE2, designated SEQ ID:21777 and SEQ ID:21779 respectively, to the nucleotide sequence of VGAM2533 RNA, herein designated VGAM RNA, also designated SEQ ID:5244.

Another function of VGAM2533 is therefore inhibition of T-cell Leukemia/lymphoma 6 (TCL6, Accession NM_020553). Accordingly, utilities of VGAM2533 include diagnosis, prevention and treatment of diseases and clinical conditions associated with TCL6. LOC152620 (Accession XM_011108) is another VGAM2533 host target gene. LOC152620 BINDING SITE is HOST TARGET binding site found in the 3' untranslated region of mRNA encoded by LOC152620, corresponding to a HOST TARGET binding site such as BINDING SITE I, BINDING SITE II or BINDING SITE III. Table 2 illustrates the complementarity of the nucleotide sequences of LOC152620 BINDING SITE, designated SEQ ID:30171, to the nucleotide sequence of VGAM2533 RNA, herein designated VGAM RNA, also designated SEQ ID:5244.

Another function of VGAM2533 is therefore inhibition of LOC152620 (Accession XM_011108). Accordingly, utilities of VGAM2533 include diagnosis, prevention and treatment of diseases and clinical conditions associated with LOC152620. LOC158668 (Accession XM_045161) is another VGAM2533 host target gene. LOC158668 BINDING SITE is HOST TARGET binding site found in the 3' untranslated region of mRNA encoded by LOC158668, corresponding to a HOST TARGET binding site such as BINDING SITE I, BINDING SITE II or BINDING SITE III. Table 2 illustrates the complementarity of the nucleotide sequences of LOC158668 BINDING SITE, designated SEQ ID:34376, to the nucleotide sequence of VGAM2533 RNA, herein designated VGAM RNA, also designated SEQ ID:5244.

Another function of VGAM2533 is therefore inhibition of LOC158668 (Accession XM_045161). Accordingly, utilities of VGAM2533 include diagnosis, prevention and treatment of diseases and clinical conditions associated with LOC158668. FIG. 1 further provides a conceptual description of a novel bioinformatically detected viral gene of the present invention, referred to here as Viral Genomic Address Messenger 2534 (VGAM2534) viral gene, which modulates expression of respective host target genes thereof, the function and utility of which host target genes is known in the art.

VGAM2534 is a novel bioinformatically detected regulatory, non protein coding, viral micro RNA (miRNA) gene. The method by which VGAM2534 was detected is described hereinabove with reference to FIGS. 1-8.

VGAM2534 gene, herein designated VGAM GENE, is a viral gene contained in the genome of Rio Bravo Virus. VGAM2534 host target gene, herein designated VGAM HOST TARGET GENE, is a human gene contained in the human genome.

VGAM2534 gene encodes a VGAM2534 precursor RNA, herein designated VGAM PRECURSOR RNA. Similar to other miRNA genes, and unlike most ordinary genes, VGAM2534 precursor RNA does not encode a protein. A nucleotide sequence identical or highly similar to the nucleotide sequence of VGAM2534 precursor RNA is designated SEQ ID:2520, and is provided hereinbelow with reference to the sequence listing part. Nucleotide sequence SEQ ID:2520 is located at position 7314 relative to the genome of Rio Bravo Virus.

VGAM2534 precursor RNA folds onto itself, forming VGAM2534 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2534 folded precursor RNA into VGAM2534 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 90%) nucleotide sequence of VGAM2534 RNA is designated SEQ ID:5245, and is provided hereinbelow with reference to the sequence listing part.

VGAM2534 host target gene, herein designated VGAM HOST TARGET GENE, encodes a corresponding messenger RNA, VGAM2534 host target RNA, herein designated VGAM HOST TARGET RNA. VGAM2534 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2534 RNA, herein designated VGAM RNA, binds complementarily to one or more host target binding sites located in untranslated regions of VGAM2534 host target RNA, herein designated VGAM HOST TARGET RNA. This complementary binding is due to the fact that the nucleotide sequence of VGAM2534 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2534 RNA, herein designated VGAM RNA, may have a different number of host target binding sites in untranslated regions of a VGAM2534 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2534 RNA, herein designated VGAM RNA, to host target binding sites on VGAM2534 host target RNA, herein designated VGAM HOST TARGET RNA, such as BINDING SITE I, BINDING SITE II and BINDING SITE III, inhibits translation of VGAM2534 host target RNA into VGAM2534 host target protein, herein designated VGAM HOST TARGET PROTEIN. VGAM host target protein is therefore outlined by a broken line.

It is appreciated that VGAM2534 host target gene, herein designated VGAM HOST TARGET GENE, in fact represents a plurality of VGAM2534 host target genes. The mRNA of each one of this plurality of VGAM2534 host target genes comprises one or more host target binding sites, each having a nucleotide sequence which is at least partly complementary to VGAM2534 RNA, herein designated VGAM RNA, and which when bound by VGAM2534 RNA causes inhibition of translation of respective one or more VGAM2534 host target proteins.

It is further appreciated by one skilled in the art that the mode of translational inhibition illustrated by FIG. 1 with specific reference to translational inhibition exerted by VGAM2534 gene, herein designated VGAM GENE, on one or more VGAM2534 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2534 is inhibition of expression of host target genes, as part of a novel viral mechanism of attacking a host. Accordingly, utilities of VGAM2534 include diagnosis, prevention and treatment of viral infection by Rio Bravo Virus. Specific functions, and accordingly utilities, of VGAM2534 correlate with, and may be deduced from, the identity of the host target genes which VGAM2534 binds and inhibits, and the function of these host target genes, as elaborated hereinbelow.

Nucleotide sequences of the VGAM2534 precursor RNA, herein designated VGAM PRECURSOR RNA, and of the 'diced' VGAM2534 RNA, herein designated VGAM RNA, and a schematic representation of the secondary folding of VGAM2534 folded precursor RNA, herein designated VGAM FOLDED PRECURSOR RNA, of VGAM2534 are further described hereinbelow with reference to Table 1.

Nucleotide sequences of host target binding sites, such as BINDING SITE-I, BINDING SITE-II and BINDING SITE-III of FIG. 1, found on VGAM2534 host target RNA, and schematic representation of the complementarity of each of these host target binding sites to VGAM2534 RNA, herein designated VGAM RNA, are described hereinbelow with reference to Table 2.

As mentioned hereinabove with reference to FIG. 1, a function of VGAM2534 gene, herein designated VGAM is inhibition of expression of VGAM2534 target genes. It is appreciated that specific functions, and accordingly utilities, of VGAM2534 correlate with, and may be deduced from, the identity of the target genes which VGAM2534 binds and inhibits, and the function of these target genes, as elaborated hereinbelow.

UDP-Gal:betaGlcNAc Beta 1,3-galactosyltransferase, Polypeptide 3 (B3GALT3, Accession NM_003781) is a VGAM2534 host target gene. B3GALT3 BINDING SITE1 through B3GALT3 BINDING SITE3 are HOST TARGET binding sites found in untranslated regions of mRNA encoded by B3GALT3, corresponding to HOST TARGET binding sites such as BINDING SITE I, BINDING SITE II or BINDING SITE III. Table 2 illustrates the complementarity of the nucleotide sequences of B3GALT3 BINDING SITE1 through B3GALT3 BINDING SITE3, designated SEQ ID:9866, SEQ ID:27015 and SEQ ID:27018 respectively, to the nucleotide sequence of VGAM2534 RNA, herein designated VGAM RNA, also designated SEQ ID:5245.

A function of VGAM2534 is therefore inhibition of UDP-Gal:betaGlcNAc Beta 1,3-galactosyltransferase, Polypeptide 3 (B3GALT3, Accession NM_003781). Accordingly, utilities of VGAM2534 include diagnosis, prevention and treatment of diseases and clinical conditions associated with B3GALT3. Fibroblast Growth Factor 1 (acidic) (FGF1, Accession NM_033137) is another VGAM2534 host target gene. FGF1 BINDING SITE1 through FGF1 BINDING SITE3 are HOST TARGET binding sites found in untranslated regions of mRNA encoded by FGF1, corresponding to HOST TARGET binding sites such as BINDING SITE I, BINDING SITE II or BINDING SITE III. Table 2 illustrates the complementarity of the nucleotide sequences of FGF1 BINDING SITE1 through FGF1 BINDING SITE3, designated SEQ ID:26988, SEQ ID:26986 and SEQ ID:6469 respectively, to the nucleotide sequence of VGAM2534 RNA, herein designated VGAM RNA, also designated SEQ ID:5245.

Another function of VGAM2534 is therefore inhibition of Fibroblast Growth Factor 1 (acidic) (FGF1, Accession NM_033137), a gene which potent mitogen for a variety of cell types. Accordingly, utilities of VGAM2534 include diagnosis, prevention and treatment of diseases and clinical conditions associated with FGF1. The function of FGF1 and its association with various diseases and clinical conditions, has been established by previous studies, as described hereinabove with reference to VGAM1958. AP1 Gamma Subunit Binding Protein 1 (AP1GBP1, Accession NM_080550) is another VGAM2534 host target gene. AP1GBP1 BINDING SITE1 through AP1GBP1 BINDING SITE3 are HOST TARGET binding sites found in untranslated regions of mRNA encoded by AP1GBP1, corresponding to HOST TARGET binding sites such as BINDING SITE I, BINDING SITE II or BINDING SITE III. Table 2 illustrates the complementarity of the nucleotide sequences of AP1GBP1 BINDING SITE1 through AP1GBP1 BINDING SITE3, designated SEQ ID:27869, SEQ ID:27875 and SEQ ID:24616 respectively, to the nucleotide sequence of VGAM2534 RNA, herein designated VGAM RNA, also designated SEQ ID:5245.

Another function of VGAM2534 is therefore inhibition of AP1 Gamma Subunit Binding Protein 1 (AP1GBP1, Accession NM_080550). Accordingly, utilities of VGAM2534 include diagnosis, prevention and treatment of diseases and clinical conditions associated with AP1GBP1. KIAA1260

(Accession XM_010461) is another VGAM2534 host target gene. KIAA1260 BINDING SITE is HOST TARGET binding site found in the 3' untranslated region of mRNA encoded by KIAA1260, corresponding to a HOST TARGET binding site such as BINDING SITE I, BINDING SITE II or BINDING SITE III. Table 2 illustrates the complementarity of the nucleotide sequences of KIAA1260 BINDING SITE, designated SEQ ID:30155, to the nucleotide sequence of VGAM2534 RNA, herein designated VGAM RNA, also designated SEQ ID:5245.

Another function of VGAM2534 is therefore inhibition of KIAA1260 (Accession XM_010461). Accordingly, utilities of VGAM2534 include diagnosis, prevention and treatment of diseases and clinical conditions associated with KIAA1260. Stromal Interaction Molecule 2 (STIM2, Accession NM_020860) is another VGAM2534 host target gene. STIM2 BINDING SITE is HOST TARGET binding site found in the 3' untranslated region of mRNA encoded by STIM2, corresponding to a HOST TARGET binding site such as BINDING SITE I, BINDING SITE II or BINDING SITE III. Table 2 illustrates the complementarity of the nucleotide sequences of STIM2 BINDING SITE, designated SEQ ID:21913, to the nucleotide sequence of VGAM2534 RNA, herein designated VGAM RNA, also designated SEQ ID:5245.

Another function of VGAM2534 is therefore inhibition of Stromal Interaction Molecule 2 (STIM2, Accession NM_020860). Accordingly, utilities of VGAM2534 include diagnosis, prevention and treatment of diseases and clinical conditions associated with STIM2. LOC130752 (Accession XM_059468) is another VGAM2534 host target gene. LOC130752 BINDING SITE is HOST TARGET binding site found in the 3' untranslated region of mRNA encoded by LOC130752, corresponding to a HOST TARGET binding site such as BINDING SITE I, BINDING SITE II or BINDING SITE III. Table 2 illustrates the complementarity of the nucleotide sequences of LOC130752 BINDING SITE, designated SEQ ID:37005, to the nucleotide sequence of VGAM2534 RNA, herein designated VGAM RNA, also designated SEQ ID:5245.

Another function of VGAM2534 is therefore inhibition of LOC130752 (Accession XM_059468). Accordingly, utilities of VGAM2534 include diagnosis, prevention and treatment of diseases and clinical conditions associated with LOC130752. LOC157869 (Accession XM_088409) is another VGAM2534 host target gene. LOC157869 BINDING SITE is HOST TARGET binding site found in the 3' untranslated region of mRNA encoded by LOC157869, corresponding to a HOST TARGET binding site such as BINDING SITE I, BINDING SITE II or BINDING SITE III. Table 2 illustrates the complementarity of the nucleotide sequences of LOC157869 BINDING SITE, designated SEQ ID:39674, to the nucleotide sequence of VGAM2534 RNA, herein designated VGAM RNA, also designated SEQ ID:5245.

Another function of VGAM2534 is therefore inhibition of LOC157869 (Accession XM_088409). Accordingly, utilities of VGAM2534 include diagnosis, prevention and treatment of diseases and clinical conditions associated with LOC157869. FIG. 1 further provides a conceptual description of a novel bioinformatically detected viral gene of the present invention, referred to here as Viral Genomic Address Messenger 2535 (VGAM2535) viral gene, which modulates expression of respective host target genes thereof, the function and utility of which host target genes is known in the art.

VGAM2535 is a novel bioinformatically detected regulatory, non protein coding, viral micro RNA (miRNA) gene. The method by which VGAM2535 was detected is described hereinabove with reference to FIGS. 1-8.

VGAM2535 gene, herein designated VGAM GENE, is a viral gene contained in the genome of Rio Bravo Virus. VGAM2535 host target gene, herein designated VGAM HOST TARGET GENE, is a human gene contained in the human genome.

VGAM2535 gene encodes a VGAM2535 precursor RNA, herein designated VGAM PRECURSOR RNA. Similar to other miRNA genes, and unlike most ordinary genes, VGAM2535 precursor RNA does not encode a protein. A nucleotide sequence identical or highly similar to the nucleotide sequence of VGAM2535 precursor RNA is designated SEQ ID:2521, and is provided hereinbelow with reference to the sequence listing part. Nucleotide sequence SEQ ID:2521 is located at position 5612 relative to the genome of Rio Bravo Virus.

VGAM2535 precursor RNA folds onto itself, forming VGAM2535 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2535 folded precursor RNA into VGAM2535 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2535 RNA is designated SEQ ID:5246, and is provided hereinbelow with reference to the sequence listing part.

VGAM2535 host target gene, herein designated VGAM HOST TARGET GENE, encodes a corresponding messenger RNA, VGAM2535 host target RNA, herein designated VGAM HOST TARGET RNA. VGAM2535 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2535 RNA, herein designated VGAM RNA, binds complementarily to one or more host target binding sites located in untranslated regions of VGAM2535 host target RNA, herein designated VGAM HOST TARGET RNA. This complementary binding is due to the fact that the nucleotide sequence of VGAM2535 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2535 RNA, herein designated VGAM RNA, may have a different number of host target binding sites in untranslated regions of a VGAM2535 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2535 RNA, herein designated VGAM RNA, to host target binding sites on VGAM2535 host target RNA, herein designated VGAM HOST TARGET RNA, such as BINDING SITE I, BINDING SITE II and BINDING SITE III, inhibits translation of VGAM2535 host target RNA into VGAM2535 host target protein, herein designated VGAM HOST TARGET PROTEIN. VGAM host target protein is therefore outlined by a broken line.

It is appreciated that VGAM2535 host target gene, herein designated VGAM HOST TARGET GENE, in fact represents a plurality of VGAM2535 host target genes. The mRNA of each one of this plurality of VGAM2535 host target genes comprises one or more host target binding sites, each having a nucleotide sequence which is at least partly complementary to VGAM2535 RNA, herein designated VGAM RNA, and which when bound by VGAM2535 RNA causes inhibition of translation of respective one or more VGAM2535 host target proteins.

It is further appreciated by one skilled in the art that the mode of translational inhibition illustrated by FIG. 1 with specific reference to translational inhibition exerted by VGAM2535 gene, herein designated VGAM GENE, on one or more VGAM2535 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2535 is inhibition of expression of host target genes, as part of a novel viral mechanism of attacking a host. Accordingly, utilities of VGAM2535 include diagnosis, prevention and treatment of viral infection by Rio Bravo Virus. Specific functions, and accordingly utilities, of VGAM2535 correlate with, and may be deduced from, the identity of the host target genes which VGAM2535 binds and inhibits, and the function of these host target genes, as elaborated hereinbelow.

Nucleotide sequences of the VGAM2535 precursor RNA, herein designated VGAM PRECURSOR RNA, and of the 'diced' VGAM2535 RNA, herein designated VGAM RNA, and a schematic representation of the secondary folding of VGAM2535 folded precursor RNA, herein designated VGAM FOLDED PRECURSOR RNA, of VGAM2535 are further described hereinbelow with reference to Table 1.

Nucleotide sequences of host target binding sites, such as BINDING SITE-I, BINDING SITE-II and BINDING SITE-III of FIG. 1, found on VGAM2535 host target RNA, and schematic representation of the complementarity of each of these host target binding sites to VGAM2535 RNA, herein designated VGAM RNA, are described hereinbelow with reference to Table 2.

As mentioned hereinabove with reference to FIG. 1, a function of VGAM2535 gene, herein designated VGAM is inhibition of expression of VGAM2535 target genes. It is appreciated that specific functions, and accordingly utilities, of VGAM2535 correlate with, and may be deduced from, the identity of the target genes which VGAM2535 binds and inhibits, and the function of these target genes, as elaborated hereinbelow.

Caspase 10, Apoptosis-related Cysteine Protease (CASP10, Accession NM_032976) is a VGAM2535 host target gene. CASP10 BINDING SITE1 and CASP10 BINDING SITE2 are HOST TARGET binding sites found in untranslated regions of mRNA encoded by CASP10, corresponding to HOST TARGET binding sites such as BINDING SITE I, BINDING SITE II or BINDING SITE III. Table 2 illustrates the complementarity of the nucleotide sequences of CASP10 BINDING SITE1 and CASP10 BINDING SITE2, designated SEQ ID:26833 and SEQ ID:26836 respectively, to the nucleotide sequence of VGAM2535 RNA, herein designated VGAM RNA, also designated SEQ ID:5246.

A function of VGAM2535 is therefore inhibition of Caspase 10, Apoptosis-related Cysteine Protease (CASP10, Accession NM_032976), a gene which is one aspartate-specific cysteine protease and important in death receptor signaling or other cellular processes. Accordingly, utilities of VGAM2535 include diagnosis, prevention and treatment of diseases and clinical conditions associated with CASP10. The function of CASP10 and its association with various diseases and clinical conditions, has been established by previous studies, as described hereinabove with reference to VGAM1959. CPEB1 (Accession NM_030594) is another VGAM2535 host target gene. CPEB1 BINDING SITE is HOST TARGET binding site found in the 3' untranslated region of mRNA encoded by CPEB1, corresponding to a HOST TARGET binding site such as BINDING SITE I, BINDING SITE II or BINDING SITE III. Table 2 illustrates the complementarity of the nucleotide sequences of CPEB1 BINDING SITE, designated SEQ ID:24959, to the nucleotide sequence of VGAM2535 RNA, herein designated VGAM RNA, also designated SEQ ID:5246.

Another function of VGAM2535 is therefore inhibition of CPEB1 (Accession NM_030594). Accordingly, utilities of VGAM2535 include diagnosis, prevention and treatment of diseases and clinical conditions associated with CPEB1. Family with Sequence Similarity 8, Member A1 (FAM8A1, Accession NM_016255) is another VGAM2535 host target gene. FAM8A1 BINDING SITE is HOST TARGET binding site found in the 3' untranslated region of mRNA encoded by FAM8A1, corresponding to a HOST TARGET binding site such as BINDING SITE I, BINDING SITE II or BINDING SITE III. Table 2 illustrates the complementarity of the nucleotide sequences of FAM8A1 BINDING SITE, designated SEQ ID:18384, to the nucleotide sequence of VGAM2535 RNA, herein designated VGAM RNA, also designated SEQ ID:5246.

Another function of VGAM2535 is therefore inhibition of Family with Sequence Similarity 8, Member A1 (FAM8A1, Accession NM_016255). Accordingly, utilities of VGAM2535 include diagnosis, prevention and treatment of diseases and clinical conditions associated with FAM8A1. FLJ20280 (Accession NM_017741) is another VGAM2535 host target gene. FLJ20280 BINDING SITE is HOST TARGET binding site found in the 5' untranslated region of mRNA encoded by FLJ20280, corresponding to a HOST TARGET binding site such as BINDING SITE I, BINDING SITE II or BINDING SITE III. Table 2 illustrates the complementarity of the nucleotide sequences of FLJ20280 BINDING SITE, designated SEQ ID:19332, to the nucleotide sequence of VGAM2535 RNA, herein designated VGAM RNA, also designated SEQ ID:5246.

Another function of VGAM2535 is therefore inhibition of FLJ20280 (Accession NM_017741). Accordingly, utilities of VGAM2535 include diagnosis, prevention and treatment of diseases and clinical conditions associated with FLJ20280.

KIAA0350 (Accession XM_028332) is another VGAM2535 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30668, to the nucleotide sequence of VGAM2535 RNA, herein designated VGAM RNA, also designated SEQ ID:5246.

Another function of VGAM2535 is therefore inhibition of KIAA0350 (Accession XM_028332). Accordingly, utilities of VGAM2535 include diagnosis, prevention and treatment of diseases and clinical conditions associated with KIAA0350. KIAA0469 (Accession NM_014851) is another VGAM2535 host target gene. KIAA0469 BINDING SITE is HOST TARGET binding site found in the 3' untranslated region of mRNA encoded by KIAA0469, corresponding to a HOST TARGET binding site such as BINDING SITE I, BINDING SITE II or BINDING SITE III. Table 2 illustrates the complementarity of the nucleotide sequences of KIAA0469 BINDING SITE, designated SEQ ID:16895, to the nucleotide sequence of VGAM2535 RNA, herein designated VGAM RNA, also designated SEQ ID:5246.

Another function of VGAM2535 is therefore inhibition of KIAA0469 (Accession NM_014851). Accordingly, utilities of VGAM2535 include diagnosis, prevention and treatment of diseases and clinical conditions associated with KIAA0469. KIAA1117 (Accession XM_028219) is another VGAM2535 host target gene. KIAA1117 BINDING SITE is HOST TARGET binding site found in the 3' untranslated region of mRNA encoded by KIAA1117, corresponding to a HOST TARGET binding site such as BINDING SITE I, BINDING SITE II or BINDING SITE III. Table 2 illustrates the complementarity of the nucleotide sequences of KIAA1117 BINDING SITE, designated SEQ ID:30633, to the nucleotide sequence of VGAM2535 RNA, herein designated VGAM RNA, also designated SEQ ID:5246.

Another function of VGAM2535 is therefore inhibition of KIAA1117 (Accession XM_028219). Accordingly, utilities of VGAM2535 include diagnosis, prevention and treatment of diseases and clinical conditions associated with KIAA1117. KIAA1128 (Accession XM_043596) is another VGAM2535 host target gene. KIAA1128 BINDING SITE is HOST TARGET binding site found in the 3' untranslated region of mRNA encoded by KIAA1128, corresponding to a HOST TARGET binding site such as BINDING SITE I, BINDING SITE II or BINDING SITE III. Table 2 illustrates the complementarity of the nucleotide sequences of KIAA1128 BINDING SITE, designated SEQ ID:33972, to the nucleotide sequence of VGAM2535 RNA, herein designated VGAM RNA, also designated SEQ ID:5246.

Another function of VGAM2535 is therefore inhibition of KIAA1128 (Accession XM_043596). Accordingly, utilities of VGAM2535 include diagnosis, prevention and treatment of diseases and clinical conditions associated with KIAA1128. Microtubule-actin Crosslinking Factor 1 (MACF1, Accession NM_012090) is another VGAM2535 host target gene. MACF1 BINDING SITE is HOST TARGET binding site found in the 3' untranslated region of mRNA encoded by MACF1, corresponding to a HOST TARGET binding site such as BINDING SITE I, BINDING SITE II or BINDING SITE III. Table 2 illustrates the complementarity of the nucleotide sequences of MACF1 BINDING SITE, designated SEQ ID:14378, to the nucleotide sequence of VGAM2535 RNA, herein designated VGAM RNA, also designated SEQ ID:5246.

Another function of VGAM2535 is therefore inhibition of Microtubule-actin Crosslinking Factor 1 (MACF1, Accession NM_012090). Accordingly, utilities of VGAM2535 include diagnosis, prevention and treatment of diseases and clinical conditions associated with MACF1. LOC157273 (Accession XM_098743) is another VGAM2535 host target gene. LOC157273 BINDING SITE is HOST TARGET binding site found in the 3' untranslated region of mRNA encoded by LOC157273, corresponding to a HOST TARGET binding site such as BINDING SITE I, BINDING SITE II or BINDING SITE III. Table 2 illustrates the complementarity of the nucleotide sequences of LOC157273 BINDING SITE, designated SEQ ID:41784, to the nucleotide sequence of VGAM2535 RNA, herein designated VGAM RNA, also designated SEQ ID:5246.

Another function of VGAM2535 is therefore inhibition of LOC157273 (Accession XM_098743). Accordingly, utilities of VGAM2535 include diagnosis, prevention and treatment of diseases and clinical conditions associated with LOC157273. LOC202020 (Accession XM_114419) is another VGAM2535 host target gene. LOC202020 BINDING SITE is HOST TARGET binding site found in the 3' untranslated region of mRNA encoded by LOC202020, corresponding to a HOST TARGET binding site such as BINDING SITE I, BINDING SITE II or BINDING SITE III. Table 2 illustrates the complementarity of the nucleotide sequences of LOC202020 BINDING SITE, designated SEQ ID:42955, to the nucleotide sequence of VGAM2535 RNA, herein designated VGAM RNA, also designated SEQ ID:5246.

Another function of VGAM2535 is therefore inhibition of LOC202020 (Accession XM_114419). Accordingly, utilities of VGAM2535 include diagnosis, prevention and treatment of diseases and clinical conditions associated with LOC202020. LOC253250 (Accession XM_170646) is another VGAM2535 host target gene. LOC253250 BINDING SITE is HOST TARGET binding site found in the 3' untranslated region of mRNA encoded by LOC253250, corresponding to a HOST TARGET binding site such as BINDING SITE I, BINDING SITE II or BINDING SITE III. Table 2 illustrates the complementarity of the nucleotide sequences of LOC253250 BINDING SITE, designated SEQ ID:45427, to the nucleotide sequence of VGAM2535 RNA, herein designated VGAM RNA, also designated SEQ ID:5246.

Another function of VGAM2535 is therefore inhibition of LOC253250 (Accession XM_170646). Accordingly, utilities of VGAM2535 include diagnosis, prevention and treatment of diseases and clinical conditions associated with LOC253250. LOC257106 (Accession XM_170910) is another VGAM2535 host target gene. LOC257106 BINDING SITE is HOST TARGET binding site found in the 3' untranslated region of mRNA encoded by LOC257106, corresponding to a HOST TARGET binding site such as BINDING SITE I, BINDING SITE II or BINDING SITE III. Table 2 illustrates the complementarity of the nucleotide sequences of LOC257106 BINDING SITE, designated SEQ ID:45680, to the nucleotide sequence of VGAM2535 RNA, herein designated VGAM RNA, also designated SEQ ID:5246.

Another function of VGAM2535 is therefore inhibition of LOC257106 (Accession XM_170910). Accordingly, utilities of VGAM2535 include diagnosis, prevention and treatment of diseases and clinical conditions associated with LOC257106. LOC257463 (Accession XM_048605) is another VGAM2535 host target gene. LOC257463 BINDING SITE is HOST TARGET binding site found in the 3' untranslated region of mRNA encoded by LOC257463, corresponding to a HOST TARGET binding site such as BINDING SITE I, BINDING SITE II or BINDING SITE III. Table 2 illustrates the complementarity of the nucleotide sequences of LOC257463 BINDING SITE, designated SEQ ID:35211, to the nucleotide sequence of VGAM2535 RNA, herein designated VGAM RNA, also designated SEQ ID:5246.

Another function of VGAM2535 is therefore inhibition of LOC257463 (Accession XM_048605). Accordingly, utilities of VGAM2535 include diagnosis, prevention and treatment of diseases and clinical conditions associated with LOC257463. LOC57826 (Accession NM_021183) is another VGAM2535 host target gene. LOC57826 BINDING SITE is HOST TARGET binding site found in the 3' untranslated region of mRNA encoded by LOC57826, corresponding to a HOST TARGET binding site such as BINDING SITE I, BINDING SITE II or BINDING SITE III. Table 2 illustrates the complementarity of the nucleotide sequences of LOC57826 BINDING SITE, designated SEQ ID:22160, to the nucleotide sequence of VGAM2535 RNA, herein designated VGAM RNA, also designated SEQ ID:5246.

Another function of VGAM2535 is therefore inhibition of LOC57826 (Accession NM_021183). Accordingly, utilities of VGAM2535 include diagnosis, prevention and treatment of diseases and clinical conditions associated with LOC57826. FIG. 1 further provides a conceptual description of a novel bioinformatically detected viral gene of the present invention, referred to here as Viral Genomic Address Messenger 2536 (VGAM2536) viral gene, which modulates expression of respective host target genes thereof, the function and utility of which host target genes is known in the art.

VGAM2536 is a novel bioinformatically detected regulatory, non protein coding, viral micro RNA (miRNA) gene. The method by which VGAM2536 was detected is described hereinabove with reference to FIGS. 1-8.

VGAM2536 gene, herein designated VGAM GENE, is a viral gene contained in the genome of Pestivirus Reindeer-1. VGAM2536 host target gene, herein designated VGAM HOST TARGET GENE, is a human gene contained in the human genome.

VGAM2536 gene encodes a VGAM2536 precursor RNA, herein designated VGAM PRECURSOR RNA. Similar to other miRNA genes, and unlike most ordinary genes, VGAM2536 precursor RNA does not encode a protein. A nucleotide sequence identical or highly similar to the nucleotide sequence of VGAM2536 precursor RNA is designated SEQ ID:2522, and is provided hereinbelow with reference to the sequence listing part. Nucleotide sequence SEQ ID:2522 is located at position 4448 relative to the genome of Pestivirus Reindeer-1.

VGAM2536 precursor RNA folds onto itself, forming VGAM2536 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2536 folded precursor RNA into VGAM2536 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2536 RNA is designated SEQ ID:5247, and is provided hereinbelow with reference to the sequence listing part.

VGAM2536 host target gene, herein designated VGAM HOST TARGET GENE, encodes a corresponding messenger RNA, VGAM2536 host target RNA, herein designated VGAM HOST TARGET RNA. VGAM2536 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2536 RNA, herein designated VGAM RNA, binds complementarily to one or more host target binding sites located in untranslated regions of VGAM2536 host target RNA, herein designated VGAM HOST TARGET RNA. This complementary binding is due to the fact that the nucleotide sequence of VGAM2536 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2536 RNA, herein designated VGAM RNA, may have a different number of host target binding sites in untranslated regions of a VGAM2536 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2536 RNA, herein designated VGAM RNA, to host target binding sites on VGAM2536 host target RNA, herein designated VGAM HOST TARGET RNA, such as BINDING SITE I, BINDING SITE II and BINDING SITE III, inhibits translation of VGAM2536 host target RNA into VGAM2536 host target protein, herein designated VGAM HOST TARGET PROTEIN. VGAM host target protein is therefore outlined by a broken line.

It is appreciated that VGAM2536 host target gene, herein designated VGAM HOST TARGET GENE, in fact represents a plurality of VGAM2536 host target genes. The mRNA of each one of this plurality of VGAM2536 host target genes comprises one or more host target binding sites, each having a nucleotide sequence which is at least partly complementary to VGAM2536 RNA, herein designated VGAM RNA, and which when bound by VGAM2536 RNA causes inhibition of translation of respective one or more VGAM2536 host target proteins.

It is further appreciated by one skilled in the art that the mode of translational inhibition illustrated by FIG. 1 with specific reference to translational inhibition exerted by VGAM2536 gene, herein designated VGAM GENE, on one or more VGAM2536 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2536 is inhibition of expression of host target genes, as part of a novel viral mechanism of attacking a host. Accordingly, utilities of VGAM2536 include diagnosis, prevention and treatment of viral infection by Pestivirus Reindeer-1. Specific functions, and accordingly utilities, of VGAM2536 correlate with, and may be deduced from, the identity of the host target genes which VGAM2536 binds and inhibits, and the function of these host target genes, as elaborated hereinbelow.

Nucleotide sequences of the VGAM2536 precursor RNA, herein designated VGAM PRECURSOR RNA, and of the 'diced' VGAM2536 RNA, herein designated VGAM RNA, and a schematic representation of the secondary folding of VGAM2536 folded precursor RNA, herein designated VGAM FOLDED PRECURSOR RNA, of VGAM2536 are further described hereinbelow with reference to Table 1.

Nucleotide sequences of host target binding sites, such as BINDING SITE-I, BINDING SITE-II and BINDING SITE-III of FIG. 1, found on VGAM2536 host target RNA, and schematic representation of the complementarity of each of these host target binding sites to VGAM2536 RNA, herein designated VGAM RNA, are described hereinbelow with reference to Table 2.

As mentioned hereinabove with reference to FIG. 1, a function of VGAM2536 gene, herein designated VGAM is inhibition of expression of VGAM2536 target genes. It is appreciated that specific functions, and accordingly utilities, of VGAM2536 correlate with, and may be deduced from, the identity of the target genes which VGAM2536 binds and inhibits, and the function of these target genes, as elaborated hereinbelow.

UDP-N-acetyl-alpha-D-galactosamine:polypeptide N-acetylgalactosaminyltransferase 1 (GalNAc-T1) (GALNT1, Accession NM_020474) is a VGAM2536 host target gene. GALNT1 BINDING SITE is HOST TARGET binding site found in the 3' untranslated region of mRNA encoded by GALNT1, corresponding to a HOST TARGET binding site such as BINDING SITE I, BINDING SITE II or BINDING SITE III. Table 2 illustrates the complementarity of the nucleotide sequences of GALNT1 BINDING SITE, designated SEQ ID:21725, to the nucleotide sequence of VGAM2536 RNA, herein designated VGAM RNA, also designated SEQ ID:5247.

A function of VGAM2536 is therefore inhibition of UDP-N-acetyl-alpha-D-galactosamine:polypeptide N-acetylgalactosaminyltransferase 1 (GalNAc-T1) (GALNT1, Accession NM_020474), a gene which transfers an N-acetyl galactosamine (GalNAc) to a serine or threonine residue in the first step of O-linked oligosaccharide biosynthesis. Accordingly, utilities of VGAM2536 include diagnosis, prevention and treatment of diseases and clinical conditions associated with GALNT1. The function of GALNT1 and its association with various diseases and clinical conditions, has been established by previous studies, as described hereinabove with reference to VGAM120. FLJ12787 (Accession NM_032175) is another VGAM2536 host target gene. FLJ12787 BINDING SITE is HOST TARGET binding site found in the 3' untranslated region of mRNA encoded by FLJ12787, corresponding to a HOST TARGET binding site such as BINDING SITE I, BINDING SITE II or BINDING SITE III. Table 2 illustrates the complementarity of the nucleotide sequences of FLJ12787 BINDING SITE, designated SEQ ID:25890, to the nucleotide sequence of VGAM2536 RNA, herein designated VGAM RNA, also designated SEQ ID:5247.

Another function of VGAM2536 is therefore inhibition of FLJ12787 (Accession NM_032175). Accordingly, utilities of VGAM2536 include diagnosis, prevention and treatment of diseases and clinical conditions associated with FLJ12787. SV2B (Accession NM_014848) is another VGAM2536 host target gene. SV2B BINDING SITE is HOST TARGET binding site found in the 3' untranslated region of mRNA encoded by SV2B, corresponding to a HOST TARGET binding site such as BINDING SITE I, BINDING SITE II or BINDING SITE III. Table 2 illustrates the complementarity of the nucleotide sequences of SV2B BINDING SITE, designated SEQ ID:16880, to the nucleotide sequence of VGAM2536 RNA, herein designated VGAM RNA, also designated SEQ ID:5247.

Another function of VGAM2536 is therefore inhibition of SV2B (Accession NM_014848). Accordingly, utilities of VGAM2536 include diagnosis, prevention and treatment of diseases and clinical conditions associated with SV2B. TA-PP2C (Accession NM_139283) is another VGAM2536 host target gene. TA-PP2C BINDING SITE is HOST TARGET binding site found in the 3' untranslated region of mRNA encoded by TA-PP2C, corresponding to a HOST TARGET binding site such as BINDING SITE I, BINDING SITE II or BINDING SITE III. Table 2 illustrates the complementarity of the nucleotide sequences of TA-PP2C BINDING SITE, designated SEQ ID:29284, to the nucleotide sequence of VGAM2536 RNA, herein designated VGAM RNA, also designated SEQ ID:5247.

Another function of VGAM2536 is therefore inhibition of TA-PP2C (Accession NM_139283). Accordingly, utilities of VGAM2536 include diagnosis, prevention and treatment of diseases and clinical conditions associated with TA-PP2C. FIG. 1 further provides a conceptual description of a novel bioinformatically detected viral gene of the present invention, referred to here as Viral Genomic Address Messenger 2537 (VGAM2537) viral gene, which modulates expression of respective host target genes thereof, the function and utility of which host target genes is known in the art.

VGAM2537 is a novel bioinformatically detected regulatory, non protein coding, viral micro RNA (miRNA) gene. The method by which VGAM2537 was detected is described hereinabove with reference to FIGS. 1-8.

VGAM2537 gene, herein designated VGAM GENE, is a viral gene contained in the genome of Pestivirus Reindeer-1. VGAM2537 host target gene, herein designated VGAM HOST TARGET GENE, is a human gene contained in the human genome.

VGAM2537 gene encodes a VGAM2537 precursor RNA, herein designated VGAM PRECURSOR RNA. Similar to other miRNA genes, and unlike most ordinary genes, VGAM2537 precursor RNA does not encode a protein. A nucleotide sequence identical or highly similar to the nucleotide sequence of VGAM2537 precursor RNA is designated SEQ ID:2523, and is provided hereinbelow with reference to the sequence listing part. Nucleotide sequence SEQ ID:2523 is located at position 4253 relative to the genome of Pestivirus Reindeer-1.

VGAM2537 precursor RNA folds onto itself, forming VGAM2537 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2537 folded precursor RNA into VGAM2537 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2537 RNA is designated SEQ ID:5248, and is provided hereinbelow with reference to the sequence listing part.

VGAM2537 host target gene, herein designated VGAM HOST TARGET GENE, encodes a corresponding messenger RNA, VGAM2537 host target RNA, herein designated VGAM HOST TARGET RNA. VGAM2537 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2537 RNA, herein designated VGAM RNA, binds complementarily to one or more host target binding sites located in untranslated regions of VGAM2537 host target RNA, herein designated VGAM HOST TARGET RNA. This complementary binding is due to the fact that the nucleotide sequence of VGAM2537 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2537 RNA, herein designated VGAM RNA, may have a different number of host target binding sites in untranslated regions of a VGAM2537 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2537 RNA, herein designated VGAM RNA, to host target binding sites on VGAM2537 host target RNA, herein designated VGAM HOST TARGET RNA, such as BINDING SITE I, BINDING SITE II and BINDING SITE III, inhibits translation of VGAM2537 host target RNA into VGAM2537 host target protein, herein designated VGAM HOST TARGET PROTEIN. VGAM host target protein is therefore outlined by a broken line.

It is appreciated that VGAM2537 host target gene, herein designated VGAM HOST TARGET GENE, in fact represents a plurality of VGAM2537 host target genes. The mRNA of each one of this plurality of VGAM2537 host target genes comprises one or more host target binding sites, each having a nucleotide sequence which is at least partly complementary to VGAM2537 RNA, herein designated VGAM RNA, and which when bound by VGAM2537 RNA causes inhibition of translation of respective one or more VGAM2537 host target proteins.

It is further appreciated by one skilled in the art that the mode of translational inhibition illustrated by FIG. 1 with specific reference to translational inhibition exerted by VGAM2537 gene, herein designated VGAM GENE, on one or more VGAM2537 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2537 is inhibition of expression of host target genes, as part of a novel viral mechanism of attacking a host. Accordingly, utilities of VGAM2537 include diagnosis, prevention and treatment of viral infection by Pestivirus Reindeer-1. Specific functions, and accordingly utilities, of VGAM2537 correlate with, and may be deduced from, the identity of the host target genes which VGAM2537 binds and inhibits, and the function of these host target genes, as elaborated hereinbelow.

Nucleotide sequences of the VGAM2537 precursor RNA, herein designated VGAM PRECURSOR RNA, and of the 'diced' VGAM2537 RNA, herein designated VGAM RNA, and a schematic representation of the secondary folding of VGAM2537 folded precursor RNA, herein designated VGAM FOLDED PRECURSOR RNA, of VGAM2537 are further described hereinbelow with reference to Table 1.

Nucleotide sequences of host target binding sites, such as BINDING SITE-I, BINDING SITE-II and BINDING SITE-III of FIG. 1, found on VGAM2537 host target RNA, and schematic representation of the complementarity of each of these host target binding sites to VGAM2537 RNA, herein designated VGAM RNA, are described hereinbelow with reference to Table 2.

As mentioned hereinabove with reference to FIG. 1, a function of VGAM2537 gene, herein designated VGAM is inhibition of expression of VGAM2537 target genes. It is appreciated that specific functions, and accordingly utilities, of VGAM2537 correlate with, and may be deduced from, the identity of the target genes which VGAM2537 binds and inhibits, and the function of these target genes, as elaborated hereinbelow.

Agrin (AGRN, Accession XM_086178) is a VGAM2537 host target gene. AGRN BINDING SITE is HOST TARGET binding site found in the 3' untranslated region of mRNA encoded by AGRN, corresponding to a HOST TARGET binding site such as BINDING SITE I, BINDING SITE II or BINDING SITE III. Table 2 illustrates the complementarity of the nucleotide sequences of AGRN BINDING SITE, designated SEQ ID:38535, to the nucleotide sequence of VGAM2537 RNA, herein designated VGAM RNA, also designated SEQ ID:5248.

A function of VGAM2537 is therefore inhibition of Agrin (AGRN, Accession XM_086178), a gene which a neuronal aggregating factor that induces the aggregation of acetylcholine receptors. Accordingly, utilities of VGAM2537 include diagnosis, prevention and treatment of diseases and clinical conditions associated with AGRN. The function of AGRN and its association with various diseases and clinical conditions, has been established by previous studies, as described hereinabove with reference to VGAM1063. Ankyrin 1, Erythrocytic (ANK1, Accession XM_016774) is another VGAM2537 host target gene. ANK1 BINDING SITE1 through ANK1 BINDING SITE3 are HOST TARGET binding sites found in untranslated regions of mRNA encoded by ANK1, corresponding to HOST TARGET binding sites such as BINDING SITE I, BINDING SITE II or BINDING SITE III. Table 2 illustrates the complementarity of the nucleotide sequences of ANK1 BINDING SITE1 through ANK1 BINDING SITE3, designated SEQ ID:30281, SEQ ID:5477 and SEQ ID:21730 respectively, to the nucleotide sequence of VGAM2537 RNA, herein designated VGAM RNA, also designated SEQ ID:5248.

Another function of VGAM2537 is therefore inhibition of Ankyrin 1, Erythrocytic (ANK1, Accession XM_016774). Accordingly, utilities of VGAM2537 include diagnosis, prevention and treatment of diseases and clinical conditions associated with ANK1. Androgen Receptor (dihydrotestosterone receptor; testicular feminization; spinal and bulbar muscular atrophy; Kennedy disease) (AR, Accession NM_000044) is another VGAM2537 host target gene. AR BINDING SITE is HOST TARGET binding site found in the 5' untranslated region of mRNA encoded by AR, corresponding to a HOST TARGET binding site such as BINDING SITE I, BINDING SITE II or BINDING SITE III. Table 2 illustrates the complementarity of the nucleotide sequences of AR BINDING SITE, designated SEQ ID:5486, to the nucleotide sequence of VGAM2537 RNA, herein designated VGAM RNA, also designated SEQ ID:5248.

Another function of VGAM2537 is therefore inhibition of Androgen Receptor (dihydrotestosterone receptor; testicular feminization; spinal and bulbar muscular atrophy; Kennedy disease) (AR, Accession NM_000044), a gene which are involved in the regulation of eukaryotic gene expression and affect cellular proliferation and differentiation in target tissues. Accordingly, utilities of VGAM2537 include diagnosis, prevention and treatment of diseases and clinical conditions associated with AR. The function of AR and its association with various diseases and clinical conditions, has been established by previous studies, as described hereinabove with reference to VGAM1971. ATPase, Na+/K+ Transporting, Beta 2 Polypeptide (ATP1B2, Accession NM_001678) is another VGAM2537 host target gene. ATP1B2 BINDING SITE1 and ATP1B2 BINDING SITE2 are HOST TARGET binding sites found in untranslated regions of mRNA encoded by ATP1B2, corresponding to HOST TARGET binding sites such as BINDING SITE I, BINDING SITE II or BINDING SITE III. Table 2 illustrates the complementarity of the nucleotide sequences of ATP1B2 BINDING SITE1 and ATP1B2 BINDING SITE2, designated SEQ ID:7390 and SEQ ID:7391 respectively, to the nucleotide sequence of VGAM2537 RNA, herein designated VGAM RNA, also designated SEQ ID:5248.

Another function of VGAM2537 is therefore inhibition of ATPase, Na+/K+ Transporting, Beta 2 Polypeptide (ATP1B2, Accession NM_001678), a gene which catalyzes the hydrolysis of ATP coupled with the exchange of Na +/K+ ions across the plasma membrane. Accordingly, utilities of VGAM2537 include diagnosis, prevention and treatment of diseases and clinical conditions associated with ATP1B2. The function of ATP1B2 and its association with various diseases and clinical conditions, has been established by previous studies, as described hereinabove with reference to VGAM152. B-cell CLL/lymphoma 11B (zinc finger protein) (BCL11B, Accession NM_022898) is another VGAM2537 host target gene. BCL11B BINDING SITE is HOST TARGET binding site found in the 3' untranslated region of mRNA encoded by BCL11B, corresponding to a HOST TARGET binding site such as BINDING SITE I, BINDING SITE II or BINDING SITE III. Table 2 illustrates the complementarity of the nucleotide sequences of BCL11B BINDING SITE, designated SEQ ID:23160, to the nucleotide sequence of VGAM2537 RNA, herein designated VGAM RNA, also designated SEQ ID:5248.

Another function of VGAM2537 is therefore inhibition of B-cell CLL/lymphoma 11B (zinc finger protein) (BCL11B, Accession NM_022898). Accordingly, utilities of VGAM2537 include diagnosis, prevention and treatment of diseases and clinical conditions associated with BCL11B. B-cell CLL/lymphoma 6 (zinc finger protein 51) (BCL6, Accession NM_138931) is another VGAM2537 host target gene. BCL6 BINDING SITE is HOST TARGET binding site found in the 5' untranslated region of mRNA encoded by BCL6, corresponding to a HOST TARGET binding site such as BINDING SITE I, BINDING SITE II or BINDING SITE III. Table 2 illustrates the complementarity of the nucleotide sequences of BCL6 BINDING SITE, designated SEQ ID:29056, to the nucleotide sequence of VGAM2537 RNA, herein designated VGAM RNA, also designated SEQ ID:5248.

Another function of VGAM2537 is therefore inhibition of B-cell CLL/lymphoma 6 (zinc finger protein 51) (BCL6, Accession NM_138931), a gene which is involved in the generation and maintenance of both T and B cells during immune responses. Accordingly, utilities of VGAM2537 include diagnosis, prevention and treatment of diseases and clinical conditions associated with BCL6. The function of BCL6 and its association with various diseases and clinical conditions, has been established by previous studies, as described hereinabove with reference to VGAM481. Breakpoint Cluster Region (BCR, Accession NM_021574) is another VGAM2537 host target gene. BCR BINDING SITE is HOST TARGET binding site found in the 5' untranslated region of mRNA encoded by BCR, corresponding to a HOST TARGET binding site such as BINDING SITE I, BINDING SITE II or BINDING SITE III. Table 2 illustrates the complementarity of the nucleotide sequences of BCR BINDING SITE, designated SEQ ID:22237, to the nucleotide sequence of VGAM2537 RNA, herein designated VGAM RNA, also designated SEQ ID:5248.

Another function of VGAM2537 is therefore inhibition of Breakpoint Cluster Region (BCR, Accession NM_021574), a gene which is a serine/threonine kinase that involves in the t (9;22) translocation (Philadelphia chromosome). Accordingly, utilities of VGAM2537 include diagnosis, prevention and treatment of diseases and clinical conditions associated with BCR. The function of BCR and its association with various diseases and clinical conditions, has been established by previous studies, as described hereinabove with reference to VGAM2151. BTG Family, Member 2 (BTG2, Accession NM_006763) is another VGAM2537 host target gene. BTG2 BINDING SITE is HOST TARGET binding site found in the 3' untranslated region of mRNA encoded by BTG2, corresponding to a HOST TARGET binding site such as BINDING SITE I, BINDING SITE II or BINDING SITE III. Table 2 illustrates the complementarity of the nucleotide sequences of BTG2 BINDING SITE, designated SEQ ID:13626, to the nucleotide sequence of VGAM2537 RNA, herein designated VGAM RNA, also designated SEQ ID:5248.

Another function of VGAM2537 is therefore inhibition of BTG Family, Member 2 (BTG2, Accession NM_006763). Accordingly, utilities of VGAM2537 include diagnosis, prevention and treatment of diseases and clinical conditions associated with BTG2. Complement Component 5 Receptor 1 (C5a ligand) (C5R1, Accession NM_001736) is another VGAM2537 host target gene. C5R1 BINDING SITE is HOST TARGET binding site found in the 3' untranslated region of mRNA encoded by C5R1, corresponding to a HOST TARGET binding site such as BINDING SITE I, BINDING SITE II or BINDING SITE III. Table 2 illustrates the complementarity of the nucleotide sequences of C5R1 BINDING SITE, designated SEQ ID:7474, to the nucleotide sequence of VGAM2537 RNA, herein designated VGAM RNA, also designated SEQ ID:5248.

Another function of VGAM2537 is therefore inhibition of Complement Component 5 Receptor 1 (C5a ligand) (C5R1, Accession NM_001736), a gene which has a nonredundant function and is required for mucosal host cell defense in the lung. Accordingly, utilities of VGAM2537 include diagnosis, prevention and treatment of diseases and clinical conditions associated with C5R1. The function of C5R1 and its association with various diseases and clinical conditions, has been established by previous studies, as described hereinabove with reference to VGAM484. CD8 Antigen, Alpha Polypeptide (p32) (CD8A, Accession NM_001768) is another VGAM2537 host target gene. CD8A BINDING SITE is HOST TARGET binding site found in the 3' untranslated region of mRNA encoded by CD8A, corresponding to a HOST TARGET binding site such as BINDING SITE I, BINDING SITE II or BINDING SITE III. Table 2 illustrates the complementarity of the nucleotide sequences of CD8A BINDING SITE, designated SEQ ID:7529, to the nucleotide sequence of VGAM2537 RNA, herein designated VGAM RNA, also designated SEQ ID:5248.

Another function of VGAM2537 is therefore inhibition of CD8 Antigen, Alpha Polypeptide (p32) (CD8A, Accession NM_001768), a gene which is thought to play a role in the process of t-cell mediated killing. Accordingly, utilities of VGAM2537 include diagnosis, prevention and treatment of diseases and clinical conditions associated with CD8A. The function of CD8A and its association with various diseases and clinical conditions, has been established by previous studies, as described hereinabove with reference to VGAM609. Cyclin-dependent Kinase Inhibitor 1A (p21, Cip1) (CDKN1A, Accession NM_078467) is another VGAM2537 host target gene. CDKN1A BINDING SITE is HOST TARGET binding site found in the 3' untranslated region of mRNA encoded by CDKN1A, corresponding to a HOST TARGET binding site such as BINDING SITE I, BINDING SITE II or BINDING SITE III. Table 2 illustrates the complementarity of the nucleotide sequences of CDKN1A BINDING SITE, designated SEQ ID:27780, to the nucleotide sequence of VGAM2537 RNA, herein designated VGAM RNA, also designated SEQ ID:5248.

Another function of VGAM2537 is therefore inhibition of Cyclin-dependent Kinase Inhibitor 1A (p21, Cip1) (CDKN1A, Accession NM_078467), a gene which inhibits cyclin-kinase activity and probably serves as the effector of p53 cell cycle control. Accordingly, utilities of VGAM2537 include diagnosis, prevention and treatment of diseases and clinical conditions associated with CDKN1A. The function of CDKN1A and its association with various diseases and clinical conditions, has been established by previous studies, as described hereinabove with reference to VGAM1912. Clock Homolog (mouse) (CLOCK, Accession NM_004898) is another VGAM2537 host target gene. CLOCK BINDING SITE is HOST TARGET binding site found in the 3' untranslated region of mRNA encoded by CLOCK, corresponding to a HOST TARGET binding site such as BINDING SITE I, BINDING SITE II or BINDING SITE III. Table 2 illustrates the complementarity of the nucleotide sequences of CLOCK BINDING SITE, designated SEQ ID:11333, to the nucleotide sequence of VGAM2537 RNA, herein designated VGAM RNA, also designated SEQ ID:5248.

Another function of VGAM2537 is therefore inhibition of Clock Homolog (mouse) (CLOCK, Accession NM_004898). Accordingly, utilities of VGAM2537 include diagnosis, prevention and treatment of diseases and clinical conditions associated with CLOCK. Coronin, Actin Binding Protein, 2B (CORO2B, Accession XM_035403) is another VGAM2537 host target gene. CORO2B BINDING SITE is HOST TARGET binding site found in the 3' untranslated region of mRNA encoded by CORO2B, corresponding to a HOST TARGET binding site such as BINDING SITE I, BINDING SITE II or BINDING SITE III. Table 2 illustrates the complementarity of the nucleotide sequences of CORO2B BINDING SITE, designated SEQ ID:32255, to the nucleotide sequence of VGAM2537 RNA, herein designated VGAM RNA, also designated SEQ ID:5248.

Another function of VGAM2537 is therefore inhibition of Coronin, Actin Binding Protein, 2B (CORO2B, Accession XM_035403), a gene which may play a role in the reorganization of neuronal actin structure. Accordingly, utilities of VGAM2537 include diagnosis, prevention and treatment of diseases and clinical conditions associated with CORO2B. The function of CORO2B and its association with various diseases and clinical conditions, has been established by previous studies, as described hereinabove with reference to VGAM923. Corticotropin Releasing Hormone Receptor 2 (CRHR2, Accession NM_001883) is another VGAM2537 host target gene. CRHR2 BINDING SITE is HOST TARGET binding site found in the 3' untranslated region of mRNA encoded by CRHR2, corresponding to a HOST TARGET binding site such as BINDING SITE I, BINDING SITE II or BINDING SITE III. Table 2 illustrates the complementarity of the nucleotide sequences of CRHR2 BINDING SITE, designated SEQ ID:7611, to the nucleotide sequence of VGAM2537 RNA, herein designated VGAM RNA, also designated SEQ ID:5248.

Another function of VGAM2537 is therefore inhibition of Corticotropin Releasing Hormone Receptor 2 (CRHR2, Accession NM_001883), a gene which is a corticotropin releasing factor receptor type II. Accordingly, utilities of VGAM2537 include diagnosis, prevention and treatment of diseases and clinical conditions associated with CRHR2. The function of CRHR2 and its association with various diseases and clinical conditions, has been established by previous studies, as described hereinabove with reference to VGAM737. C-src Tyrosine Kinase (CSK, Accession NM_004383) is another VGAM2537 host target gene. CSK BINDING SITE is HOST TARGET binding site found in the 5' untranslated region of mRNA encoded by CSK, corresponding to a HOST TARGET binding site such as BINDING SITE I, BINDING SITE II or BINDING SITE III. Table 2 illustrates the complementarity of the nucleotide sequences of CSK BINDING SITE, designated SEQ ID:10608, to the nucleotide sequence of VGAM2537 RNA, herein designated VGAM RNA, also designated SEQ ID:5248.

Another function of VGAM2537 is therefore inhibition of C-src Tyrosine Kinase (CSK, Accession NM_004383), a gene which down-regulates antigen receptor signaling in T lymphocytes and the c-src oncoprotein. Accordingly, utilities of VGAM2537 include diagnosis, prevention and treatment of diseases and clinical conditions associated with CSK. The function of CSK has been established by previous studies. Partanen et al. (1991) cloned a novel cytoplasmic tyrosine kinase designated CSK. This tyrosine kinase was shown to downregulate the tyrosine kinase activity of the c-src oncoprotein (OMIM Ref. No. 190090) through tyrosine phosphorylation of the c-src carboxy terminus. Since cell transformation by SRC oncoproteins is caused by various mechanisms that interfere with this phosphorylation, the CSK gene might function as an antioncogene (Armstrong et al., 1992). The CSK gene is ubiquitously expressed in human tissues as 2 mRNA species of 2.6 and 3.4 kb, although in some tissues and cell lines, only the larger mRNA is detected Cloutier and Veillette (1996) used the yeast 2-hybrid system to identify proteins associated with CSK. They found that the Src homology-3 (SH3) domain of CSK associates with a proline-rich region of PEP (OMIM Ref. No. 600716), a protein-tyrosine phosphatase expressed in hemopoietic cells. Cloutier and Veillette (1996) showed that this association is highly specific and speculated that PEP may be an effector and/or regulator of CSK in T cells and other hemopoietic cells Full details of the abovementioned studies are described in the following publications, the disclosure of which are hereby incorporated by reference:

Armstrong, E.; Cannizzaro, L.; Bergman, M.; Huebner, K.; Alitalo, K.: The c-src tyrosine kinase (CSK) gene, a potential antioncogene, localizes to human chromosome region 15q23-q25. Cytogenet. Cell Genet. 60:119-120, 1992; and Cloutier, J.-F.; Veillette, A.: Association of inhibitory tyrosine protein kinase p50(csk) with protein tyrosine phosphatase PEP in T cells and other hemopoietic cells. EMBO J. 15:4909.

Further studies establishing the function and utilities of CSK are found in John Hopkins OMIM database record ID 124095, and in sited publications numbered 3685-3687 listed in the bibliography section hereinbelow, which are also hereby incorporated by reference. Drebrin 1 (DBN1, Accession NM_004395) is another VGAM2537 host target gene. DBN1 BINDING SITE1 and DBN1 BINDING SITE2 are HOST TARGET binding sites found in untranslated regions of mRNA encoded by DBN1, corresponding to HOST TARGET binding sites such as BINDING SITE I, BINDING SITE II or BINDING SITE III. Table 2 illustrates the complementarity of the nucleotide sequences of DBN1 BINDING SITE1 and DBN1 BINDING SITE2, designated SEQ ID:10639 and SEQ ID:28122 respectively, to the nucleotide sequence of VGAM2537 RNA, herein designated VGAM RNA, also designated SEQ ID:5248.

Another function of VGAM2537 is therefore inhibition of Drebrin 1 (DBN1, Accession NM_004395). Accordingly, utilities of VGAM2537 include diagnosis, prevention and treatment of diseases and clinical conditions associated with DBN1. DEAD/H (Asp-Glu-Ala-Asp/His) Box Polypeptide 11 (CHL1-like helicase homolog, S. cerevisiae) (DDX11, Accession NM_004399) is another VGAM2537 host target gene. DDX11 BINDING SITE1 and DDX11 BINDING SITE2 are HOST TARGET binding sites found in untranslated regions of mRNA encoded by DDX11, corresponding to HOST TARGET binding sites such as BINDING SITE I, BINDING SITE II or BINDING SITE III. Table 2 illustrates the complementarity of the nucleotide sequences of DDX11 BINDING SITE1 and DDX11 BINDING SITE2, designated SEQ ID:10652 and SEQ ID:13561 respectively, to the nucleotide sequence of VGAM2537 RNA, herein designated VGAM RNA, also designated SEQ ID:5248.

Another function of VGAM2537 is therefore inhibition of DEAD/H (Asp-Glu-Ala-Asp/His) Box Polypeptide 11 (CHL1-like helicase homolog, S. cerevisiae) (DDX11, Accession NM_004399), a gene which could be an ATP-dependent DNA-binding helicase and may intervene in cell cycle regulation. Accordingly, utilities of VGAM2537 include diagnosis, prevention and treatment of diseases and clinical conditions associated with DDX11. The function of DDX11 and its association with various diseases and clinical conditions, has been established by previous studies, as described hereinabove with reference to VGAM1533. Doublesex and Mab-3 Related Transcription Factor 2 (DMRT2, Accession NM_006557) is another VGAM2537 host target gene. DMRT2 BINDING SITE is HOST TARGET binding site found in the 3' untranslated region of mRNA encoded by DMRT2, corresponding to a HOST TARGET binding site such as BINDING SITE I, BINDING SITE II or BINDING SITE III. Table 2 illustrates the complementarity of the nucleotide sequences of DMRT2 BINDING SITE, designated SEQ ID:13323, to the nucleotide sequence of VGAM2537 RNA, herein designated VGAM RNA, also designated SEQ ID:5248.

Another function of VGAM2537 is therefore inhibition of Doublesex and Mab-3 Related Transcription Factor 2 (DMRT2, Accession NM_006557), a gene which May be involved in male sexual development. Accordingly, utilities of VGAM2537 include diagnosis, prevention and treatment of diseases and clinical conditions associated with DMRT2. The function of DMRT2 and its association with various diseases and clinical conditions, has been established by previous studies, as described hereinabove with reference to VGAM1929. Dual Specificity Phosphatase 4 (DUSP4, Accession NM_057158) is another VGAM2537 host target gene. DUSP4 BINDING SITE is HOST TARGET binding site found in the 5' untranslated region of mRNA encoded by DUSP4, corresponding to a HOST TARGET binding site such as BINDING SITE I, BINDING SITE II or BINDING SITE III. Table 2 illustrates the complementarity of the nucleotide sequences of DUSP4 BINDING SITE, designated SEQ ID:27667, to the nucleotide sequence of VGAM2537 RNA, herein designated VGAM RNA, also designated SEQ ID:5248.

Another function of VGAM2537 is therefore inhibition of Dual Specificity Phosphatase 4 (DUSP4, Accession NM_057158), a gene which regulates mitogenic signal transduction. Accordingly, utilities of VGAM2537 include diagnosis, prevention and treatment of diseases and clinical conditions associated with DUSP4. The function of DUSP4 and its association with various diseases and clinical conditions, has been established by previous studies, as described hereinabove with reference to VGAM110. ELK1, Member of ETS Oncogene Family (ELK1, Accession NM_005229) is another VGAM2537 host target gene. ELK1 BINDING SITE is HOST TARGET binding site found in the 3' untranslated region of mRNA encoded by ELK1, corresponding to a HOST TARGET binding site such as BINDING SITE I, BINDING SITE II or BINDING SITE III. Table 2 illustrates the complementarity of the nucleotide sequences of ELK1 BINDING SITE, designated SEQ ID:11732, to the nucleotide sequence of VGAM2537 RNA, herein designated VGAM RNA, also designated SEQ ID:5248.

Another function of VGAM2537 is therefore inhibition of ELK1, Member of ETS Oncogene Family (ELK1, Accession NM_005229), a gene which stimulates transcription. can form a ternary complex with the serum response factor and the ets and srf motifs of the fos serum response element. Accordingly, utilities of VGAM2537 include diagnosis, prevention and treatment of diseases and clinical conditions associated with ELK1. The function of ELK1 and its association with various diseases and clinical conditions, has been established by previous studies, as described hereinabove with reference to VGAM178. Estrogen-related Receptor Gamma (ESRRG, Accession XM_039053) is another VGAM2537 host target gene. ESRRG BINDING SITE is HOST TARGET binding site found in the 3' untranslated region of mRNA encoded by ESRRG, corresponding to a HOST TARGET binding site such as BINDING SITE I, BINDING SITE II or BINDING SITE III. Table 2 illustrates the complementarity of the nucleotide sequences of ESRRG BINDING SITE, designated SEQ ID:32998, to the nucleotide sequence of VGAM2537 RNA, herein designated VGAM RNA, also designated SEQ ID:5248.

Another function of VGAM2537 is therefore inhibition of Estrogen-related Receptor Gamma (ESRRG, Accession XM_039053), a gene which Estrogen-related receptor gamma. Accordingly, utilities of VGAM2537 include diagnosis, prevention and treatment of diseases and clinical conditions associated with ESRRG. The function of ESRRG and its association with various diseases and clinical conditions, has been established by previous studies, as described hereinabove with reference to VGAM359. Fibroblast Growth Factor 12 (FGF12, Accession NM_021032) is another VGAM2537 host target gene. FGF12 BINDING SITE is HOST TARGET binding site found in the 3' untranslated region of mRNA encoded by FGF12, corresponding to a HOST TARGET binding site such as BINDING SITE I, BINDING SITE II or BINDING SITE III. Table 2 illustrates the complementarity of the nucleotide sequences of FGF12 BINDING SITE, designated SEQ ID:22019, to the nucleotide sequence of VGAM2537 RNA, herein designated VGAM RNA, also designated SEQ ID:5248.

Another function of VGAM2537 is therefore inhibition of Fibroblast Growth Factor 12 (FGF12, Accession NM_021032), a gene which probably involved in nervous system development and function. Accordingly, utilities of VGAM2537 include diagnosis, prevention and treatment of diseases and clinical conditions associated with FGF12. The function of FGF12 and its association with various diseases and clinical conditions, has been established by previous studies, as described hereinabove with reference to VGAM1025. FXYD Domain Containing Ion Transport Regulator 6 (FXYD6, Accession NM_022003) is another VGAM2537 host target gene. FXYD6 BINDING SITE is HOST TARGET binding site found in the 3' untranslated region of mRNA encoded by FXYD6, corresponding to a HOST TARGET binding site such as BINDING SITE I, BINDING SITE II or BINDING SITE III. Table 2 illustrates the complementarity of the nucleotide sequences of FXYD6 BINDING SITE, designated SEQ ID:22550, to the nucleotide sequence of VGAM2537 RNA, herein designated VGAM RNA, also designated SEQ ID:5248.

Another function of VGAM2537 is therefore inhibition of FXYD Domain Containing Ion Transport Regulator 6 (FXYD6, Accession NM_022003). Accordingly, utilities of VGAM2537 include diagnosis, prevention and treatment of diseases and clinical conditions associated with FXYD6. Gamma-aminobutyric Acid (GABA) A Receptor, Epsilon (GABRE, Accession NM_021990) is another VGAM2537 host target gene. GABRE BINDING SITE is HOST TARGET binding site found in the 5' untranslated region of mRNA encoded by GABRE, corresponding to a HOST TARGET binding site such as BINDING SITE I, BINDING SITE II or BINDING SITE III. Table 2 illustrates the complementarity of the nucleotide sequences of GABRE BINDING SITE, designated SEQ ID:22529, to the nucleotide sequence of VGAM2537 RNA, herein designated VGAM RNA, also designated SEQ ID:5248.

Another function of VGAM2537 is therefore inhibition of Gamma-aminobutyric Acid (GABA) A Receptor, Epsilon (GABRE, Accession NM_021990), a gene which mediates neuronal inhibition by binding to the gaba/benzodiazepine receptor and opening an integral chloride channel. Accordingly, utilities of VGAM2537 include diagnosis, prevention and treatment of diseases and clinical conditions associated with GABRE. The function of GABRE and its association with various diseases and clinical conditions, has been established by previous studies, as described hereinabove with reference to VGAM259. Galactosamine (N-acetyl)-6-sulfate Sulfatase (Morquio syndrome, mucopolysaccharidosis type IVA) (GALNS, Accession NM_000512) is another VGAM2537 host target gene. GALNS BINDING SITE is HOST TARGET binding site found in the 3' untranslated region of mRNA encoded by GALNS, corresponding to a HOST TARGET binding site such as BINDING SITE I, BINDING SITE II or BINDING SITE III. Table 2 illustrates the complementarity of the nucleotide sequences of GALNS BINDING SITE, designated SEQ ID:6124, to the nucleotide sequence of VGAM2537 RNA, herein designated VGAM RNA, also designated SEQ ID:5248.

Another function of VGAM2537 is therefore inhibition of Galactosamine (N-acetyl)-6-sulfate Sulfatase (Morquio syndrome, mucopolysaccharidosis type IVA) (GALNS, Accession NM_000512). Accordingly, utilities of VGAM2537 include diagnosis, prevention and treatment of diseases and clinical conditions associated with GALNS. Glucagon-like Peptide 1 Receptor (GLP1R, Accession NM_002062) is another VGAM2537 host target gene. GLP1R BINDING SITE1 and GLP1R BINDING SITE2 are HOST TARGET binding sites found in untranslated regions of mRNA encoded by GLP1R, corresponding to HOST TARGET binding sites such as BINDING SITE I, BINDING SITE II or BINDING SITE III. Table 2 illustrates the complementarity of the nucleotide sequences of GLP1R BINDING SITE1 and GLP1R BINDING SITE2, designated SEQ ID:7822 and SEQ ID:7823 respectively, to the nucleotide sequence of VGAM2537 RNA, herein designated VGAM RNA, also designated SEQ ID:5248.

Another function of VGAM2537 is therefore inhibition of Glucagon-like Peptide 1 Receptor (GLP1R, Accession NM_002062), a gene which is mediated by g proteins which activate adenylyl cyclase. Accordingly, utilities of VGAM2537 include diagnosis, prevention and treatment of diseases and clinical conditions associated with GLP1R. The function of GLP1R and its association with various diseases and clinical conditions, has been established by previous studies, as described hereinabove with reference to VGAM1652. G Protein-coupled Receptor 45 (GPR45, Accession NM_007227) is another VGAM2537 host target gene. GPR45 BINDING SITE is HOST TARGET binding site found in the 5' untranslated region of mRNA encoded by GPR45, corresponding to a HOST TARGET binding site such as BINDING SITE I, BINDING SITE II or BINDING SITE III. Table 2 illustrates the complementarity of the nucleotide sequences of GPR45 BINDING SITE, designated SEQ ID:14094, to the nucleotide sequence of VGAM2537 RNA, herein designated VGAM RNA, also designated SEQ ID:5248.

Another function of VGAM2537 is therefore inhibition of G Protein-coupled Receptor 45 (GPR45, Accession NM_007227). Accordingly, utilities of VGAM2537 include diagnosis, prevention and treatment of diseases and clinical conditions associated with GPR45. Hepatoma-derived Growth Factor (high-mobility group protein 1-like) (HDGF, Accession NM_004494) is another VGAM2537 host target gene. HDGF BINDING SITE is HOST TARGET binding site found in the 3' untranslated region of mRNA encoded by HDGF, corresponding to a HOST TARGET binding site such as BINDING SITE I, BINDING SITE II or BINDING SITE III. Table 2 illustrates the complementarity of the nucleotide sequences of HDGF BINDING SITE, designated SEQ ID:10832, to the nucleotide sequence of VGAM2537 RNA, herein designated VGAM RNA, also designated SEQ ID:5248.

Another function of VGAM2537 is therefore inhibition of Hepatoma-derived Growth Factor (high-mobility group protein 1-like) (HDGF, Accession NM_004494), a gene which is a heparin-binding protein, with mitogenic activity for fibroblasts. Accordingly, utilities of VGAM2537 include diagnosis, prevention and treatment of diseases and clinical conditions associated with HDGF. The function of HDGF and its association with various diseases and clinical conditions, has been established by previous studies, as described hereinabove with reference to VGAM1929. Hippocalcin-like 1

(HPCAL1, Accession NM_002149) is another VGAM2537 host target gene. HPCAL1 BINDING SITE1 through HPCAL1 BINDING SITE3 are HOST TARGET binding sites found in untranslated regions of mRNA encoded by HPCAL1, corresponding to HOST TARGET binding sites such as BINDING SITE I, BINDING SITE II or BINDING SITE III. Table 2 illustrates the complementarity of the nucleotide sequences of HPCAL1 BINDING SITE1 through HPCAL1 BINDING SITE3, designated SEQ ID:7927, SEQ ID:28635 and SEQ ID:28634 respectively, to the nucleotide sequence of VGAM2537 RNA, herein designated VGAM RNA, also designated SEQ ID:5248.

Another function of VGAM2537 is therefore inhibition of Hippocalcin-like 1 (HPCAL1, Accession NM_002149). Accordingly, utilities of VGAM2537 include diagnosis, prevention and treatment of diseases and clinical conditions associated with HPCAL1. Insulin-like Growth Factor Binding Protein 4 (IGFBP4, Accession NM_001552) is another VGAM2537 host target gene. IGFBP4 BINDING SITE is HOST TARGET binding site found in the 3' untranslated region of mRNA encoded by IGFBP4, corresponding to a HOST TARGET binding site such as BINDING SITE I, BINDING SITE II or BINDING SITE III. Table 2 illustrates the complementarity of the nucleotide sequences of IGFBP4 BINDING SITE, designated SEQ ID:7275, to the nucleotide sequence of VGAM2537 RNA, herein designated VGAM RNA, also designated SEQ ID:5248.

Another function of VGAM2537 is therefore inhibition of Insulin-like Growth Factor Binding Protein 4 (IGFBP4, Accession NM_001552), a gene which prolongs the half-life of the igfs and inhibit or stimulate their growth promoting effects on cell culture. Accordingly, utilities of VGAM2537 include diagnosis, prevention and treatment of diseases and clinical conditions associated with IGFBP4. The function of IGFBP4 has been established by previous studies. Six structurally distinct insulin-like growth factor binding proteins have been isolated and their cDNAs cloned: IGFBP1 (OMIM Ref. No. 146730), IGFBP2 (OMIM Ref. No. 146731), IGFBP3 (OMIM Ref. No. 146732), IGFBP4, IGFBP5 (OMIM Ref. No. 146734), and IGFBP6 (OMIM Ref. No. 146735). The proteins display strong sequence homologies, suggesting that they are encoded by a closely related family of genes. The IGFBPs contain 3 structurally distinct domains each comprising approximately one-third of the molecule. The N-terminal domain 1 and the C-terminal domain 3 of the 6 human IGFBPs show moderate to high levels of sequence identity including 12 and 6 invariant cysteine residues in domains 1 and 3, respectively (IGFBP6 contains 10 cysteine residues in domain 1), and are thought to be the IGF binding domains. Domain 2 is defined primarily by a lack of sequence identity among the 6 IGFBPs and by a lack of cysteine residues, though it does contain 2 cysteines in IGFBP4. Domain 3 is homologous to the thyroglobulin type I repeat unit. Kiefer et al. (1992) characterized recombinant human insulin-like growth factor binding proteins 4, 5, and 6 by their expression in yeast as fusion proteins with ubiquitin (OMIM Ref. No. 191320). Results of the study suggested to the authors that the primary effect of the 3 proteins is the attenuation of IGF activity and suggested that they contribute to the control of IGF-mediated cell growth and metabolism. Based on peptide sequences of a purified insulin-like growth factor-binding protein (IGFBP), Shimasaki et al. (1990) cloned rat IGFBP4 using PCR. They used the rat cDNA to clone the human ortholog from a liver cDNA library. Human IGFBP4 encodes a 258-amino acid polypeptide, which includes a 21-amino acid signal sequence. The protein is very hydrophilic, which may facilitate its ability as a carrier protein for the IGFs in blood. Northern blot analysis of rat tissues revealed expression in all tissues examined, with highest expression in liver. Shimasaki et al. (1990) stated that IGFBP4 acts as an inhibitor of IGF-induced bone cell proliferation.

Full details of the abovementioned studies are described in the following publications, the disclosure of which are hereby incorporated by reference:

Shimasaki, S.; Uchiyama, F.; Shimonaka, M.; Ling, N.: Molecular cloning of the cDNAs encoding a novel insulin-like growth factor-binding protein from rat and human. Molec. Endocr. 4:1451-1458, 1990; and Kiefer, M. C.; Schmid, C.; Waldvogel, M.; Schlapfer, I.; Futo, E.; Masiarz, F. R.; Green, K.; Barr, P. J.; Zapf, J.: Characterization of recombinant human insulin-like growth factor bin.

Further studies establishing the function and utilities of IGFBP4 are found in John Hopkins OMIM database record ID 146733, and in sited publications numbered 3023-3027 listed in the bibliography section hereinbelow, which are also hereby incorporated by reference. Interleukin 8 Receptor, Alpha (IL8RA, Accession NM_000634) is another VGAM2537 host target gene. IL8RA BINDING SITE is HOST TARGET binding site found in the 3' untranslated region of mRNA encoded by IL8RA, corresponding to a HOST TARGET binding site such as BINDING SITE I, BINDING SITE II or BINDING SITE III. Table 2 illustrates the complementarity of the nucleotide sequences of IL8RA BINDING SITE, designated SEQ ID:6266, to the nucleotide sequence of VGAM2537 RNA, herein designated VGAM RNA, also designated SEQ ID:5248.

Another function of VGAM2537 is therefore inhibition of Interleukin 8 Receptor, Alpha (IL8RA, Accession NM_000634), a gene which is the receptor to interleukin-8, which is a powerful neutrophils chemotactic factor. Accordingly, utilities of VGAM2537 include diagnosis, prevention and treatment of diseases and clinical conditions associated with IL8RA. The function of IL8RA and its association with various diseases and clinical conditions, has been established by previous studies, as described hereinabove with reference to VGAM300. Potassium Voltage-gated Channel, Isk-related Family, Member 1-like (KCNE1L, Accession NM_012282) is another VGAM2537 host target gene. KCNE1L BINDING SITE is HOST TARGET binding site found in the 3' untranslated region of mRNA encoded by KCNE1L, corresponding to a HOST TARGET binding site such as BINDING SITE I, BINDING SITE II or BINDING SITE III. Table 2 illustrates the complementarity of the nucleotide sequences of KCNE1L BINDING SITE, designated SEQ ID:14614, to the nucleotide sequence of VGAM2537 RNA, herein designated VGAM RNA, also designated SEQ ID:5248.

Another function of VGAM2537 is therefore inhibition of Potassium Voltage-gated Channel, Isk-related Family, Member 1-like (KCNE1L, Accession NM_012282), a gene which is a potassium voltage-gated channel. Accordingly, utilities of VGAM2537 include diagnosis, prevention and treatment of diseases and clinical conditions associated with KCNE1L. The function of KCNE1L and its association with various diseases and clinical conditions, has been established by previous studies, as described hereinabove with reference to VGAM1864. Potassium Channel, Subfamily K, Member 4 (KCNK4, Accession NM_016611) is another VGAM2537 host target gene. KCNK4 BINDING SITE is HOST TARGET binding site found in the 3' untranslated region of mRNA encoded by KCNK4, corresponding to a HOST TARGET binding site such as BINDING SITE I, BINDING SITE II or BINDING SITE III. Table 2 illustrates the complementarity of the nucleotide sequences of KCNK4 BINDING SITE, designated SEQ ID:18716, to the nucleotide sequence of VGAM2537 RNA, herein designated VGAM RNA, also designated SEQ ID:5248.

Another function of VGAM2537 is therefore inhibition of Potassium Channel, Subfamily K, Member 4 (KCNK4, Accession NM_016611). Accordingly, utilities of VGAM2537 include diagnosis, prevention and treatment of diseases and clinical conditions associated with KCNK4. L1 Cell Adhesion Molecule (hydrocephalus, stenosis of aqueduct of Sylvius 1, MASA (mental retardation, aphasia, shuffling gait and adducted thumbs) Syndrome, Spastic Paraplegia 1) (L1CAM, Accession NM_024003) is another VGAM2537 host target gene. L1CAM BINDING SITE1 and L1CAM BINDING SITE2 are HOST TARGET binding sites found in untranslated regions of mRNA encoded by L1CAM, corresponding to HOST TARGET binding sites such as BINDING SITE I, BINDING SITE II or BINDING SITE III. Table 2 illustrates the complementarity of the nucleotide sequences of L1CAM BINDING SITE1 and L1CAM BINDING SITE2, designated SEQ ID:23429 and SEQ ID:6001 respectively, to the nucleotide sequence of VGAM2537 RNA, herein designated VGAM RNA, also designated SEQ ID:5248.

Another function of VGAM2537 is therefore inhibition of L1 Cell Adhesion Molecule (hydrocephalus, stenosis of aqueduct of Sylvius 1, MASA (mental retardation, aphasia, shuffling gait and adducted thumbs) Syndrome, Spastic Paraplegia 1) (L1CAM, Accession NM_024003). Accordingly, utilities of VGAM2537 include diagnosis, prevention and treatment of diseases and clinical conditions associated with L1CAM. MAX Binding Protein (MNT, Accession NM_020310) is another VGAM2537 host target gene. MNT BINDING SITE is HOST TARGET binding site found in the 3' untranslated region of mRNA encoded by MNT, corresponding to a HOST TARGET binding site such as BINDING SITE I, BINDING SITE II or BINDING SITE III. Table 2 illustrates the complementarity of the nucleotide sequences of MNT BINDING SITE, designated SEQ ID:21560, to the nucleotide sequence of VGAM2537 RNA, herein designated VGAM RNA, also designated SEQ ID:5248.

Another function of VGAM2537 is therefore inhibition of MAX Binding Protein (MNT, Accession NM_020310). Accordingly, utilities of VGAM2537 include diagnosis, prevention and treatment of diseases and clinical conditions associated with MNT. Myotubularin Related Protein 3 (MTMR3, Accession NM_021090) is another VGAM2537 host target gene. MTMR3 BINDING SITE is HOST TARGET binding site found in the 3' untranslated region of mRNA encoded by MTMR3, corresponding to a HOST TARGET binding site such as BINDING SITE I, BINDING SITE II or BINDING SITE III. Table 2 illustrates the complementarity of the nucleotide sequences of MTMR3 BINDING SITE, designated SEQ ID:22072, to the nucleotide sequence of VGAM2537 RNA, herein designated VGAM RNA, also designated SEQ ID:5248.

Another function of VGAM2537 is therefore inhibition of Myotubularin Related Protein 3 (MTMR3, Accession NM_021090), a gene which could be a tyrosine-phosphatase. Accordingly, utilities of VGAM2537 include diagnosis, prevention and treatment of diseases and clinical conditions associated with MTMR3. The function of MTMR3 and its association with various diseases and clinical conditions, has been established by previous studies, as described hereinabove with reference to VGAM1718. Nescient Helix Loop Helix 1 (NHLH1, Accession NM_005598) is another VGAM2537 host target gene. NHLH1 BINDING SITE is HOST TARGET binding site found in the 3' untranslated region of mRNA encoded by NHLH1, corresponding to a HOST TARGET binding site such as BINDING SITE I, BINDING SITE II or BINDING SITE III. Table 2 illustrates the complementarity of the nucleotide sequences of NHLH1 BINDING SITE, designated SEQ ID:12125, to the nucleotide sequence of VGAM2537 RNA, herein designated VGAM RNA, also designated SEQ ID:5248.

Another function of VGAM2537 is therefore inhibition of Nescient Helix Loop Helix 1 (NHLH1, Accession NM_005598), a gene which may have a role in development of the nervous system. Accordingly, utilities of VGAM2537 include diagnosis, prevention and treatment of diseases and clinical conditions associated with NHLH1. The function of NHLH1 and its association with various diseases and clinical conditions, has been established by previous studies, as described hereinabove with reference to VGAM1923. Platelet-activating Factor Acetylhydrolase, Isoform Ib, Alpha Subunit 45 kDa (PAFAH1B1, Accession NM_000430) is another VGAM2537 host target gene. PAFAH1B1 BINDING SITE is HOST TARGET binding site found in the 5' untranslated region of mRNA encoded by PAFAH1B1, corresponding to a HOST TARGET binding site such as BINDING SITE I, BINDING SITE II or BINDING SITE III. Table 2 illustrates the complementarity of the nucleotide sequences of PAFAH1B1 BINDING SITE, designated SEQ ID:6010, to the nucleotide sequence of VGAM2537 RNA, herein designated VGAM RNA, also designated SEQ ID:5248.

Another function of VGAM2537 is therefore inhibition of Platelet-activating Factor Acetylhydrolase, Isoform Ib, Alpha Subunit 45 kDa (PAFAH1B1, Accession NM_000430). Accordingly, utilities of VGAM2537 include diagnosis, prevention and treatment of diseases and clinical conditions associated with PAFAH1B1. Paired Box Gene 5 (B-cell lineage specific activator protein) (PAX5, Accession NM_016734) is another VGAM2537 host target gene. PAX5 BINDING SITE is HOST TARGET binding site found in the 3' untranslated region of mRNA encoded by PAX5, corresponding to a HOST TARGET binding site such as BINDING SITE I, BINDING SITE II or BINDING SITE III. Table 2 illustrates the complementarity of the nucleotide sequences of PAX5 BINDING SITE, designated SEQ ID:18790, to the nucleotide sequence of VGAM2537 RNA, herein designated VGAM RNA, also designated SEQ ID:5248.

Another function of VGAM2537 is therefore inhibition of Paired Box Gene 5 (B-cell lineage specific activator protein) (PAX5, Accession NM_016734), a gene which plays a role in B-cell differentiation, neural development and spermatogenesis. Accordingly, utilities of VGAM2537 include diagnosis, prevention and treatment of diseases and clinical conditions associated with PAX5. The function of PAX5 and its association with various diseases and clinical conditions, has been established by previous studies, as described hereinabove with reference to VGAM1151. Phosphodiesterase 4A, CAMP-specific (phosphodiesterase E2 dunce homolog, Drosophila) (PDE4A, Accession NM_006202) is another VGAM2537 host target gene. PDE4A BINDING SITE is HOST TARGET binding site found in the 3' untranslated region of mRNA encoded by PDE4A, corresponding to a HOST TARGET binding site such as BINDING SITE I, BINDING SITE II or BINDING SITE III. Table 2 illustrates the complementarity of the nucleotide sequences of PDE4A BINDING SITE, designated SEQ ID:12874, to the nucleotide sequence of VGAM2537 RNA, herein designated VGAM RNA, also designated SEQ ID:5248.

Another function of VGAM2537 is therefore inhibition of Phosphodiesterase 4A, CAMP-specific (phosphodiesterase E2 dunce homolog, Drosophila) (PDE4A, Accession NM_006202), a gene which is a CAMP-specific phosphodiesterase. Accordingly, utilities of VGAM2537 include diagnosis, prevention and treatment of diseases and clinical conditions associated with PDE4A. The function of PDE4A and its association with various diseases and clinical conditions, has been established by previous studies, as described hereinabove with reference to VGAM1214. Peroxisomal Biogenesis Factor 14 (PEX14, Accession XM_033059) is another VGAM2537 host target gene. PEX14 BINDING SITE is HOST TARGET binding site found in the 3' untranslated region of mRNA encoded by PEX14, corresponding to a HOST TARGET binding site such as BINDING SITE I, BINDING SITE II or BINDING SITE III. Table 2 illustrates the complementarity of the nucleotide sequences of PEX14 BINDING SITE, designated SEQ ID:31827, to the nucleotide sequence of VGAM2537 RNA, herein designated VGAM RNA, also designated SEQ ID:5248.

Another function of VGAM2537 is therefore inhibition of Peroxisomal Biogenesis Factor 14 (PEX14, Accession XM_033059), a gene which is a component of the peroxisomal translocation machinery with pex13 and pex17. Accordingly, utilities of VGAM2537 include diagnosis, prevention and treatment of diseases and clinical conditions associated with PEX14. The function of PEX14 has been established by previous studies. Working with Saccharomyces cerevisiae, Albertini et al. (1997) described peroxin-14 (PEX14), the first membrane-bound peroxisomal protein that binds to the peroxisomal type-2 targeting signal (PTS2) receptor, PEX7 (OMIM Ref. No. 601757). Thus, the PEX14 protein may represent the functional docking site for PTS2-dependent protein import to the peroxisome. In addition to the interaction with the PTS2 receptor, PEX14 protein was found to interact with PEX5 protein (OMIM Ref. No. 600414), the PTS1 receptor. This observation suggested the overlapping of 2 import pathways, with PEX14 being the point of convergence. Moreover, PEX14 also interacted with 2 other membrane-bound peroxins, including the SH3 domain protein PEX13 (OMIM Ref. No. 601789), the putative docking protein for PTS1-dependent protein import. Albertini et al. (1997) proposed that these 3 peroxins are components of a common translocation machinery. Ligand blot analysis by Fransen et al. (1998) determined that PEX14 binds to both the PTS1 receptor (PEX5) and weakly with the SH3 domain of PEX13. Biochemical analysis indicated that PEX14 is required for the import of PTS1-containing proteins into peroxisomes.

Full details of the abovementioned studies are described in the following publications, the disclosure of which are hereby incorporated by reference:

Albertini, M.; Rehling, P.; Erdmann, R.; Girzalsky, W.; Kiel, J. A. K. W.; Veenhuis, M.; Kunau, W.-H.: Pex14p, a peroxisomal membrane protein binding both receptors of the two PTS-dependent import pathways. Cell 89:83-92, 1997; and Fransen, M.; Terlecky, S. R.; Subramani, S.: Identification of a human PTS1 receptor docking protein directly required for peroxisomal protein import. Proc. Nat. Acad. Sci. 95:8087-80.

Further studies establishing the function and utilities of PEX14 are found in John Hopkins OMIM database record ID 601791, and in sited publications numbered 5791 listed in the bibliography section hereinbelow, which are also hereby incorporated by reference. Polymeric Immunoglobulin Receptor (PIGR, Accession XM_052013) is another VGAM2537 host target gene. PIGR BINDING SITE is HOST TARGET binding site found in the 3' untranslated region of mRNA encoded by PIGR, corresponding to a HOST TARGET binding site such as BINDING SITE I, BINDING SITE II or BINDING SITE III. Table 2 illustrates the complementarity of the nucleotide sequences of PIGR BINDING SITE, designated SEQ ID:35938, to the nucleotide sequence of VGAM2537 RNA, herein designated VGAM RNA, also designated SEQ ID:5248.

Another function of VGAM2537 is therefore inhibition of Polymeric Immunoglobulin Receptor (PIGR, Accession XM_052013). Accordingly, utilities of VGAM2537 include diagnosis, prevention and treatment of diseases and clinical conditions associated with PIGR. Phosphoinositide-3-kinase, Catalytic, Delta Polypeptide (PIK3CD, Accession NM_005026) is another VGAM2537 host target gene. PIK3CD BINDING SITE is HOST TARGET binding site found in the 3' untranslated region of mRNA encoded by PIK3CD, corresponding to a HOST TARGET binding site such as BINDING SITE I, BINDING SITE II or BINDING SITE III. Table 2 illustrates the complementarity of the nucleotide sequences of PIK3CD BINDING SITE, designated SEQ ID:11463, to the nucleotide sequence of VGAM2537 RNA, herein designated VGAM RNA, also designated SEQ ID:5248.

Another function of VGAM2537 is therefore inhibition of Phosphoinositide-3-kinase, Catalytic, Delta Polypeptide (PIK3CD, Accession NM_005026), a gene which regulating cell growth. Accordingly, utilities of VGAM2537 include diagnosis, prevention and treatment of diseases and clinical conditions associated with PIK3CD. The function of PIK3CD and its association with various diseases and clinical conditions, has been established by previous studies, as described hereinabove with reference to VGAM2434. Procollagen-lysine, 2-oxoglutarate 5-dioxygenase (lysine hydroxylase, Ehlers-Danlos syndrome type VI) (PLOD, Accession NM_000302) is another VGAM2537 host target gene. PLOD BINDING SITE is HOST TARGET binding site found in the 3' untranslated region of mRNA encoded by PLOD, corresponding to a HOST TARGET binding site such as BINDING SITE I, BINDING SITE II or BINDING SITE III. Table 2 illustrates the complementarity of the nucleotide sequences of PLOD BINDING SITE, designated SEQ ID:5844, to the nucleotide sequence of VGAM2537 RNA, herein designated VGAM RNA, also designated SEQ ID:5248.

Another function of VGAM2537 is therefore inhibition of Procollagen-lysine, 2-oxoglutarate 5-dioxygenase (lysine hydroxylase, Ehlers-Danlos syndrome type VI) (PLOD, Accession NM_000302). Accordingly, utilities of VGAM2537 include diagnosis, prevention and treatment of diseases and clinical conditions associated with PLOD. Peanut-like 2 (Drosophila) (PNUTL2, Accession NM_080417) is another VGAM2537 host target gene. PNUTL2 BINDING SITE is HOST TARGET binding site found in the 3' untranslated region of mRNA encoded by PNUTL2, corresponding to a HOST TARGET binding site such as BINDING SITE I, BINDING SITE II or BINDING SITE III. Table 2 illustrates the complementarity of the nucleotide sequences of PNUTL2 BINDING SITE, designated SEQ ID:27837, to the nucleotide sequence of VGAM2537 RNA, herein designated VGAM RNA, also designated SEQ ID:5248.

Another function of VGAM2537 is therefore inhibition of Peanut-like 2 (Drosophila) (PNUTL2, Accession NM_080417), a gene which is involved in cytokinesis. Accordingly, utilities of VGAM2537 include diagnosis, prevention and treatment of diseases and clinical conditions associated with PNUTL2. The function of PNUTL2 and its association with various diseases and clinical conditions, has been established by previous studies, as described hereinabove with reference to VGAM95. Polymerase (DNA directed), Eta (POLH, Accession NM_006502) is another VGAM2537 host target gene. POLH BINDING SITE is HOST TARGET binding site found in the 5' untranslated region of mRNA encoded by POLH, corresponding to a HOST TARGET binding site such as BINDING SITE I, BINDING SITE II or BINDING SITE III. Table 2 illustrates the complementarity of the nucleotide sequences of POLH BINDING SITE, designated SEQ ID:13250, to the nucleotide sequence of VGAM2537 RNA, herein designated VGAM RNA, also designated SEQ ID:5248.

Another function of VGAM2537 is therefore inhibition of Polymerase (DNA directed), Eta (POLH, Accession NM_006502). Accordingly, utilities of VGAM2537 include diagnosis, prevention and treatment of diseases and clinical conditions associated with POLH. Prokineticin 1 (PROK1, Accession NM_032414) is another VGAM2537 host target gene. PROK1 BINDING SITE is HOST TARGET binding site found in the 3' untranslated region of mRNA encoded by PROK1, corresponding to a HOST TARGET binding site such as BINDING SITE I, BINDING SITE II or BINDING SITE III. Table 2 illustrates the complementarity of the nucleotide sequences of PROK1 BINDING SITE, designated SEQ ID:26200, to the nucleotide sequence of VGAM2537 RNA, herein designated VGAM RNA, also designated SEQ ID:5248.

Another function of VGAM2537 is therefore inhibition of Prokineticin 1 (PROK1, Accession NM_032414), a gene which induces proliferation, migration and fenestration in capillary endothelial cells derived from endocrine glands. Accordingly, utilities of VGAM2537 include diagnosis, prevention and treatment of diseases and clinical conditions associated with PROK1. The function of PROK1 and its association with various diseases and clinical conditions, has been established by previous studies, as described hereinabove with reference to VGAM1000. RAB, Member of RAS Oncogene Family-like 2A (RABL2A, Accession NM_013412) is another VGAM2537 host target gene. RABL2A BINDING SITE is HOST TARGET binding site found in the 3' untranslated region of mRNA encoded by RABL2A, corresponding to a HOST TARGET binding site such as BINDING SITE I, BINDING SITE II or BINDING SITE III. Table 2 illustrates the complementarity of the nucleotide sequences of RABL2A BINDING SITE, designated SEQ ID:15079, to the nucleotide sequence of VGAM2537 RNA, herein designated VGAM RNA, also designated SEQ ID:5248.

Another function of VGAM2537 is therefore inhibition of RAB, Member of RAS Oncogene Family-like 2A (RABL2A, Accession NM_013412). Accordingly, utilities of VGAM2537 include diagnosis, prevention and treatment of diseases and clinical conditions associated with RABL2A. RAB, Member of RAS Oncogene Family-like 2B (RABL2B, Accession NM_007081) is another VGAM2537 host target gene. RABL2B BINDING SITE is HOST TARGET binding site found in the 3' untranslated region of mRNA encoded by RABL2B, corresponding to a HOST TARGET binding site such as BINDING SITE I, BINDING SITE II or BINDING SITE III. Table 2 illustrates the complementarity of the nucleotide sequences of RABL2B BINDING SITE, designated SEQ ID:13946, to the nucleotide sequence of VGAM2537 RNA, herein designated VGAM RNA, also designated SEQ ID:5248.

Another function of VGAM2537 is therefore inhibition of RAB, Member of RAS Oncogene Family-like 2B (RABL2B, Accession NM_007081). Accordingly, utilities of VGAM2537 include diagnosis, prevention and treatment of diseases and clinical conditions associated with RABL2B. RNA (guanine-7-) Methyltransferase (RNMT, Accession NM_003799) is another VGAM2537 host target gene. RNMT BINDING SITE is HOST TARGET binding site found in the 3' untranslated region of mRNA encoded by RNMT, corresponding to a HOST TARGET binding site such as BINDING SITE I, BINDING SITE II or BINDING SITE III. Table 2 illustrates the complementarity of the nucleotide sequences of RNMT BINDING SITE, designated SEQ ID:9884, to the nucleotide sequence of VGAM2537 RNA, herein designated VGAM RNA, also designated SEQ ID:5248.

Another function of VGAM2537 is therefore inhibition of RNA (guanine-7-) Methyltransferase (RNMT, Accession NM_003799), a gene which catalyzes the methylation of GpppN- at the guanine N7 position. Accordingly, utilities of VGAM2537 include diagnosis, prevention and treatment of diseases and clinical conditions associated with RNMT. The function of RNMT and its association with various diseases and clinical conditions, has been established by previous studies, as described hereinabove with reference to VGAM178. Secretogranin III (SCG3, Accession NM_013243) is another VGAM2537 host target gene. SCG3 BINDING SITE is HOST TARGET binding site found in the 5' untranslated region of mRNA encoded by SCG3, corresponding to a HOST TARGET binding site such as BINDING SITE I, BINDING SITE II or BINDING SITE III. Table 2 illustrates the complementarity of the nucleotide sequences of SCG3 BINDING SITE, designated SEQ ID:14901, to the nucleotide sequence of VGAM2537 RNA, herein designated VGAM RNA, also designated SEQ ID:5248.

Another function of VGAM2537 is therefore inhibition of Secretogranin III (SCG3, Accession NM_013243). Accordingly, utilities of VGAM2537 include diagnosis, prevention and treatment of diseases and clinical conditions associated with SCG3. Syndecan 4 (amphiglycan, ryudocan) (SDC4, Accession NM_002999) is another VGAM2537 host target gene. SDC4 BINDING SITE is HOST TARGET binding site found in the 3' untranslated region of mRNA encoded by SDC4, corresponding to a HOST TARGET binding site such as BINDING SITE I, BINDING SITE II or BINDING SITE III. Table 2 illustrates the complementarity of the nucleotide sequences of SDC4 BINDING SITE, designated SEQ ID:8890, to the nucleotide sequence of VGAM2537 RNA, herein designated VGAM RNA, also designated SEQ ID:5248.

Another function of VGAM2537 is therefore inhibition of Syndecan 4 (amphiglycan, ryudocan) (SDC4, Accession NM_002999), a gene which is a cell surface proteoglycan. Accordingly, utilities of VGAM2537 include diagnosis, prevention and treatment of diseases and clinical conditions associated with SDC4. The function of SDC4 and its association with various diseases and clinical conditions, has been established by previous studies, as described hereinabove with reference to VGAM552. Selectin P Ligand (SELPLG, Accession XM_006867) is another VGAM2537 host target gene. SELPLG BINDING SITE is HOST TARGET binding site found in the 3' untranslated region of mRNA encoded by SELPLG, corresponding to a HOST TARGET binding site such as BINDING SITE I, BINDING SITE II or BINDING SITE III. Table 2 illustrates the complementarity of the nucleotide sequences of SELPLG BINDING SITE, designated SEQ ID:30017, to the nucleotide sequence of VGAM2537 RNA, herein designated VGAM RNA, also designated SEQ ID:5248.

Another function of VGAM2537 is therefore inhibition of Selectin P Ligand (SELPLG, Accession XM_006867), a gene which binds to p-, e- and l-selectins, which mediates the tethering and rolling of neutrophils and t-lymphocytes on endothelial cells. Accordingly, utilities of VGAM2537 include diagnosis, prevention and treatment of diseases and clinical conditions associated with SELPLG. The function of SELPLG and its association with various diseases and clinical conditions, has been established by previous studies, as described hereinabove with reference to VGAM200. Splicing Factor, Arginine/serine-rich 2, Interacting Protein (SFRS2IP, Accession NM_004719) is another VGAM2537 host target gene. SFRS2IP BINDING SITE is HOST TARGET binding site found in the 3' untranslated region of mRNA encoded by SFRS2IP, corresponding to a HOST TARGET binding site such as BINDING SITE I, BINDING SITE II or BINDING SITE III. Table 2 illustrates the complementarity of the nucleotide sequences of SFRS2IP BINDING SITE, designated SEQ ID:11087, to the nucleotide sequence of VGAM2537 RNA, herein designated VGAM RNA, also designated SEQ ID:5248.

Another function of VGAM2537 is therefore inhibition of Splicing Factor, Arginine/serine-rich 2, Interacting Protein (SFRS2IP, Accession NM_004719), a gene which plays an essential role in pre-mRNA splicing. Accordingly, utilities of VGAM2537 include diagnosis, prevention and treatment of diseases and clinical conditions associated with SFRS2IP. The function of SFRS2IP and its association with various diseases and clinical conditions, has been established by previous studies, as described hereinabove with reference to VGAM700. SH3-domain GRB2-like 1 (SH3GL1, Accession NM_003025) is another VGAM2537 host target gene. SH3GL1 BINDING SITE is HOST TARGET binding site found in the 3' untranslated region of mRNA encoded by SH3GL1, corresponding to a HOST TARGET binding site such as BINDING SITE I, BINDING SITE II or BINDING SITE III. Table 2 illustrates the complementarity of the nucleotide sequences of SH3GL1 BINDING SITE, designated SEQ ID:8962, to the nucleotide sequence of VGAM2537 RNA, herein designated VGAM RNA, also designated SEQ ID:5248.

Another function of VGAM2537 is therefore inhibition of SH3-domain GRB2-like 1 (SH3GL1, Accession NM_003025). Accordingly, utilities of VGAM2537 include diagnosis, prevention and treatment of diseases and clinical conditions associated with SH3GL1. SHC (Src homology 2 domain containing) Transforming Protein 1 (SHC1, Accession NM_003029) is another VGAM2537 host target gene. SHC1 BINDING SITE is HOST TARGET binding site found in the 3' untranslated region of mRNA encoded by SHC1, corresponding to a HOST TARGET binding site such as BINDING SITE I, BINDING SITE II or BINDING SITE III. Table 2 illustrates the complementarity of the nucleotide sequences of SHC1 BINDING SITE, designated SEQ ID:8970, to the nucleotide sequence of VGAM2537 RNA, herein designated VGAM RNA, also designated SEQ ID:5248.

Another function of VGAM2537 is therefore inhibition of SHC (Src homology 2 domain containing) Transforming Protein 1 (SHC1, Accession NM_003029), a gene which couples activated growth factor receptors to a signaling pathway. Accordingly, utilities of VGAM2537 include diagnosis, prevention and treatment of diseases and clinical conditions associated with SHC1. The function of SHC1 and its association with various diseases and clinical conditions, has been established by previous studies, as described hereinabove with reference to VGAM53. Sialic Acid Binding Ig-like Lectin 6 (SIGLEC6, Accession XM_009378) is another VGAM2537 host target gene. SIGLEC6 BINDING SITE is HOST TARGET binding site found in the 5' untranslated region of mRNA encoded by SIGLEC6, corresponding to a HOST TARGET binding site such as BINDING SITE I, BINDING SITE II or BINDING SITE III. Table 2 illustrates the complementarity of the nucleotide sequences of SIGLEC6 BINDING SITE, designated SEQ ID:30108, to the nucleotide sequence of VGAM2537 RNA, herein designated VGAM RNA, also designated SEQ ID:5248.

Another function of VGAM2537 is therefore inhibition of Sialic Acid Binding Ig-like Lectin 6 (SIGLEC6, Accession XM_009378), a gene which is a cell adhesion molecule for postnatal neural development. Accordingly, utilities of VGAM2537 include diagnosis, prevention and treatment of diseases and clinical conditions associated with SIGLEC6. The function of SIGLEC6 and its association with various diseases and clinical conditions, has been established by previous studies, as described hereinabove with reference to VGAM1566. Solute Carrier Family 9 (sodium/hydrogen exchanger), Isoform 5 (SLC9A5, Accession XM_007868) is another VGAM2537 host target gene. SLC9A5 BINDING SITE1 and SLC9A5 BINDING SITE2 are HOST TARGET binding sites found in untranslated regions of mRNA encoded by SLC9A5, corresponding to HOST TARGET binding sites such as BINDING SITE I, BINDING SITE II or BINDING SITE III. Table 2 illustrates the complementarity of the nucleotide sequences of SLC9A5 BINDING SITE1 and SLC9A5 BINDING SITE2, designated SEQ ID:30064 and SEQ ID:10935 respectively, to the nucleotide sequence of VGAM2537 RNA, herein designated VGAM RNA, also designated SEQ ID:5248.

Another function of VGAM2537 is therefore inhibition of Solute Carrier Family 9 (sodium/hydrogen exchanger), Isoform 5 (SLC9A5, Accession XM_007868). Accordingly, utilities of VGAM2537 include diagnosis, prevention and treatment of diseases and clinical conditions associated with SLC9A5. Syntrophin, Beta 1 (dystrophin-associated protein A1, 59 kDa, basic component 1) (SNTB1, Accession NM_021021) is another VGAM2537 host target gene. SNTB1 BINDING SITE is HOST TARGET binding site found in the 5' untranslated region of mRNA encoded by SNTB1, corresponding to a HOST TARGET binding site such as BINDING SITE I, BINDING SITE II or BINDING SITE III. Table 2 illustrates the complementarity of the nucleotide sequences of SNTB1 BINDING SITE, designated SEQ ID:22011, to the nucleotide sequence of VGAM2537 RNA, herein designated VGAM RNA, also designated SEQ ID:5248.

Another function of VGAM2537 is therefore inhibition of Syntrophin, Beta 1 (dystrophin-associated protein A1, 59 kDa, basic component 1) (SNTB1, Accession NM_021021). Accordingly, utilities of VGAM2537 include diagnosis, prevention and treatment of diseases and clinical conditions associated with SNTB1. SRY (sex determining region Y)-box 13 (SOX13, Accession NM_005686) is another VGAM2537 host target gene. SOX13 BINDING SITE is HOST TARGET binding site found in the 3' untranslated region of mRNA encoded by SOX13, corresponding to a HOST TARGET binding site such as BINDING SITE I, BINDING SITE II or BINDING SITE III. Table 2 illustrates the complementarity of the nucleotide sequences of SOX13 BINDING SITE, designated SEQ ID:12242, to the nucleotide sequence of VGAM2537 RNA, herein designated VGAM RNA, also designated SEQ ID:5248.

Another function of VGAM2537 is therefore inhibition of SRY (sex determining region Y)-box 13 (SOX13, Accession NM_005686). Accordingly, utilities of VGAM2537 include diagnosis, prevention and treatment of diseases and clinical conditions associated with SOX13. TAF4 RNA Polymerase II, TATA Box Binding Protein (TBP)-associated Factor, 135 kDa (TAF4, Accession NM_003185) is another VGAM2537 host target gene. TAF4 BINDING SITE is HOST TARGET binding site found in the 3' untranslated region of mRNA encoded by TAF4, corresponding to a HOST TARGET binding site such as BINDING SITE I, BINDING SITE II or BINDING SITE III. Table 2 illustrates the complementarity of the nucleotide sequences of TAF4 BINDING SITE, designated SEQ ID:9162, to the nucleotide sequence of VGAM2537 RNA, herein designated VGAM RNA, also designated SEQ ID:5248.

Another function of VGAM2537 is therefore inhibition of TAF4 RNA Polymerase II, TATA Box Binding Protein (TBP)-associated Factor, 135 kDa (TAF4, Accession NM_003185), a gene which plays a central role in mediating promoter responses to various activators and repressors. Accordingly, utilities of VGAM2537 include diagnosis, prevention and treatment of diseases and clinical conditions associated with TAF4. The function of TAF4 has been established by previous studies. Transcription factor TFIID is a multiprotein complex composed of the TATA box-binding protein (TBP; 600075) and multiple TBP-associated factors (TAFs; OMIM Ref. No. 313650). Tanese et al. (1996) cloned cDNAs encoding 2 subunits of the human TFIID complex: TAFII130 (also symbolized TAF2C1) and TAFII100 (TAF2D; 601787). The longest partial cDNA representing human TAFII130 encodes the predicted C-terminal 947 amino acids of the protein and 1.4 kb of 3-prime untranslated sequence; this cDNA appeared to be missing approximately 100 N-terminal amino acids of TAFII130. Tanese et al. (1996) showed that recombinant TAFII100 and TAFII130 associated with endogenous TAFs and TBP to form a TFIID complex in transfected 293 cells. Their experiments also suggested a role for TAFII130 as a direct coactivator target for Sp1 (OMIM Ref. No. 189906). See also TAF2C2 (OMIM Ref. No. 601689). By biochemical purification and genomic screening, Mengus et al. (1997) obtained a full-length cDNA encoding TAF2C1. Sequence analysis predicted that the 1,083-amino acid protein contains a C-terminal domain and a central region highly homologous to those of TAF2C2. TAF2C1 expression was found to enhance transactivation by the class II nuclear receptors RAR (see OMIM Ref. No. 180240), THRA (see OMIM Ref. No. 190120), and VDR (OMIM Ref. No. 601769) through activation function-2 in the C-terminal ligand-binding domain.

Full details of the abovementioned studies are described in the following publications, the disclosure of which are hereby incorporated by reference:

Mengus, G.; May, M.; Carre, L.; Chambon, P.; Davidson, I.: Human TAF(II)135 potentiates transcriptional activation by the AF-2s of the retinoic acid, vitamin D3, and thyroid hormone receptors in mammalian cells. Genes Dev. 11:1381-1395, 1997; and Tanese, N.; Saluja, D.; Vassallo, M. F.; Chen, J.-L.; Admon, A.: Molecular cloning and analysis of two subunits of the human TFIID complex: hTAFII130 and hTAFII100. Proc. Nat. Acad. S.

Further studies establishing the function and utilities of TAF4 are found in John Hopkins OMIM database record ID 601796, and in sited publications numbered 5225, 6238-623 and 1278 listed in the bibliography section hereinbelow, which are also hereby incorporated by reference. TAP Binding Protein (tapasin) (TAPBP, Accession NM_003190) is another VGAM2537 host target gene. TAPBP BINDING SITE is HOST TARGET binding site found in the 3' untranslated region of mRNA encoded by TAPBP, corresponding to a HOST TARGET binding site such as BINDING SITE I, BINDING SITE II or BINDING SITE III. Table 2 illustrates the complementarity of the nucleotide sequences of TAPBP BINDING SITE, designated SEQ ID:9179, to the nucleotide sequence of VGAM2537 RNA, herein designated VGAM RNA, also designated SEQ ID:5248.

Another function of VGAM2537 is therefore inhibition of TAP Binding Protein (tapasin) (TAPBP, Accession NM_003190), a gene which is involved in MHC class I-restricted antigen processing. Accordingly, utilities of VGAM2537 include diagnosis, prevention and treatment of diseases and clinical conditions associated with TAPBP. The function of TAPBP and its association with various diseases and clinical conditions, has been established by previous studies, as described hereinabove with reference to VGAM122. Transcription Factor 1, Hepatic; LF-B1, Hepatic Nuclear Factor (HNF1), Albumin Proximal Factor (TCF1, Accession NM_000545) is another VGAM2537 host target gene. TCF1 BINDING SITE is HOST TARGET binding site found in the 3' untranslated region of mRNA encoded by TCF1, corresponding to a HOST TARGET binding site such as BINDING SITE I, BINDING SITE II or BINDING SITE III. Table 2 illustrates the complementarity of the nucleotide sequences of TCF1 BINDING SITE, designated SEQ ID:6146, to the nucleotide sequence of VGAM2537 RNA, herein designated VGAM RNA, also designated SEQ ID:5248.

Another function of VGAM2537 is therefore inhibition of Transcription Factor 1, Hepatic; LF-B1, Hepatic Nuclear Factor (HNF1), Albumin Proximal Factor (TCF1, Accession NM_000545), a gene which is required for the expression of several liver specific genes. binds to the inverted palindrome 5'-gttaatnattaac-3'. Accordingly, utilities of VGAM2537 include diagnosis, prevention and treatment of diseases and clinical conditions associated with TCF1. The function of TCF1 and its association with various diseases and clinical conditions, has been established by previous studies, as described hereinabove with reference to VGAM1189. Transcription Factor 7-like 2 (T-cell specific, HMG-box) (TCF7L2, Accession NM_030756) is another VGAM2537 host target gene. TCF7L2 BINDING SITE is HOST TARGET binding site found in the 5' untranslated region of mRNA encoded by TCF7L2, corresponding to a HOST TARGET binding site such as BINDING SITE I, BINDING SITE II or BINDING SITE III. Table 2 illustrates the complementarity of the nucleotide sequences of TCF7L2 BINDING SITE, designated SEQ ID:25040, to the nucleotide sequence of VGAM2537 RNA, herein designated VGAM RNA, also designated SEQ ID:5248.

Another function of VGAM2537 is therefore inhibition of Transcription Factor 7-like 2 (T-cell specific, HMG-box) (TCF7L2, Accession NM_030756), a gene which is a transcriptional activator; interacts with ITF1 (TCF3); and contains basic helix-loop-helix domain. Accordingly, utilities of VGAM2537 include diagnosis, prevention and treatment of diseases and clinical conditions associated with TCF7L2. The function of TCF7L2 has been established by previous studies. The high mobility group (HMG) box is a DNA-binding domain. TCF7 (OMIM Ref. No. 189908), also called TCF1, and LEF1 (OMIM Ref. No. 153245), also called TCF1-alpha, are human lymphoid transcription factors that contain a virtually identical HMG box. By PCR of human genomic DNA using degenerate oligonucleotides based on the HMG boxes of TCF7 and LEF1, Castrop et al. (1992) identified the TCF7L1 (OMIM Ref. No. 604652) and TCF7L2 genes, which they called TCF3 and TCF4, respectively. TCF7L1 and TCF7L2 were not expressed in cells of the lymphoid lineage.

The deduced amino acid sequences of the HMG boxes of TCF7L1, TCF7L2, and TCF7 show striking homology. The authors suggested the existence of a subfamily of TCF7-like HMG box-containing transcription factors. Animal model experiments lend further support to the function of TCF7L2. To study the physiologic role of Tcf4 (which is encoded by the Tcf7l2 gene), Korinek et al. (1998) disrupted Tcf7l2 by homologous recombination. The homozygous null mice died shortly after birth. A single histopathologic abnormality was observed. An apparently normal transition of intestinal endoderm into epithelium occurred at approximately embryonic day (E) 14.5. However, no proliferative compartments were maintained in the prospective crypt regions between the villi. As a consequence, the neonatal epithelium was composed entirely of differentiated, nondividing villus cells. Korinek et al. (1998) concluded that the genetic program controlled by Tcf7l2 maintains the crypt stem cells of the small intestine. The constitutive activity of Tcf4 in APC-deficient epithelial cells may contribute to their malignant transformation by maintaining stem cell characteristics.

It is appreciated that the abovementioned animal model for TCF7L2 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Castrop, J.; van Norren, K.; Clevers, H.: A gene family of HMG-box transcription factors with homology to TCF-1. Nucleic Acids Res. 20:611 only, 1992; and Korinek, V.; Barker, N.; Moerer, P.; van Donselaar, E.; Huls, G.; Peters, P. J.; Clevers, H.: Depletion of epithelial stem-cell compartments in the small intestine of mice lacking Tcf-4.

Further studies establishing the function and utilities of TCF7L2 are found in John Hopkins OMIM database record ID 602228, and in sited publications numbered 5893-589 and 2303-2305 listed in the bibliography section hereinbelow, which are also hereby incorporated by reference. TEA Domain Family Member 3 (TEAD3, Accession NM_003214) is another VGAM2537 host target gene. TEAD3 BINDING SITE is HOST TARGET binding site found in the 5' untranslated region of mRNA encoded by TEAD3, corresponding to a HOST TARGET binding site such as BINDING SITE I, BINDING SITE II or BINDING SITE III. Table 2 illustrates the complementarity of the nucleotide sequences of TEAD3 BINDING SITE, designated SEQ ID:9211, to the nucleotide sequence of VGAM2537 RNA, herein designated VGAM RNA, also designated SEQ ID:5248.

Another function of VGAM2537 is therefore inhibition of TEA Domain Family Member 3 (TEAD3, Accession NM_003214), a gene which binds to multiple functional elements of the human chorionic somatomammotropin-b gene enhancer. Accordingly, utilities of VGAM2537 include diagnosis, prevention and treatment of diseases and clinical conditions associated with TEAD3. The function of TEAD3 and its association with various diseases and clinical conditions, has been established by previous studies, as described hereinabove with reference to VGAM299. Telomeric Repeat Binding Factor 2 (TERF2, Accession NM_005652) is another VGAM2537 host target gene. TERF2 BINDING SITE is HOST TARGET binding site found in the 3' untranslated region of mRNA encoded by TERF2, corresponding to a HOST TARGET binding site such as BINDING SITE I, BINDING SITE II or BINDING SITE III. Table 2 illustrates the complementarity of the nucleotide sequences of TERF2 BINDING SITE, designated SEQ ID:12190, to the nucleotide sequence of VGAM2537 RNA, herein designated VGAM RNA, also designated SEQ ID:5248.

Another function of VGAM2537 is therefore inhibition of Telomeric Repeat Binding Factor 2 (TERF2, Accession NM_005652), a gene which plays a key role in the protective activity of telomeres. Accordingly, utilities of VGAM2537 include diagnosis, prevention and treatment of diseases and clinical conditions associated with TERF2. The function of TERF2 and its association with various diseases and clinical conditions, has been established by previous studies, as described hereinabove with reference to VGAM1689. TIA1 Cytotoxic Granule-associated RNA Binding Protein-like 1 (TIAL1, Accession NM_022333) is another VGAM2537 host target gene. TIAL1 BINDING SITE is HOST TARGET binding site found in the 3' untranslated region of mRNA encoded by TIAL1, corresponding to a HOST TARGET binding site such as BINDING SITE I, BINDING SITE II or BINDING SITE III. Table 2 illustrates the complementarity of the nucleotide sequences of TIAL1 BINDING SITE, designated SEQ ID:22741, to the nucleotide sequence of VGAM2537 RNA, herein designated VGAM RNA, also designated SEQ ID:5248.

Another function of VGAM2537 is therefore inhibition of TIA1 Cytotoxic Granule-associated RNA Binding Protein-like 1 (TIAL1, Accession NM_022333), a gene which possesses nucleolytic activity against cytotoxic lymphocyte target cells. Accordingly, utilities of VGAM2537 include diagnosis, prevention and treatment of diseases and clinical conditions associated with TIAL1. The function of TIAL1 and its association with various diseases and clinical conditions, has been established by previous studies, as described hereinabove with reference to VGAM350. Tumor Necrosis Factor (ligand) Superfamily, Member 4 (tax-transcriptionally activated glycoprotein 1, 34 kDa) (TNFSF4, Accession NM_003326) is another VGAM2537 host target gene. TNFSF4 BINDING SITE is HOST TARGET binding site found in the 3' untranslated region of mRNA encoded by TNFSF4, corresponding to a HOST TARGET binding site such as BINDING SITE I, BINDING SITE II or BINDING SITE III. Table 2 illustrates the complementarity of the nucleotide sequences of TNFSF4 BINDING SITE, designated SEQ ID:9330, to the nucleotide sequence of VGAM2537 RNA, herein designated VGAM RNA, also designated SEQ ID:5248.

Another function of VGAM2537 is therefore inhibition of Tumor Necrosis Factor (ligand) Superfamily, Member 4 (tax-transcriptionally activated glycoprotein 1, 34 kDa) (TNFSF4, Accession NM_003326), a gene which co-stimulates t cell proliferation and cytokine production. Accordingly, utilities of VGAM2537 include diagnosis, prevention and treatment of diseases and clinical conditions associated with TNFSF4. The function of TNFSF4 and its association with various diseases and clinical conditions, has been established by previous studies, as described hereinabove with reference to VGAM463. Tumor Necrosis Factor (ligand) Superfamily, Member 5 (hyper-IgM syndrome) (TNFSF5, Accession NM_000074) is another VGAM2537 host target gene. TNFSF5 BINDING SITE is HOST TARGET binding site found in the 3' untranslated region of mRNA encoded by TNFSF5, corresponding to a HOST TARGET binding site such as BINDING SITE I, BINDING SITE II or BINDING SITE III. Table 2 illustrates the complementarity of the nucleotide sequences of TNFSF5 BINDING SITE, designated SEQ ID:5518, to the nucleotide sequence of VGAM2537 RNA, herein designated VGAM RNA, also designated SEQ ID:5248.

Another function of VGAM2537 is therefore inhibition of Tumor Necrosis Factor (ligand) Superfamily, Member 5 (hyper-IgM syndrome) (TNFSF5, Accession NM_000074). Accordingly, utilities of VGAM2537 include diagnosis, prevention and treatment of diseases and clinical conditions associated with TNFSF5. Tyrosine 3-monooxygenase/tryptophan 5-monooxygenase Activation Protein, Epsilon Polypeptide (YWHAE, Accession NM_006761) is another VGAM2537 host target gene. YWHAE BINDING SITE is HOST TARGET binding site found in the 3' untranslated region of mRNA encoded by YWHAE, corresponding to a HOST TARGET binding site such as BINDING SITE I, BINDING SITE II or BINDING SITE III. Table 2 illustrates the complementarity of the nucleotide sequences of YWHAE BINDING SITE, designated SEQ ID:13613, to the nucleotide sequence of VGAM2537 RNA, herein designated VGAM RNA, also designated SEQ ID:5248.

Another function of VGAM2537 is therefore inhibition of Tyrosine 3-monooxygenase/tryptophan 5-monooxygenase Activation Protein, Epsilon Polypeptide (YWHAE, Accession NM_006761), a gene which binds to cdc25 and may facilitate cdc25 interaction with Raf-1 in vivo. Accordingly, utilities of VGAM2537 include diagnosis, prevention and treatment of diseases and clinical conditions associated with YWHAE. The function of YWHAE and its association with various diseases and clinical conditions, has been established by previous studies, as described hereinabove with reference to VGAM656. Zinc Finger Protein 278 (ZNF278, Accession NM_014323) is another VGAM2537 host target gene. ZNF278 BINDING SITE1 through ZNF278 BINDING SITE4 are HOST TARGET binding sites found in untranslated regions of mRNA encoded by ZNF278, corresponding to HOST TARGET binding sites such as BINDING SITE I, BINDING SITE II or BINDING SITE III. Table 2 illustrates the complementarity of the nucleotide sequences of ZNF278 BINDING SITE1 through ZNF278 BINDING SITE4, designated SEQ ID:15625, SEQ ID:25774, SEQ ID:25777 and SEQ ID:25784 respectively, to the nucleotide sequence of VGAM2537 RNA, herein designated VGAM RNA, also designated SEQ ID:5248.

Another function of VGAM2537 is therefore inhibition of Zinc Finger Protein 278 (ZNF278, Accession NM_014323), a gene which represses basal transcription as well as RNF4-mediated activation. Accordingly, utilities of VGAM2537 include diagnosis, prevention and treatment of diseases and clinical conditions associated with ZNF278. The function of ZNF278 and its association with various diseases and clinical conditions, has been established by previous studies, as described hereinabove with reference to VGAM414. AP1 Gamma Subunit Binding Protein 1 (AP1GBP1, Accession NM_080550) is another VGAM2537 host target gene. AP1GBP1 BINDING SITE1 and AP1GBP1 BINDING SITE2 are HOST TARGET binding sites found in untranslated regions of mRNA encoded by AP1GBP1, corresponding to HOST TARGET binding sites such as BINDING SITE I, BINDING SITE II or BINDING SITE III. Table 2 illustrates the complementarity of the nucleotide sequences of AP1GBP1 BINDING SITE1 and AP1GBP1 BINDING SITE2, designated SEQ ID:27872 and SEQ ID:13362 respectively, to the nucleotide sequence of VGAM2537 RNA, herein designated VGAM RNA, also designated SEQ ID:5248.

Another function of VGAM2537 is therefore inhibition of AP1 Gamma Subunit Binding Protein 1 (AP1GBP1, Accession NM_080550). Accordingly, utilities of VGAM2537 include diagnosis, prevention and treatment of diseases and clinical conditions associated with AP1GBP1. Chromosome 14 Open Reading Frame 4 (C14orf4, Accession XM_041104) is another VGAM2537 host target gene. C14orf4 BINDING SITE is HOST TARGET binding site found in the 3' untranslated region of mRNA encoded by C14orf4, corresponding to a HOST TARGET binding site such as BINDING SITE I, BINDING SITE II or BINDING SITE III. Table 2 illustrates the complementarity of the nucleotide sequences of C14orf4 BINDING SITE, designated SEQ ID:33444, to the nucleotide sequence of VGAM2537 RNA, herein designated VGAM RNA, also designated SEQ ID:5248.

Another function of VGAM2537 is therefore inhibition of Chromosome 14 Open Reading Frame 4 (C14orf4, Accession XM_041104). Accordingly, utilities of VGAM2537 include diagnosis, prevention and treatment of diseases and clinical conditions associated with C14orf4. Chromosome 17 Open Reading Frame 31 (C17orf31, Accession NM_017575) is another VGAM2537 host target gene. C17orf31 BINDING SITE is HOST TARGET binding site found in the 5' untranslated region of mRNA encoded by C17orf31, corresponding to a HOST TARGET binding site such as BINDING SITE I, BINDING SITE II or BINDING SITE III. Table 2 illustrates the complementarity of the nucleotide sequences of C17orf31 BINDING SITE, designated SEQ ID:19000, to the nucleotide sequence of VGAM2537 RNA, herein designated VGAM RNA, also designated SEQ ID:5248.

Another function of VGAM2537 is therefore inhibition of Chromosome 17 Open Reading Frame 31 (C17orf31, Accession NM_017575). Accordingly, utilities of VGAM2537 include diagnosis, prevention and treatment of diseases and clinical conditions associated with C17orf31. Chromosome 1 Open Reading Frame 25 (C1orf25, Accession XM_051868) is another VGAM2537 host target gene. C1orf25 BINDING SITE is HOST TARGET binding site found in the 5' untranslated region of mRNA encoded by C1orf25, corresponding to a HOST TARGET binding site such as BINDING SITE I, BINDING SITE II or BINDING SITE III. Table 2 illustrates the complementarity of the nucleotide sequences of C1orf25 BINDING SITE, designated SEQ ID:35910, to the nucleotide sequence of VGAM2537 RNA, herein designated VGAM RNA, also designated SEQ ID:5248.

Another function of VGAM2537 is therefore inhibition of Chromosome 1 Open Reading Frame 25 (C1orf25, Accession XM_051868). Accordingly, utilities of VGAM2537 include diagnosis, prevention and treatment of diseases and clinical conditions associated with C1orf25. CDC14 Cell Division Cycle 14 Homolog B (S. cerevisiae) (CDC14B, Accession NM_033332) is another VGAM2537 host target gene. CDC14B BINDING SITE is HOST TARGET binding site found in the 3' untranslated region of mRNA encoded by CDC14B, corresponding to a HOST TARGET binding site such as BINDING SITE I, BINDING SITE II or BINDING SITE III. Table 2 illustrates the complementarity of the nucleotide sequences of CDC14B BINDING SITE, designated SEQ ID:27167, to the nucleotide sequence of VGAM2537 RNA, herein designated VGAM RNA, also designated SEQ ID:5248.

Another function of VGAM2537 is therefore inhibition of CDC14 Cell Division Cycle 14 Homolog B (S. cerevisiae) (CDC14B, Accession NM_033332). Accordingly, utilities of VGAM2537 include diagnosis, prevention and treatment of diseases and clinical conditions associated with CDC14B. Calsyntenin 3 (CLSTN3, Accession NM_014718) is another VGAM2537 host target gene. CLSTN3 BINDING SITE is HOST TARGET binding site found in the 3' untranslated region of mRNA encoded by CLSTN3, corresponding to a HOST TARGET binding site such as BINDING SITE I, BINDING SITE II or BINDING SITE III. Table 2 illustrates the complementarity of the nucleotide sequences of CLSTN3 BINDING SITE, designated SEQ ID:16272, to the nucleotide sequence of VGAM2537 RNA, herein designated VGAM RNA, also designated SEQ ID:5248.

Another function of VGAM2537 is therefore inhibition of Calsyntenin 3 (CLSTN3, Accession NM_014718). Accordingly, utilities of VGAM2537 include diagnosis, prevention and treatment of diseases and clinical conditions associated with CLSTN3. COP9 Constitutive Photomorphogenic Homolog Subunit 7B (Arabidopsis) (COPS7B, Accession NM_022730) is another VGAM2537 host target gene. COPS7B BINDING SITE is HOST TARGET binding site found in the 3' untranslated region of mRNA encoded by COPS7B, corresponding to a HOST TARGET binding site such as BINDING SITE I, BINDING SITE II or BINDING SITE III. Table 2 illustrates the complementarity of the nucleotide sequences of COPS7B BINDING SITE, designated SEQ ID:22933, to the nucleotide sequence of VGAM2537 RNA, herein designated VGAM RNA, also designated SEQ ID:5248.

Another function of VGAM2537 is therefore inhibition of COP9 Constitutive Photomorphogenic Homolog Subunit 7B (Arabidopsis) (COPS7B, Accession NM_022730). Accordingly, utilities of VGAM2537 include diagnosis, prevention and treatment of diseases and clinical conditions associated with COPS7B. DEAD/H (Asp-Glu-Ala-Asp/His) Box Polypeptide 12 (CHL1-like helicase homolog, S. cerevisiae) (DDX12, Accession XM_006936) is another VGAM2537 host target gene. DDX12 BINDING SITE is HOST TARGET binding site found in the 3' untranslated region of mRNA encoded by DDX12, corresponding to a HOST TARGET binding site such as BINDING SITE I, BINDING SITE II or BINDING SITE III. Table 2 illustrates the complementarity of the nucleotide sequences of DDX12 BINDING SITE, designated SEQ ID:30022, to the nucleotide sequence of VGAM2537 RNA, herein designated VGAM RNA, also designated SEQ ID:5248.

Another function of VGAM2537 is therefore inhibition of DEAD/H (Asp-Glu-Ala-Asp/His) Box Polypeptide 12 (CHL1-like helicase homolog, S. cerevisiae) (DDX12, Accession XM_006936). Accordingly, utilities of VGAM2537 include diagnosis, prevention and treatment of diseases and clinical conditions associated with DDX12. DEFCAP (Accession NM_014922) is another VGAM2537 host target gene. DEFCAP BINDING SITE is HOST TARGET binding site found in the 5' untranslated region of mRNA encoded by DEFCAP, corresponding to a HOST TARGET binding site such as BINDING SITE I, BINDING SITE II or BINDING SITE III. Table 2 illustrates the complementarity of the nucleotide sequences of DEFCAP BINDING SITE, designated SEQ ID:17201, to the nucleotide sequence of VGAM2537 RNA, herein designated VGAM RNA, also designated SEQ ID:5248.

Another function of VGAM2537 is therefore inhibition of DEFCAP (Accession NM_014922). Accordingly, utilities of VGAM2537 include diagnosis, prevention and treatment of diseases and clinical conditions associated with DEFCAP. Deiodinase, Iodothyronine, Type II (DIO2, Accession NM_013989) is another VGAM2537 host target gene. DIO2 BINDING SITE is HOST TARGET binding site found in the 5' untranslated region of mRNA encoded by DIO2, corresponding to a HOST TARGET binding site such as BINDING SITE I, BINDING SITE II or BINDING SITE III. Table 2 illustrates the complementarity of the nucleotide sequences of DIO2 BINDING SITE, designated SEQ ID:15167, to the nucleotide sequence of VGAM2537 RNA, herein designated VGAM RNA, also designated SEQ ID:5248.

Another function of VGAM2537 is therefore inhibition of Deiodinase, Iodothyronine, Type II (DIO2, Accession NM_013989). Accordingly, utilities of VGAM2537 include diagnosis, prevention and treatment of diseases and clinical conditions associated with DIO2. DKFZp434J0617 (Accession NM_032246) is another VGAM2537 host target gene. DKFZp434J0617 BINDING SITE is HOST TARGET binding site found in the 3' untranslated region of mRNA encoded by DKFZp434J0617, corresponding to a HOST TARGET binding site such as BINDING SITE I, BINDING SITE II or BINDING SITE III. Table 2 illustrates the complementarity of the nucleotide sequences of DKFZp434J0617 BINDING SITE, designated SEQ ID:25982, to the nucleotide sequence of VGAM2537 RNA, herein designated VGAM RNA, also designated SEQ ID:5248.

Another function of VGAM2537 is therefore inhibition of DKFZp434J0617 (Accession NM_032246). Accordingly, utilities of VGAM2537 include diagnosis, prevention and treatment of diseases and clinical conditions associated with DKFZp434J0617. DKFZP434N014 (Accession XM_027012) is another VGAM2537 host target gene. DKFZP434N014 BINDING SITE is HOST TARGET binding site found in the 3' untranslated region of mRNA encoded by DKFZP434N014, corresponding to a HOST TARGET binding site such as BINDING SITE I, BINDING SITE II or BINDING SITE III. Table 2 illustrates the complementarity of the nucleotide sequences of DKFZP434N014 BINDING SITE, designated SEQ ID:30389, to the nucleotide sequence of VGAM2537 RNA, herein designated VGAM RNA, also designated SEQ ID:5248.

Another function of VGAM2537 is therefore inhibition of DKFZP434N014 (Accession XM_027012). Accordingly, utilities of VGAM2537 include diagnosis, prevention and treatment of diseases and clinical conditions associated with DKFZP434N014. DKFZp434P0531 (Accession XM_166410) is another VGAM2537 host target gene. DKFZp434P0531 BINDING SITE is HOST TARGET binding site found in the 3' untranslated region of mRNA encoded by DKFZp434P0531, corresponding to a HOST TARGET binding site such as BINDING SITE I, BINDING SITE II or BINDING SITE III. Table 2 illustrates the complementarity of the nucleotide sequences of DKFZp434P0531 BINDING SITE, designated SEQ ID:44281, to the nucleotide sequence of VGAM2537 RNA, herein designated VGAM RNA, also designated SEQ ID:5248.

Another function of VGAM2537 is therefore inhibition of DKFZp434P0531 (Accession XM_166410). Accordingly, utilities of VGAM2537 include diagnosis, prevention and treatment of diseases and clinical conditions associated with DKFZp434P0531. DKFZP586N0721 (Accession NM_015400) is another VGAM2537 host target gene. DKFZP586N0721 BINDING SITE is HOST TARGET binding site found in the 5' untranslated region of mRNA encoded by DKFZP586N0721, corresponding to a HOST TARGET binding site such as BINDING SITE I, BINDING SITE II or BINDING SITE III. Table 2 illustrates the complementarity of the nucleotide sequences of DKFZP586N0721 BINDING SITE, designated SEQ ID:17708, to the nucleotide sequence of VGAM2537 RNA, herein designated VGAM RNA, also designated SEQ ID:5248.

Another function of VGAM2537 is therefore inhibition of DKFZP586N0721 (Accession NM_015400). Accordingly, utilities of VGAM2537 include diagnosis, prevention and treatment of diseases and clinical conditions associated with DKFZP586N0721. DKFZp761G2113 (Accession XM_046017) is another VGAM2537 host target gene. DKFZp761G2113 BINDING SITE is HOST TARGET binding site found in the 3' untranslated region of mRNA encoded by DKFZp761G2113, corresponding to a HOST TARGET binding site such as BINDING SITE I, BINDING SITE II or BINDING SITE III. Table 2 illustrates the complementarity of the nucleotide sequences of DKFZp761G2113 BINDING SITE, designated SEQ ID:34641, to the nucleotide sequence of VGAM2537 RNA, herein designated VGAM RNA, also designated SEQ ID:5248.

Another function of VGAM2537 is therefore inhibition of DKFZp761G2113 (Accession XM_046017). Accordingly, utilities of VGAM2537 include diagnosis, prevention and treatment of diseases and clinical conditions associated with DKFZp761G2113. EZF-2 (Accession NM_018337) is another VGAM2537 host target gene. EZF-2 BINDING SITE is HOST TARGET binding site found in the 3' untranslated region of mRNA encoded by EZF-2, corresponding to a HOST TARGET binding site such as BINDING SITE I, BINDING SITE II or BINDING SITE III. Table 2 illustrates the complementarity of the nucleotide sequences of EZF-2 BINDING SITE, designated SEQ ID:20340, to the nucleotide sequence of VGAM2537 RNA, herein designated VGAM RNA, also designated SEQ ID:5248.

Another function of VGAM2537 is therefore inhibition of EZF-2 (Accession NM_018337). Accordingly, utilities of VGAM2537 include diagnosis, prevention and treatment of diseases and clinical conditions associated with EZF-2. F-box Only Protein 27 (FBXO27, Accession XM_059045) is another VGAM2537 host target gene. FBXO27 BINDING SITE is HOST TARGET binding site found in the 3' untranslated region of mRNA encoded by FBXO27, corresponding to a HOST TARGET binding site such as BINDING SITE I, BINDING SITE II or BINDING SITE III. Table 2 illustrates the complementarity of the nucleotide sequences of FBXO27 BINDING SITE, designated SEQ ID:36834, to the nucleotide sequence of VGAM2537 RNA, herein designated VGAM RNA, also designated SEQ ID:5248.

Another function of VGAM2537 is therefore inhibition of F-box Only Protein 27 (FBXO27, Accession XM_059045). Accordingly, utilities of VGAM2537 include diagnosis, prevention and treatment of diseases and clinical conditions associated with FBXO27. FHX (Accession NM_018416) is another VGAM2537 host target gene. FHX BINDING SITE is HOST TARGET binding site found in the 5' untranslated region of mRNA encoded by FHX, corresponding to a HOST TARGET binding site such as BINDING SITE I, BINDING SITE II or BINDING SITE III. Table 2 illustrates the complementarity of the nucleotide sequences of FHX BINDING SITE, designated SEQ ID:20457, to the nucleotide sequence of VGAM2537 RNA, herein designated VGAM RNA, also designated SEQ ID:5248.

Another function of VGAM2537 is therefore inhibition of FHX (Accession NM_018416). Accordingly, utilities of VGAM2537 include diagnosis, prevention and treatment of diseases and clinical conditions associated with FHX. FLJ10074 (Accession NM_017988) is another VGAM2537 host target gene. FLJ10074 BINDING SITE is HOST TARGET binding site found in the 5' untranslated region of mRNA encoded by FLJ10074, corresponding to a HOST TARGET binding site such as BINDING SITE I, BINDING SITE II or BINDING SITE III. Table 2 illustrates the complementarity of the nucleotide sequences of FLJ10074 BINDING SITE, designated SEQ ID:19720, to the nucleotide sequence of VGAM2537 RNA, herein designated VGAM RNA, also designated SEQ ID:5248.

Another function of VGAM2537 is therefore inhibition of FLJ10074 (Accession NM_017988). Accordingly, utilities of VGAM2537 include diagnosis, prevention and treatment of diseases and clinical conditions associated with FLJ10074. FLJ10704 (Accession NM_018185) is another VGAM2537 host target gene. FLJ10704 BINDING SITE is HOST TARGET binding site found in the 3' untranslated region of mRNA encoded by FLJ10704, corresponding to a HOST TARGET binding site such as BINDING SITE I, BINDING SITE II or BINDING SITE III. Table 2 illustrates the complementarity of the nucleotide sequences of FLJ10704 BINDING SITE, designated SEQ ID:20032, to the nucleotide sequence of VGAM2537 RNA, herein designated VGAM RNA, also designated SEQ ID:5248.

Another function of VGAM2537 is therefore inhibition of FLJ10704 (Accession NM_018185). Accordingly, utilities of VGAM2537 include diagnosis, prevention and treatment of diseases and clinical conditions associated with FLJ10704. FLJ11286 (Accession NM_018381) is another VGAM2537 host target gene. FLJ11286 BINDING SITE is HOST TARGET binding site found in the 3' untranslated region of mRNA encoded by FLJ11286, corresponding to a HOST TARGET binding site such as BINDING SITE I, BINDING SITE II or BINDING SITE III. Table 2 illustrates the complementarity of the nucleotide sequences of FLJ11286 BINDING SITE, designated SEQ ID:20415, to the nucleotide sequence of VGAM2537 RNA, herein designated VGAM RNA, also designated SEQ ID:5248.

Another function of VGAM2537 is therefore inhibition of FLJ11286 (Accession NM_018381). Accordingly, utilities of VGAM2537 include diagnosis, prevention and treatment of diseases and clinical conditions associated with FLJ11286. FLJ11939 (Accession NM_024679) is another VGAM2537 host target gene. FLJ11939 BINDING SITE is HOST TARGET binding site found in the 3' untranslated region of mRNA encoded by FLJ11939, corresponding to a HOST TARGET binding site such as BINDING SITE I, BINDING SITE II or BINDING SITE III. Table 2 illustrates the complementarity of the nucleotide sequences of FLJ11939 BINDING SITE, designated SEQ ID:23991, to the nucleotide sequence of VGAM2537 RNA, herein designated VGAM RNA, also designated SEQ ID:5248.

Another function of VGAM2537 is therefore inhibition of FLJ11939 (Accession NM_024679). Accordingly, utilities of VGAM2537 include diagnosis, prevention and treatment of diseases and clinical conditions associated with FLJ11939. FLJ12541 (Accession NM_022369) is another VGAM2537 host target gene. FLJ12541 BINDING SITE is HOST TARGET binding site found in the 3' untranslated region of mRNA encoded by FLJ12541, corresponding to a HOST TARGET binding site such as BINDING SITE I, BINDING SITE II or BINDING SITE III. Table 2 illustrates the complementarity of the nucleotide sequences of FLJ12541 BINDING SITE, designated SEQ ID:22757, to the nucleotide sequence of VGAM2537 RNA, herein designated VGAM RNA, also designated SEQ ID:5248.

Another function of VGAM2537 is therefore inhibition of FLJ12541 (Accession NM_022369). Accordingly, utilities of VGAM2537 include diagnosis, prevention and treatment of diseases and clinical conditions associated with FLJ12541. FLJ12816 (Accession NM_022060) is another VGAM2537 host target gene. FLJ12816 BINDING SITE is HOST TARGET binding site found in the 3' untranslated region of mRNA encoded by FLJ12816, corresponding to a HOST TARGET binding site such as BINDING SITE I, BINDING SITE II or BINDING SITE III. Table 2 illustrates the complementarity of the nucleotide sequences of FLJ12816 BIND- ING SITE, designated SEQ ID:22603, to the nucleotide sequence of VGAM2537 RNA, herein designated VGAM RNA, also designated SEQ ID:5248.

Another function of VGAM2537 is therefore inhibition of FLJ12816 (Accession NM_022060). Accordingly, utilities of VGAM2537 include diagnosis, prevention and treatment of diseases and clinical conditions associated with FLJ12816. FLJ12921 (Accession NM_024875) is another VGAM2537 host target gene. FLJ12921 BINDING SITE is HOST TARGET binding site found in the 3' untranslated region of mRNA encoded by FLJ12921, corresponding to a HOST TARGET binding site such as BINDING SITE I, BINDING SITE II or BINDING SITE III. Table 2 illustrates the complementarity of the nucleotide sequences of FLJ12921 BINDING SITE, designated SEQ ID:24309, to the nucleotide sequence of VGAM2537 RNA, herein designated VGAM RNA, also designated SEQ ID:5248.

Another function of VGAM2537 is therefore inhibition of FLJ12921 (Accession NM_024875). Accordingly, utilities of VGAM2537 include diagnosis, prevention and treatment of diseases and clinical conditions associated with FLJ12921. FLJ14721 (Accession NM_032829) is another VGAM2537 host target gene. FLJ14721 BINDING SITE is HOST TARGET binding site found in the 3' untranslated region of mRNA encoded by FLJ14721, corresponding to a HOST TARGET binding site such as BINDING SITE I, BINDING SITE II or BINDING SITE III. Table 2 illustrates the complementarity of the nucleotide sequences of FLJ14721 BINDING SITE, designated SEQ ID:26604, to the nucleotide sequence of VGAM2537 RNA, herein designated VGAM RNA, also designated SEQ ID:5248.

Another function of VGAM2537 is therefore inhibition of FLJ14721 (Accession NM_032829). Accordingly, utilities of VGAM2537 include diagnosis, prevention and treatment of diseases and clinical conditions associated with FLJ14721. FLJ14950 (Accession NM_032865) is another VGAM2537 host target gene. FLJ14950 BINDING SITE is HOST TARGET binding site found in the 3' untranslated region of mRNA encoded by FLJ14950, corresponding to a HOST TARGET binding site such as BINDING SITE I, BINDING SITE II or BINDING SITE III. Table 2 illustrates the complementarity of the nucleotide sequences of FLJ14950 BINDING SITE, designated SEQ ID:26671, to the nucleotide sequence of VGAM2537 RNA, herein designated VGAM RNA, also designated SEQ ID:5248.

Another function of VGAM2537 is therefore inhibition of FLJ14950 (Accession NM_032865). Accordingly, utilities of VGAM2537 include diagnosis, prevention and treatment of diseases and clinical conditions associated with FLJ14950. FLJ22596 (Accession NM_025086) is another VGAM2537 host target gene. FLJ22596 BINDING SITE is HOST TARGET binding site found in the 5' untranslated region of mRNA encoded by FLJ22596, corresponding to a HOST TARGET binding site such as BINDING SITE I, BINDING SITE II or BINDING SITE III. Table 2 illustrates the complementarity of the nucleotide sequences of FLJ22596 BINDING SITE, designated SEQ ID:24703, to the nucleotide sequence of VGAM2537 RNA, herein designated VGAM RNA, also designated SEQ ID:5248.

Another function of VGAM2537 is therefore inhibition of FLJ22596 (Accession NM_025086). Accordingly, utilities of VGAM2537 include diagnosis, prevention and treatment of diseases and clinical conditions associated with FLJ22596. FLJ23537 (Accession NM_024889) is another VGAM2537 host target gene. FLJ23537 BINDING SITE1 through FLJ23537 BINDING SITE16 are HOST TARGET binding sites found in untranslated regions of mRNA encoded by FLJ23537, corresponding to HOST TARGET binding sites such as BINDING SITE I, BINDING SITE II or BINDING SITE III. Table 2 illustrates the complementarity of the nucleotide sequences of FLJ23537 BINDING SITE1 through FLJ23537 BINDING SITE16, designated SEQ ID:24362, SEQ ID:24359, SEQ ID:24360, SEQ ID:24361, SEQ ID:24347, SEQ ID:24348, SEQ ID:24349, SEQ ID:24350, SEQ ID:24351, SEQ ID:24352, SEQ ID:24353, SEQ ID:24354, SEQ ID:24355, SEQ ID:24356, SEQ ID:24357 and SEQ ID:24358 respectively, to the nucleotide sequence of VGAM2537 RNA, herein designated VGAM RNA, also designated SEQ ID:5248.

Another function of VGAM2537 is therefore inhibition of FLJ23537 (Accession NM_024889). Accordingly, utilities of VGAM2537 include diagnosis, prevention and treatment of diseases and clinical conditions associated with FLJ23537. FLJ32658 (Accession NM_144688) is another VGAM2537 host target gene. FLJ32658 BINDING SITE is HOST TARGET binding site found in the 5' untranslated region of mRNA encoded by FLJ32658, corresponding to a HOST TARGET binding site such as BINDING SITE I, BINDING SITE II or BINDING SITE III. Table 2 illustrates the complementarity of the nucleotide sequences of FLJ32658 BINDING SITE, designated SEQ ID:29508, to the nucleotide sequence of VGAM2537 RNA, herein designated VGAM RNA, also designated SEQ ID:5248.

Another function of VGAM2537 is therefore inhibition of FLJ32658 (Accession NM_144688). Accordingly, utilities of VGAM2537 include diagnosis, prevention and treatment of diseases and clinical conditions associated with FLJ32658. Guanine Nucleotide Binding Protein (G protein), Gamma 3 (GNG3, Accession NM_012202) is another VGAM2537 host target gene. GNG3 BINDING SITE is HOST TARGET binding site found in the 5' untranslated region of mRNA encoded by GNG3, corresponding to a HOST TARGET binding site such as BINDING SITE I, BINDING SITE II or BINDING SITE III. Table 2 illustrates the complementarity of the nucleotide sequences of GNG3 BINDING SITE, designated SEQ ID:14508, to the nucleotide sequence of VGAM2537 RNA, herein designated VGAM RNA, also designated SEQ ID:5248.

Another function of VGAM2537 is therefore inhibition of Guanine Nucleotide Binding Protein (G protein), Gamma 3 (GNG3, Accession NM_012202). Accordingly, utilities of VGAM2537 include diagnosis, prevention and treatment of diseases and clinical conditions associated with GNG3. Glycoprotein A33 (transmembrane) (GPA33, Accession NM_005814) is another VGAM2537 host target gene. GPA33 BINDING SITE is HOST TARGET binding site found in the 3' untranslated region of mRNA encoded by GPA33, corresponding to a HOST TARGET binding site such as BINDING SITE I, BINDING SITE II or BINDING SITE III. Table 2 illustrates the complementarity of the nucleotide sequences of GPA33 BINDING SITE, designated SEQ ID:12403, to the nucleotide sequence of VGAM2537 RNA, herein designated VGAM RNA, also designated SEQ ID:5248.

Another function of VGAM2537 is therefore inhibition of Glycoprotein A33 (transmembrane) (GPA33, Accession NM_005814). Accordingly, utilities of VGAM2537 include diagnosis, prevention and treatment of diseases and clinical conditions associated with GPA33. GR6 (Accession NM_007354) is another VGAM2537 host target gene. GR6 BINDING SITE is HOST TARGET binding site found in the 3' untranslated region of mRNA encoded by GR6, corresponding to a HOST TARGET binding site such as BINDING SITE I, BINDING SITE II or BINDING SITE III. Table 2 illustrates the complementarity of the nucleotide sequences of GR6 BINDING SITE, designated SEQ ID:14281, to the nucleotide sequence of VGAM2537 RNA, herein designated VGAM RNA, also designated SEQ ID:5248.

Another function of VGAM2537 is therefore inhibition of GR6 (Accession NM_007354). Accordingly, utilities of VGAM2537 include diagnosis, prevention and treatment of diseases and clinical conditions associated with GR6. GTPBG3 (Accession NM_032620) is another VGAM2537 host target gene. GTPBG3 BINDING SITE is HOST TARGET binding site found in the 3' untranslated region of mRNA encoded by GTPBG3, corresponding to a HOST TARGET binding site such as BINDING SITE I, BINDING SITE II or BINDING SITE III. Table 2 illustrates the complementarity of the nucleotide sequences of GTPBG3 BINDING SITE, designated SEQ ID:26333, to the nucleotide sequence of VGAM2537 RNA, herein designated VGAM RNA, also designated SEQ ID:5248.

Another function of VGAM2537 is therefore inhibition of GTPBG3 (Accession NM_032620). Accordingly, utilities of VGAM2537 include diagnosis, prevention and treatment of diseases and clinical conditions associated with GTPBG3. Hypermethylated In Cancer 2 (HIC2, Accession XM_036937) is another VGAM2537 host target gene. HIC2 BINDING SITE is HOST TARGET binding site found in the 3' untranslated region of mRNA encoded by HIC2, corresponding to a HOST TARGET binding site such as BINDING SITE I, BINDING SITE II or BINDING SITE III. Table 2 illustrates the complementarity of the nucleotide sequences of HIC2 BINDING SITE, designated SEQ ID:32526, to the nucleotide sequence of VGAM2537 RNA, herein designated VGAM RNA, also designated SEQ ID:5248.

Another function of VGAM2537 is therefore inhibition of Hypermethylated In Cancer 2 (HIC2, Accession XM_036937). Accordingly, utilities of VGAM2537 include diagnosis, prevention and treatment of diseases and clinical conditions associated with HIC2. HMT1 HnRNP Methyltransferase-like 3 (S. cerevisiae) (HRMT1L3, Accession NM_019854) is another VGAM2537 host target gene. HRMT1L3 BINDING SITE is HOST TARGET binding site found in the 3' untranslated region of mRNA encoded by HRMT1L3, corresponding to a HOST TARGET binding site such as BINDING SITE I, BINDING SITE II or BINDING SITE III. Table 2 illustrates the complementarity of the nucleotide sequences of HRMT1L3 BINDING SITE, designated SEQ ID:21258, to the nucleotide sequence of VGAM2537 RNA, herein designated VGAM RNA, also designated SEQ ID:5248.

Another function of VGAM2537 is therefore inhibition of HMT1 HnRNP Methyltransferase-like 3 (S. cerevisiae) (HRMT1L3, Accession NM_019854). Accordingly, utilities of VGAM2537 include diagnosis, prevention and treatment of diseases and clinical conditions associated with HRMT1L3. HTMP10 (Accession NM_033207) is another VGAM2537 host target gene. HTMP10 BINDING SITE is HOST TARGET binding site found in the 3' untranslated region of mRNA encoded by HTMP10, corresponding to a HOST TARGET binding site such as BINDING SITE I, BINDING SITE II or BINDING SITE III. Table 2 illustrates the complementarity of the nucleotide sequences of HTMP10 BINDING SITE, designated SEQ ID:27048, to the nucleotide sequence of VGAM2537 RNA, herein designated VGAM RNA, also designated SEQ ID:5248.

Another function of VGAM2537 is therefore inhibition of HTMP10 (Accession NM_033207). Accordingly, utilities of VGAM2537 include diagnosis, prevention and treatment of diseases and clinical conditions associated with HTMP10. IMP-2 (Accession NM_006548) is another VGAM2537 host target gene. IMP-2 BINDING SITE is HOST TARGET binding site found in the 3' untranslated region of mRNA encoded by IMP-2, corresponding to a HOST TARGET binding site such as BINDING SITE I, BINDING SITE II or BINDING SITE III. Table 2 illustrates the complementarity of the nucleotide sequences of IMP-2 BINDING SITE, designated SEQ ID:13304, to the nucleotide sequence of VGAM2537 RNA, herein designated VGAM RNA, also designated SEQ ID:5248.

Another function of VGAM2537 is therefore inhibition of IMP-2 (Accession NM_006548). Accordingly, utilities of VGAM2537 include diagnosis, prevention and treatment of diseases and clinical conditions associated with IMP-2. KALI (Accession NM_052931) is another VGAM2537 host target gene. KALI BINDING SITE is HOST TARGET binding site found in the 3' untranslated region of mRNA encoded by KALI, corresponding to a HOST TARGET binding site such as BINDING SITE I, BINDING SITE II or BINDING SITE III. Table 2 illustrates the complementarity of the nucleotide sequences of KALI BINDING SITE, designated SEQ ID:27488, to the nucleotide sequence of VGAM2537 RNA, herein designated VGAM RNA, also designated SEQ ID:5248.

Another function of VGAM2537 is therefore inhibition of KALI (Accession NM_052931). Accordingly, utilities of VGAM2537 include diagnosis, prevention and treatment of diseases and clinical conditions associated with KALI. KIAA0121 (Accession XM_052386) is another VGAM2537 host target gene. KIAA0121 BINDING SITE is HOST TARGET binding site found in the 5" untranslated region of mRNA encoded by KIAA0121, corresponding to a HOST TARGET binding site such as BINDING SITE I, BINDING SITE II or BINDING SITE III. Table 2 illustrates the complementarity of the nucleotide sequences of KIAA0121 BINDING SITE, designated SEQ ID:35968, to the nucleotide sequence of VGAM2537 RNA, herein designated VGAM RNA, also designated SEQ ID:5248.

Another function of VGAM2537 is therefore inhibition of KIAA0121 (Accession XM_052386). Accordingly, utilities of VGAM2537 include diagnosis, prevention and treatment of diseases and clinical conditions associated with KIAA0121. KIAA0205 (Accession NM_014873) is another VGAM2537 host target gene. KIAA0205 BINDING SITE is HOST TARGET binding site found in the 3' untranslated region of mRNA encoded by KIAA0205, corresponding to a HOST TARGET binding site such as BINDING SITE I, BINDING SITE II or BINDING SITE III. Table 2 illustrates the complementarity of the nucleotide sequences of KIAA0205 BINDING SITE, designated SEQ ID:17006, to the nucleotide sequence of VGAM2537 RNA, herein designated VGAM RNA, also designated SEQ ID:5248.

Another function of VGAM2537 is therefore inhibition of KIAA0205 (Accession NM_014873). Accordingly, utilities of VGAM2537 include diagnosis, prevention and treatment of diseases and clinical conditions associated with KIAA0205. KIAA0227 (Accession XM_027236) is another VGAM2537 host target gene. KIAA0227 BINDING SITE is HOST TARGET binding site found in the 3' untranslated region of mRNA encoded by KIAA0227, corresponding to a HOST TARGET binding site such as BINDING SITE I, BINDING SITE II or BINDING SITE III. Table 2 illustrates the complementarity of the nucleotide sequences of KIAA0227 BINDING SITE, designated SEQ ID:30452, to the nucleotide sequence of VGAM2537 RNA, herein designated VGAM RNA, also designated SEQ ID:5248.

Another function of VGAM2537 is therefore inhibition of KIAA0227 (Accession XM_027236). Accordingly, utilities of VGAM2537 include diagnosis, prevention and treatment of diseases and clinical conditions associated with KIAA0227. KIAA0350 (Accession XM_028332) is another VGAM2537 host target gene. KIAA0350 BINDING SITE is HOST TARGET binding site found in the 3' untranslated region of mRNA encoded by KIAA0350, corresponding to a HOST TARGET binding site such as BINDING SITE I, BINDING SITE II or BINDING SITE III. Table 2 illustrates the complementarity of the nucleotide sequences of KIAA0350 BINDING SITE, designated SEQ ID:30666, to the nucleotide sequence of VGAM2537 RNA, herein designated VGAM RNA, also designated SEQ ID:5248.

Another function of VGAM2537 is therefore inhibition of KIAA0350 (Accession XM_028332). Accordingly, utilities of VGAM2537 include diagnosis, prevention and treatment of diseases and clinical conditions associated with KIAA0350. KIAA0451 (Accession NM_014826) is another VGAM2537 host target gene. KIAA0451 BINDING SITE is HOST TARGET binding site found in the 3' untranslated region of mRNA encoded by KIAA0451, corresponding to a HOST TARGET binding site such as BINDING SITE I, BINDING SITE II or BINDING SITE III. Table 2 illustrates the complementarity of the nucleotide sequences of KIAA0451 BINDING SITE, designated SEQ ID:16804, to the nucleotide sequence of VGAM2537 RNA, herein designated VGAM RNA, also designated SEQ ID:5248.

Another function of VGAM2537 is therefore inhibition of KIAA0451 (Accession NM_014826). Accordingly, utilities of VGAM2537 include diagnosis, prevention and treatment of diseases and clinical conditions associated with KIAA0451. KIAA0461 (Accession XM_047883) is another VGAM2537 host target gene. KIAA0461 BINDING SITE is HOST TARGET binding site found in the 3' untranslated region of mRNA encoded by KIAA0461, corresponding to a HOST TARGET binding site such as BINDING SITE I, BINDING SITE II or BINDING SITE III. Table 2 illustrates the complementarity of the nucleotide sequences of KIAA0461 BINDING SITE, designated SEQ ID:35074, to the nucleotide sequence of VGAM2537 RNA, herein designated VGAM RNA, also designated SEQ ID:5248.

Another function of VGAM2537 is therefore inhibition of KIAA0461 (Accession XM_047883). Accordingly, utilities of VGAM2537 include diagnosis, prevention and treatment of diseases and clinical conditions associated with KIAA0461. KIAA0731 (Accession XM_039975) is another VGAM2537 host target gene. KIAA0731 BINDING SITE is HOST TARGET binding site found in the 3' untranslated region of mRNA encoded by KIAA0731, corresponding to a HOST TARGET binding site such as BINDING SITE I, BINDING SITE II or BINDING SITE III. Table 2 illustrates the complementarity of the nucleotide sequences of KIAA0731 BINDING SITE, designated SEQ ID:33240, to the nucleotide sequence of VGAM2537 RNA, herein designated VGAM RNA, also designated SEQ ID:5248.

Another function of VGAM2537 is therefore inhibition of KIAA0731 (Accession XM_039975). Accordingly, utilities of VGAM2537 include diagnosis, prevention and treatment of diseases and clinical conditions associated with KIAA0731. KIAA0872 (Accession NM_014940) is another VGAM2537 host target gene. KIAA0872 BINDING SITE is HOST TARGET binding site found in the 3' untranslated region of mRNA encoded by KIAA0872, corresponding to a HOST TARGET binding site such as BINDING SITE I, BINDING SITE II or BINDING SITE III. Table 2 illustrates the complementarity of the nucleotide sequences of KIAA0872 BINDING SITE, designated SEQ ID:17244, to the nucleotide sequence of VGAM2537 RNA, herein designated VGAM RNA, also designated SEQ ID:5248.

Another function of VGAM2537 is therefore inhibition of KIAA0872 (Accession NM_014940). Accordingly, utilities of VGAM2537 include diagnosis, prevention and treatment of diseases and clinical conditions associated with KIAA0872. KIAA1030 (Accession XM_167789) is another VGAM2537 host target gene. KIAA1030 BINDING SITE1 and KIAA1030 BINDING SITE2 are HOST TARGET binding sites found in untranslated regions of mRNA encoded by KIAA1030, corresponding to HOST TARGET binding sites such as BINDING SITE I, BINDING SITE II or BINDING SITE III. Table 2 illustrates the complementarity of the nucleotide sequences of KIAA1030 BINDING SITE1 and KIAA1030 BINDING SITE2, designated SEQ ID:44820 and SEQ ID:44821 respectively, to the nucleotide sequence of VGAM2537 RNA, herein designated VGAM RNA, also designated SEQ ID:5248.

Another function of VGAM2537 is therefore inhibition of KIAA1030 (Accession XM_167789). Accordingly, utilities of VGAM2537 include diagnosis, prevention and treatment of diseases and clinical conditions associated with KIAA1030. KIAA1205 (Accession XM_046305) is another VGAM2537 host target gene. KIAA1205 BINDING SITE is HOST TARGET binding site found in the 3' untranslated region of mRNA encoded by KIAA1205, corresponding to a HOST TARGET binding site such as BINDING SITE I, BINDING SITE II or BINDING SITE III. Table 2 illustrates the complementarity of the nucleotide sequences of KIAA1205 BINDING SITE, designated SEQ ID:34706, to the nucleotide sequence of VGAM2537 RNA, herein designated VGAM RNA, also designated SEQ ID:5248.

Another function of VGAM2537 is therefore inhibition of KIAA1205 (Accession XM_046305). Accordingly, utilities of VGAM2537 include diagnosis, prevention and treatment of diseases and clinical conditions associated with KIAA1205. KIAA1465 (Accession XM_027396) is another VGAM2537 host target gene. KIAA1465 BINDING SITE is HOST TARGET binding site found in the 3' untranslated region of mRNA encoded by KIAA1465, corresponding to a HOST TARGET binding site such as BINDING SITE I, BINDING SITE II or BINDING SITE III. Table 2 illustrates the complementarity of the nucleotide sequences of KIAA1465 BINDING SITE, designated SEQ ID:30501, to the nucleotide sequence of VGAM2537 RNA, herein designated VGAM RNA, also designated SEQ ID:5248.

Another function of VGAM2537 is therefore inhibition of KIAA1465 (Accession XM_027396). Accordingly, utilities of VGAM2537 include diagnosis, prevention and treatment of diseases and clinical conditions associated with KIAA1465. KIAA1538 (Accession XM_049474) is another VGAM2537 host target gene. KIAA1538 BINDING SITE is HOST TARGET binding site found in the 3' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35423, to the nucleotide sequence of VGAM2537 RNA, herein designated VGAM RNA, also designated SEQ ID:5248.

Another function of VGAM2537 is therefore inhibition of KIAA1538 (Accession XM_049474). Accordingly, utilities of VGAM2537 include diagnosis, prevention and treatment of diseases and clinical conditions associated with KIAA1538. KIAA1750 (Accession XM_043067) is another VGAM2537 host target gene. KIAA1750 BINDING SITE is HOST TARGET binding site found in the 3' untranslated region of mRNA encoded by KIAA1750, corresponding to a HOST TARGET binding site such as BINDING SITE I, BINDING SITE II or BINDING SITE III. Table 2 illustrates the complementarity of the nucleotide sequences of KIAA1750 BINDING SITE, designated SEQ ID:33875, to the nucleotide sequence of VGAM2537 RNA, herein designated VGAM RNA, also designated SEQ ID:5248.

Another function of VGAM2537 is therefore inhibition of KIAA1750 (Accession XM_043067). Accordingly, utilities of VGAM2537 include diagnosis, prevention and treatment of diseases and clinical conditions associated with KIAA1750. KIAA1817 (Accession XM_042978) is another VGAM2537 host target gene. KIAA1817 BINDING SITE is HOST TARGET binding site found in the 3' untranslated region of mRNA encoded by KIAA1817, corresponding to a HOST TARGET binding site such as BINDING SITE I, BINDING SITE II or BINDING SITE III. Table 2 illustrates the complementarity of the nucleotide sequences of KIAA1817 BINDING SITE, designated SEQ ID:33862, to the nucleotide sequence of VGAM2537 RNA, herein designated VGAM RNA, also designated SEQ ID:5248.

Another function of VGAM2537 is therefore inhibition of KIAA1817 (Accession XM_042978). Accordingly, utilities of VGAM2537 include diagnosis, prevention and treatment of diseases and clinical conditions associated with KIAA1817. KIAA1819 (Accession XM_045716) is another VGAM2537 host target gene. KIAA1819 BINDING SITE is HOST TARGET binding site found in the 5' untranslated region of mRNA encoded by KIAA1819, corresponding to a HOST TARGET binding site such as BINDING SITE I, BINDING SITE II or BINDING SITE III. Table 2 illustrates the complementarity of the nucleotide sequences of KIAA1819 BINDING SITE, designated SEQ ID:34533, to the nucleotide sequence of VGAM2537 RNA, herein designated VGAM RNA, also designated SEQ ID:5248.

Another function of VGAM2537 is therefore inhibition of KIAA1819 (Accession XM_045716). Accordingly, utilities of VGAM2537 include diagnosis, prevention and treatment of diseases and clinical conditions associated with KIAA1819. KIAA1853 (Accession XM_045184) is another VGAM2537 host target gene. KIAA1853 BINDING SITE1 and KIAA1853 BINDING SITE2 are HOST TARGET binding sites found in untranslated regions of mRNA encoded by KIAA1853, corresponding to HOST TARGET binding sites such as BINDING SITE I, BINDING SITE II or BINDING SITE III. Table 2 illustrates the complementarity of the nucleotide sequences of KIAA1853 BINDING SITE1 and KIAA1853 BINDING SITE2, designated SEQ ID:34387 and SEQ ID:34386 respectively, to the nucleotide sequence of VGAM2537 RNA, herein designated VGAM RNA, also designated SEQ ID:5248.

Another function of VGAM2537 is therefore inhibition of KIAA1853 (Accession XM_045184). Accordingly, utilities of VGAM2537 include diagnosis, prevention and treatment of diseases and clinical conditions associated with KIAA1853. KIAA1855 (Accession XM_166453) is another VGAM2537 host target gene. KIAA1855 BINDING SITE1 and KIAA1855 BINDING SITE2 are HOST TARGET binding sites found in untranslated regions of mRNA encoded by KIAA1855, corresponding to HOST TARGET binding sites such as BINDING SITE I, BINDING SITE II or BINDING SITE III. Table 2 illustrates the complementarity of the nucleotide sequences of KIAA1855 BINDING SITE1 and KIAA1855 BINDING SITE2, designated SEQ ID:44355 and SEQ ID:25863 respectively, to the nucleotide sequence of VGAM2537 RNA, herein designated VGAM RNA, also designated SEQ ID:5248.

Another function of VGAM2537 is therefore inhibition of KIAA1855 (Accession XM_166453). Accordingly, utilities of VGAM2537 include diagnosis, prevention and treatment of diseases and clinical conditions associated with KIAA1855. KIAA1938 (Accession XM_166407) is another VGAM2537 host target gene. KIAA1938 BINDING SITE is HOST TARGET binding site found in the 3' untranslated region of mRNA encoded by KIAA1938, corresponding to a HOST TARGET binding site such as BINDING SITE I, BINDING SITE II or BINDING SITE III. Table 2 illustrates the complementarity of the nucleotide sequences of KIAA1938 BINDING SITE, designated SEQ ID:44276, to the nucleotide sequence of VGAM2537 RNA, herein designated VGAM RNA, also designated SEQ ID:5248.

Another function of VGAM2537 is therefore inhibition of KIAA1938 (Accession XM_166407). Accordingly, utilities of VGAM2537 include diagnosis, prevention and treatment of diseases and clinical conditions associated with KIAA1938. Mab-21-like 2 (C. elegans) (MAB21L2, Accession NM_006439) is another VGAM2537 host target gene. MAB21L2 BINDING SITE is HOST TARGET binding site found in the 3' untranslated region of mRNA encoded by MAB21L2, corresponding to a HOST TARGET binding site such as BINDING SITE I, BINDING SITE II or BINDING SITE III. Table 2 illustrates the complementarity of the nucleotide sequences of MAB21L2 BINDING SITE, designated SEQ ID:13150, to the nucleotide sequence of VGAM2537 RNA, herein designated VGAM RNA, also designated SEQ ID:5248.

Another function of VGAM2537 is therefore inhibition of Mab-21-like 2 (C. elegans) (MAB21L2, Accession NM_006439). Accordingly, utilities of VGAM2537 include diagnosis, prevention and treatment of diseases and clinical conditions associated with MAB21L2. METL (Accession NM_018396) is another VGAM2537 host target gene. METL BINDING SITE is HOST TARGET binding site found in the 3' untranslated region of mRNA encoded by METL, corresponding to a HOST TARGET binding site such as BINDING SITE I, BINDING SITE II or BINDING SITE III. Table 2 illustrates the complementarity of the nucleotide sequences of METL BINDING SITE, designated SEQ ID:20433, to the nucleotide sequence of VGAM2537 RNA, herein designated VGAM RNA, also designated SEQ ID:5248.

Another function of VGAM2537 is therefore inhibition of METL (Accession NM_018396). Accordingly, utilities of VGAM2537 include diagnosis, prevention and treatment of diseases and clinical conditions associated with METL. MGC2714 (Accession NM_032299) is another VGAM2537 host target gene. MGC2714 BINDING SITE is HOST TARGET binding site found in the 5" untranslated region of mRNA encoded by MGC2714, corresponding to a HOST TARGET binding site such as BINDING SITE I, BINDING SITE II or BINDING SITE III. Table 2 illustrates the complementarity of the nucleotide sequences of MGC2714 BINDING SITE, designated SEQ ID:26079, to the nucleotide sequence of VGAM2537 RNA, herein designated VGAM RNA, also designated SEQ ID:5248.

Another function of VGAM2537 is therefore inhibition of MGC2714 (Accession NM_032299). Accordingly, utilities of VGAM2537 include diagnosis, prevention and treatment of diseases and clinical conditions associated with MGC2714. MGC4737 (Accession NM_031466) is another VGAM2537 host target gene. MGC4737 BINDING SITE is HOST TARGET binding site found in the 3' untranslated region of mRNA encoded by MGC4737, corresponding to a HOST TARGET binding site such as BINDING SITE I, BINDING SITE II or BINDING SITE III. Table 2 illustrates the complementarity of the nucleotide sequences of MGC4737 BINDING SITE, designated SEQ ID:25506, to the nucleotide sequence of VGAM2537 RNA, herein designated VGAM RNA, also designated SEQ ID:5248.

Another function of VGAM2537 is therefore inhibition of MGC4737 (Accession NM_031466). Accordingly, utilities of VGAM2537 include diagnosis, prevention and treatment of diseases and clinical conditions associated with MGC4737. MGC4796 (Accession XM_029031) is another VGAM2537 host target gene. MGC4796 BINDING SITE is HOST TARGET binding site found in the 3' untranslated region of mRNA encoded by MGC4796, corresponding to a HOST TARGET binding site such as BINDING SITE I, BINDING SITE II or BINDING SITE III. Table 2 illustrates the complementarity of the nucleotide sequences of MGC4796 BINDING SITE, designated SEQ ID:30830, to the nucleotide sequence of VGAM2537 RNA, herein designated VGAM RNA, also designated SEQ ID:5248.

Another function of VGAM2537 is therefore inhibition of MGC4796 (Accession XM_029031). Accordingly, utilities of VGAM2537 include diagnosis, prevention and treatment of diseases and clinical conditions associated with MGC4796. moblak (Accession NM_130807) is another VGAM2537 host target gene. moblak BINDING SITE is HOST TARGET binding site found in the 3' untranslated region of mRNA encoded by moblak, corresponding to a HOST TARGET binding site such as BINDING SITE I, BINDING SITE II or BINDING SITE III. Table 2 illustrates the complementarity of the nucleotide sequences of moblak BINDING SITE, designated SEQ ID:28307, to the nucleotide sequence of VGAM2537 RNA, herein designated VGAM RNA, also designated SEQ ID:5248.

Another function of VGAM2537 is therefore inhibition of moblak (Accession NM_130807). Accordingly, utilities of VGAM2537 include diagnosis, prevention and treatment of diseases and clinical conditions associated with moblak. N4BP3 (Accession XM_038920) is another VGAM2537 host target gene. N4BP3 BINDING SITE is HOST TARGET binding site found in the 3' untranslated region of mRNA encoded by N4BP3, corresponding to a HOST TARGET binding site such as BINDING SITE I, BINDING SITE II or BINDING SITE III. Table 2 illustrates the complementarity of the nucleotide sequences of N4BP3 BINDING SITE, designated SEQ ID:32935, to the nucleotide sequence of VGAM2537 RNA, herein designated VGAM RNA, also designated SEQ ID:5248.

Another function of VGAM2537 is therefore inhibition of N4BP3 (Accession XM_038920). Accordingly, utilities of VGAM2537 include diagnosis, prevention and treatment of diseases and clinical conditions associated with N4BP3. NDST4 (Accession NM_022569) is another VGAM2537 host target gene. NDST4 BINDING SITE is HOST TARGET binding site found in the 5' untranslated region of mRNA encoded by NDST4, corresponding to a HOST TARGET binding site such as BINDING SITE I, BINDING SITE II or BINDING SITE III. Table 2 illustrates the complementarity of the nucleotide sequences of NDST4 BINDING SITE, designated SEQ ID:22891, to the nucleotide sequence of VGAM2537 RNA, herein designated VGAM RNA, also designated SEQ ID:5248.

Another function of VGAM2537 is therefore inhibition of NDST4 (Accession NM_022569). Accordingly, utilities of VGAM2537 include diagnosis, prevention and treatment of diseases and clinical conditions associated with NDST4. Neurexophilin 3 (NXPH3, Accession XM_037847) is another VGAM2537 host target gene. NXPH3 BINDING SITE is HOST TARGET binding site found in the 3' untranslated region of mRNA encoded by NXPH3, corresponding to a HOST TARGET binding site such as BINDING SITE I, BINDING SITE II or BINDING SITE III. Table 2 illustrates the complementarity of the nucleotide sequences of NXPH3 BINDING SITE, designated SEQ ID:32718, to the nucleotide sequence of VGAM2537 RNA, herein designated VGAM RNA, also designated SEQ ID:5248.

Another function of VGAM2537 is therefore inhibition of Neurexophilin 3 (NXPH3, Accession XM_037847). Accordingly, utilities of VGAM2537 include diagnosis, prevention and treatment of diseases and clinical conditions associated with NXPH3. P450RAI-2 (Accession NM_019885) is another VGAM2537 host target gene. P450RAI-2 BINDING SITE is HOST TARGET binding site found in the 3' untranslated region of mRNA encoded by P450RAI-2, corresponding to a HOST TARGET binding site such as BINDING SITE I, BINDING SITE II or BINDING SITE III. Table 2 illustrates the complementarity of the nucleotide sequences of P450RAI-2 BINDING SITE, designated SEQ ID:21268, to the nucleotide sequence of VGAM2537 RNA, herein designated VGAM RNA, also designated SEQ ID:5248.

Another function of VGAM2537 is therefore inhibition of P450RAI-2 (Accession NM_019885). Accordingly, utilities of VGAM2537 include diagnosis, prevention and treatment of diseases and clinical conditions associated with P450RAI-2. Protein Phosphatase 1, Regulatory Subunit 10 (PPP1R10, Accession NM_002714) is another VGAM2537 host target gene. PPP1R10 BINDING SITE is HOST TARGET binding site found in the 3' untranslated region of mRNA encoded by PPP1R10, corresponding to a HOST TARGET binding site such as BINDING SITE I, BINDING SITE II or BINDING SITE III. Table 2 illustrates the complementarity of the nucleotide sequences of PPP1R10 BINDING SITE, designated SEQ ID:8575, to the nucleotide sequence of VGAM2537 RNA, herein designated VGAM RNA, also designated SEQ ID:5248.

Another function of VGAM2537 is therefore inhibition of Protein Phosphatase 1, Regulatory Subunit 10 (PPP1R10, Accession NM_002714). Accordingly, utilities of VGAM2537 include diagnosis, prevention and treatment of diseases and clinical conditions associated with PPP1R10. PRKRI (Accession NM_006260) is another VGAM2537 host target gene. PRKRI BINDING SITE is HOST TARGET binding site found in the 5' untranslated region of mRNA encoded by PRKRI, corresponding to a HOST TARGET binding site such as BINDING SITE I, BINDING SITE II or BINDING SITE III. Table 2 illustrates the complementarity of the nucleotide sequences of PRKRI BINDING SITE, designated SEQ ID:12944, to the nucleotide sequence of VGAM2537 RNA, herein designated VGAM RNA, also designated SEQ ID:5248.

Another function of VGAM2537 is therefore inhibition of PRKRI (Accession NM_006260). Accordingly, utilities of VGAM2537 include diagnosis, prevention and treatment of diseases and clinical conditions associated with PRKRI. Polymerase I and Transcript Release Factor (PTRF, Accession XM_032852) is another VGAM2537 host target gene. PTRF BINDING SITE is HOST TARGET binding site found in the 3' untranslated region of mRNA encoded by PTRF, corresponding to a HOST TARGET binding site such as BINDING SITE I, BINDING SITE II or BINDING SITE III. Table 2 illustrates the complementarity of the nucleotide sequences of PTRF BINDING SITE, designated SEQ ID:31782, to the nucleotide sequence of VGAM2537 RNA, herein designated VGAM RNA, also designated SEQ ID:5248.

Another function of VGAM2537 is therefore inhibition of Polymerase I and Transcript Release Factor (PTRF, Accession XM_032852). Accordingly, utilities of VGAM2537 include diagnosis, prevention and treatment of diseases and clinical conditions associated with PTRF. RAB35, Member RAS Oncogene Family (RAB35, Accession NM_006861) is another VGAM2537 host target gene. RAB35 BINDING SITE is HOST TARGET binding site found in the 3' untranslated region of mRNA encoded by RAB35, corresponding to a HOST TARGET binding site such as BINDING SITE I, BINDING SITE II or BINDING SITE III. Table 2 illustrates the complementarity of the nucleotide sequences of RAB35 BINDING SITE, designated SEQ ID:13732, to the nucleotide sequence of VGAM2537 RNA, herein designated VGAM RNA, also designated SEQ ID:5248.

Another function of VGAM2537 is therefore inhibition of RAB35, Member RAS Oncogene Family (RAB35, Accession NM_006861). Accordingly, utilities of VGAM2537 include diagnosis, prevention and treatment of diseases and clinical conditions associated with RAB35. RAB3A Interacting Protein (rabin3)-like 1 (RAB3IL1, Accession NM_013401) is another VGAM2537 host target gene. RAB3IL1 BINDING SITE is HOST TARGET binding site found in the 3' untranslated region of mRNA encoded by RAB3IL1, corresponding to a HOST TARGET binding site such as BINDING SITE I, BINDING SITE II or BINDING SITE III. Table 2 illustrates the complementarity of the nucleotide sequences of RAB3IL1 BINDING SITE, designated SEQ ID:15062, to the nucleotide sequence of VGAM2537 RNA, herein designated VGAM RNA, also designated SEQ ID:5248.

Another function of VGAM2537 is therefore inhibition of RAB3A Interacting Protein (rabin3)-like 1 (RAB3IL1, Accession NM_013401). Accordingly, utilities of VGAM2537 include diagnosis, prevention and treatment of diseases and clinical conditions associated with RAB3IL1. RAI (Accession NM_006663) is another VGAM2537 host target gene. RAI BINDING SITE is HOST TARGET binding site found in the 3' untranslated region of mRNA encoded by RAI, corresponding to a HOST TARGET binding site such as BINDING SITE I, BINDING SITE II or BINDING SITE III. Table 2 illustrates the complementarity of the nucleotide sequences of RAI BINDING SITE, designated SEQ ID:13470, to the nucleotide sequence of VGAM2537 RNA, herein designated VGAM RNA, also designated SEQ ID:5248.

Another function of VGAM2537 is therefore inhibition of RAI (Accession NM_006663). Accordingly, utilities of VGAM2537 include diagnosis, prevention and treatment of diseases and clinical conditions associated with RAI. REV1-like (yeast) (REV1L, Accession NM_016316) is another VGAM2537 host target gene. REV1L BINDING SITE is HOST TARGET binding site found in the 5' untranslated region of mRNA encoded by REV1L, corresponding to a HOST TARGET binding site such as BINDING SITE I, BINDING SITE II or BINDING SITE III. Table 2 illustrates the complementarity of the nucleotide sequences of REV1L BINDING SITE, designated SEQ ID:18435, to the nucleotide sequence of VGAM2537 RNA, herein designated VGAM RNA, also designated SEQ ID:5248.

Another function of VGAM2537 is therefore inhibition of REV1-like (yeast) (REV1L, Accession NM_016316). Accordingly, utilities of VGAM2537 include diagnosis, prevention and treatment of diseases and clinical conditions associated with REV1L. Sema Domain, Transmembrane Domain (TM), and Cytoplasmic Domain, (semaphorin) 6B (SEMA6B, Accession NM_032108) is another VGAM2537 host target gene. SEMA6B BINDING SITE is HOST TARGET binding site found in the 3' untranslated region of mRNA encoded by SEMA6B, corresponding to a HOST TARGET binding site such as BINDING SITE I, BINDING SITE II or BINDING SITE III. Table 2 illustrates the complementarity of the nucleotide sequences of SEMA6B BINDING SITE, designated SEQ ID:25799, to the nucleotide sequence of VGAM2537 RNA, herein designated VGAM RNA, also designated SEQ ID:5248.

Another function of VGAM2537 is therefore inhibition of Sema Domain, Transmembrane Domain (TM), and Cytoplasmic Domain, (semaphorin) 6B (SEMA6B, Accession NM_032108). Accordingly, utilities of VGAM2537 include diagnosis, prevention and treatment of diseases and clinical conditions associated with SEMA6B. Smith-Magenis Syndrome Chromosome Region, Candidate 5 (SMCR5, Accession NM_144774) is another VGAM2537 host target gene. SMCR5 BINDING SITE is HOST TARGET binding site found in the 3' untranslated region of mRNA encoded by SMCR5, corresponding to a HOST TARGET binding site such as BINDING SITE I, BINDING SITE II or BINDING SITE III. Table 2 illustrates the complementarity of the nucleotide sequences of SMCR5 BINDING SITE, designated SEQ ID:29562, to the nucleotide sequence of VGAM2537 RNA, herein designated VGAM RNA, also designated SEQ ID:5248.

Another function of VGAM2537 is therefore inhibition of Smith-Magenis Syndrome Chromosome Region, Candidate 5 (SMCR5, Accession NM_144774). Accordingly, utilities of VGAM2537 include diagnosis, prevention and treatment of diseases and clinical conditions associated with SMCR5. SP192 (Accession NM_021639) is another VGAM2537 host target gene. SP192 BINDING SITE is HOST TARGET binding site found in the 5' untranslated region of mRNA encoded by SP192, corresponding to a HOST TARGET binding site such as BINDING SITE I, BINDING SITE II or BINDING SITE III. Table 2 illustrates the complementarity of the nucleotide sequences of SP192 BINDING SITE, designated SEQ ID:22296, to the nucleotide sequence of VGAM2537 RNA, herein designated VGAM RNA, also designated SEQ ID:5248.

Another function of VGAM2537 is therefore inhibition of SP192 (Accession NM_021639). Accordingly, utilities of VGAM2537 include diagnosis, prevention and treatment of diseases and clinical conditions associated with SP192. SSH2 (Accession XM_030846) is another VGAM2537 host target gene. SSH2 BINDING SITE is HOST TARGET binding site found in the 3' untranslated region of mRNA encoded by SSH2, corresponding to a HOST TARGET binding site such as BINDING SITE I, BINDING SITE II or BINDING SITE III. Table 2 illustrates the complementarity of the nucleotide sequences of SSH2 BINDING SITE, designated SEQ ID:31180, to the nucleotide sequence of VGAM2537 RNA, herein designated VGAM RNA, also designated SEQ ID:5248.

Another function of VGAM2537 is therefore inhibition of SSH2 (Accession XM_030846). Accordingly, utilities of VGAM2537 include diagnosis, prevention and treatment of diseases and clinical conditions associated with SSH2. Striatin, Calmodulin Binding Protein 3 (STRN3, Accession NM_014574) is another VGAM2537 host target gene. STRN3 BINDING SITE is HOST TARGET binding site found in the 5' untranslated region of mRNA encoded by STRN3, corresponding to a HOST TARGET binding site such as BINDING SITE I, BINDING SITE II or BINDING SITE III. Table 2 illustrates the complementarity of the nucleotide sequences of STRN3 BINDING SITE, designated SEQ ID:15935, to the nucleotide sequence of VGAM2537 RNA, herein designated VGAM RNA, also designated SEQ ID:5248.

Another function of VGAM2537 is therefore inhibition of Striatin, Calmodulin Binding Protein 3 (STRN3, Accession NM_014574). Accordingly, utilities of VGAM2537 include diagnosis, prevention and treatment of diseases and clinical conditions associated with STRN3. Syntaxin 1B2 (STX1B2, Accession NM_052874) is another VGAM2537 host target gene. STX1B2 BINDING SITE is HOST TARGET binding site found in the 3' untranslated region of mRNA encoded by STX1B2, corresponding to a HOST TARGET binding site such as BINDING SITE I, BINDING SITE II or BINDING SITE III. Table 2 illustrates the complementarity of the nucleotide sequences of STX1B2 BINDING SITE, designated SEQ ID:27454, to the nucleotide sequence of VGAM2537 RNA, herein designated VGAM RNA, also designated SEQ ID:5248.

Another function of VGAM2537 is therefore inhibition of Syntaxin 1B2 (STX1B2, Accession NM_052874). Accordingly, utilities of VGAM2537 include diagnosis, prevention and treatment of diseases and clinical conditions associated with STX1B2. TRIP-Br2 (Accession NM_014755) is another VGAM2537 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16486, to the nucleotide sequence of VGAM2537 RNA, herein designated VGAM RNA, also designated SEQ ID:5248.

Another function of VGAM2537 is therefore inhibition of TRIP-Br2 (Accession NM_014755). Accordingly, utilities of VGAM2537 include diagnosis, prevention and treatment of diseases and clinical conditions associated with TRIP-Br2. TUSP (Accession NM_020245) is another VGAM2537 host target gene. TUSP BINDING SITE is HOST TARGET binding site found in the 3' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21524, to the nucleotide sequence of VGAM2537 RNA, herein designated VGAM RNA, also designated SEQ ID:5248.

Another function of VGAM2537 is therefore inhibition of TUSP (Accession NM_020245). Accordingly, utilities of VGAM2537 include diagnosis, prevention and treatment of diseases and clinical conditions associated with TUSP. Zinc Finger, DHHC Domain Containing 8 (ZDHHC8, Accession XM_033828) is another VGAM2537 host target gene. ZDHHC8 BINDING SITE is HOST TARGET binding site found in the 3' untranslated region of mRNA encoded by ZDHHC8, corresponding to a HOST TARGET binding site such as BINDING SITE I, BINDING SITE II or BINDING SITE III. Table 2 illustrates the complementarity of the nucleotide sequences of ZDHHC8 BINDING SITE, designated SEQ ID:31961, to the nucleotide sequence of VGAM2537 RNA, herein designated VGAM RNA, also designated SEQ ID:5248.

Another function of VGAM2537 is therefore inhibition of Zinc Finger, DHHC Domain Containing 8 (ZDHHC8, Accession XM_033828). Accordingly, utilities of VGAM2537 include diagnosis, prevention and treatment of diseases and clinical conditions associated with ZDHHC8. ZIN (Accession NM_013403) is another VGAM2537 host target gene. ZIN BINDING SITE is HOST TARGET binding site found in the 3' untranslated region of mRNA encoded by ZIN, corresponding to a HOST TARGET binding site such as BINDING SITE I, BINDING SITE II or BINDING SITE III. Table 2 illustrates the complementarity of the nucleotide sequences of ZIN BINDING SITE, designated SEQ ID:15071, to the nucleotide sequence of VGAM2537 RNA, herein designated VGAM RNA, also designated SEQ ID:5248.

Another function of VGAM2537 is therefore inhibition of ZIN (Accession NM_013403). Accordingly, utilities of VGAM2537 include diagnosis, prevention and treatment of diseases and clinical conditions associated with ZIN. LOC116411 (Accession XM_058095) is another VGAM2537 host target gene. LOC116411 BINDING SITE is HOST TARGET binding site found in the 5' untranslated region of mRNA encoded by LOC116411, corresponding to a HOST TARGET binding site such as BINDING SITE I, BINDING SITE II or BINDING SITE III. Table 2 illustrates the complementarity of the nucleotide sequences of LOC116411 BINDING SITE, designated SEQ ID:36565, to the nucleotide sequence of VGAM2537 RNA, herein designated VGAM RNA, also designated SEQ ID:5248.

Another function of VGAM2537 is therefore inhibition of LOC116411 (Accession XM_058095). Accordingly, utilities of VGAM2537 include diagnosis, prevention and treatment of diseases and clinical conditions associated with LOC116411. LOC120376 (Accession XM_071712) is another VGAM2537 host target gene. LOC120376 BINDING SITE is HOST TARGET binding site found in the 5' untranslated region of mRNA encoded by LOC120376, corresponding to a HOST TARGET binding site such as BINDING SITE I, BINDING SITE II or BINDING SITE III. Table 2 illustrates the complementarity of the nucleotide sequences of LOC120376 BINDING SITE, designated SEQ ID:37413, to the nucleotide sequence of VGAM2537 RNA, herein designated VGAM RNA, also designated SEQ ID:5248.

Another function of VGAM2537 is therefore inhibition of LOC120376 (Accession XM_071712). Accordingly, utilities of VGAM2537 include diagnosis, prevention and treatment of diseases and clinical conditions associated with LOC120376. LOC123096 (Accession XM_058679) is another VGAM2537 host target gene. LOC123096 BINDING SITE is HOST TARGET binding site found in the 3' untranslated region of mRNA encoded by LOC123096, corresponding to a HOST TARGET binding site such as BINDING SITE I, BINDING SITE II or BINDING SITE III. Table 2 illustrates the complementarity of the nucleotide sequences of LOC123096 BINDING SITE, designated SEQ ID:36720, to the nucleotide sequence of VGAM2537 RNA, herein designated VGAM RNA, also designated SEQ ID:5248.

Another function of VGAM2537 is therefore inhibition of LOC123096 (Accession XM_058679). Accordingly, utilities of VGAM2537 include diagnosis, prevention and treatment of diseases and clinical conditions associated with LOC123096. LOC124446 (Accession XM_058805) is another VGAM2537 host target gene. LOC124446 BINDING SITE is HOST TARGET binding site found in the 5' untranslated region of mRNA encoded by LOC124446, corresponding to a HOST TARGET binding site such as BINDING SITE I, BINDING SITE II or BINDING SITE III. Table 2 illustrates the complementarity of the nucleotide sequences of LOC124446 BINDING SITE, designated SEQ ID:36750, to the nucleotide sequence of VGAM2537 RNA, herein designated VGAM RNA, also designated SEQ ID:5248.

Another function of VGAM2537 is therefore inhibition of LOC124446 (Accession XM_058805). Accordingly, utilities of VGAM2537 include diagnosis, prevention and treatment of diseases and clinical conditions associated with LOC124446. LOC133308 (Accession XM_059638) is another VGAM2537 host target gene. LOC133308 BINDING SITE is HOST TARGET binding site found in the 5' untranslated region of mRNA encoded by LOC133308, corresponding to a HOST TARGET binding site such as BINDING SITE I, BINDING SITE II or BINDING SITE III. Table 2 illustrates the complementarity of the nucleotide sequences of LOC133308 BINDING SITE, designated SEQ ID:37034, to the nucleotide sequence of VGAM2537 RNA, herein designated VGAM RNA, also designated SEQ ID:5248.

Another function of VGAM2537 is therefore inhibition of LOC133308 (Accession XM_059638). Accordingly, utilities of VGAM2537 include diagnosis, prevention and treatment of diseases and clinical conditions associated with LOC133308. LOC142972 (Accession XM_036593) is another VGAM2537 host target gene. LOC142972 BINDING SITE is HOST TARGET binding site found in the 3' untranslated region of mRNA encoded by LOC142972, corresponding to a HOST TARGET binding site such as BINDING SITE I, BINDING SITE II or BINDING SITE III. Table 2 illustrates the complementarity of the nucleotide sequences of LOC142972 BINDING SITE, designated SEQ ID:32477, to the nucleotide sequence of VGAM2537 RNA, herein designated VGAM RNA, also designated SEQ ID:5248.

Another function of VGAM2537 is therefore inhibition of LOC142972 (Accession XM_036593). Accordingly, utilities of VGAM2537 include diagnosis, prevention and treatment of diseases and clinical conditions associated with LOC142972. LOC143524 (Accession XM_084559) is another VGAM2537 host target gene. LOC143524 BINDING SITE is HOST TARGET binding site found in the 3' untranslated region of mRNA encoded by LOC143524, corresponding to a HOST TARGET binding site such as BINDING SITE I, BINDING SITE II or BINDING SITE III. Table 2 illustrates the complementarity of the nucleotide sequences of LOC143524 BINDING SITE, designated SEQ ID:37628, to the nucleotide sequence of VGAM2537 RNA, herein designated VGAM RNA, also designated SEQ ID:5248.

Another function of VGAM2537 is therefore inhibition of LOC143524 (Accession XM_084559). Accordingly, utilities of VGAM2537 include diagnosis, prevention and treatment of diseases and clinical conditions associated with LOC143524. LOC143920 (Accession XM_084658) is another VGAM2537 host target gene. LOC143920 BINDING SITE is HOST TARGET binding site found in the 3' untranslated region of mRNA encoded by LOC143920, corresponding to a HOST TARGET binding site such as BINDING SITE I, BINDING SITE II or BINDING SITE III. Table 2 illustrates the complementarity of the nucleotide sequences of LOC143920 BINDING SITE, designated SEQ ID:37639, to the nucleotide sequence of VGAM2537 RNA, herein designated VGAM RNA, also designated SEQ ID:5248.

Another function of VGAM2537 is therefore inhibition of LOC143920 (Accession XM_084658). Accordingly, utilities of VGAM2537 include diagnosis, prevention and treatment of diseases and clinical conditions associated with LOC143920. LOC144373 (Accession XM_084841) is another VGAM2537 host target gene. LOC144373 BINDING SITE is HOST TARGET binding site found in the 3' untranslated region of mRNA encoded by LOC144373, corresponding to a HOST TARGET binding site such as BINDING SITE I, BINDING SITE II or BINDING SITE III. Table 2 illustrates the complementarity of the nucleotide sequences of LOC144373 BINDING SITE, designated SEQ ID:37727, to the nucleotide sequence of VGAM2537 RNA, herein designated VGAM RNA, also designated SEQ ID:5248.

Another function of VGAM2537 is therefore inhibition of LOC144373 (Accession XM_084841). Accordingly, utilities of VGAM2537 include diagnosis, prevention and treatment of diseases and clinical conditions associated with LOC144373. LOC144501 (Accession XM_096612) is another VGAM2537 host target gene. LOC144501 BINDING SITE is HOST TARGET binding site found in the 3' untranslated region of mRNA encoded by LOC144501, corresponding to a HOST TARGET binding site such as BINDING SITE I, BINDING SITE II or BINDING SITE III. Table 2 illustrates the complementarity of the nucleotide sequences of LOC144501 BINDING SITE, designated SEQ ID:40424, to the nucleotide sequence of VGAM2537 RNA, herein designated VGAM RNA, also designated SEQ ID:5248.

Another function of VGAM2537 is therefore inhibition of LOC144501 (Accession XM_096612). Accordingly, utilities of VGAM2537 include diagnosis, prevention and treatment of diseases and clinical conditions associated with LOC144501. LOC144559 (Accession XM_084896) is another VGAM2537 host target gene. LOC144559 BINDING SITE is HOST TARGET binding site found in the 3' untranslated region of mRNA encoded by LOC144559, corresponding to a HOST TARGET binding site such as BINDING SITE I, BINDING SITE II or BINDING SITE III. Table 2 illustrates the complementarity of the nucleotide sequences of LOC144559 BINDING SITE, designated SEQ ID:37764, to the nucleotide sequence of VGAM2537 RNA, herein designated VGAM RNA, also designated SEQ ID:5248.

Another function of VGAM2537 is therefore inhibition of LOC144559 (Accession XM_084896). Accordingly, utilities of VGAM2537 include diagnosis, prevention and treatment of diseases and clinical conditions associated with LOC144559. LOC145255 (Accession XM_096748) is another VGAM2537 host target gene. LOC145255 BINDING SITE is HOST TARGET binding site found in the 3' untranslated region of mRNA encoded by LOC145255, corresponding to a HOST TARGET binding site such as BINDING SITE I, BINDING SITE II or BINDING SITE III. Table 2 illustrates the complementarity of the nucleotide sequences of LOC145255 BINDING SITE, designated SEQ ID:40528, to the nucleotide sequence of VGAM2537 RNA, herein designated VGAM RNA, also designated SEQ ID:5248.

Another function of VGAM2537 is therefore inhibition of LOC145255 (Accession XM_096748). Accordingly, utilities of VGAM2537 include diagnosis, prevention and treatment of diseases and clinical conditions associated with LOC145255. LOC145719 (Accession XM_096848) is another VGAM2537 host target gene. LOC145719 BINDING SITE is HOST TARGET binding site found in the 5' untranslated region of mRNA encoded by LOC145719, corresponding to a HOST TARGET binding site such as BINDING SITE I, BINDING SITE II or BINDING SITE III. Table 2 illustrates the complementarity of the nucleotide sequences of LOC145719 BINDING SITE, designated SEQ ID:40575, to the nucleotide sequence of VGAM2537 RNA, herein designated VGAM RNA, also designated SEQ ID:5248.

Another function of VGAM2537 is therefore inhibition of LOC145719 (Accession XM_096848). Accordingly, utilities of VGAM2537 include diagnosis, prevention and treatment of diseases and clinical conditions associated with LOC145719. LOC147057 (Accession XM_097166) is another VGAM2537 host target gene. LOC147057 BINDING SITE is HOST TARGET binding site found in the 3' untranslated region of mRNA encoded by LOC147057, corresponding to a HOST TARGET binding site such as BINDING SITE I, BINDING SITE II or BINDING SITE III. Table 2 illustrates the complementarity of the nucleotide sequences of LOC147057 BINDING SITE, designated SEQ ID:40783, to the nucleotide sequence of VGAM2537 RNA, herein designated VGAM RNA, also designated SEQ ID:5248.

Another function of VGAM2537 is therefore inhibition of LOC147057 (Accession XM_097166). Accordingly, utilities of VGAM2537 include diagnosis, prevention and treatment of diseases and clinical conditions associated with LOC147057. LOC149478 (Accession XM_086536) is another VGAM2537 host target gene. LOC149478 BINDING SITE is HOST TARGET binding site found in the 5' untranslated region of mRNA encoded by LOC149478, corresponding to a HOST TARGET binding site such as BINDING SITE I, BINDING SITE II or BINDING SITE III. Table 2 illustrates the complementarity of the nucleotide sequences of LOC149478 BINDING SITE, designated SEQ ID:38750, to the nucleotide sequence of VGAM2537 RNA, herein designated VGAM RNA, also designated SEQ ID:5248.

Another function of VGAM2537 is therefore inhibition of LOC149478 (Accession XM_086536). Accordingly, utilities of VGAM2537 include diagnosis, prevention and treatment of diseases and clinical conditions associated with LOC149478. LOC150135 (Accession XM_086785) is another VGAM2537 host target gene. LOC150135 BINDING SITE is HOST TARGET binding site found in the 3' untranslated region of mRNA encoded by LOC150135, corresponding to a HOST TARGET binding site such as BINDING SITE I, BINDING SITE II or BINDING SITE III. Table 2 illustrates the complementarity of the nucleotide sequences of LOC150135 BINDING SITE, designated SEQ ID:38845, to the nucleotide sequence of VGAM2537 RNA, herein designated VGAM RNA, also designated SEQ ID:5248.

Another function of VGAM2537 is therefore inhibition of LOC150135 (Accession XM_086785). Accordingly, utilities of VGAM2537 include diagnosis, prevention and treatment of diseases and clinical conditions associated with LOC150135. LOC150498 (Accession XM_086931) is another VGAM2537 host target gene. LOC150498 BINDING SITE is HOST TARGET binding site found in the 3' untranslated region of mRNA encoded by LOC150498, corresponding to a HOST TARGET binding site such as BINDING SITE I, BINDING SITE II or BINDING SITE III. Table 2 illustrates the complementarity of the nucleotide sequences of LOC150498 BINDING SITE, designated SEQ ID:38984, to the nucleotide sequence of VGAM2537 RNA, herein designated VGAM RNA, also designated SEQ ID:5248.

Another function of VGAM2537 is therefore inhibition of LOC150498 (Accession XM_086931). Accordingly, utilities of VGAM2537 include diagnosis, prevention and treatment of diseases and clinical conditions associated with LOC150498. LOC152220 (Accession XM_098176) is another VGAM2537 host target gene. LOC152220 BINDING SITE is HOST TARGET binding site found in the 3' untranslated region of mRNA encoded by LOC152220, corresponding to a HOST TARGET binding site such as BINDING SITE I, BINDING SITE II or BINDING SITE III. Table 2 illustrates the complementarity of the nucleotide sequences of LOC152220 BINDING SITE, designated SEQ ID:41441, to the nucleotide sequence of VGAM2537 RNA, herein designated VGAM RNA, also designated SEQ ID:5248.

Another function of VGAM2537 is therefore inhibition of LOC152220 (Accession XM_098176). Accordingly, utilities of VGAM2537 include diagnosis, prevention and treatment of diseases and clinical conditions associated with LOC152220. LOC155006 (Accession XM_088117) is another VGAM2537 host target gene. LOC155006 BINDING SITE is HOST TARGET binding site found in the 3' untranslated region of mRNA encoded by LOC155006, corresponding to a HOST TARGET binding site such as BINDING SITE I, BINDING SITE II or BINDING SITE III. Table 2 illustrates the complementarity of the nucleotide sequences of LOC155006 BINDING SITE, designated SEQ ID:39524, to the nucleotide sequence of VGAM2537 RNA, herein designated VGAM RNA, also designated SEQ ID:5248.

Another function of VGAM2537 is therefore inhibition of LOC155006 (Accession XM_088117). Accordingly, utilities of VGAM2537 include diagnosis, prevention and treatment of diseases and clinical conditions associated with LOC155006. LOC157848 (Accession XM_088405) is another VGAM2537 host target gene. LOC157848 BINDING SITE is HOST TARGET binding site found in the 3' untranslated region of mRNA encoded by LOC157848, corresponding to a HOST TARGET binding site such as BINDING SITE I, BINDING SITE II or BINDING SITE III. Table 2 illustrates the complementarity of the nucleotide sequences of LOC157848 BINDING SITE, designated SEQ ID:39673, to the nucleotide sequence of VGAM2537 RNA, herein designated VGAM RNA, also designated SEQ ID:5248.

Another function of VGAM2537 is therefore inhibition of LOC157848 (Accession XM_088405). Accordingly, utilities of VGAM2537 include diagnosis, prevention and treatment of diseases and clinical conditions associated with LOC157848. LOC167147 (Accession XM_094310) is another VGAM2537 host target gene. LOC167147 BINDING SITE is HOST TARGET binding site found in the 5' untranslated region of mRNA encoded by LOC167147, corresponding to a HOST TARGET binding site such as BINDING SITE I, BINDING SITE II or BINDING SITE III. Table 2 illustrates the complementarity of the nucleotide sequences of LOC167147 BINDING SITE, designated SEQ ID:40226, to the nucleotide sequence of VGAM2537 RNA, herein designated VGAM RNA, also designated SEQ ID:5248.

Another function of VGAM2537 is therefore inhibition of LOC167147 (Accession XM_094310). Accordingly, utilities of VGAM2537 include diagnosis, prevention and treatment of diseases and clinical conditions associated with LOC167147. LOC199786 (Accession XM_114021) is another VGAM2537 host target gene. LOC199786 BINDING SITE is HOST TARGET binding site found in the 3' untranslated region of mRNA encoded by LOC199786, corresponding to a HOST TARGET binding site such as BINDING SITE I, BINDING SITE II or BINDING SITE III. Table 2 illustrates the complementarity of the nucleotide sequences of LOC199786 BINDING SITE, designated SEQ ID:42619, to the nucleotide sequence of VGAM2537 RNA, herein designated VGAM RNA, also designated SEQ ID:5248.

Another function of VGAM2537 is therefore inhibition of LOC199786 (Accession XM_114021). Accordingly, utilities of VGAM2537 include diagnosis, prevention and treatment of diseases and clinical conditions associated with LOC199786. LOC201500 (Accession XM_117101) is another VGAM2537 host target gene. LOC201500 BINDING SITE is HOST TARGET binding site found in the 5' untranslated region of mRNA encoded by LOC201500, corresponding to a HOST TARGET binding site such as BINDING SITE I, BINDING SITE II or BINDING SITE III. Table 2 illustrates the complementarity of the nucleotide sequences of LOC201500 BINDING SITE, designated SEQ ID:43223, to the nucleotide sequence of VGAM2537 RNA, herein designated VGAM RNA, also designated SEQ ID:5248.

Another function of VGAM2537 is therefore inhibition of LOC201500 (Accession XM_117101). Accordingly, utilities of VGAM2537 include diagnosis, prevention and treatment of diseases and clinical conditions associated with LOC201500. LOC202460 (Accession XM_114493) is another VGAM2537 host target gene. LOC202460 BINDING SITE is HOST TARGET binding site found in the 5' untranslated region of mRNA encoded by LOC202460, corresponding to a HOST TARGET binding site such as BINDING SITE I, BINDING SITE II or BINDING SITE III. Table 2 illustrates the complementarity of the nucleotide sequences of LOC202460 BINDING SITE, designated SEQ ID:42982, to the nucleotide sequence of VGAM2537 RNA, herein designated VGAM RNA, also designated SEQ ID:5248.

Another function of VGAM2537 is therefore inhibition of LOC202460 (Accession XM_114493). Accordingly, utilities of VGAM2537 include diagnosis, prevention and treatment of diseases and clinical conditions associated with LOC202460. LOC203248 (Accession XM_114659) is another VGAM2537 host target gene. LOC203248 BINDING SITE is HOST TARGET binding site found in the 3' untranslated region of mRNA encoded by LOC203248, corresponding to a HOST TARGET binding site such as BINDING SITE I, BINDING SITE II or BINDING SITE III. Table 2 illustrates the complementarity of the nucleotide sequences of LOC203248 BINDING SITE, designated SEQ ID:43018, to the nucleotide sequence of VGAM2537 RNA, herein designated VGAM RNA, also designated SEQ ID:5248.

Another function of VGAM2537 is therefore inhibition of LOC203248 (Accession XM_114659). Accordingly, utilities of VGAM2537 include diagnosis, prevention and treatment of diseases and clinical conditions associated with LOC203248. LOC203504 (Accession XM_117550) is another VGAM2537 host target gene. LOC203504 BINDING SITE1 and LOC203504 BINDING SITE2 are HOST TARGET binding sites found in untranslated regions of mRNA encoded by LOC203504, corresponding to HOST TARGET binding sites such as BINDING SITE I, BINDING SITE II or BINDING SITE III. Table 2 illustrates the complementarity of the nucleotide sequences of LOC203504 BINDING SITE1 and LOC203504 BINDING SITE2, designated SEQ ID:43568 and SEQ ID:43569 respectively, to the nucleotide sequence of VGAM2537 RNA, herein designated VGAM RNA, also designated SEQ ID:5248.

Another function of VGAM2537 is therefore inhibition of LOC203504 (Accession XM_117550). Accordingly, utilities of VGAM2537 include diagnosis, prevention and treatment of diseases and clinical conditions associated with LOC203504. LOC221833 (Accession XM_166519) is another VGAM2537 host target gene. LOC221833 BINDING SITE is HOST TARGET binding site found in the 3' untranslated region of mRNA encoded by LOC221833, corresponding to a HOST TARGET binding site such as BINDING SITE I, BINDING SITE II or BINDING SITE III. Table 2 illustrates the complementarity of the nucleotide sequences of LOC221833 BINDING SITE, designated SEQ ID:44455, to the nucleotide sequence of VGAM2537 RNA, herein designated VGAM RNA, also designated SEQ ID:5248.

Another function of VGAM2537 is therefore inhibition of LOC221833 (Accession XM_166519). Accordingly, utilities of VGAM2537 include diagnosis, prevention and treatment of diseases and clinical conditions associated with LOC221833. LOC221922 (Accession XM_166555) is another VGAM2537 host target gene. LOC221922 BINDING SITE is HOST TARGET binding site found in the 5' untranslated region of mRNA encoded by LOC221922, corresponding to a HOST TARGET binding site such as BINDING SITE I, BINDING SITE II or BINDING SITE III. Table 2 illustrates the complementarity of the nucleotide sequences of LOC221922 BINDING SITE, designated SEQ ID:44532, to the nucleotide sequence of VGAM2537 RNA, herein designated VGAM RNA, also designated SEQ ID:5248.

Another function of VGAM2537 is therefore inhibition of LOC221922 (Accession XM_166555). Accordingly, utilities of VGAM2537 include diagnosis, prevention and treatment of diseases and clinical conditions associated with LOC221922. LOC221935 (Accession XM_166537) is another VGAM2537 host target gene. LOC221935 BINDING SITE is HOST TARGET binding site found in the 3' untranslated region of mRNA encoded by LOC221935, corresponding to a HOST TARGET binding site such as BINDING SITE I, BINDING SITE II or BINDING SITE III. Table 2 illustrates the complementarity of the nucleotide sequences of LOC221935 BINDING SITE, designated SEQ ID:44500, to the nucleotide sequence of VGAM2537 RNA, herein designated VGAM RNA, also designated SEQ ID:5248.

Another function of VGAM2537 is therefore inhibition of LOC221935 (Accession XM_166537). Accordingly, utilities of VGAM2537 include diagnosis, prevention and treatment of diseases and clinical conditions associated with LOC221935. LOC222070 (Accession XM_168433) is another VGAM2537 host target gene. LOC222070 BINDING SITE is HOST TARGET binding site found in the 5' untranslated region of mRNA encoded by LOC222070, corresponding to a HOST TARGET binding site such as BINDING SITE I, BINDING SITE II or BINDING SITE III. Table 2 illustrates the complementarity of the nucleotide sequences of LOC222070 BINDING SITE, designated SEQ ID:45179, to the nucleotide sequence of VGAM2537 RNA, herein designated VGAM RNA, also designated SEQ ID:5248.

Another function of VGAM2537 is therefore inhibition of LOC222070 (Accession XM_168433). Accordingly, utilities of VGAM2537 include diagnosis, prevention and treatment of diseases and clinical conditions associated with LOC222070. LOC253143 (Accession XM_173062) is another VGAM2537 host target gene. LOC253143 BINDING SITE is HOST TARGET binding site found in the 5' untranslated region of mRNA encoded by LOC253143, corresponding to a HOST TARGET binding site such as BINDING SITE I, BINDING SITE II or BINDING SITE III. Table 2 illustrates the complementarity of the nucleotide sequences of LOC253143 BINDING SITE, designated SEQ ID:46315, to the nucleotide sequence of VGAM2537 RNA, herein designated VGAM RNA, also designated SEQ ID:5248.

Another function of VGAM2537 is therefore inhibition of LOC253143 (Accession XM_173062). Accordingly, utilities of VGAM2537 include diagnosis, prevention and treatment of diseases and clinical conditions associated with LOC253143. LOC254387 (Accession XM_170731) is another VGAM2537 host target gene. LOC254387 BINDING SITE is HOST TARGET binding site found in the 3' untranslated region of mRNA encoded by LOC254387, corresponding to a HOST TARGET binding site such as BINDING SITE I, BINDING SITE II or BINDING SITE III. Table 2 illustrates the complementarity of the nucleotide sequences of LOC254387 BINDING SITE, designated SEQ ID:45488, to the nucleotide sequence of VGAM2537 RNA, herein designated VGAM RNA, also designated SEQ ID:5248.

Another function of VGAM2537 is therefore inhibition of LOC254387 (Accession XM_170731). Accordingly, utilities of VGAM2537 include diagnosis, prevention and treatment of diseases and clinical conditions associated with LOC254387. LOC255515 (Accession XM_171185) is another VGAM2537 host target gene. LOC255515 BINDING SITE is HOST TARGET binding site found in the 3' untranslated region of mRNA encoded by LOC255515, corresponding to a HOST TARGET binding site such as BINDING SITE I, BINDING SITE II or BINDING SITE III. Table 2 illustrates the complementarity of the nucleotide sequences of LOC255515 BINDING SITE, designated SEQ ID:45960, to the nucleotide sequence of VGAM2537 RNA, herein designated VGAM RNA, also designated SEQ ID:5248.

Another function of VGAM2537 is therefore inhibition of LOC255515 (Accession XM_171185). Accordingly, utilities of VGAM2537 include diagnosis, prevention and treatment of diseases and clinical conditions associated with LOC255515. LOC257463 (Accession XM_048605) is another VGAM2537 host target gene. LOC257463 BINDING SITE is HOST TARGET binding site found in the 3' untranslated region of mRNA encoded by LOC257463, corresponding to a HOST TARGET binding site such as BINDING SITE I, BINDING SITE II or BINDING SITE III. Table 2 illustrates the complementarity of the nucleotide sequences of LOC257463 BINDING SITE, designated SEQ ID:35209, to the nucleotide sequence of VGAM2537 RNA, herein designated VGAM RNA, also designated SEQ ID:5248.

Another function of VGAM2537 is therefore inhibition of LOC257463 (Accession XM_048605). Accordingly, utilities of VGAM2537 include diagnosis, prevention and treatment of diseases and clinical conditions associated with LOC257463. LOC56961 (Accession XM_031857) is another VGAM2537 host target gene. LOC56961 BINDING SITE is HOST TARGET binding site found in the 5' untranslated region of mRNA encoded by LOC56961, corresponding to a HOST TARGET binding site such as BINDING SITE I, BINDING SITE II or BINDING SITE III. Table 2 illustrates the complementarity of the nucleotide sequences of LOC56961 BINDING SITE, designated SEQ ID:31506, to the nucleotide sequence of VGAM2537 RNA, herein designated VGAM RNA, also designated SEQ ID:5248.

Another function of VGAM2537 is therefore inhibition of LOC56961 (Accession XM_031857). Accordingly, utilities of VGAM2537 include diagnosis, prevention and treatment of diseases and clinical conditions associated with LOC56961. LOC57105 (Accession NM_020377) is another VGAM2537 host target gene. LOC57105 BINDING SITE is HOST TARGET binding site found in the 3' untranslated region of mRNA encoded by LOC57105, corresponding to a HOST TARGET binding site such as BINDING SITE I, BINDING SITE II or BINDING SITE III. Table 2 illustrates the complementarity of the nucleotide sequences of LOC57105 BINDING SITE, designated SEQ ID:21638, to the nucleotide sequence of VGAM2537 RNA, herein designated VGAM RNA, also designated SEQ ID:5248.

Another function of VGAM2537 is therefore inhibition of LOC57105 (Accession NM_020377). Accordingly, utilities of VGAM2537 include diagnosis, prevention and treatment of diseases and clinical conditions associated with LOC57105. LOC90643 (Accession XM_033145) is another VGAM2537 host target gene. LOC90643 BINDING SITE is HOST TARGET binding site found in the 3' untranslated region of mRNA encoded by LOC90643, corresponding to a HOST TARGET binding site such as BINDING SITE I, BINDING SITE II or BINDING SITE III. Table 2 illustrates the complementarity of the nucleotide sequences of LOC90643 BINDING SITE, designated SEQ ID:31853, to the nucleotide sequence of VGAM2537 RNA, herein designated VGAM RNA, also designated SEQ ID:5248.

Another function of VGAM2537 is therefore inhibition of LOC90643 (Accession XM_033145). Accordingly, utilities of VGAM2537 include diagnosis, prevention and treatment of diseases and clinical conditions associated with LOC90643. LOC90906 (Accession XM_034809) is another VGAM2537 host target gene. LOC90906 BINDING SITE is HOST TARGET binding site found in the 3' untranslated region of mRNA encoded by LOC90906, corresponding to a HOST TARGET binding site such as BINDING SITE I, BINDING SITE II or BINDING SITE III. Table 2 illustrates the complementarity of the nucleotide sequences of LOC90906 BINDING SITE, designated SEQ ID:32149, to the nucleotide sequence of VGAM2537 RNA, herein designated VGAM RNA, also designated SEQ ID:5248.

Another function of VGAM2537 is therefore inhibition of LOC90906 (Accession XM_034809). Accordingly, utilities of VGAM2537 include diagnosis, prevention and treatment of diseases and clinical conditions associated with LOC90906. LOC91308 (Accession XM_037600) is another VGAM2537 host target gene. LOC91308 BINDING SITE is HOST TARGET binding site found in the 3' untranslated region of mRNA encoded by LOC91308, corresponding to a HOST TARGET binding site such as BINDING SITE I, BINDING SITE II or BINDING SITE III. Table 2 illustrates the complementarity of the nucleotide sequences of LOC91308 BINDING SITE, designated SEQ ID:32656, to the nucleotide sequence of VGAM2537 RNA, herein designated VGAM RNA, also designated SEQ ID:5248.

Another function of VGAM2537 is therefore inhibition of LOC91308 (Accession XM_037600). Accordingly, utilities of VGAM2537 include diagnosis, prevention and treatment of diseases and clinical conditions associated with LOC91308. LOC91397 (Accession XM_038219) is another VGAM2537 host target gene. LOC91397 BINDING SITE is HOST TARGET binding site found in the 5' untranslated region of mRNA encoded by LOC91397, corresponding to a HOST TARGET binding site such as BINDING SITE I, BINDING SITE II or BINDING SITE III. Table 2 illustrates the complementarity of the nucleotide sequences of LOC91397 BINDING SITE, designated SEQ ID:32781, to the nucleotide sequence of VGAM2537 RNA, herein designated VGAM RNA, also designated SEQ ID:5248.

Another function of VGAM2537 is therefore inhibition of LOC91397 (Accession XM_038219). Accordingly, utilities of VGAM2537 include diagnosis, prevention and treatment of diseases and clinical conditions associated with LOC91397. LOC91974 (Accession XM_041974) is another VGAM2537 host target gene. LOC91974 BINDING SITE is HOST TARGET binding site found in the 5' untranslated region of mRNA encoded by LOC91974, corresponding to a HOST TARGET binding site such as BINDING SITE I, BINDING SITE II or BINDING SITE III. Table 2 illustrates the complementarity of the nucleotide sequences of LOC91974 BINDING SITE, designated SEQ ID:33652, to the nucleotide sequence of VGAM2537 RNA, herein designated VGAM RNA, also designated SEQ ID:5248.

Another function of VGAM2537 is therefore inhibition of LOC91974 (Accession XM_041974). Accordingly, utilities of VGAM2537 include diagnosis, prevention and treatment of diseases and clinical conditions associated with LOC91974. FIG. 1 further provides a conceptual description of a novel bioinformatically detected viral gene of the present invention, referred to here as Viral Genomic Address Messenger 2538 (VGAM2538) viral gene, which modulates expression of respective host target genes thereof, the function and utility of which host target genes is known in the art.

VGAM2538 is a novel bioinformatically detected regulatory, non protein coding, viral micro RNA (miRNA) gene. The method by which VGAM2538 was detected is described hereinabove with reference to FIGS. 1-8.

VGAM2538 gene, herein designated VGAM GENE, is a viral gene contained in the genome of Pestivirus Reindeer-1.

VGAM2538 host target gene, herein designated VGAM HOST TARGET GENE, is a human gene contained in the human genome.

VGAM2538 gene encodes a VGAM2538 precursor RNA, herein designated VGAM PRECURSOR RNA. Similar to other miRNA genes, and unlike most ordinary genes, VGAM2538 precursor RNA does not encode a protein. A nucleotide sequence identical or highly similar to the nucleotide sequence of VGAM2538 precursor RNA is designated SEQ ID:2524, and is provided hereinbelow with reference to the sequence listing part. Nucleotide sequence SEQ ID:2524 is located at position 2796 relative to the genome of Pestivirus Reindeer-1.

VGAM2538 precursor RNA folds onto itself, forming VGAM2538 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2538 folded precursor RNA into VGAM2538 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM2538 RNA is designated SEQ ID:5249, and is provided hereinbelow with reference to the sequence listing part.

VGAM2538 host target gene, herein designated VGAM HOST TARGET GENE, encodes a corresponding messenger RNA, VGAM2538 host target RNA, herein designated VGAM HOST TARGET RNA. VGAM2538 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2538 RNA, herein designated VGAM RNA, binds complementarily to one or more host target binding sites located in untranslated regions of VGAM2538 host target RNA, herein designated VGAM HOST TARGET RNA. This complementary binding is due to the fact that the nucleotide sequence of VGAM2538 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2538 RNA, herein designated VGAM RNA, may have a different number of host target binding sites in untranslated regions of a VGAM2538 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2538 RNA, herein designated VGAM RNA, to host target binding sites on VGAM2538 host target RNA, herein designated VGAM HOST TARGET RNA, such as BINDING SITE I, BINDING SITE II and BINDING SITE III, inhibits translation of VGAM2538 host target RNA into VGAM2538 host target protein, herein designated VGAM HOST TARGET PROTEIN. VGAM host target protein is therefore outlined by a broken line.

It is appreciated that VGAM2538 host target gene, herein designated VGAM HOST TARGET GENE, in fact represents a plurality of VGAM2538 host target genes. The mRNA of each one of this plurality of VGAM2538 host target genes comprises one or more host target binding sites, each having a nucleotide sequence which is at least partly complementary to VGAM2538 RNA, herein designated VGAM RNA, and which when bound by VGAM2538 RNA causes inhibition of translation of respective one or more VGAM2538 host target proteins.

It is further appreciated by one skilled in the art that the mode of translational inhibition illustrated by FIG. 1 with specific reference to translational inhibition exerted by VGAM2538 gene, herein designated VGAM GENE, on one or more VGAM2538 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2538 is inhibition of expression of host target genes, as part of a novel viral mechanism of attacking a host. Accordingly, utilities of VGAM2538 include diagnosis, prevention and treatment of viral infection by Pestivirus Reindeer-1. Specific functions, and accordingly utilities, of VGAM2538 correlate with, and may be deduced from, the identity of the host target genes which VGAM2538 binds and inhibits, and the function of these host target genes, as elaborated hereinbelow.

Nucleotide sequences of the VGAM2538 precursor RNA, herein designated VGAM PRECURSOR RNA, and of the 'diced' VGAM2538 RNA, herein designated VGAM RNA, and a schematic representation of the secondary folding of VGAM2538 folded precursor RNA, herein designated VGAM FOLDED PRECURSOR RNA, of VGAM2538 are further described hereinbelow with reference to Table 1.

Nucleotide sequences of host target binding sites, such as BINDING SITE-I, BINDING SITE-II and BINDING SITE-III of FIG. 1, found on VGAM2538 host target RNA, and schematic representation of the complementarity of each of these host target binding sites to VGAM2538 RNA, herein designated VGAM RNA, are described hereinbelow with reference to Table 2.

As mentioned hereinabove with reference to FIG. 1, a function of VGAM2538 gene, herein designated VGAM is inhibition of expression of VGAM2538 target genes. It is appreciated that specific functions, and accordingly utilities, of VGAM2538 correlate with, and may be deduced from, the identity of the target genes which VGAM2538 binds and inhibits, and the function of these target genes, as elaborated hereinbelow.

Aquaporin 6, Kidney Specific (AQP6, Accession NM_053286) is a VGAM2538 host target gene. AQP6 BINDING SITE is HOST TARGET binding site found in the 5' untranslated region of mRNA encoded by AQP6, corresponding to a HOST TARGET binding site such as BINDING SITE I, BINDING SITE II or BINDING SITE III. Table 2 illustrates the complementarity of the nucleotide sequences of AQP6 BINDING SITE, designated SEQ ID:27615, to the nucleotide sequence of VGAM2538 RNA, herein designated VGAM RNA, also designated SEQ ID:5249.

A function of VGAM2538 is therefore inhibition of Aquaporin 6, Kidney Specific (AQP6, Accession NM_053286), a gene which participates in distinct physiologic function such as glomerular filtration, tubular endocytosis, and acid-base metabolism. Accordingly, utilities of VGAM2538 include diagnosis, prevention and treatment of diseases and clinical conditions associated with AQP6. The function of AQP6 and its association with various diseases and clinical conditions, has been established by previous studies, as described hereinabove with reference to VGAM340. Coagulation Factor VII (serum prothrombin conversion accelerator) (F7, Accession NM_000131) is another VGAM2538 host target gene. F7 BINDING SITE1 and F7 BINDING SITE2 are HOST TARGET binding sites found in untranslated regions of mRNA encoded by F7, corresponding to HOST TARGET binding sites such as BINDING SITE I, BINDING SITE II or BINDING SITE III. Table 2 illustrates the complementarity of the nucleotide sequences of F7 BINDING SITE1 and F7 BINDING SITE2, designated SEQ ID:5611 and SEQ ID:21240 respectively, to the nucleotide sequence of VGAM2538 RNA, herein designated VGAM RNA, also designated SEQ ID:5249.

Another function of VGAM2538 is therefore inhibition of Coagulation Factor VII (serum prothrombin conversion accelerator) (F7, Accession NM_000131). Accordingly, utilities of VGAM2538 include diagnosis, prevention and treatment of diseases and clinical conditions associated with F7. Translin (TSN, Accession NM_004622) is another VGAM2538 host target gene. TSN BINDING SITE is HOST TARGET binding site found in the 3' untranslated region of mRNA encoded by TSN, corresponding to a HOST TARGET binding site such as BINDING SITE I, BINDING SITE II or BINDING SITE III. Table 2 illustrates the complementarity of the nucleotide sequences of TSN BINDING SITE, designated SEQ ID:10983, to the nucleotide sequence of VGAM2538 RNA, herein designated VGAM RNA, also designated SEQ ID:5249.

Another function of VGAM2538 is therefore inhibition of Translin (TSN, Accession NM_004622), a gene which is a DNA binding protein and involved in DNA repair, replication, or recombination. Accordingly, utilities of VGAM2538 include diagnosis, prevention and treatment of diseases and clinical conditions associated with TSN. The function of TSN and its association with various diseases and clinical conditions, has been established by previous studies, as described hereinabove with reference to VGAM98. ARGBP2 (Accession NM_003603) is another VGAM2538 host target gene. ARGBP2 BINDING SITE is HOST TARGET binding site found in the 5' untranslated region of mRNA encoded by ARGBP2, corresponding to a HOST TARGET binding site such as BINDING SITE I, BINDING SITE II or BINDING SITE III. Table 2 illustrates the complementarity of the nucleotide sequences of ARGBP2 BINDING SITE, designated SEQ ID:9659, to the nucleotide sequence of VGAM2538 RNA, herein designated VGAM RNA, also designated SEQ ID:5249.

Another function of VGAM2538 is therefore inhibition of ARGBP2 (Accession NM_003603). Accordingly, utilities of VGAM2538 include diagnosis, prevention and treatment of diseases and clinical conditions associated with ARGBP2. FLJ11800 (Accession NM_024974) is another VGAM2538 host target gene. FLJ11800 BINDING SITE is HOST TARGET binding site found in the 3' untranslated region of mRNA encoded by FLJ11800, corresponding to a HOST TARGET binding site such as BINDING SITE I, BINDING SITE II or BINDING SITE III. Table 2 illustrates the complementarity of the nucleotide sequences of FLJ11800 BINDING SITE, designated SEQ ID:24530, to the nucleotide sequence of VGAM2538 RNA, herein designated VGAM RNA, also designated SEQ ID:5249.

Another function of VGAM2538 is therefore inhibition of FLJ11800 (Accession NM_024974). Accordingly, utilities of VGAM2538 include diagnosis, prevention and treatment of diseases and clinical conditions associated with FLJ11800. FLJ12649 (Accession NM_024597) is another VGAM2538 host target gene. FLJ12649 BINDING SITE is HOST TARGET binding site found in the 3' untranslated region of mRNA encoded by FLJ12649, corresponding to a HOST TARGET binding site such as BINDING SITE I, BINDING SITE II or BINDING SITE III. Table 2 illustrates the complementarity of the nucleotide sequences of FLJ12649 BINDING SITE, designated SEQ ID:23833, to the nucleotide sequence of VGAM2538 RNA, herein designated VGAM RNA, also designated SEQ ID:5249.

Another function of VGAM2538 is therefore inhibition of FLJ12649 (Accession NM_024597). Accordingly, utilities of VGAM2538 include diagnosis, prevention and treatment of diseases and clinical conditions associated with FLJ12649. GREB1 (Accession XM_051545) is another VGAM2538 host target gene. GREB1 BINDING SITE is HOST TARGET binding site found in the 3' untranslated region of mRNA encoded by GREB1, corresponding to a HOST TARGET binding site such as BINDING SITE I, BINDING SITE II or BINDING SITE III. Table 2 illustrates the complementarity of the nucleotide sequences of GREB1 BINDING SITE, designated SEQ ID:35851, to the nucleotide sequence of VGAM2538 RNA, herein designated VGAM RNA, also designated SEQ ID:5249.

Another function of VGAM2538 is therefore inhibition of GREB1 (Accession XM_051545). Accordingly, utilities of VGAM2538 include diagnosis, prevention and treatment of diseases and clinical conditions associated with GREB1. MGC3329 (Accession NM_024086) is another VGAM2538 host target gene. MGC3329 BINDING SITE is HOST TARGET binding site found in the 3' untranslated region of mRNA encoded by MGC3329, corresponding to a HOST TARGET binding site such as BINDING SITE I, BINDING SITE II or BINDING SITE III. Table 2 illustrates the complementarity of the nucleotide sequences of MGC3329 BINDING SITE, designated SEQ ID:23528, to the nucleotide sequence of VGAM2538 RNA, herein designated VGAM RNA, also designated SEQ ID:5249.

Another function of VGAM2538 is therefore inhibition of MGC3329 (Accession NM_024086). Accordingly, utilities of VGAM2538 include diagnosis, prevention and treatment of diseases and clinical conditions associated with MGC3329. S164 (Accession XM_027330) is another VGAM2538 host target gene. S164 BINDING SITE is HOST TARGET binding site found in the 3' untranslated region of mRNA encoded by S164, corresponding to a HOST TARGET binding site such as BINDING SITE I, BINDING SITE II or BINDING SITE III. Table 2 illustrates the complementarity of the nucleotide sequences of S164 BINDING SITE, designated SEQ ID:30482, to the nucleotide sequence of VGAM2538 RNA, herein designated VGAM RNA, also designated SEQ ID:5249.

Another function of VGAM2538 is therefore inhibition of S164 (Accession XM_027330). Accordingly, utilities of VGAM2538 include diagnosis, prevention and treatment of diseases and clinical conditions associated with S164. TNF Receptor-associated Factor 3 (TRAF3, Accession XM_007256) is another VGAM2538 host target gene. TRAF3 BINDING SITE is HOST TARGET binding site found in the 3' untranslated region of mRNA encoded by TRAF3, corresponding to a HOST TARGET binding site such as BINDING SITE I, BINDING SITE II or BINDING SITE III. Table 2 illustrates the complementarity of the nucleotide sequences of TRAF3 BINDING SITE, designated SEQ ID:30040, to the nucleotide sequence of VGAM2538 RNA, herein designated VGAM RNA, also designated SEQ ID:5249.

Another function of VGAM2538 is therefore inhibition of TNF Receptor-associated Factor 3 (TRAF3, Accession XM_007256). Accordingly, utilities of VGAM2538 include diagnosis, prevention and treatment of diseases and clinical conditions associated with TRAF3. LOC220575 (Accession XM_083991) is another VGAM2538 host target gene. LOC220575 BINDING SITE is HOST TARGET binding site found in the 3' untranslated region of mRNA encoded by LOC220575, corresponding to a HOST TARGET binding site such as BINDING SITE I, BINDING SITE II or BINDING SITE III. Table 2 illustrates the complementarity of the nucleotide sequences of LOC220575 BINDING SITE, designated SEQ ID:37528, to the nucleotide sequence of VGAM2538 RNA, herein designated VGAM RNA, also designated SEQ ID:5249.

Another function of VGAM2538 is therefore inhibition of LOC220575 (Accession XM_083991). Accordingly, utilities of VGAM2538 include diagnosis, prevention and treatment of diseases and clinical conditions associated with LOC220575. LOC90593 (Accession XM_032815) is another VGAM2538 host target gene. LOC90593 BINDING SITE is HOST TARGET binding site found in the 3' untranslated region of mRNA encoded by LOC90593, corresponding to a HOST TARGET binding site such as BINDING SITE I, BINDING SITE II or BINDING SITE III. Table 2 illustrates the complementarity of the nucleotide sequences of LOC90593 BINDING SITE, designated SEQ ID:31765, to the nucleotide sequence of VGAM2538 RNA, herein designated VGAM RNA, also designated SEQ ID:5249.

Another function of VGAM2538 is therefore inhibition of LOC90593 (Accession XM_032815). Accordingly, utilities of VGAM2538 include diagnosis, prevention and treatment of diseases and clinical conditions associated with LOC90593. FIG. 1 further provides a conceptual description of a novel bioinformatically detected viral gene of the present invention, referred to here as Viral Genomic Address Messenger 2539 (VGAM2539) viral gene, which modulates expression of respective host target genes thereof, the function and utility of which host target genes is known in the art.

VGAM2539 is a novel bioinformatically detected regulatory, non protein coding, viral micro RNA (miRNA) gene. The method by which VGAM2539 was detected is described hereinabove with reference to FIGS. 1-8.

VGAM2539 gene, herein designated VGAM GENE, is a viral gene contained in the genome of Pestivirus Giraffe-1. VGAM2539 host target gene, herein designated VGAM HOST TARGET GENE, is a human gene contained in the human genome.

VGAM2539 gene encodes a VGAM2539 precursor RNA, herein designated VGAM PRECURSOR RNA. Similar to other miRNA genes, and unlike most ordinary genes, VGAM2539 precursor RNA does not encode a protein. A nucleotide sequence identical or highly similar to the nucleotide sequence of VGAM2539 precursor RNA is designated SEQ ID:2525, and is provided hereinbelow with reference to the sequence listing part. Nucleotide sequence SEQ ID:2525 is located at position 1159 relative to the genome of Pestivirus Giraffe-1.

VGAM2539 precursor RNA folds onto itself, forming VGAM2539 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2539 folded precursor RNA into VGAM2539 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2539 RNA is designated SEQ ID:5250, and is provided hereinbelow with reference to the sequence listing part.

VGAM2539 host target gene, herein designated VGAM HOST TARGET GENE, encodes a corresponding messenger RNA, VGAM2539 host target RNA, herein designated VGAM HOST TARGET RNA. VGAM2539 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2539 RNA, herein designated VGAM RNA, binds complementarily to one or more host target binding sites located in untranslated regions of VGAM2539 host target RNA, herein designated VGAM HOST TARGET RNA. This complementary binding is due to the fact that the nucleotide sequence of VGAM2539 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2539 RNA, herein designated VGAM RNA, may have a different number of host target binding sites in untranslated regions of a VGAM2539 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2539 RNA, herein designated VGAM RNA, to host target binding sites on VGAM2539 host target RNA, herein designated VGAM HOST TARGET RNA, such as BINDING SITE I, BINDING SITE II and BINDING SITE III, inhibits translation of VGAM2539 host target RNA into VGAM2539 host target protein, herein designated VGAM HOST TARGET PROTEIN. VGAM host target protein is therefore outlined by a broken line.

It is appreciated that VGAM2539 host target gene, herein designated VGAM HOST TARGET GENE, in fact represents a plurality of VGAM2539 host target genes. The mRNA of each one of this plurality of VGAM2539 host target genes comprises one or more host target binding sites, each having a nucleotide sequence which is at least partly complementary to VGAM2539 RNA, herein designated VGAM RNA, and which when bound by VGAM2539 RNA causes inhibition of translation of respective one or more VGAM2539 host target proteins.

It is further appreciated by one skilled in the art that the mode of translational inhibition illustrated by FIG. 1 with specific reference to translational inhibition exerted by VGAM2539 gene, herein designated VGAM GENE, on one or more VGAM2539 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2539 is inhibition of expression of host target genes, as part of a novel viral mechanism of attacking a host. Accordingly, utilities of VGAM2539 include diagnosis, prevention and treatment of viral infection by Pestivirus Giraffe-1. Specific functions, and accordingly utilities, of VGAM2539 correlate with, and may be deduced from, the identity of the host target genes which VGAM2539 binds and inhibits, and the function of these host target genes, as elaborated hereinbelow.

Nucleotide sequences of the VGAM2539 precursor RNA, herein designated VGAM PRECURSOR RNA, and of the 'diced' VGAM2539 RNA, herein designated VGAM RNA, and a schematic representation of the secondary folding of VGAM2539 folded precursor RNA, herein designated VGAM FOLDED PRECURSOR RNA, of VGAM2539 are further described hereinbelow with reference to Table 1.

Nucleotide sequences of host target binding sites, such as BINDING SITE-I, BINDING SITE-II and BINDING SITE-III of FIG. 1, found on VGAM2539 host target RNA, and schematic representation of the complementarity of each of these host target binding sites to VGAM2539 RNA, herein designated VGAM RNA, are described hereinbelow with reference to Table 2.

As mentioned hereinabove with reference to FIG. 1, a function of VGAM2539 gene, herein designated VGAM is inhibition of expression of VGAM2539 target genes. It is appreciated that specific functions, and accordingly utilities, of VGAM2539 correlate with, and may be deduced from, the identity of the target genes which VGAM2539 binds and inhibits, and the function of these target genes, as elaborated hereinbelow.

Adenosine Deaminase, RNA-specific (ADAR, Accession NM_001111) is a VGAM2539 host target gene. ADAR BINDING SITE1 through ADAR BINDING SITE3 are HOST TARGET binding sites found in untranslated regions of mRNA encoded by ADAR, corresponding to HOST TARGET binding sites such as BINDING SITE I, BINDING SITE II or BINDING SITE III. Table 2 illustrates the complementarity of the nucleotide sequences of ADAR BINDING SITE1 through ADAR BINDING SITE3, designated SEQ ID:6775, SEQ ID:17961 and SEQ ID:17968 respectively, to the nucleotide sequence of VGAM2539 RNA, herein designated VGAM RNA, also designated SEQ ID:5250.

A function of VGAM2539 is therefore inhibition of Adenosine Deaminase, RNA-specific (ADAR, Accession NM_001111), a gene which converts adenosine to inosine in double-stranded RNA. Accordingly, utilities of VGAM2539 include diagnosis, prevention and treatment of diseases and clinical conditions associated with ADAR. The function of ADAR and its association with various diseases and clinical conditions, has been established by previous studies, as described hereinabove with reference to VGAM323. CXYorf1 (Accession XM_088704) is another VGAM2539 host target gene. CXYorf1 BINDING SITE is HOST TARGET binding site found in the 3' untranslated region of mRNA encoded by CXYorf1, corresponding to a HOST TARGET binding site such as BINDING SITE I, BINDING SITE II or BINDING SITE III. Table 2 illustrates the complementarity of the nucleotide sequences of CXYorf1 BINDING SITE, designated SEQ ID:39907, to the nucleotide sequence of VGAM2539 RNA, herein designated VGAM RNA, also designated SEQ ID:5250.

Another function of VGAM2539 is therefore inhibition of CXYorf1 (Accession XM_088704). Accordingly, utilities of VGAM2539 include diagnosis, prevention and treatment of diseases and clinical conditions associated with CXYorf1. Eukaryotic Translation Initiation Factor 4 Gamma, 3 (EIF4G3, Accession NM_003760) is another VGAM2539 host target gene. EIF4G3 BINDING SITE is HOST TARGET binding site found in the 5' untranslated region of mRNA encoded by EIF4G3, corresponding to a HOST TARGET binding site such as BINDING SITE I, BINDING SITE II or BINDING SITE III. Table 2 illustrates the complementarity of the nucleotide sequences of EIF4G3 BINDING SITE, designated SEQ ID:9841, to the nucleotide sequence of VGAM2539 RNA, herein designated VGAM RNA, also designated SEQ ID:5250.

Another function of VGAM2539 is therefore inhibition of Eukaryotic Translation Initiation Factor 4 Gamma, 3 (EIF4G3, Accession NM_003760). Accordingly, utilities of VGAM2539 include diagnosis, prevention and treatment of diseases and clinical conditions associated with EIF4G3. FLJ20584 (Accession NM_017891) is another VGAM2539 host target gene. FLJ20584 BINDING SITE is HOST TARGET binding site found in the 3' untranslated region of mRNA encoded by FLJ20584, corresponding to a HOST TARGET binding site such as BINDING SITE I, BINDING SITE II or BINDING SITE III. Table 2 illustrates the complementarity of the nucleotide sequences of FLJ20584 BINDING SITE, designated SEQ ID:19560, to the nucleotide sequence of VGAM2539 RNA, herein designated VGAM RNA, also designated SEQ ID:5250.

Another function of VGAM2539 is therefore inhibition of FLJ20584 (Accession NM_017891). Accordingly, utilities of VGAM2539 include diagnosis, prevention and treatment of diseases and clinical conditions associated with FLJ20584. FLJ22390 (Accession NM_022746) is another VGAM2539 host target gene. FLJ22390 BINDING SITE is HOST TARGET binding site found in the 3' untranslated region of mRNA encoded by FLJ22390, corresponding to a HOST TARGET binding site such as BINDING SITE I, BINDING SITE II or BINDING SITE III. Table 2 illustrates the complementarity of the nucleotide sequences of FLJ22390 BINDING SITE, designated SEQ ID:22957, to the nucleotide sequence of VGAM2539 RNA, herein designated VGAM RNA, also designated SEQ ID:5250.

Another function of VGAM2539 is therefore inhibition of FLJ22390 (Accession NM_022746). Accordingly, utilities of VGAM2539 include diagnosis, prevention and treatment of diseases and clinical conditions associated with FLJ22390. KIAA1453 (Accession NM_025090) is another VGAM2539 host target gene. KIAA1453 BINDING SITE is HOST TARGET binding site found in the 3' untranslated region of mRNA encoded by KIAA1453, corresponding to a HOST TARGET binding site such as BINDING SITE I, BINDING SITE II or BINDING SITE III. Table 2 illustrates the complementarity of the nucleotide sequences of KIAA1453 BINDING SITE, designated SEQ ID:24714, to the nucleotide sequence of VGAM2539 RNA, herein designated VGAM RNA, also designated SEQ ID:5250.

Another function of VGAM2539 is therefore inhibition of KIAA1453 (Accession NM_025090). Accordingly, utilities of VGAM2539 include diagnosis, prevention and treatment of diseases and clinical conditions associated with KIAA1453. MGC14859 (Accession XM_030295) is another VGAM2539 host target gene. MGC14859 BINDING SITE is HOST TARGET binding site found in the 3' untranslated region of mRNA encoded by MGC14859, corresponding to a HOST TARGET binding site such as BINDING SITE I, BINDING SITE II or BINDING SITE III. Table 2 illustrates the complementarity of the nucleotide sequences of MGC14859 BINDING SITE, designated SEQ ID:31005, to the nucleotide sequence of VGAM2539 RNA, herein designated VGAM RNA, also designated SEQ ID:5250.

Another function of VGAM2539 is therefore inhibition of MGC14859 (Accession XM_030295). Accordingly, utilities of VGAM2539 include diagnosis, prevention and treatment of diseases and clinical conditions associated with MGC14859. PRO1048 (Accession NM_018497) is another VGAM2539 host target gene. PRO1048 BINDING SITE is HOST TARGET binding site found in the 3' untranslated region of mRNA encoded by PRO1048, corresponding to a HOST TARGET binding site such as BINDING SITE I, BINDING SITE II or BINDING SITE III. Table 2 illustrates the complementarity of the nucleotide sequences of PRO1048 BINDING SITE, designated SEQ ID:20559, to the nucleotide sequence of VGAM2539 RNA, herein designated VGAM RNA, also designated SEQ ID:5250.

Another function of VGAM2539 is therefore inhibition of PRO1048 (Accession NM_018497). Accordingly, utilities of VGAM2539 include diagnosis, prevention and treatment of diseases and clinical conditions associated with PRO1048. RPH3A (Accession NM_014954) is another VGAM2539 host target gene. RPH3A BINDING SITE is HOST TARGET binding site found in the 3' untranslated region of mRNA encoded by RPH3A, corresponding to a HOST TARGET binding site such as BINDING SITE I, BINDING SITE II or BINDING SITE III. Table 2 illustrates the complementarity of the nucleotide sequences of RPH3A BINDING SITE, designated SEQ ID:17306, to the nucleotide sequence of VGAM2539 RNA, herein designated VGAM RNA, also designated SEQ ID:5250.

Another function of VGAM2539 is therefore inhibition of RPH3A (Accession NM_014954). Accordingly, utilities of VGAM2539 include diagnosis, prevention and treatment of diseases and clinical conditions associated with RPH3A. Syntaphilin (SNPH, Accession NM_014723) is another VGAM2539 host target gene. SNPH BINDING SITE is HOST TARGET binding site found in the 3' untranslated region of mRNA encoded by SNPH, corresponding to a HOST TARGET binding site such as BINDING SITE I, BINDING SITE II or BINDING SITE III. Table 2 illustrates the complementarity of the nucleotide sequences of SNPH BINDING SITE, designated SEQ ID:16293, to the nucleotide sequence of VGAM2539 RNA, herein designated VGAM RNA, also designated SEQ ID:5250.

Another function of VGAM2539 is therefore inhibition of Syntaphilin (SNPH, Accession NM_014723). Accordingly, utilities of VGAM2539 include diagnosis, prevention and treatment of diseases and clinical conditions associated with SNPH. SPEC1 (Accession NM_020239) is another VGAM2539 host target gene. SPEC1 BINDING SITE is HOST TARGET binding site found in the 3' untranslated region of mRNA encoded by SPEC1, corresponding to a HOST TARGET binding site such as BINDING SITE I, BINDING SITE II or BINDING SITE III. Table 2 illustrates the complementarity of the nucleotide sequences of SPEC1 BINDING SITE, designated SEQ ID:21511, to the nucleotide sequence of VGAM2539 RNA, herein designated VGAM RNA, also designated SEQ ID:5250.

Another function of VGAM2539 is therefore inhibition of SPEC1 (Accession NM_020239). Accordingly, utilities of VGAM2539 include diagnosis, prevention and treatment of diseases and clinical conditions associated with SPEC1. Zinc Finger Protein 300 (ZNF300, Accession NM_052860) is another VGAM2539 host target gene. ZNF300 BINDING SITE is HOST TARGET binding site found in the 5' untranslated region of mRNA encoded by ZNF300, corresponding to a HOST TARGET binding site such as BINDING SITE I, BINDING SITE II or BINDING SITE III. Table 2 illustrates the complementarity of the nucleotide sequences of ZNF300 BINDING SITE, designated SEQ ID:27440, to the nucleotide sequence of VGAM2539 RNA, herein designated VGAM RNA, also designated SEQ ID:5250.

Another function of VGAM2539 is therefore inhibition of Zinc Finger Protein 300 (ZNF300, Accession NM_052860). Accordingly, utilities of VGAM2539 include diagnosis, prevention and treatment of diseases and clinical conditions associated with ZNF300. LOC146756 (Accession XM_097085) is another VGAM2539 host target gene. LOC146756 BINDING SITE is HOST TARGET binding site found in the 3' untranslated region of mRNA encoded by LOC146756, corresponding to a HOST TARGET binding site such as BINDING SITE I, BINDING SITE II or BINDING SITE III. Table 2 illustrates the complementarity of the nucleotide sequences of LOC146756 BINDING SITE, designated SEQ ID:40737, to the nucleotide sequence of VGAM2539 RNA, herein designated VGAM RNA, also designated SEQ ID:5250.

Another function of VGAM2539 is therefore inhibition of LOC146756 (Accession XM_097085). Accordingly, utilities of VGAM2539 include diagnosis, prevention and treatment of diseases and clinical conditions associated with LOC146756. LOC92661 (Accession XM_046465) is another VGAM2539 host target gene. LOC92661 BINDING SITE is HOST TARGET binding site found in the 3' untranslated region of mRNA encoded by LOC92661, corresponding to a HOST TARGET binding site such as BINDING SITE I, BINDING SITE II or BINDING SITE III. Table 2 illustrates the complementarity of the nucleotide sequences of LOC92661 BINDING SITE, designated SEQ ID:34722, to the nucleotide sequence of VGAM2539 RNA, herein designated VGAM RNA, also designated SEQ ID:5250.

Another function of VGAM2539 is therefore inhibition of LOC92661 (Accession XM_046465). Accordingly, utilities of VGAM2539 include diagnosis, prevention and treatment of diseases and clinical conditions associated with LOC92661. FIG. 1 further provides a conceptual description of a novel bioinformatically detected viral gene of the present invention, referred to here as Viral Genomic Address Messenger 2540 (VGAM2540) viral gene, which modulates expression of respective host target genes thereof, the function and utility of which host target genes is known in the art.

VGAM2540 is a novel bioinformatically detected regulatory, non protein coding, viral micro RNA (miRNA) gene. The method by which VGAM2540 was detected is described hereinabove with reference to FIGS. 1-8.

VGAM2540 gene, herein designated VGAM GENE, is a viral gene contained in the genome of Pestivirus Giraffe-1.

VGAM2540 host target gene, herein designated VGAM HOST TARGET GENE, is a human gene contained in the human genome.

VGAM2540 gene encodes a VGAM2540 precursor RNA, herein designated VGAM PRECURSOR RNA. Similar to other miRNA genes, and unlike most ordinary genes, VGAM2540 precursor RNA does not encode a protein. A nucleotide sequence identical or highly similar to the nucleotide sequence of VGAM2540 precursor RNA is designated SEQ ID:2526, and is provided hereinbelow with reference to the sequence listing part. Nucleotide sequence SEQ ID:2526 is located at position 4480 relative to the genome of Pestivirus Giraffe-1.

VGAM2540 precursor RNA folds onto itself, forming VGAM2540 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2540 folded precursor RNA into VGAM2540 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2540 RNA is designated SEQ ID:5251, and is provided hereinbelow with reference to the sequence listing part.

VGAM2540 host target gene, herein designated VGAM HOST TARGET GENE, encodes a corresponding messenger RNA, VGAM2540 host target RNA, herein designated VGAM HOST TARGET RNA. VGAM2540 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2540 RNA, herein designated VGAM RNA, binds complementarily to one or more host target binding sites located in untranslated regions of VGAM2540 host target RNA, herein designated VGAM HOST TARGET RNA. This complementary binding is due to the fact that the nucleotide sequence of VGAM2540 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2540 RNA, herein designated VGAM RNA, may have a different number of host target binding sites in untranslated regions of a VGAM2540 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2540 RNA, herein designated VGAM RNA, to host target binding sites on VGAM2540 host target RNA, herein designated VGAM HOST TARGET RNA, such as BINDING SITE I, BINDING SITE II and BINDING SITE III, inhibits translation of VGAM2540 host target RNA into VGAM2540 host target protein, herein designated VGAM HOST TARGET PROTEIN. VGAM host target protein is therefore outlined by a broken line.

It is appreciated that VGAM2540 host target gene, herein designated VGAM HOST TARGET GENE, in fact represents a plurality of VGAM2540 host target genes. The mRNA of each one of this plurality of VGAM2540 host target genes comprises one or more host target binding sites, each having a nucleotide sequence which is at least partly complementary to VGAM2540 RNA, herein designated VGAM RNA, and which when bound by VGAM2540 RNA causes inhibition of translation of respective one or more VGAM2540 host target proteins.

It is further appreciated by one skilled in the art that the mode of translational inhibition illustrated by FIG. 1 with specific reference to translational inhibition exerted by VGAM2540 gene, herein designated VGAM GENE, on one or more VGAM2540 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2540 is inhibition of expression of host target genes, as part of a novel viral mechanism of attacking a host. Accordingly, utilities of VGAM2540 include diagnosis, prevention and treatment of viral infection by Pestivirus Giraffe-1. Specific functions, and accordingly utilities, of VGAM2540 correlate with, and may be deduced from, the identity of the host target genes which VGAM2540 binds and inhibits, and the function of these host target genes, as elaborated hereinbelow.

Nucleotide sequences of the VGAM2540 precursor RNA, herein designated VGAM PRECURSOR RNA, and of the 'diced' VGAM2540 RNA, herein designated VGAM RNA, and a schematic representation of the secondary folding of VGAM2540 folded precursor RNA, herein designated VGAM FOLDED PRECURSOR RNA, of VGAM2540 are further described hereinbelow with reference to Table 1.

Nucleotide sequences of host target binding sites, such as BINDING SITE-I, BINDING SITE-II and BINDING SITE-III of FIG. 1, found on VGAM2540 host target RNA, and schematic representation of the complementarity of each of these host target binding sites to VGAM2540 RNA, herein designated VGAM RNA, are described hereinbelow with reference to Table 2.

As mentioned hereinabove with reference to FIG. 1, a function of VGAM2540 gene, herein designated VGAM is inhibition of expression of VGAM2540 target genes. It is appreciated that specific functions, and accordingly utilities, of VGAM2540 correlate with, and may be deduced from, the identity of the target genes which VGAM2540 binds and inhibits, and the function of these target genes, as elaborated hereinbelow.

FLJ13659 (Accession NM_025189) is a VGAM2540 host target gene. FLJ13659 BINDING SITE is HOST TARGET binding site found in the 5' untranslated region of mRNA encoded by FLJ13659, corresponding to a HOST TARGET binding site such as BINDING SITE I, BINDING SITE II or BINDING SITE III. Table 2 illustrates the complementarity of the nucleotide sequences of FLJ13659 BINDING SITE, designated SEQ ID:24833, to the nucleotide sequence of VGAM2540 RNA, herein designated VGAM RNA, also designated SEQ ID:5251.

A function of VGAM2540 is therefore inhibition of FLJ13659 (Accession NM_025189). Accordingly, utilities of VGAM2540 include diagnosis, prevention and treatment of diseases and clinical conditions associated with FLJ13659. FIG. 1 further provides a conceptual description of a novel bioinformatically detected viral gene of the present invention, referred to here as Viral Genomic Address Messenger 2541 (VGAM2541) viral gene, which modulates expression of respective host target genes thereof, the function and utility of which host target genes is known in the art.

VGAM2541 is a novel bioinformatically detected regulatory, non protein coding, viral micro RNA (miRNA) gene. The method by which VGAM2541 was detected is described hereinabove with reference to FIGS. 1-8.

VGAM2541 gene, herein designated VGAM GENE, is a viral gene contained in the genome of Langat Virus. VGAM2541 host target gene, herein designated VGAM HOST TARGET GENE, is a human gene contained in the human genome.

VGAM2541 gene encodes a VGAM2541 precursor RNA, herein designated VGAM PRECURSOR RNA. Similar to other miRNA genes, and unlike most ordinary genes, VGAM2541 precursor RNA does not encode a protein. A nucleotide sequence identical or highly similar to the nucleotide sequence of VGAM2541 precursor RNA is designated SEQ ID:2527, and is provided hereinbelow with reference to the sequence listing part. Nucleotide sequence SEQ ID:2527 is located at position 1698 relative to the genome of Langat Virus.

VGAM2541 precursor RNA folds onto itself, forming VGAM2541 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2541 folded precursor RNA into VGAM2541 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2541 RNA is designated SEQ ID:5252, and is provided hereinbelow with reference to the sequence listing part.

VGAM2541 host target gene, herein designated VGAM HOST TARGET GENE, encodes a corresponding messenger RNA, VGAM2541 host target RNA, herein designated VGAM HOST TARGET RNA. VGAM2541 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2541 RNA, herein designated VGAM RNA, binds complementarily to one or more host target binding sites located in untranslated regions of VGAM2541 host target RNA, herein designated VGAM HOST TARGET RNA. This complementary binding is due to the fact that the nucleotide sequence of VGAM2541 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2541 RNA, herein designated VGAM RNA, may have a different number of host target binding sites in untranslated regions of a VGAM2541 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2541 RNA, herein designated VGAM RNA, to host target binding sites on VGAM2541 host target RNA, herein designated VGAM HOST TARGET RNA, such as BINDING SITE I, BINDING SITE II and BINDING SITE III, inhibits translation of VGAM2541 host target RNA into VGAM2541 host target protein, herein designated VGAM HOST TARGET PROTEIN. VGAM host target protein is therefore outlined by a broken line.

It is appreciated that VGAM2541 host target gene, herein designated VGAM HOST TARGET GENE, in fact represents a plurality of VGAM2541 host target genes. The mRNA of each one of this plurality of VGAM2541 host target genes comprises one or more host target binding sites, each having a nucleotide sequence which is at least partly complementary to VGAM2541 RNA, herein designated VGAM RNA, and which when bound by VGAM2541 RNA causes inhibition of translation of respective one or more VGAM2541 host target proteins.

It is further appreciated by one skilled in the art that the mode of translational inhibition illustrated by FIG. 1 with specific reference to translational inhibition exerted by VGAM2541 gene, herein designated VGAM GENE, on one or more VGAM2541 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2541 is inhibition of expression of host target genes, as part of a novel viral mechanism of attacking a host. Accordingly, utilities of VGAM2541 include diagnosis, prevention and treatment of viral infection by Langat Virus. Specific functions, and accordingly utilities, of VGAM2541 correlate with, and may be deduced from, the identity of the host target genes which VGAM2541 binds and inhibits, and the function of these host target genes, as elaborated hereinbelow.

Nucleotide sequences of the VGAM2541 precursor RNA, herein designated VGAM PRECURSOR RNA, and of the 'diced' VGAM2541 RNA, herein designated VGAM RNA, and a schematic representation of the secondary folding of VGAM2541 folded precursor RNA, herein designated VGAM FOLDED PRECURSOR RNA, of VGAM2541 are further described hereinbelow with reference to Table 1.

Nucleotide sequences of host target binding sites, such as BINDING SITE-I, BINDING SITE-II and BINDING SITE-III of FIG. 1, found on VGAM2541 host target RNA, and schematic representation of the complementarity of each of these host target binding sites to VGAM2541 RNA, herein designated VGAM RNA, are described hereinbelow with reference to Table 2.

As mentioned hereinabove with reference to FIG. 1, a function of VGAM2541 gene, herein designated VGAM is inhibition of expression of VGAM2541 target genes. It is appreciated that specific functions, and accordingly utilities, of VGAM2541 correlate with, and may be deduced from, the identity of the target genes which VGAM2541 binds and inhibits, and the function of these target genes, as elaborated hereinbelow.

Sel-1 Suppressor of Lin-12-like (C. elegans) (SEL1L, Accession NM_005065) is a VGAM2541 host target gene. SEL1L BINDING SITE is HOST TARGET binding site found in the 3' untranslated region of mRNA encoded by SEL1L, corresponding to a HOST TARGET binding site such as BINDING SITE I, BINDING SITE II or BINDING SITE III. Table 2 illustrates the complementarity of the nucleotide sequences of SEL1L BINDING SITE, designated SEQ ID:11501, to the nucleotide sequence of VGAM2541 RNA, herein designated VGAM RNA, also designated SEQ ID:5252.

A function of VGAM2541 is therefore inhibition of Sel-1 Suppressor of Lin-12-like (C. elegans) (SEL1L, Accession NM_005065), a gene which may play a role in notch signaling (by similarity). Accordingly, utilities of VGAM2541 include diagnosis, prevention and treatment of diseases and clinical conditions associated with SEL1L. The function of SEL1L and its association with various diseases and clinical conditions, has been established by previous studies, as described hereinabove with reference to VGAM245. DKFZP434E2135 (Accession NM_030804) is another VGAM2541 host target gene. DKFZP434E2135 BINDING SITE is HOST TARGET binding site found in the 3' untranslated region of mRNA encoded by DKFZP434E2135, corresponding to a HOST TARGET binding site such as BINDING SITE I, BINDING SITE II or BINDING SITE III. Table 2 illustrates the complementarity of the nucleotide sequences of DKFZP434E2135 BINDING SITE, designated SEQ ID:25114, to the nucleotide sequence of VGAM2541 RNA, herein designated VGAM RNA, also designated SEQ ID:5252.

Another function of VGAM2541 is therefore inhibition of DKFZP434E2135 (Accession NM_030804). Accordingly, utilities of VGAM2541 include diagnosis, prevention and treatment of diseases and clinical conditions associated with DKFZP434E2135. FLJ20958 (Accession NM_022102) is another VGAM2541 host target gene. FLJ20958 BINDING SITE is HOST TARGET binding site found in the 3' untranslated region of mRNA encoded by FLJ20958, corresponding to a HOST TARGET binding site such as BINDING SITE I, BINDING SITE II or BINDING SITE III. Table 2 illustrates the complementarity of the nucleotide sequences of FLJ20958 BINDING SITE, designated SEQ ID:22646, to the nucleotide sequence of VGAM2541 RNA, herein designated VGAM RNA, also designated SEQ ID:5252.

Another function of VGAM2541 is therefore inhibition of FLJ20958 (Accession NM_022102). Accordingly, utilities of VGAM2541 include diagnosis, prevention and treatment of diseases and clinical conditions associated with FLJ20958. FLJ22833 (Accession NM_022837) is another VGAM2541 host target gene. FLJ22833 BINDING SITE is HOST TARGET binding site found in the 3' untranslated region of mRNA encoded by FLJ22833, corresponding to a HOST TARGET binding site such as BINDING SITE I, BINDING SITE II or BINDING SITE III. Table 2 illustrates the complementarity of the nucleotide sequences of FLJ22833 BINDING SITE, designated SEQ ID:23121, to the nucleotide sequence of VGAM2541 RNA, herein designated VGAM RNA, also designated SEQ ID:5252.

Another function of VGAM2541 is therefore inhibition of FLJ22833 (Accession NM_022837). Accordingly, utilities of VGAM2541 include diagnosis, prevention and treatment of diseases and clinical conditions associated with FLJ22833. Glutamate Receptor, Ionotropic, N-methyl-D-aspartate 3A (GRIN3A, Accession NM_133445) is another VGAM2541 host target gene. GRIN3A BINDING SITE is HOST TARGET binding site found in the 3' untranslated region of mRNA encoded by GRIN3A, corresponding to a HOST TARGET binding site such as BINDING SITE I, BINDING SITE II or BINDING SITE III. Table 2 illustrates the complementarity of the nucleotide sequences of GRIN3A BINDING SITE, designated SEQ ID:28528, to the nucleotide sequence of VGAM2541 RNA, herein designated VGAM RNA, also designated SEQ ID:5252.

Another function of VGAM2541 is therefore inhibition of Glutamate Receptor, Ionotropic, N-methyl-D-aspartate 3A (GRIN3A, Accession NM_133445). Accordingly, utilities of VGAM2541 include diagnosis, prevention and treatment of diseases and clinical conditions associated with GRIN3A. KIAA0240 (Accession XM_166479) is another VGAM2541 host target gene. KIAA0240 BINDING SITE is HOST TARGET binding site found in the 3" untranslated region of mRNA encoded by KIAA0240, corresponding to a HOST TARGET binding site such as BINDING SITE I, BINDING SITE II or BINDING SITE III. Table 2 illustrates the complementarity of the nucleotide sequences of KIAA0240 BINDING SITE, designated SEQ ID:44405, to the nucleotide sequence of VGAM2541 RNA, herein designated VGAM RNA, also designated SEQ ID:5252.

Another function of VGAM2541 is therefore inhibition of KIAA0240 (Accession XM_166479). Accordingly, utilities of VGAM2541 include diagnosis, prevention and treatment of diseases and clinical conditions associated with KIAA0240. KIAA1247 (Accession XM_030036) is another VGAM2541 host target gene. KIAA1247 BINDING SITE is HOST TARGET binding site found in the 3' untranslated region of mRNA encoded by KIAA1247, corresponding to a HOST TARGET binding site such as BINDING SITE I, BINDING SITE II or BINDING SITE III. Table 2 illustrates the complementarity of the nucleotide sequences of KIAA1247 BINDING SITE, designated SEQ ID:30987, to the nucleotide sequence of VGAM2541 RNA, herein designated VGAM RNA, also designated SEQ ID:5252.

Another function of VGAM2541 is therefore inhibition of KIAA1247 (Accession XM_030036). Accordingly, utilities of VGAM2541 include diagnosis, prevention and treatment of diseases and clinical conditions associated with KIAA1247. KIAA1944 (Accession XM_062545) is another VGAM2541 host target gene. KIAA1944 BINDING SITE is HOST TARGET binding site found in the 5' untranslated region of mRNA encoded by KIAA1944, corresponding to a HOST TARGET binding site such as BINDING SITE I, BINDING SITE II or BINDING SITE III. Table 2 illustrates the complementarity of the nucleotide sequences of KIAA1944 BINDING SITE, designated SEQ ID:37225, to the nucleotide sequence of VGAM2541 RNA, herein designated VGAM RNA, also designated SEQ ID:5252.

Another function of VGAM2541 is therefore inhibition of KIAA1944 (Accession XM_062545). Accordingly, utilities of VGAM2541 include diagnosis, prevention and treatment of diseases and clinical conditions associated with KIAA1944. LBP-9 (Accession NM_014553) is another VGAM2541 host target gene. LBP-9 BINDING SITE is HOST TARGET binding site found in the 3' untranslated region of mRNA encoded by LBP-9, corresponding to a HOST TARGET binding site such as BINDING SITE I, BINDING SITE II or BINDING SITE III. Table 2 illustrates the complementarity of the nucleotide sequences of LBP-9 BINDING SITE, designated SEQ ID:15874, to the nucleotide sequence of VGAM2541 RNA, herein designated VGAM RNA, also designated SEQ ID:5252.

Another function of VGAM2541 is therefore inhibition of LBP-9 (Accession NM_014553). Accordingly, utilities of VGAM2541 include diagnosis, prevention and treatment of diseases and clinical conditions associated with LBP-9. RAI (Accession NM_006663) is another VGAM2541 host target gene. RAI BINDING SITE is HOST TARGET binding site found in the 5' untranslated region of mRNA encoded by RAI, corresponding to a HOST TARGET binding site such as BINDING SITE I, BINDING SITE II or BINDING SITE III. Table 2 illustrates the complementarity of the nucleotide sequences of RAI BINDING SITE, designated SEQ ID:13467, to the nucleotide sequence of VGAM2541 RNA, herein designated VGAM RNA, also designated SEQ ID:5252.

Another function of VGAM2541 is therefore inhibition of RAI (Accession NM_006663). Accordingly, utilities of VGAM2541 include diagnosis, prevention and treatment of diseases and clinical conditions associated with RAI. RES4-25 (Accession XM_035572) is another VGAM2541 host target gene. RES4-25 BINDING SITE is HOST TARGET binding site found in the 3' untranslated region of mRNA encoded by RES4-25, corresponding to a HOST TARGET binding site such as BINDING SITE I, BINDING SITE II or BINDING SITE III. Table 2 illustrates the complementarity of the nucleotide sequences of RES4-25 BINDING SITE, designated SEQ ID:32286, to the nucleotide sequence of VGAM2541 RNA, herein designated VGAM RNA, also designated SEQ ID:5252.

Another function of VGAM2541 is therefore inhibition of RES4-25 (Accession XM_035572). Accordingly, utilities of VGAM2541 include diagnosis, prevention and treatment of diseases and clinical conditions associated with RES4-25. Syndecan 3 (N-syndecan) (SDC3, Accession NM_014654) is another VGAM2541 host target gene. SDC3 BINDING SITE is HOST TARGET binding site found in the 3' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16075, to the nucleotide sequence of VGAM2541 RNA, herein designated VGAM RNA, also designated SEQ ID:5252.

Another function of VGAM2541 is therefore inhibition of Syndecan 3 (N-syndecan) (SDC3, Accession NM_014654). Accordingly, utilities of VGAM2541 include diagnosis, prevention and treatment of diseases and clinical conditions associated with SDC3. Tumor Protein P53 Inducible Nuclear Protein 1 (TP53INP1, Accession NM_033285) is another VGAM2541 host target gene. TP53INP1 BINDING SITE1 and TP53INP1 BINDING SITE2 are HOST TARGET binding sites found in untranslated regions of mRNA encoded by TP53INP1, corresponding to HOST TARGET binding sites such as BINDING SITE I, BINDING SITE II or BINDING SITE III. Table 2 illustrates the complementarity of the nucleotide sequences of TP53INP1 BINDING SITE1 and TP53INP1 BINDING SITE2, designated SEQ ID:27102 and SEQ ID:36113 respectively, to the nucleotide sequence of VGAM2541 RNA, herein designated VGAM RNA, also designated SEQ ID:5252.

Another function of VGAM2541 is therefore inhibition of Tumor Protein P53 Inducible Nuclear Protein 1 (TP53INP1, Accession NM_033285). Accordingly, utilities of VGAM2541 include diagnosis, prevention and treatment of diseases and clinical conditions associated with TP53INP1. LOC144563 (Accession XM_084897) is another VGAM2541 host target gene. LOC144563 BINDING SITE is HOST TARGET binding site found in the 5' untranslated region of mRNA encoded by LOC144563, corresponding to a HOST TARGET binding site such as BINDING SITE I, BINDING SITE II or BINDING SITE III. Table 2 illustrates the complementarity of the nucleotide sequences of LOC144563 BINDING SITE, designated SEQ ID:37766, to the nucleotide sequence of VGAM2541 RNA, herein designated VGAM RNA, also designated SEQ ID:5252.

Another function of VGAM2541 is therefore inhibition of LOC144563 (Accession XM_084897). Accordingly, utilities of VGAM2541 include diagnosis, prevention and treatment of diseases and clinical conditions associated with LOC144563. LOC146780 (Accession XM_097086) is another VGAM2541 host target gene. LOC146780 BINDING SITE is HOST TARGET binding site found in the 5' untranslated region of mRNA encoded by LOC146780, corresponding to a HOST TARGET binding site such as BINDING SITE I, BINDING SITE II or BINDING SITE III. Table 2 illustrates the complementarity of the nucleotide sequences of LOC146780 BINDING SITE, designated SEQ ID:40742, to the nucleotide sequence of VGAM2541 RNA, herein designated VGAM RNA, also designated SEQ ID:5252.

Another function of VGAM2541 is therefore inhibition of LOC146780 (Accession XM_097086). Accordingly, utilities of VGAM2541 include diagnosis, prevention and treatment of diseases and clinical conditions associated with LOC146780. LOC151632 (Accession XM_098098) is another VGAM2541 host target gene. LOC151632 BINDING SITE is HOST TARGET binding site found in the 5' untranslated region of mRNA encoded by LOC151632, corresponding to a HOST TARGET binding site such as BINDING SITE I, BINDING SITE II or BINDING SITE III. Table 2 illustrates the complementarity of the nucleotide sequences of LOC151632 BINDING SITE, designated SEQ ID:41381, to the nucleotide sequence of VGAM2541 RNA, herein designated VGAM RNA, also designated SEQ ID:5252.

Another function of VGAM2541 is therefore inhibition of LOC151632 (Accession XM_098098). Accordingly, utilities of VGAM2541 include diagnosis, prevention and treatment of diseases and clinical conditions associated with LOC151632. LOC161829 (Accession XM_091161) is another VGAM2541 host target gene. LOC161829 BINDING SITE is HOST TARGET binding site found in the 5' untranslated region of mRNA encoded by LOC161829, corresponding to a HOST TARGET binding site such as BINDING SITE I, BINDING SITE II or BINDING SITE III. Table 2 illustrates the complementarity of the nucleotide sequences of LOC161829 BINDING SITE, designated SEQ ID:40037, to the nucleotide sequence of VGAM2541 RNA, herein designated VGAM RNA, also designated SEQ ID:5252.

Another function of VGAM2541 is therefore inhibition of LOC161829 (Accession XM_091161). Accordingly, utilities of VGAM2541 include diagnosis, prevention and treatment of diseases and clinical conditions associated with LOC161829. LOC164714 (Accession XM_104657) is another VGAM2541 host target gene. LOC164714 BIND- ING SITE is HOST TARGET binding site found in the 3' untranslated region of mRNA encoded by LOC164714, corresponding to a HOST TARGET binding site such as BINDING SITE I, BINDING SITE II or BINDING SITE III. Table 2 illustrates the complementarity of the nucleotide sequences of LOC164714 BINDING SITE, designated SEQ ID:42173, to the nucleotide sequence of VGAM2541 RNA, herein designated VGAM RNA, also designated SEQ ID:5252.

Another function of VGAM2541 is therefore inhibition of LOC164714 (Accession XM_104657). Accordingly, utilities of VGAM2541 include diagnosis, prevention and treatment of diseases and clinical conditions associated with LOC164714. LOC200904 (Accession XM_117291) is another VGAM2541 host target gene. LOC200904 BINDING SITE is HOST TARGET binding site found in the 5' untranslated region of mRNA encoded by LOC200904, corresponding to a HOST TARGET binding site such as BINDING SITE I, BINDING SITE II or BINDING SITE III. Table 2 illustrates the complementarity of the nucleotide sequences of LOC200904 BINDING SITE, designated SEQ ID:43360, to the nucleotide sequence of VGAM2541 RNA, herein designated VGAM RNA, also designated SEQ ID:5252.

Another function of VGAM2541 is therefore inhibition of LOC200904 (Accession XM_117291). Accordingly, utilities of VGAM2541 include diagnosis, prevention and treatment of diseases and clinical conditions associated with LOC200904. LOC201252 (Accession XM_113941) is another VGAM2541 host target gene. LOC201252 BINDING SITE is HOST TARGET binding site found in the 3' untranslated region of mRNA encoded by LOC201252, corresponding to a HOST TARGET binding site such as BINDING SITE I, BINDING SITE II or BINDING SITE III. Table 2 illustrates the complementarity of the nucleotide sequences of LOC201252 BINDING SITE, designated SEQ ID:42555, to the nucleotide sequence of VGAM2541 RNA, herein designated VGAM RNA, also designated SEQ ID:5252.

Another function of VGAM2541 is therefore inhibition of LOC201252 (Accession XM_113941). Accordingly, utilities of VGAM2541 include diagnosis, prevention and treatment of diseases and clinical conditions associated with LOC201252. LOC203083 (Accession XM_117496) is another VGAM2541 host target gene. LOC203083 BINDING SITE is HOST TARGET binding site found in the 5' untranslated region of mRNA encoded by LOC203083, corresponding to a HOST TARGET binding site such as BINDING SITE I, BINDING SITE II or BINDING SITE III. Table 2 illustrates the complementarity of the nucleotide sequences of LOC203083 BINDING SITE, designated SEQ ID:43478, to the nucleotide sequence of VGAM2541 RNA, herein designated VGAM RNA, also designated SEQ ID:5252.

Another function of VGAM2541 is therefore inhibition of LOC203083 (Accession XM_117496). Accordingly, utilities of VGAM2541 include diagnosis, prevention and treatment of diseases and clinical conditions associated with LOC203083. LOC219919 (Accession XM_167785) is another VGAM2541 host target gene. LOC219919 BINDING SITE is HOST TARGET binding site found in the 5' untranslated region of mRNA encoded by LOC219919, corresponding to a HOST TARGET binding site such as BINDING SITE I, BINDING SITE II or BINDING SITE III. Table 2 illustrates the complementarity of the nucleotide sequences of LOC219919 BINDING SITE, designated SEQ ID:44800, to the nucleotide sequence of VGAM2541 RNA, herein designated VGAM RNA, also designated SEQ ID:5252.

Another function of VGAM2541 is therefore inhibition of LOC219919 (Accession XM_167785). Accordingly, utilities of VGAM2541 include diagnosis, prevention and treatment of diseases and clinical conditions associated with LOC219919. LOC221795 (Accession XM_166491) is another VGAM2541 host target gene. LOC221795 BINDING SITE is HOST TARGET binding site found in the 5' untranslated region of mRNA encoded by LOC221795, corresponding to a HOST TARGET binding site such as BINDING SITE I, BINDING SITE II or BINDING SITE III. Table 2 illustrates the complementarity of the nucleotide sequences of LOC221795 BINDING SITE, designated SEQ ID:44423, to the nucleotide sequence of VGAM2541 RNA, herein designated VGAM RNA, also designated SEQ ID:5252.

Another function of VGAM2541 is therefore inhibition of LOC221795 (Accession XM_166491). Accordingly, utilities of VGAM2541 include diagnosis, prevention and treatment of diseases and clinical conditions associated with LOC221795. LOC221810 (Accession XM_168222) is another VGAM2541 host target gene. LOC221810 BINDING SITE is HOST TARGET binding site found in the 3' untranslated region of mRNA encoded by LOC221810, corresponding to a HOST TARGET binding site such as BINDING SITE I, BINDING SITE II or BINDING SITE III. Table 2 illustrates the complementarity of the nucleotide sequences of LOC221810 BINDING SITE, designated SEQ ID:45081, to the nucleotide sequence of VGAM2541 RNA, herein designated VGAM RNA, also designated SEQ ID:5252.

Another function of VGAM2541 is therefore inhibition of LOC221810 (Accession XM_168222). Accordingly, utilities of VGAM2541 include diagnosis, prevention and treatment of diseases and clinical conditions associated with LOC221810. LOC254176 (Accession XM_173215) is another VGAM2541 host target gene. LOC254176 BINDING SITE is HOST TARGET binding site found in the 5' untranslated region of mRNA encoded by LOC254176, corresponding to a HOST TARGET binding site such as BINDING SITE I, BINDING SITE II or BINDING SITE III. Table 2 illustrates the complementarity of the nucleotide sequences of LOC254176 BINDING SITE, designated SEQ ID:46475, to the nucleotide sequence of VGAM2541 RNA, herein designated VGAM RNA, also designated SEQ ID:5252.

Another function of VGAM2541 is therefore inhibition of LOC254176 (Accession XM_173215). Accordingly, utilities of VGAM2541 include diagnosis, prevention and treatment of diseases and clinical conditions associated with LOC254176. LOC256515 (Accession XM_172866) is another VGAM2541 host target gene. LOC256515 BINDING SITE is HOST TARGET binding site found in the 5' untranslated region of mRNA encoded by LOC256515, corresponding to a HOST TARGET binding site such as BINDING SITE I, BINDING SITE II or BINDING SITE III. Table 2 illustrates the complementarity of the nucleotide sequences of LOC256515 BINDING SITE, designated SEQ ID:46144, to the nucleotide sequence of VGAM2541 RNA, herein designated VGAM RNA, also designated SEQ ID:5252.

Another function of VGAM2541 is therefore inhibition of LOC256515 (Accession XM_172866). Accordingly, utilities of VGAM2541 include diagnosis, prevention and treatment of diseases and clinical conditions associated with LOC256515. LOC256594 (Accession XM_173127) is another VGAM2541 host target gene. LOC256594 BINDING SITE is HOST TARGET binding site found in the 5' untranslated region of mRNA encoded by LOC256594, corresponding to a HOST TARGET binding site such as BINDING SITE I, BINDING SITE II or BINDING SITE III. Table 2 illustrates the complementarity of the nucleotide sequences of LOC256594 BINDING SITE, designated SEQ ID:46377, to the nucleotide sequence of VGAM2541 RNA, herein designated VGAM RNA, also designated SEQ ID:5252.

Another function of VGAM2541 is therefore inhibition of LOC256594 (Accession XM_173127). Accordingly, utilities of VGAM2541 include diagnosis, prevention and treatment of diseases and clinical conditions associated with LOC256594. LOC57406 (Accession NM_020676) is another VGAM2541 host target gene. LOC57406 BINDING SITE is HOST TARGET binding site found in the 3' untranslated region of mRNA encoded by LOC57406, corresponding to a HOST TARGET binding site such as BINDING SITE I, BINDING SITE II or BINDING SITE III. Table 2 illustrates the complementarity of the nucleotide sequences of LOC57406 BINDING SITE, designated SEQ ID:21838, to the nucleotide sequence of VGAM2541 RNA, herein designated VGAM RNA, also designated SEQ ID:5252.

Another function of VGAM2541 is therefore inhibition of LOC57406 (Accession NM_020676). Accordingly, utilities of VGAM2541 include diagnosis, prevention and treatment of diseases and clinical conditions associated with LOC57406. LOC92578 (Accession XM_045900) is another VGAM2541 host target gene. LOC92578 BINDING SITE is HOST TARGET binding site found in the 5' untranslated region of mRNA encoded by LOC92578, corresponding to a HOST TARGET binding site such as BINDING SITE I, BINDING SITE II or BINDING SITE III. Table 2 illustrates the complementarity of the nucleotide sequences of LOC92578 BINDING SITE, designated SEQ ID:34606, to the nucleotide sequence of VGAM2541 RNA, herein designated VGAM RNA, also designated SEQ ID:5252.

Another function of VGAM2541 is therefore inhibition of LOC92578 (Accession XM_045900). Accordingly, utilities of VGAM2541 include diagnosis, prevention and treatment of diseases and clinical conditions associated with LOC92578. FIG. 1 further provides a conceptual description of a novel bioinformatically detected viral gene of the present invention, referred to here as Viral Genomic Address Messenger 2542 (VGAM2542) viral gene, which modulates expression of respective host target genes thereof, the function and utility of which host target genes is known in the art.

VGAM2542 is a novel bioinformatically detected regulatory, non protein coding, viral micro RNA (miRNA) gene. The method by which VGAM2542 was detected is described hereinabove with reference to FIGS. 1-8.

VGAM2542 gene, herein designated VGAM GENE, is a viral gene contained in the genome of Langat Virus. VGAM2542 host target gene, herein designated VGAM HOST TARGET GENE, is a human gene contained in the human genome.

VGAM2542 gene encodes a VGAM2542 precursor RNA, herein designated VGAM PRECURSOR RNA. Similar to other miRNA genes, and unlike most ordinary genes, VGAM2542 precursor RNA does not encode a protein. A nucleotide sequence identical or highly similar to the nucleotide sequence of VGAM2542 precursor RNA is designated SEQ ID:2528, and is provided hereinbelow with reference to the sequence listing part. Nucleotide sequence SEQ ID:2528 is located at position 9086 relative to the genome of Langat Virus.

VGAM2542 precursor RNA folds onto itself, forming VGAM2542 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2542 folded precursor RNA into VGAM2542 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2542 RNA is designated SEQ ID:5253, and is provided hereinbelow with reference to the sequence listing part.

VGAM2542 host target gene, herein designated VGAM HOST TARGET GENE, encodes a corresponding messenger RNA, VGAM2542 host target RNA, herein designated VGAM HOST TARGET RNA. VGAM2542 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2542 RNA, herein designated VGAM RNA, binds complementarily to one or more host target binding sites located in untranslated regions of VGAM2542 host target RNA, herein designated VGAM HOST TARGET RNA. This complementary binding is due to the fact that the nucleotide sequence of VGAM2542 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2542 RNA, herein designated VGAM RNA, may have a different number of host target binding sites in untranslated regions of a VGAM2542 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2542 RNA, herein designated VGAM RNA, to host target binding sites on VGAM2542 host target RNA, herein designated VGAM HOST TARGET RNA, such as BINDING SITE I, BINDING SITE II and BINDING SITE III, inhibits translation of VGAM2542 host target RNA into VGAM2542 host target protein, herein designated VGAM HOST TARGET PROTEIN. VGAM host target protein is therefore outlined by a broken line.

It is appreciated that VGAM2542 host target gene, herein designated VGAM HOST TARGET GENE, in fact represents a plurality of VGAM2542 host target genes. The mRNA of each one of this plurality of VGAM2542 host target genes comprises one or more host target binding sites, each having a nucleotide sequence which is at least partly complementary to VGAM2542 RNA, herein designated VGAM RNA, and which when bound by VGAM2542 RNA causes inhibition of translation of respective one or more VGAM2542 host target proteins.

It is further appreciated by one skilled in the art that the mode of translational inhibition illustrated by FIG. 1 with specific reference to translational inhibition exerted by VGAM2542 gene, herein designated VGAM GENE, on one or more VGAM2542 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2542 is inhibition of expression of host target genes, as part of a novel viral mechanism of attacking a host. Accordingly, utilities of VGAM2542 include diagnosis, prevention and treatment of viral infection by Langat Virus. Specific functions, and accordingly utilities, of VGAM2542 correlate with, and may be deduced from, the identity of the host target genes which VGAM2542 binds and inhibits, and the function of these host target genes, as elaborated hereinbelow.

Nucleotide sequences of the VGAM2542 precursor RNA, herein designated VGAM PRECURSOR RNA, and of the 'diced' VGAM2542 RNA, herein designated VGAM RNA, and a schematic representation of the secondary folding of VGAM2542 folded precursor RNA, herein designated VGAM FOLDED PRECURSOR RNA, of VGAM2542 are further described hereinbelow with reference to Table 1.

Nucleotide sequences of host target binding sites, such as BINDING SITE-I, BINDING SITE-II and BINDING SITE-III of FIG. 1, found on VGAM2542 host target RNA, and schematic representation of the complementarity of each of these host target binding sites to VGAM2542 RNA, herein designated VGAM RNA, are described hereinbelow with reference to Table 2.

As mentioned hereinabove with reference to FIG. 1, a function of VGAM2542 gene, herein designated VGAM is inhibition of expression of VGAM2542 target genes. It is appreciated that specific functions, and accordingly utilities, of VGAM2542 correlate with, and may be deduced from, the identity of the target genes which VGAM2542 binds and inhibits, and the function of these target genes, as elaborated hereinbelow.

Adrenergic, Alpha-2A-, Receptor (ADRA2A, Accession NM_000681) is a VGAM2542 host target gene. ADRA2A BINDING SITE is HOST TARGET binding site found in the 5' untranslated region of mRNA encoded by ADRA2A, corresponding to a HOST TARGET binding site such as BINDING SITE I, BINDING SITE II or BINDING SITE III. Table 2 illustrates the complementarity of the nucleotide sequences of ADRA2A BINDING SITE, designated SEQ ID:6336, to the nucleotide sequence of VGAM2542 RNA, herein designated VGAM RNA, also designated SEQ ID:5253.

A function of VGAM2542 is therefore inhibition of Adrenergic, Alpha-2A-, Receptor (ADRA2A, Accession NM_000681), a gene which mediates the effects of epinephrine and norepinephrine. Accordingly, utilities of VGAM2542 include diagnosis, prevention and treatment of diseases and clinical conditions associated with ADRA2A. The function of ADRA2A and its association with various diseases and clinical conditions, has been established by previous studies, as described hereinabove with reference to VGAM602. SMURF1 (Accession XM_166483) is another VGAM2542 host target gene. SMURF1 BINDING SITE is HOST TARGET binding site found in the 3' untranslated region of mRNA encoded by SMURF1, corresponding to a HOST TARGET binding site such as BINDING SITE I, BINDING SITE II or BINDING SITE III. Table 2 illustrates the complementarity of the nucleotide sequences of SMURF1 BINDING SITE, designated SEQ ID:44412, to the nucleotide sequence of VGAM2542 RNA, herein designated VGAM RNA, also designated SEQ ID:5253.

Another function of VGAM2542 is therefore inhibition of SMURF1 (Accession XM_166483). Accordingly, utilities of VGAM2542 include diagnosis, prevention and treatment of diseases and clinical conditions associated with SMURF1. BM039 (Accession NM_018455) is another VGAM2542 host target gene. BM039 BINDING SITE is HOST TARGET binding site found in the 5' untranslated region of mRNA encoded by BM039, corresponding to a HOST TARGET binding site such as BINDING SITE I, BINDING SITE II or BINDING SITE III. Table 2 illustrates the complementarity of the nucleotide sequences of BM039 BINDING SITE, designated SEQ ID:20527, to the nucleotide sequence of VGAM2542 RNA, herein designated VGAM RNA, also designated SEQ ID:5253.

Another function of VGAM2542 is therefore inhibition of BM039 (Accession NM_018455). Accordingly, utilities of VGAM2542 include diagnosis, prevention and treatment of diseases and clinical conditions associated with BM039. DKFZP434A0131 (Accession NM_018991) is another VGAM2542 host target gene. DKFZP434A0131 BINDING SITE is HOST TARGET binding site found in the 3' untranslated region of mRNA encoded by DKFZP434A0131, corresponding to a HOST TARGET binding site such as BINDING SITE I, BINDING SITE II or BINDING SITE III. Table 2 illustrates the complementarity of the nucleotide sequences of DKFZP434A0131 BINDING SITE, designated SEQ ID:21063, to the nucleotide sequence of VGAM2542 RNA, herein designated VGAM RNA, also designated SEQ ID:5253.

Another function of VGAM2542 is therefore inhibition of DKFZP434A0131 (Accession NM_018991). Accordingly, utilities of VGAM2542 include diagnosis, prevention and treatment of diseases and clinical conditions associated with DKFZP434A0131. FLJ00001 (Accession XM_088525) is another VGAM2542 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39772, to the nucleotide sequence of VGAM2542 RNA, herein designated VGAM RNA, also designated SEQ ID:5253.

Another function of VGAM2542 is therefore inhibition of FLJ00001 (Accession XM_088525). Accordingly, utilities of VGAM2542 include diagnosis, prevention and treatment of diseases and clinical conditions associated with FLJ00001. FLJ14249 (Accession NM_022460) is another VGAM2542 host target gene. FLJ14249 BINDING SITE is HOST TARGET binding site found in the 3' untranslated region of mRNA encoded by FLJ14249, corresponding to a HOST TARGET binding site such as BINDING SITE I, BINDING SITE II or BINDING SITE III. Table 2 illustrates the complementarity of the nucleotide sequences of FLJ14249 BINDING SITE, designated SEQ ID:22797, to the nucleotide sequence of VGAM2542 RNA, herein designated VGAM RNA, also designated SEQ ID:5253.

Another function of VGAM2542 is therefore inhibition of FLJ14249 (Accession NM_022460). Accordingly, utilities of VGAM2542 include diagnosis, prevention and treatment of diseases and clinical conditions associated with FLJ14249. Potassium Inwardly-rectifying Channel, Subfamily J, Member 9 (KCNJ9, Accession NM_004983) is another VGAM2542 host target gene. KCNJ9 BINDING SITE is HOST TARGET binding site found in the 5' untranslated region of mRNA encoded by KCNJ9, corresponding to a HOST TARGET binding site such as BINDING SITE I, BINDING SITE II or BINDING SITE III. Table 2 illustrates the complementarity of the nucleotide sequences of KCNJ9 BINDING SITE, designated SEQ ID:11432, to the nucleotide sequence of VGAM2542 RNA, herein designated VGAM RNA, also designated SEQ ID:5253.

Another function of VGAM2542 is therefore inhibition of Potassium Inwardly-rectifying Channel, Subfamily J, Member 9 (KCNJ9, Accession NM_004983). Accordingly, utilities of VGAM2542 include diagnosis, prevention and treatment of diseases and clinical conditions associated with KCNJ9. KIAA0789 (Accession XM_033113) is another VGAM2542 host target gene. KIAA0789 BINDING SITE is HOST TARGET binding site found in the 5' untranslated region of mRNA encoded by KIAA0789, corresponding to a HOST TARGET binding site such as BINDING SITE I, BINDING SITE II or BINDING SITE III. Table 2 illustrates the complementarity of the nucleotide sequences of KIAA0789 BINDING SITE, designated SEQ ID:31843, to the nucleotide sequence of VGAM2542 RNA, herein designated VGAM RNA, also designated SEQ ID:5253.

Another function of VGAM2542 is therefore inhibition of KIAA0789 (Accession XM_033113). Accordingly, utilities of VGAM2542 include diagnosis, prevention and treatment of diseases and clinical conditions associated with KIAA0789. Synaptotagmin XII (SYT12, Accession XM_170657) is another VGAM2542 host target gene. SYT12 BINDING SITE is HOST TARGET binding site found in the 3' untranslated region of mRNA encoded by SYT12, corresponding to a HOST TARGET binding site such as BINDING SITE I, BINDING SITE II or BINDING SITE III. Table 2 illustrates the complementarity of the nucleotide sequences of SYT12 BINDING SITE, designated SEQ ID:45430, to the nucleotide sequence of VGAM2542 RNA, herein designated VGAM RNA, also designated SEQ ID:5253.

Another function of VGAM2542 is therefore inhibition of Synaptotagmin XII (SYT12, Accession XM_170657). Accordingly, utilities of VGAM2542 include diagnosis, prevention and treatment of diseases and clinical conditions associated with SYT12. TED (Accession NM_015686) is another VGAM2542 host target gene. TED BINDING SITE is HOST TARGET binding site found in the 3' untranslated region of mRNA encoded by TED, corresponding to a HOST TARGET binding site such as BINDING SITE I, BINDING SITE II or BINDING SITE III. Table 2 illustrates the complementarity of the nucleotide sequences of TED BINDING SITE, designated SEQ ID:17911, to the nucleotide sequence of VGAM2542 RNA, herein designated VGAM RNA, also designated SEQ ID:5253.

Another function of VGAM2542 is therefore inhibition of TED (Accession NM_015686). Accordingly, utilities of VGAM2542 include diagnosis, prevention and treatment of diseases and clinical conditions associated with TED. Ubiquitin Specific Protease 20 (USP20, Accession NM_006676) is another VGAM2542 host target gene. USP20 BINDING SITE is HOST TARGET binding site found in the 3' untranslated region of mRNA encoded by USP20, corresponding to a HOST TARGET binding site such as BINDING SITE I, BINDING SITE II or BINDING SITE III. Table 2 illustrates the complementarity of the nucleotide sequences of USP20 BINDING SITE, designated SEQ ID:13501, to the nucleotide sequence of VGAM2542 RNA, herein designated VGAM RNA, also designated SEQ ID:5253.

Another function of VGAM2542 is therefore inhibition of Ubiquitin Specific Protease 20 (USP20, Accession NM_006676). Accordingly, utilities of VGAM2542 include diagnosis, prevention and treatment of diseases and clinical conditions associated with USP20. LOC135398 (Accession XM_069333) is another VGAM2542 host target gene. LOC135398 BINDING SITE is HOST TARGET binding site found in the 3' untranslated region of mRNA encoded by LOC135398, corresponding to a HOST TARGET binding site such as BINDING SITE I, BINDING SITE II or BINDING SITE III. Table 2 illustrates the complementarity of the nucleotide sequences of LOC135398 BINDING SITE, designated SEQ ID:37384, to the nucleotide sequence of VGAM2542 RNA, herein designated VGAM RNA, also designated SEQ ID:5253.

Another function of VGAM2542 is therefore inhibition of LOC135398 (Accession XM_069333). Accordingly, utilities of VGAM2542 include diagnosis, prevention and treatment of diseases and clinical conditions associated with LOC135398. LOC164537 (Accession XM_104534) is another VGAM2542 host target gene. LOC164537 BINDING SITE is HOST TARGET binding site found in the 5' untranslated region of mRNA encoded by LOC164537, corresponding to a HOST TARGET binding site such as BINDING SITE I, BINDING SITE II or BINDING SITE III. Table 2 illustrates the complementarity of the nucleotide sequences of LOC164537 BINDING SITE, designated SEQ ID:42171, to the nucleotide sequence of VGAM2542 RNA, herein designated VGAM RNA, also designated SEQ ID:5253.

Another function of VGAM2542 is therefore inhibition of LOC164537 (Accession XM_104534). Accordingly, utilities of VGAM2542 include diagnosis, prevention and treatment of diseases and clinical conditions associated with LOC164537. LOC169021 (Accession XM_095459) is another VGAM2542 host target gene. LOC169021 BINDING SITE is HOST TARGET binding site found in the 5' untranslated region of mRNA encoded by LOC169021, corresponding to a HOST TARGET binding site such as BINDING SITE I, BINDING SITE II or BINDING SITE III. Table 2 illustrates the complementarity of the nucleotide sequences of LOC169021 BINDING SITE, designated SEQ ID:40256, to the nucleotide sequence of VGAM2542 RNA, herein designated VGAM RNA, also designated SEQ ID:5253.

Another function of VGAM2542 is therefore inhibition of LOC169021 (Accession XM_095459). Accordingly, utilities of VGAM2542 include diagnosis, prevention and treatment of diseases and clinical conditions associated with LOC169021. LOC205095 (Accession XM_119820) is another VGAM2542 host target gene. LOC205095 BINDING SITE is HOST TARGET binding site found in the 3' untranslated region of mRNA encoded by LOC205095, corresponding to a HOST TARGET binding site such as BINDING SITE I, BINDING SITE II or BINDING SITE III. Table 2 illustrates the complementarity of the nucleotide sequences of LOC205095 BINDING SITE, designated SEQ ID:43601, to the nucleotide sequence of VGAM2542 RNA, herein designated VGAM RNA, also designated SEQ ID:5253.

Another function of VGAM2542 is therefore inhibition of LOC205095 (Accession XM_119820). Accordingly, utilities of VGAM2542 include diagnosis, prevention and treatment of diseases and clinical conditions associated with LOC205095. LOC58525 (Accession XM_086045) is another VGAM2542 host target gene. LOC58525 BINDING SITE is HOST TARGET binding site found in the 5' untranslated region of mRNA encoded by LOC58525, corresponding to a HOST TARGET binding site such as BINDING SITE I, BINDING SITE II or BINDING SITE III. Table 2 illustrates the complementarity of the nucleotide sequences of LOC58525 BINDING SITE, designated SEQ ID:38454, to the nucleotide sequence of VGAM2542 RNA, herein designated VGAM RNA, also designated SEQ ID:5253.

Another function of VGAM2542 is therefore inhibition of LOC58525 (Accession XM_086045). Accordingly, utilities of VGAM2542 include diagnosis, prevention and treatment of diseases and clinical conditions associated with LOC58525. LOC90246 (Accession XM_030283) is another VGAM2542 host target gene. LOC90246 BINDING SITE is HOST TARGET binding site found in the 3' untranslated region of mRNA encoded by LOC90246, corresponding to a HOST TARGET binding site such as BINDING SITE I, BINDING SITE II or BINDING SITE III. Table 2 illustrates the complementarity of the nucleotide sequences of LOC90246 BINDING SITE, designated SEQ ID:30998, to the nucleotide sequence of VGAM2542 RNA, herein designated VGAM RNA, also designated SEQ ID:5253.

Another function of VGAM2542 is therefore inhibition of LOC90246 (Accession XM_030283). Accordingly, utilities of VGAM2542 include diagnosis, prevention and treatment of diseases and clinical conditions associated with LOC90246. LOC92017 (Accession XM_042234) is another VGAM2542 host target gene. LOC92017 BINDING SITE is HOST TARGET binding site found in the 3' untranslated region of mRNA encoded by LOC92017, corresponding to a HOST TARGET binding site such as BINDING SITE I, BINDING SITE II or BINDING SITE III. Table 2 illustrates the complementarity of the nucleotide sequences of LOC92017 BINDING SITE, designated SEQ ID:33709, to the nucleotide sequence of VGAM2542 RNA, herein designated VGAM RNA, also designated SEQ ID:5253.

Another function of VGAM2542 is therefore inhibition of LOC92017 (Accession XM_042234). Accordingly, utilities of VGAM2542 include diagnosis, prevention and treatment of diseases and clinical conditions associated with LOC92017. LOC93166 (Accession XM_049619) is another VGAM2542 host target gene. LOC93166 BINDING SITE is HOST TARGET binding site found in the 3' untranslated region of mRNA encoded by LOC93166, corresponding to a HOST TARGET binding site such as BINDING SITE I, BINDING SITE II or BINDING SITE III. Table 2 illustrates the complementarity of the nucleotide sequences of LOC93166 BINDING SITE, designated SEQ ID:35458, to the nucleotide sequence of VGAM2542 RNA, herein designated VGAM RNA, also designated SEQ ID:5253.

Another function of VGAM2542 is therefore inhibition of LOC93166 (Accession XM_049619). Accordingly, utilities of VGAM2542 include diagnosis, prevention and treatment of diseases and clinical conditions associated with LOC93166. FIG. 1 further provides a conceptual description of a novel bioinformatically detected viral gene of the present invention, referred to here as Viral Genomic Address Messenger 2543 (VGAM2543) viral gene, which modulates expression of respective host target genes thereof, the function and utility of which host target genes is known in the art.

VGAM2543 is a novel bioinformatically detected regulatory, non protein coding, viral micro RNA (miRNA) gene. The method by which VGAM2543 was detected is described hereinabove with reference to FIGS. 1-8.

VGAM2543 gene, herein designated VGAM GENE, is a viral gene contained in the genome of Langat Virus. VGAM2543 host target gene, herein designated VGAM HOST TARGET GENE, is a human gene contained in the human genome.

VGAM2543 gene encodes a VGAM2543 precursor RNA, herein designated VGAM PRECURSOR RNA. Similar to other miRNA genes, and unlike most ordinary genes, VGAM2543 precursor RNA does not encode a protein. A nucleotide sequence identical or highly similar to the nucleotide sequence of VGAM2543 precursor RNA is designated SEQ ID:2529, and is provided hereinbelow with reference to the sequence listing part. Nucleotide sequence SEQ ID:2529 is located at position 976 relative to the genome of Langat Virus.

VGAM2543 precursor RNA folds onto itself, forming VGAM2543 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2543 folded precursor RNA into VGAM2543 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2543 RNA is designated SEQ ID:5254, and is provided hereinbelow with reference to the sequence listing part.

VGAM2543 host target gene, herein designated VGAM HOST TARGET GENE, encodes a corresponding messenger RNA, VGAM2543 host target RNA, herein designated VGAM HOST TARGET RNA. VGAM2543 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2543 RNA, herein designated VGAM RNA, binds complementarily to one or more host target binding sites located in untranslated regions of VGAM2543 host target RNA, herein designated VGAM HOST TARGET RNA. This complementary binding is due to the fact that the nucleotide sequence of VGAM2543 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2543 RNA, herein designated VGAM RNA, may have a different number of host target binding sites in untranslated regions of a VGAM2543 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2543 RNA, herein designated VGAM RNA, to host target binding sites on VGAM2543 host target RNA, herein designated VGAM HOST TARGET RNA, such as BINDING SITE I, BINDING SITE II and BINDING SITE III, inhibits translation of VGAM2543 host target RNA into VGAM2543 host target protein, herein designated VGAM HOST TARGET PROTEIN. VGAM host target protein is therefore outlined by a broken line.

It is appreciated that VGAM2543 host target gene, herein designated VGAM HOST TARGET GENE, in fact represents a plurality of VGAM2543 host target genes. The mRNA of each one of this plurality of VGAM2543 host target genes comprises one or more host target binding sites, each having a nucleotide sequence which is at least partly complementary to VGAM2543 RNA, herein designated VGAM RNA, and which when bound by VGAM2543 RNA causes inhibition of translation of respective one or more VGAM2543 host target proteins.

It is further appreciated by one skilled in the art that the mode of translational inhibition illustrated by FIG. 1 with specific reference to translational inhibition exerted by VGAM2543 gene, herein designated VGAM GENE, on one or more VGAM2543 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2543 is inhibition of expression of host target genes, as part of a novel viral mechanism of attacking a host. Accordingly, utilities of VGAM2543 include diagnosis, prevention and treatment of viral infection by Langat Virus. Specific functions, and accordingly utilities, of VGAM2543 correlate with, and may be deduced from, the identity of the host target genes which VGAM2543 binds and inhibits, and the function of these host target genes, as elaborated hereinbelow.

Nucleotide sequences of the VGAM2543 precursor RNA, herein designated VGAM PRECURSOR RNA, and of the 'diced' VGAM2543 RNA, herein designated VGAM RNA, and a schematic representation of the secondary folding of VGAM2543 folded precursor RNA, herein designated VGAM FOLDED PRECURSOR RNA, of VGAM2543 are further described hereinbelow with reference to Table 1.

Nucleotide sequences of host target binding sites, such as BINDING SITE-I, BINDING SITE-II and BINDING SITE-III of FIG. 1, found on VGAM2543 host target RNA, and schematic representation of the complementarity of each of these host target binding sites to VGAM2543 RNA, herein designated VGAM RNA, are described hereinbelow with reference to Table 2.

As mentioned hereinabove with reference to FIG. 1, a function of VGAM2543 gene, herein designated VGAM is inhibition of expression of VGAM2543 target genes. It is appreciated that specific functions, and accordingly utilities, of VGAM2543 correlate with, and may be deduced from, the identity of the target genes which VGAM2543 binds and inhibits, and the function of these target genes, as elaborated hereinbelow.

Endothelin 3 (EDN3, Accession NM_000114) is a VGAM2543 host target gene. EDN3 BINDING SITE is HOST TARGET binding site found in the 3' untranslated region of mRNA encoded by EDN3, corresponding to a HOST TARGET binding site such as BINDING SITE I, BINDING SITE II or BINDING SITE III. Table 2 illustrates the complementarity of the nucleotide sequences of EDN3 BINDING SITE, designated SEQ ID:5580, to the nucleotide sequence of VGAM2543 RNA, herein designated VGAM RNA, also designated SEQ ID:5254.

A function of VGAM2543 is therefore inhibition of Endothelin 3 (EDN3, Accession NM_000114). Accordingly, utilities of VGAM2543 include diagnosis, prevention and treatment of diseases and clinical conditions associated with EDN3. Inositol Polyphosphate-5-phosphatase, 145 kDa (INPP5D, Accession XM_096169) is another VGAM2543 host target gene. INPP5D BINDING SITE is HOST TARGET binding site found in the 3' untranslated region of mRNA encoded by INPP5D, corresponding to a HOST TARGET binding site such as BINDING SITE I, BINDING SITE II or BINDING SITE III. Table 2 illustrates the complementarity of the nucleotide sequences of INPP5D BINDING SITE, designated SEQ ID:40304, to the nucleotide sequence of VGAM2543 RNA, herein designated VGAM RNA, also designated SEQ ID:5254.

Another function of VGAM2543 is therefore inhibition of Inositol Polyphosphate-5-phosphatase, 145 kDa (INPP5D, Accession XM_096169), a gene which hydrolyzes Ins (1,3,4,5)P4 and PtdIns (3,4,5)P3; contains an SH2-domain. Accordingly, utilities of VGAM2543 include diagnosis, prevention and treatment of diseases and clinical conditions associated with INPP5D. The function of INPP5D and its association with various diseases and clinical conditions, has been established by previous studies, as described hereinabove with reference to VGAM64. Lymphocyte Cytosolic Protein 1 (L-plastin) (LCP1, Accession NM_002298) is another VGAM2543 host target gene. LCP1 BINDING SITE is HOST TARGET binding site found in the 3' untranslated region of mRNA encoded by LCP1, corresponding to a HOST TARGET binding site such as BINDING SITE I, BINDING SITE II or BINDING SITE III. Table 2 illustrates the complementarity of the nucleotide sequences of LCP1 BINDING SITE, designated SEQ ID:8083, to the nucleotide sequence of VGAM2543 RNA, herein designated VGAM RNA, also designated SEQ ID:5254.

Another function of VGAM2543 is therefore inhibition of Lymphocyte Cytosolic Protein 1 (L-plastin) (LCP1, Accession NM_002298), a gene which is involved in t cell antigen receptor mediated signaling. Accordingly, utilities of VGAM2543 include diagnosis, prevention and treatment of diseases and clinical conditions associated with LCP1. The function of LCP1 and its association with various diseases and clinical conditions, has been established by previous studies, as described hereinabove with reference to VGAM418. Dedicator of Cyto-kinesis 3 (DOCK3, Accession XM_039259) is another VGAM2543 host target gene. DOCK3 BINDING SITE is HOST TARGET binding site found in the 3' untranslated region of mRNA encoded by DOCK3, corresponding to a HOST TARGET binding site such as BINDING SITE I, BINDING SITE II or BINDING SITE III. Table 2 illustrates the complementarity of the nucleotide sequences of DOCK3 BINDING SITE, designated SEQ ID:33032, to the nucleotide sequence of VGAM2543 RNA, herein designated VGAM RNA, also designated SEQ ID:5254.

Another function of VGAM2543 is therefore inhibition of Dedicator of Cyto-kinesis 3 (DOCK3, Accession XM_039259). Accordingly, utilities of VGAM2543 include diagnosis, prevention and treatment of diseases and clinical conditions associated with DOCK3. FASTK (Accession NM_025096) is another VGAM2543 host target gene. FASTK BINDING SITE is HOST TARGET binding site found in the 3' untranslated region of mRNA encoded by FASTK, corresponding to a HOST TARGET binding site such as BINDING SITE I, BINDING SITE II or BINDING SITE III. Table 2 illustrates the complementarity of the nucleotide sequences of FASTK BINDING SITE, designated SEQ ID:24727, to the nucleotide sequence of VGAM2543 RNA, herein designated VGAM RNA, also designated SEQ ID:5254.

Another function of VGAM2543 is therefore inhibition of FASTK (Accession NM_025096). Accordingly, utilities of VGAM2543 include diagnosis, prevention and treatment of diseases and clinical conditions associated with FASTK. FLJ20004 (Accession XM_170889) is another VGAM2543 host target gene. FLJ20004 BINDING SITE is HOST TARGET binding site found in the 5' untranslated region of mRNA encoded by FLJ20004, corresponding to a HOST TARGET binding site such as BINDING SITE I, BINDING SITE II or BINDING SITE III. Table 2 illustrates the complementarity of the nucleotide sequences of FLJ20004 BINDING SITE, designated SEQ ID:45643, to the nucleotide sequence of VGAM2543 RNA, herein designated VGAM RNA, also designated SEQ ID:5254.

Another function of VGAM2543 is therefore inhibition of FLJ20004 (Accession XM_170889). Accordingly, utilities of VGAM2543 include diagnosis, prevention and treatment of diseases and clinical conditions associated with FLJ20004. KIAA0914 (Accession NM_014883) is another VGAM2543 host target gene. KIAA0914 BINDING SITE is HOST TARGET binding site found in the 5' untranslated region of mRNA encoded by KIAA0914, corresponding to a HOST TARGET binding site such as BINDING SITE I, BINDING SITE II or BINDING SITE III. Table 2 illustrates the complementarity of the nucleotide sequences of KIAA0914 BINDING SITE, designated SEQ ID:17035, to the nucleotide sequence of VGAM2543 RNA, herein designated VGAM RNA, also designated SEQ ID:5254.

Another function of VGAM2543 is therefore inhibition of KIAA0914 (Accession NM_014883). Accordingly, utilities of VGAM2543 include diagnosis, prevention and treatment of diseases and clinical conditions associated with KIAA0914. KIAA1030 (Accession XM_167789) is another VGAM2543 host target gene. KIAA1030 BINDING SITE is HOST TARGET binding site found in the 3' untranslated region of mRNA encoded by KIAA1030, corresponding to a HOST TARGET binding site such as BINDING SITE I, BINDING SITE II or BINDING SITE III. Table 2 illustrates the complementarity of the nucleotide sequences of KIAA1030 BINDING SITE, designated SEQ ID:44819, to the nucleotide sequence of VGAM2543 RNA, herein designated VGAM RNA, also designated SEQ ID:5254.

Another function of VGAM2543 is therefore inhibition of KIAA1030 (Accession XM_167789). Accordingly, utilities of VGAM2543 include diagnosis, prevention and treatment of diseases and clinical conditions associated with KIAA1030. 1 (3) mbt-like 2 (Drosophila) (L3MBTL2, Accession XM_114201) is another VGAM2543 host target gene. L3MBTL2 BINDING SITE is HOST TARGET binding site found in the 5' untranslated region of mRNA encoded by L3MBTL2, corresponding to a HOST TARGET binding site such as BINDING SITE I, BINDING SITE II or BINDING SITE III. Table 2 illustrates the complementarity of the nucleotide sequences of L3MBTL2 BINDING SITE, designated SEQ ID:42787, to the nucleotide sequence of VGAM2543 RNA, herein designated VGAM RNA, also designated SEQ ID:5254.

Another function of VGAM2543 is therefore inhibition of l (3) mbt-like 2 (Drosophila) (L3MBTL2, Accession XM_114201). Accordingly, utilities of VGAM2543 include diagnosis, prevention and treatment of diseases and clinical conditions associated with L3MBTL2. MGC15631 (Accession NM_032753) is another VGAM2543 host target gene. MGC15631 BINDING SITE is HOST TARGET binding site found in the 3' untranslated region of mRNA encoded by MGC15631, corresponding to a HOST TARGET binding site such as BINDING SITE I, BINDING SITE II or BINDING SITE III. Table 2 illustrates the complementarity of the nucleotide sequences of MGC15631 BINDING SITE, designated SEQ ID:26491, to the nucleotide sequence of VGAM2543 RNA, herein designated VGAM RNA, also designated SEQ ID:5254.

Another function of VGAM2543 is therefore inhibition of MGC15631 (Accession NM_032753). Accordingly, utilities of VGAM2543 include diagnosis, prevention and treatment of diseases and clinical conditions associated with MGC15631. SCAMP5 (Accession NM_138967) is another VGAM2543 host target gene. SCAMP5 BINDING SITE is HOST TARGET binding site found in the 3' untranslated region of mRNA encoded by SCAMP5, corresponding to a HOST TARGET binding site such as BINDING SITE I, BINDING SITE II or BINDING SITE III. Table 2 illustrates the complementarity of the nucleotide sequences of SCAMP5 BINDING SITE, designated SEQ ID:29073, to the nucleotide sequence of VGAM2543 RNA, herein designated VGAM RNA, also designated SEQ ID:5254.

Another function of VGAM2543 is therefore inhibition of SCAMP5 (Accession NM_138967). Accordingly, utilities of VGAM2543 include diagnosis, prevention and treatment of diseases and clinical conditions associated with SCAMP5. STATI2 (Accession XM_170547) is another VGAM2543 host target gene. STATI2 BINDING SITE1 and STATI2 BINDING SITE2 are HOST TARGET binding sites found in untranslated regions of mRNA encoded by STATI2, corresponding to HOST TARGET binding sites such as BINDING SITE I, BINDING SITE II or BINDING SITE III. Table 2 illustrates the complementarity of the nucleotide sequences of STATI2 BINDING SITE1 and STATI2 BINDING SITE2, designated SEQ ID:45370 and SEQ ID:9959 respectively, to the nucleotide sequence of VGAM2543 RNA, herein designated VGAM RNA, also designated SEQ ID:5254.

Another function of VGAM2543 is therefore inhibition of STATI2 (Accession XM_170547). Accordingly, utilities of VGAM2543 include diagnosis, prevention and treatment of diseases and clinical conditions associated with STATI2. LOC196510 (Accession XM_113738) is another VGAM2543 host target gene. LOC196510 BINDING SITE is HOST TARGET binding site found in the 3' untranslated region of mRNA encoded by LOC196510, corresponding to a HOST TARGET binding site such as BINDING SITE I, BINDING SITE II or BINDING SITE III. Table 2 illustrates the complementarity of the nucleotide sequences of LOC196510 BINDING SITE, designated SEQ ID:42393, to the nucleotide sequence of VGAM2543 RNA, herein designated VGAM RNA, also designated SEQ ID:5254.

Another function of VGAM2543 is therefore inhibition of LOC196510 (Accession XM_113738). Accordingly, utilities of VGAM2543 include diagnosis, prevention and treatment of diseases and clinical conditions associated with LOC196510. LOC200093 (Accession XM_032184) is another VGAM2543 host target gene. LOC200093 BINDING SITE is HOST TARGET binding site found in the 3' untranslated region of mRNA encoded by LOC200093, corresponding to a HOST TARGET binding site such as BINDING SITE I, BINDING SITE II or BINDING SITE III. Table 2 illustrates the complementarity of the nucleotide sequences of LOC200093 BINDING SITE, designated SEQ ID:31596, to the nucleotide sequence of VGAM2543 RNA, herein designated VGAM RNA, also designated SEQ ID:5254.

Another function of VGAM2543 is therefore inhibition of LOC200093 (Accession XM_032184). Accordingly, utilities of VGAM2543 include diagnosis, prevention and treatment of diseases and clinical conditions associated with LOC200093. LOC200220 (Accession XM_114157) is another VGAM2543 host target gene. LOC200220 BINDING SITE is HOST TARGET binding site found in the 3' untranslated region of mRNA encoded by LOC200220, corresponding to a HOST TARGET binding site such as BINDING SITE I, BINDING SITE II or BINDING SITE III. Table 2 illustrates the complementarity of the nucleotide sequences of LOC200220 BINDING SITE, designated SEQ ID:42742, to the nucleotide sequence of VGAM2543 RNA, herein designated VGAM RNA, also designated SEQ ID:5254.

Another function of VGAM2543 is therefore inhibition of LOC200220 (Accession XM_114157). Accordingly, utilities of VGAM2543 include diagnosis, prevention and treatment of diseases and clinical conditions associated with LOC200220. LOC203536 (Accession XM_114716) is another VGAM2543 host target gene. LOC203536 BINDING SITE is HOST TARGET binding site found in the 3' untranslated region of mRNA encoded by LOC203536, corresponding to a HOST TARGET binding site such as BINDING SITE I, BINDING SITE II or BINDING SITE III. Table 2 illustrates the complementarity of the nucleotide sequences of LOC203536 BINDING SITE, designated SEQ ID:43056, to the nucleotide sequence of VGAM2543 RNA, herein designated VGAM RNA, also designated SEQ ID:5254.

Another function of VGAM2543 is therefore inhibition of LOC203536 (Accession XM_114716). Accordingly, utilities of VGAM2543 include diagnosis, prevention and treatment of diseases and clinical conditions associated with LOC203536. LOC91149 (Accession XM_036480) is another VGAM2543 host target gene. LOC91149 BINDING SITE is HOST TARGET binding site found in the 3' untranslated region of mRNA encoded by LOC91149, corresponding to a HOST TARGET binding site such as BINDING SITE I, BINDING SITE II or BINDING SITE III. Table 2 illustrates the complementarity of the nucleotide sequences of LOC91149 BINDING SITE, designated SEQ ID:32454, to the nucleotide sequence of VGAM2543 RNA, herein designated VGAM RNA, also designated SEQ ID:5254.

Another function of VGAM2543 is therefore inhibition of LOC91149 (Accession XM_036480). Accordingly, utilities of VGAM2543 include diagnosis, prevention and treatment of diseases and clinical conditions associated with LOC91149. FIG. 1 further provides a conceptual description of a novel bioinformatically detected viral gene of the present invention, referred to here as Viral Genomic Address Messenger 2544 (VGAM2544) viral gene, which modulates expression of respective host target genes thereof, the function and utility of which host target genes is known in the art.

VGAM2544 is a novel bioinformatically detected regulatory, non protein coding, viral micro RNA (miRNA) gene. The method by which VGAM2544 was detected is described hereinabove with reference to FIGS. 1-8.

VGAM2544 gene, herein designated VGAM GENE, is a viral gene contained in the genome of Langat Virus. VGAM2544 host target gene, herein designated VGAM HOST TARGET GENE, is a human gene contained in the human genome.

VGAM2544 gene encodes a VGAM2544 precursor RNA, herein designated VGAM PRECURSOR RNA. Similar to other miRNA genes, and unlike most ordinary genes, VGAM2544 precursor RNA does not encode a protein. A nucleotide sequence identical or highly similar to the nucleotide sequence of VGAM2544 precursor RNA is designated SEQ ID:2530, and is provided hereinbelow with reference to the sequence listing part. Nucleotide sequence SEQ ID:2530 is located at position 9387 relative to the genome of Langat Virus.

VGAM2544 precursor RNA folds onto itself, forming VGAM2544 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2544 folded precursor RNA into VGAM2544 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2544 RNA is designated SEQ ID:5255, and is provided hereinbelow with reference to the sequence listing part.

VGAM2544 host target gene, herein designated VGAM HOST TARGET GENE, encodes a corresponding messenger RNA, VGAM2544 host target RNA, herein designated VGAM HOST TARGET RNA. VGAM2544 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2544 RNA, herein designated VGAM RNA, binds complementarily to one or more host target binding sites located in untranslated regions of VGAM2544 host target RNA, herein designated VGAM HOST TARGET RNA. This complementary binding is due to the fact that the nucleotide sequence of VGAM2544 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2544 RNA, herein designated VGAM RNA, may have a different number of host target binding sites in untranslated regions of a VGAM2544 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2544 RNA, herein designated VGAM RNA, to host target binding sites on VGAM2544 host target RNA, herein designated VGAM HOST TARGET RNA, such as BINDING SITE I, BINDING SITE II and BINDING SITE III, inhibits translation of VGAM2544 host target RNA into VGAM2544 host target protein, herein designated VGAM HOST TARGET PROTEIN. VGAM host target protein is therefore outlined by a broken line.

It is appreciated that VGAM2544 host target gene, herein designated VGAM HOST TARGET GENE, in fact represents a plurality of VGAM2544 host target genes. The mRNA of each one of this plurality of VGAM2544 host target genes comprises one or more host target binding sites, each having a nucleotide sequence which is at least partly complementary to VGAM2544 RNA, herein designated VGAM RNA, and which when bound by VGAM2544 RNA causes inhibition of translation of respective one or more VGAM2544 host target proteins.

It is further appreciated by one skilled in the art that the mode of translational inhibition illustrated by FIG. 1 with specific reference to translational inhibition exerted by VGAM2544 gene, herein designated VGAM GENE, on one or more VGAM2544 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2544 is inhibition of expression of host target genes, as part of a novel viral mechanism of attacking a host. Accordingly, utilities of VGAM2544 include diagnosis, prevention and treatment of viral infection by Langat Virus. Specific functions, and accordingly utilities, of VGAM2544 correlate with, and may be deduced from, the identity of the host target genes which VGAM2544 binds and inhibits, and the function of these host target genes, as elaborated hereinbelow.

Nucleotide sequences of the VGAM2544 precursor RNA, herein designated VGAM PRECURSOR RNA, and of the 'diced' VGAM2544 RNA, herein designated VGAM RNA, and a schematic representation of the secondary folding of VGAM2544 folded precursor RNA, herein designated VGAM FOLDED PRECURSOR RNA, of VGAM2544 are further described hereinbelow with reference to Table 1.

Nucleotide sequences of host target binding sites, such as BINDING SITE-I, BINDING SITE-II and BINDING SITE-III of FIG. 1, found on VGAM2544 host target RNA, and schematic representation of the complementarity of each of these host target binding sites to VGAM2544 RNA, herein designated VGAM RNA, are described hereinbelow with reference to Table 2.

As mentioned hereinabove with reference to FIG. 1, a function of VGAM2544 gene, herein designated VGAM is inhibition of expression of VGAM2544 target genes. It is appreciated that specific functions, and accordingly utilities, of VGAM2544 correlate with, and may be deduced from, the identity of the target genes which VGAM2544 binds and inhibits, and the function of these target genes, as elaborated hereinbelow.

Bullous Pemphigoid Antigen 1, 230/240 kDa (BPAG1, Accession NM_015548) is a VGAM2544 host target gene. BPAG1 BINDING SITE is HOST TARGET binding site found in the 3' untranslated region of mRNA encoded by BPAG1, corresponding to a HOST TARGET binding site such as BINDING SITE I, BINDING SITE II or BINDING SITE III. Table 2 illustrates the complementarity of the nucleotide sequences of BPAG1 BINDING SITE, designated SEQ ID:17810, to the nucleotide sequence of VGAM2544 RNA, herein designated VGAM RNA, also designated SEQ ID:5255.

A function of VGAM2544 is therefore inhibition of Bullous Pemphigoid Antigen 1, 230/240 kDa (BPAG1, Accession NM_015548), a gene which plays a role in cross-linking actin to other cytoskeletal proteins, binds to microtubules. Accordingly, utilities of VGAM2544 include diagnosis, prevention and treatment of diseases and clinical conditions associated with BPAG1. The function of BPAG1 and its association with various diseases and clinical conditions, has been established by previous studies, as described hereinabove with reference to VGAM494. Notch Homolog 2 (Drosophila) (NOTCH2, Accession NM_024408) is another VGAM2544 host target gene. NOTCH2 BINDING SITE is HOST TARGET binding site found in the 3' untranslated region of mRNA encoded by NOTCH2, corresponding to a HOST TARGET binding site such as BINDING SITE I, BINDING SITE II or BINDING SITE III. Table 2 illustrates the complementarity of the nucleotide sequences of NOTCH2 BINDING SITE, designated SEQ ID:23650, to the nucleotide sequence of VGAM2544 RNA, herein designated VGAM RNA, also designated SEQ ID:5255.

Another function of VGAM2544 is therefore inhibition of Notch Homolog 2 (Drosophila) (NOTCH2, Accession NM_024408), a gene which is moderately similar to a region of murine Notch1 and contains an ankyrin repeat. Accordingly, utilities of VGAM2544 include diagnosis, prevention and treatment of diseases and clinical conditions associated with NOTCH2. The function of NOTCH2 and its association with various diseases and clinical conditions, has been established by previous studies, as described hereinabove with reference to VGAM93. Carbohydrate (chondroitin 6) Sulfotransferase 3 (CHST3, Accession NM_004273) is another VGAM2544 host target gene. CHST3 BINDING SITE is HOST TARGET binding site found in the 3' untranslated region of mRNA encoded by CHST3, corresponding to a HOST TARGET binding site such as BINDING SITE I, BINDING SITE II or BINDING SITE III. Table 2 illustrates the complementarity of the nucleotide sequences of CHST3 BINDING SITE, designated SEQ ID:10475, to the nucleotide sequence of VGAM2544 RNA, herein designated VGAM RNA, also designated SEQ ID:5255.

Another function of VGAM2544 is therefore inhibition of Carbohydrate (chondroitin 6) Sulfotransferase 3 (CHST3, Accession NM_004273). Accordingly, utilities of VGAM2544 include diagnosis, prevention and treatment of diseases and clinical conditions associated with CHST3. FIG. 1 further provides a conceptual description of a novel bioinformatically detected viral gene of the present invention, referred to here as Viral Genomic Address Messenger 2545 (VGAM2545) viral gene, which modulates expression of respective host target genes thereof, the function and utility of which host target genes is known in the art.

VGAM2545 is a novel bioinformatically detected regulatory, non protein coding, viral micro RNA (miRNA) gene. The method by which VGAM2545 was detected is described hereinabove with reference to FIGS. 1-8.

VGAM2545 gene, herein designated VGAM GENE, is a viral gene contained in the genome of Langat Virus. VGAM2545 host target gene, herein designated VGAM HOST TARGET GENE, is a human gene contained in the human genome.

VGAM2545 gene encodes a VGAM2545 precursor RNA, herein designated VGAM PRECURSOR RNA. Similar to other miRNA genes, and unlike most ordinary genes, VGAM2545 precursor RNA does not encode a protein. A nucleotide sequence identical or highly similar to the nucleotide sequence of VGAM2545 precursor RNA is designated SEQ ID:2531, and is provided hereinbelow with reference to the sequence listing part. Nucleotide sequence SEQ ID:2531 is located at position 3636 relative to the genome of Langat Virus.

VGAM2545 precursor RNA folds onto itself, forming VGAM2545 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2545 folded precursor RNA into VGAM2545 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2545 RNA is designated SEQ ID:5256, and is provided hereinbelow with reference to the sequence listing part.

VGAM2545 host target gene, herein designated VGAM HOST TARGET GENE, encodes a corresponding messenger RNA, VGAM2545 host target RNA, herein designated VGAM HOST TARGET RNA. VGAM2545 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2545 RNA, herein designated VGAM RNA, binds complementarily to one or more host target binding sites located in untranslated regions of VGAM2545 host target RNA, herein designated VGAM HOST TARGET RNA. This complementary binding is due to the fact that the nucleotide sequence of VGAM2545 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2545 RNA, herein designated VGAM RNA, may have a different number of host target binding sites in untranslated regions of a VGAM2545 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2545 RNA, herein designated VGAM RNA, to host target binding sites on VGAM2545 host target RNA, herein designated VGAM HOST TARGET RNA, such as BINDING SITE I, BINDING SITE II and BINDING SITE III, inhibits translation of VGAM2545 host target RNA into VGAM2545 host target protein, herein designated VGAM HOST TARGET PROTEIN. VGAM host target protein is therefore outlined by a broken line.

It is appreciated that VGAM2545 host target gene, herein designated VGAM HOST TARGET GENE, in fact represents a plurality of VGAM2545 host target genes. The mRNA of each one of this plurality of VGAM2545 host target genes comprises one or more host target binding sites, each having a nucleotide sequence which is at least partly complementary to VGAM2545 RNA, herein designated VGAM RNA, and which when bound by VGAM2545 RNA causes inhibition of translation of respective one or more VGAM2545 host target proteins.

It is further appreciated by one skilled in the art that the mode of translational inhibition illustrated by FIG. 1 with specific reference to translational inhibition exerted by VGAM2545 gene, herein designated VGAM GENE, on one or more VGAM2545 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2545 is inhibition of expression of host target genes, as part of a novel viral mechanism of attacking a host. Accordingly, utilities of VGAM2545 include diagnosis, prevention and treatment of viral infection by Langat Virus. Specific functions, and accordingly utilities, of VGAM2545 correlate with, and may be deduced from, the identity of the host target genes which VGAM2545 binds and inhibits, and the function of these host target genes, as elaborated hereinbelow.

Nucleotide sequences of the VGAM2545 precursor RNA, herein designated VGAM PRECURSOR RNA, and of the 'diced' VGAM2545 RNA, herein designated VGAM RNA, and a schematic representation of the secondary folding of VGAM2545 folded precursor RNA, herein designated VGAM FOLDED PRECURSOR RNA, of VGAM2545 are further described hereinbelow with reference to Table 1.

Nucleotide sequences of host target binding sites, such as BINDING SITE-I, BINDING SITE-II and BINDING SITE-III of FIG. 1, found on VGAM2545 host target RNA, and schematic representation of the complementarity of each of these host target binding sites to VGAM2545 RNA, herein designated VGAM RNA, are described hereinbelow with reference to Table 2.

As mentioned hereinabove with reference to FIG. 1, a function of VGAM2545 gene, herein designated VGAM is inhibition of expression of VGAM2545 target genes. It is appreciated that specific functions, and accordingly utilities, of VGAM2545 correlate with, and may be deduced from, the identity of the target genes which VGAM2545 binds and inhibits, and the function of these target genes, as elaborated hereinbelow.

Heat Shock Transcription Factor 2 Binding Protein (HSF2BP, Accession NM_007031) is a VGAM2545 host target gene. HSF2BP BINDING SITE is HOST TARGET binding site found in the 5' untranslated region of mRNA encoded by HSF2BP, corresponding to a HOST TARGET binding site such as BINDING SITE I, BINDING SITE II or BINDING SITE III. Table 2 illustrates the complementarity of the nucleotide sequences of HSF2BP BINDING SITE, designated SEQ ID:13896, to the nucleotide sequence of VGAM2545 RNA, herein designated VGAM RNA, also designated SEQ ID:5256.

A function of VGAM2545 is therefore inhibition of Heat Shock Transcription Factor 2 Binding Protein (HSF2BP, Accession NM_007031). Accordingly, utilities of VGAM2545 include diagnosis, prevention and treatment of diseases and clinical conditions associated with HSF2BP. Myeloid Differentiation Primary Response Gene (88) (MYD88, Accession NM_002468) is another VGAM2545 host target gene. MYD88 BINDING SITE is HOST TARGET binding site found in the 3' untranslated region of mRNA encoded by MYD88, corresponding to a HOST TARGET binding site such as BINDING SITE I, BINDING SITE II or BINDING SITE III. Table 2 illustrates the complementarity of the nucleotide sequences of MYD88 BINDING SITE, designated SEQ ID:8295, to the nucleotide sequence of VGAM2545 RNA, herein designated VGAM RNA, also designated SEQ ID:5256.

Another function of VGAM2545 is therefore inhibition of Myeloid Differentiation Primary Response Gene (88) (MYD88, Accession NM_002468), a gene which is involved in the toll-like receptor and il-1 receptor signaling pathway in the innate immune response. Accordingly, utilities of VGAM2545 include diagnosis, prevention and treatment of diseases and clinical conditions associated with MYD88. The function of MYD88 and its association with various diseases and clinical conditions, has been established by previous studies, as described hereinabove with reference to VGAM18. Protein Tyrosine Phosphatase, Non-receptor Type 7 (PTPN7, Accession NM_002832) is another VGAM2545 host target gene. PTPN7 BINDING SITE1 through PTPN7 BINDING SITE3 are HOST TARGET binding sites found in untranslated regions of mRNA encoded by PTPN7, corresponding to HOST TARGET binding sites such as BINDING SITE I, BINDING SITE II or BINDING SITE III. Table 2 illustrates the complementarity of the nucleotide sequences of PTPN7 BINDING SITE1 through PTPN7 BINDING SITE3, designated SEQ ID:8709, SEQ ID:27887 and SEQ ID:27890 respectively, to the nucleotide sequence of VGAM2545 RNA, herein designated VGAM RNA, also designated SEQ ID:5256.

Another function of VGAM2545 is therefore inhibition of Protein Tyrosine Phosphatase, Non-receptor Type 7 (PTPN7, Accession NM_002832). Accordingly, utilities of VGAM2545 include diagnosis, prevention and treatment of diseases and clinical conditions associated with PTPN7. Synuclein, Alpha Interacting Protein (synphilin) (SNCAIP, Accession XM_171090) is another VGAM2545 host target gene. SNCAIP BINDING SITE is HOST TARGET binding site found in the 5' untranslated region of mRNA encoded by SNCAIP, corresponding to a HOST TARGET binding site such as BINDING SITE I, BINDING SITE II or BINDING SITE III. Table 2 illustrates the complementarity of the nucleotide sequences of SNCAIP BINDING SITE, designated SEQ ID:45903, to the nucleotide sequence of VGAM2545 RNA, herein designated VGAM RNA, also designated SEQ ID:5256.

Another function of VGAM2545 is therefore inhibition of Synuclein, Alpha Interacting Protein (synphilin) (SNCAIP, Accession XM_171090), a gene which promotes formation of cytosolic inclusions in neurons. Accordingly, utilities of VGAM2545 include diagnosis, prevention and treatment of diseases and clinical conditions associated with SNCAIP. The function of SNCAIP has been established by previous studies. Parkinson disease (PD) is a neurodegenerative disease characterized by tremor, bradykinesia, rigidity, and postural instability. Postmortem examination shows loss of neurons and Lewy bodies, which are cytoplasmic eosinophilic inclusions, in the substantia nigra and other brain regions. A few families have been found to have PD on the basis of mutations, A53T (163890.0001) or A30P (163890.0002), in the gene encoding alpha-synuclein (SNCA). Alpha-synuclein is present in Lewy bodies of patients with sporadic PD, suggesting that alpha-synuclein may be involved in the pathogenesis of PD. To determine the protein-interaction partners of alpha-synuclein, Engelender et al. (1999) screened human brain libraries in the yeast 2-hybrid system. They identified a novel interacting protein they designated synphilin-1, encoded by the gene SNCAIP. The predicted 919-amino acid synphilin-1 protein contains several protein-protein interaction domains, such as ankyrin-like repeats and a coiled-coil domain. An approximately 4-kb SNCAIP transcript was detected in many human tissues by Northern blot analysis and was particularly enriched in brain, heart, and placenta. Synphilin-1 was present in many regions in brain, including substantia nigra. In immunoblot analyses of human brain, synphilin-1 appeared as a single band of approximately 90 kD in several brain regions, with no differences in the level of expression in controls, patients with PD, or patients with Alzheimer disease (OMIM Ref. No. 104300). They found that alpha-synuclein interacts in vivo with synphilin-1 in neurons. Cotransfection of both proteins (but not control proteins) in HEK293 cells yielded cytoplasmic eosinophilic inclusions. Engelender et al. (2000) determined that the human SNCAIP gene contains 10 exons and has a highly polymorphic GT repeat within intron 5 that is suitable for linkage analysis in families with Parkinson disease. Using immunohistochemistry in human postmortem brain tissue, they found that synphilin-1 protein, like alpha-synuclein protein, is present in neuropil.

Full details of the abovementioned studies are described in the following publications, the disclosure of which are hereby incorporated by reference:

Engelender, S.; Kaminsky, Z.; Guo, X.; Sharp, A. H.; Amaravi, R. K.; Kleiderlein, J. J.; Margolis, R. L.; Troncoso, J. C.; Lanahan, A. A.; Worley, P. F.; Dawson, V. L.; Dawson, T. M.; Ross, C. A.: Synphilin-1 associates with alpha-synuclein and promotes the formation of cytosolic inclusions. Nature Genet. 22:110-114, 1999; and Engelender, S.; Wanner, T.; Kleiderlein, J. J.; Wakabayashi, K.; Tsuji, S.; Takahashi, H.; Ashworth, R.; Margolis, R. L.; Ross, C. A.: Organization of the human synphilin-1 gene, a ca.

Further studies establishing the function and utilities of SNCAIP are found in John Hopkins OMIM database record ID 603779, and in sited publications numbered 244 and 8193 listed in the bibliography section hereinbelow, which are also hereby incorporated by reference. Butyrophilin, Subfamily 2, Member A2 (BTN2A2, Accession NM_006995) is another VGAM2545 host target gene. BTN2A2 BINDING SITE is HOST TARGET binding site found in the 3' untranslated region of mRNA encoded by BTN2A2, corresponding to a HOST TARGET binding site such as BINDING SITE I, BINDING SITE II or BINDING SITE III. Table 2 illustrates the complementarity of the nucleotide sequences of BTN2A2 BINDING SITE, designated SEQ ID:13857, to the nucleotide sequence of VGAM2545 RNA, herein designated VGAM RNA, also designated SEQ ID:5256.

Another function of VGAM2545 is therefore inhibition of Butyrophilin, Subfamily 2, Member A2 (BTN2A2, Accession NM_006995). Accordingly, utilities of VGAM2545 include diagnosis, prevention and treatment of diseases and clinical conditions associated with BTN2A2. DKFZP434A0131 (Accession NM_018991) is another VGAM2545 host target gene. DKFZP434A0131 BINDING SITE is HOST TARGET binding site found in the 3' untranslated region of mRNA encoded by DKFZP434A0131, corresponding to a HOST TARGET binding site such as BINDING SITE I, BINDING SITE II or BINDING SITE III. Table 2 illustrates the complementarity of the nucleotide sequences of DKFZP434A0131 BINDING SITE, designated SEQ ID:21061, to the nucleotide sequence of VGAM2545 RNA, herein designated VGAM RNA, also designated SEQ ID:5256.

Another function of VGAM2545 is therefore inhibition of DKFZP434A0131 (Accession NM_018991). Accordingly, utilities of VGAM2545 include diagnosis, prevention and treatment of diseases and clinical conditions associated with DKFZP434A0131. F-box Only Protein 27 (FBXO27, Accession XM_059045) is another VGAM2545 host target gene. FBXO27 BINDING SITE is HOST TARGET binding site found in the 3' untranslated region of mRNA encoded by FBXO27, corresponding to a HOST TARGET binding site such as BINDING SITE I, BINDING SITE II or BINDING SITE III. Table 2 illustrates the complementarity of the nucleotide sequences of FBXO27 BINDING SITE, designated SEQ ID:36833, to the nucleotide sequence of VGAM2545 RNA, herein designated VGAM RNA, also designated SEQ ID:5256.

Another function of VGAM2545 is therefore inhibition of F-box Only Protein 27 (FBXO27, Accession XM_059045). Accordingly, utilities of VGAM2545 include diagnosis, prevention and treatment of diseases and clinical conditions associated with FBXO27. FLJ31762 (Accession NM_144601) is another VGAM2545 host target gene. FLJ31762 BINDING SITE is HOST TARGET binding site found in the 3' untranslated region of mRNA encoded by FLJ31762, corresponding to a HOST TARGET binding site such as BINDING SITE I, BINDING SITE II or BINDING SITE III. Table 2 illustrates the complementarity of the nucleotide sequences of FLJ31762 BINDING SITE, designated SEQ ID:29417, to the nucleotide sequence of VGAM2545 RNA, herein designated VGAM RNA, also designated SEQ ID:5256.

Another function of VGAM2545 is therefore inhibition of FLJ31762 (Accession NM_144601). Accordingly, utilities of VGAM2545 include diagnosis, prevention and treatment of diseases and clinical conditions associated with FLJ31762. KIAA0057 (Accession NM_012288) is another VGAM2545 host target gene. KIAA0057 BINDING SITE is HOST TARGET binding site found in the 3' untranslated region of mRNA encoded by KIAA0057, corresponding to a HOST TARGET binding site such as BINDING SITE I, BINDING SITE II or BINDING SITE III. Table 2 illustrates the complementarity of the nucleotide sequences of KIAA0057 BINDING SITE, designated SEQ ID:14620, to the nucleotide sequence of VGAM2545 RNA, herein designated VGAM RNA, also designated SEQ ID:5256.

Another function of VGAM2545 is therefore inhibition of KIAA0057 (Accession NM_012288). Accordingly, utilities of VGAM2545 include diagnosis, prevention and treatment of diseases and clinical conditions associated with KIAA0057. PAX Transcription Activation Domain Interacting Protein 1 Like (PAXIP1L, Accession XM_046538) is another VGAM2545 host target gene. PAXIP1L BINDING SITE is HOST TARGET binding site found in the 3' untranslated region of mRNA encoded by PAXIP1L, corresponding to a HOST TARGET binding site such as BINDING SITE I, BINDING SITE II or BINDING SITE III. Table 2 illustrates the complementarity of the nucleotide sequences of PAXIP1L BINDING SITE, designated SEQ ID:34738, to the nucleotide sequence of VGAM2545 RNA, herein designated VGAM RNA, also designated SEQ ID:5256.

Another function of VGAM2545 is therefore inhibition of PAX Transcription Activation Domain Interacting Protein 1 Like (PAXIP1L, Accession XM_046538). Accordingly, utilities of VGAM2545 include diagnosis, prevention and treatment of diseases and clinical conditions associated with PAXIP1L. PRO0456 (Accession NM_014127) is another VGAM2545 host target gene. PRO0456 BINDING SITE is HOST TARGET binding site found in the 3' untranslated region of mRNA encoded by PRO0456, corresponding to a HOST TARGET binding site such as BINDING SITE I, BINDING SITE II or BINDING SITE III. Table 2 illustrates the complementarity of the nucleotide sequences of PRO0456 BINDING SITE, designated SEQ ID:15394, to the nucleotide sequence of VGAM2545 RNA, herein designated VGAM RNA, also designated SEQ ID:5256.

Another function of VGAM2545 is therefore inhibition of PRO0456 (Accession NM_014127). Accordingly, utilities of VGAM2545 include diagnosis, prevention and treatment of diseases and clinical conditions associated with PRO0456. PRO2964 (Accession NM_018547) is another VGAM2545 host target gene. PRO2964 BINDING SITE is HOST TARGET binding site found in the 3' untranslated region of mRNA encoded by PRO2964, corresponding to a HOST TARGET binding site such as BINDING SITE I, BINDING SITE II or BINDING SITE III. Table 2 illustrates the complementarity of the nucleotide sequences of PRO2964 BINDING SITE, designated SEQ ID:20630, to the nucleotide sequence of VGAM2545 RNA, herein designated VGAM RNA, also designated SEQ ID:5256.

Another function of VGAM2545 is therefore inhibition of PRO2964 (Accession NM_018547). Accordingly, utilities of VGAM2545 include diagnosis, prevention and treatment of diseases and clinical conditions associated with PRO2964. Serine Palmitoyltransferase, Long Chain Base Subunit 2 (SPTLC2, Accession NM_004863) is another VGAM2545 host target gene. SPTLC2 BINDING SITE is HOST TARGET binding site found in the 3' untranslated region of mRNA encoded by SPTLC2, corresponding to a HOST TARGET binding site such as BINDING SITE I, BINDING SITE II or BINDING SITE III. Table 2 illustrates the complementarity of the nucleotide sequences of SPTLC2 BINDING SITE, designated SEQ ID:11276, to the nucleotide sequence of VGAM2545 RNA, herein designated VGAM RNA, also designated SEQ ID:5256.

Another function of VGAM2545 is therefore inhibition of Serine Palmitoyltransferase, Long Chain Base Subunit 2 (SPTLC2, Accession NM_004863). Accordingly, utilities of VGAM2545 include diagnosis, prevention and treatment of diseases and clinical conditions associated with SPTLC2. Signal Sequence Receptor, Gamma (translocon-associated protein gamma) (SSR3, Accession NM_007107) is another VGAM2545 host target gene. SSR3 BINDING SITE is HOST TARGET binding site found in the 3' untranslated region of mRNA encoded by SSR3, corresponding to a HOST TARGET binding site such as BINDING SITE I, BINDING SITE II or BINDING SITE III. Table 2 illustrates the complementarity of the nucleotide sequences of SSR3 BINDING SITE, designated SEQ ID:13970, to the nucleotide sequence of VGAM2545 RNA, herein designated VGAM RNA, also designated SEQ ID:5256.

Another function of VGAM2545 is therefore inhibition of Signal Sequence Receptor, Gamma (translocon-associated protein gamma) (SSR3, Accession NM_007107). Accordingly, utilities of VGAM2545 include diagnosis, prevention and treatment of diseases and clinical conditions associated with SSR3. Zinc Finger Protein 145 (Kruppel-like, expressed in promyelocytic leukemia) (ZNF145, Accession NM_006006) is another VGAM2545 host target gene. ZNF145 BINDING SITE is HOST TARGET binding site found in the 5' untranslated region of mRNA encoded by ZNF145, corresponding to a HOST TARGET binding site such as BINDING SITE I, BINDING SITE II or BINDING SITE III. Table 2 illustrates the complementarity of the nucleotide sequences of ZNF145 BINDING SITE, designated SEQ ID:12617, to the nucleotide sequence of VGAM2545 RNA, herein designated VGAM RNA, also designated SEQ ID:5256.

Another function of VGAM2545 is therefore inhibition of Zinc Finger Protein 145 (Kruppel-like, expressed in promyelocytic leukemia) (ZNF145, Accession NM_006006).

Accordingly, utilities of VGAM2545 include diagnosis, prevention and treatment of diseases and clinical conditions associated with ZNF145. LOC115073 (Accession XM_055193) is another VGAM2545 host target gene. LOC115073 BINDING SITE is HOST TARGET binding site found in the 5' untranslated region of mRNA encoded by LOC115073, corresponding to a HOST TARGET binding site such as BINDING SITE I, BINDING SITE II or BINDING SITE III. Table 2 illustrates the complementarity of the nucleotide sequences of LOC115073 BINDING SITE, designated SEQ ID:36238, to the nucleotide sequence of VGAM2545 RNA, herein designated VGAM RNA, also designated SEQ ID:5256.

Another function of VGAM2545 is therefore inhibition of LOC115073 (Accession XM_055193). Accordingly, utilities of VGAM2545 include diagnosis, prevention and treatment of diseases and clinical conditions associated with LOC115073. LOC145719 (Accession XM_096848) is another VGAM2545 host target gene. LOC145719 BINDING SITE is HOST TARGET binding site found in the 3' untranslated region of mRNA encoded by LOC145719, corresponding to a HOST TARGET binding site such as BINDING SITE I, BINDING SITE II or BINDING SITE III. Table 2 illustrates the complementarity of the nucleotide sequences of LOC145719 BINDING SITE, designated SEQ ID:40570, to the nucleotide sequence of VGAM2545 RNA, herein designated VGAM RNA, also designated SEQ ID:5256.

Another function of VGAM2545 is therefore inhibition of LOC145719 (Accession XM_096848). Accordingly, utilities of VGAM2545 include diagnosis, prevention and treatment of diseases and clinical conditions associated with LOC145719. LOC145720 (Accession XM_096846) is another VGAM2545 host target gene. LOC145720 BINDING SITE is HOST TARGET binding site found in the 3' untranslated region of mRNA encoded by LOC145720, corresponding to a HOST TARGET binding site such as BINDING SITE I, BINDING SITE II or BINDING SITE III. Table 2 illustrates the complementarity of the nucleotide sequences of LOC145720 BINDING SITE, designated SEQ ID:40560, to the nucleotide sequence of VGAM2545 RNA, herein designated VGAM RNA, also designated SEQ ID:5256.

Another function of VGAM2545 is therefore inhibition of LOC145720 (Accession XM_096846). Accordingly, utilities of VGAM2545 include diagnosis, prevention and treatment of diseases and clinical conditions associated with LOC145720. LOC197114 (Accession XM_116987) is another VGAM2545 host target gene. LOC197114 BINDING SITE is HOST TARGET binding site found in the 3' untranslated region of mRNA encoded by LOC197114, corresponding to a HOST TARGET binding site such as BINDING SITE I, BINDING SITE II or BINDING SITE III. Table 2 illustrates the complementarity of the nucleotide sequences of LOC197114 BINDING SITE, designated SEQ ID:43184, to the nucleotide sequence of VGAM2545 RNA, herein designated VGAM RNA, also designated SEQ ID:5256.

Another function of VGAM2545 is therefore inhibition of LOC197114 (Accession XM_116987). Accordingly, utilities of VGAM2545 include diagnosis, prevention and treatment of diseases and clinical conditions associated with LOC197114. LOC197117 (Accession XM_116989) is another VGAM2545 host target gene. LOC197117 BINDING SITE is HOST TARGET binding site found in the 3' untranslated region of mRNA encoded by LOC197117, corresponding to a HOST TARGET binding site such as BINDING SITE I, BINDING SITE II or BINDING SITE III. Table 2 illustrates the complementarity of the nucleotide sequences of LOC197117 BINDING SITE, designated SEQ ID:43193, to the nucleotide sequence of VGAM2545 RNA, herein designated VGAM RNA, also designated SEQ ID:5256.

Another function of VGAM2545 is therefore inhibition of LOC197117 (Accession XM_116989). Accordingly, utilities of VGAM2545 include diagnosis, prevention and treatment of diseases and clinical conditions associated with LOC197117. LOC222252 (Accession XM_168640) is another VGAM2545 host target gene. LOC222252 BINDING SITE is HOST TARGET binding site found in the 5' untranslated region of mRNA encoded by LOC222252, corresponding to a HOST TARGET binding site such as BINDING SITE I, BINDING SITE II or BINDING SITE III. Table 2 illustrates the complementarity of the nucleotide sequences of LOC222252 BINDING SITE, designated SEQ ID:45286, to the nucleotide sequence of VGAM2545 RNA, herein designated VGAM RNA, also designated SEQ ID:5256.

Another function of VGAM2545 is therefore inhibition of LOC222252 (Accession XM_168640). Accordingly, utilities of VGAM2545 include diagnosis, prevention and treatment of diseases and clinical conditions associated with LOC222252. FIG. 1 further provides a conceptual description of a novel bioinformatically detected viral gene of the present invention, referred to here as Viral Genomic Address Messenger 2546 (VGAM2546) viral gene, which modulates expression of respective host target genes thereof, the function and utility of which host target genes is known in the art.

VGAM2546 is a novel bioinformatically detected regulatory, non protein coding, viral micro RNA (miRNA) gene. The method by which VGAM2546 was detected is described hereinabove with reference to FIGS. 1-8.

VGAM2546 gene, herein designated VGAM GENE, is a viral gene contained in the genome of Langat Virus. VGAM2546 host target gene, herein designated VGAM HOST TARGET GENE, is a human gene contained in the human genome.

VGAM2546 gene encodes a VGAM2546 precursor RNA, herein designated VGAM PRECURSOR RNA. Similar to other miRNA genes, and unlike most ordinary genes, VGAM2546 precursor RNA does not encode a protein. A nucleotide sequence identical or highly similar to the nucleotide sequence of VGAM2546 precursor RNA is designated SEQ ID:2532, and is provided hereinbelow with reference to the sequence listing part. Nucleotide sequence SEQ ID:2532 is located at position 3420 relative to the genome of Langat Virus.

VGAM2546 precursor RNA folds onto itself, forming VGAM2546 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2546 folded precursor RNA into VGAM2546 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM2546 RNA is designated SEQ ID:5257, and is provided hereinbelow with reference to the sequence listing part.

VGAM2546 host target gene, herein designated VGAM HOST TARGET GENE, encodes a corresponding messenger RNA, VGAM2546 host target RNA, herein designated VGAM HOST TARGET RNA. VGAM2546 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2546 RNA, herein designated VGAM RNA, binds complementarily to one or more host target binding sites located in untranslated regions of VGAM2546 host target RNA, herein designated VGAM HOST TARGET RNA. This complementary binding is due to the fact that the nucleotide sequence of VGAM2546 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2546 RNA, herein designated VGAM RNA, may have a different number of host target binding sites in untranslated regions of a VGAM2546 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2546 RNA, herein designated VGAM RNA, to host target binding sites on VGAM2546 host target RNA, herein designated VGAM HOST TARGET RNA, such as BINDING SITE I, BINDING SITE II and BINDING SITE III, inhibits translation of VGAM2546 host target RNA into VGAM2546 host target protein, herein designated VGAM HOST TARGET PROTEIN. VGAM host target protein is therefore outlined by a broken line.

It is appreciated that VGAM2546 host target gene, herein designated VGAM HOST TARGET GENE, in fact represents a plurality of VGAM2546 host target genes. The mRNA of each one of this plurality of VGAM2546 host target genes comprises one or more host target binding sites, each having a nucleotide sequence which is at least partly complementary to VGAM2546 RNA, herein designated VGAM RNA, and which when bound by VGAM2546 RNA causes inhibition of translation of respective one or more VGAM2546 host target proteins.

It is further appreciated by one skilled in the art that the mode of translational inhibition illustrated by FIG. 1 with specific reference to translational inhibition exerted by VGAM2546 gene, herein designated VGAM GENE, on one or more VGAM2546 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2546 is inhibition of expression of host target genes, as part of a novel viral mechanism of attacking a host. Accordingly, utilities of VGAM2546 include diagnosis, prevention and treatment of viral infection by Langat Virus. Specific functions, and accordingly utilities, of VGAM2546 correlate with, and may be deduced from, the identity of the host target genes which VGAM2546 binds and inhibits, and the function of these host target genes, as elaborated hereinbelow.

Nucleotide sequences of the VGAM2546 precursor RNA, herein designated VGAM PRECURSOR RNA, and of the 'diced' VGAM2546 RNA, herein designated VGAM RNA, and a schematic representation of the secondary folding of VGAM2546 folded precursor RNA, herein designated VGAM FOLDED PRECURSOR RNA, of VGAM2546 are further described hereinbelow with reference to Table 1.

Nucleotide sequences of host target binding sites, such as BINDING SITE-I, BINDING SITE-II and BINDING SITE-III of FIG. 1, found on VGAM2546 host target RNA, and schematic representation of the complementarity of each of these host target binding sites to VGAM2546 RNA, herein designated VGAM RNA, are described hereinbelow with reference to Table 2.

As mentioned hereinabove with reference to FIG. 1, a function of VGAM2546 gene, herein designated VGAM is inhibition of expression of VGAM2546 target genes. It is appreciated that specific functions, and accordingly utilities, of VGAM2546 correlate with, and may be deduced from, the identity of the target genes which VGAM2546 binds and inhibits, and the function of these target genes, as elaborated hereinbelow.

CGTHBA (Accession NM_012075) is a VGAM2546 host target gene. CGTHBA BINDING SITE is HOST TARGET binding site found in the 3' untranslated region of mRNA encoded by CGTHBA, corresponding to a HOST TARGET binding site such as BINDING SITE I, BINDING SITE II or BINDING SITE III. Table 2 illustrates the complementarity of the nucleotide sequences of CGTHBA BINDING SITE, designated SEQ ID:14358, to the nucleotide sequence of VGAM2546 RNA, herein designated VGAM RNA, also designated SEQ ID:5257.

A function of VGAM2546 is therefore inhibition of CGTHBA (Accession NM_012075). Accordingly, utilities of VGAM2546 include diagnosis, prevention and treatment of diseases and clinical conditions associated with CGTHBA. Collagen, Type XI, Alpha 2 (COL11A2, Accession NM_080680) is another VGAM2546 host target gene. COL11A2 BINDING SITE1 and COL11A2 BINDING SITE2 are HOST TARGET binding sites found in untranslated regions of mRNA encoded by COL11A2, corresponding to HOST TARGET binding sites such as BINDING SITE I, BINDING SITE II or BINDING SITE III. Table 2 illustrates the complementarity of the nucleotide sequences of COL11A2 BINDING SITE1 and COL11A2 BINDING SITE2, designated SEQ ID:27975 and SEQ ID:27980 respectively, to the nucleotide sequence of VGAM2546 RNA, herein designated VGAM RNA, also designated SEQ ID:5257.

Another function of VGAM2546 is therefore inhibition of Collagen, Type XI, Alpha 2 (COL11A2, Accession NM_080680). Accordingly, utilities of VGAM2546 include diagnosis, prevention and treatment of diseases and clinical conditions associated with COL11A2. FLJ20464 (Accession NM_017834) is another VGAM2546 host target gene. FLJ20464 BINDING SITE is HOST TARGET binding site found in the 5' untranslated region of mRNA encoded by FLJ20464, corresponding to a HOST TARGET binding site such as BINDING SITE I, BINDING SITE II or BINDING SITE III. Table 2 illustrates the complementarity of the nucleotide sequences of FLJ20464 BINDING SITE, designated SEQ ID:19500, to the nucleotide sequence of VGAM2546

RNA, herein designated VGAM RNA, also designated SEQ ID:5257.

Another function of VGAM2546 is therefore inhibition of FLJ20464 (Accession NM_017834). Accordingly, utilities of VGAM2546 include diagnosis, prevention and treatment of diseases and clinical conditions associated with FLJ20464. KIAA0515 (Accession XM_033380) is another VGAM2546 host target gene. KIAA0515 BINDING SITE is HOST TARGET binding site found in the 3' untranslated region of mRNA encoded by KIAA0515, corresponding to a HOST TARGET binding site such as BINDING SITE I, BINDING SITE II or BINDING SITE III. Table 2 illustrates the complementarity of the nucleotide sequences of KIAA0515 BINDING SITE, designated SEQ ID:31920, to the nucleotide sequence of VGAM2546 RNA, herein designated VGAM RNA, also designated SEQ ID:5257.

Another function of VGAM2546 is therefore inhibition of KIAA0515 (Accession XM_033380). Accordingly, utilities of VGAM2546 include diagnosis, prevention and treatment of diseases and clinical conditions associated with KIAA0515. KIAA0542 (Accession XM_038520) is another VGAM2546 host target gene. KIAA0542 BINDING SITE is HOST TARGET binding site found in the 3' untranslated region of mRNA encoded by KIAA0542, corresponding to a HOST TARGET binding site such as BINDING SITE I, BINDING SITE II or BINDING SITE III. Table 2 illustrates the complementarity of the nucleotide sequences of KIAA0542 BINDING SITE, designated SEQ ID:32857, to the nucleotide sequence of VGAM2546 RNA, herein designated VGAM RNA, also designated SEQ ID:5257.

Another function of VGAM2546 is therefore inhibition of KIAA0542 (Accession XM_038520). Accordingly, utilities of VGAM2546 include diagnosis, prevention and treatment of diseases and clinical conditions associated with KIAA0542. VRP (Accession NM_007063) is another VGAM2546 host target gene. VRP BINDING SITE is HOST TARGET binding site found in the 5' untranslated region of mRNA encoded by VRP, corresponding to a HOST TARGET binding site such as BINDING SITE I, BINDING SITE II or BINDING SITE III. Table 2 illustrates the complementarity of the nucleotide sequences of VRP BINDING SITE, designated SEQ ID:13926, to the nucleotide sequence of VGAM2546 RNA, herein designated VGAM RNA, also designated SEQ ID:5257.

Another function of VGAM2546 is therefore inhibition of VRP (Accession NM_007063). Accordingly, utilities of VGAM2546 include diagnosis, prevention and treatment of diseases and clinical conditions associated with VRP. LOC148756 (Accession XM_097516) is another VGAM2546 host target gene. LOC148756 BINDING SITE is HOST TARGET binding site found in the 3' untranslated region of mRNA encoded by LOC148756, corresponding to a HOST TARGET binding site such as BINDING SITE I, BINDING SITE II or BINDING SITE III. Table 2 illustrates the complementarity of the nucleotide sequences of LOC148756 BINDING SITE, designated SEQ ID:40902, to the nucleotide sequence of VGAM2546 RNA, herein designated VGAM RNA, also designated SEQ ID:5257.

Another function of VGAM2546 is therefore inhibition of LOC148756 (Accession XM_097516). Accordingly, utilities of VGAM2546 include diagnosis, prevention and treatment of diseases and clinical conditions associated with LOC148756. LOC254413 (Accession XM_173141) is another VGAM2546 host target gene. LOC254413 BINDING SITE is HOST TARGET binding site found in the 5' untranslated region of mRNA encoded by LOC254413, corresponding to a HOST TARGET binding site such as BINDING SITE I, BINDING SITE II or BINDING SITE III. Table 2 illustrates the complementarity of the nucleotide sequences of LOC254413 BINDING SITE, designated SEQ ID:46399, to the nucleotide sequence of VGAM2546 RNA, herein designated VGAM RNA, also designated SEQ ID:5257.

Another function of VGAM2546 is therefore inhibition of LOC254413 (Accession XM_173141). Accordingly, utilities of VGAM2546 include diagnosis, prevention and treatment of diseases and clinical conditions associated with LOC254413. LOC255974 (Accession XM_173706) is another VGAM2546 host target gene. LOC255974 BINDING SITE is HOST TARGET binding site found in the 5' untranslated region of mRNA encoded by LOC255974, corresponding to a HOST TARGET binding site such as BINDING SITE I, BINDING SITE II or BINDING SITE III. Table 2 illustrates the complementarity of the nucleotide sequences of LOC255974 BINDING SITE, designated SEQ ID:46555, to the nucleotide sequence of VGAM2546 RNA, herein designated VGAM RNA, also designated SEQ ID:5257.

Another function of VGAM2546 is therefore inhibition of LOC255974 (Accession XM_173706). Accordingly, utilities of VGAM2546 include diagnosis, prevention and treatment of diseases and clinical conditions associated with LOC255974. LOC256306 (Accession XM_172976) is another VGAM2546 host target gene. LOC256306 BINDING SITE is HOST TARGET binding site found in the 3' untranslated region of mRNA encoded by LOC256306, corresponding to a HOST TARGET binding site such as BINDING SITE I, BINDING SITE II or BINDING SITE III. Table 2 illustrates the complementarity of the nucleotide sequences of LOC256306 BINDING SITE, designated SEQ ID:46235, to the nucleotide sequence of VGAM2546 RNA, herein designated VGAM RNA, also designated SEQ ID:5257.

Another function of VGAM2546 is therefore inhibition of LOC256306 (Accession XM_172976). Accordingly, utilities of VGAM2546 include diagnosis, prevention and treatment of diseases and clinical conditions associated with LOC256306. FIG. 1 further provides a conceptual description of a novel bioinformatically detected viral gene of the present invention, referred to here as Viral Genomic Address Messenger 2547 (VGAM2547) viral gene, which modulates expression of respective host target genes thereof, the function and utility of which host target genes is known in the art.

VGAM2547 is a novel bioinformatically detected regulatory, non protein coding, viral micro RNA (miRNA) gene. The method by which VGAM2547 was detected is described hereinabove with reference to FIGS. 1-8.

VGAM2547 gene, herein designated VGAM GENE, is a viral gene contained in the genome of Langat Virus. VGAM2547 host target gene, herein designated VGAM HOST TARGET GENE, is a human gene contained in the human genome.

VGAM2547 gene encodes a VGAM2547 precursor RNA, herein designated VGAM PRECURSOR RNA. Similar to other miRNA genes, and unlike most ordinary genes, VGAM2547 precursor RNA does not encode a protein. A nucleotide sequence identical or highly similar to the nucleotide sequence of VGAM2547 precursor RNA is designated SEQ ID:2533, and is provided hereinbelow with reference to the sequence listing part. Nucleotide sequence SEQ ID:2533 is located at position 6689 relative to the genome of Langat Virus.

VGAM2547 precursor RNA folds onto itself, forming VGAM2547 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2547 folded precursor RNA into VGAM2547 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2547 RNA is designated SEQ ID:5258, and is provided hereinbelow with reference to the sequence listing part.

VGAM2547 host target gene, herein designated VGAM HOST TARGET GENE, encodes a corresponding messenger RNA, VGAM2547 host target RNA, herein designated VGAM HOST TARGET RNA. VGAM2547 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2547 RNA, herein designated VGAM RNA, binds complementarily to one or more host target binding sites located in untranslated regions of VGAM2547 host target RNA, herein designated VGAM HOST TARGET RNA. This complementary binding is due to the fact that the nucleotide sequence of VGAM2547 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2547 RNA, herein designated VGAM RNA, may have a different number of host target binding sites in untranslated regions of a VGAM2547 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2547 RNA, herein designated VGAM RNA, to host target binding sites on VGAM2547 host target RNA, herein designated VGAM HOST TARGET RNA, such as BINDING SITE I, BINDING SITE II and BINDING SITE III, inhibits translation of VGAM2547 host target RNA into VGAM2547 host target protein, herein designated VGAM HOST TARGET PROTEIN. VGAM host target protein is therefore outlined by a broken line.

It is appreciated that VGAM2547 host target gene, herein designated VGAM HOST TARGET GENE, in fact represents a plurality of VGAM2547 host target genes. The mRNA of each one of this plurality of VGAM2547 host target genes comprises one or more host target binding sites, each having a nucleotide sequence which is at least partly complementary to VGAM2547 RNA, herein designated VGAM RNA, and which when bound by VGAM2547 RNA causes inhibition of translation of respective one or more VGAM2547 host target proteins.

It is further appreciated by one skilled in the art that the mode of translational inhibition illustrated by FIG. 1 with specific reference to translational inhibition exerted by VGAM2547 gene, herein designated VGAM GENE, on one or more VGAM2547 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2547 is inhibition of expression of host target genes, as part of a novel viral mechanism of attacking a host. Accordingly, utilities of VGAM2547 include diagnosis, prevention and treatment of viral infection by Langat Virus. Specific functions, and accordingly utilities, of VGAM2547 correlate with, and may be deduced from, the identity of the host target genes which VGAM2547 binds and inhibits, and the function of these host target genes, as elaborated hereinbelow.

Nucleotide sequences of the VGAM2547 precursor RNA, herein designated VGAM PRECURSOR RNA, and of the 'diced' VGAM2547 RNA, herein designated VGAM RNA, and a schematic representation of the secondary folding of VGAM2547 folded precursor RNA, herein designated VGAM FOLDED PRECURSOR RNA, of VGAM2547 are further described hereinbelow with reference to Table 1.

Nucleotide sequences of host target binding sites, such as BINDING SITE-I, BINDING SITE-II and BINDING SITE-III of FIG. 1, found on VGAM2547 host target RNA, and schematic representation of the complementarity of each of these host target binding sites to VGAM2547 RNA, herein designated VGAM RNA, are described hereinbelow with reference to Table 2.

As mentioned hereinabove with reference to FIG. 1, a function of VGAM2547 gene, herein designated VGAM is inhibition of expression of VGAM2547 target genes. It is appreciated that specific functions, and accordingly utilities, of VGAM2547 correlate with, and may be deduced from, the identity of the target genes which VGAM2547 binds and inhibits, and the function of these target genes, as elaborated hereinbelow.

Guanylate Cyclase 1, Soluble, Alpha 3 (GUCY1A3, Accession XM_032838) is a VGAM2547 host target gene. GUCY1A3 BINDING SITE is HOST TARGET binding site found in the 5' untranslated region of mRNA encoded by GUCY1A3, corresponding to a HOST TARGET binding site such as BINDING SITE I, BINDING SITE II or BINDING SITE III. Table 2 illustrates the complementarity of the nucleotide sequences of GUCY1A3 BINDING SITE, designated SEQ ID:31779, to the nucleotide sequence of VGAM2547 RNA, herein designated VGAM RNA, also designated SEQ ID:5258.

A function of VGAM2547 is therefore inhibition of Guanylate Cyclase 1, Soluble, Alpha 3 (GUCY1A3, Accession XM_032838), a gene which is alpha 1 (alpha 3) subunit of soluble guanylate cyclase and forms a heterodimer with GUCY1B3 that converts GTP to cGMP. Accordingly, utilities of VGAM2547 include diagnosis, prevention and treatment of diseases and clinical conditions associated with GUCY1A3. The function of GUCY1A3 and its association with various diseases and clinical conditions, has been established by previous studies, as described hereinabove with reference to VGAM206. Baculoviral IAP Repeat-containing 8 (BIRC8, Accession NM_033341) is another VGAM2547 host target gene. BIRC8 BINDING SITE is HOST TARGET binding site found in the 5' untranslated region of mRNA encoded by BIRC8, corresponding to a HOST TARGET binding site such as BINDING SITE I, BINDING SITE II or BINDING SITE III. Table 2 illustrates the complementarity of the nucleotide sequences of BIRC8 BINDING SITE, designated SEQ ID:27197, to the nucleotide sequence of VGAM2547 RNA, herein designated VGAM RNA, also designated SEQ ID:5258.

Another function of VGAM2547 is therefore inhibition of Baculoviral IAP Repeat-containing 8 (BIRC8, Accession NM_033341). Accordingly, utilities of VGAM2547 include diagnosis, prevention and treatment of diseases and clinical conditions associated with BIRC8. Carbohydrate (chondroitin 6) Sulfotransferase 3 (CHST3, Accession NM_004273) is another VGAM2547 host target gene. CHST3 BINDING SITE is HOST TARGET binding site found in the 3' untranslated region of mRNA encoded by CHST3, corresponding to a HOST TARGET binding site such as BINDING SITE I, BINDING SITE II or BINDING SITE III. Table 2 illustrates the complementarity of the nucleotide sequences of CHST3 BINDING SITE, designated SEQ ID:10477, to the nucleotide sequence of VGAM2547 RNA, herein designated VGAM RNA, also designated SEQ ID:5258.

Another function of VGAM2547 is therefore inhibition of Carbohydrate (chondroitin 6) Sulfotransferase 3 (CHST3, Accession NM_004273). Accordingly, utilities of VGAM2547 include diagnosis, prevention and treatment of diseases and clinical conditions associated with CHST3. FLJ10201 (Accession NM_018023) is another VGAM2547 host target gene. FLJ10201 BINDING SITE is HOST TARGET binding site found in the 3' untranslated region of mRNA encoded by FLJ10201, corresponding to a HOST TARGET binding site such as BINDING SITE I, BINDING SITE II or BINDING SITE III. Table 2 illustrates the complementarity of the nucleotide sequences of FLJ10201 BINDING SITE, designated SEQ ID:19761, to the nucleotide sequence of VGAM2547 RNA, herein designated VGAM RNA, also designated SEQ ID:5258.

Another function of VGAM2547 is therefore inhibition of FLJ10201 (Accession NM_018023). Accordingly, utilities of VGAM2547 include diagnosis, prevention and treatment of diseases and clinical conditions associated with FLJ10201. FLJ33069 (Accession NM_144649) is another VGAM2547 host target gene. FLJ33069 BINDING SITE is HOST TARGET binding site found in the 3' untranslated region of mRNA encoded by FLJ33069, corresponding to a HOST TARGET binding site such as BINDING SITE I, BINDING SITE II or BINDING SITE III. Table 2 illustrates the complementarity of the nucleotide sequences of FLJ33069 BINDING SITE, designated SEQ ID:29475, to the nucleotide sequence of VGAM2547 RNA, herein designated VGAM RNA, also designated SEQ ID:5258.

Another function of VGAM2547 is therefore inhibition of FLJ33069 (Accession NM_144649). Accordingly, utilities of VGAM2547 include diagnosis, prevention and treatment of diseases and clinical conditions associated with FLJ33069. KIAA0478 (Accession NM_014870) is another VGAM2547 host target gene. KIAA0478 BINDING SITE1 and KIAA0478 BINDING SITE2 are HOST TARGET binding sites found in untranslated regions of mRNA encoded by KIAA0478, corresponding to HOST TARGET binding sites such as BINDING SITE I, BINDING SITE II or BINDING SITE III. Table 2 illustrates the complementarity of the nucleotide sequences of KIAA0478 BINDING SITE1 and KIAA0478 BINDING SITE2, designated SEQ ID:16974 and SEQ ID:16975 respectively, to the nucleotide sequence of VGAM2547 RNA, herein designated VGAM RNA, also designated SEQ ID:5258.

Another function of VGAM2547 is therefore inhibition of KIAA0478 (Accession NM_014870). Accordingly, utilities of VGAM2547 include diagnosis, prevention and treatment of diseases and clinical conditions associated with KIAA0478. LOC130271 (Accession XM_059415) is another VGAM2547 host target gene. LOC130271 BINDING SITE is HOST TARGET binding site found in the 5' untranslated region of mRNA encoded by LOC130271, corresponding to a HOST TARGET binding site such as BINDING SITE I, BINDING SITE II or BINDING SITE III. Table 2 illustrates the complementarity of the nucleotide sequences of LOC130271 BINDING SITE, designated SEQ ID:36986, to the nucleotide sequence of VGAM2547 RNA, herein designated VGAM RNA, also designated SEQ ID:5258.

Another function of VGAM2547 is therefore inhibition of LOC130271 (Accession XM_059415). Accordingly, utilities of VGAM2547 include diagnosis, prevention and treatment of diseases and clinical conditions associated with LOC130271. LOC143943 (Accession XM_096504) is another VGAM2547 host target gene. LOC143943 BINDING SITE is HOST TARGET binding site found in the 3' untranslated region of mRNA encoded by LOC143943, corresponding to a HOST TARGET binding site such as BINDING SITE I, BINDING SITE II or BINDING SITE III. Table 2 illustrates the complementarity of the nucleotide sequences of LOC143943 BINDING SITE, designated SEQ ID:40382, to the nucleotide sequence of VGAM2547 RNA, herein designated VGAM RNA, also designated SEQ ID:5258.

Another function of VGAM2547 is therefore inhibition of LOC143943 (Accession XM_096504). Accordingly, utilities of VGAM2547 include diagnosis, prevention and treatment of diseases and clinical conditions associated with LOC143943. FIG. 1 further provides a conceptual description of a novel bioinformatically detected viral gene of the present invention, referred to here as Viral Genomic Address Messenger 2548 (VGAM2548) viral gene, which modulates expression of respective host target genes thereof, the function and utility of which host target genes is known in the art.

VGAM2548 is a novel bioinformatically detected regulatory, non protein coding, viral micro RNA (miRNA) gene. The method by which VGAM2548 was detected is described hereinabove with reference to FIGS. 1-8.

VGAM2548 gene, herein designated VGAM GENE, is a viral gene contained in the genome of Saccharomyces Cerevisiae Virus L-A. VGAM2548 host target gene, herein designated VGAM HOST TARGET GENE, is a human gene contained in the human genome.

VGAM2548 gene encodes a VGAM2548 precursor RNA, herein designated VGAM PRECURSOR RNA. Similar to other miRNA genes, and unlike most ordinary genes, VGAM2548 precursor RNA does not encode a protein. A nucleotide sequence identical or highly similar to the nucleotide sequence of VGAM2548 precursor RNA is designated SEQ ID:2534, and is provided hereinbelow with reference to the sequence listing part. Nucleotide sequence SEQ ID:2534 is located at position 4007 relative to the genome of Saccharomyces Cerevisiae Virus L-A.

VGAM2548 precursor RNA folds onto itself, forming VGAM2548 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2548 folded precursor RNA into VGAM2548 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2548 RNA is designated SEQ ID:5259, and is provided hereinbelow with reference to the sequence listing part.

VGAM2548 host target gene, herein designated VGAM HOST TARGET GENE, encodes a corresponding messenger RNA, VGAM2548 host target RNA, herein designated VGAM HOST TARGET RNA. VGAM2548 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2548 RNA, herein designated VGAM RNA, binds complementarily to one or more host target binding sites located in untranslated regions of VGAM2548 host target RNA, herein designated VGAM HOST TARGET RNA. This complementary binding is due to the fact that the nucleotide sequence of VGAM2548 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2548 RNA, herein designated VGAM RNA, may have a different number of host target binding sites in untranslated regions of a VGAM2548 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2548 RNA, herein designated VGAM RNA, to host target binding sites on VGAM2548 host target RNA, herein designated VGAM HOST TARGET RNA, such as BINDING SITE I, BINDING SITE II and BINDING SITE III, inhibits translation of VGAM2548 host target RNA into VGAM2548 host target protein, herein designated VGAM HOST TARGET PROTEIN. VGAM host target protein is therefore outlined by a broken line.

It is appreciated that VGAM2548 host target gene, herein designated VGAM HOST TARGET GENE, in fact represents a plurality of VGAM2548 host target genes. The mRNA of each one of this plurality of VGAM2548 host target genes comprises one or more host target binding sites, each having a nucleotide sequence which is at least partly complementary to VGAM2548 RNA, herein designated VGAM RNA, and which when bound by VGAM2548 RNA causes inhibition of translation of respective one or more VGAM2548 host target proteins.

It is further appreciated by one skilled in the art that the mode of translational inhibition illustrated by FIG. 1 with specific reference to translational inhibition exerted by VGAM2548 gene, herein designated VGAM GENE, on one or more VGAM2548 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2548 is inhibition of expression of host target genes, as part of a novel viral mechanism of attacking a host. Accordingly, utilities of VGAM2548 include diagnosis, prevention and treatment of viral infection by Saccharomyces Cerevisiae Virus L-A. Specific functions, and accordingly utilities, of VGAM2548 correlate with, and may be deduced from, the identity of the host target genes which VGAM2548 binds and inhibits, and the function of these host target genes, as elaborated hereinbelow.

Nucleotide sequences of the VGAM2548 precursor RNA, herein designated VGAM PRECURSOR RNA, and of the 'diced' VGAM2548 RNA, herein designated VGAM RNA, and a schematic representation of the secondary folding of VGAM2548 folded precursor RNA, herein designated VGAM FOLDED PRECURSOR RNA, of VGAM2548 are further described hereinbelow with reference to Table 1.

Nucleotide sequences of host target binding sites, such as BINDING SITE-I, BINDING SITE-II and BINDING SITE-III of FIG. 1, found on VGAM2548 host target RNA, and schematic representation of the complementarity of each of these host target binding sites to VGAM2548 RNA, herein designated VGAM RNA, are described hereinbelow with reference to Table 2.

As mentioned hereinabove with reference to FIG. 1, a function of VGAM2548 gene, herein designated VGAM is inhibition of expression of VGAM2548 target genes. It is appreciated that specific functions, and accordingly utilities, of VGAM2548 correlate with, and may be deduced from, the identity of the target genes which VGAM2548 binds and inhibits, and the function of these target genes, as elaborated hereinbelow.

DKFZP434P0721 (Accession XM_033181) is a VGAM2548 host target gene. DKFZP434P0721 BINDING SITE is HOST TARGET binding site found in the 5' untranslated region of mRNA encoded by DKFZP434P0721, corresponding to a HOST TARGET binding site such as BINDING SITE I, BINDING SITE II or BINDING SITE III. Table 2 illustrates the complementarity of the nucleotide sequences of DKFZP434P0721 BINDING SITE, designated SEQ ID:31867, to the nucleotide sequence of VGAM2548 RNA, herein designated VGAM RNA, also designated SEQ ID:5259.

A function of VGAM2548 is therefore inhibition of DKFZP434P0721 (Accession XM_033181). Accordingly, utilities of VGAM2548 include diagnosis, prevention and treatment of diseases and clinical conditions associated with DKFZP434P0721. LOC149386 (Accession XM_097631) is another VGAM2548 host target gene. LOC149386 BINDING SITE is HOST TARGET binding site found in the 5' untranslated region of mRNA encoded by LOC149386, corresponding to a HOST TARGET binding site such as BINDING SITE I, BINDING SITE II or BINDING SITE III. Table 2 illustrates the complementarity of the nucleotide sequences of LOC149386 BINDING SITE, designated SEQ ID:40984, to the nucleotide sequence of VGAM2548 RNA, herein designated VGAM RNA, also designated SEQ ID:5259.

Another function of VGAM2548 is therefore inhibition of LOC149386 (Accession XM_097631). Accordingly, utilities of VGAM2548 include diagnosis, prevention and treatment of diseases and clinical conditions associated with LOC149386. FIG. 1 further provides a conceptual description of a novel bioinformatically detected viral gene of the present invention, referred to here as Viral Genomic Address Messenger 2549 (VGAM2549) viral gene, which modulates expression of respective host target genes thereof, the function and utility of which host target genes is known in the art.

VGAM2549 is a novel bioinformatically detected regulatory, non protein coding, viral micro RNA (miRNA) gene. The method by which VGAM2549 was detected is described hereinabove with reference to FIGS. 1-8.

VGAM2549 gene, herein designated VGAM GENE, is a viral gene contained in the genome of Saccharomyces Cerevisiae Virus L-A. VGAM2549 host target gene, herein designated VGAM HOST TARGET GENE, is a human gene contained in the human genome.

VGAM2549 gene encodes a VGAM2549 precursor RNA, herein designated VGAM PRECURSOR RNA. Similar to other miRNA genes, and unlike most ordinary genes, VGAM2549 precursor RNA does not encode a protein. A nucleotide sequence identical or highly similar to the nucleotide sequence of VGAM2549 precursor RNA is designated SEQ ID:2535, and is provided hereinbelow with reference to the sequence listing part. Nucleotide sequence SEQ ID:2535 is located at position 2612 relative to the genome of Saccharomyces Cerevisiae Virus L-A.

VGAM2549 precursor RNA folds onto itself, forming VGAM2549 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2549 folded precursor RNA into VGAM2549 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2549 RNA is designated SEQ ID:5260, and is provided hereinbelow with reference to the sequence listing part.

VGAM2549 host target gene, herein designated VGAM HOST TARGET GENE, encodes a corresponding messenger RNA, VGAM2549 host target RNA, herein designated VGAM HOST TARGET RNA. VGAM2549 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2549 RNA, herein designated VGAM RNA, binds complementarily to one or more host target binding sites located in untranslated regions of VGAM2549 host target RNA, herein designated VGAM HOST TARGET RNA. This complementary binding is due to the fact that the nucleotide sequence of VGAM2549 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2549 RNA, herein designated VGAM RNA, may have a different number of host target binding sites in untranslated regions of a VGAM2549 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2549 RNA, herein designated VGAM RNA, to host target binding sites on VGAM2549 host target RNA, herein designated VGAM HOST TARGET RNA, such as BINDING SITE I, BINDING SITE II and BINDING SITE III, inhibits translation of VGAM2549 host target RNA into VGAM2549 host target protein, herein designated VGAM HOST TARGET PROTEIN. VGAM host target protein is therefore outlined by a broken line.

It is appreciated that VGAM2549 host target gene, herein designated VGAM HOST TARGET GENE, in fact represents a plurality of VGAM2549 host target genes. The mRNA of each one of this plurality of VGAM2549 host target genes comprises one or more host target binding sites, each having a nucleotide sequence which is at least partly complementary to VGAM2549 RNA, herein designated VGAM RNA, and which when bound by VGAM2549 RNA causes inhibition of translation of respective one or more VGAM2549 host target proteins.

It is further appreciated by one skilled in the art that the mode of translational inhibition illustrated by FIG. 1 with specific reference to translational inhibition exerted by VGAM2549 gene, herein designated VGAM GENE, on one or more VGAM2549 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2549 is inhibition of expression of host target genes, as part of a novel viral mechanism of attacking a host. Accordingly, utilities of VGAM2549 include diagnosis, prevention and treatment of viral infection by Saccharomyces Cerevisiae Virus L-A. Specific functions, and accordingly utilities, of VGAM2549 correlate with, and may be deduced from, the identity of the host target genes which VGAM2549 binds and inhibits, and the function of these host target genes, as elaborated hereinbelow.

Nucleotide sequences of the VGAM2549 precursor RNA, herein designated VGAM PRECURSOR RNA, and of the 'diced' VGAM2549 RNA, herein designated VGAM RNA, and a schematic representation of the secondary folding of VGAM2549 folded precursor RNA, herein designated VGAM FOLDED PRECURSOR RNA, of VGAM2549 are further described hereinbelow with reference to Table 1.

Nucleotide sequences of host target binding sites, such as BINDING SITE-I, BINDING SITE-II and BINDING SITE-III of FIG. 1, found on VGAM2549 host target RNA, and schematic representation of the complementarity of each of these host target binding sites to VGAM2549 RNA, herein designated VGAM RNA, are described hereinbelow with reference to Table 2.

As mentioned hereinabove with reference to FIG. 1, a function of VGAM2549 gene, herein designated VGAM is inhibition of expression of VGAM2549 target genes. It is appreciated that specific functions, and accordingly utilities, of VGAM2549 correlate with, and may be deduced from, the identity of the target genes which VGAM2549 binds and inhibits, and the function of these target genes, as elaborated hereinbelow.

DEAD/H (Asp-Glu-Ala-Asp/His) Box Polypeptide 6 (RNA helicase, 54 kDa) (DDX6, Accession NM_004397) is a VGAM2549 host target gene. DDX6 BINDING SITE is HOST TARGET binding site found in the 5' untranslated region of mRNA encoded by DDX6, corresponding to a HOST TARGET binding site such as BINDING SITE I, BINDING SITE II or BINDING SITE III. Table 2 illustrates the complementarity of the nucleotide sequences of DDX6 BINDING SITE, designated SEQ ID:10645, to the nucleotide sequence of VGAM2549 RNA, herein designated VGAM RNA, also designated SEQ ID:5260.

A function of VGAM2549 is therefore inhibition of DEAD/H (Asp-Glu-Ala-Asp/His) Box Polypeptide 6 (RNA helicase, 54 kDa) (DDX6, Accession NM_004397), a gene which is putative RNA helicases. Accordingly, utilities of VGAM2549 include diagnosis, prevention and treatment of diseases and clinical conditions associated with DDX6. The function of DDX6 and its association with various diseases and clinical conditions, has been established by previous studies, as described hereinabove with reference to VGAM179. Interleukin 16 (lymphocyte chemoattractant factor) (IL16, Accession NM_004513) is another VGAM2549 host target gene. IL16 BINDING SITE is HOST TARGET binding site found in the 5' untranslated region of mRNA encoded by IL16, corresponding to a HOST TARGET binding site such as BINDING SITE I, BINDING SITE II or BINDING SITE III. Table 2 illustrates the complementarity of the nucleotide sequences of IL16 BINDING SITE, designated SEQ ID:10840, to the nucleotide sequence of VGAM2549 RNA, herein designated VGAM RNA, also designated SEQ ID:5260.

Another function of VGAM2549 is therefore inhibition of Interleukin 16 (lymphocyte chemoattractant factor) (IL16, Accession NM_004513), a gene which modulates T-cell activation. Accordingly, utilities of VGAM2549 include diagnosis, prevention and treatment of diseases and clinical conditions associated with IL16. The function of IL16 and its association with various diseases and clinical conditions, has been established by previous studies, as described hereinabove with reference to VGAM819. Kinesin Family Member 5B (KIF5B, Accession NM_004521) is another VGAM2549 host target gene. KIF5B BINDING SITE is HOST TARGET binding site found in the 5" untranslated region of mRNA encoded by KIF5B, corresponding to a HOST TARGET binding site such as BINDING SITE I, BINDING SITE II or BINDING SITE III. Table 2 illustrates the complementarity of the nucleotide sequences of KIF5B BINDING SITE, designated SEQ ID:10850, to the nucleotide sequence of VGAM2549 RNA, herein designated VGAM RNA, also designated SEQ ID:5260.

Another function of VGAM2549 is therefore inhibition of Kinesin Family Member 5B (KIF5B, Accession NM_004521), a gene which is a microtubule-associated force-producing protein that may play a role in organelle transport. Accordingly, utilities of VGAM2549 include diagnosis, prevention and treatment of diseases and clinical conditions associated with KIF5B. The function of KIF5B has been established by previous studies. Kinesins are microtubule-based motor proteins involved in the transport of organelles in eukaryotic cells. They typically consist of 2 identical, approximately 110- to 120-kD heavy chains and 2 identical, approximately 60- to 70-kD light chains. The heavy chain contains 3 domains: a globular N-terminal motor domain, which converts the chemical energy of ATP into a motile force along microtubules in 1 fixed direction; a central alpha-helical rod domain, which enables the 2 heavy chains to dimerize; and a globular C-terminal domain, which interacts with light chains and possibly an organelle receptor. By screening a human placenta cDNA library with a probe based on a conserved region of the Drosophila and squid kinesin heavy chains (KHCs), Navone et al. (1992) isolated cDNAs encoding KNS1. The predicted 963-amino acid protein has 63% sequence identity to the Drosophila KHC. Immunoblot analysis using antibodies against squid KHC detected a 120-kD protein in CV-1 monkey kidney epithelial cells. Immunofluorescence studies showed that KNS1 expressed in CV-1 cells had both a diffuse distribution and a filamentous staining pattern that coaligned with microtubules but not vimentin (VIM; 193060) intermediate filaments; the KNS1 N- and C-terminal domains, but not the alpha-helical rod domain, also colocalized with microtubules. Kamal et al. (2000) demonstrated that the axonal transport of APP in neurons is mediated by the direct binding of APP to the kinesin light chain (OMIM Ref. No. 600025) subunit of kinesin-I. Kamal et al. (2001) identified an axonal membrane compartment that contains APP, beta-secretase (OMIM Ref. No. 604252), and presenilin-1 (OMIM Ref. No. 104311). The fast anterograde axonal transport of this compartment is mediated by APP and kinesin-I. Proteolytic processing of APP can occur in the compartment in vitro and in vivo in axons. This proteolysis generates amyloid-beta and a carboxy-terminal fragment of APP, and liberates kinesin-I from the membrane. Kamal et al. (2001) concluded that APP functions as a kinesin-I membrane receptor, mediating the axonal transport of beta-secretase and presenilin-1, and that processing of APP to amyloid-beta by secretases can occur in an axonal membrane compartment transported by kinesin-I. Animal model experiments lend further support to the function of KIF5B. Tanaka et al. (1998) disrupted the mouse kif5B gene by homologous recombination. The kif5B -/- mice were embryonic lethal with a severe growth retardation at 9.5 to 11.5 days postcoitum. To analyze the significance of this conventional kinesin heavy chain in organelle transport, the authors studied the distribution of major organelles in the extraembryonic cells. The null mutant cells impaired lysosomal dispersion, while brefeldin A could normally induce the breakdown of their Golgi apparatus. More prominently, their mitochondria abnormally clustered in the perinuclear region. This mitochondrial phenotype was reversed by an exogenous expression of KIF5B, and a subcellular fractionation revealed that KIF5B was associated with mitochondria. These data indicated that kinesin is essential for mitochondrial and lysosomal dispersion rather than for the Golgi-to-endoplasmic reticulum traffic in these cells.

It is appreciated that the abovementioned animal model for KIF5B is acknowledged by those skilled in the art as a scientifically valid animal model, as can be further appreciated from the publications sited hereinbelow.

Full details of the abovementioned studies are described in the following publications, the disclosure of which are hereby incorporated by reference:

Kamal, A.; Stokin, G. B.; Yang, Z.; Xia, C.; Goldstein, L. S.: Axonal transport of amyloid precursor protein is mediated by direct binding to the kinesin light chain subunit of kinesin-I. Neuron 28:449-459, 2000; and Navone, F.; Niclas, J.; Hom-Booher, N.; Sparks, L.; Bernstein, H. D.; McCaffrey, G.; Vale, R. D.: Cloning and expression of a human kinesin heavy chain gene: interaction of the COOH-te.

Further studies establishing the function and utilities of KIF5B are found in John Hopkins OMIM database record ID 602809, and in sited publications numbered 12307-1055 listed in the bibliography section hereinbelow, which are also hereby incorporated by reference. Oxidative-stress Responsive 1 (OSR1, Accession NM_005109) is another VGAM2549 host target gene. OSR1 BINDING SITE is HOST TARGET binding site found in the 3' untranslated region of mRNA encoded by OSR1, corresponding to a HOST TARGET binding site such as BINDING SITE I, BINDING SITE II or BINDING SITE III. Table 2 illustrates the complementarity of the nucleotide sequences of OSR1 BINDING SITE, designated SEQ ID:11587, to the nucleotide sequence of VGAM2549 RNA, herein designated VGAM RNA, also designated SEQ ID:5260.

Another function of VGAM2549 is therefore inhibition of Oxidative-stress Responsive 1 (OSR1, Accession NM_005109), a gene which mediats stress-activated signals. Accordingly, utilities of VGAM2549 include diagnosis, prevention and treatment of diseases and clinical conditions associated with OSR1. The function of OSR1 and its association with various diseases and clinical conditions, has been established by previous studies, as described hereinabove with reference to VGAM538. APEG1 (Accession XM_050966) is another VGAM2549 host target gene. APEG1 BINDING SITE is HOST TARGET binding site found in the 3' untranslated region of mRNA encoded by APEG1, corresponding to a HOST TARGET binding site such as BINDING SITE I, BINDING SITE II or BINDING SITE III. Table 2 illustrates the complementarity of the nucleotide sequences of APEG1 BINDING SITE, designated SEQ ID:35694, to the nucleotide sequence of VGAM2549 RNA, herein designated VGAM RNA, also designated SEQ ID:5260.

Another function of VGAM2549 is therefore inhibition of APEG1 (Accession XM_050966). Accordingly, utilities of VGAM2549 include diagnosis, prevention and treatment of diseases and clinical conditions associated with APEG1. Doublecortin and CaM Kinase-like 1 (DCAMKL1, Accession NM_004734) is another VGAM2549 host target gene. DCAMKL1 BINDING SITE is HOST TARGET binding site found in the 5' untranslated region of mRNA encoded by DCAMKL1, corresponding to a HOST TARGET binding site such as BINDING SITE I, BINDING SITE II or BINDING SITE III. Table 2 illustrates the complementarity of the nucleotide sequences of DCAMKL1 BINDING SITE, designated SEQ ID:11115, to the nucleotide sequence of VGAM2549 RNA, herein designated VGAM RNA, also designated SEQ ID:5260.

Another function of VGAM2549 is therefore inhibition of Doublecortin and CaM Kinase-like 1 (DCAMKL1, Accession NM_004734). Accordingly, utilities of VGAM2549 include diagnosis, prevention and treatment of diseases and clinical conditions associated with DCAMKL1. FLJ10853 (Accession NM_018246) is another VGAM2549 host target gene. FLJ10853 BINDING SITE is HOST TARGET binding site found in the 3' untranslated region of mRNA encoded by FLJ10853, corresponding to a HOST TARGET binding site such as BINDING SITE I, BINDING SITE II or BINDING SITE III. Table 2 illustrates the complementarity of the nucleotide sequences of FLJ10853 BINDING SITE, designated SEQ ID:20211, to the nucleotide sequence of VGAM2549 RNA, herein designated VGAM RNA, also designated SEQ ID:5260.

Another function of VGAM2549 is therefore inhibition of FLJ10853 (Accession NM_018246). Accordingly, utilities of VGAM2549 include diagnosis, prevention and treatment of diseases and clinical conditions associated with FLJ10853. KIAA0397 (Accession XM_029438) is another VGAM2549 host target gene. KIAA0397 BINDING SITE is HOST TARGET binding site found in the 3' untranslated region of mRNA encoded by KIAA0397, corresponding to a HOST TARGET binding site such as BINDING SITE I, BINDING SITE II or BINDING SITE III. Table 2 illustrates the complementarity of the nucleotide sequences of KIAA0397 BINDING SITE, designated SEQ ID:30896, to the nucleotide sequence of VGAM2549 RNA, herein designated VGAM RNA, also designated SEQ ID:5260.

Another function of VGAM2549 is therefore inhibition of KIAA0397 (Accession XM_029438). Accordingly, utilities of VGAM2549 include diagnosis, prevention and treatment of diseases and clinical conditions associated with KIAA0397. KIAA1344 (Accession XM_051699) is another VGAM2549 host target gene. KIAA1344 BINDING SITE is HOST TARGET binding site found in the 3' untranslated region of mRNA encoded by KIAA1344, corresponding to a HOST TARGET binding site such as BINDING SITE I, BINDING SITE II or BINDING SITE III. Table 2 illustrates the complementarity of the nucleotide sequences of KIAA1344 BINDING SITE, designated SEQ ID:35869, to the nucleotide sequence of VGAM2549 RNA, herein designated VGAM RNA, also designated SEQ ID:5260.

Another function of VGAM2549 is therefore inhibition of KIAA1344 (Accession XM_051699). Accordingly, utilities of VGAM2549 include diagnosis, prevention and treatment of diseases and clinical conditions associated with KIAA1344. TED (Accession NM_015686) is another VGAM2549 host target gene. TED BINDING SITE is HOST TARGET binding site found in the 3' untranslated region of mRNA encoded by TED, corresponding to a HOST TARGET binding site such as BINDING SITE I, BINDING SITE II or BINDING SITE III. Table 2 illustrates the complementarity of the nucleotide sequences of TED BINDING SITE, designated SEQ ID:17919, to the nucleotide sequence of VGAM2549 RNA, herein designated VGAM RNA, also designated SEQ ID:5260.

Another function of VGAM2549 is therefore inhibition of TED (Accession NM_015686). Accordingly, utilities of VGAM2549 include diagnosis, prevention and treatment of diseases and clinical conditions associated with TED. LOC147229 (Accession XM_085742) is another VGAM2549 host target gene. LOC147229 BINDING SITE is HOST TARGET binding site found in the 5' untranslated region of mRNA encoded by LOC147229, corresponding to a HOST TARGET binding site such as BINDING SITE I, BINDING SITE II or BINDING SITE III. Table 2 illustrates the complementarity of the nucleotide sequences of LOC147229 BINDING SITE, designated SEQ ID:38319, to the nucleotide sequence of VGAM2549 RNA, herein designated VGAM RNA, also designated SEQ ID:5260.

Another function of VGAM2549 is therefore inhibition of LOC147229 (Accession XM_085742). Accordingly, utilities of VGAM2549 include diagnosis, prevention and treatment of diseases and clinical conditions associated with LOC147229. LOC219722 (Accession XM_167593) is another VGAM2549 host target gene. LOC219722 BINDING SITE is HOST TARGET binding site found in the 5' untranslated region of mRNA encoded by LOC219722, corresponding to a HOST TARGET binding site such as BINDING SITE I, BINDING SITE II or BINDING SITE III. Table 2 illustrates the complementarity of the nucleotide sequences of LOC219722 BINDING SITE, designated SEQ ID:44710, to the nucleotide sequence of VGAM2549 RNA, herein designated VGAM RNA, also designated SEQ ID:5260.

Another function of VGAM2549 is therefore inhibition of LOC219722 (Accession XM_167593). Accordingly, utilities of VGAM2549 include diagnosis, prevention and treatment of diseases and clinical conditions associated with LOC219722. LOC253758 (Accession XM_173067) is another VGAM2549 host target gene. LOC253758 BINDING SITE is HOST TARGET binding site found in the 5' untranslated region of mRNA encoded by LOC253758, corresponding to a HOST TARGET binding site such as BINDING SITE I, BINDING SITE II or BINDING SITE III. Table 2 illustrates the complementarity of the nucleotide sequences of LOC253758 BINDING SITE, designated SEQ ID:46321, to the nucleotide sequence of VGAM2549 RNA, herein designated VGAM RNA, also designated SEQ ID:5260.

Another function of VGAM2549 is therefore inhibition of LOC253758 (Accession XM_173067). Accordingly, utilities of VGAM2549 include diagnosis, prevention and treatment of diseases and clinical conditions associated with LOC253758. LOC253955 (Accession XM_170486) is another VGAM2549 host target gene. LOC253955 BINDING SITE is HOST TARGET binding site found in the 5' untranslated region of mRNA encoded by LOC253955, corresponding to a HOST TARGET binding site such as BINDING SITE I, BINDING SITE II or BINDING SITE III. Table 2 illustrates the complementarity of the nucleotide sequences of LOC253955 BINDING SITE, designated SEQ ID:45327, to the nucleotide sequence of VGAM2549 RNA, herein designated VGAM RNA, also designated SEQ ID:5260.

Another function of VGAM2549 is therefore inhibition of LOC253955 (Accession XM_170486). Accordingly, utilities of VGAM2549 include diagnosis, prevention and treatment of diseases and clinical conditions associated with LOC253955. LOC51026 (Accession NM_016072) is another VGAM2549 host target gene. LOC51026 BINDING SITE is HOST TARGET binding site found in the 3' untranslated region of mRNA encoded by LOC51026, corresponding to a HOST TARGET binding site such as BINDING SITE I, BINDING SITE II or BINDING SITE III. Table 2 illustrates the complementarity of the nucleotide sequences of LOC51026 BINDING SITE, designated SEQ ID:18140, to the nucleotide sequence of VGAM2549 RNA, herein designated VGAM RNA, also designated SEQ ID:5260.

Another function of VGAM2549 is therefore inhibition of LOC51026 (Accession NM_016072). Accordingly, utilities of VGAM2549 include diagnosis, prevention and treatment of diseases and clinical conditions associated with LOC51026. LOC91574 (Accession XM_039310) is another VGAM2549 host target gene. LOC91574 BINDING SITE is HOST TARGET binding site found in the 3' untranslated region of mRNA encoded by LOC91574, corresponding to a HOST TARGET binding site such as BINDING SITE I, BINDING SITE II or BINDING SITE III. Table 2 illustrates the complementarity of the nucleotide sequences of LOC91574 BINDING SITE, designated SEQ ID:33047, to the nucleotide sequence of VGAM2549 RNA, herein designated VGAM RNA, also designated SEQ ID:5260.

Another function of VGAM2549 is therefore inhibition of LOC91574 (Accession XM_039310). Accordingly, utilities of VGAM2549 include diagnosis, prevention and treatment of diseases and clinical conditions associated with LOC91574. LOC92231 (Accession XM_043734) is another VGAM2549 host target gene. LOC92231 BINDING SITE is HOST TARGET binding site found in the 3' untranslated region of mRNA encoded by LOC92231, corresponding to a HOST TARGET binding site such as BINDING SITE I, BINDING SITE II or BINDING SITE III. Table 2 illustrates the complementarity of the nucleotide sequences of LOC92231 BINDING SITE, designated SEQ ID:34010, to the nucleotide sequence of VGAM2549 RNA, herein designated VGAM RNA, also designated SEQ ID:5260.

Another function of VGAM2549 is therefore inhibition of LOC92231 (Accession XM_043734). Accordingly, utilities of VGAM2549 include diagnosis, prevention and treatment of diseases and clinical conditions associated with LOC92231. FIG. 1 further provides a conceptual description of a novel bioinformatically detected viral gene of the present invention, referred to here as Viral Genomic Address Messenger 2550 (VGAM2550) viral gene, which modulates expression of respective host target genes thereof, the function and utility of which host target genes is known in the art.

VGAM2550 is a novel bioinformatically detected regulatory, non protein coding, viral micro RNA (miRNA) gene. The method by which VGAM2550 was detected is described hereinabove with reference to FIGS. 1-8.

VGAM2550 gene, herein designated VGAM GENE, is a viral gene contained in the genome of Saccharomyces Cerevisiae Virus L-A. VGAM2550 host target gene, herein designated VGAM HOST TARGET GENE, is a human gene contained in the human genome.

VGAM2550 gene encodes a VGAM2550 precursor RNA, herein designated VGAM PRECURSOR RNA. Similar to other miRNA genes, and unlike most ordinary genes, VGAM2550 precursor RNA does not encode a protein. A nucleotide sequence identical or highly similar to the nucleotide sequence of VGAM2550 precursor RNA is designated SEQ ID:2536, and is provided hereinbelow with reference to the sequence listing part. Nucleotide sequence SEQ ID:2536 is located at position 4405 relative to the genome of Saccharomyces Cerevisiae Virus L-A.

VGAM2550 precursor RNA folds onto itself, forming VGAM2550 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2550 folded precursor RNA into VGAM2550 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2550 RNA is designated SEQ ID:5261, and is provided hereinbelow with reference to the sequence listing part.

VGAM2550 host target gene, herein designated VGAM HOST TARGET GENE, encodes a corresponding messenger RNA, VGAM2550 host target RNA, herein designated VGAM HOST TARGET RNA. VGAM2550 host target RNA comprises three regions, as is typical of mRNA of a protein coding gene: a 5' untranslated region, a protein coding region and a 3' untranslated region, designated 5"UTR, PROTEIN CODING and 3'UTR respectively.

15621

VGAM2550 RNA, herein designated VGAM RNA, binds complementarily to one or more host target binding sites located in untranslated regions of VGAM2550 host target RNA, herein designated VGAM HOST TARGET RNA. This complementary binding is due to the fact that the nucleotide sequence of VGAM2550 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2550 RNA, herein designated VGAM RNA, may have a different number of host target binding sites in untranslated regions of a VGAM2550 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2550 RNA, herein designated VGAM RNA, to host target binding sites on VGAM2550 host target RNA, herein designated VGAM HOST TARGET RNA, such as BINDING SITE I, BINDING SITE II and BINDING SITE III, inhibits translation of VGAM2550 host target RNA into VGAM2550 host target protein, herein designated VGAM HOST TARGET PROTEIN. VGAM host target protein is therefore outlined by a broken line.

It is appreciated that VGAM2550 host target gene, herein designated VGAM HOST TARGET GENE, in fact represents a plurality of VGAM2550 host target genes. The mRNA of each one of this plurality of VGAM2550 host target genes comprises one or more host target binding sites, each having a nucleotide sequence which is at least partly complementary to VGAM2550 RNA, herein designated VGAM RNA, and which when bound by VGAM2550 RNA causes inhibition of translation of respective one or more VGAM2550 host target proteins.

It is further appreciated by one skilled in the art that the mode of translational inhibition illustrated by FIG. 1 with specific reference to translational inhibition exerted by VGAM2550 gene, herein designated VGAM GENE, on one or more VGAM2550 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2550 is inhibition of expression of host target genes, as part of a novel viral mechanism of attacking a host. Accordingly, utilities of VGAM2550 include diagnosis, prevention and treatment of viral infection by Saccharomyces Cerevisiae Virus L-A. Specific functions, and accordingly utilities, of VGAM2550 correlate with, and may be deduced from, the identity of the host target genes which VGAM2550 binds and inhibits, and the function of these target genes, as elaborated hereinbelow.

15622

Nucleotide sequences of the VGAM2550 precursor RNA, herein designated VGAM PRECURSOR RNA, and of the 'diced' VGAM2550 RNA, herein designated VGAM RNA, and a schematic representation of the secondary folding of VGAM2550 folded precursor RNA, herein designated VGAM FOLDED PRECURSOR RNA, of VGAM2550 are further described hereinbelow with reference to Table 1.

Nucleotide sequences of host target binding sites, such as BINDING SITE-I, BINDING SITE-II and BINDING SITE-III of FIG. 1, found on VGAM2550 host target RNA, and schematic representation of the complementarity of each of these host target binding sites to VGAM2550 RNA, herein designated VGAM RNA, are described hereinbelow with reference to Table 2.

As mentioned hereinabove with reference to FIG. 1, a function of VGAM2550 gene, herein designated VGAM is inhibition of expression of VGAM2550 target genes. It is appreciated that specific functions, and accordingly utilities, of VGAM2550 correlate with, and may be deduced from, the identity of the target genes which VGAM2550 binds and inhibits, and the function of these target genes, as elaborated hereinbelow.

Cyclic Nucleotide Gated Channel Beta 3 (CNGB3, Accession NM_019098) is a VGAM2550 host target gene. CNGB3 BINDING SITE is HOST TARGET binding site found in the 3' untranslated region of mRNA encoded by CNGB3, corresponding to a HOST TARGET binding site such as BINDING SITE I, BINDING SITE II or BINDING SITE III. Table 2 illustrates the complementarity of the nucleotide sequences of CNGB3 BINDING SITE, designated SEQ ID:21176, to the nucleotide sequence of VGAM2550 RNA, herein designated VGAM RNA, also designated SEQ ID:5261.

A function of VGAM2550 is therefore inhibition of Cyclic Nucleotide Gated Channel Beta 3 (CNGB3, Accession NM_019098). Accordingly, utilities of VGAM2550 include diagnosis, prevention and treatment of diseases and clinical conditions associated with CNGB3. FK506 Binding Protein 5 (FKBP5, Accession NM_004117) is another VGAM2550 host target gene. FKBP5 BINDING SITE is HOST TARGET binding site found in the 3' untranslated region of mRNA encoded by FKBP5, corresponding to a HOST TARGET binding site such as BINDING SITE I, BINDING SITE II or BINDING SITE III. Table 2 illustrates the complementarity of the nucleotide sequences of FKBP5 BINDING SITE, designated SEQ ID:10324, to the nucleotide sequence of VGAM2550 RNA, herein designated VGAM RNA, also designated SEQ ID:5261.

Another function of VGAM2550 is therefore inhibition of FK506 Binding Protein 5 (FKBP5, Accession NM_004117). Accordingly, utilities of VGAM2550 include diagnosis, prevention and treatment of diseases and clinical conditions associated with FKBP5. KIAA0939 (Accession XM_030524) is another VGAM2550 host target gene. KIAA0939 BINDING SITE is HOST TARGET binding site found in the 3' untranslated region of mRNA encoded by KIAA0939, corresponding to a HOST TARGET binding site such as BINDING SITE I, BINDING SITE II or BINDING SITE III. Table 2 illustrates the complementarity of the nucleotide sequences of KIAA0939 BINDING SITE, designated SEQ ID:31065, to the nucleotide sequence of VGAM2550 RNA, herein designated VGAM RNA, also designated SEQ ID:5261.

Another function of VGAM2550 is therefore inhibition of KIAA0939 (Accession XM_030524). Accordingly, utilities of VGAM2550 include diagnosis, prevention and treatment of diseases and clinical conditions associated with KIAA0939. LOC200010 (Accession XM_117174) is another VGAM2550 host target gene. LOC200010 BINDING SITE is HOST TARGET binding site found in the 3' untranslated region of mRNA encoded by LOC200010, corresponding to a HOST TARGET binding site such as BINDING SITE I, BINDING SITE II or BINDING SITE III. Table 2 illustrates the complementarity of the nucleotide sequences of LOC200010 BINDING SITE, designated SEQ ID:43277, to the nucleotide sequence of VGAM2550 RNA, herein designated VGAM RNA, also designated SEQ ID:5261.

Another function of VGAM2550 is therefore inhibition of LOC200010 (Accession XM_117174). Accordingly, utilities of VGAM2550 include diagnosis, prevention and treatment of diseases and clinical conditions associated with LOC200010. FIG. 1 further provides a conceptual description of a novel bioinformatically detected viral gene of the present invention, referred to here as Viral Genomic Address Messenger 2551 (VGAM2551) viral gene, which modulates expression of respective host target genes thereof, the function and utility of which host target genes is known in the art.

VGAM2551 is a novel bioinformatically detected regulatory, non protein coding, viral micro RNA (miRNA) gene. The method by which VGAM2551 was detected is described hereinabove with reference to FIGS. 1-8.

VGAM2551 gene, herein designated VGAM GENE, is a viral gene contained in the genome of Rice Yellow Stunt Virus. VGAM2551 host target gene, herein designated VGAM HOST TARGET GENE, is a human gene contained in the human genome.

VGAM2551 gene encodes a VGAM2551 precursor RNA, herein designated VGAM PRECURSOR RNA. Similar to other miRNA genes, and unlike most ordinary genes, VGAM2551 precursor RNA does not encode a protein. A nucleotide sequence identical or highly similar to the nucleotide sequence of VGAM2551 precursor RNA is designated SEQ ID:2537, and is provided hereinbelow with reference to the sequence listing part. Nucleotide sequence SEQ ID:2537 is located at position 11536 relative to the genome of Rice Yellow Stunt Virus.

VGAM2551 precursor RNA folds onto itself, forming VGAM2551 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2551 folded precursor RNA into VGAM2551 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM2551 RNA is designated SEQ ID:5262, and is provided hereinbelow with reference to the sequence listing part.

VGAM2551 host target gene, herein designated VGAM HOST TARGET GENE, encodes a corresponding messenger RNA, VGAM2551 host target RNA, herein designated VGAM HOST TARGET RNA. VGAM2551 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2551 RNA, herein designated VGAM RNA, binds complementarily to one or more host target binding sites located in untranslated regions of VGAM2551 host target RNA, herein designated VGAM HOST TARGET RNA. This complementary binding is due to the fact that the nucleotide sequence of VGAM2551 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2551 RNA, herein designated VGAM RNA, may have a different number of host target binding sites in untranslated regions of a VGAM2551 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2551 RNA, herein designated VGAM RNA, to host target binding sites on VGAM2551 host target RNA, herein designated VGAM HOST TARGET RNA, such as BINDING SITE I, BINDING SITE II and BINDING SITE III, inhibits translation of VGAM2551 host target RNA into VGAM2551 host target protein, herein designated VGAM HOST TARGET PROTEIN. VGAM host target protein is therefore outlined by a broken line.

It is appreciated that VGAM2551 host target gene, herein designated VGAM HOST TARGET GENE, in fact represents a plurality of VGAM2551 host target genes. The mRNA of each one of this plurality of VGAM2551 host target genes comprises one or more host target binding sites, each having a nucleotide sequence which is at least partly complementary to VGAM2551 RNA, herein designated VGAM RNA, and which when bound by VGAM2551 RNA causes inhibition of translation of respective one or more VGAM2551 host target proteins.

It is further appreciated by one skilled in the art that the mode of translational inhibition illustrated by FIG. 1 with specific reference to translational inhibition exerted by VGAM2551 gene, herein designated VGAM GENE, on one or more VGAM2551 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2551 is inhibition of expression of host target genes, as part of a novel viral mechanism of attacking a host. Accordingly, utilities of VGAM2551 include diagnosis, prevention and treatment of viral infection by Rice Yellow Stunt Virus. Specific functions, and accordingly utilities, of VGAM2551 correlate with, and may be deduced from, the identity of the host target genes which VGAM2551 binds and inhibits, and the function of these host target genes, as elaborated hereinbelow.

Nucleotide sequences of the VGAM2551 precursor RNA, herein designated VGAM PRECURSOR RNA, and of the 'diced' VGAM2551 RNA, herein designated VGAM RNA, and a schematic representation of the secondary folding of VGAM2551 folded precursor RNA, herein designated VGAM FOLDED PRECURSOR RNA, of VGAM2551 are further described hereinbelow with reference to Table 1.

Nucleotide sequences of host target binding sites, such as BINDING SITE-I, BINDING SITE-II and BINDING SITE-III of FIG. 1, found on VGAM2551 host target RNA, and schematic representation of the complementarity of each of these host target binding sites to VGAM2551 RNA, herein designated VGAM RNA, are described hereinbelow with reference to Table 2.

As mentioned hereinabove with reference to FIG. 1, a function of VGAM2551 gene, herein designated VGAM is inhibition of expression of VGAM2551 target genes. It is appreciated that specific functions, and accordingly utilities, of VGAM2551 correlate with, and may be deduced from, the identity of the target genes which VGAM2551 binds and inhibits, and the function of these target genes, as elaborated hereinbelow.

Aryl-hydrocarbon Receptor Nuclear Translocator 2 (ARNT2, Accession NM_014862) is a VGAM2551 host target gene. ARNT2 BINDING SITE is HOST TARGET binding site found in the 3' untranslated region of mRNA encoded by ARNT2, corresponding to a HOST TARGET binding site such as BINDING SITE I, BINDING SITE II or BINDING SITE III. Table 2 illustrates the complementarity of the nucleotide sequences of ARNT2 BINDING SITE, designated SEQ ID:16936, to the nucleotide sequence of VGAM2551 RNA, herein designated VGAM RNA, also designated SEQ ID:5262.

A function of VGAM2551 is therefore inhibition of Aryl-hydrocarbon Receptor Nuclear Translocator 2 (ARNT2, Accession NM_014862), a gene which specifically recognizes the xenobiotic response element (xre). Accordingly, utilities of VGAM2551 include diagnosis, prevention and treatment of diseases and clinical conditions associated with ARNT2. The function of ARNT2 and its association with various diseases and clinical conditions, has been established by previous studies, as described hereinabove with reference to VGAM345. Bromodomain Adjacent to Zinc Finger Domain, 1B (BAZ1B, Accession NM_032408) is another VGAM2551 host target gene. BAZ1B BINDING SITE is HOST TARGET binding site found in the 3' untranslated region of mRNA encoded by BAZ1B, corresponding to a HOST TARGET binding site such as BINDING SITE I, BINDING SITE II or BINDING SITE III. Table 2 illustrates the complementarity of the nucleotide sequences of BAZ1B BINDING SITE, designated SEQ ID:26190, to the nucleotide sequence of VGAM2551 RNA, herein designated VGAM RNA, also designated SEQ ID:5262.

Another function of VGAM2551 is therefore inhibition of Bromodomain Adjacent to Zinc Finger Domain, 1B (BAZ1B, Accession NM_032408). Accordingly, utilities of VGAM2551 include diagnosis, prevention and treatment of diseases and clinical conditions associated with BAZ1B. Chromosome 1 Open Reading Frame 6 (C1orf6, Accession NM_020131) is another VGAM2551 host target gene. C1orf6 BINDING SITE is HOST TARGET binding site found in the 3' untranslated region of mRNA encoded by C1orf6, corresponding to a HOST TARGET binding site such as BINDING SITE I, BINDING SITE II or BINDING SITE III. Table 2 illustrates the complementarity of the nucleotide sequences of C1orf6 BINDING SITE, designated SEQ ID:21327, to the nucleotide sequence of VGAM2551 RNA, herein designated VGAM RNA, also designated SEQ ID:5262.

Another function of VGAM2551 is therefore inhibition of Chromosome 1 Open Reading Frame 6 (C1orf6, Accession NM_020131), a gene which may link ataxin-1 with the chaperone and ubiquitin/proteasome pathways. Accordingly, utilities of VGAM2551 include diagnosis, prevention and treatment of diseases and clinical conditions associated with C1orf6. The function of C1orf6 and its association with various diseases and clinical conditions, has been established by previous studies, as described hereinabove with reference to VGAM1286. Centromere Protein F, 350/400ka (mitosin) (CENPF, Accession NM_016343) is another VGAM2551 host target gene. CENPF BINDING SITE is HOST TARGET binding site found in the 3' untranslated region of mRNA encoded by CENPF, corresponding to a HOST TARGET binding site such as BINDING SITE I, BINDING SITE II or BINDING SITE III. Table 2 illustrates the complementarity of the nucleotide sequences of CENPF BINDING SITE, designated SEQ ID:18470, to the nucleotide sequence of VGAM2551 RNA, herein designated VGAM RNA, also designated SEQ ID:5262.

Another function of VGAM2551 is therefore inhibition of Centromere Protein F, 350/400ka (mitosin) (CENPF, Accession NM_016343), a gene which is a protein of the nuclear matrix and regulates mitosis. Accordingly, utilities of VGAM2551 include diagnosis, prevention and treatment of diseases and clinical conditions associated with CENPF. The function of CENPF and its association with various diseases and clinical conditions, has been established by previous studies, as described hereinabove with reference to VGAM1709. Chediak-Higashi Syndrome 1 (CHS1, Accession NM_000081) is another VGAM2551 host target gene. CHS1 BINDING SITE is HOST TARGET binding site found in the 3' untranslated region of mRNA encoded by CHS1, corresponding to a HOST TARGET binding site such as BINDING SITE I, BINDING SITE II or BINDING SITE III. Table 2 illustrates the complementarity of the nucleotide sequences of CHS1 BINDING SITE, designated SEQ ID:5523, to the nucleotide sequence of VGAM2551 RNA, herein designated VGAM RNA, also designated SEQ ID:5262.

Another function of VGAM2551 is therefore inhibition of Chediak-Higashi Syndrome 1 (CHS1, Accession NM_000081), a gene which may sort endosomal resident proteins into late multivesicular endosome. Accordingly, utilities of VGAM2551 include diagnosis, prevention and treatment of diseases and clinical conditions associated with CHS1. The function of CHS1 and its association with various diseases and clinical conditions, has been established by previous studies, as described hereinabove with reference to VGAM191. Cartilage Linking Protein 1 (CRTL1, Accession NM_001884) is another VGAM2551 host target gene. CRTL1 BINDING SITE is HOST TARGET binding site found in the 5' untranslated region of mRNA encoded by CRTL1, corresponding to a HOST TARGET binding site such as BINDING SITE I, BINDING SITE II or BINDING SITE III. Table 2 illustrates the complementarity of the nucleotide sequences of CRTL1 BINDING SITE, designated SEQ ID:7615, to the nucleotide sequence of VGAM2551 RNA, herein designated VGAM RNA, also designated SEQ ID:5262.

Another function of VGAM2551 is therefore inhibition of Cartilage Linking Protein 1 (CRTL1, Accession NM_001884), a gene which stabilize the aggregates of proteoglycan monomers with hyaluronic acid. Accordingly, utilities of VGAM2551 include diagnosis, prevention and treatment of diseases and clinical conditions associated with CRTL1. The function of CRTL1 has been established by previous studies. Using a cDNA for the chicken protein, Osborne-Lawrence et al. (1990) isolated 2 overlapping clones that encode the entire human cartilage link protein. The deduced amino acid sequence is 354 residues long and shows a striking degree of similarity to porcine, rat, and chicken link protein sequences. By in situ hybridization, they mapped the gene to 5q13-q14.1. Dudhia et al. (1994) found that the CRTL1 gene comprises 5 exons and is spread over more than 60 kb. Primer extension and S1 nuclease protection analysis revealed transcription initiation to be 315 bases upstream from the translation initiation codon Cartilage link protein stabilizes aggregates of aggrecan and hyaluronan, giving cartilage its tensile strength and elasticity. Cartilage provides the template for endochondral ossification and is crucial for determining the length and width of the skeleton. During endochondral bone formation, hypertrophic chondrocytes die and the cartilage is replaced with bone matrix. Watanabe and Yamada (1999) generated targeted mutations in cartilage link protein of mice (Crtl1). Homozygotes showed defects in cartilage development and delayed bone formation with short limbs and craniofacial anomalies. Most homozygous Crtl1 mutant mice died shortly after birth due to respiratory failure, but some survived and developed progressive dwarfism and lordosis of the cervical spine. They showed small epiphyses, slightly flared metaphyses of long bones, and flattened vertebrae, characteristic of spondyloepiphyseal dysplasias. The cartilage contained significantly reduced aggrecan depositions in the hypertrophic zone and decreased numbers of prehypertrophic and hypertrophic chondrocytes. Reduced Indian hedgehog (OMIM Ref. No. 600726) expression was observed in prehypertrophic chondrocytes, and apoptosis was inhibited in hypertrophic chondrocytes. The results indicated that cartilage link protein is important for the formation of proteoglycan aggregates and normal organization of hypertrophic chondrocytes, and suggested that cartilage matrix has a role in chondrocyte differentiation and maturation Full details of the abovementioned studies are described in the following publications, the disclosure of which are hereby incorporated by reference:

Osborne-Lawrence, S. L.; Sinclair, A. K.; Hicks, R. C.; Lacey, S. W.; Eddy, R. L., Jr.; Byers, M. G.; Shows, T. B.; Duby, A. D.: Complete amino acid sequence of human cartilage link protein (CRTL1) deduced from cDNA clones and chromosomal assignment of the gene. Genomics 8:562-567, 1990; and Watanabe, H.; Yamada, Y.: Mice lacking link protein develop dwarfism and craniofacial abnormalities. Nature Genet. 21:225-229, 1999.

Further studies establishing the function and utilities of CRTL1 are found in John Hopkins OMIM database record ID 115435, and in sited publications numbered 3 and 12584-12586 listed in the bibliography section hereinbelow, which are also hereby incorporated by reference. Death-associated Protein Kinase 1 (DAPK1, Accession NM_004938) is another VGAM2551 host target gene. DAPK1 BINDING SITE is HOST TARGET binding site found in the 3' untranslated region of mRNA encoded by DAPK1, corresponding to a HOST TARGET binding site such as BINDING SITE I, BINDING SITE II or BINDING SITE III. Table 2 illustrates the complementarity of the nucleotide sequences of DAPK1 BINDING SITE, designated SEQ ID:11386, to the nucleotide sequence of VGAM2551 RNA, herein designated VGAM RNA, also designated SEQ ID:5262.

Another function of VGAM2551 is therefore inhibition of Death-associated Protein Kinase 1 (DAPK1, Accession NM_004938). Accordingly, utilities of VGAM2551 include diagnosis, prevention and treatment of diseases and clinical conditions associated with DAPK1. Heterogeneous Nuclear Ribonucleoprotein D-like (HNRPDL, Accession NM_005463) is another VGAM2551 host target gene. HNRPDL BINDING SITE is HOST TARGET binding site found in the 3' untranslated region of mRNA encoded by HNRPDL, corresponding to a HOST TARGET binding site such as BINDING SITE I, BINDING SITE II or BINDING SITE III. Table 2 illustrates the complementarity of the nucleotide sequences of HNRPDL BINDING SITE, designated SEQ ID:11954, to the nucleotide sequence of VGAM2551 RNA, herein designated VGAM RNA, also designated SEQ ID:5262.

Another function of VGAM2551 is therefore inhibition of Heterogeneous Nuclear Ribonucleoprotein D-like (HNRPDL, Accession NM_005463), a gene which binds to rna molecules that contain au-rich elements. Accordingly, utilities of VGAM2551 include diagnosis, prevention and treatment of diseases and clinical conditions associated with HNRPDL. The function of HNRPDL and its association with various diseases and clinical conditions, has been established by previous studies, as described hereinabove with reference to VGAM144. Neuronal Pentraxin I (NPTX1, Accession NM_002522) is another VGAM2551 host target gene. NPTX1 BINDING SITE is HOST TARGET binding site found in the 3' untranslated region of mRNA encoded by NPTX1, corresponding to a HOST TARGET binding site such as BINDING SITE I, BINDING SITE II or BINDING SITE III. Table 2 illustrates the complementarity of the nucleotide sequences of NPTX1 BINDING SITE, designated SEQ ID:8356, to the nucleotide sequence of VGAM2551 RNA, herein designated VGAM RNA, also designated SEQ ID:5262.

Another function of VGAM2551 is therefore inhibition of Neuronal Pentraxin I (NPTX1, Accession NM_002522), a gene which may be involved in synaptic uptake of extracellular material and is very strongly similar to rat NP1. Accordingly, utilities of VGAM2551 include diagnosis, prevention and treatment of diseases and clinical conditions associated with NPTX1. The function of NPTX1 and its association with various diseases and clinical conditions, has been established by previous studies, as described hereinabove with reference to VGAM111. Perilipin (PLIN, Accession NM_002666) is another VGAM2551 host target gene. PLIN BINDING SITE is HOST TARGET binding site found in the 3' untranslated region of mRNA encoded by PLIN, corresponding to a HOST TARGET binding site such as BINDING SITE I, BINDING SITE II or BINDING SITE III. Table 2 illustrates the complementarity of the nucleotide sequences of PLIN BINDING SITE, designated SEQ ID:8535, to the nucleotide sequence of VGAM2551 RNA, herein designated VGAM RNA, also designated SEQ ID:5262.

Another function of VGAM2551 is therefore inhibition of Perilipin (PLIN, Accession NM_002666). Accordingly, utilities of VGAM2551 include diagnosis, prevention and treatment of diseases and clinical conditions associated with PLIN. Protein Phosphatase 1, Regulatory (inhibitor) Subunit 12A (PPP1R12A, Accession NM_002480) is another VGAM2551 host target gene. PPP1R12A BINDING SITE is HOST TARGET binding site found in the 3' untranslated region of mRNA encoded by PPP1R12A, corresponding to a HOST TARGET binding site such as BINDING SITE I, BINDING SITE II or BINDING SITE III. Table 2 illustrates the complementarity of the nucleotide sequences of PPP1R12A BINDING SITE, designated SEQ ID:8304, to the nucleotide sequence of VGAM2551 RNA, herein designated VGAM RNA, also designated SEQ ID:5262.

Another function of VGAM2551 is therefore inhibition of Protein Phosphatase 1, Regulatory (inhibitor) Subunit 12A (PPP1R12A, Accession NM_002480), a gene which regulates the interaction of actin and myosin. Accordingly, utilities of VGAM2551 include diagnosis, prevention and treatment of diseases and clinical conditions associated with PPP1R12A. The function of PPP1R12A and its association with various diseases and clinical conditions, has been established by previous studies, as described hereinabove with reference to VGAM838. Prostaglandin F2 Receptor Negative Regulator (PTGFRN, Accession XM_040709) is another VGAM2551 host target gene. PTGFRN BINDING SITE is HOST TARGET binding site found in the 3' untranslated region of mRNA encoded by PTGFRN, corresponding to a HOST TARGET binding site such as BINDING SITE I, BINDING SITE II or BINDING SITE III. Table 2 illustrates the complementarity of the nucleotide sequences of PTGFRN BINDING SITE, designated SEQ ID:33361, to the nucleotide sequence of VGAM2551 RNA, herein designated VGAM RNA, also designated SEQ ID:5262.

Another function of VGAM2551 is therefore inhibition of Prostaglandin F2 Receptor Negative Regulator (PTGFRN, Accession XM_040709), a gene which inhibits the binding of prostaglandin f2-alpha (pgf2- alpha) to its specific fp receptor. Accordingly, utilities of VGAM2551 include diagnosis, prevention and treatment of diseases and clinical conditions associated with PTGFRN. The function of PTGFRN and its association with various diseases and clinical conditions, has been established by previous studies, as described hereinabove with reference to VGAM125. Paxillin (PXN, Accession NM_002859) is another VGAM2551 host target gene. PXN BINDING SITE is HOST TARGET binding site found in the 3' untranslated region of mRNA encoded by PXN, corresponding to a HOST TARGET binding site such as BINDING SITE I, BINDING SITE II or BINDING SITE III. Table 2 illustrates the complementarity of the nucleotide sequences of PXN BINDING SITE, designated SEQ ID:8759, to the nucleotide sequence of VGAM2551 RNA, herein designated VGAM RNA, also designated SEQ ID:5262.

Another function of VGAM2551 is therefore inhibition of Paxillin (PXN, Accession NM_002859), a gene which may be involved in p53-dependent apoptosis. Accordingly, utilities of VGAM2551 include diagnosis, prevention and treatment of diseases and clinical conditions associated with PXN. The function of PXN and its association with various diseases and clinical conditions, has been established by previous studies, as described hereinabove with reference to VGAM132. SMURF1 (Accession XM_166483) is another VGAM2551 host target gene. SMURF1 BINDING SITE is HOST TARGET binding site found in the 3' untranslated region of mRNA encoded by SMURF1, corresponding to a HOST TARGET binding site such as BINDING SITE I, BINDING SITE II or BINDING SITE III. Table 2 illustrates the complementarity of the nucleotide sequences of SMURF1 BINDING SITE, designated SEQ ID:44409, to the nucleotide sequence of VGAM2551 RNA, herein designated VGAM RNA, also designated SEQ ID:5262.

Another function of VGAM2551 is therefore inhibition of SMURF1 (Accession XM_166483). Accordingly, utilities of VGAM2551 include diagnosis, prevention and treatment of diseases and clinical conditions associated with SMURF1. Src Homology Three (SH3) and Cysteine Rich Domain (STAC, Accession NM_003149) is another VGAM2551 host target gene. STAC BINDING SITE is HOST TARGET binding site found in the 3' untranslated region of mRNA encoded by STAC, corresponding to a HOST TARGET binding site such as BINDING SITE I, BINDING SITE II or BINDING SITE III. Table 2 illustrates the complementarity of the nucleotide sequences of STAC BINDING SITE, designated SEQ ID:9119, to the nucleotide sequence of VGAM2551 RNA, herein designated VGAM RNA, also designated SEQ ID:5262.

Another function of VGAM2551 is therefore inhibition of Src Homology Three (SH3) and Cysteine Rich Domain (STAC, Accession NM_003149), a gene which is probably involved in a neuron-specific signal transduction. Accordingly, utilities of VGAM2551 include diagnosis, prevention and treatment of diseases and clinical conditions associated with STAC. The function of STAC and its association with various diseases and clinical conditions, has been established by previous studies, as described hereinabove with reference to VGAM331. TEM8 (Accession NM_032208) is another VGAM2551 host target gene. TEM8 BINDING SITE is HOST TARGET binding site found in the 3' untranslated region of mRNA encoded by TEM8, corresponding to a HOST TARGET binding site such as BINDING SITE I, BINDING SITE II or BINDING SITE III. Table 2 illustrates the complementarity of the nucleotide sequences of TEM8 BINDING SITE, designated SEQ ID:25917, to the nucleotide sequence of VGAM2551 RNA, herein designated VGAM RNA, also designated SEQ ID:5262.

Another function of VGAM2551 is therefore inhibition of TEM8 (Accession NM_032208), a gene which is a tumor-specific endothelial marker. Accordingly, utilities of VGAM2551 include diagnosis, prevention and treatment of diseases and clinical conditions associated with TEM8. The function of TEM8 and its association with various diseases and clinical conditions, has been established by previous studies, as described hereinabove with reference to VGAM1489. Tenascin C (hexabrachion) (TNC, Accession NM_002160) is another VGAM2551 host target gene. TNC BINDING SITE is HOST TARGET binding site found in the 3' untranslated region of mRNA encoded by TNC, corresponding to a HOST TARGET binding site such as BINDING SITE I, BINDING SITE II or BINDING SITE III. Table 2 illustrates the complementarity of the nucleotide sequences of TNC BINDING SITE, designated SEQ ID:7934, to the nucleotide sequence of VGAM2551 RNA, herein designated VGAM RNA, also designated SEQ ID:5262.

Another function of VGAM2551 is therefore inhibition of Tenascin C (hexabrachion) (TNC, Accession NM_002160), a gene which has epidermal growth factor-like repeats. Accordingly, utilities of VGAM2551 include diagnosis, prevention and treatment of diseases and clinical conditions associated with TNC. The function of TNC and its association with various diseases and clinical conditions, has been established by previous studies, as described hereinabove with reference to VGAM808. Tropomyosin 4 (TPM4, Accession NM_003290) is another VGAM2551 host target gene. TPM4 BINDING SITE is HOST TARGET binding site found in the 3' untranslated region of mRNA encoded by TPM4, corresponding to a HOST TARGET binding site such as BINDING SITE I, BINDING SITE II or BINDING SITE III. Table 2 illustrates the complementarity of the nucleotide sequences of TPM4 BINDING SITE, designated SEQ ID:9300, to the nucleotide sequence of VGAM2551 RNA, herein designated VGAM RNA, also designated SEQ ID:5262.

Another function of VGAM2551 is therefore inhibition of Tropomyosin 4 (TPM4, Accession NM_003290), a gene which plays a central role, in association with the troponin complex, in the calcium dependent regulation of vertebrate striated muscle contraction. Accordingly, utilities of VGAM2551 include diagnosis, prevention and treatment of diseases and clinical conditions associated with TPM4. The function of TPM4 and its association with various diseases and clinical conditions, has been established by previous studies, as described hereinabove with reference to VGAM744. X-prolyl Aminopeptidase (aminopeptidase P) 2, Membrane-bound (XPNPEP2, Accession NM_003399) is another VGAM2551 host target gene. XPNPEP2 BINDING SITE is HOST TARGET binding site found in the 3' untranslated region of mRNA encoded by XPNPEP2, corresponding to a HOST TARGET binding site such as BINDING SITE I, BINDING SITE II or BINDING SITE III. Table 2 illustrates the complementarity of the nucleotide sequences of XPNPEP2 BINDING SITE, designated SEQ ID:9433, to the nucleotide sequence of VGAM2551 RNA, herein designated VGAM RNA, also designated SEQ ID:5262.

Another function of VGAM2551 is therefore inhibition of X-prolyl Aminopeptidase (aminopeptidase P) 2, Membrane-bound (XPNPEP2, Accession NM_003399), a gene which is a membrane-associated X-prolyl metallopeptidase. Accordingly, utilities of VGAM2551 include diagnosis, prevention and treatment of diseases and clinical conditions associated with XPNPEP2. The function of XPNPEP2 and its association with various diseases and clinical conditions, has been established by previous studies, as described hereinabove with reference to VGAM2108. BRAG (Accession NM_014863) is another VGAM2551 host target gene. BRAG BINDING SITE is HOST TARGET binding site found in the 5' untranslated region of mRNA encoded by BRAG, corresponding to a HOST TARGET binding site such as BINDING SITE I, BINDING SITE II or BINDING SITE III. Table 2 illustrates the complementarity of the nucleotide sequences of BRAG BINDING SITE, designated SEQ ID:16940, to the nucleotide sequence of VGAM2551 RNA, herein designated VGAM RNA, also designated SEQ ID:5262.

Another function of VGAM2551 is therefore inhibition of BRAG (Accession NM_014863). Accordingly, utilities of VGAM2551 include diagnosis, prevention and treatment of diseases and clinical conditions associated with BRAG. Chromosome 20 Open Reading Frame 98 (C20orf98, Accession XM_049398) is another VGAM2551 host target gene. C20orf98 BINDING SITE is HOST TARGET binding site found in the 3' untranslated region of mRNA encoded by C20orf98, corresponding to a HOST TARGET binding site such as BINDING SITE I, BINDING SITE II or BINDING SITE III. Table 2 illustrates the complementarity of the nucleotide sequences of C20orf98 BINDING SITE, designated SEQ ID:35416, to the nucleotide sequence of VGAM2551 RNA, herein designated VGAM RNA, also designated SEQ ID:5262.

Another function of VGAM2551 is therefore inhibition of Chromosome 20 Open Reading Frame 98 (C20orf98, Accession XM_049398). Accordingly, utilities of VGAM2551 include diagnosis, prevention and treatment of diseases and clinical conditions associated with C20orf98. ENDO180 (Accession NM_006039) is another VGAM2551 host target gene. ENDO180 BINDING SITE is HOST TARGET binding site found in the 3' untranslated region of mRNA encoded by ENDO180, corresponding to a HOST TARGET binding site such as BINDING SITE I, BINDING SITE II or BINDING SITE III. Table 2 illustrates the complementarity of the nucleotide sequences of ENDO180 BINDING SITE, designated SEQ ID:12674, to the nucleotide sequence of VGAM2551 RNA, herein designated VGAM RNA, also designated SEQ ID:5262.

Another function of VGAM2551 is therefore inhibition of ENDO180 (Accession NM_006039). Accordingly, utilities of VGAM2551 include diagnosis, prevention and treatment of diseases and clinical conditions associated with ENDO180. F-box Only Protein 4 (FBXO4, Accession NM_033484) is another VGAM2551 host target gene. FBXO4 BINDING SITE is HOST TARGET binding site found in the 3' untranslated region of mRNA encoded by FBXO4, corresponding to a HOST TARGET binding site such as BINDING SITE I, BINDING SITE II or BINDING SITE III. Table 2 illustrates the complementarity of the nucleotide sequences of FBXO4 BINDING SITE, designated SEQ ID:27262, to the nucleotide sequence of VGAM2551 RNA, herein designated VGAM RNA, also designated SEQ ID:5262.

Another function of VGAM2551 is therefore inhibition of F-box Only Protein 4 (FBXO4, Accession NM_033484). Accordingly, utilities of VGAM2551 include diagnosis, prevention and treatment of diseases and clinical conditions associated with FBXO4. FLJ10512 (Accession NM_018121) is another VGAM2551 host target gene. FLJ10512 BINDING SITE is HOST TARGET binding site found in the 3' untranslated region of mRNA encoded by FLJ10512, corresponding to a HOST TARGET binding site such as BINDING SITE I, BINDING SITE II or BINDING SITE III. Table 2 illustrates the complementarity of the nucleotide sequences of FLJ10512 BINDING SITE, designated SEQ ID:19902, to the nucleotide sequence of VGAM2551 RNA, herein designated VGAM RNA, also designated SEQ ID:5262.

Another function of VGAM2551 is therefore inhibition of FLJ10512 (Accession NM_018121). Accordingly, utilities of VGAM2551 include diagnosis, prevention and treatment of diseases and clinical conditions associated with FLJ10512. FLJ11457 (Accession NM_024753) is another VGAM2551 host target gene. FLJ11457 BINDING SITE is HOST TARGET binding site found in the 3' untranslated region of mRNA encoded by FLJ11457, corresponding to a HOST TARGET binding site such as BINDING SITE I, BINDING SITE II or BINDING SITE III. Table 2 illustrates the complementarity of the nucleotide sequences of FLJ11457 BINDING SITE, designated SEQ ID:24094, to the nucleotide sequence of VGAM2551 RNA, herein designated VGAM RNA, also designated SEQ ID:5262.

Another function of VGAM2551 is therefore inhibition of FLJ11457 (Accession NM_024753). Accordingly, utilities of VGAM2551 include diagnosis, prevention and treatment of diseases and clinical conditions associated with FLJ11457. FLJ14146 (Accession NM_024709) is another VGAM2551 host target gene. FLJ14146 BINDING SITE is HOST TARGET binding site found in the 3' untranslated region of mRNA encoded by FLJ14146, corresponding to a HOST TARGET binding site such as BINDING SITE I, BINDING SITE II or BINDING SITE III. Table 2 illustrates the complementarity of the nucleotide sequences of FLJ14146 BINDING SITE, designated SEQ ID:24029, to the nucleotide sequence of VGAM2551 RNA, herein designated VGAM RNA, also designated SEQ ID:5262.

Another function of VGAM2551 is therefore inhibition of FLJ14146 (Accession NM_024709). Accordingly, utilities of VGAM2551 include diagnosis, prevention and treatment of diseases and clinical conditions associated with FLJ14146. FLJ20034 (Accession NM_017630) is another VGAM2551 host target gene. FLJ20034 BINDING SITE is HOST TARGET binding site found in the 3' untranslated region of mRNA encoded by FLJ20034, corresponding to a HOST TARGET binding site such as BINDING SITE I, BINDING SITE II or BINDING SITE III. Table 2 illustrates the complementarity of the nucleotide sequences of FLJ20034 BINDING SITE, designated SEQ ID:19128, to the nucleotide sequence of VGAM2551 RNA, herein designated VGAM RNA, also designated SEQ ID:5262.

Another function of VGAM2551 is therefore inhibition of FLJ20034 (Accession NM_017630). Accordingly, utilities of VGAM2551 include diagnosis, prevention and treatment of diseases and clinical conditions associated with FLJ20034. FLJ20094 (Accession NM_017665) is another VGAM2551 host target gene. FLJ20094 BINDING SITE is HOST TARGET binding site found in the 3' untranslated region of mRNA encoded by FLJ20094, corresponding to a HOST TARGET binding site such as BINDING SITE I, BINDING SITE II or BINDING SITE III. Table 2 illustrates the complementarity of the nucleotide sequences of FLJ20094 BINDING SITE, designated SEQ ID:19208, to the nucleotide sequence of VGAM2551 RNA, herein designated VGAM RNA, also designated SEQ ID:5262.

Another function of VGAM2551 is therefore inhibition of FLJ20094 (Accession NM_017665). Accordingly, utilities of VGAM2551 include diagnosis, prevention and treatment of diseases and clinical conditions associated with FLJ20094. GBTS1 (Accession NM_145173) is another VGAM2551 host target gene. GBTS1 BINDING SITE is HOST TARGET binding site found in the 3' untranslated region of mRNA encoded by GBTS1, corresponding to a HOST TARGET binding site such as BINDING SITE I, BINDING SITE II or BINDING SITE III. Table 2 illustrates the complementarity of the nucleotide sequences of GBTS1 BINDING SITE, designated SEQ ID:29725, to the nucleotide sequence of VGAM2551 RNA, herein designated VGAM RNA, also designated SEQ ID:5262.

Another function of VGAM2551 is therefore inhibition of GBTS1 (Accession NM_145173). Accordingly, utilities of VGAM2551 include diagnosis, prevention and treatment of diseases and clinical conditions associated with GBTS1. HCC-4 (Accession NM_138611) is another VGAM2551 host target gene. HCC-4 BINDING SITE is HOST TARGET binding site found in the 5' untranslated region of mRNA encoded by HCC-4, corresponding to a HOST TARGET binding site such as BINDING SITE I, BINDING SITE II or BINDING SITE III. Table 2 illustrates the complementarity of the nucleotide sequences of HCC-4 BINDING SITE, designated SEQ ID:28896, to the nucleotide sequence of VGAM2551 RNA, herein designated VGAM RNA, also designated SEQ ID:5262.

Another function of VGAM2551 is therefore inhibition of HCC-4 (Accession NM_138611). Accordingly, utilities of VGAM2551 include diagnosis, prevention and treatment of diseases and clinical conditions associated with HCC-4. HRIHFB2072 (Accession NM_032547) is another VGAM2551 host target gene. HRIHFB2072 BINDING SITE is HOST TARGET binding site found in the 3' untranslated region of mRNA encoded by HRIHFB2072, corresponding to a HOST TARGET binding site such as BINDING SITE I, BINDING SITE II or BINDING SITE III. Table 2 illustrates the complementarity of the nucleotide sequences of HRIHFB2072 BINDING SITE, designated SEQ ID:26271, to the nucleotide sequence of VGAM2551 RNA, herein designated VGAM RNA, also designated SEQ ID:5262.

Another function of VGAM2551 is therefore inhibition of HRIHFB2072 (Accession NM_032547). Accordingly, utilities of VGAM2551 include diagnosis, prevention and treatment of diseases and clinical conditions associated with HRIHFB2072. KIAA0255 (Accession NM_014742) is another VGAM2551 host target gene. KIAA0255 BINDING SITE is HOST TARGET binding site found in the 3' untranslated region of mRNA encoded by KIAA0255, corresponding to a HOST TARGET binding site such as BINDING SITE I, BINDING SITE II or BINDING SITE III. Table 2 illustrates the complementarity of the nucleotide sequences of KIAA0255 BINDING SITE, designated SEQ ID:16413, to the nucleotide sequence of VGAM2551 RNA, herein designated VGAM RNA, also designated SEQ ID:5262.

Another function of VGAM2551 is therefore inhibition of KIAA0255 (Accession NM_014742). Accordingly, utilities of VGAM2551 include diagnosis, prevention and treatment of diseases and clinical conditions associated with KIAA0255. KIAA1198 (Accession XM_032674) is another VGAM2551 host target gene. KIAA1198 BINDING SITE is HOST TARGET binding site found in the 3' untranslated region of mRNA encoded by KIAA1198, corresponding to a HOST TARGET binding site such as BINDING SITE I, BINDING SITE II or BINDING SITE III. Table 2 illustrates the complementarity of the nucleotide sequences of KIAA1198 BINDING SITE, designated SEQ ID:31702, to the nucleotide sequence of VGAM2551 RNA, herein designated VGAM RNA, also designated SEQ ID:5262.

Another function of VGAM2551 is therefore inhibition of KIAA1198 (Accession XM_032674). Accordingly, utilities of VGAM2551 include diagnosis, prevention and treatment of diseases and clinical conditions associated with KIAA1198. KIAA1473 (Accession XM_047550) is another VGAM2551 host target gene. KIAA1473 BINDING SITE is HOST TARGET binding site found in the 3' untranslated region of mRNA encoded by KIAA1473, corresponding to a HOST TARGET binding site such as BINDING SITE I, BINDING SITE II or BINDING SITE III. Table 2 illustrates the complementarity of the nucleotide sequences of KIAA1473 BINDING SITE, designated SEQ ID:34995, to the nucleotide sequence of VGAM2551 RNA, herein designated VGAM RNA, also designated SEQ ID:5262.

Another function of VGAM2551 is therefore inhibition of KIAA1473 (Accession XM_047550). Accordingly, utilities of VGAM2551 include diagnosis, prevention and treatment of diseases and clinical conditions associated with KIAA1473. KIAA1538 (Accession XM_049474) is another VGAM2551 host target gene. KIAA1538 BINDING SITE is HOST TARGET binding site found in the 3' untranslated region of mRNA encoded by KIAA1538, corresponding to a HOST TARGET binding site such as BINDING SITE I, BINDING SITE II or BINDING SITE III. Table 2 illustrates the complementarity of the nucleotide sequences of KIAA1538 BINDING SITE, designated SEQ ID:35431, to the nucleotide sequence of VGAM2551 RNA, herein designated VGAM RNA, also designated SEQ ID:5262.

Another function of VGAM2551 is therefore inhibition of KIAA1538 (Accession XM_049474). Accordingly, utilities of VGAM2551 include diagnosis, prevention and treatment of diseases and clinical conditions associated with KIAA1538. MGC15906 (Accession NM_032885) is another VGAM2551 host target gene. MGC15906 BINDING SITE is HOST TARGET binding site found in the 5' untranslated region of mRNA encoded by MGC15906, corresponding to a HOST TARGET binding site such as BINDING SITE I, BINDING SITE II or BINDING SITE III. Table 2 illustrates the complementarity of the nucleotide sequences of MGC15906 BINDING SITE, designated SEQ ID:26707, to the nucleotide sequence of VGAM2551 RNA, herein designated VGAM RNA, also designated SEQ ID:5262.

Another function of VGAM2551 is therefore inhibition of MGC15906 (Accession NM_032885). Accordingly, utilities of VGAM2551 include diagnosis, prevention and treatment of diseases and clinical conditions associated with MGC15906. MGC22014 (Accession XM_035307) is another VGAM2551 host target gene. MGC22014 BINDING SITE is HOST TARGET binding site found in the 3' untranslated region of mRNA encoded by MGC22014, corresponding to a HOST TARGET binding site such as BINDING SITE I, BINDING SITE II or BINDING SITE III. Table 2 illustrates the complementarity of the nucleotide sequences of MGC22014 BINDING SITE, designated SEQ ID:32218, to the nucleotide sequence of VGAM2551 RNA, herein designated VGAM RNA, also designated SEQ ID:5262.

Another function of VGAM2551 is therefore inhibition of MGC22014 (Accession XM_035307). Accordingly, utilities of VGAM2551 include diagnosis, prevention and treatment of diseases and clinical conditions associated with MGC22014. MGC5466 (Accession XM_054436) is another VGAM2551 host target gene. MGC5466 BINDING SITE is HOST TARGET binding site found in the 5' untranslated region of mRNA encoded by MGC5466, corresponding to a HOST TARGET binding site such as BINDING SITE I, BINDING SITE II or BINDING SITE III. Table 2 illustrates the complementarity of the nucleotide sequences of MGC5466 BINDING SITE, designated SEQ ID:36159, to the nucleotide sequence of VGAM2551 RNA, herein designated VGAM RNA, also designated SEQ ID:5262.

Another function of VGAM2551 is therefore inhibition of MGC5466 (Accession XM_054436). Accordingly, utilities of VGAM2551 include diagnosis, prevention and treatment of diseases and clinical conditions associated with MGC5466. Pellino Homolog 1 (Drosophila) (PELI1, Accession NM_020651) is another VGAM2551 host target gene. PELI1 BINDING SITE is HOST TARGET binding site found in the 3' untranslated region of mRNA encoded by PELI1, corresponding to a HOST TARGET binding site such as BINDING SITE I, BINDING SITE II or BINDING SITE III. Table 2 illustrates the complementarity of the nucleotide sequences of PELI1 BINDING SITE, designated SEQ ID:21815, to the nucleotide sequence of VGAM2551 RNA, herein designated VGAM RNA, also designated SEQ ID:5262.

Another function of VGAM2551 is therefore inhibition of Pellino Homolog 1 (Drosophila) (PELI1, Accession NM_020651). Accordingly, utilities of VGAM2551 include diagnosis, prevention and treatment of diseases and clinical conditions associated with PELI1. RAB3GAP (Accession XM_040048) is another VGAM2551 host target gene. RAB3GAP BINDING SITE is HOST TARGET binding site found in the 3' untranslated region of mRNA encoded by RAB3GAP, corresponding to a HOST TARGET binding site such as BINDING SITE I, BINDING SITE II or BINDING SITE III. Table 2 illustrates the complementarity of the nucleotide sequences of RAB3GAP BINDING SITE, designated SEQ ID:33245, to the nucleotide sequence of VGAM2551 RNA, herein designated VGAM RNA, also designated SEQ ID:5262.

Another function of VGAM2551 is therefore inhibition of RAB3GAP (Accession XM_040048). Accordingly, utilities of VGAM2551 include diagnosis, prevention and treatment of diseases and clinical conditions associated with RAB3GAP. SEC31B-1 (Accession NM_015490) is another VGAM2551 host target gene. SEC31B-1 BINDING SITE is HOST TARGET binding site found in the 3' untranslated region of mRNA encoded by SEC31B-1, corresponding to a HOST TARGET binding site such as BINDING SITE I, BINDING SITE II or BINDING SITE III. Table 2 illustrates the complementarity of the nucleotide sequences of SEC31B-1 BINDING SITE, designated SEQ ID:17760, to the nucleotide sequence of VGAM2551 RNA, herein designated VGAM RNA, also designated SEQ ID:5262.

Another function of VGAM2551 is therefore inhibition of SEC31B-1 (Accession NM_015490). Accordingly, utilities of VGAM2551 include diagnosis, prevention and treatment of diseases and clinical conditions associated with SEC31B-1. Solute Carrier Family 38, Member 4 (SLC38A4, Accession NM_018018) is another VGAM2551 host target gene. SLC38A4 BINDING SITE is HOST TARGET binding site found in the 3' untranslated region of mRNA encoded by SLC38A4, corresponding to a HOST TARGET binding site such as BINDING SITE I, BINDING SITE II or BINDING SITE III. Table 2 illustrates the complementarity of the nucleotide sequences of SLC38A4 BINDING SITE, designated SEQ ID:19756, to the nucleotide sequence of VGAM2551 RNA, herein designated VGAM RNA, also designated SEQ ID:5262.

Another function of VGAM2551 is therefore inhibition of Solute Carrier Family 38, Member 4 (SLC38A4, Accession NM_018018). Accordingly, utilities of VGAM2551 include diagnosis, prevention and treatment of diseases and clinical conditions associated with SLC38A4. T-box 4 (TBX4, Accession NM_018488) is another VGAM2551 host target gene. TBX4 BINDING SITE is HOST TARGET binding site found in the 3' untranslated region of mRNA encoded by TBX4, corresponding to a HOST TARGET binding site such as BINDING SITE I, BINDING SITE II or BINDING SITE III. Table 2 illustrates the complementarity of the nucleotide sequences of TBX4 BINDING SITE, designated SEQ ID:20544, to the nucleotide sequence of VGAM2551 RNA, herein designated VGAM RNA, also designated SEQ ID:5262.

Another function of VGAM2551 is therefore inhibition of T-box 4 (TBX4, Accession NM_018488). Accordingly, utilities of VGAM2551 include diagnosis, prevention and treatment of diseases and clinical conditions associated with TBX4. Transducer of ERBB2, 2 (TOB2, Accession XM_170995) is another VGAM2551 host target gene. TOB2 BINDING SITE is HOST TARGET binding site found in the 3' untranslated region of mRNA encoded by TOB2, corresponding to a HOST TARGET binding site such as BINDING SITE I, BINDING SITE II or BINDING SITE III. Table 2 illustrates the complementarity of the nucleotide sequences of TOB2 BINDING SITE, designated SEQ ID:45762, to the nucleotide sequence of VGAM2551 RNA, herein designated VGAM RNA, also designated SEQ ID:5262.

Another function of VGAM2551 is therefore inhibition of Transducer of ERBB2, 2 (TOB2, Accession XM_170995). Accordingly, utilities of VGAM2551 include diagnosis, prevention and treatment of diseases and clinical conditions associated with TOB2. Zinc Finger Protein 221 (ZNF221, Accession NM_013359) is another VGAM2551 host target gene. ZNF221 BINDING SITE is HOST TARGET binding site found in the 5' untranslated region of mRNA encoded by ZNF221, corresponding to a HOST TARGET binding site such as BINDING SITE I, BINDING SITE II or BINDING SITE III. Table 2 illustrates the complementarity of the nucleotide sequences of ZNF221 BINDING SITE, designated SEQ ID:15008, to the nucleotide sequence of VGAM2551 RNA, herein designated VGAM RNA, also designated SEQ ID:5262.

Another function of VGAM2551 is therefore inhibition of Zinc Finger Protein 221 (ZNF221, Accession NM_013359). Accordingly, utilities of VGAM2551 include diagnosis, prevention and treatment of diseases and clinical conditions associated with ZNF221. LOC144395 (Accession XM_084850) is another VGAM2551 host target gene. LOC144395 BINDING SITE is HOST TARGET binding site found in the 3' untranslated region of mRNA encoded by LOC144395, corresponding to a HOST TARGET binding site such as BINDING SITE I, BINDING SITE II or BINDING SITE III. Table 2 illustrates the complementarity of the nucleotide sequences of LOC144395 BINDING SITE, designated SEQ ID:37732, to the nucleotide sequence of VGAM2551 RNA, herein designated VGAM RNA, also designated SEQ ID:5262.

Another function of VGAM2551 is therefore inhibition of LOC144395 (Accession XM_084850). Accordingly, utilities of VGAM2551 include diagnosis, prevention and treatment of diseases and clinical conditions associated with LOC144395. LOC145719 (Accession XM_096848) is another VGAM2551 host target gene. LOC145719 BINDING SITE is HOST TARGET binding site found in the 5' untranslated region of mRNA encoded by LOC145719, corresponding to a HOST TARGET binding site such as BINDING SITE I, BINDING SITE II or BINDING SITE III. Table 2 illustrates the complementarity of the nucleotide sequences of LOC145719 BINDING SITE, designated SEQ ID:40577, to the nucleotide sequence of VGAM2551 RNA, herein designated VGAM RNA, also designated SEQ ID:5262.

Another function of VGAM2551 is therefore inhibition of LOC145719 (Accession XM_096848). Accordingly, utilities of VGAM2551 include diagnosis, prevention and treatment of diseases and clinical conditions associated with LOC145719. LOC145720 (Accession XM_096846) is another VGAM2551 host target gene. LOC145720 BINDING SITE is HOST TARGET binding site found in the 5' untranslated region of mRNA encoded by LOC145720, corresponding to a HOST TARGET binding site such as BINDING SITE I, BINDING SITE II or BINDING SITE III. Table 2 illustrates the complementarity of the nucleotide sequences of LOC145720 BINDING SITE, designated SEQ ID:40566, to the nucleotide sequence of VGAM2551 RNA, herein designated VGAM RNA, also designated SEQ ID:5262.

Another function of VGAM2551 is therefore inhibition of LOC145720 (Accession XM_096846). Accordingly, utilities of VGAM2551 include diagnosis, prevention and treatment of diseases and clinical conditions associated with LOC145720. LOC146802 (Accession XM_085595) is another VGAM2551 host target gene. LOC146802 BINDING SITE is HOST TARGET binding site found in the 3' untranslated region of mRNA encoded by LOC146802, corresponding to a HOST TARGET binding site such as BINDING SITE I, BINDING SITE II or BINDING SITE III. Table 2 illustrates the complementarity of the nucleotide sequences of LOC146802 BINDING SITE, designated SEQ ID:38245, to the nucleotide sequence of VGAM2551 RNA, herein designated VGAM RNA, also designated SEQ ID:5262.

Another function of VGAM2551 is therefore inhibition of LOC146802 (Accession XM_085595). Accordingly, utilities of VGAM2551 include diagnosis, prevention and treatment of diseases and clinical conditions associated with LOC146802. LOC148198 (Accession XM_047554) is another VGAM2551 host target gene. LOC148198 BINDING SITE is HOST TARGET binding site found in the 3' untranslated region of mRNA encoded by LOC148198, corresponding to a HOST TARGET binding site such as BINDING SITE I, BINDING SITE II or BINDING SITE III. Table 2 illustrates the complementarity of the nucleotide sequences of LOC148198 BINDING SITE, designated SEQ ID:34999, to the nucleotide sequence of VGAM2551 RNA, herein designated VGAM RNA, also designated SEQ ID:5262.

Another function of VGAM2551 is therefore inhibition of LOC148198 (Accession XM_047554). Accordingly, utilities of VGAM2551 include diagnosis, prevention and treatment of diseases and clinical conditions associated with LOC148198. LOC150203 (Accession XM_018294) is another VGAM2551 host target gene. LOC150203 BINDING SITE is HOST TARGET binding site found in the 5' untranslated region of mRNA encoded by LOC150203, corresponding to a HOST TARGET binding site such as BINDING SITE I, BINDING SITE II or BINDING SITE III. Table 2 illustrates the complementarity of the nucleotide sequences of LOC150203 BINDING SITE, designated SEQ ID:30349, to the nucleotide sequence of VGAM2551 RNA, herein designated VGAM RNA, also designated SEQ ID:5262.

Another function of VGAM2551 is therefore inhibition of LOC150203 (Accession XM_018294). Accordingly, utilities of VGAM2551 include diagnosis, prevention and treatment of diseases and clinical conditions associated with LOC150203. LOC150350 (Accession XM_086861) is another VGAM2551 host target gene. LOC150350 BINDING SITE is HOST TARGET binding site found in the 3' untranslated region of mRNA encoded by LOC150350, corresponding to a HOST TARGET binding site such as BINDING SITE I, BINDING SITE II or BINDING SITE III. Table 2 illustrates the complementarity of the nucleotide sequences of LOC150350 BINDING SITE, designated SEQ ID:38929, to the nucleotide sequence of VGAM2551 RNA, herein designated VGAM RNA, also designated SEQ ID:5262.

Another function of VGAM2551 is therefore inhibition of LOC150350 (Accession XM_086861). Accordingly, utilities of VGAM2551 include diagnosis, prevention and treatment of diseases and clinical conditions associated with LOC150350. LOC151647 (Accession XM_087261) is another VGAM2551 host target gene. LOC151647 BINDING SITE is HOST TARGET binding site found in the 3' untranslated region of mRNA encoded by LOC151647, corresponding to a HOST TARGET binding site such as BINDING SITE I, BINDING SITE II or BINDING SITE III. Table 2 illustrates the complementarity of the nucleotide sequences of LOC151647 BINDING SITE, designated SEQ ID:39156, to the nucleotide sequence of VGAM2551 RNA, herein designated VGAM RNA, also designated SEQ ID:5262.

Another function of VGAM2551 is therefore inhibition of LOC151647 (Accession XM_087261). Accordingly, utilities of VGAM2551 include diagnosis, prevention and treatment of diseases and clinical conditions associated with LOC151647. LOC197114 (Accession XM_116987) is another VGAM2551 host target gene. LOC197114 BINDING SITE is HOST TARGET binding site found in the 5' untranslated region of mRNA encoded by LOC197114, corresponding to a HOST TARGET binding site such as BINDING SITE I, BINDING SITE II or BINDING SITE III. Table 2 illustrates the complementarity of the nucleotide sequences of LOC197114 BINDING SITE, designated SEQ ID:43189, to the nucleotide sequence of VGAM2551 RNA, herein designated VGAM RNA, also designated SEQ ID:5262.

Another function of VGAM2551 is therefore inhibition of LOC197114 (Accession XM_116987). Accordingly, utilities of VGAM2551 include diagnosis, prevention and treatment of diseases and clinical conditions associated with LOC197114. LOC197117 (Accession XM_116989) is another VGAM2551 host target gene. LOC197117 BINDING SITE is HOST TARGET binding site found in the 3' untranslated region of mRNA encoded by LOC197117, corresponding to a HOST TARGET binding site such as BINDING SITE I, BINDING SITE II or BINDING SITE III. Table 2 illustrates the complementarity of the nucleotide sequences of LOC197117 BINDING SITE, designated SEQ ID:43196, to the nucleotide sequence of VGAM2551 RNA, herein designated VGAM RNA, also designated SEQ ID:5262.

Another function of VGAM2551 is therefore inhibition of LOC197117 (Accession XM_116989). Accordingly, utilities of VGAM2551 include diagnosis, prevention and treatment of diseases and clinical conditions associated with LOC197117. LOC221178 (Accession XM_167936) is another VGAM2551 host target gene. LOC221178 BINDING SITE is HOST TARGET binding site found in the 3' untranslated region of mRNA encoded by LOC221178, corresponding to a HOST TARGET binding site such as BINDING SITE I, BINDING SITE II or BINDING SITE III. Table 2 illustrates the complementarity of the nucleotide sequences of LOC221178 BINDING SITE, designated SEQ ID:44925, to the nucleotide sequence of VGAM2551 RNA, herein designated VGAM RNA, also designated SEQ ID:5262.

Another function of VGAM2551 is therefore inhibition of LOC221178 (Accession XM_167936). Accordingly, utilities of VGAM2551 include diagnosis, prevention and treatment of diseases and clinical conditions associated with LOC221178. LOC221398 (Accession XM_165762) is another VGAM2551 host target gene. LOC221398 BINDING SITE is HOST TARGET binding site found in the 3' untranslated region of mRNA encoded by LOC221398, corresponding to a HOST TARGET binding site such as BINDING SITE I, BINDING SITE II or BINDING SITE III. Table 2 illustrates the complementarity of the nucleotide sequences of LOC221398 BINDING SITE, designated SEQ ID:43749, to the nucleotide sequence of VGAM2551 RNA, herein designated VGAM RNA, also designated SEQ ID:5262.

Another function of VGAM2551 is therefore inhibition of LOC221398 (Accession XM_165762). Accordingly, utilities of VGAM2551 include diagnosis, prevention and treatment of diseases and clinical conditions associated with LOC221398. LOC221656 (Accession XM_166418) is another VGAM2551 host target gene. LOC221656 BINDING SITE is HOST TARGET binding site found in the 3' untranslated region of mRNA encoded by LOC221656, corresponding to a HOST TARGET binding site such as BINDING SITE I, BINDING SITE II or BINDING SITE III. Table 2 illustrates the complementarity of the nucleotide sequences of LOC221656 BINDING SITE, designated SEQ ID:44292, to the nucleotide sequence of VGAM2551 RNA, herein designated VGAM RNA, also designated SEQ ID:5262.

Another function of VGAM2551 is therefore inhibition of LOC221656 (Accession XM_166418). Accordingly, utilities of VGAM2551 include diagnosis, prevention and treatment of diseases and clinical conditions associated with LOC221656. LOC254018 (Accession XM_173066) is another VGAM2551 host target gene. LOC254018 BINDING SITE is HOST TARGET binding site found in the 3' untranslated region of mRNA encoded by LOC254018, corresponding to a HOST TARGET binding site such as BINDING SITE I, BINDING SITE II or BINDING SITE III. Table 2 illustrates the complementarity of the nucleotide sequences of LOC254018 BINDING SITE, designated SEQ ID:46317, to the nucleotide sequence of VGAM2551 RNA, herein designated VGAM RNA, also designated SEQ ID:5262.

Another function of VGAM2551 is therefore inhibition of LOC254018 (Accession XM_173066). Accordingly, utilities of VGAM2551 include diagnosis, prevention and treatment of diseases and clinical conditions associated with LOC254018. LOC91012 (Accession XM_035503) is another VGAM2551 host target gene. LOC91012 BINDING SITE is HOST TARGET binding site found in the 3' untranslated region of mRNA encoded by LOC91012, corresponding to a HOST TARGET binding site such as BINDING SITE I, BINDING SITE II or BINDING SITE III. Table 2 illustrates the complementarity of the nucleotide sequences of LOC91012 BINDING SITE, designated SEQ ID:32285, to the nucleotide sequence of VGAM2551 RNA, herein designated VGAM RNA, also designated SEQ ID:5262.

Another function of VGAM2551 is therefore inhibition of LOC91012 (Accession XM_035503). Accordingly, utilities of VGAM2551 include diagnosis, prevention and treatment of diseases and clinical conditions associated with LOC91012. FIG. 1 further provides a conceptual description of a novel bioinformatically detected viral gene of the present invention, referred to here as Viral Genomic Address Messenger 2552 (VGAM2552) viral gene, which modulates expression of respective host target genes thereof, the function and utility of which host target genes is known in the art.

VGAM2552 is a novel bioinformatically detected regulatory, non protein coding, viral micro RNA (miRNA) gene. The method by which VGAM2552 was detected is described hereinabove with reference to FIGS. 1-8.

VGAM2552 gene, herein designated VGAM GENE, is a viral gene contained in the genome of Rice Ragged Stunt Virus. VGAM2552 host target gene, herein designated VGAM HOST TARGET GENE, is a human gene contained in the human genome.

VGAM2552 gene encodes a VGAM2552 precursor RNA, herein designated VGAM PRECURSOR RNA. Similar to other miRNA genes, and unlike most ordinary genes, VGAM2552 precursor RNA does not encode a protein. A nucleotide sequence identical or highly similar to the nucleotide sequence of VGAM2552 precursor RNA is designated SEQ ID:2538, and is provided hereinbelow with reference to the sequence listing part. Nucleotide sequence SEQ ID:2538 is located at position 3478 relative to the genome of Rice Ragged Stunt Virus.

VGAM2552 precursor RNA folds onto itself, forming VGAM2552 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2552 folded precursor RNA into VGAM2552 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM2552 RNA is designated SEQ ID:5263, and is provided hereinbelow with reference to the sequence listing part.

VGAM2552 host target gene, herein designated VGAM HOST TARGET GENE, encodes a corresponding messenger RNA, VGAM2552 host target RNA, herein designated VGAM HOST TARGET RNA. VGAM2552 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2552 RNA, herein designated VGAM RNA, binds complementarily to one or more host target binding sites located in untranslated regions of VGAM2552 host target RNA, herein designated VGAM HOST TARGET RNA. This complementary binding is due to the fact that the nucleotide sequence of VGAM2552 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2552 RNA, herein designated VGAM RNA, may have a different number of host target binding sites in untranslated regions of a VGAM2552 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2552 RNA, herein designated VGAM RNA, to host target binding sites on VGAM2552 host target RNA, herein designated VGAM HOST TARGET RNA, such as BINDING SITE I, BINDING SITE II and BINDING SITE III, inhibits translation of VGAM2552 host target RNA into VGAM2552 host target protein, herein designated VGAM HOST TARGET PROTEIN. VGAM host target protein is therefore outlined by a broken line.

It is appreciated that VGAM2552 host target gene, herein designated VGAM HOST TARGET GENE, in fact represents a plurality of VGAM2552 host target genes. The mRNA of each one of this plurality of VGAM2552 host target genes comprises one or more host target binding sites, each having a nucleotide sequence which is at least partly complementary to VGAM2552 RNA, herein designated VGAM RNA, and which when bound by VGAM2552 RNA causes inhibition of translation of respective one or more VGAM2552 host target proteins.

It is further appreciated by one skilled in the art that the mode of translational inhibition illustrated by FIG. 1 with specific reference to translational inhibition exerted by VGAM2552 gene, herein designated VGAM GENE, on one or more VGAM2552 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2552 is inhibition of expression of host target genes, as part of a novel viral mechanism of attacking a host. Accordingly, utilities of VGAM2552 include diagnosis, prevention and treatment of viral infection by Rice Ragged Stunt Virus. Specific functions, and accordingly utilities, of VGAM2552 correlate with, and may be deduced from, the identity of the host target genes which VGAM2552 binds and inhibits, and the function of these host target genes, as elaborated hereinbelow.

Nucleotide sequences of the VGAM2552 precursor RNA, herein designated VGAM PRECURSOR RNA, and of the 'diced' VGAM2552 RNA, herein designated VGAM RNA, and a schematic representation of the secondary folding of VGAM2552 folded precursor RNA, herein designated VGAM FOLDED PRECURSOR RNA, of VGAM2552 are further described hereinbelow with reference to Table 1.

Nucleotide sequences of host target binding sites, such as BINDING SITE-I, BINDING SITE-II and BINDING SITE-III of FIG. 1, found on VGAM2552 host target RNA, and schematic representation of the complementarity of each of these host target binding sites to VGAM2552 RNA, herein designated VGAM RNA, are described hereinbelow with reference to Table 2.

As mentioned hereinabove with reference to FIG. 1, a function of VGAM2552 gene, herein designated VGAM is inhibition of expression of VGAM2552 target genes. It is appreciated that specific functions, and accordingly utilities, of VGAM2552 correlate with, and may be deduced from, the identity of the target genes which VGAM2552 binds and inhibits, and the function of these target genes, as elaborated hereinbelow.

Oxysterol Binding Protein-like 8 (OSBPL8, Accession NM_020841) is a VGAM2552 host target gene. OSBPL8 BINDING SITE is HOST TARGET binding site found in the 3' untranslated region of mRNA encoded by OSBPL8, corresponding to a HOST TARGET binding site such as BINDING SITE I, BINDING SITE II or BINDING SITE III. Table 2 illustrates the complementarity of the nucleotide sequences of OSBPL8 BINDING SITE, designated SEQ ID:21909, to the nucleotide sequence of VGAM2552 RNA, herein designated VGAM RNA, also designated SEQ ID:5263.

A function of VGAM2552 is therefore inhibition of Oxysterol Binding Protein-like 8 (OSBPL8, Accession NM_020841). Accordingly, utilities of VGAM2552 include diagnosis, prevention and treatment of diseases and clinical conditions associated with OSBPL8. FIG. 1 further provides a conceptual description of a novel bioinformatically detected viral gene of the present invention, referred to here as Viral Genomic Address Messenger 2553 (VGAM2553) viral gene, which modulates expression of respective host target genes thereof, the function and utility of which host target genes is known in the art.

VGAM2553 is a novel bioinformatically detected regulatory, non protein coding, viral micro RNA (miRNA) gene. The method by which VGAM2553 was detected is described hereinabove with reference to FIGS. 1-8.

VGAM2553 gene, herein designated VGAM GENE, is a viral gene contained in the genome of Rice Ragged Stunt Virus. VGAM2553 host target gene, herein designated VGAM HOST TARGET GENE, is a human gene contained in the human genome.

VGAM2553 gene encodes a VGAM2553 precursor RNA, herein designated VGAM PRECURSOR RNA. Similar to other miRNA genes, and unlike most ordinary genes, VGAM2553 precursor RNA does not encode a protein. A nucleotide sequence identical or highly similar to the nucleotide sequence of VGAM2553 precursor RNA is designated SEQ ID:2539, and is provided hereinbelow with reference to the sequence listing part. Nucleotide sequence SEQ ID:2539 is located at position 271 relative to the genome of Rice Ragged Stunt Virus.

VGAM2553 precursor RNA folds onto itself, forming VGAM2553 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2553 folded precursor RNA into VGAM2553 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2553 RNA is designated SEQ ID:5264, and is provided hereinbelow with reference to the sequence listing part.

VGAM2553 host target gene, herein designated VGAM HOST TARGET GENE, encodes a corresponding messenger RNA, VGAM2553 host target RNA, herein designated VGAM HOST TARGET RNA. VGAM2553 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2553 RNA, herein designated VGAM RNA, binds complementarily to one or more host target binding sites located in untranslated regions of VGAM2553 host target RNA, herein designated VGAM HOST TARGET RNA. This complementary binding is due to the fact that the nucleotide sequence of VGAM2553 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2553 RNA, herein designated VGAM RNA, may have a different number of host target binding sites in untranslated regions of a VGAM2553 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2553 RNA, herein designated VGAM RNA, to host target binding sites on VGAM2553 host target RNA, herein designated VGAM HOST TARGET RNA, such as BINDING SITE I, BINDING SITE II and BINDING SITE III, inhibits translation of VGAM2553 host target RNA into VGAM2553 host target protein, herein designated VGAM HOST TARGET PROTEIN. VGAM host target protein is therefore outlined by a broken line.

It is appreciated that VGAM2553 host target gene, herein designated VGAM HOST TARGET GENE, in fact represents a plurality of VGAM2553 host target genes. The mRNA of each one of this plurality of VGAM2553 host target genes comprises one or more host target binding sites, each having a nucleotide sequence which is at least partly complementary to VGAM2553 RNA, herein designated VGAM RNA, and which when bound by VGAM2553 RNA causes inhibition of translation of respective one or more VGAM2553 host target proteins.

It is further appreciated by one skilled in the art that the mode of translational inhibition illustrated by FIG. 1 with specific reference to translational inhibition exerted by VGAM2553 gene, herein designated VGAM GENE, on one or more VGAM2553 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2553 is inhibition of expression of host target genes, as part of a novel viral mechanism of attacking a host. Accordingly, utilities of VGAM2553 include diagnosis, prevention and treatment of viral infection by Rice Ragged Stunt Virus. Specific functions, and accordingly utilities, of VGAM2553 correlate with, and may be deduced from, the identity of the host target genes which VGAM2553 binds and inhibits, and the function of these host target genes, as elaborated hereinbelow.

Nucleotide sequences of the VGAM2553 precursor RNA, herein designated VGAM PRECURSOR RNA, and of the 'diced' VGAM2553 RNA, herein designated VGAM RNA, and a schematic representation of the secondary folding of VGAM2553 folded precursor RNA, herein designated VGAM FOLDED PRECURSOR RNA, of VGAM2553 are further described hereinbelow with reference to Table 1.

Nucleotide sequences of host target binding sites, such as BINDING SITE-I, BINDING SITE-II and BINDING SITE-III of FIG. 1, found on VGAM2553 host target RNA, and schematic representation of the complementarity of each of these host target binding sites to VGAM2553 RNA, herein designated VGAM RNA, are described hereinbelow with reference to Table 2.

As mentioned hereinabove with reference to FIG. 1, a function of VGAM2553 gene, herein designated VGAM is inhibition of expression of VGAM2553 target genes. It is appreciated that specific functions, and accordingly utilities, of VGAM2553 correlate with, and may be deduced from, the identity of the target genes which VGAM2553 binds and inhibits, and the function of these target genes, as elaborated hereinbelow.

Cytochrome P450, Subfamily XXIV (vitamin D 24-hydroxylase) (CYP24, Accession NM_000782) is a VGAM2553 host target gene. CYP24 BINDING SITE is HOST TARGET binding site found in the 3' untranslated region of mRNA encoded by CYP24, corresponding to a HOST TARGET binding site such as BINDING SITE I, BINDING SITE II or BINDING SITE III. Table 2 illustrates the complementarity of the nucleotide sequences of CYP24 BINDING SITE, designated SEQ ID:6426, to the nucleotide sequence of VGAM2553 RNA, herein designated VGAM RNA, also designated SEQ ID:5264.

A function of VGAM2553 is therefore inhibition of Cytochrome P450, Subfamily XXIV (vitamin D 24-hydroxylase) (CYP24, Accession NM_000782), a gene which induces the differentiation of promyelocytes into monocytes/macrophages. Accordingly, utilities of VGAM2553 include diagnosis, prevention and treatment of diseases and clinical conditions associated with CYP24. The function of CYP24 and its association with various diseases and clinical conditions, has been established by previous studies, as described hereinabove with reference to VGAM1204. C1q and Tumor Necrosis Factor Related Protein 7 (C1QTNF7, Accession NM_031911) is another VGAM2553 host target gene. C1QTNF7 BINDING SITE is HOST TARGET binding site found in the 3' untranslated region of mRNA encoded by C1QTNF7, corresponding to a HOST TARGET binding site such as BINDING SITE I, BINDING SITE II or BINDING SITE III. Table 2 illustrates the complementarity of the nucleotide sequences of C1QTNF7 BINDING SITE, designated SEQ ID:25665, to the nucleotide sequence of VGAM2553 RNA, herein designated VGAM RNA, also designated SEQ ID:5264.

Another function of VGAM2553 is therefore inhibition of C1q and Tumor Necrosis Factor Related Protein 7

(C1QTNF7, Accession NM_031911). Accordingly, utilities of VGAM2553 include diagnosis, prevention and treatment of diseases and clinical conditions associated with C1QTNF7. KIAA1274 (Accession XM_166125) is another VGAM2553 host target gene. KIAA1274 BINDING SITE is HOST TARGET binding site found in the 3' untranslated region of mRNA encoded by KIAA1274, corresponding to a HOST TARGET binding site such as BINDING SITE I, BINDING SITE II or BINDING SITE III. Table 2 illustrates the complementarity of the nucleotide sequences of KIAA1274 BINDING SITE, designated SEQ ID:43910, to the nucleotide sequence of VGAM2553 RNA, herein designated VGAM RNA, also designated SEQ ID:5264.

Another function of VGAM2553 is therefore inhibition of KIAA1274 (Accession XM_166125). Accordingly, utilities of VGAM2553 include diagnosis, prevention and treatment of diseases and clinical conditions associated with KIAA1274. RAS-like, Estrogen-regulated, Growth-inhibitor (RERG, Accession NM_032918) is another VGAM2553 host target gene. RERG BINDING SITE is HOST TARGET binding site found in the 5' untranslated region of mRNA encoded by RERG, corresponding to a HOST TARGET binding site such as BINDING SITE I, BINDING SITE II or BINDING SITE III. Table 2 illustrates the complementarity of the nucleotide sequences of RERG BINDING SITE, designated SEQ ID:26739, to the nucleotide sequence of VGAM2553 RNA, herein designated VGAM RNA, also designated SEQ ID:5264.

Another function of VGAM2553 is therefore inhibition of RAS-like, Estrogen-regulated, Growth-inhibitor (RERG, Accession NM_032918). Accordingly, utilities of VGAM2553 include diagnosis, prevention and treatment of diseases and clinical conditions associated with RERG. LOC256940 (Accession XM_172879) is another VGAM2553 host target gene. LOC256940 BINDING SITE is HOST TARGET binding site found in the 5' untranslated region of mRNA encoded by LOC256940, corresponding to a HOST TARGET binding site such as BINDING SITE I, BINDING SITE II or BINDING SITE III. Table 2 illustrates the complementarity of the nucleotide sequences of LOC256940 BINDING SITE, designated SEQ ID:46155, to the nucleotide sequence of VGAM2553 RNA, herein designated VGAM RNA, also designated SEQ ID:5264.

Another function of VGAM2553 is therefore inhibition of LOC256940 (Accession XM_172879). Accordingly, utilities of VGAM2553 include diagnosis, prevention and treatment of diseases and clinical conditions associated with LOC256940. FIG. 1 further provides a conceptual description of a novel bioinformatically detected viral gene of the present invention, referred to here as Viral Genomic Address Messenger 2554 (VGAM2554) viral gene, which modulates expression of respective host target genes thereof, the function and utility of which host target genes is known in the art.

VGAM2554 is a novel bioinformatically detected regulatory, non protein coding, viral micro RNA (miRNA) gene. The method by which VGAM2554 was detected is described hereinabove with reference to FIGS. 1-8.

VGAM2554 gene, herein designated VGAM GENE, is a viral gene contained in the genome of Plautia Stali Intestine Virus. VGAM2554 host target gene, herein designated VGAM HOST TARGET GENE, is a human gene contained in the human genome.

VGAM2554 gene encodes a VGAM2554 precursor RNA, herein designated VGAM PRECURSOR RNA. Similar to other miRNA genes, and unlike most ordinary genes, VGAM2554 precursor RNA does not encode a protein. A nucleotide sequence identical or highly similar to the nucleotide sequence of VGAM2554 precursor RNA is designated SEQ ID:2540, and is provided hereinbelow with reference to the sequence listing part. Nucleotide sequence SEQ ID:2540 is located at position 685 relative to the genome of Plautia Stali Intestine Virus.

VGAM2554 precursor RNA folds onto itself, forming VGAM2554 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2554 folded precursor RNA into VGAM2554 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM2554 RNA is designated SEQ ID:5265, and is provided hereinbelow with reference to the sequence listing part.

VGAM2554 host target gene, herein designated VGAM HOST TARGET GENE, encodes a corresponding messenger RNA, VGAM2554 host target RNA, herein designated VGAM HOST TARGET RNA. VGAM2554 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2554 RNA, herein designated VGAM RNA, binds complementarily to one or more host target binding sites located in untranslated regions of VGAM2554 host target RNA, herein designated VGAM HOST TARGET RNA. This complementary binding is due to the fact that the nucleotide sequence of VGAM2554 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2554 RNA, herein designated VGAM RNA, may have a different number of host target binding sites in untranslated regions of a VGAM2554 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2554 RNA, herein designated VGAM RNA, to host target binding sites on VGAM2554 host target RNA, herein designated VGAM HOST TARGET RNA, such as BINDING SITE I, BINDING SITE II and BINDING SITE III, inhibits translation of VGAM2554 host target RNA into VGAM2554 host target protein, herein designated VGAM HOST TARGET PROTEIN. VGAM host target protein is therefore outlined by a broken line.

It is appreciated that VGAM2554 host target gene, herein designated VGAM HOST TARGET GENE, in fact represents a plurality of VGAM2554 host target genes. The mRNA of each one of this plurality of VGAM2554 host target genes comprises one or more host target binding sites, each having a nucleotide sequence which is at least partly complementary to VGAM2554 RNA, herein designated VGAM RNA, and which when bound by VGAM2554 RNA causes inhibition of translation of respective one or more VGAM2554 host target proteins.

It is further appreciated by one skilled in the art that the mode of translational inhibition illustrated by FIG. 1 with specific reference to translational inhibition exerted by VGAM2554 gene, herein designated VGAM GENE, on one or more VGAM2554 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2554 is inhibition of expression of host target genes, as part of a novel viral mechanism of attacking a host. Accordingly, utilities of VGAM2554 include diagnosis, prevention and treatment of viral infection by Plautia Stali Intestine Virus. Specific functions, and accordingly utilities, of VGAM2554 correlate with, and may be deduced from, the identity of the host target genes which VGAM2554 binds and inhibits, and the function of these host target genes, as elaborated hereinbelow.

Nucleotide sequences of the VGAM2554 precursor RNA, herein designated VGAM PRECURSOR RNA, and of the 'diced' VGAM2554 RNA, herein designated VGAM RNA, and a schematic representation of the secondary folding of VGAM2554 folded precursor RNA, herein designated VGAM FOLDED PRECURSOR RNA, of VGAM2554 are further described hereinbelow with reference to Table 1.

Nucleotide sequences of host target binding sites, such as BINDING SITE-I, BINDING SITE-II and BINDING SITE-III of FIG. 1, found on VGAM2554 host target RNA, and schematic representation of the complementarity of each of these host target binding sites to VGAM2554 RNA, herein designated VGAM RNA, are described hereinbelow with reference to Table 2.

As mentioned hereinabove with reference to FIG. 1, a function of VGAM2554 gene, herein designated VGAM is inhibition of expression of VGAM2554 target genes. It is appreciated that specific functions, and accordingly utilities, of VGAM2554 correlate with, and may be deduced from, the identity of the target genes which VGAM2554 binds and inhibits, and the function of these target genes, as elaborated hereinbelow.

ATP-binding Cassette, Sub-family D (ALD), Member 4 (ABCD4, Accession NM_020326) is a VGAM2554 host target gene. ABCD4 BINDING SITE is HOST TARGET binding site found in the 3' untranslated region of mRNA encoded by ABCD4, corresponding to a HOST TARGET binding site such as BINDING SITE I, BINDING SITE II or BINDING SITE III. Table 2 illustrates the complementarity of the nucleotide sequences of ABCD4 BINDING SITE, designated SEQ ID:21592, to the nucleotide sequence of VGAM2554 RNA, herein designated VGAM RNA, also designated SEQ ID:5265.

A function of VGAM2554 is therefore inhibition of ATP-binding Cassette, Sub-family D (ALD), Member 4 (ABCD4, Accession NM_020326), a gene which Putative peroxisomal ATP binding cassette transporter. Accordingly, utilities of VGAM2554 include diagnosis, prevention and treatment of diseases and clinical conditions associated with ABCD4. The function of ABCD4 and its association with various diseases and clinical conditions, has been established by previous studies, as described hereinabove with reference to VGAM1924. Cannabinoid Receptor 1 (brain) (CNR1, Accession NM_016083) is another VGAM2554 host target gene. CNR1 BINDING SITE is HOST TARGET binding site found in the 3' untranslated region of mRNA encoded by CNR1, corresponding to a HOST TARGET binding site such as BINDING SITE I, BINDING SITE II or BINDING SITE III. Table 2 illustrates the complementarity of the nucleotide sequences of CNR1 BINDING SITE, designated SEQ ID:18162, to the nucleotide sequence of VGAM2554 RNA, herein designated VGAM RNA, also designated SEQ ID:5265.

Another function of VGAM2554 is therefore inhibition of Cannabinoid Receptor 1 (brain) (CNR1, Accession NM_016083), a gene which is involved in the cannabinoid-induced CNS effects. Accordingly, utilities of VGAM2554 include diagnosis, prevention and treatment of diseases and clinical conditions associated with CNR1. The function of CNR1 and its association with various diseases and clinical conditions, has been established by previous studies, as described hereinabove with reference to VGAM533. Fc Fragment of IgG, Low Affinity IIa, Receptor For (CD32) (FCGR2A, Accession XM_086483) is another VGAM2554 host target gene. FCGR2A BINDING SITE is HOST TARGET binding site found in the 3' untranslated region of mRNA encoded by FCGR2A, corresponding to a HOST TARGET binding site such as BINDING SITE I, BINDING SITE II or BINDING SITE III. Table 2 illustrates the complementarity of the nucleotide sequences of FCGR2A BINDING SITE, designated SEQ ID:38697, to the nucleotide sequence of VGAM2554 RNA, herein designated VGAM RNA, also designated SEQ ID:5265.

Another function of VGAM2554 is therefore inhibition of Fc Fragment of IgG, Low Affinity IIa, Receptor For (CD32) (FCGR2A, Accession XM_086483), a gene which binds IgG immune complexes; member of the immunoglobulin superfamily. Accordingly, utilities of VGAM2554 include diagnosis, prevention and treatment of diseases and clinical conditions associated with FCGR2A. The function of FCGR2A and its association with various diseases and clinical conditions, has been established by previous studies, as described hereinabove with reference to VGAM444. Mitogen-activated Protein Kinase 1 (MAPK1, Accession NM_002745) is another VGAM2554 host target gene. MAPK1 BINDING SITE is HOST TARGET binding site found in the 3' untranslated region of mRNA encoded by MAPK1, corresponding to a HOST TARGET binding site such as BINDING SITE I, BINDING SITE II or BINDING SITE III. Table 2 illustrates the complementarity of the nucleotide sequences of MAPK1 BINDING SITE, designated SEQ ID:8614, to the nucleotide sequence of VGAM2554 RNA, herein designated VGAM RNA, also designated SEQ ID:5265.

Another function of VGAM2554 is therefore inhibition of Mitogen-activated Protein Kinase 1 (MAPK1, Accession NM_002745), a gene which phosphorylates microtubule-associated protein-2 (map2). myelin basic protein (mbp), and elk-1; may promote entry in the cell cycle. Accordingly, utilities of VGAM2554 include diagnosis, prevention and treatment of diseases and clinical conditions associated with MAPK1. The function of MAPK1 and its association with various diseases and clinical conditions, has been established by previous studies, as described hereinabove with reference to VGAM217. Retinitis Pigmentosa 2 (X-linked recessive) (RP2, Accession NM_006915) is another VGAM2554 host target gene. RP2 BINDING SITE is HOST TARGET binding site found in the 3' untranslated region of mRNA encoded by RP2, corresponding to a HOST TARGET binding site such as BINDING SITE I, BINDING SITE II or BINDING SITE III. Table 2 illustrates the complementarity of the nucleotide sequences of RP2 BINDING SITE, designated SEQ ID:13792, to the nucleotide sequence of VGAM2554 RNA, herein designated VGAM RNA, also designated SEQ ID:5265.

Another function of VGAM2554 is therefore inhibition of Retinitis Pigmentosa 2 (X-linked recessive) (RP2, Accession NM_006915). Accordingly, utilities of VGAM2554 include diagnosis, prevention and treatment of diseases and clinical conditions associated with RP2. DKFZP434C1715 (Accession XM_098421) is another VGAM2554 host target gene. DKFZP434C1715 BINDING SITE is HOST TARGET binding site found in the 3' untranslated region of mRNA encoded by DKFZP434C1715, corresponding to a HOST TARGET binding site such as BINDING SITE I, BINDING SITE II or BINDING SITE III. Table 2 illustrates the complementarity of the nucleotide sequences of DKFZP434C1715 BINDING SITE, designated SEQ ID:41673, to the nucleotide sequence of VGAM2554 RNA, herein designated VGAM RNA, also designated SEQ ID:5265.

Another function of VGAM2554 is therefore inhibition of DKFZP434C1715 (Accession XM_098421). Accordingly, utilities of VGAM2554 include diagnosis, prevention and treatment of diseases and clinical conditions associated with DKFZP434C1715. KIAA1416 (Accession XM_098762) is another VGAM2554 host target gene. KIAA1416 BINDING SITE is HOST TARGET binding site found in the 3' untranslated region of mRNA encoded by KIAA1416, corresponding to a HOST TARGET binding site such as BINDING SITE I, BINDING SITE II or BINDING SITE III. Table 2 illustrates the complementarity of the nucleotide sequences of KIAA1416 BINDING SITE, designated SEQ ID:41807, to the nucleotide sequence of VGAM2554 RNA, herein designated VGAM RNA, also designated SEQ ID:5265.

Another function of VGAM2554 is therefore inhibition of KIAA1416 (Accession XM_098762). Accordingly, utilities of VGAM2554 include diagnosis, prevention and treatment of diseases and clinical conditions associated with KIAA1416. MGC9912 (Accession NM_080664) is another VGAM2554 host target gene. MGC9912 BINDING SITE is HOST TARGET binding site found in the 3' untranslated region of mRNA encoded by MGC9912, corresponding to a HOST TARGET binding site such as BINDING SITE I, BINDING SITE II or BINDING SITE III. Table 2 illustrates the complementarity of the nucleotide sequences of MGC9912 BINDING SITE, designated SEQ ID:27952, to the nucleotide sequence of VGAM2554 RNA, herein designated VGAM RNA, also designated SEQ ID:5265.

Another function of VGAM2554 is therefore inhibition of MGC9912 (Accession NM_080664). Accordingly, utilities of VGAM2554 include diagnosis, prevention and treatment of diseases and clinical conditions associated with MGC9912. LOC154222 (Accession XM_098497) is another VGAM2554 host target gene. LOC154222 BINDING SITE is HOST TARGET binding site found in the 3' untranslated region of mRNA encoded by LOC154222, corresponding to a HOST TARGET binding site such as BINDING SITE I, BINDING SITE II or BINDING SITE III. Table 2 illustrates the complementarity of the nucleotide sequences of LOC154222 BINDING SITE, designated SEQ ID:41689, to the nucleotide sequence of VGAM2554 RNA, herein designated VGAM RNA, also designated SEQ ID:5265.

Another function of VGAM2554 is therefore inhibition of LOC154222 (Accession XM_098497). Accordingly, utilities of VGAM2554 include diagnosis, prevention and treatment of diseases and clinical conditions associated with LOC154222. LOC222060 (Accession XM_168427) is another VGAM2554 host target gene. LOC222060 BINDING SITE is HOST TARGET binding site found in the 5' untranslated region of mRNA encoded by LOC222060, corresponding to a HOST TARGET binding site such as BINDING SITE I, BINDING SITE II or BINDING SITE III. Table 2 illustrates the complementarity of the nucleotide sequences of LOC222060 BINDING SITE, designated SEQ ID:45156, to the nucleotide sequence of VGAM2554 RNA, herein designated VGAM RNA, also designated SEQ ID:5265.

Another function of VGAM2554 is therefore inhibition of LOC222060 (Accession XM_168427). Accordingly, utilities of VGAM2554 include diagnosis, prevention and treatment of diseases and clinical conditions associated with LOC222060. FIG. 1 further provides a conceptual description of a novel bioinformatically detected viral gene of the present invention, referred to here as Viral Genomic Address Messenger 2555 (VGAM2555) viral gene, which modulates expression of respective host target genes thereof, the function and utility of which host target genes is known in the art.

VGAM2555 is a novel bioinformatically detected regulatory, non protein coding, viral micro RNA (miRNA) gene. The method by which VGAM2555 was detected is described hereinabove with reference to FIGS. 1-8.

VGAM2555 gene, herein designated VGAM GENE, is a viral gene contained in the genome of Plautia Stali Intestine Virus. VGAM2555 host target gene, herein designated VGAM HOST TARGET GENE, is a human gene contained in the human genome.

VGAM2555 gene encodes a VGAM2555 precursor RNA, herein designated VGAM PRECURSOR RNA. Similar to other miRNA genes, and unlike most ordinary genes, VGAM2555 precursor RNA does not encode a protein. A nucleotide sequence identical or highly similar to the nucleotide sequence of VGAM2555 precursor RNA is designated SEQ ID:2541, and is provided hereinbelow with reference to the sequence listing part. Nucleotide sequence SEQ ID:2541 is located at position 3272 relative to the genome of Plautia Stali Intestine Virus.

VGAM2555 precursor RNA folds onto itself, forming VGAM2555 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2555 folded precursor RNA into VGAM2555 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2555 RNA is designated SEQ ID:5266, and is provided hereinbelow with reference to the sequence listing part.

VGAM2555 host target gene, herein designated VGAM HOST TARGET GENE, encodes a corresponding messenger RNA, VGAM2555 host target RNA, herein designated VGAM HOST TARGET RNA. VGAM2555 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2555 RNA, herein designated VGAM RNA, binds complementarily to one or more host target binding sites located in untranslated regions of VGAM2555 host target RNA, herein designated VGAM HOST TARGET RNA. This complementary binding is due to the fact that the nucleotide sequence of VGAM2555 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2555 RNA, herein designated VGAM RNA, may have a different number of host target binding sites in untranslated regions of a VGAM2555 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2555 RNA, herein designated VGAM RNA, to host target binding sites on VGAM2555 host target RNA, herein designated VGAM HOST TARGET RNA, such as BINDING SITE I, BINDING SITE II and BINDING SITE III, inhibits translation of VGAM2555 host target RNA into VGAM2555 host target protein, herein designated VGAM HOST TARGET PROTEIN. VGAM host target protein is therefore outlined by a broken line.

It is appreciated that VGAM2555 host target gene, herein designated VGAM HOST TARGET GENE, in fact represents a plurality of VGAM2555 host target genes. The mRNA of each one of this plurality of VGAM2555 host target genes comprises one or more host target binding sites, each having a nucleotide sequence which is at least partly complementary to VGAM2555 RNA, herein designated VGAM RNA, and which when bound by VGAM2555 RNA causes inhibition of translation of respective one or more VGAM2555 host target proteins.

It is further appreciated by one skilled in the art that the mode of translational inhibition illustrated by FIG. 1 with specific reference to translational inhibition exerted by VGAM2555 gene, herein designated VGAM GENE, on one or more VGAM2555 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2555 is inhibition of expression of host target genes, as part of a novel viral mechanism of attacking a host. Accordingly, utilities of VGAM2555 include diagnosis, prevention and treatment of viral infection by Plautia Stali Intestine Virus. Specific functions, and accordingly utilities, of VGAM2555 correlate with, and may be deduced from, the identity of the host target genes which VGAM2555 binds and inhibits, and the function of these host target genes, as elaborated hereinbelow.

Nucleotide sequences of the VGAM2555 precursor RNA, herein designated VGAM PRECURSOR RNA, and of the 'diced' VGAM2555 RNA, herein designated VGAM RNA, and a schematic representation of the secondary folding of VGAM2555 folded precursor RNA, herein designated VGAM FOLDED PRECURSOR RNA, of VGAM2555 are further described hereinbelow with reference to Table 1.

Nucleotide sequences of host target binding sites, such as BINDING SITE-I, BINDING SITE-II and BINDING SITE-III of FIG. 1, found on VGAM2555 host target RNA, and schematic representation of the complementarity of each of these host target binding sites to VGAM2555 RNA, herein designated VGAM RNA, are described hereinbelow with reference to Table 2.

As mentioned hereinabove with reference to FIG. 1, a function of VGAM2555 gene, herein designated VGAM is inhibition of expression of VGAM2555 target genes. It is appreciated that specific functions, and accordingly utilities, of VGAM2555 correlate with, and may be deduced from, the identity of the target genes which VGAM2555 binds and inhibits, and the function of these target genes, as elaborated hereinbelow.

GM2 Ganglioside Activator Protein (GM2A, Accession XM_041978) is a VGAM2555 host target gene. GM2A BINDING SITE is HOST TARGET binding site found in the 3' untranslated region of mRNA encoded by GM2A, corresponding to a HOST TARGET binding site such as BINDING SITE I, BINDING SITE II or BINDING SITE III. Table 2 illustrates the complementarity of the nucleotide sequences of GM2A BINDING SITE, designated SEQ ID:33659, to the nucleotide sequence of VGAM2555 RNA, herein designated VGAM RNA, also designated SEQ ID:5266.

A function of VGAM2555 is therefore inhibition of GM2 Ganglioside Activator Protein (GM2A, Accession XM_041978). Accordingly, utilities of VGAM2555 include diagnosis, prevention and treatment of diseases and clinical conditions associated with GM2A. HCS (Accession NM_018947) is another VGAM2555 host target gene. HCS BINDING SITE is HOST TARGET binding site found in the 3' untranslated region of mRNA encoded by HCS, corresponding to a HOST TARGET binding site such as BINDING SITE I, BINDING SITE II or BINDING SITE III. Table 2 illustrates the complementarity of the nucleotide sequences of HCS BINDING SITE, designated SEQ ID:21014, to the nucleotide sequence of VGAM2555 RNA, herein designated VGAM RNA, also designated SEQ ID:5266.

Another function of VGAM2555 is therefore inhibition of HCS (Accession NM_018947). Accordingly, utilities of VGAM2555 include diagnosis, prevention and treatment of diseases and clinical conditions associated with HCS. WD Repeat Domain 4 (WDR4, Accession NM_033662) is another VGAM2555 host target gene. WDR4 BINDING SITE1 and WDR4 BINDING SITE2 are HOST TARGET binding sites found in untranslated regions of mRNA encoded by WDR4, corresponding to HOST TARGET binding sites such as BINDING SITE I, BINDING SITE II or BINDING SITE III. Table 2 illustrates the complementarity of the nucleotide sequences of WDR4 BINDING SITE1 and WDR4 BINDING SITE2, designated SEQ ID:27391 and SEQ ID:20744 respectively, to the nucleotide sequence of VGAM2555 RNA, herein designated VGAM RNA, also designated SEQ ID:5266.

Another function of VGAM2555 is therefore inhibition of WD Repeat Domain 4 (WDR4, Accession NM_033662). Accordingly, utilities of VGAM2555 include diagnosis, prevention and treatment of diseases and clinical conditions associated with WDR4. KIAA1755 (Accession XM_028810) is another VGAM2555 host target gene. KIAA1755 BINDING SITE is HOST TARGET binding site found in the 3' untranslated region of mRNA encoded by KIAA1755, corresponding to a HOST TARGET binding site such as BINDING SITE I, BINDING SITE II or BINDING SITE III. Table 2 illustrates the complementarity of the nucleotide sequences of KIAA1755 BINDING SITE, designated SEQ ID:30748, to the nucleotide sequence of VGAM2555 RNA, herein designated VGAM RNA, also designated SEQ ID:5266.

Another function of VGAM2555 is therefore inhibition of KIAA1755 (Accession XM_028810). Accordingly, utilities of VGAM2555 include diagnosis, prevention and treatment of diseases and clinical conditions associated with KIAA1755. Mitochondrial Ribosomal Protein L35 (MRPL35, Accession NM_016622) is another VGAM2555 host target gene. MRPL35 BINDING SITE is HOST TARGET binding site found in the 3' untranslated region of mRNA encoded by MRPL35, corresponding to a HOST TARGET binding site such as BINDING SITE I, BINDING SITE II or BINDING SITE III. Table 2 illustrates the complementarity of the nucleotide sequences of MRPL35 BINDING SITE, designated SEQ ID:18735, to the nucleotide sequence of VGAM2555 RNA, herein designated VGAM RNA, also designated SEQ ID:5266.

Another function of VGAM2555 is therefore inhibition of Mitochondrial Ribosomal Protein L35 (MRPL35, Accession NM_016622). Accordingly, utilities of VGAM2555 include diagnosis, prevention and treatment of diseases and clinical conditions associated with MRPL35. Mitochondrial Ribosomal Protein S27 (MRPS27, Accession NM_015084) is another VGAM2555 host target gene. MRPS27 BINDING SITE is HOST TARGET binding site found in the 3' untranslated region of mRNA encoded by MRPS27, corresponding to a HOST TARGET binding site such as BINDING SITE I, BINDING SITE II or BINDING SITE III. Table 2 illustrates the complementarity of the nucleotide sequences of MRPS27 BINDING SITE, designated SEQ ID:17475, to the nucleotide sequence of VGAM2555 RNA, herein designated VGAM RNA, also designated SEQ ID:5266.

Another function of VGAM2555 is therefore inhibition of Mitochondrial Ribosomal Protein S27 (MRPS27, Accession NM_015084). Accordingly, utilities of VGAM2555 include diagnosis, prevention and treatment of diseases and clinical conditions associated with MRPS27. RAP140 (Accession NM_015224) is another VGAM2555 host target gene. RAP140 BINDING SITE is HOST TARGET binding site found in the 3' untranslated region of mRNA encoded by RAP140, corresponding to a HOST TARGET binding site such as BINDING SITE I, BINDING SITE II or BINDING SITE III. Table 2 illustrates the complementarity of the nucleotide sequences of RAP140 BINDING SITE, designated SEQ ID:17554, to the nucleotide sequence of VGAM2555 RNA, herein designated VGAM RNA, also designated SEQ ID:5266.

Another function of VGAM2555 is therefore inhibition of RAP140 (Accession NM_015224). Accordingly, utilities of VGAM2555 include diagnosis, prevention and treatment of diseases and clinical conditions associated with RAP140. LOC152373 (Accession XM_087449) is another VGAM2555 host target gene. LOC152373 BINDING SITE is HOST TARGET binding site found in the 5' untranslated region of mRNA encoded by LOC152373, corresponding to a HOST TARGET binding site such as BINDING SITE I, BINDING SITE II or BINDING SITE III. Table 2 illustrates the complementarity of the nucleotide sequences of LOC152373 BINDING SITE, designated SEQ ID:39270, to the nucleotide sequence of VGAM2555 RNA, herein designated VGAM RNA, also designated SEQ ID:5266.

Another function of VGAM2555 is therefore inhibition of LOC152373 (Accession XM_087449). Accordingly, utilities of VGAM2555 include diagnosis, prevention and treatment of diseases and clinical conditions associated with LOC152373. LOC90155 (Accession XM_029487) is another VGAM2555 host target gene. LOC90155 BINDING SITE is HOST TARGET binding site found in the 3' untranslated region of mRNA encoded by LOC90155, corresponding to a HOST TARGET binding site such as BINDING SITE I, BINDING SITE II or BINDING SITE III. Table 2 illustrates the complementarity of the nucleotide sequences of LOC90155 BINDING SITE, designated SEQ ID:30899, to the nucleotide sequence of VGAM2555 RNA, herein designated VGAM RNA, also designated SEQ ID:5266.

Another function of VGAM2555 is therefore inhibition of LOC90155 (Accession XM_029487). Accordingly, utilities of VGAM2555 include diagnosis, prevention and treatment of diseases and clinical conditions associated with LOC90155. FIG. 1 further provides a conceptual description of a novel bioinformatically detected viral gene of the present invention, referred to here as Viral Genomic Address Messenger 2556 (VGAM2556) viral gene, which modulates expression of respective host target genes thereof, the function and utility of which host target genes is known in the art.

VGAM2556 is a novel bioinformatically detected regulatory, non protein coding, viral micro RNA (miRNA) gene. The method by which VGAM2556 was detected is described hereinabove with reference to FIGS. 1-8.

VGAM2556 gene, herein designated VGAM GENE, is a viral gene contained in the genome of Plautia Stali Intestine Virus. VGAM2556 host target gene, herein designated VGAM HOST TARGET GENE, is a human gene contained in the human genome.

VGAM2556 gene encodes a VGAM2556 precursor RNA, herein designated VGAM PRECURSOR RNA. Similar to other miRNA genes, and unlike most ordinary genes, VGAM2556 precursor RNA does not encode a protein. A nucleotide sequence identical or highly similar to the nucleotide sequence of VGAM2556 precursor RNA is designated SEQ ID:2542, and is provided hereinbelow with reference to the sequence listing part. Nucleotide sequence SEQ ID:2542 is located at position 4204 relative to the genome of Plautia Stali Intestine Virus.

VGAM2556 precursor RNA folds onto itself, forming VGAM2556 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2556 folded precursor RNA into VGAM2556 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 48%) nucleotide sequence of VGAM2556 RNA is designated SEQ ID:5267, and is provided hereinbelow with reference to the sequence listing part.

VGAM2556 host target gene, herein designated VGAM HOST TARGET GENE, encodes a corresponding messenger RNA, VGAM2556 host target RNA, herein designated VGAM HOST TARGET RNA. VGAM2556 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2556 RNA, herein designated VGAM RNA, binds complementarily to one or more host target binding sites located in untranslated regions of VGAM2556 host target RNA, herein designated VGAM HOST TARGET RNA. This complementary binding is due to the fact that the nucleotide sequence of VGAM2556 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2556 RNA, herein designated VGAM RNA, may have a different number of host target binding sites in untranslated regions of a VGAM2556 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2556 RNA, herein designated VGAM RNA, to host target binding sites on VGAM2556 host target RNA, herein designated VGAM HOST TARGET RNA, such as BINDING SITE I, BINDING SITE II and BINDING SITE III, inhibits translation of VGAM2556 host target RNA into VGAM2556 host target protein, herein designated VGAM HOST TARGET PROTEIN. VGAM host target protein is therefore outlined by a broken line.

It is appreciated that VGAM2556 host target gene, herein designated VGAM HOST TARGET GENE, in fact represents a plurality of VGAM2556 host target genes. The mRNA of each one of this plurality of VGAM2556 host target genes comprises one or more host target binding sites, each having a nucleotide sequence which is at least partly complementary to VGAM2556 RNA, herein designated VGAM RNA, and which when bound by VGAM2556 RNA causes inhibition of translation of respective one or more VGAM2556 host target proteins.

It is further appreciated by one skilled in the art that the mode of translational inhibition illustrated by FIG. 1 with specific reference to translational inhibition exerted by VGAM2556 gene, herein designated VGAM GENE, on one or more VGAM2556 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2556 is inhibition of expression of host target genes, as part of a novel viral mechanism of attacking a host. Accordingly, utilities of VGAM2556 include diagnosis, prevention and treatment of viral infection by Plautia Stali Intestine Virus. Specific functions, and accordingly utilities, of VGAM2556 correlate with, and may be deduced from, the identity of the host target genes which VGAM2556 binds and inhibits, and the function of these host target genes, as elaborated hereinbelow.

Nucleotide sequences of the VGAM2556 precursor RNA, herein designated VGAM PRECURSOR RNA, and of the 'diced' VGAM2556 RNA, herein designated VGAM RNA, and a schematic representation of the secondary folding of VGAM2556 folded precursor RNA, herein designated VGAM FOLDED PRECURSOR RNA, of VGAM2556 are further described hereinbelow with reference to Table 1.

Nucleotide sequences of host target binding sites, such as BINDING SITE-I, BINDING SITE-II and BINDING SITE-III of FIG. 1, found on VGAM2556 host target RNA, and schematic representation of the complementarity of each of these host target binding sites to VGAM2556 RNA, herein designated VGAM RNA, are described hereinbelow with reference to Table 2.

As mentioned hereinabove with reference to FIG. 1, a function of VGAM2556 gene, herein designated VGAM is inhibition of expression of VGAM2556 target genes. It is appreciated that specific functions, and accordingly utilities, of VGAM2556 correlate with, and may be deduced from, the identity of the target genes which VGAM2556 binds and inhibits, and the function of these target genes, as elaborated hereinbelow.

Aryl Hydrocarbon Receptor (AHR, Accession NM_001621) is a VGAM2556 host target gene. AHR BINDING SITE is HOST TARGET binding site found in the 5' untranslated region of mRNA encoded by AHR, corresponding to a HOST TARGET binding site such as BINDING SITE I, BINDING SITE II or BINDING SITE III. Table 2 illustrates the complementarity of the nucleotide sequences of AHR BINDING SITE, designated SEQ ID:7330, to the nucleotide sequence of VGAM2556 RNA, herein designated VGAM RNA, also designated SEQ ID:5267.

A function of VGAM2556 is therefore inhibition of Aryl Hydrocarbon Receptor (AHR, Accession NM_001621), a gene which plays a role in modulating carcinogenesis through the induction of xenobiotic-metabolizing enzymes. Accordingly, utilities of VGAM2556 include diagnosis, prevention and treatment of diseases and clinical conditions associated with AHR. The function of AHR and its association with various diseases and clinical conditions, has been established by previous studies, as described hereinabove with reference to VGAM368. Coagulation Factor VIII, Procoagulant Component (hemophilia A) (F8, Accession NM_000132) is another VGAM2556 host target gene. F8 BINDING SITE is HOST TARGET binding site found in the 3' untranslated region of mRNA encoded by F8, corresponding to a HOST TARGET binding site such as BINDING SITE I, BINDING SITE II or BINDING SITE III. Table 2 illustrates the complementarity of the nucleotide sequences of F8 BINDING SITE, designated SEQ ID:5612, to the nucleotide sequence of VGAM2556 RNA, herein designated VGAM RNA, also designated SEQ ID:5267.

Another function of VGAM2556 is therefore inhibition of Coagulation Factor VIII, Procoagulant Component (hemophilia A) (F8, Accession NM_000132). Accordingly, utilities of VGAM2556 include diagnosis, prevention and treatment of diseases and clinical conditions associated with F8.

FLJ10697 (Accession NM_018181) is another VGAM2556 host target gene. FLJ10697 BINDING SITE is HOST TARGET binding site found in the 3' untranslated region of mRNA encoded by FLJ10697, corresponding to a HOST TARGET binding site such as BINDING SITE I, BINDING SITE II or BINDING SITE III. Table 2 illustrates the complementarity of the nucleotide sequences of FLJ10697 BINDING SITE, designated SEQ ID:20015, to the nucleotide sequence of VGAM2556 RNA, herein designated VGAM RNA, also designated SEQ ID:5267.

Another function of VGAM2556 is therefore inhibition of FLJ10697 (Accession NM_018181). Accordingly, utilities of VGAM2556 include diagnosis, prevention and treatment of diseases and clinical conditions associated with FLJ10697. LOC114971 (Accession XM_054936) is another VGAM2556 host target gene. LOC114971 BINDING SITE is HOST TARGET binding site found in the 3' untranslated region of mRNA encoded by LOC114971, corresponding to a HOST TARGET binding site such as BINDING SITE I, BINDING SITE II or BINDING SITE III. Table 2 illustrates the complementarity of the nucleotide sequences of LOC114971 BINDING SITE, designated SEQ ID:36205, to the nucleotide sequence of VGAM2556 RNA, herein designated VGAM RNA, also designated SEQ ID:5267.

Another function of VGAM2556 is therefore inhibition of LOC114971 (Accession XM_054936). Accordingly, utilities of VGAM2556 include diagnosis, prevention and treatment of diseases and clinical conditions associated with LOC114971. LOC158158 (Accession XM_088494) is another VGAM2556 host target gene. LOC158158 BINDING SITE is HOST TARGET binding site found in the 3' untranslated region of mRNA encoded by LOC158158, corresponding to a HOST TARGET binding site such as BINDING SITE I, BINDING SITE II or BINDING SITE III. Table 2 illustrates the complementarity of the nucleotide sequences of LOC158158 BINDING SITE, designated SEQ ID:39731, to the nucleotide sequence of VGAM2556 RNA, herein designated VGAM RNA, also designated SEQ ID:5267.

Another function of VGAM2556 is therefore inhibition of LOC158158 (Accession XM_088494). Accordingly, utilities of VGAM2556 include diagnosis, prevention and treatment of diseases and clinical conditions associated with LOC158158. LOC257319 (Accession XM_171049) is another VGAM2556 host target gene. LOC257319 BINDING SITE is HOST TARGET binding site found in the 3' untranslated region of mRNA encoded by LOC257319, corresponding to a HOST TARGET binding site such as BINDING SITE I, BINDING SITE II or BINDING SITE III. Table 2 illustrates the complementarity of the nucleotide sequences of LOC257319 BINDING SITE, designated SEQ ID:45833, to the nucleotide sequence of VGAM2556 RNA, herein designated VGAM RNA, also designated SEQ ID:5267.

Another function of VGAM2556 is therefore inhibition of LOC257319 (Accession XM_171049). Accordingly, utilities of VGAM2556 include diagnosis, prevention and treatment of diseases and clinical conditions associated with LOC257319. FIG. 1 further provides a conceptual description of a novel bioinformatically detected viral gene of the present invention, referred to here as Viral Genomic Address Messenger 2557 (VGAM2557) viral gene, which modulates expression of respective host target genes thereof, the function and utility of which host target genes is known in the art.

VGAM2557 is a novel bioinformatically detected regulatory, non protein coding, viral micro RNA (miRNA) gene. The method by which VGAM2557 was detected is described hereinabove with reference to FIGS. 1-8.

VGAM2557 gene, herein designated VGAM GENE, is a viral gene contained in the genome of Himetobi P Virus. VGAM2557 host target gene, herein designated VGAM HOST TARGET GENE, is a human gene contained in the human genome.

VGAM2557 gene encodes a VGAM2557 precursor RNA, herein designated VGAM PRECURSOR RNA. Similar to other miRNA genes, and unlike most ordinary genes, VGAM2557 precursor RNA does not encode a protein. A nucleotide sequence identical or highly similar to the nucleotide sequence of VGAM2557 precursor RNA is designated SEQ ID:2543, and is provided hereinbelow with reference to the sequence listing part. Nucleotide sequence SEQ ID:2543 is located at position 8347 relative to the genome of Himetobi P Virus.

VGAM2557 precursor RNA folds onto itself, forming VGAM2557 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2557 folded precursor RNA into VGAM2557 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2557 RNA is designated SEQ ID:5268, and is provided hereinbelow with reference to the sequence listing part.

VGAM2557 host target gene, herein designated VGAM HOST TARGET GENE, encodes a corresponding messenger RNA, VGAM2557 host target RNA, herein designated VGAM HOST TARGET RNA. VGAM2557 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2557 RNA, herein designated VGAM RNA, binds complementarily to one or more host target binding sites located in untranslated regions of VGAM2557 host target RNA, herein designated VGAM HOST TARGET RNA. This complementary binding is due to the fact that the nucleotide sequence of VGAM2557 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2557 RNA, herein designated VGAM RNA, may have a different number of host target binding sites in untranslated regions of a VGAM2557 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2557 RNA, herein designated VGAM RNA, to host target binding sites on VGAM2557 host target RNA, herein designated VGAM HOST TARGET RNA, such as BINDING SITE I, BINDING SITE II and BINDING SITE III, inhibits translation of VGAM2557 host target RNA into VGAM2557 host target protein, herein designated VGAM HOST TARGET PROTEIN. VGAM host target protein is therefore outlined by a broken line.

It is appreciated that VGAM2557 host target gene, herein designated VGAM HOST TARGET GENE, in fact represents a plurality of VGAM2557 host target genes. The mRNA of each one of this plurality of VGAM2557 host target genes comprises one or more host target binding sites, each having a nucleotide sequence which is at least partly complementary to VGAM2557 RNA, herein designated VGAM RNA, and which when bound by VGAM2557 RNA causes inhibition of translation of respective one or more VGAM2557 host target proteins.

It is further appreciated by one skilled in the art that the mode of translational inhibition illustrated by FIG. 1 with specific reference to translational inhibition exerted by VGAM2557 gene, herein designated VGAM GENE, on one or more VGAM2557 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2557 is inhibition of expression of host target genes, as part of a novel viral mechanism of attacking a host. Accordingly, utilities of VGAM2557 include diagnosis, prevention and treatment of viral infection by Himetobi P Virus. Specific functions, and accordingly utilities, of VGAM2557 correlate with, and may be deduced from, the identity of the host target genes which VGAM2557 binds and inhibits, and the function of these host target genes, as elaborated hereinbelow.

Nucleotide sequences of the VGAM2557 precursor RNA, herein designated VGAM PRECURSOR RNA, and of the 'diced' VGAM2557 RNA, herein designated VGAM RNA, and a schematic representation of the secondary folding of VGAM2557 folded precursor RNA, herein designated VGAM FOLDED PRECURSOR RNA, of VGAM2557 are further described hereinbelow with reference to Table 1.

Nucleotide sequences of host target binding sites, such as BINDING SITE-I, BINDING SITE-II and BINDING SITE-III of FIG. 1, found on VGAM2557 host target RNA, and schematic representation of the complementarity of each of these host target binding sites to VGAM2557 RNA, herein designated VGAM RNA, are described hereinbelow with reference to Table 2.

As mentioned hereinabove with reference to FIG. 1, a function of VGAM2557 gene, herein designated VGAM is inhibition of expression of VGAM2557 target genes. It is appreciated that specific functions, and accordingly utilities, of VGAM2557 correlate with, and may be deduced from, the identity of the target genes which VGAM2557 binds and inhibits, and the function of these target genes, as elaborated hereinbelow.

Potassium Voltage-gated Channel, Shal-related Subfamily, Member 2 (KCND2, Accession NM_012281) is a VGAM2557 host target gene. KCND2 BINDING SITE is HOST TARGET binding site found in the 3' untranslated region of mRNA encoded by KCND2, corresponding to a HOST TARGET binding site such as BINDING SITE I, BINDING SITE II or BINDING SITE III. Table 2 illustrates the complementarity of the nucleotide sequences of KCND2 BINDING SITE, designated SEQ ID:14611, to the nucleotide sequence of VGAM2557 RNA, herein designated VGAM RNA, also designated SEQ ID:5268.

A function of VGAM2557 is therefore inhibition of Potassium Voltage-gated Channel, Shal-related Subfamily, Member 2 (KCND2, Accession NM_012281), a gene which is prominent in the repolarization phase of the action potential. Accordingly, utilities of VGAM2557 include diagnosis, prevention and treatment of diseases and clinical conditions associated with KCND2. The function of KCND2 and its association with various diseases and clinical conditions, has been established by previous studies, as described hereinabove with reference to VGAM449. RAS Guanyl Releasing Protein 1 (calcium and DAG-regulated) (RASGRP1, Accession NM_005739) is another VGAM2557 host target gene. RASGRP1 BINDING SITE is HOST TARGET binding site found in the 3' untranslated region of mRNA encoded by RASGRP1, corresponding to a HOST TARGET binding site such as BINDING SITE I, BINDING SITE II or BINDING SITE III. Table 2 illustrates the complementarity of the nucleotide sequences of RASGRP1 BINDING SITE, designated SEQ ID:12301, to the nucleotide sequence of VGAM2557 RNA, herein designated VGAM RNA, also designated SEQ ID:5268.

Another function of VGAM2557 is therefore inhibition of RAS Guanyl Releasing Protein 1 (calcium and DAG-regulated) (RASGRP1, Accession NM_005739). Accordingly, utilities of VGAM2557 include diagnosis, prevention and treatment of diseases and clinical conditions associated with RASGRP1. FLJ14166 (Accession NM_024565) is another VGAM2557 host target gene. FLJ14166 BINDING SITE is HOST TARGET binding site found in the 3' untranslated region of mRNA encoded by FLJ14166, corresponding to a HOST TARGET binding site such as BINDING SITE I, BINDING SITE II or BINDING SITE III. Table 2 illustrates the complementarity of the nucleotide sequences of FLJ14166 BINDING SITE, designated SEQ ID:23793, to the nucleotide sequence of VGAM2557 RNA, herein designated VGAM RNA, also designated SEQ ID:5268.

Another function of VGAM2557 is therefore inhibition of FLJ14166 (Accession NM_024565). Accordingly, utilities of VGAM2557 include diagnosis, prevention and treatment of diseases and clinical conditions associated with FLJ14166. FLJ33069 (Accession NM_144649) is another VGAM2557 host target gene. FLJ33069 BINDING SITE is HOST TARGET binding site found in the 3' untranslated region of mRNA encoded by FLJ33069, corresponding to a HOST TARGET binding site such as BINDING SITE I, BINDING SITE II or BINDING SITE III. Table 2 illustrates the complementarity of the nucleotide sequences of FLJ33069 BINDING SITE, designated SEQ ID:29473, to the nucleotide sequence of VGAM2557 RNA, herein designated VGAM RNA, also designated SEQ ID:5268.

Another function of VGAM2557 is therefore inhibition of FLJ33069 (Accession NM_144649). Accordingly, utilities of VGAM2557 include diagnosis, prevention and treatment of diseases and clinical conditions associated with FLJ33069. KIAA0152 (Accession NM_014730) is another VGAM2557 host target gene. KIAA0152 BINDING SITE is HOST TARGET binding site found in the 3' untranslated region of mRNA encoded by KIAA0152, corresponding to a HOST TARGET binding site such as BINDING SITE I, BINDING SITE II or BINDING SITE III. Table 2 illustrates the complementarity of the nucleotide sequences of KIAA0152 BINDING SITE, designated SEQ ID:16331, to the nucleotide sequence of VGAM2557 RNA, herein designated VGAM RNA, also designated SEQ ID:5268.

Another function of VGAM2557 is therefore inhibition of KIAA0152 (Accession NM_014730). Accordingly, utilities of VGAM2557 include diagnosis, prevention and treatment of diseases and clinical conditions associated with KIAA0152. LOC148195 (Accession XM_097419) is another VGAM2557 host target gene. LOC148195 BINDING SITE is HOST TARGET binding site found in the 5' untranslated region of mRNA encoded by LOC148195, corresponding to a HOST TARGET binding site such as BINDING SITE I, BINDING SITE II or BINDING SITE III. Table 2 illustrates the complementarity of the nucleotide sequences of LOC148195 BINDING SITE, designated SEQ ID:40879, to the nucleotide sequence of VGAM2557 RNA, herein designated VGAM RNA, also designated SEQ ID:5268.

Another function of VGAM2557 is therefore inhibition of LOC148195 (Accession XM_097419). Accordingly, utilities of VGAM2557 include diagnosis, prevention and treatment of diseases and clinical conditions associated with LOC148195. LOC148562 (Accession XM_086240) is another VGAM2557 host target gene. LOC148562 BINDING SITE is HOST TARGET binding site found in the 3' untranslated region of mRNA encoded by LOC148562, corresponding to a HOST TARGET binding site such as BINDING SITE I, BINDING SITE II or BINDING SITE III. Table 2 illustrates the complementarity of the nucleotide sequences of LOC148562 BINDING SITE, designated SEQ ID:38565, to the nucleotide sequence of VGAM2557 RNA, herein designated VGAM RNA, also designated SEQ ID:5268.

Another function of VGAM2557 is therefore inhibition of LOC148562 (Accession XM_086240). Accordingly, utilities of VGAM2557 include diagnosis, prevention and treatment of diseases and clinical conditions associated with LOC148562. FIG. 1 further provides a conceptual description of a novel bioinformatically detected viral gene of the present invention, referred to here as Viral Genomic Address Messenger 2558 (VGAM2558) viral gene, which modulates expression of respective host target genes thereof, the function and utility of which host target genes is known in the art.

VGAM2558 is a novel bioinformatically detected regulatory, non protein coding, viral micro RNA (miRNA) gene. The method by which VGAM2558 was detected is described hereinabove with reference to FIGS. 1-8.

VGAM2558 gene, herein designated VGAM GENE, is a viral gene contained in the genome of Himetobi P Virus. VGAM2558 host target gene, herein designated VGAM HOST TARGET GENE, is a human gene contained in the human genome.

VGAM2558 gene encodes a VGAM2558 precursor RNA, herein designated VGAM PRECURSOR RNA. Similar to other miRNA genes, and unlike most ordinary genes, VGAM2558 precursor RNA does not encode a protein. A nucleotide sequence identical or highly similar to the nucleotide sequence of VGAM2558 precursor RNA is designated SEQ ID:2544, and is provided hereinbelow with reference to the sequence listing part. Nucleotide sequence SEQ ID:2544 is located at position 7354 relative to the genome of Himetobi P Virus.

VGAM2558 precursor RNA folds onto itself, forming VGAM2558 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2558 folded precursor RNA into VGAM2558 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2558 RNA is designated SEQ ID:5269, and is provided hereinbelow with reference to the sequence listing part.

VGAM2558 host target gene, herein designated VGAM HOST TARGET GENE, encodes a corresponding messenger RNA, VGAM2558 host target RNA, herein designated VGAM HOST TARGET RNA. VGAM2558 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2558 RNA, herein designated VGAM RNA, binds complementarily to one or more host target binding sites located in untranslated regions of VGAM2558 host target RNA, herein designated VGAM HOST TARGET RNA. This complementary binding is due to the fact that the nucleotide sequence of VGAM2558 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2558 RNA, herein designated VGAM RNA, may have a different number of host target binding sites in untranslated regions of a VGAM2558 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2558 RNA, herein designated VGAM RNA, to host target binding sites on VGAM2558 host target RNA, herein designated VGAM HOST TARGET RNA, such as BINDING SITE I, BINDING SITE II and BINDING SITE III, inhibits translation of VGAM2558 host target RNA into VGAM2558 host target protein, herein designated VGAM HOST TARGET PROTEIN. VGAM host target protein is therefore outlined by a broken line.

It is appreciated that VGAM2558 host target gene, herein designated VGAM HOST TARGET GENE, in fact represents a plurality of VGAM2558 host target genes. The mRNA of each one of this plurality of VGAM2558 host target genes comprises one or more host target binding sites, each having a nucleotide sequence which is at least partly complementary to VGAM2558 RNA, herein designated VGAM RNA, and which when bound by VGAM2558 RNA causes inhibition of translation of respective one or more VGAM2558 host target proteins.

It is further appreciated by one skilled in the art that the mode of translational inhibition illustrated by FIG. 1 with specific reference to translational inhibition exerted by VGAM2558 gene, herein designated VGAM GENE, on one or more VGAM2558 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2558 is inhibition of expression of host target genes, as part of a novel viral mechanism of attacking a host. Accordingly, utilities of VGAM2558 include diagnosis, prevention and treatment of viral infection by Himetobi P Virus. Specific functions, and accordingly utilities, of VGAM2558 correlate with, and may be deduced from, the identity of the host target genes which VGAM2558 binds and inhibits, and the function of these host target genes, as elaborated hereinbelow.

Nucleotide sequences of the VGAM2558 precursor RNA, herein designated VGAM PRECURSOR RNA, and of the 'diced' VGAM2558 RNA, herein designated VGAM RNA, and a schematic representation of the secondary folding of VGAM2558 folded precursor RNA, herein designated VGAM FOLDED PRECURSOR RNA, of VGAM2558 are further described hereinbelow with reference to Table 1.

Nucleotide sequences of host target binding sites, such as BINDING SITE-I, BINDING SITE-II and BINDING SITE-III of FIG. 1, found on VGAM2558 host target RNA, and schematic representation of the complementarity of each of these host target binding sites to VGAM2558 RNA, herein designated VGAM RNA, are described hereinbelow with reference to Table 2.

As mentioned hereinabove with reference to FIG. 1, a function of VGAM2558 gene, herein designated VGAM is inhibition of expression of VGAM2558 target genes. It is appreciated that specific functions, and accordingly utilities, of VGAM2558 correlate with, and may be deduced from, the identity of the target genes which VGAM2558 binds and inhibits, and the function of these target genes, as elaborated hereinbelow.

DNAM-1 (Accession NM_006566) is a VGAM2558 host target gene. DNAM-1 BINDING SITE is HOST TARGET binding site found in the 3' untranslated region of mRNA encoded by DNAM-1, corresponding to a HOST TARGET binding site such as BINDING SITE I, BINDING SITE II or BINDING SITE III. Table 2 illustrates the complementarity of the nucleotide sequences of DNAM-1 BINDING SITE, designated SEQ ID:13338, to the nucleotide sequence of VGAM2558 RNA, herein designated VGAM RNA, also designated SEQ ID:5269.

A function of VGAM2558 is therefore inhibition of DNAM-1 (Accession NM_006566). Accordingly, utilities of VGAM2558 include diagnosis, prevention and treatment of diseases and clinical conditions associated with DNAM-1. FIG. 1 further provides a conceptual description of a novel bioinformatically detected viral gene of the present invention, referred to here as Viral Genomic Address Messenger 2559 (VGAM2559) viral gene, which modulates expression of respective host target genes thereof, the function and utility of which host target genes is known in the art.

VGAM2559 is a novel bioinformatically detected regulatory, non protein coding, viral micro RNA (miRNA) gene. The method by which VGAM2559 was detected is described hereinabove with reference to FIGS. 1-8.

VGAM2559 gene, herein designated VGAM GENE, is a viral gene contained in the genome of Himetobi P Virus. VGAM2559 host target gene, herein designated VGAM HOST TARGET GENE, is a human gene contained in the human genome.

VGAM2559 gene encodes a VGAM2559 precursor RNA, herein designated VGAM PRECURSOR RNA. Similar to other miRNA genes, and unlike most ordinary genes, VGAM2559 precursor RNA does not encode a protein. A nucleotide sequence identical or highly similar to the nucleotide sequence of VGAM2559 precursor RNA is designated SEQ ID:2545, and is provided hereinbelow with reference to the sequence listing part. Nucleotide sequence SEQ ID:2545 is located at position 8220 relative to the genome of Himetobi P Virus.

VGAM2559 precursor RNA folds onto itself, forming VGAM2559 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2559 folded precursor RNA into VGAM2559 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2559 RNA is designated SEQ ID:5270, and is provided hereinbelow with reference to the sequence listing part.

VGAM2559 host target gene, herein designated VGAM HOST TARGET GENE, encodes a corresponding messenger RNA, VGAM2559 host target RNA, herein designated VGAM HOST TARGET RNA. VGAM2559 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2559 RNA, herein designated VGAM RNA, binds complementarily to one or more host target binding sites located in untranslated regions of VGAM2559 host target RNA, herein designated VGAM HOST TARGET RNA. This complementary binding is due to the fact that the nucleotide sequence of VGAM2559 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2559 RNA, herein designated VGAM RNA, may have a different number of host target binding sites in untranslated regions of a VGAM2559 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2559 RNA, herein designated VGAM RNA, to host target binding sites on VGAM2559 host target RNA, herein designated VGAM HOST TARGET RNA, such as BINDING SITE I, BINDING SITE II and BINDING SITE III, inhibits translation of VGAM2559 host target RNA into VGAM2559 host target protein, herein designated VGAM HOST TARGET PROTEIN. VGAM host target protein is therefore outlined by a broken line.

It is appreciated that VGAM2559 host target gene, herein designated VGAM HOST TARGET GENE, in fact represents a plurality of VGAM2559 host target genes. The mRNA of each one of this plurality of VGAM2559 host target genes comprises one or more host target binding sites, each having a nucleotide sequence which is at least partly complementary to VGAM2559 RNA, herein designated VGAM RNA, and which when bound by VGAM2559 RNA causes inhibition of translation of respective one or more VGAM2559 host target proteins.

It is further appreciated by one skilled in the art that the mode of translational inhibition illustrated by FIG. 1 with specific reference to translational inhibition exerted by VGAM2559 gene, herein designated VGAM GENE, on one or more VGAM2559 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2559 is inhibition of expression of host target genes, as part of a novel viral mechanism of attacking a host. Accordingly, utilities of VGAM2559 include diagnosis, prevention and treatment of viral infection by Himetobi P Virus. Specific functions, and accordingly utilities, of VGAM2559 correlate with, and may be deduced from, the identity of the host target genes which VGAM2559 binds and inhibits, and the function of these host target genes, as elaborated hereinbelow.

Nucleotide sequences of the VGAM2559 precursor RNA, herein designated VGAM PRECURSOR RNA, and of the 'diced' VGAM2559 RNA, herein designated VGAM RNA, and a schematic representation of the secondary folding of VGAM2559 folded precursor RNA, herein designated VGAM FOLDED PRECURSOR RNA, of VGAM2559 are further described hereinbelow with reference to Table 1.

Nucleotide sequences of host target binding sites, such as BINDING SITE-I, BINDING SITE-II and BINDING SITE-III of FIG. 1, found on VGAM2559 host target RNA, and schematic representation of the complementarity of each of these host target binding sites to VGAM2559 RNA, herein designated VGAM RNA, are described hereinbelow with reference to Table 2.

As mentioned hereinabove with reference to FIG. 1, a function of VGAM2559 gene, herein designated VGAM is inhibition of expression of VGAM2559 target genes. It is appreciated that specific functions, and accordingly utilities, of VGAM2559 correlate with, and may be deduced from, the identity of the target genes which VGAM2559 binds and inhibits, and the function of these target genes, as elaborated hereinbelow.

Dystrophia Myotonica-containing WD Repeat Motif (DMWD, Accession XM_027569) is a VGAM2559 host target gene. DMWD BINDING SITE is HOST TARGET binding site found in the 3' untranslated region of mRNA encoded by DMWD, corresponding to a HOST TARGET binding site such as BINDING SITE I, BINDING SITE II or BINDING SITE III. Table 2 illustrates the complementarity of the nucleotide sequences of DMWD BINDING SITE, designated SEQ ID:30529, to the nucleotide sequence of VGAM2559 RNA, herein designated VGAM RNA, also designated SEQ ID:5270.

A function of VGAM2559 is therefore inhibition of Dystrophia Myotonica-containing WD Repeat Motif (DMWD, Accession XM_027569). Accordingly, utilities of VGAM2559 include diagnosis, prevention and treatment of diseases and clinical conditions associated with DMWD. KIAA0450 (Accession NM_014638) is another VGAM2559 host target gene. KIAA0450 BINDING SITE is HOST TARGET binding site found in the 3' untranslated region of mRNA encoded by KIAA0450, corresponding to a HOST TARGET binding site such as BINDING SITE I, BINDING SITE II or BINDING SITE III. Table 2 illustrates the complementarity of the nucleotide sequences of KIAA0450 BINDING SITE, designated SEQ ID:16029, to the nucleotide sequence of VGAM2559 RNA, herein designated VGAM RNA, also designated SEQ ID:5270.

Another function of VGAM2559 is therefore inhibition of KIAA0450 (Accession NM_014638). Accordingly, utilities of VGAM2559 include diagnosis, prevention and treatment of diseases and clinical conditions associated with KIAA0450. KIAA0594 (Accession XM_036117) is another VGAM2559 host target gene. KIAA0594 BINDING SITE is HOST TARGET binding site found in the 3' untranslated region of mRNA encoded by KIAA0594, corresponding to a HOST TARGET binding site such as BINDING SITE I, BINDING SITE II or BINDING SITE III. Table 2 illustrates the complementarity of the nucleotide sequences of KIAA0594 BINDING SITE, designated SEQ ID:32386, to the nucleotide sequence of VGAM2559 RNA, herein designated VGAM RNA, also designated SEQ ID:5270.

Another function of VGAM2559 is therefore inhibition of KIAA0594 (Accession XM_036117). Accordingly, utilities of VGAM2559 include diagnosis, prevention and treatment of diseases and clinical conditions associated with KIAA0594. KIAA1940 (Accession XM_086981) is another VGAM2559 host target gene. KIAA1940 BINDING SITE is HOST TARGET binding site found in the 3' untranslated region of mRNA encoded by KIAA1940, corresponding to a HOST TARGET binding site such as BINDING SITE I, BINDING SITE II or BINDING SITE III. Table 2 illustrates the complementarity of the nucleotide sequences of KIAA1940 BINDING SITE, designated SEQ ID:39005, to the nucleotide sequence of VGAM2559 RNA, herein designated VGAM RNA, also designated SEQ ID:5270.

Another function of VGAM2559 is therefore inhibition of KIAA1940 (Accession XM_086981). Accordingly, utilities of VGAM2559 include diagnosis, prevention and treatment of diseases and clinical conditions associated with KIAA1940. MGC11257 (Accession NM_032350) is another VGAM2559 host target gene. MGC11257 BINDING SITE is HOST TARGET binding site found in the 3' untranslated region of mRNA encoded by MGC11257, corresponding to a HOST TARGET binding site such as BINDING SITE I, BINDING SITE II or BINDING SITE III. Table 2 illustrates the complementarity of the nucleotide sequences of MGC11257 BINDING SITE, designated SEQ ID:26139, to the nucleotide sequence of VGAM2559 RNA, herein designated VGAM RNA, also designated SEQ ID:5270.

Another function of VGAM2559 is therefore inhibition of MGC11257 (Accession NM_032350). Accordingly, utilities of VGAM2559 include diagnosis, prevention and treatment of diseases and clinical conditions associated with MGC11257. LOC154739 (Accession XM_098602) is another VGAM2559 host target gene. LOC154739 BINDING SITE is HOST TARGET binding site found in the 5' untranslated region of mRNA encoded by LOC154739, corresponding to a HOST TARGET binding site such as BINDING SITE I, BINDING SITE II or BINDING SITE III. Table 2 illustrates the complementarity of the nucleotide sequences of LOC154739 BINDING SITE, designated SEQ ID:41717, to the nucleotide sequence of VGAM2559 RNA, herein designated VGAM RNA, also designated SEQ ID:5270.

Another function of VGAM2559 is therefore inhibition of LOC154739 (Accession XM_098602). Accordingly, utilities of VGAM2559 include diagnosis, prevention and treatment of diseases and clinical conditions associated with LOC154739. FIG. 1 further provides a conceptual description of a novel bioinformatically detected viral gene of the present invention, referred to here as Viral Genomic Address Messenger 2560 (VGAM2560) viral gene, which modulates expression of respective host target genes thereof, the function and utility of which host target genes is known in the art.

VGAM2560 is a novel bioinformatically detected regulatory, non protein coding, viral micro RNA (miRNA) gene. The method by which VGAM2560 was detected is described hereinabove with reference to FIGS. 1-8.

VGAM2560 gene, herein designated VGAM GENE, is a viral gene contained in the genome of Himetobi P Virus. VGAM2560 host target gene, herein designated VGAM HOST TARGET GENE, is a human gene contained in the human genome.

VGAM2560 gene encodes a VGAM2560 precursor RNA, herein designated VGAM PRECURSOR RNA. Similar to other miRNA genes, and unlike most ordinary genes, VGAM2560 precursor RNA does not encode a protein. A nucleotide sequence identical or highly similar to the nucleotide sequence of VGAM2560 precursor RNA is designated SEQ ID:2546, and is provided hereinbelow with reference to the sequence listing part. Nucleotide sequence SEQ ID:2546 is located at position 8011 relative to the genome of Himetobi P Virus.

VGAM2560 precursor RNA folds onto itself, forming VGAM2560 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2560 folded precursor RNA into VGAM2560 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2560 RNA is designated SEQ ID:5271, and is provided hereinbelow with reference to the sequence listing part.

VGAM2560 host target gene, herein designated VGAM HOST TARGET GENE, encodes a corresponding messenger RNA, VGAM2560 host target RNA, herein designated VGAM HOST TARGET RNA. VGAM2560 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2560 RNA, herein designated VGAM RNA, binds complementarily to one or more host target binding sites located in untranslated regions of VGAM2560 host target RNA, herein designated VGAM HOST TARGET RNA. This complementary binding is due to the fact that the nucleotide sequence of VGAM2560 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2560 RNA, herein designated VGAM RNA, may have a different number of host target binding sites in untranslated regions of a VGAM2560 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2560 RNA, herein designated VGAM RNA, to host target binding sites on VGAM2560 host target RNA, herein designated VGAM HOST TARGET RNA, such as BINDING SITE I, BINDING SITE II and BINDING SITE III, inhibits translation of VGAM2560 host target RNA into VGAM2560 host target protein, herein designated VGAM HOST TARGET PROTEIN. VGAM host target protein is therefore outlined by a broken line.

It is appreciated that VGAM2560 host target gene, herein designated VGAM HOST TARGET GENE, in fact represents a plurality of VGAM2560 host target genes. The mRNA of each one of this plurality of VGAM2560 host target genes comprises one or more host target binding sites, each having a nucleotide sequence which is at least partly complementary to VGAM2560 RNA, herein designated VGAM RNA, and which when bound by VGAM2560 RNA causes inhibition of translation of respective one or more VGAM2560 host target proteins.

It is further appreciated by one skilled in the art that the mode of translational inhibition illustrated by FIG. 1 with specific reference to translational inhibition exerted by VGAM2560 gene, herein designated VGAM GENE, on one or more VGAM2560 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM2560 is inhibition of expression of host target genes, as part of a novel viral mechanism of attacking a host. Accordingly, utilities of VGAM2560 include diagnosis, prevention and treatment of viral infection by Himetobi P Virus. Specific functions, and accordingly utilities, of VGAM2560 correlate with, and may be deduced from, the identity of the host target genes which VGAM2560 binds and inhibits, and the function of these host target genes, as elaborated hereinbelow.

Nucleotide sequences of the VGAM2560 precursor RNA, herein designated VGAM PRECURSOR RNA, and of the 'diced' VGAM2560 RNA, herein designated VGAM RNA, and a schematic representation of the secondary folding of VGAM2560 folded precursor RNA, herein designated VGAM FOLDED PRECURSOR RNA, of VGAM2560 are further described hereinbelow with reference to Table 1.

Nucleotide sequences of host target binding sites, such as BINDING SITE-I, BINDING SITE-II and BINDING SITE-III of FIG. 1, found on VGAM2560 host target RNA, and schematic representation of the complementarity of each of these host target binding sites to VGAM2560 RNA, herein designated VGAM RNA, are described hereinbelow with reference to Table 2.

As mentioned hereinabove with reference to FIG. 1, a function of VGAM2560 gene, herein designated VGAM is inhibition of expression of VGAM2560 target genes. It is appreciated that specific functions, and accordingly utilities, of VGAM2560 correlate with, and may be deduced from, the identity of the target genes which VGAM2560 binds and inhibits, and the function of these target genes, as elaborated hereinbelow.

Hormonally Upregulated Neu-associated Kinase (HUNK, Accession NM_014586) is a VGAM2560 host target gene. HUNK BINDING SITE is HOST TARGET binding site found in the 5' untranslated region of mRNA encoded by HUNK, corresponding to a HOST TARGET binding site such as BINDING SITE I, BINDING SITE II or BINDING SITE III. Table 2 illustrates the complementarity of the nucleotide sequences of HUNK BINDING SITE, designated SEQ ID:15949, to the nucleotide sequence of VGAM2560 RNA, herein designated VGAM RNA, also designated SEQ ID:5271.

A function of VGAM2560 is therefore inhibition of Hormonally Upregulated Neu-associated Kinase (HUNK, Accession NM_014586). Accordingly, utilities of VGAM2560 include diagnosis, prevention and treatment of diseases and clinical conditions associated with HUNK. Interleukin 1, Beta (IL1B, Accession NM_000576) is another VGAM2560 host target gene. IL1B BINDING SITE is HOST TARGET binding site found in the 3' untranslated region of mRNA encoded by IL1B, corresponding to a HOST TARGET binding site such as BINDING SITE I, BINDING SITE II or BINDING SITE III. Table 2 illustrates the complementarity of the nucleotide sequences of IL1B BINDING SITE, designated SEQ ID:6175, to the nucleotide sequence of VGAM2560 RNA, herein designated VGAM RNA, also designated SEQ ID:5271.

Another function of VGAM2560 is therefore inhibition of Interleukin 1, Beta (IL1B, Accession NM_000576), a gene which stimulates thymocyte proliferation. Accordingly, utilities of VGAM2560 include diagnosis, prevention and treatment of diseases and clinical conditions associated with IL1B. The function of IL1B and its association with various diseases and clinical conditions, has been established by previous studies, as described hereinabove with reference to VGAM2007. Mucin 4, Tracheobronchial (MUC4, Accession NM_138298) is another VGAM2560 host target gene. MUC4 BINDING SITE is HOST TARGET binding site found in the 3' untranslated region of mRNA encoded by MUC4, corresponding to a HOST TARGET binding site such as BINDING SITE I, BINDING SITE II or BINDING SITE III. Table 2 illustrates the complementarity of the nucleotide sequences of MUC4 BINDING SITE, designated SEQ ID:28711, to the nucleotide sequence of VGAM2560 RNA, herein designated VGAM RNA, also designated SEQ ID:5271.

Another function of VGAM2560 is therefore inhibition of Mucin 4, Tracheobronchial (MUC4, Accession NM_138298), a gene which may act as a ligand for ErbB2 mediated cell signalling. Accordingly, utilities of VGAM2560 include diagnosis, prevention and treatment of diseases and clinical conditions associated with MUC4. The function of MUC4 and its association with various diseases and clinical conditions, has been established by previous studies, as described hereinabove with reference to VGAM1290. Peripheral Myelin Protein 2 (PMP2, Accession NM_002677) is another VGAM2560 host target gene. PMP2 BINDING SITE is HOST TARGET binding site found in the 3' untranslated region of mRNA encoded by PMP2, corresponding to a HOST TARGET binding site such as BINDING SITE I, BINDING SITE II or BINDING SITE III. Table 2 illustrates the complementarity of the nucleotide sequences of PMP2 BINDING SITE, designated SEQ ID:8545, to the nucleotide sequence of VGAM2560 RNA, herein designated VGAM RNA, also designated SEQ ID:5271.

Another function of VGAM2560 is therefore inhibition of Peripheral Myelin Protein 2 (PMP2, Accession NM_002677), a gene which is a lipid transport protein in schwann cells. Accordingly, utilities of VGAM2560 include diagnosis, prevention and treatment of diseases and clinical conditions associated with PMP2. The function of PMP2 and its association with various diseases and clinical conditions, has been established by previous studies, as described hereinabove with reference to VGAM55. SWAP70 (Accession XM_049197) is another VGAM2560 host target gene. SWAP70 BINDING SITE is HOST TARGET binding site found in the 3' untranslated region of mRNA encoded by SWAP70, corresponding to a HOST TARGET binding site such as BINDING SITE I, BINDING SITE II or BINDING SITE III. Table 2 illustrates the complementarity of the nucleotide sequences of SWAP70 BINDING SITE, designated SEQ ID:35350, to the nucleotide sequence of VGAM2560 RNA, herein designated VGAM RNA, also designated SEQ ID:5271.

Another function of VGAM2560 is therefore inhibition of SWAP70 (Accession XM_049197), a gene which is involved not only in nuclear events but also in signaling in B-cell activation. Accordingly, utilities of VGAM2560 include diagnosis, prevention and treatment of diseases and clinical conditions associated with SWAP70. The function of SWAP70 and its association with various diseases and clinical conditions, has been established by previous studies, as described hereinabove with reference to VGAM1090. Sulfotransferase Family 4A, Member 1 (SULT4A1, Accession XM_043609) is another VGAM2560 host target gene. SULT4A1 BINDING SITE is HOST TARGET binding site found in the 3' untranslated region of mRNA encoded by SULT4A1, corresponding to a HOST TARGET binding site such as BINDING SITE I, BINDING SITE II or BINDING SITE III. Table 2 illustrates the complementarity of the nucleotide sequences of SULT4A1 BINDING SITE, designated SEQ ID:33976, to the nucleotide sequence of VGAM2560 RNA, herein designated VGAM RNA, also designated SEQ ID:5271.

Another function of VGAM2560 is therefore inhibition of Sulfotransferase Family 4A, Member 1 (SULT4A1, Accession XM_043609). Accordingly, utilities of VGAM2560 include diagnosis, prevention and treatment of diseases and clinical conditions associated with SULT4A1. LOC202934 (Accession XM_117486) is another VGAM2560 host target gene. LOC202934 BINDING SITE is HOST TARGET binding site found in the 3' untranslated region of mRNA encoded by LOC202934, corresponding to a HOST TARGET binding site such as BINDING SITE I, BINDING SITE II or BIND- ING SITE III. Table 2 illustrates the complementarity of the nucleotide sequences of LOC202934 BINDING SITE, designated SEQ ID:43463, to the nucleotide sequence of VGAM2560 RNA, herein designated VGAM RNA, also designated SEQ ID:5271.

Another function of VGAM2560 is therefore inhibition of LOC202934 (Accession XM_117486). Accordingly, utilities of VGAM2560 include diagnosis, prevention and treatment of diseases and clinical conditions associated with LOC202934. LOC255465 (Accession XM_173206) is another VGAM2560 host target gene. LOC255465 BINDING SITE is HOST TARGET binding site found in the 3' untranslated region of mRNA encoded by LOC255465, corresponding to a HOST TARGET binding site such as BINDING SITE I, BINDING SITE II or BINDING SITE III. Table 2 illustrates the complementarity of the nucleotide sequences of LOC255465 BINDING SITE, designated SEQ ID:46455, to the nucleotide sequence of VGAM2560 RNA, herein designated VGAM RNA, also designated SEQ ID:5271.

Another function of VGAM2560 is therefore inhibition of LOC255465 (Accession XM_173206). Accordingly, utilities of VGAM2560 include diagnosis, prevention and treatment of diseases and clinical conditions associated with LOC255465. LOC54505 (Accession XM_042110) is another VGAM2560 host target gene. LOC54505 BINDING SITE is HOST TARGET binding site found in the 5' untranslated region of mRNA encoded by LOC54505, corresponding to a HOST TARGET binding site such as BINDING SITE I, BINDING SITE II or BINDING SITE III. Table 2 illustrates the complementarity of the nucleotide sequences of LOC54505 BINDING SITE, designated SEQ ID:33697, to the nucleotide sequence of VGAM2560 RNA, herein designated VGAM RNA, also designated SEQ ID:5271.

Another function of VGAM2560 is therefore inhibition of LOC54505 (Accession XM_042110). Accordingly, utilities of VGAM2560 include diagnosis, prevention and treatment of diseases and clinical conditions associated with LOC54505. FIG. 1 further provides a conceptual description of a novel bioinformatically detected viral gene of the present invention, referred to here as Viral Genomic Address Messenger 2561 (VGAM2561) viral gene, which modulates expression of respective host target genes thereof, the function and utility of which host target genes is known in the art.

VGAM2561 is a novel bioinformatically detected regulatory, non protein coding, viral micro RNA (miRNA) gene. The method by which VGAM2561 was detected is described hereinabove with reference to FIGS. 1-8.

VGAM2561 gene, herein designated VGAM GENE, is a viral gene contained in the genome of Himetobi P Virus. VGAM2561 host target gene, herein designated VGAM HOST TARGET GENE, is a human gene contained in the human genome.

VGAM2561 gene encodes a VGAM2561 precursor RNA, herein designated VGAM PRECURSOR RNA. Similar to other miRNA genes, and unlike most ordinary genes, VGAM2561 precursor RNA does not encode a protein. A nucleotide sequence identical or highly similar to the nucleotide sequence of VGAM2561 precursor RNA is designated SEQ ID:2547, and is provided hereinbelow with reference to the sequence listing part. Nucleotide sequence SEQ ID:2547 is located at position 8473 relative to the genome of Himetobi P Virus.

VGAM2561 precursor RNA folds onto itself, forming VGAM2561 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2561 folded precursor RNA into VGAM2561 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2561 RNA is designated SEQ ID:5272, and is provided hereinbelow with reference to the sequence listing part.

VGAM2561 host target gene, herein designated VGAM HOST TARGET GENE, encodes a corresponding messenger RNA, VGAM2561 host target RNA, herein designated VGAM HOST TARGET RNA. VGAM2561 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2561 RNA, herein designated VGAM RNA, binds complementarily to one or more host target binding sites located in untranslated regions of VGAM2561 host target RNA, herein designated VGAM HOST TARGET RNA. This complementary binding is due to the fact that the nucleotide sequence of VGAM2561 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2561 RNA, herein designated VGAM RNA, may have a different number of host target binding sites in untranslated regions of a VGAM2561 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2561 RNA, herein designated VGAM RNA, to host target binding sites on VGAM2561 host target RNA, herein designated VGAM HOST TARGET RNA, such as BINDING SITE I, BINDING SITE II and BINDING SITE III, inhibits translation of VGAM2561 host target RNA into VGAM2561 host target protein, herein designated VGAM HOST TARGET PROTEIN. VGAM host target protein is therefore outlined by a broken line.

It is appreciated that VGAM2561 host target gene, herein designated VGAM HOST TARGET GENE, in fact represents a plurality of VGAM2561 host target genes. The mRNA of each one of this plurality of VGAM2561 host target genes comprises one or more host target binding sites, each having a nucleotide sequence which is at least partly complementary to VGAM2561 RNA, herein designated VGAM RNA, and which when bound by VGAM2561 RNA causes inhibition of translation of respective one or more VGAM2561 host target proteins.

It is further appreciated by one skilled in the art that the mode of translational inhibition illustrated by FIG. 1 with specific reference to translational inhibition exerted by VGAM2561 gene, herein designated VGAM GENE, on one or more VGAM2561 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2561 is inhibition of expression of host target genes, as part of a novel viral mechanism of attacking a host. Accordingly, utilities of VGAM2561 include diagnosis, prevention and treatment of viral infection by Himetobi P Virus. Specific functions, and accordingly utilities, of VGAM2561 correlate with, and may be deduced from, the identity of the host target genes which VGAM2561 binds and inhibits, and the function of these host target genes, as elaborated hereinbelow.

Nucleotide sequences of the VGAM2561 precursor RNA, herein designated VGAM PRECURSOR RNA, and of the 'diced' VGAM2561 RNA, herein designated VGAM RNA, and a schematic representation of the secondary folding of VGAM2561 folded precursor RNA, herein designated VGAM FOLDED PRECURSOR RNA, of VGAM2561 are further described hereinbelow with reference to Table 1.

Nucleotide sequences of host target binding sites, such as BINDING SITE-I, BINDING SITE-II and BINDING SITE-III of FIG. 1, found on VGAM2561 host target RNA, and schematic representation of the complementarity of each of these host target binding sites to VGAM2561 RNA, herein designated VGAM RNA, are described hereinbelow with reference to Table 2.

As mentioned hereinabove with reference to FIG. 1, a function of VGAM2561 gene, herein designated VGAM is inhibition of expression of VGAM2561 target genes. It is appreciated that specific functions, and accordingly utilities, of VGAM2561 correlate with, and may be deduced from, the identity of the target genes which VGAM2561 binds and inhibits, and the function of these target genes, as elaborated hereinbelow.

Myotubular Myopathy 1 (MTM1, Accession NM_000252) is a VGAM2561 host target gene. MTM1 BINDING SITE is HOST TARGET binding site found in the 3' untranslated region of mRNA encoded by MTM1, corresponding to a HOST TARGET binding site such as BINDING SITE I, BINDING SITE II or BINDING SITE III. Table 2 illustrates the complementarity of the nucleotide sequences of MTM1 BINDING SITE, designated SEQ ID:5791, to the nucleotide sequence of VGAM2561 RNA, herein designated VGAM RNA, also designated SEQ ID:5272.

A function of VGAM2561 is therefore inhibition of Myotubular Myopathy 1 (MTM1, Accession NM_000252). Accordingly, utilities of VGAM2561 include diagnosis, prevention and treatment of diseases and clinical conditions associated with MTM1. Reversion-inducing-cysteine-rich Protein with Kazal Motifs (RECK, Accession NM_021111) is another VGAM2561 host target gene. RECK BINDING SITE is HOST TARGET binding site found in the 3" untranslated region of mRNA encoded by RECK, corresponding to a HOST TARGET binding site such as BINDING SITE I, BINDING SITE II or BINDING SITE III. Table 2 illustrates the complementarity of the nucleotide sequences of RECK BINDING SITE, designated SEQ ID:22091, to the nucleotide sequence of VGAM2561 RNA, herein designated VGAM RNA, also designated SEQ ID:5272.

Another function of VGAM2561 is therefore inhibition of Reversion-inducing-cysteine-rich Protein with Kazal Motifs (RECK, Accession NM_021111), a gene which plays a role in regulation of cancer progression and tumor angiogenesis. Accordingly, utilities of VGAM2561 include diagnosis, prevention and treatment of diseases and clinical conditions associated with RECK. The function of RECK and its association with various diseases and clinical conditions, has been established by previous studies, as described hereinabove with reference to VGAM75. KIAA1915 (Accession XM_055481) is another VGAM2561 host target gene. KIAA1915 BINDING SITE is HOST TARGET binding site found in the 5' untranslated region of mRNA encoded by KIAA1915, corresponding to a HOST TARGET binding site such as BINDING SITE I, BINDING SITE II or BINDING SITE III. Table 2 illustrates the complementarity of the nucleotide sequences of KIAA1915 BINDING SITE, designated SEQ ID:36270, to the nucleotide sequence of VGAM2561 RNA, herein designated VGAM RNA, also designated SEQ ID:5272.

Another function of VGAM2561 is therefore inhibition of KIAA1915 (Accession XM_055481). Accordingly, utilities of VGAM2561 include diagnosis, prevention and treatment of diseases and clinical conditions associated with KIAA1915. PRO1617 (Accession NM_018587) is another VGAM2561 host target gene. PRO1617 BINDING SITE is HOST TARGET binding site found in the 5' untranslated region of mRNA encoded by PRO1617, corresponding to a HOST TARGET binding site such as BINDING SITE I, BINDING SITE II or BINDING SITE III. Table 2 illustrates the complementarity of the nucleotide sequences of PRO1617 BINDING SITE, designated SEQ ID:20664, to the nucleotide sequence of VGAM2561 RNA, herein designated VGAM RNA, also designated SEQ ID:5272.

Another function of VGAM2561 is therefore inhibition of PRO1617 (Accession NM_018587). Accordingly, utilities of VGAM2561 include diagnosis, prevention and treatment of diseases and clinical conditions associated with PRO1617. SE70-2 (Accession NM_022118) is another VGAM2561 host target gene. SE70-2 BINDING SITE is HOST TARGET binding site found in the 3' untranslated region of mRNA encoded by SE70-2, corresponding to a HOST TARGET binding site such as BINDING SITE I, BINDING SITE II or BINDING SITE III. Table 2 illustrates the complementarity of the nucleotide sequences of SE70-2 BINDING SITE, designated SEQ ID:22664, to the nucleotide sequence of VGAM2561 RNA, herein designated VGAM RNA, also designated SEQ ID:5272.

Another function of VGAM2561 is therefore inhibition of SE70-2 (Accession NM_022118). Accordingly, utilities of VGAM2561 include diagnosis, prevention and treatment of diseases and clinical conditions associated with SE70-2. Solute Carrier Family 26, Member 10 (SLC26A10, Accession NM_133489) is another VGAM2561 host target gene. SLC26A10 BINDING SITE is HOST TARGET binding site found in the 5' untranslated region of mRNA encoded by SLC26A10, corresponding to a HOST TARGET binding site such as BINDING SITE I, BINDING SITE II or BINDING SITE III. Table 2 illustrates the complementarity of the nucleotide sequences of SLC26A10 BINDING SITE, designated SEQ ID:28561, to the nucleotide sequence of VGAM2561 RNA, herein designated VGAM RNA, also designated SEQ ID:5272.

Another function of VGAM2561 is therefore inhibition of Solute Carrier Family 26, Member 10 (SLC26A10, Accession NM_133489). Accordingly, utilities of VGAM2561 include diagnosis, prevention and treatment of diseases and clinical conditions associated with SLC26A10. LOC157273 (Accession XM_098743) is another VGAM2561 host target gene. LOC157273 BINDING SITE is HOST TARGET binding site found in the 3' untranslated region of mRNA encoded by LOC157273, corresponding to a HOST TARGET binding site such as BINDING SITE I, BINDING SITE II or BINDING SITE III. Table 2 illustrates the complementarity of the nucleotide sequences of LOC157273 BINDING SITE, designated SEQ ID:41787, to the nucleotide sequence of VGAM2561 RNA, herein designated VGAM RNA, also designated SEQ ID:5272.

Another function of VGAM2561 is therefore inhibition of LOC157273 (Accession XM_098743). Accordingly, utilities of VGAM2561 include diagnosis, prevention and treatment of diseases and clinical conditions associated with LOC157273. FIG. 1 further provides a conceptual description of a novel bioinformatically detected viral gene of the present invention, referred to here as Viral Genomic Address Messenger 2562 (VGAM2562) viral gene, which modulates expression of respective host target genes thereof, the function and utility of which host target genes is known in the art.

VGAM2562 is a novel bioinformatically detected regulatory, non protein coding, viral micro RNA (miRNA) gene. The method by which VGAM2562 was detected is described hereinabove with reference to FIGS. 1-8.

VGAM2562 gene, herein designated VGAM GENE, is a viral gene contained in the genome of Himetobi P Virus. VGAM2562 host target gene, herein designated VGAM HOST TARGET GENE, is a human gene contained in the human genome.

VGAM2562 gene encodes a VGAM2562 precursor RNA, herein designated VGAM PRECURSOR RNA. Similar to other miRNA genes, and unlike most ordinary genes, VGAM2562 precursor RNA does not encode a protein. A nucleotide sequence identical or highly similar to the nucleotide sequence of VGAM2562 precursor RNA is designated SEQ ID:2548, and is provided hereinbelow with reference to the sequence listing part. Nucleotide sequence SEQ ID:2548 is located at position 7594 relative to the genome of Himetobi P Virus.

VGAM2562 precursor RNA folds onto itself, forming VGAM2562 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2562 folded precursor RNA into VGAM2562 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2562 RNA is designated SEQ ID:5273, and is provided hereinbelow with reference to the sequence listing part.

VGAM2562 host target gene, herein designated VGAM HOST TARGET GENE, encodes a corresponding messenger RNA, VGAM2562 host target RNA, herein designated VGAM HOST TARGET RNA. VGAM2562 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2562 RNA, herein designated VGAM RNA, binds complementarily to one or more host target binding sites located in untranslated regions of VGAM2562 host target RNA, herein designated VGAM HOST TARGET RNA. This complementary binding is due to the fact that the nucleotide sequence of VGAM2562 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2562 RNA, herein designated VGAM RNA, may have a different number of host target binding sites in untranslated regions of a VGAM2562 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2562 RNA, herein designated VGAM RNA, to host target binding sites on VGAM2562 host target RNA, herein designated VGAM HOST TARGET RNA, such as BINDING SITE I, BINDING SITE II and BINDING SITE III, inhibits translation of VGAM2562 host target RNA into VGAM2562 host target protein, herein designated VGAM HOST TARGET PROTEIN. VGAM host target protein is therefore outlined by a broken line.

It is appreciated that VGAM2562 host target gene, herein designated VGAM HOST TARGET GENE, in fact represents a plurality of VGAM2562 host target genes. The mRNA of each one of this plurality of VGAM2562 host target genes comprises one or more host target binding sites, each having a nucleotide sequence which is at least partly complementary to VGAM2562 RNA, herein designated VGAM RNA, and which when bound by VGAM2562 RNA causes inhibition of translation of respective one or more VGAM2562 host target proteins.

It is further appreciated by one skilled in the art that the mode of translational inhibition illustrated by FIG. 1 with specific reference to translational inhibition exerted by VGAM2562 gene, herein designated VGAM GENE, on one or more VGAM2562 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2562 is inhibition of expression of host target genes, as part of a novel viral mechanism of attacking a host. Accordingly, utilities of VGAM2562 include diagnosis, prevention and treatment of viral infection by Himetobi P Virus. Specific functions, and accordingly utilities, of VGAM2562 correlate with, and may be deduced from, the identity of the host target genes which VGAM2562 binds and inhibits, and the function of these host target genes, as elaborated hereinbelow.

Nucleotide sequences of the VGAM2562 precursor RNA, herein designated VGAM PRECURSOR RNA, and of the 'diced' VGAM2562 RNA, herein designated VGAM RNA, and a schematic representation of the secondary folding of VGAM2562 folded precursor RNA, herein designated VGAM FOLDED PRECURSOR RNA, of VGAM2562 are further described hereinbelow with reference to Table 1.

Nucleotide sequences of host target binding sites, such as BINDING SITE-I, BINDING SITE-II and BINDING SITE-III of FIG. 1, found on VGAM2562 host target RNA, and schematic representation of the complementarity of each of these host target binding sites to VGAM2562 RNA, herein designated VGAM RNA, are described hereinbelow with reference to Table 2.

As mentioned hereinabove with reference to FIG. 1, a function of VGAM2562 gene, herein designated VGAM is inhibition of expression of VGAM2562 target genes. It is appreciated that specific functions, and accordingly utilities, of VGAM2562 correlate with, and may be deduced from, the identity of the target genes which VGAM2562 binds and inhibits, and the function of these target genes, as elaborated hereinbelow.

AS3 (Accession NM_015928) is a VGAM2562 host target gene. AS3 BINDING SITE is HOST TARGET binding site found in the 3' untranslated region of mRNA encoded by AS3, corresponding to a HOST TARGET binding site such as BINDING SITE I, BINDING SITE II or BINDING SITE III. Table 2 illustrates the complementarity of the nucleotide sequences of AS3 BINDING SITE, designated SEQ ID:18050, to the nucleotide sequence of VGAM2562 RNA, herein designated VGAM RNA, also designated SEQ ID:5273.

A function of VGAM2562 is therefore inhibition of AS3 (Accession NM_015928), a gene which inhibits cell proloferation. Accordingly, utilities of VGAM2562 include diagnosis, prevention and treatment of diseases and clinical conditions associated with AS3. The function of AS3 and its association with various diseases and clinical conditions, has been established by previous studies, as described hereinabove with reference to VGAM393. CD164 Antigen, Sialomucin (CD164, Accession NM_006016) is another VGAM2562 host target gene. CD164 BINDING SITE is HOST TARGET binding site found in the 3' untranslated region of mRNA encoded by CD164, corresponding to a HOST TARGET binding site such as BINDING SITE I, BINDING SITE II or BINDING SITE III. Table 2 illustrates the complementarity of the nucleotide sequences of CD164 BINDING SITE, designated SEQ ID:12630, to the nucleotide sequence of VGAM2562 RNA, herein designated VGAM RNA, also designated SEQ ID:5273.

Another function of VGAM2562 is therefore inhibition of CD164 Antigen, Sialomucin (CD164, Accession NM_006016), a gene which plays a role in hematopoiesis by facilitating the adhesion of CD34+ cells to bone marrow stroma and negatively regulates CD34+ hematopoietic progenitor cell growth. Accordingly, utilities of VGAM2562 include diagnosis, prevention and treatment of diseases and clinical conditions associated with CD164. The function of CD164 and its association with various diseases and clinical conditions, has been established by previous studies, as described hereinabove with reference to VGAM75. Cytosolic Ovarian Carcinoma Antigen 1 (COVA1, Accession XM_055323) is another VGAM2562 host target gene. COVA1 BINDING SITE is HOST TARGET binding site found in the 3' untranslated region of mRNA encoded by COVA1, corresponding to a HOST TARGET binding site such as BINDING SITE I, BINDING SITE II or BINDING SITE III. Table 2 illustrates the complementarity of the nucleotide sequences of COVA1 BINDING SITE, designated SEQ ID:36265, to the nucleotide sequence of VGAM2562 RNA, herein designated VGAM RNA, also designated SEQ ID:5273.

Another function of VGAM2562 is therefore inhibition of Cytosolic Ovarian Carcinoma Antigen 1 (COVA1, Accession XM_055323). Accordingly, utilities of VGAM2562 include diagnosis, prevention and treatment of diseases and clinical conditions associated with COVA1. FLJ11273 (Accession NM_018374) is another VGAM2562 host target gene. FLJ11273 BINDING SITE is HOST TARGET binding site found in the 3' untranslated region of mRNA encoded by FLJ11273, corresponding to a HOST TARGET binding site such as BINDING SITE I, BINDING SITE II or BINDING SITE III. Table 2 illustrates the complementarity of the nucleotide sequences of FLJ11273 BINDING SITE, designated SEQ ID:20392, to the nucleotide sequence of VGAM2562 RNA, herein designated VGAM RNA, also designated SEQ ID:5273.

Another function of VGAM2562 is therefore inhibition of FLJ11273 (Accession NM_018374). Accordingly, utilities of VGAM2562 include diagnosis, prevention and treatment of diseases and clinical conditions associated with FLJ11273. KIAA0092 (Accession NM_014679) is another VGAM2562 host target gene. KIAA0092 BINDING SITE is HOST TARGET binding site found in the 3' untranslated region of mRNA encoded by KIAA0092, corresponding to a HOST TARGET binding site such as BINDING SITE I, BINDING SITE II or BINDING SITE III. Table 2 illustrates the complementarity of the nucleotide sequences of KIAA0092 BINDING SITE, designated SEQ ID:16152, to the nucleotide sequence of VGAM2562 RNA, herein designated VGAM RNA, also designated SEQ ID:5273.

Another function of VGAM2562 is therefore inhibition of KIAA0092 (Accession NM_014679). Accordingly, utilities of VGAM2562 include diagnosis, prevention and treatment of diseases and clinical conditions associated with KIAA0092. LIN-28 (Accession NM_024674) is another VGAM2562 host target gene. LIN-28 BINDING SITE is HOST TARGET binding site found in the 3' untranslated region of mRNA encoded by LIN-28, corresponding to a HOST TARGET binding site such as BINDING SITE I, BINDING SITE II or BINDING SITE III. Table 2 illustrates the complementarity of the nucleotide sequences of LIN-28 BINDING SITE, designated SEQ ID:23978, to the nucleotide sequence of VGAM2562 RNA, herein designated VGAM RNA, also designated SEQ ID:5273.

Another function of VGAM2562 is therefore inhibition of LIN-28 (Accession NM_024674). Accordingly, utilities of VGAM2562 include diagnosis, prevention and treatment of diseases and clinical conditions associated with LIN-28. Nudix (nucleoside diphosphate linked moiety X)-type Motif 12 (NUDT12, Accession NM_031438) is another VGAM2562 host target gene. NUDT12 BINDING SITE is HOST TARGET binding site found in the 3' untranslated region of mRNA encoded by NUDT12, corresponding to a HOST TARGET binding site such as BINDING SITE I, BINDING SITE II or BINDING SITE III. Table 2 illustrates the complementarity of the nucleotide sequences of NUDT12 BINDING SITE, designated SEQ ID:25448, to the nucleotide sequence of VGAM2562 RNA, herein designated VGAM RNA, also designated SEQ ID:5273.

Another function of VGAM2562 is therefore inhibition of Nudix (nucleoside diphosphate linked moiety X)-type Motif 12 (NUDT12, Accession NM_031438). Accordingly, utilities of VGAM2562 include diagnosis, prevention and treatment of diseases and clinical conditions associated with NUDT12.

FIG. 1 further provides a conceptual description of a novel bioinformatically detected viral gene of the present invention, referred to here as Viral Genomic Address Messenger 2563 (VGAM2563) viral gene, which modulates expression of respective host target genes thereof, the function and utility of which host target genes is known in the art.

VGAM2563 is a novel bioinformatically detected regulatory, non protein coding, viral micro RNA (miRNA) gene. The method by which VGAM2563 was detected is described hereinabove with reference to FIGS. 1-8.

VGAM2563 gene, herein designated VGAM GENE, is a viral gene contained in the genome of Himetobi P Virus. VGAM2563 host target gene, herein designated VGAM HOST TARGET GENE, is a human gene contained in the human genome.

VGAM2563 gene encodes a VGAM2563 precursor RNA, herein designated VGAM PRECURSOR RNA. Similar to other miRNA genes, and unlike most ordinary genes, VGAM2563 precursor RNA does not encode a protein. A nucleotide sequence identical or highly similar to the nucleotide sequence of VGAM2563 precursor RNA is designated SEQ ID:2549, and is provided hereinbelow with reference to the sequence listing part. Nucleotide sequence SEQ ID:2549 is located at position 8878 relative to the genome of Himetobi P Virus.

VGAM2563 precursor RNA folds onto itself, forming VGAM2563 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2563 folded precursor RNA into VGAM2563 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2563 RNA is designated SEQ ID:5274, and is provided hereinbelow with reference to the sequence listing part.

VGAM2563 host target gene, herein designated VGAM HOST TARGET GENE, encodes a corresponding messenger RNA, VGAM2563 host target RNA, herein designated VGAM HOST TARGET RNA. VGAM2563 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2563 RNA, herein designated VGAM RNA, binds complementarily to one or more host target binding sites located in untranslated regions of VGAM2563 host target RNA, herein designated VGAM HOST TARGET RNA. This complementary binding is due to the fact that the nucleotide sequence of VGAM2563 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2563 RNA, herein designated VGAM RNA, may have a different number of host target binding sites in untranslated regions of a VGAM2563 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2563 RNA, herein designated VGAM RNA, to host target binding sites on VGAM2563 host target RNA, herein designated VGAM HOST TARGET RNA, such as BINDING SITE I, BINDING SITE II and BINDING SITE III, inhibits translation of VGAM2563 host target RNA into VGAM2563 host target protein, herein designated VGAM HOST TARGET PROTEIN. VGAM host target protein is therefore outlined by a broken line.

It is appreciated that VGAM2563 host target gene, herein designated VGAM HOST TARGET GENE, in fact represents a plurality of VGAM2563 host target genes. The mRNA of each one of this plurality of VGAM2563 host target genes comprises one or more host target binding sites, each having a nucleotide sequence which is at least partly complementary to VGAM2563 RNA, herein designated VGAM RNA, and which when bound by VGAM2563 RNA causes inhibition of translation of respective one or more VGAM2563 host target proteins.

It is further appreciated by one skilled in the art that the mode of translational inhibition illustrated by FIG. 1 with specific reference to translational inhibition exerted by VGAM2563 gene, herein designated VGAM GENE, on one or more VGAM2563 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2563 is inhibition of expression of host target genes, as part of a novel viral mechanism of attacking a host. Accordingly, utilities of VGAM2563 include diagnosis, prevention and treatment of viral infection by Himetobi P Virus. Specific functions, and accordingly utilities, of VGAM2563 correlate with, and may be deduced from, the identity of the host target genes which VGAM2563 binds and inhibits, and the function of these host target genes, as elaborated hereinbelow.

Nucleotide sequences of the VGAM2563 precursor RNA, herein designated VGAM PRECURSOR RNA, and of the 'diced' VGAM2563 RNA, herein designated VGAM RNA, and a schematic representation of the secondary folding of VGAM2563 folded precursor RNA, herein designated VGAM FOLDED PRECURSOR RNA, of VGAM2563 are further described hereinbelow with reference to Table 1.

Nucleotide sequences of host target binding sites, such as BINDING SITE-I, BINDING SITE-II and BINDING SITE-III of FIG. 1, found on VGAM2563 host target RNA, and schematic representation of the complementarity of each of these host target binding sites to VGAM2563 RNA, herein designated VGAM RNA, are described hereinbelow with reference to Table 2.

As mentioned hereinabove with reference to FIG. 1, a function of VGAM2563 gene, herein designated VGAM is inhibition of expression of VGAM2563 target genes. It is appreciated that specific functions, and accordingly utilities, of VGAM2563 correlate with, and may be deduced from, the identity of the target genes which VGAM2563 binds and inhibits, and the function of these target genes, as elaborated hereinbelow.

LOC222484 (Accession XM_169424) is a VGAM2563 host target gene. LOC222484 BINDING SITE is HOST TARGET binding site found in the 3' untranslated region of mRNA encoded by LOC222484, corresponding to a HOST TARGET binding site such as BINDING SITE I, BINDING SITE II or BINDING SITE III. Table 2 illustrates the complementarity of the nucleotide sequences of LOC222484 BINDING SITE, designated SEQ ID:45297, to the nucleotide sequence of VGAM2563 RNA, herein designated VGAM RNA, also designated SEQ ID:5274.

A function of VGAM2563 is therefore inhibition of LOC222484 (Accession XM_169424). Accordingly, utilities of VGAM2563 include diagnosis, prevention and treatment of diseases and clinical conditions associated with LOC222484. FIG. 1 further provides a conceptual description of a novel bioinformatically detected viral gene of the present invention, referred to here as Viral Genomic Address Messenger 2564 (VGAM2564) viral gene, which modulates expression of respective host target genes thereof, the function and utility of which host target genes is known in the art.

VGAM2564 is a novel bioinformatically detected regulatory, non protein coding, viral micro RNA (miRNA) gene. The method by which VGAM2564 was detected is described hereinabove with reference to FIGS. 1-8.

VGAM2564 gene, herein designated VGAM GENE, is a viral gene contained in the genome of Triatoma Virus. VGAM2564 host target gene, herein designated VGAM HOST TARGET GENE, is a human gene contained in the human genome.

VGAM2564 gene encodes a VGAM2564 precursor RNA, herein designated VGAM PRECURSOR RNA. Similar to other miRNA genes, and unlike most ordinary genes, VGAM2564 precursor RNA does not encode a protein. A nucleotide sequence identical or highly similar to the nucleotide sequence of VGAM2564 precursor RNA is designated SEQ ID:2550, and is provided hereinbelow with reference to the sequence listing part. Nucleotide sequence SEQ ID:2550 is located at position 3567 relative to the genome of Triatoma Virus.

VGAM2564 precursor RNA folds onto itself, forming VGAM2564 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2564 folded precursor RNA into VGAM2564 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 40%) nucleotide sequence of VGAM2564 RNA is designated SEQ ID:5275, and is provided hereinbelow with reference to the sequence listing part.

VGAM2564 host target gene, herein designated VGAM HOST TARGET GENE, encodes a corresponding messenger RNA, VGAM2564 host target RNA, herein designated VGAM HOST TARGET RNA. VGAM2564 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2564 RNA, herein designated VGAM RNA, binds complementarily to one or more host target binding sites located in untranslated regions of VGAM2564 host target RNA, herein designated VGAM HOST TARGET RNA. This complementary binding is due to the fact that the nucleotide sequence of VGAM2564 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2564 RNA, herein designated VGAM RNA, may have a different number of host target binding sites in untranslated regions of a VGAM2564 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2564 RNA, herein designated VGAM RNA, to host target binding sites on VGAM2564 host target RNA, herein designated VGAM HOST TARGET RNA, such as BINDING SITE I, BINDING SITE II and BINDING SITE III, inhibits translation of VGAM2564 host target RNA into VGAM2564 host target protein, herein designated VGAM HOST TARGET PROTEIN. VGAM host target protein is therefore outlined by a broken line.

It is appreciated that VGAM2564 host target gene, herein designated VGAM HOST TARGET GENE, in fact represents a plurality of VGAM2564 host target genes. The mRNA of each one of this plurality of VGAM2564 host target genes comprises one or more host target binding sites, each having a nucleotide sequence which is at least partly complementary to VGAM2564 RNA, herein designated VGAM RNA, and which when bound by VGAM2564 RNA causes inhibition of translation of respective one or more VGAM2564 host target proteins.

It is further appreciated by one skilled in the art that the mode of translational inhibition illustrated by FIG. 1 with specific reference to translational inhibition exerted by VGAM2564 gene, herein designated VGAM GENE, on one or more VGAM2564 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM2564 is inhibition of expression of host target genes, as part of a novel viral mechanism of attacking a host. Accordingly, utilities of VGAM2564 include diagnosis, prevention and treatment of viral infection by Triatoma Virus. Specific functions, and accordingly utilities, of VGAM2564 correlate with, and may be deduced from, the identity of the host target genes which VGAM2564 binds and inhibits, and the function of these host target genes, as elaborated hereinbelow.

Nucleotide sequences of the VGAM2564 precursor RNA, herein designated VGAM PRECURSOR RNA, and of the 'diced' VGAM2564 RNA, herein designated VGAM RNA, and a schematic representation of the secondary folding of VGAM2564 folded precursor RNA, herein designated VGAM FOLDED PRECURSOR RNA, of VGAM2564 are further described hereinbelow with reference to Table 1.

Nucleotide sequences of host target binding sites, such as BINDING SITE-I, BINDING SITE-II and BINDING SITE-III of FIG. 1, found on VGAM2564 host target RNA, and schematic representation of the complementarity of each of these host target binding sites to VGAM2564 RNA, herein designated VGAM RNA, are described hereinbelow with reference to Table 2.

As mentioned hereinabove with reference to FIG. 1, a function of VGAM2564 gene, herein designated VGAM is inhibition of expression of VGAM2564 target genes. It is appreciated that specific functions, and accordingly utilities, of VGAM2564 correlate with, and may be deduced from, the identity of the target genes which VGAM2564 binds and inhibits, and the function of these target genes, as elaborated hereinbelow.

Active BCR-related Gene (ABR, Accession NM_001092) is a VGAM2564 host target gene. ABR BINDING SITE1 and ABR BINDING SITE2 are HOST TARGET binding sites found in untranslated regions of mRNA encoded by ABR, corresponding to HOST TARGET binding sites such as BINDING SITE I, BINDING SITE II or BINDING SITE III. Table 2 illustrates the complementarity of the nucleotide sequences of ABR BINDING SITE1 and ABR BINDING SITE2, designated SEQ ID:6749 and SEQ ID:22494 respectively, to the nucleotide sequence of VGAM2564 RNA, herein designated VGAM RNA, also designated SEQ ID:5275.

A function of VGAM2564 is therefore inhibition of Active BCR-related Gene (ABR, Accession NM_001092), a gene which gtpase-activating protein for rac and cdc42. Accordingly, utilities of VGAM2564 include diagnosis, prevention and treatment of diseases and clinical conditions associated with ABR. The function of ABR and its association with various diseases and clinical conditions, has been established by previous studies, as described hereinabove with reference to VGAM489. Profilin 2 (PFN2, Accession NM_002628) is another VGAM2564 host target gene. PFN2 BINDING SITE1 and PFN2 BINDING SITE2 are HOST TARGET binding sites found in untranslated regions of mRNA encoded by PFN2, corresponding to HOST TARGET binding sites such as BINDING SITE I, BINDING SITE II or BINDING SITE III. Table 2 illustrates the complementarity of the nucleotide sequences of PFN2 BINDING SITE1 and PFN2 BINDING SITE2, designated SEQ ID:8488 and SEQ ID:27581 respectively, to the nucleotide sequence of VGAM2564 RNA, herein designated VGAM RNA, also designated SEQ ID:5275.

Another function of VGAM2564 is therefore inhibition of Profilin 2 (PFN2, Accession NM_002628). Accordingly, utilities of VGAM2564 include diagnosis, prevention and treatment of diseases and clinical conditions associated with PFN2. DKFZP434P211 (Accession NM_014549) is another VGAM2564 host target gene. DKFZP434P211 BINDING SITE is HOST TARGET binding site found in the 3' untranslated region of mRNA encoded by DKFZP434P211, corresponding to a HOST TARGET binding site such as BINDING SITE I, BINDING SITE II or BINDING SITE III. Table 2 illustrates the complementarity of the nucleotide sequences of DKFZP434P211 BINDING SITE, designated SEQ ID:15870, to the nucleotide sequence of VGAM2564 RNA, herein designated VGAM RNA, also designated SEQ ID:5275.

Another function of VGAM2564 is therefore inhibition of DKFZP434P211 (Accession NM_014549). Accordingly, utilities of VGAM2564 include diagnosis, prevention and treatment of diseases and clinical conditions associated with DKFZP434P211. DKFZP586F1318 (Accession NM_015677) is another VGAM2564 host target gene. DKFZP586F1318 BINDING SITE is HOST TARGET binding site found in the 5' untranslated region of mRNA encoded by DKFZP586F1318, corresponding to a HOST TARGET binding site such as BINDING SITE I, BINDING SITE II or BINDING SITE III. Table 2 illustrates the complementarity of the nucleotide sequences of DKFZP586F1318 BINDING SITE, designated SEQ ID:17904, to the nucleotide sequence of VGAM2564 RNA, herein designated VGAM RNA, also designated SEQ ID:5275.

Another function of VGAM2564 is therefore inhibition of DKFZP586F1318 (Accession NM_015677). Accordingly, utilities of VGAM2564 include diagnosis, prevention and treatment of diseases and clinical conditions associated with DKFZP586F1318. LOC145009 (Accession XM_016472) is another VGAM2564 host target gene. LOC145009 BINDING SITE is HOST TARGET binding site found in the 3' untranslated region of mRNA encoded by LOC145009, corresponding to a HOST TARGET binding site such as BINDING SITE I, BINDING SITE II or BINDING SITE III. Table 2 illustrates the complementarity of the nucleotide sequences of LOC145009 BINDING SITE, designated SEQ ID:30261, to the nucleotide sequence of VGAM2564 RNA, herein designated VGAM RNA, also designated SEQ ID:5275.

Another function of VGAM2564 is therefore inhibition of LOC145009 (Accession XM_016472). Accordingly, utilities of VGAM2564 include diagnosis, prevention and treatment of diseases and clinical conditions associated with LOC145009. LOC150213 (Accession XM_059324) is another VGAM2564 host target gene. LOC150213 BINDING SITE is HOST TARGET binding site found in the 3' untranslated region of mRNA encoded by LOC150213, corresponding to a HOST TARGET binding site such as BINDING SITE I, BINDING SITE II or BINDING SITE III. Table 2 illustrates the complementarity of the nucleotide sequences of LOC150213 BINDING SITE, designated SEQ ID:36961, to the nucleotide sequence of VGAM2564 RNA, herein designated VGAM RNA, also designated SEQ ID:5275.

Another function of VGAM2564 is therefore inhibition of LOC150213 (Accession XM_059324). Accordingly, utilities of VGAM2564 include diagnosis, prevention and treatment of diseases and clinical conditions associated with LOC150213. LOC255027 (Accession XM_170806) is another VGAM2564 host target gene. LOC255027 BINDING SITE is HOST TARGET binding site found in the 3' untranslated region of mRNA encoded by LOC255027, corresponding to a HOST TARGET binding site such as BINDING SITE I, BINDING SITE II or BINDING SITE III. Table 2 illustrates the complementarity of the nucleotide sequences of LOC255027 BINDING SITE, designated SEQ ID:45572, to the nucleotide sequence of VGAM2564 RNA, herein designated VGAM RNA, also designated SEQ ID:5275.

Another function of VGAM2564 is therefore inhibition of LOC255027 (Accession XM_170806). Accordingly, utilities of VGAM2564 include diagnosis, prevention and treatment of diseases and clinical conditions associated with LOC255027. FIG. 1 further provides a conceptual description of a novel bioinformatically detected viral gene of the present invention, referred to here as Viral Genomic Address Messenger 2565 (VGAM2565) viral gene, which modulates expression of respective host target genes thereof, the function and utility of which host target genes is known in the art.

VGAM2565 is a novel bioinformatically detected regulatory, non protein coding, viral micro RNA (miRNA) gene. The method by which VGAM2565 was detected is described hereinabove with reference to FIGS. 1-8.

VGAM2565 gene, herein designated VGAM GENE, is a viral gene contained in the genome of Triatoma Virus. VGAM2565 host target gene, herein designated VGAM HOST TARGET GENE, is a human gene contained in the human genome.

VGAM2565 gene encodes a VGAM2565 precursor RNA, herein designated VGAM PRECURSOR RNA. Similar to other miRNA genes, and unlike most ordinary genes, VGAM2565 precursor RNA does not encode a protein. A nucleotide sequence identical or highly similar to the nucleotide sequence of VGAM2565 precursor RNA is designated SEQ ID:2551, and is provided hereinbelow with reference to the sequence listing part. Nucleotide sequence SEQ ID:2551 is located at position 1775 relative to the genome of Triatoma Virus.

VGAM2565 precursor RNA folds onto itself, forming VGAM2565 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2565 folded precursor RNA into VGAM2565 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2565 RNA is designated SEQ ID:5276, and is provided hereinbelow with reference to the sequence listing part.

VGAM2565 host target gene, herein designated VGAM HOST TARGET GENE, encodes a corresponding messenger RNA, VGAM2565 host target RNA, herein designated VGAM HOST TARGET RNA. VGAM2565 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2565 RNA, herein designated VGAM RNA, binds complementarily to one or more host target binding sites located in untranslated regions of VGAM2565 host target RNA, herein designated VGAM HOST TARGET RNA. This complementary binding is due to the fact that the nucleotide sequence of VGAM2565 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2565 RNA, herein designated VGAM RNA, may have a different number of host target binding sites in untranslated regions of a VGAM2565 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2565 RNA, herein designated VGAM RNA, to host target binding sites on VGAM2565 host target RNA, herein designated VGAM HOST TARGET RNA, such as BINDING SITE I, BINDING SITE II and BINDING SITE III, inhibits translation of VGAM2565 host target RNA into VGAM2565 host target protein, herein designated VGAM HOST TARGET PROTEIN. VGAM host target protein is therefore outlined by a broken line.

It is appreciated that VGAM2565 host target gene, herein designated VGAM HOST TARGET GENE, in fact represents a plurality of VGAM2565 host target genes. The mRNA of each one of this plurality of VGAM2565 host target genes comprises one or more host target binding sites, each having a nucleotide sequence which is at least partly complementary to VGAM2565 RNA, herein designated VGAM RNA, and which when bound by VGAM2565 RNA causes inhibition of translation of respective one or more VGAM2565 host target proteins.

It is further appreciated by one skilled in the art that the mode of translational inhibition illustrated by FIG. 1 with specific reference to translational inhibition exerted by VGAM2565 gene, herein designated VGAM GENE, on one or more VGAM2565 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2565 is inhibition of expression of host target genes, as part of a novel viral mechanism of attacking a host. Accordingly, utilities of VGAM2565 include diagnosis, prevention and treatment of viral infection by Triatoma Virus. Specific functions, and accordingly utilities, of VGAM2565 correlate with, and may be deduced from, the identity of the host target genes which VGAM2565 binds and inhibits, and the function of these host target genes, as elaborated hereinbelow.

Nucleotide sequences of the VGAM2565 precursor RNA, herein designated VGAM PRECURSOR RNA, and of the 'diced' VGAM2565 RNA, herein designated VGAM RNA, and a schematic representation of the secondary folding of VGAM2565 folded precursor RNA, herein designated VGAM FOLDED PRECURSOR RNA, of VGAM2565 are further described hereinbelow with reference to Table 1.

Nucleotide sequences of host target binding sites, such as BINDING SITE-I, BINDING SITE-II and BINDING SITE-III of FIG. 1, found on VGAM2565 host target RNA, and schematic representation of the complementarity of each of these host target binding sites to VGAM2565 RNA, herein designated VGAM RNA, are described hereinbelow with reference to Table 2.

As mentioned hereinabove with reference to FIG. 1, a function of VGAM2565 gene, herein designated VGAM is inhibition of expression of VGAM2565 target genes. It is appreciated that specific functions, and accordingly utilities, of VGAM2565 correlate with, and may be deduced from, the identity of the target genes which VGAM2565 binds and inhibits, and the function of these target genes, as elaborated hereinbelow.

Egl Nine Homolog 1 (C. elegans) (EGLN1, Accession NM_022051) is a VGAM2565 host target gene. EGLN1 BINDING SITE is HOST TARGET binding site found in the 5' untranslated region of mRNA encoded by EGLN1, corresponding to a HOST TARGET binding site such as BINDING SITE I, BINDING SITE II or BINDING SITE III. Table 2 illustrates the complementarity of the nucleotide sequences of EGLN1 BINDING SITE, designated SEQ ID:22578, to the nucleotide sequence of VGAM2565 RNA, herein designated VGAM RNA, also designated SEQ ID:5276.

A function of VGAM2565 is therefore inhibition of Egl Nine Homolog 1 (C. elegans) (EGLN1, Accession NM_022051), a gene which is expressed in the cytoplasm of arterial smooth muscle cells. Accordingly, utilities of VGAM2565 include diagnosis, prevention and treatment of diseases and clinical conditions associated with EGLN1. The function of EGLN1 and its association with various diseases and clinical conditions, has been established by previous studies, as described hereinabove with reference to VGAM216. Lysosomal-associated Membrane Protein 1 (LAMP1, Accession NM_005561) is another VGAM2565 host target gene. LAMP1 BINDING SITE is HOST TARGET binding site found in the 3' untranslated region of mRNA encoded by LAMP1, corresponding to a HOST TARGET binding site such as BINDING SITE I, BINDING SITE II or BINDING SITE III. Table 2 illustrates the complementarity of the nucleotide sequences of LAMP1 BINDING SITE, designated SEQ ID:12089, to the nucleotide sequence of VGAM2565 RNA, herein designated VGAM RNA, also designated SEQ ID:5276.

Another function of VGAM2565 is therefore inhibition of Lysosomal-associated Membrane Protein 1 (LAMP1, Accession NM_005561), a gene which presents carbohydrate ligands to selectins. Accordingly, utilities of VGAM2565 include diagnosis, prevention and treatment of diseases and clinical conditions associated with LAMP1. The function of LAMP1 has been established by previous studies. The 120-kD lysosomal membrane glycoprotein is an acidic, heavily glycosylated membrane protein enriched in the lysosomal membrane. By using an oligonucleotide probe corresponding to the amino terminus of rat lgp120, Howe et al. (1988) isolated and characterized cDNA clones containing the entire coding region. The deduced amino acid sequence demonstrated that the rat LGp120 contains a putative signal peptide, 18 sites for N-linked glycosylation, a single membrane-spanning segment, and a short (11 amino acid) cytosolic tail. LGP120 showed similarity to 2 other lysosomal membrane proteins and showed a high degree of conservation in domain organization and primary structure with the proteins in other species. Viitala et al. (1988) reported the complete amino acid sequence for the human lysosome-associated membrane glycoprotein with M(r) about 120,000. The amino acid sequence, which was deduced from analysis of the cDNA, contains 385 amino acid residues. By means of in situ hybridization, Mattei et al. (1990) assigned the LAMP1 gene to 13q34. A related gene, which may be a pseudogene, mapped to 12p13.3. The hybridization of LAMP1 cDNA to 12p13.3 was observed even when probes representing different portions of the LAMP1 cDNA were used. Although LAMP1 contains a functional hinge region, it has a disulfide arrangement different from that observed in members of the immunoglobulin superfamily and thus may represent a new family of membrane glycoproteins. The amino acid sequence of LAMP1 is more homologous to corresponding molecules from other species than it is to LAMP2 (OMIM Ref. No. 309060). Furthermore, LAMP1 and LAMP2 are immunologically distinguishable from each other. Thus it was proposed that LAMP1 and LAMP2 diverged relatively early in evolution but that LAMP1 (and possibly LAMP2) structures have been strongly conserved. Using Southern hybridization in hamster/human hybrid cell panels, Schleutker et al. (1991) confirmed the assignment of the LAMP1 gene to chromosome 13. Furthermore, Schleutker et al. (1991) demonstrated absence of genetic linkage of either LAMP1 or LAMP2 with Salla disease (OMIM Ref. No. 604369), a condition in which defective function of a lysosomal membrane transporter protein is the probable cause of accumulation of sialic acid in lysosomes. Bermingham et al. (1996) demonstrated that the Lamp1 gene is located on mouse chromosome 8. They could find no evidence that it is the site of the mutation in mnd (motorneuron degeneration) mice.

Full details of the abovementioned studies are described in the following publications, the disclosure of which are hereby incorporated by reference:

Bermingham, N. A.; Martin, J. E.; Fisher, E. M. C.: The mouse lysosomal membrane protein 1 gene as a candidate for the motorneuron degeneration (mnd) locus. Genomics 32:266-271, 1996; and Howe, C. L.; Granger, B. L.; Hull, M.; Green, S. A.; Gabel, C. A.; Helenius, A.; Mellman, I.: Derived protein sequence, oligosaccharides, and membrane insertion of the 120-kDa lysosomal.

Further studies establishing the function and utilities of LAMP1 are found in John Hopkins OMIM database record ID 153330, and in sited publications numbered 2951-2955 listed in the bibliography section hereinbelow, which are also hereby incorporated by reference. Leukemia Inhibitory Factor (cholinergic differentiation factor) (LIF, Accession NM_002309) is another VGAM2565 host target gene. LIF BINDING SITE is HOST TARGET binding site found in the 3' untranslated region of mRNA encoded by LIF, corresponding to a HOST TARGET binding site such as BINDING SITE I, BINDING SITE II or BINDING SITE III. Table 2 illustrates the complementarity of the nucleotide sequences of LIF BINDING SITE, designated SEQ ID:8093, to the nucleotide sequence of VGAM2565 RNA, herein designated VGAM RNA, also designated SEQ ID:5276.

Another function of VGAM2565 is therefore inhibition of Leukemia Inhibitory Factor (cholinergic differentiation factor) (LIF, Accession NM_002309). Accordingly, utilities of VGAM2565 include diagnosis, prevention and treatment of diseases and clinical conditions associated with LIF. SET Translocation (myeloid leukemia-associated) (SET, Accession NM_003011) is another VGAM2565 host target gene. SET BINDING SITE is HOST TARGET binding site found in the 3' untranslated region of mRNA encoded by SET, corresponding to a HOST TARGET binding site such as BINDING SITE I, BINDING SITE II or BINDING SITE III. Table 2 illustrates the complementarity of the nucleotide sequences of SET BINDING SITE, designated SEQ ID:8921, to the nucleotide sequence of VGAM2565 RNA, herein designated VGAM RNA, also designated SEQ ID:5276.

Another function of VGAM2565 is therefore inhibition of SET Translocation (myeloid leukemia-associated) (SET, Accession NM_003011). Accordingly, utilities of VGAM2565 include diagnosis, prevention and treatment of diseases and clinical conditions associated with SET. Vacuolar Protein Sorting 41 (yeast) (VPS41, Accession NM_014396) is another VGAM2565 host target gene. VPS41 BINDING SITE1 and VPS41 BINDING SITE2 are HOST TARGET binding sites found in untranslated regions of mRNA encoded by VPS41, corresponding to HOST TARGET binding sites such as BINDING SITE I, BINDING SITE II or BINDING SITE III. Table 2 illustrates the complementarity of the nucleotide sequences of VPS41 BINDING SITE1 and VPS41 BINDING SITE2, designated SEQ ID:15734 and SEQ ID:27934 respectively, to the nucleotide sequence of VGAM2565 RNA, herein designated VGAM RNA, also designated SEQ ID:5276.

Another function of VGAM2565 is therefore inhibition of Vacuolar Protein Sorting 41 (yeast) (VPS41, Accession NM_014396). Accordingly, utilities of VGAM2565 include diagnosis, prevention and treatment of diseases and clinical conditions associated with VPS41. CDV-1 (Accession NM_031473) is another VGAM2565 host target gene. CDV-1 BINDING SITE is HOST TARGET binding site found in the 3' untranslated region of mRNA encoded by CDV-1, corresponding to a HOST TARGET binding site such as BINDING SITE I, BINDING SITE II or BINDING SITE III. Table 2 illustrates the complementarity of the nucleotide sequences of CDV-1 BINDING SITE, designated SEQ ID:25539, to the nucleotide sequence of VGAM2565 RNA, herein designated VGAM RNA, also designated SEQ ID:5276.

Another function of VGAM2565 is therefore inhibition of CDV-1 (Accession NM_031473). Accordingly, utilities of VGAM2565 include diagnosis, prevention and treatment of diseases and clinical conditions associated with CDV-1. Cysteine Sulfinic Acid Decarboxylase (CSAD, Accession NM_015989) is another VGAM2565 host target gene. CSAD BINDING SITE is HOST TARGET binding site found in the 3' untranslated region of mRNA encoded by CSAD, corresponding to a HOST TARGET binding site such as BINDING SITE I, BINDING SITE II or BINDING SITE III. Table 2 illustrates the complementarity of the nucleotide sequences of CSAD BINDING SITE, designated SEQ ID:18082, to the nucleotide sequence of VGAM2565 RNA, herein designated VGAM RNA, also designated SEQ ID:5276.

Another function of VGAM2565 is therefore inhibition of Cysteine Sulfinic Acid Decarboxylase (CSAD, Accession NM_015989). Accordingly, utilities of VGAM2565 include diagnosis, prevention and treatment of diseases and clinical conditions associated with CSAD. CSL4 (Accession NM_016046) is another VGAM2565 host target gene. CSL4 BINDING SITE is HOST TARGET binding site found in the 3' untranslated region of mRNA encoded by CSL4, corresponding to a HOST TARGET binding site such as BINDING SITE I, BINDING SITE II or BINDING SITE III. Table 2 illustrates the complementarity of the nucleotide sequences of CSL4 BINDING SITE, designated SEQ ID:18124, to the nucleotide sequence of VGAM2565 RNA, herein designated VGAM RNA, also designated SEQ ID:5276.

Another function of VGAM2565 is therefore inhibition of CSL4 (Accession NM_016046). Accordingly, utilities of VGAM2565 include diagnosis, prevention and treatment of diseases and clinical conditions associated with CSL4. ENDOFIN (Accession NM_014733) is another VGAM2565 host target gene. ENDOFIN BINDING SITE is HOST TARGET binding site found in the 3' untranslated region of mRNA encoded by ENDOFIN, corresponding to a HOST TARGET binding site such as BINDING SITE I, BINDING SITE II or BINDING SITE III. Table 2 illustrates the complementarity of the nucleotide sequences of ENDOFIN BINDING SITE, designated SEQ ID:16367, to the nucleotide sequence of VGAM2565 RNA, herein designated VGAM RNA, also designated SEQ ID:5276.

Another function of VGAM2565 is therefore inhibition of ENDOFIN (Accession NM_014733). Accordingly, utilities of VGAM2565 include diagnosis, prevention and treatment of diseases and clinical conditions associated with ENDOFIN. FLJ11160 (Accession NM_018344) is another VGAM2565 host target gene. FLJ11160 BINDING SITE is HOST TARGET binding site found in the 3' untranslated region of mRNA encoded by FLJ11160, corresponding to a HOST TARGET binding site such as BINDING SITE I, BINDING SITE II or BINDING SITE III. Table 2 illustrates the complementarity of the nucleotide sequences of FLJ11160 BINDING SITE, designated SEQ ID:20351, to the nucleotide sequence of VGAM2565 RNA, herein designated VGAM RNA, also designated SEQ ID:5276.

Another function of VGAM2565 is therefore inhibition of FLJ11160 (Accession NM_018344). Accordingly, utilities of VGAM2565 include diagnosis, prevention and treatment of diseases and clinical conditions associated with FLJ11160. KIAA0527 (Accession XM_171054) is another VGAM2565 host target gene. KIAA0527 BINDING SITE is HOST TARGET binding site found in the 3' untranslated region of mRNA encoded by KIAA0527, corresponding to a HOST TARGET binding site such as BINDING SITE I, BINDING SITE II or BINDING SITE III. Table 2 illustrates the complementarity of the nucleotide sequences of KIAA0527 BINDING SITE, designated SEQ ID:45840, to the nucleotide sequence of VGAM2565 RNA, herein designated VGAM RNA, also designated SEQ ID:5276.

Another function of VGAM2565 is therefore inhibition of KIAA0527 (Accession XM_171054). Accordingly, utilities of VGAM2565 include diagnosis, prevention and treatment of diseases and clinical conditions associated with KIAA0527. KIAA1900 (Accession XM_055299) is another VGAM2565 host target gene. KIAA1900 BINDING SITE is HOST TARGET binding site found in the 3' untranslated region of mRNA encoded by KIAA1900, corresponding to a HOST TARGET binding site such as BINDING SITE I, BINDING SITE II or BINDING SITE III. Table 2 illustrates the complementarity of the nucleotide sequences of KIAA1900 BINDING SITE, designated SEQ ID:36258, to the nucleotide sequence of VGAM2565 RNA, herein designated VGAM RNA, also designated SEQ ID:5276.

Another function of VGAM2565 is therefore inhibition of KIAA1900 (Accession XM_055299). Accordingly, utilities of VGAM2565 include diagnosis, prevention and treatment of diseases and clinical conditions associated with KIAA1900. Mitochondrial Ribosomal Protein L35 (MRPL35, Accession NM_016622) is another VGAM2565 host target gene. MRPL35 BINDING SITE is HOST TARGET binding site found in the 3' untranslated region of mRNA encoded by MRPL35, corresponding to a HOST TARGET binding site such as BINDING SITE I, BINDING SITE II or BINDING SITE III. Table 2 illustrates the complementarity of the nucleotide sequences of MRPL35 BINDING SITE, designated SEQ ID:18732, to the nucleotide sequence of VGAM2565 RNA, herein designated VGAM RNA, also designated SEQ ID:5276.

Another function of VGAM2565 is therefore inhibition of Mitochondrial Ribosomal Protein L35 (MRPL35, Accession NM_016622). Accordingly, utilities of VGAM2565 include diagnosis, prevention and treatment of diseases and clinical conditions associated with MRPL35. Phospholipid Scramblase 4 (PLSCR4, Accession NM_020353) is another VGAM2565 host target gene. PLSCR4 BINDING SITE is HOST TARGET binding site found in the 3' untranslated region of mRNA encoded by PLSCR4, corresponding to a HOST TARGET binding site such as BINDING SITE I, BINDING SITE II or BINDING SITE III. Table 2 illustrates the complementarity of the nucleotide sequences of PLSCR4 BINDING SITE, designated SEQ ID:21620, to the nucleotide sequence of VGAM2565 RNA, herein designated VGAM RNA, also designated SEQ ID:5276.

Another function of VGAM2565 is therefore inhibition of Phospholipid Scramblase 4 (PLSCR4, Accession NM_020353). Accordingly, utilities of VGAM2565 include diagnosis, prevention and treatment of diseases and clinical conditions associated with PLSCR4. PR Domain Containing 8 (PRDM8, Accession NM_020226) is another VGAM2565 host target gene. PRDM8 BINDING SITE is HOST TARGET binding site found in the 5' untranslated region of mRNA encoded by PRDM8, corresponding to a HOST TARGET binding site such as BINDING SITE I, BINDING SITE II or BINDING SITE III. Table 2 illustrates the complementarity of the nucleotide sequences of PRDM8 BINDING SITE, designated SEQ ID:21489, to the nucleotide sequence of VGAM2565 RNA, herein designated VGAM RNA, also designated SEQ ID:5276.

Another function of VGAM2565 is therefore inhibition of PR Domain Containing 8 (PRDM8, Accession NM_020226). Accordingly, utilities of VGAM2565 include diagnosis, prevention and treatment of diseases and clinical conditions associated with PRDM8. Tripartite Motif-containing 2 (TRIM2, Accession NM_015271) is another VGAM2565 host target gene. TRIM2 BINDING SITE is HOST TARGET binding site found in the 3' untranslated region of mRNA encoded by TRIM2, corresponding to a HOST TARGET binding site such as BINDING SITE I, BINDING SITE II or BINDING SITE III. Table 2 illustrates the complementarity of the nucleotide sequences of TRIM2 BINDING SITE, designated SEQ ID:17595, to the nucleotide sequence of VGAM2565 RNA, herein designated VGAM RNA, also designated SEQ ID:5276.

Another function of VGAM2565 is therefore inhibition of Tripartite Motif-containing 2 (TRIM2, Accession NM_015271). Accordingly, utilities of VGAM2565 include diagnosis, prevention and treatment of diseases and clinical conditions associated with TRIM2. LOC118611 (Accession XM_061055) is another VGAM2565 host target gene. LOC118611 BINDING SITE is HOST TARGET binding site found in the 5' untranslated region of mRNA encoded by LOC118611, corresponding to a HOST TARGET binding site such as BINDING SITE I, BINDING SITE II or BINDING SITE III. Table 2 illustrates the complementarity of the nucleotide sequences of LOC118611 BINDING SITE, designated SEQ ID:37185, to the nucleotide sequence of VGAM2565 RNA, herein designated VGAM RNA, also designated SEQ ID:5276.

Another function of VGAM2565 is therefore inhibition of LOC118611 (Accession XM_061055). Accordingly, utilities of VGAM2565 include diagnosis, prevention and treatment of diseases and clinical conditions associated with LOC118611. LOC130026 (Accession NM_138468) is another VGAM2565 host target gene. LOC130026 BINDING SITE is HOST TARGET binding site found in the 3' untranslated region of mRNA encoded by LOC130026, corresponding to a HOST TARGET binding site such as BINDING SITE I, BINDING SITE II or BINDING SITE III. Table 2 illustrates the complementarity of the nucleotide sequences of LOC130026 BINDING SITE, designated SEQ ID:28817, to the nucleotide sequence of VGAM2565 RNA, herein designated VGAM RNA, also designated SEQ ID:5276.

Another function of VGAM2565 is therefore inhibition of LOC130026 (Accession NM_138468). Accordingly, utilities of VGAM2565 include diagnosis, prevention and treatment of diseases and clinical conditions associated with LOC130026. LOC153810 (Accession XM_087778) is another VGAM2565 host target gene. LOC153810 BINDING SITE is HOST TARGET binding site found in the 5' untranslated region of mRNA encoded by LOC153810, corresponding to a HOST TARGET binding site such as BINDING SITE I, BINDING SITE II or BINDING SITE III. Table 2 illustrates the complementarity of the nucleotide sequences of LOC153810 BINDING SITE, designated SEQ ID:39410, to the nucleotide sequence of VGAM2565 RNA, herein designated VGAM RNA, also designated SEQ ID:5276.

Another function of VGAM2565 is therefore inhibition of LOC153810 (Accession XM_087778). Accordingly, utilities of VGAM2565 include diagnosis, prevention and treatment of diseases and clinical conditions associated with LOC153810. LOC221312 (Accession XM_166314) is another VGAM2565 host target gene. LOC221312 BINDING SITE is HOST TARGET binding site found in the 3' untranslated region of mRNA encoded by LOC221312, corresponding to a HOST TARGET binding site such as BINDING SITE I, BINDING SITE II or BINDING SITE III. Table 2 illustrates the complementarity of the nucleotide sequences of LOC221312 BINDING SITE, designated SEQ ID:44138, to the nucleotide sequence of VGAM2565 RNA, herein designated VGAM RNA, also designated SEQ ID:5276.

Another function of VGAM2565 is therefore inhibition of LOC221312 (Accession XM_166314). Accordingly, utilities of VGAM2565 include diagnosis, prevention and treatment of diseases and clinical conditions associated with LOC221312. LOC256080 (Accession XM_174235) is another VGAM2565 host target gene. LOC256080 BINDING SITE is HOST TARGET binding site found in the 5' untranslated region of mRNA encoded by LOC256080, corresponding to a HOST TARGET binding site such as BINDING SITE I, BINDING SITE II or BINDING SITE III. Table 2 illustrates the complementarity of the nucleotide sequences of LOC256080 BINDING SITE, designated SEQ ID:46584, to the nucleotide sequence of VGAM2565 RNA, herein designated VGAM RNA, also designated SEQ ID:5276.

Another function of VGAM2565 is therefore inhibition of LOC256080 (Accession XM_174235). Accordingly, utilities of VGAM2565 include diagnosis, prevention and treatment of diseases and clinical conditions associated with LOC256080. FIG. 1 further provides a conceptual description of a novel bioinformatically detected viral gene of the present invention, referred to here as Viral Genomic Address Messenger 2566 (VGAM2566) viral gene, which modulates expression of respective host target genes thereof, the function and utility of which host target genes is known in the art.

VGAM2566 is a novel bioinformatically detected regulatory, non protein coding, viral micro RNA (miRNA) gene. The method by which VGAM2566 was detected is described hereinabove with reference to FIGS. 1-8.

VGAM2566 gene, herein designated VGAM GENE, is a viral gene contained in the genome of Triatoma Virus. VGAM2566 host target gene, herein designated VGAM HOST TARGET GENE, is a human gene contained in the human genome.

VGAM2566 gene encodes a VGAM2566 precursor RNA, herein designated VGAM PRECURSOR RNA. Similar to other miRNA genes, and unlike most ordinary genes, VGAM2566 precursor RNA does not encode a protein. A nucleotide sequence identical or highly similar to the nucleotide sequence of VGAM2566 precursor RNA is designated SEQ ID:2552, and is provided hereinbelow with reference to the sequence listing part. Nucleotide sequence SEQ ID:2552 is located at position 2022 relative to the genome of Triatoma Virus.

VGAM2566 precursor RNA folds onto itself, forming VGAM2566 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2566 folded precursor RNA into VGAM2566 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2566 RNA is designated SEQ ID:5277, and is provided hereinbelow with reference to the sequence listing part.

VGAM2566 host target gene, herein designated VGAM HOST TARGET GENE, encodes a corresponding messenger RNA, VGAM2566 host target RNA, herein designated VGAM HOST TARGET RNA. VGAM2566 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2566 RNA, herein designated VGAM RNA, binds complementarily to one or more host target binding sites located in untranslated regions of VGAM2566 host target RNA, herein designated VGAM HOST TARGET RNA. This complementary binding is due to the fact that the nucleotide sequence of VGAM2566 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2566 RNA, herein designated VGAM RNA, may have a different number of host target binding sites in untranslated regions of a VGAM2566 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2566 RNA, herein designated VGAM RNA, to host target binding sites on VGAM2566 host target RNA, herein designated VGAM HOST TARGET RNA, such as BINDING SITE I, BINDING SITE II and BINDING SITE III, inhibits translation of VGAM2566 host target RNA into VGAM2566 host target protein, herein designated VGAM HOST TARGET PROTEIN. VGAM host target protein is therefore outlined by a broken line.

It is appreciated that VGAM2566 host target gene, herein designated VGAM HOST TARGET GENE, in fact represents a plurality of VGAM2566 host target genes. The mRNA of each one of this plurality of VGAM2566 host target genes comprises one or more host target binding sites, each having a nucleotide sequence which is at least partly complementary to VGAM2566 RNA, herein designated VGAM RNA, and which when bound by VGAM2566 RNA causes inhibition of translation of respective one or more VGAM2566 host target proteins.

It is further appreciated by one skilled in the art that the mode of translational inhibition illustrated by FIG. 1 with specific reference to translational inhibition exerted by VGAM2566 gene, herein designated VGAM GENE, on one or more VGAM2566 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2566 is inhibition of expression of host target genes, as part of a novel viral mechanism of attacking a host. Accordingly, utilities of VGAM2566 include diagnosis, prevention and treatment of viral infection by Triatoma Virus. Specific functions, and accordingly utilities, of VGAM2566 correlate with, and may be deduced from, the identity of the host target genes which VGAM2566 binds and inhibits, and the function of these host target genes, as elaborated hereinbelow.

Nucleotide sequences of the VGAM2566 precursor RNA, herein designated VGAM PRECURSOR RNA, and of the 'diced' VGAM2566 RNA, herein designated VGAM RNA, and a schematic representation of the secondary folding of VGAM2566 folded precursor RNA, herein designated VGAM FOLDED PRECURSOR RNA, of VGAM2566 are further described hereinbelow with reference to Table 1.

Nucleotide sequences of host target binding sites, such as BINDING SITE-I, BINDING SITE-II and BINDING SITE-III of FIG. 1, found on VGAM2566 host target RNA, and schematic representation of the complementarity of each of these host target binding sites to VGAM2566 RNA, herein designated VGAM RNA, are described hereinbelow with reference to Table 2.

As mentioned hereinabove with reference to FIG. 1, a function of VGAM2566 gene, herein designated VGAM is inhibition of expression of VGAM2566 target genes. It is appreciated that specific functions, and accordingly utilities, of VGAM2566 correlate with, and may be deduced from, the identity of the target genes which VGAM2566 binds and inhibits, and the function of these target genes, as elaborated hereinbelow.

Unc-119 Homolog (C. elegans) (UNC119, Accession NM_054035) is a VGAM2566 host target gene. UNC119 BINDING SITE is HOST TARGET binding site found in the 3' untranslated region of mRNA encoded by UNC119, corresponding to a HOST TARGET binding site such as BINDING SITE I, BINDING SITE II or BINDING SITE III. Table 2 illustrates the complementarity of the nucleotide sequences of UNC119 BINDING SITE, designated SEQ ID:27647, to the nucleotide sequence of VGAM2566 RNA, herein designated VGAM RNA, also designated SEQ ID:5277.

A function of VGAM2566 is therefore inhibition of Unc-119 Homolog (C. elegans) (UNC119, Accession NM_054035), a gene which is expressed in the retina and may play a role in the mechanism of photoreceptor neurotransmitter release through the synaptic vesicle cycle. Accordingly, utilities of VGAM2566 include diagnosis, prevention and treatment of diseases and clinical conditions associated with UNC119. The function of UNC119 and its association with various diseases and clinical conditions, has been established by previous studies, as described hereinabove with reference to VGAM1044. FIG. 1 further provides a conceptual description of a novel bioinformatically detected viral gene of the present invention, referred to here as Viral Genomic Address Messenger 2567 (VGAM2567) viral gene, which modulates expression of respective host target genes thereof, the function and utility of which host target genes is known in the art.

VGAM2567 is a novel bioinformatically detected regulatory, non protein coding, viral micro RNA (miRNA) gene. The method by which VGAM2567 was detected is described hereinabove with reference to FIGS. 1-8.

VGAM2567 gene, herein designated VGAM GENE, is a viral gene contained in the genome of Triatoma Virus. VGAM2567 host target gene, herein designated VGAM HOST TARGET GENE, is a human gene contained in the human genome.

VGAM2567 gene encodes a VGAM2567 precursor RNA, herein designated VGAM PRECURSOR RNA. Similar to other miRNA genes, and unlike most ordinary genes, VGAM2567 precursor RNA does not encode a protein. A nucleotide sequence identical or highly similar to the nucleotide sequence of VGAM2567 precursor RNA is designated SEQ ID:2553, and is provided hereinbelow with reference to the sequence listing part. Nucleotide sequence SEQ ID:2553 is located at position 3811 relative to the genome of Triatoma Virus.

VGAM2567 precursor RNA folds onto itself, forming VGAM2567 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2567 folded precursor RNA into VGAM2567 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM2567 RNA is designated SEQ ID:5278, and is provided hereinbelow with reference to the sequence listing part.

VGAM2567 host target gene, herein designated VGAM HOST TARGET GENE, encodes a corresponding messenger RNA, VGAM2567 host target RNA, herein designated VGAM HOST TARGET RNA. VGAM2567 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2567 RNA, herein designated VGAM RNA, binds complementarily to one or more host target binding sites located in untranslated regions of VGAM2567 host target RNA, herein designated VGAM HOST TARGET RNA. This complementary binding is due to the fact that the nucleotide sequence of VGAM2567 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2567 RNA, herein designated VGAM RNA, may have a different number of host target binding sites in untranslated regions of a VGAM2567 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2567 RNA, herein designated VGAM RNA, to host target binding sites on VGAM2567 host target RNA, herein designated VGAM HOST TARGET RNA, such as BINDING SITE I, BINDING SITE II and BINDING SITE III, inhibits translation of VGAM2567 host target RNA into VGAM2567 host target protein, herein designated VGAM HOST TARGET PROTEIN. VGAM host target protein is therefore outlined by a broken line.

It is appreciated that VGAM2567 host target gene, herein designated VGAM HOST TARGET GENE, in fact represents a plurality of VGAM2567 host target genes. The mRNA of each one of this plurality of VGAM2567 host target genes comprises one or more host target binding sites, each having a nucleotide sequence which is at least partly complementary to VGAM2567 RNA, herein designated VGAM RNA, and which when bound by VGAM2567 RNA causes inhibition of translation of respective one or more VGAM2567 host target proteins.

It is further appreciated by one skilled in the art that the mode of translational inhibition illustrated by FIG. 1 with specific reference to translational inhibition exerted by VGAM2567 gene, herein designated VGAM GENE, on one or more VGAM2567 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2567 is inhibition of expression of host target genes, as part of a novel viral mechanism of attacking a host. Accordingly, utilities of VGAM2567 include diagnosis, prevention and treatment of viral infection by Triatoma Virus. Specific functions, and accordingly utilities, of VGAM2567 correlate with, and may be deduced from, the identity of the host target genes which VGAM2567 binds and inhibits, and the function of these host target genes, as elaborated hereinbelow.

Nucleotide sequences of the VGAM2567 precursor RNA, herein designated VGAM PRECURSOR RNA, and of the 'diced' VGAM2567 RNA, herein designated VGAM RNA, and a schematic representation of the secondary folding of VGAM2567 folded precursor RNA, herein designated VGAM FOLDED PRECURSOR RNA, of VGAM2567 are further described hereinbelow with reference to Table 1.

Nucleotide sequences of host target binding sites, such as BINDING SITE-I, BINDING SITE-II and BINDING SITE-III of FIG. 1, found on VGAM2567 host target RNA, and schematic representation of the complementarity of each of these host target binding sites to VGAM2567 RNA, herein designated VGAM RNA, are described hereinbelow with reference to Table 2.

As mentioned hereinabove with reference to FIG. 1, a function of VGAM2567 gene, herein designated VGAM is inhibition of expression of VGAM2567 target genes. It is appreciated that specific functions, and accordingly utilities, of VGAM2567 correlate with, and may be deduced from, the identity of the target genes which VGAM2567 binds and inhibits, and the function of these target genes, as elaborated hereinbelow.

Amiloride-sensitive Cation Channel 1, Neuronal (degenerin) (ACCN1, Accession NM_001094) is a VGAM2567 host target gene. ACCN1 BINDING SITE is HOST TARGET binding site found in the 3' untranslated region of mRNA encoded by ACCN1, corresponding to a HOST TARGET binding site such as BINDING SITE I, BINDING SITE II or BINDING SITE III. Table 2 illustrates the complementarity of the nucleotide sequences of ACCN1 BINDING SITE, designated SEQ ID:6752, to the nucleotide sequence of VGAM2567 RNA, herein designated VGAM RNA, also designated SEQ ID:5278.

A function of VGAM2567 is therefore inhibition of Amiloride-sensitive Cation Channel 1, Neuronal (degenerin) (ACCN1, Accession NM_001094), a gene which non-voltage-gated amiloride-sensitive cation channel permeable for sodium, potassium and lithium. Accordingly, utilities of VGAM2567 include diagnosis, prevention and treatment of diseases and clinical conditions associated with ACCN1. The function of ACCN1 and its association with various diseases and clinical conditions, has been established by previous studies, as described hereinabove with reference to VGAM1095. PB1 (Accession NM_018313) is another VGAM2567 host target gene. PB1 BINDING SITE is HOST TARGET binding site found in the 3' untranslated region of mRNA encoded by PB1, corresponding to a HOST TARGET binding site such as BINDING SITE I, BINDING SITE II or BINDING SITE III. Table 2 illustrates the complementarity of the nucleotide sequences of PB1 BINDING SITE, designated SEQ ID:20308, to the nucleotide sequence of VGAM2567 RNA, herein designated VGAM RNA, also designated SEQ ID:5278.

Another function of VGAM2567 is therefore inhibition of PB1 (Accession NM_018313). Accordingly, utilities of VGAM2567 include diagnosis, prevention and treatment of diseases and clinical conditions associated with PB1. FIG. 1 further provides a conceptual description of a novel bioinformatically detected viral gene of the present invention, referred to here as Viral Genomic Address Messenger 2568 (VGAM2568) viral gene, which modulates expression of respective host target genes thereof, the function and utility of which host target genes is known in the art.

VGAM2568 is a novel bioinformatically detected regulatory, non protein coding, viral micro RNA (miRNA) gene. The method by which VGAM2568 was detected is described hereinabove with reference to FIGS. 1-8.

VGAM2568 gene, herein designated VGAM GENE, is a viral gene contained in the genome of Triatoma Virus. VGAM2568 host target gene, herein designated VGAM HOST TARGET GENE, is a human gene contained in the human genome.

VGAM2568 gene encodes a VGAM2568 precursor RNA, herein designated VGAM PRECURSOR RNA. Similar to other miRNA genes, and unlike most ordinary genes, VGAM2568 precursor RNA does not encode a protein. A nucleotide sequence identical or highly similar to the nucleotide sequence of VGAM2568 precursor RNA is designated SEQ ID:2554, and is provided hereinbelow with reference to the sequence listing part. Nucleotide sequence SEQ ID:2554 is located at position 4293 relative to the genome of Triatoma Virus.

VGAM2568 precursor RNA folds onto itself, forming VGAM2568 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2568 folded precursor RNA into VGAM2568 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM2568 RNA is designated SEQ ID:5279, and is provided hereinbelow with reference to the sequence listing part.

VGAM2568 host target gene, herein designated VGAM HOST TARGET GENE, encodes a corresponding messenger RNA, VGAM2568 host target RNA, herein designated VGAM HOST TARGET RNA. VGAM2568 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2568 RNA, herein designated VGAM RNA, binds complementarily to one or more host target binding sites located in untranslated regions of VGAM2568 host target RNA, herein designated VGAM HOST TARGET RNA. This complementary binding is due to the fact that the nucleotide sequence of VGAM2568 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2568 RNA, herein designated VGAM RNA, may have a different number of host target binding sites in untranslated regions of a VGAM2568 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2568 RNA, herein designated VGAM RNA, to host target binding sites on VGAM2568 host target RNA, herein designated VGAM HOST TARGET RNA, such as BINDING SITE I, BINDING SITE II and BINDING SITE III, inhibits translation of VGAM2568 host target RNA into VGAM2568 host target protein, herein designated VGAM HOST TARGET PROTEIN. VGAM host target protein is therefore outlined by a broken line.

It is appreciated that VGAM2568 host target gene, herein designated VGAM HOST TARGET GENE, in fact represents a plurality of VGAM2568 host target genes. The mRNA of each one of this plurality of VGAM2568 host target genes comprises one or more host target binding sites, each having a nucleotide sequence which is at least partly complementary to VGAM2568 RNA, herein designated VGAM RNA, and which when bound by VGAM2568 RNA causes inhibition of translation of respective one or more VGAM2568 host target proteins.

It is further appreciated by one skilled in the art that the mode of translational inhibition illustrated by FIG. 1 with specific reference to translational inhibition exerted by VGAM2568 gene, herein designated VGAM GENE, on one or more VGAM2568 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2568 is inhibition of expression of host target genes, as part of a novel viral mechanism of attacking a host. Accordingly, utilities of VGAM2568 include diagnosis, prevention and treatment of viral infection by Triatoma Virus. Specific functions, and accordingly utilities, of VGAM2568 correlate with, and may be deduced from, the identity of the host target genes which VGAM2568 binds and inhibits, and the function of these host target genes, as elaborated hereinbelow.

Nucleotide sequences of the VGAM2568 precursor RNA, herein designated VGAM PRECURSOR RNA, and of the 'diced' VGAM2568 RNA, herein designated VGAM RNA, and a schematic representation of the secondary folding of VGAM2568 folded precursor RNA, herein designated VGAM FOLDED PRECURSOR RNA, of VGAM2568 are further described hereinbelow with reference to Table 1.

Nucleotide sequences of host target binding sites, such as BINDING SITE-I, BINDING SITE-II and BINDING SITE-III of FIG. 1, found on VGAM2568 host target RNA, and schematic representation of the complementarity of each of these host target binding sites to VGAM2568 RNA, herein designated VGAM RNA, are described hereinbelow with reference to Table 2.

As mentioned hereinabove with reference to FIG. 1, a function of VGAM2568 gene, herein designated VGAM is inhibition of expression of VGAM2568 target genes. It is appreciated that specific functions, and accordingly utilities, of VGAM2568 correlate with, and may be deduced from, the identity of the target genes which VGAM2568 binds and inhibits, and the function of these target genes, as elaborated hereinbelow.

H2A Histone Family, Member J (H2AFJ, Accession NM_018267) is a VGAM2568 host target gene. H2AFJ BINDING SITE is HOST TARGET binding site found in the 3' untranslated region of mRNA encoded by H2AFJ, corresponding to a HOST TARGET binding site such as BINDING SITE I, BINDING SITE II or BINDING SITE III. Table 2 illustrates the complementarity of the nucleotide sequences of H2AFJ BINDING SITE, designated SEQ ID:20239, to the nucleotide sequence of VGAM2568 RNA, herein designated VGAM RNA, also designated SEQ ID:5279.

A function of VGAM2568 is therefore inhibition of H2A Histone Family, Member J (H2AFJ, Accession NM_018267). Accordingly, utilities of VGAM2568 include diagnosis, prevention and treatment of diseases and clinical conditions associated with H2AFJ. KIAA0061 (Accession XM_043094) is another VGAM2568 host target gene. KIAA0061 BINDING SITE is HOST TARGET binding site found in the 3' untranslated region of mRNA encoded by KIAA0061, corresponding to a HOST TARGET binding site such as BINDING SITE I, BINDING SITE II or BINDING SITE III. Table 2 illustrates the complementarity of the nucleotide sequences of KIAA0061 BINDING SITE, designated SEQ ID:33892, to the nucleotide sequence of VGAM2568 RNA, herein designated VGAM RNA, also designated SEQ ID:5279.

Another function of VGAM2568 is therefore inhibition of KIAA0061 (Accession XM_043094). Accordingly, utilities of VGAM2568 include diagnosis, prevention and treatment of diseases and clinical conditions associated with KIAA0061. KIAA1655 (Accession XM_039442) is another VGAM2568 host target gene. KIAA1655 BINDING SITE is HOST TARGET binding site found in the 3' untranslated region of mRNA encoded by KIAA1655, corresponding to a HOST TARGET binding site such as BINDING SITE I, BINDING SITE II or BINDING SITE III. Table 2 illustrates the complementarity of the nucleotide sequences of KIAA1655 BINDING SITE, designated SEQ ID:33083, to the nucleotide sequence of VGAM2568 RNA, herein designated VGAM RNA, also designated SEQ ID:5279.

Another function of VGAM2568 is therefore inhibition of KIAA1655 (Accession XM_039442). Accordingly, utilities of VGAM2568 include diagnosis, prevention and treatment of diseases and clinical conditions associated with KIAA1655. Kelch-like 6 (Drosophila) (KLHL6, Accession NM_130446) is another VGAM2568 host target gene. KLHL6 BINDING SITE is HOST TARGET binding site found in the 3' untranslated region of mRNA encoded by KLHL6, corresponding to a HOST TARGET binding site such as BINDING SITE I, BINDING SITE II or BINDING SITE III. Table 2 illustrates the complementarity of the nucleotide sequences of KLHL6 BINDING SITE, designated SEQ ID:28215, to the nucleotide sequence of VGAM2568 RNA, herein designated VGAM RNA, also designated SEQ ID:5279.

Another function of VGAM2568 is therefore inhibition of Kelch-like 6 (Drosophila) (KLHL6, Accession NM_130446). Accordingly, utilities of VGAM2568 include diagnosis, prevention and treatment of diseases and clinical conditions associated with KLHL6. LOC147947 (Accession XM_085974) is another VGAM2568 host target gene. LOC147947 BINDING SITE is HOST TARGET binding site found in the 5' untranslated region of mRNA encoded by LOC147947, corresponding to a HOST TARGET binding site such as BINDING SITE I, BINDING SITE II or BINDING SITE III. Table 2 illustrates the complementarity of the nucleotide sequences of LOC147947 BINDING SITE, designated SEQ ID:38424, to the nucleotide sequence of VGAM2568 RNA, herein designated VGAM RNA, also designated SEQ ID:5279.

Another function of VGAM2568 is therefore inhibition of LOC147947 (Accession XM_085974). Accordingly, utilities of VGAM2568 include diagnosis, prevention and treatment of diseases and clinical conditions associated with LOC147947. FIG. 1 further provides a conceptual description of a novel bioinformatically detected viral gene of the present invention, referred to here as Viral Genomic Address Messenger 2569 (VGAM2569) viral gene, which modulates expression of respective host target genes thereof, the function and utility of which host target genes is known in the art.

VGAM2569 is a novel bioinformatically detected regulatory, non protein coding, viral micro RNA (miRNA) gene. The method by which VGAM2569 was detected is described hereinabove with reference to FIGS. 1-8.

VGAM2569 gene, herein designated VGAM GENE, is a viral gene contained in the genome of Triatoma Virus. VGAM2569 host target gene, herein designated VGAM HOST TARGET GENE, is a human gene contained in the human genome.

VGAM2569 gene encodes a VGAM2569 precursor RNA, herein designated VGAM PRECURSOR RNA. Similar to other miRNA genes, and unlike most ordinary genes, VGAM2569 precursor RNA does not encode a protein. A nucleotide sequence identical or highly similar to the nucleotide sequence of VGAM2569 precursor RNA is designated SEQ ID:2555, and is provided hereinbelow with reference to the sequence listing part. Nucleotide sequence SEQ ID:2555 is located at position 5389 relative to the genome of Triatoma Virus.

VGAM2569 precursor RNA folds onto itself, forming VGAM2569 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2569 folded precursor RNA into VGAM2569 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 45%) nucleotide sequence of VGAM2569 RNA is designated SEQ ID:5280, and is provided hereinbelow with reference to the sequence listing part.

VGAM2569 host target gene, herein designated VGAM HOST TARGET GENE, encodes a corresponding messenger RNA, VGAM2569 host target RNA, herein designated VGAM HOST TARGET RNA. VGAM2569 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2569 RNA, herein designated VGAM RNA, binds complementarily to one or more host target binding sites located in untranslated regions of VGAM2569 host target RNA, herein designated VGAM HOST TARGET RNA. This complementary binding is due to the fact that the nucleotide sequence of VGAM2569 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2569 RNA, herein designated VGAM RNA, may have a different number of host target binding sites in untranslated regions of a VGAM2569 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2569 RNA, herein designated VGAM RNA, to host target binding sites on VGAM2569 host target RNA, herein designated VGAM HOST TARGET RNA, such as BINDING SITE I, BINDING SITE II and BINDING SITE III, inhibits translation of VGAM2569 host target RNA into VGAM2569 host target protein, herein designated VGAM HOST TARGET PROTEIN. VGAM host target protein is therefore outlined by a broken line.

It is appreciated that VGAM2569 host target gene, herein designated VGAM HOST TARGET GENE, in fact represents a plurality of VGAM2569 host target genes. The mRNA of each one of this plurality of VGAM2569 host target genes comprises one or more host target binding sites, each having a nucleotide sequence which is at least partly complementary to VGAM2569 RNA, herein designated VGAM RNA, and which when bound by VGAM2569 RNA causes inhibition of translation of respective one or more VGAM2569 host target proteins.

It is further appreciated by one skilled in the art that the mode of translational inhibition illustrated by FIG. 1 with specific reference to translational inhibition exerted by VGAM2569 gene, herein designated VGAM GENE, on one or more VGAM2569 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM2569 is inhibition of expression of host target genes, as part of a novel viral mechanism of attacking a host. Accordingly, utilities of VGAM2569 include diagnosis, prevention and treatment of viral infection by Triatoma Virus. Specific functions, and accordingly utilities, of VGAM2569 correlate with, and may be deduced from, the identity of the host target genes which VGAM2569 binds and inhibits, and the function of these host target genes, as elaborated hereinbelow.

Nucleotide sequences of the VGAM2569 precursor RNA, herein designated VGAM PRECURSOR RNA, and of the ‘diced’ VGAM2569 RNA, herein designated VGAM RNA, and a schematic representation of the secondary folding of VGAM2569 folded precursor RNA, herein designated VGAM FOLDED PRECURSOR RNA, of VGAM2569 are further described hereinbelow with reference to Table 1.

Nucleotide sequences of host target binding sites, such as BINDING SITE-I, BINDING SITE-II and BINDING SITE-III of FIG. 1, found on VGAM2569 host target RNA, and schematic representation of the complementarity of each of these host target binding sites to VGAM2569 RNA, herein designated VGAM RNA, are described hereinbelow with reference to Table 2.

As mentioned hereinabove with reference to FIG. 1, a function of VGAM2569 gene, herein designated VGAM is inhibition of expression of VGAM2569 target genes. It is appreciated that specific functions, and accordingly utilities, of VGAM2569 correlate with, and may be deduced from, the identity of the target genes which VGAM2569 binds and inhibits, and the function of these target genes, as elaborated hereinbelow.

Chloride Channel 3 (CLCN3, Accession NM_001829) is a VGAM2569 host target gene. CLCN3 BINDING SITE is HOST TARGET binding site found in the 3' untranslated region of mRNA encoded by CLCN3, corresponding to a HOST TARGET binding site such as BINDING SITE I, BINDING SITE II or BINDING SITE III. Table 2 illustrates the complementarity of the nucleotide sequences of CLCN3 BINDING SITE, designated SEQ ID:7564, to the nucleotide sequence of VGAM2569 RNA, herein designated VGAM RNA, also designated SEQ ID:5280.

A function of VGAM2569 is therefore inhibition of Chloride Channel 3 (CLCN3, Accession NM_001829), a gene which play a role in the neural cell function through regulation of membrane excitability. Accordingly, utilities of VGAM2569 include diagnosis, prevention and treatment of diseases and clinical conditions associated with CLCN3. The function of CLCN3 and its association with various diseases and clinical conditions, has been established by previous studies, as described hereinabove with reference to VGAM1332. Dual Oxidase 2 (DUOX2, Accession NM_014080) is another VGAM2569 host target gene. DUOX2 BINDING SITE is HOST TARGET binding site found in the 3' untranslated region of mRNA encoded by DUOX2, corresponding to a HOST TARGET binding site such as BINDING SITE I, BINDING SITE II or BINDING SITE III. Table 2 illustrates the complementarity of the nucleotide sequences of DUOX2 BINDING SITE, designated SEQ ID:15306, to the nucleotide sequence of VGAM2569 RNA, herein designated VGAM RNA, also designated SEQ ID:5280.

Another function of VGAM2569 is therefore inhibition of Dual Oxidase 2 (DUOX2, Accession NM_014080), a gene which is a calcium-dependent flavoprotein component of thyroid NADPH oxidase. Accordingly, utilities of VGAM2569 include diagnosis, prevention and treatment of diseases and clinical conditions associated with DUOX2. The function of DUOX2 and its association with various diseases and clinical conditions, has been established by previous studies, as described hereinabove with reference to VGAM1169. Fms-related Tyrosine Kinase 1 (vascular endothelial growth factor/vascular permeability factor receptor) (FLT1, Accession NM_002019) is another VGAM2569 host target gene. FLT1 BINDING SITE is HOST TARGET binding site found in the 3' untranslated region of mRNA encoded by FLT1, corresponding to a HOST TARGET binding site such as BINDING SITE I, BINDING SITE II or BINDING SITE III. Table 2 illustrates the complementarity of the nucleotide sequences of FLT1 BINDING SITE, designated SEQ ID:7763, to the nucleotide sequence of VGAM2569 RNA, herein designated VGAM RNA, also designated SEQ ID:5280.

Another function of VGAM2569 is therefore inhibition of Fms-related Tyrosine Kinase 1 (vascular endothelial growth factor/vascular permeability factor receptor) (FLT1, Accession NM_002019). Accordingly, utilities of VGAM2569 include diagnosis, prevention and treatment of diseases and clinical conditions associated with FLT1. Forkhead Box E1 (thyroid transcription factor 2) (FOXE1, Accession NM_004473) is another VGAM2569 host target gene. FOXE1 BINDING SITE is HOST TARGET binding site found in the 5' untranslated region of mRNA encoded by FOXE1, corresponding to a HOST TARGET binding site such as BINDING SITE I, BINDING SITE II or BINDING SITE III. Table 2 illustrates the complementarity of the nucleotide sequences of FOXE1 BINDING SITE, designated SEQ ID:10782, to the nucleotide sequence of VGAM2569 RNA, herein designated VGAM RNA, also designated SEQ ID:5280.

Another function of VGAM2569 is therefore inhibition of Forkhead Box E1 (thyroid transcription factor 2) (FOXE1, Accession NM_004473). Accordingly, utilities of VGAM2569 include diagnosis, prevention and treatment of diseases and clinical conditions associated with FOXE1. UDP-N-acetyl-alpha-D-galactosamine:polypeptide N-acetylgalactosaminyltransferase 7 (GalNAc-T7) (GALNT7, Accession NM_054110) is another VGAM2569 host target gene. GALNT7 BINDING SITE is HOST TARGET binding site found in the 3' untranslated region of mRNA encoded by GALNT7, corresponding to a HOST TARGET binding site such as BINDING SITE I, BINDING SITE II or BINDING SITE III. Table 2 illustrates the complementarity of the nucleotide sequences of GALNT7 BINDING SITE, designated SEQ ID:27649, to the nucleotide sequence of VGAM2569 RNA, herein designated VGAM RNA, also designated SEQ ID:5280.

Another function of VGAM2569 is therefore inhibition of UDP-N-acetyl-alpha-D-galactosamine:polypeptide N-acetylgalactosaminyltransferase 7 (GalNAc-T7) (GALNT7, Accession NM_054110). Accordingly, utilities of VGAM2569 include diagnosis, prevention and treatment of diseases and clinical conditions associated with GALNT7. Nuclear Factor of Activated T-cells, Cytoplasmic, Calcineurin-dependent 1 (NFATC1, Accession NM_006162) is another VGAM2569 host target gene. NFATC1 BINDING SITE is HOST TARGET binding site found in the 3' untranslated region of mRNA encoded by NFATC1, corresponding to a HOST TARGET binding site such as BINDING SITE I, BINDING SITE II or BINDING SITE III. Table 2 illustrates the complementarity of the nucleotide sequences of NFATC1 BINDING SITE, designated SEQ ID:12815, to the nucleotide sequence of VGAM2569 RNA, herein designated VGAM RNA, also designated SEQ ID:5280.

Another function of VGAM2569 is therefore inhibition of Nuclear Factor of Activated T-cells, Cytoplasmic, Calcineurin-dependent 1 (NFATC1, Accession NM_006162), a gene which regulates he activation, proliferation, differentiation and programmed death of ymphoid and nonlymphoid cells. Accordingly, utilities of VGAM2569 include diagnosis, prevention and treatment of diseases and clinical conditions associated with NFATC1. The function of NFATC1 and its association with various diseases and clinical conditions, has been established by previous studies, as described hereinabove with reference to VGAM123. Peroxisomal Farnesylated Protein (PXF, Accession NM_002857) is another VGAM2569 host target gene. PXF BINDING SITE is HOST TARGET binding site found in the 3' untranslated region of mRNA encoded by PXF, corresponding to a HOST TARGET binding site such as BINDING SITE I, BINDING SITE II or BINDING SITE III. Table 2 illustrates the complementarity of the nucleotide sequences of PXF BINDING SITE, designated SEQ ID:8748, to the nucleotide sequence of VGAM2569 RNA, herein designated VGAM RNA, also designated SEQ ID:5280.

Another function of VGAM2569 is therefore inhibition of Peroxisomal Farnesylated Protein (PXF, Accession NM_002857), a gene which may function in peroxisomal biogenesis or assembly. Accordingly, utilities of VGAM2569 include diagnosis, prevention and treatment of diseases and clinical conditions associated with PXF. The function of PXF and its association with various diseases and clinical conditions, has been established by previous studies, as described hereinabove with reference to VGAM193. Vacuolar Protein Sorting 26 (yeast) (VPS26, Accession NM_004896) is another VGAM2569 host target gene. VPS26 BINDING SITE is HOST TARGET binding site found in the 3' untranslated region of mRNA encoded by VPS26, corresponding to a HOST TARGET binding site such as BINDING SITE I, BINDING SITE II or BINDING SITE III. Table 2 illustrates the complementarity of the nucleotide sequences of VPS26 BINDING SITE, designated SEQ ID:11323, to the nucleotide sequence of VGAM2569 RNA, herein designated VGAM RNA, also designated SEQ ID:5280.

Another function of VGAM2569 is therefore inhibition of Vacuolar Protein Sorting 26 (yeast) (VPS26, Accession NM_004896), a gene which is a sorting protein- ensures the proper delivery of organelle-specific proteins. Accordingly, utilities of VGAM2569 include diagnosis, prevention and treatment of diseases and clinical conditions associated with VPS26. The function of VPS26 and its association with various diseases and clinical conditions, has been established by previous studies, as described hereinabove with reference to VGAM315. Agmatine Ureohydrolase (agmatinase) (AGMAT, Accession NM_024758) is another VGAM2569 host target gene. AGMAT BINDING SITE is HOST TARGET binding site found in the 3' untranslated region of mRNA encoded by AGMAT, corresponding to a HOST TARGET binding site such as BINDING SITE I, BINDING SITE II or BINDING SITE III. Table 2 illustrates the complementarity of the nucleotide sequences of AGMAT BINDING SITE, designated SEQ ID:24104, to the nucleotide sequence of VGAM2569 RNA, herein designated VGAM RNA, also designated SEQ ID:5280.

Another function of VGAM2569 is therefore inhibition of Agmatine Ureohydrolase (agmatinase) (AGMAT, Accession NM_024758). Accordingly, utilities of VGAM2569 include diagnosis, prevention and treatment of diseases and clinical conditions associated with AGMAT. DKFZp761O17121 (Accession NM_032287) is another VGAM2569 host target gene. DKFZp761O17121 BINDING SITE is HOST TARGET binding site found in the 3' untranslated region of mRNA encoded by DKFZp761O17121, corresponding to a HOST TARGET binding site such as BINDING SITE I, BINDING SITE II or BINDING SITE III. Table 2 illustrates the complementarity of the nucleotide sequences of DKFZp761O17121 BINDING SITE, designated SEQ ID:26044, to the nucleotide sequence of VGAM2569 RNA, herein designated VGAM RNA, also designated SEQ ID:5280.

Another function of VGAM2569 is therefore inhibition of DKFZp761O17121 (Accession NM_032287). Accordingly, utilities of VGAM2569 include diagnosis, prevention and treatment of diseases and clinical conditions associated with DKFZp761O17121. Junctional Adhesion Molecule 1 (JAM1, Accession NM_144503) is another VGAM2569 host target gene. JAM1 BINDING SITE1 through JAM1 BINDING SITE4 are HOST TARGET binding sites found in untranslated regions of mRNA encoded by JAM1, corresponding to HOST TARGET binding sites such as BINDING SITE I, BINDING SITE II or BINDING SITE III. Table 2 illustrates the complementarity of the nucleotide sequences of JAM1 BINDING SITE1 through JAM1 BINDING SITE4, designated SEQ ID:29335, SEQ ID:29346, SEQ ID:29326 and SEQ ID:18859 respectively, to the nucleotide sequence of VGAM2569 RNA, herein designated VGAM RNA, also designated SEQ ID:5280.

Another function of VGAM2569 is therefore inhibition of Junctional Adhesion Molecule 1 (JAM1, Accession NM_144503). Accordingly, utilities of VGAM2569 include diagnosis, prevention and treatment of diseases and clinical conditions associated with JAM1. KIAA1573 (Accession XM_031545) is another VGAM2569 host target gene. KIAA1573 BINDING SITE is HOST TARGET binding site found in the 3' untranslated region of mRNA encoded by KIAA1573, corresponding to a HOST TARGET binding site such as BINDING SITE I, BINDING SITE II or BINDING SITE III. Table 2 illustrates the complementarity of the nucleotide sequences of KIAA1573 BINDING SITE, designated SEQ ID:31412, to the nucleotide sequence of VGAM2569 RNA, herein designated VGAM RNA, also designated SEQ ID:5280.

Another function of VGAM2569 is therefore inhibition of KIAA1573 (Accession XM_031545). Accordingly, utilities of VGAM2569 include diagnosis, prevention and treatment of diseases and clinical conditions associated with KIAA1573. KIAA1750 (Accession XM_043067) is another VGAM2569 host target gene. KIAA1750 BINDING SITE is HOST TARGET binding site found in the 3' untranslated region of mRNA encoded by KIAA1750, corresponding to a HOST TARGET binding site such as BINDING SITE I, BINDING SITE II or BINDING SITE III. Table 2 illustrates the complementarity of the nucleotide sequences of KIAA1750 BINDING SITE, designated SEQ ID:33871, to the nucleotide sequence of VGAM2569 RNA, herein designated VGAM RNA, also designated SEQ ID:5280.

Another function of VGAM2569 is therefore inhibition of KIAA1750 (Accession XM_043067). Accordingly, utilities of VGAM2569 include diagnosis, prevention and treatment of diseases and clinical conditions associated with KIAA1750. MGC11034 (Accession NM_031453) is another VGAM2569 host target gene. MGC11034 BINDING SITE is HOST TARGET binding site found in the 3' untranslated region of mRNA encoded by MGC11034, corresponding to a HOST TARGET binding site such as BINDING SITE I, BINDING SITE II or BINDING SITE III. Table 2 illustrates the complementarity of the nucleotide sequences of MGC11034 BINDING SITE, designated SEQ ID:25469, to the nucleotide sequence of VGAM2569 RNA, herein designated VGAM RNA, also designated SEQ ID:5280.

Another function of VGAM2569 is therefore inhibition of MGC11034 (Accession NM_031453). Accordingly, utilities of VGAM2569 include diagnosis, prevention and treatment of diseases and clinical conditions associated with MGC11034. Nuclear Receptor Subfamily 6, Group A, Member 1 (NR6A1, Accession NM_001489) is another VGAM2569 host target gene. NR6A1 BINDING SITE1 through NR6A1 BINDING SITE3 are HOST TARGET binding sites found in untranslated regions of mRNA encoded by NR6A1, corresponding to HOST TARGET binding sites such as BINDING SITE I, BINDING SITE II or BINDING SITE III. Table 2 illustrates the complementarity of the nucleotide sequences of NR6A1 BINDING SITE1 through NR6A1 BINDING SITE3, designated SEQ ID:7231, SEQ ID:27179 and SEQ ID:27185 respectively, to the nucleotide sequence of VGAM2569 RNA, herein designated VGAM RNA, also designated SEQ ID:5280.

Another function of VGAM2569 is therefore inhibition of Nuclear Receptor Subfamily 6, Group A, Member 1 (NR6A1, Accession NM_001489). Accordingly, utilities of VGAM2569 include diagnosis, prevention and treatment of diseases and clinical conditions associated with NR6A1. Roundabout Homolog 4, Magic Roundabout (Drosophila) (ROBO4, Accession NM_019055) is another VGAM2569 host target gene. ROBO4 BINDING SITE is HOST TARGET binding site found in the 3' untranslated region of mRNA encoded by ROBO4, corresponding to a HOST TARGET binding site such as BINDING SITE I, BINDING SITE II or BINDING SITE III. Table 2 illustrates the complementarity of the nucleotide sequences of ROBO4 BINDING SITE, designated SEQ ID:21134, to the nucleotide sequence of VGAM2569 RNA, herein designated VGAM RNA, also designated SEQ ID:5280.

Another function of VGAM2569 is therefore inhibition of Roundabout Homolog 4, Magic Roundabout (Drosophila) (ROBO4, Accession NM_019055). Accordingly, utilities of VGAM2569 include diagnosis, prevention and treatment of diseases and clinical conditions associated with ROBO4. LOC154860 (Accession XM_098623) is another VGAM2569 host target gene. LOC154860 BINDING SITE is HOST TARGET binding site found in the 5' untranslated region of mRNA encoded by LOC154860, corresponding to a HOST TARGET binding site such as BINDING SITE I, BINDING SITE II or BINDING SITE III. Table 2 illustrates the complementarity of the nucleotide sequences of LOC154860 BINDING SITE, designated SEQ ID:41733, to the nucleotide sequence of VGAM2569 RNA, herein designated VGAM RNA, also designated SEQ ID:5280.

Another function of VGAM2569 is therefore inhibition of LOC154860 (Accession XM_098623). Accordingly, utilities of VGAM2569 include diagnosis, prevention and treatment of diseases and clinical conditions associated with LOC154860. LOC220522 (Accession XM_018306) is another VGAM2569 host target gene. LOC220522 BINDING SITE is HOST TARGET binding site found in the 3' untranslated region of mRNA encoded by LOC220522, corresponding to a HOST TARGET binding site such as BINDING SITE I, BINDING SITE II or BINDING SITE III. Table 2 illustrates the complementarity of the nucleotide sequences of LOC220522 BINDING SITE, designated SEQ ID:30350, to the nucleotide sequence of VGAM2569 RNA, herein designated VGAM RNA, also designated SEQ ID:5280.

Another function of VGAM2569 is therefore inhibition of LOC220522 (Accession XM_018306). Accordingly, utilities of VGAM2569 include diagnosis, prevention and treatment of diseases and clinical conditions associated with LOC220522. LOC253596 (Accession XM_170934) is another VGAM2569 host target gene. LOC253596 BINDING SITE is HOST TARGET binding site found in the 5' untranslated region of mRNA encoded by LOC253596, corresponding to a HOST TARGET binding site such as BINDING SITE I, BINDING SITE II or BINDING SITE III. Table 2 illustrates the complementarity of the nucleotide sequences of LOC253596 BINDING SITE, designated SEQ ID:45721, to the nucleotide sequence of VGAM2569 RNA, herein designated VGAM RNA, also designated SEQ ID:5280.

Another function of VGAM2569 is therefore inhibition of LOC253596 (Accession XM_170934). Accordingly, utilities of VGAM2569 include diagnosis, prevention and treatment of diseases and clinical conditions associated with LOC253596. LOC93268 (Accession XM_050158) is another VGAM2569 host target gene. LOC93268 BINDING SITE is HOST TARGET binding site found in the 5' untranslated region of mRNA encoded by LOC93268, corresponding to a HOST TARGET binding site such as BINDING SITE I, BINDING SITE II or BINDING SITE III. Table 2 illustrates the complementarity of the nucleotide sequences of LOC93268 BINDING SITE, designated SEQ ID:35587, to the nucleotide sequence of VGAM2569 RNA, herein designated VGAM RNA, also designated SEQ ID:5280.

Another function of VGAM2569 is therefore inhibition of LOC93268 (Accession XM_050158). Accordingly, utilities of VGAM2569 include diagnosis, prevention and treatment of diseases and clinical conditions associated with LOC93268. FIG. 1 further provides a conceptual description of a novel bioinformatically detected viral gene of the present invention, referred to here as Viral Genomic Address Messenger 2570 (VGAM2570) viral gene, which modulates expression of respective host target genes thereof, the function and utility of which host target genes is known in the art.

VGAM2570 is a novel bioinformatically detected regulatory, non protein coding, viral micro RNA (miRNA) gene. The method by which VGAM2570 was detected is described hereinabove with reference to FIGS. 1-8.

VGAM2570 gene, herein designated VGAM GENE, is a viral gene contained in the genome of Triatoma Virus. VGAM2570 host target gene, herein designated VGAM HOST TARGET GENE, is a human gene contained in the human genome.

VGAM2570 gene encodes a VGAM2570 precursor RNA, herein designated VGAM PRECURSOR RNA. Similar to other miRNA genes, and unlike most ordinary genes, VGAM2570 precursor RNA does not encode a protein. A nucleotide sequence identical or highly similar to the nucleotide sequence of VGAM2570 precursor RNA is designated SEQ ID:2556, and is provided hereinbelow with reference to the sequence listing part. Nucleotide sequence SEQ ID:2556 is located at position 5274 relative to the genome of Triatoma Virus.

VGAM2570 precursor RNA folds onto itself, forming VGAM2570 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2570 folded precursor RNA into VGAM2570 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 72%) nucleotide sequence of VGAM2570 RNA is designated SEQ ID:5281, and is provided hereinbelow with reference to the sequence listing part.

VGAM2570 host target gene, herein designated VGAM HOST TARGET GENE, encodes a corresponding messenger RNA, VGAM2570 host target RNA, herein designated VGAM HOST TARGET RNA. VGAM2570 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2570 RNA, herein designated VGAM RNA, binds complementarily to one or more host target binding sites located in untranslated regions of VGAM2570 host target RNA, herein designated VGAM HOST TARGET RNA. This complementary binding is due to the fact that the nucleotide sequence of VGAM2570 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2570 RNA, herein designated VGAM RNA, may have a different number of host target binding sites in untranslated regions of a VGAM2570 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2570 RNA, herein designated VGAM RNA, to host target binding sites on VGAM2570 host target RNA, herein designated VGAM HOST TARGET RNA, such as BINDING SITE I, BINDING SITE II and BINDING SITE III, inhibits translation of VGAM2570 host target RNA into VGAM2570 host target protein, herein designated VGAM HOST TARGET PROTEIN. VGAM host target protein is therefore outlined by a broken line.

It is appreciated that VGAM2570 host target gene, herein designated VGAM HOST TARGET GENE, in fact represents a plurality of VGAM2570 host target genes. The mRNA of each one of this plurality of VGAM2570 host target genes comprises one or more host target binding sites, each having a nucleotide sequence which is at least partly complementary to VGAM2570 RNA, herein designated VGAM RNA, and which when bound by VGAM2570 RNA causes inhibition of translation of respective one or more VGAM2570 host target proteins.

It is further appreciated by one skilled in the art that the mode of translational inhibition illustrated by FIG. 1 with specific reference to translational inhibition exerted by VGAM2570 gene, herein designated VGAM GENE, on one or more VGAM2570 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2570 is inhibition of expression of host target genes, as part of a novel viral mechanism of attacking a host. Accordingly, utilities of VGAM2570 include diagnosis, prevention and treatment of viral infection by Triatoma Virus. Specific functions, and accordingly utilities, of VGAM2570 correlate with, and may be deduced from, the identity of the host target genes which VGAM2570 binds and inhibits, and the function of these host target genes, as elaborated hereinbelow.

Nucleotide sequences of the VGAM2570 precursor RNA, herein designated VGAM PRECURSOR RNA, and of the 'diced' VGAM2570 RNA, herein designated VGAM RNA, and a schematic representation of the secondary folding of VGAM2570 folded precursor RNA, herein designated VGAM FOLDED PRECURSOR RNA, of VGAM2570 are further described hereinbelow with reference to Table 1.

Nucleotide sequences of host target binding sites, such as BINDING SITE-I, BINDING SITE-II and BINDING SITE-III of FIG. 1, found on VGAM2570 host target RNA, and schematic representation of the complementarity of each of these host target binding sites to VGAM2570 RNA, herein designated VGAM RNA, are described hereinbelow with reference to Table 2.

As mentioned hereinabove with reference to FIG. 1, a function of VGAM2570 gene, herein designated VGAM is inhibition of expression of VGAM2570 target genes. It is appreciated that specific functions, and accordingly utilities, of VGAM2570 correlate with, and may be deduced from, the identity of the target genes which VGAM2570 binds and inhibits, and the function of these target genes, as elaborated hereinbelow.

Fibrinogen, A Alpha Polypeptide (FGA, Accession NM_000508) is a VGAM2570 host target gene. FGA BINDING SITE is HOST TARGET binding site found in the 3' untranslated region of mRNA encoded by FGA, corresponding to a HOST TARGET binding site such as BINDING SITE I, BINDING SITE II or BINDING SITE III. Table 2 illustrates the complementarity of the nucleotide sequences of FGA BINDING SITE, designated SEQ ID:6119, to the nucleotide sequence of VGAM2570 RNA, herein designated VGAM RNA, also designated SEQ ID:5281.

A function of VGAM2570 is therefore inhibition of Fibrinogen, A Alpha Polypeptide (FGA, Accession NM_000508). Accordingly, utilities of VGAM2570 include diagnosis, prevention and treatment of diseases and clinical conditions associated with FGA. XPO5 (Accession XM_166042) is another VGAM2570 host target gene. XPO5 BINDING SITE is HOST TARGET binding site found in the 3' untranslated region of mRNA encoded by XPO5, corresponding to a HOST TARGET binding site such as BINDING SITE I, BINDING SITE II or BINDING SITE III. Table 2 illustrates the complementarity of the nucleotide sequences of XPO5 BINDING SITE, designated SEQ ID:43839, to the nucleotide sequence of VGAM2570 RNA, herein designated VGAM RNA, also designated SEQ ID:5281.

Another function of VGAM2570 is therefore inhibition of XPO5 (Accession XM_166042). Accordingly, utilities of VGAM2570 include diagnosis, prevention and treatment of diseases and clinical conditions associated with XPO5. LOC51333 (Accession NM_016643) is another VGAM2570 host target gene. LOC51333 BINDING SITE is HOST TARGET binding site found in the 3' untranslated region of mRNA encoded by LOC51333, corresponding to a HOST TARGET binding site such as BINDING SITE I, BINDING SITE II or BINDING SITE III. Table 2 illustrates the complementarity of the nucleotide sequences of LOC51333 BINDING SITE, designated SEQ ID:18750, to the nucleotide sequence of VGAM2570 RNA, herein designated VGAM RNA, also designated SEQ ID:5281.

Another function of VGAM2570 is therefore inhibition of LOC51333 (Accession NM_016643). Accordingly, utilities of VGAM2570 include diagnosis, prevention and treatment of diseases and clinical conditions associated with LOC51333. FIG. 1 further provides a conceptual description of a novel bioinformatically detected viral gene of the present invention, referred to here as Viral Genomic Address Messenger 2571 (VGAM2571) viral gene, which modulates expression of respective host target genes thereof, the function and utility of which host target genes is known in the art.

VGAM2571 is a novel bioinformatically detected regulatory, non protein coding, viral micro RNA (miRNA) gene. The method by which VGAM2571 was detected is described hereinabove with reference to FIGS. 1-8.

VGAM2571 gene, herein designated VGAM GENE, is a viral gene contained in the genome of Triatoma Virus. VGAM2571 host target gene, herein designated VGAM HOST TARGET GENE, is a human gene contained in the human genome.

VGAM2571 gene encodes a VGAM2571 precursor RNA, herein designated VGAM PRECURSOR RNA. Similar to other miRNA genes, and unlike most ordinary genes, VGAM2571 precursor RNA does not encode a protein. A nucleotide sequence identical or highly similar to the nucleotide sequence of VGAM2571 precursor RNA is designated SEQ ID:2557, and is provided hereinbelow with reference to the sequence listing part. Nucleotide sequence SEQ ID:2557 is located at position 5836 relative to the genome of Triatoma Virus.

VGAM2571 precursor RNA folds onto itself, forming VGAM2571 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2571 folded precursor RNA into VGAM2571 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2571 RNA is designated SEQ ID:5282, and is provided hereinbelow with reference to the sequence listing part.

VGAM2571 host target gene, herein designated VGAM HOST TARGET GENE, encodes a corresponding messenger RNA, VGAM2571 host target RNA, herein designated VGAM HOST TARGET RNA. VGAM2571 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2571 RNA, herein designated VGAM RNA, binds complementarily to one or more host target binding sites located in untranslated regions of VGAM2571 host target RNA, herein designated VGAM HOST TARGET RNA. This complementary binding is due to the fact that the nucleotide sequence of VGAM2571 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2571 RNA, herein designated VGAM RNA, may have a different number of host target binding sites in untranslated regions of a VGAM2571 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2571 RNA, herein designated VGAM RNA, to host target binding sites on VGAM2571 host target RNA, herein designated VGAM HOST TARGET RNA, such as BINDING SITE I, BINDING SITE II and BINDING SITE III, inhibits translation of VGAM2571 host target RNA into VGAM2571 host target protein, herein designated VGAM HOST TARGET PROTEIN. VGAM host target protein is therefore outlined by a broken line.

It is appreciated that VGAM2571 host target gene, herein designated VGAM HOST TARGET GENE, in fact represents a plurality of VGAM2571 host target genes. The mRNA of each one of this plurality of VGAM2571 host target genes comprises one or more host target binding sites, each having a nucleotide sequence which is at least partly complementary to VGAM2571 RNA, herein designated VGAM RNA, and which when bound by VGAM2571 RNA causes inhibition of translation of respective one or more VGAM2571 host target proteins.

It is further appreciated by one skilled in the art that the mode of translational inhibition illustrated by FIG. 1 with specific reference to translational inhibition exerted by VGAM2571 gene, herein designated VGAM GENE, on one or more VGAM2571 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2571 is inhibition of expression of host target genes, as part of a novel viral mechanism of attacking a host. Accordingly, utilities of VGAM2571 include diagnosis, prevention and treatment of viral infection by Triatoma Virus. Specific functions, and accordingly utilities, of VGAM2571 correlate with, and may be deduced from, the identity of the host target genes which VGAM2571 binds and inhibits, and the function of these host target genes, as elaborated hereinbelow.

Nucleotide sequences of the VGAM2571 precursor RNA, herein designated VGAM PRECURSOR RNA, and of the 'diced' VGAM2571 RNA, herein designated VGAM RNA, and a schematic representation of the secondary folding of VGAM2571 folded precursor RNA, herein designated VGAM FOLDED PRECURSOR RNA, of VGAM2571 are further described hereinbelow with reference to Table 1.

Nucleotide sequences of host target binding sites, such as BINDING SITE-I, BINDING SITE-II and BINDING SITE-III of FIG. 1, found on VGAM2571 host target RNA, and schematic representation of the complementarity of each of these host target binding sites to VGAM2571 RNA, herein designated VGAM RNA, are described hereinbelow with reference to Table 2.

As mentioned hereinabove with reference to FIG. 1, a function of VGAM2571 gene, herein designated VGAM is inhibition of expression of VGAM2571 target genes. It is appreciated that specific functions, and accordingly utilities, of VGAM2571 correlate with, and may be deduced from, the identity of the target genes which VGAM2571 binds and inhibits, and the function of these target genes, as elaborated hereinbelow.

Ring Finger Protein (C3H2C3 type) 6 (RNF6, Accession NM_005977) is a VGAM2571 host target gene. RNF6 BINDING SITE is HOST TARGET binding site found in the 3' untranslated region of mRNA encoded by RNF6, corresponding to a HOST TARGET binding site such as BINDING SITE I, BINDING SITE II or BINDING SITE III. Table 2 illustrates the complementarity of the nucleotide sequences of RNF6 BINDING SITE, designated SEQ ID:12603, to the nucleotide sequence of VGAM2571 RNA, herein designated VGAM RNA, also designated SEQ ID:5282.

A function of VGAM2571 is therefore inhibition of Ring Finger Protein (C3H2C3 type) 6 (RNF6, Accession NM_005977), a gene which is a RING finger protein, may be a tumor suppressor. Accordingly, utilities of VGAM2571 include diagnosis, prevention and treatment of diseases and clinical conditions associated with RNF6. The function of RNF6 has been established by previous studies. By FISH and physical mapping, Macdonald et al. (1999) determined that RNF6 is located at 13q12.2 close to marker D13S1121, and that it is oriented from telomere to centromere. RNF6 was not disrupted by the t (4;13) translocation in the case of myeloproliferative disorder studied by Macdonald et al. (1999). MOLECULAR GENETICS By loss of heterozygosity (LOH) studies in esophageal squamous cell carcinoma (ESCC; 133239), Li et al. (2001) identified an 800-kb region on chromosome 13q12.11 as the site of a potential tumor suppressor gene. Lo et al. (2002) screened the ATP8A2 (OMIM Ref. No. 605870) and RNF6 genes for mutations in 24 ESCC primary tumors and 16 tumor cell lines by direct sequencing of the PCR products that were amplified from each exon. They detected no mutations in ATP8A2, but identified 3 somatic mutations in the RNF6 gene in the ESCC primary tumors (604242.0001-604242.0003); 1 mutation was also found in a tumor cell line. Lo et al. (2002) concluded that RNF6 may be a tumor suppressor gene involved in the pathogenesis of ESCC.

Full details of the abovementioned studies are described in the following publications, the disclosure of which are hereby incorporated by reference:

Lo, H. S.; Hu, N.; Gere, S.; Lu, N.; Su, H.; Goldstein, A. M.; Taylor, P. R.; Lee, M. P.: Identification of somatic mutations of the RNF6 gene in human esophageal squamous cell carcinoma. Cancer Res. 62:4191-4193, 2002; and Macdonald, D. H. C.; Lahiri, D.; Sampath, A.; Chase, A.; Sohal, J.; Cross, N. C. P.: Cloning and characterization of RNF6, a novel RING finger gene mapping to 13q12. Genomics 58:94-97, 1.

Further studies establishing the function and utilities of RNF6 are found in John Hopkins OMIM database record ID 604242, and in sited publications numbered 5366-465 and 691 listed in the bibliography section hereinbelow, which are also hereby incorporated by reference. BCL2-associated Athanogene 5 (BAG5, Accession NM_004873) is another VGAM2571 host target gene. BAG5 BINDING SITE is HOST TARGET binding site found in the 3' untranslated region of mRNA encoded by BAG5, corresponding to a HOST TARGET binding site such as BINDING SITE I, BINDING SITE II or BINDING SITE III. Table 2 illustrates the complementarity of the nucleotide sequences of BAG5 BINDING SITE, designated SEQ ID:11301, to the nucleotide sequence of VGAM2571 RNA, herein designated VGAM RNA, also designated SEQ ID:5282.

Another function of VGAM2571 is therefore inhibition of BCL2-associated Athanogene 5 (BAG5, Accession NM_004873). Accordingly, utilities of VGAM2571 include diagnosis, prevention and treatment of diseases and clinical conditions associated with BAG5. LOC143425 (Accession XM_113695) is another VGAM2571 host target gene. LOC143425 BINDING SITE is HOST TARGET binding site found in the 3' untranslated region of mRNA encoded by LOC143425, corresponding to a HOST TARGET binding site such as BINDING SITE I, BINDING SITE II or BINDING SITE III. Table 2 illustrates the complementarity of the nucleotide sequences of LOC143425 BINDING SITE, designated SEQ ID:42349, to the nucleotide sequence of VGAM2571 RNA, herein designated VGAM RNA, also designated SEQ ID:5282.

Another function of VGAM2571 is therefore inhibition of LOC143425 (Accession XM_113695). Accordingly, utilities of VGAM2571 include diagnosis, prevention and treatment of diseases and clinical conditions associated with LOC143425. LOC220936 (Accession XM_166137) is another VGAM2571 host target gene. LOC220936 BINDING SITE is HOST TARGET binding site found in the 3' untranslated region of mRNA encoded by LOC220936, corresponding to a HOST TARGET binding site such as BINDING SITE I, BINDING SITE II or BINDING SITE III. Table 2 illustrates the complementarity of the nucleotide sequences of LOC220936 BINDING SITE, designated SEQ ID:43931, to the nucleotide sequence of VGAM2571 RNA, herein designated VGAM RNA, also designated SEQ ID:5282.

Another function of VGAM2571 is therefore inhibition of LOC220936 (Accession XM_166137). Accordingly, utilities of VGAM2571 include diagnosis, prevention and treatment of diseases and clinical conditions associated with LOC220936. FIG. 1 further provides a conceptual description of a novel bioinformatically detected viral gene of the present invention, referred to here as Viral Genomic Address Messenger 2572 (VGAM2572) viral gene, which modulates expression of respective host target genes thereof, the function and utility of which host target genes is known in the art.

VGAM2572 is a novel bioinformatically detected regulatory, non protein coding, viral micro RNA (miRNA) gene. The method by which VGAM2572 was detected is described hereinabove with reference to FIGS. 1-8.

VGAM2572 gene, herein designated VGAM GENE, is a viral gene contained in the genome of Triatoma Virus. VGAM2572 host target gene, herein designated VGAM HOST TARGET GENE, is a human gene contained in the human genome.

VGAM2572 gene encodes a VGAM2572 precursor RNA, herein designated VGAM PRECURSOR RNA. Similar to other miRNA genes, and unlike most ordinary genes, VGAM2572 precursor RNA does not encode a protein. A nucleotide sequence identical or highly similar to the nucleotide sequence of VGAM2572 precursor RNA is designated SEQ ID:2558, and is provided hereinbelow with reference to the sequence listing part. Nucleotide sequence SEQ ID:2558 is located at position 3076 relative to the genome of Triatoma Virus.

VGAM2572 precursor RNA folds onto itself, forming VGAM2572 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2572 folded precursor RNA into VGAM2572 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM2572 RNA is designated SEQ ID:5283, and is provided hereinbelow with reference to the sequence listing part.

VGAM2572 host target gene, herein designated VGAM HOST TARGET GENE, encodes a corresponding messenger RNA, VGAM2572 host target RNA, herein designated VGAM HOST TARGET RNA. VGAM2572 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2572 RNA, herein designated VGAM RNA, binds complementarily to one or more host target binding sites located in untranslated regions of VGAM2572 host target RNA, herein designated VGAM HOST TARGET RNA. This complementary binding is due to the fact that the nucleotide sequence of VGAM2572 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2572 RNA, herein designated VGAM RNA, may have a different number of host target binding sites in untranslated regions of a VGAM2572 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2572 RNA, herein designated VGAM RNA, to host target binding sites on VGAM2572 host target RNA, herein designated VGAM HOST TARGET RNA, such as BINDING SITE I, BINDING SITE II and BINDING SITE III, inhibits translation of VGAM2572 host target RNA into VGAM2572 host target protein, herein designated VGAM HOST TARGET PROTEIN. VGAM host target protein is therefore outlined by a broken line.

It is appreciated that VGAM2572 host target gene, herein designated VGAM HOST TARGET GENE, in fact represents a plurality of VGAM2572 host target genes. The mRNA of each one of this plurality of VGAM2572 host target genes comprises one or more host target binding sites, each having a nucleotide sequence which is at least partly complementary to VGAM2572 RNA, herein designated VGAM RNA, and which when bound by VGAM2572 RNA causes inhibition of translation of respective one or more VGAM2572 host target proteins.

It is further appreciated by one skilled in the art that the mode of translational inhibition illustrated by FIG. 1 with specific reference to translational inhibition exerted by VGAM2572 gene, herein designated VGAM GENE, on one or more VGAM2572 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2572 is inhibition of expression of host target genes, as part of a novel viral mechanism of attacking a host. Accordingly, utilities of VGAM2572 include diagnosis, prevention and treatment of viral infection by Triatoma Virus. Specific functions, and accordingly utilities, of VGAM2572 correlate with, and may be deduced from, the identity of the host target genes which VGAM2572 binds and inhibits, and the function of these host target genes, as elaborated hereinbelow.

Nucleotide sequences of the VGAM2572 precursor RNA, herein designated VGAM PRECURSOR RNA, and of the 'diced' VGAM2572 RNA, herein designated VGAM RNA, and a schematic representation of the secondary folding of VGAM2572 folded precursor RNA, herein designated VGAM FOLDED PRECURSOR RNA, of VGAM2572 are further described hereinbelow with reference to Table 1.

Nucleotide sequences of host target binding sites, such as BINDING SITE-I, BINDING SITE-II and BINDING SITE-III of FIG. 1, found on VGAM2572 host target RNA, and schematic representation of the complementarity of each of these host target binding sites to VGAM2572 RNA, herein designated VGAM RNA, are described hereinbelow with reference to Table 2.

As mentioned hereinabove with reference to FIG. 1, a function of VGAM2572 gene, herein designated VGAM is inhibition of expression of VGAM2572 target genes. It is appreciated that specific functions, and accordingly utilities, of VGAM2572 correlate with, and may be deduced from, the identity of the target genes which VGAM2572 binds and inhibits, and the function of these target genes, as elaborated hereinbelow.

LENG4 (Accession NM_024298) is a VGAM2572 host target gene. LENG4 BINDING SITE is HOST TARGET binding site found in the 3' untranslated region of mRNA encoded by LENG4, corresponding to a HOST TARGET binding site such as BINDING SITE I, BINDING SITE II or BINDING SITE III. Table 2 illustrates the complementarity of the nucleotide sequences of LENG4 BINDING SITE, designated SEQ ID:23582, to the nucleotide sequence of VGAM2572 RNA, herein designated VGAM RNA, also designated SEQ ID:5283.

A function of VGAM2572 is therefore inhibition of LENG4 (Accession NM_024298), a gene which may be a transmembrane protein. Accordingly, utilities of VGAM2572 include diagnosis, prevention and treatment of diseases and clinical conditions associated with LENG4. The function of LENG4 and its association with various diseases and clinical conditions, has been established by previous studies, as described hereinabove with reference to VGAM259. Mucin 3B (MUC3B, Accession XM_168578) is another VGAM2572 host target gene. MUC3B BINDING SITE is HOST TARGET binding site found in the 3" untranslated region of mRNA encoded by MUC3B, corresponding to a HOST TARGET binding site such as BINDING SITE I, BINDING SITE II or BINDING SITE III. Table 2 illustrates the complementarity of the nucleotide sequences of MUC3B BINDING SITE, designated SEQ ID:45255, to the nucleotide sequence of VGAM2572 RNA, herein designated VGAM RNA, also designated SEQ ID:5283.

Another function of VGAM2572 is therefore inhibition of Mucin 3B (MUC3B, Accession XM_168578), a gene which provides a protective, lubricating barrier against particles and infectious agents at mucosal surfaces. Accordingly, utilities of VGAM2572 include diagnosis, prevention and treatment of diseases and clinical conditions associated with MUC3B. The function of MUC3B and its association with various diseases and clinical conditions, has been established by previous studies, as described hereinabove with reference to VGAM55. Phosphodiesterase 4D, CAMP-specific (phosphodiesterase E3 dunce homolog, Drosophila) (PDE4D, Accession XM_056815) is another VGAM2572 host target gene. PDE4D BINDING SITE is HOST TARGET binding site found in the 3' untranslated region of mRNA encoded by PDE4D, corresponding to a HOST TARGET binding site such as BINDING SITE I, BINDING SITE II or BINDING SITE III. Table 2 illustrates the complementarity of the nucleotide sequences of PDE4D BINDING SITE, designated SEQ ID:36435, to the nucleotide sequence of VGAM2572 RNA, herein designated VGAM RNA, also designated SEQ ID:5283.

Another function of VGAM2572 is therefore inhibition of Phosphodiesterase 4D, CAMP-specific (phosphodiesterase E3 dunce homolog, Drosophila) (PDE4D, Accession XM_056815), a gene which has similarity to Drosophila dnc, which is the affected protein in learning and memory mutant dunce. Accordingly, utilities of VGAM2572 include diagnosis, prevention and treatment of diseases and clinical conditions associated with PDE4D. The function of PDE4D and its association with various diseases and clinical conditions, has been established by previous studies, as described hereinabove with reference to VGAM180. Runt-related Transcription Factor 1 (acute myeloid leukemia 1; aml1 oncogene) (RUNX1, Accession NM_001754) is another VGAM2572 host target gene. RUNX1 BINDING SITE is HOST TARGET binding site found in the 3' untranslated region of mRNA encoded by RUNX1, corresponding to a HOST TARGET binding site such as BINDING SITE I, BINDING SITE II or BINDING SITE III. Table 2 illustrates the complementarity of the nucleotide sequences of RUNX1 BINDING SITE, designated SEQ ID:7502, to the nucleotide sequence of VGAM2572 RNA, herein designated VGAM RNA, also designated SEQ ID:5283.

Another function of VGAM2572 is therefore inhibition of Runt-related Transcription Factor 1 (acute myeloid leukemia 1; aml1 oncogene) (RUNX1, Accession NM_001754). Accordingly, utilities of VGAM2572 include diagnosis, prevention and treatment of diseases and clinical conditions associated with RUNX1. Tyrosine 3-monooxygenase/tryptophan 5-monooxygenase Activation Protein, Zeta Polypeptide (YWHAZ, Accession NM_003406) is another VGAM2572 host target gene. YWHAZ BINDING SITE is HOST TARGET binding site found in the 3' untranslated region of mRNA encoded by YWHAZ, corresponding to a HOST TARGET binding site such as BINDING SITE I, BINDING SITE II or BINDING SITE III. Table 2 illustrates the complementarity of the nucleotide sequences of YWHAZ BINDING SITE, designated SEQ ID:9444, to the nucleotide sequence of VGAM2572 RNA, herein designated VGAM RNA, also designated SEQ ID:5283.

Another function of VGAM2572 is therefore inhibition of Tyrosine 3-monooxygenase/tryptophan 5-monooxygenase Activation Protein, Zeta Polypeptide (YWHAZ, Accession NM_003406), a gene which mediates signal transduction by binding to phosphorylated serine residues on a variety of signaling molecules. Accordingly, utilities of VGAM2572 include diagnosis, prevention and treatment of diseases and clinical conditions associated with YWHAZ. The function of YWHAZ and its association with various diseases and clinical conditions, has been established by previous studies, as described hereinabove with reference to VGAM43. FEM-2 (Accession NM_014634) is another VGAM2572 host target gene. FEM-2 BINDING SITE is HOST TARGET binding site found in the 3' untranslated region of mRNA encoded by FEM-2, corresponding to a HOST TARGET binding site such as BINDING SITE I, BINDING SITE II or BINDING SITE III. Table 2 illustrates the complementarity of the nucleotide sequences of FEM-2 BINDING SITE, designated SEQ ID:16009, to the nucleotide sequence of VGAM2572 RNA, herein designated VGAM RNA, also designated SEQ ID:5283.

Another function of VGAM2572 is therefore inhibition of FEM-2 (Accession NM_014634). Accordingly, utilities of VGAM2572 include diagnosis, prevention and treatment of diseases and clinical conditions associated with FEM-2. FLJ20514 (Accession NM_017856) is another VGAM2572 host target gene. FLJ20514 BINDING SITE is HOST TARGET binding site found in the 3' untranslated region of mRNA encoded by FLJ20514, corresponding to a HOST TARGET binding site such as BINDING SITE I, BINDING SITE II or BINDING SITE III. Table 2 illustrates the complementarity of the nucleotide sequences of FLJ20514 BINDING SITE, designated SEQ ID:19532, to the nucleotide sequence of VGAM2572 RNA, herein designated VGAM RNA, also designated SEQ ID:5283.

Another function of VGAM2572 is therefore inhibition of FLJ20514 (Accession NM_017856). Accordingly, utilities of VGAM2572 include diagnosis, prevention and treatment of diseases and clinical conditions associated with FLJ20514. G4 (Accession XM_165712) is another VGAM2572 host target gene. G4 BINDING SITE is HOST TARGET binding site found in the 5' untranslated region of mRNA encoded by G4, corresponding to a HOST TARGET binding site such as BINDING SITE I, BINDING SITE II or BINDING SITE III. Table 2 illustrates the complementarity of the nucleotide sequences of G4 BINDING SITE, designated SEQ ID:43735, to the nucleotide sequence of VGAM2572 RNA, herein designated VGAM RNA, also designated SEQ ID:5283.

Another function of VGAM2572 is therefore inhibition of G4 (Accession XM_165712). Accordingly, utilities of VGAM2572 include diagnosis, prevention and treatment of diseases and clinical conditions associated with G4. KIAA1036 (Accession NM_014909) is another VGAM2572 host target gene. KIAA1036 BINDING SITE is HOST TARGET binding site found in the 3' untranslated region of mRNA encoded by KIAA1036, corresponding to a HOST TARGET binding site such as BINDING SITE I, BINDING SITE II or BINDING SITE III. Table 2 illustrates the complementarity of the nucleotide sequences of KIAA1036 BINDING SITE, designated SEQ ID:17125, to the nucleotide sequence of VGAM2572 RNA, herein designated VGAM RNA, also designated SEQ ID:5283.

Another function of VGAM2572 is therefore inhibition of KIAA1036 (Accession NM_014909). Accordingly, utilities of VGAM2572 include diagnosis, prevention and treatment of diseases and clinical conditions associated with KIAA1036. KIAA1340 (Accession XM_044836) is another VGAM2572 host target gene. KIAA1340 BINDING SITE is HOST TARGET binding site found in the 3' untranslated region of mRNA encoded by KIAA1340, corresponding to a HOST TARGET binding site such as BINDING SITE I, BINDING SITE II or BINDING SITE III. Table 2 illustrates the complementarity of the nucleotide sequences of KIAA1340 BINDING SITE, designated SEQ ID:34298, to the nucleotide sequence of VGAM2572 RNA, herein designated VGAM RNA, also designated SEQ ID:5283.

Another function of VGAM2572 is therefore inhibition of KIAA1340 (Accession XM_044836). Accordingly, utilities of VGAM2572 include diagnosis, prevention and treatment of diseases and clinical conditions associated with KIAA1340. Protein Tyrosine Phosphatase Type IVA, Member 1 (PTP4A1, Accession NM_003463) is another VGAM2572 host target gene. PTP4A1 BINDING SITE is HOST TARGET binding site found in the 3' untranslated region of mRNA encoded by PTP4A1, corresponding to a HOST TARGET binding site such as BINDING SITE I, BINDING SITE II or BINDING SITE III. Table 2 illustrates the complementarity of the nucleotide sequences of PTP4A1 BINDING SITE, designated SEQ ID:9534, to the nucleotide sequence of VGAM2572 RNA, herein designated VGAM RNA, also designated SEQ ID:5283.

Another function of VGAM2572 is therefore inhibition of Protein Tyrosine Phosphatase Type IVA, Member 1 (PTP4A1, Accession NM_003463). Accordingly, utilities of VGAM2572 include diagnosis, prevention and treatment of diseases and clinical conditions associated with PTP4A1. Ring Finger Protein (C3HC4 type) 8 (RNF8, Accession NM_003958) is another VGAM2572 host target gene. RNF8 BINDING SITE is HOST TARGET binding site found in the 3' untranslated region of mRNA encoded by RNF8, corresponding to a HOST TARGET binding site such as BINDING SITE I, BINDING SITE II or BINDING SITE III. Table 2 illustrates the complementarity of the nucleotide sequences of RNF8 BINDING SITE, designated SEQ ID:10097, to the nucleotide sequence of VGAM2572 RNA, herein designated VGAM RNA, also designated SEQ ID:5283.

Another function of VGAM2572 is therefore inhibition of Ring Finger Protein (C3HC4 type) 8 (RNF8, Accession NM_003958). Accordingly, utilities of VGAM2572 include diagnosis, prevention and treatment of diseases and clinical conditions associated with RNF8. LOC219376 (Accession XM_168147) is another VGAM2572 host target gene. LOC219376 BINDING SITE is HOST TARGET binding site found in the 5' untranslated region of mRNA encoded by LOC219376, corresponding to a HOST TARGET binding site such as BINDING SITE I, BINDING SITE II or BINDING SITE III. Table 2 illustrates the complementarity of the nucleotide sequences of LOC219376 BINDING SITE, designated SEQ ID:45069, to the nucleotide sequence of VGAM2572 RNA, herein designated VGAM RNA, also designated SEQ ID:5283.

Another function of VGAM2572 is therefore inhibition of LOC219376 (Accession XM_168147). Accordingly, utilities of VGAM2572 include diagnosis, prevention and treatment of diseases and clinical conditions associated with LOC219376. LOC257554 (Accession XM_175149) is another VGAM2572 host target gene. LOC257554 BINDING SITE is HOST TARGET binding site found in the 5' untranslated region of mRNA encoded by LOC257554, corresponding to a HOST TARGET binding site such as BINDING SITE I, BINDING SITE II or BINDING SITE III. Table 2 illustrates the complementarity of the nucleotide sequences of LOC257554 BINDING SITE, designated SEQ ID:46642, to the nucleotide sequence of VGAM2572 RNA, herein designated VGAM RNA, also designated SEQ ID:5283.

Another function of VGAM2572 is therefore inhibition of LOC257554 (Accession XM_175149). Accordingly, utilities of VGAM2572 include diagnosis, prevention and treatment of diseases and clinical conditions associated with LOC257554. FIG. 1 further provides a conceptual description of a novel bioinformatically detected viral gene of the present invention, referred to here as Viral Genomic Address Messenger 2573 (VGAM2573) viral gene, which modulates expression of respective host target genes thereof, the function and utility of which host target genes is known in the art.

VGAM2573 is a novel bioinformatically detected regulatory, non protein coding, viral micro RNA (miRNA) gene. The method by which VGAM2573 was detected is described hereinabove with reference to FIGS. 1-8.

VGAM2573 gene, herein designated VGAM GENE, is a viral gene contained in the genome of Triatoma Virus. VGAM2573 host target gene, herein designated VGAM HOST TARGET GENE, is a human gene contained in the human genome.

VGAM2573 gene encodes a VGAM2573 precursor RNA, herein designated VGAM PRECURSOR RNA. Similar to other miRNA genes, and unlike most ordinary genes, VGAM2573 precursor RNA does not encode a protein. A nucleotide sequence identical or highly similar to the nucleotide sequence of VGAM2573 precursor RNA is designated SEQ ID:2559, and is provided hereinbelow with reference to the sequence listing part. Nucleotide sequence SEQ ID:2559 is located at position 3368 relative to the genome of Triatoma Virus.

VGAM2573 precursor RNA folds onto itself, forming VGAM2573 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2573 folded precursor RNA into VGAM2573 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2573 RNA is designated SEQ ID:5284, and is provided hereinbelow with reference to the sequence listing part.

VGAM2573 host target gene, herein designated VGAM HOST TARGET GENE, encodes a corresponding messenger RNA, VGAM2573 host target RNA, herein designated VGAM HOST TARGET RNA. VGAM2573 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2573 RNA, herein designated VGAM RNA, binds complementarily to one or more host target binding sites located in untranslated regions of VGAM2573 host target RNA, herein designated VGAM HOST TARGET RNA. This complementary binding is due to the fact that the nucleotide sequence of VGAM2573 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2573 RNA, herein designated VGAM RNA, may have a different number of host target binding sites in untranslated regions of a VGAM2573 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2573 RNA, herein designated VGAM RNA, to host target binding sites on VGAM2573 host target RNA, herein designated VGAM HOST TARGET RNA, such as BINDING SITE I, BINDING SITE II and BINDING SITE III, inhibits translation of VGAM2573 host target RNA into VGAM2573 host target protein, herein designated VGAM HOST TARGET PROTEIN. VGAM host target protein is therefore outlined by a broken line.

It is appreciated that VGAM2573 host target gene, herein designated VGAM HOST TARGET GENE, in fact represents a plurality of VGAM2573 host target genes. The mRNA of each one of this plurality of VGAM2573 host target genes comprises one or more host target binding sites, each having a nucleotide sequence which is at least partly complementary to VGAM2573 RNA, herein designated VGAM RNA, and which when bound by VGAM2573 RNA causes inhibition of translation of respective one or more VGAM2573 host target proteins.

It is further appreciated by one skilled in the art that the mode of translational inhibition illustrated by FIG. 1 with specific reference to translational inhibition exerted by VGAM2573 gene, herein designated VGAM GENE, on one or more VGAM2573 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2573 is inhibition of expression of host target genes, as part of a novel viral mechanism of attacking a host. Accordingly, utilities of VGAM2573 include diagnosis, prevention and treatment of viral infection by Triatoma Virus. Specific functions, and accordingly utilities, of VGAM2573 correlate with, and may be deduced from, the identity of the host target genes which VGAM2573 binds and inhibits, and the function of these host target genes, as elaborated hereinbelow.

Nucleotide sequences of the VGAM2573 precursor RNA, herein designated VGAM PRECURSOR RNA, and of the 'diced' VGAM2573 RNA, herein designated VGAM RNA, and a schematic representation of the secondary folding of VGAM2573 folded precursor RNA, herein designated VGAM FOLDED PRECURSOR RNA, of VGAM2573 are further described hereinbelow with reference to Table 1.

Nucleotide sequences of host target binding sites, such as BINDING SITE-I, BINDING SITE-II and BINDING SITE-III of FIG. 1, found on VGAM2573 host target RNA, and schematic representation of the complementarity of each of these host target binding sites to VGAM2573 RNA, herein designated VGAM RNA, are described hereinbelow with reference to Table 2.

As mentioned hereinabove with reference to FIG. 1, a function of VGAM2573 gene, herein designated VGAM is inhibition of expression of VGAM2573 target genes. It is appreciated that specific functions, and accordingly utilities, of VGAM2573 correlate with, and may be deduced from, the identity of the target genes which VGAM2573 binds and inhibits, and the function of these target genes, as elaborated hereinbelow.

Contactin 3 (plasmacytoma associated) (CNTN3, Accession XM_039627) is a VGAM2573 host target gene. CNTN3 BINDING SITE is HOST TARGET binding site found in the 3' untranslated region of mRNA encoded by CNTN3, corresponding to a HOST TARGET binding site such as BINDING SITE I, BINDING SITE II or BINDING SITE III. Table 2 illustrates the complementarity of the nucleotide sequences of CNTN3 BINDING SITE, designated SEQ ID:33132, to the nucleotide sequence of VGAM2573 RNA, herein designated VGAM RNA, also designated SEQ ID:5284.

A function of VGAM2573 is therefore inhibition of Contactin 3 (plasmacytoma associated) (CNTN3, Accession XM_039627), a gene which may play a role in the initial growth and guidance of axons. Accordingly, utilities of VGAM2573 include diagnosis, prevention and treatment of diseases and clinical conditions associated with CNTN3. The function of CNTN3 and its association with various diseases and clinical conditions, has been established by previous studies, as described hereinabove with reference to VGAM420. C-reactive Protein, Pentraxin-related (CRP, Accession XM_049673) is another VGAM2573 host target gene. CRP BINDING SITE is HOST TARGET binding site found in the 3' untranslated region of mRNA encoded by CRP, corresponding to a HOST TARGET binding site such as BINDING SITE I, BINDING SITE II or BINDING SITE III. Table 2 illustrates the complementarity of the nucleotide sequences of CRP BINDING SITE, designated SEQ ID:35463, to the nucleotide sequence of VGAM2573 RNA, herein designated VGAM RNA, also designated SEQ ID:5284.

Another function of VGAM2573 is therefore inhibition of C-reactive Protein, Pentraxin-related (CRP, Accession XM_049673). Accordingly, utilities of VGAM2573 include diagnosis, prevention and treatment of diseases and clinical conditions associated with CRP. Ectonucleoside Triphosphate Diphosphohydrolase 6 (putative function) (ENTPD6, Accession NM_001247) is another VGAM2573 host target gene. ENTPD6 BINDING SITE is HOST TARGET binding site found in the 3' untranslated region of mRNA encoded by ENTPD6, corresponding to a HOST TARGET binding site such as BINDING SITE I, BINDING SITE II or BINDING SITE III. Table 2 illustrates the complementarity of the nucleotide sequences of ENTPD6 BINDING SITE, designated SEQ ID:6919, to the nucleotide sequence of VGAM2573 RNA, herein designated VGAM RNA, also designated SEQ ID:5284.

Another function of VGAM2573 is therefore inhibition of Ectonucleoside Triphosphate Diphosphohydrolase 6 (putative function) (ENTPD6, Accession NM_001247), a gene which might support glycosylation reactions in the golgi apparatus and, when released from cells, might catalyze the hydrolysis of extracellular nucleotides. Accordingly, utilities of VGAM2573 include diagnosis, prevention and treatment of diseases and clinical conditions associated with ENTPD6. The function of ENTPD6 and its association with various diseases and clinical conditions, has been established by previous studies, as described hereinabove with reference to VGAM827.5-methyltetrahydrofolate-homocysteine Methyltransferase (MTR, Accession NM_000254) is another VGAM2573 host target gene. MTR BINDING SITE is HOST TARGET binding site found in the 3' untranslated region of mRNA encoded by MTR, corresponding to a HOST TARGET binding site such as BINDING SITE I, BINDING SITE II or BINDING SITE III. Table 2 illustrates the complementarity of the nucleotide sequences of MTR BINDING SITE, designated SEQ ID:5795, to the nucleotide sequence of VGAM2573 RNA, herein designated VGAM RNA, also designated SEQ ID:5284.

Another function of VGAM2573 is therefore inhibition of 5-methyltetrahydrofolate-homocysteine Methyltransferase (MTR, Accession NM_000254). Accordingly, utilities of VGAM2573 include diagnosis, prevention and treatment of diseases and clinical conditions associated with MTR. Protocadherin 11 X-linked (PCDH11X, Accession NM_032967)

is another VGAM2573 host target gene. PCDH11X BINDING SITE is HOST TARGET binding site found in the 3' untranslated region of mRNA encoded by PCDH11X, corresponding to a HOST TARGET binding site such as BINDING SITE I, BINDING SITE II or BINDING SITE III. Table 2 illustrates the complementarity of the nucleotide sequences of PCDH11X BINDING SITE, designated SEQ ID:26780, to the nucleotide sequence of VGAM2573 RNA, herein designated VGAM RNA, also designated SEQ ID:5284.

Another function of VGAM2573 is therefore inhibition of Protocadherin 11 X-linked (PCDH11X, Accession NM_032967), a gene which is thought to play a fundamental role in cell-cell recognition essential for the segmental development and function of the central nervous system. Accordingly, utilities of VGAM2573 include diagnosis, prevention and treatment of diseases and clinical conditions associated with PCDH11X. The function of PCDH11X and its association with various diseases and clinical conditions, has been established by previous studies, as described hereinabove with reference to VGAM433. Protocadherin 11 Y-linked (PCDH11Y, Accession NM_032971) is another VGAM2573 host target gene. PCDH11Y BINDING SITE1 and PCDH11Y BINDING SITE2 are HOST TARGET binding sites found in untranslated regions of mRNA encoded by PCDH11Y, corresponding to HOST TARGET binding sites such as BINDING SITE I, BINDING SITE II or BINDING SITE III. Table 2 illustrates the complementarity of the nucleotide sequences of PCDH11Y BINDING SITE1 and PCDH11Y BINDING SITE2, designated SEQ ID:26813 and SEQ ID:26815 respectively, to the nucleotide sequence of VGAM2573 RNA, herein designated VGAM RNA, also designated SEQ ID:5284.

Another function of VGAM2573 is therefore inhibition of Protocadherin 11 Y-linked (PCDH11Y, Accession NM_032971). Accordingly, utilities of VGAM2573 include diagnosis, prevention and treatment of diseases and clinical conditions associated with PCDH11Y. Ubiquitin-conjugating Enzyme E2 Variant 1 (UBE2V1, Accession NM_003349) is another VGAM2573 host target gene. UBE2V1 BINDING SITE1 through UBE2V1 BINDING SITE3 are HOST TARGET binding sites found in untranslated regions of mRNA encoded by UBE2V1, corresponding to HOST TARGET binding sites such as BINDING SITE I, BINDING SITE II or BINDING SITE III. Table 2 illustrates the complementarity of the nucleotide sequences of UBE2V1 BINDING SITE1 through UBE2V1 BINDING SITE3, designated SEQ ID:9366, SEQ ID:22518 and SEQ ID:6362 respectively, to the nucleotide sequence of VGAM2573 RNA, herein designated VGAM RNA, also designated SEQ ID:5284.

Another function of VGAM2573 is therefore inhibition of Ubiquitin-conjugating Enzyme E2 Variant 1 (UBE2V1, Accession NM_003349), a gene which may play a role in signaling for DNA repair. Accordingly, utilities of VGAM2573 include diagnosis, prevention and treatment of diseases and clinical conditions associated with UBE2V1. The function of UBE2V1 and its association with various diseases and clinical conditions, has been established by previous studies, as described hereinabove with reference to VGAM155. MGC12466 (Accession XM_086336) is another VGAM2573 host target gene. MGC12466 BINDING SITE is HOST TARGET binding site found in the 3' untranslated region of mRNA encoded by MGC12466, corresponding to a HOST TARGET binding site such as BINDING SITE I, BINDING SITE II or BINDING SITE III. Table 2 illustrates the complementarity of the nucleotide sequences of MGC12466 BINDING SITE, designated SEQ ID:38609, to the nucleotide sequence of VGAM2573 RNA, herein designated VGAM RNA, also designated SEQ ID:5284.

Another function of VGAM2573 is therefore inhibition of MGC12466 (Accession XM_086336). Accordingly, utilities of VGAM2573 include diagnosis, prevention and treatment of diseases and clinical conditions associated with MGC12466. Olfactory Receptor, Family 7, Subfamily C, Member 1 (OR7C1, Accession NM_017506) is another VGAM2573 host target gene. OR7C1 BINDING SITE is HOST TARGET binding site found in the 3' untranslated region of mRNA encoded by OR7C1, corresponding to a HOST TARGET binding site such as BINDING SITE I, BINDING SITE II or BINDING SITE III. Table 2 illustrates the complementarity of the nucleotide sequences of OR7C1 BINDING SITE, designated SEQ ID:18961, to the nucleotide sequence of VGAM2573 RNA, herein designated VGAM RNA, also designated SEQ ID:5284.

Another function of VGAM2573 is therefore inhibition of Olfactory Receptor, Family 7, Subfamily C, Member 1 (OR7C1, Accession NM_017506). Accordingly, utilities of VGAM2573 include diagnosis, prevention and treatment of diseases and clinical conditions associated with OR7C1. Oxysterol Binding Protein-like 6 (OSBPL6, Accession NM_032523) is another VGAM2573 host target gene. OSBPL6 BINDING SITE is HOST TARGET binding site found in the 3' untranslated region of mRNA encoded by OSBPL6, corresponding to a HOST TARGET binding site such as BINDING SITE I, BINDING SITE II or BINDING SITE III. Table 2 illustrates the complementarity of the nucleotide sequences of OSBPL6 BINDING SITE, designated SEQ ID:26269, to the nucleotide sequence of VGAM2573 RNA, herein designated VGAM RNA, also designated SEQ ID:5284.

Another function of VGAM2573 is therefore inhibition of Oxysterol Binding Protein-like 6 (OSBPL6, Accession NM_032523). Accordingly, utilities of VGAM2573 include diagnosis, prevention and treatment of diseases and clinical conditions associated with OSBPL6. PCCX2 (Accession XM_038352) is another VGAM2573 host target gene. PCCX2 BINDING SITE is HOST TARGET binding site found in the 3' untranslated region of mRNA encoded by PCCX2, corresponding to a HOST TARGET binding site such as BINDING SITE I, BINDING SITE II or BINDING SITE III. Table 2 illustrates the complementarity of the nucleotide sequences of PCCX2 BINDING SITE, designated SEQ ID:32820, to the nucleotide sequence of VGAM2573 RNA, herein designated VGAM RNA, also designated SEQ ID:5284.

Another function of VGAM2573 is therefore inhibition of PCCX2 (Accession XM_038352). Accordingly, utilities of VGAM2573 include diagnosis, prevention and treatment of diseases and clinical conditions associated with PCCX2. TUSP (Accession NM_020245) is another VGAM2573 host target gene. TUSP BINDING SITE is HOST TARGET binding site found in the 3' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21521, to the nucleotide sequence of VGAM2573 RNA, herein designated VGAM RNA, also designated SEQ ID:5284.

Another function of VGAM2573 is therefore inhibition of TUSP (Accession NM_020245). Accordingly, utilities of VGAM2573 include diagnosis, prevention and treatment of diseases and clinical conditions associated with TUSP. LOC118738 (Accession XM_061125) is another VGAM2573 host target gene. LOC118738 BINDING SITE is HOST TARGET binding site found in the 3' untranslated region of mRNA encoded by LOC118738, corresponding to a HOST TARGET binding site such as BINDING SITE I, BINDING SITE II or BINDING SITE III. Table 2 illustrates the complementarity of the nucleotide sequences of LOC118738 BINDING SITE, designated SEQ ID:37192, to the nucleotide sequence of VGAM2573 RNA, herein designated VGAM RNA, also designated SEQ ID:5284.

Another function of VGAM2573 is therefore inhibition of LOC118738 (Accession XM_061125). Accordingly, utilities of VGAM2573 include diagnosis, prevention and treatment of diseases and clinical conditions associated with LOC118738. LOC158056 (Accession XM_088463) is another VGAM2573 host target gene. LOC158056 BINDING SITE is HOST TARGET binding site found in the 5' untranslated region of mRNA encoded by LOC158056, corresponding to a HOST TARGET binding site such as BINDING SITE I, BINDING SITE II or BINDING SITE III. Table 2 illustrates the complementarity of the nucleotide sequences of LOC158056 BINDING SITE, designated SEQ ID:39712, to the nucleotide sequence of VGAM2573 RNA, herein designated VGAM RNA, also designated SEQ ID:5284.

Another function of VGAM2573 is therefore inhibition of LOC158056 (Accession XM_088463). Accordingly, utilities of VGAM2573 include diagnosis, prevention and treatment of diseases and clinical conditions associated with LOC158056. LOC163231 (Accession XM_092094) is another VGAM2573 host target gene. LOC163231 BINDING SITE is HOST TARGET binding site found in the 5' untranslated region of mRNA encoded by LOC163231, corresponding to a HOST TARGET binding site such as BINDING SITE I, BINDING SITE II or BINDING SITE III. Table 2 illustrates the complementarity of the nucleotide sequences of LOC163231 BINDING SITE, designated SEQ ID:40092, to the nucleotide sequence of VGAM2573 RNA, herein designated VGAM RNA, also designated SEQ ID:5284.

Another function of VGAM2573 is therefore inhibition of LOC163231 (Accession XM_092094). Accordingly, utilities of VGAM2573 include diagnosis, prevention and treatment of diseases and clinical conditions associated with LOC163231. LOC205669 (Accession XM_120309) is another VGAM2573 host target gene. LOC205669 BINDING SITE is HOST TARGET binding site found in the 5' untranslated region of mRNA encoded by LOC205669, corresponding to a HOST TARGET binding site such as BINDING SITE I, BINDING SITE II or BINDING SITE III. Table 2 illustrates the complementarity of the nucleotide sequences of LOC205669 BINDING SITE, designated SEQ ID:43607, to the nucleotide sequence of VGAM2573 RNA, herein designated VGAM RNA, also designated SEQ ID:5284.

Another function of VGAM2573 is therefore inhibition of LOC205669 (Accession XM_120309). Accordingly, utilities of VGAM2573 include diagnosis, prevention and treatment of diseases and clinical conditions associated with LOC205669. LOC219738 (Accession NM_145306) is another VGAM2573 host target gene. LOC219738 BINDING SITE is HOST TARGET binding site found in the 3' untranslated region of mRNA encoded by LOC219738, corresponding to a HOST TARGET binding site such as BINDING SITE I, BINDING SITE II or BINDING SITE III. Table 2 illustrates the complementarity of the nucleotide sequences of LOC219738 BINDING SITE, designated SEQ ID:29817, to the nucleotide sequence of VGAM2573 RNA, herein designated VGAM RNA, also designated SEQ ID:5284.

Another function of VGAM2573 is therefore inhibition of LOC219738 (Accession NM_145306). Accordingly, utilities of VGAM2573 include diagnosis, prevention and treatment of diseases and clinical conditions associated with LOC219738. LOC253039 (Accession XM_171203) is another VGAM2573 host target gene. LOC253039 BINDING SITE is HOST TARGET binding site found in the 3' untranslated region of mRNA encoded by LOC253039, corresponding to a HOST TARGET binding site such as BINDING SITE I, BINDING SITE II or BINDING SITE III. Table 2 illustrates the complementarity of the nucleotide sequences of LOC253039 BINDING SITE, designated SEQ ID:45991, to the nucleotide sequence of VGAM2573 RNA, herein designated VGAM RNA, also designated SEQ ID:5284.

Another function of VGAM2573 is therefore inhibition of LOC253039 (Accession XM_171203). Accordingly, utilities of VGAM2573 include diagnosis, prevention and treatment of diseases and clinical conditions associated with LOC253039. LOC51337 (Accession NM_016647) is another VGAM2573 host target gene. LOC51337 BINDING SITE is HOST TARGET binding site found in the 3' untranslated region of mRNA encoded by LOC51337, corresponding to a HOST TARGET binding site such as BINDING SITE I, BINDING SITE II or BINDING SITE III. Table 2 illustrates the complementarity of the nucleotide sequences of LOC51337 BINDING SITE, designated SEQ ID:18761, to the nucleotide sequence of VGAM2573 RNA, herein designated VGAM RNA, also designated SEQ ID:5284.

Another function of VGAM2573 is therefore inhibition of LOC51337 (Accession NM_016647). Accordingly, utilities of VGAM2573 include diagnosis, prevention and treatment of diseases and clinical conditions associated with LOC51337. FIG. 1 further provides a conceptual description of a novel bioinformatically detected viral gene of the present invention, referred to here as Viral Genomic Address Messenger 2574 (VGAM2574) viral gene, which modulates expression of respective host target genes thereof, the function and utility of which host target genes is known in the art.

VGAM2574 is a novel bioinformatically detected regulatory, non protein coding, viral micro RNA (miRNA) gene. The method by which VGAM2574 was detected is described hereinabove with reference to FIGS. 1-8.

VGAM2574 gene, herein designated VGAM GENE, is a viral gene contained in the genome of Triatoma Virus. VGAM2574 host target gene, herein designated VGAM HOST TARGET GENE, is a human gene contained in the human genome.

VGAM2574 gene encodes a VGAM2574 precursor RNA, herein designated VGAM PRECURSOR RNA. Similar to other miRNA genes, and unlike most ordinary genes, VGAM2574 precursor RNA does not encode a protein. A nucleotide sequence identical or highly similar to the nucleotide sequence of VGAM2574 precursor RNA is designated SEQ ID:2560, and is provided hereinbelow with reference to the sequence listing part. Nucleotide sequence SEQ ID:2560 is located at position 2215 relative to the genome of Triatoma Virus.

VGAM2574 precursor RNA folds onto itself, forming VGAM2574 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2574 folded precursor RNA into VGAM2574 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM2574 RNA is designated SEQ ID:5285, and is provided hereinbelow with reference to the sequence listing part.

VGAM2574 host target gene, herein designated VGAM HOST TARGET GENE, encodes a corresponding messenger RNA, VGAM2574 host target RNA, herein designated VGAM HOST TARGET RNA. VGAM2574 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2574 RNA, herein designated VGAM RNA, binds complementarily to one or more host target binding sites located in untranslated regions of VGAM2574 host target RNA, herein designated VGAM HOST TARGET RNA. This complementary binding is due to the fact that the nucleotide sequence of VGAM2574 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2574 RNA, herein designated VGAM RNA, may have a different number of host target binding sites in untranslated regions of a VGAM2574 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2574 RNA, herein designated VGAM RNA, to host target binding sites on VGAM2574 host target RNA, herein designated VGAM HOST TARGET RNA, such as BINDING SITE I, BINDING SITE II and BINDING SITE III, inhibits translation of VGAM2574 host target RNA into VGAM2574 host target protein, herein designated VGAM HOST TARGET PROTEIN. VGAM host target protein is therefore outlined by a broken line.

It is appreciated that VGAM2574 host target gene, herein designated VGAM HOST TARGET GENE, in fact represents a plurality of VGAM2574 host target genes. The mRNA of each one of this plurality of VGAM2574 host target genes comprises one or more host target binding sites, each having a nucleotide sequence which is at least partly complementary to VGAM2574 RNA, herein designated VGAM RNA, and which when bound by VGAM2574 RNA causes inhibition of translation of respective one or more VGAM2574 host target proteins.

It is further appreciated by one skilled in the art that the mode of translational inhibition illustrated by FIG. 1 with specific reference to translational inhibition exerted by VGAM2574 gene, herein designated VGAM GENE, on one or more VGAM2574 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2574 is inhibition of expression of host target genes, as part of a novel viral mechanism of attacking a host. Accordingly, utilities of VGAM2574 include diagnosis, prevention and treatment of viral infection by Triatoma Virus. Specific functions, and accordingly utilities, of VGAM2574 correlate with, and may be deduced from, the identity of the host target genes which VGAM2574 binds and inhibits, and the function of these host target genes, as elaborated hereinbelow.

Nucleotide sequences of the VGAM2574 precursor RNA, herein designated VGAM PRECURSOR RNA, and of the 'diced' VGAM2574 RNA, herein designated VGAM RNA, and a schematic representation of the secondary folding of VGAM2574 folded precursor RNA, herein designated VGAM FOLDED PRECURSOR RNA, of VGAM2574 are further described hereinbelow with reference to Table 1.

Nucleotide sequences of host target binding sites, such as BINDING SITE-I, BINDING SITE-II and BINDING SITE-III of FIG. 1, found on VGAM2574 host target RNA, and schematic representation of the complementarity of each of these host target binding sites to VGAM2574 RNA, herein designated VGAM RNA, are described hereinbelow with reference to Table 2.

As mentioned hereinabove with reference to FIG. 1, a function of VGAM2574 gene, herein designated VGAM is inhibition of expression of VGAM2574 target genes. It is appreciated that specific functions, and accordingly utilities, of VGAM2574 correlate with, and may be deduced from, the identity of the target genes which VGAM2574 binds and inhibits, and the function of these target genes, as elaborated hereinbelow.

Amyotrophic Lateral Sclerosis 2 (juvenile) Chromosome Region, Candidate 3 (ALS2CR3, Accession NM_015049) is a VGAM2574 host target gene. ALS2CR3 BINDING SITE is HOST TARGET binding site found in the 3' untranslated region of mRNA encoded by ALS2CR3, corresponding to a HOST TARGET binding site such as BINDING SITE I, BINDING SITE II or BINDING SITE III. Table 2 illustrates the complementarity of the nucleotide sequences of ALS2CR3 BINDING SITE, designated SEQ ID:17409, to the nucleotide sequence of VGAM2574 RNA, herein designated VGAM RNA, also designated SEQ ID:5285.

A function of VGAM2574 is therefore inhibition of Amyotrophic Lateral Sclerosis 2 (juvenile) Chromosome Region, Candidate 3 (ALS2CR3, Accession NM_015049). Accordingly, utilities of VGAM2574 include diagnosis, prevention and treatment of diseases and clinical conditions associated with ALS2CR3. KIAA0555 (Accession NM_014790) is another VGAM2574 host target gene. KIAA0555 BINDING SITE is HOST TARGET binding site found in the 3' untranslated region of mRNA encoded by KIAA0555, corresponding to a HOST TARGET binding site such as BINDING SITE I, BINDING SITE II or BINDING SITE III. Table 2 illustrates the complementarity of the nucleotide sequences of KIAA0555 BINDING SITE, designated SEQ ID:16681, to the nucleotide sequence of VGAM2574 RNA, herein designated VGAM RNA, also designated SEQ ID:5285.

Another function of VGAM2574 is therefore inhibition of KIAA0555 (Accession NM_014790). Accordingly, utilities of VGAM2574 include diagnosis, prevention and treatment of diseases and clinical conditions associated with KIAA0555. KIAA0979 (Accession NM_015032) is another VGAM2574 host target gene. KIAA0979 BINDING SITE is HOST TARGET binding site found in the 3' untranslated region of mRNA encoded by KIAA0979, corresponding to a HOST TARGET binding site such as BINDING SITE I, BINDING SITE II or BINDING SITE III. Table 2 illustrates the complementarity of the nucleotide sequences of KIAA0979 BINDING SITE, designated SEQ ID:17388, to the nucleotide sequence of VGAM2574 RNA, herein designated VGAM RNA, also designated SEQ ID:5285.

Another function of VGAM2574 is therefore inhibition of KIAA0979 (Accession NM_015032). Accordingly, utilities of VGAM2574 include diagnosis, prevention and treatment of diseases and clinical conditions associated with KIAA0979. SBBI26 (Accession NM_018846) is another VGAM2574 host target gene. SBBI26 BINDING SITE is HOST TARGET binding site found in the 3' untranslated region of mRNA encoded by SBBI26, corresponding to a HOST TARGET binding site such as BINDING SITE I, BINDING SITE II or BINDING SITE III. Table 2 illustrates the complementarity of the nucleotide sequences of SBBI26 BINDING SITE, designated SEQ ID:20830, to the nucleotide sequence of VGAM2574 RNA, herein designated VGAM RNA, also designated SEQ ID:5285.

Another function of VGAM2574 is therefore inhibition of SBBI26 (Accession NM_018846). Accordingly, utilities of VGAM2574 include diagnosis, prevention and treatment of diseases and clinical conditions associated with SBBI26. LOC120892 (Accession XM_058513) is another VGAM2574 host target gene. LOC120892 BINDING SITE is HOST TARGET binding site found in the 3' untranslated region of mRNA encoded by LOC120892, corresponding to a HOST TARGET binding site such as BINDING SITE I, BINDING SITE II or BINDING SITE III. Table 2 illustrates the complementarity of the nucleotide sequences of LOC120892 BINDING SITE, designated SEQ ID:36647, to the nucleotide sequence of VGAM2574 RNA, herein designated VGAM RNA, also designated SEQ ID:5285.

Another function of VGAM2574 is therefore inhibition of LOC120892 (Accession XM_058513). Accordingly, utilities of VGAM2574 include diagnosis, prevention and treatment of diseases and clinical conditions associated with LOC120892. LOC149734 (Accession XM_097713) is another VGAM2574 host target gene. LOC149734 BINDING SITE is HOST TARGET binding site found in the 3' untranslated region of mRNA encoded by LOC149734, corresponding to a HOST TARGET binding site such as BINDING SITE I, BINDING SITE II or BINDING SITE III. Table 2 illustrates the complementarity of the nucleotide sequences of LOC149734 BINDING SITE, designated SEQ ID:41055, to the nucleotide sequence of VGAM2574 RNA, herein designated VGAM RNA, also designated SEQ ID:5285.

Another function of VGAM2574 is therefore inhibition of LOC149734 (Accession XM_097713). Accordingly, utilities of VGAM2574 include diagnosis, prevention and treatment of diseases and clinical conditions associated with LOC149734. LOC152687 (Accession XM_087503) is another VGAM2574 host target gene. LOC152687 BINDING SITE is HOST TARGET binding site found in the 5' untranslated region of mRNA encoded by LOC152687, corresponding to a HOST TARGET binding site such as BINDING SITE I, BINDING SITE II or BINDING SITE III. Table 2 illustrates the complementarity of the nucleotide sequences of LOC152687 BINDING SITE, designated SEQ ID:39301, to the nucleotide sequence of VGAM2574 RNA, herein designated VGAM RNA, also designated SEQ ID:5285.

Another function of VGAM2574 is therefore inhibition of LOC152687 (Accession XM_087503). Accordingly, utilities of VGAM2574 include diagnosis, prevention and treatment of diseases and clinical conditions associated with LOC152687. LOC166793 (Accession NM_145291) is another VGAM2574 host target gene. LOC166793 BINDING SITE is HOST TARGET binding site found in the 5' untranslated region of mRNA encoded by LOC166793, corresponding to a HOST TARGET binding site such as BINDING SITE I, BINDING SITE II or BINDING SITE III. Table 2 illustrates the complementarity of the nucleotide sequences of LOC166793 BINDING SITE, designated SEQ ID:29805, to the nucleotide sequence of VGAM2574 RNA, herein designated VGAM RNA, also designated SEQ ID:5285.

Another function of VGAM2574 is therefore inhibition of LOC166793 (Accession NM_145291). Accordingly, utilities of VGAM2574 include diagnosis, prevention and treatment of diseases and clinical conditions associated with LOC166793. LOC168391 (Accession XM_095061) is another VGAM2574 host target gene. LOC168391 BINDING SITE is HOST TARGET binding site found in the 5' untranslated region of mRNA encoded by LOC168391, corresponding to a HOST TARGET binding site such as BINDING SITE I, BINDING SITE II or BINDING SITE III. Table 2 illustrates the complementarity of the nucleotide sequences of LOC168391 BINDING SITE, designated SEQ ID:40242, to the nucleotide sequence of VGAM2574 RNA, herein designated VGAM RNA, also designated SEQ ID:5285.

Another function of VGAM2574 is therefore inhibition of LOC168391 (Accession XM_095061). Accordingly, utilities of VGAM2574 include diagnosis, prevention and treatment of diseases and clinical conditions associated with LOC168391. FIG. 1 further provides a conceptual description of a novel bioinformatically detected viral gene of the present invention, referred to here as Viral Genomic Address Messenger 2575 (VGAM2575) viral gene, which modulates expression of respective host target genes thereof, the function and utility of which host target genes is known in the art.

VGAM2575 is a novel bioinformatically detected regulatory, non protein coding, viral micro RNA (miRNA) gene. The method by which VGAM2575 was detected is described hereinabove with reference to FIGS. 1-8.

VGAM2575 gene, herein designated VGAM GENE, is a viral gene contained in the genome of Triatoma Virus. VGAM2575 host target gene, herein designated VGAM HOST TARGET GENE, is a human gene contained in the human genome.

VGAM2575 gene encodes a VGAM2575 precursor RNA, herein designated VGAM PRECURSOR RNA. Similar to other miRNA genes, and unlike most ordinary genes, VGAM2575 precursor RNA does not encode a protein. A nucleotide sequence identical or highly similar to the nucleotide sequence of VGAM2575 precursor RNA is designated SEQ ID:2561, and is provided hereinbelow with reference to the sequence listing part. Nucleotide sequence SEQ ID:2561 is located at position 4661 relative to the genome of Triatoma Virus.

VGAM2575 precursor RNA folds onto itself, forming VGAM2575 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2575 folded precursor RNA into VGAM2575 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM2575 RNA is designated SEQ ID:5286, and is provided hereinbelow with reference to the sequence listing part.

VGAM2575 host target gene, herein designated VGAM HOST TARGET GENE, encodes a corresponding messenger RNA, VGAM2575 host target RNA, herein designated VGAM HOST TARGET RNA. VGAM2575 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2575 RNA, herein designated VGAM RNA, binds complementarily to one or more host target binding sites located in untranslated regions of VGAM2575 host target RNA, herein designated VGAM HOST TARGET RNA. This complementary binding is due to the fact that the nucleotide sequence of VGAM2575 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2575 RNA, herein designated VGAM RNA, may have a different number of host target binding sites in untranslated regions of a VGAM2575 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2575 RNA, herein designated VGAM RNA, to host target binding sites on VGAM2575 host target RNA, herein designated VGAM HOST TARGET RNA, such as BINDING SITE I, BINDING SITE II and BINDING SITE III, inhibits translation of VGAM2575 host target RNA into VGAM2575 host target protein, herein designated VGAM HOST TARGET PROTEIN. VGAM host target protein is therefore outlined by a broken line.

It is appreciated that VGAM2575 host target gene, herein designated VGAM HOST TARGET GENE, in fact represents a plurality of VGAM2575 host target genes. The mRNA of each one of this plurality of VGAM2575 host target genes comprises one or more host target binding sites, each having a nucleotide sequence which is at least partly complementary to VGAM2575 RNA, herein designated VGAM RNA, and which when bound by VGAM2575 RNA causes inhibition of translation of respective one or more VGAM2575 host target proteins.

It is further appreciated by one skilled in the art that the mode of translational inhibition illustrated by FIG. 1 with specific reference to translational inhibition exerted by VGAM2575 gene, herein designated VGAM GENE, on one or more VGAM2575 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2575 is inhibition of expression of host target genes, as part of a novel viral mechanism of attacking a host. Accordingly, utilities of VGAM2575 include diagnosis, prevention and treatment of viral infection by Triatoma Virus. Specific functions, and accordingly utilities, of VGAM2575 correlate with, and may be deduced from, the identity of the host target genes which VGAM2575 binds and inhibits, and the function of these host target genes, as elaborated hereinbelow.

Nucleotide sequences of the VGAM2575 precursor RNA, herein designated VGAM PRECURSOR RNA, and of the 'diced' VGAM2575 RNA, herein designated VGAM RNA, and a schematic representation of the secondary folding of VGAM2575 folded precursor RNA, herein designated VGAM FOLDED PRECURSOR RNA, of VGAM2575 are further described hereinbelow with reference to Table 1.

Nucleotide sequences of host target binding sites, such as BINDING SITE-I, BINDING SITE-II and BINDING SITE-III of FIG. 1, found on VGAM2575 host target RNA, and schematic representation of the complementarity of each of these host target binding sites to VGAM2575 RNA, herein designated VGAM RNA, are described hereinbelow with reference to Table 2.

As mentioned hereinabove with reference to FIG. 1, a function of VGAM2575 gene, herein designated VGAM is inhibition of expression of VGAM2575 target genes. It is appreciated that specific functions, and accordingly utilities, of VGAM2575 correlate with, and may be deduced from, the identity of the target genes which VGAM2575 binds and inhibits, and the function of these target genes, as elaborated hereinbelow.

Ellis Van Creveld Syndrome (EVC, Accession NM_014556) is a VGAM2575 host target gene. EVC BINDING SITE is HOST TARGET binding site found in the 3' untranslated region of mRNA encoded by EVC, corresponding to a HOST TARGET binding site such as BINDING SITE I, BINDING SITE II or BINDING SITE III. Table 2 illustrates the complementarity of the nucleotide sequences of EVC BINDING SITE, designated SEQ ID:15897, to the nucleotide sequence of VGAM2575 RNA, herein designated VGAM RNA, also designated SEQ ID:5286.

A function of VGAM2575 is therefore inhibition of Ellis Van Creveld Syndrome (EVC, Accession NM_014556). Accordingly, utilities of VGAM2575 include diagnosis, prevention and treatment of diseases and clinical conditions associated with EVC. High Mobility Group AT-hook 2 (HMGA2, Accession NM_003483) is another VGAM2575 host target gene. HMGA2 BINDING SITE is HOST TARGET binding site found in the 3' untranslated region of mRNA encoded by HMGA2, corresponding to a HOST TARGET binding site such as BINDING SITE I, BINDING SITE II or BINDING SITE III. Table 2 illustrates the complementarity of the nucleotide sequences of HMGA2 BINDING SITE, designated SEQ ID:9574, to the nucleotide sequence of VGAM2575 RNA, herein designated VGAM RNA, also designated SEQ ID:5286.

Another function of VGAM2575 is therefore inhibition of High Mobility Group AT-hook 2 (HMGA2, Accession NM_003483), a gene which may affect transcription and cell differentiation; shares common DNA-binding motif with other HMG HMG I/Y family members. Accordingly, utilities of VGAM2575 include diagnosis, prevention and treatment of diseases and clinical conditions associated with HMGA2. The function of HMGA2 and its association with various diseases and clinical conditions, has been established by previous studies, as described hereinabove with reference to VGAM552. Integrin, Beta 1 (fibronectin receptor, beta polypeptide, antigen CD29 includes MDF2, MSK12) (ITGB1, Accession NM_033666) is another VGAM2575 host target gene. ITGB1 BINDING SITE is HOST TARGET binding site found in the 3' untranslated region of mRNA encoded by ITGB1, corresponding to a HOST TARGET binding site such as BINDING SITE I, BINDING SITE II or BINDING SITE III. Table 2 illustrates the complementarity of the nucleotide sequences of ITGB1 BINDING SITE, designated SEQ ID:27393, to the nucleotide sequence of VGAM2575 RNA, herein designated VGAM RNA, also designated SEQ ID:5286.

Another function of VGAM2575 is therefore inhibition of Integrin, Beta 1 (fibronectin receptor, beta polypeptide, antigen CD29 includes MDF2, MSK12) (ITGB1, Accession NM_033666), a gene which acts as a fibronectin receptor. Accordingly, utilities of VGAM2575 include diagnosis, prevention and treatment of diseases and clinical conditions associated with ITGB1. The function of ITGB1 and its association with various diseases and clinical conditions, has been established by previous studies, as described hereinabove with reference to VGAM427. Mannan-binding Lectin Serine Protease 1 (C4/C2 activating component of Ra-reactive factor) (MASP1, Accession NM_139125) is another VGAM2575 host target gene. MASP1 BINDING SITE is HOST TARGET binding site found in the 3' untranslated region of mRNA encoded by MASP1, corresponding to a HOST TARGET binding site such as BINDING SITE I, BINDING SITE II or BINDING SITE III. Table 2 illustrates the complementarity of the nucleotide sequences of MASP1 BINDING SITE, designated SEQ ID:29161, to the nucleotide sequence of VGAM2575 RNA, herein designated VGAM RNA, also designated SEQ ID:5286.

Another function of VGAM2575 is therefore inhibition of Mannan-binding Lectin Serine Protease 1 (C4/C2 activating component of Ra-reactive factor) (MASP1, Accession NM_139125), a gene which a complement-dependent bactericidal factor. Accordingly, utilities of VGAM2575 include diagnosis, prevention and treatment of diseases and clinical conditions associated with MASP1. The function of MASP1 and its association with various diseases and clinical conditions, has been established by previous studies, as described hereinabove with reference to VGAM566. Myeloid Cell Leukemia Sequence 1 (BCL2-related) (MCL1, Accession NM_021960) is another VGAM2575 host target gene. MCL1 BINDING SITE is HOST TARGET binding site found in the 3' untranslated region of mRNA encoded by MCL1, corresponding to a HOST TARGET binding site such as BINDING SITE I, BINDING SITE II or BINDING SITE III. Table 2 illustrates the complementarity of the nucleotide sequences of MCL1 BINDING SITE, designated SEQ ID:22491, to the nucleotide sequence of VGAM2575 RNA, herein designated VGAM RNA, also designated SEQ ID:5286.

Another function of VGAM2575 is therefore inhibition of Myeloid Cell Leukemia Sequence 1 (BCL2-related) (MCL1, Accession NM_021960), a gene which involved in programing of differentiation and concomitant maintenance of viability. Accordingly, utilities of VGAM2575 include diagnosis, prevention and treatment of diseases and clinical conditions associated with MCL1. The function of MCL1 and its association with various diseases and clinical conditions, has been established by previous studies, as described hereinabove with reference to VGAM1083. Sp3 Transcription Factor (SP3, Accession XM_092672) is another VGAM2575 host target gene. SP3 BINDING SITE is HOST TARGET binding site found in the 3' untranslated region of mRNA encoded by SP3, corresponding to a HOST TARGET binding site such as BINDING SITE I, BINDING SITE II or BINDING SITE III. Table 2 illustrates the complementarity of the nucleotide sequences of SP3 BINDING SITE, designated SEQ ID:40137, to the nucleotide sequence of VGAM2575 RNA, herein designated VGAM RNA, also designated SEQ ID:5286.

Another function of VGAM2575 is therefore inhibition of Sp3 Transcription Factor (SP3, Accession XM_092672), a gene which binds to gt and gc boxes promoters elements. Accordingly, utilities of VGAM2575 include diagnosis, prevention and treatment of diseases and clinical conditions associated with SP3. The function of SP3 and its association with various diseases and clinical conditions, has been established by previous studies, as described hereinabove with reference to VGAM861. Zinc Finger Protein 180 (HHZ168) (ZNF180, Accession NM_013256) is another VGAM2575 host target gene. ZNF180 BINDING SITE is HOST TARGET binding site found in the 3' untranslated region of mRNA encoded by ZNF180, corresponding to a HOST TARGET binding site such as BINDING SITE I, BINDING SITE II or BINDING SITE III. Table 2 illustrates the complementarity of the nucleotide sequences of ZNF180 BINDING SITE, designated SEQ ID:14925, to the nucleotide sequence of VGAM2575 RNA, herein designated VGAM RNA, also designated SEQ ID:5286.

Another function of VGAM2575 is therefore inhibition of Zinc Finger Protein 180 (HHZ168) (ZNF180, Accession NM_013256). Accordingly, utilities of VGAM2575 include diagnosis, prevention and treatment of diseases and clinical conditions associated with ZNF180. Zinc Finger Protein 192 (ZNF192, Accession NM_006298) is another VGAM2575 host target gene. ZNF192 BINDING SITE is HOST TARGET binding site found in the 3' untranslated region of mRNA encoded by ZNF192, corresponding to a HOST TARGET binding site such as BINDING SITE I, BINDING SITE II or BINDING SITE III. Table 2 illustrates the complementarity of the nucleotide sequences of ZNF192 BINDING SITE, designated SEQ ID:12989, to the nucleotide sequence of VGAM2575 RNA, herein designated VGAM RNA, also designated SEQ ID:5286.

Another function of VGAM2575 is therefore inhibition of Zinc Finger Protein 192 (ZNF192, Accession NM_006298). Accordingly, utilities of VGAM2575 include diagnosis, prevention and treatment of diseases and clinical conditions associated with ZNF192. Chromosome 11 Open Reading Frame 11 (C11orf11, Accession XM_167769) is another VGAM2575 host target gene. C11orf11 BINDING SITE is HOST TARGET binding site found in the 3' untranslated region of mRNA encoded by C11orf11, corresponding to a HOST TARGET binding site such as BINDING SITE I, BINDING SITE II or BINDING SITE III. Table 2 illustrates the complementarity of the nucleotide sequences of C11orf11 BINDING SITE, designated SEQ ID:44783, to the nucleotide sequence of VGAM2575 RNA, herein designated VGAM RNA, also designated SEQ ID:5286.

Another function of VGAM2575 is therefore inhibition of Chromosome 11 Open Reading Frame 11 (C11orf11, Accession XM_167769). Accordingly, utilities of VGAM2575 include diagnosis, prevention and treatment of diseases and clinical conditions associated with C11orf11. C3IP1 (Accession NM_021633) is another VGAM2575 host target gene. C3IP1 BINDING SITE is HOST TARGET binding site found in the 3' untranslated region of mRNA encoded by C3IP1, corresponding to a HOST TARGET binding site such as BINDING SITE I, BINDING SITE II or BINDING SITE III. Table 2 illustrates the complementarity of the nucleotide sequences of C3IP1 BINDING SITE, designated SEQ ID:22277, to the nucleotide sequence of VGAM2575 RNA, herein designated VGAM RNA, also designated SEQ ID:5286.

Another function of VGAM2575 is therefore inhibition of C3IP1 (Accession NM_021633). Accordingly, utilities of VGAM2575 include diagnosis, prevention and treatment of diseases and clinical conditions associated with C3IP1. Chromosome 6 Open Reading Frame 33 (C6orf33, Accession NM_133367) is another VGAM2575 host target gene. C6orf33 BINDING SITE is HOST TARGET binding site found in the 3' untranslated region of mRNA encoded by C6orf33, corresponding to a HOST TARGET binding site such as BINDING SITE I, BINDING SITE II or BINDING SITE III. Table 2 illustrates the complementarity of the nucleotide sequences of C6orf33 BINDING SITE, designated SEQ ID:28492, to the nucleotide sequence of VGAM2575 RNA, herein designated VGAM RNA, also designated SEQ ID:5286.

Another function of VGAM2575 is therefore inhibition of Chromosome 6 Open Reading Frame 33 (C6orf33, Accession NM_133367). Accordingly, utilities of VGAM2575 include diagnosis, prevention and treatment of diseases and clinical conditions associated with C6orf33. CDC14 Cell Division Cycle 14 Homolog A (S. cerevisiae) (CDC14A, Accession NM_003672) is another VGAM2575 host target gene. CDC14A BINDING SITE is HOST TARGET binding site found in the 3' untranslated region of mRNA encoded by CDC14A, corresponding to a HOST TARGET binding site such as BINDING SITE I, BINDING SITE II or BINDING SITE III. Table 2 illustrates the complementarity of the nucleotide sequences of CDC14A BINDING SITE, designated SEQ ID:9767, to the nucleotide sequence of VGAM2575 RNA, herein designated VGAM RNA, also designated SEQ ID:5286.

Another function of VGAM2575 is therefore inhibition of CDC14 Cell Division Cycle 14 Homolog A (S. cerevisiae) (CDC14A, Accession NM_003672). Accordingly, utilities of VGAM2575 include diagnosis, prevention and treatment of diseases and clinical conditions associated with CDC14A. DKFZP434L187 (Accession XM_044070) is another VGAM2575 host target gene. DKFZP434L187 BINDING SITE is HOST TARGET binding site found in the 5' untranslated region of mRNA encoded by DKFZP434L187, corresponding to a HOST TARGET binding site such as BINDING SITE I, BINDING SITE II or BINDING SITE III. Table 2 illustrates the complementarity of the nucleotide sequences of DKFZP434L187 BINDING SITE, designated SEQ ID:34126, to the nucleotide sequence of VGAM2575 RNA, herein designated VGAM RNA, also designated SEQ ID:5286.

Another function of VGAM2575 is therefore inhibition of DKFZP434L187 (Accession XM_044070). Accordingly, utilities of VGAM2575 include diagnosis, prevention and treatment of diseases and clinical conditions associated with DKFZP434L187. FLJ00001 (Accession XM_088525) is another VGAM2575 host target gene. FLJ00001 BINDING SITE is HOST TARGET binding site found in the 3' untranslated region of mRNA encoded by FLJ00001, corresponding to a HOST TARGET binding site such as BINDING SITE I, BINDING SITE II or BINDING SITE III. Table 2 illustrates the complementarity of the nucleotide sequences of FLJ00001 BINDING SITE, designated SEQ ID:39786, to the nucleotide sequence of VGAM2575 RNA, herein designated VGAM RNA, also designated SEQ ID:5286.

Another function of VGAM2575 is therefore inhibition of FLJ00001 (Accession XM_088525). Accordingly, utilities of VGAM2575 include diagnosis, prevention and treatment of diseases and clinical conditions associated with FLJ00001. FLJ13081 (Accession NM_024834) is another VGAM2575 host target gene. FLJ13081 BINDING SITE is HOST TARGET binding site found in the 3' untranslated region of mRNA encoded by FLJ13081, corresponding to a HOST TARGET binding site such as BINDING SITE I, BINDING SITE II or BINDING SITE III. Table 2 illustrates the complementarity of the nucleotide sequences of FLJ13081 BINDING SITE, designated SEQ ID:24239, to the nucleotide sequence of VGAM2575 RNA, herein designated VGAM RNA, also designated SEQ ID:5286.

Another function of VGAM2575 is therefore inhibition of FLJ13081 (Accession NM_024834). Accordingly, utilities of VGAM2575 include diagnosis, prevention and treatment of diseases and clinical conditions associated with FLJ13081. FLJ13614 (Accession NM_139076) is another VGAM2575 host target gene. FLJ13614 BINDING SITE is HOST TARGET binding site found in the 3' untranslated region of mRNA encoded by FLJ13614, corresponding to a HOST TARGET binding site such as BINDING SITE I, BINDING SITE II or BINDING SITE III. Table 2 illustrates the complementarity of the nucleotide sequences of FLJ13614 BINDING SITE, designated SEQ ID:29151, to the nucleotide sequence of VGAM2575 RNA, herein designated VGAM RNA, also designated SEQ ID:5286.

Another function of VGAM2575 is therefore inhibition of FLJ13614 (Accession NM_139076). Accordingly, utilities of VGAM2575 include diagnosis, prevention and treatment of diseases and clinical conditions associated with FLJ13614. FLJ13693 (Accession NM_024807) is another VGAM2575 host target gene. FLJ13693 BINDING SITE is HOST TARGET binding site found in the 3' untranslated region of mRNA encoded by FLJ13693, corresponding to a HOST TARGET binding site such as BINDING SITE I, BINDING SITE II or BINDING SITE III. Table 2 illustrates the complementarity of the nucleotide sequences of FLJ13693 BINDING SITE, designated SEQ ID:24187, to the nucleotide sequence of VGAM2575 RNA, herein designated VGAM RNA, also designated SEQ ID:5286.

Another function of VGAM2575 is therefore inhibition of FLJ13693 (Accession NM_024807). Accordingly, utilities of VGAM2575 include diagnosis, prevention and treatment of diseases and clinical conditions associated with FLJ13693. FLJ20232 (Accession NM_019008) is another VGAM2575 host target gene. FLJ20232 BINDING SITE is HOST TARGET binding site found in the 3' untranslated region of mRNA encoded by FLJ20232, corresponding to a HOST TARGET binding site such as BINDING SITE I, BINDING SITE II or BINDING SITE III. Table 2 illustrates the complementarity of the nucleotide sequences of FLJ20232 BINDING SITE, designated SEQ ID:21082, to the nucleotide sequence of VGAM2575 RNA, herein designated VGAM RNA, also designated SEQ ID:5286.

Another function of VGAM2575 is therefore inhibition of FLJ20232 (Accession NM_019008). Accordingly, utilities of VGAM2575 include diagnosis, prevention and treatment of diseases and clinical conditions associated with FLJ20232. HEMK (Accession NM_016173) is another VGAM2575 host target gene. HEMK BINDING SITE is HOST TARGET binding site found in the 3' untranslated region of mRNA encoded by HEMK, corresponding to a HOST TARGET binding site such as BINDING SITE I, BINDING SITE II or BINDING SITE III. Table 2 illustrates the complementarity of the nucleotide sequences of HEMK BINDING SITE, designated SEQ ID:18272, to the nucleotide sequence of VGAM2575 RNA, herein designated VGAM RNA, also designated SEQ ID:5286.

Another function of VGAM2575 is therefore inhibition of HEMK (Accession NM_016173). Accordingly, utilities of VGAM2575 include diagnosis, prevention and treatment of diseases and clinical conditions associated with HEMK. HSA249128 (Accession NM_017583) is another VGAM2575 host target gene. HSA249128 BINDING SITE is HOST TARGET binding site found in the 3' untranslated region of mRNA encoded by HSA249128, corresponding to a HOST TARGET binding site such as BINDING SITE I, BINDING SITE II or BINDING SITE III. Table 2 illustrates the complementarity of the nucleotide sequences of HSA249128 BINDING SITE, designated SEQ ID:19029, to the nucleotide sequence of VGAM2575 RNA, herein designated VGAM RNA, also designated SEQ ID:5286.

Another function of VGAM2575 is therefore inhibition of HSA249128 (Accession NM_017583). Accordingly, utilities of VGAM2575 include diagnosis, prevention and treatment of diseases and clinical conditions associated with HSA249128. KIAA0172 (Accession XM_036295) is another VGAM2575 host target gene. KIAA0172 BINDING SITE is HOST TARGET binding site found in the 5' untranslated region of mRNA encoded by KIAA0172, corresponding to a HOST TARGET binding site such as BINDING SITE I, BINDING SITE II or BINDING SITE III. Table 2 illustrates the complementarity of the nucleotide sequences of KIAA0172 BINDING SITE, designated SEQ ID:32412, to the nucleotide sequence of VGAM2575 RNA, herein designated VGAM RNA, also designated SEQ ID:5286.

Another function of VGAM2575 is therefore inhibition of KIAA0172 (Accession XM_036295). Accordingly, utilities of VGAM2575 include diagnosis, prevention and treatment of diseases and clinical conditions associated with KIAA0172. KIAA0247 (Accession NM_014734) is another VGAM2575 host target gene. KIAA0247 BINDING SITE is HOST TARGET binding site found in the 3' untranslated region of mRNA encoded by KIAA0247, corresponding to a HOST TARGET binding site such as BINDING SITE I, BINDING SITE II or BINDING SITE III. Table 2 illustrates the complementarity of the nucleotide sequences of KIAA0247 BINDING SITE, designated SEQ ID:16381, to the nucleotide sequence of VGAM2575 RNA, herein designated VGAM RNA, also designated SEQ ID:5286.

Another function of VGAM2575 is therefore inhibition of KIAA0247 (Accession NM_014734). Accordingly, utilities of VGAM2575 include diagnosis, prevention and treatment of diseases and clinical conditions associated with KIAA0247. KIAA1034 (Accession XM_031223) is another VGAM2575 host target gene. KIAA1034 BINDING SITE is HOST TARGET binding site found in the 3' untranslated region of mRNA encoded by KIAA1034, corresponding to a HOST TARGET binding site such as BINDING SITE I, BINDING SITE II or BINDING SITE III. Table 2 illustrates the complementarity of the nucleotide sequences of KIAA1034 BINDING SITE, designated SEQ ID:31314, to the nucleotide sequence of VGAM2575 RNA, herein designated VGAM RNA, also designated SEQ ID:5286.

Another function of VGAM2575 is therefore inhibition of KIAA1034 (Accession XM_031223). Accordingly, utilities of VGAM2575 include diagnosis, prevention and treatment of diseases and clinical conditions associated with KIAA1034. KIAA1061 (Accession XM_048786) is another VGAM2575 host target gene. KIAA1061 BINDING SITE is HOST TARGET binding site found in the 3' untranslated region of mRNA encoded by KIAA1061, corresponding to a HOST TARGET binding site such as BINDING SITE I, BINDING SITE II or BINDING SITE III. Table 2 illustrates the complementarity of the nucleotide sequences of KIAA1061 BINDING SITE, designated SEQ ID:35270, to the nucleotide sequence of VGAM2575 RNA, herein designated VGAM RNA, also designated SEQ ID:5286.

Another function of VGAM2575 is therefore inhibition of KIAA1061 (Accession XM_048786). Accordingly, utilities of VGAM2575 include diagnosis, prevention and treatment of diseases and clinical conditions associated with KIAA1061. KIAA1877 (Accession XM_038616) is another VGAM2575 host target gene. KIAA1877 BINDING SITE is HOST TARGET binding site found in the 3' untranslated region of mRNA encoded by KIAA1877, corresponding to a HOST TARGET binding site such as BINDING SITE I, BINDING SITE II or BINDING SITE III. Table 2 illustrates the complementarity of the nucleotide sequences of KIAA1877 BINDING SITE, designated SEQ ID:32881, to the nucleotide sequence of VGAM2575 RNA, herein designated VGAM RNA, also designated SEQ ID:5286.

Another function of VGAM2575 is therefore inhibition of KIAA1877 (Accession XM_038616). Accordingly, utilities of VGAM2575 include diagnosis, prevention and treatment of diseases and clinical conditions associated with KIAA1877. KIAA1946 (Accession XM_092459) is another VGAM2575 host target gene. KIAA1946 BINDING SITE is HOST TARGET binding site found in the 3' untranslated region of mRNA encoded by KIAA1946, corresponding to a HOST TARGET binding site such as BINDING SITE I, BINDING SITE II or BINDING SITE III. Table 2 illustrates the complementarity of the nucleotide sequences of KIAA1946 BINDING SITE, designated SEQ ID:40120, to the nucleotide sequence of VGAM2575 RNA, herein designated VGAM RNA, also designated SEQ ID:5286.

Another function of VGAM2575 is therefore inhibition of KIAA1946 (Accession XM_092459). Accordingly, utilities of VGAM2575 include diagnosis, prevention and treatment of diseases and clinical conditions associated with KIAA1946. LIN-28 (Accession NM_024674) is another VGAM2575 host target gene. LIN-28 BINDING SITE is HOST TARGET binding site found in the 3' untranslated region of mRNA encoded by LIN-28, corresponding to a HOST TARGET binding site such as BINDING SITE I, BINDING SITE II or BINDING SITE III. Table 2 illustrates the complementarity of the nucleotide sequences of LIN-28 BINDING SITE, designated SEQ ID:23983, to the nucleotide sequence of VGAM2575 RNA, herein designated VGAM RNA, also designated SEQ ID:5286.

Another function of VGAM2575 is therefore inhibition of LIN-28 (Accession NM_024674). Accordingly, utilities of VGAM2575 include diagnosis, prevention and treatment of diseases and clinical conditions associated with LIN-28. Mitochondrial Ribosomal Protein S35 (MRPS35, Accession NM_021821) is another VGAM2575 host target gene. MRPS35 BINDING SITE is HOST TARGET binding site found in the 3' untranslated region of mRNA encoded by MRPS35, corresponding to a HOST TARGET binding site such as BINDING SITE I, BINDING SITE II or BINDING SITE III. Table 2 illustrates the complementarity of the nucleotide sequences of MRPS35 BINDING SITE, designated SEQ ID:22399, to the nucleotide sequence of VGAM2575 RNA, herein designated VGAM RNA, also designated SEQ ID:5286.

Another function of VGAM2575 is therefore inhibition of Mitochondrial Ribosomal Protein S35 (MRPS35, Accession NM_021821). Accordingly, utilities of VGAM2575 include diagnosis, prevention and treatment of diseases and clinical conditions associated with MRPS35. Protein Phosphatase 1, Regulatory (inhibitor) Subunit 16B (PPP1R16B, Accession XM_028840) is another VGAM2575 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30779, to the nucleotide sequence of VGAM2575 RNA, herein designated VGAM RNA, also designated SEQ ID:5286.

Another function of VGAM2575 is therefore inhibition of Protein Phosphatase 1, Regulatory (inhibitor) Subunit 16B (PPP1R16B, Accession XM_028840). Accordingly, utilities of VGAM2575 include diagnosis, prevention and treatment of diseases and clinical conditions associated with PPP1R16B. PRO0097 (Accession NM_014114) is another VGAM2575 host target gene. PRO0097 BINDING SITE is HOST TARGET binding site found in the 5' untranslated region of mRNA encoded by PRO0097, corresponding to a HOST TARGET binding site such as BINDING SITE I, BINDING SITE II or BINDING SITE III. Table 2 illustrates the complementarity of the nucleotide sequences of PRO0097 BINDING SITE, designated SEQ ID:15366, to the nucleotide sequence of VGAM2575 RNA, herein designated VGAM RNA, also designated SEQ ID:5286.

Another function of VGAM2575 is therefore inhibition of PRO0097 (Accession NM_014114). Accordingly, utilities of VGAM2575 include diagnosis, prevention and treatment of diseases and clinical conditions associated with PRO0097. LOC144871 (Accession XM_096698) is another VGAM2575 host target gene. LOC144871 BINDING SITE is HOST TARGET binding site found in the 5' untranslated region of mRNA encoded by LOC144871, corresponding to a HOST TARGET binding site such as BINDING SITE I, BINDING SITE II or BINDING SITE III. Table 2 illustrates the complementarity of the nucleotide sequences of LOC144871 BINDING SITE, designated SEQ ID:40473, to the nucleotide sequence of VGAM2575 RNA, herein designated VGAM RNA, also designated SEQ ID:5286.

Another function of VGAM2575 is therefore inhibition of LOC144871 (Accession XM_096698). Accordingly, utilities of VGAM2575 include diagnosis, prevention and treatment of diseases and clinical conditions associated with LOC144871. LOC147495 (Accession XM_097240) is another VGAM2575 host target gene. LOC147495 BINDING SITE is HOST TARGET binding site found in the 3' untranslated region of mRNA encoded by LOC147495, corresponding to a HOST TARGET binding site such as BINDING SITE I, BINDING SITE II or BINDING SITE III. Table 2 illustrates the complementarity of the nucleotide sequences of LOC147495 BINDING SITE, designated SEQ ID:40841, to the nucleotide sequence of VGAM2575 RNA, herein designated VGAM RNA, also designated SEQ ID:5286.

Another function of VGAM2575 is therefore inhibition of LOC147495 (Accession XM_097240). Accordingly, utilities of VGAM2575 include diagnosis, prevention and treatment of diseases and clinical conditions associated with LOC147495. LOC149332 (Accession XM_097626) is another VGAM2575 host target gene. LOC149332 BINDING SITE is HOST TARGET binding site found in the 3' untranslated region of mRNA encoded by LOC149332, corresponding to a HOST TARGET binding site such as BINDING SITE I, BINDING SITE II or BINDING SITE III. Table 2 illustrates the complementarity of the nucleotide sequences of LOC149332 BINDING SITE, designated SEQ ID:40982, to the nucleotide sequence of VGAM2575 RNA, herein designated VGAM RNA, also designated SEQ ID:5286.

Another function of VGAM2575 is therefore inhibition of LOC149332 (Accession XM_097626). Accordingly, utilities of VGAM2575 include diagnosis, prevention and treatment of diseases and clinical conditions associated with LOC149332. LOC149837 (Accession XM_097747) is another VGAM2575 host target gene. LOC149837 BINDING SITE is HOST TARGET binding site found in the 3' untranslated region of mRNA encoded by LOC149837, corresponding to a HOST TARGET binding site such as BINDING SITE I, BINDING SITE II or BINDING SITE III. Table 2 illustrates the complementarity of the nucleotide sequences of LOC149837 BINDING SITE, designated SEQ ID:41101, to the nucleotide sequence of VGAM2575 RNA, herein designated VGAM RNA, also designated SEQ ID:5286.

Another function of VGAM2575 is therefore inhibition of LOC149837 (Accession XM_097747). Accordingly, utilities of VGAM2575 include diagnosis, prevention and treatment of diseases and clinical conditions associated with LOC149837. LOC153027 (Accession XM_041221) is another VGAM2575 host target gene. LOC153027 BINDING SITE is HOST TARGET binding site found in the 3' untranslated region of mRNA encoded by LOC153027, corresponding to a HOST TARGET binding site such as BINDING SITE I, BINDING SITE II or BINDING SITE III. Table 2 illustrates the complementarity of the nucleotide sequences of LOC153027 BINDING SITE, designated SEQ ID:33490, to the nucleotide sequence of VGAM2575 RNA, herein designated VGAM RNA, also designated SEQ ID:5286.

Another function of VGAM2575 is therefore inhibition of LOC153027 (Accession XM_041221). Accordingly, utilities of VGAM2575 include diagnosis, prevention and treatment of diseases and clinical conditions associated with LOC153027. LOC255862 (Accession XM_170505) is another VGAM2575 host target gene. LOC255862 BINDING SITE is HOST TARGET binding site found in the 3' untranslated region of mRNA encoded by LOC255862, corresponding to a HOST TARGET binding site such as BINDING SITE I, BINDING SITE II or BINDING SITE III. Table 2 illustrates the complementarity of the nucleotide sequences of LOC255862 BINDING SITE, designated SEQ ID:45342, to the nucleotide sequence of VGAM2575 RNA, herein designated VGAM RNA, also designated SEQ ID:5286.

Another function of VGAM2575 is therefore inhibition of LOC255862 (Accession XM_170505). Accordingly, utilities of VGAM2575 include diagnosis, prevention and treatment of diseases and clinical conditions associated with LOC255862. LOC257471 (Accession XM_171020) is another VGAM2575 host target gene. LOC257471 BINDING SITE is HOST TARGET binding site found in the 3' untranslated region of mRNA encoded by LOC257471, corresponding to a HOST TARGET binding site such as BINDING SITE I, BINDING SITE II or BINDING SITE III. Table 2 illustrates the complementarity of the nucleotide sequences of LOC257471 BINDING SITE, designated SEQ ID:45789, to the nucleotide sequence of VGAM2575 RNA, herein designated VGAM RNA, also designated SEQ ID:5286.

Another function of VGAM2575 is therefore inhibition of LOC257471 (Accession XM_171020). Accordingly, utilities of VGAM2575 include diagnosis, prevention and treatment of diseases and clinical conditions associated with LOC257471. LOC51097 (Accession NM_016002) is another VGAM2575 host target gene. LOC51097 BINDING SITE is HOST TARGET binding site found in the 3' untranslated region of mRNA encoded by LOC51097, corresponding to a HOST TARGET binding site such as BINDING SITE I, BINDING SITE II or BINDING SITE III. Table 2 illustrates the complementarity of the nucleotide sequences of LOC51097 BINDING SITE, designated SEQ ID:18090, to the nucleotide sequence of VGAM2575 RNA, herein designated VGAM RNA, also designated SEQ ID:5286.

Another function of VGAM2575 is therefore inhibition of LOC51097 (Accession NM_016002). Accordingly, utilities of VGAM2575 include diagnosis, prevention and treatment of diseases and clinical conditions associated with LOC51097. LOC56965 (Accession NM_020213) is another VGAM2575 host target gene. LOC56965 BINDING SITE is HOST TARGET binding site found in the 5' untranslated region of mRNA encoded by LOC56965, corresponding to a HOST TARGET binding site such as BINDING SITE I, BINDING SITE II or BINDING SITE III. Table 2 illustrates the complementarity of the nucleotide sequences of LOC56965 BINDING SITE, designated SEQ ID:21455, to the nucleotide sequence of VGAM2575 RNA, herein designated VGAM RNA, also designated SEQ ID:5286.

Another function of VGAM2575 is therefore inhibition of LOC56965 (Accession NM_020213). Accordingly, utilities of VGAM2575 include diagnosis, prevention and treatment of diseases and clinical conditions associated with LOC56965. LOC91397 (Accession XM_038219) is another VGAM2575 host target gene. LOC91397 BINDING SITE is HOST TARGET binding site found in the 5' untranslated region of mRNA encoded by LOC91397, corresponding to a HOST TARGET binding site such as BINDING SITE I, BINDING SITE II or BINDING SITE III. Table 2 illustrates the complementarity of the nucleotide sequences of LOC91397 BINDING SITE, designated SEQ ID:32783, to the nucleotide sequence of VGAM2575 RNA, herein designated VGAM RNA, also designated SEQ ID:5286.

Another function of VGAM2575 is therefore inhibition of LOC91397 (Accession XM_038219). Accordingly, utilities of VGAM2575 include diagnosis, prevention and treatment of diseases and clinical conditions associated with LOC91397. FIG. 1 further provides a conceptual description of a novel bioinformatically detected viral gene of the present invention, referred to here as Viral Genomic Address Messenger 2576 (VGAM2576) viral gene, which modulates expression of respective host target genes thereof, the function and utility of which host target genes is known in the art.

VGAM2576 is a novel bioinformatically detected regulatory, non protein coding, viral micro RNA (miRNA) gene. The method by which VGAM2576 was detected is described hereinabove with reference to FIGS. 1-8.

VGAM2576 gene, herein designated VGAM GENE, is a viral gene contained in the genome of Triatoma Virus. VGAM2576 host target gene, herein designated VGAM HOST TARGET GENE, is a human gene contained in the human genome.

VGAM2576 gene encodes a VGAM2576 precursor RNA, herein designated VGAM PRECURSOR RNA. Similar to other miRNA genes, and unlike most ordinary genes, VGAM2576 precursor RNA does not encode a protein. A nucleotide sequence identical or highly similar to the nucleotide sequence of VGAM2576 precursor RNA is designated SEQ ID:2562, and is provided hereinbelow with reference to the sequence listing part. Nucleotide sequence SEQ ID:2562 is located at position 5068 relative to the genome of Triatoma Virus.

VGAM2576 precursor RNA folds onto itself, forming VGAM2576 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2576 folded precursor RNA into VGAM2576 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 90%) nucleotide sequence of VGAM2576 RNA is designated SEQ ID:5287, and is provided hereinbelow with reference to the sequence listing part.

VGAM2576 host target gene, herein designated VGAM HOST TARGET GENE, encodes a corresponding messenger RNA, VGAM2576 host target RNA, herein designated VGAM HOST TARGET RNA. VGAM2576 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2576 RNA, herein designated VGAM RNA, binds complementarily to one or more host target binding sites located in untranslated regions of VGAM2576 host target RNA, herein designated VGAM HOST TARGET RNA. This complementary binding is due to the fact that the nucleotide sequence of VGAM2576 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2576 RNA, herein designated VGAM RNA, may have a different number of host target binding sites in untranslated regions of a VGAM2576 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2576 RNA, herein designated VGAM RNA, to host target binding sites on VGAM2576 host target RNA, herein designated VGAM HOST TARGET RNA, such as BINDING SITE I, BINDING SITE II and BINDING SITE III, inhibits translation of VGAM2576 host target RNA into VGAM2576 host target protein, herein designated VGAM HOST TARGET PROTEIN. VGAM host target protein is therefore outlined by a broken line.

It is appreciated that VGAM2576 host target gene, herein designated VGAM HOST TARGET GENE, in fact represents a plurality of VGAM2576 host target genes. The mRNA of each one of this plurality of VGAM2576 host target genes comprises one or more host target binding sites, each having a nucleotide sequence which is at least partly complementary to VGAM2576 RNA, herein designated VGAM RNA, and which when bound by VGAM2576 RNA causes inhibition of translation of respective one or more VGAM2576 host target proteins.

It is further appreciated by one skilled in the art that the mode of translational inhibition illustrated by FIG. 1 with specific reference to translational inhibition exerted by VGAM2576 gene, herein designated VGAM GENE, on one or more VGAM2576 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2576 is inhibition of expression of host target genes, as part of a novel viral mechanism of attacking a host. Accordingly, utilities of VGAM2576 include diagnosis, prevention and treatment of viral infection by Triatoma Virus. Specific functions, and accordingly utilities, of VGAM2576 correlate with, and may be deduced from, the identity of the host target genes which VGAM2576 binds and inhibits, and the function of these host target genes, as elaborated hereinbelow.

Nucleotide sequences of the VGAM2576 precursor RNA, herein designated VGAM PRECURSOR RNA, and of the 'diced' VGAM2576 RNA, herein designated VGAM RNA, and a schematic representation of the secondary folding of VGAM2576 folded precursor RNA, herein designated VGAM FOLDED PRECURSOR RNA, of VGAM2576 are further described hereinbelow with reference to Table 1.

Nucleotide sequences of host target binding sites, such as BINDING SITE-I, BINDING SITE-II and BINDING SITE-III of FIG. 1, found on VGAM2576 host target RNA, and schematic representation of the complementarity of each of these host target binding sites to VGAM2576 RNA, herein designated VGAM RNA, are described hereinbelow with reference to Table 2.

As mentioned hereinabove with reference to FIG. 1, a function of VGAM2576 gene, herein designated VGAM is inhibition of expression of VGAM2576 target genes. It is appreciated that specific functions, and accordingly utilities, of VGAM2576 correlate with, and may be deduced from, the identity of the target genes which VGAM2576 binds and inhibits, and the function of these target genes, as elaborated hereinbelow.

Collagen, Type XIX, Alpha 1 (COL19A1, Accession NM_001858) is a VGAM2576 host target gene. COL19A1 BINDING SITE is HOST TARGET binding site found in the 3' untranslated region of mRNA encoded by COL19A1, corresponding to a HOST TARGET binding site such as BINDING SITE I, BINDING SITE II or BINDING SITE III. Table 2 illustrates the complementarity of the nucleotide sequences of COL19A1 BINDING SITE, designated SEQ ID:7595, to the nucleotide sequence of VGAM2576 RNA, herein designated VGAM RNA, also designated SEQ ID:5287.

A function of VGAM2576 is therefore inhibition of Collagen, Type XIX, Alpha 1 (COL19A1, Accession NM_001858), a gene which may act as a cross-bridge between fibrils and other extracellular matrix molecules. Accordingly, utilities of VGAM2576 include diagnosis, prevention and treatment of diseases and clinical conditions associated with COL19A1. The function of COL19A1 and its association with various diseases and clinical conditions, has been established by previous studies, as described hereinabove with reference to VGAM19. Eukaryotic Translation Initiation Factor 1A (EIF1A, Accession XM_114147) is another VGAM2576 host target gene. EIF1A BINDING SITE is HOST TARGET binding site found in the 3' untranslated region of mRNA encoded by EIF1A, corresponding to a HOST TARGET binding site such as BINDING SITE I, BINDING SITE II or BINDING SITE III. Table 2 illustrates the complementarity of the nucleotide sequences of EIF1A BINDING SITE, designated SEQ ID:42718, to the nucleotide sequence of VGAM2576 RNA, herein designated VGAM RNA, also designated SEQ ID:5287.

Another function of VGAM2576 is therefore inhibition of Eukaryotic Translation Initiation Factor 1A (EIF1A, Accession XM_114147), a gene which seems to be required for maximal rate of protein biosynthesis. Accordingly, utilities of VGAM2576 include diagnosis, prevention and treatment of diseases and clinical conditions associated with EIF1A. The function of EIF1A and its association with various diseases and clinical conditions, has been established by previous studies, as described hereinabove with reference to VGAM120. CRIPT (Accession XM_057669) is another VGAM2576 host target gene. CRIPT BINDING SITE is HOST TARGET binding site found in the 3' untranslated region of mRNA encoded by CRIPT, corresponding to a HOST TARGET binding site such as BINDING SITE I, BINDING SITE II or BINDING SITE III. Table 2 illustrates the complementarity of the nucleotide sequences of CRIPT BINDING SITE, designated SEQ ID:36538, to the nucleotide sequence of VGAM2576 RNA, herein designated VGAM RNA, also designated SEQ ID:5287.

Another function of VGAM2576 is therefore inhibition of CRIPT (Accession XM_057669). Accordingly, utilities of VGAM2576 include diagnosis, prevention and treatment of diseases and clinical conditions associated with CRIPT. H_GS165L15.1 (Accession NM_004904) is another VGAM2576 host target gene. H_GS165L15.1 BINDING SITE is HOST TARGET binding site found in the 3' untranslated region of mRNA encoded by H_GS165L15.1, corresponding to a HOST TARGET binding site such as BINDING SITE I, BINDING SITE II or BINDING SITE III. Table 2 illustrates the complementarity of the nucleotide sequences of H_GS165L15.1 BINDING SITE, designated SEQ ID:11337, to the nucleotide sequence of VGAM2576 RNA, herein designated VGAM RNA, also designated SEQ ID:5287.

Another function of VGAM2576 is therefore inhibition of H_GS165L15.1 (Accession NM_004904). Accordingly, utilities of VGAM2576 include diagnosis, prevention and treatment of diseases and clinical conditions associated with H_GS165L15.1. NS1-BP (Accession XM_051877) is another VGAM2576 host target gene. NS1-BP BINDING SITE is HOST TARGET binding site found in the 5' untranslated region of mRNA encoded by NS1-BP, corresponding to a HOST TARGET binding site such as BINDING SITE I, BINDING SITE II or BINDING SITE III. Table 2 illustrates the complementarity of the nucleotide sequences of NS1-BP BINDING SITE, designated SEQ ID:35912, to the nucleotide sequence of VGAM2576 RNA, herein designated VGAM RNA, also designated SEQ ID:5287.

Another function of VGAM2576 is therefore inhibition of NS1-BP (Accession XM_051877). Accordingly, utilities of VGAM2576 include diagnosis, prevention and treatment of diseases and clinical conditions associated with NS1-BP. Splicing Factor, Arginine/serine-rich 12 (SFRS12, Accession NM_139168) is another VGAM2576 host target gene. SFRS12 BINDING SITE is HOST TARGET binding site found in the 3' untranslated region of mRNA encoded by SFRS12, corresponding to a HOST TARGET binding site such as BINDING SITE I, BINDING SITE II or BINDING SITE III. Table 2 illustrates the complementarity of the nucleotide sequences of SFRS12 BINDING SITE, designated SEQ ID:29176, to the nucleotide sequence of VGAM2576 RNA, herein designated VGAM RNA, also designated SEQ ID:5287.

Another function of VGAM2576 is therefore inhibition of Splicing Factor, Arginine/serine-rich 12 (SFRS12, Accession NM_139168). Accordingly, utilities of VGAM2576 include diagnosis, prevention and treatment of diseases and clinical conditions associated with SFRS12. FIG. 1 further provides a conceptual description of a novel bioinformatically detected viral gene of the present invention, referred to here as Viral Genomic Address Messenger 2577 (VGAM2577) viral gene, which modulates expression of respective host target genes thereof, the function and utility of which host target genes is known in the art.

VGAM2577 is a novel bioinformatically detected regulatory, non protein coding, viral micro RNA (miRNA) gene. The method by which VGAM2577 was detected is described hereinabove with reference to FIGS. 1-8.

VGAM2577 gene, herein designated VGAM GENE, is a viral gene contained in the genome of Triatoma Virus. VGAM2577 host target gene, herein designated VGAM HOST TARGET GENE, is a human gene contained in the human genome.

VGAM2577 gene encodes a VGAM2577 precursor RNA, herein designated VGAM PRECURSOR RNA. Similar to other miRNA genes, and unlike most ordinary genes, VGAM2577 precursor RNA does not encode a protein. A nucleotide sequence identical or highly similar to the nucleotide sequence of VGAM2577 precursor RNA is designated SEQ ID:2563, and is provided hereinbelow with reference to the sequence listing part. Nucleotide sequence SEQ ID:2563 is located at position 985 relative to the genome of Triatoma Virus.

VGAM2577 precursor RNA folds onto itself, forming VGAM2577 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2577 folded precursor RNA into VGAM2577 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 78%) nucleotide sequence of VGAM2577 RNA is designated SEQ ID:5288, and is provided hereinbelow with reference to the sequence listing part.

VGAM2577 host target gene, herein designated VGAM HOST TARGET GENE, encodes a corresponding messenger RNA, VGAM2577 host target RNA, herein designated VGAM HOST TARGET RNA. VGAM2577 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2577 RNA, herein designated VGAM RNA, binds complementarily to one or more host target binding sites located in untranslated regions of VGAM2577 host target RNA, herein designated VGAM HOST TARGET RNA. This complementary binding is due to the fact that the nucleotide sequence of VGAM2577 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2577 RNA, herein designated VGAM RNA, may have a different number of host target binding sites in untranslated regions of a VGAM2577 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2577 RNA, herein designated VGAM RNA, to host target binding sites on VGAM2577 host target RNA, herein designated VGAM HOST TARGET RNA, such as BINDING SITE I, BINDING SITE II and BINDING SITE III, inhibits translation of VGAM2577 host target RNA into VGAM2577 host target protein, herein designated VGAM HOST TARGET PROTEIN. VGAM host target protein is therefore outlined by a broken line.

It is appreciated that VGAM2577 host target gene, herein designated VGAM HOST TARGET GENE, in fact represents a plurality of VGAM2577 host target genes. The mRNA of each one of this plurality of VGAM2577 host target genes comprises one or more host target binding sites, each having a nucleotide sequence which is at least partly complementary to VGAM2577 RNA, herein designated VGAM RNA, and which when bound by VGAM2577 RNA causes inhibition of translation of respective one or more VGAM2577 host target proteins.

It is further appreciated by one skilled in the art that the mode of translational inhibition illustrated by FIG. 1 with specific reference to translational inhibition exerted by VGAM2577 gene, herein designated VGAM GENE, on one or more VGAM2577 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2577 is inhibition of expression of host target genes, as part of a novel viral mechanism of attacking a host. Accordingly, utilities of VGAM2577 include diagnosis, prevention and treatment of viral infection by Triatoma Virus. Specific functions, and accordingly utilities, of VGAM2577 correlate with, and may be deduced from, the identity of the host target genes which VGAM2577 binds and inhibits, and the function of these host target genes, as elaborated hereinbelow.

Nucleotide sequences of the VGAM2577 precursor RNA, herein designated VGAM PRECURSOR RNA, and of the 'diced' VGAM2577 RNA, herein designated VGAM RNA, and a schematic representation of the secondary folding of VGAM2577 folded precursor RNA, herein designated VGAM FOLDED PRECURSOR RNA, of VGAM2577 are further described hereinbelow with reference to Table 1.

Nucleotide sequences of host target binding sites, such as BINDING SITE-I, BINDING SITE-II and BINDING SITE-III of FIG. 1, found on VGAM2577 host target RNA, and schematic representation of the complementarity of each of these host target binding sites to VGAM2577 RNA, herein designated VGAM RNA, are described hereinbelow with reference to Table 2.

As mentioned hereinabove with reference to FIG. 1, a function of VGAM2577 gene, herein designated VGAM is inhibition of expression of VGAM2577 target genes. It is appreciated that specific functions, and accordingly utilities, of VGAM2577 correlate with, and may be deduced from, the identity of the target genes which VGAM2577 binds and inhibits, and the function of these target genes, as elaborated hereinbelow.

DQX1 (Accession NM_133637) is a VGAM2577 host target gene. DQX1 BINDING SITE is HOST TARGET binding site found in the 5' untranslated region of mRNA encoded by DQX1, corresponding to a HOST TARGET binding site such as BINDING SITE I, BINDING SITE II or BINDING SITE III. Table 2 illustrates the complementarity of the nucleotide sequences of DQX1 BINDING SITE, designated SEQ ID:28597, to the nucleotide sequence of VGAM2577 RNA, herein designated VGAM RNA, also designated SEQ ID:5288.

A function of VGAM2577 is therefore inhibition of DQX1 (Accession NM_133637). Accordingly, utilities of VGAM2577 include diagnosis, prevention and treatment of diseases and clinical conditions associated with DQX1. FLJ11608 (Accession NM_024557) is another VGAM2577 host target gene. FLJ11608 BINDING SITE is HOST TARGET binding site found in the 3' untranslated region of mRNA encoded by FLJ11608, corresponding to a HOST TARGET binding site such as BINDING SITE I, BINDING SITE II or BINDING SITE III. Table 2 illustrates the complementarity of the nucleotide sequences of FLJ11608 BINDING SITE, designated SEQ ID:23777, to the nucleotide sequence of VGAM2577 RNA, herein designated VGAM RNA, also designated SEQ ID:5288.

Another function of VGAM2577 is therefore inhibition of FLJ11608 (Accession NM_024557). Accordingly, utilities of VGAM2577 include diagnosis, prevention and treatment of diseases and clinical conditions associated with FLJ11608. FLJ13263 (Accession NM_025125) is another VGAM2577 host target gene. FLJ13263 BINDING SITE is HOST TARGET binding site found in the 3' untranslated region of mRNA encoded by FLJ13263, corresponding to a HOST TARGET binding site such as BINDING SITE I, BINDING SITE II or BINDING SITE III. Table 2 illustrates the complementarity of the nucleotide sequences of FLJ13263 BINDING SITE, designated SEQ ID:24769, to the nucleotide sequence of VGAM2577 RNA, herein designated VGAM RNA, also designated SEQ ID:5288.

Another function of VGAM2577 is therefore inhibition of FLJ13263 (Accession NM_025125). Accordingly, utilities of VGAM2577 include diagnosis, prevention and treatment of diseases and clinical conditions associated with FLJ13263. ICB-1 (Accession NM_004848) is another VGAM2577 host target gene. ICB-1 BINDING SITE is HOST TARGET binding site found in the 3' untranslated region of mRNA encoded by ICB-1, corresponding to a HOST TARGET binding site such as BINDING SITE I, BINDING SITE II or BINDING SITE III. Table 2 illustrates the complementarity of the nucleotide sequences of ICB-1 BINDING SITE, designated SEQ ID:11259, to the nucleotide sequence of VGAM2577 RNA, herein designated VGAM RNA, also designated SEQ ID:5288.

Another function of VGAM2577 is therefore inhibition of ICB-1 (Accession NM_004848). Accordingly, utilities of VGAM2577 include diagnosis, prevention and treatment of diseases and clinical conditions associated with ICB-1. Tumor Necrosis Factor, Alpha-induced Protein 3 (TNFAIP3, Accession NM_006290) is another VGAM2577 host target gene. TNFAIP3 BINDING SITE is HOST TARGET binding site found in the 3' untranslated region of mRNA encoded by TNFAIP3, corresponding to a HOST TARGET binding site such as BINDING SITE I, BINDING SITE II or BINDING SITE III. Table 2 illustrates the complementarity of the nucleotide sequences of TNFAIP3 BINDING SITE, designated SEQ ID:12978, to the nucleotide sequence of VGAM2577 RNA, herein designated VGAM RNA, also designated SEQ ID:5288.

Another function of VGAM2577 is therefore inhibition of Tumor Necrosis Factor, Alpha-induced Protein 3 (TNFAIP3, Accession NM_006290). Accordingly, utilities of VGAM2577 include diagnosis, prevention and treatment of diseases and clinical conditions associated with TNFAIP3. LOC130813 (Accession XM_065904) is another VGAM2577 host target gene. LOC130813 BINDING SITE is HOST TARGET binding site found in the 3' untranslated region of mRNA encoded by LOC130813, corresponding to a HOST TARGET binding site such as BINDING SITE I, BINDING SITE II or BINDING SITE III. Table 2 illustrates the complementarity of the nucleotide sequences of LOC130813 BINDING SITE, designated SEQ ID:37307, to the nucleotide sequence of VGAM2577 RNA, herein designated VGAM RNA, also designated SEQ ID:5288.

Another function of VGAM2577 is therefore inhibition of LOC130813 (Accession XM_065904). Accordingly, utilities of VGAM2577 include diagnosis, prevention and treatment of diseases and clinical conditions associated with LOC130813. LOC145828 (Accession XM_096879) is another VGAM2577 host target gene. LOC145828 BINDING SITE is HOST TARGET binding site found in the 5' untranslated region of mRNA encoded by LOC145828, corresponding to a HOST TARGET binding site such as BINDING SITE I, BINDING SITE II or BINDING SITE III. Table 2 illustrates the complementarity of the nucleotide sequences of LOC145828 BINDING SITE, designated SEQ ID:40611, to the nucleotide sequence of VGAM2577 RNA, herein designated VGAM RNA, also designated SEQ ID:5288.

Another function of VGAM2577 is therefore inhibition of LOC145828 (Accession XM_096879). Accordingly, utilities of VGAM2577 include diagnosis, prevention and treatment of diseases and clinical conditions associated with LOC145828. LOC151996 (Accession XM_098151) is another VGAM2577 host target gene. LOC151996 BINDING SITE is HOST TARGET binding site found in the 3' untranslated region of mRNA encoded by LOC151996, corresponding to a HOST TARGET binding site such as BINDING SITE I, BINDING SITE II or BINDING SITE III. Table 2 illustrates the complementarity of the nucleotide sequences of LOC151996 BINDING SITE, designated SEQ ID:41412, to the nucleotide sequence of VGAM2577 RNA, herein designated VGAM RNA, also designated SEQ ID:5288.

Another function of VGAM2577 is therefore inhibition of LOC151996 (Accession XM_098151). Accordingly, utilities of VGAM2577 include diagnosis, prevention and treatment of diseases and clinical conditions associated with LOC151996. FIG. 1 further provides a conceptual description of a novel bioinformatically detected viral gene of the present invention, referred to here as Viral Genomic Address Messenger 2578 (VGAM2578) viral gene, which modulates expression of respective host target genes thereof, the function and utility of which host target genes is known in the art.

VGAM2578 is a novel bioinformatically detected regulatory, non protein coding, viral micro RNA (miRNA) gene. The method by which VGAM2578 was detected is described hereinabove with reference to FIGS. 1-8.

VGAM2578 gene, herein designated VGAM GENE, is a viral gene contained in the genome of Triatoma Virus. VGAM2578 host target gene, herein designated VGAM HOST TARGET GENE, is a human gene contained in the human genome.

VGAM2578 gene encodes a VGAM2578 precursor RNA, herein designated VGAM PRECURSOR RNA. Similar to other miRNA genes, and unlike most ordinary genes, VGAM2578 precursor RNA does not encode a protein. A nucleotide sequence identical or highly similar to the nucleotide sequence of VGAM2578 precursor RNA is designated SEQ ID:2564, and is provided hereinbelow with reference to the sequence listing part. Nucleotide sequence SEQ ID:2564 is located at position 849 relative to the genome of Triatoma Virus.

VGAM2578 precursor RNA folds onto itself, forming VGAM2578 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2578 folded precursor RNA into VGAM2578 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM2578 RNA is designated SEQ ID:5289, and is provided hereinbelow with reference to the sequence listing part.

VGAM2578 host target gene, herein designated VGAM HOST TARGET GENE, encodes a corresponding messenger RNA, VGAM2578 host target RNA, herein designated VGAM HOST TARGET RNA. VGAM2578 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2578 RNA, herein designated VGAM RNA, binds complementarily to one or more host target binding sites located in untranslated regions of VGAM2578 host target RNA, herein designated VGAM HOST TARGET RNA. This complementary binding is due to the fact that the nucleotide sequence of VGAM2578 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2578 RNA, herein designated VGAM RNA, may have a different number of host target binding sites in untranslated regions of a VGAM2578 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2578 RNA, herein designated VGAM RNA, to host target binding sites on VGAM2578 host target RNA, herein designated VGAM HOST TARGET RNA, such as BINDING SITE I, BINDING SITE II and BINDING SITE III, inhibits translation of VGAM2578 host target RNA into VGAM2578 host target protein, herein designated VGAM HOST TARGET PROTEIN. VGAM host target protein is therefore outlined by a broken line.

It is appreciated that VGAM2578 host target gene, herein designated VGAM HOST TARGET GENE, in fact represents a plurality of VGAM2578 host target genes. The mRNA of each one of this plurality of VGAM2578 host target genes comprises one or more host target binding sites, each having a nucleotide sequence which is at least partly complementary to VGAM2578 RNA, herein designated VGAM RNA, and which when bound by VGAM2578 RNA causes inhibition of translation of respective one or more VGAM2578 host target proteins.

It is further appreciated by one skilled in the art that the mode of translational inhibition illustrated by FIG. 1 with specific reference to translational inhibition exerted by VGAM2578 gene, herein designated VGAM GENE, on one or more VGAM2578 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2578 is inhibition of expression of host target genes, as part of a novel viral mechanism of attacking a host. Accordingly, utilities of VGAM2578 include diagnosis, prevention and treatment of viral infection by Triatoma Virus. Specific functions, and accordingly utilities, of VGAM2578 correlate with, and may be deduced from, the identity of the host target genes which VGAM2578 binds and inhibits, and the function of these host target genes, as elaborated hereinbelow.

Nucleotide sequences of the VGAM2578 precursor RNA, herein designated VGAM PRECURSOR RNA, and of the 'diced' VGAM2578 RNA, herein designated VGAM RNA, and a schematic representation of the secondary folding of VGAM2578 folded precursor RNA, herein designated VGAM FOLDED PRECURSOR RNA, of VGAM2578 are further described hereinbelow with reference to Table 1.

Nucleotide sequences of host target binding sites, such as BINDING SITE-I, BINDING SITE-II and BINDING SITE-III of FIG. 1, found on VGAM2578 host target RNA, and schematic representation of the complementarity of each of these host target binding sites to VGAM2578 RNA, herein designated VGAM RNA, are described hereinbelow with reference to Table 2.

As mentioned hereinabove with reference to FIG. 1, a function of VGAM2578 gene, herein designated VGAM is inhibition of expression of VGAM2578 target genes. It is appreciated that specific functions, and accordingly utilities, of VGAM2578 correlate with, and may be deduced from, the identity of the target genes which VGAM2578 binds and inhibits, and the function of these target genes, as elaborated hereinbelow.

Carbonic Anhydrase XII (CA12, Accession NM_001218) is a VGAM2578 host target gene. CA12 BINDING SITE is HOST TARGET binding site found in the 3' untranslated region of mRNA encoded by CA12, corresponding to a HOST TARGET binding site such as BINDING SITE I, BINDING SITE II or BINDING SITE III. Table 2 illustrates the complementarity of the nucleotide sequences of CA12 BINDING SITE, designated SEQ ID:6878, to the nucleotide sequence of VGAM2578 RNA, herein designated VGAM RNA, also designated SEQ ID:5289.

A function of VGAM2578 is therefore inhibition of Carbonic Anhydrase XII (CA12, Accession NM_001218), a gene which functions in cellular transport and metabolic processes. Accordingly, utilities of VGAM2578 include diagnosis, prevention and treatment of diseases and clinical conditions associated with CA12. The function of CA12 and its association with various diseases and clinical conditions, has been established by previous studies, as described hereinabove with reference to VGAM508. FIG. 1 further provides a conceptual description of a novel bioinformatically detected viral gene of the present invention, referred to here as Viral Genomic Address Messenger 2579 (VGAM2579) viral gene, which modulates expression of respective host target genes thereof, the function and utility of which host target genes is known in the art.

VGAM2579 is a novel bioinformatically detected regulatory, non protein coding, viral micro RNA (miRNA) gene. The method by which VGAM2579 was detected is described hereinabove with reference to FIGS. 1-8.

VGAM2579 gene, herein designated VGAM GENE, is a viral gene contained in the genome of Triatoma Virus. VGAM2579 host target gene, herein designated VGAM HOST TARGET GENE, is a human gene contained in the human genome.

VGAM2579 gene encodes a VGAM2579 precursor RNA, herein designated VGAM PRECURSOR RNA. Similar to other miRNA genes, and unlike most ordinary genes, VGAM2579 precursor RNA does not encode a protein. A nucleotide sequence identical or highly similar to the nucleotide sequence of VGAM2579 precursor RNA is designated SEQ ID:2565, and is provided hereinbelow with reference to the sequence listing part. Nucleotide sequence SEQ ID:2565 is located at position 7412 relative to the genome of Triatoma Virus.

VGAM2579 precursor RNA folds onto itself, forming VGAM2579 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2579 folded precursor RNA into VGAM2579 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM2579 RNA is designated SEQ ID:5290, and is provided hereinbelow with reference to the sequence listing part.

VGAM2579 host target gene, herein designated VGAM HOST TARGET GENE, encodes a corresponding messenger RNA, VGAM2579 host target RNA, herein designated VGAM HOST TARGET RNA. VGAM2579 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2579 RNA, herein designated VGAM RNA, binds complementarily to one or more host target binding sites located in untranslated regions of VGAM2579 host target RNA, herein designated VGAM HOST TARGET RNA. This complementary binding is due to the fact that the nucleotide sequence of VGAM2579 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2579 RNA, herein designated VGAM RNA, may have a different number of host target binding sites in untranslated regions of a VGAM2579 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2579 RNA, herein designated VGAM RNA, to host target binding sites on VGAM2579 host target RNA, herein designated VGAM HOST TARGET RNA, such as BINDING SITE I, BINDING SITE II and BINDING SITE III, inhibits translation of VGAM2579 host target RNA into VGAM2579 host target protein, herein designated VGAM HOST TARGET PROTEIN. VGAM host target protein is therefore outlined by a broken line.

It is appreciated that VGAM2579 host target gene, herein designated VGAM HOST TARGET GENE, in fact represents a plurality of VGAM2579 host target genes. The mRNA of each one of this plurality of VGAM2579 host target genes comprises one or more host target binding sites, each having a nucleotide sequence which is at least partly complementary to VGAM2579 RNA, herein designated VGAM RNA, and which when bound by VGAM2579 RNA causes inhibition of translation of respective one or more VGAM2579 host target proteins.

It is further appreciated by one skilled in the art that the mode of translational inhibition illustrated by FIG. 1 with specific reference to translational inhibition exerted by VGAM2579 gene, herein designated VGAM GENE, on one or more VGAM2579 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2579 is inhibition of expression of host target genes, as part of a novel viral mechanism of attacking a host. Accordingly, utilities of VGAM2579 include diagnosis, prevention and treatment of viral infection by Triatoma Virus. Specific functions, and accordingly utilities, of VGAM2579 correlate with, and may be deduced from, the identity of the host target genes which VGAM2579 binds and inhibits, and the function of these host target genes, as elaborated hereinbelow.

Nucleotide sequences of the VGAM2579 precursor RNA, herein designated VGAM PRECURSOR RNA, and of the 'diced' VGAM2579 RNA, herein designated VGAM RNA, and a schematic representation of the secondary folding of VGAM2579 folded precursor RNA, herein designated VGAM FOLDED PRECURSOR RNA, of VGAM2579 are further described hereinbelow with reference to Table 1.

Nucleotide sequences of host target binding sites, such as BINDING SITE-I, BINDING SITE-II and BINDING SITE-III of FIG. 1, found on VGAM2579 host target RNA, and schematic representation of the complementarity of each of these host target binding sites to VGAM2579 RNA, herein designated VGAM RNA, are described hereinbelow with reference to Table 2.

As mentioned hereinabove with reference to FIG. 1, a function of VGAM2579 gene, herein designated VGAM is inhibition of expression of VGAM2579 target genes. It is appreciated that specific functions, and accordingly utilities, of VGAM2579 correlate with, and may be deduced from, the identity of the target genes which VGAM2579 binds and inhibits, and the function of these target genes, as elaborated hereinbelow.

DXF68S1E (Accession XM_010289) is a VGAM2579 host target gene. DXF68S1E BINDING SITE is HOST TARGET binding site found in the 3' untranslated region of mRNA encoded by DXF68S1E, corresponding to a HOST TARGET binding site such as BINDING SITE I, BINDING SITE II or BINDING SITE III. Table 2 illustrates the complementarity of the nucleotide sequences of DXF68S1E BINDING SITE, designated SEQ ID:30152, to the nucleotide sequence of VGAM2579 RNA, herein designated VGAM RNA, also designated SEQ ID:5290.

A function of VGAM2579 is therefore inhibition of DXF68S1E (Accession XM_010289). Accordingly, utilities of VGAM2579 include diagnosis, prevention and treatment of diseases and clinical conditions associated with DXF68S1E. Junctional Adhesion Molecule 1 (JAM1, Accession NM_016946) is another VGAM2579 host target gene. JAM1 BINDING SITE1 through JAM1 BINDING SITE4 are HOST TARGET binding sites found in untranslated regions of mRNA encoded by JAM1, corresponding to HOST TARGET binding sites such as BINDING SITE I, BINDING SITE II or BINDING SITE III. Table 2 illustrates the complementarity of the nucleotide sequences of JAM1 BINDING SITE1 through JAM1 BINDING SITE4, designated SEQ ID:18862, SEQ ID:29329, SEQ ID:29340 and SEQ ID:29350 respectively, to the nucleotide sequence of VGAM2579 RNA, herein designated VGAM RNA, also designated SEQ ID:5290.

Another function of VGAM2579 is therefore inhibition of Junctional Adhesion Molecule 1 (JAM1, Accession NM_016946). Accordingly, utilities of VGAM2579 include diagnosis, prevention and treatment of diseases and clinical conditions associated with JAM1. FIG. 1 further provides a conceptual description of a novel bioinformatically detected viral gene of the present invention, referred to here as Viral Genomic Address Messenger 2580 (VGAM2580) viral gene, which modulates expression of respective host target genes thereof, the function and utility of which host target genes is known in the art.

VGAM2580 is a novel bioinformatically detected regulatory, non protein coding, viral micro RNA (miRNA) gene. The method by which VGAM2580 was detected is described hereinabove with reference to FIGS. 1-8.

VGAM2580 gene, herein designated VGAM GENE, is a viral gene contained in the genome of Triatoma Virus. VGAM2580 host target gene, herein designated VGAM HOST TARGET GENE, is a human gene contained in the human genome.

VGAM2580 gene encodes a VGAM2580 precursor RNA, herein designated VGAM PRECURSOR RNA. Similar to other miRNA genes, and unlike most ordinary genes, VGAM2580 precursor RNA does not encode a protein. A nucleotide sequence identical or highly similar to the nucleotide sequence of VGAM2580 precursor RNA is designated SEQ ID:2566, and is provided hereinbelow with reference to the sequence listing part. Nucleotide sequence SEQ ID:2566 is located at position 7916 relative to the genome of Triatoma Virus.

VGAM2580 precursor RNA folds onto itself, forming VGAM2580 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2580 folded precursor RNA into VGAM2580 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2580 RNA is designated SEQ ID:5291, and is provided hereinbelow with reference to the sequence listing part.

VGAM2580 host target gene, herein designated VGAM HOST TARGET GENE, encodes a corresponding messenger RNA, VGAM2580 host target RNA, herein designated VGAM HOST TARGET RNA. VGAM2580 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2580 RNA, herein designated VGAM RNA, binds complementarily to one or more host target binding sites located in untranslated regions of VGAM2580 host target RNA, herein designated VGAM HOST TARGET RNA. This complementary binding is due to the fact that the nucleotide sequence of VGAM2580 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2580 RNA, herein designated VGAM RNA, may have a different number of host target binding sites in untranslated regions of a VGAM2580 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2580 RNA, herein designated VGAM RNA, to host target binding sites on VGAM2580 host target RNA, herein designated VGAM HOST TARGET RNA, such as BINDING SITE I, BINDING SITE II and BINDING SITE III, inhibits translation of VGAM2580 host target RNA into VGAM2580 host target protein, herein designated VGAM HOST TARGET PROTEIN. VGAM host target protein is therefore outlined by a broken line.

It is appreciated that VGAM2580 host target gene, herein designated VGAM HOST TARGET GENE, in fact represents a plurality of VGAM2580 host target genes. The mRNA of each one of this plurality of VGAM2580 host target genes comprises one or more host target binding sites, each having a nucleotide sequence which is at least partly complementary to VGAM2580 RNA, herein designated VGAM RNA, and which when bound by VGAM2580 RNA causes inhibition of translation of respective one or more VGAM2580 host target proteins.

It is further appreciated by one skilled in the art that the mode of translational inhibition illustrated by FIG. 1 with specific reference to translational inhibition exerted by VGAM2580 gene, herein designated VGAM GENE, on one or more VGAM2580 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2580 is inhibition of expression of host target genes, as part of a novel viral mechanism of attacking a host. Accordingly, utilities of VGAM2580 include diagnosis, prevention and treatment of viral infection by Triatoma Virus. Specific functions, and accordingly utilities, of VGAM2580 correlate with, and may be deduced from, the identity of the host target genes which VGAM2580 binds and inhibits, and the function of these host target genes, as elaborated hereinbelow.

Nucleotide sequences of the VGAM2580 precursor RNA, herein designated VGAM PRECURSOR RNA, and of the 'diced' VGAM2580 RNA, herein designated VGAM RNA, and a schematic representation of the secondary folding of VGAM2580 folded precursor RNA, herein designated VGAM FOLDED PRECURSOR RNA, of VGAM2580 are further described hereinbelow with reference to Table 1.

Nucleotide sequences of host target binding sites, such as BINDING SITE-I, BINDING SITE-II and BINDING SITE-III of FIG. 1, found on VGAM2580 host target RNA, and schematic representation of the complementarity of each of these host target binding sites to VGAM2580 RNA, herein designated VGAM RNA, are described hereinbelow with reference to Table 2.

As mentioned hereinabove with reference to FIG. 1, a function of VGAM2580 gene, herein designated VGAM is inhibition of expression of VGAM2580 target genes. It is appreciated that specific functions, and accordingly utilities, of VGAM2580 correlate with, and may be deduced from, the identity of the target genes which VGAM2580 binds and inhibits, and the function of these target genes, as elaborated hereinbelow.

Fibronectin Leucine Rich Transmembrane Protein 2 (FLRT2, Accession NM_013231) is a VGAM2580 host target gene. FLRT2 BINDING SITE is HOST TARGET binding site found in the 3' untranslated region of mRNA encoded by FLRT2, corresponding to a HOST TARGET binding site such as BINDING SITE I, BINDING SITE II or BINDING SITE III. Table 2 illustrates the complementarity of the nucleotide sequences of FLRT2 BINDING SITE, designated SEQ ID:14879, to the nucleotide sequence of VGAM2580 RNA, herein designated VGAM RNA, also designated SEQ ID:5291.

A function of VGAM2580 is therefore inhibition of Fibronectin Leucine Rich Transmembrane Protein 2 (FLRT2, Accession NM_013231), a gene which may have a function in cell adhesion and/or receptor signaling. Accordingly, utilities of VGAM2580 include diagnosis, prevention and treatment of diseases and clinical conditions associated with FLRT2. The function of FLRT2 and its association with various diseases and clinical conditions, has been established by previous studies, as described hereinabove with reference to VGAM247. Steroid Sulfatase (microsomal), Arylsulfatase C, Isozyme S (STS, Accession NM_000351) is another VGAM2580 host target gene. STS BINDING SITE is HOST TARGET binding site found in the 3' untranslated region of mRNA encoded by STS, corresponding to a HOST TARGET binding site such as BINDING SITE I, BINDING SITE II or BINDING SITE III. Table 2 illustrates the complementarity of the nucleotide sequences of STS BINDING SITE, designated SEQ ID:5907, to the nucleotide sequence of VGAM2580 RNA, herein designated VGAM RNA, also designated SEQ ID:5291.

Another function of VGAM2580 is therefore inhibition of Steroid Sulfatase (microsomal), Arylsulfatase C, Isozyme S (STS, Accession NM_000351). Accordingly, utilities of VGAM2580 include diagnosis, prevention and treatment of diseases and clinical conditions associated with STS. Thyrotropin-releasing Hormone (TRH, Accession NM_007117) is another VGAM2580 host target gene. TRH BINDING SITE is HOST TARGET binding site found in the 3' untranslated region of mRNA encoded by TRH, corresponding to a HOST TARGET binding site such as BINDING SITE I, BINDING SITE II or BINDING SITE III. Table 2 illustrates the complementarity of the nucleotide sequences of TRH BINDING SITE, designated SEQ ID:13979, to the nucleotide sequence of VGAM2580 RNA, herein designated VGAM RNA, also designated SEQ ID:5291.

Another function of VGAM2580 is therefore inhibition of Thyrotropin-releasing Hormone (TRH, Accession NM_007117), a gene which functions as a regulator of the biosynthesis of tsh in the anterior pituitary gland and as a neurotransmitter/ neuromodulator in the central and peripheral nervous systems. Accordingly, utilities of VGAM2580 include diagnosis, prevention and treatment of diseases and clinical conditions associated with TRH. The function of TRH has been established by previous studies. Thyrotropin-releasing hormone (TRH), the major hypothalamic mediator of release of thyroid-stimulating hormone (TSHB; 188540), is a tripeptide (glu-his-pro) found in highest concentrations in the medial division of the hypothalamic paraventricular nuclei and in the median eminence. TRH stimulates the release of prolactin as well as that of TSH. The prolactin response is enhanced in hypothyroidism and diminished in hyperthyroidism. Niimi et al. (1982) reported a girl with isolated TRH deficiency. The parents were unrelated. She was seen at age 4 years for short stature. The authors suggested that TRH-synthesizing enzyme in the hypothalamus (Mitnick and Reichlin, 1972) may be deficient. It is now known that TRH is a peptide synthesized as such. Katakami et al. (1984) described an 18-year-old girl with isolated TRH deficiency and suggested that hypothyroidism in this patient was due to dysfunction of hypothalamic TRH release. Foresti and Ferrari (1985) suggested that resistance of pituitary thyrotropes (TSH-producing pituitary cells) due to a receptor defect is a more likely explanation, and that direct serum determination of TRH is a valid way to diagnose TRH deficiency. Yamada et al. (1990) reported that the transcriptional unit of prepro-TRH is 3.3 kb long, with 3 exons interrupted by 2 introns of approximately 1,050 and 650 basepairs, respectively. The predicted human prepro-TRH has 242 amino acids.

Full details of the abovementioned studies are described in the following publications, the disclosure of which are hereby incorporated by reference:

Niimi, H.; Inomata, H.; Sasaki, N.; Nakajima, H.: Congenital isolated thyrotrophin releasing hormone deficiency. Arch. Dis. Child. 57:877-878, 1982; and Foresti, V.; Ferrari, C.: Central hypothyroidism: isolated thyrotropin-releasing hormone deficiency or resistance of pituitary thyrotropes (Letter) J. Endocr. Invest. 8:577 only, 19.

Further studies establishing the function and utilities of TRH are found in John Hopkins OMIM database record ID 275120, and in sited publications numbered 7236-7237, 658 and 7238-7242 listed in the bibliography section hereinbelow, which are also hereby incorporated by reference. LOC84549 (Accession NM_032509) is another VGAM2580 host target gene. LOC84549 BINDING SITE is HOST TARGET binding site found in the 3' untranslated region of mRNA encoded by LOC84549, corresponding to a HOST TARGET binding site such as BINDING SITE I, BINDING SITE II or BINDING SITE III. Table 2 illustrates the complementarity of the nucleotide sequences of LOC84549 BINDING SITE, designated SEQ ID:26258, to the nucleotide sequence of VGAM2580 RNA, herein designated VGAM RNA, also designated SEQ ID:5291.

Another function of VGAM2580 is therefore inhibition of LOC84549 (Accession NM_032509). Accordingly, utilities of VGAM2580 include diagnosis, prevention and treatment of diseases and clinical conditions associated with LOC84549. LOC90538 (Accession XM_032401) is another VGAM2580 host target gene. LOC90538 BINDING SITE is HOST TARGET binding site found in the 3' untranslated region of mRNA encoded by LOC90538, corresponding to a HOST TARGET binding site such as BINDING SITE I, BINDING SITE II or BINDING SITE III. Table 2 illustrates the complementarity of the nucleotide sequences of LOC90538 BINDING SITE, designated SEQ ID:31654, to the nucleotide sequence of VGAM2580 RNA, herein designated VGAM RNA, also designated SEQ ID:5291.

Another function of VGAM2580 is therefore inhibition of LOC90538 (Accession XM_032401). Accordingly, utilities of VGAM2580 include diagnosis, prevention and treatment of diseases and clinical conditions associated with LOC90538. LOC92935 (Accession XM_048197) is another VGAM2580 host target gene. LOC92935 BINDING SITE is HOST TARGET binding site found in the 3' untranslated region of mRNA encoded by LOC92935, corresponding to a HOST TARGET binding site such as BINDING SITE I, BINDING SITE II or BINDING SITE III. Table 2 illustrates the complementarity of the nucleotide sequences of LOC92935 BINDING SITE, designated SEQ ID:35131, to the nucleotide sequence of VGAM2580 RNA, herein designated VGAM RNA, also designated SEQ ID:5291.

Another function of VGAM2580 is therefore inhibition of LOC92935 (Accession XM_048197). Accordingly, utilities of VGAM2580 include diagnosis, prevention and treatment of diseases and clinical conditions associated with LOC92935. FIG. 1 further provides a conceptual description of a novel bioinformatically detected viral gene of the present invention, referred to here as Viral Genomic Address Messenger 2581 (VGAM2581) viral gene, which modulates expression of respective host target genes thereof, the function and utility of which host target genes is known in the art.

VGAM2581 is a novel bioinformatically detected regulatory, non protein coding, viral micro RNA (miRNA) gene. The method by which VGAM2581 was detected is described hereinabove with reference to FIGS. 1-8.

VGAM2581 gene, herein designated VGAM GENE, is a viral gene contained in the genome of Triatoma Virus. VGAM2581 host target gene, herein designated VGAM HOST TARGET GENE, is a human gene contained in the human genome.

VGAM2581 gene encodes a VGAM2581 precursor RNA, herein designated VGAM PRECURSOR RNA. Similar to other miRNA genes, and unlike most ordinary genes, VGAM2581 precursor RNA does not encode a protein. A nucleotide sequence identical or highly similar to the nucleotide sequence of VGAM2581 precursor RNA is designated SEQ ID:2567, and is provided hereinbelow with reference to the sequence listing part. Nucleotide sequence SEQ ID:2567 is located at position 6465 relative to the genome of Triatoma Virus.

VGAM2581 precursor RNA folds onto itself, forming VGAM2581 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2581 folded precursor RNA into VGAM2581 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 66%) nucleotide sequence of VGAM2581 RNA is designated SEQ ID:5292, and is provided hereinbelow with reference to the sequence listing part.

VGAM2581 host target gene, herein designated VGAM HOST TARGET GENE, encodes a corresponding messenger RNA, VGAM2581 host target RNA, herein designated VGAM HOST TARGET RNA. VGAM2581 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2581 RNA, herein designated VGAM RNA, binds complementarily to one or more host target binding sites located in untranslated regions of VGAM2581 host target RNA, herein designated VGAM HOST TARGET RNA. This complementary binding is due to the fact that the nucleotide sequence of VGAM2581 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2581 RNA, herein designated VGAM RNA, may have a different number of host target binding sites in untranslated regions of a VGAM2581 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2581 RNA, herein designated VGAM RNA, to host target binding sites on VGAM2581 host target RNA, herein designated VGAM HOST TARGET RNA, such as BINDING SITE I, BINDING SITE II and BINDING SITE III, inhibits translation of VGAM2581 host target RNA into VGAM2581 host target protein, herein designated VGAM HOST TARGET PROTEIN. VGAM host target protein is therefore outlined by a broken line.

It is appreciated that VGAM2581 host target gene, herein designated VGAM HOST TARGET GENE, in fact represents a plurality of VGAM2581 host target genes. The mRNA of each one of this plurality of VGAM2581 host target genes comprises one or more host target binding sites, each having a nucleotide sequence which is at least partly complementary to VGAM2581 RNA, herein designated VGAM RNA, and which when bound by VGAM2581 RNA causes inhibition of translation of respective one or more VGAM2581 host target proteins.

It is further appreciated by one skilled in the art that the mode of translational inhibition illustrated by FIG. 1 with specific reference to translational inhibition exerted by VGAM2581 gene, herein designated VGAM GENE, on one or more VGAM2581 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2581 is inhibition of expression of host target genes, as part of a novel viral mechanism of attacking a host. Accordingly, utilities of VGAM2581 include diagnosis, prevention and treatment of viral infection by Triatoma Virus. Specific functions, and accordingly utilities, of VGAM2581 correlate with, and may be deduced from, the identity of the host target genes which VGAM2581 binds and inhibits, and the function of these host target genes, as elaborated hereinbelow.

Nucleotide sequences of the VGAM2581 precursor RNA, herein designated VGAM PRECURSOR RNA, and of the 'diced' VGAM2581 RNA, herein designated VGAM RNA, and a schematic representation of the secondary folding of VGAM2581 folded precursor RNA, herein designated VGAM FOLDED PRECURSOR RNA, of VGAM2581 are further described hereinbelow with reference to Table 1.

Nucleotide sequences of host target binding sites, such as BINDING SITE-I, BINDING SITE-II and BINDING SITE-III of FIG. 1, found on VGAM2581 host target RNA, and schematic representation of the complementarity of each of these host target binding sites to VGAM2581 RNA, herein designated VGAM RNA, are described hereinbelow with reference to Table 2.

As mentioned hereinabove with reference to FIG. 1, a function of VGAM2581 gene, herein designated VGAM is inhibition of expression of VGAM2581 target genes. It is appreciated that specific functions, and accordingly utilities, of VGAM2581 correlate with, and may be deduced from, the identity of the target genes which VGAM2581 binds and inhibits, and the function of these target genes, as elaborated hereinbelow.

Fatty-acid-Coenzyme A Ligase, Long-chain 4 (FACL4, Accession NM_004458) is a VGAM2581 host target gene. FACL4 BINDING SITE1 and FACL4 BINDING SITE2 are HOST TARGET binding sites found in untranslated regions of mRNA encoded by FACL4, corresponding to HOST TARGET binding sites such as BINDING SITE I, BINDING SITE II or BINDING SITE III. Table 2 illustrates the complementarity of the nucleotide sequences of FACL4 BINDING SITE1 and FACL4 BINDING SITE2, designated SEQ ID:10760 and SEQ ID:23250 respectively, to the nucleotide sequence of VGAM2581 RNA, herein designated VGAM RNA, also designated SEQ ID:5292.

A function of VGAM2581 is therefore inhibition of Fatty-acid-Coenzyme A Ligase, Long-chain 4 (FACL4, Accession NM_004458). Accordingly, utilities of VGAM2581 include diagnosis, prevention and treatment of diseases and clinical conditions associated with FACL4. Ketohexokinase (fructokinase) (KHK, Accession NM_000221) is another VGAM2581 host target gene. KHK BINDING SITE1 and KHK BINDING SITE2 are HOST TARGET binding sites found in untranslated regions of mRNA encoded by KHK, corresponding to HOST TARGET binding sites such as BINDING SITE I, BINDING SITE II or BINDING SITE III. Table 2 illustrates the complementarity of the nucleotide sequences of KHK BINDING SITE1 and KHK BINDING SITE2, designated SEQ ID:5730 and SEQ ID:37563 respectively, to the nucleotide sequence of VGAM2581 RNA, herein designated VGAM RNA, also designated SEQ ID:5292.

Another function of VGAM2581 is therefore inhibition of Ketohexokinase (fructokinase) (KHK, Accession NM_000221). Accordingly, utilities of VGAM2581 include diagnosis, prevention and treatment of diseases and clinical conditions associated with KHK. Phosphatidylinositol Glycan, Class A (paroxysmal nocturnal hemoglobinuria) (PIGA, Accession NM_020473) is another VGAM2581 host target gene. PIGA BINDING SITE1 and PIGA BINDING SITE2 are HOST TARGET binding sites found in untranslated regions of mRNA encoded by PIGA, corresponding to HOST TARGET binding sites such as BINDING SITE I, BINDING SITE II or BINDING SITE III. Table 2 illustrates the complementarity of the nucleotide sequences of PIGA BINDING SITE1 and PIGA BINDING SITE2, designated SEQ ID:21716 and SEQ ID:8866 respectively, to the nucleotide sequence of VGAM2581 RNA, herein designated VGAM RNA, also designated SEQ ID:5292.

Another function of VGAM2581 is therefore inhibition of Phosphatidylinositol Glycan, Class A (paroxysmal nocturnal hemoglobinuria) (PIGA, Accession NM_020473). Accordingly, utilities of VGAM2581 include diagnosis, prevention and treatment of diseases and clinical conditions associated with PIGA. Sialyltransferase 1 (beta-galactoside alpha-2,6-sialytransferase) (SIAT1, Accession NM_003032) is another VGAM2581 host target gene. SIAT1 BINDING SITE is HOST TARGET binding site found in the 3' untranslated region of mRNA encoded by SIAT1, corresponding to a HOST TARGET binding site such as BINDING SITE I, BINDING SITE II or BINDING SITE III. Table 2 illustrates the complementarity of the nucleotide sequences of SIAT1 BINDING SITE, designated SEQ ID:8975, to the nucleotide sequence of VGAM2581 RNA, herein designated VGAM RNA, also designated SEQ ID:5292.

Another function of VGAM2581 is therefore inhibition of Sialyltransferase 1 (beta-galactoside alpha-2,6-sialyltransferase) (SIAT1, Accession NM_003032), a gene which transfers sialic acid from the donor of substrate cmp- sialic acid to galactose containing acceptor substrates. Accordingly, utilities of VGAM2581 include diagnosis, prevention and treatment of diseases and clinical conditions associated with SIAT1. The function of SIAT1 and its association with various diseases and clinical conditions, has been established by previous studies, as described hereinabove with reference to VGAM1224. Claudin 1 (CLDN1, Accession NM_021101) is another VGAM2581 host target gene. CLDN1 BINDING SITE is HOST TARGET binding site found in the 3' untranslated region of mRNA encoded by CLDN1, corresponding to a HOST TARGET binding site such as BINDING SITE I, BINDING SITE II or BINDING SITE III. Table 2 illustrates the complementarity of the nucleotide sequences of CLDN1 BINDING SITE, designated SEQ ID:22078, to the nucleotide sequence of VGAM2581 RNA, herein designated VGAM RNA, also designated SEQ ID:5292.

Another function of VGAM2581 is therefore inhibition of Claudin 1 (CLDN1, Accession NM_021101). Accordingly, utilities of VGAM2581 include diagnosis, prevention and treatment of diseases and clinical conditions associated with CLDN1. KIAA0426 (Accession NM_014724) is another VGAM2581 host target gene. KIAA0426 BINDING SITE is HOST TARGET binding site found in the 3' untranslated region of mRNA encoded by KIAA0426, corresponding to a HOST TARGET binding site such as BINDING SITE I, BINDING SITE II or BINDING SITE III. Table 2 illustrates the complementarity of the nucleotide sequences of KIAA0426 BINDING SITE, designated SEQ ID:16306, to the nucleotide sequence of VGAM2581 RNA, herein designated VGAM RNA, also designated SEQ ID:5292.

Another function of VGAM2581 is therefore inhibition of KIAA0426 (Accession NM_014724). Accordingly, utilities of VGAM2581 include diagnosis, prevention and treatment of diseases and clinical conditions associated with KIAA0426. KIAA1255 (Accession XM_040626) is another VGAM2581 host target gene. KIAA1255 BINDING SITE is HOST TARGET binding site found in the 5' untranslated region of mRNA encoded by KIAA1255, corresponding to a HOST TARGET binding site such as BINDING SITE I, BINDING SITE II or BINDING SITE III. Table 2 illustrates the complementarity of the nucleotide sequences of KIAA1255 BINDING SITE, designated SEQ ID:33345, to the nucleotide sequence of VGAM2581 RNA, herein designated VGAM RNA, also designated SEQ ID:5292.

Another function of VGAM2581 is therefore inhibition of KIAA1255 (Accession XM_040626). Accordingly, utilities of VGAM2581 include diagnosis, prevention and treatment of diseases and clinical conditions associated with KIAA1255. KIAA1712 (Accession XM_041497) is another VGAM2581 host target gene. KIAA1712 BINDING SITE is HOST TARGET binding site found in the 3' untranslated region of mRNA encoded by KIAA1712, corresponding to a HOST TARGET binding site such as BINDING SITE I, BINDING SITE II or BINDING SITE III. Table 2 illustrates the complementarity of the nucleotide sequences of KIAA1712 BINDING SITE, designated SEQ ID:33537, to the nucleotide sequence of VGAM2581 RNA, herein designated VGAM RNA, also designated SEQ ID:5292.

Another function of VGAM2581 is therefore inhibition of KIAA1712 (Accession XM_041497). Accordingly, utilities of VGAM2581 include diagnosis, prevention and treatment of diseases and clinical conditions associated with KIAA1712. MEGF10 (Accession NM_032446) is another VGAM2581 host target gene. MEGF10 BINDING SITE is HOST TARGET binding site found in the 3' untranslated region of mRNA encoded by MEGF10, corresponding to a HOST TARGET binding site such as BINDING SITE I, BINDING SITE II or BINDING SITE III. Table 2 illustrates the complementarity of the nucleotide sequences of MEGF10 BINDING SITE, designated SEQ ID:26213, to the nucleotide sequence of VGAM2581 RNA, herein designated VGAM RNA, also designated SEQ ID:5292.

Another function of VGAM2581 is therefore inhibition of MEGF10 (Accession NM_032446). Accordingly, utilities of VGAM2581 include diagnosis, prevention and treatment of diseases and clinical conditions associated with MEGF10. SCAN Domain Containing 2 (SCAND2, Accession NM_022050) is another VGAM2581 host target gene. SCAND2 BINDING SITE is HOST TARGET binding site found in the 3' untranslated region of mRNA encoded by SCAND2, corresponding to a HOST TARGET binding site such as BINDING SITE I, BINDING SITE II or BINDING SITE III. Table 2 illustrates the complementarity of the nucleotide sequences of SCAND2 BINDING SITE, designated SEQ ID:22576, to the nucleotide sequence of VGAM2581 RNA, herein designated VGAM RNA, also designated SEQ ID:5292.

Another function of VGAM2581 is therefore inhibition of SCAN Domain Containing 2 (SCAND2, Accession NM_022050). Accordingly, utilities of VGAM2581 include diagnosis, prevention and treatment of diseases and clinical conditions associated with SCAND2. TAF9-like RNA Polymerase II, TATA Box Binding Protein (TBP)-associated Factor, 31 kDa (TAF9L, Accession NM_015975) is another VGAM2581 host target gene. TAF9L BINDING SITE is HOST TARGET binding site found in the 3' untranslated region of mRNA encoded by TAF9L, corresponding to a HOST TARGET binding site such as BINDING SITE I, BINDING SITE II or BINDING SITE III. Table 2 illustrates the complementarity of the nucleotide sequences of TAF9L BINDING SITE, designated SEQ ID:18071, to the nucleotide sequence of VGAM2581 RNA, herein designated VGAM RNA, also designated SEQ ID:5292.

Another function of VGAM2581 is therefore inhibition of TAF9-like RNA Polymerase II, TATA Box Binding Protein (TBP)-associated Factor, 31 kDa (TAF9L, Accession NM_015975). Accordingly, utilities of VGAM2581 include diagnosis, prevention and treatment of diseases and clinical conditions associated with TAF9L. Translocase of Outer Mitochondrial Membrane 70 Homolog A (yeast) (TOMM70A, Accession NM_014820) is another VGAM2581 host target gene. TOMM70A BINDING SITE is HOST TARGET binding site found in the 3' untranslated region of mRNA encoded by TOMM70A, corresponding to a HOST TARGET binding site such as BINDING SITE I, BINDING SITE II or BINDING SITE III. Table 2 illustrates the complementarity of the nucleotide sequences of TOMM70A BINDING SITE, designated SEQ ID:16788, to the nucleotide sequence of VGAM2581 RNA, herein designated VGAM RNA, also designated SEQ ID:5292.

Another function of VGAM2581 is therefore inhibition of Translocase of Outer Mitochondrial Membrane 70 Homolog A (yeast) (TOMM70A, Accession NM_014820). Accordingly, utilities of VGAM2581 include diagnosis, prevention and treatment of diseases and clinical conditions associated with TOMM70A. UQCR (Accession NM_006830) is another VGAM2581 host target gene. UQCR BINDING SITE is HOST TARGET binding site found in the 3' untranslated region of mRNA encoded by UQCR, corresponding to a HOST TARGET binding site such as BINDING SITE I, BINDING SITE II or BINDING SITE III. Table 2 illustrates the complementarity of the nucleotide sequences of UQCR BINDING SITE, designated SEQ ID:13708, to the nucleotide sequence of VGAM2581 RNA, herein designated VGAM RNA, also designated SEQ ID:5292.

Another function of VGAM2581 is therefore inhibition of UQCR (Accession NM_006830). Accordingly, utilities of VGAM2581 include diagnosis, prevention and treatment of diseases and clinical conditions associated with UQCR. LOC120939 (Accession XM_073688) is another VGAM2581 host target gene. LOC120939 BINDING SITE is HOST TARGET binding site found in the 5' untranslated region of mRNA encoded by LOC120939, corresponding to a HOST TARGET binding site such as BINDING SITE I, BINDING SITE II or BINDING SITE III. Table 2 illustrates the complementarity of the nucleotide sequences of LOC120939 BINDING SITE, designated SEQ ID:37512, to the nucleotide sequence of VGAM2581 RNA, herein designated VGAM RNA, also designated SEQ ID:5292.

Another function of VGAM2581 is therefore inhibition of LOC120939 (Accession XM_073688). Accordingly, utilities of VGAM2581 include diagnosis, prevention and treatment of diseases and clinical conditions associated with LOC120939. LOC128338 (Accession XM_059238) is another VGAM2581 host target gene. LOC128338 BINDING SITE is HOST TARGET binding site found in the 3' untranslated region of mRNA encoded by LOC128338, corresponding to a HOST TARGET binding site such as BINDING SITE I, BINDING SITE II or BINDING SITE III. Table 2 illustrates the complementarity of the nucleotide sequences of LOC128338 BINDING SITE, designated SEQ ID:36925, to the nucleotide sequence of VGAM2581 RNA, herein designated VGAM RNA, also designated SEQ ID:5292.

Another function of VGAM2581 is therefore inhibition of LOC128338 (Accession XM_059238). Accordingly, utilities of VGAM2581 include diagnosis, prevention and treatment of diseases and clinical conditions associated with LOC128338. LOC144845 (Accession NM_138474) is another VGAM2581 host target gene. LOC144845 BINDING SITE is HOST TARGET binding site found in the 5' untranslated region of mRNA encoded by LOC144845, corresponding to a HOST TARGET binding site such as BINDING SITE I, BINDING SITE II or BINDING SITE III. Table 2 illustrates the complementarity of the nucleotide sequences of LOC144845 BINDING SITE, designated SEQ ID:28822, to the nucleotide sequence of VGAM2581 RNA, herein designated VGAM RNA, also designated SEQ ID:5292.

Another function of VGAM2581 is therefore inhibition of LOC144845 (Accession NM_138474). Accordingly, utilities of VGAM2581 include diagnosis, prevention and treatment of diseases and clinical conditions associated with LOC144845. LOC146780 (Accession XM_097086) is another VGAM2581 host target gene. LOC146780 BINDING SITE is HOST TARGET binding site found in the 3' untranslated region of mRNA encoded by LOC146780, corresponding to a HOST TARGET binding site such as BINDING SITE I, BINDING SITE II or BINDING SITE III. Table 2 illustrates the complementarity of the nucleotide sequences of LOC146780 BINDING SITE, designated SEQ ID:40744, to the nucleotide sequence of VGAM2581 RNA, herein designated VGAM RNA, also designated SEQ ID:5292.

Another function of VGAM2581 is therefore inhibition of LOC146780 (Accession XM_097086). Accordingly, utilities of VGAM2581 include diagnosis, prevention and treatment of diseases and clinical conditions associated with LOC146780. LOC147804 (Accession XM_085901) is another VGAM2581 host target gene. LOC147804 BINDING SITE is HOST TARGET binding site found in the 5' untranslated region of mRNA encoded by LOC147804, corresponding to a HOST TARGET binding site such as BINDING SITE I, BINDING SITE II or BINDING SITE III. Table 2 illustrates the complementarity of the nucleotide sequences of LOC147804 BINDING SITE, designated SEQ ID:38381, to the nucleotide sequence of VGAM2581 RNA, herein designated VGAM RNA, also designated SEQ ID:5292.

Another function of VGAM2581 is therefore inhibition of LOC147804 (Accession XM_085901). Accordingly, utilities of VGAM2581 include diagnosis, prevention and treatment of diseases and clinical conditions associated with LOC147804. LOC150998 (Accession XM_097990) is another VGAM2581 host target gene. LOC150998 BINDING SITE is HOST TARGET binding site found in the 3' untranslated region of mRNA encoded by LOC150998, corresponding to a HOST TARGET binding site such as BINDING SITE I, BINDING SITE II or BINDING SITE III. Table 2 illustrates the complementarity of the nucleotide sequences of LOC150998 BINDING SITE, designated SEQ ID:41285, to the nucleotide sequence of VGAM2581 RNA, herein designated VGAM RNA, also designated SEQ ID:5292.

Another function of VGAM2581 is therefore inhibition of LOC150998 (Accession XM_097990). Accordingly, utilities of VGAM2581 include diagnosis, prevention and treatment of diseases and clinical conditions associated with LOC150998. LOC151318 (Accession XM_087170) is another VGAM2581 host target gene. LOC151318 BINDING SITE is HOST TARGET binding site found in the 3' untranslated region of mRNA encoded by LOC151318, corresponding to a HOST TARGET binding site such as BINDING SITE I, BINDING SITE II or BINDING SITE III. Table 2 illustrates the complementarity of the nucleotide sequences of LOC151318 BINDING SITE, designated SEQ ID:39104, to the nucleotide sequence of VGAM2581 RNA, herein designated VGAM RNA, also designated SEQ ID:5292.

Another function of VGAM2581 is therefore inhibition of LOC151318 (Accession XM_087170). Accordingly, utilities of VGAM2581 include diagnosis, prevention and treatment of diseases and clinical conditions associated with LOC151318. LOC255481 (Accession XM_170489) is another VGAM2581 host target gene. LOC255481 BINDING SITE is HOST TARGET binding site found in the 3' untranslated region of mRNA encoded by LOC255481, corresponding to a HOST TARGET binding site such as BINDING SITE I, BINDING SITE II or BINDING SITE III. Table 2 illustrates the complementarity of the nucleotide sequences of LOC255481 BINDING SITE, designated SEQ ID:45329, to the nucleotide sequence of VGAM2581 RNA, herein designated VGAM RNA, also designated SEQ ID:5292.

Another function of VGAM2581 is therefore inhibition of LOC255481 (Accession XM_170489). Accordingly, utilities of VGAM2581 include diagnosis, prevention and treatment of diseases and clinical conditions associated with LOC255481. FIG. 1 further provides a conceptual description of a novel bioinformatically detected viral gene of the present invention, referred to here as Viral Genomic Address Messenger 2582 (VGAM2582) viral gene, which modulates expression of respective host target genes thereof, the function and utility of which host target genes is known in the art.

VGAM2582 is a novel bioinformatically detected regulatory, non protein coding, viral micro RNA (miRNA) gene. The method by which VGAM2582 was detected is described hereinabove with reference to FIGS. 1-8.

VGAM2582 gene, herein designated VGAM GENE, is a viral gene contained in the genome of Triatoma Virus. VGAM2582 host target gene, herein designated VGAM HOST TARGET GENE, is a human gene contained in the human genome.

VGAM2582 gene encodes a VGAM2582 precursor RNA, herein designated VGAM PRECURSOR RNA. Similar to other miRNA genes, and unlike most ordinary genes, VGAM2582 precursor RNA does not encode a protein. A nucleotide sequence identical or highly similar to the nucleotide sequence of VGAM2582 precursor RNA is designated SEQ ID:2568, and is provided hereinbelow with reference to the sequence listing part. Nucleotide sequence SEQ ID:2568 is located at position 8016 relative to the genome of Triatoma Virus.

VGAM2582 precursor RNA folds onto itself, forming VGAM2582 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2582 folded precursor RNA into VGAM2582 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2582 RNA is designated SEQ ID:5293, and is provided hereinbelow with reference to the sequence listing part.

VGAM2582 host target gene, herein designated VGAM HOST TARGET GENE, encodes a corresponding messenger RNA, VGAM2582 host target RNA, herein designated VGAM HOST TARGET RNA. VGAM2582 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2582 RNA, herein designated VGAM RNA, binds complementarily to one or more host target binding sites located in untranslated regions of VGAM2582 host target RNA, herein designated VGAM HOST TARGET RNA. This complementary binding is due to the fact that the nucleotide sequence of VGAM2582 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2582 RNA, herein designated VGAM RNA, may have a different number of host target binding sites in untranslated regions of a VGAM2582 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2582 RNA, herein designated VGAM RNA, to host target binding sites on VGAM2582 host target RNA, herein designated VGAM HOST TARGET RNA, such as BINDING SITE I, BINDING SITE II and BINDING SITE III, inhibits translation of VGAM2582 host target RNA into VGAM2582 host target protein, herein designated VGAM HOST TARGET PROTEIN. VGAM host target protein is therefore outlined by a broken line.

It is appreciated that VGAM2582 host target gene, herein designated VGAM HOST TARGET GENE, in fact represents a plurality of VGAM2582 host target genes. The mRNA of each one of this plurality of VGAM2582 host target genes comprises one or more host target binding sites, each having a nucleotide sequence which is at least partly complementary to VGAM2582 RNA, herein designated VGAM RNA, and which when bound by VGAM2582 RNA causes inhibition of translation of respective one or more VGAM2582 host target proteins.

It is further appreciated by one skilled in the art that the mode of translational inhibition illustrated by FIG. 1 with specific reference to translational inhibition exerted by VGAM2582 gene, herein designated VGAM GENE, on one or more VGAM2582 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2582 is inhibition of expression of host target genes, as part of a novel viral mechanism of attacking a host. Accordingly, utilities of VGAM2582 include diagnosis, prevention and treatment of viral infection by Triatoma Virus. Specific functions, and accordingly utilities, of VGAM2582 correlate with, and may be deduced from, the identity of the host target genes which VGAM2582 binds and inhibits, and the function of these host target genes, as elaborated hereinbelow.

Nucleotide sequences of the VGAM2582 precursor RNA, herein designated VGAM PRECURSOR RNA, and of the 'diced' VGAM2582 RNA, herein designated VGAM RNA, and a schematic representation of the secondary folding of VGAM2582 folded precursor RNA, herein designated VGAM FOLDED PRECURSOR RNA, of VGAM2582 are further described hereinbelow with reference to Table 1.

Nucleotide sequences of host target binding sites, such as BINDING SITE-I, BINDING SITE-II and BINDING SITE-III of FIG. 1, found on VGAM2582 host target RNA, and schematic representation of the complementarity of each of these host target binding sites to VGAM2582 RNA, herein designated VGAM RNA, are described hereinbelow with reference to Table 2.

As mentioned hereinabove with reference to FIG. 1, a function of VGAM2582 gene, herein designated VGAM is inhibition of expression of VGAM2582 target genes. It is appreciated that specific functions, and accordingly utilities, of VGAM2582 correlate with, and may be deduced from, the identity of the target genes which VGAM2582 binds and inhibits, and the function of these target genes, as elaborated hereinbelow.

Dachshund Homolog (Drosophila) (DACH, Accession NM_080759) is a VGAM2582 host target gene. DACH BINDING SITE is HOST TARGET binding site found in the 3' untranslated region of mRNA encoded by DACH, corresponding to a HOST TARGET binding site such as BINDING SITE I, BINDING SITE II or BINDING SITE III. Table 2 illustrates the complementarity of the nucleotide sequences of DACH BINDING SITE, designated SEQ ID:28040, to the nucleotide sequence of VGAM2582 RNA, herein designated VGAM RNA, also designated SEQ ID:5293.

A function of VGAM2582 is therefore inhibition of Dachshund Homolog (Drosophila) (DACH, Accession NM_080759), a gene which regulates early progenitor cell proliferation during retinogenesis and pituitary development. Accordingly, utilities of VGAM2582 include diagnosis, prevention and treatment of diseases and clinical conditions associated with DACH. The function of DACH and its association with various diseases and clinical conditions, has been established by previous studies, as described hereinabove with reference to VGAM260. Eukaryotic Translation Initiation Factor 3, Subunit 10 Theta, 150/170 kDa (EIF3S10, Accession XM_049795) is another VGAM2582 host target gene. EIF3S10 BINDING SITE is HOST TARGET binding site found in the 3' untranslated region of mRNA encoded by EIF3S10, corresponding to a HOST TARGET binding site such as BINDING SITE I, BINDING SITE II or BINDING SITE III. Table 2 illustrates the complementarity of the nucleotide sequences of EIF3S10 BINDING SITE, designated SEQ ID:35500, to the nucleotide sequence of VGAM2582 RNA, herein designated VGAM RNA, also designated SEQ ID:5293.

Another function of VGAM2582 is therefore inhibition of Eukaryotic Translation Initiation Factor 3, Subunit 10 Theta, 150/170 kDa (EIF3S10, Accession XM_049795), a gene which binds to the 40s ribosome and promotes the binding of methionyl-trnai and mrna. Accordingly, utilities of VGAM2582 include diagnosis, prevention and treatment of diseases and clinical conditions associated with EIF3S10. The function of EIF3S10 and its association with various diseases and clinical conditions, has been established by previous studies, as described hereinabove with reference to VGAM882. Fucosyltransferase 9 (alpha (1,3) Fucosyltransferase) (FUT9, Accession XM_042167) is another VGAM2582 host target gene. FUT9 BINDING SITE is HOST TARGET binding site found in the 3' untranslated region of mRNA encoded by FUT9, corresponding to a HOST TARGET binding site such as BINDING SITE I, BINDING SITE II or BINDING SITE III. Table 2 illustrates the complementarity of the nucleotide sequences of FUT9 BINDING SITE, designated SEQ ID:33699, to the nucleotide sequence of VGAM2582 RNA, herein designated VGAM RNA, also designated SEQ ID:5293.

Another function of VGAM2582 is therefore inhibition of Fucosyltransferase 9 (alpha (1,3) Fucosyltransferase) (FUT9, Accession XM_042167), a gene which catalyzes alpha-1,3 glycosidic linkages. Accordingly, utilities of VGAM2582 include diagnosis, prevention and treatment of diseases and clinical conditions associated with FUT9. The function of FUT9 and its association with various diseases and clinical conditions, has been established by previous studies, as described hereinabove with reference to VGAM206. Loss of Heterozygosity, 11, Chromosomal Region 2, Gene A (LOH11CR2A, Accession NM_014622) is another VGAM2582 host target gene. LOH11CR2A BINDING SITE is HOST TARGET binding site found in the 3' untranslated region of mRNA encoded by LOH11CR2A, corresponding to a HOST TARGET binding site such as BINDING SITE I, BINDING SITE II or BINDING SITE III. Table 2 illustrates the complementarity of the nucleotide sequences of LOH11CR2A BINDING SITE, designated SEQ ID:15985, to the nucleotide sequence of VGAM2582 RNA, herein designated VGAM RNA, also designated SEQ ID:5293.

Another function of VGAM2582 is therefore inhibition of Loss of Heterozygosity, 11, Chromosomal Region 2, Gene A (LOH11CR2A, Accession NM_014622). Accordingly, utilities of VGAM2582 include diagnosis, prevention and treatment of diseases and clinical conditions associated with LOH11CR2A. Optic Atrophy 1 (autosomal dominant) (OPA1, Accession NM_130834) is another VGAM2582 host target gene. OPA1 BINDING SITE1 through OPA1 BINDING SITE5 are HOST TARGET binding sites found in untranslated regions of mRNA encoded by OPA1, corresponding to HOST TARGET binding sites such as BINDING SITE I, BINDING SITE II or BINDING SITE III. Table 2 illustrates the complementarity of the nucleotide sequences of OPA1 BINDING SITE1 through OPA1 BINDING SITE5, designated SEQ ID:28331, SEQ ID:28355, SEQ ID:28339, SEQ ID:28323 and SEQ ID:28347 respectively, to the nucleotide sequence of VGAM2582 RNA, herein designated VGAM RNA, also designated SEQ ID:5293.

Another function of VGAM2582 is therefore inhibition of Optic Atrophy 1 (autosomal dominant) (OPA1, Accession NM_130834). Accordingly, utilities of VGAM2582 include diagnosis, prevention and treatment of diseases and clinical conditions associated with OPA1. Ubiquitination Factor E4A (UFD2 homolog, yeast) (UBE4A, Accession NM_004788) is another VGAM2582 host target gene. UBE4A BINDING SITE is HOST TARGET binding site found in the 3' untranslated region of mRNA encoded by UBE4A, corresponding to a HOST TARGET binding site such as BINDING SITE I, BINDING SITE II or BINDING SITE III. Table 2 illustrates the complementarity of the nucleotide sequences of UBE4A BINDING SITE, designated SEQ ID:11196, to the nucleotide sequence of VGAM2582 RNA, herein designated VGAM RNA, also designated SEQ ID:5293.

Another function of VGAM2582 is therefore inhibition of Ubiquitination Factor E4A (UFD2 homolog, yeast) (UBE4A, Accession NM_004788), a gene which binds to the ubiquitin moieties of preformed conjugates and catalyzes ubiquitin chain assembly in conjunction with E1, E2, and E3. Accordingly, utilities of VGAM2582 include diagnosis, prevention and treatment of diseases and clinical conditions associated with UBE4A. The function of UBE4A and its association with various diseases and clinical conditions, has been established by previous studies, as described hereinabove with reference to VGAM60. FLJ10803 (Accession NM_018224) is another VGAM2582 host target gene. FLJ10803 BINDING SITE is HOST TARGET binding site found in the 3' untranslated region of mRNA encoded by FLJ10803, corresponding to a HOST TARGET binding site such as BINDING SITE I, BINDING SITE II or BINDING SITE III. Table 2 illustrates the complementarity of the nucleotide sequences of FLJ10803 BINDING SITE, designated SEQ ID:20156, to the nucleotide sequence of VGAM2582 RNA, herein designated VGAM RNA, also designated SEQ ID:5293.

Another function of VGAM2582 is therefore inhibition of FLJ10803 (Accession NM_018224). Accordingly, utilities of VGAM2582 include diagnosis, prevention and treatment of diseases and clinical conditions associated with FLJ10803. KIAA0553 (Accession XM_045981) is another VGAM2582 host target gene. KIAA0553 BINDING SITE is HOST TARGET binding site found in the 3' untranslated region of mRNA encoded by KIAA0553, corresponding to a HOST TARGET binding site such as BINDING SITE I, BINDING SITE II or BINDING SITE III. Table 2 illustrates the complementarity of the nucleotide sequences of KIAA0553 BINDING SITE, designated SEQ ID:34633, to the nucleotide sequence of VGAM2582 RNA, herein designated VGAM RNA, also designated SEQ ID:5293.

Another function of VGAM2582 is therefore inhibition of KIAA0553 (Accession XM_045981). Accordingly, utilities of VGAM2582 include diagnosis, prevention and treatment of diseases and clinical conditions associated with KIAA0553. KIAA0924 (Accession NM_014897) is another VGAM2582 host target gene. KIAA0924 BINDING SITE is HOST TARGET binding site found in the 5' untranslated region of mRNA encoded by KIAA0924, corresponding to a HOST TARGET binding site such as BINDING SITE I, BINDING SITE II or BINDING SITE III. Table 2 illustrates the complementarity of the nucleotide sequences of KIAA0924 BINDING SITE, designated SEQ ID:17062, to the nucleotide sequence of VGAM2582 RNA, herein designated VGAM RNA, also designated SEQ ID:5293.

Another function of VGAM2582 is therefore inhibition of KIAA0924 (Accession NM_014897). Accordingly, utilities of VGAM2582 include diagnosis, prevention and treatment of diseases and clinical conditions associated with KIAA0924. KIAA1266 (Accession XM_038567) is another VGAM2582 host target gene. KIAA1266 BINDING SITE is HOST TARGET binding site found in the 3' untranslated region of mRNA encoded by KIAA1266, corresponding to a HOST TARGET binding site such as BINDING SITE I, BINDING SITE II or BINDING SITE III. Table 2 illustrates the complementarity of the nucleotide sequences of KIAA1266 BINDING SITE, designated SEQ ID:32867, to the nucleotide sequence of VGAM2582 RNA, herein designated VGAM RNA, also designated SEQ ID:5293.

Another function of VGAM2582 is therefore inhibition of KIAA1266 (Accession XM_038567). Accordingly, utilities of VGAM2582 include diagnosis, prevention and treatment of diseases and clinical conditions associated with KIAA1266. KIAA1328 (Accession XM_029429) is another VGAM2582 host target gene. KIAA1328 BINDING SITE is HOST TARGET binding site found in the 3' untranslated region of mRNA encoded by KIAA1328, corresponding to a HOST TARGET binding site such as BINDING SITE I, BINDING SITE II or BINDING SITE III. Table 2 illustrates the complementarity of the nucleotide sequences of KIAA1328 BINDING SITE, designated SEQ ID:30889, to the nucleotide sequence of VGAM2582 RNA, herein designated VGAM RNA, also designated SEQ ID:5293.

Another function of VGAM2582 is therefore inhibition of KIAA1328 (Accession XM_029429). Accordingly, utilities of VGAM2582 include diagnosis, prevention and treatment of diseases and clinical conditions associated with KIAA1328. KIAA1554 (Accession XM_170834) is another VGAM2582 host target gene. KIAA1554 BINDING SITE is HOST TARGET binding site found in the 3' untranslated region of mRNA encoded by KIAA1554, corresponding to a HOST TARGET binding site such as BINDING SITE I, BINDING SITE II or BINDING SITE III. Table 2 illustrates the complementarity of the nucleotide sequences of KIAA1554 BINDING SITE, designated SEQ ID:45606, to the nucleotide sequence of VGAM2582 RNA, herein designated VGAM RNA, also designated SEQ ID:5293.

Another function of VGAM2582 is therefore inhibition of KIAA1554 (Accession XM_170834). Accordingly, utilities of VGAM2582 include diagnosis, prevention and treatment of diseases and clinical conditions associated with KIAA1554. SKIP (Accession NM_130766) is another VGAM2582 host target gene. SKIP BINDING SITE is HOST TARGET binding site found in the 5' untranslated region of mRNA encoded by SKIP, corresponding to a HOST TARGET binding site such as BINDING SITE I, BINDING SITE II or BINDING SITE III. Table 2 illustrates the complementarity of the nucleotide sequences of SKIP BINDING SITE, designated SEQ ID:28263, to the nucleotide sequence of VGAM2582 RNA, herein designated VGAM RNA, also designated SEQ ID:5293.

Another function of VGAM2582 is therefore inhibition of SKIP (Accession NM_130766). Accordingly, utilities of VGAM2582 include diagnosis, prevention and treatment of diseases and clinical conditions associated with SKIP. LOC118668 (Accession XM_061081) is another VGAM2582 host target gene. LOC118668 BINDING SITE is HOST TARGET binding site found in the 5' untranslated region of mRNA encoded by LOC118668, corresponding to a HOST TARGET binding site such as BINDING SITE I, BINDING SITE II or BINDING SITE III. Table 2 illustrates the complementarity of the nucleotide sequences of LOC118668 BINDING SITE, designated SEQ ID:37190, to the nucleotide sequence of VGAM2582 RNA, herein designated VGAM RNA, also designated SEQ ID:5293.

Another function of VGAM2582 is therefore inhibition of LOC118668 (Accession XM_061081). Accordingly, utilities of VGAM2582 include diagnosis, prevention and treatment of diseases and clinical conditions associated with LOC118668. LOC151318 (Accession XM_087170) is another VGAM2582 host target gene. LOC151318 BINDING SITE is HOST TARGET binding site found in the 3' untranslated region of mRNA encoded by LOC151318, corresponding to a HOST TARGET binding site such as BINDING SITE I, BINDING SITE II or BINDING SITE III. Table 2 illustrates the complementarity of the nucleotide sequences of LOC151318 BINDING SITE, designated SEQ ID:39106, to the nucleotide sequence of VGAM2582 RNA, herein designated VGAM RNA, also designated SEQ ID:5293.

Another function of VGAM2582 is therefore inhibition of LOC151318 (Accession XM_087170). Accordingly, utilities of VGAM2582 include diagnosis, prevention and treatment of diseases and clinical conditions associated with LOC151318. LOC91115 (Accession XM_036218) is another VGAM2582 host target gene. LOC91115 BINDING SITE is HOST TARGET binding site found in the 3' untranslated region of mRNA encoded by LOC91115, corresponding to a HOST TARGET binding site such as BINDING SITE I, BINDING SITE II or BINDING SITE III. Table 2 illustrates the complementarity of the nucleotide sequences of LOC91115 BINDING SITE, designated SEQ ID:32401, to the nucleotide sequence of VGAM2582 RNA, herein designated VGAM RNA, also designated SEQ ID:5293.

Another function of VGAM2582 is therefore inhibition of LOC91115 (Accession XM_036218). Accordingly, utilities of VGAM2582 include diagnosis, prevention and treatment of diseases and clinical conditions associated with LOC91115. FIG. 1 further provides a conceptual description of a novel bioinformatically detected viral gene of the present invention, referred to here as Viral Genomic Address Messenger 2583 (VGAM2583) viral gene, which modulates expression of respective host target genes thereof, the function and utility of which host target genes is known in the art.

VGAM2583 is a novel bioinformatically detected regulatory, non protein coding, viral micro RNA (miRNA) gene. The method by which VGAM2583 was detected is described hereinabove with reference to FIGS. 1-8.

VGAM2583 gene, herein designated VGAM GENE, is a viral gene contained in the genome of Triatoma Virus. VGAM2583 host target gene, herein designated VGAM HOST TARGET GENE, is a human gene contained in the human genome.

VGAM2583 gene encodes a VGAM2583 precursor RNA, herein designated VGAM PRECURSOR RNA. Similar to other miRNA genes, and unlike most ordinary genes, VGAM2583 precursor RNA does not encode a protein. A nucleotide sequence identical or highly similar to the nucleotide sequence of VGAM2583 precursor RNA is designated SEQ ID:2569, and is provided hereinbelow with reference to the sequence listing part. Nucleotide sequence SEQ ID:2569 is located at position 7137 relative to the genome of Triatoma Virus.

VGAM2583 precursor RNA folds onto itself, forming VGAM2583 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2583 folded precursor RNA into VGAM2583 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2583 RNA is designated SEQ ID:5294, and is provided hereinbelow with reference to the sequence listing part.

VGAM2583 host target gene, herein designated VGAM HOST TARGET GENE, encodes a corresponding messenger RNA, VGAM2583 host target RNA, herein designated VGAM HOST TARGET RNA. VGAM2583 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2583 RNA, herein designated VGAM RNA, binds complementarily to one or more host target binding sites located in untranslated regions of VGAM2583 host target RNA, herein designated VGAM HOST TARGET RNA. This complementary binding is due to the fact that the nucleotide sequence of VGAM2583 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2583 RNA, herein designated VGAM RNA, may have a different number of host target binding sites in untranslated regions of a VGAM2583 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2583 RNA, herein designated VGAM RNA, to host target binding sites on VGAM2583 host target RNA, herein designated VGAM HOST TARGET RNA, such as BINDING SITE I, BINDING SITE II and BINDING SITE III, inhibits translation of VGAM2583 host target RNA into VGAM2583 host target protein, herein designated VGAM HOST TARGET PROTEIN. VGAM host target protein is therefore outlined by a broken line.

It is appreciated that VGAM2583 host target gene, herein designated VGAM HOST TARGET GENE, in fact represents a plurality of VGAM2583 host target genes. The mRNA of each one of this plurality of VGAM2583 host target genes comprises one or more host target binding sites, each having a nucleotide sequence which is at least partly complementary to VGAM2583 RNA, herein designated VGAM RNA, and which when bound by VGAM2583 RNA causes inhibition of translation of respective one or more VGAM2583 host target proteins.

It is further appreciated by one skilled in the art that the mode of translational inhibition illustrated by FIG. 1 with specific reference to translational inhibition exerted by VGAM2583 gene, herein designated VGAM GENE, on one or more VGAM2583 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2583 is inhibition of expression of host target genes, as part of a novel viral mechanism of attacking a host. Accordingly, utilities of VGAM2583 include diagnosis, prevention and treatment of viral infection by Triatoma Virus. Specific functions, and accordingly utilities, of VGAM2583 correlate with, and may be deduced from, the identity of the host target genes which VGAM2583 binds and inhibits, and the function of these host target genes, as elaborated hereinbelow.

Nucleotide sequences of the VGAM2583 precursor RNA, herein designated VGAM PRECURSOR RNA, and of the 'diced' VGAM2583 RNA, herein designated VGAM RNA, and a schematic representation of the secondary folding of VGAM2583 folded precursor RNA, herein designated VGAM FOLDED PRECURSOR RNA, of VGAM2583 are further described hereinbelow with reference to Table 1.

Nucleotide sequences of host target binding sites, such as BINDING SITE-I, BINDING SITE-II and BINDING SITE-III of FIG. 1, found on VGAM2583 host target RNA, and schematic representation of the complementarity of each of these host target binding sites to VGAM2583 RNA, herein designated VGAM RNA, are described hereinbelow with reference to Table 2.

As mentioned hereinabove with reference to FIG. 1, a function of VGAM2583 gene, herein designated VGAM is inhibition of expression of VGAM2583 target genes. It is appreciated that specific functions, and accordingly utilities, of VGAM2583 correlate with, and may be deduced from, the identity of the target genes which VGAM2583 binds and inhibits, and the function of these target genes, as elaborated hereinbelow.

Cystic Fibrosis Transmembrane Conductance Regulator, ATP-binding Cassette (sub-family C, member 7) (CFTR, Accession NM_000492) is a VGAM2583 host target gene. CFTR BINDING SITE is HOST TARGET binding site found in the 3" untranslated region of mRNA encoded by CFTR, corresponding to a HOST TARGET binding site such as BINDING SITE I, BINDING SITE II or BINDING SITE III. Table 2 illustrates the complementarity of the nucleotide sequences of CFTR BINDING SITE, designated SEQ ID:6100, to the nucleotide sequence of VGAM2583 RNA, herein designated VGAM RNA, also designated SEQ ID:5294.

A function of VGAM2583 is therefore inhibition of Cystic Fibrosis Transmembrane Conductance Regulator, ATP-binding Cassette (sub-family C, member 7) (CFTR, Accession NM_000492). Accordingly, utilities of VGAM2583 include diagnosis, prevention and treatment of diseases and clinical conditions associated with CFTR. Leucine Zipper, Down-regulated In Cancer 1 (LDOC1, Accession NM_012317) is another VGAM2583 host target gene. LDOC1 BINDING SITE is HOST TARGET binding site found in the 3' untranslated region of mRNA encoded by LDOC1, corresponding to a HOST TARGET binding site such as BINDING SITE I, BINDING SITE II or BINDING SITE III. Table 2 illustrates the complementarity of the nucleotide sequences of LDOC1 BINDING SITE, designated SEQ ID:14694, to the nucleotide sequence of VGAM2583 RNA, herein designated VGAM RNA, also designated SEQ ID:5294.

Another function of VGAM2583 is therefore inhibition of Leucine Zipper, Down-regulated In Cancer 1 (LDOC1, Accession NM_012317). Accordingly, utilities of VGAM2583 include diagnosis, prevention and treatment of diseases and clinical conditions associated with LDOC1. POU Domain, Class 4, Transcription Factor 1 (POU4F1, Accession NM_006237) is another VGAM2583 host target gene. POU4F1 BINDING SITE is HOST TARGET binding site found in the 3' untranslated region of mRNA encoded by POU4F1, corresponding to a HOST TARGET binding site such as BINDING SITE I, BINDING SITE II or BINDING SITE III. Table 2 illustrates the complementarity of the nucleotide sequences of POU4F1 BINDING SITE, designated SEQ ID:12902, to the nucleotide sequence of VGAM2583 RNA, herein designated VGAM RNA, also designated SEQ ID:5294.

Another function of VGAM2583 is therefore inhibition of POU Domain, Class 4, Transcription Factor 1 (POU4F1, Accession NM_006237), a gene which plays a role in the regulation of specific gene expression within a subset of neuronal lineages. Accordingly, utilities of VGAM2583 include diagnosis, prevention and treatment of diseases and clinical conditions associated with POU4F1. The function of POU4F1 and its association with various diseases and clinical conditions, has been established by previous studies, as described hereinabove with reference to VGAM1026. Solute Carrier Family 21 (prostaglandin transporter), Member 2 (SLC21A2, Accession NM_005630) is another VGAM2583 host target gene. SLC21A2 BINDING SITE is HOST TARGET binding site found in the 3' untranslated region of mRNA encoded by SLC21A2, corresponding to a HOST TARGET binding site such as BINDING SITE I, BINDING SITE II or BINDING SITE III. Table 2 illustrates the complementarity of the nucleotide sequences of SLC21A2 BINDING SITE, designated SEQ ID:12157, to the nucleotide sequence of VGAM2583 RNA, herein designated VGAM RNA, also designated SEQ ID:5294.

Another function of VGAM2583 is therefore inhibition of Solute Carrier Family 21 (prostaglandin transporter), Member 2 (SLC21A2, Accession NM_005630), a gene which is a Prostaglandin transporter. Accordingly, utilities of VGAM2583 include diagnosis, prevention and treatment of diseases and clinical conditions associated with SLC21A2.

The function of SLC21A2 and its association with various diseases and clinical conditions, has been established by previous studies, as described hereinabove with reference to VGAM83. BICD2 (Accession XM_046863) is another VGAM2583 host target gene. BICD2 BINDING SITE is HOST TARGET binding site found in the 3' untranslated region of mRNA encoded by BICD2, corresponding to a HOST TARGET binding site such as BINDING SITE I, BINDING SITE II or BINDING SITE III. Table 2 illustrates the complementarity of the nucleotide sequences of BICD2 BINDING SITE, designated SEQ ID:34853, to the nucleotide sequence of VGAM2583 RNA, herein designated VGAM RNA, also designated SEQ ID:5294.

Another function of VGAM2583 is therefore inhibition of BICD2 (Accession XM_046863). Accordingly, utilities of VGAM2583 include diagnosis, prevention and treatment of diseases and clinical conditions associated with BICD2. FLJ11117 (Accession NM_018329) is another VGAM2583 host target gene. FLJ11117 BINDING SITE is HOST TARGET binding site found in the 3' untranslated region of mRNA encoded by FLJ11117, corresponding to a HOST TARGET binding site such as BINDING SITE I, BINDING SITE II or BINDING SITE III. Table 2 illustrates the complementarity of the nucleotide sequences of FLJ11117 BINDING SITE, designated SEQ ID:20328, to the nucleotide sequence of VGAM2583 RNA, herein designated VGAM RNA, also designated SEQ ID:5294.

Another function of VGAM2583 is therefore inhibition of FLJ11117 (Accession NM_018329). Accordingly, utilities of VGAM2583 include diagnosis, prevention and treatment of diseases and clinical conditions associated with FLJ11117. FLJ20209 (Accession XM_098142) is another VGAM2583 host target gene. FLJ20209 BINDING SITE is HOST TARGET binding site found in the 3' untranslated region of mRNA encoded by FLJ20209, corresponding to a HOST TARGET binding site such as BINDING SITE I, BINDING SITE II or BINDING SITE III. Table 2 illustrates the complementarity of the nucleotide sequences of FLJ20209 BINDING SITE, designated SEQ ID:41406, to the nucleotide sequence of VGAM2583 RNA, herein designated VGAM RNA, also designated SEQ ID:5294.

Another function of VGAM2583 is therefore inhibition of FLJ20209 (Accession XM_098142). Accordingly, utilities of VGAM2583 include diagnosis, prevention and treatment of diseases and clinical conditions associated with FLJ20209. KIAA0172 (Accession XM_036295) is another VGAM2583 host target gene. KIAA0172 BINDING SITE is HOST TARGET binding site found in the 3' untranslated region of mRNA encoded by KIAA0172, corresponding to a HOST TARGET binding site such as BINDING SITE I, BINDING SITE II or BINDING SITE III. Table 2 illustrates the complementarity of the nucleotide sequences of KIAA0172 BINDING SITE, designated SEQ ID:32413, to the nucleotide sequence of VGAM2583 RNA, herein designated VGAM RNA, also designated SEQ ID:5294.

Another function of VGAM2583 is therefore inhibition of KIAA0172 (Accession XM_036295). Accordingly, utilities of VGAM2583 include diagnosis, prevention and treatment of diseases and clinical conditions associated with KIAA0172. KIAA0564 (Accession XM_038664) is another VGAM2583 host target gene. KIAA0564 BINDING SITE is HOST TARGET binding site found in the 3' untranslated region of mRNA encoded by KIAA0564, corresponding to a HOST TARGET binding site such as BINDING SITE I, BINDING SITE II or BINDING SITE III. Table 2 illustrates the complementarity of the nucleotide sequences of KIAA0564 BINDING SITE, designated SEQ ID:32901, to the nucleotide sequence of VGAM2583 RNA, herein designated VGAM RNA, also designated SEQ ID:5294.

Another function of VGAM2583 is therefore inhibition of KIAA0564 (Accession XM_038664). Accordingly, utilities of VGAM2583 include diagnosis, prevention and treatment of diseases and clinical conditions associated with KIAA0564. Paternally Expressed 10 (PEG10, Accession NM_015068) is another VGAM2583 host target gene. PEG10 BINDING SITE is HOST TARGET binding site found in the 3' untranslated region of mRNA encoded by PEG10, corresponding to a HOST TARGET binding site such as BINDING SITE I, BINDING SITE II or BINDING SITE III. Table 2 illustrates the complementarity of the nucleotide sequences of PEG10 BINDING SITE, designated SEQ ID:17435, to the nucleotide sequence of VGAM2583 RNA, herein designated VGAM RNA, also designated SEQ ID:5294.

Another function of VGAM2583 is therefore inhibition of Paternally Expressed 10 (PEG10, Accession NM_015068). Accordingly, utilities of VGAM2583 include diagnosis, prevention and treatment of diseases and clinical conditions associated with PEG10. XPO5 (Accession XM_166042) is another VGAM2583 host target gene. XPO5 BINDING SITE is HOST TARGET binding site found in the 3' untranslated region of mRNA encoded by XPO5, corresponding to a HOST TARGET binding site such as BINDING SITE I, BINDING SITE II or BINDING SITE III. Table 2 illustrates the complementarity of the nucleotide sequences of XPO5 BINDING SITE, designated SEQ ID:43842, to the nucleotide sequence of VGAM2583 RNA, herein designated VGAM RNA, also designated SEQ ID:5294.

Another function of VGAM2583 is therefore inhibition of XPO5 (Accession XM_166042). Accordingly, utilities of VGAM2583 include diagnosis, prevention and treatment of diseases and clinical conditions associated with XPO5. LOC144558 (Accession XM_096629) is another VGAM2583 host target gene. LOC144558 BINDING SITE is HOST TARGET binding site found in the 3' untranslated region of mRNA encoded by LOC144558, corresponding to a HOST TARGET binding site such as BINDING SITE I, BINDING SITE II or BINDING SITE III. Table 2 illustrates the complementarity of the nucleotide sequences of LOC144558 BINDING SITE, designated SEQ ID:40439, to the nucleotide sequence of VGAM2583 RNA, herein designated VGAM RNA, also designated SEQ ID:5294.

Another function of VGAM2583 is therefore inhibition of LOC144558 (Accession XM_096629). Accordingly, utilities of VGAM2583 include diagnosis, prevention and treatment of diseases and clinical conditions associated with LOC144558. LOC151623 (Accession XM_098096) is another VGAM2583 host target gene. LOC151623 BINDING SITE is HOST TARGET binding site found in the 3' untranslated region of mRNA encoded by LOC151623, corresponding to a HOST TARGET binding site such as BINDING SITE I, BINDING SITE II or BINDING SITE III. Table 2 illustrates the complementarity of the nucleotide sequences of LOC151623 BINDING SITE, designated SEQ ID:41379, to the nucleotide sequence of VGAM2583 RNA, herein designated VGAM RNA, also designated SEQ ID:5294.

Another function of VGAM2583 is therefore inhibition of LOC151623 (Accession XM_098096). Accordingly, utilities of VGAM2583 include diagnosis, prevention and treatment of diseases and clinical conditions associated with LOC151623. LOC221962 (Accession XM_166554) is another VGAM2583 host target gene. LOC221962 BINDING SITE is HOST TARGET binding site found in the 3' untranslated region of mRNA encoded by LOC221962, corresponding to a HOST TARGET binding site such as BINDING SITE I, BINDING SITE II or BINDING SITE III. Table 2 illustrates the complementarity of the nucleotide sequences of LOC221962 BINDING SITE, designated SEQ ID:44529, to the nucleotide sequence of VGAM2583 RNA, herein designated VGAM RNA, also designated SEQ ID:5294.

Another function of VGAM2583 is therefore inhibition of LOC221962 (Accession XM_166554). Accordingly, utilities of VGAM2583 include diagnosis, prevention and treatment of diseases and clinical conditions associated with LOC221962. FIG. 1 further provides a conceptual description of a novel bioinformatically detected viral gene of the present invention, referred to here as Viral Genomic Address Messenger 2584 (VGAM2584) viral gene, which modulates expression of respective host target genes thereof, the function and utility of which host target genes is known in the art.

VGAM2584 is a novel bioinformatically detected regulatory, non protein coding, viral micro RNA (miRNA) gene. The method by which VGAM2584 was detected is described hereinabove with reference to FIGS. 1-8.

VGAM2584 gene, herein designated VGAM GENE, is a viral gene contained in the genome of Satsuma Dwarf Virus. VGAM2584 host target gene, herein designated VGAM HOST TARGET GENE, is a human gene contained in the human genome.

VGAM2584 gene encodes a VGAM2584 precursor RNA, herein designated VGAM PRECURSOR RNA. Similar to other miRNA genes, and unlike most ordinary genes, VGAM2584 precursor RNA does not encode a protein. A nucleotide sequence identical or highly similar to the nucleotide sequence of VGAM2584 precursor RNA is designated SEQ ID:2570, and is provided hereinbelow with reference to the sequence listing part. Nucleotide sequence SEQ ID:2570 is located at position 2340 relative to the genome of Satsuma Dwarf Virus.

VGAM2584 precursor RNA folds onto itself, forming VGAM2584 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2584 folded precursor RNA into VGAM2584 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2584 RNA is designated SEQ ID:5295, and is provided hereinbelow with reference to the sequence listing part.

VGAM2584 host target gene, herein designated VGAM HOST TARGET GENE, encodes a corresponding messenger RNA, VGAM2584 host target RNA, herein designated VGAM HOST TARGET RNA. VGAM2584 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2584 RNA, herein designated VGAM RNA, binds complementarily to one or more host target binding sites located in untranslated regions of VGAM2584 host target RNA, herein designated VGAM HOST TARGET RNA. This complementary binding is due to the fact that the nucleotide sequence of VGAM2584 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2584 RNA, herein designated VGAM RNA, may have a different number of host target binding sites in untranslated regions of a VGAM2584 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2584 RNA, herein designated VGAM RNA, to host target binding sites on VGAM2584 host target RNA, herein designated VGAM HOST TARGET RNA, such as BINDING SITE I, BINDING SITE II and BINDING SITE III, inhibits translation of VGAM2584 host target RNA into VGAM2584 host target protein, herein designated VGAM HOST TARGET PROTEIN. VGAM host target protein is therefore outlined by a broken line.

It is appreciated that VGAM2584 host target gene, herein designated VGAM HOST TARGET GENE, in fact represents a plurality of VGAM2584 host target genes. The mRNA of each one of this plurality of VGAM2584 host target genes comprises one or more host target binding sites, each having a nucleotide sequence which is at least partly complementary to VGAM2584 RNA, herein designated VGAM RNA, and which when bound by VGAM2584 RNA causes inhibition of translation of respective one or more VGAM2584 host target proteins.

It is further appreciated by one skilled in the art that the mode of translational inhibition illustrated by FIG. 1 with specific reference to translational inhibition exerted by VGAM2584 gene, herein designated VGAM GENE, on one or more VGAM2584 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2584 is inhibition of expression of host target genes, as part of a novel viral mechanism of attacking a host. Accordingly, utilities of VGAM2584 include diagnosis, prevention and treatment of viral infection by Satsuma Dwarf Virus. Specific functions, and accordingly utilities, of VGAM2584 correlate with, and may be deduced from, the identity of the host target genes which VGAM2584 binds and inhibits, and the function of these host target genes, as elaborated hereinbelow.

Nucleotide sequences of the VGAM2584 precursor RNA, herein designated VGAM PRECURSOR RNA, and of the 'diced' VGAM2584 RNA, herein designated VGAM RNA, and a schematic representation of the secondary folding of VGAM2584 folded precursor RNA, herein designated VGAM FOLDED PRECURSOR RNA, of VGAM2584 are further described hereinbelow with reference to Table 1.

Nucleotide sequences of host target binding sites, such as BINDING SITE-I, BINDING SITE-II and BINDING SITE-III of FIG. 1, found on VGAM2584 host target RNA, and schematic representation of the complementarity of each of these host target binding sites to VGAM2584 RNA, herein designated VGAM RNA, are described hereinbelow with reference to Table 2.

As mentioned hereinabove with reference to FIG. 1, a function of VGAM2584 gene, herein designated VGAM is inhibition of expression of VGAM2584 target genes. It is appreciated that specific functions, and accordingly utilities, of VGAM2584 correlate with, and may be deduced from, the identity of the target genes which VGAM2584 binds and inhibits, and the function of these target genes, as elaborated hereinbelow.

KIAA0471 (Accession NM_014857) is a VGAM2584 host target gene. KIAA0471 BINDING SITE is HOST TARGET binding site found in the 3' untranslated region of mRNA encoded by KIAA0471, corresponding to a HOST TARGET binding site such as BINDING SITE I, BINDING SITE II or BINDING SITE III. Table 2 illustrates the complementarity of the nucleotide sequences of KIAA0471 BINDING SITE, designated SEQ ID:16909, to the nucleotide sequence of VGAM2584 RNA, herein designated VGAM RNA, also designated SEQ ID:5295.

A function of VGAM2584 is therefore inhibition of KIAA0471 (Accession NM_014857). Accordingly, utilities of VGAM2584 include diagnosis, prevention and treatment of diseases and clinical conditions associated with KIAA0471. Ubiquitin-conjugating Enzyme E2N (UBC13 homolog, yeast) (UBE2N, Accession NM_003348) is another VGAM2584 host target gene. UBE2N BINDING SITE1 and UBE2N BINDING SITE2 are HOST TARGET binding sites found in untranslated regions of mRNA encoded by UBE2N, corresponding to HOST TARGET binding sites such as BINDING SITE I, BINDING SITE II or BINDING SITE III. Table 2 illustrates the complementarity of the nucleotide sequences of UBE2N BINDING SITE1 and UBE2N BINDING SITE2, designated SEQ ID:9363 and SEQ ID:45358 respectively, to the nucleotide sequence of VGAM2584 RNA, herein designated VGAM RNA, also designated SEQ ID:5295.

Another function of VGAM2584 is therefore inhibition of Ubiquitin-conjugating Enzyme E2N (UBC13 homolog, yeast) (UBE2N, Accession NM_003348). Accordingly, utilities of VGAM2584 include diagnosis, prevention and treatment of diseases and clinical conditions associated with UBE2N. Chromosome 22 Open Reading Frame 19 (C22orf19, Accession NM_003678) is another VGAM2585 host target gene. C22orf19 BINDING SITE is HOST TARGET binding site found in the 3' untranslated region of mRNA encoded by C22orf19, corresponding to a HOST TARGET binding site such as BINDING SITE I, BINDING SITE II or BINDING SITE III. Table 2 illustrates the complementarity of the nucleotide sequences of C22orf19 BINDING SITE, designated SEQ ID:9773, to the nucleotide sequence of VGAM2585 RNA, herein designated VGAM RNA, also designated SEQ ID:5296.

Another function of VGAM2585 is therefore inhibition of Chromosome 22 Open Reading Frame 19 (C22orf19, Accession NM_003678). Accordingly, utilities of VGAM2585 include diagnosis, prevention and treatment of diseases and clinical conditions associated with C22orf19. KIAA1040 (Accession XM_051091) is another VGAM2585 host target gene. KIAA1040 BINDING SITE is HOST TARGET binding site found in the 3' untranslated region of mRNA encoded by KIAA1040, corresponding to a HOST TARGET binding site such as BINDING SITE I, BINDING SITE II or BINDING SITE III. Table 2 illustrates the complementarity of the nucleotide sequences of KIAA1040 BINDING SITE, designated SEQ ID:35743, to the nucleotide sequence of VGAM2585 RNA, herein designated VGAM RNA, also designated SEQ ID:5296.

Another function of VGAM2585 is therefore inhibition of KIAA1040 (Accession XM_051091). Accordingly, utilities of VGAM2585 include diagnosis, prevention and treatment of diseases and clinical conditions associated with KIAA1040. KIAA1204 (Accession XM_045011) is another VGAM2585 host target gene. KIAA1204 BINDING SITE is HOST TARGET binding site found in the 3' untranslated region of mRNA encoded by KIAA1204, corresponding to a HOST TARGET binding site such as BINDING SITE I, BINDING SITE II or BINDING SITE III. Table 2 illustrates the complementarity of the nucleotide sequences of KIAA1204 BINDING SITE, designated SEQ ID:34312, to the nucleotide sequence of VGAM2585 RNA, herein designated VGAM RNA, also designated SEQ ID:5296.

Another function of VGAM2585 is therefore inhibition of KIAA1204 (Accession XM_045011). Accordingly, utilities of VGAM2585 include diagnosis, prevention and treatment of diseases and clinical conditions associated with KIAA1204. LOC144871 (Accession XM_096698) is another VGAM2585 host target gene. LOC144871 BINDING SITE is HOST TARGET binding site found in the 3' untranslated region of mRNA encoded by LOC144871, corresponding to a HOST TARGET binding site such as BINDING SITE I, BINDING SITE II or BINDING SITE III. Table 2 illustrates the complementarity of the nucleotide sequences of LOC144871 BINDING SITE, designated SEQ ID:40472, to the nucleotide sequence of VGAM2585 RNA, herein designated VGAM RNA, also designated SEQ ID:5296.

Another function of VGAM2585 is therefore inhibition of LOC144871 (Accession XM_096698). Accordingly, utilities of VGAM2585 include diagnosis, prevention and treatment of diseases and clinical conditions associated with LOC144871. LOC145921 (Accession XM_071845) is another VGAM2585 host target gene. LOC145921 BINDING SITE is HOST TARGET binding site found in the 3' untranslated region of mRNA encoded by LOC145921, corresponding to a HOST TARGET binding site such as BINDING SITE I, BINDING SITE II or BINDING SITE III. Table 2 illustrates the complementarity of the nucleotide sequences of LOC145921 BINDING SITE, designated SEQ ID:37426, to the nucleotide sequence of VGAM2585 RNA, herein designated VGAM RNA, also designated SEQ ID:5296.

Another function of VGAM2585 is therefore inhibition of LOC145921 (Accession XM_071845). Accordingly, utilities of VGAM2585 include diagnosis, prevention and treatment of diseases and clinical conditions associated with LOC145921. LOC150333 (Accession XM_097874) is another VGAM2585 host target gene. LOC150333 BINDING SITE is HOST TARGET binding site found in the 5' untranslated region of mRNA encoded by LOC150333, corresponding to a HOST TARGET binding site such as BINDING SITE I, BINDING SITE II or BINDING SITE III. Table 2 illustrates the complementarity of the nucleotide sequences of LOC150333 BINDING SITE, designated SEQ ID:41196, to the nucleotide sequence of VGAM2585 RNA, herein designated VGAM RNA, also designated SEQ ID:5296.

Another function of VGAM2585 is therefore inhibition of LOC150333 (Accession XM_097874). Accordingly, utilities of VGAM2585 include diagnosis, prevention and treatment of diseases and clinical conditions associated with LOC150333. LOC152190 (Accession XM_045692) is another VGAM2585 host target gene. LOC152190 BINDING SITE is HOST TARGET binding site found in the 5' untranslated region of mRNA encoded by LOC152190, corresponding to a HOST TARGET binding site such as BINDING SITE I, BINDING SITE II or BINDING SITE III. Table 2 illustrates the complementarity of the nucleotide sequences of LOC152190 BINDING SITE, designated SEQ ID:34525, to the nucleotide sequence of VGAM2585 RNA, herein designated VGAM RNA, also designated SEQ ID:5296.

Another function of VGAM2585 is therefore inhibition of LOC152190 (Accession XM_045692). Accordingly, utilities of VGAM2585 include diagnosis, prevention and treatment of diseases and clinical conditions associated with LOC152190. FIG. 1 further provides a conceptual description of a novel bioinformatically detected viral gene of the present invention, referred to here as Viral Genomic Address Messenger 2586 (VGAM2586) viral gene, which modulates expression of respective host target genes thereof, the function and utility of which host target genes is known in the art.

VGAM2586 is a novel bioinformatically detected regulatory, non protein coding, viral micro RNA (miRNA) gene. The method by which VGAM2586 was detected is described hereinabove with reference to FIGS. 1-8.

VGAM2586 gene, herein designated VGAM GENE, is a viral gene contained in the genome of Satsuma Dwarf Virus. VGAM2586 host target gene, herein designated VGAM HOST TARGET GENE, is a human gene contained in the human genome.

VGAM2586 gene encodes a VGAM2586 precursor RNA, herein designated VGAM PRECURSOR RNA. Similar to other miRNA genes, and unlike most ordinary genes, VGAM2586 precursor RNA does not encode a protein. A nucleotide sequence identical or highly similar to the nucleotide sequence of VGAM2586 precursor RNA is designated SEQ ID:2572, and is provided hereinbelow with reference to the sequence listing part. Nucleotide sequence SEQ ID:2572 is located at position 5834 relative to the genome of Satsuma Dwarf Virus.

VGAM2586 precursor RNA folds onto itself, forming VGAM2586 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2586 folded precursor RNA into VGAM2586 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM2586 RNA is designated SEQ ID:5297, and is provided hereinbelow with reference to the sequence listing part.

VGAM2586 host target gene, herein designated VGAM HOST TARGET GENE, encodes a corresponding messenger RNA, VGAM2586 host target RNA, herein designated VGAM HOST TARGET RNA. VGAM2586 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2586 RNA, herein designated VGAM RNA, binds complementarily to one or more host target binding sites located in untranslated regions of VGAM2586 host target RNA, herein designated VGAM HOST TARGET RNA. This complementary binding is due to the fact that the nucleotide sequence of VGAM2586 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2586 RNA, herein designated VGAM RNA, may have a different number of host target binding sites in untranslated regions of a VGAM2586 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2586 RNA, herein designated VGAM RNA, to host target binding sites on VGAM2586 host target RNA, herein designated VGAM HOST TARGET RNA, such as BINDING SITE I, BINDING SITE II and BINDING SITE III, inhibits translation of VGAM2586 host target RNA into VGAM2586 host target protein, herein designated VGAM HOST TARGET PROTEIN. VGAM host target protein is therefore outlined by a broken line.

It is appreciated that VGAM2586 host target gene, herein designated VGAM HOST TARGET GENE, in fact represents a plurality of VGAM2586 host target genes. The mRNA of each one of this plurality of VGAM2586 host target genes comprises one or more host target binding sites, each having a nucleotide sequence which is at least partly complementary to VGAM2586 RNA, herein designated VGAM RNA, and which when bound by VGAM2586 RNA causes inhibition of translation of respective one or more VGAM2586 host target proteins.

It is further appreciated by one skilled in the art that the mode of translational inhibition illustrated by FIG. 1 with specific reference to translational inhibition exerted by VGAM2586 gene, herein designated VGAM GENE, on one or more VGAM2586 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2586 is inhibition of expression of host target genes, as part of a novel viral mechanism of attacking a host. Accordingly, utilities of VGAM2586 include diagnosis, prevention and treatment of viral infection by Satsuma Dwarf Virus. Specific functions, and accordingly utilities, of VGAM2586 correlate with, and may be deduced from, the identity of the host target genes which VGAM2586 binds and inhibits, and the function of these host target genes, as elaborated hereinbelow.

Nucleotide sequences of the VGAM2586 precursor RNA, herein designated VGAM PRECURSOR RNA, and of the 'diced' VGAM2586 RNA, herein designated VGAM RNA, and a schematic representation of the secondary folding of VGAM2586 folded precursor RNA, herein designated VGAM FOLDED PRECURSOR RNA, of VGAM2586 are further described hereinbelow with reference to Table 1.

Nucleotide sequences of host target binding sites, such as BINDING SITE-I, BINDING SITE-II and BINDING SITE-III of FIG. 1, found on VGAM2586 host target RNA, and schematic representation of the complementarity of each of these host target binding sites to VGAM2586 RNA, herein designated VGAM RNA, are described hereinbelow with reference to Table 2.

As mentioned hereinabove with reference to FIG. 1, a function of VGAM2586 gene, herein designated VGAM is inhibition of expression of VGAM2586 target genes. It is appreciated that specific functions, and accordingly utilities, of VGAM2586 correlate with, and may be deduced from, the identity of the target genes which VGAM2586 binds and inhibits, and the function of these target genes, as elaborated hereinbelow.

Glucokinase (hexokinase 4, maturity onset diabetes of the young 2) (GCK, Accession NM_033508) is a VGAM2586 host target gene. GCK BINDING SITE is HOST TARGET binding site found in the 5' untranslated region of mRNA encoded by GCK, corresponding to a HOST TARGET binding site such as BINDING SITE I, BINDING SITE II or BINDING SITE III. Table 2 illustrates the complementarity of the nucleotide sequences of GCK BINDING SITE, designated SEQ ID:27286, to the nucleotide sequence of VGAM2586 RNA, herein designated VGAM RNA, also designated SEQ ID:5297.

A function of VGAM2586 is therefore inhibition of Glucokinase (hexokinase 4, maturity onset diabetes of the young 2) (GCK, Accession NM_033508), a gene which catalyzes the initial step in utilization of glucose by the beta-cell and liver at physiological glucose concentration. Accordingly, utilities of VGAM2586 include diagnosis, prevention and treatment of diseases and clinical conditions associated with GCK. The function of GCK and its association with various diseases and clinical conditions, has been established by previous studies, as described hereinabove with reference to VGAM1781. Interleukin 1 Receptor Accessory Protein-like 2 (IL1RAPL2, Accession NM_017416) is another VGAM2586 host target gene. IL1RAPL2 BINDING SITE is HOST TARGET binding site found in the 5' untranslated region of mRNA encoded by IL1RAPL2, corresponding to a HOST TARGET binding site such as BINDING SITE I, BINDING SITE II or BINDING SITE III. Table 2 illustrates the complementarity of the nucleotide sequences of IL1RAPL2 BINDING SITE, designated SEQ ID:18873, to the nucleotide sequence of VGAM2586 RNA, herein designated VGAM RNA, also designated SEQ ID:5297.

Another function of VGAM2586 is therefore inhibition of Interleukin 1 Receptor Accessory Protein-like 2 (IL1RAPL2, Accession NM_017416), a gene which may act in the development or function of the central nervous system. Accordingly, utilities of VGAM2586 include diagnosis, prevention and treatment of diseases and clinical conditions associated with IL1RAPL2. The function of IL1RAPL2 and its association with various diseases and clinical conditions, has been established by previous studies, as described hereinabove with reference to VGAM1965. FLJ10751 (Accession NM_018239) is another VGAM2586 host target gene. FLJ10751 BINDING SITE1 and FLJ10751 BINDING SITE2 are HOST TARGET binding sites found in untranslated regions of mRNA encoded by FLJ10751, corresponding to HOST TARGET binding sites such as BINDING SITE I, BINDING SITE II or BINDING SITE III. Table 2 illustrates the complementarity of the nucleotide sequences of FLJ10751 BINDING SITE1 and FLJ10751 BINDING SITE2, designated SEQ ID:20190 and SEQ ID:20091 respectively, to the nucleotide sequence of VGAM2586 RNA, herein designated VGAM RNA, also designated SEQ ID:5297.

Another function of VGAM2586 is therefore inhibition of FLJ10751 (Accession NM_018239). Accordingly, utilities of VGAM2586 include diagnosis, prevention and treatment of diseases and clinical conditions associated with FLJ10751. KIAA0062 (Accession XM_046677) is another VGAM2586 host target gene. KIAA0062 BINDING SITE is HOST TARGET binding site found in the 3' untranslated region of mRNA encoded by KIAA0062, corresponding to a HOST TARGET binding site such as BINDING SITE I, BINDING SITE II or BINDING SITE III. Table 2 illustrates the complementarity of the nucleotide sequences of KIAA0062 BINDING SITE, designated SEQ ID:34793, to the nucleotide sequence of VGAM2586 RNA, herein designated VGAM RNA, also designated SEQ ID:5297.

Another function of VGAM2586 is therefore inhibition of KIAA0062 (Accession XM_046677). Accordingly, utilities of VGAM2586 include diagnosis, prevention and treatment of diseases and clinical conditions associated with KIAA0062. KIAA0237 (Accession NM_014747) is another VGAM2586 host target gene. KIAA0237 BINDING SITE is HOST TARGET binding site found in the 3' untranslated region of mRNA encoded by KIAA0237, corresponding to a HOST TARGET binding site such as BINDING SITE I, BINDING SITE II or BINDING SITE III. Table 2 illustrates the complementarity of the nucleotide sequences of KIAA0237 BINDING SITE, designated SEQ ID:16436, to the nucleotide sequence of VGAM2586 RNA, herein designated VGAM RNA, also designated SEQ ID:5297.

Another function of VGAM2586 is therefore inhibition of KIAA0237 (Accession NM_014747). Accordingly, utilities of VGAM2586 include diagnosis, prevention and treatment of diseases and clinical conditions associated with KIAA0237. Lectin, Galactoside-binding, Soluble, 8 (galectin 8) (LGALS8, Accession NM_006499) is another VGAM2586 host target gene. LGALS8 BINDING SITE is HOST TARGET binding site found in the 3' untranslated region of mRNA encoded by LGALS8, corresponding to a HOST TARGET binding site such as BINDING SITE I, BINDING SITE II or BINDING SITE III. Table 2 illustrates the complementarity of the nucleotide sequences of LGALS8 BINDING SITE, designated SEQ ID:13244, to the nucleotide sequence of VGAM2586 RNA, herein designated VGAM RNA, also designated SEQ ID:5297.

Another function of VGAM2586 is therefore inhibition of Lectin, Galactoside-binding, Soluble, 8 (galectin 8) (LGALS8, Accession NM_006499). Accordingly, utilities of VGAM2586 include diagnosis, prevention and treatment of diseases and clinical conditions associated with LGALS8. LOC158156 (Accession XM_088496) is another VGAM2586 host target gene. LOC158156 BINDING SITE is HOST TARGET binding site found in the 3' untranslated region of mRNA encoded by LOC158156, corresponding to a HOST TARGET binding site such as BINDING SITE I, BINDING SITE II or BINDING SITE III. Table 2 illustrates the complementarity of the nucleotide sequences of LOC158156 BINDING SITE, designated SEQ ID:39735, to the nucleotide sequence of VGAM2586 RNA, herein designated VGAM RNA, also designated SEQ ID:5297.

Another function of VGAM2586 is therefore inhibition of LOC158156 (Accession XM_088496). Accordingly, utilities of VGAM2586 include diagnosis, prevention and treatment of diseases and clinical conditions associated with LOC158156. FIG. 1 further provides a conceptual description of a novel bioinformatically detected viral gene of the present invention, referred to here as Viral Genomic Address Messenger 2587 (VGAM2587) viral gene, which modulates expression of respective host target genes thereof, the function and utility of which host target genes is known in the art.

VGAM2587 is a novel bioinformatically detected regulatory, non protein coding, viral micro RNA (miRNA) gene. The method by which VGAM2587 was detected is described hereinabove with reference to FIGS. 1-8.

VGAM2587 gene, herein designated VGAM GENE, is a viral gene contained in the genome of Satsuma Dwarf Virus. VGAM2587 host target gene, herein designated VGAM HOST TARGET GENE, is a human gene contained in the human genome.

VGAM2587 gene encodes a VGAM2587 precursor RNA, herein designated VGAM PRECURSOR RNA. Similar to other miRNA genes, and unlike most ordinary genes, VGAM2587 precursor RNA does not encode a protein. A nucleotide sequence identical or highly similar to the nucleotide sequence of VGAM2587 precursor RNA is designated SEQ ID:2573, and is provided hereinbelow with reference to the sequence listing part. Nucleotide sequence SEQ ID:2573 is located at position 4499 relative to the genome of Satsuma Dwarf Virus.

VGAM2587 precursor RNA folds onto itself, forming VGAM2587 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2587 folded precursor RNA into VGAM2587 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2587 RNA is designated SEQ ID:5298, and is provided hereinbelow with reference to the sequence listing part.

VGAM2587 host target gene, herein designated VGAM HOST TARGET GENE, encodes a corresponding messenger RNA, VGAM2587 host target RNA, herein designated VGAM HOST TARGET RNA. VGAM2587 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2587 RNA, herein designated VGAM RNA, binds complementarily to one or more host target binding sites located in untranslated regions of VGAM2587 host target RNA, herein designated VGAM HOST TARGET RNA. This complementary binding is due to the fact that the nucleotide sequence of VGAM2587 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2587 RNA, herein designated VGAM RNA, may have a different number of host target binding sites in untranslated regions of a VGAM2587 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2587 RNA, herein designated VGAM RNA, to host target binding sites on VGAM2587 host target RNA, herein designated VGAM HOST TARGET RNA, such as BINDING SITE I, BINDING SITE II and BINDING SITE III, inhibits translation of VGAM2587 host target RNA into VGAM2587 host target protein, herein designated VGAM HOST TARGET PROTEIN. VGAM host target protein is therefore outlined by a broken line.

It is appreciated that VGAM2587 host target gene, herein designated VGAM HOST TARGET GENE, in fact represents a plurality of VGAM2587 host target genes. The mRNA of each one of this plurality of VGAM2587 host target genes comprises one or more host target binding sites, each having a nucleotide sequence which is at least partly complementary to VGAM2587 RNA, herein designated VGAM RNA, and which when bound by VGAM2587 RNA causes inhibition of translation of respective one or more VGAM2587 host target proteins.

It is further appreciated by one skilled in the art that the mode of translational inhibition illustrated by FIG. 1 with specific reference to translational inhibition exerted by VGAM2587 gene, herein designated VGAM GENE, on one or more VGAM2587 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2587 is inhibition of expression of host target genes, as part of a novel viral mechanism of attacking a host. Accordingly, utilities of VGAM2587 include diagnosis, prevention and treatment of viral infection by Satsuma Dwarf Virus. Specific functions, and accordingly utilities, of VGAM2587 correlate with, and may be deduced from, the identity of the host target genes which VGAM2587 binds and inhibits, and the function of these host target genes, as elaborated hereinbelow.

Nucleotide sequences of the VGAM2587 precursor RNA, herein designated VGAM PRECURSOR RNA, and of the 'diced' VGAM2587 RNA, herein designated VGAM RNA, and a schematic representation of the secondary folding of VGAM2587 folded precursor RNA, herein designated VGAM FOLDED PRECURSOR RNA, of VGAM2587 are further described hereinbelow with reference to Table 1.

Nucleotide sequences of host target binding sites, such as BINDING SITE-I, BINDING SITE-II and BINDING SITE-III of FIG. 1, found on VGAM2587 host target RNA, and schematic representation of the complementarity of each of these host target binding sites to VGAM2587 RNA, herein designated VGAM RNA, are described hereinbelow with reference to Table 2.

As mentioned hereinabove with reference to FIG. 1, a function of VGAM2587 gene, herein designated VGAM is inhibition of expression of VGAM2587 target genes. It is appreciated that specific functions, and accordingly utilities, of VGAM2587 correlate with, and may be deduced from, the identity of the target genes which VGAM2587 binds and inhibits, and the function of these target genes, as elaborated hereinbelow.

Collagen, Type XIX, Alpha 1 (COL19A1, Accession NM_001858) is a VGAM2587 host target gene. COL19A1 BINDING SITE is HOST TARGET binding site found in the 3' untranslated region of mRNA encoded by COL19A1, corresponding to a HOST TARGET binding site such as BINDING SITE I, BINDING SITE II or BINDING SITE III. Table 2 illustrates the complementarity of the nucleotide sequences of COL19A1 BINDING SITE, designated SEQ ID:7600, to the nucleotide sequence of VGAM2587 RNA, herein designated VGAM RNA, also designated SEQ ID:5298.

A function of VGAM2587 is therefore inhibition of Collagen, Type XIX, Alpha 1 (COL19A1, Accession NM_001858), a gene which may act as a cross-bridge between fibrils and other extracellular matrix molecules. Accordingly, utilities of VGAM2587 include diagnosis, prevention and treatment of diseases and clinical conditions associated with COL19A1. The function of COL19A1 and its association with various diseases and clinical conditions, has been established by previous studies, as described hereinabove with reference to VGAM19. HTRA3 (Accession XM_114416) is another VGAM2587 host target gene. HTRA3 BINDING SITE is HOST TARGET binding site found in the 3' untranslated region of mRNA encoded by HTRA3, corresponding to a HOST TARGET binding site such as BINDING SITE I, BINDING SITE II or BINDING SITE III. Table 2 illustrates the complementarity of the nucleotide sequences of HTRA3 BINDING SITE, designated SEQ ID:42939, to the nucleotide sequence of VGAM2587 RNA, herein designated VGAM RNA, also designated SEQ ID:5298.

Another function of VGAM2587 is therefore inhibition of HTRA3 (Accession XM_114416). Accordingly, utilities of VGAM2587 include diagnosis, prevention and treatment of diseases and clinical conditions associated with HTRA3. Isovaleryl Coenzyme A Dehydrogenase (IVD, Accession NM_002225) is another VGAM2587 host target gene. IVD BINDING SITE is HOST TARGET binding site found in the 3' untranslated region of mRNA encoded by IVD, corresponding to a HOST TARGET binding site such as BINDING SITE I, BINDING SITE II or BINDING SITE III. Table 2 illustrates the complementarity of the nucleotide sequences of IVD BINDING SITE, designated SEQ ID:8003, to the nucleotide sequence of VGAM2587 RNA, herein designated VGAM RNA, also designated SEQ ID:5298.

Another function of VGAM2587 is therefore inhibition of Isovaleryl Coenzyme A Dehydrogenase (IVD, Accession NM_002225). Accordingly, utilities of VGAM2587 include diagnosis, prevention and treatment of diseases and clinical conditions associated with IVD. Kynurenine 3-monooxygenase (kynurenine 3-hydroxylase) (KMO, Accession NM_003679) is another VGAM2587 host target gene. KMO BINDING SITE is HOST TARGET binding site found in the 3" untranslated region of mRNA encoded by KMO, corresponding to a HOST TARGET binding site such as BINDING SITE I, BINDING SITE II or BINDING SITE III. Table 2 illustrates the complementarity of the nucleotide sequences of KMO BINDING SITE, designated SEQ ID:9781, to the nucleotide sequence of VGAM2587 RNA, herein designated VGAM RNA, also designated SEQ ID:5298.

Another function of VGAM2587 is therefore inhibition of Kynurenine 3-monooxygenase (kynurenine 3-hydroxylase) (KMO, Accession NM_003679), a gene which may play a role in encephalic photoreception. Accordingly, utilities of VGAM2587 include diagnosis, prevention and treatment of diseases and clinical conditions associated with KMO. The function of KMO and its association with various diseases and clinical conditions, has been established by previous studies, as described hereinabove with reference to VGAM162. SMURF1 (Accession XM_166483) is another VGAM2587 host target gene. SMURF1 BINDING SITE is HOST TARGET binding site found in the 3' untranslated region of mRNA encoded by SMURF1, corresponding to a HOST TARGET binding site such as BINDING SITE I, BINDING SITE II or BINDING SITE III. Table 2 illustrates the complementarity of the nucleotide sequences of SMURF1 BINDING SITE, designated SEQ ID:44416, to the nucleotide sequence of VGAM2587 RNA, herein designated VGAM RNA, also designated SEQ ID:5298.

Another function of VGAM2587 is therefore inhibition of SMURF1 (Accession XM_166483). Accordingly, utilities of VGAM2587 include diagnosis, prevention and treatment of diseases and clinical conditions associated with SMURF1. SPS2 (Accession NM_012248) is another VGAM2587 host target gene. SPS2 BINDING SITE is HOST TARGET binding site found in the 3' untranslated region of mRNA encoded by SPS2, corresponding to a HOST TARGET binding site such as BINDING SITE I, BINDING SITE II or BINDING SITE III. Table 2 illustrates the complementarity of the nucleotide sequences of SPS2 BINDING SITE, designated SEQ ID:14556, to the nucleotide sequence of VGAM2587 RNA, herein designated VGAM RNA, also designated SEQ ID:5298.

Another function of VGAM2587 is therefore inhibition of SPS2 (Accession NM_012248), a gene which synthesizes selenophosphate from selenide and ATP. Accordingly, utilities of VGAM2587 include diagnosis, prevention and treatment of diseases and clinical conditions associated with SPS2. The function of SPS2 and its association with various diseases and clinical conditions, has been established by previous studies, as described hereinabove with reference to VGAM1754. VAMP (vesicle-associated membrane protein)-associated Protein A, 33 kDa (VAPA, Accession NM_003574) is another VGAM2587 host target gene. VAPA BINDING SITE is HOST TARGET binding site found in the 3" untranslated region of mRNA encoded by VAPA, corresponding to a HOST TARGET binding site such as BINDING SITE I, BINDING SITE II or BINDING SITE III. Table 2 illustrates the complementarity of the nucleotide sequences of VAPA BINDING SITE, designated SEQ ID:9626, to the nucleotide sequence of VGAM2587 RNA, herein designated VGAM RNA, also designated SEQ ID:5298.

Another function of VGAM2587 is therefore inhibition of VAMP (vesicle-associated membrane protein)-associated Protein A, 33 kDa (VAPA, Accession NM_003574), a gene which may have a role in vesicle trafficking. Accordingly, utilities of VGAM2587 include diagnosis, prevention and treatment of diseases and clinical conditions associated with VAPA. The function of VAPA has been established by previous studies. By searching an EST database for human homologs of the Aplysia 33-kD VAMP-associated protein (Vap33), Weir et al. (1998) identified a cDNA encoding VAPA, which they termed VAP33. Sequence analysis predicted that the 242-amino acid protein, which is 50% identical to the molluscan sequence, contains 8 potential phosphorylation sites, an alpha-helical coiled-coil domain, and a C-terminal transmembrane domain. Northern blot analysis of mouse tissues detected a major 1.9-kb transcript and minor 3.9- and 7.1-kb transcripts in all tissues tested, with highest expression in brain, testis, ovary, kidney and skeletal muscle. In contrast, Vap33 expression is neuron specific in Aplysia. Western blot analysis showed that VAPA interacts with VAMP1 (OMIM Ref. No. 185880) and VAMP2 (OMIM Ref. No. 185881) but not with SNAP25 (OMIM Ref. No. 600322). Nishimura et al. (1999) identified cDNAs encoding VAPA and the 60% homologous VAPB (OMIM Ref. No. 605704). Northern blot analysis detected a 1.7-kb VAPA transcript in all human tissues tested. SDS-PAGE analysis demonstrated that the transmembrane domain of recombinant VAPA interacted with VAPA and VAPB fusion proteins.

Full details of the abovementioned studies are described in the following publications, the disclosure of which are hereby incorporated by reference:

Weir, M. L.; Klip, A.; Trimble, W. S.: Identification of a human homologue of the vesicle-associated membrane protein (VAMP)-associated protein of 33 kDa (VAP-33): a broadly expressed protein that binds to VAMP. Biochem. J. 333:247-251, 1998; and Nishimura, Y.; Hayashi, M.; Inada, H.; Tanaka, T.: Molecular cloning and characterization of mammalian homologues of vesicle-associated membrane protein-associated (VAMP-associated) prote.

Further studies establishing the function and utilities of VAPA are found in John Hopkins OMIM database record ID 605703, and in sited publications numbered 6617-6618 listed in the bibliography section hereinbelow, which are also hereby incorporated by reference. Complement Component 1, Q Subcomponent, Receptor 1 (C1QR1, Accession NM_012072) is another VGAM2587 host target gene. C1QR1 BINDING SITE is HOST TARGET binding site found in the 3' untranslated region of mRNA encoded by C1QR1, corresponding to a HOST TARGET binding site such as BINDING SITE I, BINDING SITE II or BINDING SITE III. Table 2 illustrates the complementarity of the nucleotide sequences of C1QR1 BINDING SITE, designated SEQ ID:14334, to the nucleotide sequence of VGAM2587 RNA, herein designated VGAM RNA, also designated SEQ ID:5298.

Another function of VGAM2587 is therefore inhibition of Complement Component 1, Q Subcomponent, Receptor 1 (C1QR1, Accession NM_012072). Accordingly, utilities of VGAM2587 include diagnosis, prevention and treatment of diseases and clinical conditions associated with C1QR1. DKFZP434F091 (Accession NM_015453) is another VGAM2587 host target gene. DKFZP434F091 BINDING SITE is HOST TARGET binding site found in the 3' untranslated region of mRNA encoded by DKFZP434F091, corresponding to a HOST TARGET binding site such as BINDING SITE I, BINDING SITE II or BINDING SITE III. Table 2 illustrates the complementarity of the nucleotide sequences of DKFZP434F091 BINDING SITE, designated SEQ ID:17737, to the nucleotide sequence of VGAM2587 RNA, herein designated VGAM RNA, also designated SEQ ID:5298.

Another function of VGAM2587 is therefore inhibition of DKFZP434F091 (Accession NM_015453). Accordingly, utilities of VGAM2587 include diagnosis, prevention and treatment of diseases and clinical conditions associated with DKFZP434F091. FLJ11413 (Accession NM_024554) is another VGAM2587 host target gene. FLJ11413 BINDING SITE is HOST TARGET binding site found in the 3' untranslated region of mRNA encoded by FLJ11413, corresponding to a HOST TARGET binding site such as BINDING SITE I, BINDING SITE II or BINDING SITE III. Table 2 illustrates the complementarity of the nucleotide sequences of FLJ11413 BINDING SITE, designated SEQ ID:23773, to the nucleotide sequence of VGAM2587 RNA, herein designated VGAM RNA, also designated SEQ ID:5298.

Another function of VGAM2587 is therefore inhibition of FLJ11413 (Accession NM_024554). Accordingly, utilities of VGAM2587 include diagnosis, prevention and treatment of diseases and clinical conditions associated with FLJ11413. KIAA1271 (Accession XM_045472) is another VGAM2587 host target gene. KIAA1271 BINDING SITE is HOST TARGET binding site found in the 3' untranslated region of mRNA encoded by KIAA1271, corresponding to a HOST TARGET binding site such as BINDING SITE I, BINDING SITE II or BINDING SITE III. Table 2 illustrates the complementarity of the nucleotide sequences of KIAA1271 BINDING SITE, designated SEQ ID:34468, to the nucleotide sequence of VGAM2587 RNA, herein designated VGAM RNA, also designated SEQ ID:5298.

Another function of VGAM2587 is therefore inhibition of KIAA1271 (Accession XM_045472). Accordingly, utilities of VGAM2587 include diagnosis, prevention and treatment of diseases and clinical conditions associated with KIAA1271. Ligand of Numb-protein X (LNX, Accession NM_032622) is another VGAM2587 host target gene. LNX BINDING SITE is HOST TARGET binding site found in the 5' untranslated region of mRNA encoded by LNX, corresponding to a HOST TARGET binding site such as BINDING SITE I, BINDING SITE II or BINDING SITE III. Table 2 illustrates the complementarity of the nucleotide sequences of LNX BINDING SITE, designated SEQ ID:26339, to the nucleotide sequence of VGAM2587 RNA, herein designated VGAM RNA, also designated SEQ ID:5298.

Another function of VGAM2587 is therefore inhibition of Ligand of Numb-protein X (LNX, Accession NM_032622). Accordingly, utilities of VGAM2587 include diagnosis, prevention and treatment of diseases and clinical conditions associated with LNX. PRO0246 (Accession NM_014123) is another VGAM2587 host target gene. PRO0246 BINDING SITE is HOST TARGET binding site found in the 5' untranslated region of mRNA encoded by PRO0246, corresponding to a HOST TARGET binding site such as BINDING SITE I, BINDING SITE II or BINDING SITE III. Table 2 illustrates the complementarity of the nucleotide sequences of PRO0246 BINDING SITE, designated SEQ ID:15379, to the nucleotide sequence of VGAM2587 RNA, herein designated VGAM RNA, also designated SEQ ID:5298.

Another function of VGAM2587 is therefore inhibition of PRO0246 (Accession NM_014123). Accordingly, utilities of VGAM2587 include diagnosis, prevention and treatment of diseases and clinical conditions associated with PRO0246. LOC143154 (Accession XM_084441) is another VGAM2587 host target gene. LOC143154 BINDING SITE is HOST TARGET binding site found in the 3' untranslated region of mRNA encoded by LOC143154, corresponding to a HOST TARGET binding site such as BINDING SITE I, BINDING SITE II or BINDING SITE III. Table 2 illustrates the complementarity of the nucleotide sequences of LOC143154 BINDING SITE, designated SEQ ID:37589, to the nucleotide sequence of VGAM2587 RNA, herein designated VGAM RNA, also designated SEQ ID:5298.

Another function of VGAM2587 is therefore inhibition of LOC143154 (Accession XM_084441). Accordingly, utilities of VGAM2587 include diagnosis, prevention and treatment of diseases and clinical conditions associated with LOC143154. LOC204970 (Accession XM_114795) is another VGAM2587 host target gene. LOC204970 BINDING SITE is HOST TARGET binding site found in the 5' untranslated region of mRNA encoded by LOC204970, corresponding to a HOST TARGET binding site such as BINDING SITE I, BINDING SITE II or BINDING SITE III. Table 2 illustrates the complementarity of the nucleotide sequences of LOC204970 BINDING SITE, designated SEQ ID:43075, to the nucleotide sequence of VGAM2587 RNA, herein designated VGAM RNA, also designated SEQ ID:5298.

Another function of VGAM2587 is therefore inhibition of LOC204970 (Accession XM_114795). Accordingly, utilities of VGAM2587 include diagnosis, prevention and treatment of diseases and clinical conditions associated with LOC204970. LOC219294 (Accession XM_167566) is another VGAM2587 host target gene. LOC219294 BINDING SITE is HOST TARGET binding site found in the 3' untranslated region of mRNA encoded by LOC219294, corresponding to a HOST TARGET binding site such as BINDING SITE I, BINDING SITE II or BINDING SITE III. Table 2 illustrates the complementarity of the nucleotide sequences of LOC219294 BINDING SITE, designated SEQ ID:44687, to the nucleotide sequence of VGAM2587 RNA, herein designated VGAM RNA, also designated SEQ ID:5298.

Another function of VGAM2587 is therefore inhibition of LOC219294 (Accession XM_167566). Accordingly, utilities of VGAM2587 include diagnosis, prevention and treatment of diseases and clinical conditions associated with LOC219294. FIG. 1 further provides a conceptual description of a novel bioinformatically detected viral gene of the present invention, referred to here as Viral Genomic Address Messenger 2588 (VGAM2588) viral gene, which modulates expression of respective host target genes thereof, the function and utility of which host target genes is known in the art.

VGAM2588 is a novel bioinformatically detected regulatory, non protein coding, viral micro RNA (miRNA) gene. The method by which VGAM2588 was detected is described hereinabove with reference to FIGS. 1-8.

VGAM2588 gene, herein designated VGAM GENE, is a viral gene contained in the genome of Satsuma Dwarf Virus. VGAM2588 host target gene, herein designated VGAM HOST TARGET GENE, is a human gene contained in the human genome.

VGAM2588 gene encodes a VGAM2588 precursor RNA, herein designated VGAM PRECURSOR RNA. Similar to other miRNA genes, and unlike most ordinary genes, VGAM2588 precursor RNA does not encode a protein. A nucleotide sequence identical or highly similar to the nucleotide sequence of VGAM2588 precursor RNA is designated SEQ ID:2574, and is provided hereinbelow with reference to the sequence listing part. Nucleotide sequence SEQ ID:2574 is located at position 1651 relative to the genome of Satsuma Dwarf Virus.

VGAM2588 precursor RNA folds onto itself, forming VGAM2588 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2588 folded precursor RNA into VGAM2588 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2588 RNA is designated SEQ ID:5299, and is provided hereinbelow with reference to the sequence listing part.

VGAM2588 host target gene, herein designated VGAM HOST TARGET GENE, encodes a corresponding messenger RNA, VGAM2588 host target RNA, herein designated VGAM HOST TARGET RNA. VGAM2588 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2588 RNA, herein designated VGAM RNA, binds complementarily to one or more host target binding sites located in untranslated regions of VGAM2588 host target RNA, herein designated VGAM HOST TARGET RNA. This complementary binding is due to the fact that the nucleotide sequence of VGAM2588 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2588 RNA, herein designated VGAM RNA, may have a different number of host target binding sites in untranslated regions of a VGAM2588 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2588 RNA, herein designated VGAM RNA, to host target binding sites on VGAM2588 host target RNA, herein designated VGAM HOST TARGET RNA, such as BINDING SITE I, BINDING SITE II and BINDING SITE III, inhibits translation of VGAM2588 host target RNA into VGAM2588 host target protein, herein designated VGAM HOST TARGET PROTEIN. VGAM host target protein is therefore outlined by a broken line.

It is appreciated that VGAM2588 host target gene, herein designated VGAM HOST TARGET GENE, in fact represents a plurality of VGAM2588 host target genes. The mRNA of each one of this plurality of VGAM2588 host target genes comprises one or more host target binding sites, each having a nucleotide sequence which is at least partly complementary to VGAM2588 RNA, herein designated VGAM RNA, and which when bound by VGAM2588 RNA causes inhibition of translation of respective one or more VGAM2588 host target proteins.

It is further appreciated by one skilled in the art that the mode of translational inhibition illustrated by FIG. 1 with specific reference to translational inhibition exerted by VGAM2588 gene, herein designated VGAM GENE, on one or more VGAM2588 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2588 is inhibition of expression of host target genes, as part of a novel viral mechanism of attacking a host. Accordingly, utilities of VGAM2588 include diagnosis, prevention and treatment of viral infection by Satsuma Dwarf Virus. Specific functions, and accordingly utilities, of VGAM2588 correlate with, and may be deduced from, the identity of the host target genes which VGAM2588 binds and inhibits, and the function of these host target genes, as elaborated hereinbelow.

Nucleotide sequences of the VGAM2588 precursor RNA, herein designated VGAM PRECURSOR RNA, and of the 'diced' VGAM2588 RNA, herein designated VGAM RNA, and a schematic representation of the secondary folding of VGAM2588 folded precursor RNA, herein designated VGAM FOLDED PRECURSOR RNA, of VGAM2588 are further described hereinbelow with reference to Table 1.

Nucleotide sequences of host target binding sites, such as BINDING SITE-I, BINDING SITE-II and BINDING SITE-III of FIG. 1, found on VGAM2588 host target RNA, and schematic representation of the complementarity of each of these host target binding sites to VGAM2588 RNA, herein designated VGAM RNA, are described hereinbelow with reference to Table 2.

As mentioned hereinabove with reference to FIG. 1, a function of VGAM2588 gene, herein designated VGAM is inhibition of expression of VGAM2588 target genes. It is appreciated that specific functions, and accordingly utilities, of VGAM2588 correlate with, and may be deduced from, the identity of the target genes which VGAM2588 binds and inhibits, and the function of these target genes, as elaborated hereinbelow.

Cytoplasmic Linker Associated Protein 1 (CLASP1, Accession XM_037105) is a VGAM2588 host target gene. CLASP1 BINDING SITE is HOST TARGET binding site found in the 3' untranslated region of mRNA encoded by CLASP1, corresponding to a HOST TARGET binding site such as BINDING SITE I, BINDING SITE II or BINDING SITE III. Table 2 illustrates the complementarity of the nucleotide sequences of CLASP1 BINDING SITE, designated SEQ ID:32539, to the nucleotide sequence of VGAM2588 RNA, herein designated VGAM RNA, also designated SEQ ID:5299.

A function of VGAM2588 is therefore inhibition of Cytoplasmic Linker Associated Protein 1 (CLASP1, Accession XM_037105), a gene which plays a role in the local regulation of microtubule dynamics. Accordingly, utilities of VGAM2588 include diagnosis, prevention and treatment of diseases and clinical conditions associated with CLASP1. The function of CLASP1 and its association with various diseases and clinical conditions, has been established by previous studies, as described hereinabove with reference to VGAM298. FLJ21817 (Accession NM_022448) is another VGAM2588 host target gene. FLJ21817 BINDING SITE is HOST TARGET binding site found in the 3' untranslated region of mRNA encoded by FLJ21817, corresponding to a HOST TARGET binding site such as BINDING SITE I, BINDING SITE II or BINDING SITE III. Table 2 illustrates the complementarity of the nucleotide sequences of FLJ21817 BINDING SITE, designated SEQ ID:22784, to the nucleotide sequence of VGAM2588 RNA, herein designated VGAM RNA, also designated SEQ ID:5299.

Another function of VGAM2588 is therefore inhibition of FLJ21817 (Accession NM_022448). Accordingly, utilities of VGAM2588 include diagnosis, prevention and treatment of diseases and clinical conditions associated with FLJ21817.

KIAA1069 (Accession XM_042635) is another VGAM2588 host target gene. KIAA1069 BINDING SITE is HOST TARGET binding site found in the 3' untranslated region of mRNA encoded by KIAA1069, corresponding to a HOST TARGET binding site such as BINDING SITE I, BINDING SITE II or BINDING SITE III. Table 2 illustrates the complementarity of the nucleotide sequences of KIAA1069 BINDING SITE, designated SEQ ID:33722, to the nucleotide sequence of VGAM2588 RNA, herein designated VGAM RNA, also designated SEQ ID:5299.

Another function of VGAM2588 is therefore inhibition of KIAA1069 (Accession XM_042635). Accordingly, utilities of VGAM2588 include diagnosis, prevention and treatment of diseases and clinical conditions associated with KIAA1069. PHRET1 (Accession NM_021200) is another VGAM2588 host target gene. PHRET1 BINDING SITE is HOST TARGET binding site found in the 3' untranslated region of mRNA encoded by PHRET1, corresponding to a HOST TARGET binding site such as BINDING SITE I, BINDING SITE II or BINDING SITE III. Table 2 illustrates the complementarity of the nucleotide sequences of PHRET1 BINDING SITE, designated SEQ ID:22176, to the nucleotide sequence of VGAM2588 RNA, herein designated VGAM RNA, also designated SEQ ID:5299.

Another function of VGAM2588 is therefore inhibition of PHRET1 (Accession NM_021200). Accordingly, utilities of VGAM2588 include diagnosis, prevention and treatment of diseases and clinical conditions associated with PHRET1. PRO1600 (Accession NM_014095) is another VGAM2588 host target gene. PRO1600 BINDING SITE is HOST TARGET binding site found in the 3' untranslated region of mRNA encoded by PRO1600, corresponding to a HOST TARGET binding site such as BINDING SITE I, BINDING SITE II or BINDING SITE III. Table 2 illustrates the complementarity of the nucleotide sequences of PRO1600 BINDING SITE, designated SEQ ID:15313, to the nucleotide sequence of VGAM2588 RNA, herein designated VGAM RNA, also designated SEQ ID:5299.

Another function of VGAM2588 is therefore inhibition of PRO1600 (Accession NM_014095). Accordingly, utilities of VGAM2588 include diagnosis, prevention and treatment of diseases and clinical conditions associated with PRO1600. SMT3 Suppressor of Mif Two 3 Homolog 2 (yeast) (SMT3H2, Accession NM_006937) is another VGAM2588 host target gene. SMT3H2 BINDING SITE is HOST TARGET binding site found in the 3' untranslated region of mRNA encoded by SMT3H2, corresponding to a HOST TARGET binding site such as BINDING SITE I, BINDING SITE II or BINDING SITE III. Table 2 illustrates the complementarity of the nucleotide sequences of SMT3H2 BINDING SITE, designated SEQ ID:13819, to the nucleotide sequence of VGAM2588 RNA, herein designated VGAM RNA, also designated SEQ ID:5299.

Another function of VGAM2588 is therefore inhibition of SMT3 Suppressor of Mif Two 3 Homolog 2 (yeast) (SMT3H2, Accession NM_006937). Accordingly, utilities of VGAM2588 include diagnosis, prevention and treatment of diseases and clinical conditions associated with SMT3H2. LOC143888 (Accession XM_084669) is another VGAM2588 host target gene. LOC143888 BINDING SITE is HOST TARGET binding site found in the 3' untranslated region of mRNA encoded by LOC143888, corresponding to a HOST TARGET binding site such as BINDING SITE I, BINDING SITE II or BINDING SITE III. Table 2 illustrates the complementarity of the nucleotide sequences of LOC143888 BINDING SITE, designated SEQ ID:37672, to the nucleotide sequence of VGAM2588 RNA, herein designated VGAM RNA, also designated SEQ ID:5299.

Another function of VGAM2588 is therefore inhibition of LOC143888 (Accession XM_084669). Accordingly, utilities of VGAM2588 include diagnosis, prevention and treatment of diseases and clinical conditions associated with LOC143888. LOC157695 (Accession XM_098811) is another VGAM2588 host target gene. LOC157695 BINDING SITE is HOST TARGET binding site found in the 5' untranslated region of mRNA encoded by LOC157695, corresponding to a HOST TARGET binding site such as BINDING SITE I, BINDING SITE II or BINDING SITE III. Table 2 illustrates the complementarity of the nucleotide sequences of LOC157695 BINDING SITE, designated SEQ ID:41832, to the nucleotide sequence of VGAM2588 RNA, herein designated VGAM RNA, also designated SEQ ID:5299.

Another function of VGAM2588 is therefore inhibition of LOC157695 (Accession XM_098811). Accordingly, utilities of VGAM2588 include diagnosis, prevention and treatment of diseases and clinical conditions associated with LOC157695. LOC158997 (Accession XM_088736) is another VGAM2588 host target gene. LOC158997 BINDING SITE is HOST TARGET binding site found in the 3' untranslated region of mRNA encoded by LOC158997, corresponding to a HOST TARGET binding site such as BINDING SITE I, BINDING SITE II or BINDING SITE III. Table 2 illustrates the complementarity of the nucleotide sequences of LOC158997 BINDING SITE, designated SEQ ID:39933, to the nucleotide sequence of VGAM2588 RNA, herein designated VGAM RNA, also designated SEQ ID:5299.

Another function of VGAM2588 is therefore inhibition of LOC158997 (Accession XM_088736). Accordingly, utilities of VGAM2588 include diagnosis, prevention and treatment of diseases and clinical conditions associated with LOC158997. FIG. 1 further provides a conceptual description of a novel bioinformatically detected viral gene of the present invention, referred to here as Viral Genomic Address Messenger 2589 (VGAM2589) viral gene, which modulates expression of respective host target genes thereof, the function and utility of which host target genes is known in the art.

VGAM2589 is a novel bioinformatically detected regulatory, non protein coding, viral micro RNA (miRNA) gene. The method by which VGAM2589 was detected is described hereinabove with reference to FIGS. 1-8.

VGAM2589 gene, herein designated VGAM GENE, is a viral gene contained in the genome of Apple Latent Spherical Virus. VGAM2589 host target gene, herein designated VGAM HOST TARGET GENE, is a human gene contained in the human genome.

VGAM2589 gene encodes a VGAM2589 precursor RNA, herein designated VGAM PRECURSOR RNA. Similar to other miRNA genes, and unlike most ordinary genes, VGAM2589 precursor RNA does not encode a protein. A nucleotide sequence identical or highly similar to the nucleotide sequence of VGAM2589 precursor RNA is designated SEQ ID:2575, and is provided hereinbelow with reference to the sequence listing part. Nucleotide sequence SEQ ID:2575 is located at position 1180 relative to the genome of Apple Latent Spherical Virus.

VGAM2589 precursor RNA folds onto itself, forming VGAM2589 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2589 folded precursor RNA into VGAM2589 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2589 RNA is designated SEQ ID:5300, and is provided hereinbelow with reference to the sequence listing part.

VGAM2589 host target gene, herein designated VGAM HOST TARGET GENE, encodes a corresponding messenger RNA, VGAM2589 host target RNA, herein designated VGAM HOST TARGET RNA. VGAM2589 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2589 RNA, herein designated VGAM RNA, binds complementarily to one or more host target binding sites located in untranslated regions of VGAM2589 host target RNA, herein designated VGAM HOST TARGET RNA. This complementary binding is due to the fact that the nucleotide sequence of VGAM2589 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2589 RNA, herein designated VGAM RNA, may have a different number of host target binding sites in untranslated regions of a VGAM2589 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2589 RNA, herein designated VGAM RNA, to host target binding sites on VGAM2589 host target RNA, herein designated VGAM HOST TARGET RNA, such as BINDING SITE I, BINDING SITE II and BINDING SITE III, inhibits translation of VGAM2589 host target RNA into VGAM2589 host target protein, herein designated VGAM HOST TARGET PROTEIN. VGAM host target protein is therefore outlined by a broken line.

It is appreciated that VGAM2589 host target gene, herein designated VGAM HOST TARGET GENE, in fact represents a plurality of VGAM2589 host target genes. The mRNA of each one of this plurality of VGAM2589 host target genes comprises one or more host target binding sites, each having a nucleotide sequence which is at least partly complementary to VGAM2589 RNA, herein designated VGAM RNA, and which when bound by VGAM2589 RNA causes inhibition of translation of respective one or more VGAM2589 host target proteins.

It is further appreciated by one skilled in the art that the mode of translational inhibition illustrated by FIG. 1 with specific reference to translational inhibition exerted by VGAM2589 gene, herein designated VGAM GENE, on one or more VGAM2589 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2589 is inhibition of expression of host target genes, as part of a novel viral mechanism of attacking a host. Accordingly, utilities of VGAM2589 include diagnosis, prevention and treatment of viral infection by Apple Latent Spherical Virus. Specific functions, and accordingly utilities, of VGAM2589 correlate with, and may be deduced from, the identity of the host target genes which VGAM2589 binds and inhibits, and the function of these host target genes, as elaborated hereinbelow.

Nucleotide sequences of the VGAM2589 precursor RNA, herein designated VGAM PRECURSOR RNA, and of the 'diced' VGAM2589 RNA, herein designated VGAM RNA, and a schematic representation of the secondary folding of VGAM2589 folded precursor RNA, herein designated VGAM FOLDED PRECURSOR RNA, of VGAM2589 are further described hereinbelow with reference to Table 1.

Nucleotide sequences of host target binding sites, such as BINDING SITE-I, BINDING SITE-II and BINDING SITE-III of FIG. 1, found on VGAM2589 host target RNA, and schematic representation of the complementarity of each of these host target binding sites to VGAM2589 RNA, herein designated VGAM RNA, are described hereinbelow with reference to Table 2.

As mentioned hereinabove with reference to FIG. 1, a function of VGAM2589 gene, herein designated VGAM is inhibition of expression of VGAM2589 target genes. It is appreciated that specific functions, and accordingly utilities, of VGAM2589 correlate with, and may be deduced from, the identity of the target genes which VGAM2589 binds and inhibits, and the function of these target genes, as elaborated hereinbelow.

ATP-binding Cassette, Sub-family D (ALD), Member 3 (ABCD3, Accession NM_002858) is a VGAM2589 host target gene. ABCD3 BINDING SITE is HOST TARGET binding site found in the 3' untranslated region of mRNA encoded by ABCD3, corresponding to a HOST TARGET binding site such as BINDING SITE I, BINDING SITE II or BINDING SITE III. Table 2 illustrates the complementarity of the nucleotide sequences of ABCD3 BINDING SITE, designated SEQ ID:8752, to the nucleotide sequence of VGAM2589 RNA, herein designated VGAM RNA, also designated SEQ ID:5300.

A function of VGAM2589 is therefore inhibition of ATP-binding Cassette, Sub-family D (ALD), Member 3 (ABCD3, Accession NM_002858), a gene which a probable transporter. Accordingly, utilities of VGAM2589 include diagnosis, prevention and treatment of diseases and clinical conditions associated with ABCD3. The function of ABCD3 and its association with various diseases and clinical conditions, has been established by previous studies, as described hereinabove with reference to VGAM1775. Endothelial Cell-specific Molecule 1 (ESM1, Accession NM_007036) is another VGAM2589 host target gene. ESM1 BINDING SITE is HOST TARGET binding site found in the 3' untranslated region of mRNA encoded by ESM1, corresponding to a HOST TARGET binding site such as BINDING SITE I, BINDING SITE II or BINDING SITE III. Table 2 illustrates the complementarity of the nucleotide sequences of ESM1 BINDING SITE, designated SEQ ID:13912, to the nucleotide sequence of VGAM2589 RNA, herein designated VGAM RNA, also designated SEQ ID:5300.

Another function of VGAM2589 is therefore inhibition of Endothelial Cell-specific Molecule 1 (ESM1, Accession NM_007036). Accordingly, utilities of VGAM2589 include diagnosis, prevention and treatment of diseases and clinical conditions associated with ESM1. FIG. 1 further provides a conceptual description of a novel bioinformatically detected viral gene of the present invention, referred to here as Viral Genomic Address Messenger 2590 (VGAM2590) viral gene, which modulates expression of respective host target genes thereof, the function and utility of which host target genes is known in the art.

VGAM2590 is a novel bioinformatically detected regulatory, non protein coding, viral micro RNA (miRNA) gene. The method by which VGAM2590 was detected is described hereinabove with reference to FIGS. 1-8.

VGAM2590 gene, herein designated VGAM GENE, is a viral gene contained in the genome of Apple Latent Spherical Virus. VGAM2590 host target gene, herein designated VGAM HOST TARGET GENE, is a human gene contained in the human genome.

VGAM2590 gene encodes a VGAM2590 precursor RNA, herein designated VGAM PRECURSOR RNA. Similar to other miRNA genes, and unlike most ordinary genes, VGAM2590 precursor RNA does not encode a protein. A nucleotide sequence identical or highly similar to the nucleotide sequence of VGAM2590 precursor RNA is designated SEQ ID:2576, and is provided hereinbelow with reference to the sequence listing part. Nucleotide sequence SEQ ID:2576 is located at position 2408 relative to the genome of Apple Latent Spherical Virus.

VGAM2590 precursor RNA folds onto itself, forming VGAM2590 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2590 folded precursor RNA into VGAM2590 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM2590 RNA is designated SEQ ID:5301, and is provided hereinbelow with reference to the sequence listing part.

VGAM2590 host target gene, herein designated VGAM HOST TARGET GENE, encodes a corresponding messenger RNA, VGAM2590 host target RNA, herein designated VGAM HOST TARGET RNA. VGAM2590 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2590 RNA, herein designated VGAM RNA, binds complementarily to one or more host target binding sites located in untranslated regions of VGAM2590 host target RNA, herein designated VGAM HOST TARGET RNA. This complementary binding is due to the fact that the nucleotide sequence of VGAM2590 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2590 RNA, herein designated VGAM RNA, may have a different number of host target binding sites in untranslated regions of a VGAM2590 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2590 RNA, herein designated VGAM RNA, to host target binding sites on VGAM2590 host target RNA, herein designated VGAM HOST TARGET RNA, such as BINDING SITE I, BINDING SITE II and BINDING SITE III, inhibits translation of VGAM2590 host target RNA into VGAM2590 host target protein, herein designated VGAM HOST TARGET PROTEIN. VGAM host target protein is therefore outlined by a broken line.

It is appreciated that VGAM2590 host target gene, herein designated VGAM HOST TARGET GENE, in fact represents a plurality of VGAM2590 host target genes. The mRNA of each one of this plurality of VGAM2590 host target genes comprises one or more host target binding sites, each having a nucleotide sequence which is at least partly complementary to VGAM2590 RNA, herein designated VGAM RNA, and which when bound by VGAM2590 RNA causes inhibition of translation of respective one or more VGAM2590 host target proteins.

It is further appreciated by one skilled in the art that the mode of translational inhibition illustrated by FIG. 1 with specific reference to translational inhibition exerted by VGAM2590 gene, herein designated VGAM GENE, on one or more VGAM2590 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2590 is inhibition of expression of host target genes, as part of a novel viral mechanism of attacking a host. Accordingly, utilities of VGAM2590 include diagnosis, prevention and treatment of viral infection by Apple Latent Spherical Virus. Specific functions, and accordingly utilities, of VGAM2590 correlate with, and may be deduced from, the identity of the host target genes which VGAM2590 binds and inhibits, and the function of these host target genes, as elaborated hereinbelow.

Nucleotide sequences of the VGAM2590 precursor RNA, herein designated VGAM PRECURSOR RNA, and of the 'diced' VGAM2590 RNA, herein designated VGAM RNA, and a schematic representation of the secondary folding of VGAM2590 folded precursor RNA, herein designated VGAM FOLDED PRECURSOR RNA, of VGAM2590 are further described hereinbelow with reference to Table 1.

Nucleotide sequences of host target binding sites, such as BINDING SITE-I, BINDING SITE-II and BINDING SITE-III of FIG. 1, found on VGAM2590 host target RNA, and schematic representation of the complementarity of each of these host target binding sites to VGAM2590 RNA, herein designated VGAM RNA, are described hereinbelow with reference to Table 2.

As mentioned hereinabove with reference to FIG. 1, a function of VGAM2590 gene, herein designated VGAM is inhibition of expression of VGAM2590 target genes. It is appreciated that specific functions, and accordingly utilities, of VGAM2590 correlate with, and may be deduced from, the identity of the target genes which VGAM2590 binds and inhibits, and the function of these target genes, as elaborated hereinbelow.

Ankyrin-like with Transmembrane Domains 1 (ANKTM1, Accession NM_007332) is a VGAM2590 host target gene. ANKTM1 BINDING SITE is HOST TARGET binding site found in the 3' untranslated region of mRNA encoded by ANKTM1, corresponding to a HOST TARGET binding site such as BINDING SITE I, BINDING SITE II or BINDING SITE III. Table 2 illustrates the complementarity of the nucleotide sequences of ANKTM1 BINDING SITE, designated SEQ ID:14260, to the nucleotide sequence of VGAM2590 RNA, herein designated VGAM RNA, also designated SEQ ID:5301.

A function of VGAM2590 is therefore inhibition of Ankyrin-like with Transmembrane Domains 1 (ANKTM1, Accession NM_007332), a gene which attaches integral membrane proteins to cytoskeletal elements. Accordingly, utilities of VGAM2590 include diagnosis, prevention and treatment of diseases and clinical conditions associated with ANKTM1. The function of ANKTM1 and its association with various diseases and clinical conditions, has been established by previous studies, as described hereinabove with reference to VGAM644. Calcium Channel, Voltage-dependent, Alpha 2/delta 3 Subunit (CACNA2D3, Accession NM_018398) is another VGAM2590 host target gene. CACNA2D3 BINDING SITE is HOST TARGET binding site found in the 5" untranslated region of mRNA encoded by CACNA2D3, corresponding to a HOST TARGET binding site such as BINDING SITE I, BINDING SITE II or BINDING SITE III. Table 2 illustrates the complementarity of the nucleotide sequences of CACNA2D3 BINDING SITE, designated SEQ ID:20435, to the nucleotide sequence of VGAM2590 RNA, herein designated VGAM RNA, also designated SEQ ID:5301.

Another function of VGAM2590 is therefore inhibition of Calcium Channel, Voltage-dependent, Alpha 2/delta 3 Subunit (CACNA2D3, Accession NM_018398). Accordingly, utilities of VGAM2590 include diagnosis, prevention and treatment of diseases and clinical conditions associated with CACNA2D3. Cadherin, EGF LAG Seven-pass G-type Receptor 1 (flamingo homolog, Drosophila) (CELSR1, Accession NM_014246) is another VGAM2590 host target gene. CELSR1 BINDING SITE is HOST TARGET binding site found in the 3' untranslated region of mRNA encoded by CELSR1, corresponding to a HOST TARGET binding site such as BINDING SITE I, BINDING SITE II or BINDING SITE III. Table 2 illustrates the complementarity of the nucleotide sequences of CELSR1 BINDING SITE, designated SEQ ID:15513, to the nucleotide sequence of VGAM2590 RNA, herein designated VGAM RNA, also designated SEQ ID:5301.

Another function of VGAM2590 is therefore inhibition of Cadherin, EGF LAG Seven-pass G-type Receptor 1 (flamingo homolog, Drosophila) (CELSR1, Accession NM_014246), a gene which is involved in contact-mediated communication. Accordingly, utilities of VGAM2590 include diagnosis, prevention and treatment of diseases and clinical conditions associated with CELSR1. The function of CELSR1 and its association with various diseases and clinical conditions, has been established by previous studies, as described hereinabove with reference to VGAM459. 7-dehydrocholesterol Reductase (DHCR7, Accession NM_001360) is another VGAM2590 host target gene. DHCR7 BINDING SITE is HOST TARGET binding site found in the 3' untranslated region of mRNA encoded by DHCR7, corresponding to a HOST TARGET binding site such as BINDING SITE I, BINDING SITE II or BINDING SITE III. Table 2 illustrates the complementarity of the nucleotide sequences of DHCR7 BINDING SITE, designated SEQ ID:7039, to the nucleotide sequence of VGAM2590 RNA, herein designated VGAM RNA, also designated SEQ ID:5301.

Another function of VGAM2590 is therefore inhibition of 7-dehydrocholesterol Reductase (DHCR7, Accession NM_001360). Accordingly, utilities of VGAM2590 include diagnosis, prevention and treatment of diseases and clinical conditions associated with DHCR7. V-myb Myeloblastosis Viral Oncogene Homolog (avian)-like 1 (MYBL1, Accession XM_034274) is another VGAM2590 host target gene. MYBL1 BINDING SITE is HOST TARGET binding site found in the 3' untranslated region of mRNA encoded by MYBL1, corresponding to a HOST TARGET binding site such as BINDING SITE I, BINDING SITE II or BINDING SITE III. Table 2 illustrates the complementarity of the nucleotide sequences of MYBL1 BINDING SITE, designated SEQ ID:32045, to the nucleotide sequence of VGAM2590 RNA, herein designated VGAM RNA, also designated SEQ ID:5301.

Another function of VGAM2590 is therefore inhibition of V-myb Myeloblastosis Viral Oncogene Homolog (avian)-like 1 (MYBL1, Accession XM_034274), a gene which could have a role in the proliferation and/or differentiation of neurogenic, spermatogenic and b-lymphoid cells. Accordingly, utilities of VGAM2590 include diagnosis, prevention and treatment of diseases and clinical conditions associated with MYBL1. The function of MYBL1 and its association with various diseases and clinical conditions, has been established by previous studies, as described hereinabove with reference to VGAM184. Phosphodiesterase 4C, CAMP-specific (phosphodiesterase E1 dunce homolog, Drosophila) (PDE4C, Accession NM_000923) is another VGAM2590 host target gene. PDE4C BINDING SITE is HOST TARGET binding site found in the 3' untranslated region of mRNA encoded by PDE4C, corresponding to a HOST TARGET binding site such as BINDING SITE I, BINDING SITE II or BINDING SITE III. Table 2 illustrates the complementarity of the nucleotide sequences of PDE4C BINDING SITE, designated SEQ ID:6634, to the nucleotide sequence of VGAM2590 RNA, herein designated VGAM RNA, also designated SEQ ID:5301.

Another function of VGAM2590 is therefore inhibition of Phosphodiesterase 4C, CAMP-specific (phosphodiesterase E1 dunce homolog, Drosophila) (PDE4C, Accession NM_000923), a gene which is a cAMP-specific phosphodiesterase and may be a protein involved in learning and memory. Accordingly, utilities of VGAM2590 include diagnosis, prevention and treatment of diseases and clinical conditions associated with PDE4C. The function of PDE4C and its association with various diseases and clinical conditions, has been established by previous studies, as described hereinabove with reference to VGAM1965. Polymyositis/scleroderma Autoantigen 1, 75 kDa (PMSCL1, Accession NM_005033) is another VGAM2590 host target gene. PMSCL1 BINDING SITE is HOST TARGET binding site found in the 5' untranslated region of mRNA encoded by PMSCL1, corresponding to a HOST TARGET binding site such as BINDING SITE I, BINDING SITE II or BINDING SITE III. Table 2 illustrates the complementarity of the nucleotide sequences of PMSCL1 BINDING SITE, designated SEQ ID:11474, to the nucleotide sequence of VGAM2590 RNA, herein designated VGAM RNA, also designated SEQ ID:5301.

Another function of VGAM2590 is therefore inhibition of Polymyositis/scleroderma Autoantigen 1, 75 kDa (PMSCL1, Accession NM_005033). Accordingly, utilities of VGAM2590 include diagnosis, prevention and treatment of diseases and clinical conditions associated with PMSCL1. POU Domain, Class 4, Transcription Factor 1 (POU4F1, Accession NM_006237) is another VGAM2590 host target gene. POU4F1 BINDING SITE is HOST TARGET binding site found in the 3' untranslated region of mRNA encoded by POU4F1, corresponding to a HOST TARGET binding site such as BINDING SITE I, BINDING SITE II or BINDING SITE III. Table 2 illustrates the complementarity of the nucleotide sequences of POU4F1 BINDING SITE, designated SEQ ID:12903, to the nucleotide sequence of VGAM2590 RNA, herein designated VGAM RNA, also designated SEQ ID:5301.

Another function of VGAM2590 is therefore inhibition of POU Domain, Class 4, Transcription Factor 1 (POU4F1, Accession NM_006237), a gene which plays a role in the regulation of specific gene expression within a subset of neuronal lineages. Accordingly, utilities of VGAM2590 include diagnosis, prevention and treatment of diseases and clinical conditions associated with POU4F1. The function of POU4F1 and its association with various diseases and clinical conditions, has been established by previous studies, as described hereinabove with reference to VGAM1026. Protein Kinase C, Beta 1 (PRKCB1, Accession XM_047187) is another VGAM2590 host target gene. PRKCB1 BINDING SITE is HOST TARGET binding site found in the 3' untranslated region of mRNA encoded by PRKCB1, corresponding to a HOST TARGET binding site such as BINDING SITE I, BINDING SITE II or BINDING SITE III. Table 2 illustrates the complementarity of the nucleotide sequences of PRKCB1 BINDING SITE, designated SEQ ID:34904, to the nucleotide sequence of VGAM2590 RNA, herein designated VGAM RNA, also designated SEQ ID:5301.

Another function of VGAM2590 is therefore inhibition of Protein Kinase C, Beta 1 (PRKCB1, Accession XM_047187), a gene which is a calcium-activated, phospholipid-dependent, serine- and threonine-specific enzyme. Accordingly, utilities of VGAM2590 include diagnosis, prevention and treatment of diseases and clinical conditions associated with PRKCB1. The function of PRKCB1 and its association with various diseases and clinical conditions, has been established by previous studies, as described hereinabove with reference to VGAM2065. SH3-domain Binding Protein 2 (SH3BP2, Accession NM_003023) is another VGAM2590 host target gene. SH3BP2 BINDING SITE is HOST TARGET binding site found in the 3' untranslated region of mRNA encoded by SH3BP2, corresponding to a HOST TARGET binding site such as BINDING SITE I, BINDING SITE II or BINDING SITE III. Table 2 illustrates the complementarity of the nucleotide sequences of SH3BP2 BINDING SITE, designated SEQ ID:8953, to the nucleotide sequence of VGAM2590 RNA, herein designated VGAM RNA, also designated SEQ ID:5301.

Another function of VGAM2590 is therefore inhibition of SH3-domain Binding Protein 2 (SH3BP2, Accession NM_003023). Accordingly, utilities of VGAM2590 include diagnosis, prevention and treatment of diseases and clinical conditions associated with SH3BP2. SRY (sex determining region Y)-box 13 (SOX13, Accession NM_005686) is another VGAM2590 host target gene. SOX13 BINDING SITE is HOST TARGET binding site found in the 3' untranslated region of mRNA encoded by SOX13, corresponding to a HOST TARGET binding site such as BINDING SITE I, BINDING SITE II or BINDING SITE III. Table 2 illustrates the complementarity of the nucleotide sequences of SOX13 BINDING SITE, designated SEQ ID:12243, to the nucleotide sequence of VGAM2590 RNA, herein designated VGAM RNA, also designated SEQ ID:5301.

Another function of VGAM2590 is therefore inhibition of SRY (sex determining region Y)-box 13 (SOX13, Accession NM_005686). Accordingly, utilities of VGAM2590 include diagnosis, prevention and treatment of diseases and clinical conditions associated with SOX13. Sp3 Transcription Factor (SP3, Accession XM_092672) is another VGAM2590 host target gene. SP3 BINDING SITE is HOST TARGET binding site found in the 5' untranslated region of mRNA encoded by SP3, corresponding to a HOST TARGET binding site such as BINDING SITE I, BINDING SITE II or BINDING SITE III. Table 2 illustrates the complementarity of the nucleotide sequences of SP3 BINDING SITE, designated SEQ ID:40134, to the nucleotide sequence of VGAM2590 RNA, herein designated VGAM RNA, also designated SEQ ID:5301.

Another function of VGAM2590 is therefore inhibition of Sp3 Transcription Factor (SP3, Accession XM_092672), a gene which binds to gt and gc boxes promoters elements. Accordingly, utilities of VGAM2590 include diagnosis, prevention and treatment of diseases and clinical conditions associated with SP3. The function of SP3 and its association with various diseases and clinical conditions, has been established by previous studies, as described hereinabove with reference to VGAM861. TIA1 Cytotoxic Granule-associated RNA Binding Protein-like 1 (TIAL1, Accession NM_022333) is another VGAM2590 host target gene. TIAL1 BINDING SITE is HOST TARGET binding site found in the 3' untranslated region of mRNA encoded by TIAL1, corresponding to a HOST TARGET binding site such as BINDING SITE I, BINDING SITE II or BINDING SITE III. Table 2 illustrates the complementarity of the nucleotide sequences of TIAL1 BINDING SITE, designated SEQ ID:22743, to the nucleotide sequence of VGAM2590 RNA, herein designated VGAM RNA, also designated SEQ ID:5301.

Another function of VGAM2590 is therefore inhibition of TIA1 Cytotoxic Granule-associated RNA Binding Protein-like 1 (TIAL1, Accession NM_022333), a gene which possesses nucleolytic activity against cytotoxic lymphocyte target cells. Accordingly, utilities of VGAM2590 include diagnosis, prevention and treatment of diseases and clinical conditions associated with TIAL1. The function of TIAL1 and its association with various diseases and clinical conditions, has been established by previous studies, as described hereinabove with reference to VGAM350. Transmembrane, Cochlear Expressed, 1 (TMC1, Accession NM_138691) is another VGAM2590 host target gene. TMC1 BINDING SITE is HOST TARGET binding site found in the 5' untranslated region of mRNA encoded by TMC1, corresponding to a HOST TARGET binding site such as BINDING SITE I, BINDING SITE II or BINDING SITE III. Table 2 illustrates the complementarity of the nucleotide sequences of TMC1 BINDING SITE, designated SEQ ID:28932, to the nucleotide sequence of VGAM2590 RNA, herein designated VGAM RNA, also designated SEQ ID:5301.

Another function of VGAM2590 is therefore inhibition of Transmembrane, Cochlear Expressed, 1 (TMC1, Accession NM_138691), a gene which is required for normal function of cochlear hair cells. Accordingly, utilities of VGAM2590 include diagnosis, prevention and treatment of diseases and clinical conditions associated with TMC1. The function of TMC1 and its association with various diseases and clinical conditions, has been established by previous studies, as described hereinabove with reference to VGAM554. Thioredoxin Reductase 1 (TXNRD1, Accession NM_003330) is another VGAM2590 host target gene. TXNRD1 BINDING SITE is HOST TARGET binding site found in the 3' untranslated region of mRNA encoded by TXNRD1, corresponding to a HOST TARGET binding site such as BINDING SITE I, BINDING SITE II or BINDING SITE III. Table 2 illustrates the complementarity of the nucleotide sequences of TXNRD1 BINDING SITE, designated SEQ ID:9337, to the nucleotide sequence of VGAM2590 RNA, herein designated VGAM RNA, also designated SEQ ID:5301.

Another function of VGAM2590 is therefore inhibition of Thioredoxin Reductase 1 (TXNRD1, Accession NM_003330), a gene which acts as an antioxidant enzyme and is involved in maintaining redox balance. Accordingly, utilities of VGAM2590 include diagnosis, prevention and treatment of diseases and clinical conditions associated with TXNRD1. The function of TXNRD1 and its association with various diseases and clinical conditions, has been established by previous studies, as described hereinabove with reference to VGAM247. Vang-like 2 (van gogh, Drosophila) (VANGL2, Accession XM_049695) is another VGAM2590 host target gene. VANGL2 BINDING SITE is HOST TARGET binding site found in the 3' untranslated region of mRNA encoded by VANGL2, corresponding to a HOST TARGET binding site such as BINDING SITE I, BINDING SITE II or BINDING SITE III. Table 2 illustrates the complementarity of the nucleotide sequences of VANGL2 BINDING SITE, designated SEQ ID:35486, to the nucleotide sequence of VGAM2590 RNA, herein designated VGAM RNA, also designated SEQ ID:5301.

Another function of VGAM2590 is therefore inhibition of Vang-like 2 (van gogh, Drosophila) (VANGL2, Accession XM_049695), a gene which may take part in defining the lateral boundary of floorplate differentiation. Accordingly, utilities of VGAM2590 include diagnosis, prevention and treatment of diseases and clinical conditions associated with VANGL2. The function of VANGL2 and its association with various diseases and clinical conditions, has been established by previous studies, as described hereinabove with reference to VGAM111. ABLIM (Accession NM_002313) is another VGAM2590 host target gene. ABLIM BINDING SITE1 and ABLIM BINDING SITE2 are HOST TARGET binding sites found in untranslated regions of mRNA encoded by ABLIM, corresponding to HOST TARGET binding sites such as BINDING SITE I, BINDING SITE II or BINDING SITE III. Table 2 illustrates the complementarity of the nucleotide sequences of ABLIM BINDING SITE1 and ABLIM BINDING SITE2, designated SEQ ID:8121 and SEQ ID:13554 respectively, to the nucleotide sequence of VGAM2590 RNA, herein designated VGAM RNA, also designated SEQ ID:5301.

Another function of VGAM2590 is therefore inhibition of ABLIM (Accession NM_002313). Accordingly, utilities of VGAM2590 include diagnosis, prevention and treatment of diseases and clinical conditions associated with ABLIM. BPES (Accession NM_023067) is another VGAM2590 host target gene. BPES BINDING SITE is HOST TARGET binding site found in the 3' untranslated region of mRNA encoded by BPES, corresponding to a HOST TARGET binding site such as BINDING SITE I, BINDING SITE II or BINDING SITE III. Table 2 illustrates the complementarity of the nucleotide sequences of BPES BINDING SITE, designated SEQ ID:23326, to the nucleotide sequence of VGAM2590 RNA, herein designated VGAM RNA, also designated SEQ ID:5301.

Another function of VGAM2590 is therefore inhibition of BPES (Accession NM_023067). Accordingly, utilities of VGAM2590 include diagnosis, prevention and treatment of diseases and clinical conditions associated with BPES. Chromosome 11 Open Reading Frame 23 (C11orf23, Accession NM_018312) is another VGAM2590 host target gene. C11orf23 BINDING SITE is HOST TARGET binding site found in the 3' untranslated region of mRNA encoded by C11orf23, corresponding to a HOST TARGET binding site such as BINDING SITE I, BINDING SITE II or BINDING SITE III. Table 2 illustrates the complementarity of the nucleotide sequences of C11orf23 BINDING SITE, designated SEQ ID:20305, to the nucleotide sequence of VGAM2590 RNA, herein designated VGAM RNA, also designated SEQ ID:5301.

Another function of VGAM2590 is therefore inhibition of Chromosome 11 Open Reading Frame 23 (C11orf23, Accession NM_018312). Accordingly, utilities of VGAM2590 include diagnosis, prevention and treatment of diseases and clinical conditions associated with C11orf23. Chromosome 20 Open Reading Frame 108 (C20orf108, Accession NM_080821) is another VGAM2590 host target gene. C20orf108 BINDING SITE is HOST TARGET binding site found in the 3" untranslated region of mRNA encoded by C20orf108, corresponding to a HOST TARGET binding site such as BINDING SITE I, BINDING SITE II or BINDING SITE III. Table 2 illustrates the complementarity of the nucleotide sequences of C20orf108 BINDING SITE, designated SEQ ID:28083, to the nucleotide sequence of VGAM2590 RNA, herein designated VGAM RNA, also designated SEQ ID:5301.

Another function of VGAM2590 is therefore inhibition of Chromosome 20 Open Reading Frame 108 (C20orf108, Accession NM_080821). Accordingly, utilities of VGAM2590 include diagnosis, prevention and treatment of diseases and clinical conditions associated with C20orf108. Dedicator of Cyto-kinesis 3 (DOCK3, Accession XM_039259) is another VGAM2590 host target gene. DOCK3 BINDING SITE is HOST TARGET binding site found in the 3' untranslated region of mRNA encoded by DOCK3, corresponding to a HOST TARGET binding site such as BINDING SITE I, BINDING SITE II or BINDING SITE III. Table 2 illustrates the complementarity of the nucleotide sequences of DOCK3 BINDING SITE, designated SEQ ID:33041, to the nucleotide sequence of VGAM2590 RNA, herein designated VGAM RNA, also designated SEQ ID:5301.

Another function of VGAM2590 is therefore inhibition of Dedicator of Cyto-kinesis 3 (DOCK3, Accession XM_039259). Accordingly, utilities of VGAM2590 include diagnosis, prevention and treatment of diseases and clinical conditions associated with DOCK3. FLJ10702 (Accession NM_018184) is another VGAM2590 host target gene. FLJ10702 BINDING SITE is HOST TARGET binding site found in the 3' untranslated region of mRNA encoded by FLJ10702, corresponding to a HOST TARGET binding site such as BINDING SITE I, BINDING SITE II or BINDING SITE III. Table 2 illustrates the complementarity of the nucleotide sequences of FLJ10702 BINDING SITE, designated SEQ ID:20029, to the nucleotide sequence of VGAM2590 RNA, herein designated VGAM RNA, also designated SEQ ID:5301.

Another function of VGAM2590 is therefore inhibition of FLJ10702 (Accession NM_018184). Accordingly, utilities of VGAM2590 include diagnosis, prevention and treatment of diseases and clinical conditions associated with FLJ10702. FLJ21438 (Accession XM_029084) is another VGAM2590 host target gene. FLJ21438 BINDING SITE is HOST TARGET binding site found in the 5' untranslated region of mRNA encoded by FLJ21438, corresponding to a HOST TARGET binding site such as BINDING SITE I, BINDING SITE II or BINDING SITE III. Table 2 illustrates the complementarity of the nucleotide sequences of FLJ21438 BINDING SITE, designated SEQ ID:30846, to the nucleotide sequence of VGAM2590 RNA, herein designated VGAM RNA, also designated SEQ ID:5301.

Another function of VGAM2590 is therefore inhibition of FLJ21438 (Accession XM_029084). Accordingly, utilities of VGAM2590 include diagnosis, prevention and treatment of diseases and clinical conditions associated with FLJ21438. Heterogeneous Nuclear Ribonucleoprotein A3 (HNRPA3, Accession NM_005758) is another VGAM2590 host target gene. HNRPA3 BINDING SITE is HOST TARGET binding site found in the 3' untranslated region of mRNA encoded by HNRPA3, corresponding to a HOST TARGET binding site such as BINDING SITE I, BINDING SITE II or BINDING SITE III. Table 2 illustrates the complementarity of the nucleotide sequences of HNRPA3 BINDING SITE, designated SEQ ID:12325, to the nucleotide sequence of VGAM2590 RNA, herein designated VGAM RNA, also designated SEQ ID:5301.

Another function of VGAM2590 is therefore inhibition of Heterogeneous Nuclear Ribonucleoprotein A3 (HNRPA3, Accession NM_005758). Accordingly, utilities of VGAM2590 include diagnosis, prevention and treatment of diseases and clinical conditions associated with HNRPA3. KIAA0133 (Accession NM_014777) is another VGAM2590 host target gene. KIAA0133 BINDING SITE is HOST TARGET binding site found in the 3' untranslated region of mRNA encoded by KIAA0133, corresponding to a HOST TARGET binding site such as BINDING SITE I, BINDING SITE II or BINDING SITE III. Table 2 illustrates the complementarity of the nucleotide sequences of KIAA0133 BINDING SITE, designated SEQ ID:16610, to the nucleotide sequence of VGAM2590 RNA, herein designated VGAM RNA, also designated SEQ ID:5301.

Another function of VGAM2590 is therefore inhibition of KIAA0133 (Accession NM_014777). Accordingly, utilities of VGAM2590 include diagnosis, prevention and treatment of diseases and clinical conditions associated with KIAA0133. KIAA0469 (Accession NM_014851) is another VGAM2590 host target gene. KIAA0469 BINDING SITE is HOST TARGET binding site found in the 3' untranslated region of mRNA encoded by KIAA0469, corresponding to a HOST TARGET binding site such as BINDING SITE I, BINDING SITE II or BINDING SITE III. Table 2 illustrates the complementarity of the nucleotide sequences of KIAA0469 BINDING SITE, designated SEQ ID:16897, to the nucleotide sequence of VGAM2590 RNA, herein designated VGAM RNA, also designated SEQ ID:5301.

Another function of VGAM2590 is therefore inhibition of KIAA0469 (Accession NM_014851). Accordingly, utilities of VGAM2590 include diagnosis, prevention and treatment of diseases and clinical conditions associated with KIAA0469. KIAA1023 (Accession NM_017604) is another VGAM2590 host target gene. KIAA1023 BINDING SITE is HOST TARGET binding site found in the 3' untranslated region of mRNA encoded by KIAA1023, corresponding to a HOST TARGET binding site such as BINDING SITE I, BINDING SITE II or BINDING SITE III. Table 2 illustrates the complementarity of the nucleotide sequences of KIAA1023 BINDING SITE, designated SEQ ID:19094, to the nucleotide sequence of VGAM2590 RNA, herein designated VGAM RNA, also designated SEQ ID:5301.

Another function of VGAM2590 is therefore inhibition of KIAA1023 (Accession NM_017604). Accordingly, utilities of VGAM2590 include diagnosis, prevention and treatment of diseases and clinical conditions associated with KIAA1023. KIAA1069 (Accession XM_042635) is another VGAM2590 host target gene. KIAA1069 BINDING SITE is HOST TARGET binding site found in the 3' untranslated region of mRNA encoded by KIAA1069, corresponding to a HOST TARGET binding site such as BINDING SITE I, BINDING SITE II or BINDING SITE III. Table 2 illustrates the complementarity of the nucleotide sequences of KIAA1069 BINDING SITE, designated SEQ ID:33726, to the nucleotide sequence of VGAM2590 RNA, herein designated VGAM RNA, also designated SEQ ID:5301.

Another function of VGAM2590 is therefore inhibition of KIAA1069 (Accession XM_042635). Accordingly, utilities of VGAM2590 include diagnosis, prevention and treatment of diseases and clinical conditions associated with KIAA1069. KIAA1203 (Accession XM_049683) is another VGAM2590 host target gene. KIAA1203 BINDING SITE is HOST TARGET binding site found in the 3' untranslated region of mRNA encoded by KIAA1203, corresponding to a HOST TARGET binding site such as BINDING SITE I, BINDING SITE II or BINDING SITE III. Table 2 illustrates the complementarity of the nucleotide sequences of KIAA1203 BINDING SITE, designated SEQ ID:35472, to the nucleotide sequence of VGAM2590 RNA, herein designated VGAM RNA, also designated SEQ ID:5301.

Another function of VGAM2590 is therefore inhibition of KIAA1203 (Accession XM_049683). Accordingly, utilities of VGAM2590 include diagnosis, prevention and treatment of diseases and clinical conditions associated with KIAA1203. KIAA1872 (Accession XM_031917) is another VGAM2590 host target gene. KIAA1872 BINDING SITE is HOST TARGET binding site found in the 3' untranslated region of mRNA encoded by KIAA1872, corresponding to a HOST TARGET binding site such as BINDING SITE I, BINDING SITE II or BINDING SITE III. Table 2 illustrates the complementarity of the nucleotide sequences of KIAA1872 BINDING SITE, designated SEQ ID:31525, to the nucleotide sequence of VGAM2590 RNA, herein designated VGAM RNA, also designated SEQ ID:5301.

Another function of VGAM2590 is therefore inhibition of KIAA1872 (Accession XM_031917). Accordingly, utilities of VGAM2590 include diagnosis, prevention and treatment of diseases and clinical conditions associated with KIAA1872. LHX6 (Accession NM_014368) is another VGAM2590 host target gene. LHX6 BINDING SITE is HOST TARGET binding site found in the 3' untranslated region of mRNA encoded by LHX6, corresponding to a HOST TARGET binding site such as BINDING SITE I, BINDING SITE II or BINDING SITE III. Table 2 illustrates the complementarity of the nucleotide sequences of LHX6 BINDING SITE, designated SEQ ID:15701, to the nucleotide sequence of VGAM2590 RNA, herein designated VGAM RNA, also designated SEQ ID:5301.

Another function of VGAM2590 is therefore inhibition of LHX6 (Accession NM_014368). Accordingly, utilities of VGAM2590 include diagnosis, prevention and treatment of diseases and clinical conditions associated with LHX6. Lipase, Endothelial (LIPG, Accession NM_006033) is another VGAM2590 host target gene. LIPG BINDING SITE is HOST TARGET binding site found in the 3' untranslated region of mRNA encoded by LIPG, corresponding to a HOST TARGET binding site such as BINDING SITE I, BINDING SITE II or BINDING SITE III. Table 2 illustrates the complementarity of the nucleotide sequences of LIPG BINDING SITE, designated SEQ ID:12656, to the nucleotide sequence of VGAM2590 RNA, herein designated VGAM RNA, also designated SEQ ID:5301.

Another function of VGAM2590 is therefore inhibition of Lipase, Endothelial (LIPG, Accession NM_006033). Accordingly, utilities of VGAM2590 include diagnosis, prevention and treatment of diseases and clinical conditions associated with LIPG. MGC15634 (Accession NM_032755) is another VGAM2590 host target gene. MGC15634 BINDING SITE is HOST TARGET binding site found in the 3' untranslated region of mRNA encoded by MGC15634, corresponding to a HOST TARGET binding site such as BINDING SITE I, BINDING SITE II or BINDING SITE III. Table 2 illustrates the complementarity of the nucleotide sequences of MGC15634 BINDING SITE, designated SEQ ID:26497, to the nucleotide sequence of VGAM2590 RNA, herein designated VGAM RNA, also designated SEQ ID:5301.

Another function of VGAM2590 is therefore inhibition of MGC15634 (Accession NM_032755). Accordingly, utilities of VGAM2590 include diagnosis, prevention and treatment of diseases and clinical conditions associated with MGC15634. MGC26684 (Accession NM_144568) is another VGAM2590 host target gene. MGC26684 BINDING SITE is HOST TARGET binding site found in the 3' untranslated region of mRNA encoded by MGC26684, corresponding to a HOST TARGET binding site such as BINDING SITE I, BINDING SITE II or BINDING SITE III. Table 2 illustrates the complementarity of the nucleotide sequences of MGC26684 BINDING SITE, designated SEQ ID:29374, to the nucleotide sequence of VGAM2590 RNA, herein designated VGAM RNA, also designated SEQ ID:5301.

Another function of VGAM2590 is therefore inhibition of MGC26684 (Accession NM_144568). Accordingly, utilities of VGAM2590 include diagnosis, prevention and treatment of diseases and clinical conditions associated with MGC26684. NCUBE1 (Accession NM_016021) is another VGAM2590 host target gene. NCUBE1 BINDING SITE is HOST TARGET binding site found in the 3' untranslated region of mRNA encoded by NCUBE1, corresponding to a HOST TARGET binding site such as BINDING SITE I, BINDING SITE II or BINDING SITE III. Table 2 illustrates the complementarity of the nucleotide sequences of NCUBE1 BINDING SITE, designated SEQ ID:18095, to the nucleotide sequence of VGAM2590 RNA, herein designated VGAM RNA, also designated SEQ ID:5301.

Another function of VGAM2590 is therefore inhibition of NCUBE1 (Accession NM_016021). Accordingly, utilities of VGAM2590 include diagnosis, prevention and treatment of diseases and clinical conditions associated with NCUBE1. N-myristoyltransferase 1 (NMT1, Accession NM_021079) is another VGAM2590 host target gene. NMT1 BINDING SITE is HOST TARGET binding site found in the 3' untranslated region of mRNA encoded by NMT1, corresponding to a HOST TARGET binding site such as BINDING SITE I, BINDING SITE II or BINDING SITE III. Table 2 illustrates the complementarity of the nucleotide sequences of NMT1 BINDING SITE, designated SEQ ID:22052, to the nucleotide sequence of VGAM2590 RNA, herein designated VGAM RNA, also designated SEQ ID:5301.

Another function of VGAM2590 is therefore inhibition of N-myristoyltransferase 1 (NMT1, Accession NM_021079). Accordingly, utilities of VGAM2590 include diagnosis, prevention and treatment of diseases and clinical conditions associated with NMT1. NYD-SP11 (Accession NM_031951) is another VGAM2590 host target gene. NYD-SP11 BINDING SITE is HOST TARGET binding site found in the 3' untranslated region of mRNA encoded by NYD-SP11, corresponding to a HOST TARGET binding site such as BINDING SITE I, BINDING SITE II or BINDING SITE III. Table 2 illustrates the complementarity of the nucleotide sequences of NYD-SP11 BINDING SITE, designated SEQ ID:25689, to the nucleotide sequence of VGAM2590 RNA, herein designated VGAM RNA, also designated SEQ ID:5301.

Another function of VGAM2590 is therefore inhibition of NYD-SP11 (Accession NM_031951). Accordingly, utilities of VGAM2590 include diagnosis, prevention and treatment of diseases and clinical conditions associated with NYD-SP11. Oxysterol Binding Protein-like 3 (OSBPL3, Accession NM_015550) is another VGAM2590 host target gene. OSBPL3 BINDING SITE is HOST TARGET binding site found in the 3' untranslated region of mRNA encoded by OSBPL3, corresponding to a HOST TARGET binding site such as BINDING SITE I, BINDING SITE II or BINDING SITE III. Table 2 illustrates the complementarity of the nucleotide sequences of OSBPL3 BINDING SITE, designated SEQ ID:17817, to the nucleotide sequence of VGAM2590 RNA, herein designated VGAM RNA, also designated SEQ ID:5301.

Another function of VGAM2590 is therefore inhibition of Oxysterol Binding Protein-like 3 (OSBPL3, Accession NM_015550). Accordingly, utilities of VGAM2590 include diagnosis, prevention and treatment of diseases and clinical conditions associated with OSBPL3. POU Domain, Class 4, Transcription Factor 2 (POU4F2, Accession NM_004575) is another VGAM2590 host target gene. POU4F2 BINDING SITE is HOST TARGET binding site found in the 3' untranslated region of mRNA encoded by POU4F2, corresponding to a HOST TARGET binding site such as BINDING SITE I, BINDING SITE II or BINDING SITE III. Table 2 illustrates the complementarity of the nucleotide sequences of POU4F2 BINDING SITE, designated SEQ ID:10920, to the nucleotide sequence of VGAM2590 RNA, herein designated VGAM RNA, also designated SEQ ID:5301.

Another function of VGAM2590 is therefore inhibition of POU Domain, Class 4, Transcription Factor 2 (POU4F2, Accession NM_004575). Accordingly, utilities of VGAM2590 include diagnosis, prevention and treatment of diseases and clinical conditions associated with POU4F2. PP1665 (Accession NM_030792) is another VGAM2590 host target gene. PP1665 BINDING SITE is HOST TARGET binding site found in the 5' untranslated region of mRNA encoded by PP1665, corresponding to a HOST TARGET binding site such as BINDING SITE I, BINDING SITE II or BINDING SITE III. Table 2 illustrates the complementarity of the nucleotide sequences of PP1665 BINDING SITE, designated SEQ ID:25093, to the nucleotide sequence of VGAM2590 RNA, herein designated VGAM RNA, also designated SEQ ID:5301.

Another function of VGAM2590 is therefore inhibition of PP1665 (Accession NM_030792). Accordingly, utilities of VGAM2590 include diagnosis, prevention and treatment of diseases and clinical conditions associated with PP1665.

Syntaphilin (SNPH, Accession NM_014723) is another VGAM2590 host target gene. SNPH BINDING SITE is HOST TARGET binding site found in the 3' untranslated region of mRNA encoded by SNPH, corresponding to a HOST TARGET binding site such as BINDING SITE I, BINDING SITE II or BINDING SITE III. Table 2 illustrates the complementarity of the nucleotide sequences of SNPH BINDING SITE, designated SEQ ID:16301, to the nucleotide sequence of VGAM2590 RNA, herein designated VGAM RNA, also designated SEQ ID:5301.

Another function of VGAM2590 is therefore inhibition of Syntaphilin (SNPH, Accession NM_014723). Accordingly, utilities of VGAM2590 include diagnosis, prevention and treatment of diseases and clinical conditions associated with SNPH. Stomatin (EPB72)-like 1 (STOML1, Accession NM_004809) is another VGAM2590 host target gene. STOML1 BINDING SITE is HOST TARGET binding site found in the 3' untranslated region of mRNA encoded by STOML1, corresponding to a HOST TARGET binding site such as BINDING SITE I, BINDING SITE II or BINDING SITE III. Table 2 illustrates the complementarity of the nucleotide sequences of STOML1 BINDING SITE, designated SEQ ID:11233, to the nucleotide sequence of VGAM2590 RNA, herein designated VGAM RNA, also designated SEQ ID:5301.

Another function of VGAM2590 is therefore inhibition of Stomatin (EPB72)-like 1 (STOML1, Accession NM_004809). Accordingly, utilities of VGAM2590 include diagnosis, prevention and treatment of diseases and clinical conditions associated with STOML1. LOC124216 (Accession XM_058783) is another VGAM2590 host target gene. LOC124216 BINDING SITE is HOST TARGET binding site found in the 3' untranslated region of mRNA encoded by LOC124216, corresponding to a HOST TARGET binding site such as BINDING SITE I, BINDING SITE II or BINDING SITE III. Table 2 illustrates the complementarity of the nucleotide sequences of LOC124216 BINDING SITE, designated SEQ ID:36738, to the nucleotide sequence of VGAM2590 RNA, herein designated VGAM RNA, also designated SEQ ID:5301.

Another function of VGAM2590 is therefore inhibition of LOC124216 (Accession XM_058783). Accordingly, utilities of VGAM2590 include diagnosis, prevention and treatment of diseases and clinical conditions associated with LOC124216. LOC126302 (Accession XM_059020) is another VGAM2590 host target gene. LOC126302 BINDING SITE is HOST TARGET binding site found in the 3' untranslated region of mRNA encoded by LOC126302, corresponding to a HOST TARGET binding site such as BINDING SITE I, BINDING SITE II or BINDING SITE III. Table 2 illustrates the complementarity of the nucleotide sequences of LOC126302 BINDING SITE, designated SEQ ID:36826, to the nucleotide sequence of VGAM2590 RNA, herein designated VGAM RNA, also designated SEQ ID:5301.

Another function of VGAM2590 is therefore inhibition of LOC126302 (Accession XM_059020). Accordingly, utilities of VGAM2590 include diagnosis, prevention and treatment of diseases and clinical conditions associated with LOC126302. LOC131870 (Accession XM_059544) is another VGAM2590 host target gene. LOC131870 BINDING SITE is HOST TARGET binding site found in the 3' untranslated region of mRNA encoded by LOC131870, corresponding to a HOST TARGET binding site such as BINDING SITE I, BINDING SITE II or BINDING SITE III. Table 2 illustrates the complementarity of the nucleotide sequences of LOC131870 BINDING SITE, designated SEQ ID:37015, to the nucleotide sequence of VGAM2590 RNA, herein designated VGAM RNA, also designated SEQ ID:5301.

Another function of VGAM2590 is therefore inhibition of LOC131870 (Accession XM_059544). Accordingly, utilities of VGAM2590 include diagnosis, prevention and treatment of diseases and clinical conditions associated with LOC131870. LOC138399 (Accession XM_059971) is another VGAM2590 host target gene. LOC138399 BINDING SITE is HOST TARGET binding site found in the 5' untranslated region of mRNA encoded by LOC138399, corresponding to a HOST TARGET binding site such as BINDING SITE I, BINDING SITE II or BINDING SITE III. Table 2 illustrates the complementarity of the nucleotide sequences of LOC138399 BINDING SITE, designated SEQ ID:37130, to the nucleotide sequence of VGAM2590 RNA, herein designated VGAM RNA, also designated SEQ ID:5301.

Another function of VGAM2590 is therefore inhibition of LOC138399 (Accession XM_059971). Accordingly, utilities of VGAM2590 include diagnosis, prevention and treatment of diseases and clinical conditions associated with LOC138399. LOC145955 (Accession XM_096912) is another VGAM2590 host target gene. LOC145955 BINDING SITE is HOST TARGET binding site found in the 3' untranslated region of mRNA encoded by LOC145955, corresponding to a HOST TARGET binding site such as BINDING SITE I, BINDING SITE II or BINDING SITE III. Table 2 illustrates the complementarity of the nucleotide sequences of LOC145955 BINDING SITE, designated SEQ ID:40647, to the nucleotide sequence of VGAM2590 RNA, herein designated VGAM RNA, also designated SEQ ID:5301.

Another function of VGAM2590 is therefore inhibition of LOC145955 (Accession XM_096912). Accordingly, utilities of VGAM2590 include diagnosis, prevention and treatment of diseases and clinical conditions associated with LOC145955. LOC149464 (Accession XM_097645) is another VGAM2590 host target gene. LOC149464 BINDING SITE is HOST TARGET binding site found in the 5' untranslated region of mRNA encoded by LOC149464, corresponding to a HOST TARGET binding site such as BINDING SITE I, BINDING SITE II or BINDING SITE III. Table 2 illustrates the complementarity of the nucleotide sequences of LOC149464 BINDING SITE, designated SEQ ID:40997, to the nucleotide sequence of VGAM2590 RNA, herein designated VGAM RNA, also designated SEQ ID:5301.

Another function of VGAM2590 is therefore inhibition of LOC149464 (Accession XM_097645). Accordingly, utilities of VGAM2590 include diagnosis, prevention and treatment of diseases and clinical conditions associated with LOC149464. LOC150468 (Accession XM_086926) is another VGAM2590 host target gene. LOC150468 BINDING SITE is HOST TARGET binding site found in the 5' untranslated region of mRNA encoded by LOC150468, corresponding to a HOST TARGET binding site such as BINDING SITE I, BINDING SITE II or BINDING SITE III. Table 2 illustrates the complementarity of the nucleotide sequences of LOC150468 BINDING SITE, designated SEQ ID:38977, to the nucleotide sequence of VGAM2590 RNA, herein designated VGAM RNA, also designated SEQ ID:5301.

Another function of VGAM2590 is therefore inhibition of LOC150468 (Accession XM_086926). Accordingly, utilities of VGAM2590 include diagnosis, prevention and treatment of diseases and clinical conditions associated with LOC150468. LOC155066 (Accession XM_088142) is another VGAM2590 host target gene. LOC155066 BINDING SITE is HOST TARGET binding site found in the 3' untranslated region of mRNA encoded by LOC155066, corresponding to a HOST TARGET binding site such as BIND- ING SITE I, BINDING SITE II or BINDING SITE III. Table 2 illustrates the complementarity of the nucleotide sequences of LOC155066 BINDING SITE, designated SEQ ID:39541, to the nucleotide sequence of VGAM2590 RNA, herein designated VGAM RNA, also designated SEQ ID:5301.

Another function of VGAM2590 is therefore inhibition of LOC155066 (Accession XM_088142). Accordingly, utilities of VGAM2590 include diagnosis, prevention and treatment of diseases and clinical conditions associated with LOC155066. LOC155179 (Accession XM_088169) is another VGAM2590 host target gene. LOC155179 BINDING SITE is HOST TARGET binding site found in the 3' untranslated region of mRNA encoded by LOC155179, corresponding to a HOST TARGET binding site such as BINDING SITE I, BINDING SITE II or BINDING SITE III. Table 2 illustrates the complementarity of the nucleotide sequences of LOC155179 BINDING SITE, designated SEQ ID:39560, to the nucleotide sequence of VGAM2590 RNA, herein designated VGAM RNA, also designated SEQ ID:5301.

Another function of VGAM2590 is therefore inhibition of LOC155179 (Accession XM_088169). Accordingly, utilities of VGAM2590 include diagnosis, prevention and treatment of diseases and clinical conditions associated with LOC155179. LOC159053 (Accession XM_099021) is another VGAM2590 host target gene. LOC159053 BINDING SITE is HOST TARGET binding site found in the 3' untranslated region of mRNA encoded by LOC159053, corresponding to a HOST TARGET binding site such as BINDING SITE I, BINDING SITE II or BINDING SITE III. Table 2 illustrates the complementarity of the nucleotide sequences of LOC159053 BINDING SITE, designated SEQ ID:42061, to the nucleotide sequence of VGAM2590 RNA, herein designated VGAM RNA, also designated SEQ ID:5301.

Another function of VGAM2590 is therefore inhibition of LOC159053 (Accession XM_099021). Accordingly, utilities of VGAM2590 include diagnosis, prevention and treatment of diseases and clinical conditions associated with LOC159053. LOC201562 (Accession XM_114343) is another VGAM2590 host target gene. LOC201562 BINDING SITE is HOST TARGET binding site found in the 3' untranslated region of mRNA encoded by LOC201562, corresponding to a HOST TARGET binding site such as BINDING SITE I, BINDING SITE II or BINDING SITE III. Table 2 illustrates the complementarity of the nucleotide sequences of LOC201562 BINDING SITE, designated SEQ ID:42885, to the nucleotide sequence of VGAM2590 RNA, herein designated VGAM RNA, also designated SEQ ID:5301.

Another function of VGAM2590 is therefore inhibition of LOC201562 (Accession XM_114343). Accordingly, utilities of VGAM2590 include diagnosis, prevention and treatment of diseases and clinical conditions associated with LOC201562. LOC201771 (Accession XM_046083) is another VGAM2590 host target gene. LOC201771 BINDING SITE is HOST TARGET binding site found in the 5' untranslated region of mRNA encoded by LOC201771, corresponding to a HOST TARGET binding site such as BINDING SITE I, BINDING SITE II or BINDING SITE III. Table 2 illustrates the complementarity of the nucleotide sequences of LOC201771 BINDING SITE, designated SEQ ID:34678, to the nucleotide sequence of VGAM2590 RNA, herein designated VGAM RNA, also designated SEQ ID:5301.

Another function of VGAM2590 is therefore inhibition of LOC201771 (Accession XM_046083). Accordingly, utilities of VGAM2590 include diagnosis, prevention and treatment of diseases and clinical conditions associated with LOC201771. LOC203378 (Accession XM_117541) is another VGAM2590 host target gene. LOC203378 BINDING SITE is HOST TARGET binding site found in the 5' untranslated region of mRNA encoded by LOC203378, corresponding to a HOST TARGET binding site such as BINDING SITE I, BINDING SITE II or BINDING SITE III. Table 2 illustrates the complementarity of the nucleotide sequences of LOC203378 BINDING SITE, designated SEQ ID:43562, to the nucleotide sequence of VGAM2590 RNA, herein designated VGAM RNA, also designated SEQ ID:5301.

Another function of VGAM2590 is therefore inhibition of LOC203378 (Accession XM_117541). Accordingly, utilities of VGAM2590 include diagnosis, prevention and treatment of diseases and clinical conditions associated with LOC203378. LOC219918 (Accession XM_166197) is another VGAM2590 host target gene. LOC219918 BINDING SITE is HOST TARGET binding site found in the 5' untranslated region of mRNA encoded by LOC219918, corresponding to a HOST TARGET binding site such as BINDING SITE I, BINDING SITE II or BINDING SITE III. Table 2 illustrates the complementarity of the nucleotide sequences of LOC219918 BINDING SITE, designated SEQ ID:44003, to the nucleotide sequence of VGAM2590 RNA, herein designated VGAM RNA, also designated SEQ ID:5301.

Another function of VGAM2590 is therefore inhibition of LOC219918 (Accession XM_166197). Accordingly, utilities of VGAM2590 include diagnosis, prevention and treatment of diseases and clinical conditions associated with LOC219918. LOC220071 (Accession XM_167848) is another VGAM2590 host target gene. LOC220071 BINDING SITE is HOST TARGET binding site found in the 5' untranslated region of mRNA encoded by LOC220071, corresponding to a HOST TARGET binding site such as BINDING SITE I, BINDING SITE II or BINDING SITE III. Table 2 illustrates the complementarity of the nucleotide sequences of LOC220071 BINDING SITE, designated SEQ ID:44878, to the nucleotide sequence of VGAM2590 RNA, herein designated VGAM RNA, also designated SEQ ID:5301.

Another function of VGAM2590 is therefore inhibition of LOC220071 (Accession XM_167848). Accordingly, utilities of VGAM2590 include diagnosis, prevention and treatment of diseases and clinical conditions associated with LOC220071. LOC220988 (Accession XM_165561) is another VGAM2590 host target gene. LOC220988 BINDING SITE is HOST TARGET binding site found in the 3' untranslated region of mRNA encoded by LOC220988, corresponding to a HOST TARGET binding site such as BINDING SITE I, BINDING SITE II or BINDING SITE III. Table 2 illustrates the complementarity of the nucleotide sequences of LOC220988 BINDING SITE, designated SEQ ID:43685, to the nucleotide sequence of VGAM2590 RNA, herein designated VGAM RNA, also designated SEQ ID:5301.

Another function of VGAM2590 is therefore inhibition of LOC220988 (Accession XM_165561). Accordingly, utilities of VGAM2590 include diagnosis, prevention and treatment of diseases and clinical conditions associated with LOC220988. LOC221747 (Accession XM_166460) is another VGAM2590 host target gene. LOC221747 BINDING SITE is HOST TARGET binding site found in the 3' untranslated region of mRNA encoded by LOC221747, corresponding to a HOST TARGET binding site such as BINDING SITE I, BINDING SITE II or BINDING SITE III. Table 2 illustrates the complementarity of the nucleotide sequences of LOC221747 BINDING SITE, designated SEQ ID:44366, to the nucleotide sequence of VGAM2590 RNA, herein designated VGAM RNA, also designated SEQ ID:5301.

Another function of VGAM2590 is therefore inhibition of LOC221747 (Accession XM_166460). Accordingly, utilities of VGAM2590 include diagnosis, prevention and treatment of diseases and clinical conditions associated with LOC221747. LOC254085 (Accession XM_171189) is another VGAM2590 host target gene. LOC254085 BINDING SITE is HOST TARGET binding site found in the 5' untranslated region of mRNA encoded by LOC254085, corresponding to a HOST TARGET binding site such as BINDING SITE I, BINDING SITE II or BINDING SITE III. Table 2 illustrates the complementarity of the nucleotide sequences of LOC254085 BINDING SITE, designated SEQ ID:45974, to the nucleotide sequence of VGAM2590 RNA, herein designated VGAM RNA, also designated SEQ ID:5301.

Another function of VGAM2590 is therefore inhibition of LOC254085 (Accession XM_171189). Accordingly, utilities of VGAM2590 include diagnosis, prevention and treatment of diseases and clinical conditions associated with LOC254085. LOC256940 (Accession XM_172879) is another VGAM2590 host target gene. LOC256940 BINDING SITE is HOST TARGET binding site found in the 5' untranslated region of mRNA encoded by LOC256940, corresponding to a HOST TARGET binding site such as BINDING SITE I, BINDING SITE II or BINDING SITE III. Table 2 illustrates the complementarity of the nucleotide sequences of LOC256940 BINDING SITE, designated SEQ ID:46157, to the nucleotide sequence of VGAM2590 RNA, herein designated VGAM RNA, also designated SEQ ID:5301.

Another function of VGAM2590 is therefore inhibition of LOC256940 (Accession XM_172879). Accordingly, utilities of VGAM2590 include diagnosis, prevention and treatment of diseases and clinical conditions associated with LOC256940. LOC257471 (Accession XM_171020) is another VGAM2590 host target gene. LOC257471 BINDING SITE is HOST TARGET binding site found in the 5' untranslated region of mRNA encoded by LOC257471, corresponding to a HOST TARGET binding site such as BINDING SITE I, BINDING SITE II or BINDING SITE III. Table 2 illustrates the complementarity of the nucleotide sequences of LOC257471 BINDING SITE, designated SEQ ID:45786, to the nucleotide sequence of VGAM2590 RNA, herein designated VGAM RNA, also designated SEQ ID:5301.

Another function of VGAM2590 is therefore inhibition of LOC257471 (Accession XM_171020). Accordingly, utilities of VGAM2590 include diagnosis, prevention and treatment of diseases and clinical conditions associated with LOC257471. LOC92228 (Accession XM_043731) is another VGAM2590 host target gene. LOC92228 BINDING SITE is HOST TARGET binding site found in the 3' untranslated region of mRNA encoded by LOC92228, corresponding to a HOST TARGET binding site such as BINDING SITE I, BINDING SITE II or BINDING SITE III. Table 2 illustrates the complementarity of the nucleotide sequences of LOC92228 BINDING SITE, designated SEQ ID:34004, to the nucleotide sequence of VGAM2590 RNA, herein designated VGAM RNA, also designated SEQ ID:5301.

Another function of VGAM2590 is therefore inhibition of LOC92228 (Accession XM_043731). Accordingly, utilities of VGAM2590 include diagnosis, prevention and treatment of diseases and clinical conditions associated with LOC92228. FIG. 1 further provides a conceptual description of a novel bioinformatically detected viral gene of the present invention, referred to here as Viral Genomic Address Messenger 2591 (VGAM2591) viral gene, which modulates expression of respective host target genes thereof, the function and utility of which host target genes is known in the art.

VGAM2591 is a novel bioinformatically detected regulatory, non protein coding, viral micro RNA (miRNA) gene. The method by which VGAM2591 was detected is described hereinabove with reference to FIGS. 1-8.

VGAM2591 gene, herein designated VGAM GENE, is a viral gene contained in the genome of Apple Latent Spherical Virus. VGAM2591 host target gene, herein designated VGAM HOST TARGET GENE, is a human gene contained in the human genome.

VGAM2591 gene encodes a VGAM2591 precursor RNA, herein designated VGAM PRECURSOR RNA. Similar to other miRNA genes, and unlike most ordinary genes, VGAM2591 precursor RNA does not encode a protein. A nucleotide sequence identical or highly similar to the nucleotide sequence of VGAM2591 precursor RNA is designated SEQ ID:2577, and is provided hereinbelow with reference to the sequence listing part. Nucleotide sequence SEQ ID:2577 is located at position 6309 relative to the genome of Apple Latent Spherical Virus.

VGAM2591 precursor RNA folds onto itself, forming VGAM2591 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2591 folded precursor RNA into VGAM2591 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 62%) nucleotide sequence of VGAM2591 RNA is designated SEQ ID:5302, and is provided hereinbelow with reference to the sequence listing part.

VGAM2591 host target gene, herein designated VGAM HOST TARGET GENE, encodes a corresponding messenger RNA, VGAM2591 host target RNA, herein designated VGAM HOST TARGET RNA. VGAM2591 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2591 RNA, herein designated VGAM RNA, binds complementarily to one or more host target binding sites located in untranslated regions of VGAM2591 host target RNA, herein designated VGAM HOST TARGET RNA. This complementary binding is due to the fact that the nucleotide sequence of VGAM2591 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2591 RNA, herein designated VGAM RNA, may have a different number of host target binding sites in untranslated regions of a VGAM2591 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2591 RNA, herein designated VGAM RNA, to host target binding sites on VGAM2591 host target RNA, herein designated VGAM HOST TARGET RNA, such as BINDING SITE I, BINDING SITE II and BINDING SITE III, inhibits translation of VGAM2591 host target RNA into VGAM2591 host target protein, herein designated VGAM HOST TARGET PROTEIN. VGAM host target protein is therefore outlined by a broken line.

It is appreciated that VGAM2591 host target gene, herein designated VGAM HOST TARGET GENE, in fact represents a plurality of VGAM2591 host target genes. The mRNA of each one of this plurality of VGAM2591 host target genes comprises one or more host target binding sites, each having a nucleotide sequence which is at least partly complementary to VGAM2591 RNA, herein designated VGAM RNA, and which when bound by VGAM2591 RNA causes inhibition of translation of respective one or more VGAM2591 host target proteins.

It is further appreciated by one skilled in the art that the mode of translational inhibition illustrated by FIG. 1 with specific reference to translational inhibition exerted by VGAM2591 gene, herein designated VGAM GENE, on one or more VGAM2591 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2591 is inhibition of expression of host target genes, as part of a novel viral mechanism of attacking a host. Accordingly, utilities of VGAM2591 include diagnosis, prevention and treatment of viral infection by Apple Latent Spherical Virus. Specific functions, and accordingly utilities, of VGAM2591 correlate with, and may be deduced from, the identity of the host target genes which VGAM2591 binds and inhibits, and the function of these host target genes, as elaborated hereinbelow.

Nucleotide sequences of the VGAM2591 precursor RNA, herein designated VGAM PRECURSOR RNA, and of the 'diced' VGAM2591 RNA, herein designated VGAM RNA, and a schematic representation of the secondary folding of VGAM2591 folded precursor RNA, herein designated VGAM FOLDED PRECURSOR RNA, of VGAM2591 are further described hereinbelow with reference to Table 1.

Nucleotide sequences of host target binding sites, such as BINDING SITE-I, BINDING SITE-II and BINDING SITE-III of FIG. 1, found on VGAM2591 host target RNA, and schematic representation of the complementarity of each of these host target binding sites to VGAM2591 RNA, herein designated VGAM RNA, are described hereinbelow with reference to Table 2.

As mentioned hereinabove with reference to FIG. 1, a function of VGAM2591 gene, herein designated VGAM is inhibition of expression of VGAM2591 target genes. It is appreciated that specific functions, and accordingly utilities, of VGAM2591 correlate with, and may be deduced from, the identity of the target genes which VGAM2591 binds and inhibits, and the function of these target genes, as elaborated hereinbelow.

Sorting Nexin 6 (SNX6, Accession NM_021249) is a VGAM2591 host target gene. SNX6 BINDING SITE is HOST TARGET binding site found in the 3' untranslated region of mRNA encoded by SNX6, corresponding to a HOST TARGET binding site such as BINDING SITE I, BINDING SITE II or BINDING SITE III. Table 2 illustrates the complementarity of the nucleotide sequences of SNX6 BINDING SITE, designated SEQ ID:22217, to the nucleotide sequence of VGAM2591 RNA, herein designated VGAM RNA, also designated SEQ ID:5302.

A function of VGAM2591 is therefore inhibition of Sorting Nexin 6 (SNX6, Accession NM_021249). Accordingly, utilities of VGAM2591 include diagnosis, prevention and treatment of diseases and clinical conditions associated with SNX6. FLJ12287 (Accession NM_022367) is another VGAM2591 host target gene. FLJ12287 BINDING SITE is HOST TARGET binding site found in the 3' untranslated region of mRNA encoded by FLJ12287, corresponding to a HOST TARGET binding site such as BINDING SITE I, BINDING SITE II or BINDING SITE III. Table 2 illustrates the complementarity of the nucleotide sequences of FLJ12287 BINDING SITE, designated SEQ ID:22752, to the nucleotide sequence of VGAM2591 RNA, herein designated VGAM RNA, also designated SEQ ID:5302.

Another function of VGAM2591 is therefore inhibition of FLJ12287 (Accession NM_022367). Accordingly, utilities of VGAM2591 include diagnosis, prevention and treatment of diseases and clinical conditions associated with FLJ12287. Wingless-type MMTV Integration Site Family, Member 2B (WNT2B, Accession NM_004185) is another VGAM2591 host target gene. WNT2B BINDING SITE1 and WNT2B BINDING SITE2 are HOST TARGET binding sites found in untranslated regions of mRNA encoded by WNT2B, corresponding to HOST TARGET binding sites such as BINDING SITE I, BINDING SITE II or BINDING SITE III. Table 2 illustrates the complementarity of the nucleotide sequences of WNT2B BINDING SITE1 and WNT2B BINDING SITE2, designated SEQ ID:10391 and SEQ ID:23692 respectively, to the nucleotide sequence of VGAM2591 RNA, herein designated VGAM RNA, also designated SEQ ID:5302.

Another function of VGAM2591 is therefore inhibition of Wingless-type MMTV Integration Site Family, Member 2B (WNT2B, Accession NM_004185). Accordingly, utilities of VGAM2591 include diagnosis, prevention and treatment of diseases and clinical conditions associated with WNT2B. LOC220776 (Accession XM_043388) is another VGAM2591 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33927, to the nucleotide sequence of VGAM2591 RNA, herein designated VGAM RNA, also designated SEQ ID:5302.

Another function of VGAM2591 is therefore inhibition of LOC220776 (Accession XM_043388). Accordingly, utilities of VGAM2591 include diagnosis, prevention and treatment of diseases and clinical conditions associated with LOC220776. LOC253936 (Accession XM_170637) is another VGAM2591 host target gene. LOC253936 BINDING SITE is HOST TARGET binding site found in the 3' untranslated region of mRNA encoded by LOC253936, corresponding to a HOST TARGET binding site such as BINDING SITE I, BINDING SITE II or BINDING SITE III. Table 2 illustrates the complementarity of the nucleotide sequences of LOC253936 BINDING SITE, designated SEQ ID:45407, to the nucleotide sequence of VGAM2591 RNA, herein designated VGAM RNA, also designated SEQ ID:5302.

Another function of VGAM2591 is therefore inhibition of LOC253936 (Accession XM_170637). Accordingly, utilities of VGAM2591 include diagnosis, prevention and treatment of diseases and clinical conditions associated with LOC253936. LOC91138 (Accession XM_036406) is another VGAM2591 host target gene. LOC91138 BINDING SITE is HOST TARGET binding site found in the 5' untranslated region of mRNA encoded by LOC91138, corresponding to a HOST TARGET binding site such as BINDING SITE I, BINDING SITE II or BINDING SITE III. Table 2 illustrates the complementarity of the nucleotide sequences of LOC91138 BINDING SITE, designated SEQ ID:32438, to the nucleotide sequence of VGAM2591 RNA, herein designated VGAM RNA, also designated SEQ ID:5302.

Another function of VGAM2591 is therefore inhibition of LOC91138 (Accession XM_036406). Accordingly, utilities of VGAM2591 include diagnosis, prevention and treatment of diseases and clinical conditions associated with LOC91138. FIG. 1 further provides a conceptual description of a novel bioinformatically detected viral gene of the present invention, referred to here as Viral Genomic Address Messenger 2592 (VGAM2592) viral gene, which modulates expression of respective host target genes thereof, the function and utility of which host target genes is known in the art.

VGAM2592 is a novel bioinformatically detected regulatory, non protein coding, viral micro RNA (miRNA) gene. The method by which VGAM2592 was detected is described hereinabove with reference to FIGS. 1-8.

VGAM2592 gene, herein designated VGAM GENE, is a viral gene contained in the genome of Apple Latent Spherical Virus. VGAM2592 host target gene, herein designated VGAM HOST TARGET GENE, is a human gene contained in the human genome.

VGAM2592 gene encodes a VGAM2592 precursor RNA, herein designated VGAM PRECURSOR RNA. Similar to other miRNA genes, and unlike most ordinary genes, VGAM2592 precursor RNA does not encode a protein. A nucleotide sequence identical or highly similar to the nucleotide sequence of VGAM2592 precursor RNA is designated SEQ ID:2578, and is provided hereinbelow with reference to the sequence listing part. Nucleotide sequence SEQ ID:2578 is located at position 1588 relative to the genome of Apple Latent Spherical Virus.

VGAM2592 precursor RNA folds onto itself, forming VGAM2592 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2592 folded precursor RNA into VGAM2592 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2592 RNA is designated SEQ ID:5303, and is provided hereinbelow with reference to the sequence listing part.

VGAM2592 host target gene, herein designated VGAM HOST TARGET GENE, encodes a corresponding messenger RNA, VGAM2592 host target RNA, herein designated VGAM HOST TARGET RNA. VGAM2592 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2592 RNA, herein designated VGAM RNA, binds complementarily to one or more host target binding sites located in untranslated regions of VGAM2592 host target RNA, herein designated VGAM HOST TARGET RNA. This complementary binding is due to the fact that the nucleotide sequence of VGAM2592 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2592 RNA, herein designated VGAM RNA, may have a different number of host target binding sites in untranslated regions of a VGAM2592 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2592 RNA, herein designated VGAM RNA, to host target binding sites on VGAM2592 host target RNA, herein designated VGAM HOST TARGET RNA, such as BINDING SITE I, BINDING SITE II and BINDING SITE III, inhibits translation of VGAM2592 host target RNA into VGAM2592 host target protein, herein designated VGAM HOST TARGET PROTEIN. VGAM host target protein is therefore outlined by a broken line.

It is appreciated that VGAM2592 host target gene, herein designated VGAM HOST TARGET GENE, in fact represents a plurality of VGAM2592 host target genes. The mRNA of each one of this plurality of VGAM2592 host target genes comprises one or more host target binding sites, each having a nucleotide sequence which is at least partly complementary to VGAM2592 RNA, herein designated VGAM RNA, and which when bound by VGAM2592 RNA causes inhibition of translation of respective one or more VGAM2592 host target proteins.

It is further appreciated by one skilled in the art that the mode of translational inhibition illustrated by FIG. 1 with specific reference to translational inhibition exerted by VGAM2592 gene, herein designated VGAM GENE, on one or more VGAM2592 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2592 is inhibition of expression of host target genes, as part of a novel viral mechanism of attacking a host. Accordingly, utilities of VGAM2592 include diagnosis, prevention and treatment of viral infection by Apple Latent Spherical Virus. Specific functions, and accordingly utilities, of VGAM2592 correlate with, and may be deduced from, the identity of the host target genes which VGAM2592 binds and inhibits, and the function of these host target genes, as elaborated hereinbelow.

Nucleotide sequences of the VGAM2592 precursor RNA, herein designated VGAM PRECURSOR RNA, and of the 'diced' VGAM2592 RNA, herein designated VGAM RNA, and a schematic representation of the secondary folding of VGAM2592 folded precursor RNA, herein designated VGAM FOLDED PRECURSOR RNA, of VGAM2592 are further described hereinbelow with reference to Table 1.

Nucleotide sequences of host target binding sites, such as BINDING SITE-I, BINDING SITE-II and BINDING SITE-III of FIG. 1, found on VGAM2592 host target RNA, and schematic representation of the complementarity of each of these host target binding sites to VGAM2592 RNA, herein designated VGAM RNA, are described hereinbelow with reference to Table 2.

As mentioned hereinabove with reference to FIG. 1, a function of VGAM2592 gene, herein designated VGAM is inhibition of expression of VGAM2592 target genes. It is appreciated that specific functions, and accordingly utilities, of VGAM2592 correlate with, and may be deduced from, the identity of the target genes which VGAM2592 binds and inhibits, and the function of these target genes, as elaborated hereinbelow.

MIG (Accession NM_002416) is a VGAM2592 host target gene. MIG BINDING SITE is HOST TARGET binding site found in the 3' untranslated region of mRNA encoded by MIG, corresponding to a HOST TARGET binding site such as BINDING SITE I, BINDING SITE II or BINDING SITE III. Table 2 illustrates the complementarity of the nucleotide sequences of MIG BINDING SITE, designated SEQ ID:8243, to the nucleotide sequence of VGAM2592 RNA, herein designated VGAM RNA, also designated SEQ ID:5303.

A function of VGAM2592 is therefore inhibition of MIG (Accession NM_002416). Accordingly, utilities of VGAM2592 include diagnosis, prevention and treatment of diseases and clinical conditions associated with MIG. PRO1596 (Accession NM_031270) is another VGAM2592 host target gene. PRO1596 BINDING SITE is HOST TARGET binding site found in the 3" untranslated region of mRNA encoded by PRO1596, corresponding to a HOST TARGET binding site such as BINDING SITE I, BINDING SITE II or BINDING SITE III. Table 2 illustrates the complementarity of the nucleotide sequences of PRO1596 BINDING SITE, designated SEQ ID:25294, to the nucleotide sequence of VGAM2592 RNA, herein designated VGAM RNA, also designated SEQ ID:5303.

Another function of VGAM2592 is therefore inhibition of PRO1596 (Accession NM_031270). Accordingly, utilities of VGAM2592 include diagnosis, prevention and treatment of diseases and clinical conditions associated with PRO1596. LOC256073 (Accession XM_172972) is another VGAM2592 host target gene. LOC256073 BINDING SITE is HOST TARGET binding site found in the 3' untranslated region of mRNA encoded by LOC256073, corresponding to a HOST TARGET binding site such as BINDING SITE I, BINDING SITE II or BINDING SITE III. Table 2 illustrates the complementarity of the nucleotide sequences of LOC256073 BINDING SITE, designated SEQ ID:46229, to the nucleotide sequence of VGAM2592 RNA, herein designated VGAM RNA, also designated SEQ ID:5303.

Another function of VGAM2592 is therefore inhibition of LOC256073 (Accession XM_172972). Accordingly, utilities of VGAM2592 include diagnosis, prevention and treatment of diseases and clinical conditions associated with LOC256073. FIG. 1 further provides a conceptual description of a novel bioinformatically detected viral gene of the present invention, referred to here as Viral Genomic Address Messenger 2593 (VGAM2593) viral gene, which modulates expression of respective host target genes thereof, the function and utility of which host target genes is known in the art.

VGAM2593 is a novel bioinformatically detected regulatory, non protein coding, viral micro RNA (miRNA) gene. The method by which VGAM2593 was detected is described hereinabove with reference to FIGS. 1-8.

VGAM2593 gene, herein designated VGAM GENE, is a viral gene contained in the genome of Apple Latent Spherical Virus. VGAM2593 host target gene, herein designated VGAM HOST TARGET GENE, is a human gene contained in the human genome.

VGAM2593 gene encodes a VGAM2593 precursor RNA, herein designated VGAM PRECURSOR RNA. Similar to other miRNA genes, and unlike most ordinary genes, VGAM2593 precursor RNA does not encode a protein. A nucleotide sequence identical or highly similar to the nucleotide sequence of VGAM2593 precursor RNA is designated SEQ ID:2579, and is provided hereinbelow with reference to the sequence listing part. Nucleotide sequence SEQ ID:2579 is located at position 5091 relative to the genome of Apple Latent Spherical Virus.

VGAM2593 precursor RNA folds onto itself, forming VGAM2593 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2593 folded precursor RNA into VGAM2593 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 71%) nucleotide sequence of VGAM2593 RNA is designated SEQ ID:5304, and is provided hereinbelow with reference to the sequence listing part.

VGAM2593 host target gene, herein designated VGAM HOST TARGET GENE, encodes a corresponding messenger RNA, VGAM2593 host target RNA, herein designated VGAM HOST TARGET RNA. VGAM2593 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2593 RNA, herein designated VGAM RNA, binds complementarily to one or more host target binding sites located in untranslated regions of VGAM2593 host target RNA, herein designated VGAM HOST TARGET RNA. This complementary binding is due to the fact that the nucleotide sequence of VGAM2593 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2593 RNA, herein designated VGAM RNA, may have a different number of host target binding sites in untranslated regions of a VGAM2593 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2593 RNA, herein designated VGAM RNA, to host target binding sites on VGAM2593 host target RNA, herein designated VGAM HOST TARGET RNA, such as BINDING SITE I, BINDING SITE II and BINDING SITE III, inhibits translation of VGAM2593 host target RNA into VGAM2593 host target protein, herein designated VGAM HOST TARGET PROTEIN. VGAM host target protein is therefore outlined by a broken line.

It is appreciated that VGAM2593 host target gene, herein designated VGAM HOST TARGET GENE, in fact represents a plurality of VGAM2593 host target genes. The mRNA of each one of this plurality of VGAM2593 host target genes comprises one or more host target binding sites, each having a nucleotide sequence which is at least partly complementary to VGAM2593 RNA, herein designated VGAM RNA, and which when bound by VGAM2593 RNA causes inhibition of translation of respective one or more VGAM2593 host target proteins.

It is further appreciated by one skilled in the art that the mode of translational inhibition illustrated by FIG. 1 with specific reference to translational inhibition exerted by VGAM2593 gene, herein designated VGAM GENE, on one or more VGAM2593 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2593 is inhibition of expression of host target genes, as part of a novel viral mechanism of attacking a host. Accordingly, utilities of VGAM2593 include diagnosis, prevention and treatment of viral infection by Apple Latent Spherical Virus. Specific functions, and accordingly utilities, of VGAM2593 correlate with, and may be deduced from, the identity of the host target genes which VGAM2593 binds and inhibits, and the function of these host target genes, as elaborated hereinbelow.

Nucleotide sequences of the VGAM2593 precursor RNA, herein designated VGAM PRECURSOR RNA, and of the 'diced' VGAM2593 RNA, herein designated VGAM RNA, and a schematic representation of the secondary folding of VGAM2593 folded precursor RNA, herein designated VGAM FOLDED PRECURSOR RNA, of VGAM2593 are further described hereinbelow with reference to Table 1.

Nucleotide sequences of host target binding sites, such as BINDING SITE-I, BINDING SITE-II and BINDING SITE-III of FIG. 1, found on VGAM2593 host target RNA, and schematic representation of the complementarity of each of these host target binding sites to VGAM2593 RNA, herein designated VGAM RNA, are described hereinbelow with reference to Table 2.

As mentioned hereinabove with reference to FIG. 1, a function of VGAM2593 gene, herein designated VGAM is inhibition of expression of VGAM2593 target genes. It is appreciated that specific functions, and accordingly utilities, of VGAM2593 correlate with, and may be deduced from, the identity of the target genes which VGAM2593 binds and inhibits, and the function of these target genes, as elaborated hereinbelow.

Sirtuin Silent Mating Type Information Regulation 2 Homolog 1 (S. cerevisiae) (SIRT1, Accession NM_012238) is a VGAM2593 host target gene. SIRT1 BINDING SITE is HOST TARGET binding site found in the 3' untranslated region of mRNA encoded by SIRT1, corresponding to a HOST TARGET binding site such as BINDING SITE I, BINDING SITE II or BINDING SITE III. Table 2 illustrates the complementarity of the nucleotide sequences of SIRT1 BINDING SITE, designated SEQ ID:14542, to the nucleotide sequence of VGAM2593 RNA, herein designated VGAM RNA, also designated SEQ ID:5304.

A function of VGAM2593 is therefore inhibition of Sirtuin Silent Mating Type Information Regulation 2 Homolog 1 (S. cerevisiae) (SIRT1, Accession NM_012238), a gene which may function as intracellular regulatory protein with mono-ADP-ribosyltransferase activity. Accordingly, utilities of VGAM2593 include diagnosis, prevention and treatment of diseases and clinical conditions associated with SIRT1. The function of SIRT1 and its association with various diseases and clinical conditions, has been established by previous studies, as described hereinabove with reference to VGAM244. FLJ20725 (Accession NM_017943) is another VGAM2593 host target gene. FLJ20725 BINDING SITE is HOST TARGET binding site found in the 3' untranslated region of mRNA encoded by FLJ20725, corresponding to a HOST TARGET binding site such as BINDING SITE I, BINDING SITE II or BINDING SITE III. Table 2 illustrates the complementarity of the nucleotide sequences of FLJ20725 BINDING SITE, designated SEQ ID:19636, to the nucleotide sequence of VGAM2593 RNA, herein designated VGAM RNA, also designated SEQ ID:5304.

Another function of VGAM2593 is therefore inhibition of FLJ20725 (Accession NM_017943). Accordingly, utilities of VGAM2593 include diagnosis, prevention and treatment of diseases and clinical conditions associated with FLJ20725. LOC122773 (Accession XM_058665) is another VGAM2593 host target gene. LOC122773 BINDING SITE is HOST TARGET binding site found in the 3' untranslated region of mRNA encoded by LOC122773, corresponding to a HOST TARGET binding site such as BINDING SITE I, BINDING SITE II or BINDING SITE III. Table 2 illustrates the complementarity of the nucleotide sequences of LOC122773 BINDING SITE, designated SEQ ID:36710, to the nucleotide sequence of VGAM2593 RNA, herein designated VGAM RNA, also designated SEQ ID:5304.

Another function of VGAM2593 is therefore inhibition of LOC122773 (Accession XM_058665). Accordingly, utilities of VGAM2593 include diagnosis, prevention and treatment of diseases and clinical conditions associated with LOC122773. LOC152200 (Accession XM_098174) is another VGAM2593 host target gene. LOC152200 BINDING SITE is HOST TARGET binding site found in the 3' untranslated region of mRNA encoded by LOC152200, corresponding to a HOST TARGET binding site such as BINDING SITE I, BINDING SITE II or BINDING SITE III. Table 2 illustrates the complementarity of the nucleotide sequences of LOC152200 BINDING SITE, designated SEQ ID:41437, to the nucleotide sequence of VGAM2593 RNA, herein designated VGAM RNA, also designated SEQ ID:5304.

Another function of VGAM2593 is therefore inhibition of LOC152200 (Accession XM_098174). Accordingly, utilities of VGAM2593 include diagnosis, prevention and treatment of diseases and clinical conditions associated with LOC152200. LOC221931 (Accession XM_168348) is another VGAM2593 host target gene. LOC221931 BINDING SITE is HOST TARGET binding site found in the 3' untranslated region of mRNA encoded by LOC221931, corresponding to a HOST TARGET binding site such as BINDING SITE I, BINDING SITE II or BINDING SITE III. Table 2 illustrates the complementarity of the nucleotide sequences of LOC221931 BINDING SITE, designated SEQ ID:45118, to the nucleotide sequence of VGAM2593 RNA, herein designated VGAM RNA, also designated SEQ ID:5304.

Another function of VGAM2593 is therefore inhibition of LOC221931 (Accession XM_168348). Accordingly, utilities of VGAM2593 include diagnosis, prevention and treatment of diseases and clinical conditions associated with LOC221931. LOC91947 (Accession XM_041721) is another VGAM2593 host target gene. LOC91947 BINDING SITE is HOST TARGET binding site found in the 3' untranslated region of mRNA encoded by LOC91947, corresponding to a HOST TARGET binding site such as BINDING SITE I, BINDING SITE II or BINDING SITE III. Table 2 illustrates the complementarity of the nucleotide sequences of LOC91947 BINDING SITE, designated SEQ ID:33568, to the nucleotide sequence of VGAM2593 RNA, herein designated VGAM RNA, also designated SEQ ID:5304.

Another function of VGAM2593 is therefore inhibition of LOC91947 (Accession XM_041721). Accordingly, utilities of VGAM2593 include diagnosis, prevention and treatment of diseases and clinical conditions associated with LOC91947. FIG. 1 further provides a conceptual description of a novel bioinformatically detected viral gene of the present invention, referred to here as Viral Genomic Address Messenger 2594 (VGAM2594) viral gene, which modulates expression of respective host target genes thereof, the function and utility of which host target genes is known in the art.

VGAM2594 is a novel bioinformatically detected regulatory, non protein coding, viral micro RNA (miRNA) gene. The method by which VGAM2594 was detected is described hereinabove with reference to FIGS. 1-8.

VGAM2594 gene, herein designated VGAM GENE, is a viral gene contained in the genome of Apple Latent Spherical Virus. VGAM2594 host target gene, herein designated VGAM HOST TARGET GENE, is a human gene contained in the human genome.

VGAM2594 gene encodes a VGAM2594 precursor RNA, herein designated VGAM PRECURSOR RNA. Similar to other miRNA genes, and unlike most ordinary genes, VGAM2594 precursor RNA does not encode a protein. A nucleotide sequence identical or highly similar to the nucleotide sequence of VGAM2594 precursor RNA is designated SEQ ID:2580, and is provided hereinbelow with reference to the sequence listing part. Nucleotide sequence SEQ ID:2580 is located at position 1452 relative to the genome of Apple Latent Spherical Virus.

VGAM2594 precursor RNA folds onto itself, forming VGAM2594 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2594 folded precursor RNA into VGAM2594 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2594 RNA is designated SEQ ID:5305, and is provided hereinbelow with reference to the sequence listing part.

VGAM2594 host target gene, herein designated VGAM HOST TARGET GENE, encodes a corresponding messenger RNA, VGAM2594 host target RNA, herein designated VGAM HOST TARGET RNA. VGAM2594 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2594 RNA, herein designated VGAM RNA, binds complementarily to one or more host target binding sites located in untranslated regions of VGAM2594 host target RNA, herein designated VGAM HOST TARGET RNA. This complementary binding is due to the fact that the nucleotide sequence of VGAM2594 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2594 RNA, herein designated VGAM RNA, may have a different number of host target binding sites in untranslated regions of a VGAM2594 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2594 RNA, herein designated VGAM RNA, to host target binding sites on VGAM2594 host target RNA, herein designated VGAM HOST TARGET RNA, such as BINDING SITE I, BINDING SITE II and BINDING SITE III, inhibits translation of VGAM2594 host target RNA into VGAM2594 host target protein, herein designated VGAM HOST TARGET PROTEIN. VGAM host target protein is therefore outlined by a broken line.

It is appreciated that VGAM2594 host target gene, herein designated VGAM HOST TARGET GENE, in fact represents a plurality of VGAM2594 host target genes. The mRNA of each one of this plurality of VGAM2594 host target genes comprises one or more host target binding sites, each having a nucleotide sequence which is at least partly complementary to VGAM2594 RNA, herein designated VGAM RNA, and which when bound by VGAM2594 RNA causes inhibition of translation of respective one or more VGAM2594 host target proteins.

It is further appreciated by one skilled in the art that the mode of translational inhibition illustrated by FIG. 1 with specific reference to translational inhibition exerted by VGAM2594 gene, herein designated VGAM GENE, on one or more VGAM2594 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2594 is inhibition of expression of host target genes, as part of a novel viral mechanism of attacking a host. Accordingly, utilities of VGAM2594 include diagnosis, prevention and treatment of viral infection by Apple Latent Spherical Virus. Specific functions, and accordingly utilities, of VGAM2594 correlate with, and may be deduced from, the identity of the host target genes which VGAM2594 binds and inhibits, and the function of these host target genes, as elaborated hereinbelow.

Nucleotide sequences of the VGAM2594 precursor RNA, herein designated VGAM PRECURSOR RNA, and of the 'diced' VGAM2594 RNA, herein designated VGAM RNA, and a schematic representation of the secondary folding of VGAM2594 folded precursor RNA, herein designated VGAM FOLDED PRECURSOR RNA, of VGAM2594 are further described hereinbelow with reference to Table 1.

Nucleotide sequences of host target binding sites, such as BINDING SITE-I, BINDING SITE-II and BINDING SITE-III of FIG. 1, found on VGAM2594 host target RNA, and schematic representation of the complementarity of each of these host target binding sites to VGAM2594 RNA, herein designated VGAM RNA, are described hereinbelow with reference to Table 2.

As mentioned hereinabove with reference to FIG. 1, a function of VGAM2594 gene, herein designated VGAM is inhibition of expression of VGAM2594 target genes. It is appreciated that specific functions, and accordingly utilities, of VGAM2594 correlate with, and may be deduced from, the identity of the target genes which VGAM2594 binds and inhibits, and the function of these target genes, as elaborated hereinbelow.

Diphtheria Toxin Receptor (heparin-binding epidermal growth factor-like growth factor) (DTR, Accession NM_001945) is a VGAM2594 host target gene. DTR BINDING SITE is HOST TARGET binding site found in the 3' untranslated region of mRNA encoded by DTR, corresponding to a HOST TARGET binding site such as BINDING SITE I, BINDING SITE II or BINDING SITE III. Table 2 illustrates the complementarity of the nucleotide sequences of DTR BINDING SITE, designated SEQ ID:7658, to the nucleotide sequence of VGAM2594 RNA, herein designated VGAM RNA, also designated SEQ ID:5305.

A function of VGAM2594 is therefore inhibition of Diphtheria Toxin Receptor (heparin-binding epidermal growth factor-like growth factor) (DTR, Accession NM_001945), a gene which may be involved in macrophage-mediated cellular proliferation. Accordingly, utilities of VGAM2594 include diagnosis, prevention and treatment of diseases and clinical conditions associated with DTR. The function of DTR and its association with various diseases and clinical conditions, has been established by previous studies, as described hereinabove with reference to VGAM242. Holocarboxylase Synthetase (biotin-[proprionyl-Coenzyme A-carboxylase (ATP-hydrolysing)] Ligase) (HLCS, Accession NM_000411) is another VGAM2594 host target gene. HLCS BINDING SITE is HOST TARGET binding site found in the 3' untranslated region of mRNA encoded by HLCS, corresponding to a HOST TARGET binding site such as BINDING SITE I, BINDING SITE II or BINDING SITE III. Table 2 illustrates the complementarity of the nucleotide sequences of HLCS BINDING SITE, designated SEQ ID:5994, to the nucleotide sequence of VGAM2594 RNA, herein designated VGAM RNA, also designated SEQ ID:5305.

Another function of VGAM2594 is therefore inhibition of Holocarboxylase Synthetase (biotin-[proprionyl-Coenzyme A-carboxylase (ATP-hydrolysing)] Ligase) (HLCS, Accession NM_000411). Accordingly, utilities of VGAM2594 include diagnosis, prevention and treatment of diseases and clinical conditions associated with HLCS. NORE1 (Accession NM_031437) is another VGAM2594 host target gene. NORE1 BINDING SITE is HOST TARGET binding site found in the 3' untranslated region of mRNA encoded by NORE1, corresponding to a HOST TARGET binding site such as BINDING SITE I, BINDING SITE II or BINDING SITE III. Table 2 illustrates the complementarity of the nucleotide sequences of NORE1 BINDING SITE, designated SEQ ID:25440, to the nucleotide sequence of VGAM2594 RNA, herein designated VGAM RNA, also designated SEQ ID:5305.

Another function of VGAM2594 is therefore inhibition of NORE1 (Accession NM_031437), a gene which may modulate intracellular signal transduction pathways. Accordingly, utilities of VGAM2594 include diagnosis, prevention and treatment of diseases and clinical conditions associated with NORE1. The function of NORE1 and its association with various diseases and clinical conditions, has been established by previous studies, as described hereinabove with reference to VGAM276. AUT-like 1, Cysteine Endopeptidase (S. cerevisiae) (AUTL1, Accession NM_032852) is another VGAM2594 host target gene. AUTL1 BINDING SITE is HOST TARGET binding site found in the 3' untranslated region of mRNA encoded by AUTL1, corresponding to a HOST TARGET binding site such as BINDING SITE I, BINDING SITE II or BINDING SITE III. Table 2 illustrates the complementarity of the nucleotide sequences of AUTL1 BINDING SITE, designated SEQ ID:26646, to the nucleotide sequence of VGAM2594 RNA, herein designated VGAM RNA, also designated SEQ ID:5305.

Another function of VGAM2594 is therefore inhibition of AUT-like 1, Cysteine Endopeptidase (S. cerevisiae) (AUTL1, Accession NM_032852). Accordingly, utilities of VGAM2594 include diagnosis, prevention and treatment of diseases and clinical conditions associated with AUTL1. KIAA1143 (Accession XM_044014) is another VGAM2594 host target gene. KIAA1143 BINDING SITE is HOST TARGET binding site found in the 3' untranslated region of mRNA encoded by KIAA1143, corresponding to a HOST TARGET binding site such as BINDING SITE I, BINDING SITE II or BINDING SITE III. Table 2 illustrates the complementarity of the nucleotide sequences of KIAA1143 BINDING SITE, designated SEQ ID:34068, to the nucleotide sequence of VGAM2594 RNA, herein designated VGAM RNA, also designated SEQ ID:5305.

Another function of VGAM2594 is therefore inhibition of KIAA1143 (Accession XM_044014). Accordingly, utilities of VGAM2594 include diagnosis, prevention and treatment of diseases and clinical conditions associated with KIAA1143. FIG. 1 further provides a conceptual description of a novel bioinformatically detected viral gene of the present invention, referred to here as Viral Genomic Address Messenger 2595 (VGAM2595) viral gene, which modulates expression of respective host target genes thereof, the function and utility of which host target genes is known in the art.

VGAM2595 is a novel bioinformatically detected regulatory, non protein coding, viral micro RNA (miRNA) gene. The method by which VGAM2595 was detected is described hereinabove with reference to FIGS. 1-8.

VGAM2595 gene, herein designated VGAM GENE, is a viral gene contained in the genome of Apple Latent Spherical Virus. VGAM2595 host target gene, herein designated VGAM HOST TARGET GENE, is a human gene contained in the human genome.

VGAM2595 gene encodes a VGAM2595 precursor RNA, herein designated VGAM PRECURSOR RNA. Similar to other miRNA genes, and unlike most ordinary genes, VGAM2595 precursor RNA does not encode a protein. A nucleotide sequence identical or highly similar to the nucleotide sequence of VGAM2595 precursor RNA is designated SEQ ID:2581, and is provided hereinbelow with reference to the sequence listing part. Nucleotide sequence SEQ ID:2581 is located at position 6486 relative to the genome of Apple Latent Spherical Virus.

VGAM2595 precursor RNA folds onto itself, forming VGAM2595 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2595 folded precursor RNA into VGAM2595 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM2595 RNA is designated SEQ ID:5306, and is provided hereinbelow with reference to the sequence listing part.

VGAM2595 host target gene, herein designated VGAM HOST TARGET GENE, encodes a corresponding messenger RNA, VGAM2595 host target RNA, herein designated VGAM HOST TARGET RNA. VGAM2595 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2595 RNA, herein designated VGAM RNA, binds complementarily to one or more host target binding sites located in untranslated regions of VGAM2595 host target RNA, herein designated VGAM HOST TARGET RNA. This complementary binding is due to the fact that the nucleotide sequence of VGAM2595 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2595 RNA, herein designated VGAM RNA, may have a different number of host target binding sites in untranslated regions of a VGAM2595 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2595 RNA, herein designated VGAM RNA, to host target binding sites on VGAM2595 host target RNA, herein designated VGAM HOST TARGET RNA, such as BINDING SITE I, BINDING SITE II and BINDING SITE III, inhibits translation of VGAM2595 host target RNA into VGAM2595 host target protein, herein designated VGAM HOST TARGET PROTEIN. VGAM host target protein is therefore outlined by a broken line.

It is appreciated that VGAM2595 host target gene, herein designated VGAM HOST TARGET GENE, in fact represents a plurality of VGAM2595 host target genes. The mRNA of each one of this plurality of VGAM2595 host target genes comprises one or more host target binding sites, each having a nucleotide sequence which is at least partly complementary to VGAM2595 RNA, herein designated VGAM RNA, and which when bound by VGAM2595 RNA causes inhibition of translation of respective one or more VGAM2595 host target proteins.

It is further appreciated by one skilled in the art that the mode of translational inhibition illustrated by FIG. 1 with specific reference to translational inhibition exerted by VGAM2595 gene, herein designated VGAM GENE, on one or more VGAM2595 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2595 is inhibition of expression of host target genes, as part of a novel viral mechanism of attacking a host. Accordingly, utilities of VGAM2595 include diagnosis, prevention and treatment of viral infection by Apple Latent Spherical Virus. Specific functions, and accordingly utilities, of VGAM2595 correlate with, and may be deduced from, the identity of the host target genes which VGAM2595 binds and inhibits, and the function of these host target genes, as elaborated hereinbelow.

Nucleotide sequences of the VGAM2595 precursor RNA, herein designated VGAM PRECURSOR RNA, and of the 'diced' VGAM2595 RNA, herein designated VGAM RNA, and a schematic representation of the secondary folding of VGAM2595 folded precursor RNA, herein designated VGAM FOLDED PRECURSOR RNA, of VGAM2595 are further described hereinbelow with reference to Table 1.

Nucleotide sequences of host target binding sites, such as BINDING SITE-I, BINDING SITE-II and BINDING SITE-III of FIG. 1, found on VGAM2595 host target RNA, and schematic representation of the complementarity of each of these host target binding sites to VGAM2595 RNA, herein designated VGAM RNA, are described hereinbelow with reference to Table 2.

As mentioned hereinabove with reference to FIG. 1, a function of VGAM2595 gene, herein designated VGAM is inhibition of expression of VGAM2595 target genes. It is appreciated that specific functions, and accordingly utilities, of VGAM2595 correlate with, and may be deduced from, the identity of the target genes which VGAM2595 binds and inhibits, and the function of these target genes, as elaborated hereinbelow.

Mastermind-like 1 (Drosophila) (MAML1, Accession NM_014757) is a VGAM2595 host target gene. MAML1 BINDING SITE is HOST TARGET binding site found in the 3' untranslated region of mRNA encoded by MAML1, corresponding to a HOST TARGET binding site such as BINDING SITE I, BINDING SITE II or BINDING SITE III. Table 2 illustrates the complementarity of the nucleotide sequences of MAML1 BINDING SITE, designated SEQ ID:16495, to the nucleotide sequence of VGAM2595 RNA, herein designated VGAM RNA, also designated SEQ ID:5306.

A function of VGAM2595 is therefore inhibition of Mastermind-like 1 (Drosophila) (MAML1, Accession NM_014757), a gene which MAML1 functions as a transcriptional coactivator for Notch signaling. Accordingly, utilities of VGAM2595 include diagnosis, prevention and treatment of diseases and clinical conditions associated with MAML1. The function of MAML1 and its association with various diseases and clinical conditions, has been established by previous studies, as described hereinabove with reference to VGAM556. AWP1 (Accession NM_019006) is another VGAM2595 host target gene. AWP1 BINDING SITE is HOST TARGET binding site found in the 3' untranslated region of mRNA encoded by AWP1, corresponding to a HOST TARGET binding site such as BINDING SITE I, BINDING SITE II or BINDING SITE III. Table 2 illustrates the complementarity of the nucleotide sequences of AWP1 BINDING SITE, designated SEQ ID:21079, to the nucleotide sequence of VGAM2595 RNA, herein designated VGAM RNA, also designated SEQ ID:5306.

Another function of VGAM2595 is therefore inhibition of AWP1 (Accession NM_019006). Accordingly, utilities of VGAM2595 include diagnosis, prevention and treatment of diseases and clinical conditions associated with AWP1. Baculoviral IAP Repeat-containing 1 (BIRC1, Accession NM_004536) is another VGAM2595 host target gene. BIRC1 BINDING SITE is HOST TARGET binding site found in the 3' untranslated region of mRNA encoded by BIRC1, corresponding to a HOST TARGET binding site such as BINDING SITE I, BINDING SITE II or BINDING SITE III. Table 2 illustrates the complementarity of the nucleotide sequences of BIRC1 BINDING SITE, designated SEQ ID:10883, to the nucleotide sequence of VGAM2595 RNA, herein designated VGAM RNA, also designated SEQ ID:5306.

Another function of VGAM2595 is therefore inhibition of Baculoviral IAP Repeat-containing 1 (BIRC1, Accession NM_004536). Accordingly, utilities of VGAM2595 include diagnosis, prevention and treatment of diseases and clinical conditions associated with BIRC1. FLJ10159 (Accession NM_018013) is another VGAM2595 host target gene. FLJ10159 BINDING SITE is HOST TARGET binding site found in the 3' untranslated region of mRNA encoded by FLJ10159, corresponding to a HOST TARGET binding site such as BINDING SITE I, BINDING SITE II or BINDING SITE III. Table 2 illustrates the complementarity of the nucleotide sequences of FLJ10159 BINDING SITE, designated SEQ ID:19749, to the nucleotide sequence of VGAM2595 RNA, herein designated VGAM RNA, also designated SEQ ID:5306.

Another function of VGAM2595 is therefore inhibition of FLJ10159 (Accession NM_018013). Accordingly, utilities of VGAM2595 include diagnosis, prevention and treatment of diseases and clinical conditions associated with FLJ10159. KIAA0419 (Accession NM_014711) is another VGAM2595 host target gene. KIAA0419 BINDING SITE is HOST TARGET binding site found in the 3' untranslated region of mRNA encoded by KIAA0419, corresponding to a HOST TARGET binding site such as BINDING SITE I, BINDING SITE II or BINDING SITE III. Table 2 illustrates the complementarity of the nucleotide sequences of KIAA0419 BINDING SITE, designated SEQ ID:16260, to the nucleotide sequence of VGAM2595 RNA, herein designated VGAM RNA, also designated SEQ ID:5306.

Another function of VGAM2595 is therefore inhibition of KIAA0419 (Accession NM_014711). Accordingly, utilities of VGAM2595 include diagnosis, prevention and treatment of diseases and clinical conditions associated with KIAA0419. KIAA0970 (Accession NM_014923) is another VGAM2595 host target gene. KIAA0970 BINDING SITE is HOST TARGET binding site found in the 3' untranslated region of mRNA encoded by KIAA0970, corresponding to a HOST TARGET binding site such as BINDING SITE I, BINDING SITE II or BINDING SITE III. Table 2 illustrates the complementarity of the nucleotide sequences of KIAA0970 BINDING SITE, designated SEQ ID:17205, to the nucleotide sequence of VGAM2595 RNA, herein designated VGAM RNA, also designated SEQ ID:5306.

Another function of VGAM2595 is therefore inhibition of KIAA0970 (Accession NM_014923). Accordingly, utilities of VGAM2595 include diagnosis, prevention and treatment of diseases and clinical conditions associated with KIAA0970. KIAA1546 (Accession XM_042301) is another VGAM2595 host target gene. KIAA1546 BINDING SITE is HOST TARGET binding site found in the 3' untranslated region of mRNA encoded by KIAA1546, corresponding to a HOST TARGET binding site such as BINDING SITE I, BINDING SITE II or BINDING SITE III. Table 2 illustrates the complementarity of the nucleotide sequences of KIAA1546 BINDING SITE, designated SEQ ID:33716, to the nucleotide sequence of VGAM2595 RNA, herein designated VGAM RNA, also designated SEQ ID:5306.

Another function of VGAM2595 is therefore inhibition of KIAA1546 (Accession XM_042301). Accordingly, utilities of VGAM2595 include diagnosis, prevention and treatment of diseases and clinical conditions associated with KIAA1546. KIAA1673 (Accession XM_047672) is another VGAM2595 host target gene. KIAA1673 BINDING SITE is HOST TARGET binding site found in the 3' untranslated region of mRNA encoded by KIAA1673, corresponding to a HOST TARGET binding site such as BINDING SITE I, BINDING SITE II or BINDING SITE III. Table 2 illustrates the complementarity of the nucleotide sequences of KIAA1673 BINDING SITE, designated SEQ ID:35025, to the nucleotide sequence of VGAM2595 RNA, herein designated VGAM RNA, also designated SEQ ID:5306.

Another function of VGAM2595 is therefore inhibition of KIAA1673 (Accession XM_047672). Accordingly, utilities of VGAM2595 include diagnosis, prevention and treatment of diseases and clinical conditions associated with KIAA1673. TRAD (Accession NM_007064) is another VGAM2595 host target gene. TRAD BINDING SITE is HOST TARGET binding site found in the 3' untranslated region of mRNA encoded by TRAD, corresponding to a HOST TARGET binding site such as BINDING SITE I, BINDING SITE II or BINDING SITE III. Table 2 illustrates the complementarity of the nucleotide sequences of TRAD BINDING SITE, designated SEQ ID:13929, to the nucleotide sequence of VGAM2595 RNA, herein designated VGAM RNA, also designated SEQ ID:5306.

Another function of VGAM2595 is therefore inhibition of TRAD (Accession NM_007064). Accordingly, utilities of VGAM2595 include diagnosis, prevention and treatment of diseases and clinical conditions associated with TRAD. LOC158381 (Accession XM_048461) is another VGAM2595 host target gene. LOC158381 BINDING SITE is HOST TARGET binding site found in the 3' untranslated region of mRNA encoded by LOC158381, corresponding to a HOST TARGET binding site such as BINDING SITE I, BINDING SITE II or BINDING SITE III. Table 2 illustrates the complementarity of the nucleotide sequences of LOC158381 BINDING SITE, designated SEQ ID:35175, to the nucleotide sequence of VGAM2595 RNA, herein designated VGAM RNA, also designated SEQ ID:5306.

Another function of VGAM2595 is therefore inhibition of LOC158381 (Accession XM_048461). Accordingly, utilities of VGAM2595 include diagnosis, prevention and treatment of diseases and clinical conditions associated with LOC158381. LOC196283 (Accession XM_113684) is another VGAM2595 host target gene. LOC196283 BINDING SITE is HOST TARGET binding site found in the 3' untranslated region of mRNA encoded by LOC196283, corresponding to a HOST TARGET binding site such as BINDING SITE I, BINDING SITE II or BINDING SITE III. Table 2 illustrates the complementarity of the nucleotide sequences of LOC196283 BINDING SITE, designated SEQ ID:42342, to the nucleotide sequence of VGAM2595 RNA, herein designated VGAM RNA, also designated SEQ ID:5306.

Another function of VGAM2595 is therefore inhibition of LOC196283 (Accession XM_113684). Accordingly, utilities of VGAM2595 include diagnosis, prevention and treatment of diseases and clinical conditions associated with LOC196283. FIG. 1 further provides a conceptual description of a novel bioinformatically detected viral gene of the present invention, referred to here as Viral Genomic Address Messenger 2596 (VGAM2596) viral gene, which modulates expression of respective host target genes thereof, the function and utility of which host target genes is known in the art.

VGAM2596 is a novel bioinformatically detected regulatory, non protein coding, viral micro RNA (miRNA) gene. The method by which VGAM2596 was detected is described hereinabove with reference to FIGS. 1-8.

VGAM2596 gene, herein designated VGAM GENE, is a viral gene contained in the genome of Tobacco Rattle Virus. VGAM2596 host target gene, herein designated VGAM HOST TARGET GENE, is a human gene contained in the human genome.

VGAM2596 gene encodes a VGAM2596 precursor RNA, herein designated VGAM PRECURSOR RNA. Similar to other miRNA genes, and unlike most ordinary genes, VGAM2596 precursor RNA does not encode a protein. A nucleotide sequence identical or highly similar to the nucleotide sequence of VGAM2596 precursor RNA is designated SEQ ID:2582, and is provided hereinbelow with reference to the sequence listing part. Nucleotide sequence SEQ ID:2582 is located at position 3368 relative to the genome of Tobacco Rattle Virus.

VGAM2596 precursor RNA folds onto itself, forming VGAM2596 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2596 folded precursor RNA into VGAM2596 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2596 RNA is designated SEQ ID:5307, and is provided hereinbelow with reference to the sequence listing part.

VGAM2596 host target gene, herein designated VGAM HOST TARGET GENE, encodes a corresponding messenger RNA, VGAM2596 host target RNA, herein designated VGAM HOST TARGET RNA. VGAM2596 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2596 RNA, herein designated VGAM RNA, binds complementarily to one or more host target binding sites located in untranslated regions of VGAM2596 host target RNA, herein designated VGAM HOST TARGET RNA. This complementary binding is due to the fact that the nucleotide sequence of VGAM2596 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2596 RNA, herein designated VGAM RNA, may have a different number of host target binding sites in untranslated regions of a VGAM2596 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2596 RNA, herein designated VGAM RNA, to host target binding sites on VGAM2596 host target RNA, herein designated VGAM HOST TARGET RNA, such as BINDING SITE I, BINDING SITE II and BINDING SITE III, inhibits translation of VGAM2596 host target RNA into VGAM2596 host target protein, herein designated VGAM HOST TARGET PROTEIN. VGAM host target protein is therefore outlined by a broken line.

It is appreciated that VGAM2596 host target gene, herein designated VGAM HOST TARGET GENE, in fact represents a plurality of VGAM2596 host target genes. The mRNA of each one of this plurality of VGAM2596 host target genes comprises one or more host target binding sites, each having a nucleotide sequence which is at least partly complementary to VGAM2596 RNA, herein designated VGAM RNA, and which when bound by VGAM2596 RNA causes inhibition of translation of respective one or more VGAM2596 host target proteins.

It is further appreciated by one skilled in the art that the mode of translational inhibition illustrated by FIG. 1 with specific reference to translational inhibition exerted by VGAM2596 gene, herein designated VGAM GENE, on one or more VGAM2596 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2596 is inhibition of expression of host target genes, as part of a novel viral mechanism of attacking a host. Accordingly, utilities of VGAM2596 include diagnosis, prevention and treatment of viral infection by Tobacco Rattle Virus. Specific functions, and accordingly utilities, of VGAM2596 correlate with, and may be deduced from, the identity of the host target genes which VGAM2596 binds and inhibits, and the function of these host target genes, as elaborated hereinbelow.

Nucleotide sequences of the VGAM2596 precursor RNA, herein designated VGAM PRECURSOR RNA, and of the 'diced' VGAM2596 RNA, herein designated VGAM RNA, and a schematic representation of the secondary folding of VGAM2596 folded precursor RNA, herein designated VGAM FOLDED PRECURSOR RNA, of VGAM2596 are further described hereinbelow with reference to Table 1.

Nucleotide sequences of host target binding sites, such as BINDING SITE-I, BINDING SITE-II and BINDING SITE-III of FIG. 1, found on VGAM2596 host target RNA, and schematic representation of the complementarity of each of these host target binding sites to VGAM2596 RNA, herein designated VGAM RNA, are described hereinbelow with reference to Table 2.

As mentioned hereinabove with reference to FIG. 1, a function of VGAM2596 gene, herein designated VGAM is inhibition of expression of VGAM2596 target genes. It is appreciated that specific functions, and accordingly utilities, of VGAM2596 correlate with, and may be deduced from, the identity of the target genes which VGAM2596 binds and inhibits, and the function of these target genes, as elaborated hereinbelow.

Cysteine-rich Motor Neuron 1 (CRIM1, Accession NM_016441) is a VGAM2596 host target gene. CRIM1 BINDING SITE is HOST TARGET binding site found in the 3' untranslated region of mRNA encoded by CRIM1, corresponding to a HOST TARGET binding site such as BINDING SITE I, BINDING SITE II or BINDING SITE III. Table 2 illustrates the complementarity of the nucleotide sequences of CRIM1 BINDING SITE, designated SEQ ID:18559, to the nucleotide sequence of VGAM2596 RNA, herein designated VGAM RNA, also designated SEQ ID:5307.

A function of VGAM2596 is therefore inhibition of Cysteine-rich Motor Neuron 1 (CRIM1, Accession NM_016441). Accordingly, utilities of VGAM2596 include diagnosis, prevention and treatment of diseases and clinical conditions associated with CRIM1. Deafness, Autosomal Dominant 5 (DFNA5, Accession NM_004403) is another VGAM2596 host target gene. DFNA5 BINDING SITE is HOST TARGET binding site found in the 3' untranslated region of mRNA encoded by DFNA5, corresponding to a HOST TARGET binding site such as BINDING SITE I, BINDING SITE II or BINDING SITE III. Table 2 illustrates the complementarity of the nucleotide sequences of DFNA5 BINDING SITE, designated SEQ ID:10656, to the nucleotide sequence of VGAM2596 RNA, herein designated VGAM RNA, also designated SEQ ID:5307.

Another function of VGAM2596 is therefore inhibition of Deafness, Autosomal Dominant 5 (DFNA5, Accession NM_004403). Accordingly, utilities of VGAM2596 include diagnosis, prevention and treatment of diseases and clinical conditions associated with DFNA5. G Protein-coupled Receptor 4 (GPR4, Accession XM_009140) is another VGAM2596 host target gene. GPR4 BINDING SITE is HOST TARGET binding site found in the 3' untranslated region of mRNA encoded by GPR4, corresponding to a HOST TARGET binding site such as BINDING SITE I, BINDING SITE II or BINDING SITE III. Table 2 illustrates the complementarity of the nucleotide sequences of GPR4 BINDING SITE, designated SEQ ID:30101, to the nucleotide sequence of VGAM2596 RNA, herein designated VGAM RNA, also designated SEQ ID:5307.

Another function of VGAM2596 is therefore inhibition of G Protein-coupled Receptor 4 (GPR4, Accession XM_009140), a gene which stimulates to produce increased calcium by both SPC and LPC. Accordingly, utilities of VGAM2596 include diagnosis, prevention and treatment of diseases and clinical conditions associated with GPR4. The function of GPR4 and its association with various diseases and clinical conditions, has been established by previous studies, as described hereinabove with reference to VGAM2087. S100 Calcium Binding Protein, Beta (neural) (S100B, Accession NM_006272) is another VGAM2596 host target gene. S100B BINDING SITE is HOST TARGET binding site found in the 3' untranslated region of mRNA encoded by S100B, corresponding to a HOST TARGET binding site such as BINDING SITE I, BINDING SITE II or BINDING SITE III. Table 2 illustrates the complementarity of the nucleotide sequences of S100B BINDING SITE, designated SEQ ID:12956, to the nucleotide sequence of VGAM2596 RNA, herein designated VGAM RNA, also designated SEQ ID:5307.

Another function of VGAM2596 is therefore inhibition of S100 Calcium Binding Protein, Beta (neural) (S100B, Accession NM_006272), a gene which weakly binds calcium but binds zinc very tightly- distinct binding sites with different affinities exist for both ions on each monomer. Accordingly, utilities of VGAM2596 include diagnosis, prevention and treatment of diseases and clinical conditions associated with S100B. The function of S100B and its association with various diseases and clinical conditions, has been established by previous studies, as described hereinabove with reference to VGAM1078. 1-acylglycerol-3-phosphate O-acyltransferase 1 (lysophosphatidic acid acyltransferase, alpha) (AGPAT1, Accession NM_032741) is another VGAM2596 host target gene. AGPAT1 BINDING SITE is HOST TARGET binding site found in the 3' untranslated region of mRNA encoded by AGPAT1, corresponding to a HOST TARGET binding site such as BINDING SITE I, BINDING SITE II or BINDING SITE III. Table 2 illustrates the complementarity of the nucleotide sequences of AGPAT1 BINDING SITE, designated SEQ ID:26474, to the nucleotide sequence of VGAM2596 RNA, herein designated VGAM RNA, also designated SEQ ID:5307.

Another function of VGAM2596 is therefore inhibition of 1-acylglycerol-3-phosphate O-acyltransferase 1 (lysophosphatidic acid acyltransferase, alpha) (AGPAT1, Accession NM_032741). Accordingly, utilities of VGAM2596 include diagnosis, prevention and treatment of diseases and clinical conditions associated with AGPAT1. Adaptor-related Protein Complex 3, Mu 1 Subunit (AP3M1, Accession NM_012095) is another VGAM2596 host target gene. AP3M1 BINDING SITE is HOST TARGET binding site found in the 3' untranslated region of mRNA encoded by AP3M1, corresponding to a HOST TARGET binding site such as BINDING SITE I, BINDING SITE II or BINDING SITE III. Table 2 illustrates the complementarity of the nucleotide sequences of AP3M1 BINDING SITE, designated SEQ ID:14398, to the nucleotide sequence of VGAM2596 RNA, herein designated VGAM RNA, also designated SEQ ID:5307.

Another function of VGAM2596 is therefore inhibition of Adaptor-related Protein Complex 3, Mu 1 Subunit (AP3M1, Accession NM_012095). Accordingly, utilities of VGAM2596 include diagnosis, prevention and treatment of diseases and clinical conditions associated with AP3M1. Chromosome 9 Open Reading Frame 7 (C9orf7, Accession NM_017586) is another VGAM2596 host target gene. C9orf7 BINDING SITE is HOST TARGET binding site found in the 3' untranslated region of mRNA encoded by C9orf7, corresponding to a HOST TARGET binding site such as BINDING SITE I, BINDING SITE II or BINDING SITE III. Table 2 illustrates the complementarity of the nucleotide sequences of C9orf7 BINDING SITE, designated SEQ ID:19036, to the nucleotide sequence of VGAM2596 RNA, herein designated VGAM RNA, also designated SEQ ID:5307.

Another function of VGAM2596 is therefore inhibition of Chromosome 9 Open Reading Frame 7 (C9orf7, Accession NM_017586). Accordingly, utilities of VGAM2596 include diagnosis, prevention and treatment of diseases and clinical conditions associated with C9orf7. DKFZP434F0318 (Accession NM_030817) is another VGAM2596 host target gene. DKFZP434F0318 BINDING SITE is HOST TARGET binding site found in the 3' untranslated region of mRNA encoded by DKFZP434F0318, corresponding to a HOST TARGET binding site such as BINDING SITE I, BINDING SITE II or BINDING SITE III. Table 2 illustrates the complementarity of the nucleotide sequences of DKFZP434F0318 BINDING SITE, designated SEQ ID:25146, to the nucleotide sequence of VGAM2596 RNA, herein designated VGAM RNA, also designated SEQ ID:5307.

Another function of VGAM2596 is therefore inhibition of DKFZP434F0318 (Accession NM_030817). Accordingly, utilities of VGAM2596 include diagnosis, prevention and treatment of diseases and clinical conditions associated with DKFZP434F0318. DKFZP434H132 (Accession XM_057020) is another VGAM2596 host target gene. DKFZP434H132 BINDING SITE is HOST TARGET binding site found in the 5' untranslated region of mRNA encoded by DKFZP434H132, corresponding to a HOST TARGET binding site such as BINDING SITE I, BINDING SITE II or BINDING SITE III. Table 2 illustrates the complementarity of the nucleotide sequences of DKFZP434H132 BINDING SITE, designated SEQ ID:36443, to the nucleotide sequence of VGAM2596 RNA, herein designated VGAM RNA, also designated SEQ ID:5307.

Another function of VGAM2596 is therefore inhibition of DKFZP434H132 (Accession XM_057020). Accordingly, utilities of VGAM2596 include diagnosis, prevention and treatment of diseases and clinical conditions associated with DKFZP434H132. DKFZP566K1924 (Accession XM_057469) is another VGAM2596 host target gene. DKFZP566K1924 BINDING SITE is HOST TARGET binding site found in the 3' untranslated region of mRNA encoded by DKFZP566K1924, corresponding to a HOST TARGET binding site such as BINDING SITE I, BINDING SITE II or BINDING SITE III. Table 2 illustrates the complementarity of the nucleotide sequences of DKFZP566K1924 BINDING SITE, designated SEQ ID:36522, to the nucleotide sequence of VGAM2596 RNA, herein designated VGAM RNA, also designated SEQ ID:5307.

Another function of VGAM2596 is therefore inhibition of DKFZP566K1924 (Accession XM_057469). Accordingly, utilities of VGAM2596 include diagnosis, prevention and treatment of diseases and clinical conditions associated with DKFZP566K1924. HSU79252 (Accession NM_013298) is another VGAM2596 host target gene. HSU79252 BINDING SITE is HOST TARGET binding site found in the 5' untranslated region of mRNA encoded by HSU79252, corresponding to a HOST TARGET binding site such as BINDING SITE I, BINDING SITE II or BINDING SITE III. Table 2 illustrates the complementarity of the nucleotide sequences of HSU79252 BINDING SITE, designated SEQ ID:14958, to the nucleotide sequence of VGAM2596 RNA, herein designated VGAM RNA, also designated SEQ ID:5307.

Another function of VGAM2596 is therefore inhibition of HSU79252 (Accession NM_013298). Accordingly, utilities of VGAM2596 include diagnosis, prevention and treatment of diseases and clinical conditions associated with HSU79252. KIAA0064 (Accession NM_014748) is another VGAM2596 host target gene. KIAA0064 BINDING SITE is HOST TARGET binding site found in the 5' untranslated region of mRNA encoded by KIAA0064, corresponding to a HOST TARGET binding site such as BINDING SITE I, BINDING SITE II or BINDING SITE III. Table 2 illustrates the complementarity of the nucleotide sequences of KIAA0064 BINDING SITE, designated SEQ ID:16460, to the nucleotide sequence of VGAM2596 RNA, herein designated VGAM RNA, also designated SEQ ID:5307.

Another function of VGAM2596 is therefore inhibition of KIAA0064 (Accession NM_014748). Accordingly, utilities of VGAM2596 include diagnosis, prevention and treatment of diseases and clinical conditions associated with KIAA0064. KIAA0410 (Accession NM_014778) is another VGAM2596 host target gene. KIAA0410 BINDING SITE is HOST TARGET binding site found in the 3' untranslated region of mRNA encoded by KIAA0410, corresponding to a HOST TARGET binding site such as BINDING SITE I, BINDING SITE II or BINDING SITE III. Table 2 illustrates the complementarity of the nucleotide sequences of KIAA0410 BINDING SITE, designated SEQ ID:16623, to the nucleotide sequence of VGAM2596 RNA, herein designated VGAM RNA, also designated SEQ ID:5307.

Another function of VGAM2596 is therefore inhibition of KIAA0410 (Accession NM_014778). Accordingly, utilities of VGAM2596 include diagnosis, prevention and treatment of diseases and clinical conditions associated with KIAA0410. KIAA1710 (Accession XM_031283) is another VGAM2596 host target gene. KIAA1710 BINDING SITE is HOST TARGET binding site found in the 5' untranslated region of mRNA encoded by KIAA1710, corresponding to a HOST TARGET binding site such as BINDING SITE I, BINDING SITE II or BINDING SITE III. Table 2 illustrates the complementarity of the nucleotide sequences of KIAA1710 BINDING SITE, designated SEQ ID:31331, to the nucleotide sequence of VGAM2596 RNA, herein designated VGAM RNA, also designated SEQ ID:5307.

Another function of VGAM2596 is therefore inhibition of KIAA1710 (Accession XM_031283). Accordingly, utilities of VGAM2596 include diagnosis, prevention and treatment of diseases and clinical conditions associated with KIAA1710. KIAA1853 (Accession XM_045184) is another VGAM2596 host target gene. KIAA1853 BINDING SITE is HOST TARGET binding site found in the 3' untranslated region of mRNA encoded by KIAA1853, corresponding to a HOST TARGET binding site such as BINDING SITE I, BINDING SITE II or BINDING SITE III. Table 2 illustrates the complementarity of the nucleotide sequences of KIAA1853 BINDING SITE, designated SEQ ID:34390, to the nucleotide sequence of VGAM2596 RNA, herein designated VGAM RNA, also designated SEQ ID:5307.

Another function of VGAM2596 is therefore inhibition of KIAA1853 (Accession XM_045184). Accordingly, utilities of VGAM2596 include diagnosis, prevention and treatment of diseases and clinical conditions associated with KIAA1853. MGC5338 (Accession NM_024062) is another VGAM2596 host target gene. MGC5338 BINDING SITE is HOST TARGET binding site found in the 3' untranslated region of mRNA encoded by MGC5338, corresponding to a HOST TARGET binding site such as BINDING SITE I, BINDING SITE II or BINDING SITE III. Table 2 illustrates the complementarity of the nucleotide sequences of MGC5338 BINDING SITE, designated SEQ ID:23498, to the nucleotide sequence of VGAM2596 RNA, herein designated VGAM RNA, also designated SEQ ID:5307.

Another function of VGAM2596 is therefore inhibition of MGC5338 (Accession NM_024062). Accordingly, utilities of VGAM2596 include diagnosis, prevention and treatment of diseases and clinical conditions associated with MGC5338. Oxysterol Binding Protein-like 3 (OSBPL3, Accession NM_015550) is another VGAM2596 host target gene. OSBPL3 BINDING SITE is HOST TARGET binding site found in the 3' untranslated region of mRNA encoded by OSBPL3, corresponding to a HOST TARGET binding site such as BINDING SITE I, BINDING SITE II or BINDING SITE III. Table 2 illustrates the complementarity of the nucleotide sequences of OSBPL3 BINDING SITE, designated SEQ ID:17819, to the nucleotide sequence of VGAM2596 RNA, herein designated VGAM RNA, also designated SEQ ID:5307.

Another function of VGAM2596 is therefore inhibition of Oxysterol Binding Protein-like 3 (OSBPL3, Accession NM_015550). Accordingly, utilities of VGAM2596 include diagnosis, prevention and treatment of diseases and clinical conditions associated with OSBPL3. P37NB (Accession NM_005824) is another VGAM2596 host target gene. P37NB BINDING SITE is HOST TARGET binding site found in the 5' untranslated region of mRNA encoded by P37NB, corresponding to a HOST TARGET binding site such as BINDING SITE I, BINDING SITE II or BINDING SITE III. Table 2 illustrates the complementarity of the nucleotide sequences of P37NB BINDING SITE, designated SEQ ID:12436, to the nucleotide sequence of VGAM2596 RNA, herein designated VGAM RNA, also designated SEQ ID:5307.

Another function of VGAM2596 is therefore inhibition of P37NB (Accession NM_005824). Accordingly, utilities of VGAM2596 include diagnosis, prevention and treatment of diseases and clinical conditions associated with P37NB. Protocadherin 19 (PCDH19, Accession XM_033173) is another VGAM2596 host target gene. PCDH19 BINDING SITE is HOST TARGET binding site found in the 3' untranslated region of mRNA encoded by PCDH19, corresponding to a HOST TARGET binding site such as BINDING SITE I, BINDING SITE II or BINDING SITE III. Table 2 illustrates the complementarity of the nucleotide sequences of PCDH19 BINDING SITE, designated SEQ ID:31865, to the nucleotide sequence of VGAM2596 RNA, herein designated VGAM RNA, also designated SEQ ID:5307.

Another function of VGAM2596 is therefore inhibition of Protocadherin 19 (PCDH19, Accession XM_033173). Accordingly, utilities of VGAM2596 include diagnosis, prevention and treatment of diseases and clinical conditions associated with PCDH19. PI4KII (Accession NM_018425) is another VGAM2596 host target gene. PI4KII BINDING SITE is HOST TARGET binding site found in the 3' untranslated region of mRNA encoded by PI4KII, corresponding to a HOST TARGET binding site such as BINDING SITE I, BINDING SITE II or BINDING SITE III. Table 2 illustrates the complementarity of the nucleotide sequences of PI4KII BINDING SITE, designated SEQ ID:20482, to the nucleotide sequence of VGAM2596 RNA, herein designated VGAM RNA, also designated SEQ ID:5307.

Another function of VGAM2596 is therefore inhibition of PI4KII (Accession NM_018425). Accordingly, utilities of VGAM2596 include diagnosis, prevention and treatment of diseases and clinical conditions associated with PI4KII. Ras Association (RalGDS/AF-6) Domain Family 2 (RASSF2, Accession NM_014737) is another VGAM2596 host target gene. RASSF2 BINDING SITE is HOST TARGET binding site found in the 3' untranslated region of mRNA encoded by RASSF2, corresponding to a HOST TARGET binding site such as BINDING SITE I, BINDING SITE II or BINDING SITE III. Table 2 illustrates the complementarity of the nucleotide sequences of RASSF2 BINDING SITE, designated SEQ ID:16400, to the nucleotide sequence of VGAM2596 RNA, herein designated VGAM RNA, also designated SEQ ID:5307.

Another function of VGAM2596 is therefore inhibition of Ras Association (RalGDS/AF-6) Domain Family 2 (RASSF2, Accession NM_014737). Accordingly, utilities of VGAM2596 include diagnosis, prevention and treatment of diseases and clinical conditions associated with RASSF2. LOC115286 (Accession XM_055644) is another VGAM2596 host target gene. LOC115286 BINDING SITE is HOST TARGET binding site found in the 3' untranslated region of mRNA encoded by LOC115286, corresponding to a HOST TARGET binding site such as BINDING SITE I, BINDING SITE II or BINDING SITE III. Table 2 illustrates the complementarity of the nucleotide sequences of LOC115286 BINDING SITE, designated SEQ ID:36314, to the nucleotide sequence of VGAM2596 RNA, herein designated VGAM RNA, also designated SEQ ID:5307.

Another function of VGAM2596 is therefore inhibition of LOC115286 (Accession XM_055644). Accordingly, utilities of VGAM2596 include diagnosis, prevention and treatment of diseases and clinical conditions associated with LOC115286. LOC152195 (Accession XM_098172) is another VGAM2596 host target gene. LOC152195 BINDING SITE is HOST TARGET binding site found in the 5' untranslated region of mRNA encoded by LOC152195, corresponding to a HOST TARGET binding site such as BINDING SITE I, BINDING SITE II or BINDING SITE III. Table 2 illustrates the complementarity of the nucleotide sequences of LOC152195 BINDING SITE, designated SEQ ID:41433, to the nucleotide sequence of VGAM2596 RNA, herein designated VGAM RNA, also designated SEQ ID:5307.

Another function of VGAM2596 is therefore inhibition of LOC152195 (Accession XM_098172). Accordingly, utilities of VGAM2596 include diagnosis, prevention and treatment of diseases and clinical conditions associated with LOC152195. LOC54516 (Accession NM_019041) is another VGAM2596 host target gene. LOC54516 BINDING SITE is HOST TARGET binding site found in the 3' untranslated region of mRNA encoded by LOC54516, corresponding to a HOST TARGET binding site such as BINDING SITE I, BINDING SITE II or BINDING SITE III. Table 2 illustrates the complementarity of the nucleotide sequences of LOC54516 BINDING SITE, designated SEQ ID:21124, to the nucleotide sequence of VGAM2596 RNA, herein designated VGAM RNA, also designated SEQ ID:5307.

Another function of VGAM2596 is therefore inhibition of LOC54516 (Accession NM_019041). Accordingly, utilities of VGAM2596 include diagnosis, prevention and treatment of diseases and clinical conditions associated with LOC54516. FIG. 1 further provides a conceptual description of a novel bioinformatically detected viral gene of the present invention, referred to here as Viral Genomic Address Messenger 2597 (VGAM2597) viral gene, which modulates expression of respective host target genes thereof, the function and utility of which host target genes is known in the art.

VGAM2597 is a novel bioinformatically detected regulatory, non protein coding, viral micro RNA (miRNA) gene. The method by which VGAM2597 was detected is described hereinabove with reference to FIGS. 1-8.

VGAM2597 gene, herein designated VGAM GENE, is a viral gene contained in the genome of Tobacco Rattle Virus. VGAM2597 host target gene, herein designated VGAM HOST TARGET GENE, is a human gene contained in the human genome.

VGAM2597 gene encodes a VGAM2597 precursor RNA, herein designated VGAM PRECURSOR RNA. Similar to other miRNA genes, and unlike most ordinary genes, VGAM2597 precursor RNA does not encode a protein. A nucleotide sequence identical or highly similar to the nucleotide sequence of VGAM2597 precursor RNA is designated SEQ ID:2583, and is provided hereinbelow with reference to the sequence listing part. Nucleotide sequence SEQ ID:2583 is located at position 1854 relative to the genome of Tobacco Rattle Virus.

VGAM2597 precursor RNA folds onto itself, forming VGAM2597 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2597 folded precursor RNA into VGAM2597 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 64%) nucleotide sequence of VGAM2597 RNA is designated SEQ ID:5308, and is provided hereinbelow with reference to the sequence listing part.

VGAM2597 host target gene, herein designated VGAM HOST TARGET GENE, encodes a corresponding messenger RNA, VGAM2597 host target RNA, herein designated VGAM HOST TARGET RNA. VGAM2597 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2597 RNA, herein designated VGAM RNA, binds complementarily to one or more host target binding sites located in untranslated regions of VGAM2597 host target RNA, herein designated VGAM HOST TARGET RNA. This complementary binding is due to the fact that the nucleotide sequence of VGAM2597 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2597 RNA, herein designated VGAM RNA, may have a different number of host target binding sites in untranslated regions of a VGAM2597 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2597 RNA, herein designated VGAM RNA, to host target binding sites on VGAM2597 host target RNA, herein designated VGAM HOST TARGET RNA, such as BINDING SITE I, BINDING SITE II and BINDING SITE III, inhibits translation of VGAM2597 host target RNA into VGAM2597 host target protein, herein designated VGAM HOST TARGET PROTEIN. VGAM host target protein is therefore outlined by a broken line.

It is appreciated that VGAM2597 host target gene, herein designated VGAM HOST TARGET GENE, in fact represents a plurality of VGAM2597 host target genes. The mRNA of each one of this plurality of VGAM2597 host target genes comprises one or more host target binding sites, each having a nucleotide sequence which is at least partly complementary to VGAM2597 RNA, herein designated VGAM RNA, and which when bound by VGAM2597 RNA causes inhibition of translation of respective one or more VGAM2597 host target proteins.

It is further appreciated by one skilled in the art that the mode of translational inhibition illustrated by FIG. 1 with specific reference to translational inhibition exerted by VGAM2597 gene, herein designated VGAM GENE, on one or more VGAM2597 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2597 is inhibition of expression of host target genes, as part of a novel viral mechanism of attacking a host. Accordingly, utilities of VGAM2597 include diagnosis, prevention and treatment of viral infection by Tobacco Rattle Virus. Specific functions, and accordingly utilities, of VGAM2597 correlate with, and may be deduced from, the identity of the host target genes which VGAM2597 binds and inhibits, and the function of these host target genes, as elaborated hereinbelow.

Nucleotide sequences of the VGAM2597 precursor RNA, herein designated VGAM PRECURSOR RNA, and of the 'diced' VGAM2597 RNA, herein designated VGAM RNA, and a schematic representation of the secondary folding of VGAM2597 folded precursor RNA, herein designated VGAM FOLDED PRECURSOR RNA, of VGAM2597 are further described hereinbelow with reference to Table 1.

Nucleotide sequences of host target binding sites, such as BINDING SITE-I, BINDING SITE-II and BINDING SITE-III of FIG. 1, found on VGAM2597 host target RNA, and schematic representation of the complementarity of each of these host target binding sites to VGAM2597 RNA, herein designated VGAM RNA, are described hereinbelow with reference to Table 2.

As mentioned hereinabove with reference to FIG. 1, a function of VGAM2597 gene, herein designated VGAM is inhibition of expression of VGAM2597 target genes. It is appreciated that specific functions, and accordingly utilities, of VGAM2597 correlate with, and may be deduced from, the identity of the target genes which VGAM2597 binds and inhibits, and the function of these target genes, as elaborated hereinbelow.

Toll-like Receptor 1 (TLR1, Accession NM_003263) is a VGAM2597 host target gene. TLR1 BINDING SITE is HOST TARGET binding site found in the 5' untranslated region of mRNA encoded by TLR1, corresponding to a HOST TARGET binding site such as BINDING SITE I, BINDING SITE II or BINDING SITE III. Table 2 illustrates the complementarity of the nucleotide sequences of TLR1 BINDING SITE, designated SEQ ID:9275, to the nucleotide sequence of VGAM2597 RNA, herein designated VGAM RNA, also designated SEQ ID:5308.

A function of VGAM2597 is therefore inhibition of Toll-like Receptor 1 (TLR1, Accession NM_003263), a gene which is a critical for antibody responses to OspA. Accordingly, utilities of VGAM2597 include diagnosis, prevention and treatment of diseases and clinical conditions associated with TLR1. The function of TLR1 has been established by previous studies. TLRs and IL1Rs share a conserved cytoplasmic TIR domain. Mutations in this domain disrupt responses to LPS and to gram-positive bacteria, mediated by TLR4 and TLR2 (OMIM Ref. No. 603028), respectively. By structural analysis, Xu et al. (2000) determined that the TIR domains of human TLR2 and TLR1, which are 50% identical at the amino acid level, contain a central 5-stranded parallel beta-sheet surrounded by 5 alpha helices on both sides. The structures have a large conserved surface patch, and mutational and functional analyses indicated that residues in the surface patch are crucial for receptor signaling. The authors concluded that instead of disturbing the structure of the TIR domain, mutations may abolish signaling by disrupting the recruitment of the MYD88 (OMIM Ref. No. 602170) adaptor molecule. Alexopoulou et al. (2002) reported that a small percentage of individuals who receive a vaccination series with the OspA antigen of Borrelia burgdorferi, the causative spirochete agent of Lyme disease, have very low antibody responses to the vaccine. They studied 7 of these 'low responders.' Macrophages from the low responders produced lower levels of the proinflammatory cytokines tumor necrosis factor (TNF; 191160) and IL6 (OMIM Ref. No. 147620), while production of the antiinflammatory cytokine IL10 (OMIM Ref. No. 124092) was similar to that of normal responders. Mutation analysis did not identify any defects in the TLR2 gene in the low responders. The human low antibody responders had no mutations in the TLR1 gene. However, flow cytometric analysis demonstrated undetectable cell-surface expression of TLR1, but not of TLR2, in all but 1 of the low responders. Animal model experiments lend further support to the function of TLR1. Tlr2-deficient mice produced lower levels of antibody and IL6 in response to OspA in the absence of complete Freund adjuvant (CFA), but not to intact B. burgdorferi. Apart from a higher spirochete burden early in the course of the disease, Tlr2 -/- mice resolved the infection in a manner similar to wildtype mice. Tlr1-deficient mice had a similar pattern of responses, except that these mice were capable of producing IL6 in response to peptidoglycan and were also capable of making IL10 in response to OspA. Alexopoulou et al. (2002) concluded that although TLR1 expression is critical for antibody responses to OspA, the presence of other TLRs in the host that presumably recognize other B. burgdorferi antigens results in no greater susceptibility to infection and disease in these hosts.

It is appreciated that the abovementioned animal model for TLR1 is acknowledged by those skilled in the art as a scientifically valid animal model, as can be further appreciated from the publications sited hereinbelow.

Full details of the abovementioned studies are described in the following publications, the disclosure of which are hereby incorporated by reference:

Xu, Y.; Tao, X.; Shen, B.; Horng, T.; Medzhitov, R.; Manley, J. L.; Tong, L.: Structural basis for signal transduction by the Toll/interleukin-1 receptor domains. Nature 408:111-115, 2000; and Alexopoulou, L.; Thomas, V.; Schnare, M.; Lobet, Y.; Anguita, J.; Schoen, R. T.; Medzhitov, R.; Fikrig, E.; Flavell, R. A.: Hyporesponsiveness to vaccination with Borrelia burgdorferi.

Further studies establishing the function and utilities of TLR1 are found in John Hopkins OMIM database record ID 601194, and in sited publications numbered 9835-9836, 6736, 983 and 10819-9840 listed in the bibliography section hereinbelow, which are also hereby incorporated by reference. FLJ14440 (Accession NM_032784) is another VGAM2597 host target gene. FLJ14440 BINDING SITE is HOST TARGET binding site found in the 3' untranslated region of mRNA encoded by FLJ14440, corresponding to a HOST TARGET binding site such as BINDING SITE I, BINDING SITE II or BINDING SITE III. Table 2 illustrates the complementarity of the nucleotide sequences of FLJ14440 BINDING SITE, designated SEQ ID:26529, to the nucleotide sequence of VGAM2597 RNA, herein designated VGAM RNA, also designated SEQ ID:5308.

Another function of VGAM2597 is therefore inhibition of FLJ14440 (Accession NM_032784). Accordingly, utilities of VGAM2597 include diagnosis, prevention and treatment of diseases and clinical conditions associated with FLJ14440. P450RAI-2 (Accession NM_019885) is another VGAM2597 host target gene. P450RAI-2 BINDING SITE is HOST TARGET binding site found in the 3' untranslated region of mRNA encoded by P450RAI-2, corresponding to a HOST TARGET binding site such as BINDING SITE I, BINDING SITE II or BINDING SITE III. Table 2 illustrates the complementarity of the nucleotide sequences of P450RAI-2 BINDING SITE, designated SEQ ID:21265, to the nucleotide sequence of VGAM2597 RNA, herein designated VGAM RNA, also designated SEQ ID:5308.

Another function of VGAM2597 is therefore inhibition of P450RAI-2 (Accession NM_019885). Accordingly, utilities of VGAM2597 include diagnosis, prevention and treatment of diseases and clinical conditions associated with P450RAI-2. LOC200347 (Accession XM_114219) is another VGAM2597 host target gene. LOC200347 BINDING SITE is HOST TARGET binding site found in the 5' untranslated region of mRNA encoded by LOC200347, corresponding to a HOST TARGET binding site such as BINDING SITE I, BINDING SITE II or BINDING SITE III. Table 2 illustrates the complementarity of the nucleotide sequences of LOC200347 BINDING SITE, designated SEQ ID:42806, to the nucleotide sequence of VGAM2597 RNA, herein designated VGAM RNA, also designated SEQ ID:5308.

Another function of VGAM2597 is therefore inhibition of LOC200347 (Accession XM_114219). Accordingly, utilities of VGAM2597 include diagnosis, prevention and treatment of diseases and clinical conditions associated with LOC200347. LOC51716 (Accession NM_016280) is another VGAM2597 host target gene. LOC51716 BINDING SITE is HOST TARGET binding site found in the 3' untranslated region of mRNA encoded by LOC51716, corresponding to a HOST TARGET binding site such as BINDING SITE I, BINDING SITE II or BINDING SITE III. Table 2 illustrates the complementarity of the nucleotide sequences of LOC51716 BINDING SITE, designated SEQ ID:18404, to the nucleotide sequence of VGAM2597 RNA, herein designated VGAM RNA, also designated SEQ ID:5308.

Another function of VGAM2597 is therefore inhibition of LOC51716 (Accession NM_016280). Accordingly, utilities of VGAM2597 include diagnosis, prevention and treatment of diseases and clinical conditions associated with LOC51716. FIG. 1 further provides a conceptual description of a novel bioinformatically detected viral gene of the present invention, referred to here as Viral Genomic Address Messenger 2598 (VGAM2598) viral gene, which modulates expression of respective host target genes thereof, the function and utility of which host target genes is known in the art.

VGAM2598 is a novel bioinformatically detected regulatory, non protein coding, viral micro RNA (miRNA) gene. The method by which VGAM2598 was detected is described hereinabove with reference to FIGS. 1-8.

VGAM2598 gene, herein designated VGAM GENE, is a viral gene contained in the genome of Tobacco Rattle Virus. VGAM2598 host target gene, herein designated VGAM HOST TARGET GENE, is a human gene contained in the human genome.

VGAM2598 gene encodes a VGAM2598 precursor RNA, herein designated VGAM PRECURSOR RNA. Similar to other miRNA genes, and unlike most ordinary genes, VGAM2598 precursor RNA does not encode a protein. A nucleotide sequence identical or highly similar to the nucleotide sequence of VGAM2598 precursor RNA is designated SEQ ID:2584, and is provided hereinbelow with reference to the sequence listing part. Nucleotide sequence SEQ ID:2584 is located at position 1327 relative to the genome of Tobacco Rattle Virus.

VGAM2598 precursor RNA folds onto itself, forming VGAM2598 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2598 folded precursor RNA into VGAM2598 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2598 RNA is designated SEQ ID:5309, and is provided hereinbelow with reference to the sequence listing part.

VGAM2598 host target gene, herein designated VGAM HOST TARGET GENE, encodes a corresponding messenger RNA, VGAM2598 host target RNA, herein designated VGAM HOST TARGET RNA. VGAM2598 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2598 RNA, herein designated VGAM RNA, binds complementarily to one or more host target binding sites located in untranslated regions of VGAM2598 host target RNA, herein designated VGAM HOST TARGET RNA. This complementary binding is due to the fact that the nucleotide sequence of VGAM2598 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2598 RNA, herein designated VGAM RNA, may have a different number of host target binding sites in untranslated regions of a VGAM2598 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2598 RNA, herein designated VGAM RNA, to host target binding sites on VGAM2598 host target RNA, herein designated VGAM HOST TARGET RNA, such as BINDING SITE I, BINDING SITE II and BINDING SITE III, inhibits translation of VGAM2598 host target RNA into VGAM2598 host target protein, herein designated VGAM HOST TARGET PROTEIN. VGAM host target protein is therefore outlined by a broken line.

It is appreciated that VGAM2598 host target gene, herein designated VGAM HOST TARGET GENE, in fact represents a plurality of VGAM2598 host target genes. The mRNA of each one of this plurality of VGAM2598 host target genes comprises one or more host target binding sites, each having a nucleotide sequence which is at least partly complementary to VGAM2598 RNA, herein designated VGAM RNA, and which when bound by VGAM2598 RNA causes inhibition of translation of respective one or more VGAM2598 host target proteins.

It is further appreciated by one skilled in the art that the mode of translational inhibition illustrated by FIG. 1 with specific reference to translational inhibition exerted by VGAM2598 gene, herein designated VGAM GENE, on one or more VGAM2598 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2598 is inhibition of expression of host target genes, as part of a novel viral mechanism of attacking a host. Accordingly, utilities of VGAM2598 include diagnosis, prevention and treatment of viral infection by Tobacco Rattle Virus. Specific functions, and accordingly utilities, of VGAM2598 correlate with, and may be deduced from, the identity of the host target genes which VGAM2598 binds and inhibits, and the function of these host target genes, as elaborated hereinbelow.

Nucleotide sequences of the VGAM2598 precursor RNA, herein designated VGAM PRECURSOR RNA, and of the 'diced' VGAM2598 RNA, herein designated VGAM RNA, and a schematic representation of the secondary folding of VGAM2598 folded precursor RNA, herein designated VGAM FOLDED PRECURSOR RNA, of VGAM2598 are further described hereinbelow with reference to Table 1.

Nucleotide sequences of host target binding sites, such as BINDING SITE-I, BINDING SITE-II and BINDING SITE-III of FIG. 1, found on VGAM2598 host target RNA, and schematic representation of the complementarity of each of these host target binding sites to VGAM2598 RNA, herein designated VGAM RNA, are described hereinbelow with reference to Table 2.

As mentioned hereinabove with reference to FIG. 1, a function of VGAM2598 gene, herein designated VGAM is inhibition of expression of VGAM2598 target genes. It is appreciated that specific functions, and accordingly utilities, of VGAM2598 correlate with, and may be deduced from, the identity of the target genes which VGAM2598 binds and inhibits, and the function of these target genes, as elaborated hereinbelow.

Formyl Peptide Receptor-like 1 (FPRL1, Accession NM_001462) is a VGAM2598 host target gene. FPRL1 BINDING SITE is HOST TARGET binding site found in the 5' untranslated region of mRNA encoded by FPRL1, corresponding to a HOST TARGET binding site such as BINDING SITE I, BINDING SITE II or BINDING SITE III. Table 2 illustrates the complementarity of the nucleotide sequences of FPRL1 BINDING SITE, designated SEQ ID:7196, to the nucleotide sequence of VGAM2598 RNA, herein designated VGAM RNA, also designated SEQ ID:5309.

A function of VGAM2598 is therefore inhibition of Formyl Peptide Receptor-like 1 (FPRL1, Accession NM_001462). Accordingly, utilities of VGAM2598 include diagnosis, prevention and treatment of diseases and clinical conditions associated with FPRL1. Interleukin 1 Receptor Accessory Protein (IL1RAP, Accession NM_002182) is another VGAM2598 host target gene. IL1RAP BINDING SITE is HOST TARGET binding site found in the 3' untranslated region of mRNA encoded by IL1RAP, corresponding to a HOST TARGET binding site such as BINDING SITE I, BINDING SITE II or BINDING SITE III. Table 2 illustrates the complementarity of the nucleotide sequences of IL1RAP BINDING SITE, designated SEQ ID:7939, to the nucleotide sequence of VGAM2598 RNA, herein designated VGAM RNA, also designated SEQ ID:5309.

Another function of VGAM2598 is therefore inhibition of Interleukin 1 Receptor Accessory Protein (IL1RAP, Accession NM_002182), a gene which may function as a membrane receptor. promotes heterophilic cellular adhesion. Accordingly, utilities of VGAM2598 include diagnosis, prevention and treatment of diseases and clinical conditions associated with IL1RAP. The function of IL1RAP and its association with various diseases and clinical conditions, has been established by previous studies, as described hereinabove with reference to VGAM142. FIG. 1 further provides a conceptual description of a novel bioinformatically detected viral gene of the present invention, referred to here as Viral Genomic Address Messenger 2599 (VGAM2599) viral gene, which modulates expression of respective host target genes thereof, the function and utility of which host target genes is known in the art.

VGAM2599 is a novel bioinformatically detected regulatory, non protein coding, viral micro RNA (miRNA) gene. The method by which VGAM2599 was detected is described hereinabove with reference to FIGS. 1-8.

VGAM2599 gene, herein designated VGAM GENE, is a viral gene contained in the genome of Obuda Pepper Virus. VGAM2599 host target gene, herein designated VGAM HOST TARGET GENE, is a human gene contained in the human genome.

VGAM2599 gene encodes a VGAM2599 precursor RNA, herein designated VGAM PRECURSOR RNA. Similar to other miRNA genes, and unlike most ordinary genes, VGAM2599 precursor RNA does not encode a protein. A nucleotide sequence identical or highly similar to the nucleotide sequence of VGAM2599 precursor RNA is designated SEQ ID:2585, and is provided hereinbelow with reference to the sequence listing part. Nucleotide sequence SEQ ID:2585 is located at position 2974 relative to the genome of Obuda Pepper Virus.

VGAM2599 precursor RNA folds onto itself, forming VGAM2599 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2599 folded precursor RNA into VGAM2599 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM2599 RNA is designated SEQ ID:5310, and is provided hereinbelow with reference to the sequence listing part.

VGAM2599 host target gene, herein designated VGAM HOST TARGET GENE, encodes a corresponding messenger RNA, VGAM2599 host target RNA, herein designated VGAM HOST TARGET RNA. VGAM2599 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2599 RNA, herein designated VGAM RNA, binds complementarily to one or more host target binding sites located in untranslated regions of VGAM2599 host target RNA, herein designated VGAM HOST TARGET RNA. This complementary binding is due to the fact that the nucleotide sequence of VGAM2599 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2599 RNA, herein designated VGAM RNA, may have a different number of host target binding sites in untranslated regions of a VGAM2599 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2599 RNA, herein designated VGAM RNA, to host target binding sites on VGAM2599 host target RNA, herein designated VGAM HOST TARGET RNA, such as BINDING SITE I, BINDING SITE II and BINDING SITE III, inhibits translation of VGAM2599 host target RNA into VGAM2599 host target protein, herein designated VGAM HOST TARGET PROTEIN. VGAM host target protein is therefore outlined by a broken line.

It is appreciated that VGAM2599 host target gene, herein designated VGAM HOST TARGET GENE, in fact represents a plurality of VGAM2599 host target genes. The mRNA of each one of this plurality of VGAM2599 host target genes comprises one or more host target binding sites, each having a nucleotide sequence which is at least partly complementary to VGAM2599 RNA, herein designated VGAM RNA, and which when bound by VGAM2599 RNA causes inhibition of translation of respective one or more VGAM2599 host target proteins.

It is further appreciated by one skilled in the art that the mode of translational inhibition illustrated by FIG. 1 with specific reference to translational inhibition exerted by VGAM2599 gene, herein designated VGAM GENE, on one or more VGAM2599 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world’, Science 294,779 (2001)).

It is yet further appreciated that a function of VGAM2599 is inhibition of expression of host target genes, as part of a novel viral mechanism of attacking a host. Accordingly, utilities of VGAM2599 include diagnosis, prevention and treatment of viral infection by Obuda Pepper Virus. Specific functions, and accordingly utilities, of VGAM2599 correlate with, and may be deduced from, the identity of the host target genes which VGAM2599 binds and inhibits, and the function of these host target genes, as elaborated hereinbelow.

Nucleotide sequences of the VGAM2599 precursor RNA, herein designated VGAM PRECURSOR RNA, and of the ‘diced’ VGAM2599 RNA, herein designated VGAM RNA, and a schematic representation of the secondary folding of VGAM2599 folded precursor RNA, herein designated VGAM FOLDED PRECURSOR RNA, of VGAM2599 are further described hereinbelow with reference to Table 1.

Nucleotide sequences of host target binding sites, such as BINDING SITE-I, BINDING SITE-II and BINDING SITE-III of FIG. 1, found on VGAM2599 host target RNA, and schematic representation of the complementarity of each of these host target binding sites to VGAM2599 RNA, herein designated VGAM RNA, are described hereinbelow with reference to Table 2.

As mentioned hereinabove with reference to FIG. 1, a function of VGAM2599 gene, herein designated VGAM is inhibition of expression of VGAM2599 target genes. It is appreciated that specific functions, and accordingly utilities, of VGAM2599 correlate with, and may be deduced from, the identity of the target genes which VGAM2599 binds and inhibits, and the function of these target genes, as elaborated hereinbelow.

Restin (Reed-Steinberg cell-expressed intermediate filament-associated protein) (RSN, Accession NM_002956) is a VGAM2599 host target gene. RSN BINDING SITE is HOST TARGET binding site found in the 3' untranslated region of mRNA encoded by RSN, corresponding to a HOST TARGET binding site such as BINDING SITE I, BINDING SITE II or BINDING SITE III. Table 2 illustrates the complementarity of the nucleotide sequences of RSN BINDING SITE, designated SEQ ID:8865, to the nucleotide sequence of VGAM2599 RNA, herein designated VGAM RNA, also designated SEQ ID:5310.

A function of VGAM2599 is therefore inhibition of Restin (Reed-Steinberg cell-expressed intermediate filament-associated protein) (RSN, Accession NM_002956), a gene which seems to be a intermediate filament associated protein that links endocytic vesicles to microtubules. Accordingly, utilities of VGAM2599 include diagnosis, prevention and treatment of diseases and clinical conditions associated with RSN. The function of RSN and its association with various diseases and clinical conditions, has been established by previous studies, as described hereinabove with reference to VGAM1086. BY55 (Accession XM_001667) is another VGAM2599 host target gene. BY55 BINDING SITE is HOST TARGET binding site found in the 3' untranslated region of mRNA encoded by BY55, corresponding to a HOST TARGET binding site such as BINDING SITE I, BINDING SITE II or BINDING SITE III. Table 2 illustrates the complementarity of the nucleotide sequences of BY55 BINDING SITE, designated SEQ ID:29846, to the nucleotide sequence of VGAM2599 RNA, herein designated VGAM RNA, also designated SEQ ID:5310.

Another function of VGAM2599 is therefore inhibition of BY55 (Accession XM_001667). Accordingly, utilities of VGAM2599 include diagnosis, prevention and treatment of diseases and clinical conditions associated with BY55. FLJ13340 (Accession NM_057175) is another VGAM2599 host target gene. FLJ13340 BINDING SITE is HOST TARGET binding site found in the 3' untranslated region of mRNA encoded by FLJ13340, corresponding to a HOST TARGET binding site such as BINDING SITE I, BINDING SITE II or BINDING SITE III. Table 2 illustrates the complementarity of the nucleotide sequences of FLJ13340 BINDING SITE, designated SEQ ID:27707, to the nucleotide sequence of VGAM2599 RNA, herein designated VGAM RNA, also designated SEQ ID:5310.

Another function of VGAM2599 is therefore inhibition of FLJ13340 (Accession NM_057175). Accordingly, utilities of VGAM2599 include diagnosis, prevention and treatment of diseases and clinical conditions associated with FLJ13340. KIAA0092 (Accession NM_014679) is another VGAM2599 host target gene. KIAA0092 BINDING SITE is HOST TARGET binding site found in the 3' untranslated region of mRNA encoded by KIAA0092, corresponding to a HOST TARGET binding site such as BINDING SITE I, BINDING SITE II or BINDING SITE III. Table 2 illustrates the complementarity of the nucleotide sequences of KIAA0092 BINDING SITE, designated SEQ ID:16154, to the nucleotide sequence of VGAM2599 RNA, herein designated VGAM RNA, also designated SEQ ID:5310.

Another function of VGAM2599 is therefore inhibition of KIAA0092 (Accession NM_014679). Accordingly, utilities of VGAM2599 include diagnosis, prevention and treatment of diseases and clinical conditions associated with KIAA0092. KIAA1361 (Accession XM_030845) is another VGAM2599 host target gene. KIAA1361 BINDING SITE is HOST TARGET binding site found in the 3' untranslated region of mRNA encoded by KIAA1361, corresponding to a HOST TARGET binding site such as BINDING SITE I, BINDING SITE II or BINDING SITE III. Table 2 illustrates the complementarity of the nucleotide sequences of KIAA1361 BINDING SITE, designated SEQ ID:31167, to the nucleotide sequence of VGAM2599 RNA, herein designated VGAM RNA, also designated SEQ ID:5310.

Another function of VGAM2599 is therefore inhibition of KIAA1361 (Accession XM_030845). Accordingly, utilities of VGAM2599 include diagnosis, prevention and treatment of diseases and clinical conditions associated with KIAA1361. Karyopherin (importin) Beta 3 (KPNB3, Accession NM_002271) is another VGAM2599 host target gene. KPNB3 BINDING SITE is HOST TARGET binding site found in the 3' untranslated region of mRNA encoded by KPNB3, corresponding to a HOST TARGET binding site such as BINDING SITE I, BINDING SITE II or BINDING SITE III. Table 2 illustrates the complementarity of the nucleotide sequences of KPNB3 BINDING SITE, designated SEQ ID:8062, to the nucleotide sequence of VGAM2599 RNA, herein designated VGAM RNA, also designated SEQ ID:5310.

Another function of VGAM2599 is therefore inhibition of Karyopherin (importin) Beta 3 (KPNB3, Accession NM_002271). Accordingly, utilities of VGAM2599 include diagnosis, prevention and treatment of diseases and clinical conditions associated with KPNB3. OSF-2 (Accession NM_006475) is another VGAM2599 host target gene. OSF-2 BINDING SITE is HOST TARGET binding site found in the 3' untranslated region of mRNA encoded by OSF-2, corresponding to a HOST TARGET binding site such as BINDING SITE I, BINDING SITE II or BINDING SITE III. Table 2 illustrates the complementarity of the nucleotide sequences of OSF-2 BINDING SITE, designated SEQ ID:13198, to the nucleotide sequence of VGAM2599 RNA, herein designated VGAM RNA, also designated SEQ ID:5310.

Another function of VGAM2599 is therefore inhibition of OSF-2 (Accession NM_006475). Accordingly, utilities of VGAM2599 include diagnosis, prevention and treatment of diseases and clinical conditions associated with OSF-2. TBDN100 (Accession NM_025085) is another VGAM2599 host target gene. TBDN100 BINDING SITE is HOST TARGET binding site found in the 3' untranslated region of mRNA encoded by TBDN100, corresponding to a HOST TARGET binding site such as BINDING SITE I, BINDING SITE II or BINDING SITE III. Table 2 illustrates the complementarity of the nucleotide sequences of TBDN100 BINDING SITE, designated SEQ ID:24698, to the nucleotide sequence of VGAM2599 RNA, herein designated VGAM RNA, also designated SEQ ID:5310.

Another function of VGAM2599 is therefore inhibition of TBDN100 (Accession NM_025085). Accordingly, utilities of VGAM2599 include diagnosis, prevention and treatment of diseases and clinical conditions associated with TBDN100. Thioesterase, Adipose Associated (THEA, Accession XM_038922) is another VGAM2599 host target gene. THEA BINDING SITE is HOST TARGET binding site found in the 3' untranslated region of mRNA encoded by THEA, corresponding to a HOST TARGET binding site such as BINDING SITE I, BINDING SITE II or BINDING SITE III. Table 2 illustrates the complementarity of the nucleotide sequences of THEA BINDING SITE, designated SEQ ID:32953, to the nucleotide sequence of VGAM2599 RNA, herein designated VGAM RNA, also designated SEQ ID:5310.

Another function of VGAM2599 is therefore inhibition of Thioesterase, Adipose Associated (THEA, Accession XM_038922). Accordingly, utilities of VGAM2599 include diagnosis, prevention and treatment of diseases and clinical conditions associated with THEA. LOC221431 (Accession XM_166380) is another VGAM2599 host target gene. LOC221431 BINDING SITE is HOST TARGET binding site found in the 3' untranslated region of mRNA encoded by LOC221431, corresponding to a HOST TARGET binding site such as BINDING SITE I, BINDING SITE II or BINDING SITE III. Table 2 illustrates the complementarity of the nucleotide sequences of LOC221431 BINDING SITE, designated SEQ ID:44223, to the nucleotide sequence of VGAM2599 RNA, herein designated VGAM RNA, also designated SEQ ID:5310.

Another function of VGAM2599 is therefore inhibition of LOC221431 (Accession XM_166380). Accordingly, utilities of VGAM2599 include diagnosis, prevention and treatment of diseases and clinical conditions associated with LOC221431. LOC255326 (Accession XM_172832) is another VGAM2599 host target gene. LOC255326 BINDING SITE is HOST TARGET binding site found in the 3' untranslated region of mRNA encoded by LOC255326, corresponding to a HOST TARGET binding site such as BINDING SITE I, BINDING SITE II or BINDING SITE III. Table 2 illustrates the complementarity of the nucleotide sequences of LOC255326 BINDING SITE, designated SEQ ID:46107, to the nucleotide sequence of VGAM2599 RNA, herein designated VGAM RNA, also designated SEQ ID:5310.

Another function of VGAM2599 is therefore inhibition of LOC255326 (Accession XM_172832). Accordingly, utilities of VGAM2599 include diagnosis, prevention and treatment of diseases and clinical conditions associated with LOC255326. FIG. 1 further provides a conceptual description of a novel bioinformatically detected viral gene of the present invention, referred to here as Viral Genomic Address Messenger 2600 (VGAM2600) viral gene, which modulates expression of respective host target genes thereof, the function and utility of which host target genes is known in the art.

VGAM2600 is a novel bioinformatically detected regulatory, non protein coding, viral micro RNA (miRNA) gene. The method by which VGAM2600 was detected is described hereinabove with reference to FIGS. 1-8.

VGAM2600 gene, herein designated VGAM GENE, is a viral gene contained in the genome of Obuda Pepper Virus. VGAM2600 host target gene, herein designated VGAM HOST TARGET GENE, is a human gene contained in the human genome.

VGAM2600 gene encodes a VGAM2600 precursor RNA, herein designated VGAM PRECURSOR RNA. Similar to other miRNA genes, and unlike most ordinary genes, VGAM2600 precursor RNA does not encode a protein. A nucleotide sequence identical or highly similar to the nucleotide sequence of VGAM2600 precursor RNA is designated SEQ ID:2586, and is provided hereinbelow with reference to the sequence listing part. Nucleotide sequence SEQ ID:2586 is located at position 1275 relative to the genome of Obuda Pepper Virus.

VGAM2600 precursor RNA folds onto itself, forming VGAM2600 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2600 folded precursor RNA into VGAM2600 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2600 RNA is designated SEQ ID:5311, and is provided hereinbelow with reference to the sequence listing part.

VGAM2600 host target gene, herein designated VGAM HOST TARGET GENE, encodes a corresponding messenger RNA, VGAM2600 host target RNA, herein designated VGAM HOST TARGET RNA. VGAM2600 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2600 RNA, herein designated VGAM RNA, binds complementarily to one or more host target binding sites located in untranslated regions of VGAM2600 host target RNA, herein designated VGAM HOST TARGET RNA. This complementary binding is due to the fact that the nucleotide sequence of VGAM2600 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2600 RNA, herein designated VGAM RNA, may have a different number of host target binding sites in untranslated regions of a VGAM2600 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2600 RNA, herein designated VGAM RNA, to host target binding sites on VGAM2600 host target RNA, herein designated VGAM HOST TARGET RNA, such as BINDING SITE I, BINDING SITE II and BINDING SITE III, inhibits translation of VGAM2600 host target RNA into VGAM2600 host target protein, herein designated VGAM HOST TARGET PROTEIN. VGAM host target protein is therefore outlined by a broken line.

It is appreciated that VGAM2600 host target gene, herein designated VGAM HOST TARGET GENE, in fact represents a plurality of VGAM2600 host target genes. The mRNA of each one of this plurality of VGAM2600 host target genes comprises one or more host target binding sites, each having a nucleotide sequence which is at least partly complementary to VGAM2600 RNA, herein designated VGAM RNA, and which when bound by VGAM2600 RNA causes inhibition of translation of respective one or more VGAM2600 host target proteins.

It is further appreciated by one skilled in the art that the mode of translational inhibition illustrated by FIG. 1 with specific reference to translational inhibition exerted by VGAM2600 gene, herein designated VGAM GENE, on one or more VGAM2600 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2600 is inhibition of expression of host target genes, as part of a novel viral mechanism of attacking a host. Accordingly, utilities of VGAM2600 include diagnosis, prevention and treatment of viral infection by Obuda Pepper Virus. Specific functions, and accordingly utilities, of VGAM2600 correlate with, and may be deduced from, the identity of the host target genes which VGAM2600 binds and inhibits, and the function of these host target genes, as elaborated hereinbelow.

Nucleotide sequences of the VGAM2600 precursor RNA, herein designated VGAM PRECURSOR RNA, and of the 'diced' VGAM2600 RNA, herein designated VGAM RNA, and a schematic representation of the secondary folding of VGAM2600 folded precursor RNA, herein designated VGAM FOLDED PRECURSOR RNA, of VGAM2600 are further described hereinbelow with reference to Table 1.

Nucleotide sequences of host target binding sites, such as BINDING SITE-I, BINDING SITE-II and BINDING SITE-III of FIG. 1, found on VGAM2600 host target RNA, and schematic representation of the complementarity of each of these host target binding sites to VGAM2600 RNA, herein designated VGAM RNA, are described hereinbelow with reference to Table 2.

As mentioned hereinabove with reference to FIG. 1, a function of VGAM2600 gene, herein designated VGAM is inhibition of expression of VGAM2600 target genes. It is appreciated that specific functions, and accordingly utilities, of VGAM2600 correlate with, and may be deduced from, the identity of the target genes which VGAM2600 binds and inhibits, and the function of these target genes, as elaborated hereinbelow.

Discs, Large (Drosophila) Homolog 5 (DLG5, Accession XM_096398) is a VGAM2600 host target gene. DLG5 BINDING SITE is HOST TARGET binding site found in the 5' untranslated region of mRNA encoded by DLG5, corresponding to a HOST TARGET binding site such as BINDING SITE I, BINDING SITE II or BINDING SITE III. Table 2 illustrates the complementarity of the nucleotide sequences of DLG5 BINDING SITE, designated SEQ ID:40333, to the nucleotide sequence of VGAM2600 RNA, herein designated VGAM RNA, also designated SEQ ID:5311.

A function of VGAM2600 is therefore inhibition of Discs, Large (Drosophila) Homolog 5 (DLG5, Accession XM_096398), a gene which may transmit extracellular signals to inhibit cell proliferation. Accordingly, utilities of VGAM2600 include diagnosis, prevention and treatment of diseases and clinical conditions associated with DLG5. The function of DLG5 and its association with various diseases and clinical conditions, has been established by previous studies, as described hereinabove with reference to VGAM444. Interleukin 2 Receptor, Beta (IL2RB, Accession NM_000878) is another VGAM2600 host target gene. IL2RB BINDING SITE is HOST TARGET binding site found in the 3' untranslated region of mRNA encoded by IL2RB, corresponding to a HOST TARGET binding site such as BINDING SITE I, BINDING SITE II or BINDING SITE III. Table 2 illustrates the complementarity of the nucleotide sequences of IL2RB BINDING SITE, designated SEQ ID:6569, to the nucleotide sequence of VGAM2600 RNA, herein designated VGAM RNA, also designated SEQ ID:5311.

Another function of VGAM2600 is therefore inhibition of Interleukin 2 Receptor, Beta (IL2RB, Accession NM_000878), a gene which is involved in receptor mediated endocytosis and transduces the mitogenic signals of il-2. Accordingly, utilities of VGAM2600 include diagnosis, prevention and treatment of diseases and clinical conditions associated with IL2RB. The function of IL2RB and its association with various diseases and clinical conditions, has been established by previous studies, as described hereinabove with reference to VGAM450. FLJ14075 (Accession NM_024894) is another VGAM2600 host target gene. FLJ14075 BINDING SITE is HOST TARGET binding site found in the 3' untranslated region of mRNA encoded by FLJ14075, corresponding to a HOST TARGET binding site such as BINDING SITE I, BINDING SITE II or BINDING SITE III. Table 2 illustrates the complementarity of the nucleotide sequences of FLJ14075 BINDING SITE, designated SEQ ID:24372, to the nucleotide sequence of VGAM2600 RNA, herein designated VGAM RNA, also designated SEQ ID:5311.

Another function of VGAM2600 is therefore inhibition of FLJ14075 (Accession NM_024894). Accordingly, utilities of VGAM2600 include diagnosis, prevention and treatment of diseases and clinical conditions associated with FLJ14075. MGC4707 (Accession NM_024113) is another VGAM2600 host target gene. MGC4707 BINDING SITE is HOST TARGET binding site found in the 3' untranslated region of mRNA encoded by MGC4707, corresponding to a HOST TARGET binding site such as BINDING SITE I, BINDING SITE II or BINDING SITE III. Table 2 illustrates the complementarity of the nucleotide sequences of MGC4707 BINDING SITE, designated SEQ ID:23562, to the nucleotide sequence of VGAM2600 RNA, herein designated VGAM RNA, also designated SEQ ID:5311.

Another function of VGAM2600 is therefore inhibition of MGC4707 (Accession NM_024113). Accordingly, utilities of VGAM2600 include diagnosis, prevention and treatment of diseases and clinical conditions associated with MGC4707. Netrin 4 (NTN4, Accession XM_031896) is another VGAM2600 host target gene. NTN4 BINDING SITE is HOST TARGET binding site found in the 3' untranslated region of mRNA encoded by NTN4, corresponding to a HOST TARGET binding site such as BINDING SITE I, BINDING SITE II or BINDING SITE III. Table 2 illustrates the complementarity of the nucleotide sequences of NTN4 BINDING SITE, designated SEQ ID:31510, to the nucleotide sequence of VGAM2600 RNA, herein designated VGAM RNA, also designated SEQ ID:5311.

Another function of VGAM2600 is therefore inhibition of Netrin 4 (NTN4, Accession XM_031896). Accordingly, utilities of VGAM2600 include diagnosis, prevention and treatment of diseases and clinical conditions associated with NTN4. LOC138429 (Accession XM_059973) is another VGAM2600 host target gene. LOC138429 BINDING SITE is HOST TARGET binding site found in the 3' untranslated region of mRNA encoded by LOC138429, corresponding to a HOST TARGET binding site such as BINDING SITE I, BINDING SITE II or BINDING SITE III. Table 2 illustrates the complementarity of the nucleotide sequences of LOC138429 BINDING SITE, designated SEQ ID:37134, to the nucleotide sequence of VGAM2600 RNA, herein designated VGAM RNA, also designated SEQ ID:5311.

Another function of VGAM2600 is therefore inhibition of LOC138429 (Accession XM_059973). Accordingly, utilities of VGAM2600 include diagnosis, prevention and treatment of diseases and clinical conditions associated with LOC138429. FIG. 1 further provides a conceptual description of a novel bioinformatically detected viral gene of the present invention, referred to here as Viral Genomic Address Messenger 2601 (VGAM2601) viral gene, which modulates expression of respective host target genes thereof, the function and utility of which host target genes is known in the art.

VGAM2601 is a novel bioinformatically detected regulatory, non protein coding, viral micro RNA (miRNA) gene. The method by which VGAM2601 was detected is described hereinabove with reference to FIGS. 1-8.

VGAM2601 gene, herein designated VGAM GENE, is a viral gene contained in the genome of Obuda Pepper Virus. VGAM2601 host target gene, herein designated VGAM HOST TARGET GENE, is a human gene contained in the human genome.

VGAM2601 gene encodes a VGAM2601 precursor RNA, herein designated VGAM PRECURSOR RNA. Similar to other miRNA genes, and unlike most ordinary genes, VGAM2601 precursor RNA does not encode a protein. A nucleotide sequence identical or highly similar to the nucleotide sequence of VGAM2601 precursor RNA is designated SEQ ID:2587, and is provided hereinbelow with reference to the sequence listing part. Nucleotide sequence SEQ ID:2587 is located at position 589 relative to the genome of Obuda Pepper Virus.

VGAM2601 precursor RNA folds onto itself, forming VGAM2601 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2601 folded precursor RNA into VGAM2601 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 92%) nucleotide sequence of VGAM2601 RNA is designated SEQ ID:5312, and is provided hereinbelow with reference to the sequence listing part.

VGAM2601 host target gene, herein designated VGAM HOST TARGET GENE, encodes a corresponding messenger RNA, VGAM2601 host target RNA, herein designated VGAM HOST TARGET RNA. VGAM2601 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2601 RNA, herein designated VGAM RNA, binds complementarily to one or more host target binding sites located in untranslated regions of VGAM2601 host target RNA, herein designated VGAM HOST TARGET RNA. This complementary binding is due to the fact that the nucleotide sequence of VGAM2601 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2601 RNA, herein designated VGAM RNA, may have a different number of host target binding sites in untranslated regions of a VGAM2601 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2601 RNA, herein designated VGAM RNA, to host target binding sites on VGAM2601 host target RNA, herein designated VGAM HOST TARGET RNA, such as BINDING SITE I, BINDING SITE II and BINDING SITE III, inhibits translation of VGAM2601 host target RNA into VGAM2601 host target protein, herein designated VGAM HOST TARGET PROTEIN. VGAM host target protein is therefore outlined by a broken line.

It is appreciated that VGAM2601 host target gene, herein designated VGAM HOST TARGET GENE, in fact represents a plurality of VGAM2601 host target genes. The mRNA of each one of this plurality of VGAM2601 host target genes comprises one or more host target binding sites, each having a nucleotide sequence which is at least partly complementary to VGAM2601 RNA, herein designated VGAM RNA, and which when bound by VGAM2601 RNA causes inhibition of translation of respective one or more VGAM2601 host target proteins.

It is further appreciated by one skilled in the art that the mode of translational inhibition illustrated by FIG. 1 with specific reference to translational inhibition exerted by VGAM2601 gene, herein designated VGAM GENE, on one or more VGAM2601 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2601 is inhibition of expression of host target genes, as part of a novel viral mechanism of attacking a host. Accordingly, utilities of VGAM2601 include diagnosis, prevention and treatment of viral infection by Obuda Pepper Virus. Specific functions, and accordingly utilities, of VGAM2601 correlate with, and may be deduced from, the identity of the host target genes which VGAM2601 binds and inhibits, and the function of these host target genes, as elaborated hereinbelow.

Nucleotide sequences of the VGAM2601 precursor RNA, herein designated VGAM PRECURSOR RNA, and of the 'diced' VGAM2601 RNA, herein designated VGAM RNA, and a schematic representation of the secondary folding of VGAM2601 folded precursor RNA, herein designated VGAM FOLDED PRECURSOR RNA, of VGAM2601 are further described hereinbelow with reference to Table 1.

Nucleotide sequences of host target binding sites, such as BINDING SITE-I, BINDING SITE-II and BINDING SITE-III of FIG. 1, found on VGAM2601 host target RNA, and schematic representation of the complementarity of each of these host target binding sites to VGAM2601 RNA, herein designated VGAM RNA, are described hereinbelow with reference to Table 2.

As mentioned hereinabove with reference to FIG. 1, a function of VGAM2601 gene, herein designated VGAM is inhibition of expression of VGAM2601 target genes. It is appreciated that specific functions, and accordingly utilities, of VGAM2601 correlate with, and may be deduced from, the identity of the target genes which VGAM2601 binds and inhibits, and the function of these target genes, as elaborated hereinbelow.

DKFZp761N1114 (Accession XM_086327) is a VGAM2601 host target gene. DKFZp761N1114 BINDING SITE is HOST TARGET binding site found in the 3' untranslated region of mRNA encoded by DKFZp761N1114, corresponding to a HOST TARGET binding site such as BINDING SITE I, BINDING SITE II or BINDING SITE III. Table 2 illustrates the complementarity of the nucleotide sequences of DKFZp761N1114 BINDING SITE, designated SEQ ID:38602, to the nucleotide sequence of VGAM2601 RNA, herein designated VGAM RNA, also designated SEQ ID:5312.

A function of VGAM2601 is therefore inhibition of DKFZp761N1114 (Accession XM_086327). Accordingly, utilities of VGAM2601 include diagnosis, prevention and treatment of diseases and clinical conditions associated with DKFZp761N1114. PRO2949 (Accession NM_018544) is another VGAM2601 host target gene. PRO2949 BINDING SITE is HOST TARGET binding site found in the 3' untranslated region of mRNA encoded by PRO2949, corresponding to a HOST TARGET binding site such as BINDING SITE I, BINDING SITE II or BINDING SITE III. Table 2 illustrates the complementarity of the nucleotide sequences of PRO2949 BINDING SITE, designated SEQ ID:20618, to the nucleotide sequence of VGAM2601 RNA, herein designated VGAM RNA, also designated SEQ ID:5312.

Another function of VGAM2601 is therefore inhibition of PRO2949 (Accession NM_018544). Accordingly, utilities of VGAM2601 include diagnosis, prevention and treatment of diseases and clinical conditions associated with PRO2949. LOC147991 (Accession XM_085993) is another VGAM2601 host target gene. LOC147991 BINDING SITE is HOST TARGET binding site found in the 5' untranslated region of mRNA encoded by LOC147991, corresponding to a HOST TARGET binding site such as BINDING SITE I, BINDING SITE II or BINDING SITE III. Table 2 illustrates the complementarity of the nucleotide sequences of LOC147991 BINDING SITE, designated SEQ ID:38433, to the nucleotide sequence of VGAM2601 RNA, herein designated VGAM RNA, also designated SEQ ID:5312.

Another function of VGAM2601 is therefore inhibition of LOC147991 (Accession XM_085993). Accordingly, utilities of VGAM2601 include diagnosis, prevention and treatment of diseases and clinical conditions associated with LOC147991. FIG. 1 further provides a conceptual description of a novel bioinformatically detected viral gene of the present invention, referred to here as Viral Genomic Address Messenger 2602 (VGAM2602) viral gene, which modulates expression of respective host target genes thereof, the function and utility of which host target genes is known in the art.

VGAM2602 is a novel bioinformatically detected regulatory, non protein coding, viral micro RNA (miRNA) gene. The method by which VGAM2602 was detected is described hereinabove with reference to FIGS. 1-8.

VGAM2602 gene, herein designated VGAM GENE, is a viral gene contained in the genome of Obuda Pepper Virus. VGAM2602 host target gene, herein designated VGAM HOST TARGET GENE, is a human gene contained in the human genome.

VGAM2602 gene encodes a VGAM2602 precursor RNA, herein designated VGAM PRECURSOR RNA. Similar to other miRNA genes, and unlike most ordinary genes, VGAM2602 precursor RNA does not encode a protein. A nucleotide sequence identical or highly similar to the nucleotide sequence of VGAM2602 precursor RNA is designated SEQ ID:2588, and is provided hereinbelow with reference to the sequence listing part. Nucleotide sequence SEQ ID:2588 is located at position 2115 relative to the genome of Obuda Pepper Virus.

VGAM2602 precursor RNA folds onto itself, forming VGAM2602 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2602 folded precursor RNA into VGAM2602 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2602 RNA is designated SEQ ID:5313, and is provided hereinbelow with reference to the sequence listing part.

VGAM2602 host target gene, herein designated VGAM HOST TARGET GENE, encodes a corresponding messenger RNA, VGAM2602 host target RNA, herein designated VGAM HOST TARGET RNA. VGAM2602 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2602 RNA, herein designated VGAM RNA, binds complementarily to one or more host target binding sites located in untranslated regions of VGAM2602 host target RNA, herein designated VGAM HOST TARGET RNA. This complementary binding is due to the fact that the nucleotide sequence of VGAM2602 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2602 RNA, herein designated VGAM RNA, may have a different number of host target binding sites in untranslated regions of a VGAM2602 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2602 RNA, herein designated VGAM RNA, to host target binding sites on VGAM2602 host target RNA, herein designated VGAM HOST TARGET RNA, such as BINDING SITE I, BINDING SITE II and BINDING SITE III, inhibits translation of VGAM2602 host target RNA into VGAM2602 host target protein, herein designated VGAM HOST TARGET PROTEIN. VGAM host target protein is therefore outlined by a broken line.

It is appreciated that VGAM2602 host target gene, herein designated VGAM HOST TARGET GENE, in fact represents a plurality of VGAM2602 host target genes. The mRNA of each one of this plurality of VGAM2602 host target genes comprises one or more host target binding sites, each having a nucleotide sequence which is at least partly complementary to VGAM2602 RNA, herein designated VGAM RNA, and which when bound by VGAM2602 RNA causes inhibition of translation of respective one or more VGAM2602 host target proteins.

It is further appreciated by one skilled in the art that the mode of translational inhibition illustrated by FIG. 1 with specific reference to translational inhibition exerted by VGAM2602 gene, herein designated VGAM GENE, on one or more VGAM2602 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2602 is inhibition of expression of host target genes, as part of a novel viral mechanism of attacking a host. Accordingly, utilities of VGAM2602 include diagnosis, prevention and treatment of viral infection by Obuda Pepper Virus. Specific functions, and accordingly utilities, of VGAM2602 correlate with, and may be deduced from, the identity of the host target genes which VGAM2602 binds and inhibits, and the function of these host target genes, as elaborated hereinbelow.

Nucleotide sequences of the VGAM2602 precursor RNA, herein designated VGAM PRECURSOR RNA, and of the 'diced' VGAM2602 RNA, herein designated VGAM RNA, and a schematic representation of the secondary folding of VGAM2602 folded precursor RNA, herein designated VGAM FOLDED PRECURSOR RNA, of VGAM2602 are further described hereinbelow with reference to Table 1.

Nucleotide sequences of host target binding sites, such as BINDING SITE-I, BINDING SITE-II and BINDING SITE-III of FIG. 1, found on VGAM2602 host target RNA, and schematic representation of the complementarity of each of these host target binding sites to VGAM2602 RNA, herein designated VGAM RNA, are described hereinbelow with reference to Table 2.

As mentioned hereinabove with reference to FIG. 1, a function of VGAM2602 gene, herein designated VGAM is inhibition of expression of VGAM2602 target genes. It is appreciated that specific functions, and accordingly utilities, of VGAM2602 correlate with, and may be deduced from, the identity of the target genes which VGAM2602 binds and inhibits, and the function of these target genes, as elaborated hereinbelow.

Replication Factor C (activator 1) 1, 145 kDa (RFC1, Accession NM_002913) is a VGAM2602 host target gene. RFC1 BINDING SITE is HOST TARGET binding site found in the 5' untranslated region of mRNA encoded by RFC1, corresponding to a HOST TARGET binding site such as BINDING SITE I, BINDING SITE II or BINDING SITE III. Table 2 illustrates the complementarity of the nucleotide sequences of RFC1 BINDING SITE, designated SEQ ID:8819, to the nucleotide sequence of VGAM2602 RNA, herein designated VGAM RNA, also designated SEQ ID:5313.

A function of VGAM2602 is therefore inhibition of Replication Factor C (activator 1) 1, 145 kDa (RFC1, Accession NM_002913), a gene which plays a role in dna transcription, replication and/or repair. Accordingly, utilities of VGAM2602 include diagnosis, prevention and treatment of diseases and clinical conditions associated with RFC1. The function of RFC1 and its association with various diseases and clinical conditions, has been established by previous studies, as described hereinabove with reference to VGAM217. LOC90917 (Accession XM_034861) is another VGAM2602 host target gene. LOC90917 BINDING SITE is HOST TARGET binding site found in the 3' untranslated region of mRNA encoded by LOC90917, corresponding to a HOST TARGET binding site such as BINDING SITE I, BINDING SITE II or BINDING SITE III. Table 2 illustrates the complementarity of the nucleotide sequences of LOC90917 BINDING SITE, designated SEQ ID:32172, to the nucleotide sequence of VGAM2602 RNA, herein designated VGAM RNA, also designated SEQ ID:5313.

Another function of VGAM2602 is therefore inhibition of LOC90917 (Accession XM_034861). Accordingly, utilities of VGAM2602 include diagnosis, prevention and treatment of diseases and clinical conditions associated with LOC90917. FIG. 1 further provides a conceptual description of a novel bioinformatically detected viral gene of the present invention, referred to here as Viral Genomic Address Messenger 2603 (VGAM2603) viral gene, which modulates expression of respective host target genes thereof, the function and utility of which host target genes is known in the art.

VGAM2603 is a novel bioinformatically detected regulatory, non protein coding, viral micro RNA (miRNA) gene. The method by which VGAM2603 was detected is described hereinabove with reference to FIGS. 1-8.

VGAM2603 gene, herein designated VGAM GENE, is a viral gene contained in the genome of Sugarcane Striate Mosaic Associated Virus. VGAM2603 host target gene, herein designated VGAM HOST TARGET GENE, is a human gene contained in the human genome.

VGAM2603 gene encodes a VGAM2603 precursor RNA, herein designated VGAM PRECURSOR RNA. Similar to other miRNA genes, and unlike most ordinary genes, VGAM2603 precursor RNA does not encode a protein. A nucleotide sequence identical or highly similar to the nucleotide sequence of VGAM2603 precursor RNA is designated SEQ ID:2589, and is provided hereinbelow with reference to the sequence listing part. Nucleotide sequence SEQ ID:2589 is located at position 5796 relative to the genome of Sugarcane Striate Mosaic Associated Virus.

VGAM2603 precursor RNA folds onto itself, forming VGAM2603 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2603 folded precursor RNA into VGAM2603 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM2603 RNA is designated SEQ ID:5314, and is provided hereinbelow with reference to the sequence listing part.

VGAM2603 host target gene, herein designated VGAM HOST TARGET GENE, encodes a corresponding messenger RNA, VGAM2603 host target RNA, herein designated VGAM HOST TARGET RNA. VGAM2603 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2603 RNA, herein designated VGAM RNA, binds complementarily to one or more host target binding sites located in untranslated regions of VGAM2603 host target RNA, herein designated VGAM HOST TARGET RNA. This complementary binding is due to the fact that the nucleotide sequence of VGAM2603 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2603 RNA, herein designated VGAM RNA, may have a different number of host target binding sites in untranslated regions of a VGAM2603 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2603 RNA, herein designated VGAM RNA, to host target binding sites on VGAM2603 host target RNA, herein designated VGAM HOST TARGET RNA, such as BINDING SITE I, BINDING SITE II and BINDING SITE III, inhibits translation of VGAM2603 host target RNA into VGAM2603 host target protein, herein designated VGAM HOST TARGET PROTEIN. VGAM host target protein is therefore outlined by a broken line.

It is appreciated that VGAM2603 host target gene, herein designated VGAM HOST TARGET GENE, in fact represents a plurality of VGAM2603 host target genes. The mRNA of each one of this plurality of VGAM2603 host target genes comprises one or more host target binding sites, each having a nucleotide sequence which is at least partly complementary to VGAM2603 RNA, herein designated VGAM RNA, and which when bound by VGAM2603 RNA causes inhibition of translation of respective one or more VGAM2603 host target proteins.

It is further appreciated by one skilled in the art that the mode of translational inhibition illustrated by FIG. 1 with specific reference to translational inhibition exerted by VGAM2603 gene, herein designated VGAM GENE, on one or more VGAM2603 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2603 is inhibition of expression of host target genes, as part of a novel viral mechanism of attacking a host. Accordingly, utilities of VGAM2603 include diagnosis, prevention and treatment of viral infection by Sugarcane Striate Mosaic Associated Virus. Specific functions, and accordingly utilities, of VGAM2603 correlate with, and may be deduced from, the identity of the host target genes which VGAM2603 binds and inhibits, and the function of these host target genes, as elaborated hereinbelow.

Nucleotide sequences of the VGAM2603 precursor RNA, herein designated VGAM PRECURSOR RNA, and of the 'diced' VGAM2603 RNA, herein designated VGAM RNA, and a schematic representation of the secondary folding of VGAM2603 folded precursor RNA, herein designated VGAM FOLDED PRECURSOR RNA, of VGAM2603 are further described hereinbelow with reference to Table 1.

Nucleotide sequences of host target binding sites, such as BINDING SITE-I, BINDING SITE-II and BINDING SITE-III of FIG. 1, found on VGAM2603 host target RNA, and schematic representation of the complementarity of each of these host target binding sites to VGAM2603 RNA, herein designated VGAM RNA, are described hereinbelow with reference to Table 2.

As mentioned hereinabove with reference to FIG. 1, a function of VGAM2603 gene, herein designated VGAM is inhibition of expression of VGAM2603 target genes. It is appreciated that specific functions, and accordingly utilities, of VGAM2603 correlate with, and may be deduced from, the identity of the target genes which VGAM2603 binds and inhibits, and the function of these target genes, as elaborated hereinbelow.

Alcohol Dehydrogenase 5 (class III), Chi Polypeptide (ADH5, Accession NM_000671) is a VGAM2603 host target gene. ADH5 BINDING SITE is HOST TARGET binding site found in the 3' untranslated region of mRNA encoded by ADH5, corresponding to a HOST TARGET binding site such as BINDING SITE I, BINDING SITE II or BINDING SITE III. Table 2 illustrates the complementarity of the nucleotide sequences of ADH5 BINDING SITE, designated SEQ ID:6325, to the nucleotide sequence of VGAM2603 RNA, herein designated VGAM RNA, also designated SEQ ID:5314.

A function of VGAM2603 is therefore inhibition of Alcohol Dehydrogenase 5 (class III), Chi Polypeptide (ADH5, Accession NM_000671), a gene which oxidizes ethanol and activated by fatty acids. It oxidizes ethanol very poorly. Accordingly, utilities of VGAM2603 include diagnosis, prevention and treatment of diseases and clinical conditions associated with ADH5. The function of ADH5 and its association with various diseases and clinical conditions, has been established by previous studies, as described hereinabove with reference to VGAM438. Formyl Peptide Receptor-like 1 (FPRL1, Accession NM_001462) is another VGAM2603 host target gene. FPRL1 BINDING SITE is HOST TARGET binding site found in the 3' untranslated region of mRNA encoded by FPRL1, corresponding to a HOST TARGET binding site such as BINDING SITE I, BINDING SITE II or BINDING SITE III. Table 2 illustrates the complementarity of the nucleotide sequences of FPRL1 BINDING SITE, designated SEQ ID:7197, to the nucleotide sequence of VGAM2603 RNA, herein designated VGAM RNA, also designated SEQ ID:5314.

Another function of VGAM2603 is therefore inhibition of Formyl Peptide Receptor-like 1 (FPRL1, Accession NM_001462). Accordingly, utilities of VGAM2603 include diagnosis, prevention and treatment of diseases and clinical conditions associated with FPRL1. Peptidylprolyl Isomerase F (cyclophilin F) (PPIF, Accession NM_005729) is another VGAM2603 host target gene. PPIF BINDING SITE is HOST TARGET binding site found in the 3' untranslated region of mRNA encoded by PPIF, corresponding to a HOST TARGET binding site such as BINDING SITE I, BINDING SITE II or BINDING SITE III. Table 2 illustrates the complementarity of the nucleotide sequences of PPIF BINDING SITE, designated SEQ ID:12285, to the nucleotide sequence of VGAM2603 RNA, herein designated VGAM RNA, also designated SEQ ID:5314.

Another function of VGAM2603 is therefore inhibition of Peptidylprolyl Isomerase F (cyclophilin F) (PPIF, Accession NM_005729), a gene which catalyzes the cis to trans isomerization of certain proline imidic peptide bonds in oligopeptides. Accordingly, utilities of VGAM2603 include diagnosis, prevention and treatment of diseases and clinical conditions associated with PPIF. The function of PPIF and its association with various diseases and clinical conditions, has been established by previous studies, as described hereinabove with reference to VGAM251. Protein Tyrosine Phosphatase Type IVA, Member 2 (PTP4A2, Accession NM_003479) is another VGAM2603 host target gene. PTP4A2 BINDING SITE is HOST TARGET binding site found in the 3' untranslated region of mRNA encoded by PTP4A2, corresponding to a HOST TARGET binding site such as BINDING SITE I, BINDING SITE II or BINDING SITE III. Table 2 illustrates the complementarity of the nucleotide sequences of PTP4A2 BINDING SITE, designated SEQ ID:9556, to the nucleotide sequence of VGAM2603 RNA, herein designated VGAM RNA, also designated SEQ ID:5314.

Another function of VGAM2603 is therefore inhibition of Protein Tyrosine Phosphatase Type IVA, Member 2 (PTP4A2, Accession NM_003479), a gene which is a protein tyrosine phosphatase which has a C-terminal prenylation site. Accordingly, utilities of VGAM2603 include diagnosis, prevention and treatment of diseases and clinical conditions associated with PTP4A2. The function of PTP4A2 and its association with various diseases and clinical conditions, has been established by previous studies, as described hereinabove with reference to VGAM217. KIAA0565 (Accession XM_039912) is another VGAM2603 host target gene. KIAA0565 BINDING SITE is HOST TARGET binding site found in the 3' untranslated region of mRNA encoded by KIAA0565, corresponding to a HOST TARGET binding site such as BINDING SITE I, BINDING SITE II or BINDING SITE III. Table 2 illustrates the complementarity of the nucleotide sequences of KIAA0565 BINDING SITE, designated SEQ ID:33223, to the nucleotide sequence of VGAM2603 RNA, herein designated VGAM RNA, also designated SEQ ID:5314.

Another function of VGAM2603 is therefore inhibition of KIAA0565 (Accession XM_039912). Accordingly, utilities of VGAM2603 include diagnosis, prevention and treatment of diseases and clinical conditions associated with KIAA0565. NIMA (never in mitosis gene a)-related Kinase 1 (NEK1, Accession XM_171077) is another VGAM2603 host target gene. NEK1 BINDING SITE is HOST TARGET binding site found in the 3' untranslated region of mRNA encoded by NEK1, corresponding to a HOST TARGET binding site such as BINDING SITE I, BINDING SITE II or BINDING SITE III. Table 2 illustrates the complementarity of the nucleotide sequences of NEK1 BINDING SITE, designated SEQ ID:45885, to the nucleotide sequence of VGAM2603 RNA, herein designated VGAM RNA, also designated SEQ ID:5314.

Another function of VGAM2603 is therefore inhibition of NIMA (never in mitosis gene a)-related Kinase 1 (NEK1, Accession XM_171077). Accordingly, utilities of VGAM2603 include diagnosis, prevention and treatment of diseases and clinical conditions associated with NEK1. RAB40C, Member RAS Oncogene Family (RAB40C, Accession NM_021168) is another VGAM2603 host target gene. RAB40C BINDING SITE is HOST TARGET binding site found in the 3' untranslated region of mRNA encoded by RAB40C, corresponding to a HOST TARGET binding site such as BINDING SITE I, BINDING SITE II or BINDING SITE III. Table 2 illustrates the complementarity of the nucleotide sequences of RAB40C BINDING SITE, designated SEQ ID:22148, to the nucleotide sequence of VGAM2603 RNA, herein designated VGAM RNA, also designated SEQ ID:5314.

Another function of VGAM2603 is therefore inhibition of RAB40C, Member RAS Oncogene Family (RAB40C, Accession NM_021168). Accordingly, utilities of VGAM2603 include diagnosis, prevention and treatment of diseases and clinical conditions associated with RAB40C. SH3 Domain Binding Glutamic Acid-rich Protein Like 2 (SH3BGRL2, Accession NM_031469) is another VGAM2603 host target gene. SH3BGRL2 BINDING SITE is HOST TARGET binding site found in the 3' untranslated region of mRNA encoded by SH3BGRL2, corresponding to a HOST TARGET binding site such as BINDING SITE I, BINDING SITE II or BINDING SITE III. Table 2 illustrates the complementarity of the nucleotide sequences of SH3BGRL2 BINDING SITE, designated SEQ ID:25534, to the nucleotide sequence of VGAM2603 RNA, herein designated VGAM RNA, also designated SEQ ID:5314.

Another function of VGAM2603 is therefore inhibition of SH3 Domain Binding Glutamic Acid-rich Protein Like 2 (SH3BGRL2, Accession NM_031469). Accordingly, utilities of VGAM2603 include diagnosis, prevention and treatment of diseases and clinical conditions associated with SH3BGRL2. Syntaxin 12 (STX12, Accession XM_039018) is another VGAM2603 host target gene. STX12 BINDING SITE is HOST TARGET binding site found in the 3' untranslated region of mRNA encoded by STX12, corresponding to a HOST TARGET binding site such as BINDING SITE I, BINDING SITE II or BINDING SITE III. Table 2 illustrates the complementarity of the nucleotide sequences of STX12 BINDING SITE, designated SEQ ID:32985, to the nucleotide sequence of VGAM2603 RNA, herein designated VGAM RNA, also designated SEQ ID:5314.

Another function of VGAM2603 is therefore inhibition of Syntaxin 12 (STX12, Accession XM_039018). Accordingly, utilities of VGAM2603 include diagnosis, prevention and treatment of diseases and clinical conditions associated with STX12. TRIP-Br2 (Accession NM_014755) is another VGAM2603 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16481, to the nucleotide sequence of VGAM2603 RNA, herein designated VGAM RNA, also designated SEQ ID:5314.

Another function of VGAM2603 is therefore inhibition of TRIP-Br2 (Accession NM_014755). Accordingly, utilities of VGAM2603 include diagnosis, prevention and treatment of diseases and clinical conditions associated with TRIP-Br2. LOC256207 (Accession XM_170837) is another VGAM2603 host target gene. LOC256207 BINDING SITE is HOST TARGET binding site found in the 3' untranslated region of mRNA encoded by LOC256207, corresponding to a HOST TARGET binding site such as BINDING SITE I, BINDING SITE II or BINDING SITE III. Table 2 illustrates the complementarity of the nucleotide sequences of LOC256207 BINDING SITE, designated SEQ ID:45623, to the nucleotide sequence of VGAM2603 RNA, herein designated VGAM RNA, also designated SEQ ID:5314.

Another function of VGAM2603 is therefore inhibition of LOC256207 (Accession XM_170837). Accordingly, utilities of VGAM2603 include diagnosis, prevention and treatment of diseases and clinical conditions associated with LOC256207. LOC92597 (Accession XM_046066) is another VGAM2603 host target gene. LOC92597 BINDING SITE is HOST TARGET binding site found in the 3' untranslated region of mRNA encoded by LOC92597, corresponding to a HOST TARGET binding site such as BINDING SITE I, BINDING SITE II or BINDING SITE III. Table 2 illustrates the complementarity of the nucleotide sequences of LOC92597 BINDING SITE, designated SEQ ID:34676, to the nucleotide sequence of VGAM2603 RNA, herein designated VGAM RNA, also designated SEQ ID:5314.

Another function of VGAM2603 is therefore inhibition of LOC92597 (Accession XM_046066). Accordingly, utilities of VGAM2603 include diagnosis, prevention and treatment of diseases and clinical conditions associated with LOC92597. FIG. 1 further provides a conceptual description of a novel bioinformatically detected viral gene of the present invention, referred to here as Viral Genomic Address Messenger 2604 (VGAM2604) viral gene, which modulates expression of respective host target genes thereof, the function and utility of which host target genes is known in the art.

VGAM2604 is a novel bioinformatically detected regulatory, non protein coding, viral micro RNA (miRNA) gene. The method by which VGAM2604 was detected is described hereinabove with reference to FIGS. 1-8.

VGAM2604 gene, herein designated VGAM GENE, is a viral gene contained in the genome of Sugarcane Striate Mosaic Associated Virus. VGAM2604 host target gene, herein designated VGAM HOST TARGET GENE, is a human gene contained in the human genome.

VGAM2604 gene encodes a VGAM2604 precursor RNA, herein designated VGAM PRECURSOR RNA. Similar to other miRNA genes, and unlike most ordinary genes, VGAM2604 precursor RNA does not encode a protein. A nucleotide sequence identical or highly similar to the nucleotide sequence of VGAM2604 precursor RNA is designated SEQ ID:2590, and is provided hereinbelow with reference to the sequence listing part. Nucleotide sequence SEQ ID:2590 is located at position 3074 relative to the genome of Sugarcane Striate Mosaic Associated Virus.

VGAM2604 precursor RNA folds onto itself, forming VGAM2604 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2604 folded precursor RNA into VGAM2604 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2604 RNA is designated SEQ ID:5315, and is provided hereinbelow with reference to the sequence listing part.

VGAM2604 host target gene, herein designated VGAM HOST TARGET GENE, encodes a corresponding messenger RNA, VGAM2604 host target RNA, herein designated VGAM HOST TARGET RNA. VGAM2604 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2604 RNA, herein designated VGAM RNA, binds complementarily to one or more host target binding sites located in untranslated regions of VGAM2604 host target RNA, herein designated VGAM HOST TARGET RNA. This complementary binding is due to the fact that the nucleotide sequence of VGAM2604 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2604 RNA, herein designated VGAM RNA, may have a different number of host target binding sites in untranslated regions of a VGAM2604 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2604 RNA, herein designated VGAM RNA, to host target binding sites on VGAM2604 host target RNA, herein designated VGAM HOST TARGET RNA, such as BINDING SITE I, BINDING SITE II and BINDING SITE III, inhibits translation of VGAM2604 host target RNA into VGAM2604 host target protein, herein designated VGAM HOST TARGET PROTEIN. VGAM host target protein is therefore outlined by a broken line.

It is appreciated that VGAM2604 host target gene, herein designated VGAM HOST TARGET GENE, in fact represents a plurality of VGAM2604 host target genes. The mRNA of each one of this plurality of VGAM2604 host target genes comprises one or more host target binding sites, each having a nucleotide sequence which is at least partly complementary to VGAM2604 RNA, herein designated VGAM RNA, and which when bound by VGAM2604 RNA causes inhibition of translation of respective one or more VGAM2604 host target proteins.

It is further appreciated by one skilled in the art that the mode of translational inhibition illustrated by FIG. 1 with specific reference to translational inhibition exerted by VGAM2604 gene, herein designated VGAM GENE, on one or more VGAM2604 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2604 is inhibition of expression of host target genes, as part of a novel viral mechanism of attacking a host. Accordingly, utilities of VGAM2604 include diagnosis, prevention and treatment of viral infection by Sugarcane Striate Mosaic Associated Virus. Specific functions, and accordingly utilities, of VGAM2604 correlate with, and may be deduced from, the identity of the host target genes which VGAM2604 binds and inhibits, and the function of these host target genes, as elaborated hereinbelow.

Nucleotide sequences of the VGAM2604 precursor RNA, herein designated VGAM PRECURSOR RNA, and of the 'diced' VGAM2604 RNA, herein designated VGAM RNA, and a schematic representation of the secondary folding of VGAM2604 folded precursor RNA, herein designated VGAM FOLDED PRECURSOR RNA, of VGAM2604 are further described hereinbelow with reference to Table 1.

Nucleotide sequences of host target binding sites, such as BINDING SITE-I, BINDING SITE-II and BINDING SITE-III of FIG. 1, found on VGAM2604 host target RNA, and schematic representation of the complementarity of each of these host target binding sites to VGAM2604 RNA, herein designated VGAM RNA, are described hereinbelow with reference to Table 2.

As mentioned hereinabove with reference to FIG. 1, a function of VGAM2604 gene, herein designated VGAM is inhibition of expression of VGAM2604 target genes. It is appreciated that specific functions, and accordingly utilities, of VGAM2604 correlate with, and may be deduced from, the identity of the target genes which VGAM2604 binds and inhibits, and the function of these target genes, as elaborated hereinbelow.

A Kinase (PRKA) Anchor Protein 1 (AKAP1, Accession NM_003488) is a VGAM2604 host target gene. AKAP1 BINDING SITE1 and AKAP1 BINDING SITE2 are HOST TARGET binding sites found in untranslated regions of mRNA encoded by AKAP1, corresponding to HOST TARGET binding sites such as BINDING SITE I, BINDING SITE II or BINDING SITE III. Table 2 illustrates the complementarity of the nucleotide sequences of AKAP1 BINDING SITE1 and AKAP1 BINDING SITE2, designated SEQ ID:9582 and SEQ ID:29268 respectively, to the nucleotide sequence of VGAM2604 RNA, herein designated VGAM RNA, also designated SEQ ID:5315.

A function of VGAM2604 is therefore inhibition of A Kinase (PRKA) Anchor Protein 1 (AKAP1, Accession NM_003488), a gene which binds to type i and ii regulatory subunits of protein kinase a. Accordingly, utilities of VGAM2604 include diagnosis, prevention and treatment of diseases and clinical conditions associated with AKAP1. The function of AKAP1 and its association with various diseases and clinical conditions, has been established by previous studies, as described hereinabove with reference to VGAM1392. Collagen, Type VI, Alpha 3 (COL6A3, Accession NM_057167) is another VGAM2604 host target gene. COL6A3 BINDING SITE1 and COL6A3 BINDING SITE2 are HOST TARGET binding sites found in untranslated regions of mRNA encoded by COL6A3, corresponding to HOST TARGET binding sites such as BINDING SITE I, BINDING SITE II or BINDING SITE III. Table 2 illustrates the complementarity of the nucleotide sequences of COL6A3 BINDING SITE1 and COL6A3 BINDING SITE2, designated SEQ ID:27670 and SEQ ID:10586 respectively, to the nucleotide sequence of VGAM2604 RNA, herein designated VGAM RNA, also designated SEQ ID:5315.

Another function of VGAM2604 is therefore inhibition of Collagen, Type VI, Alpha 3 (COL6A3, Accession NM_057167). Accordingly, utilities of VGAM2604 include diagnosis, prevention and treatment of diseases and clinical conditions associated with COL6A3. Cytochrome P450, Subfamily VIIIB (sterol 12-alpha-hydroxylase), Polypeptide 1 (CYP8B1, Accession NM_004391) is another VGAM2604 host target gene. CYP8B1 BINDING SITE is HOST TARGET binding site found in the 3' untranslated region of mRNA encoded by CYP8B1, corresponding to a HOST TARGET binding site such as BINDING SITE I, BINDING SITE II or BINDING SITE III. Table 2 illustrates the complementarity of the nucleotide sequences of CYP8B1 BINDING SITE, designated SEQ ID:10627, to the nucleotide sequence of VGAM2604 RNA, herein designated VGAM RNA, also designated SEQ ID:5315.

Another function of VGAM2604 is therefore inhibition of Cytochrome P450, Subfamily VIIIB (sterol 12-alpha-hydroxylase), Polypeptide 1 (CYP8B1, Accession NM_004391), a gene which functions in bile acid biosynthesis. Accordingly, utilities of VGAM2604 include diagnosis, prevention and treatment of diseases and clinical conditions associated with CYP8B1. The function of CYP8B1 and its association with various diseases and clinical conditions, has been established by previous studies, as described hereinabove with reference to VGAM923. Disrupted In Schizophrenia 1 (DISC1, Accession NM_018662) is another VGAM2604 host target gene. DISC1 BINDING SITE is HOST TARGET binding site found in the 3' untranslated region of mRNA encoded by DISC1, corresponding to a HOST TARGET binding site such as BINDING SITE I, BINDING SITE II or BINDING SITE III. Table 2 illustrates the complementarity of the nucleotide sequences of DISC1 BINDING SITE, designated SEQ ID:20739, to the nucleotide sequence of VGAM2604 RNA, herein designated VGAM RNA, also designated SEQ ID:5315.

Another function of VGAM2604 is therefore inhibition of Disrupted In Schizophrenia 1 (DISC1, Accession NM_018662), a gene which has globular N-terminal domain (s) and a helical C-terminal domain. Accordingly, utilities of VGAM2604 include diagnosis, prevention and treatment of diseases and clinical conditions associated with DISC1. The function of DISC1 and its association with various diseases and clinical conditions, has been established by previous studies, as described hereinabove with reference to VGAM74. Espin (ESPN, Accession NM_031475) is another VGAM2604 host target gene. ESPN BINDING SITE is HOST TARGET binding site found in the 3' untranslated region of mRNA encoded by ESPN, corresponding to a HOST TARGET binding site such as BINDING SITE I, BINDING SITE II or BINDING SITE III. Table 2 illustrates the complementarity of the nucleotide sequences of ESPN BINDING SITE, designated SEQ ID:25550, to the nucleotide sequence of VGAM2604 RNA, herein designated VGAM RNA, also designated SEQ ID:5315.

Another function of VGAM2604 is therefore inhibition of Espin (ESPN, Accession NM_031475), a gene which a membrane-cytoskeletal assemblages. Accordingly, utilities of VGAM2604 include diagnosis, prevention and treatment of diseases and clinical conditions associated with ESPN. The function of ESPN and its association with various diseases and clinical conditions, has been established by previous studies, as described hereinabove with reference to VGAM1006. Fatty Acid Binding Protein 2, Intestinal (FABP2, Accession NM_000134) is another VGAM2604 host target gene. FABP2 BINDING SITE is HOST TARGET binding site found in the 3' untranslated region of mRNA encoded by FABP2, corresponding to a HOST TARGET binding site such as BINDING SITE I, BINDING SITE II or BINDING SITE III. Table 2 illustrates the complementarity of the nucleotide sequences of FABP2 BINDING SITE, designated SEQ ID:5627, to the nucleotide sequence of VGAM2604 RNA, herein designated VGAM RNA, also designated SEQ ID:5315.

Another function of VGAM2604 is therefore inhibition of Fatty Acid Binding Protein 2, Intestinal (FABP2, Accession NM_000134), a gene which may have a role in dietary fat uptake or processing. Accordingly, utilities of VGAM2604 include diagnosis, prevention and treatment of diseases and clinical conditions associated with FABP2. The function of FABP2 and its association with various diseases and clinical conditions, has been established by previous studies, as described hereinabove with reference to VGAM951. Fanconi Anemia, Complementation Group C (FANCC, Accession XM_047190) is another VGAM2604 host target gene. FANCC BINDING SITE is HOST TARGET binding site found in the 3' untranslated region of mRNA encoded by FANCC, corresponding to a HOST TARGET binding site such as BINDING SITE I, BINDING SITE II or BINDING SITE III. Table 2 illustrates the complementarity of the nucleotide sequences of FANCC BINDING SITE, designated SEQ ID:34908, to the nucleotide sequence of VGAM2604 RNA, herein designated VGAM RNA, also designated SEQ ID:5315.

Another function of VGAM2604 is therefore inhibition of Fanconi Anemia, Complementation Group C (FANCC, Accession XM_047190). Accordingly, utilities of VGAM2604 include diagnosis, prevention and treatment of diseases and clinical conditions associated with FANCC. Fer (fps/fes related) Tyrosine Kinase (phosphoprotein NCP94) (FER, Accession NM_005246) is another VGAM2604 host target gene. FER BINDING SITE is HOST TARGET binding site found in the 5' untranslated region of mRNA encoded by FER, corresponding to a HOST TARGET binding site such as BINDING SITE I, BINDING SITE II or BINDING SITE III. Table 2 illustrates the complementarity of the nucleotide sequences of FER BINDING SITE, designated SEQ ID:11756, to the nucleotide sequence of VGAM2604 RNA, herein designated VGAM RNA, also designated SEQ ID:5315.

Another function of VGAM2604 is therefore inhibition of Fer (fps/fes related) Tyrosine Kinase (phosphoprotein NCP94) (FER, Accession NM_005246), a gene which Non-receptor protein tyrosine kinase; member of the Src family. Accordingly, utilities of VGAM2604 include diagnosis, prevention and treatment of diseases and clinical conditions associated with FER. The function of FER and its association with various diseases and clinical conditions, has been established by previous studies, as described hereinabove with reference to VGAM224. Forkhead Box E3 (FOXE3, Accession NM_012186) is another VGAM2604 host target gene. FOXE3 BINDING SITE is HOST TARGET binding site found in the 3' untranslated region of mRNA encoded by FOXE3, corresponding to a HOST TARGET binding site such as BINDING SITE I, BINDING SITE II or BINDING SITE III. Table 2 illustrates the complementarity of the nucleotide sequences of FOXE3 BINDING SITE, designated SEQ ID:14473, to the nucleotide sequence of VGAM2604 RNA, herein designated VGAM RNA, also designated SEQ ID:5315.

Another function of VGAM2604 is therefore inhibition of Forkhead Box E3 (FOXE3, Accession NM_012186), a gene which regulates embryonic development. Accordingly, utilities of VGAM2604 include diagnosis, prevention and treatment of diseases and clinical conditions associated with FOXE3. The function of FOXE3 and its association with various diseases and clinical conditions, has been established by previous studies, as described hereinabove with reference to VGAM632. Inositol 1,4,5-trisphosphate 3-kinase B (ITPKB, Accession NM_002221) is another VGAM2604 host target gene. ITPKB BINDING SITE is HOST TARGET binding site found in the 3' untranslated region of mRNA encoded by ITPKB, corresponding to a HOST TARGET binding site such as BINDING SITE I, BINDING SITE II or BINDING SITE III. Table 2 illustrates the complementarity of the nucleotide sequences of ITPKB BINDING SITE, designated SEQ ID:7983, to the nucleotide sequence of VGAM2604 RNA, herein designated VGAM RNA, also designated SEQ ID:5315.

Another function of VGAM2604 is therefore inhibition of Inositol 1,4,5-trisphosphate 3-kinase B (ITPKB, Accession NM_002221), a gene which is a type B inositol 1,4,5-triphosphate 3 kinase. Accordingly, utilities of VGAM2604 include diagnosis, prevention and treatment of diseases and clinical conditions associated with ITPKB. The function of ITPKB and its association with various diseases and clinical conditions, has been established by previous studies, as described hereinabove with reference to VGAM1252. LFG (Accession XM_084780) is another VGAM2604 host target gene. LFG BINDING SITE is HOST TARGET binding site found in the 3' untranslated region of mRNA encoded by LFG, corresponding to a HOST TARGET binding site such as BINDING SITE I, BINDING SITE II or BINDING SITE III. Table 2 illustrates the complementarity of the nucleotide sequences of LFG BINDING SITE, designated SEQ ID:37699, to the nucleotide sequence of VGAM2604 RNA, herein designated VGAM RNA, also designated SEQ ID:5315.

Another function of VGAM2604 is therefore inhibition of LFG (Accession XM_084780). Accordingly, utilities of VGAM2604 include diagnosis, prevention and treatment of diseases and clinical conditions associated with LFG. MHC Class II Transactivator (MHC2TA, Accession NM_000246) is another VGAM2604 host target gene. MHC2TA BINDING SITE is HOST TARGET binding site found in the 3' untranslated region of mRNA encoded by MHC2TA, corresponding to a HOST TARGET binding site such as BINDING SITE I, BINDING SITE II or BINDING SITE III. Table 2 illustrates the complementarity of the nucleotide sequences of MHC2TA BINDING SITE, designated SEQ ID:5785, to the nucleotide sequence of VGAM2604 RNA, herein designated VGAM RNA, also designated SEQ ID:5315.

Another function of VGAM2604 is therefore inhibition of MHC Class II Transactivator (MHC2TA, Accession NM_000246). Accordingly, utilities of VGAM2604 include diagnosis, prevention and treatment of diseases and clinical conditions associated with MHC2TA. Nebulin-related Anchoring Protein (Nrap, Accession NM_139235) is another VGAM2604 host target gene. Nrap BINDING SITE is HOST TARGET binding site found in the 3' untranslated region of mRNA encoded by Nrap, corresponding to a HOST TARGET binding site such as BINDING SITE I, BINDING SITE II or BINDING SITE III. Table 2 illustrates the complementarity of the nucleotide sequences of Nrap BINDING SITE, designated SEQ ID:29238, to the nucleotide sequence of VGAM2604 RNA, herein designated VGAM RNA, also designated SEQ ID:5315.

Another function of VGAM2604 is therefore inhibition of Nebulin-related Anchoring Protein (Nrap, Accession NM_139235), a gene which performs an anchoring function to link the terminal actin filaments of myofibrils to protein complexes located beneath the sarcolemma. Accordingly, utilities of VGAM2604 include diagnosis, prevention and treatment of diseases and clinical conditions associated with Nrap. The function of Nrap and its association with various diseases and clinical conditions, has been established by previous studies, as described hereinabove with reference to VGAM649. Parathyroid Hormone Receptor 2 (PTHR2, Accession NM_005048) is another VGAM2604 host target gene. PTHR2 BINDING SITE is HOST TARGET binding site found in the 3' untranslated region of mRNA encoded by PTHR2, corresponding to a HOST TARGET binding site such as BINDING SITE I, BINDING SITE II or BINDING SITE III. Table 2 illustrates the complementarity of the nucleotide sequences of PTHR2 BINDING SITE, designated SEQ ID:11482, to the nucleotide sequence of VGAM2604 RNA, herein designated VGAM RNA, also designated SEQ ID:5315.

Another function of VGAM2604 is therefore inhibition of Parathyroid Hormone Receptor 2 (PTHR2, Accession NM_005048), a gene which is a G protein-coupled receptor selective for parathyroid hormone binding. Accordingly, utilities of VGAM2604 include diagnosis, prevention and treatment of diseases and clinical conditions associated with PTHR2. The function of PTHR2 and its association with various diseases and clinical conditions, has been established by previous studies, as described hereinabove with reference to VGAM607. Protein Tyrosine Phosphatase, Receptor Type, O (PTPRO, Accession NM_030668) is another VGAM2604 host target gene. PTPRO BINDING SITE1 through PTPRO BINDING SITE3 are HOST TARGET binding sites found in untranslated regions of mRNA encoded by PTPRO, corresponding to HOST TARGET binding sites such as BINDING SITE I, BINDING SITE II or BINDING SITE III. Table 2 illustrates the complementarity of the nucleotide sequences of PTPRO BINDING SITE1 through PTPRO BINDING SITE3, designated SEQ ID:25015, SEQ ID:25024 and SEQ ID:25035 respectively, to the nucleotide sequence of VGAM2604 RNA, herein designated VGAM RNA, also designated SEQ ID:5315.

Another function of VGAM2604 is therefore inhibition of Protein Tyrosine Phosphatase, Receptor Type, O (PTPRO, Accession NM_030668), a gene which may function as a cell contact receptor that mediates and controls cell-cell signals. Accordingly, utilities of VGAM2604 include diagnosis, prevention and treatment of diseases and clinical conditions associated with PTPRO. The function of PTPRO and its association with various diseases and clinical conditions, has been established by previous studies, as described hereinabove with reference to VGAM140. Serine (or cysteine) Proteinase Inhibitor, Clade B (ovalbumin), Member 9 (SERPINB9, Accession NM_004155) is another VGAM2604 host target gene. SERPINB9 BINDING SITE is HOST TARGET binding site found in the 3' untranslated region of mRNA encoded by SERPINB9, corresponding to a HOST TARGET binding site such as BINDING SITE I, BINDING SITE II or BINDING SITE III. Table 2 illustrates the complementarity of the nucleotide sequences of SERPINB9 BINDING SITE, designated SEQ ID:10369, to the nucleotide sequence of VGAM2604 RNA, herein designated VGAM RNA, also designated SEQ ID:5315.

Another function of VGAM2604 is therefore inhibition of Serine (or cysteine) Proteinase Inhibitor, Clade B (ovalbumin), Member 9 (SERPINB9, Accession NM_004155), a gene which may be a serpin serine protease inhibitor that interacts with granzyme B (GZMB). Accordingly, utilities of VGAM2604 include diagnosis, prevention and treatment of diseases and clinical conditions associated with SERPINB9. The function of SERPINB9 and its association with various diseases and clinical conditions, has been established by previous studies, as described hereinabove with reference to VGAM60. Src-like-adaptor 2 (SLA2, Accession NM_032214) is another VGAM2604 host target gene. SLA2 BINDING SITE is HOST TARGET binding site found in the 3' untranslated region of mRNA encoded by SLA2, corresponding to a HOST TARGET binding site such as BINDING SITE I, BINDING SITE II or BINDING SITE III. Table 2 illustrates the complementarity of the nucleotide sequences of SLA2 BINDING SITE, designated SEQ ID:25944, to the nucleotide sequence of VGAM2604 RNA, herein designated VGAM RNA, also designated SEQ ID:5315.

Another function of VGAM2604 is therefore inhibition of Src-like-adaptor 2 (SLA2, Accession NM_032214). Accordingly, utilities of VGAM2604 include diagnosis, prevention and treatment of diseases and clinical conditions associated with SLA2. Solute Carrier Family 22 (organic cation transporter), Member 2 (SLC22A2, Accession XM_004235) is another VGAM2604 host target gene. SLC22A2 BINDING SITE is HOST TARGET binding site found in the 5' untranslated region of mRNA encoded by SLC22A2, corresponding to a HOST TARGET binding site such as BINDING SITE I, BINDING SITE II or BINDING SITE III. Table 2 illustrates the complementarity of the nucleotide sequences of SLC22A2 BINDING SITE, designated SEQ ID:29942, to the nucleotide sequence of VGAM2604 RNA, herein designated VGAM RNA, also designated SEQ ID:5315.

Another function of VGAM2604 is therefore inhibition of Solute Carrier Family 22 (organic cation transporter), Member 2 (SLC22A2, Accession XM_004235), a gene which is an organic cation transporter that may mediate first step in cation resorption. Accordingly, utilities of VGAM2604 include diagnosis, prevention and treatment of diseases and clinical conditions associated with SLC22A2. The function of SLC22A2 has been established by previous studies. Polyspecific organic cation transporters in the liver, kidney, and intestine are critical for elimination of many endogenous amines as well as a wide array of drugs and environmental toxins. Using PCR with primers derived from rat OCT1 (OMIM Ref. No. 602607), Gorboulev et al. (1997) cloned the human organic cation transporters OCT1 and OCT2 from human kidney cortex cDNA. The predicted 555-amino acid OCT2 protein has 12 putative transmembrane domains and is 70% identical to human OCT1 protein. On Northern blots, OCT2 was expressed as 2.5- and 4.0-kb mRNAs mainly in kidney, although RT-PCR detected OCT2 expression in a few other tissues. Using in situ hybridization and immunohistochemistry, Gorboulev et al. (1997) found that OCT2 is localized at the luminal membrane of the kidney distal tubule. Xenopus oocytes expressing OCT2 showed increased cation uptake. A bidirectional silencer for a 400-kb region that contains 3 imprinted, maternally expressed protein-coding genes (IGF2R, 147280; SLC22A2; SLC22A3) has been shown by targeted deletion to be located in a sequence of 3.7 kb, which also contains the promoter for the imprinted, paternally expressed noncoding Air RNA. Expression of Air is correlated with repression of all 3 genes on the paternal allele; however, Air RNA overlaps just 1 of these genes in an antisense orientation. By inserting a polyadenylation signal that truncates 96% of the RNA transcript, Sleutels et al. (2002) demonstrated that Air RNA is required for silencing. The truncated Air allele maintains imprinted expression and methylation of the Air promoter, but shows complete loss of silencing of the IGF2R/SLC22A2/SLC22A3 gene cluster on the paternal chromosome. Sleutels et al. (2002) concluded that noncoding RNAs have an active role in genomic imprinting Full details of the abovementioned studies are described in the following publications, the disclosure of which are hereby incorporated by reference:

Gorboulev, V.; Ulzheimer, J. C.; Akhoundova, A.; Ulzheimer-Teuber, I.; Karbach, U.; Quester, S.; Baumann, C.; Lang, F.; Busch, A. E.; Koepsell, H.: Cloning and characterization of two human polyspecific organic cation transporters. DNA Cell Biol. 16:871-881, 1997; and Sleutels, F.; Zwart, R.; Barlow, D. P.: The non-coding Air RNA is required for silencing autosomal imprinted genes. Nature 415:810-813, 2002.

Further studies establishing the function and utilities of SLC22A2 are found in John Hopkins OMIM database record ID 602608, and in sited publications numbered 1114, 1116, 111 and 5233 listed in the bibliography section hereinbelow, which are also hereby incorporated by reference. Solute Carrier Family 7 (cationic amino acid transporter, y+ system), Member 8 (SLC7A8, Accession NM_012244) is another VGAM2604 host target gene. SLC7A8 BINDING SITE is HOST TARGET binding site found in the 3' untranslated region of mRNA encoded by SLC7A8, corresponding to a HOST TARGET binding site such as BINDING SITE I, BINDING SITE II or BINDING SITE III. Table 2 illustrates the complementarity of the nucleotide sequences of SLC7A8 BINDING SITE, designated SEQ ID:14553, to the nucleotide sequence of VGAM2604 RNA, herein designated VGAM RNA, also designated SEQ ID:5315.

Another function of VGAM2604 is therefore inhibition of Solute Carrier Family 7 (cationic amino acid transporter, y+ system), Member 8 (SLC7A8, Accession NM_012244), a gene which helps mediate transport of large and small neutral amino acids. Accordingly, utilities of VGAM2604 include diagnosis, prevention and treatment of diseases and clinical conditions associated with SLC7A8. The function of SLC7A8 and its association with various diseases and clinical conditions, has been established by previous studies, as described hereinabove with reference to VGAM1263. SWI/SNF Related, Matrix Associated, Actin Dependent Regulator of Chromatin, Subfamily A, Member 2 (SMARCA2, Accession NM_003070) is another VGAM2604 host target gene. SMARCA2 BINDING SITE is HOST TARGET binding site found in the 3' untranslated region of mRNA encoded by SMARCA2, corresponding to a HOST TARGET binding site such as BINDING SITE I, BINDING SITE II or BINDING SITE III. Table 2 illustrates the complementarity of the nucleotide sequences of SMARCA2 BINDING SITE, designated SEQ ID:9035, to the nucleotide sequence of VGAM2604 RNA, herein designated VGAM RNA, also designated SEQ ID:5315.

Another function of VGAM2604 is therefore inhibition of SWI/SNF Related, Matrix Associated, Actin Dependent Regulator of Chromatin, Subfamily A, Member 2 (SMARCA2, Accession NM_003070), a gene which is involved in chromatin assembly and remodeling. Accordingly, utilities of VGAM2604 include diagnosis, prevention and treatment of diseases and clinical conditions associated with SMARCA2. The function of SMARCA2 and its association with various diseases and clinical conditions, has been established by previous studies, as described hereinabove with reference to VGAM191. Transient Receptor Potential Cation Channel, Subfamily V, Member 1 (TRPV1, Accession NM_018727) is another VGAM2604 host target gene. TRPV1 BINDING SITE1 through TRPV1 BINDING SITE4 are HOST TARGET binding sites found in untranslated regions of mRNA encoded by TRPV1, corresponding to HOST TARGET binding sites such as BINDING SITE I, BINDING SITE II or BINDING SITE III. Table 2 illustrates the complementarity of the nucleotide sequences of TRPV1 BINDING SITE1 through TRPV1 BINDING SITE4, designated SEQ ID:20816, SEQ ID:27996, SEQ ID:28004 and SEQ ID:28013 respectively, to the nucleotide sequence of VGAM2604 RNA, herein designated VGAM RNA, also designated SEQ ID:5315.

Another function of VGAM2604 is therefore inhibition of Transient Receptor Potential Cation Channel, Subfamily V, Member 1 (TRPV1, Accession NM_018727), a gene which functions as a receptor for capsaicin. Accordingly, utilities of VGAM2604 include diagnosis, prevention and treatment of diseases and clinical conditions associated with TRPV1. The function of TRPV1 and its association with various diseases and clinical conditions, has been established by previous studies, as described hereinabove with reference to VGAM146. Wingless-type MMTV Integration Site Family, Member 5B (WNT5B, Accession NM_030775) is another VGAM2604 host target gene. WNT5B BINDING SITE1 and WNT5B BINDING SITE2 are HOST TARGET binding sites found in untranslated regions of mRNA encoded by WNT5B, corresponding to HOST TARGET binding sites such as BINDING SITE I, BINDING SITE II or BINDING SITE III. Table 2 illustrates the complementarity of the nucleotide sequences of WNT5B BINDING SITE1 and WNT5B BINDING SITE2, designated SEQ ID:25060 and SEQ ID:26362 respectively, to the nucleotide sequence of VGAM2604 RNA, herein designated VGAM RNA, also designated SEQ ID:5315.

Another function of VGAM2604 is therefore inhibition of Wingless-type MMTV Integration Site Family, Member 5B (WNT5B, Accession NM_030775), a gene which is the ligand for members of the frizzled family of seven transmembrane receptors and may be a signaling molecule. Accordingly, utilities of VGAM2604 include diagnosis, prevention and treatment of diseases and clinical conditions associated with WNT5B. The function of WNT5B and its association with various diseases and clinical conditions, has been established by previous studies, as described hereinabove with reference to VGAM1928. Chromosome 11 Open Reading Frame 11 (C11orf11, Accession XM_167769) is another VGAM2604 host target gene. C11orf11 BINDING SITE is HOST TARGET binding site found in the 3' untranslated region of mRNA encoded by C11orf11, corresponding to a HOST TARGET binding site such as BINDING SITE I, BINDING SITE II or BINDING SITE III. Table 2 illustrates the complementarity of the nucleotide sequences of C11orf11 BINDING SITE, designated SEQ ID:44790, to the nucleotide sequence of VGAM2604 RNA, herein designated VGAM RNA, also designated SEQ ID:5315.

Another function of VGAM2604 is therefore inhibition of Chromosome 11 Open Reading Frame 11 (C11orf11, Accession XM_167769). Accordingly, utilities of VGAM2604 include diagnosis, prevention and treatment of diseases and clinical conditions associated with C11orf11. C2F (Accession NM_006331) is another VGAM2604 host target gene. C2F BINDING SITE is HOST TARGET binding site found in the 3" untranslated region of mRNA encoded by C2F, corresponding to a HOST TARGET binding site such as BINDING SITE I, BINDING SITE II or BINDING SITE III. Table 2 illustrates the complementarity of the nucleotide sequences of C2F BINDING SITE, designated SEQ ID:13030, to the nucleotide sequence of VGAM2604 RNA, herein designated VGAM RNA, also designated SEQ ID:5315.

Another function of VGAM2604 is therefore inhibition of C2F (Accession NM_006331). Accordingly, utilities of VGAM2604 include diagnosis, prevention and treatment of diseases and clinical conditions associated with C2F. Cab45 (Accession NM_016176) is another VGAM2604 host target gene. Cab45 BINDING SITE1 and Cab45 BINDING SITE2 are HOST TARGET binding sites found in untranslated regions of mRNA encoded by Cab45, corresponding to HOST TARGET binding sites such as BINDING SITE I, BINDING SITE II or BINDING SITE III. Table 2 illustrates the complementarity of the nucleotide sequences of Cab45 BINDING SITE1 and Cab45 BINDING SITE2, designated SEQ ID:18278 and SEQ ID:18621 respectively, to the nucleotide sequence of VGAM2604 RNA, herein designated VGAM RNA, also designated SEQ ID:5315.

Another function of VGAM2604 is therefore inhibition of Cab45 (Accession NM_016176). Accordingly, utilities of VGAM2604 include diagnosis, prevention and treatment of diseases and clinical conditions associated with Cab45. DKFZP434B205 (Accession XM_059966) is another VGAM2604 host target gene. DKFZP434B205 BINDING SITE is HOST TARGET binding site found in the 3' untranslated region of mRNA encoded by DKFZP434B205, corresponding to a HOST TARGET binding site such as BINDING SITE I, BINDING SITE II or BINDING SITE III. Table 2 illustrates the complementarity of the nucleotide sequences of DKFZP434B205 BINDING SITE, designated SEQ ID:37128, to the nucleotide sequence of VGAM2604 RNA, herein designated VGAM RNA, also designated SEQ ID:5315.

Another function of VGAM2604 is therefore inhibition of DKFZP434B205 (Accession XM_059966). Accordingly, utilities of VGAM2604 include diagnosis, prevention and treatment of diseases and clinical conditions associated with DKFZP434B205. DKFZP434C128 (Accession XM_036086) is another VGAM2604 host target gene. DKFZP434C128 BINDING SITE is HOST TARGET binding site found in the 3' untranslated region of mRNA encoded by DKFZP434C128, corresponding to a HOST TARGET binding site such as BINDING SITE I, BINDING SITE II or BINDING SITE III. Table 2 illustrates the complementarity of the nucleotide sequences of DKFZP434C128 BINDING SITE, designated SEQ ID:32375, to the nucleotide sequence of VGAM2604 RNA, herein designated VGAM RNA, also designated SEQ ID:5315.

Another function of VGAM2604 is therefore inhibition of DKFZP434C128 (Accession XM_036086). Accordingly, utilities of VGAM2604 include diagnosis, prevention and treatment of diseases and clinical conditions associated with DKFZP434C128. Dedicator of Cyto-kinesis 3 (DOCK3, Accession XM_039259) is another VGAM2604 host target gene. DOCK3 BINDING SITE is HOST TARGET binding site found in the 3' untranslated region of mRNA encoded by DOCK3, corresponding to a HOST TARGET binding site such as BINDING SITE I, BINDING SITE II or BINDING SITE III. Table 2 illustrates the complementarity of the nucleotide sequences of DOCK3 BINDING SITE, designated SEQ ID:33036, to the nucleotide sequence of VGAM2604 RNA, herein designated VGAM RNA, also designated SEQ ID:5315.

Another function of VGAM2604 is therefore inhibition of Dedicator of Cyto-kinesis 3 (DOCK3, Accession XM_039259). Accordingly, utilities of VGAM2604 include diagnosis, prevention and treatment of diseases and clinical conditions associated with DOCK3. EDR2 (Accession XM_018136) is another VGAM2604 host target gene. EDR2 BINDING SITE is HOST TARGET binding site found in the 3' untranslated region of mRNA encoded by EDR2, corresponding to a HOST TARGET binding site such as BINDING SITE I, BINDING SITE II or BINDING SITE III. Table 2 illustrates the complementarity of the nucleotide sequences of EDR2 BINDING SITE, designated SEQ ID:30338, to the nucleotide sequence of VGAM2604 RNA, herein designated VGAM RNA, also designated SEQ ID:5315.

Another function of VGAM2604 is therefore inhibition of EDR2 (Accession XM_018136). Accordingly, utilities of VGAM2604 include diagnosis, prevention and treatment of diseases and clinical conditions associated with EDR2. FLJ10743 (Accession NM_018201) is another VGAM2604 host target gene. FLJ10743 BINDING SITE is HOST TARGET binding site found in the 3' untranslated region of mRNA encoded by FLJ10743, corresponding to a HOST TARGET binding site such as BINDING SITE I, BINDING SITE II or BINDING SITE III. Table 2 illustrates the complementarity of the nucleotide sequences of FLJ10743 BINDING SITE, designated SEQ ID:20082, to the nucleotide sequence of VGAM2604 RNA, herein designated VGAM RNA, also designated SEQ ID:5315.

Another function of VGAM2604 is therefore inhibition of FLJ10743 (Accession NM_018201). Accordingly, utilities of VGAM2604 include diagnosis, prevention and treatment of diseases and clinical conditions associated with FLJ10743. FLJ13197 (Accession NM_024614) is another VGAM2604 host target gene. FLJ13197 BINDING SITE is HOST TARGET binding site found in the 3' untranslated region of mRNA encoded by FLJ13197, corresponding to a HOST TARGET binding site such as BINDING SITE I, BINDING SITE II or BINDING SITE III. Table 2 illustrates the complementarity of the nucleotide sequences of FLJ13197 BINDING SITE, designated SEQ ID:23873, to the nucleotide sequence of VGAM2604 RNA, herein designated VGAM RNA, also designated SEQ ID:5315.

Another function of VGAM2604 is therefore inhibition of FLJ13197 (Accession NM_024614). Accordingly, utilities of VGAM2604 include diagnosis, prevention and treatment of diseases and clinical conditions associated with FLJ13197. FLJ22659 (Accession NM_024934) is another VGAM2604 host target gene. FLJ22659 BINDING SITE is HOST TARGET binding site found in the 5' untranslated region of mRNA encoded by FLJ22659, corresponding to a HOST TARGET binding site such as BINDING SITE I, BINDING SITE II or BINDING SITE III. Table 2 illustrates the complementarity of the nucleotide sequences of FLJ22659 BINDING SITE, designated SEQ ID:24471, to the nucleotide sequence of VGAM2604 RNA, herein designated VGAM RNA, also designated SEQ ID:5315.

Another function of VGAM2604 is therefore inhibition of FLJ22659 (Accession NM_024934). Accordingly, utilities of VGAM2604 include diagnosis, prevention and treatment of diseases and clinical conditions associated with FLJ22659. FLJ22814 (Accession NM_024916) is another VGAM2604 host target gene. FLJ22814 BINDING SITE is HOST TARGET binding site found in the 3' untranslated region of mRNA encoded by FLJ22814, corresponding to a HOST TARGET binding site such as BINDING SITE I, BINDING SITE II or BINDING SITE III. Table 2 illustrates the complementarity of the nucleotide sequences of FLJ22814 BINDING SITE, designated SEQ ID:24444, to the nucleotide sequence of VGAM2604 RNA, herein designated VGAM RNA, also designated SEQ ID:5315.

Another function of VGAM2604 is therefore inhibition of FLJ22814 (Accession NM_024916). Accordingly, utilities of VGAM2604 include diagnosis, prevention and treatment of diseases and clinical conditions associated with FLJ22814. HERV-H LTR-associating 2 (HHLA2, Accession NM_007072) is another VGAM2604 host target gene. HHLA2 BINDING SITE is HOST TARGET binding site found in the 3' untranslated region of mRNA encoded by HHLA2, corresponding to a HOST TARGET binding site such as BINDING SITE I, BINDING SITE II or BINDING SITE III. Table 2 illustrates the complementarity of the nucleotide sequences of HHLA2 BINDING SITE, designated SEQ ID:13939, to the nucleotide sequence of VGAM2604 RNA, herein designated VGAM RNA, also designated SEQ ID:5315.

Another function of VGAM2604 is therefore inhibition of HERV-H LTR-associating 2 (HHLA2, Accession NM_007072). Accordingly, utilities of VGAM2604 include diagnosis, prevention and treatment of diseases and clinical conditions associated with HHLA2. HSNOV1 (Accession NM_017515) is another VGAM2604 host target gene. HSNOV1 BINDING SITE is HOST TARGET binding site found in the 3' untranslated region of mRNA encoded by HSNOV1, corresponding to a HOST TARGET binding site such as BINDING SITE I, BINDING SITE II or BINDING SITE III. Table 2 illustrates the complementarity of the nucleotide sequences of HSNOV1 BINDING SITE, designated SEQ ID:18968, to the nucleotide sequence of VGAM2604 RNA, herein designated VGAM RNA, also designated SEQ ID:5315.

Another function of VGAM2604 is therefore inhibition of HSNOV1 (Accession NM_017515). Accordingly, utilities of VGAM2604 include diagnosis, prevention and treatment of diseases and clinical conditions associated with HSNOV1. KIAA0252 (Accession XM_031646) is another VGAM2604 host target gene. KIAA0252 BINDING SITE is HOST TARGET binding site found in the 3' untranslated region of mRNA encoded by KIAA0252, corresponding to a HOST TARGET binding site such as BINDING SITE I, BINDING SITE II or BINDING SITE III. Table 2 illustrates the complementarity of the nucleotide sequences of KIAA0252 BINDING SITE, designated SEQ ID:31452, to the nucleotide sequence of VGAM2604 RNA, herein designated VGAM RNA, also designated SEQ ID:5315.

Another function of VGAM2604 is therefore inhibition of KIAA0252 (Accession XM_031646). Accordingly, utilities of VGAM2604 include diagnosis, prevention and treatment of diseases and clinical conditions associated with KIAA0252. KIAA0416 (Accession NM_015564) is another VGAM2604 host target gene. KIAA0416 BINDING SITE is HOST TARGET binding site found in the 3' untranslated region of mRNA encoded by KIAA0416, corresponding to a HOST TARGET binding site such as BINDING SITE I, BINDING SITE II or BINDING SITE III. Table 2 illustrates the complementarity of the nucleotide sequences of KIAA0416 BINDING SITE, designated SEQ ID:17835, to the nucleotide sequence of VGAM2604 RNA, herein designated VGAM RNA, also designated SEQ ID:5315.

Another function of VGAM2604 is therefore inhibition of KIAA0416 (Accession NM_015564). Accordingly, utilities of VGAM2604 include diagnosis, prevention and treatment of diseases and clinical conditions associated with KIAA0416. KIAA0420 (Accession XM_032693) is another VGAM2604 host target gene. KIAA0420 BINDING SITE is HOST TARGET binding site found in the 3' untranslated region of mRNA encoded by KIAA0420, corresponding to a HOST TARGET binding site such as BINDING SITE I, BINDING SITE II or BINDING SITE III. Table 2 illustrates the complementarity of the nucleotide sequences of KIAA0420 BINDING SITE, designated SEQ ID:31731, to the nucleotide sequence of VGAM2604 RNA, herein designated VGAM RNA, also designated SEQ ID:5315.

Another function of VGAM2604 is therefore inhibition of KIAA0420 (Accession XM_032693). Accordingly, utilities of VGAM2604 include diagnosis, prevention and treatment of diseases and clinical conditions associated with KIAA0420. KIAA0435 (Accession NM_014801) is another VGAM2604 host target gene. KIAA0435 BINDING SITE is HOST TARGET binding site found in the 5' untranslated region of mRNA encoded by KIAA0435, corresponding to a HOST TARGET binding site such as BINDING SITE I, BINDING SITE II or BINDING SITE III. Table 2 illustrates the complementarity of the nucleotide sequences of KIAA0435 BINDING SITE, designated SEQ ID:16725, to the nucleotide sequence of VGAM2604 RNA, herein designated VGAM RNA, also designated SEQ ID:5315.

Another function of VGAM2604 is therefore inhibition of KIAA0435 (Accession NM_014801). Accordingly, utilities of VGAM2604 include diagnosis, prevention and treatment of diseases and clinical conditions associated with KIAA0435. KIAA0841 (Accession XM_049237) is another VGAM2604 host target gene. KIAA0841 BINDING SITE is HOST TARGET binding site found in the 3' untranslated region of mRNA encoded by KIAA0841, corresponding to a HOST TARGET binding site such as BINDING SITE I, BINDING SITE II or BINDING SITE III. Table 2 illustrates the complementarity of the nucleotide sequences of KIAA0841 BINDING SITE, designated SEQ ID:35364, to the nucleotide sequence of VGAM2604 RNA, herein designated VGAM RNA, also designated SEQ ID:5315.

Another function of VGAM2604 is therefore inhibition of KIAA0841 (Accession XM_049237). Accordingly, utilities of VGAM2604 include diagnosis, prevention and treatment of diseases and clinical conditions associated with KIAA0841. KIAA0847 (Accession XM_085298) is another VGAM2604 host target gene. KIAA0847 BINDING SITE is HOST TARGET binding site found in the 3' untranslated region of mRNA encoded by KIAA0847, corresponding to a HOST TARGET binding site such as BINDING SITE I, BINDING SITE II or BINDING SITE III. Table 2 illustrates the complementarity of the nucleotide sequences of KIAA0847 BINDING SITE, designated SEQ ID:38048, to the nucleotide sequence of VGAM2604 RNA, herein designated VGAM RNA, also designated SEQ ID:5315.

Another function of VGAM2604 is therefore inhibition of KIAA0847 (Accession XM_085298). Accordingly, utilities of VGAM2604 include diagnosis, prevention and treatment of diseases and clinical conditions associated with KIAA0847. KIAA1069 (Accession XM_042635) is another VGAM2604 host target gene. KIAA1069 BINDING SITE is HOST TARGET binding site found in the 3' untranslated region of mRNA encoded by KIAA1069, corresponding to a HOST TARGET binding site such as BINDING SITE I, BINDING SITE II or BINDING SITE III. Table 2 illustrates the complementarity of the nucleotide sequences of KIAA1069 BINDING SITE, designated SEQ ID:33725, to the nucleotide sequence of VGAM2604 RNA, herein designated VGAM RNA, also designated SEQ ID:5315.

Another function of VGAM2604 is therefore inhibition of KIAA1069 (Accession XM_042635). Accordingly, utilities of VGAM2604 include diagnosis, prevention and treatment of diseases and clinical conditions associated with KIAA1069. KIAA1157 (Accession XM_051093) is another VGAM2604 host target gene. KIAA1157 BINDING SITE is HOST TARGET binding site found in the 3' untranslated region of mRNA encoded by KIAA1157, corresponding to a HOST TARGET binding site such as BINDING SITE I, BINDING SITE II or BINDING SITE III. Table 2 illustrates the complementarity of the nucleotide sequences of KIAA1157 BINDING SITE, designated SEQ ID:35755, to the nucleotide sequence of VGAM2604 RNA, herein designated VGAM RNA, also designated SEQ ID:5315.

Another function of VGAM2604 is therefore inhibition of KIAA1157 (Accession XM_051093). Accordingly, utilities of VGAM2604 include diagnosis, prevention and treatment of diseases and clinical conditions associated with KIAA1157. KIAA1755 (Accession XM_028810) is another VGAM2604 host target gene. KIAA1755 BINDING SITE is HOST TARGET binding site found in the 3' untranslated region of mRNA encoded by KIAA1755, corresponding to a HOST TARGET binding site such as BINDING SITE I, BINDING SITE II or BINDING SITE III. Table 2 illustrates the complementarity of the nucleotide sequences of KIAA1755 BINDING SITE, designated SEQ ID:30754, to the nucleotide sequence of VGAM2604 RNA, herein designated VGAM RNA, also designated SEQ ID:5315.

Another function of VGAM2604 is therefore inhibition of KIAA1755 (Accession XM_028810). Accordingly, utilities of VGAM2604 include diagnosis, prevention and treatment of diseases and clinical conditions associated with KIAA1755. MEF-2 (Accession XM_034883) is another VGAM2604 host target gene. MEF-2 BINDING SITE is HOST TARGET binding site found in the 3' untranslated region of mRNA encoded by MEF-2, corresponding to a HOST TARGET binding site such as BINDING SITE I, BINDING SITE II or BINDING SITE III. Table 2 illustrates the complementarity of the nucleotide sequences of MEF-2 BINDING SITE, designated SEQ ID:32181, to the nucleotide sequence of VGAM2604 RNA, herein designated VGAM RNA, also designated SEQ ID:5315.

Another function of VGAM2604 is therefore inhibition of MEF-2 (Accession XM_034883). Accordingly, utilities of VGAM2604 include diagnosis, prevention and treatment of diseases and clinical conditions associated with MEF-2. MGC13053 (Accession NM_032710) is another VGAM2604 host target gene. MGC13053 BINDING SITE is HOST TARGET binding site found in the 5' untranslated region of mRNA encoded by MGC13053, corresponding to a HOST TARGET binding site such as BINDING SITE I, BINDING SITE II or BINDING SITE III. Table 2 illustrates the complementarity of the nucleotide sequences of MGC13053 BINDING SITE, designated SEQ ID:26425, to the nucleotide sequence of VGAM2604 RNA, herein designated VGAM RNA, also designated SEQ ID:5315.

Another function of VGAM2604 is therefore inhibition of MGC13053 (Accession NM_032710). Accordingly, utilities of VGAM2604 include diagnosis, prevention and treatment of diseases and clinical conditions associated with MGC13053. MGC9912 (Accession NM_080664) is another VGAM2604 host target gene. MGC9912 BINDING SITE is HOST TARGET binding site found in the 3' untranslated region of mRNA encoded by MGC9912, corresponding to a HOST TARGET binding site such as BINDING SITE I, BINDING SITE II or BINDING SITE III. Table 2 illustrates the complementarity of the nucleotide sequences of MGC9912 BINDING SITE, designated SEQ ID:27953, to the nucleotide sequence of VGAM2604 RNA, herein designated VGAM RNA, also designated SEQ ID:5315.

Another function of VGAM2604 is therefore inhibition of MGC9912 (Accession NM_080664). Accordingly, utilities of VGAM2604 include diagnosis, prevention and treatment of diseases and clinical conditions associated with MGC9912. Nuclear Factor of Activated T-cells 5, Tonicity-responsive (NFAT5, Accession NM_138714) is another VGAM2604 host target gene. NFAT5 BINDING SITE is HOST TARGET binding site found in the 5' untranslated region of mRNA encoded by NFAT5, corresponding to a HOST TARGET binding site such as BINDING SITE I, BINDING SITE II or BINDING SITE III. Table 2 illustrates the complementarity of the nucleotide sequences of NFAT5 BINDING SITE, designated SEQ ID:28956, to the nucleotide sequence of VGAM2604 RNA, herein designated VGAM RNA, also designated SEQ ID:5315.

Another function of VGAM2604 is therefore inhibition of Nuclear Factor of Activated T-cells 5, Tonicity-responsive (NFAT5, Accession NM_138714). Accordingly, utilities of VGAM2604 include diagnosis, prevention and treatment of diseases and clinical conditions associated with NFAT5. Phosphodiesterase 2A, CGMP-stimulated (PDE2A, Accession NM_002599) is another VGAM2604 host target gene. PDE2A BINDING SITE is HOST TARGET binding site found in the 3' untranslated region of mRNA encoded by PDE2A, corresponding to a HOST TARGET binding site such as BINDING SITE I, BINDING SITE II or BINDING SITE III. Table 2 illustrates the complementarity of the nucleotide sequences of PDE2A BINDING SITE, designated SEQ ID:8461, to the nucleotide sequence of VGAM2604 RNA, herein designated VGAM RNA, also designated SEQ ID:5315.

Another function of VGAM2604 is therefore inhibition of Phosphodiesterase 2A, CGMP-stimulated (PDE2A, Accession NM_002599). Accordingly, utilities of VGAM2604 include diagnosis, prevention and treatment of diseases and clinical conditions associated with PDE2A. Retinoic Acid Induced 17 (RAI17, Accession XM_166091) is another VGAM2604 host target gene. RAI17 BINDING SITE is HOST TARGET binding site found in the 3' untranslated region of mRNA encoded by RAI17, corresponding to a HOST TARGET binding site such as BINDING SITE I, BINDING SITE II or BINDING SITE III. Table 2 illustrates the complementarity of the nucleotide sequences of RAI17 BINDING SITE, designated SEQ ID:43865, to the nucleotide sequence of VGAM2604 RNA, herein designated VGAM RNA, also designated SEQ ID:5315.

Another function of VGAM2604 is therefore inhibition of Retinoic Acid Induced 17 (RAI17, Accession XM_166091). Accordingly, utilities of VGAM2604 include diagnosis, prevention and treatment of diseases and clinical conditions associated with RAI17. RBT1 (Accession NM_013368) is another VGAM2604 host target gene. RBT1 BINDING SITE is HOST TARGET binding site found in the 3' untranslated region of mRNA encoded by RBT1, corresponding to a HOST TARGET binding site such as BINDING SITE I, BINDING SITE II or BINDING SITE III. Table 2 illustrates the complementarity of the nucleotide sequences of RBT1 BINDING SITE, designated SEQ ID:15014, to the nucleotide sequence of VGAM2604 RNA, herein designated VGAM RNA, also designated SEQ ID:5315.

Another function of VGAM2604 is therefore inhibition of RBT1 (Accession NM_013368). Accordingly, utilities of VGAM2604 include diagnosis, prevention and treatment of diseases and clinical conditions associated with RBT1. Small EDRK-rich Factor 2 (SERF2, Accession NM_005770) is another VGAM2604 host target gene. SERF2 BINDING SITE is HOST TARGET binding site found in the 5' untranslated region of mRNA encoded by SERF2, corresponding to a HOST TARGET binding site such as BINDING SITE I, BINDING SITE II or BINDING SITE III. Table 2 illustrates the complementarity of the nucleotide sequences of SERF2 BINDING SITE, designated SEQ ID:12341, to the nucleotide sequence of VGAM2604 RNA, herein designated VGAM RNA, also designated SEQ ID:5315.

Another function of VGAM2604 is therefore inhibition of Small EDRK-rich Factor 2 (SERF2, Accession NM_005770). Accordingly, utilities of VGAM2604 include diagnosis, prevention and treatment of diseases and clinical conditions associated with SERF2. SS-56 (Accession XM_006063) is another VGAM2604 host target gene. SS-56 BINDING SITE is HOST TARGET binding site found in the 3' untranslated region of mRNA encoded by SS-56, corresponding to a HOST TARGET binding site such as BINDING SITE I, BINDING SITE II or BINDING SITE III. Table 2 illustrates the complementarity of the nucleotide sequences of SS-56 BINDING SITE, designated SEQ ID:29986, to the nucleotide sequence of VGAM2604 RNA, herein designated VGAM RNA, also designated SEQ ID:5315.

Another function of VGAM2604 is therefore inhibition of SS-56 (Accession XM_006063). Accordingly, utilities of VGAM2604 include diagnosis, prevention and treatment of diseases and clinical conditions associated with SS-56. Tetratricopeptide Repeat Domain 4 (TTC4, Accession XM_038926) is another VGAM2604 host target gene. TTC4 BINDING SITE is HOST TARGET binding site found in the 3' untranslated region of mRNA encoded by TTC4, corresponding to a HOST TARGET binding site such as BINDING SITE I, BINDING SITE II or BINDING SITE III. Table 2 illustrates the complementarity of the nucleotide sequences of TTC4 BINDING SITE, designated SEQ ID:32959, to the nucleotide sequence of VGAM2604 RNA, herein designated VGAM RNA, also designated SEQ ID:5315.

Another function of VGAM2604 is therefore inhibition of Tetratricopeptide Repeat Domain 4 (TTC4, Accession XM_038926). Accordingly, utilities of VGAM2604 include diagnosis, prevention and treatment of diseases and clinical conditions associated with TTC4. LOC113763 (Accession NM_138434) is another VGAM2604 host target gene. LOC113763 BINDING SITE is HOST TARGET binding site found in the 3' untranslated region of mRNA encoded by LOC113763, corresponding to a HOST TARGET binding site such as BINDING SITE I, BINDING SITE II or BINDING SITE III. Table 2 illustrates the complementarity of the nucleotide sequences of LOC113763 BINDING SITE, designated SEQ ID:28805, to the nucleotide sequence of VGAM2604 RNA, herein designated VGAM RNA, also designated SEQ ID:5315.

Another function of VGAM2604 is therefore inhibition of LOC113763 (Accession NM_138434). Accordingly, utilities of VGAM2604 include diagnosis, prevention and treatment of diseases and clinical conditions associated with LOC113763. LOC124221 (Accession XM_058785) is another VGAM2604 host target gene. LOC124221 BINDING SITE is HOST TARGET binding site found in the 5' untranslated region of mRNA encoded by LOC124221, corresponding to a HOST TARGET binding site such as BINDING SITE I, BINDING SITE II or BINDING SITE III. Table 2 illustrates the complementarity of the nucleotide sequences of LOC124221 BINDING SITE, designated SEQ ID:36743, to the nucleotide sequence of VGAM2604 RNA, herein designated VGAM RNA, also designated SEQ ID:5315.

Another function of VGAM2604 is therefore inhibition of LOC124221 (Accession XM_058785). Accordingly, utilities of VGAM2604 include diagnosis, prevention and treatment of diseases and clinical conditions associated with LOC124221. LOC138199 (Accession XM_059950) is another VGAM2604 host target gene. LOC138199 BINDING SITE is HOST TARGET binding site found in the 3' untranslated region of mRNA encoded by LOC138199, corresponding to a HOST TARGET binding site such as BINDING SITE I, BINDING SITE II or BINDING SITE III. Table 2 illustrates the complementarity of the nucleotide sequences of LOC138199 BINDING SITE, designated SEQ ID:37118, to the nucleotide sequence of VGAM2604 RNA, herein designated VGAM RNA, also designated SEQ ID:5315.

Another function of VGAM2604 is therefore inhibition of LOC138199 (Accession XM_059950). Accordingly, utilities of VGAM2604 include diagnosis, prevention and treatment of diseases and clinical conditions associated with LOC138199. LOC150113 (Accession XM_104532) is another VGAM2604 host target gene. LOC150113 BINDING SITE is HOST TARGET binding site found in the 5' untranslated region of mRNA encoded by LOC150113, corresponding to a HOST TARGET binding site such as BINDING SITE I, BINDING SITE II or BINDING SITE III. Table 2 illustrates the complementarity of the nucleotide sequences of LOC150113 BINDING SITE, designated SEQ ID:42169, to the nucleotide sequence of VGAM2604 RNA, herein designated VGAM RNA, also designated SEQ ID:5315.

Another function of VGAM2604 is therefore inhibition of LOC150113 (Accession XM_104532). Accordingly, utilities of VGAM2604 include diagnosis, prevention and treatment of diseases and clinical conditions associated with LOC150113. LOC152315 (Accession XM_087440) is another VGAM2604 host target gene. LOC152315 BINDING SITE is HOST TARGET binding site found in the 5' untranslated region of mRNA encoded by LOC152315, corresponding to a HOST TARGET binding site such as BINDING SITE I, BINDING SITE II or BINDING SITE III. Table 2 illustrates the complementarity of the nucleotide sequences of LOC152315 BINDING SITE, designated SEQ ID:39257, to the nucleotide sequence of VGAM2604 RNA, herein designated VGAM RNA, also designated SEQ ID:5315.

Another function of VGAM2604 is therefore inhibition of LOC152315 (Accession XM_087440). Accordingly, utilities of VGAM2604 include diagnosis, prevention and treatment of diseases and clinical conditions associated with LOC152315. LOC152328 (Accession XM_087420) is another VGAM2604 host target gene. LOC152328 BINDING SITE is HOST TARGET binding site found in the 3' untranslated region of mRNA encoded by LOC152328, corresponding to a HOST TARGET binding site such as BINDING SITE I, BINDING SITE II or BINDING SITE III. Table 2 illustrates the complementarity of the nucleotide sequences of LOC152328 BINDING SITE, designated SEQ ID:39243, to the nucleotide sequence of VGAM2604 RNA, herein designated VGAM RNA, also designated SEQ ID:5315.

Another function of VGAM2604 is therefore inhibition of LOC152328 (Accession XM_087420). Accordingly, utilities of VGAM2604 include diagnosis, prevention and treatment of diseases and clinical conditions associated with LOC152328. LOC158527 (Accession XM_088594) is another VGAM2604 host target gene. LOC158527 BINDING SITE is HOST TARGET binding site found in the 5' untranslated region of mRNA encoded by LOC158527, corresponding to a HOST TARGET binding site such as BINDING SITE I, BINDING SITE II or BINDING SITE III. Table 2 illustrates the complementarity of the nucleotide sequences of LOC158527 BINDING SITE, designated SEQ ID:39860, to the nucleotide sequence of VGAM2604 RNA, herein designated VGAM RNA, also designated SEQ ID:5315.

Another function of VGAM2604 is therefore inhibition of LOC158527 (Accession XM_088594). Accordingly, utilities of VGAM2604 include diagnosis, prevention and treatment of diseases and clinical conditions associated with LOC158527. LOC196500 (Accession XM_113734) is another VGAM2604 host target gene. LOC196500 BINDING SITE is HOST TARGET binding site found in the 3' untranslated region of mRNA encoded by LOC196500, corresponding to a HOST TARGET binding site such as BINDING SITE I, BINDING SITE II or BINDING SITE III. Table 2 illustrates the complementarity of the nucleotide sequences of LOC196500 BINDING SITE, designated SEQ ID:42387, to the nucleotide sequence of VGAM2604 RNA, herein designated VGAM RNA, also designated SEQ ID:5315.

Another function of VGAM2604 is therefore inhibition of LOC196500 (Accession XM_113734). Accordingly, utilities of VGAM2604 include diagnosis, prevention and treatment of diseases and clinical conditions associated with LOC196500. LOC196759 (Accession XM_113601) is another VGAM2604 host target gene. LOC196759 BINDING SITE is HOST TARGET binding site found in the 3' untranslated region of mRNA encoded by LOC196759, corresponding to a HOST TARGET binding site such as BINDING SITE I, BINDING SITE II or BINDING SITE III. Table 2 illustrates the complementarity of the nucleotide sequences of LOC196759 BINDING SITE, designated SEQ ID:42295, to the nucleotide sequence of VGAM2604 RNA, herein designated VGAM RNA, also designated SEQ ID:5315.

Another function of VGAM2604 is therefore inhibition of LOC196759 (Accession XM_113601). Accordingly, utilities of VGAM2604 include diagnosis, prevention and treatment of diseases and clinical conditions associated with LOC196759. LOC200205 (Accession XM_114152) is another VGAM2604 host target gene. LOC200205 BINDING SITE is HOST TARGET binding site found in the 3' untranslated region of mRNA encoded by LOC200205, corresponding to a HOST TARGET binding site such as BINDING SITE I, BINDING SITE II or BINDING SITE III. Table 2 illustrates the complementarity of the nucleotide sequences of LOC200205 BINDING SITE, designated SEQ ID:42738, to the nucleotide sequence of VGAM2604 RNA, herein designated VGAM RNA, also designated SEQ ID:5315.

Another function of VGAM2604 is therefore inhibition of LOC200205 (Accession XM_114152). Accordingly, utilities of VGAM2604 include diagnosis, prevention and treatment of diseases and clinical conditions associated with LOC200205. LOC221463 (Accession XM_166374) is another VGAM2604 host target gene. LOC221463 BINDING SITE is HOST TARGET binding site found in the 3' untranslated region of mRNA encoded by LOC221463, corresponding to a HOST TARGET binding site such as BINDING SITE I, BINDING SITE II or BINDING SITE III. Table 2 illustrates the complementarity of the nucleotide sequences of LOC221463 BINDING SITE, designated SEQ ID:44205, to the nucleotide sequence of VGAM2604 RNA, herein designated VGAM RNA, also designated SEQ ID:5315.

Another function of VGAM2604 is therefore inhibition of LOC221463 (Accession XM_166374). Accordingly, utilities of VGAM2604 include diagnosis, prevention and treatment of diseases and clinical conditions associated with LOC221463. LOC221922 (Accession XM_166555) is another VGAM2604 host target gene. LOC221922 BINDING SITE is HOST TARGET binding site found in the 5' untranslated region of mRNA encoded by LOC221922, corresponding to a HOST TARGET binding site such as BINDING SITE I, BINDING SITE II or BINDING SITE III. Table 2 illustrates the complementarity of the nucleotide sequences of LOC221922 BINDING SITE, designated SEQ ID:44536, to the nucleotide sequence of VGAM2604 RNA, herein designated VGAM RNA, also designated SEQ ID:5315.

Another function of VGAM2604 is therefore inhibition of LOC221922 (Accession XM_166555). Accordingly, utilities of VGAM2604 include diagnosis, prevention and treatment of diseases and clinical conditions associated with LOC221922. LOC254082 (Accession XM_173165) is another VGAM2604 host target gene. LOC254082 BINDING SITE is HOST TARGET binding site found in the 5' untranslated region of mRNA encoded by LOC254082, corresponding to a HOST TARGET binding site such as BINDING SITE I, BINDING SITE II or BINDING SITE III. Table 2 illustrates the complementarity of the nucleotide sequences of LOC254082 BINDING SITE, designated SEQ ID:46423, to the nucleotide sequence of VGAM2604 RNA, herein designated VGAM RNA, also designated SEQ ID:5315.

Another function of VGAM2604 is therefore inhibition of LOC254082 (Accession XM_173165). Accordingly, utilities of VGAM2604 include diagnosis, prevention and treatment of diseases and clinical conditions associated with LOC254082. LOC257354 (Accession XM_170810) is another VGAM2604 host target gene. LOC257354 BINDING SITE is HOST TARGET binding site found in the 3' untranslated region of mRNA encoded by LOC257354, corresponding to a HOST TARGET binding site such as BINDING SITE I, BINDING SITE II or BINDING SITE III. Table 2 illustrates the complementarity of the nucleotide sequences of LOC257354 BINDING SITE, designated SEQ ID:45584, to the nucleotide sequence of VGAM2604 RNA, herein designated VGAM RNA, also designated SEQ ID:5315.

Another function of VGAM2604 is therefore inhibition of LOC257354 (Accession XM_170810). Accordingly, utilities of VGAM2604 include diagnosis, prevention and treatment of diseases and clinical conditions associated with LOC257354. LOC257612 (Accession XM_175270) is another VGAM2604 host target gene. LOC257612 BINDING SITE is HOST TARGET binding site found in the 5' untranslated region of mRNA encoded by LOC257612, corresponding to a HOST TARGET binding site such as BINDING SITE I, BINDING SITE II or BINDING SITE III. Table 2 illustrates the complementarity of the nucleotide sequences of LOC257612 BINDING SITE, designated SEQ ID:46741, to the nucleotide sequence of VGAM2604 RNA, herein designated VGAM RNA, also designated SEQ ID:5315.

Another function of VGAM2604 is therefore inhibition of LOC257612 (Accession XM_175270). Accordingly, utilities of VGAM2604 include diagnosis, prevention and treatment of diseases and clinical conditions associated with LOC257612. LOC51696 (Accession NM_016217) is another VGAM2604 host target gene. LOC51696 BINDING SITE is HOST TARGET binding site found in the 3' untranslated region of mRNA encoded by LOC51696, corresponding to a HOST TARGET binding site such as BINDING SITE I, BINDING SITE II or BINDING SITE III. Table 2 illustrates the complementarity of the nucleotide sequences of LOC51696 BINDING SITE, designated SEQ ID:18314, to the nucleotide sequence of VGAM2604 RNA, herein designated VGAM RNA, also designated SEQ ID:5315.

Another function of VGAM2604 is therefore inhibition of LOC51696 (Accession NM_016217). Accordingly, utilities of VGAM2604 include diagnosis, prevention and treatment of diseases and clinical conditions associated with LOC51696. LOC91694 (Accession XM_040082) is another VGAM2604 host target gene. LOC91694 BINDING SITE is HOST TARGET binding site found in the 5' untranslated region of mRNA encoded by LOC91694, corresponding to a HOST TARGET binding site such as BINDING SITE I, BINDING SITE II or BINDING SITE III. Table 2 illustrates the complementarity of the nucleotide sequences of LOC91694 BINDING SITE, designated SEQ ID:33250, to the nucleotide sequence of VGAM2604 RNA, herein designated VGAM RNA, also designated SEQ ID:5315.

Another function of VGAM2604 is therefore inhibition of LOC91694 (Accession XM_040082). Accordingly, utilities of VGAM2604 include diagnosis, prevention and treatment of diseases and clinical conditions associated with LOC91694. FIG. 1 further provides a conceptual description of a novel bioinformatically detected viral gene of the present invention, referred to here as Viral Genomic Address Messenger 2605 (VGAM2605) viral gene, which modulates expression of respective host target genes thereof, the function and utility of which host target genes is known in the art.

VGAM2605 is a novel bioinformatically detected regulatory, non protein coding, viral micro RNA (miRNA) gene. The method by which VGAM2605 was detected is described hereinabove with reference to FIGS. 1-8.

VGAM2605 gene, herein designated VGAM GENE, is a viral gene contained in the genome of Salmon Pancreas Disease Virus. VGAM2605 host target gene, herein designated VGAM HOST TARGET GENE, is a human gene contained in the human genome.

VGAM2605 gene encodes a VGAM2605 precursor RNA, herein designated VGAM PRECURSOR RNA. Similar to other miRNA genes, and unlike most ordinary genes, VGAM2605 precursor RNA does not encode a protein. A nucleotide sequence identical or highly similar to the nucleotide sequence of VGAM2605 precursor RNA is designated SEQ ID:2591, and is provided hereinbelow with reference to the sequence listing part. Nucleotide sequence SEQ ID:2591 is located at position 9457 relative to the genome of Salmon Pancreas Disease Virus.

VGAM2605 precursor RNA folds onto itself, forming VGAM2605 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2605 folded precursor RNA into VGAM2605 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2605 RNA is designated SEQ ID:5316, and is provided hereinbelow with reference to the sequence listing part.

VGAM2605 host target gene, herein designated VGAM HOST TARGET GENE, encodes a corresponding messenger RNA, VGAM2605 host target RNA, herein designated VGAM HOST TARGET RNA. VGAM2605 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2605 RNA, herein designated VGAM RNA, binds complementarily to one or more host target binding sites located in untranslated regions of VGAM2605 host target RNA, herein designated VGAM HOST TARGET RNA. This complementary binding is due to the fact that the nucleotide sequence of VGAM2605 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2605 RNA, herein designated VGAM RNA, may have a different number of host target binding sites in untranslated regions of a VGAM2605 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2605 RNA, herein designated VGAM RNA, to host target binding sites on VGAM2605 host target RNA, herein designated VGAM HOST TARGET RNA, such as BINDING SITE I, BINDING SITE II and BINDING SITE III, inhibits translation of VGAM2605 host target RNA into VGAM2605 host target protein, herein designated VGAM HOST TARGET PROTEIN. VGAM host target protein is therefore outlined by a broken line.

It is appreciated that VGAM2605 host target gene, herein designated VGAM HOST TARGET GENE, in fact represents a plurality of VGAM2605 host target genes. The mRNA of each one of this plurality of VGAM2605 host target genes comprises one or more host target binding sites, each having a nucleotide sequence which is at least partly complementary to VGAM2605 RNA, herein designated VGAM RNA, and which when bound by VGAM2605 RNA causes inhibition of translation of respective one or more VGAM2605 host target proteins.

It is further appreciated by one skilled in the art that the mode of translational inhibition illustrated by FIG. 1 with specific reference to translational inhibition exerted by VGAM2605 gene, herein designated VGAM GENE, on one or more VGAM2605 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2605 is inhibition of expression of host target genes, as part of a novel viral mechanism of attacking a host. Accordingly, utilities of VGAM2605 include diagnosis, prevention and treatment of viral infection by Salmon Pancreas Disease Virus. Specific functions, and accordingly utilities, of VGAM2605 correlate with, and may be deduced from, the identity of the host target genes which VGAM2605 binds and inhibits, and the function of these host target genes, as elaborated hereinbelow.

Nucleotide sequences of the VGAM2605 precursor RNA, herein designated VGAM PRECURSOR RNA, and of the 'diced' VGAM2605 RNA, herein designated VGAM RNA, and a schematic representation of the secondary folding of VGAM2605 folded precursor RNA, herein designated VGAM FOLDED PRECURSOR RNA, of VGAM2605 are further described hereinbelow with reference to Table 1.

Nucleotide sequences of host target binding sites, such as BINDING SITE-I, BINDING SITE-II and BINDING SITE-III of FIG. 1, found on VGAM2605 host target RNA, and schematic representation of the complementarity of each of these host target binding sites to VGAM2605 RNA, herein designated VGAM RNA, are described hereinbelow with reference to Table 2.

As mentioned hereinabove with reference to FIG. 1, a function of VGAM2605 gene, herein designated VGAM is inhibition of expression of VGAM2605 target genes. It is appreciated that specific functions, and accordingly utilities, of VGAM2605 correlate with, and may be deduced from, the identity of the target genes which VGAM2605 binds and inhibits, and the function of these target genes, as elaborated hereinbelow.

FLJ11850 (Accession NM_022741) is a VGAM2605 host target gene. FLJ11850 BINDING SITE is HOST TARGET binding site found in the 3' untranslated region of mRNA encoded by FLJ11850, corresponding to a HOST TARGET binding site such as BINDING SITE I, BINDING SITE II or BINDING SITE III. Table 2 illustrates the complementarity of the nucleotide sequences of FLJ11850 BINDING SITE, designated SEQ ID:22951, to the nucleotide sequence of VGAM2605 RNA, herein designated VGAM RNA, also designated SEQ ID:5316.

A function of VGAM2605 is therefore inhibition of FLJ11850 (Accession NM_022741). Accordingly, utilities of VGAM2605 include diagnosis, prevention and treatment of diseases and clinical conditions associated with FLJ11850. RAP2B, Member of RAS Oncogene Family (RAP2B, Accession XM_171061) is another VGAM2605 host target gene. RAP2B BINDING SITE is HOST TARGET binding site found in the 3' untranslated region of mRNA encoded by RAP2B, corresponding to a HOST TARGET binding site such as BINDING SITE I, BINDING SITE II or BINDING SITE III. Table 2 illustrates the complementarity of the nucleotide sequences of RAP2B BINDING SITE, designated SEQ ID:45860, to the nucleotide sequence of VGAM2605 RNA, herein designated VGAM RNA, also designated SEQ ID:5316.

Another function of VGAM2605 is therefore inhibition of RAP2B, Member of RAS Oncogene Family (RAP2B, Accession XM_171061). Accordingly, utilities of VGAM2605 include diagnosis, prevention and treatment of diseases and clinical conditions associated with RAP2B. LOC121274 (Accession XM_058547) is another VGAM2605 host target gene. LOC121274 BINDING SITE is HOST TARGET binding site found in the 3' untranslated region of mRNA encoded by LOC121274, corresponding to a HOST TARGET binding site such as BINDING SITE I, BINDING SITE II or BINDING SITE III. Table 2 illustrates the complementarity of the nucleotide sequences of LOC121274 BINDING SITE, designated SEQ ID:36657, to the nucleotide sequence of VGAM2605 RNA, herein designated VGAM RNA, also designated SEQ ID:5316.

Another function of VGAM2605 is therefore inhibition of LOC121274 (Accession XM_058547). Accordingly, utilities of VGAM2605 include diagnosis, prevention and treatment of diseases and clinical conditions associated with LOC121274. FIG. 1 further provides a conceptual description of a novel bioinformatically detected viral gene of the present invention, referred to here as Viral Genomic Address Messenger 2606 (VGAM2606) viral gene, which modulates expression of respective host target genes thereof, the function and utility of which host target genes is known in the art.

VGAM2606 is a novel bioinformatically detected regulatory, non protein coding, viral micro RNA (miRNA) gene. The method by which VGAM2606 was detected is described hereinabove with reference to FIGS. 1-8.

VGAM2606 gene, herein designated VGAM GENE, is a viral gene contained in the genome of Salmon Pancreas Disease Virus. VGAM2606 host target gene, herein designated VGAM HOST TARGET GENE, is a human gene contained in the human genome.

VGAM2606 gene encodes a VGAM2606 precursor RNA, herein designated VGAM PRECURSOR RNA. Similar to other miRNA genes, and unlike most ordinary genes, VGAM2606 precursor RNA does not encode a protein. A nucleotide sequence identical or highly similar to the nucleotide sequence of VGAM2606 precursor RNA is designated SEQ ID:2592, and is provided hereinbelow with reference to the sequence listing part. Nucleotide sequence SEQ ID:2592 is located at position 11312 relative to the genome of Salmon Pancreas Disease Virus.

VGAM2606 precursor RNA folds onto itself, forming VGAM2606 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2606 folded precursor RNA into VGAM2606 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2606 RNA is designated SEQ ID:5317, and is provided hereinbelow with reference to the sequence listing part.

VGAM2606 host target gene, herein designated VGAM HOST TARGET GENE, encodes a corresponding messenger RNA, VGAM2606 host target RNA, herein designated VGAM HOST TARGET RNA. VGAM2606 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2606 RNA, herein designated VGAM RNA, binds complementarily to one or more host target binding sites located in untranslated regions of VGAM2606 host target RNA, herein designated VGAM HOST TARGET RNA. This complementary binding is due to the fact that the nucleotide sequence of VGAM2606 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2606 RNA, herein designated VGAM RNA, may have a different number of host target binding sites in untranslated regions of a VGAM2606 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2606 RNA, herein designated VGAM RNA, to host target binding sites on VGAM2606 host target RNA, herein designated VGAM HOST TARGET RNA, such as BINDING SITE I, BINDING SITE II and BINDING SITE III, inhibits translation of VGAM2606 host target RNA into VGAM2606 host target protein, herein designated VGAM HOST TARGET PROTEIN. VGAM host target protein is therefore outlined by a broken line.

It is appreciated that VGAM2606 host target gene, herein designated VGAM HOST TARGET GENE, in fact represents a plurality of VGAM2606 host target genes. The mRNA of each one of this plurality of VGAM2606 host target genes comprises one or more host target binding sites, each having a nucleotide sequence which is at least partly complementary to VGAM2606 RNA, herein designated VGAM RNA, and which when bound by VGAM2606 RNA causes inhibition of translation of respective one or more VGAM2606 host target proteins.

It is further appreciated by one skilled in the art that the mode of translational inhibition illustrated by FIG. 1 with specific reference to translational inhibition exerted by VGAM2606 gene, herein designated VGAM GENE, on one or more VGAM2606 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2606 is inhibition of expression of host target genes, as part of a novel viral mechanism of attacking a host. Accordingly, utilities of VGAM2606 include diagnosis, prevention and treatment of viral infection by Salmon Pancreas Disease Virus. Specific functions, and accordingly utilities, of VGAM2606 correlate with, and may be deduced from, the identity of the host target genes which VGAM2606 binds and inhibits, and the function of these host target genes, as elaborated hereinbelow.

Nucleotide sequences of the VGAM2606 precursor RNA, herein designated VGAM PRECURSOR RNA, and of the 'diced' VGAM2606 RNA, herein designated VGAM RNA, and a schematic representation of the secondary folding of VGAM2606 folded precursor RNA, herein designated VGAM FOLDED PRECURSOR RNA, of VGAM2606 are further described hereinbelow with reference to Table 1.

Nucleotide sequences of host target binding sites, such as BINDING SITE-I, BINDING SITE-II and BINDING SITE-III of FIG. 1, found on VGAM2606 host target RNA, and schematic representation of the complementarity of each of these host target binding sites to VGAM2606 RNA, herein designated VGAM RNA, are described hereinbelow with reference to Table 2.

As mentioned hereinabove with reference to FIG. 1, a function of VGAM2606 gene, herein designated VGAM is inhibition of expression of VGAM2606 target genes. It is appreciated that specific functions, and accordingly utilities, of VGAM2606 correlate with, and may be deduced from, the identity of the target genes which VGAM2606 binds and inhibits, and the function of these target genes, as elaborated hereinbelow.

Grancalcin, EF-hand Calcium Binding Protein (GCA, Accession NM_012198) is a VGAM2606 host target gene. GCA BINDING SITE is HOST TARGET binding site found in the 3' untranslated region of mRNA encoded by GCA, corresponding to a HOST TARGET binding site such as BINDING SITE I, BINDING SITE II or BINDING SITE III. Table 2 illustrates the complementarity of the nucleotide sequences of GCA BINDING SITE, designated SEQ ID:14497, to the nucleotide sequence of VGAM2606 RNA, herein designated VGAM RNA, also designated SEQ ID:5317.

A function of VGAM2606 is therefore inhibition of Grancalcin, EF-hand Calcium Binding Protein (GCA, Accession NM_012198), a gene which may play a role in granule-membrane fusion and degranulation. Accordingly, utilities of VGAM2606 include diagnosis, prevention and treatment of diseases and clinical conditions associated with GCA. The function of GCA has been established by previous studies. By probing with antibody to the purified protein, Boyhan et al. (1992) cloned GCA, which they called grancalcin, from a promyocytic cell line expression library. The deduced 217-amino acid protein has a calculated molecular mass of 24 kD. The sequence contains an EF-hand calcium-binding region, a potential phosphorylation site, and 2 potential N-glycosylation sites. GCA shares 58% identity over 192 amino acids with sorcin (OMIM Ref. No. 182520), and about 30% identity over the calcium-binding domains of calpains (see OMIM Ref. No. 114220). Northern blot analysis revealed abundant expression of a 1.65-kb transcript in bone marrow and weaker expression in neutrophils, myeloid leukemic cells, and 2 Epstein-Barr virus-transformed B-cell lines. By Western blot analysis, a 28-kD protein was observed in B and T cells at low concentrations, and at higher levels in neutrophils and macrophages. Subcellular fractionation showed localization to be dependent upon Ca (2+) and Mg (2+). In the absence of divalent cation, grancalcin localized to the cytosolic fraction; with Mg (2+) alone, it partitioned with the granule fraction; and in the presence of Mg (2+) and Ca (2+), it associated with both the granule and membrane fractions. Teahan et al. (1992) purified grancalcin from leukopheresis samples of patients with chronic granulocytic leukemia. The purified protein migrated as a 28-kD protein by SDS-PAGE and formed homodimers of 55 kD upon gel filtration that was independent of reducing agents. No biochemical evidence was found for phosphorylation or glycosylation. Calcium binding was suggested by the difference in migration on SDS/PAGE between calcium-loaded and calcium-depleted preparations, and was confirmed by the binding of Ca (2+) to slot blots of the native protein.

Full details of the abovementioned studies are described in the following publications, the disclosure of which are hereby incorporated by reference:

Boyhan, A.; Casimir, C. M.; French, J. K.; Teahan, C. G.; Segal, A. W.: Molecular cloning and characterization of grancalcin, a novel EF-hand calcium-binding protein abundant in neutrophils and monocytes. J. Biol. Chem. 267:2928-2933, 1992; and Teahan, C. G.; Totty, N. F.; Segal, A. W.: Isolation and characterization of grancalcin, a novel 28 kDa EF-hand calcium-binding protein from human neutrophils. Biochem. J. 286:549-554.

Further studies establishing the function and utilities of GCA are found in John Hopkins OMIM database record ID 607030, and in sited publications numbered 5384-5385 listed in the bibliography section hereinbelow, which are also hereby incorporated by reference. MADS Box Transcription Enhancer Factor 2, Polypeptide C (myocyte enhancer factor 2C) (MEF2C, Accession NM_002397) is another VGAM2606 host target gene. MEF2C BINDING SITE is HOST TARGET binding site found in the 3' untranslated region of mRNA encoded by MEF2C, corresponding to a HOST TARGET binding site such as BINDING SITE I, BINDING SITE II or BINDING SITE III. Table 2 illustrates the complementarity of the nucleotide sequences of MEF2C BINDING SITE, designated SEQ ID:8215, to the nucleotide sequence of VGAM2606 RNA, herein designated VGAM RNA, also designated SEQ ID:5317.

Another function of VGAM2606 is therefore inhibition of MADS Box Transcription Enhancer Factor 2, Polypeptide C (myocyte enhancer factor 2C) (MEF2C, Accession NM_002397), a gene which regulates muscle-specific and mitogen-inducible genes. Accordingly, utilities of VGAM2606 include diagnosis, prevention and treatment of diseases and clinical conditions associated with MEF2C. The function of MEF2C and its association with various diseases and clinical conditions, has been established by previous studies, as described hereinabove with reference to VGAM386. Cab45 (Accession NM_016176) is another VGAM2606 host target gene. Cab45 BINDING SITE1 and Cab45 BINDING SITE2 are HOST TARGET binding sites found in untranslated regions of mRNA encoded by Cab45, corresponding to HOST TARGET binding sites such as BINDING SITE I, BINDING SITE II or BINDING SITE III. Table 2 illustrates the complementarity of the nucleotide sequences of Cab45 BINDING SITE1 and Cab45 BINDING SITE2, designated SEQ ID:18279 and SEQ ID:18622 respectively, to the nucleotide sequence of VGAM2606 RNA, herein designated VGAM RNA, also designated SEQ ID:5317.

Another function of VGAM2606 is therefore inhibition of Cab45 (Accession NM_016176). Accordingly, utilities of VGAM2606 include diagnosis, prevention and treatment of diseases and clinical conditions associated with Cab45. Mitochondrial Ribosomal Protein L35 (MRPL35, Accession NM_016622) is another VGAM2606 host target gene. MRPL35 BINDING SITE is HOST TARGET binding site found in the 3' untranslated region of mRNA encoded by MRPL35, corresponding to a HOST TARGET binding site such as BINDING SITE I, BINDING SITE II or BINDING SITE III. Table 2 illustrates the complementarity of the nucleotide sequences of MRPL35 BINDING SITE, designated SEQ ID:18739, to the nucleotide sequence of VGAM2606 RNA, herein designated VGAM RNA, also designated SEQ ID:5317.

Another function of VGAM2606 is therefore inhibition of Mitochondrial Ribosomal Protein L35 (MRPL35, Accession NM_016622). Accordingly, utilities of VGAM2606 include diagnosis, prevention and treatment of diseases and clinical conditions associated with MRPL35. FIG. 1 further provides a conceptual description of a novel bioinformatically detected viral gene of the present invention, referred to here as Viral Genomic Address Messenger 2607 (VGAM2607) viral gene, which modulates expression of respective host target genes thereof, the function and utility of which host target genes is known in the art.

VGAM2607 is a novel bioinformatically detected regulatory, non protein coding, viral micro RNA (miRNA) gene. The method by which VGAM2607 was detected is described hereinabove with reference to FIGS. 1-8.

VGAM2607 gene, herein designated VGAM GENE, is a viral gene contained in the genome of Ljungan Virus. VGAM2607 host target gene, herein designated VGAM HOST TARGET GENE, is a human gene contained in the human genome.

VGAM2607 gene encodes a VGAM2607 precursor RNA, herein designated VGAM PRECURSOR RNA. Similar to other miRNA genes, and unlike most ordinary genes, VGAM2607 precursor RNA does not encode a protein. A nucleotide sequence identical or highly similar to the nucleotide sequence of VGAM2607 precursor RNA is designated SEQ ID:2593, and is provided hereinbelow with reference to the sequence listing part. Nucleotide sequence SEQ ID:2593 is located at position 7425 relative to the genome of Ljungan Virus.

VGAM2607 precursor RNA folds onto itself, forming VGAM2607 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2607 folded precursor RNA into VGAM2607 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2607 RNA is designated SEQ ID:5318, and is provided hereinbelow with reference to the sequence listing part.

VGAM2607 host target gene, herein designated VGAM HOST TARGET GENE, encodes a corresponding messenger RNA, VGAM2607 host target RNA, herein designated VGAM HOST TARGET RNA. VGAM2607 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2607 RNA, herein designated VGAM RNA, binds complementarily to one or more host target binding sites located in untranslated regions of VGAM2607 host target RNA, herein designated VGAM HOST TARGET RNA. This complementary binding is due to the fact that the nucleotide sequence of VGAM2607 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2607 RNA, herein designated VGAM RNA, may have a different number of host target binding sites in untranslated regions of a VGAM2607 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2607 RNA, herein designated VGAM RNA, to host target binding sites on VGAM2607 host target RNA, herein designated VGAM HOST TARGET RNA, such as BINDING SITE I, BINDING SITE II and BINDING SITE III, inhibits translation of VGAM2607 host target RNA into VGAM2607 host target protein, herein designated VGAM HOST TARGET PROTEIN. VGAM host target protein is therefore outlined by a broken line.

It is appreciated that VGAM2607 host target gene, herein designated VGAM HOST TARGET GENE, in fact represents a plurality of VGAM2607 host target genes. The mRNA of each one of this plurality of VGAM2607 host target genes comprises one or more host target binding sites, each having a nucleotide sequence which is at least partly complementary to VGAM2607 RNA, herein designated VGAM RNA, and which when bound by VGAM2607 RNA causes inhibition of translation of respective one or more VGAM2607 host target proteins.

It is further appreciated by one skilled in the art that the mode of translational inhibition illustrated by FIG. 1 with specific reference to translational inhibition exerted by VGAM2607 gene, herein designated VGAM GENE, on one or more VGAM2607 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., ‘Perspective: Glimpses of a tiny RNA world’, Science 294,779 (2001)).

It is yet further appreciated that a function of VGAM2607 is inhibition of expression of host target genes, as part of a novel viral mechanism of attacking a host. Accordingly, utilities of VGAM2607 include diagnosis, prevention and treatment of viral infection by Ljungan Virus. Specific functions, and accordingly utilities, of VGAM2607 correlate with, and may be deduced from, the identity of the host target genes which VGAM2607 binds and inhibits, and the function of these host target genes, as elaborated hereinbelow.

Nucleotide sequences of the VGAM2607 precursor RNA, herein designated VGAM PRECURSOR RNA, and of the ‘diced’ VGAM2607 RNA, herein designated VGAM RNA, and a schematic representation of the secondary folding of VGAM2607 folded precursor RNA, herein designated VGAM FOLDED PRECURSOR RNA, of VGAM2607 are further described hereinbelow with reference to Table 1.

Nucleotide sequences of host target binding sites, such as BINDING SITE-I, BINDING SITE-II and BINDING SITE-III of FIG. 1, found on VGAM2607 host target RNA, and schematic representation of the complementarity of each of these host target binding sites to VGAM2607 RNA, herein designated VGAM RNA, are described hereinbelow with reference to Table 2.

As mentioned hereinabove with reference to FIG. 1, a function of VGAM2607 gene, herein designated VGAM is inhibition of expression of VGAM2607 target genes. It is appreciated that specific functions, and accordingly utilities, of VGAM2607 correlate with, and may be deduced from, the identity of the target genes which VGAM2607 binds and inhibits, and the function of these target genes, as elaborated hereinbelow.

BTB (POZ) Domain Containing 1 (BTBD1, Accession NM_025238) is a VGAM2607 host target gene. BTBD1 BINDING SITE is HOST TARGET binding site found in the 3' untranslated region of mRNA encoded by BTBD1, corresponding to a HOST TARGET binding site such as BINDING SITE I, BINDING SITE II or BINDING SITE III. Table 2 illustrates the complementarity of the nucleotide sequences of BTBD1 BINDING SITE, designated SEQ ID:24921, to the nucleotide sequence of VGAM2607 RNA, herein designated VGAM RNA, also designated SEQ ID:5318.

A function of VGAM2607 is therefore inhibition of BTB (POZ) Domain Containing 1 (BTBD1, Accession NM_025238). Accordingly, utilities of VGAM2607 include diagnosis, prevention and treatment of diseases and clinical conditions associated with BTBD1. DKFZP586N0721 (Accession NM_015400) is another VGAM2607 host target gene. DKFZP586N0721 BINDING SITE is HOST TARGET binding site found in the 3' untranslated region of mRNA encoded by DKFZP586N0721, corresponding to a HOST TARGET binding site such as BINDING SITE I, BINDING SITE II or BINDING SITE III. Table 2 illustrates the complementarity of the nucleotide sequences of DKFZP586N0721 BINDING SITE, designated SEQ ID:17711, to the nucleotide sequence of VGAM2607 RNA, herein designated VGAM RNA, also designated SEQ ID:5318.

Another function of VGAM2607 is therefore inhibition of DKFZP586N0721 (Accession NM_015400). Accordingly, utilities of VGAM2607 include diagnosis, prevention and treatment of diseases and clinical conditions associated with DKFZP586N0721. MGC2752 (Accession XM_085842) is another VGAM2607 host target gene. MGC2752 BINDING SITE is HOST TARGET binding site found in the 5' untranslated region of mRNA encoded by MGC2752, corresponding to a HOST TARGET binding site such as BINDING SITE I, BINDING SITE II or BINDING SITE III. Table 2 illustrates the complementarity of the nucleotide sequences of MGC2752 BINDING SITE, designated SEQ ID:38367, to the nucleotide sequence of VGAM2607 RNA, herein designated VGAM RNA, also designated SEQ ID:5318.

Another function of VGAM2607 is therefore inhibition of MGC2752 (Accession XM_085842). Accordingly, utilities of VGAM2607 include diagnosis, prevention and treatment of diseases and clinical conditions associated with MGC2752. LOC146953 (Accession XM_085659) is another VGAM2607 host target gene. LOC146953 BINDING SITE is HOST TARGET binding site found in the 5' untranslated region of mRNA encoded by LOC146953, corresponding to a HOST TARGET binding site such as BINDING SITE I, BINDING SITE II or BINDING SITE III. Table 2 illustrates the complementarity of the nucleotide sequences of LOC146953 BINDING SITE, designated SEQ ID:38285, to the nucleotide sequence of VGAM2607 RNA, herein designated VGAM RNA, also designated SEQ ID:5318.

Another function of VGAM2607 is therefore inhibition of LOC146953 (Accession XM_085659). Accordingly, utilities of VGAM2607 include diagnosis, prevention and treatment of diseases and clinical conditions associated with LOC146953. LOC151647 (Accession XM_087261) is another VGAM2607 host target gene. LOC151647 BINDING SITE is HOST TARGET binding site found in the 3' untranslated region of mRNA encoded by LOC151647, corresponding to a HOST TARGET binding site such as BINDING SITE I, BINDING SITE II or BINDING SITE III. Table 2 illustrates the complementarity of the nucleotide sequences of LOC151647 BINDING SITE, designated SEQ ID:39154, to the nucleotide sequence of VGAM2607 RNA, herein designated VGAM RNA, also designated SEQ ID:5318.

Another function of VGAM2607 is therefore inhibition of LOC151647 (Accession XM_087261). Accordingly, utilities of VGAM2607 include diagnosis, prevention and treatment of diseases and clinical conditions associated with LOC151647. LOC152453 (Accession XM_087475) is another VGAM2607 host target gene. LOC152453 BINDING SITE is HOST TARGET binding site found in the 5' untranslated region of mRNA encoded by LOC152453, corresponding to a HOST TARGET binding site such as BINDING SITE I, BINDING SITE II or BINDING SITE III. Table 2 illustrates the complementarity of the nucleotide sequences of LOC152453 BINDING SITE, designated SEQ ID:39275, to the nucleotide sequence of VGAM2607 RNA, herein designated VGAM RNA, also designated SEQ ID:5318.

Another function of VGAM2607 is therefore inhibition of LOC152453 (Accession XM_087475). Accordingly, utilities of VGAM2607 include diagnosis, prevention and treatment of diseases and clinical conditions associated with LOC152453. LOC254431 (Accession XM_173024) is another VGAM2607 host target gene. LOC254431 BINDING SITE is HOST TARGET binding site found in the 3' untranslated region of mRNA encoded by LOC254431, corresponding to a HOST TARGET binding site such as BINDING SITE I, BINDING SITE II or BINDING SITE III. Table 2 illustrates the complementarity of the nucleotide sequences of LOC254431 BINDING SITE, designated SEQ ID:46291, to the nucleotide sequence of VGAM2607 RNA, herein designated VGAM RNA, also designated SEQ ID:5318.

Another function of VGAM2607 is therefore inhibition of LOC254431 (Accession XM_173024). Accordingly, utilities of VGAM2607 include diagnosis, prevention and treatment of diseases and clinical conditions associated with LOC254431. LOC254778 (Accession XM_171193) is another VGAM2607 host target gene. LOC254778 BINDING SITE is HOST TARGET binding site found in the 3' untranslated region of mRNA encoded by LOC254778, corresponding to a HOST TARGET binding site such as BINDING SITE I, BINDING SITE II or BINDING SITE III. Table 2 illustrates the complementarity of the nucleotide sequences of LOC254778 BINDING SITE, designated SEQ ID:45978, to the nucleotide sequence of VGAM2607 RNA, herein designated VGAM RNA, also designated SEQ ID:5318.

Another function of VGAM2607 is therefore inhibition of LOC254778 (Accession XM_171193). Accordingly, utilities of VGAM2607 include diagnosis, prevention and treatment of diseases and clinical conditions associated with LOC254778. FIG. 1 further provides a conceptual description of a novel bioinformatically detected viral gene of the present invention, referred to here as Viral Genomic Address Messenger 2608 (VGAM2608) viral gene, which modulates expression of respective host target genes thereof, the function and utility of which host target genes is known in the art.

VGAM2608 is a novel bioinformatically detected regulatory, non protein coding, viral micro RNA (miRNA) gene. The method by which VGAM2608 was detected is described hereinabove with reference to FIGS. 1-8.

VGAM2608 gene, herein designated VGAM GENE, is a viral gene contained in the genome of Ljungan Virus. VGAM2608 host target gene, herein designated VGAM HOST TARGET GENE, is a human gene contained in the human genome.

VGAM2608 gene encodes a VGAM2608 precursor RNA, herein designated VGAM PRECURSOR RNA. Similar to other miRNA genes, and unlike most ordinary genes, VGAM2608 precursor RNA does not encode a protein. A nucleotide sequence identical or highly similar to the nucleotide sequence of VGAM2608 precursor RNA is designated SEQ ID:2594, and is provided hereinbelow with reference to the sequence listing part. Nucleotide sequence SEQ ID:2594 is located at position 6824 relative to the genome of Ljungan Virus.

VGAM2608 precursor RNA folds onto itself, forming VGAM2608 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2608 folded precursor RNA into VGAM2608 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 87%) nucleotide sequence of VGAM2608 RNA is designated SEQ ID:5319, and is provided hereinbelow with reference to the sequence listing part.

VGAM2608 host target gene, herein designated VGAM HOST TARGET GENE, encodes a corresponding messenger RNA, VGAM2608 host target RNA, herein designated VGAM HOST TARGET RNA. VGAM2608 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2608 RNA, herein designated VGAM RNA, binds complementarily to one or more host target binding sites located in untranslated regions of VGAM2608 host target RNA, herein designated VGAM HOST TARGET RNA. This complementary binding is due to the fact that the nucleotide sequence of VGAM2608 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2608 RNA, herein designated VGAM RNA, may have a different number of host target binding sites in untranslated regions of a VGAM2608 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5''UTR region, or in both 3'UTR and 5''UTR regions.

The complementary binding of VGAM2608 RNA, herein designated VGAM RNA, to host target binding sites on VGAM2608 host target RNA, herein designated VGAM HOST TARGET RNA, such as BINDING SITE I, BINDING SITE II and BINDING SITE III, inhibits translation of VGAM2608 host target RNA into VGAM2608 host target protein, herein designated VGAM HOST TARGET PROTEIN. VGAM host target protein is therefore outlined by a broken line.

It is appreciated that VGAM2608 host target gene, herein designated VGAM HOST TARGET GENE, in fact represents a plurality of VGAM2608 host target genes. The mRNA of each one of this plurality of VGAM2608 host target genes comprises one or more host target binding sites, each having a nucleotide sequence which is at least partly complementary to VGAM2608 RNA, herein designated VGAM RNA, and which when bound by VGAM2608 RNA causes inhibition of translation of respective one or more VGAM2608 host target proteins.

It is further appreciated by one skilled in the art that the mode of translational inhibition illustrated by FIG. 1 with specific reference to translational inhibition exerted by VGAM2608 gene, herein designated VGAM GENE, on one or more VGAM2608 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2608 is inhibition of expression of host target genes, as part of a novel viral mechanism of attacking a host. Accordingly, utilities of VGAM2608 include diagnosis, prevention and treatment of viral infection by Ljungan Virus. Specific functions, and accordingly utilities, of VGAM2608 correlate with, and may be deduced from, the identity of the host target genes which VGAM2608 binds and inhibits, and the function of these host target genes, as elaborated hereinbelow.

Nucleotide sequences of the VGAM2608 precursor RNA, herein designated VGAM PRECURSOR RNA, and of the 'diced' VGAM2608 RNA, herein designated VGAM RNA, and a schematic representation of the secondary folding of VGAM2608 folded precursor RNA, herein designated VGAM FOLDED PRECURSOR RNA, of VGAM2608 are further described hereinbelow with reference to Table 1.

Nucleotide sequences of host target binding sites, such as BINDING SITE-I, BINDING SITE-II and BINDING SITE-III of FIG. 1, found on VGAM2608 host target RNA, and schematic representation of the complementarity of each of these host target binding sites to VGAM2608 RNA, herein designated VGAM RNA, are described hereinbelow with reference to Table 2.

As mentioned hereinabove with reference to FIG. 1, a function of VGAM2608 gene, herein designated VGAM is inhibition of expression of VGAM2608 target genes. It is appreciated that specific functions, and accordingly utilities, of VGAM2608 correlate with, and may be deduced from, the identity of the target genes which VGAM2608 binds and inhibits, and the function of these target genes, as elaborated hereinbelow.

DNA (cytosine-5-)-methyltransferase 3 Beta (DNMT3B, Accession NM_006892) is a VGAM2608 host target gene. DNMT3B BINDING SITE is HOST TARGET binding site found in the 3' untranslated region of mRNA encoded by DNMT3B, corresponding to a HOST TARGET binding site such as BINDING SITE I, BINDING SITE II or BINDING SITE III. Table 2 illustrates the complementarity of the nucleotide sequences of DNMT3B BINDING SITE, designated SEQ ID:13760, to the nucleotide sequence of VGAM2608 RNA, herein designated VGAM RNA, also designated SEQ ID:5319.

A function of VGAM2608 is therefore inhibition of DNA (cytosine-5-)-methyltransferase 3 Beta (DNMT3B, Accession NM_006892), a gene which is required for genome wide de novo methylation. Accordingly, utilities of VGAM2608 include diagnosis, prevention and treatment of diseases and clinical conditions associated with DNMT3B. The function of DNMT3B and its association with various diseases and clinical conditions, has been established by previous studies, as described hereinabove with reference to VGAM280. Kelch-like 4 (Drosophila) (KLHL4, Accession NM_019117) is another VGAM2608 host target gene. KLHL4 BINDING SITE is HOST TARGET binding site found in the 3' untranslated region of mRNA encoded by KLHL4, corresponding to a HOST TARGET binding site such as BINDING SITE I, BINDING SITE II or BINDING SITE III. Table 2 illustrates the complementarity of the nucleotide sequences of KLHL4 BINDING SITE, designated SEQ ID:21193, to the nucleotide sequence of VGAM2608 RNA, herein designated VGAM RNA, also designated SEQ ID:5319.

Another function of VGAM2608 is therefore inhibition of Kelch-like 4 (Drosophila) (KLHL4, Accession NM_019117). Accordingly, utilities of VGAM2608 include diagnosis, prevention and treatment of diseases and clinical conditions associated with KLHL4. LOC153196 (Accession XM_098323) is another VGAM2608 host target gene. LOC153196 BINDING SITE is HOST TARGET binding site found in the 5' untranslated region of mRNA encoded by LOC153196, corresponding to a HOST TARGET binding site such as BINDING SITE I, BINDING SITE II or BINDING SITE III. Table 2 illustrates the complementarity of the nucleotide sequences of LOC153196 BINDING SITE, designated SEQ ID:41588, to the nucleotide sequence of VGAM2608 RNA, herein designated VGAM RNA, also designated SEQ ID:5319.

Another function of VGAM2608 is therefore inhibition of LOC153196 (Accession XM_098323). Accordingly, utilities of VGAM2608 include diagnosis, prevention and treatment of diseases and clinical conditions associated with LOC153196. LOC255096 (Accession XM_174913) is another VGAM2608 host target gene. LOC255096 BINDING SITE is HOST TARGET binding site found in the 5' untranslated region of mRNA encoded by LOC255096, corresponding to a HOST TARGET binding site such as BINDING SITE I, BINDING SITE II or BINDING SITE III. Table 2 illustrates the complementarity of the nucleotide sequences of LOC255096 BINDING SITE, designated SEQ ID:46607, to the nucleotide sequence of VGAM2608 RNA, herein designated VGAM RNA, also designated SEQ ID:5319.

Another function of VGAM2608 is therefore inhibition of LOC255096 (Accession XM_174913). Accordingly, utilities of VGAM2608 include diagnosis, prevention and treatment of diseases and clinical conditions associated with LOC255096. LOC256995 (Accession XM_174550) is another VGAM2608 host target gene. LOC256995 BINDING SITE is HOST TARGET binding site found in the 5' untranslated region of mRNA encoded by LOC256995, corresponding to a HOST TARGET binding site such as BINDING SITE I, BINDING SITE II or BINDING SITE III. Table 2 illustrates the complementarity of the nucleotide sequences of LOC256995 BINDING SITE, designated SEQ ID:46599, to the nucleotide sequence of VGAM2608 RNA, herein designated VGAM RNA, also designated SEQ ID:5319.

Another function of VGAM2608 is therefore inhibition of LOC256995 (Accession XM_174550). Accordingly, utilities of VGAM2608 include diagnosis, prevention and treatment of diseases and clinical conditions associated with LOC256995. FIG. 1 further provides a conceptual description of a novel bioinformatically detected viral gene of the present invention, referred to here as Viral Genomic Address Messenger 2609 (VGAM2609) viral gene, which modulates expression of respective host target genes thereof, the function and utility of which host target genes is known in the art.

VGAM2609 is a novel bioinformatically detected regulatory, non protein coding, viral micro RNA (miRNA) gene. The method by which VGAM2609 was detected is described hereinabove with reference to FIGS. 1-8.

VGAM2609 gene, herein designated VGAM GENE, is a viral gene contained in the genome of Ljungan Virus. VGAM2609 host target gene, herein designated VGAM HOST TARGET GENE, is a human gene contained in the human genome.

VGAM2609 gene encodes a VGAM2609 precursor RNA, herein designated VGAM PRECURSOR RNA. Similar to other miRNA genes, and unlike most ordinary genes, VGAM2609 precursor RNA does not encode a protein. A nucleotide sequence identical or highly similar to the nucleotide sequence of VGAM2609 precursor RNA is designated SEQ ID:2595, and is provided hereinbelow with reference to the sequence listing part. Nucleotide sequence SEQ ID:2595 is located at position 2766 relative to the genome of Ljungan Virus.

VGAM2609 precursor RNA folds onto itself, forming VGAM2609 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2609 folded precursor RNA into VGAM2609 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM2609 RNA is designated SEQ ID:5320, and is provided hereinbelow with reference to the sequence listing part.

VGAM2609 host target gene, herein designated VGAM HOST TARGET GENE, encodes a corresponding messenger RNA, VGAM2609 host target RNA, herein designated VGAM HOST TARGET RNA. VGAM2609 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2609 RNA, herein designated VGAM RNA, binds complementarily to one or more host target binding sites located in untranslated regions of VGAM2609 host target RNA, herein designated VGAM HOST TARGET RNA. This complementary binding is due to the fact that the nucleotide sequence of VGAM2609 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2609 RNA, herein designated VGAM RNA, may have a different number of host target binding sites in untranslated regions of a VGAM2609 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2609 RNA, herein designated VGAM RNA, to host target binding sites on VGAM2609 host target RNA, herein designated VGAM HOST TARGET RNA, such as BINDING SITE I, BINDING SITE II and BINDING SITE III, inhibits translation of VGAM2609 host target RNA into VGAM2609 host target protein, herein designated VGAM HOST TARGET PROTEIN. VGAM host target protein is therefore outlined by a broken line.

It is appreciated that VGAM2609 host target gene, herein designated VGAM HOST TARGET GENE, in fact represents a plurality of VGAM2609 host target genes. The mRNA of each one of this plurality of VGAM2609 host target genes comprises one or more host target binding sites, each having a nucleotide sequence which is at least partly complementary to VGAM2609 RNA, herein designated VGAM RNA, and which when bound by VGAM2609 RNA causes inhibition of translation of respective one or more VGAM2609 host target proteins.

It is further appreciated by one skilled in the art that the mode of translational inhibition illustrated by FIG. 1 with specific reference to translational inhibition exerted by VGAM2609 gene, herein designated VGAM GENE, on one or more VGAM2609 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2609 is inhibition of expression of host target genes, as part of a novel viral mechanism of attacking a host. Accordingly, utilities of VGAM2609 include diagnosis, prevention and treatment of viral infection by Ljungan Virus. Specific functions, and accordingly utilities, of VGAM2609 correlate with, and may be deduced from, the identity of the host target genes which VGAM2609 binds and inhibits, and the function of these host target genes, as elaborated hereinbelow.

Nucleotide sequences of the VGAM2609 precursor RNA, herein designated VGAM PRECURSOR RNA, and of the 'diced' VGAM2609 RNA, herein designated VGAM RNA, and a schematic representation of the secondary folding of VGAM2609 folded precursor RNA, herein designated VGAM FOLDED PRECURSOR RNA, of VGAM2609 are further described hereinbelow with reference to Table 1.

Nucleotide sequences of host target binding sites, such as BINDING SITE-I, BINDING SITE-II and BINDING SITE-III of FIG. 1, found on VGAM2609 host target RNA, and schematic representation of the complementarity of each of these host target binding sites to VGAM2609 RNA, herein designated VGAM RNA, are described hereinbelow with reference to Table 2.

As mentioned hereinabove with reference to FIG. 1, a function of VGAM2609 gene, herein designated VGAM is inhibition of expression of VGAM2609 target genes. It is appreciated that specific functions, and accordingly utilities, of VGAM2609 correlate with, and may be deduced from, the identity of the target genes which VGAM2609 binds and inhibits, and the function of these target genes, as elaborated hereinbelow.

Collagen, Type XIX, Alpha 1 (COL19A1, Accession NM_001858) is a VGAM2609 host target gene. COL19A1 BINDING SITE is HOST TARGET binding site found in the 3' untranslated region of mRNA encoded by COL19A1, corresponding to a HOST TARGET binding site such as BINDING SITE I, BINDING SITE II or BINDING SITE III. Table 2 illustrates the complementarity of the nucleotide sequences of COL19A1 BINDING SITE, designated SEQ ID:7591, to the nucleotide sequence of VGAM2609 RNA, herein designated VGAM RNA, also designated SEQ ID:5320.

A function of VGAM2609 is therefore inhibition of Collagen, Type XIX, Alpha 1 (COL19A1, Accession NM_001858), a gene which may act as a cross-bridge between fibrils and other extracellular matrix molecules. Accordingly, utilities of VGAM2609 include diagnosis, prevention and treatment of diseases and clinical conditions associated with COL19A1. The function of COL19A1 and its association with various diseases and clinical conditions, has been established by previous studies, as described hereinabove with reference to VGAM19. MADS Box Transcription Enhancer Factor 2, Polypeptide A (myocyte enhancer factor 2A) (MEF2A, Accession NM_005587) is another VGAM2609 host target gene. MEF2A BINDING SITE is HOST TARGET binding site found in the 3' untranslated region of mRNA encoded by MEF2A, corresponding to a HOST TARGET binding site such as BINDING SITE I, BINDING SITE II or BINDING SITE III. Table 2 illustrates the complementarity of the nucleotide sequences of MEF2A BINDING SITE, designated SEQ ID:12115, to the nucleotide sequence of VGAM2609 RNA, herein designated VGAM RNA, also designated SEQ ID:5320.

Another function of VGAM2609 is therefore inhibition of MADS Box Transcription Enhancer Factor 2, Polypeptide A (myocyte enhancer factor 2A) (MEF2A, Accession NM_005587), a gene which binds a consensus sequence that regulates transcription. Accordingly, utilities of VGAM2609 include diagnosis, prevention and treatment of diseases and clinical conditions associated with MEF2A. The function of MEF2A and its association with various diseases and clinical conditions, has been established by previous studies, as described hereinabove with reference to VGAM46. Cbp/p300-interacting Transactivator, with Glu/Asp-rich Carboxy-terminal Domain, 2 (CITED2, Accession NM_006079) is another VGAM2609 host target gene. CITED2 BINDING SITE is HOST TARGET binding site found in the 3' untranslated region of mRNA encoded by CITED2, corresponding to a HOST TARGET binding site such as BINDING SITE I, BINDING SITE II or BINDING SITE III. Table 2 illustrates the complementarity of the nucleotide sequences of CITED2 BINDING SITE, designated SEQ ID:12727, to the nucleotide sequence of VGAM2609 RNA, herein designated VGAM RNA, also designated SEQ ID:5320.

Another function of VGAM2609 is therefore inhibition of Cbp/p300-interacting Transactivator, with Glu/Asp-rich Carboxy-terminal Domain, 2 (CITED2, Accession NM_006079). Accordingly, utilities of VGAM2609 include diagnosis, prevention and treatment of diseases and clinical conditions associated with CITED2. FLJ20666 (Accession NM_018333) is another VGAM2609 host target gene. FLJ20666 BINDING SITE1 and FLJ20666 BINDING SITE2 are HOST TARGET binding sites found in untranslated regions of mRNA encoded by FLJ20666, corresponding to HOST TARGET binding sites such as BINDING SITE I, BINDING SITE II or BINDING SITE III. Table 2 illustrates the complementarity of the nucleotide sequences of FLJ20666 BINDING SITE1 and FLJ20666 BINDING SITE2, designated SEQ ID:20336 and SEQ ID:19583 respectively, to the nucleotide sequence of VGAM2609 RNA, herein designated VGAM RNA, also designated SEQ ID:5320.

Another function of VGAM2609 is therefore inhibition of FLJ20666 (Accession NM_018333). Accordingly, utilities of VGAM2609 include diagnosis, prevention and treatment of diseases and clinical conditions associated with FLJ20666. FIG. 1 further provides a conceptual description of a novel bioinformatically detected viral gene of the present invention, referred to here as Viral Genomic Address Messenger 2610 (VGAM2610) viral gene, which modulates expression of respective host target genes thereof, the function and utility of which host target genes is known in the art.

VGAM2610 is a novel bioinformatically detected regulatory, non protein coding, viral micro RNA (miRNA) gene. The method by which VGAM2610 was detected is described hereinabove with reference to FIGS. 1-8.

VGAM2610 gene, herein designated VGAM GENE, is a viral gene contained in the genome of Ljungan Virus. VGAM2610 host target gene, herein designated VGAM HOST TARGET GENE, is a human gene contained in the human genome.

VGAM2610 gene encodes a VGAM2610 precursor RNA, herein designated VGAM PRECURSOR RNA. Similar to other miRNA genes, and unlike most ordinary genes, VGAM2610 precursor RNA does not encode a protein. A nucleotide sequence identical or highly similar to the nucleotide sequence of VGAM2610 precursor RNA is designated SEQ ID:2596, and is provided hereinbelow with reference to the sequence listing part. Nucleotide sequence SEQ ID:2596 is located at position 7099 relative to the genome of Ljungan Virus.

VGAM2610 precursor RNA folds onto itself, forming VGAM2610 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2610 folded precursor RNA into VGAM2610 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2610 RNA is designated SEQ ID:5321, and is provided hereinbelow with reference to the sequence listing part.

VGAM2610 host target gene, herein designated VGAM HOST TARGET GENE, encodes a corresponding messenger RNA, VGAM2610 host target RNA, herein designated VGAM HOST TARGET RNA. VGAM2610 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2610 RNA, herein designated VGAM RNA, binds complementarily to one or more host target binding sites located in untranslated regions of VGAM2610 host target RNA, herein designated VGAM HOST TARGET RNA. This complementary binding is due to the fact that the nucleotide sequence of VGAM2610 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2610 RNA, herein designated VGAM RNA, may have a different number of host target binding sites in untranslated regions of a VGAM2610 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2610 RNA, herein designated VGAM RNA, to host target binding sites on VGAM2610 host target RNA, herein designated VGAM HOST TARGET RNA, such as BINDING SITE I, BINDING SITE II and BINDING SITE III, inhibits translation of VGAM2610 host target RNA into VGAM2610 host target protein, herein designated VGAM HOST TARGET PROTEIN. VGAM host target protein is therefore outlined by a broken line.

It is appreciated that VGAM2610 host target gene, herein designated VGAM HOST TARGET GENE, in fact represents a plurality of VGAM2610 host target genes. The mRNA of each one of this plurality of VGAM2610 host target genes comprises one or more host target binding sites, each having a nucleotide sequence which is at least partly complementary to VGAM2610 RNA, herein designated VGAM RNA, and which when bound by VGAM2610 RNA causes inhibition of translation of respective one or more VGAM2610 host target proteins.

It is further appreciated by one skilled in the art that the mode of translational inhibition illustrated by FIG. 1 with specific reference to translational inhibition exerted by VGAM2610 gene, herein designated VGAM GENE, on one or more VGAM2610 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2610 is inhibition of expression of host target genes, as part of a novel viral mechanism of attacking a host. Accordingly, utilities of VGAM2610 include diagnosis, prevention and treatment of viral infection by Ljungan Virus. Specific functions, and accordingly utilities, of VGAM2610 correlate with, and may be deduced from, the identity of the host target genes which VGAM2610 binds and inhibits, and the function of these host target genes, as elaborated hereinbelow.

Nucleotide sequences of the VGAM2610 precursor RNA, herein designated VGAM PRECURSOR RNA, and of the 'diced' VGAM2610 RNA, herein designated VGAM RNA, and a schematic representation of the secondary folding of VGAM2610 folded precursor RNA, herein designated VGAM FOLDED PRECURSOR RNA, of VGAM2610 are further described hereinbelow with reference to Table 1.

Nucleotide sequences of host target binding sites, such as BINDING SITE-I, BINDING SITE-II and BINDING SITE-III of FIG. 1, found on VGAM2610 host target RNA, and schematic representation of the complementarity of each of these host target binding sites to VGAM2610 RNA, herein designated VGAM RNA, are described hereinbelow with reference to Table 2.

As mentioned hereinabove with reference to FIG. 1, a function of VGAM2610 gene, herein designated VGAM is inhibition of expression of VGAM2610 target genes. It is appreciated that specific functions, and accordingly utilities, of VGAM2610 correlate with, and may be deduced from, the identity of the target genes which VGAM2610 binds and inhibits, and the function of these target genes, as elaborated hereinbelow.

FUS1 (Accession NM_007275) is a VGAM2610 host target gene. FUS1 BINDING SITE is HOST TARGET binding site found in the 3' untranslated region of mRNA encoded by FUS1, corresponding to a HOST TARGET binding site such as BINDING SITE I, BINDING SITE II or BINDING SITE III. Table 2 illustrates the complementarity of the nucleotide sequences of FUS1 BINDING SITE, designated SEQ ID:14137, to the nucleotide sequence of VGAM2610 RNA, herein designated VGAM RNA, also designated SEQ ID:5321.

A function of VGAM2610 is therefore inhibition of FUS1 (Accession NM_007275), a gene which may function as a tumor suppressor. Accordingly, utilities of VGAM2610 include diagnosis, prevention and treatment of diseases and clinical conditions associated with FUS1. The function of FUS1 and its association with various diseases and clinical conditions, has been established by previous studies, as described hereinabove with reference to VGAM1246. High-mobility Group Nucleosome Binding Domain 1 (HMGN1, Accession NM_004965) is another VGAM2610 host target gene. HMGN1 BINDING SITE is HOST TARGET binding site found in the 3' untranslated region of mRNA encoded by HMGN1, corresponding to a HOST TARGET binding site such as BINDING SITE I, BINDING SITE II or BINDING SITE III. Table 2 illustrates the complementarity of the nucleotide sequences of HMGN1 BINDING SITE, designated SEQ ID:11413, to the nucleotide sequence of VGAM2610 RNA, herein designated VGAM RNA, also designated SEQ ID:5321.

Another function of VGAM2610 is therefore inhibition of High-mobility Group Nucleosome Binding Domain 1 (HMGN1, Accession NM_004965), a gene which binds to the inner side of the nucleosomal DNA and involves in transcriptional regulation. Accordingly, utilities of VGAM2610 include diagnosis, prevention and treatment of diseases and clinical conditions associated with HMGN1. The function of HMGN1 and its association with various diseases and clinical conditions, has been established by previous studies, as described hereinabove with reference to VGAM381. Occludin (OCLN, Accession NM_002538) is another VGAM2610 host target gene. OCLN BINDING SITE is HOST TARGET binding site found in the 5' untranslated region of mRNA encoded by OCLN, corresponding to a HOST TARGET binding site such as BINDING SITE I, BINDING SITE II or BINDING SITE III. Table 2 illustrates the complementarity of the nucleotide sequences of OCLN BINDING SITE, designated SEQ ID:8379, to the nucleotide sequence of VGAM2610 RNA, herein designated VGAM RNA, also designated SEQ ID:5321.

Another function of VGAM2610 is therefore inhibition of Occludin (OCLN, Accession NM_002538). Accordingly, utilities of VGAM2610 include diagnosis, prevention and treatment of diseases and clinical conditions associated with OCLN. Phosphatidylinositol-4-phosphate 5-kinase, Type I, Alpha (PIP5K1A, Accession NM_003557) is another VGAM2610 host target gene. PIP5K1A BINDING SITE is HOST TARGET binding site found in the 3" untranslated region of mRNA encoded by PIP5K1A, corresponding to a HOST TARGET binding site such as BINDING SITE I, BINDING SITE II or BINDING SITE III. Table 2 illustrates the complementarity of the nucleotide sequences of PIP5K1A BINDING SITE, designated SEQ ID:9603, to the nucleotide sequence of VGAM2610 RNA, herein designated VGAM RNA, also designated SEQ ID:5321.

Another function of VGAM2610 is therefore inhibition of Phosphatidylinositol-4-phosphate 5-kinase, Type I, Alpha (PIP5K1A, Accession NM_003557), a gene which is responsible for the synthesis of PtdIns (4,5)P2. Accordingly, utilities of VGAM2610 include diagnosis, prevention and treatment of diseases and clinical conditions associated with PIP5K1A. The function of PIP5K1A and its association with various diseases and clinical conditions, has been established by previous studies, as described hereinabove with reference to VGAM427. Retinoid X Receptor, Alpha (RXRA, Accession NM_002957) is another VGAM2610 host target gene. RXRA BINDING SITE is HOST TARGET binding site found in the 3' untranslated region of mRNA encoded by RXRA, corresponding to a HOST TARGET binding site such as BINDING SITE I, BINDING SITE II or BINDING SITE III. Table 2 illustrates the complementarity of the nucleotide sequences of RXRA BINDING SITE, designated SEQ ID:8874, to the nucleotide sequence of VGAM2610 RNA, herein designated VGAM RNA, also designated SEQ ID:5321.

Another function of VGAM2610 is therefore inhibition of Retinoid X Receptor, Alpha (RXRA, Accession NM_002957), a gene which activates genes required for vitamin A metabolism, binds 9-cis retinoic acid. Accordingly, utilities of VGAM2610 include diagnosis, prevention and treatment of diseases and clinical conditions associated with RXRA. The function of RXRA and its association with various diseases and clinical conditions, has been established by previous studies, as described hereinabove with reference to VGAM349. Solute Carrier Family 1 (glutamate/neutral amino acid transporter), Member 4 (SLC1A4, Accession NM_003038) is another VGAM2610 host target gene. SLC1A4 BINDING SITE is HOST TARGET binding site found in the 3' untranslated region of mRNA encoded by SLC1A4, corresponding to a HOST TARGET binding site such as BINDING SITE I, BINDING SITE II or BINDING SITE III. Table 2 illustrates the complementarity of the nucleotide sequences of SLC1A4 BINDING SITE, designated SEQ ID:8996, to the nucleotide sequence of VGAM2610 RNA, herein designated VGAM RNA, also designated SEQ ID:5321.

Another function of VGAM2610 is therefore inhibition of Solute Carrier Family 1 (glutamate/neutral amino acid transporter), Member 4 (SLC1A4, Accession NM_003038), a gene which transports alanine, serine, cysteine, and threonine. exhibits sodium dependence. Accordingly, utilities of VGAM2610 include diagnosis, prevention and treatment of diseases and clinical conditions associated with SLC1A4. The function of SLC1A4 and its association with various diseases and clinical conditions, has been established by previous studies, as described hereinabove with reference to VGAM859. Staufen, RNA Binding Protein (Drosophila) (STAU, Accession NM_017452) is another VGAM2610 host target gene. STAU BINDING SITE1 through STAU BINDING SITE4 are HOST TARGET binding sites found in untranslated regions of mRNA encoded by STAU, corresponding to HOST TARGET binding sites such as BINDING SITE I, BINDING SITE II or BINDING SITE III. Table 2 illustrates the complementarity of the nucleotide sequences of STAU BINDING SITE1 through STAU BINDING SITE4, designated SEQ ID:18914, SEQ ID:10942, SEQ ID:18926 and SEQ ID:18920 respectively, to the nucleotide sequence of VGAM2610 RNA, herein designated VGAM RNA, also designated SEQ ID:5321.

Another function of VGAM2610 is therefore inhibition of Staufen, RNA Binding Protein (Drosophila) (STAU, Accession NM_017452), a gene which may play a role in specific positioning of mrnas at given sites in the cell and in stimulating their translation at the site. Accordingly, utilities of VGAM2610 include diagnosis, prevention and treatment of diseases and clinical conditions associated with STAU. The function of STAU and its association with various diseases and clinical conditions, has been established by previous studies, as described hereinabove with reference to VGAM916. Wolf-Hirschhorn Syndrome Candidate 1 (WHSC1, Accession NM_133336) is another VGAM2610 host target gene. WHSC1 BINDING SITE1 through WHSC1 BINDING SITE4 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE4, designated SEQ ID:28473, SEQ ID:28460, SEQ ID:28443 and SEQ ID:36468 respectively, to the nucleotide sequence of VGAM2610 RNA, herein designated VGAM RNA, also designated SEQ ID:5321.

Another function of VGAM2610 is therefore inhibition of Wolf-Hirschhorn Syndrome Candidate 1 (WHSC1, Accession NM_133336), a gene which binds covalently to and repairs g/t mismatches. Accordingly, utilities of VGAM2610 include diagnosis, prevention and treatment of diseases and clinical conditions associated with WHSC1. The function of WHSC1 and its association with various diseases and clinical conditions, has been established by previous studies, as described hereinabove with reference to VGAM200. DKFZP434O047 (Accession NM_015594) is another VGAM2610 host target gene. DKFZP434O047 BINDING SITE is HOST TARGET binding site found in the 5' untranslated region of mRNA encoded by DKFZP434O047, corresponding to a HOST TARGET binding site such as BINDING SITE I, BINDING SITE II or BINDING SITE III. Table 2 illustrates the complementarity of the nucleotide sequences of DKFZP434O047 BINDING SITE, designated SEQ ID:17869, to the nucleotide sequence of VGAM2610 RNA, herein designated VGAM RNA, also designated SEQ ID:5321.

Another function of VGAM2610 is therefore inhibition of DKFZP434O047 (Accession NM_015594). Accordingly, utilities of VGAM2610 include diagnosis, prevention and treatment of diseases and clinical conditions associated with DKFZP434O047. GBTS1 (Accession NM_145173) is another VGAM2610 host target gene. GBTS1 BINDING SITE is HOST TARGET binding site found in the 3' untranslated region of mRNA encoded by GBTS1, corresponding to a HOST TARGET binding site such as BINDING SITE I, BINDING SITE II or BINDING SITE III. Table 2 illustrates the complementarity of the nucleotide sequences of GBTS1 BINDING SITE, designated SEQ ID:29728, to the nucleotide sequence of VGAM2610 RNA, herein designated VGAM RNA, also designated SEQ ID:5321.

Another function of VGAM2610 is therefore inhibition of GBTS1 (Accession NM_145173). Accordingly, utilities of VGAM2610 include diagnosis, prevention and treatment of diseases and clinical conditions associated with GBTS1. Heart and Neural Crest Derivatives Expressed 1 (HAND1, Accession NM_004821) is another VGAM2610 host target gene. HAND1 BINDING SITE is HOST TARGET binding site found in the 3' untranslated region of mRNA encoded by HAND1, corresponding to a HOST TARGET binding site such as BINDING SITE I, BINDING SITE II or BINDING SITE III. Table 2 illustrates the complementarity of the nucleotide sequences of HAND1 BINDING SITE, designated SEQ ID:11237, to the nucleotide sequence of VGAM2610 RNA, herein designated VGAM RNA, also designated SEQ ID:5321.

Another function of VGAM2610 is therefore inhibition of Heart and Neural Crest Derivatives Expressed 1 (HAND1, Accession NM_004821). Accordingly, utilities of VGAM2610 include diagnosis, prevention and treatment of diseases and clinical conditions associated with HAND1. KIAA0481 (Accession XM_050144) is another VGAM2610 host target gene. KIAA0481 BINDING SITE is HOST TARGET binding site found in the 3' untranslated region of mRNA encoded by KIAA0481, corresponding to a HOST TARGET binding site such as BINDING SITE I, BINDING SITE II or BINDING SITE III. Table 2 illustrates the complementarity of the nucleotide sequences of KIAA0481 BINDING SITE, designated SEQ ID:35570, to the nucleotide sequence of VGAM2610 RNA, herein designated VGAM RNA, also designated SEQ ID:5321.

Another function of VGAM2610 is therefore inhibition of KIAA0481 (Accession XM_050144). Accordingly, utilities of VGAM2610 include diagnosis, prevention and treatment of diseases and clinical conditions associated with KIAA0481. KIAA1554 (Accession XM_170834) is another VGAM2610 host target gene. KIAA1554 BINDING SITE is HOST TARGET binding site found in the 3' untranslated region of mRNA encoded by KIAA1554, corresponding to a HOST TARGET binding site such as BINDING SITE I, BINDING SITE II or BINDING SITE III. Table 2 illustrates the complementarity of the nucleotide sequences of KIAA1554 BINDING SITE, designated SEQ ID:45610, to the nucleotide sequence of VGAM2610 RNA, herein designated VGAM RNA, also designated SEQ ID:5321.

Another function of VGAM2610 is therefore inhibition of KIAA1554 (Accession XM_170834). Accordingly, utilities of VGAM2610 include diagnosis, prevention and treatment of diseases and clinical conditions associated with KIAA1554. Mitochondrial Ribosomal Protein L30 (MRPL30, Accession NM_016503) is another VGAM2610 host target gene. MRPL30 BINDING SITE is HOST TARGET binding site found in the 5' untranslated region of mRNA encoded by MRPL30, corresponding to a HOST TARGET binding site such as BINDING SITE I, BINDING SITE II or BINDING SITE III. Table 2 illustrates the complementarity of the nucleotide sequences of MRPL30 BINDING SITE, designated SEQ ID:18583, to the nucleotide sequence of VGAM2610 RNA, herein designated VGAM RNA, also designated SEQ ID:5321.

Another function of VGAM2610 is therefore inhibition of Mitochondrial Ribosomal Protein L30 (MRPL30, Accession NM_016503). Accordingly, utilities of VGAM2610 include diagnosis, prevention and treatment of diseases and clinical conditions associated with MRPL30. P15-2 (Accession NM_018698) is another VGAM2610 host target gene. P15-2 BINDING SITE is HOST TARGET binding site found in the 3' untranslated region of mRNA encoded by P15-2, corresponding to a HOST TARGET binding site such as BINDING SITE I, BINDING SITE II or BINDING SITE III. Table 2 illustrates the complementarity of the nucleotide sequences of P15-2 BINDING SITE, designated SEQ ID:20783, to the nucleotide sequence of VGAM2610 RNA, herein designated VGAM RNA, also designated SEQ ID:5321.

Another function of VGAM2610 is therefore inhibition of P15-2 (Accession NM_018698). Accordingly, utilities of VGAM2610 include diagnosis, prevention and treatment of diseases and clinical conditions associated with P15-2. Proteasome (prosome, macropain) Inhibitor Subunit 1 (PI31) (PSMF1, Accession NM_006814) is another VGAM2610 host target gene. PSMF1 BINDING SITE is HOST TARGET binding site found in the 3' untranslated region of mRNA encoded by PSMF1, corresponding to a HOST TARGET binding site such as BINDING SITE I, BINDING SITE II or BINDING SITE III. Table 2 illustrates the complementarity of the nucleotide sequences of PSMF1 BINDING SITE, designated SEQ ID:13689, to the nucleotide sequence of VGAM2610 RNA, herein designated VGAM RNA, also designated SEQ ID:5321.

Another function of VGAM2610 is therefore inhibition of Proteasome (prosome, macropain) Inhibitor Subunit 1 (PI31) (PSMF1, Accession NM_006814). Accordingly, utilities of VGAM2610 include diagnosis, prevention and treatment of diseases and clinical conditions associated with PSMF1. LOC115708 (Accession XM_056552) is another VGAM2610 host target gene. LOC115708 BINDING SITE is HOST TARGET binding site found in the 3' untranslated region of mRNA encoded by LOC115708, corresponding to a HOST TARGET binding site such as BINDING SITE I, BINDING SITE II or BINDING SITE III. Table 2 illustrates the complementarity of the nucleotide sequences of LOC115708 BINDING SITE, designated SEQ ID:36407, to the nucleotide sequence of VGAM2610 RNA, herein designated VGAM RNA, also designated SEQ ID:5321.

Another function of VGAM2610 is therefore inhibition of LOC115708 (Accession XM_056552). Accordingly, utilities of VGAM2610 include diagnosis, prevention and treatment of diseases and clinical conditions associated with LOC115708. LOC145854 (Accession XM_085259) is another VGAM2610 host target gene. LOC145854 BINDING SITE is HOST TARGET binding site found in the 3' untranslated region of mRNA encoded by LOC145854, corresponding to a HOST TARGET binding site such as BINDING SITE I, BINDING SITE II or BINDING SITE III. Table 2 illustrates the complementarity of the nucleotide sequences of LOC145854 BINDING SITE, designated SEQ ID:38009, to the nucleotide sequence of VGAM2610 RNA, herein designated VGAM RNA, also designated SEQ ID:5321.

Another function of VGAM2610 is therefore inhibition of LOC145854 (Accession XM_085259). Accordingly, utilities of VGAM2610 include diagnosis, prevention and treatment of diseases and clinical conditions associated with LOC145854. LOC150967 (Accession XM_087060) is another VGAM2610 host target gene. LOC150967 BINDING SITE is HOST TARGET binding site found in the 5' untranslated region of mRNA encoded by LOC150967, corresponding to a HOST TARGET binding site such as BINDING SITE I, BINDING SITE II or BINDING SITE III. Table 2 illustrates the complementarity of the nucleotide sequences of LOC150967 BINDING SITE, designated SEQ ID:39035, to the nucleotide sequence of VGAM2610 RNA, herein designated VGAM RNA, also designated SEQ ID:5321.

Another function of VGAM2610 is therefore inhibition of LOC150967 (Accession XM_087060). Accordingly, utilities of VGAM2610 include diagnosis, prevention and treatment of diseases and clinical conditions associated with LOC150967. LOC157624 (Accession XM_098801) is another VGAM2610 host target gene. LOC157624 BINDING SITE is HOST TARGET binding site found in the 5' untranslated region of mRNA encoded by LOC157624, corresponding to a HOST TARGET binding site such as BINDING SITE I, BINDING SITE II or BINDING SITE III. Table 2 illustrates the complementarity of the nucleotide sequences of LOC157624 BINDING SITE, designated SEQ ID:41826, to the nucleotide sequence of VGAM2610 RNA, herein designated VGAM RNA, also designated SEQ ID:5321.

Another function of VGAM2610 is therefore inhibition of LOC157624 (Accession XM_098801). Accordingly, utilities of VGAM2610 include diagnosis, prevention and treatment of diseases and clinical conditions associated with LOC157624. LOC157918 (Accession XM_098842) is another VGAM2610 host target gene. LOC157918 BINDING SITE is HOST TARGET binding site found in the 3' untranslated region of mRNA encoded by LOC157918, corresponding to a HOST TARGET binding site such as BINDING SITE I, BINDING SITE II or BINDING SITE III. Table 2 illustrates the complementarity of the nucleotide sequences of LOC157918 BINDING SITE, designated SEQ ID:41899, to the nucleotide sequence of VGAM2610 RNA, herein designated VGAM RNA, also designated SEQ ID:5321.

Another function of VGAM2610 is therefore inhibition of LOC157918 (Accession XM_098842). Accordingly, utilities of VGAM2610 include diagnosis, prevention and treatment of diseases and clinical conditions associated with LOC157918. LOC158956 (Accession XM_039450) is another VGAM2610 host target gene. LOC158956 BINDING SITE is HOST TARGET binding site found in the 3' untranslated region of mRNA encoded by LOC158956, corresponding to a HOST TARGET binding site such as BINDING SITE I, BINDING SITE II or BINDING SITE III. Table 2 illustrates the complementarity of the nucleotide sequences of LOC158956 BINDING SITE, designated SEQ ID:33097, to the nucleotide sequence of VGAM2610 RNA, herein designated VGAM RNA, also designated SEQ ID:5321.

Another function of VGAM2610 is therefore inhibition of LOC158956 (Accession XM_039450). Accordingly, utilities of VGAM2610 include diagnosis, prevention and treatment of diseases and clinical conditions associated with LOC158956. LOC197320 (Accession XM_113861) is another VGAM2610 host target gene. LOC197320 BINDING SITE is HOST TARGET binding site found in the 5' untranslated region of mRNA encoded by LOC197320, corresponding to a HOST TARGET binding site such as BINDING SITE I, BINDING SITE II or BINDING SITE III. Table 2 illustrates the complementarity of the nucleotide sequences of LOC197320 BINDING SITE, designated SEQ ID:42472, to the nucleotide sequence of VGAM2610 RNA, herein designated VGAM RNA, also designated SEQ ID:5321.

Another function of VGAM2610 is therefore inhibition of LOC197320 (Accession XM_113861). Accordingly, utilities of VGAM2610 include diagnosis, prevention and treatment of diseases and clinical conditions associated with LOC197320. LOC202025 (Accession XM_117353) is another VGAM2610 host target gene. LOC202025 BINDING SITE is HOST TARGET binding site found in the 5' untranslated region of mRNA encoded by LOC202025, corresponding to a HOST TARGET binding site such as BINDING SITE I, BINDING SITE II or BINDING SITE III. Table 2 illustrates the complementarity of the nucleotide sequences of LOC202025 BINDING SITE, designated SEQ ID:43399, to the nucleotide sequence of VGAM2610 RNA, herein designated VGAM RNA, also designated SEQ ID:5321.

Another function of VGAM2610 is therefore inhibition of LOC202025 (Accession XM_117353). Accordingly, utilities of VGAM2610 include diagnosis, prevention and treatment of diseases and clinical conditions associated with LOC202025. LOC206426 (Accession XM_116505) is another VGAM2610 host target gene. LOC206426 BINDING SITE is HOST TARGET binding site found in the 3' untranslated region of mRNA encoded by LOC206426, corresponding to a HOST TARGET binding site such as BINDING SITE I, BINDING SITE II or BINDING SITE III. Table 2 illustrates the complementarity of the nucleotide sequences of LOC206426 BINDING SITE, designated SEQ ID:43120, to the nucleotide sequence of VGAM2610 RNA, herein designated VGAM RNA, also designated SEQ ID:5321.

Another function of VGAM2610 is therefore inhibition of LOC206426 (Accession XM_116505). Accordingly, utilities of VGAM2610 include diagnosis, prevention and treatment of diseases and clinical conditions associated with LOC206426. LOC222134 (Accession XM_168432) is another VGAM2610 host target gene. LOC222134 BINDING SITE is HOST TARGET binding site found in the 5' untranslated region of mRNA encoded by LOC222134, corresponding to a HOST TARGET binding site such as BINDING SITE I, BINDING SITE II or BINDING SITE III. Table 2 illustrates the complementarity of the nucleotide sequences of LOC222134 BINDING SITE, designated SEQ ID:45170, to the nucleotide sequence of VGAM2610 RNA, herein designated VGAM RNA, also designated SEQ ID:5321.

Another function of VGAM2610 is therefore inhibition of LOC222134 (Accession XM_168432). Accordingly, utilities of VGAM2610 include diagnosis, prevention and treatment of diseases and clinical conditions associated with LOC222134. LOC255654 (Accession XM_173036) is another VGAM2610 host target gene. LOC255654 BIND- ING SITE is HOST TARGET binding site found in the 5' untranslated region of mRNA encoded by LOC255654, corresponding to a HOST TARGET binding site such as BINDING SITE I, BINDING SITE II or BINDING SITE III. Table 2 illustrates the complementarity of the nucleotide sequences of LOC255654 BINDING SITE, designated SEQ ID:46303, to the nucleotide sequence of VGAM2610 RNA, herein designated VGAM RNA, also designated SEQ ID:5321.

Another function of VGAM2610 is therefore inhibition of LOC255654 (Accession XM_173036). Accordingly, utilities of VGAM2610 include diagnosis, prevention and treatment of diseases and clinical conditions associated with LOC255654. LOC257457 (Accession XM_031425) is another VGAM2610 host target gene. LOC257457 BINDING SITE is HOST TARGET binding site found in the 5' untranslated region of mRNA encoded by LOC257457, corresponding to a HOST TARGET binding site such as BINDING SITE I, BINDING SITE II or BINDING SITE III. Table 2 illustrates the complementarity of the nucleotide sequences of LOC257457 BINDING SITE, designated SEQ ID:31376, to the nucleotide sequence of VGAM2610 RNA, herein designated VGAM RNA, also designated SEQ ID:5321.

Another function of VGAM2610 is therefore inhibition of LOC257457 (Accession XM_031425). Accordingly, utilities of VGAM2610 include diagnosis, prevention and treatment of diseases and clinical conditions associated with LOC257457. LOC51619 (Accession NM_015983) is another VGAM2610 host target gene. LOC51619 BINDING SITE is HOST TARGET binding site found in the 3' untranslated region of mRNA encoded by LOC51619, corresponding to a HOST TARGET binding site such as BINDING SITE I, BINDING SITE II or BINDING SITE III. Table 2 illustrates the complementarity of the nucleotide sequences of LOC51619 BINDING SITE, designated SEQ ID:18077, to the nucleotide sequence of VGAM2610 RNA, herein designated VGAM RNA, also designated SEQ ID:5321.

Another function of VGAM2610 is therefore inhibition of LOC51619 (Accession NM_015983). Accordingly, utilities of VGAM2610 include diagnosis, prevention and treatment of diseases and clinical conditions associated with LOC51619. LOC91759 (Accession XM_040467) is another VGAM2610 host target gene. LOC91759 BINDING SITE is HOST TARGET binding site found in the 5' untranslated region of mRNA encoded by LOC91759, corresponding to a HOST TARGET binding site such as BINDING SITE I, BINDING SITE II or BINDING SITE III. Table 2 illustrates the complementarity of the nucleotide sequences of LOC91759 BINDING SITE, designated SEQ ID:33305, to the nucleotide sequence of VGAM2610 RNA, herein designated VGAM RNA, also designated SEQ ID:5321.

Another function of VGAM2610 is therefore inhibition of LOC91759 (Accession XM_040467). Accordingly, utilities of VGAM2610 include diagnosis, prevention and treatment of diseases and clinical conditions associated with LOC91759. LOC92539 (Accession XM_045632) is another VGAM2610 host target gene. LOC92539 BINDING SITE is HOST TARGET binding site found in the 5' untranslated region of mRNA encoded by LOC92539, corresponding to a HOST TARGET binding site such as BINDING SITE I, BINDING SITE II or BINDING SITE III. Table 2 illustrates the complementarity of the nucleotide sequences of LOC92539 BINDING SITE, designated SEQ ID:34503, to the nucleotide sequence of VGAM2610 RNA, herein designated VGAM RNA, also designated SEQ ID:5321.

Another function of VGAM2610 is therefore inhibition of LOC92539 (Accession XM_045632). Accordingly, utilities of VGAM2610 include diagnosis, prevention and treatment of diseases and clinical conditions associated with LOC92539. FIG. 1 further provides a conceptual description of a novel bioinformatically detected viral gene of the present invention, referred to here as Viral Genomic Address Messenger 2611 (VGAM2611) viral gene, which modulates expression of respective host target genes thereof, the function and utility of which host target genes is known in the art.

VGAM2611 is a novel bioinformatically detected regulatory, non protein coding, viral micro RNA (miRNA) gene. The method by which VGAM2611 was detected is described hereinabove with reference to FIGS. 1-8.

VGAM2611 gene, herein designated VGAM GENE, is a viral gene contained in the genome of Equine Rhinitis A Virus. VGAM2611 host target gene, herein designated VGAM HOST TARGET GENE, is a human gene contained in the human genome.

VGAM2611 gene encodes a VGAM2611 precursor RNA, herein designated VGAM PRECURSOR RNA. Similar to other miRNA genes, and unlike most ordinary genes, VGAM2611 precursor RNA does not encode a protein. A nucleotide sequence identical or highly similar to the nucleotide sequence of VGAM2611 precursor RNA is designated SEQ ID:2597, and is provided hereinbelow with reference to the sequence listing part. Nucleotide sequence SEQ ID:2597 is located at position 3057 relative to the genome of Equine Rhinitis A Virus.

VGAM2611 precursor RNA folds onto itself, forming VGAM2611 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2611 folded precursor RNA into VGAM2611 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM2611 RNA is designated SEQ ID:5322, and is provided hereinbelow with reference to the sequence listing part.

VGAM2611 host target gene, herein designated VGAM HOST TARGET GENE, encodes a corresponding messenger RNA, VGAM2611 host target RNA, herein designated VGAM HOST TARGET RNA. VGAM2611 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2611 RNA, herein designated VGAM RNA, binds complementarily to one or more host target binding sites located in untranslated regions of VGAM2611 host target RNA, herein designated VGAM HOST TARGET RNA. This complementary binding is due to the fact that the nucleotide sequence of VGAM2611 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2611 RNA, herein designated VGAM RNA, may have a different number of host target binding sites in untranslated regions of a VGAM2611 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2611 RNA, herein designated VGAM RNA, to host target binding sites on VGAM2611 host target RNA, herein designated VGAM HOST TARGET RNA, such as BINDING SITE I, BINDING SITE II and BINDING SITE III, inhibits translation of VGAM2611 host target RNA into VGAM2611 host target protein, herein designated VGAM HOST TARGET PROTEIN. VGAM host target protein is therefore outlined by a broken line.

It is appreciated that VGAM2611 host target gene, herein designated VGAM HOST TARGET GENE, in fact represents a plurality of VGAM2611 host target genes. The mRNA of each one of this plurality of VGAM2611 host target genes comprises one or more host target binding sites, each having a nucleotide sequence which is at least partly complementary to VGAM2611 RNA, herein designated VGAM RNA, and which when bound by VGAM2611 RNA causes inhibition of translation of respective one or more VGAM2611 host target proteins.

It is further appreciated by one skilled in the art that the mode of translational inhibition illustrated by FIG. 1 with specific reference to translational inhibition exerted by VGAM2611 gene, herein designated VGAM GENE, on one or more VGAM2611 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2611 is inhibition of expression of host target genes, as part of a novel viral mechanism of attacking a host. Accordingly, utilities of VGAM2611 include diagnosis, prevention and treatment of viral infection by Equine Rhinitis A Virus. Specific functions, and accordingly utilities, of VGAM2611 correlate with, and may be deduced from, the identity of the host target genes which VGAM2611 binds and inhibits, and the function of these host target genes, as elaborated hereinbelow.

Nucleotide sequences of the VGAM2611 precursor RNA, herein designated VGAM PRECURSOR RNA, and of the 'diced' VGAM2611 RNA, herein designated VGAM RNA, and a schematic representation of the secondary folding of VGAM2611 folded precursor RNA, herein designated VGAM FOLDED PRECURSOR RNA, of VGAM2611 are further described hereinbelow with reference to Table 1.

Nucleotide sequences of host target binding sites, such as BINDING SITE-I, BINDING SITE-II and BINDING SITE-III of FIG. 1, found on VGAM2611 host target RNA, and schematic representation of the complementarity of each of these host target binding sites to VGAM2611 RNA, herein designated VGAM RNA, are described hereinbelow with reference to Table 2.

As mentioned hereinabove with reference to FIG. 1, a function of VGAM2611 gene, herein designated VGAM is inhibition of expression of VGAM2611 target genes. It is appreciated that specific functions, and accordingly utilities, of VGAM2611 correlate with, and may be deduced from, the identity of the target genes which VGAM2611 binds and inhibits, and the function of these target genes, as elaborated hereinbelow.

Arachidonate 15-lipoxygenase (ALOX15, Accession NM_001140) is a VGAM2611 host target gene. ALOX15 BINDING SITE is HOST TARGET binding site found in the 3' untranslated region of mRNA encoded by ALOX15, corresponding to a HOST TARGET binding site such as BINDING SITE I, BINDING SITE II or BINDING SITE III. Table 2 illustrates the complementarity of the nucleotide sequences of ALOX15 BINDING SITE, designated SEQ ID:6809, to the nucleotide sequence of VGAM2611 RNA, herein designated VGAM RNA, also designated SEQ ID:5322.

A function of VGAM2611 is therefore inhibition of Arachidonate 15-lipoxygenase (ALOX15, Accession NM_001140), a gene which converts arachidonic acid to 15s-hydroperoxyeicosatetraenoic acid. Accordingly, utilities of VGAM2611 include diagnosis, prevention and treatment of diseases and clinical conditions associated with ALOX15. The function of ALOX15 and its association with various diseases and clinical conditions, has been established by previous studies, as described hereinabove with reference to VGAM282. Adaptor-related Protein Complex 1, Gamma 1 Subunit (AP1G1, Accession NM_001128) is another VGAM2611 host target gene. AP1G1 BINDING SITE is HOST TARGET binding site found in the 3' untranslated region of mRNA encoded by AP1G1, corresponding to a HOST TARGET binding site such as BINDING SITE I, BINDING SITE II or BINDING SITE III. Table 2 illustrates the complementarity of the nucleotide sequences of AP1G1 BINDING SITE, designated SEQ ID:6799, to the nucleotide sequence of VGAM2611 RNA, herein designated VGAM RNA, also designated SEQ ID:5322.

Another function of VGAM2611 is therefore inhibition of Adaptor-related Protein Complex 1, Gamma 1 Subunit (AP1G1, Accession NM_001128), a gene which promotes the formation of clathrin-coated pits and vesicles. Accordingly, utilities of VGAM2611 include diagnosis, prevention and treatment of diseases and clinical conditions associated with AP1G1. The function of AP1G1 and its association with various diseases and clinical conditions, has been established by previous studies, as described hereinabove with reference to VGAM316. Diaphorase (NADH) (cytochrome b-5 reductase) (DIA1, Accession NM_007326) is another VGAM2611 host target gene. DIA1 BINDING SITE is HOST TARGET binding site found in the 3' untranslated region of mRNA encoded by DIA1, corresponding to a HOST TARGET binding site such as BINDING SITE I, BINDING SITE II or BINDING SITE III. Table 2 illustrates the complementarity of the nucleotide sequences of DIA1 BINDING SITE, designated SEQ ID:14246, to the nucleotide sequence of VGAM2611 RNA, herein designated VGAM RNA, also designated SEQ ID:5322.

Another function of VGAM2611 is therefore inhibition of Diaphorase (NADH) (cytochrome b-5 reductase) (DIA1, Accession NM_007326). Accordingly, utilities of VGAM2611 include diagnosis, prevention and treatment of diseases and clinical conditions associated with DIA1. Discs, Large (Drosophila) Homolog 4 (DLG4, Accession NM_001365) is another VGAM2611 host target gene. DLG4 BINDING SITE is HOST TARGET binding site found in the 3' untranslated region of mRNA encoded by DLG4, corresponding to a HOST TARGET binding site such as BINDING SITE I, BINDING SITE II or BINDING SITE III. Table 2 illustrates the complementarity of the nucleotide sequences of DLG4 BINDING SITE, designated SEQ ID:7045, to the nucleotide sequence of VGAM2611 RNA, herein designated VGAM RNA, also designated SEQ ID:5322.

Another function of VGAM2611 is therefore inhibition of Discs, Large (Drosophila) Homolog 4 (DLG4, Accession NM_001365), a gene which is a membrane-associated guanylate kinase and may intervene in synaptogenesis. Accordingly, utilities of VGAM2611 include diagnosis, prevention and treatment of diseases and clinical conditions associated with DLG4. The function of DLG4 and its association with various diseases and clinical conditions, has been established by previous studies, as described hereinabove with reference to VGAM206. Leucine Zipper, Putative Tumor Suppressor 1 (LZTS1, Accession NM_021020) is another VGAM2611 host target gene. LZTS1 BINDING SITE is HOST TARGET binding site found in the 3' untranslated region of mRNA encoded by LZTS1, corresponding to a HOST TARGET binding site such as BINDING SITE I, BINDING SITE II or BINDING SITE III. Table 2 illustrates the complementarity of the nucleotide sequences of LZTS1 BINDING SITE, designated SEQ ID:22006, to the nucleotide sequence of VGAM2611 RNA, herein designated VGAM RNA, also designated SEQ ID:5322.

Another function of VGAM2611 is therefore inhibition of Leucine Zipper, Putative Tumor Suppressor 1 (LZTS1, Accession NM_021020), a gene which Zygin 1; may have a role in axonal outgrowth; has similarity to C. elegans UNC-76. Accordingly, utilities of VGAM2611 include diagnosis, prevention and treatment of diseases and clinical conditions associated with LZTS1. The function of LZTS1 and its association with various diseases and clinical conditions, has been established by previous studies, as described hereinabove with reference to VGAM890. RAB, Member of RAS Oncogene Family-like 2A (RABL2A, Accession NM_013412) is another VGAM2611 host target gene. RABL2A BINDING SITE is HOST TARGET binding site found in the 3' untranslated region of mRNA encoded by RABL2A, corresponding to a HOST TARGET binding site such as BINDING SITE I, BINDING SITE II or BINDING SITE III. Table 2 illustrates the complementarity of the nucleotide sequences of RABL2A BINDING SITE, designated SEQ ID:15078, to the nucleotide sequence of VGAM2611 RNA, herein designated VGAM RNA, also designated SEQ ID:5322.

Another function of VGAM2611 is therefore inhibition of RAB, Member of RAS Oncogene Family-like 2A (RABL2A, Accession NM_013412). Accordingly, utilities of VGAM2611 include diagnosis, prevention and treatment of diseases and clinical conditions associated with RABL2A. RAB, Member of RAS Oncogene Family-like 2B (RABL2B, Accession NM_007081) is another VGAM2611 host target gene. RABL2B BINDING SITE is HOST TARGET binding site found in the 3' untranslated region of mRNA encoded by RABL2B, corresponding to a HOST TARGET binding site such as BINDING SITE I, BINDING SITE II or BINDING SITE III. Table 2 illustrates the complementarity of the nucleotide sequences of RABL2B BINDING SITE, designated SEQ ID:13945, to the nucleotide sequence of VGAM2611 RNA, herein designated VGAM RNA, also designated SEQ ID:5322.

Another function of VGAM2611 is therefore inhibition of RAB, Member of RAS Oncogene Family-like 2B (RABL2B, Accession NM_007081). Accordingly, utilities of VGAM2611 include diagnosis, prevention and treatment of diseases and clinical conditions associated with RABL2B.

Solute Carrier Family 19 (folate transporter), Member 1 (SLC19A1, Accession NM_003056) is another VGAM2611 host target gene. SLC19A1 BINDING SITE is HOST TARGET binding site found in the 3' untranslated region of mRNA encoded by SLC19A1, corresponding to a HOST TARGET binding site such as BINDING SITE I, BINDING SITE II or BINDING SITE III. Table 2 illustrates the complementarity of the nucleotide sequences of SLC19A1 BINDING SITE, designated SEQ ID:9021, to the nucleotide sequence of VGAM2611 RNA, herein designated VGAM RNA, also designated SEQ ID:5322.

Another function of VGAM2611 is therefore inhibition of Solute Carrier Family 19 (folate transporter), Member 1 (SLC19A1, Accession NM_003056). Accordingly, utilities of VGAM2611 include diagnosis, prevention and treatment of diseases and clinical conditions associated with SLC19A1. Serine Racemase (SRR, Accession NM_021947) is another VGAM2611 host target gene. SRR BINDING SITE is HOST TARGET binding site found in the 3' untranslated region of mRNA encoded by SRR, corresponding to a HOST TARGET binding site such as BINDING SITE I, BINDING SITE II or BINDING SITE III. Table 2 illustrates the complementarity of the nucleotide sequences of SRR BINDING SITE, designated SEQ ID:22475, to the nucleotide sequence of VGAM2611 RNA, herein designated VGAM RNA, also designated SEQ ID:5322.

Another function of VGAM2611 is therefore inhibition of Serine Racemase (SRR, Accession NM_021947). Accordingly, utilities of VGAM2611 include diagnosis, prevention and treatment of diseases and clinical conditions associated with SRR. Chromosome 11 Open Reading Frame 11 (C11orf11, Accession XM_167769) is another VGAM2611 host target gene. C11orf11 BINDING SITE is HOST TARGET binding site found in the 5" untranslated region of mRNA encoded by C11orf11, corresponding to a HOST TARGET binding site such as BINDING SITE I, BINDING SITE II or BINDING SITE III. Table 2 illustrates the complementarity of the nucleotide sequences of C11orf11 BINDING SITE, designated SEQ ID:44784, to the nucleotide sequence of VGAM2611 RNA, herein designated VGAM RNA, also designated SEQ ID:5322.

Another function of VGAM2611 is therefore inhibition of Chromosome 11 Open Reading Frame 11 (C11orf11, Accession XM_167769). Accordingly, utilities of VGAM2611 include diagnosis, prevention and treatment of diseases and clinical conditions associated with C11orf11. Chromosome 17 Open Reading Frame 31 (C17orf31, Accession NM_017575) is another VGAM2611 host target gene. C17orf31 BINDING SITE is HOST TARGET binding site found in the 3' untranslated region of mRNA encoded by C17orf31, corresponding to a HOST TARGET binding site such as BINDING SITE I, BINDING SITE II or BINDING SITE III. Table 2 illustrates the complementarity of the nucleotide sequences of C17orf31 BINDING SITE, designated SEQ ID:18999, to the nucleotide sequence of VGAM2611 RNA, herein designated VGAM RNA, also designated SEQ ID:5322.

Another function of VGAM2611 is therefore inhibition of Chromosome 17 Open Reading Frame 31 (C17orf31, Accession NM_017575). Accordingly, utilities of VGAM2611 include diagnosis, prevention and treatment of diseases and clinical conditions associated with C17orf31. Chromosome 20 Open Reading Frame 102 (C20orf102, Accession NM_080607) is another VGAM2611 host target gene. C20orf102 BINDING SITE is HOST TARGET binding site found in the 3" untranslated region of mRNA encoded by C20orf102, corresponding to a HOST TARGET binding site such as BINDING SITE I, BINDING SITE II or BINDING SITE III. Table 2 illustrates the complementarity of the nucleotide sequences of C20orf102 BINDING SITE, designated SEQ ID:27925, to the nucleotide sequence of VGAM2611 RNA, herein designated VGAM RNA, also designated SEQ ID:5322.

Another function of VGAM2611 is therefore inhibition of Chromosome 20 Open Reading Frame 102 (C20orf102, Accession NM_080607). Accordingly, utilities of VGAM2611 include diagnosis, prevention and treatment of diseases and clinical conditions associated with C20orf102. Chromosome 9 Open Reading Frame 7 (C9orf7, Accession NM_017586) is another VGAM2611 host target gene. C9orf7 BINDING SITE is HOST TARGET binding site found in the 3' untranslated region of mRNA encoded by C9orf7, corresponding to a HOST TARGET binding site such as BINDING SITE I, BINDING SITE II or BINDING SITE III. Table 2 illustrates the complementarity of the nucleotide sequences of C9orf7 BINDING SITE, designated SEQ ID:19032, to the nucleotide sequence of VGAM2611 RNA, herein designated VGAM RNA, also designated SEQ ID:5322.

Another function of VGAM2611 is therefore inhibition of Chromosome 9 Open Reading Frame 7 (C9orf7, Accession NM_017586). Accordingly, utilities of VGAM2611 include diagnosis, prevention and treatment of diseases and clinical conditions associated with C9orf7. FLJ12788 (Accession NM_022492) is another VGAM2611 host target gene. FLJ12788 BINDING SITE is HOST TARGET binding site found in the 3' untranslated region of mRNA encoded by FLJ12788, corresponding to a HOST TARGET binding site such as BINDING SITE I, BINDING SITE II or BINDING SITE III. Table 2 illustrates the complementarity of the nucleotide sequences of FLJ12788 BINDING SITE, designated SEQ ID:22872, to the nucleotide sequence of VGAM2611 RNA, herein designated VGAM RNA, also designated SEQ ID:5322.

Another function of VGAM2611 is therefore inhibition of FLJ12788 (Accession NM_022492). Accordingly, utilities of VGAM2611 include diagnosis, prevention and treatment of diseases and clinical conditions associated with FLJ12788. FLJ20211 (Accession NM_017713) is another VGAM2611 host target gene. FLJ20211 BINDING SITE is HOST TARGET binding site found in the 3' untranslated region of mRNA encoded by FLJ20211, corresponding to a HOST TARGET binding site such as BINDING SITE I, BINDING SITE II or BINDING SITE III. Table 2 illustrates the complementarity of the nucleotide sequences of FLJ20211 BINDING SITE, designated SEQ ID:19297, to the nucleotide sequence of VGAM2611 RNA, herein designated VGAM RNA, also designated SEQ ID:5322.

Another function of VGAM2611 is therefore inhibition of FLJ20211 (Accession NM_017713). Accordingly, utilities of VGAM2611 include diagnosis, prevention and treatment of diseases and clinical conditions associated with FLJ20211. FLJ20718 (Accession NM_017939) is another VGAM2611 host target gene. FLJ20718 BINDING SITE is HOST TARGET binding site found in the 3' untranslated region of mRNA encoded by FLJ20718, corresponding to a HOST TARGET binding site such as BINDING SITE I, BINDING SITE II or BINDING SITE III. Table 2 illustrates the complementarity of the nucleotide sequences of FLJ20718 BINDING SITE, designated SEQ ID:19634, to the nucleotide sequence of VGAM2611 RNA, herein designated VGAM RNA, also designated SEQ ID:5322.

Another function of VGAM2611 is therefore inhibition of FLJ20718 (Accession NM_017939). Accordingly, utilities of VGAM2611 include diagnosis, prevention and treatment of diseases and clinical conditions associated with FLJ20718. FLJ22215 (Accession XM_173021) is another VGAM2611 host target gene. FLJ22215 BINDING SITE is HOST TARGET binding site found in the 3' untranslated region of mRNA encoded by FLJ22215, corresponding to a HOST TARGET binding site such as BINDING SITE I, BINDING SITE II or BINDING SITE III. Table 2 illustrates the complementarity of the nucleotide sequences of FLJ22215 BINDING SITE, designated SEQ ID:46281, to the nucleotide sequence of VGAM2611 RNA, herein designated VGAM RNA, also designated SEQ ID:5322.

Another function of VGAM2611 is therefore inhibition of FLJ22215 (Accession XM_173021). Accordingly, utilities of VGAM2611 include diagnosis, prevention and treatment of diseases and clinical conditions associated with FLJ22215. FLJ32752 (Accession NM_144666) is another VGAM2611 host target gene. FLJ32752 BINDING SITE is HOST TARGET binding site found in the 5' untranslated region of mRNA encoded by FLJ32752, corresponding to a HOST TARGET binding site such as BINDING SITE I, BINDING SITE II or BINDING SITE III. Table 2 illustrates the complementarity of the nucleotide sequences of FLJ32752 BINDING SITE, designated SEQ ID:29481, to the nucleotide sequence of VGAM2611 RNA, herein designated VGAM RNA, also designated SEQ ID:5322.

Another function of VGAM2611 is therefore inhibition of FLJ32752 (Accession NM_144666). Accordingly, utilities of VGAM2611 include diagnosis, prevention and treatment of diseases and clinical conditions associated with FLJ32752. KIAA0367 (Accession XM_041018) is another VGAM2611 host target gene. KIAA0367 BINDING SITE is HOST TARGET binding site found in the 3' untranslated region of mRNA encoded by KIAA0367, corresponding to a HOST TARGET binding site such as BINDING SITE I, BINDING SITE II or BINDING SITE III. Table 2 illustrates the complementarity of the nucleotide sequences of KIAA0367 BINDING SITE, designated SEQ ID:33418, to the nucleotide sequence of VGAM2611 RNA, herein designated VGAM RNA, also designated SEQ ID:5322.

Another function of VGAM2611 is therefore inhibition of KIAA0367 (Accession XM_041018). Accordingly, utilities of VGAM2611 include diagnosis, prevention and treatment of diseases and clinical conditions associated with KIAA0367. KIAA0682 (Accession NM_016196) is another VGAM2611 host target gene. KIAA0682 BINDING SITE is HOST TARGET binding site found in the 3' untranslated region of mRNA encoded by KIAA0682, corresponding to a HOST TARGET binding site such as BINDING SITE I, BINDING SITE II or BINDING SITE III. Table 2 illustrates the complementarity of the nucleotide sequences of KIAA0682 BINDING SITE, designated SEQ ID:18288, to the nucleotide sequence of VGAM2611 RNA, herein designated VGAM RNA, also designated SEQ ID:5322.

Another function of VGAM2611 is therefore inhibition of KIAA0682 (Accession NM_016196). Accordingly, utilities of VGAM2611 include diagnosis, prevention and treatment of diseases and clinical conditions associated with KIAA0682. KIAA0789 (Accession XM_033113) is another VGAM2611 host target gene. KIAA0789 BINDING SITE is HOST TARGET binding site found in the 5' untranslated region of mRNA encoded by KIAA0789, corresponding to a HOST TARGET binding site such as BINDING SITE I, BINDING SITE II or BINDING SITE III. Table 2 illustrates the complementarity of the nucleotide sequences of KIAA0789 BINDING SITE, designated SEQ ID:31846, to the nucleotide sequence of VGAM2611 RNA, herein designated VGAM RNA, also designated SEQ ID:5322.

Another function of VGAM2611 is therefore inhibition of KIAA0789 (Accession XM_033113). Accordingly, utilities of VGAM2611 include diagnosis, prevention and treatment of diseases and clinical conditions associated with KIAA0789. KIAA1862 (Accession XM_044212) is another VGAM2611 host target gene. KIAA1862 BINDING SITE is HOST TARGET binding site found in the 3' untranslated region of mRNA encoded by KIAA1862, corresponding to a HOST TARGET binding site such as BINDING SITE I, BINDING SITE II or BINDING SITE III. Table 2 illustrates the complementarity of the nucleotide sequences of KIAA1862 BINDING SITE, designated SEQ ID:34173, to the nucleotide sequence of VGAM2611 RNA, herein designated VGAM RNA, also designated SEQ ID:5322.

Another function of VGAM2611 is therefore inhibition of KIAA1862 (Accession XM_044212). Accordingly, utilities of VGAM2611 include diagnosis, prevention and treatment of diseases and clinical conditions associated with KIAA1862. Williams Beuren Syndrome Chromosome Region 21 (WBSCR21, Accession NM_031295) is another VGAM2611 host target gene. WBSCR21 BINDING SITE is HOST TARGET binding site found in the 5' untranslated region of mRNA encoded by WBSCR21, corresponding to a HOST TARGET binding site such as BINDING SITE I, BINDING SITE II or BINDING SITE III. Table 2 illustrates the complementarity of the nucleotide sequences of WBSCR21 BINDING SITE, designated SEQ ID:25327, to the nucleotide sequence of VGAM2611 RNA, herein designated VGAM RNA, also designated SEQ ID:5322.

Another function of VGAM2611 is therefore inhibition of Williams Beuren Syndrome Chromosome Region 21 (WBSCR21, Accession NM_031295). Accordingly, utilities of VGAM2611 include diagnosis, prevention and treatment of diseases and clinical conditions associated with WBSCR21. LOC143425 (Accession XM_113695) is another VGAM2611 host target gene. LOC143425 BINDING SITE is HOST TARGET binding site found in the 3' untranslated region of mRNA encoded by LOC143425, corresponding to a HOST TARGET binding site such as BINDING SITE I, BINDING SITE II or BINDING SITE III. Table 2 illustrates the complementarity of the nucleotide sequences of LOC143425 BINDING SITE, designated SEQ ID:42351, to the nucleotide sequence of VGAM2611 RNA, herein designated VGAM RNA, also designated SEQ ID:5322.

Another function of VGAM2611 is therefore inhibition of LOC143425 (Accession XM_113695). Accordingly, utilities of VGAM2611 include diagnosis, prevention and treatment of diseases and clinical conditions associated with LOC143425. LOC146745 (Accession XM_085577) is another VGAM2611 host target gene. LOC146745 BINDING SITE is HOST TARGET binding site found in the 5' untranslated region of mRNA encoded by LOC146745, corresponding to a HOST TARGET binding site such as BINDING SITE I, BINDING SITE II or BINDING SITE III. Table 2 illustrates the complementarity of the nucleotide sequences of LOC146745 BINDING SITE, designated SEQ ID:38230, to the nucleotide sequence of VGAM2611 RNA, herein designated VGAM RNA, also designated SEQ ID:5322.

Another function of VGAM2611 is therefore inhibition of LOC146745 (Accession XM_085577). Accordingly, utilities of VGAM2611 include diagnosis, prevention and treatment of diseases and clinical conditions associated with LOC146745. LOC152426 (Accession XM_098225) is another VGAM2611 host target gene. LOC152426 BINDING SITE is HOST TARGET binding site found in the 5' untranslated region of mRNA encoded by LOC152426, corresponding to a HOST TARGET binding site such as BINDING SITE I, BINDING SITE II or BINDING SITE III. Table 2 illustrates the complementarity of the nucleotide sequences of LOC152426 BINDING SITE, designated SEQ ID:41496, to the nucleotide sequence of VGAM2611 RNA, herein designated VGAM RNA, also designated SEQ ID:5322.

Another function of VGAM2611 is therefore inhibition of LOC152426 (Accession XM_098225). Accordingly, utilities of VGAM2611 include diagnosis, prevention and treatment of diseases and clinical conditions associated with LOC152426. LOC157247 (Accession XM_088275) is another VGAM2611 host target gene. LOC157247 BINDING SITE is HOST TARGET binding site found in the 5' untranslated region of mRNA encoded by LOC157247, corresponding to a HOST TARGET binding site such as BINDING SITE I, BINDING SITE II or BINDING SITE III. Table 2 illustrates the complementarity of the nucleotide sequences of LOC157247 BINDING SITE, designated SEQ ID:39573, to the nucleotide sequence of VGAM2611 RNA, herein designated VGAM RNA, also designated SEQ ID:5322.

Another function of VGAM2611 is therefore inhibition of LOC157247 (Accession XM_088275). Accordingly, utilities of VGAM2611 include diagnosis, prevention and treatment of diseases and clinical conditions associated with LOC157247. LOC201182 (Accession XM_117055) is another VGAM2611 host target gene. LOC201182 BINDING SITE is HOST TARGET binding site found in the 5' untranslated region of mRNA encoded by LOC201182, corresponding to a HOST TARGET binding site such as BINDING SITE I, BINDING SITE II or BINDING SITE III. Table 2 illustrates the complementarity of the nucleotide sequences of LOC201182 BINDING SITE, designated SEQ ID:43211, to the nucleotide sequence of VGAM2611 RNA, herein designated VGAM RNA, also designated SEQ ID:5322.

Another function of VGAM2611 is therefore inhibition of LOC201182 (Accession XM_117055). Accordingly, utilities of VGAM2611 include diagnosis, prevention and treatment of diseases and clinical conditions associated with LOC201182. LOC201243 (Accession XM_113935) is another VGAM2611 host target gene. LOC201243 BINDING SITE is HOST TARGET binding site found in the 5' untranslated region of mRNA encoded by LOC201243, corresponding to a HOST TARGET binding site such as BINDING SITE I, BINDING SITE II or BINDING SITE III. Table 2 illustrates the complementarity of the nucleotide sequences of LOC201243 BINDING SITE, designated SEQ ID:42552, to the nucleotide sequence of VGAM2611 RNA, herein designated VGAM RNA, also designated SEQ ID:5322.

Another function of VGAM2611 is therefore inhibition of LOC201243 (Accession XM_113935). Accordingly, utilities of VGAM2611 include diagnosis, prevention and treatment of diseases and clinical conditions associated with LOC201243. FIG. 1 further provides a conceptual description of a novel bioinformatically detected viral gene of the present invention, referred to here as Viral Genomic Address Messenger 2612 (VGAM2612) viral gene, which modulates expression of respective host target genes thereof, the function and utility of which host target genes is known in the art.

VGAM2612 is a novel bioinformatically detected regulatory, non protein coding, viral micro RNA (miRNA) gene. The method by which VGAM2612 was detected is described hereinabove with reference to FIGS. 1-8.

VGAM2612 gene, herein designated VGAM GENE, is a viral gene contained in the genome of Equine Rhinitis A Virus. VGAM2612 host target gene, herein designated VGAM HOST TARGET GENE, is a human gene contained in the human genome.

VGAM2612 gene encodes a VGAM2612 precursor RNA, herein designated VGAM PRECURSOR RNA. Similar to other miRNA genes, and unlike most ordinary genes, VGAM2612 precursor RNA does not encode a protein. A nucleotide sequence identical or highly similar to the nucleotide sequence of VGAM2612 precursor RNA is designated SEQ ID:2598, and is provided hereinbelow with reference to the sequence listing part. Nucleotide sequence SEQ ID:2598 is located at position 2734 relative to the genome of Equine Rhinitis A Virus.

VGAM2612 precursor RNA folds onto itself, forming VGAM2612 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2612 folded precursor RNA into VGAM2612 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2612 RNA is designated SEQ ID:5323, and is provided hereinbelow with reference to the sequence listing part.

VGAM2612 host target gene, herein designated VGAM HOST TARGET GENE, encodes a corresponding messenger RNA, VGAM2612 host target RNA, herein designated VGAM HOST TARGET RNA. VGAM2612 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2612 RNA, herein designated VGAM RNA, binds complementarily to one or more host target binding sites located in untranslated regions of VGAM2612 host target RNA, herein designated VGAM HOST TARGET RNA. This complementary binding is due to the fact that the nucleotide sequence of VGAM2612 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2612 RNA, herein designated VGAM RNA, may have a different number of host target binding sites in untranslated regions of a VGAM2612 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2612 RNA, herein designated VGAM RNA, to host target binding sites on VGAM2612 host target RNA, herein designated VGAM HOST TARGET RNA, such as BINDING SITE I, BINDING SITE II and BINDING SITE III, inhibits translation of VGAM2612 host target RNA into VGAM2612 host target protein, herein designated VGAM HOST TARGET PROTEIN. VGAM host target protein is therefore outlined by a broken line.

It is appreciated that VGAM2612 host target gene, herein designated VGAM HOST TARGET GENE, in fact represents a plurality of VGAM2612 host target genes. The mRNA of each one of this plurality of VGAM2612 host target genes comprises one or more host target binding sites, each having a nucleotide sequence which is at least partly complementary to VGAM2612 RNA, herein designated VGAM RNA, and which when bound by VGAM2612 RNA causes inhibition of translation of respective one or more VGAM2612 host target proteins.

It is further appreciated by one skilled in the art that the mode of translational inhibition illustrated by FIG. 1 with specific reference to translational inhibition exerted by VGAM2612 gene, herein designated VGAM GENE, on one or more VGAM2612 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2612 is inhibition of expression of host target genes, as part of a novel viral mechanism of attacking a host. Accordingly, utilities of VGAM2612 include diagnosis, prevention and treatment of viral infection by Equine Rhinitis A Virus. Specific functions, and accordingly utilities, of VGAM2612 correlate with, and may be deduced from, the identity of the host target genes which VGAM2612 binds and inhibits, and the function of these host target genes, as elaborated hereinbelow.

Nucleotide sequences of the VGAM2612 precursor RNA, herein designated VGAM PRECURSOR RNA, and of the 'diced' VGAM2612 RNA, herein designated VGAM RNA, and a schematic representation of the secondary folding of VGAM2612 folded precursor RNA, herein designated VGAM FOLDED PRECURSOR RNA, of VGAM2612 are further described hereinbelow with reference to Table 1.

Nucleotide sequences of host target binding sites, such as BINDING SITE-I, BINDING SITE-II and BINDING SITE-III of FIG. 1, found on VGAM2612 host target RNA, and schematic representation of the complementarity of each of these host target binding sites to VGAM2612 RNA, herein designated VGAM RNA, are described hereinbelow with reference to Table 2.

As mentioned hereinabove with reference to FIG. 1, a function of VGAM2612 gene, herein designated VGAM is inhibition of expression of VGAM2612 target genes. It is appreciated that specific functions, and accordingly utilities, of VGAM2612 correlate with, and may be deduced from, the identity of the target genes which VGAM2612 binds and inhibits, and the function of these target genes, as elaborated hereinbelow.

Sialidase 3 (membrane sialidase) (NEU3, Accession NM_006656) is a VGAM2612 host target gene. NEU3 BINDING SITE is HOST TARGET binding site found in the 3' untranslated region of mRNA encoded by NEU3, corresponding to a HOST TARGET binding site such as BINDING SITE I, BINDING SITE II or BINDING SITE III. Table 2 illustrates the complementarity of the nucleotide sequences of NEU3 BINDING SITE, designated SEQ ID:13456, to the nucleotide sequence of VGAM2612 RNA, herein designated VGAM RNA, also designated SEQ ID:5323.

A function of VGAM2612 is therefore inhibition of Sialidase 3 (membrane sialidase) (NEU3, Accession NM_006656). Accordingly, utilities of VGAM2612 include diagnosis, prevention and treatment of diseases and clinical conditions associated with NEU3. SMP1 (Accession NM_014313) is another VGAM2612 host target gene. SMP1 BINDING SITE is HOST TARGET binding site found in the 3' untranslated region of mRNA encoded by SMP1, corresponding to a HOST TARGET binding site such as BINDING SITE I, BINDING SITE II or BINDING SITE III. Table 2 illustrates the complementarity of the nucleotide sequences of SMP1 BINDING SITE, designated SEQ ID:15609, to the nucleotide sequence of VGAM2612 RNA, herein designated VGAM RNA, also designated SEQ ID:5323.

Another function of VGAM2612 is therefore inhibition of SMP1 (Accession NM_014313), a gene which is a potential integral membrane protein. Accordingly, utilities of VGAM2612 include diagnosis, prevention and treatment of diseases and clinical conditions associated with SMP1. The function of SMP1 and its association with various diseases and clinical conditions, has been established by previous studies, as described hereinabove with reference to VGAM127. Zinc Finger Protein 289, ID1 Regulated (ZNF289, Accession XM_037147) is another VGAM2612 host target gene. ZNF289 BINDING SITE is HOST TARGET binding site found in the 3' untranslated region of mRNA encoded by ZNF289, corresponding to a HOST TARGET binding site such as BINDING SITE I, BINDING SITE II or BINDING SITE III. Table 2 illustrates the complementarity of the nucleotide sequences of ZNF289 BINDING SITE, designated SEQ ID:32550, to the nucleotide sequence of VGAM2612 RNA, herein designated VGAM RNA, also designated SEQ ID:5323.

Another function of VGAM2612 is therefore inhibition of Zinc Finger Protein 289, ID1 Regulated (ZNF289, Accession XM_037147). Accordingly, utilities of VGAM2612 include diagnosis, prevention and treatment of diseases and clinical conditions associated with ZNF289. Apolipoprotein L, 2 (APOL2, Accession NM_030882) is another VGAM2612 host target gene. APOL2 BINDING SITE is HOST TARGET binding site found in the 5' untranslated region of mRNA encoded by APOL2, corresponding to a HOST TARGET binding site such as BINDING SITE I, BINDING SITE II or BINDING SITE III. Table 2 illustrates the complementarity of the nucleotide sequences of APOL2 BINDING SITE, designated SEQ ID:25161, to the nucleotide sequence of VGAM2612 RNA, herein designated VGAM RNA, also designated SEQ ID:5323.

Another function of VGAM2612 is therefore inhibition of Apolipoprotein L, 2 (APOL2, Accession NM_030882). Accordingly, utilities of VGAM2612 include diagnosis, prevention and treatment of diseases and clinical conditions associated with APOL2. Apolipoprotein L, 3 (APOL3, Accession NM_014349) is another VGAM2612 host target gene. APOL3 BINDING SITE is HOST TARGET binding site found in the 5' untranslated region of mRNA encoded by APOL3, corresponding to a HOST TARGET binding site such as BINDING SITE I, BINDING SITE II or BINDING SITE III. Table 2 illustrates the complementarity of the nucleotide sequences of APOL3 BINDING SITE, designated SEQ ID:15673, to the nucleotide sequence of VGAM2612 RNA, herein designated VGAM RNA, also designated SEQ ID:5323.

Another function of VGAM2612 is therefore inhibition of Apolipoprotein L, 3 (APOL3, Accession NM_014349). Accordingly, utilities of VGAM2612 include diagnosis, prevention and treatment of diseases and clinical conditions associated with APOL3. DKFZp434E2220 (Accession NM_017612) is another VGAM2612 host target gene. DKFZp434E2220 BINDING SITE is HOST TARGET binding site found in the 5' untranslated region of mRNA encoded by DKFZp434E2220, corresponding to a HOST TARGET binding site such as BINDING SITE I, BINDING SITE II or BINDING SITE III. Table 2 illustrates the complementarity of the nucleotide sequences of DKFZp434E2220 BINDING SITE, designated SEQ ID:19109, to the nucleotide sequence of VGAM2612 RNA, herein designated VGAM RNA, also designated SEQ ID:5323.

Another function of VGAM2612 is therefore inhibition of DKFZp434E2220 (Accession NM_017612). Accordingly, utilities of VGAM2612 include diagnosis, prevention and treatment of diseases and clinical conditions associated with DKFZp434E2220. FLJ10388 (Accession NM_018082) is another VGAM2612 host target gene. FLJ10388 BINDING SITE is HOST TARGET binding site found in the 3' untranslated region of mRNA encoded by FLJ10388, corresponding to a HOST TARGET binding site such as BINDING SITE I, BINDING SITE II or BINDING SITE III. Table 2 illustrates the complementarity of the nucleotide sequences of FLJ10388 BINDING SITE, designated SEQ ID:19843, to the nucleotide sequence of VGAM2612 RNA, herein designated VGAM RNA, also designated SEQ ID:5323.

Another function of VGAM2612 is therefore inhibition of FLJ10388 (Accession NM_018082). Accordingly, utilities of VGAM2612 include diagnosis, prevention and treatment of diseases and clinical conditions associated with FLJ10388. KIAA0367 (Accession XM_041018) is another VGAM2612 host target gene. KIAA0367 BINDING SITE is HOST TARGET binding site found in the 5' untranslated region of mRNA encoded by KIAA0367, corresponding to a HOST TARGET binding site such as BINDING SITE I, BINDING SITE II or BINDING SITE III. Table 2 illustrates the complementarity of the nucleotide sequences of KIAA0367 BINDING SITE, designated SEQ ID:33415, to the nucleotide sequence of VGAM2612 RNA, herein designated VGAM RNA, also designated SEQ ID:5323.

Another function of VGAM2612 is therefore inhibition of KIAA0367 (Accession XM_041018). Accordingly, utilities of VGAM2612 include diagnosis, prevention and treatment of diseases and clinical conditions associated with KIAA0367. KIAA0871 (Accession NM_014961) is another VGAM2612 host target gene. KIAA0871 BINDING SITE is HOST TARGET binding site found in the 3' untranslated region of mRNA encoded by KIAA0871, corresponding to a HOST TARGET binding site such as BINDING SITE I, BINDING SITE II or BINDING SITE III. Table 2 illustrates the complementarity of the nucleotide sequences of KIAA0871 BINDING SITE, designated SEQ ID:17330, to the nucleotide sequence of VGAM2612 RNA, herein designated VGAM RNA, also designated SEQ ID:5323.

Another function of VGAM2612 is therefore inhibition of KIAA0871 (Accession NM_014961). Accordingly, utilities of VGAM2612 include diagnosis, prevention and treatment of diseases and clinical conditions associated with KIAA0871. KIAA0992 (Accession NM_016081) is another VGAM2612 host target gene. KIAA0992 BINDING SITE is HOST TARGET binding site found in the 3' untranslated region of mRNA encoded by KIAA0992, corresponding to a HOST TARGET binding site such as BINDING SITE I, BINDING SITE II or BINDING SITE III. Table 2 illustrates the complementarity of the nucleotide sequences of KIAA0992 BINDING SITE, designated SEQ ID:18159, to the nucleotide sequence of VGAM2612 RNA, herein designated VGAM RNA, also designated SEQ ID:5323.

Another function of VGAM2612 is therefore inhibition of KIAA0992 (Accession NM_016081). Accordingly, utilities of VGAM2612 include diagnosis, prevention and treatment of diseases and clinical conditions associated with KIAA0992. KIAA1028 (Accession XM_166324) is another VGAM2612 host target gene. KIAA1028 BINDING SITE is HOST TARGET binding site found in the 3' untranslated region of mRNA encoded by KIAA1028, corresponding to a HOST TARGET binding site such as BINDING SITE I, BINDING SITE II or BINDING SITE III. Table 2 illustrates the complementarity of the nucleotide sequences of KIAA1028 BINDING SITE, designated SEQ ID:44157, to the nucleotide sequence of VGAM2612 RNA, herein designated VGAM RNA, also designated SEQ ID:5323.

Another function of VGAM2612 is therefore inhibition of KIAA1028 (Accession XM_166324). Accordingly, utilities of VGAM2612 include diagnosis, prevention and treatment of diseases and clinical conditions associated with KIAA1028. KIAA1203 (Accession XM_049683) is another VGAM2612 host target gene. KIAA1203 BINDING SITE is HOST TARGET binding site found in the 3' untranslated region of mRNA encoded by KIAA1203, corresponding to a HOST TARGET binding site such as BINDING SITE I, BINDING SITE II or BINDING SITE III. Table 2 illustrates the complementarity of the nucleotide sequences of KIAA1203 BINDING SITE, designated SEQ ID:35470, to the nucleotide sequence of VGAM2612 RNA, herein designated VGAM RNA, also designated SEQ ID:5323.

Another function of VGAM2612 is therefore inhibition of KIAA1203 (Accession XM_049683). Accordingly, utilities of VGAM2612 include diagnosis, prevention and treatment of diseases and clinical conditions associated with KIAA1203. KIAA1954 (Accession XM_085375) is another VGAM2612 host target gene. KIAA1954 BINDING SITE is HOST TARGET binding site found in the 3' untranslated region of mRNA encoded by KIAA1954, corresponding to a HOST TARGET binding site such as BINDING SITE I, BINDING SITE II or BINDING SITE III. Table 2 illustrates the complementarity of the nucleotide sequences of KIAA1954 BINDING SITE, designated SEQ ID:38098, to the nucleotide sequence of VGAM2612 RNA, herein designated VGAM RNA, also designated SEQ ID:5323.

Another function of VGAM2612 is therefore inhibition of KIAA1954 (Accession XM_085375). Accordingly, utilities of VGAM2612 include diagnosis, prevention and treatment of diseases and clinical conditions associated with KIAA1954. Leiomodin 1 (smooth muscle) (LMOD1, Accession NM_012134) is another VGAM2612 host target gene. LMOD1 BINDING SITE is HOST TARGET binding site found in the 3' untranslated region of mRNA encoded by LMOD1, corresponding to a HOST TARGET binding site such as BINDING SITE I, BINDING SITE II or BINDING SITE III. Table 2 illustrates the complementarity of the nucleotide sequences of LMOD1 BINDING SITE, designated SEQ ID:14447, to the nucleotide sequence of VGAM2612 RNA, herein designated VGAM RNA, also designated SEQ ID:5323.

Another function of VGAM2612 is therefore inhibition of Leiomodin 1 (smooth muscle) (LMOD1, Accession NM_012134). Accordingly, utilities of VGAM2612 include diagnosis, prevention and treatment of diseases and clinical conditions associated with LMOD1. MGC26914 (Accession NM_144976) is another VGAM2612 host target gene. MGC26914 BINDING SITE is HOST TARGET binding site found in the 3' untranslated region of mRNA encoded by MGC26914, corresponding to a HOST TARGET binding site such as BINDING SITE I, BINDING SITE II or BINDING SITE III. Table 2 illustrates the complementarity of the nucleotide sequences of MGC26914 BINDING SITE, designated SEQ ID:29586, to the nucleotide sequence of VGAM2612 RNA, herein designated VGAM RNA, also designated SEQ ID:5323.

Another function of VGAM2612 is therefore inhibition of MGC26914 (Accession NM_144976). Accordingly, utilities of VGAM2612 include diagnosis, prevention and treatment of diseases and clinical conditions associated with MGC26914. PRO1617 (Accession NM_018587) is another VGAM2612 host target gene. PRO1617 BINDING SITE is HOST TARGET binding site found in the 5' untranslated region of mRNA encoded by PRO1617, corresponding to a HOST TARGET binding site such as BINDING SITE I, BINDING SITE II or BINDING SITE III. Table 2 illustrates the complementarity of the nucleotide sequences of PRO1617 BINDING SITE, designated SEQ ID:20665, to the nucleotide sequence of VGAM2612 RNA, herein designated VGAM RNA, also designated SEQ ID:5323.

Another function of VGAM2612 is therefore inhibition of PRO1617 (Accession NM_018587). Accordingly, utilities of VGAM2612 include diagnosis, prevention and treatment of diseases and clinical conditions associated with PRO1617. SKRP1 (Accession NM_080876) is another VGAM2612 host target gene. SKRP1 BINDING SITE is HOST TARGET binding site found in the 5' untranslated region of mRNA encoded by SKRP1, corresponding to a HOST TARGET binding site such as BINDING SITE I, BINDING SITE II or BINDING SITE III. Table 2 illustrates the complementarity of the nucleotide sequences of SKRP1 BINDING SITE, designated SEQ ID:28119, to the nucleotide sequence of VGAM2612 RNA, herein designated VGAM RNA, also designated SEQ ID:5323.

Another function of VGAM2612 is therefore inhibition of SKRP1 (Accession NM_080876). Accordingly, utilities of VGAM2612 include diagnosis, prevention and treatment of diseases and clinical conditions associated with SKRP1. SPEC1 (Accession NM_020239) is another VGAM2612 host target gene. SPEC1 BINDING SITE is HOST TARGET binding site found in the 3' untranslated region of mRNA encoded by SPEC1, corresponding to a HOST TARGET binding site such as BINDING SITE I, BINDING SITE II or BINDING SITE III. Table 2 illustrates the complementarity of the nucleotide sequences of SPEC1 BINDING SITE, designated SEQ ID:21510, to the nucleotide sequence of VGAM2612 RNA, herein designated VGAM RNA, also designated SEQ ID:5323.

Another function of VGAM2612 is therefore inhibition of SPEC1 (Accession NM_020239). Accordingly, utilities of VGAM2612 include diagnosis, prevention and treatment of diseases and clinical conditions associated with SPEC1. LOC144747 (Accession XM_084954) is another VGAM2612 host target gene. LOC144747 BINDING SITE is HOST TARGET binding site found in the 5' untranslated region of mRNA encoded by LOC144747, corresponding to a HOST TARGET binding site such as BINDING SITE I, BINDING SITE II or BINDING SITE III. Table 2 illustrates the complementarity of the nucleotide sequences of LOC144747 BINDING SITE, designated SEQ ID:37782, to the nucleotide sequence of VGAM2612 RNA, herein designated VGAM RNA, also designated SEQ ID:5323.

Another function of VGAM2612 is therefore inhibition of LOC144747 (Accession XM_084954). Accordingly, utilities of VGAM2612 include diagnosis, prevention and treatment of diseases and clinical conditions associated with LOC144747. LOC158293 (Accession XM_088541) is another VGAM2612 host target gene. LOC158293 BINDING SITE is HOST TARGET binding site found in the 3' untranslated region of mRNA encoded by LOC158293, corresponding to a HOST TARGET binding site such as BINDING SITE I, BINDING SITE II or BINDING SITE III. Table 2 illustrates the complementarity of the nucleotide sequences of LOC158293 BINDING SITE, designated SEQ ID:39806, to the nucleotide sequence of VGAM2612 RNA, herein designated VGAM RNA, also designated SEQ ID:5323.

Another function of VGAM2612 is therefore inhibition of LOC158293 (Accession XM_088541). Accordingly, utilities of VGAM2612 include diagnosis, prevention and treatment of diseases and clinical conditions associated with LOC158293. LOC162239 (Accession XM_091439) is another VGAM2612 host target gene. LOC162239 BINDING SITE is HOST TARGET binding site found in the 3' untranslated region of mRNA encoded by LOC162239, corresponding to a HOST TARGET binding site such as BINDING SITE I, BINDING SITE II or BINDING SITE III. Table 2 illustrates the complementarity of the nucleotide sequences of LOC162239 BINDING SITE, designated SEQ ID:40051, to the nucleotide sequence of VGAM2612 RNA, herein designated VGAM RNA, also designated SEQ ID:5323.

Another function of VGAM2612 is therefore inhibition of LOC162239 (Accession XM_091439). Accordingly, utilities of VGAM2612 include diagnosis, prevention and treatment of diseases and clinical conditions associated with LOC162239. FIG. 1 further provides a conceptual description of a novel bioinformatically detected viral gene of the present invention, referred to here as Viral Genomic Address Messenger 2613 (VGAM2613) viral gene, which modulates expression of respective host target genes thereof, the function and utility of which host target genes is known in the art.

VGAM2613 is a novel bioinformatically detected regulatory, non protein coding, viral micro RNA (miRNA) gene. The method by which VGAM2613 was detected is described hereinabove with reference to FIGS. 1-8.

VGAM2613 gene, herein designated VGAM GENE, is a viral gene contained in the genome of Equine Rhinitis A Virus. VGAM2613 host target gene, herein designated VGAM HOST TARGET GENE, is a human gene contained in the human genome.

VGAM2613 gene encodes a VGAM2613 precursor RNA, herein designated VGAM PRECURSOR RNA. Similar to other miRNA genes, and unlike most ordinary genes, VGAM2613 precursor RNA does not encode a protein. A nucleotide sequence identical or highly similar to the nucleotide sequence of VGAM2613 precursor RNA is designated SEQ ID:2599, and is provided hereinbelow with reference to the sequence listing part. Nucleotide sequence SEQ ID:2599 is located at position 5479 relative to the genome of Equine Rhinitis A Virus.

VGAM2613 precursor RNA folds onto itself, forming VGAM2613 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2613 folded precursor RNA into VGAM2613 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 75%) nucleotide sequence of VGAM2613 RNA is designated SEQ ID:5324, and is provided hereinbelow with reference to the sequence listing part.

VGAM2613 host target gene, herein designated VGAM HOST TARGET GENE, encodes a corresponding messenger RNA, VGAM2613 host target RNA, herein designated VGAM HOST TARGET RNA. VGAM2613 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2613 RNA, herein designated VGAM RNA, binds complementarily to one or more host target binding sites located in untranslated regions of VGAM2613 host target RNA, herein designated VGAM HOST TARGET RNA. This complementary binding is due to the fact that the nucleotide sequence of VGAM2613 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2613 RNA, herein designated VGAM RNA, may have a different number of host target binding sites in untranslated regions of a VGAM2613 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2613 RNA, herein designated VGAM RNA, to host target binding sites on VGAM2613 host target RNA, herein designated VGAM HOST TARGET RNA, such as BINDING SITE I, BINDING SITE II and BINDING SITE III, inhibits translation of VGAM2613 host target RNA into VGAM2613 host target protein, herein designated VGAM HOST TARGET PROTEIN. VGAM host target protein is therefore outlined by a broken line.

It is appreciated that VGAM2613 host target gene, herein designated VGAM HOST TARGET GENE, in fact represents a plurality of VGAM2613 host target genes. The mRNA of each one of this plurality of VGAM2613 host target genes comprises one or more host target binding sites, each having a nucleotide sequence which is at least partly complementary to VGAM2613 RNA, herein designated VGAM RNA, and which when bound by VGAM2613 RNA causes inhibition of translation of respective one or more VGAM2613 host target proteins.

It is further appreciated by one skilled in the art that the mode of translational inhibition illustrated by FIG. 1 with specific reference to translational inhibition exerted by VGAM2613 gene, herein designated VGAM GENE, on one or more VGAM2613 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2613 is inhibition of expression of host target genes, as part of a novel viral mechanism of attacking a host. Accordingly, utilities of VGAM2613 include diagnosis, prevention and treatment of viral infection by Equine Rhinitis A Virus. Specific functions, and accordingly utilities, of VGAM2613 correlate with, and may be deduced from, the identity of the host target genes which VGAM2613 binds and inhibits, and the function of these host target genes, as elaborated hereinbelow.

Nucleotide sequences of the VGAM2613 precursor RNA, herein designated VGAM PRECURSOR RNA, and of the 'diced' VGAM2613 RNA, herein designated VGAM RNA, and a schematic representation of the secondary folding of VGAM2613 folded precursor RNA, herein designated VGAM FOLDED PRECURSOR RNA, of VGAM2613 are further described hereinbelow with reference to Table 1.

Nucleotide sequences of host target binding sites, such as BINDING SITE-I, BINDING SITE-II and BINDING SITE-III of FIG. 1, found on VGAM2613 host target RNA, and schematic representation of the complementarity of each of these host target binding sites to VGAM2613 RNA, herein designated VGAM RNA, are described hereinbelow with reference to Table 2.

As mentioned hereinabove with reference to FIG. 1, a function of VGAM2613 gene, herein designated VGAM is inhibition of expression of VGAM2613 target genes. It is appreciated that specific functions, and accordingly utilities, of VGAM2613 correlate with, and may be deduced from, the identity of the target genes which VGAM2613 binds and inhibits, and the function of these target genes, as elaborated hereinbelow.

Contactin Associated Protein-like 2 (CNTNAP2, Accession NM_014141) is a VGAM2613 host target gene. CNTNAP2 BINDING SITE is HOST TARGET binding site found in the 3' untranslated region of mRNA encoded by CNTNAP2, corresponding to a HOST TARGET binding site such as BINDING SITE I, BINDING SITE II or BINDING SITE III. Table 2 illustrates the complementarity of the nucleotide sequences of CNTNAP2 BINDING SITE, designated SEQ ID:15414, to the nucleotide sequence of VGAM2613 RNA, herein designated VGAM RNA, also designated SEQ ID:5324.

A function of VGAM2613 is therefore inhibition of Contactin Associated Protein-like 2 (CNTNAP2, Accession NM_014141). Accordingly, utilities of VGAM2613 include diagnosis, prevention and treatment of diseases and clinical conditions associated with CNTNAP2. Down Syndrome Critical Region Gene 5 (DSCR5, Accession NM_016430) is another VGAM2613 host target gene. DSCR5 BINDING SITE is HOST TARGET binding site found in the 5' untranslated region of mRNA encoded by DSCR5, corresponding to a HOST TARGET binding site such as BINDING SITE I, BINDING SITE II or BINDING SITE III. Table 2 illustrates the complementarity of the nucleotide sequences of DSCR5 BINDING SITE, designated SEQ ID:18549, to the nucleotide sequence of VGAM2613 RNA, herein designated VGAM RNA, also designated SEQ ID:5324.

Another function of VGAM2613 is therefore inhibition of Down Syndrome Critical Region Gene 5 (DSCR5, Accession NM_016430), a gene which is expressed in liver, skeletal muscle, heart, pancreas and testis. Accordingly, utilities of VGAM2613 include diagnosis, prevention and treatment of diseases and clinical conditions associated with DSCR5. The function of DSCR5 and its association with various diseases and clinical conditions, has been established by previous studies, as described hereinabove with reference to VGAM1720. Forkhead Box M1 (FOXM1, Accession NM_021953) is another VGAM2613 host target gene. FOXM1 BINDING SITE is HOST TARGET binding site found in the 3' untranslated region of mRNA encoded by FOXM1, corresponding to a HOST TARGET binding site such as BINDING SITE I, BINDING SITE II or BINDING SITE III. Table 2 illustrates the complementarity of the nucleotide sequences of FOXM1 BINDING SITE, designated SEQ ID:22483, to the nucleotide sequence of VGAM2613 RNA, herein designated VGAM RNA, also designated SEQ ID:5324.

Another function of VGAM2613 is therefore inhibition of Forkhead Box M1 (FOXM1, Accession NM_021953), a gene which may play a role in the control of cell proliferation. Accordingly, utilities of VGAM2613 include diagnosis, prevention and treatment of diseases and clinical conditions associated with FOXM1. The function of FOXM1 and its association with various diseases and clinical conditions, has been established by previous studies, as described hereinabove with reference to VGAM632. Optic Atrophy 1 (autosomal dominant) (OPA1, Accession NM_130837) is another VGAM2613 host target gene. OPA1 BINDING SITE1 through OPA1 BINDING SITE5 are HOST TARGET binding sites found in untranslated regions of mRNA encoded by OPA1, corresponding to HOST TARGET binding sites such as BINDING SITE I, BINDING SITE II or BINDING SITE III. Table 2 illustrates the complementarity of the nucleotide sequences of OPA1 BINDING SITE1 through OPA1 BINDING SITE5, designated SEQ ID:28352, SEQ ID:28320, SEQ ID:28336, SEQ ID:28344 and SEQ ID:28328 respectively, to the nucleotide sequence of VGAM2613 RNA, herein designated VGAM RNA, also designated SEQ ID:5324.

Another function of VGAM2613 is therefore inhibition of Optic Atrophy 1 (autosomal dominant) (OPA1, Accession NM_130837). Accordingly, utilities of VGAM2613 include diagnosis, prevention and treatment of diseases and clinical conditions associated with OPA1. Protocadherin Alpha 11 (PCDHA11, Accession NM_031861) is another VGAM2613 host target gene. PCDHA11 BINDING SITE1 and PCDHA11 BINDING SITE2 are HOST TARGET binding sites found in untranslated regions of mRNA encoded by PCDHA11, corresponding to HOST TARGET binding sites such as BINDING SITE I, BINDING SITE II or BINDING SITE III. Table 2 illustrates the complementarity of the nucleotide sequences of PCDHA11 BINDING SITE1 and PCDHA11 BINDING SITE2, designated SEQ ID:25621 and SEQ ID:11311 respectively, to the nucleotide sequence of VGAM2613 RNA, herein designated VGAM RNA, also designated SEQ ID:5324.

Another function of VGAM2613 is therefore inhibition of Protocadherin Alpha 11 (PCDHA11, Accession NM_031861). Accordingly, utilities of VGAM2613 include diagnosis, prevention and treatment of diseases and clinical conditions associated with PCDHA11. FLJ13657 (Accession NM_024828) is another VGAM2613 host target gene. FLJ13657 BINDING SITE is HOST TARGET binding site found in the 3' untranslated region of mRNA encoded by FLJ13657, corresponding to a HOST TARGET binding site such as BINDING SITE I, BINDING SITE II or BINDING SITE III. Table 2 illustrates the complementarity of the nucleotide sequences of FLJ13657 BINDING SITE, designated SEQ ID:24220, to the nucleotide sequence of VGAM2613

RNA, herein designated VGAM RNA, also designated SEQ ID:5324.

Another function of VGAM2613 is therefore inhibition of FLJ13657 (Accession NM_024828). Accordingly, utilities of VGAM2613 include diagnosis, prevention and treatment of diseases and clinical conditions associated with FLJ13657. KIAA0753 (Accession NM_014804) is another VGAM2613 host target gene. KIAA0753 BINDING SITE is HOST TARGET binding site found in the 3' untranslated region of mRNA encoded by KIAA0753, corresponding to a HOST TARGET binding site such as BINDING SITE I, BINDING SITE II or BINDING SITE III. Table 2 illustrates the complementarity of the nucleotide sequences of KIAA0753 BINDING SITE, designated SEQ ID:16736, to the nucleotide sequence of VGAM2613 RNA, herein designated VGAM RNA, also designated SEQ ID:5324.

Another function of VGAM2613 is therefore inhibition of KIAA0753 (Accession NM_014804). Accordingly, utilities of VGAM2613 include diagnosis, prevention and treatment of diseases and clinical conditions associated with KIAA0753. MAIL (Accession NM_031419) is another VGAM2613 host target gene. MAIL BINDING SITE is HOST TARGET binding site found in the 3' untranslated region of mRNA encoded by MAIL, corresponding to a HOST TARGET binding site such as BINDING SITE I, BINDING SITE II or BINDING SITE III. Table 2 illustrates the complementarity of the nucleotide sequences of MAIL BINDING SITE, designated SEQ ID:25405, to the nucleotide sequence of VGAM2613 RNA, herein designated VGAM RNA, also designated SEQ ID:5324.

Another function of VGAM2613 is therefore inhibition of MAIL (Accession NM_031419). Accordingly, utilities of VGAM2613 include diagnosis, prevention and treatment of diseases and clinical conditions associated with MAIL. Pellino Homolog 2 (Drosophila) (PELI2, Accession NM_021255) is another VGAM2613 host target gene. PELI2 BINDING SITE is HOST TARGET binding site found in the 3' untranslated region of mRNA encoded by PELI2, corresponding to a HOST TARGET binding site such as BINDING SITE I, BINDING SITE II or BINDING SITE III. Table 2 illustrates the complementarity of the nucleotide sequences of PELI2 BINDING SITE, designated SEQ ID:22232, to the nucleotide sequence of VGAM2613 RNA, herein designated VGAM RNA, also designated SEQ ID:5324.

Another function of VGAM2613 is therefore inhibition of Pellino Homolog 2 (Drosophila) (PELI2, Accession NM_021255). Accordingly, utilities of VGAM2613 include diagnosis, prevention and treatment of diseases and clinical conditions associated with PELI2. LOC130026 (Accession NM_138468) is another VGAM2613 host target gene. LOC130026 BINDING SITE is HOST TARGET binding site found in the 3' untranslated region of mRNA encoded by LOC130026, corresponding to a HOST TARGET binding site such as BINDING SITE I, BINDING SITE II or BINDING SITE III. Table 2 illustrates the complementarity of the nucleotide sequences of LOC130026 BINDING SITE, designated SEQ ID:28818, to the nucleotide sequence of VGAM2613 RNA, herein designated VGAM RNA, also designated SEQ ID:5324.

Another function of VGAM2613 is therefore inhibition of LOC130026 (Accession NM_138468). Accordingly, utilities of VGAM2613 include diagnosis, prevention and treatment of diseases and clinical conditions associated with LOC130026. LOC200314 (Accession XM_117225) is another VGAM2613 host target gene. LOC200314 BINDING SITE is HOST TARGET binding site found in the 3' untranslated region of mRNA encoded by LOC200314, corresponding to a HOST TARGET binding site such as BINDING SITE I, BINDING SITE II or BINDING SITE III. Table 2 illustrates the complementarity of the nucleotide sequences of LOC200314 BINDING SITE, designated SEQ ID:43294, to the nucleotide sequence of VGAM2613 RNA, herein designated VGAM RNA, also designated SEQ ID:5324.

Another function of VGAM2613 is therefore inhibition of LOC200314 (Accession XM_117225). Accordingly, utilities of VGAM2613 include diagnosis, prevention and treatment of diseases and clinical conditions associated with LOC200314. LOC55885 (Accession NM_018640) is another VGAM2613 host target gene. LOC55885 BINDING SITE is HOST TARGET binding site found in the 3' untranslated region of mRNA encoded by LOC55885, corresponding to a HOST TARGET binding site such as BINDING SITE I, BINDING SITE II or BINDING SITE III. Table 2 illustrates the complementarity of the nucleotide sequences of LOC55885 BINDING SITE, designated SEQ ID:20711, to the nucleotide sequence of VGAM2613 RNA, herein designated VGAM RNA, also designated SEQ ID:5324.

Another function of VGAM2613 is therefore inhibition of LOC55885 (Accession NM_018640). Accordingly, utilities of VGAM2613 include diagnosis, prevention and treatment of diseases and clinical conditions associated with LOC55885. LOC92465 (Accession XM_045250) is another VGAM2613 host target gene. LOC92465 BINDING SITE is HOST TARGET binding site found in the 5' untranslated region of mRNA encoded by LOC92465, corresponding to a HOST TARGET binding site such as BINDING SITE I, BINDING SITE II or BINDING SITE III. Table 2 illustrates the complementarity of the nucleotide sequences of LOC92465 BINDING SITE, designated SEQ ID:34394, to the nucleotide sequence of VGAM2613 RNA, herein designated VGAM RNA, also designated SEQ ID:5324.

Another function of VGAM2613 is therefore inhibition of LOC92465 (Accession XM_045250). Accordingly, utilities of VGAM2613 include diagnosis, prevention and treatment of diseases and clinical conditions associated with LOC92465. LOC93259 (Accession XM_050105) is another VGAM2613 host target gene. LOC93259 BINDING SITE is HOST TARGET binding site found in the 5' untranslated region of mRNA encoded by LOC93259, corresponding to a HOST TARGET binding site such as BINDING SITE I, BINDING SITE II or BINDING SITE III. Table 2 illustrates the complementarity of the nucleotide sequences of LOC93259 BINDING SITE, designated SEQ ID:35559, to the nucleotide sequence of VGAM2613 RNA, herein designated VGAM RNA, also designated SEQ ID:5324.

Another function of VGAM2613 is therefore inhibition of LOC93259 (Accession XM_050105). Accordingly, utilities of VGAM2613 include diagnosis, prevention and treatment of diseases and clinical conditions associated with LOC93259. LOC96597 (Accession XM_039922) is another VGAM2613 host target gene. LOC96597 BINDING SITE is HOST TARGET binding site found in the 5' untranslated region of mRNA encoded by LOC96597, corresponding to a HOST TARGET binding site such as BINDING SITE I, BINDING SITE II or BINDING SITE III. Table 2 illustrates the complementarity of the nucleotide sequences of LOC96597 BINDING SITE, designated SEQ ID:33228, to the nucleotide sequence of VGAM2613 RNA, herein designated VGAM RNA, also designated SEQ ID:5324.

Another function of VGAM2613 is therefore inhibition of LOC96597 (Accession XM_039922). Accordingly, utilities of VGAM2613 include diagnosis, prevention and treatment of diseases and clinical conditions associated with LOC96597. FIG. 1 further provides a conceptual description of a novel bioinformatically detected viral gene of the present invention, referred to here as Viral Genomic Address Messenger 2614 (VGAM2614) viral gene, which modulates expression of respective host target genes thereof, the function and utility of which host target genes is known in the art.

VGAM2614 is a novel bioinformatically detected regulatory, non protein coding, viral micro RNA (miRNA) gene. The method by which VGAM2614 was detected is described hereinabove with reference to FIGS. 1-8.

VGAM2614 gene, herein designated VGAM GENE, is a viral gene contained in the genome of Equine Rhinitis B Virus. VGAM2614 host target gene, herein designated VGAM HOST TARGET GENE, is a human gene contained in the human genome.

VGAM2614 gene encodes a VGAM2614 precursor RNA, herein designated VGAM PRECURSOR RNA. Similar to other miRNA genes, and unlike most ordinary genes, VGAM2614 precursor RNA does not encode a protein. A nucleotide sequence identical or highly similar to the nucleotide sequence of VGAM2614 precursor RNA is designated SEQ ID:2600, and is provided hereinbelow with reference to the sequence listing part. Nucleotide sequence SEQ ID:2600 is located at position 6330 relative to the genome of Equine Rhinitis B Virus.

VGAM2614 precursor RNA folds onto itself, forming VGAM2614 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2614 folded precursor RNA into VGAM2614 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2614 RNA is designated SEQ ID:5325, and is provided hereinbelow with reference to the sequence listing part.

VGAM2614 host target gene, herein designated VGAM HOST TARGET GENE, encodes a corresponding messenger RNA, VGAM2614 host target RNA, herein designated VGAM HOST TARGET RNA. VGAM2614 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2614 RNA, herein designated VGAM RNA, binds complementarily to one or more host target binding sites located in untranslated regions of VGAM2614 host target RNA, herein designated VGAM HOST TARGET RNA. This complementary binding is due to the fact that the nucleotide sequence of VGAM2614 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2614 RNA, herein designated VGAM RNA, may have a different number of host target binding sites in untranslated regions of a VGAM2614 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2614 RNA, herein designated VGAM RNA, to host target binding sites on VGAM2614 host target RNA, herein designated VGAM HOST TARGET RNA, such as BINDING SITE I, BINDING SITE II and BINDING SITE III, inhibits translation of VGAM2614 host target RNA into VGAM2614 host target protein, herein designated VGAM HOST TARGET PROTEIN. VGAM host target protein is therefore outlined by a broken line.

It is appreciated that VGAM2614 host target gene, herein designated VGAM HOST TARGET GENE, in fact represents a plurality of VGAM2614 host target genes. The mRNA of each one of this plurality of VGAM2614 host target genes comprises one or more host target binding sites, each having a nucleotide sequence which is at least partly complementary to VGAM2614 RNA, herein designated VGAM RNA, and which when bound by VGAM2614 RNA causes inhibition of translation of respective one or more VGAM2614 host target proteins.

It is further appreciated by one skilled in the art that the mode of translational inhibition illustrated by FIG. 1 with specific reference to translational inhibition exerted by VGAM2614 gene, herein designated VGAM GENE, on one or more VGAM2614 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2614 is inhibition of expression of host target genes, as part of a novel viral mechanism of attacking a host. Accordingly, utilities of VGAM2614 include diagnosis, prevention and treatment of viral infection by Equine Rhinitis B Virus. Specific functions, and accordingly utilities, of VGAM2614 correlate with, and may be deduced from, the identity of the host target genes which VGAM2614 binds and inhibits, and the function of these host target genes, as elaborated hereinbelow.

Nucleotide sequences of the VGAM2614 precursor RNA, herein designated VGAM PRECURSOR RNA, and of the 'diced' VGAM2614 RNA, herein designated VGAM RNA, and a schematic representation of the secondary folding of VGAM2614 folded precursor RNA, herein designated VGAM FOLDED PRECURSOR RNA, of VGAM2614 are further described hereinbelow with reference to Table 1.

Nucleotide sequences of host target binding sites, such as BINDING SITE-I, BINDING SITE-II and BINDING SITE-III of FIG. 1, found on VGAM2614 host target RNA, and schematic representation of the complementarity of each of these host target binding sites to VGAM2614 RNA, herein designated VGAM RNA, are described hereinbelow with reference to Table 2.

As mentioned hereinabove with reference to FIG. 1, a function of VGAM2614 gene, herein designated VGAM is inhibition of expression of VGAM2614 target genes. It is appreciated that specific functions, and accordingly utilities, of VGAM2614 correlate with, and may be deduced from, the identity of the target genes which VGAM2614 binds and inhibits, and the function of these target genes, as elaborated hereinbelow.

EDR3 (Accession XM_172303) is a VGAM2614 host target gene. EDR3 BINDING SITE is HOST TARGET binding site found in the 5' untranslated region of mRNA encoded by EDR3, corresponding to a HOST TARGET binding site such as BINDING SITE I, BINDING SITE II or BINDING SITE III. Table 2 illustrates the complementarity of the nucleotide sequences of EDR3 BINDING SITE, designated SEQ ID:46067, to the nucleotide sequence of VGAM2614 RNA, herein designated VGAM RNA, also designated SEQ ID:5325.

A function of VGAM2614 is therefore inhibition of EDR3 (Accession XM_172303). Accordingly, utilities of VGAM2614 include diagnosis, prevention and treatment of diseases and clinical conditions associated with EDR3. KIAA1393 (Accession XM_050793) is another VGAM2614 host target gene. KIAA1393 BINDING SITE is HOST TARGET binding site found in the 3' untranslated region of mRNA encoded by KIAA1393, corresponding to a HOST TARGET binding site such as BINDING SITE I, BINDING SITE II or BINDING SITE III. Table 2 illustrates the complementarity of the nucleotide sequences of KIAA1393 BINDING SITE, designated SEQ ID:35685, to the nucleotide sequence of VGAM2614 RNA, herein designated VGAM RNA, also designated SEQ ID:5325.

Another function of VGAM2614 is therefore inhibition of KIAA1393 (Accession XM_050793). Accordingly, utilities of VGAM2614 include diagnosis, prevention and treatment of diseases and clinical conditions associated with KIAA1393. FIG. 1 further provides a conceptual description of a novel bioinformatically detected viral gene of the present invention, referred to here as Viral Genomic Address Messenger 2615 (VGAM2615) viral gene, which modulates expression of respective host target genes thereof, the function and utility of which host target genes is known in the art.

VGAM2615 is a novel bioinformatically detected regulatory, non protein coding, viral micro RNA (miRNA) gene. The method by which VGAM2615 was detected is described hereinabove with reference to FIGS. 1-8.

VGAM2615 gene, herein designated VGAM GENE, is a viral gene contained in the genome of Equine Rhinitis B Virus. VGAM2615 host target gene, herein designated VGAM HOST TARGET GENE, is a human gene contained in the human genome.

VGAM2615 gene encodes a VGAM2615 precursor RNA, herein designated VGAM PRECURSOR RNA. Similar to other miRNA genes, and unlike most ordinary genes, VGAM2615 precursor RNA does not encode a protein. A nucleotide sequence identical or highly similar to the nucleotide sequence of VGAM2615 precursor RNA is designated SEQ ID:2601, and is provided hereinbelow with reference to the sequence listing part. Nucleotide sequence SEQ ID:2601 is located at position 2100 relative to the genome of Equine Rhinitis B Virus.

VGAM2615 precursor RNA folds onto itself, forming VGAM2615 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2615 folded precursor RNA into VGAM2615 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2615 RNA is designated SEQ ID:5326, and is provided hereinbelow with reference to the sequence listing part.

VGAM2615 host target gene, herein designated VGAM HOST TARGET GENE, encodes a corresponding messenger RNA, VGAM2615 host target RNA, herein designated VGAM HOST TARGET RNA. VGAM2615 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2615 RNA, herein designated VGAM RNA, binds complementarily to one or more host target binding sites located in untranslated regions of VGAM2615 host target RNA, herein designated VGAM HOST TARGET RNA. This complementary binding is due to the fact that the nucleotide sequence of VGAM2615 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2615 RNA, herein designated VGAM RNA, may have a different number of host target binding sites in untranslated regions of a VGAM2615 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2615 RNA, herein designated VGAM RNA, to host target binding sites on VGAM2615 host target RNA, herein designated VGAM HOST TARGET RNA, such as BINDING SITE I, BINDING SITE II and BINDING SITE III, inhibits translation of VGAM2615 host target RNA into VGAM2615 host target protein, herein designated VGAM HOST TARGET PROTEIN. VGAM host target protein is therefore outlined by a broken line.

It is appreciated that VGAM2615 host target gene, herein designated VGAM HOST TARGET GENE, in fact represents a plurality of VGAM2615 host target genes. The mRNA of each one of this plurality of VGAM2615 host target genes comprises one or more host target binding sites, each having a nucleotide sequence which is at least partly complementary to VGAM2615 RNA, herein designated VGAM RNA, and which when bound by VGAM2615 RNA causes inhibition of translation of respective one or more VGAM2615 host target proteins.

It is further appreciated by one skilled in the art that the mode of translational inhibition illustrated by FIG. 1 with specific reference to translational inhibition exerted by VGAM2615 gene, herein designated VGAM GENE, on one or more VGAM2615 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2615 is inhibition of expression of host target genes, as part of a novel viral mechanism of attacking a host. Accordingly, utilities of VGAM2615 include diagnosis, prevention and treatment of viral infection by Equine Rhinitis B Virus. Specific functions, and accordingly utilities, of VGAM2615 correlate with, and may be deduced from, the identity of the host target genes which VGAM2615 binds and inhibits, and the function of these host target genes, as elaborated hereinbelow.

Nucleotide sequences of the VGAM2615 precursor RNA, herein designated VGAM PRECURSOR RNA, and of the 'diced' VGAM2615 RNA, herein designated VGAM RNA, and a schematic representation of the secondary folding of VGAM2615 folded precursor RNA, herein designated VGAM FOLDED PRECURSOR RNA, of VGAM2615 are further described hereinbelow with reference to Table 1.

Nucleotide sequences of host target binding sites, such as BINDING SITE-I, BINDING SITE-II and BINDING SITE-III of FIG. 1, found on VGAM2615 host target RNA, and schematic representation of the complementarity of each of these host target binding sites to VGAM2615 RNA, herein designated VGAM RNA, are described hereinbelow with reference to Table 2.

As mentioned hereinabove with reference to FIG. 1, a function of VGAM2615 gene, herein designated VGAM is inhibition of expression of VGAM2615 target genes. It is appreciated that specific functions, and accordingly utilities, of VGAM2615 correlate with, and may be deduced from, the identity of the target genes which VGAM2615 binds and inhibits, and the function of these target genes, as elaborated hereinbelow.

CD244 (Accession NM_016382) is a VGAM2615 host target gene. CD244 BINDING SITE is HOST TARGET binding site found in the 3' untranslated region of mRNA encoded by CD244, corresponding to a HOST TARGET binding site such as BINDING SITE I, BINDING SITE II or BINDING SITE III. Table 2 illustrates the complementarity of the nucleotide sequences of CD244 BINDING SITE, designated SEQ ID:18526, to the nucleotide sequence of VGAM2615 RNA, herein designated VGAM RNA, also designated SEQ ID:5326.

A function of VGAM2615 is therefore inhibition of CD244 (Accession NM_016382), a gene which can interfere with a step as proximal as phosphorylation of an activation receptor. Accordingly, utilities of VGAM2615 include diagnosis, prevention and treatment of diseases and clinical conditions associated with CD244. The function of CD244 and its association with various diseases and clinical conditions, has been established by previous studies, as described hereinabove with reference to VGAM1224. EGF-like-domain, Multiple 5 (EGFL5, Accession XM_098838) is another VGAM2615 host target gene. EGFL5 BINDING SITE is HOST TARGET binding site found in the 3' untranslated region of mRNA encoded by EGFL5, corresponding to a HOST TARGET binding site such as BINDING SITE I, BINDING SITE II or BINDING SITE III. Table 2 illustrates the complementarity of the nucleotide sequences of EGFL5 BINDING SITE, designated SEQ ID:41873, to the nucleotide sequence of VGAM2615 RNA, herein designated VGAM RNA, also designated SEQ ID:5326.

Another function of VGAM2615 is therefore inhibition of EGF-like-domain, Multiple 5 (EGFL5, Accession XM_098838). Accordingly, utilities of VGAM2615 include diagnosis, prevention and treatment of diseases and clinical conditions associated with EGFL5. FLJ11730 (Accession NM_022756) is another VGAM2615 host target gene. FLJ11730 BINDING SITE is HOST TARGET binding site found in the 3' untranslated region of mRNA encoded by FLJ11730, corresponding to a HOST TARGET binding site such as BINDING SITE I, BINDING SITE II or BINDING SITE III. Table 2 illustrates the complementarity of the nucleotide sequences of FLJ11730 BINDING SITE, designated SEQ ID:22993, to the nucleotide sequence of VGAM2615 RNA, herein designated VGAM RNA, also designated SEQ ID:5326.

Another function of VGAM2615 is therefore inhibition of FLJ11730 (Accession NM_022756). Accordingly, utilities of VGAM2615 include diagnosis, prevention and treatment of diseases and clinical conditions associated with FLJ11730. Golgi Autoantigen, Golgin Subfamily A, 1 (GOLGA1, Accession NM_002077) is another VGAM2615 host target gene. GOLGA1 BINDING SITE is HOST TARGET binding site found in the 3' untranslated region of mRNA encoded by GOLGA1, corresponding to a HOST TARGET binding site such as BINDING SITE I, BINDING SITE II or BINDING SITE III. Table 2 illustrates the complementarity of the nucleotide sequences of GOLGA1 BINDING SITE, designated SEQ ID:7856, to the nucleotide sequence of VGAM2615 RNA, herein designated VGAM RNA, also designated SEQ ID:5326.

Another function of VGAM2615 is therefore inhibition of Golgi Autoantigen, Golgin Subfamily A, 1 (GOLGA1, Accession NM_002077). Accordingly, utilities of VGAM2615 include diagnosis, prevention and treatment of diseases and clinical conditions associated with GOLGA1. KIAA0447 (Accession XM_049733) is another VGAM2615 host target gene. KIAA0447 BINDING SITE is HOST TARGET binding site found in the 3' untranslated region of mRNA encoded by KIAA0447, corresponding to a HOST TARGET binding site such as BINDING SITE I, BINDING SITE II or BINDING SITE III. Table 2 illustrates the complementarity of the nucleotide sequences of KIAA0447 BINDING SITE, designated SEQ ID:35494, to the nucleotide sequence of VGAM2615 RNA, herein designated VGAM RNA, also designated SEQ ID:5326.

Another function of VGAM2615 is therefore inhibition of KIAA0447 (Accession XM_049733). Accordingly, utilities of VGAM2615 include diagnosis, prevention and treatment of diseases and clinical conditions associated with KIAA0447. ZAK (Accession NM_133646) is another VGAM2615 host target gene. ZAK BINDING SITE is HOST TARGET binding site found in the 3' untranslated region of mRNA encoded by ZAK, corresponding to a HOST TARGET binding site such as BINDING SITE I, BINDING SITE II or BINDING SITE III. Table 2 illustrates the complementarity of the nucleotide sequences of ZAK BINDING SITE, designated SEQ ID:28604, to the nucleotide sequence of VGAM2615 RNA, herein designated VGAM RNA, also designated SEQ ID:5326.

Another function of VGAM2615 is therefore inhibition of ZAK (Accession NM_133646). Accordingly, utilities of VGAM2615 include diagnosis, prevention and treatment of diseases and clinical conditions associated with ZAK. LOC115110 (Accession XM_049825) is another VGAM2615 host target gene. LOC115110 BINDING SITE is HOST TARGET binding site found in the 3' untranslated region of mRNA encoded by LOC115110, corresponding to a HOST TARGET binding site such as BINDING SITE I, BINDING SITE II or BINDING SITE III. Table 2 illustrates the complementarity of the nucleotide sequences of LOC115110 BINDING SITE, designated SEQ ID:35510, to the nucleotide sequence of VGAM2615 RNA, herein designated VGAM RNA, also designated SEQ ID:5326.

Another function of VGAM2615 is therefore inhibition of LOC115110 (Accession XM_049825). Accordingly, utilities of VGAM2615 include diagnosis, prevention and treatment of diseases and clinical conditions associated with LOC115110. LOC197342 (Accession XM_113869) is another VGAM2615 host target gene. LOC197342 BINDING SITE is HOST TARGET binding site found in the 3' untranslated region of mRNA encoded by LOC197342, corresponding to a HOST TARGET binding site such as BINDING SITE I, BINDING SITE II or BINDING SITE III. Table 2 illustrates the complementarity of the nucleotide sequences of LOC197342 BINDING SITE, designated SEQ ID:42487, to the nucleotide sequence of VGAM2615 RNA, herein designated VGAM RNA, also designated SEQ ID:5326.

Another function of VGAM2615 is therefore inhibition of LOC197342 (Accession XM_113869). Accordingly, utilities of VGAM2615 include diagnosis, prevention and treatment of diseases and clinical conditions associated with LOC197342. FIG. 1 further provides a conceptual description of a novel bioinformatically detected viral gene of the present invention, referred to here as Viral Genomic Address Messenger 2616 (VGAM2616) viral gene, which modulates expression of respective host target genes thereof, the function and utility of which host target genes is known in the art.

VGAM2616 is a novel bioinformatically detected regulatory, non protein coding, viral micro RNA (miRNA) gene. The method by which VGAM2616 was detected is described hereinabove with reference to FIGS. 1-8.

VGAM2616 gene, herein designated VGAM GENE, is a viral gene contained in the genome of Equine Rhinitis B Virus. VGAM2616 host target gene, herein designated VGAM HOST TARGET GENE, is a human gene contained in the human genome.

VGAM2616 gene encodes a VGAM2616 precursor RNA, herein designated VGAM PRECURSOR RNA. Similar to other miRNA genes, and unlike most ordinary genes, VGAM2616 precursor RNA does not encode a protein. A nucleotide sequence identical or highly similar to the nucleotide sequence of VGAM2616 precursor RNA is designated SEQ ID:2602, and is provided hereinbelow with reference to the sequence listing part. Nucleotide sequence SEQ ID:2602 is located at position 4799 relative to the genome of Equine Rhinitis B Virus.

VGAM2616 precursor RNA folds onto itself, forming VGAM2616 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2616 folded precursor RNA into VGAM2616 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2616 RNA is designated SEQ ID:5327, and is provided hereinbelow with reference to the sequence listing part.

VGAM2616 host target gene, herein designated VGAM HOST TARGET GENE, encodes a corresponding messenger RNA, VGAM2616 host target RNA, herein designated VGAM HOST TARGET RNA. VGAM2616 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2616 RNA, herein designated VGAM RNA, binds complementarily to one or more host target binding sites located in untranslated regions of VGAM2616 host target RNA, herein designated VGAM HOST TARGET RNA. This complementary binding is due to the fact that the nucleotide sequence of VGAM2616 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2616 RNA, herein designated VGAM RNA, may have a different number of host target binding sites in untranslated regions of a VGAM2616 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2616 RNA, herein designated VGAM RNA, to host target binding sites on VGAM2616 host target RNA, herein designated VGAM HOST TARGET RNA, such as BINDING SITE I, BINDING SITE II and BINDING SITE III, inhibits translation of VGAM2616 host target RNA into VGAM2616 host target protein, herein designated VGAM HOST TARGET PROTEIN. VGAM host target protein is therefore outlined by a broken line.

It is appreciated that VGAM2616 host target gene, herein designated VGAM HOST TARGET GENE, in fact represents a plurality of VGAM2616 host target genes. The mRNA of each one of this plurality of VGAM2616 host target genes comprises one or more host target binding sites, each having a nucleotide sequence which is at least partly complementary to VGAM2616 RNA, herein designated VGAM RNA, and which when bound by VGAM2616 RNA causes inhibition of translation of respective one or more VGAM2616 host target proteins.

It is further appreciated by one skilled in the art that the mode of translational inhibition illustrated by FIG. 1 with specific reference to translational inhibition exerted by VGAM2616 gene, herein designated VGAM GENE, on one or more VGAM2616 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2616 is inhibition of expression of host target genes, as part of a novel viral mechanism of attacking a host. Accordingly, utilities of VGAM2616 include diagnosis, prevention and treatment of viral infection by Equine Rhinitis B Virus. Specific functions, and accordingly utilities, of VGAM2616 correlate with, and may be deduced from, the identity of the host target genes which VGAM2616 binds and inhibits, and the function of these host target genes, as elaborated hereinbelow.

Nucleotide sequences of the VGAM2616 precursor RNA, herein designated VGAM PRECURSOR RNA, and of the 'diced' VGAM2616 RNA, herein designated VGAM RNA, and a schematic representation of the secondary folding of VGAM2616 folded precursor RNA, herein designated VGAM FOLDED PRECURSOR RNA, of VGAM2616 are further described hereinbelow with reference to Table 1.

Nucleotide sequences of host target binding sites, such as BINDING SITE-I, BINDING SITE-II and BINDING SITE-III of FIG. 1, found on VGAM2616 host target RNA, and schematic representation of the complementarity of each of these host target binding sites to VGAM2616 RNA, herein designated VGAM RNA, are described hereinbelow with reference to Table 2.

As mentioned hereinabove with reference to FIG. 1, a function of VGAM2616 gene, herein designated VGAM is inhibition of expression of VGAM2616 target genes. It is appreciated that specific functions, and accordingly utilities, of VGAM2616 correlate with, and may be deduced from, the identity of the target genes which VGAM2616 binds and inhibits, and the function of these target genes, as elaborated hereinbelow.

inositol (myo)-1(or 4)-monophosphatase 1 (IMPA1, Accession NM_005536) is a VGAM2616 host target gene. IMPA1 BINDING SITE is HOST TARGET binding site found in the 3' untranslated region of mRNA encoded by IMPA1, corresponding to a HOST TARGET binding site such as BINDING SITE I, BINDING SITE II or BINDING SITE III. Table 2 illustrates the complementarity of the nucleotide sequences of IMPA1 BINDING SITE, designated SEQ ID:12059, to the nucleotide sequence of VGAM2616 RNA, herein designated VGAM RNA, also designated SEQ ID:5327.

A function of VGAM2616 is therefore inhibition of inositol (myo)-1(or 4)-monophosphatase 1 (IMPA1, Accession NM_005536), a gene which is responsible for the provision of inositol required for synthesis of phosphatidylinositol and polyphosphoinositides. Accordingly, utilities of VGAM2616 include diagnosis, prevention and treatment of diseases and clinical conditions associated with IMPA1. The function of IMPA1 and its association with various diseases and clinical conditions, has been established by previous studies, as described hereinabove with reference to VGAM134. PHD Finger Protein 3 (PHF3, Accession NM_015153) is another VGAM2616 host target gene. PHF3 BINDING SITE is HOST TARGET binding site found in the 3' untranslated region of mRNA encoded by PHF3, corresponding to a HOST TARGET binding site such as BINDING SITE I, BINDING SITE II or BINDING SITE III. Table 2 illustrates the complementarity of the nucleotide sequences of PHF3 BINDING SITE, designated SEQ ID:17511, to the nucleotide sequence of VGAM2616 RNA, herein designated VGAM RNA, also designated SEQ ID:5327.

Another function of VGAM2616 is therefore inhibition of PHD Finger Protein 3 (PHF3, Accession NM_015153). Accordingly, utilities of VGAM2616 include diagnosis, prevention and treatment of diseases and clinical conditions associated with PHF3. Testis-specific Transcript, Y-linked 9 (TTTY9, Accession NM_031927) is another VGAM2616 host target gene. TTTY9 BINDING SITE is HOST TARGET binding site found in the 3' untranslated region of mRNA encoded by TTTY9, corresponding to a HOST TARGET binding site such as BINDING SITE I, BINDING SITE II or BINDING SITE III. Table 2 illustrates the complementarity of the nucleotide sequences of TTTY9 BINDING SITE, designated SEQ ID:25680, to the nucleotide sequence of VGAM2616 RNA, herein designated VGAM RNA, also designated SEQ ID:5327.

Another function of VGAM2616 is therefore inhibition of Testis-specific Transcript, Y-linked 9 (TTTY9, Accession NM_031927). Accordingly, utilities of VGAM2616 include diagnosis, prevention and treatment of diseases and clinical conditions associated with TTTY9. LOC124801 (Accession XM_058850) is another VGAM2616 host target gene. LOC124801 BINDING SITE is HOST TARGET binding site found in the 3' untranslated region of mRNA encoded by LOC124801, corresponding to a HOST TARGET binding site such as BINDING SITE I, BINDING SITE II or BINDING SITE III. Table 2 illustrates the complementarity of the nucleotide sequences of LOC124801 BINDING SITE, designated SEQ ID:36764, to the nucleotide sequence of VGAM2616 RNA, herein designated VGAM RNA, also designated SEQ ID:5327.

Another function of VGAM2616 is therefore inhibition of LOC124801 (Accession XM_058850). Accordingly, utilities of VGAM2616 include diagnosis, prevention and treatment of diseases and clinical conditions associated with LOC124801. FIG. 1 further provides a conceptual description of a novel bioinformatically detected viral gene of the present invention, referred to here as Viral Genomic Address Messenger 2617 (VGAM2617) viral gene, which modulates expression of respective host target genes thereof, the function and utility of which host target genes is known in the art.

VGAM2617 is a novel bioinformatically detected regulatory, non protein coding, viral micro RNA (miRNA) gene. The method by which VGAM2617 was detected is described hereinabove with reference to FIGS. 1-8.

VGAM2617 gene, herein designated VGAM GENE, is a viral gene contained in the genome of Equine Rhinitis B Virus. VGAM2617 host target gene, herein designated VGAM HOST TARGET GENE, is a human gene contained in the human genome.

VGAM2617 gene encodes a VGAM2617 precursor RNA, herein designated VGAM PRECURSOR RNA. Similar to other miRNA genes, and unlike most ordinary genes, VGAM2617 precursor RNA does not encode a protein. A nucleotide sequence identical or highly similar to the nucleotide sequence of VGAM2617 precursor RNA is designated SEQ ID:2603, and is provided hereinbelow with reference to the sequence listing part. Nucleotide sequence SEQ ID:2603 is located at position 8196 relative to the genome of Equine Rhinitis B Virus.

VGAM2617 precursor RNA folds onto itself, forming VGAM2617 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2617 folded precursor RNA into VGAM2617 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2617 RNA is designated SEQ ID:5328, and is provided hereinbelow with reference to the sequence listing part.

VGAM2617 host target gene, herein designated VGAM HOST TARGET GENE, encodes a corresponding messenger RNA, VGAM2617 host target RNA, herein designated VGAM HOST TARGET RNA. VGAM2617 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2617 RNA, herein designated VGAM RNA, binds complementarily to one or more host target binding sites located in untranslated regions of VGAM2617 host target RNA, herein designated VGAM HOST TARGET RNA. This complementary binding is due to the fact that the nucleotide sequence of VGAM2617 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2617 RNA, herein designated VGAM RNA, may have a different number of host target binding sites in untranslated regions of a VGAM2617 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2617 RNA, herein designated VGAM RNA, to host target binding sites on VGAM2617 host target RNA, herein designated VGAM HOST TARGET RNA, such as BINDING SITE I, BINDING SITE II and BINDING SITE III, inhibits translation of VGAM2617 host target RNA into VGAM2617 host target protein, herein designated VGAM HOST TARGET PROTEIN. VGAM host target protein is therefore outlined by a broken line.

It is appreciated that VGAM2617 host target gene, herein designated VGAM HOST TARGET GENE, in fact represents a plurality of VGAM2617 host target genes. The mRNA of each one of this plurality of VGAM2617 host target genes comprises one or more host target binding sites, each having a nucleotide sequence which is at least partly complementary to VGAM2617 RNA, herein designated VGAM RNA, and which when bound by VGAM2617 RNA causes inhibition of translation of respective one or more VGAM2617 host target proteins.

It is further appreciated by one skilled in the art that the mode of translational inhibition illustrated by FIG. 1 with specific reference to translational inhibition exerted by VGAM2617 gene, herein designated VGAM GENE, on one or more VGAM2617 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2617 is inhibition of expression of host target genes, as part of a novel viral mechanism of attacking a host. Accordingly, utilities of VGAM2617 include diagnosis, prevention and treatment of viral infection by Equine Rhinitis B Virus. Specific functions, and accordingly utilities, of VGAM2617 correlate with, and may be deduced from, the identity of the host target genes which VGAM2617 binds and inhibits, and the function of these host target genes, as elaborated hereinbelow.

Nucleotide sequences of the VGAM2617 precursor RNA, herein designated VGAM PRECURSOR RNA, and of the 'diced' VGAM2617 RNA, herein designated VGAM RNA, and a schematic representation of the secondary folding of VGAM2617 folded precursor RNA, herein designated VGAM FOLDED PRECURSOR RNA, of VGAM2617 are further described hereinbelow with reference to Table 1.

Nucleotide sequences of host target binding sites, such as BINDING SITE-I, BINDING SITE-II and BINDING SITE-III of FIG. 1, found on VGAM2617 host target RNA, and schematic representation of the complementarity of each of these host target binding sites to VGAM2617 RNA, herein designated VGAM RNA, are described hereinbelow with reference to Table 2.

As mentioned hereinabove with reference to FIG. 1, a function of VGAM2617 gene, herein designated VGAM is inhibition of expression of VGAM2617 target genes. It is appreciated that specific functions, and accordingly utilities, of VGAM2617 correlate with, and may be deduced from, the identity of the target genes which VGAM2617 binds and inhibits, and the function of these target genes, as elaborated hereinbelow.

Clathrin, Heavy Polypeptide-like 1 (CLTCL1, Accession XM_033096) is a VGAM2617 host target gene. CLTCL1 BINDING SITE is HOST TARGET binding site found in the 3' untranslated region of mRNA encoded by CLTCL1, corresponding to a HOST TARGET binding site such as BINDING SITE I, BINDING SITE II or BINDING SITE III. Table 2 illustrates the complementarity of the nucleotide sequences of CLTCL1 BINDING SITE, designated SEQ ID:31837, to the nucleotide sequence of VGAM2617 RNA, herein designated VGAM RNA, also designated SEQ ID:5328.

A function of VGAM2617 is therefore inhibition of Clathrin, Heavy Polypeptide-like 1 (CLTCL1, Accession XM_033096), a gene which is involved in vesicle budding. Accordingly, utilities of VGAM2617 include diagnosis, prevention and treatment of diseases and clinical conditions associated with CLTCL1. The function of CLTCL1 and its association with various diseases and clinical conditions, has been established by previous studies, as described hereinabove with reference to VGAM42. V-crk Sarcoma Virus CT10 Oncogene Homolog (avian)-like (CRKL, Accession NM_005207) is another VGAM2617 host target gene. CRKL BINDING SITE is HOST TARGET binding site found in the 5' untranslated region of mRNA encoded by CRKL, corresponding to a HOST TARGET binding site such as BINDING SITE I, BINDING SITE II or BINDING SITE III. Table 2 illustrates the complementarity of the nucleotide sequences of CRKL BINDING SITE, designated SEQ ID:11708, to the nucleotide sequence of VGAM2617 RNA, herein designated VGAM RNA, also designated SEQ ID:5328.

Another function of VGAM2617 is therefore inhibition of V-crk Sarcoma Virus CT10 Oncogene Homolog (avian)-like (CRKL, Accession NM_005207). Accordingly, utilities of VGAM2617 include diagnosis, prevention and treatment of diseases and clinical conditions associated with CRKL. 24-dehydrocholesterol Reductase (DHCR24, Accession NM_014762) is another VGAM2617 host target gene. DHCR24 BINDING SITE is HOST TARGET binding site found in the 3' untranslated region of mRNA encoded by DHCR24, corresponding to a HOST TARGET binding site such as BINDING SITE I, BINDING SITE II or BINDING SITE III. Table 2 illustrates the complementarity of the nucleotide sequences of DHCR24 BINDING SITE, designated SEQ ID:16527, to the nucleotide sequence of VGAM2617 RNA, herein designated VGAM RNA, also designated SEQ ID:5328.

Another function of VGAM2617 is therefore inhibition of 24-dehydrocholesterol Reductase (DHCR24, Accession NM_014762), a gene which catalyzes the reduction of sterol intermediates. Accordingly, utilities of VGAM2617 include diagnosis, prevention and treatment of diseases and clinical conditions associated with DHCR24. The function of DHCR24 and its association with various diseases and clinical conditions, has been established by previous studies, as described hereinabove with reference to VGAM235. Frizzled Homolog 4 (Drosophila) (FZD4, Accession NM_012193) is another VGAM2617 host target gene. FZD4 BINDING SITE is HOST TARGET binding site found in the 3' untranslated region of mRNA encoded by FZD4, corresponding to a HOST TARGET binding site such as BINDING SITE I, BINDING SITE II or BINDING SITE III. Table 2 illustrates the complementarity of the nucleotide sequences of FZD4 BINDING SITE, designated SEQ ID:14490, to the nucleotide sequence of VGAM2617 RNA, herein designated VGAM RNA, also designated SEQ ID:5328.

Another function of VGAM2617 is therefore inhibition of Frizzled Homolog 4 (Drosophila) (FZD4, Accession NM_012193), a gene which may function in cell polarity, cell fate specification and cancer; similar to frizzled receptor family, has seven transmembrane domains. Accordingly, utilities of VGAM2617 include diagnosis, prevention and treatment of diseases and clinical conditions associated with FZD4. The function of FZD4 and its association with various diseases and clinical conditions, has been established by previous studies, as described hereinabove with reference to VGAM309. SRY (sex determining region Y)-box 4 (SOX4, Accession NM_003107) is another VGAM2617 host target gene. SOX4 BINDING SITE is HOST TARGET binding site found in the 3' untranslated region of mRNA encoded by SOX4, corresponding to a HOST TARGET binding site such as BINDING SITE I, BINDING SITE II or BINDING SITE III. Table 2 illustrates the complementarity of the nucleotide sequences of SOX4 BINDING SITE, designated SEQ ID:9077, to the nucleotide sequence of VGAM2617 RNA, herein designated VGAM RNA, also designated SEQ ID:5328.

Another function of VGAM2617 is therefore inhibition of SRY (sex determining region Y)-box 4 (SOX4, Accession NM_003107), a gene which binds with high affinity to the t-cell enhancer motif 5'-aacaaag-3' motif. Accordingly, utilities of VGAM2617 include diagnosis, prevention and treatment of diseases and clinical conditions associated with SOX4. The function of SOX4 and its association with various diseases and clinical conditions, has been established by previous studies, as described hereinabove with reference to VGAM409. BDG-29 (Accession XM_051343) is another VGAM2617 host target gene. BDG-29 BINDING SITE is HOST TARGET binding site found in the 3' untranslated region of mRNA encoded by BDG-29, corresponding to a HOST TARGET binding site such as BINDING SITE I, BINDING SITE II or BINDING SITE III. Table 2 illustrates the complementarity of the nucleotide sequences of BDG-29 BINDING SITE, designated SEQ ID:35820, to the nucleotide sequence of VGAM2617 RNA, herein designated VGAM RNA, also designated SEQ ID:5328.

Another function of VGAM2617 is therefore inhibition of BDG-29 (Accession XM_051343). Accordingly, utilities of VGAM2617 include diagnosis, prevention and treatment of diseases and clinical conditions associated with BDG-29. FLJ21687 (Accession NM_024859) is another VGAM2617 host target gene. FLJ21687 BINDING SITE is HOST TARGET binding site found in the 3' untranslated region of mRNA encoded by FLJ21687, corresponding to a HOST TARGET binding site such as BINDING SITE I, BINDING SITE II or BINDING SITE III. Table 2 illustrates the complementarity of the nucleotide sequences of FLJ21687 BINDING SITE, designated SEQ ID:24291, to the nucleotide sequence of VGAM2617 RNA, herein designated VGAM RNA, also designated SEQ ID:5328.

Another function of VGAM2617 is therefore inhibition of FLJ21687 (Accession NM_024859). Accordingly, utilities of VGAM2617 include diagnosis, prevention and treatment of diseases and clinical conditions associated with FLJ21687. poly (rC) Binding Protein 4 (PCBP4, Accession NM_020418) is another VGAM2617 host target gene. PCBP4 BINDING SITE is HOST TARGET binding site found in the 5' untranslated region of mRNA encoded by PCBP4, corresponding to a HOST TARGET binding site such as BINDING SITE I, BINDING SITE II or BINDING SITE III. Table 2 illustrates the complementarity of the nucleotide sequences of PCBP4 BINDING SITE, designated SEQ ID:21678, to the nucleotide sequence of VGAM2617 RNA, herein designated VGAM RNA, also designated SEQ ID:5328.

Another function of VGAM2617 is therefore inhibition of poly (rC) Binding Protein 4 (PCBP4, Accession NM_020418). Accordingly, utilities of VGAM2617 include diagnosis, prevention and treatment of diseases and clinical conditions associated with PCBP4. PIF1 (Accession XM_027898) is another VGAM2617 host target gene. PIF1 BINDING SITE is HOST TARGET binding site found in the 3' untranslated region of mRNA encoded by PIF1, corresponding to a HOST TARGET binding site such as BINDING SITE I, BINDING SITE II or BINDING SITE III. Table 2 illustrates the complementarity of the nucleotide sequences of PIF1 BINDING SITE, designated SEQ ID:30588, to the nucleotide sequence of VGAM2617 RNA, herein designated VGAM RNA, also designated SEQ ID:5328.

Another function of VGAM2617 is therefore inhibition of PIF1 (Accession XM_027898). Accordingly, utilities of VGAM2617 include diagnosis, prevention and treatment of diseases and clinical conditions associated with PIF1. SHARP (Accession NM_015001) is another VGAM2617 host target gene. SHARP BINDING SITE is HOST TARGET binding site found in the 3' untranslated region of mRNA encoded by SHARP, corresponding to a HOST TARGET binding site such as BINDING SITE I, BINDING SITE II or BINDING SITE III. Table 2 illustrates the complementarity of the nucleotide sequences of SHARP BINDING SITE, designated SEQ ID:17369, to the nucleotide sequence of VGAM2617 RNA, herein designated VGAM RNA, also designated SEQ ID:5328.

Another function of VGAM2617 is therefore inhibition of SHARP (Accession NM_015001). Accordingly, utilities of VGAM2617 include diagnosis, prevention and treatment of diseases and clinical conditions associated with SHARP. LOC123096 (Accession XM_058679) is another VGAM2617 host target gene. LOC123096 BINDING SITE is HOST TARGET binding site found in the 3' untranslated region of mRNA encoded by LOC123096, corresponding to a HOST TARGET binding site such as BINDING SITE I, BINDING SITE II or BINDING SITE III. Table 2 illustrates the complementarity of the nucleotide sequences of LOC123096 BINDING SITE, designated SEQ ID:36722, to the nucleotide sequence of VGAM2617 RNA, herein designated VGAM RNA, also designated SEQ ID:5328.

Another function of VGAM2617 is therefore inhibition of LOC123096 (Accession XM_058679). Accordingly, utilities of VGAM2617 include diagnosis, prevention and treatment of diseases and clinical conditions associated with LOC123096. LOC155438 (Accession XM_098722) is another VGAM2617 host target gene. LOC155438 BINDING SITE is HOST TARGET binding site found in the 3' untranslated region of mRNA encoded by LOC155438, corresponding to a HOST TARGET binding site such as BINDING SITE I, BINDING SITE II or BINDING SITE III. Table 2 illustrates the complementarity of the nucleotide sequences of LOC155438 BINDING SITE, designated SEQ ID:41768, to the nucleotide sequence of VGAM2617 RNA, herein designated VGAM RNA, also designated SEQ ID:5328.

Another function of VGAM2617 is therefore inhibition of LOC155438 (Accession XM_098722). Accordingly, utilities of VGAM2617 include diagnosis, prevention and treatment of diseases and clinical conditions associated with LOC155438. LOC220110 (Accession XM_167882) is another VGAM2617 host target gene. LOC220110 BINDING SITE is HOST TARGET binding site found in the 5' untranslated region of mRNA encoded by LOC220110, corresponding to a HOST TARGET binding site such as BINDING SITE I, BINDING SITE II or BINDING SITE III. Table 2 illustrates the complementarity of the nucleotide sequences of LOC220110 BINDING SITE, designated SEQ ID:44895, to the nucleotide sequence of VGAM2617 RNA, herein designated VGAM RNA, also designated SEQ ID:5328.

Another function of VGAM2617 is therefore inhibition of LOC220110 (Accession XM_167882). Accordingly, utilities of VGAM2617 include diagnosis, prevention and treatment of diseases and clinical conditions associated with LOC220110. LOC254219 (Accession XM_172913) is another VGAM2617 host target gene. LOC254219 BINDING SITE is HOST TARGET binding site found in the 5' untranslated region of mRNA encoded by LOC254219, corresponding to a HOST TARGET binding site such as BINDING SITE I, BINDING SITE II or BINDING SITE III. Table 2 illustrates the complementarity of the nucleotide sequences of LOC254219 BINDING SITE, designated SEQ ID:46174, to the nucleotide sequence of VGAM2617 RNA, herein designated VGAM RNA, also designated SEQ ID:5328.

Another function of VGAM2617 is therefore inhibition of LOC254219 (Accession XM_172913). Accordingly, utilities of VGAM2617 include diagnosis, prevention and treatment of diseases and clinical conditions associated with LOC254219. FIG. 1 further provides a conceptual description of a novel bioinformatically detected viral gene of the present invention, referred to here as Viral Genomic Address Messenger 2618 (VGAM2618) viral gene, which modulates expression of respective host target genes thereof, the function and utility of which host target genes is known in the art.

VGAM2618 is a novel bioinformatically detected regulatory, non protein coding, viral micro RNA (miRNA) gene. The method by which VGAM2618 was detected is described hereinabove with reference to FIGS. 1-8.

VGAM2618 gene, herein designated VGAM GENE, is a viral gene contained in the genome of Equine Rhinitis B Virus. VGAM2618 host target gene, herein designated VGAM HOST TARGET GENE, is a human gene contained in the human genome.

VGAM2618 gene encodes a VGAM2618 precursor RNA, herein designated VGAM PRECURSOR RNA. Similar to other miRNA genes, and unlike most ordinary genes, VGAM2618 precursor RNA does not encode a protein. A nucleotide sequence identical or highly similar to the nucleotide sequence of VGAM2618 precursor RNA is designated SEQ ID:2604, and is provided hereinbelow with reference to the sequence listing part. Nucleotide sequence SEQ ID:2604 is located at position 6170 relative to the genome of Equine Rhinitis B Virus.

VGAM2618 precursor RNA folds onto itself, forming VGAM2618 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2618 folded precursor RNA into VGAM2618 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM2618 RNA is designated SEQ ID:5329, and is provided hereinbelow with reference to the sequence listing part.

VGAM2618 host target gene, herein designated VGAM HOST TARGET GENE, encodes a corresponding messenger RNA, VGAM2618 host target RNA, herein designated VGAM HOST TARGET RNA. VGAM2618 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2618 RNA, herein designated VGAM RNA, binds complementarily to one or more host target binding sites located in untranslated regions of VGAM2618 host target RNA, herein designated VGAM HOST TARGET RNA. This complementary binding is due to the fact that the nucleotide sequence of VGAM2618 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2618 RNA, herein designated VGAM RNA, may have a different number of host target binding sites in untranslated regions of a VGAM2618 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2618 RNA, herein designated VGAM RNA, to host target binding sites on VGAM2618 host target RNA, herein designated VGAM HOST TARGET RNA, such as BINDING SITE I, BINDING SITE II and BINDING SITE III, inhibits translation of VGAM2618 host target RNA into VGAM2618 host target protein, herein designated VGAM HOST TARGET PROTEIN. VGAM host target protein is therefore outlined by a broken line.

It is appreciated that VGAM2618 host target gene, herein designated VGAM HOST TARGET GENE, in fact represents a plurality of VGAM2618 host target genes. The mRNA of each one of this plurality of VGAM2618 host target genes comprises one or more host target binding sites, each having a nucleotide sequence which is at least partly complementary to VGAM2618 RNA, herein designated VGAM RNA, and which when bound by VGAM2618 RNA causes inhibition of translation of respective one or more VGAM2618 host target proteins.

It is further appreciated by one skilled in the art that the mode of translational inhibition illustrated by FIG. 1 with specific reference to translational inhibition exerted by VGAM2618 gene, herein designated VGAM GENE, on one or more VGAM2618 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2618 is inhibition of expression of host target genes, as part of a novel viral mechanism of attacking a host. Accordingly, utilities of VGAM2618 include diagnosis, prevention and treatment of viral infection by Equine Rhinitis B Virus. Specific functions, and accordingly utilities, of VGAM2618 correlate with, and may be deduced from, the identity of the host target genes which VGAM2618 binds and inhibits, and the function of these host target genes, as elaborated hereinbelow.

Nucleotide sequences of the VGAM2618 precursor RNA, herein designated VGAM PRECURSOR RNA, and of the 'diced' VGAM2618 RNA, herein designated VGAM RNA, and a schematic representation of the secondary folding of VGAM2618 folded precursor RNA, herein designated VGAM FOLDED PRECURSOR RNA, of VGAM2618 are further described hereinbelow with reference to Table 1.

Nucleotide sequences of host target binding sites, such as BINDING SITE-I, BINDING SITE-II and BINDING SITE-III of FIG. 1, found on VGAM2618 host target RNA, and schematic representation of the complementarity of each of these host target binding sites to VGAM2618 RNA, herein designated VGAM RNA, are described hereinbelow with reference to Table 2.

As mentioned hereinabove with reference to FIG. 1, a function of VGAM2618 gene, herein designated VGAM is inhibition of expression of VGAM2618 target genes. It is appreciated that specific functions, and accordingly utilities, of VGAM2618 correlate with, and may be deduced from, the identity of the target genes which VGAM2618 binds and inhibits, and the function of these target genes, as elaborated hereinbelow.

Dehydrogenase/reductase (SDR family) Member 2 (DHRS2, Accession NM_005794) is a VGAM2618 host target gene. DHRS2 BINDING SITE is HOST TARGET binding site found in the 5' untranslated region of mRNA encoded by DHRS2, corresponding to a HOST TARGET binding site such as BINDING SITE I, BINDING SITE II or BINDING SITE III. Table 2 illustrates the complementarity of the nucleotide sequences of DHRS2 BINDING SITE, designated SEQ ID:12374, to the nucleotide sequence of VGAM2618 RNA, herein designated VGAM RNA, also designated SEQ ID:5329.

A function of VGAM2618 is therefore inhibition of Dehydrogenase/reductase (SDR family) Member 2 (DHRS2, Accession NM_005794). Accordingly, utilities of VGAM2618 include diagnosis, prevention and treatment of diseases and clinical conditions associated with DHRS2. GREB1 (Accession XM_051545) is another VGAM2618 host target gene. GREB1 BINDING SITE is HOST TARGET binding site found in the 3' untranslated region of mRNA encoded by GREB1, corresponding to a HOST TARGET binding site such as BINDING SITE I, BINDING SITE II or BINDING SITE III. Table 2 illustrates the complementarity of the nucleotide sequences of GREB1 BINDING SITE, designated SEQ ID:35852, to the nucleotide sequence of VGAM2618 RNA, herein designated VGAM RNA, also designated SEQ ID:5329.

Another function of VGAM2618 is therefore inhibition of GREB1 (Accession XM_051545). Accordingly, utilities of VGAM2618 include diagnosis, prevention and treatment of diseases and clinical conditions associated with GREB1. KIAA0286 (Accession XM_043118) is another VGAM2618 host target gene. KIAA0286 BINDING SITE is HOST TARGET binding site found in the 3' untranslated region of mRNA encoded by KIAA0286, corresponding to a HOST TARGET binding site such as BINDING SITE I, BINDING SITE II or BINDING SITE III. Table 2 illustrates the complementarity of the nucleotide sequences of KIAA0286 BINDING SITE, designated SEQ ID:33905, to the nucleotide sequence of VGAM2618 RNA, herein designated VGAM RNA, also designated SEQ ID:5329.

Another function of VGAM2618 is therefore inhibition of KIAA0286 (Accession XM_043118). Accordingly, utilities of VGAM2618 include diagnosis, prevention and treatment of diseases and clinical conditions associated with KIAA0286. KIAA0565 (Accession XM_039912) is another VGAM2618 host target gene. KIAA0565 BINDING SITE is HOST TARGET binding site found in the 5' untranslated region of mRNA encoded by KIAA0565, corresponding to a HOST TARGET binding site such as BINDING SITE I, BINDING SITE II or BINDING SITE III. Table 2 illustrates the complementarity of the nucleotide sequences of KIAA0565 BINDING SITE, designated SEQ ID:33217, to the nucleotide sequence of VGAM2618 RNA, herein designated VGAM RNA, also designated SEQ ID:5329.

Another function of VGAM2618 is therefore inhibition of KIAA0565 (Accession XM_039912). Accordingly, utilities of VGAM2618 include diagnosis, prevention and treatment of diseases and clinical conditions associated with KIAA0565. PRO1600 (Accession NM_014095) is another VGAM2618 host target gene. PRO1600 BINDING SITE is HOST TARGET binding site found in the 3' untranslated region of mRNA encoded by PRO1600, corresponding to a HOST TARGET binding site such as BINDING SITE I, BINDING SITE II or BINDING SITE III. Table 2 illustrates the complementarity of the nucleotide sequences of PRO1600 BINDING SITE, designated SEQ ID:15314, to the nucleotide sequence of VGAM2618 RNA, herein designated VGAM RNA, also designated SEQ ID:5329.

Another function of VGAM2618 is therefore inhibition of PRO1600 (Accession NM_014095). Accordingly, utilities of VGAM2618 include diagnosis, prevention and treatment of diseases and clinical conditions associated with PRO1600. LOC148824 (Accession XM_097527) is another VGAM2618 host target gene. LOC148824 BINDING SITE is HOST TARGET binding site found in the 3' untranslated region of mRNA encoded by LOC148824, corresponding to a HOST TARGET binding site such as BINDING SITE I, BINDING SITE II or BINDING SITE III. Table 2 illustrates the complementarity of the nucleotide sequences of LOC148824 BINDING SITE, designated SEQ ID:40908, to the nucleotide sequence of VGAM2618 RNA, herein designated VGAM RNA, also designated SEQ ID:5329.

Another function of VGAM2618 is therefore inhibition of LOC148824 (Accession XM_097527). Accordingly, utilities of VGAM2618 include diagnosis, prevention and treatment of diseases and clinical conditions associated with LOC148824. LOC157292 (Accession XM_098740) is another VGAM2618 host target gene. LOC157292 BINDING SITE is HOST TARGET binding site found in the 3' untranslated region of mRNA encoded by LOC157292, corresponding to a HOST TARGET binding site such as BINDING SITE I, BINDING SITE II or BINDING SITE III. Table 2 illustrates the complementarity of the nucleotide sequences of LOC157292 BINDING SITE, designated SEQ ID:41775, to the nucleotide sequence of VGAM2618 RNA, herein designated VGAM RNA, also designated SEQ ID:5329.

Another function of VGAM2618 is therefore inhibition of LOC157292 (Accession XM_098740). Accordingly, utilities of VGAM2618 include diagnosis, prevention and treatment of diseases and clinical conditions associated with LOC157292. LOC157507 (Accession XM_088312) is another VGAM2618 host target gene. LOC157507 BINDING SITE is HOST TARGET binding site found in the 5' untranslated region of mRNA encoded by LOC157507, corresponding to a HOST TARGET binding site such as BINDING SITE I, BINDING SITE II or BINDING SITE III. Table 2 illustrates the complementarity of the nucleotide sequences of LOC157507 BINDING SITE, designated SEQ ID:39604, to the nucleotide sequence of VGAM2618 RNA, herein designated VGAM RNA, also designated SEQ ID:5329.

Another function of VGAM2618 is therefore inhibition of LOC157507 (Accession XM_088312). Accordingly, utilities of VGAM2618 include diagnosis, prevention and treatment of diseases and clinical conditions associated with LOC157507. LOC201287 (Accession XM_113947) is another VGAM2618 host target gene. LOC201287 BINDING SITE is HOST TARGET binding site found in the 5' untranslated region of mRNA encoded by LOC201287, corresponding to a HOST TARGET binding site such as BINDING SITE I, BINDING SITE II or BINDING SITE III. Table 2 illustrates the complementarity of the nucleotide sequences of LOC201287 BINDING SITE, designated SEQ ID:42560, to the nucleotide sequence of VGAM2618 RNA, herein designated VGAM RNA, also designated SEQ ID:5329.

Another function of VGAM2618 is therefore inhibition of LOC201287 (Accession XM_113947). Accordingly, utilities of VGAM2618 include diagnosis, prevention and treatment of diseases and clinical conditions associated with LOC201287. LOC254082 (Accession XM_173165) is another VGAM2618 host target gene. LOC254082 BINDING SITE is HOST TARGET binding site found in the 5' untranslated region of mRNA encoded by LOC254082, corresponding to a HOST TARGET binding site such as BINDING SITE I, BINDING SITE II or BINDING SITE III. Table 2 illustrates the complementarity of the nucleotide sequences of LOC254082 BINDING SITE, designated SEQ ID:46421, to the nucleotide sequence of VGAM2618 RNA, herein designated VGAM RNA, also designated SEQ ID:5329.

Another function of VGAM2618 is therefore inhibition of LOC254082 (Accession XM_173165). Accordingly, utilities of VGAM2618 include diagnosis, prevention and treatment of diseases and clinical conditions associated with LOC254082. LOC256207 (Accession XM_170837) is another VGAM2618 host target gene. LOC256207 BINDING SITE is HOST TARGET binding site found in the 5' untranslated region of mRNA encoded by LOC256207, corresponding to a HOST TARGET binding site such as BINDING SITE I, BINDING SITE II or BINDING SITE III. Table 2 illustrates the complementarity of the nucleotide sequences of LOC256207 BINDING SITE, designated SEQ ID:45618, to the nucleotide sequence of VGAM2618 RNA, herein designated VGAM RNA, also designated SEQ ID:5329.

Another function of VGAM2618 is therefore inhibition of LOC256207 (Accession XM_170837). Accordingly, utilities of VGAM2618 include diagnosis, prevention and treatment of diseases and clinical conditions associated with LOC256207. FIG. 1 further provides a conceptual description of a novel bioinformatically detected viral gene of the present invention, referred to here as Viral Genomic Address Messenger 2619 (VGAM2619) viral gene, which modulates expression of respective host target genes thereof, the function and utility of which host target genes is known in the art.

VGAM2619 is a novel bioinformatically detected regulatory, non protein coding, viral micro RNA (miRNA) gene. The method by which VGAM2619 was detected is described hereinabove with reference to FIGS. 1-8.

VGAM2619 gene, herein designated VGAM GENE, is a viral gene contained in the genome of Equine Rhinitis B Virus. VGAM2619 host target gene, herein designated VGAM HOST TARGET GENE, is a human gene contained in the human genome.

VGAM2619 gene encodes a VGAM2619 precursor RNA, herein designated VGAM PRECURSOR RNA. Similar to other miRNA genes, and unlike most ordinary genes, VGAM2619 precursor RNA does not encode a protein. A nucleotide sequence identical or highly similar to the nucleotide sequence of VGAM2619 precursor RNA is designated SEQ ID:2605, and is provided hereinbelow with reference to the sequence listing part. Nucleotide sequence SEQ ID:2605 is located at position 4452 relative to the genome of Equine Rhinitis B Virus.

VGAM2619 precursor RNA folds onto itself, forming VGAM2619 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2619 folded precursor RNA into VGAM2619 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2619 RNA is designated SEQ ID:5330, and is provided hereinbelow with reference to the sequence listing part.

VGAM2619 host target gene, herein designated VGAM HOST TARGET GENE, encodes a corresponding messenger RNA, VGAM2619 host target RNA, herein designated VGAM HOST TARGET RNA. VGAM2619 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2619 RNA, herein designated VGAM RNA, binds complementarily to one or more host target binding sites located in untranslated regions of VGAM2619 host target RNA, herein designated VGAM HOST TARGET RNA. This complementary binding is due to the fact that the nucleotide sequence of VGAM2619 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2619 RNA, herein designated VGAM RNA, may have a different number of host target binding sites in untranslated regions of a VGAM2619 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2619 RNA, herein designated VGAM RNA, to host target binding sites on VGAM2619 host target RNA, herein designated VGAM HOST TARGET RNA, such as BINDING SITE I, BINDING SITE II and BINDING SITE III, inhibits translation of VGAM2619 host target RNA into VGAM2619 host target protein, herein designated VGAM HOST TARGET PROTEIN. VGAM host target protein is therefore outlined by a broken line.

It is appreciated that VGAM2619 host target gene, herein designated VGAM HOST TARGET GENE, in fact represents a plurality of VGAM2619 host target genes. The mRNA of each one of this plurality of VGAM2619 host target genes comprises one or more host target binding sites, each having a nucleotide sequence which is at least partly complementary to VGAM2619 RNA, herein designated VGAM RNA, and which when bound by VGAM2619 RNA causes inhibition of translation of respective one or more VGAM2619 host target proteins.

It is further appreciated by one skilled in the art that the mode of translational inhibition illustrated by FIG. 1 with specific reference to translational inhibition exerted by VGAM2619 gene, herein designated VGAM GENE, on one or more VGAM2619 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2619 is inhibition of expression of host target genes, as part of a novel viral mechanism of attacking a host. Accordingly, utilities of VGAM2619 include diagnosis, prevention and treatment of viral infection by Equine Rhinitis B Virus. Specific functions, and accordingly utilities, of VGAM2619 correlate with, and may be deduced from, the identity of the host target genes which VGAM2619 binds and inhibits, and the function of these host target genes, as elaborated hereinbelow.

Nucleotide sequences of the VGAM2619 precursor RNA, herein designated VGAM PRECURSOR RNA, and of the 'diced' VGAM2619 RNA, herein designated VGAM RNA, and a schematic representation of the secondary folding of VGAM2619 folded precursor RNA, herein designated VGAM FOLDED PRECURSOR RNA, of VGAM2619 are further described hereinbelow with reference to Table 1.

Nucleotide sequences of host target binding sites, such as BINDING SITE-I, BINDING SITE-II and BINDING SITE-III of FIG. 1, found on VGAM2619 host target RNA, and schematic representation of the complementarity of each of these host target binding sites to VGAM2619 RNA, herein designated VGAM RNA, are described hereinbelow with reference to Table 2.

As mentioned hereinabove with reference to FIG. 1, a function of VGAM2619 gene, herein designated VGAM is inhibition of expression of VGAM2619 target genes. It is appreciated that specific functions, and accordingly utilities, of VGAM2619 correlate with, and may be deduced from, the identity of the target genes which VGAM2619 binds and inhibits, and the function of these target genes, as elaborated hereinbelow.

NKX3A (Accession NM_006167) is a VGAM2619 host target gene. NKX3A BINDING SITE is HOST TARGET binding site found in the 3' untranslated region of mRNA encoded by NKX3A, corresponding to a HOST TARGET binding site such as BINDING SITE I, BINDING SITE II or BINDING SITE III. Table 2 illustrates the complementarity of the nucleotide sequences of NKX3A BINDING SITE, designated SEQ ID:12825, to the nucleotide sequence of VGAM2619 RNA, herein designated VGAM RNA, also designated SEQ ID:5330.

A function of VGAM2619 is therefore inhibition of NKX3A (Accession NM_006167), a gene which may regulate gene expression and control cell differentiation. Accordingly, utilities of VGAM2619 include diagnosis, prevention and treatment of diseases and clinical conditions associated with NKX3A. The function of NKX3A and its association with various diseases and clinical conditions, has been established by previous studies, as described hereinabove with reference to VGAM481. Wolf-Hirschhorn Syndrome Candidate 1 (WHSC1, Accession NM_133336) is another VGAM2619 host target gene. WHSC1 BINDING SITE is HOST TARGET binding site found in the 5' untranslated region of mRNA encoded by WHSC1, corresponding to a HOST TARGET binding site such as BINDING SITE I, BINDING SITE II or BINDING SITE III. Table 2 illustrates the complementarity of the nucleotide sequences of WHSC1 BINDING SITE, designated SEQ ID:28478, to the nucleotide sequence of VGAM2619 RNA, herein designated VGAM RNA, also designated SEQ ID:5330.

Another function of VGAM2619 is therefore inhibition of Wolf-Hirschhorn Syndrome Candidate 1 (WHSC1, Accession NM_133336), a gene which binds covalently to and repairs g/t mismatches. Accordingly, utilities of VGAM2619 include diagnosis, prevention and treatment of diseases and clinical conditions associated with WHSC1. The function of WHSC1 and its association with various diseases and clinical conditions, has been established by previous studies, as described hereinabove with reference to VGAM200. DKFZP564K1964 (Accession NM_015544) is another VGAM2619 host target gene. DKFZP564K1964 BINDING SITE is HOST TARGET binding site found in the 3' untranslated region of mRNA encoded by DKFZP564K1964, corresponding to a HOST TARGET binding site such as BINDING SITE I, BINDING SITE II or BINDING SITE III. Table 2 illustrates the complementarity of the nucleotide sequences of DKFZP564K1964 BINDING SITE, designated SEQ ID:17805, to the nucleotide sequence of VGAM2619 RNA, herein designated VGAM RNA, also designated SEQ ID:5330.

Another function of VGAM2619 is therefore inhibition of DKFZP564K1964 (Accession NM_015544). Accordingly, utilities of VGAM2619 include diagnosis, prevention and treatment of diseases and clinical conditions associated with DKFZP564K1964. P114-RHO-GEF (Accession NM_015318) is another VGAM2619 host target gene. P114-RHO-GEF BINDING SITE is HOST TARGET binding site found in the 3' untranslated region of mRNA encoded by P114-RHO-GEF, corresponding to a HOST TARGET binding site such as BINDING SITE I, BINDING SITE II or BINDING SITE III. Table 2 illustrates the complementarity of the nucleotide sequences of P114-RHO-GEF BINDING SITE, designated SEQ ID:17636, to the nucleotide sequence of VGAM2619 RNA, herein designated VGAM RNA, also designated SEQ ID:5330.

Another function of VGAM2619 is therefore inhibition of P114-RHO-GEF (Accession NM_015318). Accordingly, utilities of VGAM2619 include diagnosis, prevention and treatment of diseases and clinical conditions associated with P114-RHO-GEF. LOC221042 (Accession XM_167669) is another VGAM2619 host target gene. LOC221042 BINDING SITE is HOST TARGET binding site found in the 5' untranslated region of mRNA encoded by LOC221042, corresponding to a HOST TARGET binding site such as BINDING SITE I, BINDING SITE II or BINDING SITE III. Table 2 illustrates the complementarity of the nucleotide sequences of LOC221042 BINDING SITE, designated SEQ ID:44750, to the nucleotide sequence of VGAM2619 RNA, herein designated VGAM RNA, also designated SEQ ID:5330.

Another function of VGAM2619 is therefore inhibition of LOC221042 (Accession XM_167669). Accordingly, utilities of VGAM2619 include diagnosis, prevention and treatment of diseases and clinical conditions associated with LOC221042. FIG. 1 further provides a conceptual description of a novel bioinformatically detected viral gene of the present invention, referred to here as Viral Genomic Address Messenger 2620 (VGAM2620) viral gene, which modulates expression of respective host target genes thereof, the function and utility of which host target genes is known in the art.

VGAM2620 is a novel bioinformatically detected regulatory, non protein coding, viral micro RNA (miRNA) gene. The method by which VGAM2620 was detected is described hereinabove with reference to FIGS. 1-8.

VGAM2620 gene, herein designated VGAM GENE, is a viral gene contained in the genome of Porcine Enterovirus A (PEV8). VGAM2620 host target gene, herein designated VGAM HOST TARGET GENE, is a human gene contained in the human genome.

VGAM2620 gene encodes a VGAM2620 precursor RNA, herein designated VGAM PRECURSOR RNA. Similar to other miRNA genes, and unlike most ordinary genes, VGAM2620 precursor RNA does not encode a protein. A nucleotide sequence identical or highly similar to the nucleotide sequence of VGAM2620 precursor RNA is designated SEQ ID:2606, and is provided hereinbelow with reference to the sequence listing part. Nucleotide sequence SEQ ID:2606 is located at position 2601 relative to the genome of Porcine Enterovirus A (PEV8).

VGAM2620 precursor RNA folds onto itself, forming VGAM2620 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2620 folded precursor RNA into VGAM2620 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM2620 RNA is designated SEQ ID:5331, and is provided hereinbelow with reference to the sequence listing part.

VGAM2620 host target gene, herein designated VGAM HOST TARGET GENE, encodes a corresponding messenger RNA, VGAM2620 host target RNA, herein designated VGAM HOST TARGET RNA. VGAM2620 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2620 RNA, herein designated VGAM RNA, binds complementarily to one or more host target binding sites located in untranslated regions of VGAM2620 host target RNA, herein designated VGAM HOST TARGET RNA. This complementary binding is due to the fact that the nucleotide sequence of VGAM2620 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2620 RNA, herein designated VGAM RNA, may have a different number of host target binding sites in untranslated regions of a VGAM2620 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2620 RNA, herein designated VGAM RNA, to host target binding sites on VGAM2620 host target RNA, herein designated VGAM HOST TARGET RNA, such as BINDING SITE I, BINDING SITE II and BINDING SITE III, inhibits translation of VGAM2620 host target RNA into VGAM2620 host target protein, herein designated VGAM HOST TARGET PROTEIN. VGAM host target protein is therefore outlined by a broken line.

It is appreciated that VGAM2620 host target gene, herein designated VGAM HOST TARGET GENE, in fact represents a plurality of VGAM2620 host target genes. The mRNA of each one of this plurality of VGAM2620 host target genes comprises one or more host target binding sites, each having a nucleotide sequence which is at least partly complementary to VGAM2620 RNA, herein designated VGAM RNA, and which when bound by VGAM2620 RNA causes inhibition of translation of respective one or more VGAM2620 host target proteins.

It is further appreciated by one skilled in the art that the mode of translational inhibition illustrated by FIG. 1 with specific reference to translational inhibition exerted by VGAM2620 gene, herein designated VGAM GENE, on one or more VGAM2620 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2620 is inhibition of expression of host target genes, as part of a novel viral mechanism of attacking a host. Accordingly, utilities of VGAM2620 include diagnosis, prevention and treatment of viral infection by Porcine Enterovirus A (PEV8). Specific functions, and accordingly utilities, of VGAM2620 correlate with, and may be deduced from, the identity of the host target genes which VGAM2620 binds and inhibits, and the function of these host target genes, as elaborated hereinbelow.

Nucleotide sequences of the VGAM2620 precursor RNA, herein designated VGAM PRECURSOR RNA, and of the 'diced' VGAM2620 RNA, herein designated VGAM RNA, and a schematic representation of the secondary folding of VGAM2620 folded precursor RNA, herein designated VGAM FOLDED PRECURSOR RNA, of VGAM2620 are further described hereinbelow with reference to Table 1.

Nucleotide sequences of host target binding sites, such as BINDING SITE-I, BINDING SITE-II and BINDING SITE-III of FIG. 1, found on VGAM2620 host target RNA, and schematic representation of the complementarity of each of these host target binding sites to VGAM2620 RNA, herein designated VGAM RNA, are described hereinbelow with reference to Table 2.

As mentioned hereinabove with reference to FIG. 1, a function of VGAM2620 gene, herein designated VGAM is inhibition of expression of VGAM2620 target genes. It is appreciated that specific functions, and accordingly utilities, of VGAM2620 correlate with, and may be deduced from, the identity of the target genes which VGAM2620 binds and inhibits, and the function of these target genes, as elaborated hereinbelow.

CDC7 Cell Division Cycle 7-like 1 (S. cerevisiae) (CDC7L1, Accession NM_003503) is a VGAM2620 host target gene. CDC7L1 BINDING SITE is HOST TARGET binding site found in the 3' untranslated region of mRNA encoded by CDC7L1, corresponding to a HOST TARGET binding site such as BINDING SITE I, BINDING SITE II or BINDING SITE III. Table 2 illustrates the complementarity of the nucleotide sequences of CDC7L1 BINDING SITE, designated SEQ ID:9591, to the nucleotide sequence of VGAM2620 RNA, herein designated VGAM RNA, also designated SEQ ID:5331.

A function of VGAM2620 is therefore inhibition of CDC7 Cell Division Cycle 7-like 1 (S. cerevisiae) (CDC7L1, Accession NM_003503), a gene which may phosphorylate critical substrates that regulate the G1/S phase transition and/or DNA replication in mammalian cells. Accordingly, utilities of VGAM2620 include diagnosis, prevention and treatment of diseases and clinical conditions associated with CDC7L1. The function of CDC7L1 and its association with various diseases and clinical conditions, has been established by previous studies, as described hereinabove with reference to VGAM1431. Olfactomedin 1 (OLFM1, Accession NM_014279) is another VGAM2620 host target gene. OLFM1 BINDING SITE is HOST TARGET binding site found in the 3' untranslated region of mRNA encoded by OLFM1, corresponding to a HOST TARGET binding site such as BINDING SITE I, BINDING SITE II or BINDING SITE III. Table 2 illustrates the complementarity of the nucleotide sequences of OLFM1 BINDING SITE, designated SEQ ID:15557, to the nucleotide sequence of VGAM2620 RNA, herein designated VGAM RNA, also designated SEQ ID:5331.

Another function of VGAM2620 is therefore inhibition of Olfactomedin 1 (OLFM1, Accession NM_014279). Accordingly, utilities of VGAM2620 include diagnosis, prevention and treatment of diseases and clinical conditions associated with OLFM1. Phosphatidylinositol Glycan, Class A (paroxysmal nocturnal hemoglobinuria) (PIGA, Accession NM_002641) is another VGAM2620 host target gene. PIGA BINDING SITE1 through PIGA BINDING SITE3 are HOST TARGET binding sites found in untranslated regions of mRNA encoded by PIGA, corresponding to HOST TARGET binding sites such as BINDING SITE I, BINDING SITE II or BINDING SITE III. Table 2 illustrates the complementarity of the nucleotide sequences of PIGA BINDING SITE1 through PIGA BINDING SITE3, designated SEQ ID:8498, SEQ ID:21711 and SEQ ID:21718 respectively, to the nucleotide sequence of VGAM2620 RNA, herein designated VGAM RNA, also designated SEQ ID:5331.

Another function of VGAM2620 is therefore inhibition of Phosphatidylinositol Glycan, Class A (paroxysmal nocturnal hemoglobinuria) (PIGA, Accession NM_002641). Accordingly, utilities of VGAM2620 include diagnosis, prevention and treatment of diseases and clinical conditions associated with PIGA. FLJ14621 (Accession NM_032811) is another VGAM2620 host target gene. FLJ14621 BINDING SITE is HOST TARGET binding site found in the 3' untranslated region of mRNA encoded by FLJ14621, corresponding to a HOST TARGET binding site such as BINDING SITE I, BINDING SITE II or BINDING SITE III. Table 2 illustrates the complementarity of the nucleotide sequences of FLJ14621 BINDING SITE, designated SEQ ID:26582, to the nucleotide sequence of VGAM2620 RNA, herein designated VGAM RNA, also designated SEQ ID:5331.

Another function of VGAM2620 is therefore inhibition of FLJ14621 (Accession NM_032811). Accordingly, utilities of VGAM2620 include diagnosis, prevention and treatment of diseases and clinical conditions associated with FLJ14621. KIAA1033 (Accession XM_035313) is another VGAM2620 host target gene. KIAA1033 BINDING SITE is HOST TARGET binding site found in the 3' untranslated region of mRNA encoded by KIAA1033, corresponding to a HOST TARGET binding site such as BINDING SITE I, BINDING SITE II or BINDING SITE III. Table 2 illustrates the complementarity of the nucleotide sequences of KIAA1033 BINDING SITE, designated SEQ ID:32229, to the nucleotide sequence of VGAM2620 RNA, herein designated VGAM RNA, also designated SEQ ID:5331.

Another function of VGAM2620 is therefore inhibition of KIAA1033 (Accession XM_035313). Accordingly, utilities of VGAM2620 include diagnosis, prevention and treatment of diseases and clinical conditions associated with KIAA1033. KIAA1128 (Accession XM_043596) is another VGAM2620 host target gene. KIAA1128 BINDING SITE is HOST TARGET binding site found in the 3' untranslated region of mRNA encoded by KIAA1128, corresponding to a HOST TARGET binding site such as BINDING SITE I, BINDING SITE II or BINDING SITE III. Table 2 illustrates the complementarity of the nucleotide sequences of KIAA1128 BINDING SITE, designated SEQ ID:33967, to the nucleotide sequence of VGAM2620 RNA, herein designated VGAM RNA, also designated SEQ ID:5331.

Another function of VGAM2620 is therefore inhibition of KIAA1128 (Accession XM_043596). Accordingly, utilities of VGAM2620 include diagnosis, prevention and treatment of diseases and clinical conditions associated with KIAA1128. MGC5590 (Accession NM_024058) is another VGAM2620 host target gene. MGC5590 BINDING SITE is HOST TARGET binding site found in the 3' untranslated region of mRNA encoded by MGC5590, corresponding to a HOST TARGET binding site such as BINDING SITE I, BINDING SITE II or BINDING SITE III. Table 2 illustrates the complementarity of the nucleotide sequences of MGC5590 BINDING SITE, designated SEQ ID:23495, to the nucleotide sequence of VGAM2620 RNA, herein designated VGAM RNA, also designated SEQ ID:5331.

Another function of VGAM2620 is therefore inhibition of MGC5590 (Accession NM_024058). Accordingly, utilities of VGAM2620 include diagnosis, prevention and treatment of diseases and clinical conditions associated with MGC5590. Phosphodiesterase 10A (PDE10A, Accession NM_006661) is another VGAM2620 host target gene. PDE10A BINDING SITE is HOST TARGET binding site found in the 3' untranslated region of mRNA encoded by PDE10A, corresponding to a HOST TARGET binding site such as BINDING SITE I, BINDING SITE II or BINDING SITE III. Table 2 illustrates the complementarity of the nucleotide sequences of PDE10A BINDING SITE, designated SEQ ID:13463, to the nucleotide sequence of VGAM2620 RNA, herein designated VGAM RNA, also designated SEQ ID:5331.

Another function of VGAM2620 is therefore inhibition of Phosphodiesterase 10A (PDE10A, Accession NM_006661). Accordingly, utilities of VGAM2620 include diagnosis, prevention and treatment of diseases and clinical conditions associated with PDE10A. Tripartite Motif-containing 2 (TRIM2, Accession NM_015271) is another VGAM2620 host target gene. TRIM2 BINDING SITE is HOST TARGET binding site found in the 3' untranslated region of mRNA encoded by TRIM2, corresponding to a HOST TARGET binding site such as BINDING SITE I, BINDING SITE II or BINDING SITE III. Table 2 illustrates the complementarity of the nucleotide sequences of TRIM2 BINDING SITE, designated SEQ ID:17597, to the nucleotide sequence of VGAM2620 RNA, herein designated VGAM RNA, also designated SEQ ID:5331.

Another function of VGAM2620 is therefore inhibition of Tripartite Motif-containing 2 (TRIM2, Accession NM_015271). Accordingly, utilities of VGAM2620 include diagnosis, prevention and treatment of diseases and clinical conditions associated with TRIM2. LOC146159 (Accession XM_085344) is another VGAM2620 host target gene. LOC146159 BINDING SITE is HOST TARGET binding site found in the 5' untranslated region of mRNA encoded by LOC146159, corresponding to a HOST TARGET binding site such as BINDING SITE I, BINDING SITE II or BINDING SITE III. Table 2 illustrates the complementarity of the nucleotide sequences of LOC146159 BINDING SITE, designated SEQ ID:38075, to the nucleotide sequence of VGAM2620 RNA, herein designated VGAM RNA, also designated SEQ ID:5331.

Another function of VGAM2620 is therefore inhibition of LOC146159 (Accession XM_085344). Accordingly, utilities of VGAM2620 include diagnosis, prevention and treatment of diseases and clinical conditions associated with LOC146159. LOC152559 (Accession XM_087487) is another VGAM2620 host target gene. LOC152559 BINDING SITE is HOST TARGET binding site found in the 3' untranslated region of mRNA encoded by LOC152559, corresponding to a HOST TARGET binding site such as BINDING SITE I, BINDING SITE II or BINDING SITE III. Table 2 illustrates the complementarity of the nucleotide sequences of LOC152559 BINDING SITE, designated SEQ ID:39282, to the nucleotide sequence of VGAM2620 RNA, herein designated VGAM RNA, also designated SEQ ID:5331.

Another function of VGAM2620 is therefore inhibition of LOC152559 (Accession XM_087487). Accordingly, utilities of VGAM2620 include diagnosis, prevention and treatment of diseases and clinical conditions associated with LOC152559. FIG. 1 further provides a conceptual description of a novel bioinformatically detected viral gene of the present invention, referred to here as Viral Genomic Address Messenger 2621 (VGAM2621) viral gene, which modulates expression of respective host target genes thereof, the function and utility of which host target genes is known in the art.

VGAM2621 is a novel bioinformatically detected regulatory, non protein coding, viral micro RNA (miRNA) gene. The method by which VGAM2621 was detected is described hereinabove with reference to FIGS. 1-8.

VGAM2621 gene, herein designated VGAM GENE, is a viral gene contained in the genome of Porcine Enterovirus A (PEV8). VGAM2621 host target gene, herein designated VGAM HOST TARGET GENE, is a human gene contained in the human genome.

VGAM2621 gene encodes a VGAM2621 precursor RNA, herein designated VGAM PRECURSOR RNA. Similar to other miRNA genes, and unlike most ordinary genes, VGAM2621 precursor RNA does not encode a protein. A nucleotide sequence identical or highly similar to the nucleotide sequence of VGAM2621 precursor RNA is designated SEQ ID:2607, and is provided hereinbelow with reference to the sequence listing part. Nucleotide sequence SEQ ID:2607 is located at position 6168 relative to the genome of Porcine Enterovirus A (PEV8).

VGAM2621 precursor RNA folds onto itself, forming VGAM2621 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2621 folded precursor RNA into VGAM2621 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 42%) nucleotide sequence of VGAM2621 RNA is designated SEQ ID:5332, and is provided hereinbelow with reference to the sequence listing part.

VGAM2621 host target gene, herein designated VGAM HOST TARGET GENE, encodes a corresponding messenger RNA, VGAM2621 host target RNA, herein designated VGAM HOST TARGET RNA. VGAM2621 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2621 RNA, herein designated VGAM RNA, binds complementarily to one or more host target binding sites located in untranslated regions of VGAM2621 host target RNA, herein designated VGAM HOST TARGET RNA. This complementary binding is due to the fact that the nucleotide sequence of VGAM2621 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2621 RNA, herein designated VGAM RNA, may have a different number of host target binding sites in untranslated regions of a VGAM2621 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2621 RNA, herein designated VGAM RNA, to host target binding sites on VGAM2621 host target RNA, herein designated VGAM HOST TARGET RNA, such as BINDING SITE I, BINDING SITE II and BINDING SITE III, inhibits translation of VGAM2621 host target RNA into VGAM2621 host target protein, herein designated VGAM HOST TARGET PROTEIN. VGAM host target protein is therefore outlined by a broken line.

It is appreciated that VGAM2621 host target gene, herein designated VGAM HOST TARGET GENE, in fact represents a plurality of VGAM2621 host target genes. The mRNA of each one of this plurality of VGAM2621 host target genes comprises one or more host target binding sites, each having a nucleotide sequence which is at least partly complementary to VGAM2621 RNA, herein designated VGAM RNA, and which when bound by VGAM2621 RNA causes inhibition of translation of respective one or more VGAM2621 host target proteins.

It is further appreciated by one skilled in the art that the mode of translational inhibition illustrated by FIG. 1 with specific reference to translational inhibition exerted by VGAM2621 gene, herein designated VGAM GENE, on one or more VGAM2621 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2621 is inhibition of expression of host target genes, as part of a novel viral mechanism of attacking a host. Accordingly, utilities of VGAM2621 include diagnosis, prevention and treatment of viral infection by Porcine Enterovirus A (PEV8). Specific functions, and accordingly utilities, of VGAM2621 correlate with, and may be deduced from, the identity of the host target genes which VGAM2621 binds and inhibits, and the function of these host target genes, as elaborated hereinbelow.

Nucleotide sequences of the VGAM2621 precursor RNA, herein designated VGAM PRECURSOR RNA, and of the 'diced' VGAM2621 RNA, herein designated VGAM RNA, and a schematic representation of the secondary folding of VGAM2621 folded precursor RNA, herein designated VGAM FOLDED PRECURSOR RNA, of VGAM2621 are further described hereinbelow with reference to Table 1.

Nucleotide sequences of host target binding sites, such as BINDING SITE-I, BINDING SITE-II and BINDING SITE-III of FIG. 1, found on VGAM2621 host target RNA, and schematic representation of the complementarity of each of these host target binding sites to VGAM2621 RNA, herein designated VGAM RNA, are described hereinbelow with reference to Table 2.

As mentioned hereinabove with reference to FIG. 1, a function of VGAM2621 gene, herein designated VGAM is inhibition of expression of VGAM2621 target genes. It is appreciated that specific functions, and accordingly utilities, of VGAM2621 correlate with, and may be deduced from, the identity of the target genes which VGAM2621 binds and inhibits, and the function of these target genes, as elaborated hereinbelow.

KIAA0884 (Accession XM_046660) is a VGAM2621 host target gene. KIAA0884 BINDING SITE is HOST TARGET binding site found in the 5' untranslated region of mRNA encoded by KIAA0884, corresponding to a HOST TARGET binding site such as BINDING SITE I, BINDING SITE II or BINDING SITE III. Table 2 illustrates the complementarity of the nucleotide sequences of KIAA0884 BINDING SITE, designated SEQ ID:34770, to the nucleotide sequence of VGAM2621 RNA, herein designated VGAM RNA, also designated SEQ ID:5332.

A function of VGAM2621 is therefore inhibition of KIAA0884 (Accession XM_046660). Accordingly, utilities of VGAM2621 include diagnosis, prevention and treatment of diseases and clinical conditions associated with KIAA0884. LOC130507 (Accession XM_059440) is another VGAM2621 host target gene. LOC130507 BINDING SITE is HOST TARGET binding site found in the 3' untranslated region of mRNA encoded by LOC130507, corresponding to a HOST TARGET binding site such as BINDING SITE I, BINDING SITE II or BINDING SITE III. Table 2 illustrates the complementarity of the nucleotide sequences of LOC130507 BINDING SITE, designated SEQ ID:36995, to the nucleotide sequence of VGAM2621 RNA, herein designated VGAM RNA, also designated SEQ ID:5332.

Another function of VGAM2621 is therefore inhibition of LOC130507 (Accession XM_059440). Accordingly, utilities of VGAM2621 include diagnosis, prevention and treatment of diseases and clinical conditions associated with LOC130507. LOC221710 (Accession XM_166471) is another VGAM2621 host target gene. LOC221710 BINDING SITE is HOST TARGET binding site found in the 5' untranslated region of mRNA encoded by LOC221710, corresponding to a HOST TARGET binding site such as BINDING SITE I, BINDING SITE II or BINDING SITE III. Table 2 illustrates the complementarity of the nucleotide sequences of LOC221710 BINDING SITE, designated SEQ ID:44395, to the nucleotide sequence of VGAM2621 RNA, herein designated VGAM RNA, also designated SEQ ID:5332.

Another function of VGAM2621 is therefore inhibition of LOC221710 (Accession XM_166471). Accordingly, utilities of VGAM2621 include diagnosis, prevention and treatment of diseases and clinical conditions associated with LOC221710. FIG. 1 further provides a conceptual description of a novel bioinformatically detected viral gene of the present invention, referred to here as Viral Genomic Address Messenger 2622 (VGAM2622) viral gene, which modulates expression of respective host target genes thereof, the function and utility of which host target genes is known in the art.

VGAM2622 is a novel bioinformatically detected regulatory, non protein coding, viral micro RNA (miRNA) gene. The method by which VGAM2622 was detected is described hereinabove with reference to FIGS. 1-8.

VGAM2622 gene, herein designated VGAM GENE, is a viral gene contained in the genome of Porcine Enterovirus A (PEV8). VGAM2622 host target gene, herein designated VGAM HOST TARGET GENE, is a human gene contained in the human genome.

VGAM2622 gene encodes a VGAM2622 precursor RNA, herein designated VGAM PRECURSOR RNA. Similar to other miRNA genes, and unlike most ordinary genes, VGAM2622 precursor RNA does not encode a protein. A nucleotide sequence identical or highly similar to the nucleotide sequence of VGAM2622 precursor RNA is designated SEQ ID:2608, and is provided hereinbelow with reference to the sequence listing part. Nucleotide sequence SEQ ID:2608 is located at position 3608 relative to the genome of Porcine Enterovirus A (PEV8).

VGAM2622 precursor RNA folds onto itself, forming VGAM2622 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2622 folded precursor RNA into VGAM2622 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2622 RNA is designated SEQ ID:5333, and is provided hereinbelow with reference to the sequence listing part.

VGAM2622 host target gene, herein designated VGAM HOST TARGET GENE, encodes a corresponding messenger RNA, VGAM2622 host target RNA, herein designated VGAM HOST TARGET RNA. VGAM2622 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2622 RNA, herein designated VGAM RNA, binds complementarily to one or more host target binding sites located in untranslated regions of VGAM2622 host target RNA, herein designated VGAM HOST TARGET RNA. This complementary binding is due to the fact that the nucleotide sequence of VGAM2622 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2622 RNA, herein designated VGAM RNA, may have a different number of host target binding sites in untranslated regions of a VGAM2622 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2622 RNA, herein designated VGAM RNA, to host target binding sites on VGAM2622 host target RNA, herein designated VGAM HOST TARGET RNA, such as BINDING SITE I, BINDING SITE II and BINDING SITE III, inhibits translation of VGAM2622 host target RNA into VGAM2622 host target protein, herein designated VGAM HOST TARGET PROTEIN. VGAM host target protein is therefore outlined by a broken line.

It is appreciated that VGAM2622 host target gene, herein designated VGAM HOST TARGET GENE, in fact represents a plurality of VGAM2622 host target genes. The mRNA of each one of this plurality of VGAM2622 host target genes comprises one or more host target binding sites, each having a nucleotide sequence which is at least partly complementary to VGAM2622 RNA, herein designated VGAM RNA, and which when bound by VGAM2622 RNA causes inhibition of translation of respective one or more VGAM2622 host target proteins.

It is further appreciated by one skilled in the art that the mode of translational inhibition illustrated by FIG. 1 with specific reference to translational inhibition exerted by VGAM2622 gene, herein designated VGAM GENE, on one or more VGAM2622 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2622 is inhibition of expression of host target genes, as part of a novel viral mechanism of attacking a host. Accordingly, utilities of VGAM2622 include diagnosis, prevention and treatment of viral infection by Porcine Enterovirus A (PEV8). Specific functions, and accordingly utilities, of VGAM2622 correlate with, and may be deduced from, the identity of the host target genes which VGAM2622 binds and inhibits, and the function of these host target genes, as elaborated hereinbelow.

Nucleotide sequences of the VGAM2622 precursor RNA, herein designated VGAM PRECURSOR RNA, and of the 'diced' VGAM2622 RNA, herein designated VGAM RNA, and a schematic representation of the secondary folding of VGAM2622 folded precursor RNA, herein designated VGAM FOLDED PRECURSOR RNA, of VGAM2622 are further described hereinbelow with reference to Table 1.

Nucleotide sequences of host target binding sites, such as BINDING SITE-I, BINDING SITE-II and BINDING SITE-III of FIG. 1, found on VGAM2622 host target RNA, and schematic representation of the complementarity of each of these host target binding sites to VGAM2622 RNA, herein designated VGAM RNA, are described hereinbelow with reference to Table 2.

As mentioned hereinabove with reference to FIG. 1, a function of VGAM2622 gene, herein designated VGAM is inhibition of expression of VGAM2622 target genes. It is appreciated that specific functions, and accordingly utilities, of VGAM2622 correlate with, and may be deduced from, the identity of the target genes which VGAM2622 binds and inhibits, and the function of these target genes, as elaborated hereinbelow.

Secreted Protein, Acidic, Cysteine-rich (osteonectin) (SPARC, Accession NM_003118) is a VGAM2622 host target gene. SPARC BINDING SITE is HOST TARGET binding site found in the 3' untranslated region of mRNA encoded by SPARC, corresponding to a HOST TARGET binding site such as BINDING SITE I, BINDING SITE II or BINDING SITE III. Table 2 illustrates the complementarity of the nucleotide sequences of SPARC BINDING SITE, designated SEQ ID:9088, to the nucleotide sequence of VGAM2622 RNA, herein designated VGAM RNA, also designated SEQ ID:5333.

A function of VGAM2622 is therefore inhibition of Secreted Protein, Acidic, Cysteine-rich (osteonectin) (SPARC, Accession NM_003118), a gene which . Appears to regulate cell growth through interactions with the extracellular matrix and cytokines. binds calcium and copper, several types of collagen, albumin, thrombospondin, pdgf and cell membranes. Accordingly, utilities of VGAM2622 include diagnosis, prevention and treatment of diseases and clinical conditions associated with SPARC. The function of SPARC and its association with various diseases and clinical conditions, has been established by previous studies, as described hereinabove with reference to VGAM1652. FLJ12592 (Accession NM_032169) is another VGAM2622 host target gene. FLJ12592 BINDING SITE is HOST TARGET binding site found in the 5' untranslated region of mRNA encoded by FLJ12592, corresponding to a HOST TARGET binding site such as BINDING SITE I, BINDING SITE II or BINDING SITE III. Table 2 illustrates the complementarity of the nucleotide sequences of FLJ12592 BINDING SITE, designated SEQ ID:25873, to the nucleotide sequence of VGAM2622 RNA, herein designated VGAM RNA, also designated SEQ ID:5333.

Another function of VGAM2622 is therefore inhibition of FLJ12592 (Accession NM_032169). Accordingly, utilities of VGAM2622 include diagnosis, prevention and treatment of diseases and clinical conditions associated with FLJ12592. FLJ25359 (Accession NM_144587) is another VGAM2622 host target gene. FLJ25359 BINDING SITE is HOST TARGET binding site found in the 5' untranslated region of mRNA encoded by FLJ25359, corresponding to a HOST TARGET binding site such as BINDING SITE I, BINDING SITE II or BINDING SITE III. Table 2 illustrates the complementarity of the nucleotide sequences of FLJ25359 BINDING SITE, designated SEQ ID:29407, to the nucleotide sequence of VGAM2622 RNA, herein designated VGAM RNA, also designated SEQ ID:5333.

Another function of VGAM2622 is therefore inhibition of FLJ25359 (Accession NM_144587). Accordingly, utilities of VGAM2622 include diagnosis, prevention and treatment of diseases and clinical conditions associated with FLJ25359. KIAA1155 (Accession XM_030864) is another VGAM2622 host target gene. KIAA1155 BINDING SITE is HOST TARGET binding site found in the 3' untranslated region of mRNA encoded by KIAA1155, corresponding to a HOST TARGET binding site such as BINDING SITE I, BINDING SITE II or BINDING SITE III. Table 2 illustrates the complementarity of the nucleotide sequences of KIAA1155 BINDING SITE, designated SEQ ID:31199, to the nucleotide sequence of VGAM2622 RNA, herein designated VGAM RNA, also designated SEQ ID:5333.

Another function of VGAM2622 is therefore inhibition of KIAA1155 (Accession XM_030864). Accordingly, utilities of VGAM2622 include diagnosis, prevention and treatment of diseases and clinical conditions associated with KIAA1155. MGC2474 (Accession NM_023931) is another VGAM2622 host target gene. MGC2474 BINDING SITE is HOST TARGET binding site found in the 3' untranslated region of mRNA encoded by MGC2474, corresponding to a HOST TARGET binding site such as BINDING SITE I, BINDING SITE II or BINDING SITE III. Table 2 illustrates the complementarity of the nucleotide sequences of MGC2474 BINDING SITE, designated SEQ ID:23420, to the nucleotide sequence of VGAM2622 RNA, herein designated VGAM RNA, also designated SEQ ID:5333.

Another function of VGAM2622 is therefore inhibition of MGC2474 (Accession NM_023931). Accordingly, utilities of VGAM2622 include diagnosis, prevention and treatment of diseases and clinical conditions associated with MGC2474. Suppression of Tumorigenicity 13 (colon carcinoma) (Hsp70 interacting protein) (ST13, Accession NM_003932) is another VGAM2622 host target gene. ST13 BINDING SITE is HOST TARGET binding site found in the 3' untranslated region of mRNA encoded by ST13, corresponding to a HOST TARGET binding site such as BINDING SITE I, BINDING SITE II or BINDING SITE III. Table 2 illustrates the complementarity of the nucleotide sequences of ST13 BINDING SITE, designated SEQ ID:10034, to the nucleotide sequence of VGAM2622 RNA, herein designated VGAM RNA, also designated SEQ ID:5333.

Another function of VGAM2622 is therefore inhibition of Suppression of Tumorigenicity 13 (colon carcinoma) (Hsp70 interacting protein) (ST13, Accession NM_003932). Accordingly, utilities of VGAM2622 include diagnosis, prevention and treatment of diseases and clinical conditions associated with ST13. FIG. 1 further provides a conceptual description of a novel bioinformatically detected viral gene of the present invention, referred to here as Viral Genomic Address Messenger 2623 (VGAM2623) viral gene, which modulates expression of respective host target genes thereof, the function and utility of which host target genes is known in the art.

VGAM2623 is a novel bioinformatically detected regulatory, non protein coding, viral micro RNA (miRNA) gene. The method by which VGAM2623 was detected is described hereinabove with reference to FIGS. 1-8.

VGAM2623 gene, herein designated VGAM GENE, is a viral gene contained in the genome of A-2 Plaque Virus. VGAM2623 host target gene, herein designated VGAM HOST TARGET GENE, is a human gene contained in the human genome.

VGAM2623 gene encodes a VGAM2623 precursor RNA, herein designated VGAM PRECURSOR RNA. Similar to other miRNA genes, and unlike most ordinary genes, VGAM2623 precursor RNA does not encode a protein. A nucleotide sequence identical or highly similar to the nucleotide sequence of VGAM2623 precursor RNA is designated SEQ ID:2609, and is provided hereinbelow with reference to the sequence listing part. Nucleotide sequence SEQ ID:2609 is located at position 4786 relative to the genome of A-2 Plaque Virus.

VGAM2623 precursor RNA folds onto itself, forming VGAM2623 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2623 folded precursor RNA into VGAM2623 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM2623 RNA is designated SEQ ID:5334, and is provided hereinbelow with reference to the sequence listing part.

VGAM2623 host target gene, herein designated VGAM HOST TARGET GENE, encodes a corresponding messenger RNA, VGAM2623 host target RNA, herein designated VGAM HOST TARGET RNA. VGAM2623 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2623 RNA, herein designated VGAM RNA, binds complementarily to one or more host target binding sites located in untranslated regions of VGAM2623 host target RNA, herein designated VGAM HOST TARGET RNA. This complementary binding is due to the fact that the nucleotide sequence of VGAM2623 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2623 RNA, herein designated VGAM RNA, may have a different number of host target binding sites in untranslated regions of a VGAM2623 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2623 RNA, herein designated VGAM RNA, to host target binding sites on VGAM2623 host target RNA, herein designated VGAM HOST TARGET RNA, such as BINDING SITE I, BINDING SITE II and BINDING SITE III, inhibits translation of VGAM2623 host target RNA into VGAM2623 host target protein, herein designated VGAM HOST TARGET PROTEIN. VGAM host target protein is therefore outlined by a broken line.

It is appreciated that VGAM2623 host target gene, herein designated VGAM HOST TARGET GENE, in fact represents a plurality of VGAM2623 host target genes. The mRNA of each one of this plurality of VGAM2623 host target genes comprises one or more host target binding sites, each having a nucleotide sequence which is at least partly complementary to VGAM2623 RNA, herein designated VGAM RNA, and which when bound by VGAM2623 RNA causes inhibition of translation of respective one or more VGAM2623 host target proteins.

It is further appreciated by one skilled in the art that the mode of translational inhibition illustrated by FIG. 1 with specific reference to translational inhibition exerted by VGAM2623 gene, herein designated VGAM GENE, on one or more VGAM2623 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2623 is inhibition of expression of host target genes, as part of a novel viral mechanism of attacking a host. Accordingly, utilities of VGAM2623 include diagnosis, prevention and treatment of viral infection by A-2 Plaque Virus. Specific functions, and accordingly utilities, of VGAM2623 correlate with, and may be deduced from, the identity of the host target genes which VGAM2623 binds and inhibits, and the function of these host target genes, as elaborated hereinbelow.

Nucleotide sequences of the VGAM2623 precursor RNA, herein designated VGAM PRECURSOR RNA, and of the 'diced' VGAM2623 RNA, herein designated VGAM RNA, and a schematic representation of the secondary folding of VGAM2623 folded precursor RNA, herein designated VGAM FOLDED PRECURSOR RNA, of VGAM2623 are further described hereinbelow with reference to Table 1.

Nucleotide sequences of host target binding sites, such as BINDING SITE-I, BINDING SITE-II and BINDING SITE-III of FIG. 1, found on VGAM2623 host target RNA, and schematic representation of the complementarity of each of these host target binding sites to VGAM2623 RNA, herein designated VGAM RNA, are described hereinbelow with reference to Table 2.

As mentioned hereinabove with reference to FIG. 1, a function of VGAM2623 gene, herein designated VGAM is inhibition of expression of VGAM2623 target genes. It is appreciated that specific functions, and accordingly utilities, of VGAM2623 correlate with, and may be deduced from, the identity of the target genes which VGAM2623 binds and inhibits, and the function of these target genes, as elaborated hereinbelow.

Chorionic Gonadotropin, Beta Polypeptide (CGB, Accession NM_000737) is a VGAM2623 host target gene. CGB BINDING SITE is HOST TARGET binding site found in the 5' untranslated region of mRNA encoded by CGB, corresponding to a HOST TARGET binding site such as BINDING SITE I, BINDING SITE II or BINDING SITE III. Table 2 illustrates the complementarity of the nucleotide sequences of CGB BINDING SITE, designated SEQ ID:6393, to the nucleotide sequence of VGAM2623 RNA, herein designated VGAM RNA, also designated SEQ ID:5334.

A function of VGAM2623 is therefore inhibition of Chorionic Gonadotropin, Beta Polypeptide (CGB, Accession NM_000737), a gene which stimulates the ovaries to synthesize the steroids. Accordingly, utilities of VGAM2623 include diagnosis, prevention and treatment of diseases and clinical conditions associated with CGB. The function of CGB and its association with various diseases and clinical conditions, has been established by previous studies, as described hereinabove with reference to VGAM1959. Guanine Nucleotide Binding Protein (G protein), Alpha Activating Activity Polypeptide O (GNAO1, Accession XM_165653) is another VGAM2623 host target gene.

GNAO1 BINDING SITE is HOST TARGET binding site found in the 3' untranslated region of mRNA encoded by GNAO1, corresponding to a HOST TARGET binding site such as BINDING SITE I, BINDING SITE II or BINDING SITE III. Table 2 illustrates the complementarity of the nucleotide sequences of GNAO1 BINDING SITE, designated SEQ ID:43720, to the nucleotide sequence of VGAM2623 RNA, herein designated VGAM RNA, also designated SEQ ID:5334.

Another function of VGAM2623 is therefore inhibition of Guanine Nucleotide Binding Protein (G protein), Alpha Activating Activity Polypeptide O (GNAO1, Accession XM_165653), a gene which functions as modulators or transducers in various transmembrane signaling systems. Accordingly, utilities of VGAM2623 include diagnosis, prevention and treatment of diseases and clinical conditions associated with GNAO1. The function of GNAO1 and its association with various diseases and clinical conditions, has been established by previous studies, as described hereinabove with reference to VGAM665. Microfibrillar-associated Protein 3 (MFAP3, Accession NM_005927) is another VGAM2623 host target gene. MFAP3 BINDING SITE is HOST TARGET binding site found in the 3' untranslated region of mRNA encoded by MFAP3, corresponding to a HOST TARGET binding site such as BINDING SITE I, BINDING SITE II or BINDING SITE III. Table 2 illustrates the complementarity of the nucleotide sequences of MFAP3 BINDING SITE, designated SEQ ID:12554, to the nucleotide sequence of VGAM2623 RNA, herein designated VGAM RNA, also designated SEQ ID:5334.

Another function of VGAM2623 is therefore inhibition of Microfibrillar-associated Protein 3 (MFAP3, Accession NM_005927). Accordingly, utilities of VGAM2623 include diagnosis, prevention and treatment of diseases and clinical conditions associated with MFAP3. MAX Binding Protein (MNT, Accession NM_020310) is another VGAM2623 host target gene. MNT BINDING SITE is HOST TARGET binding site found in the 3" untranslated region of mRNA encoded by MNT, corresponding to a HOST TARGET binding site such as BINDING SITE I, BINDING SITE II or BINDING SITE III. Table 2 illustrates the complementarity of the nucleotide sequences of MNT BINDING SITE, designated SEQ ID:21561, to the nucleotide sequence of VGAM2623 RNA, herein designated VGAM RNA, also designated SEQ ID:5334.

Another function of VGAM2623 is therefore inhibition of MAX Binding Protein (MNT, Accession NM_020310). Accordingly, utilities of VGAM2623 include diagnosis, prevention and treatment of diseases and clinical conditions associated with MNT. Solute Carrier Family 9 (sodium/hydrogen exchanger), Isoform 5 (SLC9A5, Accession XM_007868) is another VGAM2623 host target gene. SLC9A5 BINDING SITE1 and SLC9A5 BINDING SITE2 are HOST TARGET binding sites found in untranslated regions of mRNA encoded by SLC9A5, corresponding to HOST TARGET binding sites such as BINDING SITE I, BINDING SITE II or BINDING SITE III. Table 2 illustrates the complementarity of the nucleotide sequences of SLC9A5 BINDING SITE1 and SLC9A5 BINDING SITE2, designated SEQ ID:30063 and SEQ ID:10934 respectively, to the nucleotide sequence of VGAM2623 RNA, herein designated VGAM RNA, also designated SEQ ID:5334.

Another function of VGAM2623 is therefore inhibition of Solute Carrier Family 9 (sodium/hydrogen exchanger), Isoform 5 (SLC9A5, Accession XM_007868). Accordingly, utilities of VGAM2623 include diagnosis, prevention and treatment of diseases and clinical conditions associated with SLC9A5. Thy-1 Cell Surface Antigen (THY1, Accession NM_006288) is another VGAM2623 host target gene. THY1 BINDING SITE is HOST TARGET binding site found in the 3' untranslated region of mRNA encoded by THY1, corresponding to a HOST TARGET binding site such as BINDING SITE I, BINDING SITE II or BINDING SITE III. Table 2 illustrates the complementarity of the nucleotide sequences of THY1 BINDING SITE, designated SEQ ID:12976, to the nucleotide sequence of VGAM2623 RNA, herein designated VGAM RNA, also designated SEQ ID:5334.

Another function of VGAM2623 is therefore inhibition of Thy-1 Cell Surface Antigen (THY1, Accession NM_006288), a gene which plays a role in cell-cell or cell-ligand interactions during synaptogenesis. Accordingly, utilities of VGAM2623 include diagnosis, prevention and treatment of diseases and clinical conditions associated with THY1. The function of THY1 and its association with various diseases and clinical conditions, has been established by previous studies, as described hereinabove with reference to VGAM396. Calneuron 1 (CALN1, Accession NM_031468) is another VGAM2623 host target gene. CALN1 BINDING SITE is HOST TARGET binding site found in the 3' untranslated region of mRNA encoded by CALN1, corresponding to a HOST TARGET binding site such as BINDING SITE I, BINDING SITE II or BINDING SITE III. Table 2 illustrates the complementarity of the nucleotide sequences of CALN1 BINDING SITE, designated SEQ ID:25522, to the nucleotide sequence of VGAM2623 RNA, herein designated VGAM RNA, also designated SEQ ID:5334.

Another function of VGAM2623 is therefore inhibition of Calneuron 1 (CALN1, Accession NM_031468). Accordingly, utilities of VGAM2623 include diagnosis, prevention and treatment of diseases and clinical conditions associated with CALN1. Cell Division Cycle Associated 4 (CDCA4, Accession NM_017955) is another VGAM2623 host target gene. CDCA4 BINDING SITE is HOST TARGET binding site found in the 3' untranslated region of mRNA encoded by CDCA4, corresponding to a HOST TARGET binding site such as BINDING SITE I, BINDING SITE II or BINDING SITE III. Table 2 illustrates the complementarity of the nucleotide sequences of CDCA4 BINDING SITE, designated SEQ ID:19660, to the nucleotide sequence of VGAM2623 RNA, herein designated VGAM RNA, also designated SEQ ID:5334.

Another function of VGAM2623 is therefore inhibition of Cell Division Cycle Associated 4 (CDCA4, Accession NM_017955). Accordingly, utilities of VGAM2623 include diagnosis, prevention and treatment of diseases and clinical conditions associated with CDCA4. Chorionic Gonadotropin, Beta Polypeptide 5 (CGB5, Accession NM_033043) is another VGAM2623 host target gene. CGB5 BINDING SITE is HOST TARGET binding site found in the 5' untranslated region of mRNA encoded by CGB5, corresponding to a HOST TARGET binding site such as BINDING SITE I, BINDING SITE II or BINDING SITE III. Table 2 illustrates the complementarity of the nucleotide sequences of CGB5 BINDING SITE, designated SEQ ID:26930, to the nucleotide sequence of VGAM2623 RNA, herein designated VGAM RNA, also designated SEQ ID:5334.

Another function of VGAM2623 is therefore inhibition of Chorionic Gonadotropin, Beta Polypeptide 5 (CGB5, Accession NM_033043). Accordingly, utilities of VGAM2623 include diagnosis, prevention and treatment of diseases and clinical conditions associated with CGB5. Chorionic Gonadotropin, Beta Polypeptide 7 (CGB7, Accession NM_033142) is another VGAM2623 host target gene. CGB7 BINDING SITE is HOST TARGET binding site found in the 5' untranslated region of mRNA encoded by CGB7, corresponding to a HOST TARGET binding site such as BINDING SITE I, BINDING SITE II or BINDING SITE III. Table 2 illustrates the complementarity of the nucleotide sequences of CGB7 BINDING SITE, designated SEQ ID:26994, to the nucleotide sequence of VGAM2623 RNA, herein designated VGAM RNA, also designated SEQ ID:5334.

Another function of VGAM2623 is therefore inhibition of Chorionic Gonadotropin, Beta Polypeptide 7 (CGB7, Accession NM_033142). Accordingly, utilities of VGAM2623 include diagnosis, prevention and treatment of diseases and clinical conditions associated with CGB7. Chorionic Gonadotropin, Beta Polypeptide 8 (CGB8, Accession NM_033183) is another VGAM2623 host target gene. CGB8 BINDING SITE is HOST TARGET binding site found in the 5' untranslated region of mRNA encoded by CGB8, corresponding to a HOST TARGET binding site such as BINDING SITE I, BINDING SITE II or BINDING SITE III. Table 2 illustrates the complementarity of the nucleotide sequences of CGB8 BINDING SITE, designated SEQ ID:27045, to the nucleotide sequence of VGAM2623 RNA, herein designated VGAM RNA, also designated SEQ ID:5334.

Another function of VGAM2623 is therefore inhibition of Chorionic Gonadotropin, Beta Polypeptide 8 (CGB8, Accession NM_033183). Accordingly, utilities of VGAM2623 include diagnosis, prevention and treatment of diseases and clinical conditions associated with CGB8. DKFZp762E1312 (Accession NM_018410) is another VGAM2623 host target gene. DKFZp762E1312 BINDING SITE is HOST TARGET binding site found in the 5' untranslated region of mRNA encoded by DKFZp762E1312, corresponding to a HOST TARGET binding site such as BINDING SITE I, BINDING SITE II or BINDING SITE III. Table 2 illustrates the complementarity of the nucleotide sequences of DKFZp762E1312 BINDING SITE, designated SEQ ID:20450, to the nucleotide sequence of VGAM2623 RNA, herein designated VGAM RNA, also designated SEQ ID:5334.

Another function of VGAM2623 is therefore inhibition of DKFZp762E1312 (Accession NM_018410). Accordingly, utilities of VGAM2623 include diagnosis, prevention and treatment of diseases and clinical conditions associated with DKFZp762E1312. FLJ12783 (Accession NM_031426) is another VGAM2623 host target gene. FLJ12783 BINDING SITE is HOST TARGET binding site found in the 3' untranslated region of mRNA encoded by FLJ12783, corresponding to a HOST TARGET binding site such as BINDING SITE I, BINDING SITE II or BINDING SITE III. Table 2 illustrates the complementarity of the nucleotide sequences of FLJ12783 BINDING SITE, designated SEQ ID:25417, to the nucleotide sequence of VGAM2623 RNA, herein designated VGAM RNA, also designated SEQ ID:5334.

Another function of VGAM2623 is therefore inhibition of FLJ12783 (Accession NM_031426). Accordingly, utilities of VGAM2623 include diagnosis, prevention and treatment of diseases and clinical conditions associated with FLJ12783. FLJ14437 (Accession NM_032578) is another VGAM2623 host target gene. FLJ14437 BINDING SITE is HOST TARGET binding site found in the 3' untranslated region of mRNA encoded by FLJ14437, corresponding to a HOST TARGET binding site such as BINDING SITE I, BINDING SITE II or BINDING SITE III. Table 2 illustrates the complementarity of the nucleotide sequences of FLJ14437 BINDING SITE, designated SEQ ID:26308, to the nucleotide sequence of VGAM2623 RNA, herein designated VGAM RNA, also designated SEQ ID:5334.

Another function of VGAM2623 is therefore inhibition of FLJ14437 (Accession NM_032578). Accordingly, utilities of VGAM2623 include diagnosis, prevention and treatment of diseases and clinical conditions associated with FLJ14437. FLJ14810 (Accession NM_032843) is another VGAM2623 host target gene. FLJ14810 BINDING SITE is HOST TARGET binding site found in the 5' untranslated region of mRNA encoded by FLJ14810, corresponding to a HOST TARGET binding site such as BINDING SITE I, BINDING SITE II or BINDING SITE III. Table 2 illustrates the complementarity of the nucleotide sequences of FLJ14810 BINDING SITE, designated SEQ ID:26634, to the nucleotide sequence of VGAM2623 RNA, herein designated VGAM RNA, also designated SEQ ID:5334.

Another function of VGAM2623 is therefore inhibition of FLJ14810 (Accession NM_032843). Accordingly, utilities of VGAM2623 include diagnosis, prevention and treatment of diseases and clinical conditions associated with FLJ14810. FLJ20174 (Accession NM_017699) is another VGAM2623 host target gene. FLJ20174 BINDING SITE is HOST TARGET binding site found in the 3' untranslated region of mRNA encoded by FLJ20174, corresponding to a HOST TARGET binding site such as BINDING SITE I, BINDING SITE II or BINDING SITE III. Table 2 illustrates the complementarity of the nucleotide sequences of FLJ20174 BINDING SITE, designated SEQ ID:19268, to the nucleotide sequence of VGAM2623 RNA, herein designated VGAM RNA, also designated SEQ ID:5334.

Another function of VGAM2623 is therefore inhibition of FLJ20174 (Accession NM_017699). Accordingly, utilities of VGAM2623 include diagnosis, prevention and treatment of diseases and clinical conditions associated with FLJ20174. KIAA0449 (Accession NM_017596) is another VGAM2623 host target gene. KIAA0449 BINDING SITE is HOST TARGET binding site found in the 3' untranslated region of mRNA encoded by KIAA0449, corresponding to a HOST TARGET binding site such as BINDING SITE I, BINDING SITE II or BINDING SITE III. Table 2 illustrates the complementarity of the nucleotide sequences of KIAA0449 BINDING SITE, designated SEQ ID:19051, to the nucleotide sequence of VGAM2623 RNA, herein designated VGAM RNA, also designated SEQ ID:5334.

Another function of VGAM2623 is therefore inhibition of KIAA0449 (Accession NM_017596). Accordingly, utilities of VGAM2623 include diagnosis, prevention and treatment of diseases and clinical conditions associated with KIAA0449. KIAA0545 (Accession XM_032278) is another VGAM2623 host target gene. KIAA0545 BINDING SITE is HOST TARGET binding site found in the 3' untranslated region of mRNA encoded by KIAA0545, corresponding to a HOST TARGET binding site such as BINDING SITE I, BINDING SITE II or BINDING SITE III. Table 2 illustrates the complementarity of the nucleotide sequences of KIAA0545 BINDING SITE, designated SEQ ID:31635, to the nucleotide sequence of VGAM2623 RNA, herein designated VGAM RNA, also designated SEQ ID:5334.

Another function of VGAM2623 is therefore inhibition of KIAA0545 (Accession XM_032278). Accordingly, utilities of VGAM2623 include diagnosis, prevention and treatment of diseases and clinical conditions associated with KIAA0545. KIAA1010 (Accession XM_050742) is another VGAM2623 host target gene. KIAA1010 BINDING SITE is HOST TARGET binding site found in the 3' untranslated region of mRNA encoded by KIAA1010, corresponding to a HOST TARGET binding site such as BINDING SITE I, BINDING SITE II or BINDING SITE III. Table 2 illustrates the complementarity of the nucleotide sequences of KIAA1010 BINDING SITE, designated SEQ ID:35670, to the nucleotide sequence of VGAM2623 RNA, herein designated VGAM RNA, also designated SEQ ID:5334.

Another function of VGAM2623 is therefore inhibition of KIAA1010 (Accession XM_050742). Accordingly, utilities of VGAM2623 include diagnosis, prevention and treatment of diseases and clinical conditions associated with KIAA1010. KIAA1089 (Accession XM_044148) is another VGAM2623 host target gene. KIAA1089 BINDING SITE is HOST TARGET binding site found in the 3' untranslated region of mRNA encoded by KIAA1089, corresponding to a HOST TARGET binding site such as BINDING SITE I, BINDING SITE II or BINDING SITE III. Table 2 illustrates the complementarity of the nucleotide sequences of KIAA1089 BINDING SITE, designated SEQ ID:34140, to the nucleotide sequence of VGAM2623 RNA, herein designated VGAM RNA, also designated SEQ ID:5334.

Another function of VGAM2623 is therefore inhibition of KIAA1089 (Accession XM_044148). Accordingly, utilities of VGAM2623 include diagnosis, prevention and treatment of diseases and clinical conditions associated with KIAA1089. KIAA1110 (Accession XM_029973) is another VGAM2623 host target gene. KIAA1110 BINDING SITE is HOST TARGET binding site found in the 3' untranslated region of mRNA encoded by KIAA1110, corresponding to a HOST TARGET binding site such as BINDING SITE I, BINDING SITE II or BINDING SITE III. Table 2 illustrates the complementarity of the nucleotide sequences of KIAA1110 BINDING SITE, designated SEQ ID:30984, to the nucleotide sequence of VGAM2623 RNA, herein designated VGAM RNA, also designated SEQ ID:5334.

Another function of VGAM2623 is therefore inhibition of KIAA1110 (Accession XM_029973). Accordingly, utilities of VGAM2623 include diagnosis, prevention and treatment of diseases and clinical conditions associated with KIAA1110. KIAA1272 (Accession XM_046600) is another VGAM2623 host target gene. KIAA1272 BINDING SITE is HOST TARGET binding site found in the 3' untranslated region of mRNA encoded by KIAA1272, corresponding to a HOST TARGET binding site such as BINDING SITE I, BINDING SITE II or BINDING SITE III. Table 2 illustrates the complementarity of the nucleotide sequences of KIAA1272 BINDING SITE, designated SEQ ID:34761, to the nucleotide sequence of VGAM2623 RNA, herein designated VGAM RNA, also designated SEQ ID:5334.

Another function of VGAM2623 is therefore inhibition of KIAA1272 (Accession XM_046600). Accordingly, utilities of VGAM2623 include diagnosis, prevention and treatment of diseases and clinical conditions associated with KIAA1272. KIAA1855 (Accession XM_166453) is another VGAM2623 host target gene. KIAA1855 BINDING SITE is HOST TARGET binding site found in the 3' untranslated region of mRNA encoded by KIAA1855, corresponding to a HOST TARGET binding site such as BINDING SITE I, BINDING SITE II or BINDING SITE III. Table 2 illustrates the complementarity of the nucleotide sequences of KIAA1855 BINDING SITE, designated SEQ ID:44356, to the nucleotide sequence of VGAM2623 RNA, herein designated VGAM RNA, also designated SEQ ID:5334.

Another function of VGAM2623 is therefore inhibition of KIAA1855 (Accession XM_166453). Accordingly, utilities of VGAM2623 include diagnosis, prevention and treatment of diseases and clinical conditions associated with KIAA1855. MGC16279 (Accession XM_031808) is another VGAM2623 host target gene. MGC16279 BINDING SITE1 and MGC16279 BINDING SITE2 are HOST TARGET binding sites found in untranslated regions of mRNA encoded by MGC16279, corresponding to HOST TARGET binding sites such as BINDING SITE I, BINDING SITE II or BINDING SITE III. Table 2 illustrates the complementarity of the nucleotide sequences of MGC16279 BINDING SITE1 and MGC16279 BINDING SITE2, designated SEQ ID:31488 and SEQ ID:26734 respectively, to the nucleotide sequence of VGAM2623 RNA, herein designated VGAM RNA, also designated SEQ ID:5334.

Another function of VGAM2623 is therefore inhibition of MGC16279 (Accession XM_031808). Accordingly, utilities of VGAM2623 include diagnosis, prevention and treatment of diseases and clinical conditions associated with MGC16279. Myosin XVIIIB (MYO18B, Accession NM_032608) is another VGAM2623 host target gene. MYO18B BINDING SITE is HOST TARGET binding site found in the 3' untranslated region of mRNA encoded by MYO18B, corresponding to a HOST TARGET binding site such as BINDING SITE I, BINDING SITE II or BINDING SITE III. Table 2 illustrates the complementarity of the nucleotide sequences of MYO18B BINDING SITE, designated SEQ ID:26331, to the nucleotide sequence of VGAM2623 RNA, herein designated VGAM RNA, also designated SEQ ID:5334.

Another function of VGAM2623 is therefore inhibition of Myosin XVIIIB (MYO18B, Accession NM_032608). Accordingly, utilities of VGAM2623 include diagnosis, prevention and treatment of diseases and clinical conditions associated with MYO18B. PGS1 (Accession NM_024419) is another VGAM2623 host target gene. PGS1 BINDING SITE is HOST TARGET binding site found in the 5' untranslated region of mRNA encoded by PGS1, corresponding to a HOST TARGET binding site such as BINDING SITE I, BINDING SITE II or BINDING SITE III. Table 2 illustrates the complementarity of the nucleotide sequences of PGS1 BINDING SITE, designated SEQ ID:23657, to the nucleotide sequence of VGAM2623 RNA, herein designated VGAM RNA, also designated SEQ ID:5334.

Another function of VGAM2623 is therefore inhibition of PGS1 (Accession NM_024419). Accordingly, utilities of VGAM2623 include diagnosis, prevention and treatment of diseases and clinical conditions associated with PGS1. Ring Finger Protein 36 (RNF36, Accession NM_080745) is another VGAM2623 host target gene. RNF36 BINDING SITE is HOST TARGET binding site found in the 5' untranslated region of mRNA encoded by RNF36, corresponding to a HOST TARGET binding site such as BINDING SITE I, BINDING SITE II or BINDING SITE III. Table 2 illustrates the complementarity of the nucleotide sequences of RNF36 BINDING SITE, designated SEQ ID:28032, to the nucleotide sequence of VGAM2623 RNA, herein designated VGAM RNA, also designated SEQ ID:5334.

Another function of VGAM2623 is therefore inhibition of Ring Finger Protein 36 (RNF36, Accession NM_080745). Accordingly, utilities of VGAM2623 include diagnosis, prevention and treatment of diseases and clinical conditions associated with RNF36. Transmembrane 4 Superfamily Member 11 (plasmolipin) (TM4SF11, Accession NM_015993) is another VGAM2623 host target gene. TM4SF11 BINDING SITE is HOST TARGET binding site found in the 3' untranslated region of mRNA encoded by TM4SF11, corresponding to a HOST TARGET binding site such as BINDING SITE I, BINDING SITE II or BINDING SITE III. Table 2 illustrates the complementarity of the nucleotide sequences of TM4SF11 BINDING SITE, designated SEQ ID:18084, to the nucleotide sequence of VGAM2623 RNA, herein designated VGAM RNA, also designated SEQ ID:5334.

Another function of VGAM2623 is therefore inhibition of Transmembrane 4 Superfamily Member 11 (plasmolipin) (TM4SF11, Accession NM_015993). Accordingly, utilities of VGAM2623 include diagnosis, prevention and treatment of diseases and clinical conditions associated with TM4SF11. LOC115129 (Accession XM_055292) is another VGAM2623 host target gene. LOC115129 BINDING SITE is HOST TARGET binding site found in the 3' untranslated region of mRNA encoded by LOC115129, corresponding to a HOST TARGET binding site such as BINDING SITE I, BINDING SITE II or BINDING SITE III. Table 2 illustrates the complementarity of the nucleotide sequences of LOC115129 BINDING SITE, designated SEQ ID:36252, to the nucleotide sequence of VGAM2623 RNA, herein designated VGAM RNA, also designated SEQ ID:5334.

Another function of VGAM2623 is therefore inhibition of LOC115129 (Accession XM_055292). Accordingly, utilities of VGAM2623 include diagnosis, prevention and treatment of diseases and clinical conditions associated with LOC115129. LOC144114 (Accession XM_090198) is another VGAM2623 host target gene. LOC144114 BINDING SITE is HOST TARGET binding site found in the 5' untranslated region of mRNA encoded by LOC144114, corresponding to a HOST TARGET binding site such as BINDING SITE I, BINDING SITE II or BINDING SITE III. Table 2 illustrates the complementarity of the nucleotide sequences of LOC144114 BINDING SITE, designated SEQ ID:39993, to the nucleotide sequence of VGAM2623 RNA, herein designated VGAM RNA, also designated SEQ ID:5334.

Another function of VGAM2623 is therefore inhibition of LOC144114 (Accession XM_090198). Accordingly, utilities of VGAM2623 include diagnosis, prevention and treatment of diseases and clinical conditions associated with LOC144114. LOC146184 (Accession XM_096942) is another VGAM2623 host target gene. LOC146184 BINDING SITE is HOST TARGET binding site found in the 5' untranslated region of mRNA encoded by LOC146184, corresponding to a HOST TARGET binding site such as BINDING SITE I, BINDING SITE II or BINDING SITE III. Table 2 illustrates the complementarity of the nucleotide sequences of LOC146184 BINDING SITE, designated SEQ ID:40661, to the nucleotide sequence of VGAM2623 RNA, herein designated VGAM RNA, also designated SEQ ID:5334.

Another function of VGAM2623 is therefore inhibition of LOC146184 (Accession XM_096942). Accordingly, utilities of VGAM2623 include diagnosis, prevention and treatment of diseases and clinical conditions associated with LOC146184. LOC158156 (Accession XM_088496) is another VGAM2623 host target gene. LOC158156 BINDING SITE is HOST TARGET binding site found in the 3' untranslated region of mRNA encoded by LOC158156, corresponding to a HOST TARGET binding site such as BINDING SITE I, BINDING SITE II or BINDING SITE III. Table 2 illustrates the complementarity of the nucleotide sequences of LOC158156 BINDING SITE, designated SEQ ID:39740, to the nucleotide sequence of VGAM2623 RNA, herein designated VGAM RNA, also designated SEQ ID:5334.

Another function of VGAM2623 is therefore inhibition of LOC158156 (Accession XM_088496). Accordingly, utilities of VGAM2623 include diagnosis, prevention and treatment of diseases and clinical conditions associated with LOC158156. LOC196483 (Accession XM_016909) is another VGAM2623 host target gene. LOC196483 BINDING SITE is HOST TARGET binding site found in the 5' untranslated region of mRNA encoded by LOC196483, corresponding to a HOST TARGET binding site such as BINDING SITE I, BINDING SITE II or BINDING SITE III. Table 2 illustrates the complementarity of the nucleotide sequences of LOC196483 BINDING SITE, designated SEQ ID:30291, to the nucleotide sequence of VGAM2623 RNA, herein designated VGAM RNA, also designated SEQ ID:5334.

Another function of VGAM2623 is therefore inhibition of LOC196483 (Accession XM_016909). Accordingly, utilities of VGAM2623 include diagnosis, prevention and treatment of diseases and clinical conditions associated with LOC196483. LOC196955 (Accession XM_085210) is another VGAM2623 host target gene. LOC196955 BINDING SITE is HOST TARGET binding site found in the 5' untranslated region of mRNA encoded by LOC196955, corresponding to a HOST TARGET binding site such as BINDING SITE I, BINDING SITE II or BINDING SITE III. Table 2 illustrates the complementarity of the nucleotide sequences of LOC196955 BINDING SITE, designated SEQ ID:37933, to the nucleotide sequence of VGAM2623 RNA, herein designated VGAM RNA, also designated SEQ ID:5334.

Another function of VGAM2623 is therefore inhibition of LOC196955 (Accession XM_085210). Accordingly, utilities of VGAM2623 include diagnosis, prevention and treatment of diseases and clinical conditions associated with LOC196955. LOC204970 (Accession XM_114795) is another VGAM2623 host target gene. LOC204970 BINDING SITE is HOST TARGET binding site found in the 3' untranslated region of mRNA encoded by LOC204970, corresponding to a HOST TARGET binding site such as BINDING SITE I, BINDING SITE II or BINDING SITE III. Table 2 illustrates the complementarity of the nucleotide sequences of LOC204970 BINDING SITE, designated SEQ ID:43068, to the nucleotide sequence of VGAM2623 RNA, herein designated VGAM RNA, also designated SEQ ID:5334.

Another function of VGAM2623 is therefore inhibition of LOC204970 (Accession XM_114795). Accordingly, utilities of VGAM2623 include diagnosis, prevention and treatment of diseases and clinical conditions associated with LOC204970. LOC220739 (Accession XM_167548) is another VGAM2623 host target gene. LOC220739 BINDING SITE is HOST TARGET binding site found in the 3' untranslated region of mRNA encoded by LOC220739, corresponding to a HOST TARGET binding site such as BINDING SITE I, BINDING SITE II or BINDING SITE III. Table 2 illustrates the complementarity of the nucleotide sequences of LOC220739 BINDING SITE, designated SEQ ID:44656, to the nucleotide sequence of VGAM2623 RNA, herein designated VGAM RNA, also designated SEQ ID:5334.

Another function of VGAM2623 is therefore inhibition of LOC220739 (Accession XM_167548). Accordingly, utilities of VGAM2623 include diagnosis, prevention and treatment of diseases and clinical conditions associated with LOC220739. LOC221466 (Accession XM_168087) is another VGAM2623 host target gene. LOC221466 BINDING SITE is HOST TARGET binding site found in the 3' untranslated region of mRNA encoded by LOC221466, corresponding to a HOST TARGET binding site such as BINDING SITE I, BINDING SITE II or BINDING SITE III. Table 2 illustrates the complementarity of the nucleotide sequences of LOC221466 BINDING SITE, designated SEQ ID:44992, to the nucleotide sequence of VGAM2623 RNA, herein designated VGAM RNA, also designated SEQ ID:5334.

Another function of VGAM2623 is therefore inhibition of LOC221466 (Accession XM_168087). Accordingly, utilities of VGAM2623 include diagnosis, prevention and treatment of diseases and clinical conditions associated with LOC221466. LOC255974 (Accession XM_173706) is another VGAM2623 host target gene. LOC255974 BINDING SITE is HOST TARGET binding site found in the 5' untranslated region of mRNA encoded by LOC255974, corresponding to a HOST TARGET binding site such as BINDING SITE I, BINDING SITE II or BINDING SITE III. Table 2 illustrates the complementarity of the nucleotide sequences of LOC255974 BINDING SITE, designated SEQ ID:46556, to the nucleotide sequence of VGAM2623 RNA, herein designated VGAM RNA, also designated SEQ ID:5334.

Another function of VGAM2623 is therefore inhibition of LOC255974 (Accession XM_173706). Accordingly, utilities of VGAM2623 include diagnosis, prevention and treatment of diseases and clinical conditions associated with LOC255974. LOC51337 (Accession NM_016647) is another VGAM2623 host target gene. LOC51337 BINDING SITE is HOST TARGET binding site found in the 3' untranslated region of mRNA encoded by LOC51337, corresponding to a HOST TARGET binding site such as BINDING SITE I, BINDING SITE II or BINDING SITE III. Table 2 illustrates the complementarity of the nucleotide sequences of LOC51337 BINDING SITE, designated SEQ ID:18762, to the nucleotide sequence of VGAM2623 RNA, herein designated VGAM RNA, also designated SEQ ID:5334.

Another function of VGAM2623 is therefore inhibition of LOC51337 (Accession NM_016647). Accordingly, utilities of VGAM2623 include diagnosis, prevention and treatment of diseases and clinical conditions associated with LOC51337. LOC90092 (Accession XM_028862) is another VGAM2623 host target gene. LOC90092 BINDING SITE is HOST TARGET binding site found in the 5' untranslated region of mRNA encoded by LOC90092, corresponding to a HOST TARGET binding site such as BINDING SITE I, BINDING SITE II or BINDING SITE III. Table 2 illustrates the complementarity of the nucleotide sequences of LOC90092 BINDING SITE, designated SEQ ID:30786, to the nucleotide sequence of VGAM2623 RNA, herein designated VGAM RNA, also designated SEQ ID:5334.

Another function of VGAM2623 is therefore inhibition of LOC90092 (Accession XM_028862). Accordingly, utilities of VGAM2623 include diagnosis, prevention and treatment of diseases and clinical conditions associated with LOC90092. LOC96652 (Accession XM_037474) is another VGAM2623 host target gene. LOC96652 BINDING SITE is HOST TARGET binding site found in the 5' untranslated region of mRNA encoded by LOC96652, corresponding to a HOST TARGET binding site such as BINDING SITE I, BINDING SITE II or BINDING SITE III. Table 2 illustrates the complementarity of the nucleotide sequences of LOC96652 BINDING SITE, designated SEQ ID:32628, to the nucleotide sequence of VGAM2623 RNA, herein designated VGAM RNA, also designated SEQ ID:5334.

Another function of VGAM2623 is therefore inhibition of LOC96652 (Accession XM_037474). Accordingly, utilities of VGAM2623 include diagnosis, prevention and treatment of diseases and clinical conditions associated with LOC96652. FIG. 1 further provides a conceptual description of a novel bioinformatically detected viral gene of the present invention, referred to here as Viral Genomic Address Messenger 2624 (VGAM2624) viral gene, which modulates expression of respective host target genes thereof, the function and utility of which host target genes is known in the art.

VGAM2624 is a novel bioinformatically detected regulatory, non protein coding, viral micro RNA (miRNA) gene. The method by which VGAM2624 was detected is described hereinabove with reference to FIGS. 1-8.

VGAM2624 gene, herein designated VGAM GENE, is a viral gene contained in the genome of A-2 Plaque Virus. VGAM2624 host target gene, herein designated VGAM HOST TARGET GENE, is a human gene contained in the human genome.

VGAM2624 gene encodes a VGAM2624 precursor RNA, herein designated VGAM PRECURSOR RNA. Similar to other miRNA genes, and unlike most ordinary genes, VGAM2624 precursor RNA does not encode a protein. A nucleotide sequence identical or highly similar to the nucleotide sequence of VGAM2624 precursor RNA is designated SEQ ID:2610, and is provided hereinbelow with reference to the sequence listing part. Nucleotide sequence SEQ ID:2610 is located at position 5482 relative to the genome of A-2 Plaque Virus.

VGAM2624 precursor RNA folds onto itself, forming VGAM2624 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2624 folded precursor RNA into VGAM2624 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 43%) nucleotide sequence of VGAM2624 RNA is designated SEQ ID:5335, and is provided hereinbelow with reference to the sequence listing part.

VGAM2624 host target gene, herein designated VGAM HOST TARGET GENE, encodes a corresponding messenger RNA, VGAM2624 host target RNA, herein designated VGAM HOST TARGET RNA. VGAM2624 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2624 RNA, herein designated VGAM RNA, binds complementarily to one or more host target binding sites located in untranslated regions of VGAM2624 host target RNA, herein designated VGAM HOST TARGET RNA. This complementary binding is due to the fact that the nucleotide sequence of VGAM2624 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2624 RNA, herein designated VGAM RNA, may have a different number of host target binding sites in untranslated regions of a VGAM2624 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2624 RNA, herein designated VGAM RNA, to host target binding sites on VGAM2624 host target RNA, herein designated VGAM HOST TARGET RNA, such as BINDING SITE I, BINDING SITE II and BINDING SITE III, inhibits translation of VGAM2624 host target RNA into VGAM2624 host target protein, herein designated VGAM HOST TARGET PROTEIN. VGAM host target protein is therefore outlined by a broken line.

It is appreciated that VGAM2624 host target gene, herein designated VGAM HOST TARGET GENE, in fact represents a plurality of VGAM2624 host target genes. The mRNA of each one of this plurality of VGAM2624 host target genes comprises one or more host target binding sites, each having a nucleotide sequence which is at least partly complementary to VGAM2624 RNA, herein designated VGAM RNA, and which when bound by VGAM2624 RNA causes inhibition of translation of respective one or more VGAM2624 host target proteins.

It is further appreciated by one skilled in the art that the mode of translational inhibition illustrated by FIG. 1 with specific reference to translational inhibition exerted by VGAM2624 gene, herein designated VGAM GENE, on one or more VGAM2624 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2624 is inhibition of expression of host target genes, as part of a novel viral mechanism of attacking a host. Accordingly, utilities of VGAM2624 include diagnosis, prevention and treatment of viral infection by A-2 Plaque Virus. Specific functions, and accordingly utilities, of VGAM2624 correlate with, and may be deduced from, the identity of the host target genes which VGAM2624 binds and inhibits, and the function of these host target genes, as elaborated hereinbelow.

Nucleotide sequences of the VGAM2624 precursor RNA, herein designated VGAM PRECURSOR RNA, and of the 'diced' VGAM2624 RNA, herein designated VGAM RNA, and a schematic representation of the secondary folding of VGAM2624 folded precursor RNA, herein designated VGAM FOLDED PRECURSOR RNA, of VGAM2624 are further described hereinbelow with reference to Table 1.

Nucleotide sequences of host target binding sites, such as BINDING SITE-I, BINDING SITE-II and BINDING SITE-III of FIG. 1, found on VGAM2624 host target RNA, and schematic representation of the complementarity of each of these host target binding sites to VGAM2624 RNA, herein designated VGAM RNA, are described hereinbelow with reference to Table 2.

As mentioned hereinabove with reference to FIG. 1, a function of VGAM2624 gene, herein designated VGAM is inhibition of expression of VGAM2624 target genes. It is appreciated that specific functions, and accordingly utilities, of VGAM2624 correlate with, and may be deduced from, the identity of the target genes which VGAM2624 binds and inhibits, and the function of these target genes, as elaborated hereinbelow.

Platelet-derived Growth Factor Receptor, Beta Polypeptide (PDGFRB, Accession XM_038350) is a VGAM2624 host target gene. PDGFRB BINDING SITE is HOST TARGET binding site found in the 3' untranslated region of mRNA encoded by PDGFRB, corresponding to a HOST TARGET binding site such as BINDING SITE I, BINDING SITE II or BINDING SITE III. Table 2 illustrates the complementarity of the nucleotide sequences of PDGFRB BINDING SITE, designated SEQ ID:32818, to the nucleotide sequence of VGAM2624 RNA, herein designated VGAM RNA, also designated SEQ ID:5335.

A function of VGAM2624 is therefore inhibition of Platelet-derived Growth Factor Receptor, Beta Polypeptide (PDGFRB, Accession XM_038350), a gene which Platelet-derived growth factor receptor beta chain; tyrosine kinase receptor. Accordingly, utilities of VGAM2624 include diagnosis, prevention and treatment of diseases and clinical conditions associated with PDGFRB. The function of PDGFRB and its association with various diseases and clinical conditions, has been established by previous studies, as described hereinabove with reference to VGAM125. Ras Association (RalGDS/AF-6) Domain Family 1 (RASSF1, Accession NM_007182) is another VGAM2624 host target gene. RASSF1 BINDING SITE is HOST TARGET binding site found in the 3' untranslated region of mRNA encoded by RASSF1, corresponding to a HOST TARGET binding site such as BINDING SITE I, BINDING SITE II or BINDING SITE III. Table 2 illustrates the complementarity of the nucleotide sequences of RASSF1 BINDING SITE, designated SEQ ID:14039, to the nucleotide sequence of VGAM2624 RNA, herein designated VGAM RNA, also designated SEQ ID:5335.

Another function of VGAM2624 is therefore inhibition of Ras Association (RalGDS/AF-6) Domain Family 1 (RASSF1, Accession NM_007182), a gene which is a candidate renal tumor suppressor. Accordingly, utilities of VGAM2624 include diagnosis, prevention and treatment of diseases and clinical conditions associated with RASSF1. The function of RASSF1 and its association with various diseases and clinical conditions, has been established by previous studies, as described hereinabove with reference to VGAM1959. LOC157681 (Accession XM_088363) is another VGAM2624 host target gene. LOC157681 BINDING SITE is HOST TARGET binding site found in the 3' untranslated region of mRNA encoded by LOC157681, corresponding to a HOST TARGET binding site such as BINDING SITE I, BINDING SITE II or BINDING SITE III. Table 2 illustrates the complementarity of the nucleotide sequences of LOC157681 BINDING SITE, designated SEQ ID:39642, to the nucleotide sequence of VGAM2624 RNA, herein designated VGAM RNA, also designated SEQ ID:5335.

Another function of VGAM2624 is therefore inhibition of LOC157681 (Accession XM_088363). Accordingly, utilities of VGAM2624 include diagnosis, prevention and treatment of diseases and clinical conditions associated with LOC157681. LOC221431 (Accession XM_166380) is another VGAM2624 host target gene. LOC221431 BINDING SITE is HOST TARGET binding site found in the 3' untranslated region of mRNA encoded by LOC221431, corresponding to a HOST TARGET binding site such as BINDING SITE I, BINDING SITE II or BINDING SITE III. Table 2 illustrates the complementarity of the nucleotide sequences of LOC221431 BINDING SITE, designated SEQ ID:44225, to the nucleotide sequence of VGAM2624 RNA, herein designated VGAM RNA, also designated SEQ ID:5335.

Another function of VGAM2624 is therefore inhibition of LOC221431 (Accession XM_166380). Accordingly, utilities of VGAM2624 include diagnosis, prevention and treatment of diseases and clinical conditions associated with LOC221431. FIG. 1 further provides a conceptual description of a novel bioinformatically detected viral gene of the present invention, referred to here as Viral Genomic Address Messenger 2625 (VGAM2625) viral gene, which modulates expression of respective host target genes thereof, the function and utility of which host target genes is known in the art.

VGAM2625 is a novel bioinformatically detected regulatory, non protein coding, viral micro RNA (miRNA) gene. The method by which VGAM2625 was detected is described hereinabove with reference to FIGS. 1-8.

VGAM2625 gene, herein designated VGAM GENE, is a viral gene contained in the genome of A-2 Plaque Virus. VGAM2625 host target gene, herein designated VGAM HOST TARGET GENE, is a human gene contained in the human genome.

VGAM2625 gene encodes a VGAM2625 precursor RNA, herein designated VGAM PRECURSOR RNA. Similar to other miRNA genes, and unlike most ordinary genes, VGAM2625 precursor RNA does not encode a protein. A nucleotide sequence identical or highly similar to the nucleotide sequence of VGAM2625 precursor RNA is designated SEQ ID:2611, and is provided hereinbelow with reference to the sequence listing part. Nucleotide sequence SEQ ID:2611 is located at position 6077 relative to the genome of A-2 Plaque Virus.

VGAM2625 precursor RNA folds onto itself, forming VGAM2625 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2625 folded precursor RNA into VGAM2625 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2625 RNA is designated SEQ ID:5336, and is provided hereinbelow with reference to the sequence listing part.

VGAM2625 host target gene, herein designated VGAM HOST TARGET GENE, encodes a corresponding messenger RNA, VGAM2625 host target RNA, herein designated VGAM HOST TARGET RNA. VGAM2625 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2625 RNA, herein designated VGAM RNA, binds complementarily to one or more host target binding sites located in untranslated regions of VGAM2625 host target RNA, herein designated VGAM HOST TARGET RNA. This complementary binding is due to the fact that the nucleotide sequence of VGAM2625 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2625 RNA, herein designated VGAM RNA, may have a different number of host target binding sites in untranslated regions of a VGAM2625 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2625 RNA, herein designated VGAM RNA, to host target binding sites on VGAM2625 host target RNA, herein designated VGAM HOST TARGET RNA, such as BINDING SITE I, BINDING SITE II and BINDING SITE III, inhibits translation of VGAM2625 host target RNA into VGAM2625 host target protein, herein designated VGAM HOST TARGET PROTEIN. VGAM host target protein is therefore outlined by a broken line.

It is appreciated that VGAM2625 host target gene, herein designated VGAM HOST TARGET GENE, in fact represents a plurality of VGAM2625 host target genes. The mRNA of each one of this plurality of VGAM2625 host target genes comprises one or more host target binding sites, each having a nucleotide sequence which is at least partly complementary to VGAM2625 RNA, herein designated VGAM RNA, and which when bound by VGAM2625 RNA causes inhibition of translation of respective one or more VGAM2625 host target proteins.

It is further appreciated by one skilled in the art that the mode of translational inhibition illustrated by FIG. 1 with specific reference to translational inhibition exerted by VGAM2625 gene, herein designated VGAM GENE, on one or more VGAM2625 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2625 is inhibition of expression of host target genes, as part of a novel viral mechanism of attacking a host. Accordingly, utilities of VGAM2625 include diagnosis, prevention and treatment of viral infection by A-2 Plaque Virus. Specific functions, and accordingly utilities, of VGAM2625 correlate with, and may be deduced from, the identity of the host target genes which VGAM2625 binds and inhibits, and the function of these host target genes, as elaborated hereinbelow.

Nucleotide sequences of the VGAM2625 precursor RNA, herein designated VGAM PRECURSOR RNA, and of the 'diced' VGAM2625 RNA, herein designated VGAM RNA, and a schematic representation of the secondary folding of VGAM2625 folded precursor RNA, herein designated VGAM FOLDED PRECURSOR RNA, of VGAM2625 are further described hereinbelow with reference to Table 1.

Nucleotide sequences of host target binding sites, such as BINDING SITE-I, BINDING SITE-II and BINDING SITE-III of FIG. 1, found on VGAM2625 host target RNA, and schematic representation of the complementarity of each of these host target binding sites to VGAM2625 RNA, herein designated VGAM RNA, are described hereinbelow with reference to Table 2.

As mentioned hereinabove with reference to FIG. 1, a function of VGAM2625 gene, herein designated VGAM is inhibition of expression of VGAM2625 target genes. It is appreciated that specific functions, and accordingly utilities, of VGAM2625 correlate with, and may be deduced from, the identity of the target genes which VGAM2625 binds and inhibits, and the function of these target genes, as elaborated hereinbelow.

Potassium Voltage-gated Channel, Shaker-related Subfamily, Member 6 (KCNA6, Accession NM_002235) is a VGAM2625 host target gene. KCNA6 BINDING SITE is HOST TARGET binding site found in the 3' untranslated region of mRNA encoded by KCNA6, corresponding to a HOST TARGET binding site such as BINDING SITE I, BINDING SITE II or BINDING SITE III. Table 2 illustrates the complementarity of the nucleotide sequences of KCNA6 BINDING SITE, designated SEQ ID:8015, to the nucleotide sequence of VGAM2625 RNA, herein designated VGAM RNA, also designated SEQ ID:5336.

A function of VGAM2625 is therefore inhibition of Potassium Voltage-gated Channel, Shaker-related Subfamily, Member 6 (KCNA6, Accession NM_002235), a gene which mediates the voltage-dependent potassium ion permeability of excitable membranes. Accordingly, utilities of VGAM2625 include diagnosis, prevention and treatment of diseases and clinical conditions associated with KCNA6. The function of KCNA6 and its association with various diseases and clinical conditions, has been established by previous studies, as described hereinabove with reference to VGAM893. LOC161823 (Accession XM_091156) is another VGAM2625 host target gene. LOC161823 BINDING SITE is HOST TARGET binding site found in the 3' untranslated region of mRNA encoded by LOC161823, corresponding to a HOST TARGET binding site such as BINDING SITE I, BINDING SITE II or BINDING SITE III. Table 2 illustrates the complementarity of the nucleotide sequences of LOC161823 BINDING SITE, designated SEQ ID:40030, to the nucleotide sequence of VGAM2625 RNA, herein designated VGAM RNA, also designated SEQ ID:5336.

Another function of VGAM2625 is therefore inhibition of LOC161823 (Accession XM_091156). Accordingly, utilities of VGAM2625 include diagnosis, prevention and treatment of diseases and clinical conditions associated with LOC161823. FIG. 1 further provides a conceptual description of a novel bioinformatically detected viral gene of the present invention, referred to here as Viral Genomic Address Messenger 2626 (VGAM2626) viral gene, which modulates expression of respective host target genes thereof, the function and utility of which host target genes is known in the art.

VGAM2626 is a novel bioinformatically detected regulatory, non protein coding, viral micro RNA (miRNA) gene. The method by which VGAM2626 was detected is described hereinabove with reference to FIGS. 1-8.

VGAM2626 gene, herein designated VGAM GENE, is a viral gene contained in the genome of Avian Encephalomyelitis Virus. VGAM2626 host target gene, herein designated VGAM HOST TARGET GENE, is a human gene contained in the human genome.

VGAM2626 gene encodes a VGAM2626 precursor RNA, herein designated VGAM PRECURSOR RNA. Similar to other miRNA genes, and unlike most ordinary genes, VGAM2626 precursor RNA does not encode a protein. A nucleotide sequence identical or highly similar to the nucleotide sequence of VGAM2626 precursor RNA is designated SEQ ID:2612, and is provided hereinbelow with reference to the sequence listing part. Nucleotide sequence SEQ ID:2612 is located at position 6595 relative to the genome of Avian Encephalomyelitis Virus.

VGAM2626 precursor RNA folds onto itself, forming VGAM2626 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2626 folded precursor RNA into VGAM2626 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 48%) nucleotide sequence of VGAM2626 RNA is designated SEQ ID:5337, and is provided hereinbelow with reference to the sequence listing part.

VGAM2626 host target gene, herein designated VGAM HOST TARGET GENE, encodes a corresponding messenger RNA, VGAM2626 host target RNA, herein designated VGAM HOST TARGET RNA. VGAM2626 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2626 RNA, herein designated VGAM RNA, binds complementarily to one or more host target binding sites located in untranslated regions of VGAM2626 host target RNA, herein designated VGAM HOST TARGET RNA. This complementary binding is due to the fact that the nucleotide sequence of VGAM2626 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2626 RNA, herein designated VGAM RNA, may have a different number of host target binding sites in untranslated regions of a VGAM2626 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2626 RNA, herein designated VGAM RNA, to host target binding sites on VGAM2626 host target RNA, herein designated VGAM HOST TARGET RNA, such as BINDING SITE I, BINDING SITE II and BINDING SITE III, inhibits translation of VGAM2626 host target RNA into VGAM2626 host target protein, herein designated VGAM HOST TARGET PROTEIN. VGAM host target protein is therefore outlined by a broken line.

It is appreciated that VGAM2626 host target gene, herein designated VGAM HOST TARGET GENE, in fact represents a plurality of VGAM2626 host target genes. The mRNA of each one of this plurality of VGAM2626 host target genes comprises one or more host target binding sites, each having a nucleotide sequence which is at least partly complementary to VGAM2626 RNA, herein designated VGAM RNA, and which when bound by VGAM2626 RNA causes inhibition of translation of respective one or more VGAM2626 host target proteins.

It is further appreciated by one skilled in the art that the mode of translational inhibition illustrated by FIG. 1 with specific reference to translational inhibition exerted by VGAM2626 gene, herein designated VGAM GENE, on one or more VGAM2626 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2626 is inhibition of expression of host target genes, as part of a novel viral mechanism of attacking a host. Accordingly, utilities of VGAM2626 include diagnosis, prevention and treatment of viral infection by Avian Encephalomyelitis Virus. Specific functions, and accordingly utilities, of VGAM2626 correlate with, and may be deduced from, the identity of the host target genes which VGAM2626 binds and inhibits, and the function of these host target genes, as elaborated hereinbelow.

Nucleotide sequences of the VGAM2626 precursor RNA, herein designated VGAM PRECURSOR RNA, and of the 'diced' VGAM2626 RNA, herein designated VGAM RNA, and a schematic representation of the secondary folding of VGAM2626 folded precursor RNA, herein designated VGAM FOLDED PRECURSOR RNA, of VGAM2626 are further described hereinbelow with reference to Table 1.

Nucleotide sequences of host target binding sites, such as BINDING SITE-I, BINDING SITE-II and BINDING SITE-III of FIG. 1, found on VGAM2626 host target RNA, and schematic representation of the complementarity of each of these host target binding sites to VGAM2626 RNA, herein designated VGAM RNA, are described hereinbelow with reference to Table 2.

As mentioned hereinabove with reference to FIG. 1, a function of VGAM2626 gene, herein designated VGAM is inhibition of expression of VGAM2626 target genes. It is appreciated that specific functions, and accordingly utilities, of VGAM2626 correlate with, and may be deduced from, the identity of the target genes which VGAM2626 binds and inhibits, and the function of these target genes, as elaborated hereinbelow.

Potassium Voltage-gated Channel, Delayed-rectifier, Subfamily S, Member 2 (KCNS2, Accession XM_043106) is a VGAM2626 host target gene. KCNS2 BINDING SITE is HOST TARGET binding site found in the 3' untranslated region of mRNA encoded by KCNS2, corresponding to a HOST TARGET binding site such as BINDING SITE I, BINDING SITE II or BINDING SITE III. Table 2 illustrates the complementarity of the nucleotide sequences of KCNS2 BINDING SITE, designated SEQ ID:33899, to the nucleotide sequence of VGAM2626 RNA, herein designated VGAM RNA, also designated SEQ ID:5337.

A function of VGAM2626 is therefore inhibition of Potassium Voltage-gated Channel, Delayed-rectifier, Subfamily S, Member 2 (KCNS2, Accession XM_043106), a gene which mediates the voltage-dependent potassium ion permeability of excitable membranes. Accordingly, utilities of VGAM2626 include diagnosis, prevention and treatment of diseases and clinical conditions associated with KCNS2. The function of KCNS2 and its association with various diseases and clinical conditions, has been established by previous studies, as described hereinabove with reference to VGAM419. Transient Receptor Potential Cation Channel, Subfamily M, Member 2 (TRPM2, Accession NM_003307) is another VGAM2626 host target gene. TRPM2 BINDING SITE is HOST TARGET binding site found in the 3' untranslated region of mRNA encoded by TRPM2, corresponding to a HOST TARGET binding site such as BINDING SITE I, BINDING SITE II or BINDING SITE III. Table 2 illustrates the complementarity of the nucleotide sequences of TRPM2 BINDING SITE, designated SEQ ID:9311, to the nucleotide sequence of VGAM2626 RNA, herein designated VGAM RNA, also designated SEQ ID:5337.

Another function of VGAM2626 is therefore inhibition of Transient Receptor Potential Cation Channel, Subfamily M, Member 2 (TRPM2, Accession NM_003307), a gene which may be a calcium channel. Accordingly, utilities of VGAM2626 include diagnosis, prevention and treatment of diseases and clinical conditions associated with TRPM2. The function of TRPM2 and its association with various diseases and clinical conditions, has been established by previous studies, as described hereinabove with reference to VGAM1928. DKFZp434A1010 (Accession XM_049185) is another VGAM2626 host target gene. DKFZp434A1010 BINDING SITE is HOST TARGET binding site found in the 5' untranslated region of mRNA encoded by DKFZp434A1010, corresponding to a HOST TARGET binding site such as BINDING SITE I, BINDING SITE II or BINDING SITE III. Table 2 illustrates the complementarity of the nucleotide sequences of DKFZp434A1010 BINDING SITE, designated SEQ ID:35345, to the nucleotide sequence of VGAM2626 RNA, herein designated VGAM RNA, also designated SEQ ID:5337.

Another function of VGAM2626 is therefore inhibition of DKFZp434A1010 (Accession XM_049185). Accordingly, utilities of VGAM2626 include diagnosis, prevention and treatment of diseases and clinical conditions associated with DKFZp434A1010. FLJ11383 (Accession NM_024938) is another VGAM2626 host target gene. FLJ11383 BINDING SITE is HOST TARGET binding site found in the 3' untranslated region of mRNA encoded by FLJ11383, corresponding to a HOST TARGET binding site such as BINDING SITE I, BINDING SITE II or BINDING SITE III. Table 2 illustrates the complementarity of the nucleotide sequences of FLJ11383 BINDING SITE, designated SEQ ID:24480, to the nucleotide sequence of VGAM2626 RNA, herein designated VGAM RNA, also designated SEQ ID:5337.

Another function of VGAM2626 is therefore inhibition of FLJ11383 (Accession NM_024938). Accordingly, utilities of VGAM2626 include diagnosis, prevention and treatment of diseases and clinical conditions associated with FLJ11383. FLJ13102 (Accession NM_024887) is another VGAM2626 host target gene. FLJ13102 BINDING SITE is HOST TARGET binding site found in the 3' untranslated region of mRNA encoded by FLJ13102, corresponding to a HOST TARGET binding site such as BINDING SITE I, BINDING SITE II or BINDING SITE III. Table 2 illustrates the complementarity of the nucleotide sequences of FLJ13102 BINDING SITE, designated SEQ ID:24341, to the nucleotide sequence of VGAM2626 RNA, herein designated VGAM RNA, also designated SEQ ID:5337.

Another function of VGAM2626 is therefore inhibition of FLJ13102 (Accession NM_024887). Accordingly, utilities of VGAM2626 include diagnosis, prevention and treatment of diseases and clinical conditions associated with FLJ13102. KIAA0286 (Accession XM_043118) is another VGAM2626 host target gene. KIAA0286 BINDING SITE is HOST TARGET binding site found in the 3' untranslated region of mRNA encoded by KIAA0286, corresponding to a HOST TARGET binding site such as BINDING SITE I, BINDING SITE II or BINDING SITE III. Table 2 illustrates the complementarity of the nucleotide sequences of KIAA0286 BINDING SITE, designated SEQ ID:33906, to the nucleotide sequence of VGAM2626 RNA, herein designated VGAM RNA, also designated SEQ ID:5337.

Another function of VGAM2626 is therefore inhibition of KIAA0286 (Accession XM_043118). Accordingly, utilities of VGAM2626 include diagnosis, prevention and treatment of diseases and clinical conditions associated with KIAA0286. KIAA0737 (Accession NM_014828) is another VGAM2626 host target gene. KIAA0737 BINDING SITE is HOST TARGET binding site found in the 3' untranslated region of mRNA encoded by KIAA0737, corresponding to a HOST TARGET binding site such as BINDING SITE I, BINDING SITE II or BINDING SITE III. Table 2 illustrates the complementarity of the nucleotide sequences of KIAA0737 BINDING SITE, designated SEQ ID:16819, to the nucleotide sequence of VGAM2626 RNA, herein designated VGAM RNA, also designated SEQ ID:5337.

Another function of VGAM2626 is therefore inhibition of KIAA0737 (Accession NM_014828). Accordingly, utilities of VGAM2626 include diagnosis, prevention and treatment of diseases and clinical conditions associated with KIAA0737. MGC3020 (Accession NM_024048) is another VGAM2626 host target gene. MGC3020 BINDING SITE is HOST TARGET binding site found in the 3' untranslated region of mRNA encoded by MGC3020, corresponding to a HOST TARGET binding site such as BINDING SITE I, BINDING SITE II or BINDING SITE III. Table 2 illustrates the complementarity of the nucleotide sequences of MGC3020 BINDING SITE, designated SEQ ID:23482, to the nucleotide sequence of VGAM2626 RNA, herein designated VGAM RNA, also designated SEQ ID:5337.

Another function of VGAM2626 is therefore inhibition of MGC3020 (Accession NM_024048). Accordingly, utilities of VGAM2626 include diagnosis, prevention and treatment of diseases and clinical conditions associated with MGC3020. Protein Tyrosine Phosphatase Type IVA, Member 1 (PTP4A1, Accession NM_003463) is another VGAM2626 host target gene. PTP4A1 BINDING SITE is HOST TARGET binding site found in the 3' untranslated region of mRNA encoded by PTP4A1, corresponding to a HOST TARGET binding site such as BINDING SITE I, BINDING SITE II or BINDING SITE III. Table 2 illustrates the complementarity of the nucleotide sequences of PTP4A1 BINDING SITE, designated SEQ ID:9532, to the nucleotide sequence of VGAM2626 RNA, herein designated VGAM RNA, also designated SEQ ID:5337.

Another function of VGAM2626 is therefore inhibition of Protein Tyrosine Phosphatase Type IVA, Member 1 (PTP4A1, Accession NM_003463). Accordingly, utilities of VGAM2626 include diagnosis, prevention and treatment of diseases and clinical conditions associated with PTP4A1. LOC144519 (Accession XM_084890) is another VGAM2626 host target gene. LOC144519 BINDING SITE is HOST TARGET binding site found in the 3' untranslated region of mRNA encoded by LOC144519, corresponding to a HOST TARGET binding site such as BINDING SITE I, BINDING SITE II or BINDING SITE III. Table 2 illustrates the complementarity of the nucleotide sequences of LOC144519 BINDING SITE, designated SEQ ID:37758, to the nucleotide sequence of VGAM2626 RNA, herein designated VGAM RNA, also designated SEQ ID:5337.

Another function of VGAM2626 is therefore inhibition of LOC144519 (Accession XM_084890). Accordingly, utilities of VGAM2626 include diagnosis, prevention and treatment of diseases and clinical conditions associated with LOC144519. FIG. 1 further provides a conceptual description of a novel bioinformatically detected viral gene of the present invention, referred to here as Viral Genomic Address Messenger 2627 (VGAM2627) viral gene, which modulates expression of respective host target genes thereof, the function and utility of which host target genes is known in the art.

VGAM2627 is a novel bioinformatically detected regulatory, non protein coding, viral micro RNA (miRNA) gene. The method by which VGAM2627 was detected is described hereinabove with reference to FIGS. 1-8.

VGAM2627 gene, herein designated VGAM GENE, is a viral gene contained in the genome of Avian Encephalomyelitis Virus. VGAM2627 host target gene, herein designated VGAM HOST TARGET GENE, is a human gene contained in the human genome.

VGAM2627 gene encodes a VGAM2627 precursor RNA, herein designated VGAM PRECURSOR RNA. Similar to other miRNA genes, and unlike most ordinary genes, VGAM2627 precursor RNA does not encode a protein. A nucleotide sequence identical or highly similar to the nucleotide sequence of VGAM2627 precursor RNA is designated SEQ ID:2613, and is provided hereinbelow with reference to the sequence listing part. Nucleotide sequence SEQ ID:2613 is located at position 5436 relative to the genome of Avian Encephalomyelitis Virus.

VGAM2627 precursor RNA folds onto itself, forming VGAM2627 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2627 folded precursor RNA into VGAM2627 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2627 RNA is designated SEQ ID:5338, and is provided hereinbelow with reference to the sequence listing part.

VGAM2627 host target gene, herein designated VGAM HOST TARGET GENE, encodes a corresponding messenger RNA, VGAM2627 host target RNA, herein designated VGAM HOST TARGET RNA. VGAM2627 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2627 RNA, herein designated VGAM RNA, binds complementarily to one or more host target binding sites located in untranslated regions of VGAM2627 host target RNA, herein designated VGAM HOST TARGET RNA. This complementary binding is due to the fact that the nucleotide sequence of VGAM2627 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2627 RNA, herein designated VGAM RNA, may have a different number of host target binding sites in untranslated regions of a VGAM2627 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2627 RNA, herein designated VGAM RNA, to host target binding sites on VGAM2627 host target RNA, herein designated VGAM HOST TARGET RNA, such as BINDING SITE I, BINDING SITE II and BINDING SITE III, inhibits translation of VGAM2627 host target RNA into VGAM2627 host target protein, herein designated VGAM HOST TARGET PROTEIN. VGAM host target protein is therefore outlined by a broken line.

It is appreciated that VGAM2627 host target gene, herein designated VGAM HOST TARGET GENE, in fact represents a plurality of VGAM2627 host target genes. The mRNA of each one of this plurality of VGAM2627 host target genes comprises one or more host target binding sites, each having a nucleotide sequence which is at least partly complementary to VGAM2627 RNA, herein designated VGAM RNA, and which when bound by VGAM2627 RNA causes inhibition of translation of respective one or more VGAM2627 host target proteins.

It is further appreciated by one skilled in the art that the mode of translational inhibition illustrated by FIG. 1 with specific reference to translational inhibition exerted by VGAM2627 gene, herein designated VGAM GENE, on one or more VGAM2627 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2627 is inhibition of expression of host target genes, as part of a novel viral mechanism of attacking a host. Accordingly, utilities of VGAM2627 include diagnosis, prevention and treatment of viral infection by Avian Encephalomyelitis Virus. Specific functions, and accordingly utilities, of VGAM2627 correlate with, and may be deduced from, the identity of the host target genes which VGAM2627 binds and inhibits, and the function of these host target genes, as elaborated hereinbelow.

Nucleotide sequences of the VGAM2627 precursor RNA, herein designated VGAM PRECURSOR RNA, and of the 'diced' VGAM2627 RNA, herein designated VGAM RNA, and a schematic representation of the secondary folding of VGAM2627 folded precursor RNA, herein designated VGAM FOLDED PRECURSOR RNA, of VGAM2627 are further described hereinbelow with reference to Table 1.

Nucleotide sequences of host target binding sites, such as BINDING SITE-I, BINDING SITE-II and BINDING SITE-III of FIG. 1, found on VGAM2627 host target RNA, and schematic representation of the complementarity of each of these host target binding sites to VGAM2627 RNA, herein designated VGAM RNA, are described hereinbelow with reference to Table 2.

As mentioned hereinabove with reference to FIG. 1, a function of VGAM2627 gene, herein designated VGAM is inhibition of expression of VGAM2627 target genes. It is appreciated that specific functions, and accordingly utilities, of VGAM2627 correlate with, and may be deduced from, the identity of the target genes which VGAM2627 binds and inhibits, and the function of these target genes, as elaborated hereinbelow.

B-cell CLL/lymphoma 11B (zinc finger protein) (BCL11B, Accession NM_022898) is a VGAM2627 host target gene. BCL11B BINDING SITE is HOST TARGET binding site found in the 3' untranslated region of mRNA encoded by BCL11B, corresponding to a HOST TARGET binding site such as BINDING SITE I, BINDING SITE II or BINDING SITE III. Table 2 illustrates the complementarity of the nucleotide sequences of BCL11B BINDING SITE, designated SEQ ID:23166, to the nucleotide sequence of VGAM2627 RNA, herein designated VGAM RNA, also designated SEQ ID:5338.

A function of VGAM2627 is therefore inhibition of B-cell CLL/lymphoma 11B (zinc finger protein) (BCL11B, Accession NM_022898). Accordingly, utilities of VGAM2627 include diagnosis, prevention and treatment of diseases and clinical conditions associated with BCL11B. Corticotropin Releasing Hormone Receptor 1 (CRHR1, Accession NM_004382) is another VGAM2627 host target gene. CRHR1 BINDING SITE is HOST TARGET binding site found in the 3' untranslated region of mRNA encoded by CRHR1, corresponding to a HOST TARGET binding site such as BINDING SITE I, BINDING SITE II or BINDING SITE III. Table 2 illustrates the complementarity of the nucleotide sequences of CRHR1 BINDING SITE, designated SEQ ID:10604, to the nucleotide sequence of VGAM2627 RNA, herein designated VGAM RNA, also designated SEQ ID:5338.

Another function of VGAM2627 is therefore inhibition of Corticotropin Releasing Hormone Receptor 1 (CRHR1, Accession NM_004382), a gene which likely mediates physiological and behavioral response to stress. Accordingly, utilities of VGAM2627 include diagnosis, prevention and treatment of diseases and clinical conditions associated with CRHR1. The function of CRHR1 and its association with various diseases and clinical conditions, has been established by previous studies, as described hereinabove with reference to VGAM435. Enoyl-Coenzyme A, Hydratase/3-hydroxyacyl Coenzyme A Dehydrogenase (EHHADH, Accession NM_001966) is another VGAM2627 host target gene. EHHADH BINDING SITE is HOST TARGET binding site found in the 3' untranslated region of mRNA encoded by EHHADH, corresponding to a HOST TARGET binding site such as BINDING SITE I, BINDING SITE II or BINDING SITE III. Table 2 illustrates the complementarity of the nucleotide sequences of EHHADH BINDING SITE, designated SEQ ID:7694, to the nucleotide sequence of VGAM2627 RNA, herein designated VGAM RNA, also designated SEQ ID:5338.

Another function of VGAM2627 is therefore inhibition of Enoyl-Coenzyme A, Hydratase/3-hydroxyacyl Coenzyme A Dehydrogenase (EHHADH, Accession NM_001966), a gene which functions in the peroxisomal beta-oxidation pathway. Accordingly, utilities of VGAM2627 include diagnosis, prevention and treatment of diseases and clinical conditions associated with EHHADH. The function of EHHADH and its association with various diseases and clinical conditions, has been established by previous studies, as described hereinabove with reference to VGAM1959. F-box and WD-40 Domain Protein 1B (FBXW1B, Accession NM_012300) is another VGAM2627 host target gene. FBXW1B BINDING SITE1 through FBXW1B BINDING SITE3 are HOST TAR- GET binding sites found in untranslated regions of mRNA encoded by FBXW1B, corresponding to HOST TARGET binding sites such as BINDING SITE I, BINDING SITE II or BINDING SITE III. Table 2 illustrates the complementarity of the nucleotide sequences of FBXW1B BINDING SITE1 through FBXW1B BINDING SITE3, designated SEQ ID:14663, SEQ ID:27365 and SEQ ID:27375 respectively, to the nucleotide sequence of VGAM2627 RNA, herein designated VGAM RNA, also designated SEQ ID:5338.

Another function of VGAM2627 is therefore inhibition of F-box and WD-40 Domain Protein 1B (FBXW1B, Accession NM_012300), a gene which somehow is involved in the process of neuronal cell differentiation or brain development. Accordingly, utilities of VGAM2627 include diagnosis, prevention and treatment of diseases and clinical conditions associated with FBXW1B. The function of FBXW1B and its association with various diseases and clinical conditions, has been established by previous studies, as described hereinabove with reference to VGAM25. Muscleblind-like (Drosophila) (MBNL, Accession NM_021038) is another VGAM2627 host target gene. MBNL BINDING SITE is HOST TARGET binding site found in the 5' untranslated region of mRNA encoded by MBNL, corresponding to a HOST TARGET binding site such as BINDING SITE I, BINDING SITE II or BINDING SITE III. Table 2 illustrates the complementarity of the nucleotide sequences of MBNL BINDING SITE, designated SEQ ID:22023, to the nucleotide sequence of VGAM2627 RNA, herein designated VGAM RNA, also designated SEQ ID:5338.

Another function of VGAM2627 is therefore inhibition of Muscleblind-like (Drosophila) (MBNL, Accession NM_021038), a gene which binds to cug triplet repeat expansion dsrna (by similarity). Accordingly, utilities of VGAM2627 include diagnosis, prevention and treatment of diseases and clinical conditions associated with MBNL. The function of MBNL and its association with various diseases and clinical conditions, has been established by previous studies, as described hereinabove with reference to VGAM95. Phosphorylase Kinase, Alpha 2 (liver) (PHKA2, Accession NM_000292) is another VGAM2627 host target gene. PHKA2 BINDING SITE is HOST TARGET binding site found in the 3' untranslated region of mRNA encoded by PHKA2, corresponding to a HOST TARGET binding site such as BINDING SITE I, BINDING SITE II or BINDING SITE III. Table 2 illustrates the complementarity of the nucleotide sequences of PHKA2 BINDING SITE, designated SEQ ID:5834, to the nucleotide sequence of VGAM2627 RNA, herein designated VGAM RNA, also designated SEQ ID:5338.

Another function of VGAM2627 is therefore inhibition of Phosphorylase Kinase, Alpha 2 (liver) (PHKA2, Accession NM_000292). Accordingly, utilities of VGAM2627 include diagnosis, prevention and treatment of diseases and clinical conditions associated with PHKA2. Protein Tyrosine Phosphatase, Receptor Type, O (PTPRO, Accession NM_002848) is another VGAM2627 host target gene. PTPRO BINDING SITE1 through PTPRO BINDING SITE5 are HOST TARGET binding sites found in untranslated regions of mRNA encoded by PTPRO, corresponding to HOST TARGET binding sites such as BINDING SITE I, BINDING SITE II or BINDING SITE III. Table 2 illustrates the complementarity of the nucleotide sequences of PTPRO BINDING SITE1 through PTPRO BINDING SITE5, designated SEQ ID:8741, SEQ ID:25034, SEQ ID:25006, SEQ ID:25014 and SEQ ID:25023 respectively, to the nucleotide sequence of VGAM2627 RNA, herein designated VGAM RNA, also designated SEQ ID:5338.

Another function of VGAM2627 is therefore inhibition of Protein Tyrosine Phosphatase, Receptor Type, O (PTPRO, Accession NM_002848), a gene which may function as a cell contact receptor that mediates and controls cell-cell signals. Accordingly, utilities of VGAM2627 include diagnosis, prevention and treatment of diseases and clinical conditions associated with PTPRO. The function of PTPRO and its association with various diseases and clinical conditions, has been established by previous studies, as described hereinabove with reference to VGAM140. Transmembrane 4 Superfamily Member 6 (TM4SF6, Accession NM_003270) is another VGAM2627 host target gene. TM4SF6 BINDING SITE is HOST TARGET binding site found in the 3' untranslated region of mRNA encoded by TM4SF6, corresponding to a HOST TARGET binding site such as BINDING SITE I, BINDING SITE II or BINDING SITE III. Table 2 illustrates the complementarity of the nucleotide sequences of TM4SF6 BINDING SITE, designated SEQ ID:9285, to the nucleotide sequence of VGAM2627 RNA, herein designated VGAM RNA, also designated SEQ ID:5338.

Another function of VGAM2627 is therefore inhibition of Transmembrane 4 Superfamily Member 6 (TM4SF6, Accession NM_003270), a gene which plays a role in the regulation of cell development, activation, growth and motility. Accordingly, utilities of VGAM2627 include diagnosis, prevention and treatment of diseases and clinical conditions associated with TM4SF6. The function of TM4SF6 and its association with various diseases and clinical conditions, has been established by previous studies, as described hereinabove with reference to VGAM84. DKFZP564K0822 (Accession XM_168378) is another VGAM2627 host target gene. DKFZP564K0822 BINDING SITE is HOST TARGET binding site found in the 3' untranslated region of mRNA encoded by DKFZP564K0822, corresponding to a HOST TARGET binding site such as BINDING SITE I, BINDING SITE II or BINDING SITE III. Table 2 illustrates the complementarity of the nucleotide sequences of DKFZP564K0822 BINDING SITE, designated SEQ ID:45139, to the nucleotide sequence of VGAM2627 RNA, herein designated VGAM RNA, also designated SEQ ID:5338.

Another function of VGAM2627 is therefore inhibition of DKFZP564K0822 (Accession XM_168378). Accordingly, utilities of VGAM2627 include diagnosis, prevention and treatment of diseases and clinical conditions associated with DKFZP564K0822. FLJ10856 (Accession NM_018247) is another VGAM2627 host target gene. FLJ10856 BINDING SITE is HOST TARGET binding site found in the 3' untranslated region of mRNA encoded by FLJ10856, corresponding to a HOST TARGET binding site such as BINDING SITE I, BINDING SITE II or BINDING SITE III. Table 2 illustrates the complementarity of the nucleotide sequences of FLJ10856 BINDING SITE, designated SEQ ID:20217, to the nucleotide sequence of VGAM2627 RNA, herein designated VGAM RNA, also designated SEQ ID:5338.

Another function of VGAM2627 is therefore inhibition of FLJ10856 (Accession NM_018247). Accordingly, utilities of VGAM2627 include diagnosis, prevention and treatment of diseases and clinical conditions associated with FLJ10856. KIAA0087 (Accession NM_014769) is another VGAM2627 host target gene. KIAA0087 BINDING SITE is HOST TARGET binding site found in the 3' untranslated region of mRNA encoded by KIAA0087, corresponding to a HOST TARGET binding site such as BINDING SITE I, BINDING SITE II or BINDING SITE III. Table 2 illustrates the complementarity of the nucleotide sequences of KIAA0087 BINDING SITE, designated SEQ ID:16559, to the nucleotide sequence of VGAM2627 RNA, herein designated VGAM RNA, also designated SEQ ID:5338.

Another function of VGAM2627 is therefore inhibition of KIAA0087 (Accession NM_014769). Accordingly, utilities of VGAM2627 include diagnosis, prevention and treatment of diseases and clinical conditions associated with KIAA0087. KIAA0461 (Accession XM_047883) is another VGAM2627 host target gene. KIAA0461 BINDING SITE is HOST TARGET binding site found in the 3' untranslated region of mRNA encoded by KIAA0461, corresponding to a HOST TARGET binding site such as BINDING SITE I, BINDING SITE II or BINDING SITE III. Table 2 illustrates the complementarity of the nucleotide sequences of KIAA0461 BINDING SITE, designated SEQ ID:35070, to the nucleotide sequence of VGAM2627 RNA, herein designated VGAM RNA, also designated SEQ ID:5338.

Another function of VGAM2627 is therefore inhibition of KIAA0461 (Accession XM_047883). Accordingly, utilities of VGAM2627 include diagnosis, prevention and treatment of diseases and clinical conditions associated with KIAA0461. KIAA1319 (Accession NM_020770) is another VGAM2627 host target gene. KIAA1319 BINDING SITE is HOST TARGET binding site found in the 3' untranslated region of mRNA encoded by KIAA1319, corresponding to a HOST TARGET binding site such as BINDING SITE I, BINDING SITE II or BINDING SITE III. Table 2 illustrates the complementarity of the nucleotide sequences of KIAA1319 BINDING SITE, designated SEQ ID:21868, to the nucleotide sequence of VGAM2627 RNA, herein designated VGAM RNA, also designated SEQ ID:5338.

Another function of VGAM2627 is therefore inhibition of KIAA1319 (Accession NM_020770). Accordingly, utilities of VGAM2627 include diagnosis, prevention and treatment of diseases and clinical conditions associated with KIAA1319. KIAA1954 (Accession XM_085375) is another VGAM2627 host target gene. KIAA1954 BINDING SITE is HOST TARGET binding site found in the 3' untranslated region of mRNA encoded by KIAA1954, corresponding to a HOST TARGET binding site such as BINDING SITE I, BINDING SITE II or BINDING SITE III. Table 2 illustrates the complementarity of the nucleotide sequences of KIAA1954 BINDING SITE, designated SEQ ID:38092, to the nucleotide sequence of VGAM2627 RNA, herein designated VGAM RNA, also designated SEQ ID:5338.

Another function of VGAM2627 is therefore inhibition of KIAA1954 (Accession XM_085375). Accordingly, utilities of VGAM2627 include diagnosis, prevention and treatment of diseases and clinical conditions associated with KIAA1954. Protein Tyrosine Phosphatase, Receptor Type, N Polypeptide 2 (PTPRN2, Accession NM_130842) is another VGAM2627 host target gene. PTPRN2 BINDING SITE1 and PTPRN2 BINDING SITE2 are HOST TARGET binding sites found in untranslated regions of mRNA encoded by PTPRN2, corresponding to HOST TARGET binding sites such as BINDING SITE I, BINDING SITE II or BINDING SITE III. Table 2 illustrates the complementarity of the nucleotide sequences of PTPRN2 BINDING SITE1 and PTPRN2 BINDING SITE2, designated SEQ ID:28369 and SEQ ID:28374 respectively, to the nucleotide sequence of VGAM2627 RNA, herein designated VGAM RNA, also designated SEQ ID:5338.

Another function of VGAM2627 is therefore inhibition of Protein Tyrosine Phosphatase, Receptor Type, N Polypeptide 2 (PTPRN2, Accession NM_130842). Accordingly, utilities of VGAM2627 include diagnosis, prevention and treatment of diseases and clinical conditions associated with PTPRN2. SCAMP5 (Accession NM_138967) is another VGAM2627 host target gene. SCAMP5 BINDING SITE is HOST TARGET binding site found in the 3' untranslated region of mRNA encoded by SCAMP5, corresponding to a HOST TARGET binding site such as BINDING SITE I, BINDING SITE II or BINDING SITE III. Table 2 illustrates the complementarity of the nucleotide sequences of SCAMP5 BINDING SITE, designated SEQ ID:29071, to the nucleotide sequence of VGAM2627 RNA, herein designated VGAM RNA, also designated SEQ ID:5338.

Another function of VGAM2627 is therefore inhibition of SCAMP5 (Accession NM_138967). Accordingly, utilities of VGAM2627 include diagnosis, prevention and treatment of diseases and clinical conditions associated with SCAMP5. ZNF-U69274 (Accession NM_014415) is another VGAM2627 host target gene. ZNF-U69274 BINDING SITE is HOST TARGET binding site found in the 3' untranslated region of mRNA encoded by ZNF-U69274, corresponding to a HOST TARGET binding site such as BINDING SITE I, BINDING SITE II or BINDING SITE III. Table 2 illustrates the complementarity of the nucleotide sequences of ZNF-U69274 BINDING SITE, designated SEQ ID:15760, to the nucleotide sequence of VGAM2627 RNA, herein designated VGAM RNA, also designated SEQ ID:5338.

Another function of VGAM2627 is therefore inhibition of ZNF-U69274 (Accession NM_014415). Accordingly, utilities of VGAM2627 include diagnosis, prevention and treatment of diseases and clinical conditions associated with ZNF-U69274. Zinc Finger Protein 304 (ZNF304, Accession NM_020657) is another VGAM2627 host target gene. ZNF304 BINDING SITE is HOST TARGET binding site found in the 3' untranslated region of mRNA encoded by ZNF304, corresponding to a HOST TARGET binding site such as BINDING SITE I, BINDING SITE II or BINDING SITE III. Table 2 illustrates the complementarity of the nucleotide sequences of ZNF304 BINDING SITE, designated SEQ ID:21830, to the nucleotide sequence of VGAM2627 RNA, herein designated VGAM RNA, also designated SEQ ID:5338.

Another function of VGAM2627 is therefore inhibition of Zinc Finger Protein 304 (ZNF304, Accession NM_020657). Accordingly, utilities of VGAM2627 include diagnosis, prevention and treatment of diseases and clinical conditions associated with ZNF304. LOC120856 (Accession XM_058509) is another VGAM2627 host target gene. LOC120856 BINDING SITE is HOST TARGET binding site found in the 3' untranslated region of mRNA encoded by LOC120856, corresponding to a HOST TARGET binding site such as BINDING SITE I, BINDING SITE II or BINDING SITE III. Table 2 illustrates the complementarity of the nucleotide sequences of LOC120856 BINDING SITE, designated SEQ ID:36639, to the nucleotide sequence of VGAM2627 RNA, herein designated VGAM RNA, also designated SEQ ID:5338.

Another function of VGAM2627 is therefore inhibition of LOC120856 (Accession XM_058509). Accordingly, utilities of VGAM2627 include diagnosis, prevention and treatment of diseases and clinical conditions associated with LOC120856. LOC128844 (Accession XM_066199) is another VGAM2627 host target gene. LOC128844 BINDING SITE is HOST TARGET binding site found in the 5' untranslated region of mRNA encoded by LOC128844, corresponding to a HOST TARGET binding site such as BINDING SITE I, BINDING SITE II or BINDING SITE III. Table 2 illustrates the complementarity of the nucleotide sequences of LOC128844 BINDING SITE, designated SEQ ID:37319, to the nucleotide sequence of VGAM2627 RNA, herein designated VGAM RNA, also designated SEQ ID:5338.

Another function of VGAM2627 is therefore inhibition of LOC128844 (Accession XM_066199). Accordingly, utilities of VGAM2627 include diagnosis, prevention and treatment of diseases and clinical conditions associated with LOC128844. LOC161734 (Accession XM_102109) is another VGAM2627 host target gene. LOC161734 BINDING SITE is HOST TARGET binding site found in the 3' untranslated region of mRNA encoded by LOC161734, corresponding to a HOST TARGET binding site such as BINDING SITE I, BINDING SITE II or BINDING SITE III. Table 2 illustrates the complementarity of the nucleotide sequences of LOC161734 BINDING SITE, designated SEQ ID:42109, to the nucleotide sequence of VGAM2627 RNA, herein designated VGAM RNA, also designated SEQ ID:5338.

Another function of VGAM2627 is therefore inhibition of LOC161734 (Accession XM_102109). Accordingly, utilities of VGAM2627 include diagnosis, prevention and treatment of diseases and clinical conditions associated with LOC161734. LOC219445 (Accession XM_166212) is another VGAM2627 host target gene. LOC219445 BINDING SITE is HOST TARGET binding site found in the 3' untranslated region of mRNA encoded by LOC219445, corresponding to a HOST TARGET binding site such as BINDING SITE I, BINDING SITE II or BINDING SITE III. Table 2 illustrates the complementarity of the nucleotide sequences of LOC219445 BINDING SITE, designated SEQ ID:44012, to the nucleotide sequence of VGAM2627 RNA, herein designated VGAM RNA, also designated SEQ ID:5338.

Another function of VGAM2627 is therefore inhibition of LOC219445 (Accession XM_166212). Accordingly, utilities of VGAM2627 include diagnosis, prevention and treatment of diseases and clinical conditions associated with LOC219445. FIG. 1 further provides a conceptual description of a novel bioinformatically detected viral gene of the present invention, referred to here as Viral Genomic Address Messenger 2628 (VGAM2628) viral gene, which modulates expression of respective host target genes thereof, the function and utility of which host target genes is known in the art.

VGAM2628 is a novel bioinformatically detected regulatory, non protein coding, viral micro RNA (miRNA) gene. The method by which VGAM2628 was detected is described hereinabove with reference to FIGS. 1-8.

VGAM2628 gene, herein designated VGAM GENE, is a viral gene contained in the genome of Avian Encephalomyelitis Virus. VGAM2628 host target gene, herein designated VGAM HOST TARGET GENE, is a human gene contained in the human genome.

VGAM2628 gene encodes a VGAM2628 precursor RNA, herein designated VGAM PRECURSOR RNA. Similar to other miRNA genes, and unlike most ordinary genes, VGAM2628 precursor RNA does not encode a protein. A nucleotide sequence identical or highly similar to the nucleotide sequence of VGAM2628 precursor RNA is designated SEQ ID:2614, and is provided hereinbelow with reference to the sequence listing part. Nucleotide sequence SEQ ID:2614 is located at position 4961 relative to the genome of Avian Encephalomyelitis Virus.

VGAM2628 precursor RNA folds onto itself, forming VGAM2628 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2628 folded precursor RNA into VGAM2628 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2628 RNA is designated SEQ ID:5339, and is provided hereinbelow with reference to the sequence listing part.

VGAM2628 host target gene, herein designated VGAM HOST TARGET GENE, encodes a corresponding messenger RNA, VGAM2628 host target RNA, herein designated VGAM HOST TARGET RNA. VGAM2628 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2628 RNA, herein designated VGAM RNA, binds complementarily to one or more host target binding sites located in untranslated regions of VGAM2628 host target RNA, herein designated VGAM HOST TARGET RNA. This complementary binding is due to the fact that the nucleotide sequence of VGAM2628 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2628 RNA, herein designated VGAM RNA, may have a different number of host target binding sites in untranslated regions of a VGAM2628 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2628 RNA, herein designated VGAM RNA, to host target binding sites on VGAM2628 host target RNA, herein designated VGAM HOST TARGET RNA, such as BINDING SITE I, BINDING SITE II and BINDING SITE III, inhibits translation of VGAM2628 host target RNA into VGAM2628 host target protein, herein designated VGAM HOST TARGET PROTEIN. VGAM host target protein is therefore outlined by a broken line.

It is appreciated that VGAM2628 host target gene, herein designated VGAM HOST TARGET GENE, in fact represents a plurality of VGAM2628 host target genes. The mRNA of each one of this plurality of VGAM2628 host target genes comprises one or more host target binding sites, each having a nucleotide sequence which is at least partly complementary to VGAM2628 RNA, herein designated VGAM RNA, and which when bound by VGAM2628 RNA causes inhibition of translation of respective one or more VGAM2628 host target proteins.

It is further appreciated by one skilled in the art that the mode of translational inhibition illustrated by FIG. 1 with specific reference to translational inhibition exerted by VGAM2628 gene, herein designated VGAM GENE, on one or more VGAM2628 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2628 is inhibition of expression of host target genes, as part of a novel viral mechanism of attacking a host. Accordingly, utilities of VGAM2628 include diagnosis, prevention and treatment of viral infection by Avian Encephalomyelitis Virus. Specific functions, and accordingly utilities, of VGAM2628 correlate with, and may be deduced from, the identity of the host target genes which VGAM2628 binds and inhibits, and the function of these host target genes, as elaborated hereinbelow.

Nucleotide sequences of the VGAM2628 precursor RNA, herein designated VGAM PRECURSOR RNA, and of the 'diced' VGAM2628 RNA, herein designated VGAM RNA, and a schematic representation of the secondary folding of VGAM2628 folded precursor RNA, herein designated VGAM FOLDED PRECURSOR RNA, of VGAM2628 are further described hereinbelow with reference to Table 1.

Nucleotide sequences of host target binding sites, such as BINDING SITE-I, BINDING SITE-II and BINDING SITE-III of FIG. 1, found on VGAM2628 host target RNA, and schematic representation of the complementarity of each of these host target binding sites to VGAM2628 RNA, herein designated VGAM RNA, are described hereinbelow with reference to Table 2.

As mentioned hereinabove with reference to FIG. 1, a function of VGAM2628 gene, herein designated VGAM is inhibition of expression of VGAM2628 target genes. It is appreciated that specific functions, and accordingly utilities, of VGAM2628 correlate with, and may be deduced from, the identity of the target genes which VGAM2628 binds and inhibits, and the function of these target genes, as elaborated hereinbelow.

Amiloride Binding Protein 1 (amine oxidase (copper-containing)) (ABP1, Accession XM_032220) is a VGAM2628 host target gene. ABP1 BINDING SITE is HOST TARGET binding site found in the 3' untranslated region of mRNA encoded by ABP1, corresponding to a HOST TARGET binding site such as BINDING SITE I, BINDING SITE II or BINDING SITE III. Table 2 illustrates the complementarity of the nucleotide sequences of ABP1 BINDING SITE, designated SEQ ID:31614, to the nucleotide sequence of VGAM2628 RNA, herein designated VGAM RNA, also designated SEQ ID:5339.

A function of VGAM2628 is therefore inhibition of Amiloride Binding Protein 1 (amine oxidase (copper-containing)) (ABP1, Accession XM_032220), a gene which catalyzes the degradation of compounds such as putrescine. Accordingly, utilities of VGAM2628 include diagnosis, prevention and treatment of diseases and clinical conditions associated with ABP1. The function of ABP1 and its association with various diseases and clinical conditions, has been established by previous studies, as described hereinabove with reference to VGAM1958. A Kinase (PRKA) Anchor Protein 2 (AKAP2, Accession NM_007203) is another VGAM2628 host target gene. AKAP2 BINDING SITE is HOST TARGET binding site found in the 3' untranslated region of mRNA encoded by AKAP2, corresponding to a HOST TARGET binding site such as BINDING SITE I, BINDING SITE II or BINDING SITE III. Table 2 illustrates the complementarity of the nucleotide sequences of AKAP2 BINDING SITE, designated SEQ ID:14059, to the nucleotide sequence of VGAM2628 RNA, herein designated VGAM RNA, also designated SEQ ID:5339.

Another function of VGAM2628 is therefore inhibition of A Kinase (PRKA) Anchor Protein 2 (AKAP2, Accession NM_007203), a gene which binds to regulatory subunit (rii) of protein kinase a. Accordingly, utilities of VGAM2628 include diagnosis, prevention and treatment of diseases and clinical conditions associated with AKAP2. The function of AKAP2 and its association with various diseases and clinical conditions, has been established by previous studies, as described hereinabove with reference to VGAM18. Centrin, EF-hand Protein, 1 (CETN1, Accession XM_170866) is another VGAM2628 host target gene. CETN1 BINDING SITE is HOST TARGET binding site found in the 3' untranslated region of mRNA encoded by CETN1, corresponding to a HOST TARGET binding site such as BINDING SITE I, BINDING SITE II or BINDING SITE III. Table 2 illustrates the complementarity of the nucleotide sequences of CETN1 BINDING SITE, designated SEQ ID:45638, to the nucleotide sequence of VGAM2628 RNA, herein designated VGAM RNA, also designated SEQ ID:5339.

Another function of VGAM2628 is therefore inhibition of Centrin, EF-hand Protein, 1 (CETN1, Accession XM_170866). Accordingly, utilities of VGAM2628 include diagnosis, prevention and treatment of diseases and clinical conditions associated with CETN1. Erythrocyte Membrane Protein Band 4.1 (elliptocytosis 1, RH-linked) (EPB41, Accession NM_004437) is another VGAM2628 host target gene. EPB41 BINDING SITE is HOST TARGET binding site found in the 5' untranslated region of mRNA encoded by EPB41, corresponding to a HOST TARGET binding site such as BINDING SITE I, BINDING SITE II or BINDING SITE III. Table 2 illustrates the complementarity of the nucleotide sequences of EPB41 BINDING SITE, designated SEQ ID:10721, to the nucleotide sequence of VGAM2628 RNA, herein designated VGAM RNA, also designated SEQ ID:5339.

Another function of VGAM2628 is therefore inhibition of Erythrocyte Membrane Protein Band 4.1 (elliptocytosis 1, RH-linked) (EPB41, Accession NM_004437), a gene which protein 4.1 is a major structural element of the erythrocyte membrane skeleton. it plays a key role in regulating membrane physical properties of mechanical stability and deformability by stabilizing spectrin-actin interaction. binds with a high affinity to glycophorin and with lower affinity to band iii protein. associates with the nuclear mitotic apparatus. Accordingly, utilities of VGAM2628 include diagnosis, prevention and treatment of diseases and clinical conditions associated with EPB41. The function of EPB41 and its association with various diseases and clinical conditions, has been established by previous studies, as described hereinabove with reference to VGAM1709. Follistatin-like 1 (FSTL1, Accession NM_007085) is another VGAM2628 host target gene. FSTL1 BINDING SITE is HOST TARGET binding site found in the 3' untranslated region of mRNA encoded by FSTL1, corresponding to a HOST TARGET binding site such as BINDING SITE I, BINDING SITE II or BINDING SITE III. Table 2 illustrates the complementarity of the nucleotide sequences of FSTL1 BINDING SITE, designated SEQ ID:13948, to the nucleotide sequence of VGAM2628 RNA, herein designated VGAM RNA, also designated SEQ ID:5339.

Another function of VGAM2628 is therefore inhibition of Follistatin-like 1 (FSTL1, Accession NM_007085), a gene which may modulate the action of some growth factors on cell proliferation and differentiation. Accordingly, utilities of VGAM2628 include diagnosis, prevention and treatment of diseases and clinical conditions associated with FSTL1. The function of FSTL1 and its association with various diseases and clinical conditions, has been established by previous studies, as described hereinabove with reference to VGAM791. Glutamate Receptor, Metabotropic 4 (GRM4, Accession NM_000841) is another VGAM2628 host target gene. GRM4 BINDING SITE is HOST TARGET binding site found in the 3' untranslated region of mRNA encoded by GRM4, corresponding to a HOST TARGET binding site such as BINDING SITE I, BINDING SITE II or BINDING SITE III. Table 2 illustrates the complementarity of the nucleotide sequences of GRM4 BINDING SITE, designated SEQ ID:6502, to the nucleotide sequence of VGAM2628 RNA, herein designated VGAM RNA, also designated SEQ ID:5339.

Another function of VGAM2628 is therefore inhibition of Glutamate Receptor, Metabotropic 4 (GRM4, Accession NM_000841), a gene which is mediated by a g-protein that inhibits adenylate cyclase activity. Accordingly, utilities of VGAM2628 include diagnosis, prevention and treatment of diseases and clinical conditions associated with GRM4. The function of GRM4 and its association with various diseases and clinical conditions, has been established by previous studies, as described hereinabove with reference to VGAM1052. Methyltransferase-like 1 (METTL1, Accession NM_023032) is another VGAM2628 host target gene. METTL1 BINDING SITE1 and METTL1 BINDING SITE2 are HOST TARGET binding sites found in untranslated regions of mRNA encoded by METTL1, corresponding to HOST TARGET binding sites such as BINDING SITE I, BINDING SITE II or BINDING SITE III. Table 2 illustrates the complementarity of the nucleotide sequences of METTL1 BINDING SITE1 and METTL1 BINDING SITE2, designated SEQ ID:23305 and SEQ ID:23310 respectively, to the nucleotide sequence of VGAM2628 RNA, herein designated VGAM RNA, also designated SEQ ID:5339.

Another function of VGAM2628 is therefore inhibition of Methyltransferase-like 1 (METTL1, Accession NM_023032). Accordingly, utilities of VGAM2628 include diagnosis, prevention and treatment of diseases and clinical conditions associated with METTL1. Neuroligin 1 (NLGN1, Accession NM_014932) is another VGAM2628 host target gene. NLGN1 BINDING SITE is HOST TARGET binding site found in the 5' untranslated region of mRNA encoded by NLGN1, corresponding to a HOST TARGET binding site such as BINDING SITE I, BINDING SITE II or BINDING SITE III. Table 2 illustrates the complementarity of the nucleotide sequences of NLGN1 BINDING SITE, designated SEQ ID:17229, to the nucleotide sequence of VGAM2628 RNA, herein designated VGAM RNA, also designated SEQ ID:5339.

Another function of VGAM2628 is therefore inhibition of Neuroligin 1 (NLGN1, Accession NM_014932), a gene which may trigger the de novo formation of presynaptic structure. Accordingly, utilities of VGAM2628 include diagnosis, prevention and treatment of diseases and clinical conditions associated with NLGN1. The function of NLGN1 and its association with various diseases and clinical conditions, has been established by previous studies, as described hereinabove with reference to VGAM659.5'-nucleotidase, Cytosolic II (NT5C2, Accession NM_012229) is another VGAM2628 host target gene. NT5C2 BINDING SITE is HOST TARGET binding site found in the 3' untranslated region of mRNA encoded by NT5C2, corresponding to a HOST TARGET binding site such as BINDING SITE I, BINDING SITE II or BINDING SITE III. Table 2 illustrates the complementarity of the nucleotide sequences of NT5C2 BINDING SITE, designated SEQ ID:14526, to the nucleotide sequence of VGAM2628 RNA, herein designated VGAM RNA, also designated SEQ ID:5339.

Another function of VGAM2628 is therefore inhibition of 5'-nucleotidase, Cytosolic II (NT5C2, Accession NM_012229). Accordingly, utilities of VGAM2628 include diagnosis, prevention and treatment of diseases and clinical conditions associated with NT5C2. Proprotein Convertase Subtilisin/kexin Type 2 (PCSK2, Accession NM_002594) is another VGAM2628 host target gene. PCSK2 BINDING SITE is HOST TARGET binding site found in the 3' untranslated region of mRNA encoded by PCSK2, corresponding to a HOST TARGET binding site such as BINDING SITE I, BINDING SITE II or BINDING SITE III. Table 2 illustrates the complementarity of the nucleotide sequences of PCSK2 BINDING SITE, designated SEQ ID:8453, to the nucleotide sequence of VGAM2628 RNA, herein designated VGAM RNA, also designated SEQ ID:5339.

Another function of VGAM2628 is therefore inhibition of Proprotein Convertase Subtilisin/kexin Type 2 (PCSK2, Accession NM_002594), a gene which is involved in the processing of hormone and other protein precursors at sites comprised of pairs of basic amino acid residues. Accordingly, utilities of VGAM2628 include diagnosis, prevention and treatment of diseases and clinical conditions associated with PCSK2. The function of PCSK2 and its association with various diseases and clinical conditions, has been established by previous studies, as described hereinabove with reference to VGAM1120. BHC80 (Accession NM_016621) is another VGAM2628 host target gene. BHC80 BINDING SITE is HOST TARGET binding site found in the 3' untranslated region of mRNA encoded by BHC80, corresponding to a HOST TARGET binding site such as BINDING SITE I, BINDING SITE II or BINDING SITE III. Table 2 illustrates the complementarity of the nucleotide sequences of BHC80 BINDING SITE, designated SEQ ID:18728, to the nucleotide sequence of VGAM2628 RNA, herein designated VGAM RNA, also designated SEQ ID:5339.

Another function of VGAM2628 is therefore inhibition of BHC80 (Accession NM_016621). Accordingly, utilities of VGAM2628 include diagnosis, prevention and treatment of diseases and clinical conditions associated with BHC80. Baculoviral IAP Repeat-containing 3 (BIRC3, Accession XM_040715) is another VGAM2628 host target gene. BIRC3 BINDING SITE is HOST TARGET binding site found in the 3' untranslated region of mRNA encoded by BIRC3, corresponding to a HOST TARGET binding site such as BINDING SITE I, BINDING SITE II or BINDING SITE III. Table 2 illustrates the complementarity of the nucleotide sequences of BIRC3 BINDING SITE, designated SEQ ID:33368, to the nucleotide sequence of VGAM2628 RNA, herein designated VGAM RNA, also designated SEQ ID:5339.

Another function of VGAM2628 is therefore inhibition of Baculoviral IAP Repeat-containing 3 (BIRC3, Accession XM_040715). Accordingly, utilities of VGAM2628 include diagnosis, prevention and treatment of diseases and clinical conditions associated with BIRC3. Chromosome 20 Open Reading Frame 121 (C20orf121, Accession NM_024331) is another VGAM2628 host target gene. C20orf121 BINDING SITE is HOST TARGET binding site found in the 3' untranslated region of mRNA encoded by C20orf121, corresponding to a HOST TARGET binding site such as BINDING SITE I, BINDING SITE II or BINDING SITE III. Table 2 illustrates the complementarity of the nucleotide sequences of C20orf121 BINDING SITE, designated SEQ ID:23629, to the nucleotide sequence of VGAM2628 RNA, herein designated VGAM RNA, also designated SEQ ID:5339.

Another function of VGAM2628 is therefore inhibition of Chromosome 20 Open Reading Frame 121 (C20orf121, Accession NM_024331). Accordingly, utilities of VGAM2628 include diagnosis, prevention and treatment of diseases and clinical conditions associated with C20orf121. CASPR3 (Accession NM_033655) is another VGAM2628 host target gene. CASPR3 BINDING SITE is HOST TARGET binding site found in the 3' untranslated region of mRNA encoded by CASPR3, corresponding to a HOST TARGET binding site such as BINDING SITE I, BINDING SITE II or BINDING SITE III. Table 2 illustrates the complementarity of the nucleotide sequences of CASPR3 BINDING SITE, designated SEQ ID:27385, to the nucleotide sequence of VGAM2628 RNA, herein designated VGAM RNA, also designated SEQ ID:5339.

Another function of VGAM2628 is therefore inhibition of CASPR3 (Accession NM_033655). Accordingly, utilities of VGAM2628 include diagnosis, prevention and treatment of diseases and clinical conditions associated with CASPR3. Calsyntenin 2 (CLSTN2, Accession NM_022131) is another VGAM2628 host target gene. CLSTN2 BINDING SITE is HOST TARGET binding site found in the 3' untranslated region of mRNA encoded by CLSTN2, corresponding to a HOST TARGET binding site such as BINDING SITE I, BINDING SITE II or BINDING SITE III. Table 2 illustrates the complementarity of the nucleotide sequences of CLSTN2 BINDING SITE, designated SEQ ID:22691, to the nucleotide sequence of VGAM2628 RNA, herein designated VGAM RNA, also designated SEQ ID:5339.

Another function of VGAM2628 is therefore inhibition of Calsyntenin 2 (CLSTN2, Accession NM_022131). Accordingly, utilities of VGAM2628 include diagnosis, prevention and treatment of diseases and clinical conditions associated with CLSTN2. CRIPT (Accession XM_057669) is another VGAM2628 host target gene. CRIPT BINDING SITE is HOST TARGET binding site found in the 3' untranslated region of mRNA encoded by CRIPT, corresponding to a HOST TARGET binding site such as BINDING SITE I, BINDING SITE II or BINDING SITE III. Table 2 illustrates the complementarity of the nucleotide sequences of CRIPT BINDING SITE, designated SEQ ID:36537, to the nucleotide sequence of VGAM2628 RNA, herein designated VGAM RNA, also designated SEQ ID:5339.

Another function of VGAM2628 is therefore inhibition of CRIPT (Accession XM_057669). Accordingly, utilities of VGAM2628 include diagnosis, prevention and treatment of diseases and clinical conditions associated with CRIPT. DnaJ (Hsp40) Homolog, Subfamily C, Member 6 (DNAJC6, Accession NM_014787) is another VGAM2628 host target gene. DNAJC6 BINDING SITE is HOST TARGET binding site found in the 3' untranslated region of mRNA encoded by DNAJC6, corresponding to a HOST TARGET binding site such as BINDING SITE I, BINDING SITE II or BINDING SITE III. Table 2 illustrates the complementarity of the nucleotide sequences of DNAJC6 BINDING SITE, designated SEQ ID:16657, to the nucleotide sequence of VGAM2628 RNA, herein designated VGAM RNA, also designated SEQ ID:5339.

Another function of VGAM2628 is therefore inhibition of DnaJ (Hsp40) Homolog, Subfamily C, Member 6 (DNAJC6, Accession NM_014787). Accordingly, utilities of VGAM2628 include diagnosis, prevention and treatment of diseases and clinical conditions associated with DNAJC6. FLJ10392 (Accession NM_018084) is another VGAM2628 host target gene. FLJ10392 BINDING SITE is HOST TARGET binding site found in the 5' untranslated region of mRNA encoded by FLJ10392, corresponding to a HOST TARGET binding site such as BINDING SITE I, BINDING SITE II or BINDING SITE III. Table 2 illustrates the complementarity of the nucleotide sequences of FLJ10392 BINDING SITE, designated SEQ ID:19845, to the nucleotide sequence of VGAM2628 RNA, herein designated VGAM RNA, also designated SEQ ID:5339.

Another function of VGAM2628 is therefore inhibition of FLJ10392 (Accession NM_018084). Accordingly, utilities of VGAM2628 include diagnosis, prevention and treatment of diseases and clinical conditions associated with FLJ10392. FLJ20552 (Accession NM_017876) is another VGAM2628 host target gene. FLJ20552 BINDING SITE is HOST TARGET binding site found in the 3' untranslated region of mRNA encoded by FLJ20552, corresponding to a HOST TARGET binding site such as BINDING SITE I, BINDING SITE II or BINDING SITE III. Table 2 illustrates the complementarity of the nucleotide sequences of FLJ20552 BINDING SITE, designated SEQ ID:19547, to the nucleotide sequence of VGAM2628 RNA, herein designated VGAM RNA, also designated SEQ ID:5339.

Another function of VGAM2628 is therefore inhibition of FLJ20552 (Accession NM_017876). Accordingly, utilities of VGAM2628 include diagnosis, prevention and treatment of diseases and clinical conditions associated with FLJ20552. FLJ21195 (Accession NM_022469) is another VGAM2628 host target gene. FLJ21195 BINDING SITE is HOST TARGET binding site found in the 3' untranslated region of mRNA encoded by FLJ21195, corresponding to a HOST TARGET binding site such as BINDING SITE I, BINDING SITE II or BINDING SITE III. Table 2 illustrates the complementarity of the nucleotide sequences of FLJ21195 BINDING SITE, designated SEQ ID:22823, to the nucleotide sequence of VGAM2628 RNA, herein designated VGAM RNA, also designated SEQ ID:5339.

Another function of VGAM2628 is therefore inhibition of FLJ21195 (Accession NM_022469). Accordingly, utilities of VGAM2628 include diagnosis, prevention and treatment of diseases and clinical conditions associated with FLJ21195. KIAA1950 (Accession XM_166532) is another VGAM2628 host target gene. KIAA1950 BINDING SITE is HOST TARGET binding site found in the 3' untranslated region of mRNA encoded by KIAA1950, corresponding to a HOST TARGET binding site such as BINDING SITE I, BINDING SITE II or BINDING SITE III. Table 2 illustrates the complementarity of the nucleotide sequences of KIAA1950 BINDING SITE, designated SEQ ID:44485, to the nucleotide sequence of VGAM2628 RNA, herein designated VGAM RNA, also designated SEQ ID:5339.

Another function of VGAM2628 is therefore inhibition of KIAA1950 (Accession XM_166532). Accordingly, utilities of VGAM2628 include diagnosis, prevention and treatment of diseases and clinical conditions associated with KIAA1950. KR18 (Accession NM_033288) is another VGAM2628 host target gene. KR18 BINDING SITE is HOST TARGET binding site found in the 3' untranslated region of mRNA encoded by KR18, corresponding to a HOST TARGET binding site such as BINDING SITE I, BINDING SITE II or BINDING SITE III. Table 2 illustrates the complementarity of the nucleotide sequences of KR18 BINDING SITE, designated SEQ ID:27115, to the nucleotide sequence of VGAM2628 RNA, herein designated VGAM RNA, also designated SEQ ID:5339.

Another function of VGAM2628 is therefore inhibition of KR18 (Accession NM_033288). Accordingly, utilities of VGAM2628 include diagnosis, prevention and treatment of diseases and clinical conditions associated with KR18. Lysosomal-associated Membrane Protein 3 (LAMP3, Accession XM_003022) is another VGAM2628 host target gene. LAMP3 BINDING SITE is HOST TARGET binding site found in the 3' untranslated region of mRNA encoded by LAMP3, corresponding to a HOST TARGET binding site such as BINDING SITE I, BINDING SITE II or BINDING SITE III. Table 2 illustrates the complementarity of the nucleotide sequences of LAMP3 BINDING SITE, designated SEQ ID:29915, to the nucleotide sequence of VGAM2628 RNA, herein designated VGAM RNA, also designated SEQ ID:5339.

Another function of VGAM2628 is therefore inhibition of Lysosomal-associated Membrane Protein 3 (LAMP3, Accession XM_003022). Accordingly, utilities of VGAM2628 include diagnosis, prevention and treatment of diseases and clinical conditions associated with LAMP3. RER1 (Accession NM_007033) is another VGAM2628 host target gene. RER1 BINDING SITE is HOST TARGET binding site found in the 3' untranslated region of mRNA encoded by RER1, corresponding to a HOST TARGET binding site such as BINDING SITE I, BINDING SITE II or BINDING SITE III. Table 2 illustrates the complementarity of the nucleotide sequences of RER1 BINDING SITE, designated SEQ ID:13902, to the nucleotide sequence of VGAM2628 RNA, herein designated VGAM RNA, also designated SEQ ID:5339.

Another function of VGAM2628 is therefore inhibition of RER1 (Accession NM_007033). Accordingly, utilities of VGAM2628 include diagnosis, prevention and treatment of diseases and clinical conditions associated with RER1. SCYA28 (Accession NM_019846) is another VGAM2628 host target gene. SCYA28 BINDING SITE is HOST TARGET binding site found in the 3' untranslated region of mRNA encoded by SCYA28, corresponding to a HOST TARGET binding site such as BINDING SITE I, BINDING SITE II or BINDING SITE III. Table 2 illustrates the complementarity of the nucleotide sequences of SCYA28 BINDING SITE, designated SEQ ID:21249, to the nucleotide sequence of VGAM2628 RNA, herein designated VGAM RNA, also designated SEQ ID:5339.

Another function of VGAM2628 is therefore inhibition of SCYA28 (Accession NM_019846). Accordingly, utilities of VGAM2628 include diagnosis, prevention and treatment of diseases and clinical conditions associated with SCYA28. Serine Threonine Kinase 39 (STE20/SPS1 homolog, yeast) (STK39, Accession NM_013233) is another VGAM2628 host target gene. STK39 BINDING SITE is HOST TARGET binding site found in the 3' untranslated region of mRNA encoded by STK39, corresponding to a HOST TARGET binding site such as BINDING SITE I, BINDING SITE II or BINDING SITE III. Table 2 illustrates the complementarity of the nucleotide sequences of STK39 BINDING SITE, designated SEQ ID:14892, to the nucleotide sequence of VGAM2628 RNA, herein designated VGAM RNA, also designated SEQ ID:5339.

Another function of VGAM2628 is therefore inhibition of Serine Threonine Kinase 39 (STE20/SPS1 homolog, yeast) (STK39, Accession NM_013233). Accordingly, utilities of VGAM2628 include diagnosis, prevention and treatment of diseases and clinical conditions associated with STK39. Tyrosine Kinase, Non-receptor, 1 (TNK1, Accession NM_003985) is another VGAM2628 host target gene. TNK1 BINDING SITE is HOST TARGET binding site found in the 3' untranslated region of mRNA encoded by TNK1, corresponding to a HOST TARGET binding site such as BINDING SITE I, BINDING SITE II or BINDING SITE III. Table 2 illustrates the complementarity of the nucleotide sequences of TNK1 BINDING SITE, designated SEQ ID:10134, to the nucleotide sequence of VGAM2628 RNA, herein designated VGAM RNA, also designated SEQ ID:5339.

Another function of VGAM2628 is therefore inhibition of Tyrosine Kinase, Non-receptor, 1 (TNK1, Accession NM_003985). Accordingly, utilities of VGAM2628 include diagnosis, prevention and treatment of diseases and clinical conditions associated with TNK1. LOC132880 (Accession XM_059609) is another VGAM2628 host target gene. LOC132880 BINDING SITE is HOST TARGET binding site found in the 5' untranslated region of mRNA encoded by LOC132880, corresponding to a HOST TARGET binding site such as BINDING SITE I, BINDING SITE II or BINDING SITE III. Table 2 illustrates the complementarity of the nucleotide sequences of LOC132880 BINDING SITE, designated SEQ ID:37029, to the nucleotide sequence of VGAM2628 RNA, herein designated VGAM RNA, also designated SEQ ID:5339.

Another function of VGAM2628 is therefore inhibition of LOC132880 (Accession XM_059609). Accordingly, utilities of VGAM2628 include diagnosis, prevention and treatment of diseases and clinical conditions associated with LOC132880. LOC147138 (Accession XM_085717) is another VGAM2628 host target gene. LOC147138 BINDING SITE is HOST TARGET binding site found in the 5' untranslated region of mRNA encoded by LOC147138, corresponding to a HOST TARGET binding site such as BINDING SITE I, BINDING SITE II or BINDING SITE III. Table 2 illustrates the complementarity of the nucleotide sequences of LOC147138 BINDING SITE, designated SEQ ID:38307, to the nucleotide sequence of VGAM2628 RNA, herein designated VGAM RNA, also designated SEQ ID:5339.

Another function of VGAM2628 is therefore inhibition of LOC147138 (Accession XM_085717). Accordingly, utilities of VGAM2628 include diagnosis, prevention and treatment of diseases and clinical conditions associated with LOC147138. LOC147727 (Accession XM_085862) is another VGAM2628 host target gene. LOC147727 BINDING SITE is HOST TARGET binding site found in the 5' untranslated region of mRNA encoded by LOC147727, corresponding to a HOST TARGET binding site such as BINDING SITE I, BINDING SITE II or BINDING SITE III. Table 2 illustrates the complementarity of the nucleotide sequences of LOC147727 BINDING SITE, designated SEQ ID:38380, to the nucleotide sequence of VGAM2628 RNA, herein designated VGAM RNA, also designated SEQ ID:5339.

Another function of VGAM2628 is therefore inhibition of LOC147727 (Accession XM_085862). Accordingly, utilities of VGAM2628 include diagnosis, prevention and treatment of diseases and clinical conditions associated with LOC147727. LOC155081 (Accession XM_088145) is another VGAM2628 host target gene. LOC155081 BINDING SITE is HOST TARGET binding site found in the 3' untranslated region of mRNA encoded by LOC155081, corresponding to a HOST TARGET binding site such as BINDING SITE I, BINDING SITE II or BINDING SITE III. Table 2 illustrates the complementarity of the nucleotide sequences of LOC155081 BINDING SITE, designated SEQ ID:39542, to the nucleotide sequence of VGAM2628 RNA, herein designated VGAM RNA, also designated SEQ ID:5339.

Another function of VGAM2628 is therefore inhibition of LOC155081 (Accession XM_088145). Accordingly, utilities of VGAM2628 include diagnosis, prevention and treatment of diseases and clinical conditions associated with LOC155081. LOC201245 (Accession XM_113326) is another VGAM2628 host target gene. LOC201245 BINDING SITE is HOST TARGET binding site found in the 3' untranslated region of mRNA encoded by LOC201245, corresponding to a HOST TARGET binding site such as BINDING SITE I, BINDING SITE II or BINDING SITE III. Table 2 illustrates the complementarity of the nucleotide sequences of LOC201245 BINDING SITE, designated SEQ ID:42228, to the nucleotide sequence of VGAM2628 RNA, herein designated VGAM RNA, also designated SEQ ID:5339.

Another function of VGAM2628 is therefore inhibition of LOC201245 (Accession XM_113326). Accordingly, utilities of VGAM2628 include diagnosis, prevention and treatment of diseases and clinical conditions associated with LOC201245. LOC202802 (Accession XM_114560) is another VGAM2628 host target gene. LOC202802 BINDING SITE is HOST TARGET binding site found in the 3' untranslated region of mRNA encoded by LOC202802, corresponding to a HOST TARGET binding site such as BINDING SITE I, BINDING SITE II or BINDING SITE III. Table 2 illustrates the complementarity of the nucleotide sequences of LOC202802 BINDING SITE, designated SEQ ID:42987, to the nucleotide sequence of VGAM2628 RNA, herein designated VGAM RNA, also designated SEQ ID:5339.

Another function of VGAM2628 is therefore inhibition of LOC202802 (Accession XM_114560). Accordingly, utilities of VGAM2628 include diagnosis, prevention and treatment of diseases and clinical conditions associated with LOC202802. LOC222228 (Accession XM_168627) is another VGAM2628 host target gene. LOC222228 BINDING SITE is HOST TARGET binding site found in the 3' untranslated region of mRNA encoded by LOC222228, corresponding to a HOST TARGET binding site such as BINDING SITE I, BINDING SITE II or BINDING SITE III. Table 2 illustrates the complementarity of the nucleotide sequences of LOC222228 BINDING SITE, designated SEQ ID:45273, to the nucleotide sequence of VGAM2628 RNA, herein designated VGAM RNA, also designated SEQ ID:5339.

Another function of VGAM2628 is therefore inhibition of LOC222228 (Accession XM_168627). Accordingly, utilities of VGAM2628 include diagnosis, prevention and treatment of diseases and clinical conditions associated with LOC222228. LOC222233 (Accession XM_168560) is another VGAM2628 host target gene. LOC222233 BINDING SITE is HOST TARGET binding site found in the 3' untranslated region of mRNA encoded by LOC222233, corresponding to a HOST TARGET binding site such as BINDING SITE I, BINDING SITE II or BINDING SITE III. Table 2 illustrates the complementarity of the nucleotide sequences of LOC222233 BINDING SITE, designated SEQ ID:45242, to the nucleotide sequence of VGAM2628 RNA, herein designated VGAM RNA, also designated SEQ ID:5339.

Another function of VGAM2628 is therefore inhibition of LOC222233 (Accession XM_168560). Accordingly, utilities of VGAM2628 include diagnosis, prevention and treatment of diseases and clinical conditions associated with LOC222233. LOC57406 (Accession NM_020676) is another VGAM2628 host target gene. LOC57406 BINDING SITE is HOST TARGET binding site found in the 3' untranslated region of mRNA encoded by LOC57406, corresponding to a HOST TARGET binding site such as BINDING SITE I, BINDING SITE II or BINDING SITE III. Table 2 illustrates the complementarity of the nucleotide sequences of LOC57406 BINDING SITE, designated SEQ ID:21837, to the nucleotide sequence of VGAM2628 RNA, herein designated VGAM RNA, also designated SEQ ID:5339.

Another function of VGAM2628 is therefore inhibition of LOC57406 (Accession NM_020676). Accordingly, utilities of VGAM2628 include diagnosis, prevention and treatment of diseases and clinical conditions associated with LOC57406. LOC92568 (Accession XM_045852) is another VGAM2628 host target gene. LOC92568 BINDING SITE is HOST TARGET binding site found in the 3' untranslated region of mRNA encoded by LOC92568, corresponding to a HOST TARGET binding site such as BINDING SITE I, BINDING SITE II or BINDING SITE III. Table 2 illustrates the complementarity of the nucleotide sequences of LOC92568 BINDING SITE, designated SEQ ID:34575, to the nucleotide sequence of VGAM2628 RNA, herein designated VGAM RNA, also designated SEQ ID:5339.

Another function of VGAM2628 is therefore inhibition of LOC92568 (Accession XM_045852). Accordingly, utilities of VGAM2628 include diagnosis, prevention and treatment of diseases and clinical conditions associated with LOC92568. FIG. 1 further provides a conceptual description of a novel bioinformatically detected viral gene of the present invention, referred to here as Viral Genomic Address Messenger 2629 (VGAM2629) viral gene, which modulates expression of respective host target genes thereof, the function and utility of which host target genes is known in the art.

VGAM2629 is a novel bioinformatically detected regulatory, non protein coding, viral micro RNA (miRNA) gene. The method by which VGAM2629 was detected is described hereinabove with reference to FIGS. 1-8.

VGAM2629 gene, herein designated VGAM GENE, is a viral gene contained in the genome of Avian Encephalomyelitis Virus. VGAM2629 host target gene, herein designated VGAM HOST TARGET GENE, is a human gene contained in the human genome.

VGAM2629 gene encodes a VGAM2629 precursor RNA, herein designated VGAM PRECURSOR RNA. Similar to other miRNA genes, and unlike most ordinary genes, VGAM2629 precursor RNA does not encode a protein. A nucleotide sequence identical or highly similar to the nucleotide sequence of VGAM2629 precursor RNA is designated SEQ ID:2615, and is provided hereinbelow with reference to the sequence listing part. Nucleotide sequence SEQ ID:2615 is located at position 2698 relative to the genome of Avian Encephalomyelitis Virus.

VGAM2629 precursor RNA folds onto itself, forming VGAM2629 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2629 folded precursor RNA into VGAM2629 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2629 RNA is designated SEQ ID:5340, and is provided hereinbelow with reference to the sequence listing part.

VGAM2629 host target gene, herein designated VGAM HOST TARGET GENE, encodes a corresponding messenger RNA, VGAM2629 host target RNA, herein designated VGAM HOST TARGET RNA. VGAM2629 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2629 RNA, herein designated VGAM RNA, binds complementarily to one or more host target binding sites located in untranslated regions of VGAM2629 host target RNA, herein designated VGAM HOST TARGET RNA. This complementary binding is due to the fact that the nucleotide sequence of VGAM2629 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2629 RNA, herein designated VGAM RNA, may have a different number of host target binding sites in untranslated regions of a VGAM2629 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2629 RNA, herein designated VGAM RNA, to host target binding sites on VGAM2629 host target RNA, herein designated VGAM HOST TARGET RNA, such as BINDING SITE I, BINDING SITE II and BINDING SITE III, inhibits translation of VGAM2629 host target RNA into VGAM2629 host target protein, herein designated VGAM HOST TARGET PROTEIN. VGAM host target protein is therefore outlined by a broken line.

It is appreciated that VGAM2629 host target gene, herein designated VGAM HOST TARGET GENE, in fact represents a plurality of VGAM2629 host target genes. The mRNA of each one of this plurality of VGAM2629 host target genes comprises one or more host target binding sites, each having a nucleotide sequence which is at least partly complementary to VGAM2629 RNA, herein designated VGAM RNA, and which when bound by VGAM2629 RNA causes inhibition of translation of respective one or more VGAM2629 host target proteins.

It is further appreciated by one skilled in the art that the mode of translational inhibition illustrated by FIG. 1 with specific reference to translational inhibition exerted by VGAM2629 gene, herein designated VGAM GENE, on one or more VGAM2629 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2629 is inhibition of expression of host target genes, as part of a novel viral mechanism of attacking a host. Accordingly, utilities of VGAM2629 include diagnosis, prevention and treatment of viral infection by Avian Encephalomyelitis Virus. Specific functions, and accordingly utilities, of VGAM2629 correlate with, and may be deduced from, the identity of the host target genes which VGAM2629 binds and inhibits, and the function of these host target genes, as elaborated hereinbelow.

Nucleotide sequences of the VGAM2629 precursor RNA, herein designated VGAM PRECURSOR RNA, and of the 'diced' VGAM2629 RNA, herein designated VGAM RNA, and a schematic representation of the secondary folding of VGAM2629 folded precursor RNA, herein designated VGAM FOLDED PRECURSOR RNA, of VGAM2629 are further described hereinbelow with reference to Table 1.

Nucleotide sequences of host target binding sites, such as BINDING SITE-I, BINDING SITE-II and BINDING SITE-III of FIG. 1, found on VGAM2629 host target RNA, and schematic representation of the complementarity of each of these host target binding sites to VGAM2629 RNA, herein designated VGAM RNA, are described hereinbelow with reference to Table 2.

As mentioned hereinabove with reference to FIG. 1, a function of VGAM2629 gene, herein designated VGAM is inhibition of expression of VGAM2629 target genes. It is appreciated that specific functions, and accordingly utilities, of VGAM2629 correlate with, and may be deduced from, the identity of the target genes which VGAM2629 binds and inhibits, and the function of these target genes, as elaborated hereinbelow.

Hepatocyte Growth Factor (hepapoietin A; scatter factor) (HGF, Accession XM_168542) is a VGAM2629 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45217, to the nucleotide sequence of VGAM2629 RNA, herein designated VGAM RNA, also designated SEQ ID:5340.

A function of VGAM2629 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM2629 include diagnosis, prevention and treatment of diseases and clinical conditions associated with HGF. The function of HGF and its association with various diseases and clinical conditions, has been established by previous studies, as described hereinabove with reference to VGAM174. Regulatory Factor X, 2 (influences HLA class II expression) (RFX2, Accession NM_000635) is another VGAM2629 host target gene. RFX2 BINDING SITE is HOST TARGET binding site found in the 3' untranslated region of mRNA encoded by RFX2, corresponding to a HOST TARGET binding site such as BINDING SITE I, BINDING SITE II or BINDING SITE III. Table 2 illustrates the complementarity of the nucleotide sequences of RFX2 BINDING SITE, designated SEQ ID:6269, to the nucleotide sequence of VGAM2629 RNA, herein designated VGAM RNA, also designated SEQ ID:5340.

Another function of VGAM2629 is therefore inhibition of Regulatory Factor X, 2 (influences HLA class II expression) (RFX2, Accession NM_000635), a gene which acts as a dimer to regulate the expression of many genes. Accordingly, utilities of VGAM2629 include diagnosis, prevention and treatment of diseases and clinical conditions associated with RFX2. The function of RFX2 and its association with various diseases and clinical conditions, has been established by previous studies, as described hereinabove with reference to VGAM622. FLJ12934 (Accession NM_022899) is another VGAM2629 host target gene. FLJ12934 BINDING SITE is HOST TARGET binding site found in the 3' untranslated region of mRNA encoded by FLJ12934, corresponding to a HOST TARGET binding site such as BINDING SITE I, BINDING SITE II or BINDING SITE III. Table 2 illustrates the complementarity of the nucleotide sequences of FLJ12934 BINDING SITE, designated SEQ ID:23178, to the nucleotide sequence of VGAM2629 RNA, herein designated VGAM RNA, also designated SEQ ID:5340.

Another function of VGAM2629 is therefore inhibition of FLJ12934 (Accession NM_022899). Accordingly, utilities of VGAM2629 include diagnosis, prevention and treatment of diseases and clinical conditions associated with FLJ12934. FLJ13868 (Accession NM_022744) is another VGAM2629 host target gene. FLJ13868 BINDING SITE is HOST TARGET binding site found in the 3' untranslated region of mRNA encoded by FLJ13868, corresponding to a HOST TARGET binding site such as BINDING SITE I, BINDING SITE II or BINDING SITE III. Table 2 illustrates the complementarity of the nucleotide sequences of FLJ13868 BINDING SITE, designated SEQ ID:22954, to the nucleotide sequence of VGAM2629 RNA, herein designated VGAM RNA, also designated SEQ ID:5340.

Another function of VGAM2629 is therefore inhibition of FLJ13868 (Accession NM_022744). Accordingly, utilities of VGAM2629 include diagnosis, prevention and treatment of diseases and clinical conditions associated with FLJ13868. Paternally Expressed 10 (PEG10, Accession NM_015068) is another VGAM2629 host target gene. PEG10 BINDING SITE is HOST TARGET binding site found in the 3' untranslated region of mRNA encoded by PEG10, corresponding to a HOST TARGET binding site such as BINDING SITE I, BINDING SITE II or BINDING SITE III. Table 2 illustrates the complementarity of the nucleotide sequences of PEG10 BINDING SITE, designated SEQ ID:17425, to the nucleotide sequence of VGAM2629 RNA, herein designated VGAM RNA, also designated SEQ ID:5340.

Another function of VGAM2629 is therefore inhibition of Paternally Expressed 10 (PEG10, Accession NM_015068). Accordingly, utilities of VGAM2629 include diagnosis, prevention and treatment of diseases and clinical conditions associated with PEG10. UPLC1 (Accession NM_017707) is another VGAM2629 host target gene. UPLC1 BINDING SITE is HOST TARGET binding site found in the 3' untranslated region of mRNA encoded by UPLC1, corresponding to a HOST TARGET binding site such as BINDING SITE I, BINDING SITE II or BINDING SITE III. Table 2 illustrates the complementarity of the nucleotide sequences of UPLC1 BINDING SITE, designated SEQ ID:19283, to the nucleotide sequence of VGAM2629 RNA, herein designated VGAM RNA, also designated SEQ ID:5340.

Another function of VGAM2629 is therefore inhibition of UPLC1 (Accession NM_017707). Accordingly, utilities of VGAM2629 include diagnosis, prevention and treatment of diseases and clinical conditions associated with UPLC1. LOC149271 (Accession XM_086475) is another VGAM2629 host target gene. LOC149271 BINDING SITE is HOST TARGET binding site found in the 3' untranslated region of mRNA encoded by LOC149271, corresponding to a HOST TARGET binding site such as BINDING SITE I, BINDING SITE II or BINDING SITE III. Table 2 illustrates the complementarity of the nucleotide sequences of LOC149271 BINDING SITE, designated SEQ ID:38674, to the nucleotide sequence of VGAM2629 RNA, herein designated VGAM RNA, also designated SEQ ID:5340.

Another function of VGAM2629 is therefore inhibition of LOC149271 (Accession XM_086475). Accordingly, utilities of VGAM2629 include diagnosis, prevention and treatment of diseases and clinical conditions associated with LOC149271. LOC90333 (Accession XM_030958) is another VGAM2629 host target gene. LOC90333 BINDING SITE is HOST TARGET binding site found in the 3' untranslated region of mRNA encoded by LOC90333, corresponding to a HOST TARGET binding site such as BINDING SITE I, BINDING SITE II or BINDING SITE III. Table 2 illustrates the complementarity of the nucleotide sequences of LOC90333 BINDING SITE, designated SEQ ID:31218, to the nucleotide sequence of VGAM2629 RNA, herein designated VGAM RNA, also designated SEQ ID:5340.

Another function of VGAM2629 is therefore inhibition of LOC90333 (Accession XM_030958). Accordingly, utilities of VGAM2629 include diagnosis, prevention and treatment of diseases and clinical conditions associated with LOC90333. FIG. 1 further provides a conceptual description of a novel bioinformatically detected viral gene of the present invention, referred to here as Viral Genomic Address Messenger 2630 (VGAM2630) viral gene, which modulates expression of respective host target genes thereof, the function and utility of which host target genes is known in the art.

VGAM2630 is a novel bioinformatically detected regulatory, non protein coding, viral micro RNA (miRNA) gene. The method by which VGAM2630 was detected is described hereinabove with reference to FIGS. 1-8.

VGAM2630 gene, herein designated VGAM GENE, is a viral gene contained in the genome of Tamana Bat Virus. VGAM2630 host target gene, herein designated VGAM HOST TARGET GENE, is a human gene contained in the human genome.

VGAM2630 gene encodes a VGAM2630 precursor RNA, herein designated VGAM PRECURSOR RNA. Similar to other miRNA genes, and unlike most ordinary genes, VGAM2630 precursor RNA does not encode a protein. A nucleotide sequence identical or highly similar to the nucleotide sequence of VGAM2630 precursor RNA is designated SEQ ID:2616, and is provided hereinbelow with reference to the sequence listing part. Nucleotide sequence SEQ ID:2616 is located at position 2276 relative to the genome of Tamana Bat Virus.

VGAM2630 precursor RNA folds onto itself, forming VGAM2630 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2630 folded precursor RNA into VGAM2630 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 83%) nucleotide sequence of VGAM2630 RNA is designated SEQ ID:5341, and is provided hereinbelow with reference to the sequence listing part.

VGAM2630 host target gene, herein designated VGAM HOST TARGET GENE, encodes a corresponding messenger RNA, VGAM2630 host target RNA, herein designated VGAM HOST TARGET RNA. VGAM2630 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2630 RNA, herein designated VGAM RNA, binds complementarily to one or more host target binding sites located in untranslated regions of VGAM2630 host target RNA, herein designated VGAM HOST TARGET RNA. This complementary binding is due to the fact that the nucleotide sequence of VGAM2630 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2630 RNA, herein designated VGAM RNA, may have a different number of host target binding sites in untranslated regions of a VGAM2630 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2630 RNA, herein designated VGAM RNA, to host target binding sites on VGAM2630 host target RNA, herein designated VGAM HOST TARGET RNA, such as BINDING SITE I, BINDING SITE II and BINDING SITE III, inhibits translation of VGAM2630 host target RNA into VGAM2630 host target protein, herein designated VGAM HOST TARGET PROTEIN. VGAM host target protein is therefore outlined by a broken line.

It is appreciated that VGAM2630 host target gene, herein designated VGAM HOST TARGET GENE, in fact represents a plurality of VGAM2630 host target genes. The mRNA of each one of this plurality of VGAM2630 host target genes comprises one or more host target binding sites, each having a nucleotide sequence which is at least partly complementary to VGAM2630 RNA, herein designated VGAM RNA, and which when bound by VGAM2630 RNA causes inhibition of translation of respective one or more VGAM2630 host target proteins.

It is further appreciated by one skilled in the art that the mode of translational inhibition illustrated by FIG. 1 with specific reference to translational inhibition exerted by VGAM2630 gene, herein designated VGAM GENE, on one or more VGAM2630 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2630 is inhibition of expression of host target genes, as part of a novel viral mechanism of attacking a host. Accordingly, utilities of VGAM2630 include diagnosis, prevention and treatment of viral infection by Tamana Bat Virus. Specific functions, and accordingly utilities, of VGAM2630 correlate with, and may be deduced from, the identity of the host target genes which VGAM2630 binds and inhibits, and the function of these host target genes, as elaborated hereinbelow.

Nucleotide sequences of the VGAM2630 precursor RNA, herein designated VGAM PRECURSOR RNA, and of the 'diced' VGAM2630 RNA, herein designated VGAM RNA, and a schematic representation of the secondary folding of VGAM2630 folded precursor RNA, herein designated VGAM FOLDED PRECURSOR RNA, of VGAM2630 are further described hereinbelow with reference to Table 1.

Nucleotide sequences of host target binding sites, such as BINDING SITE-I, BINDING SITE-II and BINDING SITE-III of FIG. 1, found on VGAM2630 host target RNA, and schematic representation of the complementarity of each of these host target binding sites to VGAM2630 RNA, herein designated VGAM RNA, are described hereinbelow with reference to Table 2.

As mentioned hereinabove with reference to FIG. 1, a function of VGAM2630 gene, herein designated VGAM is inhibition of expression of VGAM2630 target genes. It is appreciated that specific functions, and accordingly utilities, of VGAM2630 correlate with, and may be deduced from, the identity of the target genes which VGAM2630 binds and inhibits, and the function of these target genes, as elaborated hereinbelow.

General Transcription Factor IIH, Polypeptide 1, 62 kDa (GTF2H1, Accession NM_005316) is a VGAM2630 host target gene. GTF2H1 BINDING SITE is HOST TARGET binding site found in the 3' untranslated region of mRNA encoded by GTF2H1, corresponding to a HOST TARGET binding site such as BINDING SITE I, BINDING SITE II or BINDING SITE III. Table 2 illustrates the complementarity of the nucleotide sequences of GTF2H1 BINDING SITE, designated SEQ ID:11793, to the nucleotide sequence of VGAM2630 RNA, herein designated VGAM RNA, also designated SEQ ID:5341.

A function of VGAM2630 is therefore inhibition of General Transcription Factor IIH, Polypeptide 1, 62 kDa (GTF2H1, Accession NM_005316), a gene which is subunit of RNA polymerase II transcription initiation factor IIH; involved in transcription and DNA repair mechanisms. Accordingly, utilities of VGAM2630 include diagnosis, prevention and treatment of diseases and clinical conditions associated with GTF2H1. The function of GTF2H1 and its association with various diseases and clinical conditions, has been established by previous studies, as described hereinabove with reference to VGAM1407. VAMP (vesicle-associated membrane protein)-associated Protein B and C (VAPB, Accession NM_004738) is another VGAM2630 host target gene. VAPB BINDING SITE is HOST TARGET binding site found in the 3' untranslated region of mRNA encoded by VAPB, corresponding to a HOST TARGET binding site such as BINDING SITE I, BINDING SITE II or BINDING SITE III. Table 2 illustrates the complementarity of the nucleotide sequences of VAPB BINDING SITE, designated SEQ ID:11133, to the nucleotide sequence of VGAM2630 RNA, herein designated VGAM RNA, also designated SEQ ID:5341.

Another function of VGAM2630 is therefore inhibition of VAMP (vesicle-associated membrane protein)-associated Protein B and C (VAPB, Accession NM_004738). Accordingly, utilities of VGAM2630 include diagnosis, prevention and treatment of diseases and clinical conditions associated with VAPB. C1orf27 (Accession NM_017847) is another VGAM2630 host target gene. C1orf27 BINDING SITE is HOST TARGET binding site found in the 5' untranslated region of mRNA encoded by C1orf27, corresponding to a HOST TARGET binding site such as BINDING SITE I, BINDING SITE II or BINDING SITE III. Table 2 illustrates the complementarity of the nucleotide sequences of C1orf27

BINDING SITE, designated SEQ ID:19509, to the nucleotide sequence of VGAM2630 RNA, herein designated VGAM RNA, also designated SEQ ID:5341.

Another function of VGAM2630 is therefore inhibition of C1orf27 (Accession NM_017847). Accordingly, utilities of VGAM2630 include diagnosis, prevention and treatment of diseases and clinical conditions associated with C1orf27. SRB7 Suppressor of RNA Polymerase B Homolog (yeast) (SURB7, Accession NM_004264) is another VGAM2630 host target gene. SURB7 BINDING SITE is HOST TARGET binding site found in the 3' untranslated region of mRNA encoded by SURB7, corresponding to a HOST TARGET binding site such as BINDING SITE I, BINDING SITE II or BINDING SITE III. Table 2 illustrates the complementarity of the nucleotide sequences of SURB7 BINDING SITE, designated SEQ ID:10465, to the nucleotide sequence of VGAM2630 RNA, herein designated VGAM RNA, also designated SEQ ID:5341.

Another function of VGAM2630 is therefore inhibition of SRB7 Suppressor of RNA Polymerase B Homolog (yeast) (SURB7, Accession NM_004264). Accordingly, utilities of VGAM2630 include diagnosis, prevention and treatment of diseases and clinical conditions associated with SURB7. FIG. 1 further provides a conceptual description of a novel bioinformatically detected viral gene of the present invention, referred to here as Viral Genomic Address Messenger 2631 (VGAM2631) viral gene, which modulates expression of respective host target genes thereof, the function and utility of which host target genes is known in the art.

VGAM2631 is a novel bioinformatically detected regulatory, non protein coding, viral micro RNA (miRNA) gene. The method by which VGAM2631 was detected is described hereinabove with reference to FIGS. 1-8.

VGAM2631 gene, herein designated VGAM GENE, is a viral gene contained in the genome of Tamana Bat Virus. VGAM2631 host target gene, herein designated VGAM HOST TARGET GENE, is a human gene contained in the human genome.

VGAM2631 gene encodes a VGAM2631 precursor RNA, herein designated VGAM PRECURSOR RNA. Similar to other miRNA genes, and unlike most ordinary genes, VGAM2631 precursor RNA does not encode a protein. A nucleotide sequence identical or highly similar to the nucleotide sequence of VGAM2631 precursor RNA is designated SEQ ID:2617, and is provided hereinbelow with reference to the sequence listing part. Nucleotide sequence SEQ ID:2617 is located at position 9727 relative to the genome of Tamana Bat Virus.

VGAM2631 precursor RNA folds onto itself, forming VGAM2631 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2631 folded precursor RNA into VGAM2631 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM2631 RNA is designated SEQ ID:5342, and is provided hereinbelow with reference to the sequence listing part.

VGAM2631 host target gene, herein designated VGAM HOST TARGET GENE, encodes a corresponding messenger RNA, VGAM2631 host target RNA, herein designated VGAM HOST TARGET RNA. VGAM2631 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2631 RNA, herein designated VGAM RNA, binds complementarily to one or more host target binding sites located in untranslated regions of VGAM2631 host target RNA, herein designated VGAM HOST TARGET RNA. This complementary binding is due to the fact that the nucleotide sequence of VGAM2631 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2631 RNA, herein designated VGAM RNA, may have a different number of host target binding sites in untranslated regions of a VGAM2631 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2631 RNA, herein designated VGAM RNA, to host target binding sites on VGAM2631 host target RNA, herein designated VGAM HOST TARGET RNA, such as BINDING SITE I, BINDING SITE II and BINDING SITE III, inhibits translation of VGAM2631 host target RNA into VGAM2631 host target protein, herein designated VGAM HOST TARGET PROTEIN. VGAM host target protein is therefore outlined by a broken line.

It is appreciated that VGAM2631 host target gene, herein designated VGAM HOST TARGET GENE, in fact represents a plurality of VGAM2631 host target genes. The mRNA of each one of this plurality of VGAM2631 host target genes comprises one or more host target binding sites, each having a nucleotide sequence which is at least partly complementary to VGAM2631 RNA, herein designated VGAM RNA, and which when bound by VGAM2631 RNA causes inhibition of translation of respective one or more VGAM2631 host target proteins.

It is further appreciated by one skilled in the art that the mode of translational inhibition illustrated by FIG. 1 with specific reference to translational inhibition exerted by VGAM2631 gene, herein designated VGAM GENE, on one or more VGAM2631 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2631 is inhibition of expression of host target genes, as part of a novel viral mechanism of attacking a host. Accordingly, utilities of VGAM2631 include diagnosis, prevention and treatment of viral infection by Tamana Bat Virus. Specific functions, and accordingly utilities, of VGAM2631 correlate with, and may be deduced from, the identity of the host target genes which VGAM2631 binds and inhibits, and the function of these host target genes, as elaborated hereinbelow.

Nucleotide sequences of the VGAM2631 precursor RNA, herein designated VGAM PRECURSOR RNA, and of the 'diced' VGAM2631 RNA, herein designated VGAM RNA, and a schematic representation of the secondary folding of VGAM2631 folded precursor RNA, herein designated VGAM FOLDED PRECURSOR RNA, of VGAM2631 are further described hereinbelow with reference to Table 1.

Nucleotide sequences of host target binding sites, such as BINDING SITE-I, BINDING SITE-II and BINDING SITE-III of FIG. 1, found on VGAM2631 host target RNA, and schematic representation of the complementarity of each of these host target binding sites to VGAM2631 RNA, herein designated VGAM RNA, are described hereinbelow with reference to Table 2.

As mentioned hereinabove with reference to FIG. 1, a function of VGAM2631 gene, herein designated VGAM is inhibition of expression of VGAM2631 target genes. It is appreciated that specific functions, and accordingly utilities, of VGAM2631 correlate with, and may be deduced from, the identity of the target genes which VGAM2631 binds and inhibits, and the function of these target genes, as elaborated hereinbelow.

Adenylate Kinase 2 (AK2, Accession NM_013411) is a VGAM2631 host target gene. AK2 BINDING SITE is HOST TARGET binding site found in the 3' untranslated region of mRNA encoded by AK2, corresponding to a HOST TARGET binding site such as BINDING SITE I, BINDING SITE II or BINDING SITE III. Table 2 illustrates the complementarity of the nucleotide sequences of AK2 BINDING SITE, designated SEQ ID:15076, to the nucleotide sequence of VGAM2631 RNA, herein designated VGAM RNA, also designated SEQ ID:5342.

A function of VGAM2631 is therefore inhibition of Adenylate Kinase 2 (AK2, Accession NM_013411), a gene which essential for maintenance and cell growth. Accordingly, utilities of VGAM2631 include diagnosis, prevention and treatment of diseases and clinical conditions associated with AK2. The function of AK2 and its association with various diseases and clinical conditions, has been established by previous studies, as described hereinabove with reference to VGAM1113. FKRP (Accession NM_024301) is another VGAM2631 host target gene. FKRP BINDING SITE is HOST TARGET binding site found in the 3' untranslated region of mRNA encoded by FKRP, corresponding to a HOST TARGET binding site such as BINDING SITE I, BINDING SITE II or BINDING SITE III. Table 2 illustrates the complementarity of the nucleotide sequences of FKRP BINDING SITE, designated SEQ ID:23591, to the nucleotide sequence of VGAM2631 RNA, herein designated VGAM RNA, also designated SEQ ID:5342.

Another function of VGAM2631 is therefore inhibition of FKRP (Accession NM_024301). Accordingly, utilities of VGAM2631 include diagnosis, prevention and treatment of diseases and clinical conditions associated with FKRP. Protein Phosphatase 1, Regulatory (inhibitor) Subunit 3A (glycogen and sarcoplasmic reticulum binding subunit, skeletal muscle) (PPP1R3A, Accession NM_002711) is another VGAM2631 host target gene. PPP1R3A BINDING SITE is HOST TARGET binding site found in the 3' untranslated region of mRNA encoded by PPP1R3A, corresponding to a HOST TARGET binding site such as BINDING SITE I, BINDING SITE II or BINDING SITE III. Table 2 illustrates the complementarity of the nucleotide sequences of PPP1R3A BINDING SITE, designated SEQ ID:8564, to the nucleotide sequence of VGAM2631 RNA, herein designated VGAM RNA, also designated SEQ ID:5342.

Another function of VGAM2631 is therefore inhibition of Protein Phosphatase 1, Regulatory (inhibitor) Subunit 3A (glycogen and sarcoplasmic reticulum binding subunit, skeletal muscle) (PPP1R3A, Accession NM_002711), a gene which regulates phosphatase activity towards glycogen synthase, active in skeletal muscle. Accordingly, utilities of VGAM2631 include diagnosis, prevention and treatment of diseases and clinical conditions associated with PPP1R3A. The function of PPP1R3A and its association with various diseases and clinical conditions, has been established by previous studies, as described hereinabove with reference to VGAM1872. Solute Carrier Family 14 (urea transporter), Member 2 (SLC14A2, Accession NM_007163) is another VGAM2631 host target gene. SLC14A2 BINDING SITE is HOST TARGET binding site found in the 5' untranslated region of mRNA encoded by SLC14A2, corresponding to a HOST TARGET binding site such as BINDING SITE I, BINDING SITE II or BINDING SITE III. Table 2 illustrates the complementarity of the nucleotide sequences of SLC14A2 BINDING SITE, designated SEQ ID:14006, to the nucleotide sequence of VGAM2631 RNA, herein designated VGAM RNA, also designated SEQ ID:5342.

Another function of VGAM2631 is therefore inhibition of Solute Carrier Family 14 (urea transporter), Member 2 (SLC14A2, Accession NM_007163), a gene which is a renal urea transporter 2. Accordingly, utilities of VGAM2631 include diagnosis, prevention and treatment of diseases and clinical conditions associated with SLC14A2. The function of SLC14A2 and its association with various diseases and clinical conditions, has been established by previous studies, as described hereinabove with reference to VGAM74. Sorting Nexin 9 (SNX9, Accession NM_016224) is another VGAM2631 host target gene. SNX9 BINDING SITE is HOST TARGET binding site found in the 3' untranslated region of mRNA encoded by SNX9, corresponding to a HOST TARGET binding site such as BINDING SITE I, BINDING SITE II or BINDING SITE III. Table 2 illustrates the complementarity of the nucleotide sequences of SNX9 BINDING SITE, designated SEQ ID:18331, to the nucleotide sequence of VGAM2631 RNA, herein designated VGAM RNA, also designated SEQ ID:5342.

Another function of VGAM2631 is therefore inhibition of Sorting Nexin 9 (SNX9, Accession NM_016224). Accordingly, utilities of VGAM2631 include diagnosis, prevention and treatment of diseases and clinical conditions associated with SNX9. Chromosome 1 Open Reading Frame 34 (C1orf34, Accession XM_027172) is another VGAM2631 host target gene. C1orf34 BINDING SITE is HOST TARGET binding site found in the 3' untranslated region of mRNA encoded by C1orf34, corresponding to a HOST TARGET binding site such as BINDING SITE I, BINDING SITE II or BINDING SITE III. Table 2 illustrates the complementarity of the nucleotide sequences of C1orf34 BINDING SITE, designated SEQ ID:30434, to the nucleotide sequence of VGAM2631 RNA, herein designated VGAM RNA, also designated SEQ ID:5342.

Another function of VGAM2631 is therefore inhibition of Chromosome 1 Open Reading Frame 34 (C1orf34, Accession XM_027172). Accordingly, utilities of VGAM2631 include diagnosis, prevention and treatment of diseases and clinical conditions associated with C1orf34. DKFZP564O1664 (Accession NM_030800) is another VGAM2631 host target gene. DKFZP564O1664 BINDING SITE is HOST TARGET binding site found in the 3' untranslated region of mRNA encoded by DKFZP564O1664, corresponding to a HOST TARGET binding site such as BINDING SITE I, BINDING SITE II or BINDING SITE III. Table 2 illustrates the complementarity of the nucleotide sequences of DKFZP564O1664 BINDING SITE, designated SEQ ID:25101, to the nucleotide sequence of VGAM2631 RNA, herein designated VGAM RNA, also designated SEQ ID:5342.

Another function of VGAM2631 is therefore inhibition of DKFZP564O1664 (Accession NM_030800). Accordingly, utilities of VGAM2631 include diagnosis, prevention and treatment of diseases and clinical conditions associated with DKFZP564O1664. MGC16186 (Accession NM_032372) is another VGAM2631 host target gene. MGC16186 BINDING SITE is HOST TARGET binding site found in the 5' untranslated region of mRNA encoded by MGC16186, corresponding to a HOST TARGET binding site such as BINDING SITE I, BINDING SITE II or BINDING SITE III. Table 2 illustrates the complementarity of the nucleotide sequences of MGC16186 BINDING SITE, designated SEQ ID:26160, to the nucleotide sequence of VGAM2631 RNA, herein designated VGAM RNA, also designated SEQ ID:5342.

Another function of VGAM2631 is therefore inhibition of MGC16186 (Accession NM_032372). Accordingly, utilities of VGAM2631 include diagnosis, prevention and treatment of diseases and clinical conditions associated with MGC16186. Testis-specific Kinase 2 (TESK2, Accession XM_032399) is another VGAM2631 host target gene. TESK2 BINDING SITE is HOST TARGET binding site found in the 3' untranslated region of mRNA encoded by TESK2, corresponding to a HOST TARGET binding site such as BINDING SITE I, BINDING SITE II or BINDING SITE III. Table 2 illustrates the complementarity of the nucleotide sequences of TESK2 BINDING SITE, designated SEQ ID:31648, to the nucleotide sequence of VGAM2631 RNA, herein designated VGAM RNA, also designated SEQ ID:5342.

Another function of VGAM2631 is therefore inhibition of Testis-specific Kinase 2 (TESK2, Accession XM_032399). Accordingly, utilities of VGAM2631 include diagnosis, prevention and treatment of diseases and clinical conditions associated with TESK2. LOC150157 (Accession XM_097823) is another VGAM2631 host target gene. LOC150157 BINDING SITE is HOST TARGET binding site found in the 5' untranslated region of mRNA encoded by LOC150157, corresponding to a HOST TARGET binding site such as BINDING SITE I, BINDING SITE II or BINDING SITE III. Table 2 illustrates the complementarity of the nucleotide sequences of LOC150157 BINDING SITE, designated SEQ ID:41144, to the nucleotide sequence of VGAM2631 RNA, herein designated VGAM RNA, also designated SEQ ID:5342.

Another function of VGAM2631 is therefore inhibition of LOC150157 (Accession XM_097823). Accordingly, utilities of VGAM2631 include diagnosis, prevention and treatment of diseases and clinical conditions associated with LOC150157. LOC201685 (Accession XM_117325) is another VGAM2631 host target gene. LOC201685 BINDING SITE is HOST TARGET binding site found in the 3' untranslated region of mRNA encoded by LOC201685, corresponding to a HOST TARGET binding site such as BINDING SITE I, BINDING SITE II or BINDING SITE III. Table 2 illustrates the complementarity of the nucleotide sequences of LOC201685 BINDING SITE, designated SEQ ID:43384, to the nucleotide sequence of VGAM2631 RNA, herein designated VGAM RNA, also designated SEQ ID:5342.

Another function of VGAM2631 is therefore inhibition of LOC201685 (Accession XM_117325). Accordingly, utilities of VGAM2631 include diagnosis, prevention and treatment of diseases and clinical conditions associated with LOC201685. LOC253150 (Accession XM_170948) is another VGAM2631 host target gene. LOC253150 BINDING SITE is HOST TARGET binding site found in the 3' untranslated region of mRNA encoded by LOC253150, corresponding to a HOST TARGET binding site such as BINDING SITE I, BINDING SITE II or BINDING SITE III. Table 2 illustrates the complementarity of the nucleotide sequences of LOC253150 BINDING SITE, designated SEQ ID:45732, to the nucleotide sequence of VGAM2631 RNA, herein designated VGAM RNA, also designated SEQ ID:5342.

Another function of VGAM2631 is therefore inhibition of LOC253150 (Accession XM_170948). Accordingly, utilities of VGAM2631 include diagnosis, prevention and treatment of diseases and clinical conditions associated with LOC253150. FIG. 1 further provides a conceptual description of a novel bioinformatically detected viral gene of the present invention, referred to here as Viral Genomic Address Messenger 2632 (VGAM2632) viral gene, which modulates expression of respective host target genes thereof, the function and utility of which host target genes is known in the art.

VGAM2632 is a novel bioinformatically detected regulatory, non protein coding, viral micro RNA (miRNA) gene. The method by which VGAM2632 was detected is described hereinabove with reference to FIGS. 1-8.

VGAM2632 gene, herein designated VGAM GENE, is a viral gene contained in the genome of Tamana Bat Virus. VGAM2632 host target gene, herein designated VGAM HOST TARGET GENE, is a human gene contained in the human genome.

VGAM2632 gene encodes a VGAM2632 precursor RNA, herein designated VGAM PRECURSOR RNA. Similar to other miRNA genes, and unlike most ordinary genes, VGAM2632 precursor RNA does not encode a protein. A nucleotide sequence identical or highly similar to the nucleotide sequence of VGAM2632 precursor RNA is designated SEQ ID:2618, and is provided hereinbelow with reference to the sequence listing part. Nucleotide sequence SEQ ID:2618 is located at position 1113 relative to the genome of Tamana Bat Virus.

VGAM2632 precursor RNA folds onto itself, forming VGAM2632 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2632 folded precursor RNA into VGAM2632 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2632 RNA is designated SEQ ID:5343, and is provided hereinbelow with reference to the sequence listing part.

VGAM2632 host target gene, herein designated VGAM HOST TARGET GENE, encodes a corresponding messenger RNA, VGAM2632 host target RNA, herein designated VGAM HOST TARGET RNA. VGAM2632 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2632 RNA, herein designated VGAM RNA, binds complementarily to one or more host target binding sites located in untranslated regions of VGAM2632 host target RNA, herein designated VGAM HOST TARGET RNA. This complementary binding is due to the fact that the nucleotide sequence of VGAM2632 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2632 RNA, herein designated VGAM RNA, may have a different number of host target binding sites in untranslated regions of a VGAM2632 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2632 RNA, herein designated VGAM RNA, to host target binding sites on VGAM2632 host target RNA, herein designated VGAM HOST TARGET RNA, such as BINDING SITE I, BINDING SITE II and BINDING SITE III, inhibits translation of VGAM2632 host target RNA into VGAM2632 host target protein, herein designated VGAM HOST TARGET PROTEIN. VGAM host target protein is therefore outlined by a broken line.

It is appreciated that VGAM2632 host target gene, herein designated VGAM HOST TARGET GENE, in fact represents a plurality of VGAM2632 host target genes. The mRNA of each one of this plurality of VGAM2632 host target genes comprises one or more host target binding sites, each having a nucleotide sequence which is at least partly complementary to VGAM2632 RNA, herein designated VGAM RNA, and which when bound by VGAM2632 RNA causes inhibition of translation of respective one or more VGAM2632 host target proteins.

It is further appreciated by one skilled in the art that the mode of translational inhibition illustrated by FIG. 1 with specific reference to translational inhibition exerted by VGAM2632 gene, herein designated VGAM GENE, on one or more VGAM2632 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2632 is inhibition of expression of host target genes, as part of a novel viral mechanism of attacking a host. Accordingly, utilities of VGAM2632 include diagnosis, prevention and treatment of viral infection by Tamana Bat Virus. Specific functions, and accordingly utilities, of VGAM2632 correlate with, and may be deduced from, the identity of the host target genes which VGAM2632 binds and inhibits, and the function of these host target genes, as elaborated hereinbelow.

Nucleotide sequences of the VGAM2632 precursor RNA, herein designated VGAM PRECURSOR RNA, and of the 'diced' VGAM2632 RNA, herein designated VGAM RNA, and a schematic representation of the secondary folding of VGAM2632 folded precursor RNA, herein designated VGAM FOLDED PRECURSOR RNA, of VGAM2632 are further described hereinbelow with reference to Table 1.

Nucleotide sequences of host target binding sites, such as BINDING SITE-I, BINDING SITE-II and BINDING SITE-III of FIG. 1, found on VGAM2632 host target RNA, and schematic representation of the complementarity of each of these host target binding sites to VGAM2632 RNA, herein designated VGAM RNA, are described hereinbelow with reference to Table 2.

As mentioned hereinabove with reference to FIG. 1, a function of VGAM2632 gene, herein designated VGAM is inhibition of expression of VGAM2632 target genes. It is appreciated that specific functions, and accordingly utilities, of VGAM2632 correlate with, and may be deduced from, the identity of the target genes which VGAM2632 binds and inhibits, and the function of these target genes, as elaborated hereinbelow.

FLJ10996 (Accession NM_019044) is a VGAM2632 host target gene. FLJ10996 BINDING SITE is HOST TARGET binding site found in the 3' untranslated region of mRNA encoded by FLJ10996, corresponding to a HOST TARGET binding site such as BINDING SITE I, BINDING SITE II or BINDING SITE III. Table 2 illustrates the complementarity of the nucleotide sequences of FLJ10996 BINDING SITE, designated SEQ ID:21126, to the nucleotide sequence of VGAM2632 RNA, herein designated VGAM RNA, also designated SEQ ID:5343.

A function of VGAM2632 is therefore inhibition of FLJ10996 (Accession NM_019044). Accordingly, utilities of VGAM2632 include diagnosis, prevention and treatment of diseases and clinical conditions associated with FLJ10996. FIG. 1 further provides a conceptual description of a novel bioinformatically detected viral gene of the present invention, referred to here as Viral Genomic Address Messenger 2633 (VGAM2633) viral gene, which modulates expression of respective host target genes thereof, the function and utility of which host target genes is known in the art.

VGAM2633 is a novel bioinformatically detected regulatory, non protein coding, viral micro RNA (miRNA) gene. The method by which VGAM2633 was detected is described hereinabove with reference to FIGS. 1-8.

VGAM2633 gene, herein designated VGAM GENE, is a viral gene contained in the genome of Tamana Bat Virus. VGAM2633 host target gene, herein designated VGAM HOST TARGET GENE, is a human gene contained in the human genome.

VGAM2633 gene encodes a VGAM2633 precursor RNA, herein designated VGAM PRECURSOR RNA. Similar to other miRNA genes, and unlike most ordinary genes, VGAM2633 precursor RNA does not encode a protein. A nucleotide sequence identical or highly similar to the nucleotide sequence of VGAM2633 precursor RNA is designated SEQ ID:2619, and is provided hereinbelow with reference to the sequence listing part. Nucleotide sequence SEQ ID:2619 is located at position 3876 relative to the genome of Tamana Bat Virus.

VGAM2633 precursor RNA folds onto itself, forming VGAM2633 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2633 folded precursor RNA into VGAM2633 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2633 RNA is designated SEQ ID:5344, and is provided hereinbelow with reference to the sequence listing part.

VGAM2633 host target gene, herein designated VGAM HOST TARGET GENE, encodes a corresponding messenger RNA, VGAM2633 host target RNA, herein designated VGAM HOST TARGET RNA. VGAM2633 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2633 RNA, herein designated VGAM RNA, binds complementarily to one or more host target binding sites located in untranslated regions of VGAM2633 host target RNA, herein designated VGAM HOST TARGET RNA. This complementary binding is due to the fact that the nucleotide sequence of VGAM2633 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2633 RNA, herein designated VGAM RNA, may have a different number of host target binding sites in untranslated regions of a VGAM2633 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2633 RNA, herein designated VGAM RNA, to host target binding sites on VGAM2633 host target RNA, herein designated VGAM HOST TARGET RNA, such as BINDING SITE I, BINDING SITE II and BINDING SITE III, inhibits translation of VGAM2633 host target RNA into VGAM2633 host target protein, herein designated VGAM HOST TARGET PROTEIN. VGAM host target protein is therefore outlined by a broken line.

It is appreciated that VGAM2633 host target gene, herein designated VGAM HOST TARGET GENE, in fact represents a plurality of VGAM2633 host target genes. The mRNA of each one of this plurality of VGAM2633 host target genes comprises one or more host target binding sites, each having a nucleotide sequence which is at least partly complementary to VGAM2633 RNA, herein designated VGAM RNA, and which when bound by VGAM2633 RNA causes inhibition of translation of respective one or more VGAM2633 host target proteins.

It is further appreciated by one skilled in the art that the mode of translational inhibition illustrated by FIG. 1 with specific reference to translational inhibition exerted by VGAM2633 gene, herein designated VGAM GENE, on one or more VGAM2633 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2633 is inhibition of expression of host target genes, as part of a novel viral mechanism of attacking a host. Accordingly, utilities of VGAM2633 include diagnosis, prevention and treatment of viral infection by Tamana Bat Virus. Specific functions, and accordingly utilities, of VGAM2633 correlate with, and may be deduced from, the identity of the host target genes which VGAM2633 binds and inhibits, and the function of these host target genes, as elaborated hereinbelow.

Nucleotide sequences of the VGAM2633 precursor RNA, herein designated VGAM PRECURSOR RNA, and of the 'diced' VGAM2633 RNA, herein designated VGAM RNA, and a schematic representation of the secondary folding of VGAM2633 folded precursor RNA, herein designated VGAM FOLDED PRECURSOR RNA, of VGAM2633 are further described hereinbelow with reference to Table 1.

Nucleotide sequences of host target binding sites, such as BINDING SITE-I, BINDING SITE-II and BINDING SITE-III of FIG. 1, found on VGAM2633 host target RNA, and schematic representation of the complementarity of each of these host target binding sites to VGAM2633 RNA, herein designated VGAM RNA, are described hereinbelow with reference to Table 2.

As mentioned hereinabove with reference to FIG. 1, a function of VGAM2633 gene, herein designated VGAM is inhibition of expression of VGAM2633 target genes. It is appreciated that specific functions, and accordingly utilities, of VGAM2633 correlate with, and may be deduced from, the identity of the target genes which VGAM2633 binds and inhibits, and the function of these target genes, as elaborated hereinbelow.

Cyclin D-type Binding-protein 1 (CCNDBP1, Accession NM_037370) is a VGAM2633 host target gene. CCNDBP1 BINDING SITE is HOST TARGET binding site found in the 5' untranslated region of mRNA encoded by CCNDBP1, corresponding to a HOST TARGET binding site such as BINDING SITE I, BINDING SITE II or BINDING SITE III. Table 2 illustrates the complementarity of the nucleotide sequences of CCNDBP1 BINDING SITE, designated SEQ ID:27398, to the nucleotide sequence of VGAM2633 RNA, herein designated VGAM RNA, also designated SEQ ID:5344.

A function of VGAM2633 is therefore inhibition of Cyclin D-type Binding-protein 1 (CCNDBP1, Accession NM_037370). Accordingly, utilities of VGAM2633 include diagnosis, prevention and treatment of diseases and clinical conditions associated with CCNDBP1. Collagen, Type VI, Alpha 3 (COL6A3, Accession NM_004369) is another VGAM2633 host target gene. COL6A3 BINDING SITE1 and COL6A3 BINDING SITE2 are HOST TARGET binding sites found in untranslated regions of mRNA encoded by COL6A3, corresponding to HOST TARGET binding sites such as BINDING SITE I, BINDING SITE II or BINDING SITE III. Table 2 illustrates the complementarity of the nucleotide sequences of COL6A3 BINDING SITE1 and COL6A3 BINDING SITE2, designated SEQ ID:10588 and SEQ ID:27672 respectively, to the nucleotide sequence of VGAM2633 RNA, herein designated VGAM RNA, also designated SEQ ID:5344.

Another function of VGAM2633 is therefore inhibition of Collagen, Type VI, Alpha 3 (COL6A3, Accession NM_004369). Accordingly, utilities of VGAM2633 include diagnosis, prevention and treatment of diseases and clinical conditions associated with COL6A3. BDG-29 (Accession XM_051343) is another VGAM2633 host target gene. BDG-29 BINDING SITE is HOST TARGET binding site found in the 3' untranslated region of mRNA encoded by BDG-29, corresponding to a HOST TARGET binding site such as BINDING SITE I, BINDING SITE II or BINDING SITE III. Table 2 illustrates the complementarity of the nucleotide sequences of BDG-29 BINDING SITE, designated SEQ ID:35819, to the nucleotide sequence of VGAM2633 RNA, herein designated VGAM RNA, also designated SEQ ID:5344.

Another function of VGAM2633 is therefore inhibition of BDG-29 (Accession XM_051343). Accordingly, utilities of VGAM2633 include diagnosis, prevention and treatment of diseases and clinical conditions associated with BDG-29. FLJ20275 (Accession NM_017737) is another VGAM2633 host target gene. FLJ20275 BINDING SITE is HOST TARGET binding site found in the 3' untranslated region of mRNA encoded by FLJ20275, corresponding to a HOST TARGET binding site such as BINDING SITE I, BINDING SITE II or BINDING SITE III. Table 2 illustrates the complementarity of the nucleotide sequences of FLJ20275 BINDING SITE, designated SEQ ID:19323, to the nucleotide sequence of VGAM2633 RNA, herein designated VGAM RNA, also designated SEQ ID:5344.

Another function of VGAM2633 is therefore inhibition of FLJ20275 (Accession NM_017737). Accordingly, utilities of VGAM2633 include diagnosis, prevention and treatment of diseases and clinical conditions associated with FLJ20275. HBP1 (Accession NM_012257) is another VGAM2633 host target gene. HBP1 BINDING SITE is HOST TARGET binding site found in the 3' untranslated region of mRNA encoded by HBP1, corresponding to a HOST TARGET binding site such as BINDING SITE I, BINDING SITE II or BINDING SITE III. Table 2 illustrates the complementarity of the nucleotide sequences of HBP1 BINDING SITE, designated SEQ ID:14560, to the nucleotide sequence of VGAM2633 RNA, herein designated VGAM RNA, also designated SEQ ID:5344.

Another function of VGAM2633 is therefore inhibition of HBP1 (Accession NM_012257). Accordingly, utilities of VGAM2633 include diagnosis, prevention and treatment of diseases and clinical conditions associated with HBP1. Hypermethylated In Cancer 2 (HIC2, Accession XM_036937) is another VGAM2633 host target gene. HIC2 BINDING SITE is HOST TARGET binding site found in the 3' untranslated region of mRNA encoded by HIC2, corresponding to a HOST TARGET binding site such as BINDING SITE I, BINDING SITE II or BINDING SITE III. Table 2 illustrates the complementarity of the nucleotide sequences of HIC2 BINDING SITE, designated SEQ ID:32530, to the nucleotide sequence of VGAM2633 RNA, herein designated VGAM RNA, also designated SEQ ID:5344.

Another function of VGAM2633 is therefore inhibition of Hypermethylated In Cancer 2 (HIC2, Accession XM_036937). Accordingly, utilities of VGAM2633 include diagnosis, prevention and treatment of diseases and clinical conditions associated with HIC2. MAN1 (Accession NM_014319) is another VGAM2633 host target gene. MAN1 BINDING SITE is HOST TARGET binding site found in the 3' untranslated region of mRNA encoded by MAN1, corresponding to a HOST TARGET binding site such as BINDING SITE I, BINDING SITE II or BINDING SITE III. Table 2 illustrates the complementarity of the nucleotide sequences of MAN1 BINDING SITE, designated SEQ ID:15617, to the nucleotide sequence of VGAM2633 RNA, herein designated VGAM RNA, also designated SEQ ID:5344.

Another function of VGAM2633 is therefore inhibition of MAN1 (Accession NM_014319). Accordingly, utilities of VGAM2633 include diagnosis, prevention and treatment of diseases and clinical conditions associated with MAN1. MGC16142 (Accession NM_032763) is another VGAM2633 host target gene. MGC16142 BINDING SITE is HOST TARGET binding site found in the 5' untranslated region of mRNA encoded by MGC16142, corresponding to a HOST TARGET binding site such as BINDING SITE I, BINDING SITE II or BINDING SITE III. Table 2 illustrates the complementarity of the nucleotide sequences of MGC16142 BINDING SITE, designated SEQ ID:26509, to the nucleotide sequence of VGAM2633 RNA, herein designated VGAM RNA, also designated SEQ ID:5344.

Another function of VGAM2633 is therefore inhibition of MGC16142 (Accession NM_032763). Accordingly, utilities of VGAM2633 include diagnosis, prevention and treatment of diseases and clinical conditions associated with MGC16142. MGC2827 (Accession NM_023940) is another VGAM2633 host target gene. MGC2827 BINDING SITE is HOST TARGET binding site found in the 3' untranslated region of mRNA encoded by MGC2827, corresponding to a HOST TARGET binding site such as BINDING SITE I, BINDING SITE II or BINDING SITE III. Table 2 illustrates the complementarity of the nucleotide sequences of MGC2827 BINDING SITE, designated SEQ ID:23426, to the nucleotide sequence of VGAM2633 RNA, herein designated VGAM RNA, also designated SEQ ID:5344.

Another function of VGAM2633 is therefore inhibition of MGC2827 (Accession NM_023940). Accordingly, utilities of VGAM2633 include diagnosis, prevention and treatment of diseases and clinical conditions associated with MGC2827. Tetratricopeptide Repeat Domain 4 (TTC4, Accession XM_038926) is another VGAM2633 host target gene. TTC4 BINDING SITE is HOST TARGET binding site found in the 3' untranslated region of mRNA encoded by TTC4, corresponding to a HOST TARGET binding site such as BINDING SITE I, BINDING SITE II or BINDING SITE III. Table 2 illustrates the complementarity of the nucleotide sequences of TTC4 BINDING SITE, designated SEQ ID:32961, to the nucleotide sequence of VGAM2633 RNA, herein designated VGAM RNA, also designated SEQ ID:5344.

Another function of VGAM2633 is therefore inhibition of Tetratricopeptide Repeat Domain 4 (TTC4, Accession XM_038926). Accordingly, utilities of VGAM2633 include diagnosis, prevention and treatment of diseases and clinical conditions associated with TTC4. LOC150606 (Accession XM_097928) is another VGAM2633 host target gene. LOC150606 BINDING SITE is HOST TARGET binding site found in the 3' untranslated region of mRNA encoded by LOC150606, corresponding to a HOST TARGET binding site such as BINDING SITE I, BINDING SITE II or BINDING SITE III. Table 2 illustrates the complementarity of the nucleotide sequences of LOC150606 BINDING SITE, designated SEQ ID:41235, to the nucleotide sequence of VGAM2633 RNA, herein designated VGAM RNA, also designated SEQ ID:5344.

Another function of VGAM2633 is therefore inhibition of LOC150606 (Accession XM_097928). Accordingly, utilities of VGAM2633 include diagnosis, prevention and treatment of diseases and clinical conditions associated with LOC150606. LOC91813 (Accession XM_040862) is another VGAM2633 host target gene. LOC91813 BINDING SITE is HOST TARGET binding site found in the 5' untranslated region of mRNA encoded by LOC91813, corresponding to a HOST TARGET binding site such as BINDING SITE I, BINDING SITE II or BINDING SITE III. Table 2 illustrates the complementarity of the nucleotide sequences of LOC91813 BINDING SITE, designated SEQ ID:33401, to the nucleotide sequence of VGAM2633 RNA, herein designated VGAM RNA, also designated SEQ ID:5344.

Another function of VGAM2633 is therefore inhibition of LOC91813 (Accession XM_040862). Accordingly, utilities of VGAM2633 include diagnosis, prevention and treatment of diseases and clinical conditions associated with LOC91813. FIG. 1 further provides a conceptual description of a novel bioinformatically detected viral gene of the present invention, referred to here as Viral Genomic Address Messenger 2634 (VGAM2634) viral gene, which modulates expression of respective host target genes thereof, the function and utility of which host target genes is known in the art.

VGAM2634 is a novel bioinformatically detected regulatory, non protein coding, viral micro RNA (miRNA) gene. The method by which VGAM2634 was detected is described hereinabove with reference to FIGS. 1-8.

VGAM2634 gene, herein designated VGAM GENE, is a viral gene contained in the genome of Tamana Bat Virus. VGAM2634 host target gene, herein designated VGAM HOST TARGET GENE, is a human gene contained in the human genome.

VGAM2634 gene encodes a VGAM2634 precursor RNA, herein designated VGAM PRECURSOR RNA. Similar to other miRNA genes, and unlike most ordinary genes, VGAM2634 precursor RNA does not encode a protein. A nucleotide sequence identical or highly similar to the nucleotide sequence of VGAM2634 precursor RNA is designated SEQ ID:2620, and is provided hereinbelow with reference to the sequence listing part. Nucleotide sequence SEQ ID:2620 is located at position 3523 relative to the genome of Tamana Bat Virus.

VGAM2634 precursor RNA folds onto itself, forming VGAM2634 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2634 folded precursor RNA into VGAM2634 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2634 RNA is designated SEQ ID:5345, and is provided hereinbelow with reference to the sequence listing part.

VGAM2634 host target gene, herein designated VGAM HOST TARGET GENE, encodes a corresponding messenger RNA, VGAM2634 host target RNA, herein designated VGAM HOST TARGET RNA. VGAM2634 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2634 RNA, herein designated VGAM RNA, binds complementarily to one or more host target binding sites located in untranslated regions of VGAM2634 host target RNA, herein designated VGAM HOST TARGET RNA. This complementary binding is due to the fact that the nucleotide sequence of VGAM2634 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2634 RNA, herein designated VGAM RNA, may have a different number of host target binding sites in untranslated regions of a VGAM2634 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2634 RNA, herein designated VGAM RNA, to host target binding sites on VGAM2634 host target RNA, herein designated VGAM HOST TARGET RNA, such as BINDING SITE I, BINDING SITE II and BINDING SITE III, inhibits translation of VGAM2634 host target RNA into VGAM2634 host target protein, herein designated VGAM HOST TARGET PROTEIN. VGAM host target protein is therefore outlined by a broken line.

It is appreciated that VGAM2634 host target gene, herein designated VGAM HOST TARGET GENE, in fact represents a plurality of VGAM2634 host target genes. The mRNA of each one of this plurality of VGAM2634 host target genes comprises one or more host target binding sites, each having a nucleotide sequence which is at least partly complementary to VGAM2634 RNA, herein designated VGAM RNA, and which when bound by VGAM2634 RNA causes inhibition of translation of respective one or more VGAM2634 host target proteins.

It is further appreciated by one skilled in the art that the mode of translational inhibition illustrated by FIG. 1 with specific reference to translational inhibition exerted by VGAM2634 gene, herein designated VGAM GENE, on one or more VGAM2634 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2634 is inhibition of expression of host target genes, as part of a novel viral mechanism of attacking a host. Accordingly, utilities of VGAM2634 include diagnosis, prevention and treatment of viral infection by Tamana Bat Virus. Specific functions, and accordingly utilities, of VGAM2634 correlate with, and may be deduced from, the identity of the host target genes which VGAM2634 binds and inhibits, and the function of these host target genes, as elaborated hereinbelow.

Nucleotide sequences of the VGAM2634 precursor RNA, herein designated VGAM PRECURSOR RNA, and of the 'diced' VGAM2634 RNA, herein designated VGAM RNA, and a schematic representation of the secondary folding of VGAM2634 folded precursor RNA, herein designated VGAM FOLDED PRECURSOR RNA, of VGAM2634 are further described hereinbelow with reference to Table 1.

Nucleotide sequences of host target binding sites, such as BINDING SITE-I, BINDING SITE-II and BINDING SITE-III of FIG. 1, found on VGAM2634 host target RNA, and schematic representation of the complementarity of each of these host target binding sites to VGAM2634 RNA, herein designated VGAM RNA, are described hereinbelow with reference to Table 2.

As mentioned hereinabove with reference to FIG. 1, a function of VGAM2634 gene, herein designated VGAM is inhibition of expression of VGAM2634 target genes. It is appreciated that specific functions, and accordingly utilities, of VGAM2634 correlate with, and may be deduced from, the identity of the target genes which VGAM2634 binds and inhibits, and the function of these target genes, as elaborated hereinbelow.

ATPase, Ca++ Transporting, Cardiac Muscle, Slow Twitch 2 (ATP2A2, Accession NM_001681) is a VGAM2634 host target gene. ATP2A2 BINDING SITE is HOST TARGET binding site found in the 3' untranslated region of mRNA encoded by ATP2A2, corresponding to a HOST TARGET binding site such as BINDING SITE I, BINDING SITE II or BINDING SITE III. Table 2 illustrates the complementarity of the nucleotide sequences of ATP2A2 BINDING SITE, designated SEQ ID:7403, to the nucleotide sequence of VGAM2634 RNA, herein designated VGAM RNA, also designated SEQ ID:5345.

A function of VGAM2634 is therefore inhibition of ATPase, Ca++ Transporting, Cardiac Muscle, Slow Twitch 2 (ATP2A2, Accession NM_001681). Accordingly, utilities of VGAM2634 include diagnosis, prevention and treatment of diseases and clinical conditions associated with ATP2A2. Cartilage Associated Protein (CRTAP, Accession NM_006371) is another VGAM2634 host target gene. CRTAP BINDING SITE is HOST TARGET binding site found in the 3' untranslated region of mRNA encoded by CRTAP, corresponding to a HOST TARGET binding site such as BINDING SITE I, BINDING SITE II or BINDING SITE III. Table 2 illustrates the complementarity of the nucleotide sequences of CRTAP BINDING SITE, designated SEQ ID:13064, to the nucleotide sequence of VGAM2634 RNA, herein designated VGAM RNA, also designated SEQ ID:5345.

Another function of VGAM2634 is therefore inhibition of Cartilage Associated Protein (CRTAP, Accession NM_006371), a gene which is a novel developmentally regulated chick embryo protein. Accordingly, utilities of VGAM2634 include diagnosis, prevention and treatment of diseases and clinical conditions associated with CRTAP. The function of CRTAP and its association with various diseases and clinical conditions, has been established by previous studies, as described hereinabove with reference to VGAM152. RNTRE (Accession NM_014688) is another VGAM2634 host target gene. RNTRE BINDING SITE is HOST TARGET binding site found in the 3' untranslated region of mRNA encoded by RNTRE, corresponding to a HOST TARGET binding site such as BINDING SITE I, BINDING SITE II or BINDING SITE III. Table 2 illustrates the complementarity of the nucleotide sequences of RNTRE BINDING SITE, designated SEQ ID:16189, to the nucleotide sequence of VGAM2634 RNA, herein designated VGAM RNA, also designated SEQ ID:5345.

Another function of VGAM2634 is therefore inhibition of RNTRE (Accession NM_014688), a gene which may be involved in cell proliferation. Accordingly, utilities of VGAM2634 include diagnosis, prevention and treatment of diseases and clinical conditions associated with RNTRE. The function of RNTRE and its association with various diseases and clinical conditions, has been established by previous studies, as described hereinabove with reference to VGAM379. T-box 5 (TBX5, Accession NM_080717) is another VGAM2634 host target gene. TBX5 BINDING SITE1 and TBX5 BINDING SITE2 are HOST TARGET binding sites found in untranslated regions of mRNA encoded by TBX5, corresponding to HOST TARGET binding sites such as BINDING SITE I, BINDING SITE II or BINDING SITE III. Table 2 illustrates the complementarity of the nucleotide sequences of TBX5 BINDING SITE1 and TBX5 BINDING SITE2, designated SEQ ID:28015 and SEQ ID:5691 respectively, to the nucleotide sequence of VGAM2634 RNA, herein designated VGAM RNA, also designated SEQ ID:5345.

Another function of VGAM2634 is therefore inhibition of T-box 5 (TBX5, Accession NM_080717). Accordingly, utilities of VGAM2634 include diagnosis, prevention and treatment of diseases and clinical conditions associated with TBX5. Elongation of Very Long Chain Fatty Acids (FEN1/Elo2, SUR4/Elo3, yeast)-like 2 (ELOVL2, Accession NM_017770) is another VGAM2634 host target gene. ELOVL2 BINDING SITE is HOST TARGET binding site found in the 3' untranslated region of mRNA encoded by ELOVL2, corresponding to a HOST TARGET binding site such as BINDING SITE I, BINDING SITE II or BINDING SITE III. Table 2 illustrates the complementarity of the nucleotide sequences of ELOVL2 BINDING SITE, designated SEQ ID:19389, to the nucleotide sequence of VGAM2634 RNA, herein designated VGAM RNA, also designated SEQ ID:5345.

Another function of VGAM2634 is therefore inhibition of Elongation of Very Long Chain Fatty Acids (FEN1/Elo2, SUR4/Elo3, yeast)-like 2 (ELOVL2, Accession NM_017770). Accordingly, utilities of VGAM2634 include diagnosis, prevention and treatment of diseases and clinical conditions associated with ELOVL2. FLJ13110 (Accession NM_022912) is another VGAM2634 host target gene. FLJ13110 BINDING SITE is HOST TARGET binding site found in the 3' untranslated region of mRNA encoded by FLJ13110, corresponding to a HOST TARGET binding site such as BINDING SITE I, BINDING SITE II or BINDING SITE III. Table 2 illustrates the complementarity of the nucleotide sequences of FLJ13110 BINDING SITE, designated SEQ ID:23224, to the nucleotide sequence of VGAM2634 RNA, herein designated VGAM RNA, also designated SEQ ID:5345.

Another function of VGAM2634 is therefore inhibition of FLJ13110 (Accession NM_022912). Accordingly, utilities of VGAM2634 include diagnosis, prevention and treatment of diseases and clinical conditions associated with FLJ13110. LOC200339 (Accession XM_117226) is another VGAM2634 host target gene. LOC200339 BINDING SITE is HOST TARGET binding site found in the 3' untranslated region of mRNA encoded by LOC200339, corresponding to a HOST TARGET binding site such as BINDING SITE I, BINDING SITE II or BINDING SITE III. Table 2 illustrates the complementarity of the nucleotide sequences of LOC200339 BINDING SITE, designated SEQ ID:43303, to the nucleotide sequence of VGAM2634 RNA, herein designated VGAM RNA, also designated SEQ ID:5345.

Another function of VGAM2634 is therefore inhibition of LOC200339 (Accession XM_117226). Accordingly, utilities of VGAM2634 include diagnosis, prevention and treatment of diseases and clinical conditions associated with LOC200339. LOC257407 (Accession XM_173078) is another VGAM2634 host target gene. LOC257407 BINDING SITE is HOST TARGET binding site found in the 3' untranslated region of mRNA encoded by LOC257407, corresponding to a HOST TARGET binding site such as BINDING SITE I, BINDING SITE II or BINDING SITE III. Table 2 illustrates the complementarity of the nucleotide sequences of LOC257407 BINDING SITE, designated SEQ ID:46338, to the nucleotide sequence of VGAM2634 RNA, herein designated VGAM RNA, also designated SEQ ID:5345.

Another function of VGAM2634 is therefore inhibition of LOC257407 (Accession XM_173078). Accordingly, utilities of VGAM2634 include diagnosis, prevention and treatment of diseases and clinical conditions associated with LOC257407. LOC92997 (Accession XM_048690) is another VGAM2634 host target gene. LOC92997 BINDING SITE is HOST TARGET binding site found in the 3' untranslated region of mRNA encoded by LOC92997, corresponding to a HOST TARGET binding site such as BINDING SITE I, BINDING SITE II or BINDING SITE III. Table 2 illustrates the complementarity of the nucleotide sequences of LOC92997 BINDING SITE, designated SEQ ID:35222, to the nucleotide sequence of VGAM2634 RNA, herein designated VGAM RNA, also designated SEQ ID:5345.

Another function of VGAM2634 is therefore inhibition of LOC92997 (Accession XM_048690). Accordingly, utilities of VGAM2634 include diagnosis, prevention and treatment of diseases and clinical conditions associated with LOC92997. FIG. 1 further provides a conceptual description of a novel bioinformatically detected viral gene of the present invention, referred to here as Viral Genomic Address Messenger 2635 (VGAM2635) viral gene, which modulates expression of respective host target genes thereof, the function and utility of which host target genes is known in the art.

VGAM2635 is a novel bioinformatically detected regulatory, non protein coding, viral micro RNA (miRNA) gene. The method by which VGAM2635 was detected is described hereinabove with reference to FIGS. 1-8.

VGAM2635 gene, herein designated VGAM GENE, is a viral gene contained in the genome of Tamana Bat Virus. VGAM2635 host target gene, herein designated VGAM HOST TARGET GENE, is a human gene contained in the human genome.

VGAM2635 gene encodes a VGAM2635 precursor RNA, herein designated VGAM PRECURSOR RNA. Similar to other miRNA genes, and unlike most ordinary genes, VGAM2635 precursor RNA does not encode a protein. A nucleotide sequence identical or highly similar to the nucleotide sequence of VGAM2635 precursor RNA is designated SEQ ID:2621, and is provided hereinbelow with reference to the sequence listing part. Nucleotide sequence SEQ ID:2621 is located at position 2105 relative to the genome of Tamana Bat Virus.

VGAM2635 precursor RNA folds onto itself, forming VGAM2635 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2635 folded precursor RNA into VGAM2635 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2635 RNA is designated SEQ ID:5346, and is provided hereinbelow with reference to the sequence listing part.

VGAM2635 host target gene, herein designated VGAM HOST TARGET GENE, encodes a corresponding messenger RNA, VGAM2635 host target RNA, herein designated VGAM HOST TARGET RNA. VGAM2635 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2635 RNA, herein designated VGAM RNA, binds complementarily to one or more host target binding sites located in untranslated regions of VGAM2635 host target RNA, herein designated VGAM HOST TARGET RNA. This complementary binding is due to the fact that the nucleotide sequence of VGAM2635 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2635 RNA, herein designated VGAM RNA, may have a different number of host target binding sites in untranslated regions of a VGAM2635 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2635 RNA, herein designated VGAM RNA, to host target binding sites on VGAM2635 host target RNA, herein designated VGAM HOST TARGET RNA, such as BINDING SITE I, BINDING SITE II and BINDING SITE III, inhibits translation of VGAM2635 host target RNA into VGAM2635 host target protein, herein designated VGAM HOST TARGET PROTEIN. VGAM host target protein is therefore outlined by a broken line.

It is appreciated that VGAM2635 host target gene, herein designated VGAM HOST TARGET GENE, in fact represents a plurality of VGAM2635 host target genes. The mRNA of each one of this plurality of VGAM2635 host target genes comprises one or more host target binding sites, each having a nucleotide sequence which is at least partly complementary to VGAM2635 RNA, herein designated VGAM RNA, and which when bound by VGAM2635 RNA causes inhibition of translation of respective one or more VGAM2635 host target proteins.

It is further appreciated by one skilled in the art that the mode of translational inhibition illustrated by FIG. 1 with specific reference to translational inhibition exerted by VGAM2635 gene, herein designated VGAM GENE, on one or more VGAM2635 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2635 is inhibition of expression of host target genes, as part of a novel viral mechanism of attacking a host. Accordingly, utilities of VGAM2635 include diagnosis, prevention and treatment of viral infection by Tamana Bat Virus. Specific functions, and accordingly utilities, of VGAM2635 correlate with, and may be deduced from, the identity of the host target genes which VGAM2635 binds and inhibits, and the function of these host target genes, as elaborated hereinbelow.

Nucleotide sequences of the VGAM2635 precursor RNA, herein designated VGAM PRECURSOR RNA, and of the 'diced' VGAM2635 RNA, herein designated VGAM RNA, and a schematic representation of the secondary folding of VGAM2635 folded precursor RNA, herein designated VGAM FOLDED PRECURSOR RNA, of VGAM2635 are further described hereinbelow with reference to Table 1.

Nucleotide sequences of host target binding sites, such as BINDING SITE-I, BINDING SITE-II and BINDING SITE-III of FIG. 1, found on VGAM2635 host target RNA, and schematic representation of the complementarity of each of these host target binding sites to VGAM2635 RNA, herein designated VGAM RNA, are described hereinbelow with reference to Table 2.

As mentioned hereinabove with reference to FIG. 1, a function of VGAM2635 gene, herein designated VGAM is inhibition of expression of VGAM2635 target genes. It is appreciated that specific functions, and accordingly utilities, of VGAM2635 correlate with, and may be deduced from, the identity of the target genes which VGAM2635 binds and inhibits, and the function of these target genes, as elaborated hereinbelow.

UDP-Gal:betaGlcNAc Beta 1,3-galactosyltransferase, Polypeptide 2 (B3GALT2, Accession NM_003783) is a VGAM2635 host target gene. B3GALT2 BINDING SITE is HOST TARGET binding site found in the 5' untranslated region of mRNA encoded by B3GALT2, corresponding to a HOST TARGET binding site such as BINDING SITE I, BINDING SITE II or BINDING SITE III. Table 2 illustrates the complementarity of the nucleotide sequences of B3GALT2 BINDING SITE, designated SEQ ID:9872, to the nucleotide sequence of VGAM2635 RNA, herein designated VGAM RNA, also designated SEQ ID:5346.

A function of VGAM2635 is therefore inhibition of UDP-Gal:betaGlcNAc Beta 1,3-galactosyltransferase, Polypeptide 2 (B3GALT2, Accession NM_003783). Accordingly, utilities of VGAM2635 include diagnosis, prevention and treatment of diseases and clinical conditions associated with B3GALT2. Like-glycosyltransferase (LARGE, Accession NM_004737) is another VGAM2635 host target gene. LARGE BINDING SITE1 and LARGE BINDING SITE2 are HOST TARGET binding sites found in untranslated regions of mRNA encoded by LARGE, corresponding to HOST TARGET binding sites such as BINDING SITE I, BINDING SITE II or BINDING SITE III. Table 2 illustrates the complementarity of the nucleotide sequences of LARGE BINDING SITE1 and LARGE BINDING SITE2, designated SEQ ID:11127 and SEQ ID:28599 respectively, to the nucleotide sequence of VGAM2635 RNA, herein designated VGAM RNA, also designated SEQ ID:5346.

Another function of VGAM2635 is therefore inhibition of Like-glycosyltransferase (LARGE, Accession NM_004737), a gene which is a member of the N-acetylglucosaminyltransferase family. Accordingly, utilities of VGAM2635 include diagnosis, prevention and treatment of diseases and clinical conditions associated with LARGE. The function of LARGE and its association with various diseases and clinical conditions, has been established by previous studies, as described hereinabove with reference to VGAM205. Megalencephalic Leukoencephalopathy with Subcortical Cysts 1 (MLC1, Accession NM_139202) is another VGAM2635 host target gene. MLC1 BINDING SITE1 and MLC1 BINDING SITE2 are HOST TARGET binding sites found in untranslated regions of mRNA encoded by MLC1, corresponding to HOST TARGET binding sites such as BINDING SITE I, BINDING SITE II or BINDING SITE III. Table 2 illustrates the complementarity of the nucleotide sequences of MLC1 BINDING SITE1 and MLC1 BINDING SITE2, designated SEQ ID:29218 and SEQ ID:14909 respectively, to the nucleotide sequence of VGAM2635 RNA, herein designated VGAM RNA, also designated SEQ ID:5346.

Another function of VGAM2635 is therefore inhibition of Megalencephalic Leukoencephalopathy with Subcortical Cysts 1 (MLC1, Accession NM_139202). Accordingly, utilities of VGAM2635 include diagnosis, prevention and treatment of diseases and clinical conditions associated with MLC1. RAD52 Homolog (S. cerevisiae) (RAD52, Accession NM_134422) is another VGAM2635 host target gene. RAD52 BINDING SITE1 through RAD52 BINDING SITE3 are HOST TARGET binding sites found in untranslated regions of mRNA encoded by RAD52, corresponding to HOST TARGET binding sites such as BINDING SITE I, BINDING SITE II or BINDING SITE III. Table 2 illustrates the complementarity of the nucleotide sequences of RAD52 BINDING SITE1 through RAD52 BINDING SITE3, designated SEQ ID:28649, SEQ ID:28657 and SEQ ID:28665 respectively, to the nucleotide sequence of VGAM2635 RNA, herein designated VGAM RNA, also designated SEQ ID:5346.

Another function of VGAM2635 is therefore inhibition of RAD52 Homolog (S. cerevisiae) (RAD52, Accession NM_134422). Accordingly, utilities of VGAM2635 include diagnosis, prevention and treatment of diseases and clinical conditions associated with RAD52. Chromosome 21 Open Reading Frame 93 (C21orf93, Accession NM_145179) is another VGAM2635 host target gene. C21orf93 BINDING SITE is HOST TARGET binding site found in the 5' untranslated region of mRNA encoded by C21orf93, corresponding to a HOST TARGET binding site such as BINDING SITE I, BINDING SITE II or BINDING SITE III. Table 2 illustrates the complementarity of the nucleotide sequences of C21orf93 BINDING SITE, designated SEQ ID:29741, to the nucleotide sequence of VGAM2635 RNA, herein designated VGAM RNA, also designated SEQ ID:5346.

Another function of VGAM2635 is therefore inhibition of Chromosome 21 Open Reading Frame 93 (C21orf93, Accession NM_145179). Accordingly, utilities of VGAM2635 include diagnosis, prevention and treatment of diseases and clinical conditions associated with C21orf93. DKFZP434H132 (Accession XM_057020) is another VGAM2635 host target gene. DKFZP434H132 BINDING SITE is HOST TARGET binding site found in the 5' untranslated region of mRNA encoded by DKFZP434H132, corresponding to a HOST TARGET binding site such as BINDING SITE I, BINDING SITE II or BINDING SITE III. Table 2 illustrates the complementarity of the nucleotide sequences of DKFZP434H132 BINDING SITE, designated SEQ ID:36448, to the nucleotide sequence of VGAM2635 RNA, herein designated VGAM RNA, also designated SEQ ID:5346.

Another function of VGAM2635 is therefore inhibition of DKFZP434H132 (Accession XM_057020). Accordingly, utilities of VGAM2635 include diagnosis, prevention and treatment of diseases and clinical conditions associated with DKFZP434H132. Forkhead Box H1 (FOXH1, Accession NM_003923) is another VGAM2635 host target gene. FOXH1 BINDING SITE is HOST TARGET binding site found in the 5' untranslated region of mRNA encoded by FOXH1, corresponding to a HOST TARGET binding site such as BINDING SITE I, BINDING SITE II or BINDING SITE III. Table 2 illustrates the complementarity of the nucleotide sequences of FOXH1 BINDING SITE, designated SEQ ID:10011, to the nucleotide sequence of VGAM2635 RNA, herein designated VGAM RNA, also designated SEQ ID:5346.

Another function of VGAM2635 is therefore inhibition of Forkhead Box H1 (FOXH1, Accession NM_003923). Accordingly, utilities of VGAM2635 include diagnosis, prevention and treatment of diseases and clinical conditions associated with FOXH1. KIAA1468 (Accession XM_166289) is another VGAM2635 host target gene. KIAA1468 BINDING SITE is HOST TARGET binding site found in the 5' untranslated region of mRNA encoded by KIAA1468, corresponding to a HOST TARGET binding site such as BINDING SITE I, BINDING SITE II or BINDING SITE III. Table 2 illustrates the complementarity of the nucleotide sequences of KIAA1468 BINDING SITE, designated SEQ ID:44099, to the nucleotide sequence of VGAM2635 RNA, herein designated VGAM RNA, also designated SEQ ID:5346.

Another function of VGAM2635 is therefore inhibition of KIAA1468 (Accession XM_166289). Accordingly, utilities of VGAM2635 include diagnosis, prevention and treatment of diseases and clinical conditions associated with KIAA1468. Triple Homeobox 1 (TIX1, Accession XM_029734) is another VGAM2635 host target gene. TIX1 BINDING SITE is HOST TARGET binding site found in the 3' untranslated region of mRNA encoded by TIX1, corresponding to a HOST TARGET binding site such as BINDING SITE I, BINDING SITE II or BINDING SITE III. Table 2 illustrates the complementarity of the nucleotide sequences of TIX1 BINDING SITE, designated SEQ ID:30928, to the nucleotide sequence of VGAM2635 RNA, herein designated VGAM RNA, also designated SEQ ID:5346.

Another function of VGAM2635 is therefore inhibition of Triple Homeobox 1 (TIX1, Accession XM_029734). Accordingly, utilities of VGAM2635 include diagnosis, prevention and treatment of diseases and clinical conditions associated with TIX1. LOC148759 (Accession XM_097517) is another VGAM2635 host target gene. LOC148759 BINDING SITE is HOST TARGET binding site found in the 3' untranslated region of mRNA encoded by LOC148759, corresponding to a HOST TARGET binding site such as BINDING SITE I, BINDING SITE II or BINDING SITE III. Table 2 illustrates the complementarity of the nucleotide sequences of LOC148759 BINDING SITE, designated SEQ ID:40904, to the nucleotide sequence of VGAM2635 RNA, herein designated VGAM RNA, also designated SEQ ID:5346.

Another function of VGAM2635 is therefore inhibition of LOC148759 (Accession XM_097517). Accordingly, utilities of VGAM2635 include diagnosis, prevention and treatment of diseases and clinical conditions associated with LOC148759. LOC153937 (Accession XM_087813) is another VGAM2635 host target gene. LOC153937 BINDING SITE is HOST TARGET binding site found in the 5' untranslated region of mRNA encoded by LOC153937, corresponding to a HOST TARGET binding site such as BINDING SITE I, BINDING SITE II or BINDING SITE III. Table 2 illustrates the complementarity of the nucleotide sequences of LOC153937 BINDING SITE, designated SEQ ID:39447, to the nucleotide sequence of VGAM2635 RNA, herein designated VGAM RNA, also designated SEQ ID:5346.

Another function of VGAM2635 is therefore inhibition of LOC153937 (Accession XM_087813). Accordingly, utilities of VGAM2635 include diagnosis, prevention and treatment of diseases and clinical conditions associated with LOC153937. LOC200845 (Accession XM_114305) is another VGAM2635 host target gene. LOC200845 BINDING SITE is HOST TARGET binding site found in the 5' untranslated region of mRNA encoded by LOC200845, corresponding to a HOST TARGET binding site such as BINDING SITE I, BINDING SITE II or BINDING SITE III. Table 2 illustrates the complementarity of the nucleotide sequences of LOC200845 BINDING SITE, designated SEQ ID:42863, to the nucleotide sequence of VGAM2635 RNA, herein designated VGAM RNA, also designated SEQ ID:5346.

Another function of VGAM2635 is therefore inhibition of LOC200845 (Accession XM_114305). Accordingly, utilities of VGAM2635 include diagnosis, prevention and treatment of diseases and clinical conditions associated with LOC200845. LOC220776 (Accession XM_043388) is another VGAM2635 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33932, to the nucleotide sequence of VGAM2635 RNA, herein designated VGAM RNA, also designated SEQ ID:5346.

Another function of VGAM2635 is therefore inhibition of LOC220776 (Accession XM_043388). Accordingly, utilities of VGAM2635 include diagnosis, prevention and treatment of diseases and clinical conditions associated with LOC220776. FIG. 1 further provides a conceptual description of a novel bioinformatically detected viral gene of the present invention, referred to here as Viral Genomic Address Messenger 2636 (VGAM2636) viral gene, which modulates expression of respective host target genes thereof, the function and utility of which host target genes is known in the art.

VGAM2636 is a novel bioinformatically detected regulatory, non protein coding, viral micro RNA (miRNA) gene. The method by which VGAM2636 was detected is described hereinabove with reference to FIGS. 1-8.

VGAM2636 gene, herein designated VGAM GENE, is a viral gene contained in the genome of Sheeppox Virus. VGAM2636 host target gene, herein designated VGAM HOST TARGET GENE, is a human gene contained in the human genome.

VGAM2636 gene encodes a VGAM2636 precursor RNA, herein designated VGAM PRECURSOR RNA. Similar to other miRNA genes, and unlike most ordinary genes, VGAM2636 precursor RNA does not encode a protein. A nucleotide sequence identical or highly similar to the nucleotide sequence of VGAM2636 precursor RNA is designated SEQ ID:2622, and is provided hereinbelow with reference to the sequence listing part. Nucleotide sequence SEQ ID:2622 is located at position 25048 relative to the genome of Sheeppox Virus.

VGAM2636 precursor RNA folds onto itself, forming VGAM2636 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2636 folded precursor RNA into VGAM2636 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2636 RNA is designated SEQ ID:5347, and is provided hereinbelow with reference to the sequence listing part.

VGAM2636 host target gene, herein designated VGAM HOST TARGET GENE, encodes a corresponding messenger RNA, VGAM2636 host target RNA, herein designated VGAM HOST TARGET RNA. VGAM2636 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2636 RNA, herein designated VGAM RNA, binds complementarily to one or more host target binding sites located in untranslated regions of VGAM2636 host target RNA, herein designated VGAM HOST TARGET RNA. This complementary binding is due to the fact that the nucleotide sequence of VGAM2636 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2636 RNA, herein designated VGAM RNA, may have a different number of host target binding sites in untranslated regions of a VGAM2636 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2636 RNA, herein designated VGAM RNA, to host target binding sites on VGAM2636 host target RNA, herein designated VGAM HOST TARGET RNA, such as BINDING SITE I, BINDING SITE II and BINDING SITE III, inhibits translation of VGAM2636 host target RNA into VGAM2636 host target protein, herein designated VGAM HOST TARGET PROTEIN. VGAM host target protein is therefore outlined by a broken line.

It is appreciated that VGAM2636 host target gene, herein designated VGAM HOST TARGET GENE, in fact represents a plurality of VGAM2636 host target genes. The mRNA of each one of this plurality of VGAM2636 host target genes comprises one or more host target binding sites, each having a nucleotide sequence which is at least partly complementary to VGAM2636 RNA, herein designated VGAM RNA, and which when bound by VGAM2636 RNA causes inhibition of translation of respective one or more VGAM2636 host target proteins.

It is further appreciated by one skilled in the art that the mode of translational inhibition illustrated by FIG. 1 with specific reference to translational inhibition exerted by VGAM2636 gene, herein designated VGAM GENE, on one or more VGAM2636 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2636 is inhibition of expression of host target genes, as part of a novel viral mechanism of attacking a host. Accordingly, utilities of VGAM2636 include diagnosis, prevention and treatment of viral infection by Sheeppox Virus. Specific functions, and accordingly utilities, of VGAM2636 correlate with, and may be deduced from, the identity of the host target genes which VGAM2636 binds and inhibits, and the function of these host target genes, as elaborated hereinbelow.

Nucleotide sequences of the VGAM2636 precursor RNA, herein designated VGAM PRECURSOR RNA, and of the 'diced' VGAM2636 RNA, herein designated VGAM RNA, and a schematic representation of the secondary folding of VGAM2636 folded precursor RNA, herein designated VGAM FOLDED PRECURSOR RNA, of VGAM2636 are further described hereinbelow with reference to Table 1.

Nucleotide sequences of host target binding sites, such as BINDING SITE-I, BINDING SITE-II and BINDING SITE-III of FIG. 1, found on VGAM2636 host target RNA, and schematic representation of the complementarity of each of these host target binding sites to VGAM2636 RNA, herein designated VGAM RNA, are described hereinbelow with reference to Table 2.

As mentioned hereinabove with reference to FIG. 1, a function of VGAM2636 gene, herein designated VGAM is inhibition of expression of VGAM2636 target genes. It is appreciated that specific functions, and accordingly utilities, of VGAM2636 correlate with, and may be deduced from, the identity of the target genes which VGAM2636 binds and inhibits, and the function of these target genes, as elaborated hereinbelow.

Nuclear Receptor Coactivator 6 (NCOA6, Accession NM_014071) is a VGAM2636 host target gene. NCOA6 BINDING SITE is HOST TARGET binding site found in the 5' untranslated region of mRNA encoded by NCOA6, corresponding to a HOST TARGET binding site such as BINDING SITE I, BINDING SITE II or BINDING SITE III. Table 2 illustrates the complementarity of the nucleotide sequences of NCOA6 BINDING SITE, designated SEQ ID:15286, to the nucleotide sequence of VGAM2636 RNA, herein designated VGAM RNA, also designated SEQ ID:5347.

A function of VGAM2636 is therefore inhibition of Nuclear Receptor Coactivator 6 (NCOA6, Accession NM_014071), a gene which activates gene transcription through ligand-dependent association with coactivators. Accordingly, utilities of VGAM2636 include diagnosis, prevention and treatment of diseases and clinical conditions associated with NCOA6. The function of NCOA6 and its association with various diseases and clinical conditions, has been established by previous studies, as described hereinabove with reference to VGAM25. Solute Carrier Family 1 (glial high affinity glutamate transporter), Member 3 (SLC1A3, Accession NM_004172) is another VGAM2636 host target gene. SLC1A3 BINDING SITE is HOST TARGET binding site found in the 3' untranslated region of mRNA encoded by SLC1A3, corresponding to a HOST TARGET binding site such as BINDING SITE I, BINDING SITE II or BINDING SITE III. Table 2 illustrates the complementarity of the nucleotide sequences of SLC1A3 BINDING SITE, designated SEQ ID:10385, to the nucleotide sequence of VGAM2636 RNA, herein designated VGAM RNA, also designated SEQ ID:5347.

Another function of VGAM2636 is therefore inhibition of Solute Carrier Family 1 (glial high affinity glutamate transporter), Member 3 (SLC1A3, Accession NM_004172), a gene which is a transporter molecule that regulates neurotransmitter concentrations at excitatory synapses of the mammalian cns. Accordingly, utilities of VGAM2636 include diagnosis, prevention and treatment of diseases and clinical conditions associated with SLC1A3. The function of SLC1A3 and its association with various diseases and clinical conditions, has been established by previous studies, as described hereinabove with reference to VGAM294. Glutamine-fructose-6-phosphate Transaminase 1 (GFPT1, Accession NM_002056) is another VGAM2636 host target gene. GFPT1 BINDING SITE is HOST TARGET binding site found in the 3' untranslated region of mRNA encoded by GFPT1, corresponding to a HOST TARGET binding site such as BINDING SITE I, BINDING SITE II or BINDING SITE III. Table 2 illustrates the complementarity of the nucleotide sequences of GFPT1 BINDING SITE, designated SEQ ID:7817, to the nucleotide sequence of VGAM2636 RNA, herein designated VGAM RNA, also designated SEQ ID:5347.

Another function of VGAM2636 is therefore inhibition of Glutamine-fructose-6-phosphate Transaminase 1 (GFPT1, Accession NM_002056). Accordingly, utilities of VGAM2636 include diagnosis, prevention and treatment of diseases and clinical conditions associated with GFPT1. Glutamate Receptor, Ionotropic, N-methyl-D-aspartate 3A (GRIN3A, Accession NM_133445) is another VGAM2636 host target gene. GRIN3A BINDING SITE is HOST TARGET binding site found in the 3' untranslated region of mRNA encoded by GRIN3A, corresponding to a HOST TARGET binding site such as BINDING SITE I, BINDING SITE II or BINDING SITE III. Table 2 illustrates the complementarity of the nucleotide sequences of GRIN3A BINDING SITE, designated SEQ ID:28527, to the nucleotide sequence of VGAM2636 RNA, herein designated VGAM RNA, also designated SEQ ID:5347.

Another function of VGAM2636 is therefore inhibition of Glutamate Receptor, Ionotropic, N-methyl-D-aspartate 3A (GRIN3A, Accession NM_133445). Accordingly, utilities of VGAM2636 include diagnosis, prevention and treatment of diseases and clinical conditions associated with GRIN3A. KIAA1674 (Accession XM_044065) is another VGAM2636 host target gene. KIAA1674 BINDING SITE is HOST TARGET binding site found in the 3" untranslated region of mRNA encoded by KIAA1674, corresponding to a HOST TARGET binding site such as BINDING SITE I, BINDING SITE II or BINDING SITE III. Table 2 illustrates the complementarity of the nucleotide sequences of KIAA1674 BINDING SITE, designated SEQ ID:34115, to the nucleotide sequence of VGAM2636 RNA, herein designated VGAM RNA, also designated SEQ ID:5347.

Another function of VGAM2636 is therefore inhibition of KIAA1674 (Accession XM_044065). Accordingly, utilities of VGAM2636 include diagnosis, prevention and treatment of diseases and clinical conditions associated with KIAA1674. LOC51125 (Accession NM_016099) is another VGAM2636 host target gene. LOC51125 BINDING SITE is HOST TARGET binding site found in the 3' untranslated region of mRNA encoded by LOC51125, corresponding to a HOST TARGET binding site such as BINDING SITE I, BINDING SITE II or BINDING SITE III. Table 2 illustrates the complementarity of the nucleotide sequences of LOC51125 BINDING SITE, designated SEQ ID:18182, to the nucleotide sequence of VGAM2636 RNA, herein designated VGAM RNA, also designated SEQ ID:5347.

Another function of VGAM2636 is therefore inhibition of LOC51125 (Accession NM_016099). Accordingly, utilities of VGAM2636 include diagnosis, prevention and treatment of diseases and clinical conditions associated with LOC51125. FIG. 1 further provides a conceptual description of a novel bioinformatically detected viral gene of the present invention, referred to here as Viral Genomic Address Messenger 2637 (VGAM2637) viral gene, which modulates expression of respective host target genes thereof, the function and utility of which host target genes is known in the art.

VGAM2637 is a novel bioinformatically detected regulatory, non protein coding, viral micro RNA (miRNA) gene. The method by which VGAM2637 was detected is described hereinabove with reference to FIGS. 1-8.

VGAM2637 gene, herein designated VGAM GENE, is a viral gene contained in the genome of Goatpox Virus. VGAM2637 host target gene, herein designated VGAM HOST TARGET GENE, is a human gene contained in the human genome.

VGAM2637 gene encodes a VGAM2637 precursor RNA, herein designated VGAM PRECURSOR RNA. Similar to other miRNA genes, and unlike most ordinary genes, VGAM2637 precursor RNA does not encode a protein. A nucleotide sequence identical or highly similar to the nucleotide sequence of VGAM2637 precursor RNA is designated SEQ ID:2623, and is provided hereinbelow with reference to the sequence listing part. Nucleotide sequence SEQ ID:2623 is located at position 24739 relative to the genome of Goatpox Virus.

VGAM2637 precursor RNA folds onto itself, forming VGAM2637 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2637 folded precursor RNA into VGAM2637 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM2637 RNA is designated SEQ ID:5348, and is provided hereinbelow with reference to the sequence listing part.

VGAM2637 host target gene, herein designated VGAM HOST TARGET GENE, encodes a corresponding messenger RNA, VGAM2637 host target RNA, herein designated VGAM HOST TARGET RNA. VGAM2637 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2637 RNA, herein designated VGAM RNA, binds complementarily to one or more host target binding sites located in untranslated regions of VGAM2637 host target RNA, herein designated VGAM HOST TARGET RNA. This complementary binding is due to the fact that the nucleotide sequence of VGAM2637 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2637 RNA, herein designated VGAM RNA, may have a different number of host target binding sites in untranslated regions of a VGAM2637 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2637 RNA, herein designated VGAM RNA, to host target binding sites on VGAM2637 host target RNA, herein designated VGAM HOST TARGET RNA, such as BINDING SITE I, BINDING SITE II and BINDING SITE III, inhibits translation of VGAM2637 host target RNA into VGAM2637 host target protein, herein designated VGAM HOST TARGET PROTEIN. VGAM host target protein is therefore outlined by a broken line.

It is appreciated that VGAM2637 host target gene, herein designated VGAM HOST TARGET GENE, in fact represents a plurality of VGAM2637 host target genes. The mRNA of each one of this plurality of VGAM2637 host target genes comprises one or more host target binding sites, each having a nucleotide sequence which is at least partly complementary to VGAM2637 RNA, herein designated VGAM RNA, and which when bound by VGAM2637 RNA causes inhibition of translation of respective one or more VGAM2637 host target proteins.

It is further appreciated by one skilled in the art that the mode of translational inhibition illustrated by FIG. 1 with specific reference to translational inhibition exerted by VGAM2637 gene, herein designated VGAM GENE, on one or more VGAM2637 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2637 is inhibition of expression of host target genes, as part of a novel viral mechanism of attacking a host. Accordingly, utilities of VGAM2637 include diagnosis, prevention and treatment of viral infection by Goatpox Virus. Specific functions, and accordingly utilities, of VGAM2637 correlate with, and may be deduced from, the identity of the host target genes which VGAM2637 binds and inhibits, and the function of these host target genes, as elaborated hereinbelow.

Nucleotide sequences of the VGAM2637 precursor RNA, herein designated VGAM PRECURSOR RNA, and of the 'diced' VGAM2637 RNA, herein designated VGAM RNA, and a schematic representation of the secondary folding of VGAM2637 folded precursor RNA, herein designated VGAM FOLDED PRECURSOR RNA, of VGAM2637 are further described hereinbelow with reference to Table 1.

Nucleotide sequences of host target binding sites, such as BINDING SITE-I, BINDING SITE-II and BINDING SITE-III of FIG. 1, found on VGAM2637 host target RNA, and schematic representation of the complementarity of each of these host target binding sites to VGAM2637 RNA, herein designated VGAM RNA, are described hereinbelow with reference to Table 2.

As mentioned hereinabove with reference to FIG. 1, a function of VGAM2637 gene, herein designated VGAM is inhibition of expression of VGAM2637 target genes. It is appreciated that specific functions, and accordingly utilities, of VGAM2637 correlate with, and may be deduced from, the identity of the target genes which VGAM2637 binds and inhibits, and the function of these target genes, as elaborated hereinbelow.

Prostaglandin-endoperoxide Synthase 1 (prostaglandin G/H synthase and cyclooxygenase) (PTGS1, Accession NM_000962) is a VGAM2637 host target gene. PTGS1 BINDING SITE1 and PTGS1 BINDING SITE2 are HOST TARGET binding sites found in untranslated regions of mRNA encoded by PTGS1, corresponding to HOST TARGET binding sites such as BINDING SITE I, BINDING SITE II or BINDING SITE III. Table 2 illustrates the complementarity of the nucleotide sequences of PTGS1 BINDING SITE1 and PTGS1 BINDING SITE2, designated SEQ ID:6671 and SEQ ID:27892 respectively, to the nucleotide sequence of VGAM2637 RNA, herein designated VGAM RNA, also designated SEQ ID:5348.

A function of VGAM2637 is therefore inhibition of Prostaglandin-endoperoxide Synthase 1 (prostaglandin G/H synthase and cyclooxygenase) (PTGS1, Accession NM_000962), a gene which may play an important role in regulating or promoting cell proliferation in some normal and neoplastically transformed cells. Accordingly, utilities of VGAM2637 include diagnosis, prevention and treatment of diseases and clinical conditions associated with PTGS1. The function of PTGS1 and its association with various diseases and clinical conditions, has been established by previous studies, as described hereinabove with reference to VGAM1224. Von Hippel-Lindau Binding Protein 1 (VBP1, Accession NM_003372) is another VGAM2637 host target gene. VBP1 BINDING SITE is HOST TARGET binding site found in the 3' untranslated region of mRNA encoded by VBP1, corresponding to a HOST TARGET binding site such as BINDING SITE I, BINDING SITE II or BINDING SITE III. Table 2 illustrates the complementarity of the nucleotide sequences of VBP1 BINDING SITE, designated SEQ ID:9398, to the nucleotide sequence of VGAM2637 RNA, herein designated VGAM RNA, also designated SEQ ID:5348.

Another function of VGAM2637 is therefore inhibition of Von Hippel-Lindau Binding Protein 1 (VBP1, Accession NM_003372), a gene which binds specifically to cytosolic chaperonin (c-cpn) and transfers target proteins to it. Accordingly, utilities of VGAM2637 include diagnosis, prevention and treatment of diseases and clinical conditions associated with VBP1. The function of VBP1 and its association with various diseases and clinical conditions, has been established by previous studies, as described hereinabove with reference to VGAM945. Ras Homolog Gene Family, Member E (ARHE, Accession NM_005168) is another VGAM2637 host target gene. ARHE BINDING SITE is HOST TARGET binding site found in the 3' untranslated region of mRNA encoded by ARHE, corresponding to a HOST TARGET binding site such as BINDING SITE I, BINDING SITE II or BINDING SITE III. Table 2 illustrates the complementarity of the nucleotide sequences of ARHE BINDING SITE, designated SEQ ID:11667, to the nucleotide sequence of VGAM2637 RNA, herein designated VGAM RNA, also designated SEQ ID:5348.

Another function of VGAM2637 is therefore inhibition of Ras Homolog Gene Family, Member E (ARHE, Accession NM_005168). Accordingly, utilities of VGAM2637 include diagnosis, prevention and treatment of diseases and clinical conditions associated with ARHE. FLJ10139 (Accession NM_018005) is another VGAM2637 host target gene. FLJ10139 BINDING SITE is HOST TARGET binding site found in the 3' untranslated region of mRNA encoded by FLJ10139, corresponding to a HOST TARGET binding site such as BINDING SITE I, BINDING SITE II or BINDING SITE III. Table 2 illustrates the complementarity of the nucleotide sequences of FLJ10139 BINDING SITE, designated SEQ ID:19734, to the nucleotide sequence of VGAM2637 RNA, herein designated VGAM RNA, also designated SEQ ID:5348.

Another function of VGAM2637 is therefore inhibition of FLJ10139 (Accession NM_018005). Accordingly, utilities of VGAM2637 include diagnosis, prevention and treatment of diseases and clinical conditions associated with FLJ10139. KIAA1655 (Accession XM_039442) is another VGAM2637 host target gene. KIAA1655 BINDING SITE is HOST TARGET binding site found in the 3' untranslated region of mRNA encoded by KIAA1655, corresponding to a HOST TARGET binding site such as BINDING SITE I, BINDING SITE II or BINDING SITE III. Table 2 illustrates the complementarity of the nucleotide sequences of KIAA1655 BINDING SITE, designated SEQ ID:33090, to the nucleotide sequence of VGAM2637 RNA, herein designated VGAM RNA, also designated SEQ ID:5348.

Another function of VGAM2637 is therefore inhibition of KIAA1655 (Accession XM_039442). Accordingly, utilities of VGAM2637 include diagnosis, prevention and treatment of diseases and clinical conditions associated with KIAA1655. NY-REN-25 (Accession XM_027116) is another VGAM2637 host target gene. NY-REN-25 BINDING SITE is HOST TARGET binding site found in the 3' untranslated region of mRNA encoded by NY-REN-25, corresponding to a HOST TARGET binding site such as BINDING SITE I, BINDING SITE II or BINDING SITE III. Table 2 illustrates the complementarity of the nucleotide sequences of NY-REN-25 BINDING SITE, designated SEQ ID:30414, to the nucleotide sequence of VGAM2637 RNA, herein designated VGAM RNA, also designated SEQ ID:5348.

Another function of VGAM2637 is therefore inhibition of NY-REN-25 (Accession XM_027116). Accordingly, utilities of VGAM2637 include diagnosis, prevention and treatment of diseases and clinical conditions associated with NY-REN- 25. RoXaN (Accession NM_025013) is another VGAM2637 host target gene. RoXaN BINDING SITE is HOST TARGET binding site found in the 3' untranslated region of mRNA encoded by RoXaN, corresponding to a HOST TARGET binding site such as BINDING SITE I, BINDING SITE II or BINDING SITE III. Table 2 illustrates the complementarity of the nucleotide sequences of RoXaN BINDING SITE, designated SEQ ID:24599, to the nucleotide sequence of VGAM2637 RNA, herein designated VGAM RNA, also designated SEQ ID:5348.

Another function of VGAM2637 is therefore inhibition of RoXaN (Accession NM_025013). Accordingly, utilities of VGAM2637 include diagnosis, prevention and treatment of diseases and clinical conditions associated with RoXaN. FIG. 1 further provides a conceptual description of a novel bioinformatically detected viral gene of the present invention, referred to here as Viral Genomic Address Messenger 2638 (VGAM2638) viral gene, which modulates expression of respective host target genes thereof, the function and utility of which host target genes is known in the art.

VGAM2638 is a novel bioinformatically detected regulatory, non protein coding, viral micro RNA (miRNA) gene. The method by which VGAM2638 was detected is described hereinabove with reference to FIGS. 1-8.

VGAM2638 gene, herein designated VGAM GENE, is a viral gene contained in the genome of Foot-and-mouth Disease Virus O. VGAM2638 host target gene, herein designated VGAM HOST TARGET GENE, is a human gene contained in the human genome.

VGAM2638 gene encodes a VGAM2638 precursor RNA, herein designated VGAM PRECURSOR RNA. Similar to other miRNA genes, and unlike most ordinary genes, VGAM2638 precursor RNA does not encode a protein. A nucleotide sequence identical or highly similar to the nucleotide sequence of VGAM2638 precursor RNA is designated SEQ ID:2624, and is provided hereinbelow with reference to the sequence listing part. Nucleotide sequence SEQ ID:2624 is located at position 3143 relative to the genome of Foot-and-mouth Disease Virus O.

VGAM2638 precursor RNA folds onto itself, forming VGAM2638 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2638 folded precursor RNA into VGAM2638 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM2638 RNA is designated SEQ ID:5349, and is provided hereinbelow with reference to the sequence listing part.

VGAM2638 host target gene, herein designated VGAM HOST TARGET GENE, encodes a corresponding messenger RNA, VGAM2638 host target RNA, herein designated VGAM HOST TARGET RNA. VGAM2638 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2638 RNA, herein designated VGAM RNA, binds complementarily to one or more host target binding sites located in untranslated regions of VGAM2638 host target RNA, herein designated VGAM HOST TARGET RNA. This complementary binding is due to the fact that the nucleotide sequence of VGAM2638 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2638 RNA, herein designated VGAM RNA, may have a different number of host target binding sites in untranslated regions of a VGAM2638 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2638 RNA, herein designated VGAM RNA, to host target binding sites on VGAM2638 host target RNA, herein designated VGAM HOST TARGET RNA, such as BINDING SITE I, BINDING SITE II and BINDING SITE III, inhibits translation of VGAM2638 host target RNA into VGAM2638 host target protein, herein designated VGAM HOST TARGET PROTEIN. VGAM host target protein is therefore outlined by a broken line.

It is appreciated that VGAM2638 host target gene, herein designated VGAM HOST TARGET GENE, in fact represents a plurality of VGAM2638 host target genes. The mRNA of each one of this plurality of VGAM2638 host target genes comprises one or more host target binding sites, each having a nucleotide sequence which is at least partly complementary to VGAM2638 RNA, herein designated VGAM RNA, and which when bound by VGAM2638 RNA causes inhibition of translation of respective one or more VGAM2638 host target proteins.

It is further appreciated by one skilled in the art that the mode of translational inhibition illustrated by FIG. 1 with specific reference to translational inhibition exerted by VGAM2638 gene, herein designated VGAM GENE, on one or more VGAM2638 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2638 is inhibition of expression of host target genes, as part of a novel viral mechanism of attacking a host. Accordingly, utilities of VGAM2638 include diagnosis, prevention and treatment of viral infection by Foot-and-mouth Disease Virus O. Specific functions, and accordingly utilities, of VGAM2638 correlate with, and may be deduced from, the identity of the host target genes which VGAM2638 binds and inhibits, and the function of these host target genes, as elaborated hereinbelow.

Nucleotide sequences of the VGAM2638 precursor RNA, herein designated VGAM PRECURSOR RNA, and of the 'diced' VGAM2638 RNA, herein designated VGAM RNA, and a schematic representation of the secondary folding of VGAM2638 folded precursor RNA, herein designated VGAM FOLDED PRECURSOR RNA, of VGAM2638 are further described hereinbelow with reference to Table 1.

Nucleotide sequences of host target binding sites, such as BINDING SITE-I, BINDING SITE-II and BINDING SITE-III of FIG. 1, found on VGAM2638 host target RNA, and schematic representation of the complementarity of each of these host target binding sites to VGAM2638 RNA, herein designated VGAM RNA, are described hereinbelow with reference to Table 2.

As mentioned hereinabove with reference to FIG. 1, a function of VGAM2638 gene, herein designated VGAM is inhibition of expression of VGAM2638 target genes. It is appreciated that specific functions, and accordingly utilities, of VGAM2638 correlate with, and may be deduced from, the identity of the target genes which VGAM2638 binds and inhibits, and the function of these target genes, as elaborated hereinbelow.

Forkhead Box O1A (rhabdomyosarcoma) (FOXO1A, Accession NM_002015) is a VGAM2638 host target gene. FOXO1A BINDING SITE is HOST TARGET binding site found in the 3' untranslated region of mRNA encoded by FOXO1A, corresponding to a HOST TARGET binding site such as BINDING SITE I, BINDING SITE II or BINDING SITE III. Table 2 illustrates the complementarity of the nucleotide sequences of FOXO1A BINDING SITE, designated SEQ ID:7756, to the nucleotide sequence of VGAM2638 RNA, herein designated VGAM RNA, also designated SEQ ID:5349.

A function of VGAM2638 is therefore inhibition of Forkhead Box O1A (rhabdomyosarcoma) (FOXO1A, Accession NM_002015), a gene which is a probable transcription factor. Accordingly, utilities of VGAM2638 include diagnosis, prevention and treatment of diseases and clinical conditions associated with FOXO1A. The function of FOXO1A and its association with various diseases and clinical conditions, has been established by previous studies, as described hereinabove with reference to VGAM228. Retinoschisis (X-linked, juvenile) 1 (RS1, Accession NM_000330) is another VGAM2638 host target gene. RS1 BINDING SITE is HOST TARGET binding site found in the 3" untranslated region of mRNA encoded by RS1, corresponding to a HOST TARGET binding site such as BINDING SITE I, BINDING SITE II or BINDING SITE III. Table 2 illustrates the complementarity of the nucleotide sequences of RS1 BINDING SITE, designated SEQ ID:5873, to the nucleotide sequence of VGAM2638 RNA, herein designated VGAM RNA, also designated SEQ ID:5349.

Another function of VGAM2638 is therefore inhibition of Retinoschisis (X-linked, juvenile) 1 (RS1, Accession NM_000330). Accordingly, utilities of VGAM2638 include diagnosis, prevention and treatment of diseases and clinical conditions associated with RS1. Cadherin-like 26 (CDH26, Accession NM_021810) is another VGAM2638 host target gene. CDH26 BINDING SITE is HOST TARGET binding site found in the 5' untranslated region of mRNA encoded by CDH26, corresponding to a HOST TARGET binding site such as BINDING SITE I, BINDING SITE II or BINDING SITE III. Table 2 illustrates the complementarity of the nucleotide sequences of CDH26 BINDING SITE, designated SEQ ID:22370, to the nucleotide sequence of VGAM2638 RNA, herein designated VGAM RNA, also designated SEQ ID:5349.

Another function of VGAM2638 is therefore inhibition of Cadherin-like 26 (CDH26, Accession NM_021810). Accordingly, utilities of VGAM2638 include diagnosis, prevention and treatment of diseases and clinical conditions associated with CDH26. ZER6 (Accession XM_032742) is another VGAM2638 host target gene. ZER6 BINDING SITE is HOST TARGET binding site found in the 3' untranslated region of mRNA encoded by ZER6, corresponding to a HOST TARGET binding site such as BINDING SITE I, BINDING SITE II or BINDING SITE III. Table 2 illustrates the complementarity of the nucleotide sequences of ZER6 BINDING SITE, designated SEQ ID:31747, to the nucleotide sequence of VGAM2638 RNA, herein designated VGAM RNA, also designated SEQ ID:5349.

Another function of VGAM2638 is therefore inhibition of ZER6 (Accession XM_032742). Accordingly, utilities of VGAM2638 include diagnosis, prevention and treatment of diseases and clinical conditions associated with ZER6. LOC196527 (Accession XM_113743) is another VGAM2638 host target gene. LOC196527 BINDING SITE is HOST TARGET binding site found in the 3' untranslated region of mRNA encoded by LOC196527, corresponding to a HOST TARGET binding site such as BINDING SITE I, BINDING SITE II or BINDING SITE III. Table 2 illustrates the complementarity of the nucleotide sequences of LOC196527 BINDING SITE, designated SEQ ID:42397, to the nucleotide sequence of VGAM2638 RNA, herein designated VGAM RNA, also designated SEQ ID:5349.

Another function of VGAM2638 is therefore inhibition of LOC196527 (Accession XM_113743). Accordingly, utilities of VGAM2638 include diagnosis, prevention and treatment of diseases and clinical conditions associated with LOC196527. LOC220954 (Accession XM_167628) is another VGAM2638 host target gene. LOC220954 BINDING SITE is HOST TARGET binding site found in the 3' untranslated region of mRNA encoded by LOC220954, corresponding to a HOST TARGET binding site such as BINDING SITE I, BINDING SITE II or BINDING SITE III. Table 2 illustrates the complementarity of the nucleotide sequences of LOC220954 BINDING SITE, designated SEQ ID:44736, to the nucleotide sequence of VGAM2638 RNA, herein designated VGAM RNA, also designated SEQ ID:5349.

Another function of VGAM2638 is therefore inhibition of LOC220954 (Accession XM_167628). Accordingly, utilities of VGAM2638 include diagnosis, prevention and treatment of diseases and clinical conditions associated with LOC220954. FIG. 1 further provides a conceptual description of a novel bioinformatically detected viral gene of the present invention, referred to here as Viral Genomic Address Messenger 2639 (VGAM2639) viral gene, which modulates expression of respective host target genes thereof, the function and utility of which host target genes is known in the art.

VGAM2639 is a novel bioinformatically detected regulatory, non protein coding, viral micro RNA (miRNA) gene. The method by which VGAM2639 was detected is described hereinabove with reference to FIGS. 1-8.

VGAM2639 gene, herein designated VGAM GENE, is a viral gene contained in the genome of Foot-and-mouth Disease Virus O. VGAM2639 host target gene, herein designated VGAM HOST TARGET GENE, is a human gene contained in the human genome.

VGAM2639 gene encodes a VGAM2639 precursor RNA, herein designated VGAM PRECURSOR RNA. Similar to other miRNA genes, and unlike most ordinary genes, VGAM2639 precursor RNA does not encode a protein. A nucleotide sequence identical or highly similar to the nucleotide sequence of VGAM2639 precursor RNA is designated SEQ ID:2625, and is provided hereinbelow with reference to the sequence listing part. Nucleotide sequence SEQ ID:2625 is located at position 2526 relative to the genome of Foot-and-mouth Disease Virus O.

VGAM2639 precursor RNA folds onto itself, forming VGAM2639 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2639 folded precursor RNA into VGAM2639 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2639 RNA is designated SEQ ID:5350, and is provided hereinbelow with reference to the sequence listing part.

VGAM2639 host target gene, herein designated VGAM HOST TARGET GENE, encodes a corresponding messenger RNA, VGAM2639 host target RNA, herein designated VGAM HOST TARGET RNA. VGAM2639 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2639 RNA, herein designated VGAM RNA, binds complementarily to one or more host target binding sites located in untranslated regions of VGAM2639 host target RNA, herein designated VGAM HOST TARGET RNA. This complementary binding is due to the fact that the nucleotide sequence of VGAM2639 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2639 RNA, herein designated VGAM RNA, may have a different number of host target binding sites in untranslated regions of a VGAM2639 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2639 RNA, herein designated VGAM RNA, to host target binding sites on VGAM2639 host target RNA, herein designated VGAM HOST TARGET RNA, such as BINDING SITE I, BINDING SITE II and BINDING SITE III, inhibits translation of VGAM2639 host target RNA into VGAM2639 host target protein, herein designated VGAM HOST TARGET PROTEIN. VGAM host target protein is therefore outlined by a broken line.

It is appreciated that VGAM2639 host target gene, herein designated VGAM HOST TARGET GENE, in fact represents a plurality of VGAM2639 host target genes. The mRNA of each one of this plurality of VGAM2639 host target genes comprises one or more host target binding sites, each having a nucleotide sequence which is at least partly complementary to VGAM2639 RNA, herein designated VGAM RNA, and which when bound by VGAM2639 RNA causes inhibition of translation of respective one or more VGAM2639 host target proteins.

It is further appreciated by one skilled in the art that the mode of translational inhibition illustrated by FIG. 1 with specific reference to translational inhibition exerted by VGAM2639 gene, herein designated VGAM GENE, on one or more VGAM2639 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2639 is inhibition of expression of host target genes, as part of a novel viral mechanism of attacking a host. Accordingly, utilities of VGAM2639 include diagnosis, prevention and treatment of viral infection by Foot-and-mouth Disease Virus O. Specific functions, and accordingly utilities, of VGAM2639 correlate with, and may be deduced from, the identity of the host target genes which VGAM2639 binds and inhibits, and the function of these host target genes, as elaborated hereinbelow.

Nucleotide sequences of the VGAM2639 precursor RNA, herein designated VGAM PRECURSOR RNA, and of the 'diced' VGAM2639 RNA, herein designated VGAM RNA, and a schematic representation of the secondary folding of VGAM2639 folded precursor RNA, herein designated VGAM FOLDED PRECURSOR RNA, of VGAM2639 are further described hereinbelow with reference to Table 1.

Nucleotide sequences of host target binding sites, such as BINDING SITE-I, BINDING SITE-II and BINDING SITE-III of FIG. 1, found on VGAM2639 host target RNA, and schematic representation of the complementarity of each of these host target binding sites to VGAM2639 RNA, herein designated VGAM RNA, are described hereinbelow with reference to Table 2.

As mentioned hereinabove with reference to FIG. 1, a function of VGAM2639 gene, herein designated VGAM is inhibition of expression of VGAM2639 target genes. It is appreciated that specific functions, and accordingly utilities, of VGAM2639 correlate with, and may be deduced from, the identity of the target genes which VGAM2639 binds and inhibits, and the function of these target genes, as elaborated hereinbelow.

A Disintegrin and Metalloproteinase Domain 11 (ADAM11, Accession NM_021612) is a VGAM2639 host target gene. ADAM11 BINDING SITE is HOST TARGET binding site found in the 3' untranslated region of mRNA encoded by ADAM11, corresponding to a HOST TARGET binding site such as BINDING SITE I, BINDING SITE II or BINDING SITE III. Table 2 illustrates the complementarity of the nucleotide sequences of ADAM11 BINDING SITE, designated SEQ ID:22241, to the nucleotide sequence of VGAM2639 RNA, herein designated VGAM RNA, also designated SEQ ID:5350.

A function of VGAM2639 is therefore inhibition of A Disintegrin and Metalloproteinase Domain 11 (ADAM11, Accession NM_021612), a gene which Member of the ADAM family of zinc metalloproteases. Accordingly, utilities of VGAM2639 include diagnosis, prevention and treatment of diseases and clinical conditions associated with ADAM11. The function of ADAM11 and its association with various diseases and clinical conditions, has been established by previous studies, as described hereinabove with reference to VGAM387. BTB and CNC Homology 1, Basic Leucine Zipper Transcription Factor 1 (BACH1, Accession NM_001186) is another VGAM2639 host target gene. BACH1 BINDING SITE is HOST TARGET binding site found in the 3' untranslated region of mRNA encoded by BACH1, corresponding to a HOST TARGET binding site such as BINDING SITE I, BINDING SITE II or BINDING SITE III. Table 2 illustrates the complementarity of the nucleotide sequences of BACH1 BINDING SITE, designated SEQ ID:6857, to the nucleotide sequence of VGAM2639 RNA, herein designated VGAM RNA, also designated SEQ ID:5350.

Another function of VGAM2639 is therefore inhibition of BTB and CNC Homology 1, Basic Leucine Zipper Transcription Factor 1 (BACH1, Accession NM_001186), a gene which acts as repressor or activator, binds to nf-e2 binding sites. Accordingly, utilities of VGAM2639 include diagnosis, prevention and treatment of diseases and clinical conditions associated with BACH1. The function of BACH1 and its association with various diseases and clinical conditions, has been established by previous studies, as described hereinabove with reference to VGAM724. Carnitine Acetyltransferase (CRAT, Accession NM_004003) is another VGAM2639 host target gene. CRAT BINDING SITE is HOST TARGET binding site found in the 5' untranslated region of mRNA encoded by CRAT, corresponding to a HOST TARGET binding site such as BINDING SITE I, BINDING SITE II or BINDING SITE III. Table 2 illustrates the complementarity of the nucleotide sequences of CRAT BINDING SITE, designated SEQ ID:10151, to the nucleotide sequence of VGAM2639 RNA, herein designated VGAM RNA, also designated SEQ ID:5350.

Another function of VGAM2639 is therefore inhibition of Carnitine Acetyltransferase (CRAT, Accession NM_004003), a gene which catalyzes the reversible transfer of acyl groups from an acyl-CoA thioester to carnitine. Accordingly, utilities of VGAM2639 include diagnosis, prevention and treatment of diseases and clinical conditions associated with CRAT. The function of CRAT and its association with various diseases and clinical conditions, has been established by previous studies, as described hereinabove with reference to VGAM1189. Potassium Voltage-gated Channel, Shal-related Subfamily, Member 2 (KCND2, Accession NM_012281) is another VGAM2639 host target gene. KCND2 BINDING SITE is HOST TARGET binding site found in the 5' untranslated region of mRNA encoded by KCND2, corresponding to a HOST TARGET binding site such as BINDING SITE I, BINDING SITE II or BINDING SITE III. Table 2 illustrates the complementarity of the nucleotide sequences of KCND2 BINDING SITE, designated SEQ ID:14607, to the nucleotide sequence of VGAM2639 RNA, herein designated VGAM RNA, also designated SEQ ID:5350.

Another function of VGAM2639 is therefore inhibition of Potassium Voltage-gated Channel, Shal-related Subfamily, Member 2 (KCND2, Accession NM_012281), a gene which is prominent in the repolarization phase of the action potential. Accordingly, utilities of VGAM2639 include diagnosis, prevention and treatment of diseases and clinical conditions associated with KCND2. The function of KCND2 and its association with various diseases and clinical conditions, has been established by previous studies, as described hereinabove with reference to VGAM449. Transforming Growth Factor, Beta Receptor II (70/80 kDa) (TGFBR2, Accession NM_003242) is another VGAM2639 host target gene. TGFBR2 BINDING SITE is HOST TARGET binding site found in the 3' untranslated region of mRNA encoded by TGFBR2, corresponding to a HOST TARGET binding site such as BINDING SITE I, BINDING SITE II or BINDING SITE III. Table 2 illustrates the complementarity of the nucleotide sequences of TGFBR2 BINDING SITE, designated SEQ ID:9237, to the nucleotide sequence of VGAM2639 RNA, herein designated VGAM RNA, also designated SEQ ID:5350.

Another function of VGAM2639 is therefore inhibition of Transforming Growth Factor, Beta Receptor II (70/80 kDa) (TGFBR2, Accession NM_003242). Accordingly, utilities of VGAM2639 include diagnosis, prevention and treatment of diseases and clinical conditions associated with TGFBR2. KIAA0628 (Accession NM_014789) is another VGAM2639 host target gene. KIAA0628 BINDING SITE is HOST TARGET binding site found in the 3" untranslated region of mRNA encoded by KIAA0628, corresponding to a HOST TARGET binding site such as BINDING SITE I, BINDING SITE II or BINDING SITE III. Table 2 illustrates the complementarity of the nucleotide sequences of KIAA0628 BINDING SITE, designated SEQ ID:16674, to the nucleotide sequence of VGAM2639 RNA, herein designated VGAM RNA, also designated SEQ ID:5350.

Another function of VGAM2639 is therefore inhibition of KIAA0628 (Accession NM_014789). Accordingly, utilities of VGAM2639 include diagnosis, prevention and treatment of diseases and clinical conditions associated with KIAA0628. KIAA0960 (Accession XM_166543) is another VGAM2639 host target gene. KIAA0960 BINDING SITE is HOST TARGET binding site found in the 3' untranslated region of mRNA encoded by KIAA0960, corresponding to a HOST TARGET binding site such as BINDING SITE I, BINDING SITE II or BINDING SITE III. Table 2 illustrates the complementarity of the nucleotide sequences of KIAA0960 BINDING SITE, designated SEQ ID:44516, to the nucleotide sequence of VGAM2639 RNA, herein designated VGAM RNA, also designated SEQ ID:5350.

Another function of VGAM2639 is therefore inhibition of KIAA0960 (Accession XM_166543). Accordingly, utilities of VGAM2639 include diagnosis, prevention and treatment of diseases and clinical conditions associated with KIAA0960. LOC150776 (Accession XM_032542) is another VGAM2639 host target gene. LOC150776 BINDING SITE is HOST TARGET binding site found in the 3' untranslated region of mRNA encoded by LOC150776, corresponding to a HOST TARGET binding site such as BINDING SITE I, BINDING SITE II or BINDING SITE III. Table 2 illustrates the complementarity of the nucleotide sequences of LOC150776 BINDING SITE, designated SEQ ID:31672, to the nucleotide sequence of VGAM2639 RNA, herein designated VGAM RNA, also designated SEQ ID:5350.

Another function of VGAM2639 is therefore inhibition of LOC150776 (Accession XM_032542). Accordingly, utilities of VGAM2639 include diagnosis, prevention and treatment of diseases and clinical conditions associated with LOC150776. FIG. 1 further provides a conceptual description of a novel bioinformatically detected viral gene of the present invention, referred to here as Viral Genomic Address Messenger 2640 (VGAM2640) viral gene, which modulates expression of respective host target genes thereof, the function and utility of which host target genes is known in the art.

VGAM2640 is a novel bioinformatically detected regulatory, non protein coding, viral micro RNA (miRNA) gene. The method by which VGAM2640 was detected is described hereinabove with reference to FIGS. 1-8.

VGAM2640 gene, herein designated VGAM GENE, is a viral gene contained in the genome of Foot-and-mouth Disease Virus O. VGAM2640 host target gene, herein designated VGAM HOST TARGET GENE, is a human gene contained in the human genome.

VGAM2640 gene encodes a VGAM2640 precursor RNA, herein designated VGAM PRECURSOR RNA. Similar to other miRNA genes, and unlike most ordinary genes, VGAM2640 precursor RNA does not encode a protein. A nucleotide sequence identical or highly similar to the nucleotide sequence of VGAM2640 precursor RNA is designated SEQ ID:2626, and is provided hereinbelow with reference to the sequence listing part. Nucleotide sequence SEQ ID:2626 is located at position 4136 relative to the genome of Foot-and-mouth Disease Virus O.

VGAM2640 precursor RNA folds onto itself, forming VGAM2640 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2640 folded precursor RNA into VGAM2640 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM2640 RNA is designated SEQ ID:5351, and is provided hereinbelow with reference to the sequence listing part.

VGAM2640 host target gene, herein designated VGAM HOST TARGET GENE, encodes a corresponding messenger RNA, VGAM2640 host target RNA, herein designated VGAM HOST TARGET RNA. VGAM2640 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2640 RNA, herein designated VGAM RNA, binds complementarily to one or more host target binding sites located in untranslated regions of VGAM2640 host target RNA, herein designated VGAM HOST TARGET RNA. This complementary binding is due to the fact that the nucleotide sequence of VGAM2640 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2640 RNA, herein designated VGAM RNA, may have a different number of host target binding sites in untranslated regions of a VGAM2640 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2640 RNA, herein designated VGAM RNA, to host target binding sites on VGAM2640 host target RNA, herein designated VGAM HOST TARGET RNA, such as BINDING SITE I, BINDING SITE II and BINDING SITE III, inhibits translation of VGAM2640 host target RNA into VGAM2640 host target protein, herein designated VGAM HOST TARGET PROTEIN. VGAM host target protein is therefore outlined by a broken line.

It is appreciated that VGAM2640 host target gene, herein designated VGAM HOST TARGET GENE, in fact represents a plurality of VGAM2640 host target genes. The mRNA of each one of this plurality of VGAM2640 host target genes comprises one or more host target binding sites, each having a nucleotide sequence which is at least partly complementary to VGAM2640 RNA, herein designated VGAM RNA, and which when bound by VGAM2640 RNA causes inhibition of translation of respective one or more VGAM2640 host target proteins.

It is further appreciated by one skilled in the art that the mode of translational inhibition illustrated by FIG. 1 with specific reference to translational inhibition exerted by VGAM2640 gene, herein designated VGAM GENE, on one or more VGAM2640 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2640 is inhibition of expression of host target genes, as part of a novel viral mechanism of attacking a host. Accordingly, utilities of VGAM2640 include diagnosis, prevention and treatment of viral infection by Foot-and-mouth Disease Virus O. Specific functions, and accordingly utilities, of VGAM2640 correlate with, and may be deduced from, the identity of the host target genes which VGAM2640 binds and inhibits, and the function of these host target genes, as elaborated hereinbelow.

Nucleotide sequences of the VGAM2640 precursor RNA, herein designated VGAM PRECURSOR RNA, and of the 'diced' VGAM2640 RNA, herein designated VGAM RNA, and a schematic representation of the secondary folding of VGAM2640 folded precursor RNA, herein designated VGAM FOLDED PRECURSOR RNA, of VGAM2640 are further described hereinbelow with reference to Table 1.

Nucleotide sequences of host target binding sites, such as BINDING SITE-I, BINDING SITE-II and BINDING SITE-III of FIG. 1, found on VGAM2640 host target RNA, and schematic representation of the complementarity of each of these host target binding sites to VGAM2640 RNA, herein designated VGAM RNA, are described hereinbelow with reference to Table 2.

As mentioned hereinabove with reference to FIG. 1, a function of VGAM2640 gene, herein designated VGAM is inhibition of expression of VGAM2640 target genes. It is appreciated that specific functions, and accordingly utilities, of VGAM2640 correlate with, and may be deduced from, the identity of the target genes which VGAM2640 binds and inhibits, and the function of these target genes, as elaborated hereinbelow.

B-cell CLL/lymphoma 11B (zinc finger protein) (BCL11B, Accession NM_022898) is a VGAM2640 host target gene. BCL11B BINDING SITE is HOST TARGET binding site found in the 3' untranslated region of mRNA encoded by BCL11B, corresponding to a HOST TARGET binding site such as BINDING SITE I, BINDING SITE II or BINDING SITE III. Table 2 illustrates the complementarity of the nucleotide sequences of BCL11B BINDING SITE, designated SEQ ID:23168, to the nucleotide sequence of VGAM2640 RNA, herein designated VGAM RNA, also designated SEQ ID:5351.

A function of VGAM2640 is therefore inhibition of B-cell CLL/lymphoma 11B (zinc finger protein) (BCL11B, Accession NM_022898). Accordingly, utilities of VGAM2640 include diagnosis, prevention and treatment of diseases and clinical conditions associated with BCL11B. Developmentally Regulated GTP Binding Protein 2 (DRG2, Accession NM_001388) is another VGAM2640 host target gene. DRG2 BINDING SITE is HOST TARGET binding site found in the 3' untranslated region of mRNA encoded by DRG2, corresponding to a HOST TARGET binding site such as BINDING SITE I, BINDING SITE II or BINDING SITE III. Table 2 illustrates the complementarity of the nucleotide sequences of DRG2 BINDING SITE, designated SEQ ID:7075, to the nucleotide sequence of VGAM2640 RNA, herein designated VGAM RNA, also designated SEQ ID:5351.

Another function of VGAM2640 is therefore inhibition of Developmentally Regulated GTP Binding Protein 2 (DRG2, Accession NM_001388), a gene which may play a role in cell proliferation, differentiation and death. Accordingly, utilities of VGAM2640 include diagnosis, prevention and treatment of diseases and clinical conditions associated with DRG2. The function of DRG2 and its association with various diseases and clinical conditions, has been established by previous studies, as described hereinabove with reference to VGAM2003. LFG (Accession XM_084780) is another VGAM2640 host target gene. LFG BINDING SITE is HOST TARGET binding site found in the 3' untranslated region of mRNA encoded by LFG, corresponding to a HOST TARGET binding site such as BINDING SITE I, BINDING SITE II or BINDING SITE III. Table 2 illustrates the complementarity of the nucleotide sequences of LFG BINDING SITE, designated SEQ ID:37694, to the nucleotide sequence of VGAM2640 RNA, herein designated VGAM RNA, also designated SEQ ID:5351.

Another function of VGAM2640 is therefore inhibition of LFG (Accession XM_084780). Accordingly, utilities of VGAM2640 include diagnosis, prevention and treatment of diseases and clinical conditions associated with LFG. Neogenin Homolog 1 (chicken) (NEO1, Accession NM_002499) is another VGAM2640 host target gene. NEO1 BINDING SITE is HOST TARGET binding site found in the 3' untranslated region of mRNA encoded by NEO1, corresponding to a HOST TARGET binding site such as BINDING SITE I, BINDING SITE II or BINDING SITE III. Table 2 illustrates the complementarity of the nucleotide sequences of NEO1 BINDING SITE, designated SEQ ID:8318, to the nucleotide sequence of VGAM2640 RNA, herein designated VGAM RNA, also designated SEQ ID:5351.

Another function of VGAM2640 is therefore inhibition of Neogenin Homolog 1 (chicken) (NEO1, Accession NM_002499), a gene which regulates the transition of undifferentiated proliferating cells to their differentiated state. Accordingly, utilities of VGAM2640 include diagnosis, prevention and treatment of diseases and clinical conditions associated with NEO1. The function of NEO1 and its association with various diseases and clinical conditions, has been established by previous studies, as described hereinabove with reference to VGAM329. RAP1, GTPase Activating Protein 1 (RAP1GA1, Accession NM_002885) is another VGAM2640 host target gene. RAP1GA1 BINDING SITE is HOST TARGET binding site found in the 3' untranslated region of mRNA encoded by RAP1GA1, corresponding to a HOST TARGET binding site such as BINDING SITE I, BINDING SITE II or BINDING SITE III. Table 2 illustrates the complementarity of the nucleotide sequences of RAP1GA1 BINDING SITE, designated SEQ ID:8799, to the nucleotide sequence of VGAM2640 RNA, herein designated VGAM RNA, also designated SEQ ID:5351.

Another function of VGAM2640 is therefore inhibition of RAP1, GTPase Activating Protein 1 (RAP1GA1, Accession NM_002885). Accordingly, utilities of VGAM2640 include diagnosis, prevention and treatment of diseases and clinical conditions associated with RAP1GA1. Solute Carrier Family 19 (folate transporter), Member 1 (SLC19A1, Accession NM_003056) is another VGAM2640 host target gene. SLC19A1 BINDING SITE is HOST TARGET binding site found in the 5" untranslated region of mRNA encoded by SLC19A1, corresponding to a HOST TARGET binding site such as BINDING SITE I, BINDING SITE II or BINDING SITE III. Table 2 illustrates the complementarity of the nucleotide sequences of SLC19A1 BINDING SITE, designated SEQ ID:9024, to the nucleotide sequence of VGAM2640 RNA, herein designated VGAM RNA, also designated SEQ ID:5351.

Another function of VGAM2640 is therefore inhibition of Solute Carrier Family 19 (folate transporter), Member 1 (SLC19A1, Accession NM_003056). Accordingly, utilities of VGAM2640 include diagnosis, prevention and treatment of diseases and clinical conditions associated with SLC19A1. SRY (sex determining region Y)-box 15 (SOX15, Accession NM_006942) is another VGAM2640 host target gene. SOX15 BINDING SITE is HOST TARGET binding site found in the 5' untranslated region of mRNA encoded by SOX15, corresponding to a HOST TARGET binding site such as BINDING SITE I, BINDING SITE II or BINDING SITE III. Table 2 illustrates the complementarity of the nucleotide sequences of SOX15 BINDING SITE, designated SEQ ID:13827, to the nucleotide sequence of VGAM2640 RNA, herein designated VGAM RNA, also designated SEQ ID:5351.

Another function of VGAM2640 is therefore inhibition of SRY (sex determining region Y)-box 15 (SOX15, Accession NM_006942), a gene which is a member of the SOX gene family. Accordingly, utilities of VGAM2640 include diagnosis, prevention and treatment of diseases and clinical conditions associated with SOX15. The function of SOX15 has been established by previous studies. The testis-determining gene SRY (OMIM Ref. No. 480000) encodes a transcription factor characterized by a DNA-binding motif known as the HMG domain. The SOX gene family consists of genes related to SRY, with a sequence identity of more than 60% to the SRY HMG box. Other members of the SOX gene family are assumed to play a role in gonadal function: the murine Sox5 gene is expressed exclusively in post-meiotic germ cells. SOX4 (OMIM Ref. No. 184430) is expressed in brain, heart, and testis. Mutations in the human SOX9 gene (OMIM Ref. No. 114290) cause a skeletal dysplasia, campomelic dysplasia associated with autosomal sex reversal. By use of a SOX9 cDNA as a hybridization probe, Meyer et al. (1996) discovered a new member of the SOX gene family, designated SOX20. They found that SOX20 has a high similarity to the deduced amino acid sequence of human SOX12 and murine Sox16 HMG domains. By fluorescence in situ hybridization (FISH), Meyer et al. (1996) mapped the SOX20 gene to 17p13. Critcher et al. (1998) used FISH to refine the localization to 17p12.3. Vujic et al. (1998) assigned the SOX20 gene to 17p13.1 by the study of a radiation hybrid panel.

Full details of the abovementioned studies are described in the following publications, the disclosure of which are hereby incorporated by reference:

Meyer, J.; Wirth, J.; Held, M.; Schempp, W.; Scherer, G.: SOX20, a new member of the SOX gene family, is located on chromosome 17p13. Cytogenet. Cell Genet. 72:246-249, 1996; and Vujic, M.; Rajic, T.; Goodfellow, P. N.; Stevanovic, M.: cDNA characterization and high resolution mapping of the human SOX20 gene. Mammalian Genome 9: 1059-1061, 1998.

Further studies establishing the function and utilities of SOX15 are found in John Hopkins OMIM database record ID 601297, and in sited publications numbered 12406-6897 listed in the bibliography section hereinbelow, which are also hereby incorporated by reference. Tumor Necrosis Factor Receptor Superfamily, Member 8 (TNFRSF8, Accession NM_001243) is another VGAM2640 host target gene. TNFRSF8 BINDING SITE is HOST TARGET binding site found in the 3' untranslated region of mRNA encoded by TNFRSF8, corresponding to a HOST TARGET binding site such as BINDING SITE I, BINDING SITE II or BINDING SITE III. Table 2 illustrates the complementarity of the nucleotide sequences of TNFRSF8 BINDING SITE, designated SEQ ID:6910, to the nucleotide sequence of VGAM2640 RNA, herein designated VGAM RNA, also designated SEQ ID:5351.

Another function of VGAM2640 is therefore inhibition of Tumor Necrosis Factor Receptor Superfamily, Member 8 (TNFRSF8, Accession NM_001243), a gene which regulates gene expression through activation of nf-kappab. Accordingly, utilities of VGAM2640 include diagnosis, prevention and treatment of diseases and clinical conditions associated with TNFRSF8. The function of TNFRSF8 and its association with various diseases and clinical conditions, has been established by previous studies, as described hereinabove with reference to VGAM154. Ubiquitin-conjugating Enzyme E2 Variant 1 (UBE2V1, Accession NM_003349) is another VGAM2640 host target gene. UBE2V1 BINDING SITE1 through UBE2V1 BINDING SITE3 are HOST TARGET binding sites found in untranslated regions of mRNA encoded by UBE2V1, corresponding to HOST TARGET binding sites such as BINDING SITE I, BINDING SITE II or BINDING SITE III. Table 2 illustrates the complementarity of the nucleotide sequences of UBE2V1 BINDING SITE1 through UBE2V1 BINDING SITE3, designated SEQ ID:9373, SEQ ID:22772 and SEQ ID:22525 respectively, to the nucleotide sequence of VGAM2640 RNA, herein designated VGAM RNA, also designated SEQ ID:5351.

Another function of VGAM2640 is therefore inhibition of Ubiquitin-conjugating Enzyme E2 Variant 1 (UBE2V1, Accession NM_003349), a gene which may play a role in signaling for DNA repair. Accordingly, utilities of VGAM2640 include diagnosis, prevention and treatment of diseases and clinical conditions associated with UBE2V1. The function of UBE2V1 and its association with various diseases and clinical conditions, has been established by previous studies, as described hereinabove with reference to VGAM155. Chromosome 20 Open Reading Frame 18 (C20orf18, Accession NM_031228) is another VGAM2640 host target gene. C20orf18 BINDING SITE is HOST TAR- GET binding site found in the 3' untranslated region of mRNA encoded by C20orf18, corresponding to a HOST TARGET binding site such as BINDING SITE I, BINDING SITE II or BINDING SITE III. Table 2 illustrates the complementarity of the nucleotide sequences of C20orf18 BINDING SITE, designated SEQ ID:25276, to the nucleotide sequence of VGAM2640 RNA, herein designated VGAM RNA, also designated SEQ ID:5351.

Another function of VGAM2640 is therefore inhibition of Chromosome 20 Open Reading Frame 18 (C20orf18, Accession NM_031228). Accordingly, utilities of VGAM2640 include diagnosis, prevention and treatment of diseases and clinical conditions associated with C20orf18. CDT1 (Accession XM_085327) is another VGAM2640 host target gene. CDT1 BINDING SITE is HOST TARGET binding site found in the 5' untranslated region of mRNA encoded by CDT1, corresponding to a HOST TARGET binding site such as BINDING SITE I, BINDING SITE II or BINDING SITE III. Table 2 illustrates the complementarity of the nucleotide sequences of CDT1 BINDING SITE, designated SEQ ID:38067, to the nucleotide sequence of VGAM2640 RNA, herein designated VGAM RNA, also designated SEQ ID:5351.

Another function of VGAM2640 is therefore inhibition of CDT1 (Accession XM_085327). Accordingly, utilities of VGAM2640 include diagnosis, prevention and treatment of diseases and clinical conditions associated with CDT1. Cat Eye Syndrome Chromosome Region, Candidate 7 (CECR7, Accession XM_086803) is another VGAM2640 host target gene. CECR7 BINDING SITE is HOST TARGET binding site found in the 5' untranslated region of mRNA encoded by CECR7, corresponding to a HOST TARGET binding site such as BINDING SITE I, BINDING SITE II or BINDING SITE III. Table 2 illustrates the complementarity of the nucleotide sequences of CECR7 BINDING SITE, designated SEQ ID:38880, to the nucleotide sequence of VGAM2640 RNA, herein designated VGAM RNA, also designated SEQ ID:5351.

Another function of VGAM2640 is therefore inhibition of Cat Eye Syndrome Chromosome Region, Candidate 7 (CECR7, Accession XM_086803). Accordingly, utilities of VGAM2640 include diagnosis, prevention and treatment of diseases and clinical conditions associated with CECR7. Carbohydrate (N-acetylgalactosamine 4-0) Sulfotransferase 8 (CHST8, Accession NM_022467) is another VGAM2640 host target gene. CHST8 BINDING SITE is HOST TARGET binding site found in the 5' untranslated region of mRNA encoded by CHST8, corresponding to a HOST TARGET binding site such as BINDING SITE I, BINDING SITE II or BINDING SITE III. Table 2 illustrates the complementarity of the nucleotide sequences of CHST8 BINDING SITE, designated SEQ ID:22818, to the nucleotide sequence of VGAM2640 RNA, herein designated VGAM RNA, also designated SEQ ID:5351.

Another function of VGAM2640 is therefore inhibition of Carbohydrate (N-acetylgalactosamine 4-0) Sulfotransferase 8 (CHST8, Accession NM_022467). Accordingly, utilities of VGAM2640 include diagnosis, prevention and treatment of diseases and clinical conditions associated with CHST8. DKFZP434H132 (Accession XM_057020) is another VGAM2640 host target gene. DKFZP434H132 BINDING SITE is HOST TARGET binding site found in the 5' untranslated region of mRNA encoded by DKFZP434H132, corresponding to a HOST TARGET binding site such as BINDING SITE I, BINDING SITE II or BINDING SITE III. Table 2 illustrates the complementarity of the nucleotide sequences of DKFZP434H132 BINDING SITE, designated SEQ ID:36450, to the nucleotide sequence of VGAM2640 RNA, herein designated VGAM RNA, also designated SEQ ID:5351.

Another function of VGAM2640 is therefore inhibition of DKFZP434H132 (Accession XM_057020). Accordingly, utilities of VGAM2640 include diagnosis, prevention and treatment of diseases and clinical conditions associated with DKFZP434H132. Delta-like 1 (Drosophila) (DLL1, Accession NM_005618) is another VGAM2640 host target gene. DLL1 BINDING SITE is HOST TARGET binding site found in the 3' untranslated region of mRNA encoded by DLL1, corresponding to a HOST TARGET binding site such as BINDING SITE I, BINDING SITE II or BINDING SITE III. Table 2 illustrates the complementarity of the nucleotide sequences of DLL1 BINDING SITE, designated SEQ ID:12134, to the nucleotide sequence of VGAM2640 RNA, herein designated VGAM RNA, also designated SEQ ID:5351.

Another function of VGAM2640 is therefore inhibition of Delta-like 1 (Drosophila) (DLL1, Accession NM_005618). Accordingly, utilities of VGAM2640 include diagnosis, prevention and treatment of diseases and clinical conditions associated with DLL1. FLJ10242 (Accession NM_018036) is another VGAM2640 host target gene. FLJ10242 BINDING SITE is HOST TARGET binding site found in the 3' untranslated region of mRNA encoded by FLJ10242, corresponding to a HOST TARGET binding site such as BINDING SITE I, BINDING SITE II or BINDING SITE III. Table 2 illustrates the complementarity of the nucleotide sequences of FLJ10242 BINDING SITE, designated SEQ ID:19776, to the nucleotide sequence of VGAM2640 RNA, herein designated VGAM RNA, also designated SEQ ID:5351.

Another function of VGAM2640 is therefore inhibition of FLJ10242 (Accession NM_018036). Accordingly, utilities of VGAM2640 include diagnosis, prevention and treatment of diseases and clinical conditions associated with FLJ10242. FLJ12076 (Accession NM_025187) is another VGAM2640 host target gene. FLJ12076 BINDING SITE is HOST TARGET binding site found in the 5' untranslated region of mRNA encoded by FLJ12076, corresponding to a HOST TARGET binding site such as BINDING SITE I, BINDING SITE II or BINDING SITE III. Table 2 illustrates the complementarity of the nucleotide sequences of FLJ12076 BINDING SITE, designated SEQ ID:24826, to the nucleotide sequence of VGAM2640 RNA, herein designated VGAM RNA, also designated SEQ ID:5351.

Another function of VGAM2640 is therefore inhibition of FLJ12076 (Accession NM_025187). Accordingly, utilities of VGAM2640 include diagnosis, prevention and treatment of diseases and clinical conditions associated with FLJ12076. Myelin Transcription Factor 1 (MYT1, Accession NM_004535) is another VGAM2640 host target gene. MYT1 BINDING SITE is HOST TARGET binding site found in the 3' untranslated region of mRNA encoded by MYT1, corresponding to a HOST TARGET binding site such as BINDING SITE I, BINDING SITE II or BINDING SITE III. Table 2 illustrates the complementarity of the nucleotide sequences of MYT1 BINDING SITE, designated SEQ ID:10877, to the nucleotide sequence of VGAM2640 RNA, herein designated VGAM RNA, also designated SEQ ID:5351.

Another function of VGAM2640 is therefore inhibition of Myelin Transcription Factor 1 (MYT1, Accession NM_004535). Accordingly, utilities of VGAM2640 include diagnosis, prevention and treatment of diseases and clinical conditions associated with MYT1. TAO1 (Accession NM_004783) is another VGAM2640 host target gene. TAO1 BINDING SITE is HOST TARGET binding site found in the 3' untranslated region of mRNA encoded by TAO1, corresponding to a HOST TARGET binding site such as BINDING SITE I, BINDING SITE II or BINDING SITE III. Table 2 illustrates the complementarity of the nucleotide sequences of TAO1 BINDING SITE, designated SEQ ID:11191, to the nucleotide sequence of VGAM2640 RNA, herein designated VGAM RNA, also designated SEQ ID:5351.

Another function of VGAM2640 is therefore inhibition of TAO1 (Accession NM_004783). Accordingly, utilities of VGAM2640 include diagnosis, prevention and treatment of diseases and clinical conditions associated with TAO1. Zinc Finger Protein 282 (ZNF282, Accession XM_114578) is another VGAM2640 host target gene. ZNF282 BINDING SITE is HOST TARGET binding site found in the 3' untranslated region of mRNA encoded by ZNF282, corresponding to a HOST TARGET binding site such as BINDING SITE I, BINDING SITE II or BINDING SITE III. Table 2 illustrates the complementarity of the nucleotide sequences of ZNF282 BINDING SITE, designated SEQ ID:42992, to the nucleotide sequence of VGAM2640 RNA, herein designated VGAM RNA, also designated SEQ ID:5351.

Another function of VGAM2640 is therefore inhibition of Zinc Finger Protein 282 (ZNF282, Accession XM_114578). Accordingly, utilities of VGAM2640 include diagnosis, prevention and treatment of diseases and clinical conditions associated with ZNF282. LOC112868 (Accession XM_053402) is another VGAM2640 host target gene. LOC112868 BINDING SITE is HOST TARGET binding site found in the 3' untranslated region of mRNA encoded by LOC112868, corresponding to a HOST TARGET binding site such as BINDING SITE I, BINDING SITE II or BINDING SITE III. Table 2 illustrates the complementarity of the nucleotide sequences of LOC112868 BINDING SITE, designated SEQ ID:36083, to the nucleotide sequence of VGAM2640 RNA, herein designated VGAM RNA, also designated SEQ ID:5351.

Another function of VGAM2640 is therefore inhibition of LOC112868 (Accession XM_053402). Accordingly, utilities of VGAM2640 include diagnosis, prevention and treatment of diseases and clinical conditions associated with LOC112868. LOC126661 (Accession XM_059061) is another VGAM2640 host target gene. LOC126661 BINDING SITE is HOST TARGET binding site found in the 5' untranslated region of mRNA encoded by LOC126661, corresponding to a HOST TARGET binding site such as BINDING SITE I, BINDING SITE II or BINDING SITE III. Table 2 illustrates the complementarity of the nucleotide sequences of LOC126661 BINDING SITE, designated SEQ ID:36850, to the nucleotide sequence of VGAM2640 RNA, herein designated VGAM RNA, also designated SEQ ID:5351.

Another function of VGAM2640 is therefore inhibition of LOC126661 (Accession XM_059061). Accordingly, utilities of VGAM2640 include diagnosis, prevention and treatment of diseases and clinical conditions associated with LOC126661. LOC130470 (Accession XM_059437) is another VGAM2640 host target gene. LOC130470 BINDING SITE is HOST TARGET binding site found in the 5' untranslated region of mRNA encoded by LOC130470, corresponding to a HOST TARGET binding site such as BINDING SITE I, BINDING SITE II or BINDING SITE III. Table 2 illustrates the complementarity of the nucleotide sequences of LOC130470 BINDING SITE, designated SEQ ID:36990, to the nucleotide sequence of VGAM2640 RNA, herein designated VGAM RNA, also designated SEQ ID:5351.

Another function of VGAM2640 is therefore inhibition of LOC130470 (Accession XM_059437). Accordingly, utilities of VGAM2640 include diagnosis, prevention and treatment of diseases and clinical conditions associated with LOC130470. LOC150095 (Accession XM_097805) is another VGAM2640 host target gene. LOC150095 BINDING SITE is HOST TARGET binding site found in the 5' untranslated region of mRNA encoded by LOC150095, corresponding to a HOST TARGET binding site such as BINDING SITE I, BINDING SITE II or BINDING SITE III. Table 2 illustrates the complementarity of the nucleotide sequences of LOC150095 BINDING SITE, designated SEQ ID:41130, to the nucleotide sequence of VGAM2640 RNA, herein designated VGAM RNA, also designated SEQ ID:5351.

Another function of VGAM2640 is therefore inhibition of LOC150095 (Accession XM_097805). Accordingly, utilities of VGAM2640 include diagnosis, prevention and treatment of diseases and clinical conditions associated with LOC150095. LOC158267 (Accession XM_088528) is another VGAM2640 host target gene. LOC158267 BINDING SITE is HOST TARGET binding site found in the 3' untranslated region of mRNA encoded by LOC158267, corresponding to a HOST TARGET binding site such as BINDING SITE I, BINDING SITE II or BINDING SITE III. Table 2 illustrates the complementarity of the nucleotide sequences of LOC158267 BINDING SITE, designated SEQ ID:39794, to the nucleotide sequence of VGAM2640 RNA, herein designated VGAM RNA, also designated SEQ ID:5351.

Another function of VGAM2640 is therefore inhibition of LOC158267 (Accession XM_088528). Accordingly, utilities of VGAM2640 include diagnosis, prevention and treatment of diseases and clinical conditions associated with LOC158267. LOC163682 (Accession XM_099402) is another VGAM2640 host target gene. LOC163682 BINDING SITE is HOST TARGET binding site found in the 3' untranslated region of mRNA encoded by LOC163682, corresponding to a HOST TARGET binding site such as BINDING SITE I, BINDING SITE II or BINDING SITE III. Table 2 illustrates the complementarity of the nucleotide sequences of LOC163682 BINDING SITE, designated SEQ ID:42097, to the nucleotide sequence of VGAM2640 RNA, herein designated VGAM RNA, also designated SEQ ID:5351.

Another function of VGAM2640 is therefore inhibition of LOC163682 (Accession XM_099402). Accordingly, utilities of VGAM2640 include diagnosis, prevention and treatment of diseases and clinical conditions associated with LOC163682. LOC204804 (Accession XM_115599) is another VGAM2640 host target gene. LOC204804 BINDING SITE is HOST TARGET binding site found in the 3' untranslated region of mRNA encoded by LOC204804, corresponding to a HOST TARGET binding site such as BINDING SITE I, BINDING SITE II or BINDING SITE III. Table 2 illustrates the complementarity of the nucleotide sequences of LOC204804 BINDING SITE, designated SEQ ID:43100, to the nucleotide sequence of VGAM2640 RNA, herein designated VGAM RNA, also designated SEQ ID:5351.

Another function of VGAM2640 is therefore inhibition of LOC204804 (Accession XM_115599). Accordingly, utilities of VGAM2640 include diagnosis, prevention and treatment of diseases and clinical conditions associated with LOC204804. LOC256933 (Accession XM_172970) is another VGAM2640 host target gene. LOC256933 BINDING SITE is HOST TARGET binding site found in the 5' untranslated region of mRNA encoded by LOC256933, corresponding to a HOST TARGET binding site such as BINDING SITE I, BINDING SITE II or BINDING SITE III. Table 2 illustrates the complementarity of the nucleotide sequences of LOC256933 BINDING SITE, designated SEQ ID:46226, to the nucleotide sequence of VGAM2640 RNA, herein designated VGAM RNA, also designated SEQ ID:5351.

Another function of VGAM2640 is therefore inhibition of LOC256933 (Accession XM_172970). Accordingly, utilities of VGAM2640 include diagnosis, prevention and treatment of diseases and clinical conditions associated with LOC256933. FIG. 1 further provides a conceptual description of a novel bioinformatically detected viral gene of the present invention, referred to here as Viral Genomic Address Messenger 2641 (VGAM2641) viral gene, which modulates expression of respective host target genes thereof, the function and utility of which host target genes is known in the art.

VGAM2641 is a novel bioinformatically detected regulatory, non protein coding, viral micro RNA (miRNA) gene. The method by which VGAM2641 was detected is described hereinabove with reference to FIGS. 1-8.

VGAM2641 gene, herein designated VGAM GENE, is a viral gene contained in the genome of Foot-and-mouth Disease Virus O. VGAM2641 host target gene, herein designated VGAM HOST TARGET GENE, is a human gene contained in the human genome.

VGAM2641 gene encodes a VGAM2641 precursor RNA, herein designated VGAM PRECURSOR RNA. Similar to other miRNA genes, and unlike most ordinary genes, VGAM2641 precursor RNA does not encode a protein. A nucleotide sequence identical or highly similar to the nucleotide sequence of VGAM2641 precursor RNA is designated SEQ ID:2627, and is provided hereinbelow with reference to the sequence listing part. Nucleotide sequence SEQ ID:2627 is located at position 1368 relative to the genome of Foot-and-mouth Disease Virus O.

VGAM2641 precursor RNA folds onto itself, forming VGAM2641 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2641 folded precursor RNA into VGAM2641 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM2641 RNA is designated SEQ ID:5352, and is provided hereinbelow with reference to the sequence listing part.

VGAM2641 host target gene, herein designated VGAM HOST TARGET GENE, encodes a corresponding messenger RNA, VGAM2641 host target RNA, herein designated VGAM HOST TARGET RNA. VGAM2641 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2641 RNA, herein designated VGAM RNA, binds complementarily to one or more host target binding sites located in untranslated regions of VGAM2641 host target RNA, herein designated VGAM HOST TARGET RNA. This complementary binding is due to the fact that the nucleotide sequence of VGAM2641 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2641 RNA, herein designated VGAM RNA, may have a different number of host target binding sites in untranslated regions of a VGAM2641 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2641 RNA, herein designated VGAM RNA, to host target binding sites on VGAM2641 host target RNA, herein designated VGAM HOST TARGET RNA, such as BINDING SITE I, BINDING SITE II and BINDING SITE III, inhibits translation of VGAM2641 host target RNA into VGAM2641 host target protein, herein designated VGAM HOST TARGET PROTEIN. VGAM host target protein is therefore outlined by a broken line.

It is appreciated that VGAM2641 host target gene, herein designated VGAM HOST TARGET GENE, in fact represents a plurality of VGAM2641 host target genes. The mRNA of each one of this plurality of VGAM2641 host target genes comprises one or more host target binding sites, each having a nucleotide sequence which is at least partly complementary to VGAM2641 RNA, herein designated VGAM RNA, and which when bound by VGAM2641 RNA causes inhibition of translation of respective one or more VGAM2641 host target proteins.

It is further appreciated by one skilled in the art that the mode of translational inhibition illustrated by FIG. 1 with specific reference to translational inhibition exerted by VGAM2641 gene, herein designated VGAM GENE, on one or more VGAM2641 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2641 is inhibition of expression of host target genes, as part of a novel viral mechanism of attacking a host. Accordingly, utilities of VGAM2641 include diagnosis, prevention and treatment of viral infection by Foot-and-mouth Disease Virus O. Specific functions, and accordingly utilities, of VGAM2641 correlate with, and may be deduced from, the identity of the host target genes which VGAM2641 binds and inhibits, and the function of these host target genes, as elaborated hereinbelow.

Nucleotide sequences of the VGAM2641 precursor RNA, herein designated VGAM PRECURSOR RNA, and of the 'diced' VGAM2641 RNA, herein designated VGAM RNA, and a schematic representation of the secondary folding of VGAM2641 folded precursor RNA, herein designated VGAM FOLDED PRECURSOR RNA, of VGAM2641 are further described hereinbelow with reference to Table 1.

Nucleotide sequences of host target binding sites, such as BINDING SITE-I, BINDING SITE-II and BINDING SITE-III of FIG. 1, found on VGAM2641 host target RNA, and schematic representation of the complementarity of each of these host target binding sites to VGAM2641 RNA, herein designated VGAM RNA, are described hereinbelow with reference to Table 2.

As mentioned hereinabove with reference to FIG. 1, a function of VGAM2641 gene, herein designated VGAM is inhibition of expression of VGAM2641 target genes. It is appreciated that specific functions, and accordingly utilities, of VGAM2641 correlate with, and may be deduced from, the identity of the target genes which VGAM2641 binds and inhibits, and the function of these target genes, as elaborated hereinbelow.

Axin 1 (AXIN1, Accession XM_027520) is a VGAM2641 host target gene. AXIN1 BINDING SITE1 and AXIN1 BINDING SITE2 are HOST TARGET binding sites found in untranslated regions of mRNA encoded by AXIN1, corresponding to HOST TARGET binding sites such as BINDING SITE I, BINDING SITE II or BINDING SITE III. Table 2 illustrates the complementarity of the nucleotide sequences of AXIN1 BINDING SITE1 and AXIN1 BINDING SITE2, designated SEQ ID:30512 and SEQ ID:30516 respectively, to the nucleotide sequence of VGAM2641 RNA, herein designated VGAM RNA, also designated SEQ ID:5352.

A function of VGAM2641 is therefore inhibition of Axin 1 (AXIN1, Accession XM_027520). Accordingly, utilities of VGAM2641 include diagnosis, prevention and treatment of diseases and clinical conditions associated with AXIN1. Fibroblast Growth Factor 5 (FGF5, Accession NM_004464) is another VGAM2641 host target gene. FGF5 BINDING SITE1 and FGF5 BINDING SITE2 are HOST TARGET binding sites found in untranslated regions of mRNA encoded by FGF5, corresponding to HOST TARGET binding sites such as BINDING SITE I, BINDING SITE II or BINDING SITE III. Table 2 illustrates the complementarity of the nucleotide sequences of FGF5 BINDING SITE1 and FGF5 BINDING SITE2, designated SEQ ID:10775 and SEQ ID:7884 respectively, to the nucleotide sequence of VGAM2641 RNA, herein designated VGAM RNA, also designated SEQ ID:5352.

Another function of VGAM2641 is therefore inhibition of Fibroblast Growth Factor 5 (FGF5, Accession NM_004464), a gene which induces transformation and may regulate neuronal differentiation. Accordingly, utilities of VGAM2641 include diagnosis, prevention and treatment of diseases and clinical conditions associated with FGF5. The function of FGF5 and its association with various diseases and clinical conditions, has been established by previous studies, as described hereinabove with reference to VGAM276. Trichorhinophalangeal Syndrome I (TRPS1, Accession NM_014112) is another VGAM2641 host target gene. TRPS1 BINDING SITE is HOST TARGET binding site found in the 3' untranslated region of mRNA encoded by TRPS1, corresponding to a HOST TARGET binding site such as BINDING SITE I, BINDING SITE II or BINDING SITE III. Table 2 illustrates the complementarity of the nucleotide sequences of TRPS1 BINDING SITE, designated SEQ ID:15353, to the nucleotide sequence of VGAM2641 RNA, herein designated VGAM RNA, also designated SEQ ID:5352.

Another function of VGAM2641 is therefore inhibition of Trichorhinophalangeal Syndrome I (TRPS1, Accession NM_014112), a gene which may function as a transcriptional activator protein. Accordingly, utilities of VGAM2641 include diagnosis, prevention and treatment of diseases and clinical conditions associated with TRPS1. The function of TRPS1 and its association with various diseases and clinical conditions, has been established by previous studies, as described hereinabove with reference to VGAM172. Wolf-Hirschhorn Syndrome Candidate 1 (WHSC1, Accession NM_014919) is another VGAM2641 host target gene. WHSC1 BINDING SITE1 through WHSC1 BINDING SITE3 are HOST TARGET binding sites found in untranslated regions of mRNA encoded by WHSC1, corresponding to HOST TARGET binding sites such as BINDING SITE I, BINDING SITE II or BINDING SITE III. Table 2 illustrates the complementarity of the nucleotide sequences of WHSC1 BINDING SITE1 through WHSC1 BINDING SITE3, designated SEQ ID:17187, SEQ ID:28451 and SEQ ID:28468 respectively, to the nucleotide sequence of VGAM2641 RNA, herein designated VGAM RNA, also designated SEQ ID:5352.

Another function of VGAM2641 is therefore inhibition of Wolf-Hirschhorn Syndrome Candidate 1 (WHSC1, Accession NM_014919), a gene which binds covalently to and repairs g/t mismatches. Accordingly, utilities of VGAM2641 include diagnosis, prevention and treatment of diseases and clinical conditions associated with WHSC1. The function of WHSC1 and its association with various diseases and clinical conditions, has been established by previous studies, as described hereinabove with reference to VGAM200. Caspase Recruitment Domain Family, Member 9 (CARD9, Accession NM_022352) is another VGAM2641 host target gene. CARD9 BINDING SITE is HOST TARGET binding site found in the 3' untranslated region of mRNA encoded by CARD9, corresponding to a HOST TARGET binding site such as BINDING SITE I, BINDING SITE II or BINDING SITE III. Table 2 illustrates the complementarity of the nucleotide sequences of CARD9 BINDING SITE, designated SEQ ID:22747, to the nucleotide sequence of VGAM2641 RNA, herein designated VGAM RNA, also designated SEQ ID:5352.

Another function of VGAM2641 is therefore inhibition of Caspase Recruitment Domain Family, Member 9 (CARD9, Accession NM_022352). Accordingly, utilities of VGAM2641 include diagnosis, prevention and treatment of diseases and clinical conditions associated with CARD9. Catenin, Beta Interacting Protein 1 (CTNNBIP1, Accession NM_020248) is another VGAM2641 host target gene. CTNNBIP1 BINDING SITE is HOST TARGET binding site found in the 3' untranslated region of mRNA encoded by CTNNBIP1, corresponding to a HOST TARGET binding site such as BINDING SITE I, BINDING SITE II or BINDING SITE III. Table 2 illustrates the complementarity of the nucleotide sequences of CTNNBIP1 BINDING SITE, designated SEQ ID:21545, to the nucleotide sequence of VGAM2641 RNA, herein designated VGAM RNA, also designated SEQ ID:5352.

Another function of VGAM2641 is therefore inhibition of Catenin, Beta Interacting Protein 1 (CTNNBIP1, Accession NM_020248). Accordingly, utilities of VGAM2641 include diagnosis, prevention and treatment of diseases and clinical conditions associated with CTNNBIP1. FLJ12960 (Accession NM_024638) is another VGAM2641 host target gene. FLJ12960 BINDING SITE is HOST TARGET binding site found in the 3' untranslated region of mRNA encoded by FLJ12960, corresponding to a HOST TARGET binding site such as BINDING SITE I, BINDING SITE II or BINDING SITE III. Table 2 illustrates the complementarity of the nucleotide sequences of FLJ12960 BINDING SITE, designated SEQ ID:23918, to the nucleotide sequence of VGAM2641 RNA, herein designated VGAM RNA, also designated SEQ ID:5352.

Another function of VGAM2641 is therefore inhibition of FLJ12960 (Accession NM_024638). Accordingly, utilities of VGAM2641 include diagnosis, prevention and treatment of diseases and clinical conditions associated with FLJ12960. FLJ13441 (Accession NM_023924) is another VGAM2641 host target gene. FLJ13441 BINDING SITE is HOST TARGET binding site found in the 3' untranslated region of mRNA encoded by FLJ13441, corresponding to a HOST TARGET binding site such as BINDING SITE I, BINDING SITE II or BINDING SITE III. Table 2 illustrates the complementarity of the nucleotide sequences of FLJ13441 BINDING SITE, designated SEQ ID:23396, to the nucleotide sequence of VGAM2641 RNA, herein designated VGAM RNA, also designated SEQ ID:5352.

Another function of VGAM2641 is therefore inhibition of FLJ13441 (Accession NM_023924). Accordingly, utilities of VGAM2641 include diagnosis, prevention and treatment of diseases and clinical conditions associated with FLJ13441. FLJ20452 (Accession NM_017828) is another VGAM2641 host target gene. FLJ20452 BINDING SITE is HOST TARGET binding site found in the 3' untranslated region of mRNA encoded by FLJ20452, corresponding to a HOST TARGET binding site such as BINDING SITE I, BINDING SITE II or BINDING SITE III. Table 2 illustrates the complementarity of the nucleotide sequences of FLJ20452 BINDING SITE, designated SEQ ID:19489, to the nucleotide sequence of VGAM2641 RNA, herein designated VGAM RNA, also designated SEQ ID:5352.

Another function of VGAM2641 is therefore inhibition of FLJ20452 (Accession NM_017828). Accordingly, utilities of VGAM2641 include diagnosis, prevention and treatment of diseases and clinical conditions associated with FLJ20452. KIAA0329 (Accession NM_014844) is another VGAM2641 host target gene. KIAA0329 BINDING SITE is HOST TARGET binding site found in the 3' untranslated region of mRNA encoded by KIAA0329, corresponding to a HOST TARGET binding site such as BINDING SITE I, BINDING SITE II or BINDING SITE III. Table 2 illustrates the complementarity of the nucleotide sequences of KIAA0329 BINDING SITE, designated SEQ ID:16875, to the nucleotide sequence of VGAM2641 RNA, herein designated VGAM RNA, also designated SEQ ID:5352.

Another function of VGAM2641 is therefore inhibition of KIAA0329 (Accession NM_014844). Accordingly, utilities of VGAM2641 include diagnosis, prevention and treatment of diseases and clinical conditions associated with KIAA0329. KIAA1126 (Accession XM_050325) is another VGAM2641 host target gene. KIAA1126 BINDING SITE is HOST TARGET binding site found in the 3' untranslated region of mRNA encoded by KIAA1126, corresponding to a HOST TARGET binding site such as BINDING SITE I, BINDING SITE II or BINDING SITE III. Table 2 illustrates the complementarity of the nucleotide sequences of KIAA1126 BINDING SITE, designated SEQ ID:35608, to the nucleotide sequence of VGAM2641 RNA, herein designated VGAM RNA, also designated SEQ ID:5352.

Another function of VGAM2641 is therefore inhibition of KIAA1126 (Accession XM_050325). Accordingly, utilities of VGAM2641 include diagnosis, prevention and treatment of diseases and clinical conditions associated with KIAA1126. KIAA1550 (Accession XM_039393) is another VGAM2641 host target gene. KIAA1550 BINDING SITE is HOST TARGET binding site found in the 3' untranslated region of mRNA encoded by KIAA1550, corresponding to a HOST TARGET binding site such as BINDING SITE I, BINDING SITE II or BINDING SITE III. Table 2 illustrates the complementarity of the nucleotide sequences of KIAA1550 BINDING SITE, designated SEQ ID:33065, to the nucleotide sequence of VGAM2641 RNA, herein designated VGAM RNA, also designated SEQ ID:5352.

Another function of VGAM2641 is therefore inhibition of KIAA1550 (Accession XM_039393). Accordingly, utilities of VGAM2641 include diagnosis, prevention and treatment of diseases and clinical conditions associated with KIAA1550. KIAA1918 (Accession XM_054951) is another VGAM2641 host target gene. KIAA1918 BINDING SITE is HOST TARGET binding site found in the 3' untranslated region of mRNA encoded by KIAA1918, corresponding to a HOST TARGET binding site such as BINDING SITE I, BINDING SITE II or BINDING SITE III. Table 2 illustrates the complementarity of the nucleotide sequences of KIAA1918 BINDING SITE, designated SEQ ID:36216, to the nucleotide sequence of VGAM2641 RNA, herein designated VGAM RNA, also designated SEQ ID:5352.

Another function of VGAM2641 is therefore inhibition of KIAA1918 (Accession XM_054951). Accordingly, utilities of VGAM2641 include diagnosis, prevention and treatment of diseases and clinical conditions associated with KIAA1918. KIAA1970 (Accession XM_058808) is another VGAM2641 host target gene. KIAA1970 BINDING SITE is HOST TARGET binding site found in the 3' untranslated region of mRNA encoded by KIAA1970, corresponding to a HOST TARGET binding site such as BINDING SITE I, BINDING SITE II or BINDING SITE III. Table 2 illustrates the complementarity of the nucleotide sequences of KIAA1970 BINDING SITE, designated SEQ ID:36754, to the nucleotide sequence of VGAM2641 RNA, herein designated VGAM RNA, also designated SEQ ID:5352.

Another function of VGAM2641 is therefore inhibition of KIAA1970 (Accession XM_058808). Accordingly, utilities of VGAM2641 include diagnosis, prevention and treatment of diseases and clinical conditions associated with KIAA1970. RNA Binding Protein S1, Serine-rich Domain (RNPS1, Accession NM_080594) is another VGAM2641 host target gene. RNPS1 BINDING SITE1 and RNPS1 BINDING SITE2 are HOST TARGET binding sites found in untranslated regions of mRNA encoded by RNPS1, corresponding to HOST TARGET binding sites such as BINDING SITE I, BINDING SITE II or BINDING SITE III. Table 2 illustrates the complementarity of the nucleotide sequences of RNPS1 BINDING SITE1 and RNPS1 BINDING SITE2, designated SEQ ID:27903 and SEQ ID:13538 respectively, to the nucleotide sequence of VGAM2641 RNA, herein designated VGAM RNA, also designated SEQ ID:5352.

Another function of VGAM2641 is therefore inhibition of RNA Binding Protein S1, Serine-rich Domain (RNPS1, Accession NM_080594). Accordingly, utilities of VGAM2641 include diagnosis, prevention and treatment of diseases and clinical conditions associated with RNPS1. LOC147054 (Accession XM_097172) is another VGAM2641 host target gene. LOC147054 BINDING SITE is HOST TARGET binding site found in the 5' untranslated region of mRNA encoded by LOC147054, corresponding to a HOST TARGET binding site such as BINDING SITE I, BINDING SITE II or BINDING SITE III. Table 2 illustrates the complementarity of the nucleotide sequences of LOC147054 BINDING SITE, designated SEQ ID:40791, to the nucleotide sequence of VGAM2641 RNA, herein designated VGAM RNA, also designated SEQ ID:5352.

Another function of VGAM2641 is therefore inhibition of LOC147054 (Accession XM_097172). Accordingly, utilities of VGAM2641 include diagnosis, prevention and treatment of diseases and clinical conditions associated with LOC147054. LOC147817 (Accession XM_085903) is another VGAM2641 host target gene. LOC147817 BINDING SITE is HOST TARGET binding site found in the 3' untranslated region of mRNA encoded by LOC147817, corresponding to a HOST TARGET binding site such as BINDING SITE I, BINDING SITE II or BINDING SITE III. Table 2 illustrates the complementarity of the nucleotide sequences of LOC147817 BINDING SITE, designated SEQ ID:38386, to the nucleotide sequence of VGAM2641 RNA, herein designated VGAM RNA, also designated SEQ ID:5352.

Another function of VGAM2641 is therefore inhibition of LOC147817 (Accession XM_085903). Accordingly, utilities of VGAM2641 include diagnosis, prevention and treatment of diseases and clinical conditions associated with LOC147817. LOC149345 (Accession XM_086502) is another VGAM2641 host target gene. LOC149345 BINDING SITE is HOST TARGET binding site found in the 5' untranslated region of mRNA encoded by LOC149345, corresponding to a HOST TARGET binding site such as BINDING SITE I, BINDING SITE II or BINDING SITE III. Table 2 illustrates the complementarity of the nucleotide sequences of LOC149345 BINDING SITE, designated SEQ ID:38714, to the nucleotide sequence of VGAM2641 RNA, herein designated VGAM RNA, also designated SEQ ID:5352.

Another function of VGAM2641 is therefore inhibition of LOC149345 (Accession XM_086502). Accordingly, utilities of VGAM2641 include diagnosis, prevention and treatment of diseases and clinical conditions associated with LOC149345. LOC153346 (Accession XM_098364) is another VGAM2641 host target gene. LOC153346 BINDING SITE is HOST TARGET binding site found in the 3' untranslated region of mRNA encoded by LOC153346, corresponding to a HOST TARGET binding site such as BINDING SITE I, BINDING SITE II or BINDING SITE III. Table 2 illustrates the complementarity of the nucleotide sequences of LOC153346 BINDING SITE, designated SEQ ID:41617, to the nucleotide sequence of VGAM2641 RNA, herein designated VGAM RNA, also designated SEQ ID:5352.

Another function of VGAM2641 is therefore inhibition of LOC153346 (Accession XM_098364). Accordingly, utilities of VGAM2641 include diagnosis, prevention and treatment of diseases and clinical conditions associated with LOC153346. LOC220018 (Accession XM_167816) is another VGAM2641 host target gene. LOC220018 BINDING SITE is HOST TARGET binding site found in the 5' untranslated region of mRNA encoded by LOC220018, corresponding to a HOST TARGET binding site such as BINDING SITE I, BINDING SITE II or BINDING SITE III. Table 2 illustrates the complementarity of the nucleotide sequences of LOC220018 BINDING SITE, designated SEQ ID:44855, to the nucleotide sequence of VGAM2641 RNA, herein designated VGAM RNA, also designated SEQ ID:5352.

Another function of VGAM2641 is therefore inhibition of LOC220018 (Accession XM_167816). Accordingly, utilities of VGAM2641 include diagnosis, prevention and treatment of diseases and clinical conditions associated with LOC220018. FIG. 1 further provides a conceptual description of a novel bioinformatically detected viral gene of the present invention, referred to here as Viral Genomic Address Messenger 2642 (VGAM2642) viral gene, which modulates expression of respective host target genes thereof, the function and utility of which host target genes is known in the art.

VGAM2642 is a novel bioinformatically detected regulatory, non protein coding, viral micro RNA (miRNA) gene. The method by which VGAM2642 was detected is described hereinabove with reference to FIGS. 1-8.

VGAM2642 gene, herein designated VGAM GENE, is a viral gene contained in the genome of Foot-and-mouth Disease Virus O. VGAM2642 host target gene, herein designated VGAM HOST TARGET GENE, is a human gene contained in the human genome.

VGAM2642 gene encodes a VGAM2642 precursor RNA, herein designated VGAM PRECURSOR RNA. Similar to other miRNA genes, and unlike most ordinary genes, VGAM2642 precursor RNA does not encode a protein. A nucleotide sequence identical or highly similar to the nucleotide sequence of VGAM2642 precursor RNA is designated SEQ ID:2628, and is provided hereinbelow with reference to the sequence listing part. Nucleotide sequence SEQ ID:2628 is located at position 1959 relative to the genome of Foot-and-mouth Disease Virus O.

VGAM2642 precursor RNA folds onto itself, forming VGAM2642 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2642 folded precursor RNA into VGAM2642 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 87%) nucleotide sequence of VGAM2642 RNA is designated SEQ ID:5353, and is provided hereinbelow with reference to the sequence listing part.

VGAM2642 host target gene, herein designated VGAM HOST TARGET GENE, encodes a corresponding messenger RNA, VGAM2642 host target RNA, herein designated VGAM HOST TARGET RNA. VGAM2642 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2642 RNA, herein designated VGAM RNA, binds complementarily to one or more host target binding sites located in untranslated regions of VGAM2642 host target RNA, herein designated VGAM HOST TARGET RNA. This complementary binding is due to the fact that the nucleotide sequence of VGAM2642 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2642 RNA, herein designated VGAM RNA, may have a different number of host target binding sites in untranslated regions of a VGAM2642 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2642 RNA, herein designated VGAM RNA, to host target binding sites on VGAM2642 host target RNA, herein designated VGAM HOST TARGET RNA, such as BINDING SITE I, BINDING SITE II and BINDING SITE III, inhibits translation of VGAM2642 host target RNA into VGAM2642 host target protein, herein designated VGAM HOST TARGET PRO- TEIN. VGAM host target protein is therefore outlined by a broken line.

It is appreciated that VGAM2642 host target gene, herein designated VGAM HOST TARGET GENE, in fact represents a plurality of VGAM2642 host target genes. The mRNA of each one of this plurality of VGAM2642 host target genes comprises one or more host target binding sites, each having a nucleotide sequence which is at least partly complementary to VGAM2642 RNA, herein designated VGAM RNA, and which when bound by VGAM2642 RNA causes inhibition of translation of respective one or more VGAM2642 host target proteins.

It is further appreciated by one skilled in the art that the mode of translational inhibition illustrated by FIG. 1 with specific reference to translational inhibition exerted by VGAM2642 gene, herein designated VGAM GENE, on one or more VGAM2642 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2642 is inhibition of expression of host target genes, as part of a novel viral mechanism of attacking a host. Accordingly, utilities of VGAM2642 include diagnosis, prevention and treatment of viral infection by Foot-and-mouth Disease Virus O. Specific functions, and accordingly utilities, of VGAM2642 correlate with, and may be deduced from, the identity of the host target genes which VGAM2642 binds and inhibits, and the function of these host target genes, as elaborated hereinbelow.

Nucleotide sequences of the VGAM2642 precursor RNA, herein designated VGAM PRECURSOR RNA, and of the ‘diced’ VGAM2642 RNA, herein designated VGAM RNA, and a schematic representation of the secondary folding of VGAM2642 folded precursor RNA, herein designated VGAM FOLDED PRECURSOR RNA, of VGAM2642 are further described hereinbelow with reference to Table 1.

Nucleotide sequences of host target binding sites, such as BINDING SITE-I, BINDING SITE-II and BINDING SITE-III of FIG. 1, found on VGAM2642 host target RNA, and schematic representation of the complementarity of each of these host target binding sites to VGAM2642 RNA, herein designated VGAM RNA, are described hereinbelow with reference to Table 2.

As mentioned hereinabove with reference to FIG. 1, a function of VGAM2642 gene, herein designated VGAM is inhibition of expression of VGAM2642 target genes. It is appreciated that specific functions, and accordingly utilities, of VGAM2642 correlate with, and may be deduced from, the identity of the target genes which VGAM2642 binds and inhibits, and the function of these target genes, as elaborated hereinbelow.

Cytoplasmic Linker 2 (CYLN2, Accession NM_003388) is a VGAM2642 host target gene. CYLN2 BINDING SITE is HOST TARGET binding site found in the 3' untranslated region of mRNA encoded by CYLN2, corresponding to a HOST TARGET binding site such as BINDING SITE I, BINDING SITE II or BINDING SITE III. Table 2 illustrates the complementarity of the nucleotide sequences of CYLN2 BINDING SITE, designated SEQ ID:9425, to the nucleotide sequence of VGAM2642 RNA, herein designated VGAM RNA, also designated SEQ ID:5353.

A function of VGAM2642 is therefore inhibition of Cytoplasmic Linker 2 (CYLN2, Accession NM_003388), a gene which associates with microtubules and dendritic lamellar bodies. Accordingly, utilities of VGAM2642 include diagnosis, prevention and treatment of diseases and clinical conditions associated with CYLN2. The function of CYLN2 and its association with various diseases and clinical conditions, has been established by previous studies, as described hereinabove with reference to VGAM94. Transient Receptor Potential Cation Channel, Subfamily M, Member 2 (TRPM2, Accession NM_003307) is another VGAM2642 host target gene. TRPM2 BINDING SITE is HOST TARGET binding site found in the 5' untranslated region of mRNA encoded by TRPM2, corresponding to a HOST TARGET binding site such as BINDING SITE I, BINDING SITE II or BINDING SITE III. Table 2 illustrates the complementarity of the nucleotide sequences of TRPM2 BINDING SITE, designated SEQ ID:9312, to the nucleotide sequence of VGAM2642 RNA, herein designated VGAM RNA, also designated SEQ ID:5353.

Another function of VGAM2642 is therefore inhibition of Transient Receptor Potential Cation Channel, Subfamily M, Member 2 (TRPM2, Accession NM_003307), a gene which may be a calcium channel. Accordingly, utilities of VGAM2642 include diagnosis, prevention and treatment of diseases and clinical conditions associated with TRPM2. The function of TRPM2 and its association with various diseases and clinical conditions, has been established by previous studies, as described hereinabove with reference to VGAM1928. Unc-5 Homolog B (C. elegans) (UNC5C, Accession NM_003728) is another VGAM2642 host target gene. UNC5C BINDING SITE is HOST TARGET binding site found in the 3' untranslated region of mRNA encoded by UNC5C, corresponding to a HOST TARGET binding site such as BINDING SITE I, BINDING SITE II or BINDING SITE III. Table 2 illustrates the complementarity of the nucleotide sequences of UNC5C BINDING SITE, designated SEQ ID:9820, to the nucleotide sequence of VGAM2642 RNA, herein designated VGAM RNA, also designated SEQ ID:5353.

Another function of VGAM2642 is therefore inhibition of Unc-5 Homolog B (C. elegans) (UNC5C, Accession NM_003728), a gene which is a putative receptor for netrin, which is involved in axon guidance. Accordingly, utilities of VGAM2642 include diagnosis, prevention and treatment of diseases and clinical conditions associated with UNC5C. The function of UNC5C and its association with various diseases and clinical conditions, has been established by previous studies, as described hereinabove with reference to VGAM298. Ankyrin Repeat and BTB (POZ) Domain Containing 1 (ABTB1, Accession NM_032548) is another VGAM2642 host target gene. ABTB1 BINDING SITE is HOST TARGET binding site found in the 5' untranslated region of mRNA encoded by ABTB1, corresponding to a HOST TARGET binding site such as BINDING SITE I, BINDING SITE II or BINDING SITE III. Table 2 illustrates the complementarity of the nucleotide sequences of ABTB1 BINDING SITE, designated SEQ ID:26272, to the nucleotide sequence of VGAM2642 RNA, herein designated VGAM RNA, also designated SEQ ID:5353.

Another function of VGAM2642 is therefore inhibition of Ankyrin Repeat and BTB (POZ) Domain Containing 1 (ABTB1, Accession NM_032548). Accordingly, utilities of VGAM2642 include diagnosis, prevention and treatment of diseases and clinical conditions associated with ABTB1. ADP-ribosylation Factor Domain Protein 1, 64 kDa (ARFD1, Accession NM_001656) is another VGAM2642 host target gene. ARFD1 BINDING SITE is HOST TARGET binding site found in the 3' untranslated region of mRNA encoded by ARFD1, corresponding to a HOST TARGET binding site such as BINDING SITE I, BINDING SITE II or BINDING SITE III. Table 2 illustrates the complementarity of the nucleotide sequences of ARFD1 BINDING SITE, designated SEQ ID:7371, to the nucleotide sequence of VGAM2642 RNA, herein designated VGAM RNA, also designated SEQ ID:5353.

Another function of VGAM2642 is therefore inhibition of ADP-ribosylation Factor Domain Protein 1, 64 kDa (ARFD1, Accession NM_001656). Accordingly, utilities of VGAM2642 include diagnosis, prevention and treatment of diseases and clinical conditions associated with ARFD1. Chromosome 20 Open Reading Frame 59 (C20orf59, Accession NM_022082) is another VGAM2642 host target gene. C20orf59 BINDING SITE is HOST TARGET binding site found in the 3' untranslated region of mRNA encoded by C20orf59, corresponding to a HOST TARGET binding site such as BINDING SITE I, BINDING SITE II or BINDING SITE III. Table 2 illustrates the complementarity of the nucleotide sequences of C20orf59 BINDING SITE, designated SEQ ID:22625, to the nucleotide sequence of VGAM2642 RNA, herein designated VGAM RNA, also designated SEQ ID:5353.

Another function of VGAM2642 is therefore inhibition of Chromosome 20 Open Reading Frame 59 (C20orf59, Accession NM_022082). Accordingly, utilities of VGAM2642 include diagnosis, prevention and treatment of diseases and clinical conditions associated with C20orf59. DKFZp566H0824 (Accession NM_017535) is another VGAM2642 host target gene. DKFZp566H0824 BINDING SITE is HOST TARGET binding site found in the 5' untranslated region of mRNA encoded by DKFZp566H0824, corresponding to a HOST TARGET binding site such as BINDING SITE I, BINDING SITE II or BINDING SITE III. Table 2 illustrates the complementarity of the nucleotide sequences of DKFZp566H0824 BINDING SITE, designated SEQ ID:18974, to the nucleotide sequence of VGAM2642 RNA, herein designated VGAM RNA, also designated SEQ ID:5353.

Another function of VGAM2642 is therefore inhibition of DKFZp566H0824 (Accession NM_017535). Accordingly, utilities of VGAM2642 include diagnosis, prevention and treatment of diseases and clinical conditions associated with DKFZp566H0824. KIAA0173 (Accession NM_014640) is another VGAM2642 host target gene. KIAA0173 BINDING SITE is HOST TARGET binding site found in the 5' untranslated region of mRNA encoded by KIAA0173, corresponding to a HOST TARGET binding site such as BINDING SITE I, BINDING SITE II or BINDING SITE III. Table 2 illustrates the complementarity of the nucleotide sequences of KIAA0173 BINDING SITE, designated SEQ ID:16040, to the nucleotide sequence of VGAM2642 RNA, herein designated VGAM RNA, also designated SEQ ID:5353.

Another function of VGAM2642 is therefore inhibition of KIAA0173 (Accession NM_014640). Accordingly, utilities of VGAM2642 include diagnosis, prevention and treatment of diseases and clinical conditions associated with KIAA0173. MNAB (Accession NM_018835) is another VGAM2642 host target gene. MNAB BINDING SITE is HOST TARGET binding site found in the 5' untranslated region of mRNA encoded by MNAB, corresponding to a HOST TARGET binding site such as BINDING SITE I, BINDING SITE II or BINDING SITE III. Table 2 illustrates the complementarity of the nucleotide sequences of MNAB BINDING SITE, designated SEQ ID:20821, to the nucleotide sequence of VGAM2642 RNA, herein designated VGAM RNA, also designated SEQ ID:5353.

Another function of VGAM2642 is therefore inhibition of MNAB (Accession NM_018835). Accordingly, utilities of VGAM2642 include diagnosis, prevention and treatment of diseases and clinical conditions associated with MNAB. LOC125268 (Accession XM_071960) is another VGAM2642 host target gene. LOC125268 BINDING SITE is HOST TARGET binding site found in the 3' untranslated region of mRNA encoded by LOC125268, corresponding to a HOST TARGET binding site such as BINDING SITE I, BINDING SITE II or BINDING SITE III. Table 2 illustrates the complementarity of the nucleotide sequences of LOC125268 BINDING SITE, designated SEQ ID:37451, to the nucleotide sequence of VGAM2642 RNA, herein designated VGAM RNA, also designated SEQ ID:5353.

Another function of VGAM2642 is therefore inhibition of LOC125268 (Accession XM_071960). Accordingly, utilities of VGAM2642 include diagnosis, prevention and treatment of diseases and clinical conditions associated with LOC125268. LOC256158 (Accession XM_175125) is another VGAM2642 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46626, to the nucleotide sequence of VGAM2642 RNA, herein designated VGAM RNA, also designated SEQ ID:5353.

Another function of VGAM2642 is therefore inhibition of LOC256158 (Accession XM_175125). Accordingly, utilities of VGAM2642 include diagnosis, prevention and treatment of diseases and clinical conditions associated with LOC256158. FIG. 1 further provides a conceptual description of a novel bioinformatically detected viral gene of the present invention, referred to here as Viral Genomic Address Messenger 2643 (VGAM2643) viral gene, which modulates expression of respective host target genes thereof, the function and utility of which host target genes is known in the art.

VGAM2643 is a novel bioinformatically detected regulatory, non protein coding, viral micro RNA (miRNA) gene. The method by which VGAM2643 was detected is described hereinabove with reference to FIGS. 1-8.

VGAM2643 gene, herein designated VGAM GENE, is a viral gene contained in the genome of Cowpea Aphid-borne Mosaic Virus. VGAM2643 host target gene, herein designated VGAM HOST TARGET GENE, is a human gene contained in the human genome.

VGAM2643 gene encodes a VGAM2643 precursor RNA, herein designated VGAM PRECURSOR RNA. Similar to other miRNA genes, and unlike most ordinary genes, VGAM2643 precursor RNA does not encode a protein. A nucleotide sequence identical or highly similar to the nucleotide sequence of VGAM2643 precursor RNA is designated SEQ ID:2629, and is provided hereinbelow with reference to the sequence listing part. Nucleotide sequence SEQ ID:2629 is located at position 4628 relative to the genome of Cowpea Aphid-borne Mosaic Virus.

VGAM2643 precursor RNA folds onto itself, forming VGAM2643 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2643 folded precursor RNA into VGAM2643 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 53%) nucleotide sequence of VGAM2643 RNA is designated SEQ ID:5354, and is provided hereinbelow with reference to the sequence listing part.

VGAM2643 host target gene, herein designated VGAM HOST TARGET GENE, encodes a corresponding messenger RNA, VGAM2643 host target RNA, herein designated VGAM HOST TARGET RNA. VGAM2643 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2643 RNA, herein designated VGAM RNA, binds complementarily to one or more host target binding sites located in untranslated regions of VGAM2643 host target RNA, herein designated VGAM HOST TARGET RNA. This complementary binding is due to the fact that the nucleotide sequence of VGAM2643 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2643 RNA, herein designated VGAM RNA, may have a different number of host target binding sites in untranslated regions of a VGAM2643 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2643 RNA, herein designated VGAM RNA, to host target binding sites on VGAM2643 host target RNA, herein designated VGAM HOST TARGET RNA, such as BINDING SITE I, BINDING SITE II and BINDING SITE III, inhibits translation of VGAM2643 host target RNA into VGAM2643 host target protein, herein designated VGAM HOST TARGET PROTEIN. VGAM host target protein is therefore outlined by a broken line.

It is appreciated that VGAM2643 host target gene, herein designated VGAM HOST TARGET GENE, in fact represents a plurality of VGAM2643 host target genes. The mRNA of each one of this plurality of VGAM2643 host target genes comprises one or more host target binding sites, each having a nucleotide sequence which is at least partly complementary to VGAM2643 RNA, herein designated VGAM RNA, and which when bound by VGAM2643 RNA causes inhibition of translation of respective one or more VGAM2643 host target proteins.

It is further appreciated by one skilled in the art that the mode of translational inhibition illustrated by FIG. 1 with specific reference to translational inhibition exerted by VGAM2643 gene, herein designated VGAM GENE, on one or more VGAM2643 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2643 is inhibition of expression of host target genes, as part of a novel viral mechanism of attacking a host. Accordingly, utilities of VGAM2643 include diagnosis, prevention and treatment of viral infection by Cowpea Aphid-borne Mosaic Virus. Specific functions, and accordingly utilities, of VGAM2643 correlate with, and may be deduced from, the identity of the host target genes which VGAM2643 binds and inhibits, and the function of these host target genes, as elaborated hereinbelow.

Nucleotide sequences of the VGAM2643 precursor RNA, herein designated VGAM PRECURSOR RNA, and of the 'diced' VGAM2643 RNA, herein designated VGAM RNA, and a schematic representation of the secondary folding of VGAM2643 folded precursor RNA, herein designated VGAM FOLDED PRECURSOR RNA, of VGAM2643 are further described hereinbelow with reference to Table 1.

Nucleotide sequences of host target binding sites, such as BINDING SITE-I, BINDING SITE-II and BINDING SITE-III of FIG. 1, found on VGAM2643 host target RNA, and schematic representation of the complementarity of each of these host target binding sites to VGAM2643 RNA, herein designated VGAM RNA, are described hereinbelow with reference to Table 2.

As mentioned hereinabove with reference to FIG. 1, a function of VGAM2643 gene, herein designated VGAM is inhibition of expression of VGAM2643 target genes. It is appreciated that specific functions, and accordingly utilities, of VGAM2643 correlate with, and may be deduced from, the identity of the target genes which VGAM2643 binds and inhibits, and the function of these target genes, as elaborated hereinbelow.

ACATN (Accession NM_004733) is a VGAM2643 host target gene. ACATN BINDING SITE is HOST TARGET binding site found in the 3' untranslated region of mRNA encoded by ACATN, corresponding to a HOST TARGET binding site such as BINDING SITE I, BINDING SITE II or BINDING SITE III. Table 2 illustrates the complementarity of the nucleotide sequences of ACATN BINDING SITE, designated SEQ ID:11109, to the nucleotide sequence of VGAM2643 RNA, herein designated VGAM RNA, also designated SEQ ID:5354.

A function of VGAM2643 is therefore inhibition of ACATN (Accession NM_004733), a gene which Putative acetyl-Coenzyme A transporter; required for the formation of O-acetylated gangliosides. Accordingly, utilities of VGAM2643 include diagnosis, prevention and treatment of diseases and clinical conditions associated with ACATN. The function of ACATN has been established by previous studies. The structural diversity and complexity of sugar chains in membrane gangliosides are caused in part by the occurrence of several different species of sialic acid molecules, including O-acetylated forms. Acetylation of sialic acid residues of glycoproteins and gangliosides occurs in the lumen of the Golgi apparatus, using acetyl-CoA as the acetate donor. By expression cloning, Kanamori et al. (1997) isolated a human melanoma cell line cDNA encoding AT1, a protein that directed the formation of 9-O-acetylated ganglioside GD3 in mammalian cells. The predicted 549-amino acid protein contained 6 to 10 transmembrane domains and a leucine zipper motif in transmembrane domain III. Immunofluorescence experiments indicated that the 58-kD protein is localized to the cytoplasm. Using in vitro assays with semi-intact cells, Kanamori et al. (1997) demonstrated that the AT1 protein functioned as an acetyl-CoA transporter. Northern blot analysis revealed that AT1 was expressed as 3.3- and 4.3-kb mRNAs in all tissues tested. Kanamori et al. (1997) concluded that AT1 is an acetyl-CoA transporter that is involved in the process of O-acetylation. Bora et al. (1998) stated that nucleotide sequences of the mouse and human ACATN genes are 87% identical. By fluorescence in situ hybridization, Bora et al. (1998) mapped the Acatn gene to mouse chromosome 3E1-E3.

Full details of the abovementioned studies are described in the following publications, the disclosure of which are hereby incorporated by reference:

Bora, R. S.; Kanamori, A.; Hirabayashi, Y.: Assignment of a putative acetyl-CoA transporter gene (Acatn) to mouse chromosome band 3E1-E3 by in situ hybridization. Cytogenet. Cell Genet. 83:78-79, 1998; and Kanamori, A.; Nakayama, J.; Fukuda, M. N.; Stallcup, W. B.; Sasaki, K.; Fukuda, M.; Hirabayashi, Y.: Expression cloning and characterization of a cDNA encoding a novel membrane protein.

Further studies establishing the function and utilities of ACATN are found in John Hopkins OMIM database record ID 603690, and in sited publications numbered 493 and 4949 listed in the bibliography section hereinbelow, which are also hereby incorporated by reference. Cyclin D1 (PRAD1: parathyroid adenomatosis 1) (CCND1, Accession NM_053056) is another VGAM2643 host target gene. CCND1 BINDING SITE is HOST TARGET binding site found in the 3' untranslated region of mRNA encoded by CCND1, corresponding to a HOST TARGET binding site such as BINDING SITE I, BINDING SITE II or BINDING SITE III. Table 2 illustrates the complementarity of the nucleotide sequences of CCND1 BINDING SITE, designated SEQ ID:27603, to the nucleotide sequence of VGAM2643 RNA, herein designated VGAM RNA, also designated SEQ ID:5354.

Another function of VGAM2643 is therefore inhibition of Cyclin D1 (PRAD1: parathyroid adenomatosis 1) (CCND1, Accession NM_053056), a gene which is involved in the control of cell cycle and is required for Schwann cell proliferation to proceed normally during Wallerian degeneration. Accordingly, utilities of VGAM2643 include diagnosis, prevention and treatment of diseases and clinical conditions associated with CCND1. The function of CCND1 and its association with various diseases and clinical conditions, has been established by previous studies, as described hereinabove with reference to VGAM220. CD4 Antigen (p55) (CD4, Accession NM_000616) is another VGAM2643 host target gene. CD4 BINDING SITE is HOST TARGET binding site found in the 3' untranslated region of mRNA encoded by CD4, corresponding to a HOST TARGET binding site such as BINDING SITE I, BINDING SITE II or BINDING SITE III. Table 2 illustrates the complementarity of the nucleotide sequences of CD4 BINDING SITE, designated SEQ ID:6219, to the nucleotide sequence of VGAM2643 RNA, herein designated VGAM RNA, also designated SEQ ID:5354.

Another function of VGAM2643 is therefore inhibition of CD4 Antigen (p55) (CD4, Accession NM_000616), a gene which is T-cell surface glycoprotein and has role in cell-cell interactions and may act in signal transduction. Accordingly, utilities of VGAM2643 include diagnosis, prevention and treatment of diseases and clinical conditions associated with CD4. The function of CD4 and its association with various diseases and clinical conditions, has been established by previous studies, as described hereinabove with reference to VGAM381. Development and Differentiation Enhancing Factor 2 (DDEF2, Accession NM_003887) is another VGAM2643 host target gene. DDEF2 BINDING SITE is HOST TARGET binding site found in the 3' untranslated region of mRNA encoded by DDEF2, corresponding to a HOST TARGET binding site such as BINDING SITE I, BINDING SITE II or BINDING SITE III. Table 2 illustrates the complementarity of the nucleotide sequences of DDEF2 BINDING SITE, designated SEQ ID:9970, to the nucleotide sequence of VGAM2643 RNA, herein designated VGAM RNA, also designated SEQ ID:5354.

Another function of VGAM2643 is therefore inhibition of Development and Differentiation Enhancing Factor 2 (DDEF2, Accession NM_003887), a gene which interacts with members of the Arf and Src family. Accordingly, utilities of VGAM2643 include diagnosis, prevention and treatment of diseases and clinical conditions associated with DDEF2. The function of DDEF2 and its association with various diseases and clinical conditions, has been established by previous studies, as described hereinabove with reference to VGAM464. G Protein-coupled Receptor 87 (GPR87, Accession NM_023915) is another VGAM2643 host target gene. GPR87 BINDING SITE is HOST TARGET binding site found in the 5' untranslated region of mRNA encoded by GPR87, corresponding to a HOST TARGET binding site such as BINDING SITE I, BINDING SITE II or BINDING SITE III. Table 2 illustrates the complementarity of the nucleotide sequences of GPR87 BINDING SITE, designated SEQ ID:23388, to the nucleotide sequence of VGAM2643 RNA, herein designated VGAM RNA, also designated SEQ ID:5354.

Another function of VGAM2643 is therefore inhibition of G Protein-coupled Receptor 87 (GPR87, Accession NM_023915), a gene which plays a role in cell communication. Accordingly, utilities of VGAM2643 include diagnosis, prevention and treatment of diseases and clinical conditions associated with GPR87. The function of GPR87 has been established by previous studies. By batch EST database searching, Wittenberger et al. (2001) identified a cDNA encoding GPR87. The deduced 358-amino acid protein, which is 89% identical to the mouse protein, lacks a leader peptide but possesses a C-terminal PDZ domain-binding site. Northern blot analysis revealed expression of a 1.6-kb GPR87 transcript in placenta, with weaker expression in thymus. Lee et al. (2001) identified GPR87, which they called GPR95, in a genomic database using sequences of related GPRs as query. They cloned partial GPR87 sequences from ESTs of a human testis library and a human bladder cell library. Analysis of overlapping regions confirmed identity. The deduced 358-amino acid protein shares highest identity (OMIM Ref. No. 51-62%) in the transmembrane regions with the UDP-glucose receptor, the platelet ADP receptor, P2Y12 (OMIM Ref. No. 600515), and GPR86 (OMIM Ref. No. 606380). Northern blot analysis detected a 1.8-kb transcript at high levels in prostate and at lower levels in uterus and testis. Little expression was detected in thymus, colon, small intestine, and peripheral blood leukocytes.

Full details of the abovementioned studies are described in the following publications, the disclosure of which are hereby incorporated by reference:

Lee, D. K.; Nguyen, T.; Lynch, K. R.; Cheng, R.; Vanti, W. B.; Arkhitko, O.; Lewis, T.; Evans, J. F.; George, S. R.; O'Dowd, B. F.: Discovery and mapping of ten novel G protein-coupled receptor genes. Gene 275:83-91, 2001; and Wittenberger, T.; Schaller, H. C.; Hellebrand, S.: An expressed sequence tag (EST) data mining strategy succeeding in the discovery of new G-protein coupled receptors. J. Molec. Biol.

Further studies establishing the function and utilities of GPR87 are found in John Hopkins OMIM database record ID 606379, and in sited publications numbered 10637 listed in the bibliography section hereinbelow, which are also hereby incorporated by reference. Karyopherin Alpha 1 (importin alpha 5) (KPNA1, Accession XM_087256) is another VGAM2643 host target gene. KPNA1 BINDING SITE is HOST TARGET binding site found in the 3' untranslated region of mRNA encoded by KPNA1, corresponding to a HOST TARGET binding site such as BINDING SITE I, BINDING SITE II or BINDING SITE III. Table 2 illustrates the complementarity of the nucleotide sequences of KPNA1 BINDING SITE, designated SEQ ID:39151, to the nucleotide sequence of VGAM2643 RNA, herein designated VGAM RNA, also designated SEQ ID:5354.

Another function of VGAM2643 is therefore inhibition of Karyopherin Alpha 1 (importin alpha 5) (KPNA1, Accession XM_087256), a gene which promotes docking of import substrates to the nuclear pore complex. Accordingly, utilities of VGAM2643 include diagnosis, prevention and treatment of diseases and clinical conditions associated with KPNA1. The function of KPNA1 and its association with various diseases and clinical conditions, has been established by previous studies, as described hereinabove with reference to VGAM859. Nuclear Factor of Activated T-cells, Cytoplasmic, Calcineurin-dependent 1 (NFATC1, Accession NM_006162) is another VGAM2643 host target gene. NFATC1 BINDING SITE is HOST TARGET binding site found in the 3' untranslated region of mRNA encoded by NFATC1, corresponding to a HOST TARGET binding site such as BINDING SITE I, BINDING SITE II or BINDING SITE III. Table 2 illustrates the complementarity of the nucleotide sequences of NFATC1 BINDING SITE, designated SEQ ID:12817, to the nucleotide sequence of VGAM2643 RNA, herein designated VGAM RNA, also designated SEQ ID:5354.

Another function of VGAM2643 is therefore inhibition of Nuclear Factor of Activated T-cells, Cytoplasmic, Calcineurin-dependent 1 (NFATC1, Accession NM_006162), a gene which regulates he activation, proliferation, differentiation and programmed death of ymphoid and nonlymphoid cells. Accordingly, utilities of VGAM2643 include diagnosis, prevention and treatment of diseases and clinical conditions associated with NFATC1. The function of NFATC1 and its association with various diseases and clinical conditions, has been established by previous studies, as described hereinabove with reference to VGAM123. RPP30 (Accession NM_006413) is another VGAM2643 host target gene. RPP30 BINDING SITE is HOST TARGET binding site found in the 3' untranslated region of mRNA encoded by RPP30, corresponding to a HOST TARGET binding site such as BINDING SITE I, BINDING SITE II or BINDING SITE III. Table 2 illustrates the complementarity of the nucleotide sequences of RPP30 BINDING SITE, designated SEQ ID:13123, to the nucleotide sequence of VGAM2643 RNA, herein designated VGAM RNA, also designated SEQ ID:5354.

Another function of VGAM2643 is therefore inhibition of RPP30 (Accession NM_006413), a gene which is a component of ribonuclease p that processes 5' ends of precursor tRNAs. Accordingly, utilities of VGAM2643 include diagnosis, prevention and treatment of diseases and clinical conditions associated with RPP30. The function of RPP30 and its association with various diseases and clinical conditions, has been established by previous studies, as described hereinabove with reference to VGAM230. Spastic Ataxia of Charlevoix-Saguenay (sacsin) (SACS, Accession XM_170738) is another VGAM2643 host target gene. SACS BINDING SITE is HOST TARGET binding site found in the 3' untranslated region of mRNA encoded by SACS, corresponding to a HOST TARGET binding site such as BINDING SITE I, BINDING SITE II or BINDING SITE III. Table 2 illustrates the complementarity of the nucleotide sequences of SACS BINDING SITE, designated SEQ ID:45497, to the nucleotide sequence of VGAM2643 RNA, herein designated VGAM RNA, also designated SEQ ID:5354.

Another function of VGAM2643 is therefore inhibition of Spastic Ataxia of Charlevoix-Saguenay (sacsin) (SACS, Accession XM_170738). Accordingly, utilities of VGAM2643 include diagnosis, prevention and treatment of diseases and clinical conditions associated with SACS. Ras Homolog Gene Family, Member U (ARHU, Accession NM_021205) is another VGAM2643 host target gene. ARHU BINDING SITE is HOST TARGET binding site found in the 3' untranslated region of mRNA encoded by ARHU, corresponding to a HOST TARGET binding site such as BINDING SITE I, BINDING SITE II or BINDING SITE III. Table 2 illustrates the complementarity of the nucleotide sequences of ARHU BINDING SITE, designated SEQ ID:22182, to the nucleotide sequence of VGAM2643 RNA, herein designated VGAM RNA, also designated SEQ ID:5354.

Another function of VGAM2643 is therefore inhibition of Ras Homolog Gene Family, Member U (ARHU, Accession NM_021205). Accordingly, utilities of VGAM2643 include diagnosis, prevention and treatment of diseases and clinical conditions associated with ARHU. Baculoviral IAP Repeat-containing 1 (BIRC1, Accession NM_004536) is another VGAM2643 host target gene. BIRC1 BINDING SITE is HOST TARGET binding site found in the 3' untranslated region of mRNA encoded by BIRC1, corresponding to a HOST TARGET binding site such as BINDING SITE I, BINDING SITE II or BINDING SITE III. Table 2 illustrates the complementarity of the nucleotide sequences of BIRC1 BINDING SITE, designated SEQ ID:10888, to the nucleotide sequence of VGAM2643 RNA, herein designated VGAM RNA, also designated SEQ ID:5354.

Another function of VGAM2643 is therefore inhibition of Baculoviral IAP Repeat-containing 1 (BIRC1, Accession NM_004536). Accordingly, utilities of VGAM2643 include diagnosis, prevention and treatment of diseases and clinical conditions associated with BIRC1. Cat Eye Syndrome Chromosome Region, Candidate 1 (CECR1, Accession NM_017424) is another VGAM2643 host target gene. CECR1 BINDING SITE is HOST TARGET binding site found in the 3' untranslated region of mRNA encoded by CECR1, corresponding to a HOST TARGET binding site such as BINDING SITE I, BINDING SITE II or BINDING SITE III. Table 2 illustrates the complementarity of the nucleotide sequences of CECR1 BINDING SITE, designated SEQ ID:18887, to the nucleotide sequence of VGAM2643 RNA, herein designated VGAM RNA, also designated SEQ ID:5354.

Another function of VGAM2643 is therefore inhibition of Cat Eye Syndrome Chromosome Region, Candidate 1 (CECR1, Accession NM_017424). Accordingly, utilities of VGAM2643 include diagnosis, prevention and treatment of diseases and clinical conditions associated with CECR1.

FLJ14437 (Accession NM_032578) is another VGAM2643 host target gene. FLJ14437 BINDING SITE is HOST TARGET binding site found in the 3' untranslated region of mRNA encoded by FLJ14437, corresponding to a HOST TARGET binding site such as BINDING SITE I, BINDING SITE II or BINDING SITE III. Table 2 illustrates the complementarity of the nucleotide sequences of FLJ14437 BINDING SITE, designated SEQ ID:26312, to the nucleotide sequence of VGAM2643 RNA, herein designated VGAM RNA, also designated SEQ ID:5354.

Another function of VGAM2643 is therefore inhibition of FLJ14437 (Accession NM_032578). Accordingly, utilities of VGAM2643 include diagnosis, prevention and treatment of diseases and clinical conditions associated with FLJ14437. KIAA1940 (Accession XM_086981) is another VGAM2643 host target gene. KIAA1940 BINDING SITE is HOST TARGET binding site found in the 3' untranslated region of mRNA encoded by KIAA1940, corresponding to a HOST TARGET binding site such as BINDING SITE I, BINDING SITE II or BINDING SITE III. Table 2 illustrates the complementarity of the nucleotide sequences of KIAA1940 BINDING SITE, designated SEQ ID:39011, to the nucleotide sequence of VGAM2643 RNA, herein designated VGAM RNA, also designated SEQ ID:5354.

Another function of VGAM2643 is therefore inhibition of KIAA1940 (Accession XM_086981). Accordingly, utilities of VGAM2643 include diagnosis, prevention and treatment of diseases and clinical conditions associated with KIAA1940. ODZ2 (Accession XM_047995) is another VGAM2643 host target gene. ODZ2 BINDING SITE is HOST TARGET binding site found in the 3' untranslated region of mRNA encoded by ODZ2, corresponding to a HOST TARGET binding site such as BINDING SITE I, BINDING SITE II or BINDING SITE III. Table 2 illustrates the complementarity of the nucleotide sequences of ODZ2 BINDING SITE, designated SEQ ID:35096, to the nucleotide sequence of VGAM2643 RNA, herein designated VGAM RNA, also designated SEQ ID:5354.

Another function of VGAM2643 is therefore inhibition of ODZ2 (Accession XM_047995). Accordingly, utilities of VGAM2643 include diagnosis, prevention and treatment of diseases and clinical conditions associated with ODZ2. Peptidylprolyl Isomerase (cyclophilin)-like 2 (PPIL2, Accession NM_014337) is another VGAM2643 host target gene. PPIL2 BINDING SITE is HOST TARGET binding site found in the 3' untranslated region of mRNA encoded by PPIL2, corresponding to a HOST TARGET binding site such as BINDING SITE I, BINDING SITE II or BINDING SITE III. Table 2 illustrates the complementarity of the nucleotide sequences of PPIL2 BINDING SITE, designated SEQ ID:15651, to the nucleotide sequence of VGAM2643 RNA, herein designated VGAM RNA, also designated SEQ ID:5354.

Another function of VGAM2643 is therefore inhibition of Peptidylprolyl Isomerase (cyclophilin)-like 2 (PPIL2, Accession NM_014337). Accordingly, utilities of VGAM2643 include diagnosis, prevention and treatment of diseases and clinical conditions associated with PPIL2. LOC121441 (Accession XM_058561) is another VGAM2643 host target gene. LOC121441 BINDING SITE is HOST TARGET binding site found in the 3' untranslated region of mRNA encoded by LOC121441, corresponding to a HOST TARGET binding site such as BINDING SITE I, BINDING SITE II or BINDING SITE III. Table 2 illustrates the complementarity of the nucleotide sequences of LOC121441 BINDING SITE, designated SEQ ID:36660, to the nucleotide sequence of VGAM2643 RNA, herein designated VGAM RNA, also designated SEQ ID:5354.

Another function of VGAM2643 is therefore inhibition of LOC121441 (Accession XM_058561). Accordingly, utilities of VGAM2643 include diagnosis, prevention and treatment of diseases and clinical conditions associated with LOC121441. LOC145945 (Accession XM_096908) is another VGAM2643 host target gene. LOC145945 BINDING SITE is HOST TARGET binding site found in the 5' untranslated region of mRNA encoded by LOC145945, corresponding to a HOST TARGET binding site such as BINDING SITE I, BINDING SITE II or BINDING SITE III. Table 2 illustrates the complementarity of the nucleotide sequences of LOC145945 BINDING SITE, designated SEQ ID:40631, to the nucleotide sequence of VGAM2643 RNA, herein designated VGAM RNA, also designated SEQ ID:5354.

Another function of VGAM2643 is therefore inhibition of LOC145945 (Accession XM_096908). Accordingly, utilities of VGAM2643 include diagnosis, prevention and treatment of diseases and clinical conditions associated with LOC145945. LOC222008 (Accession XM_168361) is another VGAM2643 host target gene. LOC222008 BINDING SITE is HOST TARGET binding site found in the 3' untranslated region of mRNA encoded by LOC222008, corresponding to a HOST TARGET binding site such as BINDING SITE I, BINDING SITE II or BINDING SITE III. Table 2 illustrates the complementarity of the nucleotide sequences of LOC222008 BINDING SITE, designated SEQ ID:45128, to the nucleotide sequence of VGAM2643 RNA, herein designated VGAM RNA, also designated SEQ ID:5354.

Another function of VGAM2643 is therefore inhibition of LOC222008 (Accession XM_168361). Accordingly, utilities of VGAM2643 include diagnosis, prevention and treatment of diseases and clinical conditions associated with LOC222008. FIG. 1 further provides a conceptual description of a novel bioinformatically detected viral gene of the present invention, referred to here as Viral Genomic Address Messenger 2644 (VGAM2644) viral gene, which modulates expression of respective host target genes thereof, the function and utility of which host target genes is known in the art.

VGAM2644 is a novel bioinformatically detected regulatory, non protein coding, viral micro RNA (miRNA) gene. The method by which VGAM2644 was detected is described hereinabove with reference to FIGS. 1-8.

VGAM2644 gene, herein designated VGAM GENE, is a viral gene contained in the genome of Cowpea Aphid-borne Mosaic Virus. VGAM2644 host target gene, herein designated VGAM HOST TARGET GENE, is a human gene contained in the human genome.

VGAM2644 gene encodes a VGAM2644 precursor RNA, herein designated VGAM PRECURSOR RNA. Similar to other miRNA genes, and unlike most ordinary genes, VGAM2644 precursor RNA does not encode a protein. A nucleotide sequence identical or highly similar to the nucleotide sequence of VGAM2644 precursor RNA is designated SEQ ID:2630, and is provided hereinbelow with reference to the sequence listing part. Nucleotide sequence SEQ ID:2630 is located at position 5711 relative to the genome of Cowpea Aphid-borne Mosaic Virus.

VGAM2644 precursor RNA folds onto itself, forming VGAM2644 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2644 folded precursor RNA into VGAM2644 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2644 RNA is designated SEQ ID:5355, and is provided hereinbelow with reference to the sequence listing part.

VGAM2644 host target gene, herein designated VGAM HOST TARGET GENE, encodes a corresponding messenger RNA, VGAM2644 host target RNA, herein designated VGAM HOST TARGET RNA. VGAM2644 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2644 RNA, herein designated VGAM RNA, binds complementarily to one or more host target binding sites located in untranslated regions of VGAM2644 host target RNA, herein designated VGAM HOST TARGET RNA. This complementary binding is due to the fact that the nucleotide sequence of VGAM2644 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2644 RNA, herein designated VGAM RNA, may have a different number of host target binding sites in untranslated regions of a VGAM2644 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2644 RNA, herein designated VGAM RNA, to host target binding sites on VGAM2644 host target RNA, herein designated VGAM HOST TARGET RNA, such as BINDING SITE I, BINDING SITE II and BINDING SITE III, inhibits translation of VGAM2644 host target RNA into VGAM2644 host target protein, herein designated VGAM HOST TARGET PROTEIN. VGAM host target protein is therefore outlined by a broken line.

It is appreciated that VGAM2644 host target gene, herein designated VGAM HOST TARGET GENE, in fact represents a plurality of VGAM2644 host target genes. The mRNA of each one of this plurality of VGAM2644 host target genes comprises one or more host target binding sites, each having a nucleotide sequence which is at least partly complementary to VGAM2644 RNA, herein designated VGAM RNA, and which when bound by VGAM2644 RNA causes inhibition of translation of respective one or more VGAM2644 host target proteins.

It is further appreciated by one skilled in the art that the mode of translational inhibition illustrated by FIG. 1 with specific reference to translational inhibition exerted by VGAM2644 gene, herein designated VGAM GENE, on one or more VGAM2644 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2644 is inhibition of expression of host target genes, as part of a novel viral mechanism of attacking a host. Accordingly, utilities of VGAM2644 include diagnosis, prevention and treatment of viral infection by Cowpea Aphid-borne Mosaic Virus. Specific functions, and accordingly utilities, of VGAM2644 correlate with, and may be deduced from, the identity of the host target genes which VGAM2644 binds and inhibits, and the function of these host target genes, as elaborated hereinbelow.

Nucleotide sequences of the VGAM2644 precursor RNA, herein designated VGAM PRECURSOR RNA, and of the 'diced' VGAM2644 RNA, herein designated VGAM RNA, and a schematic representation of the secondary folding of VGAM2644 folded precursor RNA, herein designated VGAM FOLDED PRECURSOR RNA, of VGAM2644 are further described hereinbelow with reference to Table 1.

Nucleotide sequences of host target binding sites, such as BINDING SITE-I, BINDING SITE-II and BINDING SITE-III of FIG. 1, found on VGAM2644 host target RNA, and schematic representation of the complementarity of each of these host target binding sites to VGAM2644 RNA, herein designated VGAM RNA, are described hereinbelow with reference to Table 2.

As mentioned hereinabove with reference to FIG. 1, a function of VGAM2644 gene, herein designated VGAM is inhibition of expression of VGAM2644 target genes. It is appreciated that specific functions, and accordingly utilities, of VGAM2644 correlate with, and may be deduced from, the identity of the target genes which VGAM2644 binds and inhibits, and the function of these target genes, as elaborated hereinbelow.

Adenylate Kinase 3 (AK3, Accession NM_013410) is a VGAM2644 host target gene. AK3 BINDING SITE is HOST TARGET binding site found in the 5' untranslated region of mRNA encoded by AK3, corresponding to a HOST TARGET binding site such as BINDING SITE I, BINDING SITE II or BINDING SITE III. Table 2 illustrates the complementarity of the nucleotide sequences of AK3 BINDING SITE, designated SEQ ID:15072, to the nucleotide sequence of VGAM2644 RNA, herein designated VGAM RNA, also designated SEQ ID:5355.

A function of VGAM2644 is therefore inhibition of Adenylate Kinase 3 (AK3, Accession NM_013410), a gene which Adenylate kinase 3; strongly similar to murine Ak4. Accordingly, utilities of VGAM2644 include diagnosis, prevention and treatment of diseases and clinical conditions associated with AK3. The function of AK3 and its association with various diseases and clinical conditions, has been established by previous studies, as described hereinabove with reference to VGAM135. ALEX3 (Accession NM_016607) is another VGAM2644 host target gene. ALEX3 BINDING SITE is HOST TARGET binding site found in the 5' untranslated region of mRNA encoded by ALEX3, corresponding to a HOST TARGET binding site such as BINDING SITE I, BINDING SITE II or BINDING SITE III. Table 2 illustrates the complementarity of the nucleotide sequences of ALEX3 BINDING SITE, designated SEQ ID:18712, to the nucleotide sequence of VGAM2644 RNA, herein designated VGAM RNA, also designated SEQ ID:5355.

Another function of VGAM2644 is therefore inhibition of ALEX3 (Accession NM_016607). Accordingly, utilities of VGAM2644 include diagnosis, prevention and treatment of diseases and clinical conditions associated with ALEX3. EH-domain Containing 2 (EHD2, Accession NM_014601) is another VGAM2644 host target gene. EHD2 BINDING SITE is HOST TARGET binding site found in the 3' untranslated region of mRNA encoded by EHD2, corresponding to a HOST TARGET binding site such as BINDING SITE I, BINDING SITE II or BINDING SITE III. Table 2 illustrates the complementarity of the nucleotide sequences of EHD2 BINDING SITE, designated SEQ ID:15965, to the nucleotide sequence of VGAM2644 RNA, herein designated VGAM RNA, also designated SEQ ID:5355.

Another function of VGAM2644 is therefore inhibition of EH-domain Containing 2 (EHD2, Accession NM_014601). Accordingly, utilities of VGAM2644 include diagnosis, prevention and treatment of diseases and clinical conditions associated with EHD2. Leukocyte Immunoglobulin-like Receptor, Subfamily B (with TM and ITIM domains), Member 4 (LILRB4, Accession NM_006847) is another VGAM2644 host target gene. LILRB4 BINDING SITE is HOST TARGET binding site found in the 3' untranslated region of mRNA encoded by LILRB4, corresponding to a HOST TARGET binding site such as BINDING SITE I, BINDING SITE II or BINDING SITE III. Table 2 illustrates the complementarity of the nucleotide sequences of LILRB4 BINDING SITE, designated SEQ ID:13715, to the nucleotide sequence of VGAM2644 RNA, herein designated VGAM RNA, also designated SEQ ID:5355.

Another function of VGAM2644 is therefore inhibition of Leukocyte Immunoglobulin-like Receptor, Subfamily B (with TM and ITIM domains), Member 4 (LILRB4, Accession NM_006847). Accordingly, utilities of VGAM2644 include diagnosis, prevention and treatment of diseases and clinical conditions associated with LILRB4. Nuclear RNA Export Factor 2 (NXF2, Accession NM_022053) is another VGAM2644 host target gene. NXF2 BINDING SITE is HOST TARGET binding site found in the 5' untranslated region of mRNA encoded by NXF2, corresponding to a HOST TARGET binding site such as BINDING SITE I, BINDING SITE II or BINDING SITE III. Table 2 illustrates the complementarity of the nucleotide sequences of NXF2 BINDING SITE, designated SEQ ID:22589, to the nucleotide sequence of VGAM2644 RNA, herein designated VGAM RNA, also designated SEQ ID:5355.

Another function of VGAM2644 is therefore inhibition of Nuclear RNA Export Factor 2 (NXF2, Accession NM_022053), a gene which is involved in the export of mrna from the nucleus to the cytoplasm. Accordingly, utilities of VGAM2644 include diagnosis, prevention and treatment of diseases and clinical conditions associated with NXF2. The function of NXF2 and its association with various diseases and clinical conditions, has been established by previous studies, as described hereinabove with reference to VGAM595. Tumor Protein P53 Binding Protein, 2 (TP53BP2, Accession NM_005426) is another VGAM2644 host target gene. TP53BP2 BINDING SITE is HOST TARGET binding site found in the 5' untranslated region of mRNA encoded by TP53BP2, corresponding to a HOST TARGET binding site such as BINDING SITE I, BINDING SITE II or BINDING SITE III. Table 2 illustrates the complementarity of the nucleotide sequences of TP53BP2 BINDING SITE, designated SEQ ID:11894, to the nucleotide sequence of VGAM2644 RNA, herein designated VGAM RNA, also designated SEQ ID:5355.

Another function of VGAM2644 is therefore inhibition of Tumor Protein P53 Binding Protein, 2 (TP53BP2, Accession NM_005426), a gene which bindes p53. enhances the trans-activation function of p53 and induces the expression of p21. Accordingly, utilities of VGAM2644 include diagnosis, prevention and treatment of diseases and clinical conditions associated with TP53BP2. The function of TP53BP2 has been established by previous studies. By immunoblot analysis, Iwabuchi et al. (1998) showed that expression of TP53BP2 or TP53BP1 (OMIM Ref. No. 605230) enhances the trans-activation function of p53 and induces the expression of p21 (CDKN1A; 116899). Immunofluorescence microscopy demonstrated that TP53BP2 is present only in the cytoplasm, regardless of p53 expression. Western blot analysis of fractionated cells confirmed that whereas p53 is found in both nuclear and cytosolic fractions, TP53BP2 is found only in the cytosol. Samuels-Lev et al. (2001) determined that the ASPP proteins interact with p53 (OMIM Ref. No. 191170) and specifically enhance p53-induced apoptosis but not cell cycle arrest. Inhibition of endogenous ASPP function suppressed the apoptotic function of endogenous p53 in response to apoptotic stimuli. ASPPs enhanced the DNA binding and transactivation function of p53 on the promoters of proapoptotic genes in vivo. Two tumor-derived p53 mutants with reduced apoptotic function were defective in cooperating with ASPP in apoptosis induction. Expression of the ASPPs was frequently downregulated in human breast carcinomas expressing wildtype p53 but not in those expressing mutant p53. Samuels-Lev et al. (2001) concluded that ASPPs regulate the tumor suppression function of p53 in vivo.

Full details of the abovementioned studies are described in the following publications, the disclosure of which are hereby incorporated by reference:

Iwabuchi, K.; Li, B.; Massa, H. F.; Trask, B. J.; Date, T.; Fields, S.: Stimulation of p53-mediated transcriptional activation by the p53-binding proteins, 53BP1 and 53BP2. J. Biol. Chem. 273:26061-26068, 1998; and Samuels-Lev, Y.; O'Connor, D. J.; Bergamaschi, D.; Trigiante, G.; Hsieh, J.-K.; Zhong, S.; Campargue, I.; Naumovski, L.; Crook, T.; Lu, X.: ASPP proteins specifically stimulate the apoptot.

Further studies establishing the function and utilities of TP53BP2 are found in John Hopkins OMIM database record ID 602143, and in sited publications numbered 5969-5973 listed in the bibliography section hereinbelow, which are also hereby incorporated by reference. Cysteine and Tyrosine-rich 1 (CYYR1, Accession NM_052954) is another VGAM2644 host target gene. CYYR1 BINDING SITE is HOST TARGET binding site found in the 3' untranslated region of mRNA encoded by CYYR1, corresponding to a HOST TARGET binding site such as BINDING SITE I, BINDING SITE II or BINDING SITE III. Table 2 illustrates the complementarity of the nucleotide sequences of CYYR1 BINDING SITE, designated SEQ ID:27511, to the nucleotide sequence of VGAM2644 RNA, herein designated VGAM RNA, also designated SEQ ID:5355.

Another function of VGAM2644 is therefore inhibition of Cysteine and Tyrosine-rich 1 (CYYR1, Accession NM_052954). Accordingly, utilities of VGAM2644 include diagnosis, prevention and treatment of diseases and clinical conditions associated with CYYR1. FLJ20507 (Accession XM_012558) is another VGAM2644 host target gene. FLJ20507 BINDING SITE1 and FLJ20507 BINDING SITE2 are HOST TARGET binding sites found in untranslated regions of mRNA encoded by FLJ20507, corresponding to HOST TARGET binding sites such as BINDING SITE I, BINDING SITE II or BINDING SITE III. Table 2 illustrates the complementarity of the nucleotide sequences of FLJ20507 BINDING SITE1 and FLJ20507 BINDING SITE2, designated SEQ ID:30221 and SEQ ID:19513 respectively, to the nucleotide sequence of VGAM2644 RNA, herein designated VGAM RNA, also designated SEQ ID:5355.

Another function of VGAM2644 is therefore inhibition of FLJ20507 (Accession XM_012558). Accordingly, utilities of VGAM2644 include diagnosis, prevention and treatment of diseases and clinical conditions associated with FLJ20507. KIAA0247 (Accession NM_014734) is another VGAM2644 host target gene. KIAA0247 BINDING SITE is HOST TARGET binding site found in the 3' untranslated region of mRNA encoded by KIAA0247, corresponding to a HOST TARGET binding site such as BINDING SITE I, BINDING SITE II or BINDING SITE III. Table 2 illustrates the complementarity of the nucleotide sequences of KIAA0247 BINDING SITE, designated SEQ ID:16370, to the nucleotide sequence of VGAM2644 RNA, herein designated VGAM RNA, also designated SEQ ID:5355.

Another function of VGAM2644 is therefore inhibition of KIAA0247 (Accession NM_014734). Accordingly, utilities of VGAM2644 include diagnosis, prevention and treatment of diseases and clinical conditions associated with KIAA0247. KIAA0453 (Accession XM_044546) is another VGAM2644 host target gene. KIAA0453 BINDING SITE is HOST TARGET binding site found in the 3' untranslated region of mRNA encoded by KIAA0453, corresponding to a HOST TARGET binding site such as BINDING SITE I, BINDING SITE II or BINDING SITE III. Table 2 illustrates the complementarity of the nucleotide sequences of KIAA0453 BINDING SITE, designated SEQ ID:34227, to the nucleotide sequence of VGAM2644 RNA, herein designated VGAM RNA, also designated SEQ ID:5355.

Another function of VGAM2644 is therefore inhibition of KIAA0453 (Accession XM_044546). Accordingly, utilities of VGAM2644 include diagnosis, prevention and treatment of diseases and clinical conditions associated with KIAA0453. KIAA0574 (Accession XM_045076) is another VGAM2644 host target gene. KIAA0574 BINDING SITE is HOST TARGET binding site found in the 3' untranslated region of mRNA encoded by KIAA0574, corresponding to a HOST TARGET binding site such as BINDING SITE I, BINDING SITE II or BINDING SITE III. Table 2 illustrates the complementarity of the nucleotide sequences of KIAA0574 BINDING SITE, designated SEQ ID:34345, to the nucleotide sequence of VGAM2644 RNA, herein designated VGAM RNA, also designated SEQ ID:5355.

Another function of VGAM2644 is therefore inhibition of KIAA0574 (Accession XM_045076). Accordingly, utilities of VGAM2644 include diagnosis, prevention and treatment of diseases and clinical conditions associated with KIAA0574. KIAA0711 (Accession NM_014867) is another VGAM2644 host target gene. KIAA0711 BINDING SITE is HOST TARGET binding site found in the 3' untranslated region of mRNA encoded by KIAA0711, corresponding to a HOST TARGET binding site such as BINDING SITE I, BINDING SITE II or BINDING SITE III. Table 2 illustrates the complementarity of the nucleotide sequences of KIAA0711 BINDING SITE, designated SEQ ID:16958, to the nucleotide sequence of VGAM2644 RNA, herein designated VGAM RNA, also designated SEQ ID:5355.

Another function of VGAM2644 is therefore inhibition of KIAA0711 (Accession NM_014867). Accordingly, utilities of VGAM2644 include diagnosis, prevention and treatment of diseases and clinical conditions associated with KIAA0711. KIAA1786 (Accession XM_038436) is another VGAM2644 host target gene. KIAA1786 BINDING SITE is HOST TARGET binding site found in the 3' untranslated region of mRNA encoded by KIAA1786, corresponding to a HOST TARGET binding site such as BINDING SITE I, BINDING SITE II or BINDING SITE III. Table 2 illustrates the complementarity of the nucleotide sequences of KIAA1786 BINDING SITE, designated SEQ ID:32843, to the nucleotide sequence of VGAM2644 RNA, herein designated VGAM RNA, also designated SEQ ID:5355.

Another function of VGAM2644 is therefore inhibition of KIAA1786 (Accession XM_038436). Accordingly, utilities of VGAM2644 include diagnosis, prevention and treatment of diseases and clinical conditions associated with KIAA1786. poly (A) Binding Protein, Cytoplasmic 5 (PABPC5, Accession NM_080832) is another VGAM2644 host target gene. PABPC5 BINDING SITE is HOST TARGET binding site found in the 3' untranslated region of mRNA encoded by PABPC5, corresponding to a HOST TARGET binding site such as BINDING SITE I, BINDING SITE II or BINDING SITE III. Table 2 illustrates the complementarity of the nucleotide sequences of PABPC5 BINDING SITE, designated SEQ ID:28095, to the nucleotide sequence of VGAM2644 RNA, herein designated VGAM RNA, also designated SEQ ID:5355.

Another function of VGAM2644 is therefore inhibition of poly (A) Binding Protein, Cytoplasmic 5 (PABPC5, Accession NM_080832). Accordingly, utilities of VGAM2644 include diagnosis, prevention and treatment of diseases and clinical conditions associated with PABPC5. PR Domain Containing 10 (PRDM10, Accession NM_020228) is another VGAM2644 host target gene. PRDM10 BINDING SITE is HOST TARGET binding site found in the 5' untranslated region of mRNA encoded by PRDM10, corresponding to a HOST TARGET binding site such as BINDING SITE I, BINDING SITE II or BINDING SITE III. Table 2 illustrates the complementarity of the nucleotide sequences of PRDM10 BINDING SITE, designated SEQ ID:21494, to the nucleotide sequence of VGAM2644 RNA, herein designated VGAM RNA, also designated SEQ ID:5355.

Another function of VGAM2644 is therefore inhibition of PR Domain Containing 10 (PRDM10, Accession NM_020228). Accordingly, utilities of VGAM2644 include diagnosis, prevention and treatment of diseases and clinical conditions associated with PRDM10. PRO1617 (Accession NM_018587) is another VGAM2644 host target gene. PRO1617 BINDING SITE is HOST TARGET binding site found in the 5' untranslated region of mRNA encoded by PRO1617, corresponding to a HOST TARGET binding site such as BINDING SITE I, BINDING SITE II or BINDING SITE III. Table 2 illustrates the complementarity of the nucleotide sequences of PRO1617 BINDING SITE, designated SEQ ID:20663, to the nucleotide sequence of VGAM2644 RNA, herein designated VGAM RNA, also designated SEQ ID:5355.

Another function of VGAM2644 is therefore inhibition of PRO1617 (Accession NM_018587). Accordingly, utilities of VGAM2644 include diagnosis, prevention and treatment of diseases and clinical conditions associated with PRO1617. Protein Tyrosine Phosphatase, Receptor Type, U (PTPRU, Accession NM_133177) is another VGAM2644 host target gene. PTPRU BINDING SITE1 through PTPRU BINDING SITE3 are HOST TARGET binding sites found in untranslated regions of mRNA encoded by PTPRU, corresponding to HOST TARGET binding sites such as BINDING SITE I, BINDING SITE II or BINDING SITE III. Table 2 illustrates the complementarity of the nucleotide sequences of PTPRU BINDING SITE1 through PTPRU BINDING SITE3, designated SEQ ID:28400, SEQ ID:28405 and SEQ ID:12255 respectively, to the nucleotide sequence of VGAM2644 RNA, herein designated VGAM RNA, also designated SEQ ID:5355.

Another function of VGAM2644 is therefore inhibition of Protein Tyrosine Phosphatase, Receptor Type, U (PTPRU, Accession NM_133177). Accordingly, utilities of VGAM2644 include diagnosis, prevention and treatment of diseases and clinical conditions associated with PTPRU. Ring Finger Protein 38 (RNF38, Accession NM_022781) is another VGAM2644 host target gene. RNF38 BINDING SITE is HOST TARGET binding site found in the 3' untranslated region of mRNA encoded by RNF38, corresponding to a HOST TARGET binding site such as BINDING SITE I, BINDING SITE II or BINDING SITE III. Table 2 illustrates the complementarity of the nucleotide sequences of RNF38 BINDING SITE, designated SEQ ID:23062, to the nucleotide sequence of VGAM2644 RNA, herein designated VGAM RNA, also designated SEQ ID:5355.

Another function of VGAM2644 is therefore inhibition of Ring Finger Protein 38 (RNF38, Accession NM_022781). Accordingly, utilities of VGAM2644 include diagnosis, prevention and treatment of diseases and clinical conditions associated with RNF38. LOC144347 (Accession XM_084832) is another VGAM2644 host target gene. LOC144347 BINDING SITE is HOST TARGET binding site found in the 3' untranslated region of mRNA encoded by LOC144347, corresponding to a HOST TARGET binding site such as BINDING SITE I, BINDING SITE II or BINDING SITE III. Table 2 illustrates the complementarity of the nucleotide sequences of LOC144347 BINDING SITE, designated SEQ ID:37723, to the nucleotide sequence of VGAM2644 RNA, herein designated VGAM RNA, also designated SEQ ID:5355.

Another function of VGAM2644 is therefore inhibition of LOC144347 (Accession XM_084832). Accordingly, utilities of VGAM2644 include diagnosis, prevention and treatment of diseases and clinical conditions associated with LOC144347. LOC148581 (Accession XM_086243) is another VGAM2644 host target gene. LOC148581 BINDING SITE is HOST TARGET binding site found in the 5' untranslated region of mRNA encoded by LOC148581, corresponding to a HOST TARGET binding site such as BINDING SITE I, BINDING SITE II or BINDING SITE III. Table 2 illustrates the complementarity of the nucleotide sequences of LOC148581 BINDING SITE, designated SEQ ID:38567, to the nucleotide sequence of VGAM2644 RNA, herein designated VGAM RNA, also designated SEQ ID:5355.

Another function of VGAM2644 is therefore inhibition of LOC148581 (Accession XM_086243). Accordingly, utilities of VGAM2644 include diagnosis, prevention and treatment of diseases and clinical conditions associated with LOC148581. LOC197259 (Accession XM_113849) is another VGAM2644 host target gene. LOC197259 BINDING SITE is HOST TARGET binding site found in the 3' untranslated region of mRNA encoded by LOC197259, corresponding to a HOST TARGET binding site such as BINDING SITE I, BINDING SITE II or BINDING SITE III. Table 2 illustrates the complementarity of the nucleotide sequences of LOC197259 BINDING SITE, designated SEQ ID:42470, to the nucleotide sequence of VGAM2644 RNA, herein designated VGAM RNA, also designated SEQ ID:5355.

Another function of VGAM2644 is therefore inhibition of LOC197259 (Accession XM_113849). Accordingly, utilities of VGAM2644 include diagnosis, prevention and treatment of diseases and clinical conditions associated with LOC197259. LOC93268 (Accession XM_050158) is another VGAM2644 host target gene. LOC93268 BINDING SITE is HOST TARGET binding site found in the 5' untranslated region of mRNA encoded by LOC93268, corresponding to a HOST TARGET binding site such as BINDING SITE I, BINDING SITE II or BINDING SITE III. Table 2 illustrates the complementarity of the nucleotide sequences of LOC93268 BINDING SITE, designated SEQ ID:35586, to the nucleotide sequence of VGAM2644 RNA, herein designated VGAM RNA, also designated SEQ ID:5355.

Another function of VGAM2644 is therefore inhibition of LOC93268 (Accession XM_050158). Accordingly, utilities of VGAM2644 include diagnosis, prevention and treatment of diseases and clinical conditions associated with LOC93268. FIG. 1 further provides a conceptual description of a novel bioinformatically detected viral gene of the present invention, referred to here as Viral Genomic Address Messenger 2645 (VGAM2645) viral gene, which modulates expression of respective host target genes thereof, the function and utility of which host target genes is known in the art.

VGAM2645 is a novel bioinformatically detected regulatory, non protein coding, viral micro RNA (miRNA) gene. The method by which VGAM2645 was detected is described hereinabove with reference to FIGS. 1-8.

VGAM2645 gene, herein designated VGAM GENE, is a viral gene contained in the genome of Cowpea Aphid-borne Mosaic Virus. VGAM2645 host target gene, herein designated VGAM HOST TARGET GENE, is a human gene contained in the human genome.

VGAM2645 gene encodes a VGAM2645 precursor RNA, herein designated VGAM PRECURSOR RNA. Similar to other miRNA genes, and unlike most ordinary genes, VGAM2645 precursor RNA does not encode a protein. A nucleotide sequence identical or highly similar to the nucleotide sequence of VGAM2645 precursor RNA is designated SEQ ID:2631, and is provided hereinbelow with reference to the sequence listing part. Nucleotide sequence SEQ ID:2631 is located at position 2957 relative to the genome of Cowpea Aphid-borne Mosaic Virus.

VGAM2645 precursor RNA folds onto itself, forming VGAM2645 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2645 folded precursor RNA into VGAM2645 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2645 RNA is designated SEQ ID:5356, and is provided hereinbelow with reference to the sequence listing part.

VGAM2645 host target gene, herein designated VGAM HOST TARGET GENE, encodes a corresponding messenger RNA, VGAM2645 host target RNA, herein designated VGAM HOST TARGET RNA. VGAM2645 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2645 RNA, herein designated VGAM RNA, binds complementarily to one or more host target binding sites located in untranslated regions of VGAM2645 host target RNA, herein designated VGAM HOST TARGET RNA. This complementary binding is due to the fact that the nucleotide sequence of VGAM2645 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2645 RNA, herein designated VGAM RNA, may have a different number of host target binding sites in untranslated regions of a VGAM2645 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2645 RNA, herein designated VGAM RNA, to host target binding sites on VGAM2645 host target RNA, herein designated VGAM HOST TARGET RNA, such as BINDING SITE I, BINDING SITE II and BINDING SITE III, inhibits translation of VGAM2645 host target RNA into VGAM2645 host target protein, herein designated VGAM HOST TARGET PROTEIN. VGAM host target protein is therefore outlined by a broken line.

It is appreciated that VGAM2645 host target gene, herein designated VGAM HOST TARGET GENE, in fact represents a plurality of VGAM2645 host target genes. The mRNA of each one of this plurality of VGAM2645 host target genes comprises one or more host target binding sites, each having a nucleotide sequence which is at least partly complementary to VGAM2645 RNA, herein designated VGAM RNA, and which when bound by VGAM2645 RNA causes inhibition of translation of respective one or more VGAM2645 host target proteins.

It is further appreciated by one skilled in the art that the mode of translational inhibition illustrated by FIG. 1 with specific reference to translational inhibition exerted by VGAM2645 gene, herein designated VGAM GENE, on one or more VGAM2645 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2645 is inhibition of expression of host target genes, as part of a novel viral mechanism of attacking a host. Accordingly, utilities of VGAM2645 include diagnosis, prevention and treatment of viral infection by Cowpea Aphid-borne Mosaic Virus. Specific functions, and accordingly utilities, of VGAM2645 correlate with, and may be deduced from, the identity of the host target genes which VGAM2645 binds and inhibits, and the function of these host target genes, as elaborated hereinbelow.

Nucleotide sequences of the VGAM2645 precursor RNA, herein designated VGAM PRECURSOR RNA, and of the 'diced' VGAM2645 RNA, herein designated VGAM RNA, and a schematic representation of the secondary folding of VGAM2645 folded precursor RNA, herein designated VGAM FOLDED PRECURSOR RNA, of VGAM2645 are further described hereinbelow with reference to Table 1.

Nucleotide sequences of host target binding sites, such as BINDING SITE-I, BINDING SITE-II and BINDING SITE-III of FIG. 1, found on VGAM2645 host target RNA, and schematic representation of the complementarity of each of these host target binding sites to VGAM2645 RNA, herein designated VGAM RNA, are described hereinbelow with reference to Table 2.

As mentioned hereinabove with reference to FIG. 1, a function of VGAM2645 gene, herein designated VGAM is inhibition of expression of VGAM2645 target genes. It is appreciated that specific functions, and accordingly utilities, of VGAM2645 correlate with, and may be deduced from, the identity of the target genes which VGAM2645 binds and inhibits, and the function of these target genes, as elaborated hereinbelow.

Spinocerebellar Ataxia 7 (olivopontocerebellar atrophy with retinal degeneration) (SCA7, Accession NM_000333) is a VGAM2645 host target gene. SCA7 BINDING SITE is HOST TARGET binding site found in the 5' untranslated region of mRNA encoded by SCA7, corresponding to a HOST TARGET binding site such as BINDING SITE I, BINDING SITE II or BINDING SITE III. Table 2 illustrates the complementarity of the nucleotide sequences of SCA7 BINDING SITE, designated SEQ ID:5885, to the nucleotide sequence of VGAM2645 RNA, herein designated VGAM RNA, also designated SEQ ID:5356.

A function of VGAM2645 is therefore inhibition of Spinocerebellar Ataxia 7 (olivopontocerebellar atrophy with retinal degeneration) (SCA7, Accession NM_000333). Accordingly, utilities of VGAM2645 include diagnosis, prevention and treatment of diseases and clinical conditions associated with SCA7. KIAA1028 (Accession XM_166324) is another VGAM2645 host target gene. KIAA1028 BINDING SITE is HOST TARGET binding site found in the 3' untranslated region of mRNA encoded by KIAA1028, corresponding to a HOST TARGET binding site such as BINDING SITE I, BINDING SITE II or BINDING SITE III. Table 2 illustrates the complementarity of the nucleotide sequences of KIAA1028 BINDING SITE, designated SEQ ID:44156, to the nucleotide sequence of VGAM2645 RNA, herein designated VGAM RNA, also designated SEQ ID:5356.

Another function of VGAM2645 is therefore inhibition of KIAA1028 (Accession XM_166324). Accordingly, utilities of VGAM2645 include diagnosis, prevention and treatment of diseases and clinical conditions associated with KIAA1028. LOC148254 (Accession XM_086121) is another VGAM2645 host target gene. LOC148254 BINDING SITE is HOST TARGET binding site found in the 3' untranslated region of mRNA encoded by LOC148254, corresponding to a HOST TARGET binding site such as BINDING SITE I, BINDING SITE II or BINDING SITE III. Table 2 illustrates the complementarity of the nucleotide sequences of LOC148254 BINDING SITE, designated SEQ ID:38500, to the nucleotide sequence of VGAM2645 RNA, herein designated VGAM RNA, also designated SEQ ID:5356.

Another function of VGAM2645 is therefore inhibition of LOC148254 (Accession XM_086121). Accordingly, utilities of VGAM2645 include diagnosis, prevention and treatment of diseases and clinical conditions associated with LOC148254. LOC256306 (Accession XM_172976) is another VGAM2645 host target gene. LOC256306 BINDING SITE is HOST TARGET binding site found in the 3' untranslated region of mRNA encoded by LOC256306, corresponding to a HOST TARGET binding site such as BINDING SITE I, BINDING SITE II or BINDING SITE III. Table 2 illustrates the complementarity of the nucleotide sequences of LOC256306 BINDING SITE, designated SEQ ID:46234, to the nucleotide sequence of VGAM2645 RNA, herein designated VGAM RNA, also designated SEQ ID:5356.

Another function of VGAM2645 is therefore inhibition of LOC256306 (Accession XM_172976). Accordingly, utilities of VGAM2645 include diagnosis, prevention and treatment of diseases and clinical conditions associated with LOC256306. FIG. 1 further provides a conceptual description of a novel bioinformatically detected viral gene of the present invention, referred to here as Viral Genomic Address Messenger 2646 (VGAM2646) viral gene, which modulates expression of respective host target genes thereof, the function and utility of which host target genes is known in the art.

VGAM2646 is a novel bioinformatically detected regulatory, non protein coding, viral micro RNA (miRNA) gene. The method by which VGAM2646 was detected is described hereinabove with reference to FIGS. 1-8.

VGAM2646 gene, herein designated VGAM GENE, is a viral gene contained in the genome of Cowpea Aphid-borne Mosaic Virus. VGAM2646 host target gene, herein designated VGAM HOST TARGET GENE, is a human gene contained in the human genome.

VGAM2646 gene encodes a VGAM2646 precursor RNA, herein designated VGAM PRECURSOR RNA. Similar to other miRNA genes, and unlike most ordinary genes, VGAM2646 precursor RNA does not encode a protein. A nucleotide sequence identical or highly similar to the nucleotide sequence of VGAM2646 precursor RNA is designated SEQ ID:2632, and is provided hereinbelow with reference to the sequence listing part. Nucleotide sequence SEQ ID:2632 is located at position 1728 relative to the genome of Cowpea Aphid-borne Mosaic Virus.

VGAM2646 precursor RNA folds onto itself, forming VGAM2646 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2646 folded precursor RNA into VGAM2646 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 63%) nucleotide sequence of VGAM2646 RNA is designated SEQ ID:5357, and is provided hereinbelow with reference to the sequence listing part.

VGAM2646 host target gene, herein designated VGAM HOST TARGET GENE, encodes a corresponding messenger RNA, VGAM2646 host target RNA, herein designated VGAM HOST TARGET RNA. VGAM2646 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2646 RNA, herein designated VGAM RNA, binds complementarily to one or more host target binding sites located in untranslated regions of VGAM2646 host target RNA, herein designated VGAM HOST TARGET RNA. This complementary binding is due to the fact that the nucleotide sequence of VGAM2646 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2646 RNA, herein designated VGAM RNA, may have a different number of host target binding sites in untranslated regions of a VGAM2646 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2646 RNA, herein designated VGAM RNA, to host target binding sites on VGAM2646 host target RNA, herein designated VGAM HOST TARGET RNA, such as BINDING SITE I, BINDING SITE II and BINDING SITE III, inhibits translation of VGAM2646 host target RNA into VGAM2646 host target protein, herein designated VGAM HOST TARGET PROTEIN. VGAM host target protein is therefore outlined by a broken line.

It is appreciated that VGAM2646 host target gene, herein designated VGAM HOST TARGET GENE, in fact represents a plurality of VGAM2646 host target genes. The mRNA of each one of this plurality of VGAM2646 host target genes comprises one or more host target binding sites, each having a nucleotide sequence which is at least partly complementary to VGAM2646 RNA, herein designated VGAM RNA, and which when bound by VGAM2646 RNA causes inhibition of translation of respective one or more VGAM2646 host target proteins.

It is further appreciated by one skilled in the art that the mode of translational inhibition illustrated by FIG. 1 with specific reference to translational inhibition exerted by VGAM2646 gene, herein designated VGAM GENE, on one or more VGAM2646 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2646 is inhibition of expression of host target genes, as part of a novel viral mechanism of attacking a host. Accordingly, utilities of VGAM2646 include diagnosis, prevention and treatment of viral infection by Cowpea Aphid-borne Mosaic Virus. Specific functions, and accordingly utilities, of VGAM2646 correlate with, and may be deduced from, the identity of the host target genes which VGAM2646 binds and inhibits, and the function of these host target genes, as elaborated hereinbelow.

Nucleotide sequences of the VGAM2646 precursor RNA, herein designated VGAM PRECURSOR RNA, and of the 'diced' VGAM2646 RNA, herein designated VGAM RNA, and a schematic representation of the secondary folding of VGAM2646 folded precursor RNA, herein designated VGAM FOLDED PRECURSOR RNA, of VGAM2646 are further described hereinbelow with reference to Table 1.

Nucleotide sequences of host target binding sites, such as BINDING SITE-I, BINDING SITE-II and BINDING SITE-III of FIG. 1, found on VGAM2646 host target RNA, and schematic representation of the complementarity of each of these host target binding sites to VGAM2646 RNA, herein designated VGAM RNA, are described hereinbelow with reference to Table 2.

As mentioned hereinabove with reference to FIG. 1, a function of VGAM2646 gene, herein designated VGAM is inhibition of expression of VGAM2646 target genes. It is appreciated that specific functions, and accordingly utilities, of VGAM2646 correlate with, and may be deduced from, the identity of the target genes which VGAM2646 binds and inhibits, and the function of these target genes, as elaborated hereinbelow.

Astrotactin (ASTN, Accession XM_045113) is a VGAM2646 host target gene. ASTN BINDING SITE is HOST TARGET binding site found in the 3' untranslated region of mRNA encoded by ASTN, corresponding to a HOST TARGET binding site such as BINDING SITE I, BINDING SITE II or BINDING SITE III. Table 2 illustrates the complementarity of the nucleotide sequences of ASTN BINDING SITE, designated SEQ ID:34362, to the nucleotide sequence of VGAM2646 RNA, herein designated VGAM RNA, also designated SEQ ID:5357.

A function of VGAM2646 is therefore inhibition of Astrotactin (ASTN, Accession XM_045113). Accordingly, utilities of VGAM2646 include diagnosis, prevention and treatment of diseases and clinical conditions associated with ASTN. UDP-N-acetyl-alpha-D-galactosamine:(N-acetylneuraminyl)-galactosylglucosylceramide N-acetylgalactosaminyltransferase (GalNAc-T) (GALGT, Accession NM_001478) is another VGAM2646 host target gene. GALGT BINDING SITE is HOST TARGET binding site found in the 5' untranslated region of mRNA encoded by GALGT, corresponding to a HOST TARGET binding site such as BINDING SITE I, BINDING SITE II or BINDING SITE III. Table 2 illustrates the complementarity of the nucleotide sequences of GALGT BINDING SITE, designated SEQ ID:7213, to the nucleotide sequence of VGAM2646 RNA, herein designated VGAM RNA, also designated SEQ ID:5357.

Another function of VGAM2646 is therefore inhibition of UDP-N-acetyl-alpha-D-galactosamine:(N-acetylneuraminyl)-galactosylglucosylceramide N-acetylgalactosaminyltransferase (GalNAc-T) (GALGT, Accession NM_001478), a gene which is involved in the biosynthesis of gangliosides gm2, gd2 and ga2. Accordingly, utilities of VGAM2646 include diagnosis, prevention and treatment of diseases and clinical conditions associated with GALGT. The function of GALGT and its association with various diseases and clinical conditions, has been established by previous studies, as described hereinabove with reference to VGAM179. KIAA0442 (Accession NM_015570) is another VGAM2646 host target gene. KIAA0442 BINDING SITE is HOST TARGET binding site found in the 3' untranslated region of mRNA encoded by KIAA0442, corresponding to a HOST TARGET binding site such as BINDING SITE I, BINDING SITE II or BINDING SITE III. Table 2 illustrates the complementarity of the nucleotide sequences of KIAA0442 BINDING SITE, designated SEQ ID:17841, to the nucleotide sequence of VGAM2646 RNA, herein designated VGAM RNA, also designated SEQ ID:5357.

Another function of VGAM2646 is therefore inhibition of KIAA0442 (Accession NM_015570). Accordingly, utilities of VGAM2646 include diagnosis, prevention and treatment of diseases and clinical conditions associated with KIAA0442. Leucine-zipper-like Transcriptional Regulator, 1 (LZTR1, Accession NM_006767) is another VGAM2646 host target gene. LZTR1 BINDING SITE is HOST TARGET binding site found in the 3' untranslated region of mRNA encoded by LZTR1, corresponding to a HOST TARGET binding site such as BINDING SITE I, BINDING SITE II or BINDING SITE III. Table 2 illustrates the complementarity of the nucleotide sequences of LZTR1 BINDING SITE, designated SEQ ID:13639, to the nucleotide sequence of VGAM2646 RNA, herein designated VGAM RNA, also designated SEQ ID:5357.

Another function of VGAM2646 is therefore inhibition of Leucine-zipper-like Transcriptional Regulator, 1 (LZTR1, Accession NM_006767). Accordingly, utilities of VGAM2646 include diagnosis, prevention and treatment of diseases and clinical conditions associated with LZTR1. Nitric Oxide Synthase 1 (neuronal) (NOS1, Accession NM_000620) is another VGAM2646 host target gene. NOS1 BINDING SITE is HOST TARGET binding site found in the 3' untranslated region of mRNA encoded by NOS1, corresponding to a HOST TARGET binding site such as BINDING SITE I, BINDING SITE II or BINDING SITE III. Table 2 illustrates the complementarity of the nucleotide sequences of NOS1 BINDING SITE, designated SEQ ID:6232, to the nucleotide sequence of VGAM2646 RNA, herein designated VGAM RNA, also designated SEQ ID:5357.

Another function of VGAM2646 is therefore inhibition of Nitric Oxide Synthase 1 (neuronal) (NOS1, Accession NM_000620), a gene which produces nitric oxide (no) which is a messenger molecule with diverse functions throughout the body. Accordingly, utilities of VGAM2646 include diagnosis, prevention and treatment of diseases and clinical conditions associated with NOS1. The function of NOS1 and its association with various diseases and clinical conditions, has been established by previous studies, as described hereinabove with reference to VGAM323. Protocadherin 11 X-linked (PCDH11X, Accession NM_032968) is another VGAM2646 host target gene. PCDH11X BINDING SITE1 and PCDH11X BINDING SITE2 are HOST TARGET binding sites found in untranslated regions of mRNA encoded by PCDH11X, corresponding to HOST TARGET binding sites such as BINDING SITE I, BINDING SITE II or BINDING SITE III. Table 2 illustrates the complementarity of the nucleotide sequences of PCDH11X BINDING SITE1 and PCDH11X BINDING SITE2, designated SEQ ID:26797 and SEQ ID:26812 respectively, to the nucleotide sequence of VGAM2646 RNA, herein designated VGAM RNA, also designated SEQ ID:5357.

Another function of VGAM2646 is therefore inhibition of Protocadherin 11 X-linked (PCDH11X, Accession NM_032968), a gene which is thought to play a fundamental role in cell-cell recognition essential for the segmental development and function of the central nervous system. Accordingly, utilities of VGAM2646 include diagnosis, prevention and treatment of diseases and clinical conditions associated with PCDH11X. The function of PCDH11X and its association with various diseases and clinical conditions, has been established by previous studies, as described hereinabove with reference to VGAM433. SMAC (Accession NM_138930) is another VGAM2646 host target gene. SMAC BINDING SITE is HOST TARGET binding site found in the 5' untranslated region of mRNA encoded by SMAC, corresponding to a HOST TARGET binding site such as BINDING SITE I, BINDING SITE II or BINDING SITE III. Table 2 illustrates the complementarity of the nucleotide sequences of SMAC BINDING SITE, designated SEQ ID:29048, to the nucleotide sequence of VGAM2646 RNA, herein designated VGAM RNA, also designated SEQ ID:5357.

Another function of VGAM2646 is therefore inhibition of SMAC (Accession NM_138930), a gene which promotes apoptosis via caspase activation. Accordingly, utilities of VGAM2646 include diagnosis, prevention and treatment of diseases and clinical conditions associated with SMAC. The function of SMAC and its association with various diseases and clinical conditions, has been established by previous studies, as described hereinabove with reference to VGAM74. UV Radiation Resistance Associated Gene (UVRAG, Accession NM_003369) is another VGAM2646 host target gene. UVRAG BINDING SITE is HOST TARGET binding site found in the 3' untranslated region of mRNA encoded by UVRAG, corresponding to a HOST TARGET binding site such as BINDING SITE I, BINDING SITE II or BINDING SITE III. Table 2 illustrates the complementarity of the nucleotide sequences of UVRAG BINDING SITE, designated SEQ ID:9395, to the nucleotide sequence of VGAM2646 RNA, herein designated VGAM RNA, also designated SEQ ID:5357.

Another function of VGAM2646 is therefore inhibition of UV Radiation Resistance Associated Gene (UVRAG, Accession NM_003369). Accordingly, utilities of VGAM2646 include diagnosis, prevention and treatment of diseases and clinical conditions associated with UVRAG. A Disintegrin and Metalloproteinase Domain 9 (meltrin gamma) (ADAM9, Accession NM_003816) is another VGAM2646 host target gene. ADAM9 BINDING SITE is HOST TARGET binding site found in the 3' untranslated region of mRNA encoded by ADAM9, corresponding to a HOST TARGET binding site such as BINDING SITE I, BINDING SITE II or BINDING SITE III. Table 2 illustrates the complementarity of the nucleotide sequences of ADAM9 BINDING SITE, designated SEQ ID:9907, to the nucleotide sequence of VGAM2646 RNA, herein designated VGAM RNA, also designated SEQ ID:5357.

Another function of VGAM2646 is therefore inhibition of A Disintegrin and Metalloproteinase Domain 9 (meltrin gamma) (ADAM9, Accession NM_003816). Accordingly, utilities of VGAM2646 include diagnosis, prevention and treatment of diseases and clinical conditions associated with ADAM9. Adaptor-related Protein Complex 3, Mu 1 Subunit (AP3M1, Accession NM_012095) is another VGAM2646 host target gene. AP3M1 BINDING SITE is HOST TARGET binding site found in the 3' untranslated region of mRNA encoded by AP3M1, corresponding to a HOST TARGET binding site such as BINDING SITE I, BINDING SITE II or BINDING SITE III. Table 2 illustrates the complementarity of the nucleotide sequences of AP3M1 BINDING SITE, designated SEQ ID:14396, to the nucleotide sequence of VGAM2646 RNA, herein designated VGAM RNA, also designated SEQ ID:5357.

Another function of VGAM2646 is therefore inhibition of Adaptor-related Protein Complex 3, Mu 1 Subunit (AP3M1, Accession NM_012095). Accordingly, utilities of VGAM2646 include diagnosis, prevention and treatment of diseases and clinical conditions associated with AP3M1.

Aquaporin 10 (AQP10, Accession NM_080429) is another VGAM2646 host target gene. AQP10 BINDING SITE is HOST TARGET binding site found in the 3' untranslated region of mRNA encoded by AQP10, corresponding to a HOST TARGET binding site such as BINDING SITE I, BINDING SITE II or BINDING SITE III. Table 2 illustrates the complementarity of the nucleotide sequences of AQP10 BINDING SITE, designated SEQ ID:27841, to the nucleotide sequence of VGAM2646 RNA, herein designated VGAM RNA, also designated SEQ ID:5357.

Another function of VGAM2646 is therefore inhibition of Aquaporin 10 (AQP10, Accession NM_080429). Accordingly, utilities of VGAM2646 include diagnosis, prevention and treatment of diseases and clinical conditions associated with AQP10. CDT1 (Accession XM_085327) is another VGAM2646 host target gene. CDT1 BINDING SITE is HOST TARGET binding site found in the 5' untranslated region of mRNA encoded by CDT1, corresponding to a HOST TARGET binding site such as BINDING SITE I, BINDING SITE II or BINDING SITE III. Table 2 illustrates the complementarity of the nucleotide sequences of CDT1 BINDING SITE, designated SEQ ID:38070, to the nucleotide sequence of VGAM2646 RNA, herein designated VGAM RNA, also designated SEQ ID:5357.

Another function of VGAM2646 is therefore inhibition of CDT1 (Accession XM_085327). Accordingly, utilities of VGAM2646 include diagnosis, prevention and treatment of diseases and clinical conditions associated with CDT1. Carbohydrate (chondroitin) Synthase 1 (CHSY1, Accession NM_014918) is another VGAM2646 host target gene. CHSY1 BINDING SITE is HOST TARGET binding site found in the 3' untranslated region of mRNA encoded by CHSY1, corresponding to a HOST TARGET binding site such as BINDING SITE I, BINDING SITE II or BINDING SITE III. Table 2 illustrates the complementarity of the nucleotide sequences of CHSY1 BINDING SITE, designated SEQ ID:17172, to the nucleotide sequence of VGAM2646 RNA, herein designated VGAM RNA, also designated SEQ ID:5357.

Another function of VGAM2646 is therefore inhibition of Carbohydrate (chondroitin) Synthase 1 (CHSY1, Accession NM_014918). Accordingly, utilities of VGAM2646 include diagnosis, prevention and treatment of diseases and clinical conditions associated with CHSY1. DKFZp434E2220 (Accession NM_017612) is another VGAM2646 host target gene. DKFZp434E2220 BINDING SITE is HOST TARGET binding site found in the 3' untranslated region of mRNA encoded by DKFZp434E2220, corresponding to a HOST TARGET binding site such as BINDING SITE I, BINDING SITE II or BINDING SITE III. Table 2 illustrates the complementarity of the nucleotide sequences of DKFZp434E2220 BINDING SITE, designated SEQ ID:19113, to the nucleotide sequence of VGAM2646 RNA, herein designated VGAM RNA, also designated SEQ ID:5357.

Another function of VGAM2646 is therefore inhibition of DKFZp434E2220 (Accession NM_017612). Accordingly, utilities of VGAM2646 include diagnosis, prevention and treatment of diseases and clinical conditions associated with DKFZp434E2220. DKFZP434L1435 (Accession XM_166401) is another VGAM2646 host target gene. DKFZP434L1435 BINDING SITE1 through DKFZP434L1435 BINDING SITE3 are HOST TARGET binding sites found in untranslated regions of mRNA encoded by DKFZP434L1435, corresponding to HOST TARGET binding sites such as BINDING SITE I, BINDING SITE II or BINDING SITE III. Table 2 illustrates the complementarity of the nucleotide sequences of DKFZP434L1435 BINDING SITE1 through DKFZP434L1435 BINDING SITE3, designated SEQ ID:44265, SEQ ID:46701 and SEQ ID:46663 respectively, to the nucleotide sequence of VGAM2646 RNA, herein designated VGAM RNA, also designated SEQ ID:5357.

Another function of VGAM2646 is therefore inhibition of DKFZP434L1435 (Accession XM_166401). Accordingly, utilities of VGAM2646 include diagnosis, prevention and treatment of diseases and clinical conditions associated with DKFZP434L1435. FLJ13195 (Accession NM_022906) is another VGAM2646 host target gene. FLJ13195 BINDING SITE is HOST TARGET binding site found in the 3' untranslated region of mRNA encoded by FLJ13195, corresponding to a HOST TARGET binding site such as BINDING SITE I, BINDING SITE II or BINDING SITE III. Table 2 illustrates the complementarity of the nucleotide sequences of FLJ13195 BINDING SITE, designated SEQ ID:23204, to the nucleotide sequence of VGAM2646 RNA, herein designated VGAM RNA, also designated SEQ ID:5357.

Another function of VGAM2646 is therefore inhibition of FLJ13195 (Accession NM_022906). Accordingly, utilities of VGAM2646 include diagnosis, prevention and treatment of diseases and clinical conditions associated with FLJ13195. FLJ14547 (Accession NM_032804) is another VGAM2646 host target gene. FLJ14547 BINDING SITE is HOST TARGET binding site found in the 3' untranslated region of mRNA encoded by FLJ14547, corresponding to a HOST TARGET binding site such as BINDING SITE I, BINDING SITE II or BINDING SITE III. Table 2 illustrates the complementarity of the nucleotide sequences of FLJ14547 BINDING SITE, designated SEQ ID:26560, to the nucleotide sequence of VGAM2646 RNA, herein designated VGAM RNA, also designated SEQ ID:5357.

Another function of VGAM2646 is therefore inhibition of FLJ14547 (Accession NM_032804). Accordingly, utilities of VGAM2646 include diagnosis, prevention and treatment of diseases and clinical conditions associated with FLJ14547. FLJ20079 (Accession NM_017656) is another VGAM2646 host target gene. FLJ20079 BINDING SITE is HOST TARGET binding site found in the 3' untranslated region of mRNA encoded by FLJ20079, corresponding to a HOST TARGET binding site such as BINDING SITE I, BINDING SITE II or BINDING SITE III. Table 2 illustrates the complementarity of the nucleotide sequences of FLJ20079 BINDING SITE, designated SEQ ID:19166, to the nucleotide sequence of VGAM2646 RNA, herein designated VGAM RNA, also designated SEQ ID:5357.

Another function of VGAM2646 is therefore inhibition of FLJ20079 (Accession NM_017656). Accordingly, utilities of VGAM2646 include diagnosis, prevention and treatment of diseases and clinical conditions associated with FLJ20079. FLJ20342 (Accession NM_017774) is another VGAM2646 host target gene. FLJ20342 BINDING SITE is HOST TARGET binding site found in the 3' untranslated region of mRNA encoded by FLJ20342, corresponding to a HOST TARGET binding site such as BINDING SITE I, BINDING SITE II or BINDING SITE III. Table 2 illustrates the complementarity of the nucleotide sequences of FLJ20342 BINDING SITE, designated SEQ ID:19397, to the nucleotide sequence of VGAM2646 RNA, herein designated VGAM RNA, also designated SEQ ID:5357.

Another function of VGAM2646 is therefore inhibition of FLJ20342 (Accession NM_017774). Accordingly, utilities of VGAM2646 include diagnosis, prevention and treatment of diseases and clinical conditions associated with FLJ20342. FLJ20519 (Accession NM_017860) is another VGAM2646 host target gene. FLJ20519 BINDING SITE is HOST TARGET binding site found in the 3' untranslated region of mRNA encoded by FLJ20519, corresponding to a HOST TARGET binding site such as BINDING SITE I, BINDING SITE II or BINDING SITE III. Table 2 illustrates the complementarity of the nucleotide sequences of FLJ20519 BINDING SITE, designated SEQ ID:19538, to the nucleotide sequence of VGAM2646 RNA, herein designated VGAM RNA, also designated SEQ ID:5357.

Another function of VGAM2646 is therefore inhibition of FLJ20519 (Accession NM_017860). Accordingly, utilities of VGAM2646 include diagnosis, prevention and treatment of diseases and clinical conditions associated with FLJ20519. FLJ22169 (Accession NM_024085) is another VGAM2646 host target gene. FLJ22169 BINDING SITE is HOST TARGET binding site found in the 3' untranslated region of mRNA encoded by FLJ22169, corresponding to a HOST TARGET binding site such as BINDING SITE I, BINDING SITE II or BINDING SITE III. Table 2 illustrates the complementarity of the nucleotide sequences of FLJ22169 BINDING SITE, designated SEQ ID:23526, to the nucleotide sequence of VGAM2646 RNA, herein designated VGAM RNA, also designated SEQ ID:5357.

Another function of VGAM2646 is therefore inhibition of FLJ22169 (Accession NM_024085). Accordingly, utilities of VGAM2646 include diagnosis, prevention and treatment of diseases and clinical conditions associated with FLJ22169. KIAA0561 (Accession XM_038150) is another VGAM2646 host target gene. KIAA0561 BINDING SITE is HOST TARGET binding site found in the 3' untranslated region of mRNA encoded by KIAA0561, corresponding to a HOST TARGET binding site such as BINDING SITE I, BINDING SITE II or BINDING SITE III. Table 2 illustrates the complementarity of the nucleotide sequences of KIAA0561 BINDING SITE, designated SEQ ID:32768, to the nucleotide sequence of VGAM2646 RNA, herein designated VGAM RNA, also designated SEQ ID:5357.

Another function of VGAM2646 is therefore inhibition of KIAA0561 (Accession XM_038150). Accordingly, utilities of VGAM2646 include diagnosis, prevention and treatment of diseases and clinical conditions associated with KIAA0561. KIAA0779 (Accession XM_098229) is another VGAM2646 host target gene. KIAA0779 BINDING SITE is HOST TARGET binding site found in the 3' untranslated region of mRNA encoded by KIAA0779, corresponding to a HOST TARGET binding site such as BINDING SITE I, BINDING SITE II or BINDING SITE III. Table 2 illustrates the complementarity of the nucleotide sequences of KIAA0779 BINDING SITE, designated SEQ ID:41502, to the nucleotide sequence of VGAM2646 RNA, herein designated VGAM RNA, also designated SEQ ID:5357.

Another function of VGAM2646 is therefore inhibition of KIAA0779 (Accession XM_098229). Accordingly, utilities of VGAM2646 include diagnosis, prevention and treatment of diseases and clinical conditions associated with KIAA0779. KIAA1396 (Accession XM_032054) is another VGAM2646 host target gene. KIAA1396 BINDING SITE is HOST TARGET binding site found in the 3' untranslated region of mRNA encoded by KIAA1396, corresponding to a HOST TARGET binding site such as BINDING SITE I, BINDING SITE II or BINDING SITE III. Table 2 illustrates the complementarity of the nucleotide sequences of KIAA1396 BINDING SITE, designated SEQ ID:31544, to the nucleotide sequence of VGAM2646 RNA, herein designated VGAM RNA, also designated SEQ ID:5357.

Another function of VGAM2646 is therefore inhibition of KIAA1396 (Accession XM_032054). Accordingly, utilities of VGAM2646 include diagnosis, prevention and treatment of diseases and clinical conditions associated with KIAA1396. KIAA1553 (Accession XM_166320) is another VGAM2646 host target gene. KIAA1553 BINDING SITE is HOST TARGET binding site found in the 3' untranslated region of mRNA encoded by KIAA1553, corresponding to a HOST TARGET binding site such as BINDING SITE I, BINDING SITE II or BINDING SITE III. Table 2 illustrates the complementarity of the nucleotide sequences of KIAA1553 BINDING SITE, designated SEQ ID:44140, to the nucleotide sequence of VGAM2646 RNA, herein designated VGAM RNA, also designated SEQ ID:5357.

Another function of VGAM2646 is therefore inhibition of KIAA1553 (Accession XM_166320). Accordingly, utilities of VGAM2646 include diagnosis, prevention and treatment of diseases and clinical conditions associated with KIAA1553. KIAA1602 (Accession XM_035497) is another VGAM2646 host target gene. KIAA1602 BINDING SITE is HOST TARGET binding site found in the 3' untranslated region of mRNA encoded by KIAA1602, corresponding to a HOST TARGET binding site such as BINDING SITE I, BINDING SITE II or BINDING SITE III. Table 2 illustrates the complementarity of the nucleotide sequences of KIAA1602 BINDING SITE, designated SEQ ID:32276, to the nucleotide sequence of VGAM2646 RNA, herein designated VGAM RNA, also designated SEQ ID:5357.

Another function of VGAM2646 is therefore inhibition of KIAA1602 (Accession XM_035497). Accordingly, utilities of VGAM2646 include diagnosis, prevention and treatment of diseases and clinical conditions associated with KIAA1602. LIM and SH3 Protein 1 (LASP1, Accession NM_006148) is another VGAM2646 host target gene. LASP1 BINDING SITE is HOST TARGET binding site found in the 3' untranslated region of mRNA encoded by LASP1, corresponding to a HOST TARGET binding site such as BINDING SITE I, BINDING SITE II or BINDING SITE III. Table 2 illustrates the complementarity of the nucleotide sequences of LASP1 BINDING SITE, designated SEQ ID:12805, to the nucleotide sequence of VGAM2646 RNA, herein designated VGAM RNA, also designated SEQ ID:5357.

Another function of VGAM2646 is therefore inhibition of LIM and SH3 Protein 1 (LASP1, Accession NM_006148). Accordingly, utilities of VGAM2646 include diagnosis, prevention and treatment of diseases and clinical conditions associated with LASP1. Mitogen-activated Protein Kinase 8 Interacting Protein 3 (MAPK8IP3, Accession NM_033392) is another VGAM2646 host target gene. MAPK8IP3 BINDING SITE is HOST TARGET binding site found in the 3' untranslated region of mRNA encoded by MAPK8IP3, corresponding to a HOST TARGET binding site such as BINDING SITE I, BINDING SITE II or BINDING SITE III. Table 2 illustrates the complementarity of the nucleotide sequences of MAPK8IP3 BINDING SITE, designated SEQ ID:27217, to the nucleotide sequence of VGAM2646 RNA, herein designated VGAM RNA, also designated SEQ ID:5357.

Another function of VGAM2646 is therefore inhibition of Mitogen-activated Protein Kinase 8 Interacting Protein 3 (MAPK8IP3, Accession NM_033392). Accordingly, utilities of VGAM2646 include diagnosis, prevention and treatment of diseases and clinical conditions associated with MAPK8IP3. Nudix (nucleoside diphosphate linked moiety X)-type Motif 12 (NUDT12, Accession NM_031438) is another VGAM2646 host target gene. NUDT12 BINDING SITE is HOST TARGET binding site found in the 3' untranslated region of mRNA encoded by NUDT12, corresponding to a HOST TARGET binding site such as BINDING SITE I, BINDING SITE II or BINDING SITE III. Table 2 illustrates the complementarity of the nucleotide sequences of NUDT12 BINDING SITE, designated SEQ ID:25446, to the nucleotide sequence of VGAM2646 RNA, herein designated VGAM RNA, also designated SEQ ID:5357.

Another function of VGAM2646 is therefore inhibition of Nudix (nucleoside diphosphate linked moiety X)-type Motif 12 (NUDT12, Accession NM_031438). Accordingly, utilities of VGAM2646 include diagnosis, prevention and treatment of diseases and clinical conditions associated with NUDT12. Paired Mesoderm Homeobox 2b (PMX2B, Accession NM_003924) is another VGAM2646 host target gene. PMX2B BINDING SITE is HOST TARGET binding site found in the 3' untranslated region of mRNA encoded by PMX2B, corresponding to a HOST TARGET binding site such as BINDING SITE I, BINDING SITE II or BINDING SITE III. Table 2 illustrates the complementarity of the nucleotide sequences of PMX2B BINDING SITE, designated SEQ ID:10014, to the nucleotide sequence of VGAM2646 RNA, herein designated VGAM RNA, also designated SEQ ID:5357.

Another function of VGAM2646 is therefore inhibition of Paired Mesoderm Homeobox 2b (PMX2B, Accession NM_003924). Accordingly, utilities of VGAM2646 include diagnosis, prevention and treatment of diseases and clinical conditions associated with PMX2B. PRO2389 (Accession XM_033334) is another VGAM2646 host target gene. PRO2389 BINDING SITE is HOST TARGET binding site found in the 3' untranslated region of mRNA encoded by PRO2389, corresponding to a HOST TARGET binding site such as BINDING SITE I, BINDING SITE II or BINDING SITE III. Table 2 illustrates the complementarity of the nucleotide sequences of PRO2389 BINDING SITE, designated SEQ ID:31879, to the nucleotide sequence of VGAM2646 RNA, herein designated VGAM RNA, also designated SEQ ID:5357.

Another function of VGAM2646 is therefore inhibition of PRO2389 (Accession XM_033334). Accordingly, utilities of VGAM2646 include diagnosis, prevention and treatment of diseases and clinical conditions associated with PRO2389. SIMRP7 (Accession XM_166462) is another VGAM2646 host target gene. SIMRP7 BINDING SITE is HOST TARGET binding site found in the 3' untranslated region of mRNA encoded by SIMRP7, corresponding to a HOST TARGET binding site such as BINDING SITE I, BINDING SITE II or BINDING SITE III. Table 2 illustrates the complementarity of the nucleotide sequences of SIMRP7 BINDING SITE, designated SEQ ID:44369, to the nucleotide sequence of VGAM2646 RNA, herein designated VGAM RNA, also designated SEQ ID:5357.

Another function of VGAM2646 is therefore inhibition of SIMRP7 (Accession XM_166462). Accordingly, utilities of VGAM2646 include diagnosis, prevention and treatment of diseases and clinical conditions associated with SIMRP7. TCF-3 (Accession NM_031283) is another VGAM2646 host target gene. TCF-3 BINDING SITE is HOST TARGET binding site found in the 3' untranslated region of mRNA encoded by TCF-3, corresponding to a HOST TARGET binding site such as BINDING SITE I, BINDING SITE II or BINDING SITE III. Table 2 illustrates the complementarity of the nucleotide sequences of TCF-3 BINDING SITE, designated SEQ ID:25307, to the nucleotide sequence of VGAM2646 RNA, herein designated VGAM RNA, also designated SEQ ID:5357.

Another function of VGAM2646 is therefore inhibition of TCF-3 (Accession NM_031283). Accordingly, utilities of VGAM2646 include diagnosis, prevention and treatment of diseases and clinical conditions associated with TCF-3.

TUBB5 (Accession NM_006087) is another VGAM2646 host target gene. TUBB5 BINDING SITE is HOST TARGET binding site found in the 3' untranslated region of mRNA encoded by TUBB5, corresponding to a HOST TARGET binding site such as BINDING SITE I, BINDING SITE II or BINDING SITE III. Table 2 illustrates the complementarity of the nucleotide sequences of TUBB5 BINDING SITE, designated SEQ ID:12732, to the nucleotide sequence of VGAM2646 RNA, herein designated VGAM RNA, also designated SEQ ID:5357.

Another function of VGAM2646 is therefore inhibition of TUBB5 (Accession NM_006087). Accordingly, utilities of VGAM2646 include diagnosis, prevention and treatment of diseases and clinical conditions associated with TUBB5. Zinc Finger Protein 31 (KOX 29) (ZNF31, Accession XM_036305) is another VGAM2646 host target gene. ZNF31 BINDING SITE is HOST TARGET binding site found in the 3' untranslated region of mRNA encoded by ZNF31, corresponding to a HOST TARGET binding site such as BINDING SITE I, BINDING SITE II or BINDING SITE III. Table 2 illustrates the complementarity of the nucleotide sequences of ZNF31 BINDING SITE, designated SEQ ID:32421, to the nucleotide sequence of VGAM2646 RNA, herein designated VGAM RNA, also designated SEQ ID:5357.

Another function of VGAM2646 is therefore inhibition of Zinc Finger Protein 31 (KOX 29) (ZNF31, Accession XM_036305). Accordingly, utilities of VGAM2646 include diagnosis and prevention and treatment of diseases and clinical conditions associated with ZNF31. Zinc Finger Protein 317 (ZNF317, Accession XM_050435) is another VGAM2646 host target gene. ZNF317 BINDING SITE is HOST TARGET binding site found in the 3' untranslated region of mRNA encoded by ZNF317, corresponding to a HOST TARGET binding site such as BINDING SITE I, BINDING SITE II or BINDING SITE III. Table 2 illustrates the complementarity of the nucleotide sequences of ZNF317 BINDING SITE, designated SEQ ID:35634, to the nucleotide sequence of VGAM2646 RNA, herein designated VGAM RNA, also designated SEQ ID:5357.

Another function of VGAM2646 is therefore inhibition of Zinc Finger Protein 317 (ZNF317, Accession XM_050435). Accordingly, utilities of VGAM2646 include diagnosis, prevention and treatment of diseases and clinical conditions associated with ZNF317. LOC130644 (Accession XM_065813) is another VGAM2646 host target gene. LOC130644 BINDING SITE is HOST TARGET binding site found in the 3' untranslated region of mRNA encoded by LOC130644, corresponding to a HOST TARGET binding site such as BINDING SITE I, BINDING SITE II or BINDING SITE III. Table 2 illustrates the complementarity of the nucleotide sequences of LOC130644 BINDING SITE, designated SEQ ID:37302, to the nucleotide sequence of VGAM2646 RNA, herein designated VGAM RNA, also designated SEQ ID:5357.

Another function of VGAM2646 is therefore inhibition of LOC130644 (Accession XM_065813). Accordingly, utilities of VGAM2646 include diagnosis, prevention and treatment of diseases and clinical conditions associated with LOC130644. LOC149650 (Accession XM_086623) is another VGAM2646 host target gene. LOC149650 BINDING SITE is HOST TARGET binding site found in the 3' untranslated region of mRNA encoded by LOC149650, corresponding to a HOST TARGET binding site such as BINDING SITE I, BINDING SITE II or BINDING SITE III. Table 2 illustrates the complementarity of the nucleotide sequences of LOC149650 BINDING SITE, designated SEQ ID:38798, to the nucleotide sequence of VGAM2646 RNA, herein designated VGAM RNA, also designated SEQ ID:5357.

Another function of VGAM2646 is therefore inhibition of LOC149650 (Accession XM_086623). Accordingly, utilities of VGAM2646 include diagnosis, prevention and treatment of diseases and clinical conditions associated with LOC149650. LOC150776 (Accession XM_032542) is another VGAM2646 host target gene. LOC150776 BINDING SITE is HOST TARGET binding site found in the 3' untranslated region of mRNA encoded by LOC150776, corresponding to a HOST TARGET binding site such as BINDING SITE I, BINDING SITE II or BINDING SITE III. Table 2 illustrates the complementarity of the nucleotide sequences of LOC150776 BINDING SITE, designated SEQ ID:31674, to the nucleotide sequence of VGAM2646 RNA, herein designated VGAM RNA, also designated SEQ ID:5357.

Another function of VGAM2646 is therefore inhibition of LOC150776 (Accession XM_032542). Accordingly, utilities of VGAM2646 include diagnosis, prevention and treatment of diseases and clinical conditions associated with LOC150776. LOC256158 (Accession XM_175125) is another VGAM2646 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46630, to the nucleotide sequence of VGAM2646 RNA, herein designated VGAM RNA, also designated SEQ ID:5357.

Another function of VGAM2646 is therefore inhibition of LOC256158 (Accession XM_175125). Accordingly, utilities of VGAM2646 include diagnosis, prevention and treatment of diseases and clinical conditions associated with LOC256158. LOC90841 (Accession XM_034427) is another VGAM2646 host target gene. LOC90841 BINDING SITE is HOST TARGET binding site found in the 3' untranslated region of mRNA encoded by LOC90841, corresponding to a HOST TARGET binding site such as BINDING SITE I, BINDING SITE II or BINDING SITE III. Table 2 illustrates the complementarity of the nucleotide sequences of LOC90841 BINDING SITE, designated SEQ ID:32112, to the nucleotide sequence of VGAM2646 RNA, herein designated VGAM RNA, also designated SEQ ID:5357.

Another function of VGAM2646 is therefore inhibition of LOC90841 (Accession XM_034427). Accordingly, utilities of VGAM2646 include diagnosis, prevention and treatment of diseases and clinical conditions associated with LOC90841. LOC92609 (Accession XM_053074) is another VGAM2646 host target gene. LOC92609 BINDING SITE is HOST TARGET binding site found in the 3' untranslated region of mRNA encoded by LOC92609, corresponding to a HOST TARGET binding site such as BINDING SITE I, BINDING SITE II or BINDING SITE III. Table 2 illustrates the complementarity of the nucleotide sequences of LOC92609 BINDING SITE, designated SEQ ID:36060, to the nucleotide sequence of VGAM2646 RNA, herein designated VGAM RNA, also designated SEQ ID:5357.

Another function of VGAM2646 is therefore inhibition of LOC92609 (Accession XM_053074). Accordingly, utilities of VGAM2646 include diagnosis, prevention and treatment of diseases and clinical conditions associated with LOC92609. FIG. 1 further provides a conceptual description of a novel bioinformatically detected viral gene of the present invention, referred to here as Viral Genomic Address Messenger 2647 (VGAM2647) viral gene, which modulates expression of respective host target genes thereof, the function and utility of which host target genes is known in the art.

VGAM2647 is a novel bioinformatically detected regulatory, non protein coding, viral micro RNA (miRNA) gene. The method by which VGAM2647 was detected is described hereinabove with reference to FIGS. 1-8.

VGAM2647 gene, herein designated VGAM GENE, is a viral gene contained in the genome of Cowpea Aphid-borne Mosaic Virus. VGAM2647 host target gene, herein designated VGAM HOST TARGET GENE, is a human gene contained in the human genome.

VGAM2647 gene encodes a VGAM2647 precursor RNA, herein designated VGAM PRECURSOR RNA. Similar to other miRNA genes, and unlike most ordinary genes, VGAM2647 precursor RNA does not encode a protein. A nucleotide sequence identical or highly similar to the nucleotide sequence of VGAM2647 precursor RNA is designated SEQ ID:2633, and is provided hereinbelow with reference to the sequence listing part. Nucleotide sequence SEQ ID:2633 is located at position 7881 relative to the genome of Cowpea Aphid-borne Mosaic Virus.

VGAM2647 precursor RNA folds onto itself, forming VGAM2647 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2647 folded precursor RNA into VGAM2647 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM2647 RNA is designated SEQ ID:5358, and is provided hereinbelow with reference to the sequence listing part.

VGAM2647 host target gene, herein designated VGAM HOST TARGET GENE, encodes a corresponding messenger RNA, VGAM2647 host target RNA, herein designated VGAM HOST TARGET RNA. VGAM2647 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2647 RNA, herein designated VGAM RNA, binds complementarily to one or more host target binding sites located in untranslated regions of VGAM2647 host target RNA, herein designated VGAM HOST TARGET RNA. This complementary binding is due to the fact that the nucleotide sequence of VGAM2647 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2647 RNA, herein designated VGAM RNA, may have a different number of host target binding sites in untranslated regions of a VGAM2647 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2647 RNA, herein designated VGAM RNA, to host target binding sites on VGAM2647 host target RNA, herein designated VGAM HOST TARGET RNA, such as BINDING SITE I, BINDING SITE II and BINDING SITE III, inhibits translation of VGAM2647 host target RNA into VGAM2647 host target protein, herein designated VGAM HOST TARGET PROTEIN. VGAM host target protein is therefore outlined by a broken line.

It is appreciated that VGAM2647 host target gene, herein designated VGAM HOST TARGET GENE, in fact represents a plurality of VGAM2647 host target genes. The mRNA of each one of this plurality of VGAM2647 host target genes comprises one or more host target binding sites, each having a nucleotide sequence which is at least partly complementary to VGAM2647 RNA, herein designated VGAM RNA, and which when bound by VGAM2647 RNA causes inhibition of translation of respective one or more VGAM2647 host target proteins.

It is further appreciated by one skilled in the art that the mode of translational inhibition illustrated by FIG. 1 with specific reference to translational inhibition exerted by VGAM2647 gene, herein designated VGAM GENE, on one or more VGAM2647 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2647 is inhibition of expression of host target genes, as part of a novel viral mechanism of attacking a host. Accordingly, utilities of VGAM2647 include diagnosis, prevention and treatment of viral infection by Cowpea Aphid-borne Mosaic Virus. Specific functions, and accordingly utilities, of VGAM2647 correlate with, and may be deduced from, the identity of the host target genes which VGAM2647 binds and inhibits, and the function of these host target genes, as elaborated hereinbelow.

Nucleotide sequences of the VGAM2647 precursor RNA, herein designated VGAM PRECURSOR RNA, and of the 'diced' VGAM2647 RNA, herein designated VGAM RNA, and a schematic representation of the secondary folding of VGAM2647 folded precursor RNA, herein designated VGAM FOLDED PRECURSOR RNA, of VGAM2647 are further described hereinbelow with reference to Table 1.

Nucleotide sequences of host target binding sites, such as BINDING SITE-I, BINDING SITE-II and BINDING SITE-III of FIG. 1, found on VGAM2647 host target RNA, and schematic representation of the complementarity of each of these host target binding sites to VGAM2647 RNA, herein designated VGAM RNA, are described hereinbelow with reference to Table 2.

As mentioned hereinabove with reference to FIG. 1, a function of VGAM2647 gene, herein designated VGAM is inhibition of expression of VGAM2647 target genes. It is appreciated that specific functions, and accordingly utilities, of VGAM2647 correlate with, and may be deduced from, the identity of the target genes which VGAM2647 binds and inhibits, and the function of these target genes, as elaborated hereinbelow.

Nebulin-related Anchoring Protein (NRAP, Accession NM_006175) is a VGAM2647 host target gene. NRAP BINDING SITE is HOST TARGET binding site found in the 3' untranslated region of mRNA encoded by NRAP, corresponding to a HOST TARGET binding site such as BINDING SITE I, BINDING SITE II or BINDING SITE III. Table 2 illustrates the complementarity of the nucleotide sequences of NRAP BINDING SITE, designated SEQ ID:12832, to the nucleotide sequence of VGAM2647 RNA, herein designated VGAM RNA, also designated SEQ ID:5358.

A function of VGAM2647 is therefore inhibition of Nebulin-related Anchoring Protein (NRAP, Accession NM_006175), a gene which performs an anchoring function to link the terminal actin filaments of myofibrils to protein complexes located beneath the sarcolemma. Accordingly, utilities of VGAM2647 include diagnosis, prevention and treatment of diseases and clinical conditions associated with NRAP. The function of NRAP and its association with various diseases and clinical conditions, has been established by previous studies, as described hereinabove with reference to VGAM649. LOC115294 (Accession XM_054302) is another VGAM2647 host target gene. LOC115294 BINDING SITE is HOST TARGET binding site found in the 3' untranslated region of mRNA encoded by LOC115294, corresponding to a HOST TARGET binding site such as BINDING SITE I, BINDING SITE II or BINDING SITE III. Table 2 illustrates the complementarity of the nucleotide sequences of LOC115294 BINDING SITE, designated SEQ ID:36144, to the nucleotide sequence of VGAM2647 RNA, herein designated VGAM RNA, also designated SEQ ID:5358.

Another function of VGAM2647 is therefore inhibition of LOC115294 (Accession XM_054302). Accordingly, utilities of VGAM2647 include diagnosis, prevention and treatment of diseases and clinical conditions associated with LOC115294. FIG. 1 further provides a conceptual description of a novel bioinformatically detected viral gene of the present invention, referred to here as Viral Genomic Address Messenger 2648 (VGAM2648) viral gene, which modulates expression of respective host target genes thereof, the function and utility of which host target genes is known in the art.

VGAM2648 is a novel bioinformatically detected regulatory, non protein coding, viral micro RNA (miRNA) gene. The method by which VGAM2648 was detected is described hereinabove with reference to FIGS. 1-8.

VGAM2648 gene, herein designated VGAM GENE, is a viral gene contained in the genome of Cowpea Aphid-borne Mosaic Virus. VGAM2648 host target gene, herein designated VGAM HOST TARGET GENE, is a human gene contained in the human genome.

VGAM2648 gene encodes a VGAM2648 precursor RNA, herein designated VGAM PRECURSOR RNA. Similar to other miRNA genes, and unlike most ordinary genes, VGAM2648 precursor RNA does not encode a protein. A nucleotide sequence identical or highly similar to the nucleotide sequence of VGAM2648 precursor RNA is designated SEQ ID:2634, and is provided hereinbelow with reference to the sequence listing part. Nucleotide sequence SEQ ID:2634 is located at position 7656 relative to the genome of Cowpea Aphid-borne Mosaic Virus.

VGAM2648 precursor RNA folds onto itself, forming VGAM2648 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2648 folded precursor RNA into VGAM2648 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2648 RNA is designated SEQ ID:5359, and is provided hereinbelow with reference to the sequence listing part.

VGAM2648 host target gene, herein designated VGAM HOST TARGET GENE, encodes a corresponding messenger RNA, VGAM2648 host target RNA, herein designated VGAM HOST TARGET RNA. VGAM2648 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2648 RNA, herein designated VGAM RNA, binds complementarily to one or more host target binding sites located in untranslated regions of VGAM2648 host target RNA, herein designated VGAM HOST TARGET RNA. This complementary binding is due to the fact that the nucleotide sequence of VGAM2648 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2648 RNA, herein designated VGAM RNA, may have a different number of host target binding sites in untranslated regions of a VGAM2648 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2648 RNA, herein designated VGAM RNA, to host target binding sites on VGAM2648 host target RNA, herein designated VGAM HOST TARGET RNA, such as BINDING SITE I, BINDING SITE II and BINDING SITE III, inhibits translation of VGAM2648 host target RNA into VGAM2648 host target protein, herein designated VGAM HOST TARGET PROTEIN. VGAM host target protein is therefore outlined by a broken line.

It is appreciated that VGAM2648 host target gene, herein designated VGAM HOST TARGET GENE, in fact represents a plurality of VGAM2648 host target genes. The mRNA of each one of this plurality of VGAM2648 host target genes comprises one or more host target binding sites, each having a nucleotide sequence which is at least partly complementary to VGAM2648 RNA, herein designated VGAM RNA, and which when bound by VGAM2648 RNA causes inhibition of translation of respective one or more VGAM2648 host target proteins.

It is further appreciated by one skilled in the art that the mode of translational inhibition illustrated by FIG. 1 with specific reference to translational inhibition exerted by VGAM2648 gene, herein designated VGAM GENE, on one or more VGAM2648 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2648 is inhibition of expression of host target genes, as part of a novel viral mechanism of attacking a host. Accordingly, utilities of VGAM2648 include diagnosis, prevention and treatment of viral infection by Cowpea Aphid-borne Mosaic Virus. Specific functions, and accordingly utilities, of VGAM2648 correlate with, and may be deduced from, the identity of the host target genes which VGAM2648 binds and inhibits, and the function of these host target genes, as elaborated hereinbelow.

Nucleotide sequences of the VGAM2648 precursor RNA, herein designated VGAM PRECURSOR RNA, and of the 'diced' VGAM2648 RNA, herein designated VGAM RNA, and a schematic representation of the secondary folding of VGAM2648 folded precursor RNA, herein designated VGAM FOLDED PRECURSOR RNA, of VGAM2648 are further described hereinbelow with reference to Table 1.

Nucleotide sequences of host target binding sites, such as BINDING SITE-I, BINDING SITE-II and BINDING SITE-III of FIG. 1, found on VGAM2648 host target RNA, and schematic representation of the complementarity of each of these host target binding sites to VGAM2648 RNA, herein designated VGAM RNA, are described hereinbelow with reference to Table 2.

As mentioned hereinabove with reference to FIG. 1, a function of VGAM2648 gene, herein designated VGAM is inhibition of expression of VGAM2648 target genes. It is appreciated that specific functions, and accordingly utilities, of VGAM2648 correlate with, and may be deduced from, the identity of the target genes which VGAM2648 binds and inhibits, and the function of these target genes, as elaborated hereinbelow.

Prominin-like 1 (mouse) (PROML1, Accession NM_006017) is a VGAM2648 host target gene. PROML1 BINDING SITE is HOST TARGET binding site found in the 3' untranslated region of mRNA encoded by PROML1, corresponding to a HOST TARGET binding site such as BINDING SITE I, BINDING SITE II or BINDING SITE III. Table 2 illustrates the complementarity of the nucleotide sequences of PROML1 BINDING SITE, designated SEQ ID:12633, to the nucleotide sequence of VGAM2648 RNA, herein designated VGAM RNA, also designated SEQ ID:5359.

A function of VGAM2648 is therefore inhibition of Prominin-like 1 (mouse) (PROML1, Accession NM_006017), a gene which is a Transmembrane protein. Accordingly, utilities of VGAM2648 include diagnosis, prevention and treatment of diseases and clinical conditions associated with PROML1. The function of PROML1 and its association with various diseases and clinical conditions, has been established by previous studies, as described hereinabove with reference to VGAM905. FLJ13052 (Accession NM_023018) is another VGAM2648 host target gene. FLJ13052 BINDING SITE is HOST TARGET binding site found in the 3' untranslated region of mRNA encoded by FLJ13052, corresponding to a HOST TARGET binding site such as BINDING SITE I, BINDING SITE II or BINDING SITE III. Table 2 illustrates the complementarity of the nucleotide sequences of FLJ13052 BINDING SITE, designated SEQ ID:23282, to the nucleotide sequence of VGAM2648 RNA, herein designated VGAM RNA, also designated SEQ ID:5359.

Another function of VGAM2648 is therefore inhibition of FLJ13052 (Accession NM_023018). Accordingly, utilities of VGAM2648 include diagnosis, prevention and treatment of diseases and clinical conditions associated with FLJ13052. HSPC063 (Accession NM_014155) is another VGAM2648 host target gene. HSPC063 BINDING SITE is HOST TARGET binding site found in the 5' untranslated region of mRNA encoded by HSPC063, corresponding to a HOST TARGET binding site such as BINDING SITE I, BINDING SITE II or BINDING SITE III. Table 2 illustrates the complementarity of the nucleotide sequences of HSPC063 BINDING SITE, designated SEQ ID:15439, to the nucleotide sequence of VGAM2648 RNA, herein designated VGAM RNA, also designated SEQ ID:5359.

Another function of VGAM2648 is therefore inhibition of HSPC063 (Accession NM_014155). Accordingly, utilities of VGAM2648 include diagnosis, prevention and treatment of diseases and clinical conditions associated with HSPC063. Proteasome (prosome, macropain) 26S Subunit, Non-ATPase, 12 (PSMD12, Accession NM_002816) is another VGAM2648 host target gene. PSMD12 BINDING SITE is HOST TARGET binding site found in the 3' untranslated region of mRNA encoded by PSMD12, corresponding to a HOST TARGET binding site such as BINDING SITE I, BINDING SITE II or BINDING SITE III. Table 2 illustrates the complementarity of the nucleotide sequences of PSMD12 BINDING SITE, designated SEQ ID:8683, to the nucleotide sequence of VGAM2648 RNA, herein designated VGAM RNA, also designated SEQ ID:5359.

Another function of VGAM2648 is therefore inhibition of Proteasome (prosome, macropain) 26S Subunit, Non-ATPase, 12 (PSMD12, Accession NM_002816). Accordingly, utilities of VGAM2648 include diagnosis, prevention and treatment of diseases and clinical conditions associated with PSMD12. LOC158055 (Accession XM_088453) is another VGAM2648 host target gene. LOC158055 BINDING SITE is HOST TARGET binding site found in the 3' untranslated region of mRNA encoded by LOC158055, corresponding to a HOST TARGET binding site such as BINDING SITE I, BINDING SITE II or BINDING SITE III. Table 2 illustrates the complementarity of the nucleotide sequences of LOC158055 BINDING SITE, designated SEQ ID:39702, to the nucleotide sequence of VGAM2648 RNA, herein designated VGAM RNA, also designated SEQ ID:5359.

Another function of VGAM2648 is therefore inhibition of LOC158055 (Accession XM_088453). Accordingly, utilities of VGAM2648 include diagnosis, prevention and treatment of diseases and clinical conditions associated with LOC158055. FIG. 1 further provides a conceptual description of a novel bioinformatically detected viral gene of the present invention, referred to here as Viral Genomic Address Messenger 2649 (VGAM2649) viral gene, which modulates expression of respective host target genes thereof, the function and utility of which host target genes is known in the art.

VGAM2649 is a novel bioinformatically detected regulatory, non protein coding, viral micro RNA (miRNA) gene. The method by which VGAM2649 was detected is described hereinabove with reference to FIGS. 1-8.

VGAM2649 gene, herein designated VGAM GENE, is a viral gene contained in the genome of Cowpea Aphid-borne Mosaic Virus. VGAM2649 host target gene, herein designated VGAM HOST TARGET GENE, is a human gene contained in the human genome.

VGAM2649 gene encodes a VGAM2649 precursor RNA, herein designated VGAM PRECURSOR RNA. Similar to other miRNA genes, and unlike most ordinary genes, VGAM2649 precursor RNA does not encode a protein. A nucleotide sequence identical or highly similar to the nucleotide sequence of VGAM2649 precursor RNA is designated SEQ ID:2635, and is provided hereinbelow with reference to the sequence listing part. Nucleotide sequence SEQ ID:2635 is located at position 2803 relative to the genome of Cowpea Aphid-borne Mosaic Virus.

VGAM2649 precursor RNA folds onto itself, forming VGAM2649 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2649 folded precursor RNA into VGAM2649 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2649 RNA is designated SEQ ID:5360, and is provided hereinbelow with reference to the sequence listing part.

VGAM2649 host target gene, herein designated VGAM HOST TARGET GENE, encodes a corresponding messenger RNA, VGAM2649 host target RNA, herein designated VGAM HOST TARGET RNA. VGAM2649 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2649 RNA, herein designated VGAM RNA, binds complementarily to one or more host target binding sites located in untranslated regions of VGAM2649 host target RNA, herein designated VGAM HOST TARGET RNA. This complementary binding is due to the fact that the nucleotide sequence of VGAM2649 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2649 RNA, herein designated VGAM RNA, may have a different number of host target binding sites in untranslated regions of a VGAM2649 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2649 RNA, herein designated VGAM RNA, to host target binding sites on VGAM2649 host target RNA, herein designated VGAM HOST TARGET RNA, such as BINDING SITE I, BINDING SITE II and BINDING SITE III, inhibits translation of VGAM2649 host target RNA into VGAM2649 host target protein, herein designated VGAM HOST TARGET PROTEIN. VGAM host target protein is therefore outlined by a broken line.

It is appreciated that VGAM2649 host target gene, herein designated VGAM HOST TARGET GENE, in fact represents a plurality of VGAM2649 host target genes. The mRNA of each one of this plurality of VGAM2649 host target genes comprises one or more host target binding sites, each having a nucleotide sequence which is at least partly complementary to VGAM2649 RNA, herein designated VGAM RNA, and which when bound by VGAM2649 RNA causes inhibition of translation of respective one or more VGAM2649 host target proteins.

It is further appreciated by one skilled in the art that the mode of translational inhibition illustrated by FIG. 1 with specific reference to translational inhibition exerted by VGAM2649 gene, herein designated VGAM GENE, on one or more VGAM2649 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2649 is inhibition of expression of host target genes, as part of a novel viral mechanism of attacking a host. Accordingly, utilities of VGAM2649 include diagnosis, prevention and treatment of viral infection by Cowpea Aphid-borne Mosaic Virus. Specific functions, and accordingly utilities, of VGAM2649 correlate with, and may be deduced from, the identity of the host target genes which VGAM2649 binds and inhibits, and the function of these host target genes, as elaborated hereinbelow.

Nucleotide sequences of the VGAM2649 precursor RNA, herein designated VGAM PRECURSOR RNA, and of the 'diced' VGAM2649 RNA, herein designated VGAM RNA, and a schematic representation of the secondary folding of VGAM2649 folded precursor RNA, herein designated VGAM FOLDED PRECURSOR RNA, of VGAM2649 are further described hereinbelow with reference to Table 1.

Nucleotide sequences of host target binding sites, such as BINDING SITE-I, BINDING SITE-II and BINDING SITE-III of FIG. 1, found on VGAM2649 host target RNA, and schematic representation of the complementarity of each of these host target binding sites to VGAM2649 RNA, herein designated VGAM RNA, are described hereinbelow with reference to Table 2.

As mentioned hereinabove with reference to FIG. 1, a function of VGAM2649 gene, herein designated VGAM is inhibition of expression of VGAM2649 target genes. It is appreciated that specific functions, and accordingly utilities, of VGAM2649 correlate with, and may be deduced from, the identity of the target genes which VGAM2649 binds and inhibits, and the function of these target genes, as elaborated hereinbelow.

Protein Kinase C, Beta 1 (PRKCB1, Accession XM_047187) is a VGAM2649 host target gene. PRKCB1 BINDING SITE is HOST TARGET binding site found in the 3' untranslated region of mRNA encoded by PRKCB1, corresponding to a HOST TARGET binding site such as BINDING SITE I, BINDING SITE II or BINDING SITE III. Table 2 illustrates the complementarity of the nucleotide sequences of PRKCB1 BINDING SITE, designated SEQ ID:34902, to the nucleotide sequence of VGAM2649 RNA, herein designated VGAM RNA, also designated SEQ ID:5360.

A function of VGAM2649 is therefore inhibition of Protein Kinase C, Beta 1 (PRKCB1, Accession XM_047187), a gene which is a calcium-activated, phospholipid-dependent, serine- and threonine-specific enzyme. Accordingly, utilities of VGAM2649 include diagnosis, prevention and treatment of diseases and clinical conditions associated with PRKCB1. The function of PRKCB1 and its association with various diseases and clinical conditions, has been established by previous studies, as described hereinabove with reference to VGAM2065. Solute Carrier Family 16 (monocarboxylic acid transporters), Member 2 (putative transporter) (SLC16A2, Accession NM_006517) is another VGAM2649 host target gene. SLC16A2 BINDING SITE is HOST TARGET binding site found in the 3' untranslated region of mRNA encoded by SLC16A2, corresponding to a HOST TARGET binding site such as BINDING SITE I, BINDING SITE II or BINDING SITE III. Table 2 illustrates the complementarity of the nucleotide sequences of SLC16A2 BINDING SITE, designated SEQ ID:13273, to the nucleotide sequence of VGAM2649 RNA, herein designated VGAM RNA, also designated SEQ ID:5360.

Another function of VGAM2649 is therefore inhibition of Solute Carrier Family 16 (monocarboxylic acid transporters), Member 2 (putative transporter) (SLC16A2, Accession NM_006517). Accordingly, utilities of VGAM2649 include diagnosis, prevention and treatment of diseases and clinical conditions associated with SLC16A2. MGC4415 (Accession NM_031484) is another VGAM2649 host target gene. MGC4415 BINDING SITE is HOST TARGET binding site found in the 3' untranslated region of mRNA encoded by MGC4415, corresponding to a HOST TARGET binding site such as BINDING SITE I, BINDING SITE II or BINDING SITE III. Table 2 illustrates the complementarity of the nucleotide sequences of MGC4415 BINDING SITE, designated SEQ ID:25573, to the nucleotide sequence of VGAM2649 RNA, herein designated VGAM RNA, also designated SEQ ID:5360.

Another function of VGAM2649 is therefore inhibition of MGC4415 (Accession NM_031484). Accordingly, utilities of VGAM2649 include diagnosis, prevention and treatment of diseases and clinical conditions associated with MGC4415. LOC126669 (Accession XM_060121) is another VGAM2649 host target gene. LOC126669 BINDING SITE is HOST TARGET binding site found in the 3' untranslated region of mRNA encoded by LOC126669, corresponding to a HOST TARGET binding site such as BINDING SITE I, BINDING SITE II or BINDING SITE III. Table 2 illustrates the complementarity of the nucleotide sequences of LOC126669 BINDING SITE, designated SEQ ID:37161, to the nucleotide sequence of VGAM2649 RNA, herein designated VGAM RNA, also designated SEQ ID:5360.

Another function of VGAM2649 is therefore inhibition of LOC126669 (Accession XM_060121). Accordingly, utilities of VGAM2649 include diagnosis, prevention and treatment of diseases and clinical conditions associated with LOC126669. LOC195977 (Accession XM_113625) is another VGAM2649 host target gene. LOC195977 BINDING SITE is HOST TARGET binding site found in the 3' untranslated region of mRNA encoded by LOC195977, corresponding to a HOST TARGET binding site such as BINDING SITE I, BINDING SITE II or BINDING SITE III. Table 2 illustrates the complementarity of the nucleotide sequences of LOC195977 BINDING SITE, designated SEQ ID:42299, to the nucleotide sequence of VGAM2649 RNA, herein designated VGAM RNA, also designated SEQ ID:5360.

Another function of VGAM2649 is therefore inhibition of LOC195977 (Accession XM_113625). Accordingly, utilities of VGAM2649 include diagnosis, prevention and treatment of diseases and clinical conditions associated with LOC195977. LOC51026 (Accession NM_016072) is another VGAM2649 host target gene. LOC51026 BINDING SITE is HOST TARGET binding site found in the 3' untranslated region of mRNA encoded by LOC51026, corresponding to a HOST TARGET binding site such as BINDING SITE I, BINDING SITE II or BINDING SITE III. Table 2 illustrates the complementarity of the nucleotide sequences of LOC51026 BINDING SITE, designated SEQ ID:18143, to the nucleotide sequence of VGAM2649 RNA, herein designated VGAM RNA, also designated SEQ ID:5360.

Another function of VGAM2649 is therefore inhibition of LOC51026 (Accession NM_016072). Accordingly, utilities of VGAM2649 include diagnosis, prevention and treatment of diseases and clinical conditions associated with LOC51026. LOC91565 (Accession XM_039231) is another VGAM2649 host target gene. LOC91565 BINDING SITE is HOST TARGET binding site found in the 3' untranslated region of mRNA encoded by LOC91565, corresponding to a HOST TARGET binding site such as BINDING SITE I, BINDING SITE II or BINDING SITE III. Table 2 illustrates the complementarity of the nucleotide sequences of LOC91565 BINDING SITE, designated SEQ ID:33025, to the nucleotide sequence of VGAM2649 RNA, herein designated VGAM RNA, also designated SEQ ID:5360.

Another function of VGAM2649 is therefore inhibition of LOC91565 (Accession XM_039231). Accordingly, utilities of VGAM2649 include diagnosis, prevention and treatment of diseases and clinical conditions associated with LOC91565. FIG. 1 further provides a conceptual description of a novel bioinformatically detected viral gene of the present invention, referred to here as Viral Genomic Address Messenger 2650 (VGAM2650) viral gene, which modulates expression of respective host target genes thereof, the function and utility of which host target genes is known in the art.

VGAM2650 is a novel bioinformatically detected regulatory, non protein coding, viral micro RNA (miRNA) gene. The method by which VGAM2650 was detected is described hereinabove with reference to FIGS. 1-8.

VGAM2650 gene, herein designated VGAM GENE, is a viral gene contained in the genome of Trichomonas Vaginalis Virus 3. VGAM2650 host target gene, herein designated VGAM HOST TARGET GENE, is a human gene contained in the human genome.

VGAM2650 gene encodes a VGAM2650 precursor RNA, herein designated VGAM PRECURSOR RNA. Similar to other miRNA genes, and unlike most ordinary genes, VGAM2650 precursor RNA does not encode a protein. A nucleotide sequence identical or highly similar to the nucleotide sequence of VGAM2650 precursor RNA is designated SEQ ID:2636, and is provided hereinbelow with reference to the sequence listing part. Nucleotide sequence SEQ ID:2636 is located at position 2782 relative to the genome of Trichomonas Vaginalis Virus 3.

VGAM2650 precursor RNA folds onto itself, forming VGAM2650 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2650 folded precursor RNA into VGAM2650 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2650 RNA is designated SEQ ID:5361, and is provided hereinbelow with reference to the sequence listing part.

VGAM2650 host target gene, herein designated VGAM HOST TARGET GENE, encodes a corresponding messenger RNA, VGAM2650 host target RNA, herein designated VGAM HOST TARGET RNA. VGAM2650 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2650 RNA, herein designated VGAM RNA, binds complementarily to one or more host target binding sites located in untranslated regions of VGAM2650 host target RNA, herein designated VGAM HOST TARGET RNA. This complementary binding is due to the fact that the nucleotide sequence of VGAM2650 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2650 RNA, herein designated VGAM RNA, may have a different number of host target binding sites in untranslated regions of a VGAM2650 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2650 RNA, herein designated VGAM RNA, to host target binding sites on VGAM2650 host target RNA, herein designated VGAM HOST TARGET RNA, such as BINDING SITE I, BINDING SITE II and BINDING SITE III, inhibits translation of VGAM2650 host target RNA into VGAM2650 host target protein, herein designated VGAM HOST TARGET PROTEIN. VGAM host target protein is therefore outlined by a broken line.

It is appreciated that VGAM2650 host target gene, herein designated VGAM HOST TARGET GENE, in fact represents a plurality of VGAM2650 host target genes. The mRNA of each one of this plurality of VGAM2650 host target genes comprises one or more host target binding sites, each having a nucleotide sequence which is at least partly complementary to VGAM2650 RNA, herein designated VGAM RNA, and which when bound by VGAM2650 RNA causes inhibition of translation of respective one or more VGAM2650 host target proteins.

It is further appreciated by one skilled in the art that the mode of translational inhibition illustrated by FIG. 1 with specific reference to translational inhibition exerted by VGAM2650 gene, herein designated VGAM GENE, on one or more VGAM2650 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2650 is inhibition of expression of host target genes, as part of a novel viral mechanism of attacking a host. Accordingly, utilities of VGAM2650 include diagnosis, prevention and treatment of viral infection by Trichomonas Vaginalis Virus 3. Specific functions, and accordingly utilities, of VGAM2650 correlate with, and may be deduced from, the identity of the host target genes which VGAM2650 binds and inhibits, and the function of these host target genes, as elaborated hereinbelow.

Nucleotide sequences of the VGAM2650 precursor RNA, herein designated VGAM PRECURSOR RNA, and of the 'diced' VGAM2650 RNA, herein designated VGAM RNA, and a schematic representation of the secondary folding of VGAM2650 folded precursor RNA, herein designated VGAM FOLDED PRECURSOR RNA, of VGAM2650 are further described hereinbelow with reference to Table 1.

Nucleotide sequences of host target binding sites, such as BINDING SITE-I, BINDING SITE-II and BINDING SITE-III of FIG. 1, found on VGAM2650 host target RNA, and schematic representation of the complementarity of each of these host target binding sites to VGAM2650 RNA, herein designated VGAM RNA, are described hereinbelow with reference to Table 2.

As mentioned hereinabove with reference to FIG. 1, a function of VGAM2650 gene, herein designated VGAM is inhibition of expression of VGAM2650 target genes. It is appreciated that specific functions, and accordingly utilities, of VGAM2650 correlate with, and may be deduced from, the identity of the target genes which VGAM2650 binds and inhibits, and the function of these target genes, as elaborated hereinbelow.

MGC10960 (Accession NM_032653) is a VGAM2650 host target gene. MGC10960 BINDING SITE is HOST TARGET binding site found in the 3' untranslated region of mRNA encoded by MGC10960, corresponding to a HOST TARGET binding site such as BINDING SITE I, BINDING SITE II or BINDING SITE III. Table 2 illustrates the complementarity of the nucleotide sequences of MGC10960 BINDING SITE, designated SEQ ID:26386, to the nucleotide sequence of VGAM2650 RNA, herein designated VGAM RNA, also designated SEQ ID:5361.

A function of VGAM2650 is therefore inhibition of MGC10960 (Accession NM_032653). Accordingly, utilities of VGAM2650 include diagnosis, prevention and treatment of diseases and clinical conditions associated with MGC10960. LOC220514 (Accession XM_017498) is another VGAM2650 host target gene. LOC220514 BINDING SITE is HOST TARGET binding site found in the 3' untranslated region of mRNA encoded by LOC220514, corresponding to a HOST TARGET binding site such as BINDING SITE I, BINDING SITE II or BINDING SITE III. Table 2 illustrates the complementarity of the nucleotide sequences of LOC220514 BINDING SITE, designated SEQ ID:30324, to the nucleotide sequence of VGAM2650 RNA, herein designated VGAM RNA, also designated SEQ ID:5361.

Another function of VGAM2650 is therefore inhibition of LOC220514 (Accession XM_017498). Accordingly, utilities of VGAM2650 include diagnosis, prevention and treatment of diseases and clinical conditions associated with LOC220514. FIG. 1 further provides a conceptual description of a novel bioinformatically detected viral gene of the present invention, referred to here as Viral Genomic Address Messenger 2651 (VGAM2651) viral gene, which modulates expression of respective host target genes thereof, the function and utility of which host target genes is known in the art.

VGAM2651 is a novel bioinformatically detected regulatory, non protein coding, viral micro RNA (miRNA) gene. The method by which VGAM2651 was detected is described hereinabove with reference to FIGS. 1-8.

VGAM2651 gene, herein designated VGAM GENE, is a viral gene contained in the genome of Trichomonas Vaginalis Virus 3. VGAM2651 host target gene, herein designated VGAM HOST TARGET GENE, is a human gene contained in the human genome.

VGAM2651 gene encodes a VGAM2651 precursor RNA, herein designated VGAM PRECURSOR RNA. Similar to other miRNA genes, and unlike most ordinary genes, VGAM2651 precursor RNA does not encode a protein. A nucleotide sequence identical or highly similar to the nucleotide sequence of VGAM2651 precursor RNA is designated SEQ ID:2637, and is provided hereinbelow with reference to the sequence listing part. Nucleotide sequence SEQ ID:2637 is located at position 3926 relative to the genome of Trichomonas Vaginalis Virus 3.

VGAM2651 precursor RNA folds onto itself, forming VGAM2651 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2651 folded precursor RNA into VGAM2651 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2651 RNA is designated SEQ ID:5362, and is provided hereinbelow with reference to the sequence listing part.

VGAM2651 host target gene, herein designated VGAM HOST TARGET GENE, encodes a corresponding messenger RNA, VGAM2651 host target RNA, herein designated VGAM HOST TARGET RNA. VGAM2651 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2651 RNA, herein designated VGAM RNA, binds complementarily to one or more host target binding sites located in untranslated regions of VGAM2651 host target RNA, herein designated VGAM HOST TARGET RNA. This complementary binding is due to the fact that the nucleotide sequence of VGAM2651 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2651 RNA, herein designated VGAM RNA, may have a different number of host target binding sites in untranslated regions of a VGAM2651 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2651 RNA, herein designated VGAM RNA, to host target binding sites on VGAM2651 host target RNA, herein designated VGAM HOST TARGET RNA, such as BINDING SITE I, BINDING SITE II and BINDING SITE III, inhibits translation of VGAM2651 host target RNA into VGAM2651 host target protein, herein designated VGAM HOST TARGET PROTEIN. VGAM host target protein is therefore outlined by a broken line.

It is appreciated that VGAM2651 host target gene, herein designated VGAM HOST TARGET GENE, in fact represents a plurality of VGAM2651 host target genes. The mRNA of each one of this plurality of VGAM2651 host target genes comprises one or more host target binding sites, each having a nucleotide sequence which is at least partly complementary to VGAM2651 RNA, herein designated VGAM RNA, and which when bound by VGAM2651 RNA causes inhibition of translation of respective one or more VGAM2651 host target proteins.

It is further appreciated by one skilled in the art that the mode of translational inhibition illustrated by FIG. 1 with specific reference to translational inhibition exerted by VGAM2651 gene, herein designated VGAM GENE, on one or more VGAM2651 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2651 is inhibition of expression of host target genes, as part of a novel viral mechanism of attacking a host. Accordingly, utilities of VGAM2651 include diagnosis, prevention and treatment of viral infection by Trichomonas Vaginalis Virus 3. Specific functions, and accordingly utilities, of VGAM2651 correlate with, and may be deduced from, the identity of the host target genes which VGAM2651 binds and inhibits, and the function of these host target genes, as elaborated hereinbelow.

Nucleotide sequences of the VGAM2651 precursor RNA, herein designated VGAM PRECURSOR RNA, and of the 'diced' VGAM2651 RNA, herein designated VGAM RNA, and a schematic representation of the secondary folding of VGAM2651 folded precursor RNA, herein designated VGAM FOLDED PRECURSOR RNA, of VGAM2651 are further described hereinbelow with reference to Table 1.

Nucleotide sequences of host target binding sites, such as BINDING SITE-I, BINDING SITE-II and BINDING SITE-III of FIG. 1, found on VGAM2651 host target RNA, and schematic representation of the complementarity of each of these host target binding sites to VGAM2651 RNA, herein designated VGAM RNA, are described hereinbelow with reference to Table 2.

As mentioned hereinabove with reference to FIG. 1, a function of VGAM2651 gene, herein designated VGAM is inhibition of expression of VGAM2651 target genes. It is appreciated that specific functions, and accordingly utilities, of VGAM2651 correlate with, and may be deduced from, the identity of the target genes which VGAM2651 binds and inhibits, and the function of these target genes, as elaborated hereinbelow.

Adducin 2 (beta) (ADD2, Accession NM_017485) is a VGAM2651 host target gene. ADD2 BINDING SITE1 through ADD2 BINDING SITE4 are HOST TARGET binding sites found in untranslated regions of mRNA encoded by ADD2, corresponding to HOST TARGET binding sites such as BINDING SITE I, BINDING SITE II or BINDING SITE III. Table 2 illustrates the complementarity of the nucleotide sequences of ADD2 BINDING SITE1 through ADD2 BINDING SITE4, designated SEQ ID:18942, SEQ ID:18945, SEQ ID:18950 and SEQ ID:18937 respectively, to the nucleotide sequence of VGAM2651 RNA, herein designated VGAM RNA, also designated SEQ ID:5362.

A function of VGAM2651 is therefore inhibition of Adducin 2 (beta) (ADD2, Accession NM_017485), a gene which membrane-cytoskeleton- protein that promotes the assembly of the spectrin-actin network. Accordingly, utilities of VGAM2651 include diagnosis, prevention and treatment of diseases and clinical conditions associated with ADD2. The function of ADD2 and its association with various diseases and clinical conditions, has been established by previous studies, as described hereinabove with reference to VGAM1185. Alpha Thalassemia/mental Retardation Syndrome X-linked (RAD54 homolog, S. cerevisiae) (ATRX, Accession NM_000489) is another VGAM2651 host target gene. ATRX BINDING SITE1 and ATRX BINDING SITE2 are HOST TARGET binding sites found in untranslated regions of mRNA encoded by ATRX, corresponding to HOST TARGET binding sites such as BINDING SITE I, BINDING SITE II or BINDING SITE III. Table 2 illustrates the complementarity of the nucleotide sequences of ATRX BINDING SITE1 and ATRX BINDING SITE2, designated SEQ ID:6099 and SEQ ID:8609 respectively, to the nucleotide sequence of VGAM2651 RNA, herein designated VGAM RNA, also designated SEQ ID:5362.

Another function of VGAM2651 is therefore inhibition of Alpha Thalassemia/mental Retardation Syndrome X-linked (RAD54 homolog, S. cerevisiae) (ATRX, Accession NM_000489). Accordingly, utilities of VGAM2651 include diagnosis, prevention and treatment of diseases and clinical conditions associated with ATRX. DKFZP434L187 (Accession XM_044070) is another VGAM2651 host target gene. DKFZP434L187 BINDING SITE is HOST TARGET binding site found in the 5' untranslated region of mRNA encoded by DKFZP434L187, corresponding to a HOST TARGET binding site such as BINDING SITE I, BINDING SITE II or BINDING SITE III. Table 2 illustrates the complementarity of the nucleotide sequences of DKFZP434L187 BINDING SITE, designated SEQ ID:34128, to the nucleotide sequence of VGAM2651 RNA, herein designated VGAM RNA, also designated SEQ ID:5362.

Another function of VGAM2651 is therefore inhibition of DKFZP434L187 (Accession XM_044070). Accordingly, utilities of VGAM2651 include diagnosis, prevention and treatment of diseases and clinical conditions associated with DKFZP434L187. FLJ11506 (Accession NM_024666) is another VGAM2651 host target gene. FLJ11506 BINDING SITE is HOST TARGET binding site found in the 3' untranslated region of mRNA encoded by FLJ11506, corresponding to a HOST TARGET binding site such as BINDING SITE I, BINDING SITE II or BINDING SITE III. Table 2 illustrates the complementarity of the nucleotide sequences of FLJ11506 BINDING SITE, designated SEQ ID:23970, to the nucleotide sequence of VGAM2651 RNA, herein designated VGAM RNA, also designated SEQ ID:5362.

Another function of VGAM2651 is therefore inhibition of FLJ11506 (Accession NM_024666). Accordingly, utilities of VGAM2651 include diagnosis, prevention and treatment of diseases and clinical conditions associated with FLJ11506. FLJ23878 (Accession NM_144990) is another VGAM2651 host target gene. FLJ23878 BINDING SITE is HOST TARGET binding site found in the 3' untranslated region of mRNA encoded by FLJ23878, corresponding to a HOST TARGET binding site such as BINDING SITE I, BINDING SITE II or BINDING SITE III. Table 2 illustrates the complementarity of the nucleotide sequences of FLJ23878 BINDING SITE, designated SEQ ID:29593, to the nucleotide sequence of VGAM2651 RNA, herein designated VGAM RNA, also designated SEQ ID:5362.

Another function of VGAM2651 is therefore inhibition of FLJ23878 (Accession NM_144990). Accordingly, utilities of VGAM2651 include diagnosis, prevention and treatment of diseases and clinical conditions associated with FLJ23878. KIAA0649 (Accession NM_014811) is another VGAM2651 host target gene. KIAA0649 BINDING SITE is HOST TARGET binding site found in the 3' untranslated region of mRNA encoded by KIAA0649, corresponding to a HOST TARGET binding site such as BINDING SITE I, BINDING SITE II or BINDING SITE III. Table 2 illustrates the complementarity of the nucleotide sequences of KIAA0649 BINDING SITE, designated SEQ ID:16775, to the nucleotide sequence of VGAM2651 RNA, herein designated VGAM RNA, also designated SEQ ID:5362.

Another function of VGAM2651 is therefore inhibition of KIAA0649 (Accession NM_014811). Accordingly, utilities of VGAM2651 include diagnosis, prevention and treatment of diseases and clinical conditions associated with KIAA0649. KIAA1238 (Accession XM_048675) is another VGAM2651 host target gene. KIAA1238 BINDING SITE is HOST TARGET binding site found in the 3' untranslated region of mRNA encoded by KIAA1238, corresponding to a HOST TARGET binding site such as BINDING SITE I, BINDING SITE II or BINDING SITE III. Table 2 illustrates the complementarity of the nucleotide sequences of KIAA1238 BINDING SITE, designated SEQ ID:35217, to the nucleotide sequence of VGAM2651 RNA, herein designated VGAM RNA, also designated SEQ ID:5362.

Another function of VGAM2651 is therefore inhibition of KIAA1238 (Accession XM_048675). Accordingly, utilities of VGAM2651 include diagnosis, prevention and treatment of diseases and clinical conditions associated with KIAA1238. Zinc Finger Protein 84 (HPF2) (ZNF84, Accession NM_003428) is another VGAM2651 host target gene. ZNF84 BINDING SITE is HOST TARGET binding site found in the 3' untranslated region of mRNA encoded by ZNF84, corresponding to a HOST TARGET binding site such as BINDING SITE I, BINDING SITE II or BINDING SITE III. Table 2 illustrates the complementarity of the nucleotide sequences of ZNF84 BINDING SITE, designated SEQ ID:9480, to the nucleotide sequence of VGAM2651 RNA, herein designated VGAM RNA, also designated SEQ ID:5362.

Another function of VGAM2651 is therefore inhibition of Zinc Finger Protein 84 (HPF2) (ZNF84, Accession NM_003428). Accordingly, utilities of VGAM2651 include diagnosis, prevention and treatment of diseases and clinical conditions associated with ZNF84. LOC152328 (Accession XM_087420) is another VGAM2651 host target gene. LOC152328 BINDING SITE is HOST TARGET binding site found in the 3' untranslated region of mRNA encoded by LOC152328, corresponding to a HOST TARGET binding site such as BINDING SITE I, BINDING SITE II or BINDING SITE III. Table 2 illustrates the complementarity of the nucleotide sequences of LOC152328 BINDING SITE, designated SEQ ID:39244, to the nucleotide sequence of VGAM2651 RNA, herein designated VGAM RNA, also designated SEQ ID:5362.

Another function of VGAM2651 is therefore inhibition of LOC152328 (Accession XM_087420). Accordingly, utilities of VGAM2651 include diagnosis, prevention and treatment of diseases and clinical conditions associated with LOC152328. LOC255533 (Accession XM_173073) is another VGAM2651 host target gene. LOC255533 BINDING SITE is HOST TARGET binding site found in the 5' untranslated region of mRNA encoded by LOC255533, corresponding to a HOST TARGET binding site such as BINDING SITE I, BINDING SITE II or BINDING SITE III. Table 2 illustrates the complementarity of the nucleotide sequences of LOC255533 BINDING SITE, designated SEQ ID:46333, to the nucleotide sequence of VGAM2651 RNA, herein designated VGAM RNA, also designated SEQ ID:5362.

Another function of VGAM2651 is therefore inhibition of LOC255533 (Accession XM_173073). Accordingly, utilities of VGAM2651 include diagnosis, prevention and treatment of diseases and clinical conditions associated with LOC255533. FIG. 1 further provides a conceptual description of a novel bioinformatically detected viral gene of the present invention, referred to here as Viral Genomic Address Messenger 2652 (VGAM2652) viral gene, which modulates expression of respective host target genes thereof, the function and utility of which host target genes is known in the art.

VGAM2652 is a novel bioinformatically detected regulatory, non protein coding, viral micro RNA (miRNA) gene. The method by which VGAM2652 was detected is described hereinabove with reference to FIGS. 1-8.

VGAM2652 gene, herein designated VGAM GENE, is a viral gene contained in the genome of Sorghum Mosaic Virus. VGAM2652 host target gene, herein designated VGAM HOST TARGET GENE, is a human gene contained in the human genome.

VGAM2652 gene encodes a VGAM2652 precursor RNA, herein designated VGAM PRECURSOR RNA. Similar to other miRNA genes, and unlike most ordinary genes, VGAM2652 precursor RNA does not encode a protein. A nucleotide sequence identical or highly similar to the nucleotide sequence of VGAM2652 precursor RNA is designated SEQ ID:2638, and is provided hereinbelow with reference to the sequence listing part. Nucleotide sequence SEQ ID:2638 is located at position 6180 relative to the genome of Sorghum Mosaic Virus.

VGAM2652 precursor RNA folds onto itself, forming VGAM2652 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2652 folded precursor RNA into VGAM2652 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2652 RNA is designated SEQ ID:5363, and is provided hereinbelow with reference to the sequence listing part.

VGAM2652 host target gene, herein designated VGAM HOST TARGET GENE, encodes a corresponding messenger RNA, VGAM2652 host target RNA, herein designated VGAM HOST TARGET RNA. VGAM2652 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2652 RNA, herein designated VGAM RNA, binds complementarily to one or more host target binding sites located in untranslated regions of VGAM2652 host target RNA, herein designated VGAM HOST TARGET RNA. This complementary binding is due to the fact that the nucleotide sequence of VGAM2652 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2652 RNA, herein designated VGAM RNA, may have a different number of host target binding sites in untranslated regions of a VGAM2652 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2652 RNA, herein designated VGAM RNA, to host target binding sites on VGAM2652 host target RNA, herein designated VGAM HOST TARGET RNA, such as BINDING SITE I, BINDING SITE II and BINDING SITE III, inhibits translation of VGAM2652 host target RNA into VGAM2652 host target protein, herein designated VGAM HOST TARGET PROTEIN. VGAM host target protein is therefore outlined by a broken line.

It is appreciated that VGAM2652 host target gene, herein designated VGAM HOST TARGET GENE, in fact represents a plurality of VGAM2652 host target genes. The mRNA of each one of this plurality of VGAM2652 host target genes comprises one or more host target binding sites, each having a nucleotide sequence which is at least partly complementary to VGAM2652 RNA, herein designated VGAM RNA, and which when bound by VGAM2652 RNA causes inhibition of translation of respective one or more VGAM2652 host target proteins.

It is further appreciated by one skilled in the art that the mode of translational inhibition illustrated by FIG. 1 with specific reference to translational inhibition exerted by VGAM2652 gene, herein designated VGAM GENE, on one or more VGAM2652 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let- 7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2652 is inhibition of expression of host target genes, as part of a novel viral mechanism of attacking a host. Accordingly, utilities of VGAM2652 include diagnosis, prevention and treatment of viral infection by Sorghum Mosaic Virus. Specific functions, and accordingly utilities, of VGAM2652 correlate with, and may be deduced from, the identity of the host target genes which VGAM2652 binds and inhibits, and the function of these host target genes, as elaborated hereinbelow.

Nucleotide sequences of the VGAM2652 precursor RNA, herein designated VGAM PRECURSOR RNA, and of the 'diced' VGAM2652 RNA, herein designated VGAM RNA, and a schematic representation of the secondary folding of VGAM2652 folded precursor RNA, herein designated VGAM FOLDED PRECURSOR RNA, of VGAM2652 are further described hereinbelow with reference to Table 1.

Nucleotide sequences of host target binding sites, such as BINDING SITE-I, BINDING SITE-II and BINDING SITE-III of FIG. 1, found on VGAM2652 host target RNA, and schematic representation of the complementarity of each of these host target binding sites to VGAM2652 RNA, herein designated VGAM RNA, are described hereinbelow with reference to Table 2.

As mentioned hereinabove with reference to FIG. 1, a function of VGAM2652 gene, herein designated VGAM is inhibition of expression of VGAM2652 target genes. It is appreciated that specific functions, and accordingly utilities, of VGAM2652 correlate with, and may be deduced from, the identity of the target genes which VGAM2652 binds and inhibits, and the function of these target genes, as elaborated hereinbelow.

Alpha-1-B Glycoprotein (A1BG, Accession NM_130786) is a VGAM2652 host target gene. A1BG BINDING SITE is HOST TARGET binding site found in the 3' untranslated region of mRNA encoded by A1BG, corresponding to a HOST TARGET binding site such as BINDING SITE I, BINDING SITE II or BINDING SITE III. Table 2 illustrates the complementarity of the nucleotide sequences of A1BG BINDING SITE, designated SEQ ID:28278, to the nucleotide sequence of VGAM2652 RNA, herein designated VGAM RNA, also designated SEQ ID:5363.

A function of VGAM2652 is therefore inhibition of Alpha-1-B Glycoprotein (A1BG, Accession NM_130786), a gene which a plasma protein of unknown function. Accordingly, utilities of VGAM2652 include diagnosis, prevention and treatment of diseases and clinical conditions associated with A1BG. The function of A1BG and its association with various diseases and clinical conditions, has been established by previous studies, as described hereinabove with reference to VGAM172. A Disintegrin-like and Metalloprotease (reprolysin type) with Thrombospondin Type 1 Motif, 4 (ADAMTS4, Accession NM_005099) is another VGAM2652 host target gene. ADAMTS4 BINDING SITE is HOST TARGET binding site found in the 3' untranslated region of mRNA encoded by ADAMTS4, corresponding to a HOST TARGET binding site such as BINDING SITE I, BINDING SITE II or BINDING SITE III. Table 2 illustrates the complementarity of the nucleotide sequences of ADAMTS4 BINDING SITE, designated SEQ ID:11570, to the nucleotide sequence of VGAM2652 RNA, herein designated VGAM RNA, also designated SEQ ID:5363.

Another function of VGAM2652 is therefore inhibition of A Disintegrin-like and Metalloprotease (reprolysin type) with Thrombospondin Type 1 Motif, 4 (ADAMTS4, Accession NM_005099), a gene which cleaves aggrecan, a cartilage proteoglycan, and may be involved in its turnover. Accordingly, utilities of VGAM2652 include diagnosis, prevention and treatment of diseases and clinical conditions associated with ADAMTS4. The function of ADAMTS4 and its association with various diseases and clinical conditions, has been established by previous studies, as described hereinabove with reference to VGAM809. Aryl Hydrocarbon Receptor (AHR, Accession NM_001621) is another VGAM2652 host target gene. AHR BINDING SITE is HOST TARGET binding site found in the 3" untranslated region of mRNA encoded by AHR, corresponding to a HOST TARGET binding site such as BINDING SITE I, BINDING SITE II or BINDING SITE III. Table 2 illustrates the complementarity of the nucleotide sequences of AHR BINDING SITE, designated SEQ ID:7334, to the nucleotide sequence of VGAM2652 RNA, herein designated VGAM RNA, also designated SEQ ID:5363.

Another function of VGAM2652 is therefore inhibition of Aryl Hydrocarbon Receptor (AHR, Accession NM_001621), a gene which plays a role in modulating carcinogenesis through the induction of xenobiotic-metabolizing enzymes. Accordingly, utilities of VGAM2652 include diagnosis, prevention and treatment of diseases and clinical conditions associated with AHR. The function of AHR and its association with various diseases and clinical conditions, has been established by previous studies, as described hereinabove with reference to VGAM368. ATPase, H+ Transporting, Lysosomal 70 kDa, V1 Subunit A, Isoform 1 (ATP6V1A1, Accession NM_001690) is another VGAM2652 host target gene. ATP6V1A1 BINDING SITE is HOST TARGET binding site found in the 3' untranslated region of mRNA encoded by ATP6V1A1, corresponding to a HOST TARGET binding site such as BINDING SITE I, BINDING SITE II or BINDING SITE III. Table 2 illustrates the complementarity of the nucleotide sequences of ATP6V1A1 BINDING SITE, designated SEQ ID:7410, to the nucleotide sequence of VGAM2652 RNA, herein designated VGAM RNA, also designated SEQ ID:5363.

Another function of VGAM2652 is therefore inhibition of ATPase, H+ Transporting, Lysosomal 70 kDa, V1 Subunit A, Isoform 1 (ATP6V1A1, Accession NM_001690), a gene which is responsible for acidifying a variety of intracellular compartments in eukaryotic cells. Accordingly, utilities of VGAM2652 include diagnosis, prevention and treatment of diseases and clinical conditions associated with ATP6V1A1. The function of ATP6V1A1 and its association with various diseases and clinical conditions, has been established by previous studies, as described hereinabove with reference to VGAM827. BRIP1 (Accession NM_032043) is another VGAM2652 host target gene. BRIP1 BINDING SITE is HOST TARGET binding site found in the 3' untranslated region of mRNA encoded by BRIP1, corresponding to a HOST TARGET binding site such as BINDING SITE I, BINDING SITE II or BINDING SITE III. Table 2 illustrates the complementarity of the nucleotide sequences of BRIP1 BINDING SITE, designated SEQ ID:25756, to the nucleotide sequence of VGAM2652 RNA, herein designated VGAM RNA, also designated SEQ ID:5363.

Another function of VGAM2652 is therefore inhibition of BRIP1 (Accession NM_032043). Accordingly, utilities of VGAM2652 include diagnosis, prevention and treatment of diseases and clinical conditions associated with BRIP1. Cholinergic Receptor, Nicotinic, Beta Polypeptide 4 (CHRNB4, Accession NM_000750) is another VGAM2652 host target gene. CHRNB4 BINDING SITE is HOST TARGET binding site found in the 3' untranslated region of mRNA encoded by CHRNB4, corresponding to a HOST TARGET binding site such as BINDING SITE I, BINDING SITE II or BINDING SITE III. Table 2 illustrates the complementarity of the nucleotide sequences of CHRNB4 BINDING SITE, designated SEQ ID:6404, to the nucleotide sequence of VGAM2652 RNA, herein designated VGAM RNA, also designated SEQ ID:5363.

Another function of VGAM2652 is therefore inhibition of Cholinergic Receptor, Nicotinic, Beta Polypeptide 4 (CHRNB4, Accession NM_000750), a gene which mediates fast signal transmission at synapses. Accordingly, utilities of VGAM2652 include diagnosis, prevention and treatment of diseases and clinical conditions associated with CHRNB4. The function of CHRNB4 has been established by previous studies. Transmitter-gated cation channels are detectors of excitatory chemical signals at synapses in the nervous system. Khakh et al. (2000) showed that structurally distinct alpha-3-beta-4 nicotinic and P2X(2) (OMIM Ref. No. 600844) channels influence each other when coactivated. The activation of one channel type affects distinct kinetic and conductance states of the other, and coactivation results in nonadditive responses owing to inhibition of both channel types. State-dependent inhibition of nicotinic channels was revealed most clearly with mutant P2X(2) channels, and inhibition was decreased at lower densities of channel expression. In synaptically coupled myenteric neurons, nicotinic fast excitatory postsynaptic currents were occluded during activation of endogenously coexpressed P2X channels. Khakh et al. (2000) concluded that their data provide a molecular basis and a synaptic context for cross-inhibition between transmitter-gated channels. Transmitter-gated cation channels are detectors of excitatory chemical signals at synapses in the nervous system. Khakh et al. (2000) showed that structurally distinct alpha-3-beta-4 nicotinic and P2X(2) (OMIM Ref. No. 600844) channels influence each other when coactivated. The activation of one channel type affects distinct kinetic and conductance states of the other, and coactivation results in nonadditive responses owing to inhibition of both channel types. State-dependent inhibition of nicotinic channels was revealed most clearly with mutant P2X(2) channels, and inhibition was decreased at lower densities of channel expression. In synaptically coupled myenteric neurons, nicotinic fast excitatory postsynaptic currents were occluded during activation of endogenously coexpressed P2X channels. Khakh et al. (2000) concluded that their data provide a molecular basis and a synaptic context for cross-inhibition between transmitter-gated channels Full details of the abovementioned studies are described in the following publications, the disclosure of which are hereby incorporated by reference:

Khakh, B. S.; Zhou, X.; Sydes, J.; Galligan, J. J.; Lester, H. A.: State-dependent cross-inhibition between transmitter-gated cation channels. Nature 406:405-410, 2000; and Tarroni, P.; Rubboli, F.; Chini, B.; Zwart, R.; Oortgiesen, M.; Sher, E.; Clementi, F.: Neuronal-type nicotinic receptors in human neuroblastoma and small-cell lung carcinoma cell line.

Further studies establishing the function and utilities of CHRNB4 are found in John Hopkins OMIM database record ID 118509, and in sited publications numbered 33, 390, 9944, 1268 and 12696 listed in the bibliography section hereinbelow, which are also hereby incorporated by reference. COX15 Homolog, Cytochrome C Oxidase Assembly Protein (yeast) (COX15, Accession NM_078470) is another VGAM2652 host target gene. COX15 BINDING SITE is HOST TARGET binding site found in the 3' untranslated region of mRNA encoded by COX15, corresponding to a HOST TARGET binding site such as BINDING SITE I, BINDING SITE II or BINDING SITE III. Table 2 illustrates the complementarity of the nucleotide sequences of COX15 BINDING SITE, designated SEQ ID:27793, to the nucleotide sequence of VGAM2652 RNA, herein designated VGAM RNA, also designated SEQ ID:5363.

Another function of VGAM2652 is therefore inhibition of COX15 Homolog, Cytochrome C Oxidase Assembly Protein (yeast) (COX15, Accession NM_078470). Accordingly, utilities of VGAM2652 include diagnosis, prevention and treatment of diseases and clinical conditions associated with COX15. Cytochrome P450, Subfamily IIB (phenobarbital-inducible), Polypeptide 6 (CYP2B6, Accession NM_000767) is another VGAM2652 host target gene. CYP2B6 BINDING SITE is HOST TARGET binding site found in the 3' untranslated region of mRNA encoded by CYP2B6, corresponding to a HOST TARGET binding site such as BINDING SITE I, BINDING SITE II or BINDING SITE III. Table 2 illustrates the complementarity of the nucleotide sequences of CYP2B6 BINDING SITE, designated SEQ ID:6415, to the nucleotide sequence of VGAM2652 RNA, herein designated VGAM RNA, also designated SEQ ID:5363.

Another function of VGAM2652 is therefore inhibition of Cytochrome P450, Subfamily IIB (phenobarbital-inducible), Polypeptide 6 (CYP2B6, Accession NM_000767), a gene which oxidizes a variety of structurally unrelated compounds, including steroids, fatty acids, and xenobiotics. Accordingly, utilities of VGAM2652 include diagnosis, prevention and treatment of diseases and clinical conditions associated with CYP2B6. The function of CYP2B6 and its association with various diseases and clinical conditions, has been established by previous studies, as described hereinabove with reference to VGAM1924. Fc Fragment of IgA, Receptor For (FCAR, Accession NM_133269) is another VGAM2652 host target gene. FCAR BINDING SITE1 through FCAR BINDING SITE5 are HOST TARGET binding sites found in untranslated regions of mRNA encoded by FCAR, corresponding to HOST TARGET binding sites such as BINDING SITE I, BINDING SITE II or BINDING SITE III. Table 2 illustrates the complementarity of the nucleotide sequences of FCAR BINDING SITE1 through FCAR BINDING SITE5, designated SEQ ID:28424, SEQ ID:7728, SEQ ID:28428, SEQ ID:28426 and SEQ ID:28430 respectively, to the nucleotide sequence of VGAM2652 RNA, herein designated VGAM RNA, also designated SEQ ID:5363.

Another function of VGAM2652 is therefore inhibition of Fc Fragment of IgA, Receptor For (FCAR, Accession NM_133269), a gene which binds to the fc region of immunoglobulins alpha and mediates several functions including cytokine production. Accordingly, utilities of VGAM2652 include diagnosis, prevention and treatment of diseases and clinical conditions associated with FCAR. The function of FCAR and its association with various diseases and clinical conditions, has been established by previous studies, as described hereinabove with reference to VGAM923. Glucose-6-phosphatase, Catalytic (glycogen storage disease type I, von Gierke disease) (G6PC, Accession NM_000151) is another VGAM2652 host target gene. G6PC BINDING SITE is HOST TARGET binding site found in the 3' untranslated region of mRNA encoded by G6PC, corresponding to a HOST TARGET binding site such as BINDING SITE I, BINDING SITE II or BINDING SITE III. Table 2 illustrates the complementarity of the nucleotide sequences of G6PC BINDING SITE, designated SEQ ID:5659, to the nucleotide sequence of VGAM2652 RNA, herein designated VGAM RNA, also designated SEQ ID:5363.

Another function of VGAM2652 is therefore inhibition of Glucose-6-phosphatase, Catalytic (glycogen storage disease type I, von Gierke disease) (G6PC, Accession NM_000151). Accordingly, utilities of VGAM2652 include diagnosis, prevention and treatment of diseases and clinical conditions associated with G6PC. G Protein-coupled Receptor 56 (GPR56, Accession NM_005682) is another VGAM2652 host target gene. GPR56 BINDING SITE is HOST TARGET binding site found in the 5' untranslated region of mRNA encoded by GPR56, corresponding to a HOST TARGET binding site such as BINDING SITE I, BINDING SITE II or BINDING SITE III. Table 2 illustrates the complementarity of the nucleotide sequences of GPR56 BINDING SITE, designated SEQ ID:12240, to the nucleotide sequence of VGAM2652 RNA, herein designated VGAM RNA, also designated SEQ ID:5363.

Another function of VGAM2652 is therefore inhibition of G Protein-coupled Receptor 56 (GPR56, Accession NM_005682), a gene which transduces extracellular signals through heterotrimeric G proteins. Accordingly, utilities of VGAM2652 include diagnosis, prevention and treatment of diseases and clinical conditions associated with GPR56. The function of GPR56 and its association with various diseases and clinical conditions, has been established by previous studies, as described hereinabove with reference to VGAM782. Membrane Component, Chromosome 11, Surface Marker 1 (M11S1, Accession NM_005898) is another VGAM2652 host target gene. M11S1 BINDING SITE is HOST TARGET binding site found in the 3' untranslated region of mRNA encoded by M11S1, corresponding to a HOST TARGET binding site such as BINDING SITE I, BINDING SITE II or BINDING SITE III. Table 2 illustrates the complementarity of the nucleotide sequences of M11S1 BINDING SITE, designated SEQ ID:12519, to the nucleotide sequence of VGAM2652 RNA, herein designated VGAM RNA, also designated SEQ ID:5363.

Another function of VGAM2652 is therefore inhibition of Membrane Component, Chromosome 11, Surface Marker 1 (M11S1, Accession NM_005898), a gene which may play a role in transporting nutrients from the gut lumen across the gutlining epithelial cell layer. Accordingly, utilities of VGAM2652 include diagnosis, prevention and treatment of diseases and clinical conditions associated with M11S1. The function of M11S1 and its association with various diseases and clinical conditions, has been established by previous studies, as described hereinabove with reference to VGAM131. Male Germ Cell-associated Kinase (MAK, Accession NM_005906) is another VGAM2652 host target gene. MAK BINDING SITE is HOST TARGET binding site found in the 3' untranslated region of mRNA encoded by MAK, corresponding to a HOST TARGET binding site such as BINDING SITE I, BINDING SITE II or BINDING SITE III. Table 2 illustrates the complementarity of the nucleotide sequences of MAK BINDING SITE, designated SEQ ID:12530, to the nucleotide sequence of VGAM2652 RNA, herein designated VGAM RNA, also designated SEQ ID:5363.

Another function of VGAM2652 is therefore inhibition of Male Germ Cell-associated Kinase (MAK, Accession NM_005906), a gene which plays an important role in spermatogenesis. Accordingly, utilities of VGAM2652 include diagnosis, prevention and treatment of diseases and clinical conditions associated with MAK. The function of MAK and its association with various diseases and clinical conditions, has been established by previous studies, as described hereinabove with reference to VGAM1322. MADS Box Transcription Enhancer Factor 2, Polypeptide A (myocyte enhancer factor 2A) (MEF2A, Accession NM_005587) is another VGAM2652 host target gene. MEF2A BINDING SITE is HOST TARGET binding site found in the 5' untranslated region of mRNA encoded by MEF2A, corresponding to a HOST TARGET binding site such as BINDING SITE I, BINDING SITE II or BINDING SITE III. Table 2 illustrates the complementarity of the nucleotide sequences of MEF2A BINDING SITE, designated SEQ ID:12117, to the nucleotide sequence of VGAM2652 RNA, herein designated VGAM RNA, also designated SEQ ID:5363.

Another function of VGAM2652 is therefore inhibition of MADS Box Transcription Enhancer Factor 2, Polypeptide A (myocyte enhancer factor 2A) (MEF2A, Accession NM_005587), a gene which binds a consensus sequence that regulates transcription. Accordingly, utilities of VGAM2652 include diagnosis, prevention and treatment of diseases and clinical conditions associated with MEF2A. The function of MEF2A and its association with various diseases and clinical conditions, has been established by previous studies, as described hereinabove with reference to VGAM46. MHC Class II Transactivator (MHC2TA, Accession NM_000246) is another VGAM2652 host target gene. MHC2TA BINDING SITE is HOST TARGET binding site found in the 3' untranslated region of mRNA encoded by MHC2TA, corresponding to a HOST TARGET binding site such as BINDING SITE I, BINDING SITE II or BINDING SITE III. Table 2 illustrates the complementarity of the nucleotide sequences of MHC2TA BINDING SITE, designated SEQ ID:5781, to the nucleotide sequence of VGAM2652 RNA, herein designated VGAM RNA, also designated SEQ ID:5363.

Another function of VGAM2652 is therefore inhibition of MHC Class II Transactivator (MHC2TA, Accession NM_000246). Accordingly, utilities of VGAM2652 include diagnosis, prevention and treatment of diseases and clinical conditions associated with MHC2TA. Myeloproliferative Leukemia Virus Oncogene (MPL, Accession NM_005373) is another VGAM2652 host target gene. MPL BINDING SITE is HOST TARGET binding site found in the 3' untranslated region of mRNA encoded by MPL, corresponding to a HOST TARGET binding site such as BINDING SITE I, BINDING SITE II or BINDING SITE III. Table 2 illustrates the complementarity of the nucleotide sequences of MPL BINDING SITE, designated SEQ ID:11851, to the nucleotide sequence of VGAM2652 RNA, herein designated VGAM RNA, also designated SEQ ID:5363.

Another function of VGAM2652 is therefore inhibition of Myeloproliferative Leukemia Virus Oncogene (MPL, Accession NM_005373). Accordingly, utilities of VGAM2652 include diagnosis, prevention and treatment of diseases and clinical conditions associated with MPL. Nuclear Receptor Coactivator 6 (NCOA6, Accession NM_014071) is another VGAM2652 host target gene. NCOA6 BINDING SITE is HOST TARGET binding site found in the 5' untranslated region of mRNA encoded by NCOA6, corresponding to a HOST TARGET binding site such as BINDING SITE I, BINDING SITE II or BINDING SITE III. Table 2 illustrates the complementarity of the nucleotide sequences of NCOA6 BINDING SITE, designated SEQ ID:15292, to the nucleotide sequence of VGAM2652 RNA, herein designated VGAM RNA, also designated SEQ ID:5363.

Another function of VGAM2652 is therefore inhibition of Nuclear Receptor Coactivator 6 (NCOA6, Accession NM_014071), a gene which activates gene transcription through ligand-dependent association with coactivators.

Accordingly, utilities of VGAM2652 include diagnosis, prevention and treatment of diseases and clinical conditions associated with NCOA6. The function of NCOA6 and its association with various diseases and clinical conditions, has been established by previous studies, as described hereinabove with reference to VGAM25. Phosphodiesterase 6B, CGMP-specific, Rod, Beta (congenital stationary night blindness 3, autosomal dominant) (PDE6B, Accession NM_000283) is another VGAM2652 host target gene. PDE6B BINDING SITE is HOST TARGET binding site found in the 3' untranslated region of mRNA encoded by PDE6B, corresponding to a HOST TARGET binding site such as BINDING SITE I, BINDING SITE II or BINDING SITE III. Table 2 illustrates the complementarity of the nucleotide sequences of PDE6B BINDING SITE, designated SEQ ID:5829, to the nucleotide sequence of VGAM2652 RNA, herein designated VGAM RNA, also designated SEQ ID:5363.

Another function of VGAM2652 is therefore inhibition of Phosphodiesterase 6B, CGMP-specific, Rod, Beta (congenital stationary night blindness 3, autosomal dominant) (PDE6B, Accession NM_000283). Accordingly, utilities of VGAM2652 include diagnosis, prevention and treatment of diseases and clinical conditions associated with PDE6B. Phosphoinositide-3-kinase, Catalytic, Delta Polypeptide (PIK3CD, Accession NM_005026) is another VGAM2652 host target gene. PIK3CD BINDING SITE is HOST TARGET binding site found in the 3' untranslated region of mRNA encoded by PIK3CD, corresponding to a HOST TARGET binding site such as BINDING SITE I, BINDING SITE II or BINDING SITE III. Table 2 illustrates the complementarity of the nucleotide sequences of PIK3CD BINDING SITE, designated SEQ ID:11464, to the nucleotide sequence of VGAM2652 RNA, herein designated VGAM RNA, also designated SEQ ID:5363.

Another function of VGAM2652 is therefore inhibition of Phosphoinositide-3-kinase, Catalytic, Delta Polypeptide (PIK3CD, Accession NM_005026), a gene which regulating cell growth. Accordingly, utilities of VGAM2652 include diagnosis, prevention and treatment of diseases and clinical conditions associated with PIK3CD. The function of PIK3CD and its association with various diseases and clinical conditions, has been established by previous studies, as described hereinabove with reference to VGAM2434. POU Domain, Class 2, Associating Factor 1 (POU2AF1, Accession NM_006235) is another VGAM2652 host target gene. POU2AF1 BINDING SITE is HOST TARGET binding site found in the 3' untranslated region of mRNA encoded by POU2AF1, corresponding to a HOST TARGET binding site such as BINDING SITE I, BINDING SITE II or BINDING SITE III. Table 2 illustrates the complementarity of the nucleotide sequences of POU2AF1 BINDING SITE, designated SEQ ID:12893, to the nucleotide sequence of VGAM2652 RNA, herein designated VGAM RNA, also designated SEQ ID:5363.

Another function of VGAM2652 is therefore inhibition of POU Domain, Class 2, Associating Factor 1 (POU2AF1, Accession NM_006235), a gene which is a transcriptional coactivator that specifically associates with either oct1 or oct2. Accordingly, utilities of VGAM2652 include diagnosis, prevention and treatment of diseases and clinical conditions associated with POU2AF1. The function of POU2AF1 and its association with various diseases and clinical conditions, has been established by previous studies, as described hereinabove with reference to VGAM171. Protein Kinase, Interferon-inducible Double Stranded RNA Dependent (PRKR, Accession NM_002759) is another VGAM2652 host target gene. PRKR BINDING SITE is HOST TARGET binding site found in the 3' untranslated region of mRNA encoded by PRKR, corresponding to a HOST TARGET binding site such as BINDING SITE I, BINDING SITE II or BINDING SITE III. Table 2 illustrates the complementarity of the nucleotide sequences of PRKR BINDING SITE, designated SEQ ID:8646, to the nucleotide sequence of VGAM2652 RNA, herein designated VGAM RNA, also designated SEQ ID:5363.

Another function of VGAM2652 is therefore inhibition of Protein Kinase, Interferon-inducible Double Stranded RNA Dependent (PRKR, Accession NM_002759), a gene which catalyze the phosphorylation of the alpha subunit of eif2. Accordingly, utilities of VGAM2652 include diagnosis, prevention and treatment of diseases and clinical conditions associated with PRKR. The function of PRKR and its association with various diseases and clinical conditions, has been established by previous studies, as described hereinabove with reference to VGAM1890. Retinoblastoma Binding Protein 9 (RBBP9, Accession XM_046553) is another VGAM2652 host target gene. RBBP9 BINDING SITE is HOST TARGET binding site found in the 3' untranslated region of mRNA encoded by RBBP9, corresponding to a HOST TARGET binding site such as BINDING SITE I, BINDING SITE II or BINDING SITE III. Table 2 illustrates the complementarity of the nucleotide sequences of RBBP9 BINDING SITE, designated SEQ ID:34747, to the nucleotide sequence of VGAM2652 RNA, herein designated VGAM RNA, also designated SEQ ID:5363.

Another function of VGAM2652 is therefore inhibition of Retinoblastoma Binding Protein 9 (RBBP9, Accession XM_046553). Accordingly, utilities of VGAM2652 include diagnosis, prevention and treatment of diseases and clinical conditions associated with RBBP9. Stearoyl-CoA Desaturase (delta-9-desaturase) (SCD, Accession NM_005063) is another VGAM2652 host target gene. SCD BINDING SITE is HOST TARGET binding site found in the 3' untranslated region of mRNA encoded by SCD, corresponding to a HOST TARGET binding site such as BINDING SITE I, BINDING SITE II or BINDING SITE III. Table 2 illustrates the complementarity of the nucleotide sequences of SCD BINDING SITE, designated SEQ ID:11498, to the nucleotide sequence of VGAM2652 RNA, herein designated VGAM RNA, also designated SEQ ID:5363.

Another function of VGAM2652 is therefore inhibition of Stearoyl-CoA Desaturase (delta-9-desaturase) (SCD, Accession NM_005063), a gene which functions in the synthesis of unsaturated fatty acids. Accordingly, utilities of VGAM2652 include diagnosis, prevention and treatment of diseases and clinical conditions associated with SCD. The function of SCD and its association with various diseases and clinical conditions, has been established by previous studies, as described hereinabove with reference to VGAM314. Thromboxane A2 Receptor (TBXA2R, Accession NM_001060) is another VGAM2652 host target gene. TBXA2R BINDING SITE is HOST TARGET binding site found in the 3' untranslated region of mRNA encoded by TBXA2R, corresponding to a HOST TARGET binding site such as BINDING SITE I, BINDING SITE II or BINDING SITE III. Table 2 illustrates the complementarity of the nucleotide sequences of TBXA2R BINDING SITE, designated SEQ ID:6728, to the nucleotide sequence of VGAM2652 RNA, herein designated VGAM RNA, also designated SEQ ID:5363.

Another function of VGAM2652 is therefore inhibition of Thromboxane A2 Receptor (TBXA2R, Accession NM_001060), a gene which activates Ca2+-activated chloride channels; stimulates platelet aggregation and smooth muscle constriction. Accordingly, utilities of VGAM2652 include diagnosis, prevention and treatment of diseases and clinical conditions associated with TBXA2R. The function of TBXA2R and its association with various diseases and clinical conditions, has been established by previous studies, as described hereinabove with reference to VGAM433. Transmembrane, Cochlear Expressed, 1 (TMC1, Accession NM_138691) is another VGAM2652 host target gene. TMC1 BINDING SITE is HOST TARGET binding site found in the 5' untranslated region of mRNA encoded by TMC1, corresponding to a HOST TARGET binding site such as BINDING SITE I, BINDING SITE II or BINDING SITE III. Table 2 illustrates the complementarity of the nucleotide sequences of TMC1 BINDING SITE, designated SEQ ID:28934, to the nucleotide sequence of VGAM2652 RNA, herein designated VGAM RNA, also designated SEQ ID:5363.

Another function of VGAM2652 is therefore inhibition of Transmembrane, Cochlear Expressed, 1 (TMC1, Accession NM_138691), a gene which is required for normal function of cochlear hair cells. Accordingly, utilities of VGAM2652 include diagnosis, prevention and treatment of diseases and clinical conditions associated with TMC1. The function of TMC1 and its association with various diseases and clinical conditions, has been established by previous studies, as described hereinabove with reference to VGAM554. Tumor Necrosis Factor Receptor Superfamily, Member 10b (TNFRSF10B, Accession NM_003842) is another VGAM2652 host target gene. TNFRSF10B BINDING SITE is HOST TARGET binding site found in the 3' untranslated region of mRNA encoded by TNFRSF10B, corresponding to a HOST TARGET binding site such as BINDING SITE I, BINDING SITE II or BINDING SITE III. Table 2 illustrates the complementarity of the nucleotide sequences of TNFRSF10B BINDING SITE, designated SEQ ID:9938, to the nucleotide sequence of VGAM2652 RNA, herein designated VGAM RNA, also designated SEQ ID:5363.

Another function of VGAM2652 is therefore inhibition of Tumor Necrosis Factor Receptor Superfamily, Member 10b (TNFRSF10B, Accession NM_003842), a gene which forms complex that induces apoptosis. Accordingly, utilities of VGAM2652 include diagnosis, prevention and treatment of diseases and clinical conditions associated with TNFRSF10B. The function of TNFRSF10B and its association with various diseases and clinical conditions, has been established by previous studies, as described hereinabove with reference to VGAM400. TNF Receptor-associated Factor 5 (TRAF5, Accession NM_004619) is another VGAM2652 host target gene. TRAF5 BINDING SITE is HOST TARGET binding site found in the 3' untranslated region of mRNA encoded by TRAF5, corresponding to a HOST TARGET binding site such as BINDING SITE I, BINDING SITE II or BINDING SITE III. Table 2 illustrates the complementarity of the nucleotide sequences of TRAF5 BINDING SITE, designated SEQ ID:10968, to the nucleotide sequence of VGAM2652 RNA, herein designated VGAM RNA, also designated SEQ ID:5363.

Another function of VGAM2652 is therefore inhibition of TNF Receptor-associated Factor 5 (TRAF5, Accession NM_004619), a gene which Member of a family of proteins that interact with TNF receptors; binds the lymphotoxin beta receptor (LTBR). Accordingly, utilities of VGAM2652 include diagnosis, prevention and treatment of diseases and clinical conditions associated with TRAF5. The function of TRAF5 and its association with various diseases and clinical conditions, has been established by previous studies, as described hereinabove with reference to VGAM76. Von Hippel-Lindau Syndrome (VHL, Accession NM_000551) is another VGAM2652 host target gene. VHL BINDING SITE is HOST TARGET binding site found in the 3' untranslated region of mRNA encoded by VHL, corresponding to a HOST TARGET binding site such as BINDING SITE I, BINDING SITE II or BINDING SITE III. Table 2 illustrates the complementarity of the nucleotide sequences of VHL BINDING SITE, designated SEQ ID:6165, to the nucleotide sequence of VGAM2652 RNA, herein designated VGAM RNA, also designated SEQ ID:5363.

Another function of VGAM2652 is therefore inhibition of Von Hippel-Lindau Syndrome (VHL, Accession NM_000551), a gene which may control rna stability through the selective degradation of rna-bound proteins. Accordingly, utilities of VGAM2652 include diagnosis, prevention and treatment of diseases and clinical conditions associated with VHL. The function of VHL and its association with various diseases and clinical conditions, has been established by previous studies, as described hereinabove with reference to VGAM197. Rho GTPase Activating Protein 9 (ARHGAP9, Accession NM_032496) is another VGAM2652 host target gene. ARHGAP9 BINDING SITE is HOST TARGET binding site found in the 5' untranslated region of mRNA encoded by ARHGAP9, corresponding to a HOST TARGET binding site such as BINDING SITE I, BINDING SITE II or BINDING SITE III. Table 2 illustrates the complementarity of the nucleotide sequences of ARHGAP9 BINDING SITE, designated SEQ ID:26248, to the nucleotide sequence of VGAM2652 RNA, herein designated VGAM RNA, also designated SEQ ID:5363.

Another function of VGAM2652 is therefore inhibition of Rho GTPase Activating Protein 9 (ARHGAP9, Accession NM_032496). Accordingly, utilities of VGAM2652 include diagnosis, prevention and treatment of diseases and clinical conditions associated with ARHGAP9. Ankyrin Repeat and SOCS Box-containing 16 (ASB16, Accession NM_080863) is another VGAM2652 host target gene. ASB16 BINDING SITE is HOST TARGET binding site found in the 3' untranslated region of mRNA encoded by ASB16, corresponding to a HOST TARGET binding site such as BINDING SITE I, BINDING SITE II or BINDING SITE III. Table 2 illustrates the complementarity of the nucleotide sequences of ASB16 BINDING SITE, designated SEQ ID:28108, to the nucleotide sequence of VGAM2652 RNA, herein designated VGAM RNA, also designated SEQ ID:5363.

Another function of VGAM2652 is therefore inhibition of Ankyrin Repeat and SOCS Box-containing 16 (ASB16, Accession NM_080863). Accordingly, utilities of VGAM2652 include diagnosis, prevention and treatment of diseases and clinical conditions associated with ASB16. BA108L7.2 (Accession NM_030971) is another VGAM2652 host target gene. BA108L7.2 BINDING SITE is HOST TARGET binding site found in the 3" untranslated region of mRNA encoded by BA108L7.2, corresponding to a HOST TARGET binding site such as BINDING SITE I, BINDING SITE II or BINDING SITE III. Table 2 illustrates the complementarity of the nucleotide sequences of BA108L7.2 BINDING SITE, designated SEQ ID:25241, to the nucleotide sequence of VGAM2652 RNA, herein designated VGAM RNA, also designated SEQ ID:5363.

Another function of VGAM2652 is therefore inhibition of BA108L7.2 (Accession NM_030971). Accordingly, utilities of VGAM2652 include diagnosis, prevention and treatment of diseases and clinical conditions associated with BA108L7.2. C6orf5 (Accession NM_015524) is another VGAM2652 host target gene. C6orf5 BINDING SITE is HOST TARGET binding site found in the 3' untranslated region of mRNA encoded by C6orf5, corresponding to a HOST TARGET binding site such as BINDING SITE I, BINDING SITE II or BINDING SITE III. Table 2 illustrates the complementarity of the nucleotide sequences of C6orf5 BINDING SITE, designated SEQ ID:17782, to the nucleotide sequence of VGAM2652 RNA, herein designated VGAM RNA, also designated SEQ ID:5363.

Another function of VGAM2652 is therefore inhibition of C6orf5 (Accession NM_015524). Accordingly, utilities of VGAM2652 include diagnosis, prevention and treatment of diseases and clinical conditions associated with C6orf5. Chromatin Accessibility Complex 1 (CHRAC1, Accession NM_017444) is another VGAM2652 host target gene. CHRAC1 BINDING SITE is HOST TARGET binding site found in the 3' untranslated region of mRNA encoded by CHRAC1, corresponding to a HOST TARGET binding site such as BINDING SITE I, BINDING SITE II or BINDING SITE III. Table 2 illustrates the complementarity of the nucleotide sequences of CHRAC1 BINDING SITE, designated SEQ ID:18907, to the nucleotide sequence of VGAM2652 RNA, herein designated VGAM RNA, also designated SEQ ID:5363.

Another function of VGAM2652 is therefore inhibition of Chromatin Accessibility Complex 1 (CHRAC1, Accession NM_017444). Accordingly, utilities of VGAM2652 include diagnosis, prevention and treatment of diseases and clinical conditions associated with CHRAC1. Collectin Sub-family Member 12 (COLEC12, Accession NM_030781) is another VGAM2652 host target gene. COLEC12 BINDING SITE is HOST TARGET binding site found in the 3' untranslated region of mRNA encoded by COLEC12, corresponding to a HOST TARGET binding site such as BINDING SITE I, BINDING SITE II or BINDING SITE III. Table 2 illustrates the complementarity of the nucleotide sequences of COLEC12 BINDING SITE, designated SEQ ID:25071, to the nucleotide sequence of VGAM2652 RNA, herein designated VGAM RNA, also designated SEQ ID:5363.

Another function of VGAM2652 is therefore inhibition of Collectin Sub-family Member 12 (COLEC12, Accession NM_030781). Accordingly, utilities of VGAM2652 include diagnosis, prevention and treatment of diseases and clinical conditions associated with COLEC12. Cylicin, Basic Protein of Sperm Head Cytoskeleton 2 (CYLC2, Accession NM_001340) is another VGAM2652 host target gene. CYLC2 BINDING SITE is HOST TARGET binding site found in the 3' untranslated region of mRNA encoded by CYLC2, corresponding to a HOST TARGET binding site such as BINDING SITE I, BINDING SITE II or BINDING SITE III. Table 2 illustrates the complementarity of the nucleotide sequences of CYLC2 BINDING SITE, designated SEQ ID:7019, to the nucleotide sequence of VGAM2652 RNA, herein designated VGAM RNA, also designated SEQ ID:5363.

Another function of VGAM2652 is therefore inhibition of Cylicin, Basic Protein of Sperm Head Cytoskeleton 2 (CYLC2, Accession NM_001340). Accordingly, utilities of VGAM2652 include diagnosis, prevention and treatment of diseases and clinical conditions associated with CYLC2. DKFZp434A2417 (Accession XM_038526) is another VGAM2652 host target gene. DKFZp434A2417 BINDING SITE is HOST TARGET binding site found in the 3' untranslated region of mRNA encoded by DKFZp434A2417, corresponding to a HOST TARGET binding site such as BINDING SITE I, BINDING SITE II or BINDING SITE III. Table 2 illustrates the complementarity of the nucleotide sequences of DKFZp434A2417 BINDING SITE, designated SEQ ID:32865, to the nucleotide sequence of VGAM2652 RNA, herein designated VGAM RNA, also designated SEQ ID:5363.

Another function of VGAM2652 is therefore inhibition of DKFZp434A2417 (Accession XM_038526). Accordingly, utilities of VGAM2652 include diagnosis, prevention and treatment of diseases and clinical conditions associated with DKFZp434A2417. DKFZP434D146 (Accession NM_015595) is another VGAM2652 host target gene. DKFZP434D146 BINDING SITE is HOST TARGET binding site found in the 3' untranslated region of mRNA encoded by DKFZP434D146, corresponding to a HOST TARGET binding site such as BINDING SITE I, BINDING SITE II or BINDING SITE III. Table 2 illustrates the complementarity of the nucleotide sequences of DKFZP434D146 BINDING SITE, designated SEQ ID:17873, to the nucleotide sequence of VGAM2652 RNA, herein designated VGAM RNA, also designated SEQ ID:5363.

Another function of VGAM2652 is therefore inhibition of DKFZP434D146 (Accession NM_015595). Accordingly, utilities of VGAM2652 include diagnosis, prevention and treatment of diseases and clinical conditions associated with DKFZP434D146. DKFZp547H025 (Accession NM_020161) is another VGAM2652 host target gene. DKFZp547H025 BINDING SITE is HOST TARGET binding site found in the 3' untranslated region of mRNA encoded by DKFZp547H025, corresponding to a HOST TARGET binding site such as BINDING SITE I, BINDING SITE II or BINDING SITE III. Table 2 illustrates the complementarity of the nucleotide sequences of DKFZp547H025 BINDING SITE, designated SEQ ID:21374, to the nucleotide sequence of VGAM2652 RNA, herein designated VGAM RNA, also designated SEQ ID:5363.

Another function of VGAM2652 is therefore inhibition of DKFZp547H025 (Accession NM_020161). Accordingly, utilities of VGAM2652 include diagnosis, prevention and treatment of diseases and clinical conditions associated with DKFZp547H025. DKFZP564G092 (Accession NM_015601) is another VGAM2652 host target gene. DKFZP564G092 BINDING SITE is HOST TARGET binding site found in the 5' untranslated region of mRNA encoded by DKFZP564G092, corresponding to a HOST TARGET binding site such as BINDING SITE I, BINDING SITE II or BINDING SITE III. Table 2 illustrates the complementarity of the nucleotide sequences of DKFZP564G092 BINDING SITE, designated SEQ ID:17877, to the nucleotide sequence of VGAM2652 RNA, herein designated VGAM RNA, also designated SEQ ID:5363.

Another function of VGAM2652 is therefore inhibition of DKFZP564G092 (Accession NM_015601). Accordingly, utilities of VGAM2652 include diagnosis, prevention and treatment of diseases and clinical conditions associated with DKFZP564G092. Ecotropic Viral Integration Site 5 (EVI5, Accession NM_005665) is another VGAM2652 host target gene. EVI5 BINDING SITE is HOST TARGET binding site found in the 3' untranslated region of mRNA encoded by EVI5, corresponding to a HOST TARGET binding site such as BINDING SITE I, BINDING SITE II or BINDING SITE III. Table 2 illustrates the complementarity of the nucleotide sequences of EVI5 BINDING SITE, designated SEQ ID:12208, to the nucleotide sequence of VGAM2652 RNA, herein designated VGAM RNA, also designated SEQ ID:5363.

Another function of VGAM2652 is therefore inhibition of Ecotropic Viral Integration Site 5 (EVI5, Accession NM_005665). Accordingly, utilities of VGAM2652 include diagnosis, prevention and treatment of diseases and clinical conditions associated with EVI5. FLJ12687 (Accession NM_024917) is another VGAM2652 host target gene. FLJ12687 BINDING SITE is HOST TARGET binding site found in the 3' untranslated region of mRNA encoded by FLJ12687, corresponding to a HOST TARGET binding site such as BINDING SITE I, BINDING SITE II or BINDING SITE III. Table 2 illustrates the complementarity of the nucleotide sequences of FLJ12687 BINDING SITE, designated SEQ ID:24446, to the nucleotide sequence of VGAM2652 RNA, herein designated VGAM RNA, also designated SEQ ID:5363.

Another function of VGAM2652 is therefore inhibition of FLJ12687 (Accession NM_024917). Accordingly, utilities of VGAM2652 include diagnosis, prevention and treatment of diseases and clinical conditions associated with FLJ12687. FLJ13188 (Accession NM_022063) is another VGAM2652 host target gene. FLJ13188 BINDING SITE is HOST TARGET binding site found in the 3' untranslated region of mRNA encoded by FLJ13188, corresponding to a HOST TARGET binding site such as BINDING SITE I, BINDING SITE II or BINDING SITE III. Table 2 illustrates the complementarity of the nucleotide sequences of FLJ13188 BINDING SITE, designated SEQ ID:22608, to the nucleotide sequence of VGAM2652 RNA, herein designated VGAM RNA, also designated SEQ ID:5363.

Another function of VGAM2652 is therefore inhibition of FLJ13188 (Accession NM_022063). Accordingly, utilities of VGAM2652 include diagnosis, prevention and treatment of diseases and clinical conditions associated with FLJ13188. FLJ14957 (Accession NM_032866) is another VGAM2652 host target gene. FLJ14957 BINDING SITE is HOST TARGET binding site found in the 3' untranslated region of mRNA encoded by FLJ14957, corresponding to a HOST TARGET binding site such as BINDING SITE I, BINDING SITE II or BINDING SITE III. Table 2 illustrates the complementarity of the nucleotide sequences of FLJ14957 BINDING SITE, designated SEQ ID:26683, to the nucleotide sequence of VGAM2652 RNA, herein designated VGAM RNA, also designated SEQ ID:5363.

Another function of VGAM2652 is therefore inhibition of FLJ14957 (Accession NM_032866). Accordingly, utilities of VGAM2652 include diagnosis, prevention and treatment of diseases and clinical conditions associated with FLJ14957. FLJ20034 (Accession NM_017630) is another VGAM2652 host target gene. FLJ20034 BINDING SITE is HOST TARGET binding site found in the 3' untranslated region of mRNA encoded by FLJ20034, corresponding to a HOST TARGET binding site such as BINDING SITE I, BINDING SITE II or BINDING SITE III. Table 2 illustrates the complementarity of the nucleotide sequences of FLJ20034 BINDING SITE, designated SEQ ID:19137, to the nucleotide sequence of VGAM2652 RNA, herein designated VGAM RNA, also designated SEQ ID:5363.

Another function of VGAM2652 is therefore inhibition of FLJ20034 (Accession NM_017630). Accordingly, utilities of VGAM2652 include diagnosis, prevention and treatment of diseases and clinical conditions associated with FLJ20034. FLJ22002 (Accession NM_024838) is another VGAM2652 host target gene. FLJ22002 BINDING SITE is HOST TARGET binding site found in the 3' untranslated region of mRNA encoded by FLJ22002, corresponding to a HOST TARGET binding site such as BINDING SITE I, BINDING SITE II or BINDING SITE III. Table 2 illustrates the complementarity of the nucleotide sequences of FLJ22002 BINDING SITE, designated SEQ ID:24248, to the nucleotide sequence of VGAM2652 RNA, herein designated VGAM RNA, also designated SEQ ID:5363.

Another function of VGAM2652 is therefore inhibition of FLJ22002 (Accession NM_024838). Accordingly, utilities of VGAM2652 include diagnosis, prevention and treatment of diseases and clinical conditions associated with FLJ22002. FLJ22531 (Accession NM_024650) is another VGAM2652 host target gene. FLJ22531 BINDING SITE is HOST TARGET binding site found in the 5' untranslated region of mRNA encoded by FLJ22531, corresponding to a HOST TARGET binding site such as BINDING SITE I, BINDING SITE II or BINDING SITE III. Table 2 illustrates the complementarity of the nucleotide sequences of FLJ22531 BINDING SITE, designated SEQ ID:23947, to the nucleotide sequence of VGAM2652 RNA, herein designated VGAM RNA, also designated SEQ ID:5363.

Another function of VGAM2652 is therefore inhibition of FLJ22531 (Accession NM_024650). Accordingly, utilities of VGAM2652 include diagnosis, prevention and treatment of diseases and clinical conditions associated with FLJ22531. FLJ22794 (Accession XM_166220) is another VGAM2652 host target gene. FLJ22794 BINDING SITE is HOST TARGET binding site found in the 3' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44036, to the nucleotide sequence of VGAM2652 RNA, herein designated VGAM RNA, also designated SEQ ID:5363.

Another function of VGAM2652 is therefore inhibition of FLJ22794 (Accession XM_166220). Accordingly, utilities of VGAM2652 include diagnosis, prevention and treatment of diseases and clinical conditions associated with FLJ22794. FLJ31153 (Accession NM_144600) is another VGAM2652 host target gene. FLJ31153 BINDING SITE is HOST TARGET binding site found in the 3' untranslated region of mRNA encoded by FLJ31153, corresponding to a HOST TARGET binding site such as BINDING SITE I, BINDING SITE II or BINDING SITE III. Table 2 illustrates the complementarity of the nucleotide sequences of FLJ31153 BINDING SITE, designated SEQ ID:29414, to the nucleotide sequence of VGAM2652 RNA, herein designated VGAM RNA, also designated SEQ ID:5363.

Another function of VGAM2652 is therefore inhibition of FLJ31153 (Accession NM_144600). Accordingly, utilities of VGAM2652 include diagnosis, prevention and treatment of diseases and clinical conditions associated with FLJ31153. FLJ32865 (Accession NM_144613) is another VGAM2652 host target gene. FLJ32865 BINDING SITE is HOST TARGET binding site found in the 3' untranslated region of mRNA encoded by FLJ32865, corresponding to a HOST TARGET binding site such as BINDING SITE I, BINDING SITE II or BINDING SITE III. Table 2 illustrates the complementarity of the nucleotide sequences of FLJ32865 BINDING SITE, designated SEQ ID:29431, to the nucleotide sequence of VGAM2652 RNA, herein designated VGAM RNA, also designated SEQ ID:5363.

Another function of VGAM2652 is therefore inhibition of FLJ32865 (Accession NM_144613). Accordingly, utilities of VGAM2652 include diagnosis, prevention and treatment of diseases and clinical conditions associated with FLJ32865. Glycoprotein V (platelet) (GP5, Accession NM_004488) is another VGAM2652 host target gene. GP5 BINDING SITE is HOST TARGET binding site found in the 3' untranslated region of mRNA encoded by GP5, corresponding to a HOST TARGET binding site such as BINDING SITE I, BINDING SITE II or BINDING SITE III. Table 2 illustrates the complementarity of the nucleotide sequences of GP5 BINDING SITE, designated SEQ ID:10822, to the nucleotide sequence of VGAM2652 RNA, herein designated VGAM RNA, also designated SEQ ID:5363.

Another function of VGAM2652 is therefore inhibition of Glycoprotein V (platelet) (GP5, Accession NM_004488). Accordingly, utilities of VGAM2652 include diagnosis, prevention and treatment of diseases and clinical conditions associated with GP5. GTPBG3 (Accession NM_032620) is another VGAM2652 host target gene. GTPBG3 BINDING SITE is HOST TARGET binding site found in the 3' untranslated region of mRNA encoded by GTPBG3, corresponding to a HOST TARGET binding site such as BINDING SITE I, BINDING SITE II or BINDING SITE III. Table 2 illustrates the complementarity of the nucleotide sequences of GTPBG3 BINDING SITE, designated SEQ ID:26334, to the nucleotide sequence of VGAM2652 RNA, herein designated VGAM RNA, also designated SEQ ID:5363.

Another function of VGAM2652 is therefore inhibition of GTPBG3 (Accession NM_032620). Accordingly, utilities of VGAM2652 include diagnosis, prevention and treatment of diseases and clinical conditions associated with GTPBG3. Histamine Receptor H4 (HRH4, Accession NM_021624) is another VGAM2652 host target gene. HRH4 BINDING SITE is HOST TARGET binding site found in the 3' untranslated region of mRNA encoded by HRH4, corresponding to a HOST TARGET binding site such as BINDING SITE I, BINDING SITE II or BINDING SITE III. Table 2 illustrates the complementarity of the nucleotide sequences of HRH4 BINDING SITE, designated SEQ ID:22262, to the nucleotide sequence of VGAM2652 RNA, herein designated VGAM RNA, also designated SEQ ID:5363.

Another function of VGAM2652 is therefore inhibition of Histamine Receptor H4 (HRH4, Accession NM_021624). Accordingly, utilities of VGAM2652 include diagnosis, prevention and treatment of diseases and clinical conditions associated with HRH4. HSMPP8 (Accession XM_167894) is another VGAM2652 host target gene. HSMPP8 BINDING SITE is HOST TARGET binding site found in the 3' untranslated region of mRNA encoded by HSMPP8, corresponding to a HOST TARGET binding site such as BINDING SITE I, BINDING SITE II or BINDING SITE III. Table 2 illustrates the complementarity of the nucleotide sequences of HSMPP8 BINDING SITE, designated SEQ ID:44904, to the nucleotide sequence of VGAM2652 RNA, herein designated VGAM RNA, also designated SEQ ID:5363.

Another function of VGAM2652 is therefore inhibition of HSMPP8 (Accession XM_167894). Accordingly, utilities of VGAM2652 include diagnosis, prevention and treatment of diseases and clinical conditions associated with HSMPP8. KIAA0472 (Accession XM_050147) is another VGAM2652 host target gene. KIAA0472 BINDING SITE is HOST TARGET binding site found in the 5' untranslated region of mRNA encoded by KIAA0472, corresponding to a HOST TARGET binding site such as BINDING SITE I, BINDING SITE II or BINDING SITE III. Table 2 illustrates the complementarity of the nucleotide sequences of KIAA0472 BINDING SITE, designated SEQ ID:35582, to the nucleotide sequence of VGAM2652 RNA, herein designated VGAM RNA, also designated SEQ ID:5363.

Another function of VGAM2652 is therefore inhibition of KIAA0472 (Accession XM_050147). Accordingly, utilities of VGAM2652 include diagnosis, prevention and treatment of diseases and clinical conditions associated with KIAA0472. KIAA0513 (Accession NM_014732) is another VGAM2652 host target gene. KIAA0513 BINDING SITE is HOST TARGET binding site found in the 5' untranslated region of mRNA encoded by KIAA0513, corresponding to a HOST TARGET binding site such as BINDING SITE I, BINDING SITE II or BINDING SITE III. Table 2 illustrates the complementarity of the nucleotide sequences of KIAA0513 BINDING SITE, designated SEQ ID:16360, to the nucleotide sequence of VGAM2652 RNA, herein designated VGAM RNA, also designated SEQ ID:5363.

Another function of VGAM2652 is therefore inhibition of KIAA0513 (Accession NM_014732). Accordingly, utilities of VGAM2652 include diagnosis, prevention and treatment of diseases and clinical conditions associated with KIAA0513. KIAA0555 (Accession NM_014790) is another VGAM2652 host target gene. KIAA0555 BINDING SITE is HOST TARGET binding site found in the 3' untranslated region of mRNA encoded by KIAA0555, corresponding to a HOST TARGET binding site such as BINDING SITE I, BINDING SITE II or BINDING SITE III. Table 2 illustrates the complementarity of the nucleotide sequences of KIAA0555 BINDING SITE, designated SEQ ID:16686, to the nucleotide sequence of VGAM2652 RNA, herein designated VGAM RNA, also designated SEQ ID:5363.

Another function of VGAM2652 is therefore inhibition of KIAA0555 (Accession NM_014790). Accordingly, utilities of VGAM2652 include diagnosis, prevention and treatment of diseases and clinical conditions associated with KIAA0555. KIAA0557 (Accession XM_085507) is another VGAM2652 host target gene. KIAA0557 BINDING SITE is HOST TARGET binding site found in the 3' untranslated region of mRNA encoded by KIAA0557, corresponding to a HOST TARGET binding site such as BINDING SITE I, BINDING SITE II or BINDING SITE III. Table 2 illustrates the complementarity of the nucleotide sequences of KIAA0557 BINDING SITE, designated SEQ ID:38210, to the nucleotide sequence of VGAM2652 RNA, herein designated VGAM RNA, also designated SEQ ID:5363.

Another function of VGAM2652 is therefore inhibition of KIAA0557 (Accession XM_085507). Accordingly, utilities of VGAM2652 include diagnosis, prevention and treatment of diseases and clinical conditions associated with KIAA0557. KIAA0836 (Accession XM_035390) is another VGAM2652 host target gene. KIAA0836 BINDING SITE is HOST TARGET binding site found in the 3' untranslated region of mRNA encoded by KIAA0836, corresponding to a HOST TARGET binding site such as BINDING SITE I, BINDING SITE II or BINDING SITE III. Table 2 illustrates the complementarity of the nucleotide sequences of KIAA0836 BINDING SITE, designated SEQ ID:32248, to the nucleotide sequence of VGAM2652 RNA, herein designated VGAM RNA, also designated SEQ ID:5363.

Another function of VGAM2652 is therefore inhibition of KIAA0836 (Accession XM_035390). Accordingly, utilities of VGAM2652 include diagnosis, prevention and treatment of diseases and clinical conditions associated with KIAA0836. KIAA0924 (Accession NM_014897) is another VGAM2652 host target gene. KIAA0924 BINDING SITE is HOST TARGET binding site found in the 3' untranslated region of mRNA encoded by KIAA0924, corresponding to a HOST TARGET binding site such as BINDING SITE I, BINDING SITE II or BINDING SITE III. Table 2 illustrates the complementarity of the nucleotide sequences of KIAA0924 BINDING SITE, designated SEQ ID:17066, to the nucleotide sequence of VGAM2652 RNA, herein designated VGAM RNA, also designated SEQ ID:5363.

Another function of VGAM2652 is therefore inhibition of KIAA0924 (Accession NM_014897). Accordingly, utilities of VGAM2652 include diagnosis, prevention and treatment of diseases and clinical conditions associated with KIAA0924. KIAA1028 (Accession XM_166324) is another VGAM2652 host target gene. KIAA1028 BINDING SITE is HOST TARGET binding site found in the 3' untranslated region of mRNA encoded by KIAA1028, corresponding to a HOST TARGET binding site such as BINDING SITE I, BINDING SITE II or BINDING SITE III. Table 2 illustrates the complementarity of the nucleotide sequences of KIAA1028 BINDING SITE, designated SEQ ID:44163, to the nucleotide sequence of VGAM2652 RNA, herein designated VGAM RNA, also designated SEQ ID:5363.

Another function of VGAM2652 is therefore inhibition of KIAA1028 (Accession XM_166324). Accordingly, utilities of VGAM2652 include diagnosis, prevention and treatment of diseases and clinical conditions associated with KIAA1028. KIAA1373 (Accession XM_048195) is another VGAM2652 host target gene. KIAA1373 BINDING SITE is HOST TARGET binding site found in the 3' untranslated region of mRNA encoded by KIAA1373, corresponding to a HOST TARGET binding site such as BINDING SITE I, BINDING SITE II or BINDING SITE III. Table 2 illustrates the complementarity of the nucleotide sequences of KIAA1373 BINDING SITE, designated SEQ ID:35129, to the nucleotide sequence of VGAM2652 RNA, herein designated VGAM RNA, also designated SEQ ID:5363.

Another function of VGAM2652 is therefore inhibition of KIAA1373 (Accession XM_048195). Accordingly, utilities of VGAM2652 include diagnosis, prevention and treatment of diseases and clinical conditions associated with KIAA1373. KIAA1473 (Accession XM_047550) is another VGAM2652 host target gene. KIAA1473 BINDING SITE is HOST TARGET binding site found in the 3' untranslated region of mRNA encoded by KIAA1473, corresponding to a HOST TARGET binding site such as BINDING SITE I, BINDING SITE II or BINDING SITE III. Table 2 illustrates the complementarity of the nucleotide sequences of KIAA1473 BINDING SITE, designated SEQ ID:34997, to the nucleotide sequence of VGAM2652 RNA, herein designated VGAM RNA, also designated SEQ ID:5363.

Another function of VGAM2652 is therefore inhibition of KIAA1473 (Accession XM_047550). Accordingly, utilities of VGAM2652 include diagnosis, prevention and treatment of diseases and clinical conditions associated with KIAA1473. KIAA1617 (Accession XM_166140) is another VGAM2652 host target gene. KIAA1617 BINDING SITE is HOST TARGET binding site found in the 3' untranslated region of mRNA encoded by KIAA1617, corresponding to a HOST TARGET binding site such as BINDING SITE I, BINDING SITE II or BINDING SITE III. Table 2 illustrates the complementarity of the nucleotide sequences of KIAA1617 BINDING SITE, designated SEQ ID:43944, to the nucleotide sequence of VGAM2652 RNA, herein designated VGAM RNA, also designated SEQ ID:5363.

Another function of VGAM2652 is therefore inhibition of KIAA1617 (Accession XM_166140). Accordingly, utilities of VGAM2652 include diagnosis, prevention and treatment of diseases and clinical conditions associated with KIAA1617. KIAA1712 (Accession XM_041497) is another VGAM2652 host target gene. KIAA1712 BINDING SITE is HOST TARGET binding site found in the 3' untranslated region of mRNA encoded by KIAA1712, corresponding to a HOST TARGET binding site such as BINDING SITE I, BINDING SITE II or BINDING SITE III. Table 2 illustrates the complementarity of the nucleotide sequences of KIAA1712 BINDING SITE, designated SEQ ID:33539, to the nucleotide sequence of VGAM2652 RNA, herein designated VGAM RNA, also designated SEQ ID:5363.

Another function of VGAM2652 is therefore inhibition of KIAA1712 (Accession XM_041497). Accordingly, utilities of VGAM2652 include diagnosis, prevention and treatment of diseases and clinical conditions associated with KIAA1712. KIAA1737 (Accession XM_041115) is another VGAM2652 host target gene. KIAA1737 BINDING SITE is HOST TARGET binding site found in the 3' untranslated region of mRNA encoded by KIAA1737, corresponding to a HOST TARGET binding site such as BINDING SITE I, BINDING SITE II or BINDING SITE III. Table 2 illustrates the complementarity of the nucleotide sequences of KIAA1737 BINDING SITE, designated SEQ ID:33449, to the nucleotide sequence of VGAM2652 RNA, herein designated VGAM RNA, also designated SEQ ID:5363.

Another function of VGAM2652 is therefore inhibition of KIAA1737 (Accession XM_041115). Accordingly, utilities of VGAM2652 include diagnosis, prevention and treatment of diseases and clinical conditions associated with KIAA1737. KIAA1826 (Accession XM_040784) is another VGAM2652 host target gene. KIAA1826 BINDING SITE is HOST TARGET binding site found in the 3' untranslated region of mRNA encoded by KIAA1826, corresponding to a HOST TARGET binding site such as BINDING SITE I, BINDING SITE II or BINDING SITE III. Table 2 illustrates the complementarity of the nucleotide sequences of KIAA1826 BINDING SITE, designated SEQ ID:33376, to the nucleotide sequence of VGAM2652 RNA, herein designated VGAM RNA, also designated SEQ ID:5363.

Another function of VGAM2652 is therefore inhibition of KIAA1826 (Accession XM_040784). Accordingly, utilities of VGAM2652 include diagnosis, prevention and treatment of diseases and clinical conditions associated with KIAA1826. MGC4638 (Accession NM_031479) is another VGAM2652 host target gene. MGC4638 BINDING SITE is HOST TARGET binding site found in the 3' untranslated region of mRNA encoded by MGC4638, corresponding to a HOST TARGET binding site such as BINDING SITE I, BINDING SITE II or BINDING SITE III. Table 2 illustrates the complementarity of the nucleotide sequences of MGC4638 BINDING SITE, designated SEQ ID:25558, to the nucleotide sequence of VGAM2652 RNA, herein designated VGAM RNA, also designated SEQ ID:5363.

Another function of VGAM2652 is therefore inhibition of MGC4638 (Accession NM_031479). Accordingly, utilities of VGAM2652 include diagnosis, prevention and treatment of diseases and clinical conditions associated with MGC4638. Mitochondrial Ribosomal Protein L44 (MRPL44, Accession NM_022915) is another VGAM2652 host target gene. MRPL44 BINDING SITE is HOST TARGET binding site found in the 3' untranslated region of mRNA encoded by MRPL44, corresponding to a HOST TARGET binding site such as BINDING SITE I, BINDING SITE II or BINDING SITE III. Table 2 illustrates the complementarity of the nucleotide sequences of MRPL44 BINDING SITE, designated SEQ ID:23228, to the nucleotide sequence of VGAM2652 RNA, herein designated VGAM RNA, also designated SEQ ID:5363.

Another function of VGAM2652 is therefore inhibition of Mitochondrial Ribosomal Protein L44 (MRPL44, Accession NM_022915). Accordingly, utilities of VGAM2652 include diagnosis, prevention and treatment of diseases and clinical conditions associated with MRPL44. NDP52 (Accession NM_005831) is another VGAM2652 host target gene. NDP52 BINDING SITE is HOST TARGET binding site found in the 3' untranslated region of mRNA encoded by NDP52, corresponding to a HOST TARGET binding site such as BINDING SITE I, BINDING SITE II or BINDING SITE III. Table 2 illustrates the complementarity of the nucleotide sequences of NDP52 BINDING SITE, designated SEQ ID:12445, to the nucleotide sequence of VGAM2652 RNA, herein designated VGAM RNA, also designated SEQ ID:5363.

Another function of VGAM2652 is therefore inhibition of NDP52 (Accession NM_005831). Accordingly, utilities of VGAM2652 include diagnosis, prevention and treatment of diseases and clinical conditions associated with NDP52. Nucleoredoxin (NXN, Accession NM_022463) is another VGAM2652 host target gene. NXN BINDING SITE is HOST TARGET binding site found in the 3' untranslated region of mRNA encoded by NXN, corresponding to a HOST TARGET binding site such as BINDING SITE I, BINDING SITE II or BINDING SITE III. Table 2 illustrates the complementarity of the nucleotide sequences of NXN BINDING SITE, designated SEQ ID:22812, to the nucleotide sequence of VGAM2652 RNA, herein designated VGAM RNA, also designated SEQ ID:5363.

Another function of VGAM2652 is therefore inhibition of Nucleoredoxin (NXN, Accession NM_022463). Accordingly, utilities of VGAM2652 include diagnosis, prevention and treatment of diseases and clinical conditions associated with NXN. PRO0529 (Accession NM_014074) is another VGAM2652 host target gene. PRO0529 BINDING SITE is HOST TARGET binding site found in the 5' untranslated region of mRNA encoded by PRO0529, corresponding to a HOST TARGET binding site such as BINDING SITE I, BINDING SITE II or BINDING SITE III. Table 2 illustrates the complementarity of the nucleotide sequences of PRO0529 BINDING SITE, designated SEQ ID:15300, to the nucleotide sequence of VGAM2652 RNA, herein designated VGAM RNA, also designated SEQ ID:5363.

Another function of VGAM2652 is therefore inhibition of PRO0529 (Accession NM_014074). Accordingly, utilities of VGAM2652 include diagnosis, prevention and treatment of diseases and clinical conditions associated with PRO0529. PRO2955 (Accession NM_018545) is another VGAM2652 host target gene. PRO2955 BINDING SITE is HOST TARGET binding site found in the 3' untranslated region of mRNA encoded by PRO2955, corresponding to a HOST TARGET binding site such as BINDING SITE I, BINDING SITE II or BINDING SITE III. Table 2 illustrates the complementarity of the nucleotide sequences of PRO2955 BINDING SITE, designated SEQ ID:20622, to the nucleotide sequence of VGAM2652 RNA, herein designated VGAM RNA, also designated SEQ ID:5363.

Another function of VGAM2652 is therefore inhibition of PRO2955 (Accession NM_018545). Accordingly, utilities of VGAM2652 include diagnosis, prevention and treatment of diseases and clinical conditions associated with PRO2955. Proline-serine-threonine Phosphatase Interacting Protein 2 (PSTPIP2, Accession NM_024430) is another VGAM2652 host target gene. PSTPIP2 BINDING SITE is HOST TARGET binding site found in the 3' untranslated region of mRNA encoded by PSTPIP2, corresponding to a HOST TARGET binding site such as BINDING SITE I, BINDING SITE II or BINDING SITE III. Table 2 illustrates the complementarity of the nucleotide sequences of PSTPIP2 BINDING SITE, designated SEQ ID:23683, to the nucleotide sequence of VGAM2652 RNA, herein designated VGAM RNA, also designated SEQ ID:5363.

Another function of VGAM2652 is therefore inhibition of Proline-serine-threonine Phosphatase Interacting Protein 2 (PSTPIP2, Accession NM_024430). Accordingly, utilities of VGAM2652 include diagnosis, prevention and treatment of diseases and clinical conditions associated with PSTPIP2. RAB33B, Member RAS Oncogene Family (RAB33B, Accession NM_031296) is another VGAM2652 host target gene. RAB33B BINDING SITE is HOST TARGET binding site found in the 3' untranslated region of mRNA encoded by RAB33B, corresponding to a HOST TARGET binding site such as BINDING SITE I, BINDING SITE II or BINDING SITE III. Table 2 illustrates the complementarity of the nucleotide sequences of RAB33B BINDING SITE, designated SEQ ID:25330, to the nucleotide sequence of VGAM2652 RNA, herein designated VGAM RNA, also designated SEQ ID:5363.

Another function of VGAM2652 is therefore inhibition of RAB33B, Member RAS Oncogene Family (RAB33B, Accession NM_031296). Accordingly, utilities of VGAM2652 include diagnosis, prevention and treatment of diseases and clinical conditions associated with RAB33B. SCAN Domain Containing 2 (SCAND2, Accession NM_022050) is another VGAM2652 host target gene. SCAND2 BINDING SITE is HOST TARGET binding site found in the 3' untranslated region of mRNA encoded by SCAND2, corresponding to a HOST TARGET binding site such as BINDING SITE I, BINDING SITE II or BINDING SITE III. Table 2 illustrates the complementarity of the nucleotide sequences of SCAND2 BINDING SITE, designated SEQ ID:22577, to the nucleotide sequence of VGAM2652 RNA, herein designated VGAM RNA, also designated SEQ ID:5363.

Another function of VGAM2652 is therefore inhibition of SCAN Domain Containing 2 (SCAND2, Accession NM_022050). Accordingly, utilities of VGAM2652 include diagnosis, prevention and treatment of diseases and clinical conditions associated with SCAND2. SCYA22 (Accession XM_165651) is another VGAM2652 host target gene. SCYA22 BINDING SITE is HOST TARGET binding site found in the 3' untranslated region of mRNA encoded by SCYA22, corresponding to a HOST TARGET binding site such as BINDING SITE I, BINDING SITE II or BINDING SITE III. Table 2 illustrates the complementarity of the nucleotide sequences of SCYA22 BINDING SITE, designated SEQ ID:43716, to the nucleotide sequence of VGAM2652 RNA, herein designated VGAM RNA, also designated SEQ ID:5363.

Another function of VGAM2652 is therefore inhibition of SCYA22 (Accession XM_165651). Accordingly, utilities of VGAM2652 include diagnosis, prevention and treatment of diseases and clinical conditions associated with SCYA22. Signal-regulatory Protein Beta 1 (SIRPB1, Accession NM_006065) is another VGAM2652 host target gene. SIRPB1 BINDING SITE is HOST TARGET binding site found in the 3' untranslated region of mRNA encoded by SIRPB1, corresponding to a HOST TARGET binding site such as BINDING SITE I, BINDING SITE II or BINDING SITE III. Table 2 illustrates the complementarity of the nucleotide sequences of SIRPB1 BINDING SITE, designated SEQ ID:12710, to the nucleotide sequence of VGAM2652 RNA, herein designated VGAM RNA, also designated SEQ ID:5363.

Another function of VGAM2652 is therefore inhibition of Signal-regulatory Protein Beta 1 (SIRPB1, Accession NM_006065). Accordingly, utilities of VGAM2652 include diagnosis, prevention and treatment of diseases and clinical conditions associated with SIRPB1. Solute Carrier Family 6 (neurotransmitter transporter), Member 14 (SLC6A14, Accession NM_007231) is another VGAM2652 host target gene. SLC6A14 BINDING SITE is HOST TARGET binding site found in the 3' untranslated region of mRNA encoded by SLC6A14, corresponding to a HOST TARGET binding site such as BINDING SITE I, BINDING SITE II or BINDING SITE III. Table 2 illustrates the complementarity of the nucleotide sequences of SLC6A14 BINDING SITE, designated SEQ ID:14104, to the nucleotide sequence of VGAM2652 RNA, herein designated VGAM RNA, also designated SEQ ID:5363.

Another function of VGAM2652 is therefore inhibition of Solute Carrier Family 6 (neurotransmitter transporter), Member 14 (SLC6A14, Accession NM_007231). Accordingly, utilities of VGAM2652 include diagnosis, prevention and treatment of diseases and clinical conditions associated with SLC6A14. Synaptosomal-associated Protein, 91 kDa Homolog (mouse) (SNAP91, Accession NM_014841) is another VGAM2652 host target gene. SNAP91 BINDING SITE is HOST TARGET binding site found in the 3' untranslated region of mRNA encoded by SNAP91, corresponding to a HOST TARGET binding site such as BINDING SITE I, BINDING SITE II or BINDING SITE III. Table 2 illustrates the complementarity of the nucleotide sequences of SNAP91 BINDING SITE, designated SEQ ID:16871, to the nucleotide sequence of VGAM2652 RNA, herein designated VGAM RNA, also designated SEQ ID:5363.

Another function of VGAM2652 is therefore inhibition of Synaptosomal-associated Protein, 91 kDa Homolog (mouse) (SNAP91, Accession NM_014841). Accordingly, utilities of VGAM2652 include diagnosis, prevention and treatment of diseases and clinical conditions associated with SNAP91. T-cell Leukemia/lymphoma 6 (TCL6, Accession NM_014418) is another VGAM2652 host target gene. TCL6 BINDING SITE1 through TCL6 BINDING SITE4 are HOST TARGET binding sites found in untranslated regions of mRNA encoded by TCL6, corresponding to HOST TARGET binding sites such as BINDING SITE I, BINDING SITE II or BINDING SITE III. Table 2 illustrates the complementarity of the nucleotide sequences of TCL6 BINDING SITE1 through TCL6 BINDING SITE4, designated SEQ ID:15769, SEQ ID:21762, SEQ ID:14845 and SEQ ID:21771 respectively, to the nucleotide sequence of VGAM2652 RNA, herein designated VGAM RNA, also designated SEQ ID:5363.

Another function of VGAM2652 is therefore inhibition of T-cell Leukemia/lymphoma 6 (TCL6, Accession NM_014418). Accordingly, utilities of VGAM2652 include diagnosis, prevention and treatment of diseases and clinical conditions associated with TCL6. TU12B1-TY (Accession NM_016575) is another VGAM2652 host target gene. TU12B1-TY BINDING SITE is HOST TARGET binding site found in the 3' untranslated region of mRNA encoded by TU12B1-TY, corresponding to a HOST TARGET binding site such as BINDING SITE I, BINDING SITE II or BINDING SITE III. Table 2 illustrates the complementarity of the nucleotide sequences of TU12B1-TY BINDING SITE, designated SEQ ID:18650, to the nucleotide sequence of VGAM2652 RNA, herein designated VGAM RNA, also designated SEQ ID:5363.

Another function of VGAM2652 is therefore inhibition of TU12B1-TY (Accession NM_016575). Accordingly, utilities of VGAM2652 include diagnosis, prevention and treatment of diseases and clinical conditions associated with TU12B1-TY. Ubiquitin Specific Protease 3 (USP3, Accession XM_116973) is another VGAM2652 host target gene. USP3 BINDING SITE is HOST TARGET binding site found in the 5' untranslated region of mRNA encoded by USP3, corresponding to a HOST TARGET binding site such as BINDING SITE I, BINDING SITE II or BINDING SITE III. Table 2 illustrates the complementarity of the nucleotide sequences of USP3 BINDING SITE, designated SEQ ID:43172, to the nucleotide sequence of VGAM2652 RNA, herein designated VGAM RNA, also designated SEQ ID:5363.

Another function of VGAM2652 is therefore inhibition of Ubiquitin Specific Protease 3 (USP3, Accession XM_116973). Accordingly, utilities of VGAM2652 include diagnosis, prevention and treatment of diseases and clinical conditions associated with USP3. Zinc Finger Protein 338 (ZNF338, Accession NM_022088) is another VGAM2652 host target gene. ZNF338 BINDING SITE is HOST TARGET binding site found in the 3' untranslated region of mRNA encoded by ZNF338, corresponding to a HOST TARGET binding site such as BINDING SITE I, BINDING SITE II or BINDING SITE III. Table 2 illustrates the complementarity of the nucleotide sequences of ZNF338 BINDING SITE, designated SEQ ID:22634, to the nucleotide sequence of VGAM2652 RNA, herein designated VGAM RNA, also designated SEQ ID:5363.

Another function of VGAM2652 is therefore inhibition of Zinc Finger Protein 338 (ZNF338, Accession NM_022088). Accordingly, utilities of VGAM2652 include diagnosis, prevention and treatment of diseases and clinical conditions associated with ZNF338. LOC113675 (Accession NM_138432) is another VGAM2652 host target gene. LOC113675 BINDING SITE is HOST TARGET binding site found in the 5' untranslated region of mRNA encoded by LOC113675, corresponding to a HOST TARGET binding site such as BINDING SITE I, BINDING SITE II or BINDING SITE III. Table 2 illustrates the complementarity of the nucleotide sequences of LOC113675 BINDING SITE, designated SEQ ID:28796, to the nucleotide sequence of VGAM2652 RNA, herein designated VGAM RNA, also designated SEQ ID:5363.

Another function of VGAM2652 is therefore inhibition of LOC113675 (Accession NM_138432). Accordingly, utilities of VGAM2652 include diagnosis, prevention and treatment of diseases and clinical conditions associated with LOC113675. LOC126364 (Accession XM_065047) is another VGAM2652 host target gene. LOC126364 BINDING SITE is HOST TARGET binding site found in the 3' untranslated region of mRNA encoded by LOC126364, corresponding to a HOST TARGET binding site such as BINDING SITE I, BINDING SITE II or BINDING SITE III. Table 2 illustrates the complementarity of the nucleotide sequences of LOC126364 BINDING SITE, designated SEQ ID:37272, to the nucleotide sequence of VGAM2652 RNA, herein designated VGAM RNA, also designated SEQ ID:5363.

Another function of VGAM2652 is therefore inhibition of LOC126364 (Accession XM_065047). Accordingly, utilities of VGAM2652 include diagnosis, prevention and treatment of diseases and clinical conditions associated with LOC126364. LOC135293 (Accession XM_072402) is another VGAM2652 host target gene. LOC135293 BINDING SITE is HOST TARGET binding site found in the 3' untranslated region of mRNA encoded by LOC135293, corresponding to a HOST TARGET binding site such as BINDING SITE I, BINDING SITE II or BINDING SITE III. Table 2 illustrates the complementarity of the nucleotide sequences of LOC135293 BINDING SITE, designated SEQ ID:37497, to the nucleotide sequence of VGAM2652 RNA, herein designated VGAM RNA, also designated SEQ ID:5363.

Another function of VGAM2652 is therefore inhibition of LOC135293 (Accession XM_072402). Accordingly, utilities of VGAM2652 include diagnosis, prevention and treatment of diseases and clinical conditions associated with LOC135293. LOC143241 (Accession NM_138812) is another VGAM2652 host target gene. LOC143241 BINDING SITE is HOST TARGET binding site found in the 5' untranslated region of mRNA encoded by LOC143241, corresponding to a HOST TARGET binding site such as BINDING SITE I, BINDING SITE II or BINDING SITE III. Table 2 illustrates the complementarity of the nucleotide sequences of LOC143241 BINDING SITE, designated SEQ ID:29036, to the nucleotide sequence of VGAM2652 RNA, herein designated VGAM RNA, also designated SEQ ID:5363.

Another function of VGAM2652 is therefore inhibition of LOC143241 (Accession NM_138812). Accordingly, utilities of VGAM2652 include diagnosis, prevention and treatment of diseases and clinical conditions associated with LOC143241. LOC144524 (Accession XM_096624) is another VGAM2652 host target gene. LOC144524 BINDING SITE is HOST TARGET binding site found in the 5' untranslated region of mRNA encoded by LOC144524, corresponding to a HOST TARGET binding site such as BINDING SITE I, BINDING SITE II or BINDING SITE III. Table 2 illustrates the complementarity of the nucleotide sequences of LOC144524 BINDING SITE, designated SEQ ID:40435, to the nucleotide sequence of VGAM2652 RNA, herein designated VGAM RNA, also designated SEQ ID:5363.

Another function of VGAM2652 is therefore inhibition of LOC144524 (Accession XM_096624). Accordingly, utilities of VGAM2652 include diagnosis, prevention and treatment of diseases and clinical conditions associated with LOC144524. LOC144776 (Accession XM_084964) is another VGAM2652 host target gene. LOC144776 BINDING SITE is HOST TARGET binding site found in the 5' untranslated region of mRNA encoded by LOC144776, corresponding to a HOST TARGET binding site such as BINDING SITE I, BINDING SITE II or BINDING SITE III. Table 2 illustrates the complementarity of the nucleotide sequences of LOC144776 BINDING SITE, designated SEQ ID:37788, to the nucleotide sequence of VGAM2652 RNA, herein designated VGAM RNA, also designated SEQ ID:5363.

Another function of VGAM2652 is therefore inhibition of LOC144776 (Accession XM_084964). Accordingly, utilities of VGAM2652 include diagnosis, prevention and treatment of diseases and clinical conditions associated with LOC144776. LOC145757 (Accession XM_085227) is another VGAM2652 host target gene. LOC145757 BINDING SITE is HOST TARGET binding site found in the 5' untranslated region of mRNA encoded by LOC145757, corresponding to a HOST TARGET binding site such as BINDING SITE I, BINDING SITE II or BINDING SITE III. Table 2 illustrates the complementarity of the nucleotide sequences of LOC145757 BINDING SITE, designated SEQ ID:37974, to the nucleotide sequence of VGAM2652 RNA, herein designated VGAM RNA, also designated SEQ ID:5363.

Another function of VGAM2652 is therefore inhibition of LOC145757 (Accession XM_085227). Accordingly, utilities of VGAM2652 include diagnosis, prevention and treatment of diseases and clinical conditions associated with LOC145757. LOC146050 (Accession XM_085301) is another VGAM2652 host target gene. LOC146050 BINDING SITE is HOST TARGET binding site found in the 3' untranslated region of mRNA encoded by LOC146050, corresponding to a HOST TARGET binding site such as BINDING SITE I, BINDING SITE II or BINDING SITE III. Table 2 illustrates the complementarity of the nucleotide sequences of LOC146050 BINDING SITE, designated SEQ ID:38056, to the nucleotide sequence of VGAM2652 RNA, herein designated VGAM RNA, also designated SEQ ID:5363.

Another function of VGAM2652 is therefore inhibition of LOC146050 (Accession XM_085301). Accordingly, utilities of VGAM2652 include diagnosis, prevention and treatment of diseases and clinical conditions associated with LOC146050. LOC146894 (Accession NM_145273) is another VGAM2652 host target gene. LOC146894 BINDING SITE is HOST TARGET binding site found in the 3' untranslated region of mRNA encoded by LOC146894, corresponding to a HOST TARGET binding site such as BINDING SITE I, BINDING SITE II or BINDING SITE III. Table 2 illustrates the complementarity of the nucleotide sequences of LOC146894 BINDING SITE, designated SEQ ID:29784, to the nucleotide sequence of VGAM2652 RNA, herein designated VGAM RNA, also designated SEQ ID:5363.

Another function of VGAM2652 is therefore inhibition of LOC146894 (Accession NM_145273). Accordingly, utilities of VGAM2652 include diagnosis, prevention and treatment of diseases and clinical conditions associated with LOC146894. LOC147817 (Accession XM_085903) is another VGAM2652 host target gene. LOC147817 BINDING SITE is HOST TARGET binding site found in the 3' untranslated region of mRNA encoded by LOC147817, corresponding to a HOST TARGET binding site such as BINDING SITE I, BINDING SITE II or BINDING SITE III. Table 2 illustrates the complementarity of the nucleotide sequences of LOC147817 BINDING SITE, designated SEQ ID:38388, to the nucleotide sequence of VGAM2652 RNA, herein designated VGAM RNA, also designated SEQ ID:5363.

Another function of VGAM2652 is therefore inhibition of LOC147817 (Accession XM_085903). Accordingly, utilities of VGAM2652 include diagnosis, prevention and treatment of diseases and clinical conditions associated with LOC147817. LOC148189 (Accession XM_086087) is another VGAM2652 host target gene. LOC148189 BINDING SITE is HOST TARGET binding site found in the 5' untranslated region of mRNA encoded by LOC148189, corresponding to a HOST TARGET binding site such as BINDING SITE I, BINDING SITE II or BINDING SITE III. Table 2 illustrates the complementarity of the nucleotide sequences of LOC148189 BINDING SITE, designated SEQ ID:38485, to the nucleotide sequence of VGAM2652 RNA, herein designated VGAM RNA, also designated SEQ ID:5363.

Another function of VGAM2652 is therefore inhibition of LOC148189 (Accession XM_086087). Accordingly, utilities of VGAM2652 include diagnosis, prevention and treatment of diseases and clinical conditions associated with LOC148189. LOC148198 (Accession XM_047554) is another VGAM2652 host target gene. LOC148198 BINDING SITE is HOST TARGET binding site found in the 3' untranslated region of mRNA encoded by LOC148198, corresponding to a HOST TARGET binding site such as BINDING SITE I, BINDING SITE II or BINDING SITE III. Table 2 illustrates the complementarity of the nucleotide sequences of LOC148198 BINDING SITE, designated SEQ ID:35000, to the nucleotide sequence of VGAM2652 RNA, herein designated VGAM RNA, also designated SEQ ID:5363.

Another function of VGAM2652 is therefore inhibition of LOC148198 (Accession XM_047554). Accordingly, utilities of VGAM2652 include diagnosis, prevention and treatment of diseases and clinical conditions associated with LOC148198. LOC149171 (Accession XM_086450) is another VGAM2652 host target gene. LOC149171 BINDING SITE is HOST TARGET binding site found in the 5' untranslated region of mRNA encoded by LOC149171, corresponding to a HOST TARGET binding site such as BINDING SITE I, BINDING SITE II or BINDING SITE III. Table 2 illustrates the complementarity of the nucleotide sequences of LOC149171 BINDING SITE, designated SEQ ID:38668, to the nucleotide sequence of VGAM2652 RNA, herein designated VGAM RNA, also designated SEQ ID:5363.

Another function of VGAM2652 is therefore inhibition of LOC149171 (Accession XM_086450). Accordingly, utilities of VGAM2652 include diagnosis, prevention and treatment of diseases and clinical conditions associated with LOC149171. LOC149267 (Accession NM_138480) is another VGAM2652 host target gene. LOC149267 BINDING SITE is HOST TARGET binding site found in the 3' untranslated region of mRNA encoded by LOC149267, corresponding to a HOST TARGET binding site such as BINDING SITE I, BINDING SITE II or BINDING SITE III. Table 2 illustrates the complementarity of the nucleotide sequences of LOC149267 BINDING SITE, designated SEQ ID:28833, to the nucleotide sequence of VGAM2652 RNA, herein designated VGAM RNA, also designated SEQ ID:5363.

Another function of VGAM2652 is therefore inhibition of LOC149267 (Accession NM_138480). Accordingly, utilities of VGAM2652 include diagnosis, prevention and treatment of diseases and clinical conditions associated with LOC149267. LOC149478 (Accession XM_086536) is another VGAM2652 host target gene. LOC149478 BINDING SITE is HOST TARGET binding site found in the 3' untranslated region of mRNA encoded by LOC149478, corresponding to a HOST TARGET binding site such as BINDING SITE I, BINDING SITE II or BINDING SITE III. Table 2 illustrates the complementarity of the nucleotide sequences of LOC149478 BINDING SITE, designated SEQ ID:38755, to the nucleotide sequence of VGAM2652 RNA, herein designated VGAM RNA, also designated SEQ ID:5363.

Another function of VGAM2652 is therefore inhibition of LOC149478 (Accession XM_086536). Accordingly, utilities of VGAM2652 include diagnosis, prevention and treatment of diseases and clinical conditions associated with LOC149478. LOC149577 (Accession XM_097675) is another VGAM2652 host target gene. LOC149577 BINDING SITE is HOST TARGET binding site found in the 3' untranslated region of mRNA encoded by LOC149577, corresponding to a HOST TARGET binding site such as BINDING SITE I, BINDING SITE II or BINDING SITE III. Table 2 illustrates the complementarity of the nucleotide sequences of LOC149577 BINDING SITE, designated SEQ ID:41023, to the nucleotide sequence of VGAM2652 RNA, herein designated VGAM RNA, also designated SEQ ID:5363.

Another function of VGAM2652 is therefore inhibition of LOC149577 (Accession XM_097675). Accordingly, utilities of VGAM2652 include diagnosis, prevention and treatment of diseases and clinical conditions associated with LOC149577. LOC149711 (Accession XM_097720) is another VGAM2652 host target gene. LOC149711 BINDING SITE is HOST TARGET binding site found in the 3' untranslated region of mRNA encoded by LOC149711, corresponding to a HOST TARGET binding site such as BINDING SITE I, BINDING SITE II or BINDING SITE III. Table 2 illustrates the complementarity of the nucleotide sequences of LOC149711 BINDING SITE, designated SEQ ID:41075, to the nucleotide sequence of VGAM2652 RNA, herein designated VGAM RNA, also designated SEQ ID:5363.

Another function of VGAM2652 is therefore inhibition of LOC149711 (Accession XM_097720). Accordingly, utilities of VGAM2652 include diagnosis, prevention and treatment of diseases and clinical conditions associated with LOC149711. LOC150054 (Accession XM_097797) is another VGAM2652 host target gene. LOC150054 BINDING SITE is HOST TARGET binding site found in the 5' untranslated region of mRNA encoded by LOC150054, corresponding to a HOST TARGET binding site such as BINDING SITE I, BINDING SITE II or BINDING SITE III. Table 2 illustrates the complementarity of the nucleotide sequences of LOC150054 BINDING SITE, designated SEQ ID:41126, to the nucleotide sequence of VGAM2652 RNA, herein designated VGAM RNA, also designated SEQ ID:5363.

Another function of VGAM2652 is therefore inhibition of LOC150054 (Accession XM_097797). Accordingly, utilities of VGAM2652 include diagnosis, prevention and treatment of diseases and clinical conditions associated with LOC150054. LOC150696 (Accession NM_144707) is another VGAM2652 host target gene. LOC150696 BINDING SITE is HOST TARGET binding site found in the 3' untranslated region of mRNA encoded by LOC150696, corresponding to a HOST TARGET binding site such as BINDING SITE I, BINDING SITE II or BINDING SITE III. Table 2 illustrates the complementarity of the nucleotide sequences of LOC150696 BINDING SITE, designated SEQ ID:29530, to the nucleotide sequence of VGAM2652 RNA, herein designated VGAM RNA, also designated SEQ ID:5363.

Another function of VGAM2652 is therefore inhibition of LOC150696 (Accession NM_144707). Accordingly, utilities of VGAM2652 include diagnosis, prevention and treatment of diseases and clinical conditions associated with LOC150696. LOC151057 (Accession XM_097998) is another VGAM2652 host target gene. LOC151057 BINDING SITE is HOST TARGET binding site found in the 3' untranslated region of mRNA encoded by LOC151057, corresponding to a HOST TARGET binding site such as BINDING SITE I, BINDING SITE II or BINDING SITE III. Table 2 illustrates the complementarity of the nucleotide sequences of LOC151057 BINDING SITE, designated SEQ ID:41295, to the nucleotide sequence of VGAM2652 RNA, herein designated VGAM RNA, also designated SEQ ID:5363.

Another function of VGAM2652 is therefore inhibition of LOC151057 (Accession XM_097998). Accordingly, utilities of VGAM2652 include diagnosis, prevention and treatment of diseases and clinical conditions associated with LOC151057. LOC152300 (Accession XM_087432) is another VGAM2652 host target gene. LOC152300 BINDING SITE is HOST TARGET binding site found in the 3' untranslated region of mRNA encoded by LOC152300, corresponding to a HOST TARGET binding site such as BINDING SITE I, BINDING SITE II or BINDING SITE III. Table 2 illustrates the complementarity of the nucleotide sequences of LOC152300 BINDING SITE, designated SEQ ID:39252, to the nucleotide sequence of VGAM2652 RNA, herein designated VGAM RNA, also designated SEQ ID:5363.

Another function of VGAM2652 is therefore inhibition of LOC152300 (Accession XM_087432). Accordingly, utilities of VGAM2652 include diagnosis, prevention and treatment of diseases and clinical conditions associated with LOC152300. LOC152925 (Accession XM_087559) is another VGAM2652 host target gene. LOC152925 BINDING SITE is HOST TARGET binding site found in the 3' untranslated region of mRNA encoded by LOC152925, corresponding to a HOST TARGET binding site such as BINDING SITE I, BINDING SITE II or BINDING SITE III. Table 2 illustrates the complementarity of the nucleotide sequences of LOC152925 BINDING SITE, designated SEQ ID:39336, to the nucleotide sequence of VGAM2652 RNA, herein designated VGAM RNA, also designated SEQ ID:5363.

Another function of VGAM2652 is therefore inhibition of LOC152925 (Accession XM_087559). Accordingly, utilities of VGAM2652 include diagnosis, prevention and treatment of diseases and clinical conditions associated with LOC152925. LOC157858 (Accession XM_098833) is another VGAM2652 host target gene. LOC157858 BINDING SITE is HOST TARGET binding site found in the 5' untranslated region of mRNA encoded by LOC157858, corresponding to a HOST TARGET binding site such as BINDING SITE I, BINDING SITE II or BINDING SITE III. Table 2 illustrates the complementarity of the nucleotide sequences of LOC157858 BINDING SITE, designated SEQ ID:41869, to the nucleotide sequence of VGAM2652 RNA, herein designated VGAM RNA, also designated SEQ ID:5363.

Another function of VGAM2652 is therefore inhibition of LOC157858 (Accession XM_098833). Accordingly, utilities of VGAM2652 include diagnosis, prevention and treatment of diseases and clinical conditions associated with LOC157858. LOC169611 (Accession XM_095809) is another VGAM2652 host target gene. LOC169611 BINDING SITE is HOST TARGET binding site found in the 3' untranslated region of mRNA encoded by LOC169611, corresponding to a HOST TARGET binding site such as BINDING SITE I, BINDING SITE II or BINDING SITE III. Table 2 illustrates the complementarity of the nucleotide sequences of LOC169611 BINDING SITE, designated SEQ ID:40286, to the nucleotide sequence of VGAM2652 RNA, herein designated VGAM RNA, also designated SEQ ID:5363.

Another function of VGAM2652 is therefore inhibition of LOC169611 (Accession XM_095809). Accordingly, utilities of VGAM2652 include diagnosis, prevention and treatment of diseases and clinical conditions associated with LOC169611. LOC196264 (Accession XM_113683) is another VGAM2652 host target gene. LOC196264 BINDING SITE is HOST TARGET binding site found in the 3' untranslated region of mRNA encoded by LOC196264, corresponding to a HOST TARGET binding site such as BINDING SITE I, BINDING SITE II or BINDING SITE III. Table 2 illustrates the complementarity of the nucleotide sequences of LOC196264 BINDING SITE, designated SEQ ID:42337, to the nucleotide sequence of VGAM2652 RNA, herein designated VGAM RNA, also designated SEQ ID:5363.

Another function of VGAM2652 is therefore inhibition of LOC196264 (Accession XM_113683). Accordingly, utilities of VGAM2652 include diagnosis, prevention and treatment of diseases and clinical conditions associated with LOC196264. LOC196411 (Accession XM_113714) is another VGAM2652 host target gene. LOC196411 BINDING SITE is HOST TARGET binding site found in the 3' untranslated region of mRNA encoded by LOC196411, corresponding to a HOST TARGET binding site such as BINDING SITE I, BINDING SITE II or BINDING SITE III. Table 2 illustrates the complementarity of the nucleotide sequences of LOC196411 BINDING SITE, designated SEQ ID:42365, to the nucleotide sequence of VGAM2652 RNA, herein designated VGAM RNA, also designated SEQ ID:5363.

Another function of VGAM2652 is therefore inhibition of LOC196411 (Accession XM_113714). Accordingly, utilities of VGAM2652 include diagnosis, prevention and treatment of diseases and clinical conditions associated with LOC196411. LOC199725 (Accession XM_117119) is another VGAM2652 host target gene. LOC199725 BINDING SITE is HOST TARGET binding site found in the 5' untranslated region of mRNA encoded by LOC199725, corresponding to a HOST TARGET binding site such as BINDING SITE I, BINDING SITE II or BINDING SITE III. Table 2 illustrates the complementarity of the nucleotide sequences of LOC199725 BINDING SITE, designated SEQ ID:43243, to the nucleotide sequence of VGAM2652 RNA, herein designated VGAM RNA, also designated SEQ ID:5363.

Another function of VGAM2652 is therefore inhibition of LOC199725 (Accession XM_117119). Accordingly, utilities of VGAM2652 include diagnosis, prevention and treatment of diseases and clinical conditions associated with LOC199725. LOC199906 (Accession XM_114052) is another VGAM2652 host target gene. LOC199906 BINDING SITE is HOST TARGET binding site found in the 3' untranslated region of mRNA encoded by LOC199906, corresponding to a HOST TARGET binding site such as BINDING SITE I, BINDING SITE II or BINDING SITE III. Table 2 illustrates the complementarity of the nucleotide sequences of LOC199906 BINDING SITE, designated SEQ ID:42658, to the nucleotide sequence of VGAM2652 RNA, herein designated VGAM RNA, also designated SEQ ID:5363.

Another function of VGAM2652 is therefore inhibition of LOC199906 (Accession XM_114052). Accordingly, utilities of VGAM2652 include diagnosis, prevention and treatment of diseases and clinical conditions associated with LOC199906. LOC200169 (Accession XM_117200) is another VGAM2652 host target gene. LOC200169 BINDING SITE is HOST TARGET binding site found in the 5' untranslated region of mRNA encoded by LOC200169, corresponding to a HOST TARGET binding site such as BINDING SITE I, BINDING SITE II or BINDING SITE III. Table 2 illustrates the complementarity of the nucleotide sequences of LOC200169 BINDING SITE, designated SEQ ID:43286, to the nucleotide sequence of VGAM2652 RNA, herein designated VGAM RNA, also designated SEQ ID:5363.

Another function of VGAM2652 is therefore inhibition of LOC200169 (Accession XM_117200). Accordingly, utilities of VGAM2652 include diagnosis, prevention and treatment of diseases and clinical conditions associated with LOC200169. LOC200860 (Accession XM_117289) is another VGAM2652 host target gene. LOC200860 BINDING SITE is HOST TARGET binding site found in the 3' untranslated region of mRNA encoded by LOC200860, corresponding to a HOST TARGET binding site such as BINDING SITE I, BINDING SITE II or BINDING SITE III. Table 2 illustrates the complementarity of the nucleotide sequences of LOC200860 BINDING SITE, designated SEQ ID:43356, to the nucleotide sequence of VGAM2652 RNA, herein designated VGAM RNA, also designated SEQ ID:5363.

Another function of VGAM2652 is therefore inhibition of LOC200860 (Accession XM_117289). Accordingly, utilities of VGAM2652 include diagnosis, prevention and treatment of diseases and clinical conditions associated with LOC200860. LOC201411 (Accession XM_031946) is another VGAM2652 host target gene. LOC201411 BINDING SITE is HOST TARGET binding site found in the 3' untranslated region of mRNA encoded by LOC201411, corresponding to a HOST TARGET binding site such as BINDING SITE I, BINDING SITE II or BINDING SITE III. Table 2 illustrates the complementarity of the nucleotide sequences of LOC201411 BINDING SITE, designated SEQ ID:31529, to the nucleotide sequence of VGAM2652 RNA, herein designated VGAM RNA, also designated SEQ ID:5363.

Another function of VGAM2652 is therefore inhibition of LOC201411 (Accession XM_031946). Accordingly, utilities of VGAM2652 include diagnosis, prevention and treatment of diseases and clinical conditions associated with LOC201411. LOC201696 (Accession XM_032269) is another VGAM2652 host target gene. LOC201696 BINDING SITE is HOST TARGET binding site found in the 3' untranslated region of mRNA encoded by LOC201696, corresponding to a HOST TARGET binding site such as BINDING SITE I, BINDING SITE II or BINDING SITE III. Table 2 illustrates the complementarity of the nucleotide sequences of LOC201696 BINDING SITE, designated SEQ ID:31626, to the nucleotide sequence of VGAM2652 RNA, herein designated VGAM RNA, also designated SEQ ID:5363.

Another function of VGAM2652 is therefore inhibition of LOC201696 (Accession XM_032269). Accordingly, utilities of VGAM2652 include diagnosis, prevention and treatment of diseases and clinical conditions associated with LOC201696. LOC202908 (Accession XM_114602) is another VGAM2652 host target gene. LOC202908 BINDING SITE is HOST TARGET binding site found in the 5' untranslated region of mRNA encoded by LOC202908, corresponding to a HOST TARGET binding site such as BINDING SITE I, BINDING SITE II or BINDING SITE III. Table 2 illustrates the complementarity of the nucleotide sequences of LOC202908 BINDING SITE, designated SEQ ID:42998, to the nucleotide sequence of VGAM2652 RNA, herein designated VGAM RNA, also designated SEQ ID:5363.

Another function of VGAM2652 is therefore inhibition of LOC202908 (Accession XM_114602). Accordingly, utilities of VGAM2652 include diagnosis, prevention and treatment of diseases and clinical conditions associated with LOC202908. LOC203197 (Accession XM_114645) is another VGAM2652 host target gene. LOC203197 BINDING SITE is HOST TARGET binding site found in the 3' untranslated region of mRNA encoded by LOC203197, corresponding to a HOST TARGET binding site such as BINDING SITE I, BINDING SITE II or BINDING SITE III. Table 2 illustrates the complementarity of the nucleotide sequences of LOC203197 BINDING SITE, designated SEQ ID:43014, to the nucleotide sequence of VGAM2652 RNA, herein designated VGAM RNA, also designated SEQ ID:5363.

Another function of VGAM2652 is therefore inhibition of LOC203197 (Accession XM_114645). Accordingly, utilities of VGAM2652 include diagnosis, prevention and treatment of diseases and clinical conditions associated with LOC203197. LOC220064 (Accession XM_167827) is another VGAM2652 host target gene. LOC220064 BINDING SITE is HOST TARGET binding site found in the 3' untranslated region of mRNA encoded by LOC220064, corresponding to a HOST TARGET binding site such as BINDING SITE I, BINDING SITE II or BINDING SITE III. Table 2 illustrates the complementarity of the nucleotide sequences of LOC220064 BINDING SITE, designated SEQ ID:44869, to the nucleotide sequence of VGAM2652 RNA, herein designated VGAM RNA, also designated SEQ ID:5363.

Another function of VGAM2652 is therefore inhibition of LOC220064 (Accession XM_167827). Accordingly, utilities of VGAM2652 include diagnosis, prevention and treatment of diseases and clinical conditions associated with LOC220064. LOC220963 (Accession XM_166145) is another VGAM2652 host target gene. LOC220963 BINDING SITE is HOST TARGET binding site found in the 3' untranslated region of mRNA encoded by LOC220963, corresponding to a HOST TARGET binding site such as BINDING SITE I, BINDING SITE II or BINDING SITE III. Table 2 illustrates the complementarity of the nucleotide sequences of LOC220963 BINDING SITE, designated SEQ ID:43960, to the nucleotide sequence of VGAM2652 RNA, herein designated VGAM RNA, also designated SEQ ID:5363.

Another function of VGAM2652 is therefore inhibition of LOC220963 (Accession XM_166145). Accordingly, utilities of VGAM2652 include diagnosis, prevention and treatment of diseases and clinical conditions associated with LOC220963. LOC221174 (Accession XM_167915) is another VGAM2652 host target gene. LOC221174 BINDING SITE is HOST TARGET binding site found in the 5' untranslated region of mRNA encoded by LOC221174, corresponding to a HOST TARGET binding site such as BINDING SITE I, BINDING SITE II or BINDING SITE III. Table 2 illustrates the complementarity of the nucleotide sequences of LOC221174 BINDING SITE, designated SEQ ID:44912, to the nucleotide sequence of VGAM2652 RNA, herein designated VGAM RNA, also designated SEQ ID:5363.

Another function of VGAM2652 is therefore inhibition of LOC221174 (Accession XM_167915). Accordingly, utilities of VGAM2652 include diagnosis, prevention and treatment of diseases and clinical conditions associated with LOC221174. LOC222031 (Accession XM_168371) is another VGAM2652 host target gene. LOC222031 BINDING SITE is HOST TARGET binding site found in the 3' untranslated region of mRNA encoded by LOC222031, corresponding to a HOST TARGET binding site such as BINDING SITE I, BINDING SITE II or BINDING SITE III. Table 2 illustrates the complementarity of the nucleotide sequences of LOC222031 BINDING SITE, designated SEQ ID:45136, to the nucleotide sequence of VGAM2652 RNA, herein designated VGAM RNA, also designated SEQ ID:5363.

Another function of VGAM2652 is therefore inhibition of LOC222031 (Accession XM_168371). Accordingly, utilities of VGAM2652 include diagnosis, prevention and treatment of diseases and clinical conditions associated with LOC222031. LOC257017 (Accession XM_173227) is another VGAM2652 host target gene. LOC257017 BINDING SITE is HOST TARGET binding site found in the 5' untranslated region of mRNA encoded by LOC257017, corresponding to a HOST TARGET binding site such as BINDING SITE I, BINDING SITE II or BINDING SITE III. Table 2 illustrates the complementarity of the nucleotide sequences of LOC257017 BINDING SITE, designated SEQ ID:46498, to the nucleotide sequence of VGAM2652 RNA, herein designated VGAM RNA, also designated SEQ ID:5363.

Another function of VGAM2652 is therefore inhibition of LOC257017 (Accession XM_173227). Accordingly, utilities of VGAM2652 include diagnosis, prevention and treatment of diseases and clinical conditions associated with LOC257017. LOC57107 (Accession NM_020381) is another VGAM2652 host target gene. LOC57107 BINDING SITE is HOST TARGET binding site found in the 3' untranslated region of mRNA encoded by LOC57107, corresponding to a HOST TARGET binding site such as BINDING SITE I, BINDING SITE II or BINDING SITE III. Table 2 illustrates the complementarity of the nucleotide sequences of LOC57107 BINDING SITE, designated SEQ ID:21652, to the nucleotide sequence of VGAM2652 RNA, herein designated VGAM RNA, also designated SEQ ID:5363.

Another function of VGAM2652 is therefore inhibition of LOC57107 (Accession NM_020381). Accordingly, utilities of VGAM2652 include diagnosis, prevention and treatment of diseases and clinical conditions associated with LOC57107. LOC90591 (Accession XM_032811) is another VGAM2652 host target gene. LOC90591 BINDING SITE is HOST TARGET binding site found in the 3' untranslated region of mRNA encoded by LOC90591, corresponding to a HOST TARGET binding site such as BINDING SITE I, BINDING SITE II or BINDING SITE III. Table 2 illustrates the complementarity of the nucleotide sequences of LOC90591 BINDING SITE, designated SEQ ID:31761, to the nucleotide sequence of VGAM2652 RNA, herein designated VGAM RNA, also designated SEQ ID:5363.

Another function of VGAM2652 is therefore inhibition of LOC90591 (Accession XM_032811). Accordingly, utilities of VGAM2652 include diagnosis, prevention and treatment of diseases and clinical conditions associated with LOC90591. LOC91115 (Accession XM_036218) is another VGAM2652 host target gene. LOC91115 BINDING SITE is HOST TARGET binding site found in the 3' untranslated region of mRNA encoded by LOC91115, corresponding to a HOST TARGET binding site such as BINDING SITE I, BINDING SITE II or BINDING SITE III. Table 2 illustrates the complementarity of the nucleotide sequences of LOC91115 BINDING SITE, designated SEQ ID:32400, to the nucleotide sequence of VGAM2652 RNA, herein designated VGAM RNA, also designated SEQ ID:5363.

Another function of VGAM2652 is therefore inhibition of LOC91115 (Accession XM_036218). Accordingly, utilities of VGAM2652 include diagnosis, prevention and treatment of diseases and clinical conditions associated with LOC91115. LOC91291 (Accession XM_037478) is another VGAM2652 host target gene. LOC91291 BINDING SITE is HOST TARGET binding site found in the 5' untranslated region of mRNA encoded by LOC91291, corresponding to a HOST TARGET binding site such as BINDING SITE I, BINDING SITE II or BINDING SITE III. Table 2 illustrates the complementarity of the nucleotide sequences of LOC91291 BINDING SITE, designated SEQ ID:32630, to the nucleotide sequence of VGAM2652 RNA, herein designated VGAM RNA, also designated SEQ ID:5363.

Another function of VGAM2652 is therefore inhibition of LOC91291 (Accession XM_037478). Accordingly, utilities of VGAM2652 include diagnosis, prevention and treatment of diseases and clinical conditions associated with LOC91291. FIG. 1 further provides a conceptual description of a novel bioinformatically detected viral gene of the present invention, referred to here as Viral Genomic Address Messenger 2653 (VGAM2653) viral gene, which modulates expression of respective host target genes thereof, the function and utility of which host target genes is known in the art.

VGAM2653 is a novel bioinformatically detected regulatory, non protein coding, viral micro RNA (miRNA) gene. The method by which VGAM2653 was detected is described hereinabove with reference to FIGS. 1-8.

VGAM2653 gene, herein designated VGAM GENE, is a viral gene contained in the genome of Sorghum Mosaic Virus. VGAM2653 host target gene, herein designated VGAM HOST TARGET GENE, is a human gene contained in the human genome.

VGAM2653 gene encodes a VGAM2653 precursor RNA, herein designated VGAM PRECURSOR RNA. Similar to other miRNA genes, and unlike most ordinary genes, VGAM2653 precursor RNA does not encode a protein. A nucleotide sequence identical or highly similar to the nucleotide sequence of VGAM2653 precursor RNA is designated SEQ ID:2639, and is provided hereinbelow with reference to the sequence listing part. Nucleotide sequence SEQ ID:2639 is located at position 9158 relative to the genome of Sorghum Mosaic Virus.

VGAM2653 precursor RNA folds onto itself, forming VGAM2653 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2653 folded precursor RNA into VGAM2653 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2653 RNA is designated SEQ ID:5364, and is provided hereinbelow with reference to the sequence listing part.

VGAM2653 host target gene, herein designated VGAM HOST TARGET GENE, encodes a corresponding messenger RNA, VGAM2653 host target RNA, herein designated VGAM HOST TARGET RNA. VGAM2653 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2653 RNA, herein designated VGAM RNA, binds complementarily to one or more host target binding sites located in untranslated regions of VGAM2653 host target RNA, herein designated VGAM HOST TARGET RNA. This complementary binding is due to the fact that the nucleotide sequence of VGAM2653 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2653 RNA, herein designated VGAM RNA, may have a different number of host target binding sites in untranslated regions of a VGAM2653 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2653 RNA, herein designated VGAM RNA, to host target binding sites on VGAM2653 host target RNA, herein designated VGAM HOST TARGET RNA, such as BINDING SITE I, BINDING SITE II and BINDING SITE III, inhibits translation of VGAM2653 host target RNA into VGAM2653 host target protein, herein designated VGAM HOST TARGET PROTEIN. VGAM host target protein is therefore outlined by a broken line.

It is appreciated that VGAM2653 host target gene, herein designated VGAM HOST TARGET GENE, in fact represents a plurality of VGAM2653 host target genes. The mRNA of each one of this plurality of VGAM2653 host target genes comprises one or more host target binding sites, each having a nucleotide sequence which is at least partly complementary to VGAM2653 RNA, herein designated VGAM RNA, and which when bound by VGAM2653 RNA causes inhibition of translation of respective one or more VGAM2653 host target proteins.

It is further appreciated by one skilled in the art that the mode of translational inhibition illustrated by FIG. 1 with specific reference to translational inhibition exerted by VGAM2653 gene, herein designated VGAM GENE, on one or more VGAM2653 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2653 is inhibition of expression of host target genes, as part of a novel viral mechanism of attacking a host. Accordingly, utilities of VGAM2653 include diagnosis, prevention and treatment of viral infection by Sorghum Mosaic Virus. Specific functions, and accordingly utilities, of VGAM2653 correlate with, and may be deduced from, the identity of the host target genes which VGAM2653 binds and inhibits, and the function of these host target genes, as elaborated hereinbelow.

Nucleotide sequences of the VGAM2653 precursor RNA, herein designated VGAM PRECURSOR RNA, and of the 'diced' VGAM2653 RNA, herein designated VGAM RNA, and a schematic representation of the secondary folding of VGAM2653 folded precursor RNA, herein designated VGAM FOLDED PRECURSOR RNA, of VGAM2653 are further described hereinbelow with reference to Table 1.

Nucleotide sequences of host target binding sites, such as BINDING SITE-I, BINDING SITE-II and BINDING SITE-III of FIG. 1, found on VGAM2653 host target RNA, and schematic representation of the complementarity of each of these host target binding sites to VGAM2653 RNA, herein designated VGAM RNA, are described hereinbelow with reference to Table 2.

As mentioned hereinabove with reference to FIG. 1, a function of VGAM2653 gene, herein designated VGAM is inhibition of expression of VGAM2653 target genes. It is appreciated that specific functions, and accordingly utilities, of VGAM2653 correlate with, and may be deduced from, the identity of the target genes which VGAM2653 binds and inhibits, and the function of these target genes, as elaborated hereinbelow.

BTB and CNC Homology 1, Basic Leucine Zipper Transcription Factor 2 (BACH2, Accession NM_021813) is a VGAM2653 host target gene. BACH2 BINDING SITE is HOST TARGET binding site found in the 3' untranslated region of mRNA encoded by BACH2, corresponding to a HOST TARGET binding site such as BINDING SITE I, BINDING SITE II or BINDING SITE III. Table 2 illustrates the complementarity of the nucleotide sequences of BACH2 BINDING SITE, designated SEQ ID:22378, to the nucleotide sequence of VGAM2653 RNA, herein designated VGAM RNA, also designated SEQ ID:5364.

A function of VGAM2653 is therefore inhibition of BTB and CNC Homology 1, Basic Leucine Zipper Transcription Factor 2 (BACH2, Accession NM_021813), a gene which acts as repressor or activator, binds to maf recognition elements. Accordingly, utilities of VGAM2653 include diagnosis, prevention and treatment of diseases and clinical conditions associated with BACH2. The function of BACH2 and its association with various diseases and clinical conditions, has been established by previous studies, as described hereinabove with reference to VGAM331. Cyclin-dependent Kinase Inhibitor 2C (p18, inhibits CDK4) (CDKN2C, Accession NM_001262) is another VGAM2653 host target gene. CDKN2C BINDING SITE is HOST TARGET binding site found in the 5' untranslated region of mRNA encoded by CDKN2C, corresponding to a HOST TARGET binding site such as BINDING SITE I, BINDING SITE II or BINDING SITE III. Table 2 illustrates the complementarity of the nucleotide sequences of CDKN2C BINDING SITE, designated SEQ ID:6928, to the nucleotide sequence of VGAM2653 RNA, herein designated VGAM RNA, also designated SEQ ID:5364.

Another function of VGAM2653 is therefore inhibition of Cyclin-dependent Kinase Inhibitor 2C (p18, inhibits CDK4) (CDKN2C, Accession NM_001262), a gene which associate with cyclin-CDK complexes or CDKs alone and inhibit their activity. Accordingly, utilities of VGAM2653 include diagnosis, prevention and treatment of diseases and clinical conditions associated with CDKN2C. The function of CDKN2C and its association with various diseases and clinical conditions, has been established by previous studies, as described hereinabove with reference to VGAM2054. Chemokine (C-X-C motif) Ligand 16 (CXCL16, Accession NM_022059) is another VGAM2653 host target gene. CXCL16 BINDING SITE is HOST TARGET binding site found in the 3' untranslated region of mRNA encoded by CXCL16, corresponding to a HOST TARGET binding site such as BINDING SITE I, BINDING SITE II or BINDING SITE III. Table 2 illustrates the complementarity of the nucleotide sequences of CXCL16 BINDING SITE, designated SEQ ID:22599, to the nucleotide sequence of VGAM2653 RNA, herein designated VGAM RNA, also designated SEQ ID:5364.

Another function of VGAM2653 is therefore inhibition of Chemokine (C-X-C motif) Ligand 16 (CXCL16, Accession NM_022059), a gene which induces calcium mobilization. Accordingly, utilities of VGAM2653 include diagnosis, prevention and treatment of diseases and clinical conditions associated with CXCL16. The function of CXCL16 and its association with various diseases and clinical conditions, has been established by previous studies, as described hereinabove with reference to VGAM1845. Eukaryotic Translation Initiation Factor 2, Subunit 3 Gamma, 52 kDa (EIF2S3, Accession NM_001415) is another VGAM2653 host target gene. EIF2S3 BINDING SITE is HOST TARGET binding site found in the 3' untranslated region of mRNA encoded by EIF2S3, corresponding to a HOST TARGET binding site such as BINDING SITE I, BINDING SITE II or BINDING SITE III. Table 2 illustrates the complementarity of the nucleotide sequences of EIF2S3 BINDING SITE, designated SEQ ID:7111, to the nucleotide sequence of VGAM2653 RNA, herein designated VGAM RNA, also designated SEQ ID:5364.

Another function of VGAM2653 is therefore inhibition of Eukaryotic Translation Initiation Factor 2, Subunit 3 Gamma, 52 kDa (EIF2S3, Accession NM_001415), a gene which functions in the early steps of protein synthesis. Accordingly, utilities of VGAM2653 include diagnosis, prevention and treatment of diseases and clinical conditions associated with EIF2S3. The function of EIF2S3 and its association with various diseases and clinical conditions, has been established by previous studies, as described hereinabove with reference to VGAM1254. Insulin-like Growth Factor Binding Protein 3 (IGFBP3, Accession NM_000598) is another VGAM2653 host target gene. IGFBP3 BINDING SITE is HOST TARGET binding site found in the 3' untranslated region of mRNA encoded by IGFBP3, corresponding to a HOST TARGET binding site such as BINDING SITE I, BINDING SITE II or BINDING SITE III. Table 2 illustrates the complementarity of the nucleotide sequences of IGFBP3 BINDING SITE, designated SEQ ID:6198, to the nucleotide sequence of VGAM2653 RNA, herein designated VGAM RNA, also designated SEQ ID:5364.

Another function of VGAM2653 is therefore inhibition of Insulin-like Growth Factor Binding Protein 3 (IGFBP3, Accession NM_000598). Accordingly, utilities of VGAM2653 include diagnosis, prevention and treatment of diseases and clinical conditions associated with IGFBP3. Mel Transforming Oncogene (derived from cell line NK14)-RAB8 Homolog (MEL, Accession NM_005370) is another VGAM2653 host target gene. MEL BINDING SITE is HOST TARGET binding site found in the 3' untranslated region of mRNA encoded by MEL, corresponding to a HOST TARGET binding site such as BINDING SITE I, BINDING SITE II or BINDING SITE III. Table 2 illustrates the complementarity of the nucleotide sequences of MEL BINDING SITE, designated SEQ ID:11845, to the nucleotide sequence of VGAM2653 RNA, herein designated VGAM RNA, also designated SEQ ID:5364.

Another function of VGAM2653 is therefore inhibition of Mel Transforming Oncogene (derived from cell line NK14)-RAB8 Homolog (MEL, Accession NM_005370), a gene which may be involved in vesicular trafficking and neurotransmitter release. Accordingly, utilities of VGAM2653 include diagnosis, prevention and treatment of diseases and clinical conditions associated with MEL. The function of MEL and its association with various diseases and clinical conditions, has been established by previous studies, as described hereinabove with reference to VGAM40. Oxidative-stress Responsive 1 (OSR1, Accession NM_005109) is another VGAM2653 host target gene. OSR1 BINDING SITE is HOST TARGET binding site found in the 3' untranslated region of mRNA encoded by OSR1, corresponding to a HOST TARGET binding site such as BINDING SITE I, BINDING SITE II or BINDING SITE III. Table 2 illustrates the complementarity of the nucleotide sequences of OSR1 BINDING SITE, designated SEQ ID:11589, to the nucleotide sequence of VGAM2653 RNA, herein designated VGAM RNA, also designated SEQ ID:5364.

Another function of VGAM2653 is therefore inhibition of Oxidative-stress Responsive 1 (OSR1, Accession NM_005109), a gene which mediats stress-activated signals. Accordingly, utilities of VGAM2653 include diagnosis, prevention and treatment of diseases and clinical conditions associated with OSR1. The function of OSR1 and its association with various diseases and clinical conditions, has been established by previous studies, as described hereinabove with reference to VGAM538. Solute Carrier Family 7 (cationic amino acid transporter, y+ system), Member 6 (SLC7A6, Accession NM_003983) is another VGAM2653 host target gene. SLC7A6 BINDING SITE is HOST TARGET binding site found in the 3' untranslated region of mRNA encoded by SLC7A6, corresponding to a HOST TARGET binding site such as BINDING SITE I, BINDING SITE II or BINDING SITE III. Table 2 illustrates the complementarity of the nucleotide sequences of SLC7A6 BINDING SITE, designated SEQ ID:10127, to the nucleotide sequence of VGAM2653 RNA, herein designated VGAM RNA, also designated SEQ ID:5364.

Another function of VGAM2653 is therefore inhibition of Solute Carrier Family 7 (cationic amino acid transporter, y+ system), Member 6 (SLC7A6, Accession NM_003983), a gene which is involved in mediating amino acid transport. Accordingly, utilities of VGAM2653 include diagnosis, prevention and treatment of diseases and clinical conditions associated with SLC7A6. The function of SLC7A6 and its association with various diseases and clinical conditions, has been established by previous studies, as described hereinabove with reference to VGAM87. Transcription Factor EB (TFEB, Accession XM_166390) is another VGAM2653 host target gene. TFEB BINDING SITE is HOST TARGET binding site found in the 5' untranslated region of mRNA encoded by TFEB, corresponding to a HOST TARGET binding site such as BINDING SITE I, BINDING SITE II or BINDING SITE III. Table 2 illustrates the complementarity of the nucleotide sequences of TFEB BINDING SITE, designated SEQ ID:44239, to the nucleotide sequence of VGAM2653 RNA, herein designated VGAM RNA, also designated SEQ ID:5364.

Another function of VGAM2653 is therefore inhibition of Transcription Factor EB (TFEB, Accession XM_166390), a gene which may function as a transcription factor. Accordingly, utilities of VGAM2653 include diagnosis, prevention and treatment of diseases and clinical conditions associated with TFEB. The function of TFEB and its association with various diseases and clinical conditions, has been established by previous studies, as described hereinabove with reference to VGAM1958. Chromosome 11 Open Reading Frame 25 (C11orf25, Accession NM_031418) is another VGAM2653 host target gene. C11orf25 BINDING SITE is HOST TARGET binding site found in the 3" untranslated region of mRNA encoded by C11orf25, corresponding to a HOST TARGET binding site such as BINDING SITE I, BINDING SITE II or BINDING SITE III. Table 2 illustrates the complementarity of the nucleotide sequences of C11orf25 BINDING SITE, designated SEQ ID:25400, to the nucleotide sequence of VGAM2653 RNA, herein designated VGAM RNA, also designated SEQ ID:5364.

Another function of VGAM2653 is therefore inhibition of Chromosome 11 Open Reading Frame 25 (C11orf25, Accession NM_031418). Accordingly, utilities of VGAM2653 include diagnosis, prevention and treatment of diseases and clinical conditions associated with C11orf25. C16orf5 (Accession NM_013399) is another VGAM2653 host target gene. C16orf5 BINDING SITE is HOST TARGET binding site found in the 3' untranslated region of mRNA encoded by C16orf5, corresponding to a HOST TARGET binding site such as BINDING SITE I, BINDING SITE II or BINDING SITE III. Table 2 illustrates the complementarity of the nucleotide sequences of C16orf5 BINDING SITE, designated SEQ ID:15052, to the nucleotide sequence of VGAM2653 RNA, herein designated VGAM RNA, also designated SEQ ID:5364.

Another function of VGAM2653 is therefore inhibition of C16orf5 (Accession NM_013399). Accordingly, utilities of VGAM2653 include diagnosis, prevention and treatment of diseases and clinical conditions associated with C16orf5. DKFZP566K1924 (Accession XM_057469) is another VGAM2653 host target gene. DKFZP566K1924 BINDING SITE is HOST TARGET binding site found in the 5' untranslated region of mRNA encoded by DKFZP566K1924, corresponding to a HOST TARGET binding site such as BINDING SITE I, BINDING SITE II or BINDING SITE III. Table 2 illustrates the complementarity of the nucleotide sequences of DKFZP566K1924 BINDING SITE, designated SEQ ID:36520, to the nucleotide sequence of VGAM2653 RNA, herein designated VGAM RNA, also designated SEQ ID:5364.

Another function of VGAM2653 is therefore inhibition of DKFZP566K1924 (Accession XM_057469). Accordingly, utilities of VGAM2653 include diagnosis, prevention and treatment of diseases and clinical conditions associated with DKFZP566K1924. Dihydropyrimidinase-like 4 (DPYSL4, Accession NM_006426) is another VGAM2653 host target gene. DPYSL4 BINDING SITE is HOST TARGET binding site found in the 3' untranslated region of mRNA encoded by DPYSL4, corresponding to a HOST TARGET binding site such as BINDING SITE I, BINDING SITE II or BINDING SITE III. Table 2 illustrates the complementarity of the nucleotide sequences of DPYSL4 BINDING SITE, designated SEQ ID:13141, to the nucleotide sequence of VGAM2653 RNA, herein designated VGAM RNA, also designated SEQ ID:5364.

Another function of VGAM2653 is therefore inhibition of Dihydropyrimidinase-like 4 (DPYSL4, Accession NM_006426). Accordingly, utilities of VGAM2653 include diagnosis, prevention and treatment of diseases and clinical conditions associated with DPYSL4. FLJ00024 (Accession XM_033361) is another VGAM2653 host target gene. FLJ00024 BINDING SITE is HOST TARGET binding site found in the 3' untranslated region of mRNA encoded by FLJ00024, corresponding to a HOST TARGET binding site such as BINDING SITE I, BINDING SITE II or BINDING SITE III. Table 2 illustrates the complementarity of the nucleotide sequences of FLJ00024 BINDING SITE, designated SEQ ID:31889, to the nucleotide sequence of VGAM2653 RNA, herein designated VGAM RNA, also designated SEQ ID:5364.

Another function of VGAM2653 is therefore inhibition of FLJ00024 (Accession XM_033361). Accordingly, utilities of VGAM2653 include diagnosis, prevention and treatment of diseases and clinical conditions associated with FLJ00024. FLJ11383 (Accession NM_024938) is another VGAM2653 host target gene. FLJ11383 BINDING SITE is HOST TARGET binding site found in the 3' untranslated region of mRNA encoded by FLJ11383, corresponding to a HOST TARGET binding site such as BINDING SITE I, BINDING SITE II or BINDING SITE III. Table 2 illustrates the complementarity of the nucleotide sequences of FLJ11383 BINDING SITE, designated SEQ ID:24476, to the nucleotide sequence of VGAM2653 RNA, herein designated VGAM RNA, also designated SEQ ID:5364.

Another function of VGAM2653 is therefore inhibition of FLJ11383 (Accession NM_024938). Accordingly, utilities of VGAM2653 include diagnosis, prevention and treatment of diseases and clinical conditions associated with FLJ11383. FLJ13114 (Accession NM_024541) is another VGAM2653 host target gene. FLJ13114 BINDING SITE is HOST TARGET binding site found in the 3' untranslated region of mRNA encoded by FLJ13114, corresponding to a HOST TARGET binding site such as BINDING SITE I, BINDING SITE II or BINDING SITE III. Table 2 illustrates the complementarity of the nucleotide sequences of FLJ13114 BINDING SITE, designated SEQ ID:23749, to the nucleotide sequence of VGAM2653 RNA, herein designated VGAM RNA, also designated SEQ ID:5364.

Another function of VGAM2653 is therefore inhibition of FLJ13114 (Accession NM_024541). Accordingly, utilities of VGAM2653 include diagnosis, prevention and treatment of diseases and clinical conditions associated with FLJ13114. FLJ32865 (Accession NM_144613) is another VGAM2653 host target gene. FLJ32865 BINDING SITE is HOST TARGET binding site found in the 3' untranslated region of mRNA encoded by FLJ32865, corresponding to a HOST TARGET binding site such as BINDING SITE I, BINDING SITE II or BINDING SITE III. Table 2 illustrates the complementarity of the nucleotide sequences of FLJ32865 BINDING SITE, designated SEQ ID:29425, to the nucleotide sequence of VGAM2653 RNA, herein designated VGAM RNA, also designated SEQ ID:5364.

Another function of VGAM2653 is therefore inhibition of FLJ32865 (Accession NM_144613). Accordingly, utilities of VGAM2653 include diagnosis, prevention and treatment of diseases and clinical conditions associated with FLJ32865. HEF1 (Accession NM_006403) is another VGAM2653 host target gene. HEF1 BINDING SITE is HOST TARGET binding site found in the 3' untranslated region of mRNA encoded by HEF1, corresponding to a HOST TARGET binding site such as BINDING SITE I, BINDING SITE II or BINDING SITE III. Table 2 illustrates the complementarity of the nucleotide sequences of HEF1 BINDING SITE, designated SEQ ID:13111, to the nucleotide sequence of VGAM2653 RNA, herein designated VGAM RNA, also designated SEQ ID:5364.

Another function of VGAM2653 is therefore inhibition of HEF1 (Accession NM_006403). Accordingly, utilities of VGAM2653 include diagnosis, prevention and treatment of diseases and clinical conditions associated with HEF1. Immune Associated Nucleotide 4 Like 1 (mouse) (IAN4L1, Accession NM_018384) is another VGAM2653 host target gene. IAN4L1 BINDING SITE is HOST TARGET binding site found in the 5' untranslated region of mRNA encoded by IAN4L1, corresponding to a HOST TARGET binding site such as BINDING SITE I, BINDING SITE II or BINDING SITE III. Table 2 illustrates the complementarity of the nucleotide sequences of IAN4L1 BINDING SITE, designated SEQ ID:20416, to the nucleotide sequence of VGAM2653 RNA, herein designated VGAM RNA, also designated SEQ ID:5364.

Another function of VGAM2653 is therefore inhibition of Immune Associated Nucleotide 4 Like 1 (mouse) (IAN4L1, Accession NM_018384). Accordingly, utilities of VGAM2653 include diagnosis, prevention and treatment of diseases and clinical conditions associated with IAN4L1. KIAA1260 (Accession XM_010461) is another VGAM2653 host target gene. KIAA1260 BINDING SITE is HOST TARGET binding site found in the 5' untranslated region of mRNA encoded by KIAA1260, corresponding to a HOST TARGET binding site such as BINDING SITE I, BINDING SITE II or BINDING SITE III. Table 2 illustrates the complementarity of the nucleotide sequences of KIAA1260 BINDING SITE, designated SEQ ID:30157, to the nucleotide sequence of VGAM2653 RNA, herein designated VGAM RNA, also designated SEQ ID:5364.

Another function of VGAM2653 is therefore inhibition of KIAA1260 (Accession XM_010461). Accordingly, utilities of VGAM2653 include diagnosis, prevention and treatment of diseases and clinical conditions associated with KIAA1260. MGC12837 (Accession NM_032726) is another VGAM2653 host target gene. MGC12837 BINDING SITE is HOST TARGET binding site found in the 3' untranslated region of mRNA encoded by MGC12837, corresponding to a HOST TARGET binding site such as BINDING SITE I, BINDING SITE II or BINDING SITE III. Table 2 illustrates the complementarity of the nucleotide sequences of MGC12837 BINDING SITE, designated SEQ ID:26452, to the nucleotide sequence of VGAM2653 RNA, herein designated VGAM RNA, also designated SEQ ID:5364.

Another function of VGAM2653 is therefore inhibition of MGC12837 (Accession NM_032726). Accordingly, utilities of VGAM2653 include diagnosis, prevention and treatment of diseases and clinical conditions associated with MGC12837. N4BP3 (Accession XM_038920) is another VGAM2653 host target gene. N4BP3 BINDING SITE is HOST TARGET binding site found in the 3' untranslated region of mRNA encoded by N4BP3, corresponding to a HOST TARGET binding site such as BINDING SITE I, BINDING SITE II or BINDING SITE III. Table 2 illustrates the complementarity of the nucleotide sequences of N4BP3 BINDING SITE, designated SEQ ID:32933, to the nucleotide sequence of VGAM2653 RNA, herein designated VGAM RNA, also designated SEQ ID:5364.

Another function of VGAM2653 is therefore inhibition of N4BP3 (Accession XM_038920). Accordingly, utilities of VGAM2653 include diagnosis, prevention and treatment of diseases and clinical conditions associated with N4BP3. Nuclear Factor of Activated T-cells 5, Tonicity-responsive (NFAT5, Accession NM_138714) is another VGAM2653 host target gene. NFAT5 BINDING SITE is HOST TARGET binding site found in the 5' untranslated region of mRNA encoded by NFAT5, corresponding to a HOST TARGET binding site such as BINDING SITE I, BINDING SITE II or BINDING SITE III. Table 2 illustrates the complementarity of the nucleotide sequences of NFAT5 BINDING SITE, designated SEQ ID:28955, to the nucleotide sequence of VGAM2653 RNA, herein designated VGAM RNA, also designated SEQ ID:5364.

Another function of VGAM2653 is therefore inhibition of Nuclear Factor of Activated T-cells 5, Tonicity-responsive (NFAT5, Accession NM_138714). Accordingly, utilities of VGAM2653 include diagnosis, prevention and treatment of diseases and clinical conditions associated with NFAT5. Protein Phosphatase 1, Regulatory (inhibitor) Subunit 16B (PPP1R16B, Accession XM_028840) is another VGAM2653 host target gene. PPP1R16B BINDING SITE is HOST TARGET binding site found in the 3' untranslated region of mRNA encoded by PPP1R16B, corresponding to a HOST TARGET binding site such as BINDING SITE I, BINDING SITE II or BINDING SITE III. Table 2 illustrates the complementarity of the nucleotide sequences of PPP1R16B BINDING SITE, designated SEQ ID:30772, to the nucleotide sequence of VGAM2653 RNA, herein designated VGAM RNA, also designated SEQ ID:5364.

Another function of VGAM2653 is therefore inhibition of Protein Phosphatase 1, Regulatory (inhibitor) Subunit 16B (PPP1R16B, Accession XM_028840). Accordingly, utilities of VGAM2653 include diagnosis, prevention and treatment of diseases and clinical conditions associated with PPP1R16B. Synovial Sarcoma Translocation Gene On Chromosome 18-like 1 (SS18L1, Accession XM_037202) is another VGAM2653 host target gene. SS18L1 BINDING SITE is HOST TARGET binding site found in the 3' untranslated region of mRNA encoded by SS18L1, corresponding to a HOST TARGET binding site such as BINDING SITE I, BINDING SITE II or BINDING SITE III. Table 2 illustrates the complementarity of the nucleotide sequences of SS18L1 BINDING SITE, designated SEQ ID:32560, to the nucleotide sequence of VGAM2653 RNA, herein designated VGAM RNA, also designated SEQ ID:5364.

Another function of VGAM2653 is therefore inhibition of Synovial Sarcoma Translocation Gene On Chromosome 18-like 1 (SS18L1, Accession XM_037202). Accordingly, utilities of VGAM2653 include diagnosis, prevention and treatment of diseases and clinical conditions associated with SS18L1. Syntaxin 1B2 (STX1B2, Accession NM_052874) is another VGAM2653 host target gene. STX1B2 BINDING SITE is HOST TARGET binding site found in the 3' untranslated region of mRNA encoded by STX1B2, corresponding to a HOST TARGET binding site such as BINDING SITE I, BINDING SITE II or BINDING SITE III. Table 2 illustrates the complementarity of the nucleotide sequences of STX1B2 BINDING SITE, designated SEQ ID:27455, to the nucleotide sequence of VGAM2653 RNA, herein designated VGAM RNA, also designated SEQ ID:5364.

Another function of VGAM2653 is therefore inhibition of Syntaxin 1B2 (STX1B2, Accession NM_052874). Accordingly, utilities of VGAM2653 include diagnosis, prevention and treatment of diseases and clinical conditions associated with STX1B2. Vacuolar Protein Sorting 4B (yeast) (VPS4B, Accession NM_004869) is another VGAM2653 host target gene. VPS4B BINDING SITE is HOST TARGET binding site found in the 5" untranslated region of mRNA encoded by VPS4B, corresponding to a HOST TARGET binding site such as BINDING SITE I, BINDING SITE II or BINDING SITE III. Table 2 illustrates the complementarity of the nucleotide sequences of VPS4B BINDING SITE, designated SEQ ID:11293, to the nucleotide sequence of VGAM2653 RNA, herein designated VGAM RNA, also designated SEQ ID:5364.

Another function of VGAM2653 is therefore inhibition of Vacuolar Protein Sorting 4B (yeast) (VPS4B, Accession NM_004869). Accordingly, utilities of VGAM2653 include diagnosis, prevention and treatment of diseases and clinical conditions associated with VPS4B. LOC144871 (Accession XM_096698) is another VGAM2653 host target gene. LOC144871 BINDING SITE is HOST TARGET binding site found in the 3' untranslated region of mRNA encoded by LOC144871, corresponding to a HOST TARGET binding site such as BINDING SITE I, BINDING SITE II or BINDING SITE III. Table 2 illustrates the complementarity of the nucleotide sequences of LOC144871 BINDING SITE, designated SEQ ID:40469, to the nucleotide sequence of VGAM2653 RNA, herein designated VGAM RNA, also designated SEQ ID:5364.

Another function of VGAM2653 is therefore inhibition of LOC144871 (Accession XM_096698). Accordingly, utilities of VGAM2653 include diagnosis, prevention and treatment of diseases and clinical conditions associated with LOC144871. LOC158987 (Accession XM_099015) is another VGAM2653 host target gene. LOC158987 BINDING SITE is HOST TARGET binding site found in the 3' untranslated region of mRNA encoded by LOC158987, corresponding to a HOST TARGET binding site such as BINDING SITE I, BINDING SITE II or BINDING SITE III. Table 2 illustrates the complementarity of the nucleotide sequences of LOC158987 BINDING SITE, designated SEQ ID:42046, to the nucleotide sequence of VGAM2653 RNA, herein designated VGAM RNA, also designated SEQ ID:5364.

Another function of VGAM2653 is therefore inhibition of LOC158987 (Accession XM_099015). Accordingly, utilities of VGAM2653 include diagnosis, prevention and treatment of diseases and clinical conditions associated with LOC158987. LOC201164 (Accession XM_113904) is another VGAM2653 host target gene. LOC201164 BINDING SITE is HOST TARGET binding site found in the 3' untranslated region of mRNA encoded by LOC201164, corresponding to a HOST TARGET binding site such as BINDING SITE I, BINDING SITE II or BINDING SITE III. Table 2 illustrates the complementarity of the nucleotide sequences of LOC201164 BINDING SITE, designated SEQ ID:42529, to the nucleotide sequence of VGAM2653 RNA, herein designated VGAM RNA, also designated SEQ ID:5364.

Another function of VGAM2653 is therefore inhibition of LOC201164 (Accession XM_113904). Accordingly, utilities of VGAM2653 include diagnosis, prevention and treatment of diseases and clinical conditions associated with LOC201164. LOC255308 (Accession XM_170536) is another VGAM2653 host target gene. LOC255308 BINDING SITE is HOST TARGET binding site found in the 3' untranslated region of mRNA encoded by LOC255308, corresponding to a HOST TARGET binding site such as BINDING SITE I, BINDING SITE II or BINDING SITE III. Table 2 illustrates the complementarity of the nucleotide sequences of LOC255308 BINDING SITE, designated SEQ ID:45354, to the nucleotide sequence of VGAM2653 RNA, herein designated VGAM RNA, also designated SEQ ID:5364.

Another function of VGAM2653 is therefore inhibition of LOC255308 (Accession XM_170536). Accordingly, utilities of VGAM2653 include diagnosis, prevention and treatment of diseases and clinical conditions associated with LOC255308. LOC256821 (Accession XM_175144) is another VGAM2653 host target gene. LOC256821 BINDING SITE is HOST TARGET binding site found in the 5' untranslated region of mRNA encoded by LOC256821, corresponding to a HOST TARGET binding site such as BINDING SITE I, BINDING SITE II or BINDING SITE III. Table 2 illustrates the complementarity of the nucleotide sequences of LOC256821 BINDING SITE, designated SEQ ID:46638, to the nucleotide sequence of VGAM2653 RNA, herein designated VGAM RNA, also designated SEQ ID:5364.

Another function of VGAM2653 is therefore inhibition of LOC256821 (Accession XM_175144). Accordingly, utilities of VGAM2653 include diagnosis, prevention and treatment of diseases and clinical conditions associated with LOC256821. FIG. 1 further provides a conceptual description of a novel bioinformatically detected viral gene of the present invention, referred to here as Viral Genomic Address Messenger 2654 (VGAM2654) viral gene, which modulates expression of respective host target genes thereof, the function and utility of which host target genes is known in the art.

VGAM2654 is a novel bioinformatically detected regulatory, non protein coding, viral micro RNA (miRNA) gene. The method by which VGAM2654 was detected is described hereinabove with reference to FIGS. 1-8.

VGAM2654 gene, herein designated VGAM GENE, is a viral gene contained in the genome of Sorghum Mosaic Virus. VGAM2654 host target gene, herein designated VGAM HOST TARGET GENE, is a human gene contained in the human genome.

VGAM2654 gene encodes a VGAM2654 precursor RNA, herein designated VGAM PRECURSOR RNA. Similar to other miRNA genes, and unlike most ordinary genes, VGAM2654 precursor RNA does not encode a protein. A nucleotide sequence identical or highly similar to the nucleotide sequence of VGAM2654 precursor RNA is designated SEQ ID:2640, and is provided hereinbelow with reference to the sequence listing part. Nucleotide sequence SEQ ID:2640 is located at position 2508 relative to the genome of Sorghum Mosaic Virus.

VGAM2654 precursor RNA folds onto itself, forming VGAM2654 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2654 folded precursor RNA into VGAM2654 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM2654 RNA is designated SEQ ID:5365, and is provided hereinbelow with reference to the sequence listing part.

VGAM2654 host target gene, herein designated VGAM HOST TARGET GENE, encodes a corresponding messenger RNA, VGAM2654 host target RNA, herein designated VGAM HOST TARGET RNA. VGAM2654 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2654 RNA, herein designated VGAM RNA, binds complementarily to one or more host target binding sites located in untranslated regions of VGAM2654 host target RNA, herein designated VGAM HOST TARGET RNA. This complementary binding is due to the fact that the nucleotide sequence of VGAM2654 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2654 RNA, herein designated VGAM RNA, may have a different number of host target binding sites in untranslated regions of a VGAM2654 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2654 RNA, herein designated VGAM RNA, to host target binding sites on VGAM2654 host target RNA, herein designated VGAM HOST TARGET RNA, such as BINDING SITE I, BINDING SITE II and BINDING SITE III, inhibits translation of VGAM2654 host target RNA into VGAM2654 host target protein, herein designated VGAM HOST TARGET PROTEIN. VGAM host target protein is therefore outlined by a broken line.

It is appreciated that VGAM2654 host target gene, herein designated VGAM HOST TARGET GENE, in fact represents a plurality of VGAM2654 host target genes. The mRNA of each one of this plurality of VGAM2654 host target genes comprises one or more host target binding sites, each having a nucleotide sequence which is at least partly complementary to VGAM2654 RNA, herein designated VGAM RNA, and which when bound by VGAM2654 RNA causes inhibition of translation of respective one or more VGAM2654 host target proteins.

It is further appreciated by one skilled in the art that the mode of translational inhibition illustrated by FIG. 1 with specific reference to translational inhibition exerted by VGAM2654 gene, herein designated VGAM GENE, on one or more VGAM2654 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2654 is inhibition of expression of host target genes, as part of a novel viral mechanism of attacking a host. Accordingly, utilities of VGAM2654 include diagnosis, prevention and treatment of viral infection by Sorghum Mosaic Virus. Specific functions, and accordingly utilities, of VGAM2654 correlate with, and may be deduced from, the identity of the host target genes which VGAM2654 binds and inhibits, and the function of these host target genes, as elaborated hereinbelow.

Nucleotide sequences of the VGAM2654 precursor RNA, herein designated VGAM PRECURSOR RNA, and of the 'diced' VGAM2654 RNA, herein designated VGAM RNA, and a schematic representation of the secondary folding of VGAM2654 folded precursor RNA, herein designated VGAM FOLDED PRECURSOR RNA, of VGAM2654 are further described hereinbelow with reference to Table 1.

Nucleotide sequences of host target binding sites, such as BINDING SITE-I, BINDING SITE-II and BINDING SITE-III of FIG. 1, found on VGAM2654 host target RNA, and schematic representation of the complementarity of each of these host target binding sites to VGAM2654 RNA, herein designated VGAM RNA, are described hereinbelow with reference to Table 2.

As mentioned hereinabove with reference to FIG. 1, a function of VGAM2654 gene, herein designated VGAM is inhibition of expression of VGAM2654 target genes. It is appreciated that specific functions, and accordingly utilities, of VGAM2654 correlate with, and may be deduced from, the identity of the target genes which VGAM2654 binds and inhibits, and the function of these target genes, as elaborated hereinbelow.

Zinc Finger Protein 215 (ZNF215, Accession NM_013250) is a VGAM2654 host target gene. ZNF215 BINDING SITE is HOST TARGET binding site found in the 3' untranslated region of mRNA encoded by ZNF215, corresponding to a HOST TARGET binding site such as BINDING SITE I, BINDING SITE II or BINDING SITE III. Table 2 illustrates the complementarity of the nucleotide sequences of ZNF215 BINDING SITE, designated SEQ ID:14911, to the nucleotide sequence of VGAM2654 RNA, herein designated VGAM RNA, also designated SEQ ID:5365.

A function of VGAM2654 is therefore inhibition of Zinc Finger Protein 215 (ZNF215, Accession NM_013250). Accordingly, utilities of VGAM2654 include diagnosis, prevention and treatment of diseases and clinical conditions associated with ZNF215. FLJ21820 (Accession NM_021925) is another VGAM2654 host target gene. FLJ21820 BINDING SITE is HOST TARGET binding site found in the 3' untranslated region of mRNA encoded by FLJ21820, corresponding to a HOST TARGET binding site such as BINDING SITE I, BINDING SITE II or BINDING SITE III. Table 2 illustrates the complementarity of the nucleotide sequences of FLJ21820 BINDING SITE, designated SEQ ID:22452, to the nucleotide sequence of VGAM2654 RNA, herein designated VGAM RNA, also designated SEQ ID:5365.

Another function of VGAM2654 is therefore inhibition of FLJ21820 (Accession NM_021925). Accordingly, utilities of VGAM2654 include diagnosis, prevention and treatment of diseases and clinical conditions associated with FLJ21820. Spermatid Perinuclear RNA Binding Protein (STRBP, Accession NM_018387) is another VGAM2654 host target gene. STRBP BINDING SITE is HOST TARGET binding site found in the 5' untranslated region of mRNA encoded by STRBP, corresponding to a HOST TARGET binding site such as BINDING SITE I, BINDING SITE II or BINDING SITE III. Table 2 illustrates the complementarity of the nucleotide sequences of STRBP BINDING SITE, designated SEQ ID:20418, to the nucleotide sequence of VGAM2654 RNA, herein designated VGAM RNA, also designated SEQ ID:5365.

Another function of VGAM2654 is therefore inhibition of Spermatid Perinuclear RNA Binding Protein (STRBP, Accession NM_018387). Accordingly, utilities of VGAM2654 include diagnosis, prevention and treatment of diseases and clinical conditions associated with STRBP. LOC149302 (Accession XM_086489) is another VGAM2654 host target gene. LOC149302 BINDING SITE is HOST TARGET binding site found in the 5' untranslated region of mRNA encoded by LOC149302, corresponding to a HOST TARGET binding site such as BINDING SITE I, BINDING SITE II or BINDING SITE III. Table 2 illustrates the complementarity of the nucleotide sequences of LOC149302 BINDING SITE, designated SEQ ID:38707, to the nucleotide sequence of VGAM2654 RNA, herein designated VGAM RNA, also designated SEQ ID:5365.

Another function of VGAM2654 is therefore inhibition of LOC149302 (Accession XM_086489). Accordingly, utilities of VGAM2654 include diagnosis, prevention and treatment of diseases and clinical conditions associated with LOC149302. FIG. 1 further provides a conceptual description of a novel bioinformatically detected viral gene of the present invention, referred to here as Viral Genomic Address Messenger 2655 (VGAM2655) viral gene, which modulates expression of respective host target genes thereof, the function and utility of which host target genes is known in the art.

VGAM2655 is a novel bioinformatically detected regulatory, non protein coding, viral micro RNA (miRNA) gene. The method by which VGAM2655 was detected is described hereinabove with reference to FIGS. 1-8.

VGAM2655 gene, herein designated VGAM GENE, is a viral gene contained in the genome of Sorghum Mosaic Virus. VGAM2655 host target gene, herein designated VGAM HOST TARGET GENE, is a human gene contained in the human genome.

VGAM2655 gene encodes a VGAM2655 precursor RNA, herein designated VGAM PRECURSOR RNA. Similar to other miRNA genes, and unlike most ordinary genes, VGAM2655 precursor RNA does not encode a protein. A nucleotide sequence identical or highly similar to the nucleotide sequence of VGAM2655 precursor RNA is designated SEQ ID:2641, and is provided hereinbelow with reference to the sequence listing part. Nucleotide sequence SEQ ID:2641 is located at position 8865 relative to the genome of Sorghum Mosaic Virus.

VGAM2655 precursor RNA folds onto itself, forming VGAM2655 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2655 folded precursor RNA into VGAM2655 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM2655 RNA is designated SEQ ID:5366, and is provided hereinbelow with reference to the sequence listing part.

VGAM2655 host target gene, herein designated VGAM HOST TARGET GENE, encodes a corresponding messenger RNA, VGAM2655 host target RNA, herein designated VGAM HOST TARGET RNA. VGAM2655 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2655 RNA, herein designated VGAM RNA, binds complementarily to one or more host target binding sites located in untranslated regions of VGAM2655 host target RNA, herein designated VGAM HOST TARGET RNA. This complementary binding is due to the fact that the nucleotide sequence of VGAM2655 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2655 RNA, herein designated VGAM RNA, may have a different number of host target binding sites in untranslated regions of a VGAM2655 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2655 RNA, herein designated VGAM RNA, to host target binding sites on VGAM2655 host target RNA, herein designated VGAM HOST TARGET RNA, such as BINDING SITE I, BINDING SITE II and BINDING SITE III, inhibits translation of VGAM2655 host target RNA into VGAM2655 host target protein, herein designated VGAM HOST TARGET PROTEIN. VGAM host target protein is therefore outlined by a broken line.

It is appreciated that VGAM2655 host target gene, herein designated VGAM HOST TARGET GENE, in fact represents a plurality of VGAM2655 host target genes. The mRNA of each one of this plurality of VGAM2655 host target genes comprises one or more host target binding sites, each having a nucleotide sequence which is at least partly complementary to VGAM2655 RNA, herein designated VGAM RNA, and which when bound by VGAM2655 RNA causes inhibition of translation of respective one or more VGAM2655 host target proteins.

It is further appreciated by one skilled in the art that the mode of translational inhibition illustrated by FIG. 1 with specific reference to translational inhibition exerted by VGAM2655 gene, herein designated VGAM GENE, on one or more VGAM2655 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2655 is inhibition of expression of host target genes, as part of a novel viral mechanism of attacking a host. Accordingly, utilities of VGAM2655 include diagnosis, prevention and treatment of viral infection by Sorghum Mosaic Virus. Specific functions, and accordingly utilities, of VGAM2655 correlate with, and may be deduced from, the identity of the host target genes which VGAM2655 binds and inhibits, and the function of these host target genes, as elaborated hereinbelow.

Nucleotide sequences of the VGAM2655 precursor RNA, herein designated VGAM PRECURSOR RNA, and of the 'diced' VGAM2655 RNA, herein designated VGAM RNA, and a schematic representation of the secondary folding of VGAM2655 folded precursor RNA, herein designated VGAM FOLDED PRECURSOR RNA, of VGAM2655 are further described hereinbelow with reference to Table 1.

Nucleotide sequences of host target binding sites, such as BINDING SITE-I, BINDING SITE-II and BINDING SITE-III of FIG. 1, found on VGAM2655 host target RNA, and schematic representation of the complementarity of each of these host target binding sites to VGAM2655 RNA, herein designated VGAM RNA, are described hereinbelow with reference to Table 2.

As mentioned hereinabove with reference to FIG. 1, a function of VGAM2655 gene, herein designated VGAM is inhibition of expression of VGAM2655 target genes. It is appreciated that specific functions, and accordingly utilities, of VGAM2655 correlate with, and may be deduced from, the identity of the target genes which VGAM2655 binds and inhibits, and the function of these target genes, as elaborated hereinbelow.

AP1 Gamma Subunit Binding Protein 1 (AP1GBP1, Accession NM_080551) is a VGAM2655 host target gene. AP1GBP1 BINDING SITE is HOST TARGET binding site found in the 3' untranslated region of mRNA encoded by AP1GBP1, corresponding to a HOST TARGET binding site such as BINDING SITE I, BINDING SITE II or BINDING SITE III. Table 2 illustrates the complementarity of the nucleotide sequences of AP1GBP1 BINDING SITE, designated SEQ ID:27880, to the nucleotide sequence of VGAM2655 RNA, herein designated VGAM RNA, also designated SEQ ID:5366.

A function of VGAM2655 is therefore inhibition of AP1 Gamma Subunit Binding Protein 1 (AP1GBP1, Accession NM_080551). Accordingly, utilities of VGAM2655 include diagnosis, prevention and treatment of diseases and clinical conditions associated with AP1GBP1. LOC158055 (Accession XM_088453) is another VGAM2655 host target gene. LOC158055 BINDING SITE is HOST TARGET binding site found in the 3' untranslated region of mRNA encoded by LOC158055, corresponding to a HOST TARGET binding site such as BINDING SITE I, BINDING SITE II or BINDING SITE III. Table 2 illustrates the complementarity of the nucleotide sequences of LOC158055 BINDING SITE, designated SEQ ID:39705, to the nucleotide sequence of VGAM2655 RNA, herein designated VGAM RNA, also designated SEQ ID:5366.

Another function of VGAM2655 is therefore inhibition of LOC158055 (Accession XM_088453). Accordingly, utilities of VGAM2655 include diagnosis, prevention and treatment of diseases and clinical conditions associated with LOC158055. FIG. 1 further provides a conceptual description of a novel bioinformatically detected viral gene of the present invention, referred to here as Viral Genomic Address Messenger 2656 (VGAM2656) viral gene, which modulates expression of respective host target genes thereof, the function and utility of which host target genes is known in the art.

VGAM2656 is a novel bioinformatically detected regulatory, non protein coding, viral micro RNA (miRNA) gene. The method by which VGAM2656 was detected is described hereinabove with reference to FIGS. 1-8.

VGAM2656 gene, herein designated VGAM GENE, is a viral gene contained in the genome of Potato Virus A. VGAM2656 host target gene, herein designated VGAM HOST TARGET GENE, is a human gene contained in the human genome.

VGAM2656 gene encodes a VGAM2656 precursor RNA, herein designated VGAM PRECURSOR RNA. Similar to other miRNA genes, and unlike most ordinary genes, VGAM2656 precursor RNA does not encode a protein. A nucleotide sequence identical or highly similar to the nucleotide sequence of VGAM2656 precursor RNA is designated SEQ ID:2642, and is provided hereinbelow with reference to the sequence listing part. Nucleotide sequence SEQ ID:2642 is located at position 5538 relative to the genome of Potato Virus A.

VGAM2656 precursor RNA folds onto itself, forming VGAM2656 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2656 folded precursor RNA into VGAM2656 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2656 RNA is designated SEQ ID:5367, and is provided hereinbelow with reference to the sequence listing part.

VGAM2656 host target gene, herein designated VGAM HOST TARGET GENE, encodes a corresponding messenger RNA, VGAM2656 host target RNA, herein designated VGAM HOST TARGET RNA. VGAM2656 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2656 RNA, herein designated VGAM RNA, binds complementarily to one or more host target binding sites located in untranslated regions of VGAM2656 host target RNA, herein designated VGAM HOST TARGET RNA. This complementary binding is due to the fact that the nucleotide sequence of VGAM2656 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2656 RNA, herein designated VGAM RNA, may have a different number of host target binding sites in untranslated regions of a VGAM2656 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2656 RNA, herein designated VGAM RNA, to host target binding sites on VGAM2656 host target RNA, herein designated VGAM HOST TARGET RNA, such as BINDING SITE I, BINDING SITE II and BINDING SITE III, inhibits translation of VGAM2656 host target RNA into VGAM2656 host target protein, herein designated VGAM HOST TARGET PROTEIN. VGAM host target protein is therefore outlined by a broken line.

It is appreciated that VGAM2656 host target gene, herein designated VGAM HOST TARGET GENE, in fact represents a plurality of VGAM2656 host target genes. The mRNA of each one of this plurality of VGAM2656 host target genes comprises one or more host target binding sites, each having a nucleotide sequence which is at least partly complementary to VGAM2656 RNA, herein designated VGAM RNA, and which when bound by VGAM2656 RNA causes inhibition of translation of respective one or more VGAM2656 host target proteins.

It is further appreciated by one skilled in the art that the mode of translational inhibition illustrated by FIG. 1 with specific reference to translational inhibition exerted by VGAM2656 gene, herein designated VGAM GENE, on one or more VGAM2656 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2656 is inhibition of expression of host target genes, as part of a novel viral mechanism of attacking a host. Accordingly, utilities of VGAM2656 include diagnosis, prevention and treatment of viral infection by Potato Virus A. Specific functions, and accordingly utilities, of VGAM2656 correlate with, and may be deduced from, the identity of the host target genes which VGAM2656 binds and inhibits, and the function of these host target genes, as elaborated hereinbelow.

Nucleotide sequences of the VGAM2656 precursor RNA, herein designated VGAM PRECURSOR RNA, and of the 'diced' VGAM2656 RNA, herein designated VGAM RNA, and a schematic representation of the secondary folding of VGAM2656 folded precursor RNA, herein designated VGAM FOLDED PRECURSOR RNA, of VGAM2656 are further described hereinbelow with reference to Table 1.

Nucleotide sequences of host target binding sites, such as BINDING SITE-I, BINDING SITE-II and BINDING SITE-III of FIG. 1, found on VGAM2656 host target RNA, and schematic representation of the complementarity of each of these host target binding sites to VGAM2656 RNA, herein designated VGAM RNA, are described hereinbelow with reference to Table 2.

As mentioned hereinabove with reference to FIG. 1, a function of VGAM2656 gene, herein designated VGAM is inhibition of expression of VGAM2656 target genes. It is appreciated that specific functions, and accordingly utilities, of VGAM2656 correlate with, and may be deduced from, the identity of the target genes which VGAM2656 binds and inhibits, and the function of these target genes, as elaborated hereinbelow.

ATP-binding Cassette, Sub-family A (ABC1), Member 1 (ABCA1, Accession NM_005502) is a VGAM2656 host target gene. ABCA1 BINDING SITE is HOST TARGET binding site found in the 3' untranslated region of mRNA encoded by ABCA1, corresponding to a HOST TARGET binding site such as BINDING SITE I, BINDING SITE II or BINDING SITE III. Table 2 illustrates the complementarity of the nucleotide sequences of ABCA1 BINDING SITE, designated SEQ ID:12011, to the nucleotide sequence of VGAM2656 RNA, herein designated VGAM RNA, also designated SEQ ID:5367.

A function of VGAM2656 is therefore inhibition of ATP-binding Cassette, Sub-family A (ABC1), Member 1 (ABCA1, Accession NM_005502), a gene which camp-dependent and sulfonylurea-sensitive anion transporter. Accordingly, utilities of VGAM2656 include diagnosis, prevention and treatment of diseases and clinical conditions associated with ABCA1. The function of ABCA1 and its association with various diseases and clinical conditions, has been established by previous studies, as described hereinabove with reference to VGAM1956. HLA-G Histocompatibility Antigen, Class I, G (HLA-G, Accession NM_002127) is another VGAM2656 host target gene. HLA-G BINDING SITE is HOST TARGET binding site found in the 3' untranslated region of mRNA encoded by HLA-G, corresponding to a HOST TARGET binding site such as BINDING SITE I, BINDING SITE II or BINDING SITE III. Table 2 illustrates the complementarity of the nucleotide sequences of HLA-G BINDING SITE, designated SEQ ID:7906, to the nucleotide sequence of VGAM2656 RNA, herein designated VGAM RNA, also designated SEQ ID:5367.

Another function of VGAM2656 is therefore inhibition of HLA-G Histocompatibility Antigen, Class I, G (HLA-G, Accession NM_002127), a gene which involved in the presentation of foreign antigens to the immune system. Accordingly, utilities of VGAM2656 include diagnosis, prevention and treatment of diseases and clinical conditions associated with HLA-G. The function of HLA-G has been established by previous studies. Extravillous trophoblast from normal human placenta and the BeWo adherent human choriocarcinoma cell line express an unusual form of class I HLA molecule. This molecule has an H chain of approximately 40 kD and is apparently nonpolymorphic. Ellis et al. (1990) isolated and sequenced a cDNA clone for this class I HLA antigen. The nucleotide sequence showed a high degree of homology with the published sequence of a genomic clone, HLA 6.0, which is the product of a class I locus other than A, B, or C. The new locus was provisionally designated HLAG. Using PCR, Ellis et al. (1990) demonstrated similar HLA class I sequences in cDNA from normal extravillous trophoblasts. Although there was some nucleotide sequence polymorphism, the amino acid sequence of the molecule was conserved; hence, it is unlikely to provoke immune responses even though it is found at the fetal-maternal interface. Considering the well established role of nonclassic HLA-G class I molecules in inhibiting natural killer cell function, the consequence of abnormal HLA-G expression in malignant cells should be the escape of tumors from immunosurveillance. To examine this hypothesis, Paul et al. (1998) analyzed HLA-G expression and NK sensitivity in human malignant melanoma cells. Two melanoma cell lines exhibited a high level of HLA-G transcription with differential HLA-G isoform transcription and protein expression patterns. A higher level of HLA-G transcription ex vivo was detected in a skin melanoma metastasis biopsy compared with a healthy skin fragment from the same individual. HLA-G protein isoforms other than membrane-bound HLA-G1 protected 1 melanoma cell line from NK lysis. It thus appeared of critical importance to consider the specific role of HLA-G expression in tumors in the design of cancer immunotherapies.

Full details of the abovementioned studies are described in the following publications, the disclosure of which are hereby incorporated by reference:

Ellis, S. A.; Palmer, M. S.; McMichael, A. J.: Human trophoblast and the choriocarcinoma cell line BeWo express a truncated HLA class I molecule. J. Immun. 144:731-735, 1990; and Paul, P.; Rouas-Freiss, N.; Khalil-Daher, I.; Moreau, P.; Riteau, B.; Le Gal, F. A.; Avril, M. F.; Dausset, J.; Guillet, J. G.; Carosella, E. D.: HLA-G expression in melanoma: a way fo.

Further studies establishing the function and utilities of HLA-G are found in John Hopkins OMIM database record ID 142871, and in sited publications numbered 3295, 11451-11460, 3781, 11461-1146 and 11499-11501 listed in the bibliography section hereinbelow, which are also hereby incorporated by reference. DKFZp761F2014 (Accession NM_020215) is another VGAM2656 host target gene. DKFZp761F2014 BINDING SITE is HOST TARGET binding site found in the 3' untranslated region of mRNA encoded by DKFZp761F2014, corresponding to a HOST TARGET binding site such as BINDING SITE I, BINDING SITE II or BINDING SITE III. Table 2 illustrates the complementarity of the nucleotide sequences of DKFZp761F2014 BINDING SITE, designated SEQ ID:21457, to the nucleotide sequence of VGAM2656 RNA, herein designated VGAM RNA, also designated SEQ ID:5367.

Another function of VGAM2656 is therefore inhibition of DKFZp761F2014 (Accession NM_020215). Accordingly, utilities of VGAM2656 include diagnosis, prevention and treatment of diseases and clinical conditions associated with DKFZp761F2014. KIAA1463 (Accession XM_051160) is another VGAM2656 host target gene. KIAA1463 BINDING SITE is HOST TARGET binding site found in the 3' untranslated region of mRNA encoded by KIAA1463, corresponding to a HOST TARGET binding site such as BINDING SITE I, BINDING SITE II or BINDING SITE III. Table 2 illustrates the complementarity of the nucleotide sequences of KIAA1463 BINDING SITE, designated SEQ ID:35768, to the nucleotide sequence of VGAM2656 RNA, herein designated VGAM RNA, also designated SEQ ID:5367.

Another function of VGAM2656 is therefore inhibition of KIAA1463 (Accession XM_051160). Accordingly, utilities of VGAM2656 include diagnosis, prevention and treatment of diseases and clinical conditions associated with KIAA1463. MGC2488 (Accession NM_024039) is another VGAM2656 host target gene. MGC2488 BINDING SITE is HOST TARGET binding site found in the 3' untranslated region of mRNA encoded by MGC2488, corresponding to a HOST TARGET binding site such as BINDING SITE I, BINDING SITE II or BINDING SITE III. Table 2 illustrates the complementarity of the nucleotide sequences of MGC2488 BINDING SITE, designated SEQ ID:23473, to the nucleotide sequence of VGAM2656 RNA, herein designated VGAM RNA, also designated SEQ ID:5367.

Another function of VGAM2656 is therefore inhibition of MGC2488 (Accession NM_024039). Accordingly, utilities of VGAM2656 include diagnosis, prevention and treatment of diseases and clinical conditions associated with MGC2488. MGC2560 (Accession NM_031452) is another VGAM2656 host target gene. MGC2560 BINDING SITE is HOST TARGET binding site found in the 3' untranslated region of mRNA encoded by MGC2560, corresponding to a HOST TARGET binding site such as BINDING SITE I, BINDING SITE II or BINDING SITE III. Table 2 illustrates the complementarity of the nucleotide sequences of MGC2560 BINDING SITE, designated SEQ ID:25466, to the nucleotide sequence of VGAM2656 RNA, herein designated VGAM RNA, also designated SEQ ID:5367.

Another function of VGAM2656 is therefore inhibition of MGC2560 (Accession NM_031452). Accordingly, utilities of VGAM2656 include diagnosis, prevention and treatment of diseases and clinical conditions associated with MGC2560. Synaptotagmin XIII (SYT13, Accession XM_167880) is another VGAM2656 host target gene. SYT13 BINDING SITE is HOST TARGET binding site found in the 3' untranslated region of mRNA encoded by SYT13, corresponding to a HOST TARGET binding site such as BINDING SITE I, BINDING SITE II or BINDING SITE III. Table 2 illustrates the complementarity of the nucleotide sequences of SYT13 BINDING SITE, designated SEQ ID:44886, to the nucleotide sequence of VGAM2656 RNA, herein designated VGAM RNA, also designated SEQ ID:5367.

Another function of VGAM2656 is therefore inhibition of Synaptotagmin XIII (SYT13, Accession XM_167880). Accordingly, utilities of VGAM2656 include diagnosis, prevention and treatment of diseases and clinical conditions associated with SYT13. LOC113523 (Accession XM_054378) is another VGAM2656 host target gene. LOC113523 BINDING SITE is HOST TARGET binding site found in the 3' untranslated region of mRNA encoded by LOC113523, corresponding to a HOST TARGET binding site such as BINDING SITE I, BINDING SITE II or BINDING SITE III. Table 2 illustrates the complementarity of the nucleotide sequences of LOC113523 BINDING SITE, designated SEQ ID:36150, to the nucleotide sequence of VGAM2656 RNA, herein designated VGAM RNA, also designated SEQ ID:5367.

Another function of VGAM2656 is therefore inhibition of LOC113523 (Accession XM_054378). Accordingly, utilities of VGAM2656 include diagnosis, prevention and treatment of diseases and clinical conditions associated with LOC113523. LOC147343 (Accession XM_097225) is another VGAM2656 host target gene. LOC147343 BINDING SITE is HOST TARGET binding site found in the 5' untranslated region of mRNA encoded by LOC147343, corresponding to a HOST TARGET binding site such as BINDING SITE I, BINDING SITE II or BINDING SITE III. Table 2 illustrates the complementarity of the nucleotide sequences of LOC147343 BINDING SITE, designated SEQ ID:40830, to the nucleotide sequence of VGAM2656 RNA, herein designated VGAM RNA, also designated SEQ ID:5367.

Another function of VGAM2656 is therefore inhibition of LOC147343 (Accession XM_097225). Accordingly, utilities of VGAM2656 include diagnosis, prevention and treatment of diseases and clinical conditions associated with LOC147343. LOC150245 (Accession XM_097843) is another VGAM2656 host target gene. LOC150245 BINDING SITE is HOST TARGET binding site found in the 3' untranslated region of mRNA encoded by LOC150245, corresponding to a HOST TARGET binding site such as BINDING SITE I, BINDING SITE II or BINDING SITE III. Table 2 illustrates the complementarity of the nucleotide sequences of LOC150245 BINDING SITE, designated SEQ ID:41161, to the nucleotide sequence of VGAM2656 RNA, herein designated VGAM RNA, also designated SEQ ID:5367.

Another function of VGAM2656 is therefore inhibition of LOC150245 (Accession XM_097843). Accordingly, utilities of VGAM2656 include diagnosis, prevention and treatment of diseases and clinical conditions associated with LOC150245. LOC220477 (Accession XM_071675) is another VGAM2656 host target gene. LOC220477 BINDING SITE is HOST TARGET binding site found in the 5' untranslated region of mRNA encoded by LOC220477, corresponding to a HOST TARGET binding site such as BINDING SITE I, BINDING SITE II or BINDING SITE III. Table 2 illustrates the complementarity of the nucleotide sequences of LOC220477 BINDING SITE, designated SEQ ID:37407, to the nucleotide sequence of VGAM2656 RNA, herein designated VGAM RNA, also designated SEQ ID:5367.

Another function of VGAM2656 is therefore inhibition of LOC220477 (Accession XM_071675). Accordingly, utilities of VGAM2656 include diagnosis, prevention and treatment of diseases and clinical conditions associated with LOC220477. LOC254700 (Accession XM_171244) is another VGAM2656 host target gene. LOC254700 BINDING SITE is HOST TARGET binding site found in the 3' untranslated region of mRNA encoded by LOC254700, corresponding to a HOST TARGET binding site such as BINDING SITE I, BINDING SITE II or BINDING SITE III. Table 2 illustrates the complementarity of the nucleotide sequences of LOC254700 BINDING SITE, designated SEQ ID:46037, to the nucleotide sequence of VGAM2656 RNA, herein designated VGAM RNA, also designated SEQ ID:5367.

Another function of VGAM2656 is therefore inhibition of LOC254700 (Accession XM_171244). Accordingly, utilities of VGAM2656 include diagnosis, prevention and treatment of diseases and clinical conditions associated with LOC254700. FIG. 1 further provides a conceptual description of a novel bioinformatically detected viral gene of the present invention, referred to here as Viral Genomic Address Messenger 2657 (VGAM2657) viral gene, which modulates expression of respective host target genes thereof, the function and utility of which host target genes is known in the art.

VGAM2657 is a novel bioinformatically detected regulatory, non protein coding, viral micro RNA (miRNA) gene. The method by which VGAM2657 was detected is described hereinabove with reference to FIGS. 1-8.

VGAM2657 gene, herein designated VGAM GENE, is a viral gene contained in the genome of Potato Virus A. VGAM2657 host target gene, herein designated VGAM HOST TARGET GENE, is a human gene contained in the human genome.

VGAM2657 gene encodes a VGAM2657 precursor RNA, herein designated VGAM PRECURSOR RNA. Similar to other miRNA genes, and unlike most ordinary genes, VGAM2657 precursor RNA does not encode a protein. A nucleotide sequence identical or highly similar to the nucleotide sequence of VGAM2657 precursor RNA is designated SEQ ID:2643, and is provided hereinbelow with reference to the sequence listing part. Nucleotide sequence SEQ ID:2643 is located at position 7993 relative to the genome of Potato Virus A.

VGAM2657 precursor RNA folds onto itself, forming VGAM2657 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2657 folded precursor RNA into VGAM2657 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2657 RNA is designated SEQ ID:5368, and is provided hereinbelow with reference to the sequence listing part.

VGAM2657 host target gene, herein designated VGAM HOST TARGET GENE, encodes a corresponding messenger RNA, VGAM2657 host target RNA, herein designated VGAM HOST TARGET RNA. VGAM2657 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2657 RNA, herein designated VGAM RNA, binds complementarily to one or more host target binding sites located in untranslated regions of VGAM2657 host target RNA, herein designated VGAM HOST TARGET RNA. This complementary binding is due to the fact that the nucleotide sequence of VGAM2657 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2657 RNA, herein designated VGAM RNA, may have a different number of host target binding sites in untranslated regions of a VGAM2657 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2657 RNA, herein designated VGAM RNA, to host target binding sites on VGAM2657 host target RNA, herein designated VGAM HOST TARGET RNA, such as BINDING SITE I, BINDING SITE II and BINDING SITE III, inhibits translation of VGAM2657 host target RNA into VGAM2657 host target protein, herein designated VGAM HOST TARGET PROTEIN. VGAM host target protein is therefore outlined by a broken line.

It is appreciated that VGAM2657 host target gene, herein designated VGAM HOST TARGET GENE, in fact represents a plurality of VGAM2657 host target genes. The mRNA of each one of this plurality of VGAM2657 host target genes comprises one or more host target binding sites, each having a nucleotide sequence which is at least partly complementary to VGAM2657 RNA, herein designated VGAM RNA, and which when bound by VGAM2657 RNA causes inhibition of translation of respective one or more VGAM2657 host target proteins.

It is further appreciated by one skilled in the art that the mode of translational inhibition illustrated by FIG. 1 with specific reference to translational inhibition exerted by VGAM2657 gene, herein designated VGAM GENE, on one or more VGAM2657 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2657 is inhibition of expression of host target genes, as part of a novel viral mechanism of attacking a host. Accordingly, utilities of VGAM2657 include diagnosis, prevention and treatment of viral infection by Potato Virus A. Specific functions, and accordingly utilities, of VGAM2657 correlate with, and may be deduced from, the identity of the host target genes which VGAM2657 binds and inhibits, and the function of these host target genes, as elaborated hereinbelow.

Nucleotide sequences of the VGAM2657 precursor RNA, herein designated VGAM PRECURSOR RNA, and of the 'diced' VGAM2657 RNA, herein designated VGAM RNA, and a schematic representation of the secondary folding of VGAM2657 folded precursor RNA, herein designated VGAM FOLDED PRECURSOR RNA, of VGAM2657 are further described hereinbelow with reference to Table 1.

Nucleotide sequences of host target binding sites, such as BINDING SITE-I, BINDING SITE-II and BINDING SITE-III of FIG. 1, found on VGAM2657 host target RNA, and schematic representation of the complementarity of each of these host target binding sites to VGAM2657 RNA, herein designated VGAM RNA, are described hereinbelow with reference to Table 2.

As mentioned hereinabove with reference to FIG. 1, a function of VGAM2657 gene, herein designated VGAM is inhibition of expression of VGAM2657 target genes. It is appreciated that specific functions, and accordingly utilities, of VGAM2657 correlate with, and may be deduced from, the identity of the target genes which VGAM2657 binds and inhibits, and the function of these target genes, as elaborated hereinbelow.

ATP-binding Cassette, Sub-family C (CFTR/MRP), Member 3 (ABCC3, Accession NM_020038) is a VGAM2657 host target gene. ABCC3 BINDING SITE is HOST TARGET binding site found in the 3' untranslated region of mRNA encoded by ABCC3, corresponding to a HOST TARGET binding site such as BINDING SITE I, BINDING SITE II or BINDING SITE III. Table 2 illustrates the complementarity of the nucleotide sequences of ABCC3 BINDING SITE, designated SEQ ID:21292, to the nucleotide sequence of VGAM2657 RNA, herein designated VGAM RNA, also designated SEQ ID:5368.

A function of VGAM2657 is therefore inhibition of ATP-binding Cassette, Sub-family C (CFTR/MRP), Member 3 (ABCC3, Accession NM_020038), a gene which may act as an inducible transporter in the biliary and intestinal excretion of organic anions. Accordingly, utilities of VGAM2657 include diagnosis, prevention and treatment of diseases and clinical conditions associated with ABCC3. The function of ABCC3 and its association with various diseases and clinical conditions, has been established by previous studies, as described hereinabove with reference to VGAM505. Cadherin, EGF LAG Seven-pass G-type Receptor 2 (flamingo homolog, Drosophila) (CELSR2, Accession NM_001408) is another VGAM2657 host target gene. CELSR2 BINDING SITE is HOST TARGET binding site found in the 3' untranslated region of mRNA encoded by CELSR2, corresponding to a HOST TARGET binding site such as BINDING SITE I, BINDING SITE II or BINDING SITE III. Table 2 illustrates the complementarity of the nucleotide sequences of CELSR2 BINDING SITE, designated SEQ ID:7107, to the nucleotide sequence of VGAM2657 RNA, herein designated VGAM RNA, also designated SEQ ID:5368.

Another function of VGAM2657 is therefore inhibition of Cadherin, EGF LAG Seven-pass G-type Receptor 2 (flamingo homolog, Drosophila) (CELSR2, Accession NM_001408), a gene which is a calcium dependent cell adhesion protein. Accordingly, utilities of VGAM2657 include diagnosis, prevention and treatment of diseases and clinical conditions associated with CELSR2. The function of CELSR2 and its association with various diseases and clinical conditions, has been established by previous studies, as described hereinabove with reference to VGAM432. FXYD Domain Containing Ion Transport Regulator 6 (FXYD6, Accession NM_022003) is another VGAM2657 host target gene. FXYD6 BINDING SITE is HOST TARGET binding site found in the 3' untranslated region of mRNA encoded by FXYD6, corresponding to a HOST TARGET binding site such as BINDING SITE I, BINDING SITE II or BINDING SITE III. Table 2 illustrates the complementarity of the nucleotide sequences of FXYD6 BINDING SITE, designated SEQ ID:22548, to the nucleotide sequence of VGAM2657 RNA, herein designated VGAM RNA, also designated SEQ ID:5368.

Another function of VGAM2657 is therefore inhibition of FXYD Domain Containing Ion Transport Regulator 6 (FXYD6, Accession NM_022003). Accordingly, utilities of VGAM2657 include diagnosis, prevention and treatment of diseases and clinical conditions associated with FXYD6. Hepatocyte Nuclear Factor 4, Alpha (HNF4A, Accession NM_000457) is another VGAM2657 host target gene. HNF4A BINDING SITE is HOST TARGET binding site found in the 3' untranslated region of mRNA encoded by HNF4A, corresponding to a HOST TARGET binding site such as BINDING SITE I, BINDING SITE II or BINDING SITE III. Table 2 illustrates the complementarity of the nucleotide sequences of HNF4A BINDING SITE, designated SEQ ID:6072, to the nucleotide sequence of VGAM2657 RNA, herein designated VGAM RNA, also designated SEQ ID:5368.

Another function of VGAM2657 is therefore inhibition of Hepatocyte Nuclear Factor 4, Alpha (HNF4A, Accession NM_000457), a gene which may be essential for development of the liver, kidney, pancreas and intestine. Accordingly, utilities of VGAM2657 include diagnosis, prevention and treatment of diseases and clinical conditions associated with HNF4A. The function of HNF4A has been established by previous studies. Stoffel and Duncan (1997) investigated the molecular mechanism by which the Q268X mutation, which deletes 187 C-terminal amino acids of the HNF4-alpha protein, causes diabetes. They showed that the mutant gene product had lost its transcriptional transactivation activity and failed to dimerize and bind DNA, implying that the MODY1 phenotype is due to a loss of HFN4-alpha function. The effect of loss of function on expression of HNF4-alpha target genes was investigated further in embryonic stem cells, which are amenable to genetic manipulation and can be induced to form visceral endoderm. Because the visceral endoderm shares many properties with the liver and pancreatic beta-cells, including expression of genes for glucose transport and metabolism, it offers an ideal system to investigate HNF4-dependent gene regulation in glucose homeostasis. With this approach, Stoffel and Duncan (1997) identified several genes encoding components of the glucose-dependent insulin secretion pathway whose expression is dependent upon HNF4-alpha. These included glucose transporter 2 (OMIM Ref. No. 138160), and the glycolytic enzymes aldolase B (OMIM Ref. No. 229600) and glyceraldehyde-3-phosphate dehydrogenase (OMIM Ref. No. 138400), and liver pyruvate kinase (OMIM Ref. No. 266200). In addition, they found that expression of the fatty acid binding proteins and cellular retinol binding protein also are downregulated in the absence of HNF4-alpha. These data provided direct evidence that HNF4-alpha is critical for regulating glucose transport and glycolysis and in doing so is critical for maintaining glucose homeostasis. Animal model experiments lend further support to the function of HNF4A. To study the contribution of HNF4A to hepatic development and differentiation, Li et al. (2000) used a technique in which Hnf4a -/- mouse embryos were complemented with wildtype visceral endoderm to counteract early embryonic lethality. By histologic analyses, the authors found that specification and early development of the liver and liver morphology did not require Hnf4a. In addition, the expression of many liver genes was unaffected in these mice. However, RT-PCR analysis showed that Hnf4a -/- fetal livers failed to express a large array of genes whose expression in differentiated hepatocytes is essential for a functional hepatic parenchyma, including apolipoproteins (e.g., APOA1; 107680), metabolic proteins (e.g., aldolase B; 229600), transferrin (OMIM Ref. No. 190000), retinol-binding protein (e.g., RBP4; 180250), and erythropoietin (OMIM Ref. No. 133170). The lack of Hnf4a did not affect the expression of most transcription factors but did significantly reduce the levels of Hnf1a (TCF1; 142410) and the pregnane X receptor (NR1I2; 603065), suggesting that HNF4A acts upstream of at least these 2 transcription factors, which are also important in hepatocyte gene expression.

It is appreciated that the abovementioned animal model for HNF4A is acknowledged by those skilled in the art as a scientifically valid animal model, as can be further appreciated from the publications sited hereinbelow.

Full details of the abovementioned studies are described in the following publications, the disclosure of which are hereby incorporated by reference:

Li, J.; Ning, G.; Duncan, S. A.: Mammalian hepatocyte differentiation requires the transcription factor HNF-4-alpha. Genes Dev. 14:464-474, 2000; and Stoffel, M.; Duncan, S. A.: The maturity-onset diabetes of the young (MODY1) transcription factor HNF4-alpha regulates expression of genes required for glucose transport and metabolism. P.

Further studies establishing the function and utilities of HNF4A are found in John Hopkins OMIM database record ID 600281, and in sited publications numbered 4979, 9869-9871, 11607, 12032-9875, 12033-12034, 987 and 12035-9878 listed in the bibliography section hereinbelow, which are also hereby incorporated by reference. Neural Retina Leucine Zipper (NRL, Accession NM_006177) is another VGAM2657 host target gene. NRL BINDING SITE is HOST TARGET binding site found in the 3' untranslated region of mRNA encoded by NRL, corresponding to a HOST TARGET binding site such as BINDING SITE I, BINDING SITE II or BINDING SITE III. Table 2 illustrates the complementarity of the nucleotide sequences of NRL BINDING SITE, designated SEQ ID:12838, to the nucleotide sequence of VGAM2657 RNA, herein designated VGAM RNA, also designated SEQ ID:5368.

Another function of VGAM2657 is therefore inhibition of Neural Retina Leucine Zipper (NRL, Accession NM_006177), a gene which has a basic motif and a leucine zipper domain similar to jun and fos. Accordingly, utilities of VGAM2657 include diagnosis, prevention and treatment of diseases and clinical conditions associated with NRL. The function of NRL and its association with various diseases and clinical conditions, has been established by previous studies, as described hereinabove with reference to VGAM419. PACE (Accession NM_002569) is another VGAM2657 host target gene. PACE BINDING SITE is HOST TARGET binding site found in the 3' untranslated region of mRNA encoded by PACE, corresponding to a HOST TARGET binding site such as BINDING SITE I, BINDING SITE II or BINDING SITE III. Table 2 illustrates the complementarity of the nucleotide sequences of PACE BINDING SITE, designated SEQ ID:8422, to the nucleotide sequence of VGAM2657 RNA, herein designated VGAM RNA, also designated SEQ ID:5368.

Another function of VGAM2657 is therefore inhibition of PACE (Accession NM_002569), a gene which processes pro-parathyroid hormone, pro-transforming growth factor beta. Accordingly, utilities of VGAM2657 include diagnosis, prevention and treatment of diseases and clinical conditions associated with PACE. The function of PACE and its association with various diseases and clinical conditions, has been established by previous studies, as described hereinabove with reference to VGAM151. RAD52 Homolog (S. cerevisiae) (RAD52, Accession NM_134423) is another VGAM2657 host target gene. RAD52 BINDING SITE is HOST TARGET binding site found in the 3' untranslated region of mRNA encoded by RAD52, corresponding to a HOST TARGET binding site such as BINDING SITE I, BINDING SITE II or BINDING SITE III. Table 2 illustrates the complementarity of the nucleotide sequences of RAD52 BINDING SITE, designated SEQ ID:28658, to the nucleotide sequence of VGAM2657 RNA, herein designated VGAM RNA, also designated SEQ ID:5368.

Another function of VGAM2657 is therefore inhibition of RAD52 Homolog (S. cerevisiae) (RAD52, Accession NM_134423). Accordingly, utilities of VGAM2657 include diagnosis, prevention and treatment of diseases and clinical conditions associated with RAD52. Regulating Synaptic Membrane Exocytosis 1 (RIMS1, Accession XM_052206) is another VGAM2657 host target gene. RIMS1 BINDING SITE is HOST TARGET binding site found in the 5' untranslated region of mRNA encoded by RIMS1, corresponding to a HOST TARGET binding site such as BINDING SITE I, BINDING SITE II or BINDING SITE III. Table 2 illustrates the complementarity of the nucleotide sequences of RIMS1 BINDING SITE, designated SEQ ID:35957, to the nucleotide sequence of VGAM2657 RNA, herein designated VGAM RNA, also designated SEQ ID:5368.

Another function of VGAM2657 is therefore inhibition of Regulating Synaptic Membrane Exocytosis 1 (RIMS1, Accession XM_052206), a gene which may have a regulatory role in the membrane interactions during trafficking of synaptic vesicles. Accordingly, utilities of VGAM2657 include diagnosis, prevention and treatment of diseases and clinical conditions associated with RIMS1. The function of RIMS1 and its association with various diseases and clinical conditions, has been established by previous studies, as described hereinabove with reference to VGAM2454. Ribonuclease/angiogenin Inhibitor (RNH, Accession XM_006139) is another VGAM2657 host target gene. RNH BINDING SITE1 and RNH BINDING SITE2 are HOST TARGET binding sites found in untranslated regions of mRNA encoded by RNH, corresponding to HOST TARGET binding sites such as BINDING SITE I, BINDING SITE II or BINDING SITE III. Table 2 illustrates the complementarity of the nucleotide sequences of RNH BINDING SITE1 and RNH BINDING SITE2, designated SEQ ID:29993 and SEQ ID:8844 respectively, to the nucleotide sequence of VGAM2657 RNA, herein designated VGAM RNA, also designated SEQ ID:5368.

Another function of VGAM2657 is therefore inhibition of Ribonuclease/angiogenin Inhibitor (RNH, Accession XM_006139), a gene which is an inhibitor of pancreatic rnase and angiogenin. may also function in the modulation of cellular activities. Accordingly, utilities of VGAM2657 include diagnosis, prevention and treatment of diseases and clinical conditions associated with RNH. The function of RNH and its association with various diseases and clinical conditions, has been established by previous studies, as described hereinabove with reference to VGAM484. Solute Carrier Family 7 (cationic amino acid transporter, y+ system), Member 7 (SLC7A7, Accession NM_003982) is another VGAM2657 host target gene. SLC7A7 BINDING SITE1 and SLC7A7 BINDING SITE2 are HOST TARGET binding sites found in untranslated regions of mRNA encoded by SLC7A7, corresponding to HOST TARGET binding sites such as BINDING SITE I, BINDING SITE II or BINDING SITE III. Table 2 illustrates the complementarity of the nucleotide sequences of SLC7A7 BINDING SITE1 and SLC7A7 BINDING SITE2, designated SEQ ID:10122 and SEQ ID:43809 respectively, to the nucleotide sequence of VGAM2657 RNA, herein designated VGAM RNA, also designated SEQ ID:5368.

Another function of VGAM2657 is therefore inhibition of Solute Carrier Family 7 (cationic amino acid transporter, y+ system), Member 7 (SLC7A7, Accession NM_003982). Accordingly, utilities of VGAM2657 include diagnosis, prevention and treatment of diseases and clinical conditions associated with SLC7A7. FLJ22814 (Accession NM_024916) is another VGAM2657 host target gene. FLJ22814 BINDING SITE is HOST TARGET binding site found in the 3' untranslated region of mRNA encoded by FLJ22814, corresponding to a HOST TARGET binding site such as BINDING SITE I, BINDING SITE II or BINDING SITE III. Table 2 illustrates the complementarity of the nucleotide sequences of FLJ22814 BINDING SITE, designated SEQ ID:24443, to the nucleotide sequence of VGAM2657 RNA, herein designated VGAM RNA, also designated SEQ ID:5368.

Another function of VGAM2657 is therefore inhibition of FLJ22814 (Accession NM_024916). Accordingly, utilities of VGAM2657 include diagnosis, prevention and treatment of diseases and clinical conditions associated with FLJ22814. FLJ23416 (Accession NM_032238) is another VGAM2657 host target gene. FLJ23416 BINDING SITE is HOST TARGET binding site found in the 3' untranslated region of mRNA encoded by FLJ23416, corresponding to a HOST TARGET binding site such as BINDING SITE I, BINDING SITE II or BINDING SITE III. Table 2 illustrates the complementarity of the nucleotide sequences of FLJ23416 BINDING SITE, designated SEQ ID:25960, to the nucleotide sequence of VGAM2657 RNA, herein designated VGAM RNA, also designated SEQ ID:5368.

Another function of VGAM2657 is therefore inhibition of FLJ23416 (Accession NM_032238). Accordingly, utilities of VGAM2657 include diagnosis, prevention and treatment of diseases and clinical conditions associated with FLJ23416. FLJ23519 (Accession XM_044932) is another VGAM2657 host target gene. FLJ23519 BINDING SITE is HOST TARGET binding site found in the 5' untranslated region of mRNA encoded by FLJ23519, corresponding to a HOST TARGET binding site such as BINDING SITE I, BINDING SITE II or BINDING SITE III. Table 2 illustrates the complementarity of the nucleotide sequences of FLJ23519 BINDING SITE, designated SEQ ID:34307, to the nucleotide sequence of VGAM2657 RNA, herein designated VGAM RNA, also designated SEQ ID:5368.

Another function of VGAM2657 is therefore inhibition of FLJ23519 (Accession XM_044932). Accordingly, utilities of VGAM2657 include diagnosis, prevention and treatment of diseases and clinical conditions associated with FLJ23519. Potassium Voltage-gated Channel, Subfamily G, Member 3 (KCNG3, Accession NM_133329) is another VGAM2657 host target gene. KCNG3 BINDING SITE is HOST TARGET binding site found in the 5' untranslated region of mRNA encoded by KCNG3, corresponding to a HOST TARGET binding site such as BINDING SITE I, BINDING SITE II or BINDING SITE III. Table 2 illustrates the complementarity of the nucleotide sequences of KCNG3 BINDING SITE, designated SEQ ID:28437, to the nucleotide sequence of VGAM2657 RNA, herein designated VGAM RNA, also designated SEQ ID:5368.

Another function of VGAM2657 is therefore inhibition of Potassium Voltage-gated Channel, Subfamily G, Member 3 (KCNG3, Accession NM_133329). Accordingly, utilities of VGAM2657 include diagnosis, prevention and treatment of diseases and clinical conditions associated with KCNG3. KIAA1464 (Accession XM_043069) is another VGAM2657 host target gene. KIAA1464 BINDING SITE is HOST TARGET binding site found in the 3' untranslated region of mRNA encoded by KIAA1464, corresponding to a HOST TARGET binding site such as BINDING SITE I, BINDING SITE II or BINDING SITE III. Table 2 illustrates the complementarity of the nucleotide sequences of KIAA1464 BINDING SITE, designated SEQ ID:33879, to the nucleotide sequence of VGAM2657 RNA, herein designated VGAM RNA, also designated SEQ ID:5368.

Another function of VGAM2657 is therefore inhibition of KIAA1464 (Accession XM_043069). Accordingly, utilities of VGAM2657 include diagnosis, prevention and treatment of diseases and clinical conditions associated with KIAA1464. KIAA1674 (Accession XM_044065) is another VGAM2657 host target gene. KIAA1674 BINDING SITE1 through KIAA1674 BINDING SITE6 are HOST TARGET binding sites found in untranslated regions of mRNA encoded by KIAA1674, corresponding to HOST TARGET binding sites such as BINDING SITE I, BINDING SITE II or BINDING SITE III. Table 2 illustrates the complementarity of the nucleotide sequences of KIAA1674 BINDING SITE1 through KIAA1674 BINDING SITE6, designated SEQ ID:34104, SEQ ID:34105, SEQ ID:34106, SEQ ID:34107, SEQ ID:34108 and SEQ ID:34109 respectively, to the nucleotide sequence of VGAM2657 RNA, herein designated VGAM RNA, also designated SEQ ID:5368.

Another function of VGAM2657 is therefore inhibition of KIAA1674 (Accession XM_044065). Accordingly, utilities of VGAM2657 include diagnosis, prevention and treatment of diseases and clinical conditions associated with KIAA1674. MGC2474 (Accession NM_023931) is another VGAM2657 host target gene. MGC2474 BINDING SITE is HOST TARGET binding site found in the 3' untranslated region of mRNA encoded by MGC2474, corresponding to a HOST TARGET binding site such as BINDING SITE I, BINDING SITE II or BINDING SITE III. Table 2 illustrates the complementarity of the nucleotide sequences of MGC2474 BINDING SITE, designated SEQ ID:23415, to the nucleotide sequence of VGAM2657 RNA, herein designated VGAM RNA, also designated SEQ ID:5368.

Another function of VGAM2657 is therefore inhibition of MGC2474 (Accession NM_023931). Accordingly, utilities of VGAM2657 include diagnosis, prevention and treatment of diseases and clinical conditions associated with MGC2474. MGC3047 (Accession NM_032348) is another VGAM2657 host target gene. MGC3047 BINDING SITE is HOST TARGET binding site found in the 3' untranslated region of mRNA encoded by MGC3047, corresponding to a HOST TARGET binding site such as BINDING SITE I, BINDING SITE II or BINDING SITE III. Table 2 illustrates the complementarity of the nucleotide sequences of MGC3047 BINDING SITE, designated SEQ ID:26138, to the nucleotide sequence of VGAM2657 RNA, herein designated VGAM RNA, also designated SEQ ID:5368.

Another function of VGAM2657 is therefore inhibition of MGC3047 (Accession NM_032348). Accordingly, utilities of VGAM2657 include diagnosis, prevention and treatment of diseases and clinical conditions associated with MGC3047. MGC5391 (Accession NM_032740) is another VGAM2657 host target gene. MGC5391 BINDING SITE is HOST TARGET binding site found in the 3' untranslated region of mRNA encoded by MGC5391, corresponding to a HOST TARGET binding site such as BINDING SITE I, BINDING SITE II or BINDING SITE III. Table 2 illustrates the complementarity of the nucleotide sequences of MGC5391 BINDING SITE, designated SEQ ID:26471, to the nucleotide sequence of VGAM2657 RNA, herein designated VGAM RNA, also designated SEQ ID:5368.

Another function of VGAM2657 is therefore inhibition of MGC5391 (Accession NM_032740). Accordingly, utilities of VGAM2657 include diagnosis, prevention and treatment of diseases and clinical conditions associated with MGC5391. NIFU (Accession XM_041081) is another VGAM2657 host target gene. NIFU BINDING SITE is HOST TARGET binding site found in the 5' untranslated region of mRNA encoded by NIFU, corresponding to a HOST TARGET binding site such as BINDING SITE I, BINDING SITE II or BINDING SITE III. Table 2 illustrates the complementarity of the nucleotide sequences of NIFU BINDING SITE, designated SEQ ID:33436, to the nucleotide sequence of VGAM2657 RNA, herein designated VGAM RNA, also designated SEQ ID:5368.

Another function of VGAM2657 is therefore inhibition of NIFU (Accession XM_041081). Accordingly, utilities of VGAM2657 include diagnosis, prevention and treatment of diseases and clinical conditions associated with NIFU. Syndecan 3 (N-syndecan) (SDC3, Accession NM_014654) is another VGAM2657 host target gene. SDC3 BINDING SITE is HOST TARGET binding site found in the 3' untranslated region of mRNA encoded by SDC3, corresponding to a HOST TARGET binding site such as BINDING SITE I, BINDING SITE II or BINDING SITE III. Table 2 illustrates the complementarity of the nucleotide sequences of SDC3 BINDING SITE, designated SEQ ID:16091, to the nucleotide sequence of VGAM2657 RNA, herein designated VGAM RNA, also designated SEQ ID:5368.

Another function of VGAM2657 is therefore inhibition of Syndecan 3 (N-syndecan) (SDC3, Accession NM_014654). Accordingly, utilities of VGAM2657 include diagnosis, prevention and treatment of diseases and clinical conditions associated with SDC3. Transducer of ERBB2, 2 (TOB2, Accession XM_170995) is another VGAM2657 host target gene. TOB2 BINDING SITE is HOST TARGET binding site found in the 3' untranslated region of mRNA encoded by TOB2, corresponding to a HOST TARGET binding site such as BINDING SITE I, BINDING SITE II or BINDING SITE III. Table 2 illustrates the complementarity of the nucleotide sequences of TOB2 BINDING SITE, designated SEQ ID:45771, to the nucleotide sequence of VGAM2657 RNA, herein designated VGAM RNA, also designated SEQ ID:5368.

Another function of VGAM2657 is therefore inhibition of Transducer of ERBB2, 2 (TOB2, Accession XM_170995). Accordingly, utilities of VGAM2657 include diagnosis, prevention and treatment of diseases and clinical conditions associated with TOB2. LOC142927 (Accession XM_084380) is another VGAM2657 host target gene. LOC142927 BINDING SITE is HOST TARGET binding site found in the 3' untranslated region of mRNA encoded by LOC142927, corresponding to a HOST TARGET binding site such as BINDING SITE I, BINDING SITE II or BINDING SITE III. Table 2 illustrates the complementarity of the nucleotide sequences of LOC142927 BINDING SITE, designated SEQ ID:37569, to the nucleotide sequence of VGAM2657 RNA, herein designated VGAM RNA, also designated SEQ ID:5368.

Another function of VGAM2657 is therefore inhibition of LOC142927 (Accession XM_084380). Accordingly, utilities of VGAM2657 include diagnosis, prevention and treatment of diseases and clinical conditions associated with LOC142927. LOC144571 (Accession XM_096630) is another VGAM2657 host target gene. LOC144571 BIND- ING SITE is HOST TARGET binding site found in the 5' untranslated region of mRNA encoded by LOC144571, corresponding to a HOST TARGET binding site such as BINDING SITE I, BINDING SITE II or BINDING SITE III. Table 2 illustrates the complementarity of the nucleotide sequences of LOC144571 BINDING SITE, designated SEQ ID:40444, to the nucleotide sequence of VGAM2657 RNA, herein designated VGAM RNA, also designated SEQ ID:5368.

Another function of VGAM2657 is therefore inhibition of LOC144571 (Accession XM_096630). Accordingly, utilities of VGAM2657 include diagnosis, prevention and treatment of diseases and clinical conditions associated with LOC144571. LOC145195 (Accession XM_096731) is another VGAM2657 host target gene. LOC145195 BINDING SITE is HOST TARGET binding site found in the 3' untranslated region of mRNA encoded by LOC145195, corresponding to a HOST TARGET binding site such as BINDING SITE I, BINDING SITE II or BINDING SITE III. Table 2 illustrates the complementarity of the nucleotide sequences of LOC145195 BINDING SITE, designated SEQ ID:40512, to the nucleotide sequence of VGAM2657 RNA, herein designated VGAM RNA, also designated SEQ ID:5368.

Another function of VGAM2657 is therefore inhibition of LOC145195 (Accession XM_096731). Accordingly, utilities of VGAM2657 include diagnosis, prevention and treatment of diseases and clinical conditions associated with LOC145195. LOC146782 (Accession XM_083963) is another VGAM2657 host target gene. LOC146782 BINDING SITE is HOST TARGET binding site found in the 5' untranslated region of mRNA encoded by LOC146782, corresponding to a HOST TARGET binding site such as BINDING SITE I, BINDING SITE II or BINDING SITE III. Table 2 illustrates the complementarity of the nucleotide sequences of LOC146782 BINDING SITE, designated SEQ ID:37524, to the nucleotide sequence of VGAM2657 RNA, herein designated VGAM RNA, also designated SEQ ID:5368.

Another function of VGAM2657 is therefore inhibition of LOC146782 (Accession XM_083963). Accordingly, utilities of VGAM2657 include diagnosis, prevention and treatment of diseases and clinical conditions associated with LOC146782. LOC148709 (Accession XM_086281) is another VGAM2657 host target gene. LOC148709 BINDING SITE is HOST TARGET binding site found in the 5' untranslated region of mRNA encoded by LOC148709, corresponding to a HOST TARGET binding site such as BINDING SITE I, BINDING SITE II or BINDING SITE III. Table 2 illustrates the complementarity of the nucleotide sequences of LOC148709 BINDING SITE, designated SEQ ID:38579, to the nucleotide sequence of VGAM2657 RNA, herein designated VGAM RNA, also designated SEQ ID:5368.

Another function of VGAM2657 is therefore inhibition of LOC148709 (Accession XM_086281). Accordingly, utilities of VGAM2657 include diagnosis, prevention and treatment of diseases and clinical conditions associated with LOC148709. LOC149478 (Accession XM_086536) is another VGAM2657 host target gene. LOC149478 BINDING SITE is HOST TARGET binding site found in the 5' untranslated region of mRNA encoded by LOC149478, corresponding to a HOST TARGET binding site such as BINDING SITE I, BINDING SITE II or BINDING SITE III. Table 2 illustrates the complementarity of the nucleotide sequences of LOC149478 BINDING SITE, designated SEQ ID:38753, to the nucleotide sequence of VGAM2657 RNA, herein designated VGAM RNA, also designated SEQ ID:5368.

Another function of VGAM2657 is therefore inhibition of LOC149478 (Accession XM_086536). Accordingly, utilities of VGAM2657 include diagnosis, prevention and treatment of diseases and clinical conditions associated with LOC149478. LOC170395 (Accession XM_084325) is another VGAM2657 host target gene. LOC170395 BINDING SITE1 through LOC170395 BINDING SITE3 are HOST TARGET binding sites found in untranslated regions of mRNA encoded by LOC170395, corresponding to HOST TARGET binding sites such as BINDING SITE I, BINDING SITE II or BINDING SITE III. Table 2 illustrates the complementarity of the nucleotide sequences of LOC170395 BINDING SITE1 through LOC170395 BINDING SITE3, designated SEQ ID:37543, SEQ ID:37541 and SEQ ID:37542 respectively, to the nucleotide sequence of VGAM2657 RNA, herein designated VGAM RNA, also designated SEQ ID:5368.

Another function of VGAM2657 is therefore inhibition of LOC170395 (Accession XM_084325). Accordingly, utilities of VGAM2657 include diagnosis, prevention and treatment of diseases and clinical conditions associated with LOC170395. LOC256158 (Accession XM_175125) is another VGAM2657 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46634, to the nucleotide sequence of VGAM2657 RNA, herein designated VGAM RNA, also designated SEQ ID:5368.

Another function of VGAM2657 is therefore inhibition of LOC256158 (Accession XM_175125). Accordingly, utilities of VGAM2657 include diagnosis, prevention and treatment of diseases and clinical conditions associated with LOC256158. LOC257054 (Accession XM_171010) is another VGAM2657 host target gene. LOC257054 BINDING SITE is HOST TARGET binding site found in the 5' untranslated region of mRNA encoded by LOC257054, corresponding to a HOST TARGET binding site such as BINDING SITE I, BINDING SITE II or BINDING SITE III. Table 2 illustrates the complementarity of the nucleotide sequences of LOC257054 BINDING SITE, designated SEQ ID:45782, to the nucleotide sequence of VGAM2657 RNA, herein designated VGAM RNA, also designated SEQ ID:5368.

Another function of VGAM2657 is therefore inhibition of LOC257054 (Accession XM_171010). Accordingly, utilities of VGAM2657 include diagnosis, prevention and treatment of diseases and clinical conditions associated with LOC257054. LOC90019 (Accession NM_138567) is another VGAM2657 host target gene. LOC90019 BINDING SITE is HOST TARGET binding site found in the 5' untranslated region of mRNA encoded by LOC90019, corresponding to a HOST TARGET binding site such as BINDING SITE I, BINDING SITE II or BINDING SITE III. Table 2 illustrates the complementarity of the nucleotide sequences of LOC90019 BINDING SITE, designated SEQ ID:28877, to the nucleotide sequence of VGAM2657 RNA, herein designated VGAM RNA, also designated SEQ ID:5368.

Another function of VGAM2657 is therefore inhibition of LOC90019 (Accession NM_138567). Accordingly, utilities of VGAM2657 include diagnosis, prevention and treatment of diseases and clinical conditions associated with LOC90019. FIG. 1 further provides a conceptual description of a novel bioinformatically detected viral gene of the present invention, referred to here as Viral Genomic Address Messenger 2658 (VGAM2658) viral gene, which modulates expression of respective host target genes thereof, the function and utility of which host target genes is known in the art.

VGAM2658 is a novel bioinformatically detected regulatory, non protein coding, viral micro RNA (miRNA) gene. The method by which VGAM2658 was detected is described hereinabove with reference to FIGS. 1-8.

VGAM2658 gene, herein designated VGAM GENE, is a viral gene contained in the genome of Potato Virus A. VGAM2658 host target gene, herein designated VGAM HOST TARGET GENE, is a human gene contained in the human genome.

VGAM2658 gene encodes a VGAM2658 precursor RNA, herein designated VGAM PRECURSOR RNA. Similar to other miRNA genes, and unlike most ordinary genes, VGAM2658 precursor RNA does not encode a protein. A nucleotide sequence identical or highly similar to the nucleotide sequence of VGAM2658 precursor RNA is designated SEQ ID:2644, and is provided hereinbelow with reference to the sequence listing part. Nucleotide sequence SEQ ID:2644 is located at position 8772 relative to the genome of Potato Virus A.

VGAM2658 precursor RNA folds onto itself, forming VGAM2658 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2658 folded precursor RNA into VGAM2658 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM2658 RNA is designated SEQ ID:5369, and is provided hereinbelow with reference to the sequence listing part.

VGAM2658 host target gene, herein designated VGAM HOST TARGET GENE, encodes a corresponding messenger RNA, VGAM2658 host target RNA, herein designated VGAM HOST TARGET RNA. VGAM2658 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2658 RNA, herein designated VGAM RNA, binds complementarily to one or more host target binding sites located in untranslated regions of VGAM2658 host target RNA, herein designated VGAM HOST TARGET RNA. This complementary binding is due to the fact that the nucleotide sequence of VGAM2658 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2658 RNA, herein designated VGAM RNA, may have a different number of host target binding sites in untranslated regions of a VGAM2658 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2658 RNA, herein designated VGAM RNA, to host target binding sites on VGAM2658 host target RNA, herein designated VGAM HOST TARGET RNA, such as BINDING SITE I, BINDING SITE II and BINDING SITE III, inhibits translation of VGAM2658 host target RNA into VGAM2658 host target protein, herein designated VGAM HOST TARGET PROTEIN. VGAM host target protein is therefore outlined by a broken line.

It is appreciated that VGAM2658 host target gene, herein designated VGAM HOST TARGET GENE, in fact represents a plurality of VGAM2658 host target genes. The mRNA of each one of this plurality of VGAM2658 host target genes comprises one or more host target binding sites, each having a nucleotide sequence which is at least partly complementary to VGAM2658 RNA, herein designated VGAM RNA, and which when bound by VGAM2658 RNA causes inhibition of translation of respective one or more VGAM2658 host target proteins.

It is further appreciated by one skilled in the art that the mode of translational inhibition illustrated by FIG. 1 with specific reference to translational inhibition exerted by VGAM2658 gene, herein designated VGAM GENE, on one or more VGAM2658 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2658 is inhibition of expression of host target genes, as part of a novel viral mechanism of attacking a host. Accordingly, utilities of VGAM2658 include diagnosis, prevention and treatment of viral infection by Potato Virus A. Specific functions, and accordingly utilities, of VGAM2658 correlate with, and may be deduced from, the identity of the host target genes which VGAM2658 binds and inhibits, and the function of these host target genes, as elaborated hereinbelow.

Nucleotide sequences of the VGAM2658 precursor RNA, herein designated VGAM PRECURSOR RNA, and of the 'diced' VGAM2658 RNA, herein designated VGAM RNA, and a schematic representation of the secondary folding of VGAM2658 folded precursor RNA, herein designated VGAM FOLDED PRECURSOR RNA, of VGAM2658 are further described hereinbelow with reference to Table 1.

Nucleotide sequences of host target binding sites, such as BINDING SITE-I, BINDING SITE-II and BINDING SITE-III of FIG. 1, found on VGAM2658 host target RNA, and schematic representation of the complementarity of each of these host target binding sites to VGAM2658 RNA, herein designated VGAM RNA, are described hereinbelow with reference to Table 2.

As mentioned hereinabove with reference to FIG. 1, a function of VGAM2658 gene, herein designated VGAM is inhibition of expression of VGAM2658 target genes. It is appreciated that specific functions, and accordingly utilities, of VGAM2658 correlate with, and may be deduced from, the identity of the target genes which VGAM2658 binds and inhibits, and the function of these target genes, as elaborated hereinbelow.

Heterogeneous Nuclear Ribonucleoprotein K (HNRPK, Accession NM_002140) is a VGAM2658 host target gene. HNRPK BINDING SITE1 and HNRPK BINDING SITE2 are HOST TARGET binding sites found in untranslated regions of mRNA encoded by HNRPK, corresponding to HOST TARGET binding sites such as BINDING SITE I, BINDING SITE II or BINDING SITE III. Table 2 illustrates the complementarity of the nucleotide sequences of HNRPK BINDING SITE1 and HNRPK BINDING SITE2, designated SEQ ID:7918 and SEQ ID:25282 respectively, to the nucleotide sequence of VGAM2658 RNA, herein designated VGAM RNA, also designated SEQ ID:5369.

A function of VGAM2658 is therefore inhibition of Heterogeneous Nuclear Ribonucleoprotein K (HNRPK, Accession NM_002140), a gene which play a role in the nuclear metabolism of hnrnas, particularly for pre-mrnas that contain cytidine-rich sequence. Accordingly, utilities of VGAM2658 include diagnosis, prevention and treatment of diseases and clinical conditions associated with HNRPK. The function of HNRPK and its association with various diseases and clinical conditions, has been established by previous studies, as described hereinabove with reference to VGAM125. Ribulose-5-phosphate-3-epimerase (RPE, Accession XM_030834) is another VGAM2658 host target gene. RPE BINDING SITE is HOST TARGET binding site found in the 5' untranslated region of mRNA encoded by RPE, corresponding to a HOST TARGET binding site such as BINDING SITE I, BINDING SITE II or BINDING SITE III. Table 2 illustrates the complementarity of the nucleotide sequences of RPE BINDING SITE, designated SEQ ID:31157, to the nucleotide sequence of VGAM2658 RNA, herein designated VGAM RNA, also designated SEQ ID:5369.

Another function of VGAM2658 is therefore inhibition of Ribulose-5-phosphate-3-epimerase (RPE, Accession XM_030834). Accordingly, utilities of VGAM2658 include diagnosis, prevention and treatment of diseases and clinical conditions associated with RPE. Chromosome 20 Open Reading Frame 140 (C20orf140, Accession NM_144628) is another VGAM2658 host target gene. C20orf140 BINDING SITE is HOST TARGET binding site found in the 3' untranslated region of mRNA encoded by C20orf140, corresponding to a HOST TARGET binding site such as BINDING SITE I, BINDING SITE II or BINDING SITE III. Table 2 illustrates the complementarity of the nucleotide sequences of C20orf140 BINDING SITE, designated SEQ ID:29444, to the nucleotide sequence of VGAM2658 RNA, herein designated VGAM RNA, also designated SEQ ID:5369.

Another function of VGAM2658 is therefore inhibition of Chromosome 20 Open Reading Frame 140 (C20orf140, Accession NM_144628). Accordingly, utilities of VGAM2658 include diagnosis, prevention and treatment of diseases and clinical conditions associated with C20orf140. CCR4-NOT Transcription Complex, Subunit 4 (CNOT4, Accession NM_013316) is another VGAM2658 host target gene. CNOT4 BINDING SITE is HOST TARGET binding site found in the 3' untranslated region of mRNA encoded by CNOT4, corresponding to a HOST TARGET binding site such as BINDING SITE I, BINDING SITE II or BINDING SITE III. Table 2 illustrates the complementarity of the nucleotide sequences of CNOT4 BINDING SITE, designated SEQ ID:14965, to the nucleotide sequence of VGAM2658 RNA, herein designated VGAM RNA, also designated SEQ ID:5369.

Another function of VGAM2658 is therefore inhibition of CCR4-NOT Transcription Complex, Subunit 4 (CNOT4, Accession NM_013316). Accordingly, utilities of VGAM2658 include diagnosis, prevention and treatment of diseases and clinical conditions associated with CNOT4. KIAA1348 (Accession XM_043826) is another VGAM2658 host target gene. KIAA1348 BINDING SITE is HOST TARGET binding site found in the 3" untranslated region of mRNA encoded by KIAA1348, corresponding to a HOST TARGET binding site such as BINDING SITE I, BINDING SITE II or BINDING SITE III. Table 2 illustrates the complementarity of the nucleotide sequences of KIAA1348 BINDING SITE, designated SEQ ID:34031, to the nucleotide sequence of VGAM2658 RNA, herein designated VGAM RNA, also designated SEQ ID:5369.

Another function of VGAM2658 is therefore inhibition of KIAA1348 (Accession XM_043826). Accordingly, utilities of VGAM2658 include diagnosis, prevention and treatment of diseases and clinical conditions associated with KIAA1348. KIAA1577 (Accession XM_035299) is another VGAM2658 host target gene. KIAA1577 BINDING SITE is HOST TARGET binding site found in the 5' untranslated region of mRNA encoded by KIAA1577, corresponding to a HOST TARGET binding site such as BINDING SITE I, BINDING SITE II or BINDING SITE III. Table 2 illustrates the complementarity of the nucleotide sequences of KIAA1577 BINDING SITE, designated SEQ ID:32210, to the nucleotide sequence of VGAM2658 RNA, herein designated VGAM RNA, also designated SEQ ID:5369.

Another function of VGAM2658 is therefore inhibition of KIAA1577 (Accession XM_035299). Accordingly, utilities of VGAM2658 include diagnosis, prevention and treatment of diseases and clinical conditions associated with KIAA1577. MGC2835 (Accession NM_024072) is another VGAM2658 host target gene. MGC2835 BINDING SITE is HOST TARGET binding site found in the 3' untranslated region of mRNA encoded by MGC2835, corresponding to a HOST TARGET binding site such as BINDING SITE I, BINDING SITE II or BINDING SITE III. Table 2 illustrates the complementarity of the nucleotide sequences of MGC2835 BINDING SITE, designated SEQ ID:23504, to the nucleotide sequence of VGAM2658 RNA, herein designated VGAM RNA, also designated SEQ ID:5369.

Another function of VGAM2658 is therefore inhibition of MGC2835 (Accession NM_024072). Accordingly, utilities of VGAM2658 include diagnosis, prevention and treatment of diseases and clinical conditions associated with MGC2835. LOC146823 (Accession XM_097105) is another VGAM2658 host target gene. LOC146823 BINDING SITE is HOST TARGET binding site found in the 3' untranslated region of mRNA encoded by LOC146823, corresponding to a HOST TARGET binding site such as BINDING SITE I, BINDING SITE II or BINDING SITE III. Table 2 illustrates the complementarity of the nucleotide sequences of LOC146823 BINDING SITE, designated SEQ ID:40751, to the nucleotide sequence of VGAM2658 RNA, herein designated VGAM RNA, also designated SEQ ID:5369.

Another function of VGAM2658 is therefore inhibition of LOC146823 (Accession XM_097105). Accordingly, utilities of VGAM2658 include diagnosis, prevention and treatment of diseases and clinical conditions associated with LOC146823. LOC149302 (Accession XM_086489) is another VGAM2658 host target gene. LOC149302 BINDING SITE is HOST TARGET binding site found in the 5' untranslated region of mRNA encoded by LOC149302, corresponding to a HOST TARGET binding site such as BINDING SITE I, BINDING SITE II or BINDING SITE III. Table 2 illustrates the complementarity of the nucleotide sequences of LOC149302 BINDING SITE, designated SEQ ID:38704, to the nucleotide sequence of VGAM2658 RNA, herein designated VGAM RNA, also designated SEQ ID:5369.

Another function of VGAM2658 is therefore inhibition of LOC149302 (Accession XM_086489). Accordingly, utilities of VGAM2658 include diagnosis, prevention and treatment of diseases and clinical conditions associated with LOC149302. LOC164397 (Accession XM_092780) is another VGAM2658 host target gene. LOC164397 BINDING SITE is HOST TARGET binding site found in the 3' untranslated region of mRNA encoded by LOC164397, corresponding to a HOST TARGET binding site such as BINDING SITE I, BINDING SITE II or BINDING SITE III. Table 2 illustrates the complementarity of the nucleotide sequences of LOC164397 BINDING SITE, designated SEQ ID:40154, to the nucleotide sequence of VGAM2658 RNA, herein designated VGAM RNA, also designated SEQ ID:5369.

Another function of VGAM2658 is therefore inhibition of LOC164397 (Accession XM_092780). Accordingly, utilities of VGAM2658 include diagnosis, prevention and treatment of diseases and clinical conditions associated with LOC164397. FIG. 1 further provides a conceptual description of a novel bioinformatically detected viral gene of the present invention, referred to here as Viral Genomic Address Messenger 2659 (VGAM2659) viral gene, which modulates expression of respective host target genes thereof, the function and utility of which host target genes is known in the art.

VGAM2659 is a novel bioinformatically detected regulatory, non protein coding, viral micro RNA (miRNA) gene. The method by which VGAM2659 was detected is described hereinabove with reference to FIGS. 1-8.

VGAM2659 gene, herein designated VGAM GENE, is a viral gene contained in the genome of Potato Virus A. VGAM2659 host target gene, herein designated VGAM HOST TARGET GENE, is a human gene contained in the human genome.

VGAM2659 gene encodes a VGAM2659 precursor RNA, herein designated VGAM PRECURSOR RNA. Similar to other miRNA genes, and unlike most ordinary genes, VGAM2659 precursor RNA does not encode a protein. A nucleotide sequence identical or highly similar to the nucleotide sequence of VGAM2659 precursor RNA is designated SEQ ID:2645, and is provided hereinbelow with reference to the sequence listing part. Nucleotide sequence SEQ ID:2645 is located at position 3436 relative to the genome of Potato Virus A.

VGAM2659 precursor RNA folds onto itself, forming VGAM2659 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2659 folded precursor RNA into VGAM2659 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2659 RNA is designated SEQ ID:5370, and is provided hereinbelow with reference to the sequence listing part.

VGAM2659 host target gene, herein designated VGAM HOST TARGET GENE, encodes a corresponding messenger RNA, VGAM2659 host target RNA, herein designated VGAM HOST TARGET RNA. VGAM2659 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2659 RNA, herein designated VGAM RNA, binds complementarily to one or more host target binding sites located in untranslated regions of VGAM2659 host target RNA, herein designated VGAM HOST TARGET RNA. This complementary binding is due to the fact that the nucleotide sequence of VGAM2659 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2659 RNA, herein designated VGAM RNA, may have a different number of host target binding sites in untranslated regions of a VGAM2659 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2659 RNA, herein designated VGAM RNA, to host target binding sites on VGAM2659 host target RNA, herein designated VGAM HOST TARGET RNA, such as BINDING SITE I, BINDING SITE II and BINDING SITE III, inhibits translation of VGAM2659 host target RNA into VGAM2659 host target protein, herein designated VGAM HOST TARGET PROTEIN. VGAM host target protein is therefore outlined by a broken line.

It is appreciated that VGAM2659 host target gene, herein designated VGAM HOST TARGET GENE, in fact represents a plurality of VGAM2659 host target genes. The mRNA of each one of this plurality of VGAM2659 host target genes comprises one or more host target binding sites, each having a nucleotide sequence which is at least partly complementary to VGAM2659 RNA, herein designated VGAM RNA, and which when bound by VGAM2659 RNA causes inhibition of translation of respective one or more VGAM2659 host target proteins.

It is further appreciated by one skilled in the art that the mode of translational inhibition illustrated by FIG. 1 with specific reference to translational inhibition exerted by VGAM2659 gene, herein designated VGAM GENE, on one or more VGAM2659 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2659 is inhibition of expression of host target genes, as part of a novel viral mechanism of attacking a host. Accordingly, utilities of VGAM2659 include diagnosis, prevention and treatment of viral infection by Potato Virus A. Specific functions, and accordingly utilities, of VGAM2659 correlate with, and may be deduced from, the identity of the host target genes which VGAM2659 binds and inhibits, and the function of these host target genes, as elaborated hereinbelow.

Nucleotide sequences of the VGAM2659 precursor RNA, herein designated VGAM PRECURSOR RNA, and of the 'diced' VGAM2659 RNA, herein designated VGAM RNA, and a schematic representation of the secondary folding of VGAM2659 folded precursor RNA, herein designated VGAM FOLDED PRECURSOR RNA, of VGAM2659 are further described hereinbelow with reference to Table 1.

Nucleotide sequences of host target binding sites, such as BINDING SITE-I, BINDING SITE-II and BINDING SITE-III of FIG. 1, found on VGAM2659 host target RNA, and schematic representation of the complementarity of each of these host target binding sites to VGAM2659 RNA, herein designated VGAM RNA, are described hereinbelow with reference to Table 2.

As mentioned hereinabove with reference to FIG. 1, a function of VGAM2659 gene, herein designated VGAM is inhibition of expression of VGAM2659 target genes. It is appreciated that specific functions, and accordingly utilities, of VGAM2659 correlate with, and may be deduced from, the identity of the target genes which VGAM2659 binds and inhibits, and the function of these target genes, as elaborated hereinbelow.

Aldehyde Dehydrogenase 3 Family, Member B1 (ALDH3B1, Accession XM_166190) is a VGAM2659 host target gene. ALDH3B1 BINDING SITE is HOST TARGET binding site found in the 3' untranslated region of mRNA encoded by ALDH3B1, corresponding to a HOST TARGET binding site such as BINDING SITE I, BINDING SITE II or BINDING SITE III. Table 2 illustrates the complementarity of the nucleotide sequences of ALDH3B1 BINDING SITE, designated SEQ ID:44001, to the nucleotide sequence of VGAM2659 RNA, herein designated VGAM RNA, also designated SEQ ID:5370.

A function of VGAM2659 is therefore inhibition of Aldehyde Dehydrogenase 3 Family, Member B1 (ALDH3B1, Accession XM_166190), a gene which may play a major role in the detoxification of aldehydes generated by alcohol metabolism and lipid peroxidation. Accordingly, utilities of VGAM2659 include diagnosis, prevention and treatment of diseases and clinical conditions associated with ALDH3B1. The function of ALDH3B1 and its association with various diseases and clinical conditions, has been established by previous studies, as described hereinabove with reference to VGAM2007. AT-binding Transcription Factor 1 (ATBF1, Accession NM_006885) is another VGAM2659 host target gene. ATBF1 BINDING SITE is HOST TARGET binding site found in the 5' untranslated region of mRNA encoded by ATBF1, corresponding to a HOST TARGET binding site such as BINDING SITE I, BINDING SITE II or BINDING SITE III. Table 2 illustrates the complementarity of the nucleotide sequences of ATBF1 BINDING SITE, designated SEQ ID:13750, to the nucleotide sequence of VGAM2659 RNA, herein designated VGAM RNA, also designated SEQ ID:5370.

Another function of VGAM2659 is therefore inhibition of AT-binding Transcription Factor 1 (ATBF1, Accession NM_006885). Accordingly, utilities of VGAM2659 include diagnosis, prevention and treatment of diseases and clinical conditions associated with ATBF1. Axin 1 (AXIN1, Accession XM_027520) is another VGAM2659 host target gene. AXIN1 BINDING SITE is HOST TARGET binding site found in the 3' untranslated region of mRNA encoded by AXIN1, corresponding to a HOST TARGET binding site such as BINDING SITE I, BINDING SITE II or BINDING SITE III. Table 2 illustrates the complementarity of the nucleotide sequences of AXIN1 BINDING SITE, designated SEQ ID:30519, to the nucleotide sequence of VGAM2659 RNA, herein designated VGAM RNA, also designated SEQ ID:5370.

Another function of VGAM2659 is therefore inhibition of Axin 1 (AXIN1, Accession XM_027520). Accordingly, utilities of VGAM2659 include diagnosis, prevention and treatment of diseases and clinical conditions associated with AXIN1. B-cell CLL/lymphoma 9 (BCL9, Accession NM_004326) is another VGAM2659 host target gene. BCL9 BINDING SITE is HOST TARGET binding site found in the 3' untranslated region of mRNA encoded by BCL9, corresponding to a HOST TARGET binding site such as BINDING SITE I, BINDING SITE II or BINDING SITE III. Table 2 illustrates the complementarity of the nucleotide sequences of BCL9 BINDING SITE, designated SEQ ID:10526, to the nucleotide sequence of VGAM2659 RNA, herein designated VGAM RNA, also designated SEQ ID:5370.

Another function of VGAM2659 is therefore inhibition of B-cell CLL/lymphoma 9 (BCL9, Accession NM_004326), a gene which recruits of PYGO to the nuclear beta-catenin-TCF complex in Wnt/Wingless signaling. Accordingly, utilities of VGAM2659 include diagnosis, prevention and treatment of diseases and clinical conditions associated with BCL9. The function of BCL9 and its association with various diseases and clinical conditions, has been established by previous studies, as described hereinabove with reference to VGAM74. Cleavage and Polyadenylation Specific Factor 6, 68 kDa (CPSF6, Accession NM_007007) is another VGAM2659 host target gene. CPSF6 BINDING SITE is HOST TARGET binding site found in the 3' untranslated region of mRNA encoded by CPSF6, corresponding to a HOST TARGET binding site such as BINDING SITE I, BINDING SITE II or BINDING SITE III. Table 2 illustrates the complementarity of the nucleotide sequences of CPSF6 BINDING SITE, designated SEQ ID:13870, to the nucleotide sequence of VGAM2659 RNA, herein designated VGAM RNA, also designated SEQ ID:5370.

Another function of VGAM2659 is therefore inhibition of Cleavage and Polyadenylation Specific Factor 6, 68 kDa (CPSF6, Accession NM_007007). Accordingly, utilities of VGAM2659 include diagnosis, prevention and treatment of diseases and clinical conditions associated with CPSF6. POU Domain, Class 4, Transcription Factor 1 (POU4F1, Accession NM_006237) is another VGAM2659 host target gene. POU4F1 BINDING SITE is HOST TARGET binding site found in the 3' untranslated region of mRNA encoded by POU4F1, corresponding to a HOST TARGET binding site such as BINDING SITE I, BINDING SITE II or BINDING SITE III. Table 2 illustrates the complementarity of the nucleotide sequences of POU4F1 BINDING SITE, designated SEQ ID:12899, to the nucleotide sequence of VGAM2659 RNA, herein designated VGAM RNA, also designated SEQ ID:5370.

Another function of VGAM2659 is therefore inhibition of POU Domain, Class 4, Transcription Factor 1 (POU4F1, Accession NM_006237), a gene which plays a role in the regulation of specific gene expression within a subset of neuronal lineages. Accordingly, utilities of VGAM2659 include diagnosis, prevention and treatment of diseases and clinical conditions associated with POU4F1. The function of POU4F1 and its association with various diseases and clinical conditions, has been established by previous studies, as described hereinabove with reference to VGAM1026. SRY (sex determining region Y)-box 4 (SOX4, Accession NM_003107) is another VGAM2659 host target gene. SOX4 BINDING SITE is HOST TARGET binding site found in the 3' untranslated region of mRNA encoded by SOX4, corresponding to a HOST TARGET binding site such as BINDING SITE I, BINDING SITE II or BINDING SITE III. Table 2 illustrates the complementarity of the nucleotide sequences of SOX4 BINDING SITE, designated SEQ ID:9078, to the nucleotide sequence of VGAM2659 RNA, herein designated VGAM RNA, also designated SEQ ID:5370.

Another function of VGAM2659 is therefore inhibition of SRY (sex determining region Y)-box 4 (SOX4, Accession NM_003107), a gene which binds with high affinity to the t-cell enhancer motif 5'-aacaaag-3' motif. Accordingly, utilities of VGAM2659 include diagnosis, prevention and treatment of diseases and clinical conditions associated with SOX4. The function of SOX4 and its association with various diseases and clinical conditions, has been established by previous studies, as described hereinabove with reference to VGAM409. T-cell Leukemia, Homeobox 1 (TLX1, Accession NM_005521) is another VGAM2659 host target gene. TLX1 BINDING SITE is HOST TARGET binding site found in the 3' untranslated region of mRNA encoded by TLX1, corresponding to a HOST TARGET binding site such as BINDING SITE I, BINDING SITE II or BINDING SITE III. Table 2 illustrates the complementarity of the nucleotide sequences of TLX1 BINDING SITE, designated SEQ ID:12047, to the nucleotide sequence of VGAM2659 RNA, herein designated VGAM RNA, also designated SEQ ID:5370.

Another function of VGAM2659 is therefore inhibition of T-cell Leukemia, Homeobox 1 (TLX1, Accession NM_005521), a gene which controls the spleen development. Accordingly, utilities of VGAM2659 include diagnosis, prevention and treatment of diseases and clinical conditions associated with TLX1. The function of TLX1 and its association with various diseases and clinical conditions, has been established by previous studies, as described hereinabove with reference to VGAM1505. Chromosome X Open Reading Frame 1 (CXorf1, Accession NM_004709) is another VGAM2659 host target gene. CXorf1 BINDING SITE is HOST TARGET binding site found in the 3' untranslated region of mRNA encoded by CXorf1, corresponding to a HOST TARGET binding site such as BINDING SITE I, BINDING SITE II or BINDING SITE III. Table 2 illustrates the complementarity of the nucleotide sequences of CXorf1 BINDING SITE, designated SEQ ID:11057, to the nucleotide sequence of VGAM2659 RNA, herein designated VGAM RNA, also designated SEQ ID:5370.

Another function of VGAM2659 is therefore inhibition of Chromosome X Open Reading Frame 1 (CXorf1, Accession NM_004709). Accordingly, utilities of VGAM2659 include diagnosis, prevention and treatment of diseases and clinical conditions associated with CXorf1. DC-TM4F2 (Accession NM_030927) is another VGAM2659 host target gene. DC-TM4F2 BINDING SITE is HOST TARGET binding site found in the 3" untranslated region of mRNA encoded by DC-TM4F2, corresponding to a HOST TARGET binding site such as BINDING SITE I, BINDING SITE II or BINDING SITE III. Table 2 illustrates the complementarity of the nucleotide sequences of DC-TM4F2 BINDING SITE, designated SEQ ID:25200, to the nucleotide sequence of VGAM2659 RNA, herein designated VGAM RNA, also designated SEQ ID:5370.

Another function of VGAM2659 is therefore inhibition of DC-TM4F2 (Accession NM_030927). Accordingly, utilities of VGAM2659 include diagnosis, prevention and treatment of diseases and clinical conditions associated with DC-TM4F2. DKFZP566N034 (Accession XM_087115) is another VGAM2659 host target gene. DKFZP566N034 BINDING SITE is HOST TARGET binding site found in the 3' untranslated region of mRNA encoded by DKFZP566N034, corresponding to a HOST TARGET binding site such as BINDING SITE I, BINDING SITE II or BINDING SITE III. Table 2 illustrates the complementarity of the nucleotide sequences of DKFZP566N034 BINDING SITE, designated SEQ ID:39064, to the nucleotide sequence of VGAM2659 RNA, herein designated VGAM RNA, also designated SEQ ID:5370.

Another function of VGAM2659 is therefore inhibition of DKFZP566N034 (Accession XM_087115). Accordingly, utilities of VGAM2659 include diagnosis, prevention and treatment of diseases and clinical conditions associated with DKFZP566N034. FLJ10597 (Accession NM_018150) is another VGAM2659 host target gene. FLJ10597 BINDING SITE is HOST TARGET binding site found in the 3' untranslated region of mRNA encoded by FLJ10597, corresponding to a HOST TARGET binding site such as BINDING SITE I, BINDING SITE II or BINDING SITE III. Table 2 illustrates the complementarity of the nucleotide sequences of FLJ10597 BINDING SITE, designated SEQ ID:19954, to the nucleotide sequence of VGAM2659 RNA, herein designated VGAM RNA, also designated SEQ ID:5370.

Another function of VGAM2659 is therefore inhibition of FLJ10597 (Accession NM_018150). Accordingly, utilities of VGAM2659 include diagnosis, prevention and treatment of diseases and clinical conditions associated with FLJ10597. FLJ12687 (Accession NM_024917) is another VGAM2659 host target gene. FLJ12687 BINDING SITE is HOST TARGET binding site found in the 3' untranslated region of mRNA encoded by FLJ12687, corresponding to a HOST TARGET binding site such as BINDING SITE I, BINDING SITE II or BINDING SITE III. Table 2 illustrates the complementarity of the nucleotide sequences of FLJ12687 BINDING SITE, designated SEQ ID:24449, to the nucleotide sequence of VGAM2659 RNA, herein designated VGAM RNA, also designated SEQ ID:5370.

Another function of VGAM2659 is therefore inhibition of FLJ12687 (Accession NM_024917). Accordingly, utilities of VGAM2659 include diagnosis, prevention and treatment of diseases and clinical conditions associated with FLJ12687. FLJ23323 (Accession NM_024654) is another VGAM2659 host target gene. FLJ23323 BINDING SITE is HOST TARGET binding site found in the 5' untranslated region of mRNA encoded by FLJ23323, corresponding to a HOST TARGET binding site such as BINDING SITE I, BINDING SITE II or BINDING SITE III. Table 2 illustrates the complementarity of the nucleotide sequences of FLJ23323 BINDING SITE, designated SEQ ID:23956, to the nucleotide sequence of VGAM2659 RNA, herein designated VGAM RNA, also designated SEQ ID:5370.

Another function of VGAM2659 is therefore inhibition of FLJ23323 (Accession NM_024654). Accordingly, utilities of VGAM2659 include diagnosis, prevention and treatment of diseases and clinical conditions associated with FLJ23323. FLJ23399 (Accession NM_022763) is another VGAM2659 host target gene. FLJ23399 BINDING SITE is HOST TARGET binding site found in the 5' untranslated region of mRNA encoded by FLJ23399, corresponding to a HOST TARGET binding site such as BINDING SITE I, BINDING SITE II or BINDING SITE III. Table 2 illustrates the complementarity of the nucleotide sequences of FLJ23399 BINDING SITE, designated SEQ ID:23009, to the nucleotide sequence of VGAM2659 RNA, herein designated VGAM RNA, also designated SEQ ID:5370.

Another function of VGAM2659 is therefore inhibition of FLJ23399 (Accession NM_022763). Accordingly, utilities of VGAM2659 include diagnosis, prevention and treatment of diseases and clinical conditions associated with FLJ23399. Golgi Phosphoprotein 3 (coat-protein) (GOLPH3, Accession NM_022130) is another VGAM2659 host target gene. GOLPH3 BINDING SITE is HOST TARGET binding site found in the 3' untranslated region of mRNA encoded by GOLPH3, corresponding to a HOST TARGET binding site such as BINDING SITE I, BINDING SITE II or BINDING SITE III. Table 2 illustrates the complementarity of the nucleotide sequences of GOLPH3 BINDING SITE, designated SEQ ID:22688, to the nucleotide sequence of VGAM2659 RNA, herein designated VGAM RNA, also designated SEQ ID:5370.

Another function of VGAM2659 is therefore inhibition of Golgi Phosphoprotein 3 (coat-protein) (GOLPH3, Accession NM_022130). Accordingly, utilities of VGAM2659 include diagnosis, prevention and treatment of diseases and clinical conditions associated with GOLPH3. KIAA1130 (Accession XM_031104) is another VGAM2659 host target gene. KIAA1130 BINDING SITE is HOST TARGET binding site found in the 3' untranslated region of mRNA encoded by KIAA1130, corresponding to a HOST TARGET binding site such as BINDING SITE I, BINDING SITE II or BINDING SITE III. Table 2 illustrates the complementarity of the nucleotide sequences of KIAA1130 BINDING SITE, designated SEQ ID:31288, to the nucleotide sequence of VGAM2659 RNA, herein designated VGAM RNA, also designated SEQ ID:5370.

Another function of VGAM2659 is therefore inhibition of KIAA1130 (Accession XM_031104). Accordingly, utilities of VGAM2659 include diagnosis, prevention and treatment of diseases and clinical conditions associated with KIAA1130. KIAA1287 (Accession XM_085753) is another VGAM2659 host target gene. KIAA1287 BINDING SITE is HOST TARGET binding site found in the 3' untranslated region of mRNA encoded by KIAA1287, corresponding to a HOST TARGET binding site such as BINDING SITE I, BINDING SITE II or BINDING SITE III. Table 2 illustrates the complementarity of the nucleotide sequences of KIAA1287 BINDING SITE, designated SEQ ID:38326, to the nucleotide sequence of VGAM2659 RNA, herein designated VGAM RNA, also designated SEQ ID:5370.

Another function of VGAM2659 is therefore inhibition of KIAA1287 (Accession XM_085753). Accordingly, utilities of VGAM2659 include diagnosis, prevention and treatment of diseases and clinical conditions associated with KIAA1287. KIAA1434 (Accession XM_045585) is another VGAM2659 host target gene. KIAA1434 BINDING SITE is HOST TARGET binding site found in the 3' untranslated region of mRNA encoded by KIAA1434, corresponding to a HOST TARGET binding site such as BINDING SITE I, BINDING SITE II or BINDING SITE III. Table 2 illustrates the complementarity of the nucleotide sequences of KIAA1434 BINDING SITE, designated SEQ ID:34492, to the nucleotide sequence of VGAM2659 RNA, herein designated VGAM RNA, also designated SEQ ID:5370.

Another function of VGAM2659 is therefore inhibition of KIAA1434 (Accession XM_045585). Accordingly, utilities of VGAM2659 include diagnosis, prevention and treatment of diseases and clinical conditions associated with KIAA1434. KIAA1493 (Accession XM_034415) is another VGAM2659 host target gene. KIAA1493 BINDING SITE is HOST TARGET binding site found in the 3' untranslated region of mRNA encoded by KIAA1493, corresponding to a HOST TARGET binding site such as BINDING SITE I, BINDING SITE II or BINDING SITE III. Table 2 illustrates the complementarity of the nucleotide sequences of KIAA1493 BINDING SITE, designated SEQ ID:32088, to the nucleotide sequence of VGAM2659 RNA, herein designated VGAM RNA, also designated SEQ ID:5370.

Another function of VGAM2659 is therefore inhibition of KIAA1493 (Accession XM_034415). Accordingly, utilities of VGAM2659 include diagnosis, prevention and treatment of diseases and clinical conditions associated with KIAA1493. MGC11352 (Accession XM_035941) is another VGAM2659 host target gene. MGC11352 BINDING SITE is HOST TARGET binding site found in the 5' untranslated region of mRNA encoded by MGC11352, corresponding to a HOST TARGET binding site such as BINDING SITE I, BINDING SITE II or BINDING SITE III. Table 2 illustrates the complementarity of the nucleotide sequences of MGC11352 BINDING SITE, designated SEQ ID:32358, to the nucleotide sequence of VGAM2659 RNA, herein designated VGAM RNA, also designated SEQ ID:5370.

Another function of VGAM2659 is therefore inhibition of MGC11352 (Accession XM_035941). Accordingly, utilities of VGAM2659 include diagnosis, prevention and treatment of diseases and clinical conditions associated with MGC11352. PRP8 Pre-mRNA Processing Factor 8 Homolog (yeast) (PRPF8, Accession XM_028335) is another VGAM2659 host target gene. PRPF8 BINDING SITE is HOST TARGET binding site found in the 3' untranslated region of mRNA encoded by PRPF8, corresponding to a HOST TARGET binding site such as BINDING SITE I, BINDING SITE II or BINDING SITE III. Table 2 illustrates the complementarity of the nucleotide sequences of PRPF8 BINDING SITE, designated SEQ ID:30690, to the nucleotide sequence of VGAM2659 RNA, herein designated VGAM RNA, also designated SEQ ID:5370.

Another function of VGAM2659 is therefore inhibition of PRP8 Pre-mRNA Processing Factor 8 Homolog (yeast) (PRPF8, Accession XM_028335). Accordingly, utilities of VGAM2659 include diagnosis, prevention and treatment of diseases and clinical conditions associated with PRPF8. Scavenger Receptor Cysteine Rich Domain Containing, Group B (4 domains) (SRCRB4D, Accession NM_080744) is another VGAM2659 host target gene. SRCRB4D BINDING SITE is HOST TARGET binding site found in the 3' untranslated region of mRNA encoded by SRCRB4D, corresponding to a HOST TARGET binding site such as BINDING SITE I, BINDING SITE II or BINDING SITE III. Table 2 illustrates the complementarity of the nucleotide sequences of SRCRB4D BINDING SITE, designated SEQ ID:28029, to the nucleotide sequence of VGAM2659 RNA, herein designated VGAM RNA, also designated SEQ ID:5370.

Another function of VGAM2659 is therefore inhibition of Scavenger Receptor Cysteine Rich Domain Containing, Group B (4 domains) (SRCRB4D, Accession NM_080744). Accordingly, utilities of VGAM2659 include diagnosis, prevention and treatment of diseases and clinical conditions associated with SRCRB4D. LOC112616 (Accession NM_138410) is another VGAM2659 host target gene. LOC112616 BINDING SITE is HOST TARGET binding site found in the 3' untranslated region of mRNA encoded by LOC112616, corresponding to a HOST TARGET binding site such as BINDING SITE I, BINDING SITE II or BINDING SITE III. Table 2 illustrates the complementarity of the nucleotide sequences of LOC112616 BINDING SITE, designated SEQ ID:28774, to the nucleotide sequence of VGAM2659 RNA, herein designated VGAM RNA, also designated SEQ ID:5370.

Another function of VGAM2659 is therefore inhibition of LOC112616 (Accession NM_138410). Accordingly, utilities of VGAM2659 include diagnosis, prevention and treatment of diseases and clinical conditions associated with LOC112616. LOC135763 (Accession NM_138572) is another VGAM2659 host target gene. LOC135763 BINDING SITE is HOST TARGET binding site found in the 3' untranslated region of mRNA encoded by LOC135763, corresponding to a HOST TARGET binding site such as BINDING SITE I, BINDING SITE II or BINDING SITE III. Table 2 illustrates the complementarity of the nucleotide sequences of LOC135763 BINDING SITE, designated SEQ ID:28885, to the nucleotide sequence of VGAM2659 RNA, herein designated VGAM RNA, also designated SEQ ID:5370.

Another function of VGAM2659 is therefore inhibition of LOC135763 (Accession NM_138572). Accordingly, utilities of VGAM2659 include diagnosis, prevention and treatment of diseases and clinical conditions associated with LOC135763. LOC150279 (Accession XM_086820) is another VGAM2659 host target gene. LOC150279 BINDING SITE is HOST TARGET binding site found in the 3' untranslated region of mRNA encoded by LOC150279, corresponding to a HOST TARGET binding site such as BINDING SITE I, BINDING SITE II or BINDING SITE III. Table 2 illustrates the complementarity of the nucleotide sequences of LOC150279 BINDING SITE, designated SEQ ID:38900, to the nucleotide sequence of VGAM2659 RNA, herein designated VGAM RNA, also designated SEQ ID:5370.

Another function of VGAM2659 is therefore inhibition of LOC150279 (Accession XM_086820). Accordingly, utilities of VGAM2659 include diagnosis, prevention and treatment of diseases and clinical conditions associated with LOC150279. LOC151516 (Accession XM_087229) is another VGAM2659 host target gene. LOC151516 BINDING SITE is HOST TARGET binding site found in the 5' untranslated region of mRNA encoded by LOC151516, corresponding to a HOST TARGET binding site such as BINDING SITE I, BINDING SITE II or BINDING SITE III. Table 2 illustrates the complementarity of the nucleotide sequences of LOC151516 BINDING SITE, designated SEQ ID:39129, to the nucleotide sequence of VGAM2659 RNA, herein designated VGAM RNA, also designated SEQ ID:5370.

Another function of VGAM2659 is therefore inhibition of LOC151516 (Accession XM_087229). Accordingly, utilities of VGAM2659 include diagnosis, prevention and treatment of diseases and clinical conditions associated with LOC151516. LOC152215 (Accession XM_087407) is another VGAM2659 host target gene. LOC152215 BINDING SITE is HOST TARGET binding site found in the 3' untranslated region of mRNA encoded by LOC152215, corresponding to a HOST TARGET binding site such as BINDING SITE I, BINDING SITE II or BINDING SITE III. Table 2 illustrates the complementarity of the nucleotide sequences of LOC152215 BINDING SITE, designated SEQ ID:39225, to the nucleotide sequence of VGAM2659 RNA, herein designated VGAM RNA, also designated SEQ ID:5370.

Another function of VGAM2659 is therefore inhibition of LOC152215 (Accession XM_087407). Accordingly, utilities of VGAM2659 include diagnosis, prevention and treatment of diseases and clinical conditions associated with LOC152215. LOC152313 (Accession XM_098190) is another VGAM2659 host target gene. LOC152313 BINDING SITE is HOST TARGET binding site found in the 5' untranslated region of mRNA encoded by LOC152313, corresponding to a HOST TARGET binding site such as BINDING SITE I, BINDING SITE II or BINDING SITE III. Table 2 illustrates the complementarity of the nucleotide sequences of LOC152313 BINDING SITE, designated SEQ ID:41475, to the nucleotide sequence of VGAM2659 RNA, herein designated VGAM RNA, also designated SEQ ID:5370.

Another function of VGAM2659 is therefore inhibition of LOC152313 (Accession XM_098190). Accordingly, utilities of VGAM2659 include diagnosis, prevention and treatment of diseases and clinical conditions associated with LOC152313. LOC158434 (Accession XM_098939) is another VGAM2659 host target gene. LOC158434 BINDING SITE is HOST TARGET binding site found in the 5' untranslated region of mRNA encoded by LOC158434, corresponding to a HOST TARGET binding site such as BINDING SITE I, BINDING SITE II or BINDING SITE III. Table 2 illustrates the complementarity of the nucleotide sequences of LOC158434 BINDING SITE, designated SEQ ID:41990, to the nucleotide sequence of VGAM2659 RNA, herein designated VGAM RNA, also designated SEQ ID:5370.

Another function of VGAM2659 is therefore inhibition of LOC158434 (Accession XM_098939). Accordingly, utilities of VGAM2659 include diagnosis, prevention and treatment of diseases and clinical conditions associated with LOC158434. LOC167147 (Accession XM_094310) is another VGAM2659 host target gene. LOC167147 BINDING SITE is HOST TARGET binding site found in the 5' untranslated region of mRNA encoded by LOC167147, corresponding to a HOST TARGET binding site such as BINDING SITE I, BINDING SITE II or BINDING SITE III. Table 2 illustrates the complementarity of the nucleotide sequences of LOC167147 BINDING SITE, designated SEQ ID:40227, to the nucleotide sequence of VGAM2659 RNA, herein designated VGAM RNA, also designated SEQ ID:5370.

Another function of VGAM2659 is therefore inhibition of LOC167147 (Accession XM_094310). Accordingly, utilities of VGAM2659 include diagnosis, prevention and treatment of diseases and clinical conditions associated with LOC167147. LOC220776 (Accession XM_043388) is another VGAM2659 host target gene. LOC220776 BINDING SITE is HOST TARGET binding site found in the 3' untranslated region of mRNA encoded by LOC220776, corresponding to a HOST TARGET binding site such as BINDING SITE I, BINDING SITE II or BINDING SITE III. Table 2 illustrates the complementarity of the nucleotide sequences of LOC220776 BINDING SITE, designated SEQ ID:33940, to the nucleotide sequence of VGAM2659 RNA, herein designated VGAM RNA, also designated SEQ ID:5370.

Another function of VGAM2659 is therefore inhibition of LOC220776 (Accession XM_043388). Accordingly, utilities of VGAM2659 include diagnosis, prevention and treatment of diseases and clinical conditions associated with LOC220776. LOC221002 (Accession XM_166156) is another VGAM2659 host target gene. LOC221002 BINDING SITE is HOST TARGET binding site found in the 3' untranslated region of mRNA encoded by LOC221002, corresponding to a HOST TARGET binding site such as BINDING SITE I, BINDING SITE II or BINDING SITE III. Table 2 illustrates the complementarity of the nucleotide sequences of LOC221002 BINDING SITE, designated SEQ ID:43973, to the nucleotide sequence of VGAM2659 RNA, herein designated VGAM RNA, also designated SEQ ID:5370.

Another function of VGAM2659 is therefore inhibition of LOC221002 (Accession XM_166156). Accordingly, utilities of VGAM2659 include diagnosis, prevention and treatment of diseases and clinical conditions associated with LOC221002. LOC221935 (Accession XM_166537) is another VGAM2659 host target gene. LOC221935 BINDING SITE is HOST TARGET binding site found in the 3' untranslated region of mRNA encoded by LOC221935, corresponding to a HOST TARGET binding site such as BINDING SITE I, BINDING SITE II or BINDING SITE III. Table 2 illustrates the complementarity of the nucleotide sequences of LOC221935 BINDING SITE, designated SEQ ID:44502, to the nucleotide sequence of VGAM2659 RNA, herein designated VGAM RNA, also designated SEQ ID:5370.

Another function of VGAM2659 is therefore inhibition of LOC221935 (Accession XM_166537). Accordingly, utilities of VGAM2659 include diagnosis, prevention and treatment of diseases and clinical conditions associated with LOC221935. LOC254228 (Accession XM_171123) is another VGAM2659 host target gene. LOC254228 BINDING SITE is HOST TARGET binding site found in the 3' untranslated region of mRNA encoded by LOC254228, corresponding to a HOST TARGET binding site such as BINDING SITE I, BINDING SITE II or BINDING SITE III. Table 2 illustrates the complementarity of the nucleotide sequences of LOC254228 BINDING SITE, designated SEQ ID:45922, to the nucleotide sequence of VGAM2659 RNA, herein designated VGAM RNA, also designated SEQ ID:5370.

Another function of VGAM2659 is therefore inhibition of LOC254228 (Accession XM_171123). Accordingly, utilities of VGAM2659 include diagnosis, prevention and treatment of diseases and clinical conditions associated with LOC254228. LOC255645 (Accession XM_172967) is another VGAM2659 host target gene. LOC255645 BINDING SITE is HOST TARGET binding site found in the 3' untranslated region of mRNA encoded by LOC255645, corresponding to a HOST TARGET binding site such as BINDING SITE I, BINDING SITE II or BINDING SITE III. Table 2 illustrates the complementarity of the nucleotide sequences of LOC255645 BINDING SITE, designated SEQ ID:46220, to the nucleotide sequence of VGAM2659 RNA, herein designated VGAM RNA, also designated SEQ ID:5370.

Another function of VGAM2659 is therefore inhibition of LOC255645 (Accession XM_172967). Accordingly, utilities of VGAM2659 include diagnosis, prevention and treatment of diseases and clinical conditions associated with LOC255645. LOC51619 (Accession NM_015983) is another VGAM2659 host target gene. LOC51619 BINDING SITE is HOST TARGET binding site found in the 3' untranslated region of mRNA encoded by LOC51619, corresponding to a HOST TARGET binding site such as BINDING SITE I, BINDING SITE II or BINDING SITE III. Table 2 illustrates the complementarity of the nucleotide sequences of LOC51619 BINDING SITE, designated SEQ ID:18079, to the nucleotide sequence of VGAM2659 RNA, herein designated VGAM RNA, also designated SEQ ID:5370.

Another function of VGAM2659 is therefore inhibition of LOC51619 (Accession NM_015983). Accordingly, utilities of VGAM2659 include diagnosis, prevention and treatment of diseases and clinical conditions associated with LOC51619. LOC92573 (Accession XM_045884) is another VGAM2659 host target gene. LOC92573 BINDING SITE is HOST TARGET binding site found in the 5' untranslated region of mRNA encoded by LOC92573, corresponding to a HOST TARGET binding site such as BINDING SITE I, BINDING SITE II or BINDING SITE III. Table 2 illustrates the complementarity of the nucleotide sequences of LOC92573 BINDING SITE, designated SEQ ID:34597, to the nucleotide sequence of VGAM2659 RNA, herein designated VGAM RNA, also designated SEQ ID:5370.

Another function of VGAM2659 is therefore inhibition of LOC92573 (Accession XM_045884). Accordingly, utilities of VGAM2659 include diagnosis, prevention and treatment of diseases and clinical conditions associated with LOC92573. FIG. 1 further provides a conceptual description of a novel bioinformatically detected viral gene of the present invention, referred to here as Viral Genomic Address Messenger 2660 (VGAM2660) viral gene, which modulates expression of respective host target genes thereof, the function and utility of which host target genes is known in the art.

VGAM2660 is a novel bioinformatically detected regulatory, non protein coding, viral micro RNA (miRNA) gene. The method by which VGAM2660 was detected is described hereinabove with reference to FIGS. 1-8.

VGAM2660 gene, herein designated VGAM GENE, is a viral gene contained in the genome of Potato Virus A. VGAM2660 host target gene, herein designated VGAM HOST TARGET GENE, is a human gene contained in the human genome.

VGAM2660 gene encodes a VGAM2660 precursor RNA, herein designated VGAM PRECURSOR RNA. Similar to other miRNA genes, and unlike most ordinary genes, VGAM2660 precursor RNA does not encode a protein. A nucleotide sequence identical or highly similar to the nucleotide sequence of VGAM2660 precursor RNA is designated SEQ ID:2646, and is provided hereinbelow with reference to the sequence listing part. Nucleotide sequence SEQ ID:2646 is located at position 4281 relative to the genome of Potato Virus A.

VGAM2660 precursor RNA folds onto itself, forming VGAM2660 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2660 folded precursor RNA into VGAM2660 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2660 RNA is designated SEQ ID:5371, and is provided hereinbelow with reference to the sequence listing part.

VGAM2660 host target gene, herein designated VGAM HOST TARGET GENE, encodes a corresponding messenger RNA, VGAM2660 host target RNA, herein designated VGAM HOST TARGET RNA. VGAM2660 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2660 RNA, herein designated VGAM RNA, binds complementarily to one or more host target binding sites located in untranslated regions of VGAM2660 host target RNA, herein designated VGAM HOST TARGET RNA. This complementary binding is due to the fact that the nucleotide sequence of VGAM2660 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2660 RNA, herein designated VGAM RNA, may have a different number of host target binding sites in untranslated regions of a VGAM2660 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2660 RNA, herein designated VGAM RNA, to host target binding sites on VGAM2660 host target RNA, herein designated VGAM HOST TARGET RNA, such as BINDING SITE I, BINDING SITE II and BINDING SITE III, inhibits translation of VGAM2660 host target RNA into VGAM2660 host target protein, herein designated VGAM HOST TARGET PROTEIN. VGAM host target protein is therefore outlined by a broken line.

It is appreciated that VGAM2660 host target gene, herein designated VGAM HOST TARGET GENE, in fact represents a plurality of VGAM2660 host target genes. The mRNA of each one of this plurality of VGAM2660 host target genes comprises one or more host target binding sites, each having a nucleotide sequence which is at least partly complementary to VGAM2660 RNA, herein designated VGAM RNA, and which when bound by VGAM2660 RNA causes inhibition of translation of respective one or more VGAM2660 host target proteins.

It is further appreciated by one skilled in the art that the mode of translational inhibition illustrated by FIG. 1 with specific reference to translational inhibition exerted by VGAM2660 gene, herein designated VGAM GENE, on one or more VGAM2660 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2660 is inhibition of expression of host target genes, as part of a novel viral mechanism of attacking a host. Accordingly, utilities of VGAM2660 include diagnosis, prevention and treatment of viral infection by Potato Virus A. Specific functions, and accordingly utilities, of VGAM2660 correlate with, and may be deduced from, the identity of the host target genes which VGAM2660 binds and inhibits, and the function of these host target genes, as elaborated hereinbelow.

Nucleotide sequences of the VGAM2660 precursor RNA, herein designated VGAM PRECURSOR RNA, and of the 'diced' VGAM2660 RNA, herein designated VGAM RNA, and a schematic representation of the secondary folding of VGAM2660 folded precursor RNA, herein designated VGAM FOLDED PRECURSOR RNA, of VGAM2660 are further described hereinbelow with reference to Table 1.

Nucleotide sequences of host target binding sites, such as BINDING SITE-I, BINDING SITE-II and BINDING SITE-III of FIG. 1, found on VGAM2660 host target RNA, and schematic representation of the complementarity of each of these host target binding sites to VGAM2660 RNA, herein designated VGAM RNA, are described hereinbelow with reference to Table 2.

As mentioned hereinabove with reference to FIG. 1, a function of VGAM2660 gene, herein designated VGAM is inhibition of expression of VGAM2660 target genes. It is appreciated that specific functions, and accordingly utilities, of VGAM2660 correlate with, and may be deduced from, the identity of the target genes which VGAM2660 binds and inhibits, and the function of these target genes, as elaborated hereinbelow.

Aquaporin 1 (channel-forming integral protein, 28 kDa) (AQP1, Accession NM_000385) is a VGAM2660 host target gene. AQP1 BINDING SITE is HOST TARGET binding site found in the 3' untranslated region of mRNA encoded by AQP1, corresponding to a HOST TARGET binding site such as BINDING SITE I, BINDING SITE II or BINDING SITE III. Table 2 illustrates the complementarity of the nucleotide sequences of AQP1 BINDING SITE, designated SEQ ID:5959, to the nucleotide sequence of VGAM2660 RNA, herein designated VGAM RNA, also designated SEQ ID:5371.

A function of VGAM2660 is therefore inhibition of Aquaporin 1 (channel-forming integral protein, 28 kDa) (AQP1, Accession NM_000385). Accordingly, utilities of VGAM2660 include diagnosis, prevention and treatment of diseases and clinical conditions associated with AQP1. Dihydrolipoamide S-succinyltransferase (E2 component of 2-oxo-glutarate complex) (DLST, Accession NM_001933) is another VGAM2660 host target gene. DLST BINDING SITE is HOST TARGET binding site found in the 3' untranslated region of mRNA encoded by DLST, corresponding to a HOST TARGET binding site such as BINDING SITE I, BINDING SITE II or BINDING SITE III. Table 2 illustrates the complementarity of the nucleotide sequences of DLST BINDING SITE, designated SEQ ID:7644, to the nucleotide sequence of VGAM2660 RNA, herein designated VGAM RNA, also designated SEQ ID:5371.

Another function of VGAM2660 is therefore inhibition of Dihydrolipoamide S-succinyltransferase (E2 component of 2-oxo-glutarate complex) (DLST, Accession NM_001933), a gene which catalyzes the oxidative decarboxylation of alpha-keto acids. Accordingly, utilities of VGAM2660 include diagnosis, prevention and treatment of diseases and clinical conditions associated with DLST. The function of DLST and its association with various diseases and clinical conditions, has been established by previous studies, as described hereinabove with reference to VGAM656. Deoxyribonuclease I-like 1 (DNASE1L1, Accession NM_006730) is another VGAM2660 host target gene. DNASE1L1 BINDING SITE is HOST TARGET binding site found in the 5" untranslated region of mRNA encoded by DNASE1L1, corresponding to a HOST TARGET binding site such as BINDING SITE I, BINDING SITE II or BINDING SITE III. Table 2 illustrates the complementarity of the nucleotide sequences of DNASE1L1 BINDING SITE, designated SEQ ID:13569, to the nucleotide sequence of VGAM2660 RNA, herein designated VGAM RNA, also designated SEQ ID:5371.

Another function of VGAM2660 is therefore inhibition of Deoxyribonuclease I-like 1 (DNASE1L1, Accession NM_006730), a gene which seems to be involved in cell death. Accordingly, utilities of VGAM2660 include diagnosis, prevention and treatment of diseases and clinical conditions associated with DNASE1L1. The function of DNASE1L1 and its association with various diseases and clinical conditions, has been established by previous studies, as described hereinabove with reference to VGAM885. Homeo Box D4 (HOXD4, Accession NM_014621) is another VGAM2660 host target gene. HOXD4 BINDING SITE is HOST TARGET binding site found in the 5' untranslated region of mRNA encoded by HOXD4, corresponding to a HOST TARGET binding site such as BINDING SITE I, BINDING SITE II or BINDING SITE III. Table 2 illustrates the complementarity of the nucleotide sequences of HOXD4 BINDING SITE, designated SEQ ID:15980, to the nucleotide sequence of VGAM2660 RNA, herein designated VGAM RNA, also designated SEQ ID:5371.

Another function of VGAM2660 is therefore inhibition of Homeo Box D4 (HOXD4, Accession NM_014621), a gene which is part of a developmental regulatory system. Accordingly, utilities of VGAM2660 include diagnosis, prevention and treatment of diseases and clinical conditions associated with HOXD4. The function of HOXD4 and its association with various diseases and clinical conditions, has been established by previous studies, as described hereinabove with reference to VGAM330. Loss of Heterozygosity, 11, Chromosomal Region 2, Gene A (LOH11CR2A, Accession NM_014622) is another VGAM2660 host target gene. LOH11CR2A BINDING SITE is HOST TARGET binding site found in the 5' untranslated region of mRNA encoded by LOH11CR2A, corresponding to a HOST TARGET binding site such as BINDING SITE I, BINDING SITE II or BINDING SITE III. Table 2 illustrates the complementarity of the nucleotide sequences of LOH11CR2A BINDING SITE, designated SEQ ID:15984, to the nucleotide sequence of VGAM2660 RNA, herein designated VGAM RNA, also designated SEQ ID:5371.

Another function of VGAM2660 is therefore inhibition of Loss of Heterozygosity, 11, Chromosomal Region 2, Gene A (LOH11CR2A, Accession NM_014622). Accordingly, utilities of VGAM2660 include diagnosis, prevention and treatment of diseases and clinical conditions associated with LOH11CR2A. Chromosome 14 Open Reading Frame 4 (C14orf4, Accession XM_041104) is another VGAM2660 host target gene. C14orf4 BINDING SITE is HOST TARGET binding site found in the 5' untranslated region of mRNA encoded by C14orf4, corresponding to a HOST TARGET binding site such as BINDING SITE I, BINDING SITE II or BINDING SITE III. Table 2 illustrates the complementarity of the nucleotide sequences of C14orf4 BINDING SITE, designated SEQ ID:33445, to the nucleotide sequence of VGAM2660 RNA, herein designated VGAM RNA, also designated SEQ ID:5371.

Another function of VGAM2660 is therefore inhibition of Chromosome 14 Open Reading Frame 4 (C14orf4, Accession XM_041104). Accordingly, utilities of VGAM2660 include diagnosis, prevention and treatment of diseases and clinical conditions associated with C14orf4. FLJ21791 (Accession XM_028958) is another VGAM2660 host target gene. FLJ21791 BINDING SITE is HOST TARGET binding site found in the 3' untranslated region of mRNA encoded by FLJ21791, corresponding to a HOST TARGET binding site such as BINDING SITE I, BINDING SITE II or BINDING SITE III. Table 2 illustrates the complementarity of the nucleotide sequences of FLJ21791 BINDING SITE, designated SEQ ID:30809, to the nucleotide sequence of VGAM2660 RNA, herein designated VGAM RNA, also designated SEQ ID:5371.

Another function of VGAM2660 is therefore inhibition of FLJ21791 (Accession XM_028958). Accordingly, utilities of VGAM2660 include diagnosis, prevention and treatment of diseases and clinical conditions associated with FLJ21791. KIAA0449 (Accession NM_017596) is another VGAM2660 host target gene. KIAA0449 BINDING SITE is HOST TARGET binding site found in the 3' untranslated region of mRNA encoded by KIAA0449, corresponding to a HOST TARGET binding site such as BINDING SITE I, BINDING SITE II or BINDING SITE III. Table 2 illustrates the complementarity of the nucleotide sequences of KIAA0449 BINDING SITE, designated SEQ ID:19052, to the nucleotide sequence of VGAM2660 RNA, herein designated VGAM RNA, also designated SEQ ID:5371.

Another function of VGAM2660 is therefore inhibition of KIAA0449 (Accession NM_017596). Accordingly, utilities of VGAM2660 include diagnosis, prevention and treatment of diseases and clinical conditions associated with KIAA0449. TUBB5 (Accession NM_006087) is another VGAM2660 host target gene. TUBB5 BINDING SITE is HOST TARGET binding site found in the 3' untranslated region of mRNA encoded by TUBB5, corresponding to a HOST TARGET binding site such as BINDING SITE I, BINDING SITE II or BINDING SITE III. Table 2 illustrates the complementarity of the nucleotide sequences of TUBB5 BINDING SITE, designated SEQ ID:12731, to the nucleotide sequence of VGAM2660 RNA, herein designated VGAM RNA, also designated SEQ ID:5371.

Another function of VGAM2660 is therefore inhibition of TUBB5 (Accession NM_006087). Accordingly, utilities of VGAM2660 include diagnosis, prevention and treatment of diseases and clinical conditions associated with TUBB5. LOC163782 (Accession XM_089138) is another VGAM2660 host target gene. LOC163782 BINDING SITE is HOST TARGET binding site found in the 3' untranslated region of mRNA encoded by LOC163782, corresponding to a HOST TARGET binding site such as BINDING SITE I, BINDING SITE II or BINDING SITE III. Table 2 illustrates the complementarity of the nucleotide sequences of LOC163782 BINDING SITE, designated SEQ ID:39965, to the nucleotide sequence of VGAM2660 RNA, herein designated VGAM RNA, also designated SEQ ID:5371.

Another function of VGAM2660 is therefore inhibition of LOC163782 (Accession XM_089138). Accordingly, utilities of VGAM2660 include diagnosis, prevention and treatment of diseases and clinical conditions associated with LOC163782. LOC221922 (Accession XM_166555) is another VGAM2660 host target gene. LOC221922 BINDING SITE is HOST TARGET binding site found in the 5' untranslated region of mRNA encoded by LOC221922, corresponding to a HOST TARGET binding site such as BINDING SITE I, BINDING SITE II or BINDING SITE III. Table 2 illustrates the complementarity of the nucleotide sequences of LOC221922 BINDING SITE, designated SEQ ID:44535, to the nucleotide sequence of VGAM2660 RNA, herein designated VGAM RNA, also designated SEQ ID:5371.

Another function of VGAM2660 is therefore inhibition of LOC221922 (Accession XM_166555). Accordingly, utilities of VGAM2660 include diagnosis, prevention and treatment of diseases and clinical conditions associated with LOC221922. LOC254848 (Accession XM_173133) is another VGAM2660 host target gene. LOC254848 BINDING SITE is HOST TARGET binding site found in the 5' untranslated region of mRNA encoded by LOC254848, corresponding to a HOST TARGET binding site such as BINDING SITE I, BINDING SITE II or BINDING SITE III. Table 2 illustrates the complementarity of the nucleotide sequences of LOC254848 BINDING SITE, designated SEQ ID:46382, to the nucleotide sequence of VGAM2660 RNA, herein designated VGAM RNA, also designated SEQ ID:5371.

Another function of VGAM2660 is therefore inhibition of LOC254848 (Accession XM_173133). Accordingly, utilities of VGAM2660 include diagnosis, prevention and treatment of diseases and clinical conditions associated with LOC254848. LOC255452 (Accession XM_174088) is another VGAM2660 host target gene. LOC255452 BINDING SITE is HOST TARGET binding site found in the 5' untranslated region of mRNA encoded by LOC255452, corresponding to a HOST TARGET binding site such as BIND- ING SITE I, BINDING SITE II or BINDING SITE III. Table 2 illustrates the complementarity of the nucleotide sequences of LOC255452 BINDING SITE, designated SEQ ID:46577, to the nucleotide sequence of VGAM2660 RNA, herein designated VGAM RNA, also designated SEQ ID:5371.

Another function of VGAM2660 is therefore inhibition of LOC255452 (Accession XM_174088). Accordingly, utilities of VGAM2660 include diagnosis, prevention and treatment of diseases and clinical conditions associated with LOC255452. LOC93496 (Accession XM_051698) is another VGAM2660 host target gene. LOC93496 BINDING SITE is HOST TARGET binding site found in the 3' untranslated region of mRNA encoded by LOC93496, corresponding to a HOST TARGET binding site such as BINDING SITE I, BINDING SITE II or BINDING SITE III. Table 2 illustrates the complementarity of the nucleotide sequences of LOC93496 BINDING SITE, designated SEQ ID:35866, to the nucleotide sequence of VGAM2660 RNA, herein designated VGAM RNA, also designated SEQ ID:5371.

Another function of VGAM2660 is therefore inhibition of LOC93496 (Accession XM_051698). Accordingly, utilities of VGAM2660 include diagnosis, prevention and treatment of diseases and clinical conditions associated with LOC93496. FIG. 1 further provides a conceptual description of a novel bioinformatically detected viral gene of the present invention, referred to here as Viral Genomic Address Messenger 2661 (VGAM2661) viral gene, which modulates expression of respective host target genes thereof, the function and utility of which host target genes is known in the art.

VGAM2661 is a novel bioinformatically detected regulatory, non protein coding, viral micro RNA (miRNA) gene. The method by which VGAM2661 was detected is described hereinabove with reference to FIGS. 1-8.

VGAM2661 gene, herein designated VGAM GENE, is a viral gene contained in the genome of Potato Virus A. VGAM2661 host target gene, herein designated VGAM HOST TARGET GENE, is a human gene contained in the human genome.

VGAM2661 gene encodes a VGAM2661 precursor RNA, herein designated VGAM PRECURSOR RNA. Similar to other miRNA genes, and unlike most ordinary genes, VGAM2661 precursor RNA does not encode a protein. A nucleotide sequence identical or highly similar to the nucleotide sequence of VGAM2661 precursor RNA is designated SEQ ID:2647, and is provided hereinbelow with reference to the sequence listing part. Nucleotide sequence SEQ ID:2647 is located at position 2878 relative to the genome of Potato Virus A.

VGAM2661 precursor RNA folds onto itself, forming VGAM2661 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2661 folded precursor RNA into VGAM2661 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2661 RNA is designated SEQ ID:5372, and is provided hereinbelow with reference to the sequence listing part.

VGAM2661 host target gene, herein designated VGAM HOST TARGET GENE, encodes a corresponding messenger RNA, VGAM2661 host target RNA, herein designated VGAM HOST TARGET RNA. VGAM2661 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2661 RNA, herein designated VGAM RNA, binds complementarily to one or more host target binding sites located in untranslated regions of VGAM2661 host target RNA, herein designated VGAM HOST TARGET RNA. This complementary binding is due to the fact that the nucleotide sequence of VGAM2661 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2661 RNA, herein designated VGAM RNA, may have a different number of host target binding sites in untranslated regions of a VGAM2661 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2661 RNA, herein designated VGAM RNA, to host target binding sites on VGAM2661 host target RNA, herein designated VGAM HOST TARGET RNA, such as BINDING SITE I, BINDING SITE II and BINDING SITE III, inhibits translation of VGAM2661 host target RNA into VGAM2661 host target protein, herein designated VGAM HOST TARGET PROTEIN. VGAM host target protein is therefore outlined by a broken line.

It is appreciated that VGAM2661 host target gene, herein designated VGAM HOST TARGET GENE, in fact represents a plurality of VGAM2661 host target genes. The mRNA of each one of this plurality of VGAM2661 host target genes comprises one or more host target binding sites, each having a nucleotide sequence which is at least partly complementary to VGAM2661 RNA, herein designated VGAM RNA, and which when bound by VGAM2661 RNA causes inhibition of translation of respective one or more VGAM2661 host target proteins.

It is further appreciated by one skilled in the art that the mode of translational inhibition illustrated by FIG. 1 with specific reference to translational inhibition exerted by VGAM2661 gene, herein designated VGAM GENE, on one or more VGAM2661 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2661 is inhibition of expression of host target genes, as part of a novel viral mechanism of attacking a host. Accordingly, utilities of VGAM2661 include diagnosis, prevention and treatment of viral infection by Potato Virus A. Specific functions, and accordingly utilities, of VGAM2661 correlate with, and may be deduced from, the identity of the host target genes which VGAM2661 binds and inhibits, and the function of these host target genes, as elaborated hereinbelow.

Nucleotide sequences of the VGAM2661 precursor RNA, herein designated VGAM PRECURSOR RNA, and of the 'diced' VGAM2661 RNA, herein designated VGAM RNA, and a schematic representation of the secondary folding of VGAM2661 folded precursor RNA, herein designated VGAM FOLDED PRECURSOR RNA, of VGAM2661 are further described hereinbelow with reference to Table 1.

Nucleotide sequences of host target binding sites, such as BINDING SITE-I, BINDING SITE-II and BINDING SITE-III of FIG. 1, found on VGAM2661 host target RNA, and schematic representation of the complementarity of each of these host target binding sites to VGAM2661 RNA, herein designated VGAM RNA, are described hereinbelow with reference to Table 2.

As mentioned hereinabove with reference to FIG. 1, a function of VGAM2661 gene, herein designated VGAM is inhibition of expression of VGAM2661 target genes. It is appreciated that specific functions, and accordingly utilities, of VGAM2661 correlate with, and may be deduced from, the identity of the target genes which VGAM2661 binds and inhibits, and the function of these target genes, as elaborated hereinbelow.

Coagulation Factor VIII, Procoagulant Component (hemophilia A) (F8, Accession NM_000132) is a VGAM2661 host target gene. F8 BINDING SITE is HOST TARGET binding site found in the 3' untranslated region of mRNA encoded by F8, corresponding to a HOST TARGET binding site such as BINDING SITE I, BINDING SITE II or BINDING SITE III. Table 2 illustrates the complementarity of the nucleotide sequences of F8 BINDING SITE, designated SEQ ID:5618, to the nucleotide sequence of VGAM2661 RNA, herein designated VGAM RNA, also designated SEQ ID:5372.

A function of VGAM2661 is therefore inhibition of Coagulation Factor VIII, Procoagulant Component (hemophilia A) (F8, Accession NM_000132). Accordingly, utilities of VGAM2661 include diagnosis, prevention and treatment of diseases and clinical conditions associated with F8. DKFZP434L187 (Accession XM_044070) is another VGAM2661 host target gene. DKFZP434L187 BINDING SITE is HOST TARGET binding site found in the 5' untranslated region of mRNA encoded by DKFZP434L187, corresponding to a HOST TARGET binding site such as BINDING SITE I, BINDING SITE II or BINDING SITE III. Table 2 illustrates the complementarity of the nucleotide sequences of DKFZP434L187 BINDING SITE, designated SEQ ID:34120, to the nucleotide sequence of VGAM2661 RNA, herein designated VGAM RNA, also designated SEQ ID:5372.

Another function of VGAM2661 is therefore inhibition of DKFZP434L187 (Accession XM_044070). Accordingly, utilities of VGAM2661 include diagnosis, prevention and treatment of diseases and clinical conditions associated with DKFZP434L187. FLJ13262 (Accession NM_024914) is another VGAM2661 host target gene. FLJ13262 BINDING SITE is HOST TARGET binding site found in the 3' untranslated region of mRNA encoded by FLJ13262, corresponding to a HOST TARGET binding site such as BINDING SITE I, BINDING SITE II or BINDING SITE III. Table 2 illustrates the complementarity of the nucleotide sequences of FLJ13262 BINDING SITE, designated SEQ ID:24431, to the nucleotide sequence of VGAM2661 RNA, herein designated VGAM RNA, also designated SEQ ID:5372.

Another function of VGAM2661 is therefore inhibition of FLJ13262 (Accession NM_024914). Accordingly, utilities of VGAM2661 include diagnosis, prevention and treatment of diseases and clinical conditions associated with FLJ13262. Heterogeneous Nuclear Ribonucleoprotein A3 (HNRPA3, Accession NM_005758) is another VGAM2661 host target gene. HNRPA3 BINDING SITE is HOST TARGET binding site found in the 3' untranslated region of mRNA encoded by HNRPA3, corresponding to a HOST TARGET binding site such as BINDING SITE I, BINDING SITE II or BINDING SITE III. Table 2 illustrates the complementarity of the nucleotide sequences of HNRPA3 BINDING SITE, designated SEQ ID:12324, to the nucleotide sequence of VGAM2661 RNA, herein designated VGAM RNA, also designated SEQ ID:5372.

Another function of VGAM2661 is therefore inhibition of Heterogeneous Nuclear Ribonucleoprotein A3 (HNRPA3, Accession NM_005758). Accordingly, utilities of VGAM2661 include diagnosis, prevention and treatment of diseases and clinical conditions associated with HNRPA3. KIAA1437 (Accession XM_026998) is another VGAM2661 host target gene. KIAA1437 BINDING SITE is HOST TARGET binding site found in the 5' untranslated region of mRNA encoded by KIAA1437, corresponding to a HOST TARGET binding site such as BINDING SITE I, BINDING SITE II or BINDING SITE III. Table 2 illustrates the complementarity of the nucleotide sequences of KIAA1437 BINDING SITE, designated SEQ ID:30383, to the nucleotide sequence of VGAM2661 RNA, herein designated VGAM RNA, also designated SEQ ID:5372.

Another function of VGAM2661 is therefore inhibition of KIAA1437 (Accession XM_026998). Accordingly, utilities of VGAM2661 include diagnosis, prevention and treatment of diseases and clinical conditions associated with KIAA1437. Proprotein Convertase Subtilisin/kexin Type 7 (PCSK7, Accession NM_004716) is another VGAM2661 host target gene. PCSK7 BINDING SITE is HOST TARGET binding site found in the 3' untranslated region of mRNA encoded by PCSK7, corresponding to a HOST TARGET binding site such as BINDING SITE I, BINDING SITE II or BINDING SITE III. Table 2 illustrates the complementarity of the nucleotide sequences of PCSK7 BINDING SITE, designated SEQ ID:11074, to the nucleotide sequence of VGAM2661 RNA, herein designated VGAM RNA, also designated SEQ ID:5372.

Another function of VGAM2661 is therefore inhibition of Proprotein Convertase Subtilisin/kexin Type 7 (PCSK7, Accession NM_004716). Accordingly, utilities of VGAM2661 include diagnosis, prevention and treatment of diseases and clinical conditions associated with PCSK7. LOC129676 (Accession XM_065341) is another VGAM2661 host target gene. LOC129676 BINDING SITE is HOST TARGET binding site found in the 5' untranslated region of mRNA encoded by LOC129676, corresponding to a HOST TARGET binding site such as BINDING SITE I, BINDING SITE II or BINDING SITE III. Table 2 illustrates the complementarity of the nucleotide sequences of LOC129676 BINDING SITE, designated SEQ ID:37283, to the nucleotide sequence of VGAM2661 RNA, herein designated VGAM RNA, also designated SEQ ID:5372.

Another function of VGAM2661 is therefore inhibition of LOC129676 (Accession XM_065341). Accordingly, utilities of VGAM2661 include diagnosis, prevention and treatment of diseases and clinical conditions associated with LOC129676. LOC148918 (Accession XM_086361) is another VGAM2661 host target gene. LOC148918 BINDING SITE is HOST TARGET binding site found in the 5' untranslated region of mRNA encoded by LOC148918, corresponding to a HOST TARGET binding site such as BINDING SITE I, BINDING SITE II or BINDING SITE III. Table 2 illustrates the complementarity of the nucleotide sequences of LOC148918 BINDING SITE, designated SEQ ID:38613, to the nucleotide sequence of VGAM2661 RNA, herein designated VGAM RNA, also designated SEQ ID:5372.

Another function of VGAM2661 is therefore inhibition of LOC148918 (Accession XM_086361). Accordingly, utilities of VGAM2661 include diagnosis, prevention and treatment of diseases and clinical conditions associated with LOC148918. LOC164832 (Accession XM_092184) is another VGAM2661 host target gene. LOC164832 BINDING SITE is HOST TARGET binding site found in the 3' untranslated region of mRNA encoded by LOC164832, corresponding to a HOST TARGET binding site such as BINDING SITE I, BINDING SITE II or BINDING SITE III. Table 2 illustrates the complementarity of the nucleotide sequences of LOC164832 BINDING SITE, designated SEQ ID:40110, to the nucleotide sequence of VGAM2661 RNA, herein designated VGAM RNA, also designated SEQ ID:5372.

Another function of VGAM2661 is therefore inhibition of LOC164832 (Accession XM_092184). Accordingly, utilities of VGAM2661 include diagnosis, prevention and treatment of diseases and clinical conditions associated with LOC164832. LOC220988 (Accession XM_165561) is another VGAM2661 host target gene. LOC220988 BINDING SITE is HOST TARGET binding site found in the 3' untranslated region of mRNA encoded by LOC220988, corresponding to a HOST TARGET binding site such as BINDING SITE I, BINDING SITE II or BINDING SITE III. Table 2 illustrates the complementarity of the nucleotide sequences of LOC220988 BINDING SITE, designated SEQ ID:43684, to the nucleotide sequence of VGAM2661 RNA, herein designated VGAM RNA, also designated SEQ ID:5372.

Another function of VGAM2661 is therefore inhibition of LOC220988 (Accession XM_165561). Accordingly, utilities of VGAM2661 include diagnosis, prevention and treatment of diseases and clinical conditions associated with LOC220988. FIG. 1 further provides a conceptual description of a novel bioinformatically detected viral gene of the present invention, referred to here as Viral Genomic Address Messenger 2662 (VGAM2662) viral gene, which modulates expression of respective host target genes thereof, the function and utility of which host target genes is known in the art.

VGAM2662 is a novel bioinformatically detected regulatory, non protein coding, viral micro RNA (miRNA) gene. The method by which VGAM2662 was detected is described hereinabove with reference to FIGS. 1-8.

VGAM2662 gene, herein designated VGAM GENE, is a viral gene contained in the genome of Potato Virus A. VGAM2662 host target gene, herein designated VGAM HOST TARGET GENE, is a human gene contained in the human genome.

VGAM2662 gene encodes a VGAM2662 precursor RNA, herein designated VGAM PRECURSOR RNA. Similar to other miRNA genes, and unlike most ordinary genes, VGAM2662 precursor RNA does not encode a protein. A nucleotide sequence identical or highly similar to the nucleotide sequence of VGAM2662 precursor RNA is designated SEQ ID:2648, and is provided hereinbelow with reference to the sequence listing part. Nucleotide sequence SEQ ID:2648 is located at position 4423 relative to the genome of Potato Virus A.

VGAM2662 precursor RNA folds onto itself, forming VGAM2662 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2662 folded precursor RNA into VGAM2662 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM2662 RNA is designated SEQ ID:5373, and is provided hereinbelow with reference to the sequence listing part.

VGAM2662 host target gene, herein designated VGAM HOST TARGET GENE, encodes a corresponding messenger RNA, VGAM2662 host target RNA, herein designated VGAM HOST TARGET RNA. VGAM2662 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2662 RNA, herein designated VGAM RNA, binds complementarily to one or more host target binding sites located in untranslated regions of VGAM2662 host target RNA, herein designated VGAM HOST TARGET RNA. This complementary binding is due to the fact that the nucleotide sequence of VGAM2662 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2662 RNA, herein designated VGAM RNA, may have a different number of host target binding sites in untranslated regions of a VGAM2662 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2662 RNA, herein designated VGAM RNA, to host target binding sites on VGAM2662 host target RNA, herein designated VGAM HOST TARGET RNA, such as BINDING SITE I, BINDING SITE II and BINDING SITE III, inhibits translation of VGAM2662 host target RNA into VGAM2662 host target protein, herein designated VGAM HOST TARGET PROTEIN. VGAM host target protein is therefore outlined by a broken line.

It is appreciated that VGAM2662 host target gene, herein designated VGAM HOST TARGET GENE, in fact represents a plurality of VGAM2662 host target genes. The mRNA of each one of this plurality of VGAM2662 host target genes comprises one or more host target binding sites, each having a nucleotide sequence which is at least partly complementary to VGAM2662 RNA, herein designated VGAM RNA, and which when bound by VGAM2662 RNA causes inhibition of translation of respective one or more VGAM2662 host target proteins.

It is further appreciated by one skilled in the art that the mode of translational inhibition illustrated by FIG. 1 with specific reference to translational inhibition exerted by VGAM2662 gene, herein designated VGAM GENE, on one or more VGAM2662 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2662 is inhibition of expression of host target genes, as part of a novel viral mechanism of attacking a host. Accordingly, utilities of VGAM2662 include diagnosis, prevention and treatment of viral infection by Potato Virus A. Specific functions, and accordingly utilities, of VGAM2662 correlate with, and may be deduced from, the identity of the host target genes which VGAM2662 binds and inhibits, and the function of these host target genes, as elaborated hereinbelow.

Nucleotide sequences of the VGAM2662 precursor RNA, herein designated VGAM PRECURSOR RNA, and of the 'diced' VGAM2662 RNA, herein designated VGAM RNA, and a schematic representation of the secondary folding of VGAM2662 folded precursor RNA, herein designated VGAM FOLDED PRECURSOR RNA, of VGAM2662 are further described hereinbelow with reference to Table 1.

Nucleotide sequences of host target binding sites, such as BINDING SITE-I, BINDING SITE-II and BINDING SITE-III of FIG. 1, found on VGAM2662 host target RNA, and schematic representation of the complementarity of each of these host target binding sites to VGAM2662 RNA, herein designated VGAM RNA, are described hereinbelow with reference to Table 2.

As mentioned hereinabove with reference to FIG. 1, a function of VGAM2662 gene, herein designated VGAM is inhibition of expression of VGAM2662 target genes. It is appreciated that specific functions, and accordingly utilities, of VGAM2662 correlate with, and may be deduced from, the identity of the target genes which VGAM2662 binds and inhibits, and the function of these target genes, as elaborated hereinbelow.

Dihydropyrimidinase-like 3 (DPYSL3, Accession NM_001387) is a VGAM2662 host target gene. DPYSL3 BINDING SITE is HOST TARGET binding site found in the 3' untranslated region of mRNA encoded by DPYSL3, corresponding to a HOST TARGET binding site such as BINDING SITE I, BINDING SITE II or BINDING SITE III. Table 2 illustrates the complementarity of the nucleotide sequences of DPYSL3 BINDING SITE, designated SEQ ID:7073, to the nucleotide sequence of VGAM2662 RNA, herein designated VGAM RNA, also designated SEQ ID:5373.

A function of VGAM2662 is therefore inhibition of Dihydropyrimidinase-like 3 (DPYSL3, Accession NM_001387), a gene which is a member of the dihydropyrimidinase family. Accordingly, utilities of VGAM2662 include diagnosis, prevention and treatment of diseases and clinical conditions associated with DPYSL3. The function of DPYSL3 and its association with various diseases and clinical conditions, has been established by previous studies, as described hereinabove with reference to VGAM24. Fanconi Anemia, Complementation Group C (FANCC, Accession XM_047190) is another VGAM2662 host target gene. FANCC BINDING SITE is HOST TARGET binding site found in the 3' untranslated region of mRNA encoded by FANCC, corresponding to a HOST TARGET binding site such as BINDING SITE I, BINDING SITE II or BINDING SITE III. Table 2 illustrates the complementarity of the nucleotide sequences of FANCC BINDING SITE, designated SEQ ID:34905, to the nucleotide sequence of VGAM2662 RNA, herein designated VGAM RNA, also designated SEQ ID:5373.

Another function of VGAM2662 is therefore inhibition of Fanconi Anemia, Complementation Group C (FANCC, Accession XM_047190). Accordingly, utilities of VGAM2662 include diagnosis, prevention and treatment of diseases and clinical conditions associated with FANCC. FLJ13055 (Accession NM_022737) is another VGAM2662 host target gene. FLJ13055 BINDING SITE is HOST TARGET binding site found in the 3' untranslated region of mRNA encoded by FLJ13055, corresponding to a HOST TARGET binding site such as BINDING SITE I, BINDING SITE II or BINDING SITE III. Table 2 illustrates the complementarity of the nucleotide sequences of FLJ13055 BINDING SITE, designated SEQ ID:22943, to the nucleotide sequence of VGAM2662 RNA, herein designated VGAM RNA, also designated SEQ ID:5373.

Another function of VGAM2662 is therefore inhibition of FLJ13055 (Accession NM_022737). Accordingly, utilities of VGAM2662 include diagnosis, prevention and treatment of diseases and clinical conditions associated with FLJ13055. KIAA0352 (Accession NM_014830) is another VGAM2662 host target gene. KIAA0352 BINDING SITE is HOST TARGET binding site found in the 3' untranslated region of mRNA encoded by KIAA0352, corresponding to a HOST TARGET binding site such as BINDING SITE I, BINDING SITE II or BINDING SITE III. Table 2 illustrates the complementarity of the nucleotide sequences of KIAA0352 BINDING SITE, designated SEQ ID:16823, to the nucleotide sequence of VGAM2662 RNA, herein designated VGAM RNA, also designated SEQ ID:5373.

Another function of VGAM2662 is therefore inhibition of KIAA0352 (Accession NM_014830). Accordingly, utilities of VGAM2662 include diagnosis, prevention and treatment of diseases and clinical conditions associated with KIAA0352. KIAA1136 (Accession XM_166110) is another VGAM2662 host target gene. KIAA1136 BINDING SITE is HOST TARGET binding site found in the 3' untranslated region of mRNA encoded by KIAA1136, corresponding to a HOST TARGET binding site such as BINDING SITE I, BINDING SITE II or BINDING SITE III. Table 2 illustrates the complementarity of the nucleotide sequences of KIAA1136 BINDING SITE, designated SEQ ID:43884, to the nucleotide sequence of VGAM2662 RNA, herein designated VGAM RNA, also designated SEQ ID:5373.

Another function of VGAM2662 is therefore inhibition of KIAA1136 (Accession XM_166110). Accordingly, utilities of VGAM2662 include diagnosis, prevention and treatment of diseases and clinical conditions associated with KIAA1136. KR18 (Accession NM_033288) is another VGAM2662 host target gene. KR18 BINDING SITE is HOST TARGET binding site found in the 5' untranslated region of mRNA encoded by KR18, corresponding to a HOST TARGET binding site such as BINDING SITE I, BINDING SITE II or BINDING SITE III. Table 2 illustrates the complementarity of the nucleotide sequences of KR18 BINDING SITE, designated SEQ ID:27116, to the nucleotide sequence of VGAM2662 RNA, herein designated VGAM RNA, also designated SEQ ID:5373.

Another function of VGAM2662 is therefore inhibition of KR18 (Accession NM_033288). Accordingly, utilities of VGAM2662 include diagnosis, prevention and treatment of diseases and clinical conditions associated with KR18. MGC16386 (Accession NM_080668) is another VGAM2662 host target gene. MGC16386 BINDING SITE is HOST TARGET binding site found in the 3' untranslated region of mRNA encoded by MGC16386, corresponding to a HOST TARGET binding site such as BINDING SITE I, BINDING SITE II or BINDING SITE III. Table 2 illustrates the complementarity of the nucleotide sequences of MGC16386 BINDING SITE, designated SEQ ID:27958, to the nucleotide sequence of VGAM2662 RNA, herein designated VGAM RNA, also designated SEQ ID:5373.

Another function of VGAM2662 is therefore inhibition of MGC16386 (Accession NM_080668). Accordingly, utilities of VGAM2662 include diagnosis, prevention and treatment of diseases and clinical conditions associated with MGC16386. Phosphatidylserine Decarboxylase (PISD, Accession NM_014338) is another VGAM2662 host target gene. PISD BINDING SITE is HOST TARGET binding site found in the 3' untranslated region of mRNA encoded by PISD, corresponding to a HOST TARGET binding site such as BINDING SITE I, BINDING SITE II or BINDING SITE III. Table 2 illustrates the complementarity of the nucleotide sequences of PISD BINDING SITE, designated SEQ ID:15654, to the nucleotide sequence of VGAM2662 RNA, herein designated VGAM RNA, also designated SEQ ID:5373.

Another function of VGAM2662 is therefore inhibition of Phosphatidylserine Decarboxylase (PISD, Accession NM_014338). Accordingly, utilities of VGAM2662 include diagnosis, prevention and treatment of diseases and clinical conditions associated with PISD. TA-PP2C (Accession NM_139283) is another VGAM2662 host target gene. TA-PP2C BINDING SITE is HOST TARGET binding site found in the 3' untranslated region of mRNA encoded by TA-PP2C, corresponding to a HOST TARGET binding site such as BINDING SITE I, BINDING SITE II or BINDING SITE III. Table 2 illustrates the complementarity of the nucleotide sequences of TA-PP2C BINDING SITE, designated SEQ ID:29281, to the nucleotide sequence of VGAM2662 RNA, herein designated VGAM RNA, also designated SEQ ID:5373.

Another function of VGAM2662 is therefore inhibition of TA-PP2C (Accession NM_139283). Accordingly, utilities of VGAM2662 include diagnosis, prevention and treatment of diseases and clinical conditions associated with TA-PP2C. LOC136288 (Accession XM_059832) is another VGAM2662 host target gene. LOC136288 BINDING SITE is HOST TARGET binding site found in the 3' untranslated region of mRNA encoded by LOC136288, corresponding to a HOST TARGET binding site such as BINDING SITE I, BINDING SITE II or BINDING SITE III. Table 2 illustrates the complementarity of the nucleotide sequences of LOC136288 BINDING SITE, designated SEQ ID:37100, to the nucleotide sequence of VGAM2662 RNA, herein designated VGAM RNA, also designated SEQ ID:5373.

Another function of VGAM2662 is therefore inhibition of LOC136288 (Accession XM_059832). Accordingly, utilities of VGAM2662 include diagnosis, prevention and treatment of diseases and clinical conditions associated with LOC136288. LOC203392 (Accession XM_114696) is another VGAM2662 host target gene. LOC203392 BINDING SITE is HOST TARGET binding site found in the 5' untranslated region of mRNA encoded by LOC203392, corresponding to a HOST TARGET binding site such as BINDING SITE I, BINDING SITE II or BINDING SITE III. Table 2 illustrates the complementarity of the nucleotide sequences of LOC203392 BINDING SITE, designated SEQ ID:43042, to the nucleotide sequence of VGAM2662 RNA, herein designated VGAM RNA, also designated SEQ ID:5373.

Another function of VGAM2662 is therefore inhibition of LOC203392 (Accession XM_114696). Accordingly, utilities of VGAM2662 include diagnosis, prevention and treatment of diseases and clinical conditions associated with LOC203392. LOC64116 (Accession NM_022154) is another VGAM2662 host target gene. LOC64116 BINDING SITE is HOST TARGET binding site found in the 3' untranslated region of mRNA encoded by LOC64116, corresponding to a HOST TARGET binding site such as BINDING SITE I, BINDING SITE II or BINDING SITE III. Table 2 illustrates the complementarity of the nucleotide sequences of LOC64116 BINDING SITE, designated SEQ ID:22713, to the nucleotide sequence of VGAM2662 RNA, herein designated VGAM RNA, also designated SEQ ID:5373.

Another function of VGAM2662 is therefore inhibition of LOC64116 (Accession NM_022154). Accordingly, utilities of VGAM2662 include diagnosis, prevention and treatment of diseases and clinical conditions associated with LOC64116. FIG. 1 further provides a conceptual description of a novel bioinformatically detected viral gene of the present invention, referred to here as Viral Genomic Address Messenger 2663 (VGAM2663) viral gene, which modulates expression of respective host target genes thereof, the function and utility of which host target genes is known in the art.

VGAM2663 is a novel bioinformatically detected regulatory, non protein coding, viral micro RNA (miRNA) gene. The method by which VGAM2663 was detected is described hereinabove with reference to FIGS. 1-8.

VGAM2663 gene, herein designated VGAM GENE, is a viral gene contained in the genome of Potato Virus A. VGAM2663 host target gene, herein designated VGAM HOST TARGET GENE, is a human gene contained in the human genome.

VGAM2663 gene encodes a VGAM2663 precursor RNA, herein designated VGAM PRECURSOR RNA. Similar to other miRNA genes, and unlike most ordinary genes, VGAM2663 precursor RNA does not encode a protein. A nucleotide sequence identical or highly similar to the nucleotide sequence of VGAM2663 precursor RNA is designated SEQ ID:2649, and is provided hereinbelow with reference to the sequence listing part. Nucleotide sequence SEQ ID:2649 is located at position 3193 relative to the genome of Potato Virus A.

VGAM2663 precursor RNA folds onto itself, forming VGAM2663 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2663 folded precursor RNA into VGAM2663 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2663 RNA is designated SEQ ID:5374, and is provided hereinbelow with reference to the sequence listing part.

VGAM2663 host target gene, herein designated VGAM HOST TARGET GENE, encodes a corresponding messenger RNA, VGAM2663 host target RNA, herein designated VGAM HOST TARGET RNA. VGAM2663 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2663 RNA, herein designated VGAM RNA, binds complementarily to one or more host target binding sites located in untranslated regions of VGAM2663 host target RNA, herein designated VGAM HOST TARGET RNA. This complementary binding is due to the fact that the nucleotide sequence of VGAM2663 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2663 RNA, herein designated VGAM RNA, may have a different number of host target binding sites in untranslated regions of a VGAM2663 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2663 RNA, herein designated VGAM RNA, to host target binding sites on VGAM2663 host target RNA, herein designated VGAM HOST TARGET RNA, such as BINDING SITE I, BINDING SITE II and BINDING SITE III, inhibits translation of VGAM2663 host target RNA into VGAM2663 host target protein, herein designated VGAM HOST TARGET PROTEIN. VGAM host target protein is therefore outlined by a broken line.

It is appreciated that VGAM2663 host target gene, herein designated VGAM HOST TARGET GENE, in fact represents a plurality of VGAM2663 host target genes. The mRNA of each one of this plurality of VGAM2663 host target genes comprises one or more host target binding sites, each having a nucleotide sequence which is at least partly complementary to VGAM2663 RNA, herein designated VGAM RNA, and which when bound by VGAM2663 RNA causes inhibition of translation of respective one or more VGAM2663 host target proteins.

It is further appreciated by one skilled in the art that the mode of translational inhibition illustrated by FIG. 1 with specific reference to translational inhibition exerted by VGAM2663 gene, herein designated VGAM GENE, on one or more VGAM2663 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2663 is inhibition of expression of host target genes, as part of a novel viral mechanism of attacking a host. Accordingly, utilities of VGAM2663 include diagnosis, prevention and treatment of viral infection by Potato Virus A. Specific functions, and accordingly utilities, of VGAM2663 correlate with, and may be deduced from, the identity of the host target genes which VGAM2663 binds and inhibits, and the function of these host target genes, as elaborated hereinbelow.

Nucleotide sequences of the VGAM2663 precursor RNA, herein designated VGAM PRECURSOR RNA, and of the 'diced' VGAM2663 RNA, herein designated VGAM RNA, and a schematic representation of the secondary folding of VGAM2663 folded precursor RNA, herein designated VGAM FOLDED PRECURSOR RNA, of VGAM2663 are further described hereinbelow with reference to Table 1.

Nucleotide sequences of host target binding sites, such as BINDING SITE-I, BINDING SITE-II and BINDING SITE-III of FIG. 1, found on VGAM2663 host target RNA, and schematic representation of the complementarity of each of these host target binding sites to VGAM2663 RNA, herein designated VGAM RNA, are described hereinbelow with reference to Table 2.

As mentioned hereinabove with reference to FIG. 1, a function of VGAM2663 gene, herein designated VGAM is inhibition of expression of VGAM2663 target genes. It is appreciated that specific functions, and accordingly utilities, of VGAM2663 correlate with, and may be deduced from, the identity of the target genes which VGAM2663 binds and inhibits, and the function of these target genes, as elaborated hereinbelow.

RAP1 (Accession NM_018975) is a VGAM2663 host target gene. RAP1 BINDING SITE is HOST TARGET binding site found in the 3' untranslated region of mRNA encoded by RAP1, corresponding to a HOST TARGET binding site such as BINDING SITE I, BINDING SITE II or BINDING SITE III. Table 2 illustrates the complementarity of the nucleotide sequences of RAP1 BINDING SITE, designated SEQ ID:21045, to the nucleotide sequence of VGAM2663 RNA, herein designated VGAM RNA, also designated SEQ ID:5374.

A function of VGAM2663 is therefore inhibition of RAP1 (Accession NM_018975), a gene which is an ortholog of the yeast telomeric protein Rap1 and may be a general characteristic of sequence-specific transcriptional factors. Accordingly, utilities of VGAM2663 include diagnosis, prevention and treatment of diseases and clinical conditions associated with RAP1. The function of RAP1 and its association with various diseases and clinical conditions, has been established by previous studies, as described hereinabove with reference to VGAM2083. FLJ22029 (Accession NM_024949) is another VGAM2663 host target gene. FLJ22029 BINDING SITE is HOST TARGET binding site found in the 3' untranslated region of mRNA encoded by FLJ22029, corresponding to a HOST TARGET binding site such as BINDING SITE I, BINDING SITE II or BINDING SITE III. Table 2 illustrates the complementarity of the nucleotide sequences of FLJ22029 BINDING SITE, designated SEQ ID:24505, to the nucleotide sequence of VGAM2663 RNA, herein designated VGAM RNA, also designated SEQ ID:5374.

Another function of VGAM2663 is therefore inhibition of FLJ22029 (Accession NM_024949). Accordingly, utilities of VGAM2663 include diagnosis, prevention and treatment of diseases and clinical conditions associated with FLJ22029. FIG. 1 further provides a conceptual description of a novel bioinformatically detected viral gene of the present invention, referred to here as Viral Genomic Address Messenger 2664

(VGAM2664) viral gene, which modulates expression of respective host target genes thereof, the function and utility of which host target genes is known in the art.

VGAM2664 is a novel bioinformatically detected regulatory, non protein coding, viral micro RNA (miRNA) gene. The method by which VGAM2664 was detected is described hereinabove with reference to FIGS. 1-8.

VGAM2664 gene, herein designated VGAM GENE, is a viral gene contained in the genome of Cryphonectria Parasitica Mitovirus 1-NB631. VGAM2664 host target gene, herein designated VGAM HOST TARGET GENE, is a human gene contained in the human genome.

VGAM2664 gene encodes a VGAM2664 precursor RNA, herein designated VGAM PRECURSOR RNA. Similar to other miRNA genes, and unlike most ordinary genes, VGAM2664 precursor RNA does not encode a protein. A nucleotide sequence identical or highly similar to the nucleotide sequence of VGAM2664 precursor RNA is designated SEQ ID:2650, and is provided hereinbelow with reference to the sequence listing part. Nucleotide sequence SEQ ID:2650 is located at position 1630 relative to the genome of Cryphonectria Parasitica Mitovirus 1-NB631.

VGAM2664 precursor RNA folds onto itself, forming VGAM2664 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2664 folded precursor RNA into VGAM2664 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 52%) nucleotide sequence of VGAM2664 RNA is designated SEQ ID:5375, and is provided hereinbelow with reference to the sequence listing part.

VGAM2664 host target gene, herein designated VGAM HOST TARGET GENE, encodes a corresponding messenger RNA, VGAM2664 host target RNA, herein designated VGAM HOST TARGET RNA. VGAM2664 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2664 RNA, herein designated VGAM RNA, binds complementarily to one or more host target binding sites located in untranslated regions of VGAM2664 host target RNA, herein designated VGAM HOST TARGET RNA. This complementary binding is due to the fact that the nucleotide sequence of VGAM2664 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2664 RNA, herein designated VGAM RNA, may have a different number of host target binding sites in untranslated regions of a VGAM2664 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2664 RNA, herein designated VGAM RNA, to host target binding sites on VGAM2664 host target RNA, herein designated VGAM HOST TARGET RNA, such as BINDING SITE I, BINDING SITE II and BINDING SITE III, inhibits translation of VGAM2664 host target RNA into VGAM2664 host target protein, herein designated VGAM HOST TARGET PROTEIN. VGAM host target protein is therefore outlined by a broken line.

It is appreciated that VGAM2664 host target gene, herein designated VGAM HOST TARGET GENE, in fact represents a plurality of VGAM2664 host target genes. The mRNA of each one of this plurality of VGAM2664 host target genes comprises one or more host target binding sites, each having a nucleotide sequence which is at least partly complementary to VGAM2664 RNA, herein designated VGAM RNA, and which when bound by VGAM2664 RNA causes inhibition of translation of respective one or more VGAM2664 host target proteins.

It is further appreciated by one skilled in the art that the mode of translational inhibition illustrated by FIG. 1 with specific reference to translational inhibition exerted by VGAM2664 gene, herein designated VGAM GENE, on one or more VGAM2664 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2664 is inhibition of expression of host target genes, as part of a novel viral mechanism of attacking a host. Accordingly, utilities of VGAM2664 include diagnosis, prevention and treatment of viral infection by Cryphonectria Parasitica Mitovirus 1-NB631. Specific functions, and accordingly utilities, of VGAM2664 correlate with, and may be deduced from, the identity of the host target genes which VGAM2664 binds and inhibits, and the function of these host target genes, as elaborated hereinbelow.

Nucleotide sequences of the VGAM2664 precursor RNA, herein designated VGAM PRECURSOR RNA, and of the 'diced' VGAM2664 RNA, herein designated VGAM RNA, and a schematic representation of the secondary folding of VGAM2664 folded precursor RNA, herein designated VGAM FOLDED PRECURSOR RNA, of VGAM2664 are further described hereinbelow with reference to Table 1.

Nucleotide sequences of host target binding sites, such as BINDING SITE-I, BINDING SITE-II and BINDING SITE-III of FIG. 1, found on VGAM2664 host target RNA, and schematic representation of the complementarity of each of these host target binding sites to VGAM2664 RNA, herein designated VGAM RNA, are described hereinbelow with reference to Table 2.

As mentioned hereinabove with reference to FIG. 1, a function of VGAM2664 gene, herein designated VGAM is inhibition of expression of VGAM2664 target genes. It is appreciated that specific functions, and accordingly utilities, of VGAM2664 correlate with, and may be deduced from, the identity of the target genes which VGAM2664 binds and inhibits, and the function of these target genes, as elaborated hereinbelow.

Heparan Sulfate 2-O-sulfotransferase 1 (HS2ST1, Accession NM_012262) is a VGAM2664 host target gene. HS2ST1 BINDING SITE is HOST TARGET binding site found in the 3' untranslated region of mRNA encoded by HS2ST1, corresponding to a HOST TARGET binding site such as BINDING SITE I, BINDING SITE II or BINDING SITE III. Table 2 illustrates the complementarity of the nucleotide sequences of HS2ST1 BINDING SITE, designated SEQ ID:14580, to the nucleotide sequence of VGAM2664 RNA, herein designated VGAM RNA, also designated SEQ ID:5375.

A function of VGAM2664 is therefore inhibition of Heparan Sulfate 2-O-sulfotransferase 1 (HS2ST1, Accession NM_012262). Accordingly, utilities of VGAM2664 include diagnosis, prevention and treatment of diseases and clinical conditions associated with HS2ST1. Myotubularin Related Protein 2 (MTMR2, Accession NM_016156) is another VGAM2664 host target gene. MTMR2 BINDING SITE is HOST TARGET binding site found in the 3' untranslated region of mRNA encoded by MTMR2, corresponding to a HOST TARGET binding site such as BINDING SITE I, BINDING SITE II or BINDING SITE III. Table 2 illustrates the complementarity of the nucleotide sequences of MTMR2 BINDING SITE, designated SEQ ID:18245, to the nucleotide sequence of VGAM2664 RNA, herein designated VGAM RNA, also designated SEQ ID:5375.

Another function of VGAM2664 is therefore inhibition of Myotubularin Related Protein 2 (MTMR2, Accession NM_016156). Accordingly, utilities of VGAM2664 include diagnosis, prevention and treatment of diseases and clinical conditions associated with MTMR2. Stress 70 Protein Chaperone, Microsome-associated, 60 kDa (STCH, Accession NM_006948) is another VGAM2664 host target gene. STCH BINDING SITE is HOST TARGET binding site found in the 3' untranslated region of mRNA encoded by STCH, corresponding to a HOST TARGET binding site such as BINDING SITE I, BINDING SITE II or BINDING SITE III. Table 2 illustrates the complementarity of the nucleotide sequences of STCH BINDING SITE, designated SEQ ID:13833, to the nucleotide sequence of VGAM2664 RNA, herein designated VGAM RNA, also designated SEQ ID:5375.

Another function of VGAM2664 is therefore inhibition of Stress 70 Protein Chaperone, Microsome-associated, 60 kDa (STCH, Accession NM_006948), a gene which has peptide-independent atpase activity. Accordingly, utilities of VGAM2664 include diagnosis, prevention and treatment of diseases and clinical conditions associated with STCH. The function of STCH and its association with various diseases and clinical conditions, has been established by previous studies, as described hereinabove with reference to VGAM550. DKFZP761E2110 (Accession NM_030953) is another VGAM2664 host target gene. DKFZP761E2110 BINDING SITE is HOST TARGET binding site found in the 3' untranslated region of mRNA encoded by DKFZP761E2110, corresponding to a HOST TARGET binding site such as BINDING SITE I, BINDING SITE II or BINDING SITE III. Table 2 illustrates the complementarity of the nucleotide sequences of DKFZP761E2110 BINDING SITE, designated SEQ ID:25225, to the nucleotide sequence of VGAM2664 RNA, herein designated VGAM RNA, also designated SEQ ID:5375.

Another function of VGAM2664 is therefore inhibition of DKFZP761E2110 (Accession NM_030953). Accordingly, utilities of VGAM2664 include diagnosis, prevention and treatment of diseases and clinical conditions associated with DKFZP761E2110. KIAA0009 (Accession NM_014637) is another VGAM2664 host target gene. KIAA0009 BINDING SITE is HOST TARGET binding site found in the 3' untranslated region of mRNA encoded by KIAA0009, corresponding to a HOST TARGET binding site such as BINDING SITE I, BINDING SITE II or BINDING SITE III. Table 2 illustrates the complementarity of the nucleotide sequences of KIAA0009 BINDING SITE, designated SEQ ID:16021, to the nucleotide sequence of VGAM2664 RNA, herein designated VGAM RNA, also designated SEQ ID:5375.

Another function of VGAM2664 is therefore inhibition of KIAA0009 (Accession NM_014637). Accordingly, utilities of VGAM2664 include diagnosis, prevention and treatment of diseases and clinical conditions associated with KIAA0009. KIAA0795 (Accession NM_025010) is another VGAM2664 host target gene. KIAA0795 BINDING SITE is HOST TARGET binding site found in the 5' untranslated region of mRNA encoded by KIAA0795, corresponding to a HOST TARGET binding site such as BINDING SITE I, BINDING SITE II or BINDING SITE III. Table 2 illustrates the complementarity of the nucleotide sequences of KIAA0795 BINDING SITE, designated SEQ ID:24584, to the nucleotide sequence of VGAM2664 RNA, herein designated VGAM RNA, also designated SEQ ID:5375.

Another function of VGAM2664 is therefore inhibition of KIAA0795 (Accession NM_025010). Accordingly, utilities of VGAM2664 include diagnosis, prevention and treatment of diseases and clinical conditions associated with KIAA0795. KIAA1348 (Accession XM_043826) is another VGAM2664 host target gene. KIAA1348 BINDING SITE is HOST TARGET binding site found in the 3' untranslated region of mRNA encoded by KIAA1348, corresponding to a HOST TARGET binding site such as BINDING SITE I, BINDING SITE II or BINDING SITE III. Table 2 illustrates the complementarity of the nucleotide sequences of KIAA1348 BINDING SITE, designated SEQ ID:34032, to the nucleotide sequence of VGAM2664 RNA, herein designated VGAM RNA, also designated SEQ ID:5375.

Another function of VGAM2664 is therefore inhibition of KIAA1348 (Accession XM_043826). Accordingly, utilities of VGAM2664 include diagnosis, prevention and treatment of diseases and clinical conditions associated with KIAA1348. Solute Carrier Family 1 (glutamate transporter), Member 7 (SLC1A7, Accession NM_006671) is another VGAM2664 host target gene. SLC1A7 BINDING SITE is HOST TARGET binding site found in the 3' untranslated region of mRNA encoded by SLC1A7, corresponding to a HOST TARGET binding site such as BINDING SITE I, BINDING SITE II or BINDING SITE III. Table 2 illustrates the complementarity of the nucleotide sequences of SLC1A7 BINDING SITE, designated SEQ ID:13491, to the nucleotide sequence of VGAM2664 RNA, herein designated VGAM RNA, also designated SEQ ID:5375.

Another function of VGAM2664 is therefore inhibition of Solute Carrier Family 1 (glutamate transporter), Member 7 (SLC1A7, Accession NM_006671). Accordingly, utilities of VGAM2664 include diagnosis, prevention and treatment of diseases and clinical conditions associated with SLC1A7. LOC203197 (Accession XM_114645) is another VGAM2664 host target gene. LOC203197 BINDING SITE is HOST TARGET binding site found in the 3' untranslated region of mRNA encoded by LOC203197, corresponding to a HOST TARGET binding site such as BINDING SITE I, BINDING SITE II or BINDING SITE III. Table 2 illustrates the complementarity of the nucleotide sequences of LOC203197 BINDING SITE, designated SEQ ID:43012, to the nucleotide sequence of VGAM2664 RNA, herein designated VGAM RNA, also designated SEQ ID:5375.

Another function of VGAM2664 is therefore inhibition of LOC203197 (Accession XM_114645). Accordingly, utilities of VGAM2664 include diagnosis, prevention and treatment of diseases and clinical conditions associated with LOC203197. LOC221692 (Accession XM_166420) is another VGAM2664 host target gene. LOC221692 BINDING SITE is HOST TARGET binding site found in the 3' untranslated region of mRNA encoded by LOC221692, corresponding to a HOST TARGET binding site such as BINDING SITE I, BINDING SITE II or BINDING SITE III. Table 2 illustrates the complementarity of the nucleotide sequences of LOC221692 BINDING SITE, designated SEQ ID:44300, to the nucleotide sequence of VGAM2664 RNA, herein designated VGAM RNA, also designated SEQ ID:5375.

Another function of VGAM2664 is therefore inhibition of LOC221692 (Accession XM_166420). Accordingly, utilities of VGAM2664 include diagnosis, prevention and treatment of diseases and clinical conditions associated with LOC221692. LOC257464 (Accession XM_116972) is another VGAM2664 host target gene. LOC257464 BINDING SITE is HOST TARGET binding site found in the 5' untranslated region of mRNA encoded by LOC257464, corresponding to a HOST TARGET binding site such as BINDING SITE I, BINDING SITE II or BINDING SITE III. Table 2 illustrates the complementarity of the nucleotide sequences of LOC257464 BINDING SITE, designated SEQ ID:43170, to the nucleotide sequence of VGAM2664 RNA, herein designated VGAM RNA, also designated SEQ ID:5375.

Another function of VGAM2664 is therefore inhibition of LOC257464 (Accession XM_116972). Accordingly, utilities of VGAM2664 include diagnosis, prevention and treatment of diseases and clinical conditions associated with LOC257464. LOC92719 (Accession XM_046853) is another VGAM2664 host target gene. LOC92719 BINDING SITE is HOST TARGET binding site found in the 3' untranslated region of mRNA encoded by LOC92719, corresponding to a HOST TARGET binding site such as BINDING SITE I, BINDING SITE II or BINDING SITE III. Table 2 illustrates the complementarity of the nucleotide sequences of LOC92719 BINDING SITE, designated SEQ ID:34846, to the nucleotide sequence of VGAM2664 RNA, herein designated VGAM RNA, also designated SEQ ID:5375.

Another function of VGAM2664 is therefore inhibition of LOC92719 (Accession XM_046853). Accordingly, utilities of VGAM2664 include diagnosis, prevention and treatment of diseases and clinical conditions associated with LOC92719. FIG. 1 further provides a conceptual description of a novel bioinformatically detected viral gene of the present invention, referred to here as Viral Genomic Address Messenger 2665 (VGAM2665) viral gene, which modulates expression of respective host target genes thereof, the function and utility of which host target genes is known in the art.

VGAM2665 is a novel bioinformatically detected regulatory, non protein coding, viral micro RNA (miRNA) gene. The method by which VGAM2665 was detected is described hereinabove with reference to FIGS. 1-8.

VGAM2665 gene, herein designated VGAM GENE, is a viral gene contained in the genome of Cryphonectria Parasitica Mitovirus 1-NB631. VGAM2665 host target gene, herein designated VGAM HOST TARGET GENE, is a human gene contained in the human genome.

VGAM2665 gene encodes a VGAM2665 precursor RNA, herein designated VGAM PRECURSOR RNA. Similar to other miRNA genes, and unlike most ordinary genes, VGAM2665 precursor RNA does not encode a protein. A nucleotide sequence identical or highly similar to the nucleotide sequence of VGAM2665 precursor RNA is designated SEQ ID:2651, and is provided hereinbelow with reference to the sequence listing part. Nucleotide sequence SEQ ID:2651 is located at position 1362 relative to the genome of Cryphonectria Parasitica Mitovirus 1-NB631.

VGAM2665 precursor RNA folds onto itself, forming VGAM2665 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2665 folded precursor RNA into VGAM2665 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2665 RNA is designated SEQ ID:5376, and is provided hereinbelow with reference to the sequence listing part.

VGAM2665 host target gene, herein designated VGAM HOST TARGET GENE, encodes a corresponding messenger RNA, VGAM2665 host target RNA, herein designated VGAM HOST TARGET RNA. VGAM2665 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2665 RNA, herein designated VGAM RNA, binds complementarily to one or more host target binding sites located in untranslated regions of VGAM2665 host target RNA, herein designated VGAM HOST TARGET RNA. This complementary binding is due to the fact that the nucleotide sequence of VGAM2665 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2665 RNA, herein designated VGAM RNA, may have a different number of host target binding sites in untranslated regions of a VGAM2665 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2665 RNA, herein designated VGAM RNA, to host target binding sites on VGAM2665 host target RNA, herein designated VGAM HOST TARGET RNA, such as BINDING SITE I, BINDING SITE II and BINDING SITE III, inhibits translation of VGAM2665 host target RNA into VGAM2665 host target protein, herein designated VGAM HOST TARGET PROTEIN. VGAM host target protein is therefore outlined by a broken line.

It is appreciated that VGAM2665 host target gene, herein designated VGAM HOST TARGET GENE, in fact represents a plurality of VGAM2665 host target genes. The mRNA of each one of this plurality of VGAM2665 host target genes comprises one or more host target binding sites, each having a nucleotide sequence which is at least partly complementary to VGAM2665 RNA, herein designated VGAM RNA, and which when bound by VGAM2665 RNA causes inhibition of translation of respective one or more VGAM2665 host target proteins.

It is further appreciated by one skilled in the art that the mode of translational inhibition illustrated by FIG. 1 with specific reference to translational inhibition exerted by VGAM2665 gene, herein designated VGAM GENE, on one or more VGAM2665 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2665 is inhibition of expression of host target genes, as part of a novel viral mechanism of attacking a host. Accordingly, utilities of VGAM2665 include diagnosis, prevention and treatment of viral infection by Cryphonectria Parasitica Mitovirus 1-NB631. Specific functions, and accordingly utilities, of VGAM2665 correlate with, and may be deduced from, the identity of the host target genes which VGAM2665 binds and inhibits, and the function of these host target genes, as elaborated hereinbelow.

Nucleotide sequences of the VGAM2665 precursor RNA, herein designated VGAM PRECURSOR RNA, and of the 'diced' VGAM2665 RNA, herein designated VGAM RNA, and a schematic representation of the secondary folding of VGAM2665 folded precursor RNA, herein designated VGAM FOLDED PRECURSOR RNA, of VGAM2665 are further described hereinbelow with reference to Table 1.

Nucleotide sequences of host target binding sites, such as BINDING SITE-I, BINDING SITE-II and BINDING SITE-III of FIG. 1, found on VGAM2665 host target RNA, and schematic representation of the complementarity of each of these host target binding sites to VGAM2665 RNA, herein designated VGAM RNA, are described hereinbelow with reference to Table 2.

As mentioned hereinabove with reference to FIG. 1, a function of VGAM2665 gene, herein designated VGAM is inhibition of expression of VGAM2665 target genes. It is appreciated that specific functions, and accordingly utilities, of VGAM2665 correlate with, and may be deduced from, the identity of the target genes which VGAM2665 binds and inhibits, and the function of these target genes, as elaborated hereinbelow.

Agouti Related Protein Homolog (mouse) (AGRP, Accession NM_001138) is a VGAM2665 host target gene. AGRP BINDING SITE is HOST TARGET binding site found in the 5' untranslated region of mRNA encoded by AGRP, corresponding to a HOST TARGET binding site such as BINDING SITE I, BINDING SITE II or BINDING SITE III. Table 2 illustrates the complementarity of the nucleotide sequences of AGRP BINDING SITE, designated SEQ ID:6806, to the nucleotide sequence of VGAM2665 RNA, herein designated VGAM RNA, also designated SEQ ID:5376.

A function of VGAM2665 is therefore inhibition of Agouti Related Protein Homolog (mouse) (AGRP, Accession NM_001138), a gene which plays a role in weight homeostasis. Accordingly, utilities of VGAM2665 include diagnosis, prevention and treatment of diseases and clinical conditions associated with AGRP. The function of AGRP and its association with various diseases and clinical conditions, has been established by previous studies, as described hereinabove with reference to VGAM1959. Cell Adhesion Molecule with Homology to L1CAM (close homolog of L1) (CHL1, Accession NM_006614) is another VGAM2665 host target gene. CHL1 BINDING SITE is HOST TARGET binding site found in the 3' untranslated region of mRNA encoded by CHL1, corresponding to a HOST TARGET binding site such as BINDING SITE I, BINDING SITE II or BINDING SITE III. Table 2 illustrates the complementarity of the nucleotide sequences of CHL1 BINDING SITE, designated SEQ ID:13399, to the nucleotide sequence of VGAM2665 RNA, herein designated VGAM RNA, also designated SEQ ID:5376.

Another function of VGAM2665 is therefore inhibition of Cell Adhesion Molecule with Homology to L1CAM (close homolog of L1) (CHL1, Accession NM_006614). Accordingly, utilities of VGAM2665 include diagnosis, prevention and treatment of diseases and clinical conditions associated with CHL1. DKFZp761A132 (Accession NM_032296) is another VGAM2665 host target gene. DKFZp761A132 BINDING SITE is HOST TARGET binding site found in the 3' untranslated region of mRNA encoded by DKFZp761A132, corresponding to a HOST TARGET binding site such as BINDING SITE I, BINDING SITE II or BINDING SITE III. Table 2 illustrates the complementarity of the nucleotide sequences of DKFZp761A132 BINDING SITE, designated SEQ ID:26077, to the nucleotide sequence of VGAM2665 RNA, herein designated VGAM RNA, also designated SEQ ID:5376.

Another function of VGAM2665 is therefore inhibition of DKFZp761A132 (Accession NM_032296). Accordingly, utilities of VGAM2665 include diagnosis, prevention and treatment of diseases and clinical conditions associated with DKFZp761A132. FLJ10375 (Accession NM_018075) is another VGAM2665 host target gene. FLJ10375 BINDING SITE is HOST TARGET binding site found in the 5' untranslated region of mRNA encoded by FLJ10375, corresponding to a HOST TARGET binding site such as BINDING SITE I, BINDING SITE II or BINDING SITE III. Table 2 illustrates the complementarity of the nucleotide sequences of FLJ10375 BINDING SITE, designated SEQ ID:19838, to the nucleotide sequence of VGAM2665 RNA, herein designated VGAM RNA, also designated SEQ ID:5376.

Another function of VGAM2665 is therefore inhibition of FLJ10375 (Accession NM_018075). Accordingly, utilities of VGAM2665 include diagnosis, prevention and treatment of diseases and clinical conditions associated with FLJ10375. FLJ11726 (Accession NM_024971) is another VGAM2665 host target gene. FLJ11726 BINDING SITE is HOST TARGET binding site found in the 3' untranslated region of mRNA encoded by FLJ11726, corresponding to a HOST TARGET binding site such as BINDING SITE I, BINDING SITE II or BINDING SITE III. Table 2 illustrates the complementarity of the nucleotide sequences of FLJ11726 BINDING SITE, designated SEQ ID:24529, to the nucleotide sequence of VGAM2665 RNA, herein designated VGAM RNA, also designated SEQ ID:5376.

Another function of VGAM2665 is therefore inhibition of FLJ11726 (Accession NM_024971). Accordingly, utilities of VGAM2665 include diagnosis, prevention and treatment of diseases and clinical conditions associated with FLJ11726. KIAA1956 (Accession XM_085836) is another VGAM2665 host target gene. KIAA1956 BINDING SITE is HOST TARGET binding site found in the 3' untranslated region of mRNA encoded by KIAA1956, corresponding to a HOST TARGET binding site such as BINDING SITE I, BINDING SITE II or BINDING SITE III. Table 2 illustrates the complementarity of the nucleotide sequences of KIAA1956 BINDING SITE, designated SEQ ID:38364, to the nucleotide sequence of VGAM2665 RNA, herein designated VGAM RNA, also designated SEQ ID:5376.

Another function of VGAM2665 is therefore inhibition of KIAA1956 (Accession XM_085836). Accordingly, utilities of VGAM2665 include diagnosis, prevention and treatment of diseases and clinical conditions associated with KIAA1956. MGC12217 (Accession NM_032771) is another VGAM2665 host target gene. MGC12217 BINDING SITE is HOST TARGET binding site found in the 5' untranslated region of mRNA encoded by MGC12217, corresponding to a HOST TARGET binding site such as BINDING SITE I, BINDING SITE II or BINDING SITE III. Table 2 illustrates the complementarity of the nucleotide sequences of MGC12217 BINDING SITE, designated SEQ ID:26517, to the nucleotide sequence of VGAM2665 RNA, herein designated VGAM RNA, also designated SEQ ID:5376.

Another function of VGAM2665 is therefore inhibition of MGC12217 (Accession NM_032771). Accordingly, utilities of VGAM2665 include diagnosis, prevention and treatment of diseases and clinical conditions associated with MGC12217. LOC51622 (Accession NM_015622) is another VGAM2665 host target gene. LOC51622 BINDING SITE is HOST TARGET binding site found in the 3' untranslated region of mRNA encoded by LOC51622, corresponding to a HOST TARGET binding site such as BINDING SITE I, BINDING SITE II or BINDING SITE III. Table 2 illustrates the complementarity of the nucleotide sequences of LOC51622 BINDING SITE, designated SEQ ID:17885, to the nucleotide sequence of VGAM2665 RNA, herein designated VGAM RNA, also designated SEQ ID:5376.

Another function of VGAM2665 is therefore inhibition of LOC51622 (Accession NM_015622). Accordingly, utilities of VGAM2665 include diagnosis, prevention and treatment of diseases and clinical conditions associated with LOC51622. LOC93082 (Accession NM_138397) is another VGAM2665 host target gene. LOC93082 BINDING SITE is HOST TARGET binding site found in the 3' untranslated region of mRNA encoded by LOC93082, corresponding to a HOST TARGET binding site such as BINDING SITE I, BINDING SITE II or BINDING SITE III. Table 2 illustrates the complementarity of the nucleotide sequences of LOC93082 BINDING SITE, designated SEQ ID:28767, to the nucleotide sequence of VGAM2665 RNA, herein designated VGAM RNA, also designated SEQ ID:5376.

Another function of VGAM2665 is therefore inhibition of LOC93082 (Accession NM_138397). Accordingly, utilities of VGAM2665 include diagnosis, prevention and treatment of diseases and clinical conditions associated with LOC93082. FIG. 1 further provides a conceptual description of a novel bioinformatically detected viral gene of the present invention, referred to here as Viral Genomic Address Messenger 2666 (VGAM2666) viral gene, which modulates expression of respective host target genes thereof, the function and utility of which host target genes is known in the art.

VGAM2666 is a novel bioinformatically detected regulatory, non protein coding, viral micro RNA (miRNA) gene. The method by which VGAM2666 was detected is described hereinabove with reference to FIGS. 1-8.

VGAM2666 gene, herein designated VGAM GENE, is a viral gene contained in the genome of Cryphonectria Parasitica Mitovirus 1-NB631. VGAM2666 host target gene, herein designated VGAM HOST TARGET GENE, is a human gene contained in the human genome.

VGAM2666 gene encodes a VGAM2666 precursor RNA, herein designated VGAM PRECURSOR RNA. Similar to other miRNA genes, and unlike most ordinary genes, VGAM2666 precursor RNA does not encode a protein. A nucleotide sequence identical or highly similar to the nucleotide sequence of VGAM2666 precursor RNA is designated SEQ ID:2652, and is provided hereinbelow with reference to the sequence listing part. Nucleotide sequence SEQ ID:2652 is located at position 680 relative to the genome of Cryphonectria Parasitica Mitovirus 1-NB631.

VGAM2666 precursor RNA folds onto itself, forming VGAM2666 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2666 folded precursor RNA into VGAM2666 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM2666 RNA is designated SEQ ID:5377, and is provided hereinbelow with reference to the sequence listing part.

VGAM2666 host target gene, herein designated VGAM HOST TARGET GENE, encodes a corresponding messenger RNA, VGAM2666 host target RNA, herein designated VGAM HOST TARGET RNA. VGAM2666 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2666 RNA, herein designated VGAM RNA, binds complementarily to one or more host target binding sites located in untranslated regions of VGAM2666 host target RNA, herein designated VGAM HOST TARGET RNA. This complementary binding is due to the fact that the nucleotide sequence of VGAM2666 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2666 RNA, herein designated VGAM RNA, may have a different number of host target binding sites in untranslated regions of a VGAM2666 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2666 RNA, herein designated VGAM RNA, to host target binding sites on VGAM2666 host target RNA, herein designated VGAM HOST TARGET RNA, such as BINDING SITE I, BINDING SITE II and BINDING SITE III, inhibits translation of VGAM2666 host target RNA into VGAM2666 host target protein, herein designated VGAM HOST TARGET PROTEIN. VGAM host target protein is therefore outlined by a broken line.

It is appreciated that VGAM2666 host target gene, herein designated VGAM HOST TARGET GENE, in fact represents a plurality of VGAM2666 host target genes. The mRNA of each one of this plurality of VGAM2666 host target genes comprises one or more host target binding sites, each having a nucleotide sequence which is at least partly complementary to VGAM2666 RNA, herein designated VGAM RNA, and which when bound by VGAM2666 RNA causes inhibition of translation of respective one or more VGAM2666 host target proteins.

It is further appreciated by one skilled in the art that the mode of translational inhibition illustrated by FIG. 1 with specific reference to translational inhibition exerted by VGAM2666 gene, herein designated VGAM GENE, on one or more VGAM2666 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2666 is inhibition of expression of host target genes, as part of a novel viral mechanism of attacking a host. Accordingly, utilities of VGAM2666 include diagnosis, prevention and treatment of viral infection by Cryphonectria Parasitica Mitovirus 1-NB631. Specific functions, and accordingly utilities, of VGAM2666 correlate with, and may be deduced from, the identity of the host target genes which VGAM2666 binds and inhibits, and the function of these host target genes, as elaborated hereinbelow.

Nucleotide sequences of the VGAM2666 precursor RNA, herein designated VGAM PRECURSOR RNA, and of the 'diced' VGAM2666 RNA, herein designated VGAM RNA, and a schematic representation of the secondary folding of VGAM2666 folded precursor RNA, herein designated VGAM FOLDED PRECURSOR RNA, of VGAM2666 are further described hereinbelow with reference to Table 1.

Nucleotide sequences of host target binding sites, such as BINDING SITE-I, BINDING SITE-II and BINDING SITE-III of FIG. 1, found on VGAM2666 host target RNA, and schematic representation of the complementarity of each of these host target binding sites to VGAM2666 RNA, herein designated VGAM RNA, are described hereinbelow with reference to Table 2.

As mentioned hereinabove with reference to FIG. 1, a function of VGAM2666 gene, herein designated VGAM is inhibition of expression of VGAM2666 target genes. It is appreciated that specific functions, and accordingly utilities, of VGAM2666 correlate with, and may be deduced from, the identity of the target genes which VGAM2666 binds and inhibits, and the function of these target genes, as elaborated hereinbelow.

APG5 Autophagy 5-like (S. cerevisiae) (APG5L, Accession NM_004849) is a VGAM2666 host target gene. APG5L BINDING SITE is HOST TARGET binding site found in the 3' untranslated region of mRNA encoded by APG5L, corresponding to a HOST TARGET binding site such as BINDING SITE I, BINDING SITE II or BINDING SITE III. Table 2 illustrates the complementarity of the nucleotide sequences of APG5L BINDING SITE, designated SEQ ID:11262, to the nucleotide sequence of VGAM2666 RNA, herein designated VGAM RNA, also designated SEQ ID:5377.

A function of VGAM2666 is therefore inhibition of APG5 Autophagy 5-like (S. cerevisiae) (APG5L, Accession NM_004849), a gene which conjugates to apg12 and associates with isolation membrane to form cup-shaped isolation membrane and autophagosome. Accordingly, utilities of VGAM2666 include diagnosis, prevention and treatment of diseases and clinical conditions associated with APG5L. The function of APG5L and its association with various diseases and clinical conditions, has been established by previous studies, as described hereinabove with reference to VGAM492. Complement Component (3b/4b) Receptor 1, Including Knops Blood Group System (CR1, Accession NM_000573) is another VGAM2666 host target gene. CR1 BINDING SITE is HOST TARGET binding site found in the 3' untranslated region of mRNA encoded by CR1, corresponding to a HOST TARGET binding site such as BINDING SITE I, BINDING SITE II or BINDING SITE III. Table 2 illustrates the complementarity of the nucleotide sequences of CR1 BINDING SITE, designated SEQ ID:6174, to the nucleotide sequence of VGAM2666 RNA, herein designated VGAM RNA, also designated SEQ ID:5377.

Another function of VGAM2666 is therefore inhibition of Complement Component (3b/4b) Receptor 1, Including Knops Blood Group System (CR1, Accession NM_000573). Accordingly, utilities of VGAM2666 include diagnosis, prevention and treatment of diseases and clinical conditions associated with CR1. Nuclear Receptor Coactivator 6 (NCOA6, Accession NM_014071) is another VGAM2666 host target gene. NCOA6 BINDING SITE is HOST TARGET binding site found in the 5' untranslated region of mRNA encoded by NCOA6, corresponding to a HOST TARGET binding site such as BINDING SITE I, BINDING SITE II or BINDING SITE III. Table 2 illustrates the complementarity of the nucleotide sequences of NCOA6 BINDING SITE, designated SEQ ID:15290, to the nucleotide sequence of VGAM2666 RNA, herein designated VGAM RNA, also designated SEQ ID:5377.

Another function of VGAM2666 is therefore inhibition of Nuclear Receptor Coactivator 6 (NCOA6, Accession NM_014071), a gene which activates gene transcription through ligand-dependent association with coactivators. Accordingly, utilities of VGAM2666 include diagnosis, prevention and treatment of diseases and clinical conditions associated with NCOA6. The function of NCOA6 and its association with various diseases and clinical conditions, has been established by previous studies, as described hereinabove with reference to VGAM25. Peroxiredoxin 3 (PRDX3, Accession XM_055573) is another VGAM2666 host target gene. PRDX3 BINDING SITE is HOST TARGET binding site found in the 3' untranslated region of mRNA encoded by PRDX3, corresponding to a HOST TARGET binding site such as BINDING SITE I, BINDING SITE II or BINDING SITE III. Table 2 illustrates the complementarity of the nucleotide sequences of PRDX3 BINDING SITE, designated SEQ ID:36303, to the nucleotide sequence of VGAM2666 RNA, herein designated VGAM RNA, also designated SEQ ID:5377.

Another function of VGAM2666 is therefore inhibition of Peroxiredoxin 3 (PRDX3, Accession XM_055573), a gene which functions as an antioxidant protein and is required to maintain normal mitochondrial function. Accordingly, utilities of VGAM2666 include diagnosis, prevention and treatment of diseases and clinical conditions associated with PRDX3. The function of PRDX3 and its association with various diseases and clinical conditions, has been established by previous studies, as described hereinabove with reference to VGAM191. Recombination Activating Gene 1 (RAG1, Accession NM_000448) is another VGAM2666 host target gene. RAG1 BINDING SITE is HOST TARGET binding site found in the 3' untranslated region of mRNA encoded by RAG1, corresponding to a HOST TARGET binding site such as BINDING SITE I, BINDING SITE II or BINDING SITE III. Table 2 illustrates the complementarity of the nucleotide sequences of RAG1 BINDING SITE, designated SEQ ID:6036, to the nucleotide sequence of VGAM2666 RNA, herein designated VGAM RNA, also designated SEQ ID:5377.

Another function of VGAM2666 is therefore inhibition of Recombination Activating Gene 1 (RAG1, Accession NM_000448). Accordingly, utilities of VGAM2666 include diagnosis, prevention and treatment of diseases and clinical conditions associated with RAG1. Vang-like 2 (van gogh, Drosophila) (VANGL2, Accession XM_049695) is another VGAM2666 host target gene. VANGL2 BINDING SITE is HOST TARGET binding site found in the 3' untranslated region of mRNA encoded by VANGL2, corresponding to a HOST TARGET binding site such as BINDING SITE I, BINDING SITE II or BINDING SITE III. Table 2 illustrates the complementarity of the nucleotide sequences of VANGL2 BINDING SITE, designated SEQ ID:35482, to the nucleotide sequence of VGAM2666 RNA, herein designated VGAM RNA, also designated SEQ ID:5377.

Another function of VGAM2666 is therefore inhibition of Vang-like 2 (van gogh, Drosophila) (VANGL2, Accession XM_049695), a gene which may take part in defining the lateral boundary of floorplate differentiation. Accordingly, utilities of VGAM2666 include diagnosis, prevention and treatment of diseases and clinical conditions associated with VANGL2. The function of VANGL2 and its association with various diseases and clinical conditions, has been established by previous studies, as described hereinabove with reference to VGAM111. CAP350 (Accession NM_014810) is another VGAM2666 host target gene. CAP350 BINDING SITE is HOST TARGET binding site found in the 3' untranslated region of mRNA encoded by CAP350, corresponding to a HOST TARGET binding site such as BINDING SITE I, BINDING SITE II or BINDING SITE III. Table 2 illustrates the complementarity of the nucleotide sequences of CAP350 BINDING SITE, designated SEQ ID:16769, to the nucleotide sequence of VGAM2666 RNA, herein designated VGAM RNA, also designated SEQ ID:5377.

Another function of VGAM2666 is therefore inhibition of CAP350 (Accession NM_014810). Accordingly, utilities of VGAM2666 include diagnosis, prevention and treatment of diseases and clinical conditions associated with CAP350. DKFZP434I092 (Accession XM_042042) is another VGAM2666 host target gene. DKFZP434I092 BINDING SITE is HOST TARGET binding site found in the 3' untranslated region of mRNA encoded by DKFZP434I092, corresponding to a HOST TARGET binding site such as BINDING SITE I, BINDING SITE II or BINDING SITE III. Table 2 illustrates the complementarity of the nucleotide sequences of DKFZP434I092 BINDING SITE, designated SEQ ID:33671, to the nucleotide sequence of VGAM2666 RNA, herein designated VGAM RNA, also designated SEQ ID:5377.

Another function of VGAM2666 is therefore inhibition of DKFZP434I092 (Accession XM_042042). Accordingly, utilities of VGAM2666 include diagnosis, prevention and treatment of diseases and clinical conditions associated with DKFZP434I092. FLJ10874 (Accession NM_018252) is another VGAM2666 host target gene. FLJ10874 BINDING SITE is HOST TARGET binding site found in the 3' untranslated region of mRNA encoded by FLJ10874, corresponding to a HOST TARGET binding site such as BINDING SITE I, BINDING SITE II or BINDING SITE III. Table 2 illustrates the complementarity of the nucleotide sequences of FLJ10874 BINDING SITE, designated SEQ ID:20219, to the nucleotide sequence of VGAM2666 RNA, herein designated VGAM RNA, also designated SEQ ID:5377.

Another function of VGAM2666 is therefore inhibition of FLJ10874 (Accession NM_018252). Accordingly, utilities of VGAM2666 include diagnosis, prevention and treatment of diseases and clinical conditions associated with FLJ10874. FLJ11383 (Accession NM_024938) is another VGAM2666 host target gene. FLJ11383 BINDING SITE is HOST TARGET binding site found in the 5' untranslated region of mRNA encoded by FLJ11383, corresponding to a HOST TARGET binding site such as BINDING SITE I, BINDING SITE II or BINDING SITE III. Table 2 illustrates the complementarity of the nucleotide sequences of FLJ11383 BINDING SITE, designated SEQ ID:24477, to the nucleotide sequence of VGAM2666 RNA, herein designated VGAM RNA, also designated SEQ ID:5377.

Another function of VGAM2666 is therefore inhibition of FLJ11383 (Accession NM_024938). Accordingly, utilities of VGAM2666 include diagnosis, prevention and treatment of diseases and clinical conditions associated with FLJ11383. KIAA0459 (Accession XM_027862) is another VGAM2666 host target gene. KIAA0459 BINDING SITE is HOST TARGET binding site found in the 3' untranslated region of mRNA encoded by KIAA0459, corresponding to a HOST TARGET binding site such as BINDING SITE I, BINDING SITE II or BINDING SITE III. Table 2 illustrates the complementarity of the nucleotide sequences of KIAA0459 BINDING SITE, designated SEQ ID:30576, to the nucleotide sequence of VGAM2666 RNA, herein designated VGAM RNA, also designated SEQ ID:5377.

Another function of VGAM2666 is therefore inhibition of KIAA0459 (Accession XM_027862). Accordingly, utilities of VGAM2666 include diagnosis, prevention and treatment of diseases and clinical conditions associated with KIAA0459. KIAA0599 (Accession XM_085127) is another VGAM2666 host target gene. KIAA0599 BINDING SITE is HOST TARGET binding site found in the 3' untranslated region of mRNA encoded by KIAA0599, corresponding to a HOST TARGET binding site such as BINDING SITE I, BINDING SITE II or BINDING SITE III. Table 2 illustrates the complementarity of the nucleotide sequences of KIAA0599 BINDING SITE, designated SEQ ID:37851, to the nucleotide sequence of VGAM2666 RNA, herein designated VGAM RNA, also designated SEQ ID:5377.

Another function of VGAM2666 is therefore inhibition of KIAA0599 (Accession XM_085127). Accordingly, utilities of VGAM2666 include diagnosis, prevention and treatment of diseases and clinical conditions associated with KIAA0599. KIAA0669 (Accession NM_014779) is another VGAM2666 host target gene. KIAA0669 BINDING SITE is HOST TARGET binding site found in the 3' untranslated region of mRNA encoded by KIAA0669, corresponding to a HOST TARGET binding site such as BINDING SITE I, BINDING SITE II or BINDING SITE III. Table 2 illustrates the complementarity of the nucleotide sequences of KIAA0669 BINDING SITE, designated SEQ ID:16627, to the nucleotide sequence of VGAM2666 RNA, herein designated VGAM RNA, also designated SEQ ID:5377.

Another function of VGAM2666 is therefore inhibition of KIAA0669 (Accession NM_014779). Accordingly, utilities of VGAM2666 include diagnosis, prevention and treatment of diseases and clinical conditions associated with KIAA0669. KIAA1317 (Accession XM_098368) is another VGAM2666 host target gene. KIAA1317 BINDING SITE is HOST TARGET binding site found in the 3' untranslated region of mRNA encoded by KIAA1317, corresponding to a HOST TARGET binding site such as BINDING SITE I, BINDING SITE II or BINDING SITE III. Table 2 illustrates the complementarity of the nucleotide sequences of KIAA1317 BINDING SITE, designated SEQ ID:41621, to the nucleotide sequence of VGAM2666 RNA, herein designated VGAM RNA, also designated SEQ ID:5377.

Another function of VGAM2666 is therefore inhibition of KIAA1317 (Accession XM_098368). Accordingly, utilities of VGAM2666 include diagnosis, prevention and treatment of diseases and clinical conditions associated with KIAA1317. LOC158722 (Accession XM_088653) is another VGAM2666 host target gene. LOC158722 BINDING SITE is HOST TARGET binding site found in the 3' untranslated region of mRNA encoded by LOC158722, corresponding to a HOST TARGET binding site such as BINDING SITE I, BINDING SITE II or BINDING SITE III. Table 2 illustrates the complementarity of the nucleotide sequences of LOC158722 BINDING SITE, designated SEQ ID:39888, to the nucleotide sequence of VGAM2666 RNA, herein designated VGAM RNA, also designated SEQ ID:5377.

Another function of VGAM2666 is therefore inhibition of LOC158722 (Accession XM_088653). Accordingly, utilities of VGAM2666 include diagnosis, prevention and treatment of diseases and clinical conditions associated with LOC158722. LOC169026 (Accession XM_095471) is another VGAM2666 host target gene. LOC169026 BINDING SITE is HOST TARGET binding site found in the 3' untranslated region of mRNA encoded by LOC169026, corresponding to a HOST TARGET binding site such as BINDING SITE I, BINDING SITE II or BINDING SITE III. Table 2 illustrates the complementarity of the nucleotide sequences of LOC169026 BINDING SITE, designated SEQ ID:40263, to the nucleotide sequence of VGAM2666 RNA, herein designated VGAM RNA, also designated SEQ ID:5377.

Another function of VGAM2666 is therefore inhibition of LOC169026 (Accession XM_095471). Accordingly, utilities of VGAM2666 include diagnosis, prevention and treatment of diseases and clinical conditions associated with LOC169026. FIG. 1 further provides a conceptual description of a novel bioinformatically detected viral gene of the present invention, referred to here as Viral Genomic Address Messenger 2667 (VGAM2667) viral gene, which modulates expression of respective host target genes thereof, the function and utility of which host target genes is known in the art.

VGAM2667 is a novel bioinformatically detected regulatory, non protein coding, viral micro RNA (miRNA) gene. The method by which VGAM2667 was detected is described hereinabove with reference to FIGS. 1-8.

VGAM2667 gene, herein designated VGAM GENE, is a viral gene contained in the genome of Bean Common Mosaic Necrosis Virus. VGAM2667 host target gene, herein designated VGAM HOST TARGET GENE, is a human gene contained in the human genome.

VGAM2667 gene encodes a VGAM2667 precursor RNA, herein designated VGAM PRECURSOR RNA. Similar to other miRNA genes, and unlike most ordinary genes, VGAM2667 precursor RNA does not encode a protein. A nucleotide sequence identical or highly similar to the nucleotide sequence of VGAM2667 precursor RNA is designated SEQ ID:2653, and is provided hereinbelow with reference to the sequence listing part. Nucleotide sequence SEQ ID:2653 is located at position 9077 relative to the genome of Bean Common Mosaic Necrosis Virus.

VGAM2667 precursor RNA folds onto itself, forming VGAM2667 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2667 folded precursor RNA into VGAM2667 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2667 RNA is designated SEQ ID:5378, and is provided hereinbelow with reference to the sequence listing part.

VGAM2667 host target gene, herein designated VGAM HOST TARGET GENE, encodes a corresponding messenger RNA, VGAM2667 host target RNA, herein designated VGAM HOST TARGET RNA. VGAM2667 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2667 RNA, herein designated VGAM RNA, binds complementarily to one or more host target binding sites located in untranslated regions of VGAM2667 host target RNA, herein designated VGAM HOST TARGET RNA. This complementary binding is due to the fact that the nucleotide sequence of VGAM2667 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2667 RNA, herein designated VGAM RNA, may have a different number of host target binding sites in untranslated regions of a VGAM2667 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2667 RNA, herein designated VGAM RNA, to host target binding sites on VGAM2667 host target RNA, herein designated VGAM HOST TARGET RNA, such as BINDING SITE I, BINDING SITE II and BINDING SITE III, inhibits translation of VGAM2667 host target RNA into VGAM2667 host target protein, herein designated VGAM HOST TARGET PROTEIN. VGAM host target protein is therefore outlined by a broken line.

It is appreciated that VGAM2667 host target gene, herein designated VGAM HOST TARGET GENE, in fact represents a plurality of VGAM2667 host target genes. The mRNA of each one of this plurality of VGAM2667 host target genes comprises one or more host target binding sites, each having a nucleotide sequence which is at least partly complementary to VGAM2667 RNA, herein designated VGAM RNA, and which when bound by VGAM2667 RNA causes inhibition of translation of respective one or more VGAM2667 host target proteins.

It is further appreciated by one skilled in the art that the mode of translational inhibition illustrated by FIG. 1 with specific reference to translational inhibition exerted by VGAM2667 gene, herein designated VGAM GENE, on one or more VGAM2667 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2667 is inhibition of expression of host target genes, as part of a novel viral mechanism of attacking a host. Accordingly, utilities of VGAM2667 include diagnosis, prevention and treatment of viral infection by Bean Common Mosaic Necrosis Virus. Specific functions, and accordingly utilities, of VGAM2667 correlate with, and may be deduced from, the identity of the host target genes which VGAM2667 binds and inhibits, and the function of these host target genes, as elaborated hereinbelow.

Nucleotide sequences of the VGAM2667 precursor RNA, herein designated VGAM PRECURSOR RNA, and of the 'diced' VGAM2667 RNA, herein designated VGAM RNA, and a schematic representation of the secondary folding of VGAM2667 folded precursor RNA, herein designated VGAM FOLDED PRECURSOR RNA, of VGAM2667 are further described hereinbelow with reference to Table 1.

Nucleotide sequences of host target binding sites, such as BINDING SITE-I, BINDING SITE-II and BINDING SITE-III of FIG. 1, found on VGAM2667 host target RNA, and schematic representation of the complementarity of each of these host target binding sites to VGAM2667 RNA, herein designated VGAM RNA, are described hereinbelow with reference to Table 2.

As mentioned hereinabove with reference to FIG. 1, a function of VGAM2667 gene, herein designated VGAM is inhibition of expression of VGAM2667 target genes. It is appreciated that specific functions, and accordingly utilities, of VGAM2667 correlate with, and may be deduced from, the identity of the target genes which VGAM2667 binds and inhibits, and the function of these target genes, as elaborated hereinbelow.

CASP8 Associated Protein 2 (CASP8AP2, Accession NM_012115) is a VGAM2667 host target gene. CASP8AP2 BINDING SITE is HOST TARGET binding site found in the 3' untranslated region of mRNA encoded by CASP8AP2, corresponding to a HOST TARGET binding site such as BINDING SITE I, BINDING SITE II or BINDING SITE III. Table 2 illustrates the complementarity of the nucleotide sequences of CASP8AP2 BINDING SITE, designated SEQ ID:14430, to the nucleotide sequence of VGAM2667 RNA, herein designated VGAM RNA, also designated SEQ ID:5378.

A function of VGAM2667 is therefore inhibition of CASP8 Associated Protein 2 (CASP8AP2, Accession NM_012115), a gene which interacts with and activates caspase-8 in Fas-mediated apoptosis. Accordingly, utilities of VGAM2667 include diagnosis, prevention and treatment of diseases and clinical conditions associated with CASP8AP2. The function of CASP8AP2 and its association with various diseases and clinical conditions, has been established by previous studies, as described hereinabove with reference to VGAM581. Leukemia Inhibitory Factor Receptor (LIFR, Accession NM_002310) is another VGAM2667 host target gene. LIFR BINDING SITE is HOST TARGET binding site found in the 3' untranslated region of mRNA encoded by LIFR, corresponding to a HOST TARGET binding site such as BINDING SITE I, BINDING SITE II or BINDING SITE III. Table 2 illustrates the complementarity of the nucleotide sequences of LIFR BINDING SITE, designated SEQ ID:8105, to the nucleotide sequence of VGAM2667 RNA, herein designated VGAM RNA, also designated SEQ ID:5378.

Another function of VGAM2667 is therefore inhibition of Leukemia Inhibitory Factor Receptor (LIFR, Accession NM_002310). Accordingly, utilities of VGAM2667 include diagnosis, prevention and treatment of diseases and clinical conditions associated with LIFR. NDRG Family Member 3 (NDRG3, Accession NM_032013) is another VGAM2667 host target gene. NDRG3 BINDING SITE is HOST TARGET binding site found in the 3' untranslated region of mRNA encoded by NDRG3, corresponding to a HOST TARGET binding site such as BINDING SITE I, BINDING SITE II or BINDING SITE III. Table 2 illustrates the complementarity of the nucleotide sequences of NDRG3 BINDING SITE, designated SEQ ID:25721, to the nucleotide sequence of VGAM2667 RNA, herein designated VGAM RNA, also designated SEQ ID:5378.

Another function of VGAM2667 is therefore inhibition of NDRG Family Member 3 (NDRG3, Accession NM_032013). Accordingly, utilities of VGAM2667 include diagnosis, prevention and treatment of diseases and clinical conditions associated with NDRG3. Polycystic Kidney Disease 2 (autosomal dominant) (PKD2, Accession XM_011124) is another VGAM2667 host target gene. PKD2 BINDING SITE is HOST TARGET binding site found in the 3' untranslated region of mRNA encoded by PKD2, corresponding to a HOST TARGET binding site such as BINDING SITE I, BINDING SITE II or BINDING SITE III. Table 2 illustrates the complementarity of the nucleotide sequences of PKD2 BINDING SITE, designated SEQ ID:30176, to the nucleotide sequence of VGAM2667 RNA, herein designated VGAM RNA, also designated SEQ ID:5378.

Another function of VGAM2667 is therefore inhibition of Polycystic Kidney Disease 2 (autosomal dominant) (PKD2, Accession XM_011124). Accordingly, utilities of VGAM2667 include diagnosis, prevention and treatment of diseases and clinical conditions associated with PKD2. C16orf5 (Accession NM_013399) is another VGAM2667 host target gene. C16orf5 BINDING SITE is HOST TARGET binding site found in the 3' untranslated region of mRNA encoded by C16orf5, corresponding to a HOST TARGET binding site such as BINDING SITE I, BINDING SITE II or BINDING SITE III. Table 2 illustrates the complementarity of the nucleotide sequences of C16orf5 BINDING SITE, designated SEQ ID:15055, to the nucleotide sequence of VGAM2667 RNA, herein designated VGAM RNA, also designated SEQ ID:5378.

Another function of VGAM2667 is therefore inhibition of C16orf5 (Accession NM_013399). Accordingly, utilities of VGAM2667 include diagnosis, prevention and treatment of diseases and clinical conditions associated with C16orf5. FLJ22635 (Accession NM_025092) is another VGAM2667 host target gene. FLJ22635 BINDING SITE is HOST TARGET binding site found in the 3' untranslated region of mRNA encoded by FLJ22635, corresponding to a HOST TARGET binding site such as BINDING SITE I, BINDING SITE II or BINDING SITE III. Table 2 illustrates the complementarity of the nucleotide sequences of FLJ22635 BINDING SITE, designated SEQ ID:24718, to the nucleotide sequence of VGAM2667 RNA, herein designated VGAM RNA, also designated SEQ ID:5378.

Another function of VGAM2667 is therefore inhibition of FLJ22635 (Accession NM_025092). Accordingly, utilities of VGAM2667 include diagnosis, prevention and treatment of diseases and clinical conditions associated with FLJ22635. KIAA0391 (Accession NM_014672) is another VGAM2667 host target gene. KIAA0391 BINDING SITE is HOST TARGET binding site found in the 3' untranslated region of mRNA encoded by KIAA0391, corresponding to a HOST TARGET binding site such as BINDING SITE I, BINDING SITE II or BINDING SITE III. Table 2 illustrates the complementarity of the nucleotide sequences of KIAA0391 BINDING SITE, designated SEQ ID:16135, to the nucleotide sequence of VGAM2667 RNA, herein designated VGAM RNA, also designated SEQ ID:5378.

Another function of VGAM2667 is therefore inhibition of KIAA0391 (Accession NM_014672). Accordingly, utilities of VGAM2667 include diagnosis, prevention and treatment of diseases and clinical conditions associated with KIAA0391. KIAA1340 (Accession XM_044836) is another VGAM2667 host target gene. KIAA1340 BINDING SITE is HOST TARGET binding site found in the 3' untranslated region of mRNA encoded by KIAA1340, corresponding to a HOST TARGET binding site such as BINDING SITE I, BINDING SITE II or BINDING SITE III. Table 2 illustrates the complementarity of the nucleotide sequences of KIAA1340 BINDING SITE, designated SEQ ID:34297, to the nucleotide sequence of VGAM2667 RNA, herein designated VGAM RNA, also designated SEQ ID:5378.

Another function of VGAM2667 is therefore inhibition of KIAA1340 (Accession XM_044836). Accordingly, utilities of VGAM2667 include diagnosis, prevention and treatment of diseases and clinical conditions associated with KIAA1340. KIAA1576 (Accession XM_038186) is another VGAM2667 host target gene. KIAA1576 BINDING SITE is HOST TARGET binding site found in the 3' untranslated region of mRNA encoded by KIAA1576, corresponding to a HOST TARGET binding site such as BINDING SITE I, BINDING SITE II or BINDING SITE III. Table 2 illustrates the complementarity of the nucleotide sequences of KIAA1576 BINDING SITE, designated SEQ ID:32777, to the nucleotide sequence of VGAM2667 RNA, herein designated VGAM RNA, also designated SEQ ID:5378.

Another function of VGAM2667 is therefore inhibition of KIAA1576 (Accession XM_038186). Accordingly, utilities of VGAM2667 include diagnosis, prevention and treatment of diseases and clinical conditions associated with KIAA1576. MGC13033 (Accession NM_031447) is another VGAM2667 host target gene. MGC13033 BINDING SITE is HOST TARGET binding site found in the 5' untranslated region of mRNA encoded by MGC13033, corresponding to a HOST TARGET binding site such as BINDING SITE I, BINDING SITE II or BINDING SITE III. Table 2 illustrates the complementarity of the nucleotide sequences of MGC13033 BINDING SITE, designated SEQ ID:25461, to the nucleotide sequence of VGAM2667 RNA, herein designated VGAM RNA, also designated SEQ ID:5378.

Another function of VGAM2667 is therefore inhibition of MGC13033 (Accession NM_031447). Accordingly, utilities of VGAM2667 include diagnosis, prevention and treatment of diseases and clinical conditions associated with MGC13033. Protein Kinase C and Casein Kinase Substrate In Neurons 2 (PACSIN2, Accession NM_007229) is another VGAM2667 host target gene. PACSIN2 BINDING SITE is HOST TARGET binding site found in the 3' untranslated region of mRNA encoded by PACSIN2, corresponding to a HOST TARGET binding site such as BINDING SITE I, BINDING SITE II or BINDING SITE III. Table 2 illustrates the complementarity of the nucleotide sequences of PACSIN2 BINDING SITE, designated SEQ ID:14099, to the nucleotide sequence of VGAM2667 RNA, herein designated VGAM RNA, also designated SEQ ID:5378.

Another function of VGAM2667 is therefore inhibition of Protein Kinase C and Casein Kinase Substrate In Neurons 2 (PACSIN2, Accession NM_007229). Accordingly, utilities of VGAM2667 include diagnosis, prevention and treatment of diseases and clinical conditions associated with PACSIN2. PRO2015 (Accession NM_018512) is another VGAM2667 host target gene. PRO2015 BINDING SITE is HOST TARGET binding site found in the 5' untranslated region of mRNA encoded by PRO2015, corresponding to a HOST TARGET binding site such as BINDING SITE I, BINDING SITE II or BINDING SITE III. Table 2 illustrates the complementarity of the nucleotide sequences of PRO2015 BINDING SITE, designated SEQ ID:20583, to the nucleotide sequence of VGAM2667 RNA, herein designated VGAM RNA, also designated SEQ ID:5378.

Another function of VGAM2667 is therefore inhibition of PRO2015 (Accession NM_018512). Accordingly, utilities of VGAM2667 include diagnosis, prevention and treatment of diseases and clinical conditions associated with PRO2015. Rpo1-2 (Accession NM_019014) is another VGAM2667 host target gene. Rpo1-2 BINDING SITE is HOST TARGET binding site found in the 3' untranslated region of mRNA encoded by Rpo1-2, corresponding to a HOST TARGET binding site such as BINDING SITE I, BINDING SITE II or BINDING SITE III. Table 2 illustrates the complementarity of the nucleotide sequences of Rpo1-2 BINDING SITE, designated SEQ ID:21107, to the nucleotide sequence of VGAM2667 RNA, herein designated VGAM RNA, also designated SEQ ID:5378.

Another function of VGAM2667 is therefore inhibition of Rpo1-2 (Accession NM_019014). Accordingly, utilities of VGAM2667 include diagnosis, prevention and treatment of diseases and clinical conditions associated with Rpo1-2. STI2 (Accession XM_114335) is another VGAM2667 host target gene. STI2 BINDING SITE is HOST TARGET binding site found in the 3' untranslated region of mRNA encoded by STI2, corresponding to a HOST TARGET binding site such as BINDING SITE I, BINDING SITE II or BINDING SITE III. Table 2 illustrates the complementarity of the nucleotide sequences of STI2 BINDING SITE, designated SEQ ID:42878, to the nucleotide sequence of VGAM2667 RNA, herein designated VGAM RNA, also designated SEQ ID:5378.

Another function of VGAM2667 is therefore inhibition of STI2 (Accession XM_114335). Accordingly, utilities of VGAM2667 include diagnosis, prevention and treatment of diseases and clinical conditions associated with STI2. LOC140214 (Accession XM_071283) is another VGAM2667 host target gene. LOC140214 BINDING SITE is HOST TARGET binding site found in the 5' untranslated region of mRNA encoded by LOC140214, corresponding to a HOST TARGET binding site such as BINDING SITE I, BINDING SITE II or BINDING SITE III. Table 2 illustrates the complementarity of the nucleotide sequences of LOC140214 BINDING SITE, designated SEQ ID:37399, to the nucleotide sequence of VGAM2667 RNA, herein designated VGAM RNA, also designated SEQ ID:5378.

Another function of VGAM2667 is therefore inhibition of LOC140214 (Accession XM_071283). Accordingly, utilities of VGAM2667 include diagnosis, prevention and treatment of diseases and clinical conditions associated with LOC140214. LOC142927 (Accession XM_084380) is another VGAM2667 host target gene. LOC142927 BINDING SITE is HOST TARGET binding site found in the 3' untranslated region of mRNA encoded by LOC142927, corresponding to a HOST TARGET binding site such as BINDING SITE I, BINDING SITE II or BINDING SITE III. Table 2 illustrates the complementarity of the nucleotide sequences of LOC142927 BINDING SITE, designated SEQ ID:37566, to the nucleotide sequence of VGAM2667 RNA, herein designated VGAM RNA, also designated SEQ ID:5378.

Another function of VGAM2667 is therefore inhibition of LOC142927 (Accession XM_084380). Accordingly, utilities of VGAM2667 include diagnosis, prevention and treatment of diseases and clinical conditions associated with LOC142927. LOC150311 (Accession XM_086858) is another VGAM2667 host target gene. LOC150311 BINDING SITE is HOST TARGET binding site found in the 5' untranslated region of mRNA encoded by LOC150311, corresponding to a HOST TARGET binding site such as BINDING SITE I, BINDING SITE II or BINDING SITE III. Table 2 illustrates the complementarity of the nucleotide sequences of LOC150311 BINDING SITE, designated SEQ ID:38928, to the nucleotide sequence of VGAM2667 RNA, herein designated VGAM RNA, also designated SEQ ID:5378.

Another function of VGAM2667 is therefore inhibition of LOC150311 (Accession XM_086858). Accordingly, utilities of VGAM2667 include diagnosis, prevention and treatment of diseases and clinical conditions associated with LOC150311. LOC158267 (Accession XM_088528) is another VGAM2667 host target gene. LOC158267 BINDING SITE is HOST TARGET binding site found in the 3' untranslated region of mRNA encoded by LOC158267, corresponding to a HOST TARGET binding site such as BINDING SITE I, BINDING SITE II or BINDING SITE III. Table 2 illustrates the complementarity of the nucleotide sequences of LOC158267 BINDING SITE, designated SEQ ID:39791, to the nucleotide sequence of VGAM2667 RNA, herein designated VGAM RNA, also designated SEQ ID:5378.

Another function of VGAM2667 is therefore inhibition of LOC158267 (Accession XM_088528). Accordingly, utilities of VGAM2667 include diagnosis, prevention and treatment of diseases and clinical conditions associated with LOC158267. LOC219445 (Accession XM_166212) is another VGAM2667 host target gene. LOC219445 BINDING SITE is HOST TARGET binding site found in the 5' untranslated region of mRNA encoded by LOC219445, corresponding to a HOST TARGET binding site such as BINDING SITE I, BINDING SITE II or BINDING SITE III. Table 2 illustrates the complementarity of the nucleotide sequences of LOC219445 BINDING SITE, designated SEQ ID:44010, to the nucleotide sequence of VGAM2667 RNA, herein designated VGAM RNA, also designated SEQ ID:5378.

Another function of VGAM2667 is therefore inhibition of LOC219445 (Accession XM_166212). Accordingly, utilities of VGAM2667 include diagnosis, prevention and treatment of diseases and clinical conditions associated with LOC219445. LOC220514 (Accession XM_017498) is another VGAM2667 host target gene. LOC220514 BINDING SITE is HOST TARGET binding site found in the 3' untranslated region of mRNA encoded by LOC220514, corresponding to a HOST TARGET binding site such as BINDING SITE I, BINDING SITE II or BINDING SITE III. Table 2 illustrates the complementarity of the nucleotide sequences of LOC220514 BINDING SITE, designated SEQ ID:30323, to the nucleotide sequence of VGAM2667 RNA, herein designated VGAM RNA, also designated SEQ ID:5378.

Another function of VGAM2667 is therefore inhibition of LOC220514 (Accession XM_017498). Accordingly, utilities of VGAM2667 include diagnosis, prevention and treatment of diseases and clinical conditions associated with LOC220514. LOC90841 (Accession XM_034427) is another VGAM2667 host target gene. LOC90841 BINDING SITE is HOST TARGET binding site found in the 3' untranslated region of mRNA encoded by LOC90841, corresponding to a HOST TARGET binding site such as BINDING SITE I, BINDING SITE II or BINDING SITE III. Table 2 illustrates the complementarity of the nucleotide sequences of LOC90841 BINDING SITE, designated SEQ ID:32110, to the nucleotide sequence of VGAM2667 RNA, herein designated VGAM RNA, also designated SEQ ID:5378.

Another function of VGAM2667 is therefore inhibition of LOC90841 (Accession XM_034427). Accordingly, utilities of VGAM2667 include diagnosis, prevention and treatment of diseases and clinical conditions associated with LOC90841. LOC93259 (Accession XM_050105) is another VGAM2667 host target gene. LOC93259 BINDING SITE is HOST TARGET binding site found in the 5' untranslated region of mRNA encoded by LOC93259, corresponding to a HOST TARGET binding site such as BINDING SITE I, BINDING SITE II or BINDING SITE III. Table 2 illustrates the complementarity of the nucleotide sequences of LOC93259 BINDING SITE, designated SEQ ID:35555, to the nucleotide sequence of VGAM2667 RNA, herein designated VGAM RNA, also designated SEQ ID:5378.

Another function of VGAM2667 is therefore inhibition of LOC93259 (Accession XM_050105). Accordingly, utilities of VGAM2667 include diagnosis, prevention and treatment of diseases and clinical conditions associated with LOC93259. FIG. 1 further provides a conceptual description of a novel bioinformatically detected viral gene of the present invention, referred to here as Viral Genomic Address Messenger 2668 (VGAM2668) viral gene, which modulates expression of respective host target genes thereof, the function and utility of which host target genes is known in the art.

VGAM2668 is a novel bioinformatically detected regulatory, non protein coding, viral micro RNA (miRNA) gene. The method by which VGAM2668 was detected is described hereinabove with reference to FIGS. 1-8.

VGAM2668 gene, herein designated VGAM GENE, is a viral gene contained in the genome of Bean Common Mosaic Necrosis Virus. VGAM2668 host target gene, herein designated VGAM HOST TARGET GENE, is a human gene contained in the human genome.

VGAM2668 gene encodes a VGAM2668 precursor RNA, herein designated VGAM PRECURSOR RNA. Similar to other miRNA genes, and unlike most ordinary genes, VGAM2668 precursor RNA does not encode a protein. A nucleotide sequence identical or highly similar to the nucleotide sequence of VGAM2668 precursor RNA is designated SEQ ID:2654, and is provided hereinbelow with reference to the sequence listing part. Nucleotide sequence SEQ ID:2654 is located at position 5617 relative to the genome of Bean Common Mosaic Necrosis Virus.

VGAM2668 precursor RNA folds onto itself, forming VGAM2668 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2668 folded precursor RNA into VGAM2668 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM2668 RNA is designated SEQ ID:5379, and is provided hereinbelow with reference to the sequence listing part.

VGAM2668 host target gene, herein designated VGAM HOST TARGET GENE, encodes a corresponding messenger RNA, VGAM2668 host target RNA, herein designated VGAM HOST TARGET RNA. VGAM2668 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2668 RNA, herein designated VGAM RNA, binds complementarily to one or more host target binding sites located in untranslated regions of VGAM2668 host target RNA, herein designated VGAM HOST TARGET RNA. This complementary binding is due to the fact that the nucleotide sequence of VGAM2668 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2668 RNA, herein designated VGAM RNA, may have a different number of host target binding sites in untranslated regions of a VGAM2668 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2668 RNA, herein designated VGAM RNA, to host target binding sites on VGAM2668 host target RNA, herein designated VGAM HOST TARGET RNA, such as BINDING SITE I, BINDING SITE II and BINDING SITE III, inhibits translation of VGAM2668 host target RNA into VGAM2668 host target protein, herein designated VGAM HOST TARGET PROTEIN. VGAM host target protein is therefore outlined by a broken line.

It is appreciated that VGAM2668 host target gene, herein designated VGAM HOST TARGET GENE, in fact represents a plurality of VGAM2668 host target genes. The mRNA of each one of this plurality of VGAM2668 host target genes comprises one or more host target binding sites, each having a nucleotide sequence which is at least partly complementary to VGAM2668 RNA, herein designated VGAM RNA, and which when bound by VGAM2668 RNA causes inhibition of translation of respective one or more VGAM2668 host target proteins.

It is further appreciated by one skilled in the art that the mode of translational inhibition illustrated by FIG. 1 with specific reference to translational inhibition exerted by VGAM2668 gene, herein designated VGAM GENE, on one or more VGAM2668 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2668 is inhibition of expression of host target genes, as part of a novel viral mechanism of attacking a host. Accordingly, utilities of VGAM2668 include diagnosis, prevention and treatment of viral infection by Bean Common Mosaic Necrosis Virus. Specific functions, and accordingly utilities, of VGAM2668 correlate with, and may be deduced from, the identity of the host target genes which VGAM2668 binds and inhibits, and the function of these host target genes, as elaborated hereinbelow.

Nucleotide sequences of the VGAM2668 precursor RNA, herein designated VGAM PRECURSOR RNA, and of the 'diced' VGAM2668 RNA, herein designated VGAM RNA, and a schematic representation of the secondary folding of VGAM2668 folded precursor RNA, herein designated VGAM FOLDED PRECURSOR RNA, of VGAM2668 are further described hereinbelow with reference to Table 1.

Nucleotide sequences of host target binding sites, such as BINDING SITE-I, BINDING SITE-II and BINDING SITE-III of FIG. 1, found on VGAM2668 host target RNA, and schematic representation of the complementarity of each of these host target binding sites to VGAM2668 RNA, herein designated VGAM RNA, are described hereinbelow with reference to Table 2.

As mentioned hereinabove with reference to FIG. 1, a function of VGAM2668 gene, herein designated VGAM is inhibition of expression of VGAM2668 target genes. It is appreciated that specific functions, and accordingly utilities, of VGAM2668 correlate with, and may be deduced from, the identity of the target genes which VGAM2668 binds and inhibits, and the function of these target genes, as elaborated hereinbelow.

ZF (Accession NM_021212) is a VGAM2668 host target gene. ZF BINDING SITE is HOST TARGET binding site found in the 3' untranslated region of mRNA encoded by ZF, corresponding to a HOST TARGET binding site such as BINDING SITE I, BINDING SITE II or BINDING SITE III. Table 2 illustrates the complementarity of the nucleotide sequences of ZF BINDING SITE, designated SEQ ID:22192, to the nucleotide sequence of VGAM2668 RNA, herein designated VGAM RNA, also designated SEQ ID:5379.

A function of VGAM2668 is therefore inhibition of ZF (Accession NM_021212). Accordingly, utilities of VGAM2668 include diagnosis, prevention and treatment of diseases and clinical conditions associated with ZF. LOC114984 (Accession XM_054962) is another VGAM2668 host target gene. LOC114984 BINDING SITE is HOST TARGET binding site found in the 5' untranslated region of mRNA encoded by LOC114984, corresponding to a HOST TARGET binding site such as BINDING SITE I, BINDING SITE II or BINDING SITE III. Table 2 illustrates the complementarity of the nucleotide sequences of LOC114984 BINDING SITE, designated SEQ ID:36219, to the nucleotide sequence of VGAM2668 RNA, herein designated VGAM RNA, also designated SEQ ID:5379.

Another function of VGAM2668 is therefore inhibition of LOC114984 (Accession XM_054962). Accordingly, utilities of VGAM2668 include diagnosis, prevention and treatment of diseases and clinical conditions associated with LOC114984. FIG. 1 further provides a conceptual description of a novel bioinformatically detected viral gene of the present invention, referred to here as Viral Genomic Address Messenger 2669 (VGAM2669) viral gene, which modulates expression of respective host target genes thereof, the function and utility of which host target genes is known in the art.

VGAM2669 is a novel bioinformatically detected regulatory, non protein coding, viral micro RNA (miRNA) gene. The method by which VGAM2669 was detected is described hereinabove with reference to FIGS. 1-8.

VGAM2669 gene, herein designated VGAM GENE, is a viral gene contained in the genome of Bean Common Mosaic Necrosis Virus. VGAM2669 host target gene, herein designated VGAM HOST TARGET GENE, is a human gene contained in the human genome.

VGAM2669 gene encodes a VGAM2669 precursor RNA, herein designated VGAM PRECURSOR RNA. Similar to other miRNA genes, and unlike most ordinary genes, VGAM2669 precursor RNA does not encode a protein. A nucleotide sequence identical or highly similar to the nucleotide sequence of VGAM2669 precursor RNA is designated SEQ ID:2655, and is provided hereinbelow with reference to the sequence listing part. Nucleotide sequence SEQ ID:2655 is located at position 1919 relative to the genome of Bean Common Mosaic Necrosis Virus.

VGAM2669 precursor RNA folds onto itself, forming VGAM2669 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2669 folded precursor RNA into VGAM2669 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2669 RNA is designated SEQ ID:5380, and is provided hereinbelow with reference to the sequence listing part.

VGAM2669 host target gene, herein designated VGAM HOST TARGET GENE, encodes a corresponding messenger RNA, VGAM2669 host target RNA, herein designated VGAM HOST TARGET RNA. VGAM2669 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2669 RNA, herein designated VGAM RNA, binds complementarily to one or more host target binding sites located in untranslated regions of VGAM2669 host target RNA, herein designated VGAM HOST TARGET RNA. This complementary binding is due to the fact that the nucleotide sequence of VGAM2669 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2669 RNA, herein designated VGAM RNA, may have a different number of host target binding sites in untranslated regions of a VGAM2669 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2669 RNA, herein designated VGAM RNA, to host target binding sites on VGAM2669 host target RNA, herein designated VGAM HOST TARGET RNA, such as BINDING SITE I, BINDING SITE II and BINDING SITE III, inhibits translation of VGAM2669 host target RNA into VGAM2669 host target protein, herein designated VGAM HOST TARGET PROTEIN. VGAM host target protein is therefore outlined by a broken line.

It is appreciated that VGAM2669 host target gene, herein designated VGAM HOST TARGET GENE, in fact represents a plurality of VGAM2669 host target genes. The mRNA of each one of this plurality of VGAM2669 host target genes comprises one or more host target binding sites, each having a nucleotide sequence which is at least partly complementary to VGAM2669 RNA, herein designated VGAM RNA, and which when bound by VGAM2669 RNA causes inhibition of translation of respective one or more VGAM2669 host target proteins.

It is further appreciated by one skilled in the art that the mode of translational inhibition illustrated by FIG. 1 with specific reference to translational inhibition exerted by VGAM2669 gene, herein designated VGAM GENE, on one or more VGAM2669 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2669 is inhibition of expression of host target genes, as part of a novel viral mechanism of attacking a host. Accordingly, utilities of VGAM2669 include diagnosis, prevention and treatment of viral infection by Bean Common Mosaic Necrosis Virus. Specific functions, and accordingly utilities, of VGAM2669 correlate with, and may be deduced from, the identity of the host target genes which VGAM2669 binds and inhibits, and the function of these host target genes, as elaborated hereinbelow.

Nucleotide sequences of the VGAM2669 precursor RNA, herein designated VGAM PRECURSOR RNA, and of the 'diced' VGAM2669 RNA, herein designated VGAM RNA, and a schematic representation of the secondary folding of VGAM2669 folded precursor RNA, herein designated VGAM FOLDED PRECURSOR RNA, of VGAM2669 are further described hereinbelow with reference to Table 1.

Nucleotide sequences of host target binding sites, such as BINDING SITE-I, BINDING SITE-II and BINDING SITE- III of FIG. 1, found on VGAM2669 host target RNA, and schematic representation of the complementarity of each of these host target binding sites to VGAM2669 RNA, herein designated VGAM RNA, are described hereinbelow with reference to Table 2.

As mentioned hereinabove with reference to FIG. 1, a function of VGAM2669 gene, herein designated VGAM is inhibition of expression of VGAM2669 target genes. It is appreciated that specific functions, and accordingly utilities, of VGAM2669 correlate with, and may be deduced from, the identity of the target genes which VGAM2669 binds and inhibits, and the function of these target genes, as elaborated hereinbelow.

BRCA1 Associated Protein-1 (ubiquitin carboxy-terminal hydrolase) (BAP1, Accession NM_004656) is a VGAM2669 host target gene. BAP1 BINDING SITE is HOST TARGET binding site found in the 3' untranslated region of mRNA encoded by BAP1, corresponding to a HOST TARGET binding site such as BINDING SITE I, BINDING SITE II or BINDING SITE III. Table 2 illustrates the complementarity of the nucleotide sequences of BAP1 BINDING SITE, designated SEQ ID:11022, to the nucleotide sequence of VGAM2669 RNA, herein designated VGAM RNA, also designated SEQ ID:5380.

A function of VGAM2669 is therefore inhibition of BRCA1 Associated Protein-1 (ubiquitin carboxy-terminal hydrolase) (BAP1, Accession NM_004656). Accordingly, utilities of VGAM2669 include diagnosis, prevention and treatment of diseases and clinical conditions associated with BAP1. D12S2489E (Accession NM_007360) is another VGAM2669 host target gene. D12S2489E BINDING SITE is HOST TARGET binding site found in the 5' untranslated region of mRNA encoded by D12S2489E, corresponding to a HOST TARGET binding site such as BINDING SITE I, BINDING SITE II or BINDING SITE III. Table 2 illustrates the complementarity of the nucleotide sequences of D12S2489E BINDING SITE, designated SEQ ID:14290, to the nucleotide sequence of VGAM2669 RNA, herein designated VGAM RNA, also designated SEQ ID:5380.

Another function of VGAM2669 is therefore inhibition of D12S2489E (Accession NM_007360), a gene which interacts in the inhibition and activation of NK cells. Accordingly, utilities of VGAM2669 include diagnosis, prevention and treatment of diseases and clinical conditions associated with D12S2489E. The function of D12S2489E and its association with various diseases and clinical conditions, has been established by previous studies, as described hereinabove with reference to VGAM156. Dystrobrevin, Alpha (DTNA, Accession NM_032978) is another VGAM2669 host target gene. DTNA BINDING SITE1 through DTNA BINDING SITE4 are HOST TARGET binding sites found in untranslated regions of mRNA encoded by DTNA, corresponding to HOST TARGET binding sites such as BINDING SITE I, BINDING SITE II or BINDING SITE III. Table 2 illustrates the complementarity of the nucleotide sequences of DTNA BINDING SITE1 through DTNA BINDING SITE4, designated SEQ ID:26837, SEQ ID:26842, SEQ ID:26847 and SEQ ID:7079 respectively, to the nucleotide sequence of VGAM2669 RNA, herein designated VGAM RNA, also designated SEQ ID:5380.

Another function of VGAM2669 is therefore inhibition of Dystrobrevin, Alpha (DTNA, Accession NM_032978), a gene which may be involved in the formation and stability of synapses. Accordingly, utilities of VGAM2669 include diagnosis, prevention and treatment of diseases and clinical conditions associated with DTNA. The function of DTNA and its association with various diseases and clinical conditions, has been established by previous studies, as described hereinabove with reference to VGAM1021. Forkhead Box F1 (FOXF1, Accession NM_001451) is another VGAM2669 host target gene. FOXF1 BINDING SITE is HOST TARGET binding site found in the 3' untranslated region of mRNA encoded by FOXF1, corresponding to a HOST TARGET binding site such as BINDING SITE I, BINDING SITE II or BINDING SITE III. Table 2 illustrates the complementarity of the nucleotide sequences of FOXF1 BINDING SITE, designated SEQ ID:7185, to the nucleotide sequence of VGAM2669 RNA, herein designated VGAM RNA, also designated SEQ ID:5380.

Another function of VGAM2669 is therefore inhibition of Forkhead Box F1 (FOXF1, Accession NM_001451), a gene which is a probable transcription activator for a number of lung- specific genes. Accordingly, utilities of VGAM2669 include diagnosis, prevention and treatment of diseases and clinical conditions associated with FOXF1. The function of FOXF1 and its association with various diseases and clinical conditions, has been established by previous studies, as described hereinabove with reference to VGAM292. Hermansky-Pudlak Syndrome 1 (HPS1, Accession NM_000195) is another VGAM2669 host target gene. HPS1 BINDING SITE is HOST TARGET binding site found in the 3' untranslated region of mRNA encoded by HPS1, corresponding to a HOST TARGET binding site such as BINDING SITE I, BINDING SITE II or BINDING SITE III. Table 2 illustrates the complementarity of the nucleotide sequences of HPS1 BINDING SITE, designated SEQ ID:5692, to the nucleotide sequence of VGAM2669 RNA, herein designated VGAM RNA, also designated SEQ ID:5380.

Another function of VGAM2669 is therefore inhibition of Hermansky-Pudlak Syndrome 1 (HPS1, Accession NM_000195). Accordingly, utilities of VGAM2669 include diagnosis, prevention and treatment of diseases and clinical conditions associated with HPS1. Protein Kinase, CGMP-dependent, Type II (PRKG2, Accession NM_006259) is another VGAM2669 host target gene. PRKG2 BINDING SITE is HOST TARGET binding site found in the 3' untranslated region of mRNA encoded by PRKG2, corresponding to a HOST TARGET binding site such as BINDING SITE I, BINDING SITE II or BINDING SITE III. Table 2 illustrates the complementarity of the nucleotide sequences of PRKG2 BINDING SITE, designated SEQ ID:12939, to the nucleotide sequence of VGAM2669 RNA, herein designated VGAM RNA, also designated SEQ ID:5380.

Another function of VGAM2669 is therefore inhibition of Protein Kinase, CGMP-dependent, Type II (PRKG2, Accession NM_006259), a gene which regulate a great variety of functions, including smooth muscle relaxation, neuronal excitability, and epithelial electrolyte transport. Accordingly, utilities of VGAM2669 include diagnosis, prevention and treatment of diseases and clinical conditions associated with PRKG2. The function of PRKG2 and its association with various diseases and clinical conditions, has been established by previous studies, as described hereinabove with reference to VGAM16. Zinc Finger Protein 216 (ZNF216, Accession NM_006007) is another VGAM2669 host target gene. ZNF216 BINDING SITE is HOST TARGET binding site found in the 3' untranslated region of mRNA encoded by ZNF216, corresponding to a HOST TARGET binding site such as BINDING SITE I, BINDING SITE II or BINDING SITE III. Table 2 illustrates the complementarity of the nucleotide sequences of ZNF216 BINDING SITE, designated SEQ ID:12620, to the nucleotide sequence of VGAM2669 RNA, herein designated VGAM RNA, also designated SEQ ID:5380.

Another function of VGAM2669 is therefore inhibition of Zinc Finger Protein 216 (ZNF216, Accession NM_006007). Accordingly, utilities of VGAM2669 include diagnosis, prevention and treatment of diseases and clinical conditions associated with ZNF216. ATP-binding Cassette, Sub-family A (ABC1), Member 10 (ABCA10, Accession NM_080282) is another VGAM2669 host target gene. ABCA10 BINDING SITE is HOST TARGET binding site found in the 5' untranslated region of mRNA encoded by ABCA10, corresponding to a HOST TARGET binding site such as BINDING SITE I, BINDING SITE II or BINDING SITE III. Table 2 illustrates the complementarity of the nucleotide sequences of ABCA10 BINDING SITE, designated SEQ ID:27823, to the nucleotide sequence of VGAM2669 RNA, herein designated VGAM RNA, also designated SEQ ID:5380.

Another function of VGAM2669 is therefore inhibition of ATP-binding Cassette, Sub-family A (ABC1), Member 10 (ABCA10, Accession NM_080282). Accordingly, utilities of VGAM2669 include diagnosis, prevention and treatment of diseases and clinical conditions associated with ABCA10. FLJ12425 (Accession XM_098290) is another VGAM2669 host target gene. FLJ12425 BINDING SITE is HOST TARGET binding site found in the 3' untranslated region of mRNA encoded by FLJ12425, corresponding to a HOST TARGET binding site such as BINDING SITE I, BINDING SITE II or BINDING SITE III. Table 2 illustrates the complementarity of the nucleotide sequences of FLJ12425 BINDING SITE, designated SEQ ID:41561, to the nucleotide sequence of VGAM2669 RNA, herein designated VGAM RNA, also designated SEQ ID:5380.

Another function of VGAM2669 is therefore inhibition of FLJ12425 (Accession XM_098290). Accordingly, utilities of VGAM2669 include diagnosis, prevention and treatment of diseases and clinical conditions associated with FLJ12425. FLJ12484 (Accession NM_022767) is another VGAM2669 host target gene. FLJ12484 BINDING SITE1 and FLJ12484 BINDING SITE2 are HOST TARGET binding sites found in untranslated regions of mRNA encoded by FLJ12484, corresponding to HOST TARGET binding sites such as BINDING SITE I, BINDING SITE II or BINDING SITE III. Table 2 illustrates the complementarity of the nucleotide sequences of FLJ12484 BINDING SITE1 and FLJ12484 BINDING SITE2, designated SEQ ID:23015 and SEQ ID:34513 respectively, to the nucleotide sequence of VGAM2669 RNA, herein designated VGAM RNA, also designated SEQ ID:5380.

Another function of VGAM2669 is therefore inhibition of FLJ12484 (Accession NM_022767). Accordingly, utilities of VGAM2669 include diagnosis, prevention and treatment of diseases and clinical conditions associated with FLJ12484. FLJ22195 (Accession NM_022758) is another VGAM2669 host target gene. FLJ22195 BINDING SITE is HOST TARGET binding site found in the 3' untranslated region of mRNA encoded by FLJ22195, corresponding to a HOST TARGET binding site such as BINDING SITE I, BINDING SITE II or BINDING SITE III. Table 2 illustrates the complementarity of the nucleotide sequences of FLJ22195 BINDING SITE, designated SEQ ID:22996, to the nucleotide sequence of VGAM2669 RNA, herein designated VGAM RNA, also designated SEQ ID:5380.

Another function of VGAM2669 is therefore inhibition of FLJ22195 (Accession NM_022758). Accordingly, utilities of VGAM2669 include diagnosis, prevention and treatment of diseases and clinical conditions associated with FLJ22195. KIAA0472 (Accession XM_050147) is another VGAM2669 host target gene. KIAA0472 BINDING SITE is HOST TARGET binding site found in the 3' untranslated region of mRNA encoded by KIAA0472, corresponding to a HOST TARGET binding site such as BINDING SITE I, BINDING SITE II or BINDING SITE III. Table 2 illustrates the complementarity of the nucleotide sequences of KIAA0472 BINDING SITE, designated SEQ ID:35573, to the nucleotide sequence of VGAM2669 RNA, herein designated VGAM RNA, also designated SEQ ID:5380.

Another function of VGAM2669 is therefore inhibition of KIAA0472 (Accession XM_050147). Accordingly, utilities of VGAM2669 include diagnosis, prevention and treatment of diseases and clinical conditions associated with KIAA0472. KIAA0794 (Accession XM_087353) is another VGAM2669 host target gene. KIAA0794 BINDING SITE is HOST TARGET binding site found in the 3' untranslated region of mRNA encoded by KIAA0794, corresponding to a HOST TARGET binding site such as BINDING SITE I, BINDING SITE II or BINDING SITE III. Table 2 illustrates the complementarity of the nucleotide sequences of KIAA0794 BINDING SITE, designated SEQ ID:39176, to the nucleotide sequence of VGAM2669 RNA, herein designated VGAM RNA, also designated SEQ ID:5380.

Another function of VGAM2669 is therefore inhibition of KIAA0794 (Accession XM_087353). Accordingly, utilities of VGAM2669 include diagnosis, prevention and treatment of diseases and clinical conditions associated with KIAA0794. p21(CDKN1A)-activated Kinase 6 (PAK6, Accession NM_020168) is another VGAM2669 host target gene. PAK6 BINDING SITE is HOST TARGET binding site found in the 5' untranslated region of mRNA encoded by PAK6, corresponding to a HOST TARGET binding site such as BINDING SITE I, BINDING SITE II or BINDING SITE III. Table 2 illustrates the complementarity of the nucleotide sequences of PAK6 BINDING SITE, designated SEQ ID:21387, to the nucleotide sequence of VGAM2669 RNA, herein designated VGAM RNA, also designated SEQ ID:5380.

Another function of VGAM2669 is therefore inhibition of p21(CDKN1A)-activated Kinase 6 (PAK6, Accession NM_020168). Accordingly, utilities of VGAM2669 include diagnosis, prevention and treatment of diseases and clinical conditions associated with PAK6. Retinoic Acid Induced 17 (RAI17, Accession XM_166091) is another VGAM2669 host target gene. RAI17 BINDING SITE is HOST TARGET binding site found in the 3' untranslated region of mRNA encoded by RAI17, corresponding to a HOST TARGET binding site such as BINDING SITE I, BINDING SITE II or BINDING SITE III. Table 2 illustrates the complementarity of the nucleotide sequences of RAI17 BINDING SITE, designated SEQ ID:43856, to the nucleotide sequence of VGAM2669 RNA, herein designated VGAM RNA, also designated SEQ ID:5380.

Another function of VGAM2669 is therefore inhibition of Retinoic Acid Induced 17 (RAI17, Accession XM_166091). Accordingly, utilities of VGAM2669 include diagnosis, prevention and treatment of diseases and clinical conditions associated with RAI17. RHO6 (Accession NM_014470) is another VGAM2669 host target gene. RHO6 BINDING SITE is HOST TARGET binding site found in the 3' untranslated region of mRNA encoded by RHO6, corresponding to a HOST TARGET binding site such as BINDING SITE I, BINDING SITE II or BINDING SITE III. Table 2 illustrates the complementarity of the nucleotide sequences of RHO6 BINDING SITE, designated SEQ ID:15819, to the nucleotide sequence of VGAM2669 RNA, herein designated VGAM RNA, also designated SEQ ID:5380.

Another function of VGAM2669 is therefore inhibition of RHO6 (Accession NM_014470). Accordingly, utilities of VGAM2669 include diagnosis, prevention and treatment of diseases and clinical conditions associated with RHO6. LOC155006 (Accession XM_088117) is another VGAM2669 host target gene. LOC155006 BINDING SITE is HOST TARGET binding site found in the 3' untranslated region of mRNA encoded by LOC155006, corresponding to a HOST TARGET binding site such as BINDING SITE I, BINDING SITE II or BINDING SITE III. Table 2 illustrates the complementarity of the nucleotide sequences of LOC155006 BINDING SITE, designated SEQ ID:39522, to the nucleotide sequence of VGAM2669 RNA, herein designated VGAM RNA, also designated SEQ ID:5380.

Another function of VGAM2669 is therefore inhibition of LOC155006 (Accession XM_088117). Accordingly, utilities of VGAM2669 include diagnosis, prevention and treatment of diseases and clinical conditions associated with LOC155006. LOC199926 (Accession XM_117157) is another VGAM2669 host target gene. LOC199926 BINDING SITE is HOST TARGET binding site found in the 5' untranslated region of mRNA encoded by LOC199926, corresponding to a HOST TARGET binding site such as BINDING SITE I, BINDING SITE II or BINDING SITE III. Table 2 illustrates the complementarity of the nucleotide sequences of LOC199926 BINDING SITE, designated SEQ ID:43258, to the nucleotide sequence of VGAM2669 RNA, herein designated VGAM RNA, also designated SEQ ID:5380.

Another function of VGAM2669 is therefore inhibition of LOC199926 (Accession XM_117157). Accordingly, utilities of VGAM2669 include diagnosis, prevention and treatment of diseases and clinical conditions associated with LOC199926. LOC202316 (Accession XM_117380) is another VGAM2669 host target gene. LOC202316 BINDING SITE is HOST TARGET binding site found in the 5' untranslated region of mRNA encoded by LOC202316, corresponding to a HOST TARGET binding site such as BINDING SITE I, BINDING SITE II or BINDING SITE III. Table 2 illustrates the complementarity of the nucleotide sequences of LOC202316 BINDING SITE, designated SEQ ID:43422, to the nucleotide sequence of VGAM2669 RNA, herein designated VGAM RNA, also designated SEQ ID:5380.

Another function of VGAM2669 is therefore inhibition of LOC202316 (Accession XM_117380). Accordingly, utilities of VGAM2669 include diagnosis, prevention and treatment of diseases and clinical conditions associated with LOC202316. LOC219899 (Accession XM_166173) is another VGAM2669 host target gene. LOC219899 BINDING SITE is HOST TARGET binding site found in the 3' untranslated region of mRNA encoded by LOC219899, corresponding to a HOST TARGET binding site such as BINDING SITE I, BINDING SITE II or BINDING SITE III. Table 2 illustrates the complementarity of the nucleotide sequences of LOC219899 BINDING SITE, designated SEQ ID:43992, to the nucleotide sequence of VGAM2669 RNA, herein designated VGAM RNA, also designated SEQ ID:5380.

Another function of VGAM2669 is therefore inhibition of LOC219899 (Accession XM_166173). Accordingly, utilities of VGAM2669 include diagnosis, prevention and treatment of diseases and clinical conditions associated with LOC219899. FIG. 1 further provides a conceptual description of a novel bioinformatically detected viral gene of the present invention, referred to here as Viral Genomic Address Messenger 2670 (VGAM2670) viral gene, which modulates expression of respective host target genes thereof, the function and utility of which host target genes is known in the art.

VGAM2670 is a novel bioinformatically detected regulatory, non protein coding, viral micro RNA (miRNA) gene. The method by which VGAM2670 was detected is described hereinabove with reference to FIGS. 1-8.

VGAM2670 gene, herein designated VGAM GENE, is a viral gene contained in the genome of Bean Common Mosaic Necrosis Virus. VGAM2670 host target gene, herein designated VGAM HOST TARGET GENE, is a human gene contained in the human genome.

VGAM2670 gene encodes a VGAM2670 precursor RNA, herein designated VGAM PRECURSOR RNA. Similar to other miRNA genes, and unlike most ordinary genes, VGAM2670 precursor RNA does not encode a protein. A nucleotide sequence identical or highly similar to the nucleotide sequence of VGAM2670 precursor RNA is designated SEQ ID:2656, and is provided hereinbelow with reference to the sequence listing part. Nucleotide sequence SEQ ID:2656 is located at position 5302 relative to the genome of Bean Common Mosaic Necrosis Virus.

VGAM2670 precursor RNA folds onto itself, forming VGAM2670 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2670 folded precursor RNA into VGAM2670 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2670 RNA is designated SEQ ID:5381, and is provided hereinbelow with reference to the sequence listing part.

VGAM2670 host target gene, herein designated VGAM HOST TARGET GENE, encodes a corresponding messenger RNA, VGAM2670 host target RNA, herein designated VGAM HOST TARGET RNA. VGAM2670 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2670 RNA, herein designated VGAM RNA, binds complementarily to one or more host target binding sites located in untranslated regions of VGAM2670 host target RNA, herein designated VGAM HOST TARGET RNA. This complementary binding is due to the fact that the nucleotide sequence of VGAM2670 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2670 RNA, herein designated VGAM RNA, may have a different number of host target binding sites in untranslated regions of a VGAM2670 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2670 RNA, herein designated VGAM RNA, to host target binding sites on VGAM2670 host target RNA, herein designated VGAM HOST TARGET RNA, such as BINDING SITE I, BINDING SITE II and BINDING SITE III, inhibits translation of VGAM2670 host target RNA into VGAM2670 host target protein, herein designated VGAM HOST TARGET PROTEIN. VGAM host target protein is therefore outlined by a broken line.

It is appreciated that VGAM2670 host target gene, herein designated VGAM HOST TARGET GENE, in fact represents a plurality of VGAM2670 host target genes. The mRNA of each one of this plurality of VGAM2670 host target genes comprises one or more host target binding sites, each having a nucleotide sequence which is at least partly complementary to VGAM2670 RNA, herein designated VGAM RNA, and which when bound by VGAM2670 RNA causes inhibition of translation of respective one or more VGAM2670 host target proteins.

It is further appreciated by one skilled in the art that the mode of translational inhibition illustrated by FIG. 1 with specific reference to translational inhibition exerted by VGAM2670 gene, herein designated VGAM GENE, on one or more VGAM2670 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2670 is inhibition of expression of host target genes, as part of a novel viral mechanism of attacking a host. Accordingly, utilities of VGAM2670 include diagnosis, prevention and treatment of viral infection by Bean Common Mosaic Necrosis Virus. Specific functions, and accordingly utilities, of VGAM2670 correlate with, and may be deduced from, the identity of the host target genes which VGAM2670 binds and inhibits, and the function of these host target genes, as elaborated hereinbelow.

Nucleotide sequences of the VGAM2670 precursor RNA, herein designated VGAM PRECURSOR RNA, and of the 'diced' VGAM2670 RNA, herein designated VGAM RNA, and a schematic representation of the secondary folding of VGAM2670 folded precursor RNA, herein designated VGAM FOLDED PRECURSOR RNA, of VGAM2670 are further described hereinbelow with reference to Table 1.

Nucleotide sequences of host target binding sites, such as BINDING SITE-I, BINDING SITE-II and BINDING SITE-III of FIG. 1, found on VGAM2670 host target RNA, and schematic representation of the complementarity of each of these host target binding sites to VGAM2670 RNA, herein designated VGAM RNA, are described hereinbelow with reference to Table 2.

As mentioned hereinabove with reference to FIG. 1, a function of VGAM2670 gene, herein designated VGAM is inhibition of expression of VGAM2670 target genes. It is appreciated that specific functions, and accordingly utilities, of VGAM2670 correlate with, and may be deduced from, the identity of the target genes which VGAM2670 binds and inhibits, and the function of these target genes, as elaborated hereinbelow.

ATP Synthase, H+ Transporting, Mitochondrial F1 Complex, Beta Polypeptide (ATP5B, Accession XM_006710) is a VGAM2670 host target gene. ATP5B BINDING SITE is HOST TARGET binding site found in the 5' untranslated region of mRNA encoded by ATP5B, corresponding to a HOST TARGET binding site such as BINDING SITE I, BINDING SITE II or BINDING SITE III. Table 2 illustrates the complementarity of the nucleotide sequences of ATP5B BINDING SITE, designated SEQ ID:30005, to the nucleotide sequence of VGAM2670 RNA, herein designated VGAM RNA, also designated SEQ ID:5381.

A function of VGAM2670 is therefore inhibition of ATP Synthase, H+ Transporting, Mitochondrial F1 Complex, Beta Polypeptide (ATP5B, Accession XM_006710). Accordingly, utilities of VGAM2670 include diagnosis, prevention and treatment of diseases and clinical conditions associated with ATP5B. ISL1 Transcription Factor, LIM/homeodomain, (islet-1) (ISL1, Accession NM_002202) is another VGAM2670 host target gene. ISL1 BINDING SITE is HOST TARGET binding site found in the 3' untranslated region of mRNA encoded by ISL1, corresponding to a HOST TARGET binding site such as BINDING SITE I, BINDING SITE II or BINDING SITE III. Table 2 illustrates the complementarity of the nucleotide sequences of ISL1 BINDING SITE, designated SEQ ID:7959, to the nucleotide sequence of VGAM2670 RNA, herein designated VGAM RNA, also designated SEQ ID:5381.

Another function of VGAM2670 is therefore inhibition of ISL1 Transcription Factor, LIM/homeodomain, (islet-1) (ISL1, Accession NM_002202), a gene which binds to one of the cis-acting domain of the insulin gene enhancer. Accordingly, utilities of VGAM2670 include diagnosis, prevention and treatment of diseases and clinical conditions associated with ISL1. The function of ISL1 and its association with various diseases and clinical conditions, has been established by previous studies, as described hereinabove with reference to VGAM464. TRIM (Accession NM_016388) is another VGAM2670 host target gene. TRIM BINDING SITE is HOST TARGET binding site found in the 3' untranslated region of mRNA encoded by TRIM, corresponding to a HOST TARGET binding site such as BINDING SITE I, BINDING SITE II or BINDING SITE III. Table 2 illustrates the complementarity of the nucleotide sequences of TRIM BINDING SITE, designated SEQ ID:18529, to the nucleotide sequence of VGAM2670 RNA, herein designated VGAM RNA, also designated SEQ ID:5381.

Another function of VGAM2670 is therefore inhibition of TRIM (Accession NM_016388), a gene which plays a role in recruiting signaling proteins to the plasma membrane upon T-cell receptor (TCR) complex activation in T cells. Accordingly, utilities of VGAM2670 include diagnosis, prevention and treatment of diseases and clinical conditions associated with TRIM. The function of TRIM and its association with various diseases and clinical conditions, has been established by previous studies, as described hereinabove with reference to VGAM227. Rho Guanine Nucleotide Exchange Factor (GEF) 15 (ARHGEF15, Accession NM_014958) is another VGAM2670 host target gene. ARHGEF15 BINDING SITE is HOST TARGET binding site found in the 3' untranslated region of mRNA encoded by ARHGEF15, corresponding to a HOST TARGET binding site such as BINDING SITE I, BINDING SITE II or BINDING SITE III. Table 2 illustrates the complementarity of the nucleotide sequences of ARHGEF15 BINDING SITE, designated SEQ ID:17317, to the nucleotide sequence of VGAM2670 RNA, herein designated VGAM RNA, also designated SEQ ID:5381.

Another function of VGAM2670 is therefore inhibition of Rho Guanine Nucleotide Exchange Factor (GEF) 15 (ARHGEF15, Accession NM_014958). Accordingly, utilities of VGAM2670 include diagnosis, prevention and treatment of diseases and clinical conditions associated with ARHGEF15. KIAA0326 (Accession XM_034819) is another VGAM2670 host target gene. KIAA0326 BINDING SITE is HOST TARGET binding site found in the 3" untranslated region of mRNA encoded by KIAA0326, corresponding to a HOST TARGET binding site such as BINDING SITE I, BINDING SITE II or BINDING SITE III. Table 2 illustrates the complementarity of the nucleotide sequences of KIAA0326 BINDING SITE, designated SEQ ID:32158, to the nucleotide sequence of VGAM2670 RNA, herein designated VGAM RNA, also designated SEQ ID:5381.

Another function of VGAM2670 is therefore inhibition of KIAA0326 (Accession XM_034819). Accordingly, utilities of VGAM2670 include diagnosis, prevention and treatment of diseases and clinical conditions associated with KIAA0326. KIAA0416 (Accession NM_015564) is another VGAM2670 host target gene. KIAA0416 BINDING SITE is HOST TARGET binding site found in the 3' untranslated region of mRNA encoded by KIAA0416, corresponding to a HOST TARGET binding site such as BINDING SITE I, BINDING SITE II or BINDING SITE III. Table 2 illustrates the complementarity of the nucleotide sequences of KIAA0416 BINDING SITE, designated SEQ ID:17833, to the nucleotide sequence of VGAM2670 RNA, herein designated VGAM RNA, also designated SEQ ID:5381.

Another function of VGAM2670 is therefore inhibition of KIAA0416 (Accession NM_015564). Accordingly, utilities of VGAM2670 include diagnosis, prevention and treatment of diseases and clinical conditions associated with KIAA0416. FIG. 1 further provides a conceptual description of a novel bioinformatically detected viral gene of the present invention, referred to here as Viral Genomic Address Messenger 2671 (VGAM2671) viral gene, which modulates expression of respective host target genes thereof, the function and utility of which host target genes is known in the art.

VGAM2671 is a novel bioinformatically detected regulatory, non protein coding, viral micro RNA (miRNA) gene. The method by which VGAM2671 was detected is described hereinabove with reference to FIGS. 1-8.

VGAM2671 gene, herein designated VGAM GENE, is a viral gene contained in the genome of Ophiostoma Mitovirus 3a. VGAM2671 host target gene, herein designated VGAM HOST TARGET GENE, is a human gene contained in the human genome.

VGAM2671 gene encodes a VGAM2671 precursor RNA, herein designated VGAM PRECURSOR RNA. Similar to other miRNA genes, and unlike most ordinary genes, VGAM2671 precursor RNA does not encode a protein. A nucleotide sequence identical or highly similar to the nucleotide sequence of VGAM2671 precursor RNA is designated SEQ ID:2657, and is provided hereinbelow with reference to the sequence listing part. Nucleotide sequence SEQ ID:2657 is located at position 673 relative to the genome of Ophiostoma Mitovirus 3a.

VGAM2671 precursor RNA folds onto itself, forming VGAM2671 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2671 folded precursor RNA into VGAM2671 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM2671 RNA is designated SEQ ID:5382, and is provided hereinbelow with reference to the sequence listing part.

VGAM2671 host target gene, herein designated VGAM HOST TARGET GENE, encodes a corresponding messenger RNA, VGAM2671 host target RNA, herein designated VGAM HOST TARGET RNA. VGAM2671 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2671 RNA, herein designated VGAM RNA, binds complementarily to one or more host target binding sites located in untranslated regions of VGAM2671 host target RNA, herein designated VGAM HOST TARGET RNA. This complementary binding is due to the fact that the nucleotide sequence of VGAM2671 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2671 RNA, herein designated VGAM RNA, may have a different number of host target binding sites in untranslated regions of a VGAM2671 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2671 RNA, herein designated VGAM RNA, to host target binding sites on VGAM2671 host target RNA, herein designated VGAM HOST TARGET RNA, such as BINDING SITE I, BINDING SITE II and BINDING SITE III, inhibits translation of VGAM2671 host target RNA into VGAM2671 host target protein, herein designated VGAM HOST TARGET PROTEIN. VGAM host target protein is therefore outlined by a broken line.

It is appreciated that VGAM2671 host target gene, herein designated VGAM HOST TARGET GENE, in fact represents a plurality of VGAM2671 host target genes. The mRNA of each one of this plurality of VGAM2671 host target genes comprises one or more host target binding sites, each having a nucleotide sequence which is at least partly complementary to VGAM2671 RNA, herein designated VGAM RNA, and which when bound by VGAM2671 RNA causes inhibition of translation of respective one or more VGAM2671 host target proteins.

It is further appreciated by one skilled in the art that the mode of translational inhibition illustrated by FIG. 1 with specific reference to translational inhibition exerted by VGAM2671 gene, herein designated VGAM GENE, on one or more VGAM2671 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2671 is inhibition of expression of host target genes, as part of a novel viral mechanism of attacking a host. Accordingly, utilities of VGAM2671 include diagnosis, prevention and treatment of viral infection by Ophiostoma Mitovirus 3a. Specific functions, and accordingly utilities, of VGAM2671 correlate with, and may be deduced from, the identity of the host target genes which VGAM2671 binds and inhibits, and the function of these host target genes, as elaborated hereinbelow.

Nucleotide sequences of the VGAM2671 precursor RNA, herein designated VGAM PRECURSOR RNA, and of the 'diced' VGAM2671 RNA, herein designated VGAM RNA, and a schematic representation of the secondary folding of VGAM2671 folded precursor RNA, herein designated VGAM FOLDED PRECURSOR RNA, of VGAM2671 are further described hereinbelow with reference to Table 1.

Nucleotide sequences of host target binding sites, such as BINDING SITE-I, BINDING SITE-II and BINDING SITE-III of FIG. 1, found on VGAM2671 host target RNA, and schematic representation of the complementarity of each of these host target binding sites to VGAM2671 RNA, herein designated VGAM RNA, are described hereinbelow with reference to Table 2.

As mentioned hereinabove with reference to FIG. 1, a function of VGAM2671 gene, herein designated VGAM is inhibition of expression of VGAM2671 target genes. It is appreciated that specific functions, and accordingly utilities, of VGAM2671 correlate with, and may be deduced from, the identity of the target genes which VGAM2671 binds and inhibits, and the function of these target genes, as elaborated hereinbelow.

MGC15705 (Accession NM_032757) is a VGAM2671 host target gene. MGC15705 BINDING SITE is HOST TARGET binding site found in the 3' untranslated region of mRNA encoded by MGC15705, corresponding to a HOST TARGET binding site such as BINDING SITE I, BINDING SITE II or BINDING SITE III. Table 2 illustrates the complementarity of the nucleotide sequences of MGC15705 BINDING SITE, designated SEQ ID:26499, to the nucleotide sequence of VGAM2671 RNA, herein designated VGAM RNA, also designated SEQ ID:5382.

A function of VGAM2671 is therefore inhibition of MGC15705 (Accession NM_032757). Accordingly, utilities of VGAM2671 include diagnosis, prevention and treatment of diseases and clinical conditions associated with MGC15705. LOC153561 (Accession XM_087708) is another VGAM2671 host target gene. LOC153561 BINDING SITE is HOST TARGET binding site found in the 3' untranslated region of mRNA encoded by LOC153561, corresponding to a HOST TARGET binding site such as BINDING SITE I, BINDING SITE II or BINDING SITE III. Table 2 illustrates the complementarity of the nucleotide sequences of LOC153561 BINDING SITE, designated SEQ ID:39401, to the nucleotide sequence of VGAM2671 RNA, herein designated VGAM RNA, also designated SEQ ID:5382.

Another function of VGAM2671 is therefore inhibition of LOC153561 (Accession XM_087708). Accordingly, utilities of VGAM2671 include diagnosis, prevention and treatment of diseases and clinical conditions associated with LOC153561. LOC223073 (Accession XM_170293) is another VGAM2671 host target gene. LOC223073 BINDING SITE is HOST TARGET binding site found in the 5' untranslated region of mRNA encoded by LOC223073, corresponding to a HOST TARGET binding site such as BINDING SITE I, BINDING SITE II or BINDING SITE III. Table 2 illustrates the complementarity of the nucleotide sequences of LOC223073 BINDING SITE, designated SEQ ID:45315, to the nucleotide sequence of VGAM2671 RNA, herein designated VGAM RNA, also designated SEQ ID:5382.

Another function of VGAM2671 is therefore inhibition of LOC223073 (Accession XM_170293). Accordingly, utilities of VGAM2671 include diagnosis, prevention and treatment of diseases and clinical conditions associated with LOC223073. LOC255231 (Accession XM_170908) is another VGAM2671 host target gene. LOC255231 BINDING SITE is HOST TARGET binding site found in the 3' untranslated region of mRNA encoded by LOC255231, corresponding to a HOST TARGET binding site such as BINDING SITE I, BINDING SITE II or BINDING SITE III. Table 2 illustrates the complementarity of the nucleotide sequences of LOC255231 BINDING SITE, designated SEQ ID:45672, to the nucleotide sequence of VGAM2671 RNA, herein designated VGAM RNA, also designated SEQ ID:5382.

Another function of VGAM2671 is therefore inhibition of LOC255231 (Accession XM_170908). Accordingly, utilities of VGAM2671 include diagnosis, prevention and treatment of diseases and clinical conditions associated with LOC255231. FIG. 1 further provides a conceptual description of a novel bioinformatically detected viral gene of the present invention, referred to here as Viral Genomic Address Messenger 2672 (VGAM2672) viral gene, which modulates expression of respective host target genes thereof, the function and utility of which host target genes is known in the art.

VGAM2672 is a novel bioinformatically detected regulatory, non protein coding, viral micro RNA (miRNA) gene. The method by which VGAM2672 was detected is described hereinabove with reference to FIGS. 1-8.

VGAM2672 gene, herein designated VGAM GENE, is a viral gene contained in the genome of Ophiostoma Mitovirus 3a. VGAM2672 host target gene, herein designated VGAM HOST TARGET GENE, is a human gene contained in the human genome.

VGAM2672 gene encodes a VGAM2672 precursor RNA, herein designated VGAM PRECURSOR RNA. Similar to other miRNA genes, and unlike most ordinary genes, VGAM2672 precursor RNA does not encode a protein. A nucleotide sequence identical or highly similar to the nucleotide sequence of VGAM2672 precursor RNA is designated SEQ ID:2658, and is provided hereinbelow with reference to the sequence listing part. Nucleotide sequence SEQ ID:2658 is located at position 1136 relative to the genome of Ophiostoma Mitovirus 3a.

VGAM2672 precursor RNA folds onto itself, forming VGAM2672 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2672 folded precursor RNA into VGAM2672 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2672 RNA is designated SEQ ID:5383, and is provided hereinbelow with reference to the sequence listing part.

VGAM2672 host target gene, herein designated VGAM HOST TARGET GENE, encodes a corresponding messenger RNA, VGAM2672 host target RNA, herein designated VGAM HOST TARGET RNA. VGAM2672 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2672 RNA, herein designated VGAM RNA, binds complementarily to one or more host target binding sites located in untranslated regions of VGAM2672 host target RNA, herein designated VGAM HOST TARGET RNA. This complementary binding is due to the fact that the nucleotide sequence of VGAM2672 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2672 RNA, herein designated VGAM RNA, may have a different number of host target binding sites in untranslated regions of a VGAM2672 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2672 RNA, herein designated VGAM RNA, to host target binding sites on VGAM2672 host target RNA, herein designated VGAM HOST TARGET RNA, such as BINDING SITE I, BINDING SITE II and BINDING SITE III, inhibits translation of VGAM2672 host target RNA into VGAM2672 host target protein, herein designated VGAM HOST TARGET PROTEIN. VGAM host target protein is therefore outlined by a broken line.

It is appreciated that VGAM2672 host target gene, herein designated VGAM HOST TARGET GENE, in fact represents a plurality of VGAM2672 host target genes. The mRNA of each one of this plurality of VGAM2672 host target genes comprises one or more host target binding sites, each having a nucleotide sequence which is at least partly complementary to VGAM2672 RNA, herein designated VGAM RNA, and which when bound by VGAM2672 RNA causes inhibition of translation of respective one or more VGAM2672 host target proteins.

It is further appreciated by one skilled in the art that the mode of translational inhibition illustrated by FIG. 1 with specific reference to translational inhibition exerted by VGAM2672 gene, herein designated VGAM GENE, on one or more VGAM2672 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2672 is inhibition of expression of host target genes, as part of a novel viral mechanism of attacking a host. Accordingly, utilities of VGAM2672 include diagnosis, prevention and treatment of viral infection by Ophiostoma Mitovirus 3a. Specific functions, and accordingly utilities, of VGAM2672 correlate with, and may be deduced from, the identity of the host target genes which VGAM2672 binds and inhibits, and the function of these host target genes, as elaborated hereinbelow.

Nucleotide sequences of the VGAM2672 precursor RNA, herein designated VGAM PRECURSOR RNA, and of the 'diced' VGAM2672 RNA, herein designated VGAM RNA, and a schematic representation of the secondary folding of VGAM2672 folded precursor RNA, herein designated VGAM FOLDED PRECURSOR RNA, of VGAM2672 are further described hereinbelow with reference to Table 1.

Nucleotide sequences of host target binding sites, such as BINDING SITE-I, BINDING SITE-II and BINDING SITE-III of FIG. 1, found on VGAM2672 host target RNA, and schematic representation of the complementarity of each of these host target binding sites to VGAM2672 RNA, herein designated VGAM RNA, are described hereinbelow with reference to Table 2.

As mentioned hereinabove with reference to FIG. 1, a function of VGAM2672 gene, herein designated VGAM is inhibition of expression of VGAM2672 target genes. It is appreciated that specific functions, and accordingly utilities, of VGAM2672 correlate with, and may be deduced from, the identity of the target genes which VGAM2672 binds and inhibits, and the function of these target genes, as elaborated hereinbelow.

DXYS155E (Accession NM_005088) is a VGAM2672 host target gene. DXYS155E BINDING SITE is HOST TARGET binding site found in the 3' untranslated region of mRNA encoded by DXYS155E, corresponding to a HOST TARGET binding site such as BINDING SITE I, BINDING SITE II or BINDING SITE III. Table 2 illustrates the complementarity of the nucleotide sequences of DXYS155E BINDING SITE, designated SEQ ID:11542, to the nucleotide sequence of VGAM2672 RNA, herein designated VGAM RNA, also designated SEQ ID:5383.

A function of VGAM2672 is therefore inhibition of DXYS155E (Accession NM_005088), a gene which may be involved in b-cell activation. may also be involved in signal transduction and gene regulation. Accordingly, utilities of VGAM2672 include diagnosis, prevention and treatment of diseases and clinical conditions associated with DXYS155E. The function of DXYS155E and its association with various diseases and clinical conditions, has been established by previous studies, as described hereinabove with reference to VGAM766. Myeloid/lymphoid Or Mixed-lineage Leukemia (trithorax homolog, Drosophila); Translocated To, 2 (MLLT2, Accession NM_005935) is another VGAM2672 host target gene. MLLT2 BINDING SITE is HOST TARGET binding site found in the 3' untranslated region of mRNA encoded by MLLT2, corresponding to a HOST TARGET binding site such as BINDING SITE I, BINDING SITE II or BINDING SITE III. Table 2 illustrates the complementarity of the nucleotide sequences of MLLT2 BINDING SITE, designated SEQ ID:12572, to the nucleotide sequence of VGAM2672 RNA, herein designated VGAM RNA, also designated SEQ ID:5383.

Another function of VGAM2672 is therefore inhibition of Myeloid/lymphoid Or Mixed-lineage Leukemia (trithorax homolog, Drosophila); Translocated To, 2 (MLLT2, Accession NM_005935), a gene which is a Putative transcription factor. Accordingly, utilities of VGAM2672 include diagnosis, prevention and treatment of diseases and clinical conditions associated with MLLT2. The function of MLLT2 and its association with various diseases and clinical conditions, has been established by previous studies, as described hereinabove with reference to VGAM57. DKFZP761E2110 (Accession NM_030953) is another VGAM2672 host target gene. DKFZP761E2110 BINDING SITE is HOST TARGET binding site found in the 3' untranslated region of mRNA encoded by DKFZP761E2110, corresponding to a HOST TARGET binding site such as BINDING SITE I, BINDING SITE II or BINDING SITE III. Table 2 illustrates the complementarity of the nucleotide sequences of DKFZP761E2110 BINDING SITE, designated SEQ ID:25227, to the nucleotide sequence of VGAM2672 RNA, herein designated VGAM RNA, also designated SEQ ID:5383.

Another function of VGAM2672 is therefore inhibition of DKFZP761E2110 (Accession NM_030953). Accordingly, utilities of VGAM2672 include diagnosis, prevention and treatment of diseases and clinical conditions associated with DKFZP761E2110. Phosphoinositide-3-kinase, Regulatory Subunit 4, P150 (PIK3R4, Accession XM_030812) is another VGAM2672 host target gene. PIK3R4 BINDING SITE is HOST TARGET binding site found in the 5' untranslated region of mRNA encoded by PIK3R4, corresponding to a HOST TARGET binding site such as BINDING SITE I, BINDING SITE II or BINDING SITE III. Table 2 illustrates the complementarity of the nucleotide sequences of PIK3R4 BINDING SITE, designated SEQ ID:31149, to the nucleotide sequence of VGAM2672 RNA, herein designated VGAM RNA, also designated SEQ ID:5383.

Another function of VGAM2672 is therefore inhibition of Phosphoinositide-3-kinase, Regulatory Subunit 4, P150 (PIK3R4, Accession XM_030812). Accordingly, utilities of VGAM2672 include diagnosis, prevention and treatment of diseases and clinical conditions associated with PIK3R4. Transmembrane Protease, Serine 5 (spinesin) (TMPRSS5, Accession NM_030770) is another VGAM2672 host target gene. TMPRSS5 BINDING SITE is HOST TARGET binding site found in the 3' untranslated region of mRNA encoded by TMPRSS5, corresponding to a HOST TARGET binding site such as BINDING SITE I, BINDING SITE II or BINDING SITE III. Table 2 illustrates the complementarity of the nucleotide sequences of TMPRSS5 BINDING SITE, designated SEQ ID:25055, to the nucleotide sequence of VGAM2672 RNA, herein designated VGAM RNA, also designated SEQ ID:5383.

Another function of VGAM2672 is therefore inhibition of Transmembrane Protease, Serine 5 (spinesin) (TMPRSS5, Accession NM_030770). Accordingly, utilities of VGAM2672 include diagnosis, prevention and treatment of diseases and clinical conditions associated with TMPRSS5. LOC129011 (Accession XM_059326) is another VGAM2672 host target gene. LOC129011 BINDING SITE is HOST TARGET binding site found in the 3' untranslated region of mRNA encoded by LOC129011, corresponding to a HOST TARGET binding site such as BINDING SITE I, BINDING SITE II or BINDING SITE III. Table 2 illustrates the complementarity of the nucleotide sequences of LOC129011 BINDING SITE, designated SEQ ID:36966, to the nucleotide sequence of VGAM2672 RNA, herein designated VGAM RNA, also designated SEQ ID:5383.

Another function of VGAM2672 is therefore inhibition of LOC129011 (Accession XM_059326). Accordingly, utilities of VGAM2672 include diagnosis, prevention and treatment of diseases and clinical conditions associated with LOC129011. LOC132235 (Accession XM_072302) is another VGAM2672 host target gene. LOC132235 BINDING SITE is HOST TARGET binding site found in the 5' untranslated region of mRNA encoded by LOC132235, corresponding to a HOST TARGET binding site such as BINDING SITE I, BINDING SITE II or BINDING SITE III. Table 2 illustrates the complementarity of the nucleotide sequences of LOC132235 BINDING SITE, designated SEQ ID:37481, to the nucleotide sequence of VGAM2672 RNA, herein designated VGAM RNA, also designated SEQ ID:5383.

Another function of VGAM2672 is therefore inhibition of LOC132235 (Accession XM_072302). Accordingly, utilities of VGAM2672 include diagnosis, prevention and treatment of diseases and clinical conditions associated with LOC132235. LOC144363 (Accession XM_084843) is another VGAM2672 host target gene. LOC144363 BINDING SITE is HOST TARGET binding site found in the 3' untranslated region of mRNA encoded by LOC144363, corresponding to a HOST TARGET binding site such as BINDING SITE I, BINDING SITE II or BINDING SITE III. Table 2 illustrates the complementarity of the nucleotide sequences of LOC144363 BINDING SITE, designated SEQ ID:37731, to the nucleotide sequence of VGAM2672 RNA, herein designated VGAM RNA, also designated SEQ ID:5383.

Another function of VGAM2672 is therefore inhibition of LOC144363 (Accession XM_084843). Accordingly, utilities of VGAM2672 include diagnosis, prevention and treatment of diseases and clinical conditions associated with LOC144363. LOC144571 (Accession XM_096630) is another VGAM2672 host target gene. LOC144571 BINDING SITE is HOST TARGET binding site found in the 3' untranslated region of mRNA encoded by LOC144571, corresponding to a HOST TARGET binding site such as BINDING SITE I, BINDING SITE II or BINDING SITE III. Table 2 illustrates the complementarity of the nucleotide sequences of LOC144571 BINDING SITE, designated SEQ ID:40443, to the nucleotide sequence of VGAM2672 RNA, herein designated VGAM RNA, also designated SEQ ID:5383.

Another function of VGAM2672 is therefore inhibition of LOC144571 (Accession XM_096630). Accordingly, utilities of VGAM2672 include diagnosis, prevention and treatment of diseases and clinical conditions associated with LOC144571. FIG. 1 further provides a conceptual description of a novel bioinformatically detected viral gene of the present invention, referred to here as Viral Genomic Address Messenger 2673 (VGAM2673) viral gene, which modulates expression of respective host target genes thereof, the function and utility of which host target genes is known in the art.

VGAM2673 is a novel bioinformatically detected regulatory, non protein coding, viral micro RNA (miRNA) gene. The method by which VGAM2673 was detected is described hereinabove with reference to FIGS. 1-8.

VGAM2673 gene, herein designated VGAM GENE, is a viral gene contained in the genome of Ophiostoma Mitovirus 3a. VGAM2673 host target gene, herein designated VGAM HOST TARGET GENE, is a human gene contained in the human genome.

VGAM2673 gene encodes a VGAM2673 precursor RNA, herein designated VGAM PRECURSOR RNA. Similar to other miRNA genes, and unlike most ordinary genes, VGAM2673 precursor RNA does not encode a protein. A nucleotide sequence identical or highly similar to the nucleotide sequence of VGAM2673 precursor RNA is designated SEQ ID:2659, and is provided hereinbelow with reference to the sequence listing part. Nucleotide sequence SEQ ID:2659 is located at position 308 relative to the genome of Ophiostoma Mitovirus 3a.

VGAM2673 precursor RNA folds onto itself, forming VGAM2673 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2673 folded precursor RNA into VGAM2673 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2673 RNA is designated SEQ ID:5384, and is provided hereinbelow with reference to the sequence listing part.

VGAM2673 host target gene, herein designated VGAM HOST TARGET GENE, encodes a corresponding messenger RNA, VGAM2673 host target RNA, herein designated VGAM HOST TARGET RNA. VGAM2673 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2673 RNA, herein designated VGAM RNA, binds complementarily to one or more host target binding sites located in untranslated regions of VGAM2673 host target RNA, herein designated VGAM HOST TARGET RNA. This complementary binding is due to the fact that the nucleotide sequence of VGAM2673 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2673 RNA, herein designated VGAM RNA, may have a different number of host target binding sites in untranslated regions of a VGAM2673 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2673 RNA, herein designated VGAM RNA, to host target binding sites on VGAM2673 host target RNA, herein designated VGAM HOST TARGET RNA, such as BINDING SITE I, BINDING SITE II and BINDING SITE III, inhibits translation of VGAM2673 host target RNA into VGAM2673 host target protein, herein designated VGAM HOST TARGET PROTEIN. VGAM host target protein is therefore outlined by a broken line.

It is appreciated that VGAM2673 host target gene, herein designated VGAM HOST TARGET GENE, in fact represents a plurality of VGAM2673 host target genes. The mRNA of each one of this plurality of VGAM2673 host target genes comprises one or more host target binding sites, each having a nucleotide sequence which is at least partly complementary to VGAM2673 RNA, herein designated VGAM RNA, and which when bound by VGAM2673 RNA causes inhibition of translation of respective one or more VGAM2673 host target proteins.

It is further appreciated by one skilled in the art that the mode of translational inhibition illustrated by FIG. 1 with specific reference to translational inhibition exerted by VGAM2673 gene, herein designated VGAM GENE, on one or more VGAM2673 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2673 is inhibition of expression of host target genes, as part of a novel viral mechanism of attacking a host. Accordingly, utilities of VGAM2673 include diagnosis, prevention and treatment of viral infection by Ophiostoma Mitovirus 3a. Specific functions, and accordingly utilities, of VGAM2673 correlate with, and may be deduced from, the identity of the host target genes which VGAM2673 binds and inhibits, and the function of these host target genes, as elaborated hereinbelow.

Nucleotide sequences of the VGAM2673 precursor RNA, herein designated VGAM PRECURSOR RNA, and of the 'diced' VGAM2673 RNA, herein designated VGAM RNA, and a schematic representation of the secondary folding of VGAM2673 folded precursor RNA, herein designated VGAM FOLDED PRECURSOR RNA, of VGAM2673 are further described hereinbelow with reference to Table 1.

Nucleotide sequences of host target binding sites, such as BINDING SITE-I, BINDING SITE-II and BINDING SITE-III of FIG. 1, found on VGAM2673 host target RNA, and schematic representation of the complementarity of each of these host target binding sites to VGAM2673 RNA, herein designated VGAM RNA, are described hereinbelow with reference to Table 2.

As mentioned hereinabove with reference to FIG. 1, a function of VGAM2673 gene, herein designated VGAM is inhibition of expression of VGAM2673 target genes. It is appreciated that specific functions, and accordingly utilities, of VGAM2673 correlate with, and may be deduced from, the identity of the target genes which VGAM2673 binds and inhibits, and the function of these target genes, as elaborated hereinbelow.

Solute Carrier Family 4, Sodium Bicarbonate Cotransporter, Member 7 (SLC4A7, Accession NM_003615) is a VGAM2673 host target gene. SLC4A7 BINDING SITE is HOST TARGET binding site found in the 3' untranslated region of mRNA encoded by SLC4A7, corresponding to a HOST TARGET binding site such as BINDING SITE I, BINDING SITE II or BINDING SITE III. Table 2 illustrates the complementarity of the nucleotide sequences of SLC4A7 BINDING SITE, designated SEQ ID:9669, to the nucleotide sequence of VGAM2673 RNA, herein designated VGAM RNA, also designated SEQ ID:5384.

A function of VGAM2673 is therefore inhibition of Solute Carrier Family 4, Sodium Bicarbonate Cotransporter, Member 7 (SLC4A7, Accession NM_003615), a gene which mediates the coupled movement of sodium and bicarbonate ions across the plasma membrane. Accordingly, utilities of VGAM2673 include diagnosis, prevention and treatment of diseases and clinical conditions associated with SLC4A7. The function of SLC4A7 and its association with various diseases and clinical conditions, has been established by previous studies, as described hereinabove with reference to VGAM66. LEC3 (Accession NM_015236) is another VGAM2673 host target gene. LEC3 BINDING SITE is HOST TARGET binding site found in the 3' untranslated region of mRNA encoded by LEC3, corresponding to a HOST TARGET binding site such as BINDING SITE I, BINDING SITE II or BINDING SITE III. Table 2 illustrates the complementarity of the nucleotide sequences of LEC3 BINDING SITE, designated SEQ ID:17570, to the nucleotide sequence of VGAM2673 RNA, herein designated VGAM RNA, also designated SEQ ID:5384.

Another function of VGAM2673 is therefore inhibition of LEC3 (Accession NM_015236). Accordingly, utilities of VGAM2673 include diagnosis, prevention and treatment of diseases and clinical conditions associated with LEC3. MGC2835 (Accession NM_024072) is another VGAM2673 host target gene. MGC2835 BINDING SITE is HOST TARGET binding site found in the 3' untranslated region of mRNA encoded by MGC2835, corresponding to a HOST TARGET binding site such as BINDING SITE I, BINDING SITE II or BINDING SITE III. Table 2 illustrates the complementarity of the nucleotide sequences of MGC2835 BINDING SITE, designated SEQ ID:23502, to the nucleotide sequence of VGAM2673 RNA, herein designated VGAM RNA, also designated SEQ ID:5384.

Another function of VGAM2673 is therefore inhibition of MGC2835 (Accession NM_024072). Accordingly, utilities of VGAM2673 include diagnosis, prevention and treatment of diseases and clinical conditions associated with MGC2835. LOC196264 (Accession XM_113683) is another VGAM2673 host target gene. LOC196264 BINDING SITE is HOST TARGET binding site found in the 3' untranslated region of mRNA encoded by LOC196264, corresponding to a HOST TARGET binding site such as BINDING SITE I, BINDING SITE II or BINDING SITE III. Table 2 illustrates the complementarity of the nucleotide sequences of LOC196264 BINDING SITE, designated SEQ ID:42332, to the nucleotide sequence of VGAM2673 RNA, herein designated VGAM RNA, also designated SEQ ID:5384.

Another function of VGAM2673 is therefore inhibition of LOC196264 (Accession XM_113683). Accordingly, utilities of VGAM2673 include diagnosis, prevention and treatment of diseases and clinical conditions associated with LOC196264. LOC202460 (Accession XM_114493) is another VGAM2673 host target gene. LOC202460 BINDING SITE is HOST TARGET binding site found in the 5' untranslated region of mRNA encoded by LOC202460, corresponding to a HOST TARGET binding site such as BINDING SITE I, BINDING SITE II or BINDING SITE III. Table 2 illustrates the complementarity of the nucleotide sequences of LOC202460 BINDING SITE, designated SEQ ID:42980, to the nucleotide sequence of VGAM2673 RNA, herein designated VGAM RNA, also designated SEQ ID:5384.

Another function of VGAM2673 is therefore inhibition of LOC202460 (Accession XM_114493). Accordingly, utilities of VGAM2673 include diagnosis, prevention and treatment of diseases and clinical conditions associated with LOC202460. FIG. 1 further provides a conceptual description of a novel bioinformatically detected viral gene of the present invention, referred to here as Viral Genomic Address Messenger 2674 (VGAM2674) viral gene, which modulates expression of respective host target genes thereof, the function and utility of which host target genes is known in the art.

VGAM2674 is a novel bioinformatically detected regulatory, non protein coding, viral micro RNA (miRNA) gene. The method by which VGAM2674 was detected is described hereinabove with reference to FIGS. 1-8.

VGAM2674 gene, herein designated VGAM GENE, is a viral gene contained in the genome of Ophiostoma Mitovirus 3a. VGAM2674 host target gene, herein designated VGAM HOST TARGET GENE, is a human gene contained in the human genome.

VGAM2674 gene encodes a VGAM2674 precursor RNA, herein designated VGAM PRECURSOR RNA. Similar to other miRNA genes, and unlike most ordinary genes, VGAM2674 precursor RNA does not encode a protein. A nucleotide sequence identical or highly similar to the nucleotide sequence of VGAM2674 precursor RNA is designated SEQ ID:2660, and is provided hereinbelow with reference to the sequence listing part. Nucleotide sequence SEQ ID:2660 is located at position 2100 relative to the genome of Ophiostoma Mitovirus 3a.

VGAM2674 precursor RNA folds onto itself, forming VGAM2674 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2674 folded precursor RNA into VGAM2674 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2674 RNA is designated SEQ ID:5385, and is provided hereinbelow with reference to the sequence listing part.

VGAM2674 host target gene, herein designated VGAM HOST TARGET GENE, encodes a corresponding messenger RNA, VGAM2674 host target RNA, herein designated VGAM HOST TARGET RNA. VGAM2674 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2674 RNA, herein designated VGAM RNA, binds complementarily to one or more host target binding sites located in untranslated regions of VGAM2674 host target RNA, herein designated VGAM HOST TARGET RNA. This complementary binding is due to the fact that the nucleotide sequence of VGAM2674 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2674 RNA, herein designated VGAM RNA, may have a different number of host target binding sites in untranslated regions of a VGAM2674 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2674 RNA, herein designated VGAM RNA, to host target binding sites on VGAM2674 host target RNA, herein designated VGAM HOST TARGET RNA, such as BINDING SITE I, BINDING SITE II and BINDING SITE III, inhibits translation of VGAM2674 host target RNA into VGAM2674 host target protein, herein designated VGAM HOST TARGET PROTEIN. VGAM host target protein is therefore outlined by a broken line.

It is appreciated that VGAM2674 host target gene, herein designated VGAM HOST TARGET GENE, in fact represents a plurality of VGAM2674 host target genes. The mRNA of each one of this plurality of VGAM2674 host target genes comprises one or more host target binding sites, each having a nucleotide sequence which is at least partly complementary to VGAM2674 RNA, herein designated VGAM RNA, and which when bound by VGAM2674 RNA causes inhibition of translation of respective one or more VGAM2674 host target proteins.

It is further appreciated by one skilled in the art that the mode of translational inhibition illustrated by FIG. 1 with specific reference to translational inhibition exerted by VGAM2674 gene, herein designated VGAM GENE, on one or more VGAM2674 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2674 is inhibition of expression of host target genes, as part of a novel viral mechanism of attacking a host. Accordingly, utilities of VGAM2674 include diagnosis, prevention and treatment of viral infection by Ophiostoma Mitovirus 3a. Specific functions, and accordingly utilities, of VGAM2674 correlate with, and may be deduced from, the identity of the host target genes which VGAM2674 binds and inhibits, and the function of these host target genes, as elaborated hereinbelow.

Nucleotide sequences of the VGAM2674 precursor RNA, herein designated VGAM PRECURSOR RNA, and of the 'diced' VGAM2674 RNA, herein designated VGAM RNA, and a schematic representation of the secondary folding of VGAM2674 folded precursor RNA, herein designated VGAM FOLDED PRECURSOR RNA, of VGAM2674 are further described hereinbelow with reference to Table 1.

Nucleotide sequences of host target binding sites, such as BINDING SITE-I, BINDING SITE-II and BINDING SITE-III of FIG. 1, found on VGAM2674 host target RNA, and schematic representation of the complementarity of each of these host target binding sites to VGAM2674 RNA, herein designated VGAM RNA, are described hereinbelow with reference to Table 2.

As mentioned hereinabove with reference to FIG. 1, a function of VGAM2674 gene, herein designated VGAM is inhibition of expression of VGAM2674 target genes. It is appreciated that specific functions, and accordingly utilities, of VGAM2674 correlate with, and may be deduced from, the identity of the target genes which VGAM2674 binds and inhibits, and the function of these target genes, as elaborated hereinbelow.

B-cell CLL/lymphoma 10 (BCL10, Accession NM_003921) is a VGAM2674 host target gene. BCL10 BINDING SITE is HOST TARGET binding site found in the 5' untranslated region of mRNA encoded by BCL10, corresponding to a HOST TARGET binding site such as BINDING SITE I, BINDING SITE II or BINDING SITE III. Table 2 illustrates the complementarity of the nucleotide sequences of BCL10 BINDING SITE, designated SEQ ID:10008, to the nucleotide sequence of VGAM2674 RNA, herein designated VGAM RNA, also designated SEQ ID:5385.

A function of VGAM2674 is therefore inhibition of B-cell CLL/lymphoma 10 (BCL10, Accession NM_003921), a gene which is a positive regulator of lymphocyte proliferation, NF-kappaB activator. Accordingly, utilities of VGAM2674 include diagnosis, prevention and treatment of diseases and clinical conditions associated with BCL10. The function of BCL10 and its association with various diseases and clinical conditions, has been established by previous studies, as described hereinabove with reference to VGAM433. Claudin 14 (CLDN14, Accession NM_144492) is another VGAM2674 host target gene. CLDN14 BINDING SITE is HOST TARGET binding site found in the 5' untranslated region of mRNA encoded by CLDN14, corresponding to a HOST TARGET binding site such as BINDING SITE I, BINDING SITE II or BINDING SITE III. Table 2 illustrates the complementarity of the nucleotide sequences of CLDN14 BINDING SITE, designated SEQ ID:29310, to the nucleotide sequence of VGAM2674 RNA, herein designated VGAM RNA, also designated SEQ ID:5385.

Another function of VGAM2674 is therefore inhibition of Claudin 14 (CLDN14, Accession NM_144492), a gene which provides structural support for the auditory neuroepithelium. Accordingly, utilities of VGAM2674 include diagnosis, prevention and treatment of diseases and clinical conditions associated with CLDN14. The function of CLDN14 and its association with various diseases and clinical conditions, has been established by previous studies, as described hereinabove with reference to VGAM1316. Glucosamine-6-phosphate Isomerase (GNPI, Accession NM_005471) is another VGAM2674 host target gene. GNPI BINDING SITE is HOST TARGET binding site found in the 3' untranslated region of mRNA encoded by GNPI, corresponding to a HOST TARGET binding site such as BINDING SITE I, BINDING SITE II or BINDING SITE III. Table 2 illustrates the complementarity of the nucleotide sequences of GNPI BINDING SITE, designated SEQ ID:11967, to the nucleotide sequence of VGAM2674 RNA, herein designated VGAM RNA, also designated SEQ ID:5385.

Another function of VGAM2674 is therefore inhibition of Glucosamine-6-phosphate Isomerase (GNPI, Accession NM_005471), a gene which converts glucosamine-6-phosphate to fructose-6-phosphate. Accordingly, utilities of VGAM2674 include diagnosis, prevention and treatment of diseases and clinical conditions associated with GNPI. The function of GNPI and its association with various diseases and clinical conditions, has been established by previous studies, as described hereinabove with reference to VGAM124. Ornithine Carbamoyltransferase (OTC, Accession NM_000531) is another VGAM2674 host target gene. OTC BINDING SITE is HOST TARGET binding site found in the 5' untranslated region of mRNA encoded by OTC, corresponding to a HOST TARGET binding site such as BINDING SITE I, BINDING SITE II or BINDING SITE III. Table 2 illustrates the complementarity of the nucleotide sequences of OTC BINDING SITE, designated SEQ ID:6133, to the nucleotide sequence of VGAM2674 RNA, herein designated VGAM RNA, also designated SEQ ID:5385.

Another function of VGAM2674 is therefore inhibition of Ornithine Carbamoyltransferase (OTC, Accession NM_000531). Accordingly, utilities of VGAM2674 include diagnosis, prevention and treatment of diseases and clinical conditions associated with OTC. Arginine-glutamic Acid Dipeptide (RE) Repeats (RERE, Accession NM_012102) is another VGAM2674 host target gene. RERE BINDING SITE is HOST TARGET binding site found in the 3' untranslated region of mRNA encoded by RERE, corresponding to a HOST TARGET binding site such as BINDING SITE I, BINDING SITE II or BINDING SITE III. Table 2 illustrates the complementarity of the nucleotide sequences of RERE BINDING SITE, designated SEQ ID:14406, to the nucleotide sequence of VGAM2674 RNA, herein designated VGAM RNA, also designated SEQ ID:5385.

Another function of VGAM2674 is therefore inhibition of Arginine-glutamic Acid Dipeptide (RE) Repeats (RERE, Accession NM_012102), a gene which binds DRPLA and locates in the nucleus. Accordingly, utilities of VGAM2674 include diagnosis, prevention and treatment of diseases and clinical conditions associated with RERE. The function of RERE and its association with various diseases and clinical conditions, has been established by previous studies, as described hereinabove with reference to VGAM51. Asporin (LRR class 1) (ASPN, Accession NM_017680) is another VGAM2674 host target gene. ASPN BINDING SITE is HOST TARGET binding site found in the 5' untranslated region of mRNA encoded by ASPN, corresponding to a HOST TARGET binding site such as BINDING SITE I, BINDING SITE II or BINDING SITE III. Table 2 illustrates the complementarity of the nucleotide sequences of ASPN BINDING SITE, designated SEQ ID:19224, to the nucleotide sequence of VGAM2674 RNA, herein designated VGAM RNA, also designated SEQ ID:5385.

Another function of VGAM2674 is therefore inhibition of Asporin (LRR class 1) (ASPN, Accession NM_017680). Accordingly, utilities of VGAM2674 include diagnosis, prevention and treatment of diseases and clinical conditions associated with ASPN. Chromosome 12 Open Reading Frame 22 (C12orf22, Accession NM_030809) is another VGAM2674 host target gene. C12orf22 BINDING SITE is HOST TARGET binding site found in the 3' untranslated region of mRNA encoded by C12orf22, corresponding to a HOST TARGET binding site such as BINDING SITE I, BINDING SITE II or BINDING SITE III. Table 2 illustrates the complementarity of the nucleotide sequences of C12orf22 BINDING SITE, designated SEQ ID:25127, to the nucleotide sequence of VGAM2674 RNA, herein designated VGAM RNA, also designated SEQ ID:5385.

Another function of VGAM2674 is therefore inhibition of Chromosome 12 Open Reading Frame 22 (C12orf22, Accession NM_030809). Accordingly, utilities of VGAM2674 include diagnosis, prevention and treatment of diseases and clinical conditions associated with C12orf22. Caspase 9, Apoptosis-related Cysteine Protease (CASP9, Accession NM_001229) is another VGAM2674 host target gene. CASP9 BINDING SITE is HOST TARGET binding site found in the 3' untranslated region of mRNA encoded by CASP9, corresponding to a HOST TARGET binding site such as BINDING SITE I, BINDING SITE II or BINDING SITE III. Table 2 illustrates the complementarity of the nucleotide sequences of CASP9 BINDING SITE, designated SEQ ID:6900, to the nucleotide sequence of VGAM2674 RNA, herein designated VGAM RNA, also designated SEQ ID:5385.

Another function of VGAM2674 is therefore inhibition of Caspase 9, Apoptosis-related Cysteine Protease (CASP9, Accession NM_001229). Accordingly, utilities of VGAM2674 include diagnosis, prevention and treatment of diseases and clinical conditions associated with CASP9. DKFZP434J193 (Accession XM_048452) is another VGAM2674 host target gene. DKFZP434J193 BINDING SITE is HOST TARGET binding site found in the 3' untranslated region of mRNA encoded by DKFZP434J193, corresponding to a HOST TARGET binding site such as BINDING SITE I, BINDING SITE II or BINDING SITE III. Table 2 illustrates the complementarity of the nucleotide sequences of DKFZP434J193 BINDING SITE, designated SEQ ID:35165, to the nucleotide sequence of VGAM2674 RNA, herein designated VGAM RNA, also designated SEQ ID:5385.

Another function of VGAM2674 is therefore inhibition of DKFZP434J193 (Accession XM_048452). Accordingly, utilities of VGAM2674 include diagnosis, prevention and treatment of diseases and clinical conditions associated with DKFZP434J193. DKFZP564B1162 (Accession NM_031305) is another VGAM2674 host target gene. DKFZP564B1162 BINDING SITE is HOST TARGET binding site found in the 5' untranslated region of mRNA encoded by DKFZP564B1162, corresponding to a HOST TARGET binding site such as BINDING SITE I, BINDING SITE II or BINDING SITE III. Table 2 illustrates the complementarity of the nucleotide sequences of DKFZP564B1162 BINDING SITE, designated SEQ ID:25338, to the nucleotide sequence of VGAM2674 RNA, herein designated VGAM RNA, also designated SEQ ID:5385.

Another function of VGAM2674 is therefore inhibition of DKFZP564B1162 (Accession NM_031305). Accordingly, utilities of VGAM2674 include diagnosis, prevention and treatment of diseases and clinical conditions associated with DKFZP564B1162. FLJ10997 (Accession NM_018293) is another VGAM2674 host target gene. FLJ10997 BINDING SITE is HOST TARGET binding site found in the 3' untranslated region of mRNA encoded by FLJ10997, corresponding to a HOST TARGET binding site such as BINDING SITE I, BINDING SITE II or BINDING SITE III. Table 2 illustrates the complementarity of the nucleotide sequences of FLJ10997 BINDING SITE, designated SEQ ID:20283, to the nucleotide sequence of VGAM2674 RNA, herein designated VGAM RNA, also designated SEQ ID:5385.

Another function of VGAM2674 is therefore inhibition of FLJ10997 (Accession NM_018293). Accordingly, utilities of VGAM2674 include diagnosis, prevention and treatment of diseases and clinical conditions associated with FLJ10997. FLJ12903 (Accession NM_022753) is another VGAM2674 host target gene. FLJ12903 BINDING SITE is HOST TARGET binding site found in the 3' untranslated region of mRNA encoded by FLJ12903, corresponding to a HOST TARGET binding site such as BINDING SITE I, BINDING SITE II or BINDING SITE III. Table 2 illustrates the complementarity of the nucleotide sequences of FLJ12903 BINDING SITE, designated SEQ ID:22979, to the nucleotide sequence of VGAM2674 RNA, herein designated VGAM RNA, also designated SEQ ID:5385.

Another function of VGAM2674 is therefore inhibition of FLJ12903 (Accession NM_022753). Accordingly, utilities of VGAM2674 include diagnosis, prevention and treatment of diseases and clinical conditions associated with FLJ12903. FLJ13189 (Accession NM_024882) is another VGAM2674 host target gene. FLJ13189 BINDING SITE is HOST TAR- GET binding site found in the 3' untranslated region of mRNA encoded by FLJ13189, corresponding to a HOST TARGET binding site such as BINDING SITE I, BINDING SITE II or BINDING SITE III. Table 2 illustrates the complementarity of the nucleotide sequences of FLJ13189 BINDING SITE, designated SEQ ID:24331, to the nucleotide sequence of VGAM2674 RNA, herein designated VGAM RNA, also designated SEQ ID:5385.

Another function of VGAM2674 is therefore inhibition of FLJ13189 (Accession NM_024882). Accordingly, utilities of VGAM2674 include diagnosis, prevention and treatment of diseases and clinical conditions associated with FLJ13189. FLJ13615 (Accession NM_025114) is another VGAM2674 host target gene. FLJ13615 BINDING SITE is HOST TARGET binding site found in the 5' untranslated region of mRNA encoded by FLJ13615, corresponding to a HOST TARGET binding site such as BINDING SITE I, BINDING SITE II or BINDING SITE III. Table 2 illustrates the complementarity of the nucleotide sequences of FLJ13615 BINDING SITE, designated SEQ ID:24764, to the nucleotide sequence of VGAM2674 RNA, herein designated VGAM RNA, also designated SEQ ID:5385.

Another function of VGAM2674 is therefore inhibition of FLJ13615 (Accession NM_025114). Accordingly, utilities of VGAM2674 include diagnosis, prevention and treatment of diseases and clinical conditions associated with FLJ13615. FLJ22169 (Accession NM_024085) is another VGAM2674 host target gene. FLJ22169 BINDING SITE is HOST TARGET binding site found in the 3' untranslated region of mRNA encoded by FLJ22169, corresponding to a HOST TARGET binding site such as BINDING SITE I, BINDING SITE II or BINDING SITE III. Table 2 illustrates the complementarity of the nucleotide sequences of FLJ22169 BINDING SITE, designated SEQ ID:23525, to the nucleotide sequence of VGAM2674 RNA, herein designated VGAM RNA, also designated SEQ ID:5385.

Another function of VGAM2674 is therefore inhibition of FLJ22169 (Accession NM_024085). Accordingly, utilities of VGAM2674 include diagnosis, prevention and treatment of diseases and clinical conditions associated with FLJ22169. G Protein-coupled Receptor Kinase-interactor 2 (GIT2, Accession NM_057169) is another VGAM2674 host target gene. GIT2 BINDING SITE1 through GIT2 BINDING SITE3 are HOST TARGET binding sites found in untranslated regions of mRNA encoded by GIT2, corresponding to HOST TARGET binding sites such as BINDING SITE I, BINDING SITE II or BINDING SITE III. Table 2 illustrates the complementarity of the nucleotide sequences of GIT2 BINDING SITE1 through GIT2 BINDING SITE3, designated SEQ ID:27685, SEQ ID:27698 and SEQ ID:16603 respectively, to the nucleotide sequence of VGAM2674 RNA, herein designated VGAM RNA, also designated SEQ ID:5385.

Another function of VGAM2674 is therefore inhibition of G Protein-coupled Receptor Kinase-interactor 2 (GIT2, Accession NM_057169). Accordingly, utilities of VGAM2674 include diagnosis, prevention and treatment of diseases and clinical conditions associated with GIT2. KIAA1789 (Accession XM_040486) is another VGAM2674 host target gene. KIAA1789 BINDING SITE is HOST TARGET binding site found in the 5' untranslated region of mRNA encoded by KIAA1789, corresponding to a HOST TARGET binding site such as BINDING SITE I, BINDING SITE II or BINDING SITE III. Table 2 illustrates the complementarity of the nucleotide sequences of KIAA1789 BINDING SITE, designated SEQ ID:33310, to the nucleotide sequence of VGAM2674 RNA, herein designated VGAM RNA, also designated SEQ ID:5385.

Another function of VGAM2674 is therefore inhibition of KIAA1789 (Accession XM_040486). Accordingly, utilities of VGAM2674 include diagnosis, prevention and treatment of diseases and clinical conditions associated with KIAA1789. KIAA1805 (Accession XM_086976) is another VGAM2674 host target gene. KIAA1805 BINDING SITE is HOST TARGET binding site found in the 3' untranslated region of mRNA encoded by KIAA1805, corresponding to a HOST TARGET binding site such as BINDING SITE I, BINDING SITE II or BINDING SITE III. Table 2 illustrates the complementarity of the nucleotide sequences of KIAA1805 BINDING SITE, designated SEQ ID:39001, to the nucleotide sequence of VGAM2674 RNA, herein designated VGAM RNA, also designated SEQ ID:5385.

Another function of VGAM2674 is therefore inhibition of KIAA1805 (Accession XM_086976). Accordingly, utilities of VGAM2674 include diagnosis, prevention and treatment of diseases and clinical conditions associated with KIAA1805. MGC15631 (Accession NM_032753) is another VGAM2674 host target gene. MGC15631 BINDING SITE is HOST TARGET binding site found in the 3' untranslated region of mRNA encoded by MGC15631, corresponding to a HOST TARGET binding site such as BINDING SITE I, BINDING SITE II or BINDING SITE III. Table 2 illustrates the complementarity of the nucleotide sequences of MGC15631 BINDING SITE, designated SEQ ID:26495, to the nucleotide sequence of VGAM2674 RNA, herein designated VGAM RNA, also designated SEQ ID:5385.

Another function of VGAM2674 is therefore inhibition of MGC15631 (Accession NM_032753). Accordingly, utilities of VGAM2674 include diagnosis, prevention and treatment of diseases and clinical conditions associated with MGC15631. MGC5139 (Accession XM_058587) is another VGAM2674 host target gene. MGC5139 BINDING SITE is HOST TARGET binding site found in the 5' untranslated region of mRNA encoded by MGC5139, corresponding to a HOST TARGET binding site such as BINDING SITE I, BINDING SITE II or BINDING SITE III. Table 2 illustrates the complementarity of the nucleotide sequences of MGC5139 BINDING SITE, designated SEQ ID:36676, to the nucleotide sequence of VGAM2674 RNA, herein designated VGAM RNA, also designated SEQ ID:5385.

Another function of VGAM2674 is therefore inhibition of MGC5139 (Accession XM_058587). Accordingly, utilities of VGAM2674 include diagnosis, prevention and treatment of diseases and clinical conditions associated with MGC5139. Protein Phosphatase 1, Regulatory Subunit 10 (PPP1R10, Accession NM_002714) is another VGAM2674 host target gene. PPP1R10 BINDING SITE is HOST TARGET binding site found in the 5' untranslated region of mRNA encoded by PPP1R10, corresponding to a HOST TARGET binding site such as BINDING SITE I, BINDING SITE II or BINDING SITE III. Table 2 illustrates the complementarity of the nucleotide sequences of PPP1R10 BINDING SITE, designated SEQ ID:8580, to the nucleotide sequence of VGAM2674 RNA, herein designated VGAM RNA, also designated SEQ ID:5385.

Another function of VGAM2674 is therefore inhibition of Protein Phosphatase 1, Regulatory Subunit 10 (PPP1R10, Accession NM_002714). Accordingly, utilities of VGAM2674 include diagnosis, prevention and treatment of diseases and clinical conditions associated with PPP1R10. RAB35, Member RAS Oncogene Family (RAB35, Accession NM_006861) is another VGAM2674 host target gene. RAB35 BINDING SITE is HOST TARGET binding site found in the 3' untranslated region of mRNA encoded by RAB35, corresponding to a HOST TARGET binding site such as BINDING SITE I, BINDING SITE II or BINDING SITE III. Table 2 illustrates the complementarity of the nucleotide sequences of RAB35 BINDING SITE, designated SEQ ID:13735, to the nucleotide sequence of VGAM2674 RNA, herein designated VGAM RNA, also designated SEQ ID:5385.

Another function of VGAM2674 is therefore inhibition of RAB35, Member RAS Oncogene Family (RAB35, Accession NM_006861). Accordingly, utilities of VGAM2674 include diagnosis, prevention and treatment of diseases and clinical conditions associated with RAB35. Tripartite Motif-containing 26 (TRIM26, Accession NM_003449) is another VGAM2674 host target gene. TRIM26 BINDING SITE is HOST TARGET binding site found in the 3' untranslated region of mRNA encoded by TRIM26, corresponding to a HOST TARGET binding site such as BINDING SITE I, BINDING SITE II or BINDING SITE III. Table 2 illustrates the complementarity of the nucleotide sequences of TRIM26 BINDING SITE, designated SEQ ID:9499, to the nucleotide sequence of VGAM2674 RNA, herein designated VGAM RNA, also designated SEQ ID:5385.

Another function of VGAM2674 is therefore inhibition of Tripartite Motif-containing 26 (TRIM26, Accession NM_003449). Accordingly, utilities of VGAM2674 include diagnosis, prevention and treatment of diseases and clinical conditions associated with TRIM26. LOC137964 (Accession XM_059933) is another VGAM2674 host target gene. LOC137964 BINDING SITE is HOST TARGET binding site found in the 5' untranslated region of mRNA encoded by LOC137964, corresponding to a HOST TARGET binding site such as BINDING SITE I, BINDING SITE II or BINDING SITE III. Table 2 illustrates the complementarity of the nucleotide sequences of LOC137964 BINDING SITE, designated SEQ ID:37111, to the nucleotide sequence of VGAM2674 RNA, herein designated VGAM RNA, also designated SEQ ID:5385.

Another function of VGAM2674 is therefore inhibition of LOC137964 (Accession XM_059933). Accordingly, utilities of VGAM2674 include diagnosis, prevention and treatment of diseases and clinical conditions associated with LOC137964. LOC144110 (Accession XM_084735) is another VGAM2674 host target gene. LOC144110 BINDING SITE is HOST TARGET binding site found in the 3' untranslated region of mRNA encoded by LOC144110, corresponding to a HOST TARGET binding site such as BINDING SITE I, BINDING SITE II or BINDING SITE III. Table 2 illustrates the complementarity of the nucleotide sequences of LOC144110 BINDING SITE, designated SEQ ID:37680, to the nucleotide sequence of VGAM2674 RNA, herein designated VGAM RNA, also designated SEQ ID:5385.

Another function of VGAM2674 is therefore inhibition of LOC144110 (Accession XM_084735). Accordingly, utilities of VGAM2674 include diagnosis, prevention and treatment of diseases and clinical conditions associated with LOC144110. LOC146226 (Accession XM_096946) is another VGAM2674 host target gene. LOC146226 BINDING SITE is HOST TARGET binding site found in the 5' untranslated region of mRNA encoded by LOC146226, corresponding to a HOST TARGET binding site such as BINDING SITE I, BINDING SITE II or BINDING SITE III. Table 2 illustrates the complementarity of the nucleotide sequences of LOC146226 BINDING SITE, designated SEQ ID:40663, to the nucleotide sequence of VGAM2674 RNA, herein designated VGAM RNA, also designated SEQ ID:5385.

Another function of VGAM2674 is therefore inhibition of LOC146226 (Accession XM_096946). Accordingly, utilities of VGAM2674 include diagnosis, prevention and treatment of diseases and clinical conditions associated with LOC146226. LOC157922 (Accession XM_098841) is another VGAM2674 host target gene. LOC157922 BINDING SITE is HOST TARGET binding site found in the 3' untranslated region of mRNA encoded by LOC157922, corresponding to a HOST TARGET binding site such as BINDING SITE I, BINDING SITE II or BINDING SITE III. Table 2 illustrates the complementarity of the nucleotide sequences of LOC157922 BINDING SITE, designated SEQ ID:41889, to the nucleotide sequence of VGAM2674 RNA, herein designated VGAM RNA, also designated SEQ ID:5385.

Another function of VGAM2674 is therefore inhibition of LOC157922 (Accession XM_098841). Accordingly, utilities of VGAM2674 include diagnosis, prevention and treatment of diseases and clinical conditions associated with LOC157922. LOC158125 (Accession XM_088492) is another VGAM2674 host target gene. LOC158125 BINDING SITE is HOST TARGET binding site found in the 5' untranslated region of mRNA encoded by LOC158125, corresponding to a HOST TARGET binding site such as BINDING SITE I, BINDING SITE II or BINDING SITE III. Table 2 illustrates the complementarity of the nucleotide sequences of LOC158125 BINDING SITE, designated SEQ ID:39730, to the nucleotide sequence of VGAM2674 RNA, herein designated VGAM RNA, also designated SEQ ID:5385.

Another function of VGAM2674 is therefore inhibition of LOC158125 (Accession XM_088492). Accordingly, utilities of VGAM2674 include diagnosis, prevention and treatment of diseases and clinical conditions associated with LOC158125. LOC221773 (Accession XM_165802) is another VGAM2674 host target gene. LOC221773 BINDING SITE is HOST TARGET binding site found in the 3' untranslated region of mRNA encoded by LOC221773, corresponding to a HOST TARGET binding site such as BINDING SITE I, BINDING SITE II or BINDING SITE III. Table 2 illustrates the complementarity of the nucleotide sequences of LOC221773 BINDING SITE, designated SEQ ID:43764, to the nucleotide sequence of VGAM2674 RNA, herein designated VGAM RNA, also designated SEQ ID:5385.

Another function of VGAM2674 is therefore inhibition of LOC221773 (Accession XM_165802). Accordingly, utilities of VGAM2674 include diagnosis, prevention and treatment of diseases and clinical conditions associated with LOC221773. LOC257494 (Accession XM_175212) is another VGAM2674 host target gene. LOC257494 BINDING SITE is HOST TARGET binding site found in the 3' untranslated region of mRNA encoded by LOC257494, corresponding to a HOST TARGET binding site such as BINDING SITE I, BINDING SITE II or BINDING SITE III. Table 2 illustrates the complementarity of the nucleotide sequences of LOC257494 BINDING SITE, designated SEQ ID:46686, to the nucleotide sequence of VGAM2674 RNA, herein designated VGAM RNA, also designated SEQ ID:5385.

Another function of VGAM2674 is therefore inhibition of LOC257494 (Accession XM_175212). Accordingly, utilities of VGAM2674 include diagnosis, prevention and treatment of diseases and clinical conditions associated with LOC257494. FIG. 1 further provides a conceptual description of a novel bioinformatically detected viral gene of the present invention, referred to here as Viral Genomic Address Messenger 2675 (VGAM2675) viral gene, which modulates expression of respective host target genes thereof, the function and utility of which host target genes is known in the art.

VGAM2675 is a novel bioinformatically detected regulatory, non protein coding, viral micro RNA (miRNA) gene. The method by which VGAM2675 was detected is described hereinabove with reference to FIGS. 1-8.

VGAM2675 gene, herein designated VGAM GENE, is a viral gene contained in the genome of Ophiostoma Mitovirus 3a. VGAM2675 host target gene, herein designated VGAM HOST TARGET GENE, is a human gene contained in the human genome.

VGAM2675 gene encodes a VGAM2675 precursor RNA, herein designated VGAM PRECURSOR RNA. Similar to other miRNA genes, and unlike most ordinary genes, VGAM2675 precursor RNA does not encode a protein. A nucleotide sequence identical or highly similar to the nucleotide sequence of VGAM2675 precursor RNA is designated SEQ ID:2661, and is provided hereinbelow with reference to the sequence listing part. Nucleotide sequence SEQ ID:2661 is located at position 567 relative to the genome of Ophiostoma Mitovirus 3a.

VGAM2675 precursor RNA folds onto itself, forming VGAM2675 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2675 folded precursor RNA into VGAM2675 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2675 RNA is designated SEQ ID:5386, and is provided hereinbelow with reference to the sequence listing part.

VGAM2675 host target gene, herein designated VGAM HOST TARGET GENE, encodes a corresponding messenger RNA, VGAM2675 host target RNA, herein designated VGAM HOST TARGET RNA. VGAM2675 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2675 RNA, herein designated VGAM RNA, binds complementarily to one or more host target binding sites located in untranslated regions of VGAM2675 host target RNA, herein designated VGAM HOST TARGET RNA. This complementary binding is due to the fact that the nucleotide sequence of VGAM2675 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2675 RNA, herein designated VGAM RNA, may have a different number of host target binding sites in untranslated regions of a VGAM2675 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2675 RNA, herein designated VGAM RNA, to host target binding sites on VGAM2675 host target RNA, herein designated VGAM HOST TARGET RNA, such as BINDING SITE I, BINDING SITE II and BINDING SITE III, inhibits translation of VGAM2675 host target RNA into VGAM2675 host target protein, herein designated VGAM HOST TARGET PROTEIN. VGAM host target protein is therefore outlined by a broken line.

It is appreciated that VGAM2675 host target gene, herein designated VGAM HOST TARGET GENE, in fact represents a plurality of VGAM2675 host target genes. The mRNA of each one of this plurality of VGAM2675 host target genes comprises one or more host target binding sites, each having a nucleotide sequence which is at least partly complementary to VGAM2675 RNA, herein designated VGAM RNA, and which when bound by VGAM2675 RNA causes inhibition of translation of respective one or more VGAM2675 host target proteins.

It is further appreciated by one skilled in the art that the mode of translational inhibition illustrated by FIG. 1 with specific reference to translational inhibition exerted by VGAM2675 gene, herein designated VGAM GENE, on one or more VGAM2675 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2675 is inhibition of expression of host target genes, as part of a novel viral mechanism of attacking a host. Accordingly, utilities of VGAM2675 include diagnosis, prevention and treatment of viral infection by Ophiostoma Mitovirus 3a. Specific functions, and accordingly utilities, of VGAM2675 correlate with, and may be deduced from, the identity of the host target genes which VGAM2675 binds and inhibits, and the function of these host target genes, as elaborated hereinbelow.

Nucleotide sequences of the VGAM2675 precursor RNA, herein designated VGAM PRECURSOR RNA, and of the 'diced' VGAM2675 RNA, herein designated VGAM RNA, and a schematic representation of the secondary folding of VGAM2675 folded precursor RNA, herein designated VGAM FOLDED PRECURSOR RNA, of VGAM2675 are further described hereinbelow with reference to Table 1.

Nucleotide sequences of host target binding sites, such as BINDING SITE-I, BINDING SITE-II and BINDING SITE-III of FIG. 1, found on VGAM2675 host target RNA, and schematic representation of the complementarity of each of these host target binding sites to VGAM2675 RNA, herein designated VGAM RNA, are described hereinbelow with reference to Table 2.

As mentioned hereinabove with reference to FIG. 1, a function of VGAM2675 gene, herein designated VGAM is inhibition of expression of VGAM2675 target genes. It is appreciated that specific functions, and accordingly utilities, of VGAM2675 correlate with, and may be deduced from, the identity of the target genes which VGAM2675 binds and inhibits, and the function of these target genes, as elaborated hereinbelow.

Protocadherin Alpha 9 (PCDHA9, Accession NM_014005) is a VGAM2675 host target gene. PCDHA9 BINDING SITE1 and PCDHA9 BINDING SITE2 are HOST TARGET binding sites found in untranslated regions of mRNA encoded by PCDHA9, corresponding to HOST TARGET binding sites such as BINDING SITE I, BINDING SITE II or BINDING SITE III. Table 2 illustrates the complementarity of the nucleotide sequences of PCDHA9 BINDING SITE1 and PCDHA9 BINDING SITE2, designated SEQ ID:15210 and SEQ ID:25602 respectively, to the nucleotide sequence of VGAM2675 RNA, herein designated VGAM RNA, also designated SEQ ID:5386.

A function of VGAM2675 is therefore inhibition of Protocadherin Alpha 9 (PCDHA9, Accession NM_014005), a gene which is a calcium-dependent cell-adhesion protein. Accordingly, utilities of VGAM2675 include diagnosis, prevention and treatment of diseases and clinical conditions associated with PCDHA9. The function of PCDHA9 and its association with various diseases and clinical conditions, has been established by previous studies, as described hereinabove with reference to VGAM71. ARPP-19 (Accession NM_006628) is another VGAM2675 host target gene. ARPP-19 BINDING SITE is HOST TARGET binding site found in the 3' untranslated region of mRNA encoded by ARPP-19, corresponding to a HOST TARGET binding site such as BINDING SITE I, BINDING SITE II or BINDING SITE III. Table 2 illustrates the complementarity of the nucleotide sequences of ARPP-19 BINDING SITE, designated SEQ ID:13420, to the nucleotide sequence of VGAM2675 RNA, herein designated VGAM RNA, also designated SEQ ID:5386.

Another function of VGAM2675 is therefore inhibition of ARPP-19 (Accession NM_006628). Accordingly, utilities of VGAM2675 include diagnosis, prevention and treatment of diseases and clinical conditions associated with ARPP-19. ATPase, H+ Transporting, Lysosomal 56/58 kDa, V1 Subunit B, Isoform 2 (ATP6V1B2, Accession NM_001693) is another VGAM2675 host target gene. ATP6V1B2 BINDING SITE is HOST TARGET binding site found in the 3' untranslated region of mRNA encoded by ATP6V1B2, corresponding to a HOST TARGET binding site such as BINDING SITE I, BINDING SITE II or BINDING SITE III. Table 2 illustrates the complementarity of the nucleotide sequences of ATP6V1B2 BINDING SITE, designated SEQ ID:7414, to the nucleotide sequence of VGAM2675 RNA, herein designated VGAM RNA, also designated SEQ ID:5386.

Another function of VGAM2675 is therefore inhibition of ATPase, H+ Transporting, Lysosomal 56/58 kDa, V1 Subunit B, Isoform 2 (ATP6V1B2, Accession NM_001693). Accordingly, utilities of VGAM2675 include diagnosis, prevention and treatment of diseases and clinical conditions associated with ATP6V1B2. Chromosome 1 Open Reading Frame 34 (C1orf34, Accession XM_027172) is another VGAM2675 host target gene. C1orf34 BINDING SITE is HOST TARGET binding site found in the 3' untranslated region of mRNA encoded by C1orf34, corresponding to a HOST TARGET binding site such as BINDING SITE I, BINDING SITE II or BINDING SITE III. Table 2 illustrates the complementarity of the nucleotide sequences of C1orf34 BINDING SITE, designated SEQ ID:30436, to the nucleotide sequence of VGAM2675 RNA, herein designated VGAM RNA, also designated SEQ ID:5386.

Another function of VGAM2675 is therefore inhibition of Chromosome 1 Open Reading Frame 34 (C1orf34, Accession XM_027172). Accordingly, utilities of VGAM2675 include diagnosis, prevention and treatment of diseases and clinical conditions associated with C1orf34. FLJ13912 (Accession NM_022770) is another VGAM2675 host target gene. FLJ13912 BINDING SITE is HOST TARGET binding site found in the 3' untranslated region of mRNA encoded by FLJ13912, corresponding to a HOST TARGET binding site such as BINDING SITE I, BINDING SITE II or BINDING SITE III. Table 2 illustrates the complementarity of the nucleotide sequences of FLJ13912 BINDING SITE, designated SEQ ID:23029, to the nucleotide sequence of VGAM2675 RNA, herein designated VGAM RNA, also designated SEQ ID:5386.

Another function of VGAM2675 is therefore inhibition of FLJ13912 (Accession NM_022770). Accordingly, utilities of VGAM2675 include diagnosis, prevention and treatment of diseases and clinical conditions associated with FLJ13912. FLJ20511 (Accession NM_017853) is another VGAM2675 host target gene. FLJ20511 BINDING SITE is HOST TARGET binding site found in the 3' untranslated region of mRNA encoded by FLJ20511, corresponding to a HOST TARGET binding site such as BINDING SITE I, BINDING SITE II or BINDING SITE III. Table 2 illustrates the complementarity of the nucleotide sequences of FLJ20511 BINDING SITE, designated SEQ ID:19527, to the nucleotide sequence of VGAM2675 RNA, herein designated VGAM RNA, also designated SEQ ID:5386.

Another function of VGAM2675 is therefore inhibition of FLJ20511 (Accession NM_017853). Accordingly, utilities of VGAM2675 include diagnosis, prevention and treatment of diseases and clinical conditions associated with FLJ20511. HCA127 (Accession NM_018684) is another VGAM2675 host target gene. HCA127 BINDING SITE is HOST TARGET binding site found in the 3' untranslated region of mRNA encoded by HCA127, corresponding to a HOST TARGET binding site such as BINDING SITE I, BINDING SITE II or BINDING SITE III. Table 2 illustrates the complementarity of the nucleotide sequences of HCA127 BINDING SITE, designated SEQ ID:20756, to the nucleotide sequence of VGAM2675 RNA, herein designated VGAM RNA, also designated SEQ ID:5386.

Another function of VGAM2675 is therefore inhibition of HCA127 (Accession NM_018684). Accordingly, utilities of VGAM2675 include diagnosis, prevention and treatment of diseases and clinical conditions associated with HCA127. LOC254057 (Accession XM_173085) is another VGAM2675 host target gene. LOC254057 BINDING SITE is HOST TARGET binding site found in the 3' untranslated region of mRNA encoded by LOC254057, corresponding to a HOST TARGET binding site such as BINDING SITE I, BINDING SITE II or BINDING SITE III. Table 2 illustrates the complementarity of the nucleotide sequences of LOC254057 BINDING SITE, designated SEQ ID:46345, to the nucleotide sequence of VGAM2675 RNA, herein designated VGAM RNA, also designated SEQ ID:5386.

Another function of VGAM2675 is therefore inhibition of LOC254057 (Accession XM_173085). Accordingly, utilities of VGAM2675 include diagnosis, prevention and treatment of diseases and clinical conditions associated with LOC254057. LOC92935 (Accession XM_048197) is another VGAM2675 host target gene. LOC92935 BINDING SITE is HOST TARGET binding site found in the 3' untranslated region of mRNA encoded by LOC92935, corresponding to a HOST TARGET binding site such as BINDING SITE I, BINDING SITE II or BINDING SITE III. Table 2 illustrates the complementarity of the nucleotide sequences of LOC92935 BINDING SITE, designated SEQ ID:35132, to the nucleotide sequence of VGAM2675 RNA, herein designated VGAM RNA, also designated SEQ ID:5386.

Another function of VGAM2675 is therefore inhibition of LOC92935 (Accession XM_048197). Accordingly, utilities of VGAM2675 include diagnosis, prevention and treatment of diseases and clinical conditions associated with LOC92935. FIG. 1 further provides a conceptual description of a novel bioinformatically detected viral gene of the present invention, referred to here as Viral Genomic Address Messenger 2676 (VGAM2676) viral gene, which modulates expression of respective host target genes thereof, the function and utility of which host target genes is known in the art.

VGAM2676 is a novel bioinformatically detected regulatory, non protein coding, viral micro RNA (miRNA) gene. The method by which VGAM2676 was detected is described hereinabove with reference to FIGS. 1-8.

VGAM2676 gene, herein designated VGAM GENE, is a viral gene contained in the genome of Ophiostoma Mitovirus 3a. VGAM2676 host target gene, herein designated VGAM HOST TARGET GENE, is a human gene contained in the human genome.

VGAM2676 gene encodes a VGAM2676 precursor RNA, herein designated VGAM PRECURSOR RNA. Similar to other miRNA genes, and unlike most ordinary genes, VGAM2676 precursor RNA does not encode a protein. A nucleotide sequence identical or highly similar to the nucleotide sequence of VGAM2676 precursor RNA is designated SEQ ID:2662, and is provided hereinbelow with reference to the sequence listing part. Nucleotide sequence SEQ ID:2662 is located at position 905 relative to the genome of Ophiostoma Mitovirus 3a.

VGAM2676 precursor RNA folds onto itself, forming VGAM2676 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2676 folded precursor RNA into VGAM2676 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM2676 RNA is designated SEQ ID:5387, and is provided hereinbelow with reference to the sequence listing part.

VGAM2676 host target gene, herein designated VGAM HOST TARGET GENE, encodes a corresponding messenger RNA, VGAM2676 host target RNA, herein designated VGAM HOST TARGET RNA. VGAM2676 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2676 RNA, herein designated VGAM RNA, binds complementarily to one or more host target binding sites located in untranslated regions of VGAM2676 host target RNA, herein designated VGAM HOST TARGET RNA. This complementary binding is due to the fact that the nucleotide sequence of VGAM2676 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2676 RNA, herein designated VGAM RNA, may have a different number of host target binding sites in untranslated regions of a VGAM2676 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2676 RNA, herein designated VGAM RNA, to host target binding sites on VGAM2676 host target RNA, herein designated VGAM HOST TARGET RNA, such as BINDING SITE I, BINDING SITE II and BINDING SITE III, inhibits translation of VGAM2676 host target RNA into VGAM2676 host target protein, herein designated VGAM HOST TARGET PROTEIN. VGAM host target protein is therefore outlined by a broken line.

It is appreciated that VGAM2676 host target gene, herein designated VGAM HOST TARGET GENE, in fact represents a plurality of VGAM2676 host target genes. The mRNA of each one of this plurality of VGAM2676 host target genes comprises one or more host target binding sites, each having a nucleotide sequence which is at least partly complementary to VGAM2676 RNA, herein designated VGAM RNA, and which when bound by VGAM2676 RNA causes inhibition of translation of respective one or more VGAM2676 host target proteins.

It is further appreciated by one skilled in the art that the mode of translational inhibition illustrated by FIG. 1 with specific reference to translational inhibition exerted by VGAM2676 gene, herein designated VGAM GENE, on one or more VGAM2676 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2676 is inhibition of expression of host target genes, as part of a novel viral mechanism of attacking a host. Accordingly, utilities of VGAM2676 include diagnosis, prevention and treatment of viral infection by Ophiostoma Mitovirus 3a. Specific functions, and accordingly utilities, of VGAM2676 correlate with, and may be deduced from, the identity of the host target genes which VGAM2676 binds and inhibits, and the function of these host target genes, as elaborated hereinbelow.

Nucleotide sequences of the VGAM2676 precursor RNA, herein designated VGAM PRECURSOR RNA, and of the 'diced' VGAM2676 RNA, herein designated VGAM RNA, and a schematic representation of the secondary folding of VGAM2676 folded precursor RNA, herein designated VGAM FOLDED PRECURSOR RNA, of VGAM2676 are further described hereinbelow with reference to Table 1.

Nucleotide sequences of host target binding sites, such as BINDING SITE-I, BINDING SITE-II and BINDING SITE-III of FIG. 1, found on VGAM2676 host target RNA, and schematic representation of the complementarity of each of these host target binding sites to VGAM2676 RNA, herein designated VGAM RNA, are described hereinbelow with reference to Table 2.

As mentioned hereinabove with reference to FIG. 1, a function of VGAM2676 gene, herein designated VGAM is inhibition of expression of VGAM2676 target genes. It is appreciated that specific functions, and accordingly utilities, of VGAM2676 correlate with, and may be deduced from, the identity of the target genes which VGAM2676 binds and inhibits, and the function of these target genes, as elaborated hereinbelow.

Kinesin-like 1 (KNSL1, Accession NM_004523) is a VGAM2676 host target gene. KNSL1 BINDING SITE is HOST TARGET binding site found in the 3' untranslated region of mRNA encoded by KNSL1, corresponding to a HOST TARGET binding site such as BINDING SITE I, BINDING SITE II or BINDING SITE III. Table 2 illustrates the complementarity of the nucleotide sequences of KNSL1 BINDING SITE, designated SEQ ID:10862, to the nucleotide sequence of VGAM2676 RNA, herein designated VGAM RNA, also designated SEQ ID:5387.

A function of VGAM2676 is therefore inhibition of Kinesin-like 1 (KNSL1, Accession NM_004523), a gene which is a motor protein required for establishing a bipolar spindle. Accordingly, utilities of VGAM2676 include diagnosis, prevention and treatment of diseases and clinical conditions associated with KNSL1. The function of KNSL1 and its association with various diseases and clinical conditions, has been established by previous studies, as described hereinabove with reference to VGAM252. KIAA0254 (Accession NM_014758) is another VGAM2676 host target gene. KIAA0254 BINDING SITE is HOST TARGET binding site found in the 3' untranslated region of mRNA encoded by KIAA0254, corresponding to a HOST TARGET binding site such as BINDING SITE I, BINDING SITE II or BINDING SITE III. Table 2 illustrates the complementarity of the nucleotide sequences of KIAA0254 BINDING SITE, designated SEQ ID:16505, to the nucleotide sequence of VGAM2676 RNA, herein designated VGAM RNA, also designated SEQ ID:5387.

Another function of VGAM2676 is therefore inhibition of KIAA0254 (Accession NM_014758). Accordingly, utilities of VGAM2676 include diagnosis, prevention and treatment of diseases and clinical conditions associated with KIAA0254. Sulfotransferase Family, Cytosolic, 1C, Member 2 (SULT1C2, Accession NM_006588) is another VGAM2676 host target gene. SULT1C2 BINDING SITE is HOST TARGET binding site found in the 5' untranslated region of mRNA encoded by SULT1C2, corresponding to a HOST TARGET binding site such as BINDING SITE I, BINDING SITE II or BINDING SITE III. Table 2 illustrates the complementarity of the nucleotide sequences of SULT1C2 BINDING SITE, designated SEQ ID:13351, to the nucleotide sequence of VGAM2676 RNA, herein designated VGAM RNA, also designated SEQ ID:5387.

Another function of VGAM2676 is therefore inhibition of Sulfotransferase Family, Cytosolic, 1C, Member 2 (SULT1C2, Accession NM_006588). Accordingly, utilities of VGAM2676 include diagnosis, prevention and treatment of diseases and clinical conditions associated with SULT1C2. LOC144519 (Accession XM_084890) is another VGAM2676 host target gene. LOC144519 BINDING SITE is HOST TARGET binding site found in the 5' untranslated region of mRNA encoded by LOC144519, corresponding to a HOST TARGET binding site such as BINDING SITE I, BINDING SITE II or BINDING SITE III. Table 2 illustrates the complementarity of the nucleotide sequences of LOC144519 BINDING SITE, designated SEQ ID:37755, to the nucleotide sequence of VGAM2676 RNA, herein designated VGAM RNA, also designated SEQ ID:5387.

Another function of VGAM2676 is therefore inhibition of LOC144519 (Accession XM_084890). Accordingly, utilities of VGAM2676 include diagnosis, prevention and treatment of diseases and clinical conditions associated with LOC144519. FIG. 1 further provides a conceptual description of a novel bioinformatically detected viral gene of the present invention, referred to here as Viral Genomic Address Messenger 2677 (VGAM2677) viral gene, which modulates expression of respective host target genes thereof, the function and utility of which host target genes is known in the art.

VGAM2677 is a novel bioinformatically detected regulatory, non protein coding, viral micro RNA (miRNA) gene. The method by which VGAM2677 was detected is described hereinabove with reference to FIGS. 1-8.

VGAM2677 gene, herein designated VGAM GENE, is a viral gene contained in the genome of Ophiostoma Mitovirus 3a. VGAM2677 host target gene, herein designated VGAM HOST TARGET GENE, is a human gene contained in the human genome.

VGAM2677 gene encodes a VGAM2677 precursor RNA, herein designated VGAM PRECURSOR RNA. Similar to other miRNA genes, and unlike most ordinary genes, VGAM2677 precursor RNA does not encode a protein. A nucleotide sequence identical or highly similar to the nucleotide sequence of VGAM2677 precursor RNA is designated SEQ ID:2663, and is provided hereinbelow with reference to the sequence listing part. Nucleotide sequence SEQ ID:2663 is located at position 1465 relative to the genome of Ophiostoma Mitovirus 3a.

VGAM2677 precursor RNA folds onto itself, forming VGAM2677 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2677 folded precursor RNA into VGAM2677 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM2677 RNA is designated SEQ ID:5388, and is provided hereinbelow with reference to the sequence listing part.

VGAM2677 host target gene, herein designated VGAM HOST TARGET GENE, encodes a corresponding messenger RNA, VGAM2677 host target RNA, herein designated VGAM HOST TARGET RNA. VGAM2677 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2677 RNA, herein designated VGAM RNA, binds complementarily to one or more host target binding sites located in untranslated regions of VGAM2677 host target RNA, herein designated VGAM HOST TARGET RNA. This complementary binding is due to the fact that the nucleotide sequence of VGAM2677 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2677 RNA, herein designated VGAM RNA, may have a different number of host target binding sites in untranslated regions of a VGAM2677 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2677 RNA, herein designated VGAM RNA, to host target binding sites on VGAM2677 host target RNA, herein designated VGAM HOST TARGET RNA, such as BINDING SITE I, BINDING SITE II and BINDING SITE III, inhibits translation of VGAM2677 host target RNA into VGAM2677 host target protein, herein designated VGAM HOST TARGET PROTEIN. VGAM host target protein is therefore outlined by a broken line.

It is appreciated that VGAM2677 host target gene, herein designated VGAM HOST TARGET GENE, in fact represents a plurality of VGAM2677 host target genes. The mRNA of each one of this plurality of VGAM2677 host target genes comprises one or more host target binding sites, each having a nucleotide sequence which is at least partly complementary to VGAM2677 RNA, herein designated VGAM RNA, and which when bound by VGAM2677 RNA causes inhibition of translation of respective one or more VGAM2677 host target proteins.

It is further appreciated by one skilled in the art that the mode of translational inhibition illustrated by FIG. 1 with specific reference to translational inhibition exerted by VGAM2677 gene, herein designated VGAM GENE, on one or more VGAM2677 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2677 is inhibition of expression of host target genes, as part of a novel viral mechanism of attacking a host. Accordingly, utilities of VGAM2677 include diagnosis, prevention and treatment of viral infection by Ophiostoma Mitovirus 3a. Specific functions, and accordingly utilities, of VGAM2677 correlate with, and may be deduced from, the identity of the host target genes which VGAM2677 binds and inhibits, and the function of these host target genes, as elaborated hereinbelow.

Nucleotide sequences of the VGAM2677 precursor RNA, herein designated VGAM PRECURSOR RNA, and of the 'diced' VGAM2677 RNA, herein designated VGAM RNA, and a schematic representation of the secondary folding of VGAM2677 folded precursor RNA, herein designated VGAM FOLDED PRECURSOR RNA, of VGAM2677 are further described hereinbelow with reference to Table 1.

Nucleotide sequences of host target binding sites, such as BINDING SITE-I, BINDING SITE-II and BINDING SITE-III of FIG. 1, found on VGAM2677 host target RNA, and schematic representation of the complementarity of each of these host target binding sites to VGAM2677 RNA, herein designated VGAM RNA, are described hereinbelow with reference to Table 2.

As mentioned hereinabove with reference to FIG. 1, a function of VGAM2677 gene, herein designated VGAM is inhibition of expression of VGAM2677 target genes. It is appreciated that specific functions, and accordingly utilities, of VGAM2677 correlate with, and may be deduced from, the identity of the target genes which VGAM2677 binds and inhibits, and the function of these target genes, as elaborated hereinbelow.

Phosphoribosylaminoimidazole Carboxylase, Phosphoribosylaminoimidazole Succinocarboxamide Synthetase (PAICS, Accession NM_006452) is a VGAM2677 host target gene. PAICS BINDING SITE is HOST TARGET binding site found in the 3' untranslated region of mRNA encoded by PAICS, corresponding to a HOST TARGET binding site such as BINDING SITE I, BINDING SITE II or BINDING SITE III. Table 2 illustrates the complementarity of the nucleotide sequences of PAICS BINDING SITE, designated SEQ ID:13162, to the nucleotide sequence of VGAM2677 RNA, herein designated VGAM RNA, also designated SEQ ID:5388.

A function of VGAM2677 is therefore inhibition of Phosphoribosylaminoimidazole Carboxylase, Phosphoribosylaminoimidazole Succinocarboxamide Synthetase (PAICS, Accession NM_006452), a gene which is required for purine biosynthesis. Accordingly, utilities of VGAM2677 include diagnosis, prevention and treatment of diseases and clinical conditions associated with PAICS. The function of PAICS and its association with various diseases and clinical conditions, has been established by previous studies, as described hereinabove with reference to VGAM894. KIAA0844 (Accession NM_014951) is another VGAM2677 host target gene. KIAA0844 BINDING SITE is HOST TARGET binding site found in the 3' untranslated region of mRNA encoded by KIAA0844, corresponding to a HOST TARGET binding site such as BINDING SITE I, BINDING SITE II or BINDING SITE III. Table 2 illustrates the complementarity of the nucleotide sequences of KIAA0844 BINDING SITE, designated SEQ ID:17284, to the nucleotide sequence of VGAM2677 RNA, herein designated VGAM RNA, also designated SEQ ID:5388.

Another function of VGAM2677 is therefore inhibition of KIAA0844 (Accession NM_014951). Accordingly, utilities of VGAM2677 include diagnosis, prevention and treatment of diseases and clinical conditions associated with KIAA0844. LOC126669 (Accession XM_060121) is another VGAM2677 host target gene. LOC126669 BINDING SITE is HOST TARGET binding site found in the 3' untranslated region of mRNA encoded by LOC126669, corresponding to a HOST TARGET binding site such as BINDING SITE I, BINDING SITE II or BINDING SITE III. Table 2 illustrates the complementarity of the nucleotide sequences of LOC126669 BINDING SITE, designated SEQ ID:37153, to the nucleotide sequence of VGAM2677 RNA, herein designated VGAM RNA, also designated SEQ ID:5388.

Another function of VGAM2677 is therefore inhibition of LOC126669 (Accession XM_060121). Accordingly, utilities of VGAM2677 include diagnosis, prevention and treatment of diseases and clinical conditions associated with LOC126669. LOC145644 (Accession XM_035608) is another VGAM2677 host target gene. LOC145644 BINDING SITE is HOST TARGET binding site found in the 5' untranslated region of mRNA encoded by LOC145644, corresponding to a HOST TARGET binding site such as BINDING SITE I, BINDING SITE II or BINDING SITE III. Table 2 illustrates the complementarity of the nucleotide sequences of LOC145644 BINDING SITE, designated SEQ ID:32289, to the nucleotide sequence of VGAM2677 RNA, herein designated VGAM RNA, also designated SEQ ID:5388.

Another function of VGAM2677 is therefore inhibition of LOC145644 (Accession XM_035608). Accordingly, utilities of VGAM2677 include diagnosis, prevention and treatment of diseases and clinical conditions associated with LOC145644. LOC90829 (Accession XM_034325) is another VGAM2677 host target gene. LOC90829 BINDING SITE is HOST TARGET binding site found in the 5' untranslated region of mRNA encoded by LOC90829, corresponding to a HOST TARGET binding site such as BINDING SITE I, BINDING SITE II or BINDING SITE III. Table 2 illustrates the complementarity of the nucleotide sequences of LOC90829 BINDING SITE, designated SEQ ID:32055, to the nucleotide sequence of VGAM2677 RNA, herein designated VGAM RNA, also designated SEQ ID:5388.

Another function of VGAM2677 is therefore inhibition of LOC90829 (Accession XM_034325). Accordingly, utilities of VGAM2677 include diagnosis, prevention and treatment of diseases and clinical conditions associated with LOC90829. FIG. 1 further provides a conceptual description of a novel bioinformatically detected viral gene of the present invention, referred to here as Viral Genomic Address Messenger 2678 (VGAM2678) viral gene, which modulates expression of respective host target genes thereof, the function and utility of which host target genes is known in the art.

VGAM2678 is a novel bioinformatically detected regulatory, non protein coding, viral micro RNA (miRNA) gene. The method by which VGAM2678 was detected is described hereinabove with reference to FIGS. 1-8.

VGAM2678 gene, herein designated VGAM GENE, is a viral gene contained in the genome of Ophiostoma Novo-ulmi Mitovirus 4-Ld. VGAM2678 host target gene, herein designated VGAM HOST TARGET GENE, is a human gene contained in the human genome.

VGAM2678 gene encodes a VGAM2678 precursor RNA, herein designated VGAM PRECURSOR RNA. Similar to other miRNA genes, and unlike most ordinary genes, VGAM2678 precursor RNA does not encode a protein. A nucleotide sequence identical or highly similar to the nucleotide sequence of VGAM2678 precursor RNA is designated SEQ ID:2664, and is provided hereinbelow with reference to the sequence listing part. Nucleotide sequence SEQ ID:2664 is located at position 1520 relative to the genome of Ophiostoma Novo-ulmi Mitovirus 4-Ld.

VGAM2678 precursor RNA folds onto itself, forming VGAM2678 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2678 folded precursor RNA into VGAM2678 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2678 RNA is designated SEQ ID:5389, and is provided hereinbelow with reference to the sequence listing part.

VGAM2678 host target gene, herein designated VGAM HOST TARGET GENE, encodes a corresponding messenger RNA, VGAM2678 host target RNA, herein designated VGAM HOST TARGET RNA. VGAM2678 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2678 RNA, herein designated VGAM RNA, binds complementarily to one or more host target binding sites located in untranslated regions of VGAM2678 host target RNA, herein designated VGAM HOST TARGET RNA. This complementary binding is due to the fact that the nucleotide sequence of VGAM2678 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2678 RNA, herein designated VGAM RNA, may have a different number of host target binding sites in untranslated regions of a VGAM2678 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2678 RNA, herein designated VGAM RNA, to host target binding sites on VGAM2678 host target RNA, herein designated VGAM HOST TARGET RNA, such as BINDING SITE I, BINDING SITE II and BINDING SITE III, inhibits translation of VGAM2678 host target RNA into VGAM2678 host target protein, herein designated VGAM HOST TARGET PROTEIN. VGAM host target protein is therefore outlined by a broken line.

It is appreciated that VGAM2678 host target gene, herein designated VGAM HOST TARGET GENE, in fact represents a plurality of VGAM2678 host target genes. The mRNA of each one of this plurality of VGAM2678 host target genes comprises one or more host target binding sites, each having a nucleotide sequence which is at least partly complementary to VGAM2678 RNA, herein designated VGAM RNA, and which when bound by VGAM2678 RNA causes inhibition of translation of respective one or more VGAM2678 host target proteins.

It is further appreciated by one skilled in the art that the mode of translational inhibition illustrated by FIG. 1 with specific reference to translational inhibition exerted by VGAM2678 gene, herein designated VGAM GENE, on one or more VGAM2678 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2678 is inhibition of expression of host target genes, as part of a novel viral mechanism of attacking a host. Accordingly, utilities of VGAM2678 include diagnosis, prevention and treatment of viral infection by Ophiostoma Novo-ulmi Mitovirus 4-Ld. Specific functions, and accordingly utilities, of VGAM2678 correlate with, and may be deduced from, the identity of the host target genes which VGAM2678 binds and inhibits, and the function of these host target genes, as elaborated hereinbelow.

Nucleotide sequences of the VGAM2678 precursor RNA, herein designated VGAM PRECURSOR RNA, and of the 'diced' VGAM2678 RNA, herein designated VGAM RNA, and a schematic representation of the secondary folding of VGAM2678 folded precursor RNA, herein designated VGAM FOLDED PRECURSOR RNA, of VGAM2678 are further described hereinbelow with reference to Table 1.

Nucleotide sequences of host target binding sites, such as BINDING SITE-I, BINDING SITE-II and BINDING SITE-III of FIG. 1, found on VGAM2678 host target RNA, and schematic representation of the complementarity of each of these host target binding sites to VGAM2678 RNA, herein designated VGAM RNA, are described hereinbelow with reference to Table 2.

As mentioned hereinabove with reference to FIG. 1, a function of VGAM2678 gene, herein designated VGAM is inhibition of expression of VGAM2678 target genes. It is appreciated that specific functions, and accordingly utilities, of VGAM2678 correlate with, and may be deduced from, the identity of the target genes which VGAM2678 binds and inhibits, and the function of these target genes, as elaborated hereinbelow.

Jagged 2 (JAG2, Accession NM_002226) is a VGAM2678 host target gene. JAG2 BINDING SITE is HOST TARGET binding site found in the 3' untranslated region of mRNA encoded by JAG2, corresponding to a HOST TARGET binding site such as BINDING SITE I, BINDING SITE II or BINDING SITE III. Table 2 illustrates the complementarity of the nucleotide sequences of JAG2 BINDING SITE, designated SEQ ID:8008, to the nucleotide sequence of VGAM2678 RNA, herein designated VGAM RNA, also designated SEQ ID:5389.

A function of VGAM2678 is therefore inhibition of Jagged 2 (JAG2, Accession NM_002226), a gene which is a putative notch ligand involved in the mediation of notch signaling. Accordingly, utilities of VGAM2678 include diagnosis, prevention and treatment of diseases and clinical conditions associated with JAG2. The function of JAG2 and its association with various diseases and clinical conditions, has been established by previous studies, as described hereinabove with reference to VGAM136. Mab-21-like 1 (C. elegans) (MAB21L1, Accession NM_005584) is another VGAM2678 host target gene. MAB21L1 BINDING SITE is HOST TARGET binding site found in the 3' untranslated region of mRNA encoded by MAB21L1, corresponding to a HOST TARGET binding site such as BINDING SITE I, BINDING SITE II or BINDING SITE III. Table 2 illustrates the complementarity of the nucleotide sequences of MAB21L1 BINDING SITE, designated SEQ ID:12114, to the nucleotide sequence of VGAM2678 RNA, herein designated VGAM RNA, also designated SEQ ID:5389.

Another function of VGAM2678 is therefore inhibition of Mab-21-like 1 (C. elegans) (MAB21L1, Accession NM_005584), a gene which may control cerebellum and eye development; very strongly similar to murine Mm.10798. Accordingly, utilities of VGAM2678 include diagnosis, prevention and treatment of diseases and clinical conditions associated with MAB21L1. The function of MAB21L1 and its association with various diseases and clinical conditions, has been established by previous studies, as described hereinabove with reference to VGAM39. Myotubular Myopathy 1 (MTM1, Accession NM_000252) is another VGAM2678 host target gene. MTM1 BINDING SITE is HOST TARGET binding site found in the 3' untranslated region of mRNA encoded by MTM1, corresponding to a HOST TARGET binding site such as BINDING SITE I, BINDING SITE II or BINDING SITE III. Table 2 illustrates the complementarity of the nucleotide sequences of MTM1 BINDING SITE, designated SEQ ID:5793, to the nucleotide sequence of VGAM2678 RNA, herein designated VGAM RNA, also designated SEQ ID:5389.

Another function of VGAM2678 is therefore inhibition of Myotubular Myopathy 1 (MTM1, Accession NM_000252). Accordingly, utilities of VGAM2678 include diagnosis, prevention and treatment of diseases and clinical conditions associated with MTM1. Von Hippel-Lindau Syndrome (VHL, Accession NM_000551) is another VGAM2678 host target gene. VHL BINDING SITE is HOST TARGET binding site found in the 3' untranslated region of mRNA encoded by VHL, corresponding to a HOST TARGET binding site such as BINDING SITE I, BINDING SITE II or BINDING SITE III. Table 2 illustrates the complementarity of the nucleotide sequences of VHL BINDING SITE, designated SEQ ID:6166, to the nucleotide sequence of VGAM2678 RNA, herein designated VGAM RNA, also designated SEQ ID:5389.

Another function of VGAM2678 is therefore inhibition of Von Hippel-Lindau Syndrome (VHL, Accession NM_000551), a gene which may control rna stability through the selective degradation of rna-bound proteins. Accordingly, utilities of VGAM2678 include diagnosis, prevention and treatment of diseases and clinical conditions associated with VHL. The function of VHL and its association with various diseases and clinical conditions, has been established by previous studies, as described hereinabove with reference to VGAM197. ANKT (Accession NM_016359) is another VGAM2678 host target gene. ANKT BINDING SITE is HOST TARGET binding site found in the 3' untranslated region of mRNA encoded by ANKT, corresponding to a HOST TARGET binding site such as BINDING SITE I, BINDING SITE II or BINDING SITE III. Table 2 illustrates the complementarity of the nucleotide sequences of ANKT BINDING SITE, designated SEQ ID:18500, to the nucleotide sequence of VGAM2678 RNA, herein designated VGAM RNA, also designated SEQ ID:5389.

Another function of VGAM2678 is therefore inhibition of ANKT (Accession NM_016359). Accordingly, utilities of VGAM2678 include diagnosis, prevention and treatment of diseases and clinical conditions associated with ANKT. DKFZP761L0424 (Accession XM_166112) is another VGAM2678 host target gene. DKFZP761L0424 BINDING SITE is HOST TARGET binding site found in the 3' untranslated region of mRNA encoded by DKFZP761L0424, corresponding to a HOST TARGET binding site such as BINDING SITE I, BINDING SITE II or BINDING SITE III. Table 2 illustrates the complementarity of the nucleotide sequences of DKFZP761L0424 BINDING SITE, designated SEQ ID:43892, to the nucleotide sequence of VGAM2678 RNA, herein designated VGAM RNA, also designated SEQ ID:5389.

Another function of VGAM2678 is therefore inhibition of DKFZP761L0424 (Accession XM_166112). Accordingly, utilities of VGAM2678 include diagnosis, prevention and treatment of diseases and clinical conditions associated with DKFZP761L0424. FLJ10852 (Accession NM_019028) is another VGAM2678 host target gene. FLJ10852 BINDING SITE is HOST TARGET binding site found in the 3' untranslated region of mRNA encoded by FLJ10852, corresponding to a HOST TARGET binding site such as BINDING SITE I, BINDING SITE II or BINDING SITE III. Table 2 illustrates the complementarity of the nucleotide sequences of FLJ10852 BINDING SITE, designated SEQ ID:21118, to the nucleotide sequence of VGAM2678 RNA, herein designated VGAM RNA, also designated SEQ ID:5389.

Another function of VGAM2678 is therefore inhibition of FLJ10852 (Accession NM_019028). Accordingly, utilities of VGAM2678 include diagnosis, prevention and treatment of diseases and clinical conditions associated with FLJ10852. FLJ22054 (Accession XM_170478) is another VGAM2678 host target gene. FLJ22054 BINDING SITE is HOST TARGET binding site found in the 3' untranslated region of mRNA encoded by FLJ22054, corresponding to a HOST TARGET binding site such as BINDING SITE I, BINDING SITE II or BINDING SITE III. Table 2 illustrates the complementarity of the nucleotide sequences of FLJ22054 BINDING SITE, designated SEQ ID:45320, to the nucleotide sequence of VGAM2678 RNA, herein designated VGAM RNA, also designated SEQ ID:5389.

Another function of VGAM2678 is therefore inhibition of FLJ22054 (Accession XM_170478). Accordingly, utilities of VGAM2678 include diagnosis, prevention and treatment of diseases and clinical conditions associated with FLJ22054. FLJ23259 (Accession NM_024727) is another VGAM2678 host target gene. FLJ23259 BINDING SITE is HOST TARGET binding site found in the 3' untranslated region of mRNA encoded by FLJ23259, corresponding to a HOST TARGET binding site such as BINDING SITE I, BINDING SITE II or BINDING SITE III. Table 2 illustrates the complementarity of the nucleotide sequences of FLJ23259 BINDING SITE, designated SEQ ID:24064, to the nucleotide sequence of VGAM2678 RNA, herein designated VGAM RNA, also designated SEQ ID:5389.

Another function of VGAM2678 is therefore inhibition of FLJ23259 (Accession NM_024727). Accordingly, utilities of VGAM2678 include diagnosis, prevention and treatment of diseases and clinical conditions associated with FLJ23259. HSMPP8 (Accession XM_167894) is another VGAM2678 host target gene. HSMPP8 BINDING SITE is HOST TARGET binding site found in the 3' untranslated region of mRNA encoded by HSMPP8, corresponding to a HOST TARGET binding site such as BINDING SITE I, BINDING SITE II or BINDING SITE III. Table 2 illustrates the complementarity of the nucleotide sequences of HSMPP8 BINDING SITE, designated SEQ ID:44906, to the nucleotide sequence of VGAM2678 RNA, herein designated VGAM RNA, also designated SEQ ID:5389.

Another function of VGAM2678 is therefore inhibition of HSMPP8 (Accession XM_167894). Accordingly, utilities of VGAM2678 include diagnosis, prevention and treatment of diseases and clinical conditions associated with HSMPP8. KIAA1014 (Accession XM_037205) is another VGAM2678 host target gene. KIAA1014 BINDING SITE is HOST TARGET binding site found in the 3' untranslated region of mRNA encoded by KIAA1014, corresponding to a HOST TARGET binding site such as BINDING SITE I, BINDING SITE II or BINDING SITE III. Table 2 illustrates the complementarity of the nucleotide sequences of KIAA1014 BINDING SITE, designated SEQ ID:32572, to the nucleotide sequence of VGAM2678 RNA, herein designated VGAM RNA, also designated SEQ ID:5389.

Another function of VGAM2678 is therefore inhibition of KIAA1014 (Accession XM_037205). Accordingly, utilities of VGAM2678 include diagnosis, prevention and treatment of diseases and clinical conditions associated with KIAA1014. MGC35558 (Accession NM_145013) is another VGAM2678 host target gene. MGC35558 BINDING SITE is HOST TARGET binding site found in the 3' untranslated region of mRNA encoded by MGC35558, corresponding to a HOST TARGET binding site such as BINDING SITE I, BINDING SITE II or BINDING SITE III. Table 2 illustrates the complementarity of the nucleotide sequences of MGC35558 BINDING SITE, designated SEQ ID:29618, to the nucleotide sequence of VGAM2678 RNA, herein designated VGAM RNA, also designated SEQ ID:5389.

Another function of VGAM2678 is therefore inhibition of MGC35558 (Accession NM_145013). Accordingly, utilities of VGAM2678 include diagnosis, prevention and treatment of diseases and clinical conditions associated with MGC35558. Spir-1 (Accession XM_035640) is another VGAM2678 host target gene. Spir-1 BINDING SITE is HOST TARGET binding site found in the 3' untranslated region of mRNA encoded by Spir-1, corresponding to a HOST TARGET binding site such as BINDING SITE I, BINDING SITE II or BINDING SITE III. Table 2 illustrates the complementarity of the nucleotide sequences of Spir-1 BINDING SITE, designated SEQ ID:32309, to the nucleotide sequence of VGAM2678 RNA, herein designated VGAM RNA, also designated SEQ ID:5389.

Another function of VGAM2678 is therefore inhibition of Spir-1 (Accession XM_035640). Accordingly, utilities of VGAM2678 include diagnosis, prevention and treatment of diseases and clinical conditions associated with Spir-1. ZFD25 (Accession NM_016220) is another VGAM2678 host target gene. ZFD25 BINDING SITE is HOST TARGET binding site found in the 3' untranslated region of mRNA encoded by ZFD25, corresponding to a HOST TARGET binding site such as BINDING SITE I, BINDING SITE II or BINDING SITE III. Table 2 illustrates the complementarity of the nucleotide sequences of ZFD25 BINDING SITE, designated SEQ ID:18326, to the nucleotide sequence of VGAM2678 RNA, herein designated VGAM RNA, also designated SEQ ID:5389.

Another function of VGAM2678 is therefore inhibition of ZFD25 (Accession NM_016220). Accordingly, utilities of VGAM2678 include diagnosis, prevention and treatment of diseases and clinical conditions associated with ZFD25. LOC157503 (Accession XM_098767) is another VGAM2678 host target gene. LOC157503 BINDING SITE is HOST TARGET binding site found in the 3' untranslated region of mRNA encoded by LOC157503, corresponding to a HOST TARGET binding site such as BINDING SITE I, BINDING SITE II or BINDING SITE III. Table 2 illustrates the complementarity of the nucleotide sequences of LOC157503 BINDING SITE, designated SEQ ID:41816, to the nucleotide sequence of VGAM2678 RNA, herein designated VGAM RNA, also designated SEQ ID:5389.

Another function of VGAM2678 is therefore inhibition of LOC157503 (Accession XM_098767). Accordingly, utilities of VGAM2678 include diagnosis, prevention and treatment of diseases and clinical conditions associated with LOC157503. LOC201475 (Accession XM_113967) is another VGAM2678 host target gene. LOC201475 BINDING SITE is HOST TARGET binding site found in the 3' untranslated region of mRNA encoded by LOC201475, corresponding to a HOST TARGET binding site such as BINDING SITE I, BINDING SITE II or BINDING SITE III. Table 2 illustrates the complementarity of the nucleotide sequences of LOC201475 BINDING SITE, designated SEQ ID:42579, to the nucleotide sequence of VGAM2678 RNA, herein designated VGAM RNA, also designated SEQ ID:5389.

Another function of VGAM2678 is therefore inhibition of LOC201475 (Accession XM_113967). Accordingly, utilities of VGAM2678 include diagnosis, prevention and treatment of diseases and clinical conditions associated with LOC201475. LOC221814 (Accession XM_168226) is another VGAM2678 host target gene. LOC221814 BIND- ING SITE is HOST TARGET binding site found in the 5' untranslated region of mRNA encoded by LOC221814, corresponding to a HOST TARGET binding site such as BINDING SITE I, BINDING SITE II or BINDING SITE III. Table 2 illustrates the complementarity of the nucleotide sequences of LOC221814 BINDING SITE, designated SEQ ID:45098, to the nucleotide sequence of VGAM2678 RNA, herein designated VGAM RNA, also designated SEQ ID:5389.

Another function of VGAM2678 is therefore inhibition of LOC221814 (Accession XM_168226). Accordingly, utilities of VGAM2678 include diagnosis, prevention and treatment of diseases and clinical conditions associated with LOC221814. FIG. 1 further provides a conceptual description of a novel bioinformatically detected viral gene of the present invention, referred to here as Viral Genomic Address Messenger 2679 (VGAM2679) viral gene, which modulates expression of respective host target genes thereof, the function and utility of which host target genes is known in the art.

VGAM2679 is a novel bioinformatically detected regulatory, non protein coding, viral micro RNA (miRNA) gene. The method by which VGAM2679 was detected is described hereinabove with reference to FIGS. 1-8.

VGAM2679 gene, herein designated VGAM GENE, is a viral gene contained in the genome of Ophiostoma Novo-ulmi Mitovirus 4-Ld. VGAM2679 host target gene, herein designated VGAM HOST TARGET GENE, is a human gene contained in the human genome.

VGAM2679 gene encodes a VGAM2679 precursor RNA, herein designated VGAM PRECURSOR RNA. Similar to other miRNA genes, and unlike most ordinary genes, VGAM2679 precursor RNA does not encode a protein. A nucleotide sequence identical or highly similar to the nucleotide sequence of VGAM2679 precursor RNA is designated SEQ ID:2665, and is provided hereinbelow with reference to the sequence listing part. Nucleotide sequence SEQ ID:2665 is located at position 676 relative to the genome of Ophiostoma Novo-ulmi Mitovirus 4-Ld.

VGAM2679 precursor RNA folds onto itself, forming VGAM2679 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2679 folded precursor RNA into VGAM2679 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2679 RNA is designated SEQ ID:5390, and is provided hereinbelow with reference to the sequence listing part.

VGAM2679 host target gene, herein designated VGAM HOST TARGET GENE, encodes a corresponding messenger RNA, VGAM2679 host target RNA, herein designated VGAM HOST TARGET RNA. VGAM2679 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2679 RNA, herein designated VGAM RNA, binds complementarily to one or more host target binding sites located in untranslated regions of VGAM2679 host target RNA, herein designated VGAM HOST TARGET RNA. This complementary binding is due to the fact that the nucleotide sequence of VGAM2679 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2679 RNA, herein designated VGAM RNA, may have a different number of host target binding sites in untranslated regions of a VGAM2679 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2679 RNA, herein designated VGAM RNA, to host target binding sites on VGAM2679 host target RNA, herein designated VGAM HOST TARGET RNA, such as BINDING SITE I, BINDING SITE II and BINDING SITE III, inhibits translation of VGAM2679 host target RNA into VGAM2679 host target protein, herein designated VGAM HOST TARGET PROTEIN. VGAM host target protein is therefore outlined by a broken line.

It is appreciated that VGAM2679 host target gene, herein designated VGAM HOST TARGET GENE, in fact represents a plurality of VGAM2679 host target genes. The mRNA of each one of this plurality of VGAM2679 host target genes comprises one or more host target binding sites, each having a nucleotide sequence which is at least partly complementary to VGAM2679 RNA, herein designated VGAM RNA, and which when bound by VGAM2679 RNA causes inhibition of translation of respective one or more VGAM2679 host target proteins.

It is further appreciated by one skilled in the art that the mode of translational inhibition illustrated by FIG. 1 with specific reference to translational inhibition exerted by VGAM2679 gene, herein designated VGAM GENE, on one or more VGAM2679 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2679 is inhibition of expression of host target genes, as part of a novel viral mechanism of attacking a host. Accordingly, utilities of VGAM2679 include diagnosis, prevention and treatment of viral infection by Ophiostoma Novo-ulmi Mitovirus 4-Ld. Specific functions, and accordingly utilities, of VGAM2679 correlate with, and may be deduced from, the identity of the host target genes which VGAM2679 binds and inhibits, and the function of these host target genes, as elaborated hereinbelow.

Nucleotide sequences of the VGAM2679 precursor RNA, herein designated VGAM PRECURSOR RNA, and of the 'diced' VGAM2679 RNA, herein designated VGAM RNA, and a schematic representation of the secondary folding of VGAM2679 folded precursor RNA, herein designated VGAM FOLDED PRECURSOR RNA, of VGAM2679 are further described hereinbelow with reference to Table 1.

Nucleotide sequences of host target binding sites, such as BINDING SITE-I, BINDING SITE-II and BINDING SITE-III of FIG. 1, found on VGAM2679 host target RNA, and schematic representation of the complementarity of each of these host target binding sites to VGAM2679 RNA, herein designated VGAM RNA, are described hereinbelow with reference to Table 2.

As mentioned hereinabove with reference to FIG. 1, a function of VGAM2679 gene, herein designated VGAM is inhibition of expression of VGAM2679 target genes. It is appreciated that specific functions, and accordingly utilities, of VGAM2679 correlate with, and may be deduced from, the identity of the target genes which VGAM2679 binds and inhibits, and the function of these target genes, as elaborated hereinbelow.

Basic Transcription Element Binding Protein 1 (BTEB1, Accession NM_001206) is a VGAM2679 host target gene. BTEB1 BINDING SITE is HOST TARGET binding site found in the 3' untranslated region of mRNA encoded by BTEB1, corresponding to a HOST TARGET binding site such as BINDING SITE I, BINDING SITE II or BINDING SITE III. Table 2 illustrates the complementarity of the nucleotide sequences of BTEB1 BINDING SITE, designated SEQ ID:6871, to the nucleotide sequence of VGAM2679 RNA, herein designated VGAM RNA, also designated SEQ ID:5390.

A function of VGAM2679 is therefore inhibition of Basic Transcription Element Binding Protein 1 (BTEB1, Accession NM_001206). Accordingly, utilities of VGAM2679 include diagnosis, prevention and treatment of diseases and clinical conditions associated with BTEB1. Nuclear Protein, Ataxia-telangiectasia Locus (NPAT, Accession XM_040846) is another VGAM2679 host target gene. NPAT BINDING SITE is HOST TARGET binding site found in the 3' untranslated region of mRNA encoded by NPAT, corresponding to a HOST TARGET binding site such as BINDING SITE I, BINDING SITE II or BINDING SITE III. Table 2 illustrates the complementarity of the nucleotide sequences of NPAT BINDING SITE, designated SEQ ID:33387, to the nucleotide sequence of VGAM2679 RNA, herein designated VGAM RNA, also designated SEQ ID:5390.

Another function of VGAM2679 is therefore inhibition of Nuclear Protein, Ataxia-telangiectasia Locus (NPAT, Accession XM_040846), a gene which is expressed in all tissues. Accordingly, utilities of VGAM2679 include diagnosis, prevention and treatment of diseases and clinical conditions associated with NPAT. The function of NPAT and its association with various diseases and clinical conditions, has been established by previous studies, as described hereinabove with reference to VGAM376. PRO0641 (Accession NM_014135) is another VGAM2679 host target gene. PRO0641 BINDING SITE is HOST TARGET binding site found in the 5' untranslated region of mRNA encoded by PRO0641, corresponding to a HOST TARGET binding site such as BINDING SITE I, BINDING SITE II or BINDING SITE III. Table 2 illustrates the complementarity of the nucleotide sequences of PRO0641 BINDING SITE, designated SEQ ID:15401, to the nucleotide sequence of VGAM2679 RNA, herein designated VGAM RNA, also designated SEQ ID:5390.

Another function of VGAM2679 is therefore inhibition of PRO0641 (Accession NM_014135). Accordingly, utilities of VGAM2679 include diagnosis, prevention and treatment of diseases and clinical conditions associated with PRO0641. RAB14, Member RAS Oncogene Family (RAB14, Accession NM_016322) is another VGAM2679 host target gene. RAB14 BINDING SITE is HOST TARGET binding site found in the 3' untranslated region of mRNA encoded by RAB14, corresponding to a HOST TARGET binding site such as BINDING SITE I, BINDING SITE II or BINDING SITE III. Table 2 illustrates the complementarity of the nucleotide sequences of RAB14 BINDING SITE, designated SEQ ID:18450, to the nucleotide sequence of VGAM2679 RNA, herein designated VGAM RNA, also designated SEQ ID:5390.

Another function of VGAM2679 is therefore inhibition of RAB14, Member RAS Oncogene Family (RAB14, Accession NM_016322). Accordingly, utilities of VGAM2679 include diagnosis, prevention and treatment of diseases and clinical conditions associated with RAB14. Wingless-type MMTV Integration Site Family, Member 2B (WNT2B, Accession NM_004185) is another VGAM2679 host target gene. WNT2B BINDING SITE1 and WNT2B BINDING SITE2 are HOST TARGET binding sites found in untranslated regions of mRNA encoded by WNT2B, corresponding to HOST TARGET binding sites such as BINDING SITE I, BINDING SITE II or BINDING SITE III. Table 2 illustrates the complementarity of the nucleotide sequences of WNT2B BINDING SITE1 and WNT2B BINDING SITE2, designated SEQ ID:10392 and SEQ ID:23693 respectively, to the nucleotide sequence of VGAM2679 RNA, herein designated VGAM RNA, also designated SEQ ID:5390.

Another function of VGAM2679 is therefore inhibition of Wingless-type MMTV Integration Site Family, Member 2B (WNT2B, Accession NM_004185). Accordingly, utilities of VGAM2679 include diagnosis, prevention and treatment of diseases and clinical conditions associated with WNT2B. FIG. 1 further provides a conceptual description of a novel bioinformatically detected viral gene of the present invention, referred to here as Viral Genomic Address Messenger 2680 (VGAM2680) viral gene, which modulates expression of respective host target genes thereof, the function and utility of which host target genes is known in the art.

VGAM2680 is a novel bioinformatically detected regulatory, non protein coding, viral micro RNA (miRNA) gene. The method by which VGAM2680 was detected is described hereinabove with reference to FIGS. 1-8.

VGAM2680 gene, herein designated VGAM GENE, is a viral gene contained in the genome of Ophiostoma Novo-ulmi Mitovirus 4-Ld. VGAM2680 host target gene, herein designated VGAM HOST TARGET GENE, is a human gene contained in the human genome.

VGAM2680 gene encodes a VGAM2680 precursor RNA, herein designated VGAM PRECURSOR RNA. Similar to other miRNA genes, and unlike most ordinary genes, VGAM2680 precursor RNA does not encode a protein. A nucleotide sequence identical or highly similar to the nucleotide sequence of VGAM2680 precursor RNA is designated SEQ ID:2666, and is provided hereinbelow with reference to the sequence listing part. Nucleotide sequence SEQ ID:2666 is located at position 316 relative to the genome of Ophiostoma Novo-ulmi Mitovirus 4-Ld.

VGAM2680 precursor RNA folds onto itself, forming VGAM2680 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2680 folded precursor RNA into VGAM2680 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM2680 RNA is designated SEQ ID:5391, and is provided hereinbelow with reference to the sequence listing part.

VGAM2680 host target gene, herein designated VGAM HOST TARGET GENE, encodes a corresponding messenger RNA, VGAM2680 host target RNA, herein designated VGAM HOST TARGET RNA. VGAM2680 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2680 RNA, herein designated VGAM RNA, binds complementarily to one or more host target binding sites located in untranslated regions of VGAM2680 host target RNA, herein designated VGAM HOST TARGET RNA. This complementary binding is due to the fact that the nucleotide sequence of VGAM2680 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2680 RNA, herein designated VGAM RNA, may have a different number of host target binding sites in untranslated regions of a VGAM2680 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2680 RNA, herein designated VGAM RNA, to host target binding sites on VGAM2680 host target RNA, herein designated VGAM HOST TARGET RNA, such as BINDING SITE I, BINDING SITE II and BINDING SITE III, inhibits translation of VGAM2680 host target RNA into VGAM2680 host target protein, herein designated VGAM HOST TARGET PROTEIN. VGAM host target protein is therefore outlined by a broken line.

It is appreciated that VGAM2680 host target gene, herein designated VGAM HOST TARGET GENE, in fact represents a plurality of VGAM2680 host target genes. The mRNA of each one of this plurality of VGAM2680 host target genes comprises one or more host target binding sites, each having a nucleotide sequence which is at least partly complementary to VGAM2680 RNA, herein designated VGAM RNA, and which when bound by VGAM2680 RNA causes inhibition of translation of respective one or more VGAM2680 host target proteins.

It is further appreciated by one skilled in the art that the mode of translational inhibition illustrated by FIG. 1 with specific reference to translational inhibition exerted by VGAM2680 gene, herein designated VGAM GENE, on one or more VGAM2680 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2680 is inhibition of expression of host target genes, as part of a novel viral mechanism of attacking a host. Accordingly, utilities of VGAM2680 include diagnosis, prevention and treatment of viral infection by Ophiostoma Novo-ulmi Mitovirus 4-Ld. Specific functions, and accordingly utilities, of VGAM2680 correlate with, and may be deduced from, the identity of the host target genes which VGAM2680 binds and inhibits, and the function of these host target genes, as elaborated hereinbelow.

Nucleotide sequences of the VGAM2680 precursor RNA, herein designated VGAM PRECURSOR RNA, and of the 'diced' VGAM2680 RNA, herein designated VGAM RNA, and a schematic representation of the secondary folding of VGAM2680 folded precursor RNA, herein designated VGAM FOLDED PRECURSOR RNA, of VGAM2680 are further described hereinbelow with reference to Table 1.

Nucleotide sequences of host target binding sites, such as BINDING SITE-I, BINDING SITE-II and BINDING SITE-III of FIG. 1, found on VGAM2680 host target RNA, and schematic representation of the complementarity of each of these host target binding sites to VGAM2680 RNA, herein designated VGAM RNA, are described hereinbelow with reference to Table 2.

As mentioned hereinabove with reference to FIG. 1, a function of VGAM2680 gene, herein designated VGAM is inhibition of expression of VGAM2680 target genes. It is appreciated that specific functions, and accordingly utilities, of VGAM2680 correlate with, and may be deduced from, the identity of the target genes which VGAM2680 binds and inhibits, and the function of these target genes, as elaborated hereinbelow.

A Disintegrin and Metalloproteinase Domain 10 (ADAM10, Accession NM_001110) is a VGAM2680 host target gene. ADAM10 BINDING SITE is HOST TARGET binding site found in the 3' untranslated region of mRNA encoded by ADAM10, corresponding to a HOST TARGET binding site such as BINDING SITE I, BINDING SITE II or BINDING SITE III. Table 2 illustrates the complementarity of the nucleotide sequences of ADAM10 BINDING SITE, designated SEQ ID:6767, to the nucleotide sequence of VGAM2680 RNA, herein designated VGAM RNA, also designated SEQ ID:5391.

A function of VGAM2680 is therefore inhibition of A Disintegrin and Metalloproteinase Domain 10 (ADAM10, Accession NM_001110), a gene which Member of ADAM family of zinc metalloproteases. Accordingly, utilities of VGAM2680 include diagnosis, prevention and treatment of diseases and clinical conditions associated with ADAM10. The function of ADAM10 and its association with various diseases and clinical conditions, has been established by previous studies, as described hereinabove with reference to VGAM706. Calcium Channel, Voltage-dependent, Gamma Subunit 2 (CACNG2, Accession NM_006078) is another VGAM2680 host target gene. CACNG2 BINDING SITE is HOST TARGET binding site found in the 5' untranslated region of mRNA encoded by CACNG2, corresponding to a HOST TARGET binding site such as BINDING SITE I, BINDING SITE II or BINDING SITE III. Table 2 illustrates the complementarity of the nucleotide sequences of CACNG2 BINDING SITE, designated SEQ ID:12724, to the nucleotide sequence of VGAM2680 RNA, herein designated VGAM RNA, also designated SEQ ID:5391.

Another function of VGAM2680 is therefore inhibition of Calcium Channel, Voltage-dependent, Gamma Subunit 2 (CACNG2, Accession NM_006078), a gene which is thought to stabilize the calcium channel in an inactivated (closed) state. Accordingly, utilities of VGAM2680 include diagnosis, prevention and treatment of diseases and clinical conditions associated with CACNG2. The function of CACNG2 has been established by previous studies. Chen et al. (2000) found that stargazer, an ataxic and epileptic mutant mouse, lacks functional AMPA receptors on cerebellar granule cells. Stargazin, the mutant protein, interacts with both AMPA receptor subunits and synaptic PDZ proteins, such as PSD95 (OMIM Ref. No. 602887). Chen et al. (2000) found that the interaction of stargazin with AMPA receptor subunits is essential for delivering functional receptors to the surface membrane of granule cells, whereas its binding with PSD95 and related PDZ proteins through a carboxy-terminal PDZ-binding domain is required for targeting the AMPA receptor to synapses. Expression of a mutant stargazin lacking the PDZ-binding domain in hippocampal pyramidal cells disrupts synaptic AMPA receptors, indicating that stargazin-like mechanisms for targeting AMPA receptors may be widespread in the central nervous syste. By searching an EST database for sequences homologous to mouse Cacng2, followed by PCR of a cerebellum cDNA library, Black and Lennon (1999) identified a cDNA encoding human CACNG2. The deduced 315-amino acid CACNG2 transmembrane protein is 98% identical to CACGN3 (OMIM Ref. No. 606403) and mouse Cacng2, but only 18% identical to CACNG1 (OMIM Ref. No. 114209).

Full details of the abovementioned studies are described in the following publications, the disclosure of which are hereby incorporated by reference:

Chen, L.; Chetkovich, D. M.; Petralla, R. S.; Sweeney, N. T.; Kawasaki, Y.; Wenthold, R. J.; Bredt, D. S.; Nicoli, R. A.: Stargazin regulates synaptic targeting of AMPA receptors by two distinct mechanisms. Nature 408:936-943, 2000; and Black, J. L., III; Lennon, V. A.: Identification and cloning of putative human neuronal voltage-gated calcium channel gamma-2 and gamma-3 subunits: neurologic implications. Mayo Clin.

Further studies establishing the function and utilities of CACNG2 are found in John Hopkins OMIM database record ID 602911, and in sited publications numbered 6188-6190 listed in the bibliography section hereinbelow, which are also hereby incorporated by reference. F-box and Leucine-rich Repeat Protein 3A (FBXL3A, Accession NM_012158) is another VGAM2680 host target gene. FBXL3A BINDING SITE is HOST TARGET binding site found in the 3' untranslated region of mRNA encoded by FBXL3A, corresponding to a HOST TARGET binding site such as BINDING SITE I, BINDING SITE II or BINDING SITE III. Table 2 illustrates the complementarity of the nucleotide sequences of FBXL3A BINDING SITE, designated SEQ ID:14458, to the nucleotide sequence of VGAM2680 RNA, herein designated VGAM RNA, also designated SEQ ID:5391.

Another function of VGAM2680 is therefore inhibition of F-box and Leucine-rich Repeat Protein 3A (FBXL3A, Accession NM_012158), a gene which is a putative SCF ubiquitin ligase subunit involved in protein degradation. Accordingly, utilities of VGAM2680 include diagnosis, prevention and treatment of diseases and clinical conditions associated with FBXL3A. The function of FBXL3A and its association with various diseases and clinical conditions, has been established by previous studies, as described hereinabove with reference to VGAM1172. Hepatocyte Growth Factor (hepapoietin A; scatter factor) (HGF, Accession XM_168542) is another VGAM2680 host target gene. HGF BINDING SITE is HOST TARGET binding site found in the 3' untranslated region of mRNA encoded by HGF, corresponding to a HOST TARGET binding site such as BINDING SITE I, BINDING SITE II or BINDING SITE III. Table 2 illustrates the complementarity of the nucleotide sequences of HGF BINDING SITE, designated SEQ ID:45227, to the nucleotide sequence of VGAM2680 RNA, herein designated VGAM RNA, also designated SEQ ID:5391.

Another function of VGAM2680 is therefore inhibition of Hepatocyte Growth Factor (hepapoietin A; scatter factor) (HGF, Accession XM_168542), a gene which may be required for normal embryonic development; strongly similar to murine Hgf, has kringle domains. Accordingly, utilities of VGAM2680 include diagnosis, prevention and treatment of diseases and clinical conditions associated with HGF. The function of HGF and its association with various diseases and clinical conditions, has been established by previous studies, as described hereinabove with reference to VGAM174. Phosphorylase, Glycogen; Brain (PYGB, Accession NM_002862) is another VGAM2680 host target gene. PYGB BINDING SITE is HOST TARGET binding site found in the 3' untranslated region of mRNA encoded by PYGB, corresponding to a HOST TARGET binding site such as BINDING SITE I, BINDING SITE II or BINDING SITE III. Table 2 illustrates the complementarity of the nucleotide sequences of PYGB BINDING SITE, designated SEQ ID:8765, to the nucleotide sequence of VGAM2680 RNA, herein designated VGAM RNA, also designated SEQ ID:5391.

Another function of VGAM2680 is therefore inhibition of Phosphorylase, Glycogen; Brain (PYGB, Accession NM_002862). Accordingly, utilities of VGAM2680 include diagnosis, prevention and treatment of diseases and clinical conditions associated with PYGB. DKFZp564K142 (Accession NM_032121) is another VGAM2680 host target gene. DKFZp564K142 BINDING SITE is HOST TARGET binding site found in the 3' untranslated region of mRNA encoded by DKFZp564K142, corresponding to a HOST TARGET binding site such as BINDING SITE I, BINDING SITE II or BINDING SITE III. Table 2 illustrates the complementarity of the nucleotide sequences of DKFZp564K142 BINDING SITE, designated SEQ ID:25806, to the nucleotide sequence of VGAM2680 RNA, herein designated VGAM RNA, also designated SEQ ID:5391.

Another function of VGAM2680 is therefore inhibition of DKFZp564K142 (Accession NM_032121). Accordingly, utilities of VGAM2680 include diagnosis, prevention and treatment of diseases and clinical conditions associated with DKFZp564K142. KIAA0429 (Accession NM_014751) is another VGAM2680 host target gene. KIAA0429 BINDING SITE is HOST TARGET binding site found in the 5' untranslated region of mRNA encoded by KIAA0429, corresponding to a HOST TARGET binding site such as BINDING SITE I, BINDING SITE II or BINDING SITE III. Table 2 illustrates the complementarity of the nucleotide sequences of KIAA0429 BINDING SITE, designated SEQ ID:16470, to the nucleotide sequence of VGAM2680 RNA, herein designated VGAM RNA, also designated SEQ ID:5391.

Another function of VGAM2680 is therefore inhibition of KIAA0429 (Accession NM_014751). Accordingly, utilities of VGAM2680 include diagnosis, prevention and treatment of diseases and clinical conditions associated with KIAA0429. KIAA1691 (Accession XM_166523) is another VGAM2680 host target gene. KIAA1691 BINDING SITE is HOST TARGET binding site found in the 3' untranslated region of mRNA encoded by KIAA1691, corresponding to a HOST TARGET binding site such as BINDING SITE I, BINDING SITE II or BINDING SITE III. Table 2 illustrates the complementarity of the nucleotide sequences of KIAA1691 BINDING SITE, designated SEQ ID:44465, to the nucleotide sequence of VGAM2680 RNA, herein designated VGAM RNA, also designated SEQ ID:5391.

Another function of VGAM2680 is therefore inhibition of KIAA1691 (Accession XM_166523). Accordingly, utilities of VGAM2680 include diagnosis, prevention and treatment of diseases and clinical conditions associated with KIAA1691. MGC3248 (Accession NM_032486) is another VGAM2680 host target gene. MGC3248 BINDING SITE is HOST TARGET binding site found in the 3' untranslated region of mRNA encoded by MGC3248, corresponding to a HOST TARGET binding site such as BINDING SITE I, BINDING SITE II or BINDING SITE III. Table 2 illustrates the complementarity of the nucleotide sequences of MGC3248 BINDING SITE, designated SEQ ID:26233, to the nucleotide sequence of VGAM2680 RNA, herein designated VGAM RNA, also designated SEQ ID:5391.

Another function of VGAM2680 is therefore inhibition of MGC3248 (Accession NM_032486). Accordingly, utilities of VGAM2680 include diagnosis, prevention and treatment of diseases and clinical conditions associated with MGC3248. Monocyte to Macrophage Differentiation-associated (MMD, Accession XM_008269) is another VGAM2680 host target gene. MMD BINDING SITE is HOST TARGET binding site found in the 3' untranslated region of mRNA encoded by MMD, corresponding to a HOST TARGET binding site such as BINDING SITE I, BINDING SITE II or BINDING SITE III. Table 2 illustrates the complementarity of the nucleotide sequences of MMD BINDING SITE, designated SEQ ID:30077, to the nucleotide sequence of VGAM2680 RNA, herein designated VGAM RNA, also designated SEQ ID:5391.

Another function of VGAM2680 is therefore inhibition of Monocyte to Macrophage Differentiation-associated (MMD, Accession XM_008269). Accordingly, utilities of VGAM2680 include diagnosis, prevention and treatment of diseases and clinical conditions associated with MMD. Phorbol-12-myristate-13-acetate-induced Protein 1 (PMAIP1, Accession NM_021127) is another VGAM2680 host target gene. PMAIP1 BINDING SITE is HOST TARGET binding site found in the 3' untranslated region of mRNA encoded by PMAIP1, corresponding to a HOST TARGET binding site such as BINDING SITE I, BINDING SITE II or BINDING SITE III. Table 2 illustrates the complementarity of the nucleotide sequences of PMAIP1 BINDING SITE, designated SEQ ID:22103, to the nucleotide sequence of VGAM2680 RNA, herein designated VGAM RNA, also designated SEQ ID:5391.

Another function of VGAM2680 is therefore inhibition of Phorbol-12-myristate-13-acetate-induced Protein 1 (PMAIP1, Accession NM_021127). Accordingly, utilities of VGAM2680 include diagnosis, prevention and treatment of diseases and clinical conditions associated with PMAIP1. PRO0611 (Accession NM_014076) is another VGAM2680 host target gene. PRO0611 BINDING SITE is HOST TARGET binding site found in the 5' untranslated region of mRNA encoded by PRO0611, corresponding to a HOST TARGET binding site such as BINDING SITE I, BINDING SITE II or BINDING SITE III. Table 2 illustrates the complementarity of the nucleotide sequences of PRO0611 BINDING SITE, designated SEQ ID:15303, to the nucleotide sequence of VGAM2680 RNA, herein designated VGAM RNA, also designated SEQ ID:5391.

Another function of VGAM2680 is therefore inhibition of PRO0611 (Accession NM_014076). Accordingly, utilities of VGAM2680 include diagnosis, prevention and treatment of diseases and clinical conditions associated with PRO0611. SE57-1 (Accession NM_025214) is another VGAM2680 host target gene. SE57-1 BINDING SITE is HOST TARGET binding site found in the 3' untranslated region of mRNA encoded by SE57-1, corresponding to a HOST TARGET binding site such as BINDING SITE I, BINDING SITE II or BINDING SITE III. Table 2 illustrates the complementarity of the nucleotide sequences of SE57-1 BINDING SITE, designated SEQ ID:24891, to the nucleotide sequence of VGAM2680 RNA, herein designated VGAM RNA, also designated SEQ ID:5391.

Another function of VGAM2680 is therefore inhibition of SE57-1 (Accession NM_025214). Accordingly, utilities of VGAM2680 include diagnosis, prevention and treatment of diseases and clinical conditions associated with SE57-1. LOC127255 (Accession NM_145258) is another VGAM2680 host target gene. LOC127255 BINDING SITE is HOST TARGET binding site found in the 3' untranslated region of mRNA encoded by LOC127255, corresponding to a HOST TARGET binding site such as BINDING SITE I, BINDING SITE II or BINDING SITE III. Table 2 illustrates the complementarity of the nucleotide sequences of LOC127255 BINDING SITE, designated SEQ ID:29775, to the nucleotide sequence of VGAM2680 RNA, herein designated VGAM RNA, also designated SEQ ID:5391.

Another function of VGAM2680 is therefore inhibition of LOC127255 (Accession NM_145258). Accordingly, utilities of VGAM2680 include diagnosis, prevention and treatment of diseases and clinical conditions associated with LOC127255. FIG. 1 further provides a conceptual description of a novel bioinformatically detected viral gene of the present invention, referred to here as Viral Genomic Address Messenger 2681 (VGAM2681) viral gene, which modulates expression of respective host target genes thereof, the function and utility of which host target genes is known in the art.

VGAM2681 is a novel bioinformatically detected regulatory, non protein coding, viral micro RNA (miRNA) gene. The method by which VGAM2681 was detected is described hereinabove with reference to FIGS. 1-8.

VGAM2681 gene, herein designated VGAM GENE, is a viral gene contained in the genome of Ophiostoma Novo-ulmi Mitovirus 4-Ld. VGAM2681 host target gene, herein designated VGAM HOST TARGET GENE, is a human gene contained in the human genome.

VGAM2681 gene encodes a VGAM2681 precursor RNA, herein designated VGAM PRECURSOR RNA. Similar to other miRNA genes, and unlike most ordinary genes, VGAM2681 precursor RNA does not encode a protein. A nucleotide sequence identical or highly similar to the nucleotide sequence of VGAM2681 precursor RNA is designated SEQ ID:2667, and is provided hereinbelow with reference to the sequence listing part. Nucleotide sequence SEQ ID:2667 is located at position 2192 relative to the genome of Ophiostoma Novo-ulmi Mitovirus 4-Ld.

VGAM2681 precursor RNA folds onto itself, forming VGAM2681 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2681 folded precursor RNA into VGAM2681 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2681 RNA is designated SEQ ID:5392, and is provided hereinbelow with reference to the sequence listing part.

VGAM2681 host target gene, herein designated VGAM HOST TARGET GENE, encodes a corresponding messenger RNA, VGAM2681 host target RNA, herein designated VGAM HOST TARGET RNA. VGAM2681 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2681 RNA, herein designated VGAM RNA, binds complementarily to one or more host target binding sites located in untranslated regions of VGAM2681 host target RNA, herein designated VGAM HOST TARGET RNA. This complementary binding is due to the fact that the nucleotide sequence of VGAM2681 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2681 RNA, herein designated VGAM RNA, may have a different number of host target binding sites in untranslated regions of a VGAM2681 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2681 RNA, herein designated VGAM RNA, to host target binding sites on VGAM2681 host target RNA, herein designated VGAM HOST TARGET RNA, such as BINDING SITE I, BINDING SITE II and BINDING SITE III, inhibits translation of VGAM2681 host target RNA into VGAM2681 host target protein, herein designated VGAM HOST TARGET PROTEIN. VGAM host target protein is therefore outlined by a broken line.

It is appreciated that VGAM2681 host target gene, herein designated VGAM HOST TARGET GENE, in fact represents a plurality of VGAM2681 host target genes. The mRNA of each one of this plurality of VGAM2681 host target genes comprises one or more host target binding sites, each having a nucleotide sequence which is at least partly complementary to VGAM2681 RNA, herein designated VGAM RNA, and which when bound by VGAM2681 RNA causes inhibition of translation of respective one or more VGAM2681 host target proteins.

It is further appreciated by one skilled in the art that the mode of translational inhibition illustrated by FIG. 1 with specific reference to translational inhibition exerted by VGAM2681 gene, herein designated VGAM GENE, on one or more VGAM2681 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2681 is inhibition of expression of host target genes, as part of a novel viral mechanism of attacking a host. Accordingly, utilities of VGAM2681 include diagnosis, prevention and treatment of viral infection by Ophiostoma Novo-ulmi Mitovirus 4-Ld. Specific functions, and accordingly utilities, of VGAM2681 correlate with, and may be deduced from, the identity of the host target genes which VGAM2681 binds and inhibits, and the function of these host target genes, as elaborated hereinbelow.

Nucleotide sequences of the VGAM2681 precursor RNA, herein designated VGAM PRECURSOR RNA, and of the 'diced' VGAM2681 RNA, herein designated VGAM RNA, and a schematic representation of the secondary folding of VGAM2681 folded precursor RNA, herein designated VGAM FOLDED PRECURSOR RNA, of VGAM2681 are further described hereinbelow with reference to Table 1.

Nucleotide sequences of host target binding sites, such as BINDING SITE-I, BINDING SITE-II and BINDING SITE-III of FIG. 1, found on VGAM2681 host target RNA, and schematic representation of the complementarity of each of these host target binding sites to VGAM2681 RNA, herein designated VGAM RNA, are described hereinbelow with reference to Table 2.

As mentioned hereinabove with reference to FIG. 1, a function of VGAM2681 gene, herein designated VGAM is inhibition of expression of VGAM2681 target genes. It is appreciated that specific functions, and accordingly utilities, of VGAM2681 correlate with, and may be deduced from, the identity of the target genes which VGAM2681 binds and inhibits, and the function of these target genes, as elaborated hereinbelow.

FLJ13456 (Accession XM_038291) is a VGAM2681 host target gene. FLJ13456 BINDING SITE is HOST TARGET binding site found in the 3' untranslated region of mRNA encoded by FLJ13456, corresponding to a HOST TARGET binding site such as BINDING SITE I, BINDING SITE II or BINDING SITE III. Table 2 illustrates the complementarity of the nucleotide sequences of FLJ13456 BINDING SITE, designated SEQ ID:32797, to the nucleotide sequence of VGAM2681 RNA, herein designated VGAM RNA, also designated SEQ ID:5392.

A function of VGAM2681 is therefore inhibition of FLJ13456 (Accession XM_038291). Accordingly, utilities of VGAM2681 include diagnosis, prevention and treatment of diseases and clinical conditions associated with FLJ13456. KIAA1979 (Accession XM_113984) is another VGAM2681 host target gene. KIAA1979 BINDING SITE is HOST TARGET binding site found in the 5' untranslated region of mRNA encoded by KIAA1979, corresponding to a HOST TARGET binding site such as BINDING SITE I, BINDING SITE II or BINDING SITE III. Table 2 illustrates the complementarity of the nucleotide sequences of KIAA1979 BINDING SITE, designated SEQ ID:42590, to the nucleotide sequence of VGAM2681 RNA, herein designated VGAM RNA, also designated SEQ ID:5392.

Another function of VGAM2681 is therefore inhibition of KIAA1979 (Accession XM_113984). Accordingly, utilities of VGAM2681 include diagnosis, prevention and treatment of diseases and clinical conditions associated with KIAA1979. MGC32104 (Accession NM_144684) is another VGAM2681 host target gene. MGC32104 BINDING SITE is HOST TARGET binding site found in the 3' untranslated region of mRNA encoded by MGC32104, corresponding to a HOST TARGET binding site such as BINDING SITE I, BINDING SITE II or BINDING SITE III. Table 2 illustrates the complementarity of the nucleotide sequences of MGC32104 BINDING SITE, designated SEQ ID:29501, to the nucleotide sequence of VGAM2681 RNA, herein designated VGAM RNA, also designated SEQ ID:5392.

Another function of VGAM2681 is therefore inhibition of MGC32104 (Accession NM_144684). Accordingly, utilities of VGAM2681 include diagnosis, prevention and treatment of diseases and clinical conditions associated with MGC32104. FIG. 1 further provides a conceptual description of a novel bioinformatically detected viral gene of the present invention, referred to here as Viral Genomic Address Messenger 2682 (VGAM2682) viral gene, which modulates expression of respective host target genes thereof, the function and utility of which host target genes is known in the art.

VGAM2682 is a novel bioinformatically detected regulatory, non protein coding, viral micro RNA (miRNA) gene. The method by which VGAM2682 was detected is described hereinabove with reference to FIGS. 1-8.

VGAM2682 gene, herein designated VGAM GENE, is a viral gene contained in the genome of Ophiostoma Novo-ulmi Mitovirus 4-Ld. VGAM2682 host target gene, herein designated VGAM HOST TARGET GENE, is a human gene contained in the human genome.

VGAM2682 gene encodes a VGAM2682 precursor RNA, herein designated VGAM PRECURSOR RNA. Similar to other miRNA genes, and unlike most ordinary genes, VGAM2682 precursor RNA does not encode a protein. A nucleotide sequence identical or highly similar to the nucleotide sequence of VGAM2682 precursor RNA is designated SEQ ID:2668, and is provided hereinbelow with reference to the sequence listing part. Nucleotide sequence SEQ ID:2668 is located at position 1099 relative to the genome of Ophiostoma Novo-ulmi Mitovirus 4-Ld.

VGAM2682 precursor RNA folds onto itself, forming VGAM2682 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2682 folded precursor RNA into VGAM2682 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2682 RNA is designated SEQ ID:5393, and is provided hereinbelow with reference to the sequence listing part.

VGAM2682 host target gene, herein designated VGAM HOST TARGET GENE, encodes a corresponding messenger RNA, VGAM2682 host target RNA, herein designated VGAM HOST TARGET RNA. VGAM2682 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2682 RNA, herein designated VGAM RNA, binds complementarily to one or more host target binding sites located in untranslated regions of VGAM2682 host target RNA, herein designated VGAM HOST TARGET RNA. This complementary binding is due to the fact that the nucleotide sequence of VGAM2682 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2682 RNA, herein designated VGAM RNA, may have a different number of host target binding sites in untranslated regions of a VGAM2682 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2682 RNA, herein designated VGAM RNA, to host target binding sites on VGAM2682 host target RNA, herein designated VGAM HOST TARGET RNA, such as BINDING SITE I, BINDING SITE II and BINDING SITE III, inhibits translation of VGAM2682 host target RNA into VGAM2682 host target protein, herein designated VGAM HOST TARGET PROTEIN. VGAM host target protein is therefore outlined by a broken line.

It is appreciated that VGAM2682 host target gene, herein designated VGAM HOST TARGET GENE, in fact represents a plurality of VGAM2682 host target genes. The mRNA of each one of this plurality of VGAM2682 host target genes comprises one or more host target binding sites, each having a nucleotide sequence which is at least partly complementary to VGAM2682 RNA, herein designated VGAM RNA, and which when bound by VGAM2682 RNA causes inhibition of translation of respective one or more VGAM2682 host target proteins.

It is further appreciated by one skilled in the art that the mode of translational inhibition illustrated by FIG. 1 with specific reference to translational inhibition exerted by VGAM2682 gene, herein designated VGAM GENE, on one or more VGAM2682 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2682 is inhibition of expression of host target genes, as part of a novel viral mechanism of attacking a host. Accordingly, utilities of VGAM2682 include diagnosis, prevention and treatment of viral infection by Ophiostoma Novo-ulmi Mitovirus 4-Ld. Specific functions, and accordingly utilities, of VGAM2682 correlate with, and may be deduced from, the identity of the host target genes which VGAM2682 binds and inhibits, and the function of these host target genes, as elaborated hereinbelow.

Nucleotide sequences of the VGAM2682 precursor RNA, herein designated VGAM PRECURSOR RNA, and of the 'diced' VGAM2682 RNA, herein designated VGAM RNA, and a schematic representation of the secondary folding of VGAM2682 folded precursor RNA, herein designated VGAM FOLDED PRECURSOR RNA, of VGAM2682 are further described hereinbelow with reference to Table 1.

Nucleotide sequences of host target binding sites, such as BINDING SITE-I, BINDING SITE-II and BINDING SITE-III of FIG. 1, found on VGAM2682 host target RNA, and schematic representation of the complementarity of each of these host target binding sites to VGAM2682 RNA, herein designated VGAM RNA, are described hereinbelow with reference to Table 2.

As mentioned hereinabove with reference to FIG. 1, a function of VGAM2682 gene, herein designated VGAM is inhibition of expression of VGAM2682 target genes. It is appreciated that specific functions, and accordingly utilities, of VGAM2682 correlate with, and may be deduced from, the identity of the target genes which VGAM2682 binds and inhibits, and the function of these target genes, as elaborated hereinbelow.

Fc Fragment of IgA, Receptor For (FCAR, Accession NM_002000) is a VGAM2682 host target gene. FCAR BINDING SITE1 through FCAR BINDING SITE7 are HOST TARGET binding sites found in untranslated regions of mRNA encoded by FCAR, corresponding to HOST TARGET binding sites such as BINDING SITE I, BINDING SITE II or BINDING SITE III. Table 2 illustrates the complementarity of the nucleotide sequences of FCAR BINDING SITE1 through FCAR BINDING SITE7, designated SEQ ID:7729, SEQ ID:28429, SEQ ID:28431, SEQ ID:28434, SEQ ID:28435, SEQ ID:28425 and SEQ ID:28427 respectively, to the nucleotide sequence of VGAM2682 RNA, herein designated VGAM RNA, also designated SEQ ID:5393.

A function of VGAM2682 is therefore inhibition of Fc Fragment of IgA, Receptor For (FCAR, Accession NM_002000), a gene which binds to the fc region of immunoglobulins alpha and mediates several functions including cytokine production. Accordingly, utilities of VGAM2682 include diagnosis, prevention and treatment of diseases and clinical conditions associated with FCAR. The function of FCAR and its association with various diseases and clinical conditions, has been established by previous studies, as described hereinabove with reference to VGAM923. Tyrosine 3-monooxygenase/tryptophan 5-monooxygenase Activation Protein, Eta Polypeptide (YWHAH, Accession NM_003405) is another VGAM2682 host target gene. YWHAH BINDING SITE is HOST TARGET binding site found in the 3' untranslated region of mRNA encoded by YWHAH, corresponding to a HOST TARGET binding site such as BINDING SITE I, BINDING SITE II or BINDING SITE III. Table 2 illustrates the complementarity of the nucleotide sequences of YWHAH BINDING SITE, designated SEQ ID:9440, to the nucleotide sequence of VGAM2682 RNA, herein designated VGAM RNA, also designated SEQ ID:5393.

Another function of VGAM2682 is therefore inhibition of Tyrosine 3-monooxygenase/tryptophan 5-monooxygenase Activation Protein, Eta Polypeptide (YWHAH, Accession NM_003405), a gene which activates tyrosine and tryptophan hydroxylases in the presence of and strongly activates protein kinase c. Accordingly, utilities of VGAM2682 include diagnosis, prevention and treatment of diseases and clinical conditions associated with YWHAH. The function of YWHAH and its association with various diseases and clinical conditions, has been established by previous studies, as described hereinabove with reference to VGAM1923. Zinc Finger Protein 10 (KOX 1) (ZNF10, Accession NM_015394) is another VGAM2682 host target gene. ZNF10 BINDING SITE is HOST TARGET binding site found in the 3' untranslated region of mRNA encoded by ZNF10, corresponding to a HOST TARGET binding site such as BINDING SITE I, BINDING SITE II or BINDING SITE III. Table 2 illustrates the complementarity of the nucleotide sequences of ZNF10 BINDING SITE, designated SEQ ID:17697, to the nucleotide sequence of VGAM2682 RNA, herein designated VGAM RNA, also designated SEQ ID:5393.

Another function of VGAM2682 is therefore inhibition of Zinc Finger Protein 10 (KOX 1) (ZNF10, Accession NM_015394), a gene which may function as a transcriptional regulator. Accordingly, utilities of VGAM2682 include diagnosis, prevention and treatment of diseases and clinical conditions associated with ZNF10. The function of ZNF10 and its association with various diseases and clinical conditions, has been established by previous studies, as described hereinabove with reference to VGAM36. DC8 (Accession NM_015471) is another VGAM2682 host target gene. DC8 BINDING SITE is HOST TARGET binding site found in the 3' untranslated region of mRNA encoded by DC8, corresponding to a HOST TARGET binding site such as BINDING SITE I, BINDING SITE II or BINDING SITE III. Table 2 illustrates the complementarity of the nucleotide sequences of DC8 BINDING SITE, designated SEQ ID:17752, to the nucleotide sequence of VGAM2682 RNA, herein designated VGAM RNA, also designated SEQ ID:5393.

Another function of VGAM2682 is therefore inhibition of DC8 (Accession NM_015471). Accordingly, utilities of VGAM2682 include diagnosis, prevention and treatment of diseases and clinical conditions associated with DC8. DNA Cross-link Repair 1A (PSO2 homolog, S. cerevisiae) (DCLRE1A, Accession XM_044815) is another VGAM2682 host target gene. DCLRE1A BINDING SITE is HOST TARGET binding site found in the 3' untranslated region of mRNA encoded by DCLRE1A, corresponding to a HOST TARGET binding site such as BINDING SITE I, BINDING SITE II or BINDING SITE III. Table 2 illustrates the complementarity of the nucleotide sequences of DCLRE1A BINDING SITE, designated SEQ ID:34283, to the nucleotide sequence of VGAM2682 RNA, herein designated VGAM RNA, also designated SEQ ID:5393.

Another function of VGAM2682 is therefore inhibition of DNA Cross-link Repair 1A (PSO2 homolog, S. cerevisiae) (DCLRE1A, Accession XM_044815). Accordingly, utilities of VGAM2682 include diagnosis, prevention and treatment of diseases and clinical conditions associated with DCLRE1A. FLJ10704 (Accession NM_018185) is another VGAM2682 host target gene. FLJ10704 BINDING SITE is HOST TARGET binding site found in the 3' untranslated region of mRNA encoded by FLJ10704, corresponding to a HOST TARGET binding site such as BINDING SITE I, BINDING SITE II or BINDING SITE III. Table 2 illustrates the complementarity of the nucleotide sequences of FLJ10704 BINDING SITE, designated SEQ ID:20035, to the nucleotide sequence of VGAM2682 RNA, herein designated VGAM RNA, also designated SEQ ID:5393.

Another function of VGAM2682 is therefore inhibition of FLJ10704 (Accession NM_018185). Accordingly, utilities of VGAM2682 include diagnosis, prevention and treatment of diseases and clinical conditions associated with FLJ10704.

FLJ23151 (Accession NM_024772) is another VGAM2682 host target gene. FLJ23151 BINDING SITE is HOST TARGET binding site found in the 3' untranslated region of mRNA encoded by FLJ23151, corresponding to a HOST TARGET binding site such as BINDING SITE I, BINDING SITE II or BINDING SITE III. Table 2 illustrates the complementarity of the nucleotide sequences of FLJ23151 BINDING SITE, designated SEQ ID:24136, to the nucleotide sequence of VGAM2682 RNA, herein designated VGAM RNA, also designated SEQ ID:5393.

Another function of VGAM2682 is therefore inhibition of FLJ23151 (Accession NM_024772). Accordingly, utilities of VGAM2682 include diagnosis, prevention and treatment of diseases and clinical conditions associated with FLJ23151. Nucleoporin 160 kDa (NUP160, Accession XM_113678) is another VGAM2682 host target gene. NUP160 BINDING SITE is HOST TARGET binding site found in the 3' untranslated region of mRNA encoded by NUP160, corresponding to a HOST TARGET binding site such as BINDING SITE I, BINDING SITE II or BINDING SITE III. Table 2 illustrates the complementarity of the nucleotide sequences of NUP160 BINDING SITE, designated SEQ ID:42328, to the nucleotide sequence of VGAM2682 RNA, herein designated VGAM RNA, also designated SEQ ID:5393.

Another function of VGAM2682 is therefore inhibition of Nucleoporin 160kDa (NUP160, Accession XM_113678). Accordingly, utilities of VGAM2682 include diagnosis, prevention and treatment of diseases and clinical conditions associated with NUP160. LOC151996 (Accession XM_098151) is another VGAM2682 host target gene. LOC151996 BINDING SITE is HOST TARGET binding site found in the 5' untranslated region of mRNA encoded by LOC151996, corresponding to a HOST TARGET binding site such as BINDING SITE I, BINDING SITE II or BINDING SITE III. Table 2 illustrates the complementarity of the nucleotide sequences of LOC151996 BINDING SITE, designated SEQ ID:41417, to the nucleotide sequence of VGAM2682 RNA, herein designated VGAM RNA, also designated SEQ ID:5393.

Another function of VGAM2682 is therefore inhibition of LOC151996 (Accession XM_098151). Accordingly, utilities of VGAM2682 include diagnosis, prevention and treatment of diseases and clinical conditions associated with LOC151996. LOC221596 (Accession XM_166331) is another VGAM2682 host target gene. LOC221596 BINDING SITE is HOST TARGET binding site found in the 5' untranslated region of mRNA encoded by LOC221596, corresponding to a HOST TARGET binding site such as BINDING SITE I, BINDING SITE II or BINDING SITE III. Table 2 illustrates the complementarity of the nucleotide sequences of LOC221596 BINDING SITE, designated SEQ ID:44173, to the nucleotide sequence of VGAM2682 RNA, herein designated VGAM RNA, also designated SEQ ID:5393.

Another function of VGAM2682 is therefore inhibition of LOC221596 (Accession XM_166331). Accordingly, utilities of VGAM2682 include diagnosis, prevention and treatment of diseases and clinical conditions associated with LOC221596. LOC256073 (Accession XM_172972) is another VGAM2682 host target gene. LOC256073 BINDING SITE is HOST TARGET binding site found in the 3' untranslated region of mRNA encoded by LOC256073, corresponding to a HOST TARGET binding site such as BINDING SITE I, BINDING SITE II or BINDING SITE III. Table 2 illustrates the complementarity of the nucleotide sequences of LOC256073 BINDING SITE, designated SEQ ID:46231, to the nucleotide sequence of VGAM2682 RNA, herein designated VGAM RNA, also designated SEQ ID:5393.

Another function of VGAM2682 is therefore inhibition of LOC256073 (Accession XM_172972). Accordingly, utilities of VGAM2682 include diagnosis, prevention and treatment of diseases and clinical conditions associated with LOC256073. FIG. 1 further provides a conceptual description of a novel bioinformatically detected viral gene of the present invention, referred to here as Viral Genomic Address Messenger 2683 (VGAM2683) viral gene, which modulates expression of respective host target genes thereof, the function and utility of which host target genes is known in the art.

VGAM2683 is a novel bioinformatically detected regulatory, non protein coding, viral micro RNA (miRNA) gene. The method by which VGAM2683 was detected is described hereinabove with reference to FIGS. 1-8.

VGAM2683 gene, herein designated VGAM GENE, is a viral gene contained in the genome of Ophiostoma Novo-ulmi Mitovirus 4-Ld. VGAM2683 host target gene, herein designated VGAM HOST TARGET GENE, is a human gene contained in the human genome.

VGAM2683 gene encodes a VGAM2683 precursor RNA, herein designated VGAM PRECURSOR RNA. Similar to other miRNA genes, and unlike most ordinary genes, VGAM2683 precursor RNA does not encode a protein. A nucleotide sequence identical or highly similar to the nucleotide sequence of VGAM2683 precursor RNA is designated SEQ ID:2669, and is provided hereinbelow with reference to the sequence listing part. Nucleotide sequence SEQ ID:2669 is located at position 2286 relative to the genome of Ophiostoma Novo-ulmi Mitovirus 4-Ld.

VGAM2683 precursor RNA folds onto itself, forming VGAM2683 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2683 folded precursor RNA into VGAM2683 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2683 RNA is designated SEQ ID:5394, and is provided hereinbelow with reference to the sequence listing part.

VGAM2683 host target gene, herein designated VGAM HOST TARGET GENE, encodes a corresponding messenger RNA, VGAM2683 host target RNA, herein designated VGAM HOST TARGET RNA. VGAM2683 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2683 RNA, herein designated VGAM RNA, binds complementarily to one or more host target binding sites located in untranslated regions of VGAM2683 host target RNA, herein designated VGAM HOST TARGET RNA. This complementary binding is due to the fact that the nucleotide sequence of VGAM2683 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2683 RNA, herein designated VGAM RNA, may have a different number of host target binding sites in untranslated regions of a VGAM2683 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2683 RNA, herein designated VGAM RNA, to host target binding sites on VGAM2683 host target RNA, herein designated VGAM HOST TARGET RNA, such as BINDING SITE I, BINDING SITE II and BINDING SITE III, inhibits translation of VGAM2683 host target RNA into VGAM2683 host target protein, herein designated VGAM HOST TARGET PROTEIN. VGAM host target protein is therefore outlined by a broken line.

It is appreciated that VGAM2683 host target gene, herein designated VGAM HOST TARGET GENE, in fact represents a plurality of VGAM2683 host target genes. The mRNA of each one of this plurality of VGAM2683 host target genes comprises one or more host target binding sites, each having a nucleotide sequence which is at least partly complementary to VGAM2683 RNA, herein designated VGAM RNA, and which when bound by VGAM2683 RNA causes inhibition of translation of respective one or more VGAM2683 host target proteins.

It is further appreciated by one skilled in the art that the mode of translational inhibition illustrated by FIG. 1 with specific reference to translational inhibition exerted by VGAM2683 gene, herein designated VGAM GENE, on one or more VGAM2683 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2683 is inhibition of expression of host target genes, as part of a novel viral mechanism of attacking a host. Accordingly, utilities of VGAM2683 include diagnosis, prevention and treatment of viral infection by Ophiostoma Novo-ulmi Mitovirus 4-Ld. Specific functions, and accordingly utilities, of VGAM2683 correlate with, and may be deduced from, the identity of the host target genes which VGAM2683 binds and inhibits, and the function of these host target genes, as elaborated hereinbelow.

Nucleotide sequences of the VGAM2683 precursor RNA, herein designated VGAM PRECURSOR RNA, and of the 'diced' VGAM2683 RNA, herein designated VGAM RNA, and a schematic representation of the secondary folding of VGAM2683 folded precursor RNA, herein designated VGAM FOLDED PRECURSOR RNA, of VGAM2683 are further described hereinbelow with reference to Table 1.

Nucleotide sequences of host target binding sites, such as BINDING SITE-I, BINDING SITE-II and BINDING SITE-III of FIG. 1, found on VGAM2683 host target RNA, and schematic representation of the complementarity of each of these host target binding sites to VGAM2683 RNA, herein designated VGAM RNA, are described hereinbelow with reference to Table 2.

As mentioned hereinabove with reference to FIG. 1, a function of VGAM2683 gene, herein designated VGAM is inhibition of expression of VGAM2683 target genes. It is appreciated that specific functions, and accordingly utilities, of VGAM2683 correlate with, and may be deduced from, the identity of the target genes which VGAM2683 binds and inhibits, and the function of these target genes, as elaborated hereinbelow.

Glucosamine (N-acetyl)-6-sulfatase (Sanfilippo disease IIID) (GNS, Accession NM_002076) is a VGAM2683 host target gene. GNS BINDING SITE is HOST TARGET binding site found in the 3' untranslated region of mRNA encoded by GNS, corresponding to a HOST TARGET binding site such as BINDING SITE I, BINDING SITE II or BINDING SITE III. Table 2 illustrates the complementarity of the nucleotide sequences of GNS BINDING SITE, designated SEQ ID:7855, to the nucleotide sequence of VGAM2683 RNA, herein designated VGAM RNA, also designated SEQ ID:5394.

A function of VGAM2683 is therefore inhibition of Glucosamine (N-acetyl)-6-sulfatase (Sanfilippo disease IIID) (GNS, Accession NM_002076), a gene which hydrolyzes sulfate groups from glycosaminoglycans. Accordingly, utilities of VGAM2683 include diagnosis, prevention and treatment of diseases and clinical conditions associated with GNS. The function of GNS has been established by previous studies. Kresse et al. (1980) found that cultured skin fibroblasts from 2 patients with clinical features of the Sanfilippo syndrome accumulated excessive amounts of heparan sulfate and were unable to release sulfate from N-acetylglucosamine-6-sulfate linkages in heparan sulfate-derived oligosaccharides. Keratan sulfate-derived oligosaccharides bearing the same residue at the nonreducing end were normally degraded. Kinetic differences between the sulfatase activities of normal fibroblasts were found. Thus, the N-acetylglucosamine-6-sulfate sulfatases degrading heparan sulfate and keratan sulfate are distinct. The activity directed against heparan sulfate is deficient in the new form of Sanfilippo syndrome, designated type D by Kresse et al. (1980). The fibroblasts were from a 7-year-old East Indian boy living in England and a 4-year-old girl from Sardinia. Both patients excreted excessive heparan sulfate in the urine. The boy was mentally retarded and had 'characteristic behavioral disturbances.' The girl showed coarse facies and hirsutism but was not mentally retarded. Gatti et al. (1982) concluded that MPS IIID cannot be distinguished clinically from the other forms of Sanfilippo syndrome. Autosomal recessive inheritance was considered confirmed. Stating that only 2 cases of MPS IIID had been reported in detail, Coppa et al. (1983) added 2 more. Both patients had a high percentage of heparan sulfate in the urinary glycosaminoglycans and severe deficiency of N-acetylglucosamine-6-sulfate sulfatase in cultured skin fibroblasts. One of the patients, who presented at age 9 years 8 months with a history of chronic diarrhea, was only mildly retarded. Kaplan and Wolfe (1987) reported the first cases of type D from North America--2 relatively mildly affected brothers. Neufeld (1987) suggested that for the sake of simplicity the enzyme deficient in this disorder be termed N-acetylglucosamine 6-sulfatase. Freeman et al. (1987) reported purification and characterization of the enzyme deficient in MPS IIID. They identified 4 forms of the enzyme in liver, which were postulated to be due to differences in the state of processing of a large subunit. The catalytic properties were studied by Freeman and Hopwood (1987). Robertson et al. (1988)

pointed out homology in nucleotide sequence to steroid sulfatase (OMIM Ref. No. 308100), a microsomal enzyme.

Full details of the abovementioned studies are described in the following publications, the disclosure of which are hereby incorporated by reference:

Freeman, C.; Clements, P. R.; Hopwood, J. J.: Human liver N-acetylglucosamine-6-sulphate sulphatase: purification and characterization. Biochem. J. 246: 347-354, 1987; and Kresse, H.; Paschke, E.; von Figura, K.; Gilberg, W.; Fuchs, W.: Sanfilippo disease type D: deficiency of N-acetylglucosamine-6-sulfate sulfatase required for heparan sulfate degradati.

Further studies establishing the function and utilities of GNS are found in John Hopkins OMIM database record ID 252940, and in sited publications numbered 9242-9248, 656 and 9249-9252 listed in the bibliography section hereinbelow, which are also hereby incorporated by reference. Myotubular Myopathy 1 (MTM1, Accession NM_000252) is another VGAM2683 host target gene. MTM1 BINDING SITE is HOST TARGET binding site found in the 3' untranslated region of mRNA encoded by MTM1, corresponding to a HOST TARGET binding site such as BINDING SITE I, BINDING SITE II or BINDING SITE III. Table 2 illustrates the complementarity of the nucleotide sequences of MTM1 BINDING SITE, designated SEQ ID:5789, to the nucleotide sequence of VGAM2683 RNA, herein designated VGAM RNA, also designated SEQ ID:5394.

Another function of VGAM2683 is therefore inhibition of Myotubular Myopathy 1 (MTM1, Accession NM_000252). Accordingly, utilities of VGAM2683 include diagnosis, prevention and treatment of diseases and clinical conditions associated with MTM1. Chromosome 11 Open Reading Frame 21 (C11orf21, Accession NM_014144) is another VGAM2683 host target gene. C11orf21 BINDING SITE is HOST TARGET binding site found in the 3' untranslated region of mRNA encoded by C11orf21, corresponding to a HOST TARGET binding site such as BINDING SITE I, BINDING SITE II or BINDING SITE III. Table 2 illustrates the complementarity of the nucleotide sequences of C11orf21 BINDING SITE, designated SEQ ID:15425, to the nucleotide sequence of VGAM2683 RNA, herein designated VGAM RNA, also designated SEQ ID:5394.

Another function of VGAM2683 is therefore inhibition of Chromosome 11 Open Reading Frame 21 (C11orf21, Accession NM_014144). Accordingly, utilities of VGAM2683 include diagnosis, prevention and treatment of diseases and clinical conditions associated with C11orf21. Chromosome 20 Open Reading Frame 38 (C20orf38, Accession NM_018327) is another VGAM2683 host target gene. C20orf38 BINDING SITE is HOST TARGET binding site found in the 3' untranslated region of mRNA encoded by C20orf38, corresponding to a HOST TARGET binding site such as BINDING SITE I, BINDING SITE II or BINDING SITE III. Table 2 illustrates the complementarity of the nucleotide sequences of C20orf38 BINDING SITE, designated SEQ ID:20322, to the nucleotide sequence of VGAM2683 RNA, herein designated VGAM RNA, also designated SEQ ID:5394.

Another function of VGAM2683 is therefore inhibition of Chromosome 20 Open Reading Frame 38 (C20orf38, Accession NM_018327). Accordingly, utilities of VGAM2683 include diagnosis, prevention and treatment of diseases and clinical conditions associated with C20orf38. DREV1 (Accession NM_016025) is another VGAM2683 host target gene. DREV1 BINDING SITE is HOST TARGET binding site found in the 3' untranslated region of mRNA encoded by DREV1, corresponding to a HOST TARGET binding site such as BINDING SITE I, BINDING SITE II or BINDING SITE III. Table 2 illustrates the complementarity of the nucleotide sequences of DREV1 BINDING SITE, designated SEQ ID:18107, to the nucleotide sequence of VGAM2683 RNA, herein designated VGAM RNA, also designated SEQ ID:5394.

Another function of VGAM2683 is therefore inhibition of DREV1 (Accession NM_016025). Accordingly, utilities of VGAM2683 include diagnosis, prevention and treatment of diseases and clinical conditions associated with DREV1. FLJ10493 (Accession NM_018112) is another VGAM2683 host target gene. FLJ10493 BINDING SITE is HOST TARGET binding site found in the 3' untranslated region of mRNA encoded by FLJ10493, corresponding to a HOST TARGET binding site such as BINDING SITE I, BINDING SITE II or BINDING SITE III. Table 2 illustrates the complementarity of the nucleotide sequences of FLJ10493 BINDING SITE, designated SEQ ID:19884, to the nucleotide sequence of VGAM2683 RNA, herein designated VGAM RNA, also designated SEQ ID:5394.

Another function of VGAM2683 is therefore inhibition of FLJ10493 (Accession NM_018112). Accordingly, utilities of VGAM2683 include diagnosis, prevention and treatment of diseases and clinical conditions associated with FLJ10493. FIG. 1 further provides a conceptual description of a novel bioinformatically detected viral gene of the present invention, referred to here as Viral Genomic Address Messenger 2684 (VGAM2684) viral gene, which modulates expression of respective host target genes thereof, the function and utility of which host target genes is known in the art.

VGAM2684 is a novel bioinformatically detected regulatory, non protein coding, viral micro RNA (miRNA) gene. The method by which VGAM2684 was detected is described hereinabove with reference to FIGS. 1-8.

VGAM2684 gene, herein designated VGAM GENE, is a viral gene contained in the genome of Ophiostoma Novo-ulmi Mitovirus 5-Ld. VGAM2684 host target gene, herein designated VGAM HOST TARGET GENE, is a human gene contained in the human genome.

VGAM2684 gene encodes a VGAM2684 precursor RNA, herein designated VGAM PRECURSOR RNA. Similar to other miRNA genes, and unlike most ordinary genes, VGAM2684 precursor RNA does not encode a protein. A nucleotide sequence identical or highly similar to the nucleotide sequence of VGAM2684 precursor RNA is designated SEQ ID:2670, and is provided hereinbelow with reference to the sequence listing part. Nucleotide sequence SEQ ID:2670 is located at position 706 relative to the genome of Ophiostoma Novo-ulmi Mitovirus 5-Ld.

VGAM2684 precursor RNA folds onto itself, forming VGAM2684 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2684 folded precursor RNA into VGAM2684 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 49%) nucleotide sequence of VGAM2684 RNA is designated SEQ ID:5395, and is provided hereinbelow with reference to the sequence listing part.

VGAM2684 host target gene, herein designated VGAM HOST TARGET GENE, encodes a corresponding messenger RNA, VGAM2684 host target RNA, herein designated VGAM HOST TARGET RNA. VGAM2684 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2684 RNA, herein designated VGAM RNA, binds complementarily to one or more host target binding sites located in untranslated regions of VGAM2684 host target RNA, herein designated VGAM HOST TARGET RNA. This complementary binding is due to the fact that the nucleotide sequence of VGAM2684 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2684 RNA, herein designated VGAM RNA, may have a different number of host target binding sites in untranslated regions of a VGAM2684 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2684 RNA, herein designated VGAM RNA, to host target binding sites on VGAM2684 host target RNA, herein designated VGAM HOST TARGET RNA, such as BINDING SITE I, BINDING SITE II and BINDING SITE III, inhibits translation of VGAM2684 host target RNA into VGAM2684 host target protein, herein designated VGAM HOST TARGET PROTEIN. VGAM host target protein is therefore outlined by a broken line.

It is appreciated that VGAM2684 host target gene, herein designated VGAM HOST TARGET GENE, in fact represents a plurality of VGAM2684 host target genes. The mRNA of each one of this plurality of VGAM2684 host target genes comprises one or more host target binding sites, each having a nucleotide sequence which is at least partly complementary to VGAM2684 RNA, herein designated VGAM RNA, and which when bound by VGAM2684 RNA causes inhibition of translation of respective one or more VGAM2684 host target proteins.

It is further appreciated by one skilled in the art that the mode of translational inhibition illustrated by FIG. 1 with specific reference to translational inhibition exerted by VGAM2684 gene, herein designated VGAM GENE, on one or more VGAM2684 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2684 is inhibition of expression of host target genes, as part of a novel viral mechanism of attacking a host. Accordingly, utilities of VGAM2684 include diagnosis, prevention and treatment of viral infection by Ophiostoma Novo-ulmi Mitovirus 5-Ld. Specific functions, and accordingly utilities, of VGAM2684 correlate with, and may be deduced from, the identity of the host target genes which VGAM2684 binds and inhibits, and the function of these host target genes, as elaborated hereinbelow.

Nucleotide sequences of the VGAM2684 precursor RNA, herein designated VGAM PRECURSOR RNA, and of the 'diced' VGAM2684 RNA, herein designated VGAM RNA, and a schematic representation of the secondary folding of VGAM2684 folded precursor RNA, herein designated VGAM FOLDED PRECURSOR RNA, of VGAM2684 are further described hereinbelow with reference to Table 1.

Nucleotide sequences of host target binding sites, such as BINDING SITE-I, BINDING SITE-II and BINDING SITE-III of FIG. 1, found on VGAM2684 host target RNA, and schematic representation of the complementarity of each of these host target binding sites to VGAM2684 RNA, herein designated VGAM RNA, are described hereinbelow with reference to Table 2.

As mentioned hereinabove with reference to FIG. 1, a function of VGAM2684 gene, herein designated VGAM is inhibition of expression of VGAM2684 target genes. It is appreciated that specific functions, and accordingly utilities, of VGAM2684 correlate with, and may be deduced from, the identity of the target genes which VGAM2684 binds and inhibits, and the function of these target genes, as elaborated hereinbelow.

Chediak-Higashi Syndrome 1 (CHS1, Accession NM_000081) is a VGAM2684 host target gene. CHS1 BINDING SITE is HOST TARGET binding site found in the 3' untranslated region of mRNA encoded by CHS1, corresponding to a HOST TARGET binding site such as BINDING SITE I, BINDING SITE II or BINDING SITE III. Table 2 illustrates the complementarity of the nucleotide sequences of CHS1 BINDING SITE, designated SEQ ID:5526, to the nucleotide sequence of VGAM2684 RNA, herein designated VGAM RNA, also designated SEQ ID:5395.

A function of VGAM2684 is therefore inhibition of Chediak-Higashi Syndrome 1 (CHS1, Accession NM_000081), a gene which may sort endosomal resident proteins into late multivesicular endosome. Accordingly, utilities of VGAM2684 include diagnosis, prevention and treatment of diseases and clinical conditions associated with CHS1. The function of CHS1 and its association with various diseases and clinical conditions, has been established by previous studies, as described hereinabove with reference to VGAM191. Homeo Box C11 (HOXC11, Accession XM_012215) is another VGAM2684 host target gene. HOXC11 BINDING SITE is HOST TARGET binding site found in the 3' untranslated region of mRNA encoded by HOXC11, corresponding to a HOST TARGET binding site such as BINDING SITE I, BINDING SITE II or BINDING SITE III. Table 2 illustrates the complementarity of the nucleotide sequences of HOXC11 BINDING SITE, designated SEQ ID:30209, to the nucleotide sequence of VGAM2684 RNA, herein designated VGAM RNA, also designated SEQ ID:5395.

Another function of VGAM2684 is therefore inhibition of Homeo Box C11 (HOXC11, Accession XM_012215), a gene which interacts with the lactase-phlorizin hydrolase promoter. Accordingly, utilities of VGAM2684 include diagnosis, prevention and treatment of diseases and clinical conditions associated with HOXC11. The function of HOXC11 and its association with various diseases and clinical conditions, has been established by previous studies, as described hereinabove with reference to VGAM2047. Mitogen-activated Protein Kinase 14 (MAPK14, Accession NM_001315) is another VGAM2684 host target gene. MAPK14 BINDING SITE1 through MAPK14 BINDING SITE3 are HOST TARGET binding sites found in untranslated regions of mRNA encoded by MAPK14, corresponding to HOST TARGET binding sites such as BINDING SITE I, BINDING SITE II or BINDING SITE III. Table 2 illustrates the complementarity of the nucleotide sequences of MAPK14 BINDING SITE1 through MAPK14 BINDING SITE3, designated SEQ ID:7001, SEQ ID:29105 and SEQ ID:29112 respectively, to the nucleotide sequence of VGAM2684 RNA, herein designated VGAM RNA, also designated SEQ ID:5395.

Another function of VGAM2684 is therefore inhibition of Mitogen-activated Protein Kinase 14 (MAPK14, Accession NM_001315), a gene which is important for cytokine production; responds to changes in extracellular osmolarity. Accordingly, utilities of VGAM2684 include diagnosis, prevention and treatment of diseases and clinical conditions associated with MAPK14. The function of MAPK14 and its association with various diseases and clinical conditions, has been established by previous studies, as described hereinabove with reference to VGAM107. MGC14289 (Accession NM_080660) is another VGAM2684 host target gene. MGC14289 BINDING SITE is HOST TARGET binding site found in the 3' untranslated region of mRNA encoded by MGC14289, corresponding to a HOST TARGET binding site such as BINDING SITE I, BINDING SITE II or BINDING SITE III. Table 2 illustrates the complementarity of the nucleotide sequences of MGC14289 BINDING SITE, designated SEQ ID:27946, to the nucleotide sequence of VGAM2684 RNA, herein designated VGAM RNA, also designated SEQ ID:5395.

Another function of VGAM2684 is therefore inhibition of MGC14289 (Accession NM_080660). Accordingly, utilities of VGAM2684 include diagnosis, prevention and treatment of diseases and clinical conditions associated with MGC14289. Myosin, Heavy Polypeptide 10, Non-muscle (MYH10, Accession XM_044702) is another VGAM2684 host target gene. MYH10 BINDING SITE is HOST TARGET binding site found in the 3' untranslated region of mRNA encoded by MYH10, corresponding to a HOST TARGET binding site such as BINDING SITE I, BINDING SITE II or BINDING SITE III. Table 2 illustrates the complementarity of the nucleotide sequences of MYH10 BINDING SITE, designated SEQ ID:34261, to the nucleotide sequence of VGAM2684 RNA, herein designated VGAM RNA, also designated SEQ ID:5395.

Another function of VGAM2684 is therefore inhibition of Myosin, Heavy Polypeptide 10, Non-muscle (MYH10, Accession XM_044702). Accordingly, utilities of VGAM2684 include diagnosis, prevention and treatment of diseases and clinical conditions associated with MYH10. Ubiquitin Specific Protease 10 (USP10, Accession XM_033922) is another VGAM2684 host target gene. USP10 BINDING SITE is HOST TARGET binding site found in the 3' untranslated region of mRNA encoded by USP10, corresponding to a HOST TARGET binding site such as BINDING SITE I, BINDING SITE II or BINDING SITE III. Table 2 illustrates the complementarity of the nucleotide sequences of USP10 BINDING SITE, designated SEQ ID:31983, to the nucleotide sequence of VGAM2684 RNA, herein designated VGAM RNA, also designated SEQ ID:5395.

Another function of VGAM2684 is therefore inhibition of Ubiquitin Specific Protease 10 (USP10, Accession XM_033922). Accordingly, utilities of VGAM2684 include diagnosis, prevention and treatment of diseases and clinical conditions associated with USP10. LOC145368 (Accession XM_085112) is another VGAM2684 host target gene. LOC145368 BINDING SITE is HOST TARGET binding site found in the 3' untranslated region of mRNA encoded by LOC145368, corresponding to a HOST TARGET binding site such as BINDING SITE I, BINDING SITE II or BINDING SITE III. Table 2 illustrates the complementarity of the nucleotide sequences of LOC145368 BINDING SITE, designated SEQ ID:37827, to the nucleotide sequence of VGAM2684 RNA, herein designated VGAM RNA, also designated SEQ ID:5395.

Another function of VGAM2684 is therefore inhibition of LOC145368 (Accession XM_085112). Accordingly, utilities of VGAM2684 include diagnosis, prevention and treatment of diseases and clinical conditions associated with LOC145368. LOC150423 (Accession XM_086912) is another VGAM2684 host target gene. LOC150423 BINDING SITE is HOST TARGET binding site found in the 3' untranslated region of mRNA encoded by LOC150423, corresponding to a HOST TARGET binding site such as BINDING SITE I, BINDING SITE II or BINDING SITE III. Table 2 illustrates the complementarity of the nucleotide sequences of LOC150423 BINDING SITE, designated SEQ ID:38967, to the nucleotide sequence of VGAM2684 RNA, herein designated VGAM RNA, also designated SEQ ID:5395.

Another function of VGAM2684 is therefore inhibition of LOC150423 (Accession XM_086912). Accordingly, utilities of VGAM2684 include diagnosis, prevention and treatment of diseases and clinical conditions associated with LOC150423. LOC152343 (Accession XM_087441) is another VGAM2684 host target gene. LOC152343 BINDING SITE is HOST TARGET binding site found in the 3' untranslated region of mRNA encoded by LOC152343, corresponding to a HOST TARGET binding site such as BINDING SITE I, BINDING SITE II or BINDING SITE III. Table 2 illustrates the complementarity of the nucleotide sequences of LOC152343 BINDING SITE, designated SEQ ID:39261, to the nucleotide sequence of VGAM2684 RNA, herein designated VGAM RNA, also designated SEQ ID:5395.

Another function of VGAM2684 is therefore inhibition of LOC152343 (Accession XM_087441). Accordingly, utilities of VGAM2684 include diagnosis, prevention and treatment of diseases and clinical conditions associated with LOC152343. LOC197358 (Accession XM_113872) is another VGAM2684 host target gene. LOC197358 BINDING SITE is HOST TARGET binding site found in the 3' untranslated region of mRNA encoded by LOC197358, corresponding to a HOST TARGET binding site such as BINDING SITE I, BINDING SITE II or BINDING SITE III. Table 2 illustrates the complementarity of the nucleotide sequences of LOC197358 BINDING SITE, designated SEQ ID:42506, to the nucleotide sequence of VGAM2684 RNA, herein designated VGAM RNA, also designated SEQ ID:5395.

Another function of VGAM2684 is therefore inhibition of LOC197358 (Accession XM_113872). Accordingly, utilities of VGAM2684 include diagnosis, prevention and treatment of diseases and clinical conditions associated with LOC197358. FIG. 1 further provides a conceptual description of a novel bioinformatically detected viral gene of the present invention, referred to here as Viral Genomic Address Messenger 2685 (VGAM2685) viral gene, which modulates expression of respective host target genes thereof, the function and utility of which host target genes is known in the art.

VGAM2685 is a novel bioinformatically detected regulatory, non protein coding, viral micro RNA (miRNA) gene. The method by which VGAM2685 was detected is described hereinabove with reference to FIGS. 1-8.

VGAM2685 gene, herein designated VGAM GENE, is a viral gene contained in the genome of Ophiostoma Novo-ulmi Mitovirus 5-Ld. VGAM2685 host target gene, herein designated VGAM HOST TARGET GENE, is a human gene contained in the human genome.

VGAM2685 gene encodes a VGAM2685 precursor RNA, herein designated VGAM PRECURSOR RNA. Similar to other miRNA genes, and unlike most ordinary genes, VGAM2685 precursor RNA does not encode a protein. A nucleotide sequence identical or highly similar to the nucleotide sequence of VGAM2685 precursor RNA is designated SEQ ID:2671, and is provided hereinbelow with reference to the sequence listing part. Nucleotide sequence SEQ ID:2671 is located at position 1580 relative to the genome of Ophiostoma Novo-ulmi Mitovirus 5-Ld.

VGAM2685 precursor RNA folds onto itself, forming VGAM2685 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2685 folded precursor RNA into VGAM2685 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2685 RNA is designated SEQ ID:5396, and is provided hereinbelow with reference to the sequence listing part.

VGAM2685 host target gene, herein designated VGAM HOST TARGET GENE, encodes a corresponding messenger RNA, VGAM2685 host target RNA, herein designated VGAM HOST TARGET RNA. VGAM2685 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2685 RNA, herein designated VGAM RNA, binds complementarily to one or more host target binding sites located in untranslated regions of VGAM2685 host target RNA, herein designated VGAM HOST TARGET RNA. This complementary binding is due to the fact that the nucleotide sequence of VGAM2685 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2685 RNA, herein designated VGAM RNA, may have a different number of host target binding sites in untranslated regions of a VGAM2685 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2685 RNA, herein designated VGAM RNA, to host target binding sites on VGAM2685 host target RNA, herein designated VGAM HOST TARGET RNA, such as BINDING SITE I, BINDING SITE II and BINDING SITE III, inhibits translation of VGAM2685 host target RNA into VGAM2685 host target protein, herein designated VGAM HOST TARGET PROTEIN. VGAM host target protein is therefore outlined by a broken line.

It is appreciated that VGAM2685 host target gene, herein designated VGAM HOST TARGET GENE, in fact represents a plurality of VGAM2685 host target genes. The mRNA of each one of this plurality of VGAM2685 host target genes comprises one or more host target binding sites, each having a nucleotide sequence which is at least partly complementary to VGAM2685 RNA, herein designated VGAM RNA, and which when bound by VGAM2685 RNA causes inhibition of translation of respective one or more VGAM2685 host target proteins.

It is further appreciated by one skilled in the art that the mode of translational inhibition illustrated by FIG. 1 with specific reference to translational inhibition exerted by VGAM2685 gene, herein designated VGAM GENE, on one or more VGAM2685 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2685 is inhibition of expression of host target genes, as part of a novel viral mechanism of attacking a host. Accordingly, utilities of VGAM2685 include diagnosis, prevention and treatment of viral infection by Ophiostoma Novo-ulmi Mitovirus 5-Ld. Specific functions, and accordingly utilities, of VGAM2685 correlate with, and may be deduced from, the identity of the host target genes which VGAM2685 binds and inhibits, and the function of these host target genes, as elaborated hereinbelow.

Nucleotide sequences of the VGAM2685 precursor RNA, herein designated VGAM PRECURSOR RNA, and of the 'diced' VGAM2685 RNA, herein designated VGAM RNA, and a schematic representation of the secondary folding of VGAM2685 folded precursor RNA, herein designated VGAM FOLDED PRECURSOR RNA, of VGAM2685 are further described hereinbelow with reference to Table 1.

Nucleotide sequences of host target binding sites, such as BINDING SITE-I, BINDING SITE-II and BINDING SITE-III of FIG. 1, found on VGAM2685 host target RNA, and schematic representation of the complementarity of each of these host target binding sites to VGAM2685 RNA, herein designated VGAM RNA, are described hereinbelow with reference to Table 2.

As mentioned hereinabove with reference to FIG. 1, a function of VGAM2685 gene, herein designated VGAM is inhibition of expression of VGAM2685 target genes. It is appreciated that specific functions, and accordingly utilities, of VGAM2685 correlate with, and may be deduced from, the identity of the target genes which VGAM2685 binds and inhibits, and the function of these target genes, as elaborated hereinbelow.

Melanoma Antigen, Family B, 4 (MAGEB4, Accession NM_002367) is a VGAM2685 host target gene. MAGEB4 BINDING SITE is HOST TARGET binding site found in the 3' untranslated region of mRNA encoded by MAGEB4, corresponding to a HOST TARGET binding site such as BINDING SITE I, BINDING SITE II or BINDING SITE III. Table 2 illustrates the complementarity of the nucleotide sequences of MAGEB4 BINDING SITE, designated SEQ ID:8176, to the nucleotide sequence of VGAM2685 RNA, herein designated VGAM RNA, also designated SEQ ID:5396.

A function of VGAM2685 is therefore inhibition of Melanoma Antigen, Family B, 4 (MAGEB4, Accession NM_002367). Accordingly, utilities of VGAM2685 include diagnosis, prevention and treatment of diseases and clinical conditions associated with MAGEB4. Claudin 1 (CLDN1, Accession NM_021101) is another VGAM2685 host target gene. CLDN1 BINDING SITE is HOST TARGET binding site found in the 3' untranslated region of mRNA encoded by CLDN1, corresponding to a HOST TARGET binding site such as BINDING SITE I, BINDING SITE II or BINDING SITE III. Table 2 illustrates the complementarity of the nucleotide sequences of CLDN1 BINDING SITE, designated SEQ ID:22083, to the nucleotide sequence of VGAM2685 RNA, herein designated VGAM RNA, also designated SEQ ID:5396.

Another function of VGAM2685 is therefore inhibition of Claudin 1 (CLDN1, Accession NM_021101). Accordingly, utilities of VGAM2685 include diagnosis, prevention and treatment of diseases and clinical conditions associated with CLDN1. RNA Binding Motif Protein 7 (RBM7, Accession NM_016090) is another VGAM2685 host target gene. RBM7 BINDING SITE is HOST TARGET binding site found in the 3' untranslated region of mRNA encoded by RBM7, corresponding to a HOST TARGET binding site such as BINDING SITE I, BINDING SITE II or BINDING SITE III. Table 2 illustrates the complementarity of the nucleotide sequences of RBM7 BINDING SITE, designated SEQ ID:18178, to the nucleotide sequence of VGAM2685 RNA, herein designated VGAM RNA, also designated SEQ ID:5396.

Another function of VGAM2685 is therefore inhibition of RNA Binding Motif Protein 7 (RBM7, Accession NM_016090). Accordingly, utilities of VGAM2685 include diagnosis, prevention and treatment of diseases and clinical conditions associated with RBM7. LOC92497 (Accession XM_045436) is another VGAM2685 host target gene. LOC92497 BINDING SITE is HOST TARGET binding site found in the 5' untranslated region of mRNA encoded by LOC92497, corresponding to a HOST TARGET binding site such as BINDING SITE I, BINDING SITE II or BINDING SITE III. Table 2 illustrates the complementarity of the nucleotide sequences of LOC92497 BINDING SITE, designated SEQ ID:34460, to the nucleotide sequence of VGAM2685 RNA, herein designated VGAM RNA, also designated SEQ ID:5396.

Another function of VGAM2685 is therefore inhibition of LOC92497 (Accession XM_045436). Accordingly, utilities of VGAM2685 include diagnosis, prevention and treatment of diseases and clinical conditions associated with LOC92497. FIG. 1 further provides a conceptual description of a novel bioinformatically detected viral gene of the present invention, referred to here as Viral Genomic Address Messenger 2686 (VGAM2686) viral gene, which modulates expression of respective host target genes thereof, the function and utility of which host target genes is known in the art.

VGAM2686 is a novel bioinformatically detected regulatory, non protein coding, viral micro RNA (miRNA) gene. The method by which VGAM2686 was detected is described hereinabove with reference to FIGS. 1-8.

VGAM2686 gene, herein designated VGAM GENE, is a viral gene contained in the genome of Ophiostoma Novo-ulmi Mitovirus 5-Ld. VGAM2686 host target gene, herein designated VGAM HOST TARGET GENE, is a human gene contained in the human genome.

VGAM2686 gene encodes a VGAM2686 precursor RNA, herein designated VGAM PRECURSOR RNA. Similar to other miRNA genes, and unlike most ordinary genes, VGAM2686 precursor RNA does not encode a protein. A nucleotide sequence identical or highly similar to the nucleotide sequence of VGAM2686 precursor RNA is designated SEQ ID:2672, and is provided hereinbelow with reference to the sequence listing part. Nucleotide sequence SEQ ID:2672 is located at position 328 relative to the genome of Ophiostoma Novo-ulmi Mitovirus 5-Ld.

VGAM2686 precursor RNA folds onto itself, forming VGAM2686 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2686 folded precursor RNA into VGAM2686 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2686 RNA is designated SEQ ID:5397, and is provided hereinbelow with reference to the sequence listing part.

VGAM2686 host target gene, herein designated VGAM HOST TARGET GENE, encodes a corresponding messenger RNA, VGAM2686 host target RNA, herein designated VGAM HOST TARGET RNA. VGAM2686 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2686 RNA, herein designated VGAM RNA, binds complementarily to one or more host target binding sites located in untranslated regions of VGAM2686 host target RNA, herein designated VGAM HOST TARGET RNA. This complementary binding is due to the fact that the nucleotide sequence of VGAM2686 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2686 RNA, herein designated VGAM RNA, may have a different number of host target binding sites in untranslated regions of a VGAM2686 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2686 RNA, herein designated VGAM RNA, to host target binding sites on VGAM2686 host target RNA, herein designated VGAM HOST TARGET RNA, such as BINDING SITE I, BINDING SITE II and BINDING SITE III, inhibits translation of VGAM2686 host target RNA into VGAM2686 host target protein, herein designated VGAM HOST TARGET PROTEIN. VGAM host target protein is therefore outlined by a broken line.

It is appreciated that VGAM2686 host target gene, herein designated VGAM HOST TARGET GENE, in fact represents a plurality of VGAM2686 host target genes. The mRNA of each one of this plurality of VGAM2686 host target genes comprises one or more host target binding sites, each having a nucleotide sequence which is at least partly complementary to VGAM2686 RNA, herein designated VGAM RNA, and which when bound by VGAM2686 RNA causes inhibition of translation of respective one or more VGAM2686 host target proteins.

It is further appreciated by one skilled in the art that the mode of translational inhibition illustrated by FIG. 1 with specific reference to translational inhibition exerted by VGAM2686 gene, herein designated VGAM GENE, on one or more VGAM2686 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2686 is inhibition of expression of host target genes, as part of a novel viral mechanism of attacking a host. Accordingly, utilities of VGAM2686 include diagnosis, prevention and treatment of viral infection by Ophiostoma Novo-ulmi Mitovirus 5-Ld. Specific functions, and accordingly utilities, of VGAM2686 correlate with, and may be deduced from, the identity of the host target genes which VGAM2686 binds and inhibits, and the function of these host target genes, as elaborated hereinbelow.

Nucleotide sequences of the VGAM2686 precursor RNA, herein designated VGAM PRECURSOR RNA, and of the 'diced' VGAM2686 RNA, herein designated VGAM RNA, and a schematic representation of the secondary folding of VGAM2686 folded precursor RNA, herein designated VGAM FOLDED PRECURSOR RNA, of VGAM2686 are further described hereinbelow with reference to Table 1.

Nucleotide sequences of host target binding sites, such as BINDING SITE-I, BINDING SITE-II and BINDING SITE-III of FIG. 1, found on VGAM2686 host target RNA, and schematic representation of the complementarity of each of these host target binding sites to VGAM2686 RNA, herein designated VGAM RNA, are described hereinbelow with reference to Table 2.

As mentioned hereinabove with reference to FIG. 1, a function of VGAM2686 gene, herein designated VGAM is inhibition of expression of VGAM2686 target genes. It is appreciated that specific functions, and accordingly utilities, of VGAM2686 correlate with, and may be deduced from, the identity of the target genes which VGAM2686 binds and inhibits, and the function of these target genes, as elaborated hereinbelow.

Calnexin (CANX, Accession XM_113469) is a VGAM2686 host target gene. CANX BINDING SITE is HOST TARGET binding site found in the 3' untranslated region of mRNA encoded by CANX, corresponding to a HOST TARGET binding site such as BINDING SITE I, BINDING SITE II or BINDING SITE III. Table 2 illustrates the complementarity of the nucleotide sequences of CANX BINDING SITE, designated SEQ ID:42277, to the nucleotide sequence of VGAM2686 RNA, herein designated VGAM RNA, also designated SEQ ID:5397.

A function of VGAM2686 is therefore inhibition of Calnexin (CANX, Accession XM_113469), a gene which may function as a chaperone in the endoplasmic reticulum, involved in the secretion of proteins from the ER to the outer cellular membrane. Accordingly, utilities of VGAM2686 include diagnosis, prevention and treatment of diseases and clinical conditions associated with CANX. The function of CANX and its association with various diseases and clinical conditions, has been established by previous studies, as described hereinabove with reference to VGAM116. Nuclear Receptor Coactivator 6 Interacting Protein (NCOA6IP, Accession NM_024831) is another VGAM2686 host target gene. NCOA6IP BINDING SITE is HOST TARGET binding site found in the 3' untranslated region of mRNA encoded by NCOA6IP, corresponding to a HOST TARGET binding site such as BINDING SITE I, BINDING SITE II or BINDING SITE III. Table 2 illustrates the complementarity of the nucleotide sequences of NCOA6IP BINDING SITE, designated SEQ ID:24227, to the nucleotide sequence of VGAM2686 RNA, herein designated VGAM RNA, also designated SEQ ID:5397.

Another function of VGAM2686 is therefore inhibition of Nuclear Receptor Coactivator 6 Interacting Protein (NCOA6IP, Accession NM_024831). Accordingly, utilities of VGAM2686 include diagnosis, prevention and treatment of diseases and clinical conditions associated with NCOA6IP. EPLIN (Accession NM_016357) is another VGAM2686 host target gene. EPLIN BINDING SITE is HOST TARGET binding site found in the 3' untranslated region of mRNA encoded by EPLIN, corresponding to a HOST TARGET binding site such as BINDING SITE I, BINDING SITE II or BINDING SITE III. Table 2 illustrates the complementarity of the nucleotide sequences of EPLIN BINDING SITE, designated SEQ ID:18497, to the nucleotide sequence of VGAM2686 RNA, herein designated VGAM RNA, also designated SEQ ID:5397.

Another function of VGAM2686 is therefore inhibition of EPLIN (Accession NM_016357). Accordingly, utilities of VGAM2686 include diagnosis, prevention and treatment of diseases and clinical conditions associated with EPLIN. LOC253970 (Accession XM_172910) is another VGAM2686 host target gene. LOC253970 BINDING SITE is HOST TARGET binding site found in the 3' untranslated region of mRNA encoded by LOC253970, corresponding to a HOST TARGET binding site such as BINDING SITE I, BINDING SITE II or BINDING SITE III. Table 2 illustrates the complementarity of the nucleotide sequences of LOC253970 BINDING SITE, designated SEQ ID:46172, to the nucleotide sequence of VGAM2686 RNA, herein designated VGAM RNA, also designated SEQ ID:5397.

Another function of VGAM2686 is therefore inhibition of LOC253970 (Accession XM_172910). Accordingly, utilities of VGAM2686 include diagnosis, prevention and treatment of diseases and clinical conditions associated with LOC253970. LOC57826 (Accession NM_021183) is another VGAM2686 host target gene. LOC57826 BINDING SITE is HOST TARGET binding site found in the 3' untranslated region of mRNA encoded by LOC57826, corresponding to a HOST TARGET binding site such as BINDING SITE I, BINDING SITE II or BINDING SITE III. Table 2 illustrates the complementarity of the nucleotide sequences of LOC57826 BINDING SITE, designated SEQ ID:22162, to the nucleotide sequence of VGAM2686 RNA, herein designated VGAM RNA, also designated SEQ ID:5397.

Another function of VGAM2686 is therefore inhibition of LOC57826 (Accession NM_021183). Accordingly, utilities of VGAM2686 include diagnosis, prevention and treatment of diseases and clinical conditions associated with LOC57826. FIG. 1 further provides a conceptual description of a novel bioinformatically detected viral gene of the present invention, referred to here as Viral Genomic Address Messenger 2687 (VGAM2687) viral gene, which modulates expression of respective host target genes thereof, the function and utility of which host target genes is known in the art.

VGAM2687 is a novel bioinformatically detected regulatory, non protein coding, viral micro RNA (miRNA) gene. The method by which VGAM2687 was detected is described hereinabove with reference to FIGS. 1-8.

VGAM2687 gene, herein designated VGAM GENE, is a viral gene contained in the genome of Southern Bean Mosaic Virus. VGAM2687 host target gene, herein designated VGAM HOST TARGET GENE, is a human gene contained in the human genome.

VGAM2687 gene encodes a VGAM2687 precursor RNA, herein designated VGAM PRECURSOR RNA. Similar to other miRNA genes, and unlike most ordinary genes, VGAM2687 precursor RNA does not encode a protein. A nucleotide sequence identical or highly similar to the nucleotide sequence of VGAM2687 precursor RNA is designated SEQ ID:2673, and is provided hereinbelow with reference to the sequence listing part. Nucleotide sequence SEQ ID:2673 is located at position 820 relative to the genome of Southern Bean Mosaic Virus.

VGAM2687 precursor RNA folds onto itself, forming VGAM2687 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2687 folded precursor RNA into VGAM2687 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2687 RNA is designated SEQ ID:5398, and is provided hereinbelow with reference to the sequence listing part.

VGAM2687 host target gene, herein designated VGAM HOST TARGET GENE, encodes a corresponding messenger RNA, VGAM2687 host target RNA, herein designated VGAM HOST TARGET RNA. VGAM2687 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2687 RNA, herein designated VGAM RNA, binds complementarily to one or more host target binding sites located in untranslated regions of VGAM2687 host target RNA, herein designated VGAM HOST TARGET RNA. This complementary binding is due to the fact that the nucleotide sequence of VGAM2687 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2687 RNA, herein designated VGAM RNA, may have a different number of host target binding sites in untranslated regions of a VGAM2687 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2687 RNA, herein designated VGAM RNA, to host target binding sites on VGAM2687 host target RNA, herein designated VGAM HOST TARGET RNA, such as BINDING SITE I, BINDING SITE II and BINDING SITE III, inhibits translation of VGAM2687 host target RNA into VGAM2687 host target protein, herein designated VGAM HOST TARGET PROTEIN. VGAM host target protein is therefore outlined by a broken line.

It is appreciated that VGAM2687 host target gene, herein designated VGAM HOST TARGET GENE, in fact represents a plurality of VGAM2687 host target genes. The mRNA of each one of this plurality of VGAM2687 host target genes comprises one or more host target binding sites, each having a nucleotide sequence which is at least partly complementary to VGAM2687 RNA, herein designated VGAM RNA, and which when bound by VGAM2687 RNA causes inhibition of translation of respective one or more VGAM2687 host target proteins.

It is further appreciated by one skilled in the art that the mode of translational inhibition illustrated by FIG. 1 with specific reference to translational inhibition exerted by VGAM2687 gene, herein designated VGAM GENE, on one or more VGAM2687 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2687 is inhibition of expression of host target genes, as part of a novel viral mechanism of attacking a host. Accordingly, utilities of VGAM2687 include diagnosis, prevention and treatment of viral infection by Southern Bean Mosaic Virus. Specific functions, and accordingly utilities, of VGAM2687 correlate with, and may be deduced from, the identity of the host target genes which VGAM2687 binds and inhibits, and the function of these host target genes, as elaborated hereinbelow.

Nucleotide sequences of the VGAM2687 precursor RNA, herein designated VGAM PRECURSOR RNA, and of the 'diced' VGAM2687 RNA, herein designated VGAM RNA, and a schematic representation of the secondary folding of VGAM2687 folded precursor RNA, herein designated VGAM FOLDED PRECURSOR RNA, of VGAM2687 are further described hereinbelow with reference to Table 1.

Nucleotide sequences of host target binding sites, such as BINDING SITE-I, BINDING SITE-II and BINDING SITE-III of FIG. 1, found on VGAM2687 host target RNA, and schematic representation of the complementarity of each of these host target binding sites to VGAM2687 RNA, herein designated VGAM RNA, are described hereinbelow with reference to Table 2.

As mentioned hereinabove with reference to FIG. 1, a function of VGAM2687 gene, herein designated VGAM is inhibition of expression of VGAM2687 target genes. It is appreciated that specific functions, and accordingly utilities, of VGAM2687 correlate with, and may be deduced from, the identity of the target genes which VGAM2687 binds and inhibits, and the function of these target genes, as elaborated hereinbelow.

Fanconi Anemia, Complementation Group F (FANCF, Accession NM_022725) is a VGAM2687 host target gene. FANCF BINDING SITE is HOST TARGET binding site found in the 3' untranslated region of mRNA encoded by FANCF, corresponding to a HOST TARGET binding site such as BINDING SITE I, BINDING SITE II or BINDING SITE III. Table 2 illustrates the complementarity of the nucleotide sequences of FANCF BINDING SITE, designated SEQ ID:22924, to the nucleotide sequence of VGAM2687 RNA, herein designated VGAM RNA, also designated SEQ ID:5398.

A function of VGAM2687 is therefore inhibition of Fanconi Anemia, Complementation Group F (FANCF, Accession NM_022725). Accordingly, utilities of VGAM2687 include diagnosis, prevention and treatment of diseases and clinical conditions associated with FANCF. FLJ10895 (Accession NM_019084) is another VGAM2687 host target gene. FLJ10895 BINDING SITE is HOST TARGET binding site found in the 3' untranslated region of mRNA encoded by FLJ10895, corresponding to a HOST TARGET binding site such as BINDING SITE I, BINDING SITE II or BINDING SITE III. Table 2 illustrates the complementarity of the nucleotide sequences of FLJ10895 BINDING SITE, designated SEQ ID:21157, to the nucleotide sequence of VGAM2687 RNA, herein designated VGAM RNA, also designated SEQ ID:5398.

Another function of VGAM2687 is therefore inhibition of FLJ10895 (Accession NM_019084). Accordingly, utilities of VGAM2687 include diagnosis, prevention and treatment of diseases and clinical conditions associated with FLJ10895. Glutamic Pyruvate Transaminase (alanine aminotransferase) 2 (GPT2, Accession NM_133443) is another VGAM2687 host target gene. GPT2 BINDING SITE is HOST TARGET binding site found in the 3' untranslated region of mRNA encoded by GPT2, corresponding to a HOST TARGET binding site such as BINDING SITE I, BINDING SITE II or BINDING SITE III. Table 2 illustrates the complementarity of the nucleotide sequences of GPT2 BINDING SITE, designated SEQ ID:28521, to the nucleotide sequence of VGAM2687 RNA, herein designated VGAM RNA, also designated SEQ ID:5398.

Another function of VGAM2687 is therefore inhibition of Glutamic Pyruvate Transaminase (alanine aminotransferase) 2 (GPT2, Accession NM_133443). Accordingly, utilities of VGAM2687 include diagnosis, prevention and treatment of diseases and clinical conditions associated with GPT2. KIAA1676 (Accession XM_167612) is another VGAM2687 host target gene. KIAA1676 BINDING SITE is HOST TARGET binding site found in the 3" untranslated region of mRNA encoded by KIAA1676, corresponding to a HOST TARGET binding site such as BINDING SITE I, BINDING SITE II or BINDING SITE III. Table 2 illustrates the complementarity of the nucleotide sequences of KIAA1676 BINDING SITE, designated SEQ ID:44728, to the nucleotide sequence of VGAM2687 RNA, herein designated VGAM RNA, also designated SEQ ID:5398.

Another function of VGAM2687 is therefore inhibition of KIAA1676 (Accession XM_167612). Accordingly, utilities of VGAM2687 include diagnosis, prevention and treatment of diseases and clinical conditions associated with KIAA1676. LOC200609 (Accession XM_117256) is another VGAM2687 host target gene. LOC200609 BINDING SITE is HOST TARGET binding site found in the 5' untranslated region of mRNA encoded by LOC200609, corresponding to a HOST TARGET binding site such as BINDING SITE I, BINDING SITE II or BINDING SITE III. Table 2 illustrates the complementarity of the nucleotide sequences of LOC200609 BINDING SITE, designated SEQ ID:43332, to the nucleotide sequence of VGAM2687 RNA, herein designated VGAM RNA, also designated SEQ ID:5398.

Another function of VGAM2687 is therefore inhibition of LOC200609 (Accession XM_117256). Accordingly, utilities of VGAM2687 include diagnosis, prevention and treatment of diseases and clinical conditions associated with LOC200609. FIG. 1 further provides a conceptual description of a novel bioinformatically detected viral gene of the present invention, referred to here as Viral Genomic Address Messenger 2688 (VGAM2688) viral gene, which modulates expression of respective host target genes thereof, the function and utility of which host target genes is known in the art.

VGAM2688 is a novel bioinformatically detected regulatory, non protein coding, viral micro RNA (miRNA) gene. The method by which VGAM2688 was detected is described hereinabove with reference to FIGS. 1-8.

VGAM2688 gene, herein designated VGAM GENE, is a viral gene contained in the genome of Southern Bean Mosaic Virus. VGAM2688 host target gene, herein designated VGAM HOST TARGET GENE, is a human gene contained in the human genome.

VGAM2688 gene encodes a VGAM2688 precursor RNA, herein designated VGAM PRECURSOR RNA. Similar to other miRNA genes, and unlike most ordinary genes, VGAM2688 precursor RNA does not encode a protein. A nucleotide sequence identical or highly similar to the nucleotide sequence of VGAM2688 precursor RNA is designated SEQ ID:2674, and is provided hereinbelow with reference to the sequence listing part. Nucleotide sequence SEQ ID:2674 is located at position 2629 relative to the genome of Southern Bean Mosaic Virus.

VGAM2688 precursor RNA folds onto itself, forming VGAM2688 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2688 folded precursor RNA into VGAM2688 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM2688 RNA is designated SEQ ID:5399, and is provided hereinbelow with reference to the sequence listing part.

VGAM2688 host target gene, herein designated VGAM HOST TARGET GENE, encodes a corresponding messenger RNA, VGAM2688 host target RNA, herein designated VGAM HOST TARGET RNA. VGAM2688 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2688 RNA, herein designated VGAM RNA, binds complementarily to one or more host target binding sites located in untranslated regions of VGAM2688 host target RNA, herein designated VGAM HOST TARGET RNA. This complementary binding is due to the fact that the nucleotide sequence of VGAM2688 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2688 RNA, herein designated VGAM RNA, may have a different number of host target binding sites in untranslated regions of a VGAM2688 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2688 RNA, herein designated VGAM RNA, to host target binding sites on VGAM2688 host target RNA, herein designated VGAM HOST TARGET RNA, such as BINDING SITE I, BINDING SITE II and BINDING SITE III, inhibits translation of VGAM2688 host target RNA into VGAM2688 host target protein, herein designated VGAM HOST TARGET PROTEIN. VGAM host target protein is therefore outlined by a broken line.

It is appreciated that VGAM2688 host target gene, herein designated VGAM HOST TARGET GENE, in fact represents a plurality of VGAM2688 host target genes. The mRNA of each one of this plurality of VGAM2688 host target genes comprises one or more host target binding sites, each having a nucleotide sequence which is at least partly complementary to VGAM2688 RNA, herein designated VGAM RNA, and which when bound by VGAM2688 RNA causes inhibition of translation of respective one or more VGAM2688 host target proteins.

It is further appreciated by one skilled in the art that the mode of translational inhibition illustrated by FIG. 1 with specific reference to translational inhibition exerted by VGAM2688 gene, herein designated VGAM GENE, on one or more VGAM2688 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2688 is inhibition of expression of host target genes, as part of a novel viral mechanism of attacking a host. Accordingly, utilities of VGAM2688 include diagnosis, prevention and treatment of viral infection by Southern Bean Mosaic Virus. Specific functions, and accordingly utilities, of VGAM2688 correlate with, and may be deduced from, the identity of the host target genes which VGAM2688 binds and inhibits, and the function of these host target genes, as elaborated hereinbelow.

Nucleotide sequences of the VGAM2688 precursor RNA, herein designated VGAM PRECURSOR RNA, and of the 'diced' VGAM2688 RNA, herein designated VGAM RNA, and a schematic representation of the secondary folding of VGAM2688 folded precursor RNA, herein designated VGAM FOLDED PRECURSOR RNA, of VGAM2688 are further described hereinbelow with reference to Table 1.

Nucleotide sequences of host target binding sites, such as BINDING SITE-I, BINDING SITE-II and BINDING SITE-III of FIG. 1, found on VGAM2688 host target RNA, and schematic representation of the complementarity of each of these host target binding sites to VGAM2688 RNA, herein designated VGAM RNA, are described hereinbelow with reference to Table 2.

As mentioned hereinabove with reference to FIG. 1, a function of VGAM2688 gene, herein designated VGAM is inhibition of expression of VGAM2688 target genes. It is appreciated that specific functions, and accordingly utilities, of VGAM2688 correlate with, and may be deduced from, the identity of the target genes which VGAM2688 binds and inhibits, and the function of these target genes, as elaborated hereinbelow.

Coagulation Factor II (thrombin) Receptor-like 3 (F2RL3, Accession NM_003950) is a VGAM2688 host target gene. F2RL3 BINDING SITE is HOST TARGET binding site found in the 3' untranslated region of mRNA encoded by F2RL3, corresponding to a HOST TARGET binding site such as BINDING SITE I, BINDING SITE II or BINDING SITE III. Table 2 illustrates the complementarity of the nucleotide sequences of F2RL3 BINDING SITE, designated SEQ ID:10080, to the nucleotide sequence of VGAM2688 RNA, herein designated VGAM RNA, also designated SEQ ID:5399.

A function of VGAM2688 is therefore inhibition of Coagulation Factor II (thrombin) Receptor-like 3 (F2RL3, Accession NM_003950), a gene which Protease-activated receptor 4; G protein-coupled receptor that increases phosphoinositide hydrolysis. Accordingly, utilities of VGAM2688 include diagnosis, prevention and treatment of diseases and clinical conditions associated with F2RL3. The function of F2RL3 and its association with various diseases and clinical conditions, has been established by previous studies, as described hereinabove with reference to VGAM193. FLJ10520 (Accession NM_018124) is another VGAM2688 host target gene. FLJ10520 BINDING SITE is HOST TARGET binding site found in the 3' untranslated region of mRNA encoded by FLJ10520, corresponding to a HOST TARGET binding site such as BINDING SITE I, BINDING SITE II or BINDING SITE III. Table 2 illustrates the complementarity of the nucleotide sequences of FLJ10520 BINDING SITE, designated SEQ ID:19903, to the nucleotide sequence of VGAM2688 RNA, herein designated VGAM RNA, also designated SEQ ID:5399.

Another function of VGAM2688 is therefore inhibition of FLJ10520 (Accession NM_018124). Accordingly, utilities of VGAM2688 include diagnosis, prevention and treatment of diseases and clinical conditions associated with FLJ10520. KIAA0451 (Accession NM_014826) is another VGAM2688 host target gene. KIAA0451 BINDING SITE is HOST TARGET binding site found in the 3' untranslated region of mRNA encoded by KIAA0451, corresponding to a HOST TARGET binding site such as BINDING SITE I, BINDING SITE II or BINDING SITE III. Table 2 illustrates the complementarity of the nucleotide sequences of KIAA0451 BINDING SITE, designated SEQ ID:16808, to the nucleotide sequence of VGAM2688 RNA, herein designated VGAM RNA, also designated SEQ ID:5399.

Another function of VGAM2688 is therefore inhibition of KIAA0451 (Accession NM_014826). Accordingly, utilities of VGAM2688 include diagnosis, prevention and treatment of diseases and clinical conditions associated with KIAA0451. Splicing Factor, Arginine/serine-rich 11 (SFRS11, Accession NM_004768) is another VGAM2688 host target gene. SFRS11 BINDING SITE is HOST TARGET binding site found in the 3' untranslated region of mRNA encoded by SFRS11, corresponding to a HOST TARGET binding site such as BINDING SITE I, BINDING SITE II or BINDING SITE III. Table 2 illustrates the complementarity of the nucleotide sequences of SFRS11 BINDING SITE, designated SEQ ID:11157, to the nucleotide sequence of VGAM2688 RNA, herein designated VGAM RNA, also designated SEQ ID:5399.

Another function of VGAM2688 is therefore inhibition of Splicing Factor, Arginine/serine-rich 11 (SFRS11, Accession NM_004768). Accordingly, utilities of VGAM2688 include diagnosis, prevention and treatment of diseases and clinical conditions associated with SFRS11. LOC149271 (Accession XM_086475) is another VGAM2688 host target gene. LOC149271 BINDING SITE is HOST TARGET binding site found in the 5' untranslated region of mRNA encoded by LOC149271, corresponding to a HOST TARGET binding site such as BINDING SITE I, BINDING SITE II or BINDING SITE III. Table 2 illustrates the complementarity of the nucleotide sequences of LOC149271 BINDING SITE, designated SEQ ID:38675, to the nucleotide sequence of VGAM2688 RNA, herein designated VGAM RNA, also designated SEQ ID:5399.

Another function of VGAM2688 is therefore inhibition of LOC149271 (Accession XM_086475). Accordingly, utilities of VGAM2688 include diagnosis, prevention and treatment of diseases and clinical conditions associated with LOC149271. LOC255196 (Accession XM_173157) is another VGAM2688 host target gene. LOC255196 BINDING SITE is HOST TARGET binding site found in the 5' untranslated region of mRNA encoded by LOC255196, corresponding to a HOST TARGET binding site such as BINDING SITE I, BINDING SITE II or BINDING SITE III. Table 2 illustrates the complementarity of the nucleotide sequences of LOC255196 BINDING SITE, designated SEQ ID:46411, to the nucleotide sequence of VGAM2688 RNA, herein designated VGAM RNA, also designated SEQ ID:5399.

Another function of VGAM2688 is therefore inhibition of LOC255196 (Accession XM_173157). Accordingly, utilities of VGAM2688 include diagnosis, prevention and treatment of diseases and clinical conditions associated with LOC255196. FIG. 1 further provides a conceptual description of a novel bioinformatically detected viral gene of the present invention, referred to here as Viral Genomic Address Messenger 2689 (VGAM2689) viral gene, which modulates expression of respective host target genes thereof, the function and utility of which host target genes is known in the art.

VGAM2689 is a novel bioinformatically detected regulatory, non protein coding, viral micro RNA (miRNA) gene. The method by which VGAM2689 was detected is described hereinabove with reference to FIGS. 1-8.

VGAM2689 gene, herein designated VGAM GENE, is a viral gene contained in the genome of Southern Bean Mosaic Virus. VGAM2689 host target gene, herein designated VGAM HOST TARGET GENE, is a human gene contained in the human genome.

VGAM2689 gene encodes a VGAM2689 precursor RNA, herein designated VGAM PRECURSOR RNA. Similar to other miRNA genes, and unlike most ordinary genes, VGAM2689 precursor RNA does not encode a protein. A nucleotide sequence identical or highly similar to the nucleotide sequence of VGAM2689 precursor RNA is designated SEQ ID:2675, and is provided hereinbelow with reference to the sequence listing part. Nucleotide sequence SEQ ID:2675 is located at position 649 relative to the genome of Southern Bean Mosaic Virus.

VGAM2689 precursor RNA folds onto itself, forming VGAM2689 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2689 folded precursor RNA into VGAM2689 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 40%) nucleotide sequence of VGAM2689 RNA is designated SEQ ID:5400, and is provided hereinbelow with reference to the sequence listing part.

VGAM2689 host target gene, herein designated VGAM HOST TARGET GENE, encodes a corresponding messenger RNA, VGAM2689 host target RNA, herein designated VGAM HOST TARGET RNA. VGAM2689 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2689 RNA, herein designated VGAM RNA, binds complementarily to one or more host target binding sites located in untranslated regions of VGAM2689 host target RNA, herein designated VGAM HOST TARGET RNA. This complementary binding is due to the fact that the nucleotide sequence of VGAM2689 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2689 RNA, herein designated VGAM RNA, may have a different number of host target binding sites in untranslated regions of a VGAM2689 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2689 RNA, herein designated VGAM RNA, to host target binding sites on VGAM2689 host target RNA, herein designated VGAM HOST TARGET RNA, such as BINDING SITE I, BINDING SITE II and BINDING SITE III, inhibits translation of VGAM2689 host target RNA into VGAM2689 host target protein, herein designated VGAM HOST TARGET PROTEIN. VGAM host target protein is therefore outlined by a broken line.

It is appreciated that VGAM2689 host target gene, herein designated VGAM HOST TARGET GENE, in fact represents a plurality of VGAM2689 host target genes. The mRNA of each one of this plurality of VGAM2689 host target genes comprises one or more host target binding sites, each having a nucleotide sequence which is at least partly complementary to VGAM2689 RNA, herein designated VGAM RNA, and which when bound by VGAM2689 RNA causes inhibition of translation of respective one or more VGAM2689 host target proteins.

It is further appreciated by one skilled in the art that the mode of translational inhibition illustrated by FIG. 1 with specific reference to translational inhibition exerted by VGAM2689 gene, herein designated VGAM GENE, on one or more VGAM2689 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2689 is inhibition of expression of host target genes, as part of a novel viral mechanism of attacking a host. Accordingly, utilities of VGAM2689 include diagnosis, prevention and treatment of viral infection by Southern Bean Mosaic Virus. Specific functions, and accordingly utilities, of VGAM2689 correlate with, and may be deduced from, the identity of the host target genes which VGAM2689 binds and inhibits, and the function of these host target genes, as elaborated hereinbelow.

Nucleotide sequences of the VGAM2689 precursor RNA, herein designated VGAM PRECURSOR RNA, and of the 'diced' VGAM2689 RNA, herein designated VGAM RNA, and a schematic representation of the secondary folding of VGAM2689 folded precursor RNA, herein designated VGAM FOLDED PRECURSOR RNA, of VGAM2689 are further described hereinbelow with reference to Table 1.

Nucleotide sequences of host target binding sites, such as BINDING SITE-I, BINDING SITE-II and BINDING SITE-III of FIG. 1, found on VGAM2689 host target RNA, and schematic representation of the complementarity of each of these host target binding sites to VGAM2689 RNA, herein designated VGAM RNA, are described hereinbelow with reference to Table 2.

As mentioned hereinabove with reference to FIG. 1, a function of VGAM2689 gene, herein designated VGAM is inhibition of expression of VGAM2689 target genes. It is appreciated that specific functions, and accordingly utilities, of VGAM2689 correlate with, and may be deduced from, the identity of the target genes which VGAM2689 binds and inhibits, and the function of these target genes, as elaborated hereinbelow.

E1A Binding Protein P300 (EP300, Accession NM_001429) is a VGAM2689 host target gene. EP300 BINDING SITE is HOST TARGET binding site found in the 5' untranslated region of mRNA encoded by EP300, corresponding to a HOST TARGET binding site such as BINDING SITE I, BINDING SITE II or BINDING SITE III. Table 2 illustrates the complementarity of the nucleotide sequences of EP300 BINDING SITE, designated SEQ ID:7148, to the nucleotide sequence of VGAM2689 RNA, herein designated VGAM RNA, also designated SEQ ID:5400.

A function of VGAM2689 is therefore inhibition of E1A Binding Protein P300 (EP300, Accession NM_001429), a gene which may have a function in cell cycle regulation. Accordingly, utilities of VGAM2689 include diagnosis, prevention and treatment of diseases and clinical conditions associated with EP300. The function of EP300 and its association with various diseases and clinical conditions, has been established by previous studies, as described hereinabove with reference to VGAM191. Heme Oxygenase (decycling) 1 (HMOX1, Accession NM_002133) is another VGAM2689 host target gene. HMOX1 BINDING SITE is HOST TARGET binding site found in the 3' untranslated region of mRNA encoded by HMOX1, corresponding to a HOST TARGET binding site such as BINDING SITE I, BINDING SITE II or BINDING SITE III. Table 2 illustrates the complementarity of the nucleotide sequences of HMOX1 BINDING SITE, designated SEQ ID:7910, to the nucleotide sequence of VGAM2689 RNA, herein designated VGAM RNA, also designated SEQ ID:5400.

Another function of VGAM2689 is therefore inhibition of Heme Oxygenase (decycling) 1 (HMOX1, Accession NM_002133). Accordingly, utilities of VGAM2689 include diagnosis, prevention and treatment of diseases and clinical conditions associated with HMOX1. Retinoid X Receptor, Alpha (RXRA, Accession NM_002957) is another VGAM2689 host target gene. RXRA BINDING SITE is HOST TARGET binding site found in the 3' untranslated region of mRNA encoded by RXRA, corresponding to a HOST TARGET binding site such as BINDING SITE I, BINDING SITE II or BINDING SITE III. Table 2 illustrates the complementarity of the nucleotide sequences of RXRA BINDING SITE, designated SEQ ID:8867, to the nucleotide sequence of VGAM2689 RNA, herein designated VGAM RNA, also designated SEQ ID:5400.

Another function of VGAM2689 is therefore inhibition of Retinoid X Receptor, Alpha (RXRA, Accession NM_002957), a gene which activates genes required for vitamin A metabolism, binds 9-cis retinoic acid. Accordingly, utilities of VGAM2689 include diagnosis, prevention and treatment of diseases and clinical conditions associated with RXRA. The function of RXRA and its association with various diseases and clinical conditions, has been established by previous studies, as described hereinabove with reference to VGAM349. Tumor Necrosis Factor (ligand) Superfamily, Member 15 (TNFSF15, Accession NM_005118) is another VGAM2689 host target gene. TNFSF15 BINDING SITE is HOST TARGET binding site found in the 3' untranslated region of mRNA encoded by TNFSF15, corresponding to a HOST TARGET binding site such as BINDING SITE I, BINDING SITE II or BINDING SITE III. Table 2 illustrates the complementarity of the nucleotide sequences of TNFSF15 BINDING SITE, designated SEQ ID:11601, to the nucleotide sequence of VGAM2689 RNA, herein designated VGAM RNA, also designated SEQ ID:5400.

Another function of VGAM2689 is therefore inhibition of Tumor Necrosis Factor (ligand) Superfamily, Member 15 (TNFSF15, Accession NM_005118), a gene which acts as an autocrine factor to induce apoptosis in endothelial cells. Accordingly, utilities of VGAM2689 include diagnosis, prevention and treatment of diseases and clinical conditions associated with TNFSF15. The function of TNFSF15 and its association with various diseases and clinical conditions, has been established by previous studies, as described hereinabove with reference to VGAM350. Vesicle Amine Transport Protein 1 Homolog (T californica) (VAT1, Accession NM_006373) is another VGAM2689 host target gene. VAT1 BINDING SITE is HOST TARGET binding site found in the 3' untranslated region of mRNA encoded by VAT1, corresponding to a HOST TARGET binding site such as BINDING SITE I, BINDING SITE II or BINDING SITE III. Table 2 illustrates the complementarity of the nucleotide sequences of VAT1 BINDING SITE, designated SEQ ID:13067, to the nucleotide sequence of VGAM2689 RNA, herein designated VGAM RNA, also designated SEQ ID:5400.

Another function of VGAM2689 is therefore inhibition of Vesicle Amine Transport Protein 1 Homolog (T californica) (VAT1, Accession NM_006373), a gene which is a membrane protein of cholinergic synaptic vesicles. Accordingly, utilities of VGAM2689 include diagnosis, prevention and treatment of diseases and clinical conditions associated with VAT1. The function of VAT1 and its association with various diseases and clinical conditions, has been established by previous studies, as described hereinabove with reference to VGAM212. Diacylglycerol Kinase, Zeta 104 kDa (DGKZ, Accession NM_003646) is another VGAM2689 host target gene. DGKZ BINDING SITE is HOST TARGET binding site found in the 3' untranslated region of mRNA encoded by DGKZ, corresponding to a HOST TARGET binding site such as BINDING SITE I, BINDING SITE II or BINDING SITE III. Table 2 illustrates the complementarity of the nucleotide sequences of DGKZ BINDING SITE, designated SEQ ID:9720, to the nucleotide sequence of VGAM2689 RNA, herein designated VGAM RNA, also designated SEQ ID:5400.

Another function of VGAM2689 is therefore inhibition of Diacylglycerol Kinase, Zeta 104 kDa (DGKZ, Accession NM_003646). Accordingly, utilities of VGAM2689 include diagnosis, prevention and treatment of diseases and clinical conditions associated with DGKZ. DKFZP434F0318 (Accession NM_030817) is another VGAM2689 host target gene. DKFZP434F0318 BINDING SITE is HOST TARGET binding site found in the 3' untranslated region of mRNA encoded by DKFZP434F0318, corresponding to a HOST TARGET binding site such as BINDING SITE I, BINDING SITE II or BINDING SITE III. Table 2 illustrates the complementarity of the nucleotide sequences of DKFZP434F0318 BINDING SITE, designated SEQ ID:25140, to the nucleotide sequence of VGAM2689 RNA, herein designated VGAM RNA, also designated SEQ ID:5400.

Another function of VGAM2689 is therefore inhibition of DKFZP434F0318 (Accession NM_030817). Accordingly, utilities of VGAM2689 include diagnosis, prevention and treatment of diseases and clinical conditions associated with DKFZP434F0318. FLJ20034 (Accession NM_017630) is another VGAM2689 host target gene. FLJ20034 BINDING SITE is HOST TARGET binding site found in the 3' untranslated region of mRNA encoded by FLJ20034, corresponding to a HOST TARGET binding site such as BINDING SITE I, BINDING SITE II or BINDING SITE III. Table 2 illustrates the complementarity of the nucleotide sequences of FLJ20034 BINDING SITE, designated SEQ ID:19131, to the nucleotide sequence of VGAM2689 RNA, herein designated VGAM RNA, also designated SEQ ID:5400.

Another function of VGAM2689 is therefore inhibition of FLJ20034 (Accession NM_017630). Accordingly, utilities of VGAM2689 include diagnosis, prevention and treatment of diseases and clinical conditions associated with FLJ20034. FLJ20188 (Accession NM_017703) is another VGAM2689 host target gene. FLJ20188 BINDING SITE is HOST TARGET binding site found in the 3' untranslated region of mRNA encoded by FLJ20188, corresponding to a HOST TARGET binding site such as BINDING SITE I, BINDING SITE II or BINDING SITE III. Table 2 illustrates the complementarity of the nucleotide sequences of FLJ20188 BINDING SITE, designated SEQ ID:19276, to the nucleotide sequence of VGAM2689 RNA, herein designated VGAM RNA, also designated SEQ ID:5400.

Another function of VGAM2689 is therefore inhibition of FLJ20188 (Accession NM_017703). Accordingly, utilities of VGAM2689 include diagnosis, prevention and treatment of diseases and clinical conditions associated with FLJ20188. KIAA1317 (Accession XM_098368) is another VGAM2689 host target gene. KIAA1317 BINDING SITE is HOST TARGET binding site found in the 5' untranslated region of mRNA encoded by KIAA1317, corresponding to a HOST TARGET binding site such as BINDING SITE I, BINDING SITE II or BINDING SITE III. Table 2 illustrates the complementarity of the nucleotide sequences of KIAA1317 BINDING SITE, designated SEQ ID:41626, to the nucleotide sequence of VGAM2689 RNA, herein designated VGAM RNA, also designated SEQ ID:5400.

Another function of VGAM2689 is therefore inhibition of KIAA1317 (Accession XM_098368). Accordingly, utilities of VGAM2689 include diagnosis, prevention and treatment of diseases and clinical conditions associated with KIAA1317. KIAA1813 (Accession XM_046743) is another VGAM2689 host target gene. KIAA1813 BINDING SITE is HOST TARGET binding site found in the 5' untranslated region of mRNA encoded by KIAA1813, corresponding to a HOST TARGET binding site such as BINDING SITE I, BINDING SITE II or BINDING SITE III. Table 2 illustrates the complementarity of the nucleotide sequences of KIAA1813 BINDING SITE, designated SEQ ID:34811, to the nucleotide sequence of VGAM2689 RNA, herein designated VGAM RNA, also designated SEQ ID:5400.

Another function of VGAM2689 is therefore inhibition of KIAA1813 (Accession XM_046743). Accordingly, utilities of VGAM2689 include diagnosis, prevention and treatment of diseases and clinical conditions associated with KIAA1813. Keratin Associated Protein 1-5 (KRTAP1-5, Accession NM_031957) is another VGAM2689 host target gene. KRTAP1-5 BINDING SITE is HOST TARGET binding site found in the 3' untranslated region of mRNA encoded by KRTAP1-5, corresponding to a HOST TARGET binding site such as BINDING SITE I, BINDING SITE II or BINDING SITE III. Table 2 illustrates the complementarity of the nucleotide sequences of KRTAP1-5 BINDING SITE, designated SEQ ID:25698, to the nucleotide sequence of VGAM2689 RNA, herein designated VGAM RNA, also designated SEQ ID:5400.

Another function of VGAM2689 is therefore inhibition of Keratin Associated Protein 1-5 (KRTAP1-5, Accession NM_031957). Accordingly, utilities of VGAM2689 include diagnosis, prevention and treatment of diseases and clinical conditions associated with KRTAP1-5. MAGE-E1 (Accession NM_030801) is another VGAM2689 host target gene. MAGE-E1 BINDING SITE is HOST TARGET binding site found in the 3' untranslated region of mRNA encoded by MAGE-E1, corresponding to a HOST TARGET binding site such as BINDING SITE I, BINDING SITE II or BINDING SITE III. Table 2 illustrates the complementarity of the nucleotide sequences of MAGE-E1 BINDING SITE, designated SEQ ID:25104, to the nucleotide sequence of VGAM2689 RNA, herein designated VGAM RNA, also designated SEQ ID:5400.

Another function of VGAM2689 is therefore inhibition of MAGE-E1 (Accession NM_030801). Accordingly, utilities of VGAM2689 include diagnosis, prevention and treatment of diseases and clinical conditions associated with MAGE-E1. moblak (Accession NM_130807) is another VGAM2689 host target gene. moblak BINDING SITE is HOST TARGET binding site found in the 3' untranslated region of mRNA encoded by moblak, corresponding to a HOST TARGET binding site such as BINDING SITE I, BINDING SITE II or BINDING SITE III. Table 2 illustrates the complementarity of the nucleotide sequences of moblak BINDING SITE, designated SEQ ID:28306, to the nucleotide sequence of VGAM2689 RNA, herein designated VGAM RNA, also designated SEQ ID:5400.

Another function of VGAM2689 is therefore inhibition of moblak (Accession NM_130807). Accordingly, utilities of VGAM2689 include diagnosis, prevention and treatment of diseases and clinical conditions associated with moblak. Myosin, Heavy Polypeptide 10, Non-muscle (MYH10, Accession XM_044702) is another VGAM2689 host target gene. MYH10 BINDING SITE is HOST TARGET binding site found in the 3' untranslated region of mRNA encoded by MYH10, corresponding to a HOST TARGET binding site such as BINDING SITE I, BINDING SITE II or BINDING SITE III. Table 2 illustrates the complementarity of the nucleotide sequences of MYH10 BINDING SITE, designated SEQ ID:34262, to the nucleotide sequence of VGAM2689 RNA, herein designated VGAM RNA, also designated SEQ ID:5400.

Another function of VGAM2689 is therefore inhibition of Myosin, Heavy Polypeptide 10, Non-muscle (MYH10, Accession XM_044702). Accordingly, utilities of VGAM2689 include diagnosis, prevention and treatment of diseases and clinical conditions associated with MYH10. TBC1 Domain Family, Member 2 (TBC1D2, Accession NM_018421) is another VGAM2689 host target gene. TBC1D2 BINDING SITE is HOST TARGET binding site found in the 5' untranslated region of mRNA encoded by TBC1D2, corresponding to a HOST TARGET binding site such as BINDING SITE I, BINDING SITE II or BINDING SITE III. Table 2 illustrates the complementarity of the nucleotide sequences of TBC1D2 BINDING SITE, designated SEQ ID:20465, to the nucleotide sequence of VGAM2689 RNA, herein designated VGAM RNA, also designated SEQ ID:5400.

Another function of VGAM2689 is therefore inhibition of TBC1 Domain Family, Member 2 (TBC1D2, Accession NM_018421). Accordingly, utilities of VGAM2689 include diagnosis, prevention and treatment of diseases and clinical conditions associated with TBC1D2. Tyrosine Kinase, Non-receptor, 1 (TNK1, Accession NM_003985) is another VGAM2689 host target gene. TNK1 BINDING SITE is HOST TARGET binding site found in the 3' untranslated region of mRNA encoded by TNK1, corresponding to a HOST TARGET binding site such as BINDING SITE I, BINDING SITE II or BINDING SITE III. Table 2 illustrates the complementarity of the nucleotide sequences of TNK1 BINDING SITE, designated SEQ ID:10135, to the nucleotide sequence of VGAM2689 RNA, herein designated VGAM RNA, also designated SEQ ID:5400.

Another function of VGAM2689 is therefore inhibition of Tyrosine Kinase, Non-receptor, 1 (TNK1, Accession NM_003985). Accordingly, utilities of VGAM2689 include diagnosis, prevention and treatment of diseases and clinical conditions associated with TNK1. LOC146774 (Accession XM_085584) is another VGAM2689 host target gene. LOC146774 BINDING SITE is HOST TARGET binding site found in the 3' untranslated region of mRNA encoded by LOC146774, corresponding to a HOST TARGET binding site such as BINDING SITE I, BINDING SITE II or BINDING SITE III. Table 2 illustrates the complementarity of the nucleotide sequences of LOC146774 BINDING SITE, designated SEQ ID:38235, to the nucleotide sequence of VGAM2689 RNA, herein designated VGAM RNA, also designated SEQ ID:5400.

Another function of VGAM2689 is therefore inhibition of LOC146774 (Accession XM_085584). Accordingly, utilities of VGAM2689 include diagnosis, prevention and treatment of diseases and clinical conditions associated with LOC146774. LOC150290 (Accession XM_086863) is another VGAM2689 host target gene. LOC150290 BINDING SITE is HOST TARGET binding site found in the 3' untranslated region of mRNA encoded by LOC150290, corresponding to a HOST TARGET binding site such as BINDING SITE I, BINDING SITE II or BINDING SITE III. Table 2 illustrates the complementarity of the nucleotide sequences of LOC150290 BINDING SITE, designated SEQ ID:38931, to the nucleotide sequence of VGAM2689 RNA, herein designated VGAM RNA, also designated SEQ ID:5400.

Another function of VGAM2689 is therefore inhibition of LOC150290 (Accession XM_086863). Accordingly, utilities of VGAM2689 include diagnosis, prevention and treatment of diseases and clinical conditions associated with LOC150290. LOC155064 (Accession XM_088128) is another VGAM2689 host target gene. LOC155064 BINDING SITE is HOST TARGET binding site found in the 5' untranslated region of mRNA encoded by LOC155064, corresponding to a HOST TARGET binding site such as BINDING SITE I, BINDING SITE II or BINDING SITE III. Table 2 illustrates the complementarity of the nucleotide sequences of LOC155064 BINDING SITE, designated SEQ ID:39528, to the nucleotide sequence of VGAM2689 RNA, herein designated VGAM RNA, also designated SEQ ID:5400.

Another function of VGAM2689 is therefore inhibition of LOC155064 (Accession XM_088128). Accordingly, utilities of VGAM2689 include diagnosis, prevention and treatment of diseases and clinical conditions associated with LOC155064. LOC256477 (Accession XM_173324) is another VGAM2689 host target gene. LOC256477 BINDING SITE is HOST TARGET binding site found in the 5' untranslated region of mRNA encoded by LOC256477, corresponding to a HOST TARGET binding site such as BINDING SITE I, BINDING SITE II or BINDING SITE III. Table 2 illustrates the complementarity of the nucleotide sequences of LOC256477 BINDING SITE, designated SEQ ID:46535, to the nucleotide sequence of VGAM2689 RNA, herein designated VGAM RNA, also designated SEQ ID:5400.

Another function of VGAM2689 is therefore inhibition of LOC256477 (Accession XM_173324). Accordingly, utilities of VGAM2689 include diagnosis, prevention and treatment of diseases and clinical conditions associated with LOC256477. LOC257465 (Accession XM_088384) is another VGAM2689 host target gene. LOC257465 BINDING SITE is HOST TARGET binding site found in the 3' untranslated region of mRNA encoded by LOC257465, corresponding to a HOST TARGET binding site such as BINDING SITE I, BINDING SITE II or BINDING SITE III. Table 2 illustrates the complementarity of the nucleotide sequences of LOC257465 BINDING SITE, designated SEQ ID:39666, to the nucleotide sequence of VGAM2689 RNA, herein designated VGAM RNA, also designated SEQ ID:5400.

Another function of VGAM2689 is therefore inhibition of LOC257465 (Accession XM_088384). Accordingly, utilities of VGAM2689 include diagnosis, prevention and treatment of diseases and clinical conditions associated with LOC257465. FIG. 1 further provides a conceptual description of a novel bioinformatically detected viral gene of the present invention, referred to here as Viral Genomic Address Messenger 2690 (VGAM2690) viral gene, which modulates expression of respective host target genes thereof, the function and utility of which host target genes is known in the art.

VGAM2690 is a novel bioinformatically detected regulatory, non protein coding, viral micro RNA (miRNA) gene. The method by which VGAM2690 was detected is described hereinabove with reference to FIGS. 1-8.

VGAM2690 gene, herein designated VGAM GENE, is a viral gene contained in the genome of Phthorimaea Operculella Granulovirus. VGAM2690 host target gene, herein designated VGAM HOST TARGET GENE, is a human gene contained in the human genome.

VGAM2690 gene encodes a VGAM2690 precursor RNA, herein designated VGAM PRECURSOR RNA. Similar to other miRNA genes, and unlike most ordinary genes, VGAM2690 precursor RNA does not encode a protein. A nucleotide sequence identical or highly similar to the nucleotide sequence of VGAM2690 precursor RNA is designated SEQ ID:2676, and is provided hereinbelow with reference to the sequence listing part. Nucleotide sequence SEQ ID:2676 is located at position 69388 relative to the genome of Phthorimaea Operculella Granulovirus.

VGAM2690 precursor RNA folds onto itself, forming VGAM2690 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2690 folded precursor RNA into VGAM2690 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2690 RNA is designated SEQ ID:5401, and is provided hereinbelow with reference to the sequence listing part.

VGAM2690 host target gene, herein designated VGAM HOST TARGET GENE, encodes a corresponding messenger RNA, VGAM2690 host target RNA, herein designated VGAM HOST TARGET RNA. VGAM2690 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2690 RNA, herein designated VGAM RNA, binds complementarily to one or more host target binding sites located in untranslated regions of VGAM2690 host target RNA, herein designated VGAM HOST TARGET RNA. This complementary binding is due to the fact that the nucleotide sequence of VGAM2690 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2690 RNA, herein designated VGAM RNA, may have a different number of host target binding sites in untranslated regions of a VGAM2690 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2690 RNA, herein designated VGAM RNA, to host target binding sites on VGAM2690 host target RNA, herein designated VGAM HOST TARGET RNA, such as BINDING SITE I, BINDING SITE II and BINDING SITE III, inhibits translation of VGAM2690 host target RNA into VGAM2690 host target protein, herein designated VGAM HOST TARGET PROTEIN. VGAM host target protein is therefore outlined by a broken line.

It is appreciated that VGAM2690 host target gene, herein designated VGAM HOST TARGET GENE, in fact represents a plurality of VGAM2690 host target genes. The mRNA of each one of this plurality of VGAM2690 host target genes comprises one or more host target binding sites, each having a nucleotide sequence which is at least partly complementary to VGAM2690 RNA, herein designated VGAM RNA, and which when bound by VGAM2690 RNA causes inhibition of translation of respective one or more VGAM2690 host target proteins.

It is further appreciated by one skilled in the art that the mode of translational inhibition illustrated by FIG. 1 with specific reference to translational inhibition exerted by VGAM2690 gene, herein designated VGAM GENE, on one or more VGAM2690 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2690 is inhibition of expression of host target genes, as part of a novel viral mechanism of attacking a host. Accordingly, utilities of VGAM2690 include diagnosis, prevention and treatment of viral infection by Phthorimaea Operculella Granulovirus. Specific functions, and accordingly utilities, of VGAM2690 correlate with, and may be deduced from, the identity of the host target genes which VGAM2690 binds and inhibits, and the function of these host target genes, as elaborated hereinbelow.

Nucleotide sequences of the VGAM2690 precursor RNA, herein designated VGAM PRECURSOR RNA, and of the 'diced' VGAM2690 RNA, herein designated VGAM RNA, and a schematic representation of the secondary folding of VGAM2690 folded precursor RNA, herein designated VGAM FOLDED PRECURSOR RNA, of VGAM2690 are further described hereinbelow with reference to Table 1.

Nucleotide sequences of host target binding sites, such as BINDING SITE-I, BINDING SITE-II and BINDING SITE-III of FIG. 1, found on VGAM2690 host target RNA, and schematic representation of the complementarity of each of these host target binding sites to VGAM2690 RNA, herein designated VGAM RNA, are described hereinbelow with reference to Table 2.

As mentioned hereinabove with reference to FIG. 1, a function of VGAM2690 gene, herein designated VGAM is inhibition of expression of VGAM2690 target genes. It is appreciated that specific functions, and accordingly utilities, of VGAM2690 correlate with, and may be deduced from, the identity of the target genes which VGAM2690 binds and inhibits, and the function of these target genes, as elaborated hereinbelow.

COX11 Homolog, Cytochrome C Oxidase Assembly Protein (yeast) (COX11, Accession NM_004375) is a VGAM2690 host target gene. COX11 BINDING SITE is HOST TARGET binding site found in the 3' untranslated region of mRNA encoded by COX11, corresponding to a HOST TARGET binding site such as BINDING SITE I, BINDING SITE II or BINDING SITE III. Table 2 illustrates the complementarity of the nucleotide sequences of COX11 BINDING SITE, designated SEQ ID:10596, to the nucleotide sequence of VGAM2690 RNA, herein designated VGAM RNA, also designated SEQ ID:5401.

A function of VGAM2690 is therefore inhibition of COX11 Homolog, Cytochrome C Oxidase Assembly Protein (yeast) (COX11, Accession NM_004375). Accordingly, utilities of VGAM2690 include diagnosis, prevention and treatment of diseases and clinical conditions associated with COX11. CEGP1 (Accession NM_020974) is another VGAM2690 host target gene. CEGP1 BINDING SITE is HOST TARGET binding site found in the 3' untranslated region of mRNA encoded by CEGP1, corresponding to a HOST TARGET binding site such as BINDING SITE I, BINDING SITE II or BINDING SITE III. Table 2 illustrates the complementarity of the nucleotide sequences of CEGP1 BINDING SITE, designated SEQ ID:21958, to the nucleotide sequence of VGAM2690 RNA, herein designated VGAM RNA, also designated SEQ ID:5401.

Another function of VGAM2690 is therefore inhibition of CEGP1 (Accession NM_020974). Accordingly, utilities of VGAM2690 include diagnosis, prevention and treatment of diseases and clinical conditions associated with CEGP1. KIAA1061 (Accession XM_048786) is another VGAM2690 host target gene. KIAA1061 BINDING SITE is HOST TARGET binding site found in the 3' untranslated region of mRNA encoded by KIAA1061, corresponding to a HOST TARGET binding site such as BINDING SITE I, BINDING SITE II or BINDING SITE III. Table 2 illustrates the complementarity of the nucleotide sequences of KIAA1061 BINDING SITE, designated SEQ ID:35264, to the nucleotide sequence of VGAM2690 RNA, herein designated VGAM RNA, also designated SEQ ID:5401.

Another function of VGAM2690 is therefore inhibition of KIAA1061 (Accession XM_048786). Accordingly, utilities of VGAM2690 include diagnosis, prevention and treatment of diseases and clinical conditions associated with KIAA1061. KIAA1211 (Accession XM_044178) is another VGAM2690 host target gene. KIAA1211 BINDING SITE is HOST TARGET binding site found in the 3' untranslated region of mRNA encoded by KIAA1211, corresponding to a HOST TARGET binding site such as BINDING SITE I, BINDING SITE II or BINDING SITE III. Table 2 illustrates the complementarity of the nucleotide sequences of KIAA1211 BINDING SITE, designated SEQ ID:34159, to the nucleotide sequence of VGAM2690 RNA, herein designated VGAM RNA, also designated SEQ ID:5401.

Another function of VGAM2690 is therefore inhibition of KIAA1211 (Accession XM_044178). Accordingly, utilities of VGAM2690 include diagnosis, prevention and treatment of diseases and clinical conditions associated with KIAA1211. LOC163231 (Accession XM_092094) is another VGAM2690 host target gene. LOC163231 BINDING SITE is HOST TARGET binding site found in the 5' untranslated region of mRNA encoded by LOC163231, corresponding to a HOST TARGET binding site such as BINDING SITE I, BINDING SITE II or BINDING SITE III. Table 2 illustrates the complementarity of the nucleotide sequences of LOC163231 BINDING SITE, designated SEQ ID:40093, to the nucleotide sequence of VGAM2690 RNA, herein designated VGAM RNA, also designated SEQ ID:5401.

Another function of VGAM2690 is therefore inhibition of LOC163231 (Accession XM_092094). Accordingly, utilities of VGAM2690 include diagnosis, prevention and treatment of diseases and clinical conditions associated with LOC163231. FIG. 1 further provides a conceptual description of a novel bioinformatically detected viral gene of the present invention, referred to here as Viral Genomic Address Messenger 2691 (VGAM2691) viral gene, which modulates expression of respective host target genes thereof, the function and utility of which host target genes is known in the art.

VGAM2691 is a novel bioinformatically detected regulatory, non protein coding, viral micro RNA (miRNA) gene. The method by which VGAM2691 was detected is described hereinabove with reference to FIGS. 1-8.

VGAM2691 gene, herein designated VGAM GENE, is a viral gene contained in the genome of Phthorimaea Operculella Granulovirus. VGAM2691 host target gene, herein designated VGAM HOST TARGET GENE, is a human gene contained in the human genome.

VGAM2691 gene encodes a VGAM2691 precursor RNA, herein designated VGAM PRECURSOR RNA. Similar to other miRNA genes, and unlike most ordinary genes, VGAM2691 precursor RNA does not encode a protein. A nucleotide sequence identical or highly similar to the nucleotide sequence of VGAM2691 precursor RNA is designated SEQ ID:2677, and is provided hereinbelow with reference to the sequence listing part. Nucleotide sequence SEQ ID:2677 is located at position 68718 relative to the genome of Phthorimaea Operculella Granulovirus.

VGAM2691 precursor RNA folds onto itself, forming VGAM2691 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2691 folded precursor RNA into VGAM2691 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 58%) nucleotide sequence of VGAM2691 RNA is designated SEQ ID:5402, and is provided hereinbelow with reference to the sequence listing part.

VGAM2691 host target gene, herein designated VGAM HOST TARGET GENE, encodes a corresponding messenger RNA, VGAM2691 host target RNA, herein designated VGAM HOST TARGET RNA. VGAM2691 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2691 RNA, herein designated VGAM RNA, binds complementarily to one or more host target binding sites located in untranslated regions of VGAM2691 host target RNA, herein designated VGAM HOST TARGET RNA. This complementary binding is due to the fact that the nucleotide sequence of VGAM2691 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2691 RNA, herein designated VGAM RNA, may have a different number of host target binding sites in untranslated regions of a VGAM2691 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2691 RNA, herein designated VGAM RNA, to host target binding sites on VGAM2691 host target RNA, herein designated VGAM HOST TARGET RNA, such as BINDING SITE I, BINDING SITE II and BINDING SITE III, inhibits translation of VGAM2691 host target RNA into VGAM2691 host target protein, herein designated VGAM HOST TARGET PROTEIN. VGAM host target protein is therefore outlined by a broken line.

It is appreciated that VGAM2691 host target gene, herein designated VGAM HOST TARGET GENE, in fact represents a plurality of VGAM2691 host target genes. The mRNA of each one of this plurality of VGAM2691 host target genes comprises one or more host target binding sites, each having a nucleotide sequence which is at least partly complementary to VGAM2691 RNA, herein designated VGAM RNA, and which when bound by VGAM2691 RNA causes inhibition of translation of respective one or more VGAM2691 host target proteins.

It is further appreciated by one skilled in the art that the mode of translational inhibition illustrated by FIG. 1 with specific reference to translational inhibition exerted by VGAM2691 gene, herein designated VGAM GENE, on one or more VGAM2691 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2691 is inhibition of expression of host target genes, as part of a novel viral mechanism of attacking a host. Accordingly, utilities of VGAM2691 include diagnosis, prevention and treatment of viral infection by Phthorimaea Operculella Granulovirus. Specific functions, and accordingly utilities, of VGAM2691 correlate with, and may be deduced from, the identity of the host target genes which VGAM2691 binds and inhibits, and the function of these host target genes, as elaborated hereinbelow.

Nucleotide sequences of the VGAM2691 precursor RNA, herein designated VGAM PRECURSOR RNA, and of the 'diced' VGAM2691 RNA, herein designated VGAM RNA, and a schematic representation of the secondary folding of VGAM2691 folded precursor RNA, herein designated VGAM FOLDED PRECURSOR RNA, of VGAM2691 are further described hereinbelow with reference to Table 1.

Nucleotide sequences of host target binding sites, such as BINDING SITE-I, BINDING SITE-II and BINDING SITE-III of FIG. 1, found on VGAM2691 host target RNA, and schematic representation of the complementarity of each of these host target binding sites to VGAM2691 RNA, herein designated VGAM RNA, are described hereinbelow with reference to Table 2.

As mentioned hereinabove with reference to FIG. 1, a function of VGAM2691 gene, herein designated VGAM is inhibition of expression of VGAM2691 target genes. It is appreciated that specific functions, and accordingly utilities, of VGAM2691 correlate with, and may be deduced from, the identity of the target genes which VGAM2691 binds and inhibits, and the function of these target genes, as elaborated hereinbelow.

Reserved (C8orf13, Accession XM_088377) is a VGAM2691 host target gene. C8orf13 BINDING SITE is HOST TARGET binding site found in the 3' untranslated region of mRNA encoded by C8orf13, corresponding to a HOST TARGET binding site such as BINDING SITE I, BINDING SITE II or BINDING SITE III. Table 2 illustrates the complementarity of the nucleotide sequences of C8orf13 BINDING SITE, designated SEQ ID:39651, to the nucleotide sequence of VGAM2691 RNA, herein designated VGAM RNA, also designated SEQ ID:5402.

A function of VGAM2691 is therefore inhibition of Reserved (C8orf13, Accession XM_088377). Accordingly, utilities of VGAM2691 include diagnosis, prevention and treatment of diseases and clinical conditions associated with C8orf13. PP35 (Accession NM_007016) is another VGAM2691 host target gene. PP35 BINDING SITE is HOST TARGET binding site found in the 3' untranslated region of mRNA encoded by PP35, corresponding to a HOST TARGET binding site such as BINDING SITE I, BINDING SITE II or BINDING SITE III. Table 2 illustrates the complementarity of the nucleotide sequences of PP35 BINDING SITE, designated SEQ ID:13871, to the nucleotide sequence of VGAM2691 RNA, herein designated VGAM RNA, also designated SEQ ID:5402.

Another function of VGAM2691 is therefore inhibition of PP35 (Accession NM_007016). Accordingly, utilities of VGAM2691 include diagnosis, prevention and treatment of diseases and clinical conditions associated with PP35. LOC200014 (Accession XM_114087) is another VGAM2691 host target gene. LOC200014 BINDING SITE is HOST TARGET binding site found in the 3' untranslated region of mRNA encoded by LOC200014, corresponding to a HOST TARGET binding site such as BINDING SITE I, BINDING SITE II or BINDING SITE III. Table 2 illustrates the complementarity of the nucleotide sequences of LOC200014 BINDING SITE, designated SEQ ID:42686, to the nucleotide sequence of VGAM2691 RNA, herein designated VGAM RNA, also designated SEQ ID:5402.

Another function of VGAM2691 is therefore inhibition of LOC200014 (Accession XM_114087). Accordingly, utilities of VGAM2691 include diagnosis, prevention and treatment of diseases and clinical conditions associated with LOC200014. FIG. 1 further provides a conceptual description of a novel bioinformatically detected viral gene of the present invention, referred to here as Viral Genomic Address Messenger 2692 (VGAM2692) viral gene, which modulates expression of respective host target genes thereof, the function and utility of which host target genes is known in the art.

VGAM2692 is a novel bioinformatically detected regulatory, non protein coding, viral micro RNA (miRNA) gene. The method by which VGAM2692 was detected is described hereinabove with reference to FIGS. 1-8.

VGAM2692 gene, herein designated VGAM GENE, is a viral gene contained in the genome of Phthorimaea Operculella Granulovirus. VGAM2692 host target gene, herein designated VGAM HOST TARGET GENE, is a human gene contained in the human genome.

VGAM2692 gene encodes a VGAM2692 precursor RNA, herein designated VGAM PRECURSOR RNA. Similar to other miRNA genes, and unlike most ordinary genes, VGAM2692 precursor RNA does not encode a protein. A nucleotide sequence identical or highly similar to the nucleotide sequence of VGAM2692 precursor RNA is designated SEQ ID:2678, and is provided hereinbelow with reference to the sequence listing part. Nucleotide sequence SEQ ID:2678 is located at position 70677 relative to the genome of Phthorimaea Operculella Granulovirus.

VGAM2692 precursor RNA folds onto itself, forming VGAM2692 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2692 folded precursor RNA into VGAM2692 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2692 RNA is designated SEQ ID:5403, and is provided hereinbelow with reference to the sequence listing part.

VGAM2692 host target gene, herein designated VGAM HOST TARGET GENE, encodes a corresponding messenger RNA, VGAM2692 host target RNA, herein designated VGAM HOST TARGET RNA. VGAM2692 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2692 RNA, herein designated VGAM RNA, binds complementarily to one or more host target binding sites located in untranslated regions of VGAM2692 host target RNA, herein designated VGAM HOST TARGET RNA. This complementary binding is due to the fact that the nucleotide sequence of VGAM2692 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2692 RNA, herein designated VGAM RNA, may have a different number of host target binding sites in untranslated regions of a VGAM2692 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2692 RNA, herein designated VGAM RNA, to host target binding sites on VGAM2692 host target RNA, herein designated VGAM HOST TARGET RNA, such as BINDING SITE I, BINDING SITE II and BINDING SITE III, inhibits translation of VGAM2692 host target RNA into VGAM2692 host target protein, herein designated VGAM HOST TARGET PROTEIN. VGAM host target protein is therefore outlined by a broken line.

It is appreciated that VGAM2692 host target gene, herein designated VGAM HOST TARGET GENE, in fact represents a plurality of VGAM2692 host target genes. The mRNA of each one of this plurality of VGAM2692 host target genes comprises one or more host target binding sites, each having a nucleotide sequence which is at least partly complementary to VGAM2692 RNA, herein designated VGAM RNA, and which when bound by VGAM2692 RNA causes inhibition of translation of respective one or more VGAM2692 host target proteins.

It is further appreciated by one skilled in the art that the mode of translational inhibition illustrated by FIG. 1 with specific reference to translational inhibition exerted by VGAM2692 gene, herein designated VGAM GENE, on one or more VGAM2692 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2692 is inhibition of expression of host target genes, as part of a novel viral mechanism of attacking a host. Accordingly, utilities of VGAM2692 include diagnosis, prevention and treatment of viral infection by Phthorimaea Operculella Granulovirus. Specific functions, and accordingly utilities, of VGAM2692 correlate with, and may be deduced from, the identity of the host target genes which VGAM2692 binds and inhibits, and the function of these host target genes, as elaborated hereinbelow.

Nucleotide sequences of the VGAM2692 precursor RNA, herein designated VGAM PRECURSOR RNA, and of the 'diced' VGAM2692 RNA, herein designated VGAM RNA, and a schematic representation of the secondary folding of VGAM2692 folded precursor RNA, herein designated VGAM FOLDED PRECURSOR RNA, of VGAM2692 are further described hereinbelow with reference to Table 1.

Nucleotide sequences of host target binding sites, such as BINDING SITE-I, BINDING SITE-II and BINDING SITE-III of FIG. 1, found on VGAM2692 host target RNA, and schematic representation of the complementarity of each of these host target binding sites to VGAM2692 RNA, herein designated VGAM RNA, are described hereinbelow with reference to Table 2.

As mentioned hereinabove with reference to FIG. 1, a function of VGAM2692 gene, herein designated VGAM is inhibition of expression of VGAM2692 target genes. It is appreciated that specific functions, and accordingly utilities, of VGAM2692 correlate with, and may be deduced from, the identity of the target genes which VGAM2692 binds and inhibits, and the function of these target genes, as elaborated hereinbelow.

F-box and WD-40 Domain Protein 1B (FBXW1B, Accession NM_012300) is a VGAM2692 host target gene. FBXW1B BINDING SITE1 through FBXW1B BINDING SITE3 are HOST TARGET binding sites found in untranslated regions of mRNA encoded by FBXW1B, corresponding to HOST TARGET binding sites such as BINDING SITE I, BINDING SITE II or BINDING SITE III. Table 2 illustrates the complementarity of the nucleotide sequences of FBXW1B BINDING SITE1 through FBXW1B BINDING SITE3, designated SEQ ID:14667, SEQ ID:27369 and SEQ ID:27379 respectively, to the nucleotide sequence of VGAM2692 RNA, herein designated VGAM RNA, also designated SEQ ID:5403.

A function of VGAM2692 is therefore inhibition of F-box and WD-40 Domain Protein 1B (FBXW1B, Accession NM_012300), a gene which somehow is involved in the process of neuronal cell differentiation or brain development. Accordingly, utilities of VGAM2692 include diagnosis, prevention and treatment of diseases and clinical conditions associated with FBXW1B. The function of FBXW1B and its association with various diseases and clinical conditions, has been established by previous studies, as described hereinabove with reference to VGAM25. Chromosome 1 Open Reading Frame 17 (C1orf17, Accession XM_042965) is another VGAM2692 host target gene. C1orf17 BINDING SITE is HOST TARGET binding site found in the 3' untranslated region of mRNA encoded by C1orf17, corresponding to a HOST TARGET binding site such as BINDING SITE I, BINDING SITE II or BINDING SITE III. Table 2 illustrates the complementarity of the nucleotide sequences of C1orf17 BINDING SITE, designated SEQ ID:33856, to the nucleotide sequence of VGAM2692 RNA, herein designated VGAM RNA, also designated SEQ ID:5403.

Another function of VGAM2692 is therefore inhibition of Chromosome 1 Open Reading Frame 17 (C1orf17, Accession XM_042965). Accordingly, utilities of VGAM2692 include diagnosis, prevention and treatment of diseases and clinical conditions associated with C1orf17. DKFZp434A2417 (Accession XM_038526) is another VGAM2692 host target gene. DKFZp434A2417 BINDING SITE is HOST TARGET binding site found in the 3' untranslated region of mRNA encoded by DKFZp434A2417, corresponding to a HOST TARGET binding site such as BINDING SITE I, BINDING SITE II or BINDING SITE III. Table 2 illustrates the complementarity of the nucleotide sequences of DKFZp434A2417 BINDING SITE, designated SEQ ID:32866, to the nucleotide sequence of VGAM2692 RNA, herein designated VGAM RNA, also designated SEQ ID:5403.

Another function of VGAM2692 is therefore inhibition of DKFZp434A2417 (Accession XM_038526). Accordingly, utilities of VGAM2692 include diagnosis, prevention and treatment of diseases and clinical conditions associated with DKFZp434A2417. FLJ10607 (Accession XM_085119) is another VGAM2692 host target gene. FLJ10607 BINDING SITE is HOST TARGET binding site found in the 3' untranslated region of mRNA encoded by FLJ10607, corresponding to a HOST TARGET binding site such as BINDING SITE I, BINDING SITE II or BINDING SITE III. Table 2 illustrates the complementarity of the nucleotide sequences of FLJ10607 BINDING SITE, designated SEQ ID:37836, to the nucleotide sequence of VGAM2692 RNA, herein designated VGAM RNA, also designated SEQ ID:5403.

Another function of VGAM2692 is therefore inhibition of FLJ10607 (Accession XM_085119). Accordingly, utilities of VGAM2692 include diagnosis, prevention and treatment of diseases and clinical conditions associated with FLJ10607. FLJ20202 (Accession NM_017709) is another VGAM2692 host target gene. FLJ20202 BINDING SITE is HOST TARGET binding site found in the 3' untranslated region of mRNA encoded by FLJ20202, corresponding to a HOST TARGET binding site such as BINDING SITE I, BINDING SITE II or BINDING SITE III. Table 2 illustrates the complementarity of the nucleotide sequences of FLJ20202 BINDING SITE, designated SEQ ID:19290, to the nucleotide sequence of VGAM2692 RNA, herein designated VGAM RNA, also designated SEQ ID:5403.

Another function of VGAM2692 is therefore inhibition of FLJ20202 (Accession NM_017709). Accordingly, utilities of VGAM2692 include diagnosis, prevention and treatment of diseases and clinical conditions associated with FLJ20202. FLJ31101 (Accession NM_017964) is another VGAM2692 host target gene. FLJ31101 BINDING SITE is HOST TARGET binding site found in the 3' untranslated region of mRNA encoded by FLJ31101, corresponding to a HOST TARGET binding site such as BINDING SITE I, BINDING SITE II or BINDING SITE III. Table 2 illustrates the complementarity of the nucleotide sequences of FLJ31101 BINDING SITE, designated SEQ ID:19688, to the nucleotide sequence of VGAM2692 RNA, herein designated VGAM RNA, also designated SEQ ID:5403.

Another function of VGAM2692 is therefore inhibition of FLJ31101 (Accession NM_017964). Accordingly, utilities of VGAM2692 include diagnosis, prevention and treatment of diseases and clinical conditions associated with FLJ31101. KIAA0979 (Accession NM_015032) is another VGAM2692 host target gene. KIAA0979 BINDING SITE is HOST TARGET binding site found in the 3' untranslated region of mRNA encoded by KIAA0979, corresponding to a HOST TARGET binding site such as BINDING SITE I, BINDING SITE II or BINDING SITE III. Table 2 illustrates the complementarity of the nucleotide sequences of KIAA0979 BINDING SITE, designated SEQ ID:17390, to the nucleotide sequence of VGAM2692 RNA, herein designated VGAM RNA, also designated SEQ ID:5403.

Another function of VGAM2692 is therefore inhibition of KIAA0979 (Accession NM_015032). Accordingly, utilities of VGAM2692 include diagnosis, prevention and treatment of diseases and clinical conditions associated with KIAA0979. Neuron Navigator 3 (NAV3, Accession NM_014903) is another VGAM2692 host target gene. NAV3 BINDING SITE is HOST TARGET binding site found in the 3' untranslated region of mRNA encoded by NAV3, corresponding to a HOST TARGET binding site such as BINDING SITE I, BINDING SITE II or BINDING SITE III. Table 2 illustrates the complementarity of the nucleotide sequences of NAV3 BINDING SITE, designated SEQ ID:17092, to the nucleotide sequence of VGAM2692 RNA, herein designated VGAM RNA, also designated SEQ ID:5403.

Another function of VGAM2692 is therefore inhibition of Neuron Navigator 3 (NAV3, Accession NM_014903). Accordingly, utilities of VGAM2692 include diagnosis, prevention and treatment of diseases and clinical conditions associated with NAV3. p21(CDKN1A)-activated Kinase 7 (PAK7, Accession XM_045653) is another VGAM2692 host target gene. PAK7 BINDING SITE is HOST TARGET binding site found in the 3' untranslated region of mRNA encoded by PAK7, corresponding to a HOST TARGET binding site such as BINDING SITE I, BINDING SITE II or BINDING SITE III. Table 2 illustrates the complementarity of the nucleotide sequences of PAK7 BINDING SITE, designated SEQ ID:34512, to the nucleotide sequence of VGAM2692 RNA, herein designated VGAM RNA, also designated SEQ ID:5403.

Another function of VGAM2692 is therefore inhibition of p21(CDKN1A)-activated Kinase 7 (PAK7, Accession XM_045653). Accordingly, utilities of VGAM2692 include diagnosis, prevention and treatment of diseases and clinical conditions associated with PAK7. SEC14-like 1 (S. cerevisiae) (SEC14L1, Accession NM_003003) is another VGAM2692 host target gene. SEC14L1 BINDING SITE is HOST TARGET binding site found in the 3' untranslated region of mRNA encoded by SEC14L1, corresponding to a HOST TARGET binding site such as BINDING SITE I, BINDING SITE II or BINDING SITE III. Table 2 illustrates the complementarity of the nucleotide sequences of SEC14L1 BINDING SITE, designated SEQ ID:8907, to the nucleotide sequence of VGAM2692 RNA, herein designated VGAM RNA, also designated SEQ ID:5403.

Another function of VGAM2692 is therefore inhibition of SEC14-like 1 (S. cerevisiae) (SEC14L1, Accession NM_003003). Accordingly, utilities of VGAM2692 include diagnosis, prevention and treatment of diseases and clinical conditions associated with SEC14L1. FIG. 1 further provides a conceptual description of a novel bioinformatically detected viral gene of the present invention, referred to here as Viral Genomic Address Messenger 2693 (VGAM2693) viral gene, which modulates expression of respective host target genes thereof, the function and utility of which host target genes is known in the art.

VGAM2693 is a novel bioinformatically detected regulatory, non protein coding, viral micro RNA (miRNA) gene. The method by which VGAM2693 was detected is described hereinabove with reference to FIGS. 1-8.

VGAM2693 gene, herein designated VGAM GENE, is a viral gene contained in the genome of Phthorimaea Operculella Granulovirus. VGAM2693 host target gene, herein designated VGAM HOST TARGET GENE, is a human gene contained in the human genome.

VGAM2693 gene encodes a VGAM2693 precursor RNA, herein designated VGAM PRECURSOR RNA. Similar to other miRNA genes, and unlike most ordinary genes, VGAM2693 precursor RNA does not encode a protein. A nucleotide sequence identical or highly similar to the nucleotide sequence of VGAM2693 precursor RNA is designated SEQ ID:2679, and is provided hereinbelow with reference to the sequence listing part. Nucleotide sequence SEQ ID:2679 is located at position 70243 relative to the genome of Phthorimaea Operculella Granulovirus.

VGAM2693 precursor RNA folds onto itself, forming VGAM2693 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2693 folded precursor RNA into VGAM2693 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 51%) nucleotide sequence of VGAM2693 RNA is designated SEQ ID:5404, and is provided hereinbelow with reference to the sequence listing part.

VGAM2693 host target gene, herein designated VGAM HOST TARGET GENE, encodes a corresponding messenger RNA, VGAM2693 host target RNA, herein designated VGAM HOST TARGET RNA. VGAM2693 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2693 RNA, herein designated VGAM RNA, binds complementarily to one or more host target binding sites located in untranslated regions of VGAM2693 host target RNA, herein designated VGAM HOST TARGET RNA. This complementary binding is due to the fact that the nucleotide sequence of VGAM2693 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2693 RNA, herein designated VGAM RNA, may have a different number of host target binding sites in untranslated regions of a VGAM2693 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2693 RNA, herein designated VGAM RNA, to host target binding sites on VGAM2693 host target RNA, herein designated VGAM HOST TARGET RNA, such as BINDING SITE I, BINDING SITE II and BINDING SITE III, inhibits translation of VGAM2693 host target RNA into VGAM2693 host target protein, herein designated VGAM HOST TARGET PROTEIN. VGAM host target protein is therefore outlined by a broken line.

It is appreciated that VGAM2693 host target gene, herein designated VGAM HOST TARGET GENE, in fact represents a plurality of VGAM2693 host target genes. The mRNA of each one of this plurality of VGAM2693 host target genes comprises one or more host target binding sites, each having a nucleotide sequence which is at least partly complementary to VGAM2693 RNA, herein designated VGAM RNA, and which when bound by VGAM2693 RNA causes inhibition of translation of respective one or more VGAM2693 host target proteins.

It is further appreciated by one skilled in the art that the mode of translational inhibition illustrated by FIG. 1 with specific reference to translational inhibition exerted by VGAM2693 gene, herein designated VGAM GENE, on one or more VGAM2693 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2693 is inhibition of expression of host target genes, as part of a novel viral mechanism of attacking a host. Accordingly, utilities of VGAM2693 include diagnosis, prevention and treatment of viral infection by Phthorimaea Operculella Granulovirus. Specific functions, and accordingly utilities, of VGAM2693 correlate with, and may be deduced from, the identity of the host target genes which VGAM2693 binds and inhibits, and the function of these host target genes, as elaborated hereinbelow.

Nucleotide sequences of the VGAM2693 precursor RNA, herein designated VGAM PRECURSOR RNA, and of the 'diced' VGAM2693 RNA, herein designated VGAM RNA, and a schematic representation of the secondary folding of VGAM2693 folded precursor RNA, herein designated VGAM FOLDED PRECURSOR RNA, of VGAM2693 are further described hereinbelow with reference to Table 1.

Nucleotide sequences of host target binding sites, such as BINDING SITE-I, BINDING SITE-II and BINDING SITE-III of FIG. 1, found on VGAM2693 host target RNA, and schematic representation of the complementarity of each of these host target binding sites to VGAM2693 RNA, herein designated VGAM RNA, are described hereinbelow with reference to Table 2.

As mentioned hereinabove with reference to FIG. 1, a function of VGAM2693 gene, herein designated VGAM is inhibition of expression of VGAM2693 target genes. It is appreciated that specific functions, and accordingly utilities, of VGAM2693 correlate with, and may be deduced from, the identity of the target genes which VGAM2693 binds and inhibits, and the function of these target genes, as elaborated hereinbelow.

Archain 1 (ARCN1, Accession NM_001655) is a VGAM2693 host target gene. ARCN1 BINDING SITE is HOST TARGET binding site found in the 3' untranslated region of mRNA encoded by ARCN1, corresponding to a HOST TARGET binding site such as BINDING SITE I, BINDING SITE II or BINDING SITE III. Table 2 illustrates the complementarity of the nucleotide sequences of ARCN1 BINDING SITE, designated SEQ ID:7365, to the nucleotide sequence of VGAM2693 RNA, herein designated VGAM RNA, also designated SEQ ID:5404.

A function of VGAM2693 is therefore inhibition of Archain 1 (ARCN1, Accession NM_001655), a gene which plays a fundamental role in eukaryotic cell biology. Accordingly, utilities of VGAM2693 include diagnosis, prevention and treatment of diseases and clinical conditions associated with ARCN1. The function of ARCN1 and its association with various diseases and clinical conditions, has been established by previous studies, as described hereinabove with reference to VGAM1226. UDP-Gal:betaGlcNAc Beta 1,3-galactosyltransferase, Polypeptide 2 (B3GALT2, Accession NM_003783) is another VGAM2693 host target gene. B3GALT2 BINDING SITE is HOST TARGET binding site found in the 5' untranslated region of mRNA encoded by B3GALT2, corresponding to a HOST TARGET binding site such as BINDING SITE I, BINDING SITE II or BINDING SITE III. Table 2 illustrates the complementarity of the nucleotide sequences of B3GALT2 BINDING SITE, designated SEQ ID:9869, to the nucleotide sequence of VGAM2693 RNA, herein designated VGAM RNA, also designated SEQ ID:5404.

Another function of VGAM2693 is therefore inhibition of UDP-Gal:betaGlcNAc Beta 1,3-galactosyltransferase, Polypeptide 2 (B3GALT2, Accession NM_003783). Accordingly, utilities of VGAM2693 include diagnosis, prevention and treatment of diseases and clinical conditions associated with B3GALT2. Ectodermal-neural Cortex (with BTB-like domain) (ENC1, Accession NM_003633) is another VGAM2693 host target gene. ENC1 BINDING SITE is HOST TARGET binding site found in the 3' untranslated region of mRNA encoded by ENC1, corresponding to a HOST TARGET binding site such as BINDING SITE I, BINDING SITE II or BINDING SITE III. Table 2 illustrates the complementarity of the nucleotide sequences of ENC1 BINDING SITE, designated SEQ ID:9695, to the nucleotide sequence of VGAM2693 RNA, herein designated VGAM RNA, also designated SEQ ID:5404.

Another function of VGAM2693 is therefore inhibition of Ectodermal-neural Cortex (with BTB-like domain) (ENC1, Accession NM_003633), a gene which is an actin-binding protein involved in the regulation of neuronal process formation and in differentiation of neural crest cells. Accordingly, utilities of VGAM2693 include diagnosis, prevention and treatment of diseases and clinical conditions associated with ENC1. The function of ENC1 and its association with various diseases and clinical conditions, has been established by previous studies, as described hereinabove with reference to VGAM233. Epidermal Growth Factor Receptor Pathway Substrate 8 (EPS8, Accession NM_004447) is another VGAM2693 host target gene. EPS8 BINDING SITE is HOST TARGET binding site found in the 3' untranslated region of mRNA encoded by EPS8, corresponding to a HOST TARGET binding site such as BINDING SITE I, BINDING SITE II or BINDING SITE III. Table 2 illustrates the complementarity of the nucleotide sequences of EPS8 BINDING SITE, designated SEQ ID:10741, to the nucleotide sequence of VGAM2693 RNA, herein designated VGAM RNA, also designated SEQ ID:5404.

Another function of VGAM2693 is therefore inhibition of Epidermal Growth Factor Receptor Pathway Substrate 8 (EPS8, Accession NM_004447), a gene which has a role in normal and neoplastic cell proliferation; contains an SH3 motif. Accordingly, utilities of VGAM2693 include diagnosis, prevention and treatment of diseases and clinical conditions associated with EPS8. The function of EPS8 and its association with various diseases and clinical conditions, has been established by previous studies, as described hereinabove with reference to VGAM1533. Fatty Acid Binding Protein 2, Intestinal (FABP2, Accession NM_000134) is another VGAM2693 host target gene. FABP2 BINDING SITE is HOST TARGET binding site found in the 3' untranslated region of mRNA encoded by FABP2, corresponding to a HOST TARGET binding site such as BINDING SITE I, BINDING SITE II or BINDING SITE III. Table 2 illustrates the complementarity of the nucleotide sequences of FABP2 BINDING SITE, designated SEQ ID:5621, to the nucleotide sequence of VGAM2693 RNA, herein designated VGAM RNA, also designated SEQ ID:5404.

Another function of VGAM2693 is therefore inhibition of Fatty Acid Binding Protein 2, Intestinal (FABP2, Accession NM_000134), a gene which may have a role in dietary fat uptake or processing. Accordingly, utilities of VGAM2693 include diagnosis, prevention and treatment of diseases and clinical conditions associated with FABP2. The function of FABP2 and its association with various diseases and clinical conditions, has been established by previous studies, as described hereinabove with reference to VGAM951. Lipoprotein Lipase (LPL, Accession NM_000237) is another VGAM2693 host target gene. LPL BINDING SITE is HOST TARGET binding site found in the 3' untranslated region of mRNA encoded by LPL, corresponding to a HOST TARGET binding site such as BINDING SITE I, BINDING SITE II or BINDING SITE III. Table 2 illustrates the complementarity of the nucleotide sequences of LPL BINDING SITE, designated SEQ ID:5748, to the nucleotide sequence of VGAM2693 RNA, herein designated VGAM RNA, also designated SEQ ID:5404.

Another function of VGAM2693 is therefore inhibition of Lipoprotein Lipase (LPL, Accession NM_000237), a gene which is the hydrolysis of triglycerides of circulating chylomicrons and very low density lipoproteins (vldl). the enzyme functions in the presence of apolipoprotein c-2 on the luminal surface of vascular. Accordingly, utilities of VGAM2693 include diagnosis, prevention and treatment of diseases and clinical conditions associated with LPL. The function of LPL and its association with various diseases and clinical conditions, has been established by previous studies, as described hereinabove with reference to VGAM55. Nuclear Receptor Subfamily 4, Group A, Member 2 (NR4A2, Accession NM_006186) is another VGAM2693 host target gene. NR4A2 BINDING SITE is HOST TARGET binding site found in the 3' untranslated region of mRNA encoded by NR4A2, corresponding to a HOST TARGET binding site such as BINDING SITE I, BINDING SITE II or BINDING SITE III. Table 2 illustrates the complementarity of the nucleotide sequences of NR4A2 BINDING SITE, designated SEQ ID:12853, to the nucleotide sequence of VGAM2693 RNA, herein designated VGAM RNA, also designated SEQ ID:5404.

Another function of VGAM2693 is therefore inhibition of Nuclear Receptor Subfamily 4, Group A, Member 2 (NR4A2, Accession NM_006186), a gene which may be a general coactivator of transcription. Accordingly, utilities of VGAM2693 include diagnosis, prevention and treatment of diseases and clinical conditions associated with NR4A2. The function of NR4A2 and its association with various diseases and clinical conditions, has been established by previous studies, as described hereinabove with reference to VGAM127. Parkinson Disease (autosomal recessive, juvenile) 2, Parkin (PARK2, Accession NM_004562) is another VGAM2693 host target gene. PARK2 BINDING SITE1 through PARK2 BINDING SITE3 are HOST TARGET binding sites found in untranslated regions of mRNA encoded by PARK2, corresponding to HOST TARGET binding sites such as BINDING SITE I, BINDING SITE II or BINDING SITE III. Table 2 illustrates the complementarity of the nucleotide sequences of PARK2 BINDING SITE1 through PARK2 BINDING SITE3, designated SEQ ID:10902, SEQ ID:15149 and SEQ ID:15156 respectively, to the nucleotide sequence of VGAM2693 RNA, herein designated VGAM RNA, also designated SEQ ID:5404.

Another function of VGAM2693 is therefore inhibition of Parkinson Disease (autosomal recessive, juvenile) 2, Parkin (PARK2, Accession NM_004562). Accordingly, utilities of VGAM2693 include diagnosis, prevention and treatment of diseases and clinical conditions associated with PARK2. Ubiquitin-conjugating Enzyme E2 Variant 1 (UBE2V1, Accession NM_021988) is another VGAM2693 host target gene. UBE2V1 BINDING SITE1 through UBE2V1 BINDING SITE3 are HOST TARGET binding sites found in untranslated regions of mRNA encoded by UBE2V1, corresponding to HOST TARGET binding sites such as BINDING SITE I, BINDING SITE II or BINDING SITE III. Table 2 illustrates the complementarity of the nucleotide sequences of UBE2V1 BINDING SITE1 through UBE2V1 BINDING SITE3, designated SEQ ID:22517, SEQ ID:9365 and SEQ ID:17886 respectively, to the nucleotide sequence of VGAM2693 RNA, herein designated VGAM RNA, also designated SEQ ID:5404.

Another function of VGAM2693 is therefore inhibition of Ubiquitin-conjugating Enzyme E2 Variant 1 (UBE2V1, Accession NM_021988), a gene which may play a role in signaling for DNA repair. Accordingly, utilities of VGAM2693 include diagnosis, prevention and treatment of diseases and clinical conditions associated with UBE2V1. The function of UBE2V1 and its association with various diseases and clinical conditions, has been established by previous studies, as described hereinabove with reference to VGAM155. KIAA0335 (Accession NM_014803) is another VGAM2693 host target gene. KIAA0335 BINDING SITE is HOST TARGET binding site found in the 3' untranslated region of mRNA encoded by KIAA0335, corresponding to a HOST TARGET binding site such as BINDING SITE I, BINDING SITE II or BINDING SITE III. Table 2 illustrates the complementarity of the nucleotide sequences of KIAA0335 BINDING SITE, designated SEQ ID:16728, to the nucleotide sequence of VGAM2693 RNA, herein designated VGAM RNA, also designated SEQ ID:5404.

Another function of VGAM2693 is therefore inhibition of KIAA0335 (Accession NM_014803). Accordingly, utilities of VGAM2693 include diagnosis, prevention and treatment of diseases and clinical conditions associated with KIAA0335. Neuropilin (NRP) and Tolloid (TLL)-like 1 (NETO1, Accession NM_138966) is another VGAM2693 host target gene. NETO1 BINDING SITE is HOST TARGET binding site found in the 3' untranslated region of mRNA encoded by NETO1, corresponding to a HOST TARGET binding site such as BINDING SITE I, BINDING SITE II or BINDING SITE III. Table 2 illustrates the complementarity of the nucleotide sequences of NETO1 BINDING SITE, designated SEQ ID:29068, to the nucleotide sequence of VGAM2693 RNA, herein designated VGAM RNA, also designated SEQ ID:5404.

Another function of VGAM2693 is therefore inhibition of Neuropilin (NRP) and Tolloid (TLL)-like 1 (NETO1, Accession NM_138966). Accordingly, utilities of VGAM2693 include diagnosis, prevention and treatment of diseases and clinical conditions associated with NETO1. NTT73 (Accession NM_018057) is another VGAM2693 host target gene. NTT73 BINDING SITE is HOST TARGET binding site found in the 3' untranslated region of mRNA encoded by NTT73, corresponding to a HOST TARGET binding site such as BINDING SITE I, BINDING SITE II or BINDING SITE III. Table 2 illustrates the complementarity of the nucleotide sequences of NTT73 BINDING SITE, designated SEQ ID:19821, to the nucleotide sequence of VGAM2693 RNA, herein designated VGAM RNA, also designated SEQ ID:5404.

Another function of VGAM2693 is therefore inhibition of NTT73 (Accession NM_018057). Accordingly, utilities of VGAM2693 include diagnosis, prevention and treatment of diseases and clinical conditions associated with NTT73. R3H Domain (binds single-stranded nucleic acids) Containing (R3HDM, Accession NM_015361) is another VGAM2693 host target gene. R3HDM BINDING SITE is HOST TARGET binding site found in the 5' untranslated region of mRNA encoded by R3HDM, corresponding to a HOST TARGET binding site such as BINDING SITE I, BINDING SITE II or BINDING SITE III. Table 2 illustrates the complementarity of the nucleotide sequences of R3HDM BINDING SITE, designated SEQ ID:17658, to the nucleotide sequence of VGAM2693 RNA, herein designated VGAM RNA, also designated SEQ ID:5404.

Another function of VGAM2693 is therefore inhibition of R3H Domain (binds single-stranded nucleic acids) Containing (R3HDM, Accession NM_015361). Accordingly, utilities of VGAM2693 include diagnosis, prevention and treatment of diseases and clinical conditions associated with R3HDM. Synovial Sarcoma Translocation Gene On Chromosome 18-like 1 (SS18L1, Accession XM_037202) is another VGAM2693 host target gene. SS18L1 BINDING SITE is HOST TARGET binding site found in the 3' untranslated region of mRNA encoded by SS18L1, corresponding to a HOST TARGET binding site such as BINDING SITE I, BINDING SITE II or BINDING SITE III. Table 2 illustrates the complementarity of the nucleotide sequences of SS18L1 BINDING SITE, designated SEQ ID:32557, to the nucleotide sequence of VGAM2693 RNA, herein designated VGAM RNA, also designated SEQ ID:5404.

Another function of VGAM2693 is therefore inhibition of Synovial Sarcoma Translocation Gene On Chromosome 18-like 1 (SS18L1, Accession XM_037202). Accordingly, utilities of VGAM2693 include diagnosis, prevention and treatment of diseases and clinical conditions associated with SS18L1. FIG. 1 further provides a conceptual description of a novel bioinformatically detected viral gene of the present invention, referred to here as Viral Genomic Address Messenger 2694 (VGAM2694) viral gene, which modulates expression of respective host target genes thereof, the function and utility of which host target genes is known in the art.

VGAM2694 is a novel bioinformatically detected regulatory, non protein coding, viral micro RNA (miRNA) gene. The method by which VGAM2694 was detected is described hereinabove with reference to FIGS. 1-8.

VGAM2694 gene, herein designated VGAM GENE, is a viral gene contained in the genome of Phthorimaea Operculella Granulovirus. VGAM2694 host target gene, herein designated VGAM HOST TARGET GENE, is a human gene contained in the human genome.

VGAM2694 gene encodes a VGAM2694 precursor RNA, herein designated VGAM PRECURSOR RNA. Similar to other miRNA genes, and unlike most ordinary genes, VGAM2694 precursor RNA does not encode a protein. A nucleotide sequence identical or highly similar to the nucleotide sequence of VGAM2694 precursor RNA is designated SEQ ID:2680, and is provided hereinbelow with reference to the sequence listing part. Nucleotide sequence SEQ ID:2680 is located at position 71428 relative to the genome of Phthorimaea Operculella Granulovirus.

VGAM2694 precursor RNA folds onto itself, forming VGAM2694 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2694 folded precursor RNA into VGAM2694 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2694 RNA is designated SEQ ID:5405, and is provided hereinbelow with reference to the sequence listing part.

VGAM2694 host target gene, herein designated VGAM HOST TARGET GENE, encodes a corresponding messenger RNA, VGAM2694 host target RNA, herein designated VGAM HOST TARGET RNA. VGAM2694 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2694 RNA, herein designated VGAM RNA, binds complementarily to one or more host target binding sites located in untranslated regions of VGAM2694 host target RNA, herein designated VGAM HOST TARGET RNA. This complementary binding is due to the fact that the nucleotide sequence of VGAM2694 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2694 RNA, herein designated VGAM RNA, may have a different number of host target binding sites in untranslated regions of a VGAM2694 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2694 RNA, herein designated VGAM RNA, to host target binding sites on VGAM2694 host target RNA, herein designated VGAM HOST TARGET RNA, such as BINDING SITE I, BINDING SITE II and BINDING SITE III, inhibits translation of VGAM2694 host target RNA into VGAM2694 host target protein, herein designated VGAM HOST TARGET PROTEIN. VGAM host target protein is therefore outlined by a broken line.

It is appreciated that VGAM2694 host target gene, herein designated VGAM HOST TARGET GENE, in fact represents a plurality of VGAM2694 host target genes. The mRNA of each one of this plurality of VGAM2694 host target genes comprises one or more host target binding sites, each having a nucleotide sequence which is at least partly complementary to VGAM2694 RNA, herein designated VGAM RNA, and which when bound by VGAM2694 RNA causes inhibition of translation of respective one or more VGAM2694 host target proteins.

It is further appreciated by one skilled in the art that the mode of translational inhibition illustrated by FIG. 1 with specific reference to translational inhibition exerted by VGAM2694 gene, herein designated VGAM GENE, on one or more VGAM2694 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2694 is inhibition of expression of host target genes, as part of a novel viral mechanism of attacking a host. Accordingly, utilities of VGAM2694 include diagnosis, prevention and treatment of viral infection by Phthorimaea Operculella Granulovirus. Specific functions, and accordingly utilities, of VGAM2694 correlate with, and may be deduced from, the identity of the host target genes which VGAM2694 binds and inhibits, and the function of these host target genes, as elaborated hereinbelow.

Nucleotide sequences of the VGAM2694 precursor RNA, herein designated VGAM PRECURSOR RNA, and of the 'diced' VGAM2694 RNA, herein designated VGAM RNA, and a schematic representation of the secondary folding of VGAM2694 folded precursor RNA, herein designated VGAM FOLDED PRECURSOR RNA, of VGAM2694 are further described hereinbelow with reference to Table 1.

Nucleotide sequences of host target binding sites, such as BINDING SITE-I, BINDING SITE-II and BINDING SITE-III of FIG. 1, found on VGAM2694 host target RNA, and schematic representation of the complementarity of each of these host target binding sites to VGAM2694 RNA, herein designated VGAM RNA, are described hereinbelow with reference to Table 2.

As mentioned hereinabove with reference to FIG. 1, a function of VGAM2694 gene, herein designated VGAM is inhibition of expression of VGAM2694 target genes. It is appreciated that specific functions, and accordingly utilities, of VGAM2694 correlate with, and may be deduced from, the identity of the target genes which VGAM2694 binds and inhibits, and the function of these target genes, as elaborated hereinbelow.

ADP-ribosylation Factor-like 4 (ARL4, Accession NM_005738) is a VGAM2694 host target gene. ARL4 BINDING SITE is HOST TARGET binding site found in the 5' untranslated region of mRNA encoded by ARL4, corresponding to a HOST TARGET binding site such as BINDING SITE I, BINDING SITE II or BINDING SITE III. Table 2 illustrates the complementarity of the nucleotide sequences of ARL4 BINDING SITE, designated SEQ ID:12299, to the nucleotide sequence of VGAM2694 RNA, herein designated VGAM RNA, also designated SEQ ID:5405.

A function of VGAM2694 is therefore inhibition of ADP-ribosylation Factor-like 4 (ARL4, Accession NM_005738), a gene which may be required for the progression of cells through meiosis. Accordingly, utilities of VGAM2694 include diagnosis, prevention and treatment of diseases and clinical conditions associated with ARL4. The function of ARL4 and its association with various diseases and clinical conditions, has been established by previous studies, as described hereinabove with reference to VGAM1050. Moesin (MSN, Accession XM_013042) is another VGAM2694 host target gene. MSN BINDING SITE is HOST TARGET binding site found in the 3' untranslated region of mRNA encoded by MSN, corresponding to a HOST TARGET binding site such as BINDING SITE I, BINDING SITE II or BINDING SITE III. Table 2 illustrates the complementarity of the nucleotide sequences of MSN BINDING SITE, designated SEQ ID:30227, to the nucleotide sequence of VGAM2694 RNA, herein designated VGAM RNA, also designated SEQ ID:5405.

Another function of VGAM2694 is therefore inhibition of Moesin (MSN, Accession XM_013042), a gene which may have a role linking the cytoskeleton to the plasma membrane. Accordingly, utilities of VGAM2694 include diagnosis, prevention and treatment of diseases and clinical conditions associated with MSN. The function of MSN and its association with various diseases and clinical conditions, has been established by previous studies, as described hereinabove with reference to VGAM248. Nuclear Receptor Coactivator 6 (NCOA6, Accession NM_014071) is another VGAM2694 host target gene. NCOA6 BINDING SITE is HOST TARGET binding site found in the 5' untranslated region of mRNA encoded by NCOA6, corresponding to a HOST TARGET binding site such as BINDING SITE I, BINDING SITE II or BINDING SITE III. Table 2 illustrates the complementarity of the nucleotide sequences of NCOA6 BINDING SITE, designated SEQ ID:15285, to the nucleotide sequence of VGAM2694 RNA, herein designated VGAM RNA, also designated SEQ ID:5405.

Another function of VGAM2694 is therefore inhibition of Nuclear Receptor Coactivator 6 (NCOA6, Accession NM_014071), a gene which activates gene transcription through ligand-dependent association with coactivators. Accordingly, utilities of VGAM2694 include diagnosis, prevention and treatment of diseases and clinical conditions associated with NCOA6. The function of NCOA6 and its association with various diseases and clinical conditions, has been established by previous studies, as described hereinabove with reference to VGAM25. Norrie Disease (pseudoglioma) (NDP, Accession NM_000266) is another VGAM2694 host target gene. NDP BINDING SITE is HOST TARGET binding site found in the 3' untranslated region of mRNA encoded by NDP, corresponding to a HOST TARGET binding site such as BINDING SITE I, BINDING SITE II or BINDING SITE III. Table 2 illustrates the complementarity of the nucleotide sequences of NDP BINDING SITE, designated SEQ ID:5805, to the nucleotide sequence of VGAM2694 RNA, herein designated VGAM RNA, also designated SEQ ID:5405.

Another function of VGAM2694 is therefore inhibition of Norrie Disease (pseudoglioma) (NDP, Accession NM_000266), a gene which may be involved in a pathway that regulates neural cell differentiation and proliferation. Accordingly, utilities of VGAM2694 include diagnosis, prevention and treatment of diseases and clinical conditions associated with NDP. The function of NDP and its association with various diseases and clinical conditions, has been established by previous studies, as described hereinabove with reference to VGAM113. Soc-2 Suppressor of Clear Homolog (C. elegans) (SHOC2, Accession NM_007373) is another VGAM2694 host target gene. SHOC2 BINDING SITE is HOST TARGET binding site found in the 3' untranslated region of mRNA encoded by SHOC2, corresponding to a HOST TARGET binding site such as BINDING SITE I, BINDING SITE II or BINDING SITE III. Table 2 illustrates the complementarity of the nucleotide sequences of SHOC2 BINDING SITE, designated SEQ ID:14305, to the nucleotide sequence of VGAM2694 RNA, herein designated VGAM RNA, also designated SEQ ID:5405.

Another function of VGAM2694 is therefore inhibition of Soc-2 Suppressor of Clear Homolog (C. elegans) (SHOC2, Accession NM_007373), a gene which may be a regulator of the let-60 ras pathway. Accordingly, utilities of VGAM2694 include diagnosis, prevention and treatment of diseases and clinical conditions associated with SHOC2. The function of SHOC2 and its association with various diseases and clinical conditions, has been established by previous studies, as described hereinabove with reference to VGAM464. Sarcospan (Kras oncogene-associated gene) (SSPN, Accession NM_005086) is another VGAM2694 host target gene. SSPN BINDING SITE is HOST TARGET binding site found in the 3' untranslated region of mRNA encoded by SSPN, corresponding to a HOST TARGET binding site such as BIND- ING SITE I, BINDING SITE II or BINDING SITE III. Table 2 illustrates the complementarity of the nucleotide sequences of SSPN BINDING SITE, designated SEQ ID:11536, to the nucleotide sequence of VGAM2694 RNA, herein designated VGAM RNA, also designated SEQ ID:5405.

Another function of VGAM2694 is therefore inhibition of Sarcospan (Kras oncogene-associated gene) (SSPN, Accession NM_005086), a gene which spans the muscle plasma membrane and forms a link between the f-actin cytoskeleton and the extracellular matrix. Accordingly, utilities of VGAM2694 include diagnosis, prevention and treatment of diseases and clinical conditions associated with SSPN. The function of SSPN and its association with various diseases and clinical conditions, has been established by previous studies, as described hereinabove with reference to VGAM996. SUV39H2 (Accession NM_024670) is another VGAM2694 host target gene. SUV39H2 BINDING SITE is HOST TARGET binding site found in the 3' untranslated region of mRNA encoded by SUV39H2, corresponding to a HOST TARGET binding site such as BINDING SITE I, BINDING SITE II or BINDING SITE III. Table 2 illustrates the complementarity of the nucleotide sequences of SUV39H2 BINDING SITE, designated SEQ ID:23977, to the nucleotide sequence of VGAM2694 RNA, herein designated VGAM RNA, also designated SEQ ID:5405.

Another function of VGAM2694 is therefore inhibition of SUV39H2 (Accession NM_024670), a gene which is involved in gene repression and the modification of position-effect- variegation. Accordingly, utilities of VGAM2694 include diagnosis, prevention and treatment of diseases and clinical conditions associated with SUV39H2. The function of SUV39H2 and its association with various diseases and clinical conditions, has been established by previous studies, as described hereinabove with reference to VGAM424. Tripartite Motif-containing 37 (TRIM37, Accession NM_015294) is another VGAM2694 host target gene. TRIM37 BINDING SITE is HOST TARGET binding site found in the 3' untranslated region of mRNA encoded by TRIM37, corresponding to a HOST TARGET binding site such as BINDING SITE I, BINDING SITE II or BINDING SITE III. Table 2 illustrates the complementarity of the nucleotide sequences of TRIM37 BINDING SITE, designated SEQ ID:17616, to the nucleotide sequence of VGAM2694 RNA, herein designated VGAM RNA, also designated SEQ ID:5405.

Another function of VGAM2694 is therefore inhibition of Tripartite Motif-containing 37 (TRIM37, Accession NM_015294). Accordingly, utilities of VGAM2694 include diagnosis, prevention and treatment of diseases and clinical conditions associated with TRIM37. Zinc Finger Protein 137 (clone pHZ-30) (ZNF137, Accession NM_003438) is another VGAM2694 host target gene. ZNF137 BINDING SITE is HOST TARGET binding site found in the 3' untranslated region of mRNA encoded by ZNF137, corresponding to a HOST TARGET binding site such as BINDING SITE I, BINDING SITE II or BINDING SITE III. Table 2 illustrates the complementarity of the nucleotide sequences of ZNF137 BINDING SITE, designated SEQ ID:9495, to the nucleotide sequence of VGAM2694 RNA, herein designated VGAM RNA, also designated SEQ ID:5405.

Another function of VGAM2694 is therefore inhibition of Zinc Finger Protein 137 (clone pHZ-30) (ZNF137, Accession NM_003438). Accordingly, utilities of VGAM2694 include diagnosis, prevention and treatment of diseases and clinical conditions associated with ZNF137. ATPase, Class V, Type 10D (ATP10D, Accession XM_054907) is another VGAM2694 host target gene. ATP10D BINDING SITE is HOST TARGET binding site found in the 3' untranslated region of mRNA encoded by ATP10D, corresponding to a HOST TARGET binding site such as BINDING SITE I, BINDING SITE II or BINDING SITE III. Table 2 illustrates the complementarity of the nucleotide sequences of ATP10D BINDING SITE, designated SEQ ID:36203, to the nucleotide sequence of VGAM2694 RNA, herein designated VGAM RNA, also designated SEQ ID:5405.

Another function of VGAM2694 is therefore inhibition of ATPase, Class V, Type 10D (ATP10D, Accession XM_054907). Accordingly, utilities of VGAM2694 include diagnosis, prevention and treatment of diseases and clinical conditions associated with ATP10D. Chromosome 2 Open Reading Frame 6 (C2orf6, Accession NM_018221) is another VGAM2694 host target gene. C2orf6 BINDING SITE is HOST TARGET binding site found in the 3' untranslated region of mRNA encoded by C2orf6, corresponding to a HOST TARGET binding site such as BINDING SITE I, BINDING SITE II or BINDING SITE III. Table 2 illustrates the complementarity of the nucleotide sequences of C2orf6 BINDING SITE, designated SEQ ID:20143, to the nucleotide sequence of VGAM2694 RNA, herein designated VGAM RNA, also designated SEQ ID:5405.

Another function of VGAM2694 is therefore inhibition of Chromosome 2 Open Reading Frame 6 (C2orf6, Accession NM_018221). Accordingly, utilities of VGAM2694 include diagnosis, prevention and treatment of diseases and clinical conditions associated with C2orf6. ELL2 (Accession NM_012081) is another VGAM2694 host target gene. ELL2 BINDING SITE is HOST TARGET binding site found in the 3' untranslated region of mRNA encoded by ELL2, corresponding to a HOST TARGET binding site such as BINDING SITE I, BINDING SITE II or BINDING SITE III. Table 2 illustrates the complementarity of the nucleotide sequences of ELL2 BINDING SITE, designated SEQ ID:14370, to the nucleotide sequence of VGAM2694 RNA, herein designated VGAM RNA, also designated SEQ ID:5405.

Another function of VGAM2694 is therefore inhibition of ELL2 (Accession NM_012081). Accordingly, utilities of VGAM2694 include diagnosis, prevention and treatment of diseases and clinical conditions associated with ELL2. FUS Interacting Protein (serine-arginine rich) 1 (FUSIP1, Accession NM_006625) is another VGAM2694 host target gene. FUSIP1 BINDING SITE is HOST TARGET binding site found in the 3' untranslated region of mRNA encoded by FUSIP1, corresponding to a HOST TARGET binding site such as BINDING SITE I, BINDING SITE II or BINDING SITE III. Table 2 illustrates the complementarity of the nucleotide sequences of FUSIP1 BINDING SITE, designated SEQ ID:13412, to the nucleotide sequence of VGAM2694 RNA, herein designated VGAM RNA, also designated SEQ ID:5405.

Another function of VGAM2694 is therefore inhibition of FUS Interacting Protein (serine-arginine rich) 1 (FUSIP1, Accession NM_006625). Accordingly, utilities of VGAM2694 include diagnosis, prevention and treatment of diseases and clinical conditions associated with FUSIP1. KIAA0495 (Accession XM_031397) is another VGAM2694 host target gene. KIAA0495 BINDING SITE is HOST TARGET binding site found in the 5" untranslated region of mRNA encoded by KIAA0495, corresponding to a HOST TARGET binding site such as BINDING SITE I, BINDING SITE II or BINDING SITE III. Table 2 illustrates the complementarity of the nucleotide sequences of KIAA0495 BINDING SITE, designated SEQ ID:31365, to the nucleotide sequence of VGAM2694 RNA, herein designated VGAM RNA, also designated SEQ ID:5405.

Another function of VGAM2694 is therefore inhibition of KIAA0495 (Accession XM_031397). Accordingly, utilities of VGAM2694 include diagnosis, prevention and treatment of diseases and clinical conditions associated with KIAA0495. NET-6 (Accession NM_014399) is another VGAM2694 host target gene. NET-6 BINDING SITE is HOST TARGET binding site found in the 3' untranslated region of mRNA encoded by NET-6, corresponding to a HOST TARGET binding site such as BINDING SITE I, BINDING SITE II or BINDING SITE III. Table 2 illustrates the complementarity of the nucleotide sequences of NET-6 BINDING SITE, designated SEQ ID:15743, to the nucleotide sequence of VGAM2694 RNA, herein designated VGAM RNA, also designated SEQ ID:5405.

Another function of VGAM2694 is therefore inhibition of NET-6 (Accession NM_014399). Accordingly, utilities of VGAM2694 include diagnosis, prevention and treatment of diseases and clinical conditions associated with NET-6. LOC150517 (Accession XM_086936) is another VGAM2694 host target gene. LOC150517 BINDING SITE is HOST TARGET binding site found in the 5' untranslated region of mRNA encoded by LOC150517, corresponding to a HOST TARGET binding site such as BINDING SITE I, BINDING SITE II or BINDING SITE III. Table 2 illustrates the complementarity of the nucleotide sequences of LOC150517 BINDING SITE, designated SEQ ID:38986, to the nucleotide sequence of VGAM2694 RNA, herein designated VGAM RNA, also designated SEQ ID:5405.

Another function of VGAM2694 is therefore inhibition of LOC150517 (Accession XM_086936). Accordingly, utilities of VGAM2694 include diagnosis, prevention and treatment of diseases and clinical conditions associated with LOC150517. LOC253228 (Accession XM_171113) is another VGAM2694 host target gene. LOC253228 BINDING SITE is HOST TARGET binding site found in the 3' untranslated region of mRNA encoded by LOC253228, corresponding to a HOST TARGET binding site such as BINDING SITE I, BINDING SITE II or BINDING SITE III. Table 2 illustrates the complementarity of the nucleotide sequences of LOC253228 BINDING SITE, designated SEQ ID:45914, to the nucleotide sequence of VGAM2694 RNA, herein designated VGAM RNA, also designated SEQ ID:5405.

Another function of VGAM2694 is therefore inhibition of LOC253228 (Accession XM_171113). Accordingly, utilities of VGAM2694 include diagnosis, prevention and treatment of diseases and clinical conditions associated with LOC253228. LOC256946 (Accession XM_170543) is another VGAM2694 host target gene. LOC256946 BINDING SITE is HOST TARGET binding site found in the 3' untranslated region of mRNA encoded by LOC256946, corresponding to a HOST TARGET binding site such as BINDING SITE I, BINDING SITE II or BINDING SITE III. Table 2 illustrates the complementarity of the nucleotide sequences of LOC256946 BINDING SITE, designated SEQ ID:45362, to the nucleotide sequence of VGAM2694 RNA, herein designated VGAM RNA, also designated SEQ ID:5405.

Another function of VGAM2694 is therefore inhibition of LOC256946 (Accession XM_170543). Accordingly, utilities of VGAM2694 include diagnosis, prevention and treatment of diseases and clinical conditions associated with LOC256946. LOC56959 (Accession XM_088578) is another VGAM2694 host target gene. LOC56959 BINDING SITE is HOST TARGET binding site found in the 5' untranslated region of mRNA encoded by LOC56959, corresponding to a HOST TARGET binding site such as BINDING SITE I, BINDING SITE II or BINDING SITE III. Table 2 illustrates the complementarity of the nucleotide sequences of LOC56959 BINDING SITE, designated SEQ ID:39838, to the nucleotide sequence of VGAM2694 RNA, herein designated VGAM RNA, also designated SEQ ID:5405.

Another function of VGAM2694 is therefore inhibition of LOC56959 (Accession XM_088578). Accordingly, utilities of VGAM2694 include diagnosis, prevention and treatment of diseases and clinical conditions associated with LOC56959. LOC93550 (Accession XM_051999) is another VGAM2694 host target gene. LOC93550 BINDING SITE is HOST TARGET binding site found in the 3' untranslated region of mRNA encoded by LOC93550, corresponding to a HOST TARGET binding site such as BINDING SITE I, BINDING SITE II or BINDING SITE III. Table 2 illustrates the complementarity of the nucleotide sequences of LOC93550 BINDING SITE, designated SEQ ID:35932, to the nucleotide sequence of VGAM2694 RNA, herein designated VGAM RNA, also designated SEQ ID:5405.

Another function of VGAM2694 is therefore inhibition of LOC93550 (Accession XM_051999). Accordingly, utilities of VGAM2694 include diagnosis, prevention and treatment of diseases and clinical conditions associated with LOC93550. FIG. 1 further provides a conceptual description of a novel bioinformatically detected viral gene of the present invention, referred to here as Viral Genomic Address Messenger 2695 (VGAM2695) viral gene, which modulates expression of respective host target genes thereof, the function and utility of which host target genes is known in the art.

VGAM2695 is a novel bioinformatically detected regulatory, non protein coding, viral micro RNA (miRNA) gene. The method by which VGAM2695 was detected is described hereinabove with reference to FIGS. 1-8.

VGAM2695 gene, herein designated VGAM GENE, is a viral gene contained in the genome of Fringilla Coelebs Papillomavirus (FPV). VGAM2695 host target gene, herein designated VGAM HOST TARGET GENE, is a human gene contained in the human genome.

VGAM2695 gene encodes a VGAM2695 precursor RNA, herein designated VGAM PRECURSOR RNA. Similar to other miRNA genes, and unlike most ordinary genes, VGAM2695 precursor RNA does not encode a protein. A nucleotide sequence identical or highly similar to the nucleotide sequence of VGAM2695 precursor RNA is designated SEQ ID:2681, and is provided hereinbelow with reference to the sequence listing part. Nucleotide sequence SEQ ID:2681 is located at position 1921 relative to the genome of Fringilla Coelebs Papillomavirus (FPV).

VGAM2695 precursor RNA folds onto itself, forming VGAM2695 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2695 folded precursor RNA into VGAM2695 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM2695 RNA is designated SEQ ID:5406, and is provided hereinbelow with reference to the sequence listing part.

VGAM2695 host target gene, herein designated VGAM HOST TARGET GENE, encodes a corresponding messenger RNA, VGAM2695 host target RNA, herein designated VGAM HOST TARGET RNA. VGAM2695 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2695 RNA, herein designated VGAM RNA, binds complementarily to one or more host target binding sites located in untranslated regions of VGAM2695 host target RNA, herein designated VGAM HOST TARGET RNA. This complementary binding is due to the fact that the nucleotide sequence of VGAM2695 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2695 RNA, herein designated VGAM RNA, may have a different number of host target binding sites in untranslated regions of a VGAM2695 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2695 RNA, herein designated VGAM RNA, to host target binding sites on VGAM2695 host target RNA, herein designated VGAM HOST TARGET RNA, such as BINDING SITE I, BINDING SITE II and BINDING SITE III, inhibits translation of VGAM2695 host target RNA into VGAM2695 host target protein, herein designated VGAM HOST TARGET PROTEIN. VGAM host target protein is therefore outlined by a broken line.

It is appreciated that VGAM2695 host target gene, herein designated VGAM HOST TARGET GENE, in fact represents a plurality of VGAM2695 host target genes. The mRNA of each one of this plurality of VGAM2695 host target genes comprises one or more host target binding sites, each having a nucleotide sequence which is at least partly complementary to VGAM2695 RNA, herein designated VGAM RNA, and which when bound by VGAM2695 RNA causes inhibition of translation of respective one or more VGAM2695 host target proteins.

It is further appreciated by one skilled in the art that the mode of translational inhibition illustrated by FIG. 1 with specific reference to translational inhibition exerted by VGAM2695 gene, herein designated VGAM GENE, on one or more VGAM2695 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2695 is inhibition of expression of host target genes, as part of a novel viral mechanism of attacking a host. Accordingly, utilities of VGAM2695 include diagnosis, prevention and treatment of viral infection by Fringilla Coelebs Papillomavirus (FPV). Specific functions, and accordingly utilities, of VGAM2695 correlate with, and may be deduced from, the identity of the host target genes which VGAM2695 binds and inhibits, and the function of these host target genes, as elaborated hereinbelow.

Nucleotide sequences of the VGAM2695 precursor RNA, herein designated VGAM PRECURSOR RNA, and of the 'diced' VGAM2695 RNA, herein designated VGAM RNA, and a schematic representation of the secondary folding of VGAM2695 folded precursor RNA, herein designated VGAM FOLDED PRECURSOR RNA, of VGAM2695 are further described hereinbelow with reference to Table 1.

Nucleotide sequences of host target binding sites, such as BINDING SITE-I, BINDING SITE-II and BINDING SITE-III of FIG. 1, found on VGAM2695 host target RNA, and schematic representation of the complementarity of each of these host target binding sites to VGAM2695 RNA, herein designated VGAM RNA, are described hereinbelow with reference to Table 2.

As mentioned hereinabove with reference to FIG. 1, a function of VGAM2695 gene, herein designated VGAM is inhibition of expression of VGAM2695 target genes. It is appreciated that specific functions, and accordingly utilities, of VGAM2695 correlate with, and may be deduced from, the identity of the target genes which VGAM2695 binds and inhibits, and the function of these target genes, as elaborated hereinbelow.

V-yes-1 Yamaguchi Sarcoma Viral Oncogene Homolog 1 (YES1, Accession NM_005433) is a VGAM2695 host target gene. YES1 BINDING SITE is HOST TARGET binding site found in the 3' untranslated region of mRNA encoded by YES1, corresponding to a HOST TARGET binding site such as BINDING SITE I, BINDING SITE II or BINDING SITE III. Table 2 illustrates the complementarity of the nucleotide sequences of YES1 BINDING SITE, designated SEQ ID:11912, to the nucleotide sequence of VGAM2695 RNA, herein designated VGAM RNA, also designated SEQ ID:5406.

A function of VGAM2695 is therefore inhibition of V-yes-1 Yamaguchi Sarcoma Viral Oncogene Homolog 1 (YES1, Accession NM_005433), a gene which is a putative protein-tyrosine kinase. Accordingly, utilities of VGAM2695 include diagnosis, prevention and treatment of diseases and clinical conditions associated with YES1. The function of YES1 and its association with various diseases and clinical conditions, has been established by previous studies, as described hereinabove with reference to VGAM74. KIAA0721 (Accession NM_021648) is another VGAM2695 host target gene. KIAA0721 BINDING SITE1 and KIAA0721 BINDING SITE2 are HOST TARGET binding sites found in untranslated regions of mRNA encoded by KIAA0721, corresponding to HOST TARGET binding sites such as BINDING SITE I, BINDING SITE II or BINDING SITE III. Table 2 illustrates the complementarity of the nucleotide sequences of KIAA0721 BINDING SITE1 and KIAA0721 BINDING SITE2, designated SEQ ID:22317 and SEQ ID:45924 respectively, to the nucleotide sequence of VGAM2695 RNA, herein designated VGAM RNA, also designated SEQ ID:5406.

Another function of VGAM2695 is therefore inhibition of KIAA0721 (Accession NM_021648). Accordingly, utilities of VGAM2695 include diagnosis, prevention and treatment of diseases and clinical conditions associated with KIAA0721. FIG. 1 further provides a conceptual description of a novel bioinformatically detected viral gene of the present invention, referred to here as Viral Genomic Address Messenger 2696 (VGAM2696) viral gene, which modulates expression of respective host target genes thereof, the function and utility of which host target genes is known in the art.

VGAM2696 is a novel bioinformatically detected regulatory, non protein coding, viral micro RNA (miRNA) gene. The method by which VGAM2696 was detected is described hereinabove with reference to FIGS. 1-8.

VGAM2696 gene, herein designated VGAM GENE, is a viral gene contained in the genome of Paprika Mild Mottle Virus. VGAM2696 host target gene, herein designated VGAM HOST TARGET GENE, is a human gene contained in the human genome.

VGAM2696 gene encodes a VGAM2696 precursor RNA, herein designated VGAM PRECURSOR RNA. Similar to other miRNA genes, and unlike most ordinary genes, VGAM2696 precursor RNA does not encode a protein. A nucleotide sequence identical or highly similar to the nucleotide sequence of VGAM2696 precursor RNA is designated SEQ ID:2682, and is provided hereinbelow with reference to the sequence listing part. Nucleotide sequence SEQ ID:2682 is located at position 4675 relative to the genome of Paprika Mild Mottle Virus.

VGAM2696 precursor RNA folds onto itself, forming VGAM2696 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2696 folded precursor RNA into VGAM2696 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 84%) nucleotide sequence of VGAM2696 RNA is designated SEQ ID:5407, and is provided hereinbelow with reference to the sequence listing part.

VGAM2696 host target gene, herein designated VGAM HOST TARGET GENE, encodes a corresponding messenger RNA, VGAM2696 host target RNA, herein designated VGAM HOST TARGET RNA. VGAM2696 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2696 RNA, herein designated VGAM RNA, binds complementarily to one or more host target binding sites located in untranslated regions of VGAM2696 host target RNA, herein designated VGAM HOST TARGET RNA. This complementary binding is due to the fact that the nucleotide sequence of VGAM2696 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2696 RNA, herein designated VGAM RNA, may have a different number of host target binding sites in untranslated regions of a VGAM2696 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2696 RNA, herein designated VGAM RNA, to host target binding sites on VGAM2696 host target RNA, herein designated VGAM HOST TARGET RNA, such as BINDING SITE I, BINDING SITE II and BINDING SITE III, inhibits translation of VGAM2696 host target RNA into VGAM2696 host target protein, herein designated VGAM HOST TARGET PROTEIN. VGAM host target protein is therefore outlined by a broken line.

It is appreciated that VGAM2696 host target gene, herein designated VGAM HOST TARGET GENE, in fact represents a plurality of VGAM2696 host target genes. The mRNA of each one of this plurality of VGAM2696 host target genes comprises one or more host target binding sites, each having a nucleotide sequence which is at least partly complementary to VGAM2696 RNA, herein designated VGAM RNA, and which when bound by VGAM2696 RNA causes inhibition of translation of respective one or more VGAM2696 host target proteins.

It is further appreciated by one skilled in the art that the mode of translational inhibition illustrated by FIG. 1 with specific reference to translational inhibition exerted by VGAM2696 gene, herein designated VGAM GENE, on one or more VGAM2696 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2696 is inhibition of expression of host target genes, as part of a novel viral mechanism of attacking a host. Accordingly, utilities of VGAM2696 include diagnosis, prevention and treatment of viral infection by Paprika Mild Mottle Virus. Specific functions, and accordingly utilities, of VGAM2696 correlate with, and may be deduced from, the identity of the host target genes which VGAM2696 binds and inhibits, and the function of these host target genes, as elaborated hereinbelow.

Nucleotide sequences of the VGAM2696 precursor RNA, herein designated VGAM PRECURSOR RNA, and of the 'diced' VGAM2696 RNA, herein designated VGAM RNA, and a schematic representation of the secondary folding of VGAM2696 folded precursor RNA, herein designated VGAM FOLDED PRECURSOR RNA, of VGAM2696 are further described hereinbelow with reference to Table 1.

Nucleotide sequences of host target binding sites, such as BINDING SITE-I, BINDING SITE-II and BINDING SITE-III of FIG. 1, found on VGAM2696 host target RNA, and schematic representation of the complementarity of each of these host target binding sites to VGAM2696 RNA, herein designated VGAM RNA, are described hereinbelow with reference to Table 2.

As mentioned hereinabove with reference to FIG. 1, a function of VGAM2696 gene, herein designated VGAM is inhibition of expression of VGAM2696 target genes. It is appreciated that specific functions, and accordingly utilities, of VGAM2696 correlate with, and may be deduced from, the identity of the target genes which VGAM2696 binds and inhibits, and the function of these target genes, as elaborated hereinbelow.

Inhibitor of Growth Family, Member 1 (ING1, Accession NM_005537) is a VGAM2696 host target gene. ING1 BINDING SITE is HOST TARGET binding site found in the 3' untranslated region of mRNA encoded by ING1, corresponding to a HOST TARGET binding site such as BINDING SITE I, BINDING SITE II or BINDING SITE III. Table 2 illustrates the complementarity of the nucleotide sequences of ING1 BINDING SITE, designated SEQ ID:12061, to the nucleotide sequence of VGAM2696 RNA, herein designated VGAM RNA, also designated SEQ ID:5407.

A function of VGAM2696 is therefore inhibition of Inhibitor of Growth Family, Member 1 (ING1, Accession NM_005537), a gene which acts as a potent growth regulator in normal and in established cells. Accordingly, utilities of VGAM2696 include diagnosis, prevention and treatment of diseases and clinical conditions associated with ING1. The function of ING1 and its association with various diseases and clinical conditions, has been established by previous studies, as described hereinabove with reference to VGAM170. Mitogen-activated Protein Kinase Kinase Kinase 9 (MAP3K9, Accession XM_027237) is another VGAM2696 host target gene. MAP3K9 BINDING SITE is HOST TARGET binding site found in the 3' untranslated region of mRNA encoded by MAP3K9, corresponding to a HOST TARGET binding site such as BINDING SITE I, BINDING SITE II or BINDING SITE III. Table 2 illustrates the complementarity of the nucleotide sequences of MAP3K9 BINDING SITE, designated SEQ ID:30460, to the nucleotide sequence of VGAM2696 RNA, herein designated VGAM RNA, also designated SEQ ID:5407.

Another function of VGAM2696 is therefore inhibition of Mitogen-activated Protein Kinase Kinase Kinase 9 (MAP3K9, Accession XM_027237), a gene which is a MIXED-LINEAGE KINASE 1. Accordingly, utilities of VGAM2696 include diagnosis, prevention and treatment of diseases and clinical conditions associated with MAP3K9. The function of MAP3K9 and its association with various diseases and clinical conditions, has been established by previous studies, as described hereinabove with reference to VGAM1601. Purinergic Receptor P2Y, G-protein Coupled, 1 (P2RY1, Accession NM_002563) is another VGAM2696 host target gene. P2RY1 BINDING SITE is HOST TARGET binding site found in the 3' untranslated region of mRNA encoded by P2RY1, corresponding to a HOST TARGET binding site such as BINDING SITE I, BINDING SITE II or BINDING SITE III. Table 2 illustrates the complementarity of the nucleotide sequences of P2RY1 BINDING SITE, designated SEQ ID:8412, to the nucleotide sequence of VGAM2696 RNA, herein designated VGAM RNA, also designated SEQ ID:5407.

Another function of VGAM2696 is therefore inhibition of Purinergic Receptor P2Y, G-protein Coupled, 1 (P2RY1, Accession NM_002563), a gene which plays an essential role in thrombotic states. Accordingly, utilities of VGAM2696 include diagnosis, prevention and treatment of diseases and clinical conditions associated with P2RY1. The function of P2RY1 and its association with various diseases and clinical conditions, has been established by previous studies, as described hereinabove with reference to VGAM1929. Solute Carrier Family 7 (cationic amino acid transporter, y+ system), Member 8 (SLC7A8, Accession NM_012244) is another VGAM2696 host target gene. SLC7A8 BINDING SITE is HOST TARGET binding site found in the 3' untranslated region of mRNA encoded by SLC7A8, corresponding to a HOST TARGET binding site such as BINDING SITE I, BINDING SITE II or BINDING SITE III. Table 2 illustrates the complementarity of the nucleotide sequences of SLC7A8 BINDING SITE, designated SEQ ID:14551, to the nucleotide sequence of VGAM2696 RNA, herein designated VGAM RNA, also designated SEQ ID:5407.

Another function of VGAM2696 is therefore inhibition of Solute Carrier Family 7 (cationic amino acid transporter, y+ system), Member 8 (SLC7A8, Accession NM_012244), a gene which helps mediate transport of large and small neutral amino acids. Accordingly, utilities of VGAM2696 include diagnosis, prevention and treatment of diseases and clinical conditions associated with SLC7A8. The function of SLC7A8 and its association with various diseases and clinical conditions, has been established by previous studies, as described hereinabove with reference to VGAM1263. Chromosome 20 Open Reading Frame 12 (C20orf12, Accession NM_018152) is another VGAM2696 host target gene. C20orf12 BINDING SITE is HOST TARGET binding site found in the 5' untranslated region of mRNA encoded by C20orf12, corresponding to a HOST TARGET binding site such as BINDING SITE I, BINDING SITE II or BINDING SITE III. Table 2 illustrates the complementarity of the nucleotide sequences of C20orf12 BINDING SITE, designated SEQ ID:19960, to the nucleotide sequence of VGAM2696 RNA, herein designated VGAM RNA, also designated SEQ ID:5407.

Another function of VGAM2696 is therefore inhibition of Chromosome 20 Open Reading Frame 12 (C20orf12, Accession NM_018152). Accordingly, utilities of VGAM2696 include diagnosis, prevention and treatment of diseases and clinical conditions associated with C20orf12. Collectin Sub-family Member 10 (C-type lectin) (COLEC10, Accession NM_006438) is another VGAM2696 host target gene. COLEC10 BINDING SITE is HOST TARGET binding site found in the 3' untranslated region of mRNA encoded by COLEC10, corresponding to a HOST TARGET binding site such as BINDING SITE I, BINDING SITE II or BINDING SITE III. Table 2 illustrates the complementarity of the nucleotide sequences of COLEC10 BINDING SITE, designated SEQ ID:13144, to the nucleotide sequence of VGAM2696 RNA, herein designated VGAM RNA, also designated SEQ ID:5407.

Another function of VGAM2696 is therefore inhibition of Collectin Sub-family Member 10 (C-type lectin) (COLEC10, Accession NM_006438). Accordingly, utilities of VGAM2696 include diagnosis, prevention and treatment of diseases and clinical conditions associated with COLEC10. Zinc Finger Protein 387 (ZNF387, Accession NM_014682) is another VGAM2696 host target gene. ZNF387 BINDING SITE is HOST TARGET binding site found in the 3' untranslated region of mRNA encoded by ZNF387, corresponding to a HOST TARGET binding site such as BINDING SITE I, BINDING SITE II or BINDING SITE III. Table 2 illustrates the complementarity of the nucleotide sequences of ZNF387 BINDING SITE, designated SEQ ID:16175, to the nucleotide sequence of VGAM2696 RNA, herein designated VGAM RNA, also designated SEQ ID:5407.

Another function of VGAM2696 is therefore inhibition of Zinc Finger Protein 387 (ZNF387, Accession NM_014682). Accordingly, utilities of VGAM2696 include diagnosis, prevention and treatment of diseases and clinical conditions associated with ZNF387. LOC133584 (Accession XM_059661) is another VGAM2696 host target gene. LOC133584 BINDING SITE is HOST TARGET binding site found in the 3' untranslated region of mRNA encoded by LOC133584, corresponding to a HOST TARGET binding site such as BINDING SITE I, BINDING SITE II or BINDING SITE III. Table 2 illustrates the complementarity of the nucleotide sequences of LOC133584 BINDING SITE, designated SEQ ID:37044, to the nucleotide sequence of VGAM2696 RNA, herein designated VGAM RNA, also designated SEQ ID:5407.

Another function of VGAM2696 is therefore inhibition of LOC133584 (Accession XM_059661). Accordingly, utilities of VGAM2696 include diagnosis, prevention and treatment of diseases and clinical conditions associated with LOC133584. FIG. 1 further provides a conceptual description of a novel bioinformatically detected viral gene of the present invention, referred to here as Viral Genomic Address Messenger 2697 (VGAM2697) viral gene, which modulates expression of respective host target genes thereof, the function and utility of which host target genes is known in the art.

VGAM2697 is a novel bioinformatically detected regulatory, non protein coding, viral micro RNA (miRNA) gene. The method by which VGAM2697 was detected is described hereinabove with reference to FIGS. 1-8.

VGAM2697 gene, herein designated VGAM GENE, is a viral gene contained in the genome of Paprika Mild Mottle Virus. VGAM2697 host target gene, herein designated VGAM HOST TARGET GENE, is a human gene contained in the human genome.

VGAM2697 gene encodes a VGAM2697 precursor RNA, herein designated VGAM PRECURSOR RNA. Similar to other miRNA genes, and unlike most ordinary genes, VGAM2697 precursor RNA does not encode a protein. A nucleotide sequence identical or highly similar to the nucleotide sequence of VGAM2697 precursor RNA is designated SEQ ID:2683, and is provided hereinbelow with reference to the sequence listing part. Nucleotide sequence SEQ ID:2683 is located at position 891 relative to the genome of Paprika Mild Mottle Virus.

VGAM2697 precursor RNA folds onto itself, forming VGAM2697 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2697 folded precursor RNA into VGAM2697 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2697 RNA is designated SEQ ID:5408, and is provided hereinbelow with reference to the sequence listing part.

VGAM2697 host target gene, herein designated VGAM HOST TARGET GENE, encodes a corresponding messenger RNA, VGAM2697 host target RNA, herein designated VGAM HOST TARGET RNA. VGAM2697 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2697 RNA, herein designated VGAM RNA, binds complementarily to one or more host target binding sites located in untranslated regions of VGAM2697 host target RNA, herein designated VGAM HOST TARGET RNA. This complementary binding is due to the fact that the nucleotide sequence of VGAM2697 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2697 RNA, herein designated VGAM RNA, may have a different number of host target binding sites in untranslated regions of a VGAM2697 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2697 RNA, herein designated VGAM RNA, to host target binding sites on VGAM2697 host target RNA, herein designated VGAM HOST TARGET RNA, such as BINDING SITE I, BINDING SITE II and BINDING SITE III, inhibits translation of VGAM2697 host target RNA into VGAM2697 host target protein, herein designated VGAM HOST TARGET PROTEIN. VGAM host target protein is therefore outlined by a broken line.

It is appreciated that VGAM2697 host target gene, herein designated VGAM HOST TARGET GENE, in fact represents a plurality of VGAM2697 host target genes. The mRNA of each one of this plurality of VGAM2697 host target genes comprises one or more host target binding sites, each having a nucleotide sequence which is at least partly complementary to VGAM2697 RNA, herein designated VGAM RNA, and which when bound by VGAM2697 RNA causes inhibition of translation of respective one or more VGAM2697 host target proteins.

It is further appreciated by one skilled in the art that the mode of translational inhibition illustrated by FIG. 1 with specific reference to translational inhibition exerted by VGAM2697 gene, herein designated VGAM GENE, on one or more VGAM2697 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2697 is inhibition of expression of host target genes, as part of a novel viral mechanism of attacking a host. Accordingly, utilities of VGAM2697 include diagnosis, prevention and treatment of viral infection by Paprika Mild Mottle Virus. Specific functions, and accordingly utilities, of VGAM2697 correlate with, and may be deduced from, the identity of the host target genes which VGAM2697 binds and inhibits, and the function of these host target genes, as elaborated hereinbelow.

Nucleotide sequences of the VGAM2697 precursor RNA, herein designated VGAM PRECURSOR RNA, and of the 'diced' VGAM2697 RNA, herein designated VGAM RNA, and a schematic representation of the secondary folding of VGAM2697 folded precursor RNA, herein designated VGAM FOLDED PRECURSOR RNA, of VGAM2697 are further described hereinbelow with reference to Table 1.

Nucleotide sequences of host target binding sites, such as BINDING SITE-I, BINDING SITE-II and BINDING SITE-III of FIG. 1, found on VGAM2697 host target RNA, and schematic representation of the complementarity of each of these host target binding sites to VGAM2697 RNA, herein designated VGAM RNA, are described hereinbelow with reference to Table 2.

As mentioned hereinabove with reference to FIG. 1, a function of VGAM2697 gene, herein designated VGAM is inhibition of expression of VGAM2697 target genes. It is appreciated that specific functions, and accordingly utilities, of VGAM2697 correlate with, and may be deduced from, the identity of the target genes which VGAM2697 binds and inhibits, and the function of these target genes, as elaborated hereinbelow.

B-cell CLL/lymphoma 11B (zinc finger protein) (BCL11B, Accession NM_022898) is a VGAM2697 host target gene. BCL11B BINDING SITE is HOST TARGET binding site found in the 3' untranslated region of mRNA encoded by BCL11B, corresponding to a HOST TARGET binding site such as BINDING SITE I, BINDING SITE II or BINDING SITE III. Table 2 illustrates the complementarity of the nucleotide sequences of BCL11B BINDING SITE, designated SEQ ID:23171, to the nucleotide sequence of VGAM2697 RNA, herein designated VGAM RNA, also designated SEQ ID:5408.

A function of VGAM2697 is therefore inhibition of B-cell CLL/lymphoma 11B (zinc finger protein) (BCL11B, Accession NM_022898). Accordingly, utilities of VGAM2697 include diagnosis, prevention and treatment of diseases and clinical conditions associated with BCL11B. Integrin, Alpha V (vitronectin receptor, alpha polypeptide, antigen CD51) (ITGAV, Accession NM_002210) is another VGAM2697 host target gene. ITGAV BINDING SITE is HOST TARGET binding site found in the 3' untranslated region of mRNA encoded by ITGAV, corresponding to a HOST TARGET binding site such as BINDING SITE I, BINDING SITE II or BINDING SITE III. Table 2 illustrates the complementarity of the nucleotide sequences of ITGAV BINDING SITE, designated SEQ ID:7975, to the nucleotide sequence of VGAM2697 RNA, herein designated VGAM RNA, also designated SEQ ID:5408.

Another function of VGAM2697 is therefore inhibition of Integrin, Alpha V (vitronectin receptor, alpha polypeptide, antigen CD51) (ITGAV, Accession NM_002210), a gene which is a member of the integrin family of cell-surface proteins. Accordingly, utilities of VGAM2697 include diagnosis, prevention and treatment of diseases and clinical conditions associated with ITGAV. The function of ITGAV and its association with various diseases and clinical conditions, has been established by previous studies, as described hereinabove with reference to VGAM20. Spondin 1, (f-spondin) Extracellular Matrix Protein (SPON1, Accession XM_031184) is another VGAM2697 host target gene. SPON1 BINDING SITE is HOST TARGET binding site found in the 3' untranslated region of mRNA encoded by SPON1, corresponding to a HOST TARGET binding site such as BINDING SITE I, BINDING SITE II or BINDING SITE III. Table 2 illustrates the complementarity of the nucleotide sequences of SPON1 BINDING SITE, designated SEQ ID:31298, to the nucleotide sequence of VGAM2697 RNA, herein designated VGAM RNA, also designated SEQ ID:5408.

Another function of VGAM2697 is therefore inhibition of Spondin 1, (f-spondin) Extracellular Matrix Protein (SPON1, Accession XM_031184). Accordingly, utilities of VGAM2697 include diagnosis, prevention and treatment of diseases and clinical conditions associated with SPON1. Activity-dependent Neuroprotector (ADNP, Accession NM_015339) is another VGAM2697 host target gene. ADNP BINDING SITE is HOST TARGET binding site found in the 3' untranslated region of mRNA encoded by ADNP, corresponding to a HOST TARGET binding site such as BINDING SITE I, BINDING SITE II or BINDING SITE III. Table 2 illustrates the complementarity of the nucleotide sequences of ADNP BINDING SITE, designated SEQ ID:17646, to the nucleotide sequence of VGAM2697 RNA, herein designated VGAM RNA, also designated SEQ ID:5408.

Another function of VGAM2697 is therefore inhibition of Activity-dependent Neuroprotector (ADNP, Accession NM_015339). Accordingly, utilities of VGAM2697 include diagnosis, prevention and treatment of diseases and clinical conditions associated with ADNP. ATP6M8-9 (Accession NM_005765) is another VGAM2697 host target gene. ATP6M8-9 BINDING SITE is HOST TARGET binding site found in the 3' untranslated region of mRNA encoded by ATP6M8-9, corresponding to a HOST TARGET binding site such as BINDING SITE I, BINDING SITE II or BINDING SITE III. Table 2 illustrates the complementarity of the nucleotide sequences of ATP6M8-9 BINDING SITE, designated SEQ ID:12328, to the nucleotide sequence of VGAM2697 RNA, herein designated VGAM RNA, also designated SEQ ID:5408.

Another function of VGAM2697 is therefore inhibition of ATP6M8-9 (Accession NM_005765). Accordingly, utilities of VGAM2697 include diagnosis, prevention and treatment of diseases and clinical conditions associated with ATP6M8-9. KIAA0830 (Accession XM_045759) is another VGAM2697 host target gene. KIAA0830 BINDING SITE is HOST TARGET binding site found in the 3' untranslated region of mRNA encoded by KIAA0830, corresponding to a HOST TARGET binding site such as BINDING SITE I, BINDING SITE II or BINDING SITE III. Table 2 illustrates the complementarity of the nucleotide sequences of KIAA0830 BINDING SITE, designated SEQ ID:34545, to the nucleotide sequence of VGAM2697 RNA, herein designated VGAM RNA, also designated SEQ ID:5408.

Another function of VGAM2697 is therefore inhibition of KIAA0830 (Accession XM_045759). Accordingly, utilities of VGAM2697 include diagnosis, prevention and treatment of diseases and clinical conditions associated with KIAA0830. LOC135932 (Accession XM_072433) is another VGAM2697 host target gene. LOC135932 BINDING SITE is HOST TARGET binding site found in the 5' untranslated region of mRNA encoded by LOC135932, corresponding to a HOST TARGET binding site such as BINDING SITE I, BINDING SITE II or BINDING SITE III. Table 2 illustrates the complementarity of the nucleotide sequences of LOC135932 BINDING SITE, designated SEQ ID:37498, to the nucleotide sequence of VGAM2697 RNA, herein designated VGAM RNA, also designated SEQ ID:5408.

Another function of VGAM2697 is therefore inhibition of LOC135932 (Accession XM_072433). Accordingly, utilities of VGAM2697 include diagnosis, prevention and treatment of diseases and clinical conditions associated with LOC135932. LOC154760 (Accession XM_098603) is another VGAM2697 host target gene. LOC154760 BINDING SITE is HOST TARGET binding site found in the 5' untranslated region of mRNA encoded by LOC154760, corresponding to a HOST TARGET binding site such as BINDING SITE I, BINDING SITE II or BINDING SITE III. Table 2 illustrates the complementarity of the nucleotide sequences of LOC154760 BINDING SITE, designated SEQ ID:41724, to the nucleotide sequence of VGAM2697 RNA, herein designated VGAM RNA, also designated SEQ ID:5408.

Another function of VGAM2697 is therefore inhibition of LOC154760 (Accession XM_098603). Accordingly, utilities of VGAM2697 include diagnosis, prevention and treatment of diseases and clinical conditions associated with LOC154760. LOC91266 (Accession XM_037268) is another VGAM2697 host target gene. LOC91266 BINDING SITE is HOST TARGET binding site found in the 5' untranslated region of mRNA encoded by LOC91266, corresponding to a HOST TARGET binding site such as BINDING SITE I, BINDING SITE II or BINDING SITE III. Table 2 illustrates the complementarity of the nucleotide sequences of LOC91266 BINDING SITE, designated SEQ ID:32605, to the nucleotide sequence of VGAM2697 RNA, herein designated VGAM RNA, also designated SEQ ID:5408.

Another function of VGAM2697 is therefore inhibition of LOC91266 (Accession XM_037268). Accordingly, utilities of VGAM2697 include diagnosis, prevention and treatment of diseases and clinical conditions associated with LOC91266. FIG. 1 further provides a conceptual description of a novel bioinformatically detected viral gene of the present invention, referred to here as Viral Genomic Address Messenger 2698 (VGAM2698) viral gene, which modulates expression of respective host target genes thereof, the function and utility of which host target genes is known in the art.

VGAM2698 is a novel bioinformatically detected regulatory, non protein coding, viral micro RNA (miRNA) gene. The method by which VGAM2698 was detected is described hereinabove with reference to FIGS. 1-8.

VGAM2698 gene, herein designated VGAM GENE, is a viral gene contained in the genome of Paprika Mild Mottle Virus. VGAM2698 host target gene, herein designated VGAM HOST TARGET GENE, is a human gene contained in the human genome.

VGAM2698 gene encodes a VGAM2698 precursor RNA, herein designated VGAM PRECURSOR RNA. Similar to other miRNA genes, and unlike most ordinary genes, VGAM2698 precursor RNA does not encode a protein. A nucleotide sequence identical or highly similar to the nucleotide sequence of VGAM2698 precursor RNA is designated SEQ ID:2684, and is provided hereinbelow with reference to the sequence listing part. Nucleotide sequence SEQ ID:2684 is located at position 1275 relative to the genome of Paprika Mild Mottle Virus.

VGAM2698 precursor RNA folds onto itself, forming VGAM2698 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2698 folded precursor RNA into VGAM2698 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2698 RNA is designated SEQ ID:5409, and is provided hereinbelow with reference to the sequence listing part.

VGAM2698 host target gene, herein designated VGAM HOST TARGET GENE, encodes a corresponding messenger RNA, VGAM2698 host target RNA, herein designated VGAM HOST TARGET RNA. VGAM2698 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2698 RNA, herein designated VGAM RNA, binds complementarily to one or more host target binding sites located in untranslated regions of VGAM2698 host target RNA, herein designated VGAM HOST TARGET RNA. This complementary binding is due to the fact that the nucleotide sequence of VGAM2698 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2698 RNA, herein designated VGAM RNA, may have a different number of host target binding sites in untranslated regions of a VGAM2698 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2698 RNA, herein designated VGAM RNA, to host target binding sites on VGAM2698 host target RNA, herein designated VGAM HOST TARGET RNA, such as BINDING SITE I, BINDING SITE II and BINDING SITE III, inhibits translation of VGAM2698 host target RNA into VGAM2698 host target protein, herein designated VGAM HOST TARGET PROTEIN. VGAM host target protein is therefore outlined by a broken line.

It is appreciated that VGAM2698 host target gene, herein designated VGAM HOST TARGET GENE, in fact represents a plurality of VGAM2698 host target genes. The mRNA of each one of this plurality of VGAM2698 host target genes comprises one or more host target binding sites, each having a nucleotide sequence which is at least partly complementary to VGAM2698 RNA, herein designated VGAM RNA, and which when bound by VGAM2698 RNA causes inhibition of translation of respective one or more VGAM2698 host target proteins.

It is further appreciated by one skilled in the art that the mode of translational inhibition illustrated by FIG. 1 with specific reference to translational inhibition exerted by VGAM2698 gene, herein designated VGAM GENE, on one or more VGAM2698 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2698 is inhibition of expression of host target genes, as part of a novel viral mechanism of attacking a host. Accordingly, utilities of VGAM2698 include diagnosis, prevention and treatment of viral infection by Paprika Mild Mottle Virus. Specific functions, and accordingly utilities, of VGAM2698 correlate with, and may be deduced from, the identity of the host target genes which VGAM2698 binds and inhibits, and the function of these host target genes, as elaborated hereinbelow.

Nucleotide sequences of the VGAM2698 precursor RNA, herein designated VGAM PRECURSOR RNA, and of the 'diced' VGAM2698 RNA, herein designated VGAM RNA, and a schematic representation of the secondary folding of VGAM2698 folded precursor RNA, herein designated VGAM FOLDED PRECURSOR RNA, of VGAM2698 are further described hereinbelow with reference to Table 1.

Nucleotide sequences of host target binding sites, such as BINDING SITE-I, BINDING SITE-II and BINDING SITE-III of FIG. 1, found on VGAM2698 host target RNA, and schematic representation of the complementarity of each of these host target binding sites to VGAM2698 RNA, herein designated VGAM RNA, are described hereinbelow with reference to Table 2.

As mentioned hereinabove with reference to FIG. 1, a function of VGAM2698 gene, herein designated VGAM is inhibition of expression of VGAM2698 target genes. It is appreciated that specific functions, and accordingly utilities, of VGAM2698 correlate with, and may be deduced from, the identity of the target genes which VGAM2698 binds and inhibits, and the function of these target genes, as elaborated hereinbelow.

Adrenergic, Beta-3-, Receptor (ADRB3, Accession NM_000025) is a VGAM2698 host target gene. ADRB3 BINDING SITE is HOST TARGET binding site found in the 3' untranslated region of mRNA encoded by ADRB3, corresponding to a HOST TARGET binding site such as BINDING SITE I, BINDING SITE II or BINDING SITE III. Table 2 illustrates the complementarity of the nucleotide sequences of ADRB3 BINDING SITE, designated SEQ ID:5462, to the nucleotide sequence of VGAM2698 RNA, herein designated VGAM RNA, also designated SEQ ID:5409.

A function of VGAM2698 is therefore inhibition of Adrenergic, Beta-3-, Receptor (ADRB3, Accession NM_000025), a gene which stimulates adenylyl cyclase activity and regulates lipolysis. Accordingly, utilities of VGAM2698 include diagnosis, prevention and treatment of diseases and clinical conditions associated with ADRB3. The function of ADRB3 and its association with various diseases and clinical conditions, has been established by previous studies, as described hereinabove with reference to VGAM179. Arginine Vasopressin Receptor 1A (AVPR1A, Accession NM_000706) is another VGAM2698 host target gene. AVPR1A BINDING SITE is HOST TARGET binding site found in the 5' untranslated region of mRNA encoded by AVPR1A, corresponding to a HOST TARGET binding site such as BINDING SITE I, BINDING SITE II or BINDING SITE III. Table 2 illustrates the complementarity of the nucleotide sequences of AVPR1A BINDING SITE, designated SEQ ID:6374, to the nucleotide sequence of VGAM2698 RNA, herein designated VGAM RNA, also designated SEQ ID:5409.

Another function of VGAM2698 is therefore inhibition of Arginine Vasopressin Receptor 1A (AVPR1A, Accession NM_000706), a gene which mediates cell contraction and proliferation, platelet aggregation, release of coagulation factor, and glycogenolysis. Accordingly, utilities of VGAM2698 include diagnosis, prevention and treatment of diseases and clinical conditions associated with AVPR1A. The function of AVPR1A and its association with various diseases and clinical conditions, has been established by previous studies, as described hereinabove with reference to VGAM549. B-cell CLL/lymphoma 2 (BCL2, Accession NM_000633) is another VGAM2698 host target gene. BCL2 BINDING SITE is HOST TARGET binding site found in the 3' untranslated region of mRNA encoded by BCL2, corresponding to a HOST TARGET binding site such as BINDING SITE I, BINDING SITE II or BINDING SITE III. Table 2 illustrates the complementarity of the nucleotide sequences of BCL2 BINDING SITE, designated SEQ ID:6253, to the nucleotide sequence of VGAM2698 RNA, herein designated VGAM RNA, also designated SEQ ID:5409.

Another function of VGAM2698 is therefore inhibition of B-cell CLL/lymphoma 2 (BCL2, Accession NM_000633). Accordingly, utilities of VGAM2698 include diagnosis, prevention and treatment of diseases and clinical conditions associated with BCL2. B-cell CLL/lymphoma 7A (BCL7A, Accession NM_020993) is another VGAM2698 host target gene. BCL7A BINDING SITE is HOST TARGET binding site found in the 3' untranslated region of mRNA encoded by BCL7A, corresponding to a HOST TARGET binding site such as BINDING SITE I, BINDING SITE II or BINDING SITE III. Table 2 illustrates the complementarity of the nucleotide sequences of BCL7A BINDING SITE, designated SEQ ID:21991, to the nucleotide sequence of VGAM2698 RNA, herein designated VGAM RNA, also designated SEQ ID:5409.

Another function of VGAM2698 is therefore inhibition of B-cell CLL/lymphoma 7A (BCL7A, Accession NM_020993). Accordingly, utilities of VGAM2698 include diagnosis, prevention and treatment of diseases and clinical conditions associated with BCL7A. V-myc Myelocytomatosis Viral Oncogene Homolog 2 (avian) (MYCL2, Accession NM_005377) is another VGAM2698 host target gene. MYCL2 BINDING SITE is HOST TARGET binding site found in the 3' untranslated region of mRNA encoded by MYCL2, corresponding to a HOST TARGET binding site such as BINDING SITE I, BINDING SITE II or BINDING SITE III. Table 2 illustrates the complementarity of the nucleotide sequences of MYCL2 BINDING SITE, designated SEQ ID:11857, to the nucleotide sequence of VGAM2698 RNA, herein designated VGAM RNA, also designated SEQ ID:5409.

Another function of VGAM2698 is therefore inhibition of V-myc Myelocytomatosis Viral Oncogene Homolog 2 (avian) (MYCL2, Accession NM_005377). Accordingly, utilities of VGAM2698 include diagnosis, prevention and treatment of diseases and clinical conditions associated with MYCL2. Synapsin III (SYN3, Accession NM_133632) is another VGAM2698 host target gene. SYN3 BINDING SITE1 through SYN3 BINDING SITE3 are HOST TARGET binding sites found in untranslated regions of mRNA encoded by SYN3, corresponding to HOST TARGET binding sites such as BINDING SITE I, BINDING SITE II or BINDING SITE III. Table 2 illustrates the complementarity of the nucleotide sequences of SYN3 BINDING SITE1 through SYN3 BINDING SITE3, designated SEQ ID:28593, SEQ ID:28595 and SEQ ID:9584 respectively, to the nucleotide sequence of VGAM2698 RNA, herein designated VGAM RNA, also designated SEQ ID:5409.

Another function of VGAM2698 is therefore inhibition of Synapsin III (SYN3, Accession NM_133632), a gene which may be involved in the regulation of neurotransmitter release and synaptogenesis. Accordingly, utilities of VGAM2698 include diagnosis, prevention and treatment of diseases and clinical conditions associated with SYN3. The function of SYN3 and its association with various diseases and clinical conditions, has been established by previous studies, as described hereinabove with reference to VGAM925. FLJ31952 (Accession NM_144682) is another VGAM2698 host target gene. FLJ31952 BINDING SITE is HOST TARGET binding site found in the 3' untranslated region of mRNA encoded by FLJ31952, corresponding to a HOST TARGET binding site such as BINDING SITE I, BINDING SITE II or BINDING SITE III. Table 2 illustrates the complementarity of the nucleotide sequences of FLJ31952 BINDING SITE, designated SEQ ID:29498, to the nucleotide sequence of VGAM2698 RNA, herein designated VGAM RNA, also designated SEQ ID:5409.

Another function of VGAM2698 is therefore inhibition of FLJ31952 (Accession NM_144682). Accordingly, utilities of VGAM2698 include diagnosis, prevention and treatment of diseases and clinical conditions associated with FLJ31952. HSOBRGRP (Accession NM_017526) is another VGAM2698 host target gene. HSOBRGRP BINDING SITE is HOST TARGET binding site found in the 3' untranslated region of mRNA encoded by HSOBRGRP, corresponding to a HOST TARGET binding site such as BINDING SITE I, BINDING SITE II or BINDING SITE III. Table 2 illustrates the complementarity of the nucleotide sequences of HSOBRGRP BINDING SITE, designated SEQ ID:18970, to the nucleotide sequence of VGAM2698 RNA, herein designated VGAM RNA, also designated SEQ ID:5409.

Another function of VGAM2698 is therefore inhibition of HSOBRGRP (Accession NM_017526). Accordingly, utilities of VGAM2698 include diagnosis, prevention and treatment of diseases and clinical conditions associated with HSOBRGRP. Myelin Transcription Factor 1-like (MYT1L, Accession XM_039762) is another VGAM2698 host target gene. MYT1L BINDING SITE is HOST TARGET binding site found in the 5' untranslated region of mRNA encoded by MYT1L, corresponding to a HOST TARGET binding site such as BINDING SITE I, BINDING SITE II or BINDING SITE III. Table 2 illustrates the complementarity of the nucleotide sequences of MYT1L BINDING SITE, designated SEQ ID:33184, to the nucleotide sequence of VGAM2698 RNA, herein designated VGAM RNA, also designated SEQ ID:5409.

Another function of VGAM2698 is therefore inhibition of Myelin Transcription Factor 1-like (MYT1L, Accession XM_039762). Accordingly, utilities of VGAM2698 include diagnosis, prevention and treatment of diseases and clinical conditions associated with MYT1L. TUSP (Accession NM_020245) is another VGAM2698 host target gene. TUSP BINDING SITE is HOST TARGET binding site found in the 3' untranslated region of mRNA encoded by TUSP, corresponding to a HOST TARGET binding site such as BINDING SITE I, BINDING SITE II or BINDING SITE III. Table 2 illustrates the complementarity of the nucleotide sequences of TUSP BINDING SITE, designated SEQ ID:21535, to the nucleotide sequence of VGAM2698 RNA, herein designated VGAM RNA, also designated SEQ ID:5409.

Another function of VGAM2698 is therefore inhibition of TUSP (Accession NM_020245). Accordingly, utilities of VGAM2698 include diagnosis, prevention and treatment of diseases and clinical conditions associated with TUSP. LOC145225 (Accession XM_096741) is another VGAM2698 host target gene. LOC145225 BINDING SITE is HOST TARGET binding site found in the 3' untranslated region of mRNA encoded by LOC145225, corresponding to a HOST TARGET binding site such as BINDING SITE I, BINDING SITE II or BINDING SITE III. Table 2 illustrates the complementarity of the nucleotide sequences of LOC145225 BINDING SITE, designated SEQ ID:40525, to the nucleotide sequence of VGAM2698 RNA, herein designated VGAM RNA, also designated SEQ ID:5409.

Another function of VGAM2698 is therefore inhibition of LOC145225 (Accession XM_096741). Accordingly, utilities of VGAM2698 include diagnosis, prevention and treatment of diseases and clinical conditions associated with LOC145225. FIG. 1 further provides a conceptual description of a novel bioinformatically detected viral gene of the present invention, referred to here as Viral Genomic Address Messenger 2699 (VGAM2699) viral gene, which modulates expression of respective host target genes thereof, the function and utility of which host target genes is known in the art.

VGAM2699 is a novel bioinformatically detected regulatory, non protein coding, viral micro RNA (miRNA) gene. The method by which VGAM2699 was detected is described hereinabove with reference to FIGS. 1-8.

VGAM2699 gene, herein designated VGAM GENE, is a viral gene contained in the genome of Paprika Mild Mottle Virus. VGAM2699 host target gene, herein designated VGAM HOST TARGET GENE, is a human gene contained in the human genome.

VGAM2699 gene encodes a VGAM2699 precursor RNA, herein designated VGAM PRECURSOR RNA. Similar to other miRNA genes, and unlike most ordinary genes, VGAM2699 precursor RNA does not encode a protein. A nucleotide sequence identical or highly similar to the nucleotide sequence of VGAM2699 precursor RNA is designated SEQ ID:2685, and is provided hereinbelow with reference to the sequence listing part. Nucleotide sequence SEQ ID:2685 is located at position 2770 relative to the genome of Paprika Mild Mottle Virus.

VGAM2699 precursor RNA folds onto itself, forming VGAM2699 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2699 folded precursor RNA into VGAM2699 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM2699 RNA is designated SEQ ID:5410, and is provided hereinbelow with reference to the sequence listing part.

VGAM2699 host target gene, herein designated VGAM HOST TARGET GENE, encodes a corresponding messenger RNA, VGAM2699 host target RNA, herein designated VGAM HOST TARGET RNA. VGAM2699 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2699 RNA, herein designated VGAM RNA, binds complementarily to one or more host target binding sites located in untranslated regions of VGAM2699 host target RNA, herein designated VGAM HOST TARGET RNA. This complementary binding is due to the fact that the nucleotide sequence of VGAM2699 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2699 RNA, herein designated VGAM RNA, may have a different number of host target binding sites in untranslated regions of a VGAM2699 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2699 RNA, herein designated VGAM RNA, to host target binding sites on VGAM2699 host target RNA, herein designated VGAM HOST TARGET RNA, such as BINDING SITE I, BINDING SITE II and BINDING SITE III, inhibits translation of VGAM2699 host target RNA into VGAM2699 host target protein, herein designated VGAM HOST TARGET PROTEIN. VGAM host target protein is therefore outlined by a broken line.

It is appreciated that VGAM2699 host target gene, herein designated VGAM HOST TARGET GENE, in fact represents a plurality of VGAM2699 host target genes. The mRNA of each one of this plurality of VGAM2699 host target genes comprises one or more host target binding sites, each having a nucleotide sequence which is at least partly complementary to VGAM2699 RNA, herein designated VGAM RNA, and which when bound by VGAM2699 RNA causes inhibition of translation of respective one or more VGAM2699 host target proteins.

It is further appreciated by one skilled in the art that the mode of translational inhibition illustrated by FIG. 1 with specific reference to translational inhibition exerted by VGAM2699 gene, herein designated VGAM GENE, on one or more VGAM2699 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2699 is inhibition of expression of host target genes, as part of a novel viral mechanism of attacking a host. Accordingly, utilities of VGAM2699 include diagnosis, prevention and treatment of viral infection by Paprika Mild Mottle Virus. Specific functions, and accordingly utilities, of VGAM2699 correlate with, and may be deduced from, the identity of the host target genes which VGAM2699 binds and inhibits, and the function of these host target genes, as elaborated hereinbelow.

Nucleotide sequences of the VGAM2699 precursor RNA, herein designated VGAM PRECURSOR RNA, and of the 'diced' VGAM2699 RNA, herein designated VGAM RNA, and a schematic representation of the secondary folding of VGAM2699 folded precursor RNA, herein designated VGAM FOLDED PRECURSOR RNA, of VGAM2699 are further described hereinbelow with reference to Table 1.

Nucleotide sequences of host target binding sites, such as BINDING SITE-I, BINDING SITE-II and BINDING SITE-III of FIG. 1, found on VGAM2699 host target RNA, and schematic representation of the complementarity of each of these host target binding sites to VGAM2699 RNA, herein designated VGAM RNA, are described hereinbelow with reference to Table 2.

As mentioned hereinabove with reference to FIG. 1, a function of VGAM2699 gene, herein designated VGAM is inhibition of expression of VGAM2699 target genes. It is appreciated that specific functions, and accordingly utilities, of VGAM2699 correlate with, and may be deduced from, the identity of the target genes which VGAM2699 binds and inhibits, and the function of these target genes, as elaborated hereinbelow.

ATPase, Na+/K+ Transporting, Alpha 2 (+) Polypeptide (ATP1A2, Accession NM_000702) is a VGAM2699 host target gene. ATP1A2 BINDING SITE is HOST TARGET binding site found in the 3' untranslated region of mRNA encoded by ATP1A2, corresponding to a HOST TARGET binding site such as BINDING SITE I, BINDING SITE II or BINDING SITE III. Table 2 illustrates the complementarity of the nucleotide sequences of ATP1A2 BINDING SITE, designated SEQ ID:6365, to the nucleotide sequence of VGAM2699 RNA, herein designated VGAM RNA, also designated SEQ ID:5410.

A function of VGAM2699 is therefore inhibition of ATPase, Na+/K+ Transporting, Alpha 2 (+) Polypeptide (ATP1A2, Accession NM_000702). Accordingly, utilities of VGAM2699 include diagnosis, prevention and treatment of diseases and clinical conditions associated with ATP1A2. Caspase 8, Apoptosis-related Cysteine Protease (CASP8, Accession NM_033357) is another VGAM2699 host target gene. CASP8 BINDING SITE is HOST TARGET binding site found in the 3' untranslated region of mRNA encoded by CASP8, corresponding to a HOST TARGET binding site such as BINDING SITE I, BINDING SITE II or BINDING SITE III. Table 2 illustrates the complementarity of the nucleotide sequences of CASP8 BINDING SITE, designated SEQ ID:27208, to the nucleotide sequence of VGAM2699 RNA, herein designated VGAM RNA, also designated SEQ ID:5410.

Another function of VGAM2699 is therefore inhibition of Caspase 8, Apoptosis-related Cysteine Protease (CASP8, Accession NM_033357), a gene which is an apoptosis-related caspase and an upstream component of Fas receptor and tumor necrosis factor (TNF) receptor-induced apoptosis. Accordingly, utilities of VGAM2699 include diagnosis, prevention and treatment of diseases and clinical conditions associated with CASP8. The function of CASP8 and its association with various diseases and clinical conditions, has been established by previous studies, as described hereinabove with reference to VGAM145. Chloride Channel 3 (CLCN3, Accession NM_001829) is another VGAM2699 host target gene. CLCN3 BINDING SITE is HOST TARGET binding site found in the 3' untranslated region of mRNA encoded by CLCN3, corresponding to a HOST TARGET binding site such as BINDING SITE I, BINDING SITE II or BINDING SITE III. Table 2 illustrates the complementarity of the nucleotide sequences of CLCN3 BINDING SITE, designated SEQ ID:7565, to the nucleotide sequence of VGAM2699 RNA, herein designated VGAM RNA, also designated SEQ ID:5410.

Another function of VGAM2699 is therefore inhibition of Chloride Channel 3 (CLCN3, Accession NM_001829), a gene which play a role in the neural cell function through regulation of membrane excitability. Accordingly, utilities of VGAM2699 include diagnosis, prevention and treatment of diseases and clinical conditions associated with CLCN3. The function of CLCN3 and its association with various diseases and clinical conditions, has been established by previous studies, as described hereinabove with reference to VGAM1332. Collagen-like Tail Subunit (single strand of homotrimer) of Asymmetric Acetylcholinesterase (COLQ, Accession NM_005677) is another VGAM2699 host target gene. COLQ BINDING SITE1 through COLQ BINDING SITE6 are HOST TARGET binding sites found in untranslated regions of mRNA encoded by COLQ, corresponding to HOST TARGET binding sites such as BINDING SITE I, BINDING SITE II or BINDING SITE III. Table 2 illustrates the complementarity of the nucleotide sequences of COLQ BINDING SITE1 through COLQ BINDING SITE6, designated SEQ ID:12231, SEQ ID:27851, SEQ ID:27854, SEQ ID:27857, SEQ ID:27860 and SEQ ID:27863 respectively, to the nucleotide sequence of VGAM2699 RNA, herein designated VGAM RNA, also designated SEQ ID:5410.

Another function of VGAM2699 is therefore inhibition of Collagen-like Tail Subunit (single strand of homotrimer) of Asymmetric Acetylcholinesterase (COLQ, Accession NM_005677). Accordingly, utilities of VGAM2699 include diagnosis, prevention and treatment of diseases and clinical conditions associated with COLQ. Islet Cell Autoantigen 1, 69 kDa (ICA1, Accession NM_022308) is another VGAM2699 host target gene. ICA1 BINDING SITE is HOST TARGET binding site found in the 3' untranslated region of mRNA encoded by ICA1, corresponding to a HOST TARGET binding site such as BINDING SITE I, BINDING SITE II or BINDING SITE III. Table 2 illustrates the complementarity of the nucleotide sequences of ICA1 BINDING SITE, designated SEQ ID:22739, to the nucleotide sequence of VGAM2699 RNA, herein designated VGAM RNA, also designated SEQ ID:5410.

Another function of VGAM2699 is therefore inhibition of Islet Cell Autoantigen 1, 69 kDa (ICA1, Accession NM_022308), a gene which Islet cell autoantigen 1. Accordingly, utilities of VGAM2699 include diagnosis, prevention and treatment of diseases and clinical conditions associated with ICA1. The function of ICA1 and its association with various diseases and clinical conditions, has been established by previous studies, as described hereinabove with reference to VGAM1958. RNA Binding Motif Protein, X Chromosome (RBMX, Accession XM_042968) is another VGAM2699 host target gene. RBMX BINDING SITE is HOST TARGET binding site found in the 3' untranslated region of mRNA encoded by RBMX, corresponding to a HOST TARGET binding site such as BINDING SITE I, BINDING SITE II or BINDING SITE III. Table 2 illustrates the complementarity of the nucleotide sequences of RBMX BINDING SITE, designated SEQ ID:33858, to the nucleotide sequence of VGAM2699 RNA, herein designated VGAM RNA, also designated SEQ ID:5410.

Another function of VGAM2699 is therefore inhibition of RNA Binding Motif Protein, X Chromosome (RBMX, Accession XM_042968), a gene which binds rna as a component of the ribonucleosome. Accordingly, utilities of VGAM2699 include diagnosis, prevention and treatment of diseases and clinical conditions associated with RBMX. The function of RBMX and its association with various diseases and clinical conditions, has been established by previous studies, as described hereinabove with reference to VGAM1043. Zinc Finger Protein 255 (ZNF255, Accession NM_005774) is another VGAM2699 host target gene. ZNF255 BINDING SITE is HOST TARGET binding site found in the 5' untranslated region of mRNA encoded by ZNF255, corresponding to a HOST TARGET binding site such as BINDING SITE I, BINDING SITE II or BINDING SITE III. Table 2 illustrates the complementarity of the nucleotide sequences of ZNF255 BINDING SITE, designated SEQ ID:12348, to the nucleotide sequence of VGAM2699 RNA, herein designated VGAM RNA, also designated SEQ ID:5410.

Another function of VGAM2699 is therefore inhibition of Zinc Finger Protein 255 (ZNF255, Accession NM_005774). Accordingly, utilities of VGAM2699 include diagnosis, prevention and treatment of diseases and clinical conditions associated with ZNF255. Zinc Finger Protein 268 (ZNF268, Accession XM_031851) is another VGAM2699 host target gene. ZNF268 BINDING SITE is HOST TARGET binding site found in the 3' untranslated region of mRNA encoded by ZNF268, corresponding to a HOST TARGET binding site such as BINDING SITE I, BINDING SITE II or BINDING SITE III. Table 2 illustrates the complementarity of the nucleotide sequences of ZNF268 BINDING SITE, designated SEQ ID:31501, to the nucleotide sequence of VGAM2699 RNA, herein designated VGAM RNA, also designated SEQ ID:5410.

Another function of VGAM2699 is therefore inhibition of Zinc Finger Protein 268 (ZNF268, Accession XM_031851). Accordingly, utilities of VGAM2699 include diagnosis, prevention and treatment of diseases and clinical conditions associated with ZNF268. Chromosome 20 Open Reading Frame 97 (C20orf97, Accession NM_021158) is another VGAM2699 host target gene. C20orf97 BINDING SITE is HOST TARGET binding site found in the 3' untranslated region of mRNA encoded by C20orf97, corresponding to a HOST TARGET binding site such as BINDING SITE I, BINDING SITE II or BINDING SITE III. Table 2 illustrates the complementarity of the nucleotide sequences of C20orf97 BINDING SITE, designated SEQ ID:22139, to the nucleotide sequence of VGAM2699 RNA, herein designated VGAM RNA, also designated SEQ ID:5410.

Another function of VGAM2699 is therefore inhibition of Chromosome 20 Open Reading Frame 97 (C20orf97, Accession NM_021158). Accordingly, utilities of VGAM2699 include diagnosis, prevention and treatment of diseases and clinical conditions associated with C20orf97. Reserved (C8orf13, Accession XM_088377) is another VGAM2699 host target gene. C8orf13 BINDING SITE is HOST TARGET binding site found in the 3' untranslated region of mRNA encoded by C8orf13, corresponding to a HOST TARGET binding site such as BINDING SITE I, BINDING SITE II or BINDING SITE III. Table 2 illustrates the complementarity of the nucleotide sequences of C8orf13 BINDING SITE, designated SEQ ID:39652, to the nucleotide sequence of VGAM2699 RNA, herein designated VGAM RNA, also designated SEQ ID:5410.

Another function of VGAM2699 is therefore inhibition of Reserved (C8orf13, Accession XM_088377). Accordingly, utilities of VGAM2699 include diagnosis, prevention and treatment of diseases and clinical conditions associated with C8orf13. FLJ13224 (Accession NM_024799) is another VGAM2699 host target gene. FLJ13224 BINDING SITE is HOST TARGET binding site found in the 3' untranslated region of mRNA encoded by FLJ13224, corresponding to a HOST TARGET binding site such as BINDING SITE I, BINDING SITE II or BINDING SITE III. Table 2 illustrates the complementarity of the nucleotide sequences of FLJ13224 BINDING SITE, designated SEQ ID:24178, to the nucleotide sequence of VGAM2699 RNA, herein designated VGAM RNA, also designated SEQ ID:5410.

Another function of VGAM2699 is therefore inhibition of FLJ13224 (Accession NM_024799). Accordingly, utilities of VGAM2699 include diagnosis, prevention and treatment of diseases and clinical conditions associated with FLJ13224.

FLJ20209 (Accession XM_098142) is another VGAM2699 host target gene. FLJ20209 BINDING SITE is HOST TARGET binding site found in the 3' untranslated region of mRNA encoded by FLJ20209, corresponding to a HOST TARGET binding site such as BINDING SITE I, BINDING SITE II or BINDING SITE III. Table 2 illustrates the complementarity of the nucleotide sequences of FLJ20209 BINDING SITE, designated SEQ ID:41404, to the nucleotide sequence of VGAM2699 RNA, herein designated VGAM RNA, also designated SEQ ID:5410.

Another function of VGAM2699 is therefore inhibition of FLJ20209 (Accession XM_098142). Accordingly, utilities of VGAM2699 include diagnosis, prevention and treatment of diseases and clinical conditions associated with FLJ20209. KIAA0217 (Accession XM_040265) is another VGAM2699 host target gene. KIAA0217 BINDING SITE is HOST TARGET binding site found in the 3' untranslated region of mRNA encoded by KIAA0217, corresponding to a HOST TARGET binding site such as BINDING SITE I, BINDING SITE II or BINDING SITE III. Table 2 illustrates the complementarity of the nucleotide sequences of KIAA0217 BINDING SITE, designated SEQ ID:33281, to the nucleotide sequence of VGAM2699 RNA, herein designated VGAM RNA, also designated SEQ ID:5410.

Another function of VGAM2699 is therefore inhibition of KIAA0217 (Accession XM_040265). Accordingly, utilities of VGAM2699 include diagnosis, prevention and treatment of diseases and clinical conditions associated with KIAA0217. KIAA0980 (Accession NM_025176) is another VGAM2699 host target gene. KIAA0980 BINDING SITE is HOST TARGET binding site found in the 3' untranslated region of mRNA encoded by KIAA0980, corresponding to a HOST TARGET binding site such as BINDING SITE I, BINDING SITE II or BINDING SITE III. Table 2 illustrates the complementarity of the nucleotide sequences of KIAA0980 BINDING SITE, designated SEQ ID:24811, to the nucleotide sequence of VGAM2699 RNA, herein designated VGAM RNA, also designated SEQ ID:5410.

Another function of VGAM2699 is therefore inhibition of KIAA0980 (Accession NM_025176). Accordingly, utilities of VGAM2699 include diagnosis, prevention and treatment of diseases and clinical conditions associated with KIAA0980. KIAA1130 (Accession XM_031104) is another VGAM2699 host target gene. KIAA1130 BINDING SITE is HOST TARGET binding site found in the 3' untranslated region of mRNA encoded by KIAA1130, corresponding to a HOST TARGET binding site such as BINDING SITE I, BINDING SITE II or BINDING SITE III. Table 2 illustrates the complementarity of the nucleotide sequences of KIAA1130 BINDING SITE, designated SEQ ID:31286, to the nucleotide sequence of VGAM2699 RNA, herein designated VGAM RNA, also designated SEQ ID:5410.

Another function of VGAM2699 is therefore inhibition of KIAA1130 (Accession XM_031104). Accordingly, utilities of VGAM2699 include diagnosis, prevention and treatment of diseases and clinical conditions associated with KIAA1130. KIAA1204 (Accession XM_045011) is another VGAM2699 host target gene. KIAA1204 BINDING SITE is HOST TARGET binding site found in the 3' untranslated region of mRNA encoded by KIAA1204, corresponding to a HOST TARGET binding site such as BINDING SITE I, BINDING SITE II or BINDING SITE III. Table 2 illustrates the complementarity of the nucleotide sequences of KIAA1204 BINDING SITE, designated SEQ ID:34314, to the nucleotide sequence of VGAM2699 RNA, herein designated VGAM RNA, also designated SEQ ID:5410.

Another function of VGAM2699 is therefore inhibition of KIAA1204 (Accession XM_045011). Accordingly, utilities of VGAM2699 include diagnosis, prevention and treatment of diseases and clinical conditions associated with KIAA1204. KIAA1281 (Accession XM_114432) is another VGAM2699 host target gene. KIAA1281 BINDING SITE is HOST TARGET binding site found in the 5' untranslated region of mRNA encoded by KIAA1281, corresponding to a HOST TARGET binding site such as BINDING SITE I, BINDING SITE II or BINDING SITE III. Table 2 illustrates the complementarity of the nucleotide sequences of KIAA1281 BINDING SITE, designated SEQ ID:42962, to the nucleotide sequence of VGAM2699 RNA, herein designated VGAM RNA, also designated SEQ ID:5410.

Another function of VGAM2699 is therefore inhibition of KIAA1281 (Accession XM_114432). Accordingly, utilities of VGAM2699 include diagnosis, prevention and treatment of diseases and clinical conditions associated with KIAA1281. KIAA1727 (Accession XM_034262) is another VGAM2699 host target gene. KIAA1727 BINDING SITE is HOST TARGET binding site found in the 3' untranslated region of mRNA encoded by KIAA1727, corresponding to a HOST TARGET binding site such as BINDING SITE I, BINDING SITE II or BINDING SITE III. Table 2 illustrates the complementarity of the nucleotide sequences of KIAA1727 BINDING SITE, designated SEQ ID:32029, to the nucleotide sequence of VGAM2699 RNA, herein designated VGAM RNA, also designated SEQ ID:5410.

Another function of VGAM2699 is therefore inhibition of KIAA1727 (Accession XM_034262). Accordingly, utilities of VGAM2699 include diagnosis, prevention and treatment of diseases and clinical conditions associated with KIAA1727. KIAA1879 (Accession XM_056635) is another VGAM2699 host target gene. KIAA1879 BINDING SITE is HOST TARGET binding site found in the 3' untranslated region of mRNA encoded by KIAA1879, corresponding to a HOST TARGET binding site such as BINDING SITE I, BINDING SITE II or BINDING SITE III. Table 2 illustrates the complementarity of the nucleotide sequences of KIAA1879 BINDING SITE, designated SEQ ID:36416, to the nucleotide sequence of VGAM2699 RNA, herein designated VGAM RNA, also designated SEQ ID:5410.

Another function of VGAM2699 is therefore inhibition of KIAA1879 (Accession XM_056635). Accordingly, utilities of VGAM2699 include diagnosis, prevention and treatment of diseases and clinical conditions associated with KIAA1879. KIAA1938 (Accession XM_166407) is another VGAM2699 host target gene. KIAA1938 BINDING SITE is HOST TARGET binding site found in the 3' untranslated region of mRNA encoded by KIAA1938, corresponding to a HOST TARGET binding site such as BINDING SITE I, BINDING SITE II or BINDING SITE III. Table 2 illustrates the complementarity of the nucleotide sequences of KIAA1938 BINDING SITE, designated SEQ ID:44278, to the nucleotide sequence of VGAM2699 RNA, herein designated VGAM RNA, also designated SEQ ID:5410.

Another function of VGAM2699 is therefore inhibition of KIAA1938 (Accession XM_166407). Accordingly, utilities of VGAM2699 include diagnosis, prevention and treatment of diseases and clinical conditions associated with KIAA1938. Nuclear Receptor Subfamily 6, Group A, Member 1 (NR6A1, Accession NM_033335) is another VGAM2699 host target gene. NR6A1 BINDING SITE1 through NR6A1 BINDING SITE3 are HOST TARGET binding sites found in untranslated regions of mRNA encoded by NR6A1, corresponding to HOST TARGET binding sites such as BINDING SITE I, BINDING SITE II or BINDING SITE III. Table 2 illustrates the complementarity of the nucleotide sequences of NR6A1 BINDING SITE1 through NR6A1 BINDING SITE3, designated SEQ ID:27186, SEQ ID:27180 and SEQ ID:7232 respectively, to the nucleotide sequence of VGAM2699 RNA, herein designated VGAM RNA, also designated SEQ ID:5410.

Another function of VGAM2699 is therefore inhibition of Nuclear Receptor Subfamily 6, Group A, Member 1 (NR6A1, Accession NM_033335). Accordingly, utilities of VGAM2699 include diagnosis, prevention and treatment of diseases and clinical conditions associated with NR6A1. RNAC (Accession NM_005772) is another VGAM2699 host target gene. RNAC BINDING SITE is HOST TARGET binding site found in the 3' untranslated region of mRNA encoded by RNAC, corresponding to a HOST TARGET binding site such as BINDING SITE I, BINDING SITE II or BINDING SITE III. Table 2 illustrates the complementarity of the nucleotide sequences of RNAC BINDING SITE, designated SEQ ID:12345, to the nucleotide sequence of VGAM2699 RNA, herein designated VGAM RNA, also designated SEQ ID:5410.

Another function of VGAM2699 is therefore inhibition of RNAC (Accession NM_005772). Accordingly, utilities of VGAM2699 include diagnosis, prevention and treatment of diseases and clinical conditions associated with RNAC. U5-116KD (Accession NM_004247) is another VGAM2699 host target gene. U5-116KD BINDING SITE is HOST TARGET binding site found in the 3' untranslated region of mRNA encoded by U5-116KD, corresponding to a HOST TARGET binding site such as BINDING SITE I, BINDING SITE II or BINDING SITE III. Table 2 illustrates the complementarity of the nucleotide sequences of U5-116KD BINDING SITE, designated SEQ ID:10436, to the nucleotide sequence of VGAM2699 RNA, herein designated VGAM RNA, also designated SEQ ID:5410.

Another function of VGAM2699 is therefore inhibition of U5-116KD (Accession NM_004247). Accordingly, utilities of VGAM2699 include diagnosis, prevention and treatment of diseases and clinical conditions associated with U5-116KD. LOC146909 (Accession XM_085634) is another VGAM2699 host target gene. LOC146909 BINDING SITE is HOST TARGET binding site found in the 3' untranslated region of mRNA encoded by LOC146909, corresponding to a HOST TARGET binding site such as BINDING SITE I, BINDING SITE II or BINDING SITE III. Table 2 illustrates the complementarity of the nucleotide sequences of LOC146909 BINDING SITE, designated SEQ ID:38272, to the nucleotide sequence of VGAM2699 RNA, herein designated VGAM RNA, also designated SEQ ID:5410.

Another function of VGAM2699 is therefore inhibition of LOC146909 (Accession XM_085634). Accordingly, utilities of VGAM2699 include diagnosis, prevention and treatment of diseases and clinical conditions associated with LOC146909. LOC152445 (Accession XM_098231) is another VGAM2699 host target gene. LOC152445 BINDING SITE is HOST TARGET binding site found in the 5' untranslated region of mRNA encoded by LOC152445, corresponding to a HOST TARGET binding site such as BINDING SITE I, BINDING SITE II or BINDING SITE III. Table 2 illustrates the complementarity of the nucleotide sequences of LOC152445 BINDING SITE, designated SEQ ID:41510, to the nucleotide sequence of VGAM2699 RNA, herein designated VGAM RNA, also designated SEQ ID:5410.

Another function of VGAM2699 is therefore inhibition of LOC152445 (Accession XM_098231). Accordingly, utilities of VGAM2699 include diagnosis, prevention and treatment of diseases and clinical conditions associated with LOC152445. LOC158476 (Accession XM_098955) is another VGAM2699 host target gene. LOC158476 BINDING SITE is HOST TARGET binding site found in the 5' untranslated region of mRNA encoded by LOC158476, corresponding to a HOST TARGET binding site such as BINDING SITE I, BINDING SITE II or BINDING SITE III. Table 2 illustrates the complementarity of the nucleotide sequences of LOC158476 BINDING SITE, designated SEQ ID:41998, to the nucleotide sequence of VGAM2699 RNA, herein designated VGAM RNA, also designated SEQ ID:5410.

Another function of VGAM2699 is therefore inhibition of LOC158476 (Accession XM_098955). Accordingly, utilities of VGAM2699 include diagnosis, prevention and treatment of diseases and clinical conditions associated with LOC158476. LOC223009 (Accession XM_170214) is another VGAM2699 host target gene. LOC223009 BINDING SITE is HOST TARGET binding site found in the 5' untranslated region of mRNA encoded by LOC223009, corresponding to a HOST TARGET binding site such as BINDING SITE I, BINDING SITE II or BINDING SITE III. Table 2 illustrates the complementarity of the nucleotide sequences of LOC223009 BINDING SITE, designated SEQ ID:45313, to the nucleotide sequence of VGAM2699 RNA, herein designated VGAM RNA, also designated SEQ ID:5410.

Another function of VGAM2699 is therefore inhibition of LOC223009 (Accession XM_170214). Accordingly, utilities of VGAM2699 include diagnosis, prevention and treatment of diseases and clinical conditions associated with LOC223009. LOC256158 (Accession XM_175125) is another VGAM2699 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46618, to the nucleotide sequence of VGAM2699 RNA, herein designated VGAM RNA, also designated SEQ ID:5410.

Another function of VGAM2699 is therefore inhibition of LOC256158 (Accession XM_175125). Accordingly, utilities of VGAM2699 include diagnosis, prevention and treatment of diseases and clinical conditions associated with LOC256158. LOC257444 (Accession XM_088028) is another VGAM2699 host target gene. LOC257444 BINDING SITE is HOST TARGET binding site found in the 3' untranslated region of mRNA encoded by LOC257444, corresponding to a HOST TARGET binding site such as BINDING SITE I, BINDING SITE II or BINDING SITE III. Table 2 illustrates the complementarity of the nucleotide sequences of LOC257444 BINDING SITE, designated SEQ ID:39479, to the nucleotide sequence of VGAM2699 RNA, herein designated VGAM RNA, also designated SEQ ID:5410.

Another function of VGAM2699 is therefore inhibition of LOC257444 (Accession XM_088028). Accordingly, utilities of VGAM2699 include diagnosis, prevention and treatment of diseases and clinical conditions associated with LOC257444. LOC56267 (Accession NM_019610) is another VGAM2699 host target gene. LOC56267 BINDING SITE is HOST TARGET binding site found in the 3' untranslated region of mRNA encoded by LOC56267, corresponding to a HOST TARGET binding site such as BINDING SITE I, BINDING SITE II or BINDING SITE III. Table 2 illustrates the complementarity of the nucleotide sequences of LOC56267 BINDING SITE, designated SEQ ID:21229, to the nucleotide sequence of VGAM2699 RNA, herein designated VGAM RNA, also designated SEQ ID:5410.

Another function of VGAM2699 is therefore inhibition of LOC56267 (Accession NM_019610). Accordingly, utilities of VGAM2699 include diagnosis, prevention and treatment of diseases and clinical conditions associated with LOC56267. FIG. 1 further provides a conceptual description of a novel bioinformatically detected viral gene of the present invention, referred to here as Viral Genomic Address Messenger 2700 (VGAM2700) viral gene, which modulates expression of respective host target genes thereof, the function and utility of which host target genes is known in the art.

VGAM2700 is a novel bioinformatically detected regulatory, non protein coding, viral micro RNA (miRNA) gene. The method by which VGAM2700 was detected is described hereinabove with reference to FIGS. 1-8.

VGAM2700 gene, herein designated VGAM GENE, is a viral gene contained in the genome of La Crosse Virus. VGAM2700 host target gene, herein designated VGAM HOST TARGET GENE, is a human gene contained in the human genome.

VGAM2700 gene encodes a VGAM2700 precursor RNA, herein designated VGAM PRECURSOR RNA. Similar to other miRNA genes, and unlike most ordinary genes, VGAM2700 precursor RNA does not encode a protein. A nucleotide sequence identical or highly similar to the nucleotide sequence of VGAM2700 precursor RNA is designated SEQ ID:2686, and is provided hereinbelow with reference to the sequence listing part. Nucleotide sequence SEQ ID:2686 is located at position 1021 relative to the genome of La Crosse Virus.

VGAM2700 precursor RNA folds onto itself, forming VGAM2700 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2700 folded precursor RNA into VGAM2700 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2700 RNA is designated SEQ ID:5411, and is provided hereinbelow with reference to the sequence listing part.

VGAM2700 host target gene, herein designated VGAM HOST TARGET GENE, encodes a corresponding messenger RNA, VGAM2700 host target RNA, herein designated VGAM HOST TARGET RNA. VGAM2700 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2700 RNA, herein designated VGAM RNA, binds complementarily to one or more host target binding sites located in untranslated regions of VGAM2700 host target RNA, herein designated VGAM HOST TARGET RNA. This complementary binding is due to the fact that the nucleotide sequence of VGAM2700 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2700 RNA, herein designated VGAM RNA, may have a different number of host target binding sites in untranslated regions of a VGAM2700 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2700 RNA, herein designated VGAM RNA, to host target binding sites on VGAM2700 host target RNA, herein designated VGAM HOST TARGET RNA, such as BINDING SITE I, BINDING SITE II and BINDING SITE III, inhibits translation of VGAM2700 host target RNA into VGAM2700 host target protein, herein designated VGAM HOST TARGET PROTEIN. VGAM host target protein is therefore outlined by a broken line.

It is appreciated that VGAM2700 host target gene, herein designated VGAM HOST TARGET GENE, in fact represents a plurality of VGAM2700 host target genes. The mRNA of each one of this plurality of VGAM2700 host target genes comprises one or more host target binding sites, each having a nucleotide sequence which is at least partly complementary to VGAM2700 RNA, herein designated VGAM RNA, and which when bound by VGAM2700 RNA causes inhibition of translation of respective one or more VGAM2700 host target proteins.

It is further appreciated by one skilled in the art that the mode of translational inhibition illustrated by FIG. 1 with specific reference to translational inhibition exerted by VGAM2700 gene, herein designated VGAM GENE, on one or more VGAM2700 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2700 is inhibition of expression of host target genes, as part of a novel viral mechanism of attacking a host. Accordingly, utilities of VGAM2700 include diagnosis, prevention and treatment of viral infection by La Crosse Virus. Specific functions, and accordingly utilities, of VGAM2700 correlate with, and may be deduced from, the identity of the host target genes which VGAM2700 binds and inhibits, and the function of these host target genes, as elaborated hereinbelow.

Nucleotide sequences of the VGAM2700 precursor RNA, herein designated VGAM PRECURSOR RNA, and of the 'diced' VGAM2700 RNA, herein designated VGAM RNA, and a schematic representation of the secondary folding of VGAM2700 folded precursor RNA, herein designated VGAM FOLDED PRECURSOR RNA, of VGAM2700 are further described hereinbelow with reference to Table 1.

Nucleotide sequences of host target binding sites, such as BINDING SITE-I, BINDING SITE-II and BINDING SITE-III of FIG. 1, found on VGAM2700 host target RNA, and schematic representation of the complementarity of each of these host target binding sites to VGAM2700 RNA, herein designated VGAM RNA, are described hereinbelow with reference to Table 2.

As mentioned hereinabove with reference to FIG. 1, a function of VGAM2700 gene, herein designated VGAM is inhibition of expression of VGAM2700 target genes. It is appreciated that specific functions, and accordingly utilities, of VGAM2700 correlate with, and may be deduced from, the identity of the target genes which VGAM2700 binds and inhibits, and the function of these target genes, as elaborated hereinbelow.

Gap Junction Protein, Alpha 1, 43 kDa (connexin 43) (GJA1, Accession NM_000165) is a VGAM2700 host target gene. GJA1 BINDING SITE is HOST TARGET binding site found in the 3' untranslated region of mRNA encoded by GJA1, corresponding to a HOST TARGET binding site such as BINDING SITE I, BINDING SITE II or BINDING SITE III. Table 2 illustrates the complementarity of the nucleotide sequences of GJA1 BINDING SITE, designated SEQ ID:5679, to the nucleotide sequence of VGAM2700 RNA, herein designated VGAM RNA, also designated SEQ ID:5411.

A function of VGAM2700 is therefore inhibition of Gap Junction Protein, Alpha 1, 43 kDa (connexin 43) (GJA1, Accession NM_000165), a gene which may act in synchronizing heart contraction and embryonic development. Accordingly, utilities of VGAM2700 include diagnosis, prevention and treatment of diseases and clinical conditions associated with GJA1. The function of GJA1 and its association with various diseases and clinical conditions, has been established by previous studies, as described hereinabove with reference to VGAM341. RAB Interacting Factor (RABIF, Accession NM_002871) is another VGAM2700 host target gene. RABIF BINDING SITE is HOST TARGET binding site found in the 3' untranslated region of mRNA encoded by RABIF, corresponding to a HOST TARGET binding site such as BINDING SITE I, BINDING SITE II or BINDING SITE III. Table 2 illustrates the complementarity of the nucleotide sequences of RABIF BINDING SITE, designated SEQ ID:8780, to the nucleotide sequence of VGAM2700 RNA, herein designated VGAM RNA, also designated SEQ ID:5411.

Another function of VGAM2700 is therefore inhibition of RAB Interacting Factor (RABIF, Accession NM_002871), a gene which is involved in the regulation of intracellular vesicular transport. Accordingly, utilities of VGAM2700 include diagnosis, prevention and treatment of diseases and clinical conditions associated with RABIF. The function of RABIF and its association with various diseases and clinical conditions, has been established by previous studies, as described hereinabove with reference to VGAM1633. Chromosome 20 Open Reading Frame 108 (C20orf108, Accession NM_080821) is another VGAM2700 host target gene. C20orf108 BINDING SITE is HOST TARGET binding site found in the 3' untranslated region of mRNA encoded by C20orf108, corresponding to a HOST TARGET binding site such as BINDING SITE I, BINDING SITE II or BINDING SITE III. Table 2 illustrates the complementarity of the nucleotide sequences of C20orf108 BINDING SITE, designated SEQ ID:28089, to the nucleotide sequence of VGAM2700 RNA, herein designated VGAM RNA, also designated SEQ ID:5411.

Another function of VGAM2700 is therefore inhibition of Chromosome 20 Open Reading Frame 108 (C20orf108, Accession NM_080821). Accordingly, utilities of VGAM2700 include diagnosis, prevention and treatment of diseases and clinical conditions associated with C20orf108.

FIG. 1 further provides a conceptual description of a novel bioinformatically detected viral gene of the present invention, referred to here as Viral Genomic Address Messenger 2701 (VGAM2701) viral gene, which modulates expression of respective host target genes thereof, the function and utility of which host target genes is known in the art.

VGAM2701 is a novel bioinformatically detected regulatory, non protein coding, viral micro RNA (miRNA) gene. The method by which VGAM2701 was detected is described hereinabove with reference to FIGS. 1-8.

VGAM2701 gene, herein designated VGAM GENE, is a viral gene contained in the genome of La Crosse Virus. VGAM2701 host target gene, herein designated VGAM HOST TARGET GENE, is a human gene contained in the human genome.

VGAM2701 gene encodes a VGAM2701 precursor RNA, herein designated VGAM PRECURSOR RNA. Similar to other miRNA genes, and unlike most ordinary genes, VGAM2701 precursor RNA does not encode a protein. A nucleotide sequence identical or highly similar to the nucleotide sequence of VGAM2701 precursor RNA is designated SEQ ID:2687, and is provided hereinbelow with reference to the sequence listing part. Nucleotide sequence SEQ ID:2687 is located at position 4064 relative to the genome of La Crosse Virus.

VGAM2701 precursor RNA folds onto itself, forming VGAM2701 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2701 folded precursor RNA into VGAM2701 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2701 RNA is designated SEQ ID:5412, and is provided hereinbelow with reference to the sequence listing part.

VGAM2701 host target gene, herein designated VGAM HOST TARGET GENE, encodes a corresponding messenger RNA, VGAM2701 host target RNA, herein designated VGAM HOST TARGET RNA. VGAM2701 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2701 RNA, herein designated VGAM RNA, binds complementarily to one or more host target binding sites located in untranslated regions of VGAM2701 host target RNA, herein designated VGAM HOST TARGET RNA. This complementary binding is due to the fact that the nucleotide sequence of VGAM2701 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2701 RNA, herein designated VGAM RNA, may have a different number of host target binding sites in untranslated regions of a VGAM2701 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2701 RNA, herein designated VGAM RNA, to host target binding sites on VGAM2701 host target RNA, herein designated VGAM HOST TARGET RNA, such as BINDING SITE I, BINDING SITE II and BINDING SITE III, inhibits translation of VGAM2701 host target RNA into VGAM2701 host target protein, herein designated VGAM HOST TARGET PROTEIN. VGAM host target protein is therefore outlined by a broken line.

It is appreciated that VGAM2701 host target gene, herein designated VGAM HOST TARGET GENE, in fact represents a plurality of VGAM2701 host target genes. The mRNA of each one of this plurality of VGAM2701 host target genes comprises one or more host target binding sites, each having a nucleotide sequence which is at least partly complementary to VGAM2701 RNA, herein designated VGAM RNA, and which when bound by VGAM2701 RNA causes inhibition of translation of respective one or more VGAM2701 host target proteins.

It is further appreciated by one skilled in the art that the mode of translational inhibition illustrated by FIG. 1 with specific reference to translational inhibition exerted by VGAM2701 gene, herein designated VGAM GENE, on one or more VGAM2701 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2701 is inhibition of expression of host target genes, as part of a novel viral mechanism of attacking a host. Accordingly, utilities of VGAM2701 include diagnosis, prevention and treatment of viral infection by La Crosse Virus. Specific functions, and accordingly utilities, of VGAM2701 correlate with, and may be deduced from, the identity of the host target genes which VGAM2701 binds and inhibits, and the function of these target genes, as elaborated hereinbelow.

Nucleotide sequences of the VGAM2701 precursor RNA, herein designated VGAM PRECURSOR RNA, and of the 'diced' VGAM2701 RNA, herein designated VGAM RNA, and a schematic representation of the secondary folding of VGAM2701 folded precursor RNA, herein designated VGAM FOLDED PRECURSOR RNA, of VGAM2701 are further described hereinbelow with reference to Table 1.

Nucleotide sequences of host target binding sites, such as BINDING SITE-I, BINDING SITE-II and BINDING SITE-III of FIG. 1, found on VGAM2701 host target RNA, and schematic representation of the complementarity of each of these host target binding sites to VGAM2701 RNA, herein designated VGAM RNA, are described hereinbelow with reference to Table 2.

As mentioned hereinabove with reference to FIG. 1, a function of VGAM2701 gene, herein designated VGAM is inhibition of expression of VGAM2701 target genes. It is appreciated that specific functions, and accordingly utilities, of VGAM2701 correlate with, and may be deduced from, the identity of the target genes which VGAM2701 binds and inhibits, and the function of these target genes, as elaborated hereinbelow.

Fibroblast Growth Factor 5 (FGF5, Accession NM_004464) is a VGAM2701 host target gene. FGF5 BINDING SITE1 and FGF5 BINDING SITE2 are HOST TARGET binding sites found in untranslated regions of mRNA encoded by FGF5, corresponding to HOST TARGET binding sites such as BINDING SITE I, BINDING SITE II or BINDING SITE III. Table 2 illustrates the complementarity of the nucleotide sequences of FGF5 BINDING SITE1 and FGF5 BINDING SITE2, designated SEQ ID:10771 and SEQ ID:26998 respectively, to the nucleotide sequence of VGAM2701 RNA, herein designated VGAM RNA, also designated SEQ ID:5412.

A function of VGAM2701 is therefore inhibition of Fibroblast Growth Factor 5 (FGF5, Accession NM_004464), a gene which induces transformation and may regulate neuronal differentiation. Accordingly, utilities of VGAM2701 include diagnosis, prevention and treatment of diseases and clinical conditions associated with FGF5. The function of FGF5 and its association with various diseases and clinical conditions, has been established by previous studies, as described hereinabove with reference to VGAM276. LOC90333 (Accession XM_030958) is another VGAM2701 host target gene. LOC90333 BINDING SITE is HOST TARGET binding site found in the 3' untranslated region of mRNA encoded by LOC90333, corresponding to a HOST TARGET binding site such as BINDING SITE I, BINDING SITE II or BINDING SITE III. Table 2 illustrates the complementarity of the nucleotide sequences of LOC90333 BINDING SITE, designated SEQ ID:31221, to the nucleotide sequence of VGAM2701 RNA, herein designated VGAM RNA, also designated SEQ ID:5412.

Another function of VGAM2701 is therefore inhibition of LOC90333 (Accession XM_030958). Accordingly, utilities of VGAM2701 include diagnosis, prevention and treatment of diseases and clinical conditions associated with LOC90333. FIG. 1 further provides a conceptual description of a novel bioinformatically detected viral gene of the present invention, referred to here as Viral Genomic Address Messenger 2702 (VGAM2702) viral gene, which modulates expression of respective host target genes thereof, the function and utility of which host target genes is known in the art.

VGAM2702 is a novel bioinformatically detected regulatory, non protein coding, viral micro RNA (miRNA) gene. The method by which VGAM2702 was detected is described hereinabove with reference to FIGS. 1-8.

VGAM2702 gene, herein designated VGAM GENE, is a viral gene contained in the genome of La Crosse Virus. VGAM2702 host target gene, herein designated VGAM HOST TARGET GENE, is a human gene contained in the human genome.

VGAM2702 gene encodes a VGAM2702 precursor RNA, herein designated VGAM PRECURSOR RNA. Similar to other miRNA genes, and unlike most ordinary genes, VGAM2702 precursor RNA does not encode a protein. A nucleotide sequence identical or highly similar to the nucleotide sequence of VGAM2702 precursor RNA is designated SEQ ID:2688, and is provided hereinbelow with reference to the sequence listing part. Nucleotide sequence SEQ ID:2688 is located at position 4272 relative to the genome of La Crosse Virus.

VGAM2702 precursor RNA folds onto itself, forming VGAM2702 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2702 folded precursor RNA into VGAM2702 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 47%) nucleotide sequence of VGAM2702 RNA is designated SEQ ID:5413, and is provided hereinbelow with reference to the sequence listing part.

VGAM2702 host target gene, herein designated VGAM HOST TARGET GENE, encodes a corresponding messenger RNA, VGAM2702 host target RNA, herein designated VGAM HOST TARGET RNA. VGAM2702 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2702 RNA, herein designated VGAM RNA, binds complementarily to one or more host target binding sites located in untranslated regions of VGAM2702 host target RNA, herein designated VGAM HOST TARGET RNA. This complementary binding is due to the fact that the nucleotide sequence of VGAM2702 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2702 RNA, herein designated VGAM RNA, may have a different number of host target binding sites in untranslated regions of a VGAM2702 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2702 RNA, herein designated VGAM RNA, to host target binding sites on VGAM2702 host target RNA, herein designated VGAM HOST TARGET RNA, such as BINDING SITE I, BINDING SITE II and BINDING SITE III, inhibits translation of VGAM2702 host target RNA into VGAM2702 host target protein, herein designated VGAM HOST TARGET PROTEIN. VGAM host target protein is therefore outlined by a broken line.

It is appreciated that VGAM2702 host target gene, herein designated VGAM HOST TARGET GENE, in fact represents a plurality of VGAM2702 host target genes. The mRNA of each one of this plurality of VGAM2702 host target genes comprises one or more host target binding sites, each having a nucleotide sequence which is at least partly complementary to VGAM2702 RNA, herein designated VGAM RNA, and which when bound by VGAM2702 RNA causes inhibition of translation of respective one or more VGAM2702 host target proteins.

It is further appreciated by one skilled in the art that the mode of translational inhibition illustrated by FIG. 1 with specific reference to translational inhibition exerted by VGAM2702 gene, herein designated VGAM GENE, on one or more VGAM2702 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2702 is inhibition of expression of host target genes, as part of a novel viral mechanism of attacking a host. Accordingly, utilities of VGAM2702 include diagnosis, prevention and treatment of viral infection by La Crosse Virus. Specific functions, and accordingly utilities, of VGAM2702 correlate with, and may be deduced from, the identity of the host target genes which VGAM2702 binds and inhibits, and the function of these host target genes, as elaborated hereinbelow.

Nucleotide sequences of the VGAM2702 precursor RNA, herein designated VGAM PRECURSOR RNA, and of the 'diced' VGAM2702 RNA, herein designated VGAM RNA, and a schematic representation of the secondary folding of VGAM2702 folded precursor RNA, herein designated VGAM FOLDED PRECURSOR RNA, of VGAM2702 are further described hereinbelow with reference to Table 1.

Nucleotide sequences of host target binding sites, such as BINDING SITE-I, BINDING SITE-II and BINDING SITE-III of FIG. 1, found on VGAM2702 host target RNA, and schematic representation of the complementarity of each of these host target binding sites to VGAM2702 RNA, herein designated VGAM RNA, are described hereinbelow with reference to Table 2.

As mentioned hereinabove with reference to FIG. 1, a function of VGAM2702 gene, herein designated VGAM is inhibition of expression of VGAM2702 target genes. It is appreciated that specific functions, and accordingly utilities, of VGAM2702 correlate with, and may be deduced from, the identity of the target genes which VGAM2702 binds and inhibits, and the function of these target genes, as elaborated hereinbelow.

Hormonally Upregulated Neu-associated Kinase (HUNK, Accession NM_014586) is a VGAM2702 host target gene. HUNK BINDING SITE is HOST TARGET binding site found in the 3' untranslated region of mRNA encoded by HUNK, corresponding to a HOST TARGET binding site such as BINDING SITE I, BINDING SITE II or BINDING SITE III. Table 2 illustrates the complementarity of the nucleotide sequences of HUNK BINDING SITE, designated SEQ ID:15944, to the nucleotide sequence of VGAM2702 RNA, herein designated VGAM RNA, also designated SEQ ID:5413.

A function of VGAM2702 is therefore inhibition of Hormonally Upregulated Neu-associated Kinase (HUNK, Accession NM_014586). Accordingly, utilities of VGAM2702 include diagnosis, prevention and treatment of diseases and clinical conditions associated with HUNK. Hyaluronan Binding Protein 2 (HABP2, Accession NM_004132) is another VGAM2702 host target gene. HABP2 BINDING SITE is HOST TARGET binding site found in the 3' untranslated region of mRNA encoded by HABP2, corresponding to a HOST TARGET binding site such as BINDING SITE I, BINDING SITE II or BINDING SITE III. Table 2 illustrates the complementarity of the nucleotide sequences of HABP2 BINDING SITE, designated SEQ ID:10341, to the nucleotide sequence of VGAM2702 RNA, herein designated VGAM RNA, also designated SEQ ID:5413.

Another function of VGAM2702 is therefore inhibition of Hyaluronan Binding Protein 2 (HABP2, Accession NM_004132). Accordingly, utilities of VGAM2702 include diagnosis, prevention and treatment of diseases and clinical conditions associated with HABP2. KIAA1023 (Accession NM_017604) is another VGAM2702 host target gene. KIAA1023 BINDING SITE is HOST TARGET binding site found in the 3' untranslated region of mRNA encoded by KIAA1023, corresponding to a HOST TARGET binding site such as BINDING SITE I, BINDING SITE II or BINDING SITE III. Table 2 illustrates the complementarity of the nucleotide sequences of KIAA1023 BINDING SITE, designated SEQ ID:19085, to the nucleotide sequence of VGAM2702 RNA, herein designated VGAM RNA, also designated SEQ ID:5413.

Another function of VGAM2702 is therefore inhibition of KIAA1023 (Accession NM_017604). Accordingly, utilities of VGAM2702 include diagnosis, prevention and treatment of diseases and clinical conditions associated with KIAA1023. Olfactory Receptor, Family 2, Subfamily C, Member 3 (OR2C3, Accession XM_060575) is another VGAM2702 host target gene. OR2C3 BINDING SITE is HOST TARGET binding site found in the 3' untranslated region of mRNA encoded by OR2C3, corresponding to a HOST TARGET binding site such as BINDING SITE I, BINDING SITE II or BINDING SITE III. Table 2 illustrates the complementarity of the nucleotide sequences of OR2C3 BINDING SITE, designated SEQ ID:37176, to the nucleotide sequence of VGAM2702 RNA, herein designated VGAM RNA, also designated SEQ ID:5413.

Another function of VGAM2702 is therefore inhibition of Olfactory Receptor, Family 2, Subfamily C, Member 3 (OR2C3, Accession XM_060575). Accordingly, utilities of VGAM2702 include diagnosis, prevention and treatment of diseases and clinical conditions associated with OR2C3. TERA (Accession NM_021238) is another VGAM2702 host target gene. TERA BINDING SITE is HOST TARGET binding site found in the 3' untranslated region of mRNA encoded by TERA, corresponding to a HOST TARGET binding site such as BINDING SITE I, BINDING SITE II or BINDING SITE III. Table 2 illustrates the complementarity of the nucleotide sequences of TERA BINDING SITE, designated SEQ ID:22203, to the nucleotide sequence of VGAM2702 RNA, herein designated VGAM RNA, also designated SEQ ID:5413.

Another function of VGAM2702 is therefore inhibition of TERA (Accession NM_021238). Accordingly, utilities of VGAM2702 include diagnosis, prevention and treatment of diseases and clinical conditions associated with TERA. LOC147949 (Accession XM_085973) is another VGAM2702 host target gene. LOC147949 BINDING SITE is HOST TARGET binding site found in the 3' untranslated region of mRNA encoded by LOC147949, corresponding to a HOST TARGET binding site such as BINDING SITE I, BINDING SITE II or BINDING SITE III. Table 2 illustrates the complementarity of the nucleotide sequences of LOC147949 BINDING SITE, designated SEQ ID:38422, to the nucleotide sequence of VGAM2702 RNA, herein designated VGAM RNA, also designated SEQ ID:5413.

Another function of VGAM2702 is therefore inhibition of LOC147949 (Accession XM_085973). Accordingly, utilities of VGAM2702 include diagnosis, prevention and treatment of diseases and clinical conditions associated with LOC147949. LOC155179 (Accession XM_088169) is another VGAM2702 host target gene. LOC155179 BINDING SITE is HOST TARGET binding site found in the 3' untranslated region of mRNA encoded by LOC155179, corresponding to a HOST TARGET binding site such as BINDING SITE I, BINDING SITE II or BINDING SITE III. Table 2 illustrates the complementarity of the nucleotide sequences of LOC155179 BINDING SITE, designated SEQ ID:39553, to the nucleotide sequence of VGAM2702 RNA, herein designated VGAM RNA, also designated SEQ ID:5413.

Another function of VGAM2702 is therefore inhibition of LOC155179 (Accession XM_088169). Accordingly, utilities of VGAM2702 include diagnosis, prevention and treatment of diseases and clinical conditions associated with LOC155179. LOC158267 (Accession XM_088528) is another VGAM2702 host target gene. LOC158267 BINDING SITE is HOST TARGET binding site found in the 3' untranslated region of mRNA encoded by LOC158267, corresponding to a HOST TARGET binding site such as BINDING SITE I, BINDING SITE II or BINDING SITE III. Table 2 illustrates the complementarity of the nucleotide sequences of LOC158267 BINDING SITE, designated SEQ ID:39790, to the nucleotide sequence of VGAM2702 RNA, herein designated VGAM RNA, also designated SEQ ID:5413.

Another function of VGAM2702 is therefore inhibition of LOC158267 (Accession XM_088528). Accordingly, utilities of VGAM2702 include diagnosis, prevention and treatment of diseases and clinical conditions associated with LOC158267. LOC90161 (Accession XM_029551) is another VGAM2702 host target gene. LOC90161 BINDING SITE is HOST TARGET binding site found in the 3' untranslated region of mRNA encoded by LOC90161, corresponding to a HOST TARGET binding site such as BINDING SITE I, BINDING SITE II or BINDING SITE III. Table 2 illustrates the complementarity of the nucleotide sequences of LOC90161 BINDING SITE, designated SEQ ID:30901, to the nucleotide sequence of VGAM2702 RNA, herein designated VGAM RNA, also designated SEQ ID:5413.

Another function of VGAM2702 is therefore inhibition of LOC90161 (Accession XM_029551). Accordingly, utilities of VGAM2702 include diagnosis, prevention and treatment of diseases and clinical conditions associated with LOC90161. FIG. 1 further provides a conceptual description of a novel bioinformatically detected viral gene of the present invention, referred to here as Viral Genomic Address Messenger 2703 (VGAM2703) viral gene, which modulates expression of respective host target genes thereof, the function and utility of which host target genes is known in the art.

VGAM2703 is a novel bioinformatically detected regulatory, non protein coding, viral micro RNA (miRNA) gene. The method by which VGAM2703 was detected is described hereinabove with reference to FIGS. 1-8.

VGAM2703 gene, herein designated VGAM GENE, is a viral gene contained in the genome of Mamestra Configurata Nucleopolyhedrovirus B. VGAM2703 host target gene, herein designated VGAM HOST TARGET GENE, is a human gene contained in the human genome.

VGAM2703 gene encodes a VGAM2703 precursor RNA, herein designated VGAM PRECURSOR RNA. Similar to other miRNA genes, and unlike most ordinary genes, VGAM2703 precursor RNA does not encode a protein. A nucleotide sequence identical or highly similar to the nucleotide sequence of VGAM2703 precursor RNA is designated SEQ ID:2689, and is provided hereinbelow with reference to the sequence listing part. Nucleotide sequence SEQ ID:2689 is located at position 133043 relative to the genome of Mamestra Configurata Nucleopolyhedrovirus B.

VGAM2703 precursor RNA folds onto itself, forming VGAM2703 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2703 folded precursor RNA into VGAM2703 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 50%) nucleotide sequence of VGAM2703 RNA is designated SEQ ID:5414, and is provided hereinbelow with reference to the sequence listing part.

VGAM2703 host target gene, herein designated VGAM HOST TARGET GENE, encodes a corresponding messenger RNA, VGAM2703 host target RNA, herein designated VGAM HOST TARGET RNA. VGAM2703 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2703 RNA, herein designated VGAM RNA, binds complementarily to one or more host target binding sites located in untranslated regions of VGAM2703 host target RNA, herein designated VGAM HOST TARGET RNA. This complementary binding is due to the fact that the nucleotide sequence of VGAM2703 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2703 RNA, herein designated VGAM RNA, may have a different number of host target binding sites in untranslated regions of a VGAM2703 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2703 RNA, herein designated VGAM RNA, to host target binding sites on VGAM2703 host target RNA, herein designated VGAM HOST TARGET RNA, such as BINDING SITE I, BINDING SITE II and BINDING SITE III, inhibits translation of VGAM2703 host target RNA into VGAM2703 host target protein, herein designated VGAM HOST TARGET PROTEIN. VGAM host target protein is therefore outlined by a broken line.

It is appreciated that VGAM2703 host target gene, herein designated VGAM HOST TARGET GENE, in fact represents a plurality of VGAM2703 host target genes. The mRNA of each one of this plurality of VGAM2703 host target genes comprises one or more host target binding sites, each having a nucleotide sequence which is at least partly complementary to VGAM2703 RNA, herein designated VGAM RNA, and which when bound by VGAM2703 RNA causes inhibition of translation of respective one or more VGAM2703 host target proteins.

It is further appreciated by one skilled in the art that the mode of translational inhibition illustrated by FIG. 1 with specific reference to translational inhibition exerted by VGAM2703 gene, herein designated VGAM GENE, on one or more VGAM2703 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2703 is inhibition of expression of host target genes, as part of a novel viral mechanism of attacking a host. Accordingly, utilities of VGAM2703 include diagnosis, prevention and treatment of viral infection by Mamestra Configurata Nucleopolyhedrovirus B. Specific functions, and accordingly utilities, of VGAM2703 correlate with, and may be deduced from, the identity of the host target genes which VGAM2703 binds and inhibits, and the function of these host target genes, as elaborated hereinbelow.

Nucleotide sequences of the VGAM2703 precursor RNA, herein designated VGAM PRECURSOR RNA, and of the 'diced' VGAM2703 RNA, herein designated VGAM RNA, and a schematic representation of the secondary folding of VGAM2703 folded precursor RNA, herein designated VGAM FOLDED PRECURSOR RNA, of VGAM2703 are further described hereinbelow with reference to Table 1.

Nucleotide sequences of host target binding sites, such as BINDING SITE-I, BINDING SITE-II and BINDING SITE-III of FIG. 1, found on VGAM2703 host target RNA, and schematic representation of the complementarity of each of these host target binding sites to VGAM2703 RNA, herein designated VGAM RNA, are described hereinbelow with reference to Table 2.

As mentioned hereinabove with reference to FIG. 1, a function of VGAM2703 gene, herein designated VGAM is inhibition of expression of VGAM2703 target genes. It is appreciated that specific functions, and accordingly utilities, of VGAM2703 correlate with, and may be deduced from, the identity of the target genes which VGAM2703 binds and inhibits, and the function of these target genes, as elaborated hereinbelow.

Chromosome 5 Open Reading Frame 3 (C5orf3, Accession NM_018691) is a VGAM2703 host target gene. C5orf3 BINDING SITE is HOST TARGET binding site found in the 3' untranslated region of mRNA encoded by C5orf3, corresponding to a HOST TARGET binding site such as BINDING SITE I, BINDING SITE II or BINDING SITE III. Table 2 illustrates the complementarity of the nucleotide sequences of C5orf3 BINDING SITE, designated SEQ ID:20763, to the nucleotide sequence of VGAM2703 RNA, herein designated VGAM RNA, also designated SEQ ID:5414.

A function of VGAM2703 is therefore inhibition of Chromosome 5 Open Reading Frame 3 (C5orf3, Accession NM_018691). Accordingly, utilities of VGAM2703 include diagnosis, prevention and treatment of diseases and clinical conditions associated with C5orf3. FLJ21870 (Accession NM_023016) is another VGAM2703 host target gene. FLJ21870 BINDING SITE is HOST TARGET binding site found in the 3' untranslated region of mRNA encoded by FLJ21870, corresponding to a HOST TARGET binding site such as BINDING SITE I, BINDING SITE II or BINDING SITE III. Table 2 illustrates the complementarity of the nucleotide sequences of FLJ21870 BINDING SITE, designated SEQ ID:23281, to the nucleotide sequence of VGAM2703 RNA, herein designated VGAM RNA, also designated SEQ ID:5414.

Another function of VGAM2703 is therefore inhibition of FLJ21870 (Accession NM_023016). Accordingly, utilities of VGAM2703 include diagnosis, prevention and treatment of diseases and clinical conditions associated with FLJ21870. MGC2452 (Accession NM_032644) is another VGAM2703 host target gene. MGC2452 BINDING SITE is HOST TARGET binding site found in the 5' untranslated region of mRNA encoded by MGC2452, corresponding to a HOST TARGET binding site such as BINDING SITE I, BINDING SITE II or BINDING SITE III. Table 2 illustrates the complementarity of the nucleotide sequences of MGC2452 BINDING SITE, designated SEQ ID:26364, to the nucleotide sequence of VGAM2703 RNA, herein designated VGAM RNA, also designated SEQ ID:5414.

Another function of VGAM2703 is therefore inhibition of MGC2452 (Accession NM_032644). Accordingly, utilities of VGAM2703 include diagnosis, prevention and treatment of diseases and clinical conditions associated with MGC2452. FIG. 1 further provides a conceptual description of a novel bioinformatically detected viral gene of the present invention, referred to here as Viral Genomic Address Messenger 2704 (VGAM2704) viral gene, which modulates expression of respective host target genes thereof, the function and utility of which host target genes is known in the art.

VGAM2704 is a novel bioinformatically detected regulatory, non protein coding, viral micro RNA (miRNA) gene. The method by which VGAM2704 was detected is described hereinabove with reference to FIGS. 1-8.

VGAM2704 gene, herein designated VGAM GENE, is a viral gene contained in the genome of Mamestra Configurata Nucleopolyhedrovirus B. VGAM2704 host target gene, herein designated VGAM HOST TARGET GENE, is a human gene contained in the human genome.

VGAM2704 gene encodes a VGAM2704 precursor RNA, herein designated VGAM PRECURSOR RNA. Similar to other miRNA genes, and unlike most ordinary genes, VGAM2704 precursor RNA does not encode a protein. A nucleotide sequence identical or highly similar to the nucleotide sequence of VGAM2704 precursor RNA is designated SEQ ID:2690, and is provided hereinbelow with reference to the sequence listing part. Nucleotide sequence SEQ ID:2690 is located at position 133581 relative to the genome of Mamestra Configurata Nucleopolyhedrovirus B.

VGAM2704 precursor RNA folds onto itself, forming VGAM2704 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2704 folded precursor RNA into VGAM2704 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 86%) nucleotide sequence of VGAM2704 RNA is designated SEQ ID:5415, and is provided hereinbelow with reference to the sequence listing part.

VGAM2704 host target gene, herein designated VGAM HOST TARGET GENE, encodes a corresponding messenger RNA, VGAM2704 host target RNA, herein designated VGAM HOST TARGET RNA. VGAM2704 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2704 RNA, herein designated VGAM RNA, binds complementarily to one or more host target binding sites located in untranslated regions of VGAM2704 host target RNA, herein designated VGAM HOST TARGET RNA. This complementary binding is due to the fact that the nucleotide sequence of VGAM2704 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2704 RNA, herein designated VGAM RNA, may have a different number of host target binding sites in untranslated regions of a VGAM2704 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2704 RNA, herein designated VGAM RNA, to host target binding sites on VGAM2704 host target RNA, herein designated VGAM HOST TARGET RNA, such as BINDING SITE I, BINDING SITE II and BINDING SITE III, inhibits translation of VGAM2704 host target RNA into VGAM2704 host target protein, herein designated VGAM HOST TARGET PROTEIN. VGAM host target protein is therefore outlined by a broken line.

It is appreciated that VGAM2704 host target gene, herein designated VGAM HOST TARGET GENE, in fact represents a plurality of VGAM2704 host target genes. The mRNA of each one of this plurality of VGAM2704 host target genes comprises one or more host target binding sites, each having a nucleotide sequence which is at least partly complementary to VGAM2704 RNA, herein designated VGAM RNA, and which when bound by VGAM2704 RNA causes inhibition of translation of respective one or more VGAM2704 host target proteins.

It is further appreciated by one skilled in the art that the mode of translational inhibition illustrated by FIG. 1 with specific reference to translational inhibition exerted by VGAM2704 gene, herein designated VGAM GENE, on one or more VGAM2704 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2704 is inhibition of expression of host target genes, as part of a novel viral mechanism of attacking a host. Accordingly, utilities of VGAM2704 include diagnosis, prevention and treatment of viral infection by Mamestra Configurata Nucleopolyhedrovirus B. Specific functions, and accordingly utilities, of VGAM2704 correlate with, and may be deduced from, the identity of the host target genes which VGAM2704 binds and inhibits, and the function of these host target genes, as elaborated hereinbelow.

Nucleotide sequences of the VGAM2704 precursor RNA, herein designated VGAM PRECURSOR RNA, and of the 'diced' VGAM2704 RNA, herein designated VGAM RNA, and a schematic representation of the secondary folding of VGAM2704 folded precursor RNA, herein designated VGAM FOLDED PRECURSOR RNA, of VGAM2704 are further described hereinbelow with reference to Table 1.

Nucleotide sequences of host target binding sites, such as BINDING SITE-I, BINDING SITE-II and BINDING SITE-III of FIG. 1, found on VGAM2704 host target RNA, and schematic representation of the complementarity of each of these host target binding sites to VGAM2704 RNA, herein designated VGAM RNA, are described hereinbelow with reference to Table 2.

As mentioned hereinabove with reference to FIG. 1, a function of VGAM2704 gene, herein designated VGAM is inhibition of expression of VGAM2704 target genes. It is appreciated that specific functions, and accordingly utilities, of VGAM2704 correlate with, and may be deduced from, the identity of the target genes which VGAM2704 binds and inhibits, and the function of these target genes, as elaborated hereinbelow.

Calumenin (CALU, Accession NM_001219) is a VGAM2704 host target gene. CALU BINDING SITE is HOST TARGET binding site found in the 3' untranslated region of mRNA encoded by CALU, corresponding to a HOST TARGET binding site such as BINDING SITE I, BINDING SITE II or BINDING SITE III. Table 2 illustrates the complementarity of the nucleotide sequences of CALU BINDING SITE, designated SEQ ID:6888, to the nucleotide sequence of VGAM2704 RNA, herein designated VGAM RNA, also designated SEQ ID:5415.

A function of VGAM2704 is therefore inhibition of Calumenin (CALU, Accession NM_001219), a gene which binds 7 calcium ions with a low affinity with unidtified function. Accordingly, utilities of VGAM2704 include diagnosis, prevention and treatment of diseases and clinical conditions associated with CALU. The function of CALU and its association with various diseases and clinical conditions, has been established by previous studies, as described hereinabove with reference to VGAM253. LAG1 Longevity Assurance Homolog 2 (S. cerevisiae) (LASS2, Accession XM_041889) is another VGAM2704 host target gene. LASS2 BINDING SITE is HOST TARGET binding site found in the 3' untranslated region of mRNA encoded by LASS2, corresponding to a HOST TARGET binding site such as BINDING SITE I, BINDING SITE II or BINDING SITE III. Table 2 illustrates the complementarity of the nucleotide sequences of LASS2 BINDING SITE, designated SEQ ID:33624, to the nucleotide sequence of VGAM2704 RNA, herein designated VGAM RNA, also designated SEQ ID:5415.

Another function of VGAM2704 is therefore inhibition of LAG1 Longevity Assurance Homolog 2 (S. cerevisiae) (LASS2, Accession XM_041889). Accordingly, utilities of VGAM2704 include diagnosis, prevention and treatment of diseases and clinical conditions associated with LASS2. LOC51339 (Accession NM_016651) is another VGAM2704 host target gene. LOC51339 BINDING SITE is HOST TARGET binding site found in the 3' untranslated region of mRNA encoded by LOC51339, corresponding to a HOST TARGET binding site such as BINDING SITE I, BINDING SITE II or BINDING SITE III. Table 2 illustrates the complementarity of the nucleotide sequences of LOC51339 BINDING SITE, designated SEQ ID:18769, to the nucleotide sequence of VGAM2704 RNA, herein designated VGAM RNA, also designated SEQ ID:5415.

Another function of VGAM2704 is therefore inhibition of LOC51339 (Accession NM_016651). Accordingly, utilities of VGAM2704 include diagnosis, prevention and treatment of diseases and clinical conditions associated with LOC51339. FIG. 1 further provides a conceptual description of a novel bioinformatically detected viral gene of the present invention, referred to here as Viral Genomic Address Messenger 2705 (VGAM2705) viral gene, which modulates expression of respective host target genes thereof, the function and utility of which host target genes is known in the art.

VGAM2705 is a novel bioinformatically detected regulatory, non protein coding, viral micro RNA (miRNA) gene. The method by which VGAM2705 was detected is described hereinabove with reference to FIGS. 1-8.

VGAM2705 gene, herein designated VGAM GENE, is a viral gene contained in the genome of Heliothis Zea Virus 1 (HZV-1). VGAM2705 host target gene, herein designated VGAM HOST TARGET GENE, is a human gene contained in the human genome.

VGAM2705 gene encodes a VGAM2705 precursor RNA, herein designated VGAM PRECURSOR RNA. Similar to other miRNA genes, and unlike most ordinary genes, VGAM2705 precursor RNA does not encode a protein. A nucleotide sequence identical or highly similar to the nucleotide sequence of VGAM2705 precursor RNA is designated SEQ ID:2691, and is provided hereinbelow with reference to the sequence listing part. Nucleotide sequence SEQ ID:2691 is located at position 81066 relative to the genome of Heliothis Zea Virus 1 (HZV-1).

VGAM2705 precursor RNA folds onto itself, forming VGAM2705 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2705 folded precursor RNA into VGAM2705 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 77%) nucleotide sequence of VGAM2705 RNA is designated SEQ ID:5416, and is provided hereinbelow with reference to the sequence listing part.

VGAM2705 host target gene, herein designated VGAM HOST TARGET GENE, encodes a corresponding messenger RNA, VGAM2705 host target RNA, herein designated VGAM HOST TARGET RNA. VGAM2705 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2705 RNA, herein designated VGAM RNA, binds complementarily to one or more host target binding sites located in untranslated regions of VGAM2705 host target RNA, herein designated VGAM HOST TARGET RNA. This complementary binding is due to the fact that the nucleotide sequence of VGAM2705 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2705 RNA, herein designated VGAM RNA, may have a different number of host target binding sites in untranslated regions of a VGAM2705 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2705 RNA, herein designated VGAM RNA, to host target binding sites on VGAM2705 host target RNA, herein designated VGAM HOST TARGET RNA, such as BINDING SITE I, BINDING SITE II and BINDING SITE III, inhibits translation of VGAM2705 host target RNA into VGAM2705 host target protein, herein designated VGAM HOST TARGET PROTEIN. VGAM host target protein is therefore outlined by a broken line.

It is appreciated that VGAM2705 host target gene, herein designated VGAM HOST TARGET GENE, in fact represents a plurality of VGAM2705 host target genes. The mRNA of each one of this plurality of VGAM2705 host target genes comprises one or more host target binding sites, each having a nucleotide sequence which is at least partly complementary to VGAM2705 RNA, herein designated VGAM RNA, and which when bound by VGAM2705 RNA causes inhibition of translation of respective one or more VGAM2705 host target proteins.

It is further appreciated by one skilled in the art that the mode of translational inhibition illustrated by FIG. 1 with specific reference to translational inhibition exerted by VGAM2705 gene, herein designated VGAM GENE, on one or more VGAM2705 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2705 is inhibition of expression of host target genes, as part of a novel viral mechanism of attacking a host. Accordingly, utilities of VGAM2705 include diagnosis, prevention and treatment of viral infection by Heliothis Zea Virus 1 (HZV-1). Specific functions, and accordingly utilities, of VGAM2705 correlate with, and may be deduced from, the identity of the host target genes which VGAM2705 binds and inhibits, and the function of these host target genes, as elaborated hereinbelow.

Nucleotide sequences of the VGAM2705 precursor RNA, herein designated VGAM PRECURSOR RNA, and of the 'diced' VGAM2705 RNA, herein designated VGAM RNA, and a schematic representation of the secondary folding of VGAM2705 folded precursor RNA, herein designated VGAM FOLDED PRECURSOR RNA, of VGAM2705 are further described hereinbelow with reference to Table 1.

Nucleotide sequences of host target binding sites, such as BINDING SITE-I, BINDING SITE-II and BINDING SITE-III of FIG. 1, found on VGAM2705 host target RNA, and schematic representation of the complementarity of each of these host target binding sites to VGAM2705 RNA, herein designated VGAM RNA, are described hereinbelow with reference to Table 2.

As mentioned hereinabove with reference to FIG. 1, a function of VGAM2705 gene, herein designated VGAM is inhibition of expression of VGAM2705 target genes. It is appreciated that specific functions, and accordingly utilities, of VGAM2705 correlate with, and may be deduced from, the identity of the target genes which VGAM2705 binds and inhibits, and the function of these target genes, as elaborated hereinbelow.

Adenosine Monophosphate Deaminase (isoform E) (AMPD3, Accession NM_000480) is a VGAM2705 host target gene. AMPD3 BINDING SITE is HOST TARGET binding site found in the 3' untranslated region of mRNA encoded by AMPD3, corresponding to a HOST TARGET binding site such as BINDING SITE I, BINDING SITE II or BINDING SITE III. Table 2 illustrates the complementarity of the nucleotide sequences of AMPD3 BINDING SITE, designated SEQ ID:6089, to the nucleotide sequence of VGAM2705 RNA, herein designated VGAM RNA, also designated SEQ ID:5416.

A function of VGAM2705 is therefore inhibition of Adenosine Monophosphate Deaminase (isoform E) (AMPD3, Accession NM_000480), a gene which plays a critical role in energy metabolism. Accordingly, utilities of VGAM2705 include diagnosis, prevention and treatment of diseases and clinical conditions associated with AMPD3. The function of AMPD3 has been established by previous studies. Yamada et al. (1992) determined the nucleotide sequence of erythrocyte cDNA. The 3.7-kb cDNA contained an open reading frame of 2,301 bp that encodes 767 amino acids to form an 89-kD protein. Whereas both the AMPD1 and AMPD2 genes are situated in the 1p21-p13 region of chromosome 1, Eddy et al. (1993) demonstrated that the AMPD3 gene is located on chromosome 11 in the region pter-p13. Sermsuvitayawong et al. (1997) demonstrated that the Ampd3 gene is located on mouse chromosome 7 in a region of conserved linkage homology with human 11p. The mouse homolog, however, has a different gene structure in the 5-prime region, the gene products are reported to be immunologically distinct, and Sermsuvitayawong et al. (1997) referred to the Ampd3 gene as the heart-type AMPD. Ogasawara et al. (1987) observed 6 related individuals with complete deficiency of erythrocyte AMP deaminase. All were healthy and had no hematologic disorders. The deficiency was limited to isozyme E, which is the red cell type. The deficiency was inherited as an autosomal recessive trait as demonstrated by the fact that both parents had partial deficiency in each case in which this could be studied and all children of completely deficient individuals were partially deficient. The frequency of the mutant gene was surprisingly high; heterozygotes had a frequency of about 1 in 30 in Japan, Seoul, and Taipei. The ATP level was approximately 50% higher in AMP-deficient red cells compared to the level in the control cells. Degradation of adenine nucleotide was slower in the deficient erythrocytes than in the control erythrocytes. Yamada et al. (1994) stated that AMPD3 deficiency had been found in Europe and that the frequency in northern Poland was almost the same as that in east Asia.

Full details of the abovementioned studies are described in the following publications, the disclosure of which are hereby incorporated by reference:

Ogasawara, N.; Goto, H.; Yamada, Y.; Nishigaki, I.; Itoh, T.; Hasegawa, I.; Park, K. S.: Deficiency of AMP deaminase in erythrocytes. Hum. Genet. 75:15-18, 1987; and Yamada, Y.; Goto, H.; Ogasawara, N.: A point mutation responsible for human erythrocyte AMP deaminase deficiency. Hum. Molec. Genet. 3:331-334, 1994.

Further studies establishing the function and utilities of AMPD3 are found in John Hopkins OMIM database record ID 102772, and in sited publications numbered 12767-12771 listed in the bibliography section hereinbelow, which are also hereby incorporated by reference. Bassoon (presynaptic cytomatrix protein) (BSN, Accession NM_003458) is another VGAM2705 host target gene. BSN BINDING SITE is HOST TARGET binding site found in the 3' untranslated region of mRNA encoded by BSN, corresponding to a HOST TARGET binding site such as BINDING SITE I, BINDING SITE II or BINDING SITE III. Table 2 illustrates the complementarity of the nucleotide sequences of BSN BINDING SITE, designated SEQ ID:9519, to the nucleotide sequence of VGAM2705 RNA, herein designated VGAM RNA, also designated SEQ ID:5416.

Another function of VGAM2705 is therefore inhibition of Bassoon (presynaptic cytomatrix protein) (BSN, Accession NM_003458), a gene which may be involved in cytomatrix organization at the site of neurotransmitter release. Accordingly, utilities of VGAM2705 include diagnosis, prevention and treatment of diseases and clinical conditions associated with BSN. The function of BSN and its association with various diseases and clinical conditions, has been established by previous studies, as described hereinabove with reference to VGAM638. Nuclear Protein, Ataxia-telangiectasia Locus (NPAT, Accession XM_040846) is another VGAM2705 host target gene. NPAT BINDING SITE is HOST TARGET binding site found in the 3' untranslated region of mRNA encoded by NPAT, corresponding to a HOST TARGET binding site such as BINDING SITE I, BINDING SITE II or BINDING SITE III. Table 2 illustrates the complementarity of the nucleotide sequences of NPAT BINDING SITE, designated SEQ ID:33388, to the nucleotide sequence of VGAM2705 RNA, herein designated VGAM RNA, also designated SEQ ID:5416.

Another function of VGAM2705 is therefore inhibition of Nuclear Protein, Ataxia-telangiectasia Locus (NPAT, Accession XM_040846), a gene which is expressed in all tissues. Accordingly, utilities of VGAM2705 include diagnosis, prevention and treatment of diseases and clinical conditions associated with NPAT. The function of NPAT and its association with various diseases and clinical conditions, has been established by previous studies, as described hereinabove with reference to VGAM376. Otoraplin (OTOR, Accession NM_020157) is another VGAM2705 host target gene. OTOR BINDING SITE is HOST TARGET binding site found in the 3' untranslated region of mRNA encoded by OTOR, corresponding to a HOST TARGET binding site such as BINDING SITE I, BINDING SITE II or BINDING SITE III. Table 2 illustrates the complementarity of the nucleotide sequences of OTOR BINDING SITE, designated SEQ ID:21367, to the nucleotide sequence of VGAM2705 RNA, herein designated VGAM RNA, also designated SEQ ID:5416.

Another function of VGAM2705 is therefore inhibition of Otoraplin (OTOR, Accession NM_020157), a gene which plays a role in the early chondrogenesis of the periotic mesenchyme. Accordingly, utilities of VGAM2705 include diagnosis, prevention and treatment of diseases and clinical conditions associated with OTOR. The function of OTOR has been established by previous studies. During large-scale analysis of human fetal cochlea EST sequences, Robertson et al. (2000) identified a novel gene, designated OTOR. They also isolated orthologous genes in mouse, chicken, and bullfrog by screening inner ear cDNA libraries. Rendtorff et al. (2001) independently identified OTOR, which they called MIA-like (MIAL), during a search for cochlea-specific EST clusters. Cohen-Salmon et al. (2000) cloned the mouse Otor gene, which they called fibrocyte-derived protein (Fdp), using a subtracted mouse cochlea cDNA library and 5-prime RACE. Human OTOR encodes a 128-amino acid protein with a predicted secretion signal peptide. The protein shares high sequence identity with the mouse (90%), chicken (80%), and bullfrog (60%) orthologs and with the related human CDRAP/MIA protein (OMIM Ref. No. 601340) (43%). By expressing OTOR in mammalian cell cultures, Rendtorff et al. (2001) showed that OTOR is translated as an approximately 15-kD polypeptide that is assembled into a covalently linked homodimer, modified by sulfation, and secreted from the cells via the Golgi apparatus. By Northern blot analysis, Robertson et al. (2000) detected expression of a major 1.1-kb and minor 1.8- and 4-kb OTOR transcripts in human cochlea. Using RT-PCR and in situ hybridization, Rendtorff et al. (2001) detected OTOR expression specific to a cell layer beneath the sensory epithelium of cochlea and vestibule of human fetal inner ear. Rendtorff et al. (2001) reported a frequent polymorphism in the translation initiation codon of OTOR (ACG instead of ATG). Of 505 unrelated individuals analyzed, 9.5% were ACG/ATG heterozygous. The ACG allele failed to direct synthesis of the OTOR protein in transfected cells. Rendtorff et al. (2001) concluded that OTOR may contribute to inner ear dysfunction in human S.

Full details of the abovementioned studies are described in the following publications, the disclosure of which are hereby incorporated by reference:

Rendtorff, N. D.; Frodin, M.; Attie-Bitach, T.; Vekemans, M.; Tommerup, N.: Identification and characterization of an inner ear-expressed human melanoma inhibitory activity (MIA)-like gene (MIAL) with a frequent polymorphism that abolishes translation. Genomics 71:40-52, 2001; and Robertson, N. G.; Heller, S.; Lin, J. S.; Resendes, B. L.; Weremowicz, S.; Denis, C. S.; Bell, A. M.; Hudspeth, A. J.; Morton, C. C.: A novel conserved cochlear gene, OTOR: identificati.

Further studies establishing the function and utilities of OTOR are found in John Hopkins OMIM database record ID 606067, and in sited publications numbered 4496-4498 listed in the bibliography section hereinbelow, which are also hereby incorporated by reference. Synaptotagmin I (SYT1, Accession NM_005639) is another VGAM2705 host target gene. SYT1 BINDING SITE is HOST TARGET binding site found in the 3' untranslated region of mRNA encoded by SYT1, corresponding to a HOST TARGET binding site such as BINDING SITE I, BINDING SITE II or BINDING SITE III. Table 2 illustrates the complementarity of the nucleotide sequences of SYT1 BINDING SITE, designated SEQ ID:12171, to the nucleotide sequence of VGAM2705 RNA, herein designated VGAM RNA, also designated SEQ ID:5416.

Another function of VGAM2705 is therefore inhibition of Synaptotagmin I (SYT1, Accession NM_005639), a gene which may have a regulatory role in the membrane interactions during trafficking of synaptic vesicles at the active zone of the synapse. Accordingly, utilities of VGAM2705 include diagnosis, prevention and treatment of diseases and clinical conditions associated with SYT1. The function of SYT1 and its association with various diseases and clinical conditions, has been established by previous studies, as described hereinabove with reference to VGAM739. T, Brachyury Homolog (mouse) (T, Accession NM_003181) is another VGAM2705 host target gene. T BINDING SITE is HOST TARGET binding site found in the 5' untranslated region of mRNA encoded by T, corresponding to a HOST TARGET binding site such as BINDING SITE I, BINDING SITE II or BINDING SITE III. Table 2 illustrates the complementarity of the nucleotide sequences of T BINDING SITE, designated SEQ ID:9154, to the nucleotide sequence of VGAM2705 RNA, herein designated VGAM RNA, also designated SEQ ID:5416.

Another function of VGAM2705 is therefore inhibition of T, Brachyury Homolog (mouse) (T, Accession NM_003181), a gene which is a potent transcription factor. Accordingly, utilities of VGAM2705 include diagnosis, prevention and treatment of diseases and clinical conditions associated with T. The function of T and its association with various diseases and clinical conditions, has been established by previous studies, as described hereinabove with reference to VGAM1083. V-yes-1 Yamaguchi Sarcoma Viral Oncogene Homolog 1 (YES1, Accession NM_005433) is another VGAM2705 host target gene. YES1 BINDING SITE is HOST TARGET binding site found in the 3' untranslated region of mRNA encoded by YES1, corresponding to a HOST TARGET binding site such as BINDING SITE I, BINDING SITE II or BINDING SITE III. Table 2 illustrates the complementarity of the nucleotide sequences of YES1 BINDING SITE, designated SEQ ID:11916, to the nucleotide sequence of VGAM2705 RNA, herein designated VGAM RNA, also designated SEQ ID:5416.

Another function of VGAM2705 is therefore inhibition of V-yes-1 Yamaguchi Sarcoma Viral Oncogene Homolog 1 (YES1, Accession NM_005433), a gene which is a putative protein-tyrosine kinase. Accordingly, utilities of VGAM2705 include diagnosis, prevention and treatment of diseases and clinical conditions associated with YES1. The function of YES1 and its association with various diseases and clinical conditions, has been established by previous studies, as described hereinabove with reference to VGAM74. Rho Guanine Nucleotide Exchange Factor (GEF) 10 (ARHGEF10, Accession XM_017169) is another VGAM2705 host target gene. ARHGEF10 BINDING SITE is HOST TARGET binding site found in the 3' untranslated region of mRNA encoded by ARHGEF10, corresponding to a HOST TARGET binding site such as BINDING SITE I, BINDING SITE II or BINDING SITE III. Table 2 illustrates the complementarity of the nucleotide sequences of ARHGEF10 BINDING SITE, designated SEQ ID:30305, to the nucleotide sequence of VGAM2705 RNA, herein designated VGAM RNA, also designated SEQ ID:5416.

Another function of VGAM2705 is therefore inhibition of Rho Guanine Nucleotide Exchange Factor (GEF) 10 (ARHGEF10, Accession XM_017169). Accordingly, utilities of VGAM2705 include diagnosis, prevention and treatment of diseases and clinical conditions associated with ARHGEF10. CD109 (Accession NM_133493) is another VGAM2705 host target gene. CD109 BINDING SITE is HOST TARGET binding site found in the 3' untranslated region of mRNA encoded by CD109, corresponding to a HOST TARGET binding site such as BINDING SITE I, BINDING SITE II or BINDING SITE III. Table 2 illustrates the complementarity of the nucleotide sequences of CD109 BINDING SITE, designated SEQ ID:28572, to the nucleotide sequence of VGAM2705 RNA, herein designated VGAM RNA, also designated SEQ ID:5416.

Another function of VGAM2705 is therefore inhibition of CD109 (Accession NM_133493). Accordingly, utilities of VGAM2705 include diagnosis, prevention and treatment of diseases and clinical conditions associated with CD109. FLJ12934 (Accession NM_022899) is another VGAM2705 host target gene. FLJ12934 BINDING SITE is HOST TARGET binding site found in the 3' untranslated region of mRNA encoded by FLJ12934, corresponding to a HOST TARGET binding site such as BINDING SITE I, BINDING SITE II or BINDING SITE III. Table 2 illustrates the complementarity of the nucleotide sequences of FLJ12934 BINDING SITE, designated SEQ ID:23177, to the nucleotide sequence of VGAM2705 RNA, herein designated VGAM RNA, also designated SEQ ID:5416.

Another function of VGAM2705 is therefore inhibition of FLJ12934 (Accession NM_022899). Accordingly, utilities of VGAM2705 include diagnosis, prevention and treatment of diseases and clinical conditions associated with FLJ12934. KIAA0014 (Accession NM_014665) is another VGAM2705 host target gene. KIAA0014 BINDING SITE is HOST TARGET binding site found in the 3' untranslated region of mRNA encoded by KIAA0014, corresponding to a HOST TARGET binding site such as BINDING SITE I, BINDING SITE II or BINDING SITE III. Table 2 illustrates the complementarity of the nucleotide sequences of KIAA0014 BINDING SITE, designated SEQ ID:16117, to the nucleotide sequence of VGAM2705 RNA, herein designated VGAM RNA, also designated SEQ ID:5416.

Another function of VGAM2705 is therefore inhibition of KIAA0014 (Accession NM_014665). Accordingly, utilities of VGAM2705 include diagnosis, prevention and treatment of diseases and clinical conditions associated with KIAA0014. KIAA0092 (Accession NM_014679) is another VGAM2705 host target gene. KIAA0092 BINDING SITE is HOST TARGET binding site found in the 3' untranslated region of mRNA encoded by KIAA0092, corresponding to a HOST TARGET binding site such as BINDING SITE I, BINDING SITE II or BINDING SITE III. Table 2 illustrates the complementarity of the nucleotide sequences of KIAA0092 BINDING SITE, designated SEQ ID:16157, to the nucleotide sequence of VGAM2705 RNA, herein designated VGAM RNA, also designated SEQ ID:5416.

Another function of VGAM2705 is therefore inhibition of KIAA0092 (Accession NM_014679). Accordingly, utilities of VGAM2705 include diagnosis, prevention and treatment of diseases and clinical conditions associated with KIAA0092. KIAA0318 (Accession XM_044334) is another VGAM2705 host target gene. KIAA0318 BINDING SITE is HOST TARGET binding site found in the 3' untranslated region of mRNA encoded by KIAA0318, corresponding to a HOST TARGET binding site such as BINDING SITE I, BINDING SITE II or BINDING SITE III. Table 2 illustrates the complementarity of the nucleotide sequences of KIAA0318 BINDING SITE, designated SEQ ID:34185, to the nucleotide sequence of VGAM2705 RNA, herein designated VGAM RNA, also designated SEQ ID:5416.

Another function of VGAM2705 is therefore inhibition of KIAA0318 (Accession XM_044334). Accordingly, utilities of VGAM2705 include diagnosis, prevention and treatment of diseases and clinical conditions associated with KIAA0318. KIAA1219 (Accession XM_028835) is another VGAM2705 host target gene. KIAA1219 BINDING SITE is HOST TARGET binding site found in the 3' untranslated region of mRNA encoded by KIAA1219, corresponding to a HOST TARGET binding site such as BINDING SITE I, BINDING SITE II or BINDING SITE III. Table 2 illustrates the complementarity of the nucleotide sequences of KIAA1219 BINDING SITE, designated SEQ ID:30760, to the nucleotide sequence of VGAM2705 RNA, herein designated VGAM RNA, also designated SEQ ID:5416.

Another function of VGAM2705 is therefore inhibition of KIAA1219 (Accession XM_028835). Accordingly, utilities of VGAM2705 include diagnosis, prevention and treatment of diseases and clinical conditions associated with KIAA1219. Low Density Lipoprotein-related Protein 1B (deleted in tumors) (LRP1B, Accession NM_018557) is another VGAM2705 host target gene. LRP1B BINDING SITE is HOST TARGET binding site found in the 3' untranslated region of mRNA encoded by LRP1B, corresponding to a HOST TARGET binding site such as BINDING SITE I, BINDING SITE II or BINDING SITE III. Table 2 illustrates the complementarity of the nucleotide sequences of LRP1B BINDING SITE, designated SEQ ID:20640, to the nucleotide sequence of VGAM2705 RNA, herein designated VGAM RNA, also designated SEQ ID:5416.

Another function of VGAM2705 is therefore inhibition of Low Density Lipoprotein-related Protein 1B (deleted in tumors) (LRP1B, Accession NM_018557). Accordingly, utilities of VGAM2705 include diagnosis, prevention and treatment of diseases and clinical conditions associated with LRP1B. TRIP-Br2 (Accession NM_014755) is another VGAM2705 host target gene. TRIP-Br2 BINDING SITE is HOST TARGET binding site found in the 3' untranslated region of mRNA encoded by TRIP-Br2, corresponding to a HOST TARGET binding site such as BINDING SITE I, BINDING SITE II or BINDING SITE III. Table 2 illustrates the complementarity of the nucleotide sequences of TRIP-Br2 BINDING SITE, designated SEQ ID:16487, to the nucleotide sequence of VGAM2705 RNA, herein designated VGAM RNA, also designated SEQ ID:5416.

Another function of VGAM2705 is therefore inhibition of TRIP-Br2 (Accession NM_014755). Accordingly, utilities of VGAM2705 include diagnosis, prevention and treatment of diseases and clinical conditions associated with TRIP-Br2. Tubulin, Gamma Complex Associated Protein 3 (TUBGCP3, Accession NM_006322) is another VGAM2705 host target gene. TUBGCP3 BINDING SITE is HOST TARGET binding site found in the 3' untranslated region of mRNA encoded by TUBGCP3, corresponding to a HOST TARGET binding site such as BINDING SITE I, BINDING SITE II or BINDING SITE III. Table 2 illustrates the complementarity of the nucleotide sequences of TUBGCP3 BINDING SITE, designated SEQ ID:13013, to the nucleotide sequence of VGAM2705 RNA, herein designated VGAM RNA, also designated SEQ ID:5416.

Another function of VGAM2705 is therefore inhibition of Tubulin, Gamma Complex Associated Protein 3 (TUBGCP3, Accession NM_006322). Accordingly, utilities of VGAM2705 include diagnosis, prevention and treatment of diseases and clinical conditions associated with TUBGCP3. LOC158014 (Accession XM_088442) is another VGAM2705 host target gene. LOC158014 BINDING SITE is HOST TARGET binding site found in the 5' untranslated region of mRNA encoded by LOC158014, corresponding to a HOST TARGET binding site such as BINDING SITE I, BINDING SITE II or BINDING SITE III. Table 2 illustrates the complementarity of the nucleotide sequences of LOC158014 BINDING SITE, designated SEQ ID:39696, to the nucleotide sequence of VGAM2705 RNA, herein designated VGAM RNA, also designated SEQ ID:5416.

Another function of VGAM2705 is therefore inhibition of LOC158014 (Accession XM_088442). Accordingly, utilities of VGAM2705 include diagnosis, prevention and treatment of diseases and clinical conditions associated with LOC158014. LOC202908 (Accession XM_114602) is another VGAM2705 host target gene. LOC202908 BINDING SITE is HOST TARGET binding site found in the 5' untranslated region of mRNA encoded by LOC202908, corresponding to a HOST TARGET binding site such as BINDING SITE I, BINDING SITE II or BINDING SITE III. Table 2 illustrates the complementarity of the nucleotide sequences of LOC202908 BINDING SITE, designated SEQ ID:42996, to the nucleotide sequence of VGAM2705 RNA, herein designated VGAM RNA, also designated SEQ ID:5416.

Another function of VGAM2705 is therefore inhibition of LOC202908 (Accession XM_114602). Accordingly, utilities of VGAM2705 include diagnosis, prevention and treatment of diseases and clinical conditions associated with LOC202908. LOC90719 (Accession XM_033704) is another VGAM2705 host target gene. LOC90719 BINDING SITE is HOST TARGET binding site found in the 5' untranslated region of mRNA encoded by LOC90719, corresponding to a HOST TARGET binding site such as BINDING SITE I, BINDING SITE II or BINDING SITE III. Table 2 illustrates the complementarity of the nucleotide sequences of LOC90719 BINDING SITE, designated SEQ ID:31948, to the nucleotide sequence of VGAM2705 RNA, herein designated VGAM RNA, also designated SEQ ID:5416.

Another function of VGAM2705 is therefore inhibition of LOC90719 (Accession XM_033704). Accordingly, utilities of VGAM2705 include diagnosis, prevention and treatment of diseases and clinical conditions associated with LOC90719. FIG. 1 further provides a conceptual description of a novel bioinformatically detected viral gene of the present invention, referred to here as Viral Genomic Address Messenger 2706 (VGAM2706) viral gene, which modulates expression of respective host target genes thereof, the function and utility of which host target genes is known in the art.

VGAM2706 is a novel bioinformatically detected regulatory, non protein coding, viral micro RNA (miRNA) gene. The method by which VGAM2706 was detected is described hereinabove with reference to FIGS. 1-8.

VGAM2706 gene, herein designated VGAM GENE, is a viral gene contained in the genome of Heliothis Zea Virus 1 (HZV-1). VGAM2706 host target gene, herein designated VGAM HOST TARGET GENE, is a human gene contained in the human genome.

VGAM2706 gene encodes a VGAM2706 precursor RNA, herein designated VGAM PRECURSOR RNA. Similar to other miRNA genes, and unlike most ordinary genes, VGAM2706 precursor RNA does not encode a protein. A nucleotide sequence identical or highly similar to the nucleotide sequence of VGAM2706 precursor RNA is designated SEQ ID:2692, and is provided hereinbelow with reference to the sequence listing part. Nucleotide sequence SEQ ID:2692 is located at position 84781 relative to the genome of Heliothis Zea Virus 1 (HZV-1).

VGAM2706 precursor RNA folds onto itself, forming VGAM2706 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2706 folded precursor RNA into VGAM2706 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 49%) nucleotide sequence of VGAM2706 RNA is designated SEQ ID:5417, and is provided hereinbelow with reference to the sequence listing part.

VGAM2706 host target gene, herein designated VGAM HOST TARGET GENE, encodes a corresponding messenger RNA, VGAM2706 host target RNA, herein designated VGAM HOST TARGET RNA. VGAM2706 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2706 RNA, herein designated VGAM RNA, binds complementarily to one or more host target binding sites located in untranslated regions of VGAM2706 host target RNA, herein designated VGAM HOST TARGET RNA. This complementary binding is due to the fact that the nucleotide sequence of VGAM2706 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2706 RNA, herein designated VGAM RNA, may have a different number of host target binding sites in untranslated regions of a VGAM2706 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2706 RNA, herein designated VGAM RNA, to host target binding sites on VGAM2706 host target RNA, herein designated VGAM HOST TARGET RNA, such as BINDING SITE I, BINDING SITE II and BINDING SITE III, inhibits translation of VGAM2706 host target RNA into VGAM2706 host target protein, herein designated VGAM HOST TARGET PROTEIN. VGAM host target protein is therefore outlined by a broken line.

It is appreciated that VGAM2706 host target gene, herein designated VGAM HOST TARGET GENE, in fact represents a plurality of VGAM2706 host target genes. The mRNA of each one of this plurality of VGAM2706 host target genes comprises one or more host target binding sites, each having a nucleotide sequence which is at least partly complementary to VGAM2706 RNA, herein designated VGAM RNA, and which when bound by VGAM2706 RNA causes inhibition of translation of respective one or more VGAM2706 host target proteins.

It is further appreciated by one skilled in the art that the mode of translational inhibition illustrated by FIG. 1 with specific reference to translational inhibition exerted by VGAM2706 gene, herein designated VGAM GENE, on one or more VGAM2706 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2706 is inhibition of expression of host target genes, as part of a novel viral mechanism of attacking a host. Accordingly, utilities of VGAM2706 include diagnosis, prevention and treatment of viral infection by Heliothis Zea Virus 1 (HZV-1). Specific functions, and accordingly utilities, of VGAM2706 correlate with, and may be deduced from, the identity of the host target genes which VGAM2706 binds and inhibits, and the function of these host target genes, as elaborated hereinbelow.

Nucleotide sequences of the VGAM2706 precursor RNA, herein designated VGAM PRECURSOR RNA, and of the 'diced' VGAM2706 RNA, herein designated VGAM RNA, and a schematic representation of the secondary folding of VGAM2706 folded precursor RNA, herein designated VGAM FOLDED PRECURSOR RNA, of VGAM2706 are further described hereinbelow with reference to Table 1.

Nucleotide sequences of host target binding sites, such as BINDING SITE-I, BINDING SITE-II and BINDING SITE-III of FIG. 1, found on VGAM2706 host target RNA, and schematic representation of the complementarity of each of these host target binding sites to VGAM2706 RNA, herein designated VGAM RNA, are described hereinbelow with reference to Table 2.

As mentioned hereinabove with reference to FIG. 1, a function of VGAM2706 gene, herein designated VGAM is inhibition of expression of VGAM2706 target genes. It is appreciated that specific functions, and accordingly utilities, of VGAM2706 correlate with, and may be deduced from, the identity of the target genes which VGAM2706 binds and inhibits, and the function of these target genes, as elaborated hereinbelow.

Dachshund Homolog (Drosophila) (DACH, Accession NM_080759) is a VGAM2706 host target gene. DACH BINDING SITE is HOST TARGET binding site found in the 3' untranslated region of mRNA encoded by DACH, corresponding to a HOST TARGET binding site such as BINDING SITE I, BINDING SITE II or BINDING SITE III. Table 2 illustrates the complementarity of the nucleotide sequences of DACH BINDING SITE, designated SEQ ID:28035, to the nucleotide sequence of VGAM2706 RNA, herein designated VGAM RNA, also designated SEQ ID:5417.

A function of VGAM2706 is therefore inhibition of Dachshund Homolog (Drosophila) (DACH, Accession NM_080759), a gene which regulates early progenitor cell proliferation during retinogenesis and pituitary development. Accordingly, utilities of VGAM2706 include diagnosis, prevention and treatment of diseases and clinical conditions associated with DACH. The function of DACH and its association with various diseases and clinical conditions, has been established by previous studies, as described hereinabove with reference to VGAM260. Serine (or cysteine) Proteinase Inhibitor, Clade B (ovalbumin), Member 9 (SERPINB9, Accession NM_004155) is another VGAM2706 host target gene. SERPINB9 BINDING SITE is HOST TARGET binding site found in the 3' untranslated region of mRNA encoded by SERPINB9, corresponding to a HOST TARGET binding site such as BINDING SITE I, BINDING SITE II or BINDING SITE III. Table 2 illustrates the complementarity of the nucleotide sequences of SERPINB9 BINDING SITE, designated SEQ ID:10362, to the nucleotide sequence of VGAM2706 RNA, herein designated VGAM RNA, also designated SEQ ID:5417.

Another function of VGAM2706 is therefore inhibition of Serine (or cysteine) Proteinase Inhibitor, Clade B (ovalbumin), Member 9 (SERPINB9, Accession NM_004155), a gene which may be a serpin serine protease inhibitor that interacts with granzyme B (GZMB). Accordingly, utilities of VGAM2706 include diagnosis, prevention and treatment of diseases and clinical conditions associated with SERPINB9. The function of SERPINB9 and its association with various diseases and clinical conditions, has been established by previous studies, as described hereinabove with reference to VGAM60. Chromosome 20 Open Reading Frame 139 (C20orf139, Accession XM_097749) is another VGAM2706 host target gene. C20orf139 BINDING SITE is HOST TARGET binding site found in the 5' untranslated region of mRNA encoded by C20orf139, corresponding to a HOST TARGET binding site such as BINDING SITE I, BINDING SITE II or BINDING SITE III. Table 2 illustrates the complementarity of the nucleotide sequences of C20orf139 BINDING SITE, designated SEQ ID:41107, to the nucleotide sequence of VGAM2706 RNA, herein designated VGAM RNA, also designated SEQ ID:5417.

Another function of VGAM2706 is therefore inhibition of Chromosome 20 Open Reading Frame 139 (C20orf139, Accession XM_097749). Accordingly, utilities of VGAM2706 include diagnosis, prevention and treatment of diseases and clinical conditions associated with C20orf139. FLJ13769 (Accession NM_025012) is another VGAM2706 host target gene. FLJ13769 BINDING SITE is HOST TARGET binding site found in the 3' untranslated region of mRNA encoded by FLJ13769, corresponding to a HOST TARGET binding site such as BINDING SITE I, BINDING SITE II or BINDING SITE III. Table 2 illustrates the complementarity of the nucleotide sequences of FLJ13769 BINDING SITE, designated SEQ ID:24590, to the nucleotide sequence of VGAM2706 RNA, herein designated VGAM RNA, also designated SEQ ID:5417.

Another function of VGAM2706 is therefore inhibition of FLJ13769 (Accession NM_025012). Accordingly, utilities of VGAM2706 include diagnosis, prevention and treatment of diseases and clinical conditions associated with FLJ13769. FLJ32734 (Accession NM_144681) is another VGAM2706 host target gene. FLJ32734 BINDING SITE is HOST TARGET binding site found in the 5' untranslated region of mRNA encoded by FLJ32734, corresponding to a HOST TARGET binding site such as BINDING SITE I, BINDING SITE II or BINDING SITE III. Table 2 illustrates the complementarity of the nucleotide sequences of FLJ32734 BINDING SITE, designated SEQ ID:29496, to the nucleotide sequence of VGAM2706 RNA, herein designated VGAM RNA, also designated SEQ ID:5417.

Another function of VGAM2706 is therefore inhibition of FLJ32734 (Accession NM_144681). Accordingly, utilities of VGAM2706 include diagnosis, prevention and treatment of diseases and clinical conditions associated with FLJ32734. KIAA0494 (Accession NM_014774) is another VGAM2706 host target gene. KIAA0494 BINDING SITE is HOST TARGET binding site found in the 3' untranslated region of mRNA encoded by KIAA0494, corresponding to a HOST TARGET binding site such as BINDING SITE I, BINDING SITE II or BINDING SITE III. Table 2 illustrates the complementarity of the nucleotide sequences of KIAA0494 BINDING SITE, designated SEQ ID:16590, to the nucleotide sequence of VGAM2706 RNA, herein designated VGAM RNA, also designated SEQ ID:5417.

Another function of VGAM2706 is therefore inhibition of KIAA0494 (Accession NM_014774). Accordingly, utilities of VGAM2706 include diagnosis, prevention and treatment of diseases and clinical conditions associated with KIAA0494. KIAA1775 (Accession NM_033100) is another VGAM2706 host target gene. KIAA1775 BINDING SITE is HOST TARGET binding site found in the 3' untranslated region of mRNA encoded by KIAA1775, corresponding to a HOST TARGET binding site such as BINDING SITE I, BINDING SITE II or BINDING SITE III. Table 2 illustrates the complementarity of the nucleotide sequences of KIAA1775 BINDING SITE, designated SEQ ID:26942, to the nucleotide sequence of VGAM2706 RNA, herein designated VGAM RNA, also designated SEQ ID:5417.

Another function of VGAM2706 is therefore inhibition of KIAA1775 (Accession NM_033100). Accordingly, utilities of VGAM2706 include diagnosis, prevention and treatment of diseases and clinical conditions associated with KIAA1775. MGC2749 (Accession NM_024069) is another VGAM2706 host target gene. MGC2749 BINDING SITE is HOST TARGET binding site found in the 3' untranslated region of mRNA encoded by MGC2749, corresponding to a HOST TARGET binding site such as BINDING SITE I, BINDING SITE II or BINDING SITE III. Table 2 illustrates the complementarity of the nucleotide sequences of MGC2749 BINDING SITE, designated SEQ ID:23499, to the nucleotide sequence of VGAM2706 RNA, herein designated VGAM RNA, also designated SEQ ID:5417.

Another function of VGAM2706 is therefore inhibition of MGC2749 (Accession NM_024069). Accordingly, utilities of VGAM2706 include diagnosis, prevention and treatment of diseases and clinical conditions associated with MGC2749. MGC3178 (Accession NM_030810) is another VGAM2706 host target gene. MGC3178 BINDING SITE is HOST TARGET binding site found in the 3' untranslated region of mRNA encoded by MGC3178, corresponding to a HOST TARGET binding site such as BINDING SITE I, BINDING SITE II or BINDING SITE III. Table 2 illustrates the complementarity of the nucleotide sequences of MGC3178 BINDING SITE, designated SEQ ID:25131, to the nucleotide sequence of VGAM2706 RNA, herein designated VGAM RNA, also designated SEQ ID:5417.

Another function of VGAM2706 is therefore inhibition of MGC3178 (Accession NM_030810). Accordingly, utilities of VGAM2706 include diagnosis, prevention and treatment of diseases and clinical conditions associated with MGC3178. LOC146229 (Accession XM_085387) is another VGAM2706 host target gene. LOC146229 BINDING SITE is HOST TARGET binding site found in the 3' untranslated region of mRNA encoded by LOC146229, corresponding to a HOST TARGET binding site such as BINDING SITE I, BINDING SITE II or BINDING SITE III. Table 2 illustrates the complementarity of the nucleotide sequences of LOC146229 BINDING SITE, designated SEQ ID:38111, to the nucleotide sequence of VGAM2706 RNA, herein designated VGAM RNA, also designated SEQ ID:5417.

Another function of VGAM2706 is therefore inhibition of LOC146229 (Accession XM_085387). Accordingly, utilities of VGAM2706 include diagnosis, prevention and treatment of diseases and clinical conditions associated with LOC146229. LOC147040 (Accession XM_085689) is another VGAM2706 host target gene. LOC147040 BINDING SITE is HOST TARGET binding site found in the 3' untranslated region of mRNA encoded by LOC147040, corresponding to a HOST TARGET binding site such as BINDING SITE I, BINDING SITE II or BINDING SITE III. Table 2 illustrates the complementarity of the nucleotide sequences of LOC147040 BINDING SITE, designated SEQ ID:38287, to the nucleotide sequence of VGAM2706 RNA, herein designated VGAM RNA, also designated SEQ ID:5417.

Another function of VGAM2706 is therefore inhibition of LOC147040 (Accession XM_085689). Accordingly, utilities of VGAM2706 include diagnosis, prevention and treatment of diseases and clinical conditions associated with LOC147040. LOC154881 (Accession XM_088063) is another VGAM2706 host target gene. LOC154881 BINDING SITE is HOST TARGET binding site found in the 3' untranslated region of mRNA encoded by LOC154881, corresponding to a HOST TARGET binding site such as BINDING SITE I, BINDING SITE II or BINDING SITE III. Table 2 illustrates the complementarity of the nucleotide sequences of LOC154881 BINDING SITE, designated SEQ ID:39496, to the nucleotide sequence of VGAM2706 RNA, herein designated VGAM RNA, also designated SEQ ID:5417.

Another function of VGAM2706 is therefore inhibition of LOC154881 (Accession XM_088063). Accordingly, utilities of VGAM2706 include diagnosis, prevention and treatment of diseases and clinical conditions associated with LOC154881. LOC155036 (Accession XM_098651) is another VGAM2706 host target gene. LOC155036 BINDING SITE is HOST TARGET binding site found in the 5' untranslated region of mRNA encoded by LOC155036, corresponding to a HOST TARGET binding site such as BINDING SITE I, BINDING SITE II or BINDING SITE III. Table 2 illustrates the complementarity of the nucleotide sequences of LOC155036 BINDING SITE, designated SEQ ID:41753, to the nucleotide sequence of VGAM2706 RNA, herein designated VGAM RNA, also designated SEQ ID:5417.

Another function of VGAM2706 is therefore inhibition of LOC155036 (Accession XM_098651). Accordingly, utilities of VGAM2706 include diagnosis, prevention and treatment of diseases and clinical conditions associated with LOC155036. LOC253681 (Accession XM_170830) is another VGAM2706 host target gene. LOC253681 BINDING SITE is HOST TARGET binding site found in the 3' untranslated region of mRNA encoded by LOC253681, corresponding to a HOST TARGET binding site such as BINDING SITE I, BINDING SITE II or BINDING SITE III. Table 2 illustrates the complementarity of the nucleotide sequences of LOC253681 BINDING SITE, designated SEQ ID:45605, to the nucleotide sequence of VGAM2706 RNA, herein designated VGAM RNA, also designated SEQ ID:5417.

Another function of VGAM2706 is therefore inhibition of LOC253681 (Accession XM_170830). Accordingly, utilities of VGAM2706 include diagnosis, prevention and treatment of diseases and clinical conditions associated with LOC253681. FIG. 1 further provides a conceptual description of a novel bioinformatically detected viral gene of the present invention, referred to here as Viral Genomic Address Messenger 2707 (VGAM2707) viral gene, which modulates expression of respective host target genes thereof, the function and utility of which host target genes is known in the art.

VGAM2707 is a novel bioinformatically detected regulatory, non protein coding, viral micro RNA (miRNA) gene. The method by which VGAM2707 was detected is described hereinabove with reference to FIGS. 1-8.

VGAM2707 gene, herein designated VGAM GENE, is a viral gene contained in the genome of Heliothis Zea Virus 1 (HZV-1). VGAM2707 host target gene, herein designated VGAM HOST TARGET GENE, is a human gene contained in the human genome.

VGAM2707 gene encodes a VGAM2707 precursor RNA, herein designated VGAM PRECURSOR RNA. Similar to other miRNA genes, and unlike most ordinary genes, VGAM2707 precursor RNA does not encode a protein. A nucleotide sequence identical or highly similar to the nucleotide sequence of VGAM2707 precursor RNA is designated SEQ ID:2693, and is provided hereinbelow with reference to the sequence listing part. Nucleotide sequence SEQ ID:2693 is located at position 85718 relative to the genome of Heliothis Zea Virus 1 (HZV-1).

VGAM2707 precursor RNA folds onto itself, forming VGAM2707 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2707 folded precursor RNA into VGAM2707 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 70%) nucleotide sequence of VGAM2707 RNA is designated SEQ ID:5418, and is provided hereinbelow with reference to the sequence listing part.

VGAM2707 host target gene, herein designated VGAM HOST TARGET GENE, encodes a corresponding messenger RNA, VGAM2707 host target RNA, herein designated VGAM HOST TARGET RNA. VGAM2707 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2707 RNA, herein designated VGAM RNA, binds complementarily to one or more host target binding sites located in untranslated regions of VGAM2707 host target RNA, herein designated VGAM HOST TARGET RNA. This complementary binding is due to the fact that the nucleotide sequence of VGAM2707 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2707 RNA, herein designated VGAM RNA, may have a different number of host target binding sites in untranslated regions of a VGAM2707 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2707 RNA, herein designated VGAM RNA, to host target binding sites on VGAM2707 host target RNA, herein designated VGAM HOST TARGET RNA, such as BINDING SITE I, BINDING SITE II and BINDING SITE III, inhibits translation of VGAM2707 host target RNA into VGAM2707 host target protein, herein designated VGAM HOST TARGET PRO- TEIN. VGAM host target protein is therefore outlined by a broken line.

It is appreciated that VGAM2707 host target gene, herein designated VGAM HOST TARGET GENE, in fact represents a plurality of VGAM2707 host target genes. The mRNA of each one of this plurality of VGAM2707 host target genes comprises one or more host target binding sites, each having a nucleotide sequence which is at least partly complementary to VGAM2707 RNA, herein designated VGAM RNA, and which when bound by VGAM2707 RNA causes inhibition of translation of respective one or more VGAM2707 host target proteins.

It is further appreciated by one skilled in the art that the mode of translational inhibition illustrated by FIG. 1 with specific reference to translational inhibition exerted by VGAM2707 gene, herein designated VGAM GENE, on one or more VGAM2707 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2707 is inhibition of expression of host target genes, as part of a novel viral mechanism of attacking a host. Accordingly, utilities of VGAM2707 include diagnosis, prevention and treatment of viral infection by Heliothis Zea Virus 1 (HZV-1). Specific functions, and accordingly utilities, of VGAM2707 correlate with, and may be deduced from, the identity of the host target genes which VGAM2707 binds and inhibits, and the function of these host target genes, as elaborated hereinbelow.

Nucleotide sequences of the VGAM2707 precursor RNA, herein designated VGAM PRECURSOR RNA, and of the 'diced' VGAM2707 RNA, herein designated VGAM RNA, and a schematic representation of the secondary folding of VGAM2707 folded precursor RNA, herein designated VGAM FOLDED PRECURSOR RNA, of VGAM2707 are further described hereinbelow with reference to Table 1.

Nucleotide sequences of host target binding sites, such as BINDING SITE-I, BINDING SITE-II and BINDING SITE-III of FIG. 1, found on VGAM2707 host target RNA, and schematic representation of the complementarity of each of these host target binding sites to VGAM2707 RNA, herein designated VGAM RNA, are described hereinbelow with reference to Table 2.

As mentioned hereinabove with reference to FIG. 1, a function of VGAM2707 gene, herein designated VGAM is inhibition of expression of VGAM2707 target genes. It is appreciated that specific functions, and accordingly utilities, of VGAM2707 correlate with, and may be deduced from, the identity of the target genes which VGAM2707 binds and inhibits, and the function of these target genes, as elaborated hereinbelow.

Transmembrane, Prostate Androgen Induced RNA (TMEPAI, Accession NM_020182) is a VGAM2707 host target gene. TMEPAI BINDING SITE is HOST TARGET binding site found in the 3' untranslated region of mRNA encoded by TMEPAI, corresponding to a HOST TARGET binding site such as BINDING SITE I, BINDING SITE II or BINDING SITE III. Table 2 illustrates the complementarity of the nucleotide sequences of TMEPAI BINDING SITE, designated SEQ ID:21404, to the nucleotide sequence of VGAM2707 RNA, herein designated VGAM RNA, also designated SEQ ID:5418.

A function of VGAM2707 is therefore inhibition of Transmembrane, Prostate Androgen Induced RNA (TMEPAI, Accession NM_020182). Accordingly, utilities of VGAM2707 include diagnosis, prevention and treatment of diseases and clinical conditions associated with TMEPAI. FLJ13769 (Accession NM_025012) is another VGAM2707 host target gene. FLJ13769 BINDING SITE is HOST TARGET binding site found in the 3' untranslated region of mRNA encoded by FLJ13769, corresponding to a HOST TARGET binding site such as BINDING SITE I, BINDING SITE II or BINDING SITE III. Table 2 illustrates the complementarity of the nucleotide sequences of FLJ13769 BINDING SITE, designated SEQ ID:24598, to the nucleotide sequence of VGAM2707 RNA, herein designated VGAM RNA, also designated SEQ ID:5418.

Another function of VGAM2707 is therefore inhibition of FLJ13769 (Accession NM_025012). Accordingly, utilities of VGAM2707 include diagnosis, prevention and treatment of diseases and clinical conditions associated with FLJ13769. KIAA1915 (Accession XM_055481) is another VGAM2707 host target gene. KIAA1915 BINDING SITE is HOST TARGET binding site found in the 3' untranslated region of mRNA encoded by KIAA1915, corresponding to a HOST TARGET binding site such as BINDING SITE I, BINDING SITE II or BINDING SITE III. Table 2 illustrates the complementarity of the nucleotide sequences of KIAA1915 BINDING SITE, designated SEQ ID:36272, to the nucleotide sequence of VGAM2707 RNA, herein designated VGAM RNA, also designated SEQ ID:5418.

Another function of VGAM2707 is therefore inhibition of KIAA1915 (Accession XM_055481). Accordingly, utilities of VGAM2707 include diagnosis, prevention and treatment of diseases and clinical conditions associated with KIAA1915. MGC12217 (Accession NM_032771) is another VGAM2707 host target gene. MGC12217 BINDING SITE is HOST TARGET binding site found in the 3' untranslated region of mRNA encoded by MGC12217, corresponding to a HOST TARGET binding site such as BINDING SITE I, BINDING SITE II or BINDING SITE III. Table 2 illustrates the complementarity of the nucleotide sequences of MGC12217 BINDING SITE, designated SEQ ID:26516, to the nucleotide sequence of VGAM2707 RNA, herein designated VGAM RNA, also designated SEQ ID:5418.

Another function of VGAM2707 is therefore inhibition of MGC12217 (Accession NM_032771). Accordingly, utilities of VGAM2707 include diagnosis, prevention and treatment of diseases and clinical conditions associated with MGC12217. LOC152503 (Accession XM_098238) is another VGAM2707 host target gene. LOC152503 BINDING SITE is HOST TARGET binding site found in the 5' untranslated region of mRNA encoded by LOC152503, corresponding to a HOST TARGET binding site such as BINDING SITE I, BINDING SITE II or BINDING SITE III. Table 2 illustrates the complementarity of the nucleotide sequences of LOC152503 BINDING SITE, designated SEQ ID:41516, to the nucleotide sequence of VGAM2707 RNA, herein designated VGAM RNA, also designated SEQ ID:5418.

Another function of VGAM2707 is therefore inhibition of LOC152503 (Accession XM_098238). Accordingly, utilities of VGAM2707 include diagnosis, prevention and treatment of diseases and clinical conditions associated with LOC152503. LOC153914 (Accession XM_087799) is another VGAM2707 host target gene. LOC153914 BIND- ING SITE is HOST TARGET binding site found in the 5' untranslated region of mRNA encoded by LOC153914, corresponding to a HOST TARGET binding site such as BINDING SITE I, BINDING SITE II or BINDING SITE III. Table 2 illustrates the complementarity of the nucleotide sequences of LOC153914 BINDING SITE, designated SEQ ID:39436, to the nucleotide sequence of VGAM2707 RNA, herein designated VGAM RNA, also designated SEQ ID:5418.

Another function of VGAM2707 is therefore inhibition of LOC153914 (Accession XM_087799). Accordingly, utilities of VGAM2707 include diagnosis, prevention and treatment of diseases and clinical conditions associated with LOC153914. LOC253430 (Accession XM_171385) is another VGAM2707 host target gene. LOC253430 BINDING SITE is HOST TARGET binding site found in the 5' untranslated region of mRNA encoded by LOC253430, corresponding to a HOST TARGET binding site such as BINDING SITE I, BINDING SITE II or BINDING SITE III. Table 2 illustrates the complementarity of the nucleotide sequences of LOC253430 BINDING SITE, designated SEQ ID:46044, to the nucleotide sequence of VGAM2707 RNA, herein designated VGAM RNA, also designated SEQ ID:5418.

Another function of VGAM2707 is therefore inhibition of LOC253430 (Accession XM_171385). Accordingly, utilities of VGAM2707 include diagnosis, prevention and treatment of diseases and clinical conditions associated with LOC253430. LOC91496 (Accession XM_038788) is another VGAM2707 host target gene. LOC91496 BINDING SITE is HOST TARGET binding site found in the 5' untranslated region of mRNA encoded by LOC91496, corresponding to a HOST TARGET binding site such as BINDING SITE I, BINDING SITE II or BINDING SITE III. Table 2 illustrates the complementarity of the nucleotide sequences of LOC91496 BINDING SITE, designated SEQ ID:32921, to the nucleotide sequence of VGAM2707 RNA, herein designated VGAM RNA, also designated SEQ ID:5418.

Another function of VGAM2707 is therefore inhibition of LOC91496 (Accession XM_038788). Accordingly, utilities of VGAM2707 include diagnosis, prevention and treatment of diseases and clinical conditions associated with LOC91496. LOC92096 (Accession XM_042812) is another VGAM2707 host target gene. LOC92096 BINDING SITE is HOST TARGET binding site found in the 3' untranslated region of mRNA encoded by LOC92096, corresponding to a HOST TARGET binding site such as BINDING SITE I, BINDING SITE II or BINDING SITE III. Table 2 illustrates the complementarity of the nucleotide sequences of LOC92096 BINDING SITE, designated SEQ ID:33777, to the nucleotide sequence of VGAM2707 RNA, herein designated VGAM RNA, also designated SEQ ID:5418.

Another function of VGAM2707 is therefore inhibition of LOC92096 (Accession XM_042812). Accordingly, utilities of VGAM2707 include diagnosis, prevention and treatment of diseases and clinical conditions associated with LOC92096. FIG. 1 further provides a conceptual description of a novel bioinformatically detected viral gene of the present invention, referred to here as Viral Genomic Address Messenger 2708 (VGAM2708) viral gene, which modulates expression of respective host target genes thereof, the function and utility of which host target genes is known in the art.

VGAM2708 is a novel bioinformatically detected regulatory, non protein coding, viral micro RNA (miRNA) gene. The method by which VGAM2708 was detected is described hereinabove with reference to FIGS. 1-8.

VGAM2708 gene, herein designated VGAM GENE, is a viral gene contained in the genome of Heliothis Zea Virus 1 (HZV-1). VGAM2708 host target gene, herein designated VGAM HOST TARGET GENE, is a human gene contained in the human genome.

VGAM2708 gene encodes a VGAM2708 precursor RNA, herein designated VGAM PRECURSOR RNA. Similar to other miRNA genes, and unlike most ordinary genes, VGAM2708 precursor RNA does not encode a protein. A nucleotide sequence identical or highly similar to the nucleotide sequence of VGAM2708 precursor RNA is designated SEQ ID:2694, and is provided hereinbelow with reference to the sequence listing part. Nucleotide sequence SEQ ID:2694 is located at position 91200 relative to the genome of Heliothis Zea Virus 1 (HZV-1).

VGAM2708 precursor RNA folds onto itself, forming VGAM2708 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2708 folded precursor RNA into VGAM2708 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2708 RNA is designated SEQ ID:5419, and is provided hereinbelow with reference to the sequence listing part.

VGAM2708 host target gene, herein designated VGAM HOST TARGET GENE, encodes a corresponding messenger RNA, VGAM2708 host target RNA, herein designated VGAM HOST TARGET RNA. VGAM2708 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2708 RNA, herein designated VGAM RNA, binds complementarily to one or more host target binding sites located in untranslated regions of VGAM2708 host target RNA, herein designated VGAM HOST TARGET RNA. This complementary binding is due to the fact that the nucleotide sequence of VGAM2708 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2708 RNA, herein designated VGAM RNA, may have a different number of host target binding sites in untranslated regions of a VGAM2708 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2708 RNA, herein designated VGAM RNA, to host target binding sites on VGAM2708 host target RNA, herein designated VGAM HOST TARGET RNA, such as BINDING SITE I, BINDING SITE II and BINDING SITE III, inhibits translation of VGAM2708 host target RNA into VGAM2708 host target protein, herein designated VGAM HOST TARGET PROTEIN. VGAM host target protein is therefore outlined by a broken line.

It is appreciated that VGAM2708 host target gene, herein designated VGAM HOST TARGET GENE, in fact represents a plurality of VGAM2708 host target genes. The mRNA of each one of this plurality of VGAM2708 host target genes comprises one or more host target binding sites, each having a nucleotide sequence which is at least partly complementary to VGAM2708 RNA, herein designated VGAM RNA, and which when bound by VGAM2708 RNA causes inhibition of translation of respective one or more VGAM2708 host target proteins.

It is further appreciated by one skilled in the art that the mode of translational inhibition illustrated by FIG. 1 with specific reference to translational inhibition exerted by VGAM2708 gene, herein designated VGAM GENE, on one or more VGAM2708 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2708 is inhibition of expression of host target genes, as part of a novel viral mechanism of attacking a host. Accordingly, utilities of VGAM2708 include diagnosis, prevention and treatment of viral infection by Heliothis Zea Virus 1 (HZV-1). Specific functions, and accordingly utilities, of VGAM2708 correlate with, and may be deduced from, the identity of the host target genes which VGAM2708 binds and inhibits, and the function of these host target genes, as elaborated hereinbelow.

Nucleotide sequences of the VGAM2708 precursor RNA, herein designated VGAM PRECURSOR RNA, and of the 'diced' VGAM2708 RNA, herein designated VGAM RNA, and a schematic representation of the secondary folding of VGAM2708 folded precursor RNA, herein designated VGAM FOLDED PRECURSOR RNA, of VGAM2708 are further described hereinbelow with reference to Table 1.

Nucleotide sequences of host target binding sites, such as BINDING SITE-I, BINDING SITE-II and BINDING SITE-III of FIG. 1, found on VGAM2708 host target RNA, and schematic representation of the complementarity of each of these host target binding sites to VGAM2708 RNA, herein designated VGAM RNA, are described hereinbelow with reference to Table 2.

As mentioned hereinabove with reference to FIG. 1, a function of VGAM2708 gene, herein designated VGAM is inhibition of expression of VGAM2708 target genes. It is appreciated that specific functions, and accordingly utilities, of VGAM2708 correlate with, and may be deduced from, the identity of the target genes which VGAM2708 binds and inhibits, and the function of these target genes, as elaborated hereinbelow.

Radixin (RDX, Accession NM_002906) is a VGAM2708 host target gene. RDX BINDING SITE is HOST TARGET binding site found in the 3' untranslated region of mRNA encoded by RDX, corresponding to a HOST TARGET binding site such as BINDING SITE I, BINDING SITE II or BINDING SITE III. Table 2 illustrates the complementarity of the nucleotide sequences of RDX BINDING SITE, designated SEQ ID:8811, to the nucleotide sequence of VGAM2708 RNA, herein designated VGAM RNA, also designated SEQ ID:5419.

A function of VGAM2708 is therefore inhibition of Radixin (RDX, Accession NM_002906), a gene which plays a crucial role in the binding of the barbed end of actin filaments to the plasma membrane. Accordingly, utilities of VGAM2708 include diagnosis, prevention and treatment of diseases and clinical conditions associated with RDX. The function of RDX and its association with various diseases and clinical conditions, has been established by previous studies, as described hereinabove with reference to VGAM290. V-akt Murine Thymoma Viral Oncogene Homolog 3 (protein kinase B, gamma) (AKT3, Accession NM_005465) is another VGAM2708 host target gene. AKT3 BINDING SITE is HOST TARGET binding site found in the 3' untranslated region of mRNA encoded by AKT3, corresponding to a HOST TARGET binding site such as BINDING SITE I, BINDING SITE II or BINDING SITE III. Table 2 illustrates the complementarity of the nucleotide sequences of AKT3 BINDING SITE, designated SEQ ID:11959, to the nucleotide sequence of VGAM2708 RNA, herein designated VGAM RNA, also designated SEQ ID:5419.

Another function of VGAM2708 is therefore inhibition of V-akt Murine Thymoma Viral Oncogene Homolog 3 (protein kinase B, gamma) (AKT3, Accession NM_005465). Accordingly, utilities of VGAM2708 include diagnosis, prevention and treatment of diseases and clinical conditions associated with AKT3. KIAA1091 (Accession XM_045750) is another VGAM2708 host target gene. KIAA1091 BINDING SITE is HOST TARGET binding site found in the 3' untranslated region of mRNA encoded by KIAA1091, corresponding to a HOST TARGET binding site such as BINDING SITE I, BINDING SITE II or BINDING SITE III. Table 2 illustrates the complementarity of the nucleotide sequences of KIAA1091 BINDING SITE, designated SEQ ID:34540, to the nucleotide sequence of VGAM2708 RNA, herein designated VGAM RNA, also designated SEQ ID:5419.

Another function of VGAM2708 is therefore inhibition of KIAA1091 (Accession XM_045750). Accordingly, utilities of VGAM2708 include diagnosis, prevention and treatment of diseases and clinical conditions associated with KIAA1091. MO25 (Accession NM_016289) is another VGAM2708 host target gene. MO25 BINDING SITE is HOST TARGET binding site found in the 3' untranslated region of mRNA encoded by MO25, corresponding to a HOST TARGET binding site such as BINDING SITE I, BINDING SITE II or BINDING SITE III. Table 2 illustrates the complementarity of the nucleotide sequences of MO25 BINDING SITE, designated SEQ ID:18418, to the nucleotide sequence of VGAM2708 RNA, herein designated VGAM RNA, also designated SEQ ID:5419.

Another function of VGAM2708 is therefore inhibition of MO25 (Accession NM_016289). Accordingly, utilities of VGAM2708 include diagnosis, prevention and treatment of diseases and clinical conditions associated with MO25. LOC155061 (Accession XM_088139) is another VGAM2708 host target gene. LOC155061 BINDING SITE is HOST TARGET binding site found in the 3' untranslated region of mRNA encoded by LOC155061, corresponding to a HOST TARGET binding site such as BINDING SITE I, BINDING SITE II or BINDING SITE III. Table 2 illustrates the complementarity of the nucleotide sequences of LOC155061 BINDING SITE, designated SEQ ID:39538, to the nucleotide sequence of VGAM2708 RNA, herein designated VGAM RNA, also designated SEQ ID:5419.

Another function of VGAM2708 is therefore inhibition of LOC155061 (Accession XM_088139). Accordingly, utilities of VGAM2708 include diagnosis, prevention and treatment of diseases and clinical conditions associated with LOC155061. FIG. 1 further provides a conceptual description of a novel bioinformatically detected viral gene of the present invention, referred to here as Viral Genomic Address Messenger 2709 (VGAM2709) viral gene, which modulates expression of respective host target genes thereof, the function and utility of which host target genes is known in the art.

VGAM2709 is a novel bioinformatically detected regulatory, non protein coding, viral micro RNA (miRNA) gene. The method by which VGAM2709 was detected is described hereinabove with reference to FIGS. 1-8.

VGAM2709 gene, herein designated VGAM GENE, is a viral gene contained in the genome of Heliothis Zea Virus 1 (HZV-1). VGAM2709 host target gene, herein designated VGAM HOST TARGET GENE, is a human gene contained in the human genome.

VGAM2709 gene encodes a VGAM2709 precursor RNA, herein designated VGAM PRECURSOR RNA. Similar to other miRNA genes, and unlike most ordinary genes, VGAM2709 precursor RNA does not encode a protein. A nucleotide sequence identical or highly similar to the nucleotide sequence of VGAM2709 precursor RNA is designated SEQ ID:2695, and is provided hereinbelow with reference to the sequence listing part. Nucleotide sequence SEQ ID:2695 is located at position 89310 relative to the genome of Heliothis Zea Virus 1 (HZV-1).

VGAM2709 precursor RNA folds onto itself, forming VGAM2709 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2709 folded precursor RNA into VGAM2709 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2709 RNA is designated SEQ ID:5420, and is provided hereinbelow with reference to the sequence listing part.

VGAM2709 host target gene, herein designated VGAM HOST TARGET GENE, encodes a corresponding messenger RNA, VGAM2709 host target RNA, herein designated VGAM HOST TARGET RNA. VGAM2709 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2709 RNA, herein designated VGAM RNA, binds complementarily to one or more host target binding sites located in untranslated regions of VGAM2709 host target RNA, herein designated VGAM HOST TARGET RNA. This complementary binding is due to the fact that the nucleotide sequence of VGAM2709 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2709 RNA, herein designated VGAM RNA, may have a different number of host target binding sites in untranslated regions of a VGAM2709 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2709 RNA, herein designated VGAM RNA, to host target binding sites on VGAM2709 host target RNA, herein designated VGAM HOST TARGET RNA, such as BINDING SITE I, BINDING SITE II and BINDING SITE III, inhibits translation of VGAM2709 host target RNA into VGAM2709 host target protein, herein designated VGAM HOST TARGET PROTEIN. VGAM host target protein is therefore outlined by a broken line.

It is appreciated that VGAM2709 host target gene, herein designated VGAM HOST TARGET GENE, in fact represents a plurality of VGAM2709 host target genes. The mRNA of each one of this plurality of VGAM2709 host target genes comprises one or more host target binding sites, each having a nucleotide sequence which is at least partly complementary to VGAM2709 RNA, herein designated VGAM RNA, and which when bound by VGAM2709 RNA causes inhibition of translation of respective one or more VGAM2709 host target proteins.

It is further appreciated by one skilled in the art that the mode of translational inhibition illustrated by FIG. 1 with specific reference to translational inhibition exerted by VGAM2709 gene, herein designated VGAM GENE, on one or more VGAM2709 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2709 is inhibition of expression of host target genes, as part of a novel viral mechanism of attacking a host. Accordingly, utilities of VGAM2709 include diagnosis, prevention and treatment of viral infection by Heliothis Zea Virus 1 (HZV-1). Specific functions, and accordingly utilities, of VGAM2709 correlate with, and may be deduced from, the identity of the host target genes which VGAM2709 binds and inhibits, and the function of these host target genes, as elaborated hereinbelow.

Nucleotide sequences of the VGAM2709 precursor RNA, herein designated VGAM PRECURSOR RNA, and of the 'diced' VGAM2709 RNA, herein designated VGAM RNA, and a schematic representation of the secondary folding of VGAM2709 folded precursor RNA, herein designated VGAM FOLDED PRECURSOR RNA, of VGAM2709 are further described hereinbelow with reference to Table 1.

Nucleotide sequences of host target binding sites, such as BINDING SITE-I, BINDING SITE-II and BINDING SITE-III of FIG. 1, found on VGAM2709 host target RNA, and schematic representation of the complementarity of each of these host target binding sites to VGAM2709 RNA, herein designated VGAM RNA, are described hereinbelow with reference to Table 2.

As mentioned hereinabove with reference to FIG. 1, a function of VGAM2709 gene, herein designated VGAM is inhibition of expression of VGAM2709 target genes. It is appreciated that specific functions, and accordingly utilities, of VGAM2709 correlate with, and may be deduced from, the identity of the target genes which VGAM2709 binds and inhibits, and the function of these target genes, as elaborated hereinbelow.

TOX (Accession NM_014729) is a VGAM2709 host target gene. TOX BINDING SITE is HOST TARGET binding site found in the 3' untranslated region of mRNA encoded by TOX, corresponding to a HOST TARGET binding site such as BINDING SITE I, BINDING SITE II or BINDING SITE III. Table 2 illustrates the complementarity of the nucleotide sequences of TOX BINDING SITE, designated SEQ ID:16328, to the nucleotide sequence of VGAM2709 RNA, herein designated VGAM RNA, also designated SEQ ID:5420.

A function of VGAM2709 is therefore inhibition of TOX (Accession NM_014729). Accordingly, utilities of VGAM2709 include diagnosis, prevention and treatment of diseases and clinical conditions associated with TOX. FLJ14153 (Accession NM_022736) is another VGAM2709 host target gene. FLJ14153 BINDING SITE is HOST TARGET binding site found in the 3' untranslated region of mRNA encoded by FLJ14153, corresponding to a HOST TARGET binding site such as BINDING SITE I, BINDING SITE II or BINDING SITE III. Table 2 illustrates the complementarity of the nucleotide sequences of FLJ14153 BINDING SITE, designated SEQ ID:22941, to the nucleotide sequence of VGAM2709 RNA, herein designated VGAM RNA, also designated SEQ ID:5420.

Another function of VGAM2709 is therefore inhibition of FLJ14153 (Accession NM_022736). Accordingly, utilities of VGAM2709 include diagnosis, prevention and treatment of diseases and clinical conditions associated with FLJ14153. FIG. 1 further provides a conceptual description of a novel bioinformatically detected viral gene of the present invention, referred to here as Viral Genomic Address Messenger 2710 (VGAM2710) viral gene, which modulates expression of respective host target genes thereof, the function and utility of which host target genes is known in the art.

VGAM2710 is a novel bioinformatically detected regulatory, non protein coding, viral micro RNA (miRNA) gene. The method by which VGAM2710 was detected is described hereinabove with reference to FIGS. 1-8.

VGAM2710 gene, herein designated VGAM GENE, is a viral gene contained in the genome of Heliothis Zea Virus 1 (HZV-1). VGAM2710 host target gene, herein designated VGAM HOST TARGET GENE, is a human gene contained in the human genome.

VGAM2710 gene encodes a VGAM2710 precursor RNA, herein designated VGAM PRECURSOR RNA. Similar to other miRNA genes, and unlike most ordinary genes, VGAM2710 precursor RNA does not encode a protein. A nucleotide sequence identical or highly similar to the nucleotide sequence of VGAM2710 precursor RNA is designated SEQ ID:2696, and is provided hereinbelow with reference to the sequence listing part. Nucleotide sequence SEQ ID:2696 is located at position 224367 relative to the genome of Heliothis Zea Virus 1 (HZV-1).

VGAM2710 precursor RNA folds onto itself, forming VGAM2710 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2710 folded precursor RNA into VGAM2710 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 74%) nucleotide sequence of VGAM2710 RNA is designated SEQ ID:5421, and is provided hereinbelow with reference to the sequence listing part.

VGAM2710 host target gene, herein designated VGAM HOST TARGET GENE, encodes a corresponding messenger RNA, VGAM2710 host target RNA, herein designated VGAM HOST TARGET RNA. VGAM2710 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2710 RNA, herein designated VGAM RNA, binds complementarily to one or more host target binding sites located in untranslated regions of VGAM2710 host target RNA, herein designated VGAM HOST TARGET RNA. This complementary binding is due to the fact that the nucleotide sequence of VGAM2710 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2710 RNA, herein designated VGAM RNA, may have a different number of host target binding sites in untranslated regions of a VGAM2710 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2710 RNA, herein designated VGAM RNA, to host target binding sites on VGAM2710 host target RNA, herein designated VGAM HOST TARGET RNA, such as BINDING SITE I, BINDING SITE II and BINDING SITE III, inhibits translation of VGAM2710 host target RNA into VGAM2710 host target protein, herein designated VGAM HOST TARGET PROTEIN. VGAM host target protein is therefore outlined by a broken line.

It is appreciated that VGAM2710 host target gene, herein designated VGAM HOST TARGET GENE, in fact represents a plurality of VGAM2710 host target genes. The mRNA of each one of this plurality of VGAM2710 host target genes comprises one or more host target binding sites, each having a nucleotide sequence which is at least partly complementary to VGAM2710 RNA, herein designated VGAM RNA, and which when bound by VGAM2710 RNA causes inhibition of translation of respective one or more VGAM2710 host target proteins.

It is further appreciated by one skilled in the art that the mode of translational inhibition illustrated by FIG. 1 with specific reference to translational inhibition exerted by VGAM2710 gene, herein designated VGAM GENE, on one or more VGAM2710 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2710 is inhibition of expression of host target genes, as part of a novel viral mechanism of attacking a host. Accordingly, utilities of VGAM2710 include diagnosis, prevention and treatment of viral infection by Heliothis Zea Virus 1 (HZV-1). Specific functions, and accordingly utilities, of VGAM2710 correlate with, and may be deduced from, the identity of the host target genes which VGAM2710 binds and inhibits, and the function of these host target genes, as elaborated hereinbelow.

Nucleotide sequences of the VGAM2710 precursor RNA, herein designated VGAM PRECURSOR RNA, and of the 'diced' VGAM2710 RNA, herein designated VGAM RNA, and a schematic representation of the secondary folding of VGAM2710 folded precursor RNA, herein designated VGAM FOLDED PRECURSOR RNA, of VGAM2710 are further described hereinbelow with reference to Table 1.

Nucleotide sequences of host target binding sites, such as BINDING SITE-I, BINDING SITE-II and BINDING SITE-III of FIG. 1, found on VGAM2710 host target RNA, and schematic representation of the complementarity of each of these host target binding sites to VGAM2710 RNA, herein designated VGAM RNA, are described hereinbelow with reference to Table 2.

As mentioned hereinabove with reference to FIG. 1, a function of VGAM2710 gene, herein designated VGAM is inhibition of expression of VGAM2710 target genes. It is appreciated that specific functions, and accordingly utilities, of VGAM2710 correlate with, and may be deduced from, the identity of the target genes which VGAM2710 binds and inhibits, and the function of these target genes, as elaborated hereinbelow.

Nijmegen Breakage Syndrome 1 (nibrin) (NBS1, Accession XM_045343) is a VGAM2710 host target gene. NBS1 BINDING SITE is HOST TARGET binding site found in the 3' untranslated region of mRNA encoded by NBS1, corresponding to a HOST TARGET binding site such as BINDING SITE I, BINDING SITE II or BINDING SITE III. Table 2 illustrates the complementarity of the nucleotide sequences of NBS1 BINDING SITE, designated SEQ ID:34434, to the nucleotide sequence of VGAM2710 RNA, herein designated VGAM RNA, also designated SEQ ID:5421.

A function of VGAM2710 is therefore inhibition of Nijmegen Breakage Syndrome 1 (nibrin) (NBS1, Accession XM_045343), a gene which may be involved in repair of DNA double-strand breaks. Accordingly, utilities of VGAM2710 include diagnosis, prevention and treatment of diseases and clinical conditions associated with NBS1. The function of NBS1 and its association with various diseases and clinical conditions, has been established by previous studies, as described hereinabove with reference to VGAM450. FLJ20127 (Accession NM_017678) is another VGAM2710 host target gene. FLJ20127 BINDING SITE is HOST TARGET binding site found in the 3' untranslated region of mRNA encoded by FLJ20127, corresponding to a HOST TARGET binding site such as BINDING SITE I, BINDING SITE II or BINDING SITE III. Table 2 illustrates the complementarity of the nucleotide sequences of FLJ20127 BINDING SITE, designated SEQ ID:19220, to the nucleotide sequence of VGAM2710 RNA, herein designated VGAM RNA, also designated SEQ ID:5421.

Another function of VGAM2710 is therefore inhibition of FLJ20127 (Accession NM_017678). Accordingly, utilities of VGAM2710 include diagnosis, prevention and treatment of diseases and clinical conditions associated with FLJ20127. LOC150503 (Accession XM_086933) is another VGAM2710 host target gene. LOC150503 BINDING SITE is HOST TARGET binding site found in the 5' untranslated region of mRNA encoded by LOC150503, corresponding to a HOST TARGET binding site such as BINDING SITE I, BINDING SITE II or BINDING SITE III. Table 2 illustrates the complementarity of the nucleotide sequences of LOC150503 BINDING SITE, designated SEQ ID:38985, to the nucleotide sequence of VGAM2710 RNA, herein designated VGAM RNA, also designated SEQ ID:5421.

Another function of VGAM2710 is therefore inhibition of LOC150503 (Accession XM_086933). Accordingly, utilities of VGAM2710 include diagnosis, prevention and treatment of diseases and clinical conditions associated with LOC150503. LOC150504 (Accession XM_001732) is another VGAM2710 host target gene. LOC150504 BINDING SITE is HOST TARGET binding site found in the 5' untranslated region of mRNA encoded by LOC150504, corresponding to a HOST TARGET binding site such as BINDING SITE I, BINDING SITE II or BINDING SITE III. Table 2 illustrates the complementarity of the nucleotide sequences of LOC150504 BINDING SITE, designated SEQ ID:29850, to the nucleotide sequence of VGAM2710 RNA, herein designated VGAM RNA, also designated SEQ ID:5421.

Another function of VGAM2710 is therefore inhibition of LOC150504 (Accession XM_001732). Accordingly, utilities of VGAM2710 include diagnosis, prevention and treatment of diseases and clinical conditions associated with LOC150504. LOC221410 (Accession XM_166373) is another VGAM2710 host target gene. LOC221410 BINDING SITE is HOST TARGET binding site found in the 3' untranslated region of mRNA encoded by LOC221410, corresponding to a HOST TARGET binding site such as BINDING SITE I, BINDING SITE II or BINDING SITE III. Table 2 illustrates the complementarity of the nucleotide sequences of LOC221410 BINDING SITE, designated SEQ ID:44194, to the nucleotide sequence of VGAM2710 RNA, herein designated VGAM RNA, also designated SEQ ID:5421.

Another function of VGAM2710 is therefore inhibition of LOC221410 (Accession XM_166373). Accordingly, utilities of VGAM2710 include diagnosis, prevention and treatment of diseases and clinical conditions associated with LOC221410. LOC90408 (Accession XM_031517) is another VGAM2710 host target gene. LOC90408 BINDING SITE is HOST TARGET binding site found in the 5' untranslated region of mRNA encoded by LOC90408, corresponding to a HOST TARGET binding site such as BINDING SITE I, BINDING SITE II or BINDING SITE III. Table 2 illustrates the complementarity of the nucleotide sequences of LOC90408 BINDING SITE, designated SEQ ID:31397, to the nucleotide sequence of VGAM2710 RNA, herein designated VGAM RNA, also designated SEQ ID:5421.

Another function of VGAM2710 is therefore inhibition of LOC90408 (Accession XM_031517). Accordingly, utilities of VGAM2710 include diagnosis, prevention and treatment of diseases and clinical conditions associated with LOC90408. FIG. 1 further provides a conceptual description of a novel bioinformatically detected viral gene of the present invention, referred to here as Viral Genomic Address Messenger 2711 (VGAM2711) viral gene, which modulates expression of respective host target genes thereof, the function and utility of which host target genes is known in the art.

VGAM2711 is a novel bioinformatically detected regulatory, non protein coding, viral micro RNA (miRNA) gene. The method by which VGAM2711 was detected is described hereinabove with reference to FIGS. 1-8.

VGAM2711 gene, herein designated VGAM GENE, is a viral gene contained in the genome of Chikungunya Virus. VGAM2711 host target gene, herein designated VGAM HOST TARGET GENE, is a human gene contained in the human genome.

VGAM2711 gene encodes a VGAM2711 precursor RNA, herein designated VGAM PRECURSOR RNA. Similar to other miRNA genes, and unlike most ordinary genes, VGAM2711 precursor RNA does not encode a protein. A nucleotide sequence identical or highly similar to the nucleotide sequence of VGAM2711 precursor RNA is designated SEQ ID:2697, and is provided hereinbelow with reference to the sequence listing part. Nucleotide sequence SEQ ID:2697 is located at position 7022 relative to the genome of Chikungunya Virus.

VGAM2711 precursor RNA folds onto itself, forming VGAM2711 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2711 folded precursor RNA into VGAM2711 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2711 RNA is designated SEQ ID:5422, and is provided hereinbelow with reference to the sequence listing part.

VGAM2711 host target gene, herein designated VGAM HOST TARGET GENE, encodes a corresponding messenger RNA, VGAM2711 host target RNA, herein designated VGAM HOST TARGET RNA. VGAM2711 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2711 RNA, herein designated VGAM RNA, binds complementarily to one or more host target binding sites located in untranslated regions of VGAM2711 host target RNA, herein designated VGAM HOST TARGET RNA. This complementary binding is due to the fact that the nucleotide sequence of VGAM2711 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2711 RNA, herein designated VGAM RNA, may have a different number of host target binding sites in untranslated regions of a VGAM2711 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2711 RNA, herein designated VGAM RNA, to host target binding sites on VGAM2711 host target RNA, herein designated VGAM HOST TARGET RNA, such as BINDING SITE I, BINDING SITE II and BINDING SITE III, inhibits translation of VGAM2711 host target RNA into VGAM2711 host target protein, herein designated VGAM HOST TARGET PROTEIN. VGAM host target protein is therefore outlined by a broken line.

It is appreciated that VGAM2711 host target gene, herein designated VGAM HOST TARGET GENE, in fact represents a plurality of VGAM2711 host target genes. The mRNA of each one of this plurality of VGAM2711 host target genes comprises one or more host target binding sites, each having a nucleotide sequence which is at least partly complementary to VGAM2711 RNA, herein designated VGAM RNA, and which when bound by VGAM2711 RNA causes inhibition of translation of respective one or more VGAM2711 host target proteins.

It is further appreciated by one skilled in the art that the mode of translational inhibition illustrated by FIG. 1 with specific reference to translational inhibition exerted by VGAM2711 gene, herein designated VGAM GENE, on one or more VGAM2711 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2711 is inhibition of expression of host target genes, as part of a novel viral mechanism of attacking a host. Accordingly, utilities of VGAM2711 include diagnosis, prevention and treatment of viral infection by Chikungunya Virus. Specific functions, and accordingly utilities, of VGAM2711 correlate with, and may be deduced from, the identity of the host target genes which VGAM2711 binds and inhibits, and the function of these host target genes, as elaborated hereinbelow.

Nucleotide sequences of the VGAM2711 precursor RNA, herein designated VGAM PRECURSOR RNA, and of the 'diced' VGAM2711 RNA, herein designated VGAM RNA, and a schematic representation of the secondary folding of VGAM2711 folded precursor RNA, herein designated VGAM FOLDED PRECURSOR RNA, of VGAM2711 are further described hereinbelow with reference to Table 1.

Nucleotide sequences of host target binding sites, such as BINDING SITE-I, BINDING SITE-II and BINDING SITE-III of FIG. 1, found on VGAM2711 host target RNA, and schematic representation of the complementarity of each of these host target binding sites to VGAM2711 RNA, herein designated VGAM RNA, are described hereinbelow with reference to Table 2.

As mentioned hereinabove with reference to FIG. 1, a function of VGAM2711 gene, herein designated VGAM is inhibition of expression of VGAM2711 target genes. It is appreciated that specific functions, and accordingly utilities, of VGAM2711 correlate with, and may be deduced from, the identity of the target genes which VGAM2711 binds and inhibits, and the function of these target genes, as elaborated hereinbelow.

V-ets Erythroblastosis Virus E26 Oncogene Homolog 2 (avian) (ETS2, Accession NM_005239) is a VGAM2711 host target gene. ETS2 BINDING SITE is HOST TARGET binding site found in the 3' untranslated region of mRNA encoded by ETS2, corresponding to a HOST TARGET binding site such as BINDING SITE I, BINDING SITE II or BINDING SITE III. Table 2 illustrates the complementarity of the nucleotide sequences of ETS2 BINDING SITE, designated SEQ ID:11749, to the nucleotide sequence of VGAM2711 RNA, herein designated VGAM RNA, also designated SEQ ID:5422.

A function of VGAM2711 is therefore inhibition of V-ets Erythroblastosis Virus E26 Oncogene Homolog 2 (avian) (ETS2, Accession NM_005239), a gene which Transcription factor. Accordingly, utilities of VGAM2711 include diagnosis, prevention and treatment of diseases and clinical conditions associated with ETS2. The function of ETS2 and its association with various diseases and clinical conditions, has been established by previous studies, as described hereinabove with reference to VGAM1958. Mannan-binding Lectin Serine Protease 1 (C4/C2 activating component of Ra-reactive factor) (MASP1, Accession NM_139125) is another VGAM2711 host target gene. MASP1 BINDING SITE is HOST TARGET binding site found in the 3' untranslated region of mRNA encoded by MASP1, corresponding to a HOST TARGET binding site such as BINDING SITE I, BINDING SITE II or BINDING SITE III. Table 2 illustrates the complementarity of the nucleotide sequences of MASP1 BINDING SITE, designated SEQ ID:29159, to the nucleotide sequence of VGAM2711 RNA, herein designated VGAM RNA, also designated SEQ ID:5422.

Another function of VGAM2711 is therefore inhibition of Mannan-binding Lectin Serine Protease 1 (C4/C2 activating component of Ra-reactive factor) (MASP1, Accession NM_139125), a gene which a complement-dependent bactericidal factor. Accordingly, utilities of VGAM2711 include diagnosis, prevention and treatment of diseases and clinical conditions associated with MASP1. The function of MASP1 and its association with various diseases and clinical conditions, has been established by previous studies, as described hereinabove with reference to VGAM566. Translocase of Inner Mitochondrial Membrane 23 Homolog (yeast) (TIMM23, Accession XM_011891) is another VGAM2711 host target gene. TIMM23 BINDING SITE is HOST TARGET binding site found in the 3' untranslated region of mRNA encoded by TIMM23, corresponding to a HOST TARGET binding site such as BINDING SITE I, BINDING SITE II or BINDING SITE III. Table 2 illustrates the complementarity of the nucleotide sequences of TIMM23 BINDING SITE, designated SEQ ID:30199, to the nucleotide sequence of VGAM2711 RNA, herein designated VGAM RNA, also designated SEQ ID:5422.

Another function of VGAM2711 is therefore inhibition of Translocase of Inner Mitochondrial Membrane 23 Homolog (yeast) (TIMM23, Accession XM_011891), a gene which translocates nuclear-encoded proteins into the mitochondrion. Accordingly, utilities of VGAM2711 include diagnosis, prevention and treatment of diseases and clinical conditions associated with TIMM23. The function of TIMM23 and its association with various diseases and clinical conditions, has been established by previous studies, as described hereinabove with reference to VGAM1958. Angiomotin (AMOT, Accession NM_133265) is another VGAM2711 host target gene. AMOT BINDING SITE is HOST TARGET binding site found in the 3' untranslated region of mRNA encoded by AMOT, corresponding to a HOST TARGET binding site such as BINDING SITE I, BINDING SITE II or BINDING SITE III. Table 2 illustrates the complementarity of the nucleotide sequences of AMOT BINDING SITE, designated SEQ ID:28412, to the nucleotide sequence of VGAM2711 RNA, herein designated VGAM RNA, also designated SEQ ID:5422.

Another function of VGAM2711 is therefore inhibition of Angiomotin (AMOT, Accession NM_133265). Accordingly, utilities of VGAM2711 include diagnosis, prevention and treatment of diseases and clinical conditions associated with AMOT. Centaurin, Alpha 2 (CENTA2, Accession NM_018404) is another VGAM2711 host target gene. CENTA2 BINDING SITE is HOST TARGET binding site found in the 3' untranslated region of mRNA encoded by CENTA2, corresponding to a HOST TARGET binding site such as BINDING SITE I, BINDING SITE II or BINDING SITE III. Table 2 illustrates the complementarity of the nucleotide sequences of CENTA2 BINDING SITE, designated SEQ ID:20442, to the nucleotide sequence of VGAM2711 RNA, herein designated VGAM RNA, also designated SEQ ID:5422.

Another function of VGAM2711 is therefore inhibition of Centaurin, Alpha 2 (CENTA2, Accession NM_018404). Accordingly, utilities of VGAM2711 include diagnosis, prevention and treatment of diseases and clinical conditions associated with CENTA2. DKFZP434O047 (Accession NM_015594) is another VGAM2711 host target gene. DKFZP434O047 BINDING SITE is HOST TARGET binding site found in the 5' untranslated region of mRNA encoded by DKFZP434O047, corresponding to a HOST TARGET binding site such as BINDING SITE I, BINDING SITE II or BINDING SITE III. Table 2 illustrates the complementarity of the nucleotide sequences of DKFZP434O047 BINDING SITE, designated SEQ ID:17864, to the nucleotide sequence of VGAM2711 RNA, herein designated VGAM RNA, also designated SEQ ID:5422.

Another function of VGAM2711 is therefore inhibition of DKFZP434O047 (Accession NM_015594). Accordingly, utilities of VGAM2711 include diagnosis, prevention and treatment of diseases and clinical conditions associated with DKFZP434O047. FLJ11078 (Accession NM_018316) is another VGAM2711 host target gene. FLJ11078 BINDING SITE is HOST TARGET binding site found in the 3' untranslated region of mRNA encoded by FLJ11078, corresponding to a HOST TARGET binding site such as BINDING SITE I, BINDING SITE II or BINDING SITE III. Table 2 illustrates the complementarity of the nucleotide sequences of FLJ11078 BINDING SITE, designated SEQ ID:20309, to the nucleotide sequence of VGAM2711 RNA, herein designated VGAM RNA, also designated SEQ ID:5422.

Another function of VGAM2711 is therefore inhibition of FLJ11078 (Accession NM_018316). Accordingly, utilities of VGAM2711 include diagnosis, prevention and treatment of diseases and clinical conditions associated with FLJ11078. FLJ11274 (Accession NM_018375) is another VGAM2711 host target gene. FLJ11274 BINDING SITE is HOST TARGET binding site found in the 3' untranslated region of mRNA encoded by FLJ11274, corresponding to a HOST TARGET binding site such as BINDING SITE I, BINDING SITE II or BINDING SITE III. Table 2 illustrates the complementarity of the nucleotide sequences of FLJ11274 BINDING SITE, designated SEQ ID:20401, to the nucleotide sequence of VGAM2711 RNA, herein designated VGAM RNA, also designated SEQ ID:5422.

Another function of VGAM2711 is therefore inhibition of FLJ11274 (Accession NM_018375). Accordingly, utilities of VGAM2711 include diagnosis, prevention and treatment of diseases and clinical conditions associated with FLJ11274. FLJ21603 (Accession NM_024762) is another VGAM2711 host target gene. FLJ21603 BINDING SITE is HOST TARGET binding site found in the 3' untranslated region of mRNA encoded by FLJ21603, corresponding to a HOST TARGET binding site such as BINDING SITE I, BINDING SITE II or BINDING SITE III. Table 2 illustrates the complementarity of the nucleotide sequences of FLJ21603 BINDING SITE, designated SEQ ID:24119, to the nucleotide sequence of VGAM2711 RNA, herein designated VGAM RNA, also designated SEQ ID:5422.

Another function of VGAM2711 is therefore inhibition of FLJ21603 (Accession NM_024762). Accordingly, utilities of VGAM2711 include diagnosis, prevention and treatment of diseases and clinical conditions associated with FLJ21603. KIAA1077 (Accession XM_053496) is another VGAM2711 host target gene. KIAA1077 BINDING SITE is HOST TARGET binding site found in the 5' untranslated region of mRNA encoded by KIAA1077, corresponding to a HOST TARGET binding site such as BINDING SITE I, BINDING SITE II or BINDING SITE III. Table 2 illustrates the complementarity of the nucleotide sequences of KIAA1077 BINDING SITE, designated SEQ ID:36096, to the nucleotide sequence of VGAM2711 RNA, herein designated VGAM RNA, also designated SEQ ID:5422.

Another function of VGAM2711 is therefore inhibition of KIAA1077 (Accession XM_053496). Accordingly, utilities of VGAM2711 include diagnosis, prevention and treatment of diseases and clinical conditions associated with KIAA1077. LOC150150 (Accession XM_097820) is another VGAM2711 host target gene. LOC150150 BINDING SITE is HOST TARGET binding site found in the 5' untranslated region of mRNA encoded by LOC150150, corresponding to a HOST TARGET binding site such as BINDING SITE I, BINDING SITE II or BINDING SITE III. Table 2 illustrates the complementarity of the nucleotide sequences of LOC150150 BINDING SITE, designated SEQ ID:41138, to the nucleotide sequence of VGAM2711 RNA, herein designated VGAM RNA, also designated SEQ ID:5422.

Another function of VGAM2711 is therefore inhibition of LOC150150 (Accession XM_097820). Accordingly, utilities of VGAM2711 include diagnosis, prevention and treatment of diseases and clinical conditions associated with LOC150150. LOC254381 (Accession XM_173436) is another VGAM2711 host target gene. LOC254381 BINDING SITE is HOST TARGET binding site found in the 5' untranslated region of mRNA encoded by LOC254381, corresponding to a HOST TARGET binding site such as BINDING SITE I, BINDING SITE II or BINDING SITE III. Table 2 illustrates the complementarity of the nucleotide sequences of LOC254381 BINDING SITE, designated SEQ ID:46544, to the nucleotide sequence of VGAM2711 RNA, herein designated VGAM RNA, also designated SEQ ID:5422.

Another function of VGAM2711 is therefore inhibition of LOC254381 (Accession XM_173436). Accordingly, utilities of VGAM2711 include diagnosis, prevention and treatment of diseases and clinical conditions associated with LOC254381. FIG. 1 further provides a conceptual description of a novel bioinformatically detected viral gene of the present invention, referred to here as Viral Genomic Address Messenger 2712 (VGAM2712) viral gene, which modulates expression of respective host target genes thereof, the function and utility of which host target genes is known in the art.

VGAM2712 is a novel bioinformatically detected regulatory, non protein coding, viral micro RNA (miRNA) gene. The method by which VGAM2712 was detected is described hereinabove with reference to FIGS. 1-8.

VGAM2712 gene, herein designated VGAM GENE, is a viral gene contained in the genome of Chikungunya Virus. VGAM2712 host target gene, herein designated VGAM HOST TARGET GENE, is a human gene contained in the human genome.

VGAM2712 gene encodes a VGAM2712 precursor RNA, herein designated VGAM PRECURSOR RNA. Similar to other miRNA genes, and unlike most ordinary genes, VGAM2712 precursor RNA does not encode a protein. A nucleotide sequence identical or highly similar to the nucleotide sequence of VGAM2712 precursor RNA is designated SEQ ID:2698, and is provided hereinbelow with reference to the sequence listing part. Nucleotide sequence SEQ ID:2698 is located at position 2249 relative to the genome of Chikungunya Virus.

VGAM2712 precursor RNA folds onto itself, forming VGAM2712 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2712 folded precursor RNA into VGAM2712 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 73%) nucleotide sequence of VGAM2712 RNA is designated SEQ ID:5423, and is provided hereinbelow with reference to the sequence listing part.

VGAM2712 host target gene, herein designated VGAM HOST TARGET GENE, encodes a corresponding messenger RNA, VGAM2712 host target RNA, herein designated VGAM HOST TARGET RNA. VGAM2712 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2712 RNA, herein designated VGAM RNA, binds complementarily to one or more host target binding sites located in untranslated regions of VGAM2712 host target RNA, herein designated VGAM HOST TARGET RNA. This complementary binding is due to the fact that the nucleotide sequence of VGAM2712 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2712 RNA, herein designated VGAM RNA, may have a different number of host target binding sites in untranslated regions of a VGAM2712 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2712 RNA, herein designated VGAM RNA, to host target binding sites on VGAM2712 host target RNA, herein designated VGAM HOST TARGET RNA, such as BINDING SITE I, BINDING SITE II and BINDING SITE III, inhibits translation of VGAM2712 host target RNA into VGAM2712 host target protein, herein designated VGAM HOST TARGET PROTEIN. VGAM host target protein is therefore outlined by a broken line.

It is appreciated that VGAM2712 host target gene, herein designated VGAM HOST TARGET GENE, in fact represents a plurality of VGAM2712 host target genes. The mRNA of each one of this plurality of VGAM2712 host target genes comprises one or more host target binding sites, each having a nucleotide sequence which is at least partly complementary to VGAM2712 RNA, herein designated VGAM RNA, and which when bound by VGAM2712 RNA causes inhibition of translation of respective one or more VGAM2712 host target proteins.

It is further appreciated by one skilled in the art that the mode of translational inhibition illustrated by FIG. 1 with specific reference to translational inhibition exerted by VGAM2712 gene, herein designated VGAM GENE, on one or more VGAM2712 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2712 is inhibition of expression of host target genes, as part of a novel viral mechanism of attacking a host. Accordingly, utilities of VGAM2712 include diagnosis, prevention and treatment of viral infection by Chikungunya Virus. Specific functions, and accordingly utilities, of VGAM2712 correlate with, and may be deduced from, the identity of the host target genes which VGAM2712 binds and inhibits, and the function of these host target genes, as elaborated hereinbelow.

Nucleotide sequences of the VGAM2712 precursor RNA, herein designated VGAM PRECURSOR RNA, and of the 'diced' VGAM2712 RNA, herein designated VGAM RNA, and a schematic representation of the secondary folding of VGAM2712 folded precursor RNA, herein designated VGAM FOLDED PRECURSOR RNA, of VGAM2712 are further described hereinbelow with reference to Table 1.

Nucleotide sequences of host target binding sites, such as BINDING SITE-I, BINDING SITE-II and BINDING SITE-III of FIG. 1, found on VGAM2712 host target RNA, and schematic representation of the complementarity of each of these host target binding sites to VGAM2712 RNA, herein designated VGAM RNA, are described hereinbelow with reference to Table 2.

As mentioned hereinabove with reference to FIG. 1, a function of VGAM2712 gene, herein designated VGAM is inhibition of expression of VGAM2712 target genes. It is appreciated that specific functions, and accordingly utilities, of VGAM2712 correlate with, and may be deduced from, the identity of the target genes which VGAM2712 binds and inhibits, and the function of these target genes, as elaborated hereinbelow.

Branched Chain Aminotransferase 1, Cytosolic (BCAT1, Accession XM_038659) is a VGAM2712 host target gene. BCAT1 BINDING SITE is HOST TARGET binding site found in the 3' untranslated region of mRNA encoded by BCAT1, corresponding to a HOST TARGET binding site such as BINDING SITE I, BINDING SITE II or BINDING SITE III. Table 2 illustrates the complementarity of the nucleotide sequences of BCAT1 BINDING SITE, designated SEQ ID:32898, to the nucleotide sequence of VGAM2712 RNA, herein designated VGAM RNA, also designated SEQ ID:5423.

A function of VGAM2712 is therefore inhibition of Branched Chain Aminotransferase 1, Cytosolic (BCAT1, Accession XM_038659), a gene which catalyzes of the essential branched chain leucine, isoleucine, and valine. Accordingly, utilities of VGAM2712 include diagnosis, prevention and treatment of diseases and clinical conditions associated with BCAT1. The function of BCAT1 and its association with various diseases and clinical conditions, has been established by previous studies, as described hereinabove with reference to VGAM1367. Development and Differentiation Enhancing Factor 1 (DDEF1, Accession XM_005169) is another VGAM2712 host target gene. DDEF1 BINDING SITE is HOST TARGET binding site found in the 3' untranslated region of mRNA encoded by DDEF1, corresponding to a HOST TARGET binding site such as BINDING SITE I, BINDING SITE II or BINDING SITE III. Table 2 illustrates the complementarity of the nucleotide sequences of DDEF1 BINDING SITE, designated SEQ ID:29962, to the nucleotide sequence of VGAM2712 RNA, herein designated VGAM RNA, also designated SEQ ID:5423.

Another function of VGAM2712 is therefore inhibition of Development and Differentiation Enhancing Factor 1 (DDEF1, Accession XM_005169). Accordingly, utilities of VGAM2712 include diagnosis, prevention and treatment of diseases and clinical conditions associated with DDEF1. Holocarboxylase Synthetase (biotin-[proprionyl-Coenzyme A-carboxylase (ATP-hydrolysing)] Ligase) (HLCS, Accession NM_000411) is another VGAM2712 host target gene. HLCS BINDING SITE is HOST TARGET binding site found in the 3' untranslated region of mRNA encoded by HLCS, corresponding to a HOST TARGET binding site such as BINDING SITE I, BINDING SITE II or BINDING SITE III. Table 2 illustrates the complementarity of the nucleotide sequences of HLCS BINDING SITE, designated SEQ ID:5989, to the nucleotide sequence of VGAM2712 RNA, herein designated VGAM RNA, also designated SEQ ID:5423.

Another function of VGAM2712 is therefore inhibition of Holocarboxylase Synthetase (biotin-[proprionyl-Coenzyme A-carboxylase (ATP-hydrolysing)] Ligase) (HLCS, Accession NM_000411). Accordingly, utilities of VGAM2712 include diagnosis, prevention and treatment of diseases and clinical conditions associated with HLCS. Phosphodiesterase 4B, CAMP-specific (phosphodiesterase E4 dunce homolog, Drosophila) (PDE4B, Accession NM_002600) is another VGAM2712 host target gene. PDE4B BINDING SITE is HOST TARGET binding site found in the 3' untranslated region of mRNA encoded by PDE4B, corresponding to a HOST TARGET binding site such as BINDING SITE I, BINDING SITE II or BINDING SITE III. Table 2 illustrates the complementarity of the nucleotide sequences of PDE4B BINDING SITE, designated SEQ ID:8465, to the nucleotide sequence of VGAM2712 RNA, herein designated VGAM RNA, also designated SEQ ID:5423.

Another function of VGAM2712 is therefore inhibition of Phosphodiesterase 4B, CAMP-specific (phosphodiesterase E4 dunce homolog, Drosophila) (PDE4B, Accession NM_002600), a gene which may be involved in mediating central nervous system effects of therapeutic agents ranging from antidepressants to antiasthmatic and anti-inflammatory agents. Accordingly, utilities of VGAM2712 include diagnosis, prevention and treatment of diseases and clinical conditions associated with PDE4B. The function of PDE4B and its association with various diseases and clinical conditions, has been established by previous studies, as described hereinabove with reference to VGAM51. SH3-domain GRB2-like 2 (SH3GL2, Accession NM_003026) is another VGAM2712 host target gene. SH3GL2 BINDING SITE is HOST TARGET binding site found in the 3' untranslated region of mRNA encoded by SH3GL2, corresponding to a HOST TARGET binding site such as BINDING SITE I, BINDING SITE II or BINDING SITE III. Table 2 illustrates the complementarity of the nucleotide sequences of SH3GL2 BINDING SITE, designated SEQ ID:8965, to the nucleotide sequence of VGAM2712 RNA, herein designated VGAM RNA, also designated SEQ ID:5423.

Another function of VGAM2712 is therefore inhibition of SH3-domain GRB2-like 2 (SH3GL2, Accession NM_003026), a gene which plays a role in synaptic vesicle recycling, in particular in clathrin-mediated vesicle endocytosis. Accordingly, utilities of VGAM2712 include diagnosis, prevention and treatment of diseases and clinical conditions associated with SH3GL2. The function of SH3GL2 and its association with various diseases and clinical conditions, has been established by previous studies, as described hereinabove with reference to VGAM982. Sarcospan (Kras oncogene-associated gene) (SSPN, Accession NM_005086) is another VGAM2712 host target gene. SSPN BINDING SITE is HOST TARGET binding site found in the 3' untranslated region of mRNA encoded by SSPN, corresponding to a HOST TARGET binding site such as BINDING SITE I, BINDING SITE II or BINDING SITE III. Table 2 illustrates the complementarity of the nucleotide sequences of SSPN BINDING SITE, designated SEQ ID:11538, to the nucleotide sequence of VGAM2712 RNA, herein designated VGAM RNA, also designated SEQ ID:5423.

Another function of VGAM2712 is therefore inhibition of Sarcospan (Kras oncogene-associated gene) (SSPN, Accession NM_005086), a gene which spans the muscle plasma membrane and forms a link between the f-actin cytoskeleton and the extracellular matrix. Accordingly, utilities of VGAM2712 include diagnosis, prevention and treatment of diseases and clinical conditions associated with SSPN. The function of SSPN and its association with various diseases and clinical conditions, has been established by previous studies, as described hereinabove with reference to VGAM996. Transforming, Acidic Coiled-coil Containing Protein 1 (TACC1, Accession NM_006283) is another VGAM2712 host target gene. TACC1 BINDING SITE is HOST TARGET binding site found in the 3' untranslated region of mRNA encoded by TACC1, corresponding to a HOST TARGET binding site such as BINDING SITE I, BINDING SITE II or BINDING SITE III. Table 2 illustrates the complementarity of the nucleotide sequences of TACC1 BINDING SITE, designated SEQ ID:12970, to the nucleotide sequence of VGAM2712 RNA, herein designated VGAM RNA, also designated SEQ ID:5423.

Another function of VGAM2712 is therefore inhibition of Transforming, Acidic Coiled-coil Containing Protein 1 (TACC1, Accession NM_006283). Accordingly, utilities of VGAM2712 include diagnosis, prevention and treatment of diseases and clinical conditions associated with TACC1. TRIM (Accession NM_016388) is another VGAM2712 host target gene. TRIM BINDING SITE is HOST TARGET binding site found in the 3' untranslated region of mRNA encoded by TRIM, corresponding to a HOST TARGET binding site such as BINDING SITE I, BINDING SITE II or BINDING SITE III. Table 2 illustrates the complementarity of the nucleotide sequences of TRIM BINDING SITE, designated SEQ ID:18530, to the nucleotide sequence of VGAM2712 RNA, herein designated VGAM RNA, also designated SEQ ID:5423.

Another function of VGAM2712 is therefore inhibition of TRIM (Accession NM_016388), a gene which plays a role in recruiting signaling proteins to the plasma membrane upon T-cell receptor (TCR) complex activation in T cells. Accordingly, utilities of VGAM2712 include diagnosis, prevention and treatment of diseases and clinical conditions associated with TRIM. The function of TRIM and its association with various diseases and clinical conditions, has been established by previous studies, as described hereinabove with reference to VGAM227. Adaptor-related Protein Complex 1, Sigma 2 Subunit (AP1S2, Accession NM_003916) is another VGAM2712 host target gene. AP1S2 BINDING SITE is HOST TARGET binding site found in the 3' untranslated region of mRNA encoded by AP1S2, corresponding to a HOST TARGET binding site such as BINDING SITE I, BINDING SITE II or BINDING SITE III. Table 2 illustrates the complementarity of the nucleotide sequences of AP1S2 BINDING SITE, designated SEQ ID:10003, to the nucleotide sequence of VGAM2712 RNA, herein designated VGAM RNA, also designated SEQ ID:5423.

Another function of VGAM2712 is therefore inhibition of Adaptor-related Protein Complex 1, Sigma 2 Subunit (AP1S2, Accession NM_003916). Accordingly, utilities of VGAM2712 include diagnosis, prevention and treatment of diseases and clinical conditions associated with AP1S2. Deiodinase, Iodothyronine, Type II (DIO2, Accession NM_013989) is another VGAM2712 host target gene. DIO2 BINDING SITE1 and DIO2 BINDING SITE2 are HOST TARGET binding sites found in untranslated regions of mRNA encoded by DIO2, corresponding to HOST TARGET binding sites such as BINDING SITE I, BINDING SITE II or BINDING SITE III. Table 2 illustrates the complementarity of the nucleotide sequences of DIO2 BINDING SITE1 and DIO2 BINDING SITE2, designated SEQ ID:15165 and SEQ ID:6455 respectively, to the nucleotide sequence of VGAM2712 RNA, herein designated VGAM RNA, also designated SEQ ID:5423.

Another function of VGAM2712 is therefore inhibition of Deiodinase, Iodothyronine, Type II (DIO2, Accession NM_013989). Accordingly, utilities of VGAM2712 include diagnosis, prevention and treatment of diseases and clinical conditions associated with DIO2. Erythrocyte Membrane Protein Band 4.1-like 1 (EPB41L1, Accession XM_047295) is another VGAM2712 host target gene. EPB41L1 BINDING SITE is HOST TARGET binding site found in the 3' untranslated region of mRNA encoded by EPB41L1, corresponding to a HOST TARGET binding site such as BINDING SITE I, BINDING SITE II or BINDING SITE III. Table 2 illustrates the complementarity of the nucleotide sequences of EPB41L1 BINDING SITE, designated SEQ ID:34937, to the nucleotide sequence of VGAM2712 RNA, herein designated VGAM RNA, also designated SEQ ID:5423.

Another function of VGAM2712 is therefore inhibition of Erythrocyte Membrane Protein Band 4.1-like 1 (EPB41L1, Accession XM_047295). Accordingly, utilities of VGAM2712 include diagnosis, prevention and treatment of diseases and clinical conditions associated with EPB41L1. G Protein-coupled Receptor Kinase-interactor 2 (GIT2, Accession NM_014776) is another VGAM2712 host target gene. GIT2 BINDING SITE1 through GIT2 BINDING SITE3 are HOST TARGET binding sites found in untranslated regions of mRNA encoded by GIT2, corresponding to HOST TARGET binding sites such as BINDING SITE I, BINDING SITE II or BINDING SITE III. Table 2 illustrates the complementarity of the nucleotide sequences of GIT2 BINDING SITE1 through GIT2 BINDING SITE3, designated SEQ ID:16599, SEQ ID:27681 and SEQ ID:27694 respectively, to the nucleotide sequence of VGAM2712 RNA, herein designated VGAM RNA, also designated SEQ ID:5423.

Another function of VGAM2712 is therefore inhibition of G Protein-coupled Receptor Kinase-interactor 2 (GIT2, Accession NM_014776). Accordingly, utilities of VGAM2712 include diagnosis, prevention and treatment of diseases and clinical conditions associated with GIT2. Neuronal Pentraxin Receptor (NPTXR, Accession NM_058178) is another VGAM2712 host target gene. NPTXR BINDING SITE1 and NPTXR BINDING SITE2 are HOST TARGET binding sites found in untranslated regions of mRNA encoded by NPTXR, corresponding to HOST TARGET binding sites such as BINDING SITE I, BINDING SITE II or BINDING SITE III. Table 2 illustrates the complementarity of the nucleotide sequences of NPTXR BINDING SITE1 and NPTXR BINDING SITE2, designated SEQ ID:27732 and SEQ ID:15584 respectively, to the nucleotide sequence of VGAM2712 RNA, herein designated VGAM RNA, also designated SEQ ID:5423.

Another function of VGAM2712 is therefore inhibition of Neuronal Pentraxin Receptor (NPTXR, Accession NM_058178). Accordingly, utilities of VGAM2712 include diagnosis, prevention and treatment of diseases and clinical conditions associated with NPTXR. PSR (Accession XM_036784) is another VGAM2712 host target gene. PSR BINDING SITE is HOST TARGET binding site found in the 3' untranslated region of mRNA encoded by PSR, corresponding to a HOST TARGET binding site such as BINDING SITE I, BINDING SITE II or BINDING SITE III. Table 2 illustrates the complementarity of the nucleotide sequences of PSR BINDING SITE, designated SEQ ID:32498, to the nucleotide sequence of VGAM2712 RNA, herein designated VGAM RNA, also designated SEQ ID:5423.

Another function of VGAM2712 is therefore inhibition of PSR (Accession XM_036784). Accordingly, utilities of VGAM2712 include diagnosis, prevention and treatment of diseases and clinical conditions associated with PSR. Solute Carrier Family 38, Member 4 (SLC38A4, Accession NM_018018) is another VGAM2712 host target gene. SLC38A4 BINDING SITE is HOST TARGET binding site found in the 3' untranslated region of mRNA encoded by SLC38A4, corresponding to a HOST TARGET binding site such as BINDING SITE I, BINDING SITE II or BINDING SITE III. Table 2 illustrates the complementarity of the nucleotide sequences of SLC38A4 BINDING SITE, designated SEQ ID:19757, to the nucleotide sequence of VGAM2712 RNA, herein designated VGAM RNA, also designated SEQ ID:5423.

Another function of VGAM2712 is therefore inhibition of Solute Carrier Family 38, Member 4 (SLC38A4, Accession NM_018018). Accordingly, utilities of VGAM2712 include diagnosis, prevention and treatment of diseases and clinical conditions associated with SLC38A4. LOC151414 (Accession XM_087197) is another VGAM2712 host target gene. LOC151414 BINDING SITE is HOST TARGET binding site found in the 3' untranslated region of mRNA encoded by LOC151414, corresponding to a HOST TARGET binding site such as BINDING SITE I, BINDING SITE II or BINDING SITE III. Table 2 illustrates the complementarity of the nucleotide sequences of LOC151414 BINDING SITE, designated SEQ ID:39108, to the nucleotide sequence of VGAM2712 RNA, herein designated VGAM RNA, also designated SEQ ID:5423.

Another function of VGAM2712 is therefore inhibition of LOC151414 (Accession XM_087197). Accordingly, utilities of VGAM2712 include diagnosis, prevention and treatment of diseases and clinical conditions associated with LOC151414. LOC199704 (Accession XM_113994) is another VGAM2712 host target gene. LOC199704 BINDING SITE is HOST TARGET binding site found in the 3' untranslated region of mRNA encoded by LOC199704, corresponding to a HOST TARGET binding site such as BINDING SITE I, BINDING SITE II or BINDING SITE III. Table 2 illustrates the complementarity of the nucleotide sequences of LOC199704 BINDING SITE, designated SEQ ID:42604, to the nucleotide sequence of VGAM2712 RNA, herein designated VGAM RNA, also designated SEQ ID:5423.

Another function of VGAM2712 is therefore inhibition of LOC199704 (Accession XM_113994). Accordingly, utilities of VGAM2712 include diagnosis, prevention and treatment of diseases and clinical conditions associated with LOC199704. LOC201771 (Accession XM_046083) is another VGAM2712 host target gene. LOC201771 BINDING SITE is HOST TARGET binding site found in the 5' untranslated region of mRNA encoded by LOC201771, corresponding to a HOST TARGET binding site such as BINDING SITE I, BINDING SITE II or BINDING SITE III. Table 2 illustrates the complementarity of the nucleotide sequences of LOC201771 BINDING SITE, designated SEQ ID:34677, to the nucleotide sequence of VGAM2712 RNA, herein designated VGAM RNA, also designated SEQ ID:5423.

Another function of VGAM2712 is therefore inhibition of LOC201771 (Accession XM_046083). Accordingly, utilities of VGAM2712 include diagnosis, prevention and treatment of diseases and clinical conditions associated with LOC201771. LOC206426 (Accession XM_116505) is another VGAM2712 host target gene. LOC206426 BINDING SITE is HOST TARGET binding site found in the 3' untranslated region of mRNA encoded by LOC206426, corresponding to a HOST TARGET binding site such as BINDING SITE I, BINDING SITE II or BINDING SITE III. Table 2 illustrates the complementarity of the nucleotide sequences of LOC206426 BINDING SITE, designated SEQ ID:43119, to the nucleotide sequence of VGAM2712 RNA, herein designated VGAM RNA, also designated SEQ ID:5423.

Another function of VGAM2712 is therefore inhibition of LOC206426 (Accession XM_116505). Accordingly, utilities of VGAM2712 include diagnosis, prevention and treatment of diseases and clinical conditions associated with LOC206426. LOC90843 (Accession XM_034430) is another VGAM2712 host target gene. LOC90843 BINDING SITE is HOST TARGET binding site found in the 3' untranslated region of mRNA encoded by LOC90843, corresponding to a HOST TARGET binding site such as BINDING SITE I, BINDING SITE II or BINDING SITE III. Table 2 illustrates the complementarity of the nucleotide sequences of LOC90843 BINDING SITE, designated SEQ ID:32117, to the nucleotide sequence of VGAM2712 RNA, herein designated VGAM RNA, also designated SEQ ID:5423.

Another function of VGAM2712 is therefore inhibition of LOC90843 (Accession XM_034430). Accordingly, utilities of VGAM2712 include diagnosis, prevention and treatment of diseases and clinical conditions associated with LOC90843. FIG. 1 further provides a conceptual description of a novel bioinformatically detected viral gene of the present invention, referred to here as Viral Genomic Address Messenger 2713 (VGAM2713) viral gene, which modulates expression of respective host target genes thereof, the function and utility of which host target genes is known in the art.

VGAM2713 is a novel bioinformatically detected regulatory, non protein coding, viral micro RNA (miRNA) gene. The method by which VGAM2713 was detected is described hereinabove with reference to FIGS. 1-8.

VGAM2713 gene, herein designated VGAM GENE, is a viral gene contained in the genome of Mammalian Orthoreovirus 2. VGAM2713 host target gene, herein designated VGAM HOST TARGET GENE, is a human gene contained in the human genome.

VGAM2713 gene encodes a VGAM2713 precursor RNA, herein designated VGAM PRECURSOR RNA. Similar to other miRNA genes, and unlike most ordinary genes, VGAM2713 precursor RNA does not encode a protein. A nucleotide sequence identical or highly similar to the nucleotide sequence of VGAM2713 precursor RNA is designated SEQ ID:2699, and is provided hereinbelow with reference to the sequence listing part. Nucleotide sequence SEQ ID:2699 is located at position 1472 relative to the genome of Mammalian Orthoreovirus 2.

VGAM2713 precursor RNA folds onto itself, forming VGAM2713 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2713 folded precursor RNA into VGAM2713 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2713 RNA is designated SEQ ID:5424, and is provided hereinbelow with reference to the sequence listing part.

VGAM2713 host target gene, herein designated VGAM HOST TARGET GENE, encodes a corresponding messenger RNA, VGAM2713 host target RNA, herein designated VGAM HOST TARGET RNA. VGAM2713 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2713 RNA, herein designated VGAM RNA, binds complementarily to one or more host target binding sites located in untranslated regions of VGAM2713 host target RNA, herein designated VGAM HOST TARGET RNA. This complementary binding is due to the fact that the nucleotide sequence of VGAM2713 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2713 RNA, herein designated VGAM RNA, may have a different number of host target binding sites in untranslated regions of a VGAM2713 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2713 RNA, herein designated VGAM RNA, to host target binding sites on VGAM2713 host target RNA, herein designated VGAM HOST TARGET RNA, such as BINDING SITE I, BINDING SITE II and BINDING SITE III, inhibits translation of VGAM2713 host target RNA into VGAM2713 host target protein, herein designated VGAM HOST TARGET PROTEIN. VGAM host target protein is therefore outlined by a broken line.

It is appreciated that VGAM2713 host target gene, herein designated VGAM HOST TARGET GENE, in fact represents a plurality of VGAM2713 host target genes. The mRNA of each one of this plurality of VGAM2713 host target genes comprises one or more host target binding sites, each having a nucleotide sequence which is at least partly complementary to VGAM2713 RNA, herein designated VGAM RNA, and which when bound by VGAM2713 RNA causes inhibition of translation of respective one or more VGAM2713 host target proteins.

It is further appreciated by one skilled in the art that the mode of translational inhibition illustrated by FIG. 1 with specific reference to translational inhibition exerted by VGAM2713 gene, herein designated VGAM GENE, on one or more VGAM2713 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2713 is inhibition of expression of host target genes, as part of a novel viral mechanism of attacking a host. Accordingly, utilities of VGAM2713 include diagnosis, prevention and treatment of viral infection by Mammalian Orthoreovirus 2. Specific functions, and accordingly utilities, of VGAM2713 correlate with, and may be deduced from, the identity of the host target genes which VGAM2713 binds and inhibits, and the function of these host target genes, as elaborated hereinbelow.

Nucleotide sequences of the VGAM2713 precursor RNA, herein designated VGAM PRECURSOR RNA, and of the 'diced' VGAM2713 RNA, herein designated VGAM RNA, and a schematic representation of the secondary folding of VGAM2713 folded precursor RNA, herein designated VGAM FOLDED PRECURSOR RNA, of VGAM2713 are further described hereinbelow with reference to Table 1.

Nucleotide sequences of host target binding sites, such as BINDING SITE-I, BINDING SITE-II and BINDING SITE-III of FIG. 1, found on VGAM2713 host target RNA, and schematic representation of the complementarity of each of these host target binding sites to VGAM2713 RNA, herein designated VGAM RNA, are described hereinbelow with reference to Table 2.

As mentioned hereinabove with reference to FIG. 1, a function of VGAM2713 gene, herein designated VGAM is inhibition of expression of VGAM2713 target genes. It is appreciated that specific functions, and accordingly utilities, of VGAM2713 correlate with, and may be deduced from, the identity of the target genes which VGAM2713 binds and inhibits, and the function of these target genes, as elaborated hereinbelow.

XT3 (Accession NM_020208) is a VGAM2713 host target gene. XT3 BINDING SITE is HOST TARGET binding site found in the 3' untranslated region of mRNA encoded by XT3, corresponding to a HOST TARGET binding site such as BINDING SITE I, BINDING SITE II or BINDING SITE III. Table 2 illustrates the complementarity of the nucleotide sequences of XT3 BINDING SITE, designated SEQ ID:21447, to the nucleotide sequence of VGAM2713 RNA, herein designated VGAM RNA, also designated SEQ ID:5424.

A function of VGAM2713 is therefore inhibition of XT3 (Accession NM_020208), a gene which is a Kidney-specific orphan transporter. Accordingly, utilities of VGAM2713 include diagnosis, prevention and treatment of diseases and clinical conditions associated with XT3. The function of XT3 and its association with various diseases and clinical conditions, has been established by previous studies, as described hereinabove with reference to VGAM21. Bromodomain and PHD Finger Containing, 3 (BRPF3, Accession XM_166450) is another VGAM2713 host target gene. BRPF3 BINDING SITE is HOST TARGET binding site found in the 3' untranslated region of mRNA encoded by BRPF3, corresponding to a HOST TARGET binding site such as BINDING SITE I, BINDING SITE II or BINDING SITE III. Table 2 illustrates the complementarity of the nucleotide sequences of BRPF3 BINDING SITE, designated SEQ ID:44346, to the nucleotide sequence of VGAM2713 RNA, herein designated VGAM RNA, also designated SEQ ID:5424.

Another function of VGAM2713 is therefore inhibition of Bromodomain and PHD Finger Containing, 3 (BRPF3, Accession XM_166450). Accordingly, utilities of VGAM2713 include diagnosis, prevention and treatment of diseases and clinical conditions associated with BRPF3. FLJ10661 (Accession NM_018172) is another VGAM2713 host target gene. FLJ10661 BINDING SITE is HOST TARGET binding site found in the 3' untranslated region of mRNA encoded by FLJ10661, corresponding to a HOST TARGET binding site such as BINDING SITE I, BINDING SITE II or BINDING SITE III. Table 2 illustrates the complementarity of the nucleotide sequences of FLJ10661 BINDING SITE, designated SEQ ID:19993, to the nucleotide sequence of VGAM2713 RNA, herein designated VGAM RNA, also designated SEQ ID:5424.

Another function of VGAM2713 is therefore inhibition of FLJ10661 (Accession NM_018172). Accordingly, utilities of VGAM2713 include diagnosis, prevention and treatment of diseases and clinical conditions associated with FLJ10661. FLJ11856 (Accession NM_024531) is another VGAM2713 host target gene. FLJ11856 BINDING SITE is HOST TARGET binding site found in the 5' untranslated region of mRNA encoded by FLJ11856, corresponding to a HOST TARGET binding site such as BINDING SITE I, BINDING SITE II or BINDING SITE III. Table 2 illustrates the complementarity of the nucleotide sequences of FLJ11856 BINDING SITE, designated SEQ ID:23735, to the nucleotide sequence of VGAM2713 RNA, herein designated VGAM RNA, also designated SEQ ID:5424.

Another function of VGAM2713 is therefore inhibition of FLJ11856 (Accession NM_024531). Accordingly, utilities of VGAM2713 include diagnosis, prevention and treatment of diseases and clinical conditions associated with FLJ11856. GFR (Accession NM_012294) is another VGAM2713 host target gene. GFR BINDING SITE is HOST TARGET binding site found in the 3' untranslated region of mRNA encoded by GFR, corresponding to a HOST TARGET binding site such as BINDING SITE I, BINDING SITE II or BINDING SITE III. Table 2 illustrates the complementarity of the nucleotide sequences of GFR BINDING SITE, designated SEQ ID:14644, to the nucleotide sequence of VGAM2713 RNA, herein designated VGAM RNA, also designated SEQ ID:5424.

Another function of VGAM2713 is therefore inhibition of GFR (Accession NM_012294). Accordingly, utilities of VGAM2713 include diagnosis, prevention and treatment of diseases and clinical conditions associated with GFR. Glutamate Receptor, Ionotropic, N-methyl-D-aspartate 3A (GRIN3A, Accession NM_133445) is another VGAM2713 host target gene. GRIN3A BINDING SITE is HOST TARGET binding site found in the 3' untranslated region of mRNA encoded by GRIN3A, corresponding to a HOST TARGET binding site such as BINDING SITE I, BINDING SITE II or BINDING SITE III. Table 2 illustrates the complementarity of the nucleotide sequences of GRIN3A BINDING SITE, designated SEQ ID:28535, to the nucleotide sequence of VGAM2713 RNA, herein designated VGAM RNA, also designated SEQ ID:5424.

Another function of VGAM2713 is therefore inhibition of Glutamate Receptor, Ionotropic, N-methyl-D-aspartate 3A (GRIN3A, Accession NM_133445). Accordingly, utilities of VGAM2713 include diagnosis, prevention and treatment of diseases and clinical conditions associated with GRIN3A. KIAA1219 (Accession XM_028835) is another VGAM2713 host target gene. KIAA1219 BINDING SITE is HOST TARGET binding site found in the 3" untranslated region of mRNA encoded by KIAA1219, corresponding to a HOST TARGET binding site such as BINDING SITE I, BINDING SITE II or BINDING SITE III. Table 2 illustrates the complementarity of the nucleotide sequences of KIAA1219 BINDING SITE, designated SEQ ID:30756, to the nucleotide sequence of VGAM2713 RNA, herein designated VGAM RNA, also designated SEQ ID:5424.

Another function of VGAM2713 is therefore inhibition of KIAA1219 (Accession XM_028835). Accordingly, utilities of VGAM2713 include diagnosis, prevention and treatment of diseases and clinical conditions associated with KIAA1219. LOC202934 (Accession XM_117486) is another VGAM2713 host target gene. LOC202934 BINDING SITE is HOST TARGET binding site found in the 3' untranslated region of mRNA encoded by LOC202934, corresponding to a HOST TARGET binding site such as BINDING SITE I, BINDING SITE II or BINDING SITE III. Table 2 illustrates the complementarity of the nucleotide sequences of LOC202934 BINDING SITE, designated SEQ ID:43452, to the nucleotide sequence of VGAM2713 RNA, herein designated VGAM RNA, also designated SEQ ID:5424.

Another function of VGAM2713 is therefore inhibition of LOC202934 (Accession XM_117486). Accordingly, utilities of VGAM2713 include diagnosis, prevention and treatment of diseases and clinical conditions associated with LOC202934. LOC255465 (Accession XM_173206) is another VGAM2713 host target gene. LOC255465 BINDING SITE is HOST TARGET binding site found in the 3' untranslated region of mRNA encoded by LOC255465, corresponding to a HOST TARGET binding site such as BIND- ING SITE I, BINDING SITE II or BINDING SITE III. Table 2 illustrates the complementarity of the nucleotide sequences of LOC255465 BINDING SITE, designated SEQ ID:46446, to the nucleotide sequence of VGAM2713 RNA, herein designated VGAM RNA, also designated SEQ ID:5424.

Another function of VGAM2713 is therefore inhibition of LOC255465 (Accession XM_173206). Accordingly, utilities of VGAM2713 include diagnosis, prevention and treatment of diseases and clinical conditions associated with LOC255465. LOC51193 (Accession NM_016331) is another VGAM2713 host target gene. LOC51193 BINDING SITE is HOST TARGET binding site found in the 5' untranslated region of mRNA encoded by LOC51193, corresponding to a HOST TARGET binding site such as BINDING SITE I, BINDING SITE II or BINDING SITE III. Table 2 illustrates the complementarity of the nucleotide sequences of LOC51193 BINDING SITE, designated SEQ ID:18454, to the nucleotide sequence of VGAM2713 RNA, herein designated VGAM RNA, also designated SEQ ID:5424.

Another function of VGAM2713 is therefore inhibition of LOC51193 (Accession NM_016331). Accordingly, utilities of VGAM2713 include diagnosis, prevention and treatment of diseases and clinical conditions associated with LOC51193. FIG. 1 further provides a conceptual description of a novel bioinformatically detected viral gene of the present invention, referred to here as Viral Genomic Address Messenger 2714 (VGAM2714) viral gene, which modulates expression of respective host target genes thereof, the function and utility of which host target genes is known in the art.

VGAM2714 is a novel bioinformatically detected regulatory, non protein coding, viral micro RNA (miRNA) gene. The method by which VGAM2714 was detected is described hereinabove with reference to FIGS. 1-8.

VGAM2714 gene, herein designated VGAM GENE, is a viral gene contained in the genome of Mammalian Orthoreovirus 2. VGAM2714 host target gene, herein designated VGAM HOST TARGET GENE, is a human gene contained in the human genome.

VGAM2714 gene encodes a VGAM2714 precursor RNA, herein designated VGAM PRECURSOR RNA. Similar to other miRNA genes, and unlike most ordinary genes, VGAM2714 precursor RNA does not encode a protein. A nucleotide sequence identical or highly similar to the nucleotide sequence of VGAM2714 precursor RNA is designated SEQ ID:2700, and is provided hereinbelow with reference to the sequence listing part. Nucleotide sequence SEQ ID:2700 is located at position 1237 relative to the genome of Mammalian Orthoreovirus 2.

VGAM2714 precursor RNA folds onto itself, forming VGAM2714 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2714 folded precursor RNA into VGAM2714 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 82%) nucleotide sequence of VGAM2714 RNA is designated SEQ ID:5425, and is provided hereinbelow with reference to the sequence listing part.

VGAM2714 host target gene, herein designated VGAM HOST TARGET GENE, encodes a corresponding messenger RNA, VGAM2714 host target RNA, herein designated VGAM HOST TARGET RNA. VGAM2714 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2714 RNA, herein designated VGAM RNA, binds complementarily to one or more host target binding sites located in untranslated regions of VGAM2714 host target RNA, herein designated VGAM HOST TARGET RNA. This complementary binding is due to the fact that the nucleotide sequence of VGAM2714 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2714 RNA, herein designated VGAM RNA, may have a different number of host target binding sites in untranslated regions of a VGAM2714 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2714 RNA, herein designated VGAM RNA, to host target binding sites on VGAM2714 host target RNA, herein designated VGAM HOST TARGET RNA, such as BINDING SITE I, BINDING SITE II and BINDING SITE III, inhibits translation of VGAM2714 host target RNA into VGAM2714 host target protein, herein designated VGAM HOST TARGET PROTEIN. VGAM host target protein is therefore outlined by a broken line.

It is appreciated that VGAM2714 host target gene, herein designated VGAM HOST TARGET GENE, in fact represents a plurality of VGAM2714 host target genes. The mRNA of each one of this plurality of VGAM2714 host target genes comprises one or more host target binding sites, each having a nucleotide sequence which is at least partly complementary to VGAM2714 RNA, herein designated VGAM RNA, and which when bound by VGAM2714 RNA causes inhibition of translation of respective one or more VGAM2714 host target proteins.

It is further appreciated by one skilled in the art that the mode of translational inhibition illustrated by FIG. 1 with specific reference to translational inhibition exerted by VGAM2714 gene, herein designated VGAM GENE, on one or more VGAM2714 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2714 is inhibition of expression of host target genes, as part of a novel viral mechanism of attacking a host. Accordingly, utilities of VGAM2714 include diagnosis, prevention and treatment of viral infection by Mammalian Orthoreovirus 2. Specific functions, and accordingly utilities, of VGAM2714 correlate with, and may be deduced from, the identity of the host target genes which VGAM2714 binds and inhibits, and the function of these host target genes, as elaborated hereinbelow.

Nucleotide sequences of the VGAM2714 precursor RNA, herein designated VGAM PRECURSOR RNA, and of the 'diced' VGAM2714 RNA, herein designated VGAM RNA, and a schematic representation of the secondary folding of VGAM2714 folded precursor RNA, herein designated VGAM FOLDED PRECURSOR RNA, of VGAM2714 are further described hereinbelow with reference to Table 1.

Nucleotide sequences of host target binding sites, such as BINDING SITE-I, BINDING SITE-II and BINDING SITE-III of FIG. 1, found on VGAM2714 host target RNA, and schematic representation of the complementarity of each of these host target binding sites to VGAM2714 RNA, herein designated VGAM RNA, are described hereinbelow with reference to Table 2.

As mentioned hereinabove with reference to FIG. 1, a function of VGAM2714 gene, herein designated VGAM is inhibition of expression of VGAM2714 target genes. It is appreciated that specific functions, and accordingly utilities, of VGAM2714 correlate with, and may be deduced from, the identity of the target genes which VGAM2714 binds and inhibits, and the function of these target genes, as elaborated hereinbelow.

Aldehyde Dehydrogenase 3 Family, Member B2 (ALDH3B2, Accession NM_000695) is a VGAM2714 host target gene. ALDH3B2 BINDING SITE is HOST TARGET binding site found in the 3' untranslated region of mRNA encoded by ALDH3B2, corresponding to a HOST TARGET binding site such as BINDING SITE I, BINDING SITE II or BINDING SITE III. Table 2 illustrates the complementarity of the nucleotide sequences of ALDH3B2 BINDING SITE, designated SEQ ID:6356, to the nucleotide sequence of VGAM2714 RNA, herein designated VGAM RNA, also designated SEQ ID:5425.

A function of VGAM2714 is therefore inhibition of Aldehyde Dehydrogenase 3 Family, Member B2 (ALDH3B2, Accession NM_000695), a gene which may play a role in alcohol detoxitation. Accordingly, utilities of VGAM2714 include diagnosis, prevention and treatment of diseases and clinical conditions associated with ALDH3B2. The function of ALDH3B2 and its association with various diseases and clinical conditions, has been established by previous studies, as described hereinabove with reference to VGAM251. BTB and CNC Homology 1, Basic Leucine Zipper Transcription Factor 2 (BACH2, Accession NM_021813) is another VGAM2714 host target gene. BACH2 BINDING SITE is HOST TARGET binding site found in the 3' untranslated region of mRNA encoded by BACH2, corresponding to a HOST TARGET binding site such as BINDING SITE I, BINDING SITE II or BINDING SITE III. Table 2 illustrates the complementarity of the nucleotide sequences of BACH2 BINDING SITE, designated SEQ ID:22379, to the nucleotide sequence of VGAM2714 RNA, herein designated VGAM RNA, also designated SEQ ID:5425.

Another function of VGAM2714 is therefore inhibition of BTB and CNC Homology 1, Basic Leucine Zipper Transcription Factor 2 (BACH2, Accession NM_021813), a gene which acts as repressor or activator, binds to maf recognition elements. Accordingly, utilities of VGAM2714 include diagnosis, prevention and treatment of diseases and clinical conditions associated with BACH2. The function of BACH2 and its association with various diseases and clinical conditions, has been established by previous studies, as described hereinabove with reference to VGAM331. Complement Component 5 Receptor 1 (C5a ligand) (C5R1, Accession NM_001736) is another VGAM2714 host target gene. C5R1 BINDING SITE is HOST TARGET binding site found in the 3' untranslated region of mRNA encoded by C5R1, corresponding to a HOST TARGET binding site such as BINDING SITE I, BINDING SITE II or BINDING SITE III. Table 2 illustrates the complementarity of the nucleotide sequences of C5R1 BINDING SITE, designated SEQ ID:7471, to the nucleotide sequence of VGAM2714 RNA, herein designated VGAM RNA, also designated SEQ ID:5425.

Another function of VGAM2714 is therefore inhibition of Complement Component 5 Receptor 1 (C5a ligand) (C5R1, Accession NM_001736), a gene which has a nonredundant function and is required for mucosal host cell defense in the lung. Accordingly, utilities of VGAM2714 include diagnosis, prevention and treatment of diseases and clinical conditions associated with C5R1. The function of C5R1 and its association with various diseases and clinical conditions, has been established by previous studies, as described hereinabove with reference to VGAM484. Collagen, Type VI, Alpha 2 (COL6A2, Accession NM_058175) is another VGAM2714 host target gene. COL6A2 BINDING SITE is HOST TARGET binding site found in the 3' untranslated region of mRNA encoded by COL6A2, corresponding to a HOST TARGET binding site such as BINDING SITE I, BINDING SITE II or BINDING SITE III. Table 2 illustrates the complementarity of the nucleotide sequences of COL6A2 BINDING SITE, designated SEQ ID:27727, to the nucleotide sequence of VGAM2714 RNA, herein designated VGAM RNA, also designated SEQ ID:5425.

Another function of VGAM2714 is therefore inhibition of Collagen, Type VI, Alpha 2 (COL6A2, Accession NM_058175). Accordingly, utilities of VGAM2714 include diagnosis, prevention and treatment of diseases and clinical conditions associated with COL6A2. Dihydrofolate Reductase (DHFR, Accession NM_000791) is another VGAM2714 host target gene. DHFR BINDING SITE is HOST TARGET binding site found in the 3' untranslated region of mRNA encoded by DHFR, corresponding to a HOST TARGET binding site such as BINDING SITE I, BINDING SITE II or BINDING SITE III. Table 2 illustrates the complementarity of the nucleotide sequences of DHFR BINDING SITE, designated SEQ ID:6448, to the nucleotide sequence of VGAM2714 RNA, herein designated VGAM RNA, also designated SEQ ID:5425.

Another function of VGAM2714 is therefore inhibition of Dihydrofolate Reductase (DHFR, Accession NM_000791), a gene which converts dihydrofolate into tetrahydrofolate. Accordingly, utilities of VGAM2714 include diagnosis, prevention and treatment of diseases and clinical conditions associated with DHFR. The function of DHFR and its association with various diseases and clinical conditions, has been established by previous studies, as described hereinabove with reference to VGAM826. Profilin 2 (PFN2, Accession NM_002628) is another VGAM2714 host target gene. PFN2 BINDING SITE1 and PFN2 BINDING SITE2 are HOST TARGET binding sites found in untranslated regions of mRNA encoded by PFN2, corresponding to HOST TARGET binding sites such as BINDING SITE I, BINDING SITE II or BINDING SITE III. Table 2 illustrates the complementarity of the nucleotide sequences of PFN2 BINDING SITE1 and PFN2 BINDING SITE2, designated SEQ ID:8487 and SEQ ID:27580 respectively, to the nucleotide sequence of VGAM2714 RNA, herein designated VGAM RNA, also designated SEQ ID:5425.

Another function of VGAM2714 is therefore inhibition of Profilin 2 (PFN2, Accession NM_002628). Accordingly, utilities of VGAM2714 include diagnosis, prevention and treatment of diseases and clinical conditions associated with PFN2. Cytochrome P450, Subfamily IIA (phenobarbital-inducible), Polypeptide 7 (CYP2A7, Accession NM_030589) is another VGAM2714 host target gene. CYP2A7 BINDING SITE1 and CYP2A7 BINDING SITE2 are HOST TARGET binding sites found in untranslated regions of mRNA encoded by CYP2A7, corresponding to HOST TARGET binding sites such as BINDING SITE I, BINDING SITE II or BINDING SITE III. Table 2 illustrates the complementarity of the nucleotide sequences of CYP2A7 BINDING SITE1 and CYP2A7 BINDING SITE2, designated SEQ ID:24957 and SEQ ID:39709 respectively, to the nucleotide sequence of VGAM2714 RNA, herein designated VGAM RNA, also designated SEQ ID:5425.

Another function of VGAM2714 is therefore inhibition of Cytochrome P450, Subfamily IIA (phenobarbital-inducible), Polypeptide 7 (CYP2A7, Accession NM_030589). Accordingly, utilities of VGAM2714 include diagnosis, prevention and treatment of diseases and clinical conditions associated with CYP2A7. MGC2452 (Accession NM_032644) is another VGAM2714 host target gene. MGC2452 BINDING SITE is HOST TARGET binding site found in the 5' untranslated region of mRNA encoded by MGC2452, corresponding to a HOST TARGET binding site such as BINDING SITE I, BINDING SITE II or BINDING SITE III. Table 2 illustrates the complementarity of the nucleotide sequences of MGC2452 BINDING SITE, designated SEQ ID:26367, to the nucleotide sequence of VGAM2714 RNA, herein designated VGAM RNA, also designated SEQ ID:5425.

Another function of VGAM2714 is therefore inhibition of MGC2452 (Accession NM_032644). Accordingly, utilities of VGAM2714 include diagnosis, prevention and treatment of diseases and clinical conditions associated with MGC2452. NESHBP (Accession NM_015429) is another VGAM2714 host target gene. NESHBP BINDING SITE is HOST TARGET binding site found in the 5' untranslated region of mRNA encoded by NESHBP, corresponding to a HOST TARGET binding site such as BINDING SITE I, BINDING SITE II or BINDING SITE III. Table 2 illustrates the complementarity of the nucleotide sequences of NESHBP BINDING SITE, designated SEQ ID:17727, to the nucleotide sequence of VGAM2714 RNA, herein designated VGAM RNA, also designated SEQ ID:5425.

Another function of VGAM2714 is therefore inhibition of NESHBP (Accession NM_015429). Accordingly, utilities of VGAM2714 include diagnosis, prevention and treatment of diseases and clinical conditions associated with NESHBP. LOC131034 (Accession NM_130808) is another VGAM2714 host target gene. LOC131034 BINDING SITE is HOST TARGET binding site found in the 5' untranslated region of mRNA encoded by LOC131034, corresponding to a HOST TARGET binding site such as BINDING SITE I, BINDING SITE II or BINDING SITE III. Table 2 illustrates the complementarity of the nucleotide sequences of LOC131034 BINDING SITE, designated SEQ ID:28314, to the nucleotide sequence of VGAM2714 RNA, herein designated VGAM RNA, also designated SEQ ID:5425.

Another function of VGAM2714 is therefore inhibition of LOC131034 (Accession NM_130808). Accordingly, utilities of VGAM2714 include diagnosis, prevention and treatment of diseases and clinical conditions associated with LOC131034. LOC196500 (Accession XM_113734) is another VGAM2714 host target gene. LOC196500 BINDING SITE is HOST TARGET binding site found in the 3' untranslated region of mRNA encoded by LOC196500, corresponding to a HOST TARGET binding site such as BINDING SITE I, BINDING SITE II or BINDING SITE III. Table 2 illustrates the complementarity of the nucleotide sequences of LOC196500 BINDING SITE, designated SEQ ID:42386, to the nucleotide sequence of VGAM2714 RNA, herein designated VGAM RNA, also designated SEQ ID:5425.

Another function of VGAM2714 is therefore inhibition of LOC196500 (Accession XM_113734). Accordingly, utilities of VGAM2714 include diagnosis, prevention and treatment of diseases and clinical conditions associated with LOC196500. LOC256158 (Accession XM_175125) is another VGAM2714 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46620, to the nucleotide sequence of VGAM2714 RNA, herein designated VGAM RNA, also designated SEQ ID:5425.

Another function of VGAM2714 is therefore inhibition of LOC256158 (Accession XM_175125). Accordingly, utilities of VGAM2714 include diagnosis, prevention and treatment of diseases and clinical conditions associated with LOC256158. FIG. 1 further provides a conceptual description of a novel bioinformatically detected viral gene of the present invention, referred to here as Viral Genomic Address Messenger 2715 (VGAM2715) viral gene, which modulates expression of respective host target genes thereof, the function and utility of which host target genes is known in the art.

VGAM2715 is a novel bioinformatically detected regulatory, non protein coding, viral micro RNA (miRNA) gene. The method by which VGAM2715 was detected is described hereinabove with reference to FIGS. 1-8.

VGAM2715 gene, herein designated VGAM GENE, is a viral gene contained in the genome of Mammalian Orthoreovirus 2. VGAM2715 host target gene, herein designated VGAM HOST TARGET GENE, is a human gene contained in the human genome.

VGAM2715 gene encodes a VGAM2715 precursor RNA, herein designated VGAM PRECURSOR RNA. Similar to other miRNA genes, and unlike most ordinary genes, VGAM2715 precursor RNA does not encode a protein. A nucleotide sequence identical or highly similar to the nucleotide sequence of VGAM2715 precursor RNA is designated SEQ ID:2701, and is provided hereinbelow with reference to the sequence listing part. Nucleotide sequence SEQ ID:2701 is located at position 1891 relative to the genome of Mammalian Orthoreovirus 2.

VGAM2715 precursor RNA folds onto itself, forming VGAM2715 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2715 folded precursor RNA into VGAM2715 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 43%) nucleotide sequence of VGAM2715 RNA is designated SEQ ID:5426, and is provided hereinbelow with reference to the sequence listing part.

VGAM2715 host target gene, herein designated VGAM HOST TARGET GENE, encodes a corresponding messenger RNA, VGAM2715 host target RNA, herein designated VGAM HOST TARGET RNA. VGAM2715 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2715 RNA, herein designated VGAM RNA, binds complementarily to one or more host target binding sites located in untranslated regions of VGAM2715 host target RNA, herein designated VGAM HOST TARGET RNA. This complementary binding is due to the fact that the nucleotide sequence of VGAM2715 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2715 RNA, herein designated VGAM RNA, may have a different number of host target binding sites in untranslated regions of a VGAM2715 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2715 RNA, herein designated VGAM RNA, to host target binding sites on VGAM2715 host target RNA, herein designated VGAM HOST TARGET RNA, such as BINDING SITE I, BINDING SITE II and BINDING SITE III, inhibits translation of VGAM2715 host target RNA into VGAM2715 host target protein, herein designated VGAM HOST TARGET PROTEIN. VGAM host target protein is therefore outlined by a broken line.

It is appreciated that VGAM2715 host target gene, herein designated VGAM HOST TARGET GENE, in fact represents a plurality of VGAM2715 host target genes. The mRNA of each one of this plurality of VGAM2715 host target genes comprises one or more host target binding sites, each having a nucleotide sequence which is at least partly complementary to VGAM2715 RNA, herein designated VGAM RNA, and which when bound by VGAM2715 RNA causes inhibition of translation of respective one or more VGAM2715 host target proteins.

It is further appreciated by one skilled in the art that the mode of translational inhibition illustrated by FIG. 1 with specific reference to translational inhibition exerted by VGAM2715 gene, herein designated VGAM GENE, on one or more VGAM2715 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2715 is inhibition of expression of host target genes, as part of a novel viral mechanism of attacking a host. Accordingly, utilities of VGAM2715 include diagnosis, prevention and treatment of viral infection by Mammalian Orthoreovirus 2. Specific functions, and accordingly utilities, of VGAM2715 correlate with, and may be deduced from, the identity of the host target genes which VGAM2715 binds and inhibits, and the function of these host target genes, as elaborated hereinbelow.

Nucleotide sequences of the VGAM2715 precursor RNA, herein designated VGAM PRECURSOR RNA, and of the 'diced' VGAM2715 RNA, herein designated VGAM RNA, and a schematic representation of the secondary folding of VGAM2715 folded precursor RNA, herein designated VGAM FOLDED PRECURSOR RNA, of VGAM2715 are further described hereinbelow with reference to Table 1.

Nucleotide sequences of host target binding sites, such as BINDING SITE-I, BINDING SITE-II and BINDING SITE-III of FIG. 1, found on VGAM2715 host target RNA, and schematic representation of the complementarity of each of these host target binding sites to VGAM2715 RNA, herein designated VGAM RNA, are described hereinbelow with reference to Table 2.

As mentioned hereinabove with reference to FIG. 1, a function of VGAM2715 gene, herein designated VGAM is inhibition of expression of VGAM2715 target genes. It is appreciated that specific functions, and accordingly utilities, of VGAM2715 correlate with, and may be deduced from, the identity of the target genes which VGAM2715 binds and inhibits, and the function of these target genes, as elaborated hereinbelow.

Adaptor-related Protein Complex 1, Beta 1 Subunit (AP1B1, Accession NM_001127) is a VGAM2715 host target gene. AP1B1 BINDING SITE is HOST TARGET binding site found in the 3' untranslated region of mRNA encoded by AP1B1, corresponding to a HOST TARGET binding site such as BINDING SITE I, BINDING SITE II or BINDING SITE III. Table 2 illustrates the complementarity of the nucleotide sequences of AP1B1 BINDING SITE, designated SEQ ID:6796, to the nucleotide sequence of VGAM2715 RNA, herein designated VGAM RNA, also designated SEQ ID:5426.

A function of VGAM2715 is therefore inhibition of Adaptor-related Protein Complex 1, Beta 1 Subunit (AP1B1, Accession NM_001127), a gene which plays a role in protein sorting in the late-golgi/trans-golgi network (tgn) and/or endosomes. Accordingly, utilities of VGAM2715 include diagnosis, prevention and treatment of diseases and clinical conditions associated with AP1B1. The function of AP1B1 and its association with various diseases and clinical conditions, has been established by previous studies, as described hereinabove with reference to VGAM1048. Collagen, Type VI, Alpha 2 (COL6A2, Accession NM_058175) is another VGAM2715 host target gene. COL6A2 BINDING SITE is HOST TARGET binding site found in the 3' untranslated region of mRNA encoded by COL6A2, corresponding to a HOST TARGET binding site such as BINDING SITE I, BINDING SITE II or BINDING SITE III. Table 2 illustrates the complementarity of the nucleotide sequences of COL6A2 BINDING SITE, designated SEQ ID:27724, to the nucleotide sequence of VGAM2715 RNA, herein designated VGAM RNA, also designated SEQ ID:5426.

Another function of VGAM2715 is therefore inhibition of Collagen, Type VI, Alpha 2 (COL6A2, Accession NM_058175). Accordingly, utilities of VGAM2715 include diagnosis, prevention and treatment of diseases and clinical conditions associated with COL6A2. CREB Binding Protein (Rubinstein-Taybi syndrome) (CREBBP, Accession NM_004380) is another VGAM2715 host target gene. CREBBP BINDING SITE is HOST TARGET binding site found in the 3' untranslated region of mRNA encoded by CREBBP, corresponding to a HOST TARGET binding site such as BINDING SITE I, BINDING SITE II or BINDING SITE III. Table 2 illustrates the complementarity of the nucleotide sequences of CREBBP BINDING SITE, designated SEQ ID:10603, to the nucleotide sequence of VGAM2715 RNA, herein designated VGAM RNA, also designated SEQ ID:5426.

Another function of VGAM2715 is therefore inhibition of CREB Binding Protein (Rubinstein-Taybi syndrome) (CREBBP, Accession NM_004380). Accordingly, utilities of VGAM2715 include diagnosis, prevention and treatment of diseases and clinical conditions associated with CREBBP. V-erb-b2 Erythroblastic Leukemia Viral Oncogene Homolog 2, Neuro/glioblastoma Derived Oncogene Homolog (avian) (ERBB2, Accession NM_004448) is another VGAM2715 host target gene. ERBB2 BINDING SITE is HOST TARGET binding site found in the 3' untranslated region of mRNA encoded by ERBB2, corresponding to a HOST TARGET binding site such as BINDING SITE I, BINDING SITE II or BINDING SITE III. Table 2 illustrates the complementarity of the nucleotide sequences of ERBB2 BINDING SITE, designated SEQ ID:10744, to the nucleotide sequence of VGAM2715 RNA, herein designated VGAM RNA, also designated SEQ ID:5426.

Another function of VGAM2715 is therefore inhibition of V-erb-b2 Erythroblastic Leukemia Viral Oncogene Homolog 2, Neuro/glioblastoma Derived Oncogene Homolog (avian) (ERBB2, Accession NM_004448), a gene which Tyrosine kinase receptor. Accordingly, utilities of VGAM2715 include diagnosis, prevention and treatment of diseases and clinical conditions associated with ERBB2. The function of ERBB2 and its association with various diseases and clinical conditions, has been established by previous studies, as described hereinabove with reference to VGAM1366. Fatty Acid Synthase (FASN, Accession NM_004104) is another VGAM2715 host target gene. FASN BINDING SITE is HOST TARGET binding site found in the 3' untranslated region of mRNA encoded by FASN, corresponding to a HOST TARGET binding site such as BINDING SITE I, BINDING SITE II or BINDING SITE III. Table 2 illustrates the complementarity of the nucleotide sequences of FASN BINDING SITE, designated SEQ ID:10314, to the nucleotide sequence of VGAM2715 RNA, herein designated VGAM RNA, also designated SEQ ID:5426.

Another function of VGAM2715 is therefore inhibition of Fatty Acid Synthase (FASN, Accession NM_004104), a gene which catalyzes the formation of long-chain fatty acids from acetyl-coa, malonyl-coa and nadph. Accordingly, utilities of VGAM2715 include diagnosis, prevention and treatment of diseases and clinical conditions associated with FASN. The function of FASN and its association with various diseases and clinical conditions, has been established by previous studies, as described hereinabove with reference to VGAM477. Integrin, Alpha L (antigen CD11A (p180), Lymphocyte Function-associated Antigen 1; Alpha Polypeptide) (ITGAL, Accession NM_002209) is another VGAM2715 host target gene. ITGAL BINDING SITE is HOST TARGET binding site found in the 3' untranslated region of mRNA encoded by ITGAL, corresponding to a HOST TARGET binding site such as BINDING SITE I, BINDING SITE II or BINDING SITE III. Table 2 illustrates the complementarity of the nucleotide sequences of ITGAL BINDING SITE, designated SEQ ID:7968, to the nucleotide sequence of VGAM2715 RNA, herein designated VGAM RNA, also designated SEQ ID:5426.

Another function of VGAM2715 is therefore inhibition of Integrin, Alpha L (antigen CD11A (p180), Lymphocyte Function-associated Antigen 1; Alpha Polypeptide) (ITGAL, Accession NM_002209), a gene which s a receptor for icam1, icam2, icam3 and icam4. it is involved in a variety of immune phenomena including leukocyte-endothelial cell interaction, cytotoxic t-cell mediated killing, and antibody dependent killing by granulocytes and monocytes. Accordingly, utilities of VGAM2715 include diagnosis, prevention and treatment of diseases and clinical conditions associated with ITGAL. The function of ITGAL and its association with various diseases and clinical conditions, has been established by previous studies, as described hereinabove with reference to VGAM200. Phosphomannomutase 2 (PMM2, Accession XM_050755) is another VGAM2715 host target gene. PMM2 BINDING SITE is HOST TARGET binding site found in the 3' untranslated region of mRNA encoded by PMM2, corresponding to a HOST TARGET binding site such as BINDING SITE I, BINDING SITE II or BINDING SITE III. Table 2 illustrates the complementarity of the nucleotide sequences of PMM2 BINDING SITE, designated SEQ ID:35677, to the nucleotide sequence of VGAM2715 RNA, herein designated VGAM RNA, also designated SEQ ID:5426.

Another function of VGAM2715 is therefore inhibition of Phosphomannomutase 2 (PMM2, Accession XM_050755). Accordingly, utilities of VGAM2715 include diagnosis, prevention and treatment of diseases and clinical conditions associated with PMM2. Apolipoprotein L, 4 (APOL4, Accession NM_030643) is another VGAM2715 host target gene. APOL4 BINDING SITE is HOST TARGET binding site found in the 3' untranslated region of mRNA encoded by APOL4, corresponding to a HOST TARGET binding site such as BINDING SITE I, BINDING SITE II or BINDING SITE III. Table 2 illustrates the complementarity of the nucleotide sequences of APOL4 BINDING SITE, designated SEQ ID:24974, to the nucleotide sequence of VGAM2715 RNA, herein designated VGAM RNA, also designated SEQ ID:5426.

Another function of VGAM2715 is therefore inhibition of Apolipoprotein L, 4 (APOL4, Accession NM_030643). Accordingly, utilities of VGAM2715 include diagnosis, prevention and treatment of diseases and clinical conditions associated with APOL4. FLJ11106 (Accession NM_018324) is another VGAM2715 host target gene. FLJ11106 BINDING SITE is HOST TARGET binding site found in the 5' untranslated region of mRNA encoded by FLJ11106, corresponding to a HOST TARGET binding site such as BINDING SITE I, BINDING SITE II or BINDING SITE III. Table 2 illustrates the complementarity of the nucleotide sequences of FLJ11106 BINDING SITE, designated SEQ ID:20317, to the nucleotide sequence of VGAM2715 RNA, herein designated VGAM RNA, also designated SEQ ID:5426.

Another function of VGAM2715 is therefore inhibition of FLJ11106 (Accession NM_018324). Accordingly, utilities of VGAM2715 include diagnosis, prevention and treatment of diseases and clinical conditions associated with FLJ11106. FLJ20699 (Accession NM_017931) is another VGAM2715 host target gene. FLJ20699 BINDING SITE is HOST TARGET binding site found in the 3' untranslated region of mRNA encoded by FLJ20699, corresponding to a HOST TARGET binding site such as BINDING SITE I, BINDING SITE II or BINDING SITE III. Table 2 illustrates the complementarity of the nucleotide sequences of FLJ20699 BINDING SITE, designated SEQ ID:19617, to the nucleotide sequence of VGAM2715 RNA, herein designated VGAM RNA, also designated SEQ ID:5426.

Another function of VGAM2715 is therefore inhibition of FLJ20699 (Accession NM_017931). Accordingly, utilities of VGAM2715 include diagnosis, prevention and treatment of diseases and clinical conditions associated with FLJ20699. KIAA1028 (Accession XM_166324) is another VGAM2715 host target gene. KIAA1028 BINDING SITE is HOST TARGET binding site found in the 3' untranslated region of mRNA encoded by KIAA1028, corresponding to a HOST TARGET binding site such as BINDING SITE I, BINDING SITE II or BINDING SITE III. Table 2 illustrates the complementarity of the nucleotide sequences of KIAA1028 BINDING SITE, designated SEQ ID:44158, to the nucleotide sequence of VGAM2715 RNA, herein designated VGAM RNA, also designated SEQ ID:5426.

Another function of VGAM2715 is therefore inhibition of KIAA1028 (Accession XM_166324). Accordingly, utilities of VGAM2715 include diagnosis, prevention and treatment of diseases and clinical conditions associated with KIAA1028. KIAA1161 (Accession XM_088501) is another VGAM2715 host target gene. KIAA1161 BINDING SITE is HOST TARGET binding site found in the 5' untranslated region of mRNA encoded by KIAA1161, corresponding to a HOST TARGET binding site such as BINDING SITE I, BINDING SITE II or BINDING SITE III. Table 2 illustrates the complementarity of the nucleotide sequences of KIAA1161 BINDING SITE, designated SEQ ID:39750, to the nucleotide sequence of VGAM2715 RNA, herein designated VGAM RNA, also designated SEQ ID:5426.

Another function of VGAM2715 is therefore inhibition of KIAA1161 (Accession XM_088501). Accordingly, utilities of VGAM2715 include diagnosis, prevention and treatment of diseases and clinical conditions associated with KIAA1161. KIAA1303 (Accession XM_038376) is another VGAM2715 host target gene. KIAA1303 BINDING SITE is HOST TARGET binding site found in the 3' untranslated region of mRNA encoded by KIAA1303, corresponding to a HOST TARGET binding site such as BINDING SITE I, BINDING SITE II or BINDING SITE III. Table 2 illustrates the complementarity of the nucleotide sequences of KIAA1303 BINDING SITE, designated SEQ ID:32832, to the nucleotide sequence of VGAM2715 RNA, herein designated VGAM RNA, also designated SEQ ID:5426.

Another function of VGAM2715 is therefore inhibition of KIAA1303 (Accession XM_038376). Accordingly, utilities of VGAM2715 include diagnosis, prevention and treatment of diseases and clinical conditions associated with KIAA1303. KIAA1866 (Accession XM_027658) is another VGAM2715 host target gene. KIAA1866 BINDING SITE is HOST TARGET binding site found in the 3' untranslated region of mRNA encoded by KIAA1866, corresponding to a HOST TARGET binding site such as BINDING SITE I, BINDING SITE II or BINDING SITE III. Table 2 illustrates the complementarity of the nucleotide sequences of KIAA1866 BINDING SITE, designated SEQ ID:30555, to the nucleotide sequence of VGAM2715 RNA, herein designated VGAM RNA, also designated SEQ ID:5426.

Another function of VGAM2715 is therefore inhibition of KIAA1866 (Accession XM_027658). Accordingly, utilities of VGAM2715 include diagnosis, prevention and treatment of diseases and clinical conditions associated with KIAA1866. PV1 (Accession NM_031310) is another VGAM2715 host target gene. PV1 BINDING SITE is HOST TARGET binding site found in the 3' untranslated region of mRNA encoded by PV1, corresponding to a HOST TARGET binding site such as BINDING SITE I, BINDING SITE II or BINDING SITE III. Table 2 illustrates the complementarity of the nucleotide sequences of PV1 BINDING SITE, designated SEQ ID:25349, to the nucleotide sequence of VGAM2715 RNA, herein designated VGAM RNA, also designated SEQ ID:5426.

Another function of VGAM2715 is therefore inhibition of PV1 (Accession NM_031310). Accordingly, utilities of VGAM2715 include diagnosis, prevention and treatment of diseases and clinical conditions associated with PV1. SEC14-like 1 (S. cerevisiae) (SEC14L1, Accession NM_003003) is another VGAM2715 host target gene. SEC14L1 BINDING SITE is HOST TARGET binding site found in the 3" untranslated region of mRNA encoded by SEC14L1, corresponding to a HOST TARGET binding site such as BINDING SITE I, BINDING SITE II or BINDING SITE III. Table 2 illustrates the complementarity of the nucleotide sequences of SEC14L1 BINDING SITE, designated SEQ ID:8901, to the nucleotide sequence of VGAM2715 RNA, herein designated VGAM RNA, also designated SEQ ID:5426.

Another function of VGAM2715 is therefore inhibition of SEC14-like 1 (S. cerevisiae) (SEC14L1, Accession NM_003003). Accordingly, utilities of VGAM2715 include diagnosis, prevention and treatment of diseases and clinical conditions associated with SEC14L1. LOC149832 (Accession XM_097733) is another VGAM2715 host target gene. LOC149832 BINDING SITE is HOST TARGET binding site found in the 5' untranslated region of mRNA encoded by LOC149832, corresponding to a HOST TARGET binding site such as BINDING SITE I, BINDING SITE II or BINDING SITE III. Table 2 illustrates the complementarity of the nucleotide sequences of LOC149832 BINDING SITE, designated SEQ ID:41078, to the nucleotide sequence of VGAM2715 RNA, herein designated VGAM RNA, also designated SEQ ID:5426.

Another function of VGAM2715 is therefore inhibition of LOC149832 (Accession XM_097733). Accordingly, utilities of VGAM2715 include diagnosis, prevention and treatment of diseases and clinical conditions associated with LOC149832. LOC151521 (Accession XM_098076) is another VGAM2715 host target gene. LOC151521 BINDING SITE is HOST TARGET binding site found in the 3' untranslated region of mRNA encoded by LOC151521, corresponding to a HOST TARGET binding site such as BINDING SITE I, BINDING SITE II or BINDING SITE III. Table 2 illustrates the complementarity of the nucleotide sequences of LOC151521 BINDING SITE, designated SEQ ID:41366, to the nucleotide sequence of VGAM2715 RNA, herein designated VGAM RNA, also designated SEQ ID:5426.

Another function of VGAM2715 is therefore inhibition of LOC151521 (Accession XM_098076). Accordingly, utilities of VGAM2715 include diagnosis, prevention and treatment of diseases and clinical conditions associated with LOC151521. LOC200325 (Accession XM_117223) is another VGAM2715 host target gene. LOC200325 BINDING SITE is HOST TARGET binding site found in the 5' untranslated region of mRNA encoded by LOC200325, corresponding to a HOST TARGET binding site such as BINDING SITE I, BINDING SITE II or BINDING SITE III. Table 2 illustrates the complementarity of the nucleotide sequences of LOC200325 BINDING SITE, designated SEQ ID:43287, to the nucleotide sequence of VGAM2715 RNA, herein designated VGAM RNA, also designated SEQ ID:5426.

Another function of VGAM2715 is therefore inhibition of LOC200325 (Accession XM_117223). Accordingly, utilities of VGAM2715 include diagnosis, prevention and treatment of diseases and clinical conditions associated with LOC200325. LOC90593 (Accession XM_032815) is another VGAM2715 host target gene. LOC90593 BINDING SITE is HOST TARGET binding site found in the 3' untranslated region of mRNA encoded by LOC90593, corresponding to a HOST TARGET binding site such as BINDING SITE I, BINDING SITE II or BINDING SITE III. Table 2 illustrates the complementarity of the nucleotide sequences of LOC90593 BINDING SITE, designated SEQ ID:31764, to the nucleotide sequence of VGAM2715 RNA, herein designated VGAM RNA, also designated SEQ ID:5426.

Another function of VGAM2715 is therefore inhibition of LOC90593 (Accession XM_032815). Accordingly, utilities of VGAM2715 include diagnosis, prevention and treatment of diseases and clinical conditions associated with LOC90593. LOC93259 (Accession XM_050105) is another VGAM2715 host target gene. LOC93259 BINDING SITE is HOST TARGET binding site found in the 5' untranslated region of mRNA encoded by LOC93259, corresponding to a HOST TARGET binding site such as BINDING SITE I, BINDING SITE II or BINDING SITE III. Table 2 illustrates the complementarity of the nucleotide sequences of LOC93259 BINDING SITE, designated SEQ ID:35556, to the nucleotide sequence of VGAM2715 RNA, herein designated VGAM RNA, also designated SEQ ID:5426.

Another function of VGAM2715 is therefore inhibition of LOC93259 (Accession XM_050105). Accordingly, utilities of VGAM2715 include diagnosis, prevention and treatment of diseases and clinical conditions associated with LOC93259. FIG. 1 further provides a conceptual description of a novel bioinformatically detected viral gene of the present invention, referred to here as Viral Genomic Address Messenger 2716 (VGAM2716) viral gene, which modulates expression of respective host target genes thereof, the function and utility of which host target genes is known in the art.

VGAM2716 is a novel bioinformatically detected regulatory, non protein coding, viral micro RNA (miRNA) gene. The method by which VGAM2716 was detected is described hereinabove with reference to FIGS. 1-8.

VGAM2716 gene, herein designated VGAM GENE, is a viral gene contained in the genome of Tacaribe Virus. VGAM2716 host target gene, herein designated VGAM HOST TARGET GENE, is a human gene contained in the human genome.

VGAM2716 gene encodes a VGAM2716 precursor RNA, herein designated VGAM PRECURSOR RNA. Similar to other miRNA genes, and unlike most ordinary genes, VGAM2716 precursor RNA does not encode a protein. A nucleotide sequence identical or highly similar to the nucleotide sequence of VGAM2716 precursor RNA is designated SEQ ID:2702, and is provided hereinbelow with reference to the sequence listing part. Nucleotide sequence SEQ ID:2702 is located at position 2511 relative to the genome of Tacaribe Virus.

VGAM2716 precursor RNA folds onto itself, forming VGAM2716 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2716 folded precursor RNA into VGAM2716 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 79%) nucleotide sequence of VGAM2716 RNA is designated SEQ ID:5427, and is provided hereinbelow with reference to the sequence listing part.

VGAM2716 host target gene, herein designated VGAM HOST TARGET GENE, encodes a corresponding messenger RNA, VGAM2716 host target RNA, herein designated VGAM HOST TARGET RNA. VGAM2716 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2716 RNA, herein designated VGAM RNA, binds complementarily to one or more host target binding sites located in untranslated regions of VGAM2716 host target RNA, herein designated VGAM HOST TARGET RNA. This complementary binding is due to the fact that the nucleotide sequence of VGAM2716 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2716 RNA, herein designated VGAM RNA, may have a different number of host target binding sites in untranslated regions of a VGAM2716 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2716 RNA, herein designated VGAM RNA, to host target binding sites on VGAM2716 host target RNA, herein designated VGAM HOST TARGET RNA, such as BINDING SITE I, BINDING SITE II and BINDING SITE III, inhibits translation of VGAM2716 host target RNA into VGAM2716 host target protein, herein designated VGAM HOST TARGET PROTEIN. VGAM host target protein is therefore outlined by a broken line.

It is appreciated that VGAM2716 host target gene, herein designated VGAM HOST TARGET GENE, in fact represents a plurality of VGAM2716 host target genes. The mRNA of each one of this plurality of VGAM2716 host target genes comprises one or more host target binding sites, each having a nucleotide sequence which is at least partly complementary to VGAM2716 RNA, herein designated VGAM RNA, and which when bound by VGAM2716 RNA causes inhibition of translation of respective one or more VGAM2716 host target proteins.

It is further appreciated by one skilled in the art that the mode of translational inhibition illustrated by FIG. 1 with specific reference to translational inhibition exerted by VGAM2716 gene, herein designated VGAM GENE, on one or more VGAM2716 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2716 is inhibition of expression of host target genes, as part of a novel viral mechanism of attacking a host. Accordingly, utilities of VGAM2716 include diagnosis, prevention and treatment of viral infection by Tacaribe Virus. Specific functions, and accordingly utilities, of VGAM2716 correlate with, and may be deduced from, the identity of the host target genes which VGAM2716 binds and inhibits, and the function of these host target genes, as elaborated hereinbelow.

Nucleotide sequences of the VGAM2716 precursor RNA, herein designated VGAM PRECURSOR RNA, and of the 'diced' VGAM2716 RNA, herein designated VGAM RNA, and a schematic representation of the secondary folding of VGAM2716 folded precursor RNA, herein designated VGAM FOLDED PRECURSOR RNA, of VGAM2716 are further described hereinbelow with reference to Table 1.

Nucleotide sequences of host target binding sites, such as BINDING SITE-I, BINDING SITE-II and BINDING SITE-III of FIG. 1, found on VGAM2716 host target RNA, and schematic representation of the complementarity of each of these host target binding sites to VGAM2716 RNA, herein designated VGAM RNA, are described hereinbelow with reference to Table 2.

As mentioned hereinabove with reference to FIG. 1, a function of VGAM2716 gene, herein designated VGAM is inhibition of expression of VGAM2716 target genes. It is appreciated that specific functions, and accordingly utilities, of VGAM2716 correlate with, and may be deduced from, the identity of the target genes which VGAM2716 binds and inhibits, and the function of these target genes, as elaborated hereinbelow.

Cadherin, EGF LAG Seven-pass G-type Receptor 2 (flamingo homolog, Drosophila) (CELSR2, Accession NM_001408) is a VGAM2716 host target gene. CELSR2 BINDING SITE is HOST TARGET binding site found in the 3' untranslated region of mRNA encoded by CELSR2, corresponding to a HOST TARGET binding site such as BINDING SITE I, BINDING SITE II or BINDING SITE III. Table 2 illustrates the complementarity of the nucleotide sequences of CELSR2 BINDING SITE, designated SEQ ID:7106, to the nucleotide sequence of VGAM2716 RNA, herein designated VGAM RNA, also designated SEQ ID:5427.

A function of VGAM2716 is therefore inhibition of Cadherin, EGF LAG Seven-pass G-type Receptor 2 (flamingo homolog, Drosophila) (CELSR2, Accession NM_001408), a gene which is a calcium dependent cell adhesion protein. Accordingly, utilities of VGAM2716 include diagnosis, prevention and treatment of diseases and clinical conditions associated with CELSR2. The function of CELSR2 and its association with various diseases and clinical conditions, has been established by previous studies, as described hereinabove with reference to VGAM432. ERAP140 (Accession XM_059748) is another VGAM2716 host target gene. ERAP140 BINDING SITE is HOST TARGET binding site found in the 3' untranslated region of mRNA encoded by ERAP140, corresponding to a HOST TARGET binding site such as BINDING SITE I, BINDING SITE II or BINDING SITE III. Table 2 illustrates the complementarity of the nucleotide sequences of ERAP140 BINDING SITE, designated SEQ ID:37085, to the nucleotide sequence of VGAM2716 RNA, herein designated VGAM RNA, also designated SEQ ID:5427.

Another function of VGAM2716 is therefore inhibition of ERAP140 (Accession XM_059748). Accordingly, utilities of VGAM2716 include diagnosis, prevention and treatment of diseases and clinical conditions associated with ERAP140. FLJ13910 (Accession NM_022780) is another VGAM2716 host target gene. FLJ13910 BINDING SITE is HOST TARGET binding site found in the 3' untranslated region of mRNA encoded by FLJ13910, corresponding to a HOST TARGET binding site such as BINDING SITE I, BINDING SITE II or BINDING SITE III. Table 2 illustrates the complementarity of the nucleotide sequences of FLJ13910 BINDING SITE, designated SEQ ID:23055, to the nucleotide sequence of VGAM2716 RNA, herein designated VGAM RNA, also designated SEQ ID:5427.

Another function of VGAM2716 is therefore inhibition of FLJ13910 (Accession NM_022780). Accordingly, utilities of VGAM2716 include diagnosis, prevention and treatment of diseases and clinical conditions associated with FLJ13910. HCA127 (Accession NM_018684) is another VGAM2716 host target gene. HCA127 BINDING SITE is HOST TARGET binding site found in the 3' untranslated region of mRNA encoded by HCA127, corresponding to a HOST TARGET binding site such as BINDING SITE I, BINDING SITE II or BINDING SITE III. Table 2 illustrates the complementarity of the nucleotide sequences of HCA127 BINDING SITE, designated SEQ ID:20759, to the nucleotide sequence of VGAM2716 RNA, herein designated VGAM RNA, also designated SEQ ID:5427.

Another function of VGAM2716 is therefore inhibition of HCA127 (Accession NM_018684). Accordingly, utilities of VGAM2716 include diagnosis, prevention and treatment of diseases and clinical conditions associated with HCA127. KIAA1009 (Accession NM_014895) is another VGAM2716 host target gene. KIAA1009 BINDING SITE is HOST TARGET binding site found in the 3' untranslated region of mRNA encoded by KIAA1009, corresponding to a HOST TARGET binding site such as BINDING SITE I, BINDING SITE II or BINDING SITE III. Table 2 illustrates the complementarity of the nucleotide sequences of KIAA1009 BINDING SITE, designated SEQ ID:17052, to the nucleotide sequence of VGAM2716 RNA, herein designated VGAM RNA, also designated SEQ ID:5427.

Another function of VGAM2716 is therefore inhibition of KIAA1009 (Accession NM_014895). Accordingly, utilities of VGAM2716 include diagnosis, prevention and treatment of diseases and clinical conditions associated with KIAA1009. Kv6.3 (Accession NM_133490) is another VGAM2716 host target gene. Kv6.3 BINDING SITE is HOST TARGET binding site found in the 3' untranslated region of mRNA encoded by Kv6.3, corresponding to a HOST TARGET binding site such as BINDING SITE I, BINDING SITE II or BINDING SITE III. Table 2 illustrates the complementarity of the nucleotide sequences of Kv6.3 BINDING SITE, designated SEQ ID:28566, to the nucleotide sequence of VGAM2716 RNA, herein designated VGAM RNA, also designated SEQ ID:5427.

Another function of VGAM2716 is therefore inhibition of Kv6.3 (Accession NM_133490). Accordingly, utilities of VGAM2716 include diagnosis, prevention and treatment of diseases and clinical conditions associated with Kv6.3. PRO0365 (Accession NM_014126) is another VGAM2716 host target gene. PRO0365 BINDING SITE is HOST TARGET binding site found in the 5' untranslated region of mRNA encoded by PRO0365, corresponding to a HOST TARGET binding site such as BINDING SITE I, BINDING SITE II or BINDING SITE III. Table 2 illustrates the complementarity of the nucleotide sequences of PRO0365 BINDING SITE, designated SEQ ID:15389, to the nucleotide sequence of VGAM2716 RNA, herein designated VGAM RNA, also designated SEQ ID:5427.

Another function of VGAM2716 is therefore inhibition of PRO0365 (Accession NM_014126). Accordingly, utilities of VGAM2716 include diagnosis, prevention and treatment of diseases and clinical conditions associated with PRO0365. LOC152742 (Accession XM_098259) is another VGAM2716 host target gene. LOC152742 BINDING SITE is HOST TARGET binding site found in the 3' untranslated region of mRNA encoded by LOC152742, corresponding to a HOST TARGET binding site such as BINDING SITE I, BINDING SITE II or BINDING SITE III. Table 2 illustrates the complementarity of the nucleotide sequences of LOC152742 BINDING SITE, designated SEQ ID:41544, to the nucleotide sequence of VGAM2716 RNA, herein designated VGAM RNA, also designated SEQ ID:5427.

Another function of VGAM2716 is therefore inhibition of LOC152742 (Accession XM_098259). Accordingly, utilities of VGAM2716 include diagnosis, prevention and treatment of diseases and clinical conditions associated with LOC152742. FIG. 1 further provides a conceptual description of a novel bioinformatically detected viral gene of the present invention, referred to here as Viral Genomic Address Messenger 2717 (VGAM2717) viral gene, which modulates expression of respective host target genes thereof, the function and utility of which host target genes is known in the art.

VGAM2717 is a novel bioinformatically detected regulatory, non protein coding, viral micro RNA (miRNA) gene. The method by which VGAM2717 was detected is described hereinabove with reference to FIGS. 1-8.

VGAM2717 gene, herein designated VGAM GENE, is a viral gene contained in the genome of Rachiplusia Ou Multiple Nucleopolyhedrovirus. VGAM2717 host target gene, herein designated VGAM HOST TARGET GENE, is a human gene contained in the human genome.

VGAM2717 gene encodes a VGAM2717 precursor RNA, herein designated VGAM PRECURSOR RNA. Similar to other miRNA genes, and unlike most ordinary genes, VGAM2717 precursor RNA does not encode a protein. A nucleotide sequence identical or highly similar to the nucleotide sequence of VGAM2717 precursor RNA is designated SEQ ID:2703, and is provided hereinbelow with reference to the sequence listing part. Nucleotide sequence SEQ ID:2703 is located at position 55572 relative to the genome of Rachiplusia Ou Multiple Nucleopolyhedrovirus.

VGAM2717 precursor RNA folds onto itself, forming VGAM2717 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2717 folded precursor RNA into VGAM2717 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2717 RNA is designated SEQ ID:5428, and is provided hereinbelow with reference to the sequence listing part.

VGAM2717 host target gene, herein designated VGAM HOST TARGET GENE, encodes a corresponding messenger RNA, VGAM2717 host target RNA, herein designated VGAM HOST TARGET RNA. VGAM2717 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2717 RNA, herein designated VGAM RNA, binds complementarily to one or more host target binding sites located in untranslated regions of VGAM2717 host target RNA, herein designated VGAM HOST TARGET RNA. This complementary binding is due to the fact that the nucleotide sequence of VGAM2717 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2717 RNA, herein designated VGAM RNA, may have a different number of host target binding sites in untranslated regions of a VGAM2717 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2717 RNA, herein designated VGAM RNA, to host target binding sites on VGAM2717 host target RNA, herein designated VGAM HOST TARGET RNA, such as BINDING SITE I, BINDING SITE II and BINDING SITE III, inhibits translation of VGAM2717 host target RNA into VGAM2717 host target protein, herein designated VGAM HOST TARGET PROTEIN. VGAM host target protein is therefore outlined by a broken line.

It is appreciated that VGAM2717 host target gene, herein designated VGAM HOST TARGET GENE, in fact represents a plurality of VGAM2717 host target genes. The mRNA of each one of this plurality of VGAM2717 host target genes comprises one or more host target binding sites, each having a nucleotide sequence which is at least partly complementary to VGAM2717 RNA, herein designated VGAM RNA, and which when bound by VGAM2717 RNA causes inhibition of translation of respective one or more VGAM2717 host target proteins.

It is further appreciated by one skilled in the art that the mode of translational inhibition illustrated by FIG. 1 with specific reference to translational inhibition exerted by VGAM2717 gene, herein designated VGAM GENE, on one or more VGAM2717 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2717 is inhibition of expression of host target genes, as part of a novel viral mechanism of attacking a host. Accordingly, utilities of VGAM2717 include diagnosis, prevention and treatment of viral infection by Rachiplusia Ou Multiple Nucleopolyhedrovirus. Specific functions, and accordingly utilities, of VGAM2717 correlate with, and may be deduced from, the identity of the host target genes which VGAM2717 binds and inhibits, and the function of these host target genes, as elaborated hereinbelow.

Nucleotide sequences of the VGAM2717 precursor RNA, herein designated VGAM PRECURSOR RNA, and of the 'diced' VGAM2717 RNA, herein designated VGAM RNA, and a schematic representation of the secondary folding of VGAM2717 folded precursor RNA, herein designated VGAM FOLDED PRECURSOR RNA, of VGAM2717 are further described hereinbelow with reference to Table 1.

Nucleotide sequences of host target binding sites, such as BINDING SITE-I, BINDING SITE-II and BINDING SITE-III of FIG. 1, found on VGAM2717 host target RNA, and schematic representation of the complementarity of each of these host target binding sites to VGAM2717 RNA, herein designated VGAM RNA, are described hereinbelow with reference to Table 2.

As mentioned hereinabove with reference to FIG. 1, a function of VGAM2717 gene, herein designated VGAM is inhibition of expression of VGAM2717 target genes. It is appreciated that specific functions, and accordingly utilities, of VGAM2717 correlate with, and may be deduced from, the identity of the target genes which VGAM2717 binds and inhibits, and the function of these target genes, as elaborated hereinbelow.

Zinc Finger Protein 265 (ZNF265, Accession NM_005455) is a VGAM2717 host target gene. ZNF265 BINDING SITE is HOST TARGET binding site found in the 3' untranslated region of mRNA encoded by ZNF265, corresponding to a HOST TARGET binding site such as BINDING SITE I, BINDING SITE II or BINDING SITE III. Table 2 illustrates the complementarity of the nucleotide sequences of ZNF265 BINDING SITE, designated SEQ ID:11940, to the nucleotide sequence of VGAM2717 RNA, herein designated VGAM RNA, also designated SEQ ID:5428.

A function of VGAM2717 is therefore inhibition of Zinc Finger Protein 265 (ZNF265, Accession NM_005455). Accordingly, utilities of VGAM2717 include diagnosis, prevention and treatment of diseases and clinical conditions associated with ZNF265. RNA Binding Motif Protein 9 (RBM9, Accession NM_014309) is another VGAM2717 host target gene. RBM9 BINDING SITE is HOST TARGET binding site found in the 3' untranslated region of mRNA encoded by RBM9, corresponding to a HOST TARGET binding site such as BINDING SITE I, BINDING SITE II or BINDING SITE III. Table 2 illustrates the complementarity of the nucleotide sequences of RBM9 BINDING SITE, designated SEQ ID:15597, to the nucleotide sequence of VGAM2717 RNA, herein designated VGAM RNA, also designated SEQ ID:5428.

Another function of VGAM2717 is therefore inhibition of RNA Binding Motif Protein 9 (RBM9, Accession NM_014309). Accordingly, utilities of VGAM2717 include diagnosis, prevention and treatment of diseases and clinical conditions associated with RBM9. Transcription Factor 6-like 1 (mitochondrial transcription factor 1-like) (TCF6L1, Accession NM_003201) is another VGAM2717 host target gene. TCF6L1 BINDING SITE is HOST TARGET binding site found in the 3' untranslated region of mRNA encoded by TCF6L1, corresponding to a HOST TARGET binding site such as BINDING SITE I, BINDING SITE II or BINDING SITE III. Table 2 illustrates the complementarity of the nucleotide sequences of TCF6L1 BINDING SITE, designated SEQ ID:9189, to the nucleotide sequence of VGAM2717 RNA, herein designated VGAM RNA, also designated SEQ ID:5428.

Another function of VGAM2717 is therefore inhibition of Transcription Factor 6-like 1 (mitochondrial transcription factor 1-like) (TCF6L1, Accession NM_003201). Accordingly, utilities of VGAM2717 include diagnosis, prevention and treatment of diseases and clinical conditions associated with TCF6L1. LOC120526 (Accession XM_058475) is another VGAM2717 host target gene. LOC120526 BINDING SITE is HOST TARGET binding site found in the 3' untranslated region of mRNA encoded by LOC120526, corresponding to a HOST TARGET binding site such as BINDING SITE I, BINDING SITE II or BINDING SITE III. Table 2 illustrates the complementarity of the nucleotide sequences of LOC120526 BINDING SITE, designated SEQ ID:36622, to the nucleotide sequence of VGAM2717 RNA, herein designated VGAM RNA, also designated SEQ ID:5428.

Another function of VGAM2717 is therefore inhibition of LOC120526 (Accession XM_058475). Accordingly, utilities of VGAM2717 include diagnosis, prevention and treatment of diseases and clinical conditions associated with LOC120526. LOC202266 (Accession XM_117373) is another VGAM2717 host target gene. LOC202266 BINDING SITE is HOST TARGET binding site found in the 3' untranslated region of mRNA encoded by LOC202266, corresponding to a HOST TARGET binding site such as BINDING SITE I, BINDING SITE II or BINDING SITE III. Table 2 illustrates the complementarity of the nucleotide sequences of LOC202266 BINDING SITE, designated SEQ ID:43420, to the nucleotide sequence of VGAM2717 RNA, herein designated VGAM RNA, also designated SEQ ID:5428.

Another function of VGAM2717 is therefore inhibition of LOC202266 (Accession XM_117373). Accordingly, utilities of VGAM2717 include diagnosis, prevention and treatment of diseases and clinical conditions associated with LOC202266. FIG. 1 further provides a conceptual description of a novel bioinformatically detected viral gene of the present invention, referred to here as Viral Genomic Address Messenger 2718 (VGAM2718) viral gene, which modulates expression of respective host target genes thereof, the function and utility of which host target genes is known in the art.

VGAM2718 is a novel bioinformatically detected regulatory, non protein coding, viral micro RNA (miRNA) gene. The method by which VGAM2718 was detected is described hereinabove with reference to FIGS. 1-8.

VGAM2718 gene, herein designated VGAM GENE, is a viral gene contained in the genome of Rachiplusia Ou Multiple Nucleopolyhedrovirus. VGAM2718 host target gene, herein designated VGAM HOST TARGET GENE, is a human gene contained in the human genome.

VGAM2718 gene encodes a VGAM2718 precursor RNA, herein designated VGAM PRECURSOR RNA. Similar to other miRNA genes, and unlike most ordinary genes, VGAM2718 precursor RNA does not encode a protein. A nucleotide sequence identical or highly similar to the nucleotide sequence of VGAM2718 precursor RNA is designated SEQ ID:2704, and is provided hereinbelow with reference to the sequence listing part. Nucleotide sequence SEQ ID:2704 is located at position 55389 relative to the genome of Rachiplusia Ou Multiple Nucleopolyhedrovirus.

VGAM2718 precursor RNA folds onto itself, forming VGAM2718 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2718 folded precursor RNA into VGAM2718 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 56%) nucleotide sequence of VGAM2718 RNA is designated SEQ ID:5429, and is provided hereinbelow with reference to the sequence listing part.

VGAM2718 host target gene, herein designated VGAM HOST TARGET GENE, encodes a corresponding messenger RNA, VGAM2718 host target RNA, herein designated VGAM HOST TARGET RNA. VGAM2718 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2718 RNA, herein designated VGAM RNA, binds complementarily to one or more host target binding sites located in untranslated regions of VGAM2718 host target RNA, herein designated VGAM HOST TARGET RNA. This complementary binding is due to the fact that the nucleotide sequence of VGAM2718 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2718 RNA, herein designated VGAM RNA, may have a different number of host target binding sites in untranslated regions of a VGAM2718 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2718 RNA, herein designated VGAM RNA, to host target binding sites on VGAM2718 host target RNA, herein designated VGAM HOST TARGET RNA, such as BINDING SITE I, BINDING SITE II and BINDING SITE III, inhibits translation of VGAM2718 host target RNA into VGAM2718 host target protein, herein designated VGAM HOST TARGET PROTEIN. VGAM host target protein is therefore outlined by a broken line.

It is appreciated that VGAM2718 host target gene, herein designated VGAM HOST TARGET GENE, in fact represents a plurality of VGAM2718 host target genes. The mRNA of each one of this plurality of VGAM2718 host target genes comprises one or more host target binding sites, each having a nucleotide sequence which is at least partly complementary to VGAM2718 RNA, herein designated VGAM RNA, and which when bound by VGAM2718 RNA causes inhibition of translation of respective one or more VGAM2718 host target proteins.

It is further appreciated by one skilled in the art that the mode of translational inhibition illustrated by FIG. 1 with specific reference to translational inhibition exerted by VGAM2718 gene, herein designated VGAM GENE, on one or more VGAM2718 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2718 is inhibition of expression of host target genes, as part of a novel viral mechanism of attacking a host. Accordingly, utilities of VGAM2718 include diagnosis, prevention and treatment of viral infection by Rachiplusia Ou Multiple Nucleopolyhedrovirus. Specific functions, and accordingly utilities, of VGAM2718 correlate with, and may be deduced from, the identity of the host target genes which VGAM2718 binds and inhibits, and the function of these host target genes, as elaborated hereinbelow.

Nucleotide sequences of the VGAM2718 precursor RNA, herein designated VGAM PRECURSOR RNA, and of the 'diced' VGAM2718 RNA, herein designated VGAM RNA, and a schematic representation of the secondary folding of VGAM2718 folded precursor RNA, herein designated VGAM FOLDED PRECURSOR RNA, of VGAM2718 are further described hereinbelow with reference to Table 1.

Nucleotide sequences of host target binding sites, such as BINDING SITE-I, BINDING SITE-II and BINDING SITE-III of FIG. 1, found on VGAM2718 host target RNA, and schematic representation of the complementarity of each of these host target binding sites to VGAM2718 RNA, herein designated VGAM RNA, are described hereinbelow with reference to Table 2.

As mentioned hereinabove with reference to FIG. 1, a function of VGAM2718 gene, herein designated VGAM is inhibition of expression of VGAM2718 target genes. It is appreciated that specific functions, and accordingly utilities, of VGAM2718 correlate with, and may be deduced from, the identity of the target genes which VGAM2718 binds and inhibits, and the function of these target genes, as elaborated hereinbelow.

BTB and CNC Homology 1, Basic Leucine Zipper Transcription Factor 2 (BACH2, Accession NM_021813) is a VGAM2718 host target gene. BACH2 BINDING SITE is HOST TARGET binding site found in the 5' untranslated region of mRNA encoded by BACH2, corresponding to a HOST TARGET binding site such as BINDING SITE I, BINDING SITE II or BINDING SITE III. Table 2 illustrates the complementarity of the nucleotide sequences of BACH2 BINDING SITE, designated SEQ ID:22383, to the nucleotide sequence of VGAM2718 RNA, herein designated VGAM RNA, also designated SEQ ID:5429.

A function of VGAM2718 is therefore inhibition of BTB and CNC Homology 1, Basic Leucine Zipper Transcription Factor 2 (BACH2, Accession NM_021813), a gene which acts as repressor or activator, binds to maf recognition elements. Accordingly, utilities of VGAM2718 include diagnosis, prevention and treatment of diseases and clinical conditions associated with BACH2. The function of BACH2 and its association with various diseases and clinical conditions, has been established by previous studies, as described hereinabove with reference to VGAM331. Kinesin Family Member 5C (KIF5C, Accession NM_004522) is another VGAM2718 host target gene. KIF5C BINDING SITE is HOST TARGET binding site found in the 3' untranslated region of mRNA encoded by KIF5C, corresponding to a HOST TARGET binding site such as BINDING SITE I, BINDING SITE II or BINDING SITE III. Table 2 illustrates the complementarity of the nucleotide sequences of KIF5C BINDING SITE, designated SEQ ID:10857, to the nucleotide sequence of VGAM2718 RNA, herein designated VGAM RNA, also designated SEQ ID:5429.

Another function of VGAM2718 is therefore inhibition of Kinesin Family Member 5C (KIF5C, Accession NM_004522). Accordingly, utilities of VGAM2718 include diagnosis, prevention and treatment of diseases and clinical conditions associated with KIF5C. Phosphorylase Kinase, Alpha 2 (liver) (PHKA2, Accession NM_000292) is another VGAM2718 host target gene. PHKA2 BINDING SITE is HOST TARGET binding site found in the 3' untranslated region of mRNA encoded by PHKA2, corresponding to a HOST TARGET binding site such as BINDING SITE I, BINDING SITE II or BINDING SITE III. Table 2 illustrates the complementarity of the nucleotide sequences of PHKA2 BINDING SITE, designated SEQ ID:5836, to the nucleotide sequence of VGAM2718 RNA, herein designated VGAM RNA, also designated SEQ ID:5429.

Another function of VGAM2718 is therefore inhibition of Phosphorylase Kinase, Alpha 2 (liver) (PHKA2, Accession NM_000292). Accordingly, utilities of VGAM2718 include diagnosis, prevention and treatment of diseases and clinical conditions associated with PHKA2. Bromodomain Containing 3 (BRD3, Accession NM_007371) is another VGAM2718 host target gene. BRD3 BINDING SITE is HOST TARGET binding site found in the 3' untranslated region of mRNA encoded by BRD3, corresponding to a HOST TARGET binding site such as BINDING SITE I, BINDING SITE II or BINDING SITE III. Table 2 illustrates the complementarity of the nucleotide sequences of BRD3 BINDING SITE, designated SEQ ID:14298, to the nucleotide sequence of VGAM2718 RNA, herein designated VGAM RNA, also designated SEQ ID:5429.

Another function of VGAM2718 is therefore inhibition of Bromodomain Containing 3 (BRD3, Accession NM_007371). Accordingly, utilities of VGAM2718 include diagnosis, prevention and treatment of diseases and clinical conditions associated with BRD3. Chromosome 1 Open Reading Frame 28 (C1orf28, Accession NM_024529) is another VGAM2718 host target gene. C1orf28 BINDING SITE is HOST TARGET binding site found in the 3' untranslated region of mRNA encoded by C1orf28, corresponding to a HOST TARGET binding site such as BINDING SITE I, BINDING SITE II or BINDING SITE III. Table 2 illustrates the complementarity of the nucleotide sequences of C1orf28 BINDING SITE, designated SEQ ID:23732, to the nucleotide sequence of VGAM2718 RNA, herein designated VGAM RNA, also designated SEQ ID:5429.

Another function of VGAM2718 is therefore inhibition of Chromosome 1 Open Reading Frame 28 (C1orf28, Accession NM_024529). Accordingly, utilities of VGAM2718 include diagnosis, prevention and treatment of diseases and clinical conditions associated with C1orf28. DCOHM (Accession NM_032151) is another VGAM2718 host target gene. DCOHM BINDING SITE is HOST TARGET binding site found in the 3' untranslated region of mRNA encoded by DCOHM, corresponding to a HOST TARGET binding site such as BINDING SITE I, BINDING SITE II or BINDING SITE III. Table 2 illustrates the complementarity of the nucleotide sequences of DCOHM BINDING SITE, designated SEQ ID:25846, to the nucleotide sequence of VGAM2718 RNA, herein designated VGAM RNA, also designated SEQ ID:5429.

Another function of VGAM2718 is therefore inhibition of DCOHM (Accession NM_032151). Accordingly, utilities of VGAM2718 include diagnosis, prevention and treatment of diseases and clinical conditions associated with DCOHM. FLJ10726 (Accession NM_018195) is another VGAM2718 host target gene. FLJ10726 BINDING SITE is HOST TARGET binding site found in the 3' untranslated region of mRNA encoded by FLJ10726, corresponding to a HOST TARGET binding site such as BINDING SITE I, BINDING SITE II or BINDING SITE III. Table 2 illustrates the complementarity of the nucleotide sequences of FLJ10726 BINDING SITE, designated SEQ ID:20060, to the nucleotide sequence of VGAM2718 RNA, herein designated VGAM RNA, also designated SEQ ID:5429.

Another function of VGAM2718 is therefore inhibition of FLJ10726 (Accession NM_018195). Accordingly, utilities of VGAM2718 include diagnosis, prevention and treatment of diseases and clinical conditions associated with FLJ10726. FLJ20986 (Accession NM_024524) is another VGAM2718 host target gene. FLJ20986 BINDING SITE is HOST TARGET binding site found in the 5' untranslated region of mRNA encoded by FLJ20986, corresponding to a HOST TARGET binding site such as BINDING SITE I, BINDING SITE II or BINDING SITE III. Table 2 illustrates the complementarity of the nucleotide sequences of FLJ20986 BINDING SITE, designated SEQ ID:23730, to the nucleotide sequence of VGAM2718 RNA, herein designated VGAM RNA, also designated SEQ ID:5429.

Another function of VGAM2718 is therefore inhibition of FLJ20986 (Accession NM_024524). Accordingly, utilities of VGAM2718 include diagnosis, prevention and treatment of diseases and clinical conditions associated with FLJ20986. FLJ22004 (Accession NM_025181) is another VGAM2718 host target gene. FLJ22004 BINDING SITE is HOST TARGET binding site found in the 3' untranslated region of mRNA encoded by FLJ22004, corresponding to a HOST TARGET binding site such as BINDING SITE I, BINDING SITE II or BINDING SITE III. Table 2 illustrates the complementarity of the nucleotide sequences of FLJ22004 BINDING SITE, designated SEQ ID:24818, to the nucleotide sequence of VGAM2718 RNA, herein designated VGAM RNA, also designated SEQ ID:5429.

Another function of VGAM2718 is therefore inhibition of FLJ22004 (Accession NM_025181). Accordingly, utilities of VGAM2718 include diagnosis, prevention and treatment of diseases and clinical conditions associated with FLJ22004. FLJ23129 (Accession NM_024763) is another VGAM2718 host target gene. FLJ23129 BINDING SITE is HOST TARGET binding site found in the 3' untranslated region of mRNA encoded by FLJ23129, corresponding to a HOST TARGET binding site such as BINDING SITE I, BINDING SITE II or BINDING SITE III. Table 2 illustrates the complementarity of the nucleotide sequences of FLJ23129 BINDING SITE, designated SEQ ID:24120, to the nucleotide sequence of VGAM2718 RNA, herein designated VGAM RNA, also designated SEQ ID:5429.

Another function of VGAM2718 is therefore inhibition of FLJ23129 (Accession NM_024763). Accordingly, utilities of VGAM2718 include diagnosis, prevention and treatment of diseases and clinical conditions associated with FLJ23129. KIAA0459 (Accession XM_027862) is another VGAM2718 host target gene. KIAA0459 BINDING SITE is HOST TARGET binding site found in the 3' untranslated region of mRNA encoded by KIAA0459, corresponding to a HOST TARGET binding site such as BINDING SITE I, BINDING SITE II or BINDING SITE III. Table 2 illustrates the complementarity of the nucleotide sequences of KIAA0459 BINDING SITE, designated SEQ ID:30580, to the nucleotide sequence of VGAM2718 RNA, herein designated VGAM RNA, also designated SEQ ID:5429.

Another function of VGAM2718 is therefore inhibition of KIAA0459 (Accession XM_027862). Accordingly, utilities of VGAM2718 include diagnosis, prevention and treatment of diseases and clinical conditions associated with KIAA0459. Mitogen-activated Protein Kinase Kinase Kinase Kinase 3 (MAP4K3, Accession NM_003618) is another VGAM2718 host target gene. MAP4K3 BINDING SITE is HOST TARGET binding site found in the 3' untranslated region of mRNA encoded by MAP4K3, corresponding to a HOST TARGET binding site such as BINDING SITE I, BINDING SITE II or BINDING SITE III. Table 2 illustrates the complementarity of the nucleotide sequences of MAP4K3 BINDING SITE, designated SEQ ID:9684, to the nucleotide sequence of VGAM2718 RNA, herein designated VGAM RNA, also designated SEQ ID:5429.

Another function of VGAM2718 is therefore inhibition of Mitogen-activated Protein Kinase Kinase Kinase Kinase 3 (MAP4K3, Accession NM_003618). Accordingly, utilities of VGAM2718 include diagnosis, prevention and treatment of diseases and clinical conditions associated with MAP4K3. MGC2217 (Accession NM_024300) is another VGAM2718 host target gene. MGC2217 BINDING SITE is HOST TARGET binding site found in the 3' untranslated region of mRNA encoded by MGC2217, corresponding to a HOST TARGET binding site such as BINDING SITE I, BINDING SITE II or BINDING SITE III. Table 2 illustrates the complementarity of the nucleotide sequences of MGC2217 BINDING SITE, designated SEQ ID:23590, to the nucleotide sequence of VGAM2718 RNA, herein designated VGAM RNA, also designated SEQ ID:5429.

Another function of VGAM2718 is therefore inhibition of MGC2217 (Accession NM_024300). Accordingly, utilities of VGAM2718 include diagnosis, prevention and treatment of diseases and clinical conditions associated with MGC2217. Protocadherin 17 (PCDH17, Accession NM_014459) is another VGAM2718 host target gene. PCDH17 BINDING SITE is HOST TARGET binding site found in the 3' untranslated region of mRNA encoded by PCDH17, corresponding to a HOST TARGET binding site such as BINDING SITE I, BINDING SITE II or BINDING SITE III. Table 2 illustrates the complementarity of the nucleotide sequences of PCDH17 BINDING SITE, designated SEQ ID:15815, to the nucleotide sequence of VGAM2718 RNA, herein designated VGAM RNA, also designated SEQ ID:5429.

Another function of VGAM2718 is therefore inhibition of Protocadherin 17 (PCDH17, Accession NM_014459). Accordingly, utilities of VGAM2718 include diagnosis, prevention and treatment of diseases and clinical conditions associated with PCDH17. Syntaxin 6 (STX6, Accession NM_005819) is another VGAM2718 host target gene. STX6 BINDING SITE is HOST TARGET binding site found in the 3' untranslated region of mRNA encoded by STX6, corresponding to a HOST TARGET binding site such as BINDING SITE I, BINDING SITE II or BINDING SITE III. Table 2 illustrates the complementarity of the nucleotide sequences of STX6 BINDING SITE, designated SEQ ID:12421, to the nucleotide sequence of VGAM2718 RNA, herein designated VGAM RNA, also designated SEQ ID:5429.

Another function of VGAM2718 is therefore inhibition of Syntaxin 6 (STX6, Accession NM_005819). Accordingly, utilities of VGAM2718 include diagnosis, prevention and treatment of diseases and clinical conditions associated with STX6. LOC145624 (Accession XM_096824) is another VGAM2718 host target gene. LOC145624 BINDING SITE is HOST TARGET binding site found in the 5' untranslated region of mRNA encoded by LOC145624, corresponding to a HOST TARGET binding site such as BINDING SITE I, BINDING SITE II or BINDING SITE III. Table 2 illustrates the complementarity of the nucleotide sequences of LOC145624 BINDING SITE, designated SEQ ID:40550, to the nucleotide sequence of VGAM2718 RNA, herein designated VGAM RNA, also designated SEQ ID:5429.

Another function of VGAM2718 is therefore inhibition of LOC145624 (Accession XM_096824). Accordingly, utilities of VGAM2718 include diagnosis, prevention and treatment of diseases and clinical conditions associated with LOC145624. LOC146909 (Accession XM_085634) is another VGAM2718 host target gene. LOC146909 BINDING SITE is HOST TARGET binding site found in the 3' untranslated region of mRNA encoded by LOC146909, corresponding to a HOST TARGET binding site such as BINDING SITE I, BINDING SITE II or BINDING SITE III. Table 2 illustrates the complementarity of the nucleotide sequences of LOC146909 BINDING SITE, designated SEQ ID:38274, to the nucleotide sequence of VGAM2718 RNA, herein designated VGAM RNA, also designated SEQ ID:5429.

Another function of VGAM2718 is therefore inhibition of LOC146909 (Accession XM_085634). Accordingly, utilities of VGAM2718 include diagnosis, prevention and treatment of diseases and clinical conditions associated with LOC146909. LOC152742 (Accession XM_098259) is another VGAM2718 host target gene. LOC152742 BINDING SITE is HOST TARGET binding site found in the 3' untranslated region of mRNA encoded by LOC152742, corresponding to a HOST TARGET binding site such as BINDING SITE I, BINDING SITE II or BINDING SITE III. Table 2 illustrates the complementarity of the nucleotide sequences of LOC152742 BINDING SITE, designated SEQ ID:41546, to the nucleotide sequence of VGAM2718 RNA, herein designated VGAM RNA, also designated SEQ ID:5429.

Another function of VGAM2718 is therefore inhibition of LOC152742 (Accession XM_098259). Accordingly, utilities of VGAM2718 include diagnosis, prevention and treatment of diseases and clinical conditions associated with LOC152742. LOC158435 (Accession NM_138497) is another VGAM2718 host target gene. LOC158435 BINDING SITE is HOST TARGET binding site found in the 3' untranslated region of mRNA encoded by LOC158435, corresponding to a HOST TARGET binding site such as BINDING SITE I, BINDING SITE II or BINDING SITE III. Table 2 illustrates the complementarity of the nucleotide sequences of LOC158435 BINDING SITE, designated SEQ ID:28847, to the nucleotide sequence of VGAM2718 RNA, herein designated VGAM RNA, also designated SEQ ID:5429.

Another function of VGAM2718 is therefore inhibition of LOC158435 (Accession NM_138497). Accordingly, utilities of VGAM2718 include diagnosis, prevention and treatment of diseases and clinical conditions associated with LOC158435. LOC219649 (Accession XM_167562) is another VGAM2718 host target gene. LOC219649 BINDING SITE is HOST TARGET binding site found in the 3' untranslated region of mRNA encoded by LOC219649, corresponding to a HOST TARGET binding site such as BINDING SITE I, BINDING SITE II or BINDING SITE III. Table 2 illustrates the complementarity of the nucleotide sequences of LOC219649 BINDING SITE, designated SEQ ID:44670, to the nucleotide sequence of VGAM2718 RNA, herein designated VGAM RNA, also designated SEQ ID:5429.

Another function of VGAM2718 is therefore inhibition of LOC219649 (Accession XM_167562). Accordingly, utilities of VGAM2718 include diagnosis, prevention and treatment of diseases and clinical conditions associated with LOC219649. LOC219940 (Accession XM_167791) is another VGAM2718 host target gene. LOC219940 BINDING SITE is HOST TARGET binding site found in the 3' untranslated region of mRNA encoded by LOC219940, corresponding to a HOST TARGET binding site such as BINDING SITE I, BINDING SITE II or BINDING SITE III. Table 2 illustrates the complementarity of the nucleotide sequences of LOC219940 BINDING SITE, designated SEQ ID:44831, to the nucleotide sequence of VGAM2718 RNA, herein designated VGAM RNA, also designated SEQ ID:5429.

Another function of VGAM2718 is therefore inhibition of LOC219940 (Accession XM_167791). Accordingly, utilities of VGAM2718 include diagnosis, prevention and treatment of diseases and clinical conditions associated with LOC219940. LOC93613 (Accession XM_052568) is another VGAM2718 host target gene. LOC93613 BINDING SITE is HOST TARGET binding site found in the 3' untranslated region of mRNA encoded by LOC93613, corresponding to a HOST TARGET binding site such as BINDING SITE I, BINDING SITE II or BINDING SITE III. Table 2 illustrates the complementarity of the nucleotide sequences of LOC93613 BINDING SITE, designated SEQ ID:35998, to the nucleotide sequence of VGAM2718 RNA, herein designated VGAM RNA, also designated SEQ ID:5429.

Another function of VGAM2718 is therefore inhibition of LOC93613 (Accession XM_052568). Accordingly, utilities of VGAM2718 include diagnosis, prevention and treatment of diseases and clinical conditions associated with LOC93613. FIG. 1 further provides a conceptual description of a novel bioinformatically detected viral gene of the present invention, referred to here as Viral Genomic Address Messenger 2719 (VGAM2719) viral gene, which modulates expression of respective host target genes thereof, the function and utility of which host target genes is known in the art.

VGAM2719 is a novel bioinformatically detected regulatory, non protein coding, viral micro RNA (miRNA) gene. The method by which VGAM2719 was detected is described hereinabove with reference to FIGS. 1-8.

VGAM2719 gene, herein designated VGAM GENE, is a viral gene contained in the genome of Aphid Lethal Paralysis Virus. VGAM2719 host target gene, herein designated VGAM HOST TARGET GENE, is a human gene contained in the human genome.

VGAM2719 gene encodes a VGAM2719 precursor RNA, herein designated VGAM PRECURSOR RNA. Similar to other miRNA genes, and unlike most ordinary genes, VGAM2719 precursor RNA does not encode a protein. A nucleotide sequence identical or highly similar to the nucleotide sequence of VGAM2719 precursor RNA is designated SEQ ID:2705, and is provided hereinbelow with reference to the sequence listing part. Nucleotide sequence SEQ ID:2705 is located at position 5960 relative to the genome of Aphid Lethal Paralysis Virus.

VGAM2719 precursor RNA folds onto itself, forming VGAM2719 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2719 folded precursor RNA into VGAM2719 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 57%) nucleotide sequence of VGAM2719 RNA is designated SEQ ID:5430, and is provided hereinbelow with reference to the sequence listing part.

VGAM2719 host target gene, herein designated VGAM HOST TARGET GENE, encodes a corresponding messenger RNA, VGAM2719 host target RNA, herein designated VGAM HOST TARGET RNA. VGAM2719 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2719 RNA, herein designated VGAM RNA, binds complementarily to one or more host target binding sites located in untranslated regions of VGAM2719 host target RNA, herein designated VGAM HOST TARGET RNA. This complementary binding is due to the fact that the nucleotide sequence of VGAM2719 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2719 RNA, herein designated VGAM RNA, may have a different number of host target binding sites in untranslated regions of a VGAM2719 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2719 RNA, herein designated VGAM RNA, to host target binding sites on VGAM2719 host target RNA, herein designated VGAM HOST TARGET RNA, such as BINDING SITE I, BINDING SITE II and BINDING SITE III, inhibits translation of VGAM2719 host target RNA into VGAM2719 host target protein, herein designated VGAM HOST TARGET PROTEIN. VGAM host target protein is therefore outlined by a broken line.

It is appreciated that VGAM2719 host target gene, herein designated VGAM HOST TARGET GENE, in fact represents a plurality of VGAM2719 host target genes. The mRNA of each one of this plurality of VGAM2719 host target genes comprises one or more host target binding sites, each having a nucleotide sequence which is at least partly complementary to VGAM2719 RNA, herein designated VGAM RNA, and which when bound by VGAM2719 RNA causes inhibition of translation of respective one or more VGAM2719 host target proteins.

It is further appreciated by one skilled in the art that the mode of translational inhibition illustrated by FIG. 1 with specific reference to translational inhibition exerted by VGAM2719 gene, herein designated VGAM GENE, on one or more VGAM2719 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2719 is inhibition of expression of host target genes, as part of a novel viral mechanism of attacking a host. Accordingly, utilities of VGAM2719 include diagnosis, prevention and treatment of viral infection by Aphid Lethal Paralysis Virus. Specific functions, and accordingly utilities, of VGAM2719 correlate with, and may be deduced from, the identity of the host target genes which VGAM2719 binds and inhibits, and the function of these host target genes, as elaborated hereinbelow.

Nucleotide sequences of the VGAM2719 precursor RNA, herein designated VGAM PRECURSOR RNA, and of the 'diced' VGAM2719 RNA, herein designated VGAM RNA, and a schematic representation of the secondary folding of VGAM2719 folded precursor RNA, herein designated VGAM FOLDED PRECURSOR RNA, of VGAM2719 are further described hereinbelow with reference to Table 1.

Nucleotide sequences of host target binding sites, such as BINDING SITE-I, BINDING SITE-II and BINDING SITE-III of FIG. 1, found on VGAM2719 host target RNA, and schematic representation of the complementarity of each of these host target binding sites to VGAM2719 RNA, herein designated VGAM RNA, are described hereinbelow with reference to Table 2.

As mentioned hereinabove with reference to FIG. 1, a function of VGAM2719 gene, herein designated VGAM is inhibition of expression of VGAM2719 target genes. It is appreciated that specific functions, and accordingly utilities, of VGAM2719 correlate with, and may be deduced from, the identity of the target genes which VGAM2719 binds and inhibits, and the function of these target genes, as elaborated hereinbelow.

Serine (or cysteine) Proteinase Inhibitor, Clade B (ovalbumin), Member 9 (SERPINB9, Accession NM_004155) is a VGAM2719 host target gene. SERPINB9 BINDING SITE is a HOST TARGET binding site found in the 3" untranslated region of mRNA encoded by SERPINB9, corresponding to a HOST TARGET binding site such as BINDING SITE I, BINDING SITE II or BINDING SITE III. Table 2 illustrates the complementarity of the nucleotide sequences of SERPINB9 BINDING SITE, designated SEQ ID:10358, to the nucleotide sequence of VGAM2719 RNA, herein designated VGAM RNA, also designated SEQ ID:5430.

A function of VGAM2719 is therefore inhibition of Serine (or cysteine) Proteinase Inhibitor, Clade B (ovalbumin), Member 9 (SERPINB9, Accession NM_004155), a gene which may be a serpin serine protease inhibitor that interacts with granzyme B (GZMB). Accordingly, utilities of VGAM2719 include diagnosis, prevention and treatment of diseases and clinical conditions associated with SERPINB9. The function of SERPINB9 and its association with various diseases and clinical conditions, has been established by previous studies, as described hereinabove with reference to VGAM60. T-complex-associated-testis-expressed 1-like (TCTE1L, Accession XM_048205) is another VGAM2719 host target gene. TCTE1L BINDING SITE is HOST TARGET binding site found in the 3' untranslated region of mRNA encoded by TCTE1L, corresponding to a HOST TARGET binding site such as BINDING SITE I, BINDING SITE II or BINDING SITE III. Table 2 illustrates the complementarity of the nucleotide sequences of TCTE1L BINDING SITE, designated SEQ ID:35141, to the nucleotide sequence of VGAM2719 RNA, herein designated VGAM RNA, also designated SEQ ID:5430.

Another function of VGAM2719 is therefore inhibition of T-complex-associated-testis-expressed 1-like (TCTE1L, Accession XM_048205). Accordingly, utilities of VGAM2719 include diagnosis, prevention and treatment of diseases and clinical conditions associated with TCTE1L. KIAA0318 (Accession XM_044334) is another VGAM2719 host target gene. KIAA0318 BINDING SITE is HOST TARGET binding site found in the 3' untranslated region of mRNA encoded by KIAA0318, corresponding to a HOST TARGET binding site such as BINDING SITE I, BINDING SITE II or BINDING SITE III. Table 2 illustrates the complementarity of the nucleotide sequences of KIAA0318 BINDING SITE, designated SEQ ID:34182, to the nucleotide sequence of VGAM2719 RNA, herein designated VGAM RNA, also designated SEQ ID:5430.

Another function of VGAM2719 is therefore inhibition of KIAA0318 (Accession XM_044334). Accordingly, utilities of VGAM2719 include diagnosis, prevention and treatment of diseases and clinical conditions associated with KIAA0318. FIG. 1 further provides a conceptual description of a novel bioinformatically detected viral gene of the present invention, referred to here as Viral Genomic Address Messenger 2720 (VGAM2720) viral gene, which modulates expression of respective host target genes thereof, the function and utility of which host target genes is known in the art.

VGAM2720 is a novel bioinformatically detected regulatory, non protein coding, viral micro RNA (miRNA) gene. The method by which VGAM2720 was detected is described hereinabove with reference to FIGS. 1-8.

VGAM2720 gene, herein designated VGAM GENE, is a viral gene contained in the genome of Aphid Lethal Paralysis Virus. VGAM2720 host target gene, herein designated VGAM HOST TARGET GENE, is a human gene contained in the human genome.

VGAM2720 gene encodes a VGAM2720 precursor RNA, herein designated VGAM PRECURSOR RNA. Similar to other miRNA genes, and unlike most ordinary genes, VGAM2720 precursor RNA does not encode a protein. A nucleotide sequence identical or highly similar to the nucleotide sequence of VGAM2720 precursor RNA is designated SEQ ID:2706, and is provided hereinbelow with reference to the sequence listing part. Nucleotide sequence SEQ ID:2706 is located at position 4386 relative to the genome of Aphid Lethal Paralysis Virus.

VGAM2720 precursor RNA folds onto itself, forming VGAM2720 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2720 folded precursor RNA into VGAM2720 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 40%) nucleotide sequence of VGAM2720 RNA is designated SEQ ID:5431, and is provided hereinbelow with reference to the sequence listing part.

VGAM2720 host target gene, herein designated VGAM HOST TARGET GENE, encodes a corresponding messenger RNA, VGAM2720 host target RNA, herein designated VGAM HOST TARGET RNA. VGAM2720 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2720 RNA, herein designated VGAM RNA, binds complementarily to one or more host target binding sites located in untranslated regions of VGAM2720 host target RNA, herein designated VGAM HOST TARGET RNA. This complementary binding is due to the fact that the nucleotide sequence of VGAM2720 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2720 RNA, herein designated VGAM RNA, may have a different number of host target binding sites in untranslated regions of a VGAM2720 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2720 RNA, herein designated VGAM RNA, to host target binding sites on VGAM2720 host target RNA, herein designated VGAM HOST TARGET RNA, such as BINDING SITE I, BINDING SITE II and BINDING SITE III, inhibits translation of VGAM2720 host target RNA into VGAM2720 host target protein, herein designated VGAM HOST TARGET PROTEIN. VGAM host target protein is therefore outlined by a broken line.

It is appreciated that VGAM2720 host target gene, herein designated VGAM HOST TARGET GENE, in fact represents a plurality of VGAM2720 host target genes. The mRNA of each one of this plurality of VGAM2720 host target genes comprises one or more host target binding sites, each having a nucleotide sequence which is at least partly complementary to VGAM2720 RNA, herein designated VGAM RNA, and which when bound by VGAM2720 RNA causes inhibition of translation of respective one or more VGAM2720 host target proteins.

It is further appreciated by one skilled in the art that the mode of translational inhibition illustrated by FIG. 1 with specific reference to translational inhibition exerted by VGAM2720 gene, herein designated VGAM GENE, on one or more VGAM2720 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2720 is inhibition of expression of host target genes, as part of a novel viral mechanism of attacking a host. Accordingly, utilities of VGAM2720 include diagnosis, prevention and treatment of viral infection by Aphid Lethal Paralysis Virus. Specific functions, and accordingly utilities, of VGAM2720 correlate with, and may be deduced from, the identity of the host target genes which VGAM2720 binds and inhibits, and the function of these host target genes, as elaborated hereinbelow.

Nucleotide sequences of the VGAM2720 precursor RNA, herein designated VGAM PRECURSOR RNA, and of the 'diced' VGAM2720 RNA, herein designated VGAM RNA, and a schematic representation of the secondary folding of VGAM2720 folded precursor RNA, herein designated VGAM FOLDED PRECURSOR RNA, of VGAM2720 are further described hereinbelow with reference to Table 1.

Nucleotide sequences of host target binding sites, such as BINDING SITE-I, BINDING SITE-II and BINDING SITE-III of FIG. 1, found on VGAM2720 host target RNA, and schematic representation of the complementarity of each of these host target binding sites to VGAM2720 RNA, herein designated VGAM RNA, are described hereinbelow with reference to Table 2.

As mentioned hereinabove with reference to FIG. 1, a function of VGAM2720 gene, herein designated VGAM is inhibition of expression of VGAM2720 target genes. It is appreciated that specific functions, and accordingly utilities, of VGAM2720 correlate with, and may be deduced from, the identity of the target genes which VGAM2720 binds and inhibits, and the function of these target genes, as elaborated hereinbelow.

Fukuyama Type Congenital Muscular Dystrophy (fukutin) (FCMD, Accession NM_006731) is a VGAM2720 host target gene. FCMD BINDING SITE is HOST TARGET binding site found in the 3' untranslated region of mRNA encoded by FCMD, corresponding to a HOST TARGET binding site such as BINDING SITE I, BINDING SITE II or BINDING SITE III. Table 2 illustrates the complementarity of the nucleotide sequences of FCMD BINDING SITE, designated SEQ ID:13576, to the nucleotide sequence of VGAM2720 RNA, herein designated VGAM RNA, also designated SEQ ID:5431.

A function of VGAM2720 is therefore inhibition of Fukuyama Type Congenital Muscular Dystrophy (fukutin) (FCMD, Accession NM_006731). Accordingly, utilities of VGAM2720 include diagnosis, prevention and treatment of diseases and clinical conditions associated with FCMD. TEM8 (Accession NM_032208) is another VGAM2720 host target gene. TEM8 BINDING SITE is HOST TARGET binding site found in the 3' untranslated region of mRNA encoded by TEM8, corresponding to a HOST TARGET binding site such as BINDING SITE I, BINDING SITE II or BINDING SITE III. Table 2 illustrates the complementarity of the nucleotide sequences of TEM8 BINDING SITE, designated SEQ ID:25921, to the nucleotide sequence of VGAM2720 RNA, herein designated VGAM RNA, also designated SEQ ID:5431.

Another function of VGAM2720 is therefore inhibition of TEM8 (Accession NM_032208), a gene which is a tumor-specific endothelial marker. Accordingly, utilities of VGAM2720 include diagnosis, prevention and treatment of diseases and clinical conditions associated with TEM8. The function of TEM8 and its association with various diseases and clinical conditions, has been established by previous studies, as described hereinabove with reference to VGAM1489. Thrombomodulin (THBD, Accession NM_000361) is another VGAM2720 host target gene. THBD BINDING SITE is HOST TARGET binding site found in the 3' untranslated region of mRNA encoded by THBD, corresponding to a HOST TARGET binding site such as BINDING SITE I, BINDING SITE II or BINDING SITE III. Table 2 illustrates the complementarity of the nucleotide sequences of THBD BINDING SITE, designated SEQ ID:5922, to the nucleotide sequence of VGAM2720 RNA, herein designated VGAM RNA, also designated SEQ ID:5431.

Another function of VGAM2720 is therefore inhibition of Thrombomodulin (THBD, Accession NM_000361). Accordingly, utilities of VGAM2720 include diagnosis, prevention and treatment of diseases and clinical conditions associated with THBD. VAMP (vesicle-associated membrane protein)-associated Protein B and C (VAPB, Accession NM_004738) is another VGAM2720 host target gene. VAPB BINDING SITE is HOST TARGET binding site found in the 3' untranslated region of mRNA encoded by VAPB, corresponding to a HOST TARGET binding site such as BINDING SITE I, BINDING SITE II or BINDING SITE III. Table 2 illustrates the complementarity of the nucleotide sequences of VAPB BINDING SITE, designated SEQ ID:11134, to the nucleotide sequence of VGAM2720 RNA, herein designated VGAM RNA, also designated SEQ ID:5431.

Another function of VGAM2720 is therefore inhibition of VAMP (vesicle-associated membrane protein)-associated Protein B and C (VAPB, Accession NM_004738). Accordingly, utilities of VGAM2720 include diagnosis, prevention and treatment of diseases and clinical conditions associated with VAPB. Tryptophanyl-tRNA Synthetase (WARS, Accession XM_041014) is another VGAM2720 host target gene. WARS BINDING SITE is HOST TARGET binding site found in the 3' untranslated region of mRNA encoded by WARS, corresponding to a HOST TARGET binding site such as BINDING SITE I, BINDING SITE II or BINDING SITE III. Table 2 illustrates the complementarity of the nucleotide sequences of WARS BINDING SITE, designated SEQ ID:33414, to the nucleotide sequence of VGAM2720 RNA, herein designated VGAM RNA, also designated SEQ ID:5431.

Another function of VGAM2720 is therefore inhibition of Tryptophanyl-tRNA Synthetase (WARS, Accession XM_041014), a gene which is a tryptophanyl-tRNA synthetase. Accordingly, utilities of VGAM2720 include diagnosis, prevention and treatment of diseases and clinical conditions associated with WARS. The function of WARS and its association with various diseases and clinical conditions, has been established by previous studies, as described hereinabove with reference to VGAM68. FLJ20802 (Accession NM_017959) is another VGAM2720 host target gene. FLJ20802 BINDING SITE is HOST TARGET binding site found in the 5' untranslated region of mRNA encoded by FLJ20802, corresponding to a HOST TARGET binding site such as BINDING SITE I, BINDING SITE II or BINDING SITE III. Table 2 illustrates the complementarity of the nucleotide sequences of FLJ20802 BINDING SITE, designated SEQ ID:19676, to the nucleotide sequence of VGAM2720 RNA, herein designated VGAM RNA, also designated SEQ ID:5431.

Another function of VGAM2720 is therefore inhibition of FLJ20802 (Accession NM_017959). Accordingly, utilities of VGAM2720 include diagnosis, prevention and treatment of diseases and clinical conditions associated with FLJ20802. FLJ22087 (Accession NM_022070) is another VGAM2720 host target gene. FLJ22087 BINDING SITE is HOST TARGET binding site found in the 5' untranslated region of mRNA encoded by FLJ22087, corresponding to a HOST TARGET binding site such as BINDING SITE I, BINDING SITE II or BINDING SITE III. Table 2 illustrates the complementarity of the nucleotide sequences of FLJ22087 BINDING SITE, designated SEQ ID:22614, to the nucleotide sequence of VGAM2720 RNA, herein designated VGAM RNA, also designated SEQ ID:5431.

Another function of VGAM2720 is therefore inhibition of FLJ22087 (Accession NM_022070). Accordingly, utilities of VGAM2720 include diagnosis, prevention and treatment of diseases and clinical conditions associated with FLJ22087. KIAA1497 (Accession XM_041431) is another VGAM2720 host target gene. KIAA1497 BINDING SITE is HOST TARGET binding site found in the 5' untranslated region of mRNA encoded by KIAA1497, corresponding to a HOST TARGET binding site such as BINDING SITE I, BINDING SITE II or BINDING SITE III. Table 2 illustrates the complementarity of the nucleotide sequences of KIAA1497 BINDING SITE, designated SEQ ID:33531, to the nucleotide sequence of VGAM2720 RNA, herein designated VGAM RNA, also designated SEQ ID:5431.

Another function of VGAM2720 is therefore inhibition of KIAA1497 (Accession XM_041431). Accordingly, utilities of VGAM2720 include diagnosis, prevention and treatment of diseases and clinical conditions associated with KIAA1497. P66 (Accession NM_020699) is another VGAM2720 host target gene. P66 BINDING SITE is HOST TARGET binding site found in the 3' untranslated region of mRNA encoded by P66, corresponding to a HOST TARGET binding site such as BINDING SITE I, BINDING SITE II or BINDING SITE III. Table 2 illustrates the complementarity of the nucleotide sequences of P66 BINDING SITE, designated SEQ ID:21849, to the nucleotide sequence of VGAM2720 RNA, herein designated VGAM RNA, also designated SEQ ID:5431.

Another function of VGAM2720 is therefore inhibition of P66 (Accession NM_020699). Accordingly, utilities of VGAM2720 include diagnosis, prevention and treatment of diseases and clinical conditions associated with P66. LOC152274 (Accession XM_087418) is another VGAM2720 host target gene. LOC152274 BINDING SITE is HOST TARGET binding site found in the 3' untranslated region of mRNA encoded by LOC152274, corresponding to a HOST TARGET binding site such as BINDING SITE I, BINDING SITE II or BINDING SITE III. Table 2 illustrates the complementarity of the nucleotide sequences of LOC152274 BINDING SITE, designated SEQ ID:39232, to the nucleotide sequence of VGAM2720 RNA, herein designated VGAM RNA, also designated SEQ ID:5431.

Another function of VGAM2720 is therefore inhibition of LOC152274 (Accession XM_087418). Accordingly, utilities of VGAM2720 include diagnosis, prevention and treatment of diseases and clinical conditions associated with LOC152274. LOC157247 (Accession XM_088275) is another VGAM2720 host target gene. LOC157247 BINDING SITE is HOST TARGET binding site found in the 5' untranslated region of mRNA encoded by LOC157247, corresponding to a HOST TARGET binding site such as BINDING SITE I, BINDING SITE II or BINDING SITE III. Table 2 illustrates the complementarity of the nucleotide sequences of LOC157247 BINDING SITE, designated SEQ ID:39577, to the nucleotide sequence of VGAM2720 RNA, herein designated VGAM RNA, also designated SEQ ID:5431.

Another function of VGAM2720 is therefore inhibition of LOC157247 (Accession XM_088275). Accordingly, utilities of VGAM2720 include diagnosis, prevention and treatment of diseases and clinical conditions associated with LOC157247. LOC199986 (Accession XM_117168) is another VGAM2720 host target gene. LOC199986 BINDING SITE is HOST TARGET binding site found in the 3' untranslated region of mRNA encoded by LOC199986, corresponding to a HOST TARGET binding site such as BINDING SITE I, BINDING SITE II or BINDING SITE III. Table 2 illustrates the complementarity of the nucleotide sequences of LOC199986 BINDING SITE, designated SEQ ID:43274, to the nucleotide sequence of VGAM2720 RNA, herein designated VGAM RNA, also designated SEQ ID:5431.

Another function of VGAM2720 is therefore inhibition of LOC199986 (Accession XM_117168). Accordingly, utilities of VGAM2720 include diagnosis, prevention and treatment of diseases and clinical conditions associated with LOC199986. LOC90750 (Accession XM_033868) is another VGAM2720 host target gene. LOC90750 BINDING SITE is HOST TARGET binding site found in the 3' untranslated region of mRNA encoded by LOC90750, corresponding to a HOST TARGET binding site such as BINDING SITE I, BINDING SITE II or BINDING SITE III. Table 2 illustrates the complementarity of the nucleotide sequences of LOC90750 BINDING SITE, designated SEQ ID:31971, to the nucleotide sequence of VGAM2720 RNA, herein designated VGAM RNA, also designated SEQ ID:5431.

Another function of VGAM2720 is therefore inhibition of LOC90750 (Accession XM_033868). Accordingly, utilities of VGAM2720 include diagnosis, prevention and treatment of diseases and clinical conditions associated with LOC90750. FIG. 1 further provides a conceptual description of a novel bioinformatically detected viral gene of the present invention, referred to here as Viral Genomic Address Messenger 2721 (VGAM2721) viral gene, which modulates expression of respective host target genes thereof, the function and utility of which host target genes is known in the art.

VGAM2721 is a novel bioinformatically detected regulatory, non protein coding, viral micro RNA (miRNA) gene. The method by which VGAM2721 was detected is described hereinabove with reference to FIGS. 1-8.

VGAM2721 gene, herein designated VGAM GENE, is a viral gene contained in the genome of Aphid Lethal Paralysis Virus. VGAM2721 host target gene, herein designated VGAM HOST TARGET GENE, is a human gene contained in the human genome.

VGAM2721 gene encodes a VGAM2721 precursor RNA, herein designated VGAM PRECURSOR RNA. Similar to other miRNA genes, and unlike most ordinary genes, VGAM2721 precursor RNA does not encode a protein. A nucleotide sequence identical or highly similar to the nucleotide sequence of VGAM2721 precursor RNA is designated SEQ ID:2707, and is provided hereinbelow with reference to the sequence listing part. Nucleotide sequence SEQ ID:2707 is located at position 3755 relative to the genome of Aphid Lethal Paralysis Virus.

VGAM2721 precursor RNA folds onto itself, forming VGAM2721 folded precursor RNA, herein designated VGAM FOLDED PRECURSOR RNA, which has a two-dimensional ‘hairpin structure’. As is well known in the art, this ‘hairpin structure’, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, ‘dices’ the VGAM2721 folded precursor RNA into VGAM2721 RNA, herein designated VGAM RNA, a single stranded ~22 nt long RNA segment. As is known in the art, ‘dicing’ of a hairpin structured RNA precursor product into a short ~22 nt RNA segment is catalyzed by an enzyme complex comprising an enzyme called Dicer together with other necessary proteins. A probable (over 46%) nucleotide sequence of VGAM2721 RNA is designated SEQ ID:5432, and is provided hereinbelow with reference to the sequence listing part.

VGAM2721 host target gene, herein designated VGAM HOST TARGET GENE, encodes a corresponding messenger RNA, VGAM2721 host target RNA, herein designated VGAM HOST TARGET RNA. VGAM2721 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2721 RNA, herein designated VGAM RNA, binds complementarily to one or more host target binding sites located in untranslated regions of VGAM2721 host target RNA, herein designated VGAM HOST TARGET RNA. This complementary binding is due to the fact that the nucleotide sequence of VGAM2721 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2721 RNA, herein designated VGAM RNA, may have a different number of host target binding sites in untranslated regions of a VGAM2721 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2721 RNA, herein designated VGAM RNA, to host target binding sites on VGAM2721 host target RNA, herein designated VGAM HOST TARGET RNA, such as BINDING SITE I, BINDING SITE II and BINDING SITE III, inhibits translation of VGAM2721 host target RNA into VGAM2721 host target protein, herein designated VGAM HOST TARGET PROTEIN. VGAM host target protein is therefore outlined by a broken line.

It is appreciated that VGAM2721 host target gene, herein designated VGAM HOST TARGET GENE, in fact represents a plurality of VGAM2721 host target genes. The mRNA of each one of this plurality of VGAM2721 host target genes comprises one or more host target binding sites, each having a nucleotide sequence which is at least partly complementary to VGAM2721 RNA, herein designated VGAM RNA, and which when bound by VGAM2721 RNA causes inhibition of translation of respective one or more VGAM2721 host target proteins.

It is further appreciated by one skilled in the art that the mode of translational inhibition illustrated by FIG. 1 with specific reference to translational inhibition exerted by VGAM2721 gene, herein designated VGAM GENE, on one or more VGAM2721 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2721 is inhibition of expression of host target genes, as part of a novel viral mechanism of attacking a host. Accordingly, utilities of VGAM2721 include diagnosis, prevention and treatment of viral infection by Aphid Lethal Paralysis Virus. Specific functions, and accordingly utilities, of VGAM2721 correlate with, and may be deduced from, the identity of the host target genes which VGAM2721 binds and inhibits, and the function of these host target genes, as elaborated hereinbelow.

Nucleotide sequences of the VGAM2721 precursor RNA, herein designated VGAM PRECURSOR RNA, and of the 'diced' VGAM2721 RNA, herein designated VGAM RNA, and a schematic representation of the secondary folding of VGAM2721 folded precursor RNA, herein designated VGAM FOLDED PRECURSOR RNA, of VGAM2721 are further described hereinbelow with reference to Table 1.

Nucleotide sequences of host target binding sites, such as BINDING SITE-I, BINDING SITE-II and BINDING SITE-III of FIG. 1, found on VGAM2721 host target RNA, and schematic representation of the complementarity of each of these host target binding sites to VGAM2721 RNA, herein designated VGAM RNA, are described hereinbelow with reference to Table 2.

As mentioned hereinabove with reference to FIG. 1, a function of VGAM2721 gene, herein designated VGAM is inhibition of expression of VGAM2721 target genes. It is appreciated that specific functions, and accordingly utilities, of VGAM2721 correlate with, and may be deduced from, the identity of the target genes which VGAM2721 binds and inhibits, and the function of these target genes, as elaborated hereinbelow.

Filamin B, Beta (actin binding protein 278) (FLNB, Accession XM_030806) is a VGAM2721 host target gene. FLNB BINDING SITE is HOST TARGET binding site found in the 3' untranslated region of mRNA encoded by FLNB, corresponding to a HOST TARGET binding site such as BINDING SITE I, BINDING SITE II or BINDING SITE III. Table 2 illustrates the complementarity of the nucleotide sequences of FLNB BINDING SITE, designated SEQ ID:31142, to the nucleotide sequence of VGAM2721 RNA, herein designated VGAM RNA, also designated SEQ ID:5432.

A function of VGAM2721 is therefore inhibition of Filamin B, Beta (actin binding protein 278) (FLNB, Accession XM_030806), a gene which Filamin B, beta; binds actin, interacts with cytoplasmic domain of Ibalpha. Accordingly, utilities of VGAM2721 include diagnosis, prevention and treatment of diseases and clinical conditions associated with FLNB. The function of FLNB and its association with various diseases and clinical conditions, has been established by previous studies, as described hereinabove with reference to VGAM416. Solute Carrier Family 4, Sodium Bicarbonate Cotransporter, Member 7 (SLC4A7, Accession NM_003615) is another VGAM2721 host target gene. SLC4A7 BINDING SITE is HOST TARGET binding site found in the 3' untranslated region of mRNA encoded by SLC4A7, corresponding to a HOST TARGET binding site such as BINDING SITE I, BINDING SITE II or BINDING SITE III. Table 2 illustrates the complementarity of the nucleotide sequences of SLC4A7 BINDING SITE, designated SEQ ID:9671, to the nucleotide sequence of VGAM2721 RNA, herein designated VGAM RNA, also designated SEQ ID:5432.

Another function of VGAM2721 is therefore inhibition of Solute Carrier Family 4, Sodium Bicarbonate Cotransporter, Member 7 (SLC4A7, Accession NM_003615), a gene which mediates the coupled movement of sodium and bicarbonate ions across the plasma membrane. Accordingly, utilities of VGAM2721 include diagnosis, prevention and treatment of diseases and clinical conditions associated with SLC4A7. The function of SLC4A7 and its association with various diseases and clinical conditions, has been established by previous studies, as described hereinabove with reference to VGAM66. FLJ10704 (Accession NM_018185) is another VGAM2721 host target gene. FLJ10704 BINDING SITE is HOST TARGET binding site found in the 3' untranslated region of mRNA encoded by FLJ10704, corresponding to a HOST TARGET binding site such as BINDING SITE I, BINDING SITE II or BINDING SITE III. Table 2 illustrates the complementarity of the nucleotide sequences of FLJ10704 BINDING SITE, designated SEQ ID:20031, to the nucleotide sequence of VGAM2721 RNA, herein designated VGAM RNA, also designated SEQ ID:5432.

Another function of VGAM2721 is therefore inhibition of FLJ10704 (Accession NM_018185). Accordingly, utilities of VGAM2721 include diagnosis, prevention and treatment of diseases and clinical conditions associated with FLJ10704. KIAA0229 (Accession XM_166478) is another VGAM2721 host target gene. KIAA0229 BINDING SITE is HOST TARGET binding site found in the 3' untranslated region of mRNA encoded by KIAA0229, corresponding to a HOST TARGET binding site such as BINDING SITE I, BINDING SITE II or BINDING SITE III. Table 2 illustrates the complementarity of the nucleotide sequences of KIAA0229 BINDING SITE, designated SEQ ID:44398, to the nucleotide sequence of VGAM2721 RNA, herein designated VGAM RNA, also designated SEQ ID:5432.

Another function of VGAM2721 is therefore inhibition of KIAA0229 (Accession XM_166478). Accordingly, utilities of VGAM2721 include diagnosis, prevention and treatment of diseases and clinical conditions associated with KIAA0229. Synaptosomal-associated Protein, 29 kDa (SNAP29, Accession NM_004782) is another VGAM2721 host target gene. SNAP29 BINDING SITE is HOST TARGET binding site found in the 3' untranslated region of mRNA encoded by SNAP29, corresponding to a HOST TARGET binding site such as BINDING SITE I, BINDING SITE II or BINDING SITE III. Table 2 illustrates the complementarity of the nucleotide sequences of SNAP29 BINDING SITE, designated SEQ ID:11185, to the nucleotide sequence of VGAM2721 RNA, herein designated VGAM RNA, also designated SEQ ID:5432.

Another function of VGAM2721 is therefore inhibition of Synaptosomal-associated Protein, 29 kDa (SNAP29, Accession NM_004782). Accordingly, utilities of VGAM2721 include diagnosis, prevention and treatment of diseases and clinical conditions associated with SNAP29. LOC89932 (Accession XM_027341) is another VGAM2721 host target gene. LOC89932 BINDING SITE is HOST TARGET binding site found in the 3' untranslated region of mRNA encoded by LOC89932, corresponding to a HOST TARGET binding site such as BINDING SITE I, BINDING SITE II or BINDING SITE III. Table 2 illustrates the complementarity of the nucleotide sequences of LOC89932 BINDING SITE, designated SEQ ID:30490, to the nucleotide sequence of VGAM2721 RNA, herein designated VGAM RNA, also designated SEQ ID:5432.

Another function of VGAM2721 is therefore inhibition of LOC89932 (Accession XM_027341). Accordingly, utilities of VGAM2721 include diagnosis, prevention and treatment of diseases and clinical conditions associated with LOC89932. FIG. 1 further provides a conceptual description of a novel bioinformatically detected viral gene of the present invention, referred to here as Viral Genomic Address Messenger 2722 (VGAM2722) viral gene, which modulates expression of respective host target genes thereof, the function and utility of which host target genes is known in the art.

VGAM2722 is a novel bioinformatically detected regulatory, non protein coding, viral micro RNA (miRNA) gene. The method by which VGAM2722 was detected is described hereinabove with reference to FIGS. 1-8.

VGAM2722 gene, herein designated VGAM GENE, is a viral gene contained in the genome of Aphid Lethal Paralysis Virus. VGAM2722 host target gene, herein designated VGAM HOST TARGET GENE, is a human gene contained in the human genome.

VGAM2722 gene encodes a VGAM2722 precursor RNA, herein designated VGAM PRECURSOR RNA. Similar to other miRNA genes, and unlike most ordinary genes, VGAM2722 precursor RNA does not encode a protein. A nucleotide sequence identical or highly similar to the nucleotide sequence of VGAM2722 precursor RNA is designated SEQ ID:2708, and is provided hereinbelow with reference to the sequence listing part. Nucleotide sequence SEQ ID:2708 is located at position 5202 relative to the genome of Aphid Lethal Paralysis Virus.

VGAM2722 precursor RNA folds onto itself, forming VGAM2722 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2722 folded precursor RNA into VGAM2722 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 81%) nucleotide sequence of VGAM2722 RNA is designated SEQ ID:5433, and is provided hereinbelow with reference to the sequence listing part.

VGAM2722 host target gene, herein designated VGAM HOST TARGET GENE, encodes a corresponding messenger RNA, VGAM2722 host target RNA, herein designated VGAM HOST TARGET RNA. VGAM2722 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2722 RNA, herein designated VGAM RNA, binds complementarily to one or more host target binding sites located in untranslated regions of VGAM2722 host target RNA, herein designated VGAM HOST TARGET RNA. This complementary binding is due to the fact that the nucleotide sequence of VGAM2722 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2722 RNA, herein designated VGAM RNA, may have a different number of host target binding sites in untranslated regions of a VGAM2722 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2722 RNA, herein designated VGAM RNA, to host target binding sites on VGAM2722 host target RNA, herein designated VGAM HOST TARGET RNA, such as BINDING SITE I, BINDING SITE II and BINDING SITE III, inhibits translation of VGAM2722 host target RNA into VGAM2722 host target protein, herein designated VGAM HOST TARGET PROTEIN. VGAM host target protein is therefore outlined by a broken line.

It is appreciated that VGAM2722 host target gene, herein designated VGAM HOST TARGET GENE, in fact represents a plurality of VGAM2722 host target genes. The mRNA of each one of this plurality of VGAM2722 host target genes comprises one or more host target binding sites, each having a nucleotide sequence which is at least partly complementary to VGAM2722 RNA, herein designated VGAM RNA, and which when bound by VGAM2722 RNA causes inhibition of translation of respective one or more VGAM2722 host target proteins.

It is further appreciated by one skilled in the art that the mode of translational inhibition illustrated by FIG. 1 with specific reference to translational inhibition exerted by VGAM2722 gene, herein designated VGAM GENE, on one or more VGAM2722 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2722 is inhibition of expression of host target genes, as part of a novel viral mechanism of attacking a host. Accordingly, utilities of VGAM2722 include diagnosis, prevention and treatment of viral infection by Aphid Lethal Paralysis Virus. Specific functions, and accordingly utilities, of VGAM2722 correlate with, and may be deduced from, the identity of the host target genes which VGAM2722 binds and inhibits, and the function of these host target genes, as elaborated hereinbelow.

Nucleotide sequences of the VGAM2722 precursor RNA, herein designated VGAM PRECURSOR RNA, and of the 'diced' VGAM2722 RNA, herein designated VGAM RNA, and a schematic representation of the secondary folding of VGAM2722 folded precursor RNA, herein designated VGAM FOLDED PRECURSOR RNA, of VGAM2722 are further described hereinbelow with reference to Table 1.

Nucleotide sequences of host target binding sites, such as BINDING SITE-I, BINDING SITE-II and BINDING SITE-III of FIG. 1, found on VGAM2722 host target RNA, and schematic representation of the complementarity of each of these host target binding sites to VGAM2722 RNA, herein designated VGAM RNA, are described hereinbelow with reference to Table 2.

As mentioned hereinabove with reference to FIG. 1, a function of VGAM2722 gene, herein designated VGAM is inhibition of expression of VGAM2722 target genes. It is appreciated that specific functions, and accordingly utilities, of VGAM2722 correlate with, and may be deduced from, the identity of the target genes which VGAM2722 binds and inhibits, and the function of these target genes, as elaborated hereinbelow.

Alpha Thalassemia/mental Retardation Syndrome X-linked (RAD54 homolog, S. cerevisiae) (ATRX, Accession NM_000489) is a VGAM2722 host target gene. ATRX BINDING SITE1 and ATRX BINDING SITE2 are HOST TARGET binding sites found in untranslated regions of mRNA encoded by ATRX, corresponding to HOST TARGET binding sites such as BINDING SITE I, BINDING SITE II or BINDING SITE III. Table 2 illustrates the complementarity of the nucleotide sequences of ATRX BINDING SITE1 and ATRX BINDING SITE2, designated SEQ ID:6097 and SEQ ID:28686 respectively, to the nucleotide sequence of VGAM2722 RNA, herein designated VGAM RNA, also designated SEQ ID:5433.

A function of VGAM2722 is therefore inhibition of Alpha Thalassemia/mental Retardation Syndrome X-linked (RAD54 homolog, S. cerevisiae) (ATRX, Accession NM_000489). Accordingly, utilities of VGAM2722 include diagnosis, prevention and treatment of diseases and clinical conditions associated with ATRX. DKFZp761H2121 (Accession NM_138339) is another VGAM2722 host target gene. DKFZp761H2121 BINDING SITE is HOST TARGET binding site found in the 5' untranslated region of mRNA encoded by DKFZp761H2121, corresponding to a HOST TARGET binding site such as BINDING SITE I, BINDING SITE II or BINDING SITE III. Table 2 illustrates the complementarity of the nucleotide sequences of DKFZp761H2121 BINDING SITE, designated SEQ ID:28739, to the nucleotide sequence of VGAM2722 RNA, herein designated VGAM RNA, also designated SEQ ID:5433.

Another function of VGAM2722 is therefore inhibition of DKFZp761H2121 (Accession NM_138339). Accordingly, utilities of VGAM2722 include diagnosis, prevention and treatment of diseases and clinical conditions associated with DKFZp761H2121. MGC2452 (Accession NM_032644) is another VGAM2722 host target gene. MGC2452 BINDING SITE is HOST TARGET binding site found in the 5' untranslated region of mRNA encoded by MGC2452, corresponding to a HOST TARGET binding site such as BINDING SITE I, BINDING SITE II or BINDING SITE III. Table 2 illustrates the complementarity of the nucleotide sequences of MGC2452 BINDING SITE, designated SEQ ID:26366, to the nucleotide sequence of VGAM2722 RNA, herein designated VGAM RNA, also designated SEQ ID:5433.

Another function of VGAM2722 is therefore inhibition of MGC2452 (Accession NM_032644). Accordingly, utilities of VGAM2722 include diagnosis, prevention and treatment of diseases and clinical conditions associated with MGC2452. Transcription Factor-like 5 (basic helix-loop-helix) (TCFL5, Accession NM_006602) is another VGAM2722 host target gene. TCFL5 BINDING SITE is HOST TARGET binding site found in the 3' untranslated region of mRNA encoded by TCFL5, corresponding to a HOST TARGET binding site such as BINDING SITE I, BINDING SITE II or BINDING SITE III. Table 2 illustrates the complementarity of the nucleotide sequences of TCFL5 BINDING SITE, designated SEQ ID:13383, to the nucleotide sequence of VGAM2722 RNA, herein designated VGAM RNA, also designated SEQ ID:5433.

Another function of VGAM2722 is therefore inhibition of Transcription Factor-like 5 (basic helix-loop-helix) (TCFL5, Accession NM_006602). Accordingly, utilities of VGAM2722 include diagnosis, prevention and treatment of diseases and clinical conditions associated with TCFL5. LOC152313 (Accession XM_098190) is another VGAM2722 host target gene. LOC152313 BINDING SITE is HOST TARGET binding site found in the 3' untranslated region of mRNA encoded by LOC152313, corresponding to a HOST TARGET binding site such as BINDING SITE I, BINDING SITE II or BINDING SITE III. Table 2 illustrates the complementarity of the nucleotide sequences of LOC152313 BINDING SITE, designated SEQ ID:41477, to the nucleotide sequence of VGAM2722 RNA, herein designated VGAM RNA, also designated SEQ ID:5433.

Another function of VGAM2722 is therefore inhibition of LOC152313 (Accession XM_098190). Accordingly, utilities of VGAM2722 include diagnosis, prevention and treatment of diseases and clinical conditions associated with LOC152313. FIG. 1 further provides a conceptual description of a novel bioinformatically detected viral gene of the present invention, referred to here as Viral Genomic Address Messenger 2723 (VGAM2723) viral gene, which modulates expression of respective host target genes thereof, the function and utility of which host target genes is known in the art.

VGAM2723 is a novel bioinformatically detected regulatory, non protein coding, viral micro RNA (miRNA) gene. The method by which VGAM2723 was detected is described hereinabove with reference to FIGS. 1-8.

VGAM2723 gene, herein designated VGAM GENE, is a viral gene contained in the genome of Aphid Lethal Paralysis Virus. VGAM2723 host target gene, herein designated VGAM HOST TARGET GENE, is a human gene contained in the human genome.

VGAM2723 gene encodes a VGAM2723 precursor RNA, herein designated VGAM PRECURSOR RNA. Similar to other miRNA genes, and unlike most ordinary genes, VGAM2723 precursor RNA does not encode a protein. A nucleotide sequence identical or highly similar to the nucleotide sequence of VGAM2723 precursor RNA is designated SEQ ID:2709, and is provided hereinbelow with reference to the sequence listing part. Nucleotide sequence SEQ ID:2709 is located at position 3973 relative to the genome of Aphid Lethal Paralysis Virus.

VGAM2723 precursor RNA folds onto itself, forming VGAM2723 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2723 folded precursor RNA into VGAM2723 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2723 RNA is designated SEQ ID:5434, and is provided hereinbelow with reference to the sequence listing part.

VGAM2723 host target gene, herein designated VGAM HOST TARGET GENE, encodes a corresponding messenger RNA, VGAM2723 host target RNA, herein designated VGAM HOST TARGET RNA. VGAM2723 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2723 RNA, herein designated VGAM RNA, binds complementarily to one or more host target binding sites located in untranslated regions of VGAM2723 host target RNA, herein designated VGAM HOST TARGET RNA. This complementary binding is due to the fact that the nucleotide sequence of VGAM2723 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2723 RNA, herein designated VGAM RNA, may have a different number of host target binding sites in untranslated regions of a VGAM2723 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2723 RNA, herein designated VGAM RNA, to host target binding sites on VGAM2723 host target RNA, herein designated VGAM HOST TARGET RNA, such as BINDING SITE I, BINDING SITE II and BINDING SITE III, inhibits translation of VGAM2723 host target RNA into VGAM2723 host target protein, herein designated VGAM HOST TARGET PROTEIN. VGAM host target protein is therefore outlined by a broken line.

It is appreciated that VGAM2723 host target gene, herein designated VGAM HOST TARGET GENE, in fact represents a plurality of VGAM2723 host target genes. The mRNA of each one of this plurality of VGAM2723 host target genes comprises one or more host target binding sites, each having a nucleotide sequence which is at least partly complementary to VGAM2723 RNA, herein designated VGAM RNA, and which when bound by VGAM2723 RNA causes inhibition of translation of respective one or more VGAM2723 host target proteins.

It is further appreciated by one skilled in the art that the mode of translational inhibition illustrated by FIG. 1 with specific reference to translational inhibition exerted by VGAM2723 gene, herein designated VGAM GENE, on one or more VGAM2723 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2723 is inhibition of expression of host target genes, as part of a novel viral mechanism of attacking a host. Accordingly, utilities of VGAM2723 include diagnosis, prevention and treatment of viral infection by Aphid Lethal Paralysis Virus. Specific functions, and accordingly utilities, of VGAM2723 correlate with, and may be deduced from, the identity of the host target genes which VGAM2723 binds and inhibits, and the function of these host target genes, as elaborated hereinbelow.

Nucleotide sequences of the VGAM2723 precursor RNA, herein designated VGAM PRECURSOR RNA, and of the 'diced' VGAM2723 RNA, herein designated VGAM RNA, and a schematic representation of the secondary folding of VGAM2723 folded precursor RNA, herein designated VGAM FOLDED PRECURSOR RNA, of VGAM2723 are further described hereinbelow with reference to Table 1.

Nucleotide sequences of host target binding sites, such as BINDING SITE-I, BINDING SITE-II and BINDING SITE-III of FIG. 1, found on VGAM2723 host target RNA, and schematic representation of the complementarity of each of these host target binding sites to VGAM2723 RNA, herein designated VGAM RNA, are described hereinbelow with reference to Table 2.

As mentioned hereinabove with reference to FIG. 1, a function of VGAM2723 gene, herein designated VGAM is inhibition of expression of VGAM2723 target genes. It is appreciated that specific functions, and accordingly utilities, of VGAM2723 correlate with, and may be deduced from, the identity of the target genes which VGAM2723 binds and inhibits, and the function of these target genes, as elaborated hereinbelow.

GA Binding Protein Transcription Factor, Beta Subunit 1, 53 kDa (GABPB1, Accession NM_005254) is a VGAM2723 host target gene. GABPB1 BINDING SITE is HOST TARGET binding site found in the 5' untranslated region of mRNA encoded by GABPB1, corresponding to a HOST TARGET binding site such as BINDING SITE I, BINDING SITE II or BINDING SITE III. Table 2 illustrates the complementarity of the nucleotide sequences of GABPB1 BINDING SITE, designated SEQ ID:11759, to the nucleotide sequence of VGAM2723 RNA, herein designated VGAM RNA, also designated SEQ ID:5434.

A function of VGAM2723 is therefore inhibition of GA Binding Protein Transcription Factor, Beta Subunit 1, 53 kDa (GABPB1, Accession NM_005254), a gene which activates adenovirus E4 gene transcription. Accordingly, utilities of VGAM2723 include diagnosis, prevention and treatment of diseases and clinical conditions associated with GABPB1. The function of GABPB1 and its association with various diseases and clinical conditions, has been established by previous studies, as described hereinabove with reference to VGAM191. Regulator of G-protein Signalling 5 (RGS5, Accession NM_003617) is another VGAM2723 host target gene. RGS5 BINDING SITE is HOST TARGET binding site found in the 3' untranslated region of mRNA encoded by RGS5, corresponding to a HOST TARGET binding site such as BINDING SITE I, BINDING SITE II or BINDING SITE III. Table 2 illustrates the complementarity of the nucleotide sequences of RGS5 BINDING SITE, designated SEQ ID:9678, to the nucleotide sequence of VGAM2723 RNA, herein designated VGAM RNA, also designated SEQ ID:5434.

Another function of VGAM2723 is therefore inhibition of Regulator of G-protein Signalling 5 (RGS5, Accession NM_003617). Accordingly, utilities of VGAM2723 include diagnosis, prevention and treatment of diseases and clinical conditions associated with RGS5. F-box Only Protein 24 (FBXO24, Accession NM_012172) is another VGAM2723 host target gene. FBXO24 BINDING SITE is HOST TARGET binding site found in the 3' untranslated region of mRNA encoded by FBXO24, corresponding to a HOST TARGET binding site such as BINDING SITE I, BINDING SITE II or BINDING SITE III. Table 2 illustrates the complementarity of the nucleotide sequences of FBXO24 BINDING SITE, designated SEQ ID:14464, to the nucleotide sequence of VGAM2723 RNA, herein designated VGAM RNA, also designated SEQ ID:5434.

Another function of VGAM2723 is therefore inhibition of F-box Only Protein 24 (FBXO24, Accession NM_012172). Accordingly, utilities of VGAM2723 include diagnosis, prevention and treatment of diseases and clinical conditions associated with FBXO24. FLJ13852 (Accession NM_023078) is another VGAM2723 host target gene. FLJ13852 BINDING SITE is HOST TARGET binding site found in the 3' untranslated region of mRNA encoded by FLJ13852, corresponding to a HOST TARGET binding site such as BINDING SITE I, BINDING SITE II or BINDING SITE III. Table 2 illustrates the complementarity of the nucleotide sequences of FLJ13852 BINDING SITE, designated SEQ ID:23342, to the nucleotide sequence of VGAM2723 RNA, herein designated VGAM RNA, also designated SEQ ID:5434.

Another function of VGAM2723 is therefore inhibition of FLJ13852 (Accession NM_023078). Accordingly, utilities of VGAM2723 include diagnosis, prevention and treatment of diseases and clinical conditions associated with FLJ13852. FLJ20202 (Accession NM_017709) is another VGAM2723 host target gene. FLJ20202 BINDING SITE is HOST TARGET binding site found in the 3' untranslated region of mRNA encoded by FLJ20202, corresponding to a HOST TARGET binding site such as BINDING SITE I, BINDING SITE II or BINDING SITE III. Table 2 illustrates the complementarity of the nucleotide sequences of FLJ20202 BINDING SITE, designated SEQ ID:19289, to the nucleotide sequence of VGAM2723 RNA, herein designated VGAM RNA, also designated SEQ ID:5434.

Another function of VGAM2723 is therefore inhibition of FLJ20202 (Accession NM_017709). Accordingly, utilities of VGAM2723 include diagnosis, prevention and treatment of diseases and clinical conditions associated with FLJ20202. FLJ23519 (Accession NM_032240) is another VGAM2723 host target gene. FLJ23519 BINDING SITE is HOST TARGET binding site found in the 3' untranslated region of mRNA encoded by FLJ23519, corresponding to a HOST TARGET binding site such as BINDING SITE I, BINDING SITE II or BINDING SITE III. Table 2 illustrates the complementarity of the nucleotide sequences of FLJ23519 BINDING SITE, designated SEQ ID:25972, to the nucleotide sequence of VGAM2723 RNA, herein designated VGAM RNA, also designated SEQ ID:5434.

Another function of VGAM2723 is therefore inhibition of FLJ23519 (Accession NM_032240). Accordingly, utilities of VGAM2723 include diagnosis, prevention and treatment of diseases and clinical conditions associated with FLJ23519. GA Binding Protein Transcription Factor, Beta Subunit 2, 47 kDa (GABPB2, Accession NM_002041) is another VGAM2723 host target gene. GABPB2 BINDING SITE is HOST TARGET binding site found in the 5' untranslated region of mRNA encoded by GABPB2, corresponding to a HOST TARGET binding site such as BINDING SITE I, BINDING SITE II or BINDING SITE III. Table 2 illustrates the complementarity of the nucleotide sequences of GABPB2 BINDING SITE, designated SEQ ID:7794, to the nucleotide sequence of VGAM2723 RNA, herein designated VGAM RNA, also designated SEQ ID:5434.

Another function of VGAM2723 is therefore inhibition of GA Binding Protein Transcription Factor, Beta Subunit 2, 47 kDa (GABPB2, Accession NM_002041). Accordingly, utilities of VGAM2723 include diagnosis, prevention and treatment of diseases and clinical conditions associated with GABPB2. GFR (Accession NM_012294) is another VGAM2723 host target gene. GFR BINDING SITE is HOST TARGET binding site found in the 3' untranslated region of mRNA encoded by GFR, corresponding to a HOST TARGET binding site such as BINDING SITE I, BINDING SITE II or BINDING SITE III. Table 2 illustrates the complementarity of the nucleotide sequences of GFR BINDING SITE, designated SEQ ID:14640, to the nucleotide sequence of VGAM2723 RNA, herein designated VGAM RNA, also designated SEQ ID:5434.

Another function of VGAM2723 is therefore inhibition of GFR (Accession NM_012294). Accordingly, utilities of VGAM2723 include diagnosis, prevention and treatment of diseases and clinical conditions associated with GFR. SEC15B (Accession XM_039570) is another VGAM2723 host target gene. SEC15B BINDING SITE is HOST TARGET binding site found in the 3' untranslated region of mRNA encoded by SEC15B, corresponding to a HOST TARGET binding site such as BINDING SITE I, BINDING SITE II or BINDING SITE III. Table 2 illustrates the complementarity of the nucleotide sequences of SEC15B BINDING SITE, designated SEQ ID:33127, to the nucleotide sequence of VGAM2723 RNA, herein designated VGAM RNA, also designated SEQ ID:5434.

Another function of VGAM2723 is therefore inhibition of SEC15B (Accession XM_039570). Accordingly, utilities of VGAM2723 include diagnosis, prevention and treatment of diseases and clinical conditions associated with SEC15B. LOC253782 (Accession XM_171023) is another VGAM2723 host target gene. LOC253782 BINDING SITE is HOST TARGET binding site found in the 3' untranslated region of mRNA encoded by LOC253782, corresponding to a HOST TARGET binding site such as BINDING SITE I, BINDING SITE II or BINDING SITE III. Table 2 illustrates the complementarity of the nucleotide sequences of LOC253782 BINDING SITE, designated SEQ ID:45799, to the nucleotide sequence of VGAM2723 RNA, herein designated VGAM RNA, also designated SEQ ID:5434.

Another function of VGAM2723 is therefore inhibition of LOC253782 (Accession XM_171023). Accordingly, utilities of VGAM2723 include diagnosis, prevention and treatment of diseases and clinical conditions associated with LOC253782. FIG. 1 further provides a conceptual description of a novel bioinformatically detected viral gene of the present invention, referred to here as Viral Genomic Address Messenger 2724 (VGAM2724) viral gene, which modulates expression of respective host target genes thereof, the function and utility of which host target genes is known in the art.

VGAM2724 is a novel bioinformatically detected regulatory, non protein coding, viral micro RNA (miRNA) gene. The method by which VGAM2724 was detected is described hereinabove with reference to FIGS. 1-8.

VGAM2724 gene, herein designated VGAM GENE, is a viral gene contained in the genome of Aphid Lethal Paralysis Virus. VGAM2724 host target gene, herein designated VGAM HOST TARGET GENE, is a human gene contained in the human genome.

VGAM2724 gene encodes a VGAM2724 precursor RNA, herein designated VGAM PRECURSOR RNA. Similar to other miRNA genes, and unlike most ordinary genes, VGAM2724 precursor RNA does not encode a protein. A nucleotide sequence identical or highly similar to the nucleotide sequence of VGAM2724 precursor RNA is designated SEQ ID:2710, and is provided hereinbelow with reference to the sequence listing part. Nucleotide sequence SEQ ID:2710 is located at position 1635 relative to the genome of Aphid Lethal Paralysis Virus.

VGAM2724 precursor RNA folds onto itself, forming VGAM2724 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2724 folded precursor RNA into VGAM2724 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2724 RNA is designated SEQ ID:5435, and is provided hereinbelow with reference to the sequence listing part.

VGAM2724 host target gene, herein designated VGAM HOST TARGET GENE, encodes a corresponding messenger RNA, VGAM2724 host target RNA, herein designated VGAM HOST TARGET RNA. VGAM2724 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2724 RNA, herein designated VGAM RNA, binds complementarily to one or more host target binding sites located in untranslated regions of VGAM2724 host target RNA, herein designated VGAM HOST TARGET RNA. This complementary binding is due to the fact that the nucleotide sequence of VGAM2724 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2724 RNA, herein designated VGAM RNA, may have a different number of host target binding sites in untranslated regions of a VGAM2724 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2724 RNA, herein designated VGAM RNA, to host target binding sites on VGAM2724 host target RNA, herein designated VGAM HOST TARGET RNA, such as BINDING SITE I, BINDING SITE II and BINDING SITE III, inhibits translation of VGAM2724 host target RNA into VGAM2724 host target protein, herein designated VGAM HOST TARGET PROTEIN. VGAM host target protein is therefore outlined by a broken line.

It is appreciated that VGAM2724 host target gene, herein designated VGAM HOST TARGET GENE, in fact represents a plurality of VGAM2724 host target genes. The mRNA of each one of this plurality of VGAM2724 host target genes comprises one or more host target binding sites, each having a nucleotide sequence which is at least partly complementary to VGAM2724 RNA, herein designated VGAM RNA, and which when bound by VGAM2724 RNA causes inhibition of translation of respective one or more VGAM2724 host target proteins.

It is further appreciated by one skilled in the art that the mode of translational inhibition illustrated by FIG. 1 with specific reference to translational inhibition exerted by VGAM2724 gene, herein designated VGAM GENE, on one or more VGAM2724 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2724 is inhibition of expression of host target genes, as part of a novel viral mechanism of attacking a host. Accordingly, utilities of VGAM2724 include diagnosis, prevention and treatment of viral infection by Aphid Lethal Paralysis Virus. Specific functions, and accordingly utilities, of VGAM2724 correlate with, and may be deduced from, the identity of the host target genes which VGAM2724 binds and inhibits, and the function of these host target genes, as elaborated hereinbelow.

Nucleotide sequences of the VGAM2724 precursor RNA, herein designated VGAM PRECURSOR RNA, and of the 'diced' VGAM2724 RNA, herein designated VGAM RNA, and a schematic representation of the secondary folding of VGAM2724 folded precursor RNA, herein designated VGAM FOLDED PRECURSOR RNA, of VGAM2724 are further described hereinbelow with reference to Table 1.

Nucleotide sequences of host target binding sites, such as BINDING SITE-I, BINDING SITE-II and BINDING SITE-III of FIG. 1, found on VGAM2724 host target RNA, and schematic representation of the complementarity of each of these host target binding sites to VGAM2724 RNA, herein designated VGAM RNA, are described hereinbelow with reference to Table 2.

As mentioned hereinabove with reference to FIG. 1, a function of VGAM2724 gene, herein designated VGAM is inhibition of expression of VGAM2724 target genes. It is appreciated that specific functions, and accordingly utilities, of VGAM2724 correlate with, and may be deduced from, the identity of the target genes which VGAM2724 binds and inhibits, and the function of these target genes, as elaborated hereinbelow.

Numb Homolog (Drosophila) (NUMB, Accession NM_003744) is a VGAM2724 host target gene. NUMB BINDING SITE is HOST TARGET binding site found in the 3' untranslated region of mRNA encoded by NUMB, corresponding to a HOST TARGET binding site such as BINDING SITE I, BINDING SITE II or BINDING SITE III. Table 2 illustrates the complementarity of the nucleotide sequences of NUMB BINDING SITE, designated SEQ ID:9833, to the nucleotide sequence of VGAM2724 RNA, herein designated VGAM RNA, also designated SEQ ID:5435.

A function of VGAM2724 is therefore inhibition of Numb Homolog (Drosophila) (NUMB, Accession NM_003744), a gene which may act in generating asymmetric cell division during neurogenesisand is strongly similar to murine Numb. Accordingly, utilities of VGAM2724 include diagnosis, prevention and treatment of diseases and clinical conditions associated with NUMB. The function of NUMB and its association with various diseases and clinical conditions, has been established by previous studies, as described hereinabove with reference to VGAM2322. DKFZp434E1822 (Accession XM_043624) is another VGAM2724 host target gene. DKFZp434E1822 BINDING SITE is HOST TARGET binding site found in the 5' untranslated region of mRNA encoded by DKFZp434E1822, corresponding to a HOST TARGET binding site such as BINDING SITE I, BINDING SITE II or BINDING SITE III. Table 2 illustrates the complementarity of the nucleotide sequences of DKFZp434E1822 BINDING SITE, designated SEQ ID:33984, to the nucleotide sequence of VGAM2724 RNA, herein designated VGAM RNA, also designated SEQ ID:5435.

Another function of VGAM2724 is therefore inhibition of DKFZp434E1822 (Accession XM_043624). Accordingly, utilities of VGAM2724 include diagnosis, prevention and treatment of diseases and clinical conditions associated with DKFZp434E1822. E74-like Factor 4 (ets domain transcription factor) (ELF4, Accession NM_001421) is another VGAM2724 host target gene. ELF4 BINDING SITE is HOST TARGET binding site found in the 3' untranslated region of mRNA encoded by ELF4, corresponding to a HOST TARGET binding site such as BINDING SITE I, BINDING SITE II or BINDING SITE III. Table 2 illustrates the complementarity of the nucleotide sequences of ELF4 BINDING SITE, designated SEQ ID:7123, to the nucleotide sequence of VGAM2724 RNA, herein designated VGAM RNA, also designated SEQ ID:5435.

Another function of VGAM2724 is therefore inhibition of E74-like Factor 4 (ets domain transcription factor) (ELF4, Accession NM_001421). Accordingly, utilities of VGAM2724 include diagnosis, prevention and treatment of diseases and clinical conditions associated with ELF4. FLJ10656 (Accession NM_018170) is another VGAM2724 host target gene. FLJ10656 BINDING SITE is HOST TARGET binding site found in the 3' untranslated region of mRNA encoded by FLJ10656, corresponding to a HOST TARGET binding site such as BINDING SITE I, BINDING SITE II or BINDING SITE III. Table 2 illustrates the complementarity of the nucleotide sequences of FLJ10656 BINDING SITE, designated SEQ ID:19991, to the nucleotide sequence of VGAM2724 RNA, herein designated VGAM RNA, also designated SEQ ID:5435.

Another function of VGAM2724 is therefore inhibition of FLJ10656 (Accession NM_018170). Accordingly, utilities of VGAM2724 include diagnosis, prevention and treatment of diseases and clinical conditions associated with FLJ10656. KIAA1728 (Accession XM_043492) is another VGAM2724 host target gene. KIAA1728 BINDING SITE is HOST TARGET binding site found in the 3' untranslated region of mRNA encoded by KIAA1728, corresponding to a HOST TARGET binding site such as BINDING SITE I, BINDING SITE II or BINDING SITE III. Table 2 illustrates the complementarity of the nucleotide sequences of KIAA1728 BINDING SITE, designated SEQ ID:33950, to the nucleotide sequence of VGAM2724 RNA, herein designated VGAM RNA, also designated SEQ ID:5435.

Another function of VGAM2724 is therefore inhibition of KIAA1728 (Accession XM_043492). Accordingly, utilities of VGAM2724 include diagnosis, prevention and treatment of diseases and clinical conditions associated with KIAA1728. LOC154877 (Accession XM_098626) is another VGAM2724 host target gene. LOC154877 BINDING SITE is HOST TARGET binding site found in the 3' untranslated region of mRNA encoded by LOC154877, corresponding to a HOST TARGET binding site such as BINDING SITE I, BINDING SITE II or BINDING SITE III. Table 2 illustrates the complementarity of the nucleotide sequences of LOC154877 BINDING SITE, designated SEQ ID:41744, to the nucleotide sequence of VGAM2724 RNA, herein designated VGAM RNA, also designated SEQ ID:5435.

Another function of VGAM2724 is therefore inhibition of LOC154877 (Accession XM_098626). Accordingly, utilities of VGAM2724 include diagnosis, prevention and treatment of diseases and clinical conditions associated with LOC154877. LOC54103 (Accession XM_168508) is another VGAM2724 host target gene. LOC54103 BINDING SITE is HOST TARGET binding site found in the 3' untranslated region of mRNA encoded by LOC54103, corresponding to a HOST TARGET binding site such as BINDING SITE I, BINDING SITE II or BINDING SITE III. Table 2 illustrates the complementarity of the nucleotide sequences of LOC54103 BINDING SITE, designated SEQ ID:45210, to the nucleotide sequence of VGAM2724 RNA, herein designated VGAM RNA, also designated SEQ ID:5435.

Another function of VGAM2724 is therefore inhibition of LOC54103 (Accession XM_168508). Accordingly, utilities of VGAM2724 include diagnosis, prevention and treatment of diseases and clinical conditions associated with LOC54103. FIG. 1 further provides a conceptual description of a novel bioinformatically detected viral gene of the present invention, referred to here as Viral Genomic Address Messenger 2725 (VGAM2725) viral gene, which modulates expression of respective host target genes thereof, the function and utility of which host target genes is known in the art.

VGAM2725 is a novel bioinformatically detected regulatory, non protein coding, viral micro RNA (miRNA) gene. The method by which VGAM2725 was detected is described hereinabove with reference to FIGS. 1-8.

VGAM2725 gene, herein designated VGAM GENE, is a viral gene contained in the genome of Aphid Lethal Paralysis Virus. VGAM2725 host target gene, herein designated VGAM HOST TARGET GENE, is a human gene contained in the human genome.

VGAM2725 gene encodes a VGAM2725 precursor RNA, herein designated VGAM PRECURSOR RNA. Similar to other miRNA genes, and unlike most ordinary genes, VGAM2725 precursor RNA does not encode a protein. A nucleotide sequence identical or highly similar to the nucleotide sequence of VGAM2725 precursor RNA is designated SEQ ID:2711, and is provided hereinbelow with reference to the sequence listing part. Nucleotide sequence SEQ ID:2711 is located at position 4120 relative to the genome of Aphid Lethal Paralysis Virus.

VGAM2725 precursor RNA folds onto itself, forming VGAM2725 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2725 folded precursor RNA into VGAM2725 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 55%) nucleotide sequence of VGAM2725 RNA is designated SEQ ID:5436, and is provided hereinbelow with reference to the sequence listing part.

VGAM2725 host target gene, herein designated VGAM HOST TARGET GENE, encodes a corresponding messenger RNA, VGAM2725 host target RNA, herein designated VGAM HOST TARGET RNA. VGAM2725 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2725 RNA, herein designated VGAM RNA, binds complementarily to one or more host target binding sites located in untranslated regions of VGAM2725 host target RNA, herein designated VGAM HOST TARGET RNA. This complementary binding is due to the fact that the nucleotide sequence of VGAM2725 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2725 RNA, herein designated VGAM RNA, may have a different number of host target binding sites in untranslated regions of a VGAM2725 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2725 RNA, herein designated VGAM RNA, to host target binding sites on VGAM2725 host target RNA, herein designated VGAM HOST TARGET RNA, such as BINDING SITE I, BINDING SITE II and BINDING SITE III, inhibits translation of VGAM2725 host target RNA into VGAM2725 host target protein, herein designated VGAM HOST TARGET PROTEIN. VGAM host target protein is therefore outlined by a broken line.

It is appreciated that VGAM2725 host target gene, herein designated VGAM HOST TARGET GENE, in fact represents a plurality of VGAM2725 host target genes. The mRNA of each one of this plurality of VGAM2725 host target genes comprises one or more host target binding sites, each having a nucleotide sequence which is at least partly complementary to VGAM2725 RNA, herein designated VGAM RNA, and which when bound by VGAM2725 RNA causes inhibition of translation of respective one or more VGAM2725 host target proteins.

It is further appreciated by one skilled in the art that the mode of translational inhibition illustrated by FIG. 1 with specific reference to translational inhibition exerted by VGAM2725 gene, herein designated VGAM GENE, on one or more VGAM2725 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2725 is inhibition of expression of host target genes, as part of a novel viral mechanism of attacking a host. Accordingly, utilities of VGAM2725 include diagnosis, prevention and treatment of viral infection by Aphid Lethal Paralysis Virus. Specific functions, and accordingly utilities, of VGAM2725 correlate with, and may be deduced from, the identity of the host target genes which VGAM2725 binds and inhibits, and the function of these host target genes, as elaborated hereinbelow.

Nucleotide sequences of the VGAM2725 precursor RNA, herein designated VGAM PRECURSOR RNA, and of the 'diced' VGAM2725 RNA, herein designated VGAM RNA, and a schematic representation of the secondary folding of VGAM2725 folded precursor RNA, herein designated VGAM FOLDED PRECURSOR RNA, of VGAM2725 are further described hereinbelow with reference to Table 1.

Nucleotide sequences of host target binding sites, such as BINDING SITE-I, BINDING SITE-II and BINDING SITE-III of FIG. 1, found on VGAM2725 host target RNA, and schematic representation of the complementarity of each of these host target binding sites to VGAM2725 RNA, herein designated VGAM RNA, are described hereinbelow with reference to Table 2.

As mentioned hereinabove with reference to FIG. 1, a function of VGAM2725 gene, herein designated VGAM is inhibition of expression of VGAM2725 target genes. It is appreciated that specific functions, and accordingly utilities, of VGAM2725 correlate with, and may be deduced from, the identity of the target genes which VGAM2725 binds and inhibits, and the function of these target genes, as elaborated hereinbelow.

Fibroblast Growth Factor 5 (FGF5, Accession NM_004464) is a VGAM2725 host target gene. FGF5 BINDING SITE1 and FGF5 BINDING SITE2 are HOST TARGET binding sites found in untranslated regions of mRNA encoded by FGF5, corresponding to HOST TARGET binding sites such as BINDING SITE I, BINDING SITE II or BINDING SITE III. Table 2 illustrates the complementarity of the nucleotide sequences of FGF5 BINDING SITE1 and FGF5 BINDING SITE2, designated SEQ ID:10770 and SEQ ID:26997 respectively, to the nucleotide sequence of VGAM2725 RNA, herein designated VGAM RNA, also designated SEQ ID:5436.

A function of VGAM2725 is therefore inhibition of Fibroblast Growth Factor 5 (FGF5, Accession NM_004464), a gene which induces transformation and may regulate neuronal differentiation. Accordingly, utilities of VGAM2725 include diagnosis, prevention and treatment of diseases and clinical conditions associated with FGF5. The function of FGF5 and its association with various diseases and clinical conditions, has been established by previous studies, as described hereinabove with reference to VGAM276.

KIAA1870 (Accession NM_032888) is another VGAM2725 host target gene. KIAA1870 BINDING SITE is HOST TARGET binding site found in the 3' untranslated region of mRNA encoded by KIAA1870, corresponding to a HOST TARGET binding site such as BINDING SITE I, BINDING SITE II or BINDING SITE III. Table 2 illustrates the complementarity of the nucleotide sequences of KIAA1870 BINDING SITE, designated SEQ ID:26711, to the nucleotide sequence of VGAM2725 RNA, herein designated VGAM RNA, also designated SEQ ID:5436.

Another function of VGAM2725 is therefore inhibition of KIAA1870 (Accession NM_032888). Accordingly, utilities of VGAM2725 include diagnosis, prevention and treatment of diseases and clinical conditions associated with KIAA1870. FIG. 1 further provides a conceptual description of a novel bioinformatically detected viral gene of the present invention, referred to here as Viral Genomic Address Messenger 2726 (VGAM2726) viral gene, which modulates expression of respective host target genes thereof, the function and utility of which host target genes is known in the art.

VGAM2726 is a novel bioinformatically detected regulatory, non protein coding, viral micro RNA (miRNA) gene. The method by which VGAM2726 was detected is described hereinabove with reference to FIGS. 1-8.

VGAM2726 gene, herein designated VGAM GENE, is a viral gene contained in the genome of Aphid Lethal Paralysis Virus. VGAM2726 host target gene, herein designated VGAM HOST TARGET GENE, is a human gene contained in the human genome.

VGAM2726 gene encodes a VGAM2726 precursor RNA, herein designated VGAM PRECURSOR RNA. Similar to other miRNA genes, and unlike most ordinary genes, VGAM2726 precursor RNA does not encode a protein. A nucleotide sequence identical or highly similar to the nucleotide sequence of VGAM2726 precursor RNA is designated SEQ ID:2712, and is provided hereinbelow with reference to the sequence listing part. Nucleotide sequence SEQ ID:2712 is located at position 3591 relative to the genome of Aphid Lethal Paralysis Virus.

VGAM2726 precursor RNA folds onto itself, forming VGAM2726 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2726 folded precursor RNA into VGAM2726 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2726 RNA is designated SEQ ID:5437, and is provided hereinbelow with reference to the sequence listing part.

VGAM2726 host target gene, herein designated VGAM HOST TARGET GENE, encodes a corresponding messenger RNA, VGAM2726 host target RNA, herein designated VGAM HOST TARGET RNA. VGAM2726 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2726 RNA, herein designated VGAM RNA, binds complementarily to one or more host target binding sites located in untranslated regions of VGAM2726 host target RNA, herein designated VGAM HOST TARGET RNA. This complementary binding is due to the fact that the nucleotide sequence of VGAM2726 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2726 RNA, herein designated VGAM RNA, may have a different number of host target binding sites in untranslated regions of a VGAM2726 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2726 RNA, herein designated VGAM RNA, to host target binding sites on VGAM2726 host target RNA, herein designated VGAM HOST TARGET RNA, such as BINDING SITE I, BINDING SITE II and BINDING SITE III, inhibits translation of VGAM2726 host target RNA into VGAM2726 host target protein, herein designated VGAM HOST TARGET PROTEIN. VGAM host target protein is therefore outlined by a broken line.

It is appreciated that VGAM2726 host target gene, herein designated VGAM HOST TARGET GENE, in fact represents a plurality of VGAM2726 host target genes. The mRNA of each one of this plurality of VGAM2726 host target genes comprises one or more host target binding sites, each having a nucleotide sequence which is at least partly complementary to VGAM2726 RNA, herein designated VGAM RNA, and which when bound by VGAM2726 RNA causes inhibition of translation of respective one or more VGAM2726 host target proteins.

It is further appreciated by one skilled in the art that the mode of translational inhibition illustrated by FIG. 1 with specific reference to translational inhibition exerted by VGAM2726 gene, herein designated VGAM GENE, on one or more VGAM2726 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2726 is inhibition of expression of host target genes, as part of a novel viral mechanism of attacking a host. Accordingly, utilities of VGAM2726 include diagnosis, prevention and treatment of viral infection by Aphid Lethal Paralysis Virus. Specific functions, and accordingly utilities, of VGAM2726 correlate with, and may be deduced from, the identity of the host target genes which VGAM2726 binds and inhibits, and the function of these host target genes, as elaborated hereinbelow.

Nucleotide sequences of the VGAM2726 precursor RNA, herein designated VGAM PRECURSOR RNA, and of the 'diced' VGAM2726 RNA, herein designated VGAM RNA, and a schematic representation of the secondary folding of VGAM2726 folded precursor RNA, herein designated VGAM FOLDED PRECURSOR RNA, of VGAM2726 are further described hereinbelow with reference to Table 1.

Nucleotide sequences of host target binding sites, such as BINDING SITE-I, BINDING SITE-II and BINDING SITE-III of FIG. 1, found on VGAM2726 host target RNA, and schematic representation of the complementarity of each of these host target binding sites to VGAM2726 RNA, herein designated VGAM RNA, are described hereinbelow with reference to Table 2.

As mentioned hereinabove with reference to FIG. 1, a function of VGAM2726 gene, herein designated VGAM is inhibition of expression of VGAM2726 target genes. It is appreciated that specific functions, and accordingly utilities, of VGAM2726 correlate with, and may be deduced from, the identity of the target genes which VGAM2726 binds and inhibits, and the function of these target genes, as elaborated hereinbelow.

DKFZp761B0514 (Accession NM_032289) is a VGAM2726 host target gene. DKFZp761B0514 BINDING SITE is HOST TARGET binding site found in the 3' untranslated region of mRNA encoded by DKFZp761B0514, corresponding to a HOST TARGET binding site such as BINDING SITE I, BINDING SITE II or BINDING SITE III. Table 2 illustrates the complementarity of the nucleotide sequences of DKFZp761B0514 BINDING SITE, designated SEQ ID:26048, to the nucleotide sequence of VGAM2726 RNA, herein designated VGAM RNA, also designated SEQ ID:5437.

A function of VGAM2726 is therefore inhibition of DKFZp761B0514 (Accession NM_032289). Accordingly, utilities of VGAM2726 include diagnosis, prevention and treatment of diseases and clinical conditions associated with DKFZp761B0514. KIAA1028 (Accession XM_166324) is another VGAM2726 host target gene. KIAA1028 BINDING SITE is HOST TARGET binding site found in the 3' untranslated region of mRNA encoded by KIAA1028, corresponding to a HOST TARGET binding site such as BINDING SITE I, BINDING SITE II or BINDING SITE III. Table 2 illustrates the complementarity of the nucleotide sequences of KIAA1028 BINDING SITE, designated SEQ ID:44162, to the nucleotide sequence of VGAM2726 RNA, herein designated VGAM RNA, also designated SEQ ID:5437.

Another function of VGAM2726 is therefore inhibition of KIAA1028 (Accession XM_166324). Accordingly, utilities of VGAM2726 include diagnosis, prevention and treatment of diseases and clinical conditions associated with KIAA1028. PRO2831 (Accession NM_018540) is another VGAM2726 host target gene. PRO2831 BINDING SITE is HOST TARGET binding site found in the 3' untranslated region of mRNA encoded by PRO2831, corresponding to a HOST TARGET binding site such as BINDING SITE I, BINDING SITE II or BINDING SITE III. Table 2 illustrates the complementarity of the nucleotide sequences of PRO2831 BINDING SITE, designated SEQ ID:20612, to the nucleotide sequence of VGAM2726 RNA, herein designated VGAM RNA, also designated SEQ ID:5437.

Another function of VGAM2726 is therefore inhibition of PRO2831 (Accession NM_018540). Accordingly, utilities of VGAM2726 include diagnosis, prevention and treatment of diseases and clinical conditions associated with PRO2831. LOC200734 (Accession XM_114286) is another VGAM2726 host target gene. LOC200734 BINDING SITE is HOST TARGET binding site found in the 3' untranslated region of mRNA encoded by LOC200734, corresponding to a HOST TARGET binding site such as BINDING SITE I, BINDING SITE II or BINDING SITE III. Table 2 illustrates the complementarity of the nucleotide sequences of LOC200734 BINDING SITE, designated SEQ ID:42841, to the nucleotide sequence of VGAM2726 RNA, herein designated VGAM RNA, also designated SEQ ID:5437.

Another function of VGAM2726 is therefore inhibition of LOC200734 (Accession XM_114286). Accordingly, utilities of VGAM2726 include diagnosis, prevention and treatment of diseases and clinical conditions associated with LOC200734. LOC219940 (Accession XM_167791) is another VGAM2726 host target gene. LOC219940 BINDING SITE is HOST TARGET binding site found in the 3' untranslated region of mRNA encoded by LOC219940, corresponding to a HOST TARGET binding site such as BINDING SITE I, BINDING SITE II or BINDING SITE III. Table 2 illustrates the complementarity of the nucleotide sequences of LOC219940 BINDING SITE, designated SEQ ID:44833, to the nucleotide sequence of VGAM2726 RNA, herein designated VGAM RNA, also designated SEQ ID:5437.

Another function of VGAM2726 is therefore inhibition of LOC219940 (Accession XM_167791). Accordingly, utilities of VGAM2726 include diagnosis, prevention and treatment of diseases and clinical conditions associated with LOC219940. FIG. 1 further provides a conceptual description of a novel bioinformatically detected viral gene of the present invention, referred to here as Viral Genomic Address Messenger 2727 (VGAM2727) viral gene, which modulates expression of respective host target genes thereof, the function and utility of which host target genes is known in the art.

VGAM2727 is a novel bioinformatically detected regulatory, non protein coding, viral micro RNA (miRNA) gene. The method by which VGAM2727 was detected is described hereinabove with reference to FIGS. 1-8.

VGAM2727 gene, herein designated VGAM GENE, is a viral gene contained in the genome of Aphid Lethal Paralysis Virus. VGAM2727 host target gene, herein designated VGAM HOST TARGET GENE, is a human gene contained in the human genome.

VGAM2727 gene encodes a VGAM2727 precursor RNA, herein designated VGAM PRECURSOR RNA. Similar to other miRNA genes, and unlike most ordinary genes, VGAM2727 precursor RNA does not encode a protein. A nucleotide sequence identical or highly similar to the nucleotide sequence of VGAM2727 precursor RNA is designated SEQ ID:2713, and is provided hereinbelow with reference to the sequence listing part. Nucleotide sequence SEQ ID:2713 is located at position 4727 relative to the genome of Aphid Lethal Paralysis Virus.

VGAM2727 precursor RNA folds onto itself, forming VGAM2727 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2727 folded precursor RNA into VGAM2727 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 54%) nucleotide sequence of VGAM2727 RNA is designated SEQ ID:5438, and is provided hereinbelow with reference to the sequence listing part.

VGAM2727 host target gene, herein designated VGAM HOST TARGET GENE, encodes a corresponding messenger RNA, VGAM2727 host target RNA, herein designated VGAM HOST TARGET RNA. VGAM2727 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2727 RNA, herein designated VGAM RNA, binds complementarily to one or more host target binding sites located in untranslated regions of VGAM2727 host target RNA, herein designated VGAM HOST TARGET RNA. This complementary binding is due to the fact that the nucleotide sequence of VGAM2727 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2727 RNA, herein designated VGAM RNA, may have a different number of host target binding sites in untranslated regions of a VGAM2727 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2727 RNA, herein designated VGAM RNA, to host target binding sites on VGAM2727 host target RNA, herein designated VGAM HOST TARGET RNA, such as BINDING SITE I, BINDING SITE II and BINDING SITE III, inhibits translation of VGAM2727 host target RNA into VGAM2727 host target protein, herein designated VGAM HOST TARGET PROTEIN. VGAM host target protein is therefore outlined by a broken line.

It is appreciated that VGAM2727 host target gene, herein designated VGAM HOST TARGET GENE, in fact represents a plurality of VGAM2727 host target genes. The mRNA of each one of this plurality of VGAM2727 host target genes comprises one or more host target binding sites, each having a nucleotide sequence which is at least partly complementary to VGAM2727 RNA, herein designated VGAM RNA, and which when bound by VGAM2727 RNA causes inhibition of translation of respective one or more VGAM2727 host target proteins.

It is further appreciated by one skilled in the art that the mode of translational inhibition illustrated by FIG. 1 with specific reference to translational inhibition exerted by VGAM2727 gene, herein designated VGAM GENE, on one or more VGAM2727 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2727 is inhibition of expression of host target genes, as part of a novel viral mechanism of attacking a host. Accordingly, utilities of VGAM2727 include diagnosis, prevention and treatment of viral infection by Aphid Lethal Paralysis Virus. Specific functions, and accordingly utilities, of VGAM2727 correlate with, and may be deduced from, the identity of the host target genes which VGAM2727 binds and inhibits, and the function of these host target genes, as elaborated hereinbelow.

Nucleotide sequences of the VGAM2727 precursor RNA, herein designated VGAM PRECURSOR RNA, and of the 'diced' VGAM2727 RNA, herein designated VGAM RNA, and a schematic representation of the secondary folding of VGAM2727 folded precursor RNA, herein designated VGAM FOLDED PRECURSOR RNA, of VGAM2727 are further described hereinbelow with reference to Table 1.

Nucleotide sequences of host target binding sites, such as BINDING SITE-I, BINDING SITE-II and BINDING SITE-III of FIG. 1, found on VGAM2727 host target RNA, and schematic representation of the complementarity of each of these host target binding sites to VGAM2727 RNA, herein designated VGAM RNA, are described hereinbelow with reference to Table 2.

As mentioned hereinabove with reference to FIG. 1, a function of VGAM2727 gene, herein designated VGAM is inhibition of expression of VGAM2727 target genes. It is appreciated that specific functions, and accordingly utilities, of VGAM2727 correlate with, and may be deduced from, the identity of the target genes which VGAM2727 binds and inhibits, and the function of these target genes, as elaborated hereinbelow.

C-terminal Binding Protein 2 (CTBP2, Accession NM_001329) is a VGAM2727 host target gene. CTBP2 BINDING SITE is HOST TARGET binding site found in the 5' untranslated region of mRNA encoded by CTBP2, corresponding to a HOST TARGET binding site such as BINDING SITE I, BINDING SITE II or BINDING SITE III. Table 2 illustrates the complementarity of the nucleotide sequences of CTBP2 BINDING SITE, designated SEQ ID:7010, to the nucleotide sequence of VGAM2727 RNA, herein designated VGAM RNA, also designated SEQ ID:5438.

A function of VGAM2727 is therefore inhibition of C-terminal Binding Protein 2 (CTBP2, Accession NM_001329), a gene which binds to cellular and viral transcriptional repressors regulated by NAD+ and NADH. Accordingly, utilities of VGAM2727 include diagnosis, prevention and treatment of diseases and clinical conditions associated with CTBP2. The function of CTBP2 has been established by previous studies. In Drosophila and in vertebrates, the Polycomb (Pc) group (PcG) genes have been identified as being part of a cellular memory system that is responsible for the stable and heritable repression of gene expression. PC2 (OMIM Ref. No. 603079), a human Pc homolog, CBX2 (OMIM Ref. No. 602770), HPH1 (OMIM Ref. No. 602978), HPH2 (OMIM Ref. No. 602979), BMI1 (OMIM Ref. No. 164831), and RING1 (OMIM Ref. No. 602045) form a complex that localizes in large nuclear domains termed PcG domains. Using a yeast 2-hybrid assay, Sewalt et al. (1999) found that CTBP2 interacts with PC2 and that Xenopus Ctbp1 interacts with Xenopus Pc. The CTBP2 and PC2 interaction also exists in vivo, since the proteins coimmunoprecipitate with each other and partially colocalize in large PcG domains in interphase nuclei. CTBP1 showed the same localization pattern. As with PC2, chimeric LexA-CTBP2 and LexA-CTBP1 proteins repressed gene activity when targeted to a reporter gene. Sewalt et al. (1999) suggested that the CTBP proteins target PC2, and thereby the PcG complex, to particular loci in chromatin that contain binding sites for specific repressors of gene activity, thereby forming a complex between the repressors and the PcG complex, with CTBP as a bridging protein. They speculated that the interference of the adenoviral E1A protein with the transcription machinery of the infected cell may involve interference with PcG-mediated repression through disruption of the CTBP-PcG interaction Zhang et al. (2002) demonstrated that CTBP binding to cellular and viral transcriptional repressors is regulated by NAD+ and NADH, with NADH being 2 to 3 orders of magnitude more effective. Levels of free nuclear nicotinamide adenine dinucleotides, determined using 2-photon microscopy, corresponded to the levels required for half-maximal CTBP binding and were considerably lower than those previously reported. Agents capable of increasing NADH levels stimulated CTBP binding to its partners in vivo and potentiated CTBP-mediated repression. Zhang et al. (2002) proposed that this ability to detect changes in nuclear NAD+/NADH ratio allows CTBP to serve as a redox sensor for transcription Full details of the abovementioned studies are described in the following publications, the disclosure of which are hereby incorporated by reference:

Sewalt, R. G. A. B.; Gunster, M. J.; van der Vlag, J.; Satijn, D. P. E.; Otte, A. P.: C-terminal binding protein is a transcriptional repressor that interacts with a specific class of vertebrate polycomb proteins. Molec. Cell. Biol. 19:777-787, 1999; and Zhang, Q.; Piston, D. W.; Goodman, R. H.: Regulation of corepressor function by nuclear NADH. Science 295:1895-1897, 2002.

Further studies establishing the function and utilities of CTBP2 are found in John Hopkins OMIM database record ID 602619, and in sited publications numbered 8464-846 and 8553-8468 listed in the bibliography section hereinbelow, which are also hereby incorporated by reference. DKFZP434O125 (Accession XM_036284) is another VGAM2727 host target gene. DKFZP434O125 BINDING SITE is HOST TARGET binding site found in the 3' untranslated region of mRNA encoded by DKFZP434O125, corresponding to a HOST TARGET binding site such as BINDING SITE I, BINDING SITE II or BINDING SITE III. Table 2 illustrates the complementarity of the nucleotide sequences of DKFZP434O125 BINDING SITE, designated SEQ ID:32405, to the nucleotide sequence of VGAM2727 RNA, herein designated VGAM RNA, also designated SEQ ID:5438.

Another function of VGAM2727 is therefore inhibition of DKFZP434O125 (Accession XM_036284). Accordingly, utilities of VGAM2727 include diagnosis, prevention and treatment of diseases and clinical conditions associated with DKFZP434O125. KIAA0546 (Accession XM_049055) is another VGAM2727 host target gene. KIAA0546 BINDING SITE is HOST TARGET binding site found in the 3' untranslated region of mRNA encoded by KIAA0546, corresponding to a HOST TARGET binding site such as BINDING SITE I, BINDING SITE II or BINDING SITE III. Table 2 illustrates the complementarity of the nucleotide sequences of KIAA0546 BINDING SITE, designated SEQ ID:35329, to the nucleotide sequence of VGAM2727 RNA, herein designated VGAM RNA, also designated SEQ ID:5438.

Another function of VGAM2727 is therefore inhibition of KIAA0546 (Accession XM_049055). Accordingly, utilities of VGAM2727 include diagnosis, prevention and treatment of diseases and clinical conditions associated with KIAA0546. Leucine-rich Repeat Protein, Neuronal 3 (LRRN3, Accession XM_045261) is another VGAM2727 host target gene. LRRN3 BINDING SITE is HOST TARGET binding site found in the 5' untranslated region of mRNA encoded by LRRN3, corresponding to a HOST TARGET binding site such as BINDING SITE I, BINDING SITE II or BINDING SITE III. Table 2 illustrates the complementarity of the nucleotide sequences of LRRN3 BINDING SITE, designated SEQ ID:34402, to the nucleotide sequence of VGAM2727 RNA, herein designated VGAM RNA, also designated SEQ ID:5438.

Another function of VGAM2727 is therefore inhibition of Leucine-rich Repeat Protein, Neuronal 3 (LRRN3, Accession XM_045261). Accordingly, utilities of VGAM2727 include diagnosis, prevention and treatment of diseases and clinical conditions associated with LRRN3. Rpo1-2 (Accession NM_019014) is another VGAM2727 host target gene. Rpo1-2 BINDING SITE1 and Rpo1-2 BINDING SITE2 are HOST TARGET binding sites found in untranslated regions of mRNA encoded by Rpo1-2, corresponding to HOST TARGET binding sites such as BINDING SITE I, BINDING SITE II or BINDING SITE III. Table 2 illustrates the complementarity of the nucleotide sequences of Rpo1-2 BINDING SITE1 and Rpo1-2 BINDING SITE2, designated SEQ ID:21106 and SEQ ID:25936 respectively, to the nucleotide sequence of VGAM2727 RNA, herein designated VGAM RNA, also designated SEQ ID:5438.

Another function of VGAM2727 is therefore inhibition of Rpo1-2 (Accession NM_019014). Accordingly, utilities of VGAM2727 include diagnosis, prevention and treatment of diseases and clinical conditions associated with Rpo1-2. LOC157695 (Accession XM_098811) is another VGAM2727 host target gene. LOC157695 BINDING SITE is HOST TARGET binding site found in the 3' untranslated region of mRNA encoded by LOC157695, corresponding to a HOST TARGET binding site such as BINDING SITE I, BINDING SITE II or BINDING SITE III. Table 2 illustrates the complementarity of the nucleotide sequences of LOC157695 BINDING SITE, designated SEQ ID:41833, to the nucleotide sequence of VGAM2727 RNA, herein designated VGAM RNA, also designated SEQ ID:5438.

Another function of VGAM2727 is therefore inhibition of LOC157695 (Accession XM_098811). Accordingly, utilities of VGAM2727 include diagnosis, prevention and treatment of diseases and clinical conditions associated with LOC157695. LOC221042 (Accession XM_167669) is another VGAM2727 host target gene. LOC221042 BINDING SITE is HOST TARGET binding site found in the 5' untranslated region of mRNA encoded by LOC221042, corresponding to a HOST TARGET binding site such as BINDING SITE I, BINDING SITE II or BINDING SITE III. Table 2 illustrates the complementarity of the nucleotide sequences of LOC221042 BINDING SITE, designated SEQ ID:44758, to the nucleotide sequence of VGAM2727 RNA, herein designated VGAM RNA, also designated SEQ ID:5438.

Another function of VGAM2727 is therefore inhibition of LOC221042 (Accession XM_167669). Accordingly, utilities of VGAM2727 include diagnosis, prevention and treatment of diseases and clinical conditions associated with LOC221042. FIG. 1 further provides a conceptual description of a novel bioinformatically detected viral gene of the present invention, referred to here as Viral Genomic Address Messenger 2728 (VGAM2728) viral gene, which modulates expression of respective host target genes thereof, the function and utility of which host target genes is known in the art.

VGAM2728 is a novel bioinformatically detected regulatory, non protein coding, viral micro RNA (miRNA) gene. The method by which VGAM2728 was detected is described hereinabove with reference to FIGS. 1-8.

VGAM2728 gene, herein designated VGAM GENE, is a viral gene contained in the genome of Aphid Lethal Paralysis Virus. VGAM2728 host target gene, herein designated VGAM HOST TARGET GENE, is a human gene contained in the human genome.

VGAM2728 gene encodes a VGAM2728 precursor RNA, herein designated VGAM PRECURSOR RNA. Similar to other miRNA genes, and unlike most ordinary genes, VGAM2728 precursor RNA does not encode a protein. A nucleotide sequence identical or highly similar to the nucleotide sequence of VGAM2728 precursor RNA is designated SEQ ID:2714, and is provided hereinbelow with reference to the sequence listing part. Nucleotide sequence SEQ ID:2714 is located at position 7888 relative to the genome of Aphid Lethal Paralysis Virus.

VGAM2728 precursor RNA folds onto itself, forming VGAM2728 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2728 folded precursor RNA into VGAM2728 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2728 RNA is designated SEQ ID:5439, and is provided hereinbelow with reference to the sequence listing part.

VGAM2728 host target gene, herein designated VGAM HOST TARGET GENE, encodes a corresponding messenger RNA, VGAM2728 host target RNA, herein designated VGAM HOST TARGET RNA. VGAM2728 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2728 RNA, herein designated VGAM RNA, binds complementarily to one or more host target binding sites located in untranslated regions of VGAM2728 host target RNA, herein designated VGAM HOST TARGET RNA. This complementary binding is due to the fact that the nucleotide sequence of VGAM2728 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2728 RNA, herein designated VGAM RNA, may have a different number of host target binding sites in untranslated regions of a VGAM2728 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2728 RNA, herein designated VGAM RNA, to host target binding sites on VGAM2728 host target RNA, herein designated VGAM HOST TARGET RNA, such as BINDING SITE I, BINDING SITE II and BINDING SITE III, inhibits translation of VGAM2728 host target RNA into VGAM2728 host target protein, herein designated VGAM HOST TARGET PROTEIN. VGAM host target protein is therefore outlined by a broken line.

It is appreciated that VGAM2728 host target gene, herein designated VGAM HOST TARGET GENE, in fact represents a plurality of VGAM2728 host target genes. The mRNA of each one of this plurality of VGAM2728 host target genes comprises one or more host target binding sites, each having a nucleotide sequence which is at least partly complementary to VGAM2728 RNA, herein designated VGAM RNA, and which when bound by VGAM2728 RNA causes inhibition of translation of respective one or more VGAM2728 host target proteins.

It is further appreciated by one skilled in the art that the mode of translational inhibition illustrated by FIG. 1 with specific reference to translational inhibition exerted by VGAM2728 gene, herein designated VGAM GENE, on one or more VGAM2728 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2728 is inhibition of expression of host target genes, as part of a novel viral mechanism of attacking a host. Accordingly, utilities of VGAM2728 include diagnosis, prevention and treatment of viral infection by Aphid Lethal Paralysis Virus. Specific functions, and accordingly utilities, of VGAM2728 correlate with, and may be deduced from, the identity of the host target genes which VGAM2728 binds and inhibits, and the function of these host target genes, as elaborated hereinbelow.

Nucleotide sequences of the VGAM2728 precursor RNA, herein designated VGAM PRECURSOR RNA, and of the 'diced' VGAM2728 RNA, herein designated VGAM RNA, and a schematic representation of the secondary folding of VGAM2728 folded precursor RNA, herein designated VGAM FOLDED PRECURSOR RNA, of VGAM2728 are further described hereinbelow with reference to Table 1.

Nucleotide sequences of host target binding sites, such as BINDING SITE-I, BINDING SITE-II and BINDING SITE-III of FIG. 1, found on VGAM2728 host target RNA, and schematic representation of the complementarity of each of these host target binding sites to VGAM2728 RNA, herein designated VGAM RNA, are described hereinbelow with reference to Table 2.

As mentioned hereinabove with reference to FIG. 1, a function of VGAM2728 gene, herein designated VGAM is inhibition of expression of VGAM2728 target genes. It is appreciated that specific functions, and accordingly utilities, of VGAM2728 correlate with, and may be deduced from, the identity of the target genes which VGAM2728 binds and inhibits, and the function of these target genes, as elaborated hereinbelow.

Hepatoma-derived Growth Factor (high-mobility group protein 1-like) (HDGF, Accession NM_004494) is a VGAM2728 host target gene. HDGF BINDING SITE is HOST TARGET binding site found in the 3' untranslated region of mRNA encoded by HDGF, corresponding to a HOST TARGET binding site such as BINDING SITE I, BINDING SITE II or BINDING SITE III. Table 2 illustrates the complementarity of the nucleotide sequences of HDGF BINDING SITE, designated SEQ ID:10831, to the nucleotide sequence of VGAM2728 RNA, herein designated VGAM RNA, also designated SEQ ID:5439.

A function of VGAM2728 is therefore inhibition of Hepatoma-derived Growth Factor (high-mobility group protein 1-like) (HDGF, Accession NM_004494), a gene which is a heparin-binding protein, with mitogenic activity for fibroblasts. Accordingly, utilities of VGAM2728 include diagnosis, prevention and treatment of diseases and clinical conditions associated with HDGF. The function of HDGF and its association with various diseases and clinical conditions, has been established by previous studies, as described hereinabove with reference to VGAM1929. Insulin-like Growth Factor Binding Protein 4 (IGFBP4, Accession NM_001552) is another VGAM2728 host target gene. IGFBP4 BINDING SITE is HOST TARGET binding site found in the 3' untranslated region of mRNA encoded by IGFBP4, corresponding to a HOST TARGET binding site such as BINDING SITE I, BINDING SITE II or BINDING SITE III. Table 2 illustrates the complementarity of the nucleotide sequences of IGFBP4 BINDING SITE, designated SEQ ID:7274, to the nucleotide sequence of VGAM2728 RNA, herein designated VGAM RNA, also designated SEQ ID:5439.

Another function of VGAM2728 is therefore inhibition of Insulin-like Growth Factor Binding Protein 4 (IGFBP4, Accession NM_001552), a gene which prolongs the half-life of the igfs and inhibit or stimulate their growth promoting effects on cell culture. Accordingly, utilities of VGAM2728 include diagnosis, prevention and treatment of diseases and clinical conditions associated with IGFBP4. The function of IGFBP4 and its association with various diseases and clinical conditions, has been established by previous studies, as described hereinabove with reference to VGAM2537. Phospholamban (PLN, Accession NM_002667) is another VGAM2728 host target gene. PLN BINDING SITE is HOST TARGET binding site found in the 5' untranslated region of mRNA encoded by PLN, corresponding to a HOST TARGET binding site such as BINDING SITE I, BINDING SITE II or BINDING SITE III. Table 2 illustrates the complementarity of the nucleotide sequences of PLN BINDING SITE, designated SEQ ID:8537, to the nucleotide sequence of VGAM2728 RNA, herein designated VGAM RNA, also designated SEQ ID:5439.

Another function of VGAM2728 is therefore inhibition of Phospholamban (PLN, Accession NM_002667), a gene which regulates the activity of the calcium pump of cardiac sarcoplasmic reticulum. Accordingly, utilities of VGAM2728 include diagnosis, prevention and treatment of diseases and clinical conditions associated with PLN. The function of PLN and its association with various diseases and clinical conditions, has been established by previous studies, as described hereinabove with reference to VGAM119. Protein Phosphatase 1, Catalytic Subunit, Beta Isoform (PPP1CB, Accession NM_002709) is another VGAM2728 host target gene. PPP1CB BINDING SITE is HOST TARGET binding site found in the 3' untranslated region of mRNA encoded by PPP1CB, corresponding to a HOST TARGET binding site such as BINDING SITE I, BINDING SITE II or BINDING SITE III. Table 2 illustrates the complementarity of the nucleotide sequences of PPP1CB BINDING SITE, designated SEQ ID:8557, to the nucleotide sequence of VGAM2728 RNA, herein designated VGAM RNA, also designated SEQ ID:5439.

Another function of VGAM2728 is therefore inhibition of Protein Phosphatase 1, Catalytic Subunit, Beta Isoform (PPP1CB, Accession NM_002709), a gene which is the catalytic subunit of protein phosphatase 1. Accordingly, utilities of VGAM2728 include diagnosis, prevention and treatment of diseases and clinical conditions associated with PPP1CB. The function of PPP1CB and its association with various diseases and clinical conditions, has been established by previous studies, as described hereinabove with reference to VGAM46. Solute Carrier Family 22 (extraneuronal monoamine transporter), Member 3 (SLC22A3, Accession NM_021977) is another VGAM2728 host target gene.

SLC22A3 BINDING SITE is HOST TARGET binding site found in the 3' untranslated region of mRNA encoded by SLC22A3, corresponding to a HOST TARGET binding site such as BINDING SITE I, BINDING SITE II or BINDING SITE III. Table 2 illustrates the complementarity of the nucleotide sequences of SLC22A3 BINDING SITE, designated SEQ ID:22502, to the nucleotide sequence of VGAM2728 RNA, herein designated VGAM RNA, also designated SEQ ID:5439.

Another function of VGAM2728 is therefore inhibition of Solute Carrier Family 22 (extraneuronal monoamine transporter), Member 3 (SLC22A3, Accession NM_021977), a gene which is a sodium-ion dependent, high affinity carnitine transporter. also transports organic cations without the involvement of sodium. involved in the active cellular uptake of carnitine. Accordingly, utilities of VGAM2728 include diagnosis, prevention and treatment of diseases and clinical conditions associated with SLC22A3. The function of SLC22A3 and its association with various diseases and clinical conditions, has been established by previous studies, as described hereinabove with reference to VGAM2147. DKFZP434H132 (Accession NM_015492) is another VGAM2728 host target gene. DKFZP434H132 BINDING SITE is HOST TARGET binding site found in the 5' untranslated region of mRNA encoded by DKFZP434H132, corresponding to a HOST TARGET binding site such as BINDING SITE I, BINDING SITE II or BINDING SITE III. Table 2 illustrates the complementarity of the nucleotide sequences of DKFZP434H132 BINDING SITE, designated SEQ ID:17763, to the nucleotide sequence of VGAM2728 RNA, herein designated VGAM RNA, also designated SEQ ID:5439.

Another function of VGAM2728 is therefore inhibition of DKFZP434H132 (Accession NM_015492). Accordingly, utilities of VGAM2728 include diagnosis, prevention and treatment of diseases and clinical conditions associated with DKFZP434H132. FLJ22833 (Accession NM_022837) is another VGAM2728 host target gene. FLJ22833 BINDING SITE is HOST TARGET binding site found in the 3' untranslated region of mRNA encoded by FLJ22833, corresponding to a HOST TARGET binding site such as BINDING SITE I, BINDING SITE II or BINDING SITE III. Table 2 illustrates the complementarity of the nucleotide sequences of FLJ22833 BINDING SITE, designated SEQ ID:23120, to the nucleotide sequence of VGAM2728 RNA, herein designated VGAM RNA, also designated SEQ ID:5439.

Another function of VGAM2728 is therefore inhibition of FLJ22833 (Accession NM_022837). Accordingly, utilities of VGAM2728 include diagnosis, prevention and treatment of diseases and clinical conditions associated with FLJ22833. KIAA1821 (Accession XM_050101) is another VGAM2728 host target gene. KIAA1821 BINDING SITE is HOST TARGET binding site found in the 3' untranslated region of mRNA encoded by KIAA1821, corresponding to a HOST TARGET binding site such as BINDING SITE I, BINDING SITE II or BINDING SITE III. Table 2 illustrates the complementarity of the nucleotide sequences of KIAA1821 BINDING SITE, designated SEQ ID:35552, to the nucleotide sequence of VGAM2728 RNA, herein designated VGAM RNA, also designated SEQ ID:5439.

Another function of VGAM2728 is therefore inhibition of KIAA1821 (Accession XM_050101). Accordingly, utilities of VGAM2728 include diagnosis, prevention and treatment of diseases and clinical conditions associated with KIAA1821. MGC22014 (Accession XM_035307) is another VGAM2728 host target gene. MGC22014 BINDING SITE is HOST TARGET binding site found in the 3' untranslated region of mRNA encoded by MGC22014, corresponding to a HOST TARGET binding site such as BINDING SITE I, BINDING SITE II or BINDING SITE III. Table 2 illustrates the complementarity of the nucleotide sequences of MGC22014 BINDING SITE, designated SEQ ID:32225, to the nucleotide sequence of VGAM2728 RNA, herein designated VGAM RNA, also designated SEQ ID:5439.

Another function of VGAM2728 is therefore inhibition of MGC22014 (Accession XM_035307). Accordingly, utilities of VGAM2728 include diagnosis, prevention and treatment of diseases and clinical conditions associated with MGC22014. LOC90829 (Accession XM_034325) is another VGAM2728 host target gene. LOC90829 BINDING SITE is HOST TARGET binding site found in the 5' untranslated region of mRNA encoded by LOC90829, corresponding to a HOST TARGET binding site such as BINDING SITE I, BINDING SITE II or BINDING SITE III. Table 2 illustrates the complementarity of the nucleotide sequences of LOC90829 BINDING SITE, designated SEQ ID:32054, to the nucleotide sequence of VGAM2728 RNA, herein designated VGAM RNA, also designated SEQ ID:5439.

Another function of VGAM2728 is therefore inhibition of LOC90829 (Accession XM_034325). Accordingly, utilities of VGAM2728 include diagnosis, prevention and treatment of diseases and clinical conditions associated with LOC90829. FIG. 1 further provides a conceptual description of a novel bioinformatically detected viral gene of the present invention, referred to here as Viral Genomic Address Messenger 2729 (VGAM2729) viral gene, which modulates expression of respective host target genes thereof, the function and utility of which host target genes is known in the art.

VGAM2729 is a novel bioinformatically detected regulatory, non protein coding, viral micro RNA (miRNA) gene. The method by which VGAM2729 was detected is described hereinabove with reference to FIGS. 1-8.

VGAM2729 gene, herein designated VGAM GENE, is a viral gene contained in the genome of Aphid Lethal Paralysis Virus. VGAM2729 host target gene, herein designated VGAM HOST TARGET GENE, is a human gene contained in the human genome.

VGAM2729 gene encodes a VGAM2729 precursor RNA, herein designated VGAM PRECURSOR RNA. Similar to other miRNA genes, and unlike most ordinary genes, VGAM2729 precursor RNA does not encode a protein. A nucleotide sequence identical or highly similar to the nucleotide sequence of VGAM2729 precursor RNA is designated SEQ ID:2715, and is provided hereinbelow with reference to the sequence listing part. Nucleotide sequence SEQ ID:2715 is located at position 7811 relative to the genome of Aphid Lethal Paralysis Virus.

VGAM2729 precursor RNA folds onto itself, forming VGAM2729 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2729 folded precursor RNA into VGAM2729 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2729 RNA is designated SEQ ID:5440, and is provided hereinbelow with reference to the sequence listing part.

VGAM2729 host target gene, herein designated VGAM HOST TARGET GENE, encodes a corresponding messenger RNA, VGAM2729 host target RNA, herein designated VGAM HOST TARGET RNA. VGAM2729 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2729 RNA, herein designated VGAM RNA, binds complementarily to one or more host target binding sites located in untranslated regions of VGAM2729 host target RNA, herein designated VGAM HOST TARGET RNA. This complementary binding is due to the fact that the nucleotide sequence of VGAM2729 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2729 RNA, herein designated VGAM RNA, may have a different number of host target binding sites in untranslated regions of a VGAM2729 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2729 RNA, herein designated VGAM RNA, to host target binding sites on VGAM2729 host target RNA, herein designated VGAM HOST TARGET RNA, such as BINDING SITE I, BINDING SITE II and BINDING SITE III, inhibits translation of VGAM2729 host target RNA into VGAM2729 host target protein, herein designated VGAM HOST TARGET PROTEIN. VGAM host target protein is therefore outlined by a broken line.

It is appreciated that VGAM2729 host target gene, herein designated VGAM HOST TARGET GENE, in fact represents a plurality of VGAM2729 host target genes. The mRNA of each one of this plurality of VGAM2729 host target genes comprises one or more host target binding sites, each having a nucleotide sequence which is at least partly complementary to VGAM2729 RNA, herein designated VGAM RNA, and which when bound by VGAM2729 RNA causes inhibition of translation of respective one or more VGAM2729 host target proteins.

It is further appreciated by one skilled in the art that the mode of translational inhibition illustrated by FIG. 1 with specific reference to translational inhibition exerted by VGAM2729 gene, herein designated VGAM GENE, on one or more VGAM2729 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294, 779 (2001)).

It is yet further appreciated that a function of VGAM2729 is inhibition of expression of host target genes, as part of a novel viral mechanism of attacking a host. Accordingly, utilities of VGAM2729 include diagnosis, prevention and treatment of viral infection by Aphid Lethal Paralysis Virus. Specific functions, and accordingly utilities, of VGAM2729 correlate with, and may be deduced from, the identity of the host target genes which VGAM2729 binds and inhibits, and the function of these host target genes, as elaborated hereinbelow.

Nucleotide sequences of the VGAM2729 precursor RNA, herein designated VGAM PRECURSOR RNA, and of the 'diced' VGAM2729 RNA, herein designated VGAM RNA, and a schematic representation of the secondary folding of VGAM2729 folded precursor RNA, herein designated VGAM FOLDED PRECURSOR RNA, of VGAM2729 are further described hereinbelow with reference to Table 1.

Nucleotide sequences of host target binding sites, such as BINDING SITE-I, BINDING SITE-II and BINDING SITE-III of FIG. 1, found on VGAM2729 host target RNA, and schematic representation of the complementarity of each of these host target binding sites to VGAM2729 RNA, herein designated VGAM RNA, are described hereinbelow with reference to Table 2.

As mentioned hereinabove with reference to FIG. 1, a function of VGAM2729 gene, herein designated VGAM is inhibition of expression of VGAM2729 target genes. It is appreciated that specific functions, and accordingly utilities, of VGAM2729 correlate with, and may be deduced from, the identity of the target genes which VGAM2729 binds and inhibits, and the function of these target genes, as elaborated hereinbelow.

Fukuyama Type Congenital Muscular Dystrophy (fukutin) (FCMD, Accession NM_006731) is a VGAM2729 host target gene. FCMD BINDING SITE is HOST TARGET binding site found in the 3' untranslated region of mRNA encoded by FCMD, corresponding to a HOST TARGET binding site such as BINDING SITE I, BINDING SITE II or BINDING SITE III. Table 2 illustrates the complementarity of the nucleotide sequences of FCMD BINDING SITE, designated SEQ ID:13573, to the nucleotide sequence of VGAM2729 RNA, herein designated VGAM RNA, also designated SEQ ID:5440.

A function of VGAM2729 is therefore inhibition of Fukuyama Type Congenital Muscular Dystrophy (fukutin) (FCMD, Accession NM_006731). Accordingly, utilities of VGAM2729 include diagnosis, prevention and treatment of diseases and clinical conditions associated with FCMD. Keratocan (KERA, Accession NM_007035) is another VGAM2729 host target gene. KERA BINDING SITE is HOST TARGET binding site found in the 3' untranslated region of mRNA encoded by KERA, corresponding to a HOST TARGET binding site such as BINDING SITE I, BINDING SITE II or BINDING SITE III. Table 2 illustrates the complementarity of the nucleotide sequences of KERA BINDING SITE, designated SEQ ID:13908, to the nucleotide sequence of VGAM2729 RNA, herein designated VGAM RNA, also designated SEQ ID:5440.

Another function of VGAM2729 is therefore inhibition of Keratocan (KERA, Accession NM_007035), a gene which may be important in developing and maintaining corneal transparency and for the structure of the stromal matrix. Accordingly, utilities of VGAM2729 include diagnosis, prevention and treatment of diseases and clinical conditions associated with KERA. The function of KERA and its association with various diseases and clinical conditions, has been established by previous studies, as described hereinabove with reference to VGAM723. Vang-like 2 (van gogh, Drosophila) (VANGL2, Accession XM_049695) is another VGAM2729 host target gene. VANGL2 BINDING SITE is HOST TARGET binding site found in the 3' untranslated region of mRNA encoded by VANGL2, corresponding to a HOST TARGET binding site such as BINDING SITE I, BINDING SITE II or BINDING SITE III. Table 2 illustrates the complementarity of the nucleotide sequences of VANGL2 BINDING SITE, designated SEQ ID:35485, to the nucleotide sequence of VGAM2729 RNA, herein designated VGAM RNA, also designated SEQ ID:5440.

Another function of VGAM2729 is therefore inhibition of Vang-like 2 (van gogh, Drosophila) (VANGL2, Accession XM_049695), a gene which may take part in defining the lateral boundary of floorplate differentiation. Accordingly, utilities of VGAM2729 include diagnosis, prevention and treatment of diseases and clinical conditions associated with VANGL2. The function of VANGL2 and its association with various diseases and clinical conditions, has been established by previous studies, as described hereinabove with reference to VGAM111. FIG. 1 further provides a conceptual description of a novel bioinformatically detected viral gene of the present invention, referred to here as Viral Genomic Address Messenger 2730 (VGAM2730) viral gene, which modulates expression of respective host target genes thereof, the function and utility of which host target genes is known in the art.

VGAM2730 is a novel bioinformatically detected regulatory, non protein coding, viral micro RNA (miRNA) gene. The method by which VGAM2730 was detected is described hereinabove with reference to FIGS. 1-8.

VGAM2730 gene, herein designated VGAM GENE, is a viral gene contained in the genome of Callitrichine Herpesvirus 3. VGAM2730 host target gene, herein designated VGAM HOST TARGET GENE, is a human gene contained in the human genome.

VGAM2730 gene encodes a VGAM2730 precursor RNA, herein designated VGAM PRECURSOR RNA. Similar to other miRNA genes, and unlike most ordinary genes, VGAM2730 precursor RNA does not encode a protein. A nucleotide sequence identical or highly similar to the nucleotide sequence of VGAM2730 precursor RNA is designated SEQ ID:2716, and is provided hereinbelow with reference to the sequence listing part. Nucleotide sequence SEQ ID:2716 is located at position 95914 relative to the genome of Callitrichine Herpesvirus 3.

VGAM2730 precursor RNA folds onto itself, forming VGAM2730 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2730 folded precursor RNA into VGAM2730 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2730 RNA is designated SEQ ID:5441, and is provided hereinbelow with reference to the sequence listing part.

VGAM2730 host target gene, herein designated VGAM HOST TARGET GENE, encodes a corresponding messenger RNA, VGAM2730 host target RNA, herein designated VGAM HOST TARGET RNA. VGAM2730 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2730 RNA, herein designated VGAM RNA, binds complementarily to one or more host target binding sites located in untranslated regions of VGAM2730 host target RNA, herein designated VGAM HOST TARGET RNA. This complementary binding is due to the fact that the nucleotide sequence of VGAM2730 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2730 RNA, herein designated VGAM RNA, may have a different number of host target binding sites in untranslated regions of a VGAM2730 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2730 RNA, herein designated VGAM RNA, to host target binding sites on VGAM2730 host target RNA, herein designated VGAM HOST TARGET RNA, such as BINDING SITE I, BINDING SITE II and BINDING SITE III, inhibits translation of VGAM2730 host target RNA into VGAM2730 host target protein, herein designated VGAM HOST TARGET PROTEIN. VGAM host target protein is therefore outlined by a broken line.

It is appreciated that VGAM2730 host target gene, herein designated VGAM HOST TARGET GENE, in fact represents a plurality of VGAM2730 host target genes. The mRNA of each one of this plurality of VGAM2730 host target genes comprises one or more host target binding sites, each having a nucleotide sequence which is at least partly complementary to VGAM2730 RNA, herein designated VGAM RNA, and which when bound by VGAM2730 RNA causes inhibition of translation of respective one or more VGAM2730 host target proteins.

It is further appreciated by one skilled in the art that the mode of translational inhibition illustrated by FIG. 1 with specific reference to translational inhibition exerted by VGAM2730 gene, herein designated VGAM GENE, on one or more VGAM2730 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2730 is inhibition of expression of host target genes, as part of a novel viral mechanism of attacking a host. Accordingly, utilities of VGAM2730 include diagnosis, prevention and treatment of viral infection by Callitrichine Herpesvirus 3. Specific functions, and accordingly utilities, of VGAM2730 correlate with, and may be deduced from, the identity of the host target genes which VGAM2730 binds and inhibits, and the function of these host target genes, as elaborated hereinbelow.

Nucleotide sequences of the VGAM2730 precursor RNA, herein designated VGAM PRECURSOR RNA, and of the 'diced' VGAM2730 RNA, herein designated VGAM RNA, and a schematic representation of the secondary folding of VGAM2730 folded precursor RNA, herein designated VGAM FOLDED PRECURSOR RNA, of VGAM2730 are further described hereinbelow with reference to Table 1.

Nucleotide sequences of host target binding sites, such as BINDING SITE-I, BINDING SITE-II and BINDING SITE-III of FIG. 1, found on VGAM2730 host target RNA, and schematic representation of the complementarity of each of these host target binding sites to VGAM2730 RNA, herein designated VGAM RNA, are described hereinbelow with reference to Table 2.

As mentioned hereinabove with reference to FIG. 1, a function of VGAM2730 gene, herein designated VGAM is inhibition of expression of VGAM2730 target genes. It is appreciated that specific functions, and accordingly utilities, of VGAM2730 correlate with, and may be deduced from, the identity of the target genes which VGAM2730 binds and inhibits, and the function of these target genes, as elaborated hereinbelow.

Fibroblast Growth Factor 2 (basic) (FGF2, Accession NM_002006) is a VGAM2730 host target gene. FGF2 BINDING SITE is HOST TARGET binding site found in the 3' untranslated region of mRNA encoded by FGF2, corresponding to a HOST TARGET binding site such as BINDING SITE I, BINDING SITE II or BINDING SITE III. Table 2 illustrates the complementarity of the nucleotide sequences of FGF2 BINDING SITE, designated SEQ ID:7740, to the nucleotide sequence of VGAM2730 RNA, herein designated VGAM RNA, also designated SEQ ID:5441.

A function of VGAM2730 is therefore inhibition of Fibroblast Growth Factor 2 (basic) (FGF2, Accession NM_002006), a gene which probably involved in nervous system development and function. Accordingly, utilities of VGAM2730 include diagnosis, prevention and treatment of diseases and clinical conditions associated with FGF2. The function of FGF2 and its association with various diseases and clinical conditions, has been established by previous studies, as described hereinabove with reference to VGAM51. Sex Comb On Midleg-like 1 (Drosophila) (SCML1, Accession NM_006746) is another VGAM2730 host target gene. SCML1 BINDING SITE is HOST TARGET binding site found in the 3' untranslated region of mRNA encoded by SCML1, corresponding to a HOST TARGET binding site such as BINDING SITE I, BINDING SITE II or BINDING SITE III. Table 2 illustrates the complementarity of the nucleotide sequences of SCML1 BINDING SITE, designated SEQ ID:13593, to the nucleotide sequence of VGAM2730 RNA, herein designated VGAM RNA, also designated SEQ ID:5441.

Another function of VGAM2730 is therefore inhibition of Sex Comb On Midleg-like 1 (Drosophila) (SCML1, Accession NM_006746). Accordingly, utilities of VGAM2730 include diagnosis, prevention and treatment of diseases and clinical conditions associated with SCML1. Titin (TTN, Accession NM_133378) is another VGAM2730 host target gene. TTN BINDING SITE1 through TTN BINDING SITE3 are HOST TARGET binding sites found in untranslated regions of mRNA encoded by TTN, corresponding to HOST TARGET binding sites such as BINDING SITE I, BINDING SITE II or BINDING SITE III. Table 2 illustrates the complementarity of the nucleotide sequences of TTN BINDING SITE1 through TTN BINDING SITE3, designated SEQ ID:28504, SEQ ID:28509 and SEQ ID:28519 respectively, to the nucleotide sequence of VGAM2730 RNA, herein designated VGAM RNA, also designated SEQ ID:5441.

Another function of VGAM2730 is therefore inhibition of Titin (TTN, Accession NM_133378). Accordingly, utilities of VGAM2730 include diagnosis, prevention and treatment of diseases and clinical conditions associated with TTN. KIAA1116 (Accession NM_014892) is another VGAM2730 host target gene. KIAA1116 BINDING SITE is HOST TARGET binding site found in the 3' untranslated region of mRNA encoded by KIAA1116, corresponding to a HOST TARGET binding site such as BINDING SITE I, BINDING SITE II or BINDING SITE III. Table 2 illustrates the complementarity of the nucleotide sequences of KIAA1116 BINDING SITE, designated SEQ ID:17041, to the nucleotide sequence of VGAM2730 RNA, herein designated VGAM RNA, also designated SEQ ID:5441.

Another function of VGAM2730 is therefore inhibition of KIAA1116 (Accession NM_014892). Accordingly, utilities of VGAM2730 include diagnosis, prevention and treatment of diseases and clinical conditions associated with KIAA1116. Rpo1-2 (Accession NM_019014) is another VGAM2730 host target gene. Rpo1-2 BINDING SITE1 and Rpo1-2 BINDING SITE2 are HOST TARGET binding sites found in untranslated regions of mRNA encoded by Rpo1-2, corresponding to HOST TARGET binding sites such as BINDING SITE I, BINDING SITE II or BINDING SITE III. Table 2 illustrates the complementarity of the nucleotide sequences of Rpo1-2 BINDING SITE1 and Rpo1-2 BINDING SITE2, designated SEQ ID:21104 and SEQ ID:25934 respectively, to the nucleotide sequence of VGAM2730 RNA, herein designated VGAM RNA, also designated SEQ ID:5441.

Another function of VGAM2730 is therefore inhibition of Rpo1-2 (Accession NM_019014). Accordingly, utilities of VGAM2730 include diagnosis, prevention and treatment of diseases and clinical conditions associated with Rpo1-2. LOC93613 (Accession XM_052568) is another VGAM2730 host target gene. LOC93613 BINDING SITE is HOST TARGET binding site found in the 5' untranslated region of mRNA encoded by LOC93613, corresponding to a HOST TARGET binding site such as BINDING SITE I, BINDING SITE II or BINDING SITE III. Table 2 illustrates the complementarity of the nucleotide sequences of LOC93613 BINDING SITE, designated SEQ ID:35995, to the nucleotide sequence of VGAM2730 RNA, herein designated VGAM RNA, also designated SEQ ID:5441.

Another function of VGAM2730 is therefore inhibition of LOC93613 (Accession XM_052568). Accordingly, utilities of VGAM2730 include diagnosis, prevention and treatment of diseases and clinical conditions associated with LOC93613. FIG. 1 further provides a conceptual description of a novel bioinformatically detected viral gene of the present invention, referred to here as Viral Genomic Address Messenger 2731 (VGAM2731) viral gene, which modulates expression of respective host target genes thereof, the function and utility of which host target genes is known in the art.

VGAM2731 is a novel bioinformatically detected regulatory, non protein coding, viral micro RNA (miRNA) gene. The method by which VGAM2731 was detected is described hereinabove with reference to FIGS. 1-8.

VGAM2731 gene, herein designated VGAM GENE, is a viral gene contained in the genome of Callitrichine Herpesvirus 3. VGAM2731 host target gene, herein designated VGAM HOST TARGET GENE, is a human gene contained in the human genome.

VGAM2731 gene encodes a VGAM2731 precursor RNA, herein designated VGAM PRECURSOR RNA. Similar to other miRNA genes, and unlike most ordinary genes, VGAM2731 precursor RNA does not encode a protein. A nucleotide sequence identical or highly similar to the nucleotide sequence of VGAM2731 precursor RNA is designated SEQ ID:2717, and is provided hereinbelow with reference to the sequence listing part. Nucleotide sequence SEQ ID:2717 is located at position 96552 relative to the genome of Callitrichine Herpesvirus 3.

VGAM2731 precursor RNA folds onto itself, forming VGAM2731 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2731 folded precursor RNA into VGAM2731 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 76%) nucleotide sequence of VGAM2731 RNA is designated SEQ ID:5442, and is provided hereinbelow with reference to the sequence listing part.

VGAM2731 host target gene, herein designated VGAM HOST TARGET GENE, encodes a corresponding messenger RNA, VGAM2731 host target RNA, herein designated VGAM HOST TARGET RNA. VGAM2731 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2731 RNA, herein designated VGAM RNA, binds complementarily to one or more host target binding sites located in untranslated regions of VGAM2731 host target RNA, herein designated VGAM HOST TARGET RNA. This complementary binding is due to the fact that the nucleotide sequence of VGAM2731 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2731 RNA, herein designated VGAM RNA, may have a different number of host target binding sites in untranslated regions of a VGAM2731 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2731 RNA, herein designated VGAM RNA, to host target binding sites on VGAM2731 host target RNA, herein designated VGAM HOST TARGET RNA, such as BINDING SITE I, BINDING SITE II and BINDING SITE III, inhibits translation of VGAM2731 host target RNA into VGAM2731 host target protein, herein designated VGAM HOST TARGET PROTEIN. VGAM host target protein is therefore outlined by a broken line.

It is appreciated that VGAM2731 host target gene, herein designated VGAM HOST TARGET GENE, in fact represents a plurality of VGAM2731 host target genes. The mRNA of each one of this plurality of VGAM2731 host target genes comprises one or more host target binding sites, each having a nucleotide sequence which is at least partly complementary to VGAM2731 RNA, herein designated VGAM RNA, and which when bound by VGAM2731 RNA causes inhibition of translation of respective one or more VGAM2731 host target proteins.

It is further appreciated by one skilled in the art that the mode of translational inhibition illustrated by FIG. 1 with specific reference to translational inhibition exerted by VGAM2731 gene, herein designated VGAM GENE, on one or more VGAM2731 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2731 is inhibition of expression of host target genes, as part of a novel viral mechanism of attacking a host. Accordingly, utilities of VGAM2731 include diagnosis, prevention and treatment of viral infection by Callitrichine Herpesvirus 3. Specific functions, and accordingly utilities, of VGAM2731 correlate with, and may be deduced from, the identity of the host target genes which VGAM2731 binds and inhibits, and the function of these host target genes, as elaborated hereinbelow.

Nucleotide sequences of the VGAM2731 precursor RNA, herein designated VGAM PRECURSOR RNA, and of the 'diced' VGAM2731 RNA, herein designated VGAM RNA, and a schematic representation of the secondary folding of VGAM2731 folded precursor RNA, herein designated VGAM FOLDED PRECURSOR RNA, of VGAM2731 are further described hereinbelow with reference to Table 1.

Nucleotide sequences of host target binding sites, such as BINDING SITE-I, BINDING SITE-II and BINDING SITE-III of FIG. 1, found on VGAM2731 host target RNA, and schematic representation of the complementarity of each of these host target binding sites to VGAM2731 RNA, herein designated VGAM RNA, are described hereinbelow with reference to Table 2.

As mentioned hereinabove with reference to FIG. 1, a function of VGAM2731 gene, herein designated VGAM is inhibition of expression of VGAM2731 target genes. It is appreciated that specific functions, and accordingly utilities, of VGAM2731 correlate with, and may be deduced from, the identity of the target genes which VGAM2731 binds and inhibits, and the function of these target genes, as elaborated hereinbelow.

LOC152328 (Accession XM_087420) is a VGAM2731 host target gene. LOC152328 BINDING SITE is HOST TARGET binding site found in the 3' untranslated region of mRNA encoded by LOC152328, corresponding to a HOST TARGET binding site such as BINDING SITE I, BINDING SITE II or BINDING SITE III. Table 2 illustrates the complementarity of the nucleotide sequences of LOC152328 BINDING SITE, designated SEQ ID:39242, to the nucleotide sequence of VGAM2731 RNA, herein designated VGAM RNA, also designated SEQ ID:5442.

A function of VGAM2731 is therefore inhibition of LOC152328 (Accession XM_087420). Accordingly, utilities of VGAM2731 include diagnosis, prevention and treatment of diseases and clinical conditions associated with LOC152328. FIG. 1 further provides a conceptual description of a novel bioinformatically detected viral gene of the present invention, referred to here as Viral Genomic Address Messenger 2732 (VGAM2732) viral gene, which modulates expression of respective host target genes thereof, the function and utility of which host target genes is known in the art.

VGAM2732 is a novel bioinformatically detected regulatory, non protein coding, viral micro RNA (miRNA) gene. The method by which VGAM2732 was detected is described hereinabove with reference to FIGS. 1-8.

VGAM2732 gene, herein designated VGAM GENE, is a viral gene contained in the genome of Callitrichine Herpesvirus 3. VGAM2732 host target gene, herein designated VGAM HOST TARGET GENE, is a human gene contained in the human genome.

VGAM2732 gene encodes a VGAM2732 precursor RNA, herein designated VGAM PRECURSOR RNA. Similar to other miRNA genes, and unlike most ordinary genes, VGAM2732 precursor RNA does not encode a protein. A nucleotide sequence identical or highly similar to the nucleotide sequence of VGAM2732 precursor RNA is designated SEQ ID:2718, and is provided hereinbelow with reference to the sequence listing part. Nucleotide sequence SEQ ID:2718 is located at position 136708 relative to the genome of Callitrichine Herpesvirus 3.

VGAM2732 precursor RNA folds onto itself, forming VGAM2732 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2732 folded precursor RNA into VGAM2732 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 46%) nucleotide sequence of VGAM2732 RNA is designated SEQ ID:5443, and is provided hereinbelow with reference to the sequence listing part.

VGAM2732 host target gene, herein designated VGAM HOST TARGET GENE, encodes a corresponding messenger RNA, VGAM2732 host target RNA, herein designated VGAM HOST TARGET RNA. VGAM2732 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2732 RNA, herein designated VGAM RNA, binds complementarily to one or more host target binding sites located in untranslated regions of VGAM2732 host target RNA, herein designated VGAM HOST TARGET RNA. This complementary binding is due to the fact that the nucleotide sequence of VGAM2732 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2732 RNA, herein designated VGAM RNA, may have a different number of host target binding sites in untranslated regions of a VGAM2732 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2732 RNA, herein designated VGAM RNA, to host target binding sites on VGAM2732 host target RNA, herein designated VGAM HOST TARGET RNA, such as BINDING SITE I, BINDING SITE II and BINDING SITE III, inhibits translation of VGAM2732 host target RNA into VGAM2732 host target protein, herein designated VGAM HOST TARGET PROTEIN. VGAM host target protein is therefore outlined by a broken line.

It is appreciated that VGAM2732 host target gene, herein designated VGAM HOST TARGET GENE, in fact represents a plurality of VGAM2732 host target genes. The mRNA of each one of this plurality of VGAM2732 host target genes comprises one or more host target binding sites, each having a nucleotide sequence which is at least partly complementary to VGAM2732 RNA, herein designated VGAM RNA, and which when bound by VGAM2732 RNA causes inhibition of translation of respective one or more VGAM2732 host target proteins.

It is further appreciated by one skilled in the art that the mode of translational inhibition illustrated by FIG. 1 with specific reference to translational inhibition exerted by VGAM2732 gene, herein designated VGAM GENE, on one or more VGAM2732 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2732 is inhibition of expression of host target genes, as part of a novel viral mechanism of attacking a host. Accordingly, utilities of VGAM2732 include diagnosis, prevention and treatment of viral infection by Callitrichine Herpesvirus 3. Specific functions, and accordingly utilities, of VGAM2732 correlate with, and may be deduced from, the identity of the host target genes which VGAM2732 binds and inhibits, and the function of these host target genes, as elaborated hereinbelow.

Nucleotide sequences of the VGAM2732 precursor RNA, herein designated VGAM PRECURSOR RNA, and of the 'diced' VGAM2732 RNA, herein designated VGAM RNA, and a schematic representation of the secondary folding of VGAM2732 folded precursor RNA, herein designated VGAM FOLDED PRECURSOR RNA, of VGAM2732 are further described hereinbelow with reference to Table 1.

Nucleotide sequences of host target binding sites, such as BINDING SITE-I, BINDING SITE-II and BINDING SITE-III of FIG. 1, found on VGAM2732 host target RNA, and schematic representation of the complementarity of each of these host target binding sites to VGAM2732 RNA, herein designated VGAM RNA, are described hereinbelow with reference to Table 2.

As mentioned hereinabove with reference to FIG. 1, a function of VGAM2732 gene, herein designated VGAM is inhibition of expression of VGAM2732 target genes. It is appreciated that specific functions, and accordingly utilities, of VGAM2732 correlate with, and may be deduced from, the identity of the target genes which VGAM2732 binds and inhibits, and the function of these target genes, as elaborated hereinbelow.

FLJ20701 (Accession NM_017933) is a VGAM2732 host target gene. FLJ20701 BINDING SITE is HOST TARGET binding site found in the 3' untranslated region of mRNA encoded by FLJ20701, corresponding to a HOST TARGET binding site such as BINDING SITE I, BINDING SITE II or BINDING SITE III. Table 2 illustrates the complementarity of the nucleotide sequences of FLJ20701 BINDING SITE, designated SEQ ID:19621, to the nucleotide sequence of VGAM2732 RNA, herein designated VGAM RNA, also designated SEQ ID:5443.

A function of VGAM2732 is therefore inhibition of FLJ20701 (Accession NM_017933). Accordingly, utilities of VGAM2732 include diagnosis, prevention and treatment of diseases and clinical conditions associated with FLJ20701. P5-1 (Accession NM_006674) is another VGAM2732 host target gene. P5-1 BINDING SITE is HOST TARGET binding site found in the 3' untranslated region of mRNA encoded by P5-1, corresponding to a HOST TARGET binding site such as BINDING SITE I, BINDING SITE II or BINDING SITE III. Table 2 illustrates the complementarity of the nucleotide sequences of P5-1 BINDING SITE, designated SEQ ID:13495, to the nucleotide sequence of VGAM2732 RNA, herein designated VGAM RNA, also designated SEQ ID:5443.

Another function of VGAM2732 is therefore inhibition of P5-1 (Accession NM_006674). Accordingly, utilities of VGAM2732 include diagnosis, prevention and treatment of diseases and clinical conditions associated with P5-1. LOC149705 (Accession XM_097711) is another VGAM2732 host target gene. LOC149705 BINDING SITE is HOST TARGET binding site found in the 3' untranslated region of mRNA encoded by LOC149705, corresponding to a HOST TARGET binding site such as BINDING SITE I, BINDING SITE II or BINDING SITE III. Table 2 illustrates the complementarity of the nucleotide sequences of LOC149705 BINDING SITE, designated SEQ ID:41051, to the nucleotide sequence of VGAM2732 RNA, herein designated VGAM RNA, also designated SEQ ID:5443.

Another function of VGAM2732 is therefore inhibition of LOC149705 (Accession XM_097711). Accordingly, utilities of VGAM2732 include diagnosis, prevention and treatment of diseases and clinical conditions associated with LOC149705. FIG. 1 further provides a conceptual description of a novel bioinformatically detected viral gene of the present invention, referred to here as Viral Genomic Address Messenger 2733 (VGAM2733) viral gene, which modulates expression of respective host target genes thereof, the function and utility of which host target genes is known in the art.

VGAM2733 is a novel bioinformatically detected regulatory, non protein coding, viral micro RNA (miRNA) gene. The method by which VGAM2733 was detected is described hereinabove with reference to FIGS. 1-8.

VGAM2733 gene, herein designated VGAM GENE, is a viral gene contained in the genome of Broad Bean Necrosis Virus. VGAM2733 host target gene, herein designated VGAM HOST TARGET GENE, is a human gene contained in the human genome.

VGAM2733 gene encodes a VGAM2733 precursor RNA, herein designated VGAM PRECURSOR RNA. Similar to other miRNA genes, and unlike most ordinary genes, VGAM2733 precursor RNA does not encode a protein. A nucleotide sequence identical or highly similar to the nucleotide sequence of VGAM2733 precursor RNA is designated SEQ ID:2719, and is provided hereinbelow with reference to the sequence listing part. Nucleotide sequence SEQ ID:2719 is located at position 1316 relative to the genome of Broad Bean Necrosis Virus.

VGAM2733 precursor RNA folds onto itself, forming VGAM2733 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2733 folded precursor RNA into VGAM2733 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 80%) nucleotide sequence of VGAM2733 RNA is designated SEQ ID:5444, and is provided hereinbelow with reference to the sequence listing part.

VGAM2733 host target gene, herein designated VGAM HOST TARGET GENE, encodes a corresponding messenger RNA, VGAM2733 host target RNA, herein designated VGAM HOST TARGET RNA. VGAM2733 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2733 RNA, herein designated VGAM RNA, binds complementarily to one or more host target binding sites located in untranslated regions of VGAM2733 host target RNA, herein designated VGAM HOST TARGET RNA. This complementary binding is due to the fact that the nucleotide sequence of VGAM2733 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2733 RNA, herein designated VGAM RNA, may have a different number of host target binding sites in untranslated regions of a VGAM2733 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2733 RNA, herein designated VGAM RNA, to host target binding sites on VGAM2733 host target RNA, herein designated VGAM HOST TARGET RNA, such as BINDING SITE I, BINDING SITE II and BINDING SITE III, inhibits translation of VGAM2733 host target RNA into VGAM2733 host target protein, herein designated VGAM HOST TARGET PROTEIN. VGAM host target protein is therefore outlined by a broken line.

It is appreciated that VGAM2733 host target gene, herein designated VGAM HOST TARGET GENE, in fact represents a plurality of VGAM2733 host target genes. The mRNA of each one of this plurality of VGAM2733 host target genes comprises one or more host target binding sites, each having a nucleotide sequence which is at least partly complementary to VGAM2733 RNA, herein designated VGAM RNA, and which when bound by VGAM2733 RNA causes inhibition of translation of respective one or more VGAM2733 host target proteins.

It is further appreciated by one skilled in the art that the mode of translational inhibition illustrated by FIG. 1 with specific reference to translational inhibition exerted by VGAM2733 gene, herein designated VGAM GENE, on one or more VGAM2733 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2733 is inhibition of expression of host target genes, as part of a novel viral mechanism of attacking a host. Accordingly, utilities of VGAM2733 include diagnosis, prevention and treatment of viral infection by Broad Bean Necrosis Virus. Specific functions, and accordingly utilities, of VGAM2733 correlate with, and may be deduced from, the identity of the host target genes which VGAM2733 binds and inhibits, and the function of these host target genes, as elaborated hereinbelow.

Nucleotide sequences of the VGAM2733 precursor RNA, herein designated VGAM PRECURSOR RNA, and of the 'diced' VGAM2733 RNA, herein designated VGAM RNA, and a schematic representation of the secondary folding of VGAM2733 folded precursor RNA, herein designated VGAM FOLDED PRECURSOR RNA, of VGAM2733 are further described hereinbelow with reference to Table 1.

Nucleotide sequences of host target binding sites, such as BINDING SITE-I, BINDING SITE-II and BINDING SITE-III of FIG. 1, found on VGAM2733 host target RNA, and schematic representation of the complementarity of each of these host target binding sites to VGAM2733 RNA, herein designated VGAM RNA, are described hereinbelow with reference to Table 2.

As mentioned hereinabove with reference to FIG. 1, a function of VGAM2733 gene, herein designated VGAM is inhibition of expression of VGAM2733 target genes. It is appreciated that specific functions, and accordingly utilities, of VGAM2733 correlate with, and may be deduced from, the identity of the target genes which VGAM2733 binds and inhibits, and the function of these target genes, as elaborated hereinbelow.

B-cell CLL/lymphoma 7A (BCL7A, Accession NM_020993) is a VGAM2733 host target gene. BCL7A BINDING SITE is HOST TARGET binding site found in the 3' untranslated region of mRNA encoded by BCL7A, corresponding to a HOST TARGET binding site such as BINDING SITE I, BINDING SITE II or BINDING SITE III. Table 2 illustrates the complementarity of the nucleotide sequences of BCL7A BINDING SITE, designated SEQ ID:21996, to the nucleotide sequence of VGAM2733 RNA, herein designated VGAM RNA, also designated SEQ ID:5444.

A function of VGAM2733 is therefore inhibition of B-cell CLL/lymphoma 7A (BCL7A, Accession NM_020993). Accordingly, utilities of VGAM2733 include diagnosis, prevention and treatment of diseases and clinical conditions associated with BCL7A. BRF1 Homolog, Subunit of RNA Polymerase III Transcription Initiation Factor IIIB (S. cerevisiae) (BRF1, Accession NM_001519) is another VGAM2733 host target gene. BRF1 BINDING SITE is HOST TARGET binding site found in the 3' untranslated region of mRNA encoded by BRF1, corresponding to a HOST TARGET binding site such as BINDING SITE I, BINDING SITE II or BINDING SITE III. Table 2 illustrates the complementarity of the nucleotide sequences of BRF1 BINDING SITE, designated SEQ ID:7257, to the nucleotide sequence of VGAM2733 RNA, herein designated VGAM RNA, also designated SEQ ID:5444.

Another function of VGAM2733 is therefore inhibition of BRF1 Homolog, Subunit of RNA Polymerase III Transcription Initiation Factor IIIB (S. cerevisiae) (BRF1, Accession NM_001519), a gene which is a general activator of RNA polymerase III. Accordingly, utilities of VGAM2733 include diagnosis, prevention and treatment of diseases and clinical conditions associated with BRF1. The function of BRF1 and its association with various diseases and clinical conditions, has been established by previous studies, as described hereinabove with reference to VGAM232. Capping Protein (actin filament) Muscle Z-line, Alpha 1 (CAPZA1, Accession XM_052116) is another VGAM2733 host target gene. CAPZA1 BINDING SITE is HOST TARGET binding site found in the 3' untranslated region of mRNA encoded by CAPZA1, corresponding to a HOST TARGET binding site such as BINDING SITE I, BINDING SITE II or BINDING SITE III. Table 2 illustrates the complementarity of the nucleotide sequences of CAPZA1 BINDING SITE, designated SEQ ID:35948, to the nucleotide sequence of VGAM2733 RNA, herein designated VGAM RNA, also designated SEQ ID:5444.

Another function of VGAM2733 is therefore inhibition of Capping Protein (actin filament) Muscle Z-line, Alpha 1 (CAPZA1, Accession XM_052116), a gene which is alpha 1 subunit of actin filament capping protein; binds actin, has roles in cell motility and actin assembly. Accordingly, utilities of VGAM2733 include diagnosis, prevention and treatment of diseases and clinical conditions associated with CAPZA1. The function of CAPZA1 and its association with various diseases and clinical conditions, has been established by previous studies, as described hereinabove with reference to VGAM547. Fibroblast Growth Factor 23 (FGF23, Accession NM_020638) is another VGAM2733 host target gene. FGF23 BINDING SITE is HOST TARGET binding site found in the 3' untranslated region of mRNA encoded by FGF23, corresponding to a HOST TARGET binding site such as BINDING SITE I, BINDING SITE II or BINDING SITE III. Table 2 illustrates the complementarity of the nucleotide sequences of FGF23 BINDING SITE, designated SEQ ID:21795, to the nucleotide sequence of VGAM2733 RNA, herein designated VGAM RNA, also designated SEQ ID:5444.

Another function of VGAM2733 is therefore inhibition of Fibroblast Growth Factor 23 (FGF23, Accession NM_020638), a gene which a member of the fibroblast growth factor family. Accordingly, utilities of VGAM2733 include diagnosis, prevention and treatment of diseases and clinical conditions associated with FGF23. The function of FGF23 and its association with various diseases and clinical conditions, has been established by previous studies, as described hereinabove with reference to VGAM24. Oculocerebrorenal Syndrome of Lowe (OCRL, Accession NM_000276) is another VGAM2733 host target gene. OCRL BINDING SITE1 and OCRL BINDING SITE2 are HOST TARGET binding sites found in untranslated regions of mRNA encoded by OCRL, corresponding to HOST TARGET binding sites such as BINDING SITE I, BINDING SITE II or BINDING SITE III. Table 2 illustrates the complementarity of the nucleotide sequences of OCRL BINDING SITE1 and OCRL BINDING SITE2, designated SEQ ID:5820 and SEQ ID:7307 respectively, to the nucleotide sequence of VGAM2733 RNA, herein designated VGAM RNA, also designated SEQ ID:5444.

Another function of VGAM2733 is therefore inhibition of Oculocerebrorenal Syndrome of Lowe (OCRL, Accession NM_000276). Accordingly, utilities of VGAM2733 include diagnosis, prevention and treatment of diseases and clinical conditions associated with OCRL. SMP1 (Accession NM_014313) is another VGAM2733 host target gene. SMP1 BINDING SITE is HOST TARGET binding site found in the 3' untranslated region of mRNA encoded by SMP1, corresponding to a HOST TARGET binding site such as BINDING SITE I, BINDING SITE II or BINDING SITE III. Table 2 illustrates the complementarity of the nucleotide sequences of SMP1 BINDING SITE, designated SEQ ID:15612, to the nucleotide sequence of VGAM2733 RNA, herein designated VGAM RNA, also designated SEQ ID:5444.

Another function of VGAM2733 is therefore inhibition of SMP1 (Accession NM_014313), a gene which is a potential integral membrane protein. Accordingly, utilities of VGAM2733 include diagnosis, prevention and treatment of diseases and clinical conditions associated with SMP1. The function of SMP1 and its association with various diseases and clinical conditions, has been established by previous studies, as described hereinabove with reference to VGAM127. SORCS3 (Accession NM_014978) is another VGAM2733 host target gene. SORCS3 BINDING SITE is HOST TARGET binding site found in the 3' untranslated region of mRNA encoded by SORCS3, corresponding to a HOST TARGET binding site such as BINDING SITE I, BINDING SITE II or BINDING SITE III. Table 2 illustrates the complementarity of the nucleotide sequences of SORCS3 BINDING SITE, designated SEQ ID:17365, to the nucleotide sequence of VGAM2733 RNA, herein designated VGAM RNA, also designated SEQ ID:5444.

Another function of VGAM2733 is therefore inhibition of SORCS3 (Accession NM_014978). Accordingly, utilities of VGAM2733 include diagnosis, prevention and treatment of diseases and clinical conditions associated with SORCS3. Tumor Necrosis Factor Receptor Superfamily, Member 10b (TNFRSF10B, Accession NM_003842) is another VGAM2733 host target gene. TNFRSF10B BINDING SITE is HOST TARGET binding site found in the 3' untranslated region of mRNA encoded by TNFRSF10B, corresponding to a HOST TARGET binding site such as BINDING SITE I, BINDING SITE II or BINDING SITE III. Table 2 illustrates the complementarity of the nucleotide sequences of TNFRSF10B BINDING SITE, designated SEQ ID:9937, to the nucleotide sequence of VGAM2733 RNA, herein designated VGAM RNA, also designated SEQ ID:5444.

Another function of VGAM2733 is therefore inhibition of Tumor Necrosis Factor Receptor Superfamily, Member 10b (TNFRSF10B, Accession NM_003842), a gene which forms complex that induces apoptosis. Accordingly, utilities of VGAM2733 include diagnosis, prevention and treatment of diseases and clinical conditions associated with TNFRSF10B. The function of TNFRSF10B and its association with various diseases and clinical conditions, has been established by previous studies, as described hereinabove with reference to VGAM400. BRAG (Accession NM_014863) is another VGAM2733 host target gene. BRAG BINDING SITE is HOST TARGET binding site found in the 3' untranslated region of mRNA encoded by BRAG, corresponding to a HOST TARGET binding site such as BINDING SITE I, BINDING SITE II or BINDING SITE III. Table 2 illustrates the complementarity of the nucleotide sequences of BRAG BINDING SITE, designated SEQ ID:16943, to the nucleotide sequence of VGAM2733 RNA, herein designated VGAM RNA, also designated SEQ ID:5444.

Another function of VGAM2733 is therefore inhibition of BRAG (Accession NM_014863). Accordingly, utilities of VGAM2733 include diagnosis, prevention and treatment of diseases and clinical conditions associated with BRAG. DNA Cross-link Repair 1A (PSO2 homolog, S. cerevisiae) (DCLRE1A, Accession XM_044815) is another VGAM2733 host target gene. DCLRE1A BINDING SITE is HOST TARGET binding site found in the 3' untranslated region of mRNA encoded by DCLRE1A, corresponding to a HOST TARGET binding site such as BINDING SITE I, BINDING SITE II or BINDING SITE III. Table 2 illustrates the complementarity of the nucleotide sequences of DCLRE1A BINDING SITE, designated SEQ ID:34282, to the nucleotide sequence of VGAM2733 RNA, herein designated VGAM RNA, also designated SEQ ID:5444.

Another function of VGAM2733 is therefore inhibition of DNA Cross-link Repair 1A (PSO2 homolog, S. cerevisiae) (DCLRE1A, Accession XM_044815). Accordingly, utilities of VGAM2733 include diagnosis, prevention and treatment of diseases and clinical conditions associated with DCLRE1A. DKFZP434P0111 (Accession XM_041116) is another VGAM2733 host target gene. DKFZP434P0111 BINDING SITE is HOST TARGET binding site found in the 3' untranslated region of mRNA encoded by DKFZP434P0111, corresponding to a HOST TARGET binding site such as BINDING SITE I, BINDING SITE II or BINDING SITE III. Table 2 illustrates the complementarity of the nucleotide sequences of DKFZP434P0111 BINDING SITE, designated SEQ ID:33459, to the nucleotide sequence of VGAM2733 RNA, herein designated VGAM RNA, also designated SEQ ID:5444.

Another function of VGAM2733 is therefore inhibition of DKFZP434P0111 (Accession XM_041116). Accordingly, utilities of VGAM2733 include diagnosis, prevention and treatment of diseases and clinical conditions associated with DKFZP434P0111. FLJ22944 (Accession NM_025145) is another VGAM2733 host target gene. FLJ22944 BINDING SITE is HOST TARGET binding site found in the 3' untranslated region of mRNA encoded by FLJ22944, corresponding to a HOST TARGET binding site such as BINDING SITE I, BINDING SITE II or BINDING SITE III. Table 2 illustrates the complementarity of the nucleotide sequences of FLJ22944 BINDING SITE, designated SEQ ID:24783, to the nucleotide sequence of VGAM2733 RNA, herein designated VGAM RNA, also designated SEQ ID:5444.

Another function of VGAM2733 is therefore inhibition of FLJ22944 (Accession NM_025145). Accordingly, utilities of VGAM2733 include diagnosis, prevention and treatment of diseases and clinical conditions associated with FLJ22944. FLJ23022 (Accession NM_025051) is another VGAM2733 host target gene. FLJ23022 BINDING SITE is HOST TARGET binding site found in the 5' untranslated region of mRNA encoded by FLJ23022, corresponding to a HOST TARGET binding site such as BINDING SITE I, BINDING SITE II or BINDING SITE III. Table 2 illustrates the complementarity of the nucleotide sequences of FLJ23022 BINDING SITE, designated SEQ ID:24648, to the nucleotide sequence of VGAM2733 RNA, herein designated VGAM RNA, also designated SEQ ID:5444.

Another function of VGAM2733 is therefore inhibition of FLJ23022 (Accession NM_025051). Accordingly, utilities of VGAM2733 include diagnosis, prevention and treatment of diseases and clinical conditions associated with FLJ23022. Junctional Adhesion Molecule 1 (JAM1, Accession NM_144502) is another VGAM2733 host target gene. JAM1 BINDING SITE1 through JAM1 BINDING SITE5 are HOST TARGET binding sites found in untranslated regions of mRNA encoded by JAM1, corresponding to HOST TARGET binding sites such as BINDING SITE I, BINDING SITE II or BINDING SITE III. Table 2 illustrates the complementarity of the nucleotide sequences of JAM1 BINDING SITE1 through JAM1 BINDING SITE5, designated SEQ ID:29330, SEQ ID:29341, SEQ ID:18863, SEQ ID:29322 and SEQ ID:29351 respectively, to the nucleotide sequence of VGAM2733 RNA, herein designated VGAM RNA, also designated SEQ ID:5444.

Another function of VGAM2733 is therefore inhibition of Junctional Adhesion Molecule 1 (JAM1, Accession NM_144502). Accordingly, utilities of VGAM2733 include diagnosis, prevention and treatment of diseases and clinical conditions associated with JAM1. MYLE (Accession NM_014015) is another VGAM2733 host target gene. MYLE BINDING SITE is HOST TARGET binding site found in the 3' untranslated region of mRNA encoded by MYLE, corresponding to a HOST TARGET binding site such as BINDING SITE I, BINDING SITE II or BINDING SITE III. Table 2 illustrates the complementarity of the nucleotide sequences of MYLE BINDING SITE, designated SEQ ID:15235, to the nucleotide sequence of VGAM2733 RNA, herein designated VGAM RNA, also designated SEQ ID:5444.

Another function of VGAM2733 is therefore inhibition of MYLE (Accession NM_014015). Accordingly, utilities of VGAM2733 include diagnosis, prevention and treatment of diseases and clinical conditions associated with MYLE. LOC118738 (Accession XM_061125) is another VGAM2733 host target gene. LOC118738 BINDING SITE is HOST TARGET binding site found in the 3' untranslated region of mRNA encoded by LOC118738, corresponding to a HOST TARGET binding site such as BINDING SITE I, BINDING SITE II or BINDING SITE III. Table 2 illustrates the complementarity of the nucleotide sequences of LOC118738 BINDING SITE, designated SEQ ID:37195, to the nucleotide sequence of VGAM2733 RNA, herein designated VGAM RNA, also designated SEQ ID:5444.

Another function of VGAM2733 is therefore inhibition of LOC118738 (Accession XM_061125). Accordingly, utilities of VGAM2733 include diagnosis, prevention and treatment of diseases and clinical conditions associated with LOC118738. LOC142913 (Accession XM_084378) is another VGAM2733 host target gene. LOC142913 BINDING SITE is HOST TARGET binding site found in the 5' untranslated region of mRNA encoded by LOC142913, corresponding to a HOST TARGET binding site such as BINDING SITE I, BINDING SITE II or BINDING SITE III. Table 2 illustrates the complementarity of the nucleotide sequences of LOC142913 BINDING SITE, designated SEQ ID:37564, to the nucleotide sequence of VGAM2733 RNA, herein designated VGAM RNA, also designated SEQ ID:5444.

Another function of VGAM2733 is therefore inhibition of LOC142913 (Accession XM_084378). Accordingly, utilities of VGAM2733 include diagnosis, prevention and treatment of diseases and clinical conditions associated with LOC142913. LOC144519 (Accession XM_084890) is another VGAM2733 host target gene. LOC144519 BINDING SITE is HOST TARGET binding site found in the 5' untranslated region of mRNA encoded by LOC144519, corresponding to a HOST TARGET binding site such as BINDING SITE I, BINDING SITE II or BINDING SITE III. Table 2 illustrates the complementarity of the nucleotide sequences of LOC144519 BINDING SITE, designated SEQ ID:37761, to the nucleotide sequence of VGAM2733 RNA, herein designated VGAM RNA, also designated SEQ ID:5444.

Another function of VGAM2733 is therefore inhibition of LOC144519 (Accession XM_084890). Accordingly, utilities of VGAM2733 include diagnosis, prevention and treatment of diseases and clinical conditions associated with LOC144519. LOC145501 (Accession XM_085157) is another VGAM2733 host target gene. LOC145501 BINDING SITE is HOST TARGET binding site found in the 3' untranslated region of mRNA encoded by LOC145501, corresponding to a HOST TARGET binding site such as BINDING SITE I, BINDING SITE II or BINDING SITE III. Table 2 illustrates the complementarity of the nucleotide sequences of LOC145501 BINDING SITE, designated SEQ ID:37884, to the nucleotide sequence of VGAM2733 RNA, herein designated VGAM RNA, also designated SEQ ID:5444.

Another function of VGAM2733 is therefore inhibition of LOC145501 (Accession XM_085157). Accordingly, utilities of VGAM2733 include diagnosis, prevention and treatment of diseases and clinical conditions associated with LOC145501. LOC148930 (Accession XM_086369) is another VGAM2733 host target gene. LOC148930 BINDING SITE is HOST TARGET binding site found in the 3' untranslated region of mRNA encoded by LOC148930, corresponding to a HOST TARGET binding site such as BINDING SITE I, BINDING SITE II or BINDING SITE III. Table 2 illustrates the complementarity of the nucleotide sequences of LOC148930 BINDING SITE, designated SEQ ID:38621, to the nucleotide sequence of VGAM2733 RNA, herein designated VGAM RNA, also designated SEQ ID:5444.

Another function of VGAM2733 is therefore inhibition of LOC148930 (Accession XM_086369). Accordingly, utilities of VGAM2733 include diagnosis, prevention and treatment of diseases and clinical conditions associated with LOC148930. LOC166206 (Accession XM_093743) is another VGAM2733 host target gene. LOC166206 BINDING SITE is HOST TARGET binding site found in the 5' untranslated region of mRNA encoded by LOC166206, corresponding to a HOST TARGET binding site such as BINDING SITE I, BINDING SITE II or BINDING SITE III. Table 2 illustrates the complementarity of the nucleotide sequences of LOC166206 BINDING SITE, designated SEQ ID:40209, to the nucleotide sequence of VGAM2733 RNA, herein designated VGAM RNA, also designated SEQ ID:5444.

Another function of VGAM2733 is therefore inhibition of LOC166206 (Accession XM_093743). Accordingly, utilities of VGAM2733 include diagnosis, prevention and treatment of diseases and clinical conditions associated with LOC166206. LOC200227 (Accession XM_114162) is another VGAM2733 host target gene. LOC200227 BINDING SITE is HOST TARGET binding site found in the 3' untranslated region of mRNA encoded by LOC200227, corresponding to a HOST TARGET binding site such as BINDING SITE I, BINDING SITE II or BINDING SITE III. Table 2 illustrates the complementarity of the nucleotide sequences of LOC200227 BINDING SITE, designated SEQ ID:42746, to the nucleotide sequence of VGAM2733 RNA, herein designated VGAM RNA, also designated SEQ ID:5444.

Another function of VGAM2733 is therefore inhibition of LOC200227 (Accession XM_114162). Accordingly, utilities of VGAM2733 include diagnosis, prevention and treatment of diseases and clinical conditions associated with LOC200227. LOC221466 (Accession XM_168087) is another VGAM2733 host target gene. LOC221466 BINDING SITE is HOST TARGET binding site found in the 3' untranslated region of mRNA encoded by LOC221466, corresponding to a HOST TARGET binding site such as BINDING SITE I, BINDING SITE II or BINDING SITE III. Table 2 illustrates the complementarity of the nucleotide sequences of LOC221466 BINDING SITE, designated SEQ ID:44999, to the nucleotide sequence of VGAM2733 RNA, herein designated VGAM RNA, also designated SEQ ID:5444.

Another function of VGAM2733 is therefore inhibition of LOC221466 (Accession XM_168087). Accordingly, utilities of VGAM2733 include diagnosis, prevention and treatment of diseases and clinical conditions associated with LOC221466. LOC254531 (Accession XM_170773) is another VGAM2733 host target gene. LOC254531 BINDING SITE is HOST TARGET binding site found in the 5' untranslated region of mRNA encoded by LOC254531, corresponding to a HOST TARGET binding site such as BINDING SITE I, BINDING SITE II or BINDING SITE III. Table 2 illustrates the complementarity of the nucleotide sequences of LOC254531 BINDING SITE, designated SEQ ID:45539, to the nucleotide sequence of VGAM2733 RNA, herein designated VGAM RNA, also designated SEQ ID:5444.

Another function of VGAM2733 is therefore inhibition of LOC254531 (Accession XM_170773). Accordingly, utilities of VGAM2733 include diagnosis, prevention and treatment of diseases and clinical conditions associated with LOC254531. LOC91097 (Accession XM_035977) is another VGAM2733 host target gene. LOC91097 BINDING SITE is HOST TARGET binding site found in the 5' untranslated region of mRNA encoded by LOC91097, corresponding to a HOST TARGET binding site such as BINDING SITE I, BINDING SITE II or BINDING SITE III. Table 2 illustrates the complementarity of the nucleotide sequences of LOC91097 BINDING SITE, designated SEQ ID:32371, to the nucleotide sequence of VGAM2733 RNA, herein designated VGAM RNA, also designated SEQ ID:5444.

Another function of VGAM2733 is therefore inhibition of LOC91097 (Accession XM_035977). Accordingly, utilities of VGAM2733 include diagnosis, prevention and treatment of diseases and clinical conditions associated with LOC91097. LOC91689 (Accession NM_033318) is another VGAM2733 host target gene. LOC91689 BINDING SITE is HOST TARGET binding site found in the 3' untranslated region of mRNA encoded by LOC91689, corresponding to a HOST TARGET binding site such as BINDING SITE I, BINDING SITE II or BINDING SITE III. Table 2 illustrates the complementarity of the nucleotide sequences of LOC91689 BINDING SITE, designated SEQ ID:27156, to the nucleotide sequence of VGAM2733 RNA, herein designated VGAM RNA, also designated SEQ ID:5444.

Another function of VGAM2733 is therefore inhibition of LOC91689 (Accession NM_033318). Accordingly, utilities of VGAM2733 include diagnosis, prevention and treatment of diseases and clinical conditions associated with LOC91689. FIG. 1 further provides a conceptual description of a novel bioinformatically detected viral gene of the present invention, referred to here as Viral Genomic Address Messenger 2734 (VGAM2734) viral gene, which modulates expression of respective host target genes thereof, the function and utility of which host target genes is known in the art.

VGAM2734 is a novel bioinformatically detected regulatory, non protein coding, viral micro RNA (miRNA) gene. The method by which VGAM2734 was detected is described hereinabove with reference to FIGS. 1-8.

VGAM2734 gene, herein designated VGAM GENE, is a viral gene contained in the genome of Broad Bean Necrosis Virus. VGAM2734 host target gene, herein designated VGAM HOST TARGET GENE, is a human gene contained in the human genome.

VGAM2734 gene encodes a VGAM2734 precursor RNA, herein designated VGAM PRECURSOR RNA. Similar to other miRNA genes, and unlike most ordinary genes, VGAM2734 precursor RNA does not encode a protein. A nucleotide sequence identical or highly similar to the nucleotide sequence of VGAM2734 precursor RNA is designated SEQ ID:2720, and is provided hereinbelow with reference to the sequence listing part. Nucleotide sequence SEQ ID:2720 is located at position 3664 relative to the genome of Broad Bean Necrosis Virus.

VGAM2734 precursor RNA folds onto itself, forming VGAM2734 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2734 folded precursor RNA into VGAM2734 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 88%) nucleotide sequence of VGAM2734 RNA is designated SEQ ID:5445, and is provided hereinbelow with reference to the sequence listing part.

VGAM2734 host target gene, herein designated VGAM HOST TARGET GENE, encodes a corresponding messenger RNA, VGAM2734 host target RNA, herein designated VGAM HOST TARGET RNA. VGAM2734 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2734 RNA, herein designated VGAM RNA, binds complementarily to one or more host target binding sites located in untranslated regions of VGAM2734 host target RNA, herein designated VGAM HOST TARGET RNA. This complementary binding is due to the fact that the nucleotide sequence of VGAM2734 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2734 RNA, herein designated VGAM RNA, may have a different number of host target binding sites in untranslated regions of a VGAM2734 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2734 RNA, herein designated VGAM RNA, to host target binding sites on VGAM2734 host target RNA, herein designated VGAM HOST TARGET RNA, such as BINDING SITE I, BINDING SITE II and BINDING SITE III, inhibits translation of VGAM2734 host target RNA into VGAM2734 host target protein, herein designated VGAM HOST TARGET PROTEIN. VGAM host target protein is therefore outlined by a broken line.

It is appreciated that VGAM2734 host target gene, herein designated VGAM HOST TARGET GENE, in fact represents a plurality of VGAM2734 host target genes. The mRNA of each one of this plurality of VGAM2734 host target genes comprises one or more host target binding sites, each having a nucleotide sequence which is at least partly complementary to VGAM2734 RNA, herein designated VGAM RNA, and which when bound by VGAM2734 RNA causes inhibition of translation of respective one or more VGAM2734 host target proteins.

It is further appreciated by one skilled in the art that the mode of translational inhibition illustrated by FIG. 1 with specific reference to translational inhibition exerted by VGAM2734 gene, herein designated VGAM GENE, on one or more VGAM2734 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2734 is inhibition of expression of host target genes, as part of a novel viral mechanism of attacking a host. Accordingly, utilities of VGAM2734 include diagnosis, prevention and treatment of viral infection by Broad Bean Necrosis Virus. Specific functions, and accordingly utilities, of VGAM2734 correlate with, and may be deduced from, the identity of the host target genes which VGAM2734 binds and inhibits, and the function of these host target genes, as elaborated hereinbelow.

Nucleotide sequences of the VGAM2734 precursor RNA, herein designated VGAM PRECURSOR RNA, and of the 'diced' VGAM2734 RNA, herein designated VGAM RNA, and a schematic representation of the secondary folding of VGAM2734 folded precursor RNA, herein designated VGAM FOLDED PRECURSOR RNA, of VGAM2734 are further described hereinbelow with reference to Table 1.

Nucleotide sequences of host target binding sites, such as BINDING SITE-I, BINDING SITE-II and BINDING SITE-III of FIG. 1, found on VGAM2734 host target RNA, and schematic representation of the complementarity of each of these host target binding sites to VGAM2734 RNA, herein designated VGAM RNA, are described hereinbelow with reference to Table 2.

As mentioned hereinabove with reference to FIG. 1, a function of VGAM2734 gene, herein designated VGAM is inhibition of expression of VGAM2734 target genes. It is appreciated that specific functions, and accordingly utilities, of VGAM2734 correlate with, and may be deduced from, the identity of the target genes which VGAM2734 binds and inhibits, and the function of these target genes, as elaborated hereinbelow.

UDP-Gal:betaGlcNAc Beta 1,4-Galactosyltransferase, Polypeptide 1 (B4GALT1, Accession NM_001497) is a VGAM2734 host target gene. B4GALT1 BINDING SITE is HOST TARGET binding site found in the 3' untranslated region of mRNA encoded by B4GALT1, corresponding to a HOST TARGET binding site such as BINDING SITE I, BINDING SITE II or BINDING SITE III. Table 2 illustrates the complementarity of the nucleotide sequences of B4GALT1 BINDING SITE, designated SEQ ID:7243, to the nucleotide sequence of VGAM2734 RNA, herein designated VGAM RNA, also designated SEQ ID:5445.

A function of VGAM2734 is therefore inhibition of UDP-Gal:betaGlcNAc Beta 1,4-Galactosyltransferase, Polypeptide 1 (B4GALT1, Accession NM_001497). Accordingly, utilities of VGAM2734 include diagnosis, prevention and treatment of diseases and clinical conditions associated with B4GALT1. Corticotropin Releasing Hormone Receptor 1 (CRHR1, Accession NM_004382) is another VGAM2734 host target gene. CRHR1 BINDING SITE is HOST TARGET binding site found in the 3' untranslated region of mRNA encoded by CRHR1, corresponding to a HOST TARGET binding site such as BINDING SITE I, BINDING SITE II or BINDING SITE III. Table 2 illustrates the complementarity of the nucleotide sequences of CRHR1 BINDING SITE, designated SEQ ID:10605, to the nucleotide sequence of VGAM2734 RNA, herein designated VGAM RNA, also designated SEQ ID:5445.

Another function of VGAM2734 is therefore inhibition of Corticotropin Releasing Hormone Receptor 1 (CRHR1, Accession NM_004382), a gene which likely mediates physiological and behavioral response to stress. Accordingly, utilities of VGAM2734 include diagnosis, prevention and treatment of diseases and clinical conditions associated with CRHR1. The function of CRHR1 and its association with various diseases and clinical conditions, has been established by previous studies, as described hereinabove with reference to VGAM435. Von Hippel-Lindau Syndrome (VHL, Accession NM_000551) is another VGAM2734 host target gene. VHL BINDING SITE is HOST TARGET binding site found in the 3' untranslated region of mRNA encoded by VHL, corresponding to a HOST TARGET binding site such as BINDING SITE I, BINDING SITE II or BINDING SITE III. Table 2 illustrates the complementarity of the nucleotide sequences of VHL BINDING SITE, designated SEQ ID:6155, to the nucleotide sequence of VGAM2734 RNA, herein designated VGAM RNA, also designated SEQ ID:5445.

Another function of VGAM2734 is therefore inhibition of Von Hippel-Lindau Syndrome (VHL, Accession NM_000551), a gene which may control rna stability through the selective degradation of rna-bound proteins. Accordingly, utilities of VGAM2734 include diagnosis, prevention and treatment of diseases and clinical conditions associated with VHL. The function of VHL and its association with various diseases and clinical conditions, has been established by previous studies, as described hereinabove with reference to VGAM197. Cyclin-dependent Kinase-like 2 (CDC2-related kinase) (CDKL2, Accession NM_003948) is another VGAM2734 host target gene. CDKL2 BINDING SITE is HOST TARGET binding site found in the 5' untranslated region of mRNA encoded by CDKL2, corresponding to a HOST TARGET binding site such as BINDING SITE I, BINDING SITE II or BINDING SITE III. Table 2 illustrates the complementarity of the nucleotide sequences of CDKL2 BINDING SITE, designated SEQ ID:10069, to the nucleotide sequence of VGAM2734 RNA, herein designated VGAM RNA, also designated SEQ ID:5445.

Another function of VGAM2734 is therefore inhibition of Cyclin-dependent Kinase-like 2 (CDC2-related kinase) (CDKL2, Accession NM_003948). Accordingly, utilities of VGAM2734 include diagnosis, prevention and treatment of diseases and clinical conditions associated with CDKL2. FLJ11117 (Accession NM_018329) is another VGAM2734 host target gene. FLJ11117 BINDING SITE is HOST TARGET binding site found in the 3' untranslated region of mRNA encoded by FLJ11117, corresponding to a HOST TARGET binding site such as BINDING SITE I, BINDING SITE II or BINDING SITE III. Table 2 illustrates the complementarity of the nucleotide sequences of FLJ11117 BINDING SITE, designated SEQ ID:20325, to the nucleotide sequence of VGAM2734 RNA, herein designated VGAM RNA, also designated SEQ ID:5445.

Another function of VGAM2734 is therefore inhibition of FLJ11117 (Accession NM_018329). Accordingly, utilities of VGAM2734 include diagnosis, prevention and treatment of diseases and clinical conditions associated with FLJ11117. FLJ12649 (Accession NM_024597) is another VGAM2734 host target gene. FLJ12649 BINDING SITE is HOST TARGET binding site found in the 3' untranslated region of mRNA encoded by FLJ12649, corresponding to a HOST TARGET binding site such as BINDING SITE I, BINDING SITE II or BINDING SITE III. Table 2 illustrates the complementarity of the nucleotide sequences of FLJ12649 BINDING SITE, designated SEQ ID:23832, to the nucleotide sequence of VGAM2734 RNA, herein designated VGAM RNA, also designated SEQ ID:5445.

Another function of VGAM2734 is therefore inhibition of FLJ12649 (Accession NM_024597). Accordingly, utilities of VGAM2734 include diagnosis, prevention and treatment of diseases and clinical conditions associated with FLJ12649. FLJ13081 (Accession NM_024834) is another VGAM2734 host target gene. FLJ13081 BINDING SITE is HOST TARGET binding site found in the 3' untranslated region of mRNA encoded by FLJ13081, corresponding to a HOST TARGET binding site such as BINDING SITE I, BINDING SITE II or BINDING SITE III. Table 2 illustrates the complementarity of the nucleotide sequences of FLJ13081 BINDING SITE, designated SEQ ID:24236, to the nucleotide sequence of VGAM2734 RNA, herein designated VGAM RNA, also designated SEQ ID:5445.

Another function of VGAM2734 is therefore inhibition of FLJ13081 (Accession NM_024834). Accordingly, utilities of VGAM2734 include diagnosis, prevention and treatment of diseases and clinical conditions associated with FLJ13081. FLJ22794 (Accession XM_166220) is another VGAM2734 host target gene. FLJ22794 BINDING SITE is HOST TARGET binding site found in the 3' untranslated region of mRNA encoded by FLJ22794, corresponding to a HOST TARGET binding site such as BINDING SITE I, BINDING SITE II or BINDING SITE III. Table 2 illustrates the complementarity of the nucleotide sequences of FLJ22794 BINDING SITE, designated SEQ ID:44021, to the nucleotide sequence of VGAM2734 RNA, herein designated VGAM RNA, also designated SEQ ID:5445.

Another function of VGAM2734 is therefore inhibition of FLJ22794 (Accession XM_166220). Accordingly, utilities of VGAM2734 include diagnosis, prevention and treatment of diseases and clinical conditions associated with FLJ22794. KIAA0084 (Accession XM_042841) is another VGAM2734 host target gene. KIAA0084 BINDING SITE is HOST TARGET binding site found in the 3' untranslated region of mRNA encoded by KIAA0084, corresponding to a HOST TARGET binding site such as BINDING SITE I, BINDING SITE II or BINDING SITE III. Table 2 illustrates the complementarity of the nucleotide sequences of KIAA0084 BINDING SITE, designated SEQ ID:33803, to the nucleotide sequence of VGAM2734 RNA, herein designated VGAM RNA, also designated SEQ ID:5445.

Another function of VGAM2734 is therefore inhibition of KIAA0084 (Accession XM_042841). Accordingly, utilities of VGAM2734 include diagnosis, prevention and treatment of diseases and clinical conditions associated with KIAA0084. LOC155179 (Accession XM_088169) is another VGAM2734 host target gene. LOC155179 BINDING SITE is HOST TARGET binding site found in the 3' untranslated region of mRNA encoded by LOC155179, corresponding to a HOST TARGET binding site such as BINDING SITE I, BINDING SITE II or BINDING SITE III. Table 2 illustrates the complementarity of the nucleotide sequences of LOC155179 BINDING SITE, designated SEQ ID:39550, to the nucleotide sequence of VGAM2734 RNA, herein designated VGAM RNA, also designated SEQ ID:5445.

Another function of VGAM2734 is therefore inhibition of LOC155179 (Accession XM_088169). Accordingly, utilities of VGAM2734 include diagnosis, prevention and treatment of diseases and clinical conditions associated with LOC155179. LOC90092 (Accession XM_028862) is another VGAM2734 host target gene. LOC90092 BINDING SITE is HOST TARGET binding site found in the 5' untranslated region of mRNA encoded by LOC90092, corresponding to a HOST TARGET binding site such as BINDING SITE I, BINDING SITE II or BINDING SITE III. Table 2 illustrates the complementarity of the nucleotide sequences of LOC90092 BINDING SITE, designated SEQ ID:30780, to the nucleotide sequence of VGAM2734 RNA, herein designated VGAM RNA, also designated SEQ ID:5445.

Another function of VGAM2734 is therefore inhibition of LOC90092 (Accession XM_028862). Accordingly, utilities of VGAM2734 include diagnosis, prevention and treatment of diseases and clinical conditions associated with LOC90092. FIG. 1 further provides a conceptual description of a novel bioinformatically detected viral gene of the present invention, referred to here as Viral Genomic Address Messenger 2735 (VGAM2735) viral gene, which modulates expression of respective host target genes thereof, the function and utility of which host target genes is known in the art.

VGAM2735 is a novel bioinformatically detected regulatory, non protein coding, viral micro RNA (miRNA) gene. The method by which VGAM2735 was detected is described hereinabove with reference to FIGS. 1-8.

VGAM2735 gene, herein designated VGAM GENE, is a viral gene contained in the genome of Broad Bean Necrosis Virus. VGAM2735 host target gene, herein designated VGAM HOST TARGET GENE, is a human gene contained in the human genome.

VGAM2735 gene encodes a VGAM2735 precursor RNA, herein designated VGAM PRECURSOR RNA. Similar to other miRNA genes, and unlike most ordinary genes, VGAM2735 precursor RNA does not encode a protein. A nucleotide sequence identical or highly similar to the nucleotide sequence of VGAM2735 precursor RNA is designated SEQ ID:2721, and is provided hereinbelow with reference to the sequence listing part. Nucleotide sequence SEQ ID:2721 is located at position 2997 relative to the genome of Broad Bean Necrosis Virus.

VGAM2735 precursor RNA folds onto itself, forming VGAM2735 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2735 folded precursor RNA into VGAM2735 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 42%) nucleotide sequence of VGAM2735 RNA is designated SEQ ID:5446, and is provided hereinbelow with reference to the sequence listing part.

VGAM2735 host target gene, herein designated VGAM HOST TARGET GENE, encodes a corresponding messenger RNA, VGAM2735 host target RNA, herein designated VGAM HOST TARGET RNA. VGAM2735 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2735 RNA, herein designated VGAM RNA, binds complementarily to one or more host target binding sites located in untranslated regions of VGAM2735 host target RNA, herein designated VGAM HOST TARGET RNA. This complementary binding is due to the fact that the nucleotide sequence of VGAM2735 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2735 RNA, herein designated VGAM RNA, may have a different number of host target binding sites in untranslated regions of a VGAM2735 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2735 RNA, herein designated VGAM RNA, to host target binding sites on VGAM2735 host target RNA, herein designated VGAM HOST TARGET RNA, such as BINDING SITE I, BINDING SITE II and BINDING SITE III, inhibits translation of VGAM2735 host target RNA into VGAM2735 host target protein, herein designated VGAM HOST TARGET PROTEIN. VGAM host target protein is therefore outlined by a broken line.

It is appreciated that VGAM2735 host target gene, herein designated VGAM HOST TARGET GENE, in fact represents a plurality of VGAM2735 host target genes. The mRNA of each one of this plurality of VGAM2735 host target genes comprises one or more host target binding sites, each having a nucleotide sequence which is at least partly complementary to VGAM2735 RNA, herein designated VGAM RNA, and which when bound by VGAM2735 RNA causes inhibition of translation of respective one or more VGAM2735 host target proteins.

It is further appreciated by one skilled in the art that the mode of translational inhibition illustrated by FIG. 1 with specific reference to translational inhibition exerted by VGAM2735 gene, herein designated VGAM GENE, on one or more VGAM2735 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2735 is inhibition of expression of host target genes, as part of a novel viral mechanism of attacking a host. Accordingly, utilities of VGAM2735 include diagnosis, prevention and treatment of viral infection by Broad Bean Necrosis Virus. Specific functions, and accordingly utilities, of VGAM2735 correlate with, and may be deduced from, the identity of the host target genes which VGAM2735 binds and inhibits, and the function of these host target genes, as elaborated hereinbelow.

Nucleotide sequences of the VGAM2735 precursor RNA, herein designated VGAM PRECURSOR RNA, and of the 'diced' VGAM2735 RNA, herein designated VGAM RNA, and a schematic representation of the secondary folding of VGAM2735 folded precursor RNA, herein designated VGAM FOLDED PRECURSOR RNA, of VGAM2735 are further described hereinbelow with reference to Table 1.

Nucleotide sequences of host target binding sites, such as BINDING SITE-I, BINDING SITE-II and BINDING SITE-III of FIG. 1, found on VGAM2735 host target RNA, and schematic representation of the complementarity of each of these host target binding sites to VGAM2735 RNA, herein designated VGAM RNA, are described hereinbelow with reference to Table 2.

As mentioned hereinabove with reference to FIG. 1, a function of VGAM2735 gene, herein designated VGAM is inhibition of expression of VGAM2735 target genes. It is appreciated that specific functions, and accordingly utilities, of VGAM2735 correlate with, and may be deduced from, the identity of the target genes which VGAM2735 binds and inhibits, and the function of these target genes, as elaborated hereinbelow.

Prodynorphin (PDYN, Accession NM_024411) is a VGAM2735 host target gene. PDYN BINDING SITE is HOST TARGET binding site found in the 3' untranslated region of mRNA encoded by PDYN, corresponding to a HOST TARGET binding site such as BINDING SITE I, BINDING SITE II or BINDING SITE III. Table 2 illustrates the complementarity of the nucleotide sequences of PDYN BINDING SITE, designated SEQ ID:23654, to the nucleotide sequence of VGAM2735 RNA, herein designated VGAM RNA, also designated SEQ ID:5446.

A function of VGAM2735 is therefore inhibition of Prodynorphin (PDYN, Accession NM_024411), a gene which is an opioid peptide acting on the kappa-receptor. Accordingly, utilities of VGAM2735 include diagnosis, prevention and treatment of diseases and clinical conditions associated with PDYN. The function of PDYN and its association with various diseases and clinical conditions, has been established by previous studies, as described hereinabove with reference to VGAM444. BHC80 (Accession NM_016621) is another VGAM2735 host target gene. BHC80 BINDING SITE is HOST TARGET binding site found in the 3' untranslated region of mRNA encoded by BHC80, corresponding to a HOST TARGET binding site such as BINDING SITE I, BINDING SITE II or BINDING SITE III. Table 2 illustrates the complementarity of the nucleotide sequences of BHC80 BINDING SITE, designated SEQ ID:18730, to the nucleotide sequence of VGAM2735 RNA, herein designated VGAM RNA, also designated SEQ ID:5446.

Another function of VGAM2735 is therefore inhibition of BHC80 (Accession NM_016621). Accordingly, utilities of VGAM2735 include diagnosis, prevention and treatment of diseases and clinical conditions associated with BHC80. Chromosome 20 Open Reading Frame 50 (C20orf50, Accession XM_046437) is another VGAM2735 host target gene. C20orf50 BINDING SITE is HOST TARGET binding site found in the 5' untranslated region of mRNA encoded by C20orf50, corresponding to a HOST TARGET binding site such as BINDING SITE I, BINDING SITE II or BINDING SITE III. Table 2 illustrates the complementarity of the nucleotide sequences of C20orf50 BINDING SITE, designated SEQ ID:34719, to the nucleotide sequence of VGAM2735 RNA, herein designated VGAM RNA, also designated SEQ ID:5446.

Another function of VGAM2735 is therefore inhibition of Chromosome 20 Open Reading Frame 50 (C20orf50, Accession XM_046437). Accordingly, utilities of VGAM2735 include diagnosis, prevention and treatment of diseases and clinical conditions associated with C20orf50. LOC151760 (Accession XM_098117) is another VGAM2735 host target gene. LOC151760 BINDING SITE is HOST TARGET binding site found in the 5' untranslated region of mRNA encoded by LOC151760, corresponding to a HOST TARGET binding site such as BINDING SITE I, BINDING SITE II or BINDING SITE III. Table 2 illustrates the complementarity of the nucleotide sequences of LOC151760 BINDING SITE, designated SEQ ID:41389, to the nucleotide sequence of VGAM2735 RNA, herein designated VGAM RNA, also designated SEQ ID:5446.

Another function of VGAM2735 is therefore inhibition of LOC151760 (Accession XM_098117). Accordingly, utilities of VGAM2735 include diagnosis, prevention and treatment of diseases and clinical conditions associated with LOC151760. FIG. 1 further provides a conceptual description of a novel bioinformatically detected viral gene of the present invention, referred to here as Viral Genomic Address Messenger 2736 (VGAM2736) viral gene, which modulates expression of respective host target genes thereof, the function and utility of which host target genes is known in the art.

VGAM2736 is a novel bioinformatically detected regulatory, non protein coding, viral micro RNA (miRNA) gene. The method by which VGAM2736 was detected is described hereinabove with reference to FIGS. 1-8.

VGAM2736 gene, herein designated VGAM GENE, is a viral gene contained in the genome of Broad Bean Necrosis Virus. VGAM2736 host target gene, herein designated VGAM HOST TARGET GENE, is a human gene contained in the human genome.

VGAM2736 gene encodes a VGAM2736 precursor RNA, herein designated VGAM PRECURSOR RNA. Similar to other miRNA genes, and unlike most ordinary genes, VGAM2736 precursor RNA does not encode a protein. A nucleotide sequence identical or highly similar to the nucleotide sequence of VGAM2736 precursor RNA is designated SEQ ID:2722, and is provided hereinbelow with reference to the sequence listing part. Nucleotide sequence SEQ ID:2722 is located at position 2155 relative to the genome of Broad Bean Necrosis Virus.

VGAM2736 precursor RNA folds onto itself, forming VGAM2736 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2736 folded precursor RNA into VGAM2736 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2736 RNA is designated SEQ ID:5447, and is provided hereinbelow with reference to the sequence listing part.

VGAM2736 host target gene, herein designated VGAM HOST TARGET GENE, encodes a corresponding messenger RNA, VGAM2736 host target RNA, herein designated VGAM HOST TARGET RNA. VGAM2736 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2736 RNA, herein designated VGAM RNA, binds complementarily to one or more host target binding sites located in untranslated regions of VGAM2736 host target RNA, herein designated VGAM HOST TARGET RNA. This complementary binding is due to the fact that the nucleotide sequence of VGAM2736 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2736 RNA, herein designated VGAM RNA, may have a different number of host target binding sites in untranslated regions of a VGAM2736 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2736 RNA, herein designated VGAM RNA, to host target binding sites on VGAM2736 host target RNA, herein designated VGAM HOST TARGET RNA, such as BINDING SITE I, BINDING SITE II and BINDING SITE III, inhibits translation of VGAM2736 host target RNA into VGAM2736 host target protein, herein designated VGAM HOST TARGET PROTEIN. VGAM host target protein is therefore outlined by a broken line.

It is appreciated that VGAM2736 host target gene, herein designated VGAM HOST TARGET GENE, in fact represents a plurality of VGAM2736 host target genes. The mRNA of each one of this plurality of VGAM2736 host target genes comprises one or more host target binding sites, each having a nucleotide sequence which is at least partly complementary to VGAM2736 RNA, herein designated VGAM RNA, and which when bound by VGAM2736 RNA causes inhibition of translation of respective one or more VGAM2736 host target proteins.

It is further appreciated by one skilled in the art that the mode of translational inhibition illustrated by FIG. 1 with specific reference to translational inhibition exerted by VGAM2736 gene, herein designated VGAM GENE, on one or more VGAM2736 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2736 is inhibition of expression of host target genes, as part of a novel viral mechanism of attacking a host. Accordingly, utilities of VGAM2736 include diagnosis, prevention and treatment of viral infection by Broad Bean Necrosis Virus. Specific functions, and accordingly utilities, of VGAM2736 correlate with, and may be deduced from, the identity of the host target genes which VGAM2736 binds and inhibits, and the function of these host target genes, as elaborated hereinbelow.

Nucleotide sequences of the VGAM2736 precursor RNA, herein designated VGAM PRECURSOR RNA, and of the 'diced' VGAM2736 RNA, herein designated VGAM RNA, and a schematic representation of the secondary folding of VGAM2736 folded precursor RNA, herein designated VGAM FOLDED PRECURSOR RNA, of VGAM2736 are further described hereinbelow with reference to Table 1.

Nucleotide sequences of host target binding sites, such as BINDING SITE-I, BINDING SITE-II and BINDING SITE-III of FIG. 1, found on VGAM2736 host target RNA, and schematic representation of the complementarity of each of these host target binding sites to VGAM2736 RNA, herein designated VGAM RNA, are described hereinbelow with reference to Table 2.

As mentioned hereinabove with reference to FIG. 1, a function of VGAM2736 gene, herein designated VGAM is inhibition of expression of VGAM2736 target genes. It is appreciated that specific functions, and accordingly utilities, of VGAM2736 correlate with, and may be deduced from, the identity of the target genes which VGAM2736 binds and inhibits, and the function of these target genes, as elaborated hereinbelow.

TEM8 (Accession NM_032208) is a VGAM2736 host target gene. TEM8 BINDING SITE is HOST TARGET binding site found in the 3' untranslated region of mRNA encoded by TEM8, corresponding to a HOST TARGET binding site such as BINDING SITE I, BINDING SITE II or BINDING SITE III. Table 2 illustrates the complementarity of the nucleotide sequences of TEM8 BINDING SITE, designated SEQ ID:25919, to the nucleotide sequence of VGAM2736 RNA, herein designated VGAM RNA, also designated SEQ ID:5447.

A function of VGAM2736 is therefore inhibition of TEM8 (Accession NM_032208), a gene which is a tumor-specific endothelial marker. Accordingly, utilities of VGAM2736 include diagnosis, prevention and treatment of diseases and clinical conditions associated with TEM8. The function of TEM8 and its association with various diseases and clinical conditions, has been established by previous studies, as described hereinabove with reference to VGAM1489. FLJ13612 (Accession NM_025202) is another VGAM2736 host target gene. FLJ13612 BINDING SITE is HOST TARGET binding site found in the 3' untranslated region of mRNA encoded by FLJ13612, corresponding to a HOST TARGET binding site such as BINDING SITE I, BINDING SITE II or BINDING SITE III. Table 2 illustrates the complementarity of the nucleotide sequences of FLJ13612 BINDING SITE, designated SEQ ID:24860, to the nucleotide sequence of VGAM2736 RNA, herein designated VGAM RNA, also designated SEQ ID:5447.

Another function of VGAM2736 is therefore inhibition of FLJ13612 (Accession NM_025202). Accordingly, utilities of VGAM2736 include diagnosis, prevention and treatment of diseases and clinical conditions associated with FLJ13612. KIAA0534 (Accession XM_049349) is another VGAM2736 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35386, to the nucleotide sequence of VGAM2736 RNA, herein designated VGAM RNA, also designated SEQ ID:5447.

Another function of VGAM2736 is therefore inhibition of KIAA0534 (Accession XM_049349). Accordingly, utilities of VGAM2736 include diagnosis, prevention and treatment of diseases and clinical conditions associated with KIAA0534. PRO2214 (Accession NM_018517) is another VGAM2736 host target gene. PRO2214 BINDING SITE is HOST TARGET binding site found in the 5' untranslated region of mRNA encoded by PRO2214, corresponding to a HOST TARGET binding site such as BINDING SITE I, BINDING SITE II or BINDING SITE III. Table 2 illustrates the complementarity of the nucleotide sequences of PRO2214 BINDING SITE, designated SEQ ID:20589, to the nucleotide sequence of VGAM2736 RNA, herein designated VGAM RNA, also designated SEQ ID:5447.

Another function of VGAM2736 is therefore inhibition of PRO2214 (Accession NM_018517). Accordingly, utilities of VGAM2736 include diagnosis, prevention and treatment of diseases and clinical conditions associated with PRO2214. LOC149721 (Accession XM_086649) is another VGAM2736 host target gene. LOC149721 BINDING SITE is HOST TARGET binding site found in the 3' untranslated region of mRNA encoded by LOC149721, corresponding to a HOST TARGET binding site such as BINDING SITE I, BINDING SITE II or BINDING SITE III. Table 2 illustrates the complementarity of the nucleotide sequences of LOC149721 BINDING SITE, designated SEQ ID:38813, to the nucleotide sequence of VGAM2736 RNA, herein designated VGAM RNA, also designated SEQ ID:5447.

Another function of VGAM2736 is therefore inhibition of LOC149721 (Accession XM_086649). Accordingly, utilities of VGAM2736 include diagnosis, prevention and treatment of diseases and clinical conditions associated with LOC149721. LOC153883 (Accession XM_087798) is another VGAM2736 host target gene. LOC153883 BINDING SITE is HOST TARGET binding site found in the 3' untranslated region of mRNA encoded by LOC153883, corresponding to a HOST TARGET binding site such as BINDING SITE I, BINDING SITE II or BINDING SITE III. Table 2 illustrates the complementarity of the nucleotide sequences of LOC153883 BINDING SITE, designated SEQ ID:39430, to the nucleotide sequence of VGAM2736 RNA, herein designated VGAM RNA, also designated SEQ ID:5447.

Another function of VGAM2736 is therefore inhibition of LOC153883 (Accession XM_087798). Accordingly, utilities of VGAM2736 include diagnosis, prevention and treatment of diseases and clinical conditions associated with LOC153883. FIG. 1 further provides a conceptual description of a novel bioinformatically detected viral gene of the present invention, referred to here as Viral Genomic Address Messenger 2737 (VGAM2737) viral gene, which modulates expression of respective host target genes thereof, the function and utility of which host target genes is known in the art.

VGAM2737 is a novel bioinformatically detected regulatory, non protein coding, viral micro RNA (miRNA) gene. The method by which VGAM2737 was detected is described hereinabove with reference to FIGS. 1-8.

VGAM2737 gene, herein designated VGAM GENE, is a viral gene contained in the genome of Broad Bean Necrosis Virus. VGAM2737 host target gene, herein designated VGAM HOST TARGET GENE, is a human gene contained in the human genome.

VGAM2737 gene encodes a VGAM2737 precursor RNA, herein designated VGAM PRECURSOR RNA. Similar to other miRNA genes, and unlike most ordinary genes, VGAM2737 precursor RNA does not encode a protein. A nucleotide sequence identical or highly similar to the nucleotide sequence of VGAM2737 precursor RNA is designated SEQ ID:2723, and is provided hereinbelow with reference to the sequence listing part. Nucleotide sequence SEQ ID:2723 is located at position 4765 relative to the genome of Broad Bean Necrosis Virus.

VGAM2737 precursor RNA folds onto itself, forming VGAM2737 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2737 folded precursor RNA into VGAM2737 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 45%) nucleotide sequence of VGAM2737 RNA is designated SEQ ID:5448, and is provided hereinbelow with reference to the sequence listing part.

VGAM2737 host target gene, herein designated VGAM HOST TARGET GENE, encodes a corresponding messenger RNA, VGAM2737 host target RNA, herein designated VGAM HOST TARGET RNA. VGAM2737 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2737 RNA, herein designated VGAM RNA, binds complementarily to one or more host target binding sites located in untranslated regions of VGAM2737 host target RNA, herein designated VGAM HOST TARGET RNA. This complementary binding is due to the fact that the nucleotide sequence of VGAM2737 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2737 RNA, herein designated VGAM RNA, may have a different number of host target binding sites in untranslated regions of a VGAM2737 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2737 RNA, herein designated VGAM RNA, to host target binding sites on VGAM2737 host target RNA, herein designated VGAM HOST TARGET RNA, such as BINDING SITE I, BINDING SITE II and BINDING SITE III, inhibits translation of VGAM2737 host target RNA into VGAM2737 host target protein, herein designated VGAM HOST TARGET PROTEIN. VGAM host target protein is therefore outlined by a broken line.

It is appreciated that VGAM2737 host target gene, herein designated VGAM HOST TARGET GENE, in fact represents a plurality of VGAM2737 host target genes. The mRNA of each one of this plurality of VGAM2737 host target genes comprises one or more host target binding sites, each having a nucleotide sequence which is at least partly complementary to VGAM2737 RNA, herein designated VGAM RNA, and which when bound by VGAM2737 RNA causes inhibition of translation of respective one or more VGAM2737 host target proteins.

It is further appreciated by one skilled in the art that the mode of translational inhibition illustrated by FIG. 1 with specific reference to translational inhibition exerted by VGAM2737 gene, herein designated VGAM GENE, on one or more VGAM2737 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2737 is inhibition of expression of host target genes, as part of a novel viral mechanism of attacking a host. Accordingly, utilities of VGAM2737 include diagnosis, prevention and treatment of viral infection by Broad Bean Necrosis Virus. Specific functions, and accordingly utilities, of VGAM2737 correlate with, and may be deduced from, the identity of the host target genes which VGAM2737 binds and inhibits, and the function of these host target genes, as elaborated hereinbelow.

Nucleotide sequences of the VGAM2737 precursor RNA, herein designated VGAM PRECURSOR RNA, and of the 'diced' VGAM2737 RNA, herein designated VGAM RNA, and a schematic representation of the secondary folding of VGAM2737 folded precursor RNA, herein designated VGAM FOLDED PRECURSOR RNA, of VGAM2737 are further described hereinbelow with reference to Table 1.

Nucleotide sequences of host target binding sites, such as BINDING SITE-I, BINDING SITE-II and BINDING SITE-III of FIG. 1, found on VGAM2737 host target RNA, and schematic representation of the complementarity of each of these host target binding sites to VGAM2737 RNA, herein designated VGAM RNA, are described hereinbelow with reference to Table 2.

As mentioned hereinabove with reference to FIG. 1, a function of VGAM2737 gene, herein designated VGAM is inhibition of expression of VGAM2737 target genes. It is appreciated that specific functions, and accordingly utilities, of VGAM2737 correlate with, and may be deduced from, the identity of the target genes which VGAM2737 binds and inhibits, and the function of these target genes, as elaborated hereinbelow.

RIG (Accession NM_006394) is a VGAM2737 host target gene. RIG BINDING SITE is HOST TARGET binding site found in the 3' untranslated region of mRNA encoded by RIG, corresponding to a HOST TARGET binding site such as BINDING SITE I, BINDING SITE II or BINDING SITE III. Table 2 illustrates the complementarity of the nucleotide sequences of RIG BINDING SITE, designated SEQ ID:13107, to the nucleotide sequence of VGAM2737 RNA, herein designated VGAM RNA, also designated SEQ ID:5448.

A function of VGAM2737 is therefore inhibition of RIG (Accession NM_006394), a gene which is ribosomal protein S15. Accordingly, utilities of VGAM2737 include diagnosis, prevention and treatment of diseases and clinical conditions associated with RIG. The function of RIG and its association with various diseases and clinical conditions, has been established by previous studies, as described hereinabove with reference to VGAM206. LOC85479 (Accession NM_033105) is another VGAM2737 host target gene. LOC85479 BINDING SITE is HOST TARGET binding site found in the 5' untranslated region of mRNA encoded by LOC85479, corresponding to a HOST TARGET binding site such as BINDING SITE I, BINDING SITE II or BINDING SITE III. Table 2 illustrates the complementarity of the nucleotide sequences of LOC85479 BINDING SITE, designated SEQ ID:26957, to the nucleotide sequence of VGAM2737 RNA, herein designated VGAM RNA, also designated SEQ ID:5448.

Another function of VGAM2737 is therefore inhibition of LOC85479 (Accession NM_033105). Accordingly, utilities of VGAM2737 include diagnosis, prevention and treatment of diseases and clinical conditions associated with LOC85479. FIG. 1 further provides a conceptual description of a novel bioinformatically detected viral gene of the present invention, referred to here as Viral Genomic Address Messenger 2738 (VGAM2738) viral gene, which modulates expression of respective host target genes thereof, the function and utility of which host target genes is known in the art.

VGAM2738 is a novel bioinformatically detected regulatory, non protein coding, viral micro RNA (miRNA) gene. The method by which VGAM2738 was detected is described hereinabove with reference to FIGS. 1-8.

VGAM2738 gene, herein designated VGAM GENE, is a viral gene contained in the genome of Broad Bean Necrosis Virus. VGAM2738 host target gene, herein designated VGAM HOST TARGET GENE, is a human gene contained in the human genome.

VGAM2738 gene encodes a VGAM2738 precursor RNA, herein designated VGAM PRECURSOR RNA. Similar to other miRNA genes, and unlike most ordinary genes, VGAM2738 precursor RNA does not encode a protein. A nucleotide sequence identical or highly similar to the nucleotide sequence of VGAM2738 precursor RNA is designated SEQ ID:2724, and is provided hereinbelow with reference to the sequence listing part. Nucleotide sequence SEQ ID:2724 is located at position 4423 relative to the genome of Broad Bean Necrosis Virus.

VGAM2738 precursor RNA folds onto itself, forming VGAM2738 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2738 folded precursor RNA into VGAM2738 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 41%) nucleotide sequence of VGAM2738 RNA is designated SEQ ID:5449, and is provided hereinbelow with reference to the sequence listing part.

VGAM2738 host target gene, herein designated VGAM HOST TARGET GENE, encodes a corresponding messenger RNA, VGAM2738 host target RNA, herein designated VGAM HOST TARGET RNA. VGAM2738 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2738 RNA, herein designated VGAM RNA, binds complementarily to one or more host target binding sites located in untranslated regions of VGAM2738 host target RNA, herein designated VGAM HOST TARGET RNA. This complementary binding is due to the fact that the nucleotide sequence of VGAM2738 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2738 RNA, herein designated VGAM RNA, may have a different number of host target binding sites in untranslated regions of a VGAM2738 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2738 RNA, herein designated VGAM RNA, to host target binding sites on VGAM2738 host target RNA, herein designated VGAM HOST TARGET RNA, such as BINDING SITE I, BINDING SITE II and BINDING SITE III, inhibits translation of VGAM2738 host target RNA into VGAM2738 host target protein, herein designated VGAM HOST TARGET PROTEIN. VGAM host target protein is therefore outlined by a broken line.

It is appreciated that VGAM2738 host target gene, herein designated VGAM HOST TARGET GENE, in fact represents a plurality of VGAM2738 host target genes. The mRNA of each one of this plurality of VGAM2738 host target genes comprises one or more host target binding sites, each having a nucleotide sequence which is at least partly complementary to VGAM2738 RNA, herein designated VGAM RNA, and which when bound by VGAM2738 RNA causes inhibition of translation of respective one or more VGAM2738 host target proteins.

It is further appreciated by one skilled in the art that the mode of translational inhibition illustrated by FIG. 1 with specific reference to translational inhibition exerted by VGAM2738 gene, herein designated VGAM GENE, on one or more VGAM2738 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2738 is inhibition of expression of host target genes, as part of a novel viral mechanism of attacking a host. Accordingly, utilities of VGAM2738 include diagnosis, prevention and treatment of viral infection by Broad Bean Necrosis Virus. Specific functions, and accordingly utilities, of VGAM2738 correlate with, and may be deduced from, the identity of the host target genes which VGAM2738 binds and inhibits, and the function of these host target genes, as elaborated hereinbelow.

Nucleotide sequences of the VGAM2738 precursor RNA, herein designated VGAM PRECURSOR RNA, and of the 'diced' VGAM2738 RNA, herein designated VGAM RNA, and a schematic representation of the secondary folding of VGAM2738 folded precursor RNA, herein designated VGAM FOLDED PRECURSOR RNA, of VGAM2738 are further described hereinbelow with reference to Table 1.

Nucleotide sequences of host target binding sites, such as BINDING SITE-I, BINDING SITE-II and BINDING SITE-III of FIG. 1, found on VGAM2738 host target RNA, and schematic representation of the complementarity of each of these host target binding sites to VGAM2738 RNA, herein designated VGAM RNA, are described hereinbelow with reference to Table 2.

As mentioned hereinabove with reference to FIG. 1, a function of VGAM2738 gene, herein designated VGAM is inhibition of expression of VGAM2738 target genes. It is appreciated that specific functions, and accordingly utilities, of VGAM2738 correlate with, and may be deduced from, the identity of the target genes which VGAM2738 binds and inhibits, and the function of these target genes, as elaborated hereinbelow.

SMT3 Suppressor of Mif Two 3 Homolog 1 (yeast) (SMT3H1, Accession XM_009805) is a VGAM2738 host target gene. SMT3H1 BINDING SITE is HOST TARGET binding site found in the 3' untranslated region of mRNA encoded by SMT3H1, corresponding to a HOST TARGET binding site such as BINDING SITE I, BINDING SITE II or BINDING SITE III. Table 2 illustrates the complementarity of the nucleotide sequences of SMT3H1 BINDING SITE, designated SEQ ID:30127, to the nucleotide sequence of VGAM2738 RNA, herein designated VGAM RNA, also designated SEQ ID:5449.

A function of VGAM2738 is therefore inhibition of SMT3 Suppressor of Mif Two 3 Homolog 1 (yeast) (SMT3H1, Accession XM_009805), a gene which is involved in the function and/or structure of the eukaryotic kinetochore. Accordingly, utilities of VGAM2738 include diagnosis, prevention and treatment of diseases and clinical conditions associated with SMT3H1. The function of SMT3H1 and its association with various diseases and clinical conditions, has been established by previous studies, as described hereinabove with reference to VGAM119. FLJ23071 (Accession NM_025192) is another VGAM2738 host target gene. FLJ23071 BINDING SITE is HOST TARGET binding site found in the 5' untranslated region of mRNA encoded by FLJ23071, corresponding to a HOST TARGET binding site such as BINDING SITE I, BINDING SITE II or BINDING SITE III. Table 2 illustrates the complementarity of the nucleotide sequences of FLJ23071 BINDING SITE, designated SEQ ID:24844, to the nucleotide sequence of VGAM2738 RNA, herein designated VGAM RNA, also designated SEQ ID:5449.

Another function of VGAM2738 is therefore inhibition of FLJ23071 (Accession NM_025192). Accordingly, utilities of VGAM2738 include diagnosis, prevention and treatment of diseases and clinical conditions associated with FLJ23071. KIAA0332 (Accession XM_031553) is another VGAM2738 host target gene. KIAA0332 BINDING SITE is HOST TARGET binding site found in the 3' untranslated region of mRNA encoded by KIAA0332, corresponding to a HOST TARGET binding site such as BINDING SITE I, BINDING SITE II or BINDING SITE III. Table 2 illustrates the complementarity of the nucleotide sequences of KIAA0332 BINDING SITE, designated SEQ ID:31423, to the nucleotide sequence of VGAM2738 RNA, herein designated VGAM RNA, also designated SEQ ID:5449.

Another function of VGAM2738 is therefore inhibition of KIAA0332 (Accession XM_031553). Accordingly, utilities of VGAM2738 include diagnosis, prevention and treatment of diseases and clinical conditions associated with KIAA0332. PRSC (Accession NM_006587) is another VGAM2738 host target gene. PRSC BINDING SITE is HOST TARGET binding site found in the 3' untranslated region of mRNA encoded by PRSC, corresponding to a HOST TARGET binding site such as BINDING SITE I, BINDING SITE II or BINDING SITE III. Table 2 illustrates the complementarity of the nucleotide sequences of PRSC BINDING SITE, designated SEQ ID:13350, to the nucleotide sequence of VGAM2738 RNA, herein designated VGAM RNA, also designated SEQ ID:5449.

Another function of VGAM2738 is therefore inhibition of PRSC (Accession NM_006587). Accordingly, utilities of VGAM2738 include diagnosis, prevention and treatment of diseases and clinical conditions associated with PRSC. LOC256158 (Accession XM_175125) is another VGAM2738 host target gene. LOC256158 BINDING SITE is HOST TARGET binding site found in the 5' untranslated region of mRNA encoded by LOC256158, corresponding to a HOST TARGET binding site such as BINDING SITE I, BINDING SITE II or BINDING SITE III. Table 2 illustrates the complementarity of the nucleotide sequences of LOC256158 BINDING SITE, designated SEQ ID:46631, to the nucleotide sequence of VGAM2738 RNA, herein designated VGAM RNA, also designated SEQ ID:5449.

Another function of VGAM2738 is therefore inhibition of LOC256158 (Accession XM_175125). Accordingly, utilities of VGAM2738 include diagnosis, prevention and treatment of diseases and clinical conditions associated with LOC256158. FIG. 1 further provides a conceptual description of a novel bioinformatically detected viral gene of the present invention, referred to here as Viral Genomic Address Messenger 2739 (VGAM2739) viral gene, which modulates expression of respective host target genes thereof, the function and utility of which host target genes is known in the art.

VGAM2739 is a novel bioinformatically detected regulatory, non protein coding, viral micro RNA (miRNA) gene. The method by which VGAM2739 was detected is described hereinabove with reference to FIGS. 1-8.

VGAM2739 gene, herein designated VGAM GENE, is a viral gene contained in the genome of Broad Bean Necrosis Virus. VGAM2739 host target gene, herein designated VGAM HOST TARGET GENE, is a human gene contained in the human genome.

VGAM2739 gene encodes a VGAM2739 precursor RNA, herein designated VGAM PRECURSOR RNA. Similar to other miRNA genes, and unlike most ordinary genes, VGAM2739 precursor RNA does not encode a protein. A nucleotide sequence identical or highly similar to the nucleotide sequence of VGAM2739 precursor RNA is designated SEQ ID:2725, and is provided hereinbelow with reference to the sequence listing part. Nucleotide sequence SEQ ID:2725 is located at position 2143 relative to the genome of Broad Bean Necrosis Virus.

VGAM2739 precursor RNA folds onto itself, forming VGAM2739 folded precursor RNA, herein designated VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, 'dices' the VGAM2739 folded precursor RNA into VGAM2739 RNA, herein designated VGAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins. A probable (over 44%) nucleotide sequence of VGAM2739 RNA is designated SEQ ID:5450, and is provided hereinbelow with reference to the sequence listing part.

VGAM2739 host target gene, herein designated VGAM HOST TARGET GENE, encodes a corresponding messenger RNA, VGAM2739 host target RNA, herein designated VGAM HOST TARGET RNA. VGAM2739 host target RNA comprises three regions, as is typical of mRNA of a protein coding gene: a 5' untranslated region, a protein coding region and a 3' untranslated region, designated 5"UTR, PROTEIN CODING and 3'UTR respectively.

VGAM2739 RNA, herein designated VGAM RNA, binds complementarily to one or more host target binding sites located in untranslated regions of VGAM2739 host target RNA, herein designated VGAM HOST TARGET RNA. This complementary binding is due to the fact that the nucleotide sequence of VGAM2739 RNA is an accurate or a partial inversed-reversed sequence of the nucleotide sequence of each of the host target binding sites. As an illustration, FIG. 1 shows three such host target binding sites, designated BINDING SITE I, BINDING SITE II and BINDING SITE III respectively. It is appreciated that the number of host target binding sites shown in FIG. 1 is meant as an illustration only, and is not meant to be limiting - VGAM2739 RNA, herein designated VGAM RNA, may have a different number of host target binding sites in untranslated regions of a VGAM2739 host target RNA, herein designated VGAM HOST TARGET RNA. It is further appreciated that while FIG. 1 depicts host target binding sites in the 3'UTR region, this is meant as an example only - these host target binding sites may be located in the 3'UTR region, the 5"UTR region, or in both 3'UTR and 5"UTR regions.

The complementary binding of VGAM2739 RNA, herein designated VGAM RNA, to host target binding sites on VGAM2739 host target RNA, herein designated VGAM HOST TARGET RNA, such as BINDING SITE I, BINDING SITE II and BINDING SITE III, inhibits translation of VGAM2739 host target RNA into VGAM2739 host target protein, herein designated VGAM HOST TARGET PROTEIN. VGAM host target protein is therefore outlined by a broken line.

It is appreciated that VGAM2739 host target gene, herein designated VGAM HOST TARGET GENE, in fact represents a plurality of VGAM2739 host target genes. The mRNA of each one of this plurality of VGAM2739 host target genes comprises one or more host target binding sites, each having a nucleotide sequence which is at least partly complementary to VGAM2739 RNA, herein designated VGAM RNA, and which when bound by VGAM2739 RNA causes inhibition of translation of respective one or more VGAM2739 host target proteins.

It is further appreciated by one skilled in the art that the mode of translational inhibition illustrated by FIG. 1 with specific reference to translational inhibition exerted by VGAM2739 gene, herein designated VGAM GENE, on one or more VGAM2739 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of a tiny RNA world', Science 294,779 (2001)).

It is yet further appreciated that a function of VGAM2739 is inhibition of expression of host target genes, as part of a novel viral mechanism of attacking a host. Accordingly, utilities of VGAM2739 include diagnosis, prevention and treatment of viral infection by Broad Bean Necrosis Virus. Specific functions, and accordingly utilities, of VGAM2739 correlate with, and may be deduced from, the identity of the host target genes which VGAM2739 binds and inhibits, and the function of these host target genes, as elaborated hereinbelow.

Nucleotide sequences of the VGAM2739 precursor RNA, herein designated VGAM PRECURSOR RNA, and of the 'diced' VGAM2739 RNA, herein designated VGAM RNA, and a schematic representation of the secondary folding of VGAM2739 folded precursor RNA, herein designated VGAM FOLDED PRECURSOR RNA, of VGAM2739 are further described hereinbelow with reference to Table 1.

Nucleotide sequences of host target binding sites, such as BINDING SITE-I, BINDING SITE-II and BINDING SITE-III of FIG. 1, found on VGAM2739 host target RNA, and schematic representation of the complementarity of each of these host target binding sites to VGAM2739 RNA, herein designated VGAM RNA, are described hereinbelow with reference to Table 2.

As mentioned hereinabove with reference to FIG. 1, a function of VGAM2739 gene, herein designated VGAM is inhibition of expression of VGAM2739 target genes. It is appreciated that specific functions, and accordingly utilities, of VGAM2739 correlate with, and may be deduced from, the identity of the target genes which VGAM2739 binds and inhibits, and the function of these target genes, as elaborated hereinbelow.

TEM8 (Accession NM_032208) is a VGAM2739 host target gene. TEM8 BINDING SITE is HOST TARGET binding site found in the 3' untranslated region of mRNA encoded by TEM8, corresponding to a HOST TARGET binding site such as BINDING SITE I, BINDING SITE II or BINDING SITE III. Table 2 illustrates the complementarity of the nucleotide sequences of TEM8 BINDING SITE, designated SEQ ID:25919, to the nucleotide sequence of VGAM2739 RNA, herein designated VGAM RNA, also designated SEQ ID:5450.

A function of VGAM2739 is therefore inhibition of TEM8 (Accession NM_032208), a gene which is a tumor-specific endothelial marker. Accordingly, utilities of VGAM2739 include diagnosis, prevention and treatment of diseases and clinical conditions associated with TEM8. The function of TEM8 and its association with various diseases and clinical conditions, has been established by previous studies, as described hereinabove with reference to VGAM1489. FLJ13612 (Accession NM_025202) is another VGAM2739 host target gene. FLJ13612 BINDING SITE is HOST TARGET binding site found in the 3' untranslated region of mRNA encoded by FLJ13612, corresponding to a HOST TARGET binding site such as BINDING SITE I, BINDING SITE II or BINDING SITE III. Table 2 illustrates the complementarity of the nucleotide sequences of FLJ13612 BINDING SITE, designated SEQ ID:24860, to the nucleotide sequence of VGAM2739 RNA, herein designated VGAM RNA, also designated SEQ ID:5450.

Another function of VGAM2739 is therefore inhibition of FLJ13612 (Accession NM_025202). Accordingly, utilities of VGAM2739 include diagnosis, prevention and treatment of diseases and clinical conditions associated with FLJ13612. KIAA0534 (Accession XM_049349) is another VGAM2739 host target gene. KIAA0534 BINDING SITE is HOST TARGET binding site found in the 3' untranslated region of mRNA encoded by KIAA0534, corresponding to a HOST TARGET binding site such as BINDING SITE I, BINDING SITE II or BINDING SITE III. Table 2 illustrates the complementarity of the nucleotide sequences of KIAA0534 BINDING SITE, designated SEQ ID:35386, to the nucleotide sequence of VGAM2739 RNA, herein designated VGAM RNA, also designated SEQ ID:5450.

Another function of VGAM2739 is therefore inhibition of KIAA0534 (Accession XM_049349). Accordingly, utilities of VGAM2739 include diagnosis, prevention and treatment of diseases and clinical conditions associated with KIAA0534. PRO2214 (Accession NM_018517) is another VGAM2739 host target gene. PRO2214 BINDING SITE is HOST TARGET binding site found in the 5' untranslated region of mRNA encoded by PRO2214, corresponding to a HOST TARGET binding site such as BINDING SITE I, BINDING SITE II or BINDING SITE III. Table 2 illustrates the complementarity of the nucleotide sequences of PRO2214 BINDING SITE, designated SEQ ID:20589, to the nucleotide sequence of VGAM2739 RNA, herein designated VGAM RNA, also designated SEQ ID:5450.

Another function of VGAM2739 is therefore inhibition of PRO2214 (Accession NM_018517). Accordingly, utilities of VGAM2739 include diagnosis, prevention and treatment of diseases and clinical conditions associated with PRO2214. LOC149721 (Accession XM_086649) is another VGAM2739 host target gene. LOC149721 BINDING SITE is HOST TARGET binding site found in the 3' untranslated region of mRNA encoded by LOC149721, corresponding to a HOST TARGET binding site such as BINDING SITE I, BINDING SITE II or BINDING SITE III. Table 2 illustrates the complementarity of the nucleotide sequences of LOC149721 BINDING SITE, designated SEQ ID:38813, to the nucleotide sequence of VGAM2739 RNA, herein designated VGAM RNA, also designated SEQ ID:5450.

Another function of VGAM2739 is therefore inhibition of LOC149721 (Accession XM_086649). Accordingly, utilities of VGAM2739 include diagnosis, prevention and treatment of diseases and clinical conditions associated with LOC149721. LOC153883 (Accession XM_087798) is another VGAM2739 host target gene. LOC153883 BINDING SITE is HOST TARGET binding site found in the 3' untranslated region of mRNA encoded by LOC153883, corresponding to a HOST TARGET binding site such as BINDING SITE I, BINDING SITE II or BINDING SITE III. Table 2 illustrates the complementarity of the nucleotide sequences of LOC153883 BINDING SITE, designated SEQ ID:39430, to the nucleotide sequence of VGAM2739 RNA, herein designated VGAM RNA, also designated SEQ ID:5450.

Another function of VGAM2739 is therefore inhibition of LOC153883 (Accession XM_087798). Accordingly, utilities of VGAM2739 include diagnosis, prevention and treatment of diseases and clinical conditions associated with LOC153883. FIG. 9 further provides a conceptual description of novel bioinformatically detected regulatory viral gene, referred to here as Viral Genomic Record 2740(VGR2740) viral gene, which encodes an 'operon-like' cluster of novel viral micro RNA-like genes, each of which in turn modulates expression of at least one host target gene, the function and utility of which at least one host target gene is known in the art.

VGR2740 gene, herein designated VGR GENE, is a novel bioinformatically detected regulatory, non protein coding, RNA viral gene. The method by which VGR2740 gene was detected is described hereinabove with reference to FIGS. 1-9.

VGR2740 gene encodes VGR2740 precursor RNA, herein designated VGR PRECURSOR RNA, an RNA molecule, typically several hundred nucleotides long.

VGR2740 precursor RNA folds spatially, forming VGR2740 folded precursor RNA, herein designated VGR FOLDED PRECURSOR RNA. It is appreciated that VGR2740 folded precursor RNA comprises a plurality of what is known in the art as 'hairpin' structures. These 'hairpin' structures are due to the fact that the nucleotide sequence of VGR2740 precursor RNA comprises a plurality of segments, the first half of each such segment having a nucleotide sequence which is at least a partial inversed-reversed sequence of the second half thereof, as is well known in the art.

VGR2740 folded precursor RNA is naturally processed by cellular enzymatic activity into at least 2 separate VGAM precursor RNAs, VGAM15 precursor RNA and VGAM16 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM15 RNA and VGAM16 RNA, herein schematically represented by VGAM1 RNA through VGAM3 RNA, each of which VGAM RNAs corresponding to VGAM RNA of FIG. 1.

VGAM15 RNA, herein schematically represented by VGAM1 RNA through VGAM3 RNA, binds complementarily to a host target binding site located in an untranslated region of VGAM15 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM15 host target RNA into VGAM15 host target protein, herein schematically represented by VGAM1 HOST TARGET PROTEIN through VGAM3 HOST TARGET PROTEIN, all of FIG. 1.

VGAM16 RNA, herein schematically represented by VGAM1 RNA through VGAM3 RNA, binds complementarily to a host target binding site located in an untranslated region of VGAM16 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM16 host target RNA into VGAM16 host target protein, herein schematically represented by VGAM1 HOST TARGET PROTEIN through VGAM3 HOST TARGET PROTEIN, all of FIG. 1.

It is appreciated that a function of VGR2740 gene, herein designated VGR GENE, is inhibition of expression of host target genes, as part of a novel viral mechanism of attacking a host. Accordingly, utilities of VGR2740 gene include diagnosis, prevention and treatment of viral infection by Human Herpesvirus 7. Specific functions, and accordingly utilities, of VGR2740 gene correlate with, and may be deduced from, the identity of the host target genes, which are inhibited by VGAM RNAs comprised in the 'operon-like' cluster of VGR2740 gene: VGAM15 host target protein and VGAM16 host target protein, herein schematically represented by VGAM1 HOST TARGET PROTEIN through VGAM3 HOST TARGET PROTEIN. The function of these host target genes is elaborated hereinabove with reference to VGAM15 and VGAM16. FIG. 9 further provides a conceptual description of novel bioinformatically detected regulatory viral gene, referred to here as Viral Genomic Record 2741(VGR2741) viral gene, which encodes an 'operon-like' cluster of novel viral micro RNA-like genes, each of which in turn modulates expression of at least one host target gene, the function and utility of which at least one host target gene is known in the art.

VGR2741 gene, herein designated VGR GENE, is a novel bioinformatically detected regulatory, non protein coding, RNA viral gene. The method by which VGR2741 gene was detected is described hereinabove with reference to FIGS. 1-9.

VGR2741 gene encodes VGR2741 precursor RNA, herein designated VGR PRECURSOR RNA, an RNA molecule, typically several hundred nucleotides long.

VGR2741 precursor RNA folds spatially, forming VGR2741 folded precursor RNA, herein designated VGR FOLDED PRECURSOR RNA. It is appreciated that VGR2741 folded precursor RNA comprises a plurality of what is known in the art as 'hairpin' structures. These 'hairpin' structures are due to the fact that the nucleotide sequence of VGR2741 precursor RNA comprises a plurality of segments, the first half of each such segment having a nucleotide sequence which is at least a partial inversed-reversed sequence of the second half thereof, as is well known in the art.

VGR2741 folded precursor RNA is naturally processed by cellular enzymatic activity into at least 8 separate VGAM precursor RNAs, VGAM18 precursor RNA, VGAM19 precursor RNA, VGAM20 precursor RNA, VGAM21 precursor RNA, VGAM22 precursor RNA, VGAM23 precursor RNA, VGAM24 precursor RNA and VGAM25 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM18 RNA, VGAM19 RNA, VGAM20 RNA, VGAM21 RNA, VGAM22 RNA, VGAM23 RNA, VGAM24 RNA and VGAM25 RNA, herein schematically represented by VGAM1 RNA through VGAM3 RNA, each of which VGAM RNAs corresponding to VGAM RNA of FIG. 1.

VGAM18 RNA, herein schematically represented by VGAM1 RNA through VGAM3 RNA, binds complementarily to a host target binding site located in an untranslated region of VGAM18 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM18 host target RNA into VGAM18 host target protein, herein schematically represented by VGAM1 HOST TARGET PROTEIN through VGAM3 HOST TARGET PROTEIN, all of FIG. 1.

VGAM19 RNA, herein schematically represented by VGAM1 RNA through VGAM3 RNA, binds complementarily to a host target binding site located in an untranslated region of VGAM19 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM19 host target RNA into VGAM19 host target protein, herein schematically represented by VGAM1 HOST TARGET PROTEIN through VGAM3 HOST TARGET PROTEIN, all of FIG. 1.

VGAM20 RNA, herein schematically represented by VGAM1 RNA through VGAM3 RNA, binds complementarily to a host target binding site located in an untranslated region of VGAM20 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM20 host target RNA into VGAM20 host target protein, herein schematically represented by VGAM1 HOST TARGET PROTEIN through VGAM3 HOST TARGET PROTEIN, all of FIG. 1.

VGAM21 RNA, herein schematically represented by VGAM1 RNA through VGAM3 RNA, binds complementarily to a host target binding site located in an untranslated region of VGAM21 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM21 host target RNA into VGAM21 host target protein, herein schematically represented by VGAM1 HOST TARGET PROTEIN through VGAM3 HOST TARGET PROTEIN, all of FIG. 1.

VGAM22 RNA, herein schematically represented by VGAM1 RNA through VGAM3 RNA, binds complementarily to a host target binding site located in an untranslated region of VGAM22 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM22 host target RNA into VGAM22 host target protein, herein schematically represented by VGAM1 HOST TARGET PROTEIN through VGAM3 HOST TARGET PROTEIN, all of FIG. 1.

VGAM23 RNA, herein schematically represented by VGAM1 RNA through VGAM3 RNA, binds complementarily to a host target binding site located in an untranslated region of VGAM23 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM23 host target RNA into VGAM23 host target protein, herein schematically represented by VGAM1 HOST TARGET PROTEIN through VGAM3 HOST TARGET PROTEIN, all of FIG. 1.

VGAM24 RNA, herein schematically represented by VGAM1 RNA through VGAM3 RNA, binds complementarily to a host target binding site located in an untranslated region of VGAM24 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM24 host target RNA into VGAM24 host target protein, herein schematically represented by VGAM1 HOST TARGET PROTEIN through VGAM3 HOST TARGET PROTEIN, all of FIG. 1.

VGAM25 RNA, herein schematically represented by VGAM1 RNA through VGAM3 RNA, binds complementarily to a host target binding site located in an untranslated region of VGAM25 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM25 host target RNA into VGAM25 host target protein, herein schematically represented by VGAM1 HOST TARGET PROTEIN through VGAM3 HOST TARGET PROTEIN, all of FIG. 1.

It is appreciated that a function of VGR2741 gene, herein designated VGR GENE, is inhibition of expression of host target genes, as part of a novel viral mechanism of attacking a host. Accordingly, utilities of VGR2741 gene include diagnosis, prevention and treatment of viral infection by Invertebrate Iridescent Virus 6. Specific functions, and accordingly utilities, of VGR2741 gene correlate with, and may be deduced from, the identity of the host target genes, which are inhibited by VGAM RNAs comprised in the 'operon-like' cluster of VGR2741 gene: VGAM18 host target protein, VGAM19 host target protein, VGAM20 host target protein, VGAM21 host target protein, VGAM22 host target protein, VGAM23 host target protein, VGAM24 host target protein and VGAM25 host target protein, herein schematically represented by VGAM1 HOST TARGET PROTEIN through VGAM3 HOST TARGET PROTEIN. The function of these host target genes is elaborated hereinabove with reference to VGAM18, VGAM19, VGAM20, VGAM21, VGAM22, VGAM23, VGAM24 and VGAM25. FIG. 9 further provides a conceptual description of novel bioinformatically detected regulatory viral gene, referred to here as Viral Genomic Record 2742(VGR2742) viral gene, which encodes an 'operon-like' cluster of novel viral micro RNA-like genes, each of which in turn modulates expression of at least one host target gene, the function and utility of which at least one host target gene is known in the art.

VGR2742 gene, herein designated VGR GENE, is a novel bioinformatically detected regulatory, non protein coding, RNA viral gene. The method by which VGR2742 gene was detected is described hereinabove with reference to FIGS. 1-9.

VGR2742 gene encodes VGR2742 precursor RNA, herein designated VGR PRECURSOR RNA, an RNA molecule, typically several hundred nucleotides long.

VGR2742 precursor RNA folds spatially, forming VGR2742 folded precursor RNA, herein designated VGR FOLDED PRECURSOR RNA. It is appreciated that VGR2742 folded precursor RNA comprises a plurality of what is known in the art as 'hairpin' structures. These 'hairpin' structures are due to the fact that the nucleotide sequence of VGR2742 precursor RNA comprises a plurality of segments, the first half of each such segment having a nucleotide sequence which is at least a partial inversed-reversed sequence of the second half thereof, as is well known in the art.

VGR2742 folded precursor RNA is naturally processed by cellular enzymatic activity into at least 8 separate VGAM precursor RNAs, VGAM26 precursor RNA, VGAM27 precursor RNA, VGAM28 precursor RNA, VGAM29 precursor RNA, VGAM30 precursor RNA, VGAM31 precursor RNA, VGAM32 precursor RNA and VGAM33 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM26 RNA, VGAM27 RNA, VGAM28 RNA, VGAM29 RNA, VGAM30 RNA, VGAM31 RNA, VGAM32 RNA and VGAM33 RNA, herein schematically represented by VGAM1 RNA through VGAM3 RNA, each of which VGAM RNAs corresponding to VGAM RNA of FIG. 1.

VGAM26 RNA, herein schematically represented by VGAM1 RNA through VGAM3 RNA, binds complementarily to a host target binding site located in an untranslated region of VGAM26 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM26 host target RNA into VGAM26 host target protein, herein schematically represented by VGAM1 HOST TARGET PROTEIN through VGAM3 HOST TARGET PROTEIN, all of FIG. 1.

VGAM27 RNA, herein schematically represented by VGAM1 RNA through VGAM3 RNA, binds complementarily to a host target binding site located in an untranslated region of VGAM27 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM27 host target RNA into VGAM27 host target protein, herein schematically represented by VGAM1 HOST TARGET PROTEIN through VGAM3 HOST TARGET PROTEIN, all of FIG. 1.

VGAM28 RNA, herein schematically represented by VGAM1 RNA through VGAM3 RNA, binds complementarily to a host target binding site located in an untranslated region of VGAM28 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM28 host target RNA into VGAM28 host target protein, herein schematically represented by VGAM1 HOST TARGET PROTEIN through VGAM3 HOST TARGET PROTEIN, all of FIG. 1.

VGAM29 RNA, herein schematically represented by VGAM1 RNA through VGAM3 RNA, binds complementarily to a host target binding site located in an untranslated region of VGAM29 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM29 host target RNA into VGAM29 host target protein, herein schematically represented by VGAM1 HOST TARGET PROTEIN through VGAM3 HOST TARGET PROTEIN, all of FIG. 1.

VGAM30 RNA, herein schematically represented by VGAM1 RNA through VGAM3 RNA, binds complementarily to a host target binding site located in an untranslated region of VGAM30 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM30 host target RNA into VGAM30 host target protein, herein schematically represented by VGAM1 HOST TARGET PROTEIN through VGAM3 HOST TARGET PROTEIN, all of FIG. 1.

VGAM31 RNA, herein schematically represented by VGAM1 RNA through VGAM3 RNA, binds complementarily to a host target binding site located in an untranslated region of VGAM31 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM31 host target RNA into VGAM31 host target protein, herein schematically represented by VGAM1 HOST TARGET PROTEIN through VGAM3 HOST TARGET PROTEIN, all of FIG. 1.

VGAM32 RNA, herein schematically represented by VGAM1 RNA through VGAM3 RNA, binds complementarily to a host target binding site located in an untranslated region of VGAM32 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM32 host target RNA into VGAM32 host target protein, herein schematically represented by VGAM1 HOST TARGET PROTEIN through VGAM3 HOST TARGET PROTEIN, all of FIG. 1.

VGAM33 RNA, herein schematically represented by VGAM1 RNA through VGAM3 RNA, binds complementarily to a host target binding site located in an untranslated region of VGAM33 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM33 host target RNA into VGAM33 host target protein, herein schematically represented by VGAM1 HOST TARGET PROTEIN through VGAM3 HOST TARGET PROTEIN, all of FIG. 1.

It is appreciated that a function of VGR2742 gene, herein designated VGR GENE, is inhibition of expression of host target genes, as part of a novel viral mechanism of attacking a host. Accordingly, utilities of VGR2742 gene include diagnosis, prevention and treatment of viral infection by Invertebrate Iridescent Virus 6. Specific functions, and accordingly utilities, of VGR2742 gene correlate with, and may be deduced from, the identity of the host target genes, which are inhibited by VGAM RNAs comprised in the 'operon-like' cluster of VGR2742 gene: VGAM26 host target protein, VGAM27 host target protein, VGAM28 host target protein, VGAM29 host target protein, VGAM30 host target protein, VGAM31 host target protein, VGAM32 host target protein and VGAM33 host target protein, herein schematically represented by VGAM1 HOST TARGET PROTEIN through VGAM3 HOST TARGET PROTEIN. The function of these host target genes is elaborated hereinabove with reference to VGAM26, VGAM27, VGAM28, VGAM29, VGAM30, VGAM31, VGAM32 and VGAM33. FIG. 9 further provides a conceptual description of novel bioinformatically detected regulatory viral gene, referred to here as Viral Genomic Record 2743(VGR2743) viral gene, which encodes an 'operon-like' cluster of novel viral micro RNA-like genes, each of which in turn modulates expression of at least one host target gene, the function and utility of which at least one host target gene is known in the art.

VGR2743 gene, herein designated VGR GENE, is a novel bioinformatically detected regulatory, non protein coding, RNA viral gene. The method by which VGR2743 gene was detected is described hereinabove with reference to FIGS. 1-9.

VGR2743 gene encodes VGR2743 precursor RNA, herein designated VGR PRECURSOR RNA, an RNA molecule, typically several hundred nucleotides long.

VGR2743 precursor RNA folds spatially, forming VGR2743 folded precursor RNA, herein designated VGR FOLDED PRECURSOR RNA. It is appreciated that VGR2743 folded precursor RNA comprises a plurality of what is known in the art as 'hairpin' structures. These 'hairpin' structures are due to the fact that the nucleotide sequence of VGR2743 precursor RNA comprises a plurality of segments, the first half of each such segment having a nucleotide sequence which is at least a partial inversed-reversed sequence of the second half thereof, as is well known in the art.

VGR2743 folded precursor RNA is naturally processed by cellular enzymatic activity into at least 8 separate VGAM precursor RNAs, VGAM34 precursor RNA, VGAM35 precursor RNA, VGAM36 precursor RNA, VGAM37 precursor RNA, VGAM38 precursor RNA, VGAM39 precursor RNA, VGAM40 precursor RNA and VGAM41 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM34 RNA, VGAM35 RNA, VGAM36 RNA, VGAM37 RNA, VGAM38 RNA, VGAM39 RNA, VGAM40 RNA and VGAM41 RNA, herein schematically represented by VGAM1 RNA through VGAM3 RNA, each of which VGAM RNAs corresponding to VGAM RNA of FIG. 1.

VGAM34 RNA, herein schematically represented by VGAM1 RNA through VGAM3 RNA, binds complementarily to a host target binding site located in an untranslated region of VGAM34 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM34 host target RNA into VGAM34 host target protein, herein schematically represented by VGAM1 HOST TARGET PROTEIN through VGAM3 HOST TARGET PROTEIN, all of FIG. 1.

VGAM35 RNA, herein schematically represented by VGAM1 RNA through VGAM3 RNA, binds complementarily to a host target binding site located in an untranslated region of VGAM35 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM35 host target RNA into VGAM35 host target protein, herein schematically represented by VGAM1 HOST TARGET PROTEIN through VGAM3 HOST TARGET PROTEIN, all of FIG. 1.

VGAM36 RNA, herein schematically represented by VGAM1 RNA through VGAM3 RNA, binds complementarily to a host target binding site located in an untranslated region of VGAM36 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM36 host target RNA into VGAM36 host target protein, herein schematically represented by VGAM1 HOST TARGET PROTEIN through VGAM3 HOST TARGET PROTEIN, all of FIG. 1.

VGAM37 RNA, herein schematically represented by VGAM1 RNA through VGAM3 RNA, binds complementarily to a host target binding site located in an untranslated region of VGAM37 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM37 host target RNA into VGAM37 host target protein, herein schematically represented by VGAM1 HOST TARGET PROTEIN through VGAM3 HOST TARGET PROTEIN, all of FIG. 1.

VGAM38 RNA, herein schematically represented by VGAM1 RNA through VGAM3 RNA, binds complementarily to a host target binding site located in an untranslated region of VGAM38 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM38 host target RNA into VGAM38 host target protein, herein schematically represented by VGAM1 HOST TARGET PROTEIN through VGAM3 HOST TARGET PROTEIN, all of FIG. 1.

VGAM39 RNA, herein schematically represented by VGAM1 RNA through VGAM3 RNA, binds complementarily to a host target binding site located in an untranslated region of VGAM39 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM39 host target RNA into VGAM39 host target protein, herein schematically represented by VGAM1 HOST TARGET PROTEIN through VGAM3 HOST TARGET PROTEIN, all of FIG. 1.

VGAM40 RNA, herein schematically represented by VGAM1 RNA through VGAM3 RNA, binds complementarily to a host target binding site located in an untranslated region of VGAM40 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM40 host target RNA into VGAM40 host target protein, herein schematically represented by VGAM1 HOST TARGET PROTEIN through VGAM3 HOST TARGET PROTEIN, all of FIG. 1.

VGAM41 RNA, herein schematically represented by VGAM1 RNA through VGAM3 RNA, binds complementarily to a host target binding site located in an untranslated region of VGAM41 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM41 host target RNA into VGAM41 host target protein, herein schematically represented by VGAM1 HOST TARGET PROTEIN through VGAM3 HOST TARGET PROTEIN, all of FIG. 1.

It is appreciated that a function of VGR2743 gene, herein designated VGR GENE, is inhibition of expression of host target genes, as part of a novel viral mechanism of attacking a host. Accordingly, utilities of VGR2743 gene include diagnosis, prevention and treatment of viral infection by Invertebrate Iridescent Virus 6. Specific functions, and accordingly utilities, of VGR2743 gene correlate with, and may be deduced from, the identity of the host target genes, which are inhibited by VGAM RNAs comprised in the 'operon-like' cluster of VGR2743 gene: VGAM34 host target protein, VGAM35 host target protein, VGAM36 host target protein, VGAM37 host target protein, VGAM38 host target protein, VGAM39 host target protein, VGAM40 host target protein and VGAM41 host target protein, herein schematically represented by VGAM1 HOST TARGET PROTEIN through VGAM3 HOST TARGET PROTEIN. The function of these host target genes is elaborated hereinabove with reference to VGAM34, VGAM35, VGAM36, VGAM37, VGAM38, VGAM39, VGAM40 and VGAM41. FIG. 9 further provides a conceptual description of novel bioinformatically detected regulatory viral gene, referred to here as Viral Genomic Record 2744(VGR2744) viral gene, which encodes an 'operon-like' cluster of novel viral micro RNA-like genes, each of which in turn modulates expression of at least one host target gene, the function and utility of which at least one host target gene is known in the art.

VGR2744 gene, herein designated VGR GENE, is a novel bioinformatically detected regulatory, non protein coding, RNA viral gene. The method by which VGR2744 gene was detected is described hereinabove with reference to FIGS. 1-9.

VGR2744 gene encodes VGR2744 precursor RNA, herein designated VGR PRECURSOR RNA, an RNA molecule, typically several hundred nucleotides long.

VGR2744 precursor RNA folds spatially, forming VGR2744 folded precursor RNA, herein designated VGR FOLDED PRECURSOR RNA. It is appreciated that VGR2744 folded precursor RNA comprises a plurality of what is known in the art as 'hairpin' structures. These 'hairpin' structures are due to the fact that the nucleotide sequence of VGR2744 precursor RNA comprises a plurality of segments, the first half of each such segment having a nucleotide sequence which is at least a partial inversed-reversed sequence of the second half thereof, as is well known in the art.

VGR2744 folded precursor RNA is naturally processed by cellular enzymatic activity into at least 8 separate VGAM precursor RNAs, VGAM42 precursor RNA, VGAM43 precursor RNA, VGAM44 precursor RNA, VGAM45 precursor RNA, VGAM46 precursor RNA, VGAM47 precursor RNA, VGAM48 precursor RNA and VGAM49 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM42 RNA, VGAM43 RNA, VGAM44 RNA, VGAM45 RNA, VGAM46 RNA, VGAM47 RNA, VGAM48 RNA and VGAM49 RNA, herein schematically represented by VGAM1 RNA through VGAM3 RNA, each of which VGAM RNAs corresponding to VGAM RNA of FIG. 1.

VGAM42 RNA, herein schematically represented by VGAM1 RNA through VGAM3 RNA, binds complementarily to a host target binding site located in an untranslated region of VGAM42 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM42 host target RNA into VGAM42 host target protein, herein schematically represented by VGAM1 HOST TARGET PROTEIN through VGAM3 HOST TARGET PROTEIN, all of FIG. 1.

VGAM43 RNA, herein schematically represented by VGAM1 RNA through VGAM3 RNA, binds complementarily to a host target binding site located in an untranslated region of VGAM43 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM43 host target RNA into VGAM43 host target protein, herein schematically represented by VGAM1 HOST TARGET PROTEIN through VGAM3 HOST TARGET PROTEIN, all of FIG. 1.

VGAM44 RNA, herein schematically represented by VGAM1 RNA through VGAM3 RNA, binds complementarily to a host target binding site located in an untranslated region of VGAM44 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM44 host target RNA into VGAM44 host target protein, herein schematically represented by VGAM1 HOST TARGET PROTEIN through VGAM3 HOST TARGET PROTEIN, all of FIG. 1.

VGAM45 RNA, herein schematically represented by VGAM1 RNA through VGAM3 RNA, binds complementarily to a host target binding site located in an untranslated region of VGAM45 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM45 host target RNA into VGAM45 host target protein, herein schematically represented by VGAM1 HOST TARGET PROTEIN through VGAM3 HOST TARGET PROTEIN, all of FIG. 1.

VGAM46 RNA, herein schematically represented by VGAM1 RNA through VGAM3 RNA, binds complementarily to a host target binding site located in an untranslated region of VGAM46 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM46 host target RNA into VGAM46 host target protein, herein schematically represented by VGAM1 HOST TARGET PROTEIN through VGAM3 HOST TARGET PROTEIN, all of FIG. 1.

VGAM47 RNA, herein schematically represented by VGAM1 RNA through VGAM3 RNA, binds complementarily to a host target binding site located in an untranslated region of VGAM47 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM47 host target RNA into VGAM47 host target protein, herein schematically represented by VGAM1 HOST TARGET PROTEIN through VGAM3 HOST TARGET PROTEIN, all of FIG. 1.

VGAM48 RNA, herein schematically represented by VGAM1 RNA through VGAM3 RNA, binds complementarily to a host target binding site located in an untranslated region of VGAM48 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM48 host target RNA into VGAM48 host target protein, herein schematically represented by VGAM1 HOST TARGET PROTEIN through VGAM3 HOST TARGET PROTEIN, all of FIG. 1.

VGAM49 RNA, herein schematically represented by VGAM1 RNA through VGAM3 RNA, binds complementarily to a host target binding site located in an untranslated region of VGAM49 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM49 host target RNA into VGAM49 host target protein, herein schematically represented by VGAM1 HOST TARGET PROTEIN through VGAM3 HOST TARGET PROTEIN, all of FIG. 1.

It is appreciated that a function of VGR2744 gene, herein designated VGR GENE, is inhibition of expression of host target genes, as part of a novel viral mechanism of attacking a host. Accordingly, utilities of VGR2744 gene include diagnosis, prevention and treatment of viral infection by Invertebrate Iridescent Virus 6. Specific functions, and accordingly utilities, of VGR2744 gene correlate with, and may be deduced from, the identity of the host target genes, which are inhibited by VGAM RNAs comprised in the 'operon-like' cluster of VGR2744 gene: VGAM42 host target protein, VGAM43 host target protein, VGAM44 host target protein, VGAM45 host target protein, VGAM46 host target protein, VGAM47 host target protein, VGAM48 host target protein and VGAM49 host target protein, herein schematically represented by VGAM1 HOST TARGET PROTEIN through VGAM3 HOST TARGET PROTEIN. The function of these host target genes is elaborated hereinabove with reference to VGAM42, VGAM43, VGAM44, VGAM45, VGAM46, VGAM47, VGAM48 and VGAM49. FIG. 9 further provides a conceptual description of novel bioinformatically detected regulatory viral gene, referred to here as Viral Genomic Record 2745(VGR2745) viral gene, which encodes an 'operon-like' cluster of novel viral micro RNA-like genes, each of which in turn modulates expression of at least one host target gene, the function and utility of which at least one host target gene is known in the art.

VGR2745 gene, herein designated VGR GENE, is a novel bioinformatically detected regulatory, non protein coding, RNA viral gene. The method by which VGR2745 gene was detected is described hereinabove with reference to FIGS. 1-9.

VGR2745 gene encodes VGR2745 precursor RNA, herein designated VGR PRECURSOR RNA, an RNA molecule, typically several hundred nucleotides long.

VGR2745 precursor RNA folds spatially, forming VGR2745 folded precursor RNA, herein designated VGR FOLDED PRECURSOR RNA. It is appreciated that VGR2745 folded precursor RNA comprises a plurality of what is known in the art as 'hairpin' structures. These 'hairpin' structures are due to the fact that the nucleotide sequence of VGR2745 precursor RNA comprises a plurality of segments, the first half of each such segment having a nucleotide sequence which is at least a partial inversed-reversed sequence of the second half thereof, as is well known in the art.

VGR2745 folded precursor RNA is naturally processed by cellular enzymatic activity into at least 8 separate VGAM precursor RNAs, VGAM50 precursor RNA, VGAM51 precursor RNA, VGAM52 precursor RNA, VGAM53 precursor RNA, VGAM54 precursor RNA, VGAM55 precursor RNA, VGAM56 precursor RNA and VGAM57 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM50 RNA, VGAM51 RNA, VGAM52 RNA, VGAM53 RNA, VGAM54 RNA, VGAM55 RNA, VGAM56 RNA and VGAM57 RNA, herein schematically represented by VGAM1 RNA through VGAM3 RNA, each of which VGAM RNAs corresponding to VGAM RNA of FIG. 1.

VGAM50 RNA, herein schematically represented by VGAM1 RNA through VGAM3 RNA, binds complementarily to a host target binding site located in an untranslated region of VGAM50 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM50 host target RNA into VGAM50 host target protein, herein schematically represented by VGAM1 HOST TARGET PROTEIN through VGAM3 HOST TARGET PROTEIN, all of FIG. 1.

VGAM51 RNA, herein schematically represented by VGAM1 RNA through VGAM3 RNA, binds complementarily to a host target binding site located in an untranslated region of VGAM51 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM51 host target RNA into VGAM51 host target protein, herein schematically represented by VGAM1 HOST TARGET PROTEIN through VGAM3 HOST TARGET PROTEIN, all of FIG. 1.

VGAM52 RNA, herein schematically represented by VGAM1 RNA through VGAM3 RNA, binds complementarily to a host target binding site located in an untranslated region of VGAM52 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM52 host target RNA into VGAM52 host target protein, herein schematically represented by VGAM1 HOST TARGET PROTEIN through VGAM3 HOST TARGET PROTEIN, all of FIG. 1.

VGAM53 RNA, herein schematically represented by VGAM1 RNA through VGAM3 RNA, binds complementarily to a host target binding site located in an untranslated region of VGAM53 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM53 host target RNA into VGAM53 host target protein, herein schematically represented by VGAM1 HOST TARGET PROTEIN through VGAM3 HOST TARGET PROTEIN, all of FIG. 1.

VGAM54 RNA, herein schematically represented by VGAM1 RNA through VGAM3 RNA, binds complementarily to a host target binding site located in an untranslated region of VGAM54 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM54 host target RNA into VGAM54 host target protein, herein schematically represented by VGAM1 HOST TARGET PROTEIN through VGAM3 HOST TARGET PROTEIN, all of FIG. 1.

VGAM55 RNA, herein schematically represented by VGAM1 RNA through VGAM3 RNA, binds complementarily to a host target binding site located in an untranslated region of VGAM55 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM55 host target RNA into VGAM55 host target protein, herein schematically represented by VGAM1 HOST TARGET PROTEIN through VGAM3 HOST TARGET PROTEIN, all of FIG. 1.

VGAM56 RNA, herein schematically represented by VGAM1 RNA through VGAM3 RNA, binds complementarily to a host target binding site located in an untranslated region of VGAM56 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM56 host target RNA into VGAM56 host target protein, herein schematically represented by VGAM1 HOST TARGET PROTEIN through VGAM3 HOST TARGET PROTEIN, all of FIG. 1.

VGAM57 RNA, herein schematically represented by VGAM1 RNA through VGAM3 RNA, binds complementarily to a host target binding site located in an untranslated region of VGAM57 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM57 host target RNA into VGAM57 host target protein, herein schematically represented by VGAM1 HOST TARGET PROTEIN through VGAM3 HOST TARGET PROTEIN, all of FIG. 1.

It is appreciated that a function of VGR2745 gene, herein designated VGR GENE, is inhibition of expression of host target genes, as part of a novel viral mechanism of attacking a host. Accordingly, utilities of VGR2745 gene include diagnosis, prevention and treatment of viral infection by Invertebrate Iridescent Virus 6. Specific functions, and accordingly utilities, of VGR2745 gene correlate with, and may be deduced from, the identity of the host target genes, which are inhibited by VGAM RNAs comprised in the 'operon-like' cluster of VGR2745 gene: VGAM50 host target protein, VGAM51 host target protein, VGAM52 host target protein, VGAM53 host target protein, VGAM54 host target protein, VGAM55 host target protein, VGAM56 host target protein and VGAM57 host target protein, herein schematically represented by VGAM1 HOST TARGET PROTEIN through VGAM3 HOST TARGET PROTEIN. The function of these host target genes is elaborated hereinabove with reference to VGAM50, VGAM51, VGAM52, VGAM53, VGAM54, VGAM55, VGAM56 and VGAM57. FIG. 9 further provides a conceptual description of novel bioinformatically detected regulatory viral gene, referred to here as Viral Genomic Record 2746(VGR2746) viral gene, which encodes an 'operon-like' cluster of novel viral micro RNA-like genes, each of which in turn modulates expression of at least one host target gene, the function and utility of which at least one host target gene is known in the art.

VGR2746 gene, herein designated VGR GENE, is a novel bioinformatically detected regulatory, non protein coding, RNA viral gene. The method by which VGR2746 gene was detected is described hereinabove with reference to FIGS. 1-9.

VGR2746 gene encodes VGR2746 precursor RNA, herein designated VGR PRECURSOR RNA, an RNA molecule, typically several hundred nucleotides long.

VGR2746 precursor RNA folds spatially, forming VGR2746 folded precursor RNA, herein designated VGR FOLDED PRECURSOR RNA. It is appreciated that VGR2746 folded precursor RNA comprises a plurality of what is known in the art as 'hairpin' structures. These 'hairpin' structures are due to the fact that the nucleotide sequence of VGR2746 precursor RNA comprises a plurality of segments, the first half of each such segment having a nucleotide sequence which is at least a partial inversed-reversed sequence of the second half thereof, as is well known in the art.

VGR2746 folded precursor RNA is naturally processed by cellular enzymatic activity into at least 8 separate VGAM precursor RNAs, VGAM58 precursor RNA, VGAM59 precursor RNA, VGAM60 precursor RNA, VGAM61 precursor RNA, VGAM62 precursor RNA, VGAM63 precursor RNA, VGAM64 precursor RNA and VGAM65 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM58 RNA, VGAM59 RNA, VGAM60 RNA, VGAM61 RNA, VGAM62 RNA, VGAM63 RNA, VGAM64 RNA and VGAM65 RNA, herein schematically represented by VGAM1 RNA through VGAM3 RNA, each of which VGAM RNAs corresponding to VGAM RNA of FIG. 1.

VGAM58 RNA, herein schematically represented by VGAM1 RNA through VGAM3 RNA, binds complementarily to a host target binding site located in an untranslated region of VGAM58 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM58 host target RNA into VGAM58 host target protein, herein schematically represented by VGAM1 HOST TARGET PROTEIN through VGAM3 HOST TARGET PROTEIN, all of FIG. 1.

VGAM59 RNA, herein schematically represented by VGAM1 RNA through VGAM3 RNA, binds complementarily to a host target binding site located in an untranslated region of VGAM59 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM59 host target RNA into VGAM59 host target protein, herein schematically represented by VGAM1 HOST TARGET PROTEIN through VGAM3 HOST TARGET PROTEIN, all of FIG. 1.

VGAM60 RNA, herein schematically represented by VGAM1 RNA through VGAM3 RNA, binds complementarily to a host target binding site located in an untranslated region of VGAM60 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM60 host target RNA into VGAM60 host target protein, herein schematically represented by VGAM1 HOST TARGET PROTEIN through VGAM3 HOST TARGET PROTEIN, all of FIG. 1.

VGAM61 RNA, herein schematically represented by VGAM1 RNA through VGAM3 RNA, binds complementarily to a host target binding site located in an untranslated region of VGAM61 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM61 host target RNA into VGAM61 host target protein, herein schematically represented by VGAM1 HOST TARGET PROTEIN through VGAM3 HOST TARGET PROTEIN, all of FIG. 1.

VGAM62 RNA, herein schematically represented by VGAM1 RNA through VGAM3 RNA, binds complementarily to a host target binding site located in an untranslated region of VGAM62 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM62 host target RNA into VGAM62 host target protein, herein schematically represented by VGAM1 HOST TARGET PROTEIN through VGAM3 HOST TARGET PROTEIN, all of FIG. 1.

VGAM63 RNA, herein schematically represented by VGAM1 RNA through VGAM3 RNA, binds complementarily to a host target binding site located in an untranslated region of VGAM63 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM63 host target RNA into VGAM63 host target protein, herein schematically represented by VGAM1 HOST TARGET PROTEIN through VGAM3 HOST TARGET PROTEIN, all of FIG. 1.

VGAM64 RNA, herein schematically represented by VGAM1 RNA through VGAM3 RNA, binds complementarily to a host target binding site located in an untranslated region of VGAM64 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM64 host target RNA into VGAM64 host target protein, herein schematically represented by VGAM1 HOST TARGET PROTEIN through VGAM3 HOST TARGET PROTEIN, all of FIG. 1.

VGAM65 RNA, herein schematically represented by VGAM1 RNA through VGAM3 RNA, binds complementarily to a host target binding site located in an untranslated region of VGAM65 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM65 host target RNA into VGAM65 host target protein, herein schematically represented by VGAM1 HOST TARGET PROTEIN through VGAM3 HOST TARGET PROTEIN, all of FIG. 1.

It is appreciated that a function of VGR2746 gene, herein designated VGR GENE, is inhibition of expression of host target genes, as part of a novel viral mechanism of attacking a host. Accordingly, utilities of VGR2746 gene include diagnosis, prevention and treatment of viral infection by Invertebrate Iridescent Virus 6. Specific functions, and accordingly utilities, of VGR2746 gene correlate with, and may be deduced from, the identity of the host target genes, which are inhibited by VGAM RNAs comprised in the 'operon-like' cluster of VGR2746 gene: VGAM58 host target protein, VGAM59 host target protein, VGAM60 host target protein, VGAM61 host target protein, VGAM62 host target protein, VGAM63 host target protein, VGAM64 host target protein and VGAM65 host target protein, herein schematically represented by VGAM1 HOST TARGET PROTEIN through VGAM3 HOST TARGET PROTEIN. The function of these host target genes is elaborated hereinabove with reference to VGAM58, VGAM59, VGAM60, VGAM61, VGAM62, VGAM63, VGAM64 and VGAM65. FIG. 9 further provides a conceptual description of novel bioinformatically detected regulatory viral gene, referred to here as Viral Genomic Record 2747(VGR2747) viral gene, which encodes an 'operon-like' cluster of novel viral micro RNA-like genes, each of which in turn modulates expression of at least one host target gene, the function and utility of which at least one host target gene is known in the art.

VGR2747 gene, herein designated VGR GENE, is a novel bioinformatically detected regulatory, non protein coding, RNA viral gene. The method by which VGR2747 gene was detected is described hereinabove with reference to FIGS. 1-9.

VGR2747 gene encodes VGR2747 precursor RNA, herein designated VGR PRECURSOR RNA, an RNA molecule, typically several hundred nucleotides long.

VGR2747 precursor RNA folds spatially, forming VGR2747 folded precursor RNA, herein designated VGR FOLDED PRECURSOR RNA. It is appreciated that VGR2747 folded precursor RNA comprises a plurality of what is known in the art as 'hairpin' structures. These 'hairpin' structures are due to the fact that the nucleotide sequence of VGR2747 precursor RNA comprises a plurality of segments, the first half of each such segment having a nucleotide sequence which is at least a partial inversed-reversed sequence of the second half thereof, as is well known in the art.

VGR2747 folded precursor RNA is naturally processed by cellular enzymatic activity into at least 8 separate VGAM precursor RNAs, VGAM66 precursor RNA, VGAM67 precursor RNA, VGAM68 precursor RNA, VGAM69 precursor RNA, VGAM70 precursor RNA, VGAM71 precursor RNA, VGAM72 precursor RNA and VGAM73 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM66 RNA, VGAM67 RNA, VGAM68 RNA, VGAM69 RNA, VGAM70 RNA, VGAM71 RNA, VGAM72 RNA and VGAM73 RNA, herein schematically represented by VGAM1 RNA through VGAM3 RNA, each of which VGAM RNAs corresponding to VGAM RNA of FIG. 1.

VGAM66 RNA, herein schematically represented by VGAM1 RNA through VGAM3 RNA, binds complementarily to a host target binding site located in an untranslated region of VGAM66 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM66 host target RNA into VGAM66 host target protein, herein schematically represented by VGAM1 HOST TARGET PROTEIN through VGAM3 HOST TARGET PROTEIN, all of FIG. 1.

VGAM67 RNA, herein schematically represented by VGAM1 RNA through VGAM3 RNA, binds complementarily to a host target binding site located in an untranslated region of VGAM67 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM67 host target RNA into VGAM67 host target protein, herein schematically represented by VGAM1 HOST TARGET PROTEIN through VGAM3 HOST TARGET PROTEIN, all of FIG. 1.

VGAM68 RNA, herein schematically represented by VGAM1 RNA through VGAM3 RNA, binds complementarily to a host target binding site located in an untranslated region of VGAM68 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM68 host target RNA into VGAM68 host target protein, herein schematically represented by VGAM1 HOST TARGET PROTEIN through VGAM3 HOST TARGET PROTEIN, all of FIG. 1.

VGAM69 RNA, herein schematically represented by VGAM1 RNA through VGAM3 RNA, binds complementarily to a host target binding site located in an untranslated region of VGAM69 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM69 host target RNA into VGAM69 host target protein, herein schematically represented by VGAM1 HOST TARGET PROTEIN through VGAM3 HOST TARGET PROTEIN, all of FIG. 1.

VGAM70 RNA, herein schematically represented by VGAM1 RNA through VGAM3 RNA, binds complementarily to a host target binding site located in an untranslated region of VGAM70 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM70 host target RNA into VGAM70 host target protein, herein schematically represented by VGAM1 HOST TARGET PROTEIN through VGAM3 HOST TARGET PROTEIN, all of FIG. 1.

VGAM71 RNA, herein schematically represented by VGAM1 RNA through VGAM3 RNA, binds complementarily to a host target binding site located in an untranslated region of VGAM71 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM71 host target RNA into VGAM71 host target protein, herein schematically represented by VGAM1 HOST TARGET PROTEIN through VGAM3 HOST TARGET PROTEIN, all of FIG. 1.

VGAM72 RNA, herein schematically represented by VGAM1 RNA through VGAM3 RNA, binds complementarily to a host target binding site located in an untranslated region of VGAM72 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM72 host target RNA into VGAM72 host target protein, herein schematically represented by VGAM1 HOST TARGET PROTEIN through VGAM3 HOST TARGET PROTEIN, all of FIG. 1.

VGAM73 RNA, herein schematically represented by VGAM1 RNA through VGAM3 RNA, binds complementarily to a host target binding site located in an untranslated region of VGAM73 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM73 host target RNA into VGAM73 host target protein, herein schematically represented by VGAM1 HOST TARGET PROTEIN through VGAM3 HOST TARGET PROTEIN, all of FIG. 1.

It is appreciated that a function of VGR2747 gene, herein designated VGR GENE, is inhibition of expression of host target genes, as part of a novel viral mechanism of attacking a host. Accordingly, utilities of VGR2747 gene include diagnosis, prevention and treatment of viral infection by Invertebrate Iridescent Virus 6. Specific functions, and accordingly utilities, of VGR2747 gene correlate with, and may be deduced from, the identity of the host target genes, which are inhibited by VGAM RNAs comprised in the 'operon-like' cluster of VGR2747 gene: VGAM66 host target protein, VGAM67 host target protein, VGAM68 host target protein, VGAM69 host target protein, VGAM70 host target protein, VGAM71 host target protein, VGAM72 host target protein and VGAM73 host target protein, herein schematically represented by VGAM1 HOST TARGET PROTEIN through VGAM3 HOST TARGET PROTEIN. The function of these host target genes is elaborated hereinabove with reference to VGAM66, VGAM67, VGAM68, VGAM69, VGAM70, VGAM71, VGAM72 and VGAM73. FIG. 9 further provides a conceptual description of novel bioinformatically detected regulatory viral gene, referred to here as Viral Genomic Record 2748(VGR2748) viral gene, which encodes an 'operon-like' cluster of novel viral micro RNA-like genes, each of which in turn modulates expression of at least one host target gene, the function and utility of which at least one host target gene is known in the art.

VGR2748 gene, herein designated VGR GENE, is a novel bioinformatically detected regulatory, non protein coding, RNA viral gene. The method by which VGR2748 gene was detected is described hereinabove with reference to FIGS. 1-9.

VGR2748 gene encodes VGR2748 precursor RNA, herein designated VGR PRECURSOR RNA, an RNA molecule, typically several hundred nucleotides long.

VGR2748 precursor RNA folds spatially, forming VGR2748 folded precursor RNA, herein designated VGR FOLDED PRECURSOR RNA. It is appreciated that VGR2748 folded precursor RNA comprises a plurality of what is known in the art as 'hairpin' structures. These 'hairpin' structures are due to the fact that the nucleotide sequence of VGR2748 precursor RNA comprises a plurality of segments, the first half of each such segment having a nucleotide sequence which is at least a partial inversed-reversed sequence of the second half thereof, as is well known in the art.

VGR2748 folded precursor RNA is naturally processed by cellular enzymatic activity into at least 2 separate VGAM precursor RNAs, VGAM76 precursor RNA and VGAM77 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM76 RNA and VGAM77 RNA, herein schematically represented by VGAM1 RNA through VGAM3 RNA, each of which VGAM RNAs corresponding to VGAM RNA of FIG. 1.

VGAM76 RNA, herein schematically represented by VGAM1 RNA through VGAM3 RNA, binds complementarily to a host target binding site located in an untranslated region of VGAM76 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM76 host target RNA into VGAM76 host target protein, herein schematically represented by VGAM1 HOST TARGET PROTEIN through VGAM3 HOST TARGET PROTEIN, all of FIG. 1.

VGAM77 RNA, herein schematically represented by VGAM1 RNA through VGAM3 RNA, binds complementarily to a host target binding site located in an untranslated region of VGAM77 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM77 host target RNA into VGAM77 host target protein, herein schematically represented by VGAM1 HOST TARGET PROTEIN through VGAM3 HOST TARGET PROTEIN, all of FIG. 1.

It is appreciated that a function of VGR2748 gene, herein designated VGR GENE, is inhibition of expression of host target genes, as part of a novel viral mechanism of attacking a host. Accordingly, utilities of VGR2748 gene include diagnosis, prevention and treatment of viral infection by Murine Adenovirus A. Specific functions, and accordingly utilities, of VGR2748 gene correlate with, and may be deduced from, the identity of the host target genes, which are inhibited by VGAM RNAs comprised in the 'operon-like' cluster of VGR2748 gene: VGAM76 host target protein and VGAM77 host target protein, herein schematically represented by VGAM1 HOST TARGET PROTEIN through VGAM3 HOST TARGET PROTEIN. The function of these host target genes is elaborated hereinabove with reference to VGAM76 and VGAM77. FIG. 9 further provides a conceptual description of novel bioinformatically detected regulatory viral gene, referred to here as Viral Genomic Record 2749(VGR2749) viral gene, which encodes an 'operon-like' cluster of novel viral micro RNA-like genes, each of which in turn modulates expression of at least one host target gene, the function and utility of which at least one host target gene is known in the art.

VGR2749 gene, herein designated VGR GENE, is a novel bioinformatically detected regulatory, non protein coding, RNA viral gene. The method by which VGR2749 gene was detected is described hereinabove with reference to FIGS. 1-9.

VGR2749 gene encodes VGR2749 precursor RNA, herein designated VGR PRECURSOR RNA, an RNA molecule, typically several hundred nucleotides long.

VGR2749 precursor RNA folds spatially, forming VGR2749 folded precursor RNA, herein designated VGR FOLDED PRECURSOR RNA. It is appreciated that VGR2749 folded precursor RNA comprises a plurality of what is known in the art as 'hairpin' structures. These 'hairpin' structures are due to the fact that the nucleotide sequence of VGR2749 precursor RNA comprises a plurality of segments, the first half of each such segment having a nucleotide sequence which is at least a partial inversed-reversed sequence of the second half thereof, as is well known in the art.

VGR2749 folded precursor RNA is naturally processed by cellular enzymatic activity into at least 8 separate VGAM precursor RNAs, VGAM78 precursor RNA, VGAM79 precursor RNA, VGAM80 precursor RNA, VGAM81 precursor RNA, VGAM82 precursor RNA, VGAM83 precursor RNA, VGAM84 precursor RNA and VGAM85 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM78 RNA, VGAM79 RNA, VGAM80 RNA, VGAM81 RNA, VGAM82 RNA, VGAM83 RNA, VGAM84 RNA and VGAM85 RNA, herein schematically represented by VGAM1 RNA through VGAM3 RNA, each of which VGAM RNAs corresponding to VGAM RNA of FIG. 1.

VGAM78 RNA, herein schematically represented by VGAM1 RNA through VGAM3 RNA, binds complementarily to a host target binding site located in an untranslated region of VGAM78 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM78 host target RNA into VGAM78 host target protein, herein schematically represented by VGAM1 HOST TARGET PROTEIN through VGAM3 HOST TARGET PROTEIN, all of FIG. 1.

VGAM79 RNA, herein schematically represented by VGAM1 RNA through VGAM3 RNA, binds complementarily to a host target binding site located in an untranslated region of VGAM79 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM79 host target RNA into VGAM79 host target protein, herein schematically represented by VGAM1 HOST TARGET PROTEIN through VGAM3 HOST TARGET PROTEIN, all of FIG. 1.

VGAM80 RNA, herein schematically represented by VGAM1 RNA through VGAM3 RNA, binds complementarily to a host target binding site located in an untranslated region of VGAM80 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM80 host target RNA into VGAM80 host target protein, herein schematically represented by VGAM1 HOST TARGET PROTEIN through VGAM3 HOST TARGET PROTEIN, all of FIG. 1.

VGAM81 RNA, herein schematically represented by VGAM1 RNA through VGAM3 RNA, binds complementarily to a host target binding site located in an untranslated region of VGAM81 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM81 host target RNA into VGAM81 host target protein, herein schematically represented by VGAM1 HOST TARGET PROTEIN through VGAM3 HOST TARGET PROTEIN, all of FIG. 1.

VGAM82 RNA, herein schematically represented by VGAM1 RNA through VGAM3 RNA, binds complementarily to a host target binding site located in an untranslated region of VGAM82 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM82 host target RNA into VGAM82 host target protein, herein schematically represented by VGAM1 HOST TARGET PROTEIN through VGAM3 HOST TARGET PROTEIN, all of FIG. 1.

VGAM83 RNA, herein schematically represented by VGAM1 RNA through VGAM3 RNA, binds complementarily to a host target binding site located in an untranslated region of VGAM83 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM83 host target RNA into VGAM83 host target protein, herein schematically represented by VGAM1 HOST TARGET PROTEIN through VGAM3 HOST TARGET PROTEIN, all of FIG. 1.

VGAM84 RNA, herein schematically represented by VGAM1 RNA through VGAM3 RNA, binds complementarily to a host target binding site located in an untranslated region of VGAM84 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM84 host target RNA into VGAM84 host target protein, herein schematically represented by VGAM1 HOST TARGET PROTEIN through VGAM3 HOST TARGET PROTEIN, all of FIG. 1.

VGAM85 RNA, herein schematically represented by VGAM1 RNA through VGAM3 RNA, binds complementarily to a host target binding site located in an untranslated region of VGAM85 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM85 host target RNA into VGAM85 host target protein, herein schematically represented by VGAM1 HOST TARGET PROTEIN through VGAM3 HOST TARGET PROTEIN, all of FIG. 1.

It is appreciated that a function of VGR2749 gene, herein designated VGR GENE, is inhibition of expression of host target genes, as part of a novel viral mechanism of attacking a host. Accordingly, utilities of VGR2749 gene include diagnosis, prevention and treatment of viral infection by Plutella Xylostella Granulovirus. Specific functions, and accordingly utilities, of VGR2749 gene correlate with, and may be deduced from, the identity of the host target genes, which are inhibited by VGAM RNAs comprised in the 'operon-like' cluster of VGR2749 gene: VGAM78 host target protein, VGAM79 host target protein, VGAM80 host target protein, VGAM81 host target protein, VGAM82 host target protein, VGAM83 host target protein, VGAM84 host target protein and VGAM85 host target protein, herein schematically represented by VGAM1 HOST TARGET PROTEIN through VGAM3 HOST TARGET PROTEIN. The function of these host target genes is elaborated hereinabove with reference to VGAM78, VGAM79, VGAM80, VGAM81, VGAM82, VGAM83, VGAM84 and VGAM85. FIG. 9 further provides a conceptual description of novel bioinformatically detected regulatory viral gene, referred to here as Viral Genomic Record 2750(VGR2750) viral gene, which encodes an 'operon-like' cluster of novel viral micro RNA-like genes, each of which in turn modulates expression of at least one host target gene, the function and utility of which at least one host target gene is known in the art.

VGR2750 gene, herein designated VGR GENE, is a novel bioinformatically detected regulatory, non protein coding, RNA viral gene. The method by which VGR2750 gene was detected is described hereinabove with reference to FIGS. 1-9.

VGR2750 gene encodes VGR2750 precursor RNA, herein designated VGR PRECURSOR RNA, an RNA molecule, typically several hundred nucleotides long.

VGR2750 precursor RNA folds spatially, forming VGR2750 folded precursor RNA, herein designated VGR FOLDED PRECURSOR RNA. It is appreciated that VGR2750 folded precursor RNA comprises a plurality of what is known in the art as 'hairpin' structures. These 'hairpin' structures are due to the fact that the nucleotide sequence of VGR2750 precursor RNA comprises a plurality of segments, the first half of each such segment having a nucleotide sequence which is at least a partial inversed-reversed sequence of the second half thereof, as is well known in the art.

VGR2750 folded precursor RNA is naturally processed by cellular enzymatic activity into at least 8 separate VGAM precursor RNAs, VGAM86 precursor RNA, VGAM87 precursor RNA, VGAM88 precursor RNA, VGAM89 precursor RNA, VGAM90 precursor RNA, VGAM91 precursor RNA, VGAM92 precursor RNA and VGAM93 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM86 RNA, VGAM87 RNA, VGAM88 RNA, VGAM89 RNA, VGAM90 RNA, VGAM91 RNA, VGAM92 RNA and VGAM93 RNA, herein schematically represented by VGAM1 RNA through VGAM3 RNA, each of which VGAM RNAs corresponding to VGAM RNA of FIG. 1.

VGAM86 RNA, herein schematically represented by VGAM1 RNA through VGAM3 RNA, binds complementarily to a host target binding site located in an untranslated region of VGAM86 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM86 host target RNA into VGAM86 host target protein, herein schematically represented by VGAM1 HOST TARGET PROTEIN through VGAM3 HOST TARGET PROTEIN, all of FIG. 1.

VGAM87 RNA, herein schematically represented by VGAM1 RNA through VGAM3 RNA, binds complementarily to a host target binding site located in an untranslated region of VGAM87 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM87 host target RNA into VGAM87 host target protein, herein schematically represented by VGAM1 HOST TARGET PROTEIN through VGAM3 HOST TARGET PROTEIN, all of FIG. 1.

VGAM88 RNA, herein schematically represented by VGAM1 RNA through VGAM3 RNA, binds complementarily to a host target binding site located in an untranslated region of VGAM88 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM88 host target RNA into VGAM88 host target protein, herein schematically represented by VGAM1 HOST TARGET PROTEIN through VGAM3 HOST TARGET PROTEIN, all of FIG. 1.

VGAM89 RNA, herein schematically represented by VGAM1 RNA through VGAM3 RNA, binds complementarily to a host target binding site located in an untranslated region of VGAM89 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM89 host target RNA into VGAM89 host target protein, herein schematically represented by VGAM1 HOST TARGET PROTEIN through VGAM3 HOST TARGET PROTEIN, all of FIG. 1.

VGAM90 RNA, herein schematically represented by VGAM1 RNA through VGAM3 RNA, binds complementarily to a host target binding site located in an untranslated region of VGAM90 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM90 host target RNA into VGAM90 host target protein, herein schematically represented by VGAM1 HOST TARGET PROTEIN through VGAM3 HOST TARGET PROTEIN, all of FIG. 1.

VGAM91 RNA, herein schematically represented by VGAM1 RNA through VGAM3 RNA, binds complementarily to a host target binding site located in an untranslated region of VGAM91 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM91 host target RNA into VGAM91 host target protein, herein schematically represented by VGAM1 HOST TARGET PROTEIN through VGAM3 HOST TARGET PROTEIN, all of FIG. 1.

VGAM92 RNA, herein schematically represented by VGAM1 RNA through VGAM3 RNA, binds complementarily to a host target binding site located in an untranslated region of VGAM92 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM92 host target RNA into VGAM92 host target protein, herein schematically represented by VGAM1 HOST TARGET PROTEIN through VGAM3 HOST TARGET PROTEIN, all of FIG. 1.

VGAM93 RNA, herein schematically represented by VGAM1 RNA through VGAM3 RNA, binds complementarily to a host target binding site located in an untranslated region of VGAM93 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM93 host target RNA into VGAM93 host target protein, herein schematically represented by VGAM1 HOST TARGET PROTEIN through VGAM3 HOST TARGET PROTEIN, all of FIG. 1.

It is appreciated that a function of VGR2750 gene, herein designated VGR GENE, is inhibition of expression of host target genes, as part of a novel viral mechanism of attacking a host. Accordingly, utilities of VGR2750 gene include diagnosis, prevention and treatment of viral infection by Plutella Xylostella Granulovirus. Specific functions, and accordingly utilities, of VGR2750 gene correlate with, and may be deduced from, the identity of the host target genes, which are inhibited by VGAM RNAs comprised in the 'operon-like' cluster of VGR2750 gene: VGAM86 host target protein, VGAM87 host target protein, VGAM88 host target protein, VGAM89 host target protein, VGAM90 host target protein, VGAM91 host target protein, VGAM92 host target protein and VGAM93 host target protein, herein schematically represented by VGAM1 HOST TARGET PROTEIN through VGAM3 HOST TARGET PROTEIN. The function of these host target genes is elaborated hereinabove with reference to VGAM86, VGAM87, VGAM88, VGAM89, VGAM90, VGAM91, VGAM92 and VGAM93. FIG. 9 further provides a conceptual description of novel bioinformatically detected regulatory viral gene, referred to here as Viral Genomic Record 2751(VGR2751) viral gene, which encodes an 'operon-like' cluster of novel viral micro RNA-like genes, each of which in turn modulates expression of at least one host target gene, the function and utility of which at least one host target gene is known in the art.

VGR2751 gene, herein designated VGR GENE, is a novel bioinformatically detected regulatory, non protein coding, RNA viral gene. The method by which VGR2751 gene was detected is described hereinabove with reference to FIGS. 1-9.

VGR2751 gene encodes VGR2751 precursor RNA, herein designated VGR PRECURSOR RNA, an RNA molecule, typically several hundred nucleotides long.

VGR2751 precursor RNA folds spatially, forming VGR2751 folded precursor RNA, herein designated VGR FOLDED PRECURSOR RNA. It is appreciated that VGR2751 folded precursor RNA comprises a plurality of what is known in the art as 'hairpin' structures. These 'hairpin' structures are due to the fact that the nucleotide sequence of VGR2751 precursor RNA comprises a plurality of segments, the first half of each such segment having a nucleotide sequence which is at least a partial inversed-reversed sequence of the second half thereof, as is well known in the art.

VGR2751 folded precursor RNA is naturally processed by cellular enzymatic activity into at least 8 separate VGAM precursor RNAs, VGAM94 precursor RNA, VGAM95 precursor RNA, VGAM96 precursor RNA, VGAM97 precursor RNA, VGAM98 precursor RNA, VGAM99 precursor RNA, VGAM100 precursor RNA and VGAM101 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM94 RNA, VGAM95 RNA, VGAM96 RNA, VGAM97 RNA, VGAM98 RNA, VGAM99 RNA, VGAM100 RNA and VGAM101 RNA, herein schematically represented by VGAM1 RNA through VGAM3 RNA, each of which VGAM RNAs corresponding to VGAM RNA of FIG. 1.

VGAM94 RNA, herein schematically represented by VGAM1 RNA through VGAM3 RNA, binds complementarily to a host target binding site located in an untranslated region of VGAM94 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM94 host target RNA into VGAM94 host target protein, herein schematically represented by VGAM1 HOST TARGET PROTEIN through VGAM3 HOST TARGET PROTEIN, all of FIG. 1.

VGAM95 RNA, herein schematically represented by VGAM1 RNA through VGAM3 RNA, binds complementarily to a host target binding site located in an untranslated region of VGAM95 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM95 host target RNA into VGAM95 host target protein, herein schematically represented by VGAM1 HOST TARGET PROTEIN through VGAM3 HOST TARGET PROTEIN, all of FIG. 1.

VGAM96 RNA, herein schematically represented by VGAM1 RNA through VGAM3 RNA, binds complementarily to a host target binding site located in an untranslated region of VGAM96 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM96 host target RNA into VGAM96 host target protein, herein schematically represented by VGAM1 HOST TARGET PROTEIN through VGAM3 HOST TARGET PROTEIN, all of FIG. 1.

VGAM97 RNA, herein schematically represented by VGAM1 RNA through VGAM3 RNA, binds complementarily to a host target binding site located in an untranslated region of VGAM97 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM97 host target RNA into VGAM97 host target protein, herein schematically represented by VGAM1 HOST TARGET PROTEIN through VGAM3 HOST TARGET PROTEIN, all of FIG. 1.

VGAM98 RNA, herein schematically represented by VGAM1 RNA through VGAM3 RNA, binds complementarily to a host target binding site located in an untranslated region of VGAM98 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM98 host target RNA into VGAM98 host target protein, herein schematically represented by VGAM1 HOST TARGET PROTEIN through VGAM3 HOST TARGET PROTEIN, all of FIG. 1.

VGAM99 RNA, herein schematically represented by VGAM1 RNA through VGAM3 RNA, binds complementarily to a host target binding site located in an untranslated region of VGAM99 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM99 host target RNA into VGAM99 host target protein, herein schematically represented by VGAM1 HOST TARGET PROTEIN through VGAM3 HOST TARGET PROTEIN, all of FIG. 1.

VGAM100 RNA, herein schematically represented by VGAM1 RNA through VGAM3 RNA, binds complementarily to a host target binding site located in an untranslated region of VGAM100 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM100 host target RNA into VGAM100 host target protein, herein schematically represented by VGAM1 HOST TARGET PROTEIN through VGAM3 HOST TARGET PROTEIN, all of FIG. 1.

VGAM101 RNA, herein schematically represented by VGAM1 RNA through VGAM3 RNA, binds complementarily to a host target binding site located in an untranslated region of VGAM101 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM101 host target RNA into VGAM101 host target protein, herein schematically represented by VGAM1 HOST TARGET PROTEIN through VGAM3 HOST TARGET PROTEIN, all of FIG. 1.

It is appreciated that a function of VGR2751 gene, herein designated VGR GENE, is inhibition of expression of host target genes, as part of a novel viral mechanism of attacking a host. Accordingly, utilities of VGR2751 gene include diagnosis, prevention and treatment of viral infection by Plutella Xylostella Granulovirus. Specific functions, and accordingly utilities, of VGR2751 gene correlate with, and may be deduced from, the identity of the host target genes, which are inhibited by VGAM RNAs comprised in the 'operon-like' cluster of VGR2751 gene: VGAM94 host target protein, VGAM95 host target protein, VGAM96 host target protein, VGAM97 host target protein, VGAM98 host target protein, VGAM99 host target protein, VGAM100 host target protein and VGAM101 host target protein, herein schematically represented by VGAM1 HOST TARGET PROTEIN through VGAM3 HOST TARGET PROTEIN. The function of these host target genes is elaborated hereinabove with reference to VGAM94, VGAM95, VGAM96, VGAM97, VGAM98, VGAM99, VGAM100 and VGAM101. FIG. 9 further provides a conceptual description of novel bioinformatically detected regulatory viral gene, referred to here as Viral Genomic Record 2752(VGR2752) viral gene, which encodes an 'operon-like' cluster of novel viral micro RNA-like genes, each of which in turn modulates expression of at least one host target gene, the function and utility of which at least one host target gene is known in the art.

VGR2752 gene, herein designated VGR GENE, is a novel bioinformatically detected regulatory, non protein coding, RNA viral gene. The method by which VGR2752 gene was detected is described hereinabove with reference to FIGS. 1-9.

VGR2752 gene encodes VGR2752 precursor RNA, herein designated VGR PRECURSOR RNA, an RNA molecule, typically several hundred nucleotides long.

VGR2752 precursor RNA folds spatially, forming VGR2752 folded precursor RNA, herein designated VGR FOLDED PRECURSOR RNA. It is appreciated that VGR2752 folded precursor RNA comprises a plurality of what is known in the art as 'hairpin' structures. These 'hairpin' structures are due to the fact that the nucleotide sequence of VGR2752 precursor RNA comprises a plurality of segments, the first half of each such segment having a nucleotide sequence which is at least a partial inversed-reversed sequence of the second half thereof, as is well known in the art.

VGR2752 folded precursor RNA is naturally processed by cellular enzymatic activity into at least 4 separate VGAM precursor RNAs, VGAM102 precursor RNA, VGAM103 precursor RNA, VGAM104 precursor RNA and VGAM105 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM102 RNA, VGAM103 RNA, VGAM104 RNA and VGAM105 RNA, herein schematically represented by VGAM1 RNA through VGAM3 RNA, each of which VGAM RNAs corresponding to VGAM RNA of FIG. 1.

VGAM102 RNA, herein schematically represented by VGAM1 RNA through VGAM3 RNA, binds complementarily to a host target binding site located in an untranslated region of VGAM102 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM102 host target RNA into VGAM102 host target protein, herein schematically represented by VGAM1 HOST TARGET PROTEIN through VGAM3 HOST TARGET PROTEIN, all of FIG. 1.

VGAM103 RNA, herein schematically represented by VGAM1 RNA through VGAM3 RNA, binds complementarily to a host target binding site located in an untranslated region of VGAM103 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM103 host target RNA into VGAM103 host target protein, herein schematically represented by VGAM1 HOST TARGET PROTEIN through VGAM3 HOST TARGET PROTEIN, all of FIG. 1.

VGAM104 RNA, herein schematically represented by VGAM1 RNA through VGAM3 RNA, binds complementarily to a host target binding site located in an untranslated region of VGAM104 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM104 host target RNA into VGAM104 host target protein, herein schematically represented by VGAM1 HOST TARGET PROTEIN through VGAM3 HOST TARGET PROTEIN, all of FIG. 1.

VGAM105 RNA, herein schematically represented by VGAM1 RNA through VGAM3 RNA, binds complementarily to a host target binding site located in an untranslated region of VGAM105 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM105 host target RNA into VGAM105 host target protein, herein schematically represented by VGAM1 HOST TARGET PROTEIN through VGAM3 HOST TARGET PROTEIN, all of FIG. 1.

It is appreciated that a function of VGR2752 gene, herein designated VGR GENE, is inhibition of expression of host target genes, as part of a novel viral mechanism of attacking a host. Accordingly, utilities of VGR2752 gene include diagnosis, prevention and treatment of viral infection by Plutella Xylostella Granulovirus. Specific functions, and accordingly utilities, of VGR2752 gene correlate with, and may be deduced from, the identity of the host target genes, which are inhibited by VGAM RNAs comprised in the 'operon-like' cluster of VGR2752 gene: VGAM102 host target protein, VGAM103 host target protein, VGAM104 host target protein and VGAM105 host target protein, herein schematically represented by VGAM1 HOST TARGET PROTEIN through VGAM3 HOST TARGET PROTEIN. The function of these host target genes is elaborated hereinabove with reference to VGAM102, VGAM103, VGAM104 and VGAM105. FIG. 9 further provides a conceptual description of novel bioinformatically detected regulatory viral gene, referred to here as Viral Genomic Record 2753(VGR2753) viral gene, which encodes an 'operon-like' cluster of novel viral micro RNA-like genes, each of which in turn modulates expression of at least one host target gene, the function and utility of which at least one host target gene is known in the art.

VGR2753 gene, herein designated VGR GENE, is a novel bioinformatically detected regulatory, non protein coding, RNA viral gene. The method by which VGR2753 gene was detected is described hereinabove with reference to FIGS. 1-9.

VGR2753 gene encodes VGR2753 precursor RNA, herein designated VGR PRECURSOR RNA, an RNA molecule, typically several hundred nucleotides long.

VGR2753 precursor RNA folds spatially, forming VGR2753 folded precursor RNA, herein designated VGR FOLDED PRECURSOR RNA. It is appreciated that VGR2753 folded precursor RNA comprises a plurality of what is known in the art as 'hairpin' structures. These 'hairpin' structures are due to the fact that the nucleotide sequence of VGR2753 precursor RNA comprises a plurality of segments, the first half of each such segment having a nucleotide sequence which is at least a partial inversed-reversed sequence of the second half thereof, as is well known in the art.

VGR2753 folded precursor RNA is naturally processed by cellular enzymatic activity into at least 4 separate VGAM precursor RNAs, VGAM106 precursor RNA, VGAM107 precursor RNA, VGAM108 precursor RNA and VGAM109 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM106 RNA, VGAM107 RNA, VGAM108 RNA and VGAM109 RNA, herein schematically represented by VGAM1 RNA through VGAM3 RNA, each of which VGAM RNAs corresponding to VGAM RNA of FIG. 1.

VGAM106 RNA, herein schematically represented by VGAM1 RNA through VGAM3 RNA, binds complementarily to a host target binding site located in an untranslated region of VGAM106 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM106 host target RNA into VGAM106 host target protein, herein schematically represented by VGAM1 HOST TARGET PROTEIN through VGAM3 HOST TARGET PROTEIN, all of FIG. 1.

VGAM107 RNA, herein schematically represented by VGAM1 RNA through VGAM3 RNA, binds complementarily to a host target binding site located in an untranslated region of VGAM107 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM107 host target RNA into VGAM107 host target protein, herein schematically represented by VGAM1 HOST TARGET PROTEIN through VGAM3 HOST TARGET PROTEIN, all of FIG. 1.

VGAM108 RNA, herein schematically represented by VGAM1 RNA through VGAM3 RNA, binds complementarily to a host target binding site located in an untranslated region of VGAM108 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM108 host target RNA into VGAM108 host target protein, herein schematically represented by VGAM1 HOST TARGET PROTEIN through VGAM3 HOST TARGET PROTEIN, all of FIG. 1.

VGAM109 RNA, herein schematically represented by VGAM1 RNA through VGAM3 RNA, binds complementarily to a host target binding site located in an untranslated region of VGAM109 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM109 host target RNA into VGAM109 host target protein, herein schematically represented by VGAM1 HOST TARGET PROTEIN through VGAM3 HOST TARGET PROTEIN, all of FIG. 1.

It is appreciated that a function of VGR2753 gene, herein designated VGR GENE, is inhibition of expression of host target genes, as part of a novel viral mechanism of attacking a host. Accordingly, utilities of VGR2753 gene include diagnosis, prevention and treatment of viral infection by Saimiriine Herpesvirus 2. Specific functions, and accordingly utilities, of VGR2753 gene correlate with, and may be deduced from, the identity of the host target genes, which are inhibited by VGAM RNAs comprised in the 'operon-like' cluster of VGR2753 gene: VGAM106 host target protein, VGAM107 host target protein, VGAM108 host target protein and VGAM109 host target protein, herein schematically represented by VGAM1 HOST TARGET PROTEIN through VGAM3 HOST TARGET PROTEIN. The function of these host target genes is elaborated hereinabove with reference to VGAM106, VGAM107, VGAM108 and VGAM109. FIG. 9 further provides a conceptual description of novel bioinformatically detected regulatory viral gene, referred to here as Viral Genomic Record 2754(VGR2754) viral gene, which encodes an 'operon-like' cluster of novel viral micro RNA-like genes, each of which in turn modulates expression of at least one host target gene, the function and utility of which at least one host target gene is known in the art.

VGR2754 gene, herein designated VGR GENE, is a novel bioinformatically detected regulatory, non protein coding, RNA viral gene. The method by which VGR2754 gene was detected is described hereinabove with reference to FIGS. 1-9.

VGR2754 gene encodes VGR2754 precursor RNA, herein designated VGR PRECURSOR RNA, an RNA molecule, typically several hundred nucleotides long.

VGR2754 precursor RNA folds spatially, forming VGR2754 folded precursor RNA, herein designated VGR FOLDED PRECURSOR RNA. It is appreciated that VGR2754 folded precursor RNA comprises a plurality of what is known in the art as 'hairpin' structures. These 'hairpin' structures are due to the fact that the nucleotide sequence of VGR2754 precursor RNA comprises a plurality of segments, the first half of each such segment having a nucleotide sequence which is at least a partial inversed-reversed sequence of the second half thereof, as is well known in the art.

VGR2754 folded precursor RNA is naturally processed by cellular enzymatic activity into at least 8 separate VGAM precursor RNAs, VGAM110 precursor RNA, VGAM111 precursor RNA, VGAM112 precursor RNA, VGAM113 precursor RNA, VGAM114 precursor RNA, VGAM115 precursor RNA, VGAM116 precursor RNA and VGAM117 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM110 RNA, VGAM111 RNA, VGAM112 RNA, VGAM113 RNA, VGAM114 RNA, VGAM115 RNA, VGAM116 RNA and VGAM117 RNA, herein schematically represented by VGAM1 RNA through VGAM3 RNA, each of which VGAM RNAs corresponding to VGAM RNA of FIG. 1.

VGAM110 RNA, herein schematically represented by VGAM1 RNA through VGAM3 RNA, binds complementarily to a host target binding site located in an untranslated region of VGAM110 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM110 host target RNA into VGAM110 host target protein, herein schematically represented by VGAM1 HOST TARGET PROTEIN through VGAM3 HOST TARGET PROTEIN, all of FIG. 1.

VGAM111 RNA, herein schematically represented by VGAM1 RNA through VGAM3 RNA, binds complementarily to a host target binding site located in an untranslated region of VGAM111 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM111 host target RNA into VGAM111 host target protein, herein schematically represented by VGAM1 HOST TARGET PROTEIN through VGAM3 HOST TARGET PROTEIN, all of FIG. 1.

VGAM112 RNA, herein schematically represented by VGAM1 RNA through VGAM3 RNA, binds complementarily to a host target binding site located in an untranslated region of VGAM112 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM112 host target RNA into VGAM112 host target protein, herein schematically represented by VGAM1 HOST TARGET PROTEIN through VGAM3 HOST TARGET PROTEIN, all of FIG. 1.

VGAM113 RNA, herein schematically represented by VGAM1 RNA through VGAM3 RNA, binds complementarily to a host target binding site located in an untranslated region of VGAM113 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM113 host target RNA into VGAM113 host target protein, herein schematically represented by VGAM1 HOST TARGET PROTEIN through VGAM3 HOST TARGET PROTEIN, all of FIG. 1.

VGAM114 RNA, herein schematically represented by VGAM1 RNA through VGAM3 RNA, binds complementarily to a host target binding site located in an untranslated region of VGAM114 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM114 host target RNA into VGAM114 host target protein, herein schematically represented by VGAM1 HOST TARGET PROTEIN through VGAM3 HOST TARGET PROTEIN, all of FIG. 1.

VGAM115 RNA, herein schematically represented by VGAM1 RNA through VGAM3 RNA, binds complementarily to a host target binding site located in an untranslated region of VGAM115 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM115 host target RNA into VGAM115 host target protein, herein schematically represented by VGAM1 HOST TARGET PROTEIN through VGAM3 HOST TARGET PROTEIN, all of FIG. 1.

VGAM116 RNA, herein schematically represented by VGAM1 RNA through VGAM3 RNA, binds complementarily to a host target binding site located in an untranslated region of VGAM116 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM116 host target RNA into VGAM116 host target protein, herein schematically represented by VGAM1 HOST TARGET PROTEIN through VGAM3 HOST TARGET PROTEIN, all of FIG. 1.

VGAM117 RNA, herein schematically represented by VGAM1 RNA through VGAM3 RNA, binds complementarily to a host target binding site located in an untranslated region of VGAM117 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM117 host target RNA into VGAM117 host target protein, herein schematically represented by VGAM1 HOST TARGET PROTEIN through VGAM3 HOST TARGET PROTEIN, all of FIG. 1.

It is appreciated that a function of VGR2754 gene, herein designated VGR GENE, is inhibition of expression of host target genes, as part of a novel viral mechanism of attacking a host. Accordingly, utilities of VGR2754 gene include diagnosis, prevention and treatment of viral infection by Shrimp White Spot Syndrome Virus (white spot bacilliform virus). Specific functions, and accordingly utilities, of VGR2754 gene correlate with, and may be deduced from, the identity of the host target genes, which are inhibited by VGAM RNAs comprised in the 'operon-like' cluster of VGR2754 gene: VGAM110 host target protein, VGAM111 host target protein, VGAM112 host target protein, VGAM113 host target protein, VGAM114 host target protein, VGAM115 host target protein, VGAM116 host target protein and VGAM117 host target protein, herein schematically represented by VGAM1 HOST TARGET PROTEIN through VGAM3 HOST TARGET PROTEIN. The function of these host target genes is elaborated hereinabove with reference to VGAM110, VGAM111, VGAM112, VGAM113, VGAM114, VGAM115, VGAM116 and VGAM117. FIG. 9 further provides a conceptual description of novel bioinformatically detected regulatory viral gene, referred to here as Viral Genomic Record 2755(VGR2755) viral gene, which encodes an 'operon-like' cluster of novel viral micro RNA-like genes, each of which in turn modulates expression of at least one host target gene, the function and utility of which at least one host target gene is known in the art.

VGR2755 gene, herein designated VGR GENE, is a novel bioinformatically detected regulatory, non protein coding, RNA viral gene. The method by which VGR2755 gene was detected is described hereinabove with reference to FIGS. 1-9.

VGR2755 gene encodes VGR2755 precursor RNA, herein designated VGR PRECURSOR RNA, an RNA molecule, typically several hundred nucleotides long.

VGR2755 precursor RNA folds spatially, forming VGR2755 folded precursor RNA, herein designated VGR FOLDED PRECURSOR RNA. It is appreciated that VGR2755 folded precursor RNA comprises a plurality of what is known in the art as 'hairpin' structures. These 'hairpin' structures are due to the fact that the nucleotide sequence of VGR2755 precursor RNA comprises a plurality of segments, the first half of each such segment having a nucleotide sequence which is at least a partial inversed-reversed sequence of the second half thereof, as is well known in the art.

VGR2755 folded precursor RNA is naturally processed by cellular enzymatic activity into at least 8 separate VGAM precursor RNAs, VGAM118 precursor RNA, VGAM119 precursor RNA, VGAM120 precursor RNA, VGAM121 precursor RNA, VGAM122 precursor RNA, VGAM123 precursor RNA, VGAM124 precursor RNA and VGAM125 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM118 RNA, VGAM119 RNA, VGAM120 RNA, VGAM121 RNA, VGAM122 RNA, VGAM123 RNA, VGAM124 RNA and VGAM125 RNA, herein schematically represented by VGAM1 RNA through VGAM3 RNA, each of which VGAM RNAs corresponding to VGAM RNA of FIG. 1.

VGAM118 RNA, herein schematically represented by VGAM1 RNA through VGAM3 RNA, binds complementarily to a host target binding site located in an untranslated region of VGAM118 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM118 host target RNA into VGAM118 host target protein, herein schematically represented by VGAM1 HOST TARGET PROTEIN through VGAM3 HOST TARGET PROTEIN, all of FIG. 1.

VGAM119 RNA, herein schematically represented by VGAM1 RNA through VGAM3 RNA, binds complementarily to a host target binding site located in an untranslated region of VGAM119 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM119 host target RNA into VGAM119 host target protein, herein schematically represented by VGAM1 HOST TARGET PROTEIN through VGAM3 HOST TARGET PROTEIN, all of FIG. 1.

VGAM120 RNA, herein schematically represented by VGAM1 RNA through VGAM3 RNA, binds complementarily to a host target binding site located in an untranslated region of VGAM120 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM120 host target RNA into VGAM120 host target protein, herein schematically represented by VGAM1 HOST TARGET PROTEIN through VGAM3 HOST TARGET PROTEIN, all of FIG. 1.

VGAM121 RNA, herein schematically represented by VGAM1 RNA through VGAM3 RNA, binds complementarily to a host target binding site located in an untranslated region of VGAM121 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM121 host target RNA into VGAM121 host target protein, herein schematically represented by VGAM1 HOST TARGET PROTEIN through VGAM3 HOST TARGET PROTEIN, all of FIG. 1.

VGAM122 RNA, herein schematically represented by VGAM1 RNA through VGAM3 RNA, binds complementarily to a host target binding site located in an untranslated region of VGAM122 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM122 host target RNA into VGAM122 host target protein, herein schematically represented by VGAM1 HOST TARGET PROTEIN through VGAM3 HOST TARGET PROTEIN, all of FIG. 1.

VGAM123 RNA, herein schematically represented by VGAM1 RNA through VGAM3 RNA, binds complementarily to a host target binding site located in an untranslated region of VGAM123 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM123 host target RNA into VGAM123 host target protein, herein schematically represented by VGAM1 HOST TARGET PROTEIN through VGAM3 HOST TARGET PROTEIN, all of FIG. 1.

VGAM124 RNA, herein schematically represented by VGAM1 RNA through VGAM3 RNA, binds complementarily to a host target binding site located in an untranslated region of VGAM124 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM124 host target RNA into VGAM124 host target protein, herein schematically represented by VGAM1 HOST TARGET PROTEIN through VGAM3 HOST TARGET PROTEIN, all of FIG. 1.

VGAM125 RNA, herein schematically represented by VGAM1 RNA through VGAM3 RNA, binds complementarily to a host target binding site located in an untranslated region of VGAM125 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM125 host target RNA into VGAM125 host target protein, herein schematically represented by VGAM1 HOST TARGET PROTEIN through VGAM3 HOST TARGET PROTEIN, all of FIG. 1.

It is appreciated that a function of VGR2755 gene, herein designated VGR GENE, is inhibition of expression of host target genes, as part of a novel viral mechanism of attacking a host. Accordingly, utilities of VGR2755 gene include diagnosis, prevention and treatment of viral infection by Shrimp White Spot Syndrome Virus (white spot bacilliform virus). Specific functions, and accordingly utilities, of VGR2755 gene correlate with, and may be deduced from, the identity of the host target genes, which are inhibited by VGAM RNAs comprised in the 'operon-like' cluster of VGR2755 gene: VGAM118 host target protein, VGAM119 host target protein, VGAM120 host target protein, VGAM121 host target protein, VGAM122 host target protein, VGAM123 host target protein, VGAM124 host target protein and VGAM125 host target protein, herein schematically represented by VGAM1 HOST TARGET PROTEIN through VGAM3 HOST TARGET PROTEIN. The function of these host target genes is elaborated hereinabove with reference to VGAM118, VGAM119, VGAM120, VGAM121, VGAM122, VGAM123, VGAM124 and VGAM125. FIG. 9 further provides a conceptual description of novel bioinformatically detected regulatory viral gene, referred to here as Viral Genomic Record 2756(VGR2756) viral gene, which encodes an 'operon-like' cluster of novel viral micro RNA-like genes, each of which in turn modulates expression of at least one host target gene, the function and utility of which at least one host target gene is known in the art.

VGR2756 gene, herein designated VGR GENE, is a novel bioinformatically detected regulatory, non protein coding, RNA viral gene. The method by which VGR2756 gene was detected is described hereinabove with reference to FIGS. 1-9.

VGR2756 gene encodes VGR2756 precursor RNA, herein designated VGR PRECURSOR RNA, an RNA molecule, typically several hundred nucleotides long.

VGR2756 precursor RNA folds spatially, forming VGR2756 folded precursor RNA, herein designated VGR FOLDED PRECURSOR RNA. It is appreciated that VGR2756 folded precursor RNA comprises a plurality of what is known in the art as 'hairpin' structures. These 'hairpin' structures are due to the fact that the nucleotide sequence of VGR2756 precursor RNA comprises a plurality of segments, the first half of each such segment having a nucleotide sequence which is at least a partial inversed-reversed sequence of the second half thereof, as is well known in the art.

VGR2756 folded precursor RNA is naturally processed by cellular enzymatic activity into at least 8 separate VGAM precursor RNAs, VGAM126 precursor RNA, VGAM127 precursor RNA, VGAM128 precursor RNA, VGAM129 precursor RNA, VGAM130 precursor RNA, VGAM131 precursor RNA, VGAM132 precursor RNA and VGAM133 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM126 RNA, VGAM127 RNA, VGAM128 RNA, VGAM129 RNA, VGAM130 RNA, VGAM131 RNA, VGAM132 RNA and VGAM133 RNA, herein schematically represented by VGAM1 RNA through VGAM3 RNA, each of which VGAM RNAs corresponding to VGAM RNA of FIG. 1.

VGAM126 RNA, herein schematically represented by VGAM1 RNA through VGAM3 RNA, binds complementarily to a host target binding site located in an untranslated region of VGAM126 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM126 host target RNA into VGAM126 host target protein, herein schematically represented by VGAM1 HOST TARGET PROTEIN through VGAM3 HOST TARGET PROTEIN, all of FIG. 1.

VGAM127 RNA, herein schematically represented by VGAM1 RNA through VGAM3 RNA, binds complementarily to a host target binding site located in an untranslated region of VGAM127 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM127 host target RNA into VGAM127 host target protein, herein schematically represented by VGAM1 HOST TARGET PROTEIN through VGAM3 HOST TARGET PROTEIN, all of FIG. 1.

VGAM128 RNA, herein schematically represented by VGAM1 RNA through VGAM3 RNA, binds complementarily to a host target binding site located in an untranslated region of VGAM128 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM128 host target RNA into VGAM128 host target protein, herein schematically represented by VGAM1 HOST TARGET PROTEIN through VGAM3 HOST TARGET PROTEIN, all of FIG. 1.

VGAM129 RNA, herein schematically represented by VGAM1 RNA through VGAM3 RNA, binds complementarily to a host target binding site located in an untranslated region of VGAM129 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM129 host target RNA into VGAM129 host target protein, herein schematically represented by VGAM1 HOST TARGET PROTEIN through VGAM3 HOST TARGET PROTEIN, all of FIG. 1.

VGAM130 RNA, herein schematically represented by VGAM1 RNA through VGAM3 RNA, binds complementarily to a host target binding site located in an untranslated region of VGAM130 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM130 host target RNA into VGAM130 host target protein, herein schematically represented by VGAM1 HOST TARGET PROTEIN through VGAM3 HOST TARGET PROTEIN, all of FIG. 1.

VGAM131 RNA, herein schematically represented by VGAM1 RNA through VGAM3 RNA, binds complementarily to a host target binding site located in an untranslated region of VGAM131 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM131 host target RNA into VGAM131 host target protein, herein schematically represented by VGAM1 HOST TARGET PROTEIN through VGAM3 HOST TARGET PROTEIN, all of FIG. 1.

VGAM132 RNA, herein schematically represented by VGAM1 RNA through VGAM3 RNA, binds complementarily to a host target binding site located in an untranslated region of VGAM132 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM132 host target RNA into VGAM132 host target protein, herein schematically represented by VGAM1 HOST TARGET PROTEIN through VGAM3 HOST TARGET PROTEIN, all of FIG. 1.

VGAM133 RNA, herein schematically represented by VGAM1 RNA through VGAM3 RNA, binds complementarily to a host target binding site located in an untranslated region of VGAM133 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM133 host target RNA into VGAM133 host target protein, herein schematically represented by VGAM1 HOST TARGET PROTEIN through VGAM3 HOST TARGET PROTEIN, all of FIG. 1.

It is appreciated that a function of VGR2756 gene, herein designated VGR GENE, is inhibition of expression of host target genes, as part of a novel viral mechanism of attacking a host. Accordingly, utilities of VGR2756 gene include diagnosis, prevention and treatment of viral infection by Shrimp White Spot Syndrome Virus (white spot bacilliform virus). Specific functions, and accordingly utilities, of VGR2756 gene correlate with, and may be deduced from, the identity of the host target genes, which are inhibited by VGAM RNAs comprised in the 'operon-like' cluster of VGR2756 gene: VGAM126 host target protein, VGAM127 host target protein, VGAM128 host target protein, VGAM129 host target protein, VGAM130 host target protein, VGAM131 host target protein, VGAM132 host target protein and VGAM133 host target protein, herein schematically represented by VGAM1 HOST TARGET PROTEIN through VGAM3 HOST TARGET PROTEIN. The function of these host target genes is elaborated hereinabove with reference to VGAM126, VGAM127, VGAM128, VGAM129, VGAM130, VGAM131, VGAM132 and VGAM133. FIG. 9 further provides a conceptual description of novel bioinformatically detected regulatory viral gene, referred to here as Viral Genomic Record 2757(VGR2757) viral gene, which encodes an 'operon-like' cluster of novel viral micro RNA-like genes, each of which in turn modulates expression of at least one host target gene, the function and utility of which at least one host target gene is known in the art.

VGR2757 gene, herein designated VGR GENE, is a novel bioinformatically detected regulatory, non protein coding, RNA viral gene. The method by which VGR2757 gene was detected is described hereinabove with reference to FIGS. 1-9.

VGR2757 gene encodes VGR2757 precursor RNA, herein designated VGR PRECURSOR RNA, an RNA molecule, typically several hundred nucleotides long.

VGR2757 precursor RNA folds spatially, forming VGR2757 folded precursor RNA, herein designated VGR FOLDED PRECURSOR RNA. It is appreciated that VGR2757 folded precursor RNA comprises a plurality of what is known in the art as 'hairpin' structures. These 'hairpin' structures are due to the fact that the nucleotide sequence of VGR2757 precursor RNA comprises a plurality of segments, the first half of each such segment having a nucleotide sequence which is at least a partial inversed-reversed sequence of the second half thereof, as is well known in the art.

VGR2757 folded precursor RNA is naturally processed by cellular enzymatic activity into at least 8 separate VGAM precursor RNAs, VGAM134 precursor RNA, VGAM135 precursor RNA, VGAM136 precursor RNA, VGAM137 precursor RNA, VGAM138 precursor RNA, VGAM139 precursor RNA, VGAM140 precursor RNA and VGAM141 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM134 RNA, VGAM135 RNA, VGAM136 RNA, VGAM137 RNA, VGAM138 RNA, VGAM139 RNA, VGAM140 RNA and VGAM141 RNA, herein schematically represented by VGAM1 RNA through VGAM3 RNA, each of which VGAM RNAs corresponding to VGAM RNA of FIG. 1.

VGAM134 RNA, herein schematically represented by VGAM1 RNA through VGAM3 RNA, binds complementarily to a host target binding site located in an untranslated region of VGAM134 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM134 host target RNA into VGAM134 host target protein, herein schematically represented by VGAM1 HOST TARGET PROTEIN through VGAM3 HOST TARGET PROTEIN, all of FIG. 1.

VGAM135 RNA, herein schematically represented by VGAM1 RNA through VGAM3 RNA, binds complementarily to a host target binding site located in an untranslated region of VGAM135 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM135 host target RNA into VGAM135 host target protein, herein schematically represented by VGAM1 HOST TARGET PROTEIN through VGAM3 HOST TARGET PROTEIN, all of FIG. 1.

VGAM136 RNA, herein schematically represented by VGAM1 RNA through VGAM3 RNA, binds complementarily to a host target binding site located in an untranslated region of VGAM136 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM136 host target RNA into VGAM136 host target protein, herein schematically represented by VGAM1 HOST TARGET PROTEIN through VGAM3 HOST TARGET PROTEIN, all of FIG. 1.

VGAM137 RNA, herein schematically represented by VGAM1 RNA through VGAM3 RNA, binds complementarily to a host target binding site located in an untranslated region of VGAM137 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM137 host target RNA into VGAM137 host target protein, herein schematically represented by VGAM1 HOST TARGET PROTEIN through VGAM3 HOST TARGET PROTEIN, all of FIG. 1.

VGAM138 RNA, herein schematically represented by VGAM1 RNA through VGAM3 RNA, binds complementarily to a host target binding site located in an untranslated region of VGAM138 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM138 host target RNA into VGAM138 host target protein, herein schematically represented by VGAM1 HOST TARGET PROTEIN through VGAM3 HOST TARGET PROTEIN, all of FIG. 1.

VGAM139 RNA, herein schematically represented by VGAM1 RNA through VGAM3 RNA, binds complementarily to a host target binding site located in an untranslated region of VGAM139 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM139 host target RNA into VGAM139 host target protein, herein schematically represented by VGAM1 HOST TARGET PROTEIN through VGAM3 HOST TARGET PROTEIN, all of FIG. 1.

VGAM140 RNA, herein schematically represented by VGAM1 RNA through VGAM3 RNA, binds complementarily to a host target binding site located in an untranslated region of VGAM140 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM140 host target RNA into VGAM140 host target protein, herein schematically represented by VGAM1 HOST TARGET PROTEIN through VGAM3 HOST TARGET PROTEIN, all of FIG. 1.

VGAM141 RNA, herein schematically represented by VGAM1 RNA through VGAM3 RNA, binds complementarily to a host target binding site located in an untranslated region of VGAM141 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM141 host target RNA into VGAM141 host target protein, herein schematically represented by VGAM1 HOST TARGET PROTEIN through VGAM3 HOST TARGET PROTEIN, all of FIG. 1.

It is appreciated that a function of VGR2757 gene, herein designated VGR GENE, is inhibition of expression of host target genes, as part of a novel viral mechanism of attacking a host. Accordingly, utilities of VGR2757 gene include diagnosis, prevention and treatment of viral infection by Shrimp White Spot Syndrome Virus (white spot bacilliform virus). Specific functions, and accordingly utilities, of VGR2757 gene correlate with, and may be deduced from, the identity of the host target genes, which are inhibited by VGAM RNAs comprised in the 'operon-like' cluster of VGR2757 gene: VGAM134 host target protein, VGAM135 host target protein, VGAM136 host target protein, VGAM137 host target protein, VGAM138 host target protein, VGAM139 host target protein, VGAM140 host target protein and VGAM141 host target protein, herein schematically represented by VGAM1 HOST TARGET PROTEIN through VGAM3 HOST TARGET PROTEIN. The function of these host target genes is elaborated hereinabove with reference to VGAM134, VGAM135, VGAM136, VGAM137, VGAM138, VGAM139, VGAM140 and VGAM141. FIG. 9 further provides a conceptual description of novel bioinformatically detected regulatory viral gene, referred to here as Viral Genomic Record 2758(VGR2758) viral gene, which encodes an 'operon-like' cluster of novel viral micro RNA-like genes, each of which in turn modulates expression of at least one host target gene, the function and utility of which at least one host target gene is known in the art.

VGR2758 gene, herein designated VGR GENE, is a novel bioinformatically detected regulatory, non protein coding, RNA viral gene. The method by which VGR2758 gene was detected is described hereinabove with reference to FIGS. 1-9.

VGR2758 gene encodes VGR2758 precursor RNA, herein designated VGR PRECURSOR RNA, an RNA molecule, typically several hundred nucleotides long.

VGR2758 precursor RNA folds spatially, forming VGR2758 folded precursor RNA, herein designated VGR FOLDED PRECURSOR RNA. It is appreciated that VGR2758 folded precursor RNA comprises a plurality of what is known in the art as 'hairpin' structures. These 'hairpin' structures are due to the fact that the nucleotide sequence of VGR2758 precursor RNA comprises a plurality of segments, the first half of each such segment having a nucleotide sequence which is at least a partial inversed-reversed sequence of the second half thereof, as is well known in the art.

VGR2758 folded precursor RNA is naturally processed by cellular enzymatic activity into at least 8 separate VGAM precursor RNAs, VGAM142 precursor RNA, VGAM143 precursor RNA, VGAM144 precursor RNA, VGAM145 precursor RNA, VGAM146 precursor RNA, VGAM147 precursor RNA, VGAM148 precursor RNA and VGAM149 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM142 RNA, VGAM143 RNA, VGAM144 RNA, VGAM145 RNA, VGAM146 RNA, VGAM147 RNA, VGAM148 RNA and VGAM149 RNA, herein schematically represented by VGAM1 RNA through VGAM3 RNA, each of which VGAM RNAs corresponding to VGAM RNA of FIG. 1.

VGAM142 RNA, herein schematically represented by VGAM1 RNA through VGAM3 RNA, binds complementarily to a host target binding site located in an untranslated region of VGAM142 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM142 host target RNA into VGAM142 host target protein, herein schematically represented by VGAM1 HOST TARGET PROTEIN through VGAM3 HOST TARGET PROTEIN, all of FIG. 1.

VGAM143 RNA, herein schematically represented by VGAM1 RNA through VGAM3 RNA, binds complementarily to a host target binding site located in an untranslated region of VGAM143 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM143 host target RNA into VGAM143 host target protein, herein schematically represented by VGAM1 HOST TARGET PROTEIN through VGAM3 HOST TARGET PROTEIN, all of FIG. 1.

VGAM144 RNA, herein schematically represented by VGAM1 RNA through VGAM3 RNA, binds complementarily to a host target binding site located in an untranslated region of VGAM144 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM144 host target RNA into VGAM144 host target protein, herein schematically represented by VGAM1 HOST TARGET PROTEIN through VGAM3 HOST TARGET PROTEIN, all of FIG. 1.

VGAM145 RNA, herein schematically represented by VGAM1 RNA through VGAM3 RNA, binds complementarily to a host target binding site located in an untranslated region of VGAM145 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM145 host target RNA into VGAM145 host target protein, herein schematically represented by VGAM1 HOST TARGET PROTEIN through VGAM3 HOST TARGET PROTEIN, all of FIG. 1.

VGAM146 RNA, herein schematically represented by VGAM1 RNA through VGAM3 RNA, binds complementarily to a host target binding site located in an untranslated region of VGAM146 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM146 host target RNA into VGAM146 host target protein, herein schematically represented by VGAM1 HOST TARGET PROTEIN through VGAM3 HOST TARGET PROTEIN, all of FIG. 1.

VGAM147 RNA, herein schematically represented by VGAM1 RNA through VGAM3 RNA, binds complementarily to a host target binding site located in an untranslated region of VGAM147 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM147 host target RNA into VGAM147 host target protein, herein schematically represented by VGAM1 HOST TARGET PROTEIN through VGAM3 HOST TARGET PROTEIN, all of FIG. 1.

VGAM148 RNA, herein schematically represented by VGAM1 RNA through VGAM3 RNA, binds complementarily to a host target binding site located in an untranslated region of VGAM148 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM148 host target RNA into VGAM148 host target protein, herein schematically represented by VGAM1 HOST TARGET PROTEIN through VGAM3 HOST TARGET PROTEIN, all of FIG. 1.

VGAM149 RNA, herein schematically represented by VGAM1 RNA through VGAM3 RNA, binds complementarily to a host target binding site located in an untranslated region of VGAM149 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM149 host target RNA into VGAM149 host target protein, herein schematically represented by VGAM1 HOST TARGET PROTEIN through VGAM3 HOST TARGET PROTEIN, all of FIG. 1.

It is appreciated that a function of VGR2758 gene, herein designated VGR GENE, is inhibition of expression of host target genes, as part of a novel viral mechanism of attacking a host. Accordingly, utilities of VGR2758 gene include diagnosis, prevention and treatment of viral infection by Shrimp White Spot Syndrome Virus (white spot bacilliform virus). Specific functions, and accordingly utilities, of VGR2758 gene correlate with, and may be deduced from, the identity of the host target genes, which are inhibited by VGAM RNAs comprised in the 'operon-like' cluster of VGR2758 gene: VGAM142 host target protein, VGAM143 host target protein, VGAM144 host target protein, VGAM145 host target protein, VGAM146 host target protein, VGAM147 host target protein, VGAM148 host target protein and VGAM149 host target protein, herein schematically represented by VGAM1 HOST TARGET PROTEIN through VGAM3 HOST TARGET PROTEIN. The function of these host target genes is elaborated hereinabove with reference to VGAM142, VGAM143, VGAM144, VGAM145, VGAM146, VGAM147, VGAM148 and VGAM149. FIG. 9 further provides a conceptual description of novel bioinformatically detected regulatory viral gene, referred to here as Viral Genomic Record 2759(VGR2759) viral gene, which encodes an 'operon-like' cluster of novel viral micro RNA-like genes, each of which in turn modulates expression of at least one host target gene, the function and utility of which at least one host target gene is known in the art.

VGR2759 gene, herein designated VGR GENE, is a novel bioinformatically detected regulatory, non protein coding, RNA viral gene. The method by which VGR2759 gene was detected is described hereinabove with reference to FIGS. 1-9.

VGR2759 gene encodes VGR2759 precursor RNA, herein designated VGR PRECURSOR RNA, an RNA molecule, typically several hundred nucleotides long.

VGR2759 precursor RNA folds spatially, forming VGR2759 folded precursor RNA, herein designated VGR FOLDED PRECURSOR RNA. It is appreciated that VGR2759 folded precursor RNA comprises a plurality of what is known in the art as 'hairpin' structures. These 'hairpin' structures are due to the fact that the nucleotide sequence of VGR2759 precursor RNA comprises a plurality of segments, the first half of each such segment having a nucleotide sequence which is at least a partial inversed-reversed sequence of the second half thereof, as is well known in the art.

VGR2759 folded precursor RNA is naturally processed by cellular enzymatic activity into at least 8 separate VGAM precursor RNAs, VGAM150 precursor RNA, VGAM151 precursor RNA, VGAM152 precursor RNA, VGAM153 precursor RNA, VGAM154 precursor RNA, VGAM155 precursor RNA, VGAM156 precursor RNA and VGAM157 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM150 RNA, VGAM151 RNA, VGAM152 RNA, VGAM153 RNA, VGAM154 RNA, VGAM155 RNA, VGAM156 RNA and VGAM157 RNA, herein schematically represented by VGAM1 RNA through VGAM3 RNA, each of which VGAM RNAs corresponding to VGAM RNA of FIG. 1.

VGAM150 RNA, herein schematically represented by VGAM1 RNA through VGAM3 RNA, binds complementarily to a host target binding site located in an untranslated region of VGAM150 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM150 host target RNA into VGAM150 host target protein, herein schematically represented by VGAM1 HOST TARGET PROTEIN through VGAM3 HOST TARGET PROTEIN, all of FIG. 1.

VGAM151 RNA, herein schematically represented by VGAM1 RNA through VGAM3 RNA, binds complementarily to a host target binding site located in an untranslated region of VGAM151 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM151 host target RNA into VGAM151 host target protein, herein schematically represented by VGAM1 HOST TARGET PROTEIN through VGAM3 HOST TARGET PROTEIN, all of FIG. 1.

VGAM152 RNA, herein schematically represented by VGAM1 RNA through VGAM3 RNA, binds complementarily to a host target binding site located in an untranslated region of VGAM152 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM152 host target RNA into VGAM152 host target protein, herein schematically represented by VGAM1 HOST TARGET PROTEIN through VGAM3 HOST TARGET PROTEIN, all of FIG. 1.

VGAM153 RNA, herein schematically represented by VGAM1 RNA through VGAM3 RNA, binds complementarily to a host target binding site located in an untranslated region of VGAM153 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM153 host target RNA into VGAM153 host target protein, herein schematically represented by VGAM1 HOST TARGET PROTEIN through VGAM3 HOST TARGET PROTEIN, all of FIG. 1.

VGAM154 RNA, herein schematically represented by VGAM1 RNA through VGAM3 RNA, binds complementarily to a host target binding site located in an untranslated region of VGAM154 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM154 host target RNA into VGAM154 host target protein, herein schematically represented by VGAM1 HOST TARGET PROTEIN through VGAM3 HOST TARGET PROTEIN, all of FIG. 1.

VGAM155 RNA, herein schematically represented by VGAM1 RNA through VGAM3 RNA, binds complementarily to a host target binding site located in an untranslated region of VGAM155 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM155 host target RNA into VGAM155 host target protein, herein schematically represented by VGAM1 HOST TARGET PROTEIN through VGAM3 HOST TARGET PROTEIN, all of FIG. 1.

VGAM156 RNA, herein schematically represented by VGAM1 RNA through VGAM3 RNA, binds complementarily to a host target binding site located in an untranslated region of VGAM156 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM156 host target RNA into VGAM156 host target protein, herein schematically represented by VGAM1 HOST TARGET PROTEIN through VGAM3 HOST TARGET PROTEIN, all of FIG. 1.

VGAM157 RNA, herein schematically represented by VGAM1 RNA through VGAM3 RNA, binds complementarily to a host target binding site located in an untranslated region of VGAM157 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM157 host target RNA into VGAM157 host target protein, herein schematically represented by VGAM1 HOST TARGET PROTEIN through VGAM3 HOST TARGET PROTEIN, all of FIG. 1.

It is appreciated that a function of VGR2759 gene, herein designated VGR GENE, is inhibition of expression of host target genes, as part of a novel viral mechanism of attacking a host. Accordingly, utilities of VGR2759 gene include diagnosis, prevention and treatment of viral infection by Shrimp White Spot Syndrome Virus (white spot bacilliform virus). Specific functions, and accordingly utilities, of VGR2759 gene correlate with, and may be deduced from, the identity of the host target genes, which are inhibited by VGAM RNAs comprised in the 'operon-like' cluster of VGR2759 gene: VGAM150 host target protein, VGAM151 host target protein, VGAM152 host target protein, VGAM153 host target protein, VGAM154 host target protein, VGAM155 host target protein, VGAM156 host target protein and VGAM157 host target protein, herein schematically represented by VGAM1 HOST TARGET PROTEIN through VGAM3 HOST TARGET PROTEIN. The function of these host target genes is elaborated hereinabove with reference to VGAM150, VGAM151, VGAM152, VGAM153, VGAM154, VGAM155, VGAM156 and VGAM157. FIG. 9 further provides a conceptual description of novel bioinformatically detected regulatory viral gene, referred to here as Viral Genomic Record 2760(VGR2760) viral gene, which encodes an 'operon-like' cluster of novel viral micro RNA-like genes, each of which in turn modulates expression of at least one host target gene, the function and utility of which at least one host target gene is known in the art.

VGR2760 gene, herein designated VGR GENE, is a novel bioinformatically detected regulatory, non protein coding, RNA viral gene. The method by which VGR2760 gene was detected is described hereinabove with reference to FIGS. 1-9.

VGR2760 gene encodes VGR2760 precursor RNA, herein designated VGR PRECURSOR RNA, an RNA molecule, typically several hundred nucleotides long.

VGR2760 precursor RNA folds spatially, forming VGR2760 folded precursor RNA, herein designated VGR FOLDED PRECURSOR RNA. It is appreciated that VGR2760 folded precursor RNA comprises a plurality of what is known in the art as 'hairpin' structures. These 'hairpin' structures are due to the fact that the nucleotide sequence of VGR2760 precursor RNA comprises a plurality of segments, the first half of each such segment having a nucleotide sequence which is at least a partial inversed-reversed sequence of the second half thereof, as is well known in the art.

VGR2760 folded precursor RNA is naturally processed by cellular enzymatic activity into at least 8 separate VGAM precursor RNAs, VGAM158 precursor RNA, VGAM159 precursor RNA, VGAM160 precursor RNA, VGAM161 precursor RNA, VGAM162 precursor RNA, VGAM163 precursor RNA, VGAM164 precursor RNA and VGAM165 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM158 RNA, VGAM159 RNA, VGAM160 RNA, VGAM161 RNA, VGAM162 RNA, VGAM163 RNA, VGAM164 RNA and VGAM165 RNA, herein schematically represented by VGAM1 RNA through VGAM3 RNA, each of which VGAM RNAs corresponding to VGAM RNA of FIG. 1.

VGAM158 RNA, herein schematically represented by VGAM1 RNA through VGAM3 RNA, binds complementarily to a host target binding site located in an untranslated region of VGAM158 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM158 host target RNA into VGAM158 host target protein, herein schematically represented by VGAM1 HOST TARGET PROTEIN through VGAM3 HOST TARGET PROTEIN, all of FIG. 1.

VGAM159 RNA, herein schematically represented by VGAM1 RNA through VGAM3 RNA, binds complementarily to a host target binding site located in an untranslated region of VGAM159 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM159 host target RNA into VGAM159 host target protein, herein schematically represented by VGAM1 HOST TARGET PROTEIN through VGAM3 HOST TARGET PROTEIN, all of FIG. 1.

VGAM160 RNA, herein schematically represented by VGAM1 RNA through VGAM3 RNA, binds complementarily to a host target binding site located in an untranslated region of VGAM160 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM160 host target RNA into VGAM160 host target protein, herein schematically represented by VGAM1 HOST TARGET PROTEIN through VGAM3 HOST TARGET PROTEIN, all of FIG. 1.

VGAM161 RNA, herein schematically represented by VGAM1 RNA through VGAM3 RNA, binds complementarily to a host target binding site located in an untranslated region of VGAM161 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM161 host target RNA into VGAM161 host target protein, herein schematically represented by VGAM1 HOST TARGET PROTEIN through VGAM3 HOST TARGET PROTEIN, all of FIG. 1.

VGAM162 RNA, herein schematically represented by VGAM1 RNA through VGAM3 RNA, binds complementarily to a host target binding site located in an untranslated region of VGAM162 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM162 host target RNA into VGAM162 host target protein, herein schematically represented by VGAM1 HOST TARGET PROTEIN through VGAM3 HOST TARGET PROTEIN, all of FIG. 1.

VGAM163 RNA, herein schematically represented by VGAM1 RNA through VGAM3 RNA, binds complementarily to a host target binding site located in an untranslated region of VGAM163 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM163 host target RNA into VGAM163 host target protein, herein schematically represented by VGAM1 HOST TARGET PROTEIN through VGAM3 HOST TARGET PROTEIN, all of FIG. 1.

VGAM164 RNA, herein schematically represented by VGAM1 RNA through VGAM3 RNA, binds complementarily to a host target binding site located in an untranslated region of VGAM164 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM164 host target RNA into VGAM164 host target protein, herein schematically represented by VGAM1 HOST TARGET PROTEIN through VGAM3 HOST TARGET PROTEIN, all of FIG. 1.

VGAM165 RNA, herein schematically represented by VGAM1 RNA through VGAM3 RNA, binds complementarily to a host target binding site located in an untranslated region of VGAM165 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM165 host target RNA into VGAM165 host target protein, herein schematically represented by VGAM1 HOST TARGET PROTEIN through VGAM3 HOST TARGET PROTEIN, all of FIG. 1.

It is appreciated that a function of VGR2760 gene, herein designated VGR GENE, is inhibition of expression of host target genes, as part of a novel viral mechanism of attacking a host. Accordingly, utilities of VGR2760 gene include diagnosis, prevention and treatment of viral infection by Shrimp White Spot Syndrome Virus (white spot bacilliform virus). Specific functions, and accordingly utilities, of VGR2760 gene correlate with, and may be deduced from, the identity of the host target genes, which are inhibited by VGAM RNAs comprised in the 'operon-like' cluster of VGR2760 gene: VGAM158 host target protein, VGAM159 host target protein, VGAM160 host target protein, VGAM161 host target protein, VGAM162 host target protein, VGAM163 host target protein, VGAM164 host target protein and VGAM165 host target protein, herein schematically represented by VGAM1 HOST TARGET PROTEIN through VGAM3 HOST TARGET PROTEIN. The function of these host target genes is elaborated hereinabove with reference to VGAM158, VGAM159, VGAM160, VGAM161, VGAM162, VGAM163, VGAM164 and VGAM165. FIG. 9 further provides a conceptual description of novel bioinformatically detected regulatory viral gene, referred to here as Viral Genomic Record 2761(VGR2761) viral gene, which encodes an 'operon-like' cluster of novel viral micro RNA-like genes, each of which in turn modulates expression of at least one host target gene, the function and utility of which at least one host target gene is known in the art.

VGR2761 gene, herein designated VGR GENE, is a novel bioinformatically detected regulatory, non protein coding, RNA viral gene. The method by which VGR2761 gene was detected is described hereinabove with reference to FIGS. 1-9.

VGR2761 gene encodes VGR2761 precursor RNA, herein designated VGR PRECURSOR RNA, an RNA molecule, typically several hundred nucleotides long.

VGR2761 precursor RNA folds spatially, forming VGR2761 folded precursor RNA, herein designated VGR FOLDED PRECURSOR RNA. It is appreciated that VGR2761 folded precursor RNA comprises a plurality of what is known in the art as 'hairpin' structures. These 'hairpin' structures are due to the fact that the nucleotide sequence of VGR2761 precursor RNA comprises a plurality of segments, the first half of each such segment having a nucleotide sequence which is at least a partial inversed-reversed sequence of the second half thereof, as is well known in the art.

VGR2761 folded precursor RNA is naturally processed by cellular enzymatic activity into at least 8 separate VGAM precursor RNAs, VGAM166 precursor RNA, VGAM167 precursor RNA, VGAM168 precursor RNA, VGAM169 precursor RNA, VGAM170 precursor RNA, VGAM171 precursor RNA, VGAM172 precursor RNA and VGAM173 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM166 RNA, VGAM167 RNA, VGAM168 RNA, VGAM169 RNA, VGAM170 RNA, VGAM171 RNA, VGAM172 RNA and VGAM173 RNA, herein schematically represented by VGAM1 RNA through VGAM3 RNA, each of which VGAM RNAs corresponding to VGAM RNA of FIG. 1.

VGAM166 RNA, herein schematically represented by VGAM1 RNA through VGAM3 RNA, binds complementarily to a host target binding site located in an untranslated region of VGAM166 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM166 host target RNA into VGAM166 host target protein, herein schematically represented by VGAM1 HOST TARGET PROTEIN through VGAM3 HOST TARGET PROTEIN, all of FIG. 1.

VGAM167 RNA, herein schematically represented by VGAM1 RNA through VGAM3 RNA, binds complementarily to a host target binding site located in an untranslated region of VGAM167 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM167 host target RNA into VGAM167 host target protein, herein schematically represented by VGAM1 HOST TARGET PROTEIN through VGAM3 HOST TARGET PROTEIN, all of FIG. 1.

VGAM168 RNA, herein schematically represented by VGAM1 RNA through VGAM3 RNA, binds complementarily to a host target binding site located in an untranslated region of VGAM168 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM168 host target RNA into VGAM168 host target protein, herein schematically represented by VGAM1 HOST TARGET PROTEIN through VGAM3 HOST TARGET PROTEIN, all of FIG. 1.

VGAM169 RNA, herein schematically represented by VGAM1 RNA through VGAM3 RNA, binds complementarily to a host target binding site located in an untranslated region of VGAM169 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM169 host target RNA into VGAM169 host target protein, herein schematically represented by VGAM1 HOST TARGET PROTEIN through VGAM3 HOST TARGET PROTEIN, all of FIG. 1.

VGAM170 RNA, herein schematically represented by VGAM1 RNA through VGAM3 RNA, binds complementarily to a host target binding site located in an untranslated region of VGAM170 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM170 host target RNA into VGAM170 host target protein, herein schematically represented by VGAM1 HOST TARGET PROTEIN through VGAM3 HOST TARGET PROTEIN, all of FIG. 1.

VGAM171 RNA, herein schematically represented by VGAM1 RNA through VGAM3 RNA, binds complementarily to a host target binding site located in an untranslated region of VGAM171 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM171 host target RNA into VGAM171 host target protein, herein schematically represented by VGAM1 HOST TARGET PROTEIN through VGAM3 HOST TARGET PROTEIN, all of FIG. 1.

VGAM172 RNA, herein schematically represented by VGAM1 RNA through VGAM3 RNA, binds complementarily to a host target binding site located in an untranslated region of VGAM172 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM172 host target RNA into VGAM172 host target protein, herein schematically represented by VGAM1 HOST TARGET PROTEIN through VGAM3 HOST TARGET PROTEIN, all of FIG. 1.

VGAM173 RNA, herein schematically represented by VGAM1 RNA through VGAM3 RNA, binds complementarily to a host target binding site located in an untranslated region of VGAM173 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM173 host target RNA into VGAM173 host target protein, herein schematically represented by VGAM1 HOST TARGET PROTEIN through VGAM3 HOST TARGET PROTEIN, all of FIG. 1.

It is appreciated that a function of VGR2761 gene, herein designated VGR GENE, is inhibition of expression of host target genes, as part of a novel viral mechanism of attacking a host. Accordingly, utilities of VGR2761 gene include diagnosis, prevention and treatment of viral infection by Shrimp White Spot Syndrome Virus (white spot bacilliform virus). Specific functions, and accordingly utilities, of VGR2761 gene correlate with, and may be deduced from, the identity of the host target genes, which are inhibited by VGAM RNAs comprised in the 'operon-like' cluster of VGR2761 gene: VGAM166 host target protein, VGAM167 host target protein, VGAM168 host target protein, VGAM169 host target protein, VGAM170 host target protein, VGAM171 host target protein, VGAM172 host target protein and VGAM173 host target protein, herein schematically represented by VGAM1 HOST TARGET PROTEIN through VGAM3 HOST TARGET PROTEIN. The function of these host target genes is elaborated hereinabove with reference to VGAM166, VGAM167, VGAM168, VGAM169, VGAM170, VGAM171, VGAM172 and VGAM173. FIG. 9 further provides a conceptual description of novel bioinformatically detected regulatory viral gene, referred to here as Viral Genomic Record 2762(VGR2762) viral gene, which encodes an 'operon-like' cluster of novel viral micro RNA-like genes, each of which in turn modulates expression of at least one host target gene, the function and utility of which at least one host target gene is known in the art.

VGR2762 gene, herein designated VGR GENE, is a novel bioinformatically detected regulatory, non protein coding, RNA viral gene. The method by which VGR2762 gene was detected is described hereinabove with reference to FIGS. 1-9.

VGR2762 gene encodes VGR2762 precursor RNA, herein designated VGR PRECURSOR RNA, an RNA molecule, typically several hundred nucleotides long.

VGR2762 precursor RNA folds spatially, forming VGR2762 folded precursor RNA, herein designated VGR FOLDED PRECURSOR RNA. It is appreciated that VGR2762 folded precursor RNA comprises a plurality of what is known in the art as 'hairpin' structures. These 'hairpin' structures are due to the fact that the nucleotide sequence of VGR2762 precursor RNA comprises a plurality of segments, the first half of each such segment having a nucleotide sequence which is at least a partial inversed-reversed sequence of the second half thereof, as is well known in the art.

VGR2762 folded precursor RNA is naturally processed by cellular enzymatic activity into at least 8 separate VGAM precursor RNAs, VGAM174 precursor RNA, VGAM175 precursor RNA, VGAM176 precursor RNA, VGAM177 precursor RNA, VGAM178 precursor RNA, VGAM179 precursor RNA, VGAM180 precursor RNA and VGAM181 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM174 RNA, VGAM175 RNA, VGAM176 RNA, VGAM177 RNA, VGAM178 RNA, VGAM179 RNA, VGAM180 RNA and VGAM181 RNA, herein schematically represented by VGAM1 RNA through VGAM3 RNA, each of which VGAM RNAs corresponding to VGAM RNA of FIG. 1.

VGAM174 RNA, herein schematically represented by VGAM1 RNA through VGAM3 RNA, binds complementarily to a host target binding site located in an untranslated region of VGAM174 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM174 host target RNA into VGAM174 host target protein, herein schematically represented by VGAM1 HOST TARGET PROTEIN through VGAM3 HOST TARGET PROTEIN, all of FIG. 1.

VGAM175 RNA, herein schematically represented by VGAM1 RNA through VGAM3 RNA, binds complementarily to a host target binding site located in an untranslated region of VGAM175 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM175 host target RNA into VGAM175 host target protein, herein schematically represented by VGAM1 HOST TARGET PROTEIN through VGAM3 HOST TARGET PROTEIN, all of FIG. 1.

VGAM176 RNA, herein schematically represented by VGAM1 RNA through VGAM3 RNA, binds complementarily to a host target binding site located in an untranslated region of VGAM176 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM176 host target RNA into VGAM176 host target protein, herein schematically represented by VGAM1 HOST TARGET PROTEIN through VGAM3 HOST TARGET PROTEIN, all of FIG. 1.

VGAM177 RNA, herein schematically represented by VGAM1 RNA through VGAM3 RNA, binds complementarily to a host target binding site located in an untranslated region of VGAM177 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM177 host target RNA into VGAM177 host target protein, herein schematically represented by VGAM1 HOST TARGET PROTEIN through VGAM3 HOST TARGET PROTEIN, all of FIG. 1.

VGAM178 RNA, herein schematically represented by VGAM1 RNA through VGAM3 RNA, binds complementarily to a host target binding site located in an untranslated region of VGAM178 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM178 host target RNA into VGAM178 host target protein, herein schematically represented by VGAM1 HOST TARGET PROTEIN through VGAM3 HOST TARGET PROTEIN, all of FIG. 1.

VGAM179 RNA, herein schematically represented by VGAM1 RNA through VGAM3 RNA, binds complementarily to a host target binding site located in an untranslated region of VGAM179 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM179 host target RNA into VGAM179 host target protein, herein schematically represented by VGAM1 HOST TARGET PROTEIN through VGAM3 HOST TARGET PROTEIN, all of FIG. 1.

VGAM180 RNA, herein schematically represented by VGAM1 RNA through VGAM3 RNA, binds complementarily to a host target binding site located in an untranslated region of VGAM180 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM180 host target RNA into VGAM180 host target protein, herein schematically represented by VGAM1 HOST TARGET PROTEIN through VGAM3 HOST TARGET PROTEIN, all of FIG. 1.

VGAM181 RNA, herein schematically represented by VGAM1 RNA through VGAM3 RNA, binds complementarily to a host target binding site located in an untranslated region of VGAM181 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM181 host target RNA into VGAM181 host target protein, herein schematically represented by VGAM1 HOST TARGET PROTEIN through VGAM3 HOST TARGET PROTEIN, all of FIG. 1.

It is appreciated that a function of VGR2762 gene, herein designated VGR GENE, is inhibition of expression of host target genes, as part of a novel viral mechanism of attacking a host. Accordingly, utilities of VGR2762 gene include diagnosis, prevention and treatment of viral infection by Shrimp White Spot Syndrome Virus (white spot bacilliform virus). Specific functions, and accordingly utilities, of VGR2762 gene correlate with, and may be deduced from, the identity of the host target genes, which are inhibited by VGAM RNAs comprised in the 'operon-like' cluster of VGR2762 gene: VGAM174 host target protein, VGAM175 host target protein, VGAM176 host target protein, VGAM177 host target protein, VGAM178 host target protein, VGAM179 host target protein, VGAM180 host target protein and VGAM181 host target protein, herein schematically represented by VGAM1 HOST TARGET PROTEIN through VGAM3 HOST TARGET PROTEIN. The function of these host target genes is elaborated hereinabove with reference to VGAM174, VGAM175, VGAM176, VGAM177, VGAM178, VGAM179, VGAM180 and VGAM181. FIG. 9 further provides a conceptual description of novel bioinformatically detected regulatory viral gene, referred to here as Viral Genomic Record 2763(VGR2763) viral gene, which encodes an 'operon-like' cluster of novel viral micro RNA-like genes, each of which in turn modulates expression of at least one host target gene, the function and utility of which at least one host target gene is known in the art.

VGR2763 gene, herein designated VGR GENE, is a novel bioinformatically detected regulatory, non protein coding, RNA viral gene. The method by which VGR2763 gene was detected is described hereinabove with reference to FIGS. 1-9.

VGR2763 gene encodes VGR2763 precursor RNA, herein designated VGR PRECURSOR RNA, an RNA molecule, typically several hundred nucleotides long.

VGR2763 precursor RNA folds spatially, forming VGR2763 folded precursor RNA, herein designated VGR FOLDED PRECURSOR RNA. It is appreciated that VGR2763 folded precursor RNA comprises a plurality of what is known in the art as 'hairpin' structures. These 'hairpin' structures are due to the fact that the nucleotide sequence of VGR2763 precursor RNA comprises a plurality of segments, the first half of each such segment having a nucleotide sequence which is at least a partial inversed-reversed sequence of the second half thereof, as is well known in the art.

VGR2763 folded precursor RNA is naturally processed by cellular enzymatic activity into at least 8 separate VGAM precursor RNAs, VGAM182 precursor RNA, VGAM183 precursor RNA, VGAM184 precursor RNA, VGAM185 precursor RNA, VGAM186 precursor RNA, VGAM187 precursor RNA, VGAM188 precursor RNA and VGAM189 precursor RNA, herein schematically represented by VGAM1

FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM182 RNA, VGAM183 RNA, VGAM184 RNA, VGAM185 RNA, VGAM186 RNA, VGAM187 RNA, VGAM188 RNA and VGAM189 RNA, herein schematically represented by VGAM1 RNA through VGAM3 RNA, each of which VGAM RNAs corresponding to VGAM RNA of FIG. 1.

VGAM182 RNA, herein schematically represented by VGAM1 RNA through VGAM3 RNA, binds complementarily to a host target binding site located in an untranslated region of VGAM182 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM182 host target RNA into VGAM182 host target protein, herein schematically represented by VGAM1 HOST TARGET PROTEIN through VGAM3 HOST TARGET PROTEIN, all of FIG. 1.

VGAM183 RNA, herein schematically represented by VGAM1 RNA through VGAM3 RNA, binds complementarily to a host target binding site located in an untranslated region of VGAM183 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM183 host target RNA into VGAM183 host target protein, herein schematically represented by VGAM1 HOST TARGET PROTEIN through VGAM3 HOST TARGET PROTEIN, all of FIG. 1.

VGAM184 RNA, herein schematically represented by VGAM1 RNA through VGAM3 RNA, binds complementarily to a host target binding site located in an untranslated region of VGAM184 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM184 host target RNA into VGAM184 host target protein, herein schematically represented by VGAM1 HOST TARGET PROTEIN through VGAM3 HOST TARGET PROTEIN, all of FIG. 1.

VGAM185 RNA, herein schematically represented by VGAM1 RNA through VGAM3 RNA, binds complementarily to a host target binding site located in an untranslated region of VGAM185 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM185 host target RNA into VGAM185 host target protein, herein schematically represented by VGAM1 HOST TARGET PROTEIN through VGAM3 HOST TARGET PROTEIN, all of FIG. 1.

VGAM186 RNA, herein schematically represented by VGAM1 RNA through VGAM3 RNA, binds complementarily to a host target binding site located in an untranslated region of VGAM186 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM186 host target RNA into VGAM186 host target protein, herein schematically represented by VGAM1 HOST TARGET PROTEIN through VGAM3 HOST TARGET PROTEIN, all of FIG. 1.

VGAM187 RNA, herein schematically represented by VGAM1 RNA through VGAM3 RNA, binds complementarily to a host target binding site located in an untranslated region of VGAM187 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM187 host target RNA into VGAM187 host target protein, herein schematically represented by VGAM1 HOST TARGET PROTEIN through VGAM3 HOST TARGET PROTEIN, all of FIG. 1.

VGAM188 RNA, herein schematically represented by VGAM1 RNA through VGAM3 RNA, binds complementarily to a host target binding site located in an untranslated region of VGAM188 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM188 host target RNA into VGAM188 host target protein, herein schematically represented by VGAM1 HOST TARGET PROTEIN through VGAM3 HOST TARGET PROTEIN, all of FIG. 1.

VGAM189 RNA, herein schematically represented by VGAM1 RNA through VGAM3 RNA, binds complementarily to a host target binding site located in an untranslated region of VGAM189 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM189 host target RNA into VGAM189 host target protein, herein schematically represented by VGAM1 HOST TARGET PROTEIN through VGAM3 HOST TARGET PROTEIN, all of FIG. 1.

It is appreciated that a function of VGR2763 gene, herein designated VGR GENE, is inhibition of expression of host target genes, as part of a novel viral mechanism of attacking a host. Accordingly, utilities of VGR2763 gene include diagnosis, prevention and treatment of viral infection by Shrimp White Spot Syndrome Virus (white spot bacilliform virus). Specific functions, and accordingly utilities, of VGR2763 gene correlate with, and may be deduced from, the identity of the host target genes, which are inhibited by VGAM RNAs comprised in the 'operon-like' cluster of VGR2763 gene: VGAM182 host target protein, VGAM183 host target protein, VGAM184 host target protein, VGAM185 host target protein, VGAM186 host target protein, VGAM187 host target protein, VGAM188 host target protein and VGAM189 host target protein, herein schematically represented by VGAM1 HOST TARGET PROTEIN through VGAM3 HOST TARGET PROTEIN. The function of these host target genes is elaborated hereinabove with reference to VGAM182, VGAM183, VGAM184, VGAM185, VGAM186, VGAM187, VGAM188 and VGAM189. FIG. 9 further provides a conceptual description of novel bioinformatically detected regulatory viral gene, referred to here as Viral Genomic Record 2764(VGR2764) viral gene, which encodes an 'operon-like' cluster of novel viral micro RNA-like genes, each of which in turn modulates expression of at least one host target gene, the function and utility of which at least one host target gene is known in the art.

VGR2764 gene, herein designated VGR GENE, is a novel bioinformatically detected regulatory, non protein coding, RNA viral gene. The method by which VGR2764 gene was detected is described hereinabove with reference to FIGS. 1-9.

VGR2764 gene encodes VGR2764 precursor RNA, herein designated VGR PRECURSOR RNA, an RNA molecule, typically several hundred nucleotides long.

VGR2764 precursor RNA folds spatially, forming VGR2764 folded precursor RNA, herein designated VGR FOLDED PRECURSOR RNA. It is appreciated that VGR2764 folded precursor RNA comprises a plurality of what is known in the art as 'hairpin' structures. These 'hairpin' structures are due to the fact that the nucleotide sequence of VGR2764 precursor RNA comprises a plurality of segments, the first half of each such segment having a nucleotide sequence which is at least a partial inversed-reversed sequence of the second half thereof, as is well known in the art.

VGR2764 folded precursor RNA is naturally processed by cellular enzymatic activity into at least 8 separate VGAM precursor RNAs, VGAM190 precursor RNA, VGAM191 precursor RNA, VGAM192 precursor RNA, VGAM193 precursor RNA, VGAM194 precursor RNA, VGAM195 precursor RNA, VGAM196 precursor RNA and VGAM197 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM190 RNA, VGAM191 RNA, VGAM192 RNA, VGAM193 RNA, VGAM194 RNA, VGAM195 RNA, VGAM196 RNA and VGAM197 RNA, herein schematically represented by VGAM1 RNA through VGAM3 RNA, each of which VGAM RNAs corresponding to VGAM RNA of FIG. 1.

VGAM190 RNA, herein schematically represented by VGAM1 RNA through VGAM3 RNA, binds complementarily to a host target binding site located in an untranslated region of VGAM190 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM190 host target RNA into VGAM190 host target protein, herein schematically represented by VGAM1 HOST TARGET PROTEIN through VGAM3 HOST TARGET PROTEIN, all of FIG. 1.

VGAM191 RNA, herein schematically represented by VGAM1 RNA through VGAM3 RNA, binds complementarily to a host target binding site located in an untranslated region of VGAM191 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM191 host target RNA into VGAM191 host target protein, herein schematically represented by VGAM1 HOST TARGET PROTEIN through VGAM3 HOST TARGET PROTEIN, all of FIG. 1.

VGAM192 RNA, herein schematically represented by VGAM1 RNA through VGAM3 RNA, binds complementarily to a host target binding site located in an untranslated region of VGAM192 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM192 host target RNA into VGAM192 host target protein, herein schematically represented by VGAM1 HOST TARGET PROTEIN through VGAM3 HOST TARGET PROTEIN, all of FIG. 1.

VGAM193 RNA, herein schematically represented by VGAM1 RNA through VGAM3 RNA, binds complementarily to a host target binding site located in an untranslated region of VGAM193 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM193 host target RNA into VGAM193 host target protein, herein schematically represented by VGAM1 HOST TARGET PROTEIN through VGAM3 HOST TARGET PROTEIN, all of FIG. 1.

VGAM194 RNA, herein schematically represented by VGAM1 RNA through VGAM3 RNA, binds complementarily to a host target binding site located in an untranslated region of VGAM194 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM194 host target RNA into VGAM194 host target protein, herein schematically represented by VGAM1 HOST TARGET PROTEIN through VGAM3 HOST TARGET PROTEIN, all of FIG. 1.

VGAM195 RNA, herein schematically represented by VGAM1 RNA through VGAM3 RNA, binds complementarily to a host target binding site located in an untranslated region of VGAM195 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM195 host target RNA into VGAM195 host target protein, herein schematically represented by VGAM1 HOST TARGET PROTEIN through VGAM3 HOST TARGET PROTEIN, all of FIG. 1.

VGAM196 RNA, herein schematically represented by VGAM1 RNA through VGAM3 RNA, binds complementarily to a host target binding site located in an untranslated region of VGAM196 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM196 host target RNA into VGAM196 host target protein, herein schematically represented by VGAM1 HOST TARGET PROTEIN through VGAM3 HOST TARGET PROTEIN, all of FIG. 1.

VGAM197 RNA, herein schematically represented by VGAM1 RNA through VGAM3 RNA, binds complementarily to a host target binding site located in an untranslated region of VGAM197 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM197 host target RNA into VGAM197 host target protein, herein schematically represented by VGAM1 HOST TARGET PROTEIN through VGAM3 HOST TARGET PROTEIN, all of FIG. 1.

It is appreciated that a function of VGR2764 gene, herein designated VGR GENE, is inhibition of expression of host target genes, as part of a novel viral mechanism of attacking a host. Accordingly, utilities of VGR2764 gene include diagnosis, prevention and treatment of viral infection by Shrimp White Spot Syndrome Virus (white spot baciliform virus). Specific functions, and accordingly utilities, of VGR2764 gene correlate with, and may be deduced from, the identity of the host target genes, which are inhibited by VGAM RNAs comprised in the 'operon-like' cluster of VGR2764 gene: VGAM190 host target protein, VGAM191 host target protein, VGAM192 host target protein, VGAM193 host target protein, VGAM194 host target protein, VGAM195 host target protein, VGAM196 host target protein and VGAM197 host target protein, herein schematically represented by VGAM1 HOST TARGET PROTEIN through VGAM3 HOST TARGET PROTEIN. The function of these host target genes is elaborated hereinabove with reference to VGAM190, VGAM191, VGAM192, VGAM193, VGAM194, VGAM195, VGAM196 and VGAM197. FIG. 9 further provides a conceptual description of novel bioinformatically detected regulatory viral gene, referred to here as Viral Genomic Record 2765(VGR2765) viral gene, which encodes an 'operon-like' cluster of novel viral micro RNA-like genes, each of which in turn modulates expression of at least one host target gene, the function and utility of which at least one host target gene is known in the art.

VGR2765 gene, herein designated VGR GENE, is a novel bioinformatically detected regulatory, non protein coding, RNA viral gene. The method by which VGR2765 gene was detected is described hereinabove with reference to FIGS. 1-9.

VGR2765 gene encodes VGR2765 precursor RNA, herein designated VGR PRECURSOR RNA, an RNA molecule, typically several hundred nucleotides long.

VGR2765 precursor RNA folds spatially, forming VGR2765 folded precursor RNA, herein designated VGR FOLDED PRECURSOR RNA. It is appreciated that VGR2765 folded precursor RNA comprises a plurality of what is known in the art as 'hairpin' structures. These 'hairpin' structures are due to the fact that the nucleotide sequence of VGR2765 precursor RNA comprises a plurality of segments, the first half of each such segment having a nucleotide sequence which is at least a partial inversed-reversed sequence of the second half thereof, as is well known in the art.

VGR2765 folded precursor RNA is naturally processed by cellular enzymatic activity into at least 8 separate VGAM precursor RNAs, VGAM198 precursor RNA, VGAM199 precursor RNA, VGAM200 precursor RNA, VGAM201 precursor RNA, VGAM202 precursor RNA, VGAM203 precursor RNA, VGAM204 precursor RNA and VGAM205 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM198 RNA, VGAM199 RNA, VGAM200 RNA, VGAM201 RNA, VGAM202 RNA, VGAM203 RNA, VGAM204 RNA and VGAM205 RNA, herein schematically represented by VGAM1 RNA through VGAM3 RNA, each of which VGAM RNAs corresponding to VGAM RNA of FIG. 1.

VGAM198 RNA, herein schematically represented by VGAM1 RNA through VGAM3 RNA, binds complementarily to a host target binding site located in an untranslated region of VGAM198 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM198 host target RNA into VGAM198 host target protein, herein schematically represented by VGAM1 HOST TARGET PROTEIN through VGAM3 HOST TARGET PROTEIN, all of FIG. 1.

VGAM199 RNA, herein schematically represented by VGAM1 RNA through VGAM3 RNA, binds complementarily to a host target binding site located in an untranslated region of VGAM199 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM199 host target RNA into VGAM199 host target protein, herein schematically represented by VGAM1 HOST TARGET PROTEIN through VGAM3 HOST TARGET PROTEIN, all of FIG. 1.

VGAM200 RNA, herein schematically represented by VGAM1 RNA through VGAM3 RNA, binds complementarily to a host target binding site located in an untranslated region of VGAM200 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM200 host target RNA into VGAM200 host target protein, herein schematically represented by VGAM1 HOST TARGET PROTEIN through VGAM3 HOST TARGET PROTEIN, all of FIG. 1.

VGAM201 RNA, herein schematically represented by VGAM1 RNA through VGAM3 RNA, binds complementarily to a host target binding site located in an untranslated region of VGAM201 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM201 host target RNA into VGAM201 host target protein, herein schematically represented by VGAM1 HOST TARGET PROTEIN through VGAM3 HOST TARGET PROTEIN, all of FIG. 1.

VGAM202 RNA, herein schematically represented by VGAM1 RNA through VGAM3 RNA, binds complementarily to a host target binding site located in an untranslated region of VGAM202 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM202 host target RNA into VGAM202 host target protein, herein schematically represented by VGAM1 HOST TARGET PROTEIN through VGAM3 HOST TARGET PROTEIN, all of FIG. 1.

VGAM203 RNA, herein schematically represented by VGAM1 RNA through VGAM3 RNA, binds complementarily to a host target binding site located in an untranslated region of VGAM203 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM203 host target RNA into VGAM203 host target protein, herein schematically represented by VGAM1 HOST TARGET PROTEIN through VGAM3 HOST TARGET PROTEIN, all of FIG. 1.

VGAM204 RNA, herein schematically represented by VGAM1 RNA through VGAM3 RNA, binds complementarily to a host target binding site located in an untranslated region of VGAM204 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM204 host target RNA into VGAM204 host target protein, herein schematically represented by VGAM1 HOST TARGET PROTEIN through VGAM3 HOST TARGET PROTEIN, all of FIG. 1.

VGAM205 RNA, herein schematically represented by VGAM1 RNA through VGAM3 RNA, binds complementarily to a host target binding site located in an untranslated region of VGAM205 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM205 host target RNA into VGAM205 host target protein, herein schematically represented by VGAM1 HOST TARGET PROTEIN through VGAM3 HOST TARGET PROTEIN, all of FIG. 1.

It is appreciated that a function of VGR2765 gene, herein designated VGR GENE, is inhibition of expression of host target genes, as part of a novel viral mechanism of attacking a host. Accordingly, utilities of VGR2765 gene include diagnosis, prevention and treatment of viral infection by Shrimp White Spot Syndrome Virus (white spot bacilliform virus). Specific functions, and accordingly utilities, of VGR2765 gene correlate with, and may be deduced from, the identity of the host target genes, which are inhibited by VGAM RNAs comprised in the 'operon-like' cluster of VGR2765 gene: VGAM198 host target protein, VGAM199 host target protein, VGAM200 host target protein, VGAM201 host target protein, VGAM202 host target protein, VGAM203 host target protein, VGAM204 host target protein and VGAM205 host target protein, herein schematically represented by VGAM1 HOST TARGET PROTEIN through VGAM3 HOST TARGET PROTEIN. The function of these host target genes is elaborated hereinabove with reference to VGAM198, VGAM199, VGAM200, VGAM201, VGAM202, VGAM203, VGAM204 and VGAM205. FIG. 9 further provides a conceptual description of novel bioinformatically detected regulatory viral gene, referred to here as Viral Genomic Record 2766(VGR2766) viral gene, which encodes an 'operon-like' cluster of novel viral micro RNA-like genes, each of which in turn modulates expression of at least one host target gene, the function and utility of which at least one host target gene is known in the art.

VGR2766 gene, herein designated VGR GENE, is a novel bioinformatically detected regulatory, non protein coding, RNA viral gene. The method by which VGR2766 gene was detected is described hereinabove with reference to FIGS. 1-9.

VGR2766 gene encodes VGR2766 precursor RNA, herein designated VGR PRECURSOR RNA, an RNA molecule, typically several hundred nucleotides long.

VGR2766 precursor RNA folds spatially, forming VGR2766 folded precursor RNA, herein designated VGR FOLDED PRECURSOR RNA. It is appreciated that VGR2766 folded precursor RNA comprises a plurality of what is known in the art as 'hairpin' structures. These 'hairpin' structures are due to the fact that the nucleotide sequence of VGR2766 precursor RNA comprises a plurality of segments, the first half of each such segment having a nucleotide sequence which is at least a partial inversed-reversed sequence of the second half thereof, as is well known in the art.

VGR2766 folded precursor RNA is naturally processed by cellular enzymatic activity into at least 5 separate VGAM precursor RNAs, VGAM206 precursor RNA, VGAM207 precursor RNA, VGAM208 precursor RNA, VGAM209 precursor RNA and VGAM210 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM206 RNA, VGAM207 RNA, VGAM208 RNA, VGAM209 RNA and VGAM210 RNA, herein schematically represented by VGAM1 RNA through VGAM3 RNA, each of which VGAM RNAs corresponding to VGAM RNA of FIG. 1.

VGAM206 RNA, herein schematically represented by VGAM1 RNA through VGAM3 RNA, binds complementarily to a host target binding site located in an untranslated region of VGAM206 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM206 host target RNA into VGAM206 host target protein, herein schematically represented by VGAM1 HOST TARGET PROTEIN through VGAM3 HOST TARGET PROTEIN, all of FIG. 1.

VGAM207 RNA, herein schematically represented by VGAM1 RNA through VGAM3 RNA, binds complementarily to a host target binding site located in an untranslated region of VGAM207 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM207 host target RNA into VGAM207 host target protein, herein schematically represented by VGAM1 HOST TARGET PROTEIN through VGAM3 HOST TARGET PROTEIN, all of FIG. 1.

VGAM208 RNA, herein schematically represented by VGAM1 RNA through VGAM3 RNA, binds complementarily to a host target binding site located in an untranslated region of VGAM208 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM208 host target RNA into VGAM208 host target protein, herein schematically represented by VGAM1 HOST TARGET PROTEIN through VGAM3 HOST TARGET PROTEIN, all of FIG. 1.

VGAM209 RNA, herein schematically represented by VGAM1 RNA through VGAM3 RNA, binds complementarily to a host target binding site located in an untranslated region of VGAM209 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM209 host target RNA into VGAM209 host target protein, herein schematically represented by VGAM1 HOST TARGET PROTEIN through VGAM3 HOST TARGET PROTEIN, all of FIG. 1.

VGAM210 RNA, herein schematically represented by VGAM1 RNA through VGAM3 RNA, binds complementarily to a host target binding site located in an untranslated region of VGAM210 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM210 host target RNA into VGAM210 host target protein, herein schematically represented by VGAM1 HOST TARGET PROTEIN through VGAM3 HOST TARGET PROTEIN, all of FIG. 1.

It is appreciated that a function of VGR2766 gene, herein designated VGR GENE, is inhibition of expression of host target genes, as part of a novel viral mechanism of attacking a host. Accordingly, utilities of VGR2766 gene include diagnosis, prevention and treatment of viral infection by Shrimp White Spot Syndrome Virus (white spot baciliform virus). Specific functions, and accordingly utilities, of VGR2766 gene correlate with, and may be deduced from, the identity of the host target genes, which are inhibited by VGAM RNAs comprised in the 'operon-like' cluster of VGR2766 gene: VGAM206 host target protein, VGAM207 host target protein, VGAM208 host target protein, VGAM209 host target protein and VGAM210 host target protein, herein schematically represented by VGAM1 HOST TARGET PROTEIN through VGAM3 HOST TARGET PROTEIN. The function of these host target genes is elaborated hereinabove with reference to VGAM206, VGAM207, VGAM208, VGAM209 and VGAM210. FIG. 9 further provides a conceptual description of novel bioinformatically detected regulatory viral gene, referred to here as Viral Genomic Record 2767(VGR2767) viral gene, which encodes an 'operon-like' cluster of novel viral micro RNA-like genes, each of which in turn modulates expression of at least one host target gene, the function and utility of which at least one host target gene is known in the art.

VGR2767 gene, herein designated VGR GENE, is a novel bioinformatically detected regulatory, non protein coding, RNA viral gene. The method by which VGR2767 gene was detected is described hereinabove with reference to FIGS. 1-9.

VGR2767 gene encodes VGR2767 precursor RNA, herein designated VGR PRECURSOR RNA, an RNA molecule, typically several hundred nucleotides long.

VGR2767 precursor RNA folds spatially, forming VGR2767 folded precursor RNA, herein designated VGR FOLDED PRECURSOR RNA. It is appreciated that VGR2767 folded precursor RNA comprises a plurality of what is known in the art as 'hairpin' structures. These 'hairpin' structures are due to the fact that the nucleotide sequence of VGR2767 precursor RNA comprises a plurality of segments, the first half of each such segment having a nucleotide sequence which is at least a partial inversed-reversed sequence of the second half thereof, as is well known in the art.

VGR2767 folded precursor RNA is naturally processed by cellular enzymatic activity into at least 3 separate VGAM precursor RNAs, VGAM211 precursor RNA, VGAM212 precursor RNA and VGAM213 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM211 RNA, VGAM212 RNA and VGAM213 RNA, herein schematically represented by VGAM1 RNA through VGAM3 RNA, each of which VGAM RNAs corresponding to VGAM RNA of FIG. 1.

VGAM211 RNA, herein schematically represented by VGAM1 RNA through VGAM3 RNA, binds complementarily to a host target binding site located in an untranslated region of VGAM211 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM211 host target RNA into VGAM211 host target protein, herein schematically represented by VGAM1 HOST TARGET PROTEIN through VGAM3 HOST TARGET PROTEIN, all of FIG. 1.

VGAM212 RNA, herein schematically represented by VGAM1 RNA through VGAM3 RNA, binds complementarily to a host target binding site located in an untranslated region of VGAM212 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM212 host target RNA into VGAM212 host target protein, herein schematically represented by VGAM1 HOST TARGET PROTEIN through VGAM3 HOST TARGET PROTEIN, all of FIG. 1.

VGAM213 RNA, herein schematically represented by VGAM1 RNA through VGAM3 RNA, binds complementarily to a host target binding site located in an untranslated region of VGAM213 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM213 host target RNA into VGAM213 host target protein, herein schematically represented by VGAM1 HOST TARGET PROTEIN through VGAM3 HOST TARGET PROTEIN, all of FIG. 1.

It is appreciated that a function of VGR2767 gene, herein designated VGR GENE, is inhibition of expression of host target genes, as part of a novel viral mechanism of attacking a host. Accordingly, utilities of VGR2767 gene include diagnosis, prevention and treatment of viral infection by Simian Virus 40. Specific functions, and accordingly utilities, of VGR2767 gene correlate with, and may be deduced from, the identity of the host target genes, which are inhibited by VGAM RNAs comprised in the 'operon-like' cluster of VGR2767 gene: VGAM211 host target protein, VGAM212 host target protein and VGAM213 host target protein, herein schematically represented by VGAM1 HOST TARGET PROTEIN through VGAM3 HOST TARGET PROTEIN. The function of these host target genes is elaborated hereinabove with reference to VGAM211, VGAM212 and VGAM213. FIG. 9 further provides a conceptual description of novel bioinformatically detected regulatory viral gene, referred to here as Viral Genomic Record 2768(VGR2768) viral gene, which encodes an 'operon-like' cluster of novel viral micro RNA-like genes, each of which in turn modulates expression of at least one host target gene, the function and utility of which at least one host target gene is known in the art.

VGR2768 gene, herein designated VGR GENE, is a novel bioinformatically detected regulatory, non protein coding, RNA viral gene. The method by which VGR2768 gene was detected is described hereinabove with reference to FIGS. 1-9.

VGR2768 gene encodes VGR2768 precursor RNA, herein designated VGR PRECURSOR RNA, an RNA molecule, typically several hundred nucleotides long.

VGR2768 precursor RNA folds spatially, forming VGR2768 folded precursor RNA, herein designated VGR FOLDED PRECURSOR RNA. It is appreciated that VGR2768 folded precursor RNA comprises a plurality of what is known in the art as 'hairpin' structures. These 'hairpin' structures are due to the fact that the nucleotide sequence of VGR2768 precursor RNA comprises a plurality of segments, the first half of each such segment having a nucleotide sequence which is at least a partial inversed-reversed sequence of the second half thereof, as is well known in the art.

VGR2768 folded precursor RNA is naturally processed by cellular enzymatic activity into at least 2 separate VGAM precursor RNAs, VGAM214 precursor RNA and VGAM215 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM214 RNA and VGAM215 RNA, herein schematically represented by VGAM1 RNA through VGAM3 RNA, each of which VGAM RNAs corresponding to VGAM RNA of FIG. 1.

VGAM214 RNA, herein schematically represented by VGAM1 RNA through VGAM3 RNA, binds complementarily to a host target binding site located in an untranslated region of VGAM214 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM214 host target RNA into VGAM214 host target protein, herein schematically represented by VGAM1 HOST TARGET PROTEIN through VGAM3 HOST TARGET PROTEIN, all of FIG. 1.

VGAM215 RNA, herein schematically represented by VGAM1 RNA through VGAM3 RNA, binds complementarily to a host target binding site located in an untranslated region of VGAM215 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM215 host target RNA into VGAM215 host target protein, herein schematically represented by VGAM1 HOST TARGET PROTEIN through VGAM3 HOST TARGET PROTEIN, all of FIG. 1.

It is appreciated that a function of VGR2768 gene, herein designated VGR GENE, is inhibition of expression of host target genes, as part of a novel viral mechanism of attacking a host. Accordingly, utilities of VGR2768 gene include diagnosis, prevention and treatment of viral infection by Autographa Californica Nucleopolyhedrovirus. Specific functions, and accordingly utilities, of VGR2768 gene correlate with, and may be deduced from, the identity of the host target genes, which are inhibited by VGAM RNAs comprised in the 'operon-like' cluster of VGR2768 gene: VGAM214 host target protein and VGAM215 host target protein, herein schematically represented by VGAM1 HOST TARGET PROTEIN through VGAM3 HOST TARGET PROTEIN. The function of these host target genes is elaborated hereinabove with reference to VGAM214 and VGAM215. FIG. 9 further provides a conceptual description of novel bioinformatically detected regulatory viral gene, referred to here as Viral Genomic Record 2769(VGR2769) viral gene, which encodes an 'operon-like' cluster of novel viral micro RNA-like genes, each of which in turn modulates expression of at least one host target gene, the function and utility of which at least one host target gene is known in the art.

VGR2769 gene, herein designated VGR GENE, is a novel bioinformatically detected regulatory, non protein coding, RNA viral gene. The method by which VGR2769 gene was detected is described hereinabove with reference to FIGS. 1-9.

VGR2769 gene encodes VGR2769 precursor RNA, herein designated VGR PRECURSOR RNA, an RNA molecule, typically several hundred nucleotides long.

VGR2769 precursor RNA folds spatially, forming VGR2769 folded precursor RNA, herein designated VGR FOLDED PRECURSOR RNA. It is appreciated that VGR2769 folded precursor RNA comprises a plurality of what is known in the art as 'hairpin' structures. These 'hairpin' structures are due to the fact that the nucleotide sequence of VGR2769 precursor RNA comprises a plurality of segments, the first half of each such segment having a nucleotide sequence which is at least a partial inversed-reversed sequence of the second half thereof, as is well known in the art.

VGR2769 folded precursor RNA is naturally processed by cellular enzymatic activity into at least 2 separate VGAM precursor RNAs, VGAM216 precursor RNA and VGAM217 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM216 RNA and VGAM217 RNA, herein schematically represented by VGAM1 RNA through VGAM3 RNA, each of which VGAM RNAs corresponding to VGAM RNA of FIG. 1.

VGAM216 RNA, herein schematically represented by VGAM1 RNA through VGAM3 RNA, binds complementarily to a host target binding site located in an untranslated region of VGAM216 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM216 host target RNA into VGAM216 host target protein, herein schematically represented by VGAM1 HOST TARGET PROTEIN through VGAM3 HOST TARGET PROTEIN, all of FIG. 1.

VGAM217 RNA, herein schematically represented by VGAM1 RNA through VGAM3 RNA, binds complementarily to a host target binding site located in an untranslated region of VGAM217 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM217 host target RNA into VGAM217 host target protein, herein schematically represented by VGAM1 HOST TARGET PROTEIN through VGAM3 HOST TARGET PROTEIN, all of FIG. 1.

It is appreciated that a function of VGR2769 gene, herein designated VGR GENE, is inhibition of expression of host target genes, as part of a novel viral mechanism of attacking a host. Accordingly, utilities of VGR2769 gene include diagnosis, prevention and treatment of viral infection by Avian Leukosis Virus. Specific functions, and accordingly utilities, of VGR2769 gene correlate with, and may be deduced from, the identity of the host target genes, which are inhibited by VGAM RNAs comprised in the 'operon-like' cluster of VGR2769 gene: VGAM216 host target protein and VGAM217 host target protein, herein schematically represented by VGAM1 HOST TARGET PROTEIN through VGAM3 HOST TARGET PROTEIN. The function of these host target genes is elaborated hereinabove with reference to VGAM216 and VGAM217. FIG. 9 further provides a conceptual description of novel bioinformatically detected regulatory viral gene, referred to here as Viral Genomic Record 2770(VGR2770) viral gene, which encodes an 'operon-like' cluster of novel viral micro RNA-like genes, each of which in turn modulates expression of at least one host target gene, the function and utility of which at least one host target gene is known in the art.

VGR2770 gene, herein designated VGR GENE, is a novel bioinformatically detected regulatory, non protein coding, RNA viral gene. The method by which VGR2770 gene was detected is described hereinabove with reference to FIGS. 1-9.

VGR2770 gene encodes VGR2770 precursor RNA, herein designated VGR PRECURSOR RNA, an RNA molecule, typically several hundred nucleotides long.

VGR2770 precursor RNA folds spatially, forming VGR2770 folded precursor RNA, herein designated VGR FOLDED PRECURSOR RNA. It is appreciated that VGR2770 folded precursor RNA comprises a plurality of what is known in the art as 'hairpin' structures. These 'hairpin' structures are due to the fact that the nucleotide sequence of VGR2770 precursor RNA comprises a plurality of segments, the first half of each such segment having a nucleotide sequence which is at least a partial inversed-reversed sequence of the second half thereof, as is well known in the art.

VGR2770 folded precursor RNA is naturally processed by cellular enzymatic activity into at least 2 separate VGAM precursor RNAs, VGAM218 precursor RNA and VGAM219 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM218 RNA and VGAM219 RNA, herein schematically represented by VGAM1 RNA through VGAM3 RNA, each of which VGAM RNAs corresponding to VGAM RNA of FIG. 1.

VGAM218 RNA, herein schematically represented by VGAM1 RNA through VGAM3 RNA, binds complementarily to a host target binding site located in an untranslated region of VGAM218 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM218 host target RNA into VGAM218 host target protein, herein schematically represented by VGAM1 HOST TARGET PROTEIN through VGAM3 HOST TARGET PROTEIN, all of FIG. 1.

VGAM219 RNA, herein schematically represented by VGAM1 RNA through VGAM3 RNA, binds complementarily to a host target binding site located in an untranslated region of VGAM219 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM219 host target RNA into VGAM219 host target protein, herein schematically represented by VGAM1 HOST TARGET PROTEIN through VGAM3 HOST TARGET PROTEIN, all of FIG. 1.

It is appreciated that a function of VGR2770 gene, herein designated VGR GENE, is inhibition of expression of host target genes, as part of a novel viral mechanism of attacking a host. Accordingly, utilities of VGR2770 gene include diagnosis, prevention and treatment of viral infection by Bovine Leukemia Virus. Specific functions, and accordingly utilities, of VGR2770 gene correlate with, and may be deduced from, the identity of the host target genes, which are inhibited by VGAM RNAs comprised in the 'operon-like' cluster of VGR2770 gene: VGAM218 host target protein and VGAM219 host target protein, herein schematically represented by VGAM1 HOST TARGET PROTEIN through VGAM3 HOST TARGET PROTEIN. The function of these host target genes is elaborated hereinabove with reference to VGAM218 and VGAM219. FIG. 9 further provides a conceptual description of novel bioinformatically detected regulatory viral gene, referred to here as Viral Genomic Record 2771(VGR2771) viral gene, which encodes an 'operon-like' cluster of novel viral micro RNA-like genes, each of which in turn modulates expression of at least one host target gene, the function and utility of which at least one host target gene is known in the art.

VGR2771 gene, herein designated VGR GENE, is a novel bioinformatically detected regulatory, non protein coding, RNA viral gene. The method by which VGR2771 gene was detected is described hereinabove with reference to FIGS. 1-9.

VGR2771 gene encodes VGR2771 precursor RNA, herein designated VGR PRECURSOR RNA, an RNA molecule, typically several hundred nucleotides long.

VGR2771 precursor RNA folds spatially, forming VGR2771 folded precursor RNA, herein designated VGR FOLDED PRECURSOR RNA. It is appreciated that VGR2771 folded precursor RNA comprises a plurality of what is known in the art as 'hairpin' structures. These 'hairpin' structures are due to the fact that the nucleotide sequence of VGR2771 precursor RNA comprises a plurality of segments, the first half of each such segment having a nucleotide sequence which is at least a partial inversed-reversed sequence of the second half thereof, as is well known in the art.

VGR2771 folded precursor RNA is naturally processed by cellular enzymatic activity into at least 8 separate VGAM precursor RNAs, VGAM220 precursor RNA, VGAM221 precursor RNA, VGAM222 precursor RNA, VGAM223 precursor RNA, VGAM224 precursor RNA, VGAM225 precursor RNA, VGAM226 precursor RNA and VGAM227 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM220 RNA, VGAM221 RNA, VGAM222 RNA, VGAM223 RNA, VGAM224 RNA, VGAM225 RNA, VGAM226 RNA and VGAM227 RNA, herein schematically represented by VGAM1 RNA through VGAM3 RNA, each of which VGAM RNAs corresponding to VGAM RNA of FIG. 1.

VGAM220 RNA, herein schematically represented by VGAM1 RNA through VGAM3 RNA, binds complementarily to a host target binding site located in an untranslated region of VGAM220 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM220 host target RNA into VGAM220 host target protein, herein schematically represented by VGAM1 HOST TARGET PROTEIN through VGAM3 HOST TARGET PROTEIN, all of FIG. 1.

VGAM221 RNA, herein schematically represented by VGAM1 RNA through VGAM3 RNA, binds complementarily to a host target binding site located in an untranslated region of VGAM221 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM221 host target RNA into VGAM221 host target protein, herein schematically represented by VGAM1 HOST TARGET PROTEIN through VGAM3 HOST TARGET PROTEIN, all of FIG. 1.

VGAM222 RNA, herein schematically represented by VGAM1 RNA through VGAM3 RNA, binds complementarily to a host target binding site located in an untranslated region of VGAM222 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM222 host target RNA into VGAM222 host target protein, herein schematically represented by VGAM1 HOST TARGET PROTEIN through VGAM3 HOST TARGET PROTEIN, all of FIG. 1.

VGAM223 RNA, herein schematically represented by VGAM1 RNA through VGAM3 RNA, binds complementarily to a host target binding site located in an untranslated region of VGAM223 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM223 host target RNA into VGAM223 host target protein, herein schematically represented by VGAM1 HOST TARGET PROTEIN through VGAM3 HOST TARGET PROTEIN, all of FIG. 1.

VGAM224 RNA, herein schematically represented by VGAM1 RNA through VGAM3 RNA, binds complementarily to a host target binding site located in an untranslated region of VGAM224 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM224 host target RNA into VGAM224 host target protein, herein schematically represented by VGAM1 HOST TARGET PROTEIN through VGAM3 HOST TARGET PROTEIN, all of FIG. 1.

VGAM225 RNA, herein schematically represented by VGAM1 RNA through VGAM3 RNA, binds complementarily to a host target binding site located in an untranslated region of VGAM225 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM225 host target RNA into VGAM225 host target protein, herein schematically represented by VGAM1 HOST TARGET PROTEIN through VGAM3 HOST TARGET PROTEIN, all of FIG. 1.

VGAM226 RNA, herein schematically represented by VGAM1 RNA through VGAM3 RNA, binds complementarily to a host target binding site located in an untranslated region of VGAM226 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM226 host target RNA into VGAM226 host target protein, herein schematically represented by VGAM1 HOST TARGET PROTEIN through VGAM3 HOST TARGET PROTEIN, all of FIG. 1.

VGAM227 RNA, herein schematically represented by VGAM1 RNA through VGAM3 RNA, binds complementarily to a host target binding site located in an untranslated region of VGAM227 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM227 host target RNA into VGAM227 host target protein, herein schematically represented by VGAM1 HOST TARGET PROTEIN through VGAM3 HOST TARGET PROTEIN, all of FIG. 1.

It is appreciated that a function of VGR2771 gene, herein designated VGR GENE, is inhibition of expression of host target genes, as part of a novel viral mechanism of attacking a host. Accordingly, utilities of VGR2771 gene include diagnosis, prevention and treatment of viral infection by Callitrichine Herpesvirus 3. Specific functions, and accordingly utilities, of VGR2771 gene correlate with, and may be deduced from, the identity of the host target genes, which are inhibited by VGAM RNAs comprised in the 'operon-like' cluster of VGR2771 gene: VGAM220 host target protein, VGAM221 host target protein, VGAM222 host target protein, VGAM223 host target protein, VGAM224 host target protein, VGAM225 host target protein, VGAM226 host target protein and VGAM227 host target protein, herein schematically represented by VGAM1 HOST TARGET PROTEIN through VGAM3 HOST TARGET PROTEIN. The function of these host target genes is elaborated hereinabove with reference to VGAM220, VGAM221, VGAM222, VGAM223, VGAM224, VGAM225, VGAM226 and VGAM227. FIG. 9 further provides a conceptual description of novel bioinformatically detected regulatory viral gene, referred to here as Viral Genomic Record 2772(VGR2772) viral gene, which encodes an 'operon-like' cluster of novel viral micro RNA-like genes, each of which in turn modulates expression of at least one host target gene, the function and utility of which at least one host target gene is known in the art.

VGR2772 gene, herein designated VGR GENE, is a novel bioinformatically detected regulatory, non protein coding, RNA viral gene. The method by which VGR2772 gene was detected is described hereinabove with reference to FIGS. 1-9.

VGR2772 gene encodes VGR2772 precursor RNA, herein designated VGR PRECURSOR RNA, an RNA molecule, typically several hundred nucleotides long.

VGR2772 precursor RNA folds spatially, forming VGR2772 folded precursor RNA, herein designated VGR FOLDED PRECURSOR RNA. It is appreciated that VGR2772 folded precursor RNA comprises a plurality of what is known in the art as 'hairpin' structures. These 'hairpin' structures are due to the fact that the nucleotide sequence of VGR2772 precursor RNA comprises a plurality of segments, the first half of each such segment having a nucleotide sequence which is at least a partial inversed-reversed sequence of the second half thereof, as is well known in the art.

VGR2772 folded precursor RNA is naturally processed by cellular enzymatic activity into at least 8 separate VGAM precursor RNAs, VGAM228 precursor RNA, VGAM229 precursor RNA, VGAM230 precursor RNA, VGAM231 precursor RNA, VGAM232 precursor RNA, VGAM233 precursor RNA, VGAM234 precursor RNA and VGAM235 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM228 RNA, VGAM229 RNA, VGAM230 RNA, VGAM231 RNA, VGAM232 RNA, VGAM233 RNA, VGAM234 RNA and VGAM235 RNA, herein schematically represented by VGAM1 RNA through VGAM3 RNA, each of which VGAM RNAs corresponding to VGAM RNA of FIG. 1.

VGAM228 RNA, herein schematically represented by VGAM1 RNA through VGAM3 RNA, binds complementarily to a host target binding site located in an untranslated region of VGAM228 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM228 host target RNA into VGAM228 host target protein, herein schematically represented by VGAM1 HOST TARGET PROTEIN through VGAM3 HOST TARGET PROTEIN, all of FIG. 1.

VGAM229 RNA, herein schematically represented by VGAM1 RNA through VGAM3 RNA, binds complementarily to a host target binding site located in an untranslated region of VGAM229 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM229 host target RNA into VGAM229 host target protein, herein schematically represented by VGAM1 HOST TARGET PROTEIN through VGAM3 HOST TARGET PROTEIN, all of FIG. 1.

VGAM230 RNA, herein schematically represented by VGAM1 RNA through VGAM3 RNA, binds complementarily to a host target binding site located in an untranslated region of VGAM230 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM230 host target RNA into VGAM230 host target protein, herein schematically represented by VGAM1 HOST TARGET PROTEIN through VGAM3 HOST TARGET PROTEIN, all of FIG. 1.

VGAM231 RNA, herein schematically represented by VGAM1 RNA through VGAM3 RNA, binds complementarily to a host target binding site located in an untranslated region of VGAM231 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM231 host target RNA into VGAM231 host target protein, herein schematically represented by VGAM1 HOST TARGET PROTEIN through VGAM3 HOST TARGET PROTEIN, all of FIG. 1.

VGAM232 RNA, herein schematically represented by VGAM1 RNA through VGAM3 RNA, binds complementarily to a host target binding site located in an untranslated region of VGAM232 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM232 host target RNA into VGAM232 host target protein, herein schematically represented by VGAM1 HOST TARGET PROTEIN through VGAM3 HOST TARGET PROTEIN, all of FIG. 1.

VGAM233 RNA, herein schematically represented by VGAM1 RNA through VGAM3 RNA, binds complementarily to a host target binding site located in an untranslated region of VGAM233 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM233 host target RNA into VGAM233 host target protein, herein schematically represented by VGAM1 HOST TARGET PROTEIN through VGAM3 HOST TARGET PROTEIN, all of FIG. 1.

VGAM234 RNA, herein schematically represented by VGAM1 RNA through VGAM3 RNA, binds complementarily to a host target binding site located in an untranslated region of VGAM234 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM234 host target RNA into VGAM234 host target protein, herein schematically represented by VGAM1 HOST TARGET PROTEIN through VGAM3 HOST TARGET PROTEIN, all of FIG. 1.

VGAM235 RNA, herein schematically represented by VGAM1 RNA through VGAM3 RNA, binds complementarily to a host target binding site located in an untranslated region of VGAM235 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM235 host target RNA into VGAM235 host target protein, herein schematically represented by VGAM1 HOST TARGET PROTEIN through VGAM3 HOST TARGET PROTEIN, all of FIG. 1.

It is appreciated that a function of VGR2772 gene, herein designated VGR GENE, is inhibition of expression of host target genes, as part of a novel viral mechanism of attacking a host. Accordingly, utilities of VGR2772 gene include diagnosis, prevention and treatment of viral infection by Callitrichine Herpesvirus 3. Specific functions, and accordingly utilities, of VGR2772 gene correlate with, and may be deduced from, the identity of the host target genes, which are inhibited by VGAM RNAs comprised in the 'operon-like' cluster of VGR2772 gene: VGAM228 host target protein, VGAM229 host target protein, VGAM230 host target protein, VGAM231 host target protein, VGAM232 host target protein, VGAM233 host target protein, VGAM234 host target protein and VGAM235 host target protein, herein schematically represented by VGAM1 HOST TARGET PROTEIN through VGAM3 HOST TARGET PROTEIN. The function of these host target genes is elaborated hereinabove with reference to VGAM228, VGAM229, VGAM230, VGAM231, VGAM232, VGAM233, VGAM234 and VGAM235. FIG. 9 further provides a conceptual description of novel bioinformatically detected regulatory viral gene, referred to here as Viral Genomic Record 2773(VGR2773) viral gene, which encodes an 'operon-like' cluster of novel viral micro RNA-like genes, each of which in turn modulates expression of at least one host target gene, the function and utility of which at least one host target gene is known in the art.

VGR2773 gene, herein designated VGR GENE, is a novel bioinformatically detected regulatory, non protein coding, RNA viral gene. The method by which VGR2773 gene was detected is described hereinabove with reference to FIGS. 1-9.

VGR2773 gene encodes VGR2773 precursor RNA, herein designated VGR PRECURSOR RNA, an RNA molecule, typically several hundred nucleotides long.

VGR2773 precursor RNA folds spatially, forming VGR2773 folded precursor RNA, herein designated VGR FOLDED PRECURSOR RNA. It is appreciated that VGR2773 folded precursor RNA comprises a plurality of what is known in the art as 'hairpin' structures. These 'hairpin' structures are due to the fact that the nucleotide sequence of VGR2773 precursor RNA comprises a plurality of segments, the first half of each such segment having a nucleotide sequence which is at least a partial inversed-reversed sequence of the second half thereof, as is well known in the art.

VGR2773 folded precursor RNA is naturally processed by cellular enzymatic activity into at least 8 separate VGAM precursor RNAs, VGAM236 precursor RNA, VGAM237 precursor RNA, VGAM238 precursor RNA, VGAM239 precursor RNA, VGAM240 precursor RNA, VGAM241 precursor RNA, VGAM242 precursor RNA and VGAM243 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM236 RNA, VGAM237 RNA, VGAM238 RNA, VGAM239 RNA, VGAM240 RNA, VGAM241 RNA, VGAM242 RNA and VGAM243 RNA, herein schematically represented by VGAM1 RNA through VGAM3 RNA, each of which VGAM RNAs corresponding to VGAM RNA of FIG. 1.

VGAM236 RNA, herein schematically represented by VGAM1 RNA through VGAM3 RNA, binds complementarily to a host target binding site located in an untranslated region of VGAM236 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM236 host target RNA into VGAM236 host target protein, herein schematically represented by VGAM1 HOST TARGET PROTEIN through VGAM3 HOST TARGET PROTEIN, all of FIG. 1.

VGAM237 RNA, herein schematically represented by VGAM1 RNA through VGAM3 RNA, binds complementarily to a host target binding site located in an untranslated region of VGAM237 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM237 host target RNA into VGAM237 host target protein, herein schematically represented by VGAM1 HOST TARGET PROTEIN through VGAM3 HOST TARGET PROTEIN, all of FIG. 1.

VGAM238 RNA, herein schematically represented by VGAM1 RNA through VGAM3 RNA, binds complementarily to a host target binding site located in an untranslated region of VGAM238 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM238 host target RNA into VGAM238 host target protein, herein schematically represented by VGAM1 HOST TARGET PROTEIN through VGAM3 HOST TARGET PROTEIN, all of FIG. 1.

VGAM239 RNA, herein schematically represented by VGAM1 RNA through VGAM3 RNA, binds complementarily to a host target binding site located in an untranslated region of VGAM239 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM239 host target RNA into VGAM239 host target protein, herein schematically represented by VGAM1 HOST TARGET PROTEIN through VGAM3 HOST TARGET PROTEIN, all of FIG. 1.

VGAM240 RNA, herein schematically represented by VGAM1 RNA through VGAM3 RNA, binds complementarily to a host target binding site located in an untranslated region of VGAM240 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM240 host target RNA into VGAM240 host target protein, herein schematically represented by VGAM1 HOST TARGET PROTEIN through VGAM3 HOST TARGET PROTEIN, all of FIG. 1.

VGAM241 RNA, herein schematically represented by VGAM1 RNA through VGAM3 RNA, binds complementarily to a host target binding site located in an untranslated region of VGAM241 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM241 host target RNA into VGAM241 host target protein, herein schematically represented by VGAM1 HOST TARGET PROTEIN through VGAM3 HOST TARGET PROTEIN, all of FIG. 1.

VGAM242 RNA, herein schematically represented by VGAM1 RNA through VGAM3 RNA, binds complementarily to a host target binding site located in an untranslated region of VGAM242 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM242 host target RNA into VGAM242 host target protein, herein schematically represented by VGAM1 HOST TARGET PROTEIN through VGAM3 HOST TARGET PROTEIN, all of FIG. 1.

VGAM243 RNA, herein schematically represented by VGAM1 RNA through VGAM3 RNA, binds complementarily to a host target binding site located in an untranslated region of VGAM243 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM243 host target RNA into VGAM243 host target protein, herein schematically represented by VGAM1 HOST TARGET PROTEIN through VGAM3 HOST TARGET PROTEIN, all of FIG. 1.

It is appreciated that a function of VGR2773 gene, herein designated VGR GENE, is inhibition of expression of host target genes, as part of a novel viral mechanism of attacking a host. Accordingly, utilities of VGR2773 gene include diagnosis, prevention and treatment of viral infection by Callitrichine Herpesvirus 3. Specific functions, and accordingly utilities, of VGR2773 gene correlate with, and may be deduced from, the identity of the host target genes, which are inhibited by VGAM RNAs comprised in the 'operon-like' cluster of VGR2773 gene: VGAM236 host target protein, VGAM237 host target protein, VGAM238 host target protein, VGAM239 host target protein, VGAM240 host target protein, VGAM241 host target protein, VGAM242 host target protein and VGAM243 host target protein, herein schematically represented by VGAM1 HOST TARGET PROTEIN through VGAM3 HOST TARGET PROTEIN. The function of these host target genes is elaborated hereinabove with reference to VGAM236, VGAM237, VGAM238, VGAM239, VGAM240, VGAM241, VGAM242 and VGAM243. FIG. 9 further provides a conceptual description of novel bioinformatically detected regulatory viral gene, referred to here as Viral Genomic Record 2774(VGR2774) viral gene, which encodes an 'operon-like' cluster of novel viral micro RNA-like genes, each of which in turn modulates expression of at least one host target gene, the function and utility of which at least one host target gene is known in the art.

VGR2774 gene, herein designated VGR GENE, is a novel bioinformatically detected regulatory, non protein coding, RNA viral gene. The method by which VGR2774 gene was detected is described hereinabove with reference to FIGS. 1-9.

VGR2774 gene encodes VGR2774 precursor RNA, herein designated VGR PRECURSOR RNA, an RNA molecule, typically several hundred nucleotides long.

VGR2774 precursor RNA folds spatially, forming VGR2774 folded precursor RNA, herein designated VGR FOLDED PRECURSOR RNA. It is appreciated that VGR2774 folded precursor RNA comprises a plurality of what is known in the art as 'hairpin' structures. These 'hairpin' structures are due to the fact that the nucleotide sequence of VGR2774 precursor RNA comprises a plurality of segments, the first half of each such segment having a nucleotide sequence which is at least a partial inversed-reversed sequence of the second half thereof, as is well known in the art.

VGR2774 folded precursor RNA is naturally processed by cellular enzymatic activity into at least 8 separate VGAM precursor RNAs, VGAM244 precursor RNA, VGAM245 precursor RNA, VGAM246 precursor RNA, VGAM247 precursor RNA, VGAM248 precursor RNA, VGAM249 precursor RNA, VGAM250 precursor RNA and VGAM251 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM244 RNA, VGAM245 RNA, VGAM246 RNA, VGAM247 RNA, VGAM248 RNA, VGAM249 RNA, VGAM250 RNA and VGAM251 RNA, herein schematically represented by VGAM1 RNA through VGAM3 RNA, each of which VGAM RNAs corresponding to VGAM RNA of FIG. 1.

VGAM244 RNA, herein schematically represented by VGAM1 RNA through VGAM3 RNA, binds complementarily to a host target binding site located in an untranslated region of VGAM244 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM244 host target RNA into VGAM244 host target protein, herein schematically represented by VGAM1 HOST TARGET PROTEIN through VGAM3 HOST TARGET PROTEIN, all of FIG. 1.

VGAM245 RNA, herein schematically represented by VGAM1 RNA through VGAM3 RNA, binds complementarily to a host target binding site located in an untranslated region of VGAM245 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM245 host target RNA into VGAM245 host target protein, herein schematically represented by VGAM1 HOST TARGET PROTEIN through VGAM3 HOST TARGET PROTEIN, all of FIG. 1.

VGAM246 RNA, herein schematically represented by VGAM1 RNA through VGAM3 RNA, binds complementarily to a host target binding site located in an untranslated region of VGAM246 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM246 host target RNA into VGAM246 host target protein, herein schematically represented by VGAM1 HOST TARGET PROTEIN through VGAM3 HOST TARGET PROTEIN, all of FIG. 1.

VGAM247 RNA, herein schematically represented by VGAM1 RNA through VGAM3 RNA, binds complementarily to a host target binding site located in an untranslated region of VGAM247 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM247 host target RNA into VGAM247 host target protein, herein schematically represented by VGAM1 HOST TARGET PROTEIN through VGAM3 HOST TARGET PROTEIN, all of FIG. 1.

VGAM248 RNA, herein schematically represented by VGAM1 RNA through VGAM3 RNA, binds complementarily to a host target binding site located in an untranslated region of VGAM248 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM248 host target RNA into VGAM248 host target protein, herein schematically represented by VGAM1 HOST TARGET PROTEIN through VGAM3 HOST TARGET PROTEIN, all of FIG. 1.

VGAM249 RNA, herein schematically represented by VGAM1 RNA through VGAM3 RNA, binds complementarily to a host target binding site located in an untranslated region of VGAM249 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM249 host target RNA into VGAM249 host target protein, herein schematically represented by VGAM1 HOST TARGET PROTEIN through VGAM3 HOST TARGET PROTEIN, all of FIG. 1.

VGAM250 RNA, herein schematically represented by VGAM1 RNA through VGAM3 RNA, binds complementarily to a host target binding site located in an untranslated region of VGAM250 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM250 host target RNA into VGAM250 host target protein, herein schematically represented by VGAM1 HOST TARGET PROTEIN through VGAM3 HOST TARGET PROTEIN, all of FIG. 1.

VGAM251 RNA, herein schematically represented by VGAM1 RNA through VGAM3 RNA, binds complementarily to a host target binding site located in an untranslated region of VGAM251 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM251 host target RNA into VGAM251 host target protein, herein schematically represented by VGAM1 HOST TARGET PROTEIN through VGAM3 HOST TARGET PROTEIN, all of FIG. 1.

It is appreciated that a function of VGR2774 gene, herein designated VGR GENE, is inhibition of expression of host target genes, as part of a novel viral mechanism of attacking a host. Accordingly, utilities of VGR2774 gene include diagnosis, prevention and treatment of viral infection by Callitrichine Herpesvirus 3. Specific functions, and accordingly utilities, of VGR2774 gene correlate with, and may be deduced from, the identity of the host target genes, which are inhibited by VGAM RNAs comprised in the 'operon-like' cluster of VGR2774 gene: VGAM244 host target protein, VGAM245 host target protein, VGAM246 host target protein, VGAM247 host target protein, VGAM248 host target protein, VGAM249 host target protein, VGAM250 host target protein and VGAM251 host target protein, herein schematically represented by VGAM1 HOST TARGET PROTEIN through VGAM3 HOST TARGET PROTEIN. The function of these host target genes is elaborated hereinabove with reference to VGAM244, VGAM245, VGAM246, VGAM247, VGAM248, VGAM249, VGAM250 and VGAM251. FIG. 9 further provides a conceptual description of novel bioinformatically detected regulatory viral gene, referred to here as Viral Genomic Record 2775(VGR2775) viral gene, which encodes an 'operon-like' cluster of novel viral micro RNA-like genes, each of which in turn modulates expression of at least one host target gene, the function and utility of which at least one host target gene is known in the art.

VGR2775 gene, herein designated VGR GENE, is a novel bioinformatically detected regulatory, non protein coding, RNA viral gene. The method by which VGR2775 gene was detected is described hereinabove with reference to FIGS. 1-9.

VGR2775 gene encodes VGR2775 precursor RNA, herein designated VGR PRECURSOR RNA, an RNA molecule, typically several hundred nucleotides long.

VGR2775 precursor RNA folds spatially, forming VGR2775 folded precursor RNA, herein designated VGR FOLDED PRECURSOR RNA. It is appreciated that VGR2775 folded precursor RNA comprises a plurality of what is known in the art as 'hairpin' structures. These 'hairpin' structures are due to the fact that the nucleotide sequence of VGR2775 precursor RNA comprises a plurality of segments, the first half of each such segment having a nucleotide sequence which is at least a partial inversed-reversed sequence of the second half thereof, as is well known in the art.

VGR2775 folded precursor RNA is naturally processed by cellular enzymatic activity into at least 8 separate VGAM precursor RNAs, VGAM252 precursor RNA, VGAM253 precursor RNA, VGAM254 precursor RNA, VGAM255 precursor RNA, VGAM256 precursor RNA, VGAM257 precursor RNA, VGAM258 precursor RNA and VGAM259 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM252 RNA, VGAM253 RNA, VGAM254 RNA, VGAM255 RNA, VGAM256 RNA, VGAM257 RNA, VGAM258 RNA and VGAM259 RNA, herein schematically represented by VGAM1 RNA through VGAM3 RNA, each of which VGAM RNAs corresponding to VGAM RNA of FIG. 1.

VGAM252 RNA, herein schematically represented by VGAM1 RNA through VGAM3 RNA, binds complementarily to a host target binding site located in an untranslated region of VGAM252 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM252 host target RNA into VGAM252 host target protein, herein schematically represented by VGAM1 HOST TARGET PROTEIN through VGAM3 HOST TARGET PROTEIN, all of FIG. 1.

VGAM253 RNA, herein schematically represented by VGAM1 RNA through VGAM3 RNA, binds complementarily to a host target binding site located in an untranslated region of VGAM253 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM253 host target RNA into VGAM253 host target protein, herein schematically represented by VGAM1 HOST TARGET PROTEIN through VGAM3 HOST TARGET PROTEIN, all of FIG. 1.

VGAM254 RNA, herein schematically represented by VGAM1 RNA through VGAM3 RNA, binds complementarily to a host target binding site located in an untranslated region of VGAM254 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM254 host target RNA into VGAM254 host target protein, herein schematically represented by VGAM1 HOST TARGET PROTEIN through VGAM3 HOST TARGET PROTEIN, all of FIG. 1.

VGAM255 RNA, herein schematically represented by VGAM1 RNA through VGAM3 RNA, binds complementarily to a host target binding site located in an untranslated region of VGAM255 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM255 host target RNA into VGAM255 host target protein, herein schematically represented by VGAM1 HOST TARGET PROTEIN through VGAM3 HOST TARGET PROTEIN, all of FIG. 1.

VGAM256 RNA, herein schematically represented by VGAM1 RNA through VGAM3 RNA, binds complementarily to a host target binding site located in an untranslated region of VGAM256 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM256 host target RNA into VGAM256 host target protein, herein schematically represented by VGAM1 HOST TARGET PROTEIN through VGAM3 HOST TARGET PROTEIN, all of FIG. 1.

VGAM257 RNA, herein schematically represented by VGAM1 RNA through VGAM3 RNA, binds complementarily to a host target binding site located in an untranslated region of VGAM257 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM257 host target RNA into VGAM257 host target protein, herein schematically represented by VGAM1 HOST TARGET PROTEIN through VGAM3 HOST TARGET PROTEIN, all of FIG. 1.

VGAM258 RNA, herein schematically represented by VGAM1 RNA through VGAM3 RNA, binds complementarily to a host target binding site located in an untranslated region of VGAM258 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM258 host target RNA into VGAM258 host target protein, herein schematically represented by VGAM1 HOST TARGET PROTEIN through VGAM3 HOST TARGET PROTEIN, all of FIG. 1.

VGAM259 RNA, herein schematically represented by VGAM1 RNA through VGAM3 RNA, binds complementarily to a host target binding site located in an untranslated region of VGAM259 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM259 host target RNA into VGAM259 host target protein, herein schematically represented by VGAM1 HOST TARGET PROTEIN through VGAM3 HOST TARGET PROTEIN, all of FIG. 1.

It is appreciated that a function of VGR2775 gene, herein designated VGR GENE, is inhibition of expression of host target genes, as part of a novel viral mechanism of attacking a host. Accordingly, utilities of VGR2775 gene include diagnosis, prevention and treatment of viral infection by Callitrichine Herpesvirus 3. Specific functions, and accordingly utilities, of VGR2775 gene correlate with, and may be deduced from, the identity of the host target genes, which are inhibited by VGAM RNAs comprised in the 'operon-like' cluster of VGR2775 gene: VGAM252 host target protein, VGAM253 host target protein, VGAM254 host target protein, VGAM255 host target protein, VGAM256 host target protein, VGAM257 host target protein, VGAM258 host target protein and VGAM259 host target protein, herein schematically represented by VGAM1 HOST TARGET PROTEIN through VGAM3 HOST TARGET PROTEIN. The function of these host target genes is elaborated hereinabove with reference to VGAM252, VGAM253, VGAM254, VGAM255, VGAM256, VGAM257, VGAM258 and VGAM259. FIG. 9 further provides a conceptual description of novel bioinformatically detected regulatory viral gene, referred to here as Viral Genomic Record 2776(VGR2776) viral gene, which encodes an 'operon-like' cluster of novel viral micro RNA-like genes, each of which in turn modulates expression of at least one host target gene, the function and utility of which at least one host target gene is known in the art.

VGR2776 gene, herein designated VGR GENE, is a novel bioinformatically detected regulatory, non protein coding, RNA viral gene. The method by which VGR2776 gene was detected is described hereinabove with reference to FIGS. 1-9.

VGR2776 gene encodes VGR2776 precursor RNA, herein designated VGR PRECURSOR RNA, an RNA molecule, typically several hundred nucleotides long.

VGR2776 precursor RNA folds spatially, forming VGR2776 folded precursor RNA, herein designated VGR FOLDED PRECURSOR RNA. It is appreciated that VGR2776 folded precursor RNA comprises a plurality of what is known in the art as 'hairpin' structures. These 'hairpin' structures are due to the fact that the nucleotide sequence of VGR2776 precursor RNA comprises a plurality of segments, the first half of each such segment having a nucleotide sequence which is at least a partial inversed-reversed sequence of the second half thereof, as is well known in the art.

VGR2776 folded precursor RNA is naturally processed by cellular enzymatic activity into at least 6 separate VGAM precursor RNAs, VGAM260 precursor RNA, VGAM261 precursor RNA, VGAM262 precursor RNA, VGAM263 precursor RNA, VGAM264 precursor RNA and VGAM265 precursor RNA, herein schematically represented by VGAM1 FOLDED PRECURSOR through VGAM3 FOLDED PRE- CURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM260 RNA, VGAM261 RNA, VGAM262 RNA, VGAM263 RNA, VGAM264 RNA and VGAM265 RNA, herein schematically represented by VGAM1 RNA through VGAM3 RNA, each of which VGAM RNAs corresponding to VGAM RNA of FIG. 1.

VGAM260 RNA, herein schematically represented by VGAM1 RNA through VGAM3 RNA, binds complementarily to a host target binding site located in an untranslated region of VGAM260 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM260 host target RNA into VGAM260 host target protein, herein schematically represented by VGAM1 HOST TARGET PROTEIN through VGAM3 HOST TARGET PROTEIN, all of FIG. 1.

VGAM261 RNA, herein schematically represented by VGAM1 RNA through VGAM3 RNA, binds complementarily to a host target binding site located in an untranslated region of VGAM261 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM261 host target RNA into VGAM261 host target protein, herein schematically represented by VGAM1 HOST TARGET PROTEIN through VGAM3 HOST TARGET PROTEIN, all of FIG. 1.

VGAM262 RNA, herein schematically represented by VGAM1 RNA through VGAM3 RNA, binds complementarily to a host target binding site located in an untranslated region of VGAM262 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM262 host target RNA into VGAM262 host target protein, herein schematically represented by VGAM1 HOST TARGET PROTEIN through VGAM3 HOST TARGET PROTEIN, all of FIG. 1.

VGAM263 RNA, herein schematically represented by VGAM1 RNA through VGAM3 RNA, binds complementarily to a host target binding site located in an untranslated region of VGAM263 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM263 host target RNA into VGAM263 host target protein, herein schematically represented by VGAM1 HOST TARGET PROTEIN through VGAM3 HOST TARGET PROTEIN, all of FIG. 1.

VGAM264 RNA, herein schematically represented by VGAM1 RNA through VGAM3 RNA, binds complementarily to a host target binding site located in an untranslated region of VGAM264 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM264 host target RNA into VGAM264 host target protein, herein schematically represented by VGAM1 HOST TARGET PROTEIN through VGAM3 HOST TARGET PROTEIN, all of FIG. 1.

VGAM265 RNA, herein schematically represented by VGAM1 RNA through VGAM3 RNA, binds complementarily to a host target binding site located in an untranslated region of VGAM265 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM265 host target RNA into VGAM265 host target protein, herein schematically represented by VGAM1 HOST TARGET PROTEIN through VGAM3 HOST TARGET PROTEIN, all of FIG. 1.

It is appreciated that a function of VGR2776 gene, herein designated VGR GENE, is inhibition of expression of host target genes, as part of a novel viral mechanism of attacking a host. Accordingly, utilities of VGR2776 gene include diagnosis, prevention and treatment of viral infection by Callitrichine Herpesvirus 3. Specific functions, and accordingly utilities, of VGR2776 gene correlate with, and may be deduced from, the identity of the host target genes, which are inhibited by VGAM RNAs comprised in the 'operon-like' cluster of VGR2776 gene: VGAM260 host target protein, VGAM261 host target protein, VGAM262 host target protein, VGAM263 host target protein, VGAM264 host target protein and VGAM265 host target protein, herein schematically represented by VGAM1 HOST TARGET PROTEIN through VGAM3 HOST TARGET PROTEIN. The function of these host target genes is elaborated hereinabove with reference to VGAM260, VGAM261, VGAM262, VGAM263, VGAM264 and VGAM265. FIG. 9 further provides a conceptual description of novel bioinformatically detected regulatory viral gene, referred to here as Viral Genomic Record 2777(VGR2777) viral gene, which encodes an 'operon-like' cluster of novel viral micro RNA-like genes, each of which in turn modulates expression of at least one host target gene, the function and utility of which at least one host target gene is known in the art.

VGR2777 gene, herein designated VGR GENE, is a novel bioinformatically detected regulatory, non protein coding, RNA viral gene. The method by which VGR2777 gene was detected is described hereinabove with reference to FIGS. 1-9.

VGR2777 gene encodes VGR2777 precursor RNA, herein designated VGR PRECURSOR RNA, an RNA molecule, typically several hundred nucleotides long.

VGR2777 precursor RNA folds spatially, forming VGR2777 folded precursor RNA, herein designated VGR FOLDED PRECURSOR RNA. It is appreciated that VGR2777 folded precursor RNA comprises a plurality of what is known in the art as 'hairpin' structures. These 'hairpin' structures are due to the fact that the nucleotide sequence of VGR2777 precursor RNA comprises a plurality of segments, the first half of each such segment having a nucleotide sequence which is at least a partial inversed-reversed sequence of the second half thereof, as is well known in the art.

VGR2777 folded precursor RNA is naturally processed by cellular enzymatic activity into at least 8 separate VGAM precursor RNAs, VGAM266 precursor RNA, VGAM267 precursor RNA, VGAM268 precursor RNA, VGAM269 precursor RNA, VGAM270 precursor RNA, VGAM271 precursor RNA, VGAM272 precursor RNA and VGAM273 precursor RNA, herein schematically represented by VGAM1

FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM266 RNA, VGAM267 RNA, VGAM268 RNA, VGAM269 RNA, VGAM270 RNA, VGAM271 RNA, VGAM272 RNA and VGAM273 RNA, herein schematically represented by VGAM1 RNA through VGAM3 RNA, each of which VGAM RNAs corresponding to VGAM RNA of FIG. 1.

VGAM266 RNA, herein schematically represented by VGAM1 RNA through VGAM3 RNA, binds complementarily to a host target binding site located in an untranslated region of VGAM266 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM266 host target RNA into VGAM266 host target protein, herein schematically represented by VGAM1 HOST TARGET PROTEIN through VGAM3 HOST TARGET PROTEIN, all of FIG. 1.

VGAM267 RNA, herein schematically represented by VGAM1 RNA through VGAM3 RNA, binds complementarily to a host target binding site located in an untranslated region of VGAM267 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM267 host target RNA into VGAM267 host target protein, herein schematically represented by VGAM1 HOST TARGET PROTEIN through VGAM3 HOST TARGET PROTEIN, all of FIG. 1.

VGAM268 RNA, herein schematically represented by VGAM1 RNA through VGAM3 RNA, binds complementarily to a host target binding site located in an untranslated region of VGAM268 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM268 host target RNA into VGAM268 host target protein, herein schematically represented by VGAM1 HOST TARGET PROTEIN through VGAM3 HOST TARGET PROTEIN, all of FIG. 1.

VGAM269 RNA, herein schematically represented by VGAM1 RNA through VGAM3 RNA, binds complementarily to a host target binding site located in an untranslated region of VGAM269 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM269 host target RNA into VGAM269 host target protein, herein schematically represented by VGAM1 HOST TARGET PROTEIN through VGAM3 HOST TARGET PROTEIN, all of FIG. 1.

VGAM270 RNA, herein schematically represented by VGAM1 RNA through VGAM3 RNA, binds complementarily to a host target binding site located in an untranslated region of VGAM270 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM270 host target RNA into VGAM270 host target protein, herein schematically represented by VGAM1 HOST TARGET PROTEIN through VGAM3 HOST TARGET PROTEIN, all of FIG. 1.

VGAM271 RNA, herein schematically represented by VGAM1 RNA through VGAM3 RNA, binds complementarily to a host target binding site located in an untranslated region of VGAM271 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM271 host target RNA into VGAM271 host target protein, herein schematically represented by VGAM1 HOST TARGET PROTEIN through VGAM3 HOST TARGET PROTEIN, all of FIG. 1.

VGAM272 RNA, herein schematically represented by VGAM1 RNA through VGAM3 RNA, binds complementarily to a host target binding site located in an untranslated region of VGAM272 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM272 host target RNA into VGAM272 host target protein, herein schematically represented by VGAM1 HOST TARGET PROTEIN through VGAM3 HOST TARGET PROTEIN, all of FIG. 1.

VGAM273 RNA, herein schematically represented by VGAM1 RNA through VGAM3 RNA, binds complementarily to a host target binding site located in an untranslated region of VGAM273 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM273 host target RNA into VGAM273 host target protein, herein schematically represented by VGAM1 HOST TARGET PROTEIN through VGAM3 HOST TARGET PROTEIN, all of FIG. 1.

It is appreciated that a function of VGR2777 gene, herein designated VGR GENE, is inhibition of expression of host target genes, as part of a novel viral mechanism of attacking a host. Accordingly, utilities of VGR2777 gene include diagnosis, prevention and treatment of viral infection by Epiphyas Postvittana Nucleopolyhedrovirus. Specific functions, and accordingly utilities, of VGR2777 gene correlate with, and may be deduced from, the identity of the host target genes, which are inhibited by VGAM RNAs comprised in the 'operon-like' cluster of VGR2777 gene: VGAM266 host target protein, VGAM267 host target protein, VGAM268 host target protein, VGAM269 host target protein, VGAM270 host target protein, VGAM271 host target protein, VGAM272 host target protein and VGAM273 host target protein, herein schematically represented by VGAM1 HOST TARGET PROTEIN through VGAM3 HOST TARGET PROTEIN. The function of these host target genes is elaborated hereinabove with reference to VGAM266, VGAM267, VGAM268, VGAM269, VGAM270, VGAM271, VGAM272 and VGAM273. FIG. 9 further provides a conceptual description of novel bioinformatically detected regulatory viral gene, referred to here as Viral Genomic Record 2778(VGR2778) viral gene, which encodes an 'operon-like' cluster of novel viral micro RNA-like genes, each of which in turn modulates expression of at least one host target gene, the function and utility of which at least one host target gene is known in the art.

VGR2778 gene, herein designated VGR GENE, is a novel bioinformatically detected regulatory, non protein coding, RNA viral gene. The method by which VGR2778 gene was detected is described hereinabove with reference to FIGS. 1-9.

VGR2778 gene encodes VGR2778 precursor RNA, herein designated VGR PRECURSOR RNA, an RNA molecule, typically several hundred nucleotides long.

VGR2778 precursor RNA folds spatially, forming VGR2778 folded precursor RNA, herein designated VGR FOLDED PRECURSOR RNA. It is appreciated that VGR2778 folded precursor RNA comprises a plurality of what is known in the art as 'hairpin' structures. These 'hairpin' structures are due to the fact that the nucleotide sequence of VGR2778 precursor RNA comprises a plurality of segments, the first half of each such segment having a nucleotide sequence which is at least a partial inversed-reversed sequence of the second half thereof, as is well known in the art.

VGR2778 folded precursor RNA is naturally processed by cellular enzymatic activity into at least 8 separate VGAM precursor RNAs, VGAM274 precursor RNA, VGAM275 precursor RNA, VGAM276 precursor RNA, VGAM277 precursor RNA, VGAM278 precursor RNA, VGAM279 precursor RNA, VGAM280 precursor RNA and VGAM281 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM274 RNA, VGAM275 RNA, VGAM276 RNA, VGAM277 RNA, VGAM278 RNA, VGAM279 RNA, VGAM280 RNA and VGAM281 RNA, herein schematically represented by VGAM1 RNA through VGAM3 RNA, each of which VGAM RNAs corresponding to VGAM RNA of FIG. 1.

VGAM274 RNA, herein schematically represented by VGAM1 RNA through VGAM3 RNA, binds complementarily to a host target binding site located in an untranslated region of VGAM274 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM274 host target RNA into VGAM274 host target protein, herein schematically represented by VGAM1 HOST TARGET PROTEIN through VGAM3 HOST TARGET PROTEIN, all of FIG. 1.

VGAM275 RNA, herein schematically represented by VGAM1 RNA through VGAM3 RNA, binds complementarily to a host target binding site located in an untranslated region of VGAM275 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM275 host target RNA into VGAM275 host target protein, herein schematically represented by VGAM1 HOST TARGET PROTEIN through VGAM3 HOST TARGET PROTEIN, all of FIG. 1.

VGAM276 RNA, herein schematically represented by VGAM1 RNA through VGAM3 RNA, binds complementarily to a host target binding site located in an untranslated region of VGAM276 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM276 host target RNA into VGAM276 host target protein, herein schematically represented by VGAM1 HOST TARGET PROTEIN through VGAM3 HOST TARGET PROTEIN, all of FIG. 1.

VGAM277 RNA, herein schematically represented by VGAM1 RNA through VGAM3 RNA, binds complementarily to a host target binding site located in an untranslated region of VGAM277 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM277 host target RNA into VGAM277 host target protein, herein schematically represented by VGAM1 HOST TARGET PROTEIN through VGAM3 HOST TARGET PROTEIN, all of FIG. 1.

VGAM278 RNA, herein schematically represented by VGAM1 RNA through VGAM3 RNA, binds complementarily to a host target binding site located in an untranslated region of VGAM278 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM278 host target RNA into VGAM278 host target protein, herein schematically represented by VGAM1 HOST TARGET PROTEIN through VGAM3 HOST TARGET PROTEIN, all of FIG. 1.

VGAM279 RNA, herein schematically represented by VGAM1 RNA through VGAM3 RNA, binds complementarily to a host target binding site located in an untranslated region of VGAM279 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM279 host target RNA into VGAM279 host target protein, herein schematically represented by VGAM1 HOST TARGET PROTEIN through VGAM3 HOST TARGET PROTEIN, all of FIG. 1.

VGAM280 RNA, herein schematically represented by VGAM1 RNA through VGAM3 RNA, binds complementarily to a host target binding site located in an untranslated region of VGAM280 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM280 host target RNA into VGAM280 host target protein, herein schematically represented by VGAM1 HOST TARGET PROTEIN through VGAM3 HOST TARGET PROTEIN, all of FIG. 1.

VGAM281 RNA, herein schematically represented by VGAM1 RNA through VGAM3 RNA, binds complementarily to a host target binding site located in an untranslated region of VGAM281 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM281 host target RNA into VGAM281 host target protein, herein schematically represented by VGAM1 HOST TARGET PROTEIN through VGAM3 HOST TARGET PROTEIN, all of FIG. 1.

It is appreciated that a function of VGR2778 gene, herein designated VGR GENE, is inhibition of expression of host target genes, as part of a novel viral mechanism of attacking a host. Accordingly, utilities of VGR2778 gene include diagnosis, prevention and treatment of viral infection by Epiphyas Postvittana Nucleopolyhedrovirus. Specific functions, and accordingly utilities, of VGR2778 gene correlate with, and may be deduced from, the identity of the host target genes, which are inhibited by VGAM RNAs comprised in the 'operon-like' cluster of VGR2778 gene: VGAM274 host target protein, VGAM275 host target protein, VGAM276 host target protein, VGAM277 host target protein, VGAM278 host target protein, VGAM279 host target protein, VGAM280 host target protein and VGAM281 host target protein, herein schematically represented by VGAM1 HOST TARGET PROTEIN through VGAM3 HOST TARGET PROTEIN. The function of these host target genes is elaborated hereinabove with reference to VGAM274, VGAM275, VGAM276, VGAM277, VGAM278, VGAM279, VGAM280 and VGAM281. FIG. 9 further provides a conceptual description of novel bioinformatically detected regulatory viral gene, referred to here as Viral Genomic Record 2779(VGR2779) viral gene, which encodes an 'operon-like' cluster of novel viral micro RNA-like genes, each of which in turn modulates expression of at least one host target gene, the function and utility of which at least one host target gene is known in the art.

VGR2779 gene, herein designated VGR GENE, is a novel bioinformatically detected regulatory, non protein coding, RNA viral gene. The method by which VGR2779 gene was detected is described hereinabove with reference to FIGS. 1-9.

VGR2779 gene encodes VGR2779 precursor RNA, herein designated VGR PRECURSOR RNA, an RNA molecule, typically several hundred nucleotides long.

VGR2779 precursor RNA folds spatially, forming VGR2779 folded precursor RNA, herein designated VGR FOLDED PRECURSOR RNA. It is appreciated that VGR2779 folded precursor RNA comprises a plurality of what is known in the art as 'hairpin' structures. These 'hairpin' structures are due to the fact that the nucleotide sequence of VGR2779 precursor RNA comprises a plurality of segments, the first half of each such segment having a nucleotide sequence which is at least a partial inversed-reversed sequence of the second half thereof, as is well known in the art.

VGR2779 folded precursor RNA is naturally processed by cellular enzymatic activity into at least 8 separate VGAM precursor RNAs, VGAM282 precursor RNA, VGAM283 precursor RNA, VGAM284 precursor RNA, VGAM285 precursor RNA, VGAM286 precursor RNA, VGAM287 precursor RNA, VGAM288 precursor RNA and VGAM289 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM282 RNA, VGAM283 RNA, VGAM284 RNA, VGAM285 RNA, VGAM286 RNA, VGAM287 RNA, VGAM288 RNA and VGAM289 RNA, herein schematically represented by VGAM1 RNA through VGAM3 RNA, each of which VGAM RNAs corresponding to VGAM RNA of FIG. 1.

VGAM282 RNA, herein schematically represented by VGAM1 RNA through VGAM3 RNA, binds complementarily to a host target binding site located in an untranslated region of VGAM282 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM282 host target RNA into VGAM282 host target protein, herein schematically represented by VGAM1 HOST TARGET PROTEIN through VGAM3 HOST TARGET PROTEIN, all of FIG. 1.

VGAM283 RNA, herein schematically represented by VGAM1 RNA through VGAM3 RNA, binds complementarily to a host target binding site located in an untranslated region of VGAM283 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM283 host target RNA into VGAM283 host target protein, herein schematically represented by VGAM1 HOST TARGET PROTEIN through VGAM3 HOST TARGET PROTEIN, all of FIG. 1.

VGAM284 RNA, herein schematically represented by VGAM1 RNA through VGAM3 RNA, binds complementarily to a host target binding site located in an untranslated region of VGAM284 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM284 host target RNA into VGAM284 host target protein, herein schematically represented by VGAM1 HOST TARGET PROTEIN through VGAM3 HOST TARGET PROTEIN, all of FIG. 1.

VGAM285 RNA, herein schematically represented by VGAM1 RNA through VGAM3 RNA, binds complementarily to a host target binding site located in an untranslated region of VGAM285 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM285 host target RNA into VGAM285 host target protein, herein schematically represented by VGAM1 HOST TARGET PROTEIN through VGAM3 HOST TARGET PROTEIN, all of FIG. 1.

VGAM286 RNA, herein schematically represented by VGAM1 RNA through VGAM3 RNA, binds complementarily to a host target binding site located in an untranslated region of VGAM286 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM286 host target RNA into VGAM286 host target protein, herein schematically represented by VGAM1 HOST TARGET PROTEIN through VGAM3 HOST TARGET PROTEIN, all of FIG. 1.

VGAM287 RNA, herein schematically represented by VGAM1 RNA through VGAM3 RNA, binds complementarily to a host target binding site located in an untranslated region of VGAM287 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM287 host target RNA into VGAM287 host target protein, herein schematically represented by VGAM1 HOST TARGET PROTEIN through VGAM3 HOST TARGET PROTEIN, all of FIG. 1.

VGAM288 RNA, herein schematically represented by VGAM1 RNA through VGAM3 RNA, binds complementarily to a host target binding site located in an untranslated region of VGAM288 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM288 host target RNA into VGAM288 host target protein, herein schematically represented by VGAM1 HOST TARGET PROTEIN through VGAM3 HOST TARGET PROTEIN, all of FIG. 1.

VGAM289 RNA, herein schematically represented by VGAM1 RNA through VGAM3 RNA, binds complementarily to a host target binding site located in an untranslated region of VGAM289 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM289 host target RNA into VGAM289 host target protein, herein schematically represented by VGAM1 HOST TARGET PROTEIN through VGAM3 HOST TARGET PROTEIN, all of FIG. 1.

It is appreciated that a function of VGR2779 gene, herein designated VGR GENE, is inhibition of expression of host target genes, as part of a novel viral mechanism of attacking a host. Accordingly, utilities of VGR2779 gene include diagnosis, prevention and treatment of viral infection by Epiphyas Postvittana Nucleopolyhedrovirus. Specific functions, and accordingly utilities, of VGR2779 gene correlate with, and may be deduced from, the identity of the host target genes, which are inhibited by VGAM RNAs comprised in the 'operon-like' cluster of VGR2779 gene: VGAM282 host target protein, VGAM283 host target protein, VGAM284 host target protein, VGAM285 host target protein, VGAM286 host target protein, VGAM287 host target protein, VGAM288 host target protein and VGAM289 host target protein, herein schematically represented by VGAM1 HOST TARGET PROTEIN through VGAM3 HOST TARGET PROTEIN. The function of these host target genes is elaborated hereinabove with reference to VGAM282, VGAM283, VGAM284, VGAM285, VGAM286, VGAM287, VGAM288 and VGAM289. FIG. 9 further provides a conceptual description of novel bioinformatically detected regulatory viral gene, referred to here as Viral Genomic Record 2780(VGR2780) viral gene, which encodes an 'operon-like' cluster of novel viral micro RNA-like genes, each of which in turn modulates expression of at least one host target gene, the function and utility of which at least one host target gene is known in the art.

VGR2780 gene, herein designated VGR GENE, is a novel bioinformatically detected regulatory, non protein coding, RNA viral gene. The method by which VGR2780 gene was detected is described hereinabove with reference to FIGS. 1-9.

VGR2780 gene encodes VGR2780 precursor RNA, herein designated VGR PRECURSOR RNA, an RNA molecule, typically several hundred nucleotides long.

VGR2780 precursor RNA folds spatially, forming VGR2780 folded precursor RNA, herein designated VGR FOLDED PRECURSOR RNA. It is appreciated that VGR2780 folded precursor RNA comprises a plurality of what is known in the art as 'hairpin' structures. These 'hairpin' structures are due to the fact that the nucleotide sequence of VGR2780 precursor RNA comprises a plurality of segments, the first half of each such segment having a nucleotide sequence which is at least a partial inversed-reversed sequence of the second half thereof, as is well known in the art.

VGR2780 folded precursor RNA is naturally processed by cellular enzymatic activity into at least 8 separate VGAM precursor RNAs, VGAM290 precursor RNA, VGAM291 precursor RNA, VGAM292 precursor RNA, VGAM293 precursor RNA, VGAM294 precursor RNA, VGAM295 precursor RNA, VGAM296 precursor RNA and VGAM297 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM290 RNA, VGAM291 RNA, VGAM292 RNA, VGAM293 RNA, VGAM294 RNA, VGAM295 RNA, VGAM296 RNA and VGAM297 RNA, herein schematically represented by VGAM1 RNA through VGAM3 RNA, each of which VGAM RNAs corresponding to VGAM RNA of FIG. 1.

VGAM290 RNA, herein schematically represented by VGAM1 RNA through VGAM3 RNA, binds complementarily to a host target binding site located in an untranslated region of VGAM290 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM290 host target RNA into VGAM290 host target protein, herein schematically represented by VGAM1 HOST TARGET PROTEIN through VGAM3 HOST TARGET PROTEIN, all of FIG. 1.

VGAM291 RNA, herein schematically represented by VGAM1 RNA through VGAM3 RNA, binds complementarily to a host target binding site located in an untranslated region of VGAM291 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM291 host target RNA into VGAM291 host target protein, herein schematically represented by VGAM1 HOST TARGET PROTEIN through VGAM3 HOST TARGET PROTEIN, all of FIG. 1.

VGAM292 RNA, herein schematically represented by VGAM1 RNA through VGAM3 RNA, binds complementarily to a host target binding site located in an untranslated region of VGAM292 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM292 host target RNA into VGAM292 host target protein, herein schematically represented by VGAM1 HOST TARGET PROTEIN through VGAM3 HOST TARGET PROTEIN, all of FIG. 1.

VGAM293 RNA, herein schematically represented by VGAM1 RNA through VGAM3 RNA, binds complementarily to a host target binding site located in an untranslated region of VGAM293 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM293 host target RNA into VGAM293 host target protein, herein schematically represented by VGAM1 HOST TARGET PROTEIN through VGAM3 HOST TARGET PROTEIN, all of FIG. 1.

VGAM294 RNA, herein schematically represented by VGAM1 RNA through VGAM3 RNA, binds complementarily to a host target binding site located in an untranslated region of VGAM294 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM294 host target RNA into VGAM294 host target protein, herein schematically represented by VGAM1 HOST TARGET PROTEIN through VGAM3 HOST TARGET PROTEIN, all of FIG. 1.

VGAM295 RNA, herein schematically represented by VGAM1 RNA through VGAM3 RNA, binds complementarily to a host target binding site located in an untranslated region of VGAM295 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM295 host target RNA into VGAM295 host target protein, herein schematically represented by VGAM1 HOST TARGET PROTEIN through VGAM3 HOST TARGET PROTEIN, all of FIG. 1.

VGAM296 RNA, herein schematically represented by VGAM1 RNA through VGAM3 RNA, binds complementarily to a host target binding site located in an untranslated region of VGAM296 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM296 host target RNA into VGAM296 host target protein, herein schematically represented by VGAM1 HOST TARGET PROTEIN through VGAM3 HOST TARGET PROTEIN, all of FIG. 1.

VGAM297 RNA, herein schematically represented by VGAM1 RNA through VGAM3 RNA, binds complementarily to a host target binding site located in an untranslated region of VGAM297 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM297 host target RNA into VGAM297 host target protein, herein schematically represented by VGAM1 HOST TARGET PROTEIN through VGAM3 HOST TARGET PROTEIN, all of FIG. 1.

It is appreciated that a function of VGR2780 gene, herein designated VGR GENE, is inhibition of expression of host target genes, as part of a novel viral mechanism of attacking a host. Accordingly, utilities of VGR2780 gene include diagnosis, prevention and treatment of viral infection by Epiphyas Postvittana Nucleopolyhedrovirus. Specific functions, and accordingly utilities, of VGR2780 gene correlate with, and may be deduced from, the identity of the host target genes, which are inhibited by VGAM RNAs comprised in the 'operon-like' cluster of VGR2780 gene: VGAM290 host target protein, VGAM291 host target protein, VGAM292 host target protein, VGAM293 host target protein, VGAM294 host target protein, VGAM295 host target protein, VGAM296 host target protein and VGAM297 host target protein, herein schematically represented by VGAM1 HOST TARGET PROTEIN through VGAM3 HOST TARGET PROTEIN. The function of these host target genes is elaborated hereinabove with reference to VGAM290, VGAM291, VGAM292, VGAM293, VGAM294, VGAM295, VGAM296 and VGAM297. FIG. 9 further provides a conceptual description of novel bioinformatically detected regulatory viral gene, referred to here as Viral Genomic Record 2781(VGR2781) viral gene, which encodes an 'operon-like' cluster of novel viral micro RNA-like genes, each of which in turn modulates expression of at least one host target gene, the function and utility of which at least one host target gene is known in the art.

VGR2781 gene, herein designated VGR GENE, is a novel bioinformatically detected regulatory, non protein coding, RNA viral gene. The method by which VGR2781 gene was detected is described hereinabove with reference to FIGS. 1-9.

VGR2781 gene encodes VGR2781 precursor RNA, herein designated VGR PRECURSOR RNA, an RNA molecule, typically several hundred nucleotides long.

VGR2781 precursor RNA folds spatially, forming VGR2781 folded precursor RNA, herein designated VGR FOLDED PRECURSOR RNA. It is appreciated that VGR2781 folded precursor RNA comprises a plurality of what is known in the art as 'hairpin' structures. These 'hairpin' structures are due to the fact that the nucleotide sequence of VGR2781 precursor RNA comprises a plurality of segments, the first half of each such segment having a nucleotide sequence which is at least a partial inversed-reversed sequence of the second half thereof, as is well known in the art.

VGR2781 folded precursor RNA is naturally processed by cellular enzymatic activity into at least 6 separate VGAM precursor RNAs, VGAM298 precursor RNA, VGAM299 precursor RNA, VGAM300 precursor RNA, VGAM301 precursor RNA, VGAM302 precursor RNA and VGAM303 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM298 RNA, VGAM299 RNA, VGAM300 RNA, VGAM301 RNA, VGAM302 RNA and VGAM303 RNA, herein schematically represented by VGAM1 RNA through VGAM3 RNA, each of which VGAM RNAs corresponding to VGAM RNA of FIG. 1.

VGAM298 RNA, herein schematically represented by VGAM1 RNA through VGAM3 RNA, binds complementarily to a host target binding site located in an untranslated region of VGAM298 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM298 host target RNA into VGAM298 host target protein, herein schematically represented by VGAM1 HOST TARGET PROTEIN through VGAM3 HOST TARGET PROTEIN, all of FIG. 1.

VGAM299 RNA, herein schematically represented by VGAM1 RNA through VGAM3 RNA, binds complementarily to a host target binding site located in an untranslated region of VGAM299 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM299 host target RNA into VGAM299 host target protein, herein schematically represented by VGAM1 HOST TARGET PROTEIN through VGAM3 HOST TARGET PROTEIN, all of FIG. 1.

VGAM300 RNA, herein schematically represented by VGAM1 RNA through VGAM3 RNA, binds complementarily to a host target binding site located in an untranslated region of VGAM300 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM300 host target RNA into VGAM300 host target protein, herein schematically represented by VGAM1 HOST TARGET PROTEIN through VGAM3 HOST TARGET PROTEIN, all of FIG. 1.

VGAM301 RNA, herein schematically represented by VGAM1 RNA through VGAM3 RNA, binds complementarily to a host target binding site located in an untranslated region of VGAM301 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM301 host target RNA into VGAM301 host target protein, herein schematically represented by VGAM1 HOST TARGET PROTEIN through VGAM3 HOST TARGET PROTEIN, all of FIG. 1.

VGAM302 RNA, herein schematically represented by VGAM1 RNA through VGAM3 RNA, binds complementarily to a host target binding site located in an untranslated region of VGAM302 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM302 host target RNA into VGAM302 host target protein, herein schematically represented by VGAM1 HOST TARGET PROTEIN through VGAM3 HOST TARGET PROTEIN, all of FIG. 1.

VGAM303 RNA, herein schematically represented by VGAM1 RNA through VGAM3 RNA, binds complementarily to a host target binding site located in an untranslated region of VGAM303 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM303 host target RNA into VGAM303 host target protein, herein schematically represented by VGAM1 HOST TARGET PROTEIN through VGAM3 HOST TARGET PROTEIN, all of FIG. 1.

It is appreciated that a function of VGR2781 gene, herein designated VGR GENE, is inhibition of expression of host target genes, as part of a novel viral mechanism of attacking a host. Accordingly, utilities of VGR2781 gene include diagnosis, prevention and treatment of viral infection by Epiphyas Postvittana Nucleopolyhedrovirus. Specific functions, and accordingly utilities, of VGR2781 gene correlate with, and may be deduced from, the identity of the host target genes, which are inhibited by VGAM RNAs comprised in the 'operon-like' cluster of VGR2781 gene: VGAM298 host target protein, VGAM299 host target protein, VGAM300 host target protein, VGAM301 host target protein, VGAM302 host target protein and VGAM303 host target protein, herein schematically represented by VGAM1 HOST TARGET PROTEIN through VGAM3 HOST TARGET PROTEIN. The function of these host target genes is elaborated hereinabove with reference to VGAM298, VGAM299, VGAM300, VGAM301, VGAM302 and VGAM303. FIG. 9 further provides a conceptual description of novel bioinformatically detected regulatory viral gene, referred to here as Viral Genomic Record 2782(VGR2782) viral gene, which encodes an 'operon-like' cluster of novel viral micro RNA-like genes, each of which in turn modulates expression of at least one host target gene, the function and utility of which at least one host target gene is known in the art.

VGR2782 gene, herein designated VGR GENE, is a novel bioinformatically detected regulatory, non protein coding, RNA viral gene. The method by which VGR2782 gene was detected is described hereinabove with reference to FIGS. 1-9.

VGR2782 gene encodes VGR2782 precursor RNA, herein designated VGR PRECURSOR RNA, an RNA molecule, typically several hundred nucleotides long.

VGR2782 precursor RNA folds spatially, forming VGR2782 folded precursor RNA, herein designated VGR FOLDED PRECURSOR RNA. It is appreciated that VGR2782 folded precursor RNA comprises a plurality of what is known in the art as 'hairpin' structures. These 'hairpin' structures are due to the fact that the nucleotide sequence of VGR2782 precursor RNA comprises a plurality of segments, the first half of each such segment having a nucleotide sequence which is at least a partial inversed-reversed sequence of the second half thereof, as is well known in the art.

VGR2782 folded precursor RNA is naturally processed by cellular enzymatic activity into at least 3 separate VGAM precursor RNAs, VGAM304 precursor RNA, VGAM305 precursor RNA and VGAM306 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM304 RNA, VGAM305 RNA and VGAM306 RNA, herein schematically represented by VGAM1 RNA through VGAM3 RNA, each of which VGAM RNAs corresponding to VGAM RNA of FIG. 1.

VGAM304 RNA, herein schematically represented by VGAM1 RNA through VGAM3 RNA, binds complementarily to a host target binding site located in an untranslated region of VGAM304 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM304 host target RNA into VGAM304 host target protein, herein schematically represented by VGAM1 HOST TARGET PROTEIN through VGAM3 HOST TARGET PROTEIN, all of FIG. 1.

VGAM305 RNA, herein schematically represented by VGAM1 RNA through VGAM3 RNA, binds complementarily to a host target binding site located in an untranslated region of VGAM305 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM305 host target RNA into VGAM305 host target protein, herein schematically represented by VGAM1 HOST TARGET PROTEIN through VGAM3 HOST TARGET PROTEIN, all of FIG. 1.

VGAM306 RNA, herein schematically represented by VGAM1 RNA through VGAM3 RNA, binds complementarily to a host target binding site located in an untranslated region of VGAM306 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM306 host target RNA into VGAM306 host target protein, herein schematically represented by VGAM1 HOST TARGET PROTEIN through VGAM3 HOST TARGET PROTEIN, all of FIG. 1.

It is appreciated that a function of VGR2782 gene, herein designated VGR GENE, is inhibition of expression of host target genes, as part of a novel viral mechanism of attacking a host. Accordingly, utilities of VGR2782 gene include diagnosis, prevention and treatment of viral infection by Equine Herpesvirus 4. Specific functions, and accordingly utilities, of VGR2782 gene correlate with, and may be deduced from, the identity of the host target genes, which are inhibited by VGAM RNAs comprised in the 'operon-like' cluster of VGR2782 gene: VGAM304 host target protein, VGAM305 host target protein and VGAM306 host target protein, herein schematically represented by VGAM1 HOST TARGET PROTEIN through VGAM3 HOST TARGET PROTEIN. The function of these host target genes is elaborated hereinabove with reference to VGAM304, VGAM305 and VGAM306. FIG. 9 further provides a conceptual description of novel bioinformatically detected regulatory viral gene, referred to here as Viral Genomic Record 2783(VGR2783) viral gene, which encodes an 'operon-like' cluster of novel viral micro RNA-like genes, each of which in turn modulates expression of at least one host target gene, the function and utility of which at least one host target gene is known in the art.

VGR2783 gene, herein designated VGR GENE, is a novel bioinformatically detected regulatory, non protein coding, RNA viral gene. The method by which VGR2783 gene was detected is described hereinabove with reference to FIGS. 1-9.

VGR2783 gene encodes VGR2783 precursor RNA, herein designated VGR PRECURSOR RNA, an RNA molecule, typically several hundred nucleotides long.

VGR2783 precursor RNA folds spatially, forming VGR2783 folded precursor RNA, herein designated VGR FOLDED PRECURSOR RNA. It is appreciated that VGR2783 folded precursor RNA comprises a plurality of what is known in the art as 'hairpin' structures. These 'hairpin' structures are due to the fact that the nucleotide sequence of VGR2783 precursor RNA comprises a plurality of segments, the first half of each such segment having a nucleotide sequence which is at least a partial inversed-reversed sequence of the second half thereof, as is well known in the art.

VGR2783 folded precursor RNA is naturally processed by cellular enzymatic activity into at least 3 separate VGAM precursor RNAs, VGAM310 precursor RNA, VGAM311 precursor RNA and VGAM312 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM310 RNA, VGAM311 RNA and VGAM312 RNA, herein schematically represented by VGAM1 RNA through VGAM3 RNA, each of which VGAM RNAs corresponding to VGAM RNA of FIG. 1.

VGAM310 RNA, herein schematically represented by VGAM1 RNA through VGAM3 RNA, binds complementarily to a host target binding site located in an untranslated region of VGAM310 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM310 host target RNA into VGAM310 host target protein, herein schematically represented by VGAM1 HOST TARGET PROTEIN through VGAM3 HOST TARGET PROTEIN, all of FIG. 1.

VGAM311 RNA, herein schematically represented by VGAM1 RNA through VGAM3 RNA, binds complementarily to a host target binding site located in an untranslated region of VGAM311 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM311 host target RNA into VGAM311 host target protein, herein schematically represented by VGAM1 HOST TARGET PROTEIN through VGAM3 HOST TARGET PROTEIN, all of FIG. 1.

VGAM312 RNA, herein schematically represented by VGAM1 RNA through VGAM3 RNA, binds complementarily to a host target binding site located in an untranslated region of VGAM312 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM312 host target RNA into VGAM312 host target protein, herein schematically represented by VGAM1 HOST TARGET PROTEIN through VGAM3 HOST TARGET PROTEIN, all of FIG. 1.

It is appreciated that a function of VGR2783 gene, herein designated VGR GENE, is inhibition of expression of host target genes, as part of a novel viral mechanism of attacking a host. Accordingly, utilities of VGR2783 gene include diagnosis, prevention and treatment of viral infection by Pothos Latent Virus. Specific functions, and accordingly utilities, of VGR2783 gene correlate with, and may be deduced from, the identity of the host target genes, which are inhibited by VGAM RNAs comprised in the 'operon-like' cluster of VGR2783 gene: VGAM310 host target protein, VGAM311 host target protein and VGAM312 host target protein, herein schematically represented by VGAM1 HOST TARGET PROTEIN through VGAM3 HOST TARGET PROTEIN. The function of these host target genes is elaborated hereinabove with reference to VGAM310, VGAM311 and VGAM312. FIG. 9 further provides a conceptual description of novel bioinformatically detected regulatory viral gene, referred to here as Viral Genomic Record 2784(VGR2784) viral gene, which encodes an 'operon-like' cluster of novel viral micro RNA-like genes, each of which in turn modulates expression of at least one host target gene, the function and utility of which at least one host target gene is known in the art.

VGR2784 gene, herein designated VGR GENE, is a novel bioinformatically detected regulatory, non protein coding, RNA viral gene. The method by which VGR2784 gene was detected is described hereinabove with reference to FIGS. 1-9.

VGR2784 gene encodes VGR2784 precursor RNA, herein designated VGR PRECURSOR RNA, an RNA molecule, typically several hundred nucleotides long.

VGR2784 precursor RNA folds spatially, forming VGR2784 folded precursor RNA, herein designated VGR FOLDED PRECURSOR RNA. It is appreciated that VGR2784 folded precursor RNA comprises a plurality of what is known in the art as 'hairpin' structures. These 'hairpin' structures are due to the fact that the nucleotide sequence of VGR2784 precursor RNA comprises a plurality of segments, the first half of each such segment having a nucleotide sequence which is at least a partial inversed-reversed sequence of the second half thereof, as is well known in the art.

VGR2784 folded precursor RNA is naturally processed by cellular enzymatic activity into at least 4 separate VGAM precursor RNAs, VGAM315 precursor RNA, VGAM316 precursor RNA, VGAM317 precursor RNA and VGAM318 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM315 RNA, VGAM316 RNA, VGAM317 RNA and VGAM318 RNA, herein schematically represented by VGAM1 RNA through VGAM3 RNA, each of which VGAM RNAs corresponding to VGAM RNA of FIG. 1.

VGAM315 RNA, herein schematically represented by VGAM1 RNA through VGAM3 RNA, binds complementarily to a host target binding site located in an untranslated region of VGAM315 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM315 host target RNA into VGAM315 host target protein, herein schematically represented by VGAM1 HOST TARGET PROTEIN through VGAM3 HOST TARGET PROTEIN, all of FIG. 1.

VGAM316 RNA, herein schematically represented by VGAM1 RNA through VGAM3 RNA, binds complementarily to a host target binding site located in an untranslated region of VGAM316 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM316 host target RNA into VGAM316 host target protein, herein schematically represented by VGAM1 HOST TARGET PROTEIN through VGAM3 HOST TARGET PROTEIN, all of FIG. 1.

VGAM317 RNA, herein schematically represented by VGAM1 RNA through VGAM3 RNA, binds complementarily to a host target binding site located in an untranslated region of VGAM317 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM317 host target RNA into VGAM317 host target protein, herein schematically represented by VGAM1 HOST TARGET PROTEIN through VGAM3 HOST TARGET PROTEIN, all of FIG. 1.

VGAM318 RNA, herein schematically represented by VGAM1 RNA through VGAM3 RNA, binds complementarily to a host target binding site located in an untranslated region of VGAM318 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM318 host target RNA into VGAM318 host target protein, herein schematically represented by VGAM1 HOST TARGET PROTEIN through VGAM3 HOST TARGET PROTEIN, all of FIG. 1.

It is appreciated that a function of VGR2784 gene, herein designated VGR GENE, is inhibition of expression of host target genes, as part of a novel viral mechanism of attacking a host. Accordingly, utilities of VGR2784 gene include diagnosis, prevention and treatment of viral infection by Cryphonectria Hypovirus 3. Specific functions, and accordingly utilities, of VGR2784 gene correlate with, and may be deduced from, the identity of the host target genes, which are inhibited by VGAM RNAs comprised in the 'operon-like' cluster of VGR2784 gene: VGAM315 host target protein, VGAM316 host target protein, VGAM317 host target protein and VGAM318 host target protein, herein schematically represented by VGAM1 HOST TARGET PROTEIN through VGAM3 HOST TARGET PROTEIN. The function of these host target genes is elaborated hereinabove with reference to VGAM315, VGAM316, VGAM317 and VGAM318. FIG. 9 further provides a conceptual description of novel bioinformatically detected regulatory viral gene, referred to here as Viral Genomic Record 2785(VGR2785) viral gene, which encodes an 'operon-like' cluster of novel viral micro RNA-like genes, each of which in turn modulates expression of at least one host target gene, the function and utility of which at least one host target gene is known in the art.

VGR2785 gene, herein designated VGR GENE, is a novel bioinformatically detected regulatory, non protein coding, RNA viral gene. The method by which VGR2785 gene was detected is described hereinabove with reference to FIGS. 1-9.

VGR2785 gene encodes VGR2785 precursor RNA, herein designated VGR PRECURSOR RNA, an RNA molecule, typically several hundred nucleotides long.

VGR2785 precursor RNA folds spatially, forming VGR2785 folded precursor RNA, herein designated VGR FOLDED PRECURSOR RNA. It is appreciated that VGR2785 folded precursor RNA comprises a plurality of what is known in the art as 'hairpin' structures. These 'hairpin' structures are due to the fact that the nucleotide sequence of VGR2785 precursor RNA comprises a plurality of segments, the first half of each such segment having a nucleotide sequence which is at least a partial inversed-reversed sequence of the second half thereof, as is well known in the art.

VGR2785 folded precursor RNA is naturally processed by cellular enzymatic activity into at least 2 separate VGAM precursor RNAs, VGAM319 precursor RNA and VGAM320 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM319 RNA and VGAM320 RNA, herein schematically represented by VGAM1 RNA through VGAM3 RNA, each of which VGAM RNAs corresponding to VGAM RNA of FIG. 1.

VGAM319 RNA, herein schematically represented by VGAM1 RNA through VGAM3 RNA, binds complementarily to a host target binding site located in an untranslated region of VGAM319 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM319 host target RNA into VGAM319 host target protein, herein schematically represented by VGAM1 HOST TARGET PROTEIN through VGAM3 HOST TARGET PROTEIN, all of FIG. 1.

VGAM320 RNA, herein schematically represented by VGAM1 RNA through VGAM3 RNA, binds complementarily to a host target binding site located in an untranslated region of VGAM320 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM320 host target RNA into VGAM320 host target protein, herein schematically represented by VGAM1 HOST TARGET PROTEIN through VGAM3 HOST TARGET PROTEIN, all of FIG. 1.

It is appreciated that a function of VGR2785 gene, herein designated VGR GENE, is inhibition of expression of host target genes, as part of a novel viral mechanism of attacking a host. Accordingly, utilities of VGR2785 gene include diagnosis, prevention and treatment of viral infection by Myxoma Virus. Specific functions, and accordingly utilities, of VGR2785 gene correlate with, and may be deduced from, the identity of the host target genes, which are inhibited by VGAM RNAs comprised in the 'operon-like' cluster of VGR2785 gene: VGAM319 host target protein and VGAM320 host target protein, herein schematically represented by VGAM1 HOST TARGET PROTEIN through VGAM3 HOST TARGET PROTEIN. The function of these host target genes is elaborated hereinabove with reference to VGAM319 and VGAM320. FIG. 9 further provides a conceptual description of novel bioinformatically detected regulatory viral gene, referred to here as Viral Genomic Record 2786(VGR2786) viral gene, which encodes an 'operon-like' cluster of novel viral micro RNA-like genes, each of which in turn modulates expression of at least one host target gene, the function and utility of which at least one host target gene is known in the art.

VGR2786 gene, herein designated VGR GENE, is a novel bioinformatically detected regulatory, non protein coding, RNA viral gene. The method by which VGR2786 gene was detected is described hereinabove with reference to FIGS. 1-9.

VGR2786 gene encodes VGR2786 precursor RNA, herein designated VGR PRECURSOR RNA, an RNA molecule, typically several hundred nucleotides long.

VGR2786 precursor RNA folds spatially, forming VGR2786 folded precursor RNA, herein designated VGR FOLDED PRECURSOR RNA. It is appreciated that VGR2786 folded precursor RNA comprises a plurality of what is known in the art as 'hairpin' structures. These 'hairpin' structures are due to the fact that the nucleotide sequence of VGR2786 precursor RNA comprises a plurality of segments, the first half of each such segment having a nucleotide sequence which is at least a partial inversed-reversed sequence of the second half thereof, as is well known in the art.

VGR2786 folded precursor RNA is naturally processed by cellular enzymatic activity into at least 3 separate VGAM precursor RNAs, VGAM324 precursor RNA, VGAM325 precursor RNA and VGAM326 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM324 RNA, VGAM325 RNA and VGAM326 RNA, herein schematically represented by VGAM1 RNA through VGAM3 RNA, each of which VGAM RNAs corresponding to VGAM RNA of FIG. 1.

VGAM324 RNA, herein schematically represented by VGAM1 RNA through VGAM3 RNA, binds complementarily to a host target binding site located in an untranslated region of VGAM324 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM324 host target RNA into VGAM324 host target protein, herein schematically represented by VGAM1 HOST TARGET PROTEIN through VGAM3 HOST TARGET PROTEIN, all of FIG. 1.

VGAM325 RNA, herein schematically represented by VGAM1 RNA through VGAM3 RNA, binds complementarily to a host target binding site located in an untranslated region of VGAM325 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM325 host target RNA into VGAM325 host target protein, herein schematically represented by VGAM1 HOST TARGET PROTEIN through VGAM3 HOST TARGET PROTEIN, all of FIG. 1.

VGAM326 RNA, herein schematically represented by VGAM1 RNA through VGAM3 RNA, binds complementarily to a host target binding site located in an untranslated region of VGAM326 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM326 host target RNA into VGAM326 host target protein, herein schematically represented by VGAM1 HOST TARGET PROTEIN through VGAM3 HOST TARGET PROTEIN, all of FIG. 1.

It is appreciated that a function of VGR2786 gene, herein designated VGR GENE, is inhibition of expression of host target genes, as part of a novel viral mechanism of attacking a host. Accordingly, utilities of VGR2786 gene include diagnosis, prevention and treatment of viral infection by Rabbit Fibroma Virus. Specific functions, and accordingly utilities, of VGR2786 gene correlate with, and may be deduced from, the identity of the host target genes, which are inhibited by VGAM RNAs comprised in the 'operon-like' cluster of

16635

VGR2786 gene: VGAM324 host target protein, VGAM325 host target protein and VGAM326 host target protein, herein schematically represented by VGAM1 HOST TARGET PROTEIN through VGAM3 HOST TARGET PROTEIN. The function of these host target genes is elaborated hereinabove with reference to VGAM324, VGAM325 and VGAM326. FIG. 9 further provides a conceptual description of novel bioinformatically detected regulatory viral gene, referred to here as Viral Genomic Record 2787(VGR2787) viral gene, which encodes an 'operon-like' cluster of novel viral micro RNA-like genes, each of which in turn modulates expression of at least one host target gene, the function and utility of which at least one host target gene is known in the art.

VGR2787 gene, herein designated VGR GENE, is a novel bioinformatically detected regulatory, non protein coding, RNA viral gene. The method by which VGR2787 gene was detected is described hereinabove with reference to FIGS. 1-9.

VGR2787 gene encodes VGR2787 precursor RNA, herein designated VGR PRECURSOR RNA, an RNA molecule, typically several hundred nucleotides long.

VGR2787 precursor RNA folds spatially, forming VGR2787 folded precursor RNA, herein designated VGR FOLDED PRECURSOR RNA. It is appreciated that VGR2787 folded precursor RNA comprises a plurality of what is known in the art as 'hairpin' structures. These 'hairpin' structures are due to the fact that the nucleotide sequence of VGR2787 precursor RNA comprises a plurality of segments, the first half of each such segment having a nucleotide sequence which is at least a partial inversed-reversed sequence of the second half thereof, as is well known in the art.

VGR2787 folded precursor RNA is naturally processed by cellular enzymatic activity into at least 2 separate VGAM precursor RNAs, VGAM333 precursor RNA and VGAM334 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM333 RNA and VGAM334 RNA, herein schematically represented by VGAM1 RNA through VGAM3 RNA, each of which VGAM RNAs corresponding to VGAM RNA of FIG. 1.

VGAM333 RNA, herein schematically represented by VGAM1 RNA through VGAM3 RNA, binds complementarily to a host target binding site located in an untranslated region of VGAM333 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM333 host target RNA into VGAM333 host target protein, herein schematically represented by VGAM1 HOST TARGET PROTEIN through VGAM3 HOST TARGET PROTEIN, all of FIG. 1.

VGAM334 RNA, herein schematically represented by VGAM1 RNA through VGAM3 RNA, binds complementarily to a host target binding site located in an untranslated region of VGAM334 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM334 host target RNA into VGAM334 host target protein, herein schematically represented by VGAM1 HOST TARGET PROTEIN through VGAM3 HOST TARGET PROTEIN, all of FIG. 1.

It is appreciated that a function of VGR2787 gene, herein designated VGR GENE, is inhibition of expression of host target genes, as part of a novel viral mechanism of attacking a host. Accordingly, utilities of VGR2787 gene include diagnosis, prevention and treatment of viral infection by Human Herpesvirus 3. Specific functions, and accordingly utilities, of VGR2787 gene correlate with, and may be deduced from, the identity of the host target genes, which are inhibited by VGAM RNAs comprised in the 'operon-like' cluster of VGR2787 gene: VGAM333 host target protein and VGAM334 host target protein, herein schematically represented by VGAM1 HOST TARGET PROTEIN through VGAM3 HOST TARGET PROTEIN. The function of these host target genes is elaborated hereinabove with reference to VGAM333 and VGAM334. FIG. 9 further provides a conceptual description of novel bioinformatically detected regulatory viral gene, referred to here as Viral Genomic Record 2788(VGR2788) viral gene, which encodes an 'operon-like' cluster of novel viral micro RNA-like genes, each of which in turn modulates expression of at least one host target gene, the function and utility of which at least one host target gene is known in the art.

VGR2788 gene, herein designated VGR GENE, is a novel bioinformatically detected regulatory, non protein coding, RNA viral gene. The method by which VGR2788 gene was detected is described hereinabove with reference to FIGS. 1-9.

VGR2788 gene encodes VGR2788 precursor RNA, herein designated VGR PRECURSOR RNA, an RNA molecule, typically several hundred nucleotides long.

VGR2788 precursor RNA folds spatially, forming VGR2788 folded precursor RNA, herein designated VGR FOLDED PRECURSOR RNA. It is appreciated that VGR2788 folded precursor RNA comprises a plurality of what is known in the art as 'hairpin' structures. These 'hairpin' structures are due to the fact that the nucleotide sequence of VGR2788 precursor RNA comprises a plurality of segments, the first half of each such segment having a nucleotide sequence which is at least a partial inversed-reversed sequence of the second half thereof, as is well known in the art.

VGR2788 folded precursor RNA is naturally processed by cellular enzymatic activity into at least 5 separate VGAM precursor RNAs, VGAM335 precursor RNA, VGAM336 precursor RNA, VGAM337 precursor RNA, VGAM338 precursor RNA and VGAM339 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM335 RNA, VGAM336 RNA, VGAM337 RNA, VGAM338 RNA and VGAM339 RNA, herein schematically represented by VGAM1 RNA through VGAM3 RNA, each of which VGAM RNAs corresponding to VGAM RNA of FIG. 1.

VGAM335 RNA, herein schematically represented by VGAM1 RNA through VGAM3 RNA, binds complementarily to a host target binding site located in an untranslated region of VGAM335 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM335 host target RNA into VGAM335 host target protein, herein schematically represented by VGAM1 HOST TARGET PROTEIN through VGAM3 HOST TARGET PROTEIN, all of FIG. 1.

VGAM336 RNA, herein schematically represented by VGAM1 RNA through VGAM3 RNA, binds complementarily to a host target binding site located in an untranslated region of VGAM336 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM336 host target RNA into VGAM336 host target protein, herein schematically represented by VGAM1 HOST TARGET PROTEIN through VGAM3 HOST TARGET PROTEIN, all of FIG. 1.

VGAM337 RNA, herein schematically represented by VGAM1 RNA through VGAM3 RNA, binds complementarily to a host target binding site located in an untranslated region of VGAM337 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM337 host target RNA into VGAM337 host target protein, herein schematically represented by VGAM1 HOST TARGET PROTEIN through VGAM3 HOST TARGET PROTEIN, all of FIG. 1.

VGAM338 RNA, herein schematically represented by VGAM1 RNA through VGAM3 RNA, binds complementarily to a host target binding site located in an untranslated region of VGAM338 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM338 host target RNA into VGAM338 host target protein, herein schematically represented by VGAM1 HOST TARGET PROTEIN through VGAM3 HOST TARGET PROTEIN, all of FIG. 1.

VGAM339 RNA, herein schematically represented by VGAM1 RNA through VGAM3 RNA, binds complementarily to a host target binding site located in an untranslated region of VGAM339 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM339 host target RNA into VGAM339 host target protein, herein schematically represented by VGAM1 HOST TARGET PROTEIN through VGAM3 HOST TARGET PROTEIN, all of FIG. 1.

It is appreciated that a function of VGR2788 gene, herein designated VGR GENE, is inhibition of expression of host target genes, as part of a novel viral mechanism of attacking a host. Accordingly, utilities of VGR2788 gene include diagnosis, prevention and treatment of viral infection by Saimiriine Herpesvirus 2. Specific functions, and accordingly utilities, of VGR2788 gene correlate with, and may be deduced from, the identity of the host target genes, which are inhibited by VGAM RNAs comprised in the 'operon-like' cluster of VGR2788 gene: VGAM335 host target protein, VGAM336 host target protein, VGAM337 host target protein, VGAM338 host target protein and VGAM339 host target protein, herein schematically represented by VGAM1 HOST TARGET PROTEIN through VGAM3 HOST TARGET PROTEIN. The function of these host target genes is elaborated hereinabove with reference to VGAM335, VGAM336, VGAM337, VGAM338 and VGAM339. FIG. 9 further provides a conceptual description of novel bioinformatically detected regulatory viral gene, referred to here as Viral Genomic Record 2789(VGR2789) viral gene, which encodes an 'operon-like' cluster of novel viral micro RNA-like genes, each of which in turn modulates expression of at least one host target gene, the function and utility of which at least one host target gene is known in the art.

VGR2789 gene, herein designated VGR GENE, is a novel bioinformatically detected regulatory, non protein coding, RNA viral gene. The method by which VGR2789 gene was detected is described hereinabove with reference to FIGS. 1-9.

VGR2789 gene encodes VGR2789 precursor RNA, herein designated VGR PRECURSOR RNA, an RNA molecule, typically several hundred nucleotides long.

VGR2789 precursor RNA folds spatially, forming VGR2789 folded precursor RNA, herein designated VGR FOLDED PRECURSOR RNA. It is appreciated that VGR2789 folded precursor RNA comprises a plurality of what is known in the art as 'hairpin' structures. These 'hairpin' structures are due to the fact that the nucleotide sequence of VGR2789 precursor RNA comprises a plurality of segments, the first half of each such segment having a nucleotide sequence which is at least a partial inversed-reversed sequence of the second half thereof, as is well known in the art.

VGR2789 folded precursor RNA is naturally processed by cellular enzymatic activity into at least 5 separate VGAM precursor RNAs, VGAM340 precursor RNA, VGAM341 precursor RNA, VGAM342 precursor RNA, VGAM343 precursor RNA and VGAM344 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM340 RNA, VGAM341 RNA, VGAM342 RNA, VGAM343 RNA and VGAM344 RNA, herein schematically represented by VGAM1 RNA through VGAM3 RNA, each of which VGAM RNAs corresponding to VGAM RNA of FIG. 1.

VGAM340 RNA, herein schematically represented by VGAM1 RNA through VGAM3 RNA, binds complementarily to a host target binding site located in an untranslated region of VGAM340 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM340 host target RNA into VGAM340 host target protein, herein schematically represented by VGAM1 HOST TARGET PROTEIN through VGAM3 HOST TARGET PROTEIN, all of FIG. 1.

VGAM341 RNA, herein schematically represented by VGAM1 RNA through VGAM3 RNA, binds complementarily to a host target binding site located in an untranslated region of VGAM341 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM341 host target RNA into VGAM341 host target protein, herein schematically represented by VGAM1 HOST TARGET PROTEIN through VGAM3 HOST TARGET PROTEIN, all of FIG. 1.

VGAM342 RNA, herein schematically represented by VGAM1 RNA through VGAM3 RNA, binds complementarily to a host target binding site located in an untranslated region of VGAM342 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM342 host target RNA into VGAM342 host target protein, herein schematically represented by VGAM1 HOST TARGET PROTEIN through VGAM3 HOST TARGET PROTEIN, all of FIG. 1.

VGAM343 RNA, herein schematically represented by VGAM1 RNA through VGAM3 RNA, binds complementarily to a host target binding site located in an untranslated region of VGAM343 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM343 host target RNA into VGAM343 host target protein, herein schematically represented by VGAM1 HOST TARGET PROTEIN through VGAM3 HOST TARGET PROTEIN, all of FIG. 1.

VGAM344 RNA, herein schematically represented by VGAM1 RNA through VGAM3 RNA, binds complementarily to a host target binding site located in an untranslated region of VGAM344 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM344 host target RNA into VGAM344 host target protein, herein schematically represented by VGAM1 HOST TARGET PROTEIN through VGAM3 HOST TARGET PROTEIN, all of FIG. 1.

It is appreciated that a function of VGR2789 gene, herein designated VGR GENE, is inhibition of expression of host target genes, as part of a novel viral mechanism of attacking a host. Accordingly, utilities of VGR2789 gene include diagnosis, prevention and treatment of viral infection by Tobacco Mosaic Virus. Specific functions, and accordingly utilities, of VGR2789 gene correlate with, and may be deduced from, the identity of the host target genes, which are inhibited by VGAM RNAs comprised in the 'operon-like' cluster of VGR2789 gene: VGAM340 host target protein, VGAM341 host target protein, VGAM342 host target protein, VGAM343 host target protein and VGAM344 host target protein, herein schematically represented by VGAM1 HOST TARGET PROTEIN through VGAM3 HOST TARGET PROTEIN. The function of these host target genes is elaborated hereinabove with reference to VGAM340, VGAM341, VGAM342, VGAM343 and VGAM344. FIG. 9 further provides a conceptual description of novel bioinformatically detected regulatory viral gene, referred to here as Viral Genomic Record 2790(VGR2790) viral gene, which encodes an 'operon-like' cluster of novel viral micro RNA-like genes, each of which in turn modulates expression of at least one host target gene, the function and utility of which at least one host target gene is known in the art.

VGR2790 gene, herein designated VGR GENE, is a novel bioinformatically detected regulatory, non protein coding, RNA viral gene. The method by which VGR2790 gene was detected is described hereinabove with reference to FIGS. 1-9.

VGR2790 gene encodes VGR2790 precursor RNA, herein designated VGR PRECURSOR RNA, an RNA molecule, typically several hundred nucleotides long.

VGR2790 precursor RNA folds spatially, forming VGR2790 folded precursor RNA, herein designated VGR FOLDED PRECURSOR RNA. It is appreciated that VGR2790 folded precursor RNA comprises a plurality of what is known in the art as 'hairpin' structures. These 'hairpin' structures are due to the fact that the nucleotide sequence of VGR2790 precursor RNA comprises a plurality of segments, the first half of each such segment having a nucleotide sequence which is at least a partial inversed-reversed sequence of the second half thereof, as is well known in the art.

VGR2790 folded precursor RNA is naturally processed by cellular enzymatic activity into at least 2 separate VGAM precursor RNAs, VGAM346 precursor RNA and VGAM347 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM346 RNA and VGAM347 RNA, herein schematically represented by VGAM1 RNA through VGAM3 RNA, each of which VGAM RNAs corresponding to VGAM RNA of FIG. 1.

VGAM346 RNA, herein schematically represented by VGAM1 RNA through VGAM3 RNA, binds complementarily to a host target binding site located in an untranslated region of VGAM346 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM346 host target RNA into VGAM346 host target protein, herein schematically represented by VGAM1 HOST TARGET PROTEIN through VGAM3 HOST TARGET PROTEIN, all of FIG. 1.

VGAM347 RNA, herein schematically represented by VGAM1 RNA through VGAM3 RNA, binds complementarily to a host target binding site located in an untranslated region of VGAM347 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM347 host target RNA into VGAM347 host target protein, herein schematically represented by VGAM1 HOST TARGET PROTEIN through VGAM3 HOST TARGET PROTEIN, all of FIG. 1.

It is appreciated that a function of VGR2790 gene, herein designated VGR GENE, is inhibition of expression of host target genes, as part of a novel viral mechanism of attacking a host. Accordingly, utilities of VGR2790 gene include diagnosis, prevention and treatment of viral infection by Black Beetle Virus. Specific functions, and accordingly utilities, of VGR2790 gene correlate with, and may be deduced from, the identity of the host target genes, which are inhibited by VGAM RNAs comprised in the 'operon-like' cluster of VGR2790 gene: VGAM346 host target protein and VGAM347 host target protein, herein schematically represented by VGAM1 HOST TARGET PROTEIN through VGAM3 HOST TARGET PROTEIN. The function of these host target genes is elaborated hereinabove with reference to VGAM346 and VGAM347. FIG. 9 further provides a conceptual description of novel bioinformatically detected regulatory viral gene, referred to here as Viral Genomic Record 2791(VGR2791) viral gene, which encodes an 'operon-like' cluster of novel viral micro RNA-like genes, each of which in turn modulates expression of at least one host target gene, the function and utility of which at least one host target gene is known in the art.

VGR2791 gene, herein designated VGR GENE, is a novel bioinformatically detected regulatory, non protein coding, RNA viral gene. The method by which VGR2791 gene was detected is described hereinabove with reference to FIGS. 1-9.

VGR2791 gene encodes VGR2791 precursor RNA, herein designated VGR PRECURSOR RNA, an RNA molecule, typically several hundred nucleotides long.

VGR2791 precursor RNA folds spatially, forming VGR2791 folded precursor RNA, herein designated VGR FOLDED PRECURSOR RNA. It is appreciated that VGR2791 folded precursor RNA comprises a plurality of what is known in the art as 'hairpin' structures. These 'hairpin' structures are due to the fact that the nucleotide sequence of VGR2791 precursor RNA comprises a plurality of segments, the first half of each such segment having a nucleotide sequence which is at least a partial inversed-reversed sequence of the second half thereof, as is well known in the art.

VGR2791 folded precursor RNA is naturally processed by cellular enzymatic activity into at least 2 separate VGAM precursor RNAs, VGAM348 precursor RNA and VGAM349 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM348 RNA and VGAM349 RNA, herein schematically represented by VGAM1 RNA through VGAM3 RNA, each of which VGAM RNAs corresponding to VGAM RNA of FIG. 1.

VGAM348 RNA, herein schematically represented by VGAM1 RNA through VGAM3 RNA, binds complementarily to a host target binding site located in an untranslated region of VGAM348 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM348 host target RNA into VGAM348 host target protein, herein schematically represented by VGAM1 HOST TARGET PROTEIN through VGAM3 HOST TARGET PROTEIN, all of FIG. 1.

VGAM349 RNA, herein schematically represented by VGAM1 RNA through VGAM3 RNA, binds complementarily to a host target binding site located in an untranslated region of VGAM349 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM349 host target RNA into VGAM349 host target protein, herein schematically represented by VGAM1 HOST TARGET PROTEIN through VGAM3 HOST TARGET PROTEIN, all of FIG. 1.

It is appreciated that a function of VGR2791 gene, herein designated VGR GENE, is inhibition of expression of host target genes, as part of a novel viral mechanism of attacking a host. Accordingly, utilities of VGR2791 gene include diagnosis, prevention and treatment of viral infection by Human Enterovirus C. Specific functions, and accordingly utilities, of VGR2791 gene correlate with, and may be deduced from, the identity of the host target genes, which are inhibited by VGAM RNAs comprised in the 'operon-like' cluster of VGR2791 gene: VGAM348 host target protein and VGAM349 host target protein, herein schematically represented by VGAM1 HOST TARGET PROTEIN through VGAM3 HOST TARGET PROTEIN. The function of these host target genes is elaborated hereinabove with reference to VGAM348 and VGAM349. FIG. 9 further provides a conceptual description of novel bioinformatically detected regulatory viral gene, referred to here as Viral Genomic Record 2792(VGR2792) viral gene, which encodes an 'operon-like' cluster of novel viral micro RNA-like genes, each of which in turn modulates expression of at least one host target gene, the function and utility of which at least one host target gene is known in the art.

VGR2792 gene, herein designated VGR GENE, is a novel bioinformatically detected regulatory, non protein coding, RNA viral gene. The method by which VGR2792 gene was detected is described hereinabove with reference to FIGS. 1-9.

VGR2792 gene encodes VGR2792 precursor RNA, herein designated VGR PRECURSOR RNA, an RNA molecule, typically several hundred nucleotides long.

VGR2792 precursor RNA folds spatially, forming VGR2792 folded precursor RNA, herein designated VGR FOLDED PRECURSOR RNA. It is appreciated that VGR2792 folded precursor RNA comprises a plurality of what is known in the art as 'hairpin' structures. These 'hairpin' structures are due to the fact that the nucleotide sequence of VGR2792 precursor RNA comprises a plurality of segments, the first half of each such segment having a nucleotide sequence which is at least a partial inversed-reversed sequence of the second half thereof, as is well known in the art.

VGR2792 folded precursor RNA is naturally processed by cellular enzymatic activity into at least 8 separate VGAM precursor RNAs, VGAM350 precursor RNA, VGAM351 precursor RNA, VGAM352 precursor RNA, VGAM353 precursor RNA, VGAM354 precursor RNA, VGAM355 precursor RNA, VGAM356 precursor RNA and VGAM357 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM350 RNA, VGAM351 RNA, VGAM352 RNA, VGAM353 RNA, VGAM354 RNA, VGAM355 RNA, VGAM356 RNA and VGAM357 RNA, herein schematically represented by VGAM1 RNA through VGAM3 RNA, each of which VGAM RNAs corresponding to VGAM RNA of FIG. 1.

VGAM350 RNA, herein schematically represented by VGAM1 RNA through VGAM3 RNA, binds complementarily to a host target binding site located in an untranslated region of VGAM350 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM350 host target RNA into VGAM350 host target protein, herein schematically represented by VGAM1 HOST TARGET PROTEIN through VGAM3 HOST TARGET PROTEIN, all of FIG. 1.

VGAM351 RNA, herein schematically represented by VGAM1 RNA through VGAM3 RNA, binds complementarily to a host target binding site located in an untranslated region of VGAM351 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM351 host target RNA into VGAM351 host target protein, herein schematically represented by VGAM1 HOST TARGET PROTEIN through VGAM3 HOST TARGET PROTEIN, all of FIG. 1.

VGAM352 RNA, herein schematically represented by VGAM1 RNA through VGAM3 RNA, binds complementarily to a host target binding site located in an untranslated region of VGAM352 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM352 host target RNA into VGAM352 host target protein, herein schematically represented by VGAM1 HOST TARGET PROTEIN through VGAM3 HOST TARGET PROTEIN, all of FIG. 1.

VGAM353 RNA, herein schematically represented by VGAM1 RNA through VGAM3 RNA, binds complementarily to a host target binding site located in an untranslated region of VGAM353 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM353 host target RNA into VGAM353 host target protein, herein schematically represented by VGAM1 HOST TARGET PROTEIN through VGAM3 HOST TARGET PROTEIN, all of FIG. 1.

VGAM354 RNA, herein schematically represented by VGAM1 RNA through VGAM3 RNA, binds complementarily to a host target binding site located in an untranslated region of VGAM354 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM354 host target RNA into VGAM354 host target protein, herein schematically represented by VGAM1 HOST TARGET PROTEIN through VGAM3 HOST TARGET PROTEIN, all of FIG. 1.

VGAM355 RNA, herein schematically represented by VGAM1 RNA through VGAM3 RNA, binds complementarily to a host target binding site located in an untranslated region of VGAM355 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM355 host target RNA into VGAM355 host target protein, herein schematically represented by VGAM1 HOST TARGET PROTEIN through VGAM3 HOST TARGET PROTEIN, all of FIG. 1.

VGAM356 RNA, herein schematically represented by VGAM1 RNA through VGAM3 RNA, binds complementarily to a host target binding site located in an untranslated region of VGAM356 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM356 host target RNA into VGAM356 host target protein, herein schematically represented by VGAM1 HOST TARGET PROTEIN through VGAM3 HOST TARGET PROTEIN, all of FIG. 1.

VGAM357 RNA, herein schematically represented by VGAM1 RNA through VGAM3 RNA, binds complementarily to a host target binding site located in an untranslated region of VGAM357 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM357 host target RNA into VGAM357 host target protein, herein schematically represented by VGAM1 HOST TARGET PROTEIN through VGAM3 HOST TARGET PROTEIN, all of FIG. 1.

It is appreciated that a function of VGR2792 gene, herein designated VGR GENE, is inhibition of expression of host target genes, as part of a novel viral mechanism of attacking a host. Accordingly, utilities of VGR2792 gene include diagnosis, prevention and treatment of viral infection by Avian Infectious Bronchitis Virus. Specific functions, and accordingly utilities, of VGR2792 gene correlate with, and may be deduced from, the identity of the host target genes, which are inhibited by VGAM RNAs comprised in the 'operon-like' cluster of VGR2792 gene: VGAM350 host target protein, VGAM351 host target protein, VGAM352 host target protein, VGAM353 host target protein, VGAM354 host target protein, VGAM355 host target protein, VGAM356 host target protein and VGAM357 host target protein, herein schematically represented by VGAM1 HOST TARGET PROTEIN through VGAM3 HOST TARGET PROTEIN. The function of these host target genes is elaborated hereinabove with reference to VGAM350, VGAM351, VGAM352, VGAM353, VGAM354, VGAM355, VGAM356 and VGAM357. FIG. 9 further provides a conceptual description of novel bioinformatically detected regulatory viral gene, referred to here as Viral Genomic Record 2793(VGR2793) viral gene, which encodes an 'operon-like' cluster of novel viral micro RNA-like genes, each of which in turn modulates expression of at least one host target gene, the function and utility of which at least one host target gene is known in the art.

VGR2793 gene, herein designated VGR GENE, is a novel bioinformatically detected regulatory, non protein coding, RNA viral gene. The method by which VGR2793 gene was detected is described hereinabove with reference to FIGS. 1-9.

VGR2793 gene encodes VGR2793 precursor RNA, herein designated VGR PRECURSOR RNA, an RNA molecule, typically several hundred nucleotides long.

VGR2793 precursor RNA folds spatially, forming VGR2793 folded precursor RNA, herein designated VGR FOLDED PRECURSOR RNA. It is appreciated that VGR2793 folded precursor RNA comprises a plurality of what is known in the art as 'hairpin' structures. These 'hairpin' structures are due to the fact that the nucleotide sequence of VGR2793 precursor RNA comprises a plurality of segments, the first half of each such segment having a nucleotide sequence which is at least a partial inversed-reversed sequence of the second half thereof, as is well known in the art.

VGR2793 folded precursor RNA is naturally processed by cellular enzymatic activity into at least 7 separate VGAM precursor RNAs, VGAM358 precursor RNA, VGAM359 precursor RNA, VGAM360 precursor RNA, VGAM361 precursor RNA, VGAM362 precursor RNA, VGAM363 precursor RNA and VGAM364 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM358 RNA, VGAM359 RNA, VGAM360 RNA, VGAM361 RNA, VGAM362 RNA, VGAM363 RNA and VGAM364 RNA, herein schematically represented by VGAM1 RNA through VGAM3 RNA, each of which VGAM RNAs corresponding to VGAM RNA of FIG. 1.

VGAM358 RNA, herein schematically represented by VGAM1 RNA through VGAM3 RNA, binds complementarily to a host target binding site located in an untranslated region of VGAM358 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM358 host target RNA into VGAM358 host target protein, herein schematically represented by VGAM1 HOST TARGET PROTEIN through VGAM3 HOST TARGET PROTEIN, all of FIG. 1.

VGAM359 RNA, herein schematically represented by VGAM1 RNA through VGAM3 RNA, binds complementarily to a host target binding site located in an untranslated region of VGAM359 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM359 host target RNA into VGAM359 host target protein, herein schematically represented by VGAM1 HOST TARGET PROTEIN through VGAM3 HOST TARGET PROTEIN, all of FIG. 1.

VGAM360 RNA, herein schematically represented by VGAM1 RNA through VGAM3 RNA, binds complementarily to a host target binding site located in an untranslated region of VGAM360 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM360 host target RNA into VGAM360 host target protein, herein schematically represented by VGAM1 HOST TARGET PROTEIN through VGAM3 HOST TARGET PROTEIN, all of FIG. 1.

VGAM361 RNA, herein schematically represented by VGAM1 RNA through VGAM3 RNA, binds complementarily to a host target binding site located in an untranslated region of VGAM361 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM361 host target RNA into VGAM361 host target protein, herein schematically represented by VGAM1 HOST TARGET PROTEIN through VGAM3 HOST TARGET PROTEIN, all of FIG. 1.

VGAM362 RNA, herein schematically represented by VGAM1 RNA through VGAM3 RNA, binds complementarily to a host target binding site located in an untranslated region of VGAM362 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM362 host target RNA into VGAM362 host target protein, herein schematically represented by VGAM1 HOST TARGET PROTEIN through VGAM3 HOST TARGET PROTEIN, all of FIG. 1.

VGAM363 RNA, herein schematically represented by VGAM1 RNA through VGAM3 RNA, binds complementarily to a host target binding site located in an untranslated region of VGAM363 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM363 host target RNA into VGAM363 host target protein, herein schematically represented by VGAM1 HOST TARGET PROTEIN through VGAM3 HOST TARGET PROTEIN, all of FIG. 1.

VGAM364 RNA, herein schematically represented by VGAM1 RNA through VGAM3 RNA, binds complementarily to a host target binding site located in an untranslated region of VGAM364 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM364 host target RNA into VGAM364 host target protein, herein schematically represented by VGAM1 HOST TARGET PROTEIN through VGAM3 HOST TARGET PROTEIN, all of FIG. 1.

It is appreciated that a function of VGR2793 gene, herein designated VGR GENE, is inhibition of expression of host target genes, as part of a novel viral mechanism of attacking a host. Accordingly, utilities of VGR2793 gene include diagnosis, prevention and treatment of viral infection by Avian Infectious Bronchitis Virus. Specific functions, and accordingly utilities, of VGR2793 gene correlate with, and may be deduced from, the identity of the host target genes, which are inhibited by VGAM RNAs comprised in the 'operon-like' cluster of VGR2793 gene: VGAM358 host target protein, VGAM359 host target protein, VGAM360 host target protein, VGAM361 host target protein, VGAM362 host target protein, VGAM363 host target protein and VGAM364 host target protein, herein schematically represented by VGAM1 HOST TARGET PROTEIN through VGAM3 HOST TARGET PROTEIN. The function of these host target genes is elaborated hereinabove with reference to VGAM358, VGAM359, VGAM360, VGAM361, VGAM362, VGAM363 and VGAM364. FIG. 9 further provides a conceptual description of novel bioinformatically detected regulatory viral gene, referred to here as Viral Genomic Record 2794(VGR2794) viral gene, which encodes an 'operon-like' cluster of novel viral micro RNA-like genes, each of which in turn modulates expression of at least one host target gene, the function and utility of which at least one host target gene is known in the art.

VGR2794 gene, herein designated VGR GENE, is a novel bioinformatically detected regulatory, non protein coding, RNA viral gene. The method by which VGR2794 gene was detected is described hereinabove with reference to FIGS. 1-9.

VGR2794 gene encodes VGR2794 precursor RNA, herein designated VGR PRECURSOR RNA, an RNA molecule, typically several hundred nucleotides long.

VGR2794 precursor RNA folds spatially, forming VGR2794 folded precursor RNA, herein designated VGR FOLDED PRECURSOR RNA. It is appreciated that VGR2794 folded precursor RNA comprises a plurality of what is known in the art as 'hairpin' structures. These 'hairpin' structures are due to the fact that the nucleotide sequence of VGR2794 precursor RNA comprises a plurality of segments, the first half of each such segment having a nucleotide sequence which is at least a partial inversed-reversed sequence of the second half thereof, as is well known in the art.

VGR2794 folded precursor RNA is naturally processed by cellular enzymatic activity into at least 4 separate VGAM precursor RNAs, VGAM365 precursor RNA, VGAM366 precursor RNA, VGAM367 precursor RNA and VGAM368 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM365 RNA, VGAM366 RNA, VGAM367 RNA and VGAM368 RNA, herein schematically represented by VGAM1 RNA through VGAM3 RNA, each of which VGAM RNAs corresponding to VGAM RNA of FIG. 1.

VGAM365 RNA, herein schematically represented by VGAM1 RNA through VGAM3 RNA, binds complementarily to a host target binding site located in an untranslated region of VGAM365 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM365 host target RNA into VGAM365 host target protein, herein schematically represented by VGAM1 HOST TARGET PROTEIN through VGAM3 HOST TARGET PROTEIN, all of FIG. 1.

VGAM366 RNA, herein schematically represented by VGAM1 RNA through VGAM3 RNA, binds complementarily to a host target binding site located in an untranslated region of VGAM366 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM366 host target RNA into VGAM366 host target protein, herein schematically represented by VGAM1 HOST TARGET PROTEIN through VGAM3 HOST TARGET PROTEIN, all of FIG. 1.

VGAM367 RNA, herein schematically represented by VGAM1 RNA through VGAM3 RNA, binds complementarily to a host target binding site located in an untranslated region of VGAM367 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM367 host target RNA into VGAM367 host target protein, herein schematically represented by VGAM1 HOST TARGET PROTEIN through VGAM3 HOST TARGET PROTEIN, all of FIG. 1.

VGAM368 RNA, herein schematically represented by VGAM1 RNA through VGAM3 RNA, binds complementarily to a host target binding site located in an untranslated region of VGAM368 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM368 host target RNA into VGAM368 host target protein, herein schematically represented by VGAM1 HOST TARGET PROTEIN through VGAM3 HOST TARGET PROTEIN, all of FIG. 1.

It is appreciated that a function of VGR2794 gene, herein designated VGR GENE, is inhibition of expression of host target genes, as part of a novel viral mechanism of attacking a host. Accordingly, utilities of VGR2794 gene include diagnosis, prevention and treatment of viral infection by Avian Infectious Bronchitis Virus. Specific functions, and accordingly utilities, of VGR2794 gene correlate with, and may be deduced from, the identity of the host target genes, which are inhibited by VGAM RNAs comprised in the 'operon-like' cluster of VGR2794 gene: VGAM365 host target protein, VGAM366 host target protein, VGAM367 host target protein and VGAM368 host target protein, herein schematically represented by VGAM1 HOST TARGET PROTEIN through VGAM3 HOST TARGET PROTEIN. The function of these host target genes is elaborated hereinabove with reference to VGAM365, VGAM366, VGAM367 and VGAM368. FIG. 9 further provides a conceptual description of novel bioinformatically detected regulatory viral gene, referred to here as Viral Genomic Record 2795(VGR2795) viral gene, which encodes an 'operon-like' cluster of novel viral micro RNA-like genes, each of which in turn modulates expression of at least one host target gene, the function and utility of which at least one host target gene is known in the art.

VGR2795 gene, herein designated VGR GENE, is a novel bioinformatically detected regulatory, non protein coding, RNA viral gene. The method by which VGR2795 gene was detected is described hereinabove with reference to FIGS. 1-9.

VGR2795 gene encodes VGR2795 precursor RNA, herein designated VGR PRECURSOR RNA, an RNA molecule, typically several hundred nucleotides long.

VGR2795 precursor RNA folds spatially, forming VGR2795 folded precursor RNA, herein designated VGR FOLDED PRECURSOR RNA. It is appreciated that VGR2795 folded precursor RNA comprises a plurality of what is known in the art as 'hairpin' structures. These 'hairpin' structures are due to the fact that the nucleotide sequence of VGR2795 precursor RNA comprises a plurality of segments, the first half of each such segment having a nucleotide sequence which is at least a partial inversed-reversed sequence of the second half thereof, as is well known in the art.

VGR2795 folded precursor RNA is naturally processed by cellular enzymatic activity into at least 7 separate VGAM precursor RNAs, VGAM369 precursor RNA, VGAM370 precursor RNA, VGAM371 precursor RNA, VGAM372 precursor RNA, VGAM373 precursor RNA, VGAM374 precursor RNA and VGAM375 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM369 RNA, VGAM370 RNA, VGAM371 RNA, VGAM372 RNA, VGAM373 RNA, VGAM374 RNA and VGAM375 RNA, herein schematically represented by VGAM1 RNA through VGAM3 RNA, each of which VGAM RNAs corresponding to VGAM RNA of FIG. 1.

VGAM369 RNA, herein schematically represented by VGAM1 RNA through VGAM3 RNA, binds complementarily to a host target binding site located in an untranslated region of VGAM369 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM369 host target RNA into VGAM369 host target protein, herein schematically represented by VGAM1 HOST TARGET PROTEIN through VGAM3 HOST TARGET PROTEIN, all of FIG. 1.

VGAM370 RNA, herein schematically represented by VGAM1 RNA through VGAM3 RNA, binds complementarily to a host target binding site located in an untranslated region of VGAM370 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM370 host target RNA into VGAM370 host target protein, herein schematically represented by VGAM1 HOST TARGET PROTEIN through VGAM3 HOST TARGET PROTEIN, all of FIG. 1.

VGAM371 RNA, herein schematically represented by VGAM1 RNA through VGAM3 RNA, binds complementarily to a host target binding site located in an untranslated region of VGAM371 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM371 host target RNA into VGAM371 host target protein, herein schematically represented by VGAM1 HOST TARGET PROTEIN through VGAM3 HOST TARGET PROTEIN, all of FIG. 1.

VGAM372 RNA, herein schematically represented by VGAM1 RNA through VGAM3 RNA, binds complementarily to a host target binding site located in an untranslated region of VGAM372 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM372 host target RNA into VGAM372 host target protein, herein schematically represented by VGAM1 HOST TARGET PROTEIN through VGAM3 HOST TARGET PROTEIN, all of FIG. 1.

VGAM373 RNA, herein schematically represented by VGAM1 RNA through VGAM3 RNA, binds complementarily to a host target binding site located in an untranslated region of VGAM373 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM373 host target RNA into VGAM373 host target protein, herein schematically represented by VGAM1 HOST TARGET PROTEIN through VGAM3 HOST TARGET PROTEIN, all of FIG. 1.

VGAM374 RNA, herein schematically represented by VGAM1 RNA through VGAM3 RNA, binds complementarily to a host target binding site located in an untranslated region of VGAM374 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM374 host target RNA into VGAM374 host target protein, herein schematically represented by VGAM1 HOST TARGET PROTEIN through VGAM3 HOST TARGET PROTEIN, all of FIG. 1.

VGAM375 RNA, herein schematically represented by VGAM1 RNA through VGAM3 RNA, binds complementarily to a host target binding site located in an untranslated region of VGAM375 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM375 host target RNA into VGAM375 host target protein, herein schematically represented by VGAM1 HOST TARGET PROTEIN through VGAM3 HOST TARGET PROTEIN, all of FIG. 1.

It is appreciated that a function of VGR2795 gene, herein designated VGR GENE, is inhibition of expression of host target genes, as part of a novel viral mechanism of attacking a host. Accordingly, utilities of VGR2795 gene include diagnosis, prevention and treatment of viral infection by Avian Infectious Bronchitis Virus. Specific functions, and accordingly utilities, of VGR2795 gene correlate with, and may be deduced from, the identity of the host target genes, which are inhibited by VGAM RNAs comprised in the 'operon-like' cluster of VGR2795 gene: VGAM369 host target protein, VGAM370 host target protein, VGAM371 host target protein, VGAM372 host target protein, VGAM373 host target protein, VGAM374 host target protein and VGAM375 host target protein, herein schematically represented by VGAM1 HOST TARGET PROTEIN through VGAM3 HOST TARGET PROTEIN. The function of these host target genes is elaborated hereinabove with reference to VGAM369, VGAM370, VGAM371, VGAM372, VGAM373, VGAM374 and VGAM375. FIG. 9 further provides a conceptual description of novel bioinformatically detected regulatory viral gene, referred to here as Viral Genomic Record 2796(VGR2796) viral gene, which encodes an 'operon-like' cluster of novel viral micro RNA-like genes, each of which in turn modulates expression of at least one host target gene, the function and utility of which at least one host target gene is known in the art.

VGR2796 gene, herein designated VGR GENE, is a novel bioinformatically detected regulatory, non protein coding, RNA viral gene. The method by which VGR2796 gene was detected is described hereinabove with reference to FIGS. 1-9.

VGR2796 gene encodes VGR2796 precursor RNA, herein designated VGR PRECURSOR RNA, an RNA molecule, typically several hundred nucleotides long.

VGR2796 precursor RNA folds spatially, forming VGR2796 folded precursor RNA, herein designated VGR FOLDED PRECURSOR RNA. It is appreciated that VGR2796 folded precursor RNA comprises a plurality of what is known in the art as 'hairpin' structures. These 'hairpin' structures are due to the fact that the nucleotide sequence of VGR2796 precursor RNA comprises a plurality of segments, the first half of each such segment having a nucleotide sequence which is at least a partial inversed-reversed sequence of the second half thereof, as is well known in the art.

VGR2796 folded precursor RNA is naturally processed by cellular enzymatic activity into at least 2 separate VGAM precursor RNAs, VGAM376 precursor RNA and VGAM377 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM376 RNA and VGAM377 RNA, herein schematically represented by VGAM1 RNA through VGAM3 RNA, each of which VGAM RNAs corresponding to VGAM RNA of FIG. 1.

VGAM376 RNA, herein schematically represented by VGAM1 RNA through VGAM3 RNA, binds complementarily to a host target binding site located in an untranslated region of VGAM376 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM376 host target RNA into VGAM376 host target protein, herein schematically represented by VGAM1 HOST TARGET PROTEIN through VGAM3 HOST TARGET PROTEIN, all of FIG. 1.

VGAM377 RNA, herein schematically represented by VGAM1 RNA through VGAM3 RNA, binds complementarily to a host target binding site located in an untranslated region of VGAM377 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM377 host target RNA into VGAM377 host target protein, herein schematically represented by VGAM1 HOST TARGET PROTEIN through VGAM3 HOST TARGET PROTEIN, all of FIG. 1.

It is appreciated that a function of VGR2796 gene, herein designated VGR GENE, is inhibition of expression of host target genes, as part of a novel viral mechanism of attacking a host. Accordingly, utilities of VGR2796 gene include diagnosis, prevention and treatment of viral infection by Eggplant Mosaic Virus. Specific functions, and accordingly utilities, of VGR2796 gene correlate with, and may be deduced from, the identity of the host target genes, which are inhibited by VGAM RNAs comprised in the 'operon-like' cluster of VGR2796 gene: VGAM376 host target protein and VGAM377 host target protein, herein schematically represented by VGAM1 HOST TARGET PROTEIN through VGAM3 HOST TARGET PROTEIN. The function of these host target genes is elaborated hereinabove with reference to VGAM376 and VGAM377. FIG. 9 further provides a conceptual description of novel bioinformatically detected regulatory viral gene, referred to here as Viral Genomic Record 2797(VGR2797) viral gene, which encodes an 'operon-like' cluster of novel viral micro RNA-like genes, each of which in turn modulates expression of at least one host target gene, the function and utility of which at least one host target gene is known in the art.

VGR2797 gene, herein designated VGR GENE, is a novel bioinformatically detected regulatory, non protein coding, RNA viral gene. The method by which VGR2797 gene was detected is described hereinabove with reference to FIGS. 1-9.

VGR2797 gene encodes VGR2797 precursor RNA, herein designated VGR PRECURSOR RNA, an RNA molecule, typically several hundred nucleotides long.

VGR2797 precursor RNA folds spatially, forming VGR2797 folded precursor RNA, herein designated VGR FOLDED PRECURSOR RNA. It is appreciated that VGR2797 folded precursor RNA comprises a plurality of what is known in the art as 'hairpin' structures. These 'hairpin' structures are due to the fact that the nucleotide sequence of VGR2797 precursor RNA comprises a plurality of segments, the first half of each such segment having a nucleotide sequence which is at least a partial inversed-reversed sequence of the second half thereof, as is well known in the art.

VGR2797 folded precursor RNA is naturally processed by cellular enzymatic activity into at least 4 separate VGAM precursor RNAs, VGAM378 precursor RNA, VGAM379 precursor RNA, VGAM380 precursor RNA and VGAM381 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM378 RNA, VGAM379 RNA, VGAM380 RNA and VGAM381 RNA, herein schematically represented by VGAM1 RNA through VGAM3 RNA, each of which VGAM RNAs corresponding to VGAM RNA of FIG. 1.

VGAM378 RNA, herein schematically represented by VGAM1 RNA through VGAM3 RNA, binds complementarily to a host target binding site located in an untranslated region of VGAM378 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM378 host target RNA into VGAM378 host target protein, herein schematically represented by VGAM1 HOST TARGET PROTEIN through VGAM3 HOST TARGET PROTEIN, all of FIG. 1.

VGAM379 RNA, herein schematically represented by VGAM1 RNA through VGAM3 RNA, binds complementarily to a host target binding site located in an untranslated region of VGAM379 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM379 host target RNA into VGAM379 host target protein, herein schematically represented by VGAM1 HOST TARGET PROTEIN through VGAM3 HOST TARGET PROTEIN, all of FIG. 1.

VGAM380 RNA, herein schematically represented by VGAM1 RNA through VGAM3 RNA, binds complementarily to a host target binding site located in an untranslated region of VGAM380 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM380 host target RNA into VGAM380 host target protein, herein schematically represented by VGAM1 HOST TARGET PROTEIN through VGAM3 HOST TARGET PROTEIN, all of FIG. 1.

VGAM381 RNA, herein schematically represented by VGAM1 RNA through VGAM3 RNA, binds complementarily to a host target binding site located in an untranslated region of VGAM381 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM381 host target RNA into VGAM381 host target protein, herein schematically represented by VGAM1 HOST TARGET PROTEIN through VGAM3 HOST TARGET PROTEIN, all of FIG. 1.

It is appreciated that a function of VGR2797 gene, herein designated VGR GENE, is inhibition of expression of host target genes, as part of a novel viral mechanism of attacking a host. Accordingly, utilities of VGR2797 gene include diagnosis, prevention and treatment of viral infection by Feline Immunodeficiency Virus. Specific functions, and accordingly utilities, of VGR2797 gene correlate with, and may be deduced from, the identity of the host target genes, which are inhibited by VGAM RNAs comprised in the 'operon-like' cluster of VGR2797 gene: VGAM378 host target protein, VGAM379 host target protein, VGAM380 host target protein and VGAM381 host target protein, herein schematically represented by VGAM1 HOST TARGET PROTEIN through VGAM3 HOST TARGET PROTEIN. The function of these host target genes is elaborated hereinabove with reference to VGAM378, VGAM379, VGAM380 and VGAM381. FIG. 9 further provides a conceptual description of novel bioinformatically detected regulatory viral gene, referred to here as Viral Genomic Record 2798(VGR2798) viral gene, which encodes an 'operon-like' cluster of novel viral micro RNA-like genes, each of which in turn modulates expression of at least one host target gene, the function and utility of which at least one host target gene is known in the art.

VGR2798 gene, herein designated VGR GENE, is a novel bioinformatically detected regulatory, non protein coding, RNA viral gene. The method by which VGR2798 gene was detected is described hereinabove with reference to FIGS. 1-9.

VGR2798 gene encodes VGR2798 precursor RNA, herein designated VGR PRECURSOR RNA, an RNA molecule, typically several hundred nucleotides long.

VGR2798 precursor RNA folds spatially, forming VGR2798 folded precursor RNA, herein designated VGR FOLDED PRECURSOR RNA. It is appreciated that VGR2798 folded precursor RNA comprises a plurality of what is known in the art as 'hairpin' structures. These 'hairpin' structures are due to the fact that the nucleotide sequence of VGR2798 precursor RNA comprises a plurality of segments, the first half of each such segment having a nucleotide sequence which is at least a partial inversed-reversed sequence of the second half thereof, as is well known in the art.

VGR2798 folded precursor RNA is naturally processed by cellular enzymatic activity into at least 5 separate VGAM precursor RNAs, VGAM382 precursor RNA, VGAM383 precursor RNA, VGAM384 precursor RNA, VGAM385 precursor RNA and VGAM386 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM382 RNA, VGAM383 RNA, VGAM384 RNA, VGAM385 RNA and VGAM386 RNA, herein schematically represented by VGAM1 RNA through VGAM3 RNA, each of which VGAM RNAs corresponding to VGAM RNA of FIG. 1.

VGAM382 RNA, herein schematically represented by VGAM1 RNA through VGAM3 RNA, binds complementarily to a host target binding site located in an untranslated region of VGAM382 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM382 host target RNA into VGAM382 host target protein, herein schematically represented by VGAM1 HOST TARGET PROTEIN through VGAM3 HOST TARGET PROTEIN, all of FIG. 1.

VGAM383 RNA, herein schematically represented by VGAM1 RNA through VGAM3 RNA, binds complementarily to a host target binding site located in an untranslated region of VGAM383 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM383 host target RNA into VGAM383 host target protein, herein schematically represented by VGAM1 HOST TARGET PROTEIN through VGAM3 HOST TARGET PROTEIN, all of FIG. 1.

VGAM384 RNA, herein schematically represented by VGAM1 RNA through VGAM3 RNA, binds complementarily to a host target binding site located in an untranslated region of VGAM384 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM384 host target RNA into VGAM384 host target protein, herein schematically represented by VGAM1 HOST TARGET PROTEIN through VGAM3 HOST TARGET PROTEIN, all of FIG. 1.

VGAM385 RNA, herein schematically represented by VGAM1 RNA through VGAM3 RNA, binds complementarily to a host target binding site located in an untranslated region of VGAM385 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM385 host target RNA into VGAM385 host target protein, herein schematically represented by VGAM1 HOST TARGET PROTEIN through VGAM3 HOST TARGET PROTEIN, all of FIG. 1.

VGAM386 RNA, herein schematically represented by VGAM1 RNA through VGAM3 RNA, binds complementarily to a host target binding site located in an untranslated region of VGAM386 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM386 host target RNA into VGAM386 host target protein, herein schematically represented by VGAM1 HOST TARGET PROTEIN through VGAM3 HOST TARGET PROTEIN, all of FIG. 1.

It is appreciated that a function of VGR2798 gene, herein designated VGR GENE, is inhibition of expression of host target genes, as part of a novel viral mechanism of attacking a host. Accordingly, utilities of VGR2798 gene include diagnosis, prevention and treatment of viral infection by Hepatitis A Virus. Specific functions, and accordingly utilities, of VGR2798 gene correlate with, and may be deduced from, the identity of the host target genes, which are inhibited by VGAM RNAs comprised in the 'operon-like' cluster of VGR2798 gene: VGAM382 host target protein, VGAM383 host target protein, VGAM384 host target protein, VGAM385 host target protein and VGAM386 host target protein, herein schematically represented by VGAM1 HOST TARGET PROTEIN through VGAM3 HOST TARGET PROTEIN. The function of these host target genes is elaborated hereinabove with reference to VGAM382, VGAM383, VGAM384, VGAM385 and VGAM386. FIG. 9 further provides a conceptual description of novel bioinformatically detected regulatory viral gene, referred to here as Viral Genomic Record 2799(VGR2799) viral gene, which encodes an 'operon-like' cluster of novel viral micro RNA-like genes, each of which in turn modulates expression of at least one host target gene, the function and utility of which at least one host target gene is known in the art.

VGR2799 gene, herein designated VGR GENE, is a novel bioinformatically detected regulatory, non protein coding, RNA viral gene. The method by which VGR2799 gene was detected is described hereinabove with reference to FIGS. 1-9.

VGR2799 gene encodes VGR2799 precursor RNA, herein designated VGR PRECURSOR RNA, an RNA molecule, typically several hundred nucleotides long.

VGR2799 precursor RNA folds spatially, forming VGR2799 folded precursor RNA, herein designated VGR FOLDED PRECURSOR RNA. It is appreciated that VGR2799 folded precursor RNA comprises a plurality of what is known in the art as 'hairpin' structures. These 'hairpin' structures are due to the fact that the nucleotide sequence of VGR2799 precursor RNA comprises a plurality of segments, the first half of each such segment having a nucleotide sequence which is at least a partial inversed-reversed sequence of the second half thereof, as is well known in the art.

VGR2799 folded precursor RNA is naturally processed by cellular enzymatic activity into at least 5 separate VGAM precursor RNAs, VGAM387 precursor RNA, VGAM388 precursor RNA, VGAM389 precursor RNA, VGAM390 precursor RNA and VGAM391 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM387 RNA, VGAM388 RNA, VGAM389 RNA, VGAM390 RNA and VGAM391 RNA, herein schematically represented by VGAM1 RNA through VGAM3 RNA, each of which VGAM RNAs corresponding to VGAM RNA of FIG. 1.

VGAM387 RNA, herein schematically represented by VGAM1 RNA through VGAM3 RNA, binds complementarily to a host target binding site located in an untranslated region of VGAM387 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM387 host target RNA into VGAM387 host target protein, herein schematically represented by VGAM1 HOST TARGET PROTEIN through VGAM3 HOST TARGET PROTEIN, all of FIG. 1.

VGAM388 RNA, herein schematically represented by VGAM1 RNA through VGAM3 RNA, binds complementarily to a host target binding site located in an untranslated region of VGAM388 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM388 host target RNA into VGAM388 host target protein, herein schematically represented by VGAM1 HOST TARGET PROTEIN through VGAM3 HOST TARGET PROTEIN, all of FIG. 1.

VGAM389 RNA, herein schematically represented by VGAM1 RNA through VGAM3 RNA, binds complementarily to a host target binding site located in an untranslated region of VGAM389 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM389 host target RNA into VGAM389 host target protein, herein schematically represented by VGAM1 HOST TARGET PROTEIN through VGAM3 HOST TARGET PROTEIN, all of FIG. 1.

VGAM390 RNA, herein schematically represented by VGAM1 RNA through VGAM3 RNA, binds complementarily to a host target binding site located in an untranslated region of VGAM390 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM390 host target RNA into VGAM390 host target protein, herein schematically represented by VGAM1 HOST TARGET PROTEIN through VGAM3 HOST TARGET PROTEIN, all of FIG. 1.

VGAM391 RNA, herein schematically represented by VGAM1 RNA through VGAM3 RNA, binds complementarily to a host target binding site located in an untranslated region of VGAM391 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM391 host target RNA into VGAM391 host target protein, herein schematically represented by VGAM1 HOST TARGET PROTEIN through VGAM3 HOST TARGET PROTEIN, all of FIG. 1.

It is appreciated that a function of VGR2799 gene, herein designated VGR GENE, is inhibition of expression of host target genes, as part of a novel viral mechanism of attacking a host. Accordingly, utilities of VGR2799 gene include diagnosis, prevention and treatment of viral infection by Equine Herpesvirus 1. Specific functions, and accordingly utilities, of VGR2799 gene correlate with, and may be deduced from, the identity of the host target genes, which are inhibited by VGAM RNAs comprised in the 'operon-like' cluster of VGR2799 gene: VGAM387 host target protein, VGAM388 host target protein, VGAM389 host target protein, VGAM390 host target protein and VGAM391 host target protein, herein schematically represented by VGAM1 HOST TARGET PROTEIN through VGAM3 HOST TARGET PROTEIN. The function of these host target genes is elaborated hereinabove with reference to VGAM387, VGAM388, VGAM389, VGAM390 and VGAM391. FIG. 9 further provides a conceptual description of novel bioinformatically detected regulatory viral gene, referred to here as Viral Genomic Record 2800(VGR2800) viral gene, which encodes an 'operon-like' cluster of novel viral micro RNA-like genes, each of which in turn modulates expression of at least one host target gene, the function and utility of which at least one host target gene is known in the art.

VGR2800 gene, herein designated VGR GENE, is a novel bioinformatically detected regulatory, non protein coding, RNA viral gene. The method by which VGR2800 gene was detected is described hereinabove with reference to FIGS. 1-9.

VGR2800 gene encodes VGR2800 precursor RNA, herein designated VGR PRECURSOR RNA, an RNA molecule, typically several hundred nucleotides long.

VGR2800 precursor RNA folds spatially, forming VGR2800 folded precursor RNA, herein designated VGR FOLDED PRECURSOR RNA. It is appreciated that VGR2800 folded precursor RNA comprises a plurality of what is known in the art as 'hairpin' structures. These 'hairpin' structures are due to the fact that the nucleotide sequence of VGR2800 precursor RNA comprises a plurality of segments, the first half of each such segment having a nucleotide sequence which is at least a partial inversed-reversed sequence of the second half thereof, as is well known in the art.

VGR2800 folded precursor RNA is naturally processed by cellular enzymatic activity into at least 8 separate VGAM precursor RNAs, VGAM393 precursor RNA, VGAM394 precursor RNA, VGAM395 precursor RNA, VGAM396 precursor RNA, VGAM397 precursor RNA, VGAM398 precursor RNA, VGAM399 precursor RNA and VGAM400 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM393 RNA, VGAM394 RNA, VGAM395 RNA, VGAM396 RNA, VGAM397 RNA, VGAM398 RNA, VGAM399 RNA and VGAM400 RNA, herein schematically represented by VGAM1 RNA through VGAM3 RNA, each of which VGAM RNAs corresponding to VGAM RNA of FIG. 1.

VGAM393 RNA, herein schematically represented by VGAM1 RNA through VGAM3 RNA, binds complementarily to a host target binding site located in an untranslated region of VGAM393 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM393 host target RNA into VGAM393 host target protein, herein schematically represented by VGAM1 HOST TARGET PROTEIN through VGAM3 HOST TARGET PROTEIN, all of FIG. 1.

VGAM394 RNA, herein schematically represented by VGAM1 RNA through VGAM3 RNA, binds complementarily to a host target binding site located in an untranslated region of VGAM394 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM394 host target RNA into VGAM394 host target protein, herein schematically represented by VGAM1 HOST TARGET PROTEIN through VGAM3 HOST TARGET PROTEIN, all of FIG. 1.

VGAM395 RNA, herein schematically represented by VGAM1 RNA through VGAM3 RNA, binds complementarily to a host target binding site located in an untranslated region of VGAM395 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM395 host target RNA into VGAM395 host target protein, herein schematically represented by VGAM1 HOST TARGET PROTEIN through VGAM3 HOST TARGET PROTEIN, all of FIG. 1.

VGAM396 RNA, herein schematically represented by VGAM1 RNA through VGAM3 RNA, binds complementarily to a host target binding site located in an untranslated region of VGAM396 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM396 host target RNA into VGAM396 host target protein, herein schematically represented by VGAM1 HOST TARGET PROTEIN through VGAM3 HOST TARGET PROTEIN, all of FIG. 1.

VGAM397 RNA, herein schematically represented by VGAM1 RNA through VGAM3 RNA, binds complementarily to a host target binding site located in an untranslated region of VGAM397 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM397 host target RNA into VGAM397 host target protein, herein schematically represented by VGAM1 HOST TARGET PROTEIN through VGAM3 HOST TARGET PROTEIN, all of FIG. 1.

VGAM398 RNA, herein schematically represented by VGAM1 RNA through VGAM3 RNA, binds complementarily to a host target binding site located in an untranslated region of VGAM398 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM398 host target RNA into VGAM398 host target protein, herein schematically represented by VGAM1 HOST TARGET PROTEIN through VGAM3 HOST TARGET PROTEIN, all of FIG. 1.

VGAM399 RNA, herein schematically represented by VGAM1 RNA through VGAM3 RNA, binds complementarily to a host target binding site located in an untranslated region of VGAM399 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM399 host target RNA into VGAM399 host target protein, herein schematically represented by VGAM1 HOST TARGET PROTEIN through VGAM3 HOST TARGET PROTEIN, all of FIG. 1.

VGAM400 RNA, herein schematically represented by VGAM1 RNA through VGAM3 RNA, binds complementarily to a host target binding site located in an untranslated region of VGAM400 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM400 host target RNA into VGAM400 host target protein, herein schematically represented by VGAM1 HOST TARGET PROTEIN through VGAM3 HOST TARGET PROTEIN, all of FIG. 1.

It is appreciated that a function of VGR2800 gene, herein designated VGR GENE, is inhibition of expression of host target genes, as part of a novel viral mechanism of attacking a host. Accordingly, utilities of VGR2800 gene include diagnosis, prevention and treatment of viral infection by Cryphonectria Hypovirus 1. Specific functions, and accordingly utilities, of VGR2800 gene correlate with, and may be deduced from, the identity of the host target genes, which are inhibited by VGAM RNAs com cally represented by VGAM1 HOST TARGET PROTEIN through VGAM3 HOST TARGET PROTEIN, all of FIG. 1.

VGAM406 RNA, herein schematically represented by VGAM1 RNA through VGAM3 RNA, binds complementarily to a host target binding site located in an untranslated region of VGAM406 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM406 host target RNA into VGAM406 host target protein, herein schematically represented by VGAM1 HOST TARGET PROTEIN through VGAM3 HOST TARGET PROTEIN, all of FIG. 1.

It is appreciated that a function of VGR2801 gene, herein designated VGR GENE, is inhibition of expression of host target genes, as part of a novel viral mechanism of attacking a host. Accordingly, utilities of VGR2801 gene include diagnosis, prevention and treatment of viral infection by Cryphonectria Hypovirus 1. Specific functions, and accordingly utilities, of VGR2801 gene correlate with, and may be deduced from, the identity of the host target genes, which are inhibited by VGAM RNAs comprised in the 'operon-like' cluster of VGR2801 gene: VGAM401 host target protein, VGAM402 host target protein, VGAM403 host target protein, VGAM404 host target protein, VGAM405 host target protein and VGAM406 host target protein, herein schematically represented by VGAM1 HOST TARGET PROTEIN through VGAM3 HOST TARGET PROTEIN. The function of these host target genes is elaborated hereinabove with reference to VGAM401, VGAM402, VGAM403, VGAM404, VGAM405 and VGAM406. FIG. 9 further provides a conceptual description of novel bioinformatically detected regulatory viral gene, referred to here as Viral Genomic Record 2802(VGR2802) viral gene, which encodes an 'operon-like' cluster of novel viral micro RNA-like genes, each of which in turn modulates expression of at least one host target gene, the function and utility of which at least one host target gene is known in the art.

VGR2802 gene, herein designated VGR GENE, is a novel bioinformatically detected regulatory, non protein coding, RNA viral gene. The method by which VGR2802 gene was detected is described hereinabove with reference to FIGS. 1-9.

VGR2802 gene encodes VGR2802 precursor RNA, herein designated VGR PRECURSOR RNA, an RNA molecule, typically several hundred nucleotides long.

VGR2802 precursor RNA folds spatially, forming VGR2802 folded precursor RNA, herein designated VGR FOLDED PRECURSOR RNA. It is appreciated that VGR2802 folded precursor RNA comprises a plurality of what is known in the art as 'hairpin' structures. These 'hairpin' structures are due to the fact that the nucleotide sequence of VGR2802 precursor RNA comprises a plurality of segments, the first half of each such segment having a nucleotide sequence which is at least a partial inversed-reversed sequence of the second half thereof, as is well known in the art.

VGR2802 folded precursor RNA is naturally processed by cellular enzymatic activity into at least 3 separate VGAM precursor RNAs, VGAM407 precursor RNA, VGAM408 precursor RNA and VGAM409 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM407 RNA, VGAM408 RNA and VGAM409 RNA, herein schematically represented by VGAM1 RNA through VGAM3 RNA, each of which VGAM RNAs corresponding to VGAM RNA of FIG. 1.

VGAM407 RNA, herein schematically represented by VGAM1 RNA through VGAM3 RNA, binds complementarily to a host target binding site located in an untranslated region of VGAM407 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM407 host target RNA into VGAM407 host target protein, herein schematically represented by VGAM1 HOST TARGET PROTEIN through VGAM3 HOST TARGET PROTEIN, all of FIG. 1.

VGAM408 RNA, herein schematically represented by VGAM1 RNA through VGAM3 RNA, binds complementarily to a host target binding site located in an untranslated region of VGAM408 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM408 host target RNA into VGAM408 host target protein, herein schematically represented by VGAM1 HOST TARGET PROTEIN through VGAM3 HOST TARGET PROTEIN, all of FIG. 1.

VGAM409 RNA, herein schematically represented by VGAM1 RNA through VGAM3 RNA, binds complementarily to a host target binding site located in an untranslated region of VGAM409 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM409 host target RNA into VGAM409 host target protein, herein schematically represented by VGAM1 HOST TARGET PROTEIN through VGAM3 HOST TARGET PROTEIN, all of FIG. 1.

It is appreciated that a function of VGR2802 gene, herein designated VGR GENE, is inhibition of expression of host target genes, as part of a novel viral mechanism of attacking a host. Accordingly, utilities of VGR2802 gene include diagnosis, prevention and treatment of viral infection by Melon Necrotic Spot Virus. Specific functions, and accordingly utilities, of VGR2802 gene correlate with, and may be deduced from, the identity of the host target genes, which are inhibited by VGAM RNAs comprised in the 'operon-like' cluster of VGR2802 gene: VGAM407 host target protein, VGAM408 host target protein and VGAM409 host target protein, herein schematically represented by VGAM1 HOST TARGET PROTEIN through VGAM3 HOST TARGET PROTEIN. The function of these host target genes is elaborated hereinabove with reference to VGAM407, VGAM408 and VGAM409. FIG. 9 further provides a conceptual description of novel bioinformatically detected regulatory viral gene, referred to here as Viral Genomic Record 2803(VGR2803) viral gene, which encodes an 'operon-like' cluster of novel viral micro RNA-like genes, each of which in turn modulates expression of at least one host target gene, the function and utility of which at least one host target gene is known in the art.

VGR2803 gene, herein designated VGR GENE, is a novel bioinformatically detected regulatory, non protein coding, RNA viral gene. The method by which VGR2803 gene was detected is described hereinabove with reference to FIGS. 1-9.

VGR2803 gene encodes VGR2803 precursor RNA, herein designated VGR PRECURSOR RNA, an RNA molecule, typically several hundred nucleotides long.

VGR2803 precursor RNA folds spatially, forming VGR2803 folded precursor RNA, herein designated VGR FOLDED PRECURSOR RNA. It is appreciated that VGR2803 folded precursor RNA comprises a plurality of what is known in the art as 'hairpin' structures. These 'hairpin' structures are due to the fact that the nucleotide sequence of VGR2803 precursor RNA comprises a plurality of segments, the first half of each such segment having a nucleotide sequence which is at least a partial inversed-reversed sequence of the second half thereof, as is well known in the art.

VGR2803 folded precursor RNA is naturally processed by cellular enzymatic activity into at least 3 separate VGAM precursor RNAs, VGAM410 precursor RNA, VGAM411 precursor RNA and VGAM412 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM410 RNA, VGAM411 RNA and VGAM412 RNA, herein schematically represented by VGAM1 RNA through VGAM3 RNA, each of which VGAM RNAs corresponding to VGAM RNA of FIG. 1.

VGAM410 RNA, herein schematically represented by VGAM1 RNA through VGAM3 RNA, binds complementarily to a host target binding site located in an untranslated region of VGAM410 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM410 host target RNA into VGAM410 host target protein, herein schematically represented by VGAM1 HOST TARGET PROTEIN through VGAM3 HOST TARGET PROTEIN, all of FIG. 1.

VGAM411 RNA, herein schematically represented by VGAM1 RNA through VGAM3 RNA, binds complementarily to a host target binding site located in an untranslated region of VGAM411 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM411 host target RNA into VGAM411 host target protein, herein schematically represented by VGAM1 HOST TARGET PROTEIN through VGAM3 HOST TARGET PROTEIN, all of FIG. 1.

VGAM412 RNA, herein schematically represented by VGAM1 RNA through VGAM3 RNA, binds complementarily to a host target binding site located in an untranslated region of VGAM412 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM412 host target RNA into VGAM412 host target protein, herein schematically represented by VGAM1 HOST TARGET PROTEIN through VGAM3 HOST TARGET PROTEIN, all of FIG. 1.

It is appreciated that a function of VGR2803 gene, herein designated VGR GENE, is inhibition of expression of host target genes, as part of a novel viral mechanism of attacking a host. Accordingly, utilities of VGR2803 gene include diagnosis, prevention and treatment of viral infection by O'nyong-nyong Virus. Specific functions, and accordingly utilities, of VGR2803 gene correlate with, and may be deduced from, the identity of the host target genes, which are inhibited by VGAM RNAs comprised in the 'operon-like' cluster of VGR2803 gene: VGAM410 host target protein, VGAM411 host target protein and VGAM412 host target protein, herein schematically represented by VGAM1 HOST TARGET PROTEIN through VGAM3 HOST TARGET PROTEIN. The function of these host target genes is elaborated hereinabove with reference to VGAM410, VGAM411 and VGAM412. FIG. 9 further provides a conceptual description of novel bioinformatically detected regulatory viral gene, referred to here as Viral Genomic Record 2804(VGR2804) viral gene, which encodes an 'operon-like' cluster of novel viral micro RNA-like genes, each of which in turn modulates expression of at least one host target gene, the function and utility of which at least one host target gene is known in the art.

VGR2804 gene, herein designated VGR GENE, is a novel bioinformatically detected regulatory, non protein coding, RNA viral gene. The method by which VGR2804 gene was detected is described hereinabove with reference to FIGS. 1-9.

VGR2804 gene encodes VGR2804 precursor RNA, herein designated VGR PRECURSOR RNA, an RNA molecule, typically several hundred nucleotides long.

VGR2804 precursor RNA folds spatially, forming VGR2804 folded precursor RNA, herein designated VGR FOLDED PRECURSOR RNA. It is appreciated that VGR2804 folded precursor RNA comprises a plurality of what is known in the art as 'hairpin' structures. These 'hairpin' structures are due to the fact that the nucleotide sequence of VGR2804 precursor RNA comprises a plurality of segments, the first half of each such segment having a nucleotide sequence which is at least a partial inversed-reversed sequence of the second half thereof, as is well known in the art.

VGR2804 folded precursor RNA is naturally processed by cellular enzymatic activity into at least 7 separate VGAM precursor RNAs, VGAM413 precursor RNA, VGAM414 precursor RNA, VGAM415 precursor RNA, VGAM416 precursor RNA, VGAM417 precursor RNA, VGAM418 precursor RNA and VGAM419 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM413 RNA, VGAM414 RNA, VGAM415 RNA, VGAM416 RNA, VGAM417 RNA, VGAM418 RNA and VGAM419 RNA, herein schematically represented by VGAM1 RNA through VGAM3 RNA, each of which VGAM RNAs corresponding to VGAM RNA of FIG. 1.

VGAM413 RNA, herein schematically represented by VGAM1 RNA through VGAM3 RNA, binds complementarily to a host target binding site located in an untranslated region of VGAM413 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM413 host target RNA into VGAM413 host target protein, herein schematically represented by VGAM1 HOST TARGET PROTEIN through VGAM3 HOST TARGET PROTEIN, all of FIG. 1.

VGAM414 RNA, herein schematically represented by VGAM1 RNA through VGAM3 RNA, binds complementarily to a host target binding site located in an untranslated region of VGAM414 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM414 host target RNA into VGAM414 host target protein, herein schematically represented by VGAM1 HOST TARGET PROTEIN through VGAM3 HOST TARGET PROTEIN, all of FIG. 1.

VGAM415 RNA, herein schematically represented by VGAM1 RNA through VGAM3 RNA, binds complementarily to a host target binding site located in an untranslated region of VGAM415 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM415 host target RNA into VGAM415 host target protein, herein schematically represented by VGAM1 HOST TARGET PROTEIN through VGAM3 HOST TARGET PROTEIN, all of FIG. 1.

VGAM416 RNA, herein schematically represented by VGAM1 RNA through VGAM3 RNA, binds complementarily to a host target binding site located in an untranslated region of VGAM416 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM416 host target RNA into VGAM416 host target protein, herein schematically represented by VGAM1 HOST TARGET PROTEIN through VGAM3 HOST TARGET PROTEIN, all of FIG. 1.

VGAM417 RNA, herein schematically represented by VGAM1 RNA through VGAM3 RNA, binds complementarily to a host target binding site located in an untranslated region of VGAM417 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM417 host target RNA into VGAM417 host target protein, herein schematically represented by VGAM1 HOST TARGET PROTEIN through VGAM3 HOST TARGET PROTEIN, all of FIG. 1.

VGAM418 RNA, herein schematically represented by VGAM1 RNA through VGAM3 RNA, binds complementarily to a host target binding site located in an untranslated region of VGAM418 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM418 host target RNA into VGAM418 host target protein, herein schematically represented by VGAM1 HOST TARGET PROTEIN through VGAM3 HOST TARGET PROTEIN, all of FIG. 1.

VGAM419 RNA, herein schematically represented by VGAM1 RNA through VGAM3 RNA, binds complementarily to a host target binding site located in an untranslated region of VGAM419 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM419 host target RNA into VGAM419 host target protein, herein schematically represented by VGAM1 HOST TARGET PROTEIN through VGAM3 HOST TARGET PROTEIN, all of FIG. 1.

It is appreciated that a function of VGR2804 gene, herein designated VGR GENE, is inhibition of expression of host target genes, as part of a novel viral mechanism of attacking a host. Accordingly, utilities of VGR2804 gene include diagnosis, prevention and treatment of viral infection by Pepper Mottle Virus. Specific functions, and accordingly utilities, of VGR2804 gene correlate with, and may be deduced from, the identity of the host target genes, which are inhibited by VGAM RNAs comprised in the 'operon-like' cluster of VGR2804 gene: VGAM413 host target protein, VGAM414 host target protein, VGAM415 host target protein, VGAM416 host target protein, VGAM417 host target protein, VGAM418 host target protein and VGAM419 host target protein, herein schematically represented by VGAM1 HOST TARGET PROTEIN through VGAM3 HOST TARGET PROTEIN. The function of these host target genes is elaborated hereinabove with reference to VGAM413, VGAM414, VGAM415, VGAM416, VGAM417, VGAM418 and VGAM419. FIG. 9 further provides a conceptual description of novel bioinformatically detected regulatory viral gene, referred to here as Viral Genomic Record 2805(VGR2805) viral gene, which encodes an 'operon-like' cluster of novel viral micro RNA-like genes, each of which in turn modulates expression of at least one host target gene, the function and utility of which at least one host target gene is known in the art.

VGR2805 gene, herein designated VGR GENE, is a novel bioinformatically detected regulatory, non protein coding, RNA viral gene. The method by which VGR2805 gene was detected is described hereinabove with reference to FIGS. 1-9.

VGR2805 gene encodes VGR2805 precursor RNA, herein designated VGR PRECURSOR RNA, an RNA molecule, typically several hundred nucleotides long.

VGR2805 precursor RNA folds spatially, forming VGR2805 folded precursor RNA, herein designated VGR FOLDED PRECURSOR RNA. It is appreciated that VGR2805 folded precursor RNA comprises a plurality of what is known in the art as 'hairpin' structures. These 'hairpin' structures are due to the fact that the nucleotide sequence of VGR2805 precursor RNA comprises a plurality of segments, the first half of each such segment having a nucleotide sequence which is at least a partial inversed-reversed sequence of the second half thereof, as is well known in the art.

VGR2805 folded precursor RNA is naturally processed by cellular enzymatic activity into at least 2 separate VGAM precursor RNAs, VGAM420 precursor RNA and VGAM421 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM420 RNA and VGAM421 RNA, herein schematically represented by VGAM1 RNA through VGAM3 RNA, each of which VGAM RNAs corresponding to VGAM RNA of FIG. 1.

VGAM420 RNA, herein schematically represented by VGAM1 RNA through VGAM3 RNA, binds complementarily to a host target binding site located in an untranslated region of VGAM420 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM420 host target RNA into VGAM420 host target protein, herein schematically represented by VGAM1 HOST TARGET PROTEIN through VGAM3 HOST TARGET PROTEIN, all of FIG. 1.

VGAM421 RNA, herein schematically represented by VGAM1 RNA through VGAM3 RNA, binds complementarily to a host target binding site located in an untranslated region of VGAM421 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM421 host target RNA into VGAM421 host target protein, herein schematically represented by VGAM1 HOST TARGET PROTEIN through VGAM3 HOST TARGET PROTEIN, all of FIG. 1.

It is appreciated that a function of VGR2805 gene, herein designated VGR GENE, is inhibition of expression of host target genes, as part of a novel viral mechanism of attacking a host. Accordingly, utilities of VGR2805 gene include diagnosis, prevention and treatment of viral infection by Human Papillomavirus Type 39. Specific functions, and accordingly utilities, of VGR2805 gene correlate with, and may be deduced from, the identity of the host target genes, which are inhibited by VGAM RNAs comprised in the 'operon-like' cluster of VGR2805 gene: VGAM420 host target protein and VGAM421 host target protein, herein schematically represented by VGAM1 HOST TARGET PROTEIN through VGAM3 HOST TARGET PROTEIN. The function of these host target genes is elaborated hereinabove with reference to VGAM420 and VGAM421. FIG. 9 further provides a conceptual description of novel bioinformatically detected regulatory viral gene, referred to here as Viral Genomic Record 2806(VGR2806) viral gene, which encodes an 'operon-like' cluster of novel viral micro RNA-like genes, each of which in turn modulates expression of at least one host target gene, the function and utility of which at least one host target gene is known in the art.

VGR2806 gene, herein designated VGR GENE, is a novel bioinformatically detected regulatory, non protein coding, RNA viral gene. The method by which VGR2806 gene was detected is described hereinabove with reference to FIGS. 1-9.

VGR2806 gene encodes VGR2806 precursor RNA, herein designated VGR PRECURSOR RNA, an RNA molecule, typically several hundred nucleotides long.

VGR2806 precursor RNA folds spatially, forming VGR2806 folded precursor RNA, herein designated VGR FOLDED PRECURSOR RNA. It is appreciated that VGR2806 folded precursor RNA comprises a plurality of what is known in the art as 'hairpin' structures. These 'hairpin' structures are due to the fact that the nucleotide sequence of VGR2806 precursor RNA comprises a plurality of segments, the first half of each such segment having a nucleotide sequence which is at least a partial inversed-reversed sequence of the second half thereof, as is well known in the art.

VGR2806 folded precursor RNA is naturally processed by cellular enzymatic activity into at least 2 separate VGAM precursor RNAs, VGAM422 precursor RNA and VGAM423 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM422 RNA and VGAM423 RNA, herein schematically represented by VGAM1 RNA through VGAM3 RNA, each of which VGAM RNAs corresponding to VGAM RNA of FIG. 1.

VGAM422 RNA, herein schematically represented by VGAM1 RNA through VGAM3 RNA, binds complementarily to a host target binding site located in an untranslated region of VGAM422 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM422 host target RNA into VGAM422 host target protein, herein schematically represented by VGAM1 HOST TARGET PROTEIN through VGAM3 HOST TARGET PROTEIN, all of FIG. 1.

VGAM423 RNA, herein schematically represented by VGAM1 RNA through VGAM3 RNA, binds complementarily to a host target binding site located in an untranslated region of VGAM423 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM423 host target RNA into VGAM423 host target protein, herein schematically represented by VGAM1 HOST TARGET PROTEIN through VGAM3 HOST TARGET PROTEIN, all of FIG. 1.

It is appreciated that a function of VGR2806 gene, herein designated VGR GENE, is inhibition of expression of host target genes, as part of a novel viral mechanism of attacking a host. Accordingly, utilities of VGR2806 gene include diagnosis, prevention and treatment of viral infection by Canine Parvovirus. Specific functions, and accordingly utilities, of VGR2806 gene correlate with, and may be deduced from, the identity of the host target genes, which are inhibited by VGAM RNAs comprised in the 'operon-like' cluster of VGR2806 gene: VGAM422 host target protein and VGAM423 host target protein, herein schematically represented by VGAM1 HOST TARGET PROTEIN through VGAM3 HOST TARGET PROTEIN. The function of these host target genes is elaborated hereinabove with reference to VGAM422 and VGAM423. FIG. 9 further provides a conceptual description of novel bioinformatically detected regulatory viral gene, referred to here as Viral Genomic Record 2807(VGR2807) viral gene, which encodes an 'operon-like' cluster of novel viral micro RNA-like genes, each of which in turn modulates expression of at least one host target gene, the function and utility of which at least one host target gene is known in the art.

VGR2807 gene, herein designated VGR GENE, is a novel bioinformatically detected regulatory, non protein coding, RNA viral gene. The method by which VGR2807 gene was detected is described hereinabove with reference to FIGS. 1-9.

VGR2807 gene encodes VGR2807 precursor RNA, herein designated VGR PRECURSOR RNA, an RNA molecule, typically several hundred nucleotides long.

VGR2807 precursor RNA folds spatially, forming VGR2807 folded precursor RNA, herein designated VGR FOLDED PRECURSOR RNA. It is appreciated that VGR2807 folded precursor RNA comprises a plurality of what is known in the art as 'hairpin' structures. These 'hairpin' structures are due to the fact that the nucleotide sequence of VGR2807 precursor RNA comprises a plurality of segments, the first half of each such segment having a nucleotide sequence which is at least a partial inversed-reversed sequence of the second half thereof, as is well known in the art.

VGR2807 folded precursor RNA is naturally processed by cellular enzymatic activity into at least 5 separate VGAM precursor RNAs, VGAM424 precursor RNA, VGAM425 precursor RNA, VGAM426 precursor RNA, VGAM427 precursor RNA and VGAM428 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM424 RNA, VGAM425 RNA, VGAM426 RNA, VGAM427 RNA and VGAM428 RNA, herein schematically represented by VGAM1 RNA through VGAM3 RNA, each of which VGAM RNAs corresponding to VGAM RNA of FIG. 1.

VGAM424 RNA, herein schematically represented by VGAM1 RNA through VGAM3 RNA, binds complementarily to a host target binding site located in an untranslated region of VGAM424 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM424 host target RNA into VGAM424 host target protein, herein schematically represented by VGAM1 HOST TARGET PROTEIN through VGAM3 HOST TARGET PROTEIN, all of FIG. 1.

VGAM425 RNA, herein schematically represented by VGAM1 RNA through VGAM3 RNA, binds complementarily to a host target binding site located in an untranslated region of VGAM425 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM425 host target RNA into VGAM425 host target protein, herein schematically represented by VGAM1 HOST TARGET PROTEIN through VGAM3 HOST TARGET PROTEIN, all of FIG. 1.

VGAM426 RNA, herein schematically represented by VGAM1 RNA through VGAM3 RNA, binds complementarily to a host target binding site located in an untranslated region of VGAM426 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM426 host target RNA into VGAM426 host target protein, herein schematically represented by VGAM1 HOST TARGET PROTEIN through VGAM3 HOST TARGET PROTEIN, all of FIG. 1.

VGAM427 RNA, herein schematically represented by VGAM1 RNA through VGAM3 RNA, binds complementarily to a host target binding site located in an untranslated region of VGAM427 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM427 host target RNA into VGAM427 host target protein, herein schematically represented by VGAM1 HOST TARGET PROTEIN through VGAM3 HOST TARGET PROTEIN, all of FIG. 1.

VGAM428 RNA, herein schematically represented by VGAM1 RNA through VGAM3 RNA, binds complementarily to a host target binding site located in an untranslated region of VGAM428 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM428 host target RNA into VGAM428 host target protein, herein schematically represented by VGAM1 HOST TARGET PROTEIN through VGAM3 HOST TARGET PROTEIN, all of FIG. 1.

It is appreciated that a function of VGR2807 gene, herein designated VGR GENE, is inhibition of expression of host target genes, as part of a novel viral mechanism of attacking a host. Accordingly, utilities of VGR2807 gene include diagnosis, prevention and treatment of viral infection by Rabies Virus. Specific functions, and accordingly utilities, of VGR2807 gene correlate with, and may be deduced from, the identity of the host target genes, which are inhibited by VGAM RNAs comprised in the 'operon-like' cluster of VGR2807 gene: VGAM424 host target protein, VGAM425 host target protein, VGAM426 host target protein, VGAM427 host target protein and VGAM428 host target protein, herein schematically represented by VGAM1 HOST TARGET PROTEIN through VGAM3 HOST TARGET PROTEIN. The function of these host target genes is elaborated hereinabove with reference to VGAM424, VGAM425, VGAM426, VGAM427 and VGAM428. FIG. 9 further provides a conceptual description of novel bioinformatically detected regulatory viral gene, referred to here as Viral Genomic Record 2808(VGR2808) viral gene, which encodes an 'operon-like' cluster of novel viral micro RNA-like genes, each of which in turn modulates expression of at least one host target gene, the function and utility of which at least one host target gene is known in the art.

VGR2808 gene, herein designated VGR GENE, is a novel bioinformatically detected regulatory, non protein coding, RNA viral gene. The method by which VGR2808 gene was detected is described hereinabove with reference to FIGS. 1-9.

VGR2808 gene encodes VGR2808 precursor RNA, herein designated VGR PRECURSOR RNA, an RNA molecule, typically several hundred nucleotides long.

VGR2808 precursor RNA folds spatially, forming VGR2808 folded precursor RNA, herein designated VGR FOLDED PRECURSOR RNA. It is appreciated that VGR2808 folded precursor RNA comprises a plurality of what is known in the art as 'hairpin' structures. These 'hairpin' structures are due to the fact that the nucleotide sequence of VGR2808 precursor RNA comprises a plurality of segments, the first half of each such segment having a nucleotide sequence which is at least a partial inversed-reversed sequence of the second half thereof, as is well known in the art.

VGR2808 folded precursor RNA is naturally processed by cellular enzymatic activity into at least 5 separate VGAM precursor RNAs, VGAM429 precursor RNA, VGAM430 precursor RNA, VGAM431 precursor RNA, VGAM432 precursor RNA and VGAM433 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM429 RNA, VGAM430 RNA, VGAM431 RNA, VGAM432 RNA and VGAM433 RNA, herein schematically represented by VGAM1 RNA through VGAM3 RNA, each of which VGAM RNAs corresponding to VGAM RNA of FIG. 1.

VGAM429 RNA, herein schematically represented by VGAM1 RNA through VGAM3 RNA, binds complementarily to a host target binding site located in an untranslated region of VGAM429 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM429 host target RNA into VGAM429 host target protein, herein schematically represented by VGAM1 HOST TARGET PROTEIN through VGAM3 HOST TARGET PROTEIN, all of FIG. 1.

VGAM430 RNA, herein schematically represented by VGAM1 RNA through VGAM3 RNA, binds complementarily to a host target binding site located in an untranslated region of VGAM430 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM430 host target RNA into VGAM430 host target protein, herein schematically represented by VGAM1 HOST TARGET PROTEIN through VGAM3 HOST TARGET PROTEIN, all of FIG. 1.

VGAM431 RNA, herein schematically represented by VGAM1 RNA through VGAM3 RNA, binds complementarily to a host target binding site located in an untranslated region of VGAM431 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM431 host target RNA into VGAM431 host target protein, herein schematically represented by VGAM1 HOST TARGET PROTEIN through VGAM3 HOST TARGET PROTEIN, all of FIG. 1.

VGAM432 RNA, herein schematically represented by VGAM1 RNA through VGAM3 RNA, binds complementarily to a host target binding site located in an untranslated region of VGAM432 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM432 host target RNA into VGAM432 host target protein, herein schematically represented by VGAM1 HOST TARGET PROTEIN through VGAM3 HOST TARGET PROTEIN, all of FIG. 1.

VGAM433 RNA, herein schematically represented by VGAM1 RNA through VGAM3 RNA, binds complementarily to a host target binding site located in an untranslated region of VGAM433 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM433 host target RNA into VGAM433 host target protein, herein schematically represented by VGAM1 HOST TARGET PROTEIN through VGAM3 HOST TARGET PROTEIN, all of FIG. 1.

It is appreciated that a function of VGR2808 gene, herein designated VGR GENE, is inhibition of expression of host target genes, as part of a novel viral mechanism of attacking a host. Accordingly, utilities of VGR2808 gene include diagnosis, prevention and treatment of viral infection by Rabbit Hemorrhagic Disease Virus. Specific functions, and accordingly utilities, of VGR2808 gene correlate with, and may be deduced from, the identity of the host target genes, which are inhibited by VGAM RNAs comprised in the 'operon-like' cluster of VGR2808 gene: VGAM429 host target protein, VGAM430 host target protein, VGAM431 host target protein, VGAM432 host target protein and VGAM433 host target protein, herein schematically represented by VGAM1 HOST TARGET PROTEIN through VGAM3 HOST TARGET PROTEIN. The function of these host target genes is elaborated hereinabove with reference to VGAM429, VGAM430, VGAM431, VGAM432 and VGAM433. FIG. 9 further provides a conceptual description of novel bioinformatically detected regulatory viral gene, referred to here as Viral Genomic Record 2809(VGR2809) viral gene, which encodes an 'operon-like' cluster of novel viral micro RNA-like genes, each of which in turn modulates expression of at least one host target gene, the function and utility of which at least one host target gene is known in the art.

VGR2809 gene, herein designated VGR GENE, is a novel bioinformatically detected regulatory, non protein coding, RNA viral gene. The method by which VGR2809 gene was detected is described hereinabove with reference to FIGS. 1-9.

VGR2809 gene encodes VGR2809 precursor RNA, herein designated VGR PRECURSOR RNA, an RNA molecule, typically several hundred nucleotides long.

VGR2809 precursor RNA folds spatially, forming VGR2809 folded precursor RNA, herein designated VGR FOLDED PRECURSOR RNA. It is appreciated that VGR2809 folded precursor RNA comprises a plurality of what is known in the art as 'hairpin' structures. These 'hairpin' structures are due to the fact that the nucleotide sequence of VGR2809 precursor RNA comprises a plurality of segments, the first half of each such segment having a nucleotide sequence which is at least a partial inversed-reversed sequence of the second half thereof, as is well known in the art.

VGR2809 folded precursor RNA is naturally processed by cellular enzymatic activity into at least 3 separate VGAM precursor RNAs, VGAM434 precursor RNA, VGAM435 precursor RNA and VGAM436 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM434 RNA, VGAM435 RNA and VGAM436 RNA, herein schematically represented by VGAM1 RNA through VGAM3 RNA, each of which VGAM RNAs corresponding to VGAM RNA of FIG. 1.

VGAM434 RNA, herein schematically represented by VGAM1 RNA through VGAM3 RNA, binds complementarily to a host target binding site located in an untranslated region of VGAM434 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM434 host target RNA into VGAM434 host target protein, herein schematically represented by VGAM1 HOST TARGET PROTEIN through VGAM3 HOST TARGET PROTEIN, all of FIG. 1.

VGAM435 RNA, herein schematically represented by VGAM1 RNA through VGAM3 RNA, binds complementarily to a host target binding site located in an untranslated region of VGAM435 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM435 host target RNA into VGAM435 host target protein, herein schematically represented by VGAM1 HOST TARGET PROTEIN through VGAM3 HOST TARGET PROTEIN, all of FIG. 1.

VGAM436 RNA, herein schematically represented by VGAM1 RNA through VGAM3 RNA, binds complementarily to a host target binding site located in an untranslated region of VGAM436 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM436 host target RNA into VGAM436 host target protein, herein schematically represented by VGAM1 HOST TARGET PROTEIN through VGAM3 HOST TARGET PROTEIN, all of FIG. 1.

It is appreciated that a function of VGR2809 gene, herein designated VGR GENE, is inhibition of expression of host target genes, as part of a novel viral mechanism of attacking a host. Accordingly, utilities of VGR2809 gene include diagnosis, prevention and treatment of viral infection by Sendai Virus. Specific functions, and accordingly utilities, of VGR2809 gene correlate with, and may be deduced from, the identity of the host target genes, which are inhibited by VGAM RNAs comprised in the 'operon-like' cluster of VGR2809 gene: VGAM434 host target protein, VGAM435 host target protein and VGAM436 host target protein, herein schematically represented by VGAM1 HOST TARGET PROTEIN through VGAM3 HOST TARGET PROTEIN. The function of these host target genes is elaborated hereinabove with reference to VGAM434, VGAM435 and VGAM436. FIG. 9 further provides a conceptual description of novel bioinformatically detected regulatory viral gene, referred to here as Viral Genomic Record 2810(VGR2810) viral gene, which encodes an 'operon-like' cluster of novel viral micro RNA-like genes, each of which in turn modulates expression of at least one host target gene, the function and utility of which at least one host target gene is known in the art.

VGR2810 gene, herein designated VGR GENE, is a novel bioinformatically detected regulatory, non protein coding, RNA viral gene. The method by which VGR2810 gene was detected is described hereinabove with reference to FIGS. 1-9.

VGR2810 gene encodes VGR2810 precursor RNA, herein designated VGR PRECURSOR RNA, an RNA molecule, typically several hundred nucleotides long.

VGR2810 precursor RNA folds spatially, forming VGR2810 folded precursor RNA, herein designated VGR FOLDED PRECURSOR RNA. It is appreciated that VGR2810 folded precursor RNA comprises a plurality of what is known in the art as 'hairpin' structures. These 'hairpin' structures are due to the fact that the nucleotide sequence of VGR2810 precursor RNA comprises a plurality of segments, the first half of each such segment having a nucleotide sequence which is at least a partial inversed-reversed sequence of the second half thereof, as is well known in the art.

VGR2810 folded precursor RNA is naturally processed by cellular enzymatic activity into at least 3 separate VGAM precursor RNAs, VGAM437 precursor RNA, VGAM438 precursor RNA and VGAM439 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM437 RNA, VGAM438 RNA and VGAM439 RNA, herein schematically represented by VGAM1 RNA through VGAM3 RNA, each of which VGAM RNAs corresponding to VGAM RNA of FIG. 1.

VGAM437 RNA, herein schematically represented by VGAM1 RNA through VGAM3 RNA, binds complementarily to a host target binding site located in an untranslated region of VGAM437 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM437 host target RNA into VGAM437 host target protein, herein schematically represented by VGAM1 HOST TARGET PROTEIN through VGAM3 HOST TARGET PROTEIN, all of FIG. 1.

VGAM438 RNA, herein schematically represented by VGAM1 RNA through VGAM3 RNA, binds complementarily to a host target binding site located in an untranslated region of VGAM438 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM438 host target RNA into VGAM438 host target protein, herein schematically represented by VGAM1 HOST TARGET PROTEIN through VGAM3 HOST TARGET PROTEIN, all of FIG. 1.

VGAM439 RNA, herein schematically represented by VGAM1 RNA through VGAM3 RNA, binds complementarily to a host target binding site located in an untranslated region of VGAM439 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM439 host target RNA into VGAM439 host target protein, herein schematically represented by VGAM1 HOST TARGET PROTEIN through VGAM3 HOST TARGET PROTEIN, all of FIG. 1.

It is appreciated that a function of VGR2810 gene, herein designated VGR GENE, is inhibition of expression of host target genes, as part of a novel viral mechanism of attacking a host. Accordingly, utilities of VGR2810 gene include diagnosis, prevention and treatment of viral infection by Tomato Bushy Stunt Virus. Specific functions, and accordingly utilities, of VGR2810 gene correlate with, and may be deduced from, the identity of the host target genes, which are inhibited by VGAM RNAs comprised in the 'operon-like' cluster of VGR2810 gene: VGAM437 host target protein, VGAM438 host target protein and VGAM439 host target protein, herein schematically represented by VGAM1 HOST TARGET PROTEIN through VGAM3 HOST TARGET PROTEIN. The function of these host target genes is elaborated hereinabove with reference to VGAM437, VGAM438 and VGAM439. FIG. 9 further provides a conceptual description of novel bioinformatically detected regulatory viral gene, referred to here as Viral Genomic Record 2811(VGR2811) viral gene, which encodes an 'operon-like' cluster of novel viral micro RNA-like genes, each of which in turn modulates expression of at least one host target gene, the function and utility of which at least one host target gene is known in the art.

VGR2811 gene, herein designated VGR GENE, is a novel bioinformatically detected regulatory, non protein coding, RNA viral gene. The method by which VGR2811 gene was detected is described hereinabove with reference to FIGS. 1-9.

VGR2811 gene encodes VGR2811 precursor RNA, herein designated VGR PRECURSOR RNA, an RNA molecule, typically several hundred nucleotides long.

VGR2811 precursor RNA folds spatially, forming VGR2811 folded precursor RNA, herein designated VGR FOLDED PRECURSOR RNA. It is appreciated that VGR2811 folded precursor RNA comprises a plurality of what is known in the art as 'hairpin' structures. These 'hairpin' structures are due to the fact that the nucleotide sequence of VGR2811 precursor RNA comprises a plurality of segments, the first half of each such segment having a nucleotide sequence which is at least a partial inversed-reversed sequence of the second half thereof, as is well known in the art.

VGR2811 folded precursor RNA is naturally processed by cellular enzymatic activity into at least 2 separate VGAM precursor RNAs, VGAM441 precursor RNA and VGAM442 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM441 RNA and VGAM442 RNA, herein schematically represented by VGAM1 RNA through VGAM3 RNA, each of which VGAM RNAs corresponding to VGAM RNA of FIG. 1.

VGAM441 RNA, herein schematically represented by VGAM1 RNA through VGAM3 RNA, binds complementarily to a host target binding site located in an untranslated region of VGAM441 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM441 host target RNA into VGAM441 host target protein, herein schematically represented by VGAM1 HOST TARGET PROTEIN through VGAM3 HOST TARGET PROTEIN, all of FIG. 1.

VGAM442 RNA, herein schematically represented by VGAM1 RNA through VGAM3 RNA, binds complementarily to a host target binding site located in an untranslated region of VGAM442 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM442 host target RNA into VGAM442 host target protein, herein schematically represented by VGAM1 HOST TARGET PROTEIN through VGAM3 HOST TARGET PROTEIN, all of FIG. 1.

It is appreciated that a function of VGR2811 gene, herein designated VGR GENE, is inhibition of expression of host target genes, as part of a novel viral mechanism of attacking a host. Accordingly, utilities of VGR2811 gene include diagnosis, prevention and treatment of viral infection by Vaccinia Virus. Specific functions, and accordingly utilities, of VGR2811 gene correlate with, and may be deduced from, the identity of the host target genes, which are inhibited by VGAM RNAs comprised in the 'operon-like' cluster of VGR2811 gene: VGAM441 host target protein and VGAM442 host target protein, herein schematically represented by VGAM1 HOST TARGET PROTEIN through VGAM3 HOST TARGET PROTEIN. The function of these host target genes is elaborated hereinabove with reference to VGAM441 and VGAM442. FIG. 9 further provides a conceptual description of novel bioinformatically detected regulatory viral gene, referred to here as Viral Genomic Record 2812(VGR2812) viral gene, which encodes an 'operon-like' cluster of novel viral micro RNA-like genes, each of which in turn modulates expression of at least one host target gene, the function and utility of which at least one host target gene is known in the art.

VGR2812 gene, herein designated VGR GENE, is a novel bioinformatically detected regulatory, non protein coding, RNA viral gene. The method by which VGR2812 gene was detected is described hereinabove with reference to FIGS. 1-9.

VGR2812 gene encodes VGR2812 precursor RNA, herein designated VGR PRECURSOR RNA, an RNA molecule, typically several hundred nucleotides long.

VGR2812 precursor RNA folds spatially, forming VGR2812 folded precursor RNA, herein designated VGR FOLDED PRECURSOR RNA. It is appreciated that VGR2812 folded precursor RNA comprises a plurality of what is known in the art as 'hairpin' structures. These 'hairpin' structures are due to the fact that the nucleotide sequence of VGR2812 precursor RNA comprises a plurality of segments, the first half of each such segment having a nucleotide sequence which is at least a partial inversed-reversed sequence of the second half thereof, as is well known in the art.

VGR2812 folded precursor RNA is naturally processed by cellular enzymatic activity into at least 2 separate VGAM precursor RNAs, VGAM443 precursor RNA and VGAM444 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM443 RNA and VGAM444 RNA, herein schematically represented by VGAM1 RNA through VGAM3 RNA, each of which VGAM RNAs corresponding to VGAM RNA of FIG. 1.

VGAM443 RNA, herein schematically represented by VGAM1 RNA through VGAM3 RNA, binds complementarily to a host target binding site located in an untranslated region of VGAM443 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM443 host target RNA into VGAM443 host target protein, herein schematically represented by VGAM1 HOST TARGET PROTEIN through VGAM3 HOST TARGET PROTEIN, all of FIG. 1.

VGAM444 RNA, herein schematically represented by VGAM1 RNA through VGAM3 RNA, binds complementarily to a host target binding site located in an untranslated region of VGAM444 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM444 host target RNA into VGAM444 host target protein, herein schematically represented by VGAM1 HOST TARGET PROTEIN through VGAM3 HOST TARGET PROTEIN, all of FIG. 1.

It is appreciated that a function of VGR2812 gene, herein designated VGR GENE, is inhibition of expression of host target genes, as part of a novel viral mechanism of attacking a host. Accordingly, utilities of VGR2812 gene include diagnosis, prevention and treatment of viral infection by Vaccinia Virus. Specific functions, and accordingly utilities, of VGR2812 gene correlate with, and may be deduced from, the identity of the host target genes, which are inhibited by VGAM RNAs comprised in the 'operon-like' cluster of VGR2812 gene: VGAM443 host target protein and VGAM444 host target protein, herein schematically represented by VGAM1 HOST TARGET PROTEIN through VGAM3 HOST TARGET PROTEIN. The function of these host target genes is elaborated hereinabove with reference to VGAM443 and VGAM444. FIG. 9 further provides a conceptual description of novel bioinformatically detected regulatory viral gene, referred to here as Viral Genomic Record 2813(VGR2813) viral gene, which encodes an 'operon-like' cluster of novel viral micro RNA-like genes, each of which in turn modulates expression of at least one host target gene, the function and utility of which at least one host target gene is known in the art.

VGR2813 gene, herein designated VGR GENE, is a novel bioinformatically detected regulatory, non protein coding, RNA viral gene. The method by which VGR2813 gene was detected is described hereinabove with reference to FIGS. 1-9.

VGR2813 gene encodes VGR2813 precursor RNA, herein designated VGR PRECURSOR RNA, an RNA molecule, typically several hundred nucleotides long.

VGR2813 precursor RNA folds spatially, forming VGR2813 folded precursor RNA, herein designated VGR FOLDED PRECURSOR RNA. It is appreciated that VGR2813 folded precursor RNA comprises a plurality of what is known in the art as 'hairpin' structures. These 'hairpin' structures are due to the fact that the nucleotide sequence of VGR2813 precursor RNA comprises a plurality of segments, the first half of each such segment having a nucleotide sequence which is at least a partial inversed-reversed sequence of the second half thereof, as is well known in the art.

VGR2813 folded precursor RNA is naturally processed by cellular enzymatic activity into at least 2 separate VGAM precursor RNAs, VGAM445 precursor RNA and VGAM446 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM445 RNA and VGAM446 RNA, herein schematically represented by VGAM1 RNA through VGAM3 RNA, each of which VGAM RNAs corresponding to VGAM RNA of FIG. 1.

VGAM445 RNA, herein schematically represented by VGAM1 RNA through VGAM3 RNA, binds complementarily to a host target binding site located in an untranslated region of VGAM445 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM445 host target RNA into VGAM445 host target protein, herein schematically represented by VGAM1 HOST TARGET PROTEIN through VGAM3 HOST TARGET PROTEIN, all of FIG. 1.

VGAM446 RNA, herein schematically represented by VGAM1 RNA through VGAM3 RNA, binds complementarily to a host target binding site located in an untranslated region of VGAM446 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM446 host target RNA into VGAM446 host target protein, herein schematically represented by VGAM1 HOST TARGET PROTEIN through VGAM3 HOST TARGET PROTEIN, all of FIG. 1.

It is appreciated that a function of VGR2813 gene, herein designated VGR GENE, is inhibition of expression of host target genes, as part of a novel viral mechanism of attacking a host. Accordingly, utilities of VGR2813 gene include diagnosis, prevention and treatment of viral infection by Human Papillomavirus Type 17. Specific functions, and accordingly utilities, of VGR2813 gene correlate with, and may be deduced from, the identity of the host target genes, which are inhibited by VGAM RNAs comprised in the 'operon-like' cluster of VGR2813 gene: VGAM445 host target protein and VGAM446 host target protein, herein schematically represented by VGAM1 HOST TARGET PROTEIN through VGAM3 HOST TARGET PROTEIN. The function of these host target genes is elaborated hereinabove with reference to VGAM445 and VGAM446. FIG. 9 further provides a conceptual description of novel bioinformatically detected regulatory viral gene, referred to here as Viral Genomic Record 2814(VGR2814) viral gene, which encodes an 'operon-like' cluster of novel viral micro RNA-like genes, each of which in turn modulates expression of at least one host target gene, the function and utility of which at least one host target gene is known in the art.

VGR2814 gene, herein designated VGR GENE, is a novel bioinformatically detected regulatory, non protein coding, RNA viral gene. The method by which VGR2814 gene was detected is described hereinabove with reference to FIGS. 1-9.

VGR2814 gene encodes VGR2814 precursor RNA, herein designated VGR PRECURSOR RNA, an RNA molecule, typically several hundred nucleotides long.

VGR2814 precursor RNA folds spatially, forming VGR2814 folded precursor RNA, herein designated VGR FOLDED PRECURSOR RNA. It is appreciated that VGR2814 folded precursor RNA comprises a plurality of what is known in the art as 'hairpin' structures. These 'hairpin' structures are due to the fact that the nucleotide sequence of VGR2814 precursor RNA comprises a plurality of segments, the first half of each such segment having a nucleotide sequence which is at least a partial inversed-reversed sequence of the second half thereof, as is well known in the art.

VGR2814 folded precursor RNA is naturally processed by cellular enzymatic activity into at least 2 separate VGAM precursor RNAs, VGAM447 precursor RNA and VGAM448 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM447 RNA and VGAM448 RNA, herein schematically represented by VGAM1 RNA through VGAM3 RNA, each of which VGAM RNAs corresponding to VGAM RNA of FIG. 1.

VGAM447 RNA, herein schematically represented by VGAM1 RNA through VGAM3 RNA, binds complementarily to a host target binding site located in an untranslated region of VGAM447 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM447 host target RNA into VGAM447 host target protein, herein schematically represented by VGAM1 HOST TARGET PROTEIN through VGAM3 HOST TARGET PROTEIN, all of FIG. 1.

VGAM448 RNA, herein schematically represented by VGAM1 RNA through VGAM3 RNA, binds complementarily to a host target binding site located in an untranslated region of VGAM448 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM448 host target RNA into VGAM448 host target protein, herein schematically represented by VGAM1 HOST TARGET PROTEIN through VGAM3 HOST TARGET PROTEIN, all of FIG. 1.

It is appreciated that a function of VGR2814 gene, herein designated VGR GENE, is inhibition of expression of host target genes, as part of a novel viral mechanism of attacking a host. Accordingly, utilities of VGR2814 gene include diagnosis, prevention and treatment of viral infection by Human Papillomavirus Type 40. Specific functions, and accordingly utilities, of VGR2814 gene correlate with, and may be deduced from, the identity of the host target genes, which are inhibited by VGAM RNAs comprised in the 'operon-like' cluster of VGR2814 gene: VGAM447 host target protein and VGAM448 host target protein, herein schematically represented by VGAM1 HOST TARGET PROTEIN through VGAM3 HOST TARGET PROTEIN. The function of these host target genes is elaborated hereinabove with reference to VGAM447 and VGAM448. FIG. 9 further provides a conceptual description of novel bioinformatically detected regulatory viral gene, referred to here as Viral Genomic Record 2815(VGR2815) viral gene, which encodes an 'operon-like' cluster of novel viral micro RNA-like genes, each of which in turn modulates expression of at least one host target gene, the function and utility of which at least one host target gene is known in the art.

VGR2815 gene, herein designated VGR GENE, is a novel bioinformatically detected regulatory, non protein coding, RNA viral gene. The method by which VGR2815 gene was detected is described hereinabove with reference to FIGS. 1-9.

VGR2815 gene encodes VGR2815 precursor RNA, herein designated VGR PRECURSOR RNA, an RNA molecule, typically several hundred nucleotides long.

VGR2815 precursor RNA folds spatially, forming VGR2815 folded precursor RNA, herein designated VGR FOLDED PRECURSOR RNA. It is appreciated that VGR2815 folded precursor RNA comprises a plurality of what is known in the art as 'hairpin' structures. These 'hairpin' structures are due to the fact that the nucleotide sequence of VGR2815 precursor RNA comprises a plurality of segments, the first half of each such segment having a nucleotide sequence which is at least a partial inversed-reversed sequence of the second half thereof, as is well known in the art.

VGR2815 folded precursor RNA is naturally processed by cellular enzymatic activity into at least 3 separate VGAM precursor RNAs, VGAM450 precursor RNA, VGAM451 precursor RNA and VGAM452 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM450 RNA, VGAM451 RNA and VGAM452 RNA, herein schematically represented by VGAM1 RNA through VGAM3 RNA, each of which VGAM RNAs corresponding to VGAM RNA of FIG. 1.

VGAM450 RNA, herein schematically represented by VGAM1 RNA through VGAM3 RNA, binds complementarily to a host target binding site located in an untranslated region of VGAM450 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM450 host target RNA into VGAM450 host target protein, herein schematically represented by VGAM1 HOST TARGET PROTEIN through VGAM3 HOST TARGET PROTEIN, all of FIG. 1.

VGAM451 RNA, herein schematically represented by VGAM1 RNA through VGAM3 RNA, binds complementarily to a host target binding site located in an untranslated region of VGAM451 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM451 host target RNA into VGAM451 host target protein, herein schematically represented by VGAM1 HOST TARGET PROTEIN through VGAM3 HOST TARGET PROTEIN, all of FIG. 1.

VGAM452 RNA, herein schematically represented by VGAM1 RNA through VGAM3 RNA, binds complementarily to a host target binding site located in an untranslated region of VGAM452 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM452 host target RNA into VGAM452 host target protein, herein schematically represented by VGAM1 HOST TARGET PROTEIN through VGAM3 HOST TARGET PROTEIN, all of FIG. 1.

It is appreciated that a function of VGR2815 gene, herein designated VGR GENE, is inhibition of expression of host target genes, as part of a novel viral mechanism of attacking a host. Accordingly, utilities of VGR2815 gene include diagnosis, prevention and treatment of viral infection by Cardamine Chlorotic Fleck Virus. Specific functions, and accordingly utilities, of VGR2815 gene correlate with, and may be deduced from, the identity of the host target genes, which are inhibited by VGAM RNAs comprised in the 'operon-like' cluster of VGR2815 gene: VGAM450 host target protein, VGAM451 host target protein and VGAM452 host target protein, herein schematically represented by VGAM1 HOST TARGET PROTEIN through VGAM3 HOST TARGET PROTEIN. The function of these host target genes is elaborated hereinabove with reference to VGAM450, VGAM451 and VGAM452. FIG. 9 further provides a conceptual description of novel bioinformatically detected regulatory viral gene, referred to here as Viral Genomic Record 2816(VGR2816) viral gene, which encodes an 'operon-like' cluster of novel viral micro RNA-like genes, each of which in turn modulates expression of at least one host target gene, the function and utility of which at least one host target gene is known in the art.

VGR2816 gene, herein designated VGR GENE, is a novel bioinformatically detected regulatory, non protein coding, RNA viral gene. The method by which VGR2816 gene was detected is described hereinabove with reference to FIGS. 1-9.

VGR2816 gene encodes VGR2816 precursor RNA, herein designated VGR PRECURSOR RNA, an RNA molecule, typically several hundred nucleotides long.

VGR2816 precursor RNA folds spatially, forming VGR2816 folded precursor RNA, herein designated VGR FOLDED PRECURSOR RNA. It is appreciated that VGR2816 folded precursor RNA comprises a plurality of what is known in the art as 'hairpin' structures. These 'hairpin' structures are due to the fact that the nucleotide sequence of VGR2816 precursor RNA comprises a plurality of segments, the first half of each such segment having a nucleotide sequence which is at least a partial inversed-reversed sequence of the second half thereof, as is well known in the art.

VGR2816 folded precursor RNA is naturally processed by cellular enzymatic activity into at least 3 separate VGAM precursor RNAs, VGAM453 precursor RNA, VGAM454 precursor RNA and VGAM455 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM453 RNA, VGAM454 RNA and VGAM455 RNA, herein schematically represented by VGAM1 RNA through VGAM3 RNA, each of which VGAM RNAs corresponding to VGAM RNA of FIG. 1.

VGAM453 RNA, herein schematically represented by VGAM1 RNA through VGAM3 RNA, binds complementarily to a host target binding site located in an untranslated region of VGAM453 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM453 host target RNA into VGAM453 host target protein, herein schematically represented by VGAM1 HOST TARGET PROTEIN through VGAM3 HOST TARGET PROTEIN, all of FIG. 1.

VGAM454 RNA, herein schematically represented by VGAM1 RNA through VGAM3 RNA, binds complementarily to a host target binding site located in an untranslated region of VGAM454 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM454 host target RNA into VGAM454 host target protein, herein schematically represented by VGAM1 HOST TARGET PROTEIN through VGAM3 HOST TARGET PROTEIN, all of FIG. 1.

VGAM455 RNA, herein schematically represented by VGAM1 RNA through VGAM3 RNA, binds complementarily to a host target binding site located in an untranslated region of VGAM455 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM455 host target RNA into VGAM455 host target protein, herein schematically represented by VGAM1 HOST TARGET PROTEIN through VGAM3 HOST TARGET PROTEIN, all of FIG. 1.

It is appreciated that a function of VGR2816 gene, herein designated VGR GENE, is inhibition of expression of host target genes, as part of a novel viral mechanism of attacking a host. Accordingly, utilities of VGR2816 gene include diagnosis, prevention and treatment of viral infection by Borna Disease Virus. Specific functions, and accordingly utilities, of VGR2816 gene correlate with, and may be deduced from, the identity of the host target genes, which are inhibited by VGAM RNAs comprised in the 'operon-like' cluster of VGR2816 gene: VGAM453 host target protein, VGAM454 host target protein and VGAM455 host target protein, herein schematically represented by VGAM1 HOST TARGET PROTEIN through VGAM3 HOST TARGET PROTEIN. The function of these host target genes is elaborated hereinabove with reference to VGAM453, VGAM454 and VGAM455. FIG. 9 further provides a conceptual description of novel bioinformatically detected regulatory viral gene, referred to here as Viral Genomic Record 2817(VGR2817) viral gene, which encodes an 'operon-like' cluster of novel viral micro RNA-like genes, each of which in turn modulates expression of at least one host target gene, the function and utility of which at least one host target gene is known in the art.

VGR2817 gene, herein designated VGR GENE, is a novel bioinformatically detected regulatory, non protein coding, RNA viral gene. The method by which VGR2817 gene was detected is described hereinabove with reference to FIGS. 1-9.

VGR2817 gene encodes VGR2817 precursor RNA, herein designated VGR PRECURSOR RNA, an RNA molecule, typically several hundred nucleotides long.

VGR2817 precursor RNA folds spatially, forming VGR2817 folded precursor RNA, herein designated VGR FOLDED PRECURSOR RNA. It is appreciated that VGR2817 folded precursor RNA comprises a plurality of what is known in the art as 'hairpin' structures. These 'hairpin' structures are due to the fact that the nucleotide sequence of VGR2817 precursor RNA comprises a plurality of segments, the first half of each such segment having a nucleotide sequence which is at least a partial inversed-reversed sequence of the second half thereof, as is well known in the art.

VGR2817 folded precursor RNA is naturally processed by cellular enzymatic activity into at least 2 separate VGAM precursor RNAs, VGAM456 precursor RNA and VGAM457 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM456 RNA and VGAM457 RNA, herein schematically represented by VGAM1 RNA through VGAM3 RNA, each of which VGAM RNAs corresponding to VGAM RNA of FIG. 1.

VGAM456 RNA, herein schematically represented by VGAM1 RNA through VGAM3 RNA, binds complementarily to a host target binding site located in an untranslated region of VGAM456 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM456 host target RNA into VGAM456 host target protein, herein schematically represented by VGAM1 HOST TARGET PROTEIN through VGAM3 HOST TARGET PROTEIN, all of FIG. 1.

VGAM457 RNA, herein schematically represented by VGAM1 RNA through VGAM3 RNA, binds complementarily to a host target binding site located in an untranslated region of VGAM457 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM457 host target RNA into VGAM457 host target protein, herein schematically represented by VGAM1 HOST TARGET PROTEIN through VGAM3 HOST TARGET PROTEIN, all of FIG. 1.

It is appreciated that a function of VGR2817 gene, herein designated VGR GENE, is inhibition of expression of host target genes, as part of a novel viral mechanism of attacking a host. Accordingly, utilities of VGR2817 gene include diagnosis, prevention and treatment of viral infection by Variola Virus. Specific functions, and accordingly utilities, of VGR2817 gene correlate with, and may be deduced from, the identity of the host target genes, which are inhibited by VGAM RNAs comprised in the 'operon-like' cluster of VGR2817 gene: VGAM456 host target protein and VGAM457 host target protein, herein schematically represented by VGAM1 HOST TARGET PROTEIN through VGAM3 HOST TARGET PROTEIN. The function of these host target genes is elaborated hereinabove with reference to VGAM456 and VGAM457. FIG. 9 further provides a conceptual description of novel bioinformatically detected regulatory viral gene, referred to here as Viral Genomic Record 2818(VGR2818) viral gene, which encodes an 'operon-like' cluster of novel viral micro RNA-like genes, each of which in turn modulates expression of at least one host target gene, the function and utility of which at least one host target gene is known in the art.

VGR2818 gene, herein designated VGR GENE, is a novel bioinformatically detected regulatory, non protein coding, RNA viral gene. The method by which VGR2818 gene was detected is described hereinabove with reference to FIGS. 1-9.

VGR2818 gene encodes VGR2818 precursor RNA, herein designated VGR PRECURSOR RNA, an RNA molecule, typically several hundred nucleotides long.

VGR2818 precursor RNA folds spatially, forming VGR2818 folded precursor RNA, herein designated VGR FOLDED PRECURSOR RNA. It is appreciated that VGR2818 folded precursor RNA comprises a plurality of what is known in the art as 'hairpin' structures. These 'hairpin' structures are due to the fact that the nucleotide sequence of VGR2818 precursor RNA comprises a plurality of segments, the first half of each such segment having a nucleotide sequence which is at least a partial inversed-reversed sequence of the second half thereof, as is well known in the art.

VGR2818 folded precursor RNA is naturally processed by cellular enzymatic activity into at least 2 separate VGAM precursor RNAs, VGAM458 precursor RNA and VGAM459 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM458 RNA and VGAM459 RNA, herein schematically represented by VGAM1 RNA through VGAM3 RNA, each of which VGAM RNAs corresponding to VGAM RNA of FIG. 1.

VGAM458 RNA, herein schematically represented by VGAM1 RNA through VGAM3 RNA, binds complementarily to a host target binding site located in an untranslated region of VGAM458 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM458 host target RNA into VGAM458 host target protein, herein schematically represented by VGAM1 HOST TARGET PROTEIN through VGAM3 HOST TARGET PROTEIN, all of FIG. 1.

VGAM459 RNA, herein schematically represented by VGAM1 RNA through VGAM3 RNA, binds complementarily to a host target binding site located in an untranslated region of VGAM459 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM459 host target RNA into VGAM459 host target protein, herein schematically represented by VGAM1 HOST TARGET PROTEIN through VGAM3 HOST TARGET PROTEIN, all of FIG. 1.

It is appreciated that a function of VGR2818 gene, herein designated VGR GENE, is inhibition of expression of host target genes, as part of a novel viral mechanism of attacking a host. Accordingly, utilities of VGR2818 gene include diagnosis, prevention and treatment of viral infection by Camelpox Virus. Specific functions, and accordingly utilities, of VGR2818 gene correlate with, and may be deduced from, the identity of the host target genes, which are inhibited by VGAM RNAs comprised in the 'operon-like' cluster of VGR2818 gene: VGAM458 host target protein and VGAM459 host target protein, herein schematically represented by VGAM1 HOST TARGET PROTEIN through VGAM3 HOST TARGET PROTEIN. The function of these host target genes is elaborated hereinabove with reference to VGAM458 and VGAM459. FIG. 9 further provides a conceptual description of novel bioinformatically detected regulatory viral gene, referred to here as Viral Genomic Record 2819(VGR2819) viral gene, which encodes an 'operon-like' cluster of novel viral micro RNA-like genes, each of which in turn modulates expression of at least one host target gene, the function and utility of which at least one host target gene is known in the art.

VGR2819 gene, herein designated VGR GENE, is a novel bioinformatically detected regulatory, non protein coding, RNA viral gene. The method by which VGR2819 gene was detected is described hereinabove with reference to FIGS. 1-9.

VGR2819 gene encodes VGR2819 precursor RNA, herein designated VGR PRECURSOR RNA, an RNA molecule, typically several hundred nucleotides long.

VGR2819 precursor RNA folds spatially, forming VGR2819 folded precursor RNA, herein designated VGR FOLDED PRECURSOR RNA. It is appreciated that VGR2819 folded precursor RNA comprises a plurality of what is known in the art as 'hairpin' structures. These 'hairpin' structures are due to the fact that the nucleotide sequence of VGR2819 precursor RNA comprises a plurality of segments, the first half of each such segment having a nucleotide sequence which is at least a partial inversed-reversed sequence of the second half thereof, as is well known in the art.

VGR2819 folded precursor RNA is naturally processed by cellular enzymatic activity into at least 3 separate VGAM precursor RNAs, VGAM462 precursor RNA, VGAM463 precursor RNA and VGAM464 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM462 RNA, VGAM463 RNA and VGAM464 RNA, herein schematically represented by VGAM1 RNA through VGAM3 RNA, each of which VGAM RNAs corresponding to VGAM RNA of FIG. 1.

VGAM462 RNA, herein schematically represented by VGAM1 RNA through VGAM3 RNA, binds complementarily to a host target binding site located in an untranslated region of VGAM462 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM462 host target RNA into VGAM462 host target protein, herein schematically represented by VGAM1 HOST TARGET PROTEIN through VGAM3 HOST TARGET PROTEIN, all of FIG. 1.

VGAM463 RNA, herein schematically represented by VGAM1 RNA through VGAM3 RNA, binds complementarily to a host target binding site located in an untranslated region of VGAM463 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM463 host target RNA into VGAM463 host target protein, herein schematically represented by VGAM1 HOST TARGET PROTEIN through VGAM3 HOST TARGET PROTEIN, all of FIG. 1.

VGAM464 RNA, herein schematically represented by VGAM1 RNA through VGAM3 RNA, binds complementarily to a host target binding site located in an untranslated region of VGAM464 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM464 host target RNA into VGAM464 host target protein, herein schematically represented by VGAM1 HOST TARGET PROTEIN through VGAM3 HOST TARGET PROTEIN, all of FIG. 1.

It is appreciated that a function of VGR2819 gene, herein designated VGR GENE, is inhibition of expression of host target genes, as part of a novel viral mechanism of attacking a host. Accordingly, utilities of VGR2819 gene include diagnosis, prevention and treatment of viral infection by Variola Virus. Specific functions, and accordingly utilities, of VGR2819 gene correlate with, and may be deduced from, the identity of the host target genes, which are inhibited by VGAM RNAs comprised in the 'operon-like' cluster of VGR2819 gene: VGAM462 host target protein, VGAM463 host target protein and VGAM464 host target protein, herein schematically represented by VGAM1 HOST TARGET PROTEIN through VGAM3 HOST TARGET PROTEIN. The function of these host target genes is elaborated hereinabove with reference to VGAM462, VGAM463 and VGAM464. FIG. 9 further provides a conceptual description of novel bioinformatically detected regulatory viral gene, referred to here as Viral Genomic Record 2820(VGR2820) viral gene, which encodes an 'operon-like' cluster of novel viral micro RNA-like genes, each of which in turn modulates expression of at least one host target gene, the function and utility of which at least one host target gene is known in the art.

VGR2820 gene, herein designated VGR GENE, is a novel bioinformatically detected regulatory, non protein coding, RNA viral gene. The method by which VGR2820 gene was detected is described hereinabove with reference to FIGS. 1-9.

VGR2820 gene encodes VGR2820 precursor RNA, herein designated VGR PRECURSOR RNA, an RNA molecule, typically several hundred nucleotides long.

VGR2820 precursor RNA folds spatially, forming VGR2820 folded precursor RNA, herein designated VGR FOLDED PRECURSOR RNA. It is appreciated that VGR2820 folded precursor RNA comprises a plurality of what is known in the art as 'hairpin' structures. These 'hairpin' structures are due to the fact that the nucleotide sequence of VGR2820 precursor RNA comprises a plurality of segments, the first half of each such segment having a nucleotide sequence which is at least a partial inversed-reversed sequence of the second half thereof, as is well known in the art.

VGR2820 folded precursor RNA is naturally processed by cellular enzymatic activity into at least 2 separate VGAM precursor RNAs, VGAM466 precursor RNA and VGAM467 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM466 RNA and VGAM467 RNA, herein schematically represented by VGAM1 RNA through VGAM3 RNA, each of which VGAM RNAs corresponding to VGAM RNA of FIG. 1.

VGAM466 RNA, herein schematically represented by VGAM1 RNA through VGAM3 RNA, binds complementarily to a host target binding site located in an untranslated region of VGAM466 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM466 host target RNA into VGAM466 host target protein, herein schematically represented by VGAM1 HOST TARGET PROTEIN through VGAM3 HOST TARGET PROTEIN, all of FIG. 1.

VGAM467 RNA, herein schematically represented by VGAM1 RNA through VGAM3 RNA, binds complementarily to a host target binding site located in an untranslated region of VGAM467 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM467 host target RNA into VGAM467 host target protein, herein schematically represented by VGAM1 HOST TARGET PROTEIN through VGAM3 HOST TARGET PROTEIN, all of FIG. 1.

It is appreciated that a function of VGR2820 gene, herein designated VGR GENE, is inhibition of expression of host target genes, as part of a novel viral mechanism of attacking a host. Accordingly, utilities of VGR2820 gene include diagnosis, prevention and treatment of viral infection by Autographa Californica Nucleopolyhedrovirus. Specific functions, and accordingly utilities, of VGR2820 gene correlate with, and may be deduced from, the identity of the host target genes, which are inhibited by VGAM RNAs comprised in the 'operon-like' cluster of VGR2820 gene: VGAM466 host target protein and VGAM467 host target protein, herein schematically represented by VGAM1 HOST TARGET PROTEIN through VGAM3 HOST TARGET PROTEIN. The function of these host target genes is elaborated hereinabove with reference to VGAM466 and VGAM467. FIG. 9 further provides a conceptual description of novel bioinformatically detected regulatory viral gene, referred to here as Viral Genomic Record 2821(VGR2821) viral gene, which encodes an 'operon-like' cluster of novel viral micro RNA-like genes, each of which in turn modulates expression of at least one host target gene, the function and utility of which at least one host target gene is known in the art.

VGR2821 gene, herein designated VGR GENE, is a novel bioinformatically detected regulatory, non protein coding, RNA viral gene. The method by which VGR2821 gene was detected is described hereinabove with reference to FIGS. 1-9.

VGR2821 gene encodes VGR2821 precursor RNA, herein designated VGR PRECURSOR RNA, an RNA molecule, typically several hundred nucleotides long.

VGR2821 precursor RNA folds spatially, forming VGR2821 folded precursor RNA, herein designated VGR FOLDED PRECURSOR RNA. It is appreciated that VGR2821 folded precursor RNA comprises a plurality of what is known in the art as 'hairpin' structures. These 'hairpin' structures are due to the fact that the nucleotide sequence of VGR2821 precursor RNA comprises a plurality of segments, the first half of each such segment having a nucleotide sequence which is at least a partial inversed-reversed sequence of the second half thereof, as is well known in the art.

VGR2821 folded precursor RNA is naturally processed by cellular enzymatic activity into at least 5 separate VGAM precursor RNAs, VGAM472 precursor RNA, VGAM473 precursor RNA, VGAM474 precursor RNA, VGAM475 precursor RNA and VGAM476 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM472 RNA, VGAM473 RNA, VGAM474 RNA, VGAM475 RNA and VGAM476 RNA, herein schematically represented by VGAM1 RNA through VGAM3 RNA, each of which VGAM RNAs corresponding to VGAM RNA of FIG. 1.

VGAM472 RNA, herein schematically represented by VGAM1 RNA through VGAM3 RNA, binds complementarily to a host target binding site located in an untranslated region of VGAM472 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM472 host target RNA into VGAM472 host target protein, herein schematically represented by VGAM1 HOST TARGET PROTEIN through VGAM3 HOST TARGET PROTEIN, all of FIG. 1.

VGAM473 RNA, herein schematically represented by VGAM1 RNA through VGAM3 RNA, binds complementarily to a host target binding site located in an untranslated region of VGAM473 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM473 host target RNA into VGAM473 host target protein, herein schematically represented by VGAM1 HOST TARGET PROTEIN through VGAM3 HOST TARGET PROTEIN, all of FIG. 1.

VGAM474 RNA, herein schematically represented by VGAM1 RNA through VGAM3 RNA, binds complementarily to a host target binding site located in an untranslated region of VGAM474 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM474 host target RNA into VGAM474 host target protein, herein schematically represented by VGAM1 HOST TARGET PROTEIN through VGAM3 HOST TARGET PROTEIN, all of FIG. 1.

VGAM475 RNA, herein schematically represented by VGAM1 RNA through VGAM3 RNA, binds complementarily to a host target binding site located in an untranslated region of VGAM475 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM475 host target RNA into VGAM475 host target protein, herein schematically represented by VGAM1 HOST TARGET PROTEIN through VGAM3 HOST TARGET PROTEIN, all of FIG. 1.

VGAM476 RNA, herein schematically represented by VGAM1 RNA through VGAM3 RNA, binds complementarily to a host target binding site located in an untranslated region of VGAM476 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM476 host target RNA into VGAM476 host target protein, herein schematically represented by VGAM1 HOST TARGET PROTEIN through VGAM3 HOST TARGET PROTEIN, all of FIG. 1.

It is appreciated that a function of VGR2821 gene, herein designated VGR GENE, is inhibition of expression of host target genes, as part of a novel viral mechanism of attacking a host. Accordingly, utilities of VGR2821 gene include diagnosis, prevention and treatment of viral infection by Tickborne Encephalitis Virus. Specific functions, and accordingly utilities, of VGR2821 gene correlate with, and may be deduced from, the identity of the host target genes, which are inhibited by VGAM RNAs comprised in the 'operon-like' cluster of VGR2821 gene: VGAM472 host target protein, VGAM473 host target protein, VGAM474 host target protein, VGAM475 host target protein and VGAM476 host target protein, herein schematically represented by VGAM1 HOST TARGET PROTEIN through VGAM3 HOST TARGET PROTEIN. The function of these host target genes is elaborated hereinabove with reference to VGAM472, VGAM473, VGAM474, VGAM475 and VGAM476. FIG. 9 further provides a conceptual description of novel bioinformatically detected regulatory viral gene, referred to here as Viral Genomic Record 2822(VGR2822) viral gene, which encodes an 'operon-like' cluster of novel viral micro RNA-like genes, each of which in turn modulates expression of at least one host target gene, the function and utility of which at least one host target gene is known in the art.

VGR2822 gene, herein designated VGR GENE, is a novel bioinformatically detected regulatory, non protein coding, RNA viral gene. The method by which VGR2822 gene was detected is described hereinabove with reference to FIGS. 1-9.

VGR2822 gene encodes VGR2822 precursor RNA, herein designated VGR PRECURSOR RNA, an RNA molecule, typically several hundred nucleotides long.

VGR2822 precursor RNA folds spatially, forming VGR2822 folded precursor RNA, herein designated VGR FOLDED PRECURSOR RNA. It is appreciated that VGR2822 folded precursor RNA comprises a plurality of what is known in the art as 'hairpin' structures. These 'hairpin' structures are due to the fact that the nucleotide sequence of VGR2822 precursor RNA comprises a plurality of segments, the first half of each such segment having a nucleotide sequence which is at least a partial inversed-reversed sequence of the second half thereof, as is well known in the art.

VGR2822 folded precursor RNA is naturally processed by cellular enzymatic activity into at least 8 separate VGAM precursor RNAs, VGAM477 precursor RNA, VGAM478 precursor RNA, VGAM479 precursor RNA, VGAM480 precursor RNA, VGAM481 precursor RNA, VGAM482 precursor RNA, VGAM483 precursor RNA and VGAM484 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM477 RNA, VGAM478 RNA, VGAM479 RNA, VGAM480 RNA, VGAM481 RNA, VGAM482 RNA, VGAM483 RNA and VGAM484 RNA, herein schematically represented by VGAM1 RNA through VGAM3 RNA, each of which VGAM RNAs corresponding to VGAM RNA of FIG. 1.

VGAM477 RNA, herein schematically represented by VGAM1 RNA through VGAM3 RNA, binds complementarily to a host target binding site located in an untranslated region of VGAM477 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM477 host target RNA into VGAM477 host target protein, herein schematically represented by VGAM1 HOST TARGET PROTEIN through VGAM3 HOST TARGET PROTEIN, all of FIG. 1.

VGAM478 RNA, herein schematically represented by VGAM1 RNA through VGAM3 RNA, binds complementarily to a host target binding site located in an untranslated region of VGAM478 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM478 host target RNA into VGAM478 host target protein, herein schematically represented by VGAM1 HOST TARGET PROTEIN through VGAM3 HOST TARGET PROTEIN, all of FIG. 1.

VGAM479 RNA, herein schematically represented by VGAM1 RNA through VGAM3 RNA, binds complementarily to a host target binding site located in an untranslated region of VGAM479 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM479 host target RNA into VGAM479 host target protein, herein schematically represented by VGAM1 HOST TARGET PROTEIN through VGAM3 HOST TARGET PROTEIN, all of FIG. 1.

VGAM480 RNA, herein schematically represented by VGAM1 RNA through VGAM3 RNA, binds complementarily to a host target binding site located in an untranslated region of VGAM480 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM480 host target RNA into VGAM480 host target protein, herein schematically represented by VGAM1 HOST TARGET PROTEIN through VGAM3 HOST TARGET PROTEIN, all of FIG. 1.

VGAM481 RNA, herein schematically represented by VGAM1 RNA through VGAM3 RNA, binds complementarily to a host target binding site located in an untranslated region of VGAM481 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM481 host target RNA into VGAM481 host target protein, herein schematically represented by VGAM1 HOST TARGET PROTEIN through VGAM3 HOST TARGET PROTEIN, all of FIG. 1.

VGAM482 RNA, herein schematically represented by VGAM1 RNA through VGAM3 RNA, binds complementarily to a host target binding site located in an untranslated region of VGAM482 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM482 host target RNA into VGAM482 host target protein, herein schematically represented by VGAM1 HOST TARGET PROTEIN through VGAM3 HOST TARGET PROTEIN, all of FIG. 1.

VGAM483 RNA, herein schematically represented by VGAM1 RNA through VGAM3 RNA, binds complementarily to a host target binding site located in an untranslated region of VGAM483 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM483 host target RNA into VGAM483 host target protein, herein schematically represented by VGAM1 HOST TARGET PROTEIN through VGAM3 HOST TARGET PROTEIN, all of FIG. 1.

VGAM484 RNA, herein schematically represented by VGAM1 RNA through VGAM3 RNA, binds complementarily to a host target binding site located in an untranslated region of VGAM484 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM484 host target RNA into VGAM484 host target protein, herein schematically represented by VGAM1 HOST TARGET PROTEIN through VGAM3 HOST TARGET PROTEIN, all of FIG. 1.

It is appreciated that a function of VGR2822 gene, herein designated VGR GENE, is inhibition of expression of host target genes, as part of a novel viral mechanism of attacking a host. Accordingly, utilities of VGR2822 gene include diagnosis, prevention and treatment of viral infection by Hepatitis G Virus. Specific functions, and accordingly utilities, of VGR2822 gene correlate with, and may be deduced from, the identity of the host target genes, which are inhibited by VGAM RNAs comprised in the 'operon-like' cluster of VGR2822 gene: VGAM477 host target protein, VGAM478 host target protein, VGAM479 host target protein, VGAM480 host target protein, VGAM481 host target protein, VGAM482 host target protein, VGAM483 host target protein and VGAM484 host target protein, herein schematically represented by VGAM1 HOST TARGET PROTEIN through VGAM3 HOST TARGET PROTEIN. The function of these host target genes is elaborated hereinabove with reference to VGAM477, VGAM478, VGAM479, VGAM480, VGAM481, VGAM482, VGAM483 and VGAM484. FIG. 9 further provides a conceptual description of novel bioinformatically detected regulatory viral gene, referred to here as Viral Genomic Record 2823(VGR2823) viral gene, which encodes an 'operon-like' cluster of novel viral micro RNA-like genes, each of which in turn modulates expression of at least one host target gene, the function and utility of which at least one host target gene is known in the art.

VGR2823 gene, herein designated VGR GENE, is a novel bioinformatically detected regulatory, non protein coding, RNA viral gene. The method by which VGR2823 gene was detected is described hereinabove with reference to FIGS. 1-9.

VGR2823 gene encodes VGR2823 precursor RNA, herein designated VGR PRECURSOR RNA, an RNA molecule, typically several hundred nucleotides long.

VGR2823 precursor RNA folds spatially, forming VGR2823 folded precursor RNA, herein designated VGR FOLDED PRECURSOR RNA. It is appreciated that VGR2823 folded precursor RNA comprises a plurality of what is known in the art as 'hairpin' structures. These 'hairpin' structures are due to the fact that the nucleotide sequence of VGR2823 precursor RNA comprises a plurality of segments, the first half of each such segment having a nucleotide sequence which is at least a partial inversed-reversed sequence of the second half thereof, as is well known in the art.

VGR2823 folded precursor RNA is naturally processed by cellular enzymatic activity into at least 8 separate VGAM precursor RNAs, VGAM485 precursor RNA, VGAM486 precursor RNA, VGAM487 precursor RNA, VGAM488 precursor RNA, VGAM489 precursor RNA, VGAM490 precursor RNA, VGAM491 precursor RNA and VGAM492 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM485 RNA, VGAM486 RNA, VGAM487 RNA, VGAM488 RNA, VGAM489 RNA, VGAM490 RNA, VGAM491 RNA and VGAM492 RNA, herein schematically represented by VGAM1 RNA through VGAM3 RNA, each of which VGAM RNAs corresponding to VGAM RNA of FIG. 1.

VGAM485 RNA, herein schematically represented by VGAM1 RNA through VGAM3 RNA, binds complementarily to a host target binding site located in an untranslated region of VGAM485 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM485 host target RNA into VGAM485 host target protein, herein schematically represented by VGAM1 HOST TARGET PROTEIN through VGAM3 HOST TARGET PROTEIN, all of FIG. 1.

VGAM486 RNA, herein schematically represented by VGAM1 RNA through VGAM3 RNA, binds complementarily to a host target binding site located in an untranslated region of VGAM486 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM486 host target RNA into VGAM486 host target protein, herein schematically represented by VGAM1 HOST TARGET PROTEIN through VGAM3 HOST TARGET PROTEIN, all of FIG. 1.

VGAM487 RNA, herein schematically represented by VGAM1 RNA through VGAM3 RNA, binds complementarily to a host target binding site located in an untranslated region of VGAM487 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM487 host target RNA into VGAM487 host target protein, herein schematically represented by VGAM1 HOST TARGET PROTEIN through VGAM3 HOST TARGET PROTEIN, all of FIG. 1.

VGAM488 RNA, herein schematically represented by VGAM1 RNA through VGAM3 RNA, binds complementarily to a host target binding site located in an untranslated region of VGAM488 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM488 host target RNA into VGAM488 host target protein, herein schematically represented by VGAM1 HOST TARGET PROTEIN through VGAM3 HOST TARGET PROTEIN, all of FIG. 1.

VGAM489 RNA, herein schematically represented by VGAM1 RNA through VGAM3 RNA, binds complementarily to a host target binding site located in an untranslated region of VGAM489 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM489 host target RNA into VGAM489 host target protein, herein schematically represented by VGAM1 HOST TARGET PROTEIN through VGAM3 HOST TARGET PROTEIN, all of FIG. 1.

VGAM490 RNA, herein schematically represented by VGAM1 RNA through VGAM3 RNA, binds complementarily to a host target binding site located in an untranslated region of VGAM490 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM490 host target RNA into VGAM490 host target protein, herein schematically represented by VGAM1 HOST TARGET PROTEIN through VGAM3 HOST TARGET PROTEIN, all of FIG. 1.

VGAM491 RNA, herein schematically represented by VGAM1 RNA through VGAM3 RNA, binds complementarily to a host target binding site located in an untranslated region of VGAM491 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM491 host target RNA into VGAM491 host target protein, herein schematically represented by VGAM1 HOST TARGET PROTEIN through VGAM3 HOST TARGET PROTEIN, all of FIG. 1.

VGAM492 RNA, herein schematically represented by VGAM1 RNA through VGAM3 RNA, binds complementarily to a host target binding site located in an untranslated region of VGAM492 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM492 host target RNA into VGAM492 host target protein, herein schematically represented by VGAM1 HOST TARGET PROTEIN through VGAM3 HOST TARGET PROTEIN, all of FIG. 1.

It is appreciated that a function of VGR2823 gene, herein designated VGR GENE, is inhibition of expression of host target genes, as part of a novel viral mechanism of attacking a host. Accordingly, utilities of VGR2823 gene include diagnosis, prevention and treatment of viral infection by Hepatitis G Virus. Specific functions, and accordingly utilities, of VGR2823 gene correlate with, and may be deduced from, the identity of the host target genes, which are inhibited by VGAM RNAs comprised in the 'operon-like' cluster of VGR2823 gene: VGAM485 host target protein, VGAM486 host target protein, VGAM487 host target protein, VGAM488 host target protein, VGAM489 host target protein, VGAM490 host target protein, VGAM491 host target protein and VGAM492 host target protein, herein schematically represented by VGAM1 HOST TARGET PROTEIN through VGAM3 HOST TARGET PROTEIN. The function of these host target genes is elaborated hereinabove with reference to VGAM485, VGAM486, VGAM487, VGAM488, VGAM489, VGAM490, VGAM491 and VGAM492. FIG. 9 further provides a conceptual description of novel bioinformatically detected regulatory viral gene, referred to here as Viral Genomic Record 2824(VGR2824) viral gene, which encodes an 'operon-like' cluster of novel viral micro RNA-like genes, each of which in turn modulates expression of at least one host target gene, the function and utility of which at least one host target gene is known in the art.

VGR2824 gene, herein designated VGR GENE, is a novel bioinformatically detected regulatory, non protein coding, RNA viral gene. The method by which VGR2824 gene was detected is described hereinabove with reference to FIGS. 1-9.

VGR2824 gene encodes VGR2824 precursor RNA, herein designated VGR PRECURSOR RNA, an RNA molecule, typically several hundred nucleotides long.

VGR2824 precursor RNA folds spatially, forming VGR2824 folded precursor RNA, herein designated VGR FOLDED PRECURSOR RNA. It is appreciated that VGR2824 folded precursor RNA comprises a plurality of what is known in the art as 'hairpin' structures. These 'hairpin' structures are due to the fact that the nucleotide sequence of VGR2824 precursor RNA comprises a plurality of segments, the first half of each such segment having a nucleotide sequence which is at least a partial inversed-reversed sequence of the second half thereof, as is well known in the art.

VGR2824 folded precursor RNA is naturally processed by cellular enzymatic activity into at least 3 separate VGAM precursor RNAs, VGAM493 precursor RNA, VGAM494 precursor RNA and VGAM495 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM493 RNA, VGAM494 RNA and VGAM495 RNA, herein schematically represented by VGAM1 RNA through VGAM3 RNA, each of which VGAM RNAs corresponding to VGAM RNA of FIG. 1.

VGAM493 RNA, herein schematically represented by VGAM1 RNA through VGAM3 RNA, binds complementarily to a host target binding site located in an untranslated region of VGAM493 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM493 host target RNA into VGAM493 host target protein, herein schematically represented by VGAM1 HOST TARGET PROTEIN through VGAM3 HOST TARGET PROTEIN, all of FIG. 1.

VGAM494 RNA, herein schematically represented by VGAM1 RNA through VGAM3 RNA, binds complementarily to a host target binding site located in an untranslated region of VGAM494 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM494 host target RNA into VGAM494 host target protein, herein schematically represented by VGAM1 HOST TARGET PROTEIN through VGAM3 HOST TARGET PROTEIN, all of FIG. 1.

VGAM495 RNA, herein schematically represented by VGAM1 RNA through VGAM3 RNA, binds complementarily to a host target binding site located in an untranslated region of VGAM495 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM495 host target RNA into VGAM495 host target protein, herein schematically represented by VGAM1 HOST TARGET PROTEIN through VGAM3 HOST TARGET PROTEIN, all of FIG. 1.

It is appreciated that a function of VGR2824 gene, herein designated VGR GENE, is inhibition of expression of host target genes, as part of a novel viral mechanism of attacking a host. Accordingly, utilities of VGR2824 gene include diagnosis, prevention and treatment of viral infection by Hepatitis G Virus. Specific functions, and accordingly utilities, of VGR2824 gene correlate with, and may be deduced from, the identity of the host target genes, which are inhibited by VGAM RNAs comprised in the 'operon-like' cluster of VGR2824 gene: VGAM493 host target protein, VGAM494 host target protein and VGAM495 host target protein, herein schematically represented by VGAM1 HOST TARGET PROTEIN through VGAM3 HOST TARGET PROTEIN. The function of these host target genes is elaborated hereinabove with reference to VGAM493, VGAM494 and VGAM495. FIG. 9 further provides a conceptual description of novel bioinformatically detected regulatory viral gene, referred to here as Viral Genomic Record 2825(VGR2825) viral gene, which encodes an 'operon-like' cluster of novel viral micro RNA-like genes, each of which in turn modulates expression of at least one host target gene, the function and utility of which at least one host target gene is known in the art.

VGR2825 gene, herein designated VGR GENE, is a novel bioinformatically detected regulatory, non protein coding, RNA viral gene. The method by which VGR2825 gene was detected is described hereinabove with reference to FIGS. 1-9.

VGR2825 gene encodes VGR2825 precursor RNA, herein designated VGR PRECURSOR RNA, an RNA molecule, typically several hundred nucleotides long.

VGR2825 precursor RNA folds spatially, forming VGR2825 folded precursor RNA, herein designated VGR FOLDED PRECURSOR RNA. It is appreciated that VGR2825 folded precursor RNA comprises a plurality of what is known in the art as 'hairpin' structures. These 'hairpin' structures are due to the fact that the nucleotide sequence of VGR2825 precursor RNA comprises a plurality of segments, the first half of each such segment having a nucleotide sequence which is at least a partial inversed-reversed sequence of the second half thereof, as is well known in the art.

VGR2825 folded precursor RNA is naturally processed by cellular enzymatic activity into at least 2 separate VGAM precursor RNAs, VGAM496 precursor RNA and VGAM497 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM496 RNA and VGAM497 RNA, herein schematically represented by VGAM1 RNA through VGAM3 RNA, each of which VGAM RNAs corresponding to VGAM RNA of FIG. 1.

VGAM496 RNA, herein schematically represented by VGAM1 RNA through VGAM3 RNA, binds complementarily to a host target binding site located in an untranslated region of VGAM496 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM496 host target RNA into VGAM496 host target protein, herein schematically represented by VGAM1 HOST TARGET PROTEIN through VGAM3 HOST TARGET PROTEIN, all of FIG. 1.

VGAM497 RNA, herein schematically represented by VGAM1 RNA through VGAM3 RNA, binds complementarily to a host target binding site located in an untranslated region of VGAM497 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM497 host target RNA into VGAM497 host target protein, herein schematically represented by VGAM1 HOST TARGET PROTEIN through VGAM3 HOST TARGET PROTEIN, all of FIG. 1.

It is appreciated that a function of VGR2825 gene, herein designated VGR GENE, is inhibition of expression of host target genes, as part of a novel viral mechanism of attacking a host. Accordingly, utilities of VGR2825 gene include diagnosis, prevention and treatment of viral infection by Human Herpesvirus 7. Specific functions, and accordingly utilities, of VGR2825 gene correlate with, and may be deduced from, the identity of the host target genes, which are inhibited by VGAM RNAs comprised in the 'operon-like' cluster of VGR2825 gene: VGAM496 host target protein and VGAM497 host target protein, herein schematically represented by VGAM1 HOST TARGET PROTEIN through VGAM3 HOST TARGET PROTEIN. The function of these host target genes is elaborated hereinabove with reference to VGAM496 and VGAM497. FIG. 9 further provides a conceptual description of novel bioinformatically detected regulatory viral gene, referred to here as Viral Genomic Record 2826(VGR2826) viral gene, which encodes an 'operon-like' cluster of novel viral micro RNA-like genes, each of which in turn modulates expression of at least one host target gene, the function and utility of which at least one host target gene is known in the art.

VGR2826 gene, herein designated VGR GENE, is a novel bioinformatically detected regulatory, non protein coding, RNA viral gene. The method by which VGR2826 gene was detected is described hereinabove with reference to FIGS. 1-9.

VGR2826 gene encodes VGR2826 precursor RNA, herein designated VGR PRECURSOR RNA, an RNA molecule, typically several hundred nucleotides long.

VGR2826 precursor RNA folds spatially, forming VGR2826 folded precursor RNA, herein designated VGR FOLDED PRECURSOR RNA. It is appreciated that VGR2826 folded precursor RNA comprises a plurality of what is known in the art as 'hairpin' structures. These 'hairpin' structures are due to the fact that the nucleotide sequence of VGR2826 precursor RNA comprises a plurality of segments, the first half of each such segment having a nucleotide sequence which is at least a partial inversed-reversed sequence of the second half thereof, as is well known in the art.

VGR2826 folded precursor RNA is naturally processed by cellular enzymatic activity into at least 2 separate VGAM precursor RNAs, VGAM499 precursor RNA and VGAM500 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM499 RNA and VGAM500 RNA, herein schematically represented by VGAM1 RNA through VGAM3 RNA, each of which VGAM RNAs corresponding to VGAM RNA of FIG. 1.

VGAM499 RNA, herein schematically represented by VGAM1 RNA through VGAM3 RNA, binds complementarily to a host target binding site located in an untranslated region of VGAM499 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM499 host target RNA into VGAM499 host target protein, herein schematically represented by VGAM1 HOST TARGET PROTEIN through VGAM3 HOST TARGET PROTEIN, all of FIG. 1.

VGAM500 RNA, herein schematically represented by VGAM1 RNA through VGAM3 RNA, binds complementarily to a host target binding site located in an untranslated region of VGAM500 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM500 host target RNA into VGAM500 host target protein, herein schematically represented by VGAM1 HOST TARGET PROTEIN through VGAM3 HOST TARGET PROTEIN, all of FIG. 1.

It is appreciated that a function of VGR2826 gene, herein designated VGR GENE, is inhibition of expression of host target genes, as part of a novel viral mechanism of attacking a host. Accordingly, utilities of VGR2826 gene include diagnosis, prevention and treatment of viral infection by Strawberry Vein Banding Virus (SVBV). Specific functions, and accordingly utilities, of VGR2826 gene correlate with, and may be deduced from, the identity of the host target genes, which are inhibited by VGAM RNAs comprised in the 'operon-like' cluster of VGR2826 gene: VGAM499 host target protein and VGAM500 host target protein, herein schematically represented by VGAM1 HOST TARGET PROTEIN through VGAM3 HOST TARGET PROTEIN. The function of these host target genes is elaborated hereinabove with reference to VGAM499 and VGAM500. FIG. 9 further provides a conceptual description of novel bioinformatically detected regulatory viral gene, referred to here as Viral Genomic Record 2827(VGR2827) viral gene, which encodes an 'operon-like' cluster of novel viral micro RNA-like genes, each of which in turn modulates expression of at least one host target gene, the function and utility of which at least one host target gene is known in the art.

VGR2827 gene, herein designated VGR GENE, is a novel bioinformatically detected regulatory, non protein coding, RNA viral gene. The method by which VGR2827 gene was detected is described hereinabove with reference to FIGS. 1-9.

VGR2827 gene encodes VGR2827 precursor RNA, herein designated VGR PRECURSOR RNA, an RNA molecule, typically several hundred nucleotides long.

VGR2827 precursor RNA folds spatially, forming VGR2827 folded precursor RNA, herein designated VGR FOLDED PRECURSOR RNA. It is appreciated that VGR2827 folded precursor RNA comprises a plurality of what is known in the art as 'hairpin' structures. These 'hairpin' structures are due to the fact that the nucleotide sequence of VGR2827 precursor RNA comprises a plurality of segments, the first half of each such segment having a nucleotide sequence which is at least a partial inversed-reversed sequence of the second half thereof, as is well known in the art.

VGR2827 folded precursor RNA is naturally processed by cellular enzymatic activity into at least 2 separate VGAM precursor RNAs, VGAM501 precursor RNA and VGAM502 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM501 RNA and VGAM502 RNA, herein schematically represented by VGAM1 RNA through VGAM3 RNA, each of which VGAM RNAs corresponding to VGAM RNA of FIG. 1.

VGAM501 RNA, herein schematically represented by VGAM1 RNA through VGAM3 RNA, binds complementarily to a host target binding site located in an untranslated region of VGAM501 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM501 host target RNA into VGAM501 host target protein, herein schematically represented by VGAM1 HOST TARGET PROTEIN through VGAM3 HOST TARGET PROTEIN, all of FIG. 1.

VGAM502 RNA, herein schematically represented by VGAM1 RNA through VGAM3 RNA, binds complementarily to a host target binding site located in an untranslated region of VGAM502 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM502 host target RNA into VGAM502 host target protein, herein schematically represented by VGAM1 HOST TARGET PROTEIN through VGAM3 HOST TARGET PROTEIN, all of FIG. 1.

It is appreciated that a function of VGR2827 gene, herein designated VGR GENE, is inhibition of expression of host target genes, as part of a novel viral mechanism of attacking a host. Accordingly, utilities of VGR2827 gene include diagnosis, prevention and treatment of viral infection by Carrot Mottle Mimic Virus. Specific functions, and accordingly utilities, of VGR2827 gene correlate with, and may be deduced from, the identity of the host target genes, which are inhibited by VGAM RNAs comprised in the 'operon-like' cluster of VGR2827 gene: VGAM501 host target protein and VGAM502 host target protein, herein schematically represented by VGAM1 HOST TARGET PROTEIN through VGAM3 HOST TARGET PROTEIN. The function of these host target genes is elaborated hereinabove with reference to VGAM501 and VGAM502. FIG. 9 further provides a conceptual description of novel bioinformatically detected regulatory viral gene, referred to here as Viral Genomic Record 2828(VGR2828) viral gene, which encodes an 'operon-like' cluster of novel viral micro RNA-like genes, each of which in turn modulates expression of at least one host target gene, the function and utility of which at least one host target gene is known in the art.

VGR2828 gene, herein designated VGR GENE, is a novel bioinformatically detected regulatory, non protein coding, RNA viral gene. The method by which VGR2828 gene was detected is described hereinabove with reference to FIGS. 1-9.

VGR2828 gene encodes VGR2828 precursor RNA, herein designated VGR PRECURSOR RNA, an RNA molecule, typically several hundred nucleotides long.

VGR2828 precursor RNA folds spatially, forming VGR2828 folded precursor RNA, herein designated VGR FOLDED PRECURSOR RNA. It is appreciated that VGR2828 folded precursor RNA comprises a plurality of what is known in the art as 'hairpin' structures. These 'hairpin' structures are due to the fact that the nucleotide sequence of VGR2828 precursor RNA comprises a plurality of segments, the first half of each such segment having a nucleotide sequence which is at least a partial inversed-reversed sequence of the second half thereof, as is well known in the art.

VGR2828 folded precursor RNA is naturally processed by cellular enzymatic activity into at least 3 separate VGAM precursor RNAs, VGAM506 precursor RNA, VGAM507 precursor RNA and VGAM508 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM506 RNA, VGAM507 RNA and VGAM508 RNA, herein schematically represented by VGAM1 RNA through VGAM3 RNA, each of which VGAM RNAs corresponding to VGAM RNA of FIG. 1.

VGAM506 RNA, herein schematically represented by VGAM1 RNA through VGAM3 RNA, binds complementarily to a host target binding site located in an untranslated region of VGAM506 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM506 host target RNA into VGAM506 host target protein, herein schematically represented by VGAM1 HOST TARGET PROTEIN through VGAM3 HOST TARGET PROTEIN, all of FIG. 1.

VGAM507 RNA, herein schematically represented by VGAM1 RNA through VGAM3 RNA, binds complementarily to a host target binding site located in an untranslated region of VGAM507 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM507 host target RNA into VGAM507 host target protein, herein schematically represented by VGAM1 HOST TARGET PROTEIN through VGAM3 HOST TARGET PROTEIN, all of FIG. 1.

VGAM508 RNA, herein schematically represented by VGAM1 RNA through VGAM3 RNA, binds complementarily to a host target binding site located in an untranslated region of VGAM508 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM508 host target RNA into VGAM508 host target protein, herein schematically represented by VGAM1 HOST TARGET PROTEIN through VGAM3 HOST TARGET PROTEIN, all of FIG. 1.

It is appreciated that a function of VGR2828 gene, herein designated VGR GENE, is inhibition of expression of host target genes, as part of a novel viral mechanism of attacking a host. Accordingly, utilities of VGR2828 gene include diagnosis, prevention and treatment of viral infection by Saguaro Cactus Virus. Specific functions, and accordingly utilities, of VGR2828 gene correlate with, and may be deduced from, the identity of the host target genes, which are inhibited by VGAM RNAs comprised in the 'operon-like' cluster of VGR2828 gene: VGAM506 host target protein, VGAM507 host target protein and VGAM508 host target protein, herein schematically represented by VGAM1 HOST TARGET PROTEIN through VGAM3 HOST TARGET PROTEIN. The function of these host target genes is elaborated hereinabove with reference to VGAM506, VGAM507 and VGAM508. FIG. 9 further provides a conceptual description of novel bioinformatically detected regulatory viral gene, referred to here as Viral Genomic Record 2829(VGR2829) viral gene, which encodes an 'operon-like' cluster of novel viral micro RNA-like genes, each of which in turn modulates expression of at least one host target gene, the function and utility of which at least one host target gene is known in the art.

VGR2829 gene, herein designated VGR GENE, is a novel bioinformatically detected regulatory, non protein coding, RNA viral gene. The method by which VGR2829 gene was detected is described hereinabove with reference to FIGS. 1-9.

VGR2829 gene encodes VGR2829 precursor RNA, herein designated VGR PRECURSOR RNA, an RNA molecule, typically several hundred nucleotides long.

VGR2829 precursor RNA folds spatially, forming VGR2829 folded precursor RNA, herein designated VGR FOLDED PRECURSOR RNA. It is appreciated that VGR2829 folded precursor RNA comprises a plurality of what is known in the art as 'hairpin' structures. These 'hairpin' structures are due to the fact that the nucleotide sequence of VGR2829 precursor RNA comprises a plurality of segments, the first half of each such segment having a nucleotide sequence which is at least a partial inversed-reversed sequence of the second half thereof, as is well known in the art.

VGR2829 folded precursor RNA is naturally processed by cellular enzymatic activity into at least 2 separate VGAM precursor RNAs, VGAM509 precursor RNA and VGAM510 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM509 RNA and VGAM510 RNA, herein schematically represented by VGAM1 RNA through VGAM3 RNA, each of which VGAM RNAs corresponding to VGAM RNA of FIG. 1.

VGAM509 RNA, herein schematically represented by VGAM1 RNA through VGAM3 RNA, binds complementarily to a host target binding site located in an untranslated region of VGAM509 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM509 host target RNA into VGAM509 host target protein, herein schematically represented by VGAM1 HOST TARGET PROTEIN through VGAM3 HOST TARGET PROTEIN, all of FIG. 1.

VGAM510 RNA, herein schematically represented by VGAM1 RNA through VGAM3 RNA, binds complementarily to a host target binding site located in an untranslated region of VGAM510 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM510 host target RNA into VGAM510 host target protein, herein schematically represented by VGAM1 HOST TARGET PROTEIN through VGAM3 HOST TARGET PROTEIN, all of FIG. 1.

It is appreciated that a function of VGR2829 gene, herein designated VGR GENE, is inhibition of expression of host target genes, as part of a novel viral mechanism of attacking a host. Accordingly, utilities of VGR2829 gene include diagnosis, prevention and treatment of viral infection by Papaya Ringspot Virus. Specific functions, and accordingly utilities, of VGR2829 gene correlate with, and may be deduced from, the identity of the host target genes, which are inhibited by VGAM RNAs comprised in the 'operon-like' cluster of VGR2829 gene: VGAM509 host target protein and VGAM510 host target protein, herein schematically represented by VGAM1 HOST TARGET PROTEIN through VGAM3 HOST TARGET PROTEIN. The function of these host target genes is elaborated hereinabove with reference to VGAM509 and VGAM510. FIG. 9 further provides a conceptual description of novel bioinformatically detected regulatory viral gene, referred to here as Viral Genomic Record 2830(VGR2830) viral gene, which encodes an 'operon-like' cluster of novel viral micro RNA-like genes, each of which in turn modulates expression of at least one host target gene, the function and utility of which at least one host target gene is known in the art.

VGR2830 gene, herein designated VGR GENE, is a novel bioinformatically detected regulatory, non protein coding, RNA viral gene. The method by which VGR2830 gene was detected is described hereinabove with reference to FIGS. 1-9.

VGR2830 gene encodes VGR2830 precursor RNA, herein designated VGR PRECURSOR RNA, an RNA molecule, typically several hundred nucleotides long.

VGR2830 precursor RNA folds spatially, forming VGR2830 folded precursor RNA, herein designated VGR FOLDED PRECURSOR RNA. It is appreciated that VGR2830 folded precursor RNA comprises a plurality of what is known in the art as 'hairpin' structures. These 'hairpin' structures are due to the fact that the nucleotide sequence of VGR2830 precursor RNA comprises a plurality of segments, the first half of each such segment having a nucleotide sequence which is at least a partial inversed-reversed sequence of the second half thereof, as is well known in the art.

VGR2830 folded precursor RNA is naturally processed by cellular enzymatic activity into at least 5 separate VGAM precursor RNAs, VGAM511 precursor RNA, VGAM512 precursor RNA, VGAM513 precursor RNA, VGAM514 precursor RNA and VGAM515 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM511 RNA, VGAM512 RNA, VGAM513 RNA, VGAM514 RNA and VGAM515 RNA, herein schematically represented by VGAM1 RNA through VGAM3 RNA, each of which VGAM RNAs corresponding to VGAM RNA of FIG. 1.

VGAM511 RNA, herein schematically represented by VGAM1 RNA through VGAM3 RNA, binds complementarily to a host target binding site located in an untranslated region of VGAM511 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM511 host target RNA into VGAM511 host target protein, herein schematically represented by VGAM1 HOST TARGET PROTEIN through VGAM3 HOST TARGET PROTEIN, all of FIG. 1.

VGAM512 RNA, herein schematically represented by VGAM1 RNA through VGAM3 RNA, binds complementarily to a host target binding site located in an untranslated region of VGAM512 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM512 host target RNA into VGAM512 host target protein, herein schematically represented by VGAM1 HOST TARGET PROTEIN through VGAM3 HOST TARGET PROTEIN, all of FIG. 1.

VGAM513 RNA, herein schematically represented by VGAM1 RNA through VGAM3 RNA, binds complementarily to a host target binding site located in an untranslated region of VGAM513 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM513 host target RNA into VGAM513 host target protein, herein schematically represented by VGAM1 HOST TARGET PROTEIN through VGAM3 HOST TARGET PROTEIN, all of FIG. 1.

VGAM514 RNA, herein schematically represented by VGAM1 RNA through VGAM3 RNA, binds complementarily to a host target binding site located in an untranslated region of VGAM514 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM514 host target RNA into VGAM514 host target protein, herein schematically represented by VGAM1 HOST TARGET PROTEIN through VGAM3 HOST TARGET PROTEIN, all of FIG. 1.

VGAM515 RNA, herein schematically represented by VGAM1 RNA through VGAM3 RNA, binds complementarily to a host target binding site located in an untranslated region of VGAM515 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM515 host target RNA into VGAM515 host target protein, herein schematically represented by VGAM1 HOST TARGET PROTEIN through VGAM3 HOST TARGET PROTEIN, all of FIG. 1.

It is appreciated that a function of VGR2830 gene, herein designated VGR GENE, is inhibition of expression of host target genes, as part of a novel viral mechanism of attacking a host. Accordingly, utilities of VGR2830 gene include diagnosis, prevention and treatment of viral infection by Cucumber Green Mottle Mosaic Virus. Specific functions, and accordingly utilities, of VGR2830 gene correlate with, and may be deduced from, the identity of the host target genes, which are inhibited by VGAM RNAs comprised in the 'operon-like' cluster of VGR2830 gene: VGAM511 host target protein, VGAM512 host target protein, VGAM513 host target protein, VGAM514 host target protein and VGAM515 host target protein, herein schematically represented by VGAM1 HOST TARGET PROTEIN through VGAM3 HOST TARGET PROTEIN. The function of these host target genes is elaborated hereinabove with reference to VGAM511, VGAM512, VGAM513, VGAM514 and VGAM515. FIG. 9 further provides a conceptual description of novel bioinformatically detected regulatory viral gene, referred to here as Viral Genomic Record 2831(VGR2831) viral gene, which encodes an 'operon-like' cluster of novel viral micro RNA-like genes, each of which in turn modulates expression of at least one host target gene, the function and utility of which at least one host target gene is known in the art.

VGR2831 gene, herein designated VGR GENE, is a novel bioinformatically detected regulatory, non protein coding, RNA viral gene. The method by which VGR2831 gene was detected is described hereinabove with reference to FIGS. 1-9.

VGR2831 gene encodes VGR2831 precursor RNA, herein designated VGR PRECURSOR RNA, an RNA molecule, typically several hundred nucleotides long.

VGR2831 precursor RNA folds spatially, forming VGR2831 folded precursor RNA, herein designated VGR FOLDED PRECURSOR RNA. It is appreciated that VGR2831 folded precursor RNA comprises a plurality of what is known in the art as 'hairpin' structures. These 'hairpin' structures are due to the fact that the nucleotide sequence of VGR2831 precursor RNA comprises a plurality of segments, the first half of each such segment having a nucleotide sequence which is at least a partial inversed-reversed sequence of the second half thereof, as is well known in the art.

VGR2831 folded precursor RNA is naturally processed by cellular enzymatic activity into at least 2 separate VGAM precursor RNAs, VGAM516 precursor RNA and VGAM517 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM516 RNA and VGAM517 RNA, herein schematically represented by VGAM1 RNA through VGAM3 RNA, each of which VGAM RNAs corresponding to VGAM RNA of FIG. 1.

VGAM516 RNA, herein schematically represented by VGAM1 RNA through VGAM3 RNA, binds complementarily to a host target binding site located in an untranslated region of VGAM516 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM516 host target RNA into VGAM516 host target protein, herein schematically represented by VGAM1 HOST TARGET PROTEIN through VGAM3 HOST TARGET PROTEIN, all of FIG. 1.

VGAM517 RNA, herein schematically represented by VGAM1 RNA through VGAM3 RNA, binds complementarily to a host target binding site located in an untranslated region of VGAM517 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM517 host target RNA into VGAM517 host target protein, herein schematically represented by VGAM1 HOST TARGET PROTEIN through VGAM3 HOST TARGET PROTEIN, all of FIG. 1.

It is appreciated that a function of VGR2831 gene, herein designated VGR GENE, is inhibition of expression of host target genes, as part of a novel viral mechanism of attacking a host. Accordingly, utilities of VGR2831 gene include diagnosis, prevention and treatment of viral infection by Galinsoga Mosaic Virus. Specific functions, and accordingly utilities, of VGR2831 gene correlate with, and may be deduced from, the identity of the host target genes, which are inhibited by VGAM RNAs comprised in the 'operon-like' cluster of VGR2831 gene: VGAM516 host target protein and VGAM517 host target protein, herein schematically represented by VGAM1 HOST TARGET PROTEIN through VGAM3 HOST TARGET PROTEIN. The function of these host target genes is elaborated hereinabove with reference to VGAM516 and VGAM517. FIG. 9 further provides a conceptual description of novel bioinformatically detected regulatory viral gene, referred to here as Viral Genomic Record 2832(VGR2832) viral gene, which encodes an 'operon-like' cluster of novel viral micro RNA-like genes, each of which in turn modulates expression of at least one host target gene, the function and utility of which at least one host target gene is known in the art.

VGR2832 gene, herein designated VGR GENE, is a novel bioinformatically detected regulatory, non protein coding, RNA viral gene. The method by which VGR2832 gene was detected is described hereinabove with reference to FIGS. 1-9.

VGR2832 gene encodes VGR2832 precursor RNA, herein designated VGR PRECURSOR RNA, an RNA molecule, typically several hundred nucleotides long.

VGR2832 precursor RNA folds spatially, forming VGR2832 folded precursor RNA, herein designated VGR FOLDED PRECURSOR RNA. It is appreciated that VGR2832 folded precursor RNA comprises a plurality of what is known in the art as 'hairpin' structures. These 'hairpin' structures are due to the fact that the nucleotide sequence of VGR2832 precursor RNA comprises a plurality of segments, the first half of each such segment having a nucleotide sequence which is at least a partial inversed-reversed sequence of the second half thereof, as is well known in the art.

VGR2832 folded precursor RNA is naturally processed by cellular enzymatic activity into at least 2 separate VGAM precursor RNAs, VGAM519 precursor RNA and VGAM520 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM519 RNA and VGAM520 RNA, herein schematically represented by VGAM1 RNA through VGAM3 RNA, each of which VGAM RNAs corresponding to VGAM RNA of FIG. 1.

VGAM519 RNA, herein schematically represented by VGAM1 RNA through VGAM3 RNA, binds complementarily to a host target binding site located in an untranslated region of VGAM519 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM519 host target RNA into VGAM519 host target protein, herein schematically represented by VGAM1 HOST TARGET PROTEIN through VGAM3 HOST TARGET PROTEIN, all of FIG. 1.

VGAM520 RNA, herein schematically represented by VGAM1 RNA through VGAM3 RNA, binds complementarily to a host target binding site located in an untranslated region of VGAM520 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM520 host target RNA into VGAM520 host target protein, herein schematically represented by VGAM1 HOST TARGET PROTEIN through VGAM3 HOST TARGET PROTEIN, all of FIG. 1.

It is appreciated that a function of VGR2832 gene, herein designated VGR GENE, is inhibition of expression of host target genes, as part of a novel viral mechanism of attacking a host. Accordingly, utilities of VGR2832 gene include diagnosis, prevention and treatment of viral infection by Lymphocystis Disease Virus 1. Specific functions, and accordingly utilities, of VGR2832 gene correlate with, and may be deduced from, the identity of the host target genes, which are inhibited by VGAM RNAs comprised in the 'operon-like' cluster of VGR2832 gene: VGAM519 host target protein and VGAM520 host target protein, herein schematically represented by VGAM1 HOST TARGET PROTEIN through VGAM3 HOST TARGET PROTEIN. The function of these host target genes is elaborated hereinabove with reference to VGAM519 and VGAM520. FIG. 9 further provides a conceptual description of novel bioinformatically detected regulatory viral gene, referred to here as Viral Genomic Record 2833(VGR2833) viral gene, which encodes an 'operon-like' cluster of novel viral micro RNA-like genes, each of which in turn modulates expression of at least one host target gene, the function and utility of which at least one host target gene is known in the art.

VGR2833 gene, herein designated VGR GENE, is a novel bioinformatically detected regulatory, non protein coding, RNA viral gene. The method by which VGR2833 gene was detected is described hereinabove with reference to FIGS. 1-9.

VGR2833 gene encodes VGR2833 precursor RNA, herein designated VGR PRECURSOR RNA, an RNA molecule, typically several hundred nucleotides long.

VGR2833 precursor RNA folds spatially, forming VGR2833 folded precursor RNA, herein designated VGR FOLDED PRECURSOR RNA. It is appreciated that VGR2833 folded precursor RNA comprises a plurality of what is known in the art as 'hairpin' structures. These 'hairpin' structures are due to the fact that the nucleotide sequence of VGR2833 precursor RNA comprises a plurality of segments, the first half of each such segment having a nucleotide sequence which is at least a partial inversed-reversed sequence of the second half thereof, as is well known in the art.

VGR2833 folded precursor RNA is naturally processed by cellular enzymatic activity into at least 2 separate VGAM precursor RNAs, VGAM521 precursor RNA and VGAM522 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM521 RNA and VGAM522 RNA, herein schematically represented by VGAM1 RNA through VGAM3 RNA, each of which VGAM RNAs corresponding to VGAM RNA of FIG. 1.

VGAM521 RNA, herein schematically represented by VGAM1 RNA through VGAM3 RNA, binds complementarily to a host target binding site located in an untranslated region of VGAM521 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM521 host target RNA into VGAM521 host target protein, herein schematically represented by VGAM1 HOST TARGET PROTEIN through VGAM3 HOST TARGET PROTEIN, all of FIG. 1.

VGAM522 RNA, herein schematically represented by VGAM1 RNA through VGAM3 RNA, binds complementarily to a host target binding site located in an untranslated region of VGAM522 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM522 host target RNA into VGAM522 host target protein, herein schematically represented by VGAM1 HOST TARGET PROTEIN through VGAM3 HOST TARGET PROTEIN, all of FIG. 1.

It is appreciated that a function of VGR2833 gene, herein designated VGR GENE, is inhibition of expression of host target genes, as part of a novel viral mechanism of attacking a host. Accordingly, utilities of VGR2833 gene include diagnosis, prevention and treatment of viral infection by Lymphocystis Disease Virus 1. Specific functions, and accordingly utilities, of VGR2833 gene correlate with, and may be deduced from, the identity of the host target genes, which are inhibited by VGAM RNAs comprised in the 'operon-like' cluster of VGR2833 gene: VGAM521 host target protein and VGAM522 host target protein, herein schematically represented by VGAM1 HOST TARGET PROTEIN through VGAM3 HOST TARGET PROTEIN. The function of these host target genes is elaborated hereinabove with reference to VGAM521 and VGAM522. FIG. 9 further provides a conceptual description of novel bioinformatically detected regulatory viral gene, referred to here as Viral Genomic Record 2834(VGR2834) viral gene, which encodes an 'operon-like' cluster of novel viral micro RNA-like genes, each of which in turn modulates expression of at least one host target gene, the function and utility of which at least one host target gene is known in the art.

VGR2834 gene, herein designated VGR GENE, is a novel bioinformatically detected regulatory, non protein coding, RNA viral gene. The method by which VGR2834 gene was detected is described hereinabove with reference to FIGS. 1-9.

VGR2834 gene encodes VGR2834 precursor RNA, herein designated VGR PRECURSOR RNA, an RNA molecule, typically several hundred nucleotides long.

VGR2834 precursor RNA folds spatially, forming VGR2834 folded precursor RNA, herein designated VGR FOLDED PRECURSOR RNA. It is appreciated that VGR2834 folded precursor RNA comprises a plurality of what is known in the art as 'hairpin' structures. These 'hairpin' structures are due to the fact that the nucleotide sequence of VGR2834 precursor RNA comprises a plurality of segments, the first half of each such segment having a nucleotide sequence which is at least a partial inversed-reversed sequence of the second half thereof, as is well known in the art.

VGR2834 folded precursor RNA is naturally processed by cellular enzymatic activity into at least 2 separate VGAM precursor RNAs, VGAM523 precursor RNA and VGAM524 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM523 RNA and VGAM524 RNA, herein schematically represented by VGAM1 RNA through VGAM3 RNA, each of which VGAM RNAs corresponding to VGAM RNA of FIG. 1.

VGAM523 RNA, herein schematically represented by VGAM1 RNA through VGAM3 RNA, binds complementarily to a host target binding site located in an untranslated region of VGAM523 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM523 host target RNA into VGAM523 host target protein, herein schematically represented by VGAM1 HOST TARGET PROTEIN through VGAM3 HOST TARGET PROTEIN, all of FIG. 1.

VGAM524 RNA, herein schematically represented by VGAM1 RNA through VGAM3 RNA, binds complementarily to a host target binding site located in an untranslated region of VGAM524 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM524 host target RNA into VGAM524 host target protein, herein schematically represented by VGAM1 HOST TARGET PROTEIN through VGAM3 HOST TARGET PROTEIN, all of FIG. 1.

It is appreciated that a function of VGR2834 gene, herein designated VGR GENE, is inhibition of expression of host target genes, as part of a novel viral mechanism of attacking a host. Accordingly, utilities of VGR2834 gene include diagnosis, prevention and treatment of viral infection by Murid Herpesvirus 4. Specific functions, and accordingly utilities, of VGR2834 gene correlate with, and may be deduced from, the identity of the host target genes, which are inhibited by VGAM RNAs comprised in the 'operon-like' cluster of VGR2834 gene: VGAM523 host target protein and VGAM524 host target protein, herein schematically represented by VGAM1 HOST TARGET PROTEIN through VGAM3 HOST TARGET PROTEIN. The function of these host target genes is elaborated hereinabove with reference to VGAM523 and VGAM524. FIG. 9 further provides a conceptual description of novel bioinformatically detected regulatory viral gene, referred to here as Viral Genomic Record 2835(VGR2835) viral gene, which encodes an 'operon-like' cluster of novel viral micro RNA-like genes, each of which in turn modulates expression of at least one host target gene, the function and utility of which at least one host target gene is known in the art.

VGR2835 gene, herein designated VGR GENE, is a novel bioinformatically detected regulatory, non protein coding, RNA viral gene. The method by which VGR2835 gene was detected is described hereinabove with reference to FIGS. 1-9.

VGR2835 gene encodes VGR2835 precursor RNA, herein designated VGR PRECURSOR RNA, an RNA molecule, typically several hundred nucleotides long.

VGR2835 precursor RNA folds spatially, forming VGR2835 folded precursor RNA, herein designated VGR FOLDED PRECURSOR RNA. It is appreciated that VGR2835 folded precursor RNA comprises a plurality of what is known in the art as 'hairpin' structures. These 'hairpin' structures are due to the fact that the nucleotide sequence of VGR2835 precursor RNA comprises a plurality of segments, the first half of each such segment having a nucleotide sequence which is at least a partial inversed-reversed sequence of the second half thereof, as is well known in the art.

VGR2835 folded precursor RNA is naturally processed by cellular enzymatic activity into at least 2 separate VGAM precursor RNAs, VGAM525 precursor RNA and VGAM526 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM525 RNA and VGAM526 RNA, herein schematically represented by VGAM1 RNA through VGAM3 RNA, each of which VGAM RNAs corresponding to VGAM RNA of FIG. 1.

VGAM525 RNA, herein schematically represented by VGAM1 RNA through VGAM3 RNA, binds complementarily to a host target binding site located in an untranslated region of VGAM525 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM525 host target RNA into VGAM525 host target protein, herein schematically represented by VGAM1 HOST TARGET PROTEIN through VGAM3 HOST TARGET PROTEIN, all of FIG. 1.

VGAM526 RNA, herein schematically represented by VGAM1 RNA through VGAM3 RNA, binds complementarily to a host target binding site located in an untranslated region of VGAM526 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM526 host target RNA into VGAM526 host target protein, herein schematically represented by VGAM1 HOST TARGET PROTEIN through VGAM3 HOST TARGET PROTEIN, all of FIG. 1.

It is appreciated that a function of VGR2835 gene, herein designated VGR GENE, is inhibition of expression of host target genes, as part of a novel viral mechanism of attacking a host. Accordingly, utilities of VGR2835 gene include diagnosis, prevention and treatment of viral infection by Murid Herpesvirus 4. Specific functions, and accordingly utilities, of VGR2835 gene correlate with, and may be deduced from, the identity of the host target genes, which are inhibited by VGAM RNAs comprised in the 'operon-like' cluster of VGR2835 gene: VGAM525 host target protein and VGAM526 host target protein, herein schematically represented by VGAM1 HOST TARGET PROTEIN through VGAM3 HOST TARGET PROTEIN. The function of these host target genes is elaborated hereinabove with reference to VGAM525 and VGAM526. FIG. 9 further provides a conceptual description of novel bioinformatically detected regulatory viral gene, referred to here as Viral Genomic Record 2836(VGR2836) viral gene, which encodes an 'operon-like' cluster of novel viral micro RNA-like genes, each of which in turn modulates expression of at least one host target gene, the function and utility of which at least one host target gene is known in the art.

VGR2836 gene, herein designated VGR GENE, is a novel bioinformatically detected regulatory, non protein coding, RNA viral gene. The method by which VGR2836 gene was detected is described hereinabove with reference to FIGS. 1-9.

VGR2836 gene encodes VGR2836 precursor RNA, herein designated VGR PRECURSOR RNA, an RNA molecule, typically several hundred nucleotides long.

VGR2836 precursor RNA folds spatially, forming VGR2836 folded precursor RNA, herein designated VGR FOLDED PRECURSOR RNA. It is appreciated that VGR2836 folded precursor RNA comprises a plurality of what is known in the art as 'hairpin' structures. These 'hairpin' structures are due to the fact that the nucleotide sequence of VGR2836 precursor RNA comprises a plurality of segments, the first half of each such segment having a nucleotide sequence which is at least a partial inversed-reversed sequence of the second half thereof, as is well known in the art.

VGR2836 folded precursor RNA is naturally processed by cellular enzymatic activity into at least 2 separate VGAM precursor RNAs, VGAM536 precursor RNA and VGAM537 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM536 RNA and VGAM537 RNA, herein schematically represented by VGAM1 RNA through VGAM3 RNA, each of which VGAM RNAs corresponding to VGAM RNA of FIG. 1.

VGAM536 RNA, herein schematically represented by VGAM1 RNA through VGAM3 RNA, binds complementarily to a host target binding site located in an untranslated region of VGAM536 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM536 host target RNA into VGAM536 host target protein, herein schematically represented by VGAM1 HOST TARGET PROTEIN through VGAM3 HOST TARGET PROTEIN, all of FIG. 1.

VGAM537 RNA, herein schematically represented by VGAM1 RNA through VGAM3 RNA, binds complementarily to a host target binding site located in an untranslated region of VGAM537 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM537 host target RNA into VGAM537 host target protein, herein schematically represented by VGAM1 HOST TARGET PROTEIN through VGAM3 HOST TARGET PROTEIN, all of FIG. 1.

It is appreciated that a function of VGR2836 gene, herein designated VGR GENE, is inhibition of expression of host target genes, as part of a novel viral mechanism of attacking a host. Accordingly, utilities of VGR2836 gene include diagnosis, prevention and treatment of viral infection by Ateline Herpesvirus 3. Specific functions, and accordingly utilities, of VGR2836 gene correlate with, and may be deduced from, the identity of the host target genes, which are inhibited by VGAM RNAs comprised in the 'operon-like' cluster of VGR2836 gene: VGAM536 host target protein and VGAM537 host target protein, herein schematically represented by VGAM1 HOST TARGET PROTEIN through VGAM3 HOST TARGET PROTEIN. The function of these host target genes is elaborated hereinabove with reference to VGAM536 and VGAM537. FIG. 9 further provides a conceptual description of novel bioinformatically detected regulatory viral gene, referred to here as Viral Genomic Record 2837(VGR2837) viral gene, which encodes an 'operon-like' cluster of novel viral micro RNA-like genes, each of which in turn modulates expression of at least one host target gene, the function and utility of which at least one host target gene is known in the art.

VGR2837 gene, herein designated VGR GENE, is a novel bioinformatically detected regulatory, non protein coding, RNA viral gene. The method by which VGR2837 gene was detected is described hereinabove with reference to FIGS. 1-9.

VGR2837 gene encodes VGR2837 precursor RNA, herein designated VGR PRECURSOR RNA, an RNA molecule, typically several hundred nucleotides long.

VGR2837 precursor RNA folds spatially, forming VGR2837 folded precursor RNA, herein designated VGR FOLDED PRECURSOR RNA. It is appreciated that VGR2837 folded precursor RNA comprises a plurality of what is known in the art as 'hairpin' structures. These 'hairpin' structures are due to the fact that the nucleotide sequence of VGR2837 precursor RNA comprises a plurality of segments, the first half of each such segment having a nucleotide sequence which is at least a partial inversed-reversed sequence of the second half thereof, as is well known in the art.

VGR2837 folded precursor RNA is naturally processed by cellular enzymatic activity into at least 3 separate VGAM precursor RNAs, VGAM539 precursor RNA, VGAM540 precursor RNA and VGAM541 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM539 RNA, VGAM540 RNA and VGAM541 RNA, herein schematically represented by VGAM1 RNA through VGAM3 RNA, each of which VGAM RNAs corresponding to VGAM RNA of FIG. 1.

VGAM539 RNA, herein schematically represented by VGAM1 RNA through VGAM3 RNA, binds complementarily to a host target binding site located in an untranslated region of VGAM539 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM539 host target RNA into VGAM539 host target protein, herein schematically represented by VGAM1 HOST TARGET PROTEIN through VGAM3 HOST TARGET PROTEIN, all of FIG. 1.

VGAM540 RNA, herein schematically represented by VGAM1 RNA through VGAM3 RNA, binds complementarily to a host target binding site located in an untranslated region of VGAM540 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM540 host target RNA into VGAM540 host target protein, herein schematically represented by VGAM1 HOST TARGET PROTEIN through VGAM3 HOST TARGET PROTEIN, all of FIG. 1.

VGAM541 RNA, herein schematically represented by VGAM1 RNA through VGAM3 RNA, binds complementarily to a host target binding site located in an untranslated region of VGAM541 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM541 host target RNA into VGAM541 host target protein, herein schematically represented by VGAM1 HOST TARGET PROTEIN through VGAM3 HOST TARGET PROTEIN, all of FIG. 1.

It is appreciated that a function of VGR2837 gene, herein designated VGR GENE, is inhibition of expression of host target genes, as part of a novel viral mechanism of attacking a host. Accordingly, utilities of VGR2837 gene include diagnosis, prevention and treatment of viral infection by Bovine Respiratory Syncytial Virus. Specific functions, and accordingly utilities, of VGR2837 gene correlate with, and may be deduced from, the identity of the host target genes, which are inhibited by VGAM RNAs comprised in the 'operon-like' cluster of VGR2837 gene: VGAM539 host target protein, VGAM540 host target protein and VGAM541 host target protein, herein schematically represented by VGAM1 HOST TARGET PROTEIN through VGAM3 HOST TARGET PROTEIN. The function of these host target genes is elaborated hereinabove with reference to VGAM539, VGAM540 and VGAM541. FIG. 9 further provides a conceptual description of novel bioinformatically detected regulatory viral gene, referred to here as Viral Genomic Record 2838(VGR2838) viral gene, which encodes an 'operon-like' cluster of novel viral micro RNA-like genes, each of which in turn modulates expression of at least one host target gene, the function and utility of which at least one host target gene is known in the art.

VGR2838 gene, herein designated VGR GENE, is a novel bioinformatically detected regulatory, non protein coding, RNA viral gene. The method by which VGR2838 gene was detected is described hereinabove with reference to FIGS. 1-9.

VGR2838 gene encodes VGR2838 precursor RNA, herein designated VGR PRECURSOR RNA, an RNA molecule, typically several hundred nucleotides long.

VGR2838 precursor RNA folds spatially, forming VGR2838 folded precursor RNA, herein designated VGR FOLDED PRECURSOR RNA. It is appreciated that VGR2838 folded precursor RNA comprises a plurality of what is known in the art as 'hairpin' structures. These 'hairpin' structures are due to the fact that the nucleotide sequence of VGR2838 precursor RNA comprises a plurality of segments, the first half of each such segment having a nucleotide sequence which is at least a partial inversed-reversed sequence of the second half thereof, as is well known in the art.

VGR2838 folded precursor RNA is naturally processed by cellular enzymatic activity into at least 2 separate VGAM precursor RNAs, VGAM546 precursor RNA and VGAM547 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM546 RNA and VGAM547 RNA, herein schematically represented by VGAM1 RNA through VGAM3 RNA, each of which VGAM RNAs corresponding to VGAM RNA of FIG. 1.

VGAM546 RNA, herein schematically represented by VGAM1 RNA through VGAM3 RNA, binds complementarily to a host target binding site located in an untranslated region of VGAM546 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM546 host target RNA into VGAM546 host target protein, herein schematically represented by VGAM1 HOST TARGET PROTEIN through VGAM3 HOST TARGET PROTEIN, all of FIG. 1.

VGAM547 RNA, herein schematically represented by VGAM1 RNA through VGAM3 RNA, binds complementarily to a host target binding site located in an untranslated region of VGAM547 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM547 host target RNA into VGAM547 host target protein, herein schematically represented by VGAM1 HOST TARGET PROTEIN through VGAM3 HOST TARGET PROTEIN, all of FIG. 1.

It is appreciated that a function of VGR2838 gene, herein designated VGR GENE, is inhibition of expression of host target genes, as part of a novel viral mechanism of attacking a host. Accordingly, utilities of VGR2838 gene include diagnosis, prevention and treatment of viral infection by Peanut Stunt Virus. Specific functions, and accordingly utilities, of VGR2838 gene correlate with, and may be deduced from, the identity of the host target genes, which are inhibited by VGAM RNAs comprised in the 'operon-like' cluster of VGR2838 gene: VGAM546 host target protein and VGAM547 host target protein, herein schematically represented by VGAM1 HOST TARGET PROTEIN through VGAM3 HOST TARGET PROTEIN. The function of these host target genes is elaborated hereinabove with reference to VGAM546 and VGAM547. FIG. 9 further provides a conceptual description of novel bioinformatically detected regulatory viral gene, referred to here as Viral Genomic Record 2839(VGR2839) viral gene, which encodes an 'operon-like' cluster of novel viral micro RNA-like genes, each of which in turn modulates expression of at least one host target gene, the function and utility of which at least one host target gene is known in the art.

VGR2839 gene, herein designated VGR GENE, is a novel bioinformatically detected regulatory, non protein coding, RNA viral gene. The method by which VGR2839 gene was detected is described hereinabove with reference to FIGS. 1-9.

VGR2839 gene encodes VGR2839 precursor RNA, herein designated VGR PRECURSOR RNA, an RNA molecule, typically several hundred nucleotides long.

VGR2839 precursor RNA folds spatially, forming VGR2839 folded precursor RNA, herein designated VGR FOLDED PRECURSOR RNA. It is appreciated that VGR2839 folded precursor RNA comprises a plurality of what is known in the art as 'hairpin' structures. These 'hairpin' structures are due to the fact that the nucleotide sequence of VGR2839 precursor RNA comprises a plurality of segments, the first half of each such segment having a nucleotide sequence which is at least a partial inversed-reversed sequence of the second half thereof, as is well known in the art.

VGR2839 folded precursor RNA is naturally processed by cellular enzymatic activity into at least 2 separate VGAM precursor RNAs, VGAM550 precursor RNA and VGAM551 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM550 RNA and VGAM551 RNA, herein schematically represented by VGAM1 RNA through VGAM3 RNA, each of which VGAM RNAs corresponding to VGAM RNA of FIG. 1.

VGAM550 RNA, herein schematically represented by VGAM1 RNA through VGAM3 RNA, binds complementarily to a host target binding site located in an untranslated region of VGAM550 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM550 host target RNA into VGAM550 host target protein, herein schematically represented by VGAM1 HOST TARGET PROTEIN through VGAM3 HOST TARGET PROTEIN, all of FIG. 1.

VGAM551 RNA, herein schematically represented by VGAM1 RNA through VGAM3 RNA, binds complementarily to a host target binding site located in an untranslated region of VGAM551 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM551 host target RNA into VGAM551 host target protein, herein schematically represented by VGAM1 HOST TARGET PROTEIN through VGAM3 HOST TARGET PROTEIN, all of FIG. 1.

It is appreciated that a function of VGR2839 gene, herein designated VGR GENE, is inhibition of expression of host target genes, as part of a novel viral mechanism of attacking a host. Accordingly, utilities of VGR2839 gene include diagnosis, prevention and treatment of viral infection by Leishmania RNA Virus 2-1. Specific functions, and accordingly utilities, of VGR2839 gene correlate with, and may be deduced from, the identity of the host target genes, which are inhibited by VGAM RNAs comprised in the 'operon-like' cluster of VGR2839 gene: VGAM550 host target protein and VGAM551 host target protein, herein schematically represented by VGAM1 HOST TARGET PROTEIN through VGAM3 HOST TARGET PROTEIN. The function of these host target genes is elaborated hereinabove with reference to VGAM550 and VGAM551. FIG. 9 further provides a conceptual description of novel bioinformatically detected regulatory viral gene, referred to here as Viral Genomic Record 2840(VGR2840) viral gene, which encodes an 'operon-like' cluster of novel viral micro RNA-like genes, each of which in turn modulates expression of at least one host target gene, the function and utility of which at least one host target gene is known in the art.

VGR2840 gene, herein designated VGR GENE, is a novel bioinformatically detected regulatory, non protein coding, RNA viral gene. The method by which VGR2840 gene was detected is described hereinabove with reference to FIGS. 1-9.

VGR2840 gene encodes VGR2840 precursor RNA, herein designated VGR PRECURSOR RNA, an RNA molecule, typically several hundred nucleotides long.

VGR2840 precursor RNA folds spatially, forming VGR2840 folded precursor RNA, herein designated VGR FOLDED PRECURSOR RNA. It is appreciated that VGR2840 folded precursor RNA comprises a plurality of what is known in the art as 'hairpin' structures. These 'hairpin' structures are due to the fact that the nucleotide sequence of VGR2840 precursor RNA comprises a plurality of segments, the first half of each such segment having a nucleotide sequence which is at least a partial inversed-reversed sequence of the second half thereof, as is well known in the art.

VGR2840 folded precursor RNA is naturally processed by cellular enzymatic activity into at least 3 separate VGAM precursor RNAs, VGAM554 precursor RNA, VGAM555 precursor RNA and VGAM556 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM554 RNA, VGAM555 RNA and VGAM556 RNA, herein schematically represented by VGAM1 RNA through VGAM3 RNA, each of which VGAM RNAs corresponding to VGAM RNA of FIG. 1.

VGAM554 RNA, herein schematically represented by VGAM1 RNA through VGAM3 RNA, binds complementarily to a host target binding site located in an untranslated region of VGAM554 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM554 host target RNA into VGAM554 host target protein, herein schematically represented by VGAM1 HOST TARGET PROTEIN through VGAM3 HOST TARGET PROTEIN, all of FIG. 1.

VGAM555 RNA, herein schematically represented by VGAM1 RNA through VGAM3 RNA, binds complementarily to a host target binding site located in an untranslated region of VGAM555 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM555 host target RNA into VGAM555 host target protein, herein schematically represented by VGAM1 HOST TARGET PROTEIN through VGAM3 HOST TARGET PROTEIN, all of FIG. 1.

VGAM556 RNA, herein schematically represented by VGAM1 RNA through VGAM3 RNA, binds complementarily to a host target binding site located in an untranslated region of VGAM556 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM556 host target RNA into VGAM556 host target protein, herein schematically represented by VGAM1 HOST TARGET PROTEIN through VGAM3 HOST TARGET PROTEIN, all of FIG. 1.

It is appreciated that a function of VGR2840 gene, herein designated VGR GENE, is inhibition of expression of host target genes, as part of a novel viral mechanism of attacking a host. Accordingly, utilities of VGR2840 gene include diagnosis, prevention and treatment of viral infection by Spodoptera Exigua Nucleopolyhedrovirus. Specific functions, and accordingly utilities, of VGR2840 gene correlate with, and may be deduced from, the identity of the host target genes, which are inhibited by VGAM RNAs comprised in the 'operon-like' cluster of VGR2840 gene: VGAM554 host target protein, VGAM555 host target protein and VGAM556 host target protein, herein schematically represented by VGAM1 HOST TARGET PROTEIN through VGAM3 HOST TARGET PROTEIN. The function of these host target genes is elaborated hereinabove with reference to VGAM554, VGAM555 and VGAM556. FIG. 9 further provides a conceptual description of novel bioinformatically detected regulatory viral gene, referred to here as Viral Genomic Record 2841 (VGR2841) viral gene, which encodes an 'operon-like' cluster of novel viral micro RNA-like genes, each of which in turn modulates expression of at least one host target gene, the function and utility of which at least one host target gene is known in the art.

VGR2841 gene, herein designated VGR GENE, is a novel bioinformatically detected regulatory, non protein coding, RNA viral gene. The method by which VGR2841 gene was detected is described hereinabove with reference to FIGS. 1-9.

VGR2841 gene encodes VGR2841 precursor RNA, herein designated VGR PRECURSOR RNA, an RNA molecule, typically several hundred nucleotides long.

VGR2841 precursor RNA folds spatially, forming VGR2841 folded precursor RNA, herein designated VGR FOLDED PRECURSOR RNA. It is appreciated that VGR2841 folded precursor RNA comprises a plurality of what is known in the art as 'hairpin' structures. These 'hairpin' structures are due to the fact that the nucleotide sequence of VGR2841 precursor RNA comprises a plurality of segments, the first half of each such segment having a nucleotide sequence which is at least a partial inversed-reversed sequence of the second half thereof, as is well known in the art.

VGR2841 folded precursor RNA is naturally processed by cellular enzymatic activity into at least 3 separate VGAM precursor RNAs, VGAM562 precursor RNA, VGAM563 precursor RNA and VGAM564 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM562 RNA, VGAM563 RNA and VGAM564 RNA, herein schematically represented by VGAM1 RNA through VGAM3 RNA, each of which VGAM RNAs corresponding to VGAM RNA of FIG. 1.

VGAM562 RNA, herein schematically represented by VGAM1 RNA through VGAM3 RNA, binds complementarily to a host target binding site located in an untranslated region of VGAM562 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM562 host target RNA into VGAM562 host target protein, herein schematically represented by VGAM1 HOST TARGET PROTEIN through VGAM3 HOST TARGET PROTEIN, all of FIG. 1.

VGAM563 RNA, herein schematically represented by VGAM1 RNA through VGAM3 RNA, binds complementarily to a host target binding site located in an untranslated region of VGAM563 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM563 host target RNA into VGAM563 host target protein, herein schematically represented by VGAM1 HOST TARGET PROTEIN through VGAM3 HOST TARGET PROTEIN, all of FIG. 1.

VGAM564 RNA, herein schematically represented by VGAM1 RNA through VGAM3 RNA, binds complementarily to a host target binding site located in an untranslated region of VGAM564 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM564 host target RNA into VGAM564 host target protein, herein schematically represented by VGAM1 HOST TARGET PROTEIN through VGAM3 HOST TARGET PROTEIN, all of FIG. 1.

It is appreciated that a function of VGR2841 gene, herein designated VGR GENE, is inhibition of expression of host target genes, as part of a novel viral mechanism of attacking a host. Accordingly, utilities of VGR2841 gene include diagnosis, prevention and treatment of viral infection by Fowlpox Virus. Specific functions, and accordingly utilities, of VGR2841 gene correlate with, and may be deduced from, the identity of the host target genes, which are inhibited by VGAM RNAs comprised in the 'operon-like' cluster of VGR2841 gene: VGAM562 host target protein, VGAM563 host target protein and VGAM564 host target protein, herein schematically represented by VGAM1 HOST TARGET PROTEIN through VGAM3 HOST TARGET PROTEIN. The function of these host target genes is elaborated hereinabove with reference to VGAM562, VGAM563 and VGAM564. FIG. 9 further provides a conceptual description of novel bioinformatically detected regulatory viral gene, referred to here as Viral Genomic Record 2842(VGR2842) viral gene, which encodes an 'operon-like' cluster of novel viral micro RNA-like genes, each of which in turn modulates expression of at least one host target gene, the function and utility of which at least one host target gene is known in the art.

VGR2842 gene, herein designated VGR GENE, is a novel bioinformatically detected regulatory, non protein coding, RNA viral gene. The method by which VGR2842 gene was detected is described hereinabove with reference to FIGS. 1-9.

VGR2842 gene encodes VGR2842 precursor RNA, herein designated VGR PRECURSOR RNA, an RNA molecule, typically several hundred nucleotides long.

VGR2842 precursor RNA folds spatially, forming VGR2842 folded precursor RNA, herein designated VGR FOLDED PRECURSOR RNA. It is appreciated that VGR2842 folded precursor RNA comprises a plurality of what is known in the art as 'hairpin' structures. These 'hairpin' structures are due to the fact that the nucleotide sequence of VGR2842 precursor RNA comprises a plurality of segments, the first half of each such segment having a nucleotide sequence which is at least a partial inversed-reversed sequence of the second half thereof, as is well known in the art.

VGR2842 folded precursor RNA is naturally processed by cellular enzymatic activity into at least 2 separate VGAM precursor RNAs, VGAM565 precursor RNA and VGAM566 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM565 RNA and VGAM566 RNA, herein schematically represented by VGAM1 RNA through VGAM3 RNA, each of which VGAM RNAs corresponding to VGAM RNA of FIG. 1.

VGAM565 RNA, herein schematically represented by VGAM1 RNA through VGAM3 RNA, binds complementarily to a host target binding site located in an untranslated region of VGAM565 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM565 host target RNA into VGAM565 host target protein, herein schematically represented by VGAM1 HOST TARGET PROTEIN through VGAM3 HOST TARGET PROTEIN, all of FIG. 1.

VGAM566 RNA, herein schematically represented by VGAM1 RNA through VGAM3 RNA, binds complementarily to a host target binding site located in an untranslated region of VGAM566 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM566 host target RNA into VGAM566 host target protein, herein schematically represented by VGAM1 HOST TARGET PROTEIN through VGAM3 HOST TARGET PROTEIN, all of FIG. 1.

It is appreciated that a function of VGR2842 gene, herein designated VGR GENE, is inhibition of expression of host target genes, as part of a novel viral mechanism of attacking a host. Accordingly, utilities of VGR2842 gene include diagnosis, prevention and treatment of viral infection by Fowlpox Virus. Specific functions, and accordingly utilities, of VGR2842 gene correlate with, and may be deduced from, the identity of the host target genes, which are inhibited by VGAM RNAs comprised in the 'operon-like' cluster of VGR2842 gene: VGAM565 host target protein and VGAM566 host target protein, herein schematically represented by VGAM1 HOST TARGET PROTEIN through VGAM3 HOST TARGET PROTEIN. The function of these host target genes is elaborated hereinabove with reference to VGAM565 and VGAM566. FIG. 9 further provides a conceptual description of novel bioinformatically detected regulatory viral gene, referred to here as Viral Genomic Record 2843(VGR2843) viral gene, which encodes an 'operon-like' cluster of novel viral micro RNA-like genes, each of which in turn modulates expression of at least one host target gene, the function and utility of which at least one host target gene is known in the art.

VGR2843 gene, herein designated VGR GENE, is a novel bioinformatically detected regulatory, non protein coding, RNA viral gene. The method by which VGR2843 gene was detected is described hereinabove with reference to FIGS. 1-9.

VGR2843 gene encodes VGR2843 precursor RNA, herein designated VGR PRECURSOR RNA, an RNA molecule, typically several hundred nucleotides long.

VGR2843 precursor RNA folds spatially, forming VGR2843 folded precursor RNA, herein designated VGR FOLDED PRECURSOR RNA. It is appreciated that VGR2843 folded precursor RNA comprises a plurality of what is known in the art as 'hairpin' structures. These 'hairpin' structures are due to the fact that the nucleotide sequence of VGR2843 precursor RNA comprises a plurality of segments, the first half of each such segment having a nucleotide sequence which is at least a partial inversed-reversed sequence of the second half thereof, as is well known in the art.

VGR2843 folded precursor RNA is naturally processed by cellular enzymatic activity into at least 4 separate VGAM precursor RNAs, VGAM567 precursor RNA, VGAM568 precursor RNA, VGAM569 precursor RNA and VGAM570 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM567 RNA, VGAM568 RNA, VGAM569 RNA and VGAM570 RNA, herein schematically represented by VGAM1 RNA through VGAM3 RNA, each of which VGAM RNAs corresponding to VGAM RNA of FIG. 1.

VGAM567 RNA, herein schematically represented by VGAM1 RNA through VGAM3 RNA, binds complementarily to a host target binding site located in an untranslated region of VGAM567 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM567 host target RNA into VGAM567 host target protein, herein schematically represented by VGAM1 HOST TARGET PROTEIN through VGAM3 HOST TARGET PROTEIN, all of FIG. 1.

VGAM568 RNA, herein schematically represented by VGAM1 RNA through VGAM3 RNA, binds complementarily to a host target binding site located in an untranslated region of VGAM568 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM568 host target RNA into VGAM568 host target protein, herein schematically represented by VGAM1 HOST TARGET PROTEIN through VGAM3 HOST TARGET PROTEIN, all of FIG. 1.

VGAM569 RNA, herein schematically represented by VGAM1 RNA through VGAM3 RNA, binds complementarily to a host target binding site located in an untranslated region of VGAM569 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM569 host target RNA into VGAM569 host target protein, herein schematically represented by VGAM1 HOST TARGET PROTEIN through VGAM3 HOST TARGET PROTEIN, all of FIG. 1.

VGAM570 RNA, herein schematically represented by VGAM1 RNA through VGAM3 RNA, binds complementarily to a host target binding site located in an untranslated region of VGAM570 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM570 host target RNA into VGAM570 host target protein, herein schematically represented by VGAM1 HOST TARGET PROTEIN through VGAM3 HOST TARGET PROTEIN, all of FIG. 1.

It is appreciated that a function of VGR2843 gene, herein designated VGR GENE, is inhibition of expression of host target genes, as part of a novel viral mechanism of attacking a host. Accordingly, utilities of VGR2843 gene include diagnosis, prevention and treatment of viral infection by Fowlpox Virus. Specific functions, and accordingly utilities, of VGR2843 gene correlate with, and may be deduced from, the identity of the host target genes, which are inhibited by VGAM RNAs comprised in the 'operon-like' cluster of VGR2843 gene: VGAM567 host target protein, VGAM568 host target protein, VGAM569 host target protein and VGAM570 host target protein, herein schematically represented by VGAM1 HOST TARGET PROTEIN through VGAM3 HOST TARGET PROTEIN. The function of these host target genes is elaborated hereinabove with reference to VGAM567, VGAM568, VGAM569 and VGAM570. FIG. 9 further provides a conceptual description of novel bioinformatically detected regulatory viral gene, referred to here as Viral Genomic Record 2844(VGR2844) viral gene, which encodes an 'operon-like' cluster of novel viral micro RNA-like genes, each of which in turn modulates expression of at least one host target gene, the function and utility of which at least one host target gene is known in the art.

VGR2844 gene, herein designated VGR GENE, is a novel bioinformatically detected regulatory, non protein coding, RNA viral gene. The method by which VGR2844 gene was detected is described hereinabove with reference to FIGS. 1-9.

VGR2844 gene encodes VGR2844 precursor RNA, herein designated VGR PRECURSOR RNA, an RNA molecule, typically several hundred nucleotides long.

VGR2844 precursor RNA folds spatially, forming VGR2844 folded precursor RNA, herein designated VGR FOLDED PRECURSOR RNA. It is appreciated that VGR2844 folded precursor RNA comprises a plurality of what is known in the art as 'hairpin' structures. These 'hairpin' structures are due to the fact that the nucleotide sequence of VGR2844 precursor RNA comprises a plurality of segments, the first half of each such segment having a nucleotide sequence which is at least a partial inversed-reversed sequence of the second half thereof, as is well known in the art.

VGR2844 folded precursor RNA is naturally processed by cellular enzymatic activity into at least 4 separate VGAM precursor RNAs, VGAM571 precursor RNA, VGAM572 precursor RNA, VGAM573 precursor RNA and VGAM574 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM571 RNA, VGAM572 RNA, VGAM573 RNA and VGAM574 RNA, herein schematically represented by VGAM1 RNA through VGAM3 RNA, each of which VGAM RNAs corresponding to VGAM RNA of FIG. 1.

VGAM571 RNA, herein schematically represented by VGAM1 RNA through VGAM3 RNA, binds complementarily to a host target binding site located in an untranslated region of VGAM571 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM571 host target RNA into VGAM571 host target protein, herein schematically represented by VGAM1 HOST TARGET PROTEIN through VGAM3 HOST TARGET PROTEIN, all of FIG. 1.

VGAM572 RNA, herein schematically represented by VGAM1 RNA through VGAM3 RNA, binds complementarily to a host target binding site located in an untranslated region of VGAM572 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM572 host target RNA into VGAM572 host target protein, herein schematically represented by VGAM1 HOST TARGET PROTEIN through VGAM3 HOST TARGET PROTEIN, all of FIG. 1.

VGAM573 RNA, herein schematically represented by VGAM1 RNA through VGAM3 RNA, binds complementarily to a host target binding site located in an untranslated region of VGAM573 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM573 host target RNA into VGAM573 host target protein, herein schematically represented by VGAM1 HOST TARGET PROTEIN through VGAM3 HOST TARGET PROTEIN, all of FIG. 1.

VGAM574 RNA, herein schematically represented by VGAM1 RNA through VGAM3 RNA, binds complementarily to a host target binding site located in an untranslated region of VGAM574 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM574 host target RNA into VGAM574 host target protein, herein schematically represented by VGAM1 HOST TARGET PROTEIN through VGAM3 HOST TARGET PROTEIN, all of FIG. 1.

It is appreciated that a function of VGR2844 gene, herein designated VGR GENE, is inhibition of expression of host target genes, as part of a novel viral mechanism of attacking a host. Accordingly, utilities of VGR2844 gene include diagnosis, prevention and treatment of viral infection by Fowlpox Virus. Specific functions, and accordingly utilities, of VGR2844 gene correlate with, and may be deduced from, the identity of the host target genes, which are inhibited by VGAM RNAs comprised in the 'operon-like' cluster of VGR2844 gene: VGAM571 host target protein, VGAM572 host target protein, VGAM573 host target protein and VGAM574 host target protein, herein schematically represented by VGAM1 HOST TARGET PROTEIN through VGAM3 HOST TARGET PROTEIN. The function of these host target genes is elaborated hereinabove with reference to VGAM571, VGAM572, VGAM573 and VGAM574. FIG. 9 further provides a conceptual description of novel bioinformatically detected regulatory viral gene, referred to here as Viral Genomic Record 2845(VGR2845) viral gene, which encodes an 'operon-like' cluster of novel viral micro RNA-like genes, each of which in turn modulates expression of at least one host target gene, the function and utility of which at least one host target gene is known in the art.

VGR2845 gene, herein designated VGR GENE, is a novel bioinformatically detected regulatory, non protein coding, RNA viral gene. The method by which VGR2845 gene was detected is described hereinabove with reference to FIGS. 1-9.

VGR2845 gene encodes VGR2845 precursor RNA, herein designated VGR PRECURSOR RNA, an RNA molecule, typically several hundred nucleotides long.

VGR2845 precursor RNA folds spatially, forming VGR2845 folded precursor RNA, herein designated VGR FOLDED PRECURSOR RNA. It is appreciated that VGR2845 folded precursor RNA comprises a plurality of what is known in the art as 'hairpin' structures. These 'hairpin' structures are due to the fact that the nucleotide sequence of VGR2845 precursor RNA comprises a plurality of segments, the first half of each such segment having a nucleotide sequence which is at least a partial inversed-reversed sequence of the second half thereof, as is well known in the art.

VGR2845 folded precursor RNA is naturally processed by cellular enzymatic activity into at least 2 separate VGAM precursor RNAs, VGAM575 precursor RNA and VGAM576 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM575 RNA and VGAM576 RNA, herein schematically represented by VGAM1 RNA through VGAM3 RNA, each of which VGAM RNAs corresponding to VGAM RNA of FIG. 1.

VGAM575 RNA, herein schematically represented by VGAM1 RNA through VGAM3 RNA, binds complementarily to a host target binding site located in an untranslated region of VGAM575 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM575 host target RNA into VGAM575 host target protein, herein schematically represented by VGAM1 HOST TARGET PROTEIN through VGAM3 HOST TARGET PROTEIN, all of FIG. 1.

VGAM576 RNA, herein schematically represented by VGAM1 RNA through VGAM3 RNA, binds complementarily to a host target binding site located in an untranslated region of VGAM576 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM576 host target RNA into VGAM576 host target protein, herein schematically represented by VGAM1 HOST TARGET PROTEIN through VGAM3 HOST TARGET PROTEIN, all of FIG. 1.

It is appreciated that a function of VGR2845 gene, herein designated VGR GENE, is inhibition of expression of host target genes, as part of a novel viral mechanism of attacking a host. Accordingly, utilities of VGR2845 gene include diagnosis, prevention and treatment of viral infection by Fowlpox Virus. Specific functions, and accordingly utilities, of VGR2845 gene correlate with, and may be deduced from, the identity of the host target genes, which are inhibited by VGAM RNAs comprised in the 'operon-like' cluster of VGR2845 gene: VGAM575 host target protein and VGAM576 host target protein, herein schematically represented by VGAM1 HOST TARGET PROTEIN through VGAM3 HOST TARGET PROTEIN. The function of these host target genes is elaborated hereinabove with reference to VGAM575 and VGAM576. FIG. 9 further provides a conceptual description of novel bioinformatically detected regulatory viral gene, referred to here as Viral Genomic Record 2846(VGR2846) viral gene, which encodes an 'operon-like' cluster of novel viral micro RNA-like genes, each of which in turn modulates expression of at least one host target gene, the function and utility of which at least one host target gene is known in the art.

VGR2846 gene, herein designated VGR GENE, is a novel bioinformatically detected regulatory, non protein coding, RNA viral gene. The method by which VGR2846 gene was detected is described hereinabove with reference to FIGS. 1-9.

VGR2846 gene encodes VGR2846 precursor RNA, herein designated VGR PRECURSOR RNA, an RNA molecule, typically several hundred nucleotides long.

VGR2846 precursor RNA folds spatially, forming VGR2846 folded precursor RNA, herein designated VGR FOLDED PRECURSOR RNA. It is appreciated that VGR2846 folded precursor RNA comprises a plurality of what is known in the art as 'hairpin' structures. These 'hairpin' structures are due to the fact that the nucleotide sequence of VGR2846 precursor RNA comprises a plurality of segments, the first half of each such segment having a nucleotide sequence which is at least a partial inversed-reversed sequence of the second half thereof, as is well known in the art.

VGR2846 folded precursor RNA is naturally processed by cellular enzymatic activity into at least 2 separate VGAM precursor RNAs, VGAM577 precursor RNA and VGAM578 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM577 RNA and VGAM578 RNA, herein schematically represented by VGAM1 RNA through VGAM3 RNA, each of which VGAM RNAs corresponding to VGAM RNA of FIG. 1.

VGAM577 RNA, herein schematically represented by VGAM1 RNA through VGAM3 RNA, binds complementarily to a host target binding site located in an untranslated region of VGAM577 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM577 host target RNA into VGAM577 host target protein, herein schematically represented by VGAM1 HOST TARGET PROTEIN through VGAM3 HOST TARGET PROTEIN, all of FIG. 1.

VGAM578 RNA, herein schematically represented by VGAM1 RNA through VGAM3 RNA, binds complementarily to a host target binding site located in an untranslated region of VGAM578 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM578 host target RNA into VGAM578 host target protein, herein schematically represented by VGAM1 HOST TARGET PROTEIN through VGAM3 HOST TARGET PROTEIN, all of FIG. 1.

It is appreciated that a function of VGR2846 gene, herein designated VGR GENE, is inhibition of expression of host target genes, as part of a novel viral mechanism of attacking a host. Accordingly, utilities of VGR2846 gene include diagnosis, prevention and treatment of viral infection by Fowlpox Virus. Specific functions, and accordingly utilities, of VGR2846 gene correlate with, and may be deduced from, the identity of the host target genes, which are inhibited by VGAM RNAs comprised in the 'operon-like' cluster of VGR2846 gene: VGAM577 host target protein and VGAM578 host target protein, herein schematically represented by VGAM1 HOST TARGET PROTEIN through VGAM3 HOST TARGET PROTEIN. The function of these host target genes is elaborated hereinabove with reference to VGAM577 and VGAM578. FIG. 9 further provides a conceptual description of novel bioinformatically detected regulatory viral gene, referred to here as Viral Genomic Record 2847(VGR2847) viral gene, which encodes an 'operon-like' cluster of novel viral micro RNA-like genes, each of which in turn modulates expression of at least one host target gene, the function and utility of which at least one host target gene is known in the art.

VGR2847 gene, herein designated VGR GENE, is a novel bioinformatically detected regulatory, non protein coding, RNA viral gene. The method by which VGR2847 gene was detected is described hereinabove with reference to FIGS. 1-9.

VGR2847 gene encodes VGR2847 precursor RNA, herein designated VGR PRECURSOR RNA, an RNA molecule, typically several hundred nucleotides long.

VGR2847 precursor RNA folds spatially, forming VGR2847 folded precursor RNA, herein designated VGR FOLDED PRECURSOR RNA. It is appreciated that VGR2847 folded precursor RNA comprises a plurality of what is known in the art as 'hairpin' structures. These 'hairpin' structures are due to the fact that the nucleotide sequence of VGR2847 precursor RNA comprises a plurality of segments, the first half of each such segment having a nucleotide sequence which is at least a partial inversed-reversed sequence of the second half thereof, as is well known in the art.

VGR2847 folded precursor RNA is naturally processed by cellular enzymatic activity into at least 2 separate VGAM precursor RNAs, VGAM580 precursor RNA and VGAM581 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM580 RNA and VGAM581 RNA, herein schematically represented by VGAM1 RNA through VGAM3 RNA, each of which VGAM RNAs corresponding to VGAM RNA of FIG. 1.

VGAM580 RNA, herein schematically represented by VGAM1 RNA through VGAM3 RNA, binds complementarily to a host target binding site located in an untranslated region of VGAM580 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM580 host target RNA into VGAM580 host target protein, herein schematically represented by VGAM1 HOST TARGET PROTEIN through VGAM3 HOST TARGET PROTEIN, all of FIG. 1.

VGAM581 RNA, herein schematically represented by VGAM1 RNA through VGAM3 RNA, binds complementarily to a host target binding site located in an untranslated region of VGAM581 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM581 host target RNA into VGAM581 host target protein, herein schematically represented by VGAM1 HOST TARGET PROTEIN through VGAM3 HOST TARGET PROTEIN, all of FIG. 1.

It is appreciated that a function of VGR2847 gene, herein designated VGR GENE, is inhibition of expression of host target genes, as part of a novel viral mechanism of attacking a host. Accordingly, utilities of VGR2847 gene include diagnosis, prevention and treatment of viral infection by Fowlpox Virus. Specific functions, and accordingly utilities, of VGR2847 gene correlate with, and may be deduced from, the identity of the host target genes, which are inhibited by VGAM RNAs comprised in the 'operon-like' cluster of VGR2847 gene: VGAM580 host target protein and VGAM581 host target protein, herein schematically represented by VGAM1 HOST TARGET PROTEIN through VGAM3 HOST TARGET PROTEIN. The function of these host target genes is elaborated hereinabove with reference to VGAM580 and VGAM581. FIG. 9 further provides a conceptual description of novel bioinformatically detected regulatory viral gene, referred to here as Viral Genomic Record 2848(VGR2848) viral gene, which encodes an 'operon-like' cluster of novel viral micro RNA-like genes, each of which in turn modulates expression of at least one host target gene, the function and utility of which at least one host target gene is known in the art.

VGR2848 gene, herein designated VGR GENE, is a novel bioinformatically detected regulatory, non protein coding, RNA viral gene. The method by which VGR2848 gene was detected is described hereinabove with reference to FIGS. 1-9.

VGR2848 gene encodes VGR2848 precursor RNA, herein designated VGR PRECURSOR RNA, an RNA molecule, typically several hundred nucleotides long.

VGR2848 precursor RNA folds spatially, forming VGR2848 folded precursor RNA, herein designated VGR FOLDED PRECURSOR RNA. It is appreciated that VGR2848 folded precursor RNA comprises a plurality of what is known in the art as 'hairpin' structures. These 'hairpin' structures are due to the fact that the nucleotide sequence of VGR2848 precursor RNA comprises a plurality of segments, the first half of each such segment having a nucleotide sequence which is at least a partial inversed-reversed sequence of the second half thereof, as is well known in the art.

VGR2848 folded precursor RNA is naturally processed by cellular enzymatic activity into at least 3 separate VGAM precursor RNAs, VGAM585 precursor RNA, VGAM586 precursor RNA and VGAM587 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM585 RNA, VGAM586 RNA and VGAM587 RNA, herein schematically represented by VGAM1 RNA through VGAM3 RNA, each of which VGAM RNAs corresponding to VGAM RNA of FIG. 1.

VGAM585 RNA, herein schematically represented by VGAM1 RNA through VGAM3 RNA, binds complementarily to a host target binding site located in an untranslated region of VGAM585 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM585 host target RNA into VGAM585 host target protein, herein schematically represented by VGAM1 HOST TARGET PROTEIN through VGAM3 HOST TARGET PROTEIN, all of FIG. 1.

VGAM586 RNA, herein schematically represented by VGAM1 RNA through VGAM3 RNA, binds complementarily to a host target binding site located in an untranslated region of VGAM586 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM586 host target RNA into VGAM586 host target protein, herein schematically represented by VGAM1 HOST TARGET PROTEIN through VGAM3 HOST TARGET PROTEIN, all of FIG. 1.

VGAM587 RNA, herein schematically represented by VGAM1 RNA through VGAM3 RNA, binds complementarily to a host target binding site located in an untranslated region of VGAM587 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM587 host target RNA into VGAM587 host target protein, herein schematically represented by VGAM1 HOST TARGET PROTEIN through VGAM3 HOST TARGET PROTEIN, all of FIG. 1.

It is appreciated that a function of VGR2848 gene, herein designated VGR GENE, is inhibition of expression of host target genes, as part of a novel viral mechanism of attacking a host. Accordingly, utilities of VGR2848 gene include diagnosis, prevention and treatment of viral infection by Gallid Herpesvirus 2. Specific functions, and accordingly utilities, of VGR2848 gene correlate with, and may be deduced from, the identity of the host target genes, which are inhibited by VGAM RNAs comprised in the 'operon-like' cluster of VGR2848 gene: VGAM585 host target protein, VGAM586 host target protein and VGAM587 host target protein, herein schematically represented by VGAM1 HOST TARGET PROTEIN through VGAM3 HOST TARGET PROTEIN. The function of these host target genes is elaborated hereinabove with reference to VGAM585, VGAM586 and VGAM587. FIG. 9 further provides a conceptual description of novel bioinformatically detected regulatory viral gene, referred to here as Viral Genomic Record 2849(VGR2849) viral gene, which encodes an 'operon-like' cluster of novel viral micro RNA-like genes, each of which in turn modulates expression of at least one host target gene, the function and utility of which at least one host target gene is known in the art.

VGR2849 gene, herein designated VGR GENE, is a novel bioinformatically detected regulatory, non protein coding, RNA viral gene. The method by which VGR2849 gene was detected is described hereinabove with reference to FIGS. 1-9.

VGR2849 gene encodes VGR2849 precursor RNA, herein designated VGR PRECURSOR RNA, an RNA molecule, typically several hundred nucleotides long.

VGR2849 precursor RNA folds spatially, forming VGR2849 folded precursor RNA, herein designated VGR FOLDED PRECURSOR RNA. It is appreciated that VGR2849 folded precursor RNA comprises a plurality of what is known in the art as 'hairpin' structures. These 'hairpin' structures are due to the fact that the nucleotide sequence of VGR2849 precursor RNA comprises a plurality of segments, the first half of each such segment having a nucleotide sequence which is at least a partial inversed-reversed sequence of the second half thereof, as is well known in the art.

VGR2849 folded precursor RNA is naturally processed by cellular enzymatic activity into at least 3 separate VGAM precursor RNAs, VGAM588 precursor RNA, VGAM589 precursor RNA and VGAM590 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM588 RNA, VGAM589 RNA and VGAM590 RNA, herein schematically represented by VGAM1 RNA through VGAM3 RNA, each of which VGAM RNAs corresponding to VGAM RNA of FIG. 1.

VGAM588 RNA, herein schematically represented by VGAM1 RNA through VGAM3 RNA, binds complementarily to a host target binding site located in an untranslated region of VGAM588 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM588 host target RNA into VGAM588 host target protein, herein schematically represented by VGAM1 HOST TARGET PROTEIN through VGAM3 HOST TARGET PROTEIN, all of FIG. 1.

VGAM589 RNA, herein schematically represented by VGAM1 RNA through VGAM3 RNA, binds complementarily to a host target binding site located in an untranslated region of VGAM589 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM589 host target RNA into VGAM589 host target protein, herein schematically represented by VGAM1 HOST TARGET PROTEIN through VGAM3 HOST TARGET PROTEIN, all of FIG. 1.

VGAM590 RNA, herein schematically represented by VGAM1 RNA through VGAM3 RNA, binds complementarily to a host target binding site located in an untranslated region of VGAM590 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM590 host target RNA into VGAM590 host target protein, herein schematically represented by VGAM1 HOST TARGET PROTEIN through VGAM3 HOST TARGET PROTEIN, all of FIG. 1.

It is appreciated that a function of VGR2849 gene, herein designated VGR GENE, is inhibition of expression of host target genes, as part of a novel viral mechanism of attacking a host. Accordingly, utilities of VGR2849 gene include diagnosis, prevention and treatment of viral infection by Gallid Herpesvirus 2. Specific functions, and accordingly utilities, of VGR2849 gene correlate with, and may be deduced from, the identity of the host target genes, which are inhibited by VGAM RNAs comprised in the 'operon-like' cluster of VGR2849 gene: VGAM588 host target protein, VGAM589 host target protein and VGAM590 host target protein, herein schematically represented by VGAM1 HOST TARGET PROTEIN through VGAM3 HOST TARGET PROTEIN. The function of these host target genes is elaborated hereinabove with reference to VGAM588, VGAM589 and VGAM590. FIG. 9 further provides a conceptual description of novel bioinformatically detected regulatory viral gene, referred to here as Viral Genomic Record 2850 (VGR2850) viral gene, which encodes an 'operon-like' cluster of novel viral micro RNA-like genes, each of which in turn modulates expression of at least one host target gene, the function and utility of which at least one host target gene is known in the art.

VGR2850 gene, herein designated VGR GENE, is a novel bioinformatically detected regulatory, non protein coding, RNA viral gene. The method by which VGR2850 gene was detected is described hereinabove with reference to FIGS. 1-9.

VGR2850 gene encodes VGR2850 precursor RNA, herein designated VGR PRECURSOR RNA, an RNA molecule, typically several hundred nucleotides long.

VGR2850 precursor RNA folds spatially, forming VGR2850 folded precursor RNA, herein designated VGR FOLDED PRECURSOR RNA. It is appreciated that VGR2850 folded precursor RNA comprises a plurality of what is known in the art as 'hairpin' structures. These 'hairpin' structures are due to the fact that the nucleotide sequence of VGR2850 precursor RNA comprises a plurality of segments, the first half of each such segment having a nucleotide sequence which is at least a partial inversed-reversed sequence of the second half thereof, as is well known in the art.

VGR2850 folded precursor RNA is naturally processed by cellular enzymatic activity into at least 2 separate VGAM precursor RNAs, VGAM591 precursor RNA and VGAM592 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM591 RNA and VGAM592 RNA, herein schematically represented by VGAM1 RNA through VGAM3 RNA, each of which VGAM RNAs corresponding to VGAM RNA of FIG. 1.

VGAM591 RNA, herein schematically represented by VGAM1 RNA through VGAM3 RNA, binds complementarily to a host target binding site located in an untranslated region of VGAM591 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM591 host target RNA into VGAM591 host target protein, herein schematically represented by VGAM1 HOST TARGET PROTEIN through VGAM3 HOST TARGET PROTEIN, all of FIG. 1.

VGAM592 RNA, herein schematically represented by VGAM1 RNA through VGAM3 RNA, binds complementarily to a host target binding site located in an untranslated region of VGAM592 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM592 host target RNA into VGAM592 host target protein, herein schematically represented by VGAM1 HOST TARGET PROTEIN through VGAM3 HOST TARGET PROTEIN, all of FIG. 1.

It is appreciated that a function of VGR2850 gene, herein designated VGR GENE, is inhibition of expression of host target genes, as part of a novel viral mechanism of attacking a host. Accordingly, utilities of VGR2850 gene include diagnosis, prevention and treatment of viral infection by Gallid Herpesvirus 2. Specific functions, and accordingly utilities, of VGR2850 gene correlate with, and may be deduced from, the identity of the host target genes, which are inhibited by VGAM RNAs comprised in the 'operon-like' cluster of VGR2850 gene: VGAM591 host target protein and VGAM592 host target protein, herein schematically represented by VGAM1 HOST TARGET PROTEIN through VGAM3 HOST TARGET PROTEIN. The function of these host target genes is elaborated hereinabove with reference to VGAM591 and VGAM592. FIG. 9 further provides a conceptual description of novel bioinformatically detected regulatory viral gene, referred to here as Viral Genomic Record 2851(VGR2851) viral gene, which encodes an 'operon-like' cluster of novel viral micro RNA-like genes, each of which in turn modulates expression of at least one host target gene, the function and utility of which at least one host target gene is known in the art.

VGR2851 gene, herein designated VGR GENE, is a novel bioinformatically detected regulatory, non protein coding, RNA viral gene. The method by which VGR2851 gene was detected is described hereinabove with reference to FIGS. 1-9.

VGR2851 gene encodes VGR2851 precursor RNA, herein designated VGR PRECURSOR RNA, an RNA molecule, typically several hundred nucleotides long.

VGR2851 precursor RNA folds spatially, forming VGR2851 folded precursor RNA, herein designated VGR FOLDED PRECURSOR RNA. It is appreciated that VGR2851 folded precursor RNA comprises a plurality of what is known in the art as 'hairpin' structures. These 'hairpin' structures are due to the fact that the nucleotide sequence of VGR2851 precursor RNA comprises a plurality of segments, the first half of each such segment having a nucleotide sequence which is at least a partial inversed-reversed sequence of the second half thereof, as is well known in the art.

VGR2851 folded precursor RNA is naturally processed by cellular enzymatic activity into at least 3 separate VGAM precursor RNAs, VGAM594 precursor RNA, VGAM595 precursor RNA and VGAM596 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM594 RNA, VGAM595 RNA and VGAM596 RNA, herein schematically represented by VGAM1 RNA through VGAM3 RNA, each of which VGAM RNAs corresponding to VGAM RNA of FIG. 1.

VGAM594 RNA, herein schematically represented by VGAM1 RNA through VGAM3 RNA, binds complementarily to a host target binding site located in an untranslated region of VGAM594 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM594 host target RNA into VGAM594 host target protein, herein schematically represented by VGAM1 HOST TARGET PROTEIN through VGAM3 HOST TARGET PROTEIN, all of FIG. 1.

VGAM595 RNA, herein schematically represented by VGAM1 RNA through VGAM3 RNA, binds complementarily to a host target binding site located in an untranslated region of VGAM595 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM595 host target RNA into VGAM595 host target protein, herein schematically represented by VGAM1 HOST TARGET PROTEIN through VGAM3 HOST TARGET PROTEIN, all of FIG. 1.

VGAM596 RNA, herein schematically represented by VGAM1 RNA through VGAM3 RNA, binds complementarily to a host target binding site located in an untranslated region of VGAM596 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM596 host target RNA into VGAM596 host target protein, herein schematically represented by VGAM1 HOST TARGET PROTEIN through VGAM3 HOST TARGET PROTEIN, all of FIG. 1.

It is appreciated that a function of VGR2851 gene, herein designated VGR GENE, is inhibition of expression of host target genes, as part of a novel viral mechanism of attacking a host. Accordingly, utilities of VGR2851 gene include diagnosis, prevention and treatment of viral infection by Northern Cereal Mosaic Virus. Specific functions, and accordingly utilities, of VGR2851 gene correlate with, and may be deduced from, the identity of the host target genes, which are inhibited by VGAM RNAs comprised in the 'operon-like' cluster of VGR2851 gene: VGAM594 host target protein, VGAM595 host target protein and VGAM596 host target protein, herein schematically represented by VGAM1 HOST TARGET PROTEIN through VGAM3 HOST TARGET PROTEIN. The function of these host target genes is elaborated hereinabove with reference to VGAM594, VGAM595 and VGAM596. FIG. 9 further provides a conceptual description of novel bioinformatically detected regulatory viral gene, referred to here as Viral Genomic Record 2852(VGR2852) viral gene, which encodes an 'operon-like' cluster of novel viral micro RNA-like genes, each of which in turn modulates expression of at least one host target gene, the function and utility of which at least one host target gene is known in the art.

VGR2852 gene, herein designated VGR GENE, is a novel bioinformatically detected regulatory, non protein coding, RNA viral gene. The method by which VGR2852 gene was detected is described hereinabove with reference to FIGS. 1-9.

VGR2852 gene encodes VGR2852 precursor RNA, herein designated VGR PRECURSOR RNA, an RNA molecule, typically several hundred nucleotides long.

VGR2852 precursor RNA folds spatially, forming VGR2852 folded precursor RNA, herein designated VGR FOLDED PRECURSOR RNA. It is appreciated that VGR2852 folded precursor RNA comprises a plurality of what is known in the art as 'hairpin' structures. These 'hairpin' structures are due to the fact that the nucleotide sequence of VGR2852 precursor RNA comprises a plurality of segments, the first half of each such segment having a nucleotide sequence which is at least a partial inversed-reversed sequence of the second half thereof, as is well known in the art.

VGR2852 folded precursor RNA is naturally processed by cellular enzymatic activity into at least 8 separate VGAM precursor RNAs, VGAM597 precursor RNA, VGAM598 precursor RNA, VGAM599 precursor RNA, VGAM600 precursor RNA, VGAM601 precursor RNA, VGAM602 precursor RNA, VGAM603 precursor RNA and VGAM604 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM597 RNA, VGAM598 RNA, VGAM599 RNA, VGAM600 RNA, VGAM601 RNA, VGAM602 RNA, VGAM603 RNA and VGAM604 RNA, herein schematically represented by VGAM1 RNA through VGAM3 RNA, each of which VGAM RNAs corresponding to VGAM RNA of FIG. 1.

VGAM597 RNA, herein schematically represented by VGAM1 RNA through VGAM3 RNA, binds complementarily to a host target binding site located in an untranslated region of VGAM597 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM597 host target RNA into VGAM597 host target protein, herein schematically represented by VGAM1 HOST TARGET PROTEIN through VGAM3 HOST TARGET PROTEIN, all of FIG. 1.

VGAM598 RNA, herein schematically represented by VGAM1 RNA through VGAM3 RNA, binds complementarily to a host target binding site located in an untranslated region of VGAM598 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM598 host target RNA into VGAM598 host target protein, herein schematically represented by VGAM1 HOST TARGET PROTEIN through VGAM3 HOST TARGET PROTEIN, all of FIG. 1.

VGAM599 RNA, herein schematically represented by VGAM1 RNA through VGAM3 RNA, binds complementarily to a host target binding site located in an untranslated region of VGAM599 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM599 host target RNA into VGAM599 host target protein, herein schematically represented by VGAM1 HOST TARGET PROTEIN through VGAM3 HOST TARGET PROTEIN, all of FIG. 1.

VGAM600 RNA, herein schematically represented by VGAM1 RNA through VGAM3 RNA, binds complementarily to a host target binding site located in an untranslated region of VGAM600 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM600 host target RNA into VGAM600 host target protein, herein schematically represented by VGAM1 HOST TARGET PROTEIN through VGAM3 HOST TARGET PROTEIN, all of FIG. 1.

VGAM601 RNA, herein schematically represented by VGAM1 RNA through VGAM3 RNA, binds complementarily to a host target binding site located in an untranslated region of VGAM601 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM601 host target RNA into VGAM601 host target protein, herein schematically represented by VGAM1 HOST TARGET PROTEIN through VGAM3 HOST TARGET PROTEIN, all of FIG. 1.

VGAM602 RNA, herein schematically represented by VGAM1 RNA through VGAM3 RNA, binds complementarily to a host target binding site located in an untranslated region of VGAM602 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM602 host target RNA into VGAM602 host target protein, herein schematically represented by VGAM1 HOST TARGET PROTEIN through VGAM3 HOST TARGET PROTEIN, all of FIG. 1.

VGAM603 RNA, herein schematically represented by VGAM1 RNA through VGAM3 RNA, binds complementarily to a host target binding site located in an untranslated region of VGAM603 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM603 host target RNA into VGAM603 host target protein, herein schematically represented by VGAM1 HOST TARGET PROTEIN through VGAM3 HOST TARGET PROTEIN, all of FIG. 1.

VGAM604 RNA, herein schematically represented by VGAM1 RNA through VGAM3 RNA, binds complementarily to a host target binding site located in an untranslated region of VGAM604 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM604 host target RNA into VGAM604 host target protein, herein schematically represented by VGAM1 HOST TARGET PROTEIN through VGAM3 HOST TARGET PROTEIN, all of FIG. 1.

It is appreciated that a function of VGR2852 gene, herein designated VGR GENE, is inhibition of expression of host target genes, as part of a novel viral mechanism of attacking a host. Accordingly, utilities of VGR2852 gene include diagnosis, prevention and treatment of viral infection by Transmissible Gastroenteritis Virus. Specific functions, and accordingly utilities, of VGR2852 gene correlate with, and may be deduced from, the identity of the host target genes, which are inhibited by VGAM RNAs comprised in the 'operon-like' cluster of VGR2852 gene: VGAM597 host target protein, VGAM598 host target protein, VGAM599 host target protein, VGAM600 host target protein, VGAM601 host target protein, VGAM602 host target protein, VGAM603 host target protein and VGAM604 host target protein, herein schematically represented by VGAM1 HOST TARGET PROTEIN through VGAM3 HOST TARGET PROTEIN. The function of these host target genes is elaborated hereinabove with reference to VGAM597, VGAM598, VGAM599, VGAM600, VGAM601, VGAM602, VGAM603 and VGAM604. FIG. 9 further provides a conceptual description of novel bioinformatically detected regulatory viral gene, referred to here as Viral Genomic Record 2853(VGR2853) viral gene, which encodes an 'operon-like' cluster of novel viral micro RNA-like genes, each of which in turn modulates expression of at least one host target gene, the function and utility of which at least one host target gene is known in the art.

VGR2853 gene, herein designated VGR GENE, is a novel bioinformatically detected regulatory, non protein coding, RNA viral gene. The method by which VGR2853 gene was detected is described hereinabove with reference to FIGS. 1-9.

VGR2853 gene encodes VGR2853 precursor RNA, herein designated VGR PRECURSOR RNA, an RNA molecule, typically several hundred nucleotides long.

VGR2853 precursor RNA folds spatially, forming VGR2853 folded precursor RNA, herein designated VGR FOLDED PRECURSOR RNA. It is appreciated that VGR2853 folded precursor RNA comprises a plurality of what is known in the art as 'hairpin' structures. These 'hairpin' structures are due to the fact that the nucleotide sequence of VGR2853 precursor RNA comprises a plurality of segments, the first half of each such segment having a nucleotide sequence which is at least a partial inversed-reversed sequence of the second half thereof, as is well known in the art.

VGR2853 folded precursor RNA is naturally processed by cellular enzymatic activity into at least 2 separate VGAM precursor RNAs, VGAM605 precursor RNA and VGAM606 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM605 RNA and VGAM606 RNA, herein schematically represented by VGAM1 RNA through VGAM3 RNA, each of which VGAM RNAs corresponding to VGAM RNA of FIG. 1.

VGAM605 RNA, herein schematically represented by VGAM1 RNA through VGAM3 RNA, binds complementarily to a host target binding site located in an untranslated region of VGAM605 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM605 host target RNA into VGAM605 host target protein, herein schematically represented by VGAM1 HOST TARGET PROTEIN through VGAM3 HOST TARGET PROTEIN, all of FIG. 1.

VGAM606 RNA, herein schematically represented by VGAM1 RNA through VGAM3 RNA, binds complementarily to a host target binding site located in an untranslated region of VGAM606 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM606 host target RNA into VGAM606 host target protein, herein schematically represented by VGAM1 HOST TARGET PROTEIN through VGAM3 HOST TARGET PROTEIN, all of FIG. 1.

It is appreciated that a function of VGR2853 gene, herein designated VGR GENE, is inhibition of expression of host target genes, as part of a novel viral mechanism of attacking a host. Accordingly, utilities of VGR2853 gene include diagnosis, prevention and treatment of viral infection by Transmissible Gastroenteritis Virus. Specific functions, and accordingly utilities, of VGR2853 gene correlate with, and may be deduced from, the identity of the host target genes, which are inhibited by VGAM RNAs comprised in the 'operon-like' cluster of VGR2853 gene: VGAM605 host target protein and VGAM606 host target protein, herein schematically represented by VGAM1 HOST TARGET PROTEIN through VGAM3 HOST TARGET PROTEIN. The function of these host target genes is elaborated hereinabove with reference to VGAM605 and VGAM606. FIG. 9 further provides a conceptual description of novel bioinformatically detected regulatory viral gene, referred to here as Viral Genomic Record 2854(VGR2854) viral gene, which encodes an 'operon-like' cluster of novel viral micro RNA-like genes, each of which in turn modulates expression of at least one host target gene, the function and utility of which at least one host target gene is known in the art.

VGR2854 gene, herein designated VGR GENE, is a novel bioinformatically detected regulatory, non protein coding, RNA viral gene. The method by which VGR2854 gene was detected is described hereinabove with reference to FIGS. 1-9.

VGR2854 gene encodes VGR2854 precursor RNA, herein designated VGR PRECURSOR RNA, an RNA molecule, typically several hundred nucleotides long.

VGR2854 precursor RNA folds spatially, forming VGR2854 folded precursor RNA, herein designated VGR FOLDED PRECURSOR RNA. It is appreciated that VGR2854 folded precursor RNA comprises a plurality of what is known in the art as 'hairpin' structures. These 'hairpin' structures are due to the fact that the nucleotide sequence of VGR2854 precursor RNA comprises a plurality of segments, the first half of each such segment having a nucleotide sequence which is at least a partial inversed-reversed sequence of the second half thereof, as is well known in the art.

VGR2854 folded precursor RNA is naturally processed by cellular enzymatic activity into at least 4 separate VGAM precursor RNAs, VGAM607 precursor RNA, VGAM608 precursor RNA, VGAM609 precursor RNA and VGAM610 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM607 RNA, VGAM608 RNA, VGAM609 RNA and VGAM610 RNA, herein schematically represented by VGAM1 RNA through VGAM3 RNA, each of which VGAM RNAs corresponding to VGAM RNA of FIG. 1.

VGAM607 RNA, herein schematically represented by VGAM1 RNA through VGAM3 RNA, binds complementarily to a host target binding site located in an untranslated region of VGAM607 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM607 host target RNA into VGAM607 host target protein, herein schematically represented by VGAM1 HOST TARGET PROTEIN through VGAM3 HOST TARGET PROTEIN, all of FIG. 1.

VGAM608 RNA, herein schematically represented by VGAM1 RNA through VGAM3 RNA, binds complementarily to a host target binding site located in an untranslated region of VGAM608 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM608 host target RNA into VGAM608 host target protein, herein schematically represented by VGAM1 HOST TARGET PROTEIN through VGAM3 HOST TARGET PROTEIN, all of FIG. 1.

VGAM609 RNA, herein schematically represented by VGAM1 RNA through VGAM3 RNA, binds complementarily to a host target binding site located in an untranslated region of VGAM609 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM609 host target RNA into VGAM609 host target protein, herein schematically represented by VGAM1 HOST TARGET PROTEIN through VGAM3 HOST TARGET PROTEIN, all of FIG. 1.

VGAM610 RNA, herein schematically represented by VGAM1 RNA through VGAM3 RNA, binds complementarily to a host target binding site located in an untranslated region of VGAM610 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM610 host target RNA into VGAM610 host target protein, herein schematically represented by VGAM1 HOST TARGET PROTEIN through VGAM3 HOST TARGET PROTEIN, all of FIG. 1.

It is appreciated that a function of VGR2854 gene, herein designated VGR GENE, is inhibition of expression of host target genes, as part of a novel viral mechanism of attacking a host. Accordingly, utilities of VGR2854 gene include diagnosis, prevention and treatment of viral infection by Rice Grassy Stunt Virus. Specific functions, and accordingly utilities, of VGR2854 gene correlate with, and may be deduced from, the identity of the host target genes, which are inhibited by VGAM RNAs comprised in the 'operon-like' cluster of VGR2854 gene: VGAM607 host target protein, VGAM608 host target protein, VGAM609 host target protein and VGAM610 host target protein, herein schematically represented by VGAM1 HOST TARGET PROTEIN through VGAM3 HOST TARGET PROTEIN. The function of these host target genes is elaborated hereinabove with reference to VGAM607, VGAM608, VGAM609 and VGAM610. FIG. 9 further provides a conceptual description of novel bioinformatically detected regulatory viral gene, referred to here as Viral Genomic Record 2855(VGR2855) viral gene, which encodes an 'operon-like' cluster of novel viral micro RNA-like genes, each of which in turn modulates expression of at least one host target gene, the function and utility of which at least one host target gene is known in the art.

VGR2855 gene, herein designated VGR GENE, is a novel bioinformatically detected regulatory, non protein coding, RNA viral gene. The method by which VGR2855 gene was detected is described hereinabove with reference to FIGS. 1-9.

VGR2855 gene encodes VGR2855 precursor RNA, herein designated VGR PRECURSOR RNA, an RNA molecule, typically several hundred nucleotides long.

VGR2855 precursor RNA folds spatially, forming VGR2855 folded precursor RNA, herein designated VGR FOLDED PRECURSOR RNA. It is appreciated that VGR2855 folded precursor RNA comprises a plurality of what is known in the art as 'hairpin' structures. These 'hairpin' structures are due to the fact that the nucleotide sequence of VGR2855 precursor RNA comprises a plurality of segments, the first half of each such segment having a nucleotide sequence which is at least a partial inversed-reversed sequence of the second half thereof, as is well known in the art.

VGR2855 folded precursor RNA is naturally processed by cellular enzymatic activity into at least 2 separate VGAM precursor RNAs, VGAM613 precursor RNA and VGAM614 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM613 RNA and VGAM614 RNA, herein schematically represented by VGAM1 RNA through VGAM3 RNA, each of which VGAM RNAs corresponding to VGAM RNA of FIG. 1.

VGAM613 RNA, herein schematically represented by VGAM1 RNA through VGAM3 RNA, binds complementarily to a host target binding site located in an untranslated region of VGAM613 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM613 host target RNA into VGAM613 host target protein, herein schematically represented by VGAM1 HOST TARGET PROTEIN through VGAM3 HOST TARGET PROTEIN, all of FIG. 1.

VGAM614 RNA, herein schematically represented by VGAM1 RNA through VGAM3 RNA, binds complementarily to a host target binding site located in an untranslated region of VGAM614 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM614 host target RNA into VGAM614 host target protein, herein schematically represented by VGAM1 HOST TARGET PROTEIN through VGAM3 HOST TARGET PROTEIN, all of FIG. 1.

It is appreciated that a function of VGR2855 gene, herein designated VGR GENE, is inhibition of expression of host target genes, as part of a novel viral mechanism of attacking a host. Accordingly, utilities of VGR2855 gene include diagnosis, prevention and treatment of viral infection by Xestia C-nigrum Granulovirus. Specific functions, and accordingly utilities, of VGR2855 gene correlate with, and may be deduced from, the identity of the host target genes, which are inhibited by VGAM RNAs comprised in the 'operon-like' cluster of VGR2855 gene: VGAM613 host target protein and VGAM614 host target protein, herein schematically represented by VGAM1 HOST TARGET PROTEIN through VGAM3 HOST TARGET PROTEIN. The function of these host target genes is elaborated hereinabove with reference to VGAM613 and VGAM614. FIG. 9 further provides a conceptual description of novel bioinformatically detected regulatory viral gene, referred to here as Viral Genomic Record 2856(VGR2856) viral gene, which encodes an 'operon-like' cluster of novel viral micro RNA-like genes, each of which in turn modulates expression of at least one host target gene, the function and utility of which at least one host target gene is known in the art.

VGR2856 gene, herein designated VGR GENE, is a novel bioinformatically detected regulatory, non protein coding, RNA viral gene. The method by which VGR2856 gene was detected is described hereinabove with reference to FIGS. 1-9.

VGR2856 gene encodes VGR2856 precursor RNA, herein designated VGR PRECURSOR RNA, an RNA molecule, typically several hundred nucleotides long.

VGR2856 precursor RNA folds spatially, forming VGR2856 folded precursor RNA, herein designated VGR FOLDED PRECURSOR RNA. It is appreciated that VGR2856 folded precursor RNA comprises a plurality of what is known in the art as 'hairpin' structures. These 'hairpin' structures are due to the fact that the nucleotide sequence of VGR2856 precursor RNA comprises a plurality of segments, the first half of each such segment having a nucleotide sequence which is at least a partial inversed-reversed sequence of the second half thereof, as is well known in the art.

VGR2856 folded precursor RNA is naturally processed by cellular enzymatic activity into at least 2 separate VGAM precursor RNAs, VGAM615 precursor RNA and VGAM616 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM615 RNA and VGAM616 RNA, herein schematically represented by VGAM1 RNA through VGAM3 RNA, each of which VGAM RNAs corresponding to VGAM RNA of FIG. 1.

VGAM615 RNA, herein schematically represented by VGAM1 RNA through VGAM3 RNA, binds complementarily to a host target binding site located in an untranslated region of VGAM615 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM615 host target RNA into VGAM615 host target protein, herein schematically represented by VGAM1 HOST TARGET PROTEIN through VGAM3 HOST TARGET PROTEIN, all of FIG. 1.

VGAM616 RNA, herein schematically represented by VGAM1 RNA through VGAM3 RNA, binds complementarily to a host target binding site located in an untranslated region of VGAM616 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM616 host target RNA into VGAM616 host target protein, herein schematically represented by VGAM1 HOST TARGET PROTEIN through VGAM3 HOST TARGET PROTEIN, all of FIG. 1.

It is appreciated that a function of VGR2856 gene, herein designated VGR GENE, is inhibition of expression of host target genes, as part of a novel viral mechanism of attacking a host. Accordingly, utilities of VGR2856 gene include diagnosis, prevention and treatment of viral infection by Xestia C-nigrum Granulovirus. Specific functions, and accordingly utilities, of VGR2856 gene correlate with, and may be deduced from, the identity of the host target genes, which are inhibited by VGAM RNAs comprised in the 'operon-like' cluster of VGR2856 gene: VGAM615 host target protein and VGAM616 host target protein, herein schematically represented by VGAM1 HOST TARGET PROTEIN through VGAM3 HOST TARGET PROTEIN. The function of these host target genes is elaborated hereinabove with reference to VGAM615 and VGAM616. FIG. 9 further provides a conceptual description of novel bioinformatically detected regulatory viral gene, referred to here as Viral Genomic Record 2857(VGR2857) viral gene, which encodes an 'operon-like' cluster of novel viral micro RNA-like genes, each of which in turn modulates expression of at least one host target gene, the function and utility of which at least one host target gene is known in the art.

VGR2857 gene, herein designated VGR GENE, is a novel bioinformatically detected regulatory, non protein coding, RNA viral gene. The method by which VGR2857 gene was detected is described hereinabove with reference to FIGS. 1-9.

VGR2857 gene encodes VGR2857 precursor RNA, herein designated VGR PRECURSOR RNA, an RNA molecule, typically several hundred nucleotides long.

VGR2857 precursor RNA folds spatially, forming VGR2857 folded precursor RNA, herein designated VGR FOLDED PRECURSOR RNA. It is appreciated that VGR2857 folded precursor RNA comprises a plurality of what is known in the art as 'hairpin' structures. These 'hairpin' structures are due to the fact that the nucleotide sequence of VGR2857 precursor RNA comprises a plurality of segments, the first half of each such segment having a nucleotide sequence which is at least a partial inversed-reversed sequence of the second half thereof, as is well known in the art.

VGR2857 folded precursor RNA is naturally processed by cellular enzymatic activity into at least 8 separate VGAM precursor RNAs, VGAM619 precursor RNA, VGAM620 precursor RNA, VGAM621 precursor RNA, VGAM622 precursor RNA, VGAM623 precursor RNA, VGAM624 precursor RNA, VGAM625 precursor RNA and VGAM626 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM619 RNA, VGAM620 RNA, VGAM621 RNA, VGAM622 RNA, VGAM623 RNA, VGAM624 RNA, VGAM625 RNA and VGAM626 RNA, herein schematically represented by VGAM1 RNA through VGAM3 RNA, each of which VGAM RNAs corresponding to VGAM RNA of FIG. 1.

VGAM619 RNA, herein schematically represented by VGAM1 RNA through VGAM3 RNA, binds complementarily to a host target binding site located in an untranslated region of VGAM619 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM619 host target RNA into VGAM619 host target protein, herein schematically represented by VGAM1 HOST TARGET PROTEIN through VGAM3 HOST TARGET PROTEIN, all of FIG. 1.

VGAM620 RNA, herein schematically represented by VGAM1 RNA through VGAM3 RNA, binds complementarily to a host target binding site located in an untranslated region of VGAM620 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM620 host target RNA into VGAM620 host target protein, herein schematically represented by VGAM1 HOST TARGET PROTEIN through VGAM3 HOST TARGET PROTEIN, all of FIG. 1.

VGAM621 RNA, herein schematically represented by VGAM1 RNA through VGAM3 RNA, binds complementarily to a host target binding site located in an untranslated region of VGAM621 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM621 host target RNA into VGAM621 host target protein, herein schematically represented by VGAM1 HOST TARGET PROTEIN through VGAM3 HOST TARGET PROTEIN, all of FIG. 1.

VGAM622 RNA, herein schematically represented by VGAM1 RNA through VGAM3 RNA, binds complementarily to a host target binding site located in an untranslated region of VGAM622 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM622 host target RNA into VGAM622 host target protein, herein schematically represented by VGAM1 HOST TARGET PROTEIN through VGAM3 HOST TARGET PROTEIN, all of FIG. 1.

VGAM623 RNA, herein schematically represented by VGAM1 RNA through VGAM3 RNA, binds complementarily to a host target binding site located in an untranslated region of VGAM623 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM623 host target RNA into VGAM623 host target protein, herein schematically represented by VGAM1 HOST TARGET PROTEIN through VGAM3 HOST TARGET PROTEIN, all of FIG. 1.

VGAM624 RNA, herein schematically represented by VGAM1 RNA through VGAM3 RNA, binds complementarily to a host target binding site located in an untranslated region of VGAM624 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM624 host target RNA into VGAM624 host target protein, herein schematically represented by VGAM1 HOST TARGET PROTEIN through VGAM3 HOST TARGET PROTEIN, all of FIG. 1.

VGAM625 RNA, herein schematically represented by VGAM1 RNA through VGAM3 RNA, binds complementarily to a host target binding site located in an untranslated region of VGAM625 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM625 host target RNA into VGAM625 host target protein, herein schematically represented by VGAM1 HOST TARGET PROTEIN through VGAM3 HOST TARGET PROTEIN, all of FIG. 1.

VGAM626 RNA, herein schematically represented by VGAM1 RNA through VGAM3 RNA, binds complementarily to a host target binding site located in an untranslated region of VGAM626 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM626 host target RNA into VGAM626 host target protein, herein schematically represented by VGAM1 HOST TARGET PROTEIN through VGAM3 HOST TARGET PROTEIN, all of FIG. 1.

It is appreciated that a function of VGR2857 gene, herein designated VGR GENE, is inhibition of expression of host target genes, as part of a novel viral mechanism of attacking a host. Accordingly, utilities of VGR2857 gene include diagnosis, prevention and treatment of viral infection by Hepatitis GB Virus C. Specific functions, and accordingly utilities, of VGR2857 gene correlate with, and may be deduced from, the identity of the host target genes, which are inhibited by VGAM RNAs comprised in the 'operon-like' cluster of VGR2857 gene: VGAM619 host target protein, VGAM620 host target protein, VGAM621 host target protein, VGAM622 host target protein, VGAM623 host target protein, VGAM624 host target protein, VGAM625 host target protein and VGAM626 host target protein, herein schematically represented by VGAM1 HOST TARGET PROTEIN through VGAM3 HOST TARGET PROTEIN. The function of these host target genes is elaborated hereinabove with reference to VGAM619, VGAM620, VGAM621, VGAM622, VGAM623, VGAM624, VGAM625 and VGAM626. FIG. 9 further provides a conceptual description of novel bioinformatically detected regulatory viral gene, referred to here as Viral Genomic Record 2858(VGR2858) viral gene, which encodes an 'operon-like' cluster of novel viral micro RNA-like genes, each of which in turn modulates expression of at least one host target gene, the function and utility of which at least one host target gene is known in the art.

VGR2858 gene, herein designated VGR GENE, is a novel bioinformatically detected regulatory, non protein coding, RNA viral gene. The method by which VGR2858 gene was detected is described hereinabove with reference to FIGS. 1-9.

VGR2858 gene encodes VGR2858 precursor RNA, herein designated VGR PRECURSOR RNA, an RNA molecule, typically several hundred nucleotides long.

VGR2858 precursor RNA folds spatially, forming VGR2858 folded precursor RNA, herein designated VGR FOLDED PRECURSOR RNA. It is appreciated that VGR2858 folded precursor RNA comprises a plurality of what is known in the art as 'hairpin' structures. These 'hairpin' structures are due to the fact that the nucleotide sequence of VGR2858 precursor RNA comprises a plurality of segments, the first half of each such segment having a nucleotide sequence which is at least a partial inversed-reversed sequence of the second half thereof, as is well known in the art.

VGR2858 folded precursor RNA is naturally processed by cellular enzymatic activity into at least 4 separate VGAM precursor RNAs, VGAM627 precursor RNA, VGAM628 precursor RNA, VGAM629 precursor RNA and VGAM630 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM627 RNA, VGAM628 RNA, VGAM629 RNA and VGAM630 RNA, herein schematically represented by VGAM1 RNA through VGAM3 RNA, each of which VGAM RNAs corresponding to VGAM RNA of FIG. 1.

VGAM627 RNA, herein schematically represented by VGAM1 RNA through VGAM3 RNA, binds complementarily to a host target binding site located in an untranslated region of VGAM627 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM627 host target RNA into VGAM627 host target protein, herein schematically represented by VGAM1 HOST TARGET PROTEIN through VGAM3 HOST TARGET PROTEIN, all of FIG. 1.

VGAM628 RNA, herein schematically represented by VGAM1 RNA through VGAM3 RNA, binds complementarily to a host target binding site located in an untranslated region of VGAM628 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM628 host target RNA into VGAM628 host target protein, herein schematically represented by VGAM1 HOST TARGET PROTEIN through VGAM3 HOST TARGET PROTEIN, all of FIG. 1.

VGAM629 RNA, herein schematically represented by VGAM1 RNA through VGAM3 RNA, binds complementarily to a host target binding site located in an untranslated region of VGAM629 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM629 host target RNA into VGAM629 host target protein, herein schematically represented by VGAM1 HOST TARGET PROTEIN through VGAM3 HOST TARGET PROTEIN, all of FIG. 1.

VGAM630 RNA, herein schematically represented by VGAM1 RNA through VGAM3 RNA, binds complementarily to a host target binding site located in an untranslated region of VGAM630 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM630 host target RNA into VGAM630 host target protein, herein schematically represented by VGAM1 HOST TARGET PROTEIN through VGAM3 HOST TARGET PROTEIN, all of FIG. 1.

It is appreciated that a function of VGR2858 gene, herein designated VGR GENE, is inhibition of expression of host target genes, as part of a novel viral mechanism of attacking a host. Accordingly, utilities of VGR2858 gene include diagnosis, prevention and treatment of viral infection by Hepatitis GB Virus C. Specific functions, and accordingly utilities, of VGR2858 gene correlate with, and may be deduced from, the identity of the host target genes, which are inhibited by VGAM RNAs comprised in the 'operon-like' cluster of VGR2858 gene: VGAM627 host target protein, VGAM628 host target protein, VGAM629 host target protein and VGAM630 host target protein, herein schematically represented by VGAM1 HOST TARGET PROTEIN through VGAM3 HOST TARGET PROTEIN. The function of these host target genes is elaborated hereinabove with reference to VGAM627, VGAM628, VGAM629 and VGAM630. FIG. 9 further provides a conceptual description of novel bioinformatically detected regulatory viral gene, referred to here as Viral Genomic Record 2859(VGR2859) viral gene, which encodes an 'operon-like' cluster of novel viral micro RNA-like genes, each of which in turn modulates expression of at least one host target gene, the function and utility of which at least one host target gene is known in the art.

VGR2859 gene, herein designated VGR GENE, is a novel bioinformatically detected regulatory, non protein coding, RNA viral gene. The method by which VGR2859 gene was detected is described hereinabove with reference to FIGS. 1-9.

VGR2859 gene encodes VGR2859 precursor RNA, herein designated VGR PRECURSOR RNA, an RNA molecule, typically several hundred nucleotides long.

VGR2859 precursor RNA folds spatially, forming VGR2859 folded precursor RNA, herein designated VGR FOLDED PRECURSOR RNA. It is appreciated that VGR2859 folded precursor RNA comprises a plurality of what is known in the art as 'hairpin' structures. These 'hairpin' structures are due to the fact that the nucleotide sequence of VGR2859 precursor RNA comprises a plurality of segments, the first half of each such segment having a nucleotide sequence which is at least a partial inversed-reversed sequence of the second half thereof, as is well known in the art.

VGR2859 folded precursor RNA is naturally processed by cellular enzymatic activity into at least 2 separate VGAM precursor RNAs, VGAM631 precursor RNA and VGAM632 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM631 RNA and VGAM632 RNA, herein schematically represented by VGAM1 RNA through VGAM3 RNA, each of which VGAM RNAs corresponding to VGAM RNA of FIG. 1.

VGAM631 RNA, herein schematically represented by VGAM1 RNA through VGAM3 RNA, binds complementarily to a host target binding site located in an untranslated region of VGAM631 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM631 host target RNA into VGAM631 host target protein, herein schematically represented by VGAM1 HOST TARGET PROTEIN through VGAM3 HOST TARGET PROTEIN, all of FIG. 1.

VGAM632 RNA, herein schematically represented by VGAM1 RNA through VGAM3 RNA, binds complementarily to a host target binding site located in an untranslated region of VGAM632 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM632 host target RNA into VGAM632 host target protein, herein schematically represented by VGAM1 HOST TARGET PROTEIN through VGAM3 HOST TARGET PROTEIN, all of FIG. 1.

It is appreciated that a function of VGR2859 gene, herein designated VGR GENE, is inhibition of expression of host target genes, as part of a novel viral mechanism of attacking a host. Accordingly, utilities of VGR2859 gene include diagnosis, prevention and treatment of viral infection by Ovine Astrovirus. Specific functions, and accordingly utilities, of VGR2859 gene correlate with, and may be deduced from, the identity of the host target genes, which are inhibited by VGAM RNAs comprised in the 'operon-like' cluster of VGR2859 gene: VGAM631 host target protein and VGAM632 host target protein, herein schematically represented by VGAM1 HOST TARGET PROTEIN through VGAM3 HOST TARGET PROTEIN. The function of these host target genes is elaborated hereinabove with reference to VGAM631 and VGAM632. FIG. 9 further provides a conceptual description of novel bioinformatically detected regulatory viral gene, referred to here as Viral Genomic Record 2860(VGR2860) viral gene, which encodes an 'operon-like' cluster of novel viral micro RNA-like genes, each of which in turn modulates expression of at least one host target gene, the function and utility of which at least one host target gene is known in the art.

VGR2860 gene, herein designated VGR GENE, is a novel bioinformatically detected regulatory, non protein coding, RNA viral gene. The method by which VGR2860 gene was detected is described hereinabove with reference to FIGS. 1-9.

VGR2860 gene encodes VGR2860 precursor RNA, herein designated VGR PRECURSOR RNA, an RNA molecule, typically several hundred nucleotides long.

VGR2860 precursor RNA folds spatially, forming VGR2860 folded precursor RNA, herein designated VGR FOLDED PRECURSOR RNA. It is appreciated that VGR2860 folded precursor RNA comprises a plurality of what is known in the art as 'hairpin' structures. These 'hairpin' structures are due to the fact that the nucleotide sequence of VGR2860 precursor RNA comprises a plurality of segments, the first half of each such segment having a nucleotide sequence which is at least a partial inversed-reversed sequence of the second half thereof, as is well known in the art.

VGR2860 folded precursor RNA is naturally processed by cellular enzymatic activity into at least 2 separate VGAM precursor RNAs, VGAM633 precursor RNA and VGAM634 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM633 RNA and VGAM634 RNA, herein schematically represented by VGAM1 RNA through VGAM3 RNA, each of which VGAM RNAs corresponding to VGAM RNA of FIG. 1.

VGAM633 RNA, herein schematically represented by VGAM1 RNA through VGAM3 RNA, binds complementarily to a host target binding site located in an untranslated region of VGAM633 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM633 host target RNA into VGAM633 host target protein, herein schematically represented by VGAM1 HOST TARGET PROTEIN through VGAM3 HOST TARGET PROTEIN, all of FIG. 1.

VGAM634 RNA, herein schematically represented by VGAM1 RNA through VGAM3 RNA, binds complementarily to a host target binding site located in an untranslated region of VGAM634 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM634 host target RNA into VGAM634 host target protein, herein schematically represented by VGAM1 HOST TARGET PROTEIN through VGAM3 HOST TARGET PROTEIN, all of FIG. 1.

It is appreciated that a function of VGR2860 gene, herein designated VGR GENE, is inhibition of expression of host target genes, as part of a novel viral mechanism of attacking a host. Accordingly, utilities of VGR2860 gene include diagnosis, prevention and treatment of viral infection by Turkey Astrovirus. Specific functions, and accordingly utilities, of VGR2860 gene correlate with, and may be deduced from, the identity of the host target genes, which are inhibited by VGAM RNAs comprised in the 'operon-like' cluster of VGR2860 gene: VGAM633 host target protein and VGAM634 host target protein, herein schematically represented by VGAM1 HOST TARGET PROTEIN through VGAM3 HOST TARGET PROTEIN. The function of these host target genes is elaborated hereinabove with reference to VGAM633 and VGAM634. FIG. 9 further provides a conceptual description of novel bioinformatically detected regulatory viral gene, referred to here as Viral Genomic Record 2861(VGR2861) viral gene, which encodes an 'operon-like' cluster of novel viral micro RNA-like genes, each of which in turn modulates expression of at least one host target gene, the function and utility of which at least one host target gene is known in the art.

VGR2861 gene, herein designated VGR GENE, is a novel bioinformatically detected regulatory, non protein coding, RNA viral gene. The method by which VGR2861 gene was detected is described hereinabove with reference to FIGS. 1-9.

VGR2861 gene encodes VGR2861 precursor RNA, herein designated VGR PRECURSOR RNA, an RNA molecule, typically several hundred nucleotides long.

VGR2861 precursor RNA folds spatially, forming VGR2861 folded precursor RNA, herein designated VGR FOLDED PRECURSOR RNA. It is appreciated that VGR2861 folded precursor RNA comprises a plurality of what is known in the art as 'hairpin' structures. These 'hairpin' structures are due to the fact that the nucleotide sequence of VGR2861 precursor RNA comprises a plurality of segments, the first half of each such segment having a nucleotide sequence which is at least a partial inversed-reversed sequence of the second half thereof, as is well known in the art.

VGR2861 folded precursor RNA is naturally processed by cellular enzymatic activity into at least 2 separate VGAM precursor RNAs, VGAM635 precursor RNA and VGAM636 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM635 RNA and VGAM636 RNA, herein schematically represented by VGAM1 RNA through VGAM3 RNA, each of which VGAM RNAs corresponding to VGAM RNA of FIG. 1.

VGAM635 RNA, herein schematically represented by VGAM1 RNA through VGAM3 RNA, binds complementarily to a host target binding site located in an untranslated region of VGAM635 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM635 host target RNA into VGAM635 host target protein, herein schematically represented by VGAM1 HOST TARGET PROTEIN through VGAM3 HOST TARGET PROTEIN, all of FIG. 1.

VGAM636 RNA, herein schematically represented by VGAM1 RNA through VGAM3 RNA, binds complementarily to a host target binding site located in an untranslated region of VGAM636 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM636 host target RNA into VGAM636 host target protein, herein schematically represented by VGAM1 HOST TARGET PROTEIN through VGAM3 HOST TARGET PROTEIN, all of FIG. 1.

It is appreciated that a function of VGR2861 gene, herein designated VGR GENE, is inhibition of expression of host target genes, as part of a novel viral mechanism of attacking a host. Accordingly, utilities of VGR2861 gene include diagnosis, prevention and treatment of viral infection by Cherry Mottle Leaf Virus. Specific functions, and accordingly utilities, of VGR2861 gene correlate with, and may be deduced from, the identity of the host target genes, which are inhibited by VGAM RNAs comprised in the 'operon-like' cluster of VGR2861 gene: VGAM635 host target protein and VGAM636 host target protein, herein schematically represented by VGAM1 HOST TARGET PROTEIN through VGAM3 HOST TARGET PROTEIN. The function of these host target genes is elaborated hereinabove with reference to VGAM635 and VGAM636. FIG. 9 further provides a conceptual description of novel bioinformatically detected regulatory viral gene, referred to here as Viral Genomic Record 2862(VGR2862) viral gene, which encodes an 'operon-like' cluster of novel viral micro RNA-like genes, each of which in turn modulates expression of at least one host target gene, the function and utility of which at least one host target gene is known in the art.

VGR2862 gene, herein designated VGR GENE, is a novel bioinformatically detected regulatory, non protein coding, RNA viral gene. The method by which VGR2862 gene was detected is described hereinabove with reference to FIGS. 1-9.

VGR2862 gene encodes VGR2862 precursor RNA, herein designated VGR PRECURSOR RNA, an RNA molecule, typically several hundred nucleotides long.

VGR2862 precursor RNA folds spatially, forming VGR2862 folded precursor RNA, herein designated VGR FOLDED PRECURSOR RNA. It is appreciated that VGR2862 folded precursor RNA comprises a plurality of what is known in the art as 'hairpin' structures. These 'hairpin' structures are due to the fact that the nucleotide sequence of VGR2862 precursor RNA comprises a plurality of segments, the first half of each such segment having a nucleotide sequence which is at least a partial inversed-reversed sequence of the second half thereof, as is well known in the art.

VGR2862 folded precursor RNA is naturally processed by cellular enzymatic activity into at least 3 separate VGAM precursor RNAs, VGAM638 precursor RNA, VGAM639 precursor RNA and VGAM640 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM638 RNA, VGAM639 RNA and VGAM640 RNA, herein schematically represented by VGAM1 RNA through VGAM3 RNA, each of which VGAM RNAs corresponding to VGAM RNA of FIG. 1.

VGAM638 RNA, herein schematically represented by VGAM1 RNA through VGAM3 RNA, binds complementarily to a host target binding site located in an untranslated region of VGAM638 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM638 host target RNA into VGAM638 host target protein, herein schematically represented by VGAM1 HOST TARGET PROTEIN through VGAM3 HOST TARGET PROTEIN, all of FIG. 1.

VGAM639 RNA, herein schematically represented by VGAM1 RNA through VGAM3 RNA, binds complementarily to a host target binding site located in an untranslated region of VGAM639 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM639 host target RNA into VGAM639 host target protein, herein schematically represented by VGAM1 HOST TARGET PROTEIN through VGAM3 HOST TARGET PROTEIN, all of FIG. 1.

VGAM640 RNA, herein schematically represented by VGAM1 RNA through VGAM3 RNA, binds complementarily to a host target binding site located in an untranslated region of VGAM640 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM640 host target RNA into VGAM640 host target protein, herein schematically represented by VGAM1 HOST TARGET PROTEIN through VGAM3 HOST TARGET PROTEIN, all of FIG. 1.

It is appreciated that a function of VGR2862 gene, herein designated VGR GENE, is inhibition of expression of host target genes, as part of a novel viral mechanism of attacking a host. Accordingly, utilities of VGR2862 gene include diagnosis, prevention and treatment of viral infection by Turnip Mosaic Virus. Specific functions, and accordingly utilities, of VGR2862 gene correlate with, and may be deduced from, the identity of the host target genes, which are inhibited by VGAM RNAs comprised in the 'operon-like' cluster of VGR2862 gene: VGAM638 host target protein, VGAM639 host target protein and VGAM640 host target protein, herein schematically represented by VGAM1 HOST TARGET PROTEIN through VGAM3 HOST TARGET PROTEIN. The function of these host target genes is elaborated hereinabove with reference to VGAM638, VGAM639 and VGAM640. FIG. 9 further provides a conceptual description of novel bioinformatically detected regulatory viral gene, referred to here as Viral Genomic Record 2863(VGR2863) viral gene, which encodes an 'operon-like' cluster of novel viral micro RNA-like genes, each of which in turn modulates expression of at least one host target gene, the function and utility of which at least one host target gene is known in the art.

VGR2863 gene, herein designated VGR GENE, is a novel bioinformatically detected regulatory, non protein coding, RNA viral gene. The method by which VGR2863 gene was detected is described hereinabove with reference to FIGS. 1-9.

VGR2863 gene encodes VGR2863 precursor RNA, herein designated VGR PRECURSOR RNA, an RNA molecule, typically several hundred nucleotides long.

VGR2863 precursor RNA folds spatially, forming VGR2863 folded precursor RNA, herein designated VGR FOLDED PRECURSOR RNA. It is appreciated that VGR2863 folded precursor RNA comprises a plurality of what is known in the art as 'hairpin' structures. These 'hairpin' structures are due to the fact that the nucleotide sequence of VGR2863 precursor RNA comprises a plurality of segments, the first half of each such segment having a nucleotide sequence which is at least a partial inversed-reversed sequence of the second half thereof, as is well known in the art.

VGR2863 folded precursor RNA is naturally processed by cellular enzymatic activity into at least 2 separate VGAM precursor RNAs, VGAM644 precursor RNA and VGAM645 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM644 RNA and VGAM645 RNA, herein schematically represented by VGAM1 RNA through VGAM3 RNA, each of which VGAM RNAs corresponding to VGAM RNA of FIG. 1.

VGAM644 RNA, herein schematically represented by VGAM1 RNA through VGAM3 RNA, binds complementarily to a host target binding site located in an untranslated region of VGAM644 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM644 host target RNA into VGAM644 host target protein, herein schematically represented by VGAM1 HOST TARGET PROTEIN through VGAM3 HOST TARGET PROTEIN, all of FIG. 1.

VGAM645 RNA, herein schematically represented by VGAM1 RNA through VGAM3 RNA, binds complementarily to a host target binding site located in an untranslated region of VGAM645 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM645 host target RNA into VGAM645 host target protein, herein schematically represented by VGAM1 HOST TARGET PROTEIN through VGAM3 HOST TARGET PROTEIN, all of FIG. 1.

It is appreciated that a function of VGR2863 gene, herein designated VGR GENE, is inhibition of expression of host target genes, as part of a novel viral mechanism of attacking a host. Accordingly, utilities of VGR2863 gene include diagnosis, prevention and treatment of viral infection by Parvovirus H1. Specific functions, and accordingly utilities, of VGR2863 gene correlate with, and may be deduced from, the identity of the host target genes, which are inhibited by VGAM RNAs comprised in the 'operon-like' cluster of VGR2863 gene: VGAM644 host target protein and VGAM645 host target protein, herein schematically represented by VGAM1 HOST TARGET PROTEIN through VGAM3 HOST TARGET PROTEIN. The function of these host target genes is elaborated hereinabove with reference to VGAM644 and VGAM645. FIG. 9 further provides a conceptual description of novel bioinformatically detected regulatory viral gene, referred to here as Viral Genomic Record 2864(VGR2864) viral gene, which encodes an 'operon-like' cluster of novel viral micro RNA-like genes, each of which in turn modulates expression of at least one host target gene, the function and utility of which at least one host target gene is known in the art.

VGR2864 gene, herein designated VGR GENE, is a novel bioinformatically detected regulatory, non protein coding, RNA viral gene. The method by which VGR2864 gene was detected is described hereinabove with reference to FIGS. 1-9.

VGR2864 gene encodes VGR2864 precursor RNA, herein designated VGR PRECURSOR RNA, an RNA molecule, typically several hundred nucleotides long.

VGR2864 precursor RNA folds spatially, forming VGR2864 folded precursor RNA, herein designated VGR FOLDED PRECURSOR RNA. It is appreciated that VGR2864 folded precursor RNA comprises a plurality of what is known in the art as 'hairpin' structures. These 'hairpin' structures are due to the fact that the nucleotide sequence of VGR2864 precursor RNA comprises a plurality of segments, the first half of each such segment having a nucleotide sequence which is at least a partial inversed-reversed sequence of the second half thereof, as is well known in the art.

VGR2864 folded precursor RNA is naturally processed by cellular enzymatic activity into at least 3 separate VGAM precursor RNAs, VGAM647 precursor RNA, VGAM648 precursor RNA and VGAM649 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM647

RNA, VGAM648 RNA and VGAM649 RNA, herein schematically represented by VGAM1 RNA through VGAM3 RNA, each of which VGAM RNAs corresponding to VGAM RNA of FIG. 1.

VGAM647 RNA, herein schematically represented by VGAM1 RNA through VGAM3 RNA, binds complementarily to a host target binding site located in an untranslated region of VGAM647 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM647 host target RNA into VGAM647 host target protein, herein schematically represented by VGAM1 HOST TARGET PROTEIN through VGAM3 HOST TARGET PROTEIN, all of FIG. 1.

VGAM648 RNA, herein schematically represented by VGAM1 RNA through VGAM3 RNA, binds complementarily to a host target binding site located in an untranslated region of VGAM648 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM648 host target RNA into VGAM648 host target protein, herein schematically represented by VGAM1 HOST TARGET PROTEIN through VGAM3 HOST TARGET PROTEIN, all of FIG. 1.

VGAM649 RNA, herein schematically represented by VGAM1 RNA through VGAM3 RNA, binds complementarily to a host target binding site located in an untranslated region of VGAM649 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM649 host target RNA into VGAM649 host target protein, herein schematically represented by VGAM1 HOST TARGET PROTEIN through VGAM3 HOST TARGET PROTEIN, all of FIG. 1.

It is appreciated that a function of VGR2864 gene, herein designated VGR GENE, is inhibition of expression of host target genes, as part of a novel viral mechanism of attacking a host. Accordingly, utilities of VGR2864 gene include diagnosis, prevention and treatment of viral infection by Acute Bee Paralysis Virus. Specific functions, and accordingly utilities, of VGR2864 gene correlate with, and may be deduced from, the identity of the host target genes, which are inhibited by VGAM RNAs comprised in the 'operon-like' cluster of VGR2864 gene: VGAM647 host target protein, VGAM648 host target protein and VGAM649 host target protein, herein schematically represented by VGAM1 HOST TARGET PROTEIN through VGAM3 HOST TARGET PROTEIN. The function of these host target genes is elaborated hereinabove with reference to VGAM647, VGAM648 and VGAM649. FIG. 9 further provides a conceptual description of novel bioinformatically detected regulatory viral gene, referred to here as Viral Genomic Record 2865(VGR2865) viral gene, which encodes an 'operon-like' cluster of novel viral micro RNA-like genes, each of which in turn modulates expression of at least one host target gene, the function and utility of which at least one host target gene is known in the art.

VGR2865 gene, herein designated VGR GENE, is a novel bioinformatically detected regulatory, non protein coding, RNA viral gene. The method by which VGR2865 gene was detected is described hereinabove with reference to FIGS. 1-9.

VGR2865 gene encodes VGR2865 precursor RNA, herein designated VGR PRECURSOR RNA, an RNA molecule, typically several hundred nucleotides long.

VGR2865 precursor RNA folds spatially, forming VGR2865 folded precursor RNA, herein designated VGR FOLDED PRECURSOR RNA. It is appreciated that VGR2865 folded precursor RNA comprises a plurality of what is known in the art as 'hairpin' structures. These 'hairpin' structures are due to the fact that the nucleotide sequence of VGR2865 precursor RNA comprises a plurality of segments, the first half of each such segment having a nucleotide sequence which is at least a partial inversed-reversed sequence of the second half thereof, as is well known in the art.

VGR2865 folded precursor RNA is naturally processed by cellular enzymatic activity into at least 2 separate VGAM precursor RNAs, VGAM652 precursor RNA and VGAM653 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM652 RNA and VGAM653 RNA, herein schematically represented by VGAM1 RNA through VGAM3 RNA, each of which VGAM RNAs corresponding to VGAM RNA of FIG. 1.

VGAM652 RNA, herein schematically represented by VGAM1 RNA through VGAM3 RNA, binds complementarily to a host target binding site located in an untranslated region of VGAM652 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM652 host target RNA into VGAM652 host target protein, herein schematically represented by VGAM1 HOST TARGET PROTEIN through VGAM3 HOST TARGET PROTEIN, all of FIG. 1.

VGAM653 RNA, herein schematically represented by VGAM1 RNA through VGAM3 RNA, binds complementarily to a host target binding site located in an untranslated region of VGAM653 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM653 host target RNA into VGAM653 host target protein, herein schematically represented by VGAM1 HOST TARGET PROTEIN through VGAM3 HOST TARGET PROTEIN, all of FIG. 1.

It is appreciated that a function of VGR2865 gene, herein designated VGR GENE, is inhibition of expression of host target genes, as part of a novel viral mechanism of attacking a host. Accordingly, utilities of VGR2865 gene include diagnosis, prevention and treatment of viral infection by Meleagrid Herpesvirus 1. Specific functions, and accordingly utilities, of VGR2865 gene correlate with, and may be deduced from, the identity of the host target genes, which are inhibited by VGAM RNAs comprised in the 'operon-like' cluster of VGR2865 gene: VGAM652 host target protein and VGAM653 host target protein, herein schematically represented by VGAM1 HOST TARGET PROTEIN through VGAM3 HOST TARGET PROTEIN. The function of these host target genes is elaborated hereinabove with reference to VGAM652 and VGAM653. FIG. 9 further provides a conceptual description of novel bioinformatically detected regulatory viral gene, referred to here as Viral Genomic Record 2866(VGR2866) viral gene, which encodes an 'operon-like' cluster of novel viral micro RNA-like genes, each of which in turn modulates expression of at least one host target gene, the function and utility of which at least one host target gene is known in the art.

VGR2866 gene, herein designated VGR GENE, is a novel bioinformatically detected regulatory, non protein coding, RNA viral gene. The method by which VGR2866 gene was detected is described hereinabove with reference to FIGS. 1-9.

VGR2866 gene encodes VGR2866 precursor RNA, herein designated VGR PRECURSOR RNA, an RNA molecule, typically several hundred nucleotides long.

VGR2866 precursor RNA folds spatially, forming VGR2866 folded precursor RNA, herein designated VGR FOLDED PRECURSOR RNA. It is appreciated that VGR2866 folded precursor RNA comprises a plurality of what is known in the art as 'hairpin' structures. These 'hairpin' structures are due to the fact that the nucleotide sequence of VGR2866 precursor RNA comprises a plurality of segments, the first half of each such segment having a nucleotide sequence which is at least a partial inversed-reversed sequence of the second half thereof, as is well known in the art.

VGR2866 folded precursor RNA is naturally processed by cellular enzymatic activity into at least 4 separate VGAM precursor RNAs, VGAM654 precursor RNA, VGAM655 precursor RNA, VGAM656 precursor RNA and VGAM657 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM654 RNA, VGAM655 RNA, VGAM656 RNA and VGAM657 RNA, herein schematically represented by VGAM1 RNA through VGAM3 RNA, each of which VGAM RNAs corresponding to VGAM RNA of FIG. 1.

VGAM654 RNA, herein schematically represented by VGAM1 RNA through VGAM3 RNA, binds complementarily to a host target binding site located in an untranslated region of VGAM654 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM654 host target RNA into VGAM654 host target protein, herein schematically represented by VGAM1 HOST TARGET PROTEIN through VGAM3 HOST TARGET PROTEIN, all of FIG. 1.

VGAM655 RNA, herein schematically represented by VGAM1 RNA through VGAM3 RNA, binds complementarily to a host target binding site located in an untranslated region of VGAM655 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM655 host target RNA into VGAM655 host target protein, herein schematically represented by VGAM1 HOST TARGET PROTEIN through VGAM3 HOST TARGET PROTEIN, all of FIG. 1.

VGAM656 RNA, herein schematically represented by VGAM1 RNA through VGAM3 RNA, binds complementarily to a host target binding site located in an untranslated region of VGAM656 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM656 host target RNA into VGAM656 host target protein, herein schematically represented by VGAM1 HOST TARGET PROTEIN through VGAM3 HOST TARGET PROTEIN, all of FIG. 1.

VGAM657 RNA, herein schematically represented by VGAM1 RNA through VGAM3 RNA, binds complementarily to a host target binding site located in an untranslated region of VGAM657 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM657 host target RNA into VGAM657 host target protein, herein schematically represented by VGAM1 HOST TARGET PROTEIN through VGAM3 HOST TARGET PROTEIN, all of FIG. 1.

It is appreciated that a function of VGR2866 gene, herein designated VGR GENE, is inhibition of expression of host target genes, as part of a novel viral mechanism of attacking a host. Accordingly, utilities of VGR2866 gene include diagnosis, prevention and treatment of viral infection by Meleagrid Herpesvirus 1. Specific functions, and accordingly utilities, of VGR2866 gene correlate with, and may be deduced from, the identity of the host target genes, which are inhibited by VGAM RNAs comprised in the 'operon-like' cluster of VGR2866 gene: VGAM654 host target protein, VGAM655 host target protein, VGAM656 host target protein and VGAM657 host target protein, herein schematically represented by VGAM1 HOST TARGET PROTEIN through VGAM3 HOST TARGET PROTEIN. The function of these host target genes is elaborated hereinabove with reference to VGAM654, VGAM655, VGAM656 and VGAM657. FIG. 9 further provides a conceptual description of novel bioinformatically detected regulatory viral gene, referred to here as Viral Genomic Record 2867(VGR2867) viral gene, which encodes an 'operon-like' cluster of novel viral micro RNA-like genes, each of which in turn modulates expression of at least one host target gene, the function and utility of which at least one host target gene is known in the art.

VGR2867 gene, herein designated VGR GENE, is a novel bioinformatically detected regulatory, non protein coding, RNA viral gene. The method by which VGR2867 gene was detected is described hereinabove with reference to FIGS. 1-9.

VGR2867 gene encodes VGR2867 precursor RNA, herein designated VGR PRECURSOR RNA, an RNA molecule, typically several hundred nucleotides long.

VGR2867 precursor RNA folds spatially, forming VGR2867 folded precursor RNA, herein designated VGR FOLDED PRECURSOR RNA. It is appreciated that VGR2867 folded precursor RNA comprises a plurality of what is known in the art as 'hairpin' structures. These 'hairpin' structures are due to the fact that the nucleotide sequence of VGR2867 precursor RNA comprises a plurality of segments, the first half of each such segment having a nucleotide sequence which is at least a partial inversed-reversed sequence of the second half thereof, as is well known in the art.

VGR2867 folded precursor RNA is naturally processed by cellular enzymatic activity into at least 3 separate VGAM precursor RNAs, VGAM658 precursor RNA, VGAM659 precursor RNA and VGAM660 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM658 RNA, VGAM659 RNA and VGAM660 RNA, herein schematically represented by VGAM1 RNA through VGAM3 RNA, each of which VGAM RNAs corresponding to VGAM RNA of FIG. 1.

VGAM658 RNA, herein schematically represented by VGAM1 RNA through VGAM3 RNA, binds complementarily to a host target binding site located in an untranslated region of VGAM658 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM658 host target RNA into VGAM658 host target protein, herein schematically represented by VGAM1 HOST TARGET PROTEIN through VGAM3 HOST TARGET PROTEIN, all of FIG. 1.

VGAM659 RNA, herein schematically represented by VGAM1 RNA through VGAM3 RNA, binds complementarily to a host target binding site located in an untranslated region of VGAM659 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM659 host target RNA into VGAM659 host target protein, herein schematically represented by VGAM1 HOST TARGET PROTEIN through VGAM3 HOST TARGET PROTEIN, all of FIG. 1.

VGAM660 RNA, herein schematically represented by VGAM1 RNA through VGAM3 RNA, binds complementarily to a host target binding site located in an untranslated region of VGAM660 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM660 host target RNA into VGAM660 host target protein, herein schematically represented by VGAM1 HOST TARGET PROTEIN through VGAM3 HOST TARGET PROTEIN, all of FIG. 1.

It is appreciated that a function of VGR2867 gene, herein designated VGR GENE, is inhibition of expression of host target genes, as part of a novel viral mechanism of attacking a host. Accordingly, utilities of VGR2867 gene include diagnosis, prevention and treatment of viral infection by Meleagrid Herpesvirus 1. Specific functions, and accordingly utilities, of VGR2867 gene correlate with, and may be deduced from, the identity of the host target genes, which are inhibited by VGAM RNAs comprised in the 'operon-like' cluster of VGR2867 gene: VGAM658 host target protein, VGAM659 host target protein and VGAM660 host target protein, herein schematically represented by VGAM1 HOST TARGET PROTEIN through VGAM3 HOST TARGET PROTEIN.

The function of these host target genes is elaborated hereinabove with reference to VGAM658, VGAM659 and VGAM660. FIG. 9 further provides a conceptual description of novel bioinformatically detected regulatory viral gene, referred to here as Viral Genomic Record 2868(VGR2868) viral gene, which encodes an 'operon-like' cluster of novel viral micro RNA-like genes, each of which in turn modulates expression of at least one host target gene, the function and utility of which at least one host target gene is known in the art.

VGR2868 gene, herein designated VGR GENE, is a novel bioinformatically detected regulatory, non protein coding, RNA viral gene. The method by which VGR2868 gene was detected is described hereinabove with reference to FIGS. 1-9.

VGR2868 gene encodes VGR2868 precursor RNA, herein designated VGR PRECURSOR RNA, an RNA molecule, typically several hundred nucleotides long.

VGR2868 precursor RNA folds spatially, forming VGR2868 folded precursor RNA, herein designated VGR FOLDED PRECURSOR RNA. It is appreciated that VGR2868 folded precursor RNA comprises a plurality of what is known in the art as 'hairpin' structures. These 'hairpin' structures are due to the fact that the nucleotide sequence of VGR2868 precursor RNA comprises a plurality of segments, the first half of each such segment having a nucleotide sequence which is at least a partial inversed-reversed sequence of the second half thereof, as is well known in the art.

VGR2868 folded precursor RNA is naturally processed by cellular enzymatic activity into at least 3 separate VGAM precursor RNAs, VGAM663 precursor RNA, VGAM664 precursor RNA and VGAM665 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM663 RNA, VGAM664 RNA and VGAM665 RNA, herein schematically represented by VGAM1 RNA through VGAM3 RNA, each of which VGAM RNAs corresponding to VGAM RNA of FIG. 1.

VGAM663 RNA, herein schematically represented by VGAM1 RNA through VGAM3 RNA, binds complementarily to a host target binding site located in an untranslated region of VGAM663 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM663 host target RNA into VGAM663 host target protein, herein schematically represented by VGAM1 HOST TARGET PROTEIN through VGAM3 HOST TARGET PROTEIN, all of FIG. 1.

VGAM664 RNA, herein schematically represented by VGAM1 RNA through VGAM3 RNA, binds complementarily to a host target binding site located in an untranslated region of VGAM664 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM664 host target RNA into VGAM664 host target protein, herein schematically represented by VGAM1 HOST TARGET PROTEIN through VGAM3 HOST TARGET PROTEIN, all of FIG. 1.

VGAM665 RNA, herein schematically represented by VGAM1 RNA through VGAM3 RNA, binds complementarily to a host target binding site located in an untranslated region of VGAM665 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM665 host target RNA into VGAM665 host target protein, herein schematically represented by VGAM1 HOST TARGET PROTEIN through VGAM3 HOST TARGET PROTEIN, all of FIG. 1.

It is appreciated that a function of VGR2868 gene, herein designated VGR GENE, is inhibition of expression of host target genes, as part of a novel viral mechanism of attacking a host. Accordingly, utilities of VGR2868 gene include diagnosis, prevention and treatment of viral infection by Rachiplusia Ou Multiple Nucleopolyhedrovirus. Specific functions, and accordingly utilities, of VGR2868 gene correlate with, and may be deduced from, the identity of the host target genes, which are inhibited by VGAM RNAs comprised in the 'operon-like' cluster of VGR2868 gene: VGAM663 host target protein, VGAM664 host target protein and VGAM665 host target protein, herein schematically represented by VGAM1 HOST TARGET PROTEIN through VGAM3 HOST TARGET PROTEIN. The function of these host target genes is elaborated hereinabove with reference to VGAM663, VGAM664 and VGAM665. FIG. 9 further provides a conceptual description of novel bioinformatically detected regulatory viral gene, referred to here as Viral Genomic Record 2869(VGR2869) viral gene, which encodes an 'operon-like' cluster of novel viral micro RNA-like genes, each of which in turn modulates expression of at least one host target gene, the function and utility of which at least one host target gene is known in the art.

VGR2869 gene, herein designated VGR GENE, is a novel bioinformatically detected regulatory, non protein coding, RNA viral gene. The method by which VGR2869 gene was detected is described hereinabove with reference to FIGS. 1-9.

VGR2869 gene encodes VGR2869 precursor RNA, herein designated VGR PRECURSOR RNA, an RNA molecule, typically several hundred nucleotides long.

VGR2869 precursor RNA folds spatially, forming VGR2869 folded precursor RNA, herein designated VGR FOLDED PRECURSOR RNA. It is appreciated that VGR2869 folded precursor RNA comprises a plurality of what is known in the art as 'hairpin' structures. These 'hairpin' structures are due to the fact that the nucleotide sequence of VGR2869 precursor RNA comprises a plurality of segments, the first half of each such segment having a nucleotide sequence which is at least a partial inversed-reversed sequence of the second half thereof, as is well known in the art.

VGR2869 folded precursor RNA is naturally processed by cellular enzymatic activity into at least 2 separate VGAM precursor RNAs, VGAM671 precursor RNA and VGAM672 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM671 RNA and VGAM672 RNA, herein schematically represented by VGAM1 RNA through VGAM3 RNA, each of which VGAM RNAs corresponding to VGAM RNA of FIG. 1.

VGAM671 RNA, herein schematically represented by VGAM1 RNA through VGAM3 RNA, binds complementarily to a host target binding site located in an untranslated region of VGAM671 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM671 host target RNA into VGAM671 host target protein, herein schematically represented by VGAM1 HOST TARGET PROTEIN through VGAM3 HOST TARGET PROTEIN, all of FIG. 1.

VGAM672 RNA, herein schematically represented by VGAM1 RNA through VGAM3 RNA, binds complementarily to a host target binding site located in an untranslated region of VGAM672 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM672 host target RNA into VGAM672 host target protein, herein schematically represented by VGAM1 HOST TARGET PROTEIN through VGAM3 HOST TARGET PROTEIN, all of FIG. 1.

It is appreciated that a function of VGR2869 gene, herein designated VGR GENE, is inhibition of expression of host target genes, as part of a novel viral mechanism of attacking a host. Accordingly, utilities of VGR2869 gene include diagnosis, prevention and treatment of viral infection by Yaba-like Disease Virus. Specific functions, and accordingly utilities, of VGR2869 gene correlate with, and may be deduced from, the identity of the host target genes, which are inhibited by VGAM RNAs comprised in the 'operon-like' cluster of VGR2869 gene: VGAM671 host target protein and VGAM672 host target protein, herein schematically represented by VGAM1 HOST TARGET PROTEIN through VGAM3 HOST TARGET PROTEIN. The function of these host target genes is elaborated hereinabove with reference to VGAM671 and VGAM672. FIG. 9 further provides a conceptual description of novel bioinformatically detected regulatory viral gene, referred to here as Viral Genomic Record 2870(VGR2870) viral gene, which encodes an 'operon-like' cluster of novel viral micro RNA-like genes, each of which in turn modulates expression of at least one host target gene, the function and utility of which at least one host target gene is known in the art.

VGR2870 gene, herein designated VGR GENE, is a novel bioinformatically detected regulatory, non protein coding, RNA viral gene. The method by which VGR2870 gene was detected is described hereinabove with reference to FIGS. 1-9.

VGR2870 gene encodes VGR2870 precursor RNA, herein designated VGR PRECURSOR RNA, an RNA molecule, typically several hundred nucleotides long.

VGR2870 precursor RNA folds spatially, forming VGR2870 folded precursor RNA, herein designated VGR FOLDED PRECURSOR RNA. It is appreciated that VGR2870 folded precursor RNA comprises a plurality of what is known in the art as 'hairpin' structures. These 'hairpin' structures are due to the fact that the nucleotide sequence of VGR2870 precursor RNA comprises a plurality of segments, the first half of each such segment having a nucleotide sequence which is at least a partial inversed-reversed sequence of the second half thereof, as is well known in the art.

VGR2870 folded precursor RNA is naturally processed by cellular enzymatic activity into at least 8 separate VGAM precursor RNAs, VGAM673 precursor RNA, VGAM674 precursor RNA, VGAM675 precursor RNA, VGAM676 precursor RNA, VGAM677 precursor RNA, VGAM678 precursor RNA, VGAM679 precursor RNA and VGAM680 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM673 RNA, VGAM674 RNA, VGAM675 RNA, VGAM676 RNA, VGAM677 RNA, VGAM678 RNA, VGAM679 RNA and VGAM680 RNA, herein schematically represented by VGAM1 RNA through VGAM3 RNA, each of which VGAM RNAs corresponding to VGAM RNA of FIG. 1.

VGAM673 RNA, herein schematically represented by VGAM1 RNA through VGAM3 RNA, binds complementarily to a host target binding site located in an untranslated region of VGAM673 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM673 host target RNA into VGAM673 host target protein, herein schematically represented by VGAM1 HOST TARGET PROTEIN through VGAM3 HOST TARGET PROTEIN, all of FIG. 1.

VGAM674 RNA, herein schematically represented by VGAM1 RNA through VGAM3 RNA, binds complementarily to a host target binding site located in an untranslated region of VGAM674 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM674 host target RNA into VGAM674 host target protein, herein schematically represented by VGAM1 HOST TARGET PROTEIN through VGAM3 HOST TARGET PROTEIN, all of FIG. 1.

VGAM675 RNA, herein schematically represented by VGAM1 RNA through VGAM3 RNA, binds complementarily to a host target binding site located in an untranslated region of VGAM675 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM675 host target RNA into VGAM675 host target protein, herein schematically represented by VGAM1 HOST TARGET PROTEIN through VGAM3 HOST TARGET PROTEIN, all of FIG. 1.

VGAM676 RNA, herein schematically represented by VGAM1 RNA through VGAM3 RNA, binds complementarily to a host target binding site located in an untranslated region of VGAM676 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM676 host target RNA into VGAM676 host target protein, herein schematically represented by VGAM1 HOST TARGET PROTEIN through VGAM3 HOST TARGET PROTEIN, all of FIG. 1.

VGAM677 RNA, herein schematically represented by VGAM1 RNA through VGAM3 RNA, binds complementarily to a host target binding site located in an untranslated region of VGAM677 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM677 host target RNA into VGAM677 host target protein, herein schematically represented by VGAM1 HOST TARGET PROTEIN through VGAM3 HOST TARGET PROTEIN, all of FIG. 1.

VGAM678 RNA, herein schematically represented by VGAM1 RNA through VGAM3 RNA, binds complementarily to a host target binding site located in an untranslated region of VGAM678 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM678 host target RNA into VGAM678 host target protein, herein schematically represented by VGAM1 HOST TARGET PROTEIN through VGAM3 HOST TARGET PROTEIN, all of FIG. 1.

VGAM679 RNA, herein schematically represented by VGAM1 RNA through VGAM3 RNA, binds complementarily to a host target binding site located in an untranslated region of VGAM679 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM679 host target RNA into VGAM679 host target protein, herein schematically represented by VGAM1 HOST TARGET PROTEIN through VGAM3 HOST TARGET PROTEIN, all of FIG. 1.

VGAM680 RNA, herein schematically represented by VGAM1 RNA through VGAM3 RNA, binds complementarily to a host target binding site located in an untranslated region of VGAM680 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM680 host target RNA into VGAM680 host target protein, herein schematically represented by VGAM1 HOST TARGET PROTEIN through VGAM3 HOST TARGET PROTEIN, all of FIG. 1.

It is appreciated that a function of VGR2870 gene, herein designated VGR GENE, is inhibition of expression of host target genes, as part of a novel viral mechanism of attacking a host. Accordingly, utilities of VGR2870 gene include diagnosis, prevention and treatment of viral infection by Human Coronavirus 229E. Specific functions, and accordingly utilities, of VGR2870 gene correlate with, and may be deduced from, the identity of the host target genes, which are inhibited by VGAM RNAs comprised in the 'operon-like' cluster of VGR2870 gene: VGAM673 host target protein, VGAM674 host target protein, VGAM675 host target protein, VGAM676 host target protein, VGAM677 host target protein, VGAM678 host target protein, VGAM679 host target protein and VGAM680 host target protein, herein schematically represented by VGAM1 HOST TARGET PROTEIN through VGAM3 HOST TARGET PROTEIN. The function of these host target genes is elaborated hereinabove with reference to VGAM673, VGAM674, VGAM675, VGAM676, VGAM677, VGAM678, VGAM679 and VGAM680. FIG. 9 further provides a conceptual description of novel bioinformatically detected regulatory viral gene, referred to here as Viral Genomic Record 2871(VGR2871) viral gene, which encodes an 'operon-like' cluster of novel viral micro RNA-like genes, each of which in turn modulates expression of at least one host target gene, the function and utility of which at least one host target gene is known in the art.

VGR2871 gene, herein designated VGR GENE, is a novel bioinformatically detected regulatory, non protein coding, RNA viral gene. The method by which VGR2871 gene was detected is described hereinabove with reference to FIGS. 1-9.

VGR2871 gene encodes VGR2871 precursor RNA, herein designated VGR PRECURSOR RNA, an RNA molecule, typically several hundred nucleotides long.

VGR2871 precursor RNA folds spatially, forming VGR2871 folded precursor RNA, herein designated VGR FOLDED PRECURSOR RNA. It is appreciated that VGR2871 folded precursor RNA comprises a plurality of what is known in the art as 'hairpin' structures. These 'hairpin' structures are due to the fact that the nucleotide sequence of VGR2871 precursor RNA comprises a plurality of segments, the first half of each such segment having a nucleotide sequence which is at least a partial inversed-reversed sequence of the second half thereof, as is well known in the art.

VGR2871 folded precursor RNA is naturally processed by cellular enzymatic activity into at least 8 separate VGAM precursor RNAs, VGAM681 precursor RNA, VGAM682 precursor RNA, VGAM683 precursor RNA, VGAM684 precursor RNA, VGAM685 precursor RNA, VGAM686 precursor RNA, VGAM687 precursor RNA and VGAM688 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM681 RNA, VGAM682 RNA, VGAM683 RNA, VGAM684 RNA, VGAM685 RNA, VGAM686 RNA, VGAM687 RNA and VGAM688 RNA, herein schematically represented by VGAM1 RNA through VGAM3 RNA, each of which VGAM RNAs corresponding to VGAM RNA of FIG. 1.

VGAM681 RNA, herein schematically represented by VGAM1 RNA through VGAM3 RNA, binds complementarily to a host target binding site located in an untranslated region of VGAM681 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM681 host target RNA into VGAM681 host target protein, herein schematically represented by VGAM1 HOST TARGET PROTEIN through VGAM3 HOST TARGET PROTEIN, all of FIG. 1.

VGAM682 RNA, herein schematically represented by VGAM1 RNA through VGAM3 RNA, binds complementarily to a host target binding site located in an untranslated region of VGAM682 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM682 host target RNA into VGAM682 host target protein, herein schematically represented by VGAM1 HOST TARGET PROTEIN through VGAM3 HOST TARGET PROTEIN, all of FIG. 1.

VGAM683 RNA, herein schematically represented by VGAM1 RNA through VGAM3 RNA, binds complementarily to a host target binding site located in an untranslated region of VGAM683 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM683 host target RNA into VGAM683 host target protein, herein schematically represented by VGAM1 HOST TARGET PROTEIN through VGAM3 HOST TARGET PROTEIN, all of FIG. 1.

VGAM684 RNA, herein schematically represented by VGAM1 RNA through VGAM3 RNA, binds complementarily to a host target binding site located in an untranslated region of VGAM684 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM684 host target RNA into VGAM684 host target protein, herein schematically represented by VGAM1 HOST TARGET PROTEIN through VGAM3 HOST TARGET PROTEIN, all of FIG. 1.

VGAM685 RNA, herein schematically represented by VGAM1 RNA through VGAM3 RNA, binds complementarily to a host target binding site located in an untranslated region of VGAM685 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM685 host target RNA into VGAM685 host target protein, herein schematically represented by VGAM1 HOST TARGET PROTEIN through VGAM3 HOST TARGET PROTEIN, all of FIG. 1.

VGAM686 RNA, herein schematically represented by VGAM1 RNA through VGAM3 RNA, binds complementarily to a host target binding site located in an untranslated region of VGAM686 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM686 host target RNA into VGAM686 host target protein, herein schematically represented by VGAM1 HOST TARGET PROTEIN through VGAM3 HOST TARGET PROTEIN, all of FIG. 1.

VGAM687 RNA, herein schematically represented by VGAM1 RNA through VGAM3 RNA, binds complementarily to a host target binding site located in an untranslated region of VGAM687 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM687 host target RNA into VGAM687 host target protein, herein schematically represented by VGAM1 HOST TARGET PROTEIN through VGAM3 HOST TARGET PROTEIN, all of FIG. 1.

VGAM688 RNA, herein schematically represented by VGAM1 RNA through VGAM3 RNA, binds complementarily to a host target binding site located in an untranslated region of VGAM688 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM688 host target RNA into VGAM688 host target protein, herein schematically represented by VGAM1 HOST TARGET PROTEIN through VGAM3 HOST TARGET PROTEIN, all of FIG. 1.

It is appreciated that a function of VGR2871 gene, herein designated VGR GENE, is inhibition of expression of host target genes, as part of a novel viral mechanism of attacking a host. Accordingly, utilities of VGR2871 gene include diagnosis, prevention and treatment of viral infection by Human Coronavirus 229E. Specific functions, and accordingly utilities, of VGR2871 gene correlate with, and may be deduced from, the identity of the host target genes, which are inhibited by VGAM RNAs comprised in the 'operon-like' cluster of VGR2871 gene: VGAM681 host target protein, VGAM682 host target protein, VGAM683 host target protein, VGAM684 host target protein, VGAM685 host target protein, VGAM686 host target protein, VGAM687 host target protein and VGAM688 host target protein, herein schematically represented by VGAM1 HOST TARGET PROTEIN through VGAM3 HOST TARGET PROTEIN. The function of these host target genes is elaborated hereinabove with reference to VGAM681, VGAM682, VGAM683, VGAM684, VGAM685, VGAM686, VGAM687 and VGAM688. FIG. 9 further provides a conceptual description of novel bioinformatically detected regulatory viral gene, referred to here as Viral Genomic Record 2872(VGR2872) viral gene, which encodes an 'operon-like' cluster of novel viral micro RNA-like genes, each of which in turn modulates expression of at least one host target gene, the function and utility of which at least one host target gene is known in the art.

VGR2872 gene, herein designated VGR GENE, is a novel bioinformatically detected regulatory, non protein coding, RNA viral gene. The method by which VGR2872 gene was detected is described hereinabove with reference to FIGS. 1-9.

VGR2872 gene encodes VGR2872 precursor RNA, herein designated VGR PRECURSOR RNA, an RNA molecule, typically several hundred nucleotides long.

VGR2872 precursor RNA folds spatially, forming VGR2872 folded precursor RNA, herein designated VGR FOLDED PRECURSOR RNA. It is appreciated that VGR2872 folded precursor RNA comprises a plurality of what is known in the art as 'hairpin' structures. These 'hairpin' structures are due to the fact that the nucleotide sequence of VGR2872 precursor RNA comprises a plurality of segments, the first half of each such segment having a nucleotide sequence which is at least a partial inversed-reversed sequence of the second half thereof, as is well known in the art.

VGR2872 folded precursor RNA is naturally processed by cellular enzymatic activity into at least 8 separate VGAM precursor RNAs, VGAM689 precursor RNA, VGAM690 precursor RNA, VGAM691 precursor RNA, VGAM692 precursor RNA, VGAM693 precursor RNA, VGAM694 precursor RNA, VGAM695 precursor RNA and VGAM696 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM689 RNA, VGAM690 RNA, VGAM691 RNA, VGAM692 RNA, VGAM693 RNA, VGAM694 RNA, VGAM695 RNA and VGAM696 RNA, herein schematically represented by VGAM1 RNA through VGAM3 RNA, each of which VGAM RNAs corresponding to VGAM RNA of FIG. 1.

VGAM689 RNA, herein schematically represented by VGAM1 RNA through VGAM3 RNA, binds complementarily to a host target binding site located in an untranslated region of VGAM689 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM689 host target RNA into VGAM689 host target protein, herein schematically represented by VGAM1 HOST TARGET PROTEIN through VGAM3 HOST TARGET PROTEIN, all of FIG. 1.

VGAM690 RNA, herein schematically represented by VGAM1 RNA through VGAM3 RNA, binds complementarily to a host target binding site located in an untranslated region of VGAM690 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM690 host target RNA into VGAM690 host target protein, herein schematically represented by VGAM1 HOST TARGET PROTEIN through VGAM3 HOST TARGET PROTEIN, all of FIG. 1.

VGAM691 RNA, herein schematically represented by VGAM1 RNA through VGAM3 RNA, binds complementarily to a host target binding site located in an untranslated region of VGAM691 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM691 host target RNA into VGAM691 host target protein, herein schematically represented by VGAM1 HOST TARGET PROTEIN through VGAM3 HOST TARGET PROTEIN, all of FIG. 1.

VGAM692 RNA, herein schematically represented by VGAM1 RNA through VGAM3 RNA, binds complementarily to a host target binding site located in an untranslated region of VGAM692 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM692 host target RNA into VGAM692 host target protein, herein schematically represented by VGAM1 HOST TARGET PROTEIN through VGAM3 HOST TARGET PROTEIN, all of FIG. 1.

VGAM693 RNA, herein schematically represented by VGAM1 RNA through VGAM3 RNA, binds complementarily to a host target binding site located in an untranslated region of VGAM693 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM693 host target RNA into VGAM693 host target protein, herein schematically represented by VGAM1 HOST TARGET PROTEIN through VGAM3 HOST TARGET PROTEIN, all of FIG. 1.

VGAM694 RNA, herein schematically represented by VGAM1 RNA through VGAM3 RNA, binds complementarily to a host target binding site located in an untranslated region of VGAM694 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM694 host target RNA into VGAM694 host target protein, herein schematically represented by VGAM1 HOST TARGET PROTEIN through VGAM3 HOST TARGET PROTEIN, all of FIG. 1.

VGAM695 RNA, herein schematically represented by VGAM1 RNA through VGAM3 RNA, binds complementarily to a host target binding site located in an untranslated region of VGAM695 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM695 host target RNA into VGAM695 host target protein, herein schematically represented by VGAM1 HOST TARGET PROTEIN through VGAM3 HOST TARGET PROTEIN, all of FIG. 1.

VGAM696 RNA, herein schematically represented by VGAM1 RNA through VGAM3 RNA, binds complementarily to a host target binding site located in an untranslated region of VGAM696 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM696 host target RNA into VGAM696 host target protein, herein schematically represented by VGAM1 HOST TARGET PROTEIN through VGAM3 HOST TARGET PROTEIN, all of FIG. 1.

It is appreciated that a function of VGR2872 gene, herein designated VGR GENE, is inhibition of expression of host target genes, as part of a novel viral mechanism of attacking a host. Accordingly, utilities of VGR2872 gene include diagnosis, prevention and treatment of viral infection by Human Coronavirus 229E. Specific functions, and accordingly utilities, of VGR2872 gene correlate with, and may be deduced from, the identity of the host target genes, which are inhibited by VGAM RNAs comprised in the 'operon-like' cluster of VGR2872 gene: VGAM689 host target protein, VGAM690 host target protein, VGAM691 host target protein, VGAM692 host target protein, VGAM693 host target protein, VGAM694 host target protein, VGAM695 host target protein and VGAM696 host target protein, herein schematically represented by VGAM1 HOST TARGET PROTEIN through VGAM3 HOST TARGET PROTEIN. The function of these host target genes is elaborated hereinabove with reference to VGAM689, VGAM690, VGAM691, VGAM692, VGAM693, VGAM694, VGAM695 and VGAM696. FIG. 9 further provides a conceptual description of novel bioinformatically detected regulatory viral gene, referred to here as Viral Genomic Record 2873(VGR2873) viral gene, which encodes an 'operon-like' cluster of novel viral micro RNA-like genes, each of which in turn modulates expression of at least one host target gene, the function and utility of which at least one host target gene is known in the art.

VGR2873 gene, herein designated VGR GENE, is a novel bioinformatically detected regulatory, non protein coding, RNA viral gene. The method by which VGR2873 gene was detected is described hereinabove with reference to FIGS. 1-9.

VGR2873 gene encodes VGR2873 precursor RNA, herein designated VGR PRECURSOR RNA, an RNA molecule, typically several hundred nucleotides long.

VGR2873 precursor RNA folds spatially, forming VGR2873 folded precursor RNA, herein designated VGR FOLDED PRECURSOR RNA. It is appreciated that VGR2873 folded precursor RNA comprises a plurality of what is known in the art as 'hairpin' structures. These 'hairpin' structures are due to the fact that the nucleotide sequence of VGR2873 precursor RNA comprises a plurality of segments, the first half of each such segment having a nucleotide sequence which is at least a partial inversed-reversed sequence of the second half thereof, as is well known in the art.

VGR2873 folded precursor RNA is naturally processed by cellular enzymatic activity into at least 4 separate VGAM precursor RNAs, VGAM697 precursor RNA, VGAM698 precursor RNA, VGAM699 precursor RNA and VGAM700 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM697 RNA, VGAM698 RNA, VGAM699 RNA and VGAM700 RNA, herein schematically represented by VGAM1 RNA through VGAM3 RNA, each of which VGAM RNAs corresponding to VGAM RNA of FIG. 1.

VGAM697 RNA, herein schematically represented by VGAM1 RNA through VGAM3 RNA, binds complementarily to a host target binding site located in an untranslated region of VGAM697 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM697 host target RNA into VGAM697 host target protein, herein schematically represented by VGAM1 HOST TARGET PROTEIN through VGAM3 HOST TARGET PROTEIN, all of FIG. 1.

VGAM698 RNA, herein schematically represented by VGAM1 RNA through VGAM3 RNA, binds complementarily to a host target binding site located in an untranslated region of VGAM698 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM698 host target RNA into VGAM698 host target protein, herein schematically represented by VGAM1 HOST TARGET PROTEIN through VGAM3 HOST TARGET PROTEIN, all of FIG. 1.

VGAM699 RNA, herein schematically represented by VGAM1 RNA through VGAM3 RNA, binds complementarily to a host target binding site located in an untranslated region of VGAM699 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM699 host target RNA into VGAM699 host target protein, herein schematically represented by VGAM1 HOST TARGET PROTEIN through VGAM3 HOST TARGET PROTEIN, all of FIG. 1.

VGAM700 RNA, herein schematically represented by VGAM1 RNA through VGAM3 RNA, binds complementarily to a host target binding site located in an untranslated region of VGAM700 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM700 host target RNA into VGAM700 host target protein, herein schematically represented by VGAM1 HOST TARGET PROTEIN through VGAM3 HOST TARGET PROTEIN, all of FIG. 1.

It is appreciated that a function of VGR2873 gene, herein designated VGR GENE, is inhibition of expression of host target genes, as part of a novel viral mechanism of attacking a host. Accordingly, utilities of VGR2873 gene include diagnosis, prevention and treatment of viral infection by Human Coronavirus 229E. Specific functions, and accordingly utilities, of VGR2873 gene correlate with, and may be deduced from, the identity of the host target genes, which are inhibited by VGAM RNAs comprised in the 'operon-like' cluster of VGR2873 gene: VGAM697 host target protein, VGAM698 host target protein, VGAM699 host target protein and VGAM700 host target protein, herein schematically represented by VGAM1 HOST TARGET PROTEIN through VGAM3 HOST TARGET PROTEIN. The function of these host target genes is elaborated hereinabove with reference to VGAM697, VGAM698, VGAM699 and VGAM700. FIG. 9 further provides a conceptual description of novel bioinformatically detected regulatory viral gene, referred to here as Viral Genomic Record 2874(VGR2874) viral gene, which encodes an 'operon-like' cluster of novel viral micro RNA-like genes, each of which in turn modulates expression of at least one host target gene, the function and utility of which at least one host target gene is known in the art.

VGR2874 gene, herein designated VGR GENE, is a novel bioinformatically detected regulatory, non protein coding, RNA viral gene. The method by which VGR2874 gene was detected is described hereinabove with reference to FIGS. 1-9.

VGR2874 gene encodes VGR2874 precursor RNA, herein designated VGR PRECURSOR RNA, an RNA molecule, typically several hundred nucleotides long.

VGR2874 precursor RNA folds spatially, forming VGR2874 folded precursor RNA, herein designated VGR FOLDED PRECURSOR RNA. It is appreciated that VGR2874 folded precursor RNA comprises a plurality of what is known in the art as 'hairpin' structures. These 'hairpin' structures are due to the fact that the nucleotide sequence of VGR2874 precursor RNA comprises a plurality of segments, the first half of each such segment having a nucleotide sequence which is at least a partial inversed-reversed sequence of the second half thereof, as is well known in the art.

VGR2874 folded precursor RNA is naturally processed by cellular enzymatic activity into at least 6 separate VGAM precursor RNAs, VGAM701 precursor RNA, VGAM702 precursor RNA, VGAM703 precursor RNA, VGAM704 precursor RNA, VGAM705 precursor RNA and VGAM706 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM701 RNA, VGAM702 RNA, VGAM703 RNA, VGAM704 RNA, VGAM705 RNA and VGAM706 RNA, herein schematically represented by VGAM1 RNA through VGAM3 RNA, each of which VGAM RNAs corresponding to VGAM RNA of FIG. 1.

VGAM701 RNA, herein schematically represented by VGAM1 RNA through VGAM3 RNA, binds complementarily to a host target binding site located in an untranslated region of VGAM701 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM701 host target RNA into VGAM701 host target protein, herein schematically represented by VGAM1 HOST TARGET PROTEIN through VGAM3 HOST TARGET PROTEIN, all of FIG. 1.

VGAM702 RNA, herein schematically represented by VGAM1 RNA through VGAM3 RNA, binds complementarily to a host target binding site located in an untranslated region of VGAM702 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM702 host target RNA into VGAM702 host target protein, herein schematically represented by VGAM1 HOST TARGET PROTEIN through VGAM3 HOST TARGET PROTEIN, all of FIG. 1.

VGAM703 RNA, herein schematically represented by VGAM1 RNA through VGAM3 RNA, binds complementarily to a host target binding site located in an untranslated region of VGAM703 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM703 host target RNA into VGAM703 host target protein, herein schematically represented by VGAM1 HOST TARGET PROTEIN through VGAM3 HOST TARGET PROTEIN, all of FIG. 1.

VGAM704 RNA, herein schematically represented by VGAM1 RNA through VGAM3 RNA, binds complementarily to a host target binding site located in an untranslated region of VGAM704 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM704 host target RNA into VGAM704 host target protein, herein schematically represented by VGAM1 HOST TARGET PROTEIN through VGAM3 HOST TARGET PROTEIN, all of FIG. 1.

VGAM705 RNA, herein schematically represented by VGAM1 RNA through VGAM3 RNA, binds complementarily to a host target binding site located in an untranslated region of VGAM705 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM705 host target RNA into VGAM705 host target protein, herein schematically represented by VGAM1 HOST TARGET PROTEIN through VGAM3 HOST TARGET PROTEIN, all of FIG. 1.

VGAM706 RNA, herein schematically represented by VGAM1 RNA through VGAM3 RNA, binds complementarily to a host target binding site located in an untranslated region of VGAM706 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM706 host target RNA into VGAM706 host target protein, herein schematically represented by VGAM1 HOST TARGET PROTEIN through VGAM3 HOST TARGET PROTEIN, all of FIG. 1.

It is appreciated that a function of VGR2874 gene, herein designated VGR GENE, is inhibition of expression of host target genes, as part of a novel viral mechanism of attacking a host. Accordingly, utilities of VGR2874 gene include diagnosis, prevention and treatment of viral infection by Human Coronavirus 229E. Specific functions, and accordingly utilities, of VGR2874 gene correlate with, and may be deduced from, the identity of the host target genes, which are inhibited by VGAM RNAs comprised in the 'operon-like' cluster of VGR2874 gene: VGAM701 host target protein, VGAM702 host target protein, VGAM703 host target protein, VGAM704 host target protein, VGAM705 host target protein and VGAM706 host target protein, herein schematically represented by VGAM1 HOST TARGET PROTEIN through VGAM3 HOST TARGET PROTEIN. The function of these host target genes is elaborated hereinabove with reference to VGAM701, VGAM702, VGAM703, VGAM704, VGAM705 and VGAM706. FIG. 9 further provides a conceptual description of novel bioinformatically detected regulatory viral gene, referred to here as Viral Genomic Record 2875(VGR2875) viral gene, which encodes an 'operon-like' cluster of novel viral micro RNA-like genes, each of which in turn modulates expression of at least one host target gene, the function and utility of which at least one host target gene is known in the art.

VGR2875 gene, herein designated VGR GENE, is a novel bioinformatically detected regulatory, non protein coding, RNA viral gene. The method by which VGR2875 gene was detected is described hereinabove with reference to FIGS. 1-9.

VGR2875 gene encodes VGR2875 precursor RNA, herein designated VGR PRECURSOR RNA, an RNA molecule, typically several hundred nucleotides long.

VGR2875 precursor RNA folds spatially, forming VGR2875 folded precursor RNA, herein designated VGR FOLDED PRECURSOR RNA. It is appreciated that VGR2875 folded precursor RNA comprises a plurality of what is known in the art as 'hairpin' structures. These 'hairpin' structures are due to the fact that the nucleotide sequence of VGR2875 precursor RNA comprises a plurality of segments, the first half of each such segment having a nucleotide sequence which is at least a partial inversed-reversed sequence of the second half thereof, as is well known in the art.

VGR2875 folded precursor RNA is naturally processed by cellular enzymatic activity into at least 3 separate VGAM precursor RNAs, VGAM710 precursor RNA, VGAM711 precursor RNA and VGAM712 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM710 RNA, VGAM711 RNA and VGAM712 RNA, herein schematically represented by VGAM1 RNA through VGAM3 RNA, each of which VGAM RNAs corresponding to VGAM RNA of FIG. 1.

VGAM710 RNA, herein schematically represented by VGAM1 RNA through VGAM3 RNA, binds complementarily to a host target binding site located in an untranslated region of VGAM710 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM710 host target RNA into VGAM710 host target protein, herein schematically represented by VGAM1 HOST TARGET PROTEIN through VGAM3 HOST TARGET PROTEIN, all of FIG. 1.

VGAM711 RNA, herein schematically represented by VGAM1 RNA through VGAM3 RNA, binds complementarily to a host target binding site located in an untranslated region of VGAM711 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM711 host target RNA into VGAM711 host target protein, herein schematically represented by VGAM1 HOST TARGET PROTEIN through VGAM3 HOST TARGET PROTEIN, all of FIG. 1.

VGAM712 RNA, herein schematically represented by VGAM1 RNA through VGAM3 RNA, binds complementarily to a host target binding site located in an untranslated region of VGAM712 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM712 host target RNA into VGAM712 host target protein, herein schematically represented by VGAM1 HOST TARGET PROTEIN through VGAM3 HOST TARGET PROTEIN, all of FIG. 1.

It is appreciated that a function of VGR2875 gene, herein designated VGR GENE, is inhibition of expression of host target genes, as part of a novel viral mechanism of attacking a host. Accordingly, utilities of VGR2875 gene include diagnosis, prevention and treatment of viral infection by Pestivirus Type 2. Specific functions, and accordingly utilities, of VGR2875 gene correlate with, and may be deduced from, the identity of the host target genes, which are inhibited by VGAM RNAs comprised in the 'operon-like' cluster of VGR2875 gene: VGAM710 host target protein, VGAM711 host target protein and VGAM712 host target protein, herein schematically represented by VGAM1 HOST TARGET PROTEIN through VGAM3 HOST TARGET PROTEIN. The function of these host target genes is elaborated hereinabove with reference to VGAM710, VGAM711 and VGAM712. FIG. 9 further provides a conceptual description of novel bioinformatically detected regulatory viral gene, referred to here as Viral Genomic Record 2876(VGR2876) viral gene, which encodes an 'operon-like' cluster of novel viral micro RNA-like genes, each of which in turn modulates expression of at least one host target gene, the function and utility of which at least one host target gene is known in the art.

VGR2876 gene, herein designated VGR GENE, is a novel bioinformatically detected regulatory, non protein coding, RNA viral gene. The method by which VGR2876 gene was detected is described hereinabove with reference to FIGS. 1-9.

VGR2876 gene encodes VGR2876 precursor RNA, herein designated VGR PRECURSOR RNA, an RNA molecule, typically several hundred nucleotides long.

VGR2876 precursor RNA folds spatially, forming VGR2876 folded precursor RNA, herein designated VGR FOLDED PRECURSOR RNA. It is appreciated that VGR2876 folded precursor RNA comprises a plurality of what is known in the art as 'hairpin' structures. These 'hairpin' structures are due to the fact that the nucleotide sequence of VGR2876 precursor RNA comprises a plurality of segments, the first half of each such segment having a nucleotide sequence which is at least a partial inversed-reversed sequence of the second half thereof, as is well known in the art.

VGR2876 folded precursor RNA is naturally processed by cellular enzymatic activity into at least 2 separate VGAM precursor RNAs, VGAM713 precursor RNA and VGAM714 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM713 RNA and VGAM714 RNA, herein schematically represented by VGAM1 RNA through VGAM3 RNA, each of which VGAM RNAs corresponding to VGAM RNA of FIG. 1.

VGAM713 RNA, herein schematically represented by VGAM1 RNA through VGAM3 RNA, binds complementarily to a host target binding site located in an untranslated region of VGAM713 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM713 host target RNA into VGAM713 host target protein, herein schematically represented by VGAM1 HOST TARGET PROTEIN through VGAM3 HOST TARGET PROTEIN, all of FIG. 1.

VGAM714 RNA, herein schematically represented by VGAM1 RNA through VGAM3 RNA, binds complementarily to a host target binding site located in an untranslated region of VGAM714 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM714 host target RNA into VGAM714 host target protein, herein schematically represented by VGAM1 HOST TARGET PROTEIN through VGAM3 HOST TARGET PROTEIN, all of FIG. 1.

It is appreciated that a function of VGR2876 gene, herein designated VGR GENE, is inhibition of expression of host target genes, as part of a novel viral mechanism of attacking a host. Accordingly, utilities of VGR2876 gene include diagnosis, prevention and treatment of viral infection by Bovine Herpesvirus 4. Specific functions, and accordingly utilities, of VGR2876 gene correlate with, and may be deduced from, the identity of the host target genes, which are inhibited by VGAM RNAs comprised in the 'operon-like' cluster of VGR2876 gene: VGAM713 host target protein and VGAM714 host target protein, herein schematically represented by VGAM1 HOST TARGET PROTEIN through VGAM3 HOST TARGET PROTEIN. The function of these host target genes is elaborated hereinabove with reference to VGAM713 and VGAM714. FIG. 9 further provides a conceptual description of novel bioinformatically detected regulatory viral gene, referred to here as Viral Genomic Record 2877(VGR2877) viral gene, which encodes an 'operon-like' cluster of novel viral micro RNA-like genes, each of which in turn modulates expression of at least one host target gene, the function and utility of which at least one host target gene is known in the art.

VGR2877 gene, herein designated VGR GENE, is a novel bioinformatically detected regulatory, non protein coding, RNA viral gene. The method by which VGR2877 gene was detected is described hereinabove with reference to FIGS. 1-9.

VGR2877 gene encodes VGR2877 precursor RNA, herein designated VGR PRECURSOR RNA, an RNA molecule, typically several hundred nucleotides long.

VGR2877 precursor RNA folds spatially, forming VGR2877 folded precursor RNA, herein designated VGR FOLDED PRECURSOR RNA. It is appreciated that VGR2877 folded precursor RNA comprises a plurality of what is known in the art as 'hairpin' structures. These 'hairpin' structures are due to the fact that the nucleotide sequence of VGR2877 precursor RNA comprises a plurality of segments, the first half of each such segment having a nucleotide sequence which is at least a partial inversed-reversed sequence of the second half thereof, as is well known in the art.

VGR2877 folded precursor RNA is naturally processed by cellular enzymatic activity into at least 4 separate VGAM precursor RNAs, VGAM715 precursor RNA, VGAM716 precursor RNA, VGAM717 precursor RNA and VGAM718 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM715 RNA, VGAM716 RNA, VGAM717 RNA and VGAM718 RNA, herein schematically represented by VGAM1 RNA through VGAM3 RNA, each of which VGAM RNAs corresponding to VGAM RNA of FIG. 1.

VGAM715 RNA, herein schematically represented by VGAM1 RNA through VGAM3 RNA, binds complementarily to a host target binding site located in an untranslated region of VGAM715 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM715 host target RNA into VGAM715 host target protein, herein schematically represented by VGAM1 HOST TARGET PROTEIN through VGAM3 HOST TARGET PROTEIN, all of FIG. 1.

VGAM716 RNA, herein schematically represented by VGAM1 RNA through VGAM3 RNA, binds complementarily to a host target binding site located in an untranslated region of VGAM716 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM716 host target RNA into VGAM716 host target protein, herein schematically represented by VGAM1 HOST TARGET PROTEIN through VGAM3 HOST TARGET PROTEIN, all of FIG. 1.

VGAM717 RNA, herein schematically represented by VGAM1 RNA through VGAM3 RNA, binds complementarily to a host target binding site located in an untranslated region of VGAM717 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM717 host target RNA into VGAM717 host target protein, herein schematically represented by VGAM1 HOST TARGET PROTEIN through VGAM3 HOST TARGET PROTEIN, all of FIG. 1.

VGAM718 RNA, herein schematically represented by VGAM1 RNA through VGAM3 RNA, binds complementarily to a host target binding site located in an untranslated region of VGAM718 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM718 host target RNA into VGAM718 host target protein, herein schematically represented by VGAM1 HOST TARGET PROTEIN through VGAM3 HOST TARGET PROTEIN, all of FIG. 1.

It is appreciated that a function of VGR2877 gene, herein designated VGR GENE, is inhibition of expression of host target genes, as part of a novel viral mechanism of attacking a host. Accordingly, utilities of VGR2877 gene include diagnosis, prevention and treatment of viral infection by Cercopithecine Herpesvirus 7. Specific functions, and accordingly utilities, of VGR2877 gene correlate with, and may be deduced from, the identity of the host target genes, which are inhibited by VGAM RNAs comprised in the 'operon-like' cluster of VGR2877 gene: VGAM715 host target protein, VGAM716 host target protein, VGAM717 host target protein and VGAM718 host target protein, herein schematically represented by VGAM1 HOST TARGET PROTEIN through VGAM3 HOST TARGET PROTEIN. The function of these host target genes is elaborated hereinabove with reference to VGAM715, VGAM716, VGAM717 and VGAM718. FIG. 9 further provides a conceptual description of novel bioinformatically detected regulatory viral gene, referred to here as Viral Genomic Record 2878(VGR2878) viral gene, which encodes an 'operon-like' cluster of novel viral micro RNA-like genes, each of which in turn modulates expression of at least one host target gene, the function and utility of which at least one host target gene is known in the art.

VGR2878 gene, herein designated VGR GENE, is a novel bioinformatically detected regulatory, non protein coding, RNA viral gene. The method by which VGR2878 gene was detected is described hereinabove with reference to FIGS. 1-9.

VGR2878 gene encodes VGR2878 precursor RNA, herein designated VGR PRECURSOR RNA, an RNA molecule, typically several hundred nucleotides long.

VGR2878 precursor RNA folds spatially, forming VGR2878 folded precursor RNA, herein designated VGR FOLDED PRECURSOR RNA. It is appreciated that VGR2878 folded precursor RNA comprises a plurality of what is known in the art as 'hairpin' structures. These 'hairpin' structures are due to the fact that the nucleotide sequence of VGR2878 precursor RNA comprises a plurality of segments, the first half of each such segment having a nucleotide sequence which is at least a partial inversed-reversed sequence of the second half thereof, as is well known in the art.

VGR2878 folded precursor RNA is naturally processed by cellular enzymatic activity into at least 2 separate VGAM precursor RNAs, VGAM719 precursor RNA and VGAM720 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM719 RNA and VGAM720 RNA, herein schematically represented by VGAM1 RNA through VGAM3 RNA, each of which VGAM RNAs corresponding to VGAM RNA of FIG. 1.

VGAM719 RNA, herein schematically represented by VGAM1 RNA through VGAM3 RNA, binds complementarily to a host target binding site located in an untranslated region of VGAM719 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM719 host target RNA into VGAM719 host target protein, herein schematically represented by VGAM1 HOST TARGET PROTEIN through VGAM3 HOST TARGET PROTEIN, all of FIG. 1.

VGAM720 RNA, herein schematically represented by VGAM1 RNA through VGAM3 RNA, binds complementarily to a host target binding site located in an untranslated region of VGAM720 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM720 host target RNA into VGAM720 host target protein, herein schematically represented by VGAM1 HOST TARGET PROTEIN through VGAM3 HOST TARGET PROTEIN, all of FIG. 1.

It is appreciated that a function of VGR2878 gene, herein designated VGR GENE, is inhibition of expression of host target genes, as part of a novel viral mechanism of attacking a host. Accordingly, utilities of VGR2878 gene include diagnosis, prevention and treatment of viral infection by Ectocarpus Siliculosus Virus. Specific functions, and accordingly utilities, of VGR2878 gene correlate with, and may be deduced from, the identity of the host target genes, which are inhibited by VGAM RNAs comprised in the 'operon-like' cluster of VGR2878 gene: VGAM719 host target protein and VGAM720 host target protein, herein schematically represented by VGAM1 HOST TARGET PROTEIN through VGAM3 HOST TARGET PROTEIN. The function of these host target genes is elaborated hereinabove with reference to VGAM719 and VGAM720. FIG. 9 further provides a conceptual description of novel bioinformatically detected regulatory viral gene, referred to here as Viral Genomic Record 2879(VGR2879) viral gene, which encodes an 'operon-like' cluster of novel viral micro RNA-like genes, each of which in turn modulates expression of at least one host target gene, the function and utility of which at least one host target gene is known in the art.

VGR2879 gene, herein designated VGR GENE, is a novel bioinformatically detected regulatory, non protein coding, RNA viral gene. The method by which VGR2879 gene was detected is described hereinabove with reference to FIGS. 1-9.

VGR2879 gene encodes VGR2879 precursor RNA, herein designated VGR PRECURSOR RNA, an RNA molecule, typically several hundred nucleotides long.

VGR2879 precursor RNA folds spatially, forming VGR2879 folded precursor RNA, herein designated VGR FOLDED PRECURSOR RNA. It is appreciated that VGR2879 folded precursor RNA comprises a plurality of what is known in the art as 'hairpin' structures. These 'hairpin' structures are due to the fact that the nucleotide sequence of VGR2879 precursor RNA comprises a plurality of segments, the first half of each such segment having a nucleotide sequence which is at least a partial inversed-reversed sequence of the second half thereof, as is well known in the art.

VGR2879 folded precursor RNA is naturally processed by cellular enzymatic activity into at least 5 separate VGAM precursor RNAs, VGAM721 precursor RNA, VGAM722 precursor RNA, VGAM723 precursor RNA, VGAM724 precursor RNA and VGAM725 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM721 RNA, VGAM722 RNA, VGAM723 RNA, VGAM724 RNA and VGAM725 RNA, herein schematically represented by VGAM1 RNA through VGAM3 RNA, each of which VGAM RNAs corresponding to VGAM RNA of FIG. 1.

VGAM721 RNA, herein schematically represented by VGAM1 RNA through VGAM3 RNA, binds complementarily to a host target binding site located in an untranslated region of VGAM721 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM721 host target RNA into VGAM721 host target protein, herein schematically represented by VGAM1 HOST TARGET PROTEIN through VGAM3 HOST TARGET PROTEIN, all of FIG. 1.

VGAM722 RNA, herein schematically represented by VGAM1 RNA through VGAM3 RNA, binds complementarily to a host target binding site located in an untranslated region of VGAM722 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM722 host target RNA into VGAM722 host target protein, herein schematically represented by VGAM1 HOST TARGET PROTEIN through VGAM3 HOST TARGET PROTEIN, all of FIG. 1.

VGAM723 RNA, herein schematically represented by VGAM1 RNA through VGAM3 RNA, binds complementarily to a host target binding site located in an untranslated region of VGAM723 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM723 host target RNA into VGAM723 host target protein, herein schematically represented by VGAM1 HOST TARGET PROTEIN through VGAM3 HOST TARGET PROTEIN, all of FIG. 1.

VGAM724 RNA, herein schematically represented by VGAM1 RNA through VGAM3 RNA, binds complementarily to a host target binding site located in an untranslated region of VGAM724 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM724 host target RNA into VGAM724 host target protein, herein schematically represented by VGAM1 HOST TARGET PROTEIN through VGAM3 HOST TARGET PROTEIN, all of FIG. 1.

VGAM725 RNA, herein schematically represented by VGAM1 RNA through VGAM3 RNA, binds complementarily to a host target binding site located in an untranslated region of VGAM725 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM725 host target RNA into VGAM725 host target protein, herein schematically represented by VGAM1 HOST TARGET PROTEIN through VGAM3 HOST TARGET PROTEIN, all of FIG. 1.

It is appreciated that a function of VGR2879 gene, herein designated VGR GENE, is inhibition of expression of host target genes, as part of a novel viral mechanism of attacking a host. Accordingly, utilities of VGR2879 gene include diagnosis, prevention and treatment of viral infection by Tomato Mosaic Virus. Specific functions, and accordingly utilities, of VGR2879 gene correlate with, and may be deduced from, the identity of the host target genes, which are inhibited by VGAM RNAs comprised in the 'operon-like' cluster of VGR2879 gene: VGAM721 host target protein, VGAM722 host target protein, VGAM723 host target protein, VGAM724 host target protein and VGAM725 host target protein, herein schematically represented by VGAM1 HOST TARGET PROTEIN through VGAM3 HOST TARGET PROTEIN. The function of these host target genes is elaborated hereinabove with reference to VGAM721, VGAM722, VGAM723, VGAM724 and VGAM725. FIG. 9 further provides a conceptual description of novel bioinformatically detected regulatory viral gene, referred to here as Viral Genomic Record 2880(VGR2880) viral gene, which encodes an 'operon-like' cluster of novel viral micro RNA-like genes, each of which in turn modulates expression of at least one host target gene, the function and utility of which at least one host target gene is known in the art.

VGR2880 gene, herein designated VGR GENE, is a novel bioinformatically detected regulatory, non protein coding, RNA viral gene. The method by which VGR2880 gene was detected is described hereinabove with reference to FIGS. 1-9.

VGR2880 gene encodes VGR2880 precursor RNA, herein designated VGR PRECURSOR RNA, an RNA molecule, typically several hundred nucleotides long.

VGR2880 precursor RNA folds spatially, forming VGR2880 folded precursor RNA, herein designated VGR FOLDED PRECURSOR RNA. It is appreciated that VGR2880 folded precursor RNA comprises a plurality of what is known in the art as 'hairpin' structures. These 'hairpin' structures are due to the fact that the nucleotide sequence of VGR2880 precursor RNA comprises a plurality of segments, the first half of each such segment having a nucleotide sequence which is at least a partial inversed-reversed sequence of the second half thereof, as is well known in the art.

VGR2880 folded precursor RNA is naturally processed by cellular enzymatic activity into at least 2 separate VGAM precursor RNAs, VGAM727 precursor RNA and VGAM728 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM727 RNA and VGAM728 RNA, herein schematically represented by VGAM1 RNA through VGAM3 RNA, each of which VGAM RNAs corresponding to VGAM RNA of FIG. 1.

VGAM727 RNA, herein schematically represented by VGAM1 RNA through VGAM3 RNA, binds complementarily to a host target binding site located in an untranslated region of VGAM727 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM727 host target RNA into VGAM727 host target protein, herein schematically represented by VGAM1 HOST TARGET PROTEIN through VGAM3 HOST TARGET PROTEIN, all of FIG. 1.

VGAM728 RNA, herein schematically represented by VGAM1 RNA through VGAM3 RNA, binds complementarily to a host target binding site located in an untranslated region of VGAM728 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM728 host target RNA into VGAM728 host target protein, herein schematically represented by VGAM1 HOST TARGET PROTEIN through VGAM3 HOST TARGET PROTEIN, all of FIG. 1.

It is appreciated that a function of VGR2880 gene, herein designated VGR GENE, is inhibition of expression of host target genes, as part of a novel viral mechanism of attacking a host. Accordingly, utilities of VGR2880 gene include diagnosis, prevention and treatment of viral infection by Aconitum Latent Virus. Specific functions, and accordingly utilities, of VGR2880 gene correlate with, and may be deduced from, the identity of the host target genes, which are inhibited by VGAM RNAs comprised in the 'operon-like' cluster of VGR2880 gene: VGAM727 host target protein and VGAM728 host target protein, herein schematically represented by VGAM1 HOST TARGET PROTEIN through VGAM3 HOST TARGET PROTEIN. The function of these host target genes is elaborated hereinabove with reference to VGAM727 and VGAM728. FIG. 9 further provides a conceptual description of novel bioinformatically detected regulatory viral gene, referred to here as Viral Genomic Record 2881(VGR2881) viral gene, which encodes an 'operon-like' cluster of novel viral micro RNA-like genes, each of which in turn modulates expression of at least one host target gene, the function and utility of which at least one host target gene is known in the art.

VGR2881 gene, herein designated VGR GENE, is a novel bioinformatically detected regulatory, non protein coding, RNA viral gene. The method by which VGR2881 gene was detected is described hereinabove with reference to FIGS. 1-9.

VGR2881 gene encodes VGR2881 precursor RNA, herein designated VGR PRECURSOR RNA, an RNA molecule, typically several hundred nucleotides long.

VGR2881 precursor RNA folds spatially, forming VGR2881 folded precursor RNA, herein designated VGR FOLDED PRECURSOR RNA. It is appreciated that VGR2881 folded precursor RNA comprises a plurality of what is known in the art as 'hairpin' structures. These 'hairpin' structures are due to the fact that the nucleotide sequence of VGR2881 precursor RNA comprises a plurality of segments, the first half of each such segment having a nucleotide sequence which is at least a partial inversed-reversed sequence of the second half thereof, as is well known in the art.

VGR2881 folded precursor RNA is naturally processed by cellular enzymatic activity into at least 4 separate VGAM precursor RNAs, VGAM729 precursor RNA, VGAM730 precursor RNA, VGAM731 precursor RNA and VGAM732 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM729 RNA, VGAM730 RNA, VGAM731 RNA and VGAM732 RNA, herein schematically represented by VGAM1 RNA through VGAM3 RNA, each of which VGAM RNAs corresponding to VGAM RNA of FIG. 1.

VGAM729 RNA, herein schematically represented by VGAM1 RNA through VGAM3 RNA, binds complementarily to a host target binding site located in an untranslated region of VGAM729 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM729 host target RNA into VGAM729 host target protein, herein schematically represented by VGAM1 HOST TARGET PROTEIN through VGAM3 HOST TARGET PROTEIN, all of FIG. 1.

VGAM730 RNA, herein schematically represented by VGAM1 RNA through VGAM3 RNA, binds complementarily to a host target binding site located in an untranslated region of VGAM730 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM730 host target RNA into VGAM730 host target protein, herein schematically represented by VGAM1 HOST TARGET PROTEIN through VGAM3 HOST TARGET PROTEIN, all of FIG. 1.

VGAM731 RNA, herein schematically represented by VGAM1 RNA through VGAM3 RNA, binds complementarily to a host target binding site located in an untranslated region of VGAM731 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM731 host target RNA into VGAM731 host target protein, herein schematically represented by VGAM1 HOST TARGET PROTEIN through VGAM3 HOST TARGET PROTEIN, all of FIG. 1.

VGAM732 RNA, herein schematically represented by VGAM1 RNA through VGAM3 RNA, binds complementarily to a host target binding site located in an untranslated region of VGAM732 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM732 host target RNA into VGAM732 host target protein, herein schematically represented by VGAM1 HOST TARGET PROTEIN through VGAM3 HOST TARGET PROTEIN, all of FIG. 1.

It is appreciated that a function of VGR2881 gene, herein designated VGR GENE, is inhibition of expression of host target genes, as part of a novel viral mechanism of attacking a host. Accordingly, utilities of VGR2881 gene include diagnosis, prevention and treatment of viral infection by Cydia Pomonella Granulovirus. Specific functions, and accordingly utilities, of VGR2881 gene correlate with, and may be deduced from, the identity of the host target genes, which are inhibited by VGAM RNAs comprised in the 'operon-like' cluster of VGR2881 gene: VGAM729 host target protein, VGAM730 host target protein, VGAM731 host target protein and VGAM732 host target protein, herein schematically represented by VGAM1 HOST TARGET PROTEIN through VGAM3 HOST TARGET PROTEIN. The function of these host target genes is elaborated hereinabove with reference to VGAM729, VGAM730, VGAM731 and VGAM732. FIG. 9 further provides a conceptual description of novel bioinformatically detected regulatory viral gene, referred to here as Viral Genomic Record 2882(VGR2882) viral gene, which encodes an 'operon-like' cluster of novel viral micro RNA-like genes, each of which in turn modulates expression of at least one host target gene, the function and utility of which at least one host target gene is known in the art.

VGR2882 gene, herein designated VGR GENE, is a novel bioinformatically detected regulatory, non protein coding, RNA viral gene. The method by which VGR2882 gene was detected is described hereinabove with reference to FIGS. 1-9.

VGR2882 gene encodes VGR2882 precursor RNA, herein designated VGR PRECURSOR RNA, an RNA molecule, typically several hundred nucleotides long.

VGR2882 precursor RNA folds spatially, forming VGR2882 folded precursor RNA, herein designated VGR FOLDED PRECURSOR RNA. It is appreciated that VGR2882 folded precursor RNA comprises a plurality of what is known in the art as 'hairpin' structures. These 'hairpin' structures are due to the fact that the nucleotide sequence of VGR2882 precursor RNA comprises a plurality of segments, the first half of each such segment having a nucleotide sequence which is at least a partial inversed-reversed sequence of the second half thereof, as is well known in the art.

VGR2882 folded precursor RNA is naturally processed by cellular enzymatic activity into at least 6 separate VGAM precursor RNAs, VGAM733 precursor RNA, VGAM734 precursor RNA, VGAM735 precursor RNA, VGAM736 precursor RNA, VGAM737 precursor RNA and VGAM738 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM733 RNA, VGAM734 RNA, VGAM735 RNA, VGAM736 RNA, VGAM737 RNA and VGAM738 RNA, herein schematically represented by VGAM1 RNA through VGAM3 RNA, each of which VGAM RNAs corresponding to VGAM RNA of FIG. 1.

VGAM733 RNA, herein schematically represented by VGAM1 RNA through VGAM3 RNA, binds complementarily to a host target binding site located in an untranslated region of VGAM733 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM733 host target RNA into VGAM733 host target protein, herein schematically represented by VGAM1 HOST TARGET PROTEIN through VGAM3 HOST TARGET PROTEIN, all of FIG. 1.

VGAM734 RNA, herein schematically represented by VGAM1 RNA through VGAM3 RNA, binds complementarily to a host target binding site located in an untranslated region of VGAM734 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM734 host target RNA into VGAM734 host target protein, herein schematically represented by VGAM1 HOST TARGET PROTEIN through VGAM3 HOST TARGET PROTEIN, all of FIG. 1.

VGAM735 RNA, herein schematically represented by VGAM1 RNA through VGAM3 RNA, binds complementarily to a host target binding site located in an untranslated region of VGAM735 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM735 host target RNA into VGAM735 host target protein, herein schematically represented by VGAM1 HOST TARGET PROTEIN through VGAM3 HOST TARGET PROTEIN, all of FIG. 1.

VGAM736 RNA, herein schematically represented by VGAM1 RNA through VGAM3 RNA, binds complementarily to a host target binding site located in an untranslated region of VGAM736 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM736 host target RNA into VGAM736 host target protein, herein schematically represented by VGAM1 HOST TARGET PROTEIN through VGAM3 HOST TARGET PROTEIN, all of FIG. 1.

VGAM737 RNA, herein schematically represented by VGAM1 RNA through VGAM3 RNA, binds complementarily to a host target binding site located in an untranslated region of VGAM737 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM737 host target RNA into VGAM737 host target protein, herein schematically represented by VGAM1 HOST TARGET PROTEIN through VGAM3 HOST TARGET PROTEIN, all of FIG. 1.

VGAM738 RNA, herein schematically represented by VGAM1 RNA through VGAM3 RNA, binds complementarily to a host target binding site located in an untranslated region of VGAM738 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM738 host target RNA into VGAM738 host target protein, herein schematically represented by VGAM1 HOST TARGET PROTEIN through VGAM3 HOST TARGET PROTEIN, all of FIG. 1.

It is appreciated that a function of VGR2882 gene, herein designated VGR GENE, is inhibition of expression of host target genes, as part of a novel viral mechanism of attacking a host. Accordingly, utilities of VGR2882 gene include diagnosis, prevention and treatment of viral infection by Barley Yellow Mosaic Virus. Specific functions, and accordingly utilities, of VGR2882 gene correlate with, and may be deduced from, the identity of the host target genes, which are inhibited by VGAM RNAs comprised in the 'operon-like' cluster of VGR2882 gene: VGAM733 host target protein, VGAM734 host target protein, VGAM735 host target protein, VGAM736 host target protein, VGAM737 host target protein and VGAM738 host target protein, herein schematically represented by VGAM1 HOST TARGET PROTEIN through VGAM3 HOST TARGET PROTEIN. The function of these host target genes is elaborated hereinabove with reference to VGAM733, VGAM734, VGAM735, VGAM736, VGAM737 and VGAM738. FIG. 9 further provides a conceptual description of novel bioinformatically detected regulatory viral gene, referred to here as Viral Genomic Record 2883(VGR2883) viral gene, which encodes an 'operon-like' cluster of novel viral micro RNA-like genes, each of which in turn modulates expression of at least one host target gene, the function and utility of which at least one host target gene is known in the art.

VGR2883 gene, herein designated VGR GENE, is a novel bioinformatically detected regulatory, non protein coding, RNA viral gene. The method by which VGR2883 gene was detected is described hereinabove with reference to FIGS. 1-9.

VGR2883 gene encodes VGR2883 precursor RNA, herein designated VGR PRECURSOR RNA, an RNA molecule, typically several hundred nucleotides long.

VGR2883 precursor RNA folds spatially, forming VGR2883 folded precursor RNA, herein designated VGR FOLDED PRECURSOR RNA. It is appreciated that VGR2883 folded precursor RNA comprises a plurality of what is known in the art as 'hairpin' structures. These 'hairpin' structures are due to the fact that the nucleotide sequence of VGR2883 precursor RNA comprises a plurality of segments, the first half of each such segment having a nucleotide sequence which is at least a partial inversed-reversed sequence of the second half thereof, as is well known in the art.

VGR2883 folded precursor RNA is naturally processed by cellular enzymatic activity into at least 4 separate VGAM precursor RNAs, VGAM739 precursor RNA, VGAM740 precursor RNA, VGAM741 precursor RNA and VGAM742 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM739 RNA, VGAM740 RNA, VGAM741 RNA and VGAM742 RNA, herein schematically represented by VGAM1 RNA through VGAM3 RNA, each of which VGAM RNAs corresponding to VGAM RNA of FIG. 1.

VGAM739 RNA, herein schematically represented by VGAM1 RNA through VGAM3 RNA, binds complementarily to a host target binding site located in an untranslated region of VGAM739 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM739 host target RNA into VGAM739 host target protein, herein schematically represented by VGAM1 HOST TARGET PROTEIN through VGAM3 HOST TARGET PROTEIN, all of FIG. 1.

VGAM740 RNA, herein schematically represented by VGAM1 RNA through VGAM3 RNA, binds complementarily to a host target binding site located in an untranslated region of VGAM740 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM740 host target RNA into VGAM740 host target protein, herein schematically represented by VGAM1 HOST TARGET PROTEIN through VGAM3 HOST TARGET PROTEIN, all of FIG. 1.

VGAM741 RNA, herein schematically represented by VGAM1 RNA through VGAM3 RNA, binds complementarily to a host target binding site located in an untranslated region of VGAM741 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM741 host target RNA into VGAM741 host target protein, herein schematically represented by VGAM1 HOST TARGET PROTEIN through VGAM3 HOST TARGET PROTEIN, all of FIG. 1.

VGAM742 RNA, herein schematically represented by VGAM1 RNA through VGAM3 RNA, binds complementarily to a host target binding site located in an untranslated region of VGAM742 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM742 host target RNA into VGAM742 host target protein, herein schematically represented by VGAM1 HOST TARGET PROTEIN through VGAM3 HOST TARGET PROTEIN, all of FIG. 1.

It is appreciated that a function of VGR2883 gene, herein designated VGR GENE, is inhibition of expression of host target genes, as part of a novel viral mechanism of attacking a host. Accordingly, utilities of VGR2883 gene include diagnosis, prevention and treatment of viral infection by Taura Syndrome Virus. Specific functions, and accordingly utilities, of VGR2883 gene correlate with, and may be deduced from, the identity of the host target genes, which are inhibited by VGAM RNAs comprised in the 'operon-like' cluster of VGR2883 gene: VGAM739 host target protein, VGAM740 host target protein, VGAM741 host target protein and VGAM742 host target protein, herein schematically represented by VGAM1 HOST TARGET PROTEIN through VGAM3 HOST TARGET PROTEIN. The function of these host target genes is elaborated hereinabove with reference to VGAM739, VGAM740, VGAM741 and VGAM742. FIG. 9 further provides a conceptual description of novel bioinformatically detected regulatory viral gene, referred to here as Viral Genomic Record 2884(VGR2884) viral gene, which encodes an 'operon-like' cluster of novel viral micro RNA-like genes, each of which in turn modulates expression of at least one host target gene, the function and utility of which at least one host target gene is known in the art.

VGR2884 gene, herein designated VGR GENE, is a novel bioinformatically detected regulatory, non protein coding, RNA viral gene. The method by which VGR2884 gene was detected is described hereinabove with reference to FIGS. 1-9.

VGR2884 gene encodes VGR2884 precursor RNA, herein designated VGR PRECURSOR RNA, an RNA molecule, typically several hundred nucleotides long.

VGR2884 precursor RNA folds spatially, forming VGR2884 folded precursor RNA, herein designated VGR FOLDED PRECURSOR RNA. It is appreciated that VGR2884 folded precursor RNA comprises a plurality of what is known in the art as 'hairpin' structures. These 'hairpin' structures are due to the fact that the nucleotide sequence of VGR2884 precursor RNA comprises a plurality of segments, the first half of each such segment having a nucleotide sequence which is at least a partial inversed-reversed sequence of the second half thereof, as is well known in the art.

VGR2884 folded precursor RNA is naturally processed by cellular enzymatic activity into at least 8 separate VGAM precursor RNAs, VGAM744 precursor RNA, VGAM745 precursor RNA, VGAM746 precursor RNA, VGAM747 precursor RNA, VGAM748 precursor RNA, VGAM749 precursor RNA, VGAM750 precursor RNA and VGAM751 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM744 RNA, VGAM745 RNA, VGAM746 RNA, VGAM747 RNA, VGAM748 RNA, VGAM749 RNA, VGAM750 RNA and VGAM751 RNA, herein schematically represented by VGAM1 RNA through VGAM3 RNA, each of which VGAM RNAs corresponding to VGAM RNA of FIG. 1.

VGAM744 RNA, herein schematically represented by VGAM1 RNA through VGAM3 RNA, binds complementarily to a host target binding site located in an untranslated region of VGAM744 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM744 host target RNA into VGAM744 host target protein, herein schematically represented by VGAM1 HOST TARGET PROTEIN through VGAM3 HOST TARGET PROTEIN, all of FIG. 1.

VGAM745 RNA, herein schematically represented by VGAM1 RNA through VGAM3 RNA, binds complementarily to a host target binding site located in an untranslated region of VGAM745 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM745 host target RNA into VGAM745 host target protein, herein schematically represented by VGAM1 HOST TARGET PROTEIN through VGAM3 HOST TARGET PROTEIN, all of FIG. 1.

VGAM746 RNA, herein schematically represented by VGAM1 RNA through VGAM3 RNA, binds complementarily to a host target binding site located in an untranslated region of VGAM746 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM746 host target RNA into VGAM746 host target protein, herein schematically represented by VGAM1 HOST TARGET PROTEIN through VGAM3 HOST TARGET PROTEIN, all of FIG. 1.

VGAM747 RNA, herein schematically represented by VGAM1 RNA through VGAM3 RNA, binds complementarily to a host target binding site located in an untranslated region of VGAM747 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM747 host target RNA into VGAM747 host target protein, herein schematically represented by VGAM1 HOST TARGET PROTEIN through VGAM3 HOST TARGET PROTEIN, all of FIG. 1.

VGAM748 RNA, herein schematically represented by VGAM1 RNA through VGAM3 RNA, binds complementarily to a host target binding site located in an untranslated region of VGAM748 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM748 host target RNA into VGAM748 host target protein, herein schematically represented by VGAM1 HOST TARGET PROTEIN through VGAM3 HOST TARGET PROTEIN, all of FIG. 1.

VGAM749 RNA, herein schematically represented by VGAM1 RNA through VGAM3 RNA, binds complementarily to a host target binding site located in an untranslated region of VGAM749 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM749 host target RNA into VGAM749 host target protein, herein schematically represented by VGAM1 HOST TARGET PROTEIN through VGAM3 HOST TARGET PROTEIN, all of FIG. 1.

VGAM750 RNA, herein schematically represented by VGAM1 RNA through VGAM3 RNA, binds complementarily to a host target binding site located in an untranslated region of VGAM750 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM750 host target RNA into VGAM750 host target protein, herein schematically represented by VGAM1 HOST TARGET PROTEIN through VGAM3 HOST TARGET PROTEIN, all of FIG. 1.

VGAM751 RNA, herein schematically represented by VGAM1 RNA through VGAM3 RNA, binds complementarily to a host target binding site located in an untranslated region of VGAM751 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM751 host target RNA into VGAM751 host target protein, herein schematically represented by VGAM1 HOST TARGET PROTEIN through VGAM3 HOST TARGET PROTEIN, all of FIG. 1.

It is appreciated that a function of VGR2884 gene, herein designated VGR GENE, is inhibition of expression of host target genes, as part of a novel viral mechanism of attacking a host. Accordingly, utilities of VGR2884 gene include diagnosis, prevention and treatment of viral infection by Bovine Coronavirus. Specific functions, and accordingly utilities, of VGR2884 gene correlate with, and may be deduced from, the identity of the host target genes, which are inhibited by VGAM RNAs comprised in the 'operon-like' cluster of VGR2884 gene: VGAM744 host target protein, VGAM745 host target protein, VGAM746 host target protein, VGAM747 host target protein, VGAM748 host target protein, VGAM749 host target protein, VGAM750 host target protein and VGAM751 host target protein, herein schematically represented by VGAM1 HOST TARGET PROTEIN through VGAM3 HOST TARGET PROTEIN. The function of these host target genes is elaborated hereinabove with reference to VGAM744, VGAM745, VGAM746, VGAM747, VGAM748, VGAM749, VGAM750 and VGAM751. FIG. 9 further provides a conceptual description of novel bioinformatically detected regulatory viral gene, referred to here as Viral Genomic Record 2885(VGR2885) viral gene, which encodes an 'operon-like' cluster of novel viral micro RNA-like genes, each of which in turn modulates expression of at least one host target gene, the function and utility of which at least one host target gene is known in the art.

VGR2885 gene, herein designated VGR GENE, is a novel bioinformatically detected regulatory, non protein coding, RNA viral gene. The method by which VGR2885 gene was detected is described hereinabove with reference to FIGS. 1-9.

VGR2885 gene encodes VGR2885 precursor RNA, herein designated VGR PRECURSOR RNA, an RNA molecule, typically several hundred nucleotides long.

VGR2885 precursor RNA folds spatially, forming VGR2885 folded precursor RNA, herein designated VGR FOLDED PRECURSOR RNA. It is appreciated that VGR2885 folded precursor RNA comprises a plurality of what is known in the art as 'hairpin' structures. These 'hairpin' structures are due to the fact that the nucleotide sequence of VGR2885 precursor RNA comprises a plurality of segments, the first half of each such segment having a nucleotide sequence which is at least a partial inversed-reversed sequence of the second half thereof, as is well known in the art.

VGR2885 folded precursor RNA is naturally processed by cellular enzymatic activity into at least 8 separate VGAM precursor RNAs, VGAM752 precursor RNA, VGAM753 precursor RNA, VGAM754 precursor RNA, VGAM755 precursor RNA, VGAM756 precursor RNA, VGAM757 precursor RNA, VGAM758 precursor RNA and VGAM759 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM752 RNA, VGAM753 RNA, VGAM754 RNA, VGAM755 RNA, VGAM756 RNA, VGAM757 RNA, VGAM758 RNA and VGAM759 RNA, herein schematically represented by VGAM1 RNA through VGAM3 RNA, each of which VGAM RNAs corresponding to VGAM RNA of FIG. 1.

VGAM752 RNA, herein schematically represented by VGAM1 RNA through VGAM3 RNA, binds complementarily to a host target binding site located in an untranslated region of VGAM752 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM752 host target RNA into VGAM752 host target protein, herein schematically represented by VGAM1 HOST TARGET PROTEIN through VGAM3 HOST TARGET PROTEIN, all of FIG. 1.

VGAM753 RNA, herein schematically represented by VGAM1 RNA through VGAM3 RNA, binds complementarily to a host target binding site located in an untranslated region of VGAM753 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM753 host target RNA into VGAM753 host target protein, herein schematically represented by VGAM1 HOST TARGET PROTEIN through VGAM3 HOST TARGET PROTEIN, all of FIG. 1.

VGAM754 RNA, herein schematically represented by VGAM1 RNA through VGAM3 RNA, binds complementarily to a host target binding site located in an untranslated region of VGAM754 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM754 host target RNA into VGAM754 host target protein, herein schematically represented by VGAM1 HOST TARGET PROTEIN through VGAM3 HOST TARGET PROTEIN, all of FIG. 1.

VGAM755 RNA, herein schematically represented by VGAM1 RNA through VGAM3 RNA, binds complementarily to a host target binding site located in an untranslated region of VGAM755 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM755 host target RNA into VGAM755 host target protein, herein schematically represented by VGAM1 HOST TARGET PROTEIN through VGAM3 HOST TARGET PROTEIN, all of FIG. 1.

VGAM756 RNA, herein schematically represented by VGAM1 RNA through VGAM3 RNA, binds complementarily to a host target binding site located in an untranslated region of VGAM756 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM756 host target RNA into VGAM756 host target protein, herein schematically represented by VGAM1 HOST TARGET PROTEIN through VGAM3 HOST TARGET PROTEIN, all of FIG. 1.

VGAM757 RNA, herein schematically represented by VGAM1 RNA through VGAM3 RNA, binds complementarily to a host target binding site located in an untranslated region of VGAM757 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM757 host target RNA into VGAM757 host target protein, herein schematically represented by VGAM1 HOST TARGET PROTEIN through VGAM3 HOST TARGET PROTEIN, all of FIG. 1.

VGAM758 RNA, herein schematically represented by VGAM1 RNA through VGAM3 RNA, binds complementarily to a host target binding site located in an untranslated region of VGAM758 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM758 host target RNA into VGAM758 host target protein, herein schematically represented by VGAM1 HOST TARGET PROTEIN through VGAM3 HOST TARGET PROTEIN, all of FIG. 1.

VGAM759 RNA, herein schematically represented by VGAM1 RNA through VGAM3 RNA, binds complementarily to a host target binding site located in an untranslated region of VGAM759 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM759 host target RNA into VGAM759 host target protein, herein schematically represented by VGAM1 HOST TARGET PROTEIN through VGAM3 HOST TARGET PROTEIN, all of FIG. 1.

It is appreciated that a function of VGR2885 gene, herein designated VGR GENE, is inhibition of expression of host target genes, as part of a novel viral mechanism of attacking a host. Accordingly, utilities of VGR2885 gene include diagnosis, prevention and treatment of viral infection by Bovine Coronavirus. Specific functions, and accordingly utilities, of VGR2885 gene correlate with, and may be deduced from, the identity of the host target genes, which are inhibited by VGAM RNAs comprised in the 'operon-like' cluster of VGR2885 gene: VGAM752 host target protein, VGAM753 host target protein, VGAM754 host target protein, VGAM755 host target protein, VGAM756 host target protein, VGAM757 host target protein, VGAM758 host target protein and VGAM759 host target protein, herein schematically represented by VGAM1 HOST TARGET PROTEIN through VGAM3 HOST TARGET PROTEIN. The function of these host target genes is elaborated hereinabove with reference to VGAM752, VGAM753, VGAM754, VGAM755, VGAM756, VGAM757, VGAM758 and VGAM759. FIG. 9 further provides a conceptual description of novel bioinformatically detected regulatory viral gene, referred to here as Viral Genomic Record 2886(VGR2886) viral gene, which encodes an 'operon-like' cluster of novel viral micro RNA-like genes, each of which in turn modulates expression of at least one host target gene, the function and utility of which at least one host target gene is known in the art.

VGR2886 gene, herein designated VGR GENE, is a novel bioinformatically detected regulatory, non protein coding, RNA viral gene. The method by which VGR2886 gene was detected is described hereinabove with reference to FIGS. 1-9.

VGR2886 gene encodes VGR2886 precursor RNA, herein designated VGR PRECURSOR RNA, an RNA molecule, typically several hundred nucleotides long.

VGR2886 precursor RNA folds spatially, forming VGR2886 folded precursor RNA, herein designated VGR FOLDED PRECURSOR RNA. It is appreciated that VGR2886 folded precursor RNA comprises a plurality of what is known in the art as 'hairpin' structures. These 'hairpin' structures are due to the fact that the nucleotide sequence of VGR2886 precursor RNA comprises a plurality of segments, the first half of each such segment having a nucleotide sequence which is at least a partial inversed-reversed sequence of the second half thereof, as is well known in the art.

VGR2886 folded precursor RNA is naturally processed by cellular enzymatic activity into at least 8 separate VGAM precursor RNAs, VGAM760 precursor RNA, VGAM761 precursor RNA, VGAM762 precursor RNA, VGAM763 precursor RNA, VGAM764 precursor RNA, VGAM765 precursor RNA, VGAM766 precursor RNA and VGAM767 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM760 RNA, VGAM761 RNA, VGAM762 RNA, VGAM763 RNA, VGAM764 RNA, VGAM765 RNA, VGAM766 RNA and VGAM767 RNA, herein schematically represented by VGAM1 RNA through VGAM3 RNA, each of which VGAM RNAs corresponding to VGAM RNA of FIG. 1.

VGAM760 RNA, herein schematically represented by VGAM1 RNA through VGAM3 RNA, binds complementarily to a host target binding site located in an untranslated region of VGAM760 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM760 host target RNA into VGAM760 host target protein, herein schematically represented by VGAM1 HOST TARGET PROTEIN through VGAM3 HOST TARGET PROTEIN, all of FIG. 1.

VGAM761 RNA, herein schematically represented by VGAM1 RNA through VGAM3 RNA, binds complementarily to a host target binding site located in an untranslated region of VGAM761 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM761 host target RNA into VGAM761 host target protein, herein schematically represented by VGAM1 HOST TARGET PROTEIN through VGAM3 HOST TARGET PROTEIN, all of FIG. 1.

VGAM762 RNA, herein schematically represented by VGAM1 RNA through VGAM3 RNA, binds complementarily to a host target binding site located in an untranslated region of VGAM762 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM762 host target RNA into VGAM762 host target protein, herein schematically represented by VGAM1 HOST TARGET PROTEIN through VGAM3 HOST TARGET PROTEIN, all of FIG. 1.

VGAM763 RNA, herein schematically represented by VGAM1 RNA through VGAM3 RNA, binds complementarily to a host target binding site located in an untranslated region of VGAM763 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM763 host target RNA into VGAM763 host target protein, herein schematically represented by VGAM1 HOST TARGET PROTEIN through VGAM3 HOST TARGET PROTEIN, all of FIG. 1.

VGAM764 RNA, herein schematically represented by VGAM1 RNA through VGAM3 RNA, binds complementarily to a host target binding site located in an untranslated region of VGAM764 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM764 host target RNA into VGAM764 host target protein, herein schematically represented by VGAM1 HOST TARGET PROTEIN through VGAM3 HOST TARGET PROTEIN, all of FIG. 1.

VGAM765 RNA, herein schematically represented by VGAM1 RNA through VGAM3 RNA, binds complementarily to a host target binding site located in an untranslated region of VGAM765 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM765 host target RNA into VGAM765 host target protein, herein schematically represented by VGAM1 HOST TARGET PROTEIN through VGAM3 HOST TARGET PROTEIN, all of FIG. 1.

VGAM766 RNA, herein schematically represented by VGAM1 RNA through VGAM3 RNA, binds complementarily to a host target binding site located in an untranslated region of VGAM766 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM766 host target RNA into VGAM766 host target protein, herein schematically represented by VGAM1 HOST TARGET PROTEIN through VGAM3 HOST TARGET PROTEIN, all of FIG. 1.

VGAM767 RNA, herein schematically represented by VGAM1 RNA through VGAM3 RNA, binds complementarily to a host target binding site located in an untranslated region of VGAM767 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM767 host target RNA into VGAM767 host target protein, herein schematically represented by VGAM1 HOST TARGET PROTEIN through VGAM3 HOST TARGET PROTEIN, all of FIG. 1.

It is appreciated that a function of VGR2886 gene, herein designated VGR GENE, is inhibition of expression of host target genes, as part of a novel viral mechanism of attacking a host. Accordingly, utilities of VGR2886 gene include diagnosis, prevention and treatment of viral infection by Bovine Coronavirus. Specific functions, and accordingly utilities, of VGR2886 gene correlate with, and may be deduced from, the identity of the host target genes, which are inhibited by VGAM RNAs comprised in the 'operon-like' cluster of VGR2886 gene: VGAM760 host target protein, VGAM761 host target protein, VGAM762 host target protein, VGAM763 host target protein, VGAM764 host target protein, VGAM765 host target protein, VGAM766 host target protein and VGAM767 host target protein, herein schematically represented by VGAM1 HOST TARGET PROTEIN through VGAM3 HOST TARGET PROTEIN. The function of these host target genes is elaborated hereinabove with reference to VGAM760, VGAM761, VGAM762, VGAM763, VGAM764, VGAM765, VGAM766 and VGAM767. FIG. 9 further provides a conceptual description of novel bioinformatically detected regulatory viral gene, referred to here as Viral Genomic Record 2887(VGR2887) viral gene, which encodes an 'operon-like' cluster of novel viral micro RNA-like genes, each of which in turn modulates expression of at least one host target gene, the function and utility of which at least one host target gene is known in the art.

VGR2887 gene, herein designated VGR GENE, is a novel bioinformatically detected regulatory, non protein coding, RNA viral gene. The method by which VGR2887 gene was detected is described hereinabove with reference to FIGS. 1-9.

VGR2887 gene encodes VGR2887 precursor RNA, herein designated VGR PRECURSOR RNA, an RNA molecule, typically several hundred nucleotides long.

VGR2887 precursor RNA folds spatially, forming VGR2887 folded precursor RNA, herein designated VGR FOLDED PRECURSOR RNA. It is appreciated that VGR2887 folded precursor RNA comprises a plurality of what is known in the art as 'hairpin' structures. These 'hairpin' structures are due to the fact that the nucleotide sequence of VGR2887 precursor RNA comprises a plurality of segments, the first half of each such segment having a nucleotide sequence which is at least a partial inversed-reversed sequence of the second half thereof, as is well known in the art.

VGR2887 folded precursor RNA is naturally processed by cellular enzymatic activity into at least 2 separate VGAM precursor RNAs, VGAM768 precursor RNA and VGAM769 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM768 RNA and VGAM769 RNA, herein schematically represented by VGAM1 RNA through VGAM3 RNA, each of which VGAM RNAs corresponding to VGAM RNA of FIG. 1.

VGAM768 RNA, herein schematically represented by VGAM1 RNA through VGAM3 RNA, binds complementarily to a host target binding site located in an untranslated region of VGAM768 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM768 host target RNA into VGAM768 host target protein, herein schematically represented by VGAM1 HOST TARGET PROTEIN through VGAM3 HOST TARGET PROTEIN, all of FIG. 1.

VGAM769 RNA, herein schematically represented by VGAM1 RNA through VGAM3 RNA, binds complementarily to a host target binding site located in an untranslated region of VGAM769 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM769 host target RNA into VGAM769 host target protein, herein schematically represented by VGAM1 HOST TARGET PROTEIN through VGAM3 HOST TARGET PROTEIN, all of FIG. 1.

It is appreciated that a function of VGR2887 gene, herein designated VGR GENE, is inhibition of expression of host target genes, as part of a novel viral mechanism of attacking a host. Accordingly, utilities of VGR2887 gene include diagnosis, prevention and treatment of viral infection by Bovine Coronavirus. Specific functions, and accordingly utilities, of VGR2887 gene correlate with, and may be deduced from, the identity of the host target genes, which are inhibited by VGAM RNAs comprised in the 'operon-like' cluster of VGR2887 gene: VGAM768 host target protein and VGAM769 host target protein, herein schematically represented by VGAM1 HOST TARGET PROTEIN through VGAM3 HOST TARGET PROTEIN. The function of these host target genes is elaborated hereinabove with reference to VGAM768 and VGAM769. FIG. 9 further provides a conceptual description of novel bioinformatically detected regulatory viral gene, referred to here as Viral Genomic Record 2888(VGR2888) viral gene, which encodes an 'operon-like' cluster of novel viral micro RNA-like genes, each of which in turn modulates expression of at least one host target gene, the function and utility of which at least one host target gene is known in the art.

VGR2888 gene, herein designated VGR GENE, is a novel bioinformatically detected regulatory, non protein coding, RNA viral gene. The method by which VGR2888 gene was detected is described hereinabove with reference to FIGS. 1-9.

VGR2888 gene encodes VGR2888 precursor RNA, herein designated VGR PRECURSOR RNA, an RNA molecule, typically several hundred nucleotides long.

VGR2888 precursor RNA folds spatially, forming VGR2888 folded precursor RNA, herein designated VGR FOLDED PRECURSOR RNA. It is appreciated that VGR2888 folded precursor RNA comprises a plurality of what is known in the art as 'hairpin' structures. These 'hairpin' structures are due to the fact that the nucleotide sequence of VGR2888 precursor RNA comprises a plurality of segments, the first half of each such segment having a nucleotide sequence which is at least a partial inversed-reversed sequence of the second half thereof, as is well known in the art.

VGR2888 folded precursor RNA is naturally processed by cellular enzymatic activity into at least 5 separate VGAM precursor RNAs, VGAM771 precursor RNA, VGAM772 precursor RNA, VGAM773 precursor RNA, VGAM774 precursor RNA and VGAM775 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM771 RNA, VGAM772 RNA, VGAM773 RNA, VGAM774 RNA and VGAM775 RNA, herein schematically represented by VGAM1 RNA through VGAM3 RNA, each of which VGAM RNAs corresponding to VGAM RNA of FIG. 1.

VGAM771 RNA, herein schematically represented by VGAM1 RNA through VGAM3 RNA, binds complementarily to a host target binding site located in an untranslated region of VGAM771 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM771 host target RNA into VGAM771 host target protein, herein schematically represented by VGAM1 HOST TARGET PROTEIN through VGAM3 HOST TARGET PROTEIN, all of FIG. 1.

VGAM772 RNA, herein schematically represented by VGAM1 RNA through VGAM3 RNA, binds complementarily to a host target binding site located in an untranslated region of VGAM772 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM772 host target RNA into VGAM772 host target protein, herein schematically represented by VGAM1 HOST TARGET PROTEIN through VGAM3 HOST TARGET PROTEIN, all of FIG. 1.

VGAM773 RNA, herein schematically represented by VGAM1 RNA through VGAM3 RNA, binds complementarily to a host target binding site located in an untranslated region of VGAM773 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM773 host target RNA into VGAM773 host target protein, herein schematically represented by VGAM1 HOST TARGET PROTEIN through VGAM3 HOST TARGET PROTEIN, all of FIG. 1.

VGAM774 RNA, herein schematically represented by VGAM1 RNA through VGAM3 RNA, binds complementarily to a host target binding site located in an untranslated region of VGAM774 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM774 host target RNA into VGAM774 host target protein, herein schematically represented by VGAM1 HOST TARGET PROTEIN through VGAM3 HOST TARGET PROTEIN, all of FIG. 1.

VGAM775 RNA, herein schematically represented by VGAM1 RNA through VGAM3 RNA, binds complementarily to a host target binding site located in an untranslated region of VGAM775 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM775 host target RNA into VGAM775 host target protein, herein schematically represented by VGAM1 HOST TARGET PROTEIN through VGAM3 HOST TARGET PROTEIN, all of FIG. 1.

It is appreciated that a function of VGR2888 gene, herein designated VGR GENE, is inhibition of expression of host target genes, as part of a novel viral mechanism of attacking a host. Accordingly, utilities of VGR2888 gene include diagnosis, prevention and treatment of viral infection by Bovine Coronavirus. Specific functions, and accordingly utilities, of VGR2888 gene correlate with, and may be deduced from, the identity of the host target genes, which are inhibited by VGAM RNAs comprised in the 'operon-like' cluster of VGR2888 gene: VGAM771 host target protein, VGAM772 host target protein, VGAM773 host target protein, VGAM774 host target protein and VGAM775 host target protein, herein schematically represented by VGAM1 HOST TARGET PROTEIN through VGAM3 HOST TARGET PROTEIN. The function of these host target genes is elaborated hereinabove with reference to VGAM771, VGAM772, VGAM773, VGAM774 and VGAM775. FIG. 9 further provides a conceptual description of novel bioinformatically detected regulatory viral gene, referred to here as Viral Genomic Record 2889(VGR2889) viral gene, which encodes an 'operon-like' cluster of novel viral micro RNA-like genes, each of which in turn modulates expression of at least one host target gene, the function and utility of which at least one host target gene is known in the art.

VGR2889 gene, herein designated VGR GENE, is a novel bioinformatically detected regulatory, non protein coding, RNA viral gene. The method by which VGR2889 gene was detected is described hereinabove with reference to FIGS. 1-9.

VGR2889 gene encodes VGR2889 precursor RNA, herein designated VGR PRECURSOR RNA, an RNA molecule, typically several hundred nucleotides long.

VGR2889 precursor RNA folds spatially, forming VGR2889 folded precursor RNA, herein designated VGR FOLDED PRECURSOR RNA. It is appreciated that VGR2889 folded precursor RNA comprises a plurality of what is known in the art as 'hairpin' structures. These 'hairpin' structures are due to the fact that the nucleotide sequence of VGR2889 precursor RNA comprises a plurality of segments, the first half of each such segment having a nucleotide sequence which is at least a partial inversed-reversed sequence of the second half thereof, as is well known in the art.

VGR2889 folded precursor RNA is naturally processed by cellular enzymatic activity into at least 4 separate VGAM precursor RNAs, VGAM781 precursor RNA, VGAM782 precursor RNA, VGAM783 precursor RNA and VGAM784 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM781 RNA, VGAM782 RNA, VGAM783 RNA and VGAM784 RNA, herein schematically represented by VGAM1 RNA through VGAM3 RNA, each of which VGAM RNAs corresponding to VGAM RNA of FIG. 1.

VGAM781 RNA, herein schematically represented by VGAM1 RNA through VGAM3 RNA, binds complementarily to a host target binding site located in an untranslated region of VGAM781 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM781 host target RNA into VGAM781 host target protein, herein schematically represented by VGAM1 HOST TARGET PROTEIN through VGAM3 HOST TARGET PROTEIN, all of FIG. 1.

VGAM782 RNA, herein schematically represented by VGAM1 RNA through VGAM3 RNA, binds complementarily to a host target binding site located in an untranslated region of VGAM782 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM782 host target RNA into VGAM782 host target protein, herein schematically represented by VGAM1 HOST TARGET PROTEIN through VGAM3 HOST TARGET PROTEIN, all of FIG. 1.

VGAM783 RNA, herein schematically represented by VGAM1 RNA through VGAM3 RNA, binds complementarily to a host target binding site located in an untranslated region of VGAM783 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM783 host target RNA into VGAM783 host target protein, herein schematically represented by VGAM1 HOST TARGET PROTEIN through VGAM3 HOST TARGET PROTEIN, all of FIG. 1.

VGAM784 RNA, herein schematically represented by VGAM1 RNA through VGAM3 RNA, binds complementarily to a host target binding site located in an untranslated region of VGAM784 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM784 host target RNA into VGAM784 host target protein, herein schematically represented by VGAM1 HOST TARGET PROTEIN through VGAM3 HOST TARGET PROTEIN, all of FIG. 1.

It is appreciated that a function of VGR2889 gene, herein designated VGR GENE, is inhibition of expression of host target genes, as part of a novel viral mechanism of attacking a host. Accordingly, utilities of VGR2889 gene include diagnosis, prevention and treatment of viral infection by Deer Tick Virus. Specific functions, and accordingly utilities, of VGR2889 gene correlate with, and may be deduced from, the identity of the host target genes, which are inhibited by VGAM RNAs comprised in the 'operon-like' cluster of VGR2889 gene: VGAM781 host target protein, VGAM782 host target protein, VGAM783 host target protein and VGAM784 host target protein, herein schematically represented by VGAM1 HOST TARGET PROTEIN through VGAM3 HOST TARGET PROTEIN. The function of these host target genes is elaborated hereinabove with reference to VGAM781, VGAM782, VGAM783 and VGAM784. FIG. 9 further provides a conceptual description of novel bioinformatically detected regulatory viral gene, referred to here as Viral Genomic Record 2890(VGR2890) viral gene, which encodes an 'operon-like' cluster of novel viral micro RNA-like genes, each of which in turn modulates expression of at least one host target gene, the function and utility of which at least one host target gene is known in the art.

VGR2890 gene, herein designated VGR GENE, is a novel bioinformatically detected regulatory, non protein coding, RNA viral gene. The method by which VGR2890 gene was detected is described hereinabove with reference to FIGS. 1-9.

VGR2890 gene encodes VGR2890 precursor RNA, herein designated VGR PRECURSOR RNA, an RNA molecule, typically several hundred nucleotides long.

VGR2890 precursor RNA folds spatially, forming VGR2890 folded precursor RNA, herein designated VGR FOLDED PRECURSOR RNA. It is appreciated that VGR2890 folded precursor RNA comprises a plurality of what is known in the art as 'hairpin' structures. These 'hairpin' structures are due to the fact that the nucleotide sequence of VGR2890 precursor RNA comprises a plurality of segments, the first half of each such segment having a nucleotide sequence which is at least a partial inversed-reversed sequence of the second half thereof, as is well known in the art.

VGR2890 folded precursor RNA is naturally processed by cellular enzymatic activity into at least 4 separate VGAM precursor RNAs, VGAM785 precursor RNA, VGAM786 precursor RNA, VGAM787 precursor RNA and VGAM788 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM785 RNA, VGAM786 RNA, VGAM787 RNA and VGAM788 RNA, herein schematically represented by VGAM1 RNA through VGAM3 RNA, each of which VGAM RNAs corresponding to VGAM RNA of FIG. 1.

VGAM785 RNA, herein schematically represented by VGAM1 RNA through VGAM3 RNA, binds complementarily to a host target binding site located in an untranslated region of VGAM785 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM785 host target RNA into VGAM785 host target protein, herein schematically represented by VGAM1 HOST TARGET PROTEIN through VGAM3 HOST TARGET PROTEIN, all of FIG. 1.

VGAM786 RNA, herein schematically represented by VGAM1 RNA through VGAM3 RNA, binds complementarily to a host target binding site located in an untranslated region of VGAM786 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM786 host target RNA into VGAM786 host target protein, herein schematically represented by VGAM1 HOST TARGET PROTEIN through VGAM3 HOST TARGET PROTEIN, all of FIG. 1.

VGAM787 RNA, herein schematically represented by VGAM1 RNA through VGAM3 RNA, binds complementarily to a host target binding site located in an untranslated region of VGAM787 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM787 host target RNA into VGAM787 host target protein, herein schematically represented by VGAM1 HOST TARGET PROTEIN through VGAM3 HOST TARGET PROTEIN, all of FIG. 1.

VGAM788 RNA, herein schematically represented by VGAM1 RNA through VGAM3 RNA, binds complementarily to a host target binding site located in an untranslated region of VGAM788 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM788 host target RNA into VGAM788 host target protein, herein schematically represented by VGAM1 HOST TARGET PROTEIN through VGAM3 HOST TARGET PROTEIN, all of FIG. 1.

It is appreciated that a function of VGR2890 gene, herein designated VGR GENE, is inhibition of expression of host target genes, as part of a novel viral mechanism of attacking a host. Accordingly, utilities of VGR2890 gene include diagnosis, prevention and treatment of viral infection by Zucchini Yellow Mosaic Virus. Specific functions, and accordingly utilities, of VGR2890 gene correlate with, and may be deduced from, the identity of the host target genes, which are inhibited by VGAM RNAs comprised in the 'operon-like' cluster of VGR2890 gene: VGAM785 host target protein, VGAM786 host target protein, VGAM787 host target protein and VGAM788 host target protein, herein schematically represented by VGAM1 HOST TARGET PROTEIN through VGAM3 HOST TARGET PROTEIN. The function of these host target genes is elaborated hereinabove with reference to VGAM785, VGAM786, VGAM787 and VGAM788. FIG. 9 further provides a conceptual description of novel bioinformatically detected regulatory viral gene, referred to here as Viral Genomic Record 2891(VGR2891) viral gene, which encodes an 'operon-like' cluster of novel viral micro RNA-like genes, each of which in turn modulates expression of at least one host target gene, the function and utility of which at least one host target gene is known in the art.

VGR2891 gene, herein designated VGR GENE, is a novel bioinformatically detected regulatory, non protein coding, RNA viral gene. The method by which VGR2891 gene was detected is described hereinabove with reference to FIGS. 1-9.

VGR2891 gene encodes VGR2891 precursor RNA, herein designated VGR PRECURSOR RNA, an RNA molecule, typically several hundred nucleotides long.

VGR2891 precursor RNA folds spatially, forming VGR2891 folded precursor RNA, herein designated VGR FOLDED PRECURSOR RNA. It is appreciated that VGR2891 folded precursor RNA comprises a plurality of what is known in the art as 'hairpin' structures. These 'hairpin' structures are due to the fact that the nucleotide sequence of VGR2891 precursor RNA comprises a plurality of segments, the first half of each such segment having a nucleotide sequence which is at least a partial inversed-reversed sequence of the second half thereof, as is well known in the art.

VGR2891 folded precursor RNA is naturally processed by cellular enzymatic activity into at least 3 separate VGAM precursor RNAs, VGAM789 precursor RNA, VGAM790 precursor RNA and VGAM791 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM789 RNA, VGAM790 RNA and VGAM791 RNA, herein schematically represented by VGAM1 RNA through VGAM3 RNA, each of which VGAM RNAs corresponding to VGAM RNA of FIG. 1.

VGAM789 RNA, herein schematically represented by VGAM1 RNA through VGAM3 RNA, binds complementarily to a host target binding site located in an untranslated region of VGAM789 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM789 host target RNA into VGAM789 host target protein, herein schematically represented by VGAM1 HOST TARGET PROTEIN through VGAM3 HOST TARGET PROTEIN, all of FIG. 1.

VGAM790 RNA, herein schematically represented by VGAM1 RNA through VGAM3 RNA, binds complementarily to a host target binding site located in an untranslated region of VGAM790 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM790 host target RNA into VGAM790 host target protein, herein schematically represented by VGAM1 HOST TARGET PROTEIN through VGAM3 HOST TARGET PROTEIN, all of FIG. 1.

VGAM791 RNA, herein schematically represented by VGAM1 RNA through VGAM3 RNA, binds complementarily to a host target binding site located in an untranslated region of VGAM791 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM791 host target RNA into VGAM791 host target protein, herein schematically represented by VGAM1 HOST TARGET PROTEIN through VGAM3 HOST TARGET PROTEIN, all of FIG. 1.

It is appreciated that a function of VGR2891 gene, herein designated VGR GENE, is inhibition of expression of host target genes, as part of a novel viral mechanism of attacking a host. Accordingly, utilities of VGR2891 gene include diagnosis, prevention and treatment of viral infection by Shrimp White Spot Syndrome Virus (white spot bacilliform virus). Specific functions, and accordingly utilities, of VGR2891 gene correlate with, and may be deduced from, the identity of the host target genes, which are inhibited by VGAM RNAs comprised in the ‘operon-like’ cluster of VGR2891 gene: VGAM789 host target protein, VGAM790 host target protein and VGAM791 host target protein, herein schematically represented by VGAM1 HOST TARGET PROTEIN through VGAM3 HOST TARGET PROTEIN. The function of these host target genes is elaborated hereinabove with reference to VGAM789, VGAM790 and VGAM791. FIG. 9 further provides a conceptual description of novel bioinformatically detected regulatory viral gene, referred to here as Viral Genomic Record 2892(VGR2892) viral gene, which encodes an ‘operon-like’ cluster of novel viral micro RNA-like genes, each of which in turn modulates expression of at least one host target gene, the function and utility of which at least one host target gene is known in the art.

VGR2892 gene, herein designated VGR GENE, is a novel bioinformatically detected regulatory, non protein coding, RNA viral gene. The method by which VGR2892 gene was detected is described hereinabove with reference to FIGS. 1-9.

VGR2892 gene encodes VGR2892 precursor RNA, herein designated VGR PRECURSOR RNA, an RNA molecule, typically several hundred nucleotides long.

VGR2892 precursor RNA folds spatially, forming VGR2892 folded precursor RNA, herein designated VGR FOLDED PRECURSOR RNA. It is appreciated that VGR2892 folded precursor RNA comprises a plurality of what is known in the art as ‘hairpin’ structures. These ‘hairpin’ structures are due to the fact that the nucleotide sequence of VGR2892 precursor RNA comprises a plurality of segments, the first half of each such segment having a nucleotide sequence which is at least a partial inversed-reversed sequence of the second half thereof, as is well known in the art.

VGR2892 folded precursor RNA is naturally processed by cellular enzymatic activity into at least 2 separate VGAM precursor RNAs, VGAM792 precursor RNA and VGAM793 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are ‘diced’ by DICER COMPLEX of FIG. 1, yielding respective short RNA segments of about 22 nucleotides in length, VGAM792 RNA and VGAM793 RNA, herein schematically represented by VGAM1 RNA through VGAM3 RNA, each of which VGAM RNAs corresponding to VGAM RNA of FIG. 1.

VGAM792 RNA, herein schematically represented by VGAM1 RNA through VGAM3 RNA, binds complementarily to a host target binding site located in an untranslated region of VGAM792 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM792 host target RNA into VGAM792 host target protein, herein schematically represented by VGAM1 HOST TARGET PROTEIN through VGAM3 HOST TARGET PROTEIN, all of FIG. 1.

VGAM793 RNA, herein schematically represented by VGAM1 RNA through VGAM3 RNA, binds complementarily to a host target binding site located in an untranslated region of VGAM793 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM793 host target RNA into VGAM793 host target protein, herein schematically represented by VGAM1 HOST TARGET PROTEIN through VGAM3 HOST TARGET PROTEIN, all of FIG. 1.

It is appreciated that a function of VGR2892 gene, herein designated VGR GENE, is inhibition of expression of host target genes, as part of a novel viral mechanism of attacking a host. Accordingly, utilities of VGR2892 gene include diagnosis, prevention and treatment of viral infection by Shrimp White Spot Syndrome Virus (white spot bacilliform virus). Specific functions, and accordingly utilities, of VGR2892 gene correlate with, and may be deduced from, the identity of the host target genes, which are inhibited by VGAM RNAs comprised in the ‘operon-like’ cluster of VGR2892 gene: VGAM792 host target protein and VGAM793 host target protein, herein schematically represented by VGAM1 HOST TARGET PROTEIN through VGAM3 HOST TARGET PROTEIN. The function of these host target genes is elaborated hereinabove with reference to VGAM792 and VGAM793. FIG. 9 further provides a conceptual description of novel bioinformatically detected regulatory viral gene, referred to here as Viral Genomic Record 2893(VGR2893)

viral gene, which encodes an 'operon-like' cluster of novel viral micro RNA-like genes, each of which in turn modulates expression of at least one host target gene, the function and utility of which at least one host target gene is known in the art.

VGR2893 gene, herein designated VGR GENE, is a novel bioinformatically detected regulatory, non protein coding, RNA viral gene. The method by which VGR2893 gene was detected is described hereinabove with reference to FIGS. 1-9.

VGR2893 gene encodes VGR2893 precursor RNA, herein designated VGR PRECURSOR RNA, an RNA molecule, typically several hundred nucleotides long.

VGR2893 precursor RNA folds spatially, forming VGR2893 folded precursor RNA, herein designated VGR FOLDED PRECURSOR RNA. It is appreciated that VGR2893 folded precursor RNA comprises a plurality of what is known in the art as 'hairpin' structures. These 'hairpin' structures are due to the fact that the nucleotide sequence of VGR2893 precursor RNA comprises a plurality of segments, the first half of each such segment having a nucleotide sequence which is at least a partial inversed-reversed sequence of the second half thereof, as is well known in the art.

VGR2893 folded precursor RNA is naturally processed by cellular enzymatic activity into at least 2 separate VGAM precursor RNAs, VGAM795 precursor RNA and VGAM796 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM795 RNA and VGAM796 RNA, herein schematically represented by VGAM1 RNA through VGAM3 RNA, each of which VGAM RNAs corresponding to VGAM RNA of FIG. 1.

VGAM795 RNA, herein schematically represented by VGAM1 RNA through VGAM3 RNA, binds complementarily to a host target binding site located in an untranslated region of VGAM795 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM795 host target RNA into VGAM795 host target protein, herein schematically represented by VGAM1 HOST TARGET PROTEIN through VGAM3 HOST TARGET PROTEIN, all of FIG. 1.

VGAM796 RNA, herein schematically represented by VGAM1 RNA through VGAM3 RNA, binds complementarily to a host target binding site located in an untranslated region of VGAM796 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM796 host target RNA into VGAM796 host target protein, herein schematically represented by VGAM1 HOST TARGET PROTEIN through VGAM3 HOST TARGET PROTEIN, all of FIG. 1.

It is appreciated that a function of VGR2893 gene, herein designated VGR GENE, is inhibition of expression of host target genes, as part of a novel viral mechanism of attacking a host. Accordingly, utilities of VGR2893 gene include diagnosis, prevention and treatment of viral infection by Shrimp White Spot Syndrome Virus (white spot bacilliform virus). Specific functions, and accordingly utilities, of VGR2893 gene correlate with, and may be deduced from, the identity of the host target genes, which are inhibited by VGAM RNAs comprised in the 'operon-like' cluster of VGR2893 gene: VGAM795 host target protein and VGAM796 host target protein, herein schematically represented by VGAM1 HOST TARGET PROTEIN through VGAM3 HOST TARGET PROTEIN. The function of these host target genes is elaborated hereinabove with reference to VGAM795 and VGAM796. FIG. 9 further provides a conceptual description of novel bioinformatically detected regulatory viral gene, referred to here as Viral Genomic Record 2894(VGR2894) viral gene, which encodes an 'operon-like' cluster of novel viral micro RNA-like genes, each of which in turn modulates expression of at least one host target gene, the function and utility of which at least one host target gene is known in the art.

VGR2894 gene, herein designated VGR GENE, is a novel bioinformatically detected regulatory, non protein coding, RNA viral gene. The method by which VGR2894 gene was detected is described hereinabove with reference to FIGS. 1-9.

VGR2894 gene encodes VGR2894 precursor RNA, herein designated VGR PRECURSOR RNA, an RNA molecule, typically several hundred nucleotides long.

VGR2894 precursor RNA folds spatially, forming VGR2894 folded precursor RNA, herein designated VGR FOLDED PRECURSOR RNA. It is appreciated that VGR2894 folded precursor RNA comprises a plurality of what is known in the art as 'hairpin' structures. These 'hairpin' structures are due to the fact that the nucleotide sequence of VGR2894 precursor RNA comprises a plurality of segments, the first half of each such segment having a nucleotide sequence which is at least a partial inversed-reversed sequence of the second half thereof, as is well known in the art.

VGR2894 folded precursor RNA is naturally processed by cellular enzymatic activity into at least 2 separate VGAM precursor RNAs, VGAM797 precursor RNA and VGAM798 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM797 RNA and VGAM798 RNA, herein schematically represented by VGAM1 RNA through VGAM3 RNA, each of which VGAM RNAs corresponding to VGAM RNA of FIG. 1.

VGAM797 RNA, herein schematically represented by VGAM1 RNA through VGAM3 RNA, binds complementarily to a host target binding site located in an untranslated region of VGAM797 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM797 host target RNA into VGAM797 host target protein, herein schematically represented by VGAM1 HOST TARGET PROTEIN through VGAM3 HOST TARGET PROTEIN, all of FIG. 1.

VGAM798 RNA, herein schematically represented by VGAM1 RNA through VGAM3 RNA, binds complementarily to a host target binding site located in an untranslated region of VGAM798 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM798 host target RNA into VGAM798 host target protein, herein schematically represented by VGAM1 HOST TARGET PROTEIN through VGAM3 HOST TARGET PROTEIN, all of FIG. 1.

It is appreciated that a function of VGR2894 gene, herein designated VGR GENE, is inhibition of expression of host target genes, as part of a novel viral mechanism of attacking a host. Accordingly, utilities of VGR2894 gene include diagnosis, prevention and treatment of viral infection by Shrimp White Spot Syndrome Virus (white spot baciliform virus). Specific functions, and accordingly utilities, of VGR2894 gene correlate with, and may be deduced from, the identity of the host target genes, which are inhibited by VGAM RNAs comprised in the 'operon-like' cluster of VGR2894 gene: VGAM797 host target protein and VGAM798 host target protein, herein schematically represented by VGAM1 HOST TARGET PROTEIN through VGAM3 HOST TARGET PROTEIN. The function of these host target genes is elaborated hereinabove with reference to VGAM797 and VGAM798. FIG. 9 further provides a conceptual description of novel bioinformatically detected regulatory viral gene, referred to here as Viral Genomic Record 2895(VGR2895) viral gene, which encodes an 'operon-like' cluster of novel viral micro RNA-like genes, each of which in turn modulates expression of at least one host target gene, the function and utility of which at least one host target gene is known in the art.

VGR2895 gene, herein designated VGR GENE, is a novel bioinformatically detected regulatory, non protein coding, RNA viral gene. The method by which VGR2895 gene was detected is described hereinabove with reference to FIGS. 1-9.

VGR2895 gene encodes VGR2895 precursor RNA, herein designated VGR PRECURSOR RNA, an RNA molecule, typically several hundred nucleotides long.

VGR2895 precursor RNA folds spatially, forming VGR2895 folded precursor RNA, herein designated VGR FOLDED PRECURSOR RNA. It is appreciated that VGR2895 folded precursor RNA comprises a plurality of what is known in the art as 'hairpin' structures. These 'hairpin' structures are due to the fact that the nucleotide sequence of VGR2895 precursor RNA comprises a plurality of segments, the first half of each such segment having a nucleotide sequence which is at least a partial inversed-reversed sequence of the second half thereof, as is well known in the art.

VGR2895 folded precursor RNA is naturally processed by cellular enzymatic activity into at least 2 separate VGAM precursor RNAs, VGAM799 precursor RNA and VGAM800 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM799 RNA and VGAM800 RNA, herein schematically represented by VGAM1 RNA through VGAM3 RNA, each of which VGAM RNAs corresponding to VGAM RNA of FIG. 1.

VGAM799 RNA, herein schematically represented by VGAM1 RNA through VGAM3 RNA, binds complementarily to a host target binding site located in an untranslated region of VGAM799 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM799 host target RNA into VGAM799 host target protein, herein schematically represented by VGAM1 HOST TARGET PROTEIN through VGAM3 HOST TARGET PROTEIN, all of FIG. 1.

VGAM800 RNA, herein schematically represented by VGAM1 RNA through VGAM3 RNA, binds complementarily to a host target binding site located in an untranslated region of VGAM800 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM800 host target RNA into VGAM800 host target protein, herein schematically represented by VGAM1 HOST TARGET PROTEIN through VGAM3 HOST TARGET PROTEIN, all of FIG. 1.

It is appreciated that a function of VGR2895 gene, herein designated VGR GENE, is inhibition of expression of host target genes, as part of a novel viral mechanism of attacking a host. Accordingly, utilities of VGR2895 gene include diagnosis, prevention and treatment of viral infection by Shrimp White Spot Syndrome Virus (white spot baciliform virus). Specific functions, and accordingly utilities, of VGR2895 gene correlate with, and may be deduced from, the identity of the host target genes, which are inhibited by VGAM RNAs comprised in the 'operon-like' cluster of VGR2895 gene: VGAM799 host target protein and VGAM800 host target protein, herein schematically represented by VGAM1 HOST TARGET PROTEIN through VGAM3 HOST TARGET PROTEIN. The function of these host target genes is elaborated hereinabove with reference to VGAM799 and VGAM800. FIG. 9 further provides a conceptual description of novel bioinformatically detected regulatory viral gene, referred to here as Viral Genomic Record 2896(VGR2896) viral gene, which encodes an 'operon-like' cluster of novel viral micro RNA-like genes, each of which in turn modulates expression of at least one host target gene, the function and utility of which at least one host target gene is known in the art.

VGR2896 gene, herein designated VGR GENE, is a novel bioinformatically detected regulatory, non protein coding, RNA viral gene. The method by which VGR2896 gene was detected is described hereinabove with reference to FIGS. 1-9.

VGR2896 gene encodes VGR2896 precursor RNA, herein designated VGR PRECURSOR RNA, an RNA molecule, typically several hundred nucleotides long.

VGR2896 precursor RNA folds spatially, forming VGR2896 folded precursor RNA, herein designated VGR FOLDED PRECURSOR RNA. It is appreciated that VGR2896 folded precursor RNA comprises a plurality of what is known in the art as 'hairpin' structures. These 'hairpin' structures are due to the fact that the nucleotide sequence of VGR2896 precursor RNA comprises a plurality of segments, the first half of each such segment having a nucleotide sequence which is at least a partial inversed-reversed sequence of the second half thereof, as is well known in the art.

VGR2896 folded precursor RNA is naturally processed by cellular enzymatic activity into at least 3 separate VGAM precursor RNAs, VGAM801 precursor RNA, VGAM802 precursor RNA and VGAM803 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM801 RNA, VGAM802 RNA and VGAM803 RNA, herein schematically represented by VGAM1 RNA through VGAM3 RNA, each of which VGAM RNAs corresponding to VGAM RNA of FIG. 1.

VGAM801 RNA, herein schematically represented by VGAM1 RNA through VGAM3 RNA, binds complementarily to a host target binding site located in an untranslated region of VGAM801 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM801 host target RNA into VGAM801 host target protein, herein schematically represented by VGAM1 HOST TARGET PROTEIN through VGAM3 HOST TARGET PROTEIN, all of FIG. 1.

VGAM802 RNA, herein schematically represented by VGAM1 RNA through VGAM3 RNA, binds complementarily to a host target binding site located in an untranslated region of VGAM802 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM802 host target RNA into VGAM802 host target protein, herein schematically represented by VGAM1 HOST TARGET PROTEIN through VGAM3 HOST TARGET PROTEIN, all of FIG. 1.

VGAM803 RNA, herein schematically represented by VGAM1 RNA through VGAM3 RNA, binds complementarily to a host target binding site located in an untranslated region of VGAM803 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM803 host target RNA into VGAM803 host target protein, herein schematically represented by VGAM1 HOST TARGET PROTEIN through VGAM3 HOST TARGET PROTEIN, all of FIG. 1.

It is appreciated that a function of VGR2896 gene, herein designated VGR GENE, is inhibition of expression of host target genes, as part of a novel viral mechanism of attacking a host. Accordingly, utilities of VGR2896 gene include diagnosis, prevention and treatment of viral infection by Murid Herpesvirus 4. Specific functions, and accordingly utilities, of VGR2896 gene correlate with, and may be deduced from, the identity of the host target genes, which are inhibited by VGAM RNAs comprised in the 'operon-like' cluster of VGR2896 gene: VGAM801 host target protein, VGAM802 host target protein and VGAM803 host target protein, herein schematically represented by VGAM1 HOST TARGET PROTEIN through VGAM3 HOST TARGET PROTEIN. The function of these host target genes is elaborated hereinabove with reference to VGAM801, VGAM802 and VGAM803. FIG. 9 further provides a conceptual description of novel bioinformatically detected regulatory viral gene, referred to here as Viral Genomic Record 2897(VGR2897) viral gene, which encodes an 'operon-like' cluster of novel viral micro RNA-like genes, each of which in turn modulates expression of at least one host target gene, the function and utility of which at least one host target gene is known in the art.

VGR2897 gene, herein designated VGR GENE, is a novel bioinformatically detected regulatory, non protein coding, RNA viral gene. The method by which VGR2897 gene was detected is described hereinabove with reference to FIGS. 1-9.

VGR2897 gene encodes VGR2897 precursor RNA, herein designated VGR PRECURSOR RNA, an RNA molecule, typically several hundred nucleotides long.

VGR2897 precursor RNA folds spatially, forming VGR2897 folded precursor RNA, herein designated VGR FOLDED PRECURSOR RNA. It is appreciated that VGR2897 folded precursor RNA comprises a plurality of what is known in the art as 'hairpin' structures. These 'hairpin' structures are due to the fact that the nucleotide sequence of VGR2897 precursor RNA comprises a plurality of segments, the first half of each such segment having a nucleotide sequence which is at least a partial inversed-reversed sequence of the second half thereof, as is well known in the art.

VGR2897 folded precursor RNA is naturally processed by cellular enzymatic activity into at least 3 separate VGAM precursor RNAs, VGAM807 precursor RNA, VGAM808 precursor RNA and VGAM809 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM807 RNA, VGAM808 RNA and VGAM809 RNA, herein schematically represented by VGAM1 RNA through VGAM3 RNA, each of which VGAM RNAs corresponding to VGAM RNA of FIG. 1.

VGAM807 RNA, herein schematically represented by VGAM1 RNA through VGAM3 RNA, binds complementarily to a host target binding site located in an untranslated region of VGAM807 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM807 host target RNA into VGAM807 host target protein, herein schematically represented by VGAM1 HOST TARGET PROTEIN through VGAM3 HOST TARGET PROTEIN, all of FIG. 1.

VGAM808 RNA, herein schematically represented by VGAM1 RNA through VGAM3 RNA, binds complementarily to a host target binding site located in an untranslated region of VGAM808 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM808 host target RNA into VGAM808 host target protein, herein schematically represented by VGAM1 HOST TARGET PROTEIN through VGAM3 HOST TARGET PROTEIN, all of FIG. 1.

VGAM809 RNA, herein schematically represented by VGAM1 RNA through VGAM3 RNA, binds complementarily to a host target binding site located in an untranslated region of VGAM809 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM809 host target RNA into VGAM809 host target protein, herein schematically represented by VGAM1 HOST TARGET PROTEIN through VGAM3 HOST TARGET PROTEIN, all of FIG. 1.

It is appreciated that a function of VGR2897 gene, herein designated VGR GENE, is inhibition of expression of host target genes, as part of a novel viral mechanism of attacking a host. Accordingly, utilities of VGR2897 gene include diagnosis, prevention and treatment of viral infection by Equine Herpesvirus 2. Specific functions, and accordingly utilities, of VGR2897 gene correlate with, and may be deduced from, the identity of the host target genes, which are inhibited by VGAM RNAs comprised in the 'operon-like' cluster of VGR2897 gene: VGAM807 host target protein, VGAM808 host target protein and VGAM809 host target protein, herein schematically represented by VGAM1 HOST TARGET PROTEIN through VGAM3 HOST TARGET PROTEIN. The function of these host target genes is elaborated hereinabove with reference to VGAM807, VGAM808 and VGAM809. FIG. 9 further provides a conceptual description of novel bioinformatically detected regulatory viral gene, referred to here as Viral Genomic Record 2898(VGR2898) viral gene, which encodes an 'operon-like' cluster of novel viral micro RNA-like genes, each of which in turn modulates expression of at least one host target gene, the function and utility of which at least one host target gene is known in the art.

VGR2898 gene, herein designated VGR GENE, is a novel bioinformatically detected regulatory, non protein coding, RNA viral gene. The method by which VGR2898 gene was detected is described hereinabove with reference to FIGS. 1-9.

VGR2898 gene encodes VGR2898 precursor RNA, herein designated VGR PRECURSOR RNA, an RNA molecule, typically several hundred nucleotides long.

VGR2898 precursor RNA folds spatially, forming VGR2898 folded precursor RNA, herein designated VGR FOLDED PRECURSOR RNA. It is appreciated that VGR2898 folded precursor RNA comprises a plurality of what is known in the art as 'hairpin' structures. These 'hairpin' structures are due to the fact that the nucleotide sequence of VGR2898 precursor RNA comprises a plurality of segments, the first half of each such segment having a nucleotide sequence which is at least a partial inversed-reversed sequence of the second half thereof, as is well known in the art.

VGR2898 folded precursor RNA is naturally processed by cellular enzymatic activity into at least 3 separate VGAM precursor RNAs, VGAM812 precursor RNA, VGAM813 precursor RNA and VGAM814 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM812 RNA, VGAM813 RNA and VGAM814 RNA, herein schematically represented by VGAM1 RNA through VGAM3 RNA, each of which VGAM RNAs corresponding to VGAM RNA of FIG. 1.

VGAM812 RNA, herein schematically represented by VGAM1 RNA through VGAM3 RNA, binds complementarily to a host target binding site located in an untranslated region of VGAM812 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM812 host target RNA into VGAM812 host target protein, herein schematically represented by VGAM1 HOST TARGET PROTEIN through VGAM3 HOST TARGET PROTEIN, all of FIG. 1.

VGAM813 RNA, herein schematically represented by VGAM1 RNA through VGAM3 RNA, binds complementarily to a host target binding site located in an untranslated region of VGAM813 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM813 host target RNA into VGAM813 host target protein, herein schematically represented by VGAM1 HOST TARGET PROTEIN through VGAM3 HOST TARGET PROTEIN, all of FIG. 1.

VGAM814 RNA, herein schematically represented by VGAM1 RNA through VGAM3 RNA, binds complementarily to a host target binding site located in an untranslated region of VGAM814 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM814 host target RNA into VGAM814 host target protein, herein schematically represented by VGAM1 HOST TARGET PROTEIN through VGAM3 HOST TARGET PROTEIN, all of FIG. 1.

It is appreciated that a function of VGR2898 gene, herein designated VGR GENE, is inhibition of expression of host target genes, as part of a novel viral mechanism of attacking a host. Accordingly, utilities of VGR2898 gene include diagnosis, prevention and treatment of viral infection by Murid Herpesvirus 4. Specific functions, and accordingly utilities, of VGR2898 gene correlate with, and may be deduced from, the identity of the host target genes, which are inhibited by VGAM RNAs comprised in the 'operon-like' cluster of VGR2898 gene: VGAM812 host target protein, VGAM813 host target protein and VGAM814 host target protein, herein schematically represented by VGAM1 HOST TARGET PROTEIN through VGAM3 HOST TARGET PROTEIN. The function of these host target genes is elaborated hereinabove with reference to VGAM812, VGAM813 and VGAM814. FIG. 9 further provides a conceptual description of novel bioinformatically detected regulatory viral gene, referred to here as Viral Genomic Record 2899(VGR2899) viral gene, which encodes an 'operon-like' cluster of novel viral micro RNA-like genes, each of which in turn modulates expression of at least one host target gene, the function and utility of which at least one host target gene is known in the art.

VGR2899 gene, herein designated VGR GENE, is a novel bioinformatically detected regulatory, non protein coding, RNA viral gene. The method by which VGR2899 gene was detected is described hereinabove with reference to FIGS. 1-9.

VGR2899 gene encodes VGR2899 precursor RNA, herein designated VGR PRECURSOR RNA, an RNA molecule, typically several hundred nucleotides long.

VGR2899 precursor RNA folds spatially, forming VGR2899 folded precursor RNA, herein designated VGR FOLDED PRECURSOR RNA. It is appreciated that VGR2899 folded precursor RNA comprises a plurality of what is known in the art as 'hairpin' structures. These 'hairpin' structures are due to the fact that the nucleotide sequence of VGR2899 precursor RNA comprises a plurality of segments, the first half of each such segment having a nucleotide sequence which is at least a partial inversed-reversed sequence of the second half thereof, as is well known in the art.

VGR2899 folded precursor RNA is naturally processed by cellular enzymatic activity into at least 2 separate VGAM precursor RNAs, VGAM815 precursor RNA and VGAM816 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM815 RNA and VGAM816 RNA, herein schematically represented by VGAM1 RNA through VGAM3 RNA, each of which VGAM RNAs corresponding to VGAM RNA of FIG. 1.

VGAM815 RNA, herein schematically represented by VGAM1 RNA through VGAM3 RNA, binds complementarily to a host target binding site located in an untranslated region of VGAM815 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM815 host target RNA into VGAM815 host target protein, herein schematically represented by VGAM1 HOST TARGET PROTEIN through VGAM3 HOST TARGET PROTEIN, all of FIG. 1.

VGAM816 RNA, herein schematically represented by VGAM1 RNA through VGAM3 RNA, binds complementarily to a host target binding site located in an untranslated region of VGAM816 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM816 host target RNA into VGAM816 host target protein, herein schematically represented by VGAM1 HOST TARGET PROTEIN through VGAM3 HOST TARGET PROTEIN, all of FIG. 1.

It is appreciated that a function of VGR2899 gene, herein designated VGR GENE, is inhibition of expression of host target genes, as part of a novel viral mechanism of attacking a host. Accordingly, utilities of VGR2899 gene include diagnosis, prevention and treatment of viral infection by Macaca Mulatta Rhadinovirus. Specific functions, and accordingly utilities, of VGR2899 gene correlate with, and may be deduced from, the identity of the host target genes, which are inhibited by VGAM RNAs comprised in the 'operon-like' cluster of VGR2899 gene: VGAM815 host target protein and VGAM816 host target protein, herein schematically represented by VGAM1 HOST TARGET PROTEIN through VGAM3 HOST TARGET PROTEIN. The function of these host target genes is elaborated hereinabove with reference to VGAM815 and VGAM816. FIG. 9 further provides a conceptual description of novel bioinformatically detected regulatory viral gene, referred to here as Viral Genomic Record 2900(VGR2900) viral gene, which encodes an 'operon-like' cluster of novel viral micro RNA-like genes, each of which in turn modulates expression of at least one host target gene, the function and utility of which at least one host target gene is known in the art.

VGR2900 gene, herein designated VGR GENE, is a novel bioinformatically detected regulatory, non protein coding, RNA viral gene. The method by which VGR2900 gene was detected is described hereinabove with reference to FIGS. 1-9.

VGR2900 gene encodes VGR2900 precursor RNA, herein designated VGR PRECURSOR RNA, an RNA molecule, typically several hundred nucleotides long.

VGR2900 precursor RNA folds spatially, forming VGR2900 folded precursor RNA, herein designated VGR FOLDED PRECURSOR RNA. It is appreciated that VGR2900 folded precursor RNA comprises a plurality of what is known in the art as 'hairpin' structures. These 'hairpin' structures are due to the fact that the nucleotide sequence of VGR2900 precursor RNA comprises a plurality of segments, the first half of each such segment having a nucleotide sequence which is at least a partial inversed-reversed sequence of the second half thereof, as is well known in the art.

VGR2900 folded precursor RNA is naturally processed by cellular enzymatic activity into at least 2 separate VGAM precursor RNAs, VGAM821 precursor RNA and VGAM822 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM821 RNA and VGAM822 RNA, herein schematically represented by VGAM1 RNA through VGAM3 RNA, each of which VGAM RNAs corresponding to VGAM RNA of FIG. 1.

VGAM821 RNA, herein schematically represented by VGAM1 RNA through VGAM3 RNA, binds complementarily to a host target binding site located in an untranslated region of VGAM821 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM821 host target RNA into VGAM821 host target protein, herein schematically represented by VGAM1 HOST TARGET PROTEIN through VGAM3 HOST TARGET PROTEIN, all of FIG. 1.

VGAM822 RNA, herein schematically represented by VGAM1 RNA through VGAM3 RNA, binds complementarily to a host target binding site located in an untranslated region of VGAM822 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM822 host target RNA into VGAM822 host target protein, herein schematically represented by VGAM1 HOST TARGET PROTEIN through VGAM3 HOST TARGET PROTEIN, all of FIG. 1.

It is appreciated that a function of VGR2900 gene, herein designated VGR GENE, is inhibition of expression of host target genes, as part of a novel viral mechanism of attacking a host. Accordingly, utilities of VGR2900 gene include diagnosis, prevention and treatment of viral infection by Human Herpesvirus 6. Specific functions, and accordingly utilities, of VGR2900 gene correlate with, and may be deduced from, the identity of the host target genes, which are inhibited by VGAM RNAs comprised in the 'operon-like' cluster of VGR2900 gene: VGAM821 host target protein and VGAM822 host target protein, herein schematically represented by VGAM1 HOST TARGET PROTEIN through VGAM3 HOST TARGET PROTEIN. The function of these host target genes is elaborated hereinabove with reference to VGAM821 and VGAM822. FIG. 9 further provides a conceptual description of novel bioinformatically detected regulatory viral gene, referred to here as Viral Genomic Record 2901(VGR2901) viral gene, which encodes an 'operon-like' cluster of novel viral micro RNA-like genes, each of which in turn modulates expression of at least one host target gene, the function and utility of which at least one host target gene is known in the art.

VGR2901 gene, herein designated VGR GENE, is a novel bioinformatically detected regulatory, non protein coding, RNA viral gene. The method by which VGR2901 gene was detected is described hereinabove with reference to FIGS. 1-9.

VGR2901 gene encodes VGR2901 precursor RNA, herein designated VGR PRECURSOR RNA, an RNA molecule, typically several hundred nucleotides long.

VGR2901 precursor RNA folds spatially, forming VGR2901 folded precursor RNA, herein designated VGR FOLDED PRECURSOR RNA. It is appreciated that VGR2901 folded precursor RNA comprises a plurality of what is known in the art as 'hairpin' structures. These 'hairpin' structures are due to the fact that the nucleotide sequence of VGR2901 precursor RNA comprises a plurality of segments, the first half of each such segment having a nucleotide sequence which is at least a partial inversed-reversed sequence of the second half thereof, as is well known in the art.

VGR2901 folded precursor RNA is naturally processed by cellular enzymatic activity into at least 2 separate VGAM precursor RNAs, VGAM823 precursor RNA and VGAM824 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM823 RNA and VGAM824 RNA, herein schematically represented by VGAM1 RNA through VGAM3 RNA, each of which VGAM RNAs corresponding to VGAM RNA of FIG. 1.

VGAM823 RNA, herein schematically represented by VGAM1 RNA through VGAM3 RNA, binds complementarily to a host target binding site located in an untranslated region of VGAM823 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM823 host target RNA into VGAM823 host target protein, herein schematically represented by VGAM1 HOST TARGET PROTEIN through VGAM3 HOST TARGET PROTEIN, all of FIG. 1.

VGAM824 RNA, herein schematically represented by VGAM1 RNA through VGAM3 RNA, binds complementarily to a host target binding site located in an untranslated region of VGAM824 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM824 host target RNA into VGAM824 host target protein, herein schematically represented by VGAM1 HOST TARGET PROTEIN through VGAM3 HOST TARGET PROTEIN, all of FIG. 1.

It is appreciated that a function of VGR2901 gene, herein designated VGR GENE, is inhibition of expression of host target genes, as part of a novel viral mechanism of attacking a host. Accordingly, utilities of VGR2901 gene include diagnosis, prevention and treatment of viral infection by African Swine Fever Virus. Specific functions, and accordingly utilities, of VGR2901 gene correlate with, and may be deduced from, the identity of the host target genes, which are inhibited by VGAM RNAs comprised in the 'operon-like' cluster of VGR2901 gene: VGAM823 host target protein and VGAM824 host target protein, herein schematically represented by VGAM1 HOST TARGET PROTEIN through VGAM3 HOST TARGET PROTEIN. The function of these host target genes is elaborated hereinabove with reference to VGAM823 and VGAM824. FIG. 9 further provides a conceptual description of novel bioinformatically detected regulatory viral gene, referred to here as Viral Genomic Record 2902(VGR2902) viral gene, which encodes an 'operon-like' cluster of novel viral micro RNA-like genes, each of which in turn modulates expression of at least one host target gene, the function and utility of which at least one host target gene is known in the art.

VGR2902 gene, herein designated VGR GENE, is a novel bioinformatically detected regulatory, non protein coding, RNA viral gene. The method by which VGR2902 gene was detected is described hereinabove with reference to FIGS. 1-9.

VGR2902 gene encodes VGR2902 precursor RNA, herein designated VGR PRECURSOR RNA, an RNA molecule, typically several hundred nucleotides long.

VGR2902 precursor RNA folds spatially, forming VGR2902 folded precursor RNA, herein designated VGR FOLDED PRECURSOR RNA. It is appreciated that VGR2902 folded precursor RNA comprises a plurality of what is known in the art as 'hairpin' structures. These 'hairpin' structures are due to the fact that the nucleotide sequence of VGR2902 precursor RNA comprises a plurality of segments, the first half of each such segment having a nucleotide sequence which is at least a partial inversed-reversed sequence of the second half thereof, as is well known in the art.

VGR2902 folded precursor RNA is naturally processed by cellular enzymatic activity into at least 2 separate VGAM precursor RNAs, VGAM826 precursor RNA and VGAM827 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM826 RNA and VGAM827 RNA, herein schematically represented by VGAM1 RNA through VGAM3 RNA, each of which VGAM RNAs corresponding to VGAM RNA of FIG. 1.

VGAM826 RNA, herein schematically represented by VGAM1 RNA through VGAM3 RNA, binds complementarily to a host target binding site located in an untranslated region of VGAM826 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM826 host target RNA into VGAM826 host target protein, herein schematically represented by VGAM1 HOST TARGET PROTEIN through VGAM3 HOST TARGET PROTEIN, all of FIG. 1.

VGAM827 RNA, herein schematically represented by VGAM1 RNA through VGAM3 RNA, binds complementarily to a host target binding site located in an untranslated region of VGAM827 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM827 host target RNA into VGAM827 host target protein, herein schematically represented by VGAM1 HOST TARGET PROTEIN through VGAM3 HOST TARGET PROTEIN, all of FIG. 1.

It is appreciated that a function of VGR2902 gene, herein designated VGR GENE, is inhibition of expression of host target genes, as part of a novel viral mechanism of attacking a host. Accordingly, utilities of VGR2902 gene include diagnosis, prevention and treatment of viral infection by Bovine Herpesvirus 4. Specific functions, and accordingly utilities, of VGR2902 gene correlate with, and may be deduced from, the identity of the host target genes, which are inhibited by VGAM RNAs comprised in the 'operon-like' cluster of VGR2902 gene: VGAM826 host target protein and VGAM827 host target protein, herein schematically represented by VGAM1 HOST TARGET PROTEIN through VGAM3 HOST TARGET PROTEIN. The function of these host target genes is elaborated hereinabove with reference to VGAM826 and VGAM827. FIG. 9 further provides a conceptual description of novel bioinformatically detected regulatory viral gene, referred to here as Viral Genomic Record 2903(VGR2903) viral gene, which encodes an 'operon-like' cluster of novel viral micro RNA-like genes, each of which in turn modulates expression of at least one host target gene, the function and utility of which at least one host target gene is known in the art.

VGR2903 gene, herein designated VGR GENE, is a novel bioinformatically detected regulatory, non protein coding, RNA viral gene. The method by which VGR2903 gene was detected is described hereinabove with reference to FIGS. 1-9.

VGR2903 gene encodes VGR2903 precursor RNA, herein designated VGR PRECURSOR RNA, an RNA molecule, typically several hundred nucleotides long.

VGR2903 precursor RNA folds spatially, forming VGR2903 folded precursor RNA, herein designated VGR FOLDED PRECURSOR RNA. It is appreciated that VGR2903 folded precursor RNA comprises a plurality of what is known in the art as 'hairpin' structures. These 'hairpin' structures are due to the fact that the nucleotide sequence of VGR2903 precursor RNA comprises a plurality of segments, the first half of each such segment having a nucleotide sequence which is at least a partial inversed-reversed sequence of the second half thereof, as is well known in the art.

VGR2903 folded precursor RNA is naturally processed by cellular enzymatic activity into at least 3 separate VGAM precursor RNAs, VGAM828 precursor RNA, VGAM829 precursor RNA and VGAM830 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM828 RNA, VGAM829 RNA and VGAM830 RNA, herein schematically represented by VGAM1 RNA through VGAM3 RNA, each of which VGAM RNAs corresponding to VGAM RNA of FIG. 1.

VGAM828 RNA, herein schematically represented by VGAM1 RNA through VGAM3 RNA, binds complementarily to a host target binding site located in an untranslated region of VGAM828 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM828 host target RNA into VGAM828 host target protein, herein schematically represented by VGAM1 HOST TARGET PROTEIN through VGAM3 HOST TARGET PROTEIN, all of FIG. 1.

VGAM829 RNA, herein schematically represented by VGAM1 RNA through VGAM3 RNA, binds complementarily to a host target binding site located in an untranslated region of VGAM829 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM829 host target RNA into VGAM829 host target protein, herein schematically represented by VGAM1 HOST TARGET PROTEIN through VGAM3 HOST TARGET PROTEIN, all of FIG. 1.

VGAM830 RNA, herein schematically represented by VGAM1 RNA through VGAM3 RNA, binds complementarily to a host target binding site located in an untranslated region of VGAM830 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM830 host target RNA into VGAM830 host target protein, herein schematically represented by VGAM1 HOST TARGET PROTEIN through VGAM3 HOST TARGET PROTEIN, all of FIG. 1.

It is appreciated that a function of VGR2903 gene, herein designated VGR GENE, is inhibition of expression of host target genes, as part of a novel viral mechanism of attacking a host. Accordingly, utilities of VGR2903 gene include diagnosis, prevention and treatment of viral infection by African Swine Fever Virus. Specific functions, and accordingly utilities, of VGR2903 gene correlate with, and may be deduced from, the identity of the host target genes, which are inhibited by VGAM RNAs comprised in the 'operon-like' cluster of VGR2903 gene: VGAM828 host target protein, VGAM829 host target protein and VGAM830 host target protein, herein schematically represented by VGAM1 HOST TARGET PROTEIN through VGAM3 HOST TARGET PROTEIN. The function of these host target genes is elaborated hereinabove with reference to VGAM828, VGAM829 and VGAM830. FIG. 9 further provides a conceptual description of novel bioinformatically detected regulatory viral gene, referred to here as Viral Genomic Record 2904(VGR2904) viral gene, which encodes an 'operon-like' cluster of novel viral micro RNA-like genes, each of which in turn modulates expression of at least one host target gene, the function and utility of which at least one host target gene is known in the art.

VGR2904 gene, herein designated VGR GENE, is a novel bioinformatically detected regulatory, non protein coding, RNA viral gene. The method by which VGR2904 gene was detected is described hereinabove with reference to FIGS. 1-9.

VGR2904 gene encodes VGR2904 precursor RNA, herein designated VGR PRECURSOR RNA, an RNA molecule, typically several hundred nucleotides long.

VGR2904 precursor RNA folds spatially, forming VGR2904 folded precursor RNA, herein designated VGR FOLDED PRECURSOR RNA. It is appreciated that VGR2904 folded precursor RNA comprises a plurality of what is known in the art as 'hairpin' structures. These 'hairpin' structures are due to the fact that the nucleotide sequence of VGR2904 precursor RNA comprises a plurality of segments, the first half of each such segment having a nucleotide sequence which is at least a partial inversed-reversed sequence of the second half thereof, as is well known in the art.

VGR2904 folded precursor RNA is naturally processed by cellular enzymatic activity into at least 2 separate VGAM precursor RNAs, VGAM831 precursor RNA and VGAM832 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM831 RNA and VGAM832 RNA, herein schematically represented by VGAM1 RNA through VGAM3 RNA, each of which VGAM RNAs corresponding to VGAM RNA of FIG. 1.

VGAM831 RNA, herein schematically represented by VGAM1 RNA through VGAM3 RNA, binds complementarily to a host target binding site located in an untranslated region of VGAM831 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM831 host target RNA into VGAM831 host target protein, herein schematically represented by VGAM1 HOST TARGET PROTEIN through VGAM3 HOST TARGET PROTEIN, all of FIG. 1.

VGAM832 RNA, herein schematically represented by VGAM1 RNA through VGAM3 RNA, binds complementarily to a host target binding site located in an untranslated region of VGAM832 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM832 host target RNA into VGAM832 host target protein, herein schematically represented by VGAM1 HOST TARGET PROTEIN through VGAM3 HOST TARGET PROTEIN, all of FIG. 1.

It is appreciated that a function of VGR2904 gene, herein designated VGR GENE, is inhibition of expression of host target genes, as part of a novel viral mechanism of attacking a host. Accordingly, utilities of VGR2904 gene include diagnosis, prevention and treatment of viral infection by Human Herpesvirus 6B. Specific functions, and accordingly utilities, of VGR2904 gene correlate with, and may be deduced from, the identity of the host target genes, which are inhibited by VGAM RNAs comprised in the 'operon-like' cluster of VGR2904 gene: VGAM831 host target protein and VGAM832 host target protein, herein schematically represented by VGAM1 HOST TARGET PROTEIN through VGAM3 HOST TARGET PROTEIN. The function of these host target genes is elaborated hereinabove with reference to VGAM831 and VGAM832. FIG. 9 further provides a conceptual description of novel bioinformatically detected regulatory viral gene, referred to here as Viral Genomic Record 2905(VGR2905) viral gene, which encodes an 'operon-like' cluster of novel viral micro RNA-like genes, each of which in turn modulates expression of at least one host target gene, the function and utility of which at least one host target gene is known in the art.

VGR2905 gene, herein designated VGR GENE, is a novel bioinformatically detected regulatory, non protein coding, RNA viral gene. The method by which VGR2905 gene was detected is described hereinabove with reference to FIGS. 1-9.

VGR2905 gene encodes VGR2905 precursor RNA, herein designated VGR PRECURSOR RNA, an RNA molecule, typically several hundred nucleotides long.

VGR2905 precursor RNA folds spatially, forming VGR2905 folded precursor RNA, herein designated VGR FOLDED PRECURSOR RNA. It is appreciated that VGR2905 folded precursor RNA comprises a plurality of what is known in the art as 'hairpin' structures. These 'hairpin' structures are due to the fact that the nucleotide sequence of VGR2905 precursor RNA comprises a plurality of segments, the first half of each such segment having a nucleotide sequence which is at least a partial inversed-reversed sequence of the second half thereof, as is well known in the art.

VGR2905 folded precursor RNA is naturally processed by cellular enzymatic activity into at least 6 separate VGAM precursor RNAs, VGAM833 precursor RNA, VGAM834 precursor RNA, VGAM835 precursor RNA, VGAM836 precursor RNA, VGAM837 precursor RNA and VGAM838 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM833 RNA, VGAM834 RNA, VGAM835 RNA, VGAM836 RNA, VGAM837 RNA and VGAM838 RNA, herein schematically represented by VGAM1 RNA through VGAM3 RNA, each of which VGAM RNAs corresponding to VGAM RNA of FIG. 1.

VGAM833 RNA, herein schematically represented by VGAM1 RNA through VGAM3 RNA, binds complementarily to a host target binding site located in an untranslated region of VGAM833 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM833 host target RNA into VGAM833 host target protein, herein schematically represented by VGAM1 HOST TARGET PROTEIN through VGAM3 HOST TARGET PROTEIN, all of FIG. 1.

VGAM834 RNA, herein schematically represented by VGAM1 RNA through VGAM3 RNA, binds complementarily to a host target binding site located in an untranslated region of VGAM834 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM834 host target RNA into VGAM834 host target protein, herein schematically represented by VGAM1 HOST TARGET PROTEIN through VGAM3 HOST TARGET PROTEIN, all of FIG. 1.

VGAM835 RNA, herein schematically represented by VGAM1 RNA through VGAM3 RNA, binds complementarily to a host target binding site located in an untranslated region of VGAM835 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM835 host target RNA into VGAM835 host target protein, herein schematically represented by VGAM1 HOST TARGET PROTEIN through VGAM3 HOST TARGET PROTEIN, all of FIG. 1.

VGAM836 RNA, herein schematically represented by VGAM1 RNA through VGAM3 RNA, binds complementarily to a host target binding site located in an untranslated region of VGAM836 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM836 host target RNA into VGAM836 host target protein, herein schematically represented by VGAM1 HOST TARGET PROTEIN through VGAM3 HOST TARGET PROTEIN, all of FIG. 1.

VGAM837 RNA, herein schematically represented by VGAM1 RNA through VGAM3 RNA, binds complementarily to a host target binding site located in an untranslated region of VGAM837 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM837 host target RNA into VGAM837 host target protein, herein schematically represented by VGAM1 HOST TARGET PROTEIN through VGAM3 HOST TARGET PROTEIN, all of FIG. 1.

VGAM838 RNA, herein schematically represented by VGAM1 RNA through VGAM3 RNA, binds complementarily to a host target binding site located in an untranslated region of VGAM838 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM838 host target RNA into VGAM838 host target protein, herein schematically represented by VGAM1 HOST TARGET PROTEIN through VGAM3 HOST TARGET PROTEIN, all of FIG. 1.

It is appreciated that a function of VGR2905 gene, herein designated VGR GENE, is inhibition of expression of host target genes, as part of a novel viral mechanism of attacking a host. Accordingly, utilities of VGR2905 gene include diagnosis, prevention and treatment of viral infection by Monkeypox Virus. Specific functions, and accordingly utilities, of VGR2905 gene correlate with, and may be deduced from, the identity of the host target genes, which are inhibited by VGAM RNAs comprised in the 'operon-like' cluster of VGR2905 gene: VGAM833 host target protein, VGAM834 host target protein, VGAM835 host target protein, VGAM836 host target protein, VGAM837 host target protein and VGAM838 host target protein, herein schematically represented by VGAM1 HOST TARGET PROTEIN through VGAM3 HOST TARGET PROTEIN. The function of these host target genes is elaborated hereinabove with reference to VGAM833, VGAM834, VGAM835, VGAM836, VGAM837 and VGAM838. FIG. 9 further provides a conceptual description of novel bioinformatically detected regulatory viral gene, referred to here as Viral Genomic Record 2906(VGR2906) viral gene, which encodes an 'operon-like' cluster of novel viral micro RNA-like genes, each of which in turn modulates expression of at least one host target gene, the function and utility of which at least one host target gene is known in the art.

VGR2906 gene, herein designated VGR GENE, is a novel bioinformatically detected regulatory, non protein coding, RNA viral gene. The method by which VGR2906 gene was detected is described hereinabove with reference to FIGS. 1-9.

VGR2906 gene encodes VGR2906 precursor RNA, herein designated VGR PRECURSOR RNA, an RNA molecule, typically several hundred nucleotides long.

VGR2906 precursor RNA folds spatially, forming VGR2906 folded precursor RNA, herein designated VGR FOLDED PRECURSOR RNA. It is appreciated that VGR2906 folded precursor RNA comprises a plurality of what is known in the art as 'hairpin' structures. These 'hairpin' structures are due to the fact that the nucleotide sequence of VGR2906 precursor RNA comprises a plurality of segments, the first half of each such segment having a nucleotide sequence which is at least a partial inversed-reversed sequence of the second half thereof, as is well known in the art.

VGR2906 folded precursor RNA is naturally processed by cellular enzymatic activity into at least 2 separate VGAM precursor RNAs, VGAM841 precursor RNA and VGAM842 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM841 RNA and VGAM842 RNA, herein schematically represented by VGAM1 RNA through VGAM3 RNA, each of which VGAM RNAs corresponding to VGAM RNA of FIG. 1.

VGAM841 RNA, herein schematically represented by VGAM1 RNA through VGAM3 RNA, binds complementarily to a host target binding site located in an untranslated region of VGAM841 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM841 host target RNA into VGAM841 host target protein, herein schematically represented by VGAM1 HOST TARGET PROTEIN through VGAM3 HOST TARGET PROTEIN, all of FIG. 1.

VGAM842 RNA, herein schematically represented by VGAM1 RNA through VGAM3 RNA, binds complementarily to a host target binding site located in an untranslated region of VGAM842 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM842 host target RNA into VGAM842 host target protein, herein schematically represented by VGAM1 HOST TARGET PROTEIN through VGAM3 HOST TARGET PROTEIN, all of FIG. 1.

It is appreciated that a function of VGR2906 gene, herein designated VGR GENE, is inhibition of expression of host target genes, as part of a novel viral mechanism of attacking a host. Accordingly, utilities of VGR2906 gene include diagnosis, prevention and treatment of viral infection by Equine Herpesvirus 2. Specific functions, and accordingly utilities, of VGR2906 gene correlate with, and may be deduced from, the identity of the host target genes, which are inhibited by VGAM RNAs comprised in the 'operon-like' cluster of VGR2906 gene: VGAM841 host target protein and VGAM842 host target protein, herein schematically represented by VGAM1 HOST TARGET PROTEIN through VGAM3 HOST TARGET PROTEIN. The function of these host target genes is elaborated hereinabove with reference to VGAM841 and VGAM842. FIG. 9 further provides a conceptual description of novel bioinformatically detected regulatory viral gene, referred to here as Viral Genomic Record 2907(VGR2907) viral gene, which encodes an 'operon-like' cluster of novel viral micro RNA-like genes, each of which in turn modulates expression of at least one host target gene, the function and utility of which at least one host target gene is known in the art.

VGR2907 gene, herein designated VGR GENE, is a novel bioinformatically detected regulatory, non protein coding, RNA viral gene. The method by which VGR2907 gene was detected is described hereinabove with reference to FIGS. 1-9.

VGR2907 gene encodes VGR2907 precursor RNA, herein designated VGR PRECURSOR RNA, an RNA molecule, typically several hundred nucleotides long.

VGR2907 precursor RNA folds spatially, forming VGR2907 folded precursor RNA, herein designated VGR FOLDED PRECURSOR RNA. It is appreciated that VGR2907 folded precursor RNA comprises a plurality of what is known in the art as 'hairpin' structures. These 'hairpin' structures are due to the fact that the nucleotide sequence of VGR2907 precursor RNA comprises a plurality of segments, the first half of each such segment having a nucleotide sequence which is at least a partial inversed-reversed sequence of the second half thereof, as is well known in the art.

VGR2907 folded precursor RNA is naturally processed by cellular enzymatic activity into at least 2 separate VGAM precursor RNAs, VGAM843 precursor RNA and VGAM844 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM843 RNA and VGAM844 RNA, herein schematically represented by VGAM1 RNA through VGAM3 RNA, each of which VGAM RNAs corresponding to VGAM RNA of FIG. 1.

VGAM843 RNA, herein schematically represented by VGAM1 RNA through VGAM3 RNA, binds complementarily to a host target binding site located in an untranslated region of VGAM843 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM843 host target RNA into VGAM843 host target protein, herein schematically represented by VGAM1 HOST TARGET PROTEIN through VGAM3 HOST TARGET PROTEIN, all of FIG. 1.

VGAM844 RNA, herein schematically represented by VGAM1 RNA through VGAM3 RNA, binds complementarily to a host target binding site located in an untranslated region of VGAM844 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM844 host target RNA into VGAM844 host target protein, herein schematically represented by VGAM1 HOST TARGET PROTEIN through VGAM3 HOST TARGET PROTEIN, all of FIG. 1.

It is appreciated that a function of VGR2907 gene, herein designated VGR GENE, is inhibition of expression of host target genes, as part of a novel viral mechanism of attacking a host. Accordingly, utilities of VGR2907 gene include diagnosis, prevention and treatment of viral infection by Monkeypox Virus. Specific functions, and accordingly utilities, of VGR2907 gene correlate with, and may be deduced from, the identity of the host target genes, which are inhibited by VGAM RNAs comprised in the 'operon-like' cluster of VGR2907 gene: VGAM843 host target protein and VGAM844 host target protein, herein schematically represented by VGAM1 HOST TARGET PROTEIN through VGAM3 HOST TARGET PROTEIN. The function of these host target genes is elaborated hereinabove with reference to VGAM843 and VGAM844. FIG. 9 further provides a conceptual description of novel bioinformatically detected regulatory viral gene, referred to here as Viral Genomic Record 2908(VGR2908) viral gene, which encodes an 'operon-like' cluster of novel viral micro RNA-like genes, each of which in turn modulates expression of at least one host target gene, the function and utility of which at least one host target gene is known in the art.

VGR2908 gene, herein designated VGR GENE, is a novel bioinformatically detected regulatory, non protein coding, RNA viral gene. The method by which VGR2908 gene was detected is described hereinabove with reference to FIGS. 1-9.

VGR2908 gene encodes VGR2908 precursor RNA, herein designated VGR PRECURSOR RNA, an RNA molecule, typically several hundred nucleotides long.

VGR2908 precursor RNA folds spatially, forming VGR2908 folded precursor RNA, herein designated VGR FOLDED PRECURSOR RNA. It is appreciated that VGR2908 folded precursor RNA comprises a plurality of what is known in the art as 'hairpin' structures. These 'hairpin' structures are due to the fact that the nucleotide sequence of VGR2908 precursor RNA comprises a plurality of segments, the first half of each such segment having a nucleotide sequence which is at least a partial inversed-reversed sequence of the second half thereof, as is well known in the art.

VGR2908 folded precursor RNA is naturally processed by cellular enzymatic activity into at least 4 separate VGAM precursor RNAs, VGAM845 precursor RNA, VGAM846 precursor RNA, VGAM847 precursor RNA and VGAM848 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM845 RNA, VGAM846 RNA, VGAM847 RNA and VGAM848 RNA, herein schematically represented by VGAM1 RNA through VGAM3 RNA, each of which VGAM RNAs corresponding to VGAM RNA of FIG. 1.

VGAM845 RNA, herein schematically represented by VGAM1 RNA through VGAM3 RNA, binds complementarily to a host target binding site located in an untranslated region of VGAM845 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM845 host target RNA into VGAM845 host target protein, herein schematically represented by VGAM1 HOST TARGET PROTEIN through VGAM3 HOST TARGET PROTEIN, all of FIG. 1.

VGAM846 RNA, herein schematically represented by VGAM1 RNA through VGAM3 RNA, binds complementarily to a host target binding site located in an untranslated region of VGAM846 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM846 host target RNA into VGAM846 host target protein, herein schematically represented by VGAM1 HOST TARGET PROTEIN through VGAM3 HOST TARGET PROTEIN, all of FIG. 1.

VGAM847 RNA, herein schematically represented by VGAM1 RNA through VGAM3 RNA, binds complementarily to a host target binding site located in an untranslated region of VGAM847 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM847 host target RNA into VGAM847 host target protein, herein schematically represented by VGAM1 HOST TARGET PROTEIN through VGAM3 HOST TARGET PROTEIN, all of FIG. 1.

VGAM848 RNA, herein schematically represented by VGAM1 RNA through VGAM3 RNA, binds complementarily to a host target binding site located in an untranslated region of VGAM848 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM848 host target RNA into VGAM848 host target protein, herein schematically represented by VGAM1 HOST TARGET PROTEIN through VGAM3 HOST TARGET PROTEIN, all of FIG. 1.

It is appreciated that a function of VGR2908 gene, herein designated VGR GENE, is inhibition of expression of host target genes, as part of a novel viral mechanism of attacking a host. Accordingly, utilities of VGR2908 gene include diagnosis, prevention and treatment of viral infection by Gallid Herpesvirus 2. Specific functions, and accordingly utilities, of VGR2908 gene correlate with, and may be deduced from, the identity of the host target genes, which are inhibited by VGAM RNAs comprised in the 'operon-like' cluster of VGR2908 gene: VGAM845 host target protein, VGAM846 host target protein, VGAM847 host target protein and VGAM848 host target protein, herein schematically represented by VGAM1 HOST TARGET PROTEIN through VGAM3 HOST TARGET PROTEIN. The function of these host target genes is elaborated hereinabove with reference to VGAM845, VGAM846, VGAM847 and VGAM848. FIG. 9 further provides a conceptual description of novel bioinformatically detected regulatory viral gene, referred to here as Viral Genomic Record 2909(VGR2909) viral gene, which encodes an 'operon-like' cluster of novel viral micro RNA-like genes, each of which in turn modulates expression of at least one host target gene, the function and utility of which at least one host target gene is known in the art.

VGR2909 gene, herein designated VGR GENE, is a novel bioinformatically detected regulatory, non protein coding, RNA viral gene. The method by which VGR2909 gene was detected is described hereinabove with reference to FIGS. 1-9.

VGR2909 gene encodes VGR2909 precursor RNA, herein designated VGR PRECURSOR RNA, an RNA molecule, typically several hundred nucleotides long.

VGR2909 precursor RNA folds spatially, forming VGR2909 folded precursor RNA, herein designated VGR FOLDED PRECURSOR RNA. It is appreciated that VGR2909 folded precursor RNA comprises a plurality of what is known in the art as 'hairpin' structures. These 'hairpin' structures are due to the fact that the nucleotide sequence of VGR2909 precursor RNA comprises a plurality of segments, the first half of each such segment having a nucleotide sequence which is at least a partial inversed-reversed sequence of the second half thereof, as is well known in the art.

VGR2909 folded precursor RNA is naturally processed by cellular enzymatic activity into at least 3 separate VGAM precursor RNAs, VGAM849 precursor RNA, VGAM850 precursor RNA and VGAM851 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM849 RNA, VGAM850 RNA and VGAM851 RNA, herein schematically represented by VGAM1 RNA through VGAM3 RNA, each of which VGAM RNAs corresponding to VGAM RNA of FIG. 1.

VGAM849 RNA, herein schematically represented by VGAM1 RNA through VGAM3 RNA, binds complementarily to a host target binding site located in an untranslated region of VGAM849 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM849 host target RNA into VGAM849 host target protein, herein schematically represented by VGAM1 HOST TARGET PROTEIN through VGAM3 HOST TARGET PROTEIN, all of FIG. 1.

VGAM850 RNA, herein schematically represented by VGAM1 RNA through VGAM3 RNA, binds complementarily to a host target binding site located in an untranslated region of VGAM850 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM850 host target RNA into VGAM850 host target protein, herein schematically represented by VGAM1 HOST TARGET PROTEIN through VGAM3 HOST TARGET PROTEIN, all of FIG. 1.

VGAM851 RNA, herein schematically represented by VGAM1 RNA through VGAM3 RNA, binds complementarily to a host target binding site located in an untranslated region of VGAM851 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM851 host target RNA into VGAM851 host target protein, herein schematically represented by VGAM1 HOST TARGET PROTEIN through VGAM3 HOST TARGET PROTEIN, all of FIG. 1.

It is appreciated that a function of VGR2909 gene, herein designated VGR GENE, is inhibition of expression of host target genes, as part of a novel viral mechanism of attacking a host. Accordingly, utilities of VGR2909 gene include diagnosis, prevention and treatment of viral infection by Lymphocystis Disease Virus 1. Specific functions, and accordingly utilities, of VGR2909 gene correlate with, and may be deduced from, the identity of the host target genes, which are inhibited by VGAM RNAs comprised in the 'operon-like' cluster of VGR2909 gene: VGAM849 host target protein, VGAM850 host target protein and VGAM851 host target protein, herein schematically represented by VGAM1 HOST TARGET PROTEIN through VGAM3 HOST TARGET PROTEIN. The function of these host target genes is elaborated hereinabove with reference to VGAM849, VGAM850 and VGAM851. FIG. 9 further provides a conceptual description of novel bioinformatically detected regulatory viral gene, referred to here as Viral Genomic Record 2910(VGR2910) viral gene, which encodes an 'operon-like' cluster of novel viral micro RNA-like genes, each of which in turn modulates expression of at least one host target gene, the function and utility of which at least one host target gene is known in the art.

VGR2910 gene, herein designated VGR GENE, is a novel bioinformatically detected regulatory, non protein coding, RNA viral gene. The method by which VGR2910 gene was detected is described hereinabove with reference to FIGS. 1-9.

VGR2910 gene encodes VGR2910 precursor RNA, herein designated VGR PRECURSOR RNA, an RNA molecule, typically several hundred nucleotides long.

VGR2910 precursor RNA folds spatially, forming VGR2910 folded precursor RNA, herein designated VGR FOLDED PRECURSOR RNA. It is appreciated that VGR2910 folded precursor RNA comprises a plurality of what is known in the art as 'hairpin' structures. These 'hairpin' structures are due to the fact that the nucleotide sequence of VGR2910 precursor RNA comprises a plurality of segments, the first half of each such segment having a nucleotide sequence which is at least a partial inversed-reversed sequence of the second half thereof, as is well known in the art.

VGR2910 folded precursor RNA is naturally processed by cellular enzymatic activity into at least 2 separate VGAM precursor RNAs, VGAM855 precursor RNA and VGAM856 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM855 RNA and VGAM856 RNA, herein schematically represented by VGAM1 RNA through VGAM3 RNA, each of which VGAM RNAs corresponding to VGAM RNA of FIG. 1.

VGAM855 RNA, herein schematically represented by VGAM1 RNA through VGAM3 RNA, binds complementarily to a host target binding site located in an untranslated region of VGAM855 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM855 host target RNA into VGAM855 host target protein, herein schematically represented by VGAM1 HOST TARGET PROTEIN through VGAM3 HOST TARGET PROTEIN, all of FIG. 1.

VGAM856 RNA, herein schematically represented by VGAM1 RNA through VGAM3 RNA, binds complementarily to a host target binding site located in an untranslated region of VGAM856 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM856 host target RNA into VGAM856 host target protein, herein schematically represented by VGAM1 HOST TARGET PROTEIN through VGAM3 HOST TARGET PROTEIN, all of FIG. 1.

It is appreciated that a function of VGR2910 gene, herein designated VGR GENE, is inhibition of expression of host target genes, as part of a novel viral mechanism of attacking a host. Accordingly, utilities of VGR2910 gene include diagnosis, prevention and treatment of viral infection by African Swine Fever Virus. Specific functions, and accordingly utilities, of VGR2910 gene correlate with, and may be deduced from, the identity of the host target genes, which are inhibited by VGAM RNAs comprised in the 'operon-like' cluster of VGR2910 gene: VGAM855 host target protein and VGAM856 host target protein, herein schematically represented by VGAM1 HOST TARGET PROTEIN through VGAM3 HOST TARGET PROTEIN. The function of these host target genes is elaborated hereinabove with reference to VGAM855 and VGAM856. FIG. 9 further provides a conceptual description of novel bioinformatically detected regulatory viral gene, referred to here as Viral Genomic Record 2911(VGR2911) viral gene, which encodes an 'operon-like' cluster of novel viral micro RNA-like genes, each of which in turn modulates expression of at least one host target gene, the function and utility of which at least one host target gene is known in the art.

VGR2911 gene, herein designated VGR GENE, is a novel bioinformatically detected regulatory, non protein coding, RNA viral gene. The method by which VGR2911 gene was detected is described hereinabove with reference to FIGS. 1-9.

VGR2911 gene encodes VGR2911 precursor RNA, herein designated VGR PRECURSOR RNA, an RNA molecule, typically several hundred nucleotides long.

VGR2911 precursor RNA folds spatially, forming VGR2911 folded precursor RNA, herein designated VGR FOLDED PRECURSOR RNA. It is appreciated that VGR2911 folded precursor RNA comprises a plurality of what is known in the art as 'hairpin' structures. These 'hairpin' structures are due to the fact that the nucleotide sequence of VGR2911 precursor RNA comprises a plurality of segments, the first half of each such segment having a nucleotide sequence which is at least a partial inversed-reversed sequence of the second half thereof, as is well known in the art.

VGR2911 folded precursor RNA is naturally processed by cellular enzymatic activity into at least 3 separate VGAM precursor RNAs, VGAM857 precursor RNA, VGAM858 precursor RNA and VGAM859 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM857 RNA, VGAM858 RNA and VGAM859 RNA, herein schematically represented by VGAM1 RNA through VGAM3 RNA, each of which VGAM RNAs corresponding to VGAM RNA of FIG. 1.

VGAM857 RNA, herein schematically represented by VGAM1 RNA through VGAM3 RNA, binds complementarily to a host target binding site located in an untranslated region of VGAM857 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM857 host target RNA into VGAM857 host target protein, herein schematically represented by VGAM1 HOST TARGET PROTEIN through VGAM3 HOST TARGET PROTEIN, all of FIG. 1.

VGAM858 RNA, herein schematically represented by VGAM1 RNA through VGAM3 RNA, binds complementarily to a host target binding site located in an untranslated region of VGAM858 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM858 host target RNA into VGAM858 host target protein, herein schematically represented by VGAM1 HOST TARGET PROTEIN through VGAM3 HOST TARGET PROTEIN, all of FIG. 1.

VGAM859 RNA, herein schematically represented by VGAM1 RNA through VGAM3 RNA, binds complementarily to a host target binding site located in an untranslated region of VGAM859 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM859 host target RNA into VGAM859 host target protein, herein schematically represented by VGAM1 HOST TARGET PROTEIN through VGAM3 HOST TARGET PROTEIN, all of FIG. 1.

It is appreciated that a function of VGR2911 gene, herein designated VGR GENE, is inhibition of expression of host target genes, as part of a novel viral mechanism of attacking a host. Accordingly, utilities of VGR2911 gene include diagnosis, prevention and treatment of viral infection by Ectromelia Virus. Specific functions, and accordingly utilities, of VGR2911 gene correlate with, and may be deduced from, the identity of the host target genes, which are inhibited by VGAM RNAs comprised in the 'operon-like' cluster of VGR2911 gene: VGAM857 host target protein, VGAM858 host target protein and VGAM859 host target protein, herein schematically represented by VGAM1 HOST TARGET PROTEIN through VGAM3 HOST TARGET PROTEIN. The function of these host target genes is elaborated hereinabove with reference to VGAM857, VGAM858 and VGAM859. FIG. 9 further provides a conceptual description of novel bioinformatically detected regulatory viral gene, referred to here as Viral Genomic Record 2912(VGR2912) viral gene, which encodes an 'operon-like' cluster of novel viral micro RNA-like genes, each of which in turn modulates expression of at least one host target gene, the function and utility of which at least one host target gene is known in the art.

VGR2912 gene, herein designated VGR GENE, is a novel bioinformatically detected regulatory, non protein coding, RNA viral gene. The method by which VGR2912 gene was detected is described hereinabove with reference to FIGS. 1-9.

VGR2912 gene encodes VGR2912 precursor RNA, herein designated VGR PRECURSOR RNA, an RNA molecule, typically several hundred nucleotides long.

VGR2912 precursor RNA folds spatially, forming VGR2912 folded precursor RNA, herein designated VGR FOLDED PRECURSOR RNA. It is appreciated that VGR2912 folded precursor RNA comprises a plurality of what is known in the art as 'hairpin' structures. These 'hairpin' structures are due to the fact that the nucleotide sequence of VGR2912 precursor RNA comprises a plurality of segments, the first half of each such segment having a nucleotide sequence which is at least a partial inversed-reversed sequence of the second half thereof, as is well known in the art.

VGR2912 folded precursor RNA is naturally processed by cellular enzymatic activity into at least 4 separate VGAM precursor RNAs, VGAM861 precursor RNA, VGAM862 precursor RNA, VGAM863 precursor RNA and VGAM864 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM861 RNA, VGAM862 RNA, VGAM863 RNA and VGAM864 RNA, herein schematically represented by VGAM1 RNA through VGAM3 RNA, each of which VGAM RNAs corresponding to VGAM RNA of FIG. 1.

VGAM861 RNA, herein schematically represented by VGAM1 RNA through VGAM3 RNA, binds complementarily to a host target binding site located in an untranslated region of VGAM861 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM861 host target RNA into VGAM861 host target protein, herein schematically represented by VGAM1 HOST TARGET PROTEIN through VGAM3 HOST TARGET PROTEIN, all of FIG. 1.

VGAM862 RNA, herein schematically represented by VGAM1 RNA through VGAM3 RNA, binds complementarily to a host target binding site located in an untranslated region of VGAM862 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM862 host target RNA into VGAM862 host target protein, herein schematically represented by VGAM1 HOST TARGET PROTEIN through VGAM3 HOST TARGET PROTEIN, all of FIG. 1.

VGAM863 RNA, herein schematically represented by VGAM1 RNA through VGAM3 RNA, binds complementarily to a host target binding site located in an untranslated region of VGAM863 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM863 host target RNA into VGAM863 host target protein, herein schematically represented by VGAM1 HOST TARGET PROTEIN through VGAM3 HOST TARGET PROTEIN, all of FIG. 1.

VGAM864 RNA, herein schematically represented by VGAM1 RNA through VGAM3 RNA, binds complementarily to a host target binding site located in an untranslated region of VGAM864 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM864 host target RNA into VGAM864 host target protein, herein schematically represented by VGAM1 HOST TARGET PROTEIN through VGAM3 HOST TARGET PROTEIN, all of FIG. 1.

It is appreciated that a function of VGR2912 gene, herein designated VGR GENE, is inhibition of expression of host target genes, as part of a novel viral mechanism of attacking a host. Accordingly, utilities of VGR2912 gene include diagnosis, prevention and treatment of viral infection by Ictalurid Herpesvirus 1. Specific functions, and accordingly utilities, of VGR2912 gene correlate with, and may be deduced from, the identity of the host target genes, which are inhibited by VGAM RNAs comprised in the 'operon-like' cluster of VGR2912 gene: VGAM861 host target protein, VGAM862 host target protein, VGAM863 host target protein and VGAM864 host target protein, herein schematically represented by VGAM1 HOST TARGET PROTEIN through VGAM3 HOST TARGET PROTEIN. The function of these host target genes is elaborated hereinabove with reference to VGAM861, VGAM862, VGAM863 and VGAM864. FIG. 9 further provides a conceptual description of novel bioinformatically detected regulatory viral gene, referred to here as Viral Genomic Record 2913(VGR2913) viral gene, which encodes an 'operon-like' cluster of novel viral micro RNA-like genes, each of which in turn modulates expression of at least one host target gene, the function and utility of which at least one host target gene is known in the art.

VGR2913 gene, herein designated VGR GENE, is a novel bioinformatically detected regulatory, non protein coding, RNA viral gene. The method by which VGR2913 gene was detected is described hereinabove with reference to FIGS. 1-9.

VGR2913 gene encodes VGR2913 precursor RNA, herein designated VGR PRECURSOR RNA, an RNA molecule, typically several hundred nucleotides long.

VGR2913 precursor RNA folds spatially, forming VGR2913 folded precursor RNA, herein designated VGR FOLDED PRECURSOR RNA. It is appreciated that VGR2913 folded precursor RNA comprises a plurality of what is known in the art as 'hairpin' structures. These 'hairpin' structures are due to the fact that the nucleotide sequence of VGR2913 precursor RNA comprises a plurality of segments, the first half of each such segment having a nucleotide sequence which is at least a partial inversed-reversed sequence of the second half thereof, as is well known in the art.

VGR2913 folded precursor RNA is naturally processed by cellular enzymatic activity into at least 2 separate VGAM precursor RNAs, VGAM865 precursor RNA and VGAM866 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM865 RNA and VGAM866 RNA, herein schematically represented by VGAM1 RNA through VGAM3 RNA, each of which VGAM RNAs corresponding to VGAM RNA of FIG. 1.

VGAM865 RNA, herein schematically represented by VGAM1 RNA through VGAM3 RNA, binds complementarily to a host target binding site located in an untranslated region of VGAM865 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM865 host target RNA into VGAM865 host target protein, herein schematically represented by VGAM1 HOST TARGET PROTEIN through VGAM3 HOST TARGET PROTEIN, all of FIG. 1.

VGAM866 RNA, herein schematically represented by VGAM1 RNA through VGAM3 RNA, binds complementarily to a host target binding site located in an untranslated region of VGAM866 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM866 host target RNA into VGAM866 host target protein, herein schematically represented by VGAM1 HOST TARGET PROTEIN through VGAM3 HOST TARGET PROTEIN, all of FIG. 1.

It is appreciated that a function of VGR2913 gene, herein designated VGR GENE, is inhibition of expression of host target genes, as part of a novel viral mechanism of attacking a host. Accordingly, utilities of VGR2913 gene include diagnosis, prevention and treatment of viral infection by Swinepox Virus. Specific functions, and accordingly utilities, of VGR2913 gene correlate with, and may be deduced from, the identity of the host target genes, which are inhibited by VGAM RNAs comprised in the 'operon-like' cluster of VGR2913 gene: VGAM865 host target protein and VGAM866 host target protein, herein schematically represented by VGAM1 HOST TARGET PROTEIN through VGAM3 HOST TARGET PROTEIN. The function of these host target genes is elaborated hereinabove with reference to VGAM865 and VGAM866. FIG. 9 further provides a conceptual description of novel bioinformatically detected regulatory viral gene, referred to here as Viral Genomic Record 2914(VGR2914) viral gene, which encodes an 'operon-like' cluster of novel viral micro RNA-like genes, each of which in turn modulates expression of at least one host target gene, the function and utility of which at least one host target gene is known in the art.

VGR2914 gene, herein designated VGR GENE, is a novel bioinformatically detected regulatory, non protein coding, RNA viral gene. The method by which VGR2914 gene was detected is described hereinabove with reference to FIGS. 1-9.

VGR2914 gene encodes VGR2914 precursor RNA, herein designated VGR PRECURSOR RNA, an RNA molecule, typically several hundred nucleotides long.

VGR2914 precursor RNA folds spatially, forming VGR2914 folded precursor RNA, herein designated VGR FOLDED PRECURSOR RNA. It is appreciated that VGR2914 folded precursor RNA comprises a plurality of what is known in the art as 'hairpin' structures. These 'hairpin' structures are due to the fact that the nucleotide sequence of VGR2914 precursor RNA comprises a plurality of segments, the first half of each such segment having a nucleotide sequence which is at least a partial inversed-reversed sequence of the second half thereof, as is well known in the art.

VGR2914 folded precursor RNA is naturally processed by cellular enzymatic activity into at least 2 separate VGAM precursor RNAs, VGAM867 precursor RNA and VGAM868 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM867 RNA and VGAM868 RNA, herein schematically represented by VGAM1 RNA through VGAM3 RNA, each of which VGAM RNAs corresponding to VGAM RNA of FIG. 1.

VGAM867 RNA, herein schematically represented by VGAM1 RNA through VGAM3 RNA, binds complementarily to a host target binding site located in an untranslated region of VGAM867 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM867 host target RNA into VGAM867 host target protein, herein schematically represented by VGAM1 HOST TARGET PROTEIN through VGAM3 HOST TARGET PROTEIN, all of FIG. 1.

VGAM868 RNA, herein schematically represented by VGAM1 RNA through VGAM3 RNA, binds complementarily to a host target binding site located in an untranslated region of VGAM868 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM868 host target RNA into VGAM868 host target protein, herein schematically represented by VGAM1 HOST TARGET PROTEIN through VGAM3 HOST TARGET PROTEIN, all of FIG. 1.

It is appreciated that a function of VGR2914 gene, herein designated VGR GENE, is inhibition of expression of host target genes, as part of a novel viral mechanism of attacking a host. Accordingly, utilities of VGR2914 gene include diagnosis, prevention and treatment of viral infection by Turkey Adenovirus 3. Specific functions, and accordingly utilities, of VGR2914 gene correlate with, and may be deduced from, the identity of the host target genes, which are inhibited by VGAM RNAs comprised in the 'operon-like' cluster of VGR2914 gene: VGAM867 host target protein and VGAM868 host target protein, herein schematically represented by VGAM1 HOST TARGET PROTEIN through VGAM3 HOST TARGET PROTEIN. The function of these host target genes is elaborated hereinabove with reference to VGAM867 and VGAM868. FIG. 9 further provides a conceptual description of novel bioinformatically detected regulatory viral gene, referred to here as Viral Genomic Record 2915(VGR2915) viral gene, which encodes an 'operon-like' cluster of novel viral micro RNA-like genes, each of which in turn modulates expression of at least one host target gene, the function and utility of which at least one host target gene is known in the art.

VGR2915 gene, herein designated VGR GENE, is a novel bioinformatically detected regulatory, non protein coding, RNA viral gene. The method by which VGR2915 gene was detected is described hereinabove with reference to FIGS. 1-9.

VGR2915 gene encodes VGR2915 precursor RNA, herein designated VGR PRECURSOR RNA, an RNA molecule, typically several hundred nucleotides long.

VGR2915 precursor RNA folds spatially, forming VGR2915 folded precursor RNA, herein designated VGR FOLDED PRECURSOR RNA. It is appreciated that VGR2915 folded precursor RNA comprises a plurality of what is known in the art as 'hairpin' structures. These 'hairpin' structures are due to the fact that the nucleotide sequence of VGR2915 precursor RNA comprises a plurality of segments, the first half of each such segment having a nucleotide sequence which is at least a partial inversed-reversed sequence of the second half thereof, as is well known in the art.

VGR2915 folded precursor RNA is naturally processed by cellular enzymatic activity into at least 5 separate VGAM precursor RNAs, VGAM869 precursor RNA, VGAM870 precursor RNA, VGAM871 precursor RNA, VGAM872 precursor RNA and VGAM873 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM869 RNA, VGAM870 RNA, VGAM871 RNA, VGAM872 RNA and VGAM873 RNA, herein schematically represented by VGAM1 RNA through VGAM3 RNA, each of which VGAM RNAs corresponding to VGAM RNA of FIG. 1.

VGAM869 RNA, herein schematically represented by VGAM1 RNA through VGAM3 RNA, binds complementarily to a host target binding site located in an untranslated region of VGAM869 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM869 host target RNA into VGAM869 host target protein, herein schematically represented by VGAM1 HOST TARGET PROTEIN through VGAM3 HOST TARGET PROTEIN, all of FIG. 1.

VGAM870 RNA, herein schematically represented by VGAM1 RNA through VGAM3 RNA, binds complementarily to a host target binding site located in an untranslated region of VGAM870 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM870 host target RNA into VGAM870 host target protein, herein schematically represented by VGAM1 HOST TARGET PROTEIN through VGAM3 HOST TARGET PROTEIN, all of FIG. 1.

VGAM871 RNA, herein schematically represented by VGAM1 RNA through VGAM3 RNA, binds complementarily to a host target binding site located in an untranslated region of VGAM871 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM871 host target RNA into VGAM871 host target protein, herein schematically represented by VGAM1 HOST TARGET PROTEIN through VGAM3 HOST TARGET PROTEIN, all of FIG. 1.

VGAM872 RNA, herein schematically represented by VGAM1 RNA through VGAM3 RNA, binds complementarily to a host target binding site located in an untranslated region of VGAM872 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM872 host target RNA into VGAM872 host target protein, herein schematically represented by VGAM1 HOST TARGET PROTEIN through VGAM3 HOST TARGET PROTEIN, all of FIG. 1.

VGAM873 RNA, herein schematically represented by VGAM1 RNA through VGAM3 RNA, binds complementarily to a host target binding site located in an untranslated region of VGAM873 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM873 host target RNA into VGAM873 host target protein, herein schematically represented by VGAM1 HOST TARGET PROTEIN through VGAM3 HOST TARGET PROTEIN, all of FIG. 1.

It is appreciated that a function of VGR2915 gene, herein designated VGR GENE, is inhibition of expression of host target genes, as part of a novel viral mechanism of attacking a host. Accordingly, utilities of VGR2915 gene include diagnosis, prevention and treatment of viral infection by Fowlpox Virus. Specific functions, and accordingly utilities, of VGR2915 gene correlate with, and may be deduced from, the identity of the host target genes, which are inhibited by VGAM RNAs comprised in the 'operon-like' cluster of VGR2915 gene: VGAM869 host target protein, VGAM870 host target protein, VGAM871 host target protein, VGAM872 host target protein and VGAM873 host target protein, herein schematically represented by VGAM1 HOST TARGET PROTEIN through VGAM3 HOST TARGET PROTEIN. The function of these host target genes is elaborated hereinabove with reference to VGAM869, VGAM870, VGAM871, VGAM872 and VGAM873. FIG. 9 further provides a conceptual description of novel bioinformatically detected regulatory viral gene, referred to here as Viral Genomic Record 2916(VGR2916) viral gene, which encodes an 'operon-like' cluster of novel viral micro RNA-like genes, each of which in turn modulates expression of at least one host target gene, the function and utility of which at least one host target gene is known in the art.

VGR2916 gene, herein designated VGR GENE, is a novel bioinformatically detected regulatory, non protein coding, RNA viral gene. The method by which VGR2916 gene was detected is described hereinabove with reference to FIGS. 1-9.

VGR2916 gene encodes VGR2916 precursor RNA, herein designated VGR PRECURSOR RNA, an RNA molecule, typically several hundred nucleotides long.

VGR2916 precursor RNA folds spatially, forming VGR2916 folded precursor RNA, herein designated VGR FOLDED PRECURSOR RNA. It is appreciated that VGR2916 folded precursor RNA comprises a plurality of what is known in the art as 'hairpin' structures. These 'hairpin' structures are due to the fact that the nucleotide sequence of VGR2916 precursor RNA comprises a plurality of segments, the first half of each such segment having a nucleotide sequence which is at least a partial inversed-reversed sequence of the second half thereof, as is well known in the art.

VGR2916 folded precursor RNA is naturally processed by cellular enzymatic activity into at least 3 separate VGAM precursor RNAs, VGAM875 precursor RNA, VGAM876 precursor RNA and VGAM877 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM875 RNA, VGAM876 RNA and VGAM877 RNA, herein schematically represented by VGAM1 RNA through VGAM3 RNA, each of which VGAM RNAs corresponding to VGAM RNA of FIG. 1.

VGAM875 RNA, herein schematically represented by VGAM1 RNA through VGAM3 RNA, binds complementarily to a host target binding site located in an untranslated region of VGAM875 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM875 host target RNA into VGAM875 host target protein, herein schematically represented by VGAM1 HOST TARGET PROTEIN through VGAM3 HOST TARGET PROTEIN, all of FIG. 1.

VGAM876 RNA, herein schematically represented by VGAM1 RNA through VGAM3 RNA, binds complementarily to a host target binding site located in an untranslated region of VGAM876 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM876 host target RNA into VGAM876 host target protein, herein schematically represented by VGAM1 HOST TARGET PROTEIN through VGAM3 HOST TARGET PROTEIN, all of FIG. 1.

VGAM877 RNA, herein schematically represented by VGAM1 RNA through VGAM3 RNA, binds complementarily to a host target binding site located in an untranslated region of VGAM877 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM877 host target RNA into VGAM877 host target protein, herein schematically represented by VGAM1 HOST TARGET PROTEIN through VGAM3 HOST TARGET PROTEIN, all of FIG. 1.

It is appreciated that a function of VGR2916 gene, herein designated VGR GENE, is inhibition of expression of host target genes, as part of a novel viral mechanism of attacking a host. Accordingly, utilities of VGR2916 gene include diagnosis, prevention and treatment of viral infection by Human Herpesvirus 5. Specific functions, and accordingly utilities, of VGR2916 gene correlate with, and may be deduced from, the identity of the host target genes, which are inhibited by VGAM RNAs comprised in the 'operon-like' cluster of VGR2916 gene: VGAM875 host target protein, VGAM876 host target protein and VGAM877 host target protein, herein schematically represented by VGAM1 HOST TARGET PROTEIN through VGAM3 HOST TARGET PROTEIN. The function of these host target genes is elaborated hereinabove with reference to VGAM875, VGAM876 and VGAM877. FIG. 9 further provides a conceptual description of novel bioinformatically detected regulatory viral gene, referred to here as Viral Genomic Record 2917(VGR2917) viral gene, which encodes an 'operon-like' cluster of novel viral micro RNA-like genes, each of which in turn modulates expression of at least one host target gene, the function and utility of which at least one host target gene is known in the art.

VGR2917 gene, herein designated VGR GENE, is a novel bioinformatically detected regulatory, non protein coding, RNA viral gene. The method by which VGR2917 gene was detected is described hereinabove with reference to FIGS. 1-9.

VGR2917 gene encodes VGR2917 precursor RNA, herein designated VGR PRECURSOR RNA, an RNA molecule, typically several hundred nucleotides long.

VGR2917 precursor RNA folds spatially, forming VGR2917 folded precursor RNA, herein designated VGR FOLDED PRECURSOR RNA. It is appreciated that VGR2917 folded precursor RNA comprises a plurality of what is known in the art as 'hairpin' structures. These 'hairpin' structures are due to the fact that the nucleotide sequence of VGR2917 precursor RNA comprises a plurality of segments, the first half of each such segment having a nucleotide sequence which is at least a partial inversed-reversed sequence of the second half thereof, as is well known in the art.

VGR2917 folded precursor RNA is naturally processed by cellular enzymatic activity into at least 2 separate VGAM precursor RNAs, VGAM880 precursor RNA and VGAM881 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM880 RNA and VGAM881 RNA, herein schematically represented by VGAM1 RNA through VGAM3 RNA, each of which VGAM RNAs corresponding to VGAM RNA of FIG. 1.

VGAM880 RNA, herein schematically represented by VGAM1 RNA through VGAM3 RNA, binds complementarily to a host target binding site located in an untranslated region of VGAM880 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM880 host target RNA into VGAM880 host target protein, herein schematically represented by VGAM1 HOST TARGET PROTEIN through VGAM3 HOST TARGET PROTEIN, all of FIG. 1.

VGAM881 RNA, herein schematically represented by VGAM1 RNA through VGAM3 RNA, binds complementarily to a host target binding site located in an untranslated region of VGAM881 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM881 host target RNA into VGAM881 host target protein, herein schematically represented by VGAM1 HOST TARGET PROTEIN through VGAM3 HOST TARGET PROTEIN, all of FIG. 1.

It is appreciated that a function of VGR2917 gene, herein designated VGR GENE, is inhibition of expression of host target genes, as part of a novel viral mechanism of attacking a host. Accordingly, utilities of VGR2917 gene include diagnosis, prevention and treatment of viral infection by Gallid Herpesvirus 3. Specific functions, and accordingly utilities, of VGR2917 gene correlate with, and may be deduced from, the identity of the host target genes, which are inhibited by VGAM RNAs comprised in the 'operon-like' cluster of VGR2917 gene: VGAM880 host target protein and VGAM881 host target protein, herein schematically represented by VGAM1 HOST TARGET PROTEIN through VGAM3 HOST TARGET PROTEIN. The function of these host target genes is elaborated hereinabove with reference to VGAM880 and VGAM881. FIG. 9 further provides a conceptual description of novel bioinformatically detected regulatory viral gene, referred to here as Viral Genomic Record 2918(VGR2918) viral gene, which encodes an 'operon-like' cluster of novel viral micro RNA-like genes, each of which in turn modulates expression of at least one host target gene, the function and utility of which at least one host target gene is known in the art.

VGR2918 gene, herein designated VGR GENE, is a novel bioinformatically detected regulatory, non protein coding, RNA viral gene. The method by which VGR2918 gene was detected is described hereinabove with reference to FIGS. 1-9.

VGR2918 gene encodes VGR2918 precursor RNA, herein designated VGR PRECURSOR RNA, an RNA molecule, typically several hundred nucleotides long.

VGR2918 precursor RNA folds spatially, forming VGR2918 folded precursor RNA, herein designated VGR FOLDED PRECURSOR RNA. It is appreciated that VGR2918 folded precursor RNA comprises a plurality of what is known in the art as 'hairpin' structures. These 'hairpin' structures are due to the fact that the nucleotide sequence of VGR2918 precursor RNA comprises a plurality of segments, the first half of each such segment having a nucleotide sequence which is at least a partial inversed-reversed sequence of the second half thereof, as is well known in the art.

VGR2918 folded precursor RNA is naturally processed by cellular enzymatic activity into at least 2 separate VGAM precursor RNAs, VGAM886 precursor RNA and VGAM887 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM886 RNA and VGAM887 RNA, herein schematically represented by VGAM1 RNA through VGAM3 RNA, each of which VGAM RNAs corresponding to VGAM RNA of FIG. 1.

VGAM886 RNA, herein schematically represented by VGAM1 RNA through VGAM3 RNA, binds complementarily to a host target binding site located in an untranslated region of VGAM886 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM886 host target RNA into VGAM886 host target protein, herein schematically represented by VGAM1 HOST TARGET PROTEIN through VGAM3 HOST TARGET PROTEIN, all of FIG. 1.

VGAM887 RNA, herein schematically represented by VGAM1 RNA through VGAM3 RNA, binds complementarily to a host target binding site located in an untranslated region of VGAM887 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM887 host target RNA into VGAM887 host target protein, herein schematically represented by VGAM1 HOST TARGET PROTEIN through VGAM3 HOST TARGET PROTEIN, all of FIG. 1.

It is appreciated that a function of VGR2918 gene, herein designated VGR GENE, is inhibition of expression of host target genes, as part of a novel viral mechanism of attacking a host. Accordingly, utilities of VGR2918 gene include diagnosis, prevention and treatment of viral infection by Vaccinia Virus. Specific functions, and accordingly utilities, of VGR2918 gene correlate with, and may be deduced from, the identity of the host target genes, which are inhibited by VGAM RNAs comprised in the 'operon-like' cluster of VGR2918 gene: VGAM886 host target protein and VGAM887 host target protein, herein schematically represented by VGAM1 HOST TARGET PROTEIN through VGAM3 HOST TARGET PROTEIN. The function of these host target genes is elaborated hereinabove with reference to VGAM886 and VGAM887. FIG. 9 further provides a conceptual description of novel bioinformatically detected regulatory viral gene, referred to here as Viral Genomic Record 2919(VGR2919) viral gene, which encodes an 'operon-like' cluster of novel viral micro RNA-like genes, each of which in turn modulates expression of at least one host target gene, the function and utility of which at least one host target gene is known in the art.

VGR2919 gene, herein designated VGR GENE, is a novel bioinformatically detected regulatory, non protein coding, RNA viral gene. The method by which VGR2919 gene was detected is described hereinabove with reference to FIGS. 1-9.

VGR2919 gene encodes VGR2919 precursor RNA, herein designated VGR PRECURSOR RNA, an RNA molecule, typically several hundred nucleotides long.

VGR2919 precursor RNA folds spatially, forming VGR2919 folded precursor RNA, herein designated VGR FOLDED PRECURSOR RNA. It is appreciated that VGR2919 folded precursor RNA comprises a plurality of what is known in the art as 'hairpin' structures. These 'hairpin' structures are due to the fact that the nucleotide sequence of VGR2919 precursor RNA comprises a plurality of segments, the first half of each such segment having a nucleotide sequence which is at least a partial inversed-reversed sequence of the second half thereof, as is well known in the art.

VGR2919 folded precursor RNA is naturally processed by cellular enzymatic activity into at least 4 separate VGAM precursor RNAs, VGAM888 precursor RNA, VGAM889 precursor RNA, VGAM890 precursor RNA and VGAM891 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM888 RNA, VGAM889 RNA, VGAM890 RNA and VGAM891 RNA, herein schematically represented by VGAM1 RNA through VGAM3 RNA, each of which VGAM RNAs corresponding to VGAM RNA of FIG. 1.

VGAM888 RNA, herein schematically represented by VGAM1 RNA through VGAM3 RNA, binds complementarily to a host target binding site located in an untranslated region of VGAM888 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM888 host target RNA into VGAM888 host target protein, herein schematically represented by VGAM1 HOST TARGET PROTEIN through VGAM3 HOST TARGET PROTEIN, all of FIG. 1.

VGAM889 RNA, herein schematically represented by VGAM1 RNA through VGAM3 RNA, binds complementarily to a host target binding site located in an untranslated region of VGAM889 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM889 host target RNA into VGAM889 host target protein, herein schematically represented by VGAM1 HOST TARGET PROTEIN through VGAM3 HOST TARGET PROTEIN, all of FIG. 1.

VGAM890 RNA, herein schematically represented by VGAM1 RNA through VGAM3 RNA, binds complementarily to a host target binding site located in an untranslated region of VGAM890 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM890 host target RNA into VGAM890 host target protein, herein schematically represented by VGAM1 HOST TARGET PROTEIN through VGAM3 HOST TARGET PROTEIN, all of FIG. 1.

VGAM891 RNA, herein schematically represented by VGAM1 RNA through VGAM3 RNA, binds complementarily to a host target binding site located in an untranslated region of VGAM891 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM891 host target RNA into VGAM891 host target protein, herein schematically represented by VGAM1 HOST TARGET PROTEIN through VGAM3 HOST TARGET PROTEIN, all of FIG. 1.

It is appreciated that a function of VGR2919 gene, herein designated VGR GENE, is inhibition of expression of host target genes, as part of a novel viral mechanism of attacking a host. Accordingly, utilities of VGR2919 gene include diagnosis, prevention and treatment of viral infection by Human Herpesvirus 4. Specific functions, and accordingly utilities, of VGR2919 gene correlate with, and may be deduced from, the identity of the host target genes, which are inhibited by VGAM RNAs comprised in the 'operon-like' cluster of VGR2919 gene: VGAM888 host target protein, VGAM889 host target protein, VGAM890 host target protein and VGAM891 host target protein, herein schematically represented by VGAM1 HOST TARGET PROTEIN through VGAM3 HOST TARGET PROTEIN. The function of these host target genes is elaborated hereinabove with reference to VGAM888, VGAM889, VGAM890 and VGAM891. FIG. 9 further provides a conceptual description of novel bioinformatically detected regulatory viral gene, referred to here as Viral Genomic Record 2920(VGR2920) viral gene, which encodes an 'operon-like' cluster of novel viral micro RNA-like genes, each of which in turn modulates expression of at least one host target gene, the function and utility of which at least one host target gene is known in the art.

VGR2920 gene, herein designated VGR GENE, is a novel bioinformatically detected regulatory, non protein coding, RNA viral gene. The method by which VGR2920 gene was detected is described hereinabove with reference to FIGS. 1-9.

VGR2920 gene encodes VGR2920 precursor RNA, herein designated VGR PRECURSOR RNA, an RNA molecule, typically several hundred nucleotides long.

VGR2920 precursor RNA folds spatially, forming VGR2920 folded precursor RNA, herein designated VGR FOLDED PRECURSOR RNA. It is appreciated that VGR2920 folded precursor RNA comprises a plurality of what is known in the art as 'hairpin' structures. These 'hairpin' structures are due to the fact that the nucleotide sequence of VGR2920 precursor RNA comprises a plurality of segments, the first half of each such segment having a nucleotide sequence which is at least a partial inversed-reversed sequence of the second half thereof, as is well known in the art.

VGR2920 folded precursor RNA is naturally processed by cellular enzymatic activity into at least 3 separate VGAM precursor RNAs, VGAM892 precursor RNA, VGAM893 precursor RNA and VGAM894 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM892 RNA, VGAM893 RNA and VGAM894 RNA, herein schematically represented by VGAM1 RNA through VGAM3 RNA, each of which VGAM RNAs corresponding to VGAM RNA of FIG. 1.

VGAM892 RNA, herein schematically represented by VGAM1 RNA through VGAM3 RNA, binds complementarily to a host target binding site located in an untranslated region of VGAM892 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM892 host target RNA into VGAM892 host target protein, herein schematically represented by VGAM1 HOST TARGET PROTEIN through VGAM3 HOST TARGET PROTEIN, all of FIG. 1.

VGAM893 RNA, herein schematically represented by VGAM1 RNA through VGAM3 RNA, binds complementarily to a host target binding site located in an untranslated region of VGAM893 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM893 host target RNA into VGAM893 host target protein, herein schematically represented by VGAM1 HOST TARGET PROTEIN through VGAM3 HOST TARGET PROTEIN, all of FIG. 1.

VGAM894 RNA, herein schematically represented by VGAM1 RNA through VGAM3 RNA, binds complementarily to a host target binding site located in an untranslated region of VGAM894 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM894 host target RNA into VGAM894 host target protein, herein schematically represented by VGAM1 HOST TARGET PROTEIN through VGAM3 HOST TARGET PROTEIN, all of FIG. 1.

It is appreciated that a function of VGR2920 gene, herein designated VGR GENE, is inhibition of expression of host target genes, as part of a novel viral mechanism of attacking a host. Accordingly, utilities of VGR2920 gene include diagnosis, prevention and treatment of viral infection by Periplaneta Fuliginosa Densovirus. Specific functions, and accordingly utilities, of VGR2920 gene correlate with, and may be deduced from, the identity of the host target genes, which are inhibited by VGAM RNAs comprised in the 'operon-like' cluster of VGR2920 gene: VGAM892 host target protein, VGAM893 host target protein and VGAM894 host target protein, herein schematically represented by VGAM1 HOST TARGET PROTEIN through VGAM3 HOST TARGET PROTEIN. The function of these host target genes is elaborated hereinabove with reference to VGAM892, VGAM893 and VGAM894. FIG. 9 further provides a conceptual description of novel bioinformatically detected regulatory viral gene, referred to here as Viral Genomic Record 2921(VGR2921) viral gene, which encodes an 'operon-like' cluster of novel viral micro RNA-like genes, each of which in turn modulates expression of at least one host target gene, the function and utility of which at least one host target gene is known in the art.

VGR2921 gene, herein designated VGR GENE, is a novel bioinformatically detected regulatory, non protein coding, RNA viral gene. The method by which VGR2921 gene was detected is described hereinabove with reference to FIGS. 1-9.

VGR2921 gene encodes VGR2921 precursor RNA, herein designated VGR PRECURSOR RNA, an RNA molecule, typically several hundred nucleotides long.

VGR2921 precursor RNA folds spatially, forming VGR2921 folded precursor RNA, herein designated VGR FOLDED PRECURSOR RNA. It is appreciated that VGR2921 folded precursor RNA comprises a plurality of what is known in the art as 'hairpin' structures. These 'hairpin' structures are due to the fact that the nucleotide sequence of VGR2921 precursor RNA comprises a plurality of segments, the first half of each such segment having a nucleotide sequence which is at least a partial inversed-reversed sequence of the second half thereof, as is well known in the art.

VGR2921 folded precursor RNA is naturally processed by cellular enzymatic activity into at least 3 separate VGAM precursor RNAs, VGAM895 precursor RNA, VGAM896 precursor RNA and VGAM897 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM895 RNA, VGAM896 RNA and VGAM897 RNA, herein schematically represented by VGAM1 RNA through VGAM3 RNA, each of which VGAM RNAs corresponding to VGAM RNA of FIG. 1.

VGAM895 RNA, herein schematically represented by VGAM1 RNA through VGAM3 RNA, binds complementarily to a host target binding site located in an untranslated region of VGAM895 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM895 host target RNA into VGAM895 host target protein, herein schematically represented by VGAM1 HOST TARGET PROTEIN through VGAM3 HOST TARGET PROTEIN, all of FIG. 1.

VGAM896 RNA, herein schematically represented by VGAM1 RNA through VGAM3 RNA, binds complementarily to a host target binding site located in an untranslated region of VGAM896 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM896 host target RNA into VGAM896 host target protein, herein schematically represented by VGAM1 HOST TARGET PROTEIN through VGAM3 HOST TARGET PROTEIN, all of FIG. 1.

VGAM897 RNA, herein schematically represented by VGAM1 RNA through VGAM3 RNA, binds complementarily to a host target binding site located in an untranslated region of VGAM897 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM897 host target RNA into VGAM897 host target protein, herein schematically represented by VGAM1 HOST TARGET PROTEIN through VGAM3 HOST TARGET PROTEIN, all of FIG. 1.

It is appreciated that a function of VGR2921 gene, herein designated VGR GENE, is inhibition of expression of host target genes, as part of a novel viral mechanism of attacking a host. Accordingly, utilities of VGR2921 gene include diagnosis, prevention and treatment of viral infection by Gallid Herpesvirus 2. Specific functions, and accordingly utilities, of VGR2921 gene correlate with, and may be deduced from, the identity of the host target genes, which are inhibited by VGAM RNAs comprised in the 'operon-like' cluster of VGR2921 gene: VGAM895 host target protein, VGAM896 host target protein and VGAM897 host target protein, herein schematically represented by VGAM1 HOST TARGET PROTEIN through VGAM3 HOST TARGET PROTEIN. The function of these host target genes is elaborated hereinabove with reference to VGAM895, VGAM896 and VGAM897. FIG. 9 further provides a conceptual description of novel bioinformatically detected regulatory viral gene, referred to here as Viral Genomic Record 2922(VGR2922) viral gene, which encodes an 'operon-like' cluster of novel viral micro RNA-like genes, each of which in turn modulates expression of at least one host target gene, the function and utility of which at least one host target gene is known in the art.

VGR2922 gene, herein designated VGR GENE, is a novel bioinformatically detected regulatory, non protein coding, RNA viral gene. The method by which VGR2922 gene was detected is described hereinabove with reference to FIGS. 1-9.

VGR2922 gene encodes VGR2922 precursor RNA, herein designated VGR PRECURSOR RNA, an RNA molecule, typically several hundred nucleotides long.

VGR2922 precursor RNA folds spatially, forming VGR2922 folded precursor RNA, herein designated VGR FOLDED PRECURSOR RNA. It is appreciated that VGR2922 folded precursor RNA comprises a plurality of what is known in the art as 'hairpin' structures. These 'hairpin' structures are due to the fact that the nucleotide sequence of VGR2922 precursor RNA comprises a plurality of segments, the first half of each such segment having a nucleotide sequence which is at least a partial inversed-reversed sequence of the second half thereof, as is well known in the art.

VGR2922 folded precursor RNA is naturally processed by cellular enzymatic activity into at least 2 separate VGAM precursor RNAs, VGAM901 precursor RNA and VGAM902 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM901 RNA and VGAM902 RNA, herein schematically represented by VGAM1 RNA through VGAM3 RNA, each of which VGAM RNAs corresponding to VGAM RNA of FIG. 1.

VGAM901 RNA, herein schematically represented by VGAM1 RNA through VGAM3 RNA, binds complementarily to a host target binding site located in an untranslated region of VGAM901 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM901 host target RNA into VGAM901 host target protein, herein schematically represented by VGAM1 HOST TARGET PROTEIN through VGAM3 HOST TARGET PROTEIN, all of FIG. 1.

VGAM902 RNA, herein schematically represented by VGAM1 RNA through VGAM3 RNA, binds complementarily to a host target binding site located in an untranslated region of VGAM902 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM902 host target RNA into VGAM902 host target protein, herein schematically represented by VGAM1 HOST TARGET PROTEIN through VGAM3 HOST TARGET PROTEIN, all of FIG. 1.

It is appreciated that a function of VGR2922 gene, herein designated VGR GENE, is inhibition of expression of host target genes, as part of a novel viral mechanism of attacking a host. Accordingly, utilities of VGR2922 gene include diagnosis, prevention and treatment of viral infection by Sulfolobus Virus SIRV-1. Specific functions, and accordingly utilities, of VGR2922 gene correlate with, and may be deduced from, the identity of the host target genes, which are inhibited by VGAM RNAs comprised in the 'operon-like' cluster of VGR2922 gene: VGAM901 host target protein and VGAM902 host target protein, herein schematically represented by VGAM1 HOST TARGET PROTEIN through VGAM3 HOST TARGET PROTEIN. The function of these host target genes is elaborated hereinabove with reference to VGAM901 and VGAM902. FIG. 9 further provides a conceptual description of novel bioinformatically detected regulatory viral gene, referred to here as Viral Genomic Record 2923(VGR2923) viral gene, which encodes an 'operon-like' cluster of novel viral micro RNA-like genes, each of which in turn modulates expression of at least one host target gene, the function and utility of which at least one host target gene is known in the art.

VGR2923 gene, herein designated VGR GENE, is a novel bioinformatically detected regulatory, non protein coding, RNA viral gene. The method by which VGR2923 gene was detected is described hereinabove with reference to FIGS. 1-9.

VGR2923 gene encodes VGR2923 precursor RNA, herein designated VGR PRECURSOR RNA, an RNA molecule, typically several hundred nucleotides long.

VGR2923 precursor RNA folds spatially, forming VGR2923 folded precursor RNA, herein designated VGR FOLDED PRECURSOR RNA. It is appreciated that VGR2923 folded precursor RNA comprises a plurality of what is known in the art as 'hairpin' structures. These 'hairpin' structures are due to the fact that the nucleotide sequence of VGR2923 precursor RNA comprises a plurality of segments, the first half of each such segment having a nucleotide sequence which is at least a partial inversed-reversed sequence of the second half thereof, as is well known in the art.

VGR2923 folded precursor RNA is naturally processed by cellular enzymatic activity into at least 2 separate VGAM precursor RNAs, VGAM903 precursor RNA and VGAM904 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM903 RNA and VGAM904 RNA, herein schematically represented by VGAM1 RNA through VGAM3 RNA, each of which VGAM RNAs corresponding to VGAM RNA of FIG. 1.

VGAM903 RNA, herein schematically represented by VGAM1 RNA through VGAM3 RNA, binds complementarily to a host target binding site located in an untranslated region of VGAM903 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM903 host target RNA into VGAM903 host target protein, herein schematically represented by VGAM1 HOST TARGET PROTEIN through VGAM3 HOST TARGET PROTEIN, all of FIG. 1.

VGAM904 RNA, herein schematically represented by VGAM1 RNA through VGAM3 RNA, binds complementarily to a host target binding site located in an untranslated region of VGAM904 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM904 host target RNA into VGAM904 host target protein, herein schematically represented by VGAM1 HOST TARGET PROTEIN through VGAM3 HOST TARGET PROTEIN, all of FIG. 1.

It is appreciated that a function of VGR2923 gene, herein designated VGR GENE, is inhibition of expression of host target genes, as part of a novel viral mechanism of attacking a host. Accordingly, utilities of VGR2923 gene include diagnosis, prevention and treatment of viral infection by Melanoplus Sanguinipes Entomopoxvirus. Specific functions, and accordingly utilities, of VGR2923 gene correlate with, and may be deduced from, the identity of the host target genes, which are inhibited by VGAM RNAs comprised in the 'operon-like' cluster of VGR2923 gene: VGAM903 host target protein and VGAM904 host target protein, herein schematically represented by VGAM1 HOST TARGET PROTEIN through VGAM3 HOST TARGET PROTEIN. The function of these host target genes is elaborated hereinabove with reference to VGAM903 and VGAM904. FIG. 9 further provides a conceptual description of novel bioinformatically detected regulatory viral gene, referred to here as Viral Genomic Record 2924(VGR2924) viral gene, which encodes an 'operon-like' cluster of novel viral micro RNA-like genes, each of which in turn modulates expression of at least one host target gene, the function and utility of which at least one host target gene is known in the art.

VGR2924 gene, herein designated VGR GENE, is a novel bioinformatically detected regulatory, non protein coding, RNA viral gene. The method by which VGR2924 gene was detected is described hereinabove with reference to FIGS. 1-9.

VGR2924 gene encodes VGR2924 precursor RNA, herein designated VGR PRECURSOR RNA, an RNA molecule, typically several hundred nucleotides long.

VGR2924 precursor RNA folds spatially, forming VGR2924 folded precursor RNA, herein designated VGR FOLDED PRECURSOR RNA. It is appreciated that VGR2924 folded precursor RNA comprises a plurality of what is known in the art as 'hairpin' structures. These 'hairpin' structures are due to the fact that the nucleotide sequence of VGR2924 precursor RNA comprises a plurality of segments, the first half of each such segment having a nucleotide sequence which is at least a partial inversed-reversed sequence of the second half thereof, as is well known in the art.

VGR2924 folded precursor RNA is naturally processed by cellular enzymatic activity into at least 4 separate VGAM precursor RNAs, VGAM905 precursor RNA, VGAM906 precursor RNA, VGAM907 precursor RNA and VGAM908 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM905 RNA, VGAM906 RNA, VGAM907 RNA and VGAM908 RNA, herein schematically represented by VGAM1 RNA through VGAM3 RNA, each of which VGAM RNAs corresponding to VGAM RNA of FIG. 1.

VGAM905 RNA, herein schematically represented by VGAM1 RNA through VGAM3 RNA, binds complementarily to a host target binding site located in an untranslated region of VGAM905 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM905 host target RNA into VGAM905 host target protein, herein schematically represented by VGAM1 HOST TARGET PROTEIN through VGAM3 HOST TARGET PROTEIN, all of FIG. 1.

VGAM906 RNA, herein schematically represented by VGAM1 RNA through VGAM3 RNA, binds complementarily to a host target binding site located in an untranslated region of VGAM906 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM906 host target RNA into VGAM906 host target protein, herein schematically represented by VGAM1 HOST TARGET PROTEIN through VGAM3 HOST TARGET PROTEIN, all of FIG. 1.

VGAM907 RNA, herein schematically represented by VGAM1 RNA through VGAM3 RNA, binds complementarily to a host target binding site located in an untranslated region of VGAM907 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM907 host target RNA into VGAM907 host target protein, herein schematically represented by VGAM1 HOST TARGET PROTEIN through VGAM3 HOST TARGET PROTEIN, all of FIG. 1.

VGAM908 RNA, herein schematically represented by VGAM1 RNA through VGAM3 RNA, binds complementarily to a host target binding site located in an untranslated region of VGAM908 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM908 host target RNA into VGAM908 host target protein, herein schematically represented by VGAM1 HOST TARGET PROTEIN through VGAM3 HOST TARGET PROTEIN, all of FIG. 1.

It is appreciated that a function of VGR2924 gene, herein designated VGR GENE, is inhibition of expression of host target genes, as part of a novel viral mechanism of attacking a host. Accordingly, utilities of VGR2924 gene include diagnosis, prevention and treatment of viral infection by Saimiriine Herpesvirus 2. Specific functions, and accordingly utilities, of VGR2924 gene correlate with, and may be deduced from, the identity of the host target genes, which are inhibited by VGAM RNAs comprised in the 'operon-like' cluster of VGR2924 gene: VGAM905 host target protein, VGAM906 host target protein, VGAM907 host target protein and VGAM908 host target protein, herein schematically represented by VGAM1 HOST TARGET PROTEIN through VGAM3 HOST TARGET PROTEIN. The function of these host target genes is elaborated hereinabove with reference to VGAM905, VGAM906, VGAM907 and VGAM908. FIG. 9 further provides a conceptual description of novel bioinformatically detected regulatory viral gene, referred to here as Viral Genomic Record 2925(VGR2925) viral gene, which encodes an 'operon-like' cluster of novel viral micro RNA-like genes, each of which in turn modulates expression of at least one host target gene, the function and utility of which at least one host target gene is known in the art.

VGR2925 gene, herein designated VGR GENE, is a novel bioinformatically detected regulatory, non protein coding, RNA viral gene. The method by which VGR2925 gene was detected is described hereinabove with reference to FIGS. 1-9.

VGR2925 gene encodes VGR2925 precursor RNA, herein designated VGR PRECURSOR RNA, an RNA molecule, typically several hundred nucleotides long.

VGR2925 precursor RNA folds spatially, forming VGR2925 folded precursor RNA, herein designated VGR FOLDED PRECURSOR RNA. It is appreciated that VGR2925 folded precursor RNA comprises a plurality of what is known in the art as 'hairpin' structures. These 'hairpin' structures are due to the fact that the nucleotide sequence of VGR2925 precursor RNA comprises a plurality of segments, the first half of each such segment having a nucleotide sequence which is at least a partial inversed-reversed sequence of the second half thereof, as is well known in the art.

VGR2925 folded precursor RNA is naturally processed by cellular enzymatic activity into at least 2 separate VGAM precursor RNAs, VGAM909 precursor RNA and VGAM910 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM909 RNA and VGAM910 RNA, herein schematically represented by VGAM1 RNA through VGAM3 RNA, each of which VGAM RNAs corresponding to VGAM RNA of FIG. 1.

VGAM909 RNA, herein schematically represented by VGAM1 RNA through VGAM3 RNA, binds complementarily to a host target binding site located in an untranslated region of VGAM909 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM909 host target RNA into VGAM909 host target protein, herein schematically represented by VGAM1 HOST TARGET PROTEIN through VGAM3 HOST TARGET PROTEIN, all of FIG. 1.

VGAM910 RNA, herein schematically represented by VGAM1 RNA through VGAM3 RNA, binds complementarily to a host target binding site located in an untranslated region of VGAM910 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM910 host target RNA into VGAM910 host target protein, herein schematically represented by VGAM1 HOST TARGET PROTEIN through VGAM3 HOST TARGET PROTEIN, all of FIG. 1.

It is appreciated that a function of VGR2925 gene, herein designated VGR GENE, is inhibition of expression of host target genes, as part of a novel viral mechanism of attacking a host. Accordingly, utilities of VGR2925 gene include diagnosis, prevention and treatment of viral infection by Alcelaphine Herpesvirus 1. Specific functions, and accordingly utilities, of VGR2925 gene correlate with, and may be deduced from, the identity of the host target genes, which are inhibited by VGAM RNAs comprised in the 'operon-like' cluster of VGR2925 gene: VGAM909 host target protein and VGAM910 host target protein, herein schematically represented by VGAM1 HOST TARGET PROTEIN through VGAM3 HOST TARGET PROTEIN. The function of these host target genes is elaborated hereinabove with reference to VGAM909 and VGAM910. FIG. 9 further provides a conceptual description of novel bioinformatically detected regulatory viral gene, referred to here as Viral Genomic Record 2926(VGR2926) viral gene, which encodes an 'operon-like' cluster of novel viral micro RNA-like genes, each of which in turn modulates expression of at least one host target gene, the function and utility of which at least one host target gene is known in the art.

VGR2926 gene, herein designated VGR GENE, is a novel bioinformatically detected regulatory, non protein coding, RNA viral gene. The method by which VGR2926 gene was detected is described hereinabove with reference to FIGS. 1-9.

VGR2926 gene encodes VGR2926 precursor RNA, herein designated VGR PRECURSOR RNA, an RNA molecule, typically several hundred nucleotides long.

VGR2926 precursor RNA folds spatially, forming VGR2926 folded precursor RNA, herein designated VGR FOLDED PRECURSOR RNA. It is appreciated that VGR2926 folded precursor RNA comprises a plurality of what is known in the art as 'hairpin' structures. These 'hairpin' structures are due to the fact that the nucleotide sequence of VGR2926 precursor RNA comprises a plurality of segments, the first half of each such segment having a nucleotide sequence which is at least a partial inversed-reversed sequence of the second half thereof, as is well known in the art.

VGR2926 folded precursor RNA is naturally processed by cellular enzymatic activity into at least 2 separate VGAM precursor RNAs, VGAM911 precursor RNA and VGAM912 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM911 RNA and VGAM912 RNA, herein schematically represented by VGAM1 RNA through VGAM3 RNA, each of which VGAM RNAs corresponding to VGAM RNA of FIG. 1.

VGAM911 RNA, herein schematically represented by VGAM1 RNA through VGAM3 RNA, binds complementarily to a host target binding site located in an untranslated region of VGAM911 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM911 host target RNA into VGAM911 host target protein, herein schematically represented by VGAM1 HOST TARGET PROTEIN through VGAM3 HOST TARGET PROTEIN, all of FIG. 1.

VGAM912 RNA, herein schematically represented by VGAM1 RNA through VGAM3 RNA, binds complementarily to a host target binding site located in an untranslated region of VGAM912 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM912 host target RNA into VGAM912 host target protein, herein schematically represented by VGAM1 HOST TARGET PROTEIN through VGAM3 HOST TARGET PROTEIN, all of FIG. 1.

It is appreciated that a function of VGR2926 gene, herein designated VGR GENE, is inhibition of expression of host target genes, as part of a novel viral mechanism of attacking a host. Accordingly, utilities of VGR2926 gene include diagnosis, prevention and treatment of viral infection by Human Herpesvirus 8. Specific functions, and accordingly utilities, of VGR2926 gene correlate with, and may be deduced from, the identity of the host target genes, which are inhibited by VGAM RNAs comprised in the 'operon-like' cluster of VGR2926 gene: VGAM911 host target protein and VGAM912 host target protein, herein schematically represented by VGAM1 HOST TARGET PROTEIN through VGAM3 HOST TARGET PROTEIN. The function of these host target genes is elaborated hereinabove with reference to VGAM911 and VGAM912. FIG. 9 further provides a conceptual description of novel bioinformatically detected regulatory viral gene, referred to here as Viral Genomic Record 2927(VGR2927) viral gene, which encodes an 'operon-like' cluster of novel viral micro RNA-like genes, each of which in turn modulates expression of at least one host target gene, the function and utility of which at least one host target gene is known in the art.

VGR2927 gene, herein designated VGR GENE, is a novel bioinformatically detected regulatory, non protein coding, RNA viral gene. The method by which VGR2927 gene was detected is described hereinabove with reference to FIGS. 1-9.

VGR2927 gene encodes VGR2927 precursor RNA, herein designated VGR PRECURSOR RNA, an RNA molecule, typically several hundred nucleotides long.

VGR2927 precursor RNA folds spatially, forming VGR2927 folded precursor RNA, herein designated VGR FOLDED PRECURSOR RNA. It is appreciated that VGR2927 folded precursor RNA comprises a plurality of what is known in the art as 'hairpin' structures. These 'hairpin' structures are due to the fact that the nucleotide sequence of VGR2927 precursor RNA comprises a plurality of segments, the first half of each such segment having a nucleotide sequence which is at least a partial inversed-reversed sequence of the second half thereof, as is well known in the art.

VGR2927 folded precursor RNA is naturally processed by cellular enzymatic activity into at least 2 separate VGAM precursor RNAs, VGAM913 precursor RNA and VGAM914 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM913 RNA and VGAM914 RNA, herein schematically represented by VGAM1 RNA through VGAM3 RNA, each of which VGAM RNAs corresponding to VGAM RNA of FIG. 1.

VGAM913 RNA, herein schematically represented by VGAM1 RNA through VGAM3 RNA, binds complementarily to a host target binding site located in an untranslated region of VGAM913 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM913 host target RNA into VGAM913 host target protein, herein schematically represented by VGAM1 HOST TARGET PROTEIN through VGAM3 HOST TARGET PROTEIN, all of FIG. 1.

VGAM914 RNA, herein schematically represented by VGAM1 RNA through VGAM3 RNA, binds complementarily to a host target binding site located in an untranslated region of VGAM914 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM914 host target RNA into VGAM914 host target protein, herein schematically represented by VGAM1 HOST TARGET PROTEIN through VGAM3 HOST TARGET PROTEIN, all of FIG. 1.

It is appreciated that a function of VGR2927 gene, herein designated VGR GENE, is inhibition of expression of host target genes, as part of a novel viral mechanism of attacking a host. Accordingly, utilities of VGR2927 gene include diagnosis, prevention and treatment of viral infection by Pothos Latent Virus. Specific functions, and accordingly utilities, of VGR2927 gene correlate with, and may be deduced from, the identity of the host target genes, which are inhibited by VGAM RNAs comprised in the 'operon-like' cluster of VGR2927 gene: VGAM913 host target protein and VGAM914 host target protein, herein schematically represented by VGAM1 HOST TARGET PROTEIN through VGAM3 HOST TARGET PROTEIN. The function of these host target genes is elaborated hereinabove with reference to VGAM913 and VGAM914. FIG. 9 further provides a conceptual description of novel bioinformatically detected regulatory viral gene, referred to here as Viral Genomic Record 2928(VGR2928) viral gene, which encodes an 'operon-like' cluster of novel viral micro RNA-like genes, each of which in turn modulates expression of at least one host target gene, the function and utility of which at least one host target gene is known in the art.

VGR2928 gene, herein designated VGR GENE, is a novel bioinformatically detected regulatory, non protein coding, RNA viral gene. The method by which VGR2928 gene was detected is described hereinabove with reference to FIGS. 1-9.

VGR2928 gene encodes VGR2928 precursor RNA, herein designated VGR PRECURSOR RNA, an RNA molecule, typically several hundred nucleotides long.

VGR2928 precursor RNA folds spatially, forming VGR2928 folded precursor RNA, herein designated VGR FOLDED PRECURSOR RNA. It is appreciated that VGR2928 folded precursor RNA comprises a plurality of what is known in the art as 'hairpin' structures. These 'hairpin' structures are due to the fact that the nucleotide sequence of VGR2928 precursor RNA comprises a plurality of segments, the first half of each such segment having a nucleotide sequence which is at least a partial inversed-reversed sequence of the second half thereof, as is well known in the art.

VGR2928 folded precursor RNA is naturally processed by cellular enzymatic activity into at least 2 separate VGAM precursor RNAs, VGAM915 precursor RNA and VGAM916 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM915 RNA and VGAM916 RNA, herein schematically represented by VGAM1 RNA through VGAM3 RNA, each of which VGAM RNAs corresponding to VGAM RNA of FIG. 1.

VGAM915 RNA, herein schematically represented by VGAM1 RNA through VGAM3 RNA, binds complementarily to a host target binding site located in an untranslated region of VGAM915 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM915 host target RNA into VGAM915 host target protein, herein schematically represented by VGAM1 HOST TARGET PROTEIN through VGAM3 HOST TARGET PROTEIN, all of FIG. 1.

VGAM916 RNA, herein schematically represented by VGAM1 RNA through VGAM3 RNA, binds complementarily to a host target binding site located in an untranslated region of VGAM916 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM916 host target RNA into VGAM916 host target protein, herein schematically represented by VGAM1 HOST TARGET PROTEIN through VGAM3 HOST TARGET PROTEIN, all of FIG. 1.

It is appreciated that a function of VGR2928 gene, herein designated VGR GENE, is inhibition of expression of host target genes, as part of a novel viral mechanism of attacking a host. Accordingly, utilities of VGR2928 gene include diagnosis, prevention and treatment of viral infection by Trichoplusia Ni Cytoplasmic Polyhedrosis Virus 15. Specific functions, and accordingly utilities, of VGR2928 gene correlate with, and may be deduced from, the identity of the host target genes, which are inhibited by VGAM RNAs comprised in the 'operon-like' cluster of VGR2928 gene: VGAM915 host target protein and VGAM916 host target protein, herein schematically represented by VGAM1 HOST TARGET PROTEIN through VGAM3 HOST TARGET PROTEIN. The function of these host target genes is elaborated hereinabove with reference to VGAM915 and VGAM916. FIG. 9 further provides a conceptual description of novel bioinformatically detected regulatory viral gene, referred to here as Viral Genomic Record 2929(VGR2929) viral gene, which encodes an 'operon-like' cluster of novel viral micro RNA-like genes, each of which in turn modulates expression of at least one host target gene, the function and utility of which at least one host target gene is known in the art.

VGR2929 gene, herein designated VGR GENE, is a novel bioinformatically detected regulatory, non protein coding, RNA viral gene. The method by which VGR2929 gene was detected is described hereinabove with reference to FIGS. 1-9.

VGR2929 gene encodes VGR2929 precursor RNA, herein designated VGR PRECURSOR RNA, an RNA molecule, typically several hundred nucleotides long.

VGR2929 precursor RNA folds spatially, forming VGR2929 folded precursor RNA, herein designated VGR FOLDED PRECURSOR RNA. It is appreciated that VGR2929 folded precursor RNA comprises a plurality of what is known in the art as 'hairpin' structures. These 'hairpin' structures are due to the fact that the nucleotide sequence of VGR2929 precursor RNA comprises a plurality of segments, the first half of each such segment having a nucleotide sequence which is at least a partial inversed-reversed sequence of the second half thereof, as is well known in the art.

VGR2929 folded precursor RNA is naturally processed by cellular enzymatic activity into at least 2 separate VGAM precursor RNAs, VGAM918 precursor RNA and VGAM919 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM918 RNA and VGAM919 RNA, herein schematically represented by VGAM1 RNA through VGAM3 RNA, each of which VGAM RNAs corresponding to VGAM RNA of FIG. 1.

VGAM918 RNA, herein schematically represented by VGAM1 RNA through VGAM3 RNA, binds complementarily to a host target binding site located in an untranslated region of VGAM918 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM918 host target RNA into VGAM918 host target protein, herein schematically represented by VGAM1 HOST TARGET PROTEIN through VGAM3 HOST TARGET PROTEIN, all of FIG. 1.

VGAM919 RNA, herein schematically represented by VGAM1 RNA through VGAM3 RNA, binds complementarily to a host target binding site located in an untranslated region of VGAM919 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM919 host target RNA into VGAM919 host target protein, herein schematically represented by VGAM1 HOST TARGET PROTEIN through VGAM3 HOST TARGET PROTEIN, all of FIG. 1.

It is appreciated that a function of VGR2929 gene, herein designated VGR GENE, is inhibition of expression of host target genes, as part of a novel viral mechanism of attacking a host. Accordingly, utilities of VGR2929 gene include diagnosis, prevention and treatment of viral infection by Vaccinia Virus. Specific functions, and accordingly utilities, of VGR2929 gene correlate with, and may be deduced from, the identity of the host target genes, which are inhibited by VGAM RNAs comprised in the 'operon-like' cluster of VGR2929 gene: VGAM918 host target protein and VGAM919 host target protein, herein schematically represented by VGAM1 HOST TARGET PROTEIN through VGAM3 HOST TARGET PROTEIN. The function of these host target genes is elaborated hereinabove with reference to VGAM918 and VGAM919. FIG. 9 further provides a conceptual description of novel bioinformatically detected regulatory viral gene, referred to here as Viral Genomic Record 2930(VGR2930) viral gene, which encodes an 'operon-like' cluster of novel viral micro RNA-like genes, each of which in turn modulates expression of at least one host target gene, the function and utility of which at least one host target gene is known in the art.

VGR2930 gene, herein designated VGR GENE, is a novel bioinformatically detected regulatory, non protein coding, RNA viral gene. The method by which VGR2930 gene was detected is described hereinabove with reference to FIGS. 1-9.

VGR2930 gene encodes VGR2930 precursor RNA, herein designated VGR PRECURSOR RNA, an RNA molecule, typically several hundred nucleotides long.

VGR2930 precursor RNA folds spatially, forming VGR2930 folded precursor RNA, herein designated VGR FOLDED PRECURSOR RNA. It is appreciated that VGR2930 folded precursor RNA comprises a plurality of what is known in the art as 'hairpin' structures. These 'hairpin' structures are due to the fact that the nucleotide sequence of VGR2930 precursor RNA comprises a plurality of segments, the first half of each such segment having a nucleotide sequence which is at least a partial inversed-reversed sequence of the second half thereof, as is well known in the art.

VGR2930 folded precursor RNA is naturally processed by cellular enzymatic activity into at least 3 separate VGAM precursor RNAs, VGAM921 precursor RNA, VGAM922 precursor RNA and VGAM923 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM921 RNA, VGAM922 RNA and VGAM923 RNA, herein schematically represented by VGAM1 RNA through VGAM3 RNA, each of which VGAM RNAs corresponding to VGAM RNA of FIG. 1.

VGAM921 RNA, herein schematically represented by VGAM1 RNA through VGAM3 RNA, binds complementarily to a host target binding site located in an untranslated region of VGAM921 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM921 host target RNA into VGAM921 host target protein, herein schematically represented by VGAM1 HOST TARGET PROTEIN through VGAM3 HOST TARGET PROTEIN, all of FIG. 1.

VGAM922 RNA, herein schematically represented by VGAM1 RNA through VGAM3 RNA, binds complementarily to a host target binding site located in an untranslated region of VGAM922 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM922 host target RNA into VGAM922 host target protein, herein schematically represented by VGAM1 HOST TARGET PROTEIN through VGAM3 HOST TARGET PROTEIN, all of FIG. 1.

VGAM923 RNA, herein schematically represented by VGAM1 RNA through VGAM3 RNA, binds complementarily to a host target binding site located in an untranslated region of VGAM923 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM923 host target RNA into VGAM923 host target protein, herein schematically represented by VGAM1 HOST TARGET PROTEIN through VGAM3 HOST TARGET PROTEIN, all of FIG. 1.

It is appreciated that a function of VGR2930 gene, herein designated VGR GENE, is inhibition of expression of host target genes, as part of a novel viral mechanism of attacking a host. Accordingly, utilities of VGR2930 gene include diagnosis, prevention and treatment of viral infection by Peanut Clump Virus. Specific functions, and accordingly utilities, of VGR2930 gene correlate with, and may be deduced from, the identity of the host target genes, which are inhibited by VGAM RNAs comprised in the 'operon-like' cluster of VGR2930 gene: VGAM921 host target protein, VGAM922 host target protein and VGAM923 host target protein, herein schematically represented by VGAM1 HOST TARGET PROTEIN through VGAM3 HOST TARGET PROTEIN. The function of these host target genes is elaborated hereinabove with reference to VGAM921, VGAM922 and VGAM923. FIG. 9 further provides a conceptual description of novel bioinformatically detected regulatory viral gene, referred to here as Viral Genomic Record 2931(VGR2931) viral gene, which encodes an 'operon-like' cluster of novel viral micro RNA-like genes, each of which in turn modulates expression of at least one host target gene, the function and utility of which at least one host target gene is known in the art.

VGR2931 gene, herein designated VGR GENE, is a novel bioinformatically detected regulatory, non protein coding, RNA viral gene. The method by which VGR2931 gene was detected is described hereinabove with reference to FIGS. 1-9.

VGR2931 gene encodes VGR2931 precursor RNA, herein designated VGR PRECURSOR RNA, an RNA molecule, typically several hundred nucleotides long.

VGR2931 precursor RNA folds spatially, forming VGR2931 folded precursor RNA, herein designated VGR FOLDED PRECURSOR RNA. It is appreciated that VGR2931 folded precursor RNA comprises a plurality of what is known in the art as 'hairpin' structures. These 'hairpin' structures are due to the fact that the nucleotide sequence of VGR2931 precursor RNA comprises a plurality of segments, the first half of each such segment having a nucleotide sequence which is at least a partial inversed-reversed sequence of the second half thereof, as is well known in the art.

VGR2931 folded precursor RNA is naturally processed by cellular enzymatic activity into at least 6 separate VGAM precursor RNAs, VGAM924 precursor RNA, VGAM925 precursor RNA, VGAM926 precursor RNA, VGAM927 precursor RNA, VGAM928 precursor RNA and VGAM929 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM924 RNA, VGAM925 RNA, VGAM926 RNA, VGAM927 RNA, VGAM928 RNA and VGAM929 RNA, herein schematically represented by VGAM1 RNA through VGAM3 RNA, each of which VGAM RNAs corresponding to VGAM RNA of FIG. 1.

VGAM924 RNA, herein schematically represented by VGAM1 RNA through VGAM3 RNA, binds complementarily to a host target binding site located in an untranslated region of VGAM924 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM924 host target RNA into VGAM924 host target protein, herein schematically represented by VGAM1 HOST TARGET PROTEIN through VGAM3 HOST TARGET PROTEIN, all of FIG. 1.

VGAM925 RNA, herein schematically represented by VGAM1 RNA through VGAM3 RNA, binds complementarily to a host target binding site located in an untranslated region of VGAM925 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM925 host target RNA into VGAM925 host target protein, herein schematically represented by VGAM1 HOST TARGET PROTEIN through VGAM3 HOST TARGET PROTEIN, all of FIG. 1.

VGAM926 RNA, herein schematically represented by VGAM1 RNA through VGAM3 RNA, binds complementarily to a host target binding site located in an untranslated region of VGAM926 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM926 host target RNA into VGAM926 host target protein, herein schematically represented by VGAM1 HOST TARGET PROTEIN through VGAM3 HOST TARGET PROTEIN, all of FIG. 1.

VGAM927 RNA, herein schematically represented by VGAM1 RNA through VGAM3 RNA, binds complementarily to a host target binding site located in an untranslated region of VGAM927 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM927 host target RNA into VGAM927 host target protein, herein schematically represented by VGAM1 HOST TARGET PROTEIN through VGAM3 HOST TARGET PROTEIN, all of FIG. 1.

VGAM928 RNA, herein schematically represented by VGAM1 RNA through VGAM3 RNA, binds complementarily to a host target binding site located in an untranslated region of VGAM928 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM928 host target RNA into VGAM928 host target protein, herein schematically represented by VGAM1 HOST TARGET PROTEIN through VGAM3 HOST TARGET PROTEIN, all of FIG. 1.

VGAM929 RNA, herein schematically represented by VGAM1 RNA through VGAM3 RNA, binds complementarily to a host target binding site located in an untranslated region of VGAM929 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM929 host target RNA into VGAM929 host target protein, herein schematically represented by VGAM1 HOST TARGET PROTEIN through VGAM3 HOST TARGET PROTEIN, all of FIG. 1.

It is appreciated that a function of VGR2931 gene, herein designated VGR GENE, is inhibition of expression of host target genes, as part of a novel viral mechanism of attacking a host. Accordingly, utilities of VGR2931 gene include diagnosis, prevention and treatment of viral infection by Infectious Spleen and Kidney Necrosis Virus. Specific functions, and accordingly utilities, of VGR2931 gene correlate with, and may be deduced from, the identity of the host target genes, which are inhibited by VGAM RNAs comprised in the 'operon-like' cluster of VGR2931 gene: VGAM924 host target protein, VGAM925 host target protein, VGAM926 host target protein, VGAM927 host target protein, VGAM928 host target protein and VGAM929 host target protein, herein schematically represented by VGAM1 HOST TARGET PROTEIN through VGAM3 HOST TARGET PROTEIN. The function of these host target genes is elaborated hereinabove with reference to VGAM924, VGAM925, VGAM926, VGAM927, VGAM928 and VGAM929. FIG. 9 further provides a conceptual description of novel bioinformatically detected regulatory viral gene, referred to here as Viral Genomic Record 2932(VGR2932) viral gene, which encodes an 'operon-like' cluster of novel viral micro RNA-like genes, each of which in turn modulates expression of at least one host target gene, the function and utility of which at least one host target gene is known in the art.

VGR2932 gene, herein designated VGR GENE, is a novel bioinformatically detected regulatory, non protein coding, RNA viral gene. The method by which VGR2932 gene was detected is described hereinabove with reference to FIGS. 1-9.

VGR2932 gene encodes VGR2932 precursor RNA, herein designated VGR PRECURSOR RNA, an RNA molecule, typically several hundred nucleotides long.

VGR2932 precursor RNA folds spatially, forming VGR2932 folded precursor RNA, herein designated VGR FOLDED PRECURSOR RNA. It is appreciated that VGR2932 folded precursor RNA comprises a plurality of what is known in the art as 'hairpin' structures. These 'hairpin' structures are due to the fact that the nucleotide sequence of VGR2932 precursor RNA comprises a plurality of segments, the first half of each such segment having a nucleotide sequence which is at least a partial inversed-reversed sequence of the second half thereof, as is well known in the art.

VGR2932 folded precursor RNA is naturally processed by cellular enzymatic activity into at least 3 separate VGAM precursor RNAs, VGAM932 precursor RNA, VGAM933 precursor RNA and VGAM934 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM932 RNA, VGAM933 RNA and VGAM934 RNA, herein schematically represented by VGAM1 RNA through VGAM3 RNA, each of which VGAM RNAs corresponding to VGAM RNA of FIG. 1.

VGAM932 RNA, herein schematically represented by VGAM1 RNA through VGAM3 RNA, binds complementarily to a host target binding site located in an untranslated region of VGAM932 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM932 host target RNA into VGAM932 host target protein, herein schematically represented by VGAM1 HOST TARGET PROTEIN through VGAM3 HOST TARGET PROTEIN, all of FIG. 1.

VGAM933 RNA, herein schematically represented by VGAM1 RNA through VGAM3 RNA, binds complementarily to a host target binding site located in an untranslated region of VGAM933 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM933 host target RNA into VGAM933 host target protein, herein schematically represented by VGAM1 HOST TARGET PROTEIN through VGAM3 HOST TARGET PROTEIN, all of FIG. 1.

VGAM934 RNA, herein schematically represented by VGAM1 RNA through VGAM3 RNA, binds complementarily to a host target binding site located in an untranslated region of VGAM934 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM934 host target RNA into VGAM934 host target protein, herein schematically represented by VGAM1 HOST TARGET PROTEIN through VGAM3 HOST TARGET PROTEIN, all of FIG. 1.

It is appreciated that a function of VGR2932 gene, herein designated VGR GENE, is inhibition of expression of host target genes, as part of a novel viral mechanism of attacking a host. Accordingly, utilities of VGR2932 gene include diagnosis, prevention and treatment of viral infection by Human Herpesvirus 4. Specific functions, and accordingly utilities, of VGR2932 gene correlate with, and may be deduced from, the identity of the host target genes, which are inhibited by VGAM RNAs comprised in the 'operon-like' cluster of VGR2932 gene: VGAM932 host target protein, VGAM933 host target protein and VGAM934 host target protein, herein schematically represented by VGAM1 HOST TARGET PROTEIN through VGAM3 HOST TARGET PROTEIN. The function of these host target genes is elaborated hereinabove with reference to VGAM932, VGAM933 and VGAM934. FIG. 9 further provides a conceptual description of novel bioinformatically detected regulatory viral gene, referred to here as Viral Genomic Record 2933(VGR2933) viral gene, which encodes an 'operon-like' cluster of novel viral micro RNA-like genes, each of which in turn modulates expression of at least one host target gene, the function and utility of which at least one host target gene is known in the art.

VGR2933 gene, herein designated VGR GENE, is a novel bioinformatically detected regulatory, non protein coding, RNA viral gene. The method by which VGR2933 gene was detected is described hereinabove with reference to FIGS. 1-9.

VGR2933 gene encodes VGR2933 precursor RNA, herein designated VGR PRECURSOR RNA, an RNA molecule, typically several hundred nucleotides long.

VGR2933 precursor RNA folds spatially, forming VGR2933 folded precursor RNA, herein designated VGR FOLDED PRECURSOR RNA. It is appreciated that VGR2933 folded precursor RNA comprises a plurality of what is known in the art as 'hairpin' structures. These 'hairpin' structures are due to the fact that the nucleotide sequence of VGR2933 precursor RNA comprises a plurality of segments, the first half of each such segment having a nucleotide sequence which is at least a partial inversed-reversed sequence of the second half thereof, as is well known in the art.

VGR2933 folded precursor RNA is naturally processed by cellular enzymatic activity into at least 3 separate VGAM precursor RNAs, VGAM935 precursor RNA, VGAM936 precursor RNA and VGAM937 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM935 RNA, VGAM936 RNA and VGAM937 RNA, herein schematically represented by VGAM1 RNA through VGAM3 RNA, each of which VGAM RNAs corresponding to VGAM RNA of FIG. 1.

VGAM935 RNA, herein schematically represented by VGAM1 RNA through VGAM3 RNA, binds complementarily to a host target binding site located in an untranslated region of VGAM935 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM935 host target RNA into VGAM935 host target protein, herein schematically represented by VGAM1 HOST TARGET PROTEIN through VGAM3 HOST TARGET PROTEIN, all of FIG. 1.

VGAM936 RNA, herein schematically represented by VGAM1 RNA through VGAM3 RNA, binds complementarily to a host target binding site located in an untranslated region of VGAM936 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM936 host target RNA into VGAM936 host target protein, herein schematically represented by VGAM1 HOST TARGET PROTEIN through VGAM3 HOST TARGET PROTEIN, all of FIG. 1.

VGAM937 RNA, herein schematically represented by VGAM1 RNA through VGAM3 RNA, binds complementarily to a host target binding site located in an untranslated region of VGAM937 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM937 host target RNA into VGAM937 host target protein, herein schematically represented by VGAM1 HOST TARGET PROTEIN through VGAM3 HOST TARGET PROTEIN, all of FIG. 1.

It is appreciated that a function of VGR2933 gene, herein designated VGR GENE, is inhibition of expression of host target genes, as part of a novel viral mechanism of attacking a host. Accordingly, utilities of VGR2933 gene include diagnosis, prevention and treatment of viral infection by Melanoplus Sanguinipes Entomopoxvirus. Specific functions, and accordingly utilities, of VGR2933 gene correlate with, and may be deduced from, the identity of the host target genes, which are inhibited by VGAM RNAs comprised in the 'operon-like' cluster of VGR2933 gene: VGAM935 host target protein, VGAM936 host target protein and VGAM937 host target protein, herein schematically represented by VGAM1 HOST TARGET PROTEIN through VGAM3 HOST TARGET PROTEIN. The function of these host target genes is elaborated hereinabove with reference to VGAM935, VGAM936 and VGAM937. FIG. 9 further provides a conceptual description of novel bioinformatically detected regulatory viral gene, referred to here as Viral Genomic Record 2934(VGR2934) viral gene, which encodes an 'operon-like' cluster of novel viral micro RNA-like genes, each of which in turn modulates expression of at least one host target gene, the function and utility of which at least one host target gene is known in the art.

VGR2934 gene, herein designated VGR GENE, is a novel bioinformatically detected regulatory, non protein coding, RNA viral gene. The method by which VGR2934 gene was detected is described hereinabove with reference to FIGS. 1-9.

VGR2934 gene encodes VGR2934 precursor RNA, herein designated VGR PRECURSOR RNA, an RNA molecule, typically several hundred nucleotides long.

VGR2934 precursor RNA folds spatially, forming VGR2934 folded precursor RNA, herein designated VGR FOLDED PRECURSOR RNA. It is appreciated that VGR2934 folded precursor RNA comprises a plurality of what is known in the art as 'hairpin' structures. These 'hairpin' structures are due to the fact that the nucleotide sequence of VGR2934 precursor RNA comprises a plurality of segments, the first half of each such segment having a nucleotide sequence which is at least a partial inversed-reversed sequence of the second half thereof, as is well known in the art.

VGR2934 folded precursor RNA is naturally processed by cellular enzymatic activity into at least 3 separate VGAM precursor RNAs, VGAM938 precursor RNA, VGAM939 precursor RNA and VGAM940 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM938 RNA, VGAM939 RNA and VGAM940 RNA, herein schematically represented by VGAM1 RNA through VGAM3 RNA, each of which VGAM RNAs corresponding to VGAM RNA of FIG. 1.

VGAM938 RNA, herein schematically represented by VGAM1 RNA through VGAM3 RNA, binds complementarily to a host target binding site located in an untranslated region of VGAM938 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM938 host target RNA into VGAM938 host target protein, herein schematically represented by VGAM1 HOST TARGET PROTEIN through VGAM3 HOST TARGET PROTEIN, all of FIG. 1.

VGAM939 RNA, herein schematically represented by VGAM1 RNA through VGAM3 RNA, binds complementarily to a host target binding site located in an untranslated region of VGAM939 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM939 host target RNA into VGAM939 host target protein, herein schematically represented by VGAM1 HOST TARGET PROTEIN through VGAM3 HOST TARGET PROTEIN, all of FIG. 1.

VGAM940 RNA, herein schematically represented by VGAM1 RNA through VGAM3 RNA, binds complementarily to a host target binding site located in an untranslated region of VGAM940 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM940 host target RNA into VGAM940 host target protein, herein schematically represented by VGAM1 HOST TARGET PROTEIN through VGAM3 HOST TARGET PROTEIN, all of FIG. 1.

It is appreciated that a function of VGR2934 gene, herein designated VGR GENE, is inhibition of expression of host target genes, as part of a novel viral mechanism of attacking a host. Accordingly, utilities of VGR2934 gene include diagnosis, prevention and treatment of viral infection by Beet Soil-borne Mosaic Virus. Specific functions, and accordingly utilities, of VGR2934 gene correlate with, and may be deduced from, the identity of the host target genes, which are inhibited by VGAM RNAs comprised in the 'operon-like' cluster of VGR2934 gene: VGAM938 host target protein, VGAM939 host target protein and VGAM940 host target protein, herein schematically represented by VGAM1 HOST TARGET PROTEIN through VGAM3 HOST TARGET PROTEIN. The function of these host target genes is elaborated hereinabove with reference to VGAM938, VGAM939 and VGAM940. FIG. 9 further provides a conceptual description of novel bioinformatically detected regulatory viral gene, referred to here as Viral Genomic Record 2935(VGR2935) viral gene, which encodes an 'operon-like' cluster of novel viral micro RNA-like genes, each of which in turn modulates expression of at least one host target gene, the function and utility of which at least one host target gene is known in the art.

VGR2935 gene, herein designated VGR GENE, is a novel bioinformatically detected regulatory, non protein coding, RNA viral gene. The method by which VGR2935 gene was detected is described hereinabove with reference to FIGS. 1-9.

VGR2935 gene encodes VGR2935 precursor RNA, herein designated VGR PRECURSOR RNA, an RNA molecule, typically several hundred nucleotides long.

VGR2935 precursor RNA folds spatially, forming VGR2935 folded precursor RNA, herein designated VGR FOLDED PRECURSOR RNA. It is appreciated that VGR2935 folded precursor RNA comprises a plurality of what is known in the art as 'hairpin' structures. These 'hairpin' structures are due to the fact that the nucleotide sequence of VGR2935 precursor RNA comprises a plurality of segments, the first half of each such segment having a nucleotide sequence which is at least a partial inversed-reversed sequence of the second half thereof, as is well known in the art.

VGR2935 folded precursor RNA is naturally processed by cellular enzymatic activity into at least 3 separate VGAM precursor RNAs, VGAM941 precursor RNA, VGAM942 precursor RNA and VGAM943 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM941 RNA, VGAM942 RNA and VGAM943 RNA, herein schematically represented by VGAM1 RNA through VGAM3 RNA, each of which VGAM RNAs corresponding to VGAM RNA of FIG. 1.

VGAM941 RNA, herein schematically represented by VGAM1 RNA through VGAM3 RNA, binds complementarily to a host target binding site located in an untranslated region of VGAM941 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM941 host target RNA into VGAM941 host target protein, herein schematically represented by VGAM1 HOST TARGET PROTEIN through VGAM3 HOST TARGET PROTEIN, all of FIG. 1.

VGAM942 RNA, herein schematically represented by VGAM1 RNA through VGAM3 RNA, binds complementarily to a host target binding site located in an untranslated region of VGAM942 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM942 host target RNA into VGAM942 host target protein, herein schematically represented by VGAM1 HOST TARGET PROTEIN through VGAM3 HOST TARGET PROTEIN, all of FIG. 1.

VGAM943 RNA, herein schematically represented by VGAM1 RNA through VGAM3 RNA, binds complementarily to a host target binding site located in an untranslated region of VGAM943 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM943 host target RNA into VGAM943 host target protein, herein schematically represented by VGAM1 HOST TARGET PROTEIN through VGAM3 HOST TARGET PROTEIN, all of FIG. 1.

It is appreciated that a function of VGR2935 gene, herein designated VGR GENE, is inhibition of expression of host target genes, as part of a novel viral mechanism of attacking a host. Accordingly, utilities of VGR2935 gene include diagnosis, prevention and treatment of viral infection by Infectious Spleen and Kidney Necrosis Virus. Specific functions, and accordingly utilities, of VGR2935 gene correlate with, and may be deduced from, the identity of the host target genes, which are inhibited by VGAM RNAs comprised in the 'operon-like' cluster of VGR2935 gene: VGAM941 host target protein, VGAM942 host target protein and VGAM943 host target protein, herein schematically represented by VGAM1 HOST TARGET PROTEIN through VGAM3 HOST TARGET PROTEIN. The function of these host target genes is elaborated hereinabove with reference to VGAM941, VGAM942 and VGAM943. FIG. 9 further provides a conceptual description of novel bioinformatically detected regulatory viral gene, referred to here as Viral Genomic Record 2936(VGR2936) viral gene, which encodes an 'operon-like' cluster of novel viral micro RNA-like genes, each of which in turn modulates expression of at least one host target gene, the function and utility of which at least one host target gene is known in the art.

VGR2936 gene, herein designated VGR GENE, is a novel bioinformatically detected regulatory, non protein coding, RNA viral gene. The method by which VGR2936 gene was detected is described hereinabove with reference to FIGS. 1-9.

VGR2936 gene encodes VGR2936 precursor RNA, herein designated VGR PRECURSOR RNA, an RNA molecule, typically several hundred nucleotides long.

VGR2936 precursor RNA folds spatially, forming VGR2936 folded precursor RNA, herein designated VGR FOLDED PRECURSOR RNA. It is appreciated that VGR2936 folded precursor RNA comprises a plurality of what is known in the art as 'hairpin' structures. These 'hairpin' structures are due to the fact that the nucleotide sequence of VGR2936 precursor RNA comprises a plurality of segments, the first half of each such segment having a nucleotide sequence which is at least a partial inversed-reversed sequence of the second half thereof, as is well known in the art.

VGR2936 folded precursor RNA is naturally processed by cellular enzymatic activity into at least 2 separate VGAM precursor RNAs, VGAM944 precursor RNA and VGAM945 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM944 RNA and VGAM945 RNA, herein schematically represented by VGAM1 RNA through VGAM3 RNA, each of which VGAM RNAs corresponding to VGAM RNA of FIG. 1.

VGAM944 RNA, herein schematically represented by VGAM1 RNA through VGAM3 RNA, binds complementarily to a host target binding site located in an untranslated region of VGAM944 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM944 host target RNA into VGAM944 host target protein, herein schematically represented by VGAM1 HOST TARGET PROTEIN through VGAM3 HOST TARGET PROTEIN, all of FIG. 1.

VGAM945 RNA, herein schematically represented by VGAM1 RNA through VGAM3 RNA, binds complementarily to a host target binding site located in an untranslated region of VGAM945 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM945 host target RNA into VGAM945 host target protein, herein schematically represented by VGAM1 HOST TARGET PROTEIN through VGAM3 HOST TARGET PROTEIN, all of FIG. 1.

It is appreciated that a function of VGR2936 gene, herein designated VGR GENE, is inhibition of expression of host target genes, as part of a novel viral mechanism of attacking a host. Accordingly, utilities of VGR2936 gene include diagnosis, prevention and treatment of viral infection by Human Herpesvirus 7. Specific functions, and accordingly utilities, of VGR2936 gene correlate with, and may be deduced from, the identity of the host target genes, which are inhibited by VGAM RNAs comprised in the 'operon-like' cluster of VGR2936 gene: VGAM944 host target protein and VGAM945 host target protein, herein schematically represented by VGAM1 HOST TARGET PROTEIN through VGAM3 HOST TARGET PROTEIN. The function of these host target genes is elaborated hereinabove with reference to VGAM944 and VGAM945. FIG. 9 further provides a conceptual description of novel bioinformatically detected regulatory viral gene, referred to here as Viral Genomic Record 2937(VGR2937) viral gene, which encodes an 'operon-like' cluster of novel viral micro RNA-like genes, each of which in turn modulates expression of at least one host target gene, the function and utility of which at least one host target gene is known in the art.

VGR2937 gene, herein designated VGR GENE, is a novel bioinformatically detected regulatory, non protein coding, RNA viral gene. The method by which VGR2937 gene was detected is described hereinabove with reference to FIGS. 1-9.

VGR2937 gene encodes VGR2937 precursor RNA, herein designated VGR PRECURSOR RNA, an RNA molecule, typically several hundred nucleotides long.

VGR2937 precursor RNA folds spatially, forming VGR2937 folded precursor RNA, herein designated VGR FOLDED PRECURSOR RNA. It is appreciated that VGR2937 folded precursor RNA comprises a plurality of what is known in the art as 'hairpin' structures. These 'hairpin' structures are due to the fact that the nucleotide sequence of VGR2937 precursor RNA comprises a plurality of segments, the first half of each such segment having a nucleotide sequence which is at least a partial inversed-reversed sequence of the second half thereof, as is well known in the art.

VGR2937 folded precursor RNA is naturally processed by cellular enzymatic activity into at least 2 separate VGAM precursor RNAs, VGAM946 precursor RNA and VGAM947 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM946 RNA and VGAM947 RNA, herein schematically represented by VGAM1 RNA through VGAM3 RNA, each of which VGAM RNAs corresponding to VGAM RNA of FIG. 1.

VGAM946 RNA, herein schematically represented by VGAM1 RNA through VGAM3 RNA, binds complementarily to a host target binding site located in an untranslated region of VGAM946 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM946 host target RNA into VGAM946 host target protein, herein schematically represented by VGAM1 HOST TARGET PROTEIN through VGAM3 HOST TARGET PROTEIN, all of FIG. 1.

VGAM947 RNA, herein schematically represented by VGAM1 RNA through VGAM3 RNA, binds complementarily to a host target binding site located in an untranslated region of VGAM947 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM947 host target RNA into VGAM947 host target protein, herein schematically represented by VGAM1 HOST TARGET PROTEIN through VGAM3 HOST TARGET PROTEIN, all of FIG. 1.

It is appreciated that a function of VGR2937 gene, herein designated VGR GENE, is inhibition of expression of host target genes, as part of a novel viral mechanism of attacking a host. Accordingly, utilities of VGR2937 gene include diagnosis, prevention and treatment of viral infection by Human Herpesvirus 6. Specific functions, and accordingly utilities, of VGR2937 gene correlate with, and may be deduced from, the identity of the host target genes, which are inhibited by VGAM RNAs comprised in the 'operon-like' cluster of VGR2937 gene: VGAM946 host target protein and VGAM947 host target protein, herein schematically represented by VGAM1 HOST TARGET PROTEIN through VGAM3 HOST TARGET PROTEIN. The function of these host target genes is elaborated hereinabove with reference to VGAM946 and VGAM947. FIG. 9 further provides a conceptual description of novel bioinformatically detected regulatory viral gene, referred to here as Viral Genomic Record 2938(VGR2938) viral gene, which encodes an 'operon-like' cluster of novel viral micro RNA-like genes, each of which in turn modulates expression of at least one host target gene, the function and utility of which at least one host target gene is known in the art.

VGR2938 gene, herein designated VGR GENE, is a novel bioinformatically detected regulatory, non protein coding, RNA viral gene. The method by which VGR2938 gene was detected is described hereinabove with reference to FIGS. 1-9.

VGR2938 gene encodes VGR2938 precursor RNA, herein designated VGR PRECURSOR RNA, an RNA molecule, typically several hundred nucleotides long.

VGR2938 precursor RNA folds spatially, forming VGR2938 folded precursor RNA, herein designated VGR FOLDED PRECURSOR RNA. It is appreciated that VGR2938 folded precursor RNA comprises a plurality of what is known in the art as 'hairpin' structures. These 'hairpin' structures are due to the fact that the nucleotide sequence of VGR2938 precursor RNA comprises a plurality of segments, the first half of each such segment having a nucleotide sequence which is at least a partial inversed-reversed sequence of the second half thereof, as is well known in the art.

VGR2938 folded precursor RNA is naturally processed by cellular enzymatic activity into at least 2 separate VGAM precursor RNAs, VGAM948 precursor RNA and VGAM949 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM948 RNA and VGAM949 RNA, herein schematically represented by VGAM1 RNA through VGAM3 RNA, each of which VGAM RNAs corresponding to VGAM RNA of FIG. 1.

VGAM948 RNA, herein schematically represented by VGAM1 RNA through VGAM3 RNA, binds complementarily to a host target binding site located in an untranslated region of VGAM948 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM948 host target RNA into VGAM948 host target protein, herein schematically represented by VGAM1 HOST TARGET PROTEIN through VGAM3 HOST TARGET PROTEIN, all of FIG. 1.

VGAM949 RNA, herein schematically represented by VGAM1 RNA through VGAM3 RNA, binds complementarily to a host target binding site located in an untranslated region of VGAM949 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM949 host target RNA into VGAM949 host target protein, herein schematically represented by VGAM1 HOST TARGET PROTEIN through VGAM3 HOST TARGET PROTEIN, all of FIG. 1.

It is appreciated that a function of VGR2938 gene, herein designated VGR GENE, is inhibition of expression of host target genes, as part of a novel viral mechanism of attacking a host. Accordingly, utilities of VGR2938 gene include diagnosis, prevention and treatment of viral infection by Carnation Italian Ringspot Virus. Specific functions, and accordingly utilities, of VGR2938 gene correlate with, and may be deduced from, the identity of the host target genes, which are inhibited by VGAM RNAs comprised in the 'operon-like' cluster of VGR2938 gene: VGAM948 host target protein and VGAM949 host target protein, herein schematically represented by VGAM1 HOST TARGET PROTEIN through VGAM3 HOST TARGET PROTEIN. The function of these host target genes is elaborated hereinabove with reference to VGAM948 and VGAM949. FIG. 9 further provides a conceptual description of novel bioinformatically detected regulatory viral gene, referred to here as Viral Genomic Record 2939(VGR2939) viral gene, which encodes an 'operon-like' cluster of novel viral micro RNA-like genes, each of which in turn modulates expression of at least one host target gene, the function and utility of which at least one host target gene is known in the art.

VGR2939 gene, herein designated VGR GENE, is a novel bioinformatically detected regulatory, non protein coding, RNA viral gene. The method by which VGR2939 gene was detected is described hereinabove with reference to FIGS. 1-9.

VGR2939 gene encodes VGR2939 precursor RNA, herein designated VGR PRECURSOR RNA, an RNA molecule, typically several hundred nucleotides long.

VGR2939 precursor RNA folds spatially, forming VGR2939 folded precursor RNA, herein designated VGR FOLDED PRECURSOR RNA. It is appreciated that VGR2939 folded precursor RNA comprises a plurality of what is known in the art as 'hairpin' structures. These 'hairpin' structures are due to the fact that the nucleotide sequence of VGR2939 precursor RNA comprises a plurality of segments, the first half of each such segment having a nucleotide sequence which is at least a partial inversed-reversed sequence of the second half thereof, as is well known in the art.

VGR2939 folded precursor RNA is naturally processed by cellular enzymatic activity into at least 3 separate VGAM precursor RNAs, VGAM950 precursor RNA, VGAM951 precursor RNA and VGAM952 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM950

RNA, VGAM951 RNA and VGAM952 RNA, herein schematically represented by VGAM1 RNA through VGAM3 RNA, each of which VGAM RNAs corresponding to VGAM RNA of FIG. 1.

VGAM950 RNA, herein schematically represented by VGAM1 RNA through VGAM3 RNA, binds complementarily to a host target binding site located in an untranslated region of VGAM950 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM950 host target RNA into VGAM950 host target protein, herein schematically represented by VGAM1 HOST TARGET PROTEIN through VGAM3 HOST TARGET PROTEIN, all of FIG. 1.

VGAM951 RNA, herein schematically represented by VGAM1 RNA through VGAM3 RNA, binds complementarily to a host target binding site located in an untranslated region of VGAM951 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM951 host target RNA into VGAM951 host target protein, herein schematically represented by VGAM1 HOST TARGET PROTEIN through VGAM3 HOST TARGET PROTEIN, all of FIG. 1.

VGAM952 RNA, herein schematically represented by VGAM1 RNA through VGAM3 RNA, binds complementarily to a host target binding site located in an untranslated region of VGAM952 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM952 host target RNA into VGAM952 host target protein, herein schematically represented by VGAM1 HOST TARGET PROTEIN through VGAM3 HOST TARGET PROTEIN, all of FIG. 1.

It is appreciated that a function of VGR2939 gene, herein designated VGR GENE, is inhibition of expression of host target genes, as part of a novel viral mechanism of attacking a host. Accordingly, utilities of VGR2939 gene include diagnosis, prevention and treatment of viral infection by Tomato Bushy Stunt Virus. Specific functions, and accordingly utilities, of VGR2939 gene correlate with, and may be deduced from, the identity of the host target genes, which are inhibited by VGAM RNAs comprised in the 'operon-like' cluster of VGR2939 gene: VGAM950 host target protein, VGAM951 host target protein and VGAM952 host target protein, herein schematically represented by VGAM1 HOST TARGET PROTEIN through VGAM3 HOST TARGET PROTEIN. The function of these host target genes is elaborated hereinabove with reference to VGAM950, VGAM951 and VGAM952. FIG. 9 further provides a conceptual description of novel bioinformatically detected regulatory viral gene, referred to here as Viral Genomic Record 2940(VGR2940) viral gene, which encodes an 'operon-like' cluster of novel viral micro RNA-like genes, each of which in turn modulates expression of at least one host target gene, the function and utility of which at least one host target gene is known in the art.

VGR2940 gene, herein designated VGR GENE, is a novel bioinformatically detected regulatory, non protein coding, RNA viral gene. The method by which VGR2940 gene was detected is described hereinabove with reference to FIGS. 1-9.

VGR2940 gene encodes VGR2940 precursor RNA, herein designated VGR PRECURSOR RNA, an RNA molecule, typically several hundred nucleotides long.

VGR2940 precursor RNA folds spatially, forming VGR2940 folded precursor RNA, herein designated VGR FOLDED PRECURSOR RNA. It is appreciated that VGR2940 folded precursor RNA comprises a plurality of what is known in the art as 'hairpin' structures. These 'hairpin' structures are due to the fact that the nucleotide sequence of VGR2940 precursor RNA comprises a plurality of segments, the first half of each such segment having a nucleotide sequence which is at least a partial inversed-reversed sequence of the second half thereof, as is well known in the art.

VGR2940 folded precursor RNA is naturally processed by cellular enzymatic activity into at least 6 separate VGAM precursor RNAs, VGAM953 precursor RNA, VGAM954 precursor RNA, VGAM955 precursor RNA, VGAM956 precursor RNA, VGAM957 precursor RNA and VGAM958 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM953 RNA, VGAM954 RNA, VGAM955 RNA, VGAM956 RNA, VGAM957 RNA and VGAM958 RNA, herein schematically represented by VGAM1 RNA through VGAM3 RNA, each of which VGAM RNAs corresponding to VGAM RNA of FIG. 1.

VGAM953 RNA, herein schematically represented by VGAM1 RNA through VGAM3 RNA, binds complementarily to a host target binding site located in an untranslated region of VGAM953 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM953 host target RNA into VGAM953 host target protein, herein schematically represented by VGAM1 HOST TARGET PROTEIN through VGAM3 HOST TARGET PROTEIN, all of FIG. 1.

VGAM954 RNA, herein schematically represented by VGAM1 RNA through VGAM3 RNA, binds complementarily to a host target binding site located in an untranslated region of VGAM954 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM954 host target RNA into VGAM954 host target protein, herein schematically represented by VGAM1 HOST TARGET PROTEIN through VGAM3 HOST TARGET PROTEIN, all of FIG. 1.

VGAM955 RNA, herein schematically represented by VGAM1 RNA through VGAM3 RNA, binds complementarily to a host target binding site located in an untranslated region of VGAM955 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM955 host target RNA into VGAM955 host target protein, herein schematically represented by VGAM1 HOST TARGET PROTEIN through VGAM3 HOST TARGET PROTEIN, all of FIG. 1.

VGAM956 RNA, herein schematically represented by VGAM1 RNA through VGAM3 RNA, binds complementarily to a host target binding site located in an untranslated region of VGAM956 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM956 host target RNA into VGAM956 host target protein, herein schematically represented by VGAM1 HOST TARGET PROTEIN through VGAM3 HOST TARGET PROTEIN, all of FIG. 1.

VGAM957 RNA, herein schematically represented by VGAM1 RNA through VGAM3 RNA, binds complementarily to a host target binding site located in an untranslated region of VGAM957 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM957 host target RNA into VGAM957 host target protein, herein schematically represented by VGAM1 HOST TARGET PROTEIN through VGAM3 HOST TARGET PROTEIN, all of FIG. 1.

VGAM958 RNA, herein schematically represented by VGAM1 RNA through VGAM3 RNA, binds complementarily to a host target binding site located in an untranslated region of VGAM958 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM958 host target RNA into VGAM958 host target protein, herein schematically represented by VGAM1 HOST TARGET PROTEIN through VGAM3 HOST TARGET PROTEIN, all of FIG. 1.

It is appreciated that a function of VGR2940 gene, herein designated VGR GENE, is inhibition of expression of host target genes, as part of a novel viral mechanism of attacking a host. Accordingly, utilities of VGR2940 gene include diagnosis, prevention and treatment of viral infection by Tomato Spotted Wilt Virus. Specific functions, and accordingly utilities, of VGR2940 gene correlate with, and may be deduced from, the identity of the host target genes, which are inhibited by VGAM RNAs comprised in the 'operon-like' cluster of VGR2940 gene: VGAM953 host target protein, VGAM954 host target protein, VGAM955 host target protein, VGAM956 host target protein, VGAM957 host target protein and VGAM958 host target protein, herein schematically represented by VGAM1 HOST TARGET PROTEIN through VGAM3 HOST TARGET PROTEIN. The function of these host target genes is elaborated hereinabove with reference to VGAM953, VGAM954, VGAM955, VGAM956, VGAM957 and VGAM958. FIG. 9 further provides a conceptual description of novel bioinformatically detected regulatory viral gene, referred to here as Viral Genomic Record 2941(VGR2941) viral gene, which encodes an 'operon-like' cluster of novel viral micro RNA-like genes, each of which in turn modulates expression of at least one host target gene, the function and utility of which at least one host target gene is known in the art.

VGR2941 gene, herein designated VGR GENE, is a novel bioinformatically detected regulatory, non protein coding, RNA viral gene. The method by which VGR2941 gene was detected is described hereinabove with reference to FIGS. 1-9.

VGR2941 gene encodes VGR2941 precursor RNA, herein designated VGR PRECURSOR RNA, an RNA molecule, typically several hundred nucleotides long.

VGR2941 precursor RNA folds spatially, forming VGR2941 folded precursor RNA, herein designated VGR FOLDED PRECURSOR RNA. It is appreciated that VGR2941 folded precursor RNA comprises a plurality of what is known in the art as 'hairpin' structures. These 'hairpin' structures are due to the fact that the nucleotide sequence of VGR2941 precursor RNA comprises a plurality of segments, the first half of each such segment having a nucleotide sequence which is at least a partial inversed-reversed sequence of the second half thereof, as is well known in the art.

VGR2941 folded precursor RNA is naturally processed by cellular enzymatic activity into at least 3 separate VGAM precursor RNAs, VGAM959 precursor RNA, VGAM960 precursor RNA and VGAM961 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM959 RNA, VGAM960 RNA and VGAM961 RNA, herein schematically represented by VGAM1 RNA through VGAM3 RNA, each of which VGAM RNAs corresponding to VGAM RNA of FIG. 1.

VGAM959 RNA, herein schematically represented by VGAM1 RNA through VGAM3 RNA, binds complementarily to a host target binding site located in an untranslated region of VGAM959 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM959 host target RNA into VGAM959 host target protein, herein schematically represented by VGAM1 HOST TARGET PROTEIN through VGAM3 HOST TARGET PROTEIN, all of FIG. 1.

VGAM960 RNA, herein schematically represented by VGAM1 RNA through VGAM3 RNA, binds complementarily to a host target binding site located in an untranslated region of VGAM960 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM960 host target RNA into VGAM960 host target protein, herein schematically represented by VGAM1 HOST TARGET PROTEIN through VGAM3 HOST TARGET PROTEIN, all of FIG. 1.

VGAM961 RNA, herein schematically represented by VGAM1 RNA through VGAM3 RNA, binds complementarily to a host target binding site located in an untranslated region of VGAM961 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM961 host target RNA into VGAM961 host target protein, herein schematically represented by VGAM1 HOST TARGET PROTEIN through VGAM3 HOST TARGET PROTEIN, all of FIG. 1.

It is appreciated that a function of VGR2941 gene, herein designated VGR GENE, is inhibition of expression of host target genes, as part of a novel viral mechanism of attacking a host. Accordingly, utilities of VGR2941 gene include diagnosis, prevention and treatment of viral infection by Lumpy Skin Disease Virus. Specific functions, and accordingly utilities, of VGR2941 gene correlate with, and may be deduced from, the identity of the host target genes, which are inhibited by VGAM RNAs comprised in the 'operon-like' cluster of VGR2941 gene: VGAM959 host target protein, VGAM960 host target protein and VGAM961 host target protein, herein schematically represented by VGAM1 HOST TARGET PROTEIN through VGAM3 HOST TARGET PROTEIN. The function of these host target genes is elaborated hereinabove with reference to VGAM959, VGAM960 and VGAM961. FIG. 9 further provides a conceptual description of novel bioinformatically detected regulatory viral gene, referred to here as Viral Genomic Record 2942(VGR2942) viral gene, which encodes an 'operon-like' cluster of novel viral micro RNA-like genes, each of which in turn modulates expression of at least one host target gene, the function and utility of which at least one host target gene is known in the art.

VGR2942 gene, herein designated VGR GENE, is a novel bioinformatically detected regulatory, non protein coding, RNA viral gene. The method by which VGR2942 gene was detected is described hereinabove with reference to FIGS. 1-9.

VGR2942 gene encodes VGR2942 precursor RNA, herein designated VGR PRECURSOR RNA, an RNA molecule, typically several hundred nucleotides long.

VGR2942 precursor RNA folds spatially, forming VGR2942 folded precursor RNA, herein designated VGR FOLDED PRECURSOR RNA. It is appreciated that VGR2942 folded precursor RNA comprises a plurality of what is known in the art as 'hairpin' structures. These 'hairpin' structures are due to the fact that the nucleotide sequence of VGR2942 precursor RNA comprises a plurality of segments, the first half of each such segment having a nucleotide sequence which is at least a partial inversed-reversed sequence of the second half thereof, as is well known in the art.

VGR2942 folded precursor RNA is naturally processed by cellular enzymatic activity into at least 5 separate VGAM precursor RNAs, VGAM962 precursor RNA, VGAM963 precursor RNA, VGAM964 precursor RNA, VGAM965 precursor RNA and VGAM966 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM962 RNA, VGAM963 RNA, VGAM964 RNA, VGAM965 RNA and VGAM966 RNA, herein schematically represented by VGAM1 RNA through VGAM3 RNA, each of which VGAM RNAs corresponding to VGAM RNA of FIG. 1.

VGAM962 RNA, herein schematically represented by VGAM1 RNA through VGAM3 RNA, binds complementarily to a host target binding site located in an untranslated region of VGAM962 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM962 host target RNA into VGAM962 host target protein, herein schematically represented by VGAM1 HOST TARGET PROTEIN through VGAM3 HOST TARGET PROTEIN, all of FIG. 1.

VGAM963 RNA, herein schematically represented by VGAM1 RNA through VGAM3 RNA, binds complementarily to a host target binding site located in an untranslated region of VGAM963 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM963 host target RNA into VGAM963 host target protein, herein schematically represented by VGAM1 HOST TARGET PROTEIN through VGAM3 HOST TARGET PROTEIN, all of FIG. 1.

VGAM964 RNA, herein schematically represented by VGAM1 RNA through VGAM3 RNA, binds complementarily to a host target binding site located in an untranslated region of VGAM964 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM964 host target RNA into VGAM964 host target protein, herein schematically represented by VGAM1 HOST TARGET PROTEIN through VGAM3 HOST TARGET PROTEIN, all of FIG. 1.

VGAM965 RNA, herein schematically represented by VGAM1 RNA through VGAM3 RNA, binds complementarily to a host target binding site located in an untranslated region of VGAM965 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM965 host target RNA into VGAM965 host target protein, herein schematically represented by VGAM1 HOST TARGET PROTEIN through VGAM3 HOST TARGET PROTEIN, all of FIG. 1.

VGAM966 RNA, herein schematically represented by VGAM1 RNA through VGAM3 RNA, binds complementarily to a host target binding site located in an untranslated region of VGAM966 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM966 host target RNA into VGAM966 host target protein, herein schematically represented by VGAM1 HOST TARGET PROTEIN through VGAM3 HOST TARGET PROTEIN, all of FIG. 1.

It is appreciated that a function of VGR2942 gene, herein designated VGR GENE, is inhibition of expression of host target genes, as part of a novel viral mechanism of attacking a host. Accordingly, utilities of VGR2942 gene include diagnosis, prevention and treatment of viral infection by Meleagrid Herpesvirus 1. Specific functions, and accordingly utilities, of VGR2942 gene correlate with, and may be deduced from, the identity of the host target genes, which are inhibited by VGAM RNAs comprised in the 'operon-like' cluster of VGR2942 gene: VGAM962 host target protein, VGAM963 host target protein, VGAM964 host target protein, VGAM965 host target protein and VGAM966 host target protein, herein schematically represented by VGAM1 HOST TARGET PROTEIN through VGAM3 HOST TARGET PROTEIN. The function of these host target genes is elaborated hereinabove with reference to VGAM962, VGAM963, VGAM964, VGAM965 and VGAM966. FIG. 9 further provides a conceptual description of novel bioinformatically detected regulatory viral gene, referred to here as Viral Genomic Record 2943(VGR2943) viral gene, which encodes an 'operon-like' cluster of novel viral micro RNA-like genes, each of which in turn modulates expression of at least one host target gene, the function and utility of which at least one host target gene is known in the art.

VGR2943 gene, herein designated VGR GENE, is a novel bioinformatically detected regulatory, non protein coding, RNA viral gene. The method by which VGR2943 gene was detected is described hereinabove with reference to FIGS. 1-9.

VGR2943 gene encodes VGR2943 precursor RNA, herein designated VGR PRECURSOR RNA, an RNA molecule, typically several hundred nucleotides long.

VGR2943 precursor RNA folds spatially, forming VGR2943 folded precursor RNA, herein designated VGR FOLDED PRECURSOR RNA. It is appreciated that VGR2943 folded precursor RNA comprises a plurality of what is known in the art as 'hairpin' structures. These 'hairpin' structures are due to the fact that the nucleotide sequence of VGR2943 precursor RNA comprises a plurality of segments, the first half of each such segment having a nucleotide sequence which is at least a partial inversed-reversed sequence of the second half thereof, as is well known in the art.

VGR2943 folded precursor RNA is naturally processed by cellular enzymatic activity into at least 4 separate VGAM precursor RNAs, VGAM967 precursor RNA, VGAM968 precursor RNA, VGAM969 precursor RNA and VGAM970 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM967 RNA, VGAM968 RNA, VGAM969 RNA and VGAM970 RNA, herein schematically represented by VGAM1 RNA through VGAM3 RNA, each of which VGAM RNAs corresponding to VGAM RNA of FIG. 1.

VGAM967 RNA, herein schematically represented by VGAM1 RNA through VGAM3 RNA, binds complementarily to a host target binding site located in an untranslated region of VGAM967 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM967 host target RNA into VGAM967 host target protein, herein schematically represented by VGAM1 HOST TARGET PROTEIN through VGAM3 HOST TARGET PROTEIN, all of FIG. 1.

VGAM968 RNA, herein schematically represented by VGAM1 RNA through VGAM3 RNA, binds complementarily to a host target binding site located in an untranslated region of VGAM968 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM968 host target RNA into VGAM968 host target protein, herein schematically represented by VGAM1 HOST TARGET PROTEIN through VGAM3 HOST TARGET PROTEIN, all of FIG. 1.

VGAM969 RNA, herein schematically represented by VGAM1 RNA through VGAM3 RNA, binds complementarily to a host target binding site located in an untranslated region of VGAM969 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM969 host target RNA into VGAM969 host target protein, herein schematically represented by VGAM1 HOST TARGET PROTEIN through VGAM3 HOST TARGET PROTEIN, all of FIG. 1.

VGAM970 RNA, herein schematically represented by VGAM1 RNA through VGAM3 RNA, binds complementarily to a host target binding site located in an untranslated region of VGAM970 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM970 host target RNA into VGAM970 host target protein, herein schematically represented by VGAM1 HOST TARGET PROTEIN through VGAM3 HOST TARGET PROTEIN, all of FIG. 1.

It is appreciated that a function of VGR2943 gene, herein designated VGR GENE, is inhibition of expression of host target genes, as part of a novel viral mechanism of attacking a host. Accordingly, utilities of VGR2943 gene include diagnosis, prevention and treatment of viral infection by Sheeppox Virus. Specific functions, and accordingly utilities, of VGR2943 gene correlate with, and may be deduced from, the identity of the host target genes, which are inhibited by VGAM RNAs comprised in the 'operon-like' cluster of VGR2943 gene: VGAM967 host target protein, VGAM968 host target protein, VGAM969 host target protein and VGAM970 host target protein, herein schematically represented by VGAM1 HOST TARGET PROTEIN through VGAM3 HOST TARGET PROTEIN. The function of these host target genes is elaborated hereinabove with reference to VGAM967, VGAM968, VGAM969 and VGAM970. FIG. 9 further provides a conceptual description of novel bioinformatically detected regulatory viral gene, referred to here as Viral Genomic Record 2944(VGR2944) viral gene, which encodes an 'operon-like' cluster of novel viral micro RNA-like genes, each of which in turn modulates expression of at least one host target gene, the function and utility of which at least one host target gene is known in the art.

VGR2944 gene, herein designated VGR GENE, is a novel bioinformatically detected regulatory, non protein coding, RNA viral gene. The method by which VGR2944 gene was detected is described hereinabove with reference to FIGS. 1-9.

VGR2944 gene encodes VGR2944 precursor RNA, herein designated VGR PRECURSOR RNA, an RNA molecule, typically several hundred nucleotides long.

VGR2944 precursor RNA folds spatially, forming VGR2944 folded precursor RNA, herein designated VGR FOLDED PRECURSOR RNA. It is appreciated that VGR2944 folded precursor RNA comprises a plurality of what is known in the art as 'hairpin' structures. These 'hairpin' structures are due to the fact that the nucleotide sequence of VGR2944 precursor RNA comprises a plurality of segments, the first half of each such segment having a nucleotide sequence which is at least a partial inversed-reversed sequence of the second half thereof, as is well known in the art.

VGR2944 folded precursor RNA is naturally processed by cellular enzymatic activity into at least 2 separate VGAM precursor RNAs, VGAM971 precursor RNA and VGAM972 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM971 RNA and VGAM972 RNA, herein schematically represented by VGAM1 RNA through VGAM3 RNA, each of which VGAM RNAs corresponding to VGAM RNA of FIG. 1.

VGAM971 RNA, herein schematically represented by VGAM1 RNA through VGAM3 RNA, binds complementarily to a host target binding site located in an untranslated region of VGAM971 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM971 host target RNA into VGAM971 host target protein, herein schematically represented by VGAM1 HOST TARGET PROTEIN through VGAM3 HOST TARGET PROTEIN, all of FIG. 1.

VGAM972 RNA, herein schematically represented by VGAM1 RNA through VGAM3 RNA, binds complementarily to a host target binding site located in an untranslated region of VGAM972 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM972 host target RNA into VGAM972 host target protein, herein schematically represented by VGAM1 HOST TARGET PROTEIN through VGAM3 HOST TARGET PROTEIN, all of FIG. 1.

It is appreciated that a function of VGR2944 gene, herein designated VGR GENE, is inhibition of expression of host target genes, as part of a novel viral mechanism of attacking a host. Accordingly, utilities of VGR2944 gene include diagnosis, prevention and treatment of viral infection by Melanoplus Sanguinipes Entomopoxvirus. Specific functions, and accordingly utilities, of VGR2944 gene correlate with, and may be deduced from, the identity of the host target genes, which are inhibited by VGAM RNAs comprised in the 'operon-like' cluster of VGR2944 gene: VGAM971 host target protein and VGAM972 host target protein, herein schematically represented by VGAM1 HOST TARGET PROTEIN through VGAM3 HOST TARGET PROTEIN. The function of these host target genes is elaborated hereinabove with reference to VGAM971 and VGAM972. FIG. 9 further provides a conceptual description of novel bioinformatically detected regulatory viral gene, referred to here as Viral Genomic Record 2945(VGR2945) viral gene, which encodes an 'operon-like' cluster of novel viral micro RNA-like genes, each of which in turn modulates expression of at least one host target gene, the function and utility of which at least one host target gene is known in the art.

VGR2945 gene, herein designated VGR GENE, is a novel bioinformatically detected regulatory, non protein coding, RNA viral gene. The method by which VGR2945 gene was detected is described hereinabove with reference to FIGS. 1-9.

VGR2945 gene encodes VGR2945 precursor RNA, herein designated VGR PRECURSOR RNA, an RNA molecule, typically several hundred nucleotides long.

VGR2945 precursor RNA folds spatially, forming VGR2945 folded precursor RNA, herein designated VGR FOLDED PRECURSOR RNA. It is appreciated that VGR2945 folded precursor RNA comprises a plurality of what is known in the art as 'hairpin' structures. These 'hairpin' structures are due to the fact that the nucleotide sequence of VGR2945 precursor RNA comprises a plurality of segments, the first half of each such segment having a nucleotide sequence which is at least a partial inversed-reversed sequence of the second half thereof, as is well known in the art.

VGR2945 folded precursor RNA is naturally processed by cellular enzymatic activity into at least 5 separate VGAM precursor RNAs, VGAM975 precursor RNA, VGAM976 precursor RNA, VGAM977 precursor RNA, VGAM978 precursor RNA and VGAM979 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM975 RNA, VGAM976 RNA, VGAM977 RNA, VGAM978 RNA and VGAM979 RNA, herein schematically represented by VGAM1 RNA through VGAM3 RNA, each of which VGAM RNAs corresponding to VGAM RNA of FIG. 1.

VGAM975 RNA, herein schematically represented by VGAM1 RNA through VGAM3 RNA, binds complementarily to a host target binding site located in an untranslated region of VGAM975 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM975 host target RNA into VGAM975 host target protein, herein schematically represented by VGAM1 HOST TARGET PROTEIN through VGAM3 HOST TARGET PROTEIN, all of FIG. 1.

VGAM976 RNA, herein schematically represented by VGAM1 RNA through VGAM3 RNA, binds complementarily to a host target binding site located in an untranslated region of VGAM976 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM976 host target RNA into VGAM976 host target protein, herein schematically represented by VGAM1 HOST TARGET PROTEIN through VGAM3 HOST TARGET PROTEIN, all of FIG. 1.

VGAM977 RNA, herein schematically represented by VGAM1 RNA through VGAM3 RNA, binds complementarily to a host target binding site located in an untranslated region of VGAM977 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM977 host target RNA into VGAM977 host target protein, herein schematically represented by VGAM1 HOST TARGET PROTEIN through VGAM3 HOST TARGET PROTEIN, all of FIG. 1.

VGAM978 RNA, herein schematically represented by VGAM1 RNA through VGAM3 RNA, binds complementarily to a host target binding site located in an untranslated region of VGAM978 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM978 host target RNA into VGAM978 host target protein, herein schematically represented by VGAM1 HOST TARGET PROTEIN through VGAM3 HOST TARGET PROTEIN, all of FIG. 1.

VGAM979 RNA, herein schematically represented by VGAM1 RNA through VGAM3 RNA, binds complementarily to a host target binding site located in an untranslated region of VGAM979 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM979 host target RNA into VGAM979 host target protein, herein schematically represented by VGAM1 HOST TARGET PROTEIN through VGAM3 HOST TARGET PROTEIN, all of FIG. 1.

It is appreciated that a function of VGR2945 gene, herein designated VGR GENE, is inhibition of expression of host target genes, as part of a novel viral mechanism of attacking a host. Accordingly, utilities of VGR2945 gene include diagnosis, prevention and treatment of viral infection by Variola Virus. Specific functions, and accordingly utilities, of VGR2945 gene correlate with, and may be deduced from, the identity of the host target genes, which are inhibited by VGAM RNAs comprised in the 'operon-like' cluster of VGR2945 gene: VGAM975 host target protein, VGAM976 host target protein, VGAM977 host target protein, VGAM978 host target protein and VGAM979 host target protein, herein schematically represented by VGAM1 HOST TARGET PROTEIN through VGAM3 HOST TARGET PROTEIN. The function of these host target genes is elaborated hereinabove with reference to VGAM975, VGAM976, VGAM977, VGAM978 and VGAM979. FIG. 9 further provides a conceptual description of novel bioinformatically detected regulatory viral gene, referred to here as Viral Genomic Record 2946(VGR2946) viral gene, which encodes an 'operon-like' cluster of novel viral micro RNA-like genes, each of which in turn modulates expression of at least one host target gene, the function and utility of which at least one host target gene is known in the art.

VGR2946 gene, herein designated VGR GENE, is a novel bioinformatically detected regulatory, non protein coding, RNA viral gene. The method by which VGR2946 gene was detected is described hereinabove with reference to FIGS. 1-9.

VGR2946 gene encodes VGR2946 precursor RNA, herein designated VGR PRECURSOR RNA, an RNA molecule, typically several hundred nucleotides long.

VGR2946 precursor RNA folds spatially, forming VGR2946 folded precursor RNA, herein designated VGR FOLDED PRECURSOR RNA. It is appreciated that VGR2946 folded precursor RNA comprises a plurality of what is known in the art as 'hairpin' structures. These 'hairpin' structures are due to the fact that the nucleotide sequence of VGR2946 precursor RNA comprises a plurality of segments, the first half of each such segment having a nucleotide sequence which is at least a partial inversed-reversed sequence of the second half thereof, as is well known in the art.

VGR2946 folded precursor RNA is naturally processed by cellular enzymatic activity into at least 5 separate VGAM precursor RNAs, VGAM980 precursor RNA, VGAM981 precursor RNA, VGAM982 precursor RNA, VGAM983 precursor RNA and VGAM984 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM980 RNA, VGAM981 RNA, VGAM982 RNA, VGAM983 RNA and VGAM984 RNA, herein schematically represented by VGAM1 RNA through VGAM3 RNA, each of which VGAM RNAs corresponding to VGAM RNA of FIG. 1.

VGAM980 RNA, herein schematically represented by VGAM1 RNA through VGAM3 RNA, binds complementarily to a host target binding site located in an untranslated region of VGAM980 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM980 host target RNA into VGAM980 host target protein, herein schematically represented by VGAM1 HOST TARGET PROTEIN through VGAM3 HOST TARGET PROTEIN, all of FIG. 1.

VGAM981 RNA, herein schematically represented by VGAM1 RNA through VGAM3 RNA, binds complementarily to a host target binding site located in an untranslated region of VGAM981 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM981 host target RNA into VGAM981 host target protein, herein schematically represented by VGAM1 HOST TARGET PROTEIN through VGAM3 HOST TARGET PROTEIN, all of FIG. 1.

VGAM982 RNA, herein schematically represented by VGAM1 RNA through VGAM3 RNA, binds complementarily to a host target binding site located in an untranslated region of VGAM982 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM982 host target RNA into VGAM982 host target protein, herein schematically represented by VGAM1 HOST TARGET PROTEIN through VGAM3 HOST TARGET PROTEIN, all of FIG. 1.

VGAM983 RNA, herein schematically represented by VGAM1 RNA through VGAM3 RNA, binds complementarily to a host target binding site located in an untranslated region of VGAM983 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM983 host target RNA into VGAM983 host target protein, herein schematically represented by VGAM1 HOST TARGET PROTEIN through VGAM3 HOST TARGET PROTEIN, all of FIG. 1.

VGAM984 RNA, herein schematically represented by VGAM1 RNA through VGAM3 RNA, binds complementarily to a host target binding site located in an untranslated region of VGAM984 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM984 host target RNA into VGAM984 host target protein, herein schematically represented by VGAM1 HOST TARGET PROTEIN through VGAM3 HOST TARGET PROTEIN, all of FIG. 1.

It is appreciated that a function of VGR2946 gene, herein designated VGR GENE, is inhibition of expression of host target genes, as part of a novel viral mechanism of attacking a host. Accordingly, utilities of VGR2946 gene include diagnosis, prevention and treatment of viral infection by Ectromelia Virus. Specific functions, and accordingly utilities, of VGR2946 gene correlate with, and may be deduced from, the identity of the host target genes, which are inhibited by VGAM RNAs comprised in the 'operon-like' cluster of VGR2946 gene: VGAM980 host target protein, VGAM981 host target protein, VGAM982 host target protein, VGAM983 host target protein and VGAM984 host target protein, herein schematically represented by VGAM1 HOST TARGET PROTEIN through VGAM3 HOST TARGET PROTEIN. The function of these host target genes is elaborated hereinabove with reference to VGAM980, VGAM981, VGAM982, VGAM983 and VGAM984. FIG. 9 further provides a conceptual description of novel bioinformatically detected regulatory viral gene, referred to here as Viral Genomic Record 2947(VGR2947) viral gene, which encodes an 'operon-like' cluster of novel viral micro RNA-like genes, each of which in turn modulates expression of at least one host target gene, the function and utility of which at least one host target gene is known in the art.

VGR2947 gene, herein designated VGR GENE, is a novel bioinformatically detected regulatory, non protein coding, RNA viral gene. The method by which VGR2947 gene was detected is described hereinabove with reference to FIGS. 1-9.

VGR2947 gene encodes VGR2947 precursor RNA, herein designated VGR PRECURSOR RNA, an RNA molecule, typically several hundred nucleotides long.

VGR2947 precursor RNA folds spatially, forming VGR2947 folded precursor RNA, herein designated VGR FOLDED PRECURSOR RNA. It is appreciated that VGR2947 folded precursor RNA comprises a plurality of what is known in the art as 'hairpin' structures. These 'hairpin' structures are due to the fact that the nucleotide sequence of VGR2947 precursor RNA comprises a plurality of segments, the first half of each such segment having a nucleotide sequence which is at least a partial inversed-reversed sequence of the second half thereof, as is well known in the art.

VGR2947 folded precursor RNA is naturally processed by cellular enzymatic activity into at least 5 separate VGAM precursor RNAs, VGAM986 precursor RNA, VGAM987 precursor RNA, VGAM988 precursor RNA, VGAM989 precursor RNA and VGAM990 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM986 RNA, VGAM987 RNA, VGAM988 RNA, VGAM989 RNA and VGAM990 RNA, herein schematically represented by VGAM1 RNA through VGAM3 RNA, each of which VGAM RNAs corresponding to VGAM RNA of FIG. 1.

VGAM986 RNA, herein schematically represented by VGAM1 RNA through VGAM3 RNA, binds complementarily to a host target binding site located in an untranslated region of VGAM986 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM986 host target RNA into VGAM986 host target protein, herein schematically represented by VGAM1 HOST TARGET PROTEIN through VGAM3 HOST TARGET PROTEIN, all of FIG. 1.

VGAM987 RNA, herein schematically represented by VGAM1 RNA through VGAM3 RNA, binds complementarily to a host target binding site located in an untranslated region of VGAM987 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM987 host target RNA into VGAM987 host target protein, herein schematically represented by VGAM1 HOST TARGET PROTEIN through VGAM3 HOST TARGET PROTEIN, all of FIG. 1.

VGAM988 RNA, herein schematically represented by VGAM1 RNA through VGAM3 RNA, binds complementarily to a host target binding site located in an untranslated region of VGAM988 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM988 host target RNA into VGAM988 host target protein, herein schematically represented by VGAM1 HOST TARGET PROTEIN through VGAM3 HOST TARGET PROTEIN, all of FIG. 1.

VGAM989 RNA, herein schematically represented by VGAM1 RNA through VGAM3 RNA, binds complementarily to a host target binding site located in an untranslated region of VGAM989 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM989 host target RNA into VGAM989 host target protein, herein schematically represented by VGAM1 HOST TARGET PROTEIN through VGAM3 HOST TARGET PROTEIN, all of FIG. 1.

VGAM990 RNA, herein schematically represented by VGAM1 RNA through VGAM3 RNA, binds complementarily to a host target binding site located in an untranslated region of VGAM990 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM990 host target RNA into VGAM990 host target protein, herein schematically represented by VGAM1 HOST TARGET PROTEIN through VGAM3 HOST TARGET PROTEIN, all of FIG. 1.

It is appreciated that a function of VGR2947 gene, herein designated VGR GENE, is inhibition of expression of host target genes, as part of a novel viral mechanism of attacking a host. Accordingly, utilities of VGR2947 gene include diagnosis, prevention and treatment of viral infection by Leishmania RNA Virus 1-4. Specific functions, and accordingly utilities, of VGR2947 gene correlate with, and may be deduced from, the identity of the host target genes, which are inhibited by VGAM RNAs comprised in the 'operon-like' cluster of VGR2947 gene: VGAM986 host target protein, VGAM987 host target protein, VGAM988 host target protein, VGAM989 host target protein and VGAM990 host target protein, herein schematically represented by VGAM1 HOST TARGET PROTEIN through VGAM3 HOST TARGET PROTEIN. The function of these host target genes is elaborated hereinabove with reference to VGAM986, VGAM987, VGAM988, VGAM989 and VGAM990. FIG. 9 further provides a conceptual description of novel bioinformatically detected regulatory viral gene, referred to here as Viral Genomic Record 2948(VGR2948) viral gene, which encodes an 'operon-like' cluster of novel viral micro RNA-like genes, each of which in turn modulates expression of at least one host target gene, the function and utility of which at least one host target gene is known in the art.

VGR2948 gene, herein designated VGR GENE, is a novel bioinformatically detected regulatory, non protein coding, RNA viral gene. The method by which VGR2948 gene was detected is described hereinabove with reference to FIGS. 1-9.

VGR2948 gene encodes VGR2948 precursor RNA, herein designated VGR PRECURSOR RNA, an RNA molecule, typically several hundred nucleotides long.

VGR2948 precursor RNA folds spatially, forming VGR2948 folded precursor RNA, herein designated VGR FOLDED PRECURSOR RNA. It is appreciated that VGR2948 folded precursor RNA comprises a plurality of what is known in the art as 'hairpin' structures. These 'hairpin' structures are due to the fact that the nucleotide sequence of VGR2948 precursor RNA comprises a plurality of segments, the first half of each such segment having a nucleotide sequence which is at least a partial inversed-reversed sequence of the second half thereof, as is well known in the art.

VGR2948 folded precursor RNA is naturally processed by cellular enzymatic activity into at least 6 separate VGAM precursor RNAs, VGAM991 precursor RNA, VGAM992 precursor RNA, VGAM993 precursor RNA, VGAM994 precursor RNA, VGAM995 precursor RNA and VGAM996 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM991 RNA, VGAM992 RNA, VGAM993 RNA, VGAM994 RNA, VGAM995 RNA and VGAM996 RNA, herein schematically represented by VGAM1 RNA through VGAM3 RNA, each of which VGAM RNAs corresponding to VGAM RNA of FIG. 1.

VGAM991 RNA, herein schematically represented by VGAM1 RNA through VGAM3 RNA, binds complementarily to a host target binding site located in an untranslated region of VGAM991 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM991 host target RNA into VGAM991 host target protein, herein schematically represented by VGAM1 HOST TARGET PROTEIN through VGAM3 HOST TARGET PROTEIN, all of FIG. 1.

VGAM992 RNA, herein schematically represented by VGAM1 RNA through VGAM3 RNA, binds complementarily to a host target binding site located in an untranslated region of VGAM992 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM992 host target RNA into VGAM992 host target protein, herein schematically represented by VGAM1 HOST TARGET PROTEIN through VGAM3 HOST TARGET PROTEIN, all of FIG. 1.

VGAM993 RNA, herein schematically represented by VGAM1 RNA through VGAM3 RNA, binds complementarily to a host target binding site located in an untranslated region of VGAM993 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM993 host target RNA into VGAM993 host target protein, herein schematically represented by VGAM1 HOST TARGET PROTEIN through VGAM3 HOST TARGET PROTEIN, all of FIG. 1.

VGAM994 RNA, herein schematically represented by VGAM1 RNA through VGAM3 RNA, binds complementarily to a host target binding site located in an untranslated region of VGAM994 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM994 host target RNA into VGAM994 host target protein, herein schematically represented by VGAM1 HOST TARGET PROTEIN through VGAM3 HOST TARGET PROTEIN, all of FIG. 1.

VGAM995 RNA, herein schematically represented by VGAM1 RNA through VGAM3 RNA, binds complementarily to a host target binding site located in an untranslated region of VGAM995 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM995 host target RNA into VGAM995 host target protein, herein schematically represented by VGAM1 HOST TARGET PROTEIN through VGAM3 HOST TARGET PROTEIN, all of FIG. 1.

VGAM996 RNA, herein schematically represented by VGAM1 RNA through VGAM3 RNA, binds complementarily to a host target binding site located in an untranslated region of VGAM996 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM996 host target RNA into VGAM996 host target protein, herein schematically represented by VGAM1 HOST TARGET PROTEIN through VGAM3 HOST TARGET PROTEIN, all of FIG. 1.

It is appreciated that a function of VGR2948 gene, herein designated VGR GENE, is inhibition of expression of host target genes, as part of a novel viral mechanism of attacking a host. Accordingly, utilities of VGR2948 gene include diagnosis, prevention and treatment of viral infection by Leishmania RNA Virus 1-1. Specific functions, and accordingly utilities, of VGR2948 gene correlate with, and may be deduced from, the identity of the host target genes, which are inhibited by VGAM RNAs comprised in the 'operon-like' cluster of VGR2948 gene: VGAM991 host target protein, VGAM992 host target protein, VGAM993 host target protein, VGAM994 host target protein, VGAM995 host target protein and VGAM996 host target protein, herein schematically represented by VGAM1 HOST TARGET PROTEIN through VGAM3 HOST TARGET PROTEIN. The function of these host target genes is elaborated hereinabove with reference to VGAM991, VGAM992, VGAM993, VGAM994, VGAM995 and VGAM996. FIG. 9 further provides a conceptual description of novel bioinformatically detected regulatory viral gene, referred to here as Viral Genomic Record 2949(VGR2949) viral gene, which encodes an 'operon-like' cluster of novel viral micro RNA-like genes, each of which in turn modulates expression of at least one host target gene, the function and utility of which at least one host target gene is known in the art.

VGR2949 gene, herein designated VGR GENE, is a novel bioinformatically detected regulatory, non protein coding, RNA viral gene. The method by which VGR2949 gene was detected is described hereinabove with reference to FIGS. 1-9.

VGR2949 gene encodes VGR2949 precursor RNA, herein designated VGR PRECURSOR RNA, an RNA molecule, typically several hundred nucleotides long.

VGR2949 precursor RNA folds spatially, forming VGR2949 folded precursor RNA, herein designated VGR FOLDED PRECURSOR RNA. It is appreciated that VGR2949 folded precursor RNA comprises a plurality of what is known in the art as 'hairpin' structures. These 'hairpin' structures are due to the fact that the nucleotide sequence of VGR2949 precursor RNA comprises a plurality of segments, the first half of each such segment having a nucleotide sequence which is at least a partial inversed-reversed sequence of the second half thereof, as is well known in the art.

VGR2949 folded precursor RNA is naturally processed by cellular enzymatic activity into at least 5 separate VGAM precursor RNAs, VGAM997 precursor RNA, VGAM998 precursor RNA, VGAM999 precursor RNA, VGAM1000 precursor RNA and VGAM1001 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM997 RNA, VGAM998 RNA, VGAM999 RNA, VGAM1000 RNA and VGAM1001 RNA, herein schematically represented by VGAM1 RNA through VGAM3 RNA, each of which VGAM RNAs corresponding to VGAM RNA of FIG. 1.

VGAM997 RNA, herein schematically represented by VGAM1 RNA through VGAM3 RNA, binds complementarily to a host target binding site located in an untranslated region of VGAM997 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM997 host target RNA into VGAM997 host target protein, herein schematically represented by VGAM1 HOST TARGET PROTEIN through VGAM3 HOST TARGET PROTEIN, all of FIG. 1.

VGAM998 RNA, herein schematically represented by VGAM1 RNA through VGAM3 RNA, binds complementarily to a host target binding site located in an untranslated region of VGAM998 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM998 host target RNA into VGAM998 host target protein, herein schematically represented by VGAM1 HOST TARGET PROTEIN through VGAM3 HOST TARGET PROTEIN, all of FIG. 1.

VGAM999 RNA, herein schematically represented by VGAM1 RNA through VGAM3 RNA, binds complementarily to a host target binding site located in an untranslated region of VGAM999 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM999 host target RNA into VGAM999 host target protein, herein schematically represented by VGAM1 HOST TARGET PROTEIN through VGAM3 HOST TARGET PROTEIN, all of FIG. 1.

VGAM1000 RNA, herein schematically represented by VGAM1 RNA through VGAM3 RNA, binds complementarily to a host target binding site located in an untranslated region of VGAM1000 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1000 host target RNA into VGAM1000 host target protein, herein schematically represented by VGAM1 HOST TARGET PROTEIN through VGAM3 HOST TARGET PROTEIN, all of FIG. 1.

VGAM1001 RNA, herein schematically represented by VGAM1 RNA through VGAM3 RNA, binds complementarily to a host target binding site located in an untranslated region of VGAM1001 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1001 host target RNA into VGAM1001 host target protein, herein schematically represented by VGAM1 HOST TARGET PROTEIN through VGAM3 HOST TARGET PROTEIN, all of FIG. 1.

It is appreciated that a function of VGR2949 gene, herein designated VGR GENE, is inhibition of expression of host target genes, as part of a novel viral mechanism of attacking a host. Accordingly, utilities of VGR2949 gene include diagnosis, prevention and treatment of viral infection by Cowpox Virus. Specific functions, and accordingly utilities, of VGR2949 gene correlate with, and may be deduced from, the identity of the host target genes, which are inhibited by VGAM RNAs comprised in the 'operon-like' cluster of VGR2949 gene: VGAM997 host target protein, VGAM998 host target protein, VGAM999 host target protein, VGAM1000 host target protein and VGAM1001 host target protein, herein schematically represented by VGAM1 HOST TARGET PROTEIN through VGAM3 HOST TARGET PROTEIN. The function of these host target genes is elaborated hereinabove with reference to VGAM997, VGAM998, VGAM999, VGAM1000 and VGAM1001. FIG. 9 further provides a conceptual description of novel bioinformatically detected regulatory viral gene, referred to here as Viral Genomic Record 2950(VGR2950) viral gene, which encodes an 'operon-like' cluster of novel viral micro RNA-like genes, each of which in turn modulates expression of at least one host target gene, the function and utility of which at least one host target gene is known in the art.

VGR2950 gene, herein designated VGR GENE, is a novel bioinformatically detected regulatory, non protein coding, RNA viral gene. The method by which VGR2950 gene was detected is described hereinabove with reference to FIGS. 1-9.

VGR2950 gene encodes VGR2950 precursor RNA, herein designated VGR PRECURSOR RNA, an RNA molecule, typically several hundred nucleotides long.

VGR2950 precursor RNA folds spatially, forming VGR2950 folded precursor RNA, herein designated VGR FOLDED PRECURSOR RNA. It is appreciated that VGR2950 folded precursor RNA comprises a plurality of what is known in the art as 'hairpin' structures. These 'hairpin' structures are due to the fact that the nucleotide sequence of VGR2950 precursor RNA comprises a plurality of segments, the first half of each such segment having a nucleotide sequence which is at least a partial inversed-reversed sequence of the second half thereof, as is well known in the art.

VGR2950 folded precursor RNA is naturally processed by cellular enzymatic activity into at least 7 separate VGAM precursor RNAs, VGAM1002 precursor RNA, VGAM1003 precursor RNA, VGAM1004 precursor RNA, VGAM1005 precursor RNA, VGAM1006 precursor RNA, VGAM1007 precursor RNA and VGAM1008 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1002 RNA, VGAM1003 RNA, VGAM1004 RNA, VGAM1005 RNA, VGAM1006 RNA, VGAM1007 RNA and VGAM1008 RNA, herein schematically represented by VGAM1 RNA through VGAM3 RNA, each of which VGAM RNAs corresponding to VGAM RNA of FIG. 1.

VGAM1002 RNA, herein schematically represented by VGAM1 RNA through VGAM3 RNA, binds complementarily to a host target binding site located in an untranslated region of VGAM1002 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1002 host target RNA into VGAM1002 host target protein, herein schematically represented by VGAM1 HOST TARGET PROTEIN through VGAM3 HOST TARGET PROTEIN, all of FIG. 1.

VGAM1003 RNA, herein schematically represented by VGAM1 RNA through VGAM3 RNA, binds complementarily to a host target binding site located in an untranslated region of VGAM1003 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1003 host target RNA into VGAM1003 host target protein, herein schematically represented by VGAM1 HOST TARGET PROTEIN through VGAM3 HOST TARGET PROTEIN, all of FIG. 1.

VGAM1004 RNA, herein schematically represented by VGAM1 RNA through VGAM3 RNA, binds complementarily to a host target binding site located in an untranslated region of VGAM1004 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1004 host target RNA into VGAM1004 host target protein, herein schematically represented by VGAM1 HOST TARGET PROTEIN through VGAM3 HOST TARGET PROTEIN, all of FIG. 1.

VGAM1005 RNA, herein schematically represented by VGAM1 RNA through VGAM3 RNA, binds complementarily to a host target binding site located in an untranslated region of VGAM1005 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1005 host target RNA into VGAM1005 host target protein, herein schematically represented by VGAM1 HOST TARGET PROTEIN through VGAM3 HOST TARGET PROTEIN, all of FIG. 1.

VGAM1006 RNA, herein schematically represented by VGAM1 RNA through VGAM3 RNA, binds complementarily to a host target binding site located in an untranslated region of VGAM1006 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1006 host target RNA into VGAM1006 host target protein, herein schematically represented by VGAM1 HOST TARGET PROTEIN through VGAM3 HOST TARGET PROTEIN, all of FIG. 1.

VGAM1007 RNA, herein schematically represented by VGAM1 RNA through VGAM3 RNA, binds complementarily to a host target binding site located in an untranslated region of VGAM1007 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1007 host target RNA into VGAM1007 host target protein, herein schematically represented by VGAM1 HOST TARGET PROTEIN through VGAM3 HOST TARGET PROTEIN, all of FIG. 1.

VGAM1008 RNA, herein schematically represented by VGAM1 RNA through VGAM3 RNA, binds complementarily to a host target binding site located in an untranslated region of VGAM1008 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1008 host target RNA into VGAM1008 host target protein, herein schematically represented by VGAM1 HOST TARGET PROTEIN through VGAM3 HOST TARGET PROTEIN, all of FIG. 1.

It is appreciated that a function of VGR2950 gene, herein designated VGR GENE, is inhibition of expression of host target genes, as part of a novel viral mechanism of attacking a host. Accordingly, utilities of VGR2950 gene include diagnosis, prevention and treatment of viral infection by Chimpanzee Cytomegalovirus. Specific functions, and accordingly utilities, of VGR2950 gene correlate with, and may be deduced from, the identity of the host target genes, which are inhibited by VGAM RNAs comprised in the 'operon-like' cluster of VGR2950 gene: VGAM1002 host target protein, VGAM1003 host target protein, VGAM1004 host target protein, VGAM1005 host target protein, VGAM1006 host target protein, VGAM1007 host target protein and VGAM1008 host target protein, herein schematically represented by VGAM1 HOST TARGET PROTEIN through VGAM3 HOST TARGET PROTEIN. The function of these host target genes is elaborated hereinabove with reference to VGAM1002, VGAM1003, VGAM1004, VGAM1005, VGAM1006, VGAM1007 and VGAM1008. FIG. 9 further provides a conceptual description of novel bioinformatically detected regulatory viral gene, referred to here as Viral Genomic Record 2951(VGR2951) viral gene, which encodes an 'operon-like' cluster of novel viral micro RNA-like genes, each of which in turn modulates expression of at least one host target gene, the function and utility of which at least one host target gene is known in the art.

VGR2951 gene, herein designated VGR GENE, is a novel bioinformatically detected regulatory, non protein coding, RNA viral gene. The method by which VGR2951 gene was detected is described hereinabove with reference to FIGS. 1-9.

VGR2951 gene encodes VGR2951 precursor RNA, herein designated VGR PRECURSOR RNA, an RNA molecule, typically several hundred nucleotides long.

VGR2951 precursor RNA folds spatially, forming VGR2951 folded precursor RNA, herein designated VGR FOLDED PRECURSOR RNA. It is appreciated that VGR2951 folded precursor RNA comprises a plurality of what is known in the art as 'hairpin' structures. These 'hairpin' structures are due to the fact that the nucleotide sequence of VGR2951 precursor RNA comprises a plurality of segments, the first half of each such segment having a nucleotide sequence which is at least a partial inversed-reversed sequence of the second half thereof, as is well known in the art.

VGR2951 folded precursor RNA is naturally processed by cellular enzymatic activity into at least 3 separate VGAM precursor RNAs, VGAM1009 precursor RNA, VGAM1010 precursor RNA and VGAM1011 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1009 RNA, VGAM1010 RNA and VGAM1011 RNA, herein schematically represented by VGAM1 RNA through VGAM3 RNA, each of which VGAM RNAs corresponding to VGAM RNA of FIG. 1.

VGAM1009 RNA, herein schematically represented by VGAM1 RNA through VGAM3 RNA, binds complementarily to a host target binding site located in an untranslated region of VGAM1009 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1009 host target RNA into VGAM1009 host target protein, herein schematically represented by VGAM1 HOST TARGET PROTEIN through VGAM3 HOST TARGET PROTEIN, all of FIG. 1.

VGAM1010 RNA, herein schematically represented by VGAM1 RNA through VGAM3 RNA, binds complementarily to a host target binding site located in an untranslated region of VGAM1010 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1010 host target RNA into VGAM1010 host target protein, herein schematically represented by VGAM1 HOST TARGET PROTEIN through VGAM3 HOST TARGET PROTEIN, all of FIG. 1.

VGAM1011 RNA, herein schematically represented by VGAM1 RNA through VGAM3 RNA, binds complementarily to a host target binding site located in an untranslated region of VGAM1011 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1011 host target RNA into VGAM1011 host target protein, herein schematically represented by VGAM1 HOST TARGET PROTEIN through VGAM3 HOST TARGET PROTEIN, all of FIG. 1.

It is appreciated that a function of VGR2951 gene, herein designated VGR GENE, is inhibition of expression of host target genes, as part of a novel viral mechanism of attacking a host. Accordingly, utilities of VGR2951 gene include diagnosis, prevention and treatment of viral infection by Equine Herpesvirus 4. Specific functions, and accordingly utilities, of VGR2951 gene correlate with, and may be deduced from, the identity of the host target genes, which are inhibited by VGAM RNAs comprised in the 'operon-like' cluster of VGR2951 gene: VGAM1009 host target protein, VGAM1010 host target protein and VGAM1011 host target protein, herein schematically represented by VGAM1 HOST TARGET PROTEIN through VGAM3 HOST TARGET PROTEIN. The function of these host target genes is elaborated hereinabove with reference to VGAM1009, VGAM1010 and VGAM1011. FIG. 9 further provides a conceptual description of novel bioinformatically detected regulatory viral gene, referred to here as Viral Genomic Record 2952(VGR2952) viral gene, which encodes an 'operon-like' cluster of novel viral micro RNA-like genes, each of which in turn modulates expression of at least one host target gene, the function and utility of which at least one host target gene is known in the art.

VGR2952 gene, herein designated VGR GENE, is a novel bioinformatically detected regulatory, non protein coding, RNA viral gene. The method by which VGR2952 gene was detected is described hereinabove with reference to FIGS. 1-9.

VGR2952 gene encodes VGR2952 precursor RNA, herein designated VGR PRECURSOR RNA, an RNA molecule, typically several hundred nucleotides long.

VGR2952 precursor RNA folds spatially, forming VGR2952 folded precursor RNA, herein designated VGR FOLDED PRECURSOR RNA. It is appreciated that VGR2952 folded precursor RNA comprises a plurality of what is known in the art as 'hairpin' structures. These 'hairpin' structures are due to the fact that the nucleotide sequence of VGR2952 precursor RNA comprises a plurality of segments, the first half of each such segment having a nucleotide sequence which is at least a partial inversed-reversed sequence of the second half thereof, as is well known in the art.

VGR2952 folded precursor RNA is naturally processed by cellular enzymatic activity into at least 2 separate VGAM precursor RNAs, VGAM1012 precursor RNA and VGAM1013 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1012 RNA and VGAM1013 RNA, herein schematically represented by VGAM1 RNA through VGAM3 RNA, each of which VGAM RNAs corresponding to VGAM RNA of FIG. 1.

VGAM1012 RNA, herein schematically represented by VGAM1 RNA through VGAM3 RNA, binds complementarily to a host target binding site located in an untranslated region of VGAM1012 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1012 host target RNA into VGAM1012 host target protein, herein schematically represented by VGAM1 HOST TARGET PROTEIN through VGAM3 HOST TARGET PROTEIN, all of FIG. 1.

VGAM1013 RNA, herein schematically represented by VGAM1 RNA through VGAM3 RNA, binds complementarily to a host target binding site located in an untranslated region of VGAM1013 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1013 host target RNA into VGAM1013 host target protein, herein schematically represented by VGAM1 HOST TARGET PROTEIN through VGAM3 HOST TARGET PROTEIN, all of FIG. 1.

It is appreciated that a function of VGR2952 gene, herein designated VGR GENE, is inhibition of expression of host target genes, as part of a novel viral mechanism of attacking a host. Accordingly, utilities of VGR2952 gene include diagnosis, prevention and treatment of viral infection by Equine Herpesvirus 1. Specific functions, and accordingly utilities, of VGR2952 gene correlate with, and may be deduced from, the identity of the host target genes, which are inhibited by VGAM RNAs comprised in the 'operon-like' cluster of VGR2952 gene: VGAM1012 host target protein and VGAM1013 host target protein, herein schematically represented by VGAM1 HOST TARGET PROTEIN through VGAM3 HOST TARGET PROTEIN. The function of these host target genes is elaborated hereinabove with reference to VGAM1012 and VGAM1013. FIG. 9 further provides a conceptual description of novel bioinformatically detected regulatory viral gene, referred to here as Viral Genomic Record 2953(VGR2953) viral gene, which encodes an 'operon-like' cluster of novel viral micro RNA-like genes, each of which in turn modulates expression of at least one host target gene, the function and utility of which at least one host target gene is known in the art.

VGR2953 gene, herein designated VGR GENE, is a novel bioinformatically detected regulatory, non protein coding, RNA viral gene. The method by which VGR2953 gene was detected is described hereinabove with reference to FIGS. 1-9.

VGR2953 gene encodes VGR2953 precursor RNA, herein designated VGR PRECURSOR RNA, an RNA molecule, typically several hundred nucleotides long.

VGR2953 precursor RNA folds spatially, forming VGR2953 folded precursor RNA, herein designated VGR FOLDED PRECURSOR RNA. It is appreciated that VGR2953 folded precursor RNA comprises a plurality of what is known in the art as 'hairpin' structures. These 'hairpin' structures are due to the fact that the nucleotide sequence of VGR2953 precursor RNA comprises a plurality of segments, the first half of each such segment having a nucleotide sequence which is at least a partial inversed-reversed sequence of the second half thereof, as is well known in the art.

VGR2953 folded precursor RNA is naturally processed by cellular enzymatic activity into at least 2 separate VGAM precursor RNAs, VGAM1015 precursor RNA and VGAM1016 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1015 RNA and VGAM1016 RNA, herein schematically represented by VGAM1 RNA through VGAM3 RNA, each of which VGAM RNAs corresponding to VGAM RNA of FIG. 1.

VGAM1015 RNA, herein schematically represented by VGAM1 RNA through VGAM3 RNA, binds complementarily to a host target binding site located in an untranslated region of VGAM1015 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1015 host target RNA into VGAM1015 host target protein, herein schematically represented by VGAM1 HOST TARGET PROTEIN through VGAM3 HOST TARGET PROTEIN, all of FIG. 1.

VGAM1016 RNA, herein schematically represented by VGAM1 RNA through VGAM3 RNA, binds complementarily to a host target binding site located in an untranslated region of VGAM1016 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1016 host target RNA into VGAM1016 host target protein, herein schematically represented by VGAM1 HOST TARGET PROTEIN through VGAM3 HOST TARGET PROTEIN, all of FIG. 1.

It is appreciated that a function of VGR2953 gene, herein designated VGR GENE, is inhibition of expression of host target genes, as part of a novel viral mechanism of attacking a host. Accordingly, utilities of VGR2953 gene include diagnosis, prevention and treatment of viral infection by Broad Bean Necrosis Virus. Specific functions, and accordingly utilities, of VGR2953 gene correlate with, and may be deduced from, the identity of the host target genes, which are inhibited by VGAM RNAs comprised in the 'operon-like' cluster of VGR2953 gene: VGAM1015 host target protein and VGAM1016 host target protein, herein schematically represented by VGAM1 HOST TARGET PROTEIN through VGAM3 HOST TARGET PROTEIN. The function of these host target genes is elaborated hereinabove with reference to VGAM1015 and VGAM1016. FIG. 9 further provides a conceptual description of novel bioinformatically detected regulatory viral gene, referred to here as Viral Genomic Record 2954(VGR2954) viral gene, which encodes an 'operon-like' cluster of novel viral micro RNA-like genes, each of which in turn modulates expression of at least one host target gene, the function and utility of which at least one host target gene is known in the art.

VGR2954 gene, herein designated VGR GENE, is a novel bioinformatically detected regulatory, non protein coding, RNA viral gene. The method by which VGR2954 gene was detected is described hereinabove with reference to FIGS. 1-9.

VGR2954 gene encodes VGR2954 precursor RNA, herein designated VGR PRECURSOR RNA, an RNA molecule, typically several hundred nucleotides long.

VGR2954 precursor RNA folds spatially, forming VGR2954 folded precursor RNA, herein designated VGR FOLDED PRECURSOR RNA. It is appreciated that VGR2954 folded precursor RNA comprises a plurality of what is known in the art as 'hairpin' structures. These 'hairpin' structures are due to the fact that the nucleotide sequence of VGR2954 precursor RNA comprises a plurality of segments, the first half of each such segment having a nucleotide sequence which is at least a partial inversed-reversed sequence of the second half thereof, as is well known in the art.

VGR2954 folded precursor RNA is naturally processed by cellular enzymatic activity into at least 3 separate VGAM precursor RNAs, VGAM1017 precursor RNA, VGAM1018 precursor RNA and VGAM1019 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1017 RNA, VGAM1018 RNA and VGAM1019 RNA, herein schematically represented by VGAM1 RNA through VGAM3 RNA, each of which VGAM RNAs corresponding to VGAM RNA of FIG. 1.

VGAM1017 RNA, herein schematically represented by VGAM1 RNA through VGAM3 RNA, binds complementarily to a host target binding site located in an untranslated region of VGAM1017 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1017 host target RNA into VGAM1017 host target protein, herein schematically represented by VGAM1 HOST TARGET PROTEIN through VGAM3 HOST TARGET PROTEIN, all of FIG. 1.

VGAM1018 RNA, herein schematically represented by VGAM1 RNA through VGAM3 RNA, binds complementarily to a host target binding site located in an untranslated region of VGAM1018 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1018 host target RNA into VGAM1018 host target protein, herein schematically represented by VGAM1 HOST TARGET PROTEIN through VGAM3 HOST TARGET PROTEIN, all of FIG. 1.

VGAM1019 RNA, herein schematically represented by VGAM1 RNA through VGAM3 RNA, binds complementarily to a host target binding site located in an untranslated region of VGAM1019 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1019 host target RNA into VGAM1019 host target protein, herein schematically represented by VGAM1 HOST TARGET PROTEIN through VGAM3 HOST TARGET PROTEIN, all of FIG. 1.

It is appreciated that a function of VGR2954 gene, herein designated VGR GENE, is inhibition of expression of host target genes, as part of a novel viral mechanism of attacking a host. Accordingly, utilities of VGR2954 gene include diagnosis, prevention and treatment of viral infection by Beet Western Yellows Virus. Specific functions, and accordingly utilities, of VGR2954 gene correlate with, and may be deduced from, the identity of the host target genes, which are inhibited by VGAM RNAs comprised in the 'operon-like' cluster of VGR2954 gene: VGAM1017 host target protein, VGAM1018 host target protein and VGAM1019 host target protein, herein schematically represented by VGAM1 HOST TARGET PROTEIN through VGAM3 HOST TARGET PROTEIN. The function of these host target genes is elaborated hereinabove with reference to VGAM1017, VGAM1018 and VGAM1019. FIG. 9 further provides a conceptual description of novel bioinformatically detected regulatory viral gene, referred to here as Viral Genomic Record 2955(VGR2955) viral gene, which encodes an 'operon-like' cluster of novel viral micro RNA-like genes, each of which in turn modulates expression of at least one host target gene, the function and utility of which at least one host target gene is known in the art.

VGR2955 gene, herein designated VGR GENE, is a novel bioinformatically detected regulatory, non protein coding, RNA viral gene. The method by which VGR2955 gene was detected is described hereinabove with reference to FIGS. 1-9.

VGR2955 gene encodes VGR2955 precursor RNA, herein designated VGR PRECURSOR RNA, an RNA molecule, typically several hundred nucleotides long.

VGR2955 precursor RNA folds spatially, forming VGR2955 folded precursor RNA, herein designated VGR FOLDED PRECURSOR RNA. It is appreciated that VGR2955 folded precursor RNA comprises a plurality of what is known in the art as 'hairpin' structures. These 'hairpin' structures are due to the fact that the nucleotide sequence of VGR2955 precursor RNA comprises a plurality of segments, the first half of each such segment having a nucleotide sequence which is at least a partial inversed-reversed sequence of the second half thereof, as is well known in the art.

VGR2955 folded precursor RNA is naturally processed by cellular enzymatic activity into at least 7 separate VGAM precursor RNAs, VGAM1020 precursor RNA, VGAM1021 precursor RNA, VGAM1022 precursor RNA, VGAM1023 precursor RNA, VGAM1024 precursor RNA, VGAM1025 precursor RNA and VGAM1026 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1020 RNA, VGAM1021 RNA, VGAM1022 RNA, VGAM1023 RNA, VGAM1024 RNA, VGAM1025 RNA and VGAM1026 RNA, herein schematically represented by VGAM1 RNA through VGAM3 RNA, each of which VGAM RNAs corresponding to VGAM RNA of FIG. 1.

VGAM1020 RNA, herein schematically represented by VGAM1 RNA through VGAM3 RNA, binds complementarily to a host target binding site located in an untranslated region of VGAM1020 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1020 host target RNA into VGAM1020 host target protein, herein schematically represented by VGAM1 HOST TARGET PROTEIN through VGAM3 HOST TARGET PROTEIN, all of FIG. 1.

VGAM1021 RNA, herein schematically represented by VGAM1 RNA through VGAM3 RNA, binds complementarily to a host target binding site located in an untranslated region of VGAM1021 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1021 host target RNA into VGAM1021 host target protein, herein schematically represented by VGAM1 HOST TARGET PROTEIN through VGAM3 HOST TARGET PROTEIN, all of FIG. 1.

VGAM1022 RNA, herein schematically represented by VGAM1 RNA through VGAM3 RNA, binds complementarily to a host target binding site located in an untranslated region of VGAM1022 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1022 host target RNA into VGAM1022 host target protein, herein schematically represented by VGAM1 HOST TARGET PROTEIN through VGAM3 HOST TARGET PROTEIN, all of FIG. 1.

VGAM1023 RNA, herein schematically represented by VGAM1 RNA through VGAM3 RNA, binds complementarily to a host target binding site located in an untranslated region of VGAM1023 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1023 host target RNA into VGAM1023 host target protein, herein schematically represented by VGAM1 HOST TARGET PROTEIN through VGAM3 HOST TARGET PROTEIN, all of FIG. 1.

VGAM1024 RNA, herein schematically represented by VGAM1 RNA through VGAM3 RNA, binds complementarily to a host target binding site located in an untranslated region of VGAM1024 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1024 host target RNA into VGAM1024 host target protein, herein schematically represented by VGAM1 HOST TARGET PROTEIN through VGAM3 HOST TARGET PROTEIN, all of FIG. 1.

VGAM1025 RNA, herein schematically represented by VGAM1 RNA through VGAM3 RNA, binds complementarily to a host target binding site located in an untranslated region of VGAM1025 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1025 host target RNA into VGAM1025 host target protein, herein schematically represented by VGAM1 HOST TARGET PROTEIN through VGAM3 HOST TARGET PROTEIN, all of FIG. 1.

VGAM1026 RNA, herein schematically represented by VGAM1 RNA through VGAM3 RNA, binds complementarily to a host target binding site located in an untranslated region of VGAM1026 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1026 host target RNA into VGAM1026 host target protein, herein schematically represented by VGAM1 HOST TARGET PROTEIN through VGAM3 HOST TARGET PROTEIN, all of FIG. 1.

It is appreciated that a function of VGR2955 gene, herein designated VGR GENE, is inhibition of expression of host target genes, as part of a novel viral mechanism of attacking a host. Accordingly, utilities of VGR2955 gene include diagnosis, prevention and treatment of viral infection by Cereal Yellow Dwarf Virus - RPV. Specific functions, and accordingly utilities, of VGR2955 gene correlate with, and may be deduced from, the identity of the host target genes, which are inhibited by VGAM RNAs comprised in the 'operon-like' cluster of VGR2955 gene: VGAM1020 host target protein, VGAM1021 host target protein, VGAM1022 host target protein, VGAM1023 host target protein, VGAM1024 host target protein, VGAM1025 host target protein and VGAM1026 host target protein, herein schematically represented by VGAM1 HOST TARGET PROTEIN through VGAM3 HOST TARGET PROTEIN. The function of these host target genes is elaborated hereinabove with reference to VGAM1020, VGAM1021, VGAM1022, VGAM1023, VGAM1024, VGAM1025 and VGAM1026. FIG. 9 further provides a conceptual description of novel bioinformatically detected regulatory viral gene, referred to here as Viral Genomic Record 2956(VGR2956) viral gene, which encodes an 'operon-like' cluster of novel viral micro RNA-like genes, each of which in turn modulates expression of at least one host target gene, the function and utility of which at least one host target gene is known in the art.

VGR2956 gene, herein designated VGR GENE, is a novel bioinformatically detected regulatory, non protein coding, RNA viral gene. The method by which VGR2956 gene was detected is described hereinabove with reference to FIGS. 1-9.

VGR2956 gene encodes VGR2956 precursor RNA, herein designated VGR PRECURSOR RNA, an RNA molecule, typically several hundred nucleotides long.

VGR2956 precursor RNA folds spatially, forming VGR2956 folded precursor RNA, herein designated VGR FOLDED PRECURSOR RNA. It is appreciated that VGR2956 folded precursor RNA comprises a plurality of what is known in the art as 'hairpin' structures. These 'hairpin' structures are due to the fact that the nucleotide sequence of VGR2956 precursor RNA comprises a plurality of segments, the first half of each such segment having a nucleotide sequence which is at least a partial inversed-reversed sequence of the second half thereof, as is well known in the art.

VGR2956 folded precursor RNA is naturally processed by cellular enzymatic activity into at least 2 separate VGAM precursor RNAs, VGAM1027 precursor RNA and VGAM1028 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1027 RNA and VGAM1028 RNA, herein schematically represented by VGAM1 RNA through VGAM3 RNA, each of which VGAM RNAs corresponding to VGAM RNA of FIG. 1.

VGAM1027 RNA, herein schematically represented by VGAM1 RNA through VGAM3 RNA, binds complementarily to a host target binding site located in an untranslated region of VGAM1027 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1027 host target RNA into VGAM1027 host target protein, herein schematically represented by VGAM1 HOST TARGET PROTEIN through VGAM3 HOST TARGET PROTEIN, all of FIG. 1.

VGAM1028 RNA, herein schematically represented by VGAM1 RNA through VGAM3 RNA, binds complementarily to a host target binding site located in an untranslated region of VGAM1028 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1028 host target RNA into VGAM1028 host target protein, herein schematically represented by VGAM1 HOST TARGET PROTEIN through VGAM3 HOST TARGET PROTEIN, all of FIG. 1.

It is appreciated that a function of VGR2956 gene, herein designated VGR GENE, is inhibition of expression of host target genes, as part of a novel viral mechanism of attacking a host. Accordingly, utilities of VGR2956 gene include diagnosis, prevention and treatment of viral infection by Ictalurid Herpesvirus 1. Specific functions, and accordingly utilities, of VGR2956 gene correlate with, and may be deduced from, the identity of the host target genes, which are inhibited by VGAM RNAs comprised in the 'operon-like' cluster of VGR2956 gene: VGAM1027 host target protein and VGAM1028 host target protein, herein schematically represented by VGAM1 HOST TARGET PROTEIN through VGAM3 HOST TARGET PROTEIN. The function of these host target genes is elaborated hereinabove with reference to VGAM1027 and VGAM1028. FIG. 9 further provides a conceptual description of novel bioinformatically detected regulatory viral gene, referred to here as Viral Genomic Record 2957(VGR2957) viral gene, which encodes an 'operon-like' cluster of novel viral micro RNA-like genes, each of which in turn modulates expression of at least one host target gene, the function and utility of which at least one host target gene is known in the art.

VGR2957 gene, herein designated VGR GENE, is a novel bioinformatically detected regulatory, non protein coding, RNA viral gene. The method by which VGR2957 gene was detected is described hereinabove with reference to FIGS. 1-9.

VGR2957 gene encodes VGR2957 precursor RNA, herein designated VGR PRECURSOR RNA, an RNA molecule, typically several hundred nucleotides long.

VGR2957 precursor RNA folds spatially, forming VGR2957 folded precursor RNA, herein designated VGR FOLDED PRECURSOR RNA. It is appreciated that VGR2957 folded precursor RNA comprises a plurality of what is known in the art as 'hairpin' structures. These 'hairpin' structures are due to the fact that the nucleotide sequence of VGR2957 precursor RNA comprises a plurality of segments, the first half of each such segment having a nucleotide sequence which is at least a partial inversed-reversed sequence of the second half thereof, as is well known in the art.

VGR2957 folded precursor RNA is naturally processed by cellular enzymatic activity into at least 2 separate VGAM precursor RNAs, VGAM1030 precursor RNA and VGAM1031 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1030 RNA and VGAM1031 RNA, herein schematically represented by VGAM1 RNA through VGAM3 RNA, each of which VGAM RNAs corresponding to VGAM RNA of FIG. 1.

VGAM1030 RNA, herein schematically represented by VGAM1 RNA through VGAM3 RNA, binds complementarily to a host target binding site located in an untranslated region of VGAM1030 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1030 host target RNA into VGAM1030 host target protein, herein schematically represented by VGAM1 HOST TARGET PROTEIN through VGAM3 HOST TARGET PROTEIN, all of FIG. 1.

VGAM1031 RNA, herein schematically represented by VGAM1 RNA through VGAM3 RNA, binds complementarily to a host target binding site located in an untranslated region of VGAM1031 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1031 host target RNA into VGAM1031 host target protein, herein schematically represented by VGAM1 HOST TARGET PROTEIN through VGAM3 HOST TARGET PROTEIN, all of FIG. 1.

It is appreciated that a function of VGR2957 gene, herein designated VGR GENE, is inhibition of expression of host target genes, as part of a novel viral mechanism of attacking a host. Accordingly, utilities of VGR2957 gene include diagnosis, prevention and treatment of viral infection by Beet Mild Yellowing Virus. Specific functions, and accordingly utilities, of VGR2957 gene correlate with, and may be deduced from, the identity of the host target genes, which are inhibited by VGAM RNAs comprised in the 'operon-like' cluster of VGR2957 gene: VGAM1030 host target protein and VGAM1031 host target protein, herein schematically represented by VGAM1 HOST TARGET PROTEIN through VGAM3 HOST TARGET PROTEIN. The function of these host target genes is elaborated hereinabove with reference to VGAM1030 and VGAM1031. FIG. 9 further provides a conceptual description of novel bioinformatically detected regulatory viral gene, referred to here as Viral Genomic Record 2958(VGR2958) viral gene, which encodes an 'operon-like' cluster of novel viral micro RNA-like genes, each of which in turn modulates expression of at least one host target gene, the function and utility of which at least one host target gene is known in the art.

VGR2958 gene, herein designated VGR GENE, is a novel bioinformatically detected regulatory, non protein coding, RNA viral gene. The method by which VGR2958 gene was detected is described hereinabove with reference to FIGS. 1-9.

VGR2958 gene encodes VGR2958 precursor RNA, herein designated VGR PRECURSOR RNA, an RNA molecule, typically several hundred nucleotides long.

VGR2958 precursor RNA folds spatially, forming VGR2958 folded precursor RNA, herein designated VGR FOLDED PRECURSOR RNA. It is appreciated that VGR2958 folded precursor RNA comprises a plurality of what is known in the art as 'hairpin' structures. These 'hairpin' structures are due to the fact that the nucleotide sequence of VGR2958 precursor RNA comprises a plurality of segments, the first half of each such segment having a nucleotide sequence which is at least a partial inversed-reversed sequence of the second half thereof, as is well known in the art.

VGR2958 folded precursor RNA is naturally processed by cellular enzymatic activity into at least 5 separate VGAM precursor RNAs, VGAM1032 precursor RNA, VGAM1033 precursor RNA, VGAM1034 precursor RNA, VGAM1035 precursor RNA and VGAM1036 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1032 RNA, VGAM1033 RNA, VGAM1034 RNA, VGAM1035 RNA and VGAM1036 RNA, herein schematically represented by VGAM1 RNA through VGAM3 RNA, each of which VGAM RNAs corresponding to VGAM RNA of FIG. 1.

VGAM1032 RNA, herein schematically represented by VGAM1 RNA through VGAM3 RNA, binds complementarily to a host target binding site located in an untranslated region of VGAM1032 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1032 host target RNA into VGAM1032 host target protein, herein schematically represented by VGAM1 HOST TARGET PROTEIN through VGAM3 HOST TARGET PROTEIN, all of FIG. 1.

VGAM1033 RNA, herein schematically represented by VGAM1 RNA through VGAM3 RNA, binds complementarily to a host target binding site located in an untranslated region of VGAM1033 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1033 host target RNA into VGAM1033 host target protein, herein schematically represented by VGAM1 HOST TARGET PROTEIN through VGAM3 HOST TARGET PROTEIN, all of FIG. 1.

VGAM1034 RNA, herein schematically represented by VGAM1 RNA through VGAM3 RNA, binds complementarily to a host target binding site located in an untranslated region of VGAM1034 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1034 host target RNA into VGAM1034 host target protein, herein schematically represented by VGAM1 HOST TARGET PROTEIN through VGAM3 HOST TARGET PROTEIN, all of FIG. 1.

VGAM1035 RNA, herein schematically represented by VGAM1 RNA through VGAM3 RNA, binds complementarily to a host target binding site located in an untranslated region of VGAM1035 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1035 host target RNA into VGAM1035 host target protein, herein schematically represented by VGAM1 HOST TARGET PROTEIN through VGAM3 HOST TARGET PROTEIN, all of FIG. 1.

VGAM1036 RNA, herein schematically represented by VGAM1 RNA through VGAM3 RNA, binds complementarily to a host target binding site located in an untranslated region of VGAM1036 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1036 host target RNA into VGAM1036 host target protein, herein schematically represented by VGAM1 HOST TARGET PROTEIN through VGAM3 HOST TARGET PROTEIN, all of FIG. 1.

It is appreciated that a function of VGR2958 gene, herein designated VGR GENE, is inhibition of expression of host target genes, as part of a novel viral mechanism of attacking a host. Accordingly, utilities of VGR2958 gene include diagnosis, prevention and treatment of viral infection by Cercopithecine Herpesvirus 7. Specific functions, and accordingly utilities, of VGR2958 gene correlate with, and may be deduced from, the identity of the host target genes, which are inhibited by VGAM RNAs comprised in the 'operon-like' cluster of VGR2958 gene: VGAM1032 host target protein, VGAM1033 host target protein, VGAM1034 host target protein, VGAM1035 host target protein and VGAM1036 host target protein, herein schematically represented by VGAM1 HOST TARGET PROTEIN through VGAM3 HOST TARGET PROTEIN. The function of these host target genes is elaborated hereinabove with reference to VGAM1032, VGAM1033, VGAM1034, VGAM1035 and VGAM1036. FIG. 9 further provides a conceptual description of novel bioinformatically detected regulatory viral gene, referred to here as Viral Genomic Record 2959(VGR2959) viral gene, which encodes an 'operon-like' cluster of novel viral micro RNA-like genes, each of which in turn modulates expression of at least one host target gene, the function and utility of which at least one host target gene is known in the art.

VGR2959 gene, herein designated VGR GENE, is a novel bioinformatically detected regulatory, non protein coding, RNA viral gene. The method by which VGR2959 gene was detected is described hereinabove with reference to FIGS. 1-9.

VGR2959 gene encodes VGR2959 precursor RNA, herein designated VGR PRECURSOR RNA, an RNA molecule, typically several hundred nucleotides long.

VGR2959 precursor RNA folds spatially, forming VGR2959 folded precursor RNA, herein designated VGR FOLDED PRECURSOR RNA. It is appreciated that VGR2959 folded precursor RNA comprises a plurality of what is known in the art as 'hairpin' structures. These 'hairpin' structures are due to the fact that the nucleotide sequence of VGR2959 precursor RNA comprises a plurality of segments, the first half of each such segment having a nucleotide sequence which is at least a partial inversed-reversed sequence of the second half thereof, as is well known in the art.

VGR2959 folded precursor RNA is naturally processed by cellular enzymatic activity into at least 4 separate VGAM precursor RNAs, VGAM1037 precursor RNA, VGAM1038 precursor RNA, VGAM1039 precursor RNA and VGAM1040 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1037 RNA, VGAM1038 RNA, VGAM1039 RNA and VGAM1040 RNA, herein schematically represented by VGAM1 RNA through VGAM3 RNA, each of which VGAM RNAs corresponding to VGAM RNA of FIG. 1.

VGAM1037 RNA, herein schematically represented by VGAM1 RNA through VGAM3 RNA, binds complementarily to a host target binding site located in an untranslated region of VGAM1037 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1037 host target RNA into VGAM1037 host target protein, herein schematically represented by VGAM1 HOST TARGET PROTEIN through VGAM3 HOST TARGET PROTEIN, all of FIG. 1.

VGAM1038 RNA, herein schematically represented by VGAM1 RNA through VGAM3 RNA, binds complementarily to a host target binding site located in an untranslated region of VGAM1038 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1038 host target RNA into VGAM1038 host target protein, herein schematically represented by VGAM1 HOST TARGET PROTEIN through VGAM3 HOST TARGET PROTEIN, all of FIG. 1.

VGAM1039 RNA, herein schematically represented by VGAM1 RNA through VGAM3 RNA, binds complementarily to a host target binding site located in an untranslated region of VGAM1039 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1039 host target RNA into VGAM1039 host target protein, herein schematically represented by VGAM1 HOST TARGET PROTEIN through VGAM3 HOST TARGET PROTEIN, all of FIG. 1.

VGAM1040 RNA, herein schematically represented by VGAM1 RNA through VGAM3 RNA, binds complementarily to a host target binding site located in an untranslated region of VGAM1040 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1040 host target RNA into VGAM1040 host target protein, herein schematically represented by VGAM1 HOST TARGET PROTEIN through VGAM3 HOST TARGET PROTEIN, all of FIG. 1.

It is appreciated that a function of VGR2959 gene, herein designated VGR GENE, is inhibition of expression of host target genes, as part of a novel viral mechanism of attacking a host. Accordingly, utilities of VGR2959 gene include diagnosis, prevention and treatment of viral infection by Molluscum Contagiosum Virus. Specific functions, and accordingly utilities, of VGR2959 gene correlate with, and may be deduced from, the identity of the host target genes, which are inhibited by VGAM RNAs comprised in the 'operon-like' cluster of VGR2959 gene: VGAM1037 host target protein, VGAM1038 host target protein, VGAM1039 host target protein and VGAM1040 host target protein, herein schematically represented by VGAM1 HOST TARGET PROTEIN through VGAM3 HOST TARGET PROTEIN. The function of these host target genes is elaborated hereinabove with reference to VGAM1037, VGAM1038, VGAM1039 and VGAM1040.

FIG. 9 further provides a conceptual description of novel bioinformatically detected regulatory viral gene, referred to here as Viral Genomic Record 2960(VGR2960) viral gene, which encodes an 'operon-like' cluster of novel viral micro RNA-like genes, each of which in turn modulates expression of at least one host target gene, the function and utility of which at least one host target gene is known in the art.

VGR2960 gene, herein designated VGR GENE, is a novel bioinformatically detected regulatory, non protein coding, RNA viral gene. The method by which VGR2960 gene was detected is described hereinabove with reference to FIGS. 1-9.

VGR2960 gene encodes VGR2960 precursor RNA, herein designated VGR PRECURSOR RNA, an RNA molecule, typically several hundred nucleotides long.

VGR2960 precursor RNA folds spatially, forming VGR2960 folded precursor RNA, herein designated VGR FOLDED PRECURSOR RNA. It is appreciated that VGR2960 folded precursor RNA comprises a plurality of what is known in the art as 'hairpin' structures. These 'hairpin' structures are due to the fact that the nucleotide sequence of VGR2960 precursor RNA comprises a plurality of segments, the first half of each such segment having a nucleotide sequence which is at least a partial inversed-reversed sequence of the second half thereof, as is well known in the art.

VGR2960 folded precursor RNA is naturally processed by cellular enzymatic activity into at least 3 separate VGAM precursor RNAs, VGAM1041 precursor RNA, VGAM1042 precursor RNA and VGAM1043 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1041 RNA, VGAM1042 RNA and VGAM1043 RNA, herein schematically represented by VGAM1 RNA through VGAM3 RNA, each of which VGAM RNAs corresponding to VGAM RNA of FIG. 1.

VGAM1041 RNA, herein schematically represented by VGAM1 RNA through VGAM3 RNA, binds complementarily to a host target binding site located in an untranslated region of VGAM1041 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1041 host target RNA into VGAM1041 host target protein, herein schematically represented by VGAM1 HOST TARGET PROTEIN through VGAM3 HOST TARGET PROTEIN, all of FIG. 1.

VGAM1042 RNA, herein schematically represented by VGAM1 RNA through VGAM3 RNA, binds complementarily to a host target binding site located in an untranslated region of VGAM1042 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1042 host target RNA into VGAM1042 host target protein, herein schematically represented by VGAM1 HOST TARGET PROTEIN through VGAM3 HOST TARGET PROTEIN, all of FIG. 1.

VGAM1043 RNA, herein schematically represented by VGAM1 RNA through VGAM3 RNA, binds complementarily to a host target binding site located in an untranslated region of VGAM1043 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1043 host target RNA into VGAM1043 host target protein, herein schematically represented by VGAM1 HOST TARGET PROTEIN through VGAM3 HOST TARGET PROTEIN, all of FIG. 1.

It is appreciated that a function of VGR2960 gene, herein designated VGR GENE, is inhibition of expression of host target genes, as part of a novel viral mechanism of attacking a host. Accordingly, utilities of VGR2960 gene include diagnosis, prevention and treatment of viral infection by White Clover Mosaic Virus. Specific functions, and accordingly utilities, of VGR2960 gene correlate with, and may be deduced from, the identity of the host target genes, which are inhibited by VGAM RNAs comprised in the 'operon-like' cluster of VGR2960 gene: VGAM1041 host target protein, VGAM1042 host target protein and VGAM1043 host target protein, herein schematically represented by VGAM1 HOST TARGET PROTEIN through VGAM3 HOST TARGET PROTEIN. The function of these host target genes is elaborated hereinabove with reference to VGAM1041, VGAM1042 and VGAM1043. FIG. 9 further provides a conceptual description of novel bioinformatically detected regulatory viral gene, referred to here as Viral Genomic Record 2961(VGR2961) viral gene, which encodes an 'operon-like' cluster of novel viral micro RNA-like genes, each of which in turn modulates expression of at least one host target gene, the function and utility of which at least one host target gene is known in the art.

VGR2961 gene, herein designated VGR GENE, is a novel bioinformatically detected regulatory, non protein coding, RNA viral gene. The method by which VGR2961 gene was detected is described hereinabove with reference to FIGS. 1-9.

VGR2961 gene encodes VGR2961 precursor RNA, herein designated VGR PRECURSOR RNA, an RNA molecule, typically several hundred nucleotides long.

VGR2961 precursor RNA folds spatially, forming VGR2961 folded precursor RNA, herein designated VGR FOLDED PRECURSOR RNA. It is appreciated that VGR2961 folded precursor RNA comprises a plurality of what is known in the art as 'hairpin' structures. These 'hairpin' structures are due to the fact that the nucleotide sequence of VGR2961 precursor RNA comprises a plurality of segments, the first half of each such segment having a nucleotide sequence which is at least a partial inversed-reversed sequence of the second half thereof, as is well known in the art.

VGR2961 folded precursor RNA is naturally processed by cellular enzymatic activity into at least 3 separate VGAM precursor RNAs, VGAM1044 precursor RNA, VGAM1045 precursor RNA and VGAM1046 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1044 RNA, VGAM1045 RNA and VGAM1046 RNA, herein schematically represented by VGAM1 RNA through VGAM3 RNA, each of which VGAM RNAs corresponding to VGAM RNA of FIG. 1.

VGAM1044 RNA, herein schematically represented by VGAM1 RNA through VGAM3 RNA, binds complementarily to a host target binding site located in an untranslated region of VGAM1044 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1044 host target RNA into VGAM1044 host target protein, herein schematically represented by VGAM1 HOST TARGET PROTEIN through VGAM3 HOST TARGET PROTEIN, all of FIG. 1.

VGAM1045 RNA, herein schematically represented by VGAM1 RNA through VGAM3 RNA, binds complementarily to a host target binding site located in an untranslated region of VGAM1045 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1045 host target RNA into VGAM1045 host target protein, herein schematically represented by VGAM1 HOST TARGET PROTEIN through VGAM3 HOST TARGET PROTEIN, all of FIG. 1.

VGAM1046 RNA, herein schematically represented by VGAM1 RNA through VGAM3 RNA, binds complementarily to a host target binding site located in an untranslated region of VGAM1046 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1046 host target RNA into VGAM1046 host target protein, herein schematically represented by VGAM1 HOST TARGET PROTEIN through VGAM3 HOST TARGET PROTEIN, all of FIG. 1.

It is appreciated that a function of VGR2961 gene, herein designated VGR GENE, is inhibition of expression of host target genes, as part of a novel viral mechanism of attacking a host. Accordingly, utilities of VGR2961 gene include diagnosis, prevention and treatment of viral infection by Human Herpesvirus 8. Specific functions, and accordingly utilities, of VGR2961 gene correlate with, and may be deduced from, the identity of the host target genes, which are inhibited by VGAM RNAs comprised in the 'operon-like' cluster of VGR2961 gene: VGAM1044 host target protein, VGAM1045 host target protein and VGAM1046 host target protein, herein schematically represented by VGAM1 HOST TARGET PROTEIN through VGAM3 HOST TARGET PROTEIN. The function of these host target genes is elaborated hereinabove with reference to VGAM1044, VGAM1045 and VGAM1046. FIG. 9 further provides a conceptual description of novel bioinformatically detected regulatory viral gene, referred to here as Viral Genomic Record 2962(VGR2962) viral gene, which encodes an 'operon-like' cluster of novel viral micro RNA-like genes, each of which in turn modulates expression of at least one host target gene, the function and utility of which at least one host target gene is known in the art.

VGR2962 gene, herein designated VGR GENE, is a novel bioinformatically detected regulatory, non protein coding, RNA viral gene. The method by which VGR2962 gene was detected is described hereinabove with reference to FIGS. 1-9.

VGR2962 gene encodes VGR2962 precursor RNA, herein designated VGR PRECURSOR RNA, an RNA molecule, typically several hundred nucleotides long.

VGR2962 precursor RNA folds spatially, forming VGR2962 folded precursor RNA, herein designated VGR FOLDED PRECURSOR RNA. It is appreciated that VGR2962 folded precursor RNA comprises a plurality of what is known in the art as 'hairpin' structures. These 'hairpin' structures are due to the fact that the nucleotide sequence of VGR2962 precursor RNA comprises a plurality of segments, the first half of each such segment having a nucleotide sequence which is at least a partial inversed-reversed sequence of the second half thereof, as is well known in the art.

VGR2962 folded precursor RNA is naturally processed by cellular enzymatic activity into at least 3 separate VGAM precursor RNAs, VGAM1047 precursor RNA, VGAM1048 precursor RNA and VGAM1049 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1047 RNA, VGAM1048 RNA and VGAM1049 RNA, herein schematically represented by VGAM1 RNA through VGAM3 RNA, each of which VGAM RNAs corresponding to VGAM RNA of FIG. 1.

VGAM1047 RNA, herein schematically represented by VGAM1 RNA through VGAM3 RNA, binds complementarily to a host target binding site located in an untranslated region of VGAM1047 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1047 host target RNA into VGAM1047 host target protein, herein schematically represented by VGAM1 HOST TARGET PROTEIN through VGAM3 HOST TARGET PROTEIN, all of FIG. 1.

VGAM1048 RNA, herein schematically represented by VGAM1 RNA through VGAM3 RNA, binds complementarily to a host target binding site located in an untranslated region of VGAM1048 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1048 host target RNA into VGAM1048 host target protein, herein schematically represented by VGAM1 HOST TARGET PROTEIN through VGAM3 HOST TARGET PROTEIN, all of FIG. 1.

VGAM1049 RNA, herein schematically represented by VGAM1 RNA through VGAM3 RNA, binds complementarily to a host target binding site located in an untranslated region of VGAM1049 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1049 host target RNA into VGAM1049 host target protein, herein schematically represented by VGAM1 HOST TARGET PROTEIN through VGAM3 HOST TARGET PROTEIN, all of FIG. 1.

It is appreciated that a function of VGR2962 gene, herein designated VGR GENE, is inhibition of expression of host target genes, as part of a novel viral mechanism of attacking a host. Accordingly, utilities of VGR2962 gene include diagnosis, prevention and treatment of viral infection by Strawberry Mild Yellow Edge Virus. Specific functions, and accordingly utilities, of VGR2962 gene correlate with, and may be deduced from, the identity of the host target genes, which are inhibited by VGAM RNAs comprised in the 'operon-like' cluster of VGR2962 gene: VGAM1047 host target protein, VGAM1048 host target protein and VGAM1049 host target protein, herein schematically represented by VGAM1 HOST TARGET PROTEIN through VGAM3 HOST TARGET PROTEIN. The function of these host target genes is elaborated hereinabove with reference to VGAM1047, VGAM1048 and VGAM1049. FIG. 9 further provides a conceptual description of novel bioinformatically detected regulatory viral gene, referred to here as Viral Genomic Record 2963(VGR2963) viral gene, which encodes an 'operon-like' cluster of novel viral micro RNA-like genes, each of which in turn modulates expression of at least one host target gene, the function and utility of which at least one host target gene is known in the art.

VGR2963 gene, herein designated VGR GENE, is a novel bioinformatically detected regulatory, non protein coding, RNA viral gene. The method by which VGR2963 gene was detected is described hereinabove with reference to FIGS. 1-9.

VGR2963 gene encodes VGR2963 precursor RNA, herein designated VGR PRECURSOR RNA, an RNA molecule, typically several hundred nucleotides long.

VGR2963 precursor RNA folds spatially, forming VGR2963 folded precursor RNA, herein designated VGR FOLDED PRECURSOR RNA. It is appreciated that VGR2963 folded precursor RNA comprises a plurality of what is known in the art as 'hairpin' structures. These 'hairpin' structures are due to the fact that the nucleotide sequence of VGR2963 precursor RNA comprises a plurality of segments, the first half of each such segment having a nucleotide sequence which is at least a partial inversed-reversed sequence of the second half thereof, as is well known in the art.

VGR2963 folded precursor RNA is naturally processed by cellular enzymatic activity into at least 4 separate VGAM precursor RNAs, VGAM1050 precursor RNA, VGAM1051 precursor RNA, VGAM1052 precursor RNA and VGAM1053 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1050 RNA, VGAM1051 RNA, VGAM1052 RNA and VGAM1053 RNA, herein schematically represented by VGAM1 RNA through VGAM3 RNA, each of which VGAM RNAs corresponding to VGAM RNA of FIG. 1.

VGAM1050 RNA, herein schematically represented by VGAM1 RNA through VGAM3 RNA, binds complementarily to a host target binding site located in an untranslated region of VGAM1050 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1050 host target RNA into VGAM1050 host target protein, herein schematically represented by VGAM1 HOST TARGET PROTEIN through VGAM3 HOST TARGET PROTEIN, all of FIG. 1.

VGAM1051 RNA, herein schematically represented by VGAM1 RNA through VGAM3 RNA, binds complementarily to a host target binding site located in an untranslated region of VGAM1051 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1051 host target RNA into VGAM1051 host target protein, herein schematically represented by VGAM1 HOST TARGET PROTEIN through VGAM3 HOST TARGET PROTEIN, all of FIG. 1.

VGAM1052 RNA, herein schematically represented by VGAM1 RNA through VGAM3 RNA, binds complementarily to a host target binding site located in an untranslated region of VGAM1052 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1052 host target RNA into VGAM1052 host target protein, herein schematically represented by VGAM1 HOST TARGET PROTEIN through VGAM3 HOST TARGET PROTEIN, all of FIG. 1.

VGAM1053 RNA, herein schematically represented by VGAM1 RNA through VGAM3 RNA, binds complementarily to a host target binding site located in an untranslated region of VGAM1053 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1053 host target RNA into VGAM1053 host target protein, herein schematically represented by VGAM1 HOST TARGET PROTEIN through VGAM3 HOST TARGET PROTEIN, all of FIG. 1.

It is appreciated that a function of VGR2963 gene, herein designated VGR GENE, is inhibition of expression of host target genes, as part of a novel viral mechanism of attacking a host. Accordingly, utilities of VGR2963 gene include diagnosis, prevention and treatment of viral infection by Meleagrid Herpesvirus 1. Specific functions, and accordingly utilities, of VGR2963 gene correlate with, and may be deduced from, the identity of the host target genes, which are inhibited by VGAM RNAs comprised in the 'operon-like' cluster of VGR2963 gene: VGAM1050 host target protein, VGAM1051 host target protein, VGAM1052 host target protein and VGAM1053 host target protein, herein schematically represented by VGAM1 HOST TARGET PROTEIN through VGAM3 HOST TARGET PROTEIN. The function of these host target genes is elaborated hereinabove with reference to VGAM1050, VGAM1051, VGAM1052 and VGAM1053.

FIG. 9 further provides a conceptual description of novel bioinformatically detected regulatory viral gene, referred to here as Viral Genomic Record 2964(VGR2964) viral gene, which encodes an 'operon-like' cluster of novel viral micro RNA-like genes, each of which in turn modulates expression of at least one host target gene, the function and utility of which at least one host target gene is known in the art.

VGR2964 gene, herein designated VGR GENE, is a novel bioinformatically detected regulatory, non protein coding, RNA viral gene. The method by which VGR2964 gene was detected is described hereinabove with reference to FIGS. 1-9.

VGR2964 gene encodes VGR2964 precursor RNA, herein designated VGR PRECURSOR RNA, an RNA molecule, typically several hundred nucleotides long.

VGR2964 precursor RNA folds spatially, forming VGR2964 folded precursor RNA, herein designated VGR FOLDED PRECURSOR RNA. It is appreciated that VGR2964 folded precursor RNA comprises a plurality of what is known in the art as 'hairpin' structures. These 'hairpin' structures are due to the fact that the nucleotide sequence of VGR2964 precursor RNA comprises a plurality of segments, the first half of each such segment having a nucleotide sequence which is at least a partial inversed-reversed sequence of the second half thereof, as is well known in the art.

VGR2964 folded precursor RNA is naturally processed by cellular enzymatic activity into at least 2 separate VGAM precursor RNAs, VGAM1055 precursor RNA and VGAM1056 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1055 RNA and VGAM1056 RNA, herein schematically represented by VGAM1 RNA through VGAM3 RNA, each of which VGAM RNAs corresponding to VGAM RNA of FIG. 1.

VGAM1055 RNA, herein schematically represented by VGAM1 RNA through VGAM3 RNA, binds complementarily to a host target binding site located in an untranslated region of VGAM1055 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1055 host target RNA into VGAM1055 host target protein, herein schematically represented by VGAM1 HOST TARGET PROTEIN through VGAM3 HOST TARGET PROTEIN, all of FIG. 1.

VGAM1056 RNA, herein schematically represented by VGAM1 RNA through VGAM3 RNA, binds complementarily to a host target binding site located in an untranslated region of VGAM1056 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1056 host target RNA into VGAM1056 host target protein, herein schematically represented by VGAM1 HOST TARGET PROTEIN through VGAM3 HOST TARGET PROTEIN, all of FIG. 1.

It is appreciated that a function of VGR2964 gene, herein designated VGR GENE, is inhibition of expression of host target genes, as part of a novel viral mechanism of attacking a host. Accordingly, utilities of VGR2964 gene include diagnosis, prevention and treatment of viral infection by Mayaro Virus. Specific functions, and accordingly utilities, of VGR2964 gene correlate with, and may be deduced from, the identity of the host target genes, which are inhibited by VGAM RNAs comprised in the 'operon-like' cluster of VGR2964 gene: VGAM1055 host target protein and VGAM1056 host target protein, herein schematically represented by VGAM1 HOST TARGET PROTEIN through VGAM3 HOST TARGET PROTEIN. The function of these host target genes is elaborated hereinabove with reference to VGAM1055 and VGAM1056. FIG. 9 further provides a conceptual description of novel bioinformatically detected regulatory viral gene, referred to here as Viral Genomic Record 2965(VGR2965) viral gene, which encodes an 'operon-like' cluster of novel viral micro RNA-like genes, each of which in turn modulates expression of at least one host target gene, the function and utility of which at least one host target gene is known in the art.

VGR2965 gene, herein designated VGR GENE, is a novel bioinformatically detected regulatory, non protein coding, RNA viral gene. The method by which VGR2965 gene was detected is described hereinabove with reference to FIGS. 1-9.

VGR2965 gene encodes VGR2965 precursor RNA, herein designated VGR PRECURSOR RNA, an RNA molecule, typically several hundred nucleotides long.

VGR2965 precursor RNA folds spatially, forming VGR2965 folded precursor RNA, herein designated VGR FOLDED PRECURSOR RNA. It is appreciated that VGR2965 folded precursor RNA comprises a plurality of what is known in the art as 'hairpin' structures. These 'hairpin' structures are due to the fact that the nucleotide sequence of VGR2965 precursor RNA comprises a plurality of segments, the first half of each such segment having a nucleotide sequence which is at least a partial inversed-reversed sequence of the second half thereof, as is well known in the art.

VGR2965 folded precursor RNA is naturally processed by cellular enzymatic activity into at least 3 separate VGAM precursor RNAs, VGAM1057 precursor RNA, VGAM1058 precursor RNA and VGAM1059 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1057 RNA, VGAM1058 RNA and VGAM1059 RNA, herein schematically represented by VGAM1 RNA through VGAM3 RNA, each of which VGAM RNAs corresponding to VGAM RNA of FIG. 1.

VGAM1057 RNA, herein schematically represented by VGAM1 RNA through VGAM3 RNA, binds complementarily to a host target binding site located in an untranslated region of VGAM1057 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1057 host target RNA into VGAM1057 host target protein, herein schematically represented by VGAM1 HOST TARGET PROTEIN through VGAM3 HOST TARGET PROTEIN, all of FIG. 1.

VGAM1058 RNA, herein schematically represented by VGAM1 RNA through VGAM3 RNA, binds complementarily to a host target binding site located in an untranslated region of VGAM1058 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1058 host target RNA into VGAM1058 host target protein, herein schematically represented by VGAM1 HOST TARGET PROTEIN through VGAM3 HOST TARGET PROTEIN, all of FIG. 1.

VGAM1059 RNA, herein schematically represented by VGAM1 RNA through VGAM3 RNA, binds complementarily to a host target binding site located in an untranslated region of VGAM1059 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1059 host target RNA into VGAM1059 host target protein, herein schematically represented by VGAM1 HOST TARGET PROTEIN through VGAM3 HOST TARGET PROTEIN, all of FIG. 1.

It is appreciated that a function of VGR2965 gene, herein designated VGR GENE, is inhibition of expression of host target genes, as part of a novel viral mechanism of attacking a host. Accordingly, utilities of VGR2965 gene include diagnosis, prevention and treatment of viral infection by Murid Herpesvirus 4. Specific functions, and accordingly utilities, of VGR2965 gene correlate with, and may be deduced from, the identity of the host target genes, which are inhibited by VGAM RNAs comprised in the 'operon-like' cluster of VGR2965 gene: VGAM1057 host target protein, VGAM1058 host target protein and VGAM1059 host target protein, herein schematically represented by VGAM1 HOST TARGET PROTEIN through VGAM3 HOST TARGET PROTEIN. The function of these host target genes is elaborated hereinabove with reference to VGAM1057, VGAM1058 and VGAM1059. FIG. 9 further provides a conceptual description of novel bioinformatically detected regulatory viral gene, referred to here as Viral Genomic Record 2966(VGR2966) viral gene, which encodes an 'operon-like' cluster of novel viral micro RNA-like genes, each of which in turn modulates expression of at least one host target gene, the function and utility of which at least one host target gene is known in the art.

VGR2966 gene, herein designated VGR GENE, is a novel bioinformatically detected regulatory, non protein coding, RNA viral gene. The method by which VGR2966 gene was detected is described hereinabove with reference to FIGS. 1-9.

VGR2966 gene encodes VGR2966 precursor RNA, herein designated VGR PRECURSOR RNA, an RNA molecule, typically several hundred nucleotides long.

VGR2966 precursor RNA folds spatially, forming VGR2966 folded precursor RNA, herein designated VGR FOLDED PRECURSOR RNA. It is appreciated that VGR2966 folded precursor RNA comprises a plurality of what is known in the art as 'hairpin' structures. These 'hairpin' structures are due to the fact that the nucleotide sequence of VGR2966 precursor RNA comprises a plurality of segments, the first half of each such segment having a nucleotide sequence which is at least a partial inversed-reversed sequence of the second half thereof, as is well known in the art.

VGR2966 folded precursor RNA is naturally processed by cellular enzymatic activity into at least 2 separate VGAM precursor RNAs, VGAM1061 precursor RNA and VGAM1062 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1061 RNA and VGAM1062 RNA, herein schematically represented by VGAM1 RNA through VGAM3 RNA, each of which VGAM RNAs corresponding to VGAM RNA of FIG. 1.

VGAM1061 RNA, herein schematically represented by VGAM1 RNA through VGAM3 RNA, binds complementarily to a host target binding site located in an untranslated region of VGAM1061 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1061 host target RNA into VGAM1061 host target protein, herein schematically represented by VGAM1 HOST TARGET PROTEIN through VGAM3 HOST TARGET PROTEIN, all of FIG. 1.

VGAM1062 RNA, herein schematically represented by VGAM1 RNA through VGAM3 RNA, binds complementarily to a host target binding site located in an untranslated region of VGAM1062 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1062 host target RNA into VGAM1062 host target protein, herein schematically represented by VGAM1 HOST TARGET PROTEIN through VGAM3 HOST TARGET PROTEIN, all of FIG. 1.

It is appreciated that a function of VGR2966 gene, herein designated VGR GENE, is inhibition of expression of host target genes, as part of a novel viral mechanism of attacking a host. Accordingly, utilities of VGR2966 gene include diagnosis, prevention and treatment of viral infection by Canine Adenovirus Type 1. Specific functions, and accordingly utilities, of VGR2966 gene correlate with, and may be deduced from, the identity of the host target genes, which are inhibited by VGAM RNAs comprised in the 'operon-like' cluster of VGR2966 gene: VGAM1061 host target protein and VGAM1062 host target protein, herein schematically represented by VGAM1 HOST TARGET PROTEIN through VGAM3 HOST TARGET PROTEIN. The function of these host target genes is elaborated hereinabove with reference to VGAM1061 and VGAM1062. FIG. 9 further provides a conceptual description of novel bioinformatically detected regulatory viral gene, referred to here as Viral Genomic Record 2967(VGR2967) viral gene, which encodes an 'operon-like' cluster of novel viral micro RNA-like genes, each of which in turn modulates expression of at least one host target gene, the function and utility of which at least one host target gene is known in the art.

VGR2967 gene, herein designated VGR GENE, is a novel bioinformatically detected regulatory, non protein coding, RNA viral gene. The method by which VGR2967 gene was detected is described hereinabove with reference to FIGS. 1-9.

VGR2967 gene encodes VGR2967 precursor RNA, herein designated VGR PRECURSOR RNA, an RNA molecule, typically several hundred nucleotides long.

VGR2967 precursor RNA folds spatially, forming VGR2967 folded precursor RNA, herein designated VGR FOLDED PRECURSOR RNA. It is appreciated that VGR2967 folded precursor RNA comprises a plurality of what is known in the art as 'hairpin' structures. These 'hairpin' structures are due to the fact that the nucleotide sequence of VGR2967 precursor RNA comprises a plurality of segments, the first half of each such segment having a nucleotide sequence which is at least a partial inversed-reversed sequence of the second half thereof, as is well known in the art.

VGR2967 folded precursor RNA is naturally processed by cellular enzymatic activity into at least 4 separate VGAM precursor RNAs, VGAM1063 precursor RNA, VGAM1064 precursor RNA, VGAM1065 precursor RNA and VGAM1066 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1063 RNA, VGAM1064 RNA, VGAM1065 RNA and VGAM1066 RNA, herein schematically represented by VGAM1 RNA through VGAM3 RNA, each of which VGAM RNAs corresponding to VGAM RNA of FIG. 1.

VGAM1063 RNA, herein schematically represented by VGAM1 RNA through VGAM3 RNA, binds complementarily to a host target binding site located in an untranslated region of VGAM1063 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1063 host target RNA into VGAM1063 host target protein, herein schematically represented by VGAM1 HOST TARGET PROTEIN through VGAM3 HOST TARGET PROTEIN, all of FIG. 1.

VGAM1064 RNA, herein schematically represented by VGAM1 RNA through VGAM3 RNA, binds complementarily to a host target binding site located in an untranslated region of VGAM1064 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1064 host target RNA into VGAM1064 host target protein, herein schematically represented by VGAM1 HOST TARGET PROTEIN through VGAM3 HOST TARGET PROTEIN, all of FIG. 1.

VGAM1065 RNA, herein schematically represented by VGAM1 RNA through VGAM3 RNA, binds complementarily to a host target binding site located in an untranslated region of VGAM1065 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1065 host target RNA into VGAM1065 host target protein, herein schematically represented by VGAM1 HOST TARGET PROTEIN through VGAM3 HOST TARGET PROTEIN, all of FIG. 1.

VGAM1066 RNA, herein schematically represented by VGAM1 RNA through VGAM3 RNA, binds complementarily to a host target binding site located in an untranslated region of VGAM1066 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1066 host target RNA into VGAM1066 host target protein, herein schematically represented by VGAM1 HOST TARGET PROTEIN through VGAM3 HOST TARGET PROTEIN, all of FIG. 1.

It is appreciated that a function of VGR2967 gene, herein designated VGR GENE, is inhibition of expression of host target genes, as part of a novel viral mechanism of attacking a host. Accordingly, utilities of VGR2967 gene include diagnosis, prevention and treatment of viral infection by Tulip Virus X. Specific functions, and accordingly utilities, of VGR2967 gene correlate with, and may be deduced from, the identity of the host target genes, which are inhibited by VGAM RNAs comprised in the 'operon-like' cluster of VGR2967 gene: VGAM1063 host target protein, VGAM1064 host target protein, VGAM1065 host target protein and VGAM1066 host target protein, herein schematically represented by VGAM1 HOST TARGET PROTEIN through VGAM3 HOST TARGET PROTEIN. The function of these host target genes is elaborated hereinabove with reference to VGAM1063, VGAM1064, VGAM1065 and VGAM1066.

FIG. 9 further provides a conceptual description of novel bioinformatically detected regulatory viral gene, referred to here as Viral Genomic Record 2968(VGR2968) viral gene, which encodes an 'operon-like' cluster of novel viral micro RNA-like genes, each of which in turn modulates expression of at least one host target gene, the function and utility of which at least one host target gene is known in the art.

VGR2968 gene, herein designated VGR GENE, is a novel bioinformatically detected regulatory, non protein coding, RNA viral gene. The method by which VGR2968 gene was detected is described hereinabove with reference to FIGS. 1-9.

VGR2968 gene encodes VGR2968 precursor RNA, herein designated VGR PRECURSOR RNA, an RNA molecule, typically several hundred nucleotides long.

VGR2968 precursor RNA folds spatially, forming VGR2968 folded precursor RNA, herein designated VGR FOLDED PRECURSOR RNA. It is appreciated that VGR2968 folded precursor RNA comprises a plurality of what is known in the art as 'hairpin' structures. These 'hairpin' structures are due to the fact that the nucleotide sequence of VGR2968 precursor RNA comprises a plurality of segments, the first half of each such segment having a nucleotide sequence which is at least a partial inversed-reversed sequence of the second half thereof, as is well known in the art.

VGR2968 folded precursor RNA is naturally processed by cellular enzymatic activity into at least 8 separate VGAM precursor RNAs, VGAM1067 precursor RNA, VGAM1068 precursor RNA, VGAM1069 precursor RNA, VGAM1070 precursor RNA, VGAM1071 precursor RNA, VGAM1072 precursor RNA, VGAM1073 precursor RNA and VGAM1074 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1067 RNA, VGAM1068 RNA, VGAM1069 RNA, VGAM1070 RNA, VGAM1071 RNA, VGAM1072 RNA, VGAM1073 RNA and VGAM1074 RNA, herein schematically represented by VGAM1 RNA through VGAM3 RNA, each of which VGAM RNAs corresponding to VGAM RNA of FIG. 1.

VGAM1067 RNA, herein schematically represented by VGAM1 RNA through VGAM3 RNA, binds complementarily to a host target binding site located in an untranslated region of VGAM1067 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1067 host target RNA into VGAM1067 host target protein, herein schematically represented by VGAM1 HOST TARGET PROTEIN through VGAM3 HOST TARGET PROTEIN, all of FIG. 1.

VGAM1068 RNA, herein schematically represented by VGAM1 RNA through VGAM3 RNA, binds complementarily to a host target binding site located in an untranslated region of VGAM1068 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1068 host target RNA into VGAM1068 host target protein, herein schematically represented by VGAM1 HOST TARGET PROTEIN through VGAM3 HOST TARGET PROTEIN, all of FIG. 1.

VGAM1069 RNA, herein schematically represented by VGAM1 RNA through VGAM3 RNA, binds complementarily to a host target binding site located in an untranslated region of VGAM1069 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1069 host target RNA into VGAM1069 host target protein, herein schematically represented by VGAM1 HOST TARGET PROTEIN through VGAM3 HOST TARGET PROTEIN, all of FIG. 1.

VGAM1070 RNA, herein schematically represented by VGAM1 RNA through VGAM3 RNA, binds complementarily to a host target binding site located in an untranslated region of VGAM1070 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1070 host target RNA into VGAM1070 host target protein, herein schematically represented by VGAM1 HOST TARGET PROTEIN through VGAM3 HOST TARGET PROTEIN, all of FIG. 1.

VGAM1071 RNA, herein schematically represented by VGAM1 RNA through VGAM3 RNA, binds complementarily to a host target binding site located in an untranslated region of VGAM1071 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1071 host target RNA into VGAM1071 host target protein, herein schematically represented by VGAM1 HOST TARGET PROTEIN through VGAM3 HOST TARGET PROTEIN, all of FIG. 1.

VGAM1072 RNA, herein schematically represented by VGAM1 RNA through VGAM3 RNA, binds complementarily to a host target binding site located in an untranslated region of VGAM1072 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1072 host target RNA into VGAM1072 host target protein, herein schematically represented by VGAM1 HOST TARGET PROTEIN through VGAM3 HOST TARGET PROTEIN, all of FIG. 1.

VGAM1073 RNA, herein schematically represented by VGAM1 RNA through VGAM3 RNA, binds complementarily to a host target binding site located in an untranslated region of VGAM1073 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1073 host target RNA into VGAM1073 host target protein, herein schematically represented by VGAM1 HOST TARGET PROTEIN through VGAM3 HOST TARGET PROTEIN, all of FIG. 1.

VGAM1074 RNA, herein schematically represented by VGAM1 RNA through VGAM3 RNA, binds complementarily to a host target binding site located in an untranslated region of VGAM1074 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1074 host target RNA into VGAM1074 host target protein, herein schematically represented by VGAM1 HOST TARGET PROTEIN through VGAM3 HOST TARGET PROTEIN, all of FIG. 1.

It is appreciated that a function of VGR2968 gene, herein designated VGR GENE, is inhibition of expression of host target genes, as part of a novel viral mechanism of attacking a host. Accordingly, utilities of VGR2968 gene include diagnosis, prevention and treatment of viral infection by Porcine Epidemic Diarrhea Virus. Specific functions, and accordingly utilities, of VGR2968 gene correlate with, and may be deduced from, the identity of the host target genes, which are inhibited by VGAM RNAs comprised in the 'operon-like' cluster of VGR2968 gene: VGAM1067 host target protein, VGAM1068 host target protein, VGAM1069 host target protein, VGAM1070 host target protein, VGAM1071 host target protein, VGAM1072 host target protein, VGAM1073 host target protein and VGAM1074 host target protein, herein schematically represented by VGAM1 HOST TARGET PROTEIN through VGAM3 HOST TARGET PROTEIN. The function of these host target genes is elaborated hereinabove with reference to VGAM1067, VGAM1068, VGAM1069, VGAM1070, VGAM1071, VGAM1072, VGAM1073 and VGAM1074. FIG. 9 further provides a conceptual description of novel bioinformatically detected regulatory viral gene, referred to here as Viral Genomic Record 2969 (VGR2969) viral gene, which encodes an 'operon-like' cluster of novel viral micro RNA-like genes, each of which in turn modulates expression of at least one host target gene, the function and utility of which at least one host target gene is known in the art.

VGR2969 gene, herein designated VGR GENE, is a novel bioinformatically detected regulatory, non protein coding, RNA viral gene. The method by which VGR2969 gene was detected is described hereinabove with reference to FIGS. 1-9.

VGR2969 gene encodes VGR2969 precursor RNA, herein designated VGR PRECURSOR RNA, an RNA molecule, typically several hundred nucleotides long.

VGR2969 precursor RNA folds spatially, forming VGR2969 folded precursor RNA, herein designated VGR FOLDED PRECURSOR RNA. It is appreciated that VGR2969 folded precursor RNA comprises a plurality of what is known in the art as 'hairpin' structures. These 'hairpin' structures are due to the fact that the nucleotide sequence of VGR2969 precursor RNA comprises a plurality of segments, the first half of each such segment having a nucleotide sequence which is at least a partial inversed-reversed sequence of the second half thereof, as is well known in the art.

VGR2969 folded precursor RNA is naturally processed by cellular enzymatic activity into at least 8 separate VGAM precursor RNAs, VGAM1075 precursor RNA, VGAM1076 precursor RNA, VGAM1077 precursor RNA, VGAM1078 precursor RNA, VGAM1079 precursor RNA, VGAM1080 precursor RNA, VGAM1081 precursor RNA and VGAM1082 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1075 RNA, VGAM1076 RNA, VGAM1077 RNA, VGAM1078 RNA, VGAM1079 RNA, VGAM1080 RNA, VGAM1081 RNA and VGAM1082 RNA, herein schematically represented by VGAM1 RNA through VGAM3 RNA, each of which VGAM RNAs corresponding to VGAM RNA of FIG. 1.

VGAM1075 RNA, herein schematically represented by VGAM1 RNA through VGAM3 RNA, binds complementarily to a host target binding site located in an untranslated region of VGAM1075 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1075 host target RNA into VGAM1075 host target protein, herein schematically represented by VGAM1 HOST TARGET PROTEIN through VGAM3 HOST TARGET PROTEIN, all of FIG. 1.

VGAM1076 RNA, herein schematically represented by VGAM1 RNA through VGAM3 RNA, binds complementarily to a host target binding site located in an untranslated region of VGAM1076 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1076 host target RNA into VGAM1076 host target protein, herein schematically represented by VGAM1 HOST TARGET PROTEIN through VGAM3 HOST TARGET PROTEIN, all of FIG. 1.

VGAM1077 RNA, herein schematically represented by VGAM1 RNA through VGAM3 RNA, binds complementarily to a host target binding site located in an untranslated region of VGAM1077 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1077 host target RNA into VGAM1077 host target protein, herein schematically represented by VGAM1 HOST TARGET PROTEIN through VGAM3 HOST TARGET PROTEIN, all of FIG. 1.

VGAM1078 RNA, herein schematically represented by VGAM1 RNA through VGAM3 RNA, binds complementarily to a host target binding site located in an untranslated region of VGAM1078 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1078 host target RNA into VGAM1078 host target protein, herein schematically represented by VGAM1 HOST TARGET PROTEIN through VGAM3 HOST TARGET PROTEIN, all of FIG. 1.

VGAM1079 RNA, herein schematically represented by VGAM1 RNA through VGAM3 RNA, binds complementarily to a host target binding site located in an untranslated region of VGAM1079 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1079 host target RNA into VGAM1079 host target protein, herein schematically represented by VGAM1 HOST TARGET PROTEIN through VGAM3 HOST TARGET PROTEIN, all of FIG. 1.

VGAM1080 RNA, herein schematically represented by VGAM1 RNA through VGAM3 RNA, binds complementarily to a host target binding site located in an untranslated region of VGAM1080 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1080 host target RNA into VGAM1080 host target protein, herein schematically represented by VGAM1 HOST TARGET PROTEIN through VGAM3 HOST TARGET PROTEIN, all of FIG. 1.

VGAM1081 RNA, herein schematically represented by VGAM1 RNA through VGAM3 RNA, binds complementarily to a host target binding site located in an untranslated region of VGAM1081 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1081 host target RNA into VGAM1081 host target protein, herein schematically represented by VGAM1 HOST TARGET PROTEIN through VGAM3 HOST TARGET PROTEIN, all of FIG. 1.

VGAM1082 RNA, herein schematically represented by VGAM1 RNA through VGAM3 RNA, binds complementarily to a host target binding site located in an untranslated region of VGAM1082 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1082 host target RNA into VGAM1082 host target protein, herein schematically represented by VGAM1 HOST TARGET PROTEIN through VGAM3 HOST TARGET PROTEIN, all of FIG. 1.

It is appreciated that a function of VGR2969 gene, herein designated VGR GENE, is inhibition of expression of host target genes, as part of a novel viral mechanism of attacking a host. Accordingly, utilities of VGR2969 gene include diagnosis, prevention and treatment of viral infection by Porcine Epidemic Diarrhea Virus. Specific functions, and accordingly utilities, of VGR2969 gene correlate with, and may be deduced from, the identity of the host target genes, which are inhibited by VGAM RNAs comprised in the 'operon-like' cluster of VGR2969 gene: VGAM1075 host target protein, VGAM1076 host target protein, VGAM1077 host target protein, VGAM1078 host target protein, VGAM1079 host target protein, VGAM1080 host target protein, VGAM1081 host target protein and VGAM1082 host target protein, herein schematically represented by VGAM1 HOST TARGET PROTEIN through VGAM3 HOST TARGET PROTEIN. The function of these host target genes is elaborated hereinabove with reference to VGAM1075, VGAM1076, VGAM1077, VGAM1078, VGAM1079, VGAM1080, VGAM1081 and VGAM1082. FIG. 9 further provides a conceptual description of novel bioinformatically detected regulatory viral gene, referred to here as Viral Genomic Record 2970(VGR2970) viral gene, which encodes an 'operon-like' cluster of novel viral micro RNA-like genes, each of which in turn modulates expression of at least one host target gene, the function and utility of which at least one host target gene is known in the art.

VGR2970 gene, herein designated VGR GENE, is a novel bioinformatically detected regulatory, non protein coding, RNA viral gene. The method by which VGR2970 gene was detected is described hereinabove with reference to FIGS. 1-9.

VGR2970 gene encodes VGR2970 precursor RNA, herein designated VGR PRECURSOR RNA, an RNA molecule, typically several hundred nucleotides long.

VGR2970 precursor RNA folds spatially, forming VGR2970 folded precursor RNA, herein designated VGR FOLDED PRECURSOR RNA. It is appreciated that VGR2970 folded precursor RNA comprises a plurality of what is known in the art as 'hairpin' structures. These 'hairpin' structures are due to the fact that the nucleotide sequence of VGR2970 precursor RNA comprises a plurality of segments, the first half of each such segment having a nucleotide sequence which is at least a partial inversed-reversed sequence of the second half thereof, as is well known in the art.

VGR2970 folded precursor RNA is naturally processed by cellular enzymatic activity into at least 8 separate VGAM precursor RNAs, VGAM1083 precursor RNA, VGAM1084 precursor RNA, VGAM1085 precursor RNA, VGAM1086 precursor RNA, VGAM1087 precursor RNA, VGAM1088 precursor RNA, VGAM1089 precursor RNA and VGAM1090 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1083 RNA, VGAM1084 RNA, VGAM1085 RNA, VGAM1086 RNA, VGAM1087 RNA, VGAM1088 RNA, VGAM1089 RNA and VGAM1090 RNA, herein schematically represented by VGAM1 RNA through VGAM3 RNA, each of which VGAM RNAs corresponding to VGAM RNA of FIG. 1.

VGAM1083 RNA, herein schematically represented by VGAM1 RNA through VGAM3 RNA, binds complementarily to a host target binding site located in an untranslated region of VGAM1083 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1083 host target RNA into VGAM1083 host target protein, herein schematically represented by VGAM1 HOST TARGET PROTEIN through VGAM3 HOST TARGET PROTEIN, all of FIG. 1.

VGAM1084 RNA, herein schematically represented by VGAM1 RNA through VGAM3 RNA, binds complementarily to a host target binding site located in an untranslated region of VGAM1084 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1084 host target RNA into VGAM1084 host target protein, herein schematically represented by VGAM1 HOST TARGET PROTEIN through VGAM3 HOST TARGET PROTEIN, all of FIG. 1.

VGAM1085 RNA, herein schematically represented by VGAM1 RNA through VGAM3 RNA, binds complementarily to a host target binding site located in an untranslated region of VGAM1085 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1085 host target RNA into VGAM1085 host target protein, herein schematically represented by VGAM1 HOST TARGET PROTEIN through VGAM3 HOST TARGET PROTEIN, all of FIG. 1.

VGAM1086 RNA, herein schematically represented by VGAM1 RNA through VGAM3 RNA, binds complementarily to a host target binding site located in an untranslated region of VGAM1086 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1086 host target RNA into VGAM1086 host target protein, herein schematically represented by VGAM1 HOST TARGET PROTEIN through VGAM3 HOST TARGET PROTEIN, all of FIG. 1.

VGAM1087 RNA, herein schematically represented by VGAM1 RNA through VGAM3 RNA, binds complementarily to a host target binding site located in an untranslated region of VGAM1087 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1087 host target RNA into VGAM1087 host target protein, herein schematically represented by VGAM1 HOST TARGET PROTEIN through VGAM3 HOST TARGET PROTEIN, all of FIG. 1.

VGAM1088 RNA, herein schematically represented by VGAM1 RNA through VGAM3 RNA, binds complementarily to a host target binding site located in an untranslated region of VGAM1088 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1088 host target RNA into VGAM1088 host target protein, herein schematically represented by VGAM1 HOST TARGET PROTEIN through VGAM3 HOST TARGET PROTEIN, all of FIG. 1.

VGAM1089 RNA, herein schematically represented by VGAM1 RNA through VGAM3 RNA, binds complementarily to a host target binding site located in an untranslated region of VGAM1089 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1089 host target RNA into VGAM1089 host target protein, herein schematically represented by VGAM1 HOST TARGET PROTEIN through VGAM3 HOST TARGET PROTEIN, all of FIG. 1.

VGAM1090 RNA, herein schematically represented by VGAM1 RNA through VGAM3 RNA, binds complementarily to a host target binding site located in an untranslated region of VGAM1090 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1090 host target RNA into VGAM1090 host target protein, herein schematically represented by VGAM1 HOST TARGET PROTEIN through VGAM3 HOST TARGET PROTEIN, all of FIG. 1.

It is appreciated that a function of VGR2970 gene, herein designated VGR GENE, is inhibition of expression of host target genes, as part of a novel viral mechanism of attacking a host. Accordingly, utilities of VGR2970 gene include diagnosis, prevention and treatment of viral infection by Porcine Epidemic Diarrhea Virus. Specific functions, and accordingly utilities, of VGR2970 gene correlate with, and may be deduced from, the identity of the host target genes, which are inhibited by VGAM RNAs comprised in the 'operon-like' cluster of VGR2970 gene: VGAM1083 host target protein, VGAM1084 host target protein, VGAM1085 host target protein, VGAM1086 host target protein, VGAM1087 host target protein, VGAM1088 host target protein, VGAM1089 host target protein and VGAM1090 host target protein, herein schematically represented by VGAM1 HOST TARGET PROTEIN through VGAM3 HOST TARGET PROTEIN. The function of these host target genes is elaborated hereinabove with reference to VGAM1083, VGAM1084, VGAM1085, VGAM1086, VGAM1087, VGAM1088, VGAM1089 and VGAM1090. FIG. 9 further provides a conceptual description of novel bioinformatically detected regulatory viral gene, referred to here as Viral Genomic Record 2971(VGR2971) viral gene, which encodes an 'operon-like' cluster of novel viral micro RNA-like genes, each of which in turn modulates expression of at least one host target gene, the function and utility of which at least one host target gene is known in the art.

VGR2971 gene, herein designated VGR GENE, is a novel bioinformatically detected regulatory, non protein coding, RNA viral gene. The method by which VGR2971 gene was detected is described hereinabove with reference to FIGS. 1-9.

VGR2971 gene encodes VGR2971 precursor RNA, herein designated VGR PRECURSOR RNA, an RNA molecule, typically several hundred nucleotides long.

VGR2971 precursor RNA folds spatially, forming VGR2971 folded precursor RNA, herein designated VGR FOLDED PRECURSOR RNA. It is appreciated that VGR2971 folded precursor RNA comprises a plurality of what is known in the art as 'hairpin' structures. These 'hairpin' structures are due to the fact that the nucleotide sequence of VGR2971 precursor RNA comprises a plurality of segments, the first half of each such segment having a nucleotide sequence which is at least a partial inversed-reversed sequence of the second half thereof, as is well known in the art.

VGR2971 folded precursor RNA is naturally processed by cellular enzymatic activity into at least 5 separate VGAM precursor RNAs, VGAM1091 precursor RNA, VGAM1092 precursor RNA, VGAM1093 precursor RNA, VGAM1094 precursor RNA and VGAM1095 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1091 RNA, VGAM1092 RNA, VGAM1093 RNA, VGAM1094 RNA and VGAM1095 RNA, herein schematically represented by VGAM1 RNA through VGAM3 RNA, each of which VGAM RNAs corresponding to VGAM RNA of FIG. 1.

VGAM1091 RNA, herein schematically represented by VGAM1 RNA through VGAM3 RNA, binds complementarily to a host target binding site located in an untranslated region of VGAM1091 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1091 host target RNA into VGAM1091 host target protein, herein schematically represented by VGAM1 HOST TARGET PROTEIN through VGAM3 HOST TARGET PROTEIN, all of FIG. 1.

VGAM1092 RNA, herein schematically represented by VGAM1 RNA through VGAM3 RNA, binds complementarily to a host target binding site located in an untranslated region of VGAM1092 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1092 host target RNA into VGAM1092 host target protein, herein schematically represented by VGAM1 HOST TARGET PROTEIN through VGAM3 HOST TARGET PROTEIN, all of FIG. 1.

VGAM1093 RNA, herein schematically represented by VGAM1 RNA through VGAM3 RNA, binds complementarily to a host target binding site located in an untranslated region of VGAM1093 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1093 host target RNA into VGAM1093 host target protein, herein schematically represented by VGAM1 HOST TARGET PROTEIN through VGAM3 HOST TARGET PROTEIN, all of FIG. 1.

VGAM1094 RNA, herein schematically represented by VGAM1 RNA through VGAM3 RNA, binds complementarily to a host target binding site located in an untranslated region of VGAM1094 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1094 host target RNA into VGAM1094 host target protein, herein schematically represented by VGAM1 HOST TARGET PROTEIN through VGAM3 HOST TARGET PROTEIN, all of FIG. 1.

VGAM1095 RNA, herein schematically represented by VGAM1 RNA through VGAM3 RNA, binds complementarily to a host target binding site located in an untranslated region of VGAM1095 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1095 host target RNA into VGAM1095 host target protein, herein schematically represented by VGAM1 HOST TARGET PROTEIN through VGAM3 HOST TARGET PROTEIN, all of FIG. 1.

It is appreciated that a function of VGR2971 gene, herein designated VGR GENE, is inhibition of expression of host target genes, as part of a novel viral mechanism of attacking a host. Accordingly, utilities of VGR2971 gene include diagnosis, prevention and treatment of viral infection by Poinsettia Mosaic Virus. Specific functions, and accordingly utilities, of VGR2971 gene correlate with, and may be deduced from, the identity of the host target genes, which are inhibited by VGAM RNAs comprised in the 'operon-like' cluster of VGR2971 gene: VGAM1091 host target protein, VGAM1092 host target protein, VGAM1093 host target protein, VGAM1094 host target protein and VGAM1095 host target protein, herein schematically represented by VGAM1 HOST TARGET PROTEIN through VGAM3 HOST TARGET PROTEIN. The function of these host target genes is elaborated hereinabove with reference to VGAM1091, VGAM1092, VGAM1093, VGAM1094 and VGAM1095. FIG. 9 further provides a conceptual description of novel bioinformatically detected regulatory viral gene, referred to here as Viral Genomic Record 2972(VGR2972) viral gene, which encodes an 'operon-like' cluster of novel viral micro RNA-like genes, each of which in turn modulates expression of at least one host target gene, the function and utility of which at least one host target gene is known in the art.

VGR2972 gene, herein designated VGR GENE, is a novel bioinformatically detected regulatory, non protein coding, RNA viral gene. The method by which VGR2972 gene was detected is described hereinabove with reference to FIGS. 1-9.

VGR2972 gene encodes VGR2972 precursor RNA, herein designated VGR PRECURSOR RNA, an RNA molecule, typically several hundred nucleotides long.

VGR2972 precursor RNA folds spatially, forming VGR2972 folded precursor RNA, herein designated VGR FOLDED PRECURSOR RNA. It is appreciated that VGR2972 folded precursor RNA comprises a plurality of what is known in the art as 'hairpin' structures. These 'hairpin' structures are due to the fact that the nucleotide sequence of VGR2972 precursor RNA comprises a plurality of segments, the first half of each such segment having a nucleotide sequence which is at least a partial inversed-reversed sequence of the second half thereof, as is well known in the art.

VGR2972 folded precursor RNA is naturally processed by cellular enzymatic activity into at least 8 separate VGAM precursor RNAs, VGAM1096 precursor RNA, VGAM1097 precursor RNA, VGAM1098 precursor RNA, VGAM1099 precursor RNA, VGAM1100 precursor RNA, VGAM1101 precursor RNA, VGAM1102 precursor RNA and VGAM1103 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1096 RNA, VGAM1097 RNA, VGAM1098 RNA, VGAM1099 RNA, VGAM1100 RNA, VGAM1101 RNA, VGAM1102 RNA and VGAM1103 RNA, herein schematically represented by VGAM1 RNA through VGAM3 RNA, each of which VGAM RNAs corresponding to VGAM RNA of FIG. 1.

VGAM1096 RNA, herein schematically represented by VGAM1 RNA through VGAM3 RNA, binds complementarily to a host target binding site located in an untranslated region of VGAM1096 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1096 host target RNA into VGAM1096 host target protein, herein schematically represented by VGAM1 HOST TARGET PROTEIN through VGAM3 HOST TARGET PROTEIN, all of FIG. 1.

VGAM1097 RNA, herein schematically represented by VGAM1 RNA through VGAM3 RNA, binds complementarily to a host target binding site located in an untranslated region of VGAM1097 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1097 host target RNA into VGAM1097 host target protein, herein schematically represented by VGAM1 HOST TARGET PROTEIN through VGAM3 HOST TARGET PROTEIN, all of FIG. 1.

VGAM1098 RNA, herein schematically represented by VGAM1 RNA through VGAM3 RNA, binds complementarily to a host target binding site located in an untranslated region of VGAM1098 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1098 host target RNA into VGAM1098 host target protein, herein schematically represented by VGAM1 HOST TARGET PROTEIN through VGAM3 HOST TARGET PROTEIN, all of FIG. 1.

VGAM1099 RNA, herein schematically represented by VGAM1 RNA through VGAM3 RNA, binds complementarily to a host target binding site located in an untranslated region of VGAM1099 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1099 host target RNA into VGAM1099 host target protein, herein schematically represented by VGAM1 HOST TARGET PROTEIN through VGAM3 HOST TARGET PROTEIN, all of FIG. 1.

VGAM1100 RNA, herein schematically represented by VGAM1 RNA through VGAM3 RNA, binds complementarily to a host target binding site located in an untranslated region of VGAM1100 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1100 host target RNA into VGAM1100 host target protein, herein schematically represented by VGAM1 HOST TARGET PROTEIN through VGAM3 HOST TARGET PROTEIN, all of FIG. 1.

VGAM1101 RNA, herein schematically represented by VGAM1 RNA through VGAM3 RNA, binds complementarily to a host target binding site located in an untranslated region of VGAM1101 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1101 host target RNA into VGAM1101 host target protein, herein schematically represented by VGAM1 HOST TARGET PROTEIN through VGAM3 HOST TARGET PROTEIN, all of FIG. 1.

VGAM1102 RNA, herein schematically represented by VGAM1 RNA through VGAM3 RNA, binds complementarily to a host target binding site located in an untranslated region of VGAM1102 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1102 host target RNA into VGAM1102 host target protein, herein schematically represented by VGAM1 HOST TARGET PROTEIN through VGAM3 HOST TARGET PROTEIN, all of FIG. 1.

VGAM1103 RNA, herein schematically represented by VGAM1 RNA through VGAM3 RNA, binds complementarily to a host target binding site located in an untranslated region of VGAM1103 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1103 host target RNA into VGAM1103 host target protein, herein schematically represented by VGAM1 HOST TARGET PROTEIN through VGAM3 HOST TARGET PROTEIN, all of FIG. 1.

It is appreciated that a function of VGR2972 gene, herein designated VGR GENE, is inhibition of expression of host target genes, as part of a novel viral mechanism of attacking a host. Accordingly, utilities of VGR2972 gene include diagnosis, prevention and treatment of viral infection by Strawberry Mottle Virus. Specific functions, and accordingly utilities, of VGR2972 gene correlate with, and may be deduced from, the identity of the host target genes, which are inhibited by VGAM RNAs comprised in the 'operon-like' cluster of VGR2972 gene: VGAM1096 host target protein, VGAM1097 host target protein, VGAM1098 host target protein, VGAM1099 host target protein, VGAM1100 host target protein, VGAM1101 host target protein, VGAM1102 host target protein and VGAM1103 host target protein, herein schematically represented by VGAM1 HOST TARGET PROTEIN through VGAM3 HOST TARGET PROTEIN. The function of these host target genes is elaborated hereinabove with reference to VGAM1096, VGAM1097, VGAM1098, VGAM1099, VGAM1100, VGAM1101, VGAM1102 and VGAM1103. FIG. 9 further provides a conceptual description of novel bioinformatically detected regulatory viral gene, referred to here as Viral Genomic Record 2973(VGR2973) viral gene, which encodes an 'operon-like' cluster of novel viral micro RNA-like genes, each of which in turn modulates expression of at least one host target gene, the function and utility of which at least one host target gene is known in the art.

VGR2973 gene, herein designated VGR GENE, is a novel bioinformatically detected regulatory, non protein coding, RNA viral gene. The method by which VGR2973 gene was detected is described hereinabove with reference to FIGS. 1-9.

VGR2973 gene encodes VGR2973 precursor RNA, herein designated VGR PRECURSOR RNA, an RNA molecule, typically several hundred nucleotides long.

VGR2973 precursor RNA folds spatially, forming VGR2973 folded precursor RNA, herein designated VGR FOLDED PRECURSOR RNA. It is appreciated that VGR2973 folded precursor RNA comprises a plurality of what is known in the art as 'hairpin' structures. These 'hairpin' structures are due to the fact that the nucleotide sequence of VGR2973 precursor RNA comprises a plurality of segments, the first half of each such segment having a nucleotide sequence which is at least a partial inversed-reversed sequence of the second half thereof, as is well known in the art.

VGR2973 folded precursor RNA is naturally processed by cellular enzymatic activity into at least 3 separate VGAM precursor RNAs, VGAM1104 precursor RNA, VGAM1105 precursor RNA and VGAM1106 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1104 RNA, VGAM1105 RNA and VGAM1106 RNA, herein schematically represented by VGAM1 RNA through VGAM3 RNA, each of which VGAM RNAs corresponding to VGAM RNA of FIG. 1.

VGAM1104 RNA, herein schematically represented by VGAM1 RNA through VGAM3 RNA, binds complementarily to a host target binding site located in an untranslated region of VGAM1104 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1104 host target RNA into VGAM1104 host target protein, herein schematically represented by VGAM1 HOST TARGET PROTEIN through VGAM3 HOST TARGET PROTEIN, all of FIG. 1.

VGAM1105 RNA, herein schematically represented by VGAM1 RNA through VGAM3 RNA, binds complementarily to a host target binding site located in an untranslated region of VGAM1105 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1105 host target RNA into VGAM1105 host target protein, herein schematically represented by VGAM1 HOST TARGET PROTEIN through VGAM3 HOST TARGET PROTEIN, all of FIG. 1.

VGAM1106 RNA, herein schematically represented by VGAM1 RNA through VGAM3 RNA, binds complementarily to a host target binding site located in an untranslated region of VGAM1106 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1106 host target RNA into VGAM1106 host target protein, herein schematically represented by VGAM1 HOST TARGET PROTEIN through VGAM3 HOST TARGET PROTEIN, all of FIG. 1.

It is appreciated that a function of VGR2973 gene, herein designated VGR GENE, is inhibition of expression of host target genes, as part of a novel viral mechanism of attacking a host. Accordingly, utilities of VGR2973 gene include diagnosis, prevention and treatment of viral infection by Human Herpesvirus 2. Specific functions, and accordingly utilities, of VGR2973 gene correlate with, and may be deduced from, the identity of the host target genes, which are inhibited by VGAM RNAs comprised in the 'operon-like' cluster of VGR2973 gene: VGAM1104 host target protein, VGAM1105 host target protein and VGAM1106 host target protein, herein schematically represented by VGAM1 HOST TARGET PROTEIN through VGAM3 HOST TARGET PROTEIN. The function of these host target genes is elaborated hereinabove with reference to VGAM1104, VGAM1105 and VGAM1106. FIG. 9 further provides a conceptual description of novel bioinformatically detected regulatory viral gene, referred to here as Viral Genomic Record 2974(VGR2974) viral gene, which encodes an 'operon-like' cluster of novel viral micro RNA-like genes, each of which in turn modulates expression of at least one host target gene, the function and utility of which at least one host target gene is known in the art.

VGR2974 gene, herein designated VGR GENE, is a novel bioinformatically detected regulatory, non protein coding, RNA viral gene. The method by which VGR2974 gene was detected is described hereinabove with reference to FIGS. 1-9.

VGR2974 gene encodes VGR2974 precursor RNA, herein designated VGR PRECURSOR RNA, an RNA molecule, typically several hundred nucleotides long.

VGR2974 precursor RNA folds spatially, forming VGR2974 folded precursor RNA, herein designated VGR FOLDED PRECURSOR RNA. It is appreciated that VGR2974 folded precursor RNA comprises a plurality of what is known in the art as 'hairpin' structures. These 'hairpin' structures are due to the fact that the nucleotide sequence of VGR2974 precursor RNA comprises a plurality of segments, the first half of each such segment having a nucleotide sequence which is at least a partial inversed-reversed sequence of the second half thereof, as is well known in the art.

VGR2974 folded precursor RNA is naturally processed by cellular enzymatic activity into at least 2 separate VGAM precursor RNAs, VGAM1108 precursor RNA and VGAM1109 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1108 RNA and VGAM1109 RNA, herein schematically represented by VGAM1 RNA through VGAM3 RNA, each of which VGAM RNAs corresponding to VGAM RNA of FIG. 1.

VGAM1108 RNA, herein schematically represented by VGAM1 RNA through VGAM3 RNA, binds complementarily to a host target binding site located in an untranslated region of VGAM1108 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1108 host target RNA into VGAM1108 host target protein, herein schematically represented by VGAM1 HOST TARGET PROTEIN through VGAM3 HOST TARGET PROTEIN, all of FIG. 1.

VGAM1109 RNA, herein schematically represented by VGAM1 RNA through VGAM3 RNA, binds complementarily to a host target binding site located in an untranslated region of VGAM1109 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1109 host target RNA into VGAM1109 host target protein, herein schematically represented by VGAM1 HOST TARGET PROTEIN through VGAM3 HOST TARGET PROTEIN, all of FIG. 1.

It is appreciated that a function of VGR2974 gene, herein designated VGR GENE, is inhibition of expression of host target genes, as part of a novel viral mechanism of attacking a host. Accordingly, utilities of VGR2974 gene include diagnosis, prevention and treatment of viral infection by Chimpanzee Cytomegalovirus. Specific functions, and accordingly utilities, of VGR2974 gene correlate with, and may be deduced from, the identity of the host target genes, which are inhibited by VGAM RNAs comprised in the 'operon-like' cluster of VGR2974 gene: VGAM1108 host target protein and VGAM1109 host target protein, herein schematically represented by VGAM1 HOST TARGET PROTEIN through VGAM3 HOST TARGET PROTEIN. The function of these host target genes is elaborated hereinabove with reference to VGAM1108 and VGAM1109. FIG. 9 further provides a conceptual description of novel bioinformatically detected regulatory viral gene, referred to here as Viral Genomic Record 2975(VGR2975) viral gene, which encodes an 'operon-like' cluster of novel viral micro RNA-like genes, each of which in turn modulates expression of at least one host target gene, the function and utility of which at least one host target gene is known in the art.

VGR2975 gene, herein designated VGR GENE, is a novel bioinformatically detected regulatory, non protein coding, RNA viral gene. The method by which VGR2975 gene was detected is described hereinabove with reference to FIGS. 1-9.

VGR2975 gene encodes VGR2975 precursor RNA, herein designated VGR PRECURSOR RNA, an RNA molecule, typically several hundred nucleotides long.

VGR2975 precursor RNA folds spatially, forming VGR2975 folded precursor RNA, herein designated VGR FOLDED PRECURSOR RNA. It is appreciated that VGR2975 folded precursor RNA comprises a plurality of what is known in the art as 'hairpin' structures. These 'hairpin' structures are due to the fact that the nucleotide sequence of VGR2975 precursor RNA comprises a plurality of segments, the first half of each such segment having a nucleotide sequence which is at least a partial inversed-reversed sequence of the second half thereof, as is well known in the art.

VGR2975 folded precursor RNA is naturally processed by cellular enzymatic activity into at least 5 separate VGAM precursor RNAs, VGAM1111 precursor RNA, VGAM1112 precursor RNA, VGAM1113 precursor RNA, VGAM1114 precursor RNA and VGAM1115 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1111 RNA, VGAM1112 RNA, VGAM1113 RNA, VGAM1114 RNA and VGAM1115 RNA, herein schematically represented by VGAM1 RNA through VGAM3 RNA, each of which VGAM RNAs corresponding to VGAM RNA of FIG. 1.

VGAM1111 RNA, herein schematically represented by VGAM1 RNA through VGAM3 RNA, binds complementarily to a host target binding site located in an untranslated region of VGAM1111 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1111 host target RNA into VGAM1111 host target protein, herein schematically represented by VGAM1 HOST TARGET PROTEIN through VGAM3 HOST TARGET PROTEIN, all of FIG. 1.

VGAM1112 RNA, herein schematically represented by VGAM1 RNA through VGAM3 RNA, binds complementarily to a host target binding site located in an untranslated region of VGAM1112 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1112 host target RNA into VGAM1112 host target protein, herein schematically represented by VGAM1 HOST TARGET PROTEIN through VGAM3 HOST TARGET PROTEIN, all of FIG. 1.

VGAM1113 RNA, herein schematically represented by VGAM1 RNA through VGAM3 RNA, binds complementarily to a host target binding site located in an untranslated region of VGAM1113 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1113 host target RNA into VGAM1113 host target protein, herein schematically represented by VGAM1 HOST TARGET PROTEIN through VGAM3 HOST TARGET PROTEIN, all of FIG. 1.

VGAM1114 RNA, herein schematically represented by VGAM1 RNA through VGAM3 RNA, binds complementarily to a host target binding site located in an untranslated region of VGAM1114 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1114 host target RNA into VGAM1114 host target protein, herein schematically represented by VGAM1 HOST TARGET PROTEIN through VGAM3 HOST TARGET PROTEIN, all of FIG. 1.

VGAM1115 RNA, herein schematically represented by VGAM1 RNA through VGAM3 RNA, binds complementarily to a host target binding site located in an untranslated region of VGAM1115 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1115 host target RNA into VGAM1115 host target protein, herein schematically represented by VGAM1 HOST TARGET PROTEIN through VGAM3 HOST TARGET PROTEIN, all of FIG. 1.

It is appreciated that a function of VGR2975 gene, herein designated VGR GENE, is inhibition of expression of host target genes, as part of a novel viral mechanism of attacking a host. Accordingly, utilities of VGR2975 gene include diagnosis, prevention and treatment of viral infection by Camelpox Virus. Specific functions, and accordingly utilities, of VGR2975 gene correlate with, and may be deduced from, the identity of the host target genes, which are inhibited by VGAM RNAs comprised in the 'operon-like' cluster of VGR2975 gene: VGAM1111 host target protein, VGAM1112 host target protein, VGAM1113 host target protein, VGAM1114 host target protein and VGAM1115 host target protein, herein schematically represented by VGAM1 HOST TARGET PROTEIN through VGAM3 HOST TARGET PROTEIN. The function of these host target genes is elaborated hereinabove with reference to VGAM1111, VGAM1112, VGAM1113, VGAM1114 and VGAM1115. FIG. 9 further provides a conceptual description of novel bioinformatically detected regulatory viral gene, referred to here as Viral Genomic Record 2976(VGR2976) viral gene, which encodes an 'operon-like' cluster of novel viral micro RNA-like genes, each of which in turn modulates expression of at least one host target gene, the function and utility of which at least one host target gene is known in the art.

VGR2976 gene, herein designated VGR GENE, is a novel bioinformatically detected regulatory, non protein coding, RNA viral gene. The method by which VGR2976 gene was detected is described hereinabove with reference to FIGS. 1-9.

VGR2976 gene encodes VGR2976 precursor RNA, herein designated VGR PRECURSOR RNA, an RNA molecule, typically several hundred nucleotides long.

VGR2976 precursor RNA folds spatially, forming VGR2976 folded precursor RNA, herein designated VGR FOLDED PRECURSOR RNA. It is appreciated that VGR2976 folded precursor RNA comprises a plurality of what is known in the art as 'hairpin' structures. These 'hairpin' structures are due to the fact that the nucleotide sequence of VGR2976 precursor RNA comprises a plurality of segments, the first half of each such segment having a nucleotide sequence which is at least a partial inversed-reversed sequence of the second half thereof, as is well known in the art.

VGR2976 folded precursor RNA is naturally processed by cellular enzymatic activity into at least 5 separate VGAM precursor RNAs, VGAM1116 precursor RNA, VGAM1117 precursor RNA, VGAM1118 precursor RNA, VGAM1119 precursor RNA and VGAM1120 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1116 RNA, VGAM1117 RNA, VGAM1118 RNA, VGAM1119 RNA and VGAM1120 RNA, herein schematically represented by VGAM1 RNA through VGAM3 RNA, each of which VGAM RNAs corresponding to VGAM RNA of FIG. 1.

VGAM1116 RNA, herein schematically represented by VGAM1 RNA through VGAM3 RNA, binds complementarily to a host target binding site located in an untranslated region of VGAM1116 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1116 host target RNA into VGAM1116 host target protein, herein schematically represented by VGAM1 HOST TARGET PROTEIN through VGAM3 HOST TARGET PROTEIN, all of FIG. 1.

VGAM1117 RNA, herein schematically represented by VGAM1 RNA through VGAM3 RNA, binds complementarily to a host target binding site located in an untranslated region of VGAM1117 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1117 host target RNA into VGAM1117 host target protein, herein schematically represented by VGAM1 HOST TARGET PROTEIN through VGAM3 HOST TARGET PROTEIN, all of FIG. 1.

VGAM1118 RNA, herein schematically represented by VGAM1 RNA through VGAM3 RNA, binds complementarily to a host target binding site located in an untranslated region of VGAM1118 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1118 host target RNA into VGAM1118 host target protein, herein schematically represented by VGAM1 HOST TARGET PROTEIN through VGAM3 HOST TARGET PROTEIN, all of FIG. 1.

VGAM1119 RNA, herein schematically represented by VGAM1 RNA through VGAM3 RNA, binds complementarily to a host target binding site located in an untranslated region of VGAM1119 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1119 host target RNA into VGAM1119 host target protein, herein schematically represented by VGAM1 HOST TARGET PROTEIN through VGAM3 HOST TARGET PROTEIN, all of FIG. 1.

VGAM1120 RNA, herein schematically represented by VGAM1 RNA through VGAM3 RNA, binds complementarily to a host target binding site located in an untranslated region of VGAM1120 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1120 host target RNA into VGAM1120 host target protein, herein schematically represented by VGAM1 HOST TARGET PROTEIN through VGAM3 HOST TARGET PROTEIN, all of FIG. 1.

It is appreciated that a function of VGR2976 gene, herein designated VGR GENE, is inhibition of expression of host target genes, as part of a novel viral mechanism of attacking a host. Accordingly, utilities of VGR2976 gene include diagnosis, prevention and treatment of viral infection by Monkeypox Virus. Specific functions, and accordingly utilities, of VGR2976 gene correlate with, and may be deduced from, the identity of the host target genes, which are inhibited by VGAM RNAs comprised in the 'operon-like' cluster of VGR2976 gene: VGAM1116 host target protein, VGAM1117 host target protein, VGAM1118 host target protein, VGAM1119 host target protein and VGAM1120 host target protein, herein schematically represented by VGAM1 HOST TARGET PROTEIN through VGAM3 HOST TARGET PROTEIN. The function of these host target genes is elaborated hereinabove with reference to VGAM1116, VGAM1117, VGAM1118, VGAM1119 and VGAM1120.

FIG. 9 further provides a conceptual description of novel bioinformatically detected regulatory viral gene, referred to here as Viral Genomic Record 2977(VGR2977) viral gene, which encodes an 'operon-like' cluster of novel viral micro RNA-like genes, each of which in turn modulates expression of at least one host target gene, the function and utility of which at least one host target gene is known in the art.

VGR2977 gene, herein designated VGR GENE, is a novel bioinformatically detected regulatory, non protein coding, RNA viral gene. The method by which VGR2977 gene was detected is described hereinabove with reference to FIGS. 1-9.

VGR2977 gene encodes VGR2977 precursor RNA, herein designated VGR PRECURSOR RNA, an RNA molecule, typically several hundred nucleotides long.

VGR2977 precursor RNA folds spatially, forming VGR2977 folded precursor RNA, herein designated VGR FOLDED PRECURSOR RNA. It is appreciated that VGR2977 folded precursor RNA comprises a plurality of what is known in the art as 'hairpin' structures. These 'hairpin' structures are due to the fact that the nucleotide sequence of VGR2977 precursor RNA comprises a plurality of segments, the first half of each such segment having a nucleotide sequence which is at least a partial inversed-reversed sequence of the second half thereof, as is well known in the art.

VGR2977 folded precursor RNA is naturally processed by cellular enzymatic activity into at least 5 separate VGAM precursor RNAs, VGAM1121 precursor RNA, VGAM1122 precursor RNA, VGAM1123 precursor RNA, VGAM1124 precursor RNA and VGAM1125 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1121 RNA, VGAM1122 RNA, VGAM1123 RNA, VGAM1124 RNA and VGAM1125 RNA, herein schematically represented by VGAM1 RNA through VGAM3 RNA, each of which VGAM RNAs corresponding to VGAM RNA of FIG. 1.

VGAM1121 RNA, herein schematically represented by VGAM1 RNA through VGAM3 RNA, binds complementarily to a host target binding site located in an untranslated region of VGAM1121 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1121 host target RNA into VGAM1121 host target protein, herein schematically represented by VGAM1 HOST TARGET PROTEIN through VGAM3 HOST TARGET PROTEIN, all of FIG. 1.

VGAM1122 RNA, herein schematically represented by VGAM1 RNA through VGAM3 RNA, binds complementarily to a host target binding site located in an untranslated region of VGAM1122 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1122 host target RNA into VGAM1122 host target protein, herein schematically represented by VGAM1 HOST TARGET PROTEIN through VGAM3 HOST TARGET PROTEIN, all of FIG. 1.

VGAM1123 RNA, herein schematically represented by VGAM1 RNA through VGAM3 RNA, binds complementarily to a host target binding site located in an untranslated region of VGAM1123 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1123 host target RNA into VGAM1123 host target protein, herein schematically represented by VGAM1 HOST TARGET PROTEIN through VGAM3 HOST TARGET PROTEIN, all of FIG. 1.

VGAM1124 RNA, herein schematically represented by VGAM1 RNA through VGAM3 RNA, binds complementarily to a host target binding site located in an untranslated region of VGAM1124 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1124 host target RNA into VGAM1124 host target protein, herein schematically represented by VGAM1 HOST TARGET PROTEIN through VGAM3 HOST TARGET PROTEIN, all of FIG. 1.

VGAM1125 RNA, herein schematically represented by VGAM1 RNA through VGAM3 RNA, binds complementarily to a host target binding site located in an untranslated region of VGAM1125 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1125 host target RNA into VGAM1125 host target protein, herein schematically represented by VGAM1 HOST TARGET PROTEIN through VGAM3 HOST TARGET PROTEIN, all of FIG. 1.

It is appreciated that a function of VGR2977 gene, herein designated VGR GENE, is inhibition of expression of host target genes, as part of a novel viral mechanism of attacking a host. Accordingly, utilities of VGR2977 gene include diagnosis, prevention and treatment of viral infection by Saimiriine Herpesvirus 2. Specific functions, and accordingly utilities, of VGR2977 gene correlate with, and may be deduced from, the identity of the host target genes, which are inhibited by VGAM RNAs comprised in the 'operon-like' cluster of VGR2977 gene: VGAM1121 host target protein, VGAM1122 host target protein, VGAM1123 host target protein, VGAM1124 host target protein and VGAM1125 host target protein, herein schematically represented by VGAM1 HOST TARGET PROTEIN through VGAM3 HOST TARGET PROTEIN. The function of these host target genes is elaborated hereinabove with reference to VGAM1121, VGAM1122, VGAM1123, VGAM1124 and VGAM1125. FIG. 9 further provides a conceptual description of novel bioinformatically detected regulatory viral gene, referred to here as Viral Genomic Record 2978(VGR2978) viral gene, which encodes an 'operon-like' cluster of novel viral micro RNA-like genes, each of which in turn modulates expression of at least one host target gene, the function and utility of which at least one host target gene is known in the art.

VGR2978 gene, herein designated VGR GENE, is a novel bioinformatically detected regulatory, non protein coding, RNA viral gene. The method by which VGR2978 gene was detected is described hereinabove with reference to FIGS. 1-9.

VGR2978 gene encodes VGR2978 precursor RNA, herein designated VGR PRECURSOR RNA, an RNA molecule, typically several hundred nucleotides long.

VGR2978 precursor RNA folds spatially, forming VGR2978 folded precursor RNA, herein designated VGR FOLDED PRECURSOR RNA. It is appreciated that VGR2978 folded precursor RNA comprises a plurality of what is known in the art as 'hairpin' structures. These 'hairpin' structures are due to the fact that the nucleotide sequence of VGR2978 precursor RNA comprises a plurality of segments, the first half of each such segment having a nucleotide sequence which is at least a partial inversed-reversed sequence of the second half thereof, as is well known in the art.

VGR2978 folded precursor RNA is naturally processed by cellular enzymatic activity into at least 6 separate VGAM precursor RNAs, VGAM1127 precursor RNA, VGAM1128 precursor RNA, VGAM1129 precursor RNA, VGAM1130 precursor RNA, VGAM1131 precursor RNA and VGAM1132 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1127 RNA, VGAM1128 RNA, VGAM1129 RNA, VGAM1130 RNA, VGAM1131 RNA and VGAM1132 RNA, herein schematically represented by VGAM1 RNA through VGAM3 RNA, each of which VGAM RNAs corresponding to VGAM RNA of FIG. 1.

VGAM1127 RNA, herein schematically represented by VGAM1 RNA through VGAM3 RNA, binds complementarily to a host target binding site located in an untranslated region of VGAM1127 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1127 host target RNA into VGAM1127 host target protein, herein schematically represented by VGAM1 HOST TARGET PROTEIN through VGAM3 HOST TARGET PROTEIN, all of FIG. 1.

VGAM1128 RNA, herein schematically represented by VGAM1 RNA through VGAM3 RNA, binds complementarily to a host target binding site located in an untranslated region of VGAM1128 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1128 host target RNA into VGAM1128 host target protein, herein schematically represented by VGAM1 HOST TARGET PROTEIN through VGAM3 HOST TARGET PROTEIN, all of FIG. 1.

VGAM1129 RNA, herein schematically represented by VGAM1 RNA through VGAM3 RNA, binds complementarily to a host target binding site located in an untranslated region of VGAM1129 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1129 host target RNA into VGAM1129 host target protein, herein schematically represented by VGAM1 HOST TARGET PROTEIN through VGAM3 HOST TARGET PROTEIN, all of FIG. 1.

VGAM1130 RNA, herein schematically represented by VGAM1 RNA through VGAM3 RNA, binds complementarily to a host target binding site located in an untranslated region of VGAM1130 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1130 host target RNA into VGAM1130 host target protein, herein schematically represented by VGAM1 HOST TARGET PROTEIN through VGAM3 HOST TARGET PROTEIN, all of FIG. 1.

VGAM1131 RNA, herein schematically represented by VGAM1 RNA through VGAM3 RNA, binds complementarily to a host target binding site located in an untranslated region of VGAM1131 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1131 host target RNA into VGAM1131 host target protein, herein schematically represented by VGAM1 HOST TARGET PROTEIN through VGAM3 HOST TARGET PROTEIN, all of FIG. 1.

VGAM1132 RNA, herein schematically represented by VGAM1 RNA through VGAM3 RNA, binds complementarily to a host target binding site located in an untranslated region of VGAM1132 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1132 host target RNA into VGAM1132 host target protein, herein schematically represented by VGAM1 HOST TARGET PROTEIN through VGAM3 HOST TARGET PROTEIN, all of FIG. 1.

It is appreciated that a function of VGR2978 gene, herein designated VGR GENE, is inhibition of expression of host target genes, as part of a novel viral mechanism of attacking a host. Accordingly, utilities of VGR2978 gene include diagnosis, prevention and treatment of viral infection by Barley Stripe Mosaic Virus. Specific functions, and accordingly utilities, of VGR2978 gene correlate with, and may be deduced from, the identity of the host target genes, which are inhibited by VGAM RNAs comprised in the 'operon-like' cluster of VGR2978 gene: VGAM1127 host target protein, VGAM1128 host target protein, VGAM1129 host target protein, VGAM1130 host target protein, VGAM1131 host target protein and VGAM1132 host target protein, herein schematically represented by VGAM1 HOST TARGET PROTEIN through VGAM3 HOST TARGET PROTEIN. The function of these host target genes is elaborated hereinabove with reference to VGAM1127, VGAM1128, VGAM1129, VGAM1130, VGAM1131 and VGAM1132. FIG. 9 further provides a conceptual description of novel bioinformatically detected regulatory viral gene, referred to here as Viral Genomic Record 2979(VGR2979) viral gene, which encodes an 'operon-like' cluster of novel viral micro RNA-like genes, each of which in turn modulates expression of at least one host target gene, the function and utility of which at least one host target gene is known in the art.

VGR2979 gene, herein designated VGR GENE, is a novel bioinformatically detected regulatory, non protein coding, RNA viral gene. The method by which VGR2979 gene was detected is described hereinabove with reference to FIGS. 1-9.

VGR2979 gene encodes VGR2979 precursor RNA, herein designated VGR PRECURSOR RNA, an RNA molecule, typically several hundred nucleotides long.

VGR2979 precursor RNA folds spatially, forming VGR2979 folded precursor RNA, herein designated VGR FOLDED PRECURSOR RNA. It is appreciated that VGR2979 folded precursor RNA comprises a plurality of what is known in the art as 'hairpin' structures. These 'hairpin' structures are due to the fact that the nucleotide sequence of VGR2979 precursor RNA comprises a plurality of segments, the first half of each such segment having a nucleotide sequence which is at least a partial inversed-reversed sequence of the second half thereof, as is well known in the art.

VGR2979 folded precursor RNA is naturally processed by cellular enzymatic activity into at least 3 separate VGAM precursor RNAs, VGAM1133 precursor RNA, VGAM1134 precursor RNA and VGAM1135 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1133 RNA, VGAM1134 RNA and VGAM1135 RNA, herein schematically represented by VGAM1 RNA through VGAM3 RNA, each of which VGAM RNAs corresponding to VGAM RNA of FIG. 1.

VGAM1133 RNA, herein schematically represented by VGAM1 RNA through VGAM3 RNA, binds complementarily to a host target binding site located in an untranslated region of VGAM1133 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1133 host target RNA into VGAM1133 host target protein, herein schematically represented by VGAM1 HOST TARGET PROTEIN through VGAM3 HOST TARGET PROTEIN, all of FIG. 1.

VGAM1134 RNA, herein schematically represented by VGAM1 RNA through VGAM3 RNA, binds complementarily to a host target binding site located in an untranslated region of VGAM1134 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1134 host target RNA into VGAM1134 host target protein, herein schematically represented by VGAM1 HOST TARGET PROTEIN through VGAM3 HOST TARGET PROTEIN, all of FIG. 1.

VGAM1135 RNA, herein schematically represented by VGAM1 RNA through VGAM3 RNA, binds complementarily to a host target binding site located in an untranslated region of VGAM1135 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1135 host target RNA into VGAM1135 host target protein, herein schematically represented by VGAM1 HOST TARGET PROTEIN through VGAM3 HOST TARGET PROTEIN, all of FIG. 1.

It is appreciated that a function of VGR2979 gene, herein designated VGR GENE, is inhibition of expression of host target genes, as part of a novel viral mechanism of attacking a host. Accordingly, utilities of VGR2979 gene include diagnosis, prevention and treatment of viral infection by Maize Rayado Fino Virus. Specific functions, and accordingly utilities, of VGR2979 gene correlate with, and may be deduced from, the identity of the host target genes, which are inhibited by VGAM RNAs comprised in the 'operon-like' cluster of VGR2979 gene: VGAM1133 host target protein, VGAM1134 host target protein and VGAM1135 host target protein, herein schematically represented by VGAM1 HOST TARGET PROTEIN through VGAM3 HOST TARGET PROTEIN. The function of these host target genes is elaborated hereinabove with reference to VGAM1133, VGAM1134 and VGAM1135. FIG. 9 further provides a conceptual description of novel bioinformatically detected regulatory viral gene, referred to here as Viral Genomic Record 2980(VGR2980) viral gene, which encodes an 'operon-like' cluster of novel viral micro RNA-like genes, each of which in turn modulates expression of at least one host target gene, the function and utility of which at least one host target gene is known in the art.

VGR2980 gene, herein designated VGR GENE, is a novel bioinformatically detected regulatory, non protein coding, RNA viral gene. The method by which VGR2980 gene was detected is described hereinabove with reference to FIGS. 1-9.

VGR2980 gene encodes VGR2980 precursor RNA, herein designated VGR PRECURSOR RNA, an RNA molecule, typically several hundred nucleotides long.

VGR2980 precursor RNA folds spatially, forming VGR2980 folded precursor RNA, herein designated VGR FOLDED PRECURSOR RNA. It is appreciated that VGR2980 folded precursor RNA comprises a plurality of what is known in the art as 'hairpin' structures. These 'hairpin' structures are due to the fact that the nucleotide sequence of VGR2980 precursor RNA comprises a plurality of segments, the first half of each such segment having a nucleotide sequence which is at least a partial inversed-reversed sequence of the second half thereof, as is well known in the art.

VGR2980 folded precursor RNA is naturally processed by cellular enzymatic activity into at least 3 separate VGAM precursor RNAs, VGAM1136 precursor RNA, VGAM1137 precursor RNA and VGAM1138 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1136 RNA, VGAM1137 RNA and VGAM1138 RNA, herein schematically represented by VGAM1 RNA through VGAM3 RNA, each of which VGAM RNAs corresponding to VGAM RNA of FIG. 1.

VGAM1136 RNA, herein schematically represented by VGAM1 RNA through VGAM3 RNA, binds complementarily to a host target binding site located in an untranslated region of VGAM1136 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1136 host target RNA into VGAM1136 host target protein, herein schematically represented by VGAM1 HOST TARGET PROTEIN through VGAM3 HOST TARGET PROTEIN, all of FIG. 1.

VGAM1137 RNA, herein schematically represented by VGAM1 RNA through VGAM3 RNA, binds complementarily to a host target binding site located in an untranslated region of VGAM1137 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1137 host target RNA into VGAM1137 host target protein, herein schematically represented by VGAM1 HOST TARGET PROTEIN through VGAM3 HOST TARGET PROTEIN, all of FIG. 1.

VGAM1138 RNA, herein schematically represented by VGAM1 RNA through VGAM3 RNA, binds complementarily to a host target binding site located in an untranslated region of VGAM1138 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1138 host target RNA into VGAM1138 host target protein, herein schematically represented by VGAM1 HOST TARGET PROTEIN through VGAM3 HOST TARGET PROTEIN, all of FIG. 1.

It is appreciated that a function of VGR2980 gene, herein designated VGR GENE, is inhibition of expression of host target genes, as part of a novel viral mechanism of attacking a host. Accordingly, utilities of VGR2980 gene include diagnosis, prevention and treatment of viral infection by Beet Mild Yellowing Virus. Specific functions, and accordingly utilities, of VGR2980 gene correlate with, and may be deduced from, the identity of the host target genes, which are inhibited by VGAM RNAs comprised in the 'operon-like' cluster of VGR2980 gene: VGAM1136 host target protein, VGAM1137 host target protein and VGAM1138 host target protein, herein schematically represented by VGAM1 HOST TARGET PROTEIN through VGAM3 HOST TARGET PROTEIN. The function of these host target genes is elaborated hereinabove with reference to VGAM1136, VGAM1137 and VGAM1138. FIG. 9 further provides a conceptual description of novel bioinformatically detected regulatory viral gene, referred to here as Viral Genomic Record 2981(VGR2981) viral gene, which encodes an 'operon-like' cluster of novel viral micro RNA-like genes, each of which in turn modulates expression of at least one host target gene, the function and utility of which at least one host target gene is known in the art.

VGR2981 gene, herein designated VGR GENE, is a novel bioinformatically detected regulatory, non protein coding, RNA viral gene. The method by which VGR2981 gene was detected is described hereinabove with reference to FIGS. 1-9.

VGR2981 gene encodes VGR2981 precursor RNA, herein designated VGR PRECURSOR RNA, an RNA molecule, typically several hundred nucleotides long.

VGR2981 precursor RNA folds spatially, forming VGR2981 folded precursor RNA, herein designated VGR FOLDED PRECURSOR RNA. It is appreciated that VGR2981 folded precursor RNA comprises a plurality of what is known in the art as 'hairpin' structures. These 'hairpin' structures are due to the fact that the nucleotide sequence of VGR2981 precursor RNA comprises a plurality of segments, the first half of each such segment having a nucleotide sequence which is at least a partial inversed-reversed sequence of the second half thereof, as is well known in the art.

VGR2981 folded precursor RNA is naturally processed by cellular enzymatic activity into at least 3 separate VGAM precursor RNAs, VGAM1139 precursor RNA, VGAM1140 precursor RNA and VGAM1141 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1139 RNA, VGAM1140 RNA and VGAM1141 RNA, herein schematically represented by VGAM1 RNA through VGAM3 RNA, each of which VGAM RNAs corresponding to VGAM RNA of FIG. 1.

VGAM1139 RNA, herein schematically represented by VGAM1 RNA through VGAM3 RNA, binds complementarily to a host target binding site located in an untranslated region of VGAM1139 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1139 host target RNA into VGAM1139 host target protein, herein schematically represented by VGAM1 HOST TARGET PROTEIN through VGAM3 HOST TARGET PROTEIN, all of FIG. 1.

VGAM1140 RNA, herein schematically represented by VGAM1 RNA through VGAM3 RNA, binds complementarily to a host target binding site located in an untranslated region of VGAM1140 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1140 host target RNA into VGAM1140 host target protein, herein schematically represented by VGAM1 HOST TARGET PROTEIN through VGAM3 HOST TARGET PROTEIN, all of FIG. 1.

VGAM1141 RNA, herein schematically represented by VGAM1 RNA through VGAM3 RNA, binds complementarily to a host target binding site located in an untranslated region of VGAM1141 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1141 host target RNA into VGAM1141 host target protein, herein schematically represented by VGAM1 HOST TARGET PROTEIN through VGAM3 HOST TARGET PROTEIN, all of FIG. 1.

It is appreciated that a function of VGR2981 gene, herein designated VGR GENE, is inhibition of expression of host target genes, as part of a novel viral mechanism of attacking a host. Accordingly, utilities of VGR2981 gene include diagnosis, prevention and treatment of viral infection by Chayote Mosaic Tymovirus. Specific functions, and accordingly utilities, of VGR2981 gene correlate with, and may be deduced from, the identity of the host target genes, which are inhibited by VGAM RNAs comprised in the 'operon-like' cluster of VGR2981 gene: VGAM1139 host target protein, VGAM1140 host target protein and VGAM1141 host target protein, herein schematically represented by VGAM1 HOST TARGET PROTEIN through VGAM3 HOST TARGET PROTEIN. The function of these host target genes is elaborated hereinabove with reference to VGAM1139, VGAM1140 and VGAM1141. FIG. 9 further provides a conceptual description of novel bioinformatically detected regulatory viral gene, referred to here as Viral Genomic Record 2982(VGR2982) viral gene, which encodes an 'operon-like' cluster of novel viral micro RNA-like genes, each of which in turn modulates expression of at least one host target gene, the function and utility of which at least one host target gene is known in the art.

VGR2982 gene, herein designated VGR GENE, is a novel bioinformatically detected regulatory, non protein coding, RNA viral gene. The method by which VGR2982 gene was detected is described hereinabove with reference to FIGS. 1-9.

VGR2982 gene encodes VGR2982 precursor RNA, herein designated VGR PRECURSOR RNA, an RNA molecule, typically several hundred nucleotides long.

VGR2982 precursor RNA folds spatially, forming VGR2982 folded precursor RNA, herein designated VGR FOLDED PRECURSOR RNA. It is appreciated that VGR2982 folded precursor RNA comprises a plurality of what is known in the art as 'hairpin' structures. These 'hairpin' structures are due to the fact that the nucleotide sequence of VGR2982 precursor RNA comprises a plurality of segments, the first half of each such segment having a nucleotide sequence which is at least a partial inversed-reversed sequence of the second half thereof, as is well known in the art.

VGR2982 folded precursor RNA is naturally processed by cellular enzymatic activity into at least 4 separate VGAM precursor RNAs, VGAM1142 precursor RNA, VGAM1143 precursor RNA, VGAM1144 precursor RNA and VGAM1145 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1142 RNA, VGAM1143 RNA, VGAM1144 RNA and VGAM1145 RNA, herein schematically represented by VGAM1 RNA through VGAM3 RNA, each of which VGAM RNAs corresponding to VGAM RNA of FIG. 1.

VGAM1142 RNA, herein schematically represented by VGAM1 RNA through VGAM3 RNA, binds complementarily to a host target binding site located in an untranslated region of VGAM1142 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1142 host target RNA into VGAM1142 host target protein, herein schematically represented by VGAM1 HOST TARGET PROTEIN through VGAM3 HOST TARGET PROTEIN, all of FIG. 1.

VGAM1143 RNA, herein schematically represented by VGAM1 RNA through VGAM3 RNA, binds complementarily to a host target binding site located in an untranslated region of VGAM1143 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1143 host target RNA into VGAM1143 host target protein, herein schematically represented by VGAM1 HOST TARGET PROTEIN through VGAM3 HOST TARGET PROTEIN, all of FIG. 1.

VGAM1144 RNA, herein schematically represented by VGAM1 RNA through VGAM3 RNA, binds complementarily to a host target binding site located in an untranslated region of VGAM1144 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1144 host target RNA into VGAM1144 host target protein, herein schematically represented by VGAM1 HOST TARGET PROTEIN through VGAM3 HOST TARGET PROTEIN, all of FIG. 1.

VGAM1145 RNA, herein schematically represented by VGAM1 RNA through VGAM3 RNA, binds complementarily to a host target binding site located in an untranslated region of VGAM1145 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1145 host target RNA into VGAM1145 host target protein, herein schematically represented by VGAM1 HOST TARGET PROTEIN through VGAM3 HOST TARGET PROTEIN, all of FIG. 1.

It is appreciated that a function of VGR2982 gene, herein designated VGR GENE, is inhibition of expression of host target genes, as part of a novel viral mechanism of attacking a host. Accordingly, utilities of VGR2982 gene include diagnosis, prevention and treatment of viral infection by Bamboo Mosaic Virus. Specific functions, and accordingly utilities, of VGR2982 gene correlate with, and may be deduced from, the identity of the host target genes, which are inhibited by VGAM RNAs comprised in the 'operon-like' cluster of VGR2982 gene: VGAM1142 host target protein, VGAM1143 host target protein, VGAM1144 host target protein and VGAM1145 host target protein, herein schematically represented by VGAM1 HOST TARGET PROTEIN through VGAM3 HOST TARGET PROTEIN. The function of these host target genes is elaborated hereinabove with reference to VGAM1142, VGAM1143, VGAM1144 and VGAM1145. FIG. 9 further provides a conceptual description of novel bioinformatically detected regulatory viral gene, referred to here as Viral Genomic Record 2983(VGR2983) viral gene, which encodes an 'operon-like' cluster of novel viral micro RNA-like genes, each of which in turn modulates expression of at least one host target gene, the function and utility of which at least one host target gene is known in the art.

VGR2983 gene, herein designated VGR GENE, is a novel bioinformatically detected regulatory, non protein coding, RNA viral gene. The method by which VGR2983 gene was detected is described hereinabove with reference to FIGS. 1-9.

VGR2983 gene encodes VGR2983 precursor RNA, herein designated VGR PRECURSOR RNA, an RNA molecule, typically several hundred nucleotides long.

VGR2983 precursor RNA folds spatially, forming VGR2983 folded precursor RNA, herein designated VGR FOLDED PRECURSOR RNA. It is appreciated that VGR2983 folded precursor RNA comprises a plurality of what is known in the art as 'hairpin' structures. These 'hairpin' structures are due to the fact that the nucleotide sequence of VGR2983 precursor RNA comprises a plurality of segments, the first half of each such segment having a nucleotide sequence which is at least a partial inversed-reversed sequence of the second half thereof, as is well known in the art.

VGR2983 folded precursor RNA is naturally processed by cellular enzymatic activity into at least 2 separate VGAM precursor RNAs, VGAM1146 precursor RNA and VGAM1147 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1146 RNA and VGAM1147 RNA, herein schematically represented by VGAM1 RNA through VGAM3 RNA, each of which VGAM RNAs corresponding to VGAM RNA of FIG. 1.

VGAM1146 RNA, herein schematically represented by VGAM1 RNA through VGAM3 RNA, binds complementarily to a host target binding site located in an untranslated region of VGAM1146 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1146 host target RNA into VGAM1146 host target protein, herein schematically represented by VGAM1 HOST TARGET PROTEIN through VGAM3 HOST TARGET PROTEIN, all of FIG. 1.

VGAM1147 RNA, herein schematically represented by VGAM1 RNA through VGAM3 RNA, binds complementarily to a host target binding site located in an untranslated region of VGAM1147 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1147 host target RNA into VGAM1147 host target protein, herein schematically represented by VGAM1 HOST TARGET PROTEIN through VGAM3 HOST TARGET PROTEIN, all of FIG. 1.

It is appreciated that a function of VGR2983 gene, herein designated VGR GENE, is inhibition of expression of host target genes, as part of a novel viral mechanism of attacking a host. Accordingly, utilities of VGR2983 gene include diagnosis, prevention and treatment of viral infection by Fowlpox Virus. Specific functions, and accordingly utilities, of VGR2983 gene correlate with, and may be deduced from, the identity of the host target genes, which are inhibited by VGAM RNAs comprised in the 'operon-like' cluster of VGR2983 gene: VGAM1146 host target protein and VGAM1147 host target protein, herein schematically represented by VGAM1 HOST TARGET PROTEIN through VGAM3 HOST TARGET PROTEIN. The function of these host target genes is elaborated hereinabove with reference to VGAM1146 and VGAM1147. FIG. 9 further provides a conceptual description of novel bioinformatically detected regulatory viral gene, referred to here as Viral Genomic Record 2984(VGR2984) viral gene, which encodes an 'operon-like' cluster of novel viral micro RNA-like genes, each of which in turn modulates expression of at least one host target gene, the function and utility of which at least one host target gene is known in the art.

VGR2984 gene, herein designated VGR GENE, is a novel bioinformatically detected regulatory, non protein coding, RNA viral gene. The method by which VGR2984 gene was detected is described hereinabove with reference to FIGS. 1-9.

VGR2984 gene encodes VGR2984 precursor RNA, herein designated VGR PRECURSOR RNA, an RNA molecule, typically several hundred nucleotides long.

VGR2984 precursor RNA folds spatially, forming VGR2984 folded precursor RNA, herein designated VGR FOLDED PRECURSOR RNA. It is appreciated that VGR2984 folded precursor RNA comprises a plurality of what is known in the art as 'hairpin' structures. These 'hairpin' structures are due to the fact that the nucleotide sequence of VGR2984 precursor RNA comprises a plurality of segments, the first half of each such segment having a nucleotide sequence which is at least a partial inversed-reversed sequence of the second half thereof, as is well known in the art.

VGR2984 folded precursor RNA is naturally processed by cellular enzymatic activity into at least 3 separate VGAM precursor RNAs, VGAM1148 precursor RNA, VGAM1149 precursor RNA and VGAM1150 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1148 RNA, VGAM1149 RNA and VGAM1150 RNA, herein schematically represented by VGAM1 RNA through VGAM3 RNA, each of which VGAM RNAs corresponding to VGAM RNA of FIG. 1.

VGAM1148 RNA, herein schematically represented by VGAM1 RNA through VGAM3 RNA, binds complementarily to a host target binding site located in an untranslated region of VGAM1148 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1148 host target RNA into VGAM1148 host target protein, herein schematically represented by VGAM1 HOST TARGET PROTEIN through VGAM3 HOST TARGET PROTEIN, all of FIG. 1.

VGAM1149 RNA, herein schematically represented by VGAM1 RNA through VGAM3 RNA, binds complementarily to a host target binding site located in an untranslated region of VGAM1149 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1149 host target RNA into VGAM1149 host target protein, herein schematically represented by VGAM1 HOST TARGET PROTEIN through VGAM3 HOST TARGET PROTEIN, all of FIG. 1.

VGAM1150 RNA, herein schematically represented by VGAM1 RNA through VGAM3 RNA, binds complementarily to a host target binding site located in an untranslated region of VGAM1150 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1150 host target RNA into VGAM1150 host target protein, herein schematically represented by VGAM1 HOST TARGET PROTEIN through VGAM3 HOST TARGET PROTEIN, all of FIG. 1.

It is appreciated that a function of VGR2984 gene, herein designated VGR GENE, is inhibition of expression of host target genes, as part of a novel viral mechanism of attacking a host. Accordingly, utilities of VGR2984 gene include diagnosis, prevention and treatment of viral infection by Cercopithecine Herpesvirus 7. Specific functions, and accordingly utilities, of VGR2984 gene correlate with, and may be deduced from, the identity of the host target genes, which are inhibited by VGAM RNAs comprised in the 'operon-like' cluster of VGR2984 gene: VGAM1148 host target protein, VGAM1149 host target protein and VGAM1150 host target protein, herein schematically represented by VGAM1 HOST TARGET PROTEIN through VGAM3 HOST TARGET PROTEIN. The function of these host target genes is elaborated hereinabove with reference to VGAM1148, VGAM1149 and VGAM1150. FIG. 9 further provides a conceptual description of novel bioinformatically detected regulatory viral gene, referred to here as Viral Genomic Record 2985(VGR2985) viral gene, which encodes an 'operon-like' cluster of novel viral micro RNA-like genes, each of which in turn modulates expression of at least one host target gene, the function and utility of which at least one host target gene is known in the art.

VGR2985 gene, herein designated VGR GENE, is a novel bioinformatically detected regulatory, non protein coding, RNA viral gene. The method by which VGR2985 gene was detected is described hereinabove with reference to FIGS. 1-9.

VGR2985 gene encodes VGR2985 precursor RNA, herein designated VGR PRECURSOR RNA, an RNA molecule, typically several hundred nucleotides long.

VGR2985 precursor RNA folds spatially, forming VGR2985 folded precursor RNA, herein designated VGR FOLDED PRECURSOR RNA. It is appreciated that VGR2985 folded precursor RNA comprises a plurality of what is known in the art as 'hairpin' structures. These 'hairpin' structures are due to the fact that the nucleotide sequence of VGR2985 precursor RNA comprises a plurality of segments, the first half of each such segment having a nucleotide sequence which is at least a partial inversed-reversed sequence of the second half thereof, as is well known in the art.

VGR2985 folded precursor RNA is naturally processed by cellular enzymatic activity into at least 4 separate VGAM precursor RNAs, VGAM1151 precursor RNA, VGAM1152 precursor RNA, VGAM1153 precursor RNA and VGAM1154 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1151 RNA, VGAM1152 RNA, VGAM1153 RNA and VGAM1154 RNA, herein schematically represented by VGAM1 RNA through VGAM3 RNA, each of which VGAM RNAs corresponding to VGAM RNA of FIG. 1.

VGAM1151 RNA, herein schematically represented by VGAM1 RNA through VGAM3 RNA, binds complementarily to a host target binding site located in an untranslated region of VGAM1151 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1151 host target RNA into VGAM1151 host target protein, herein schematically represented by VGAM1 HOST TARGET PROTEIN through VGAM3 HOST TARGET PROTEIN, all of FIG. 1.

VGAM1152 RNA, herein schematically represented by VGAM1 RNA through VGAM3 RNA, binds complementarily to a host target binding site located in an untranslated region of VGAM1152 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1152 host target RNA into VGAM1152 host target protein, herein schematically represented by VGAM1 HOST TARGET PROTEIN through VGAM3 HOST TARGET PROTEIN, all of FIG. 1.

VGAM1153 RNA, herein schematically represented by VGAM1 RNA through VGAM3 RNA, binds complementarily to a host target binding site located in an untranslated region of VGAM1153 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1153 host target RNA into VGAM1153 host target protein, herein schematically represented by VGAM1 HOST TARGET PROTEIN through VGAM3 HOST TARGET PROTEIN, all of FIG. 1.

VGAM1154 RNA, herein schematically represented by VGAM1 RNA through VGAM3 RNA, binds complementarily to a host target binding site located in an untranslated region of VGAM1154 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1154 host target RNA into VGAM1154 host target protein, herein schematically represented by VGAM1 HOST TARGET PROTEIN through VGAM3 HOST TARGET PROTEIN, all of FIG. 1.

It is appreciated that a function of VGR2985 gene, herein designated VGR GENE, is inhibition of expression of host target genes, as part of a novel viral mechanism of attacking a host. Accordingly, utilities of VGR2985 gene include diagnosis, prevention and treatment of viral infection by Cowpox Virus. Specific functions, and accordingly utilities, of VGR2985 gene correlate with, and may be deduced from, the identity of the host target genes, which are inhibited by VGAM RNAs comprised in the 'operon-like' cluster of VGR2985 gene: VGAM1151 host target protein, VGAM1152 host target protein, VGAM1153 host target protein and VGAM1154 host target protein, herein schematically represented by VGAM1 HOST TARGET PROTEIN through VGAM3 HOST TARGET PROTEIN. The function of these host target genes is elaborated hereinabove with reference to VGAM1151, VGAM1152, VGAM1153 and VGAM1154. FIG. 9 further provides a conceptual description of novel bioinformatically detected regulatory viral gene, referred to here as Viral Genomic Record 2986(VGR2986) viral gene, which encodes an 'operon-like' cluster of novel viral micro RNA-like genes, each of which in turn modulates expression of at least one host target gene, the function and utility of which at least one host target gene is known in the art.

VGR2986 gene, herein designated VGR GENE, is a novel bioinformatically detected regulatory, non protein coding, RNA viral gene. The method by which VGR2986 gene was detected is described hereinabove with reference to FIGS. 1-9.

VGR2986 gene encodes VGR2986 precursor RNA, herein designated VGR PRECURSOR RNA, an RNA molecule, typically several hundred nucleotides long.

VGR2986 precursor RNA folds spatially, forming VGR2986 folded precursor RNA, herein designated VGR FOLDED PRECURSOR RNA. It is appreciated that VGR2986 folded precursor RNA comprises a plurality of what is known in the art as 'hairpin' structures. These 'hairpin' structures are due to the fact that the nucleotide sequence of VGR2986 precursor RNA comprises a plurality of segments, the first half of each such segment having a nucleotide sequence which is at least a partial inversed-reversed sequence of the second half thereof, as is well known in the art.

VGR2986 folded precursor RNA is naturally processed by cellular enzymatic activity into at least 3 separate VGAM precursor RNAs, VGAM1155 precursor RNA, VGAM1156 precursor RNA and VGAM1157 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1155 RNA, VGAM1156 RNA and VGAM1157 RNA, herein schematically represented by VGAM1 RNA through VGAM3 RNA, each of which VGAM RNAs corresponding to VGAM RNA of FIG. 1.

VGAM1155 RNA, herein schematically represented by VGAM1 RNA through VGAM3 RNA, binds complementarily to a host target binding site located in an untranslated region of VGAM1155 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1155 host target RNA into VGAM1155 host target protein, herein schematically represented by VGAM1 HOST TARGET PROTEIN through VGAM3 HOST TARGET PROTEIN, all of FIG. 1.

VGAM1156 RNA, herein schematically represented by VGAM1 RNA through VGAM3 RNA, binds complementarily to a host target binding site located in an untranslated region of VGAM1156 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1156 host target RNA into VGAM1156 host target protein, herein schematically represented by VGAM1 HOST TARGET PROTEIN through VGAM3 HOST TARGET PROTEIN, all of FIG. 1.

VGAM1157 RNA, herein schematically represented by VGAM1 RNA through VGAM3 RNA, binds complementarily to a host target binding site located in an untranslated region of VGAM1157 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1157 host target RNA into VGAM1157 host target protein, herein schematically represented by VGAM1 HOST TARGET PROTEIN through VGAM3 HOST TARGET PROTEIN, all of FIG. 1.

It is appreciated that a function of VGR2986 gene, herein designated VGR GENE, is inhibition of expression of host target genes, as part of a novel viral mechanism of attacking a host. Accordingly, utilities of VGR2986 gene include diagnosis, prevention and treatment of viral infection by Cowpox Virus. Specific functions, and accordingly utilities, of VGR2986 gene correlate with, and may be deduced from, the identity of the host target genes, which are inhibited by VGAM RNAs comprised in the 'operon-like' cluster of VGR2986 gene: VGAM1155 host target protein, VGAM1156 host target protein and VGAM1157 host target protein, herein schematically represented by VGAM1 HOST TARGET PROTEIN through VGAM3 HOST TARGET PROTEIN. The function of these host target genes is elaborated hereinabove with reference to VGAM1155, VGAM1156 and VGAM1157. FIG. 9 further provides a conceptual description of novel bioinformatically detected regulatory viral gene, referred to here as Viral Genomic Record 2987(VGR2987) viral gene, which encodes an 'operon-like' cluster of novel viral micro RNA-like genes, each of which in turn modulates expression of at least one host target gene, the function and utility of which at least one host target gene is known in the art.

VGR2987 gene, herein designated VGR GENE, is a novel bioinformatically detected regulatory, non protein coding, RNA viral gene. The method by which VGR2987 gene was detected is described hereinabove with reference to FIGS. 1-9.

VGR2987 gene encodes VGR2987 precursor RNA, herein designated VGR PRECURSOR RNA, an RNA molecule, typically several hundred nucleotides long.

VGR2987 precursor RNA folds spatially, forming VGR2987 folded precursor RNA, herein designated VGR FOLDED PRECURSOR RNA. It is appreciated that VGR2987 folded precursor RNA comprises a plurality of what is known in the art as 'hairpin' structures. These 'hairpin' structures are due to the fact that the nucleotide sequence of VGR2987 precursor RNA comprises a plurality of segments, the first half of each such segment having a nucleotide sequence which is at least a partial inversed-reversed sequence of the second half thereof, as is well known in the art.

VGR2987 folded precursor RNA is naturally processed by cellular enzymatic activity into at least 3 separate VGAM precursor RNAs, VGAM1159 precursor RNA, VGAM1160 precursor RNA and VGAM1161 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1159 RNA, VGAM1160 RNA and VGAM1161 RNA, herein schematically represented by VGAM1 RNA through VGAM3 RNA, each of which VGAM RNAs corresponding to VGAM RNA of FIG. 1.

VGAM1159 RNA, herein schematically represented by VGAM1 RNA through VGAM3 RNA, binds complementarily to a host target binding site located in an untranslated region of VGAM1159 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1159 host target RNA into VGAM1159 host target protein, herein schematically represented by VGAM1 HOST TARGET PROTEIN through VGAM3 HOST TARGET PROTEIN, all of FIG. 1.

VGAM1160 RNA, herein schematically represented by VGAM1 RNA through VGAM3 RNA, binds complementarily to a host target binding site located in an untranslated region of VGAM1160 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1160 host target RNA into VGAM1160 host target protein, herein schematically represented by VGAM1 HOST TARGET PROTEIN through VGAM3 HOST TARGET PROTEIN, all of FIG. 1.

VGAM1161 RNA, herein schematically represented by VGAM1 RNA through VGAM3 RNA, binds complementarily to a host target binding site located in an untranslated region of VGAM1161 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1161 host target RNA into VGAM1161 host target protein, herein schematically represented by VGAM1 HOST TARGET PROTEIN through VGAM3 HOST TARGET PROTEIN, all of FIG. 1.

It is appreciated that a function of VGR2987 gene, herein designated VGR GENE, is inhibition of expression of host target genes, as part of a novel viral mechanism of attacking a host. Accordingly, utilities of VGR2987 gene include diagnosis, prevention and treatment of viral infection by Meleagrid Herpesvirus 1. Specific functions, and accordingly utilities, of VGR2987 gene correlate with, and may be deduced from, the identity of the host target genes, which are inhibited by VGAM RNAs comprised in the 'operon-like' cluster of VGR2987 gene: VGAM1159 host target protein, VGAM1160 host target protein and VGAM1161 host target protein, herein schematically represented by VGAM1 HOST TARGET PROTEIN through VGAM3 HOST TARGET PROTEIN. The function of these host target genes is elaborated hereinabove with reference to VGAM1159, VGAM1160 and VGAM1161. FIG. 9 further provides a conceptual description of novel bioinformatically detected regulatory viral gene, referred to here as Viral Genomic Record 2988(VGR2988) viral gene, which encodes an 'operon-like' cluster of novel viral micro RNA-like genes, each of which in turn modulates expression of at least one host target gene, the function and utility of which at least one host target gene is known in the art.

VGR2988 gene, herein designated VGR GENE, is a novel bioinformatically detected regulatory, non protein coding, RNA viral gene. The method by which VGR2988 gene was detected is described hereinabove with reference to FIGS. 1-9.

VGR2988 gene encodes VGR2988 precursor RNA, herein designated VGR PRECURSOR RNA, an RNA molecule, typically several hundred nucleotides long.

VGR2988 precursor RNA folds spatially, forming VGR2988 folded precursor RNA, herein designated VGR FOLDED PRECURSOR RNA. It is appreciated that VGR2988 folded precursor RNA comprises a plurality of what is known in the art as 'hairpin' structures. These 'hairpin' structures are due to the fact that the nucleotide sequence of VGR2988 precursor RNA comprises a plurality of segments, the first half of each such segment having a nucleotide sequence which is at least a partial inversed-reversed sequence of the second half thereof, as is well known in the art.

VGR2988 folded precursor RNA is naturally processed by cellular enzymatic activity into at least 4 separate VGAM precursor RNAs, VGAM1162 precursor RNA, VGAM1163 precursor RNA, VGAM1164 precursor RNA and VGAM1165 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1162 RNA, VGAM1163 RNA, VGAM1164 RNA and VGAM1165 RNA, herein schematically represented by VGAM1 RNA through VGAM3 RNA, each of which VGAM RNAs corresponding to VGAM RNA of FIG. 1.

VGAM1162 RNA, herein schematically represented by VGAM1 RNA through VGAM3 RNA, binds complementarily to a host target binding site located in an untranslated region of VGAM1162 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1162 host target RNA into VGAM1162 host target protein, herein schematically represented by VGAM1 HOST TARGET PROTEIN through VGAM3 HOST TARGET PROTEIN, all of FIG. 1.

VGAM1163 RNA, herein schematically represented by VGAM1 RNA through VGAM3 RNA, binds complementarily to a host target binding site located in an untranslated region of VGAM1163 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1163 host target RNA into VGAM1163 host target protein, herein schematically represented by VGAM1 HOST TARGET PROTEIN through VGAM3 HOST TARGET PROTEIN, all of FIG. 1.

VGAM1164 RNA, herein schematically represented by VGAM1 RNA through VGAM3 RNA, binds complementarily to a host target binding site located in an untranslated region of VGAM1164 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1164 host target RNA into VGAM1164 host target protein, herein schematically represented by VGAM1 HOST TARGET PROTEIN through VGAM3 HOST TARGET PROTEIN, all of FIG. 1.

VGAM1165 RNA, herein schematically represented by VGAM1 RNA through VGAM3 RNA, binds complementarily to a host target binding site located in an untranslated region of VGAM1165 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1165 host target RNA into VGAM1165 host target protein, herein schematically represented by VGAM1 HOST TARGET PROTEIN through VGAM3 HOST TARGET PROTEIN, all of FIG. 1.

It is appreciated that a function of VGR2988 gene, herein designated VGR GENE, is inhibition of expression of host target genes, as part of a novel viral mechanism of attacking a host. Accordingly, utilities of VGR2988 gene include diagnosis, prevention and treatment of viral infection by Ectromelia Virus. Specific functions, and accordingly utilities, of VGR2988 gene correlate with, and may be deduced from, the identity of the host target genes, which are inhibited by VGAM RNAs comprised in the 'operon-like' cluster of VGR2988 gene: VGAM1162 host target protein, VGAM1163 host target protein, VGAM1164 host target protein and VGAM1165 host target protein, herein schematically represented by VGAM1 HOST TARGET PROTEIN through VGAM3 HOST TARGET PROTEIN. The function of these host target genes is elaborated hereinabove with reference to VGAM1162, VGAM1163, VGAM1164 and VGAM1165.

FIG. 9 further provides a conceptual description of novel bioinformatically detected regulatory viral gene, referred to here as Viral Genomic Record 2989(VGR2989) viral gene, which encodes an 'operon-like' cluster of novel viral micro RNA-like genes, each of which in turn modulates expression of at least one host target gene, the function and utility of which at least one host target gene is known in the art.

VGR2989 gene, herein designated VGR GENE, is a novel bioinformatically detected regulatory, non protein coding, RNA viral gene. The method by which VGR2989 gene was detected is described hereinabove with reference to FIGS. 1-9.

VGR2989 gene encodes VGR2989 precursor RNA, herein designated VGR PRECURSOR RNA, an RNA molecule, typically several hundred nucleotides long.

VGR2989 precursor RNA folds spatially, forming VGR2989 folded precursor RNA, herein designated VGR FOLDED PRECURSOR RNA. It is appreciated that VGR2989 folded precursor RNA comprises a plurality of what is known in the art as 'hairpin' structures. These 'hairpin' structures are due to the fact that the nucleotide sequence of VGR2989 precursor RNA comprises a plurality of segments, the first half of each such segment having a nucleotide sequence which is at least a partial inversed-reversed sequence of the second half thereof, as is well known in the art.

VGR2989 folded precursor RNA is naturally processed by cellular enzymatic activity into at least 2 separate VGAM precursor RNAs, VGAM1166 precursor RNA and VGAM1167 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1166 RNA and VGAM1167 RNA, herein schematically represented by VGAM1 RNA through VGAM3 RNA, each of which VGAM RNAs corresponding to VGAM RNA of FIG. 1.

VGAM1166 RNA, herein schematically represented by VGAM1 RNA through VGAM3 RNA, binds complementarily to a host target binding site located in an untranslated region of VGAM1166 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1166 host target RNA into VGAM1166 host target protein, herein schematically represented by VGAM1 HOST TARGET PROTEIN through VGAM3 HOST TARGET PROTEIN, all of FIG. 1.

VGAM1167 RNA, herein schematically represented by VGAM1 RNA through VGAM3 RNA, binds complementarily to a host target binding site located in an untranslated region of VGAM1167 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1167 host target RNA into VGAM1167 host target protein, herein schematically represented by VGAM1 HOST TARGET PROTEIN through VGAM3 HOST TARGET PROTEIN, all of FIG. 1.

It is appreciated that a function of VGR2989 gene, herein designated VGR GENE, is inhibition of expression of host target genes, as part of a novel viral mechanism of attacking a host. Accordingly, utilities of VGR2989 gene include diagnosis, prevention and treatment of viral infection by Cucumber Green Mottle Mosaic Virus. Specific functions, and accordingly utilities, of VGR2989 gene correlate with, and may be deduced from, the identity of the host target genes, which are inhibited by VGAM RNAs comprised in the 'operon-like' cluster of VGR2989 gene: VGAM1166 host target protein and VGAM1167 host target protein, herein schematically represented by VGAM1 HOST TARGET PROTEIN through VGAM3 HOST TARGET PROTEIN. The function of these host target genes is elaborated hereinabove with reference to VGAM1166 and VGAM1167. FIG. 9 further provides a conceptual description of novel bioinformatically detected regulatory viral gene, referred to here as Viral Genomic Record 2990(VGR2990) viral gene, which encodes an 'operon-like' cluster of novel viral micro RNA-like genes, each of which in turn modulates expression of at least one host target gene, the function and utility of which at least one host target gene is known in the art.

VGR2990 gene, herein designated VGR GENE, is a novel bioinformatically detected regulatory, non protein coding, RNA viral gene. The method by which VGR2990 gene was detected is described hereinabove with reference to FIGS. 1-9.

VGR2990 gene encodes VGR2990 precursor RNA, herein designated VGR PRECURSOR RNA, an RNA molecule, typically several hundred nucleotides long.

VGR2990 precursor RNA folds spatially, forming VGR2990 folded precursor RNA, herein designated VGR FOLDED PRECURSOR RNA. It is appreciated that VGR2990 folded precursor RNA comprises a plurality of what is known in the art as 'hairpin' structures. These 'hairpin' structures are due to the fact that the nucleotide sequence of VGR2990 precursor RNA comprises a plurality of segments, the first half of each such segment having a nucleotide sequence which is at least a partial inversed-reversed sequence of the second half thereof, as is well known in the art.

VGR2990 folded precursor RNA is naturally processed by cellular enzymatic activity into at least 2 separate VGAM precursor RNAs, VGAM1168 precursor RNA and VGAM1169 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1168 RNA and VGAM1169 RNA, herein schematically represented by VGAM1 RNA through VGAM3 RNA, each of which VGAM RNAs corresponding to VGAM RNA of FIG. 1.

VGAM1168 RNA, herein schematically represented by VGAM1 RNA through VGAM3 RNA, binds complementarily to a host target binding site located in an untranslated region of VGAM1168 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1168 host target RNA into VGAM1168 host target protein, herein schematically represented by VGAM1 HOST TARGET PROTEIN through VGAM3 HOST TARGET PROTEIN, all of FIG. 1.

VGAM1169 RNA, herein schematically represented by VGAM1 RNA through VGAM3 RNA, binds complementarily to a host target binding site located in an untranslated region of VGAM1169 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1169 host target RNA into VGAM1169 host target protein, herein schematically represented by VGAM1 HOST TARGET PROTEIN through VGAM3 HOST TARGET PROTEIN, all of FIG. 1.

It is appreciated that a function of VGR2990 gene, herein designated VGR GENE, is inhibition of expression of host target genes, as part of a novel viral mechanism of attacking a host. Accordingly, utilities of VGR2990 gene include diagnosis, prevention and treatment of viral infection by Rana Tigrina Ranavirus. Specific functions, and accordingly utilities, of VGR2990 gene correlate with, and may be deduced from, the identity of the host target genes, which are inhibited by VGAM RNAs comprised in the 'operon-like' cluster of VGR2990 gene: VGAM1168 host target protein and VGAM1169 host target protein, herein schematically represented by VGAM1 HOST TARGET PROTEIN through VGAM3 HOST TARGET PROTEIN. The function of these host target genes is elaborated hereinabove with reference to VGAM1168 and VGAM1169. FIG. 9 further provides a conceptual description of novel bioinformatically detected regulatory viral gene, referred to here as Viral Genomic Record 2991(VGR2991) viral gene, which encodes an 'operon-like' cluster of novel viral micro RNA-like genes, each of which in turn modulates expression of at least one host target gene, the function and utility of which at least one host target gene is known in the art.

VGR2991 gene, herein designated VGR GENE, is a novel bioinformatically detected regulatory, non protein coding, RNA viral gene. The method by which VGR2991 gene was detected is described hereinabove with reference to FIGS. 1-9.

VGR2991 gene encodes VGR2991 precursor RNA, herein designated VGR PRECURSOR RNA, an RNA molecule, typically several hundred nucleotides long.

VGR2991 precursor RNA folds spatially, forming VGR2991 folded precursor RNA, herein designated VGR FOLDED PRECURSOR RNA. It is appreciated that VGR2991 folded precursor RNA comprises a plurality of what is known in the art as 'hairpin' structures. These 'hairpin' structures are due to the fact that the nucleotide sequence of VGR2991 precursor RNA comprises a plurality of segments, the first half of each such segment having a nucleotide sequence which is at least a partial inversed-reversed sequence of the second half thereof, as is well known in the art.

VGR2991 folded precursor RNA is naturally processed by cellular enzymatic activity into at least 3 separate VGAM precursor RNAs, VGAM1171 precursor RNA, VGAM1172 precursor RNA and VGAM1173 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1171 RNA, VGAM1172 RNA and VGAM1173 RNA, herein schematically represented by VGAM1 RNA through VGAM3 RNA, each of which VGAM RNAs corresponding to VGAM RNA of FIG. 1.

VGAM1171 RNA, herein schematically represented by VGAM1 RNA through VGAM3 RNA, binds complementarily to a host target binding site located in an untranslated region of VGAM1171 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1171 host target RNA into VGAM1171 host target protein, herein schematically represented by VGAM1 HOST TARGET PROTEIN through VGAM3 HOST TARGET PROTEIN, all of FIG. 1.

VGAM1172 RNA, herein schematically represented by VGAM1 RNA through VGAM3 RNA, binds complementarily to a host target binding site located in an untranslated region of VGAM1172 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1172 host target RNA into VGAM1172 host target protein, herein schematically represented by VGAM1 HOST TARGET PROTEIN through VGAM3 HOST TARGET PROTEIN, all of FIG. 1.

VGAM1173 RNA, herein schematically represented by VGAM1 RNA through VGAM3 RNA, binds complementarily to a host target binding site located in an untranslated region of VGAM1173 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1173 host target RNA into VGAM1173 host target protein, herein schematically represented by VGAM1 HOST TARGET PROTEIN through VGAM3 HOST TARGET PROTEIN, all of FIG. 1.

It is appreciated that a function of VGR2991 gene, herein designated VGR GENE, is inhibition of expression of host target genes, as part of a novel viral mechanism of attacking a host. Accordingly, utilities of VGR2991 gene include diagnosis, prevention and treatment of viral infection by Cucumber Fruit Mottle Mosaic Virus. Specific functions, and accordingly utilities, of VGR2991 gene correlate with, and may be deduced from, the identity of the host target genes, which are inhibited by VGAM RNAs comprised in the 'operon-like' cluster of VGR2991 gene: VGAM1171 host target protein, VGAM1172 host target protein and VGAM1173 host target protein, herein schematically represented by VGAM1 HOST TARGET PROTEIN through VGAM3 HOST TARGET PROTEIN. The function of these host target genes is elaborated hereinabove with reference to VGAM1171, VGAM1172 and VGAM1173. FIG. 9 further provides a conceptual description of novel bioinformatically detected regulatory viral gene, referred to here as Viral Genomic Record 2992(VGR2992) viral gene, which encodes an 'operon-like' cluster of novel viral micro RNA-like genes, each of which in turn modulates expression of at least one host target gene, the function and utility of which at least one host target gene is known in the art.

VGR2992 gene, herein designated VGR GENE, is a novel bioinformatically detected regulatory, non protein coding, RNA viral gene. The method by which VGR2992 gene was detected is described hereinabove with reference to FIGS. 1-9.

VGR2992 gene encodes VGR2992 precursor RNA, herein designated VGR PRECURSOR RNA, an RNA molecule, typically several hundred nucleotides long.

VGR2992 precursor RNA folds spatially, forming VGR2992 folded precursor RNA, herein designated VGR FOLDED PRECURSOR RNA. It is appreciated that VGR2992 folded precursor RNA comprises a plurality of what is known in the art as 'hairpin' structures. These 'hairpin' structures are due to the fact that the nucleotide sequence of VGR2992 precursor RNA comprises a plurality of segments, the first half of each such segment having a nucleotide sequence which is at least a partial inversed-reversed sequence of the second half thereof, as is well known in the art.

VGR2992 folded precursor RNA is naturally processed by cellular enzymatic activity into at least 3 separate VGAM precursor RNAs, VGAM1174 precursor RNA, VGAM1175 precursor RNA and VGAM1176 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1174 RNA, VGAM1175 RNA and VGAM1176 RNA, herein schematically represented by VGAM1 RNA through VGAM3 RNA, each of which VGAM RNAs corresponding to VGAM RNA of FIG. 1.

VGAM1174 RNA, herein schematically represented by VGAM1 RNA through VGAM3 RNA, binds complementarily to a host target binding site located in an untranslated region of VGAM1174 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1174 host target RNA into VGAM1174 host target protein, herein schematically represented by VGAM1 HOST TARGET PROTEIN through VGAM3 HOST TARGET PROTEIN, all of FIG. 1.

VGAM1175 RNA, herein schematically represented by VGAM1 RNA through VGAM3 RNA, binds complementarily to a host target binding site located in an untranslated region of VGAM1175 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1175 host target RNA into VGAM1175 host target protein, herein schematically represented by VGAM1 HOST TARGET PROTEIN through VGAM3 HOST TARGET PROTEIN, all of FIG. 1.

VGAM1176 RNA, herein schematically represented by VGAM1 RNA through VGAM3 RNA, binds complementarily to a host target binding site located in an untranslated region of VGAM1176 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1176 host target RNA into VGAM1176 host target protein, herein schematically represented by VGAM1 HOST TARGET PROTEIN through VGAM3 HOST TARGET PROTEIN, all of FIG. 1.

It is appreciated that a function of VGR2992 gene, herein designated VGR GENE, is inhibition of expression of host target genes, as part of a novel viral mechanism of attacking a host. Accordingly, utilities of VGR2992 gene include diagnosis, prevention and treatment of viral infection by Rift Valley Fever Virus. Specific functions, and accordingly utilities, of VGR2992 gene correlate with, and may be deduced from, the identity of the host target genes, which are inhibited by VGAM RNAs comprised in the 'operon-like' cluster of VGR2992 gene: VGAM1174 host target protein, VGAM1175 host target protein and VGAM1176 host target protein, herein schematically represented by VGAM1 HOST TARGET PROTEIN through VGAM3 HOST TARGET PROTEIN. The function of these host target genes is elaborated hereinabove with reference to VGAM1174, VGAM1175 and VGAM1176. FIG. 9 further provides a conceptual description of novel bioinformatically detected regulatory viral gene, referred to here as Viral Genomic Record 2993(VGR2993) viral gene, which encodes an 'operon-like' cluster of novel viral micro RNA-like genes, each of which in turn modulates expression of at least one host target gene, the function and utility of which at least one host target gene is known in the art.

VGR2993 gene, herein designated VGR GENE, is a novel bioinformatically detected regulatory, non protein coding, RNA viral gene. The method by which VGR2993 gene was detected is described hereinabove with reference to FIGS. 1-9.

VGR2993 gene encodes VGR2993 precursor RNA, herein designated VGR PRECURSOR RNA, an RNA molecule, typically several hundred nucleotides long.

VGR2993 precursor RNA folds spatially, forming VGR2993 folded precursor RNA, herein designated VGR FOLDED PRECURSOR RNA. It is appreciated that VGR2993 folded precursor RNA comprises a plurality of what is known in the art as 'hairpin' structures. These 'hairpin' structures are due to the fact that the nucleotide sequence of VGR2993 precursor RNA comprises a plurality of segments, the first half of each such segment having a nucleotide sequence which is at least a partial inversed-reversed sequence of the second half thereof, as is well known in the art.

VGR2993 folded precursor RNA is naturally processed by cellular enzymatic activity into at least 5 separate VGAM precursor RNAs, VGAM1177 precursor RNA, VGAM1178 precursor RNA, VGAM1179 precursor RNA, VGAM1180 precursor RNA and VGAM1181 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1177 RNA, VGAM1178 RNA, VGAM1179 RNA, VGAM1180 RNA and VGAM1181 RNA, herein schematically represented by VGAM1 RNA through VGAM3 RNA, each of which VGAM RNAs corresponding to VGAM RNA of FIG. 1.

VGAM1177 RNA, herein schematically represented by VGAM1 RNA through VGAM3 RNA, binds complementarily to a host target binding site located in an untranslated region of VGAM1177 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1177 host target RNA into VGAM1177 host target protein, herein schematically represented by VGAM1 HOST TARGET PROTEIN through VGAM3 HOST TARGET PROTEIN, all of FIG. 1.

VGAM1178 RNA, herein schematically represented by VGAM1 RNA through VGAM3 RNA, binds complementarily to a host target binding site located in an untranslated region of VGAM1178 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1178 host target RNA into VGAM1178 host target protein, herein schematically represented by VGAM1 HOST TARGET PROTEIN through VGAM3 HOST TARGET PROTEIN, all of FIG. 1.

VGAM1179 RNA, herein schematically represented by VGAM1 RNA through VGAM3 RNA, binds complementarily to a host target binding site located in an untranslated region of VGAM1179 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1179 host target RNA into VGAM1179 host target protein, herein schematically represented by VGAM1 HOST TARGET PROTEIN through VGAM3 HOST TARGET PROTEIN, all of FIG. 1.

VGAM1180 RNA, herein schematically represented by VGAM1 RNA through VGAM3 RNA, binds complementarily to a host target binding site located in an untranslated region of VGAM1180 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1180 host target RNA into VGAM1180 host target protein, herein schematically represented by VGAM1 HOST TARGET PROTEIN through VGAM3 HOST TARGET PROTEIN, all of FIG. 1.

VGAM1181 RNA, herein schematically represented by VGAM1 RNA through VGAM3 RNA, binds complementarily to a host target binding site located in an untranslated region of VGAM1181 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1181 host target RNA into VGAM1181 host target protein, herein schematically represented by VGAM1 HOST TARGET PROTEIN through VGAM3 HOST TARGET PROTEIN, all of FIG. 1.

It is appreciated that a function of VGR2993 gene, herein designated VGR GENE, is inhibition of expression of host target genes, as part of a novel viral mechanism of attacking a host. Accordingly, utilities of VGR2993 gene include diagnosis, prevention and treatment of viral infection by Odontoglossum Ringspot Virus. Specific functions, and accordingly utilities, of VGR2993 gene correlate with, and may be deduced from, the identity of the host target genes, which are inhibited by VGAM RNAs comprised in the 'operon-like' cluster of VGR2993 gene: VGAM1177 host target protein, VGAM1178 host target protein, VGAM1179 host target protein, VGAM1180 host target protein and VGAM1181 host target protein, herein schematically represented by VGAM1 HOST TARGET PROTEIN through VGAM3 HOST TARGET PROTEIN. The function of these host target genes is elaborated hereinabove with reference to VGAM1177, VGAM1178, VGAM1179, VGAM1180 and VGAM1181. FIG. 9 further provides a conceptual description of novel bioinformatically detected regulatory viral gene, referred to here as Viral Genomic Record 2994(VGR2994) viral gene, which encodes an 'operon-like' cluster of novel viral micro RNA-like genes, each of which in turn modulates expression of at least one host target gene, the function and utility of which at least one host target gene is known in the art.

VGR2994 gene, herein designated VGR GENE, is a novel bioinformatically detected regulatory, non protein coding, RNA viral gene. The method by which VGR2994 gene was detected is described hereinabove with reference to FIGS. 1-9.

VGR2994 gene encodes VGR2994 precursor RNA, herein designated VGR PRECURSOR RNA, an RNA molecule, typically several hundred nucleotides long.

VGR2994 precursor RNA folds spatially, forming VGR2994 folded precursor RNA, herein designated VGR FOLDED PRECURSOR RNA. It is appreciated that VGR2994 folded precursor RNA comprises a plurality of what is known in the art as 'hairpin' structures. These 'hairpin' structures are due to the fact that the nucleotide sequence of VGR2994 precursor RNA comprises a plurality of segments, the first half of each such segment having a nucleotide sequence which is at least a partial inversed-reversed sequence of the second half thereof, as is well known in the art.

VGR2994 folded precursor RNA is naturally processed by cellular enzymatic activity into at least 3 separate VGAM precursor RNAs, VGAM1183 precursor RNA, VGAM1184 precursor RNA and VGAM1185 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1183 RNA, VGAM1184 RNA and VGAM1185 RNA, herein schematically represented by VGAM1 RNA through VGAM3 RNA, each of which VGAM RNAs corresponding to VGAM RNA of FIG. 1.

VGAM1183 RNA, herein schematically represented by VGAM1 RNA through VGAM3 RNA, binds complementarily to a host target binding site located in an untranslated region of VGAM1183 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1183 host target RNA into VGAM1183 host target protein, herein schematically represented by VGAM1 HOST TARGET PROTEIN through VGAM3 HOST TARGET PROTEIN, all of FIG. 1.

VGAM1184 RNA, herein schematically represented by VGAM1 RNA through VGAM3 RNA, binds complementarily to a host target binding site located in an untranslated region of VGAM1184 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1184 host target RNA into VGAM1184 host target protein, herein schematically represented by VGAM1 HOST TARGET PROTEIN through VGAM3 HOST TARGET PROTEIN, all of FIG. 1.

VGAM1185 RNA, herein schematically represented by VGAM1 RNA through VGAM3 RNA, binds complementarily to a host target binding site located in an untranslated region of VGAM1185 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1185 host target RNA into VGAM1185 host target protein, herein schematically represented by VGAM1 HOST TARGET PROTEIN through VGAM3 HOST TARGET PROTEIN, all of FIG. 1.

It is appreciated that a function of VGR2994 gene, herein designated VGR GENE, is inhibition of expression of host target genes, as part of a novel viral mechanism of attacking a host. Accordingly, utilities of VGR2994 gene include diagnosis, prevention and treatment of viral infection by Cactus Virus X. Specific functions, and accordingly utilities, of VGR2994 gene correlate with, and may be deduced from, the identity of the host target genes, which are inhibited by VGAM RNAs comprised in the 'operon-like' cluster of VGR2994 gene: VGAM1183 host target protein, VGAM1184 host target protein and VGAM1185 host target protein, herein schematically represented by VGAM1 HOST TARGET PROTEIN through VGAM3 HOST TARGET PROTEIN. The function of these host target genes is elaborated hereinabove with reference to VGAM1183, VGAM1184 and VGAM1185. FIG. 9 further provides a conceptual description of novel bioinformatically detected regulatory viral gene, referred to here as Viral Genomic Record 2995(VGR2995) viral gene, which encodes an 'operon-like' cluster of novel viral micro RNA-like genes, each of which in turn modulates expression of at least one host target gene, the function and utility of which at least one host target gene is known in the art.

VGR2995 gene, herein designated VGR GENE, is a novel bioinformatically detected regulatory, non protein coding, RNA viral gene. The method by which VGR2995 gene was detected is described hereinabove with reference to FIGS. 1-9.

VGR2995 gene encodes VGR2995 precursor RNA, herein designated VGR PRECURSOR RNA, an RNA molecule, typically several hundred nucleotides long.

VGR2995 precursor RNA folds spatially, forming VGR2995 folded precursor RNA, herein designated VGR FOLDED PRECURSOR RNA. It is appreciated that VGR2995 folded precursor RNA comprises a plurality of what is known in the art as 'hairpin' structures. These 'hairpin' structures are due to the fact that the nucleotide sequence of VGR2995 precursor RNA comprises a plurality of segments, the first half of each such segment having a nucleotide sequence which is at least a partial inversed-reversed sequence of the second half thereof, as is well known in the art.

VGR2995 folded precursor RNA is naturally processed by cellular enzymatic activity into at least 3 separate VGAM precursor RNAs, VGAM1186 precursor RNA, VGAM1187 precursor RNA and VGAM1188 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1186 RNA, VGAM1187 RNA and VGAM1188 RNA, herein schematically represented by VGAM1 RNA through VGAM3 RNA, each of which VGAM RNAs corresponding to VGAM RNA of FIG. 1.

VGAM1186 RNA, herein schematically represented by VGAM1 RNA through VGAM3 RNA, binds complementarily to a host target binding site located in an untranslated region of VGAM1186 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1186 host target RNA into VGAM1186 host target protein, herein schematically represented by VGAM1 HOST TARGET PROTEIN through VGAM3 HOST TARGET PROTEIN, all of FIG. 1.

VGAM1187 RNA, herein schematically represented by VGAM1 RNA through VGAM3 RNA, binds complementarily to a host target binding site located in an untranslated region of VGAM1187 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1187 host target RNA into VGAM1187 host target protein, herein schematically represented by VGAM1 HOST TARGET PROTEIN through VGAM3 HOST TARGET PROTEIN, all of FIG. 1.

VGAM1188 RNA, herein schematically represented by VGAM1 RNA through VGAM3 RNA, binds complementarily to a host target binding site located in an untranslated region of VGAM1188 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1188 host target RNA into VGAM1188 host target protein, herein schematically represented by VGAM1 HOST TARGET PROTEIN through VGAM3 HOST TARGET PROTEIN, all of FIG. 1.

It is appreciated that a function of VGR2995 gene, herein designated VGR GENE, is inhibition of expression of host target genes, as part of a novel viral mechanism of attacking a host. Accordingly, utilities of VGR2995 gene include diagnosis, prevention and treatment of viral infection by Human Adenovirus C. Specific functions, and accordingly utilities, of VGR2995 gene correlate with, and may be deduced from, the identity of the host target genes, which are inhibited by VGAM RNAs comprised in the 'operon-like' cluster of VGR2995 gene: VGAM1186 host target protein, VGAM1187 host target protein and VGAM1188 host target protein, herein schematically represented by VGAM1 HOST TARGET PROTEIN through VGAM3 HOST TARGET PROTEIN. The function of these host target genes is elaborated hereinabove with reference to VGAM1186, VGAM1187 and VGAM1188. FIG. 9 further provides a conceptual description of novel bioinformatically detected regulatory viral gene, referred to here as Viral Genomic Record 2996(VGR2996) viral gene, which encodes an 'operon-like' cluster of novel viral micro RNA-like genes, each of which in turn modulates expression of at least one host target gene, the function and utility of which at least one host target gene is known in the art.

VGR2996 gene, herein designated VGR GENE, is a novel bioinformatically detected regulatory, non protein coding, RNA viral gene. The method by which VGR2996 gene was detected is described hereinabove with reference to FIGS. 1-9.

VGR2996 gene encodes VGR2996 precursor RNA, herein designated VGR PRECURSOR RNA, an RNA molecule, typically several hundred nucleotides long.

VGR2996 precursor RNA folds spatially, forming VGR2996 folded precursor RNA, herein designated VGR FOLDED PRECURSOR RNA. It is appreciated that VGR2996 folded precursor RNA comprises a plurality of what is known in the art as 'hairpin' structures. These 'hairpin' structures are due to the fact that the nucleotide sequence of VGR2996 precursor RNA comprises a plurality of segments, the first half of each such segment having a nucleotide sequence which is at least a partial inversed-reversed sequence of the second half thereof, as is well known in the art.

VGR2996 folded precursor RNA is naturally processed by cellular enzymatic activity into at least 3 separate VGAM precursor RNAs, VGAM1189 precursor RNA, VGAM1190 precursor RNA and VGAM1191 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1189 RNA, VGAM1190 RNA and VGAM1191 RNA, herein schematically represented by VGAM1 RNA through VGAM3 RNA, each of which VGAM RNAs corresponding to VGAM RNA of FIG. 1.

VGAM1189 RNA, herein schematically represented by VGAM1 RNA through VGAM3 RNA, binds complementarily to a host target binding site located in an untranslated region of VGAM1189 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1189 host target RNA into VGAM1189 host target protein, herein schematically represented by VGAM1 HOST TARGET PROTEIN through VGAM3 HOST TARGET PROTEIN, all of FIG. 1.

VGAM1190 RNA, herein schematically represented by VGAM1 RNA through VGAM3 RNA, binds complementarily to a host target binding site located in an untranslated region of VGAM1190 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1190 host target RNA into VGAM1190 host target protein, herein schematically represented by VGAM1 HOST TARGET PROTEIN through VGAM3 HOST TARGET PROTEIN, all of FIG. 1.

VGAM1191 RNA, herein schematically represented by VGAM1 RNA through VGAM3 RNA, binds complementarily to a host target binding site located in an untranslated region of VGAM1191 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1191 host target RNA into VGAM1191 host target protein, herein schematically represented by VGAM1 HOST TARGET PROTEIN through VGAM3 HOST TARGET PROTEIN, all of FIG. 1.

It is appreciated that a function of VGR2996 gene, herein designated VGR GENE, is inhibition of expression of host target genes, as part of a novel viral mechanism of attacking a host. Accordingly, utilities of VGR2996 gene include diagnosis, prevention and treatment of viral infection by Botrytis Virus F. Specific functions, and accordingly utilities, of VGR2996 gene correlate with, and may be deduced from, the identity of the host target genes, which are inhibited by VGAM RNAs comprised in the 'operon-like' cluster of VGR2996 gene: VGAM1189 host target protein, VGAM1190 host target protein and VGAM1191 host target protein, herein schematically represented by VGAM1 HOST TARGET PROTEIN through VGAM3 HOST TARGET PROTEIN. The function of these host target genes is elaborated hereinabove with reference to VGAM1189, VGAM1190 and VGAM1191. FIG. 9 further provides a conceptual description of novel bioinformatically detected regulatory viral gene, referred to here as Viral Genomic Record 2997(VGR2997) viral gene, which encodes an 'operon-like' cluster of novel viral micro RNA-like genes, each of which in turn modulates expression of at least one host target gene, the function and utility of which at least one host target gene is known in the art.

VGR2997 gene, herein designated VGR GENE, is a novel bioinformatically detected regulatory, non protein coding, RNA viral gene. The method by which VGR2997 gene was detected is described hereinabove with reference to FIGS. 1-9.

VGR2997 gene encodes VGR2997 precursor RNA, herein designated VGR PRECURSOR RNA, an RNA molecule, typically several hundred nucleotides long.

VGR2997 precursor RNA folds spatially, forming VGR2997 folded precursor RNA, herein designated VGR FOLDED PRECURSOR RNA. It is appreciated that VGR2997 folded precursor RNA comprises a plurality of what is known in the art as 'hairpin' structures. These 'hairpin' structures are due to the fact that the nucleotide sequence of VGR2997 precursor RNA comprises a plurality of segments, the first half of each such segment having a nucleotide sequence which is at least a partial inversed-reversed sequence of the second half thereof, as is well known in the art.

VGR2997 folded precursor RNA is naturally processed by cellular enzymatic activity into at least 3 separate VGAM precursor RNAs, VGAM1192 precursor RNA, VGAM1193 precursor RNA and VGAM1194 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1192 RNA, VGAM1193 RNA and VGAM1194 RNA, herein schematically represented by VGAM1 RNA through VGAM3 RNA, each of which VGAM RNAs corresponding to VGAM RNA of FIG. 1.

VGAM1192 RNA, herein schematically represented by VGAM1 RNA through VGAM3 RNA, binds complementarily to a host target binding site located in an untranslated region of VGAM1192 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1192 host target RNA into VGAM1192 host target protein, herein schematically represented by VGAM1 HOST TARGET PROTEIN through VGAM3 HOST TARGET PROTEIN, all of FIG. 1.

VGAM1193 RNA, herein schematically represented by VGAM1 RNA through VGAM3 RNA, binds complementarily to a host target binding site located in an untranslated region of VGAM1193 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1193 host target RNA into VGAM1193 host target protein, herein schematically represented by VGAM1 HOST TARGET PROTEIN through VGAM3 HOST TARGET PROTEIN, all of FIG. 1.

VGAM1194 RNA, herein schematically represented by VGAM1 RNA through VGAM3 RNA, binds complementarily to a host target binding site located in an untranslated region of VGAM1194 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1194 host target RNA into VGAM1194 host target protein, herein schematically represented by VGAM1 HOST TARGET PROTEIN through VGAM3 HOST TARGET PROTEIN, all of FIG. 1.

It is appreciated that a function of VGR2997 gene, herein designated VGR GENE, is inhibition of expression of host target genes, as part of a novel viral mechanism of attacking a host. Accordingly, utilities of VGR2997 gene include diagnosis, prevention and treatment of viral infection by Cowpox Virus. Specific functions, and accordingly utilities, of VGR2997 gene correlate with, and may be deduced from, the identity of the host target genes, which are inhibited by VGAM RNAs comprised in the 'operon-like' cluster of VGR2997 gene: VGAM1192 host target protein, VGAM1193 host target protein and VGAM1194 host target protein, herein schematically represented by VGAM1 HOST TARGET PROTEIN through VGAM3 HOST TARGET PROTEIN. The function of these host target genes is elaborated hereinabove with reference to VGAM1192, VGAM1193 and VGAM1194. FIG. 9 further provides a conceptual description of novel bioinformatically detected regulatory viral gene, referred to here as Viral Genomic Record 2998(VGR2998) viral gene, which encodes an 'operon-like' cluster of novel viral micro RNA-like genes, each of which in turn modulates expression of at least one host target gene, the function and utility of which at least one host target gene is known in the art.

VGR2998 gene, herein designated VGR GENE, is a novel bioinformatically detected regulatory, non protein coding, RNA viral gene. The method by which VGR2998 gene was detected is described hereinabove with reference to FIGS. 1-9.

VGR2998 gene encodes VGR2998 precursor RNA, herein designated VGR PRECURSOR RNA, an RNA molecule, typically several hundred nucleotides long.

VGR2998 precursor RNA folds spatially, forming VGR2998 folded precursor RNA, herein designated VGR FOLDED PRECURSOR RNA. It is appreciated that VGR2998 folded precursor RNA comprises a plurality of what is known in the art as 'hairpin' structures. These 'hairpin' structures are due to the fact that the nucleotide sequence of VGR2998 precursor RNA comprises a plurality of segments, the first half of each such segment having a nucleotide sequence which is at least a partial inversed-reversed sequence of the second half thereof, as is well known in the art.

VGR2998 folded precursor RNA is naturally processed by cellular enzymatic activity into at least 4 separate VGAM precursor RNAs, VGAM1195 precursor RNA, VGAM1196 precursor RNA, VGAM1197 precursor RNA and VGAM1198 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1195 RNA, VGAM1196 RNA, VGAM1197 RNA and VGAM1198 RNA, herein schematically represented by VGAM1 RNA through VGAM3 RNA, each of which VGAM RNAs corresponding to VGAM RNA of FIG. 1.

VGAM1195 RNA, herein schematically represented by VGAM1 RNA through VGAM3 RNA, binds complementarily to a host target binding site located in an untranslated region of VGAM1195 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1195 host target RNA into VGAM1195 host target protein, herein schematically represented by VGAM1 HOST TARGET PROTEIN through VGAM3 HOST TARGET PROTEIN, all of FIG. 1.

VGAM1196 RNA, herein schematically represented by VGAM1 RNA through VGAM3 RNA, binds complementarily to a host target binding site located in an untranslated region of VGAM1196 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1196 host target RNA into VGAM1196 host target protein, herein schematically represented by VGAM1 HOST TARGET PROTEIN through VGAM3 HOST TARGET PROTEIN, all of FIG. 1.

VGAM1197 RNA, herein schematically represented by VGAM1 RNA through VGAM3 RNA, binds complementarily to a host target binding site located in an untranslated region of VGAM1197 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1197 host target RNA into VGAM1197 host target protein, herein schematically represented by VGAM1 HOST TARGET PROTEIN through VGAM3 HOST TARGET PROTEIN, all of FIG. 1.

VGAM1198 RNA, herein schematically represented by VGAM1 RNA through VGAM3 RNA, binds complementarily to a host target binding site located in an untranslated region of VGAM1198 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1198 host target RNA into VGAM1198 host target protein, herein schematically represented by VGAM1 HOST TARGET PROTEIN through VGAM3 HOST TARGET PROTEIN, all of FIG. 1.

It is appreciated that a function of VGR2998 gene, herein designated VGR GENE, is inhibition of expression of host target genes, as part of a novel viral mechanism of attacking a host. Accordingly, utilities of VGR2998 gene include diagnosis, prevention and treatment of viral infection by Equine Herpesvirus 1. Specific functions, and accordingly utilities, of VGR2998 gene correlate with, and may be deduced from, the identity of the host target genes, which are inhibited by VGAM RNAs comprised in the 'operon-like' cluster of VGR2998 gene: VGAM1195 host target protein, VGAM1196 host target protein, VGAM1197 host target protein and VGAM1198 host target protein, herein schematically represented by VGAM1 HOST TARGET PROTEIN through VGAM3 HOST TARGET PROTEIN. The function of these host target genes is elaborated hereinabove with reference to VGAM1195, VGAM1196, VGAM1197 and VGAM1198.

FIG. 9 further provides a conceptual description of novel bioinformatically detected regulatory viral gene, referred to here as Viral Genomic Record 2999(VGR2999) viral gene, which encodes an 'operon-like' cluster of novel viral micro RNA-like genes, each of which in turn modulates expression of at least one host target gene, the function and utility of which at least one host target gene is known in the art.

VGR2999 gene, herein designated VGR GENE, is a novel bioinformatically detected regulatory, non protein coding, RNA viral gene. The method by which VGR2999 gene was detected is described hereinabove with reference to FIGS. 1-9.

VGR2999 gene encodes VGR2999 precursor RNA, herein designated VGR PRECURSOR RNA, an RNA molecule, typically several hundred nucleotides long.

VGR2999 precursor RNA folds spatially, forming VGR2999 folded precursor RNA, herein designated VGR FOLDED PRECURSOR RNA. It is appreciated that VGR2999 folded precursor RNA comprises a plurality of what is known in the art as 'hairpin' structures. These 'hairpin' structures are due to the fact that the nucleotide sequence of VGR2999 precursor RNA comprises a plurality of segments, the first half of each such segment having a nucleotide sequence which is at least a partial inversed-reversed sequence of the second half thereof, as is well known in the art.

VGR2999 folded precursor RNA is naturally processed by cellular enzymatic activity into at least 4 separate VGAM precursor RNAs, VGAM1199 precursor RNA, VGAM1200 precursor RNA, VGAM1201 precursor RNA and VGAM1202 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1199 RNA, VGAM1200 RNA, VGAM1201 RNA and VGAM1202 RNA, herein schematically represented by VGAM1 RNA through VGAM3 RNA, each of which VGAM RNAs corresponding to VGAM RNA of FIG. 1.

VGAM1199 RNA, herein schematically represented by VGAM1 RNA through VGAM3 RNA, binds complementarily to a host target binding site located in an untranslated region of VGAM1199 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1199 host target RNA into VGAM1199 host target protein, herein schematically represented by VGAM1 HOST TARGET PROTEIN through VGAM3 HOST TARGET PROTEIN, all of FIG. 1.

VGAM1200 RNA, herein schematically represented by VGAM1 RNA through VGAM3 RNA, binds complementarily to a host target binding site located in an untranslated region of VGAM1200 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1200 host target RNA into VGAM1200 host target protein, herein schematically represented by VGAM1 HOST TARGET PROTEIN through VGAM3 HOST TARGET PROTEIN, all of FIG. 1.

VGAM1201 RNA, herein schematically represented by VGAM1 RNA through VGAM3 RNA, binds complementarily to a host target binding site located in an untranslated region of VGAM1201 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1201 host target RNA into VGAM1201 host target protein, herein schematically represented by VGAM1 HOST TARGET PROTEIN through VGAM3 HOST TARGET PROTEIN, all of FIG. 1.

VGAM1202 RNA, herein schematically represented by VGAM1 RNA through VGAM3 RNA, binds complementarily to a host target binding site located in an untranslated region of VGAM1202 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1202 host target RNA into VGAM1202 host target protein, herein schematically represented by VGAM1 HOST TARGET PROTEIN through VGAM3 HOST TARGET PROTEIN, all of FIG. 1.

It is appreciated that a function of VGR2999 gene, herein designated VGR GENE, is inhibition of expression of host target genes, as part of a novel viral mechanism of attacking a host. Accordingly, utilities of VGR2999 gene include diagnosis, prevention and treatment of viral infection by Avian Nephritis Virus. Specific functions, and accordingly utilities, of VGR2999 gene correlate with, and may be deduced from, the identity of the host target genes, which are inhibited by VGAM RNAs comprised in the 'operon-like' cluster of VGR2999 gene: VGAM1199 host target protein, VGAM1200 host target protein, VGAM1201 host target protein and VGAM1202 host target protein, herein schematically represented by VGAM1 HOST TARGET PROTEIN through VGAM3 HOST TARGET PROTEIN. The function of these host target genes is elaborated hereinabove with reference to VGAM1199, VGAM1200, VGAM1201 and VGAM1202. FIG. 9 further provides a conceptual description of novel bioinformatically detected regulatory viral gene, referred to here as Viral Genomic Record 3000(VGR3000) viral gene, which encodes an 'operon-like' cluster of novel viral micro RNA-like genes, each of which in turn modulates expression of at least one host target gene, the function and utility of which at least one host target gene is known in the art.

VGR3000 gene, herein designated VGR GENE, is a novel bioinformatically detected regulatory, non protein coding, RNA viral gene. The method by which VGR3000 gene was detected is described hereinabove with reference to FIGS. 1-9.

VGR3000 gene encodes VGR3000 precursor RNA, herein designated VGR PRECURSOR RNA, an RNA molecule, typically several hundred nucleotides long.

VGR3000 precursor RNA folds spatially, forming VGR3000 folded precursor RNA, herein designated VGR FOLDED PRECURSOR RNA. It is appreciated that VGR3000 folded precursor RNA comprises a plurality of what is known in the art as 'hairpin' structures. These 'hairpin' structures are due to the fact that the nucleotide sequence of VGR3000 precursor RNA comprises a plurality of segments, the first half of each such segment having a nucleotide sequence which is at least a partial inversed-reversed sequence of the second half thereof, as is well known in the art.

VGR3000 folded precursor RNA is naturally processed by cellular enzymatic activity into at least 3 separate VGAM precursor RNAs, VGAM1203 precursor RNA, VGAM1204 precursor RNA and VGAM1205 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1203 RNA, VGAM1204 RNA and VGAM1205 RNA, herein schematically represented by VGAM1 RNA through VGAM3 RNA, each of which VGAM RNAs corresponding to VGAM RNA of FIG. 1.

VGAM1203 RNA, herein schematically represented by VGAM1 RNA through VGAM3 RNA, binds complementarily to a host target binding site located in an untranslated region of VGAM1203 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1203 host target RNA into VGAM1203 host target protein, herein schematically represented by VGAM1 HOST TARGET PROTEIN through VGAM3 HOST TARGET PROTEIN, all of FIG. 1.

VGAM1204 RNA, herein schematically represented by VGAM1 RNA through VGAM3 RNA, binds complementarily to a host target binding site located in an untranslated region of VGAM1204 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1204 host target RNA into VGAM1204 host target protein, herein schematically represented by VGAM1 HOST TARGET PROTEIN through VGAM3 HOST TARGET PROTEIN, all of FIG. 1.

VGAM1205 RNA, herein schematically represented by VGAM1 RNA through VGAM3 RNA, binds complementarily to a host target binding site located in an untranslated region of VGAM1205 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1205 host target RNA into VGAM1205 host target protein, herein schematically represented by VGAM1 HOST TARGET PROTEIN through VGAM3 HOST TARGET PROTEIN, all of FIG. 1.

It is appreciated that a function of VGR3000 gene, herein designated VGR GENE, is inhibition of expression of host target genes, as part of a novel viral mechanism of attacking a host. Accordingly, utilities of VGR3000 gene include diagnosis, prevention and treatment of viral infection by Scallion Virus X. Specific functions, and accordingly utilities, of VGR3000 gene correlate with, and may be deduced from, the identity of the host target genes, which are inhibited by VGAM RNAs comprised in the 'operon-like' cluster of VGR3000 gene: VGAM1203 host target protein, VGAM1204 host target protein and VGAM1205 host target protein, herein schematically represented by VGAM1 HOST TARGET PROTEIN through VGAM3 HOST TARGET PROTEIN. The function of these host target genes is elaborated hereinabove with reference to VGAM1203, VGAM1204 and VGAM1205. FIG. 9 further provides a conceptual description of novel bioinformatically detected regulatory viral gene, referred to here as Viral Genomic Record 3001(VGR3001) viral gene, which encodes an 'operon-like' cluster of novel viral micro RNA-like genes, each of which in turn modulates expression of at least one host target gene, the function and utility of which at least one host target gene is known in the art.

VGR3001 gene, herein designated VGR GENE, is a novel bioinformatically detected regulatory, non protein coding, RNA viral gene. The method by which VGR3001 gene was detected is described hereinabove with reference to FIGS. 1-9.

VGR3001 gene encodes VGR3001 precursor RNA, herein designated VGR PRECURSOR RNA, an RNA molecule, typically several hundred nucleotides long.

VGR3001 precursor RNA folds spatially, forming VGR3001 folded precursor RNA, herein designated VGR FOLDED PRECURSOR RNA. It is appreciated that VGR3001 folded precursor RNA comprises a plurality of what is known in the art as 'hairpin' structures. These 'hairpin' structures are due to the fact that the nucleotide sequence of VGR3001 precursor RNA comprises a plurality of segments, the first half of each such segment having a nucleotide sequence which is at least a partial inversed-reversed sequence of the second half thereof, as is well known in the art.

VGR3001 folded precursor RNA is naturally processed by cellular enzymatic activity into at least 4 separate VGAM precursor RNAs, VGAM1206 precursor RNA, VGAM1207 precursor RNA, VGAM1208 precursor RNA and VGAM1209 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1206 RNA, VGAM1207 RNA, VGAM1208 RNA and VGAM1209 RNA, herein schematically represented by VGAM1 RNA through VGAM3 RNA, each of which VGAM RNAs corresponding to VGAM RNA of FIG. 1.

VGAM1206 RNA, herein schematically represented by VGAM1 RNA through VGAM3 RNA, binds complementarily to a host target binding site located in an untranslated region of VGAM1206 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1206 host target RNA into VGAM1206 host target protein, herein schematically represented by VGAM1 HOST TARGET PROTEIN through VGAM3 HOST TARGET PROTEIN, all of FIG. 1.

VGAM1207 RNA, herein schematically represented by VGAM1 RNA through VGAM3 RNA, binds complementarily to a host target binding site located in an untranslated region of VGAM1207 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1207 host target RNA into VGAM1207 host target protein, herein schematically represented by VGAM1 HOST TARGET PROTEIN through VGAM3 HOST TARGET PROTEIN, all of FIG. 1.

VGAM1208 RNA, herein schematically represented by VGAM1 RNA through VGAM3 RNA, binds complementarily to a host target binding site located in an untranslated region of VGAM1208 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1208 host target RNA into VGAM1208 host target protein, herein schematically represented by VGAM1 HOST TARGET PROTEIN through VGAM3 HOST TARGET PROTEIN, all of FIG. 1.

VGAM1209 RNA, herein schematically represented by VGAM1 RNA through VGAM3 RNA, binds complementarily to a host target binding site located in an untranslated region of VGAM1209 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1209 host target RNA into VGAM1209 host target protein, herein schematically represented by VGAM1 HOST TARGET PROTEIN through VGAM3 HOST TARGET PROTEIN, all of FIG. 1.

It is appreciated that a function of VGR3001 gene, herein designated VGR GENE, is inhibition of expression of host target genes, as part of a novel viral mechanism of attacking a host. Accordingly, utilities of VGR3001 gene include diagnosis, prevention and treatment of viral infection by Clover Yellow Mosaic Virus. Specific functions, and accordingly utilities, of VGR3001 gene correlate with, and may be deduced from, the identity of the host target genes, which are inhibited by VGAM RNAs comprised in the 'operon-like' cluster of VGR3001 gene: VGAM1206 host target protein, VGAM1207 host target protein, VGAM1208 host target protein and VGAM1209 host target protein, herein schematically represented by VGAM1 HOST TARGET PROTEIN through VGAM3 HOST TARGET PROTEIN. The function of these host target genes is elaborated hereinabove with reference to VGAM1206, VGAM1207, VGAM1208 and VGAM1209. FIG. 9 further provides a conceptual description of novel bioinformatically detected regulatory viral gene, referred to here as Viral Genomic Record 3002(VGR3002) viral gene, which encodes an 'operon-like' cluster of novel viral micro RNA-like genes, each of which in turn modulates expression of at least one host target gene, the function and utility of which at least one host target gene is known in the art.

VGR3002 gene, herein designated VGR GENE, is a novel bioinformatically detected regulatory, non protein coding, RNA viral gene. The method by which VGR3002 gene was detected is described hereinabove with reference to FIGS. 1-9.

VGR3002 gene encodes VGR3002 precursor RNA, herein designated VGR PRECURSOR RNA, an RNA molecule, typically several hundred nucleotides long.

VGR3002 precursor RNA folds spatially, forming VGR3002 folded precursor RNA, herein designated VGR FOLDED PRECURSOR RNA. It is appreciated that VGR3002 folded precursor RNA comprises a plurality of what is known in the art as 'hairpin' structures. These 'hairpin' structures are due to the fact that the nucleotide sequence of VGR3002 precursor RNA comprises a plurality of segments, the first half of each such segment having a nucleotide sequence which is at least a partial inversed-reversed sequence of the second half thereof, as is well known in the art.

VGR3002 folded precursor RNA is naturally processed by cellular enzymatic activity into at least 3 separate VGAM precursor RNAs, VGAM1210 precursor RNA, VGAM1211 precursor RNA and VGAM1212 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1210 RNA, VGAM1211 RNA and VGAM1212 RNA, herein schematically represented by VGAM1 RNA through VGAM3 RNA, each of which VGAM RNAs corresponding to VGAM RNA of FIG. 1.

VGAM1210 RNA, herein schematically represented by VGAM1 RNA through VGAM3 RNA, binds complementarily to a host target binding site located in an untranslated region of VGAM1210 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1210 host target RNA into VGAM1210 host target protein, herein schematically represented by VGAM1 HOST TARGET PROTEIN through VGAM3 HOST TARGET PROTEIN, all of FIG. 1.

VGAM1211 RNA, herein schematically represented by VGAM1 RNA through VGAM3 RNA, binds complementarily to a host target binding site located in an untranslated region of VGAM1211 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1211 host target RNA into VGAM1211 host target protein, herein schematically represented by VGAM1 HOST TARGET PROTEIN through VGAM3 HOST TARGET PROTEIN, all of FIG. 1.

VGAM1212 RNA, herein schematically represented by VGAM1 RNA through VGAM3 RNA, binds complementarily to a host target binding site located in an untranslated region of VGAM1212 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1212 host target RNA into VGAM1212 host target protein, herein schematically represented by VGAM1 HOST TARGET PROTEIN through VGAM3 HOST TARGET PROTEIN, all of FIG. 1.

It is appreciated that a function of VGR3002 gene, herein designated VGR GENE, is inhibition of expression of host target genes, as part of a novel viral mechanism of attacking a host. Accordingly, utilities of VGR3002 gene include diagnosis, prevention and treatment of viral infection by Camelpox Virus. Specific functions, and accordingly utilities, of VGR3002 gene correlate with, and may be deduced from, the identity of the host target genes, which are inhibited by VGAM RNAs comprised in the 'operon-like' cluster of VGR3002 gene: VGAM1210 host target protein, VGAM1211 host target protein and VGAM1212 host target protein, herein schematically represented by VGAM1 HOST TARGET PROTEIN through VGAM3 HOST TARGET PROTEIN. The function of these host target genes is elaborated hereinabove with reference to VGAM1210, VGAM1211 and VGAM1212. FIG. 9 further provides a conceptual description of novel bioinformatically detected regulatory viral gene, referred to here as Viral Genomic Record 3003(VGR3003) viral gene, which encodes an 'operon-like' cluster of novel viral micro RNA-like genes, each of which in turn modulates expression of at least one host target gene, the function and utility of which at least one host target gene is known in the art.

VGR3003 gene, herein designated VGR GENE, is a novel bioinformatically detected regulatory, non protein coding, RNA viral gene. The method by which VGR3003 gene was detected is described hereinabove with reference to FIGS. 1-9.

VGR3003 gene encodes VGR3003 precursor RNA, herein designated VGR PRECURSOR RNA, an RNA molecule, typically several hundred nucleotides long.

VGR3003 precursor RNA folds spatially, forming VGR3003 folded precursor RNA, herein designated VGR FOLDED PRECURSOR RNA. It is appreciated that VGR3003 folded precursor RNA comprises a plurality of what is known in the art as 'hairpin' structures. These 'hairpin' structures are due to the fact that the nucleotide sequence of VGR3003 precursor RNA comprises a plurality of segments, the first half of each such segment having a nucleotide sequence which is at least a partial inversed-reversed sequence of the second half thereof, as is well known in the art.

VGR3003 folded precursor RNA is naturally processed by cellular enzymatic activity into at least 4 separate VGAM precursor RNAs, VGAM1214 precursor RNA, VGAM1215 precursor RNA, VGAM1216 precursor RNA and VGAM1217 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1214 RNA, VGAM1215 RNA, VGAM1216 RNA and VGAM1217 RNA, herein schematically represented by VGAM1 RNA through VGAM3 RNA, each of which VGAM RNAs corresponding to VGAM RNA of FIG. 1.

VGAM1214 RNA, herein schematically represented by VGAM1 RNA through VGAM3 RNA, binds complementarily to a host target binding site located in an untranslated region of VGAM1214 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1214 host target RNA into VGAM1214 host target protein, herein schematically represented by VGAM1 HOST TARGET PROTEIN through VGAM3 HOST TARGET PROTEIN, all of FIG. 1.

VGAM1215 RNA, herein schematically represented by VGAM1 RNA through VGAM3 RNA, binds complementarily to a host target binding site located in an untranslated region of VGAM1215 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1215 host target RNA into VGAM1215 host target protein, herein schematically represented by VGAM1 HOST TARGET PROTEIN through VGAM3 HOST TARGET PROTEIN, all of FIG. 1.

VGAM1216 RNA, herein schematically represented by VGAM1 RNA through VGAM3 RNA, binds complementarily to a host target binding site located in an untranslated region of VGAM1216 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1216 host target RNA into VGAM1216 host target protein, herein schematically represented by VGAM1 HOST TARGET PROTEIN through VGAM3 HOST TARGET PROTEIN, all of FIG. 1.

VGAM1217 RNA, herein schematically represented by VGAM1 RNA through VGAM3 RNA, binds complementarily to a host target binding site located in an untranslated region of VGAM1217 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1217 host target RNA into VGAM1217 host target protein, herein schematically represented by VGAM1 HOST TARGET PROTEIN through VGAM3 HOST TARGET PROTEIN, all of FIG. 1.

It is appreciated that a function of VGR3003 gene, herein designated VGR GENE, is inhibition of expression of host target genes, as part of a novel viral mechanism of attacking a host. Accordingly, utilities of VGR3003 gene include diagnosis, prevention and treatment of viral infection by Tupaia Herpesvirus. Specific functions, and accordingly utilities, of VGR3003 gene correlate with, and may be deduced from, the identity of the host target genes, which are inhibited by VGAM RNAs comprised in the 'operon-like' cluster of VGR3003 gene: VGAM1214 host target protein, VGAM1215 host target protein, VGAM1216 host target protein and VGAM1217 host target protein, herein schematically represented by VGAM1 HOST TARGET PROTEIN through VGAM3 HOST TARGET PROTEIN. The function of these host target genes is elaborated hereinabove with reference to VGAM1214, VGAM1215, VGAM1216 and VGAM1217. FIG. 9 further provides a conceptual description of novel bioinformatically detected regulatory viral gene, referred to here as Viral Genomic Record 3004(VGR3004) viral gene, which encodes an 'operon-like' cluster of novel viral micro RNA-like genes, each of which in turn modulates expression of at least one host target gene, the function and utility of which at least one host target gene is known in the art.

VGR3004 gene, herein designated VGR GENE, is a novel bioinformatically detected regulatory, non protein coding, RNA viral gene. The method by which VGR3004 gene was detected is described hereinabove with reference to FIGS. 1-9.

VGR3004 gene encodes VGR3004 precursor RNA, herein designated VGR PRECURSOR RNA, an RNA molecule, typically several hundred nucleotides long.

VGR3004 precursor RNA folds spatially, forming VGR3004 folded precursor RNA, herein designated VGR FOLDED PRECURSOR RNA. It is appreciated that VGR3004 folded precursor RNA comprises a plurality of what is known in the art as 'hairpin' structures. These 'hairpin' structures are due to the fact that the nucleotide sequence of VGR3004 precursor RNA comprises a plurality of segments, the first half of each such segment having a nucleotide sequence which is at least a partial inversed-reversed sequence of the second half thereof, as is well known in the art.

VGR3004 folded precursor RNA is naturally processed by cellular enzymatic activity into at least 2 separate VGAM precursor RNAs, VGAM1218 precursor RNA and VGAM1219 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1218 RNA and VGAM1219 RNA, herein schematically represented by VGAM1 RNA through VGAM3 RNA, each of which VGAM RNAs corresponding to VGAM RNA of FIG. 1.

VGAM1218 RNA, herein schematically represented by VGAM1 RNA through VGAM3 RNA, binds complementarily to a host target binding site located in an untranslated region of VGAM1218 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1218 host target RNA into VGAM1218 host target protein, herein schematically represented by VGAM1 HOST TARGET PROTEIN through VGAM3 HOST TARGET PROTEIN, all of FIG. 1.

VGAM1219 RNA, herein schematically represented by VGAM1 RNA through VGAM3 RNA, binds complementarily to a host target binding site located in an untranslated region of VGAM1219 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1219 host target RNA into VGAM1219 host target protein, herein schematically represented by VGAM1 HOST TARGET PROTEIN through VGAM3 HOST TARGET PROTEIN, all of FIG. 1.

It is appreciated that a function of VGR3004 gene, herein designated VGR GENE, is inhibition of expression of host target genes, as part of a novel viral mechanism of attacking a host. Accordingly, utilities of VGR3004 gene include diagnosis, prevention and treatment of viral infection by Fowlpox Virus. Specific functions, and accordingly utilities, of VGR3004 gene correlate with, and may be deduced from, the identity of the host target genes, which are inhibited by VGAM RNAs comprised in the 'operon-like' cluster of VGR3004 gene: VGAM1218 host target protein and VGAM1219 host target protein, herein schematically represented by VGAM1 HOST TARGET PROTEIN through VGAM3 HOST TARGET PROTEIN. The function of these host target genes is elaborated hereinabove with reference to VGAM1218 and VGAM1219. FIG. 9 further provides a conceptual description of novel bioinformatically detected regulatory viral gene, referred to here as Viral Genomic Record 3005(VGR3005) viral gene, which encodes an 'operon-like' cluster of novel viral micro RNA-like genes, each of which in turn modulates expression of at least one host target gene, the function and utility of which at least one host target gene is known in the art.

VGR3005 gene, herein designated VGR GENE, is a novel bioinformatically detected regulatory, non protein coding, RNA viral gene. The method by which VGR3005 gene was detected is described hereinabove with reference to FIGS. 1-9.

VGR3005 gene encodes VGR3005 precursor RNA, herein designated VGR PRECURSOR RNA, an RNA molecule, typically several hundred nucleotides long.

VGR3005 precursor RNA folds spatially, forming VGR3005 folded precursor RNA, herein designated VGR FOLDED PRECURSOR RNA. It is appreciated that VGR3005 folded precursor RNA comprises a plurality of what is known in the art as 'hairpin' structures. These 'hairpin' structures are due to the fact that the nucleotide sequence of VGR3005 precursor RNA comprises a plurality of segments, the first half of each such segment having a nucleotide sequence which is at least a partial inversed-reversed sequence of the second half thereof, as is well known in the art.

VGR3005 folded precursor RNA is naturally processed by cellular enzymatic activity into at least 3 separate VGAM precursor RNAs, VGAM1220 precursor RNA, VGAM1221 precursor RNA and VGAM1222 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1220 RNA, VGAM1221 RNA and VGAM1222 RNA, herein schematically represented by VGAM1 RNA through VGAM3 RNA, each of which VGAM RNAs corresponding to VGAM RNA of FIG. 1.

VGAM1220 RNA, herein schematically represented by VGAM1 RNA through VGAM3 RNA, binds complementarily to a host target binding site located in an untranslated region of VGAM1220 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1220 host target RNA into VGAM1220 host target protein, herein schematically represented by VGAM1 HOST TARGET PROTEIN through VGAM3 HOST TARGET PROTEIN, all of FIG. 1.

VGAM1221 RNA, herein schematically represented by VGAM1 RNA through VGAM3 RNA, binds complementarily to a host target binding site located in an untranslated region of VGAM1221 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1221 host target RNA into VGAM1221 host target protein, herein schematically represented by VGAM1 HOST TARGET PROTEIN through VGAM3 HOST TARGET PROTEIN, all of FIG. 1.

VGAM1222 RNA, herein schematically represented by VGAM1 RNA through VGAM3 RNA, binds complementarily to a host target binding site located in an untranslated region of VGAM1222 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1222 host target RNA into VGAM1222 host target protein, herein schematically represented by VGAM1 HOST TARGET PROTEIN through VGAM3 HOST TARGET PROTEIN, all of FIG. 1.

It is appreciated that a function of VGR3005 gene, herein designated VGR GENE, is inhibition of expression of host target genes, as part of a novel viral mechanism of attacking a host. Accordingly, utilities of VGR3005 gene include diagnosis, prevention and treatment of viral infection by Fowl Adenovirus D. Specific functions, and accordingly utilities, of VGR3005 gene correlate with, and may be deduced from, the identity of the host target genes, which are inhibited by VGAM RNAs comprised in the 'operon-like' cluster of VGR3005 gene: VGAM1220 host target protein, VGAM1221 host target protein and VGAM1222 host target protein, herein schematically represented by VGAM1 HOST TARGET PROTEIN through VGAM3 HOST TARGET PROTEIN. The function of these host target genes is elaborated hereinabove with reference to VGAM1220, VGAM1221 and VGAM1222. FIG. 9 further provides a conceptual description of novel bioinformatically detected regulatory viral gene, referred to here as Viral Genomic Record 3006(VGR3006) viral gene, which encodes an 'operon-like' cluster of novel viral micro RNA-like genes, each of which in turn modulates expression of at least one host target gene, the function and utility of which at least one host target gene is known in the art.

VGR3006 gene, herein designated VGR GENE, is a novel bioinformatically detected regulatory, non protein coding, RNA viral gene. The method by which VGR3006 gene was detected is described hereinabove with reference to FIGS. 1-9.

VGR3006 gene encodes VGR3006 precursor RNA, herein designated VGR PRECURSOR RNA, an RNA molecule, typically several hundred nucleotides long.

VGR3006 precursor RNA folds spatially, forming VGR3006 folded precursor RNA, herein designated VGR FOLDED PRECURSOR RNA. It is appreciated that VGR3006 folded precursor RNA comprises a plurality of what is known in the art as 'hairpin' structures. These 'hairpin' structures are due to the fact that the nucleotide sequence of VGR3006 precursor RNA comprises a plurality of segments, the first half of each such segment having a nucleotide sequence which is at least a partial inversed-reversed sequence of the second half thereof, as is well known in the art.

VGR3006 folded precursor RNA is naturally processed by cellular enzymatic activity into at least 2 separate VGAM precursor RNAs, VGAM1223 precursor RNA and VGAM1224 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1223 RNA and VGAM1224 RNA, herein schematically represented by VGAM1 RNA through VGAM3 RNA, each of which VGAM RNAs corresponding to VGAM RNA of FIG. 1.

VGAM1223 RNA, herein schematically represented by VGAM1 RNA through VGAM3 RNA, binds complementarily to a host target binding site located in an untranslated region of VGAM1223 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1223 host target RNA into VGAM1223 host target protein, herein schematically represented by VGAM1 HOST TARGET PROTEIN through VGAM3 HOST TARGET PROTEIN, all of FIG. 1.

VGAM1224 RNA, herein schematically represented by VGAM1 RNA through VGAM3 RNA, binds complementarily to a host target binding site located in an untranslated region of VGAM1224 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1224 host target RNA into VGAM1224 host target protein, herein schematically represented by VGAM1 HOST TARGET PROTEIN through VGAM3 HOST TARGET PROTEIN, all of FIG. 1.

It is appreciated that a function of VGR3006 gene, herein designated VGR GENE, is inhibition of expression of host target genes, as part of a novel viral mechanism of attacking a host. Accordingly, utilities of VGR3006 gene include diagnosis, prevention and treatment of viral infection by Equine Herpesvirus 2. Specific functions, and accordingly utilities, of VGR3006 gene correlate with, and may be deduced from, the identity of the host target genes, which are inhibited by VGAM RNAs comprised in the 'operon-like' cluster of VGR3006 gene: VGAM1223 host target protein and VGAM1224 host target protein, herein schematically represented by VGAM1 HOST TARGET PROTEIN through VGAM3 HOST TARGET PROTEIN. The function of these host target genes is elaborated hereinabove with reference to VGAM1223 and VGAM1224. FIG. 9 further provides a conceptual description of novel bioinformatically detected regulatory viral gene, referred to here as Viral Genomic Record 3007(VGR3007) viral gene, which encodes an 'operon-like' cluster of novel viral micro RNA-like genes, each of which in turn modulates expression of at least one host target gene, the function and utility of which at least one host target gene is known in the art.

VGR3007 gene, herein designated VGR GENE, is a novel bioinformatically detected regulatory, non protein coding, RNA viral gene. The method by which VGR3007 gene was detected is described hereinabove with reference to FIGS. 1-9.

VGR3007 gene encodes VGR3007 precursor RNA, herein designated VGR PRECURSOR RNA, an RNA molecule, typically several hundred nucleotides long.

VGR3007 precursor RNA folds spatially, forming VGR3007 folded precursor RNA, herein designated VGR FOLDED PRECURSOR RNA. It is appreciated that VGR3007 folded precursor RNA comprises a plurality of what is known in the art as 'hairpin' structures. These 'hairpin' structures are due to the fact that the nucleotide sequence of VGR3007 precursor RNA comprises a plurality of segments, the first half of each such segment having a nucleotide sequence which is at least a partial inversed-reversed sequence of the second half thereof, as is well known in the art.

VGR3007 folded precursor RNA is naturally processed by cellular enzymatic activity into at least 4 separate VGAM precursor RNAs, VGAM1226 precursor RNA, VGAM1227 precursor RNA, VGAM1228 precursor RNA and VGAM1229 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1226 RNA, VGAM1227 RNA, VGAM1228 RNA and VGAM1229 RNA, herein schematically represented by VGAM1 RNA through VGAM3 RNA, each of which VGAM RNAs corresponding to VGAM RNA of FIG. 1.

VGAM1226 RNA, herein schematically represented by VGAM1 RNA through VGAM3 RNA, binds complementarily to a host target binding site located in an untranslated region of VGAM1226 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1226 host target RNA into VGAM1226 host target protein, herein schematically represented by VGAM1 HOST TARGET PROTEIN through VGAM3 HOST TARGET PROTEIN, all of FIG. 1.

VGAM1227 RNA, herein schematically represented by VGAM1 RNA through VGAM3 RNA, binds complementarily to a host target binding site located in an untranslated region of VGAM1227 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1227 host target RNA into VGAM1227 host target protein, herein schematically represented by VGAM1 HOST TARGET PROTEIN through VGAM3 HOST TARGET PROTEIN, all of FIG. 1.

VGAM1228 RNA, herein schematically represented by VGAM1 RNA through VGAM3 RNA, binds complementarily to a host target binding site located in an untranslated region of VGAM1228 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1228 host target RNA into VGAM1228 host target protein, herein schematically represented by VGAM1 HOST TARGET PROTEIN through VGAM3 HOST TARGET PROTEIN, all of FIG. 1.

VGAM1229 RNA, herein schematically represented by VGAM1 RNA through VGAM3 RNA, binds complementarily to a host target binding site located in an untranslated region of VGAM1229 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1229 host target RNA into VGAM1229 host target protein, herein schematically represented by VGAM1 HOST TARGET PROTEIN through VGAM3 HOST TARGET PROTEIN, all of FIG. 1.

It is appreciated that a function of VGR3007 gene, herein designated VGR GENE, is inhibition of expression of host target genes, as part of a novel viral mechanism of attacking a host. Accordingly, utilities of VGR3007 gene include diagnosis, prevention and treatment of viral infection by Tacaribe Virus. Specific functions, and accordingly utilities, of VGR3007 gene correlate with, and may be deduced from, the identity of the host target genes, which are inhibited by VGAM RNAs comprised in the 'operon-like' cluster of VGR3007 gene: VGAM1226 host target protein, VGAM1227 host target protein, VGAM1228 host target protein and VGAM1229 host target protein, herein schematically represented by VGAM1 HOST TARGET PROTEIN through VGAM3 HOST TARGET PROTEIN. The function of these host target genes is elaborated hereinabove with reference to VGAM1226, VGAM1227, VGAM1228 and VGAM1229.

FIG. 9 further provides a conceptual description of novel bioinformatically detected regulatory viral gene, referred to here as Viral Genomic Record 3008(VGR3008) viral gene, which encodes an 'operon-like' cluster of novel viral micro RNA-like genes, each of which in turn modulates expression of at least one host target gene, the function and utility of which at least one host target gene is known in the art.

VGR3008 gene, herein designated VGR GENE, is a novel bioinformatically detected regulatory, non protein coding, RNA viral gene. The method by which VGR3008 gene was detected is described hereinabove with reference to FIGS. 1-9.

VGR3008 gene encodes VGR3008 precursor RNA, herein designated VGR PRECURSOR RNA, an RNA molecule, typically several hundred nucleotides long.

VGR3008 precursor RNA folds spatially, forming VGR3008 folded precursor RNA, herein designated VGR FOLDED PRECURSOR RNA. It is appreciated that VGR3008 folded precursor RNA comprises a plurality of what is known in the art as 'hairpin' structures. These 'hairpin' structures are due to the fact that the nucleotide sequence of VGR3008 precursor RNA comprises a plurality of segments, the first half of each such segment having a nucleotide sequence which is at least a partial inversed-reversed sequence of the second half thereof, as is well known in the art.

VGR3008 folded precursor RNA is naturally processed by cellular enzymatic activity into at least 5 separate VGAM precursor RNAs, VGAM1230 precursor RNA, VGAM1231 precursor RNA, VGAM1232 precursor RNA, VGAM1233 precursor RNA and VGAM1234 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1230 RNA, VGAM1231 RNA, VGAM1232 RNA, VGAM1233 RNA and VGAM1234 RNA, herein schematically represented by VGAM1 RNA through VGAM3 RNA, each of which VGAM RNAs corresponding to VGAM RNA of FIG. 1.

VGAM1230 RNA, herein schematically represented by VGAM1 RNA through VGAM3 RNA, binds complementarily to a host target binding site located in an untranslated region of VGAM1230 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1230 host target RNA into VGAM1230 host target protein, herein schematically represented by VGAM1 HOST TARGET PROTEIN through VGAM3 HOST TARGET PROTEIN, all of FIG. 1.

VGAM1231 RNA, herein schematically represented by VGAM1 RNA through VGAM3 RNA, binds complementarily to a host target binding site located in an untranslated region of VGAM1231 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1231 host target RNA into VGAM1231 host target protein, herein schematically represented by VGAM1 HOST TARGET PROTEIN through VGAM3 HOST TARGET PROTEIN, all of FIG. 1.

VGAM1232 RNA, herein schematically represented by VGAM1 RNA through VGAM3 RNA, binds complementarily to a host target binding site located in an untranslated region of VGAM1232 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1232 host target RNA into VGAM1232 host target protein, herein schematically represented by VGAM1 HOST TARGET PROTEIN through VGAM3 HOST TARGET PROTEIN, all of FIG. 1.

VGAM1233 RNA, herein schematically represented by VGAM1 RNA through VGAM3 RNA, binds complementarily to a host target binding site located in an untranslated region of VGAM1233 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1233 host target RNA into VGAM1233 host target protein, herein schematically represented by VGAM1 HOST TARGET PROTEIN through VGAM3 HOST TARGET PROTEIN, all of FIG. 1.

VGAM1234 RNA, herein schematically represented by VGAM1 RNA through VGAM3 RNA, binds complementarily to a host target binding site located in an untranslated region of VGAM1234 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1234 host target RNA into VGAM1234 host target protein, herein schematically represented by VGAM1 HOST TARGET PROTEIN through VGAM3 HOST TARGET PROTEIN, all of FIG. 1.

It is appreciated that a function of VGR3008 gene, herein designated VGR GENE, is inhibition of expression of host target genes, as part of a novel viral mechanism of attacking a host. Accordingly, utilities of VGR3008 gene include diagnosis, prevention and treatment of viral infection by Equine Herpesvirus 2. Specific functions, and accordingly utilities, of VGR3008 gene correlate with, and may be deduced from, the identity of the host target genes, which are inhibited by VGAM RNAs comprised in the 'operon-like' cluster of VGR3008 gene: VGAM1230 host target protein, VGAM1231 host target protein, VGAM1232 host target protein, VGAM1233 host target protein and VGAM1234 host target protein, herein schematically represented by VGAM1 HOST TARGET PROTEIN through VGAM3 HOST TARGET PROTEIN. The function of these host target genes is elaborated hereinabove with reference to VGAM1230, VGAM1231, VGAM1232, VGAM1233 and VGAM1234.

FIG. 9 further provides a conceptual description of novel bioinformatically detected regulatory viral gene, referred to here as Viral Genomic Record 3009(VGR3009) viral gene, which encodes an 'operon-like' cluster of novel viral micro RNA-like genes, each of which in turn modulates expression of at least one host target gene, the function and utility of which at least one host target gene is known in the art.

VGR3009 gene, herein designated VGR GENE, is a novel bioinformatically detected regulatory, non protein coding, RNA viral gene. The method by which VGR3009 gene was detected is described hereinabove with reference to FIGS. 1-9.

VGR3009 gene encodes VGR3009 precursor RNA, herein designated VGR PRECURSOR RNA, an RNA molecule, typically several hundred nucleotides long.

VGR3009 precursor RNA folds spatially, forming VGR3009 folded precursor RNA, herein designated VGR FOLDED PRECURSOR RNA. It is appreciated that VGR3009 folded precursor RNA comprises a plurality of what is known in the art as 'hairpin' structures. These 'hairpin' structures are due to the fact that the nucleotide sequence of VGR3009 precursor RNA comprises a plurality of segments, the first half of each such segment having a nucleotide sequence which is at least a partial inversed-reversed sequence of the second half thereof, as is well known in the art.

VGR3009 folded precursor RNA is naturally processed by cellular enzymatic activity into at least 6 separate VGAM precursor RNAs, VGAM1235 precursor RNA, VGAM1236 precursor RNA, VGAM1237 precursor RNA, VGAM1238 precursor RNA, VGAM1239 precursor RNA and VGAM1240 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1235 RNA, VGAM1236 RNA, VGAM1237 RNA, VGAM1238 RNA, VGAM1239 RNA and VGAM1240 RNA, herein schematically represented by VGAM1 RNA through VGAM3 RNA, each of which VGAM RNAs corresponding to VGAM RNA of FIG. 1.

VGAM1235 RNA, herein schematically represented by VGAM1 RNA through VGAM3 RNA, binds complementarily to a host target binding site located in an untranslated region of VGAM1235 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1235 host target RNA into VGAM1235 host target protein, herein schematically represented by VGAM1 HOST TARGET PROTEIN through VGAM3 HOST TARGET PROTEIN, all of FIG. 1.

VGAM1236 RNA, herein schematically represented by VGAM1 RNA through VGAM3 RNA, binds complementarily to a host target binding site located in an untranslated region of VGAM1236 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1236 host target RNA into VGAM1236 host target protein, herein schematically represented by VGAM1 HOST TARGET PROTEIN through VGAM3 HOST TARGET PROTEIN, all of FIG. 1.

VGAM1237 RNA, herein schematically represented by VGAM1 RNA through VGAM3 RNA, binds complementarily to a host target binding site located in an untranslated region of VGAM1237 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1237 host target RNA into VGAM1237 host target protein, herein schematically represented by VGAM1 HOST TARGET PROTEIN through VGAM3 HOST TARGET PROTEIN, all of FIG. 1.

VGAM1238 RNA, herein schematically represented by VGAM1 RNA through VGAM3 RNA, binds complementarily to a host target binding site located in an untranslated region of VGAM1238 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1238 host target RNA into VGAM1238 host target protein, herein schematically represented by VGAM1 HOST TARGET PROTEIN through VGAM3 HOST TARGET PROTEIN, all of FIG. 1.

VGAM1239 RNA, herein schematically represented by VGAM1 RNA through VGAM3 RNA, binds complementarily to a host target binding site located in an untranslated region of VGAM1239 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1239 host target RNA into VGAM1239 host target protein, herein schematically represented by VGAM1 HOST TARGET PROTEIN through VGAM3 HOST TARGET PROTEIN, all of FIG. 1.

VGAM1240 RNA, herein schematically represented by VGAM1 RNA through VGAM3 RNA, binds complementarily to a host target binding site located in an untranslated region of VGAM1240 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1240 host target RNA into VGAM1240 host target protein, herein schematically represented by VGAM1 HOST TARGET PROTEIN through VGAM3 HOST TARGET PROTEIN, all of FIG. 1.

It is appreciated that a function of VGR3009 gene, herein designated VGR GENE, is inhibition of expression of host target genes, as part of a novel viral mechanism of attacking a host. Accordingly, utilities of VGR3009 gene include diagnosis, prevention and treatment of viral infection by Bovine Herpesvirus 4. Specific functions, and accordingly utilities, of VGR3009 gene correlate with, and may be deduced from, the identity of the host target genes, which are inhibited by VGAM RNAs comprised in the 'operon-like' cluster of VGR3009 gene: VGAM1235 host target protein, VGAM1236 host target protein, VGAM1237 host target protein, VGAM1238 host target protein, VGAM1239 host target protein and VGAM1240 host target protein, herein schematically represented by VGAM1 HOST TARGET PROTEIN through VGAM3 HOST TARGET PROTEIN. The function of these host target genes is elaborated hereinabove with reference to VGAM1235, VGAM1236, VGAM1237, VGAM1238, VGAM1239 and VGAM1240. FIG. 9 further provides a conceptual description of novel bioinformatically detected regulatory viral gene, referred to here as Viral Genomic Record 3010(VGR3010) viral gene, which encodes an 'operon-like' cluster of novel viral micro RNA-like genes, each of which in turn modulates expression of at least one host target gene, the function and utility of which at least one host target gene is known in the art.

VGR3010 gene, herein designated VGR GENE, is a novel bioinformatically detected regulatory, non protein coding, RNA viral gene. The method by which VGR3010 gene was detected is described hereinabove with reference to FIGS. 1-9.

VGR3010 gene encodes VGR3010 precursor RNA, herein designated VGR PRECURSOR RNA, an RNA molecule, typically several hundred nucleotides long.

VGR3010 precursor RNA folds spatially, forming VGR3010 folded precursor RNA, herein designated VGR FOLDED PRECURSOR RNA. It is appreciated that VGR3010 folded precursor RNA comprises a plurality of what is known in the art as 'hairpin' structures. These 'hairpin' structures are due to the fact that the nucleotide sequence of VGR3010 precursor RNA comprises a plurality of segments, the first half of each such segment having a nucleotide sequence which is at least a partial inversed-reversed sequence of the second half thereof, as is well known in the art.

VGR3010 folded precursor RNA is naturally processed by cellular enzymatic activity into at least 2 separate VGAM precursor RNAs, VGAM1241 precursor RNA and VGAM1242 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1241 RNA and VGAM1242 RNA, herein schematically represented by VGAM1 RNA through VGAM3 RNA, each of which VGAM RNAs corresponding to VGAM RNA of FIG. 1.

VGAM1241 RNA, herein schematically represented by VGAM1 RNA through VGAM3 RNA, binds complementarily to a host target binding site located in an untranslated region of VGAM1241 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1241 host target RNA into VGAM1241 host target protein, herein schematically represented by VGAM1 HOST TARGET PROTEIN through VGAM3 HOST TARGET PROTEIN, all of FIG. 1.

VGAM1242 RNA, herein schematically represented by VGAM1 RNA through VGAM3 RNA, binds complementarily to a host target binding site located in an untranslated region of VGAM1242 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1242 host target RNA into VGAM1242 host target protein, herein schematically represented by VGAM1 HOST TARGET PROTEIN through VGAM3 HOST TARGET PROTEIN, all of FIG. 1.

It is appreciated that a function of VGR3010 gene, herein designated VGR GENE, is inhibition of expression of host target genes, as part of a novel viral mechanism of attacking a host. Accordingly, utilities of VGR3010 gene include diagnosis, prevention and treatment of viral infection by Gallid Herpesvirus 3. Specific functions, and accordingly utilities, of VGR3010 gene correlate with, and may be deduced from, the identity of the host target genes, which are inhibited by VGAM RNAs comprised in the 'operon-like' cluster of VGR3010 gene: VGAM1241 host target protein and VGAM1242 host target protein, herein schematically represented by VGAM1 HOST TARGET PROTEIN through VGAM3 HOST TARGET PROTEIN. The function of these host target genes is elaborated hereinabove with reference to VGAM1241 and VGAM1242. FIG. 9 further provides a conceptual description of novel bioinformatically detected regulatory viral gene, referred to here as Viral Genomic Record 3011(VGR3011) viral gene, which encodes an 'operon-like' cluster of novel viral micro RNA-like genes, each of which in turn modulates expression of at least one host target gene, the function and utility of which at least one host target gene is known in the art.

VGR3011 gene, herein designated VGR GENE, is a novel bioinformatically detected regulatory, non protein coding, RNA viral gene. The method by which VGR3011 gene was detected is described hereinabove with reference to FIGS. 1-9.

VGR3011 gene encodes VGR3011 precursor RNA, herein designated VGR PRECURSOR RNA, an RNA molecule, typically several hundred nucleotides long.

VGR3011 precursor RNA folds spatially, forming VGR3011 folded precursor RNA, herein designated VGR FOLDED PRECURSOR RNA. It is appreciated that VGR3011 folded precursor RNA comprises a plurality of what is known in the art as 'hairpin' structures. These 'hairpin' structures are due to the fact that the nucleotide sequence of VGR3011 precursor RNA comprises a plurality of segments, the first half of each such segment having a nucleotide sequence which is at least a partial inversed-reversed sequence of the second half thereof, as is well known in the art.

VGR3011 folded precursor RNA is naturally processed by cellular enzymatic activity into at least 4 separate VGAM precursor RNAs, VGAM1243 precursor RNA, VGAM1244 precursor RNA, VGAM1245 precursor RNA and VGAM1246 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1243 RNA, VGAM1244 RNA, VGAM1245 RNA and VGAM1246 RNA, herein schematically represented by VGAM1 RNA through VGAM3 RNA, each of which VGAM RNAs corresponding to VGAM RNA of FIG. 1.

VGAM1243 RNA, herein schematically represented by VGAM1 RNA through VGAM3 RNA, binds complementarily to a host target binding site located in an untranslated region of VGAM1243 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1243 host target RNA into VGAM1243 host target protein, herein schematically represented by VGAM1 HOST TARGET PROTEIN through VGAM3 HOST TARGET PROTEIN, all of FIG. 1.

VGAM1244 RNA, herein schematically represented by VGAM1 RNA through VGAM3 RNA, binds complementarily to a host target binding site located in an untranslated region of VGAM1244 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1244 host target RNA into VGAM1244 host target protein, herein schematically represented by VGAM1 HOST TARGET PROTEIN through VGAM3 HOST TARGET PROTEIN, all of FIG. 1.

VGAM1245 RNA, herein schematically represented by VGAM1 RNA through VGAM3 RNA, binds complementarily to a host target binding site located in an untranslated region of VGAM1245 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1245 host target RNA into VGAM1245 host target protein, herein schematically represented by VGAM1 HOST TARGET PROTEIN through VGAM3 HOST TARGET PROTEIN, all of FIG. 1.

VGAM1246 RNA, herein schematically represented by VGAM1 RNA through VGAM3 RNA, binds complementarily to a host target binding site located in an untranslated region of VGAM1246 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1246 host target RNA into VGAM1246 host target protein, herein schematically represented by VGAM1 HOST TARGET PROTEIN through VGAM3 HOST TARGET PROTEIN, all of FIG. 1.

It is appreciated that a function of VGR3011 gene, herein designated VGR GENE, is inhibition of expression of host target genes, as part of a novel viral mechanism of attacking a host. Accordingly, utilities of VGR3011 gene include diagnosis, prevention and treatment of viral infection by Turkey Adenovirus 3. Specific functions, and accordingly utilities, of VGR3011 gene correlate with, and may be deduced from, the identity of the host target genes, which are inhibited by VGAM RNAs comprised in the 'operon-like' cluster of VGR3011 gene: VGAM1243 host target protein, VGAM1244 host target protein, VGAM1245 host target protein and VGAM1246 host target protein, herein schematically represented by VGAM1 HOST TARGET PROTEIN through VGAM3 HOST TARGET PROTEIN. The function of these host target genes is elaborated hereinabove with reference to VGAM1243, VGAM1244, VGAM1245 and VGAM1246.

FIG. 9 further provides a conceptual description of novel bioinformatically detected regulatory viral gene, referred to here as Viral Genomic Record 3012(VGR3012) viral gene, which encodes an 'operon-like' cluster of novel viral micro RNA-like genes, each of which in turn modulates expression of at least one host target gene, the function and utility of which at least one host target gene is known in the art.

VGR3012 gene, herein designated VGR GENE, is a novel bioinformatically detected regulatory, non protein coding, RNA viral gene. The method by which VGR3012 gene was detected is described hereinabove with reference to FIGS. 1-9.

VGR3012 gene encodes VGR3012 precursor RNA, herein designated VGR PRECURSOR RNA, an RNA molecule, typically several hundred nucleotides long.

VGR3012 precursor RNA folds spatially, forming VGR3012 folded precursor RNA, herein designated VGR FOLDED PRECURSOR RNA. It is appreciated that VGR3012 folded precursor RNA comprises a plurality of what is known in the art as 'hairpin' structures. These 'hairpin' structures are due to the fact that the nucleotide sequence of VGR3012 precursor RNA comprises a plurality of segments, the first half of each such segment having a nucleotide sequence which is at least a partial inversed-reversed sequence of the second half thereof, as is well known in the art.

VGR3012 folded precursor RNA is naturally processed by cellular enzymatic activity into at least 5 separate VGAM precursor RNAs, VGAM1247 precursor RNA, VGAM1248 precursor RNA, VGAM1249 precursor RNA, VGAM1250 precursor RNA and VGAM1251 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1247 RNA, VGAM1248 RNA, VGAM1249 RNA, VGAM1250 RNA and VGAM1251 RNA, herein schematically represented by VGAM1 RNA through VGAM3 RNA, each of which VGAM RNAs corresponding to VGAM RNA of FIG. 1.

VGAM1247 RNA, herein schematically represented by VGAM1 RNA through VGAM3 RNA, binds complementarily to a host target binding site located in an untranslated region of VGAM1247 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1247 host target RNA into VGAM1247 host target protein, herein schematically represented by VGAM1 HOST TARGET PROTEIN through VGAM3 HOST TARGET PROTEIN, all of FIG. 1.

VGAM1248 RNA, herein schematically represented by VGAM1 RNA through VGAM3 RNA, binds complementarily to a host target binding site located in an untranslated region of VGAM1248 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1248 host target RNA into VGAM1248 host target protein, herein schematically represented by VGAM1 HOST TARGET PROTEIN through VGAM3 HOST TARGET PROTEIN, all of FIG. 1.

VGAM1249 RNA, herein schematically represented by VGAM1 RNA through VGAM3 RNA, binds complementarily to a host target binding site located in an untranslated region of VGAM1249 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1249 host target RNA into VGAM1249 host target protein, herein schematically represented by VGAM1 HOST TARGET PROTEIN through VGAM3 HOST TARGET PROTEIN, all of FIG. 1.

VGAM1250 RNA, herein schematically represented by VGAM1 RNA through VGAM3 RNA, binds complementarily to a host target binding site located in an untranslated region of VGAM1250 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1250 host target RNA into VGAM1250 host target protein, herein schematically represented by VGAM1 HOST TARGET PROTEIN through VGAM3 HOST TARGET PROTEIN, all of FIG. 1.

VGAM1251 RNA, herein schematically represented by VGAM1 RNA through VGAM3 RNA, binds complementarily to a host target binding site located in an untranslated region of VGAM1251 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1251 host target RNA into VGAM1251 host target protein, herein schematically represented by VGAM1 HOST TARGET PROTEIN through VGAM3 HOST TARGET PROTEIN, all of FIG. 1.

It is appreciated that a function of VGR3012 gene, herein designated VGR GENE, is inhibition of expression of host target genes, as part of a novel viral mechanism of attacking a host. Accordingly, utilities of VGR3012 gene include diagnosis, prevention and treatment of viral infection by Monkeypox Virus. Specific functions, and accordingly utilities, of VGR3012 gene correlate with, and may be deduced from, the identity of the host target genes, which are inhibited by VGAM RNAs comprised in the 'operon-like' cluster of VGR3012 gene: VGAM1247 host target protein, VGAM1248 host target protein, VGAM1249 host target protein, VGAM1250 host target protein and VGAM1251 host target protein, herein schematically represented by VGAM1 HOST TARGET PROTEIN through VGAM3 HOST TARGET PROTEIN. The function of these host target genes is elaborated hereinabove with reference to VGAM1247, VGAM1248, VGAM1249, VGAM1250 and VGAM1251.

FIG. 9 further provides a conceptual description of novel bioinformatically detected regulatory viral gene, referred to here as Viral Genomic Record 3013(VGR3013) viral gene, which encodes an 'operon-like' cluster of novel viral micro RNA-like genes, each of which in turn modulates expression of at least one host target gene, the function and utility of which at least one host target gene is known in the art.

VGR3013 gene, herein designated VGR GENE, is a novel bioinformatically detected regulatory, non protein coding, RNA viral gene. The method by which VGR3013 gene was detected is described hereinabove with reference to FIGS. 1-9.

VGR3013 gene encodes VGR3013 precursor RNA, herein designated VGR PRECURSOR RNA, an RNA molecule, typically several hundred nucleotides long.

VGR3013 precursor RNA folds spatially, forming VGR3013 folded precursor RNA, herein designated VGR FOLDED PRECURSOR RNA. It is appreciated that VGR3013 folded precursor RNA comprises a plurality of what is known in the art as 'hairpin' structures. These 'hairpin' structures are due to the fact that the nucleotide sequence of VGR3013 precursor RNA comprises a plurality of segments, the first half of each such segment having a nucleotide sequence which is at least a partial inversed-reversed sequence of the second half thereof, as is well known in the art.

VGR3013 folded precursor RNA is naturally processed by cellular enzymatic activity into at least 5 separate VGAM precursor RNAs, VGAM1252 precursor RNA, VGAM1253 precursor RNA, VGAM1254 precursor RNA, VGAM1255 precursor RNA and VGAM1256 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1252 RNA, VGAM1253 RNA, VGAM1254 RNA, VGAM1255 RNA and VGAM1256 RNA, herein schematically represented by VGAM1 RNA through VGAM3 RNA, each of which VGAM RNAs corresponding to VGAM RNA of FIG. 1.

VGAM1252 RNA, herein schematically represented by VGAM1 RNA through VGAM3 RNA, binds complementarily to a host target binding site located in an untranslated region of VGAM1252 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1252 host target RNA into VGAM1252 host target protein, herein schematically represented by VGAM1 HOST TARGET PROTEIN through VGAM3 HOST TARGET PROTEIN, all of FIG. 1.

VGAM1253 RNA, herein schematically represented by VGAM1 RNA through VGAM3 RNA, binds complementarily to a host target binding site located in an untranslated region of VGAM1253 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1253 host target RNA into VGAM1253 host target protein, herein schematically represented by VGAM1 HOST TARGET PROTEIN through VGAM3 HOST TARGET PROTEIN, all of FIG. 1.

VGAM1254 RNA, herein schematically represented by VGAM1 RNA through VGAM3 RNA, binds complementarily to a host target binding site located in an untranslated region of VGAM1254 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1254 host target RNA into VGAM1254 host target protein, herein schematically represented by VGAM1 HOST TARGET PROTEIN through VGAM3 HOST TARGET PROTEIN, all of FIG. 1.

VGAM1255 RNA, herein schematically represented by VGAM1 RNA through VGAM3 RNA, binds complementarily to a host target binding site located in an untranslated region of VGAM1255 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1255 host target RNA into VGAM1255 host target protein, herein schematically represented by VGAM1 HOST TARGET PROTEIN through VGAM3 HOST TARGET PROTEIN, all of FIG. 1.

VGAM1256 RNA, herein schematically represented by VGAM1 RNA through VGAM3 RNA, binds complementarily to a host target binding site located in an untranslated region of VGAM1256 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1256 host target RNA into VGAM1256 host target protein, herein schematically represented by VGAM1 HOST TARGET PROTEIN through VGAM3 HOST TARGET PROTEIN, all of FIG. 1.

It is appreciated that a function of VGR3013 gene, herein designated VGR GENE, is inhibition of expression of host target genes, as part of a novel viral mechanism of attacking a host. Accordingly, utilities of VGR3013 gene include diagnosis, prevention and treatment of viral infection by Human Adenovirus D. Specific functions, and accordingly utilities, of VGR3013 gene correlate with, and may be deduced from, the identity of the host target genes, which are inhibited by VGAM RNAs comprised in the 'operon-like' cluster of VGR3013 gene: VGAM1252 host target protein, VGAM1253 host target protein, VGAM1254 host target protein, VGAM1255 host target protein and VGAM1256 host target protein, herein schematically represented by VGAM1 HOST TARGET PROTEIN through VGAM3 HOST TARGET PROTEIN. The function of these host target genes is elaborated hereinabove with reference to VGAM1252, VGAM1253, VGAM1254, VGAM1255 and VGAM1256. FIG. 9 further provides a conceptual description of novel bioinformatically detected regulatory viral gene, referred to here as Viral Genomic Record 3014(VGR3014) viral gene, which encodes an 'operon-like' cluster of novel viral micro RNA-like genes, each of which in turn modulates expression of at least one host target gene, the function and utility of which at least one host target gene is known in the art.

VGR3014 gene, herein designated VGR GENE, is a novel bioinformatically detected regulatory, non protein coding, RNA viral gene. The method by which VGR3014 gene was detected is described hereinabove with reference to FIGS. 1-9.

VGR3014 gene encodes VGR3014 precursor RNA, herein designated VGR PRECURSOR RNA, an RNA molecule, typically several hundred nucleotides long.

VGR3014 precursor RNA folds spatially, forming VGR3014 folded precursor RNA, herein designated VGR FOLDED PRECURSOR RNA. It is appreciated that VGR3014 folded precursor RNA comprises a plurality of what is known in the art as 'hairpin' structures. These 'hairpin' structures are due to the fact that the nucleotide sequence of VGR3014 precursor RNA comprises a plurality of segments, the first half of each such segment having a nucleotide sequence which is at least a partial inversed-reversed sequence of the second half thereof, as is well known in the art.

VGR3014 folded precursor RNA is naturally processed by cellular enzymatic activity into at least 2 separate VGAM precursor RNAs, VGAM1257 precursor RNA and VGAM1258 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1257 RNA and VGAM1258 RNA, herein schematically represented by VGAM1 RNA through VGAM3 RNA, each of which VGAM RNAs corresponding to VGAM RNA of FIG. 1.

VGAM1257 RNA, herein schematically represented by VGAM1 RNA through VGAM3 RNA, binds complementarily to a host target binding site located in an untranslated region of VGAM1257 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1257 host target RNA into VGAM1257 host target protein, herein schematically represented by VGAM1 HOST TARGET PROTEIN through VGAM3 HOST TARGET PROTEIN, all of FIG. 1.

VGAM1258 RNA, herein schematically represented by VGAM1 RNA through VGAM3 RNA, binds complementarily to a host target binding site located in an untranslated region of VGAM1258 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1258 host target RNA into VGAM1258 host target protein, herein schematically represented by VGAM1 HOST TARGET PROTEIN through VGAM3 HOST TARGET PROTEIN, all of FIG. 1.

It is appreciated that a function of VGR3014 gene, herein designated VGR GENE, is inhibition of expression of host target genes, as part of a novel viral mechanism of attacking a host. Accordingly, utilities of VGR3014 gene include diagnosis, prevention and treatment of viral infection by Yaba-like Disease Virus. Specific functions, and accordingly utilities, of VGR3014 gene correlate with, and may be deduced from, the identity of the host target genes, which are inhibited by VGAM RNAs comprised in the 'operon-like' cluster of VGR3014 gene: VGAM1257 host target protein and VGAM1258 host target protein, herein schematically represented by VGAM1 HOST TARGET PROTEIN through VGAM3 HOST TARGET PROTEIN. The function of these host target genes is elaborated hereinabove with reference to VGAM1257 and VGAM1258. FIG. 9 further provides a conceptual description of novel bioinformatically detected regulatory viral gene, referred to here as Viral Genomic Record 3015(VGR3015) viral gene, which encodes an 'operon-like' cluster of novel viral micro RNA-like genes, each of which in turn modulates expression of at least one host target gene, the function and utility of which at least one host target gene is known in the art.

VGR3015 gene, herein designated VGR GENE, is a novel bioinformatically detected regulatory, non protein coding, RNA viral gene. The method by which VGR3015 gene was detected is described hereinabove with reference to FIGS. 1-9.

VGR3015 gene encodes VGR3015 precursor RNA, herein designated VGR PRECURSOR RNA, an RNA molecule, typically several hundred nucleotides long.

VGR3015 precursor RNA folds spatially, forming VGR3015 folded precursor RNA, herein designated VGR FOLDED PRECURSOR RNA. It is appreciated that VGR3015 folded precursor RNA comprises a plurality of what is known in the art as 'hairpin' structures. These 'hairpin' structures are due to the fact that the nucleotide sequence of VGR3015 precursor RNA comprises a plurality of segments, the first half of each such segment having a nucleotide sequence which is at least a partial inversed-reversed sequence of the second half thereof, as is well known in the art.

VGR3015 folded precursor RNA is naturally processed by cellular enzymatic activity into at least 4 separate VGAM precursor RNAs, VGAM1259 precursor RNA, VGAM1260 precursor RNA, VGAM1261 precursor RNA and VGAM1262 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1259 RNA, VGAM1260 RNA, VGAM1261 RNA and VGAM1262 RNA, herein schematically represented by VGAM1 RNA through VGAM3 RNA, each of which VGAM RNAs corresponding to VGAM RNA of FIG. 1.

VGAM1259 RNA, herein schematically represented by VGAM1 RNA through VGAM3 RNA, binds complementarily to a host target binding site located in an untranslated region of VGAM1259 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1259 host target RNA into VGAM1259 host target protein, herein schematically represented by VGAM1 HOST TARGET PROTEIN through VGAM3 HOST TARGET PROTEIN, all of FIG. 1.

VGAM1260 RNA, herein schematically represented by VGAM1 RNA through VGAM3 RNA, binds complementarily to a host target binding site located in an untranslated region of VGAM1260 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1260 host target RNA into VGAM1260 host target protein, herein schematically represented by VGAM1 HOST TARGET PROTEIN through VGAM3 HOST TARGET PROTEIN, all of FIG. 1.

VGAM1261 RNA, herein schematically represented by VGAM1 RNA through VGAM3 RNA, binds complementarily to a host target binding site located in an untranslated region of VGAM1261 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1261 host target RNA into VGAM1261 host target protein, herein schematically represented by VGAM1 HOST TARGET PROTEIN through VGAM3 HOST TARGET PROTEIN, all of FIG. 1.

VGAM1262 RNA, herein schematically represented by VGAM1 RNA through VGAM3 RNA, binds complementarily to a host target binding site located in an untranslated region of VGAM1262 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1262 host target RNA into VGAM1262 host target protein, herein schematically represented by VGAM1 HOST TARGET PROTEIN through VGAM3 HOST TARGET PROTEIN, all of FIG. 1.

It is appreciated that a function of VGR3015 gene, herein designated VGR GENE, is inhibition of expression of host target genes, as part of a novel viral mechanism of attacking a host. Accordingly, utilities of VGR3015 gene include diagnosis, prevention and treatment of viral infection by Blackcurrant Reversion Virus. Specific functions, and accordingly utilities, of VGR3015 gene correlate with, and may be deduced from, the identity of the host target genes, which are inhibited by VGAM RNAs comprised in the 'operon-like' cluster of VGR3015 gene: VGAM1259 host target protein, VGAM1260 host target protein, VGAM1261 host target protein and VGAM1262 host target protein, herein schematically represented by VGAM1 HOST TARGET PROTEIN through VGAM3 HOST TARGET PROTEIN. The function of these host target genes is elaborated hereinabove with reference to VGAM1259, VGAM1260, VGAM1261 and VGAM1262.

FIG. 9 further provides a conceptual description of novel bioinformatically detected regulatory viral gene, referred to here as Viral Genomic Record 3016(VGR3016) viral gene, which encodes an 'operon-like' cluster of novel viral micro RNA-like genes, each of which in turn modulates expression of at least one host target gene, the function and utility of which at least one host target gene is known in the art.

VGR3016 gene, herein designated VGR GENE, is a novel bioinformatically detected regulatory, non protein coding, RNA viral gene. The method by which VGR3016 gene was detected is described hereinabove with reference to FIGS. 1-9.

VGR3016 gene encodes VGR3016 precursor RNA, herein designated VGR PRECURSOR RNA, an RNA molecule, typically several hundred nucleotides long.

VGR3016 precursor RNA folds spatially, forming VGR3016 folded precursor RNA, herein designated VGR FOLDED PRECURSOR RNA. It is appreciated that VGR3016 folded precursor RNA comprises a plurality of what is known in the art as 'hairpin' structures. These 'hairpin' structures are due to the fact that the nucleotide sequence of VGR3016 precursor RNA comprises a plurality of segments, the first half of each such segment having a nucleotide sequence which is at least a partial inversed-reversed sequence of the second half thereof, as is well known in the art.

VGR3016 folded precursor RNA is naturally processed by cellular enzymatic activity into at least 5 separate VGAM precursor RNAs, VGAM1263 precursor RNA, VGAM1264 precursor RNA, VGAM1265 precursor RNA, VGAM1266 precursor RNA and VGAM1267 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1263 RNA, VGAM1264 RNA, VGAM1265 RNA, VGAM1266 RNA and VGAM1267 RNA, herein schematically represented by VGAM1 RNA through VGAM3 RNA, each of which VGAM RNAs corresponding to VGAM RNA of FIG. 1.

VGAM1263 RNA, herein schematically represented by VGAM1 RNA through VGAM3 RNA, binds complementarily to a host target binding site located in an untranslated region of VGAM1263 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1263 host target RNA into VGAM1263 host target protein, herein schematically represented by VGAM1 HOST TARGET PROTEIN through VGAM3 HOST TARGET PROTEIN, all of FIG. 1.

VGAM1264 RNA, herein schematically represented by VGAM1 RNA through VGAM3 RNA, binds complementarily to a host target binding site located in an untranslated region of VGAM1264 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1264 host target RNA into VGAM1264 host target protein, herein schematically represented by VGAM1 HOST TARGET PROTEIN through VGAM3 HOST TARGET PROTEIN, all of FIG. 1.

VGAM1265 RNA, herein schematically represented by VGAM1 RNA through VGAM3 RNA, binds complementarily to a host target binding site located in an untranslated region of VGAM1265 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1265 host target RNA into VGAM1265 host target protein, herein schematically represented by VGAM1 HOST TARGET PROTEIN through VGAM3 HOST TARGET PROTEIN, all of FIG. 1.

VGAM1266 RNA, herein schematically represented by VGAM1 RNA through VGAM3 RNA, binds complementarily to a host target binding site located in an untranslated region of VGAM1266 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1266 host target RNA into VGAM1266 host target protein, herein schematically represented by VGAM1 HOST TARGET PROTEIN through VGAM3 HOST TARGET PROTEIN, all of FIG. 1.

VGAM1267 RNA, herein schematically represented by VGAM1 RNA through VGAM3 RNA, binds complementarily to a host target binding site located in an untranslated region of VGAM1267 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1267 host target RNA into VGAM1267 host target protein, herein schematically represented by VGAM1 HOST TARGET PROTEIN through VGAM3 HOST TARGET PROTEIN, all of FIG. 1.

It is appreciated that a function of VGR3016 gene, herein designated VGR GENE, is inhibition of expression of host target genes, as part of a novel viral mechanism of attacking a host. Accordingly, utilities of VGR3016 gene include diagnosis, prevention and treatment of viral infection by Beet Soil-borne Mosaic Virus. Specific functions, and accordingly utilities, of VGR3016 gene correlate with, and may be deduced from, the identity of the host target genes, which are inhibited by VGAM RNAs comprised in the 'operon-like' cluster of VGR3016 gene: VGAM1263 host target protein, VGAM1264 host target protein, VGAM1265 host target protein, VGAM1266 host target protein and VGAM1267 host target protein, herein schematically represented by VGAM1 HOST TARGET PROTEIN through VGAM3 HOST TARGET PROTEIN. The function of these host target genes is elaborated hereinabove with reference to VGAM1263, VGAM1264, VGAM1265, VGAM1266 and VGAM1267.

FIG. 9 further provides a conceptual description of novel bioinformatically detected regulatory viral gene, referred to here as Viral Genomic Record 3017(VGR3017) viral gene, which encodes an 'operon-like' cluster of novel viral micro RNA-like genes, each of which in turn modulates expression of at least one host target gene, the function and utility of which at least one host target gene is known in the art.

VGR3017 gene, herein designated VGR GENE, is a novel bioinformatically detected regulatory, non protein coding, RNA viral gene. The method by which VGR3017 gene was detected is described hereinabove with reference to FIGS. 1-9.

VGR3017 gene encodes VGR3017 precursor RNA, herein designated VGR PRECURSOR RNA, an RNA molecule, typically several hundred nucleotides long.

VGR3017 precursor RNA folds spatially, forming VGR3017 folded precursor RNA, herein designated VGR FOLDED PRECURSOR RNA. It is appreciated that VGR3017 folded precursor RNA comprises a plurality of what is known in the art as 'hairpin' structures. These 'hairpin' structures are due to the fact that the nucleotide sequence of VGR3017 precursor RNA comprises a plurality of segments, the first half of each such segment having a nucleotide sequence which is at least a partial inversed-reversed sequence of the second half thereof, as is well known in the art.

VGR3017 folded precursor RNA is naturally processed by cellular enzymatic activity into at least 5 separate VGAM precursor RNAs, VGAM1268 precursor RNA, VGAM1269 precursor RNA, VGAM1270 precursor RNA, VGAM1271 precursor RNA and VGAM1272 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1268 RNA, VGAM1269 RNA, VGAM1270 RNA, VGAM1271 RNA and VGAM1272 RNA, herein schematically represented by VGAM1 RNA through VGAM3 RNA, each of which VGAM RNAs corresponding to VGAM RNA of FIG. 1.

VGAM1268 RNA, herein schematically represented by VGAM1 RNA through VGAM3 RNA, binds complementarily to a host target binding site located in an untranslated region of VGAM1268 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1268 host target RNA into VGAM1268 host target protein, herein schematically represented by VGAM1 HOST TARGET PROTEIN through VGAM3 HOST TARGET PROTEIN, all of FIG. 1.

VGAM1269 RNA, herein schematically represented by VGAM1 RNA through VGAM3 RNA, binds complementarily to a host target binding site located in an untranslated region of VGAM1269 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1269 host target RNA into VGAM1269 host target protein, herein schematically represented by VGAM1 HOST TARGET PROTEIN through VGAM3 HOST TARGET PROTEIN, all of FIG. 1.

VGAM1270 RNA, herein schematically represented by VGAM1 RNA through VGAM3 RNA, binds complementarily to a host target binding site located in an untranslated region of VGAM1270 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1270 host target RNA into VGAM1270 host target protein, herein schematically represented by VGAM1 HOST TARGET PROTEIN through VGAM3 HOST TARGET PROTEIN, all of FIG. 1.

VGAM1271 RNA, herein schematically represented by VGAM1 RNA through VGAM3 RNA, binds complementarily to a host target binding site located in an untranslated region of VGAM1271 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1271 host target RNA into VGAM1271 host target protein, herein schematically represented by VGAM1 HOST TARGET PROTEIN through VGAM3 HOST TARGET PROTEIN, all of FIG. 1.

VGAM1272 RNA, herein schematically represented by VGAM1 RNA through VGAM3 RNA, binds complementarily to a host target binding site located in an untranslated region of VGAM1272 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1272 host target RNA into VGAM1272 host target protein, herein schematically represented by VGAM1 HOST TARGET PROTEIN through VGAM3 HOST TARGET PROTEIN, all of FIG. 1.

It is appreciated that a function of VGR3017 gene, herein designated VGR GENE, is inhibition of expression of host target genes, as part of a novel viral mechanism of attacking a host. Accordingly, utilities of VGR3017 gene include diagnosis, prevention and treatment of viral infection by Grapevine Virus A. Specific functions, and accordingly utilities, of VGR3017 gene correlate with, and may be deduced from, the identity of the host target genes, which are inhibited by VGAM RNAs comprised in the 'operon-like' cluster of VGR3017 gene: VGAM1268 host target protein, VGAM1269 host target protein, VGAM1270 host target protein, VGAM1271 host target protein and VGAM1272 host target protein, herein schematically represented by VGAM1 HOST TARGET PROTEIN through VGAM3 HOST TARGET PROTEIN. The function of these host target genes is elaborated hereinabove with reference to VGAM1268, VGAM1269, VGAM1270, VGAM1271 and VGAM1272. FIG. 9 further provides a conceptual description of novel bioinformatically detected regulatory viral gene, referred to here as Viral Genomic Record 3018(VGR3018) viral gene, which encodes an 'operon-like' cluster of novel viral micro RNA-like genes, each of which in turn modulates expression of at least one host target gene, the function and utility of which at least one host target gene is known in the art.

VGR3018 gene, herein designated VGR GENE, is a novel bioinformatically detected regulatory, non protein coding, RNA viral gene. The method by which VGR3018 gene was detected is described hereinabove with reference to FIGS. 1-9.

VGR3018 gene encodes VGR3018 precursor RNA, herein designated VGR PRECURSOR RNA, an RNA molecule, typically several hundred nucleotides long.

VGR3018 precursor RNA folds spatially, forming VGR3018 folded precursor RNA, herein designated VGR FOLDED PRECURSOR RNA. It is appreciated that VGR3018 folded precursor RNA comprises a plurality of what is known in the art as 'hairpin' structures. These 'hairpin' structures are due to the fact that the nucleotide sequence of VGR3018 precursor RNA comprises a plurality of segments, the first half of each such segment having a nucleotide sequence which is at least a partial inversed-reversed sequence of the second half thereof, as is well known in the art.

VGR3018 folded precursor RNA is naturally processed by cellular enzymatic activity into at least 4 separate VGAM precursor RNAs, VGAM1273 precursor RNA, VGAM1274 precursor RNA, VGAM1275 precursor RNA and VGAM1276 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1273 RNA, VGAM1274 RNA, VGAM1275 RNA and VGAM1276 RNA, herein schematically represented by VGAM1 RNA through VGAM3 RNA, each of which VGAM RNAs corresponding to VGAM RNA of FIG. 1.

VGAM1273 RNA, herein schematically represented by VGAM1 RNA through VGAM3 RNA, binds complementarily to a host target binding site located in an untranslated region of VGAM1273 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1273 host target RNA into VGAM1273 host target protein, herein schematically represented by VGAM1 HOST TARGET PROTEIN through VGAM3 HOST TARGET PROTEIN, all of FIG. 1.

VGAM1274 RNA, herein schematically represented by VGAM1 RNA through VGAM3 RNA, binds complementarily to a host target binding site located in an untranslated region of VGAM1274 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1274 host target RNA into VGAM1274 host target protein, herein schematically represented by VGAM1 HOST TARGET PROTEIN through VGAM3 HOST TARGET PROTEIN, all of FIG. 1.

VGAM1275 RNA, herein schematically represented by VGAM1 RNA through VGAM3 RNA, binds complementarily to a host target binding site located in an untranslated region of VGAM1275 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1275 host target RNA into VGAM1275 host target protein, herein schematically represented by VGAM1 HOST TARGET PROTEIN through VGAM3 HOST TARGET PROTEIN, all of FIG. 1.

VGAM1276 RNA, herein schematically represented by VGAM1 RNA through VGAM3 RNA, binds complementarily to a host target binding site located in an untranslated region of VGAM1276 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1276 host target RNA into VGAM1276 host target protein, herein schematically represented by VGAM1 HOST TARGET PROTEIN through VGAM3 HOST TARGET PROTEIN, all of FIG. 1.

It is appreciated that a function of VGR3018 gene, herein designated VGR GENE, is inhibition of expression of host target genes, as part of a novel viral mechanism of attacking a host. Accordingly, utilities of VGR3018 gene include diagnosis, prevention and treatment of viral infection by A-2 Plaque Virus. Specific functions, and accordingly utilities, of VGR3018 gene correlate with, and may be deduced from, the identity of the host target genes, which are inhibited by VGAM RNAs comprised in the 'operon-like' cluster of VGR3018 gene: VGAM1273 host target protein, VGAM1274 host target protein, VGAM1275 host target protein and VGAM1276 host target protein, herein schematically represented by VGAM1 HOST TARGET PROTEIN through VGAM3 HOST TARGET PROTEIN. The function of these host target genes is elaborated hereinabove with reference to VGAM1273, VGAM1274, VGAM1275 and VGAM1276. FIG. 9 further provides a conceptual description of novel bioinformatically detected regulatory viral gene, referred to here as Viral Genomic Record 3019(VGR3019) viral gene, which encodes an 'operon-like' cluster of novel viral micro RNA-like genes, each of which in turn modulates expression of at least one host target gene, the function and utility of which at least one host target gene is known in the art.

VGR3019 gene, herein designated VGR GENE, is a novel bioinformatically detected regulatory, non protein coding, RNA viral gene. The method by which VGR3019 gene was detected is described hereinabove with reference to FIGS. 1-9.

VGR3019 gene encodes VGR3019 precursor RNA, herein designated VGR PRECURSOR RNA, an RNA molecule, typically several hundred nucleotides long.

VGR3019 precursor RNA folds spatially, forming VGR3019 folded precursor RNA, herein designated VGR FOLDED PRECURSOR RNA. It is appreciated that VGR3019 folded precursor RNA comprises a plurality of what is known in the art as 'hairpin' structures. These 'hairpin' structures are due to the fact that the nucleotide sequence of VGR3019 precursor RNA comprises a plurality of segments, the first half of each such segment having a nucleotide sequence which is at least a partial inversed-reversed sequence of the second half thereof, as is well known in the art.

VGR3019 folded precursor RNA is naturally processed by cellular enzymatic activity into at least 4 separate VGAM precursor RNAs, VGAM1277 precursor RNA, VGAM1278 precursor RNA, VGAM1279 precursor RNA and VGAM1280 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1277 RNA, VGAM1278 RNA, VGAM1279 RNA and VGAM1280 RNA, herein schematically represented by VGAM1 RNA through VGAM3 RNA, each of which VGAM RNAs corresponding to VGAM RNA of FIG. 1.

VGAM1277 RNA, herein schematically represented by VGAM1 RNA through VGAM3 RNA, binds complementarily to a host target binding site located in an untranslated region of VGAM1277 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1277 host target RNA into VGAM1277 host target protein, herein schematically represented by VGAM1 HOST TARGET PROTEIN through VGAM3 HOST TARGET PROTEIN, all of FIG. 1.

VGAM1278 RNA, herein schematically represented by VGAM1 RNA through VGAM3 RNA, binds complementarily to a host target binding site located in an untranslated region of VGAM1278 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1278 host target RNA into VGAM1278 host target protein, herein schematically represented by VGAM1 HOST TARGET PROTEIN through VGAM3 HOST TARGET PROTEIN, all of FIG. 1.

VGAM1279 RNA, herein schematically represented by VGAM1 RNA through VGAM3 RNA, binds complementarily to a host target binding site located in an untranslated region of VGAM1279 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1279 host target RNA into VGAM1279 host target protein, herein schematically represented by VGAM1 HOST TARGET PROTEIN through VGAM3 HOST TARGET PROTEIN, all of FIG. 1.

VGAM1280 RNA, herein schematically represented by VGAM1 RNA through VGAM3 RNA, binds complementarily to a host target binding site located in an untranslated region of VGAM1280 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1280 host target RNA into VGAM1280 host target protein, herein schematically represented by VGAM1 HOST TARGET PROTEIN through VGAM3 HOST TARGET PROTEIN, all of FIG. 1.

It is appreciated that a function of VGR3019 gene, herein designated VGR GENE, is inhibition of expression of host target genes, as part of a novel viral mechanism of attacking a host. Accordingly, utilities of VGR3019 gene include diagnosis, prevention and treatment of viral infection by Human Enterovirus C. Specific functions, and accordingly utilities, of VGR3019 gene correlate with, and may be deduced from, the identity of the host target genes, which are inhibited by VGAM RNAs comprised in the 'operon-like' cluster of VGR3019 gene: VGAM1277 host target protein, VGAM1278 host target protein, VGAM1279 host target protein and VGAM1280 host target protein, herein schematically represented by VGAM1 HOST TARGET PROTEIN through VGAM3 HOST TARGET PROTEIN. The function of these host target genes is elaborated hereinabove with reference to VGAM1277, VGAM1278, VGAM1279 and VGAM1280. FIG. 9 further provides a conceptual description of novel bioinformatically detected regulatory viral gene, referred to here as Viral Genomic Record 3020(VGR3020) viral gene, which encodes an 'operon-like' cluster of novel viral micro RNA-like genes, each of which in turn modulates expression of at least one host target gene, the function and utility of which at least one host target gene is known in the art.

VGR3020 gene, herein designated VGR GENE, is a novel bioinformatically detected regulatory, non protein coding, RNA viral gene. The method by which VGR3020 gene was detected is described hereinabove with reference to FIGS. 1-9.

VGR3020 gene encodes VGR3020 precursor RNA, herein designated VGR PRECURSOR RNA, an RNA molecule, typically several hundred nucleotides long.

VGR3020 precursor RNA folds spatially, forming VGR3020 folded precursor RNA, herein designated VGR FOLDED PRECURSOR RNA. It is appreciated that VGR3020 folded precursor RNA comprises a plurality of what is known in the art as 'hairpin' structures. These 'hairpin' structures are due to the fact that the nucleotide sequence of VGR3020 precursor RNA comprises a plurality of segments, the first half of each such segment having a nucleotide sequence which is at least a partial inversed-reversed sequence of the second half thereof, as is well known in the art.

VGR3020 folded precursor RNA is naturally processed by cellular enzymatic activity into at least 7 separate VGAM precursor RNAs, VGAM1281 precursor RNA, VGAM1282 precursor RNA, VGAM1283 precursor RNA, VGAM1284 precursor RNA, VGAM1285 precursor RNA, VGAM1286 precursor RNA and VGAM1287 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1281 RNA, VGAM1282 RNA, VGAM1283 RNA, VGAM1284 RNA, VGAM1285 RNA, VGAM1286 RNA and VGAM1287 RNA, herein schematically represented by VGAM1 RNA through VGAM3 RNA, each of which VGAM RNAs corresponding to VGAM RNA of FIG. 1.

VGAM1281 RNA, herein schematically represented by VGAM1 RNA through VGAM3 RNA, binds complementarily to a host target binding site located in an untranslated region of VGAM1281 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1281 host target RNA into VGAM1281 host target protein, herein schematically represented by VGAM1 HOST TARGET PROTEIN through VGAM3 HOST TARGET PROTEIN, all of FIG. 1.

VGAM1282 RNA, herein schematically represented by VGAM1 RNA through VGAM3 RNA, binds complementarily to a host target binding site located in an untranslated region of VGAM1282 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1282 host target RNA into VGAM1282 host target protein, herein schematically represented by VGAM1 HOST TARGET PROTEIN through VGAM3 HOST TARGET PROTEIN, all of FIG. 1.

VGAM1283 RNA, herein schematically represented by VGAM1 RNA through VGAM3 RNA, binds complementarily to a host target binding site located in an untranslated region of VGAM1283 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1283 host target RNA into VGAM1283 host target protein, herein schematically represented by VGAM1 HOST TARGET PROTEIN through VGAM3 HOST TARGET PROTEIN, all of FIG. 1.

VGAM1284 RNA, herein schematically represented by VGAM1 RNA through VGAM3 RNA, binds complementarily to a host target binding site located in an untranslated region of VGAM1284 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1284 host target RNA into VGAM1284 host target protein, herein schematically represented by VGAM1 HOST TARGET PROTEIN through VGAM3 HOST TARGET PROTEIN, all of FIG. 1.

VGAM1285 RNA, herein schematically represented by VGAM1 RNA through VGAM3 RNA, binds complementarily to a host target binding site located in an untranslated region of VGAM1285 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1285 host target RNA into VGAM1285 host target protein, herein schematically represented by VGAM1 HOST TARGET PROTEIN through VGAM3 HOST TARGET PROTEIN, all of FIG. 1.

VGAM1286 RNA, herein schematically represented by VGAM1 RNA through VGAM3 RNA, binds complementarily to a host target binding site located in an untranslated region of VGAM1286 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1286 host target RNA into VGAM1286 host target protein, herein schematically represented by VGAM1 HOST TARGET PROTEIN through VGAM3 HOST TARGET PROTEIN, all of FIG. 1.

VGAM1287 RNA, herein schematically represented by VGAM1 RNA through VGAM3 RNA, binds complementarily to a host target binding site located in an untranslated region of VGAM1287 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1287 host target RNA into VGAM1287 host target protein, herein schematically represented by VGAM1 HOST TARGET PROTEIN through VGAM3 HOST TARGET PROTEIN, all of FIG. 1.

It is appreciated that a function of VGR3020 gene, herein designated VGR GENE, is inhibition of expression of host target genes, as part of a novel viral mechanism of attacking a host. Accordingly, utilities of VGR3020 gene include diagnosis, prevention and treatment of viral infection by Beet Virus Q. Specific functions, and accordingly utilities, of VGR3020 gene correlate with, and may be deduced from, the identity of the host target genes, which are inhibited by VGAM RNAs comprised in the 'operon-like' cluster of VGR3020 gene: VGAM1281 host target protein, VGAM1282 host target protein, VGAM1283 host target protein, VGAM1284 host target protein, VGAM1285 host target protein, VGAM1286 host target protein and VGAM1287 host target protein, herein schematically represented by VGAM1 HOST TARGET PROTEIN through VGAM3 HOST TARGET PROTEIN. The function of these host target genes is elaborated hereinabove with reference to VGAM1281, VGAM1282, VGAM1283, VGAM1284, VGAM1285, VGAM1286 and VGAM1287. FIG. 9 further provides a conceptual description of novel bioinformatically detected regulatory viral gene, referred to here as Viral Genomic Record 3021(VGR3021) viral gene, which encodes an 'operon-like' cluster of novel viral micro RNA-like genes, each of which in turn modulates expression of at least one host target gene, the function and utility of which at least one host target gene is known in the art.

VGR3021 gene, herein designated VGR GENE, is a novel bioinformatically detected regulatory, non protein coding, RNA viral gene. The method by which VGR3021 gene was detected is described hereinabove with reference to FIGS. 1-9.

VGR3021 gene encodes VGR3021 precursor RNA, herein designated VGR PRECURSOR RNA, an RNA molecule, typically several hundred nucleotides long.

VGR3021 precursor RNA folds spatially, forming VGR3021 folded precursor RNA, herein designated VGR FOLDED PRECURSOR RNA. It is appreciated that VGR3021 folded precursor RNA comprises a plurality of what is known in the art as 'hairpin' structures. These 'hairpin' structures are due to the fact that the nucleotide sequence of VGR3021 precursor RNA comprises a plurality of segments, the first half of each such segment having a nucleotide sequence which is at least a partial inversed-reversed sequence of the second half thereof, as is well known in the art.

VGR3021 folded precursor RNA is naturally processed by cellular enzymatic activity into at least 2 separate VGAM precursor RNAs, VGAM1288 precursor RNA and VGAM1289 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1288 RNA and VGAM1289 RNA, herein schematically represented by VGAM1 RNA through VGAM3 RNA, each of which VGAM RNAs corresponding to VGAM RNA of FIG. 1.

VGAM1288 RNA, herein schematically represented by VGAM1 RNA through VGAM3 RNA, binds complementarily to a host target binding site located in an untranslated region of VGAM1288 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1288 host target RNA into VGAM1288 host target protein, herein schematically represented by VGAM1 HOST TARGET PROTEIN through VGAM3 HOST TARGET PROTEIN, all of FIG. 1.

VGAM1289 RNA, herein schematically represented by VGAM1 RNA through VGAM3 RNA, binds complementarily to a host target binding site located in an untranslated region of VGAM1289 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1289 host target RNA into VGAM1289 host target protein, herein schematically represented by VGAM1 HOST TARGET PROTEIN through VGAM3 HOST TARGET PROTEIN, all of FIG. 1.

It is appreciated that a function of VGR3021 gene, herein designated VGR GENE, is inhibition of expression of host target genes, as part of a novel viral mechanism of attacking a host. Accordingly, utilities of VGR3021 gene include diagnosis, prevention and treatment of viral infection by Saimiriine Herpesvirus 2. Specific functions, and accordingly utilities, of VGR3021 gene correlate with, and may be deduced from, the identity of the host target genes, which are inhibited by VGAM RNAs comprised in the 'operon-like' cluster of VGR3021 gene: VGAM1288 host target protein and VGAM1289 host target protein, herein schematically represented by VGAM1 HOST TARGET PROTEIN through VGAM3 HOST TARGET PROTEIN. The function of these host target genes is elaborated hereinabove with reference to VGAM1288 and VGAM1289. FIG. 9 further provides a conceptual description of novel bioinformatically detected regulatory viral gene, referred to here as Viral Genomic Record 3022(VGR3022) viral gene, which encodes an 'operon-like' cluster of novel viral micro RNA-like genes, each of which in turn modulates expression of at least one host target gene, the function and utility of which at least one host target gene is known in the art.

VGR3022 gene, herein designated VGR GENE, is a novel bioinformatically detected regulatory, non protein coding, RNA viral gene. The method by which VGR3022 gene was detected is described hereinabove with reference to FIGS. 1-9.

VGR3022 gene encodes VGR3022 precursor RNA, herein designated VGR PRECURSOR RNA, an RNA molecule, typically several hundred nucleotides long.

VGR3022 precursor RNA folds spatially, forming VGR3022 folded precursor RNA, herein designated VGR FOLDED PRECURSOR RNA. It is appreciated that VGR3022 folded precursor RNA comprises a plurality of what is known in the art as 'hairpin' structures. These 'hairpin' structures are due to the fact that the nucleotide sequence of VGR3022 precursor RNA comprises a plurality of segments, the first half of each such segment having a nucleotide sequence which is at least a partial inversed-reversed sequence of the second half thereof, as is well known in the art.

VGR3022 folded precursor RNA is naturally processed by cellular enzymatic activity into at least 3 separate VGAM precursor RNAs, VGAM1291 precursor RNA, VGAM1292 precursor RNA and VGAM1293 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1291 RNA, VGAM1292 RNA and VGAM1293 RNA, herein schematically represented by VGAM1 RNA through VGAM3 RNA, each of which VGAM RNAs corresponding to VGAM RNA of FIG. 1.

VGAM1291 RNA, herein schematically represented by VGAM1 RNA through VGAM3 RNA, binds complementarily to a host target binding site located in an untranslated region of VGAM1291 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1291 host target RNA into VGAM1291 host target protein, herein schematically represented by VGAM1 HOST TARGET PROTEIN through VGAM3 HOST TARGET PROTEIN, all of FIG. 1.

VGAM1292 RNA, herein schematically represented by VGAM1 RNA through VGAM3 RNA, binds complementarily to a host target binding site located in an untranslated region of VGAM1292 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1292 host target RNA into VGAM1292 host target protein, herein schematically represented by VGAM1 HOST TARGET PROTEIN through VGAM3 HOST TARGET PROTEIN, all of FIG. 1.

VGAM1293 RNA, herein schematically represented by VGAM1 RNA through VGAM3 RNA, binds complementarily to a host target binding site located in an untranslated region of VGAM1293 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1293 host target RNA into VGAM1293 host target protein, herein schematically represented by VGAM1 HOST TARGET PROTEIN through VGAM3 HOST TARGET PROTEIN, all of FIG. 1.

It is appreciated that a function of VGR3022 gene, herein designated VGR GENE, is inhibition of expression of host target genes, as part of a novel viral mechanism of attacking a host. Accordingly, utilities of VGR3022 gene include diagnosis, prevention and treatment of viral infection by Swinepox Virus. Specific functions, and accordingly utilities, of VGR3022 gene correlate with, and may be deduced from, the identity of the host target genes, which are inhibited by VGAM RNAs comprised in the 'operon-like' cluster of VGR3022 gene: VGAM1291 host target protein, VGAM1292 host target protein and VGAM1293 host target protein, herein schematically represented by VGAM1 HOST TARGET PROTEIN through VGAM3 HOST TARGET PROTEIN. The function of these host target genes is elaborated hereinabove with reference to VGAM1291, VGAM1292 and VGAM1293. FIG. 9 further provides a conceptual description of novel bioinformatically detected regulatory viral gene, referred to here as Viral Genomic Record 3023(VGR3023) viral gene, which encodes an 'operon-like' cluster of novel viral micro RNA-like genes, each of which in turn modulates expression of at least one host target gene, the function and utility of which at least one host target gene is known in the art.

VGR3023 gene, herein designated VGR GENE, is a novel bioinformatically detected regulatory, non protein coding, RNA viral gene. The method by which VGR3023 gene was detected is described hereinabove with reference to FIGS. 1-9.

VGR3023 gene encodes VGR3023 precursor RNA, herein designated VGR PRECURSOR RNA, an RNA molecule, typically several hundred nucleotides long.

VGR3023 precursor RNA folds spatially, forming VGR3023 folded precursor RNA, herein designated VGR FOLDED PRECURSOR RNA. It is appreciated that VGR3023 folded precursor RNA comprises a plurality of what is known in the art as 'hairpin' structures. These 'hairpin' structures are due to the fact that the nucleotide sequence of VGR3023 precursor RNA comprises a plurality of segments, the first half of each such segment having a nucleotide sequence which is at least a partial inversed-reversed sequence of the second half thereof, as is well known in the art.

VGR3023 folded precursor RNA is naturally processed by cellular enzymatic activity into at least 3 separate VGAM precursor RNAs, VGAM1294 precursor RNA, VGAM1295 precursor RNA and VGAM1296 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1294 RNA, VGAM1295 RNA and VGAM1296 RNA, herein schematically represented by VGAM1 RNA through VGAM3 RNA, each of which VGAM RNAs corresponding to VGAM RNA of FIG. 1.

VGAM1294 RNA, herein schematically represented by VGAM1 RNA through VGAM3 RNA, binds complementarily to a host target binding site located in an untranslated region of VGAM1294 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1294 host target RNA into VGAM1294 host target protein, herein schematically represented by VGAM1 HOST TARGET PROTEIN through VGAM3 HOST TARGET PROTEIN, all of FIG. 1.

VGAM1295 RNA, herein schematically represented by VGAM1 RNA through VGAM3 RNA, binds complementarily to a host target binding site located in an untranslated region of VGAM1295 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1295 host target RNA into VGAM1295 host target protein, herein schematically represented by VGAM1 HOST TARGET PROTEIN through VGAM3 HOST TARGET PROTEIN, all of FIG. 1.

VGAM1296 RNA, herein schematically represented by VGAM1 RNA through VGAM3 RNA, binds complementarily to a host target binding site located in an untranslated region of VGAM1296 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1296 host target RNA into VGAM1296 host target protein, herein schematically represented by VGAM1 HOST TARGET PROTEIN through VGAM3 HOST TARGET PROTEIN, all of FIG. 1.

It is appreciated that a function of VGR3023 gene, herein designated VGR GENE, is inhibition of expression of host target genes, as part of a novel viral mechanism of attacking a host. Accordingly, utilities of VGR3023 gene include diagnosis, prevention and treatment of viral infection by Vaccinia Virus. Specific functions, and accordingly utilities, of VGR3023 gene correlate with, and may be deduced from, the identity of the host target genes, which are inhibited by VGAM RNAs comprised in the 'operon-like' cluster of VGR3023 gene: VGAM1294 host target protein, VGAM1295 host target protein and VGAM1296 host target protein, herein schematically represented by VGAM1 HOST TARGET PROTEIN through VGAM3 HOST TARGET PROTEIN. The function of these host target genes is elaborated hereinabove with reference to VGAM1294, VGAM1295 and VGAM1296. FIG. 9 further provides a conceptual description of novel bioinformatically detected regulatory viral gene, referred to here as Viral Genomic Record 3024(VGR3024) viral gene, which encodes an 'operon-like' cluster of novel viral micro RNA-like genes, each of which in turn modulates expression of at least one host target gene, the function and utility of which at least one host target gene is known in the art.

VGR3024 gene, herein designated VGR GENE, is a novel bioinformatically detected regulatory, non protein coding, RNA viral gene. The method by which VGR3024 gene was detected is described hereinabove with reference to FIGS. 1-9.

VGR3024 gene encodes VGR3024 precursor RNA, herein designated VGR PRECURSOR RNA, an RNA molecule, typically several hundred nucleotides long.

VGR3024 precursor RNA folds spatially, forming VGR3024 folded precursor RNA, herein designated VGR FOLDED PRECURSOR RNA. It is appreciated that VGR3024 folded precursor RNA comprises a plurality of what is known in the art as 'hairpin' structures. These 'hairpin' structures are due to the fact that the nucleotide sequence of VGR3024 precursor RNA comprises a plurality of segments, the first half of each such segment having a nucleotide sequence which is at least a partial inversed-reversed sequence of the second half thereof, as is well known in the art.

VGR3024 folded precursor RNA is naturally processed by cellular enzymatic activity into at least 5 separate VGAM precursor RNAs, VGAM1297 precursor RNA, VGAM1298 precursor RNA, VGAM1299 precursor RNA, VGAM1300 precursor RNA and VGAM1301 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1297 RNA, VGAM1298 RNA, VGAM1299 RNA, VGAM1300 RNA and VGAM1301 RNA, herein schematically represented by VGAM1 RNA through VGAM3 RNA, each of which VGAM RNAs corresponding to VGAM RNA of FIG. 1.

VGAM1297 RNA, herein schematically represented by VGAM1 RNA through VGAM3 RNA, binds complementarily to a host target binding site located in an untranslated region of VGAM1297 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1297 host target RNA into VGAM1297 host target protein, herein schematically represented by VGAM1 HOST TARGET PROTEIN through VGAM3 HOST TARGET PROTEIN, all of FIG. 1.

VGAM1298 RNA, herein schematically represented by VGAM1 RNA through VGAM3 RNA, binds complementarily to a host target binding site located in an untranslated region of VGAM1298 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1298 host target RNA into VGAM1298 host target protein, herein schematically represented by VGAM1 HOST TARGET PROTEIN through VGAM3 HOST TARGET PROTEIN, all of FIG. 1.

VGAM1299 RNA, herein schematically represented by VGAM1 RNA through VGAM3 RNA, binds complementarily to a host target binding site located in an untranslated region of VGAM1299 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1299 host target RNA into VGAM1299 host target protein, herein schematically represented by VGAM1 HOST TARGET PROTEIN through VGAM3 HOST TARGET PROTEIN, all of FIG. 1.

VGAM1300 RNA, herein schematically represented by VGAM1 RNA through VGAM3 RNA, binds complementarily to a host target binding site located in an untranslated region of VGAM1300 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1300 host target RNA into VGAM1300 host target protein, herein schematically represented by VGAM1 HOST TARGET PROTEIN through VGAM3 HOST TARGET PROTEIN, all of FIG. 1.

VGAM1301 RNA, herein schematically represented by VGAM1 RNA through VGAM3 RNA, binds complementarily to a host target binding site located in an untranslated region of VGAM1301 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1301 host target RNA into VGAM1301 host target protein, herein schematically represented by VGAM1 HOST TARGET PROTEIN through VGAM3 HOST TARGET PROTEIN, all of FIG. 1.

It is appreciated that a function of VGR3024 gene, herein designated VGR GENE, is inhibition of expression of host target genes, as part of a novel viral mechanism of attacking a host. Accordingly, utilities of VGR3024 gene include diagnosis, prevention and treatment of viral infection by Yaba-like Disease Virus. Specific functions, and accordingly utilities, of VGR3024 gene correlate with, and may be deduced from, the identity of the host target genes, which are inhibited by VGAM RNAs comprised in the 'operon-like' cluster of VGR3024 gene: VGAM1297 host target protein, VGAM1298 host target protein, VGAM1299 host target protein, VGAM1300 host target protein and VGAM1301 host target protein, herein schematically represented by VGAM1 HOST TARGET PROTEIN through VGAM3 HOST TARGET PROTEIN. The function of these host target genes is elaborated hereinabove with reference to VGAM1297, VGAM1298, VGAM1299, VGAM1300 and VGAM1301. FIG. 9 further provides a conceptual description of novel bioinformatically detected regulatory viral gene, referred to here as Viral Genomic Record 3025(VGR3025) viral gene, which encodes an 'operon-like' cluster of novel viral micro RNA-like genes, each of which in turn modulates expression of at least one host target gene, the function and utility of which at least one host target gene is known in the art.

VGR3025 gene, herein designated VGR GENE, is a novel bioinformatically detected regulatory, non protein coding, RNA viral gene. The method by which VGR3025 gene was detected is described hereinabove with reference to FIGS. 1-9.

VGR3025 gene encodes VGR3025 precursor RNA, herein designated VGR PRECURSOR RNA, an RNA molecule, typically several hundred nucleotides long.

VGR3025 precursor RNA folds spatially, forming VGR3025 folded precursor RNA, herein designated VGR FOLDED PRECURSOR RNA. It is appreciated that VGR3025 folded precursor RNA comprises a plurality of what is known in the art as 'hairpin' structures. These 'hairpin' structures are due to the fact that the nucleotide sequence of VGR3025 precursor RNA comprises a plurality of segments, the first half of each such segment having a nucleotide sequence which is at least a partial inversed-reversed sequence of the second half thereof, as is well known in the art.

VGR3025 folded precursor RNA is naturally processed by cellular enzymatic activity into at least 3 separate VGAM precursor RNAs, VGAM1302 precursor RNA, VGAM1303 precursor RNA and VGAM1304 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1302 RNA, VGAM1303 RNA and VGAM1304 RNA, herein schematically represented by VGAM1 RNA through VGAM3 RNA, each of which VGAM RNAs corresponding to VGAM RNA of FIG. 1.

VGAM1302 RNA, herein schematically represented by VGAM1 RNA through VGAM3 RNA, binds complementarily to a host target binding site located in an untranslated region of VGAM1302 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1302 host target RNA into VGAM1302 host target protein, herein schematically represented by VGAM1 HOST TARGET PROTEIN through VGAM3 HOST TARGET PROTEIN, all of FIG. 1.

VGAM1303 RNA, herein schematically represented by VGAM1 RNA through VGAM3 RNA, binds complementarily to a host target binding site located in an untranslated region of VGAM1303 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1303 host target RNA into VGAM1303 host target protein, herein schematically represented by VGAM1 HOST TARGET PROTEIN through VGAM3 HOST TARGET PROTEIN, all of FIG. 1.

VGAM1304 RNA, herein schematically represented by VGAM1 RNA through VGAM3 RNA, binds complementarily to a host target binding site located in an untranslated region of VGAM1304 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1304 host target RNA into VGAM1304 host target protein, herein schematically represented by VGAM1 HOST TARGET PROTEIN through VGAM3 HOST TARGET PROTEIN, all of FIG. 1.

It is appreciated that a function of VGR3025 gene, herein designated VGR GENE, is inhibition of expression of host target genes, as part of a novel viral mechanism of attacking a host. Accordingly, utilities of VGR3025 gene include diagnosis, prevention and treatment of viral infection by Human Herpesvirus 5. Specific functions, and accordingly utilities, of VGR3025 gene correlate with, and may be deduced from, the identity of the host target genes, which are inhibited by VGAM RNAs comprised in the 'operon-like' cluster of VGR3025 gene: VGAM1302 host target protein, VGAM1303 host target protein and VGAM1304 host target protein, herein schematically represented by VGAM1 HOST TARGET PROTEIN through VGAM3 HOST TARGET PROTEIN. The function of these host target genes is elaborated hereinabove with reference to VGAM1302, VGAM1303 and VGAM1304. FIG. 9 further provides a conceptual description of novel bioinformatically detected regulatory viral gene, referred to here as Viral Genomic Record 3026(VGR3026) viral gene, which encodes an 'operon-like' cluster of novel viral micro RNA-like genes, each of which in turn modulates expression of at least one host target gene, the function and utility of which at least one host target gene is known in the art.

VGR3026 gene, herein designated VGR GENE, is a novel bioinformatically detected regulatory, non protein coding, RNA viral gene. The method by which VGR3026 gene was detected is described hereinabove with reference to FIGS. 1-9.

VGR3026 gene encodes VGR3026 precursor RNA, herein designated VGR PRECURSOR RNA, an RNA molecule, typically several hundred nucleotides long.

VGR3026 precursor RNA folds spatially, forming VGR3026 folded precursor RNA, herein designated VGR FOLDED PRECURSOR RNA. It is appreciated that VGR3026 folded precursor RNA comprises a plurality of what is known in the art as 'hairpin' structures. These 'hairpin' structures are due to the fact that the nucleotide sequence of VGR3026 precursor RNA comprises a plurality of segments, the first half of each such segment having a nucleotide sequence which is at least a partial inversed-reversed sequence of the second half thereof, as is well known in the art.

VGR3026 folded precursor RNA is naturally processed by cellular enzymatic activity into at least 4 separate VGAM precursor RNAs, VGAM1305 precursor RNA, VGAM1306 precursor RNA, VGAM1307 precursor RNA and VGAM1308 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1305 RNA, VGAM1306 RNA, VGAM1307 RNA and VGAM1308 RNA, herein schematically represented by VGAM1 RNA through VGAM3 RNA, each of which VGAM RNAs corresponding to VGAM RNA of FIG. 1.

VGAM1305 RNA, herein schematically represented by VGAM1 RNA through VGAM3 RNA, binds complementarily to a host target binding site located in an untranslated region of VGAM1305 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1305 host target RNA into VGAM1305 host target protein, herein schematically represented by VGAM1 HOST TARGET PROTEIN through VGAM3 HOST TARGET PROTEIN, all of FIG. 1.

VGAM1306 RNA, herein schematically represented by VGAM1 RNA through VGAM3 RNA, binds complementarily to a host target binding site located in an untranslated region of VGAM1306 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1306 host target RNA into VGAM1306 host target protein, herein schematically represented by VGAM1 HOST TARGET PROTEIN through VGAM3 HOST TARGET PROTEIN, all of FIG. 1.

VGAM1307 RNA, herein schematically represented by VGAM1 RNA through VGAM3 RNA, binds complementarily to a host target binding site located in an untranslated region of VGAM1307 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1307 host target RNA into VGAM1307 host target protein, herein schematically represented by VGAM1 HOST TARGET PROTEIN through VGAM3 HOST TARGET PROTEIN, all of FIG. 1.

VGAM1308 RNA, herein schematically represented by VGAM1 RNA through VGAM3 RNA, binds complementarily to a host target binding site located in an untranslated region of VGAM1308 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1308 host target RNA into VGAM1308 host target protein, herein schematically represented by VGAM1 HOST TARGET PROTEIN through VGAM3 HOST TARGET PROTEIN, all of FIG. 1.

It is appreciated that a function of VGR3026 gene, herein designated VGR GENE, is inhibition of expression of host target genes, as part of a novel viral mechanism of attacking a host. Accordingly, utilities of VGR3026 gene include diagnosis, prevention and treatment of viral infection by Foot-and-mouth Disease Virus SAT 2 (FMDV-SAT2). Specific functions, and accordingly utilities, of VGR3026 gene correlate with, and may be deduced from, the identity of the host target genes, which are inhibited by VGAM RNAs comprised in the 'operon-like' cluster of VGR3026 gene: VGAM1305 host target protein, VGAM1306 host target protein, VGAM1307 host target protein and VGAM1308 host target protein, herein schematically represented by VGAM1 HOST TARGET PROTEIN through VGAM3 HOST TARGET PROTEIN. The function of these host target genes is elaborated hereinabove with reference to VGAM1305, VGAM1306, VGAM1307 and VGAM1308. FIG. 9 further provides a conceptual description of novel bioinformatically detected regulatory viral gene, referred to here as Viral Genomic Record 3027(VGR3027) viral gene, which encodes an 'operon-like' cluster of novel viral micro RNA-like genes, each of which in turn modulates expression of at least one host target gene, the function and utility of which at least one host target gene is known in the art.

VGR3027 gene, herein designated VGR GENE, is a novel bioinformatically detected regulatory, non protein coding, RNA viral gene. The method by which VGR3027 gene was detected is described hereinabove with reference to FIGS. 1-9.

VGR3027 gene encodes VGR3027 precursor RNA, herein designated VGR PRECURSOR RNA, an RNA molecule, typically several hundred nucleotides long.

VGR3027 precursor RNA folds spatially, forming VGR3027 folded precursor RNA, herein designated VGR FOLDED PRECURSOR RNA. It is appreciated that VGR3027 folded precursor RNA comprises a plurality of what is known in the art as 'hairpin' structures. These 'hairpin' structures are due to the fact that the nucleotide sequence of VGR3027 precursor RNA comprises a plurality of segments, the first half of each such segment having a nucleotide sequence which is at least a partial inversed-reversed sequence of the second half thereof, as is well known in the art.

VGR3027 folded precursor RNA is naturally processed by cellular enzymatic activity into at least 2 separate VGAM precursor RNAs, VGAM1309 precursor RNA and VGAM1310 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1309 RNA and VGAM1310 RNA, herein schematically represented by VGAM1 RNA through VGAM3 RNA, each of which VGAM RNAs corresponding to VGAM RNA of FIG. 1.

VGAM1309 RNA, herein schematically represented by VGAM1 RNA through VGAM3 RNA, binds complementarily to a host target binding site located in an untranslated region of VGAM1309 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1309 host target RNA into VGAM1309 host target protein, herein schematically represented by VGAM1 HOST TARGET PROTEIN through VGAM3 HOST TARGET PROTEIN, all of FIG. 1.

VGAM1310 RNA, herein schematically represented by VGAM1 RNA through VGAM3 RNA, binds complementarily to a host target binding site located in an untranslated region of VGAM1310 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1310 host target RNA into VGAM1310 host target protein, herein schematically represented by VGAM1 HOST TARGET PROTEIN through VGAM3 HOST TARGET PROTEIN, all of FIG. 1.

It is appreciated that a function of VGR3027 gene, herein designated VGR GENE, is inhibition of expression of host target genes, as part of a novel viral mechanism of attacking a host. Accordingly, utilities of VGR3027 gene include diagnosis, prevention and treatment of viral infection by Human Adenovirus D. Specific functions, and accordingly utilities, of VGR3027 gene correlate with, and may be deduced from, the identity of the host target genes, which are inhibited by VGAM RNAs comprised in the 'operon-like' cluster of VGR3027 gene: VGAM1309 host target protein and VGAM1310 host target protein, herein schematically represented by VGAM1 HOST TARGET PROTEIN through VGAM3 HOST TARGET PROTEIN. The function of these host target genes is elaborated hereinabove with reference to VGAM1309 and VGAM1310. FIG. 9 further provides a conceptual description of novel bioinformatically detected regulatory viral gene, referred to here as Viral Genomic Record 3028(VGR3028) viral gene, which encodes an 'operon-like' cluster of novel viral micro RNA-like genes, each of which in turn modulates expression of at least one host target gene, the function and utility of which at least one host target gene is known in the art.

VGR3028 gene, herein designated VGR GENE, is a novel bioinformatically detected regulatory, non protein coding, RNA viral gene. The method by which VGR3028 gene was detected is described hereinabove with reference to FIGS. 1-9.

VGR3028 gene encodes VGR3028 precursor RNA, herein designated VGR PRECURSOR RNA, an RNA molecule, typically several hundred nucleotides long.

VGR3028 precursor RNA folds spatially, forming VGR3028 folded precursor RNA, herein designated VGR FOLDED PRECURSOR RNA. It is appreciated that VGR3028 folded precursor RNA comprises a plurality of what is known in the art as 'hairpin' structures. These 'hairpin' structures are due to the fact that the nucleotide sequence of VGR3028 precursor RNA comprises a plurality of segments, the first half of each such segment having a nucleotide sequence which is at least a partial inversed-reversed sequence of the second half thereof, as is well known in the art.

VGR3028 folded precursor RNA is naturally processed by cellular enzymatic activity into at least 6 separate VGAM precursor RNAs, VGAM1311 precursor RNA, VGAM1312 precursor RNA, VGAM1313 precursor RNA, VGAM1314 precursor RNA, VGAM1315 precursor RNA and VGAM1316 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1311 RNA, VGAM1312 RNA, VGAM1313 RNA, VGAM1314 RNA, VGAM1315 RNA and VGAM1316 RNA, herein schematically represented by VGAM1 RNA through VGAM3 RNA, each of which VGAM RNAs corresponding to VGAM RNA of FIG. 1.

VGAM1311 RNA, herein schematically represented by VGAM1 RNA through VGAM3 RNA, binds complementarily to a host target binding site located in an untranslated region of VGAM1311 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1311 host target RNA into VGAM1311 host target protein, herein schematically represented by VGAM1 HOST TARGET PROTEIN through VGAM3 HOST TARGET PROTEIN, all of FIG. 1.

VGAM1312 RNA, herein schematically represented by VGAM1 RNA through VGAM3 RNA, binds complementarily to a host target binding site located in an untranslated region of VGAM1312 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1312 host target RNA into VGAM1312 host target protein, herein schematically represented by VGAM1 HOST TARGET PROTEIN through VGAM3 HOST TARGET PROTEIN, all of FIG. 1.

VGAM1313 RNA, herein schematically represented by VGAM1 RNA through VGAM3 RNA, binds complementarily to a host target binding site located in an untranslated region of VGAM1313 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1313 host target RNA into VGAM1313 host target protein, herein schematically represented by VGAM1 HOST TARGET PROTEIN through VGAM3 HOST TARGET PROTEIN, all of FIG. 1.

VGAM1314 RNA, herein schematically represented by VGAM1 RNA through VGAM3 RNA, binds complementarily to a host target binding site located in an untranslated region of VGAM1314 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1314 host target RNA into VGAM1314 host target protein, herein schematically represented by VGAM1 HOST TARGET PROTEIN through VGAM3 HOST TARGET PROTEIN, all of FIG. 1.

VGAM1315 RNA, herein schematically represented by VGAM1 RNA through VGAM3 RNA, binds complementarily to a host target binding site located in an untranslated region of VGAM1315 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1315 host target RNA into VGAM1315 host target protein, herein schematically represented by VGAM1 HOST TARGET PROTEIN through VGAM3 HOST TARGET PROTEIN, all of FIG. 1.

VGAM1316 RNA, herein schematically represented by VGAM1 RNA through VGAM3 RNA, binds complementarily to a host target binding site located in an untranslated region of VGAM1316 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1316 host target RNA into VGAM1316 host target protein, herein schematically represented by VGAM1 HOST TARGET PROTEIN through VGAM3 HOST TARGET PROTEIN, all of FIG. 1.

It is appreciated that a function of VGR3028 gene, herein designated VGR GENE, is inhibition of expression of host target genes, as part of a novel viral mechanism of attacking a host. Accordingly, utilities of VGR3028 gene include diagnosis, prevention and treatment of viral infection by Foot-and-mouth Disease Virus C. Specific functions, and accordingly utilities, of VGR3028 gene correlate with, and may be deduced from, the identity of the host target genes, which are inhibited by VGAM RNAs comprised in the 'operon-like' cluster of VGR3028 gene: VGAM1311 host target protein, VGAM1312 host target protein, VGAM1313 host target protein, VGAM1314 host target protein, VGAM1315 host target protein and VGAM1316 host target protein, herein schematically represented by VGAM1 HOST TARGET PROTEIN through VGAM3 HOST TARGET PROTEIN. The function of these host target genes is elaborated hereinabove with reference to VGAM1311, VGAM1312, VGAM1313, VGAM1314, VGAM1315 and VGAM1316. FIG. 9 further provides a conceptual description of novel bioinformatically detected regulatory viral gene, referred to here as Viral Genomic Record 3029(VGR3029) viral gene, which encodes an 'operon-like' cluster of novel viral micro RNA-like genes, each of which in turn modulates expression of at least one host target gene, the function and utility of which at least one host target gene is known in the art.

VGR3029 gene, herein designated VGR GENE, is a novel bioinformatically detected regulatory, non protein coding, RNA viral gene. The method by which VGR3029 gene was detected is described hereinabove with reference to FIGS. 1-9.

VGR3029 gene encodes VGR3029 precursor RNA, herein designated VGR PRECURSOR RNA, an RNA molecule, typically several hundred nucleotides long.

VGR3029 precursor RNA folds spatially, forming VGR3029 folded precursor RNA, herein designated VGR FOLDED PRECURSOR RNA. It is appreciated that VGR3029 folded precursor RNA comprises a plurality of what is known in the art as 'hairpin' structures. These 'hairpin' structures are due to the fact that the nucleotide sequence of VGR3029 precursor RNA comprises a plurality of segments, the first half of each such segment having a nucleotide sequence which is at least a partial inversed-reversed sequence of the second half thereof, as is well known in the art.

VGR3029 folded precursor RNA is naturally processed by cellular enzymatic activity into at least 3 separate VGAM precursor RNAs, VGAM1317 precursor RNA, VGAM1318 precursor RNA and VGAM1319 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1317 RNA, VGAM1318 RNA and VGAM1319 RNA, herein schematically represented by VGAM1 RNA through VGAM3 RNA, each of which VGAM RNAs corresponding to VGAM RNA of FIG. 1.

VGAM1317 RNA, herein schematically represented by VGAM1 RNA through VGAM3 RNA, binds complementarily to a host target binding site located in an untranslated region of VGAM1317 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1317 host target RNA into VGAM1317 host target protein, herein schematically represented by VGAM1 HOST TARGET PROTEIN through VGAM3 HOST TARGET PROTEIN, all of FIG. 1.

VGAM1318 RNA, herein schematically represented by VGAM1 RNA through VGAM3 RNA, binds complementarily to a host target binding site located in an untranslated region of VGAM1318 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1318 host target RNA into VGAM1318 host target protein, herein schematically represented by VGAM1 HOST TARGET PROTEIN through VGAM3 HOST TARGET PROTEIN, all of FIG. 1.

VGAM1319 RNA, herein schematically represented by VGAM1 RNA through VGAM3 RNA, binds complementarily to a host target binding site located in an untranslated region of VGAM1319 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1319 host target RNA into VGAM1319 host target protein, herein schematically represented by VGAM1 HOST TARGET PROTEIN through VGAM3 HOST TARGET PROTEIN, all of FIG. 1.

It is appreciated that a function of VGR3029 gene, herein designated VGR GENE, is inhibition of expression of host target genes, as part of a novel viral mechanism of attacking a host. Accordingly, utilities of VGR3029 gene include diagnosis, prevention and treatment of viral infection by Foot-and-mouth Disease Virus O. Specific functions, and accordingly utilities, of VGR3029 gene correlate with, and may be deduced from, the identity of the host target genes, which are inhibited by VGAM RNAs comprised in the 'operon-like' cluster of VGR3029 gene: VGAM1317 host target protein, VGAM1318 host target protein and VGAM1319 host target protein, herein schematically represented by VGAM1 HOST TARGET PROTEIN through VGAM3 HOST TARGET PROTEIN. The function of these host target genes is elaborated hereinabove with reference to VGAM1317, VGAM1318 and VGAM1319. FIG. 9 further provides a conceptual description of novel bioinformatically detected regulatory viral gene, referred to here as Viral Genomic Record 3030(VGR3030) viral gene, which encodes an 'operon-like' cluster of novel viral micro RNA-like genes, each of which in turn modulates expression of at least one host target gene, the function and utility of which at least one host target gene is known in the art.

VGR3030 gene, herein designated VGR GENE, is a novel bioinformatically detected regulatory, non protein coding, RNA viral gene. The method by which VGR3030 gene was detected is described hereinabove with reference to FIGS. 1-9.

VGR3030 gene encodes VGR3030 precursor RNA, herein designated VGR PRECURSOR RNA, an RNA molecule, typically several hundred nucleotides long.

VGR3030 precursor RNA folds spatially, forming VGR3030 folded precursor RNA, herein designated VGR FOLDED PRECURSOR RNA. It is appreciated that VGR3030 folded precursor RNA comprises a plurality of what is known in the art as 'hairpin' structures. These 'hairpin' structures are due to the fact that the nucleotide sequence of VGR3030 precursor RNA comprises a plurality of segments, the first half of each such segment having a nucleotide sequence which is at least a partial inversed-reversed sequence of the second half thereof, as is well known in the art.

VGR3030 folded precursor RNA is naturally processed by cellular enzymatic activity into at least 2 separate VGAM precursor RNAs, VGAM1320 precursor RNA and VGAM1321 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1320 RNA and VGAM1321 RNA, herein schematically represented by VGAM1 RNA through VGAM3 RNA, each of which VGAM RNAs corresponding to VGAM RNA of FIG. 1.

VGAM1320 RNA, herein schematically represented by VGAM1 RNA through VGAM3 RNA, binds complementarily to a host target binding site located in an untranslated region of VGAM1320 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1320 host target RNA into VGAM1320 host target protein, herein schematically represented by VGAM1 HOST TARGET PROTEIN through VGAM3 HOST TARGET PROTEIN, all of FIG. 1.

VGAM1321 RNA, herein schematically represented by VGAM1 RNA through VGAM3 RNA, binds complementarily to a host target binding site located in an untranslated region of VGAM1321 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1321 host target RNA into VGAM1321 host target protein, herein schematically represented by VGAM1 HOST TARGET PROTEIN through VGAM3 HOST TARGET PROTEIN, all of FIG. 1.

It is appreciated that a function of VGR3030 gene, herein designated VGR GENE, is inhibition of expression of host target genes, as part of a novel viral mechanism of attacking a host. Accordingly, utilities of VGR3030 gene include diagnosis, prevention and treatment of viral infection by Melanoplus Sanguinipes Entomopoxvirus. Specific functions, and accordingly utilities, of VGR3030 gene correlate with, and may be deduced from, the identity of the host target genes, which are inhibited by VGAM RNAs comprised in the 'operon-like' cluster of VGR3030 gene: VGAM1320 host target protein and VGAM1321 host target protein, herein schematically represented by VGAM1 HOST TARGET PROTEIN through VGAM3 HOST TARGET PROTEIN. The function of these host target genes is elaborated hereinabove with reference to VGAM1320 and VGAM1321. FIG. 9 further provides a conceptual description of novel bioinformatically detected regulatory viral gene, referred to here as Viral Genomic Record 3031(VGR3031) viral gene, which encodes an 'operon-like' cluster of novel viral micro RNA-like genes, each of which in turn modulates expression of at least one host target gene, the function and utility of which at least one host target gene is known in the art.

VGR3031 gene, herein designated VGR GENE, is a novel bioinformatically detected regulatory, non protein coding, RNA viral gene. The method by which VGR3031 gene was detected is described hereinabove with reference to FIGS. 1-9.

VGR3031 gene encodes VGR3031 precursor RNA, herein designated VGR PRECURSOR RNA, an RNA molecule, typically several hundred nucleotides long.

VGR3031 precursor RNA folds spatially, forming VGR3031 folded precursor RNA, herein designated VGR FOLDED PRECURSOR RNA. It is appreciated that VGR3031 folded precursor RNA comprises a plurality of what is known in the art as 'hairpin' structures. These 'hairpin' structures are due to the fact that the nucleotide sequence of VGR3031 precursor RNA comprises a plurality of segments, the first half of each such segment having a nucleotide sequence which is at least a partial inversed-reversed sequence of the second half thereof, as is well known in the art.

VGR3031 folded precursor RNA is naturally processed by cellular enzymatic activity into at least 4 separate VGAM precursor RNAs, VGAM1322 precursor RNA, VGAM1323 precursor RNA, VGAM1324 precursor RNA and VGAM1325 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1322 RNA, VGAM1323 RNA, VGAM1324 RNA and VGAM1325 RNA, herein schematically represented by VGAM1 RNA through VGAM3 RNA, each of which VGAM RNAs corresponding to VGAM RNA of FIG. 1.

VGAM1322 RNA, herein schematically represented by VGAM1 RNA through VGAM3 RNA, binds complementarily to a host target binding site located in an untranslated region of VGAM1322 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1322 host target RNA into VGAM1322 host target protein, herein schematically represented by VGAM1 HOST TARGET PROTEIN through VGAM3 HOST TARGET PROTEIN, all of FIG. 1.

VGAM1323 RNA, herein schematically represented by VGAM1 RNA through VGAM3 RNA, binds complementarily to a host target binding site located in an untranslated region of VGAM1323 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1323 host target RNA into VGAM1323 host target protein, herein schematically represented by VGAM1 HOST TARGET PROTEIN through VGAM3 HOST TARGET PROTEIN, all of FIG. 1.

VGAM1324 RNA, herein schematically represented by VGAM1 RNA through VGAM3 RNA, binds complementarily to a host target binding site located in an untranslated region of VGAM1324 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1324 host target RNA into VGAM1324 host target protein, herein schematically represented by VGAM1 HOST TARGET PROTEIN through VGAM3 HOST TARGET PROTEIN, all of FIG. 1.

VGAM1325 RNA, herein schematically represented by VGAM1 RNA through VGAM3 RNA, binds complementarily to a host target binding site located in an untranslated region of VGAM1325 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1325 host target RNA into VGAM1325 host target protein, herein schematically represented by VGAM1 HOST TARGET PROTEIN through VGAM3 HOST TARGET PROTEIN, all of FIG. 1.

It is appreciated that a function of VGR3031 gene, herein designated VGR GENE, is inhibition of expression of host target genes, as part of a novel viral mechanism of attacking a host. Accordingly, utilities of VGR3031 gene include diagnosis, prevention and treatment of viral infection by Garlic Latent Virus. Specific functions, and accordingly utilities, of VGR3031 gene correlate with, and may be deduced from, the identity of the host target genes, which are inhibited by VGAM RNAs comprised in the 'operon-like' cluster of VGR3031 gene: VGAM1322 host target protein, VGAM1323 host target protein, VGAM1324 host target protein and VGAM1325 host target protein, herein schematically represented by VGAM1 HOST TARGET PROTEIN through VGAM3 HOST TARGET PROTEIN. The function of these host target genes is elaborated hereinabove with reference to VGAM1322, VGAM1323, VGAM1324 and VGAM1325. FIG. 9 further provides a conceptual description of novel bioinformatically detected regulatory viral gene, referred to here as Viral Genomic Record 3032(VGR3032) viral gene, which encodes an 'operon-like' cluster of novel viral micro RNA-like genes, each of which in turn modulates expression of at least one host target gene, the function and utility of which at least one host target gene is known in the art.

VGR3032 gene, herein designated VGR GENE, is a novel bioinformatically detected regulatory, non protein coding, RNA viral gene. The method by which VGR3032 gene was detected is described hereinabove with reference to FIGS. 1-9.

VGR3032 gene encodes VGR3032 precursor RNA, herein designated VGR PRECURSOR RNA, an RNA molecule, typically several hundred nucleotides long.

VGR3032 precursor RNA folds spatially, forming VGR3032 folded precursor RNA, herein designated VGR FOLDED PRECURSOR RNA. It is appreciated that VGR3032 folded precursor RNA comprises a plurality of what is known in the art as 'hairpin' structures. These 'hairpin' structures are due to the fact that the nucleotide sequence of VGR3032 precursor RNA comprises a plurality of segments, the first half of each such segment having a nucleotide sequence which is at least a partial inversed-reversed sequence of the second half thereof, as is well known in the art.

VGR3032 folded precursor RNA is naturally processed by cellular enzymatic activity into at least 3 separate VGAM precursor RNAs, VGAM1326 precursor RNA, VGAM1327 precursor RNA and VGAM1328 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1326 RNA, VGAM1327 RNA and VGAM1328 RNA, herein schematically represented by VGAM1 RNA through VGAM3 RNA, each of which VGAM RNAs corresponding to VGAM RNA of FIG. 1.

VGAM1326 RNA, herein schematically represented by VGAM1 RNA through VGAM3 RNA, binds complementarily to a host target binding site located in an untranslated region of VGAM1326 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1326 host target RNA into VGAM1326 host target protein, herein schematically represented by VGAM1 HOST TARGET PROTEIN through VGAM3 HOST TARGET PROTEIN, all of FIG. 1.

VGAM1327 RNA, herein schematically represented by VGAM1 RNA through VGAM3 RNA, binds complementarily to a host target binding site located in an untranslated region of VGAM1327 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1327 host target RNA into VGAM1327 host target protein, herein schematically represented by VGAM1 HOST TARGET PROTEIN through VGAM3 HOST TARGET PROTEIN, all of FIG. 1.

VGAM1328 RNA, herein schematically represented by VGAM1 RNA through VGAM3 RNA, binds complementarily to a host target binding site located in an untranslated region of VGAM1328 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1328 host target RNA into VGAM1328 host target protein, herein schematically represented by VGAM1 HOST TARGET PROTEIN through VGAM3 HOST TARGET PROTEIN, all of FIG. 1.

It is appreciated that a function of VGR3032 gene, herein designated VGR GENE, is inhibition of expression of host target genes, as part of a novel viral mechanism of attacking a host. Accordingly, utilities of VGR3032 gene include diagnosis, prevention and treatment of viral infection by Myxoma Virus. Specific functions, and accordingly utilities, of VGR3032 gene correlate with, and may be deduced from, the identity of the host target genes, which are inhibited by VGAM RNAs comprised in the 'operon-like' cluster of VGR3032 gene: VGAM1326 host target protein, VGAM1327 host target protein and VGAM1328 host target protein, herein schematically represented by VGAM1 HOST TARGET PROTEIN through VGAM3 HOST TARGET PROTEIN. The function of these host target genes is elaborated hereinabove with reference to VGAM1326, VGAM1327 and VGAM1328. FIG. 9 further provides a conceptual description of novel bioinformatically detected regulatory viral gene, referred to here as Viral Genomic Record 3033(VGR3033) viral gene, which encodes an 'operon-like' cluster of novel viral micro RNA-like genes, each of which in turn modulates expression of at least one host target gene, the function and utility of which at least one host target gene is known in the art.

VGR3033 gene, herein designated VGR GENE, is a novel bioinformatically detected regulatory, non protein coding, RNA viral gene. The method by which VGR3033 gene was detected is described hereinabove with reference to FIGS. 1-9.

VGR3033 gene encodes VGR3033 precursor RNA, herein designated VGR PRECURSOR RNA, an RNA molecule, typically several hundred nucleotides long.

VGR3033 precursor RNA folds spatially, forming VGR3033 folded precursor RNA, herein designated VGR FOLDED PRECURSOR RNA. It is appreciated that VGR3033 folded precursor RNA comprises a plurality of what is known in the art as 'hairpin' structures. These 'hairpin' structures are due to the fact that the nucleotide sequence of VGR3033 precursor RNA comprises a plurality of segments, the first half of each such segment having a nucleotide sequence which is at least a partial inversed-reversed sequence of the second half thereof, as is well known in the art.

VGR3033 folded precursor RNA is naturally processed by cellular enzymatic activity into at least 6 separate VGAM precursor RNAs, VGAM1330 precursor RNA, VGAM1331 precursor RNA, VGAM1332 precursor RNA, VGAM1333 precursor RNA, VGAM1334 precursor RNA and VGAM1335 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1330 RNA, VGAM1331 RNA, VGAM1332 RNA, VGAM1333 RNA, VGAM1334 RNA and VGAM1335 RNA, herein schematically represented by VGAM1 RNA through VGAM3 RNA, each of which VGAM RNAs corresponding to VGAM RNA of FIG. 1.

VGAM1330 RNA, herein schematically represented by VGAM1 RNA through VGAM3 RNA, binds complementarily to a host target binding site located in an untranslated region of VGAM1330 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1330 host target RNA into VGAM1330 host target protein, herein schematically represented by VGAM1 HOST TARGET PROTEIN through VGAM3 HOST TARGET PROTEIN, all of FIG. 1.

VGAM1331 RNA, herein schematically represented by VGAM1 RNA through VGAM3 RNA, binds complementarily to a host target binding site located in an untranslated region of VGAM1331 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1331 host target RNA into VGAM1331 host target protein, herein schematically represented by VGAM1 HOST TARGET PROTEIN through VGAM3 HOST TARGET PROTEIN, all of FIG. 1.

VGAM1332 RNA, herein schematically represented by VGAM1 RNA through VGAM3 RNA, binds complementarily to a host target binding site located in an untranslated region of VGAM1332 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1332 host target RNA into VGAM1332 host target protein, herein schematically represented by VGAM1 HOST TARGET PROTEIN through VGAM3 HOST TARGET PROTEIN, all of FIG. 1.

VGAM1333 RNA, herein schematically represented by VGAM1 RNA through VGAM3 RNA, binds complementarily to a host target binding site located in an untranslated region of VGAM1333 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1333 host target RNA into VGAM1333 host target protein, herein schematically represented by VGAM1 HOST TARGET PROTEIN through VGAM3 HOST TARGET PROTEIN, all of FIG. 1.

VGAM1334 RNA, herein schematically represented by VGAM1 RNA through VGAM3 RNA, binds complementarily to a host target binding site located in an untranslated region of VGAM1334 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1334 host target RNA into VGAM1334 host target protein, herein schematically represented by VGAM1 HOST TARGET PROTEIN through VGAM3 HOST TARGET PROTEIN, all of FIG. 1.

VGAM1335 RNA, herein schematically represented by VGAM1 RNA through VGAM3 RNA, binds complementarily to a host target binding site located in an untranslated region of VGAM1335 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1335 host target RNA into VGAM1335 host target protein, herein schematically represented by VGAM1 HOST TARGET PROTEIN through VGAM3 HOST TARGET PROTEIN, all of FIG. 1.

It is appreciated that a function of VGR3033 gene, herein designated VGR GENE, is inhibition of expression of host target genes, as part of a novel viral mechanism of attacking a host. Accordingly, utilities of VGR3033 gene include diagnosis, prevention and treatment of viral infection by Human Adenovirus A. Specific functions, and accordingly utilities, of VGR3033 gene correlate with, and may be deduced from, the identity of the host target genes, which are inhibited by VGAM RNAs comprised in the 'operon-like' cluster of VGR3033 gene: VGAM1330 host target protein, VGAM1331 host target protein, VGAM1332 host target protein, VGAM1333 host target protein, VGAM1334 host target protein and VGAM1335 host target protein, herein schematically represented by VGAM1 HOST TARGET PROTEIN through VGAM3 HOST TARGET PROTEIN. The function of these host target genes is elaborated hereinabove with reference to VGAM1330, VGAM1331, VGAM1332, VGAM1333, VGAM1334 and VGAM1335. FIG. 9 further provides a conceptual description of novel bioinformatically detected regulatory viral gene, referred to here as Viral Genomic Record 3034(VGR3034) viral gene, which encodes an 'operon-like' cluster of novel viral micro RNA-like genes, each of which in turn modulates expression of at least one host target gene, the function and utility of which at least one host target gene is known in the art.

VGR3034 gene, herein designated VGR GENE, is a novel bioinformatically detected regulatory, non protein coding, RNA viral gene. The method by which VGR3034 gene was detected is described hereinabove with reference to FIGS. 1-9.

VGR3034 gene encodes VGR3034 precursor RNA, herein designated VGR PRECURSOR RNA, an RNA molecule, typically several hundred nucleotides long.

VGR3034 precursor RNA folds spatially, forming VGR3034 folded precursor RNA, herein designated VGR FOLDED PRECURSOR RNA. It is appreciated that VGR3034 folded precursor RNA comprises a plurality of what is known in the art as 'hairpin' structures. These 'hairpin' structures are due to the fact that the nucleotide sequence of VGR3034 precursor RNA comprises a plurality of segments, the first half of each such segment having a nucleotide sequence which is at least a partial inversed-reversed sequence of the second half thereof, as is well known in the art.

VGR3034 folded precursor RNA is naturally processed by cellular enzymatic activity into at least 2 separate VGAM precursor RNAs, VGAM1336 precursor RNA and VGAM1337 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1336 RNA and VGAM1337 RNA, herein schematically represented by VGAM1 RNA through VGAM3 RNA, each of which VGAM RNAs corresponding to VGAM RNA of FIG. 1.

VGAM1336 RNA, herein schematically represented by VGAM1 RNA through VGAM3 RNA, binds complementarily to a host target binding site located in an untranslated region of VGAM1336 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1336 host target RNA into VGAM1336 host target protein, herein schematically represented by VGAM1 HOST TARGET PROTEIN through VGAM3 HOST TARGET PROTEIN, all of FIG. 1.

VGAM1337 RNA, herein schematically represented by VGAM1 RNA through VGAM3 RNA, binds complementarily to a host target binding site located in an untranslated region of VGAM1337 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1337 host target RNA into VGAM1337 host target protein, herein schematically represented by VGAM1 HOST TARGET PROTEIN through VGAM3 HOST TARGET PROTEIN, all of FIG. 1.

It is appreciated that a function of VGR3034 gene, herein designated VGR GENE, is inhibition of expression of host target genes, as part of a novel viral mechanism of attacking a host. Accordingly, utilities of VGR3034 gene include diagnosis, prevention and treatment of viral infection by Sheeppox Virus. Specific functions, and accordingly utilities, of VGR3034 gene correlate with, and may be deduced from, the identity of the host target genes, which are inhibited by VGAM RNAs comprised in the 'operon-like' cluster of VGR3034 gene: VGAM1336 host target protein and VGAM1337 host target protein, herein schematically represented by VGAM1 HOST TARGET PROTEIN through VGAM3 HOST TARGET PROTEIN. The function of these host target genes is elaborated hereinabove with reference to VGAM1336 and VGAM1337. FIG. 9 further provides a conceptual description of novel bioinformatically detected regulatory viral gene, referred to here as Viral Genomic Record 3035(VGR3035) viral gene, which encodes an 'operon-like' cluster of novel viral micro RNA-like genes, each of which in turn modulates expression of at least one host target gene, the function and utility of which at least one host target gene is known in the art.

VGR3035 gene, herein designated VGR GENE, is a novel bioinformatically detected regulatory, non protein coding, RNA viral gene. The method by which VGR3035 gene was detected is described hereinabove with reference to FIGS. 1-9.

VGR3035 gene encodes VGR3035 precursor RNA, herein designated VGR PRECURSOR RNA, an RNA molecule, typically several hundred nucleotides long.

VGR3035 precursor RNA folds spatially, forming VGR3035 folded precursor RNA, herein designated VGR FOLDED PRECURSOR RNA. It is appreciated that VGR3035 folded precursor RNA comprises a plurality of what is known in the art as 'hairpin' structures. These 'hairpin' structures are due to the fact that the nucleotide sequence of VGR3035 precursor RNA comprises a plurality of segments, the first half of each such segment having a nucleotide sequence which is at least a partial inversed-reversed sequence of the second half thereof, as is well known in the art.

VGR3035 folded precursor RNA is naturally processed by cellular enzymatic activity into at least 4 separate VGAM precursor RNAs, VGAM1340 precursor RNA, VGAM1341 precursor RNA, VGAM1342 precursor RNA and VGAM1343 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1340 RNA, VGAM1341 RNA, VGAM1342 RNA and VGAM1343 RNA, herein schematically represented by VGAM1 RNA through VGAM3 RNA, each of which VGAM RNAs corresponding to VGAM RNA of FIG. 1.

VGAM1340 RNA, herein schematically represented by VGAM1 RNA through VGAM3 RNA, binds complementarily to a host target binding site located in an untranslated region of VGAM1340 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1340 host target RNA into VGAM1340 host target protein, herein schematically represented by VGAM1 HOST TARGET PROTEIN through VGAM3 HOST TARGET PROTEIN, all of FIG. 1.

VGAM1341 RNA, herein schematically represented by VGAM1 RNA through VGAM3 RNA, binds complementarily to a host target binding site located in an untranslated region of VGAM1341 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1341 host target RNA into VGAM1341 host target protein, herein schematically represented by VGAM1 HOST TARGET PROTEIN through VGAM3 HOST TARGET PROTEIN, all of FIG. 1.

VGAM1342 RNA, herein schematically represented by VGAM1 RNA through VGAM3 RNA, binds complementarily to a host target binding site located in an untranslated region of VGAM1342 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1342 host target RNA into VGAM1342 host target protein, herein schematically represented by VGAM1 HOST TARGET PROTEIN through VGAM3 HOST TARGET PROTEIN, all of FIG. 1.

VGAM1343 RNA, herein schematically represented by VGAM1 RNA through VGAM3 RNA, binds complementarily to a host target binding site located in an untranslated region of VGAM1343 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1343 host target RNA into VGAM1343 host target protein, herein schematically represented by VGAM1 HOST TARGET PROTEIN through VGAM3 HOST TARGET PROTEIN, all of FIG. 1.

It is appreciated that a function of VGR3035 gene, herein designated VGR GENE, is inhibition of expression of host target genes, as part of a novel viral mechanism of attacking a host. Accordingly, utilities of VGR3035 gene include diagnosis, prevention and treatment of viral infection by Garlic Virus A. Specific functions, and accordingly utilities, of VGR3035 gene correlate with, and may be deduced from, the identity of the host target genes, which are inhibited by VGAM RNAs comprised in the 'operon-like' cluster of VGR3035 gene: VGAM1340 host target protein, VGAM1341 host target protein, VGAM1342 host target protein and VGAM1343 host target protein, herein schematically represented by VGAM1 HOST TARGET PROTEIN through VGAM3 HOST TARGET PROTEIN. The function of these host target genes is elaborated hereinabove with reference to VGAM1340, VGAM1341, VGAM1342 and VGAM1343. FIG. 9 further provides a conceptual description of novel bioinformatically detected regulatory viral gene, referred to here as Viral Genomic Record 3036(VGR3036) viral gene, which encodes an 'operon-like' cluster of novel viral micro RNA-like genes, each of which in turn modulates expression of at least one host target gene, the function and utility of which at least one host target gene is known in the art.

VGR3036 gene, herein designated VGR GENE, is a novel bioinformatically detected regulatory, non protein coding, RNA viral gene. The method by which VGR3036 gene was detected is described hereinabove with reference to FIGS. 1-9.

VGR3036 gene encodes VGR3036 precursor RNA, herein designated VGR PRECURSOR RNA, an RNA molecule, typically several hundred nucleotides long.

VGR3036 precursor RNA folds spatially, forming VGR3036 folded precursor RNA, herein designated VGR FOLDED PRECURSOR RNA. It is appreciated that VGR3036 folded precursor RNA comprises a plurality of what is known in the art as 'hairpin' structures. These 'hairpin' structures are due to the fact that the nucleotide sequence of VGR3036 precursor RNA comprises a plurality of segments, the first half of each such segment having a nucleotide sequence which is at least a partial inversed-reversed sequence of the second half thereof, as is well known in the art.

VGR3036 folded precursor RNA is naturally processed by cellular enzymatic activity into at least 8 separate VGAM precursor RNAs, VGAM1346 precursor RNA, VGAM1347 precursor RNA, VGAM1348 precursor RNA, VGAM1349 precursor RNA, VGAM1350 precursor RNA, VGAM1351 precursor RNA, VGAM1352 precursor RNA and VGAM1353 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1346 RNA, VGAM1347 RNA, VGAM1348 RNA, VGAM1349 RNA, VGAM1350 RNA, VGAM1351 RNA, VGAM1352 RNA and VGAM1353 RNA, herein schematically represented by VGAM1 RNA through VGAM3 RNA, each of which VGAM RNAs corresponding to VGAM RNA of FIG. 1.

VGAM1346 RNA, herein schematically represented by VGAM1 RNA through VGAM3 RNA, binds complementarily to a host target binding site located in an untranslated region of VGAM1346 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1346 host target RNA into VGAM1346 host target protein, herein schematically represented by VGAM1 HOST TARGET PROTEIN through VGAM3 HOST TARGET PROTEIN, all of FIG. 1.

VGAM1347 RNA, herein schematically represented by VGAM1 RNA through VGAM3 RNA, binds complementarily to a host target binding site located in an untranslated region of VGAM1347 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1347 host target RNA into VGAM1347 host target protein, herein schematically represented by VGAM1 HOST TARGET PROTEIN through VGAM3 HOST TARGET PROTEIN, all of FIG. 1.

VGAM1348 RNA, herein schematically represented by VGAM1 RNA through VGAM3 RNA, binds complementarily to a host target binding site located in an untranslated region of VGAM1348 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM1348 host target RNA into VGAM1348 host target protein, herein schematically represented by VGAM1 HOST TARGET PROTEIN through VGAM3 HOST TARGET PROTEIN, all of FIG. 1.

VGAM1349 RNA, herein schematically represented by VGAM1 RNA through VGAM3 RNA, binds complementarily to a host target binding site located in an untranslated region of VGAM1349 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1349 host target RNA into VGAM1349 host target protein, herein schematically represented by VGAM1 HOST TARGET PROTEIN through VGAM3 HOST TARGET PROTEIN, all of FIG. 1.

VGAM1350 RNA, herein schematically represented by VGAM1 RNA through VGAM3 RNA, binds complementarily to a host target binding site located in an untranslated region of VGAM1350 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1350 host target RNA into VGAM1350 host target protein, herein schematically represented by VGAM1 HOST TARGET PROTEIN through VGAM3 HOST TARGET PROTEIN, all of FIG. 1.

VGAM1351 RNA, herein schematically represented by VGAM1 RNA through VGAM3 RNA, binds complementarily to a host target binding site located in an untranslated region of VGAM1351 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1351 host target RNA into VGAM1351 host target protein, herein schematically represented by VGAM1 HOST TARGET PROTEIN through VGAM3 HOST TARGET PROTEIN, all of FIG. 1.

VGAM1352 RNA, herein schematically represented by VGAM1 RNA through VGAM3 RNA, binds complementarily to a host target binding site located in an untranslated region of VGAM1352 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1352 host target RNA into VGAM1352 host target protein, herein schematically represented by VGAM1 HOST TARGET PROTEIN through VGAM3 HOST TARGET PROTEIN, all of FIG. 1.

VGAM1353 RNA, herein schematically represented by VGAM1 RNA through VGAM3 RNA, binds complementarily to a host target binding site located in an untranslated region of VGAM1353 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1353 host target RNA into VGAM1353 host target protein, herein schematically represented by VGAM1 HOST TARGET PROTEIN through VGAM3 HOST TARGET PROTEIN, all of FIG. 1.

It is appreciated that a function of VGR3036 gene, herein designated VGR GENE, is inhibition of expression of host target genes, as part of a novel viral mechanism of attacking a host. Accordingly, utilities of VGR3036 gene include diagnosis, prevention and treatment of viral infection by Fowlpox Virus. Specific functions, and accordingly utilities, of VGR3036 gene correlate with, and may be deduced from, the identity of the host target genes, which are inhibited by VGAM RNAs comprised in the 'operon-like' cluster of VGR3036 gene: VGAM1346 host target protein, VGAM1347 host target protein, VGAM1348 host target protein, VGAM1349 host target protein, VGAM1350 host target protein, VGAM1351 host target protein, VGAM1352 host target protein and VGAM1353 host target protein, herein schematically represented by VGAM1 HOST TARGET PROTEIN through VGAM3 HOST TARGET PROTEIN. The function of these host target genes is elaborated hereinabove with reference to VGAM1346, VGAM1347, VGAM1348, VGAM1349, VGAM1350, VGAM1351, VGAM1352 and VGAM1353. FIG. 9 further provides a conceptual description of novel bioinformatically detected regulatory viral gene, referred to here as Viral Genomic Record 3037(VGR3037) viral gene, which encodes an 'operon-like' cluster of novel viral micro RNA-like genes, each of which in turn modulates expression of at least one host target gene, the function and utility of which at least one host target gene is known in the art.

VGR3037 gene, herein designated VGR GENE, is a novel bioinformatically detected regulatory, non protein coding, RNA viral gene. The method by which VGR3037 gene was detected is described hereinabove with reference to FIGS. 1-9.

VGR3037 gene encodes VGR3037 precursor RNA, herein designated VGR PRECURSOR RNA, an RNA molecule, typically several hundred nucleotides long.

VGR3037 precursor RNA folds spatially, forming VGR3037 folded precursor RNA, herein designated VGR FOLDED PRECURSOR RNA. It is appreciated that VGR3037 folded precursor RNA comprises a plurality of what is known in the art as 'hairpin' structures. These 'hairpin' structures are due to the fact that the nucleotide sequence of VGR3037 precursor RNA comprises a plurality of segments, the first half of each such segment having a nucleotide sequence which is at least a partial inversed-reversed sequence of the second half thereof, as is well known in the art.

VGR3037 folded precursor RNA is naturally processed by cellular enzymatic activity into at least 8 separate VGAM precursor RNAs, VGAM1354 precursor RNA, VGAM1355 precursor RNA, VGAM1356 precursor RNA, VGAM1357 precursor RNA, VGAM1358 precursor RNA, VGAM1359 precursor RNA, VGAM1360 precursor RNA and VGAM1361 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1354 RNA, VGAM1355 RNA, VGAM1356 RNA, VGAM1357 RNA, VGAM1358 RNA, VGAM1359 RNA, VGAM1360 RNA and VGAM1361 RNA, herein schematically represented by VGAM1 RNA through VGAM3 RNA, each of which VGAM RNAs corresponding to VGAM RNA of FIG. 1.

VGAM1354 RNA, herein schematically represented by VGAM1 RNA through VGAM3 RNA, binds complementarily to a host target binding site located in an untranslated region of VGAM1354 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1354 host target RNA into VGAM1354 host target protein, herein schematically represented by VGAM1 HOST TARGET PROTEIN through VGAM3 HOST TARGET PROTEIN, all of FIG. 1.

VGAM1355 RNA, herein schematically represented by VGAM1 RNA through VGAM3 RNA, binds complementarily to a host target binding site located in an untranslated region of VGAM1355 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1355 host target RNA into VGAM1355 host target protein, herein schematically represented by VGAM1 HOST TARGET PROTEIN through VGAM3 HOST TARGET PROTEIN, all of FIG. 1.

VGAM1356 RNA, herein schematically represented by VGAM1 RNA through VGAM3 RNA, binds complementarily to a host target binding site located in an untranslated region of VGAM1356 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1356 host target RNA into VGAM1356 host target protein, herein schematically represented by VGAM1 HOST TARGET PROTEIN through VGAM3 HOST TARGET PROTEIN, all of FIG. 1.

VGAM1357 RNA, herein schematically represented by VGAM1 RNA through VGAM3 RNA, binds complementarily to a host target binding site located in an untranslated region of VGAM1357 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1357 host target RNA into VGAM1357 host target protein, herein schematically represented by VGAM1 HOST TARGET PROTEIN through VGAM3 HOST TARGET PROTEIN, all of FIG. 1.

VGAM1358 RNA, herein schematically represented by VGAM1 RNA through VGAM3 RNA, binds complementarily to a host target binding site located in an untranslated region of VGAM1358 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1358 host target RNA into VGAM1358 host target protein, herein schematically represented by VGAM1 HOST TARGET PROTEIN through VGAM3 HOST TARGET PROTEIN, all of FIG. 1.

VGAM1359 RNA, herein schematically represented by VGAM1 RNA through VGAM3 RNA, binds complementarily to a host target binding site located in an untranslated region of VGAM1359 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1359 host target RNA into VGAM1359 host target protein, herein schematically represented by VGAM1 HOST TARGET PROTEIN through VGAM3 HOST TARGET PROTEIN, all of FIG. 1.

VGAM1360 RNA, herein schematically represented by VGAM1 RNA through VGAM3 RNA, binds complementarily to a host target binding site located in an untranslated region of VGAM1360 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1360 host target RNA into VGAM1360 host target protein, herein schematically represented by VGAM1 HOST TARGET PROTEIN through VGAM3 HOST TARGET PROTEIN, all of FIG. 1.

VGAM1361 RNA, herein schematically represented by VGAM1 RNA through VGAM3 RNA, binds complementarily to a host target binding site located in an untranslated region of VGAM1361 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1361 host target RNA into VGAM1361 host target protein, herein schematically represented by VGAM1 HOST TARGET PROTEIN through VGAM3 HOST TARGET PROTEIN, all of FIG. 1.

It is appreciated that a function of VGR3037 gene, herein designated VGR GENE, is inhibition of expression of host target genes, as part of a novel viral mechanism of attacking a host. Accordingly, utilities of VGR3037 gene include diagnosis, prevention and treatment of viral infection by Triatoma Virus. Specific functions, and accordingly utilities, of VGR3037 gene correlate with, and may be deduced from, the identity of the host target genes, which are inhibited by VGAM RNAs comprised in the 'operon-like' cluster of VGR3037 gene: VGAM1354 host target protein, VGAM1355 host target protein, VGAM1356 host target protein, VGAM1357 host target protein, VGAM1358 host target protein, VGAM1359 host target protein, VGAM1360 host target protein and VGAM1361 host target protein, herein schematically represented by VGAM1 HOST TARGET PROTEIN through VGAM3 HOST TARGET PROTEIN. The function of these host target genes is elaborated hereinabove with reference to VGAM1354, VGAM1355, VGAM1356, VGAM1357, VGAM1358, VGAM1359, VGAM1360 and VGAM1361. FIG. 9 further provides a conceptual description of novel bioinformatically detected regulatory viral gene, referred to here as Viral Genomic Record 3038(VGR3038) viral gene, which encodes an 'operon-like' cluster of novel viral micro RNA-like genes, each of which in turn modulates expression of at least one host target gene, the function and utility of which at least one host target gene is known in the art.

VGR3038 gene, herein designated VGR GENE, is a novel bioinformatically detected regulatory, non protein coding, RNA viral gene. The method by which VGR3038 gene was detected is described hereinabove with reference to FIGS. 1-9.

VGR3038 gene encodes VGR3038 precursor RNA, herein designated VGR PRECURSOR RNA, an RNA molecule, typically several hundred nucleotides long.

VGR3038 precursor RNA folds spatially, forming VGR3038 folded precursor RNA, herein designated VGR FOLDED PRECURSOR RNA. It is appreciated that VGR3038 folded precursor RNA comprises a plurality of what is known in the art as 'hairpin' structures. These 'hairpin' structures are due to the fact that the nucleotide sequence of VGR3038 precursor RNA comprises a plurality of segments, the first half of each such segment having a nucleotide sequence which is at least a partial inversed-reversed sequence of the second half thereof, as is well known in the art.

VGR3038 folded precursor RNA is naturally processed by cellular enzymatic activity into at least 4 separate VGAM precursor RNAs, VGAM1362 precursor RNA, VGAM1363 precursor RNA, VGAM1364 precursor RNA and VGAM1365 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1362 RNA, VGAM1363 RNA, VGAM1364 RNA and VGAM1365 RNA, herein schematically represented by VGAM1 RNA through VGAM3 RNA, each of which VGAM RNAs corresponding to VGAM RNA of FIG. 1.

VGAM1362 RNA, herein schematically represented by VGAM1 RNA through VGAM3 RNA, binds complementarily to a host target binding site located in an untranslated region of VGAM1362 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1362 host target RNA into VGAM1362 host target protein, herein schematically represented by VGAM1 HOST TARGET PROTEIN through VGAM3 HOST TARGET PROTEIN, all of FIG. 1.

VGAM1363 RNA, herein schematically represented by VGAM1 RNA through VGAM3 RNA, binds complementarily to a host target binding site located in an untranslated region of VGAM1363 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1363 host target RNA into VGAM1363 host target protein, herein schematically represented by VGAM1 HOST TARGET PROTEIN through VGAM3 HOST TARGET PROTEIN, all of FIG. 1.

VGAM1364 RNA, herein schematically represented by VGAM1 RNA through VGAM3 RNA, binds complementarily to a host target binding site located in an untranslated region of VGAM1364 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1364 host target RNA into VGAM1364 host target protein, herein schematically represented by VGAM1 HOST TARGET PROTEIN through VGAM3 HOST TARGET PROTEIN, all of FIG. 1.

VGAM1365 RNA, herein schematically represented by VGAM1 RNA through VGAM3 RNA, binds complementarily to a host target binding site located in an untranslated region of VGAM1365 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1365 host target RNA into VGAM1365 host target protein, herein schematically represented by VGAM1 HOST TARGET PROTEIN through VGAM3 HOST TARGET PROTEIN, all of FIG. 1.

It is appreciated that a function of VGR3038 gene, herein designated VGR GENE, is inhibition of expression of host target genes, as part of a novel viral mechanism of attacking a host. Accordingly, utilities of VGR3038 gene include diagnosis, prevention and treatment of viral infection by Duck Adenovirus 1. Specific functions, and accordingly utilities, of VGR3038 gene correlate with, and may be deduced from, the identity of the host target genes, which are inhibited by VGAM RNAs comprised in the 'operon-like' cluster of VGR3038 gene: VGAM1362 host target protein, VGAM1363 host target protein, VGAM1364 host target protein and VGAM1365 host target protein, herein schematically represented by VGAM1 HOST TARGET PROTEIN through VGAM3 HOST TARGET PROTEIN. The function of these host target genes is elaborated hereinabove with reference to VGAM1362, VGAM1363, VGAM1364 and VGAM1365.

FIG. 9 further provides a conceptual description of novel bioinformatically detected regulatory viral gene, referred to here as Viral Genomic Record 3039(VGR3039) viral gene, which encodes an 'operon-like' cluster of novel viral micro RNA-like genes, each of which in turn modulates expression of at least one host target gene, the function and utility of which at least one host target gene is known in the art.

VGR3039 gene, herein designated VGR GENE, is a novel bioinformatically detected regulatory, non protein coding, RNA viral gene. The method by which VGR3039 gene was detected is described hereinabove with reference to FIGS. 1-9.

VGR3039 gene encodes VGR3039 precursor RNA, herein designated VGR PRECURSOR RNA, an RNA molecule, typically several hundred nucleotides long.

VGR3039 precursor RNA folds spatially, forming VGR3039 folded precursor RNA, herein designated VGR FOLDED PRECURSOR RNA. It is appreciated that VGR3039 folded precursor RNA comprises a plurality of what is known in the art as 'hairpin' structures. These 'hairpin' structures are due to the fact that the nucleotide sequence of VGR3039 precursor RNA comprises a plurality of segments, the first half of each such segment having a nucleotide sequence which is at least a partial inversed-reversed sequence of the second half thereof, as is well known in the art.

VGR3039 folded precursor RNA is naturally processed by cellular enzymatic activity into at least 6 separate VGAM precursor RNAs, VGAM1366 precursor RNA, VGAM1367 precursor RNA, VGAM1368 precursor RNA, VGAM1369 precursor RNA, VGAM1370 precursor RNA and VGAM1371 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1366 RNA, VGAM1367 RNA, VGAM1368 RNA, VGAM1369 RNA, VGAM1370 RNA and VGAM1371 RNA, herein schematically represented by VGAM1 RNA through VGAM3 RNA, each of which VGAM RNAs corresponding to VGAM RNA of FIG. 1.

VGAM1366 RNA, herein schematically represented by VGAM1 RNA through VGAM3 RNA, binds complementarily to a host target binding site located in an untranslated region of VGAM1366 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1366 host target RNA into VGAM1366 host target protein, herein schematically represented by VGAM1 HOST TARGET PROTEIN through VGAM3 HOST TARGET PROTEIN, all of FIG. 1.

VGAM1367 RNA, herein schematically represented by VGAM1 RNA through VGAM3 RNA, binds complementarily to a host target binding site located in an untranslated region of VGAM1367 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1367 host target RNA into VGAM1367 host target protein, herein schematically represented by VGAM1 HOST TARGET PROTEIN through VGAM3 HOST TARGET PROTEIN, all of FIG. 1.

VGAM1368 RNA, herein schematically represented by VGAM1 RNA through VGAM3 RNA, binds complementarily to a host target binding site located in an untranslated region of VGAM1368 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1368 host target RNA into VGAM1368 host target protein, herein schematically represented by VGAM1 HOST TARGET PROTEIN through VGAM3 HOST TARGET PROTEIN, all of FIG. 1.

VGAM1369 RNA, herein schematically represented by VGAM1 RNA through VGAM3 RNA, binds complementarily to a host target binding site located in an untranslated region of VGAM1369 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1369 host target RNA into VGAM1369 host target protein, herein schematically represented by VGAM1 HOST TARGET PROTEIN through VGAM3 HOST TARGET PROTEIN, all of FIG. 1.

VGAM1370 RNA, herein schematically represented by VGAM1 RNA through VGAM3 RNA, binds complementarily to a host target binding site located in an untranslated region of VGAM1370 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1370 host target RNA into VGAM1370 host target protein, herein schematically represented by VGAM1 HOST TARGET PROTEIN through VGAM3 HOST TARGET PROTEIN, all of FIG. 1.

VGAM1371 RNA, herein schematically represented by VGAM1 RNA through VGAM3 RNA, binds complementarily to a host target binding site located in an untranslated region of VGAM1371 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1371 host target RNA into VGAM1371 host target protein, herein schematically represented by VGAM1 HOST TARGET PROTEIN through VGAM3 HOST TARGET PROTEIN, all of FIG. 1.

It is appreciated that a function of VGR3039 gene, herein designated VGR GENE, is inhibition of expression of host target genes, as part of a novel viral mechanism of attacking a host. Accordingly, utilities of VGR3039 gene include diagnosis, prevention and treatment of viral infection by Human Herpesvirus 6. Specific functions, and accordingly utilities, of VGR3039 gene correlate with, and may be deduced from, the identity of the host target genes, which are inhibited by VGAM RNAs comprised in the 'operon-like' cluster of VGR3039 gene: VGAM1366 host target protein, VGAM1367 host target protein, VGAM1368 host target protein, VGAM1369 host target protein, VGAM1370 host target protein and VGAM1371 host target protein, herein schematically represented by VGAM1 HOST TARGET PROTEIN through VGAM3 HOST TARGET PROTEIN. The function of these host target genes is elaborated hereinabove with reference to VGAM1366, VGAM1367, VGAM1368, VGAM1369, VGAM1370 and VGAM1371. FIG. 9 further provides a conceptual description of novel bioinformatically detected regulatory viral gene, referred to here as Viral Genomic Record 3040(VGR3040) viral gene, which encodes an 'operon-like' cluster of novel viral micro RNA-like genes, each of which in turn modulates expression of at least one host target gene, the function and utility of which at least one host target gene is known in the art.

VGR3040 gene, herein designated VGR GENE, is a novel bioinformatically detected regulatory, non protein coding, RNA viral gene. The method by which VGR3040 gene was detected is described hereinabove with reference to FIGS. 1-9.

VGR3040 gene encodes VGR3040 precursor RNA, herein designated VGR PRECURSOR RNA, an RNA molecule, typically several hundred nucleotides long.

VGR3040 precursor RNA folds spatially, forming VGR3040 folded precursor RNA, herein designated VGR FOLDED PRECURSOR RNA. It is appreciated that VGR3040 folded precursor RNA comprises a plurality of what is known in the art as 'hairpin' structures. These 'hairpin' structures are due to the fact that the nucleotide sequence of VGR3040 precursor RNA comprises a plurality of segments, the first half of each such segment having a nucleotide sequence which is at least a partial inversed-reversed sequence of the second half thereof, as is well known in the art.

VGR3040 folded precursor RNA is naturally processed by cellular enzymatic activity into at least 6 separate VGAM precursor RNAs, VGAM1372 precursor RNA, VGAM1373 precursor RNA, VGAM1374 precursor RNA, VGAM1375 precursor RNA, VGAM1376 precursor RNA and VGAM1377 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1372 RNA, VGAM1373 RNA, VGAM1374 RNA, VGAM1375 RNA, VGAM1376 RNA and VGAM1377 RNA, herein schematically represented by VGAM1 RNA through VGAM3 RNA, each of which VGAM RNAs corresponding to VGAM RNA of FIG. 1.

VGAM1372 RNA, herein schematically represented by VGAM1 RNA through VGAM3 RNA, binds complementarily to a host target binding site located in an untranslated region of VGAM1372 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1372 host target RNA into VGAM1372 host target protein, herein schematically represented by VGAM1 HOST TARGET PROTEIN through VGAM3 HOST TARGET PROTEIN, all of FIG. 1.

VGAM1373 RNA, herein schematically represented by VGAM1 RNA through VGAM3 RNA, binds complementarily to a host target binding site located in an untranslated region of VGAM1373 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1373 host target RNA into VGAM1373 host target protein, herein schematically represented by VGAM1 HOST TARGET PROTEIN through VGAM3 HOST TARGET PROTEIN, all of FIG. 1.

VGAM1374 RNA, herein schematically represented by VGAM1 RNA through VGAM3 RNA, binds complementarily to a host target binding site located in an untranslated region of VGAM1374 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1374 host target RNA into VGAM1374 host target protein, herein schematically represented by VGAM1 HOST TARGET PROTEIN through VGAM3 HOST TARGET PROTEIN, all of FIG. 1.

VGAM1375 RNA, herein schematically represented by VGAM1 RNA through VGAM3 RNA, binds complementarily to a host target binding site located in an untranslated region of VGAM1375 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1375 host target RNA into VGAM1375 host target protein, herein schematically represented by VGAM1 HOST TARGET PROTEIN through VGAM3 HOST TARGET PROTEIN, all of FIG. 1.

VGAM1376 RNA, herein schematically represented by VGAM1 RNA through VGAM3 RNA, binds complementarily to a host target binding site located in an untranslated region of VGAM1376 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1376 host target RNA into VGAM1376 host target protein, herein schematically represented by VGAM1 HOST TARGET PROTEIN through VGAM3 HOST TARGET PROTEIN, all of FIG. 1.

VGAM1377 RNA, herein schematically represented by VGAM1 RNA through VGAM3 RNA, binds complementarily to a host target binding site located in an untranslated region of VGAM1377 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1377 host target RNA into VGAM1377 host target protein, herein schematically represented by VGAM1 HOST TARGET PROTEIN through VGAM3 HOST TARGET PROTEIN, all of FIG. 1.

It is appreciated that a function of VGR3040 gene, herein designated VGR GENE, is inhibition of expression of host target genes, as part of a novel viral mechanism of attacking a host. Accordingly, utilities of VGR3040 gene include diagnosis, prevention and treatment of viral infection by Alcelaphine Herpesvirus 1. Specific functions, and accordingly utilities, of VGR3040 gene correlate with, and may be deduced from, the identity of the host target genes, which are inhibited by VGAM RNAs comprised in the 'operon-like' cluster of VGR3040 gene: VGAM1372 host target protein, VGAM1373 host target protein, VGAM1374 host target protein, VGAM1375 host target protein, VGAM1376 host target protein and VGAM1377 host target protein, herein schematically represented by VGAM1 HOST TARGET PROTEIN through VGAM3 HOST TARGET PROTEIN. The function of these host target genes is elaborated hereinabove with reference to VGAM1372, VGAM1373, VGAM1374, VGAM1375, VGAM1376 and VGAM1377. FIG. 9 further provides a conceptual description of novel bioinformatically detected regulatory viral gene, referred to here as Viral Genomic Record 3041 (VGR3041) viral gene, which encodes an 'operon-like' cluster of novel viral micro RNA-like genes, each of which in turn modulates expression of at least one host target gene, the function and utility of which at least one host target gene is known in the art.

VGR3041 gene, herein designated VGR GENE, is a novel bioinformatically detected regulatory, non protein coding, RNA viral gene. The method by which VGR3041 gene was detected is described hereinabove with reference to FIGS. 1-9.

VGR3041 gene encodes VGR3041 precursor RNA, herein designated VGR PRECURSOR RNA, an RNA molecule, typically several hundred nucleotides long.

VGR3041 precursor RNA folds spatially, forming VGR3041 folded precursor RNA, herein designated VGR FOLDED PRECURSOR RNA. It is appreciated that VGR3041 folded precursor RNA comprises a plurality of what is known in the art as 'hairpin' structures. These 'hairpin' structures are due to the fact that the nucleotide sequence of VGR3041 precursor RNA comprises a plurality of segments, the first half of each such segment having a nucleotide sequence which is at least a partial inversed-reversed sequence of the second half thereof, as is well known in the art.

VGR3041 folded precursor RNA is naturally processed by cellular enzymatic activity into at least 2 separate VGAM precursor RNAs, VGAM1378 precursor RNA and VGAM1379 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1378 RNA and VGAM1379 RNA, herein schematically represented by VGAM1 RNA through VGAM3 RNA, each of which VGAM RNAs corresponding to VGAM RNA of FIG. 1.

VGAM1378 RNA, herein schematically represented by VGAM1 RNA through VGAM3 RNA, binds complementarily to a host target binding site located in an untranslated region of VGAM1378 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1378 host target RNA into VGAM1378 host target protein, herein schematically represented by VGAM1 HOST TARGET PROTEIN through VGAM3 HOST TARGET PROTEIN, all of FIG. 1.

VGAM1379 RNA, herein schematically represented by VGAM1 RNA through VGAM3 RNA, binds complementarily to a host target binding site located in an untranslated region of VGAM1379 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1379 host target RNA into VGAM1379 host target protein, herein schematically represented by VGAM1 HOST TARGET PROTEIN through VGAM3 HOST TARGET PROTEIN, all of FIG. 1.

It is appreciated that a function of VGR3041 gene, herein designated VGR GENE, is inhibition of expression of host target genes, as part of a novel viral mechanism of attacking a host. Accordingly, utilities of VGR3041 gene include diagnosis, prevention and treatment of viral infection by Human Herpesvirus 1. Specific functions, and accordingly utilities, of VGR3041 gene correlate with, and may be deduced from, the identity of the host target genes, which are inhibited by VGAM RNAs comprised in the 'operon-like' cluster of VGR3041 gene: VGAM1378 host target protein and VGAM1379 host target protein, herein schematically represented by VGAM1 HOST TARGET PROTEIN through VGAM3 HOST TARGET PROTEIN. The function of these host target genes is elaborated hereinabove with reference to VGAM1378 and VGAM1379. FIG. 9 further provides a conceptual description of novel bioinformatically detected regulatory viral gene, referred to here as Viral Genomic Record 3042(VGR3042) viral gene, which encodes an 'operon-like' cluster of novel viral micro RNA-like genes, each of which in turn modulates expression of at least one host target gene, the function and utility of which at least one host target gene is known in the art.

VGR3042 gene, herein designated VGR GENE, is a novel bioinformatically detected regulatory, non protein coding, RNA viral gene. The method by which VGR3042 gene was detected is described hereinabove with reference to FIGS. 1-9.

VGR3042 gene encodes VGR3042 precursor RNA, herein designated VGR PRECURSOR RNA, an RNA molecule, typically several hundred nucleotides long.

VGR3042 precursor RNA folds spatially, forming VGR3042 folded precursor RNA, herein designated VGR FOLDED PRECURSOR RNA. It is appreciated that VGR3042 folded precursor RNA comprises a plurality of what is known in the art as 'hairpin' structures. These 'hairpin' structures are due to the fact that the nucleotide sequence of VGR3042 precursor RNA comprises a plurality of segments, the first half of each such segment having a nucleotide sequence which is at least a partial inversed-reversed sequence of the second half thereof, as is well known in the art.

VGR3042 folded precursor RNA is naturally processed by cellular enzymatic activity into at least 8 separate VGAM precursor RNAs, VGAM1380 precursor RNA, VGAM1381 precursor RNA, VGAM1382 precursor RNA, VGAM1383 precursor RNA, VGAM1384 precursor RNA, VGAM1385 precursor RNA, VGAM1386 precursor RNA and VGAM1387 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1380 RNA, VGAM1381 RNA, VGAM1382 RNA, VGAM1383 RNA, VGAM1384 RNA, VGAM1385 RNA, VGAM1386 RNA and VGAM1387 RNA, herein schematically represented by VGAM1 RNA through VGAM3 RNA, each of which VGAM RNAs corresponding to VGAM RNA of FIG. 1.

VGAM1380 RNA, herein schematically represented by VGAM1 RNA through VGAM3 RNA, binds complementarily to a host target binding site located in an untranslated region of VGAM1380 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1380 host target RNA into VGAM1380 host target protein, herein schematically represented by VGAM1 HOST TARGET PROTEIN through VGAM3 HOST TARGET PROTEIN, all of FIG. 1.

VGAM1381 RNA, herein schematically represented by VGAM1 RNA through VGAM3 RNA, binds complementarily to a host target binding site located in an untranslated region of VGAM1381 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1381 host target RNA into VGAM1381 host target protein, herein schematically represented by VGAM1 HOST TARGET PROTEIN through VGAM3 HOST TARGET PROTEIN, all of FIG. 1.

VGAM1382 RNA, herein schematically represented by VGAM1 RNA through VGAM3 RNA, binds complementarily to a host target binding site located in an untranslated region of VGAM1382 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1382 host target RNA into VGAM1382 host target protein, herein schematically represented by VGAM1 HOST TARGET PROTEIN through VGAM3 HOST TARGET PROTEIN, all of FIG. 1.

VGAM1383 RNA, herein schematically represented by VGAM1 RNA through VGAM3 RNA, binds complementarily to a host target binding site located in an untranslated region of VGAM1383 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1383 host target RNA into VGAM1383 host target protein, herein schematically represented by VGAM1 HOST TARGET PROTEIN through VGAM3 HOST TARGET PROTEIN, all of FIG. 1.

VGAM1384 RNA, herein schematically represented by VGAM1 RNA through VGAM3 RNA, binds complementarily to a host target binding site located in an untranslated region of VGAM1384 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1384 host target RNA into VGAM1384 host target protein, herein schematically represented by VGAM1 HOST TARGET PROTEIN through VGAM3 HOST TARGET PROTEIN, all of FIG. 1.

VGAM1385 RNA, herein schematically represented by VGAM1 RNA through VGAM3 RNA, binds complementarily to a host target binding site located in an untranslated region of VGAM1385 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1385 host target RNA into VGAM1385 host target protein, herein schematically represented by VGAM1 HOST TARGET PROTEIN through VGAM3 HOST TARGET PROTEIN, all of FIG. 1.

VGAM1386 RNA, herein schematically represented by VGAM1 RNA through VGAM3 RNA, binds complementarily to a host target binding site located in an untranslated region of VGAM1386 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1386 host target RNA into VGAM1386 host target protein, herein schematically represented by VGAM1 HOST TARGET PROTEIN through VGAM3 HOST TARGET PROTEIN, all of FIG. 1.

VGAM1387 RNA, herein schematically represented by VGAM1 RNA through VGAM3 RNA, binds complementarily to a host target binding site located in an untranslated region of VGAM1387 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1387 host target RNA into VGAM1387 host target protein, herein schematically represented by VGAM1 HOST TARGET PROTEIN through VGAM3 HOST TARGET PROTEIN, all of FIG. 1.

It is appreciated that a function of VGR3042 gene, herein designated VGR GENE, is inhibition of expression of host target genes, as part of a novel viral mechanism of attacking a host. Accordingly, utilities of VGR3042 gene include diagnosis, prevention and treatment of viral infection by Himetobi P Virus. Specific functions, and accordingly utilities, of VGR3042 gene correlate with, and may be deduced from, the identity of the host target genes, which are inhibited by VGAM RNAs comprised in the 'operon-like' cluster of VGR3042 gene: VGAM1380 host target protein, VGAM1381 host target protein, VGAM1382 host target protein, VGAM1383 host target protein, VGAM1384 host target protein, VGAM1385 host target protein, VGAM1386 host target protein and VGAM1387 host target protein, herein schematically represented by VGAM1 HOST TARGET PROTEIN through VGAM3 HOST TARGET PROTEIN. The function of these host target genes is elaborated hereinabove with reference to VGAM1380, VGAM1381, VGAM1382, VGAM1383, VGAM1384, VGAM1385, VGAM1386 and VGAM1387. FIG. 9 further provides a conceptual description of novel bioinformatically detected regulatory viral gene, referred to here as Viral Genomic Record 3043(VGR3043) viral gene, which encodes an 'operon-like' cluster of novel viral micro RNA-like genes, each of which in turn modulates expression of at least one host target gene, the function and utility of which at least one host target gene is known in the art.

VGR3043 gene, herein designated VGR GENE, is a novel bioinformatically detected regulatory, non protein coding, RNA viral gene. The method by which VGR3043 gene was detected is described hereinabove with reference to FIGS. 1-9.

VGR3043 gene encodes VGR3043 precursor RNA, herein designated VGR PRECURSOR RNA, an RNA molecule, typically several hundred nucleotides long.

VGR3043 precursor RNA folds spatially, forming VGR3043 folded precursor RNA, herein designated VGR FOLDED PRECURSOR RNA. It is appreciated that VGR3043 folded precursor RNA comprises a plurality of what is known in the art as 'hairpin' structures. These 'hairpin' structures are due to the fact that the nucleotide sequence of VGR3043 precursor RNA comprises a plurality of segments, the first half of each such segment having a nucleotide sequence which is at least a partial inversed-reversed sequence of the second half thereof, as is well known in the art.

VGR3043 folded precursor RNA is naturally processed by cellular enzymatic activity into at least 3 separate VGAM precursor RNAs, VGAM1388 precursor RNA, VGAM1389 precursor RNA and VGAM1390 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1388 RNA, VGAM1389 RNA and VGAM1390 RNA, herein schematically represented by VGAM1 RNA through VGAM3 RNA, each of which VGAM RNAs corresponding to VGAM RNA of FIG. 1.

VGAM1388 RNA, herein schematically represented by VGAM1 RNA through VGAM3 RNA, binds complementarily to a host target binding site located in an untranslated region of VGAM1388 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1388 host target RNA into VGAM1388 host target protein, herein schematically represented by VGAM1 HOST TARGET PROTEIN through VGAM3 HOST TARGET PROTEIN, all of FIG. 1.

VGAM1389 RNA, herein schematically represented by VGAM1 RNA through VGAM3 RNA, binds complementarily to a host target binding site located in an untranslated region of VGAM1389 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1389 host target RNA into VGAM1389 host target protein, herein schematically represented by VGAM1 HOST TARGET PROTEIN through VGAM3 HOST TARGET PROTEIN, all of FIG. 1.

VGAM1390 RNA, herein schematically represented by VGAM1 RNA through VGAM3 RNA, binds complementarily to a host target binding site located in an untranslated region of VGAM1390 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1390 host target RNA into VGAM1390 host target protein, herein schematically represented by VGAM1 HOST TARGET PROTEIN through VGAM3 HOST TARGET PROTEIN, all of FIG. 1.

It is appreciated that a function of VGR3043 gene, herein designated VGR GENE, is inhibition of expression of host target genes, as part of a novel viral mechanism of attacking a host. Accordingly, utilities of VGR3043 gene include diagnosis, prevention and treatment of viral infection by Cercopithecine Herpesvirus 7. Specific functions, and accordingly utilities, of VGR3043 gene correlate with, and may be deduced from, the identity of the host target genes, which are inhibited by VGAM RNAs comprised in the 'operon-like' cluster of VGR3043 gene: VGAM1388 host target protein, VGAM1389 host target protein and VGAM1390 host target protein, herein schematically represented by VGAM1 HOST TARGET PROTEIN through VGAM3 HOST TARGET PROTEIN. The function of these host target genes is elaborated hereinabove with reference to VGAM1388, VGAM1389 and VGAM1390. FIG. 9 further provides a conceptual description of novel bioinformatically detected regulatory viral gene, referred to here as Viral Genomic Record 3044(VGR3044) viral gene, which encodes an 'operon-like' cluster of novel viral micro RNA-like genes, each of which in turn modulates expression of at least one host target gene, the function and utility of which at least one host target gene is known in the art.

VGR3044 gene, herein designated VGR GENE, is a novel bioinformatically detected regulatory, non protein coding, RNA viral gene. The method by which VGR3044 gene was detected is described hereinabove with reference to FIGS. 1-9.

VGR3044 gene encodes VGR3044 precursor RNA, herein designated VGR PRECURSOR RNA, an RNA molecule, typically several hundred nucleotides long.

VGR3044 precursor RNA folds spatially, forming VGR3044 folded precursor RNA, herein designated VGR FOLDED PRECURSOR RNA. It is appreciated that VGR3044 folded precursor RNA comprises a plurality of what is known in the art as 'hairpin' structures. These 'hairpin' structures are due to the fact that the nucleotide sequence of VGR3044 precursor RNA comprises a plurality of segments, the first half of each such segment having a nucleotide sequence which is at least a partial inversed-reversed sequence of the second half thereof, as is well known in the art.

VGR3044 folded precursor RNA is naturally processed by cellular enzymatic activity into at least 4 separate VGAM precursor RNAs, VGAM1391 precursor RNA, VGAM1392 precursor RNA, VGAM1393 precursor RNA and VGAM1394 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1391 RNA, VGAM1392 RNA, VGAM1393 RNA and VGAM1394 RNA, herein schematically represented by VGAM1 RNA through VGAM3 RNA, each of which VGAM RNAs corresponding to VGAM RNA of FIG. 1.

VGAM1391 RNA, herein schematically represented by VGAM1 RNA through VGAM3 RNA, binds complementarily to a host target binding site located in an untranslated region of VGAM1391 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1391 host target RNA into VGAM1391 host target protein, herein schematically represented by VGAM1 HOST TARGET PROTEIN through VGAM3 HOST TARGET PROTEIN, all of FIG. 1.

VGAM1392 RNA, herein schematically represented by VGAM1 RNA through VGAM3 RNA, binds complementarily to a host target binding site located in an untranslated region of VGAM1392 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1392 host target RNA into VGAM1392 host target protein, herein schematically represented by VGAM1 HOST TARGET PROTEIN through VGAM3 HOST TARGET PROTEIN, all of FIG. 1.

VGAM1393 RNA, herein schematically represented by VGAM1 RNA through VGAM3 RNA, binds complementarily to a host target binding site located in an untranslated region of VGAM1393 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1393 host target RNA into VGAM1393 host target protein, herein schematically represented by VGAM1 HOST TARGET PROTEIN through VGAM3 HOST TARGET PROTEIN, all of FIG. 1.

VGAM1394 RNA, herein schematically represented by VGAM1 RNA through VGAM3 RNA, binds complementarily to a host target binding site located in an untranslated region of VGAM1394 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1394 host target RNA into VGAM1394 host target protein, herein schematically represented by VGAM1 HOST TARGET PROTEIN through VGAM3 HOST TARGET PROTEIN, all of FIG. 1.

It is appreciated that a function of VGR3044 gene, herein designated VGR GENE, is inhibition of expression of host target genes, as part of a novel viral mechanism of attacking a host. Accordingly, utilities of VGR3044 gene include diagnosis, prevention and treatment of viral infection by Wheat Streak Mosaic Virus. Specific functions, and accordingly utilities, of VGR3044 gene correlate with, and may be deduced from, the identity of the host target genes, which are inhibited by VGAM RNAs comprised in the 'operon-like' cluster of VGR3044 gene: VGAM1391 host target protein, VGAM1392 host target protein, VGAM1393 host target protein and VGAM1394 host target protein, herein schematically represented by VGAM1 HOST TARGET PROTEIN through VGAM3 HOST TARGET PROTEIN. The function of these host target genes is elaborated hereinabove with reference to VGAM1391, VGAM1392, VGAM1393 and VGAM1394. FIG. 9 further provides a conceptual description of novel bioinformatically detected regulatory viral gene, referred to here as Viral Genomic Record 3045(VGR3045) viral gene, which encodes an 'operon-like' cluster of novel viral micro RNA-like genes, each of which in turn modulates expression of at least one host target gene, the function and utility of which at least one host target gene is known in the art.

VGR3045 gene, herein designated VGR GENE, is a novel bioinformatically detected regulatory, non protein coding, RNA viral gene. The method by which VGR3045 gene was detected is described hereinabove with reference to FIGS. 1-9.

VGR3045 gene encodes VGR3045 precursor RNA, herein designated VGR PRECURSOR RNA, an RNA molecule, typically several hundred nucleotides long.

VGR3045 precursor RNA folds spatially, forming VGR3045 folded precursor RNA, herein designated VGR FOLDED PRECURSOR RNA. It is appreciated that VGR3045 folded precursor RNA comprises a plurality of what is known in the art as 'hairpin' structures. These 'hairpin' structures are due to the fact that the nucleotide sequence of VGR3045 precursor RNA comprises a plurality of segments, the first half of each such segment having a nucleotide sequence which is at least a partial inversed-reversed sequence of the second half thereof, as is well known in the art.

VGR3045 folded precursor RNA is naturally processed by cellular enzymatic activity into at least 3 separate VGAM precursor RNAs, VGAM1395 precursor RNA, VGAM1396 precursor RNA and VGAM1397 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1395 RNA, VGAM1396 RNA and VGAM1397 RNA, herein schematically represented by VGAM1 RNA through VGAM3 RNA, each of which VGAM RNAs corresponding to VGAM RNA of FIG. 1.

VGAM1395 RNA, herein schematically represented by VGAM1 RNA through VGAM3 RNA, binds complementarily to a host target binding site located in an untranslated region of VGAM1395 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1395 host target RNA into VGAM1395 host target protein, herein schematically represented by VGAM1 HOST TARGET PROTEIN through VGAM3 HOST TARGET PROTEIN, all of FIG. 1.

VGAM1396 RNA, herein schematically represented by VGAM1 RNA through VGAM3 RNA, binds complementarily to a host target binding site located in an untranslated region of VGAM1396 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1396 host target RNA into VGAM1396 host target protein, herein schematically represented by VGAM1 HOST TARGET PROTEIN through VGAM3 HOST TARGET PROTEIN, all of FIG. 1.

VGAM1397 RNA, herein schematically represented by VGAM1 RNA through VGAM3 RNA, binds complementarily to a host target binding site located in an untranslated region of VGAM1397 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1397 host target RNA into VGAM1397 host target protein, herein schematically represented by VGAM1 HOST TARGET PROTEIN through VGAM3 HOST TARGET PROTEIN, all of FIG. 1.

It is appreciated that a function of VGR3045 gene, herein designated VGR GENE, is inhibition of expression of host target genes, as part of a novel viral mechanism of attacking a host. Accordingly, utilities of VGR3045 gene include diagnosis, prevention and treatment of viral infection by Cowpea Aphid-borne Mosaic Virus. Specific functions, and accordingly utilities, of VGR3045 gene correlate with, and may be deduced from, the identity of the host target genes, which are inhibited by VGAM RNAs comprised in the 'operon-like' cluster of VGR3045 gene: VGAM1395 host target protein, VGAM1396 host target protein and VGAM1397 host target protein, herein schematically represented by VGAM1 HOST TARGET PROTEIN through VGAM3 HOST TARGET PROTEIN. The function of these host target genes is elaborated hereinabove with reference to VGAM1395, VGAM1396 and VGAM1397. FIG. 9 further provides a conceptual description of novel bioinformatically detected regulatory viral gene, referred to here as Viral Genomic Record 3046(VGR3046) viral gene, which encodes an 'operon-like' cluster of novel viral micro RNA-like genes, each of which in turn modulates expression of at least one host target gene, the function and utility of which at least one host target gene is known in the art.

VGR3046 gene, herein designated VGR GENE, is a novel bioinformatically detected regulatory, non protein coding, RNA viral gene. The method by which VGR3046 gene was detected is described hereinabove with reference to FIGS. 1-9.

VGR3046 gene encodes VGR3046 precursor RNA, herein designated VGR PRECURSOR RNA, an RNA molecule, typically several hundred nucleotides long.

VGR3046 precursor RNA folds spatially, forming VGR3046 folded precursor RNA, herein designated VGR FOLDED PRECURSOR RNA. It is appreciated that VGR3046 folded precursor RNA comprises a plurality of what is known in the art as 'hairpin' structures. These 'hairpin' structures are due to the fact that the nucleotide sequence of VGR3046 precursor RNA comprises a plurality of segments, the first half of each such segment having a nucleotide sequence which is at least a partial inversed-reversed sequence of the second half thereof, as is well known in the art.

VGR3046 folded precursor RNA is naturally processed by cellular enzymatic activity into at least 7 separate VGAM precursor RNAs, VGAM1398 precursor RNA, VGAM1399 precursor RNA, VGAM1400 precursor RNA, VGAM1401 precursor RNA, VGAM1402 precursor RNA, VGAM1403 precursor RNA and VGAM1404 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1398 RNA, VGAM1399 RNA, VGAM1400 RNA, VGAM1401 RNA, VGAM1402 RNA, VGAM1403 RNA and VGAM1404 RNA, herein schematically represented by VGAM1 RNA through VGAM3 RNA, each of which VGAM RNAs corresponding to VGAM RNA of FIG. 1.

VGAM1398 RNA, herein schematically represented by VGAM1 RNA through VGAM3 RNA, binds complementarily to a host target binding site located in an untranslated region of VGAM1398 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1398 host target RNA into VGAM1398 host target protein, herein schematically represented by VGAM1 HOST TARGET PROTEIN through VGAM3 HOST TARGET PROTEIN, all of FIG. 1.

VGAM1399 RNA, herein schematically represented by VGAM1 RNA through VGAM3 RNA, binds complementarily to a host target binding site located in an untranslated region of VGAM1399 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1399 host target RNA into VGAM1399 host target protein, herein schematically represented by VGAM1 HOST TARGET PROTEIN through VGAM3 HOST TARGET PROTEIN, all of FIG. 1.

VGAM1400 RNA, herein schematically represented by VGAM1 RNA through VGAM3 RNA, binds complementarily to a host target binding site located in an untranslated region of VGAM1400 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1400 host target RNA into VGAM1400 host target protein, herein schematically represented by VGAM1 HOST TARGET PROTEIN through VGAM3 HOST TARGET PROTEIN, all of FIG. 1.

VGAM1401 RNA, herein schematically represented by VGAM1 RNA through VGAM3 RNA, binds complementarily to a host target binding site located in an untranslated region of VGAM1401 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1401 host target RNA into VGAM1401 host target protein, herein schematically represented by VGAM1 HOST TARGET PROTEIN through VGAM3 HOST TARGET PROTEIN, all of FIG. 1.

VGAM1402 RNA, herein schematically represented by VGAM1 RNA through VGAM3 RNA, binds complementarily to a host target binding site located in an untranslated region of VGAM1402 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1402 host target RNA into VGAM1402 host target protein, herein schematically represented by VGAM1 HOST TARGET PROTEIN through VGAM3 HOST TARGET PROTEIN, all of FIG. 1.

VGAM1403 RNA, herein schematically represented by VGAM1 RNA through VGAM3 RNA, binds complementarily to a host target binding site located in an untranslated region of VGAM1403 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1403 host target RNA into VGAM1403 host target protein, herein schematically represented by VGAM1 HOST TARGET PROTEIN through VGAM3 HOST TARGET PROTEIN, all of FIG. 1.

VGAM1404 RNA, herein schematically represented by VGAM1 RNA through VGAM3 RNA, binds complementarily to a host target binding site located in an untranslated region of VGAM1404 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1404 host target RNA into VGAM1404 host target protein, herein schematically represented by VGAM1 HOST TARGET PROTEIN through VGAM3 HOST TARGET PROTEIN, all of FIG. 1.

It is appreciated that a function of VGR3046 gene, herein designated VGR GENE, is inhibition of expression of host target genes, as part of a novel viral mechanism of attacking a host. Accordingly, utilities of VGR3046 gene include diagnosis, prevention and treatment of viral infection by Perina Nuda Picorna-like Virus. Specific functions, and accordingly utilities, of VGR3046 gene correlate with, and may be deduced from, the identity of the host target genes, which are inhibited by VGAM RNAs comprised in the 'operon-like' cluster of VGR3046 gene: VGAM1398 host target protein, VGAM1399 host target protein, VGAM1400 host target protein, VGAM1401 host target protein, VGAM1402 host target protein, VGAM1403 host target protein and VGAM1404 host target protein, herein schematically represented by VGAM1 HOST TARGET PROTEIN through VGAM3 HOST TARGET PROTEIN. The function of these host target genes is elaborated hereinabove with reference to VGAM1398, VGAM1399, VGAM1400, VGAM1401, VGAM1402, VGAM1403 and VGAM1404. FIG. 9 further provides a conceptual description of novel bioinformatically detected regulatory viral gene, referred to here as Viral Genomic Record 3047(VGR3047) viral gene, which encodes an 'operon-like' cluster of novel viral micro RNA-like genes, each of which in turn modulates expression of at least one host target gene, the function and utility of which at least one host target gene is known in the art.

VGR3047 gene, herein designated VGR GENE, is a novel bioinformatically detected regulatory, non protein coding, RNA viral gene. The method by which VGR3047 gene was detected is described hereinabove with reference to FIGS. 1-9.

VGR3047 gene encodes VGR3047 precursor RNA, herein designated VGR PRECURSOR RNA, an RNA molecule, typically several hundred nucleotides long.

VGR3047 precursor RNA folds spatially, forming VGR3047 folded precursor RNA, herein designated VGR FOLDED PRECURSOR RNA. It is appreciated that VGR3047 folded precursor RNA comprises a plurality of what is known in the art as 'hairpin' structures. These 'hairpin' structures are due to the fact that the nucleotide sequence of VGR3047 precursor RNA comprises a plurality of segments, the first half of each such segment having a nucleotide sequence which is at least a partial inversed-reversed sequence of the second half thereof, as is well known in the art.

VGR3047 folded precursor RNA is naturally processed by cellular enzymatic activity into at least 2 separate VGAM precursor RNAs, VGAM1405 precursor RNA and VGAM1406 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1405 RNA and VGAM1406 RNA, herein schematically represented by VGAM1 RNA through VGAM3 RNA, each of which VGAM RNAs corresponding to VGAM RNA of FIG. 1.

VGAM1405 RNA, herein schematically represented by VGAM1 RNA through VGAM3 RNA, binds complementarily to a host target binding site located in an untranslated region of VGAM1405 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1405 host target RNA into VGAM1405 host target protein, herein schematically represented by VGAM1 HOST TARGET PROTEIN through VGAM3 HOST TARGET PROTEIN, all of FIG. 1.

VGAM1406 RNA, herein schematically represented by VGAM1 RNA through VGAM3 RNA, binds complementarily to a host target binding site located in an untranslated region of VGAM1406 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1406 host target RNA into VGAM1406 host target protein, herein schematically represented by VGAM1 HOST TARGET PROTEIN through VGAM3 HOST TARGET PROTEIN, all of FIG. 1.

It is appreciated that a function of VGR3047 gene, herein designated VGR GENE, is inhibition of expression of host target genes, as part of a novel viral mechanism of attacking a host. Accordingly, utilities of VGR3047 gene include diagnosis, prevention and treatment of viral infection by Perina Nuda Picorna-like Virus. Specific functions, and accordingly utilities, of VGR3047 gene correlate with, and may be deduced from, the identity of the host target genes, which are inhibited by VGAM RNAs comprised in the 'operon-like' cluster of VGR3047 gene: VGAM1405 host target protein and VGAM1406 host target protein, herein schematically represented by VGAM1 HOST TARGET PROTEIN through VGAM3 HOST TARGET PROTEIN. The function of these host target genes is elaborated hereinabove with reference to VGAM1405 and VGAM1406. FIG. 9 further provides a conceptual description of novel bioinformatically detected regulatory viral gene, referred to here as Viral Genomic Record 3048(VGR3048) viral gene, which encodes an 'operon-like' cluster of novel viral micro RNA-like genes, each of which in turn modulates expression of at least one host target gene, the function and utility of which at least one host target gene is known in the art.

VGR3048 gene, herein designated VGR GENE, is a novel bioinformatically detected regulatory, non protein coding, RNA viral gene. The method by which VGR3048 gene was detected is described hereinabove with reference to FIGS. 1-9.

VGR3048 gene encodes VGR3048 precursor RNA, herein designated VGR PRECURSOR RNA, an RNA molecule, typically several hundred nucleotides long.

VGR3048 precursor RNA folds spatially, forming VGR3048 folded precursor RNA, herein designated VGR FOLDED PRECURSOR RNA. It is appreciated that VGR3048 folded precursor RNA comprises a plurality of what is known in the art as 'hairpin' structures. These 'hairpin' structures are due to the fact that the nucleotide sequence of VGR3048 precursor RNA comprises a plurality of segments, the first half of each such segment having a nucleotide sequence which is at least a partial inversed-reversed sequence of the second half thereof, as is well known in the art.

VGR3048 folded precursor RNA is naturally processed by cellular enzymatic activity into at least 5 separate VGAM precursor RNAs, VGAM1407 precursor RNA, VGAM1408 precursor RNA, VGAM1409 precursor RNA, VGAM1410 precursor RNA and VGAM1411 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1407 RNA, VGAM1408 RNA, VGAM1409 RNA, VGAM1410 RNA and VGAM1411 RNA, herein schematically represented by VGAM1 RNA through VGAM3 RNA, each of which VGAM RNAs corresponding to VGAM RNA of FIG. 1.

VGAM1407 RNA, herein schematically represented by VGAM1 RNA through VGAM3 RNA, binds complementarily to a host target binding site located in an untranslated region of VGAM1407 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1407 host target RNA into VGAM1407 host target protein, herein schematically represented by VGAM1 HOST TARGET PROTEIN through VGAM3 HOST TARGET PROTEIN, all of FIG. 1.

VGAM1408 RNA, herein schematically represented by VGAM1 RNA through VGAM3 RNA, binds complementarily to a host target binding site located in an untranslated region of VGAM1408 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1408 host target RNA into VGAM1408 host target protein, herein schematically represented by VGAM1 HOST TARGET PROTEIN through VGAM3 HOST TARGET PROTEIN, all of FIG. 1.

VGAM1409 RNA, herein schematically represented by VGAM1 RNA through VGAM3 RNA, binds complementarily to a host target binding site located in an untranslated region of VGAM1409 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1409 host target RNA into VGAM1409 host target protein, herein schematically represented by VGAM1 HOST TARGET PROTEIN through VGAM3 HOST TARGET PROTEIN, all of FIG. 1.

VGAM1410 RNA, herein schematically represented by VGAM1 RNA through VGAM3 RNA, binds complementarily to a host target binding site located in an untranslated region of VGAM1410 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1410 host target RNA into VGAM1410 host target protein, herein schematically represented by VGAM1 HOST TARGET PROTEIN through VGAM3 HOST TARGET PROTEIN, all of FIG. 1.

VGAM1411 RNA, herein schematically represented by VGAM1 RNA through VGAM3 RNA, binds complementarily to a host target binding site located in an untranslated region of VGAM1411 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1411 host target RNA into VGAM1411 host target protein, herein schematically represented by VGAM1 HOST TARGET PROTEIN through VGAM3 HOST TARGET PROTEIN, all of FIG. 1.

It is appreciated that a function of VGR3048 gene, herein designated VGR GENE, is inhibition of expression of host target genes, as part of a novel viral mechanism of attacking a host. Accordingly, utilities of VGR3048 gene include diagnosis, prevention and treatment of viral infection by Acute Bee Paralysis Virus. Specific functions, and accordingly utilities, of VGR3048 gene correlate with, and may be deduced from, the identity of the host target genes, which are inhibited by VGAM RNAs comprised in the 'operon-like' cluster of VGR3048 gene: VGAM1407 host target protein, VGAM1408 host target protein, VGAM1409 host target protein, VGAM1410 host target protein and VGAM1411 host target protein, herein schematically represented by VGAM1 HOST TARGET PROTEIN through VGAM3 HOST TARGET PROTEIN. The function of these host target genes is elaborated hereinabove with reference to VGAM1407, VGAM1408, VGAM1409, VGAM1410 and VGAM1411.

FIG. 9 further provides a conceptual description of novel bioinformatically detected regulatory viral gene, referred to here as Viral Genomic Record 3049(VGR3049) viral gene, which encodes an 'operon-like' cluster of novel viral micro RNA-like genes, each of which in turn modulates expression of at least one host target gene, the function and utility of which at least one host target gene is known in the art.

VGR3049 gene, herein designated VGR GENE, is a novel bioinformatically detected regulatory, non protein coding, RNA viral gene. The method by which VGR3049 gene was detected is described hereinabove with reference to FIGS. 1-9.

VGR3049 gene encodes VGR3049 precursor RNA, herein designated VGR PRECURSOR RNA, an RNA molecule, typically several hundred nucleotides long.

VGR3049 precursor RNA folds spatially, forming VGR3049 folded precursor RNA, herein designated VGR FOLDED PRECURSOR RNA. It is appreciated that VGR3049 folded precursor RNA comprises a plurality of what is known in the art as 'hairpin' structures. These 'hairpin' structures are due to the fact that the nucleotide sequence of VGR3049 precursor RNA comprises a plurality of segments, the first half of each such segment having a nucleotide sequence which is at least a partial inversed-reversed sequence of the second half thereof, as is well known in the art.

VGR3049 folded precursor RNA is naturally processed by cellular enzymatic activity into at least 4 separate VGAM precursor RNAs, VGAM1412 precursor RNA, VGAM1413 precursor RNA, VGAM1414 precursor RNA and VGAM1415 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1412 RNA, VGAM1413 RNA, VGAM1414 RNA and VGAM1415 RNA, herein schematically represented by VGAM1 RNA through VGAM3 RNA, each of which VGAM RNAs corresponding to VGAM RNA of FIG. 1.

VGAM1412 RNA, herein schematically represented by VGAM1 RNA through VGAM3 RNA, binds complementarily to a host target binding site located in an untranslated region of VGAM1412 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1412 host target RNA into VGAM1412 host target protein, herein schematically represented by VGAM1 HOST TARGET PROTEIN through VGAM3 HOST TARGET PROTEIN, all of FIG. 1.

VGAM1413 RNA, herein schematically represented by VGAM1 RNA through VGAM3 RNA, binds complementarily to a host target binding site located in an untranslated region of VGAM1413 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1413 host target RNA into VGAM1413 host target protein, herein schematically represented by VGAM1 HOST TARGET PROTEIN through VGAM3 HOST TARGET PROTEIN, all of FIG. 1.

VGAM1414 RNA, herein schematically represented by VGAM1 RNA through VGAM3 RNA, binds complementarily to a host target binding site located in an untranslated region of VGAM1414 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1414 host target RNA into VGAM1414 host target protein, herein schematically represented by VGAM1 HOST TARGET PROTEIN through VGAM3 HOST TARGET PROTEIN, all of FIG. 1.

VGAM1415 RNA, herein schematically represented by VGAM1 RNA through VGAM3 RNA, binds complementarily to a host target binding site located in an untranslated region of VGAM1415 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1415 host target RNA into VGAM1415 host target protein, herein schematically represented by VGAM1 HOST TARGET PROTEIN through VGAM3 HOST TARGET PROTEIN, all of FIG. 1.

It is appreciated that a function of VGR3049 gene, herein designated VGR GENE, is inhibition of expression of host target genes, as part of a novel viral mechanism of attacking a host. Accordingly, utilities of VGR3049 gene include diagnosis, prevention and treatment of viral infection by Bean Yellow Mosaic Virus. Specific functions, and accordingly utilities, of VGR3049 gene correlate with, and may be deduced from, the identity of the host target genes, which are inhibited by VGAM RNAs comprised in the 'operon-like' cluster of VGR3049 gene: VGAM1412 host target protein, VGAM1413 host target protein, VGAM1414 host target protein and VGAM1415 host target protein, herein schematically represented by VGAM1 HOST TARGET PROTEIN through VGAM3 HOST TARGET PROTEIN. The function of these host target genes is elaborated hereinabove with reference to VGAM1412, VGAM1413, VGAM1414 and VGAM1415. FIG. 9 further provides a conceptual description of novel bioinformatically detected regulatory viral gene, referred to here as Viral Genomic Record 3050(VGR3050) viral gene, which encodes an 'operon-like' cluster of novel viral micro RNA-like genes, each of which in turn modulates expression of at least one host target gene, the function and utility of which at least one host target gene is known in the art.

VGR3050 gene, herein designated VGR GENE, is a novel bioinformatically detected regulatory, non protein coding, RNA viral gene. The method by which VGR3050 gene was detected is described hereinabove with reference to FIGS. 1-9.

VGR3050 gene encodes VGR3050 precursor RNA, herein designated VGR PRECURSOR RNA, an RNA molecule, typically several hundred nucleotides long.

VGR3050 precursor RNA folds spatially, forming VGR3050 folded precursor RNA, herein designated VGR FOLDED PRECURSOR RNA. It is appreciated that VGR3050 folded precursor RNA comprises a plurality of what is known in the art as 'hairpin' structures. These 'hairpin' structures are due to the fact that the nucleotide sequence of VGR3050 precursor RNA comprises a plurality of segments, the first half of each such segment having a nucleotide sequence which is at least a partial inversed-reversed sequence of the second half thereof, as is well known in the art.

VGR3050 folded precursor RNA is naturally processed by cellular enzymatic activity into at least 4 separate VGAM precursor RNAs, VGAM1416 precursor RNA, VGAM1417 precursor RNA, VGAM1418 precursor RNA and VGAM1419 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1416 RNA, VGAM1417 RNA, VGAM1418 RNA and VGAM1419 RNA, herein schematically represented by VGAM1 RNA through VGAM3 RNA, each of which VGAM RNAs corresponding to VGAM RNA of FIG. 1.

VGAM1416 RNA, herein schematically represented by VGAM1 RNA through VGAM3 RNA, binds complementarily to a host target binding site located in an untranslated region of VGAM1416 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1416 host target RNA into VGAM1416 host target protein, herein schematically represented by VGAM1 HOST TARGET PROTEIN through VGAM3 HOST TARGET PROTEIN, all of FIG. 1.

VGAM1417 RNA, herein schematically represented by VGAM1 RNA through VGAM3 RNA, binds complementarily to a host target binding site located in an untranslated region of VGAM1417 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1417 host target RNA into VGAM1417 host target protein, herein schematically represented by VGAM1 HOST TARGET PROTEIN through VGAM3 HOST TARGET PROTEIN, all of FIG. 1.

VGAM1418 RNA, herein schematically represented by VGAM1 RNA through VGAM3 RNA, binds complementarily to a host target binding site located in an untranslated region of VGAM1418 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1418 host target RNA into VGAM1418 host target protein, herein schematically represented by VGAM1 HOST TARGET PROTEIN through VGAM3 HOST TARGET PROTEIN, all of FIG. 1.

VGAM1419 RNA, herein schematically represented by VGAM1 RNA through VGAM3 RNA, binds complementarily to a host target binding site located in an untranslated region of VGAM1419 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1419 host target RNA into VGAM1419 host target protein, herein schematically represented by VGAM1 HOST TARGET PROTEIN through VGAM3 HOST TARGET PROTEIN, all of FIG. 1.

It is appreciated that a function of VGR3050 gene, herein designated VGR GENE, is inhibition of expression of host target genes, as part of a novel viral mechanism of attacking a host. Accordingly, utilities of VGR3050 gene include diagnosis, prevention and treatment of viral infection by Ryegrass Mosaic Virus. Specific functions, and accordingly utilities, of VGR3050 gene correlate with, and may be deduced from, the identity of the host target genes, which are inhibited by VGAM RNAs comprised in the 'operon-like' cluster of VGR3050 gene: VGAM1416 host target protein, VGAM1417 host target protein, VGAM1418 host target protein and VGAM1419 host target protein, herein schematically represented by VGAM1 HOST TARGET PROTEIN through VGAM3 HOST TARGET PROTEIN. The function of these host target genes is elaborated hereinabove with reference to VGAM1416, VGAM1417, VGAM1418 and VGAM1419. FIG. 9 further provides a conceptual description of novel bioinformatically detected regulatory viral gene, referred to here as Viral Genomic Record 3051(VGR3051) viral gene, which encodes an 'operon-like' cluster of novel viral micro RNA-like genes, each of which in turn modulates expression of at least one host target gene, the function and utility of which at least one host target gene is known in the art.

VGR3051 gene, herein designated VGR GENE, is a novel bioinformatically detected regulatory, non protein coding, RNA viral gene. The method by which VGR3051 gene was detected is described hereinabove with reference to FIGS. 1-9.

VGR3051 gene encodes VGR3051 precursor RNA, herein designated VGR PRECURSOR RNA, an RNA molecule, typically several hundred nucleotides long.

VGR3051 precursor RNA folds spatially, forming VGR3051 folded precursor RNA, herein designated VGR FOLDED PRECURSOR RNA. It is appreciated that VGR3051 folded precursor RNA comprises a plurality of what is known in the art as 'hairpin' structures. These 'hairpin' structures are due to the fact that the nucleotide sequence of VGR3051 precursor RNA comprises a plurality of segments, the first half of each such segment having a nucleotide sequence which is at least a partial inversed-reversed sequence of the second half thereof, as is well known in the art.

VGR3051 folded precursor RNA is naturally processed by cellular enzymatic activity into at least 4 separate VGAM precursor RNAs, VGAM1420 precursor RNA, VGAM1421 precursor RNA, VGAM1422 precursor RNA and VGAM1423 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1420 RNA, VGAM1421 RNA, VGAM1422 RNA and VGAM1423 RNA, herein schematically represented by VGAM1 RNA through VGAM3 RNA, each of which VGAM RNAs corresponding to VGAM RNA of FIG. 1.

VGAM1420 RNA, herein schematically represented by VGAM1 RNA through VGAM3 RNA, binds complementarily to a host target binding site located in an untranslated region of VGAM1420 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1420 host target RNA into VGAM1420 host target protein, herein schematically represented by VGAM1 HOST TARGET PROTEIN through VGAM3 HOST TARGET PROTEIN, all of FIG. 1.

VGAM1421 RNA, herein schematically represented by VGAM1 RNA through VGAM3 RNA, binds complementarily to a host target binding site located in an untranslated region of VGAM1421 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1421 host target RNA into VGAM1421 host target protein, herein schematically represented by VGAM1 HOST TARGET PROTEIN through VGAM3 HOST TARGET PROTEIN, all of FIG. 1.

VGAM1422 RNA, herein schematically represented by VGAM1 RNA through VGAM3 RNA, binds complementarily to a host target binding site located in an untranslated region of VGAM1422 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1422 host target RNA into VGAM1422 host target protein, herein schematically represented by VGAM1 HOST TARGET PROTEIN through VGAM3 HOST TARGET PROTEIN, all of FIG. 1.

VGAM1423 RNA, herein schematically represented by VGAM1 RNA through VGAM3 RNA, binds complementarily to a host target binding site located in an untranslated region of VGAM1423 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1423 host target RNA into VGAM1423 host target protein, herein schematically represented by VGAM1 HOST TARGET PROTEIN through VGAM3 HOST TARGET PROTEIN, all of FIG. 1.

It is appreciated that a function of VGR3051 gene, herein designated VGR GENE, is inhibition of expression of host target genes, as part of a novel viral mechanism of attacking a host. Accordingly, utilities of VGR3051 gene include diagnosis, prevention and treatment of viral infection by Hepatitis GB Virus A. Specific functions, and accordingly utilities, of VGR3051 gene correlate with, and may be deduced from, the identity of the host target genes, which are inhibited by VGAM RNAs comprised in the 'operon-like' cluster of VGR3051 gene: VGAM1420 host target protein, VGAM1421 host target protein, VGAM1422 host target protein and VGAM1423 host target protein, herein schematically represented by VGAM1 HOST TARGET PROTEIN through VGAM3 HOST TARGET PROTEIN. The function of these host target genes is elaborated hereinabove with reference to VGAM1420, VGAM1421, VGAM1422 and VGAM1423. FIG. 9 further provides a conceptual description of novel bioinformatically detected regulatory viral gene, referred to here as Viral Genomic Record 3052(VGR3052) viral gene, which encodes an 'operon-like' cluster of novel viral micro RNA-like genes, each of which in turn modulates expression of at least one host target gene, the function and utility of which at least one host target gene is known in the art.

VGR3052 gene, herein designated VGR GENE, is a novel bioinformatically detected regulatory, non protein coding, RNA viral gene. The method by which VGR3052 gene was detected is described hereinabove with reference to FIGS. 1-9.

VGR3052 gene encodes VGR3052 precursor RNA, herein designated VGR PRECURSOR RNA, an RNA molecule, typically several hundred nucleotides long.

VGR3052 precursor RNA folds spatially, forming VGR3052 folded precursor RNA, herein designated VGR FOLDED PRECURSOR RNA. It is appreciated that VGR3052 folded precursor RNA comprises a plurality of what is known in the art as 'hairpin' structures. These 'hairpin' structures are due to the fact that the nucleotide sequence of VGR3052 precursor RNA comprises a plurality of segments, the first half of each such segment having a nucleotide sequence which is at least a partial inversed-reversed sequence of the second half thereof, as is well known in the art.

VGR3052 folded precursor RNA is naturally processed by cellular enzymatic activity into at least 7 separate VGAM precursor RNAs, VGAM1424 precursor RNA, VGAM1425 precursor RNA, VGAM1426 precursor RNA, VGAM1427 precursor RNA, VGAM1428 precursor RNA, VGAM1429 precursor RNA and VGAM1430 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1424 RNA, VGAM1425 RNA, VGAM1426 RNA, VGAM1427 RNA, VGAM1428 RNA, VGAM1429 RNA and VGAM1430 RNA, herein schematically represented by VGAM1 RNA through VGAM3 RNA, each of which VGAM RNAs corresponding to VGAM RNA of FIG. 1.

VGAM1424 RNA, herein schematically represented by VGAM1 RNA through VGAM3 RNA, binds complementarily to a host target binding site located in an untranslated region of VGAM1424 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1424 host target RNA into VGAM1424 host target protein, herein schematically represented by VGAM1 HOST TARGET PROTEIN through VGAM3 HOST TARGET PROTEIN, all of FIG. 1.

VGAM1425 RNA, herein schematically represented by VGAM1 RNA through VGAM3 RNA, binds complementarily to a host target binding site located in an untranslated region of VGAM1425 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1425 host target RNA into VGAM1425 host target protein, herein schematically represented by VGAM1 HOST TARGET PROTEIN through VGAM3 HOST TARGET PROTEIN, all of FIG. 1.

VGAM1426 RNA, herein schematically represented by VGAM1 RNA through VGAM3 RNA, binds complementarily to a host target binding site located in an untranslated region of VGAM1426 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1426 host target RNA into VGAM1426 host target protein, herein schematically represented by VGAM1 HOST TARGET PROTEIN through VGAM3 HOST TARGET PROTEIN, all of FIG. 1.

VGAM1427 RNA, herein schematically represented by VGAM1 RNA through VGAM3 RNA, binds complementarily to a host target binding site located in an untranslated region of VGAM1427 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1427 host target RNA into VGAM1427 host target protein, herein schematically represented by VGAM1 HOST TARGET PROTEIN through VGAM3 HOST TARGET PROTEIN, all of FIG. 1.

VGAM1428 RNA, herein schematically represented by VGAM1 RNA through VGAM3 RNA, binds complementarily to a host target binding site located in an untranslated region of VGAM1428 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1428 host target RNA into VGAM1428 host target protein, herein schematically represented by VGAM1 HOST TARGET PROTEIN through VGAM3 HOST TARGET PROTEIN, all of FIG. 1.

VGAM1429 RNA, herein schematically represented by VGAM1 RNA through VGAM3 RNA, binds complementarily to a host target binding site located in an untranslated region of VGAM1429 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1429 host target RNA into VGAM1429 host target protein, herein schematically represented by VGAM1 HOST TARGET PROTEIN through VGAM3 HOST TARGET PROTEIN, all of FIG. 1.

VGAM1430 RNA, herein schematically represented by VGAM1 RNA through VGAM3 RNA, binds complementarily to a host target binding site located in an untranslated region of VGAM1430 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1430 host target RNA into VGAM1430 host target protein, herein schematically represented by VGAM1 HOST TARGET PROTEIN through VGAM3 HOST TARGET PROTEIN, all of FIG. 1.

It is appreciated that a function of VGR3052 gene, herein designated VGR GENE, is inhibition of expression of host target genes, as part of a novel viral mechanism of attacking a host. Accordingly, utilities of VGR3052 gene include diagnosis, prevention and treatment of viral infection by Clover Yellow Vein Virus. Specific functions, and accordingly utilities, of VGR3052 gene correlate with, and may be deduced from, the identity of the host target genes, which are inhibited by VGAM RNAs comprised in the 'operon-like' cluster of VGR3052 gene: VGAM1424 host target protein, VGAM1425 host target protein, VGAM1426 host target protein, VGAM1427 host target protein, VGAM1428 host target protein, VGAM1429 host target protein and VGAM1430 host target protein, herein schematically represented by VGAM1 HOST TARGET PROTEIN through VGAM3 HOST TARGET PROTEIN. The function of these host target genes is elaborated hereinabove with reference to VGAM1424, VGAM1425, VGAM1426, VGAM1427, VGAM1428, VGAM1429 and VGAM1430. FIG. 9 further provides a conceptual description of novel bioinformatically detected regulatory viral gene, referred to here as Viral Genomic Record 3053(VGR3053) viral gene, which encodes an 'operon-like' cluster of novel viral micro RNA-like genes, each of which in turn modulates expression of at least one host target gene, the function and utility of which at least one host target gene is known in the art.

VGR3053 gene, herein designated VGR GENE, is a novel bioinformatically detected regulatory, non protein coding, RNA viral gene. The method by which VGR3053 gene was detected is described hereinabove with reference to FIGS. 1-9.

VGR3053 gene encodes VGR3053 precursor RNA, herein designated VGR PRECURSOR RNA, an RNA molecule, typically several hundred nucleotides long.

VGR3053 precursor RNA folds spatially, forming VGR3053 folded precursor RNA, herein designated VGR FOLDED PRECURSOR RNA. It is appreciated that VGR3053 folded precursor RNA comprises a plurality of what is known in the art as 'hairpin' structures. These 'hairpin' structures are due to the fact that the nucleotide sequence of VGR3053 precursor RNA comprises a plurality of segments, the first half of each such segment having a nucleotide sequence which is at least a partial inversed-reversed sequence of the second half thereof, as is well known in the art.

VGR3053 folded precursor RNA is naturally processed by cellular enzymatic activity into at least 7 separate VGAM precursor RNAs, VGAM1431 precursor RNA, VGAM1432 precursor RNA, VGAM1433 precursor RNA, VGAM1434 precursor RNA, VGAM1435 precursor RNA, VGAM1436 precursor RNA and VGAM1437 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1431 RNA, VGAM1432 RNA, VGAM1433 RNA, VGAM1434 RNA, VGAM1435 RNA, VGAM1436 RNA and VGAM1437 RNA, herein schematically represented by VGAM1 RNA through VGAM3 RNA, each of which VGAM RNAs corresponding to VGAM RNA of FIG. 1.

VGAM1431 RNA, herein schematically represented by VGAM1 RNA through VGAM3 RNA, binds complementarily to a host target binding site located in an untranslated region of VGAM1431 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1431 host target RNA into VGAM1431 host target protein, herein schematically represented by VGAM1 HOST TARGET PROTEIN through VGAM3 HOST TARGET PROTEIN, all of FIG. 1.

VGAM1432 RNA, herein schematically represented by VGAM1 RNA through VGAM3 RNA, binds complementarily to a host target binding site located in an untranslated region of VGAM1432 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1432 host target RNA into VGAM1432 host target protein, herein schematically represented by VGAM1 HOST TARGET PROTEIN through VGAM3 HOST TARGET PROTEIN, all of FIG. 1.

VGAM1433 RNA, herein schematically represented by VGAM1 RNA through VGAM3 RNA, binds complementarily to a host target binding site located in an untranslated region of VGAM1433 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1433 host target RNA into VGAM1433 host target protein, herein schematically represented by VGAM1 HOST TARGET PROTEIN through VGAM3 HOST TARGET PROTEIN, all of FIG. 1.

VGAM1434 RNA, herein schematically represented by VGAM1 RNA through VGAM3 RNA, binds complementarily to a host target binding site located in an untranslated region of VGAM1434 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1434 host target RNA into VGAM1434 host target protein, herein schematically represented by VGAM1 HOST TARGET PROTEIN through VGAM3 HOST TARGET PROTEIN, all of FIG. 1.

VGAM1435 RNA, herein schematically represented by VGAM1 RNA through VGAM3 RNA, binds complementarily to a host target binding site located in an untranslated region of VGAM1435 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1435 host target RNA into VGAM1435 host target protein, herein schematically represented by VGAM1 HOST TARGET PROTEIN through VGAM3 HOST TARGET PROTEIN, all of FIG. 1.

VGAM1436 RNA, herein schematically represented by VGAM1 RNA through VGAM3 RNA, binds complementarily to a host target binding site located in an untranslated region of VGAM1436 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1436 host target RNA into VGAM1436 host target protein, herein schematically represented by VGAM1 HOST TARGET PROTEIN through VGAM3 HOST TARGET PROTEIN, all of FIG. 1.

VGAM1437 RNA, herein schematically represented by VGAM1 RNA through VGAM3 RNA, binds complementarily to a host target binding site located in an untranslated region of VGAM1437 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1437 host target RNA into VGAM1437 host target protein, herein schematically represented by VGAM1 HOST TARGET PROTEIN through VGAM3 HOST TARGET PROTEIN, all of FIG. 1.

It is appreciated that a function of VGR3053 gene, herein designated VGR GENE, is inhibition of expression of host target genes, as part of a novel viral mechanism of attacking a host. Accordingly, utilities of VGR3053 gene include diagnosis, prevention and treatment of viral infection by Potato Virus A. Specific functions, and accordingly utilities, of VGR3053 gene correlate with, and may be deduced from, the identity of the host target genes, which are inhibited by VGAM RNAs comprised in the 'operon-like' cluster of VGR3053 gene: VGAM1431 host target protein, VGAM1432 host target protein, VGAM1433 host target protein, VGAM1434 host target protein, VGAM1435 host target protein, VGAM1436 host target protein and VGAM1437 host target protein, herein schematically represented by VGAM1 HOST TARGET PROTEIN through VGAM3 HOST TARGET PROTEIN. The function of these host target genes is elaborated hereinabove with reference to VGAM1431, VGAM1432, VGAM1433, VGAM1434, VGAM1435, VGAM1436 and VGAM1437. FIG. 9 further provides a conceptual description of novel bioinformatically detected regulatory viral gene, referred to here as Viral Genomic Record 3054(VGR3054) viral gene, which encodes an 'operon-like' cluster of novel viral micro RNA-like genes, each of which in turn modulates expression of at least one host target gene, the function and utility of which at least one host target gene is known in the art.

VGR3054 gene, herein designated VGR GENE, is a novel bioinformatically detected regulatory, non protein coding, RNA viral gene. The method by which VGR3054 gene was detected is described hereinabove with reference to FIGS. 1-9.

VGR3054 gene encodes VGR3054 precursor RNA, herein designated VGR PRECURSOR RNA, an RNA molecule, typically several hundred nucleotides long.

VGR3054 precursor RNA folds spatially, forming VGR3054 folded precursor RNA, herein designated VGR FOLDED PRECURSOR RNA. It is appreciated that VGR3054 folded precursor RNA comprises a plurality of what is known in the art as 'hairpin' structures. These 'hairpin' structures are due to the fact that the nucleotide sequence of VGR3054 precursor RNA comprises a plurality of segments, the first half of each such segment having a nucleotide sequence which is at least a partial inversed-reversed sequence of the second half thereof, as is well known in the art.

VGR3054 folded precursor RNA is naturally processed by cellular enzymatic activity into at least 5 separate VGAM precursor RNAs, VGAM1438 precursor RNA, VGAM1439 precursor RNA, VGAM1440 precursor RNA, VGAM1441 precursor RNA and VGAM1442 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1438 RNA, VGAM1439 RNA, VGAM1440 RNA, VGAM1441 RNA and VGAM1442 RNA, herein schematically represented by VGAM1 RNA through VGAM3 RNA, each of which VGAM RNAs corresponding to VGAM RNA of FIG. 1.

VGAM1438 RNA, herein schematically represented by VGAM1 RNA through VGAM3 RNA, binds complementarily to a host target binding site located in an untranslated region of VGAM1438 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1438 host target RNA into VGAM1438 host target protein, herein schematically represented by VGAM1 HOST TARGET PROTEIN through VGAM3 HOST TARGET PROTEIN, all of FIG. 1.

VGAM1439 RNA, herein schematically represented by VGAM1 RNA through VGAM3 RNA, binds complementarily to a host target binding site located in an untranslated region of VGAM1439 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1439 host target RNA into VGAM1439 host target protein, herein schematically represented by VGAM1 HOST TARGET PROTEIN through VGAM3 HOST TARGET PROTEIN, all of FIG. 1.

VGAM1440 RNA, herein schematically represented by VGAM1 RNA through VGAM3 RNA, binds complementarily to a host target binding site located in an untranslated region of VGAM1440 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1440 host target RNA into VGAM1440 host target protein, herein schematically represented by VGAM1 HOST TARGET PROTEIN through VGAM3 HOST TARGET PROTEIN, all of FIG. 1.

VGAM1441 RNA, herein schematically represented by VGAM1 RNA through VGAM3 RNA, binds complementarily to a host target binding site located in an untranslated region of VGAM1441 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1441 host target RNA into VGAM1441 host target protein, herein schematically represented by VGAM1 HOST TARGET PROTEIN through VGAM3 HOST TARGET PROTEIN, all of FIG. 1.

VGAM1442 RNA, herein schematically represented by VGAM1 RNA through VGAM3 RNA, binds complementarily to a host target binding site located in an untranslated region of VGAM1442 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1442 host target RNA into VGAM1442 host target protein, herein schematically represented by VGAM1 HOST TARGET PROTEIN through VGAM3 HOST TARGET PROTEIN, all of FIG. 1.

It is appreciated that a function of VGR3054 gene, herein designated VGR GENE, is inhibition of expression of host target genes, as part of a novel viral mechanism of attacking a host. Accordingly, utilities of VGR3054 gene include diagnosis, prevention and treatment of viral infection by Bean Common Mosaic Necrosis Virus. Specific functions, and accordingly utilities, of VGR3054 gene correlate with, and may be deduced from, the identity of the host target genes, which are inhibited by VGAM RNAs comprised in the 'operon-like' cluster of VGR3054 gene: VGAM1438 host target protein, VGAM1439 host target protein, VGAM1440 host target protein, VGAM1441 host target protein and VGAM1442 host target protein, herein schematically represented by VGAM1 HOST TARGET PROTEIN through VGAM3 HOST TARGET PROTEIN. The function of these host target genes is elaborated hereinabove with reference to VGAM1438, VGAM1439, VGAM1440, VGAM1441 and VGAM1442. FIG. 9 further provides a conceptual description of novel bioinformatically detected regulatory viral gene, referred to here as Viral Genomic Record 3055(VGR3055) viral gene, which encodes an 'operon-like' cluster of novel viral micro RNA-like genes, each of which in turn modulates expression of at least one host target gene, the function and utility of which at least one host target gene is known in the art.

VGR3055 gene, herein designated VGR GENE, is a novel bioinformatically detected regulatory, non protein coding, RNA viral gene. The method by which VGR3055 gene was detected is described hereinabove with reference to FIGS. 1-9.

VGR3055 gene encodes VGR3055 precursor RNA, herein designated VGR PRECURSOR RNA, an RNA molecule, typically several hundred nucleotides long.

VGR3055 precursor RNA folds spatially, forming VGR3055 folded precursor RNA, herein designated VGR FOLDED PRECURSOR RNA. It is appreciated that VGR3055 folded precursor RNA comprises a plurality of what is known in the art as 'hairpin' structures. These 'hairpin' structures are due to the fact that the nucleotide sequence of VGR3055 precursor RNA comprises a plurality of segments, the first half of each such segment having a nucleotide sequence which is at least a partial inversed-reversed sequence of the second half thereof, as is well known in the art.

VGR3055 folded precursor RNA is naturally processed by cellular enzymatic activity into at least 6 separate VGAM precursor RNAs, VGAM1443 precursor RNA, VGAM1444 precursor RNA, VGAM1445 precursor RNA, VGAM1446 precursor RNA, VGAM1447 precursor RNA and VGAM1448 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1443 RNA, VGAM1444 RNA, VGAM1445 RNA, VGAM1446 RNA, VGAM1447 RNA and VGAM1448 RNA, herein schematically represented by VGAM1 RNA through VGAM3 RNA, each of which VGAM RNAs corresponding to VGAM RNA of FIG. 1.

VGAM1443 RNA, herein schematically represented by VGAM1 RNA through VGAM3 RNA, binds complementarily to a host target binding site located in an untranslated region of VGAM1443 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1443 host target RNA into VGAM1443 host target protein, herein schematically represented by VGAM1 HOST TARGET PROTEIN through VGAM3 HOST TARGET PROTEIN, all of FIG. 1.

VGAM1444 RNA, herein schematically represented by VGAM1 RNA through VGAM3 RNA, binds complementarily to a host target binding site located in an untranslated region of VGAM1444 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1444 host target RNA into VGAM1444 host target protein, herein schematically represented by VGAM1 HOST TARGET PROTEIN through VGAM3 HOST TARGET PROTEIN, all of FIG. 1.

VGAM1445 RNA, herein schematically represented by VGAM1 RNA through VGAM3 RNA, binds complementarily to a host target binding site located in an untranslated region of VGAM1445 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1445 host target RNA into VGAM1445 host target protein, herein schematically represented by VGAM1 HOST TARGET PROTEIN through VGAM3 HOST TARGET PROTEIN, all of FIG. 1.

VGAM1446 RNA, herein schematically represented by VGAM1 RNA through VGAM3 RNA, binds complementarily to a host target binding site located in an untranslated region of VGAM1446 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1446 host target RNA into VGAM1446 host target protein, herein schematically represented by VGAM1 HOST TARGET PROTEIN through VGAM3 HOST TARGET PROTEIN, all of FIG. 1.

VGAM1447 RNA, herein schematically represented by VGAM1 RNA through VGAM3 RNA, binds complementarily to a host target binding site located in an untranslated region of VGAM1447 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1447 host target RNA into VGAM1447 host target protein, herein schematically represented by VGAM1 HOST TARGET PROTEIN through VGAM3 HOST TARGET PROTEIN, all of FIG. 1.

VGAM1448 RNA, herein schematically represented by VGAM1 RNA through VGAM3 RNA, binds complementarily to a host target binding site located in an untranslated region of VGAM1448 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1448 host target RNA into VGAM1448 host target protein, herein schematically represented by VGAM1 HOST TARGET PROTEIN through VGAM3 HOST TARGET PROTEIN, all of FIG. 1.

It is appreciated that a function of VGR3055 gene, herein designated VGR GENE, is inhibition of expression of host target genes, as part of a novel viral mechanism of attacking a host. Accordingly, utilities of VGR3055 gene include diagnosis, prevention and treatment of viral infection by Pepper Mottle Virus. Specific functions, and accordingly utilities, of VGR3055 gene correlate with, and may be deduced from, the identity of the host target genes, which are inhibited by VGAM RNAs comprised in the 'operon-like' cluster of VGR3055 gene: VGAM1443 host target protein, VGAM1444 host target protein, VGAM1445 host target protein, VGAM1446 host target protein, VGAM1447 host target protein and VGAM1448 host target protein, herein schematically represented by VGAM1 HOST TARGET PROTEIN through VGAM3 HOST TARGET PROTEIN. The function of these host target genes is elaborated hereinabove with reference to VGAM1443, VGAM1444, VGAM1445, VGAM1446, VGAM1447 and VGAM1448. FIG. 9 further provides a conceptual description of novel bioinformatically detected regulatory viral gene, referred to here as Viral Genomic Record 3056(VGR3056) viral gene, which encodes an 'operon-like' cluster of novel viral micro RNA-like genes, each of which in turn modulates expression of at least one host target gene, the function and utility of which at least one host target gene is known in the art.

VGR3056 gene, herein designated VGR GENE, is a novel bioinformatically detected regulatory, non protein coding, RNA viral gene. The method by which VGR3056 gene was detected is described hereinabove with reference to FIGS. 1-9.

VGR3056 gene encodes VGR3056 precursor RNA, herein designated VGR PRECURSOR RNA, an RNA molecule, typically several hundred nucleotides long.

VGR3056 precursor RNA folds spatially, forming VGR3056 folded precursor RNA, herein designated VGR FOLDED PRECURSOR RNA. It is appreciated that VGR3056 folded precursor RNA comprises a plurality of what is known in the art as 'hairpin' structures. These 'hairpin' structures are due to the fact that the nucleotide sequence of VGR3056 precursor RNA comprises a plurality of segments, the first half of each such segment having a nucleotide sequence which is at least a partial inversed-reversed sequence of the second half thereof, as is well known in the art.

VGR3056 folded precursor RNA is naturally processed by cellular enzymatic activity into at least 8 separate VGAM precursor RNAs, VGAM1449 precursor RNA, VGAM1450 precursor RNA, VGAM1451 precursor RNA, VGAM1452 precursor RNA, VGAM1453 precursor RNA, VGAM1454 precursor RNA, VGAM1455 precursor RNA and VGAM1456 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1449 RNA, VGAM1450 RNA, VGAM1451 RNA, VGAM1452 RNA, VGAM1453 RNA, VGAM1454 RNA, VGAM1455 RNA and VGAM1456 RNA, herein schematically represented by VGAM1 RNA through VGAM3 RNA, each of which VGAM RNAs corresponding to VGAM RNA of FIG. 1.

VGAM1449 RNA, herein schematically represented by VGAM1 RNA through VGAM3 RNA, binds complementarily to a host target binding site located in an untranslated region of VGAM1449 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1449 host target RNA into VGAM1449 host target protein, herein schematically represented by VGAM1 HOST TARGET PROTEIN through VGAM3 HOST TARGET PROTEIN, all of FIG. 1.

VGAM1450 RNA, herein schematically represented by VGAM1 RNA through VGAM3 RNA, binds complementarily to a host target binding site located in an untranslated region of VGAM1450 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1450 host target RNA into VGAM1450 host target protein, herein schematically represented by VGAM1 HOST TARGET PROTEIN through VGAM3 HOST TARGET PROTEIN, all of FIG. 1.

VGAM1451 RNA, herein schematically represented by VGAM1 RNA through VGAM3 RNA, binds complementarily to a host target binding site located in an untranslated region of VGAM1451 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1451 host target RNA into VGAM1451 host target protein, herein schematically represented by VGAM1 HOST TARGET PROTEIN through VGAM3 HOST TARGET PROTEIN, all of FIG. 1.

VGAM1452 RNA, herein schematically represented by VGAM1 RNA through VGAM3 RNA, binds complementarily to a host target binding site located in an untranslated region of VGAM1452 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1452 host target RNA into VGAM1452 host target protein, herein schematically represented by VGAM1 HOST TARGET PROTEIN through VGAM3 HOST TARGET PROTEIN, all of FIG. 1.

VGAM1453 RNA, herein schematically represented by VGAM1 RNA through VGAM3 RNA, binds complementarily to a host target binding site located in an untranslated region of VGAM1453 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1453 host target RNA into VGAM1453 host target protein, herein schematically represented by VGAM1 HOST TARGET PROTEIN through VGAM3 HOST TARGET PROTEIN, all of FIG. 1.

VGAM1454 RNA, herein schematically represented by VGAM1 RNA through VGAM3 RNA, binds complementarily to a host target binding site located in an untranslated region of VGAM1454 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1454 host target RNA into VGAM1454 host target protein, herein schematically represented by VGAM1 HOST TARGET PROTEIN through VGAM3 HOST TARGET PROTEIN, all of FIG. 1.

VGAM1455 RNA, herein schematically represented by VGAM1 RNA through VGAM3 RNA, binds complementarily to a host target binding site located in an untranslated region of VGAM1455 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1455 host target RNA into VGAM1455 host target protein, herein schematically represented by VGAM1 HOST TARGET PROTEIN through VGAM3 HOST TARGET PROTEIN, all of FIG. 1.

VGAM1456 RNA, herein schematically represented by VGAM1 RNA through VGAM3 RNA, binds complementarily to a host target binding site located in an untranslated region of VGAM1456 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1456 host target RNA into VGAM1456 host target protein, herein schematically represented by VGAM1 HOST TARGET PROTEIN through VGAM3 HOST TARGET PROTEIN, all of FIG. 1.

It is appreciated that a function of VGR3056 gene, herein designated VGR GENE, is inhibition of expression of host target genes, as part of a novel viral mechanism of attacking a host. Accordingly, utilities of VGR3056 gene include diagnosis, prevention and treatment of viral infection by Equine Herpesvirus 2. Specific functions, and accordingly utilities, of VGR3056 gene correlate with, and may be deduced from, the identity of the host target genes, which are inhibited by VGAM RNAs comprised in the 'operon-like' cluster of VGR3056 gene: VGAM1449 host target protein, VGAM1450 host target protein, VGAM1451 host target protein, VGAM1452 host target protein, VGAM1453 host target protein, VGAM1454 host target protein, VGAM1455 host target protein and VGAM1456 host target protein, herein schematically represented by VGAM1 HOST TARGET PROTEIN through VGAM3 HOST TARGET PROTEIN. The function of these host target genes is elaborated hereinabove with reference to VGAM1449, VGAM1450, VGAM1451, VGAM1452, VGAM1453, VGAM1454, VGAM1455 and VGAM1456. FIG. 9 further provides a conceptual description of novel bioinformatically detected regulatory viral gene, referred to here as Viral Genomic Record 3057(VGR3057) viral gene, which encodes an 'operon-like' cluster of novel viral micro RNA-like genes, each of which in turn modulates expression of at least one host target gene, the function and utility of which at least one host target gene is known in the art.

VGR3057 gene, herein designated VGR GENE, is a novel bioinformatically detected regulatory, non protein coding, RNA viral gene. The method by which VGR3057 gene was detected is described hereinabove with reference to FIGS. 1-9.

VGR3057 gene encodes VGR3057 precursor RNA, herein designated VGR PRECURSOR RNA, an RNA molecule, typically several hundred nucleotides long.

VGR3057 precursor RNA folds spatially, forming VGR3057 folded precursor RNA, herein designated VGR FOLDED PRECURSOR RNA. It is appreciated that VGR3057 folded precursor RNA comprises a plurality of what is known in the art as 'hairpin' structures. These 'hairpin' structures are due to the fact that the nucleotide sequence of VGR3057 precursor RNA comprises a plurality of segments, the first half of each such segment having a nucleotide sequence which is at least a partial inversed-reversed sequence of the second half thereof, as is well known in the art.

VGR3057 folded precursor RNA is naturally processed by cellular enzymatic activity into at least 8 separate VGAM precursor RNAs, VGAM1457 precursor RNA, VGAM1458 precursor RNA, VGAM1459 precursor RNA, VGAM1460 precursor RNA, VGAM1461 precursor RNA, VGAM1462 precursor RNA, VGAM1463 precursor RNA and VGAM1464 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1457 RNA, VGAM1458 RNA, VGAM1459 RNA, VGAM1460 RNA, VGAM1461 RNA, VGAM1462 RNA, VGAM1463 RNA and VGAM1464 RNA, herein schematically represented by VGAM1 RNA through VGAM3 RNA, each of which VGAM RNAs corresponding to VGAM RNA of FIG. 1.

VGAM1457 RNA, herein schematically represented by VGAM1 RNA through VGAM3 RNA, binds complementarily to a host target binding site located in an untranslated region of VGAM1457 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1457 host target RNA into VGAM1457 host target protein, herein schematically represented by VGAM1 HOST TARGET PROTEIN through VGAM3 HOST TARGET PROTEIN, all of FIG. 1.

VGAM1458 RNA, herein schematically represented by VGAM1 RNA through VGAM3 RNA, binds complementarily to a host target binding site located in an untranslated region of VGAM1458 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1458 host target RNA into VGAM1458 host target protein, herein schematically represented by VGAM1 HOST TARGET PROTEIN through VGAM3 HOST TARGET PROTEIN, all of FIG. 1.

VGAM1459 RNA, herein schematically represented by VGAM1 RNA through VGAM3 RNA, binds complementarily to a host target binding site located in an untranslated region of VGAM1459 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1459 host target RNA into VGAM1459 host target protein, herein schematically represented by VGAM1 HOST TARGET PROTEIN through VGAM3 HOST TARGET PROTEIN, all of FIG. 1.

VGAM1460 RNA, herein schematically represented by VGAM1 RNA through VGAM3 RNA, binds complementarily to a host target binding site located in an untranslated region of VGAM1460 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1460 host target RNA into VGAM1460 host target protein, herein schematically represented by VGAM1 HOST TARGET PROTEIN through VGAM3 HOST TARGET PROTEIN, all of FIG. 1.

VGAM1461 RNA, herein schematically represented by VGAM1 RNA through VGAM3 RNA, binds complementarily to a host target binding site located in an untranslated region of VGAM1461 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1461 host target RNA into VGAM1461 host target protein, herein schematically represented by VGAM1 HOST TARGET PROTEIN through VGAM3 HOST TARGET PROTEIN, all of FIG. 1.

VGAM1462 RNA, herein schematically represented by VGAM1 RNA through VGAM3 RNA, binds complementarily to a host target binding site located in an untranslated region of VGAM1462 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1462 host target RNA into VGAM1462 host target protein, herein schematically represented by VGAM1 HOST TARGET PROTEIN through VGAM3 HOST TARGET PROTEIN, all of FIG. 1.

VGAM1463 RNA, herein schematically represented by VGAM1 RNA through VGAM3 RNA, binds complementarily to a host target binding site located in an untranslated region of VGAM1463 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1463 host target RNA into VGAM1463 host target protein, herein schematically represented by VGAM1 HOST TARGET PROTEIN through VGAM3 HOST TARGET PROTEIN, all of FIG. 1.

VGAM1464 RNA, herein schematically represented by VGAM1 RNA through VGAM3 RNA, binds complementarily to a host target binding site located in an untranslated region of VGAM1464 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1464 host target RNA into VGAM1464 host target protein, herein schematically represented by VGAM1 HOST TARGET PROTEIN through VGAM3 HOST TARGET PROTEIN, all of FIG. 1.

It is appreciated that a function of VGR3057 gene, herein designated VGR GENE, is inhibition of expression of host target genes, as part of a novel viral mechanism of attacking a host. Accordingly, utilities of VGR3057 gene include diagnosis, prevention and treatment of viral infection by Equine Herpesvirus 2. Specific functions, and accordingly utilities, of VGR3057 gene correlate with, and may be deduced from, the identity of the host target genes, which are inhibited by VGAM RNAs comprised in the 'operon-like' cluster of VGR3057 gene: VGAM1457 host target protein, VGAM1458 host target protein, VGAM1459 host target protein, VGAM1460 host target protein, VGAM1461 host target protein, VGAM1462 host target protein, VGAM1463 host target protein and VGAM1464 host target protein, herein schematically represented by VGAM1 HOST TARGET PROTEIN through VGAM3 HOST TARGET PROTEIN. The function of these host target genes is elaborated hereinabove with reference to VGAM1457, VGAM1458, VGAM1459, VGAM1460, VGAM1461, VGAM1462, VGAM1463 and VGAM1464. FIG. 9 further provides a conceptual description of novel bioinformatically detected regulatory viral gene, referred to here as Viral Genomic Record 3058(VGR3058) viral gene, which encodes an 'operon-like' cluster of novel viral micro RNA-like genes, each of which in turn modulates expression of at least one host target gene, the function and utility of which at least one host target gene is known in the art.

VGR3058 gene, herein designated VGR GENE, is a novel bioinformatically detected regulatory, non protein coding, RNA viral gene. The method by which VGR3058 gene was detected is described hereinabove with reference to FIGS. 1-9.

VGR3058 gene encodes VGR3058 precursor RNA, herein designated VGR PRECURSOR RNA, an RNA molecule, typically several hundred nucleotides long.

VGR3058 precursor RNA folds spatially, forming VGR3058 folded precursor RNA, herein designated VGR FOLDED PRECURSOR RNA. It is appreciated that VGR3058 folded precursor RNA comprises a plurality of what is known in the art as 'hairpin' structures. These 'hairpin' structures are due to the fact that the nucleotide sequence of VGR3058 precursor RNA comprises a plurality of segments, the first half of each such segment having a nucleotide sequence which is at least a partial inversed-reversed sequence of the second half thereof, as is well known in the art.

VGR3058 folded precursor RNA is naturally processed by cellular enzymatic activity into at least 3 separate VGAM precursor RNAs, VGAM1465 precursor RNA, VGAM1466 precursor RNA and VGAM1467 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1465 RNA, VGAM1466 RNA and VGAM1467 RNA, herein schematically represented by VGAM1 RNA through VGAM3 RNA, each of which VGAM RNAs corresponding to VGAM RNA of FIG. 1.

VGAM1465 RNA, herein schematically represented by VGAM1 RNA through VGAM3 RNA, binds complementarily to a host target binding site located in an untranslated region of VGAM1465 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1465 host target RNA into VGAM1465 host target protein, herein schematically represented by VGAM1 HOST TARGET PROTEIN through VGAM3 HOST TARGET PROTEIN, all of FIG. 1.

VGAM1466 RNA, herein schematically represented by VGAM1 RNA through VGAM3 RNA, binds complementarily to a host target binding site located in an untranslated region of VGAM1466 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1466 host target RNA into VGAM1466 host target protein, herein schematically represented by VGAM1 HOST TARGET PROTEIN through VGAM3 HOST TARGET PROTEIN, all of FIG. 1.

VGAM1467 RNA, herein schematically represented by VGAM1 RNA through VGAM3 RNA, binds complementarily to a host target binding site located in an untranslated region of VGAM1467 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1467 host target RNA into VGAM1467 host target protein, herein schematically represented by VGAM1 HOST TARGET PROTEIN through VGAM3 HOST TARGET PROTEIN, all of FIG. 1.

It is appreciated that a function of VGR3058 gene, herein designated VGR GENE, is inhibition of expression of host target genes, as part of a novel viral mechanism of attacking a host. Accordingly, utilities of VGR3058 gene include diagnosis, prevention and treatment of viral infection by Equine Herpesvirus 2. Specific functions, and accordingly utilities, of VGR3058 gene correlate with, and may be deduced from, the identity of the host target genes, which are inhibited by VGAM RNAs comprised in the 'operon-like' cluster of VGR3058 gene: VGAM1465 host target protein, VGAM1466 host target protein and VGAM1467 host target protein, herein schematically represented by VGAM1 HOST TARGET PROTEIN through VGAM3 HOST TARGET PROTEIN. The function of these host target genes is elaborated hereinabove with reference to VGAM1465, VGAM1466 and VGAM1467. FIG. 9 further provides a conceptual description of novel bioinformatically detected regulatory viral gene, referred to here as Viral Genomic Record 3059(VGR3059) viral gene, which encodes an 'operon-like' cluster of novel viral micro RNA-like genes, each of which in turn modulates expression of at least one host target gene, the function and utility of which at least one host target gene is known in the art.

VGR3059 gene, herein designated VGR GENE, is a novel bioinformatically detected regulatory, non protein coding, RNA viral gene. The method by which VGR3059 gene was detected is described hereinabove with reference to FIGS. 1-9.

VGR3059 gene encodes VGR3059 precursor RNA, herein designated VGR PRECURSOR RNA, an RNA molecule, typically several hundred nucleotides long.

VGR3059 precursor RNA folds spatially, forming VGR3059 folded precursor RNA, herein designated VGR FOLDED PRECURSOR RNA. It is appreciated that VGR3059 folded precursor RNA comprises a plurality of what is known in the art as 'hairpin' structures. These 'hairpin' structures are due to the fact that the nucleotide sequence of VGR3059 precursor RNA comprises a plurality of segments, the first half of each such segment having a nucleotide sequence which is at least a partial inversed-reversed sequence of the second half thereof, as is well known in the art.

VGR3059 folded precursor RNA is naturally processed by cellular enzymatic activity into at least 2 separate VGAM precursor RNAs, VGAM1468 precursor RNA and VGAM1469 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1468 RNA and VGAM1469 RNA, herein schematically represented by VGAM1 RNA through VGAM3 RNA, each of which VGAM RNAs corresponding to VGAM RNA of FIG. 1.

VGAM1468 RNA, herein schematically represented by VGAM1 RNA through VGAM3 RNA, binds complementarily to a host target binding site located in an untranslated region of VGAM1468 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1468 host target RNA into VGAM1468 host target protein, herein schematically represented by VGAM1 HOST TARGET PROTEIN through VGAM3 HOST TARGET PROTEIN, all of FIG. 1.

VGAM1469 RNA, herein schematically represented by VGAM1 RNA through VGAM3 RNA, binds complementarily to a host target binding site located in an untranslated region of VGAM1469 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1469 host target RNA into VGAM1469 host target protein, herein schematically represented by VGAM1 HOST TARGET PROTEIN through VGAM3 HOST TARGET PROTEIN, all of FIG. 1.

It is appreciated that a function of VGR3059 gene, herein designated VGR GENE, is inhibition of expression of host target genes, as part of a novel viral mechanism of attacking a host. Accordingly, utilities of VGR3059 gene include diagnosis, prevention and treatment of viral infection by Infectious Flacherie Virus. Specific functions, and accordingly utilities, of VGR3059 gene correlate with, and may be deduced from, the identity of the host target genes, which are inhibited by VGAM RNAs comprised in the 'operon-like' cluster of VGR3059 gene: VGAM1468 host target protein and VGAM1469 host target protein, herein schematically represented by VGAM1 HOST TARGET PROTEIN through VGAM3 HOST TARGET PROTEIN. The function of these host target genes is elaborated hereinabove with reference to VGAM1468 and VGAM1469. FIG. 9 further provides a conceptual description of novel bioinformatically detected regulatory viral gene, referred to here as Viral Genomic Record 3060(VGR3060) viral gene, which encodes an 'operon-like' cluster of novel viral micro RNA-like genes, each of which in turn modulates expression of at least one host target gene, the function and utility of which at least one host target gene is known in the art.

VGR3060 gene, herein designated VGR GENE, is a novel bioinformatically detected regulatory, non protein coding, RNA viral gene. The method by which VGR3060 gene was detected is described hereinabove with reference to FIGS. 1-9.

VGR3060 gene encodes VGR3060 precursor RNA, herein designated VGR PRECURSOR RNA, an RNA molecule, typically several hundred nucleotides long.

VGR3060 precursor RNA folds spatially, forming VGR3060 folded precursor RNA, herein designated VGR FOLDED PRECURSOR RNA. It is appreciated that VGR3060 folded precursor RNA comprises a plurality of what is known in the art as 'hairpin' structures. These 'hairpin' structures are due to the fact that the nucleotide sequence of VGR3060 precursor RNA comprises a plurality of segments, the first half of each such segment having a nucleotide sequence which is at least a partial inversed-reversed sequence of the second half thereof, as is well known in the art.

VGR3060 folded precursor RNA is naturally processed by cellular enzymatic activity into at least 8 separate VGAM precursor RNAs, VGAM1470 precursor RNA, VGAM1471 precursor RNA, VGAM1472 precursor RNA, VGAM1473 precursor RNA, VGAM1474 precursor RNA, VGAM1475 precursor RNA, VGAM1476 precursor RNA and VGAM1477 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1470 RNA, VGAM1471 RNA, VGAM1472 RNA, VGAM1473 RNA, VGAM1474 RNA, VGAM1475 RNA, VGAM1476 RNA and VGAM1477 RNA, herein schematically represented by VGAM1 RNA through VGAM3 RNA, each of which VGAM RNAs corresponding to VGAM RNA of FIG. 1.

VGAM1470 RNA, herein schematically represented by VGAM1 RNA through VGAM3 RNA, binds complementarily to a host target binding site located in an untranslated region of VGAM1470 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1470 host target RNA into VGAM1470 host target protein, herein schematically represented by VGAM1 HOST TARGET PROTEIN through VGAM3 HOST TARGET PROTEIN, all of FIG. 1.

VGAM1471 RNA, herein schematically represented by VGAM1 RNA through VGAM3 RNA, binds complementarily to a host target binding site located in an untranslated region of VGAM1471 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1471 host target RNA into VGAM1471 host target protein, herein schematically represented by VGAM1 HOST TARGET PROTEIN through VGAM3 HOST TARGET PROTEIN, all of FIG. 1.

VGAM1472 RNA, herein schematically represented by VGAM1 RNA through VGAM3 RNA, binds complementarily to a host target binding site located in an untranslated region of VGAM1472 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1472 host target RNA into VGAM1472 host target protein, herein schematically represented by VGAM1 HOST TARGET PROTEIN through VGAM3 HOST TARGET PROTEIN, all of FIG. 1.

VGAM1473 RNA, herein schematically represented by VGAM1 RNA through VGAM3 RNA, binds complementarily to a host target binding site located in an untranslated region of VGAM1473 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1473 host target RNA into VGAM1473 host target protein, herein schematically represented by VGAM1 HOST TARGET PROTEIN through VGAM3 HOST TARGET PROTEIN, all of FIG. 1.

VGAM1474 RNA, herein schematically represented by VGAM1 RNA through VGAM3 RNA, binds complementarily to a host target binding site located in an untranslated region of VGAM1474 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1474 host target RNA into VGAM1474 host target protein, herein schematically represented by VGAM1 HOST TARGET PROTEIN through VGAM3 HOST TARGET PROTEIN, all of FIG. 1.

VGAM1475 RNA, herein schematically represented by VGAM1 RNA through VGAM3 RNA, binds complementarily to a host target binding site located in an untranslated region of VGAM1475 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1475 host target RNA into VGAM1475 host target protein, herein schematically represented by VGAM1 HOST TARGET PROTEIN through VGAM3 HOST TARGET PROTEIN, all of FIG. 1.

VGAM1476 RNA, herein schematically represented by VGAM1 RNA through VGAM3 RNA, binds complementarily to a host target binding site located in an untranslated region of VGAM1476 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1476 host target RNA into VGAM1476 host target protein, herein schematically represented by VGAM1 HOST TARGET PROTEIN through VGAM3 HOST TARGET PROTEIN, all of FIG. 1.

VGAM1477 RNA, herein schematically represented by VGAM1 RNA through VGAM3 RNA, binds complementarily to a host target binding site located in an untranslated region of VGAM1477 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1477 host target RNA into VGAM1477 host target protein, herein schematically represented by VGAM1 HOST TARGET PROTEIN through VGAM3 HOST TARGET PROTEIN, all of FIG. 1.

It is appreciated that a function of VGR3060 gene, herein designated VGR GENE, is inhibition of expression of host target genes, as part of a novel viral mechanism of attacking a host. Accordingly, utilities of VGR3060 gene include diagnosis, prevention and treatment of viral infection by Cocksfoot Streak Virus (CSV). Specific functions, and accordingly utilities, of VGR3060 gene correlate with, and may be deduced from, the identity of the host target genes, which are inhibited by VGAM RNAs comprised in the 'operon-like' cluster of VGR3060 gene: VGAM1470 host target protein, VGAM1471 host target protein, VGAM1472 host target protein, VGAM1473 host target protein, VGAM1474 host target protein, VGAM1475 host target protein, VGAM1476 host target protein and VGAM1477 host target protein, herein schematically represented by VGAM1 HOST TARGET PROTEIN through VGAM3 HOST TARGET PROTEIN. The function of these host target genes is elaborated hereinabove with reference to VGAM1470, VGAM1471, VGAM1472, VGAM1473, VGAM1474, VGAM1475, VGAM1476 and VGAM1477. FIG. 9 further provides a conceptual description of novel bioinformatically detected regulatory viral gene, referred to here as Viral Genomic Record 3061(VGR3061) viral gene, which encodes an 'operon-like' cluster of novel viral micro RNA-like genes, each of which in turn modulates expression of at least one host target gene, the function and utility of which at least one host target gene is known in the art.

VGR3061 gene, herein designated VGR GENE, is a novel bioinformatically detected regulatory, non protein coding, RNA viral gene. The method by which VGR3061 gene was detected is described hereinabove with reference to FIGS. 1-9.

VGR3061 gene encodes VGR3061 precursor RNA, herein designated VGR PRECURSOR RNA, an RNA molecule, typically several hundred nucleotides long.

VGR3061 precursor RNA folds spatially, forming VGR3061 folded precursor RNA, herein designated VGR FOLDED PRECURSOR RNA. It is appreciated that VGR3061 folded precursor RNA comprises a plurality of what is known in the art as 'hairpin' structures. These 'hairpin' structures are due to the fact that the nucleotide sequence of VGR3061 precursor RNA comprises a plurality of segments, the first half of each such segment having a nucleotide sequence which is at least a partial inversed-reversed sequence of the second half thereof, as is well known in the art.

VGR3061 folded precursor RNA is naturally processed by cellular enzymatic activity into at least 6 separate VGAM precursor RNAs, VGAM1478 precursor RNA, VGAM1479 precursor RNA, VGAM1480 precursor RNA, VGAM1481 precursor RNA, VGAM1482 precursor RNA and VGAM1483 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1478 RNA, VGAM1479 RNA, VGAM1480 RNA, VGAM1481 RNA, VGAM1482 RNA and VGAM1483 RNA, herein schematically represented by VGAM1 RNA through VGAM3 RNA, each of which VGAM RNAs corresponding to VGAM RNA of FIG. 1.

VGAM1478 RNA, herein schematically represented by VGAM1 RNA through VGAM3 RNA, binds complementarily to a host target binding site located in an untranslated region of VGAM1478 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1478 host target RNA into VGAM1478 host target protein, herein schematically represented by VGAM1 HOST TARGET PROTEIN through VGAM3 HOST TARGET PROTEIN, all of FIG. 1.

VGAM1479 RNA, herein schematically represented by VGAM1 RNA through VGAM3 RNA, binds complementarily to a host target binding site located in an untranslated region of VGAM1479 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1479 host target RNA into VGAM1479 host target protein, herein schematically represented by VGAM1 HOST TARGET PROTEIN through VGAM3 HOST TARGET PROTEIN, all of FIG. 1.

VGAM1480 RNA, herein schematically represented by VGAM1 RNA through VGAM3 RNA, binds complementarily to a host target binding site located in an untranslated region of VGAM1480 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1480 host target RNA into VGAM1480 host target protein, herein schematically represented by VGAM1 HOST TARGET PROTEIN through VGAM3 HOST TARGET PROTEIN, all of FIG. 1.

VGAM1481 RNA, herein schematically represented by VGAM1 RNA through VGAM3 RNA, binds complementarily to a host target binding site located in an untranslated region of VGAM1481 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1481 host target RNA into VGAM1481 host target protein, herein schematically represented by VGAM1 HOST TARGET PROTEIN through VGAM3 HOST TARGET PROTEIN, all of FIG. 1.

VGAM1482 RNA, herein schematically represented by VGAM1 RNA through VGAM3 RNA, binds complementarily to a host target binding site located in an untranslated region of VGAM1482 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1482 host target RNA into VGAM1482 host target protein, herein schematically represented by VGAM1 HOST TARGET PROTEIN through VGAM3 HOST TARGET PROTEIN, all of FIG. 1.

VGAM1483 RNA, herein schematically represented by VGAM1 RNA through VGAM3 RNA, binds complementarily to a host target binding site located in an untranslated region of VGAM1483 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1483 host target RNA into VGAM1483 host target protein, herein schematically represented by VGAM1 HOST TARGET PROTEIN through VGAM3 HOST TARGET PROTEIN, all of FIG. 1.

It is appreciated that a function of VGR3061 gene, herein designated VGR GENE, is inhibition of expression of host target genes, as part of a novel viral mechanism of attacking a host. Accordingly, utilities of VGR3061 gene include diagnosis, prevention and treatment of viral infection by Brome Streak Mosaic Virus. Specific functions, and accordingly utilities, of VGR3061 gene correlate with, and may be deduced from, the identity of the host target genes, which are inhibited by VGAM RNAs comprised in the 'operon-like' cluster of VGR3061 gene: VGAM1478 host target protein, VGAM1479 host target protein, VGAM1480 host target protein, VGAM1481 host target protein, VGAM1482 host target protein and VGAM1483 host target protein, herein schematically represented by VGAM1 HOST TARGET PROTEIN through VGAM3 HOST TARGET PROTEIN. The function of these host target genes is elaborated hereinabove with reference to VGAM1478, VGAM1479, VGAM1480, VGAM1481, VGAM1482 and VGAM1483. FIG. 9 further provides a conceptual description of novel bioinformatically detected regulatory viral gene, referred to here as Viral Genomic Record 3062(VGR3062) viral gene, which encodes an 'operon-like' cluster of novel viral micro RNA-like genes, each of which in turn modulates expression of at least one host target gene, the function and utility of which at least one host target gene is known in the art.

VGR3062 gene, herein designated VGR GENE, is a novel bioinformatically detected regulatory, non protein coding, RNA viral gene. The method by which VGR3062 gene was detected is described hereinabove with reference to FIGS. 1-9.

VGR3062 gene encodes VGR3062 precursor RNA, herein designated VGR PRECURSOR RNA, an RNA molecule, typically several hundred nucleotides long.

VGR3062 precursor RNA folds spatially, forming VGR3062 folded precursor RNA, herein designated VGR FOLDED PRECURSOR RNA. It is appreciated that VGR3062 folded precursor RNA comprises a plurality of what is known in the art as 'hairpin' structures. These 'hairpin' structures are due to the fact that the nucleotide sequence of VGR3062 precursor RNA comprises a plurality of segments, the first half of each such segment having a nucleotide sequence which is at least a partial inversed-reversed sequence of the second half thereof, as is well known in the art.

VGR3062 folded precursor RNA is naturally processed by cellular enzymatic activity into at least 4 separate VGAM precursor RNAs, VGAM1484 precursor RNA, VGAM1485 precursor RNA, VGAM1486 precursor RNA and VGAM1487 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1484 RNA, VGAM1485 RNA, VGAM1486 RNA and VGAM1487 RNA, herein schematically represented by VGAM1 RNA through VGAM3 RNA, each of which VGAM RNAs corresponding to VGAM RNA of FIG. 1.

VGAM1484 RNA, herein schematically represented by VGAM1 RNA through VGAM3 RNA, binds complementarily to a host target binding site located in an untranslated region of VGAM1484 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1484 host target RNA into VGAM1484 host target protein, herein schematically represented by VGAM1 HOST TARGET PROTEIN through VGAM3 HOST TARGET PROTEIN, all of FIG. 1.

VGAM1485 RNA, herein schematically represented by VGAM1 RNA through VGAM3 RNA, binds complementarily to a host target binding site located in an untranslated region of VGAM1485 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1485 host target RNA into VGAM1485 host target protein, herein schematically represented by VGAM1 HOST TARGET PROTEIN through VGAM3 HOST TARGET PROTEIN, all of FIG. 1.

VGAM1486 RNA, herein schematically represented by VGAM1 RNA through VGAM3 RNA, binds complementarily to a host target binding site located in an untranslated region of VGAM1486 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1486 host target RNA into VGAM1486 host target protein, herein schematically represented by VGAM1 HOST TARGET PROTEIN through VGAM3 HOST TARGET PROTEIN, all of FIG. 1.

VGAM1487 RNA, herein schematically represented by VGAM1 RNA through VGAM3 RNA, binds complementarily to a host target binding site located in an untranslated region of VGAM1487 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1487 host target RNA into VGAM1487 host target protein, herein schematically represented by VGAM1 HOST TARGET PROTEIN through VGAM3 HOST TARGET PROTEIN, all of FIG. 1.

It is appreciated that a function of VGR3062 gene, herein designated VGR GENE, is inhibition of expression of host target genes, as part of a novel viral mechanism of attacking a host. Accordingly, utilities of VGR3062 gene include diagnosis, prevention and treatment of viral infection by Gallid Herpesvirus 2. Specific functions, and accordingly utilities, of VGR3062 gene correlate with, and may be deduced from, the identity of the host target genes, which are inhibited by VGAM RNAs comprised in the 'operon-like' cluster of VGR3062 gene: VGAM1484 host target protein, VGAM1485 host target protein, VGAM1486 host target protein and VGAM1487 host target protein, herein schematically represented by VGAM1 HOST TARGET PROTEIN through VGAM3 HOST TARGET PROTEIN. The function of these host target genes is elaborated hereinabove with reference to VGAM1484, VGAM1485, VGAM1486 and VGAM1487. FIG. 9 further provides a conceptual description of novel bioinformatically detected regulatory viral gene, referred to here as Viral Genomic Record 3063(VGR3063) viral gene, which encodes an 'operon-like' cluster of novel viral micro RNA-like genes, each of which in turn modulates expression of at least one host target gene, the function and utility of which at least one host target gene is known in the art.

VGR3063 gene, herein designated VGR GENE, is a novel bioinformatically detected regulatory, non protein coding, RNA viral gene. The method by which VGR3063 gene was detected is described hereinabove with reference to FIGS. 1-9.

VGR3063 gene encodes VGR3063 precursor RNA, herein designated VGR PRECURSOR RNA, an RNA molecule, typically several hundred nucleotides long.

VGR3063 precursor RNA folds spatially, forming VGR3063 folded precursor RNA, herein designated VGR FOLDED PRECURSOR RNA. It is appreciated that VGR3063 folded precursor RNA comprises a plurality of what is known in the art as 'hairpin' structures. These 'hairpin' structures are due to the fact that the nucleotide sequence of VGR3063 precursor RNA comprises a plurality of segments, the first half of each such segment having a nucleotide sequence which is at least a partial inversed-reversed sequence of the second half thereof, as is well known in the art.

VGR3063 folded precursor RNA is naturally processed by cellular enzymatic activity into at least 4 separate VGAM precursor RNAs, VGAM1488 precursor RNA, VGAM1489 precursor RNA, VGAM1490 precursor RNA and VGAM1491 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1488 RNA, VGAM1489 RNA, VGAM1490 RNA and VGAM1491 RNA, herein schematically represented by VGAM1 RNA through VGAM3 RNA, each of which VGAM RNAs corresponding to VGAM RNA of FIG. 1.

VGAM1488 RNA, herein schematically represented by VGAM1 RNA through VGAM3 RNA, binds complementarily to a host target binding site located in an untranslated region of VGAM1488 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM1488 host target RNA into VGAM1488 host target protein, herein schematically represented by VGAM1 HOST TARGET PROTEIN through VGAM3 HOST TARGET PROTEIN, all of FIG. 1.

VGAM1489 RNA, herein schematically represented by VGAM1 RNA through VGAM3 RNA, binds complementarily to a host target binding site located in an untranslated region of VGAM1489 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1489 host target RNA into VGAM1489 host target protein, herein schematically represented by VGAM1 HOST TARGET PROTEIN through VGAM3 HOST TARGET PROTEIN, all of FIG. 1.

VGAM1490 RNA, herein schematically represented by VGAM1 RNA through VGAM3 RNA, binds complementarily to a host target binding site located in an untranslated region of VGAM1490 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1490 host target RNA into VGAM1490 host target protein, herein schematically represented by VGAM1 HOST TARGET PROTEIN through VGAM3 HOST TARGET PROTEIN, all of FIG. 1.

VGAM1491 RNA, herein schematically represented by VGAM1 RNA through VGAM3 RNA, binds complementarily to a host target binding site located in an untranslated region of VGAM1491 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1491 host target RNA into VGAM1491 host target protein, herein schematically represented by VGAM1 HOST TARGET PROTEIN through VGAM3 HOST TARGET PROTEIN, all of FIG. 1.

It is appreciated that a function of VGR3063 gene, herein designated VGR GENE, is inhibition of expression of host target genes, as part of a novel viral mechanism of attacking a host. Accordingly, utilities of VGR3063 gene include diagnosis, prevention and treatment of viral infection by Plum Pox Virus. Specific functions, and accordingly utilities, of VGR3063 gene correlate with, and may be deduced from, the identity of the host target genes, which are inhibited by VGAM RNAs comprised in the 'operon-like' cluster of VGR3063 gene: VGAM1488 host target protein, VGAM1489 host target protein, VGAM1490 host target protein and VGAM1491 host target protein, herein schematically represented by VGAM1 HOST TARGET PROTEIN through VGAM3 HOST TARGET PROTEIN. The function of these host target genes is elaborated hereinabove with reference to VGAM1488, VGAM1489, VGAM1490 and VGAM1491.

FIG. 9 further provides a conceptual description of novel bioinformatically detected regulatory viral gene, referred to here as Viral Genomic Record 3064(VGR3064) viral gene, which encodes an 'operon-like' cluster of novel viral micro RNA-like genes, each of which in turn modulates expression of at least one host target gene, the function and utility of which at least one host target gene is known in the art.

VGR3064 gene, herein designated VGR GENE, is a novel bioinformatically detected regulatory, non protein coding, RNA viral gene. The method by which VGR3064 gene was detected is described hereinabove with reference to FIGS. 1-9.

VGR3064 gene encodes VGR3064 precursor RNA, herein designated VGR PRECURSOR RNA, an RNA molecule, typically several hundred nucleotides long.

VGR3064 precursor RNA folds spatially, forming VGR3064 folded precursor RNA, herein designated VGR FOLDED PRECURSOR RNA. It is appreciated that VGR3064 folded precursor RNA comprises a plurality of what is known in the art as 'hairpin' structures. These 'hairpin' structures are due to the fact that the nucleotide sequence of VGR3064 precursor RNA comprises a plurality of segments, the first half of each such segment having a nucleotide sequence which is at least a partial inversed-reversed sequence of the second half thereof, as is well known in the art.

VGR3064 folded precursor RNA is naturally processed by cellular enzymatic activity into at least 4 separate VGAM precursor RNAs, VGAM1492 precursor RNA, VGAM1493 precursor RNA, VGAM1494 precursor RNA and VGAM1495 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1492 RNA, VGAM1493 RNA, VGAM1494 RNA and VGAM1495 RNA, herein schematically represented by VGAM1 RNA through VGAM3 RNA, each of which VGAM RNAs corresponding to VGAM RNA of FIG. 1.

VGAM1492 RNA, herein schematically represented by VGAM1 RNA through VGAM3 RNA, binds complementarily to a host target binding site located in an untranslated region of VGAM1492 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1492 host target RNA into VGAM1492 host target protein, herein schematically represented by VGAM1 HOST TARGET PROTEIN through VGAM3 HOST TARGET PROTEIN, all of FIG. 1.

VGAM1493 RNA, herein schematically represented by VGAM1 RNA through VGAM3 RNA, binds complementarily to a host target binding site located in an untranslated region of VGAM1493 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1493 host target RNA into VGAM1493 host target protein, herein schematically represented by VGAM1 HOST TARGET PROTEIN through VGAM3 HOST TARGET PROTEIN, all of FIG. 1.

VGAM1494 RNA, herein schematically represented by VGAM1 RNA through VGAM3 RNA, binds complementarily to a host target binding site located in an untranslated region of VGAM1494 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1494 host target RNA into VGAM1494 host target protein, herein schematically represented by VGAM1 HOST TARGET PROTEIN through VGAM3 HOST TARGET PROTEIN, all of FIG. 1.

VGAM1495 RNA, herein schematically represented by VGAM1 RNA through VGAM3 RNA, binds complementarily to a host target binding site located in an untranslated region of VGAM1495 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1495 host target RNA into VGAM1495 host target protein, herein schematically represented by VGAM1 HOST TARGET PROTEIN through VGAM3 HOST TARGET PROTEIN, all of FIG. 1.

It is appreciated that a function of VGR3064 gene, herein designated VGR GENE, is inhibition of expression of host target genes, as part of a novel viral mechanism of attacking a host. Accordingly, utilities of VGR3064 gene include diagnosis, prevention and treatment of viral infection by Johnsongrass Mosaic Virus. Specific functions, and accordingly utilities, of VGR3064 gene correlate with, and may be deduced from, the identity of the host target genes, which are inhibited by VGAM RNAs comprised in the 'operon-like' cluster of VGR3064 gene: VGAM1492 host target protein, VGAM1493 host target protein, VGAM1494 host target protein and VGAM1495 host target protein, herein schematically represented by VGAM1 HOST TARGET PROTEIN through VGAM3 HOST TARGET PROTEIN. The function of these host target genes is elaborated hereinabove with reference to VGAM1492, VGAM1493, VGAM1494 and VGAM1495. FIG. 9 further provides a conceptual description of novel bioinformatically detected regulatory viral gene, referred to here as Viral Genomic Record 3065(VGR3065) viral gene, which encodes an 'operon-like' cluster of novel viral micro RNA-like genes, each of which in turn modulates expression of at least one host target gene, the function and utility of which at least one host target gene is known in the art.

VGR3065 gene, herein designated VGR GENE, is a novel bioinformatically detected regulatory, non protein coding, RNA viral gene. The method by which VGR3065 gene was detected is described hereinabove with reference to FIGS. 1-9.

VGR3065 gene encodes VGR3065 precursor RNA, herein designated VGR PRECURSOR RNA, an RNA molecule, typically several hundred nucleotides long.

VGR3065 precursor RNA folds spatially, forming VGR3065 folded precursor RNA, herein designated VGR FOLDED PRECURSOR RNA. It is appreciated that VGR3065 folded precursor RNA comprises a plurality of what is known in the art as 'hairpin' structures. These 'hairpin' structures are due to the fact that the nucleotide sequence of VGR3065 precursor RNA comprises a plurality of segments, the first half of each such segment having a nucleotide sequence which is at least a partial inversed-reversed sequence of the second half thereof, as is well known in the art.

VGR3065 folded precursor RNA is naturally processed by cellular enzymatic activity into at least 4 separate VGAM precursor RNAs, VGAM1496 precursor RNA, VGAM1497 precursor RNA, VGAM1498 precursor RNA and VGAM1499 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1496 RNA, VGAM1497 RNA, VGAM1498 RNA and VGAM1499 RNA, herein schematically represented by VGAM1 RNA through VGAM3 RNA, each of which VGAM RNAs corresponding to VGAM RNA of FIG. 1.

VGAM1496 RNA, herein schematically represented by VGAM1 RNA through VGAM3 RNA, binds complementarily to a host target binding site located in an untranslated region of VGAM1496 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1496 host target RNA into VGAM1496 host target protein, herein schematically represented by VGAM1 HOST TARGET PROTEIN through VGAM3 HOST TARGET PROTEIN, all of FIG. 1.

VGAM1497 RNA, herein schematically represented by VGAM1 RNA through VGAM3 RNA, binds complementarily to a host target binding site located in an untranslated region of VGAM1497 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1497 host target RNA into VGAM1497 host target protein, herein schematically represented by VGAM1 HOST TARGET PROTEIN through VGAM3 HOST TARGET PROTEIN, all of FIG. 1.

VGAM1498 RNA, herein schematically represented by VGAM1 RNA through VGAM3 RNA, binds complementarily to a host target binding site located in an untranslated region of VGAM1498 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1498 host target RNA into VGAM1498 host target protein, herein schematically represented by VGAM1 HOST TARGET PROTEIN through VGAM3 HOST TARGET PROTEIN, all of FIG. 1.

VGAM1499 RNA, herein schematically represented by VGAM1 RNA through VGAM3 RNA, binds complementarily to a host target binding site located in an untranslated region of VGAM1499 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1499 host target RNA into VGAM1499 host target protein, herein schematically represented by VGAM1 HOST TARGET PROTEIN through VGAM3 HOST TARGET PROTEIN, all of FIG. 1.

It is appreciated that a function of VGR3065 gene, herein designated VGR GENE, is inhibition of expression of host target genes, as part of a novel viral mechanism of attacking a host. Accordingly, utilities of VGR3065 gene include diagnosis, prevention and treatment of viral infection by Alcelaphine Herpesvirus 1. Specific functions, and accordingly utilities, of VGR3065 gene correlate with, and may be deduced from, the identity of the host target genes, which are inhibited by VGAM RNAs comprised in the 'operon-like' cluster of VGR3065 gene: VGAM1496 host target protein, VGAM1497 host target protein, VGAM1498 host target protein and VGAM1499 host target protein, herein schematically represented by VGAM1 HOST TARGET PROTEIN through VGAM3 HOST TARGET PROTEIN. The function of these host target genes is elaborated hereinabove with reference to VGAM1496, VGAM1497, VGAM1498 and VGAM1499.

FIG. 9 further provides a conceptual description of novel bioinformatically detected regulatory viral gene, referred to here as Viral Genomic Record 3066(VGR3066) viral gene, which encodes an 'operon-like' cluster of novel viral micro RNA-like genes, each of which in turn modulates expression of at least one host target gene, the function and utility of which at least one host target gene is known in the art.

VGR3066 gene, herein designated VGR GENE, is a novel bioinformatically detected regulatory, non protein coding, RNA viral gene. The method by which VGR3066 gene was detected is described hereinabove with reference to FIGS. 1-9.

VGR3066 gene encodes VGR3066 precursor RNA, herein designated VGR PRECURSOR RNA, an RNA molecule, typically several hundred nucleotides long.

VGR3066 precursor RNA folds spatially, forming VGR3066 folded precursor RNA, herein designated VGR FOLDED PRECURSOR RNA. It is appreciated that VGR3066 folded precursor RNA comprises a plurality of what is known in the art as 'hairpin' structures. These 'hairpin' structures are due to the fact that the nucleotide sequence of VGR3066 precursor RNA comprises a plurality of segments, the first half of each such segment having a nucleotide sequence which is at least a partial inversed-reversed sequence of the second half thereof, as is well known in the art.

VGR3066 folded precursor RNA is naturally processed by cellular enzymatic activity into at least 8 separate VGAM precursor RNAs, VGAM1500 precursor RNA, VGAM1501 precursor RNA, VGAM1502 precursor RNA, VGAM1503 precursor RNA, VGAM1504 precursor RNA, VGAM1505 precursor RNA, VGAM1506 precursor RNA and VGAM1507 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1500 RNA, VGAM1501 RNA, VGAM1502 RNA, VGAM1503 RNA, VGAM1504 RNA, VGAM1505 RNA, VGAM1506 RNA and VGAM1507 RNA, herein schematically represented by VGAM1 RNA through VGAM3 RNA, each of which VGAM RNAs corresponding to VGAM RNA of FIG. 1.

VGAM1500 RNA, herein schematically represented by VGAM1 RNA through VGAM3 RNA, binds complementarily to a host target binding site located in an untranslated region of VGAM1500 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1500 host target RNA into VGAM1500 host target protein, herein schematically represented by VGAM1 HOST TARGET PROTEIN through VGAM3 HOST TARGET PROTEIN, all of FIG. 1.

VGAM1501 RNA, herein schematically represented by VGAM1 RNA through VGAM3 RNA, binds complementarily to a host target binding site located in an untranslated region of VGAM1501 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1501 host target RNA into VGAM1501 host target protein, herein schematically represented by VGAM1 HOST TARGET PROTEIN through VGAM3 HOST TARGET PROTEIN, all of FIG. 1.

VGAM1502 RNA, herein schematically represented by VGAM1 RNA through VGAM3 RNA, binds complementarily to a host target binding site located in an untranslated region of VGAM1502 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1502 host target RNA into VGAM1502 host target protein, herein schematically represented by VGAM1 HOST TARGET PROTEIN through VGAM3 HOST TARGET PROTEIN, all of FIG. 1.

VGAM1503 RNA, herein schematically represented by VGAM1 RNA through VGAM3 RNA, binds complementarily to a host target binding site located in an untranslated region of VGAM1503 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1503 host target RNA into VGAM1503 host target protein, herein schematically represented by VGAM1 HOST TARGET PROTEIN through VGAM3 HOST TARGET PROTEIN, all of FIG. 1.

VGAM1504 RNA, herein schematically represented by VGAM1 RNA through VGAM3 RNA, binds complementarily to a host target binding site located in an untranslated region of VGAM1504 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1504 host target RNA into VGAM1504 host target protein, herein schematically represented by VGAM1 HOST TARGET PROTEIN through VGAM3 HOST TARGET PROTEIN, all of FIG. 1.

VGAM1505 RNA, herein schematically represented by VGAM1 RNA through VGAM3 RNA, binds complementarily to a host target binding site located in an untranslated region of VGAM1505 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1505 host target RNA into VGAM1505 host target protein, herein schematically represented by VGAM1 HOST TARGET PROTEIN through VGAM3 HOST TARGET PROTEIN, all of FIG. 1.

VGAM1506 RNA, herein schematically represented by VGAM1 RNA through VGAM3 RNA, binds complementarily to a host target binding site located in an untranslated region of VGAM1506 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1506 host target RNA into VGAM1506 host target protein, herein schematically represented by VGAM1 HOST TARGET PROTEIN through VGAM3 HOST TARGET PROTEIN, all of FIG. 1.

VGAM1507 RNA, herein schematically represented by VGAM1 RNA through VGAM3 RNA, binds complementarily to a host target binding site located in an untranslated region of VGAM1507 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1507 host target RNA into VGAM1507 host target protein, herein schematically represented by VGAM1 HOST TARGET PROTEIN through VGAM3 HOST TARGET PROTEIN, all of FIG. 1.

It is appreciated that a function of VGR3066 gene, herein designated VGR GENE, is inhibition of expression of host target genes, as part of a novel viral mechanism of attacking a host. Accordingly, utilities of VGR3066 gene include diagnosis, prevention and treatment of viral infection by Aphid Lethal Paralysis Virus. Specific functions, and accordingly utilities, of VGR3066 gene correlate with, and may be deduced from, the identity of the host target genes, which are inhibited by VGAM RNAs comprised in the 'operon-like' cluster of VGR3066 gene: VGAM1500 host target protein, VGAM1501 host target protein, VGAM1502 host target protein, VGAM1503 host target protein, VGAM1504 host target protein, VGAM1505 host target protein, VGAM1506 host target protein and VGAM1507 host target protein, herein schematically represented by VGAM1 HOST TARGET PROTEIN through VGAM3 HOST TARGET PROTEIN. The function of these host target genes is elaborated hereinabove with reference to VGAM1500, VGAM1501, VGAM1502, VGAM1503, VGAM1504, VGAM1505, VGAM1506 and VGAM1507. FIG. 9 further provides a conceptual description of novel bioinformatically detected regulatory viral gene, referred to here as Viral Genomic Record 3067(VGR3067) viral gene, which encodes an 'operon-like' cluster of novel viral micro RNA-like genes, each of which in turn modulates expression of at least one host target gene, the function and utility of which at least one host target gene is known in the art.

VGR3067 gene, herein designated VGR GENE, is a novel bioinformatically detected regulatory, non protein coding, RNA viral gene. The method by which VGR3067 gene was detected is described hereinabove with reference to FIGS. 1-9.

VGR3067 gene encodes VGR3067 precursor RNA, herein designated VGR PRECURSOR RNA, an RNA molecule, typically several hundred nucleotides long.

VGR3067 precursor RNA folds spatially, forming VGR3067 folded precursor RNA, herein designated VGR FOLDED PRECURSOR RNA. It is appreciated that VGR3067 folded precursor RNA comprises a plurality of what is known in the art as 'hairpin' structures. These 'hairpin' structures are due to the fact that the nucleotide sequence of VGR3067 precursor RNA comprises a plurality of segments, the first half of each such segment having a nucleotide sequence which is at least a partial inversed-reversed sequence of the second half thereof, as is well known in the art.

VGR3067 folded precursor RNA is naturally processed by cellular enzymatic activity into at least 4 separate VGAM precursor RNAs, VGAM1508 precursor RNA, VGAM1509 precursor RNA, VGAM1510 precursor RNA and VGAM1511 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1508 RNA, VGAM1509 RNA, VGAM1510 RNA and VGAM1511 RNA, herein schematically represented by VGAM1 RNA through VGAM3 RNA, each of which VGAM RNAs corresponding to VGAM RNA of FIG. 1.

VGAM1508 RNA, herein schematically represented by VGAM1 RNA through VGAM3 RNA, binds complementarily to a host target binding site located in an untranslated region of VGAM1508 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1508 host target RNA into VGAM1508 host target protein, herein schematically represented by VGAM1 HOST TARGET PROTEIN through VGAM3 HOST TARGET PROTEIN, all of FIG. 1.

VGAM1509 RNA, herein schematically represented by VGAM1 RNA through VGAM3 RNA, binds complementarily to a host target binding site located in an untranslated region of VGAM1509 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1509 host target RNA into VGAM1509 host target protein, herein schematically represented by VGAM1 HOST TARGET PROTEIN through VGAM3 HOST TARGET PROTEIN, all of FIG. 1.

VGAM1510 RNA, herein schematically represented by VGAM1 RNA through VGAM3 RNA, binds complementarily to a host target binding site located in an untranslated region of VGAM1510 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1510 host target RNA into VGAM1510 host target protein, herein schematically represented by VGAM1 HOST TARGET PROTEIN through VGAM3 HOST TARGET PROTEIN, all of FIG. 1.

VGAM1511 RNA, herein schematically represented by VGAM1 RNA through VGAM3 RNA, binds complementarily to a host target binding site located in an untranslated region of VGAM1511 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1511 host target RNA into VGAM1511 host target protein, herein schematically represented by VGAM1 HOST TARGET PROTEIN through VGAM3 HOST TARGET PROTEIN, all of FIG. 1.

It is appreciated that a function of VGR3067 gene, herein designated VGR GENE, is inhibition of expression of host target genes, as part of a novel viral mechanism of attacking a host. Accordingly, utilities of VGR3067 gene include diagnosis, prevention and treatment of viral infection by Potato Virus V. Specific functions, and accordingly utilities, of VGR3067 gene correlate with, and may be deduced from, the identity of the host target genes, which are inhibited by VGAM RNAs comprised in the 'operon-like' cluster of VGR3067 gene: VGAM1508 host target protein, VGAM1509 host target protein, VGAM1510 host target protein and VGAM1511 host target protein, herein schematically represented by VGAM1 HOST TARGET PROTEIN through VGAM3 HOST TARGET PROTEIN. The function of these host target genes is elaborated hereinabove with reference to VGAM1508, VGAM1509, VGAM1510 and VGAM1511. FIG. 9 further provides a conceptual description of novel bioinformatically detected regulatory viral gene, referred to here as Viral Genomic Record 3068(VGR3068) viral gene, which encodes an 'operon-like' cluster of novel viral micro RNA-like genes, each of which in turn modulates expression of at least one host target gene, the function and utility of which at least one host target gene is known in the art.

VGR3068 gene, herein designated VGR GENE, is a novel bioinformatically detected regulatory, non protein coding, RNA viral gene. The method by which VGR3068 gene was detected is described hereinabove with reference to FIGS. 1-9.

VGR3068 gene encodes VGR3068 precursor RNA, herein designated VGR PRECURSOR RNA, an RNA molecule, typically several hundred nucleotides long.

VGR3068 precursor RNA folds spatially, forming VGR3068 folded precursor RNA, herein designated VGR FOLDED PRECURSOR RNA. It is appreciated that VGR3068 folded precursor RNA comprises a plurality of what is known in the art as 'hairpin' structures. These 'hairpin' structures are due to the fact that the nucleotide sequence of VGR3068 precursor RNA comprises a plurality of segments, the first half of each such segment having a nucleotide sequence which is at least a partial inversed-reversed sequence of the second half thereof, as is well known in the art.

VGR3068 folded precursor RNA is naturally processed by cellular enzymatic activity into at least 5 separate VGAM precursor RNAs, VGAM1512 precursor RNA, VGAM1513 precursor RNA, VGAM1514 precursor RNA, VGAM1515 precursor RNA and VGAM1516 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1512 RNA, VGAM1513 RNA, VGAM1514 RNA, VGAM1515 RNA and VGAM1516 RNA, herein schematically represented by VGAM1 RNA through VGAM3 RNA, each of which VGAM RNAs corresponding to VGAM RNA of FIG. 1.

VGAM1512 RNA, herein schematically represented by VGAM1 RNA through VGAM3 RNA, binds complementarily to a host target binding site located in an untranslated region of VGAM1512 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1512 host target RNA into VGAM1512 host target protein, herein schematically represented by VGAM1 HOST TARGET PROTEIN through VGAM3 HOST TARGET PROTEIN, all of FIG. 1.

VGAM1513 RNA, herein schematically represented by VGAM1 RNA through VGAM3 RNA, binds complementarily to a host target binding site located in an untranslated region of VGAM1513 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1513 host target RNA into VGAM1513 host target protein, herein schematically represented by VGAM1 HOST TARGET PROTEIN through VGAM3 HOST TARGET PROTEIN, all of FIG. 1.

VGAM1514 RNA, herein schematically represented by VGAM1 RNA through VGAM3 RNA, binds complementarily to a host target binding site located in an untranslated region of VGAM1514 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1514 host target RNA into VGAM1514 host target protein, herein schematically represented by VGAM1 HOST TARGET PROTEIN through VGAM3 HOST TARGET PROTEIN, all of FIG. 1.

VGAM1515 RNA, herein schematically represented by VGAM1 RNA through VGAM3 RNA, binds complementarily to a host target binding site located in an untranslated region of VGAM1515 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1515 host target RNA into VGAM1515 host target protein, herein schematically represented by VGAM1 HOST TARGET PROTEIN through VGAM3 HOST TARGET PROTEIN, all of FIG. 1.

VGAM1516 RNA, herein schematically represented by VGAM1 RNA through VGAM3 RNA, binds complementarily to a host target binding site located in an untranslated region of VGAM1516 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1516 host target RNA into VGAM1516 host target protein, herein schematically represented by VGAM1 HOST TARGET PROTEIN through VGAM3 HOST TARGET PROTEIN, all of FIG. 1.

It is appreciated that a function of VGR3068 gene, herein designated VGR GENE, is inhibition of expression of host target genes, as part of a novel viral mechanism of attacking a host. Accordingly, utilities of VGR3068 gene include diagnosis, prevention and treatment of viral infection by Parsnip Yellow Fleck Virus. Specific functions, and accordingly utilities, of VGR3068 gene correlate with, and may be deduced from, the identity of the host target genes, which are inhibited by VGAM RNAs comprised in the 'operon-like' cluster of VGR3068 gene: VGAM1512 host target protein, VGAM1513 host target protein, VGAM1514 host target protein, VGAM1515 host target protein and VGAM1516 host target protein, herein schematically represented by VGAM1 HOST TARGET PROTEIN through VGAM3 HOST TARGET PROTEIN. The function of these host target genes is elaborated hereinabove with reference to VGAM1512, VGAM1513, VGAM1514, VGAM1515 and VGAM1516. FIG. 9 further provides a conceptual description of novel bioinformatically detected regulatory viral gene, referred to here as Viral Genomic Record 3069(VGR3069) viral gene, which encodes an 'operon-like' cluster of novel viral micro RNA-like genes, each of which in turn modulates expression of at least one host target gene, the function and utility of which at least one host target gene is known in the art.

VGR3069 gene, herein designated VGR GENE, is a novel bioinformatically detected regulatory, non protein coding, RNA viral gene. The method by which VGR3069 gene was detected is described hereinabove with reference to FIGS. 1-9.

VGR3069 gene encodes VGR3069 precursor RNA, herein designated VGR PRECURSOR RNA, an RNA molecule, typically several hundred nucleotides long.

VGR3069 precursor RNA folds spatially, forming VGR3069 folded precursor RNA, herein designated VGR FOLDED PRECURSOR RNA. It is appreciated that VGR3069 folded precursor RNA comprises a plurality of what is known in the art as 'hairpin' structures. These 'hairpin' structures are due to the fact that the nucleotide sequence of VGR3069 precursor RNA comprises a plurality of segments, the first half of each such segment having a nucleotide sequence which is at least a partial inversed-reversed sequence of the second half thereof, as is well known in the art.

VGR3069 folded precursor RNA is naturally processed by cellular enzymatic activity into at least 3 separate VGAM precursor RNAs, VGAM1517 precursor RNA, VGAM1518 precursor RNA and VGAM1519 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1517 RNA, VGAM1518 RNA and VGAM1519 RNA, herein schematically represented by VGAM1 RNA through VGAM3 RNA, each of which VGAM RNAs corresponding to VGAM RNA of FIG. 1.

VGAM1517 RNA, herein schematically represented by VGAM1 RNA through VGAM3 RNA, binds complementarily to a host target binding site located in an untranslated region of VGAM1517 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1517 host target RNA into VGAM1517 host target protein, herein schematically represented by VGAM1 HOST TARGET PROTEIN through VGAM3 HOST TARGET PROTEIN, all of FIG. 1.

VGAM1518 RNA, herein schematically represented by VGAM1 RNA through VGAM3 RNA, binds complementarily to a host target binding site located in an untranslated region of VGAM1518 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1518 host target RNA into VGAM1518 host target protein, herein schematically represented by VGAM1 HOST TARGET PROTEIN through VGAM3 HOST TARGET PROTEIN, all of FIG. 1.

VGAM1519 RNA, herein schematically represented by VGAM1 RNA through VGAM3 RNA, binds complementarily to a host target binding site located in an untranslated region of VGAM1519 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1519 host target RNA into VGAM1519 host target protein, herein schematically represented by VGAM1 HOST TARGET PROTEIN through VGAM3 HOST TARGET PROTEIN, all of FIG. 1.

It is appreciated that a function of VGR3069 gene, herein designated VGR GENE, is inhibition of expression of host target genes, as part of a novel viral mechanism of attacking a host. Accordingly, utilities of VGR3069 gene include diagnosis, prevention and treatment of viral infection by Pea Seed-borne Mosaic Virus. Specific functions, and accordingly utilities, of VGR3069 gene correlate with, and may be deduced from, the identity of the host target genes, which are inhibited by VGAM RNAs comprised in the 'operon-like' cluster of VGR3069 gene: VGAM1517 host target protein, VGAM1518 host target protein and VGAM1519 host target protein, herein schematically represented by VGAM1 HOST TARGET PROTEIN through VGAM3 HOST TARGET PROTEIN. The function of these host target genes is elaborated hereinabove with reference to VGAM1517, VGAM1518 and VGAM1519. FIG. 9 further provides a conceptual description of novel bioinformatically detected regulatory viral gene, referred to here as Viral Genomic Record 3070(VGR3070) viral gene, which encodes an 'operon-like' cluster of novel viral micro RNA-like genes, each of which in turn modulates expression of at least one host target gene, the function and utility of which at least one host target gene is known in the art.

VGR3070 gene, herein designated VGR GENE, is a novel bioinformatically detected regulatory, non protein coding, RNA viral gene. The method by which VGR3070 gene was detected is described hereinabove with reference to FIGS. 1-9.

VGR3070 gene encodes VGR3070 precursor RNA, herein designated VGR PRECURSOR RNA, an RNA molecule, typically several hundred nucleotides long.

VGR3070 precursor RNA folds spatially, forming VGR3070 folded precursor RNA, herein designated VGR FOLDED PRECURSOR RNA. It is appreciated that VGR3070 folded precursor RNA comprises a plurality of what is known in the art as 'hairpin' structures. These 'hairpin' structures are due to the fact that the nucleotide sequence of VGR3070 precursor RNA comprises a plurality of segments, the first half of each such segment having a nucleotide sequence which is at least a partial inversed-reversed sequence of the second half thereof, as is well known in the art.

VGR3070 folded precursor RNA is naturally processed by cellular enzymatic activity into at least 8 separate VGAM precursor RNAs, VGAM1520 precursor RNA, VGAM1521 precursor RNA, VGAM1522 precursor RNA, VGAM1523 precursor RNA, VGAM1524 precursor RNA, VGAM1525 precursor RNA, VGAM1526 precursor RNA and VGAM1527 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1520 RNA, VGAM1521 RNA, VGAM1522 RNA, VGAM1523 RNA, VGAM1524 RNA, VGAM1525 RNA, VGAM1526 RNA and VGAM1527 RNA, herein schematically represented by VGAM1 RNA through VGAM3 RNA, each of which VGAM RNAs corresponding to VGAM RNA of FIG. 1.

VGAM1520 RNA, herein schematically represented by VGAM1 RNA through VGAM3 RNA, binds complementarily to a host target binding site located in an untranslated region of VGAM1520 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1520 host target RNA into VGAM1520 host target protein, herein schematically represented by VGAM1 HOST TARGET PROTEIN through VGAM3 HOST TARGET PROTEIN, all of FIG. 1.

VGAM1521 RNA, herein schematically represented by VGAM1 RNA through VGAM3 RNA, binds complementarily to a host target binding site located in an untranslated region of VGAM1521 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1521 host target RNA into VGAM1521 host target protein, herein schematically represented by VGAM1 HOST TARGET PROTEIN through VGAM3 HOST TARGET PROTEIN, all of FIG. 1.

VGAM1522 RNA, herein schematically represented by VGAM1 RNA through VGAM3 RNA, binds complementarily to a host target binding site located in an untranslated region of VGAM1522 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1522 host target RNA into VGAM1522 host target protein, herein schematically represented by VGAM1 HOST TARGET PROTEIN through VGAM3 HOST TARGET PROTEIN, all of FIG. 1.

VGAM1523 RNA, herein schematically represented by VGAM1 RNA through VGAM3 RNA, binds complementarily to a host target binding site located in an untranslated region of VGAM1523 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1523 host target RNA into VGAM1523 host target protein, herein schematically represented by VGAM1 HOST TARGET PROTEIN through VGAM3 HOST TARGET PROTEIN, all of FIG. 1.

VGAM1524 RNA, herein schematically represented by VGAM1 RNA through VGAM3 RNA, binds complementarily to a host target binding site located in an untranslated region of VGAM1524 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1524 host target RNA into VGAM1524 host target protein, herein schematically represented by VGAM1 HOST TARGET PROTEIN through VGAM3 HOST TARGET PROTEIN, all of FIG. 1.

VGAM1525 RNA, herein schematically represented by VGAM1 RNA through VGAM3 RNA, binds complementarily to a host target binding site located in an untranslated region of VGAM1525 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1525 host target RNA into VGAM1525 host target protein, herein schematically represented by VGAM1 HOST TARGET PROTEIN through VGAM3 HOST TARGET PROTEIN, all of FIG. 1.

VGAM1526 RNA, herein schematically represented by VGAM1 RNA through VGAM3 RNA, binds complementarily to a host target binding site located in an untranslated region of VGAM1526 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1526 host target RNA into VGAM1526 host target protein, herein schematically represented by VGAM1 HOST TARGET PROTEIN through VGAM3 HOST TARGET PROTEIN, all of FIG. 1.

VGAM1527 RNA, herein schematically represented by VGAM1 RNA through VGAM3 RNA, binds complementarily to a host target binding site located in an untranslated region of VGAM1527 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1527 host target RNA into VGAM1527 host target protein, herein schematically represented by VGAM1 HOST TARGET PROTEIN through VGAM3 HOST TARGET PROTEIN, all of FIG. 1.

It is appreciated that a function of VGR3070 gene, herein designated VGR GENE, is inhibition of expression of host target genes, as part of a novel viral mechanism of attacking a host. Accordingly, utilities of VGR3070 gene include diagnosis, prevention and treatment of viral infection by Ectromelia Virus. Specific functions, and accordingly utilities, of VGR3070 gene correlate with, and may be deduced from, the identity of the host target genes, which are inhibited by VGAM RNAs comprised in the 'operon-like' cluster of VGR3070 gene: VGAM1520 host target protein, VGAM1521 host target protein, VGAM1522 host target protein, VGAM1523 host target protein, VGAM1524 host target protein, VGAM1525 host target protein, VGAM1526 host target protein and VGAM1527 host target protein, herein schematically represented by VGAM1 HOST TARGET PROTEIN through VGAM3 HOST TARGET PROTEIN. The function of these host target genes is elaborated hereinabove with reference to VGAM1520, VGAM1521, VGAM1522, VGAM1523, VGAM1524, VGAM1525, VGAM1526 and VGAM1527. FIG. 9 further provides a conceptual description of novel bioinformatically detected regulatory viral gene, referred to here as Viral Genomic Record 3071 (VGR3071) viral gene, which encodes an 'operon-like' cluster of novel viral micro RNA-like genes, each of which in turn modulates expression of at least one host target gene, the function and utility of which at least one host target gene is known in the art.

VGR3071 gene, herein designated VGR GENE, is a novel bioinformatically detected regulatory, non protein coding, RNA viral gene. The method by which VGR3071 gene was detected is described hereinabove with reference to FIGS. 1-9.

VGR3071 gene encodes VGR3071 precursor RNA, herein designated VGR PRECURSOR RNA, an RNA molecule, typically several hundred nucleotides long.

VGR3071 precursor RNA folds spatially, forming VGR3071 folded precursor RNA, herein designated VGR FOLDED PRECURSOR RNA. It is appreciated that VGR3071 folded precursor RNA comprises a plurality of what is known in the art as 'hairpin' structures. These 'hairpin' structures are due to the fact that the nucleotide sequence of VGR3071 precursor RNA comprises a plurality of segments, the first half of each such segment having a nucleotide sequence which is at least a partial inversed-reversed sequence of the second half thereof, as is well known in the art.

VGR3071 folded precursor RNA is naturally processed by cellular enzymatic activity into at least 4 separate VGAM precursor RNAs, VGAM1528 precursor RNA, VGAM1529 precursor RNA, VGAM1530 precursor RNA and VGAM1531 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1528 RNA, VGAM1529 RNA, VGAM1530 RNA and VGAM1531 RNA, herein schematically represented by VGAM1 RNA through VGAM3 RNA, each of which VGAM RNAs corresponding to VGAM RNA of FIG. 1.

VGAM1528 RNA, herein schematically represented by VGAM1 RNA through VGAM3 RNA, binds complementarily to a host target binding site located in an untranslated region of VGAM1528 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1528 host target RNA into VGAM1528 host target protein, herein schematically represented by VGAM1 HOST TARGET PROTEIN through VGAM3 HOST TARGET PROTEIN, all of FIG. 1.

VGAM1529 RNA, herein schematically represented by VGAM1 RNA through VGAM3 RNA, binds complementarily to a host target binding site located in an untranslated region of VGAM1529 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1529 host target RNA into VGAM1529 host target protein, herein schematically represented by VGAM1 HOST TARGET PROTEIN through VGAM3 HOST TARGET PROTEIN, all of FIG. 1.

VGAM1530 RNA, herein schematically represented by VGAM1 RNA through VGAM3 RNA, binds complementarily to a host target binding site located in an untranslated region of VGAM1530 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1530 host target RNA into VGAM1530 host target protein, herein schematically represented by VGAM1 HOST TARGET PROTEIN through VGAM3 HOST TARGET PROTEIN, all of FIG. 1.

VGAM1531 RNA, herein schematically represented by VGAM1 RNA through VGAM3 RNA, binds complementarily to a host target binding site located in an untranslated region of VGAM1531 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1531 host target RNA into VGAM1531 host target protein, herein schematically represented by VGAM1 HOST TARGET PROTEIN through VGAM3 HOST TARGET PROTEIN, all of FIG. 1.

It is appreciated that a function of VGR3071 gene, herein designated VGR GENE, is inhibition of expression of host target genes, as part of a novel viral mechanism of attacking a host. Accordingly, utilities of VGR3071 gene include diagnosis, prevention and treatment of viral infection by Ectromelia Virus. Specific functions, and accordingly utilities, of VGR3071 gene correlate with, and may be deduced from, the identity of the host target genes, which are inhibited by VGAM RNAs comprised in the 'operon-like' cluster of VGR3071 gene: VGAM1528 host target protein, VGAM1529 host target protein, VGAM1530 host target protein and VGAM1531 host target protein, herein schematically represented by VGAM1 HOST TARGET PROTEIN through VGAM3 HOST TARGET PROTEIN. The function of these host target genes is elaborated hereinabove with reference to VGAM1528, VGAM1529, VGAM1530 and VGAM1531.

FIG. 9 further provides a conceptual description of novel bioinformatically detected regulatory viral gene, referred to here as Viral Genomic Record 3072(VGR3072) viral gene, which encodes an 'operon-like' cluster of novel viral micro RNA-like genes, each of which in turn modulates expression of at least one host target gene, the function and utility of which at least one host target gene is known in the art.

VGR3072 gene, herein designated VGR GENE, is a novel bioinformatically detected regulatory, non protein coding, RNA viral gene. The method by which VGR3072 gene was detected is described hereinabove with reference to FIGS. 1-9.

VGR3072 gene encodes VGR3072 precursor RNA, herein designated VGR PRECURSOR RNA, an RNA molecule, typically several hundred nucleotides long.

VGR3072 precursor RNA folds spatially, forming VGR3072 folded precursor RNA, herein designated VGR FOLDED PRECURSOR RNA. It is appreciated that VGR3072 folded precursor RNA comprises a plurality of what is known in the art as 'hairpin' structures. These 'hairpin' structures are due to the fact that the nucleotide sequence of VGR3072 precursor RNA comprises a plurality of segments, the first half of each such segment having a nucleotide sequence which is at least a partial inversed-reversed sequence of the second half thereof, as is well known in the art.

VGR3072 folded precursor RNA is naturally processed by cellular enzymatic activity into at least 6 separate VGAM precursor RNAs, VGAM1532 precursor RNA, VGAM1533 precursor RNA, VGAM1534 precursor RNA, VGAM1535 precursor RNA, VGAM1536 precursor RNA and VGAM1537 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1532 RNA, VGAM1533 RNA, VGAM1534 RNA, VGAM1535 RNA, VGAM1536 RNA and VGAM1537

RNA, herein schematically represented by VGAM1 RNA through VGAM3 RNA, each of which VGAM RNAs corresponding to VGAM RNA of FIG. 1.

VGAM1532 RNA, herein schematically represented by VGAM1 RNA through VGAM3 RNA, binds complementarily to a host target binding site located in an untranslated region of VGAM1532 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1532 host target RNA into VGAM1532 host target protein, herein schematically represented by VGAM1 HOST TARGET PROTEIN through VGAM3 HOST TARGET PROTEIN, all of FIG. 1.

VGAM1533 RNA, herein schematically represented by VGAM1 RNA through VGAM3 RNA, binds complementarily to a host target binding site located in an untranslated region of VGAM1533 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1533 host target RNA into VGAM1533 host target protein, herein schematically represented by VGAM1 HOST TARGET PROTEIN through VGAM3 HOST TARGET PROTEIN, all of FIG. 1.

VGAM1534 RNA, herein schematically represented by VGAM1 RNA through VGAM3 RNA, binds complementarily to a host target binding site located in an untranslated region of VGAM1534 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1534 host target RNA into VGAM1534 host target protein, herein schematically represented by VGAM1 HOST TARGET PROTEIN through VGAM3 HOST TARGET PROTEIN, all of FIG. 1.

VGAM1535 RNA, herein schematically represented by VGAM1 RNA through VGAM3 RNA, binds complementarily to a host target binding site located in an untranslated region of VGAM1535 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1535 host target RNA into VGAM1535 host target protein, herein schematically represented by VGAM1 HOST TARGET PROTEIN through VGAM3 HOST TARGET PROTEIN, all of FIG. 1.

VGAM1536 RNA, herein schematically represented by VGAM1 RNA through VGAM3 RNA, binds complementarily to a host target binding site located in an untranslated region of VGAM1536 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1536 host target RNA into VGAM1536 host target protein, herein schematically represented by VGAM1 HOST TARGET PROTEIN through VGAM3 HOST TARGET PROTEIN, all of FIG. 1.

VGAM1537 RNA, herein schematically represented by VGAM1 RNA through VGAM3 RNA, binds complementarily to a host target binding site located in an untranslated region of VGAM1537 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1537 host target RNA into VGAM1537 host target protein, herein schematically represented by VGAM1 HOST TARGET PROTEIN through VGAM3 HOST TARGET PROTEIN, all of FIG. 1.

It is appreciated that a function of VGR3072 gene, herein designated VGR GENE, is inhibition of expression of host target genes, as part of a novel viral mechanism of attacking a host. Accordingly, utilities of VGR3072 gene include diagnosis, prevention and treatment of viral infection by Cowpox Virus. Specific functions, and accordingly utilities, of VGR3072 gene correlate with, and may be deduced from, the identity of the host target genes, which are inhibited by VGAM RNAs comprised in the 'operon-like' cluster of VGR3072 gene: VGAM1532 host target protein, VGAM1533 host target protein, VGAM1534 host target protein, VGAM1535 host target protein, VGAM1536 host target protein and VGAM1537 host target protein, herein schematically represented by VGAM1 HOST TARGET PROTEIN through VGAM3 HOST TARGET PROTEIN. The function of these host target genes is elaborated hereinabove with reference to VGAM1532, VGAM1533, VGAM1534, VGAM1535, VGAM1536 and VGAM1537. FIG. 9 further provides a conceptual description of novel bioinformatically detected regulatory viral gene, referred to here as Viral Genomic Record 3073(VGR3073) viral gene, which encodes an 'operon-like' cluster of novel viral micro RNA-like genes, each of which in turn modulates expression of at least one host target gene, the function and utility of which at least one host target gene is known in the art.

VGR3073 gene, herein designated VGR GENE, is a novel bioinformatically detected regulatory, non protein coding, RNA viral gene. The method by which VGR3073 gene was detected is described hereinabove with reference to FIGS. 1-9.

VGR3073 gene encodes VGR3073 precursor RNA, herein designated VGR PRECURSOR RNA, an RNA molecule, typically several hundred nucleotides long.

VGR3073 precursor RNA folds spatially, forming VGR3073 folded precursor RNA, herein designated VGR FOLDED PRECURSOR RNA. It is appreciated that VGR3073 folded precursor RNA comprises a plurality of what is known in the art as 'hairpin' structures. These 'hairpin' structures are due to the fact that the nucleotide sequence of VGR3073 precursor RNA comprises a plurality of segments, the first half of each such segment having a nucleotide sequence which is at least a partial inversed-reversed sequence of the second half thereof, as is well known in the art.

VGR3073 folded precursor RNA is naturally processed by cellular enzymatic activity into at least 4 separate VGAM precursor RNAs, VGAM1538 precursor RNA, VGAM1539 precursor RNA, VGAM1540 precursor RNA and VGAM1541 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1538 RNA, VGAM1539 RNA, VGAM1540 RNA and VGAM1541 RNA, herein schematically represented by VGAM1 RNA through VGAM3 RNA, each of which VGAM RNAs corresponding to VGAM RNA of FIG. 1.

VGAM1538 RNA, herein schematically represented by VGAM1 RNA through VGAM3 RNA, binds complementarily to a host target binding site located in an untranslated region of VGAM1538 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1538 host target RNA into VGAM1538 host target protein, herein schematically represented by VGAM1 HOST TARGET PROTEIN through VGAM3 HOST TARGET PROTEIN, all of FIG. 1.

VGAM1539 RNA, herein schematically represented by VGAM1 RNA through VGAM3 RNA, binds complementarily to a host target binding site located in an untranslated region of VGAM1539 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1539 host target RNA into VGAM1539 host target protein, herein schematically represented by VGAM1 HOST TARGET PROTEIN through VGAM3 HOST TARGET PROTEIN, all of FIG. 1.

VGAM1540 RNA, herein schematically represented by VGAM1 RNA through VGAM3 RNA, binds complementarily to a host target binding site located in an untranslated region of VGAM1540 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1540 host target RNA into VGAM1540 host target protein, herein schematically represented by VGAM1 HOST TARGET PROTEIN through VGAM3 HOST TARGET PROTEIN, all of FIG. 1.

VGAM1541 RNA, herein schematically represented by VGAM1 RNA through VGAM3 RNA, binds complementarily to a host target binding site located in an untranslated region of VGAM1541 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1541 host target RNA into VGAM1541 host target protein, herein schematically represented by VGAM1 HOST TARGET PROTEIN through VGAM3 HOST TARGET PROTEIN, all of FIG. 1.

It is appreciated that a function of VGR3073 gene, herein designated VGR GENE, is inhibition of expression of host target genes, as part of a novel viral mechanism of attacking a host. Accordingly, utilities of VGR3073 gene include diagnosis, prevention and treatment of viral infection by Monkeypox Virus. Specific functions, and accordingly utilities, of VGR3073 gene correlate with, and may be deduced from, the identity of the host target genes, which are inhibited by VGAM RNAs comprised in the 'operon-like' cluster of VGR3073 gene: VGAM1538 host target protein, VGAM1539 host target protein, VGAM1540 host target protein and VGAM1541 host target protein, herein schematically represented by VGAM1 HOST TARGET PROTEIN through VGAM3 HOST TARGET PROTEIN. The function of these host target genes is elaborated hereinabove with reference to VGAM1538, VGAM1539, VGAM1540 and VGAM1541.

FIG. 9 further provides a conceptual description of novel bioinformatically detected regulatory viral gene, referred to here as Viral Genomic Record 3074(VGR3074) viral gene, which encodes an 'operon-like' cluster of novel viral micro RNA-like genes, each of which in turn modulates expression of at least one host target gene, the function and utility of which at least one host target gene is known in the art.

VGR3074 gene, herein designated VGR GENE, is a novel bioinformatically detected regulatory, non protein coding, RNA viral gene. The method by which VGR3074 gene was detected is described hereinabove with reference to FIGS. 1-9.

VGR3074 gene encodes VGR3074 precursor RNA, herein designated VGR PRECURSOR RNA, an RNA molecule, typically several hundred nucleotides long.

VGR3074 precursor RNA folds spatially, forming VGR3074 folded precursor RNA, herein designated VGR FOLDED PRECURSOR RNA. It is appreciated that VGR3074 folded precursor RNA comprises a plurality of what is known in the art as 'hairpin' structures. These 'hairpin' structures are due to the fact that the nucleotide sequence of VGR3074 precursor RNA comprises a plurality of segments, the first half of each such segment having a nucleotide sequence which is at least a partial inversed-reversed sequence of the second half thereof, as is well known in the art.

VGR3074 folded precursor RNA is naturally processed by cellular enzymatic activity into at least 6 separate VGAM precursor RNAs, VGAM1542 precursor RNA, VGAM1543 precursor RNA, VGAM1544 precursor RNA, VGAM1545 precursor RNA, VGAM1546 precursor RNA and VGAM1547 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1542 RNA, VGAM1543 RNA, VGAM1544 RNA, VGAM1545 RNA, VGAM1546 RNA and VGAM1547 RNA, herein schematically represented by VGAM1 RNA through VGAM3 RNA, each of which VGAM RNAs corresponding to VGAM RNA of FIG. 1.

VGAM1542 RNA, herein schematically represented by VGAM1 RNA through VGAM3 RNA, binds complementarily to a host target binding site located in an untranslated region of VGAM1542 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1542 host target RNA into VGAM1542 host target protein, herein schematically represented by VGAM1 HOST TARGET PROTEIN through VGAM3 HOST TARGET PROTEIN, all of FIG. 1.

VGAM1543 RNA, herein schematically represented by VGAM1 RNA through VGAM3 RNA, binds complementarily to a host target binding site located in an untranslated region of VGAM1543 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1543 host target RNA into VGAM1543 host target protein, herein schematically represented by VGAM1 HOST TARGET PROTEIN through VGAM3 HOST TARGET PROTEIN, all of FIG. 1.

VGAM1544 RNA, herein schematically represented by VGAM1 RNA through VGAM3 RNA, binds complementarily to a host target binding site located in an untranslated region of VGAM1544 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1544 host target RNA into VGAM1544 host target protein, herein schematically represented by VGAM1 HOST TARGET PROTEIN through VGAM3 HOST TARGET PROTEIN, all of FIG. 1.

VGAM1545 RNA, herein schematically represented by VGAM1 RNA through VGAM3 RNA, binds complementarily to a host target binding site located in an untranslated region of VGAM1545 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1545 host target RNA into VGAM1545 host target protein, herein schematically represented by VGAM1 HOST TARGET PROTEIN through VGAM3 HOST TARGET PROTEIN, all of FIG. 1.

VGAM1546 RNA, herein schematically represented by VGAM1 RNA through VGAM3 RNA, binds complementarily to a host target binding site located in an untranslated region of VGAM1546 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1546 host target RNA into VGAM1546 host target protein, herein schematically represented by VGAM1 HOST TARGET PROTEIN through VGAM3 HOST TARGET PROTEIN, all of FIG. 1.

VGAM1547 RNA, herein schematically represented by VGAM1 RNA through VGAM3 RNA, binds complementarily to a host target binding site located in an untranslated region of VGAM1547 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1547 host target RNA into VGAM1547 host target protein, herein schematically represented by VGAM1 HOST TARGET PROTEIN through VGAM3 HOST TARGET PROTEIN, all of FIG. 1.

It is appreciated that a function of VGR3074 gene, herein designated VGR GENE, is inhibition of expression of host target genes, as part of a novel viral mechanism of attacking a host. Accordingly, utilities of VGR3074 gene include diagnosis, prevention and treatment of viral infection by Variola Virus. Specific functions, and accordingly utilities, of VGR3074 gene correlate with, and may be deduced from, the identity of the host target genes, which are inhibited by VGAM RNAs comprised in the 'operon-like' cluster of VGR3074 gene: VGAM1542 host target protein, VGAM1543 host target protein, VGAM1544 host target protein, VGAM1545 host target protein, VGAM1546 host target protein and VGAM1547 host target protein, herein schematically represented by VGAM1 HOST TARGET PROTEIN through VGAM3 HOST TARGET PROTEIN. The function of these host target genes is elaborated hereinabove with reference to VGAM1542, VGAM1543, VGAM1544, VGAM1545, VGAM1546 and VGAM1547. FIG. 9 further provides a conceptual description of novel bioinformatically detected regulatory viral gene, referred to here as Viral Genomic Record 3075(VGR3075) viral gene, which encodes an 'operon-like' cluster of novel viral micro RNA-like genes, each of which in turn modulates expression of at least one host target gene, the function and utility of which at least one host target gene is known in the art.

VGR3075 gene, herein designated VGR GENE, is a novel bioinformatically detected regulatory, non protein coding, RNA viral gene. The method by which VGR3075 gene was detected is described hereinabove with reference to FIGS. 1-9.

VGR3075 gene encodes VGR3075 precursor RNA, herein designated VGR PRECURSOR RNA, an RNA molecule, typically several hundred nucleotides long.

VGR3075 precursor RNA folds spatially, forming VGR3075 folded precursor RNA, herein designated VGR FOLDED PRECURSOR RNA. It is appreciated that VGR3075 folded precursor RNA comprises a plurality of what is known in the art as 'hairpin' structures. These 'hairpin' structures are due to the fact that the nucleotide sequence of VGR3075 precursor RNA comprises a plurality of segments, the first half of each such segment having a nucleotide sequence which is at least a partial inversed-reversed sequence of the second half thereof, as is well known in the art.

VGR3075 folded precursor RNA is naturally processed by cellular enzymatic activity into at least 8 separate VGAM precursor RNAs, VGAM1548 precursor RNA, VGAM1549 precursor RNA, VGAM1550 precursor RNA, VGAM1551 precursor RNA, VGAM1552 precursor RNA, VGAM1553 precursor RNA, VGAM1554 precursor RNA and VGAM1555 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1548 RNA, VGAM1549 RNA, VGAM1550 RNA, VGAM1551 RNA, VGAM1552 RNA, VGAM1553 RNA, VGAM1554 RNA and VGAM1555 RNA, herein schematically represented by VGAM1 RNA through VGAM3 RNA, each of which VGAM RNAs corresponding to VGAM RNA of FIG. 1.

VGAM1548 RNA, herein schematically represented by VGAM1 RNA through VGAM3 RNA, binds complementarily to a host target binding site located in an untranslated region of VGAM1548 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1548 host target RNA into VGAM1548 host target protein, herein schematically represented by VGAM1 HOST TARGET PROTEIN through VGAM3 HOST TARGET PROTEIN, all of FIG. 1.

VGAM1549 RNA, herein schematically represented by VGAM1 RNA through VGAM3 RNA, binds complementarily to a host target binding site located in an untranslated region of VGAM1549 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1549 host target RNA into VGAM1549 host target protein, herein schematically represented by VGAM1 HOST TARGET PROTEIN through VGAM3 HOST TARGET PROTEIN, all of FIG. 1.

VGAM1550 RNA, herein schematically represented by VGAM1 RNA through VGAM3 RNA, binds complementarily to a host target binding site located in an untranslated region of VGAM1550 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1550 host target RNA into VGAM1550 host target protein, herein schematically represented by VGAM1 HOST TARGET PROTEIN through VGAM3 HOST TARGET PROTEIN, all of FIG. 1.

VGAM1551 RNA, herein schematically represented by VGAM1 RNA through VGAM3 RNA, binds complementarily to a host target binding site located in an untranslated region of VGAM1551 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1551 host target RNA into VGAM1551 host target protein, herein schematically represented by VGAM1 HOST TARGET PROTEIN through VGAM3 HOST TARGET PROTEIN, all of FIG. 1.

VGAM1552 RNA, herein schematically represented by VGAM1 RNA through VGAM3 RNA, binds complementarily to a host target binding site located in an untranslated region of VGAM1552 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1552 host target RNA into VGAM1552 host target protein, herein schematically represented by VGAM1 HOST TARGET PROTEIN through VGAM3 HOST TARGET PROTEIN, all of FIG. 1.

VGAM1553 RNA, herein schematically represented by VGAM1 RNA through VGAM3 RNA, binds complementarily to a host target binding site located in an untranslated region of VGAM1553 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1553 host target RNA into VGAM1553 host target protein, herein schematically represented by VGAM1 HOST TARGET PROTEIN through VGAM3 HOST TARGET PROTEIN, all of FIG. 1.

VGAM1554 RNA, herein schematically represented by VGAM1 RNA through VGAM3 RNA, binds complementarily to a host target binding site located in an untranslated region of VGAM1554 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1554 host target RNA into VGAM1554 host target protein, herein schematically represented by VGAM1 HOST TARGET PROTEIN through VGAM3 HOST TARGET PROTEIN, all of FIG. 1.

VGAM1555 RNA, herein schematically represented by VGAM1 RNA through VGAM3 RNA, binds complementarily to a host target binding site located in an untranslated region of VGAM1555 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1555 host target RNA into VGAM1555 host target protein, herein schematically represented by VGAM1 HOST TARGET PROTEIN through VGAM3 HOST TARGET PROTEIN, all of FIG. 1.

It is appreciated that a function of VGR3075 gene, herein designated VGR GENE, is inhibition of expression of host target genes, as part of a novel viral mechanism of attacking a host. Accordingly, utilities of VGR3075 gene include diagnosis, prevention and treatment of viral infection by Macaca Mulatta Rhadinovirus. Specific functions, and accordingly utilities, of VGR3075 gene correlate with, and may be deduced from, the identity of the host target genes, which are inhibited by VGAM RNAs comprised in the 'operon-like' cluster of VGR3075 gene: VGAM1548 host target protein, VGAM1549 host target protein, VGAM1550 host target protein, VGAM1551 host target protein, VGAM1552 host target protein, VGAM1553 host target protein, VGAM1554 host target protein and VGAM1555 host target protein, herein schematically represented by VGAM1 HOST TARGET PROTEIN through VGAM3 HOST TARGET PROTEIN. The function of these host target genes is elaborated hereinabove with reference to VGAM1548, VGAM1549, VGAM1550, VGAM1551, VGAM1552, VGAM1553, VGAM1554 and VGAM1555. FIG. 9 further provides a conceptual description of novel bioinformatically detected regulatory viral gene, referred to here as Viral Genomic Record 3076(VGR3076) viral gene, which encodes an 'operon-like' cluster of novel viral micro RNA-like genes, each of which in turn modulates expression of at least one host target gene, the function and utility of which at least one host target gene is known in the art.

VGR3076 gene, herein designated VGR GENE, is a novel bioinformatically detected regulatory, non protein coding, RNA viral gene. The method by which VGR3076 gene was detected is described hereinabove with reference to FIGS. 1-9.

VGR3076 gene encodes VGR3076 precursor RNA, herein designated VGR PRECURSOR RNA, an RNA molecule, typically several hundred nucleotides long.

VGR3076 precursor RNA folds spatially, forming VGR3076 folded precursor RNA, herein designated VGR FOLDED PRECURSOR RNA. It is appreciated that VGR3076 folded precursor RNA comprises a plurality of what is known in the art as 'hairpin' structures. These 'hairpin' structures are due to the fact that the nucleotide sequence of VGR3076 precursor RNA comprises a plurality of segments, the first half of each such segment having a nucleotide sequence which is at least a partial inversed-reversed sequence of the second half thereof, as is well known in the art.

VGR3076 folded precursor RNA is naturally processed by cellular enzymatic activity into at least 2 separate VGAM precursor RNAs, VGAM1556 precursor RNA and VGAM1557 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1556 RNA and VGAM1557 RNA, herein schematically represented by VGAM1 RNA through VGAM3 RNA, each of which VGAM RNAs corresponding to VGAM RNA of FIG. 1.

VGAM1556 RNA, herein schematically represented by VGAM1 RNA through VGAM3 RNA, binds complementarily to a host target binding site located in an untranslated region of VGAM1556 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1556 host target RNA into VGAM1556 host target protein, herein schematically represented by VGAM1 HOST TARGET PROTEIN through VGAM3 HOST TARGET PROTEIN, all of FIG. 1.

VGAM1557 RNA, herein schematically represented by VGAM1 RNA through VGAM3 RNA, binds complementarily to a host target binding site located in an untranslated region of VGAM1557 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1557 host target RNA into VGAM1557 host target protein, herein schematically represented by VGAM1 HOST TARGET PROTEIN through VGAM3 HOST TARGET PROTEIN, all of FIG. 1.

It is appreciated that a function of VGR3076 gene, herein designated VGR GENE, is inhibition of expression of host target genes, as part of a novel viral mechanism of attacking a host. Accordingly, utilities of VGR3076 gene include diagnosis, prevention and treatment of viral infection by Macaca Mulatta Rhadinovirus. Specific functions, and accordingly utilities, of VGR3076 gene correlate with, and may be deduced from, the identity of the host target genes, which are inhibited by VGAM RNAs comprised in the 'operon-like' cluster of VGR3076 gene: VGAM1556 host target protein and VGAM1557 host target protein, herein schematically represented by VGAM1 HOST TARGET PROTEIN through VGAM3 HOST TARGET PROTEIN. The function of these host target genes is elaborated hereinabove with reference to VGAM1556 and VGAM1557. FIG. 9 further provides a conceptual description of novel bioinformatically detected regulatory viral gene, referred to here as Viral Genomic Record 3077(VGR3077) viral gene, which encodes an 'operon-like' cluster of novel viral micro RNA-like genes, each of which in turn modulates expression of at least one host target gene, the function and utility of which at least one host target gene is known in the art.

VGR3077 gene, herein designated VGR GENE, is a novel bioinformatically detected regulatory, non protein coding, RNA viral gene. The method by which VGR3077 gene was detected is described hereinabove with reference to FIGS. 1-9.

VGR3077 gene encodes VGR3077 precursor RNA, herein designated VGR PRECURSOR RNA, an RNA molecule, typically several hundred nucleotides long.

VGR3077 precursor RNA folds spatially, forming VGR3077 folded precursor RNA, herein designated VGR FOLDED PRECURSOR RNA. It is appreciated that VGR3077 folded precursor RNA comprises a plurality of what is known in the art as 'hairpin' structures. These 'hairpin' structures are due to the fact that the nucleotide sequence of VGR3077 precursor RNA comprises a plurality of segments, the first half of each such segment having a nucleotide sequence which is at least a partial inversed-reversed sequence of the second half thereof, as is well known in the art.

VGR3077 folded precursor RNA is naturally processed by cellular enzymatic activity into at least 6 separate VGAM precursor RNAs, VGAM1558 precursor RNA, VGAM1559 precursor RNA, VGAM1560 precursor RNA, VGAM1561 precursor RNA, VGAM1562 precursor RNA and VGAM1563 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1558 RNA, VGAM1559 RNA, VGAM1560 RNA, VGAM1561 RNA, VGAM1562 RNA and VGAM1563 RNA, herein schematically represented by VGAM1 RNA through VGAM3 RNA, each of which VGAM RNAs corresponding to VGAM RNA of FIG. 1.

VGAM1558 RNA, herein schematically represented by VGAM1 RNA through VGAM3 RNA, binds complementarily to a host target binding site located in an untranslated region of VGAM1558 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1558 host target RNA into VGAM1558 host target protein, herein schematically represented by VGAM1 HOST TARGET PROTEIN through VGAM3 HOST TARGET PROTEIN, all of FIG. 1.

VGAM1559 RNA, herein schematically represented by VGAM1 RNA through VGAM3 RNA, binds complementarily to a host target binding site located in an untranslated region of VGAM1559 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1559 host target RNA into VGAM1559 host target protein, herein schematically represented by VGAM1 HOST TARGET PROTEIN through VGAM3 HOST TARGET PROTEIN, all of FIG. 1.

VGAM1560 RNA, herein schematically represented by VGAM1 RNA through VGAM3 RNA, binds complementarily to a host target binding site located in an untranslated region of VGAM1560 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1560 host target RNA into VGAM1560 host target protein, herein schematically represented by VGAM1 HOST TARGET PROTEIN through VGAM3 HOST TARGET PROTEIN, all of FIG. 1.

VGAM1561 RNA, herein schematically represented by VGAM1 RNA through VGAM3 RNA, binds complementarily to a host target binding site located in an untranslated region of VGAM1561 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1561 host target RNA into VGAM1561 host target protein, herein schematically represented by VGAM1 HOST TARGET PROTEIN through VGAM3 HOST TARGET PROTEIN, all of FIG. 1.

VGAM1562 RNA, herein schematically represented by VGAM1 RNA through VGAM3 RNA, binds complementarily to a host target binding site located in an untranslated region of VGAM1562 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1562 host target RNA into VGAM1562 host target protein, herein schematically represented by VGAM1 HOST TARGET PROTEIN through VGAM3 HOST TARGET PROTEIN, all of FIG. 1.

VGAM1563 RNA, herein schematically represented by VGAM1 RNA through VGAM3 RNA, binds complementarily to a host target binding site located in an untranslated region of VGAM1563 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1563 host target RNA into VGAM1563 host target protein, herein schematically represented by VGAM1 HOST TARGET PROTEIN through VGAM3 HOST TARGET PROTEIN, all of FIG. 1.

It is appreciated that a function of VGR3077 gene, herein designated VGR GENE, is inhibition of expression of host target genes, as part of a novel viral mechanism of attacking a host. Accordingly, utilities of VGR3077 gene include diagnosis, prevention and treatment of viral infection by Bean Common Mosaic Virus. Specific functions, and accordingly utilities, of VGR3077 gene correlate with, and may be deduced from, the identity of the host target genes, which are inhibited by VGAM RNAs comprised in the 'operon-like' cluster of VGR3077 gene: VGAM1558 host target protein, VGAM1559 host target protein, VGAM1560 host target protein, VGAM1561 host target protein, VGAM1562 host target protein and VGAM1563 host target protein, herein schematically represented by VGAM1 HOST TARGET PROTEIN through VGAM3 HOST TARGET PROTEIN. The function of these host target genes is elaborated hereinabove with reference to VGAM1558, VGAM1559, VGAM1560, VGAM1561, VGAM1562 and VGAM1563. FIG. 9 further provides a conceptual description of novel bioinformatically detected regulatory viral gene, referred to here as Viral Genomic Record 3078(VGR3078) viral gene, which encodes an 'operon-like' cluster of novel viral micro RNA-like genes, each of which in turn modulates expression of at least one host target gene, the function and utility of which at least one host target gene is known in the art.

VGR3078 gene, herein designated VGR GENE, is a novel bioinformatically detected regulatory, non protein coding, RNA viral gene. The method by which VGR3078 gene was detected is described hereinabove with reference to FIGS. 1-9.

VGR3078 gene encodes VGR3078 precursor RNA, herein designated VGR PRECURSOR RNA, an RNA molecule, typically several hundred nucleotides long.

VGR3078 precursor RNA folds spatially, forming VGR3078 folded precursor RNA, herein designated VGR FOLDED PRECURSOR RNA. It is appreciated that VGR3078 folded precursor RNA comprises a plurality of what is known in the art as 'hairpin' structures. These 'hairpin' structures are due to the fact that the nucleotide sequence of VGR3078 precursor RNA comprises a plurality of segments, the first half of each such segment having a nucleotide sequence which is at least a partial inversed-reversed sequence of the second half thereof, as is well known in the art.

VGR3078 folded precursor RNA is naturally processed by cellular enzymatic activity into at least 3 separate VGAM precursor RNAs, VGAM1564 precursor RNA, VGAM1565 precursor RNA and VGAM1566 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1564 RNA, VGAM1565 RNA and VGAM1566 RNA, herein schematically represented by VGAM1 RNA through VGAM3 RNA, each of which VGAM RNAs corresponding to VGAM RNA of FIG. 1.

VGAM1564 RNA, herein schematically represented by VGAM1 RNA through VGAM3 RNA, binds complementarily to a host target binding site located in an untranslated region of VGAM1564 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1564 host target RNA into VGAM1564 host target protein, herein schematically represented by VGAM1 HOST TARGET PROTEIN through VGAM3 HOST TARGET PROTEIN, all of FIG. 1.

VGAM1565 RNA, herein schematically represented by VGAM1 RNA through VGAM3 RNA, binds complementarily to a host target binding site located in an untranslated region of VGAM1565 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1565 host target RNA into VGAM1565 host target protein, herein schematically represented by VGAM1 HOST TARGET PROTEIN through VGAM3 HOST TARGET PROTEIN, all of FIG. 1.

VGAM1566 RNA, herein schematically represented by VGAM1 RNA through VGAM3 RNA, binds complementarily to a host target binding site located in an untranslated region of VGAM1566 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1566 host target RNA into VGAM1566 host target protein, herein schematically represented by VGAM1 HOST TARGET PROTEIN through VGAM3 HOST TARGET PROTEIN, all of FIG. 1.

It is appreciated that a function of VGR3078 gene, herein designated VGR GENE, is inhibition of expression of host target genes, as part of a novel viral mechanism of attacking a host. Accordingly, utilities of VGR3078 gene include diagnosis, prevention and treatment of viral infection by Human Herpesvirus 5. Specific functions, and accordingly utilities, of VGR3078 gene correlate with, and may be deduced from, the identity of the host target genes, which are inhibited by VGAM RNAs comprised in the 'operon-like' cluster of VGR3078 gene: VGAM1564 host target protein, VGAM1565 host target protein and VGAM1566 host target protein, herein schematically represented by VGAM1 HOST TARGET PROTEIN through VGAM3 HOST TARGET PROTEIN. The function of these host target genes is elaborated hereinabove with reference to VGAM1564, VGAM1565 and VGAM1566. FIG. 9 further provides a conceptual description of novel bioinformatically detected regulatory viral gene, referred to here as Viral Genomic Record 3079(VGR3079) viral gene, which encodes an 'operon-like' cluster of novel viral micro RNA-like genes, each of which in turn modulates expression of at least one host target gene, the function and utility of which at least one host target gene is known in the art.

VGR3079 gene, herein designated VGR GENE, is a novel bioinformatically detected regulatory, non protein coding, RNA viral gene. The method by which VGR3079 gene was detected is described hereinabove with reference to FIGS. 1-9.

VGR3079 gene encodes VGR3079 precursor RNA, herein designated VGR PRECURSOR RNA, an RNA molecule, typically several hundred nucleotides long.

VGR3079 precursor RNA folds spatially, forming VGR3079 folded precursor RNA, herein designated VGR FOLDED PRECURSOR RNA. It is appreciated that VGR3079 folded precursor RNA comprises a plurality of what is known in the art as 'hairpin' structures. These 'hairpin' structures are due to the fact that the nucleotide sequence of VGR3079 precursor RNA comprises a plurality of segments, the first half of each such segment having a nucleotide sequence which is at least a partial inversed-reversed sequence of the second half thereof, as is well known in the art.

VGR3079 folded precursor RNA is naturally processed by cellular enzymatic activity into at least 4 separate VGAM precursor RNAs, VGAM1567 precursor RNA, VGAM1568 precursor RNA, VGAM1569 precursor RNA and VGAM1570 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1567 RNA, VGAM1568 RNA, VGAM1569 RNA and VGAM1570 RNA, herein schematically represented by VGAM1 RNA through VGAM3 RNA, each of which VGAM RNAs corresponding to VGAM RNA of FIG. 1.

VGAM1567 RNA, herein schematically represented by VGAM1 RNA through VGAM3 RNA, binds complementarily to a host target binding site located in an untranslated region of VGAM1567 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1567 host target RNA into VGAM1567 host target protein, herein schematically represented by VGAM1 HOST TARGET PROTEIN through VGAM3 HOST TARGET PROTEIN, all of FIG. 1.

VGAM1568 RNA, herein schematically represented by VGAM1 RNA through VGAM3 RNA, binds complementarily to a host target binding site located in an untranslated region of VGAM1568 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1568 host target RNA into VGAM1568 host target protein, herein schematically represented by VGAM1 HOST TARGET PROTEIN through VGAM3 HOST TARGET PROTEIN, all of FIG. 1.

VGAM1569 RNA, herein schematically represented by VGAM1 RNA through VGAM3 RNA, binds complementarily to a host target binding site located in an untranslated region of VGAM1569 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1569 host target RNA into VGAM1569 host target protein, herein schematically represented by VGAM1 HOST TARGET PROTEIN through VGAM3 HOST TARGET PROTEIN, all of FIG. 1.

VGAM1570 RNA, herein schematically represented by VGAM1 RNA through VGAM3 RNA, binds complementarily to a host target binding site located in an untranslated region of VGAM1570 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1570 host target RNA into VGAM1570 host target protein, herein schematically represented by VGAM1 HOST TARGET PROTEIN through VGAM3 HOST TARGET PROTEIN, all of FIG. 1.

It is appreciated that a function of VGR3079 gene, herein designated VGR GENE, is inhibition of expression of host target genes, as part of a novel viral mechanism of attacking a host. Accordingly, utilities of VGR3079 gene include diagnosis, prevention and treatment of viral infection by Human Herpesvirus 5. Specific functions, and accordingly utilities, of VGR3079 gene correlate with, and may be deduced from, the identity of the host target genes, which are inhibited by VGAM RNAs comprised in the 'operon-like' cluster of VGR3079 gene: VGAM1567 host target protein, VGAM1568 host target protein, VGAM1569 host target protein and VGAM1570 host target protein, herein schematically represented by VGAM1 HOST TARGET PROTEIN through VGAM3 HOST TARGET PROTEIN. The function of these host target genes is elaborated hereinabove with reference to VGAM1567, VGAM1568, VGAM1569 and VGAM1570. FIG. 9 further provides a conceptual description of novel bioinformatically detected regulatory viral gene, referred to here as Viral Genomic Record 3080(VGR3080) viral gene, which encodes an 'operon-like' cluster of novel viral micro RNA-like genes, each of which in turn modulates expression of at least one host target gene, the function and utility of which at least one host target gene is known in the art.

VGR3080 gene, herein designated VGR GENE, is a novel bioinformatically detected regulatory, non protein coding, RNA viral gene. The method by which VGR3080 gene was detected is described hereinabove with reference to FIGS. 1-9.

VGR3080 gene encodes VGR3080 precursor RNA, herein designated VGR PRECURSOR RNA, an RNA molecule, typically several hundred nucleotides long.

VGR3080 precursor RNA folds spatially, forming VGR3080 folded precursor RNA, herein designated VGR FOLDED PRECURSOR RNA. It is appreciated that VGR3080 folded precursor RNA comprises a plurality of what is known in the art as 'hairpin' structures. These 'hairpin' structures are due to the fact that the nucleotide sequence of VGR3080 precursor RNA comprises a plurality of segments, the first half of each such segment having a nucleotide sequence which is at least a partial inversed-reversed sequence of the second half thereof, as is well known in the art.

VGR3080 folded precursor RNA is naturally processed by cellular enzymatic activity into at least 8 separate VGAM precursor RNAs, VGAM1571 precursor RNA, VGAM1572 precursor RNA, VGAM1573 precursor RNA, VGAM1574 precursor RNA, VGAM1575 precursor RNA, VGAM1576 precursor RNA, VGAM1577 precursor RNA and VGAM1578 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1571 RNA, VGAM1572 RNA, VGAM1573 RNA, VGAM1574 RNA, VGAM1575 RNA, VGAM1576 RNA, VGAM1577 RNA and VGAM1578 RNA, herein schematically represented by VGAM1 RNA through VGAM3 RNA, each of which VGAM RNAs corresponding to VGAM RNA of FIG. 1.

VGAM1571 RNA, herein schematically represented by VGAM1 RNA through VGAM3 RNA, binds complementarily to a host target binding site located in an untranslated region of VGAM1571 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1571 host target RNA into VGAM1571 host target protein, herein schematically represented by VGAM1 HOST TARGET PROTEIN through VGAM3 HOST TARGET PROTEIN, all of FIG. 1.

VGAM1572 RNA, herein schematically represented by VGAM1 RNA through VGAM3 RNA, binds complementarily to a host target binding site located in an untranslated region of VGAM1572 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1572 host target RNA into VGAM1572 host target protein, herein schematically represented by VGAM1 HOST TARGET PROTEIN through VGAM3 HOST TARGET PROTEIN, all of FIG. 1.

VGAM1573 RNA, herein schematically represented by VGAM1 RNA through VGAM3 RNA, binds complementarily to a host target binding site located in an untranslated region of VGAM1573 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1573 host target RNA into VGAM1573 host target protein, herein schematically represented by VGAM1 HOST TARGET PROTEIN through VGAM3 HOST TARGET PROTEIN, all of FIG. 1.

VGAM1574 RNA, herein schematically represented by VGAM1 RNA through VGAM3 RNA, binds complementarily to a host target binding site located in an untranslated region of VGAM1574 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1574 host target RNA into VGAM1574 host target protein, herein schematically represented by VGAM1 HOST TARGET PROTEIN through VGAM3 HOST TARGET PROTEIN, all of FIG. 1.

VGAM1575 RNA, herein schematically represented by VGAM1 RNA through VGAM3 RNA, binds complementarily to a host target binding site located in an untranslated region of VGAM1575 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1575 host target RNA into VGAM1575 host target protein, herein schematically represented by VGAM1 HOST TARGET PROTEIN through VGAM3 HOST TARGET PROTEIN, all of FIG. 1.

VGAM1576 RNA, herein schematically represented by VGAM1 RNA through VGAM3 RNA, binds complementarily to a host target binding site located in an untranslated region of VGAM1576 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1576 host target RNA into VGAM1576 host target protein, herein schematically represented by VGAM1 HOST TARGET PROTEIN through VGAM3 HOST TARGET PROTEIN, all of FIG. 1.

VGAM1577 RNA, herein schematically represented by VGAM1 RNA through VGAM3 RNA, binds complementarily to a host target binding site located in an untranslated region of VGAM1577 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1577 host target RNA into VGAM1577 host target protein, herein schematically represented by VGAM1 HOST TARGET PROTEIN through VGAM3 HOST TARGET PROTEIN, all of FIG. 1.

VGAM1578 RNA, herein schematically represented by VGAM1 RNA through VGAM3 RNA, binds complementarily to a host target binding site located in an untranslated region of VGAM1578 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1578 host target RNA into VGAM1578 host target protein, herein schematically represented by VGAM1 HOST TARGET PROTEIN through VGAM3 HOST TARGET PROTEIN, all of FIG. 1.

It is appreciated that a function of VGR3080 gene, herein designated VGR GENE, is inhibition of expression of host target genes, as part of a novel viral mechanism of attacking a host. Accordingly, utilities of VGR3080 gene include diagnosis, prevention and treatment of viral infection by Rhopalosiphum Padi Virus. Specific functions, and accordingly utilities, of VGR3080 gene correlate with, and may be deduced from, the identity of the host target genes, which are inhibited by VGAM RNAs comprised in the 'operon-like' cluster of VGR3080 gene: VGAM1571 host target protein, VGAM1572 host target protein, VGAM1573 host target protein, VGAM1574 host target protein, VGAM1575 host target protein, VGAM1576 host target protein, VGAM1577 host target protein and VGAM1578 host target protein, herein schematically represented by VGAM1 HOST TARGET PROTEIN through VGAM3 HOST TARGET PROTEIN. The function of these host target genes is elaborated hereinabove with reference to VGAM1571, VGAM1572, VGAM1573, VGAM1574, VGAM1575, VGAM1576, VGAM1577 and VGAM1578. FIG. 9 further provides a conceptual description of novel bioinformatically detected regulatory viral gene, referred to here as Viral Genomic Record 3081(VGR3081) viral gene, which encodes an 'operon-like' cluster of novel viral micro RNA-like genes, each of which in turn modulates expression of at least one host target gene, the function and utility of which at least one host target gene is known in the art.

VGR3081 gene, herein designated VGR GENE, is a novel bioinformatically detected regulatory, non protein coding, RNA viral gene. The method by which VGR3081 gene was detected is described hereinabove with reference to FIGS. 1-9.

VGR3081 gene encodes VGR3081 precursor RNA, herein designated VGR PRECURSOR RNA, an RNA molecule, typically several hundred nucleotides long.

VGR3081 precursor RNA folds spatially, forming VGR3081 folded precursor RNA, herein designated VGR FOLDED PRECURSOR RNA. It is appreciated that VGR3081 folded precursor RNA comprises a plurality of what is known in the art as 'hairpin' structures. These 'hairpin' structures are due to the fact that the nucleotide sequence of VGR3081 precursor RNA comprises a plurality of segments, the first half of each such segment having a nucleotide sequence which is at least a partial inversed-reversed sequence of the second half thereof, as is well known in the art.

VGR3081 folded precursor RNA is naturally processed by cellular enzymatic activity into at least 2 separate VGAM precursor RNAs, VGAM1579 precursor RNA and VGAM1580 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1579 RNA and VGAM1580 RNA, herein schematically represented by VGAM1 RNA through VGAM3 RNA, each of which VGAM RNAs corresponding to VGAM RNA of FIG. 1.

VGAM1579 RNA, herein schematically represented by VGAM1 RNA through VGAM3 RNA, binds complementarily to a host target binding site located in an untranslated region of VGAM1579 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1579 host target RNA into VGAM1579 host target protein, herein schematically represented by VGAM1 HOST TARGET PROTEIN through VGAM3 HOST TARGET PROTEIN, all of FIG. 1.

VGAM1580 RNA, herein schematically represented by VGAM1 RNA through VGAM3 RNA, binds complementarily to a host target binding site located in an untranslated region of VGAM1580 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1580 host target RNA into VGAM1580 host target protein, herein schematically represented by VGAM1 HOST TARGET PROTEIN through VGAM3 HOST TARGET PROTEIN, all of FIG. 1.

It is appreciated that a function of VGR3081 gene, herein designated VGR GENE, is inhibition of expression of host target genes, as part of a novel viral mechanism of attacking a host. Accordingly, utilities of VGR3081 gene include diagnosis, prevention and treatment of viral infection by Rhopalosiphum Padi Virus. Specific functions, and accordingly utilities, of VGR3081 gene correlate with, and may be deduced from, the identity of the host target genes, which are inhibited by VGAM RNAs comprised in the 'operon-like' cluster of VGR3081 gene: VGAM1579 host target protein and VGAM1580 host target protein, herein schematically represented by VGAM1 HOST TARGET PROTEIN through VGAM3 HOST TARGET PROTEIN. The function of these host target genes is elaborated hereinabove with reference to VGAM1579 and VGAM1580. FIG. 9 further provides a conceptual description of novel bioinformatically detected regulatory viral gene, referred to here as Viral Genomic Record 3082(VGR3082) viral gene, which encodes an 'operon-like' cluster of novel viral micro RNA-like genes, each of which in turn modulates expression of at least one host target gene, the function and utility of which at least one host target gene is known in the art.

VGR3082 gene, herein designated VGR GENE, is a novel bioinformatically detected regulatory, non protein coding, RNA viral gene. The method by which VGR3082 gene was detected is described hereinabove with reference to FIGS. 1-9.

VGR3082 gene encodes VGR3082 precursor RNA, herein designated VGR PRECURSOR RNA, an RNA molecule, typically several hundred nucleotides long.

VGR3082 precursor RNA folds spatially, forming VGR3082 folded precursor RNA, herein designated VGR FOLDED PRECURSOR RNA. It is appreciated that VGR3082 folded precursor RNA comprises a plurality of what is known in the art as 'hairpin' structures. These 'hairpin' structures are due to the fact that the nucleotide sequence of VGR3082 precursor RNA comprises a plurality of segments, the first half of each such segment having a nucleotide sequence which is at least a partial inversed-reversed sequence of the second half thereof, as is well known in the art.

VGR3082 folded precursor RNA is naturally processed by cellular enzymatic activity into at least 8 separate VGAM precursor RNAs, VGAM1581 precursor RNA, VGAM1582 precursor RNA, VGAM1583 precursor RNA, VGAM1584 precursor RNA, VGAM1585 precursor RNA, VGAM1586 precursor RNA, VGAM1587 precursor RNA and VGAM1588 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1581 RNA, VGAM1582 RNA, VGAM1583 RNA, VGAM1584 RNA, VGAM1585 RNA, VGAM1586 RNA, VGAM1587 RNA and VGAM1588 RNA, herein schematically represented by VGAM1 RNA through VGAM3 RNA, each of which VGAM RNAs corresponding to VGAM RNA of FIG. 1.

VGAM1581 RNA, herein schematically represented by VGAM1 RNA through VGAM3 RNA, binds complementarily to a host target binding site located in an untranslated region of VGAM1581 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1581 host target RNA into VGAM1581 host target protein, herein schematically represented by VGAM1 HOST TARGET PROTEIN through VGAM3 HOST TARGET PROTEIN, all of FIG. 1.

VGAM1582 RNA, herein schematically represented by VGAM1 RNA through VGAM3 RNA, binds complementarily to a host target binding site located in an untranslated region of VGAM1582 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1582 host target RNA into VGAM1582 host target protein, herein schematically represented by VGAM1 HOST TARGET PROTEIN through VGAM3 HOST TARGET PROTEIN, all of FIG. 1.

VGAM1583 RNA, herein schematically represented by VGAM1 RNA through VGAM3 RNA, binds complementarily to a host target binding site located in an untranslated region of VGAM1583 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1583 host target RNA into VGAM1583 host target protein, herein schematically represented by VGAM1 HOST TARGET PROTEIN through VGAM3 HOST TARGET PROTEIN, all of FIG. 1.

VGAM1584 RNA, herein schematically represented by VGAM1 RNA through VGAM3 RNA, binds complementarily to a host target binding site located in an untranslated region of VGAM1584 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1584 host target RNA into VGAM1584 host target protein, herein schematically represented by VGAM1 HOST TARGET PROTEIN through VGAM3 HOST TARGET PROTEIN, all of FIG. 1.

VGAM1585 RNA, herein schematically represented by VGAM1 RNA through VGAM3 RNA, binds complementarily to a host target binding site located in an untranslated region of VGAM1585 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1585 host target RNA into VGAM1585 host target protein, herein schematically represented by VGAM1 HOST TARGET PROTEIN through VGAM3 HOST TARGET PROTEIN, all of FIG. 1.

VGAM1586 RNA, herein schematically represented by VGAM1 RNA through VGAM3 RNA, binds complementarily to a host target binding site located in an untranslated region of VGAM1586 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1586 host target RNA into VGAM1586 host target protein, herein schematically represented by VGAM1 HOST TARGET PROTEIN through VGAM3 HOST TARGET PROTEIN, all of FIG. 1.

VGAM1587 RNA, herein schematically represented by VGAM1 RNA through VGAM3 RNA, binds complementarily to a host target binding site located in an untranslated region of VGAM1587 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1587 host target RNA into VGAM1587 host target protein, herein schematically represented by VGAM1 HOST TARGET PROTEIN through VGAM3 HOST TARGET PROTEIN, all of FIG. 1.

VGAM1588 RNA, herein schematically represented by VGAM1 RNA through VGAM3 RNA, binds complementarily to a host target binding site located in an untranslated region of VGAM1588 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1588 host target RNA into VGAM1588 host target protein, herein schematically represented by VGAM1 HOST TARGET PROTEIN through VGAM3 HOST TARGET PROTEIN, all of FIG. 1.

It is appreciated that a function of VGR3082 gene, herein designated VGR GENE, is inhibition of expression of host target genes, as part of a novel viral mechanism of attacking a host. Accordingly, utilities of VGR3082 gene include diagnosis, prevention and treatment of viral infection by Saimiriine Herpesvirus 2. Specific functions, and accordingly utilities, of VGR3082 gene correlate with, and may be deduced from, the identity of the host target genes, which are inhibited by VGAM RNAs comprised in the 'operon-like' cluster of VGR3082 gene: VGAM1581 host target protein, VGAM1582 host target protein, VGAM1583 host target protein, VGAM1584 host target protein, VGAM1585 host target protein, VGAM1586 host target protein, VGAM1587 host target protein and VGAM1588 host target protein, herein schematically represented by VGAM1 HOST TARGET PROTEIN through VGAM3 HOST TARGET PROTEIN. The function of these host target genes is elaborated hereinabove with reference to VGAM1581, VGAM1582, VGAM1583, VGAM1584, VGAM1585, VGAM1586, VGAM1587 and VGAM1588. FIG. 9 further provides a conceptual description of novel bioinformatically detected regulatory viral gene, referred to here as Viral Genomic Record 3083(VGR3083) viral gene, which encodes an 'operon-like' cluster of novel viral micro RNA-like genes, each of which in turn modulates expression of at least one host target gene, the function and utility of which at least one host target gene is known in the art.

VGR3083 gene, herein designated VGR GENE, is a novel bioinformatically detected regulatory, non protein coding, RNA viral gene. The method by which VGR3083 gene was detected is described hereinabove with reference to FIGS. 1-9.

VGR3083 gene encodes VGR3083 precursor RNA, herein designated VGR PRECURSOR RNA, an RNA molecule, typically several hundred nucleotides long.

VGR3083 precursor RNA folds spatially, forming VGR3083 folded precursor RNA, herein designated VGR FOLDED PRECURSOR RNA. It is appreciated that VGR3083 folded precursor RNA comprises a plurality of what is known in the art as 'hairpin' structures. These 'hairpin' structures are due to the fact that the nucleotide sequence of VGR3083 precursor RNA comprises a plurality of segments, the first half of each such segment having a nucleotide sequence which is at least a partial inversed-reversed sequence of the second half thereof, as is well known in the art.

VGR3083 folded precursor RNA is naturally processed by cellular enzymatic activity into at least 5 separate VGAM precursor RNAs, VGAM1589 precursor RNA, VGAM1590 precursor RNA, VGAM1591 precursor RNA, VGAM1592 precursor RNA and VGAM1593 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1589 RNA, VGAM1590 RNA, VGAM1591 RNA, VGAM1592 RNA and VGAM1593 RNA, herein schematically represented by VGAM1 RNA through VGAM3 RNA, each of which VGAM RNAs corresponding to VGAM RNA of FIG. 1.

VGAM1589 RNA, herein schematically represented by VGAM1 RNA through VGAM3 RNA, binds complementarily to a host target binding site located in an untranslated region of VGAM1589 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1589 host target RNA into VGAM1589 host target protein, herein schematically represented by VGAM1 HOST TARGET PROTEIN through VGAM3 HOST TARGET PROTEIN, all of FIG. 1.

VGAM1590 RNA, herein schematically represented by VGAM1 RNA through VGAM3 RNA, binds complementarily to a host target binding site located in an untranslated region of VGAM1590 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1590 host target RNA into VGAM1590 host target protein, herein schematically represented by VGAM1 HOST TARGET PROTEIN through VGAM3 HOST TARGET PROTEIN, all of FIG. 1.

VGAM1591 RNA, herein schematically represented by VGAM1 RNA through VGAM3 RNA, binds complementarily to a host target binding site located in an untranslated region of VGAM1591 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1591 host target RNA into VGAM1591 host target protein, herein schematically represented by VGAM1 HOST TARGET PROTEIN through VGAM3 HOST TARGET PROTEIN, all of FIG. 1.

VGAM1592 RNA, herein schematically represented by VGAM1 RNA through VGAM3 RNA, binds complementarily to a host target binding site located in an untranslated region of VGAM1592 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1592 host target RNA into VGAM1592 host target protein, herein schematically represented by VGAM1 HOST TARGET PROTEIN through VGAM3 HOST TARGET PROTEIN, all of FIG. 1.

VGAM1593 RNA, herein schematically represented by VGAM1 RNA through VGAM3 RNA, binds complementarily to a host target binding site located in an untranslated region of VGAM1593 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1593 host target RNA into VGAM1593 host target protein, herein schematically represented by VGAM1 HOST TARGET PROTEIN through VGAM3 HOST TARGET PROTEIN, all of FIG. 1.

It is appreciated that a function of VGR3083 gene, herein designated VGR GENE, is inhibition of expression of host target genes, as part of a novel viral mechanism of attacking a host. Accordingly, utilities of VGR3083 gene include diagnosis, prevention and treatment of viral infection by Ateline Herpesvirus 3. Specific functions, and accordingly utilities, of VGR3083 gene correlate with, and may be deduced from, the identity of the host target genes, which are inhibited by VGAM RNAs comprised in the 'operon-like' cluster of VGR3083 gene: VGAM1589 host target protein, VGAM1590 host target protein, VGAM1591 host target protein, VGAM1592 host target protein and VGAM1593 host target protein, herein schematically represented by VGAM1 HOST TARGET PROTEIN through VGAM3 HOST TARGET PROTEIN. The function of these host target genes is elaborated hereinabove with reference to VGAM1589, VGAM1590, VGAM1591, VGAM1592 and VGAM1593.

FIG. 9 further provides a conceptual description of novel bioinformatically detected regulatory viral gene, referred to here as Viral Genomic Record 3084(VGR3084) viral gene, which encodes an 'operon-like' cluster of novel viral micro RNA-like genes, each of which in turn modulates expression of at least one host target gene, the function and utility of which at least one host target gene is known in the art.

VGR3084 gene, herein designated VGR GENE, is a novel bioinformatically detected regulatory, non protein coding, RNA viral gene. The method by which VGR3084 gene was detected is described hereinabove with reference to FIGS. 1-9.

VGR3084 gene encodes VGR3084 precursor RNA, herein designated VGR PRECURSOR RNA, an RNA molecule, typically several hundred nucleotides long.

VGR3084 precursor RNA folds spatially, forming VGR3084 folded precursor RNA, herein designated VGR FOLDED PRECURSOR RNA. It is appreciated that VGR3084 folded precursor RNA comprises a plurality of what is known in the art as 'hairpin' structures. These 'hairpin' structures are due to the fact that the nucleotide sequence of VGR3084 precursor RNA comprises a plurality of segments, the first half of each such segment having a nucleotide sequence which is at least a partial inversed-reversed sequence of the second half thereof, as is well known in the art.

VGR3084 folded precursor RNA is naturally processed by cellular enzymatic activity into at least 4 separate VGAM precursor RNAs, VGAM1594 precursor RNA, VGAM1595 precursor RNA, VGAM1596 precursor RNA and VGAM1597 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1594 RNA, VGAM1595 RNA, VGAM1596 RNA and VGAM1597 RNA, herein schematically represented by VGAM1 RNA through VGAM3 RNA, each of which VGAM RNAs corresponding to VGAM RNA of FIG. 1.

VGAM1594 RNA, herein schematically represented by VGAM1 RNA through VGAM3 RNA, binds complementarily to a host target binding site located in an untranslated region of VGAM1594 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1594 host target RNA into VGAM1594 host target protein, herein schematically represented by VGAM1 HOST TARGET PROTEIN through VGAM3 HOST TARGET PROTEIN, all of FIG. 1.

VGAM1595 RNA, herein schematically represented by VGAM1 RNA through VGAM3 RNA, binds complementarily to a host target binding site located in an untranslated region of VGAM1595 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1595 host target RNA into VGAM1595 host target protein, herein schematically represented by VGAM1 HOST TARGET PROTEIN through VGAM3 HOST TARGET PROTEIN, all of FIG. 1.

VGAM1596 RNA, herein schematically represented by VGAM1 RNA through VGAM3 RNA, binds complementarily to a host target binding site located in an untranslated region of VGAM1596 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1596 host target RNA into VGAM1596 host target protein, herein schematically represented by VGAM1 HOST TARGET PROTEIN through VGAM3 HOST TARGET PROTEIN, all of FIG. 1.

VGAM1597 RNA, herein schematically represented by VGAM1 RNA through VGAM3 RNA, binds complementarily to a host target binding site located in an untranslated region of VGAM1597 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1597 host target RNA into VGAM1597 host target protein, herein schematically represented by VGAM1 HOST TARGET PROTEIN through VGAM3 HOST TARGET PROTEIN, all of FIG. 1.

It is appreciated that a function of VGR3084 gene, herein designated VGR GENE, is inhibition of expression of host target genes, as part of a novel viral mechanism of attacking a host. Accordingly, utilities of VGR3084 gene include diagnosis, prevention and treatment of viral infection by Leek Yellow Stripe Potyvirus. Specific functions, and accordingly utilities, of VGR3084 gene correlate with, and may be deduced from, the identity of the host target genes, which are inhibited by VGAM RNAs comprised in the 'operon-like' cluster of VGR3084 gene: VGAM1594 host target protein, VGAM1595 host target protein, VGAM1596 host target protein and VGAM1597 host target protein, herein schematically represented by VGAM1 HOST TARGET PROTEIN through VGAM3 HOST TARGET PROTEIN. The function of these host target genes is elaborated hereinabove with reference to VGAM1594, VGAM1595, VGAM1596 and VGAM1597. FIG. 9 further provides a conceptual description of novel bioinformatically detected regulatory viral gene, referred to here as Viral Genomic Record 3085(VGR3085) viral gene, which encodes an 'operon-like' cluster of novel viral micro RNA-like genes, each of which in turn modulates expression of at least one host target gene, the function and utility of which at least one host target gene is known in the art.

VGR3085 gene, herein designated VGR GENE, is a novel bioinformatically detected regulatory, non protein coding, RNA viral gene. The method by which VGR3085 gene was detected is described hereinabove with reference to FIGS. 1-9.

VGR3085 gene encodes VGR3085 precursor RNA, herein designated VGR PRECURSOR RNA, an RNA molecule, typically several hundred nucleotides long.

VGR3085 precursor RNA folds spatially, forming VGR3085 folded precursor RNA, herein designated VGR FOLDED PRECURSOR RNA. It is appreciated that VGR3085 folded precursor RNA comprises a plurality of what is known in the art as 'hairpin' structures. These 'hairpin' structures are due to the fact that the nucleotide sequence of VGR3085 precursor RNA comprises a plurality of segments, the first half of each such segment having a nucleotide sequence which is at least a partial inversed-reversed sequence of the second half thereof, as is well known in the art.

VGR3085 folded precursor RNA is naturally processed by cellular enzymatic activity into at least 5 separate VGAM precursor RNAs, VGAM1598 precursor RNA, VGAM1599 precursor RNA, VGAM1600 precursor RNA, VGAM1601 precursor RNA and VGAM1602 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1598 RNA, VGAM1599 RNA, VGAM1600 RNA, VGAM1601 RNA and VGAM1602 RNA, herein schematically represented by VGAM1 RNA through VGAM3 RNA, each of which VGAM RNAs corresponding to VGAM RNA of FIG. 1.

VGAM1598 RNA, herein schematically represented by VGAM1 RNA through VGAM3 RNA, binds complementarily to a host target binding site located in an untranslated region of VGAM1598 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1598 host target RNA into VGAM1598 host target protein, herein schematically represented by VGAM1 HOST TARGET PROTEIN through VGAM3 HOST TARGET PROTEIN, all of FIG. 1.

VGAM1599 RNA, herein schematically represented by VGAM1 RNA through VGAM3 RNA, binds complementarily to a host target binding site located in an untranslated region of VGAM1599 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1599 host target RNA into VGAM1599 host target protein, herein schematically represented by VGAM1 HOST TARGET PROTEIN through VGAM3 HOST TARGET PROTEIN, all of FIG. 1.

VGAM1600 RNA, herein schematically represented by VGAM1 RNA through VGAM3 RNA, binds complementarily to a host target binding site located in an untranslated region of VGAM1600 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1600 host target RNA into VGAM1600 host target protein, herein schematically represented by VGAM1 HOST TARGET PROTEIN through VGAM3 HOST TARGET PROTEIN, all of FIG. 1.

VGAM1601 RNA, herein schematically represented by VGAM1 RNA through VGAM3 RNA, binds complementarily to a host target binding site located in an untranslated region of VGAM1601 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1601 host target RNA into VGAM1601 host target protein, herein schematically represented by VGAM1 HOST TARGET PROTEIN through VGAM3 HOST TARGET PROTEIN, all of FIG. 1.

VGAM1602 RNA, herein schematically represented by VGAM1 RNA through VGAM3 RNA, binds complementarily to a host target binding site located in an untranslated region of VGAM1602 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1602 host target RNA into VGAM1602 host target protein, herein schematically represented by VGAM1 HOST TARGET PROTEIN through VGAM3 HOST TARGET PROTEIN, all of FIG. 1.

It is appreciated that a function of VGR3085 gene, herein designated VGR GENE, is inhibition of expression of host target genes, as part of a novel viral mechanism of attacking a host. Accordingly, utilities of VGR3085 gene include diagnosis, prevention and treatment of viral infection by Human Adenovirus E. Specific functions, and accordingly utilities, of VGR3085 gene correlate with, and may be deduced from, the identity of the host target genes, which are inhibited by VGAM RNAs comprised in the 'operon-like' cluster of VGR3085 gene: VGAM1598 host target protein, VGAM1599 host target protein, VGAM1600 host target protein, VGAM1601 host target protein and VGAM1602 host target protein, herein schematically represented by VGAM1 HOST TARGET PROTEIN through VGAM3 HOST TARGET PROTEIN. The function of these host target genes is elaborated hereinabove with reference to VGAM1598, VGAM1599, VGAM1600, VGAM1601 and VGAM1602.

FIG. 9 further provides a conceptual description of novel bioinformatically detected regulatory viral gene, referred to here as Viral Genomic Record 3086(VGR3086) viral gene, which encodes an 'operon-like' cluster of novel viral micro RNA-like genes, each of which in turn modulates expression of at least one host target gene, the function and utility of which at least one host target gene is known in the art.

VGR3086 gene, herein designated VGR GENE, is a novel bioinformatically detected regulatory, non protein coding, RNA viral gene. The method by which VGR3086 gene was detected is described hereinabove with reference to FIGS. 1-9.

VGR3086 gene encodes VGR3086 precursor RNA, herein designated VGR PRECURSOR RNA, an RNA molecule, typically several hundred nucleotides long.

VGR3086 precursor RNA folds spatially, forming VGR3086 folded precursor RNA, herein designated VGR FOLDED PRECURSOR RNA. It is appreciated that VGR3086 folded precursor RNA comprises a plurality of what is known in the art as 'hairpin' structures. These 'hairpin' structures are due to the fact that the nucleotide sequence of VGR3086 precursor RNA comprises a plurality of segments, the first half of each such segment having a nucleotide sequence which is at least a partial inversed-reversed sequence of the second half thereof, as is well known in the art.

VGR3086 folded precursor RNA is naturally processed by cellular enzymatic activity into at least 6 separate VGAM precursor RNAs, VGAM1603 precursor RNA, VGAM1604 precursor RNA, VGAM1605 precursor RNA, VGAM1606 precursor RNA, VGAM1607 precursor RNA and VGAM1608 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1603 RNA, VGAM1604 RNA, VGAM1605 RNA, VGAM1606 RNA, VGAM1607 RNA and VGAM1608 RNA, herein schematically represented by VGAM1 RNA through VGAM3 RNA, each of which VGAM RNAs corresponding to VGAM RNA of FIG. 1.

VGAM1603 RNA, herein schematically represented by VGAM1 RNA through VGAM3 RNA, binds complementarily to a host target binding site located in an untranslated region of VGAM1603 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1603 host target RNA into VGAM1603 host target protein, herein schematically represented by VGAM1 HOST TARGET PROTEIN through VGAM3 HOST TARGET PROTEIN, all of FIG. 1.

VGAM1604 RNA, herein schematically represented by VGAM1 RNA through VGAM3 RNA, binds complementarily to a host target binding site located in an untranslated region of VGAM1604 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1604 host target RNA into VGAM1604 host target protein, herein schematically represented by VGAM1 HOST TARGET PROTEIN through VGAM3 HOST TARGET PROTEIN, all of FIG. 1.

VGAM1605 RNA, herein schematically represented by VGAM1 RNA through VGAM3 RNA, binds complementarily to a host target binding site located in an untranslated region of VGAM1605 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1605 host target RNA into VGAM1605 host target protein, herein schematically represented by VGAM1 HOST TARGET PROTEIN through VGAM3 HOST TARGET PROTEIN, all of FIG. 1.

VGAM1606 RNA, herein schematically represented by VGAM1 RNA through VGAM3 RNA, binds complementarily to a host target binding site located in an untranslated region of VGAM1606 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1606 host target RNA into VGAM1606 host target protein, herein schematically represented by VGAM1 HOST TARGET PROTEIN through VGAM3 HOST TARGET PROTEIN, all of FIG. 1.

VGAM1607 RNA, herein schematically represented by VGAM1 RNA through VGAM3 RNA, binds complementarily to a host target binding site located in an untranslated region of VGAM1607 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1607 host target RNA into VGAM1607 host target protein, herein schematically represented by VGAM1 HOST TARGET PROTEIN through VGAM3 HOST TARGET PROTEIN, all of FIG. 1.

VGAM1608 RNA, herein schematically represented by VGAM1 RNA through VGAM3 RNA, binds complementarily to a host target binding site located in an untranslated region of VGAM1608 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1608 host target RNA into VGAM1608 host target protein, herein schematically represented by VGAM1 HOST TARGET PROTEIN through VGAM3 HOST TARGET PROTEIN, all of FIG. 1.

It is appreciated that a function of VGR3086 gene, herein designated VGR GENE, is inhibition of expression of host target genes, as part of a novel viral mechanism of attacking a host. Accordingly, utilities of VGR3086 gene include diagnosis, prevention and treatment of viral infection by Taura Syndrome Virus. Specific functions, and accordingly utilities, of VGR3086 gene correlate with, and may be deduced from, the identity of the host target genes, which are inhibited by VGAM RNAs comprised in the 'operon-like' cluster of VGR3086 gene: VGAM1603 host target protein, VGAM1604 host target protein, VGAM1605 host target protein, VGAM1606 host target protein, VGAM1607 host target protein and VGAM1608 host target protein, herein schematically represented by VGAM1 HOST TARGET PROTEIN through VGAM3 HOST TARGET PROTEIN. The function of these host target genes is elaborated hereinabove with reference to VGAM1603, VGAM1604, VGAM1605, VGAM1606, VGAM1607 and VGAM1608. FIG. 9 further provides a conceptual description of novel bioinformatically detected regulatory viral gene, referred to here as Viral Genomic Record 3087(VGR3087) viral gene, which encodes an 'operon-like' cluster of novel viral micro RNA-like genes, each of which in turn modulates expression of at least one host target gene, the function and utility of which at least one host target gene is known in the art.

VGR3087 gene, herein designated VGR GENE, is a novel bioinformatically detected regulatory, non protein coding, RNA viral gene. The method by which VGR3087 gene was detected is described hereinabove with reference to FIGS. 1-9.

VGR3087 gene encodes VGR3087 precursor RNA, herein designated VGR PRECURSOR RNA, an RNA molecule, typically several hundred nucleotides long.

VGR3087 precursor RNA folds spatially, forming VGR3087 folded precursor RNA, herein designated VGR FOLDED PRECURSOR RNA. It is appreciated that VGR3087 folded precursor RNA comprises a plurality of what is known in the art as 'hairpin' structures. These 'hairpin' structures are due to the fact that the nucleotide sequence of VGR3087 precursor RNA comprises a plurality of segments, the first half of each such segment having a nucleotide sequence which is at least a partial inversed-reversed sequence of the second half thereof, as is well known in the art.

VGR3087 folded precursor RNA is naturally processed by cellular enzymatic activity into at least 8 separate VGAM precursor RNAs, VGAM1609 precursor RNA, VGAM1610 precursor RNA, VGAM1611 precursor RNA, VGAM1612 precursor RNA, VGAM1613 precursor RNA, VGAM1614 precursor RNA, VGAM1615 precursor RNA and VGAM1616 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1609 RNA, VGAM1610 RNA, VGAM1611 RNA, VGAM1612 RNA, VGAM1613 RNA, VGAM1614 RNA, VGAM1615 RNA and VGAM1616 RNA, herein schematically represented by VGAM1 RNA through VGAM3 RNA, each of which VGAM RNAs corresponding to VGAM RNA of FIG. 1.

VGAM1609 RNA, herein schematically represented by VGAM1 RNA through VGAM3 RNA, binds complementarily to a host target binding site located in an untranslated region of VGAM1609 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1609 host target RNA into VGAM1609 host target protein, herein schematically represented by VGAM1 HOST TARGET PROTEIN through VGAM3 HOST TARGET PROTEIN, all of FIG. 1.

VGAM1610 RNA, herein schematically represented by VGAM1 RNA through VGAM3 RNA, binds complementarily to a host target binding site located in an untranslated region of VGAM1610 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1610 host target RNA into VGAM1610 host target protein, herein schematically represented by VGAM1 HOST TARGET PROTEIN through VGAM3 HOST TARGET PROTEIN, all of FIG. 1.

VGAM1611 RNA, herein schematically represented by VGAM1 RNA through VGAM3 RNA, binds complementarily to a host target binding site located in an untranslated region of VGAM1611 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1611 host target RNA into VGAM1611 host target protein, herein schematically represented by VGAM1 HOST TARGET PROTEIN through VGAM3 HOST TARGET PROTEIN, all of FIG. 1.

VGAM1612 RNA, herein schematically represented by VGAM1 RNA through VGAM3 RNA, binds complementarily to a host target binding site located in an untranslated region of VGAM1612 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1612 host target RNA into VGAM1612 host target protein, herein schematically represented by VGAM1 HOST TARGET PROTEIN through VGAM3 HOST TARGET PROTEIN, all of FIG. 1.

VGAM1613 RNA, herein schematically represented by VGAM1 RNA through VGAM3 RNA, binds complementarily to a host target binding site located in an untranslated region of VGAM1613 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1613 host target RNA into VGAM1613 host target protein, herein schematically represented by VGAM1 HOST TARGET PROTEIN through VGAM3 HOST TARGET PROTEIN, all of FIG. 1.

VGAM1614 RNA, herein schematically represented by VGAM1 RNA through VGAM3 RNA, binds complementarily to a host target binding site located in an untranslated region of VGAM1614 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1614 host target RNA into VGAM1614 host target protein, herein schematically represented by VGAM1 HOST TARGET PROTEIN through VGAM3 HOST TARGET PROTEIN, all of FIG. 1.

VGAM1615 RNA, herein schematically represented by VGAM1 RNA through VGAM3 RNA, binds complementarily to a host target binding site located in an untranslated region of VGAM1615 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1615 host target RNA into VGAM1615 host target protein, herein schematically represented by VGAM1 HOST TARGET PROTEIN through VGAM3 HOST TARGET PROTEIN, all of FIG. 1.

VGAM1616 RNA, herein schematically represented by VGAM1 RNA through VGAM3 RNA, binds complementarily to a host target binding site located in an untranslated region of VGAM1616 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1616 host target RNA into VGAM1616 host target protein, herein schematically represented by VGAM1 HOST TARGET PROTEIN through VGAM3 HOST TARGET PROTEIN, all of FIG. 1.

It is appreciated that a function of VGR3087 gene, herein designated VGR GENE, is inhibition of expression of host target genes, as part of a novel viral mechanism of attacking a host. Accordingly, utilities of VGR3087 gene include diagnosis, prevention and treatment of viral infection by Chimpanzee Cytomegalovirus. Specific functions, and accordingly utilities, of VGR3087 gene correlate with, and may be deduced from, the identity of the host target genes, which are inhibited by VGAM RNAs comprised in the 'operon-like' cluster of VGR3087 gene: VGAM1609 host target protein, VGAM1610 host target protein, VGAM1611 host target protein, VGAM1612 host target protein, VGAM1613 host target protein, VGAM1614 host target protein, VGAM1615 host target protein and VGAM1616 host target protein, herein schematically represented by VGAM1 HOST TARGET PROTEIN through VGAM3 HOST TARGET PROTEIN. The function of these host target genes is elaborated hereinabove with reference to VGAM1609, VGAM1610, VGAM1611, VGAM1612, VGAM1613, VGAM1614, VGAM1615 and VGAM1616. FIG. 9 further provides a conceptual description of novel bioinformatically detected regulatory viral gene, referred to here as Viral Genomic Record 3088(VGR3088) viral gene, which encodes an 'operon-like' cluster of novel viral micro RNA-like genes, each of which in turn modulates expression of at least one host target gene, the function and utility of which at least one host target gene is known in the art.

VGR3088 gene, herein designated VGR GENE, is a novel bioinformatically detected regulatory, non protein coding, RNA viral gene. The method by which VGR3088 gene was detected is described hereinabove with reference to FIGS. 1-9.

VGR3088 gene encodes VGR3088 precursor RNA, herein designated VGR PRECURSOR RNA, an RNA molecule, typically several hundred nucleotides long.

VGR3088 precursor RNA folds spatially, forming VGR3088 folded precursor RNA, herein designated VGR FOLDED PRECURSOR RNA. It is appreciated that VGR3088 folded precursor RNA comprises a plurality of what is known in the art as 'hairpin' structures. These 'hairpin' structures are due to the fact that the nucleotide sequence of VGR3088 precursor RNA comprises a plurality of segments, the first half of each such segment having a nucleotide sequence which is at least a partial inversed-reversed sequence of the second half thereof, as is well known in the art.

VGR3088 folded precursor RNA is naturally processed by cellular enzymatic activity into at least 5 separate VGAM precursor RNAs, VGAM1617 precursor RNA, VGAM1618 precursor RNA, VGAM1619 precursor RNA, VGAM1620 precursor RNA and VGAM1621 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1617 RNA, VGAM1618 RNA, VGAM1619 RNA, VGAM1620 RNA and VGAM1621 RNA, herein schematically represented by VGAM1 RNA through VGAM3 RNA, each of which VGAM RNAs corresponding to VGAM RNA of FIG. 1.

VGAM1617 RNA, herein schematically represented by VGAM1 RNA through VGAM3 RNA, binds complementarily to a host target binding site located in an untranslated region of VGAM1617 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1617 host target RNA into VGAM1617 host target protein, herein schematically represented by VGAM1 HOST TARGET PROTEIN through VGAM3 HOST TARGET PROTEIN, all of FIG. 1.

VGAM1618 RNA, herein schematically represented by VGAM1 RNA through VGAM3 RNA, binds complementarily to a host target binding site located in an untranslated region of VGAM1618 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1618 host target RNA into VGAM1618 host target protein, herein schematically represented by VGAM1 HOST TARGET PROTEIN through VGAM3 HOST TARGET PROTEIN, all of FIG. 1.

VGAM1619 RNA, herein schematically represented by VGAM1 RNA through VGAM3 RNA, binds complementarily to a host target binding site located in an untranslated region of VGAM1619 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1619 host target RNA into VGAM1619 host target protein, herein schematically represented by VGAM1 HOST TARGET PROTEIN through VGAM3 HOST TARGET PROTEIN, all of FIG. 1.

VGAM1620 RNA, herein schematically represented by VGAM1 RNA through VGAM3 RNA, binds complementarily to a host target binding site located in an untranslated region of VGAM1620 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1620 host target RNA into VGAM1620 host target protein, herein schematically represented by VGAM1 HOST TARGET PROTEIN through VGAM3 HOST TARGET PROTEIN, all of FIG. 1.

VGAM1621 RNA, herein schematically represented by VGAM1 RNA through VGAM3 RNA, binds complementarily to a host target binding site located in an untranslated region of VGAM1621 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1621 host target RNA into VGAM1621 host target protein, herein schematically represented by VGAM1 HOST TARGET PROTEIN through VGAM3 HOST TARGET PROTEIN, all of FIG. 1.

It is appreciated that a function of VGR3088 gene, herein designated VGR GENE, is inhibition of expression of host target genes, as part of a novel viral mechanism of attacking a host. Accordingly, utilities of VGR3088 gene include diagnosis, prevention and treatment of viral infection by Fowl Adenovirus D. Specific functions, and accordingly utilities, of VGR3088 gene correlate with, and may be deduced from, the identity of the host target genes, which are inhibited by VGAM RNAs comprised in the 'operon-like' cluster of VGR3088 gene: VGAM1617 host target protein, VGAM1618 host target protein, VGAM1619 host target protein, VGAM1620 host target protein and VGAM1621 host target protein, herein schematically represented by VGAM1 HOST TARGET PROTEIN through VGAM3 HOST TARGET PROTEIN. The function of these host target genes is elaborated hereinabove with reference to VGAM1617, VGAM1618, VGAM1619, VGAM1620 and VGAM1621.

FIG. 9 further provides a conceptual description of novel bioinformatically detected regulatory viral gene, referred to here as Viral Genomic Record 3089(VGR3089) viral gene, which encodes an 'operon-like' cluster of novel viral micro RNA-like genes, each of which in turn modulates expression of at least one host target gene, the function and utility of which at least one host target gene is known in the art.

VGR3089 gene, herein designated VGR GENE, is a novel bioinformatically detected regulatory, non protein coding, RNA viral gene. The method by which VGR3089 gene was detected is described hereinabove with reference to FIGS. 1-9.

VGR3089 gene encodes VGR3089 precursor RNA, herein designated VGR PRECURSOR RNA, an RNA molecule, typically several hundred nucleotides long.

VGR3089 precursor RNA folds spatially, forming VGR3089 folded precursor RNA, herein designated VGR FOLDED PRECURSOR RNA. It is appreciated that VGR3089 folded precursor RNA comprises a plurality of what is known in the art as 'hairpin' structures. These 'hairpin' structures are due to the fact that the nucleotide sequence of VGR3089 precursor RNA comprises a plurality of segments, the first half of each such segment having a nucleotide sequence which is at least a partial inversed-reversed sequence of the second half thereof, as is well known in the art.

VGR3089 folded precursor RNA is naturally processed by cellular enzymatic activity into at least 8 separate VGAM precursor RNAs, VGAM1622 precursor RNA, VGAM1623 precursor RNA, VGAM1624 precursor RNA, VGAM1625 precursor RNA, VGAM1626 precursor RNA, VGAM1627 precursor RNA, VGAM1628 precursor RNA and VGAM1629 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1622 RNA, VGAM1623 RNA, VGAM1624 RNA, VGAM1625 RNA, VGAM1626 RNA, VGAM1627 RNA, VGAM1628 RNA and VGAM1629 RNA, herein schematically represented by VGAM1 RNA through VGAM3 RNA, each of which VGAM RNAs corresponding to VGAM RNA of FIG. 1.

VGAM1622 RNA, herein schematically represented by VGAM1 RNA through VGAM3 RNA, binds complementarily to a host target binding site located in an untranslated region of VGAM1622 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1622 host target RNA into VGAM1622 host target protein, herein schematically represented by VGAM1 HOST TARGET PROTEIN through VGAM3 HOST TARGET PROTEIN, all of FIG. 1.

VGAM1623 RNA, herein schematically represented by VGAM1 RNA through VGAM3 RNA, binds complementarily to a host target binding site located in an untranslated region of VGAM1623 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1623 host target RNA into VGAM1623 host target protein, herein schematically represented by VGAM1 HOST TARGET PROTEIN through VGAM3 HOST TARGET PROTEIN, all of FIG. 1.

VGAM1624 RNA, herein schematically represented by VGAM1 RNA through VGAM3 RNA, binds complementarily to a host target binding site located in an untranslated region of VGAM1624 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1624 host target RNA into VGAM1624 host target protein, herein schematically represented by VGAM1 HOST TARGET PROTEIN through VGAM3 HOST TARGET PROTEIN, all of FIG. 1.

VGAM1625 RNA, herein schematically represented by VGAM1 RNA through VGAM3 RNA, binds complementarily to a host target binding site located in an untranslated region of VGAM1625 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1625 host target RNA into VGAM1625 host target protein, herein schematically represented by VGAM1 HOST TARGET PROTEIN through VGAM3 HOST TARGET PROTEIN, all of FIG. 1.

VGAM1626 RNA, herein schematically represented by VGAM1 RNA through VGAM3 RNA, binds complementarily to a host target binding site located in an untranslated region of VGAM1626 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1626 host target RNA into VGAM1626 host target protein, herein schematically represented by VGAM1 HOST TARGET PROTEIN through VGAM3 HOST TARGET PROTEIN, all of FIG. 1.

VGAM1627 RNA, herein schematically represented by VGAM1 RNA through VGAM3 RNA, binds complementarily to a host target binding site located in an untranslated region of VGAM1627 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1627 host target RNA into VGAM1627 host target protein, herein schematically represented by VGAM1 HOST TARGET PROTEIN through VGAM3 HOST TARGET PROTEIN, all of FIG. 1.

VGAM1628 RNA, herein schematically represented by VGAM1 RNA through VGAM3 RNA, binds complementarily to a host target binding site located in an untranslated region of VGAM1628 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1628 host target RNA into VGAM1628 host target protein, herein schematically represented by VGAM1 HOST TARGET PROTEIN through VGAM3 HOST TARGET PROTEIN, all of FIG. 1.

VGAM1629 RNA, herein schematically represented by VGAM1 RNA through VGAM3 RNA, binds complementarily to a host target binding site located in an untranslated region of VGAM1629 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1629 host target RNA into VGAM1629 host target protein, herein schematically represented by VGAM1 HOST TARGET PROTEIN through VGAM3 HOST TARGET PROTEIN, all of FIG. 1.

It is appreciated that a function of VGR3089 gene, herein designated VGR GENE, is inhibition of expression of host target genes, as part of a novel viral mechanism of attacking a host. Accordingly, utilities of VGR3089 gene include diagnosis, prevention and treatment of viral infection by Bovine Herpesvirus 4. Specific functions, and accordingly utilities, of VGR3089 gene correlate with, and may be deduced from, the identity of the host target genes, which are inhibited by VGAM RNAs comprised in the 'operon-like' cluster of VGR3089 gene: VGAM1622 host target protein, VGAM1623 host target protein, VGAM1624 host target protein, VGAM1625 host target protein, VGAM1626 host target protein, VGAM1627 host target protein, VGAM1628 host target protein and VGAM1629 host target protein, herein schematically represented by VGAM1 HOST TARGET PROTEIN through VGAM3 HOST TARGET PROTEIN. The function of these host target genes is elaborated hereinabove with reference to VGAM1622, VGAM1623, VGAM1624, VGAM1625, VGAM1626, VGAM1627, VGAM1628 and VGAM1629. FIG. 9 further provides a conceptual description of novel bioinformatically detected regulatory viral gene, referred to here as Viral Genomic Record 3090(VGR3090) viral gene, which encodes an 'operon-like' cluster of novel viral micro RNA-like genes, each of which in turn modulates expression of at least one host target gene, the function and utility of which at least one host target gene is known in the art.

VGR3090 gene, herein designated VGR GENE, is a novel bioinformatically detected regulatory, non protein coding, RNA viral gene. The method by which VGR3090 gene was detected is described hereinabove with reference to FIGS. 1-9.

VGR3090 gene encodes VGR3090 precursor RNA, herein designated VGR PRECURSOR RNA, an RNA molecule, typically several hundred nucleotides long.

VGR3090 precursor RNA folds spatially, forming VGR3090 folded precursor RNA, herein designated VGR FOLDED PRECURSOR RNA. It is appreciated that VGR3090 folded precursor RNA comprises a plurality of what is known in the art as 'hairpin' structures. These 'hairpin' structures are due to the fact that the nucleotide sequence of VGR3090 precursor RNA comprises a plurality of segments, the first half of each such segment having a nucleotide sequence which is at least a partial inversed-reversed sequence of the second half thereof, as is well known in the art.

VGR3090 folded precursor RNA is naturally processed by cellular enzymatic activity into at least 5 separate VGAM precursor RNAs, VGAM1630 precursor RNA, VGAM1631 precursor RNA, VGAM1632 precursor RNA, VGAM1633 precursor RNA and VGAM1634 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1630 RNA, VGAM1631 RNA, VGAM1632 RNA, VGAM1633 RNA and VGAM1634 RNA, herein schematically represented by VGAM1 RNA through VGAM3 RNA, each of which VGAM RNAs corresponding to VGAM RNA of FIG. 1.

VGAM1630 RNA, herein schematically represented by VGAM1 RNA through VGAM3 RNA, binds complementarily to a host target binding site located in an untranslated region of VGAM1630 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1630 host target RNA into VGAM1630 host target protein, herein schematically represented by VGAM1 HOST TARGET PROTEIN through VGAM3 HOST TARGET PROTEIN, all of FIG. 1.

VGAM1631 RNA, herein schematically represented by VGAM1 RNA through VGAM3 RNA, binds complementarily to a host target binding site located in an untranslated region of VGAM1631 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1631 host target RNA into VGAM1631 host target protein, herein schematically represented by VGAM1 HOST TARGET PROTEIN through VGAM3 HOST TARGET PROTEIN, all of FIG. 1.

VGAM1632 RNA, herein schematically represented by VGAM1 RNA through VGAM3 RNA, binds complementarily to a host target binding site located in an untranslated region of VGAM1632 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1632 host target RNA into VGAM1632 host target protein, herein schematically represented by VGAM1 HOST TARGET PROTEIN through VGAM3 HOST TARGET PROTEIN, all of FIG. 1.

VGAM1633 RNA, herein schematically represented by VGAM1 RNA through VGAM3 RNA, binds complementarily to a host target binding site located in an untranslated region of VGAM1633 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1633 host target RNA into VGAM1633 host target protein, herein schematically represented by VGAM1 HOST TARGET PROTEIN through VGAM3 HOST TARGET PROTEIN, all of FIG. 1.

VGAM1634 RNA, herein schematically represented by VGAM1 RNA through VGAM3 RNA, binds complementarily to a host target binding site located in an untranslated region of VGAM1634 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1634 host target RNA into VGAM1634 host target protein, herein schematically represented by VGAM1 HOST TARGET PROTEIN through VGAM3 HOST TARGET PROTEIN, all of FIG. 1.

It is appreciated that a function of VGR3090 gene, herein designated VGR GENE, is inhibition of expression of host target genes, as part of a novel viral mechanism of attacking a host. Accordingly, utilities of VGR3090 gene include diagnosis, prevention and treatment of viral infection by Bovine Herpesvirus 4. Specific functions, and accordingly utilities, of VGR3090 gene correlate with, and may be deduced from, the identity of the host target genes, which are inhibited by VGAM RNAs comprised in the 'operon-like' cluster of VGR3090 gene: VGAM1630 host target protein, VGAM1631 host target protein, VGAM1632 host target protein, VGAM1633 host target protein and VGAM1634 host target protein, herein schematically represented by VGAM1 HOST TARGET PROTEIN through VGAM3 HOST TARGET PROTEIN. The function of these host target genes is elaborated hereinabove with reference to VGAM1630, VGAM1631, VGAM1632, VGAM1633 and VGAM1634. FIG. 9 further provides a conceptual description of novel bioinformatically detected regulatory viral gene, referred to here as Viral Genomic Record 3091(VGR3091) viral gene, which encodes an 'operon-like' cluster of novel viral micro RNA-like genes, each of which in turn modulates expression of at least one host target gene, the function and utility of which at least one host target gene is known in the art.

VGR3091 gene, herein designated VGR GENE, is a novel bioinformatically detected regulatory, non protein coding, RNA viral gene. The method by which VGR3091 gene was detected is described hereinabove with reference to FIGS. 1-9.

VGR3091 gene encodes VGR3091 precursor RNA, herein designated VGR PRECURSOR RNA, an RNA molecule, typically several hundred nucleotides long.

VGR3091 precursor RNA folds spatially, forming VGR3091 folded precursor RNA, herein designated VGR FOLDED PRECURSOR RNA. It is appreciated that VGR3091 folded precursor RNA comprises a plurality of what is known in the art as 'hairpin' structures. These 'hairpin' structures are due to the fact that the nucleotide sequence of VGR3091 precursor RNA comprises a plurality of segments, the first half of each such segment having a nucleotide sequence which is at least a partial inversed-reversed sequence of the second half thereof, as is well known in the art.

VGR3091 folded precursor RNA is naturally processed by cellular enzymatic activity into at least 6 separate VGAM precursor RNAs, VGAM1635 precursor RNA, VGAM1636 precursor RNA, VGAM1637 precursor RNA, VGAM1638 precursor RNA, VGAM1639 precursor RNA and VGAM1640 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1635 RNA, VGAM1636 RNA, VGAM1637 RNA, VGAM1638 RNA, VGAM1639 RNA and VGAM1640 RNA, herein schematically represented by VGAM1 RNA through VGAM3 RNA, each of which VGAM RNAs corresponding to VGAM RNA of FIG. 1.

VGAM1635 RNA, herein schematically represented by VGAM1 RNA through VGAM3 RNA, binds complementarily to a host target binding site located in an untranslated region of VGAM1635 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1635 host target RNA into VGAM1635 host target protein, herein schematically represented by VGAM1 HOST TARGET PROTEIN through VGAM3 HOST TARGET PROTEIN, all of FIG. 1.

VGAM1636 RNA, herein schematically represented by VGAM1 RNA through VGAM3 RNA, binds complementarily to a host target binding site located in an untranslated region of VGAM1636 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1636 host target RNA into VGAM1636 host target protein, herein schematically represented by VGAM1 HOST TARGET PROTEIN through VGAM3 HOST TARGET PROTEIN, all of FIG. 1.

VGAM1637 RNA, herein schematically represented by VGAM1 RNA through VGAM3 RNA, binds complementarily to a host target binding site located in an untranslated region of VGAM1637 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1637 host target RNA into VGAM1637 host target protein, herein schematically represented by VGAM1 HOST TARGET PROTEIN through VGAM3 HOST TARGET PROTEIN, all of FIG. 1.

VGAM1638 RNA, herein schematically represented by VGAM1 RNA through VGAM3 RNA, binds complementarily to a host target binding site located in an untranslated region of VGAM1638 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1638 host target RNA into VGAM1638 host target protein, herein schematically represented by VGAM1 HOST TARGET PROTEIN through VGAM3 HOST TARGET PROTEIN, all of FIG. 1.

VGAM1639 RNA, herein schematically represented by VGAM1 RNA through VGAM3 RNA, binds complementarily to a host target binding site located in an untranslated region of VGAM1639 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1639 host target RNA into VGAM1639 host target protein, herein schematically represented by VGAM1 HOST TARGET PROTEIN through VGAM3 HOST TARGET PROTEIN, all of FIG. 1.

VGAM1640 RNA, herein schematically represented by VGAM1 RNA through VGAM3 RNA, binds complementarily to a host target binding site located in an untranslated region of VGAM1640 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1640 host target RNA into VGAM1640 host target protein, herein schematically represented by VGAM1 HOST TARGET PROTEIN through VGAM3 HOST TARGET PROTEIN, all of FIG. 1.

It is appreciated that a function of VGR3091 gene, herein designated VGR GENE, is inhibition of expression of host target genes, as part of a novel viral mechanism of attacking a host. Accordingly, utilities of VGR3091 gene include diagnosis, prevention and treatment of viral infection by Human Herpesvirus 8. Specific functions, and accordingly utilities, of VGR3091 gene correlate with, and may be deduced from, the identity of the host target genes, which are inhibited by VGAM RNAs comprised in the 'operon-like' cluster of VGR3091 gene: VGAM1635 host target protein, VGAM1636 host target protein, VGAM1637 host target protein, VGAM1638 host target protein, VGAM1639 host target protein and VGAM1640 host target protein, herein schematically represented by VGAM1 HOST TARGET PROTEIN through VGAM3 HOST TARGET PROTEIN. The function of these host target genes is elaborated hereinabove with reference to VGAM1635, VGAM1636, VGAM1637, VGAM1638, VGAM1639 and VGAM1640. FIG. 9 further provides a conceptual description of novel bioinformatically detected regulatory viral gene, referred to here as Viral Genomic Record 3092(VGR3092) viral gene, which encodes an 'operon-like' cluster of novel viral micro RNA-like genes, each of which in turn modulates expression of at least one host target gene, the function and utility of which at least one host target gene is known in the art.

VGR3092 gene, herein designated VGR GENE, is a novel bioinformatically detected regulatory, non protein coding, RNA viral gene. The method by which VGR3092 gene was detected is described hereinabove with reference to FIGS. 1-9.

VGR3092 gene encodes VGR3092 precursor RNA, herein designated VGR PRECURSOR RNA, an RNA molecule, typically several hundred nucleotides long.

VGR3092 precursor RNA folds spatially, forming VGR3092 folded precursor RNA, herein designated VGR FOLDED PRECURSOR RNA. It is appreciated that VGR3092 folded precursor RNA comprises a plurality of what is known in the art as 'hairpin' structures. These 'hairpin' structures are due to the fact that the nucleotide sequence of VGR3092 precursor RNA comprises a plurality of segments, the first half of each such segment having a nucleotide sequence which is at least a partial inversed-reversed sequence of the second half thereof, as is well known in the art.

VGR3092 folded precursor RNA is naturally processed by cellular enzymatic activity into at least 3 separate VGAM precursor RNAs, VGAM1641 precursor RNA, VGAM1642 precursor RNA and VGAM1643 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1641 RNA, VGAM1642 RNA and VGAM1643 RNA, herein schematically represented by VGAM1 RNA through VGAM3 RNA, each of which VGAM RNAs corresponding to VGAM RNA of FIG. 1.

VGAM1641 RNA, herein schematically represented by VGAM1 RNA through VGAM3 RNA, binds complementarily to a host target binding site located in an untranslated region of VGAM1641 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1641 host target RNA into VGAM1641 host target protein, herein schematically represented by VGAM1 HOST TARGET PROTEIN through VGAM3 HOST TARGET PROTEIN, all of FIG. 1.

VGAM1642 RNA, herein schematically represented by VGAM1 RNA through VGAM3 RNA, binds complementarily to a host target binding site located in an untranslated region of VGAM1642 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1642 host target RNA into VGAM1642 host target protein, herein schematically represented by VGAM1 HOST TARGET PROTEIN through VGAM3 HOST TARGET PROTEIN, all of FIG. 1.

VGAM1643 RNA, herein schematically represented by VGAM1 RNA through VGAM3 RNA, binds complementarily to a host target binding site located in an untranslated region of VGAM1643 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1643 host target RNA into VGAM1643 host target protein, herein schematically represented by VGAM1 HOST TARGET PROTEIN through VGAM3 HOST TARGET PROTEIN, all of FIG. 1.

It is appreciated that a function of VGR3092 gene, herein designated VGR GENE, is inhibition of expression of host target genes, as part of a novel viral mechanism of attacking a host. Accordingly, utilities of VGR3092 gene include diagnosis, prevention and treatment of viral infection by Cell Fusing Agent Virus. Specific functions, and accordingly utilities, of VGR3092 gene correlate with, and may be deduced from, the identity of the host target genes, which are inhibited by VGAM RNAs comprised in the 'operon-like' cluster of VGR3092 gene: VGAM1641 host target protein, VGAM1642 host target protein and VGAM1643 host target protein, herein schematically represented by VGAM1 HOST TARGET PROTEIN through VGAM3 HOST TARGET PROTEIN. The function of these host target genes is elaborated hereinabove with reference to VGAM1641, VGAM1642 and VGAM1643. FIG. 9 further provides a conceptual description of novel bioinformatically detected regulatory viral gene, referred to here as Viral Genomic Record 3093(VGR3093) viral gene, which encodes an 'operon-like' cluster of novel viral micro RNA-like genes, each of which in turn modulates expression of at least one host target gene, the function and utility of which at least one host target gene is known in the art.

VGR3093 gene, herein designated VGR GENE, is a novel bioinformatically detected regulatory, non protein coding, RNA viral gene. The method by which VGR3093 gene was detected is described hereinabove with reference to FIGS. 1-9.

VGR3093 gene encodes VGR3093 precursor RNA, herein designated VGR PRECURSOR RNA, an RNA molecule, typically several hundred nucleotides long.

VGR3093 precursor RNA folds spatially, forming VGR3093 folded precursor RNA, herein designated VGR FOLDED PRECURSOR RNA. It is appreciated that VGR3093 folded precursor RNA comprises a plurality of what is known in the art as 'hairpin' structures. These 'hairpin' structures are due to the fact that the nucleotide sequence of VGR3093 precursor RNA comprises a plurality of segments, the first half of each such segment having a nucleotide sequence which is at least a partial inversed-reversed sequence of the second half thereof, as is well known in the art.

VGR3093 folded precursor RNA is naturally processed by cellular enzymatic activity into at least 3 separate VGAM precursor RNAs, VGAM1644 precursor RNA, VGAM1645 precursor RNA and VGAM1646 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1644 RNA, VGAM1645 RNA and VGAM1646 RNA, herein schematically represented by VGAM1 RNA through VGAM3 RNA, each of which VGAM RNAs corresponding to VGAM RNA of FIG. 1.

VGAM1644 RNA, herein schematically represented by VGAM1 RNA through VGAM3 RNA, binds complementarily to a host target binding site located in an untranslated region of VGAM1644 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1644 host target RNA into VGAM1644 host target protein, herein schematically represented by VGAM1 HOST TARGET PROTEIN through VGAM3 HOST TARGET PROTEIN, all of FIG. 1.

VGAM1645 RNA, herein schematically represented by VGAM1 RNA through VGAM3 RNA, binds complementarily to a host target binding site located in an untranslated region of VGAM1645 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1645 host target RNA into VGAM1645 host target protein, herein schematically represented by VGAM1 HOST TARGET PROTEIN through VGAM3 HOST TARGET PROTEIN, all of FIG. 1.

VGAM1646 RNA, herein schematically represented by VGAM1 RNA through VGAM3 RNA, binds complementarily to a host target binding site located in an untranslated region of VGAM1646 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1646 host target RNA into VGAM1646 host target protein, herein schematically represented by VGAM1 HOST TARGET PROTEIN through VGAM3 HOST TARGET PROTEIN, all of FIG. 1.

It is appreciated that a function of VGR3093 gene, herein designated VGR GENE, is inhibition of expression of host target genes, as part of a novel viral mechanism of attacking a host. Accordingly, utilities of VGR3093 gene include diagnosis, prevention and treatment of viral infection by Dengue Virus. Specific functions, and accordingly utilities, of VGR3093 gene correlate with, and may be deduced from, the identity of the host target genes, which are inhibited by VGAM RNAs comprised in the 'operon-like' cluster of VGR3093 gene: VGAM1644 host target protein, VGAM1645 host target protein and VGAM1646 host target protein, herein schematically represented by VGAM1 HOST TARGET PROTEIN through VGAM3 HOST TARGET PROTEIN. The function of these host target genes is elaborated hereinabove with reference to VGAM1644, VGAM1645 and VGAM1646. FIG. 9 further provides a conceptual description of novel bioinformatically detected regulatory viral gene, referred to here as Viral Genomic Record 3094(VGR3094) viral gene, which encodes an 'operon-like' cluster of novel viral micro RNA-like genes, each of which in turn modulates expression of at least one host target gene, the function and utility of which at least one host target gene is known in the art.

VGR3094 gene, herein designated VGR GENE, is a novel bioinformatically detected regulatory, non protein coding, RNA viral gene. The method by which VGR3094 gene was detected is described hereinabove with reference to FIGS. 1-9.

VGR3094 gene encodes VGR3094 precursor RNA, herein designated VGR PRECURSOR RNA, an RNA molecule, typically several hundred nucleotides long.

VGR3094 precursor RNA folds spatially, forming VGR3094 folded precursor RNA, herein designated VGR FOLDED PRECURSOR RNA. It is appreciated that VGR3094 folded precursor RNA comprises a plurality of what is known in the art as 'hairpin' structures. These 'hairpin' structures are due to the fact that the nucleotide sequence of VGR3094 precursor RNA comprises a plurality of segments, the first half of each such segment having a nucleotide sequence which is at least a partial inversed-reversed sequence of the second half thereof, as is well known in the art.

VGR3094 folded precursor RNA is naturally processed by cellular enzymatic activity into at least 5 separate VGAM precursor RNAs, VGAM1647 precursor RNA, VGAM1648 precursor RNA, VGAM1649 precursor RNA, VGAM1650 precursor RNA and VGAM1651 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1647 RNA, VGAM1648 RNA, VGAM1649 RNA, VGAM1650 RNA and VGAM1651 RNA, herein schematically represented by VGAM1 RNA through VGAM3 RNA, each of which VGAM RNAs corresponding to VGAM RNA of FIG. 1.

VGAM1647 RNA, herein schematically represented by VGAM1 RNA through VGAM3 RNA, binds complementarily to a host target binding site located in an untranslated region of VGAM1647 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1647 host target RNA into VGAM1647 host target protein, herein schematically represented by VGAM1 HOST TARGET PROTEIN through VGAM3 HOST TARGET PROTEIN, all of FIG. 1.

VGAM1648 RNA, herein schematically represented by VGAM1 RNA through VGAM3 RNA, binds complementarily to a host target binding site located in an untranslated region of VGAM1648 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1648 host target RNA into VGAM1648 host target protein, herein schematically represented by VGAM1 HOST TARGET PROTEIN through VGAM3 HOST TARGET PROTEIN, all of FIG. 1.

VGAM1649 RNA, herein schematically represented by VGAM1 RNA through VGAM3 RNA, binds complementarily to a host target binding site located in an untranslated region of VGAM1649 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1649 host target RNA into VGAM1649 host target protein, herein schematically represented by VGAM1 HOST TARGET PROTEIN through VGAM3 HOST TARGET PROTEIN, all of FIG. 1.

VGAM1650 RNA, herein schematically represented by VGAM1 RNA through VGAM3 RNA, binds complementarily to a host target binding site located in an untranslated region of VGAM1650 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1650 host target RNA into VGAM1650 host target protein, herein schematically represented by VGAM1 HOST TARGET PROTEIN through VGAM3 HOST TARGET PROTEIN, all of FIG. 1.

VGAM1651 RNA, herein schematically represented by VGAM1 RNA through VGAM3 RNA, binds complementarily to a host target binding site located in an untranslated region of VGAM1651 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1651 host target RNA into VGAM1651 host target protein, herein schematically represented by VGAM1 HOST TARGET PROTEIN through VGAM3 HOST TARGET PROTEIN, all of FIG. 1.

It is appreciated that a function of VGR3094 gene, herein designated VGR GENE, is inhibition of expression of host target genes, as part of a novel viral mechanism of attacking a host. Accordingly, utilities of VGR3094 gene include diagnosis, prevention and treatment of viral infection by Human Herpesvirus 8. Specific functions, and accordingly utilities, of VGR3094 gene correlate with, and may be deduced from, the identity of the host target genes, which are inhibited by VGAM RNAs comprised in the 'operon-like' cluster of VGR3094 gene: VGAM1647 host target protein, VGAM1648 host target protein, VGAM1649 host target protein, VGAM1650 host target protein and VGAM1651 host target protein, herein schematically represented by VGAM1 HOST TARGET PROTEIN through VGAM3 HOST TARGET PROTEIN. The function of these host target genes is elaborated hereinabove with reference to VGAM1647, VGAM1648, VGAM1649, VGAM1650 and VGAM1651. FIG. 9 further provides a conceptual description of novel bioinformatically detected regulatory viral gene, referred to here as Viral Genomic Record 3095(VGR3095) viral gene, which encodes an 'operon-like' cluster of novel viral micro RNA-like genes, each of which in turn modulates expression of at least one host target gene, the function and utility of which at least one host target gene is known in the art.

VGR3095 gene, herein designated VGR GENE, is a novel bioinformatically detected regulatory, non protein coding, RNA viral gene. The method by which VGR3095 gene was detected is described hereinabove with reference to FIGS. 1-9.

VGR3095 gene encodes VGR3095 precursor RNA, herein designated VGR PRECURSOR RNA, an RNA molecule, typically several hundred nucleotides long.

VGR3095 precursor RNA folds spatially, forming VGR3095 folded precursor RNA, herein designated VGR FOLDED PRECURSOR RNA. It is appreciated that VGR3095 folded precursor RNA comprises a plurality of what is known in the art as 'hairpin' structures. These 'hairpin' structures are due to the fact that the nucleotide sequence of VGR3095 precursor RNA comprises a plurality of segments, the first half of each such segment having a nucleotide sequence which is at least a partial inversed-reversed sequence of the second half thereof, as is well known in the art.

VGR3095 folded precursor RNA is naturally processed by cellular enzymatic activity into at least 4 separate VGAM precursor RNAs, VGAM1652 precursor RNA, VGAM1653 precursor RNA, VGAM1654 precursor RNA and VGAM1655 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1652 RNA, VGAM1653 RNA, VGAM1654 RNA and VGAM1655 RNA, herein schematically represented by VGAM1 RNA through VGAM3 RNA, each of which VGAM RNAs corresponding to VGAM RNA of FIG. 1.

VGAM1652 RNA, herein schematically represented by VGAM1 RNA through VGAM3 RNA, binds complementarily to a host target binding site located in an untranslated region of VGAM1652 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1652 host target RNA into VGAM1652 host target protein, herein schematically represented by VGAM1 HOST TARGET PROTEIN through VGAM3 HOST TARGET PROTEIN, all of FIG. 1.

VGAM1653 RNA, herein schematically represented by VGAM1 RNA through VGAM3 RNA, binds complementarily to a host target binding site located in an untranslated region of VGAM1653 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1653 host target RNA into VGAM1653 host target protein, herein schematically represented by VGAM1 HOST TARGET PROTEIN through VGAM3 HOST TARGET PROTEIN, all of FIG. 1.

VGAM1654 RNA, herein schematically represented by VGAM1 RNA through VGAM3 RNA, binds complementarily to a host target binding site located in an untranslated region of VGAM1654 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1654 host target RNA into VGAM1654 host target protein, herein schematically represented by VGAM1 HOST TARGET PROTEIN through VGAM3 HOST TARGET PROTEIN, all of FIG. 1.

VGAM1655 RNA, herein schematically represented by VGAM1 RNA through VGAM3 RNA, binds complementarily to a host target binding site located in an untranslated region of VGAM1655 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1655 host target RNA into VGAM1655 host target protein, herein schematically represented by VGAM1 HOST TARGET PROTEIN through VGAM3 HOST TARGET PROTEIN, all of FIG. 1.

It is appreciated that a function of VGR3095 gene, herein designated VGR GENE, is inhibition of expression of host target genes, as part of a novel viral mechanism of attacking a host. Accordingly, utilities of VGR3095 gene include diagnosis, prevention and treatment of viral infection by Yellow Fever Virus. Specific functions, and accordingly utilities, of VGR3095 gene correlate with, and may be deduced from, the identity of the host target genes, which are inhibited by VGAM RNAs comprised in the 'operon-like' cluster of VGR3095 gene: VGAM1652 host target protein, VGAM1653 host target protein, VGAM1654 host target protein and VGAM1655 host target protein, herein schematically represented by VGAM1 HOST TARGET PROTEIN through VGAM3 HOST TARGET PROTEIN. The function of these host target genes is elaborated hereinabove with reference to VGAM1652, VGAM1653, VGAM1654 and VGAM1655. FIG. 9 further provides a conceptual description of novel bioinformatically detected regulatory viral gene, referred to here as Viral Genomic Record 3096(VGR3096) viral gene, which encodes an 'operon-like' cluster of novel viral micro RNA-like genes, each of which in turn modulates expression of at least one host target gene, the function and utility of which at least one host target gene is known in the art.

VGR3096 gene, herein designated VGR GENE, is a novel bioinformatically detected regulatory, non protein coding, RNA viral gene. The method by which VGR3096 gene was detected is described hereinabove with reference to FIGS. 1-9.

VGR3096 gene encodes VGR3096 precursor RNA, herein designated VGR PRECURSOR RNA, an RNA molecule, typically several hundred nucleotides long.

VGR3096 precursor RNA folds spatially, forming VGR3096 folded precursor RNA, herein designated VGR FOLDED PRECURSOR RNA. It is appreciated that VGR3096 folded precursor RNA comprises a plurality of what is known in the art as 'hairpin' structures. These 'hairpin' structures are due to the fact that the nucleotide sequence of VGR3096 precursor RNA comprises a plurality of segments, the first half of each such segment having a nucleotide sequence which is at least a partial inversed-reversed sequence of the second half thereof, as is well known in the art.

VGR3096 folded precursor RNA is naturally processed by cellular enzymatic activity into at least 5 separate VGAM precursor RNAs, VGAM1656 precursor RNA, VGAM1657 precursor RNA, VGAM1658 precursor RNA, VGAM1659 precursor RNA and VGAM1660 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1656 RNA, VGAM1657 RNA, VGAM1658 RNA, VGAM1659 RNA and VGAM1660 RNA, herein schematically represented by VGAM1 RNA through VGAM3 RNA, each of which VGAM RNAs corresponding to VGAM RNA of FIG. 1.

VGAM1656 RNA, herein schematically represented by VGAM1 RNA through VGAM3 RNA, binds complementarily to a host target binding site located in an untranslated region of VGAM1656 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1656 host target RNA into VGAM1656 host target protein, herein schematically represented by VGAM1 HOST TARGET PROTEIN through VGAM3 HOST TARGET PROTEIN, all of FIG. 1.

VGAM1657 RNA, herein schematically represented by VGAM1 RNA through VGAM3 RNA, binds complementarily to a host target binding site located in an untranslated region of VGAM1657 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1657 host target RNA into VGAM1657 host target protein, herein schematically represented by VGAM1 HOST TARGET PROTEIN through VGAM3 HOST TARGET PROTEIN, all of FIG. 1.

VGAM1658 RNA, herein schematically represented by VGAM1 RNA through VGAM3 RNA, binds complementarily to a host target binding site located in an untranslated region of VGAM1658 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1658 host target RNA into VGAM1658 host target protein, herein schematically represented by VGAM1 HOST TARGET PROTEIN through VGAM3 HOST TARGET PROTEIN, all of FIG. 1.

VGAM1659 RNA, herein schematically represented by VGAM1 RNA through VGAM3 RNA, binds complementarily to a host target binding site located in an untranslated region of VGAM1659 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1659 host target RNA into VGAM1659 host target protein, herein schematically represented by VGAM1 HOST TARGET PROTEIN through VGAM3 HOST TARGET PROTEIN, all of FIG. 1.

VGAM1660 RNA, herein schematically represented by VGAM1 RNA through VGAM3 RNA, binds complementarily to a host target binding site located in an untranslated region of VGAM1660 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1660 host target RNA into VGAM1660 host target protein, herein schematically represented by VGAM1 HOST TARGET PROTEIN through VGAM3 HOST TARGET PROTEIN, all of FIG. 1.

It is appreciated that a function of VGR3096 gene, herein designated VGR GENE, is inhibition of expression of host target genes, as part of a novel viral mechanism of attacking a host. Accordingly, utilities of VGR3096 gene include diagnosis, prevention and treatment of viral infection by Molluscum Contagiosum Virus. Specific functions, and accordingly utilities, of VGR3096 gene correlate with, and may be deduced from, the identity of the host target genes, which are inhibited by VGAM RNAs comprised in the 'operon-like' cluster of VGR3096 gene: VGAM1656 host target protein, VGAM1657 host target protein, VGAM1658 host target protein, VGAM1659 host target protein and VGAM1660 host target protein, herein schematically represented by VGAM1 HOST TARGET PROTEIN through VGAM3 HOST TARGET PROTEIN. The function of these host target genes is elaborated hereinabove with reference to VGAM1656, VGAM1657, VGAM1658, VGAM1659 and VGAM1660.

FIG. 9 further provides a conceptual description of novel bioinformatically detected regulatory viral gene, referred to here as Viral Genomic Record 3097(VGR3097) viral gene, which encodes an 'operon-like' cluster of novel viral micro RNA-like genes, each of which in turn modulates expression of at least one host target gene, the function and utility of which at least one host target gene is known in the art.

VGR3097 gene, herein designated VGR GENE, is a novel bioinformatically detected regulatory, non protein coding, RNA viral gene. The method by which VGR3097 gene was detected is described hereinabove with reference to FIGS. 1-9.

VGR3097 gene encodes VGR3097 precursor RNA, herein designated VGR PRECURSOR RNA, an RNA molecule, typically several hundred nucleotides long.

VGR3097 precursor RNA folds spatially, forming VGR3097 folded precursor RNA, herein designated VGR FOLDED PRECURSOR RNA. It is appreciated that VGR3097 folded precursor RNA comprises a plurality of what is known in the art as 'hairpin' structures. These 'hairpin' structures are due to the fact that the nucleotide sequence of VGR3097 precursor RNA comprises a plurality of segments, the first half of each such segment having a nucleotide sequence which is at least a partial inversed-reversed sequence of the second half thereof, as is well known in the art.

VGR3097 folded precursor RNA is naturally processed by cellular enzymatic activity into at least 4 separate VGAM precursor RNAs, VGAM1661 precursor RNA, VGAM1662 precursor RNA, VGAM1663 precursor RNA and VGAM1664 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1661 RNA, VGAM1662 RNA, VGAM1663 RNA and VGAM1664 RNA, herein schematically represented by VGAM1 RNA through VGAM3 RNA, each of which VGAM RNAs corresponding to VGAM RNA of FIG. 1.

VGAM1661 RNA, herein schematically represented by VGAM1 RNA through VGAM3 RNA, binds complementarily to a host target binding site located in an untranslated region of VGAM1661 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1661 host target RNA into VGAM1661 host target protein, herein schematically represented by VGAM1 HOST TARGET PROTEIN through VGAM3 HOST TARGET PROTEIN, all of FIG. 1.

VGAM1662 RNA, herein schematically represented by VGAM1 RNA through VGAM3 RNA, binds complementarily to a host target binding site located in an untranslated region of VGAM1662 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1662 host target RNA into VGAM1662 host target protein, herein schematically represented by VGAM1 HOST TARGET PROTEIN through VGAM3 HOST TARGET PROTEIN, all of FIG. 1.

VGAM1663 RNA, herein schematically represented by VGAM1 RNA through VGAM3 RNA, binds complementarily to a host target binding site located in an untranslated region of VGAM1663 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1663 host target RNA into VGAM1663 host target protein, herein schematically represented by VGAM1 HOST TARGET PROTEIN through VGAM3 HOST TARGET PROTEIN, all of FIG. 1.

VGAM1664 RNA, herein schematically represented by VGAM1 RNA through VGAM3 RNA, binds complementarily to a host target binding site located in an untranslated region of VGAM1664 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1664 host target RNA into VGAM1664 host target protein, herein schematically represented by VGAM1 HOST TARGET PROTEIN through VGAM3 HOST TARGET PROTEIN, all of FIG. 1.

It is appreciated that a function of VGR3097 gene, herein designated VGR GENE, is inhibition of expression of host target genes, as part of a novel viral mechanism of attacking a host. Accordingly, utilities of VGR3097 gene include diagnosis, prevention and treatment of viral infection by Cercopithecine Herpesvirus 7. Specific functions, and accordingly utilities, of VGR3097 gene correlate with, and may be deduced from, the identity of the host target genes, which are inhibited by VGAM RNAs comprised in the 'operon-like' cluster of VGR3097 gene: VGAM1661 host target protein, VGAM1662 host target protein, VGAM1663 host target protein and VGAM1664 host target protein, herein schematically represented by VGAM1 HOST TARGET PROTEIN through VGAM3 HOST TARGET PROTEIN. The function of these host target genes is elaborated hereinabove with reference to VGAM1661, VGAM1662, VGAM1663 and VGAM1664.

FIG. 9 further provides a conceptual description of novel bioinformatically detected regulatory viral gene, referred to here as Viral Genomic Record 3098(VGR3098) viral gene, which encodes an 'operon-like' cluster of novel viral micro RNA-like genes, each of which in turn modulates expression of at least one host target gene, the function and utility of which at least one host target gene is known in the art.

VGR3098 gene, herein designated VGR GENE, is a novel bioinformatically detected regulatory, non protein coding, RNA viral gene. The method by which VGR3098 gene was detected is described hereinabove with reference to FIGS. 1-9.

VGR3098 gene encodes VGR3098 precursor RNA, herein designated VGR PRECURSOR RNA, an RNA molecule, typically several hundred nucleotides long.

VGR3098 precursor RNA folds spatially, forming VGR3098 folded precursor RNA, herein designated VGR FOLDED PRECURSOR RNA. It is appreciated that VGR3098 folded precursor RNA comprises a plurality of what is known in the art as 'hairpin' structures. These 'hairpin' structures are due to the fact that the nucleotide sequence of VGR3098 precursor RNA comprises a plurality of segments, the first half of each such segment having a nucleotide sequence which is at least a partial inversed-reversed sequence of the second half thereof, as is well known in the art.

VGR3098 folded precursor RNA is naturally processed by cellular enzymatic activity into at least 3 separate VGAM precursor RNAs, VGAM1665 precursor RNA, VGAM1666 precursor RNA and VGAM1667 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1665 RNA, VGAM1666 RNA and VGAM1667 RNA, herein schematically represented by VGAM1 RNA through VGAM3 RNA, each of which VGAM RNAs corresponding to VGAM RNA of FIG. 1.

VGAM1665 RNA, herein schematically represented by VGAM1 RNA through VGAM3 RNA, binds complementarily to a host target binding site located in an untranslated region of VGAM1665 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1665 host target RNA into VGAM1665 host target protein, herein schematically represented by VGAM1 HOST TARGET PROTEIN through VGAM3 HOST TARGET PROTEIN, all of FIG. 1.

VGAM1666 RNA, herein schematically represented by VGAM1 RNA through VGAM3 RNA, binds complementarily to a host target binding site located in an untranslated region of VGAM1666 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1666 host target RNA into VGAM1666 host target protein, herein schematically represented by VGAM1 HOST TARGET PROTEIN through VGAM3 HOST TARGET PROTEIN, all of FIG. 1.

VGAM1667 RNA, herein schematically represented by VGAM1 RNA through VGAM3 RNA, binds complementarily to a host target binding site located in an untranslated region of VGAM1667 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1667 host target RNA into VGAM1667 host target protein, herein schematically represented by VGAM1 HOST TARGET PROTEIN through VGAM3 HOST TARGET PROTEIN, all of FIG. 1.

It is appreciated that a function of VGR3098 gene, herein designated VGR GENE, is inhibition of expression of host target genes, as part of a novel viral mechanism of attacking a host. Accordingly, utilities of VGR3098 gene include diagnosis, prevention and treatment of viral infection by Infectious Spleen and Kidney Necrosis Virus. Specific functions, and accordingly utilities, of VGR3098 gene correlate with, and may be deduced from, the identity of the host target genes, which are inhibited by VGAM RNAs comprised in the 'operon-like' cluster of VGR3098 gene: VGAM1665 host target protein, VGAM1666 host target protein and VGAM1667 host target protein, herein schematically represented by VGAM1 HOST TARGET PROTEIN through VGAM3 HOST TARGET PROTEIN. The function of these host target genes is elaborated hereinabove with reference to VGAM1665, VGAM1666 and VGAM1667. FIG. 9 further provides a conceptual description of novel bioinformatically detected regulatory viral gene, referred to here as Viral Genomic Record 3099(VGR3099) viral gene, which encodes an 'operon-like' cluster of novel viral micro RNA-like genes, each of which in turn modulates expression of at least one host target gene, the function and utility of which at least one host target gene is known in the art.

VGR3099 gene, herein designated VGR GENE, is a novel bioinformatically detected regulatory, non protein coding, RNA viral gene. The method by which VGR3099 gene was detected is described hereinabove with reference to FIGS. 1-9.

VGR3099 gene encodes VGR3099 precursor RNA, herein designated VGR PRECURSOR RNA, an RNA molecule, typically several hundred nucleotides long.

VGR3099 precursor RNA folds spatially, forming VGR3099 folded precursor RNA, herein designated VGR FOLDED PRECURSOR RNA. It is appreciated that VGR3099 folded precursor RNA comprises a plurality of what is known in the art as 'hairpin' structures. These 'hairpin' structures are due to the fact that the nucleotide sequence of VGR3099 precursor RNA comprises a plurality of segments, the first half of each such segment having a nucleotide sequence which is at least a partial inversed-reversed sequence of the second half thereof, as is well known in the art.

VGR3099 folded precursor RNA is naturally processed by cellular enzymatic activity into at least 4 separate VGAM precursor RNAs, VGAM1668 precursor RNA, VGAM1669 precursor RNA, VGAM1670 precursor RNA and VGAM1671 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1668 RNA, VGAM1669 RNA, VGAM1670 RNA and VGAM1671 RNA, herein schematically represented by VGAM1 RNA through VGAM3 RNA, each of which VGAM RNAs corresponding to VGAM RNA of FIG. 1.

VGAM1668 RNA, herein schematically represented by VGAM1 RNA through VGAM3 RNA, binds complementarily to a host target binding site located in an untranslated region of VGAM1668 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1668 host target RNA into VGAM1668 host target protein, herein schematically represented by VGAM1 HOST TARGET PROTEIN through VGAM3 HOST TARGET PROTEIN, all of FIG. 1.

VGAM1669 RNA, herein schematically represented by VGAM1 RNA through VGAM3 RNA, binds complementarily to a host target binding site located in an untranslated region of VGAM1669 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1669 host target RNA into VGAM1669 host target protein, herein schematically represented by VGAM1 HOST TARGET PROTEIN through VGAM3 HOST TARGET PROTEIN, all of FIG. 1.

VGAM1670 RNA, herein schematically represented by VGAM1 RNA through VGAM3 RNA, binds complementarily to a host target binding site located in an untranslated region of VGAM1670 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1670 host target RNA into VGAM1670 host target protein, herein schematically represented by VGAM1 HOST TARGET PROTEIN through VGAM3 HOST TARGET PROTEIN, all of FIG. 1.

VGAM1671 RNA, herein schematically represented by VGAM1 RNA through VGAM3 RNA, binds complementarily to a host target binding site located in an untranslated region of VGAM1671 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1671 host target RNA into VGAM1671 host target protein, herein schematically represented by VGAM1 HOST TARGET PROTEIN through VGAM3 HOST TARGET PROTEIN, all of FIG. 1.

It is appreciated that a function of VGR3099 gene, herein designated VGR GENE, is inhibition of expression of host target genes, as part of a novel viral mechanism of attacking a host. Accordingly, utilities of VGR3099 gene include diagnosis, prevention and treatment of viral infection by Human Adenovirus D. Specific functions, and accordingly utilities, of VGR3099 gene correlate with, and may be deduced from, the identity of the host target genes, which are inhibited by VGAM RNAs comprised in the 'operon-like' cluster of VGR3099 gene: VGAM1668 host target protein, VGAM1669 host target protein, VGAM1670 host target protein and VGAM1671 host target protein, herein schematically represented by VGAM1 HOST TARGET PROTEIN through VGAM3 HOST TARGET PROTEIN. The function of these host target genes is elaborated hereinabove with reference to VGAM1668, VGAM1669, VGAM1670 and VGAM1671. FIG. 9 further provides a conceptual description of novel bioinformatically detected regulatory viral gene, referred to here as Viral Genomic Record 3100(VGR3100) viral gene, which encodes an 'operon-like' cluster of novel viral micro RNA-like genes, each of which in turn modulates expression of at least one host target gene, the function and utility of which at least one host target gene is known in the art.

VGR3100 gene, herein designated VGR GENE, is a novel bioinformatically detected regulatory, non protein coding, RNA viral gene. The method by which VGR3100 gene was detected is described hereinabove with reference to FIGS. 1-9.

VGR3100 gene encodes VGR3100 precursor RNA, herein designated VGR PRECURSOR RNA, an RNA molecule, typically several hundred nucleotides long.

VGR3100 precursor RNA folds spatially, forming VGR3100 folded precursor RNA, herein designated VGR FOLDED PRECURSOR RNA. It is appreciated that VGR3100 folded precursor RNA comprises a plurality of what is known in the art as 'hairpin' structures. These 'hairpin' structures are due to the fact that the nucleotide sequence of VGR3100 precursor RNA comprises a plurality of segments, the first half of each such segment having a nucleotide sequence which is at least a partial inversed-reversed sequence of the second half thereof, as is well known in the art.

VGR3100 folded precursor RNA is naturally processed by cellular enzymatic activity into at least 3 separate VGAM precursor RNAs, VGAM1672 precursor RNA, VGAM1673 precursor RNA and VGAM1674 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1672 RNA, VGAM1673 RNA and VGAM1674 RNA, herein schematically represented by VGAM1 RNA through VGAM3 RNA, each of which VGAM RNAs corresponding to VGAM RNA of FIG. 1.

VGAM1672 RNA, herein schematically represented by VGAM1 RNA through VGAM3 RNA, binds complementarily to a host target binding site located in an untranslated region of VGAM1672 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1672 host target RNA into VGAM1672 host target protein, herein schematically represented by VGAM1 HOST TARGET PROTEIN through VGAM3 HOST TARGET PROTEIN, all of FIG. 1.

VGAM1673 RNA, herein schematically represented by VGAM1 RNA through VGAM3 RNA, binds complementarily to a host target binding site located in an untranslated region of VGAM1673 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1673 host target RNA into VGAM1673 host target protein, herein schematically represented by VGAM1 HOST TARGET PROTEIN through VGAM3 HOST TARGET PROTEIN, all of FIG. 1.

VGAM1674 RNA, herein schematically represented by VGAM1 RNA through VGAM3 RNA, binds complementarily to a host target binding site located in an untranslated region of VGAM1674 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1674 host target RNA into VGAM1674 host target protein, herein schematically represented by VGAM1 HOST TARGET PROTEIN through VGAM3 HOST TARGET PROTEIN, all of FIG. 1.

It is appreciated that a function of VGR3100 gene, herein designated VGR GENE, is inhibition of expression of host target genes, as part of a novel viral mechanism of attacking a host. Accordingly, utilities of VGR3100 gene include diagnosis, prevention and treatment of viral infection by Tick-borne Encephalitis Virus. Specific functions, and accordingly utilities, of VGR3100 gene correlate with, and may be deduced from, the identity of the host target genes, which are inhibited by VGAM RNAs comprised in the 'operon-like' cluster of VGR3100 gene: VGAM1672 host target protein, VGAM1673 host target protein and VGAM1674 host target protein, herein schematically represented by VGAM1 HOST TARGET PROTEIN through VGAM3 HOST TARGET PROTEIN. The function of these host target genes is elaborated hereinabove with reference to VGAM1672, VGAM1673 and VGAM1674. FIG. 9 further provides a conceptual description of novel bioinformatically detected regulatory viral gene, referred to here as Viral Genomic Record 3101(VGR3101) viral gene, which encodes an 'operon-like' cluster of novel viral micro RNA-like genes, each of which in turn modulates expression of at least one host target gene, the function and utility of which at least one host target gene is known in the art.

VGR3101 gene, herein designated VGR GENE, is a novel bioinformatically detected regulatory, non protein coding, RNA viral gene. The method by which VGR3101 gene was detected is described hereinabove with reference to FIGS. 1-9.

VGR3101 gene encodes VGR3101 precursor RNA, herein designated VGR PRECURSOR RNA, an RNA molecule, typically several hundred nucleotides long.

VGR3101 precursor RNA folds spatially, forming VGR3101 folded precursor RNA, herein designated VGR FOLDED PRECURSOR RNA. It is appreciated that VGR3101 folded precursor RNA comprises a plurality of what is known in the art as 'hairpin' structures. These 'hairpin' structures are due to the fact that the nucleotide sequence of VGR3101 precursor RNA comprises a plurality of segments, the first half of each such segment having a nucleotide sequence which is at least a partial inversed-reversed sequence of the second half thereof, as is well known in the art.

VGR3101 folded precursor RNA is naturally processed by cellular enzymatic activity into at least 6 separate VGAM precursor RNAs, VGAM1675 precursor RNA, VGAM1676 precursor RNA, VGAM1677 precursor RNA, VGAM1678 precursor RNA, VGAM1679 precursor RNA and VGAM1680 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1675 RNA, VGAM1676 RNA, VGAM1677 RNA, VGAM1678 RNA, VGAM1679 RNA and VGAM1680 RNA, herein schematically represented by VGAM1 RNA through VGAM3 RNA, each of which VGAM RNAs corresponding to VGAM RNA of FIG. 1.

VGAM1675 RNA, herein schematically represented by VGAM1 RNA through VGAM3 RNA, binds complementarily to a host target binding site located in an untranslated region of VGAM1675 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1675 host target RNA into VGAM1675 host target protein, herein schematically represented by VGAM1 HOST TARGET PROTEIN through VGAM3 HOST TARGET PROTEIN, all of FIG. 1.

VGAM1676 RNA, herein schematically represented by VGAM1 RNA through VGAM3 RNA, binds complementarily to a host target binding site located in an untranslated region of VGAM1676 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1676 host target RNA into VGAM1676 host target protein, herein schematically represented by VGAM1 HOST TARGET PROTEIN through VGAM3 HOST TARGET PROTEIN, all of FIG. 1.

VGAM1677 RNA, herein schematically represented by VGAM1 RNA through VGAM3 RNA, binds complementarily to a host target binding site located in an untranslated region of VGAM1677 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1677 host target RNA into VGAM1677 host target protein, herein schematically represented by VGAM1 HOST TARGET PROTEIN through VGAM3 HOST TARGET PROTEIN, all of FIG. 1.

VGAM1678 RNA, herein schematically represented by VGAM1 RNA through VGAM3 RNA, binds complementarily to a host target binding site located in an untranslated region of VGAM1678 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1678 host target RNA into VGAM1678 host target protein, herein schematically represented by VGAM1 HOST TARGET PROTEIN through VGAM3 HOST TARGET PROTEIN, all of FIG. 1.

VGAM1679 RNA, herein schematically represented by VGAM1 RNA through VGAM3 RNA, binds complementarily to a host target binding site located in an untranslated region of VGAM1679 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1679 host target RNA into VGAM1679 host target protein, herein schematically represented by VGAM1 HOST TARGET PROTEIN through VGAM3 HOST TARGET PROTEIN, all of FIG. 1.

VGAM1680 RNA, herein schematically represented by VGAM1 RNA through VGAM3 RNA, binds complementarily to a host target binding site located in an untranslated region of VGAM1680 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1680 host target RNA into VGAM1680 host target protein, herein schematically represented by VGAM1 HOST TARGET PROTEIN through VGAM3 HOST TARGET PROTEIN, all of FIG. 1.

It is appreciated that a function of VGR3101 gene, herein designated VGR GENE, is inhibition of expression of host target genes, as part of a novel viral mechanism of attacking a host. Accordingly, utilities of VGR3101 gene include diagnosis, prevention and treatment of viral infection by Viral Hemorrhagic Sep.icemia Virus. Specific functions, and accordingly utilities, of VGR3101 gene correlate with, and may be deduced from, the identity of the host target genes, which are inhibited by VGAM RNAs comprised in the 'operon-like' cluster of VGR3101 gene: VGAM1675 host target protein, VGAM1676 host target protein, VGAM1677 host target protein, VGAM1678 host target protein, VGAM1679 host target protein and VGAM1680 host target protein, herein schematically represented by VGAM1 HOST TARGET PROTEIN through VGAM3 HOST TARGET PROTEIN. The function of these host target genes is elaborated hereinabove with reference to VGAM1675, VGAM1676, VGAM1677, VGAM1678, VGAM1679 and VGAM1680. FIG. 9 further provides a conceptual description of novel bioinformatically detected regulatory viral gene, referred to here as Viral Genomic Record 3102(VGR3102) viral gene, which encodes an 'operon-like' cluster of novel viral micro RNA-like genes, each of which in turn modulates expression of at least one host target gene, the function and utility of which at least one host target gene is known in the art.

VGR3102 gene, herein designated VGR GENE, is a novel bioinformatically detected regulatory, non protein coding, RNA viral gene. The method by which VGR3102 gene was detected is described hereinabove with reference to FIGS. 1-9.

VGR3102 gene encodes VGR3102 precursor RNA, herein designated VGR PRECURSOR RNA, an RNA molecule, typically several hundred nucleotides long.

VGR3102 precursor RNA folds spatially, forming VGR3102 folded precursor RNA, herein designated VGR FOLDED PRECURSOR RNA. It is appreciated that VGR3102 folded precursor RNA comprises a plurality of what is known in the art as 'hairpin' structures. These 'hairpin' structures are due to the fact that the nucleotide sequence of VGR3102 precursor RNA comprises a plurality of segments, the first half of each such segment having a nucleotide sequence which is at least a partial inversed-reversed sequence of the second half thereof, as is well known in the art.

VGR3102 folded precursor RNA is naturally processed by cellular enzymatic activity into at least 6 separate VGAM precursor RNAs, VGAM1681 precursor RNA, VGAM1682 precursor RNA, VGAM1683 precursor RNA, VGAM1684 precursor RNA, VGAM1685 precursor RNA and VGAM1686 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1681 RNA, VGAM1682 RNA, VGAM1683 RNA, VGAM1684 RNA, VGAM1685 RNA and VGAM1686 RNA, herein schematically represented by VGAM1 RNA through VGAM3 RNA, each of which VGAM RNAs corresponding to VGAM RNA of FIG. 1.

VGAM1681 RNA, herein schematically represented by VGAM1 RNA through VGAM3 RNA, binds complementarily to a host target binding site located in an untranslated region of VGAM1681 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1681 host target RNA into VGAM1681 host target protein, herein schematically represented by VGAM1 HOST TARGET PROTEIN through VGAM3 HOST TARGET PROTEIN, all of FIG. 1.

VGAM1682 RNA, herein schematically represented by VGAM1 RNA through VGAM3 RNA, binds complementarily to a host target binding site located in an untranslated region of VGAM1682 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1682 host target RNA into VGAM1682 host target protein, herein schematically represented by VGAM1 HOST TARGET PROTEIN through VGAM3 HOST TARGET PROTEIN, all of FIG. 1.

VGAM1683 RNA, herein schematically represented by VGAM1 RNA through VGAM3 RNA, binds complementarily to a host target binding site located in an untranslated region of VGAM1683 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1683 host target RNA into VGAM1683 host target protein, herein schematically represented by VGAM1 HOST TARGET PROTEIN through VGAM3 HOST TARGET PROTEIN, all of FIG. 1.

VGAM1684 RNA, herein schematically represented by VGAM1 RNA through VGAM3 RNA, binds complementarily to a host target binding site located in an untranslated region of VGAM1684 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1684 host target RNA into VGAM1684 host target protein, herein schematically represented by VGAM1 HOST TARGET PROTEIN through VGAM3 HOST TARGET PROTEIN, all of FIG. 1.

VGAM1685 RNA, herein schematically represented by VGAM1 RNA through VGAM3 RNA, binds complementarily to a host target binding site located in an untranslated region of VGAM1685 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1685 host target RNA into VGAM1685 host target protein, herein schematically represented by VGAM1 HOST TARGET PROTEIN through VGAM3 HOST TARGET PROTEIN, all of FIG. 1.

VGAM1686 RNA, herein schematically represented by VGAM1 RNA through VGAM3 RNA, binds complementarily to a host target binding site located in an untranslated region of VGAM1686 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1686 host target RNA into VGAM1686 host target protein, herein schematically represented by VGAM1 HOST TARGET PROTEIN through VGAM3 HOST TARGET PROTEIN, all of FIG. 1.

It is appreciated that a function of VGR3102 gene, herein designated VGR GENE, is inhibition of expression of host target genes, as part of a novel viral mechanism of attacking a host. Accordingly, utilities of VGR3102 gene include diagnosis, prevention and treatment of viral infection by Vesicular Stomatitis Indiana Virus. Specific functions, and accordingly utilities, of VGR3102 gene correlate with, and may be deduced from, the identity of the host target genes, which are inhibited by VGAM RNAs comprised in the 'operon-like' cluster of VGR3102 gene: VGAM1681 host target protein, VGAM1682 host target protein, VGAM1683 host target protein, VGAM1684 host target protein, VGAM1685 host target protein and VGAM1686 host target protein, herein schematically represented by VGAM1 HOST TARGET PROTEIN through VGAM3 HOST TARGET PROTEIN. The function of these host target genes is elaborated hereinabove with reference to VGAM1681, VGAM1682, VGAM1683, VGAM1684, VGAM1685 and VGAM1686. FIG. 9 further provides a conceptual description of novel bioinformatically detected regulatory viral gene, referred to here as Viral Genomic Record 3103(VGR3103) viral gene, which encodes an 'operon-like' cluster of novel viral micro RNA-like genes, each of which in turn modulates expression of at least one host target gene, the function and utility of which at least one host target gene is known in the art.

VGR3103 gene, herein designated VGR GENE, is a novel bioinformatically detected regulatory, non protein coding, RNA viral gene. The method by which VGR3103 gene was detected is described hereinabove with reference to FIGS. 1-9.

VGR3103 gene encodes VGR3103 precursor RNA, herein designated VGR PRECURSOR RNA, an RNA molecule, typically several hundred nucleotides long.

VGR3103 precursor RNA folds spatially, forming VGR3103 folded precursor RNA, herein designated VGR FOLDED PRECURSOR RNA. It is appreciated that VGR3103 folded precursor RNA comprises a plurality of what is known in the art as 'hairpin' structures. These 'hairpin' structures are due to the fact that the nucleotide sequence of VGR3103 precursor RNA comprises a plurality of segments, the first half of each such segment having a nucleotide sequence which is at least a partial inversed-reversed sequence of the second half thereof, as is well known in the art.

VGR3103 folded precursor RNA is naturally processed by cellular enzymatic activity into at least 3 separate VGAM precursor RNAs, VGAM1687 precursor RNA, VGAM1688 precursor RNA and VGAM1689 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1687 RNA, VGAM1688 RNA and VGAM1689 RNA, herein schematically represented by VGAM1 RNA through VGAM3 RNA, each of which VGAM RNAs corresponding to VGAM RNA of FIG. 1.

VGAM1687 RNA, herein schematically represented by VGAM1 RNA through VGAM3 RNA, binds complementarily to a host target binding site located in an untranslated region of VGAM1687 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1687 host target RNA into VGAM1687 host target protein, herein schematically represented by VGAM1 HOST TARGET PROTEIN through VGAM3 HOST TARGET PROTEIN, all of FIG. 1.

VGAM1688 RNA, herein schematically represented by VGAM1 RNA through VGAM3 RNA, binds complementarily to a host target binding site located in an untranslated region of VGAM1688 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1688 host target RNA into VGAM1688 host target protein, herein schematically represented by VGAM1 HOST TARGET PROTEIN through VGAM3 HOST TARGET PROTEIN, all of FIG. 1.

VGAM1689 RNA, herein schematically represented by VGAM1 RNA through VGAM3 RNA, binds complementarily to a host target binding site located in an untranslated region of VGAM1689 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1689 host target RNA into VGAM1689 host target protein, herein schematically represented by VGAM1 HOST TARGET PROTEIN through VGAM3 HOST TARGET PROTEIN, all of FIG. 1.

It is appreciated that a function of VGR3103 gene, herein designated VGR GENE, is inhibition of expression of host target genes, as part of a novel viral mechanism of attacking a host. Accordingly, utilities of VGR3103 gene include diagnosis, prevention and treatment of viral infection by Chimpanzee Cytomegalovirus. Specific functions, and accordingly utilities, of VGR3103 gene correlate with, and may be deduced from, the identity of the host target genes, which are inhibited by VGAM RNAs comprised in the 'operon-like' cluster of VGR3103 gene: VGAM1687 host target protein, VGAM1688 host target protein and VGAM1689 host target protein, herein schematically represented by VGAM1 HOST TARGET PROTEIN through VGAM3 HOST TARGET PROTEIN. The function of these host target genes is elaborated hereinabove with reference to VGAM1687, VGAM1688 and VGAM1689. FIG. 9 further provides a conceptual description of novel bioinformatically detected regulatory viral gene, referred to here as Viral Genomic Record 3104(VGR3104) viral gene, which encodes an 'operon-like' cluster of novel viral micro RNA-like genes, each of which in turn modulates expression of at least one host target gene, the function and utility of which at least one host target gene is known in the art.

VGR3104 gene, herein designated VGR GENE, is a novel bioinformatically detected regulatory, non protein coding, RNA viral gene. The method by which VGR3104 gene was detected is described hereinabove with reference to FIGS. 1-9.

VGR3104 gene encodes VGR3104 precursor RNA, herein designated VGR PRECURSOR RNA, an RNA molecule, typically several hundred nucleotides long.

VGR3104 precursor RNA folds spatially, forming VGR3104 folded precursor RNA, herein designated VGR FOLDED PRECURSOR RNA. It is appreciated that VGR3104 folded precursor RNA comprises a plurality of what is known in the art as 'hairpin' structures. These 'hairpin' structures are due to the fact that the nucleotide sequence of VGR3104 precursor RNA comprises a plurality of segments, the first half of each such segment having a nucleotide sequence which is at least a partial inversed-reversed sequence of the second half thereof, as is well known in the art.

VGR3104 folded precursor RNA is naturally processed by cellular enzymatic activity into at least 8 separate VGAM precursor RNAs, VGAM1690 precursor RNA, VGAM1691 precursor RNA, VGAM1692 precursor RNA, VGAM1693 precursor RNA, VGAM1694 precursor RNA, VGAM1695 precursor RNA, VGAM1696 precursor RNA and VGAM1697 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1690 RNA, VGAM1691 RNA, VGAM1692 RNA, VGAM1693 RNA, VGAM1694 RNA, VGAM1695 RNA, VGAM1696 RNA and VGAM1697 RNA, herein schematically represented by VGAM1 RNA through VGAM3 RNA, each of which VGAM RNAs corresponding to VGAM RNA of FIG. 1.

VGAM1690 RNA, herein schematically represented by VGAM1 RNA through VGAM3 RNA, binds complementarily to a host target binding site located in an untranslated region of VGAM1690 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1690 host target RNA into VGAM1690 host target protein, herein schematically represented by VGAM1 HOST TARGET PROTEIN through VGAM3 HOST TARGET PROTEIN, all of FIG. 1.

VGAM1691 RNA, herein schematically represented by VGAM1 RNA through VGAM3 RNA, binds complementarily to a host target binding site located in an untranslated region of VGAM1691 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1691 host target RNA into VGAM1691 host target protein, herein schematically represented by VGAM1 HOST TARGET PROTEIN through VGAM3 HOST TARGET PROTEIN, all of FIG. 1.

VGAM1692 RNA, herein schematically represented by VGAM1 RNA through VGAM3 RNA, binds complementarily to a host target binding site located in an untranslated region of VGAM1692 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1692 host target RNA into VGAM1692 host target protein, herein schematically represented by VGAM1 HOST TARGET PROTEIN through VGAM3 HOST TARGET PROTEIN, all of FIG. 1.

VGAM1693 RNA, herein schematically represented by VGAM1 RNA through VGAM3 RNA, binds complementarily to a host target binding site located in an untranslated region of VGAM1693 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1693 host target RNA into VGAM1693 host target protein, herein schematically represented by VGAM1 HOST TARGET PROTEIN through VGAM3 HOST TARGET PROTEIN, all of FIG. 1.

VGAM1694 RNA, herein schematically represented by VGAM1 RNA through VGAM3 RNA, binds complementarily to a host target binding site located in an untranslated region of VGAM1694 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1694 host target RNA into VGAM1694 host target protein, herein schematically represented by VGAM1 HOST TARGET PROTEIN through VGAM3 HOST TARGET PROTEIN, all of FIG. 1.

VGAM1695 RNA, herein schematically represented by VGAM1 RNA through VGAM3 RNA, binds complementarily to a host target binding site located in an untranslated region of VGAM1695 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1695 host target RNA into VGAM1695 host target protein, herein schematically represented by VGAM1 HOST TARGET PROTEIN through VGAM3 HOST TARGET PROTEIN, all of FIG. 1.

VGAM1696 RNA, herein schematically represented by VGAM1 RNA through VGAM3 RNA, binds complementarily to a host target binding site located in an untranslated region of VGAM1696 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1696 host target RNA into VGAM1696 host target protein, herein schematically represented by VGAM1 HOST TARGET PROTEIN through VGAM3 HOST TARGET PROTEIN, all of FIG. 1.

VGAM1697 RNA, herein schematically represented by VGAM1 RNA through VGAM3 RNA, binds complementarily to a host target binding site located in an untranslated region of VGAM1697 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1697 host target RNA into VGAM1697 host target protein, herein schematically represented by VGAM1 HOST TARGET PROTEIN through VGAM3 HOST TARGET PROTEIN, all of FIG. 1.

It is appreciated that a function of VGR3104 gene, herein designated VGR GENE, is inhibition of expression of host target genes, as part of a novel viral mechanism of attacking a host. Accordingly, utilities of VGR3104 gene include diagnosis, prevention and treatment of viral infection by Ectocarpus Siliculosus Virus. Specific functions, and accordingly utilities, of VGR3104 gene correlate with, and may be deduced from, the identity of the host target genes, which are inhibited by VGAM RNAs comprised in the 'operon-like' cluster of VGR3104 gene: VGAM1690 host target protein, VGAM1691 host target protein, VGAM1692 host target protein, VGAM1693 host target protein, VGAM1694 host target protein, VGAM1695 host target protein, VGAM1696 host target protein and VGAM1697 host target protein, herein schematically represented by VGAM1 HOST TARGET PROTEIN through VGAM3 HOST TARGET PROTEIN. The function of these host target genes is elaborated hereinabove with reference to VGAM1690, VGAM1691, VGAM1692, VGAM1693, VGAM1694, VGAM1695, VGAM1696 and VGAM1697. FIG. 9 further provides a conceptual description of novel bioinformatically detected regulatory viral gene, referred to here as Viral Genomic Record 3105(VGR3105) viral gene, which encodes an 'operon-like' cluster of novel viral micro RNA-like genes, each of which in turn modulates expression of at least one host target gene, the function and utility of which at least one host target gene is known in the art.

VGR3105 gene, herein designated VGR GENE, is a novel bioinformatically detected regulatory, non protein coding, RNA viral gene. The method by which VGR3105 gene was detected is described hereinabove with reference to FIGS. 1-9.

VGR3105 gene encodes VGR3105 precursor RNA, herein designated VGR PRECURSOR RNA, an RNA molecule, typically several hundred nucleotides long.

VGR3105 precursor RNA folds spatially, forming VGR3105 folded precursor RNA, herein designated VGR FOLDED PRECURSOR RNA. It is appreciated that VGR3105 folded precursor RNA comprises a plurality of what is known in the art as 'hairpin' structures. These 'hairpin' structures are due to the fact that the nucleotide sequence of VGR3105 precursor RNA comprises a plurality of segments, the first half of each such segment having a nucleotide sequence which is at least a partial inversed-reversed sequence of the second half thereof, as is well known in the art.

VGR3105 folded precursor RNA is naturally processed by cellular enzymatic activity into at least 8 separate VGAM precursor RNAs, VGAM1698 precursor RNA, VGAM1699 precursor RNA, VGAM1700 precursor RNA, VGAM1701 precursor RNA, VGAM1702 precursor RNA, VGAM1703 precursor RNA, VGAM1704 precursor RNA and VGAM1705 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1698 RNA, VGAM1699 RNA, VGAM1700 RNA, VGAM1701 RNA, VGAM1702 RNA, VGAM1703 RNA, VGAM1704 RNA and VGAM1705 RNA, herein schematically represented by VGAM1 RNA through VGAM3 RNA, each of which VGAM RNAs corresponding to VGAM RNA of FIG. 1.

VGAM1698 RNA, herein schematically represented by VGAM1 RNA through VGAM3 RNA, binds complementarily to a host target binding site located in an untranslated region of VGAM1698 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1698 host target RNA into VGAM1698 host target protein, herein schematically represented by VGAM1 HOST TARGET PROTEIN through VGAM3 HOST TARGET PROTEIN, all of FIG. 1.

VGAM1699 RNA, herein schematically represented by VGAM1 RNA through VGAM3 RNA, binds complementarily to a host target binding site located in an untranslated region of VGAM1699 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1699 host target RNA into VGAM1699 host target protein, herein schematically represented by VGAM1 HOST TARGET PROTEIN through VGAM3 HOST TARGET PROTEIN, all of FIG. 1.

VGAM1700 RNA, herein schematically represented by VGAM1 RNA through VGAM3 RNA, binds complementarily to a host target binding site located in an untranslated region of VGAM1700 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1700 host target RNA into VGAM1700 host target protein, herein schematically represented by VGAM1 HOST TARGET PROTEIN through VGAM3 HOST TARGET PROTEIN, all of FIG. 1.

VGAM1701 RNA, herein schematically represented by VGAM1 RNA through VGAM3 RNA, binds complementarily to a host target binding site located in an untranslated region of VGAM1701 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1701 host target RNA into VGAM1701 host target protein, herein schematically represented by VGAM1 HOST TARGET PROTEIN through VGAM3 HOST TARGET PROTEIN, all of FIG. 1.

VGAM1702 RNA, herein schematically represented by VGAM1 RNA through VGAM3 RNA, binds complementarily to a host target binding site located in an untranslated region of VGAM1702 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1702 host target RNA into VGAM1702 host target protein, herein schematically represented by VGAM1 HOST TARGET PROTEIN through VGAM3 HOST TARGET PROTEIN, all of FIG. 1.

VGAM1703 RNA, herein schematically represented by VGAM1 RNA through VGAM3 RNA, binds complementarily to a host target binding site located in an untranslated region of VGAM1703 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1703 host target RNA into VGAM1703 host target protein, herein schematically represented by VGAM1 HOST TARGET PROTEIN through VGAM3 HOST TARGET PROTEIN, all of FIG. 1.

VGAM1704 RNA, herein schematically represented by VGAM1 RNA through VGAM3 RNA, binds complementarily to a host target binding site located in an untranslated region of VGAM1704 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1704 host target RNA into VGAM1704 host target protein, herein schematically represented by VGAM1 HOST TARGET PROTEIN through VGAM3 HOST TARGET PROTEIN, all of FIG. 1.

VGAM1705 RNA, herein schematically represented by VGAM1 RNA through VGAM3 RNA, binds complementarily to a host target binding site located in an untranslated region of VGAM1705 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1705 host target RNA into VGAM1705 host target protein, herein schematically represented by VGAM1 HOST TARGET PROTEIN through VGAM3 HOST TARGET PROTEIN, all of FIG. 1.

It is appreciated that a function of VGR3105 gene, herein designated VGR GENE, is inhibition of expression of host target genes, as part of a novel viral mechanism of attacking a host. Accordingly, utilities of VGR3105 gene include diagnosis, prevention and treatment of viral infection by Ectocarpus Siliculosus Virus. Specific functions, and accordingly utilities, of VGR3105 gene correlate with, and may be deduced from, the identity of the host target genes, which are inhibited by VGAM RNAs comprised in the 'operon-like' cluster of VGR3105 gene: VGAM1698 host target protein, VGAM1699 host target protein, VGAM1700 host target protein, VGAM1701 host target protein, VGAM1702 host target protein, VGAM1703 host target protein, VGAM1704 host target protein and VGAM1705 host target protein, herein schematically represented by VGAM1 HOST TARGET PROTEIN through VGAM3 HOST TARGET PROTEIN. The function of these host target genes is elaborated hereinabove with reference to VGAM1698, VGAM1699, VGAM1700, VGAM1701, VGAM1702, VGAM1703, VGAM1704 and VGAM1705. FIG. 9 further provides a conceptual description of novel bioinformatically detected regulatory viral gene, referred to here as Viral Genomic Record 3106(VGR3106) viral gene, which encodes an 'operon-like' cluster of novel viral micro RNA-like genes, each of which in turn modulates expression of at least one host target gene, the function and utility of which at least one host target gene is known in the art.

VGR3106 gene, herein designated VGR GENE, is a novel bioinformatically detected regulatory, non protein coding, RNA viral gene. The method by which VGR3106 gene was detected is described hereinabove with reference to FIGS. 1-9.

VGR3106 gene encodes VGR3106 precursor RNA, herein designated VGR PRECURSOR RNA, an RNA molecule, typically several hundred nucleotides long.

VGR3106 precursor RNA folds spatially, forming VGR3106 folded precursor RNA, herein designated VGR FOLDED PRECURSOR RNA. It is appreciated that VGR3106 folded precursor RNA comprises a plurality of what is known in the art as 'hairpin' structures. These 'hairpin' structures are due to the fact that the nucleotide sequence of VGR3106 precursor RNA comprises a plurality of segments, the first half of each such segment having a nucleotide sequence which is at least a partial inversed-reversed sequence of the second half thereof, as is well known in the art.

VGR3106 folded precursor RNA is naturally processed by cellular enzymatic activity into at least 2 separate VGAM precursor RNAs, VGAM1706 precursor RNA and VGAM1707 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1706 RNA and VGAM1707 RNA, herein schematically represented by VGAM1 RNA through VGAM3 RNA, each of which VGAM RNAs corresponding to VGAM RNA of FIG. 1.

VGAM1706 RNA, herein schematically represented by VGAM1 RNA through VGAM3 RNA, binds complementarily to a host target binding site located in an untranslated region of VGAM1706 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1706 host target RNA into VGAM1706 host target protein, herein schematically represented by VGAM1 HOST TARGET PROTEIN through VGAM3 HOST TARGET PROTEIN, all of FIG. 1.

VGAM1707 RNA, herein schematically represented by VGAM1 RNA through VGAM3 RNA, binds complementarily to a host target binding site located in an untranslated region of VGAM1707 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1707 host target RNA into VGAM1707 host target protein, herein schematically represented by VGAM1 HOST TARGET PROTEIN through VGAM3 HOST TARGET PROTEIN, all of FIG. 1.

It is appreciated that a function of VGR3106 gene, herein designated VGR GENE, is inhibition of expression of host target genes, as part of a novel viral mechanism of attacking a host. Accordingly, utilities of VGR3106 gene include diagnosis, prevention and treatment of viral infection by Ectocarpus Siliculosus Virus. Specific functions, and accordingly utilities, of VGR3106 gene correlate with, and may be deduced from, the identity of the host target genes, which are inhibited by VGAM RNAs comprised in the 'operon-like' cluster of VGR3106 gene: VGAM1706 host target protein and VGAM1707 host target protein, herein schematically represented by VGAM1 HOST TARGET PROTEIN through VGAM3 HOST TARGET PROTEIN. The function of these host target genes is elaborated hereinabove with reference to VGAM1706 and VGAM1707. FIG. 9 further provides a conceptual description of novel bioinformatically detected regulatory viral gene, referred to here as Viral Genomic Record 3107(VGR3107) viral gene, which encodes an 'operon-like' cluster of novel viral micro RNA-like genes, each of which in turn modulates expression of at least one host target gene, the function and utility of which at least one host target gene is known in the art.

VGR3107 gene, herein designated VGR GENE, is a novel bioinformatically detected regulatory, non protein coding, RNA viral gene. The method by which VGR3107 gene was detected is described hereinabove with reference to FIGS. 1-9.

VGR3107 gene encodes VGR3107 precursor RNA, herein designated VGR PRECURSOR RNA, an RNA molecule, typically several hundred nucleotides long.

VGR3107 precursor RNA folds spatially, forming VGR3107 folded precursor RNA, herein designated VGR FOLDED PRECURSOR RNA. It is appreciated that VGR3107 folded precursor RNA comprises a plurality of what is known in the art as 'hairpin' structures. These 'hairpin' structures are due to the fact that the nucleotide sequence of VGR3107 precursor RNA comprises a plurality of segments, the first half of each such segment having a nucleotide sequence which is at least a partial inversed-reversed sequence of the second half thereof, as is well known in the art.

VGR3107 folded precursor RNA is naturally processed by cellular enzymatic activity into at least 3 separate VGAM precursor RNAs, VGAM1709 precursor RNA, VGAM1710 precursor RNA and VGAM1711 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1709 RNA, VGAM1710 RNA and VGAM1711 RNA, herein schematically represented by VGAM1 RNA through VGAM3 RNA, each of which VGAM RNAs corresponding to VGAM RNA of FIG. 1.

VGAM1709 RNA, herein schematically represented by VGAM1 RNA through VGAM3 RNA, binds complementarily to a host target binding site located in an untranslated region of VGAM1709 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1709 host target RNA into VGAM1709 host target protein, herein schematically represented by VGAM1 HOST TARGET PROTEIN through VGAM3 HOST TARGET PROTEIN, all of FIG. 1.

VGAM1710 RNA, herein schematically represented by VGAM1 RNA through VGAM3 RNA, binds complementarily to a host target binding site located in an untranslated region of VGAM1710 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1710 host target RNA into VGAM1710 host target protein, herein schematically represented by VGAM1 HOST TARGET PROTEIN through VGAM3 HOST TARGET PROTEIN, all of FIG. 1.

VGAM1711 RNA, herein schematically represented by VGAM1 RNA through VGAM3 RNA, binds complementarily to a host target binding site located in an untranslated region of VGAM1711 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1711 host target RNA into VGAM1711 host target protein, herein schematically represented by VGAM1 HOST TARGET PROTEIN through VGAM3 HOST TARGET PROTEIN, all of FIG. 1.

It is appreciated that a function of VGR3107 gene, herein designated VGR GENE, is inhibition of expression of host target genes, as part of a novel viral mechanism of attacking a host. Accordingly, utilities of VGR3107 gene include diagnosis, prevention and treatment of viral infection by Semliki Forest Virus. Specific functions, and accordingly utilities, of VGR3107 gene correlate with, and may be deduced from, the identity of the host target genes, which are inhibited by VGAM RNAs comprised in the 'operon-like' cluster of VGR3107 gene: VGAM1709 host target protein, VGAM1710 host target protein and VGAM1711 host target protein, herein schematically represented by VGAM1 HOST TARGET PROTEIN through VGAM3 HOST TARGET PROTEIN. The function of these host target genes is elaborated hereinabove with reference to VGAM1709, VGAM1710 and VGAM1711. FIG. 9 further provides a conceptual description of novel bioinformatically detected regulatory viral gene, referred to here as Viral Genomic Record 3108(VGR3108) viral gene, which encodes an 'operon-like' cluster of novel viral micro RNA-like genes, each of which in turn modulates expression of at least one host target gene, the function and utility of which at least one host target gene is known in the art.

VGR3108 gene, herein designated VGR GENE, is a novel bioinformatically detected regulatory, non protein coding, RNA viral gene. The method by which VGR3108 gene was detected is described hereinabove with reference to FIGS. 1-9.

VGR3108 gene encodes VGR3108 precursor RNA, herein designated VGR PRECURSOR RNA, an RNA molecule, typically several hundred nucleotides long.

VGR3108 precursor RNA folds spatially, forming VGR3108 folded precursor RNA, herein designated VGR FOLDED PRECURSOR RNA. It is appreciated that VGR3108 folded precursor RNA comprises a plurality of what is known in the art as 'hairpin' structures. These 'hairpin' structures are due to the fact that the nucleotide sequence of VGR3108 precursor RNA comprises a plurality of segments, the first half of each such segment having a nucleotide sequence which is at least a partial inversed-reversed sequence of the second half thereof, as is well known in the art.

VGR3108 folded precursor RNA is naturally processed by cellular enzymatic activity into at least 5 separate VGAM precursor RNAs, VGAM1712 precursor RNA, VGAM1713 precursor RNA, VGAM1714 precursor RNA, VGAM1715 precursor RNA and VGAM1716 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1712 RNA, VGAM1713 RNA, VGAM1714 RNA, VGAM1715 RNA and VGAM1716 RNA, herein schematically represented by VGAM1 RNA through VGAM3 RNA, each of which VGAM RNAs corresponding to VGAM RNA of FIG. 1.

VGAM1712 RNA, herein schematically represented by VGAM1 RNA through VGAM3 RNA, binds complementarily to a host target binding site located in an untranslated region of VGAM1712 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1712 host target RNA into VGAM1712 host target protein, herein schematically represented by VGAM1 HOST TARGET PROTEIN through VGAM3 HOST TARGET PROTEIN, all of FIG. 1.

VGAM1713 RNA, herein schematically represented by VGAM1 RNA through VGAM3 RNA, binds complementarily to a host target binding site located in an untranslated region of VGAM1713 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1713 host target RNA into VGAM1713 host target protein, herein schematically represented by VGAM1 HOST TARGET PROTEIN through VGAM3 HOST TARGET PROTEIN, all of FIG. 1.

VGAM1714 RNA, herein schematically represented by VGAM1 RNA through VGAM3 RNA, binds complementarily to a host target binding site located in an untranslated region of VGAM1714 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1714 host target RNA into VGAM1714 host target protein, herein schematically represented by VGAM1 HOST TARGET PROTEIN through VGAM3 HOST TARGET PROTEIN, all of FIG. 1.

VGAM1715 RNA, herein schematically represented by VGAM1 RNA through VGAM3 RNA, binds complementarily to a host target binding site located in an untranslated region of VGAM1715 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1715 host target RNA into VGAM1715 host target protein, herein schematically represented by VGAM1 HOST TARGET PROTEIN through VGAM3 HOST TARGET PROTEIN, all of FIG. 1.

VGAM1716 RNA, herein schematically represented by VGAM1 RNA through VGAM3 RNA, binds complementarily to a host target binding site located in an untranslated region of VGAM1716 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM1716 host target RNA into VGAM1716 host target protein, herein schematically represented by VGAM1 HOST TARGET PROTEIN through VGAM3 HOST TARGET PROTEIN, all of FIG. 1.

It is appreciated that a function of VGR3108 gene, herein designated VGR GENE, is inhibition of expression of host target genes, as part of a novel viral mechanism of attacking a host. Accordingly, utilities of VGR3108 gene include diagnosis, prevention and treatment of viral infection by Sindbis Virus. Specific functions, and accordingly utilities, of VGR3108 gene correlate with, and may be deduced from, the identity of the host target genes, which are inhibited by VGAM RNAs comprised in the 'operon-like' cluster of VGR3108 gene: VGAM1712 host target protein, VGAM1713 host target protein, VGAM1714 host target protein, VGAM1715 host target protein and VGAM1716 host target protein, herein schematically represented by VGAM1 HOST TARGET PROTEIN through VGAM3 HOST TARGET PROTEIN. The function of these host target genes is elaborated hereinabove with reference to VGAM1712, VGAM1713, VGAM1714, VGAM1715 and VGAM1716. FIG. 9 further provides a conceptual description of novel bioinformatically detected regulatory viral gene, referred to here as Viral Genomic Record 3109(VGR3109) viral gene, which encodes an 'operon-like' cluster of novel viral micro RNA-like genes, each of which in turn modulates expression of at least one host target gene, the function and utility of which at least one host target gene is known in the art.

VGR3109 gene, herein designated VGR GENE, is a novel bioinformatically detected regulatory, non protein coding, RNA viral gene. The method by which VGR3109 gene was detected is described hereinabove with reference to FIGS. 1-9.

VGR3109 gene encodes VGR3109 precursor RNA, herein designated VGR PRECURSOR RNA, an RNA molecule, typically several hundred nucleotides long.

VGR3109 precursor RNA folds spatially, forming VGR3109 folded precursor RNA, herein designated VGR FOLDED PRECURSOR RNA. It is appreciated that VGR3109 folded precursor RNA comprises a plurality of what is known in the art as 'hairpin' structures. These 'hairpin' structures are due to the fact that the nucleotide sequence of VGR3109 precursor RNA comprises a plurality of segments, the first half of each such segment having a nucleotide sequence which is at least a partial inversed-reversed sequence of the second half thereof, as is well known in the art.

VGR3109 folded precursor RNA is naturally processed by cellular enzymatic activity into at least 2 separate VGAM precursor RNAs, VGAM1717 precursor RNA and VGAM1718 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1717 RNA and VGAM1718 RNA, herein schematically represented by VGAM1 RNA through VGAM3 RNA, each of which VGAM RNAs corresponding to VGAM RNA of FIG. 1.

VGAM1717 RNA, herein schematically represented by VGAM1 RNA through VGAM3 RNA, binds complementarily to a host target binding site located in an untranslated region of VGAM1717 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1717 host target RNA into VGAM1717 host target protein, herein schematically represented by VGAM1 HOST TARGET PROTEIN through VGAM3 HOST TARGET PROTEIN, all of FIG. 1.

VGAM1718 RNA, herein schematically represented by VGAM1 RNA through VGAM3 RNA, binds complementarily to a host target binding site located in an untranslated region of VGAM1718 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1718 host target RNA into VGAM1718 host target protein, herein schematically represented by VGAM1 HOST TARGET PROTEIN through VGAM3 HOST TARGET PROTEIN, all of FIG. 1.

It is appreciated that a function of VGR3109 gene, herein designated VGR GENE, is inhibition of expression of host target genes, as part of a novel viral mechanism of attacking a host. Accordingly, utilities of VGR3109 gene include diagnosis, prevention and treatment of viral infection by Molluscum Contagiosum Virus. Specific functions, and accordingly utilities, of VGR3109 gene correlate with, and may be deduced from, the identity of the host target genes, which are inhibited by VGAM RNAs comprised in the 'operon-like' cluster of VGR3109 gene: VGAM1717 host target protein and VGAM1718 host target protein, herein schematically represented by VGAM1 HOST TARGET PROTEIN through VGAM3 HOST TARGET PROTEIN. The function of these host target genes is elaborated hereinabove with reference to VGAM1717 and VGAM1718. FIG. 9 further provides a conceptual description of novel bioinformatically detected regulatory viral gene, referred to here as Viral Genomic Record 3110(VGR3110) viral gene, which encodes an 'operon-like' cluster of novel viral micro RNA-like genes, each of which in turn modulates expression of at least one host target gene, the function and utility of which at least one host target gene is known in the art.

VGR3110 gene, herein designated VGR GENE, is a novel bioinformatically detected regulatory, non protein coding, RNA viral gene. The method by which VGR3110 gene was detected is described hereinabove with reference to FIGS. 1-9.

VGR3110 gene encodes VGR3110 precursor RNA, herein designated VGR PRECURSOR RNA, an RNA molecule, typically several hundred nucleotides long.

VGR3110 precursor RNA folds spatially, forming VGR3110 folded precursor RNA, herein designated VGR FOLDED PRECURSOR RNA. It is appreciated that VGR3110 folded precursor RNA comprises a plurality of what is known in the art as 'hairpin' structures. These 'hairpin' structures are due to the fact that the nucleotide sequence of VGR3110 precursor RNA comprises a plurality of segments, the first half of each such segment having a nucleotide sequence which is at least a partial inversed-reversed sequence of the second half thereof, as is well known in the art.

VGR3110 folded precursor RNA is naturally processed by cellular enzymatic activity into at least 2 separate VGAM precursor RNAs, VGAM1719 precursor RNA and VGAM1720 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1719 RNA and VGAM1720 RNA, herein schematically represented by VGAM1 RNA through VGAM3 RNA, each of which VGAM RNAs corresponding to VGAM RNA of FIG. 1.

VGAM1719 RNA, herein schematically represented by VGAM1 RNA through VGAM3 RNA, binds complementarily to a host target binding site located in an untranslated region of VGAM1719 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1719 host target RNA into VGAM1719 host target protein, herein schematically represented by VGAM1 HOST TARGET PROTEIN through VGAM3 HOST TARGET PROTEIN, all of FIG. 1.

VGAM1720 RNA, herein schematically represented by VGAM1 RNA through VGAM3 RNA, binds complementarily to a host target binding site located in an untranslated region of VGAM1720 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1720 host target RNA into VGAM1720 host target protein, herein schematically represented by VGAM1 HOST TARGET PROTEIN through VGAM3 HOST TARGET PROTEIN, all of FIG. 1.

It is appreciated that a function of VGR3110 gene, herein designated VGR GENE, is inhibition of expression of host target genes, as part of a novel viral mechanism of attacking a host. Accordingly, utilities of VGR3110 gene include diagnosis, prevention and treatment of viral infection by Rat Cytomegalovirus. Specific functions, and accordingly utilities, of VGR3110 gene correlate with, and may be deduced from, the identity of the host target genes, which are inhibited by VGAM RNAs comprised in the 'operon-like' cluster of VGR3110 gene: VGAM1719 host target protein and VGAM1720 host target protein, herein schematically represented by VGAM1 HOST TARGET PROTEIN through VGAM3 HOST TARGET PROTEIN. The function of these host target genes is elaborated hereinabove with reference to VGAM1719 and VGAM1720. FIG. 9 further provides a conceptual description of novel bioinformatically detected regulatory viral gene, referred to here as Viral Genomic Record 3111(VGR3111) viral gene, which encodes an 'operon-like' cluster of novel viral micro RNA-like genes, each of which in turn modulates expression of at least one host target gene, the function and utility of which at least one host target gene is known in the art.

VGR3111 gene, herein designated VGR GENE, is a novel bioinformatically detected regulatory, non protein coding, RNA viral gene. The method by which VGR3111 gene was detected is described hereinabove with reference to FIGS. 1-9.

VGR3111 gene encodes VGR3111 precursor RNA, herein designated VGR PRECURSOR RNA, an RNA molecule, typically several hundred nucleotides long.

VGR3111 precursor RNA folds spatially, forming VGR3111 folded precursor RNA, herein designated VGR FOLDED PRECURSOR RNA. It is appreciated that VGR3111 folded precursor RNA comprises a plurality of what is known in the art as 'hairpin' structures. These 'hairpin' structures are due to the fact that the nucleotide sequence of VGR3111 precursor RNA comprises a plurality of segments, the first half of each such segment having a nucleotide sequence which is at least a partial inversed-reversed sequence of the second half thereof, as is well known in the art.

VGR3111 folded precursor RNA is naturally processed by cellular enzymatic activity into at least 3 separate VGAM precursor RNAs, VGAM1721 precursor RNA, VGAM1722 precursor RNA and VGAM1723 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1721 RNA, VGAM1722 RNA and VGAM1723 RNA, herein schematically represented by VGAM1 RNA through VGAM3 RNA, each of which VGAM RNAs corresponding to VGAM RNA of FIG. 1.

VGAM1721 RNA, herein schematically represented by VGAM1 RNA through VGAM3 RNA, binds complementarily to a host target binding site located in an untranslated region of VGAM1721 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1721 host target RNA into VGAM1721 host target protein, herein schematically represented by VGAM1 HOST TARGET PROTEIN through VGAM3 HOST TARGET PROTEIN, all of FIG. 1.

VGAM1722 RNA, herein schematically represented by VGAM1 RNA through VGAM3 RNA, binds complementarily to a host target binding site located in an untranslated region of VGAM1722 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1722 host target RNA into VGAM1722 host target protein, herein schematically represented by VGAM1 HOST TARGET PROTEIN through VGAM3 HOST TARGET PROTEIN, all of FIG. 1.

VGAM1723 RNA, herein schematically represented by VGAM1 RNA through VGAM3 RNA, binds complementarily to a host target binding site located in an untranslated region of VGAM1723 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1723 host target RNA into VGAM1723 host target protein, herein schematically represented by VGAM1 HOST TARGET PROTEIN through VGAM3 HOST TARGET PROTEIN, all of FIG. 1.

It is appreciated that a function of VGR3111 gene, herein designated VGR GENE, is inhibition of expression of host target genes, as part of a novel viral mechanism of attacking a host. Accordingly, utilities of VGR3111 gene include diagnosis, prevention and treatment of viral infection by Myxoma Virus. Specific functions, and accordingly utilities, of VGR3111 gene correlate with, and may be deduced from, the identity of the host target genes, which are inhibited by VGAM RNAs comprised in the 'operon-like' cluster of VGR3111 gene: VGAM1721 host target protein, VGAM1722 host target protein and VGAM1723 host target protein, herein schematically represented by VGAM1 HOST TARGET PROTEIN through VGAM3 HOST TARGET PROTEIN. The function of these host target genes is elaborated hereinabove with reference to VGAM1721, VGAM1722 and VGAM1723. FIG. 9 further provides a conceptual description of novel bioinformatically detected regulatory viral gene, referred to here as Viral Genomic Record 3112(VGR3112) viral gene, which encodes an 'operon-like' cluster of novel viral micro RNA-like genes, each of which in turn modulates expression of at least one host target gene, the function and utility of which at least one host target gene is known in the art.

VGR3112 gene, herein designated VGR GENE, is a novel bioinformatically detected regulatory, non protein coding, RNA viral gene. The method by which VGR3112 gene was detected is described hereinabove with reference to FIGS. 1-9.

VGR3112 gene encodes VGR3112 precursor RNA, herein designated VGR PRECURSOR RNA, an RNA molecule, typically several hundred nucleotides long.

VGR3112 precursor RNA folds spatially, forming VGR3112 folded precursor RNA, herein designated VGR FOLDED PRECURSOR RNA. It is appreciated that VGR3112 folded precursor RNA comprises a plurality of what is known in the art as 'hairpin' structures. These 'hairpin' structures are due to the fact that the nucleotide sequence of VGR3112 precursor RNA comprises a plurality of segments, the first half of each such segment having a nucleotide sequence which is at least a partial inversed-reversed sequence of the second half thereof, as is well known in the art.

VGR3112 folded precursor RNA is naturally processed by cellular enzymatic activity into at least 7 separate VGAM precursor RNAs, VGAM1724 precursor RNA, VGAM1725 precursor RNA, VGAM1726 precursor RNA, VGAM1727 precursor RNA, VGAM1728 precursor RNA, VGAM1729 precursor RNA and VGAM1730 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1724 RNA, VGAM1725 RNA, VGAM1726 RNA, VGAM1727 RNA, VGAM1728 RNA, VGAM1729 RNA and VGAM1730 RNA, herein schematically represented by VGAM1 RNA through VGAM3 RNA, each of which VGAM RNAs corresponding to VGAM RNA of FIG. 1.

VGAM1724 RNA, herein schematically represented by VGAM1 RNA through VGAM3 RNA, binds complementarily to a host target binding site located in an untranslated region of VGAM1724 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1724 host target RNA into VGAM1724 host target protein, herein schematically represented by VGAM1 HOST TARGET PROTEIN through VGAM3 HOST TARGET PROTEIN, all of FIG. 1.

VGAM1725 RNA, herein schematically represented by VGAM1 RNA through VGAM3 RNA, binds complementarily to a host target binding site located in an untranslated region of VGAM1725 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1725 host target RNA into VGAM1725 host target protein, herein schematically represented by VGAM1 HOST TARGET PROTEIN through VGAM3 HOST TARGET PROTEIN, all of FIG. 1.

VGAM1726 RNA, herein schematically represented by VGAM1 RNA through VGAM3 RNA, binds complementarily to a host target binding site located in an untranslated region of VGAM1726 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1726 host target RNA into VGAM1726 host target protein, herein schematically represented by VGAM1 HOST TARGET PROTEIN through VGAM3 HOST TARGET PROTEIN, all of FIG. 1.

VGAM1727 RNA, herein schematically represented by VGAM1 RNA through VGAM3 RNA, binds complementarily to a host target binding site located in an untranslated region of VGAM1727 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1727 host target RNA into VGAM1727 host target protein, herein schematically represented by VGAM1 HOST TARGET PROTEIN through VGAM3 HOST TARGET PROTEIN, all of FIG. 1.

VGAM1728 RNA, herein schematically represented by VGAM1 RNA through VGAM3 RNA, binds complementarily to a host target binding site located in an untranslated region of VGAM1728 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1728 host target RNA into VGAM1728 host target protein, herein schematically represented by VGAM1 HOST TARGET PROTEIN through VGAM3 HOST TARGET PROTEIN, all of FIG. 1.

VGAM1729 RNA, herein schematically represented by VGAM1 RNA through VGAM3 RNA, binds complementarily to a host target binding site located in an untranslated region of VGAM1729 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1729 host target RNA into VGAM1729 host target protein, herein schematically represented by VGAM1 HOST TARGET PROTEIN through VGAM3 HOST TARGET PROTEIN, all of FIG. 1.

VGAM1730 RNA, herein schematically represented by VGAM1 RNA through VGAM3 RNA, binds complementarily to a host target binding site located in an untranslated region of VGAM1730 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1730 host target RNA into VGAM1730 host target protein, herein schematically represented by VGAM1 HOST TARGET PROTEIN through VGAM3 HOST TARGET PROTEIN, all of FIG. 1.

It is appreciated that a function of VGR3112 gene, herein designated VGR GENE, is inhibition of expression of host target genes, as part of a novel viral mechanism of attacking a host. Accordingly, utilities of VGR3112 gene include diagnosis, prevention and treatment of viral infection by Rabies Virus. Specific functions, and accordingly utilities, of VGR3112 gene correlate with, and may be deduced from, the identity of the host target genes, which are inhibited by VGAM RNAs comprised in the 'operon-like' cluster of VGR3112 gene: VGAM1724 host target protein, VGAM1725 host target protein, VGAM1726 host target protein, VGAM1727 host target protein, VGAM1728 host target protein, VGAM1729 host target protein and VGAM1730 host target protein, herein schematically represented by VGAM1 HOST TARGET PROTEIN through VGAM3 HOST TARGET PROTEIN. The function of these host target genes is elaborated hereinabove with reference to VGAM1724, VGAM1725, VGAM1726, VGAM1727, VGAM1728, VGAM1729 and VGAM1730. FIG. 9 further provides a conceptual description of novel bioinformatically detected regulatory viral gene, referred to here as Viral Genomic Record 3113(VGR3113) viral gene, which encodes an 'operon-like' cluster of novel viral micro RNA-like genes, each of which in turn modulates expression of at least one host target gene, the function and utility of which at least one host target gene is known in the art.

VGR3113 gene, herein designated VGR GENE, is a novel bioinformatically detected regulatory, non protein coding, RNA viral gene. The method by which VGR3113 gene was detected is described hereinabove with reference to FIGS. 1-9.

VGR3113 gene encodes VGR3113 precursor RNA, herein designated VGR PRECURSOR RNA, an RNA molecule, typically several hundred nucleotides long.

VGR3113 precursor RNA folds spatially, forming VGR3113 folded precursor RNA, herein designated VGR FOLDED PRECURSOR RNA. It is appreciated that VGR3113 folded precursor RNA comprises a plurality of what is known in the art as 'hairpin' structures. These 'hairpin' structures are due to the fact that the nucleotide sequence of VGR3113 precursor RNA comprises a plurality of segments, the first half of each such segment having a nucleotide sequence which is at least a partial inversed-reversed sequence of the second half thereof, as is well known in the art.

VGR3113 folded precursor RNA is naturally processed by cellular enzymatic activity into at least 2 separate VGAM precursor RNAs, VGAM1731 precursor RNA and VGAM1732 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1731 RNA and VGAM1732 RNA, herein schematically represented by VGAM1 RNA through VGAM3 RNA, each of which VGAM RNAs corresponding to VGAM RNA of FIG. 1.

VGAM1731 RNA, herein schematically represented by VGAM1 RNA through VGAM3 RNA, binds complementarily to a host target binding site located in an untranslated region of VGAM1731 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1731 host target RNA into VGAM1731 host target protein, herein schematically represented by VGAM1 HOST TARGET PROTEIN through VGAM3 HOST TARGET PROTEIN, all of FIG. 1.

VGAM1732 RNA, herein schematically represented by VGAM1 RNA through VGAM3 RNA, binds complementarily to a host target binding site located in an untranslated region of VGAM1732 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1732 host target RNA into VGAM1732 host target protein, herein schematically represented by VGAM1 HOST TARGET PROTEIN through VGAM3 HOST TARGET PROTEIN, all of FIG. 1.

It is appreciated that a function of VGR3113 gene, herein designated VGR GENE, is inhibition of expression of host target genes, as part of a novel viral mechanism of attacking a host. Accordingly, utilities of VGR3113 gene include diagnosis, prevention and treatment of viral infection by Rabies Virus. Specific functions, and accordingly utilities, of VGR3113 gene correlate with, and may be deduced from, the identity of the host target genes, which are inhibited by VGAM RNAs comprised in the 'operon-like' cluster of VGR3113 gene: VGAM1731 host target protein and VGAM1732 host target protein, herein schematically represented by VGAM1 HOST TARGET PROTEIN through VGAM3 HOST TARGET PROTEIN. The function of these host target genes is elaborated hereinabove with reference to VGAM1731 and VGAM1732. FIG. 9 further provides a conceptual description of novel bioinformatically detected regulatory viral gene, referred to here as Viral Genomic Record 3114(VGR3114) viral gene, which encodes an 'operon-like' cluster of novel viral micro RNA-like genes, each of which in turn modulates expression of at least one host target gene, the function and utility of which at least one host target gene is known in the art.

VGR3114 gene, herein designated VGR GENE, is a novel bioinformatically detected regulatory, non protein coding, RNA viral gene. The method by which VGR3114 gene was detected is described hereinabove with reference to FIGS. 1-9.

VGR3114 gene encodes VGR3114 precursor RNA, herein designated VGR PRECURSOR RNA, an RNA molecule, typically several hundred nucleotides long.

VGR3114 precursor RNA folds spatially, forming VGR3114 folded precursor RNA, herein designated VGR FOLDED PRECURSOR RNA. It is appreciated that VGR3114 folded precursor RNA comprises a plurality of what is known in the art as 'hairpin' structures. These 'hairpin' structures are due to the fact that the nucleotide sequence of VGR3114 precursor RNA comprises a plurality of segments, the first half of each such segment having a nucleotide sequence which is at least a partial inversed-reversed sequence of the second half thereof, as is well known in the art.

VGR3114 folded precursor RNA is naturally processed by cellular enzymatic activity into at least 8 separate VGAM precursor RNAs, VGAM1733 precursor RNA, VGAM1734 precursor RNA, VGAM1735 precursor RNA, VGAM1736 precursor RNA, VGAM1737 precursor RNA, VGAM1738 precursor RNA, VGAM1739 precursor RNA and VGAM1740 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1733 RNA, VGAM1734 RNA, VGAM1735 RNA, VGAM1736 RNA, VGAM1737 RNA, VGAM1738 RNA, VGAM1739 RNA and VGAM1740 RNA, herein schematically represented by VGAM1 RNA through VGAM3 RNA, each of which VGAM RNAs corresponding to VGAM RNA of FIG. 1.

VGAM1733 RNA, herein schematically represented by VGAM1 RNA through VGAM3 RNA, binds complementarily to a host target binding site located in an untranslated region of VGAM1733 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1733 host target RNA into VGAM1733 host target protein, herein schematically represented by VGAM1 HOST TARGET PROTEIN through VGAM3 HOST TARGET PROTEIN, all of FIG. 1.

VGAM1734 RNA, herein schematically represented by VGAM1 RNA through VGAM3 RNA, binds complementarily to a host target binding site located in an untranslated region of VGAM1734 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1734 host target RNA into VGAM1734 host target protein, herein schematically represented by VGAM1 HOST TARGET PROTEIN through VGAM3 HOST TARGET PROTEIN, all of FIG. 1.

VGAM1735 RNA, herein schematically represented by VGAM1 RNA through VGAM3 RNA, binds complementarily to a host target binding site located in an untranslated region of VGAM1735 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1735 host target RNA into VGAM1735 host target protein, herein schematically represented by VGAM1 HOST TARGET PROTEIN through VGAM3 HOST TARGET PROTEIN, all of FIG. 1.

VGAM1736 RNA, herein schematically represented by VGAM1 RNA through VGAM3 RNA, binds complementarily to a host target binding site located in an untranslated region of VGAM1736 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1736 host target RNA into VGAM1736 host target protein, herein schematically represented by VGAM1 HOST TARGET PROTEIN through VGAM3 HOST TARGET PROTEIN, all of FIG. 1.

VGAM1737 RNA, herein schematically represented by VGAM1 RNA through VGAM3 RNA, binds complementarily to a host target binding site located in an untranslated region of VGAM1737 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1737 host target RNA into VGAM1737 host target protein, herein schematically represented by VGAM1 HOST TARGET PROTEIN through VGAM3 HOST TARGET PROTEIN, all of FIG. 1.

VGAM1738 RNA, herein schematically represented by VGAM1 RNA through VGAM3 RNA, binds complementarily to a host target binding site located in an untranslated region of VGAM1738 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1738 host target RNA into VGAM1738 host target protein, herein schematically represented by VGAM1 HOST TARGET PROTEIN through VGAM3 HOST TARGET PROTEIN, all of FIG. 1.

VGAM1739 RNA, herein schematically represented by VGAM1 RNA through VGAM3 RNA, binds complementarily to a host target binding site located in an untranslated region of VGAM1739 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1739 host target RNA into VGAM1739 host target protein, herein schematically represented by VGAM1 HOST TARGET PROTEIN through VGAM3 HOST TARGET PROTEIN, all of FIG. 1.

VGAM1740 RNA, herein schematically represented by VGAM1 RNA through VGAM3 RNA, binds complementarily to a host target binding site located in an untranslated region of VGAM1740 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1740 host target RNA into VGAM1740 host target protein, herein schematically represented by VGAM1 HOST TARGET PROTEIN through VGAM3 HOST TARGET PROTEIN, all of FIG. 1.

It is appreciated that a function of VGR3114 gene, herein designated VGR GENE, is inhibition of expression of host target genes, as part of a novel viral mechanism of attacking a host. Accordingly, utilities of VGR3114 gene include diagnosis, prevention and treatment of viral infection by Human Herpesvirus 3. Specific functions, and accordingly utilities, of VGR3114 gene correlate with, and may be deduced from, the identity of the host target genes, which are inhibited by VGAM RNAs comprised in the 'operon-like' cluster of VGR3114 gene: VGAM1733 host target protein, VGAM1734 host target protein, VGAM1735 host target protein, VGAM1736 host target protein, VGAM1737 host target protein, VGAM1738 host target protein, VGAM1739 host target protein and VGAM1740 host target protein, herein schematically represented by VGAM1 HOST TARGET PROTEIN through VGAM3 HOST TARGET PROTEIN. The function of these host target genes is elaborated hereinabove with reference to VGAM1733, VGAM1734, VGAM1735, VGAM1736, VGAM1737, VGAM1738, VGAM1739 and VGAM1740. FIG. 9 further provides a conceptual description of novel bioinformatically detected regulatory viral gene, referred to here as Viral Genomic Record 3115(VGR3115) viral gene, which encodes an 'operon-like' cluster of novel viral micro RNA-like genes, each of which in turn modulates expression of at least one host target gene, the function and utility of which at least one host target gene is known in the art.

VGR3115 gene, herein designated VGR GENE, is a novel bioinformatically detected regulatory, non protein coding, RNA viral gene. The method by which VGR3115 gene was detected is described hereinabove with reference to FIGS. 1-9.

VGR3115 gene encodes VGR3115 precursor RNA, herein designated VGR PRECURSOR RNA, an RNA molecule, typically several hundred nucleotides long.

VGR3115 precursor RNA folds spatially, forming VGR3115 folded precursor RNA, herein designated VGR FOLDED PRECURSOR RNA. It is appreciated that VGR3115 folded precursor RNA comprises a plurality of what is known in the art as 'hairpin' structures. These 'hairpin' structures are due to the fact that the nucleotide sequence of VGR3115 precursor RNA comprises a plurality of segments, the first half of each such segment having a nucleotide sequence which is at least a partial inversed-reversed sequence of the second half thereof, as is well known in the art.

VGR3115 folded precursor RNA is naturally processed by cellular enzymatic activity into at least 6 separate VGAM precursor RNAs, VGAM1741 precursor RNA, VGAM1742 precursor RNA, VGAM1743 precursor RNA, VGAM1744 precursor RNA, VGAM1745 precursor RNA and VGAM1746 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1741 RNA, VGAM1742 RNA, VGAM1743 RNA, VGAM1744 RNA, VGAM1745 RNA and VGAM1746 RNA, herein schematically represented by VGAM1 RNA through VGAM3 RNA, each of which VGAM RNAs corresponding to VGAM RNA of FIG. 1.

VGAM1741 RNA, herein schematically represented by VGAM1 RNA through VGAM3 RNA, binds complementarily to a host target binding site located in an untranslated region of VGAM1741 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1741 host target RNA into VGAM1741 host target protein, herein schematically represented by VGAM1 HOST TARGET PROTEIN through VGAM3 HOST TARGET PROTEIN, all of FIG. 1.

VGAM1742 RNA, herein schematically represented by VGAM1 RNA through VGAM3 RNA, binds complementarily to a host target binding site located in an untranslated region of VGAM1742 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1742 host target RNA into VGAM1742 host target protein, herein schematically represented by VGAM1 HOST TARGET PROTEIN through VGAM3 HOST TARGET PROTEIN, all of FIG. 1.

VGAM1743 RNA, herein schematically represented by VGAM1 RNA through VGAM3 RNA, binds complementarily to a host target binding site located in an untranslated region of VGAM1743 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1743 host target RNA into VGAM1743 host target protein, herein schematically represented by VGAM1 HOST TARGET PROTEIN through VGAM3 HOST TARGET PROTEIN, all of FIG. 1.

VGAM1744 RNA, herein schematically represented by VGAM1 RNA through VGAM3 RNA, binds complementarily to a host target binding site located in an untranslated region of VGAM1744 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1744 host target RNA into VGAM1744 host target protein, herein schematically represented by VGAM1 HOST TARGET PROTEIN through VGAM3 HOST TARGET PROTEIN, all of FIG. 1.

VGAM1745 RNA, herein schematically represented by VGAM1 RNA through VGAM3 RNA, binds complementarily to a host target binding site located in an untranslated region of VGAM1745 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1745 host target RNA into VGAM1745 host target protein, herein schematically represented by VGAM1 HOST TARGET PROTEIN through VGAM3 HOST TARGET PROTEIN, all of FIG. 1.

VGAM1746 RNA, herein schematically represented by VGAM1 RNA through VGAM3 RNA, binds complementarily to a host target binding site located in an untranslated region of VGAM1746 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1746 host target RNA into VGAM1746 host target protein, herein schematically represented by VGAM1 HOST TARGET PROTEIN through VGAM3 HOST TARGET PROTEIN, all of FIG. 1.

It is appreciated that a function of VGR3115 gene, herein designated VGR GENE, is inhibition of expression of host target genes, as part of a novel viral mechanism of attacking a host. Accordingly, utilities of VGR3115 gene include diagnosis, prevention and treatment of viral infection by Cercopithecine Herpesvirus 7. Specific functions, and accordingly utilities, of VGR3115 gene correlate with, and may be deduced from, the identity of the host target genes, which are inhibited by VGAM RNAs comprised in the 'operon-like' cluster of VGR3115 gene: VGAM1741 host target protein, VGAM1742 host target protein, VGAM1743 host target protein, VGAM1744 host target protein, VGAM1745 host target protein and VGAM1746 host target protein, herein schematically represented by VGAM1 HOST TARGET PROTEIN through VGAM3 HOST TARGET PROTEIN. The function of these host target genes is elaborated hereinabove with reference to VGAM1741, VGAM1742, VGAM1743, VGAM1744, VGAM1745 and VGAM1746. FIG. 9 further provides a conceptual description of novel bioinformatically detected regulatory viral gene, referred to here as Viral Genomic Record 3116(VGR3116) viral gene, which encodes an 'operon-like' cluster of novel viral micro RNA-like genes, each of which in turn modulates expression of at least one host target gene, the function and utility of which at least one host target gene is known in the art.

VGR3116 gene, herein designated VGR GENE, is a novel bioinformatically detected regulatory, non protein coding, RNA viral gene. The method by which VGR3116 gene was detected is described hereinabove with reference to FIGS. 1-9.

VGR3116 gene encodes VGR3116 precursor RNA, herein designated VGR PRECURSOR RNA, an RNA molecule, typically several hundred nucleotides long.

VGR3116 precursor RNA folds spatially, forming VGR3116 folded precursor RNA, herein designated VGR FOLDED PRECURSOR RNA. It is appreciated that VGR3116 folded precursor RNA comprises a plurality of what is known in the art as 'hairpin' structures. These 'hairpin' structures are due to the fact that the nucleotide sequence of VGR3116 precursor RNA comprises a plurality of segments, the first half of each such segment having a nucleotide sequence which is at least a partial inversed-reversed sequence of the second half thereof, as is well known in the art.

VGR3116 folded precursor RNA is naturally processed by cellular enzymatic activity into at least 8 separate VGAM precursor RNAs, VGAM1747 precursor RNA, VGAM1748 precursor RNA, VGAM1749 precursor RNA, VGAM1750 precursor RNA, VGAM1751 precursor RNA, VGAM1752 precursor RNA, VGAM1753 precursor RNA and VGAM1754 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1747 RNA, VGAM1748 RNA, VGAM1749 RNA, VGAM1750 RNA, VGAM1751 RNA, VGAM1752 RNA, VGAM1753 RNA and VGAM1754 RNA, herein schematically represented by VGAM1 RNA through VGAM3 RNA, each of which VGAM RNAs corresponding to VGAM RNA of FIG. 1.

VGAM1747 RNA, herein schematically represented by VGAM1 RNA through VGAM3 RNA, binds complementarily to a host target binding site located in an untranslated region of VGAM1747 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1747 host target RNA into VGAM1747 host target protein, herein schematically represented by VGAM1 HOST TARGET PROTEIN through VGAM3 HOST TARGET PROTEIN, all of FIG. 1.

VGAM1748 RNA, herein schematically represented by VGAM1 RNA through VGAM3 RNA, binds complementarily to a host target binding site located in an untranslated region of VGAM1748 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1748 host target RNA into VGAM1748 host target protein, herein schematically represented by VGAM1 HOST TARGET PROTEIN through VGAM3 HOST TARGET PROTEIN, all of FIG. 1.

VGAM1749 RNA, herein schematically represented by VGAM1 RNA through VGAM3 RNA, binds complementarily to a host target binding site located in an untranslated region of VGAM1749 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1749 host target RNA into VGAM1749 host target protein, herein schematically represented by VGAM1 HOST TARGET PROTEIN through VGAM3 HOST TARGET PROTEIN, all of FIG. 1.

VGAM1750 RNA, herein schematically represented by VGAM1 RNA through VGAM3 RNA, binds complementarily to a host target binding site located in an untranslated region of VGAM1750 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1750 host target RNA into VGAM1750 host target protein, herein schematically represented by VGAM1 HOST TARGET PROTEIN through VGAM3 HOST TARGET PROTEIN, all of FIG. 1.

VGAM1751 RNA, herein schematically represented by VGAM1 RNA through VGAM3 RNA, binds complementarily to a host target binding site located in an untranslated region of VGAM1751 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1751 host target RNA into VGAM1751 host target protein, herein schematically represented by VGAM1 HOST TARGET PROTEIN through VGAM3 HOST TARGET PROTEIN, all of FIG. 1.

VGAM1752 RNA, herein schematically represented by VGAM1 RNA through VGAM3 RNA, binds complementarily to a host target binding site located in an untranslated region of VGAM1752 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1752 host target RNA into VGAM1752 host target protein, herein schematically represented by VGAM1 HOST TARGET PROTEIN through VGAM3 HOST TARGET PROTEIN, all of FIG. 1.

VGAM1753 RNA, herein schematically represented by VGAM1 RNA through VGAM3 RNA, binds complementarily to a host target binding site located in an untranslated region of VGAM1753 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1753 host target RNA into VGAM1753 host target protein, herein schematically represented by VGAM1 HOST TARGET PROTEIN through VGAM3 HOST TARGET PROTEIN, all of FIG. 1.

VGAM1754 RNA, herein schematically represented by VGAM1 RNA through VGAM3 RNA, binds complementarily to a host target binding site located in an untranslated region of VGAM1754 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1754 host target RNA into VGAM1754 host target protein, herein schematically represented by VGAM1 HOST TARGET PROTEIN through VGAM3 HOST TARGET PROTEIN, all of FIG. 1.

It is appreciated that a function of VGR3116 gene, herein designated VGR GENE, is inhibition of expression of host target genes, as part of a novel viral mechanism of attacking a host. Accordingly, utilities of VGR3116 gene include diagnosis, prevention and treatment of viral infection by Camelpox Virus. Specific functions, and accordingly utilities, of VGR3116 gene correlate with, and may be deduced from, the identity of the host target genes, which are inhibited by VGAM RNAs comprised in the 'operon-like' cluster of VGR3116 gene: VGAM1747 host target protein, VGAM1748 host target protein, VGAM1749 host target protein, VGAM1750 host target protein, VGAM1751 host target protein, VGAM1752 host target protein, VGAM1753 host target protein and VGAM1754 host target protein, herein schematically represented by VGAM1 HOST TARGET PROTEIN through VGAM3 HOST TARGET PROTEIN. The function of these host target genes is elaborated hereinabove with reference to VGAM1747, VGAM1748, VGAM1749, VGAM1750, VGAM1751, VGAM1752, VGAM1753 and VGAM1754. FIG. 9 further provides a conceptual description of novel bioinformatically detected regulatory viral gene, referred to here as Viral Genomic Record 3117(VGR3117) viral gene, which encodes an 'operon-like' cluster of novel viral micro RNA-like genes, each of which in turn modulates expression of at least one host target gene, the function and utility of which at least one host target gene is known in the art.

VGR3117 gene, herein designated VGR GENE, is a novel bioinformatically detected regulatory, non protein coding, RNA viral gene. The method by which VGR3117 gene was detected is described hereinabove with reference to FIGS. 1-9.

VGR3117 gene encodes VGR3117 precursor RNA, herein designated VGR PRECURSOR RNA, an RNA molecule, typically several hundred nucleotides long.

VGR3117 precursor RNA folds spatially, forming VGR3117 folded precursor RNA, herein designated VGR FOLDED PRECURSOR RNA. It is appreciated that VGR3117 folded precursor RNA comprises a plurality of what is known in the art as 'hairpin' structures. These 'hairpin' structures are due to the fact that the nucleotide sequence of VGR3117 precursor RNA comprises a plurality of segments, the first half of each such segment having a nucleotide sequence which is at least a partial inversed-reversed sequence of the second half thereof, as is well known in the art.

VGR3117 folded precursor RNA is naturally processed by cellular enzymatic activity into at least 4 separate VGAM precursor RNAs, VGAM1755 precursor RNA, VGAM1756 precursor RNA, VGAM1757 precursor RNA and VGAM1758 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1755 RNA, VGAM1756 RNA, VGAM1757 RNA and VGAM1758 RNA, herein schematically represented by VGAM1 RNA through VGAM3 RNA, each of which VGAM RNAs corresponding to VGAM RNA of FIG. 1.

VGAM1755 RNA, herein schematically represented by VGAM1 RNA through VGAM3 RNA, binds complementarily to a host target binding site located in an untranslated region of VGAM1755 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1755 host target RNA into VGAM1755 host target protein, herein schematically represented by VGAM1 HOST TARGET PROTEIN through VGAM3 HOST TARGET PROTEIN, all of FIG. 1.

VGAM1756 RNA, herein schematically represented by VGAM1 RNA through VGAM3 RNA, binds complementarily to a host target binding site located in an untranslated region of VGAM1756 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1756 host target RNA into VGAM1756 host target protein, herein schematically represented by VGAM1 HOST TARGET PROTEIN through VGAM3 HOST TARGET PROTEIN, all of FIG. 1.

VGAM1757 RNA, herein schematically represented by VGAM1 RNA through VGAM3 RNA, binds complementarily to a host target binding site located in an untranslated region of VGAM1757 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1757 host target RNA into VGAM1757 host target protein, herein schematically represented by VGAM1 HOST TARGET PROTEIN through VGAM3 HOST TARGET PROTEIN, all of FIG. 1.

VGAM1758 RNA, herein schematically represented by VGAM1 RNA through VGAM3 RNA, binds complementarily to a host target binding site located in an untranslated region of VGAM1758 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1758 host target RNA into VGAM1758 host target protein, herein schematically represented by VGAM1 HOST TARGET PROTEIN through VGAM3 HOST TARGET PROTEIN, all of FIG. 1.

It is appreciated that a function of VGR3117 gene, herein designated VGR GENE, is inhibition of expression of host target genes, as part of a novel viral mechanism of attacking a host. Accordingly, utilities of VGR3117 gene include diagnosis, prevention and treatment of viral infection by Camelpox Virus. Specific functions, and accordingly utilities, of VGR3117 gene correlate with, and may be deduced from, the identity of the host target genes, which are inhibited by VGAM RNAs comprised in the 'operon-like' cluster of VGR3117 gene: VGAM1755 host target protein, VGAM1756 host target protein, VGAM1757 host target protein and VGAM1758 host target protein, herein schematically represented by VGAM1 HOST TARGET PROTEIN through VGAM3 HOST TARGET PROTEIN. The function of these host target genes is elaborated hereinabove with reference to VGAM1755, VGAM1756, VGAM1757 and VGAM1758. FIG. 9 further provides a conceptual description of novel bioinformatically detected regulatory viral gene, referred to here as Viral Genomic Record 3118(VGR3118) viral gene, which encodes an 'operon-like' cluster of novel viral micro RNA-like genes, each of which in turn modulates expression of at least one host target gene, the function and utility of which at least one host target gene is known in the art.

VGR3118 gene, herein designated VGR GENE, is a novel bioinformatically detected regulatory, non protein coding, RNA viral gene. The method by which VGR3118 gene was detected is described hereinabove with reference to FIGS. 1-9.

VGR3118 gene encodes VGR3118 precursor RNA, herein designated VGR PRECURSOR RNA, an RNA molecule, typically several hundred nucleotides long.

VGR3118 precursor RNA folds spatially, forming VGR3118 folded precursor RNA, herein designated VGR FOLDED PRECURSOR RNA. It is appreciated that VGR3118 folded precursor RNA comprises a plurality of what is known in the art as 'hairpin' structures. These 'hairpin' structures are due to the fact that the nucleotide sequence of VGR3118 precursor RNA comprises a plurality of segments, the first half of each such segment having a nucleotide sequence which is at least a partial inversed-reversed sequence of the second half thereof, as is well known in the art.

VGR3118 folded precursor RNA is naturally processed by cellular enzymatic activity into at least 8 separate VGAM precursor RNAs, VGAM1759 precursor RNA, VGAM1760 precursor RNA, VGAM1761 precursor RNA, VGAM1762 precursor RNA, VGAM1763 precursor RNA, VGAM1764 precursor RNA, VGAM1765 precursor RNA and VGAM1766 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1759 RNA, VGAM1760 RNA, VGAM1761 RNA, VGAM1762 RNA, VGAM1763 RNA, VGAM1764 RNA, VGAM1765 RNA and VGAM1766 RNA, herein schematically represented by VGAM1 RNA through VGAM3 RNA, each of which VGAM RNAs corresponding to VGAM RNA of FIG. 1.

VGAM1759 RNA, herein schematically represented by VGAM1 RNA through VGAM3 RNA, binds complementarily to a host target binding site located in an untranslated region of VGAM1759 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1759 host target RNA into VGAM1759 host target protein, herein schematically represented by VGAM1 HOST TARGET PROTEIN through VGAM3 HOST TARGET PROTEIN, all of FIG. 1.

VGAM1760 RNA, herein schematically represented by VGAM1 RNA through VGAM3 RNA, binds complementarily to a host target binding site located in an untranslated region of VGAM1760 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1760 host target RNA into VGAM1760 host target protein, herein schematically represented by VGAM1 HOST TARGET PROTEIN through VGAM3 HOST TARGET PROTEIN, all of FIG. 1.

VGAM1761 RNA, herein schematically represented by VGAM1 RNA through VGAM3 RNA, binds complementarily to a host target binding site located in an untranslated region of VGAM1761 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1761 host target RNA into VGAM1761 host target protein, herein schematically represented by VGAM1 HOST TARGET PROTEIN through VGAM3 HOST TARGET PROTEIN, all of FIG. 1.

VGAM1762 RNA, herein schematically represented by VGAM1 RNA through VGAM3 RNA, binds complementarily to a host target binding site located in an untranslated region of VGAM1762 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1762 host target RNA into VGAM1762 host target protein, herein schematically represented by VGAM1 HOST TARGET PROTEIN through VGAM3 HOST TARGET PROTEIN, all of FIG. 1.

VGAM1763 RNA, herein schematically represented by VGAM1 RNA through VGAM3 RNA, binds complementarily to a host target binding site located in an untranslated region of VGAM1763 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1763 host target RNA into VGAM1763 host target protein, herein schematically represented by VGAM1 HOST TARGET PROTEIN through VGAM3 HOST TARGET PROTEIN, all of FIG. 1.

VGAM1764 RNA, herein schematically represented by VGAM1 RNA through VGAM3 RNA, binds complementarily to a host target binding site located in an untranslated region of VGAM1764 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1764 host target RNA into VGAM1764 host target protein, herein schematically represented by VGAM1 HOST TARGET PROTEIN through VGAM3 HOST TARGET PROTEIN, all of FIG. 1.

VGAM1765 RNA, herein schematically represented by VGAM1 RNA through VGAM3 RNA, binds complementarily to a host target binding site located in an untranslated region of VGAM1765 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1765 host target RNA into VGAM1765 host target protein, herein schematically represented by VGAM1 HOST TARGET PROTEIN through VGAM3 HOST TARGET PROTEIN, all of FIG. 1.

VGAM1766 RNA, herein schematically represented by VGAM1 RNA through VGAM3 RNA, binds complementarily to a host target binding site located in an untranslated region of VGAM1766 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1766 host target RNA into VGAM1766 host target protein, herein schematically represented by VGAM1 HOST TARGET PROTEIN through VGAM3 HOST TARGET PROTEIN, all of FIG. 1.

It is appreciated that a function of VGR3118 gene, herein designated VGR GENE, is inhibition of expression of host target genes, as part of a novel viral mechanism of attacking a host. Accordingly, utilities of VGR3118 gene include diagnosis, prevention and treatment of viral infection by Bovine Viral Diarrhea Virus Genotype 2 (BVDV-2). Specific functions, and accordingly utilities, of VGR3118 gene correlate with, and may be deduced from, the identity of the host target genes, which are inhibited by VGAM RNAs comprised in the 'operon-like' cluster of VGR3118 gene: VGAM1759 host target protein, VGAM1760 host target protein, VGAM1761 host target protein, VGAM1762 host target protein, VGAM1763 host target protein, VGAM1764 host target protein, VGAM1765 host target protein and VGAM1766 host target protein, herein schematically represented by VGAM1 HOST TARGET PROTEIN through VGAM3 HOST TARGET PROTEIN. The function of these host target genes is elaborated hereinabove with reference to VGAM1759, VGAM1760, VGAM1761, VGAM1762, VGAM1763, VGAM1764, VGAM1765 and VGAM1766. FIG. 9 further provides a conceptual description of novel bioinformatically detected regulatory viral gene, referred to here as Viral Genomic Record 3119(VGR3119) viral gene, which encodes an 'operon-like' cluster of novel viral micro RNA-like genes, each of which in turn modulates expression of at least one host target gene, the function and utility of which at least one host target gene is known in the art.

VGR3119 gene, herein designated VGR GENE, is a novel bioinformatically detected regulatory, non protein coding, RNA viral gene. The method by which VGR3119 gene was detected is described hereinabove with reference to FIGS. 1-9.

VGR3119 gene encodes VGR3119 precursor RNA, herein designated VGR PRECURSOR RNA, an RNA molecule, typically several hundred nucleotides long.

VGR3119 precursor RNA folds spatially, forming VGR3119 folded precursor RNA, herein designated VGR FOLDED PRECURSOR RNA. It is appreciated that VGR3119 folded precursor RNA comprises a plurality of what is known in the art as 'hairpin' structures. These 'hairpin' structures are due to the fact that the nucleotide sequence of VGR3119 precursor RNA comprises a plurality of segments, the first half of each such segment having a nucleotide sequence which is at least a partial inversed-reversed sequence of the second half thereof, as is well known in the art.

VGR3119 folded precursor RNA is naturally processed by cellular enzymatic activity into at least 4 separate VGAM precursor RNAs, VGAM1767 precursor RNA, VGAM1768 precursor RNA, VGAM1769 precursor RNA and VGAM1770 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1767 RNA, VGAM1768 RNA, VGAM1769 RNA and VGAM1770 RNA, herein schematically represented by VGAM1 RNA through VGAM3 RNA, each of which VGAM RNAs corresponding to VGAM RNA of FIG. 1.

VGAM1767 RNA, herein schematically represented by VGAM1 RNA through VGAM3 RNA, binds complementarily to a host target binding site located in an untranslated region of VGAM1767 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1767 host target RNA into VGAM1767 host target protein, herein schematically represented by VGAM1 HOST TARGET PROTEIN through VGAM3 HOST TARGET PROTEIN, all of FIG. 1.

VGAM1768 RNA, herein schematically represented by VGAM1 RNA through VGAM3 RNA, binds complementarily to a host target binding site located in an untranslated region of VGAM1768 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1768 host target RNA into VGAM1768 host target protein, herein schematically represented by VGAM1 HOST TARGET PROTEIN through VGAM3 HOST TARGET PROTEIN, all of FIG. 1.

VGAM1769 RNA, herein schematically represented by VGAM1 RNA through VGAM3 RNA, binds complementarily to a host target binding site located in an untranslated region of VGAM1769 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1769 host target RNA into VGAM1769 host target protein, herein schematically represented by VGAM1 HOST TARGET PROTEIN through VGAM3 HOST TARGET PROTEIN, all of FIG. 1.

VGAM1770 RNA, herein schematically represented by VGAM1 RNA through VGAM3 RNA, binds complementarily to a host target binding site located in an untranslated region of VGAM1770 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1770 host target RNA into VGAM1770 host target protein, herein schematically represented by VGAM1 HOST TARGET PROTEIN through VGAM3 HOST TARGET PROTEIN, all of FIG. 1.

It is appreciated that a function of VGR3119 gene, herein designated VGR GENE, is inhibition of expression of host target genes, as part of a novel viral mechanism of attacking a host. Accordingly, utilities of VGR3119 gene include diagnosis, prevention and treatment of viral infection by Rabbit Fibroma Virus. Specific functions, and accordingly utilities, of VGR3119 gene correlate with, and may be deduced from, the identity of the host target genes, which are inhibited by VGAM RNAs comprised in the 'operon-like' cluster of VGR3119 gene: VGAM1767 host target protein, VGAM1768 host target protein, VGAM1769 host target protein and VGAM1770 host target protein, herein schematically represented by VGAM1 HOST TARGET PROTEIN through VGAM3 HOST TARGET PROTEIN. The function of these host target genes is elaborated hereinabove with reference to VGAM1767, VGAM1768, VGAM1769 and VGAM1770. FIG. 9 further provides a conceptual description of novel bioinformatically detected regulatory viral gene, referred to here as Viral Genomic Record 3120(VGR3120) viral gene, which encodes an 'operon-like' cluster of novel viral micro RNA-like genes, each of which in turn modulates expression of at least one host target gene, the function and utility of which at least one host target gene is known in the art.

VGR3120 gene, herein designated VGR GENE, is a novel bioinformatically detected regulatory, non protein coding, RNA viral gene. The method by which VGR3120 gene was detected is described hereinabove with reference to FIGS. 1-9.

VGR3120 gene encodes VGR3120 precursor RNA, herein designated VGR PRECURSOR RNA, an RNA molecule, typically several hundred nucleotides long.

VGR3120 precursor RNA folds spatially, forming VGR3120 folded precursor RNA, herein designated VGR FOLDED PRECURSOR RNA. It is appreciated that VGR3120 folded precursor RNA comprises a plurality of what is known in the art as 'hairpin' structures. These 'hairpin' structures are due to the fact that the nucleotide sequence of VGR3120 precursor RNA comprises a plurality of segments, the first half of each such segment having a nucleotide sequence which is at least a partial inversed-reversed sequence of the second half thereof, as is well known in the art.

VGR3120 folded precursor RNA is naturally processed by cellular enzymatic activity into at least 2 separate VGAM precursor RNAs, VGAM1771 precursor RNA and VGAM1772 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1771 RNA and VGAM1772 RNA, herein schematically represented by VGAM1 RNA through VGAM3 RNA, each of which VGAM RNAs corresponding to VGAM RNA of FIG. 1.

VGAM1771 RNA, herein schematically represented by VGAM1 RNA through VGAM3 RNA, binds complementarily to a host target binding site located in an untranslated region of VGAM1771 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1771 host target RNA into VGAM1771 host target protein, herein schematically represented by VGAM1 HOST TARGET PROTEIN through VGAM3 HOST TARGET PROTEIN, all of FIG. 1.

VGAM1772 RNA, herein schematically represented by VGAM1 RNA through VGAM3 RNA, binds complementarily to a host target binding site located in an untranslated region of VGAM1772 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1772 host target RNA into VGAM1772 host target protein, herein schematically represented by VGAM1 HOST TARGET PROTEIN through VGAM3 HOST TARGET PROTEIN, all of FIG. 1.

It is appreciated that a function of VGR3120 gene, herein designated VGR GENE, is inhibition of expression of host target genes, as part of a novel viral mechanism of attacking a host. Accordingly, utilities of VGR3120 gene include diagnosis, prevention and treatment of viral infection by Pestivirus Type 1. Specific functions, and accordingly utilities, of VGR3120 gene correlate with, and may be deduced from, the identity of the host target genes, which are inhibited by VGAM RNAs comprised in the 'operon-like' cluster of VGR3120 gene: VGAM1771 host target protein and VGAM1772 host target protein, herein schematically represented by VGAM1 HOST TARGET PROTEIN through VGAM3 HOST TARGET PROTEIN. The function of these host target genes is elaborated hereinabove with reference to VGAM1771 and VGAM1772. FIG. 9 further provides a conceptual description of novel bioinformatically detected regulatory viral gene, referred to here as Viral Genomic Record 3121(VGR3121) viral gene, which encodes an 'operon-like' cluster of novel viral micro RNA-like genes, each of which in turn modulates expression of at least one host target gene, the function and utility of which at least one host target gene is known in the art.

VGR3121 gene, herein designated VGR GENE, is a novel bioinformatically detected regulatory, non protein coding, RNA viral gene. The method by which VGR3121 gene was detected is described hereinabove with reference to FIGS. 1-9.

VGR3121 gene encodes VGR3121 precursor RNA, herein designated VGR PRECURSOR RNA, an RNA molecule, typically several hundred nucleotides long.

VGR3121 precursor RNA folds spatially, forming VGR3121 folded precursor RNA, herein designated VGR FOLDED PRECURSOR RNA. It is appreciated that VGR3121 folded precursor RNA comprises a plurality of what is known in the art as 'hairpin' structures. These 'hairpin' structures are due to the fact that the nucleotide sequence of VGR3121 precursor RNA comprises a plurality of segments, the first half of each such segment having a nucleotide sequence which is at least a partial inversed-reversed sequence of the second half thereof, as is well known in the art.

VGR3121 folded precursor RNA is naturally processed by cellular enzymatic activity into at least 8 separate VGAM precursor RNAs, VGAM1773 precursor RNA, VGAM1774 precursor RNA, VGAM1775 precursor RNA, VGAM1776 precursor RNA, VGAM1777 precursor RNA, VGAM1778 precursor RNA, VGAM1779 precursor RNA and VGAM1780 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1773 RNA, VGAM1774 RNA, VGAM1775 RNA, VGAM1776 RNA, VGAM1777 RNA, VGAM1778 RNA, VGAM1779 RNA and VGAM1780 RNA, herein schematically represented by VGAM1 RNA through VGAM3 RNA, each of which VGAM RNAs corresponding to VGAM RNA of FIG. 1.

VGAM1773 RNA, herein schematically represented by VGAM1 RNA through VGAM3 RNA, binds complementarily to a host target binding site located in an untranslated region of VGAM1773 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1773 host target RNA into VGAM1773 host target protein, herein schematically represented by VGAM1 HOST TARGET PROTEIN through VGAM3 HOST TARGET PROTEIN, all of FIG. 1.

VGAM1774 RNA, herein schematically represented by VGAM1 RNA through VGAM3 RNA, binds complementarily to a host target binding site located in an untranslated region of VGAM1774 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1774 host target RNA into VGAM1774 host target protein, herein schematically represented by VGAM1 HOST TARGET PROTEIN through VGAM3 HOST TARGET PROTEIN, all of FIG. 1.

VGAM1775 RNA, herein schematically represented by VGAM1 RNA through VGAM3 RNA, binds complementarily to a host target binding site located in an untranslated region of VGAM1775 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1775 host target RNA into VGAM1775 host target protein, herein schematically represented by VGAM1 HOST TARGET PROTEIN through VGAM3 HOST TARGET PROTEIN, all of FIG. 1.

VGAM1776 RNA, herein schematically represented by VGAM1 RNA through VGAM3 RNA, binds complementarily to a host target binding site located in an untranslated region of VGAM1776 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1776 host target RNA into VGAM1776 host target protein, herein schematically represented by VGAM1 HOST TARGET PROTEIN through VGAM3 HOST TARGET PROTEIN, all of FIG. 1.

VGAM1777 RNA, herein schematically represented by VGAM1 RNA through VGAM3 RNA, binds complementarily to a host target binding site located in an untranslated region of VGAM1777 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1777 host target RNA into VGAM1777 host target protein, herein schematically represented by VGAM1 HOST TARGET PROTEIN through VGAM3 HOST TARGET PROTEIN, all of FIG. 1.

VGAM1778 RNA, herein schematically represented by VGAM1 RNA through VGAM3 RNA, binds complementarily to a host target binding site located in an untranslated region of VGAM1778 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1778 host target RNA into VGAM1778 host target protein, herein schematically represented by VGAM1 HOST TARGET PROTEIN through VGAM3 HOST TARGET PROTEIN, all of FIG. 1.

VGAM1779 RNA, herein schematically represented by VGAM1 RNA through VGAM3 RNA, binds complementarily to a host target binding site located in an untranslated region of VGAM1779 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1779 host target RNA into VGAM1779 host target protein, herein schematically represented by VGAM1 HOST TARGET PROTEIN through VGAM3 HOST TARGET PROTEIN, all of FIG. 1.

VGAM1780 RNA, herein schematically represented by VGAM1 RNA through VGAM3 RNA, binds complementarily to a host target binding site located in an untranslated region of VGAM1780 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1780 host target RNA into VGAM1780 host target protein, herein schematically represented by VGAM1 HOST TARGET PROTEIN through VGAM3 HOST TARGET PROTEIN, all of FIG. 1.

It is appreciated that a function of VGR3121 gene, herein designated VGR GENE, is inhibition of expression of host target genes, as part of a novel viral mechanism of attacking a host. Accordingly, utilities of VGR3121 gene include diagnosis, prevention and treatment of viral infection by Cryphonectria Hypovirus 1. Specific functions, and accordingly utilities, of VGR3121 gene correlate with, and may be deduced from, the identity of the host target genes, which are inhibited by VGAM RNAs comprised in the 'operon-like' cluster of VGR3121 gene: VGAM1773 host target protein, VGAM1774 host target protein, VGAM1775 host target protein, VGAM1776 host target protein, VGAM1777 host target protein, VGAM1778 host target protein, VGAM1779 host target protein and VGAM1780 host target protein, herein schematically represented by VGAM1 HOST TARGET PROTEIN through VGAM3 HOST TARGET PROTEIN. The function of these host target genes is elaborated hereinabove with reference to VGAM1773, VGAM1774, VGAM1775, VGAM1776, VGAM1777, VGAM1778, VGAM1779 and VGAM1780. FIG. 9 further provides a conceptual description of novel bioinformatically detected regulatory viral gene, referred to here as Viral Genomic Record 3122(VGR3122) viral gene, which encodes an 'operon-like' cluster of novel viral micro RNA-like genes, each of which in turn modulates expression of at least one host target gene, the function and utility of which at least one host target gene is known in the art.

VGR3122 gene, herein designated VGR GENE, is a novel bioinformatically detected regulatory, non protein coding, RNA viral gene. The method by which VGR3122 gene was detected is described hereinabove with reference to FIGS. 1-9.

VGR3122 gene encodes VGR3122 precursor RNA, herein designated VGR PRECURSOR RNA, an RNA molecule, typically several hundred nucleotides long.

VGR3122 precursor RNA folds spatially, forming VGR3122 folded precursor RNA, herein designated VGR FOLDED PRECURSOR RNA. It is appreciated that VGR3122 folded precursor RNA comprises a plurality of what is known in the art as 'hairpin' structures. These 'hairpin' structures are due to the fact that the nucleotide sequence of VGR3122 precursor RNA comprises a plurality of segments, the first half of each such segment having a nucleotide sequence which is at least a partial inversed-reversed sequence of the second half thereof, as is well known in the art.

VGR3122 folded precursor RNA is naturally processed by cellular enzymatic activity into at least 2 separate VGAM precursor RNAs, VGAM1781 precursor RNA and VGAM1782 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1781 RNA and VGAM1782 RNA, herein schematically represented by VGAM1 RNA through VGAM3 RNA, each of which VGAM RNAs corresponding to VGAM RNA of FIG. 1.

VGAM1781 RNA, herein schematically represented by VGAM1 RNA through VGAM3 RNA, binds complementarily to a host target binding site located in an untranslated region of VGAM1781 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1781 host target RNA into VGAM1781 host target protein, herein schematically represented by VGAM1 HOST TARGET PROTEIN through VGAM3 HOST TARGET PROTEIN, all of FIG. 1.

VGAM1782 RNA, herein schematically represented by VGAM1 RNA through VGAM3 RNA, binds complementarily to a host target binding site located in an untranslated region of VGAM1782 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1782 host target RNA into VGAM1782 host target protein, herein schematically represented by VGAM1 HOST TARGET PROTEIN through VGAM3 HOST TARGET PROTEIN, all of FIG. 1.

It is appreciated that a function of VGR3122 gene, herein designated VGR GENE, is inhibition of expression of host target genes, as part of a novel viral mechanism of attacking a host. Accordingly, utilities of VGR3122 gene include diagnosis, prevention and treatment of viral infection by Cryphonectria Hypovirus 1. Specific functions, and accordingly utilities, of VGR3122 gene correlate with, and may be deduced from, the identity of the host target genes, which are inhibited by VGAM RNAs comprised in the 'operon-like' cluster of VGR3122 gene: VGAM1781 host target protein and VGAM1782 host target protein, herein schematically represented by VGAM1 HOST TARGET PROTEIN through VGAM3 HOST TARGET PROTEIN. The function of these host target genes is elaborated hereinabove with reference to VGAM1781 and VGAM1782. FIG. 9 further provides a conceptual description of novel bioinformatically detected regulatory viral gene, referred to here as Viral Genomic Record 3123(VGR3123) viral gene, which encodes an 'operon-like' cluster of novel viral micro RNA-like genes, each of which in turn modulates expression of at least one host target gene, the function and utility of which at least one host target gene is known in the art.

VGR3123 gene, herein designated VGR GENE, is a novel bioinformatically detected regulatory, non protein coding, RNA viral gene. The method by which VGR3123 gene was detected is described hereinabove with reference to FIGS. 1-9.

VGR3123 gene encodes VGR3123 precursor RNA, herein designated VGR PRECURSOR RNA, an RNA molecule, typically several hundred nucleotides long.

VGR3123 precursor RNA folds spatially, forming VGR3123 folded precursor RNA, herein designated VGR FOLDED PRECURSOR RNA. It is appreciated that VGR3123 folded precursor RNA comprises a plurality of what is known in the art as 'hairpin' structures. These 'hairpin' structures are due to the fact that the nucleotide sequence of VGR3123 precursor RNA comprises a plurality of segments, the first half of each such segment having a nucleotide sequence which is at least a partial inversed-reversed sequence of the second half thereof, as is well known in the art.

VGR3123 folded precursor RNA is naturally processed by cellular enzymatic activity into at least 7 separate VGAM precursor RNAs, VGAM1783 precursor RNA, VGAM1784 precursor RNA, VGAM1785 precursor RNA, VGAM1786 precursor RNA, VGAM1787 precursor RNA, VGAM1788 precursor RNA and VGAM1789 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1783 RNA, VGAM1784 RNA, VGAM1785 RNA, VGAM1786 RNA, VGAM1787 RNA, VGAM1788 RNA and VGAM1789 RNA, herein schematically represented by VGAM1 RNA through VGAM3 RNA, each of which VGAM RNAs corresponding to VGAM RNA of FIG. 1.

VGAM1783 RNA, herein schematically represented by VGAM1 RNA through VGAM3 RNA, binds complementarily to a host target binding site located in an untranslated region of VGAM1783 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1783 host target RNA into VGAM1783 host target protein, herein schematically represented by VGAM1 HOST TARGET PROTEIN through VGAM3 HOST TARGET PROTEIN, all of FIG. 1.

VGAM1784 RNA, herein schematically represented by VGAM1 RNA through VGAM3 RNA, binds complementarily to a host target binding site located in an untranslated region of VGAM1784 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1784 host target RNA into VGAM1784 host target protein, herein schematically represented by VGAM1 HOST TARGET PROTEIN through VGAM3 HOST TARGET PROTEIN, all of FIG. 1.

VGAM1785 RNA, herein schematically represented by VGAM1 RNA through VGAM3 RNA, binds complementarily to a host target binding site located in an untranslated region of VGAM1785 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1785 host target RNA into VGAM1785 host target protein, herein schematically represented by VGAM1 HOST TARGET PROTEIN through VGAM3 HOST TARGET PROTEIN, all of FIG. 1.

VGAM1786 RNA, herein schematically represented by VGAM1 RNA through VGAM3 RNA, binds complementarily to a host target binding site located in an untranslated region of VGAM1786 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1786 host target RNA into VGAM1786 host target protein, herein schematically represented by VGAM1 HOST TARGET PROTEIN through VGAM3 HOST TARGET PROTEIN, all of FIG. 1.

VGAM1787 RNA, herein schematically represented by VGAM1 RNA through VGAM3 RNA, binds complementarily to a host target binding site located in an untranslated region of VGAM1787 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1787 host target RNA into VGAM1787 host target protein, herein schematically represented by VGAM1 HOST TARGET PROTEIN through VGAM3 HOST TARGET PROTEIN, all of FIG. 1.

VGAM1788 RNA, herein schematically represented by VGAM1 RNA through VGAM3 RNA, binds complementarily to a host target binding site located in an untranslated region of VGAM1788 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1788 host target RNA into VGAM1788 host target protein, herein schematically represented by VGAM1 HOST TARGET PROTEIN through VGAM3 HOST TARGET PROTEIN, all of FIG. 1.

VGAM1789 RNA, herein schematically represented by VGAM1 RNA through VGAM3 RNA, binds complementarily to a host target binding site located in an untranslated region of VGAM1789 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1789 host target RNA into VGAM1789 host target protein, herein schematically represented by VGAM1 HOST TARGET PROTEIN through VGAM3 HOST TARGET PROTEIN, all of FIG. 1.

It is appreciated that a function of VGR3123 gene, herein designated VGR GENE, is inhibition of expression of host target genes, as part of a novel viral mechanism of attacking a host. Accordingly, utilities of VGR3123 gene include diagnosis, prevention and treatment of viral infection by Fowlpox Virus. Specific functions, and accordingly utilities, of VGR3123 gene correlate with, and may be deduced from, the identity of the host target genes, which are inhibited by VGAM RNAs comprised in the 'operon-like' cluster of VGR3123 gene: VGAM1783 host target protein, VGAM1784 host target protein, VGAM1785 host target protein, VGAM1786 host target protein, VGAM1787 host target protein, VGAM1788 host target protein and VGAM1789 host target protein, herein schematically represented by VGAM1 HOST TARGET PROTEIN through VGAM3 HOST TARGET PROTEIN. The function of these host target genes is elaborated hereinabove with reference to VGAM1783, VGAM1784, VGAM1785, VGAM1786, VGAM1787, VGAM1788 and VGAM1789. FIG. 9 further provides a conceptual description of novel bioinformatically detected regulatory viral gene, referred to here as Viral Genomic Record 3124(VGR3124) viral gene, which encodes an 'operon-like' cluster of novel viral micro RNA-like genes, each of which in turn modulates expression of at least one host target gene, the function and utility of which at least one host target gene is known in the art.

VGR3124 gene, herein designated VGR GENE, is a novel bioinformatically detected regulatory, non protein coding, RNA viral gene. The method by which VGR3124 gene was detected is described hereinabove with reference to FIGS. 1-9.

VGR3124 gene encodes VGR3124 precursor RNA, herein designated VGR PRECURSOR RNA, an RNA molecule, typically several hundred nucleotides long.

VGR3124 precursor RNA folds spatially, forming VGR3124 folded precursor RNA, herein designated VGR FOLDED PRECURSOR RNA. It is appreciated that VGR3124 folded precursor RNA comprises a plurality of what is known in the art as 'hairpin' structures. These 'hairpin' structures are due to the fact that the nucleotide sequence of VGR3124 precursor RNA comprises a plurality of segments, the first half of each such segment having a nucleotide sequence which is at least a partial inversed-reversed sequence of the second half thereof, as is well known in the art.

VGR3124 folded precursor RNA is naturally processed by cellular enzymatic activity into at least 7 separate VGAM precursor RNAs, VGAM1790 precursor RNA, VGAM1791 precursor RNA, VGAM1792 precursor RNA, VGAM1793 precursor RNA, VGAM1794 precursor RNA, VGAM1795 precursor RNA and VGAM1796 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1790 RNA, VGAM1791 RNA, VGAM1792 RNA, VGAM1793 RNA, VGAM1794 RNA, VGAM1795 RNA and VGAM1796 RNA, herein schematically represented by VGAM1 RNA through VGAM3 RNA, each of which VGAM RNAs corresponding to VGAM RNA of FIG. 1.

VGAM1790 RNA, herein schematically represented by VGAM1 RNA through VGAM3 RNA, binds complementarily to a host target binding site located in an untranslated region of VGAM1790 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM1790 host target RNA into VGAM1790 host target protein, herein schematically represented by VGAM1 HOST TARGET PROTEIN through VGAM3 HOST TARGET PROTEIN, all of FIG. 1.

VGAM1791 RNA, herein schematically represented by VGAM1 RNA through VGAM3 RNA, binds complementarily to a host target binding site located in an untranslated region of VGAM1791 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1791 host target RNA into VGAM1791 host target protein, herein schematically represented by VGAM1 HOST TARGET PROTEIN through VGAM3 HOST TARGET PROTEIN, all of FIG. 1.

VGAM1792 RNA, herein schematically represented by VGAM1 RNA through VGAM3 RNA, binds complementarily to a host target binding site located in an untranslated region of VGAM1792 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1792 host target RNA into VGAM1792 host target protein, herein schematically represented by VGAM1 HOST TARGET PROTEIN through VGAM3 HOST TARGET PROTEIN, all of FIG. 1.

VGAM1793 RNA, herein schematically represented by VGAM1 RNA through VGAM3 RNA, binds complementarily to a host target binding site located in an untranslated region of VGAM1793 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1793 host target RNA into VGAM1793 host target protein, herein schematically represented by VGAM1 HOST TARGET PROTEIN through VGAM3 HOST TARGET PROTEIN, all of FIG. 1.

VGAM1794 RNA, herein schematically represented by VGAM1 RNA through VGAM3 RNA, binds complementarily to a host target binding site located in an untranslated region of VGAM1794 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1794 host target RNA into VGAM1794 host target protein, herein schematically represented by VGAM1 HOST TARGET PROTEIN through VGAM3 HOST TARGET PROTEIN, all of FIG. 1.

VGAM1795 RNA, herein schematically represented by VGAM1 RNA through VGAM3 RNA, binds complementarily to a host target binding site located in an untranslated region of VGAM1795 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1795 host target RNA into VGAM1795 host target protein, herein schematically represented by VGAM1 HOST TARGET PROTEIN through VGAM3 HOST TARGET PROTEIN, all of FIG. 1.

VGAM1796 RNA, herein schematically represented by VGAM1 RNA through VGAM3 RNA, binds complementarily to a host target binding site located in an untranslated region of VGAM1796 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1796 host target RNA into VGAM1796 host target protein, herein schematically represented by VGAM1 HOST TARGET PROTEIN through VGAM3 HOST TARGET PROTEIN, all of FIG. 1.

It is appreciated that a function of VGR3124 gene, herein designated VGR GENE, is inhibition of expression of host target genes, as part of a novel viral mechanism of attacking a host. Accordingly, utilities of VGR3124 gene include diagnosis, prevention and treatment of viral infection by Rana Tigrina Ranavirus. Specific functions, and accordingly utilities, of VGR3124 gene correlate with, and may be deduced from, the identity of the host target genes, which are inhibited by VGAM RNAs comprised in the 'operon-like' cluster of VGR3124 gene: VGAM1790 host target protein, VGAM1791 host target protein, VGAM1792 host target protein, VGAM1793 host target protein, VGAM1794 host target protein, VGAM1795 host target protein and VGAM1796 host target protein, herein schematically represented by VGAM1 HOST TARGET PROTEIN through VGAM3 HOST TARGET PROTEIN. The function of these host target genes is elaborated hereinabove with reference to VGAM1790, VGAM1791, VGAM1792, VGAM1793, VGAM1794, VGAM1795 and VGAM1796. FIG. 9 further provides a conceptual description of novel bioinformatically detected regulatory viral gene, referred to here as Viral Genomic Record 3125(VGR3125) viral gene, which encodes an 'operon-like' cluster of novel viral micro RNA-like genes, each of which in turn modulates expression of at least one host target gene, the function and utility of which at least one host target gene is known in the art.

VGR3125 gene, herein designated VGR GENE, is a novel bioinformatically detected regulatory, non protein coding, RNA viral gene. The method by which VGR3125 gene was detected is described hereinabove with reference to FIGS. 1-9.

VGR3125 gene encodes VGR3125 precursor RNA, herein designated VGR PRECURSOR RNA, an RNA molecule, typically several hundred nucleotides long.

VGR3125 precursor RNA folds spatially, forming VGR3125 folded precursor RNA, herein designated VGR FOLDED PRECURSOR RNA. It is appreciated that VGR3125 folded precursor RNA comprises a plurality of what is known in the art as 'hairpin' structures. These 'hairpin' structures are due to the fact that the nucleotide sequence of VGR3125 precursor RNA comprises a plurality of segments, the first half of each such segment having a nucleotide sequence which is at least a partial inversed-reversed sequence of the second half thereof, as is well known in the art.

VGR3125 folded precursor RNA is naturally processed by cellular enzymatic activity into at least 2 separate VGAM precursor RNAs, VGAM1797 precursor RNA and VGAM1798 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1797 RNA and VGAM1798 RNA, herein schematically represented by VGAM1 RNA through VGAM3 RNA, each of which VGAM RNAs corresponding to VGAM RNA of FIG. 1.

VGAM1797 RNA, herein schematically represented by VGAM1 RNA through VGAM3 RNA, binds complementarily to a host target binding site located in an untranslated region of VGAM1797 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1797 host target RNA into VGAM1797 host target protein, herein schematically represented by VGAM1 HOST TARGET PROTEIN through VGAM3 HOST TARGET PROTEIN, all of FIG. 1.

VGAM1798 RNA, herein schematically represented by VGAM1 RNA through VGAM3 RNA, binds complementarily to a host target binding site located in an untranslated region of VGAM1798 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1798 host target RNA into VGAM1798 host target protein, herein schematically represented by VGAM1 HOST TARGET PROTEIN through VGAM3 HOST TARGET PROTEIN, all of FIG. 1.

It is appreciated that a function of VGR3125 gene, herein designated VGR GENE, is inhibition of expression of host target genes, as part of a novel viral mechanism of attacking a host. Accordingly, utilities of VGR3125 gene include diagnosis, prevention and treatment of viral infection by Rana Tigrina Ranavirus. Specific functions, and accordingly utilities, of VGR3125 gene correlate with, and may be deduced from, the identity of the host target genes, which are inhibited by VGAM RNAs comprised in the 'operon-like' cluster of VGR3125 gene: VGAM1797 host target protein and VGAM1798 host target protein, herein schematically represented by VGAM1 HOST TARGET PROTEIN through VGAM3 HOST TARGET PROTEIN. The function of these host target genes is elaborated hereinabove with reference to VGAM1797 and VGAM1798. FIG. 9 further provides a conceptual description of novel bioinformatically detected regulatory viral gene, referred to here as Viral Genomic Record 3126(VGR3126) viral gene, which encodes an 'operon-like' cluster of novel viral micro RNA-like genes, each of which in turn modulates expression of at least one host target gene, the function and utility of which at least one host target gene is known in the art.

VGR3126 gene, herein designated VGR GENE, is a novel bioinformatically detected regulatory, non protein coding, RNA viral gene. The method by which VGR3126 gene was detected is described hereinabove with reference to FIGS. 1-9.

VGR3126 gene encodes VGR3126 precursor RNA, herein designated VGR PRECURSOR RNA, an RNA molecule, typically several hundred nucleotides long.

VGR3126 precursor RNA folds spatially, forming VGR3126 folded precursor RNA, herein designated VGR FOLDED PRECURSOR RNA. It is appreciated that VGR3126 folded precursor RNA comprises a plurality of what is known in the art as 'hairpin' structures. These 'hairpin' structures are due to the fact that the nucleotide sequence of VGR3126 precursor RNA comprises a plurality of segments, the first half of each such segment having a nucleotide sequence which is at least a partial inversed-reversed sequence of the second half thereof, as is well known in the art.

VGR3126 folded precursor RNA is naturally processed by cellular enzymatic activity into at least 8 separate VGAM precursor RNAs, VGAM1799 precursor RNA, VGAM1800 precursor RNA, VGAM1801 precursor RNA, VGAM1802 precursor RNA, VGAM1803 precursor RNA, VGAM1804 precursor RNA, VGAM1805 precursor RNA and VGAM1806 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1799 RNA, VGAM1800 RNA, VGAM1801 RNA, VGAM1802 RNA, VGAM1803 RNA, VGAM1804 RNA, VGAM1805 RNA and VGAM1806 RNA, herein schematically represented by VGAM1 RNA through VGAM3 RNA, each of which VGAM RNAs corresponding to VGAM RNA of FIG. 1.

VGAM1799 RNA, herein schematically represented by VGAM1 RNA through VGAM3 RNA, binds complementarily to a host target binding site located in an untranslated region of VGAM1799 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1799 host target RNA into VGAM1799 host target protein, herein schematically represented by VGAM1 HOST TARGET PROTEIN through VGAM3 HOST TARGET PROTEIN, all of FIG. 1.

VGAM1800 RNA, herein schematically represented by VGAM1 RNA through VGAM3 RNA, binds complementarily to a host target binding site located in an untranslated region of VGAM1800 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1800 host target RNA into VGAM1800 host target protein, herein schematically represented by VGAM1 HOST TARGET PROTEIN through VGAM3 HOST TARGET PROTEIN, all of FIG. 1.

VGAM1801 RNA, herein schematically represented by VGAM1 RNA through VGAM3 RNA, binds complementarily to a host target binding site located in an untranslated region of VGAM1801 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1801 host target RNA into VGAM1801 host target protein, herein schematically represented by VGAM1 HOST TARGET PROTEIN through VGAM3 HOST TARGET PROTEIN, all of FIG. 1.

VGAM1802 RNA, herein schematically represented by VGAM1 RNA through VGAM3 RNA, binds complementarily to a host target binding site located in an untranslated region of VGAM1802 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM1802 host target RNA into VGAM1802 host target protein, herein schematically represented by VGAM1 HOST TARGET PROTEIN through VGAM3 HOST TARGET PROTEIN, all of FIG. 1.

VGAM1803 RNA, herein schematically represented by VGAM1 RNA through VGAM3 RNA, binds complementarily to a host target binding site located in an untranslated region of VGAM1803 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1803 host target RNA into VGAM1803 host target protein, herein schematically represented by VGAM1 HOST TARGET PROTEIN through VGAM3 HOST TARGET PROTEIN, all of FIG. 1.

VGAM1804 RNA, herein schematically represented by VGAM1 RNA through VGAM3 RNA, binds complementarily to a host target binding site located in an untranslated region of VGAM1804 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1804 host target RNA into VGAM1804 host target protein, herein schematically represented by VGAM1 HOST TARGET PROTEIN through VGAM3 HOST TARGET PROTEIN, all of FIG. 1.

VGAM1805 RNA, herein schematically represented by VGAM1 RNA through VGAM3 RNA, binds complementarily to a host target binding site located in an untranslated region of VGAM1805 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1805 host target RNA into VGAM1805 host target protein, herein schematically represented by VGAM1 HOST TARGET PROTEIN through VGAM3 HOST TARGET PROTEIN, all of FIG. 1.

VGAM1806 RNA, herein schematically represented by VGAM1 RNA through VGAM3 RNA, binds complementarily to a host target binding site located in an untranslated region of VGAM1806 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1806 host target RNA into VGAM1806 host target protein, herein schematically represented by VGAM1 HOST TARGET PROTEIN through VGAM3 HOST TARGET PROTEIN, all of FIG. 1.

It is appreciated that a function of VGR3126 gene, herein designated VGR GENE, is inhibition of expression of host target genes, as part of a novel viral mechanism of attacking a host. Accordingly, utilities of VGR3126 gene include diagnosis, prevention and treatment of viral infection by Tupaia Herpesvirus. Specific functions, and accordingly utilities, of VGR3126 gene correlate with, and may be deduced from, the identity of the host target genes, which are inhibited by VGAM RNAs comprised in the 'operon-like' cluster of VGR3126 gene: VGAM1799 host target protein, VGAM1800 host target protein, VGAM1801 host target protein, VGAM1802 host target protein, VGAM1803 host target protein, VGAM1804 host target protein, VGAM1805 host target protein and VGAM1806 host target protein, herein schematically represented by VGAM1 HOST TARGET PROTEIN through VGAM3 HOST TARGET PROTEIN. The function of these host target genes is elaborated hereinabove with reference to VGAM1799, VGAM1800, VGAM1801, VGAM1802, VGAM1803, VGAM1804, VGAM1805 and VGAM1806. FIG. 9 further provides a conceptual description of novel bioinformatically detected regulatory viral gene, referred to here as Viral Genomic Record 3127(VGR3127) viral gene, which encodes an 'operon-like' cluster of novel viral micro RNA-like genes, each of which in turn modulates expression of at least one host target gene, the function and utility of which at least one host target gene is known in the art.

VGR3127 gene, herein designated VGR GENE, is a novel bioinformatically detected regulatory, non protein coding, RNA viral gene. The method by which VGR3127 gene was detected is described hereinabove with reference to FIGS. 1-9.

VGR3127 gene encodes VGR3127 precursor RNA, herein designated VGR PRECURSOR RNA, an RNA molecule, typically several hundred nucleotides long.

VGR3127 precursor RNA folds spatially, forming VGR3127 folded precursor RNA, herein designated VGR FOLDED PRECURSOR RNA. It is appreciated that VGR3127 folded precursor RNA comprises a plurality of what is known in the art as 'hairpin' structures. These 'hairpin' structures are due to the fact that the nucleotide sequence of VGR3127 precursor RNA comprises a plurality of segments, the first half of each such segment having a nucleotide sequence which is at least a partial inversed-reversed sequence of the second half thereof, as is well known in the art.

VGR3127 folded precursor RNA is naturally processed by cellular enzymatic activity into at least 3 separate VGAM precursor RNAs, VGAM1807 precursor RNA, VGAM1808 precursor RNA and VGAM1809 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1807 RNA, VGAM1808 RNA and VGAM1809 RNA, herein schematically represented by VGAM1 RNA through VGAM3 RNA, each of which VGAM RNAs corresponding to VGAM RNA of FIG. 1.

VGAM1807 RNA, herein schematically represented by VGAM1 RNA through VGAM3 RNA, binds complementarily to a host target binding site located in an untranslated region of VGAM1807 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1807 host target RNA into VGAM1807 host target protein, herein schematically represented by VGAM1 HOST TARGET PROTEIN through VGAM3 HOST TARGET PROTEIN, all of FIG. 1.

VGAM1808 RNA, herein schematically represented by VGAM1 RNA through VGAM3 RNA, binds complementarily to a host target binding site located in an untranslated region of VGAM1808 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM1808 host target RNA into VGAM1808 host target protein, herein schematically represented by VGAM1 HOST TARGET PROTEIN through VGAM3 HOST TARGET PROTEIN, all of FIG. 1.

VGAM1809 RNA, herein schematically represented by VGAM1 RNA through VGAM3 RNA, binds complementarily to a host target binding site located in an untranslated region of VGAM1809 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1809 host target RNA into VGAM1809 host target protein, herein schematically represented by VGAM1 HOST TARGET PROTEIN through VGAM3 HOST TARGET PROTEIN, all of FIG. 1.

It is appreciated that a function of VGR3127 gene, herein designated VGR GENE, is inhibition of expression of host target genes, as part of a novel viral mechanism of attacking a host. Accordingly, utilities of VGR3127 gene include diagnosis, prevention and treatment of viral infection by Rana Tigrina Ranavirus. Specific functions, and accordingly utilities, of VGR3127 gene correlate with, and may be deduced from, the identity of the host target genes, which are inhibited by VGAM RNAs comprised in the 'operon-like' cluster of VGR3127 gene: VGAM1807 host target protein, VGAM1808 host target protein and VGAM1809 host target protein, herein schematically represented by VGAM1 HOST TARGET PROTEIN through VGAM3 HOST TARGET PROTEIN. The function of these host target genes is elaborated hereinabove with reference to VGAM1807, VGAM1808 and VGAM1809. FIG. 9 further provides a conceptual description of novel bioinformatically detected regulatory viral gene, referred to here as Viral Genomic Record 3128(VGR3128) viral gene, which encodes an 'operon-like' cluster of novel viral micro RNA-like genes, each of which in turn modulates expression of at least one host target gene, the function and utility of which at least one host target gene is known in the art.

VGR3128 gene, herein designated VGR GENE, is a novel bioinformatically detected regulatory, non protein coding, RNA viral gene. The method by which VGR3128 gene was detected is described hereinabove with reference to FIGS. 1-9.

VGR3128 gene encodes VGR3128 precursor RNA, herein designated VGR PRECURSOR RNA, an RNA molecule, typically several hundred nucleotides long.

VGR3128 precursor RNA folds spatially, forming VGR3128 folded precursor RNA, herein designated VGR FOLDED PRECURSOR RNA. It is appreciated that VGR3128 folded precursor RNA comprises a plurality of what is known in the art as 'hairpin' structures. These 'hairpin' structures are due to the fact that the nucleotide sequence of VGR3128 precursor RNA comprises a plurality of segments, the first half of each such segment having a nucleotide sequence which is at least a partial inversed-reversed sequence of the second half thereof, as is well known in the art.

VGR3128 folded precursor RNA is naturally processed by cellular enzymatic activity into at least 6 separate VGAM precursor RNAs, VGAM1810 precursor RNA, VGAM1811 precursor RNA, VGAM1812 precursor RNA, VGAM1813 precursor RNA, VGAM1814 precursor RNA and VGAM1815 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1810 RNA, VGAM1811 RNA, VGAM1812 RNA, VGAM1813 RNA, VGAM1814 RNA and VGAM1815 RNA, herein schematically represented by VGAM1 RNA through VGAM3 RNA, each of which VGAM RNAs corresponding to VGAM RNA of FIG. 1.

VGAM1810 RNA, herein schematically represented by VGAM1 RNA through VGAM3 RNA, binds complementarily to a host target binding site located in an untranslated region of VGAM1810 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1810 host target RNA into VGAM1810 host target protein, herein schematically represented by VGAM1 HOST TARGET PROTEIN through VGAM3 HOST TARGET PROTEIN, all of FIG. 1.

VGAM1811 RNA, herein schematically represented by VGAM1 RNA through VGAM3 RNA, binds complementarily to a host target binding site located in an untranslated region of VGAM1811 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1811 host target RNA into VGAM1811 host target protein, herein schematically represented by VGAM1 HOST TARGET PROTEIN through VGAM3 HOST TARGET PROTEIN, all of FIG. 1.

VGAM1812 RNA, herein schematically represented by VGAM1 RNA through VGAM3 RNA, binds complementarily to a host target binding site located in an untranslated region of VGAM1812 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1812 host target RNA into VGAM1812 host target protein, herein schematically represented by VGAM1 HOST TARGET PROTEIN through VGAM3 HOST TARGET PROTEIN, all of FIG. 1.

VGAM1813 RNA, herein schematically represented by VGAM1 RNA through VGAM3 RNA, binds complementarily to a host target binding site located in an untranslated region of VGAM1813 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1813 host target RNA into VGAM1813 host target protein, herein schematically represented by VGAM1 HOST TARGET PROTEIN through VGAM3 HOST TARGET PROTEIN, all of FIG. 1.

VGAM1814 RNA, herein schematically represented by VGAM1 RNA through VGAM3 RNA, binds complementarily to a host target binding site located in an untranslated region of VGAM1814 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1814 host target RNA into VGAM1814 host target protein, herein schematically represented by VGAM1 HOST TARGET PROTEIN through VGAM3 HOST TARGET PROTEIN, all of FIG. 1.

VGAM1815 RNA, herein schematically represented by VGAM1 RNA through VGAM3 RNA, binds complementarily to a host target binding site located in an untranslated region of VGAM1815 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1815 host target RNA into VGAM1815 host target protein, herein schematically represented by VGAM1 HOST TARGET PROTEIN through VGAM3 HOST TARGET PROTEIN, all of FIG. 1.

It is appreciated that a function of VGR3128 gene, herein designated VGR GENE, is inhibition of expression of host target genes, as part of a novel viral mechanism of attacking a host. Accordingly, utilities of VGR3128 gene include diagnosis, prevention and treatment of viral infection by Equine Herpesvirus 1. Specific functions, and accordingly utilities, of VGR3128 gene correlate with, and may be deduced from, the identity of the host target genes, which are inhibited by VGAM RNAs comprised in the 'operon-like' cluster of VGR3128 gene: VGAM1810 host target protein, VGAM1811 host target protein, VGAM1812 host target protein, VGAM1813 host target protein, VGAM1814 host target protein and VGAM1815 host target protein, herein schematically represented by VGAM1 HOST TARGET PROTEIN through VGAM3 HOST TARGET PROTEIN. The function of these host target genes is elaborated hereinabove with reference to VGAM1810, VGAM1811, VGAM1812, VGAM1813, VGAM1814 and VGAM1815. FIG. 9 further provides a conceptual description of novel bioinformatically detected regulatory viral gene, referred to here as Viral Genomic Record 3129(VGR3129) viral gene, which encodes an 'operon-like' cluster of novel viral micro RNA-like genes, each of which in turn modulates expression of at least one host target gene, the function and utility of which at least one host target gene is known in the art.

VGR3129 gene, herein designated VGR GENE, is a novel bioinformatically detected regulatory, non protein coding, RNA viral gene. The method by which VGR3129 gene was detected is described hereinabove with reference to FIGS. 1-9.

VGR3129 gene encodes VGR3129 precursor RNA, herein designated VGR PRECURSOR RNA, an RNA molecule, typically several hundred nucleotides long.

VGR3129 precursor RNA folds spatially, forming VGR3129 folded precursor RNA, herein designated VGR FOLDED PRECURSOR RNA. It is appreciated that VGR3129 folded precursor RNA comprises a plurality of what is known in the art as 'hairpin' structures. These 'hairpin' structures are due to the fact that the nucleotide sequence of VGR3129 precursor RNA comprises a plurality of segments, the first half of each such segment having a nucleotide sequence which is at least a partial inversed-reversed sequence of the second half thereof, as is well known in the art.

VGR3129 folded precursor RNA is naturally processed by cellular enzymatic activity into at least 8 separate VGAM precursor RNAs, VGAM1816 precursor RNA, VGAM1817 precursor RNA, VGAM1818 precursor RNA, VGAM1819 precursor RNA, VGAM1820 precursor RNA, VGAM1821 precursor RNA, VGAM1822 precursor RNA and VGAM1823 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1816 RNA, VGAM1817 RNA, VGAM1818 RNA, VGAM1819 RNA, VGAM1820 RNA, VGAM1821 RNA, VGAM1822 RNA and VGAM1823 RNA, herein schematically represented by VGAM1 RNA through VGAM3 RNA, each of which VGAM RNAs corresponding to VGAM RNA of FIG. 1.

VGAM1816 RNA, herein schematically represented by VGAM1 RNA through VGAM3 RNA, binds complementarily to a host target binding site located in an untranslated region of VGAM1816 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1816 host target RNA into VGAM1816 host target protein, herein schematically represented by VGAM1 HOST TARGET PROTEIN through VGAM3 HOST TARGET PROTEIN, all of FIG. 1.

VGAM1817 RNA, herein schematically represented by VGAM1 RNA through VGAM3 RNA, binds complementarily to a host target binding site located in an untranslated region of VGAM1817 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1817 host target RNA into VGAM1817 host target protein, herein schematically represented by VGAM1 HOST TARGET PROTEIN through VGAM3 HOST TARGET PROTEIN, all of FIG. 1.

VGAM1818 RNA, herein schematically represented by VGAM1 RNA through VGAM3 RNA, binds complementarily to a host target binding site located in an untranslated region of VGAM1818 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1818 host target RNA into VGAM1818 host target protein, herein schematically represented by VGAM1 HOST TARGET PROTEIN through VGAM3 HOST TARGET PROTEIN, all of FIG. 1.

VGAM1819 RNA, herein schematically represented by VGAM1 RNA through VGAM3 RNA, binds complementarily to a host target binding site located in an untranslated region of VGAM1819 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1819 host target RNA into VGAM1819 host target protein, herein schematically represented by VGAM1 HOST TARGET PROTEIN through VGAM3 HOST TARGET PROTEIN, all of FIG. 1.

VGAM1820 RNA, herein schematically represented by VGAM1 RNA through VGAM3 RNA, binds complementarily to a host target binding site located in an untranslated region of VGAM1820 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1820 host target RNA into VGAM1820 host target protein, herein schematically represented by VGAM1 HOST TARGET PROTEIN through VGAM3 HOST TARGET PROTEIN, all of FIG. 1.

VGAM1821 RNA, herein schematically represented by VGAM1 RNA through VGAM3 RNA, binds complementarily to a host target binding site located in an untranslated region of VGAM1821 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1821 host target RNA into VGAM1821 host target protein, herein schematically represented by VGAM1 HOST TARGET PROTEIN through VGAM3 HOST TARGET PROTEIN, all of FIG. 1.

VGAM1822 RNA, herein schematically represented by VGAM1 RNA through VGAM3 RNA, binds complementarily to a host target binding site located in an untranslated region of VGAM1822 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1822 host target RNA into VGAM1822 host target protein, herein schematically represented by VGAM1 HOST TARGET PROTEIN through VGAM3 HOST TARGET PROTEIN, all of FIG. 1.

VGAM1823 RNA, herein schematically represented by VGAM1 RNA through VGAM3 RNA, binds complementarily to a host target binding site located in an untranslated region of VGAM1823 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1823 host target RNA into VGAM1823 host target protein, herein schematically represented by VGAM1 HOST TARGET PROTEIN through VGAM3 HOST TARGET PROTEIN, all of FIG. 1.

It is appreciated that a function of VGR3129 gene, herein designated VGR GENE, is inhibition of expression of host target genes, as part of a novel viral mechanism of attacking a host. Accordingly, utilities of VGR3129 gene include diagnosis, prevention and treatment of viral infection by Camelpox Virus. Specific functions, and accordingly utilities, of VGR3129 gene correlate with, and may be deduced from, the identity of the host target genes, which are inhibited by VGAM RNAs comprised in the 'operon-like' cluster of VGR3129 gene: VGAM1816 host target protein, VGAM1817 host target protein, VGAM1818 host target protein, VGAM1819 host target protein, VGAM1820 host target protein, VGAM1821 host target protein, VGAM1822 host target protein and VGAM1823 host target protein, herein schematically represented by VGAM1 HOST TARGET PROTEIN through VGAM3 HOST TARGET PROTEIN. The function of these host target genes is elaborated hereinabove with reference to VGAM1816, VGAM1817, VGAM1818, VGAM1819, VGAM1820, VGAM1821, VGAM1822 and VGAM1823. FIG. 9 further provides a conceptual description of novel bioinformatically detected regulatory viral gene, referred to here as Viral Genomic Record 3130(VGR3130) viral gene, which encodes an 'operon-like' cluster of novel viral micro RNA-like genes, each of which in turn modulates expression of at least one host target gene, the function and utility of which at least one host target gene is known in the art.

VGR3130 gene, herein designated VGR GENE, is a novel bioinformatically detected regulatory, non protein coding, RNA viral gene. The method by which VGR3130 gene was detected is described hereinabove with reference to FIGS. 1-9.

VGR3130 gene encodes VGR3130 precursor RNA, herein designated VGR PRECURSOR RNA, an RNA molecule, typically several hundred nucleotides long.

VGR3130 precursor RNA folds spatially, forming VGR3130 folded precursor RNA, herein designated VGR FOLDED PRECURSOR RNA. It is appreciated that VGR3130 folded precursor RNA comprises a plurality of what is known in the art as 'hairpin' structures. These 'hairpin' structures are due to the fact that the nucleotide sequence of VGR3130 precursor RNA comprises a plurality of segments, the first half of each such segment having a nucleotide sequence which is at least a partial inversed-reversed sequence of the second half thereof, as is well known in the art.

VGR3130 folded precursor RNA is naturally processed by cellular enzymatic activity into at least 3 separate VGAM precursor RNAs, VGAM1824 precursor RNA, VGAM1825 precursor RNA and VGAM1826 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1824 RNA, VGAM1825 RNA and VGAM1826 RNA, herein schematically represented by VGAM1 RNA through VGAM3 RNA, each of which VGAM RNAs corresponding to VGAM RNA of FIG. 1.

VGAM1824 RNA, herein schematically represented by VGAM1 RNA through VGAM3 RNA, binds complementarily to a host target binding site located in an untranslated region of VGAM1824 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1824 host target RNA into VGAM1824 host target protein, herein schematically represented by VGAM1 HOST TARGET PROTEIN through VGAM3 HOST TARGET PROTEIN, all of FIG. 1.

VGAM1825 RNA, herein schematically represented by VGAM1 RNA through VGAM3 RNA, binds complementarily to a host target binding site located in an untranslated region of VGAM1825 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1825 host target RNA into VGAM1825 host target protein, herein schematically represented by VGAM1 HOST TARGET PROTEIN through VGAM3 HOST TARGET PROTEIN, all of FIG. 1.

VGAM1826 RNA, herein schematically represented by VGAM1 RNA through VGAM3 RNA, binds complementarily to a host target binding site located in an untranslated region of VGAM1826 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1826 host target RNA into VGAM1826 host target protein, herein schematically represented by VGAM1 HOST TARGET PROTEIN through VGAM3 HOST TARGET PROTEIN, all of FIG. 1.

It is appreciated that a function of VGR3130 gene, herein designated VGR GENE, is inhibition of expression of host target genes, as part of a novel viral mechanism of attacking a host. Accordingly, utilities of VGR3130 gene include diagnosis, prevention and treatment of viral infection by Cryphonectria Hypovirus. Specific functions, and accordingly utilities, of VGR3130 gene correlate with, and may be deduced from, the identity of the host target genes, which are inhibited by VGAM RNAs comprised in the 'operon-like' cluster of VGR3130 gene: VGAM1824 host target protein, VGAM1825 host target protein and VGAM1826 host target protein, herein schematically represented by VGAM1 HOST TARGET PROTEIN through VGAM3 HOST TARGET PROTEIN. The function of these host target genes is elaborated hereinabove with reference to VGAM1824, VGAM1825 and VGAM1826. FIG. 9 further provides a conceptual description of novel bioinformatically detected regulatory viral gene, referred to here as Viral Genomic Record 3131(VGR3131) viral gene, which encodes an 'operon-like' cluster of novel viral micro RNA-like genes, each of which in turn modulates expression of at least one host target gene, the function and utility of which at least one host target gene is known in the art.

VGR3131 gene, herein designated VGR GENE, is a novel bioinformatically detected regulatory, non protein coding, RNA viral gene. The method by which VGR3131 gene was detected is described hereinabove with reference to FIGS. 1-9.

VGR3131 gene encodes VGR3131 precursor RNA, herein designated VGR PRECURSOR RNA, an RNA molecule, typically several hundred nucleotides long.

VGR3131 precursor RNA folds spatially, forming VGR3131 folded precursor RNA, herein designated VGR FOLDED PRECURSOR RNA. It is appreciated that VGR3131 folded precursor RNA comprises a plurality of what is known in the art as 'hairpin' structures. These 'hairpin' structures are due to the fact that the nucleotide sequence of VGR3131 precursor RNA comprises a plurality of segments, the first half of each such segment having a nucleotide sequence which is at least a partial inversed-reversed sequence of the second half thereof, as is well known in the art.

VGR3131 folded precursor RNA is naturally processed by cellular enzymatic activity into at least 3 separate VGAM precursor RNAs, VGAM1827 precursor RNA, VGAM1828 precursor RNA and VGAM1829 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1827 RNA, VGAM1828 RNA and VGAM1829 RNA, herein schematically represented by VGAM1 RNA through VGAM3 RNA, each of which VGAM RNAs corresponding to VGAM RNA of FIG. 1.

VGAM1827 RNA, herein schematically represented by VGAM1 RNA through VGAM3 RNA, binds complementarily to a host target binding site located in an untranslated region of VGAM1827 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1827 host target RNA into VGAM1827 host target protein, herein schematically represented by VGAM1 HOST TARGET PROTEIN through VGAM3 HOST TARGET PROTEIN, all of FIG. 1.

VGAM1828 RNA, herein schematically represented by VGAM1 RNA through VGAM3 RNA, binds complementarily to a host target binding site located in an untranslated region of VGAM1828 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1828 host target RNA into VGAM1828 host target protein, herein schematically represented by VGAM1 HOST TARGET PROTEIN through VGAM3 HOST TARGET PROTEIN, all of FIG. 1.

VGAM1829 RNA, herein schematically represented by VGAM1 RNA through VGAM3 RNA, binds complementarily to a host target binding site located in an untranslated region of VGAM1829 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1829 host target RNA into VGAM1829 host target protein, herein schematically represented by VGAM1 HOST TARGET PROTEIN through VGAM3 HOST TARGET PROTEIN, all of FIG. 1.

It is appreciated that a function of VGR3131 gene, herein designated VGR GENE, is inhibition of expression of host target genes, as part of a novel viral mechanism of attacking a host. Accordingly, utilities of VGR3131 gene include diagnosis, prevention and treatment of viral infection by Rabbit Fibroma Virus. Specific functions, and accordingly utilities, of VGR3131 gene correlate with, and may be deduced from, the identity of the host target genes, which are inhibited by VGAM RNAs comprised in the 'operon-like' cluster of VGR3131 gene: VGAM1827 host target protein, VGAM1828 host target protein and VGAM1829 host target protein, herein schematically represented by VGAM1 HOST TARGET PROTEIN through VGAM3 HOST TARGET PROTEIN. The function of these host target genes is elaborated hereinabove with reference to VGAM1827, VGAM1828 and VGAM1829. FIG. 9 further provides a conceptual description of novel bioinformatically detected regulatory viral gene, referred to here as Viral Genomic Record 3132(VGR3132) viral gene, which encodes an 'operon-like' cluster of novel viral micro RNA-like genes, each of which in turn modulates expression of at least one host target gene, the function and utility of which at least one host target gene is known in the art.

VGR3132 gene, herein designated VGR GENE, is a novel bioinformatically detected regulatory, non protein coding, RNA viral gene. The method by which VGR3132 gene was detected is described hereinabove with reference to FIGS. 1-9.

VGR3132 gene encodes VGR3132 precursor RNA, herein designated VGR PRECURSOR RNA, an RNA molecule, typically several hundred nucleotides long.

VGR3132 precursor RNA folds spatially, forming VGR3132 folded precursor RNA, herein designated VGR FOLDED PRECURSOR RNA. It is appreciated that VGR3132 folded precursor RNA comprises a plurality of what is known in the art as 'hairpin' structures. These 'hairpin' structures are due to the fact that the nucleotide sequence of VGR3132 precursor RNA comprises a plurality of segments, the first half of each such segment having a nucleotide sequence which is at least a partial inversed-reversed sequence of the second half thereof, as is well known in the art.

VGR3132 folded precursor RNA is naturally processed by cellular enzymatic activity into at least 5 separate VGAM precursor RNAs, VGAM1830 precursor RNA, VGAM1831 precursor RNA, VGAM1832 precursor RNA, VGAM1833 precursor RNA and VGAM1834 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1830 RNA, VGAM1831 RNA, VGAM1832 RNA, VGAM1833 RNA and VGAM1834 RNA, herein schematically represented by VGAM1 RNA through VGAM3 RNA, each of which VGAM RNAs corresponding to VGAM RNA of FIG. 1.

VGAM1830 RNA, herein schematically represented by VGAM1 RNA through VGAM3 RNA, binds complementarily to a host target binding site located in an untranslated region of VGAM1830 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1830 host target RNA into VGAM1830 host target protein, herein schematically represented by VGAM1 HOST TARGET PROTEIN through VGAM3 HOST TARGET PROTEIN, all of FIG. 1.

VGAM1831 RNA, herein schematically represented by VGAM1 RNA through VGAM3 RNA, binds complementarily to a host target binding site located in an untranslated region of VGAM1831 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1831 host target RNA into VGAM1831 host target protein, herein schematically represented by VGAM1 HOST TARGET PROTEIN through VGAM3 HOST TARGET PROTEIN, all of FIG. 1.

VGAM1832 RNA, herein schematically represented by VGAM1 RNA through VGAM3 RNA, binds complementarily to a host target binding site located in an untranslated region of VGAM1832 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1832 host target RNA into VGAM1832 host target protein, herein schematically represented by VGAM1 HOST TARGET PROTEIN through VGAM3 HOST TARGET PROTEIN, all of FIG. 1.

VGAM1833 RNA, herein schematically represented by VGAM1 RNA through VGAM3 RNA, binds complementarily to a host target binding site located in an untranslated region of VGAM1833 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1833 host target RNA into VGAM1833 host target protein, herein schematically represented by VGAM1 HOST TARGET PROTEIN through VGAM3 HOST TARGET PROTEIN, all of FIG. 1.

VGAM1834 RNA, herein schematically represented by VGAM1 RNA through VGAM3 RNA, binds complementarily to a host target binding site located in an untranslated region of VGAM1834 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1834 host target RNA into VGAM1834 host target protein, herein schematically represented by VGAM1 HOST TARGET PROTEIN through VGAM3 HOST TARGET PROTEIN, all of FIG. 1.

It is appreciated that a function of VGR3132 gene, herein designated VGR GENE, is inhibition of expression of host target genes, as part of a novel viral mechanism of attacking a host. Accordingly, utilities of VGR3132 gene include diagnosis, prevention and treatment of viral infection by Camelpox Virus. Specific functions, and accordingly utilities, of VGR3132 gene correlate with, and may be deduced from, the identity of the host target genes, which are inhibited by VGAM RNAs comprised in the 'operon-like' cluster of VGR3132 gene: VGAM1830 host target protein, VGAM1831 host target protein, VGAM1832 host target protein, VGAM1833 host target protein and VGAM1834 host target protein, herein schematically represented by VGAM1 HOST TARGET PROTEIN through VGAM3 HOST TARGET PROTEIN. The function of these host target genes is elaborated hereinabove with reference to VGAM1830, VGAM1831, VGAM1832, VGAM1833 and VGAM1834. FIG. 9 further provides a conceptual description of novel bioinformatically detected regulatory viral gene, referred to here as Viral Genomic Record 3133(VGR3133) viral gene, which encodes an 'operon-like' cluster of novel viral micro RNA-like genes, each of which in turn modulates expression of at least one host target gene, the function and utility of which at least one host target gene is known in the art.

VGR3133 gene, herein designated VGR GENE, is a novel bioinformatically detected regulatory, non protein coding, RNA viral gene. The method by which VGR3133 gene was detected is described hereinabove with reference to FIGS. 1-9.

VGR3133 gene encodes VGR3133 precursor RNA, herein designated VGR PRECURSOR RNA, an RNA molecule, typically several hundred nucleotides long.

VGR3133 precursor RNA folds spatially, forming VGR3133 folded precursor RNA, herein designated VGR FOLDED PRECURSOR RNA. It is appreciated that VGR3133 folded precursor RNA comprises a plurality of what is known in the art as 'hairpin' structures. These 'hairpin' structures are due to the fact that the nucleotide sequence of VGR3133 precursor RNA comprises a plurality of segments, the first half of each such segment having a nucleotide sequence which is at least a partial inversed-reversed sequence of the second half thereof, as is well known in the art.

VGR3133 folded precursor RNA is naturally processed by cellular enzymatic activity into at least 5 separate VGAM precursor RNAs, VGAM1835 precursor RNA, VGAM1836 precursor RNA, VGAM1837 precursor RNA, VGAM1838 precursor RNA and VGAM1839 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1835 RNA, VGAM1836 RNA, VGAM1837 RNA, VGAM1838 RNA and VGAM1839 RNA, herein schematically represented by VGAM1 RNA through VGAM3 RNA, each of which VGAM RNAs corresponding to VGAM RNA of FIG. 1.

VGAM1835 RNA, herein schematically represented by VGAM1 RNA through VGAM3 RNA, binds complementarily to a host target binding site located in an untranslated region of VGAM1835 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1835 host target RNA into VGAM1835 host target protein, herein schematically represented by VGAM1 HOST TARGET PROTEIN through VGAM3 HOST TARGET PROTEIN, all of FIG. 1.

VGAM1836 RNA, herein schematically represented by VGAM1 RNA through VGAM3 RNA, binds complementarily to a host target binding site located in an untranslated region of VGAM1836 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1836 host target RNA into VGAM1836 host target protein, herein schematically represented by VGAM1 HOST TARGET PROTEIN through VGAM3 HOST TARGET PROTEIN, all of FIG. 1.

VGAM1837 RNA, herein schematically represented by VGAM1 RNA through VGAM3 RNA, binds complementarily to a host target binding site located in an untranslated region of VGAM1837 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1837 host target RNA into VGAM1837 host target protein, herein schematically represented by VGAM1 HOST TARGET PROTEIN through VGAM3 HOST TARGET PROTEIN, all of FIG. 1.

VGAM1838 RNA, herein schematically represented by VGAM1 RNA through VGAM3 RNA, binds complementarily to a host target binding site located in an untranslated region of VGAM1838 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1838 host target RNA into VGAM1838 host target protein, herein schematically represented by VGAM1 HOST TARGET PROTEIN through VGAM3 HOST TARGET PROTEIN, all of FIG. 1.

VGAM1839 RNA, herein schematically represented by VGAM1 RNA through VGAM3 RNA, binds complementarily to a host target binding site located in an untranslated region of VGAM1839 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1839 host target RNA into VGAM1839 host target protein, herein schematically represented by VGAM1 HOST TARGET PROTEIN through VGAM3 HOST TARGET PROTEIN, all of FIG. 1.

It is appreciated that a function of VGR3133 gene, herein designated VGR GENE, is inhibition of expression of host target genes, as part of a novel viral mechanism of attacking a host. Accordingly, utilities of VGR3133 gene include diagnosis, prevention and treatment of viral infection by Fowlpox Virus. Specific functions, and accordingly utilities, of VGR3133 gene correlate with, and may be deduced from, the identity of the host target genes, which are inhibited by VGAM RNAs comprised in the 'operon-like' cluster of VGR3133 gene: VGAM1835 host target protein, VGAM1836 host target protein, VGAM1837 host target protein, VGAM1838 host target protein and VGAM1839 host target protein, herein schematically represented by VGAM1 HOST TARGET PROTEIN through VGAM3 HOST TARGET PROTEIN. The function of these host target genes is elaborated hereinabove with reference to VGAM1835, VGAM1836, VGAM1837, VGAM1838 and VGAM1839.

FIG. 9 further provides a conceptual description of novel bioinformatically detected regulatory viral gene, referred to here as Viral Genomic Record 3134(VGR3134) viral gene, which encodes an 'operon-like' cluster of novel viral micro RNA-like genes, each of which in turn modulates expression of at least one host target gene, the function and utility of which at least one host target gene is known in the art.

VGR3134 gene, herein designated VGR GENE, is a novel bioinformatically detected regulatory, non protein coding, RNA viral gene. The method by which VGR3134 gene was detected is described hereinabove with reference to FIGS. 1-9.

VGR3134 gene encodes VGR3134 precursor RNA, herein designated VGR PRECURSOR RNA, an RNA molecule, typically several hundred nucleotides long.

VGR3134 precursor RNA folds spatially, forming VGR3134 folded precursor RNA, herein designated VGR FOLDED PRECURSOR RNA. It is appreciated that VGR3134 folded precursor RNA comprises a plurality of what is known in the art as 'hairpin' structures. These 'hairpin' structures are due to the fact that the nucleotide sequence of VGR3134 precursor RNA comprises a plurality of segments, the first half of each such segment having a nucleotide sequence which is at least a partial inversed-reversed sequence of the second half thereof, as is well known in the art.

VGR3134 folded precursor RNA is naturally processed by cellular enzymatic activity into at least 2 separate VGAM precursor RNAs, VGAM1840 precursor RNA and VGAM1841 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1840 RNA and VGAM1841 RNA, herein schematically represented by VGAM1 RNA through VGAM3 RNA, each of which VGAM RNAs corresponding to VGAM RNA of FIG. 1.

VGAM1840 RNA, herein schematically represented by VGAM1 RNA through VGAM3 RNA, binds complementarily to a host target binding site located in an untranslated region of VGAM1840 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1840 host target RNA into VGAM1840 host target protein, herein schematically represented by VGAM1 HOST TARGET PROTEIN through VGAM3 HOST TARGET PROTEIN, all of FIG. 1.

VGAM1841 RNA, herein schematically represented by VGAM1 RNA through VGAM3 RNA, binds complementarily to a host target binding site located in an untranslated region of VGAM1841 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1841 host target RNA into VGAM1841 host target protein, herein schematically represented by VGAM1 HOST TARGET PROTEIN through VGAM3 HOST TARGET PROTEIN, all of FIG. 1.

It is appreciated that a function of VGR3134 gene, herein designated VGR GENE, is inhibition of expression of host target genes, as part of a novel viral mechanism of attacking a host. Accordingly, utilities of VGR3134 gene include diagnosis, prevention and treatment of viral infection by Cowpea Mottle Virus. Specific functions, and accordingly utilities, of VGR3134 gene correlate with, and may be deduced from, the identity of the host target genes, which are inhibited by VGAM RNAs comprised in the 'operon-like' cluster of VGR3134 gene: VGAM1840 host target protein and VGAM1841 host target protein, herein schematically represented by VGAM1 HOST TARGET PROTEIN through VGAM3 HOST TARGET PROTEIN. The function of these host target genes is elaborated hereinabove with reference to VGAM1840 and VGAM1841. FIG. 9 further provides a conceptual description of novel bioinformatically detected regulatory viral gene, referred to here as Viral Genomic Record 3135(VGR3135) viral gene, which encodes an 'operon-like' cluster of novel viral micro RNA-like genes, each of which in turn modulates expression of at least one host target gene, the function and utility of which at least one host target gene is known in the art.

VGR3135 gene, herein designated VGR GENE, is a novel bioinformatically detected regulatory, non protein coding, RNA viral gene. The method by which VGR3135 gene was detected is described hereinabove with reference to FIGS. 1-9.

VGR3135 gene encodes VGR3135 precursor RNA, herein designated VGR PRECURSOR RNA, an RNA molecule, typically several hundred nucleotides long.

VGR3135 precursor RNA folds spatially, forming VGR3135 folded precursor RNA, herein designated VGR FOLDED PRECURSOR RNA. It is appreciated that VGR3135 folded precursor RNA comprises a plurality of what is known in the art as 'hairpin' structures. These 'hairpin' structures are due to the fact that the nucleotide sequence of VGR3135 precursor RNA comprises a plurality of segments, the first half of each such segment having a nucleotide sequence which is at least a partial inversed-reversed sequence of the second half thereof, as is well known in the art.

VGR3135 folded precursor RNA is naturally processed by cellular enzymatic activity into at least 5 separate VGAM precursor RNAs, VGAM1842 precursor RNA, VGAM1843 precursor RNA, VGAM1844 precursor RNA, VGAM1845 precursor RNA and VGAM1846 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1842 RNA, VGAM1843 RNA, VGAM1844 RNA, VGAM1845 RNA and VGAM1846 RNA, herein schematically represented by VGAM1 RNA through VGAM3 RNA, each of which VGAM RNAs corresponding to VGAM RNA of FIG. 1.

VGAM1842 RNA, herein schematically represented by VGAM1 RNA through VGAM3 RNA, binds complementarily to a host target binding site located in an untranslated region of VGAM1842 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1842 host target RNA into VGAM1842 host target protein, herein schematically represented by VGAM1 HOST TARGET PROTEIN through VGAM3 HOST TARGET PROTEIN, all of FIG. 1.

VGAM1843 RNA, herein schematically represented by VGAM1 RNA through VGAM3 RNA, binds complementarily to a host target binding site located in an untranslated region of VGAM1843 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1843 host target RNA into VGAM1843 host target protein, herein schematically represented by VGAM1 HOST TARGET PROTEIN through VGAM3 HOST TARGET PROTEIN, all of FIG. 1.

VGAM1844 RNA, herein schematically represented by VGAM1 RNA through VGAM3 RNA, binds complementarily to a host target binding site located in an untranslated region of VGAM1844 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1844 host target RNA into VGAM1844 host target protein, herein schematically represented by VGAM1 HOST TARGET PROTEIN through VGAM3 HOST TARGET PROTEIN, all of FIG. 1.

VGAM1845 RNA, herein schematically represented by VGAM1 RNA through VGAM3 RNA, binds complementarily to a host target binding site located in an untranslated region of VGAM1845 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1845 host target RNA into VGAM1845 host target protein, herein schematically represented by VGAM1 HOST TARGET PROTEIN through VGAM3 HOST TARGET PROTEIN, all of FIG. 1.

VGAM1846 RNA, herein schematically represented by VGAM1 RNA through VGAM3 RNA, binds complementarily to a host target binding site located in an untranslated region of VGAM1846 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1846 host target RNA into VGAM1846 host target protein, herein schematically represented by VGAM1 HOST TARGET PROTEIN through VGAM3 HOST TARGET PROTEIN, all of FIG. 1.

It is appreciated that a function of VGR3135 gene, herein designated VGR GENE, is inhibition of expression of host target genes, as part of a novel viral mechanism of attacking a host. Accordingly, utilities of VGR3135 gene include diagnosis, prevention and treatment of viral infection by Chimpanzee Cytomegalovirus. Specific functions, and accordingly utilities, of VGR3135 gene correlate with, and may be deduced from, the identity of the host target genes, which are inhibited by VGAM RNAs comprised in the 'operon-like' cluster of VGR3135 gene: VGAM1842 host target protein, VGAM1843 host target protein, VGAM1844 host target protein, VGAM1845 host target protein and VGAM1846 host target protein, herein schematically represented by VGAM1 HOST TARGET PROTEIN through VGAM3 HOST TARGET PROTEIN. The function of these host target genes is elaborated hereinabove with reference to VGAM1842, VGAM1843, VGAM1844, VGAM1845 and VGAM1846.

FIG. 9 further provides a conceptual description of novel bioinformatically detected regulatory viral gene, referred to here as Viral Genomic Record 3136(VGR3136) viral gene, which encodes an 'operon-like' cluster of novel viral micro RNA-like genes, each of which in turn modulates expression of at least one host target gene, the function and utility of which at least one host target gene is known in the art.

VGR3136 gene, herein designated VGR GENE, is a novel bioinformatically detected regulatory, non protein coding, RNA viral gene. The method by which VGR3136 gene was detected is described hereinabove with reference to FIGS. 1-9.

VGR3136 gene encodes VGR3136 precursor RNA, herein designated VGR PRECURSOR RNA, an RNA molecule, typically several hundred nucleotides long.

VGR3136 precursor RNA folds spatially, forming VGR3136 folded precursor RNA, herein designated VGR FOLDED PRECURSOR RNA. It is appreciated that VGR3136 folded precursor RNA comprises a plurality of what is known in the art as 'hairpin' structures. These 'hairpin' structures are due to the fact that the nucleotide sequence of VGR3136 precursor RNA comprises a plurality of segments, the first half of each such segment having a nucleotide sequence which is at least a partial inversed-reversed sequence of the second half thereof, as is well known in the art.

VGR3136 folded precursor RNA is naturally processed by cellular enzymatic activity into at least 7 separate VGAM precursor RNAs, VGAM1847 precursor RNA, VGAM1848 precursor RNA, VGAM1849 precursor RNA, VGAM1850 precursor RNA, VGAM1851 precursor RNA, VGAM1852 precursor RNA and VGAM1853 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1847 RNA, VGAM1848 RNA, VGAM1849 RNA, VGAM1850 RNA, VGAM1851 RNA, VGAM1852 RNA and VGAM1853 RNA, herein schematically represented by VGAM1 RNA through VGAM3 RNA, each of which VGAM RNAs corresponding to VGAM RNA of FIG. 1.

VGAM1847 RNA, herein schematically represented by VGAM1 RNA through VGAM3 RNA, binds complementarily to a host target binding site located in an untranslated region of VGAM1847 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1847 host target RNA into VGAM1847 host target protein, herein schematically represented by VGAM1 HOST TARGET PROTEIN through VGAM3 HOST TARGET PROTEIN, all of FIG. 1.

VGAM1848 RNA, herein schematically represented by VGAM1 RNA through VGAM3 RNA, binds complementarily to a host target binding site located in an untranslated region of VGAM1848 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1848 host target RNA into VGAM1848 host target protein, herein schematically represented by VGAM1 HOST TARGET PROTEIN through VGAM3 HOST TARGET PROTEIN, all of FIG. 1.

VGAM1849 RNA, herein schematically represented by VGAM1 RNA through VGAM3 RNA, binds complementarily to a host target binding site located in an untranslated region of VGAM1849 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1849 host target RNA into VGAM1849 host target protein, herein schematically represented by VGAM1 HOST TARGET PROTEIN through VGAM3 HOST TARGET PROTEIN, all of FIG. 1.

VGAM1850 RNA, herein schematically represented by VGAM1 RNA through VGAM3 RNA, binds complementarily to a host target binding site located in an untranslated region of VGAM1850 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1850 host target RNA into VGAM1850 host target protein, herein schematically represented by VGAM1 HOST TARGET PROTEIN through VGAM3 HOST TARGET PROTEIN, all of FIG. 1.

VGAM1851 RNA, herein schematically represented by VGAM1 RNA through VGAM3 RNA, binds complementarily to a host target binding site located in an untranslated region of VGAM1851 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1851 host target RNA into VGAM1851 host target protein, herein schematically represented by VGAM1 HOST TARGET PROTEIN through VGAM3 HOST TARGET PROTEIN, all of FIG. 1.

VGAM1852 RNA, herein schematically represented by VGAM1 RNA through VGAM3 RNA, binds complementarily to a host target binding site located in an untranslated region of VGAM1852 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1852 host target RNA into VGAM1852 host target protein, herein schematically represented by VGAM1 HOST TARGET PROTEIN through VGAM3 HOST TARGET PROTEIN, all of FIG. 1.

VGAM1853 RNA, herein schematically represented by VGAM1 RNA through VGAM3 RNA, binds complementarily to a host target binding site located in an untranslated region of VGAM1853 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1853 host target RNA into VGAM1853 host target protein, herein schematically represented by VGAM1 HOST TARGET PROTEIN through VGAM3 HOST TARGET PROTEIN, all of FIG. 1.

It is appreciated that a function of VGR3136 gene, herein designated VGR GENE, is inhibition of expression of host target genes, as part of a novel viral mechanism of attacking a host. Accordingly, utilities of VGR3136 gene include diagnosis, prevention and treatment of viral infection by Sonchus Yellow Net Virus. Specific functions, and accordingly utilities, of VGR3136 gene correlate with, and may be deduced from, the identity of the host target genes, which are inhibited by VGAM RNAs comprised in the 'operon-like' cluster of VGR3136 gene: VGAM1847 host target protein, VGAM1848 host target protein, VGAM1849 host target protein, VGAM1850 host target protein, VGAM1851 host target protein, VGAM1852 host target protein and VGAM1853 host target protein, herein schematically represented by VGAM1 HOST TARGET PROTEIN through VGAM3 HOST TARGET PROTEIN. The function of these host target genes is elaborated hereinabove with reference to VGAM1847, VGAM1848, VGAM1849, VGAM1850, VGAM1851, VGAM1852 and VGAM1853. FIG. 9 further provides a conceptual description of novel bioinformatically detected regulatory viral gene, referred to here as Viral Genomic Record 3137(VGR3137) viral gene, which encodes an 'operon-like' cluster of novel viral micro RNA-like genes, each of which in turn modulates expression of at least one host target gene, the function and utility of which at least one host target gene is known in the art.

VGR3137 gene, herein designated VGR GENE, is a novel bioinformatically detected regulatory, non protein coding, RNA viral gene. The method by which VGR3137 gene was detected is described hereinabove with reference to FIGS. 1-9.

VGR3137 gene encodes VGR3137 precursor RNA, herein designated VGR PRECURSOR RNA, an RNA molecule, typically several hundred nucleotides long.

VGR3137 precursor RNA folds spatially, forming VGR3137 folded precursor RNA, herein designated VGR FOLDED PRECURSOR RNA. It is appreciated that VGR3137 folded precursor RNA comprises a plurality of what is known in the art as 'hairpin' structures. These 'hairpin' structures are due to the fact that the nucleotide sequence of VGR3137 precursor RNA comprises a plurality of segments, the first half of each such segment having a nucleotide sequence which is at least a partial inversed-reversed sequence of the second half thereof, as is well known in the art.

VGR3137 folded precursor RNA is naturally processed by cellular enzymatic activity into at least 2 separate VGAM precursor RNAs, VGAM1854 precursor RNA and VGAM1855 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1854 RNA and VGAM1855 RNA, herein schematically represented by VGAM1 RNA through VGAM3 RNA, each of which VGAM RNAs corresponding to VGAM RNA of FIG. 1.

VGAM1854 RNA, herein schematically represented by VGAM1 RNA through VGAM3 RNA, binds complementarily to a host target binding site located in an untranslated region of VGAM1854 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1854 host target RNA into VGAM1854 host target protein, herein schematically represented by VGAM1 HOST TARGET PROTEIN through VGAM3 HOST TARGET PROTEIN, all of FIG. 1.

VGAM1855 RNA, herein schematically represented by VGAM1 RNA through VGAM3 RNA, binds complementarily to a host target binding site located in an untranslated region of VGAM1855 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1855 host target RNA into VGAM1855 host target protein, herein schematically represented by VGAM1 HOST TARGET PROTEIN through VGAM3 HOST TARGET PROTEIN, all of FIG. 1.

It is appreciated that a function of VGR3137 gene, herein designated VGR GENE, is inhibition of expression of host target genes, as part of a novel viral mechanism of attacking a host. Accordingly, utilities of VGR3137 gene include diagnosis, prevention and treatment of viral infection by Cowpea Chlorotic Mottle Virus. Specific functions, and accordingly utilities, of VGR3137 gene correlate with, and may be deduced from, the identity of the host target genes, which are inhibited by VGAM RNAs comprised in the 'operon-like' cluster of VGR3137 gene: VGAM1854 host target protein and VGAM1855 host target protein, herein schematically represented by VGAM1 HOST TARGET PROTEIN through VGAM3 HOST TARGET PROTEIN. The function of these host target genes is elaborated hereinabove with reference to VGAM1854 and VGAM1855. FIG. 9 further provides a conceptual description of novel bioinformatically detected regulatory viral gene, referred to here as Viral Genomic Record 3138(VGR3138) viral gene, which encodes an 'operon-like' cluster of novel viral micro RNA-like genes, each of which in turn modulates expression of at least one host target gene, the function and utility of which at least one host target gene is known in the art.

VGR3138 gene, herein designated VGR GENE, is a novel bioinformatically detected regulatory, non protein coding, RNA viral gene. The method by which VGR3138 gene was detected is described hereinabove with reference to FIGS. 1-9.

VGR3138 gene encodes VGR3138 precursor RNA, herein designated VGR PRECURSOR RNA, an RNA molecule, typically several hundred nucleotides long.

VGR3138 precursor RNA folds spatially, forming VGR3138 folded precursor RNA, herein designated VGR FOLDED PRECURSOR RNA. It is appreciated that VGR3138 folded precursor RNA comprises a plurality of what is known in the art as 'hairpin' structures. These 'hairpin' structures are due to the fact that the nucleotide sequence of VGR3138 precursor RNA comprises a plurality of segments, the first half of each such segment having a nucleotide sequence which is at least a partial inversed-reversed sequence of the second half thereof, as is well known in the art.

VGR3138 folded precursor RNA is naturally processed by cellular enzymatic activity into at least 6 separate VGAM precursor RNAs, VGAM1856 precursor RNA, VGAM1857 precursor RNA, VGAM1858 precursor RNA, VGAM1859 precursor RNA, VGAM1860 precursor RNA and VGAM1861 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1856 RNA, VGAM1857 RNA, VGAM1858 RNA, VGAM1859 RNA, VGAM1860 RNA and VGAM1861 RNA, herein schematically represented by VGAM1 RNA through VGAM3 RNA, each of which VGAM RNAs corresponding to VGAM RNA of FIG. 1.

VGAM1856 RNA, herein schematically represented by VGAM1 RNA through VGAM3 RNA, binds complementarily to a host target binding site located in an untranslated region of VGAM1856 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1856 host target RNA into VGAM1856 host target protein, herein schematically represented by VGAM1 HOST TARGET PROTEIN through VGAM3 HOST TARGET PROTEIN, all of FIG. 1.

VGAM1857 RNA, herein schematically represented by VGAM1 RNA through VGAM3 RNA, binds complementarily to a host target binding site located in an untranslated region of VGAM1857 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1857 host target RNA into VGAM1857 host target protein, herein schematically represented by VGAM1 HOST TARGET PROTEIN through VGAM3 HOST TARGET PROTEIN, all of FIG. 1.

VGAM1858 RNA, herein schematically represented by VGAM1 RNA through VGAM3 RNA, binds complementarily to a host target binding site located in an untranslated region of VGAM1858 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1858 host target RNA into VGAM1858 host target protein, herein schematically represented by VGAM1 HOST TARGET PROTEIN through VGAM3 HOST TARGET PROTEIN, all of FIG. 1.

VGAM1859 RNA, herein schematically represented by VGAM1 RNA through VGAM3 RNA, binds complementarily to a host target binding site located in an untranslated region of VGAM1859 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1859 host target RNA into VGAM1859 host target protein, herein schematically represented by VGAM1 HOST TARGET PROTEIN through VGAM3 HOST TARGET PROTEIN, all of FIG. 1.

VGAM1860 RNA, herein schematically represented by VGAM1 RNA through VGAM3 RNA, binds complementarily to a host target binding site located in an untranslated region of VGAM1860 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1860 host target RNA into VGAM1860 host target protein, herein schematically represented by VGAM1 HOST TARGET PROTEIN through VGAM3 HOST TARGET PROTEIN, all of FIG. 1.

VGAM1861 RNA, herein schematically represented by VGAM1 RNA through VGAM3 RNA, binds complementarily to a host target binding site located in an untranslated region of VGAM1861 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1861 host target RNA into VGAM1861 host target protein, herein schematically represented by VGAM1 HOST TARGET PROTEIN through VGAM3 HOST TARGET PROTEIN, all of FIG. 1.

It is appreciated that a function of VGR3138 gene, herein designated VGR GENE, is inhibition of expression of host target genes, as part of a novel viral mechanism of attacking a host. Accordingly, utilities of VGR3138 gene include diagnosis, prevention and treatment of viral infection by Rice Yellow Stunt Virus. Specific functions, and accordingly utilities, of VGR3138 gene correlate with, and may be deduced from, the identity of the host target genes, which are inhibited by VGAM RNAs comprised in the 'operon-like' cluster of VGR3138 gene: VGAM1856 host target protein, VGAM1857 host target protein, VGAM1858 host target protein, VGAM1859 host target protein, VGAM1860 host target protein and VGAM1861 host target protein, herein schematically represented by VGAM1 HOST TARGET PROTEIN through VGAM3 HOST TARGET PROTEIN. The function of these host target genes is elaborated hereinabove with reference to VGAM1856, VGAM1857, VGAM1858, VGAM1859, VGAM1860 and VGAM1861. FIG. 9 further provides a conceptual description of novel bioinformatically detected regulatory viral gene, referred to here as Viral Genomic Record 3139(VGR3139) viral gene, which encodes an 'operon-like' cluster of novel viral micro RNA-like genes, each of which in turn modulates expression of at least one host target gene, the function and utility of which at least one host target gene is known in the art.

VGR3139 gene, herein designated VGR GENE, is a novel bioinformatically detected regulatory, non protein coding, RNA viral gene. The method by which VGR3139 gene was detected is described hereinabove with reference to FIGS. 1-9.

VGR3139 gene encodes VGR3139 precursor RNA, herein designated VGR PRECURSOR RNA, an RNA molecule, typically several hundred nucleotides long.

VGR3139 precursor RNA folds spatially, forming VGR3139 folded precursor RNA, herein designated VGR FOLDED PRECURSOR RNA. It is appreciated that VGR3139 folded precursor RNA comprises a plurality of what is known in the art as 'hairpin' structures. These 'hairpin' structures are due to the fact that the nucleotide sequence of VGR3139 precursor RNA comprises a plurality of segments, the first half of each such segment having a nucleotide sequence which is at least a partial inversed-reversed sequence of the second half thereof, as is well known in the art.

VGR3139 folded precursor RNA is naturally processed by cellular enzymatic activity into at least 6 separate VGAM precursor RNAs, VGAM1863 precursor RNA, VGAM1864 precursor RNA, VGAM1865 precursor RNA, VGAM1866 precursor RNA, VGAM1867 precursor RNA and VGAM1868 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1863 RNA, VGAM1864 RNA, VGAM1865 RNA, VGAM1866 RNA, VGAM1867 RNA and VGAM1868 RNA, herein schematically represented by VGAM1 RNA through VGAM3 RNA, each of which VGAM RNAs corresponding to VGAM RNA of FIG. 1.

VGAM1863 RNA, herein schematically represented by VGAM1 RNA through VGAM3 RNA, binds complementarily to a host target binding site located in an untranslated region of VGAM1863 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1863 host target RNA into VGAM1863 host target protein, herein schematically represented by VGAM1 HOST TARGET PROTEIN through VGAM3 HOST TARGET PROTEIN, all of FIG. 1.

VGAM1864 RNA, herein schematically represented by VGAM1 RNA through VGAM3 RNA, binds complementarily to a host target binding site located in an untranslated region of VGAM1864 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1864 host target RNA into VGAM1864 host target protein, herein schematically represented by VGAM1 HOST TARGET PROTEIN through VGAM3 HOST TARGET PROTEIN, all of FIG. 1.

VGAM1865 RNA, herein schematically represented by VGAM1 RNA through VGAM3 RNA, binds complementarily to a host target binding site located in an untranslated region of VGAM1865 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1865 host target RNA into VGAM1865 host target protein, herein schematically represented by VGAM1 HOST TARGET PROTEIN through VGAM3 HOST TARGET PROTEIN, all of FIG. 1.

VGAM1866 RNA, herein schematically represented by VGAM1 RNA through VGAM3 RNA, binds complementarily to a host target binding site located in an untranslated region of VGAM1866 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1866 host target RNA into VGAM1866 host target protein, herein schematically represented by VGAM1 HOST TARGET PROTEIN through VGAM3 HOST TARGET PROTEIN, all of FIG. 1.

VGAM1867 RNA, herein schematically represented by VGAM1 RNA through VGAM3 RNA, binds complementarily to a host target binding site located in an untranslated region of VGAM1867 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1867 host target RNA into VGAM1867 host target protein, herein schematically represented by VGAM1 HOST TARGET PROTEIN through VGAM3 HOST TARGET PROTEIN, all of FIG. 1.

VGAM1868 RNA, herein schematically represented by VGAM1 RNA through VGAM3 RNA, binds complementarily to a host target binding site located in an untranslated region of VGAM1868 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1868 host target RNA into VGAM1868 host target protein, herein schematically represented by VGAM1 HOST TARGET PROTEIN through VGAM3 HOST TARGET PROTEIN, all of FIG. 1.

It is appreciated that a function of VGR3139 gene, herein designated VGR GENE, is inhibition of expression of host target genes, as part of a novel viral mechanism of attacking a host. Accordingly, utilities of VGR3139 gene include diagnosis, prevention and treatment of viral infection by Callitrichine Herpesvirus 3. Specific functions, and accordingly utilities, of VGR3139 gene correlate with, and may be deduced from, the identity of the host target genes, which are inhibited by VGAM RNAs comprised in the 'operon-like' cluster of VGR3139 gene: VGAM1863 host target protein, VGAM1864 host target protein, VGAM1865 host target protein, VGAM1866 host target protein, VGAM1867 host target protein and VGAM1868 host target protein, herein schematically represented by VGAM1 HOST TARGET PROTEIN through VGAM3 HOST TARGET PROTEIN. The function of these host target genes is elaborated hereinabove with reference to VGAM1863, VGAM1864, VGAM1865, VGAM1866, VGAM1867 and VGAM1868. FIG. 9 further provides a conceptual description of novel bioinformatically detected regulatory viral gene, referred to here as Viral Genomic Record 3140(VGR3140) viral gene, which encodes an 'operon-like' cluster of novel viral micro RNA-like genes, each of which in turn modulates expression of at least one host target gene, the function and utility of which at least one host target gene is known in the art.

VGR3140 gene, herein designated VGR GENE, is a novel bioinformatically detected regulatory, non protein coding, RNA viral gene. The method by which VGR3140 gene was detected is described hereinabove with reference to FIGS. 1-9.

VGR3140 gene encodes VGR3140 precursor RNA, herein designated VGR PRECURSOR RNA, an RNA molecule, typically several hundred nucleotides long.

VGR3140 precursor RNA folds spatially, forming VGR3140 folded precursor RNA, herein designated VGR FOLDED PRECURSOR RNA. It is appreciated that VGR3140 folded precursor RNA comprises a plurality of what is known in the art as 'hairpin' structures. These 'hairpin' structures are due to the fact that the nucleotide sequence of VGR3140 precursor RNA comprises a plurality of segments, the first half of each such segment having a nucleotide sequence which is at least a partial inversed-reversed sequence of the second half thereof, as is well known in the art.

VGR3140 folded precursor RNA is naturally processed by cellular enzymatic activity into at least 8 separate VGAM precursor RNAs, VGAM1870 precursor RNA, VGAM1871 precursor RNA, VGAM1872 precursor RNA, VGAM1873 precursor RNA, VGAM1874 precursor RNA, VGAM1875 precursor RNA, VGAM1876 precursor RNA and VGAM1877 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1870 RNA, VGAM1871 RNA, VGAM1872 RNA, VGAM1873 RNA, VGAM1874 RNA, VGAM1875 RNA, VGAM1876 RNA and VGAM1877 RNA, herein schematically represented by VGAM1 RNA through VGAM3 RNA, each of which VGAM RNAs corresponding to VGAM RNA of FIG. 1.

VGAM1870 RNA, herein schematically represented by VGAM1 RNA through VGAM3 RNA, binds complementarily to a host target binding site located in an untranslated region of VGAM1870 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1870 host target RNA into VGAM1870 host target protein, herein schematically represented by VGAM1 HOST TARGET PROTEIN through VGAM3 HOST TARGET PROTEIN, all of FIG. 1.

VGAM1871 RNA, herein schematically represented by VGAM1 RNA through VGAM3 RNA, binds complementarily to a host target binding site located in an untranslated region of VGAM1871 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1871 host target RNA into VGAM1871 host target protein, herein schematically represented by VGAM1 HOST TARGET PROTEIN through VGAM3 HOST TARGET PROTEIN, all of FIG. 1.

VGAM1872 RNA, herein schematically represented by VGAM1 RNA through VGAM3 RNA, binds complementarily to a host target binding site located in an untranslated region of VGAM1872 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1872 host target RNA into VGAM1872 host target protein, herein schematically represented by VGAM1 HOST TARGET PROTEIN through VGAM3 HOST TARGET PROTEIN, all of FIG. 1.

VGAM1873 RNA, herein schematically represented by VGAM1 RNA through VGAM3 RNA, binds complementarily to a host target binding site located in an untranslated region of VGAM1873 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1873 host target RNA into VGAM1873 host target protein, herein schematically represented by VGAM1 HOST TARGET PROTEIN through VGAM3 HOST TARGET PROTEIN, all of FIG. 1.

VGAM1874 RNA, herein schematically represented by VGAM1 RNA through VGAM3 RNA, binds complementarily to a host target binding site located in an untranslated region of VGAM1874 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1874 host target RNA into VGAM1874 host target protein, herein schematically represented by VGAM1 HOST TARGET PROTEIN through VGAM3 HOST TARGET PROTEIN, all of FIG. 1.

VGAM1875 RNA, herein schematically represented by VGAM1 RNA through VGAM3 RNA, binds complementarily to a host target binding site located in an untranslated region of VGAM1875 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1875 host target RNA into VGAM1875 host target protein, herein schematically represented by VGAM1 HOST TARGET PROTEIN through VGAM3 HOST TARGET PROTEIN, all of FIG. 1.

VGAM1876 RNA, herein schematically represented by VGAM1 RNA through VGAM3 RNA, binds complementarily to a host target binding site located in an untranslated region of VGAM1876 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1876 host target RNA into VGAM1876 host target protein, herein schematically represented by VGAM1 HOST TARGET PROTEIN through VGAM3 HOST TARGET PROTEIN, all of FIG. 1.

VGAM1877 RNA, herein schematically represented by VGAM1 RNA through VGAM3 RNA, binds complementarily to a host target binding site located in an untranslated region of VGAM1877 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1877 host target RNA into VGAM1877 host target protein, herein schematically represented by VGAM1 HOST TARGET PROTEIN through VGAM3 HOST TARGET PROTEIN, all of FIG. 1.

It is appreciated that a function of VGR3140 gene, herein designated VGR GENE, is inhibition of expression of host target genes, as part of a novel viral mechanism of attacking a host. Accordingly, utilities of VGR3140 gene include diagnosis, prevention and treatment of viral infection by Fowlpox Virus. Specific functions, and accordingly utilities, of VGR3140 gene correlate with, and may be deduced from, the identity of the host target genes, which are inhibited by VGAM RNAs comprised in the 'operon-like' cluster of VGR3140 gene: VGAM1870 host target protein, VGAM1871 host target protein, VGAM1872 host target protein, VGAM1873 host target protein, VGAM1874 host target protein, VGAM1875 host target protein, VGAM1876 host target protein and VGAM1877 host target protein, herein schematically represented by VGAM1 HOST TARGET PROTEIN through VGAM3 HOST TARGET PROTEIN. The function of these host target genes is elaborated hereinabove with reference to VGAM1870, VGAM1871, VGAM1872, VGAM1873, VGAM1874, VGAM1875, VGAM1876 and VGAM1877. FIG. 9 further provides a conceptual description of novel bioinformatically detected regulatory viral gene, referred to here as Viral Genomic Record 3141(VGR3141) viral gene, which encodes an 'operon-like' cluster of novel viral micro RNA-like genes, each of which in turn modulates expression of at least one host target gene, the function and utility of which at least one host target gene is known in the art.

VGR3141 gene, herein designated VGR GENE, is a novel bioinformatically detected regulatory, non protein coding, RNA viral gene. The method by which VGR3141 gene was detected is described hereinabove with reference to FIGS. 1-9.

VGR3141 gene encodes VGR3141 precursor RNA, herein designated VGR PRECURSOR RNA, an RNA molecule, typically several hundred nucleotides long.

VGR3141 precursor RNA folds spatially, forming VGR3141 folded precursor RNA, herein designated VGR FOLDED PRECURSOR RNA. It is appreciated that VGR3141 folded precursor RNA comprises a plurality of what is known in the art as 'hairpin' structures. These 'hairpin' structures are due to the fact that the nucleotide sequence of VGR3141 precursor RNA comprises a plurality of segments, the first half of each such segment having a nucleotide sequence which is at least a partial inversed-reversed sequence of the second half thereof, as is well known in the art.

VGR3141 folded precursor RNA is naturally processed by cellular enzymatic activity into at least 7 separate VGAM precursor RNAs, VGAM1878 precursor RNA, VGAM1879 precursor RNA, VGAM1880 precursor RNA, VGAM1881 precursor RNA, VGAM1882 precursor RNA, VGAM1883 precursor RNA and VGAM1884 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1878 RNA, VGAM1879 RNA, VGAM1880 RNA, VGAM1881 RNA, VGAM1882 RNA, VGAM1883 RNA and VGAM1884 RNA, herein schematically represented by VGAM1 RNA through VGAM3 RNA, each of which VGAM RNAs corresponding to VGAM RNA of FIG. 1.

VGAM1878 RNA, herein schematically represented by VGAM1 RNA through VGAM3 RNA, binds complementarily to a host target binding site located in an untranslated region of VGAM1878 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1878 host target RNA into VGAM1878 host target protein, herein schematically represented by VGAM1 HOST TARGET PROTEIN through VGAM3 HOST TARGET PROTEIN, all of FIG. 1.

VGAM1879 RNA, herein schematically represented by VGAM1 RNA through VGAM3 RNA, binds complementarily to a host target binding site located in an untranslated region of VGAM1879 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1879 host target RNA into VGAM1879 host target protein, herein schematically represented by VGAM1 HOST TARGET PROTEIN through VGAM3 HOST TARGET PROTEIN, all of FIG. 1.

VGAM1880 RNA, herein schematically represented by VGAM1 RNA through VGAM3 RNA, binds complementarily to a host target binding site located in an untranslated region of VGAM1880 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1880 host target RNA into VGAM1880 host target protein, herein schematically represented by VGAM1 HOST TARGET PROTEIN through VGAM3 HOST TARGET PROTEIN, all of FIG. 1.

VGAM1881 RNA, herein schematically represented by VGAM1 RNA through VGAM3 RNA, binds complementarily to a host target binding site located in an untranslated region of VGAM1881 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1881 host target RNA into VGAM1881 host target protein, herein schematically represented by VGAM1 HOST TARGET PROTEIN through VGAM3 HOST TARGET PROTEIN, all of FIG. 1.

VGAM1882 RNA, herein schematically represented by VGAM1 RNA through VGAM3 RNA, binds complementarily to a host target binding site located in an untranslated region of VGAM1882 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1882 host target RNA into VGAM1882 host target protein, herein schematically represented by VGAM1 HOST TARGET PROTEIN through VGAM3 HOST TARGET PROTEIN, all of FIG. 1.

VGAM1883 RNA, herein schematically represented by VGAM1 RNA through VGAM3 RNA, binds complementarily to a host target binding site located in an untranslated region of VGAM1883 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1883 host target RNA into VGAM1883 host target protein, herein schematically represented by VGAM1 HOST TARGET PROTEIN through VGAM3 HOST TARGET PROTEIN, all of FIG. 1.

VGAM1884 RNA, herein schematically represented by VGAM1 RNA through VGAM3 RNA, binds complementarily to a host target binding site located in an untranslated region of VGAM1884 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1884 host target RNA into VGAM1884 host target protein, herein schematically represented by VGAM1 HOST TARGET PROTEIN through VGAM3 HOST TARGET PROTEIN, all of FIG. 1.

It is appreciated that a function of VGR3141 gene, herein designated VGR GENE, is inhibition of expression of host target genes, as part of a novel viral mechanism of attacking a host. Accordingly, utilities of VGR3141 gene include diagnosis, prevention and treatment of viral infection by Bovine Respiratory Syncytial Virus. Specific functions, and accordingly utilities, of VGR3141 gene correlate with, and may be deduced from, the identity of the host target genes, which are inhibited by VGAM RNAs comprised in the 'operon-like' cluster of VGR3141 gene: VGAM1878 host target protein, VGAM1879 host target protein, VGAM1880 host target protein, VGAM1881 host target protein, VGAM1882 host target protein, VGAM1883 host target protein and VGAM1884 host target protein, herein schematically represented by VGAM1 HOST TARGET PROTEIN through VGAM3 HOST TARGET PROTEIN. The function of these host target genes is elaborated hereinabove with reference to VGAM1878, VGAM1879, VGAM1880, VGAM1881, VGAM1882, VGAM1883 and VGAM1884. FIG. 9 further provides a conceptual description of novel bioinformatically detected regulatory viral gene, referred to here as Viral Genomic Record 3142(VGR3142) viral gene, which encodes an 'operon-like' cluster of novel viral micro RNA-like genes, each of which in turn modulates expression of at least one host target gene, the function and utility of which at least one host target gene is known in the art.

VGR3142 gene, herein designated VGR GENE, is a novel bioinformatically detected regulatory, non protein coding, RNA viral gene. The method by which VGR3142 gene was detected is described hereinabove with reference to FIGS. 1-9.

VGR3142 gene encodes VGR3142 precursor RNA, herein designated VGR PRECURSOR RNA, an RNA molecule, typically several hundred nucleotides long.

VGR3142 precursor RNA folds spatially, forming VGR3142 folded precursor RNA, herein designated VGR FOLDED PRECURSOR RNA. It is appreciated that VGR3142 folded precursor RNA comprises a plurality of what is known in the art as 'hairpin' structures. These 'hairpin' structures are due to the fact that the nucleotide sequence of VGR3142 precursor RNA comprises a plurality of segments, the first half of each such segment having a nucleotide sequence which is at least a partial inversed-reversed sequence of the second half thereof, as is well known in the art.

VGR3142 folded precursor RNA is naturally processed by cellular enzymatic activity into at least 7 separate VGAM precursor RNAs, VGAM1885 precursor RNA, VGAM1886 precursor RNA, VGAM1887 precursor RNA, VGAM1888 precursor RNA, VGAM1889 precursor RNA, VGAM1890 precursor RNA and VGAM1891 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1885 RNA, VGAM1886 RNA, VGAM1887 RNA, VGAM1888 RNA, VGAM1889 RNA, VGAM1890 RNA and VGAM1891 RNA, herein schematically represented by VGAM1 RNA through VGAM3 RNA, each of which VGAM RNAs corresponding to VGAM RNA of FIG. 1.

VGAM1885 RNA, herein schematically represented by VGAM1 RNA through VGAM3 RNA, binds complementarily to a host target binding site located in an untranslated region of VGAM1885 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1885 host target RNA into VGAM1885 host target protein, herein schematically represented by VGAM1 HOST TARGET PROTEIN through VGAM3 HOST TARGET PROTEIN, all of FIG. 1.

VGAM1886 RNA, herein schematically represented by VGAM1 RNA through VGAM3 RNA, binds complementarily to a host target binding site located in an untranslated region of VGAM1886 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1886 host target RNA into VGAM1886 host target protein, herein schematically represented by VGAM1 HOST TARGET PROTEIN through VGAM3 HOST TARGET PROTEIN, all of FIG. 1.

VGAM1887 RNA, herein schematically represented by VGAM1 RNA through VGAM3 RNA, binds complementarily to a host target binding site located in an untranslated region of VGAM1887 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1887 host target RNA into VGAM1887 host target protein, herein schematically represented by VGAM1 HOST TARGET PROTEIN through VGAM3 HOST TARGET PROTEIN, all of FIG. 1.

VGAM1888 RNA, herein schematically represented by VGAM1 RNA through VGAM3 RNA, binds complementarily to a host target binding site located in an untranslated region of VGAM1888 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1888 host target RNA into VGAM1888 host target protein, herein schematically represented by VGAM1 HOST TARGET PROTEIN through VGAM3 HOST TARGET PROTEIN, all of FIG. 1.

VGAM1889 RNA, herein schematically represented by VGAM1 RNA through VGAM3 RNA, binds complementarily to a host target binding site located in an untranslated region of VGAM1889 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1889 host target RNA into VGAM1889 host target protein, herein schematically represented by VGAM1 HOST TARGET PROTEIN through VGAM3 HOST TARGET PROTEIN, all of FIG. 1.

VGAM1890 RNA, herein schematically represented by VGAM1 RNA through VGAM3 RNA, binds complementarily to a host target binding site located in an untranslated region of VGAM1890 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1890 host target RNA into VGAM1890 host target protein, herein schematically represented by VGAM1 HOST TARGET PROTEIN through VGAM3 HOST TARGET PROTEIN, all of FIG. 1.

VGAM1891 RNA, herein schematically represented by VGAM1 RNA through VGAM3 RNA, binds complementarily to a host target binding site located in an untranslated region of VGAM1891 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1891 host target RNA into VGAM1891 host target protein, herein schematically represented by VGAM1 HOST TARGET PROTEIN through VGAM3 HOST TARGET PROTEIN, all of FIG. 1.

It is appreciated that a function of VGR3142 gene, herein designated VGR GENE, is inhibition of expression of host target genes, as part of a novel viral mechanism of attacking a host. Accordingly, utilities of VGR3142 gene include diagnosis, prevention and treatment of viral infection by Newcastle Disease Virus. Specific functions, and accordingly utilities, of VGR3142 gene correlate with, and may be deduced from, the identity of the host target genes, which are inhibited by VGAM RNAs comprised in the 'operon-like' cluster of VGR3142 gene: VGAM1885 host target protein, VGAM1886 host target protein, VGAM1887 host target protein, VGAM1888 host target protein, VGAM1889 host target protein, VGAM1890 host target protein and VGAM1891 host target protein, herein schematically represented by VGAM1 HOST TARGET PROTEIN through VGAM3 HOST TARGET PROTEIN. The function of these host target genes is elaborated hereinabove with reference to VGAM1885, VGAM1886, VGAM1887, VGAM1888, VGAM1889, VGAM1890 and VGAM1891. FIG. 9 further provides a conceptual description of novel bioinformatically detected regulatory viral gene, referred to here as Viral Genomic Record 3143(VGR3143) viral gene, which encodes an 'operon-like' cluster of novel viral micro RNA-like genes, each of which in turn modulates expression of at least one host target gene, the function and utility of which at least one host target gene is known in the art.

VGR3143 gene, herein designated VGR GENE, is a novel bioinformatically detected regulatory, non protein coding, RNA viral gene. The method by which VGR3143 gene was detected is described hereinabove with reference to FIGS. 1-9.

VGR3143 gene encodes VGR3143 precursor RNA, herein designated VGR PRECURSOR RNA, an RNA molecule, typically several hundred nucleotides long.

VGR3143 precursor RNA folds spatially, forming VGR3143 folded precursor RNA, herein designated VGR FOLDED PRECURSOR RNA. It is appreciated that VGR3143 folded precursor RNA comprises a plurality of what is known in the art as 'hairpin' structures. These 'hairpin' structures are due to the fact that the nucleotide sequence of VGR3143 precursor RNA comprises a plurality of segments, the first half of each such segment having a nucleotide sequence which is at least a partial inversed-reversed sequence of the second half thereof, as is well known in the art.

VGR3143 folded precursor RNA is naturally processed by cellular enzymatic activity into at least 2 separate VGAM precursor RNAs, VGAM1892 precursor RNA and VGAM1893 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1892 RNA and VGAM1893 RNA, herein schematically represented by VGAM1 RNA through VGAM3 RNA, each of which VGAM RNAs corresponding to VGAM RNA of FIG. 1.

VGAM1892 RNA, herein schematically represented by VGAM1 RNA through VGAM3 RNA, binds complementarily to a host target binding site located in an untranslated region of VGAM1892 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1892 host target RNA into VGAM1892 host target protein, herein schematically represented by VGAM1 HOST TARGET PROTEIN through VGAM3 HOST TARGET PROTEIN, all of FIG. 1.

VGAM1893 RNA, herein schematically represented by VGAM1 RNA through VGAM3 RNA, binds complementarily to a host target binding site located in an untranslated region of VGAM1893 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1893 host target RNA into VGAM1893 host target protein, herein schematically represented by VGAM1 HOST TARGET PROTEIN through VGAM3 HOST TARGET PROTEIN, all of FIG. 1.

It is appreciated that a function of VGR3143 gene, herein designated VGR GENE, is inhibition of expression of host target genes, as part of a novel viral mechanism of attacking a host. Accordingly, utilities of VGR3143 gene include diagnosis, prevention and treatment of viral infection by Newcastle Disease Virus. Specific functions, and accordingly utilities, of VGR3143 gene correlate with, and may be deduced from, the identity of the host target genes, which are inhibited by VGAM RNAs comprised in the 'operon-like' cluster of VGR3143 gene: VGAM1892 host target protein and VGAM1893 host target protein, herein schematically represented by VGAM1 HOST TARGET PROTEIN through VGAM3 HOST TARGET PROTEIN. The function of these host target genes is elaborated hereinabove with reference to VGAM1892 and VGAM1893. FIG. 9 further provides a conceptual description of novel bioinformatically detected regulatory viral gene, referred to here as Viral Genomic Record 3144(VGR3144) viral gene, which encodes an 'operon-like' cluster of novel viral micro RNA-like genes, each of which in turn modulates expression of at least one host target gene, the function and utility of which at least one host target gene is known in the art.

VGR3144 gene, herein designated VGR GENE, is a novel bioinformatically detected regulatory, non protein coding, RNA viral gene. The method by which VGR3144 gene was detected is described hereinabove with reference to FIGS. 1-9.

VGR3144 gene encodes VGR3144 precursor RNA, herein designated VGR PRECURSOR RNA, an RNA molecule, typically several hundred nucleotides long.

VGR3144 precursor RNA folds spatially, forming VGR3144 folded precursor RNA, herein designated VGR FOLDED PRECURSOR RNA. It is appreciated that VGR3144 folded precursor RNA comprises a plurality of what is known in the art as 'hairpin' structures. These 'hairpin' structures are due to the fact that the nucleotide sequence of VGR3144 precursor RNA comprises a plurality of segments, the first half of each such segment having a nucleotide sequence which is at least a partial inversed-reversed sequence of the second half thereof, as is well known in the art.

VGR3144 folded precursor RNA is naturally processed by cellular enzymatic activity into at least 8 separate VGAM precursor RNAs, VGAM1894 precursor RNA, VGAM1895 precursor RNA, VGAM1896 precursor RNA, VGAM1897 precursor RNA, VGAM1898 precursor RNA, VGAM1899 precursor RNA, VGAM1900 precursor RNA and VGAM1901 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1894 RNA, VGAM1895 RNA, VGAM1896 RNA, VGAM1897 RNA, VGAM1898 RNA, VGAM1899 RNA, VGAM1900 RNA and VGAM1901 RNA, herein schematically represented by VGAM1 RNA through VGAM3 RNA, each of which VGAM RNAs corresponding to VGAM RNA of FIG. 1.

VGAM1894 RNA, herein schematically represented by VGAM1 RNA through VGAM3 RNA, binds complementarily to a host target binding site located in an untranslated region of VGAM1894 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1894 host target RNA into VGAM1894 host target protein, herein schematically represented by VGAM1 HOST TARGET PROTEIN through VGAM3 HOST TARGET PROTEIN, all of FIG. 1.

VGAM1895 RNA, herein schematically represented by VGAM1 RNA through VGAM3 RNA, binds complementarily to a host target binding site located in an untranslated region of VGAM1895 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1895 host target RNA into VGAM1895 host target protein, herein schematically represented by VGAM1 HOST TARGET PROTEIN through VGAM3 HOST TARGET PROTEIN, all of FIG. 1.

VGAM1896 RNA, herein schematically represented by VGAM1 RNA through VGAM3 RNA, binds complementarily to a host target binding site located in an untranslated region of VGAM1896 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1896 host target RNA into VGAM1896 host target protein, herein schematically represented by VGAM1 HOST TARGET PROTEIN through VGAM3 HOST TARGET PROTEIN, all of FIG. 1.

VGAM1897 RNA, herein schematically represented by VGAM1 RNA through VGAM3 RNA, binds complementarily to a host target binding site located in an untranslated region of VGAM1897 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1897 host target RNA into VGAM1897 host target protein, herein schematically represented by VGAM1 HOST TARGET PROTEIN through VGAM3 HOST TARGET PROTEIN, all of FIG. 1.

VGAM1898 RNA, herein schematically represented by VGAM1 RNA through VGAM3 RNA, binds complementarily to a host target binding site located in an untranslated region of VGAM1898 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1898 host target RNA into VGAM1898 host target protein, herein schematically represented by VGAM1 HOST TARGET PROTEIN through VGAM3 HOST TARGET PROTEIN, all of FIG. 1.

VGAM1899 RNA, herein schematically represented by VGAM1 RNA through VGAM3 RNA, binds complementarily to a host target binding site located in an untranslated region of VGAM1899 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1899 host target RNA into VGAM1899 host target protein, herein schematically represented by VGAM1 HOST TARGET PROTEIN through VGAM3 HOST TARGET PROTEIN, all of FIG. 1.

VGAM1900 RNA, herein schematically represented by VGAM1 RNA through VGAM3 RNA, binds complementarily to a host target binding site located in an untranslated region of VGAM1900 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1900 host target RNA into VGAM1900 host target protein, herein schematically represented by VGAM1 HOST TARGET PROTEIN through VGAM3 HOST TARGET PROTEIN, all of FIG. 1.

VGAM1901 RNA, herein schematically represented by VGAM1 RNA through VGAM3 RNA, binds complementarily to a host target binding site located in an untranslated region of VGAM1901 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1901 host target RNA into VGAM1901 host target protein, herein schematically represented by VGAM1 HOST TARGET PROTEIN through VGAM3 HOST TARGET PROTEIN, all of FIG. 1.

It is appreciated that a function of VGR3144 gene, herein designated VGR GENE, is inhibition of expression of host target genes, as part of a novel viral mechanism of attacking a host. Accordingly, utilities of VGR3144 gene include diagnosis, prevention and treatment of viral infection by Respiratory Syncytial Virus. Specific functions, and accordingly utilities, of VGR3144 gene correlate with, and may be deduced from, the identity of the host target genes, which are inhibited by VGAM RNAs comprised in the 'operon-like' cluster of VGR3144 gene: VGAM1894 host target protein, VGAM1895 host target protein, VGAM1896 host target protein, VGAM1897 host target protein, VGAM1898 host target protein, VGAM1899 host target protein, VGAM1900 host target protein and VGAM1901 host target protein, herein schematically represented by VGAM1 HOST TARGET PROTEIN through VGAM3 HOST TARGET PROTEIN. The function of these host target genes is elaborated hereinabove with reference to VGAM1894, VGAM1895, VGAM1896, VGAM1897, VGAM1898, VGAM1899, VGAM1900 and VGAM1901. FIG. 9 further provides a conceptual description of novel bioinformatically detected regulatory viral gene, referred to here as Viral Genomic Record 3145(VGR3145) viral gene, which encodes an 'operon-like' cluster of novel viral micro RNA-like genes, each of which in turn modulates expression of at least one host target gene, the function and utility of which at least one host target gene is known in the art.

VGR3145 gene, herein designated VGR GENE, is a novel bioinformatically detected regulatory, non protein coding, RNA viral gene. The method by which VGR3145 gene was detected is described hereinabove with reference to FIGS. 1-9.

VGR3145 gene encodes VGR3145 precursor RNA, herein designated VGR PRECURSOR RNA, an RNA molecule, typically several hundred nucleotides long.

VGR3145 precursor RNA folds spatially, forming VGR3145 folded precursor RNA, herein designated VGR FOLDED PRECURSOR RNA. It is appreciated that VGR3145 folded precursor RNA comprises a plurality of what is known in the art as 'hairpin' structures. These 'hairpin' structures are due to the fact that the nucleotide sequence of VGR3145 precursor RNA comprises a plurality of segments, the first half of each such segment having a nucleotide sequence which is at least a partial inversed-reversed sequence of the second half thereof, as is well known in the art.

VGR3145 folded precursor RNA is naturally processed by cellular enzymatic activity into at least 3 separate VGAM precursor RNAs, VGAM1902 precursor RNA, VGAM1903 precursor RNA and VGAM1904 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1902 RNA, VGAM1903 RNA and VGAM1904 RNA, herein schematically represented by VGAM1 RNA through VGAM3 RNA, each of which VGAM RNAs corresponding to VGAM RNA of FIG. 1.

VGAM1902 RNA, herein schematically represented by VGAM1 RNA through VGAM3 RNA, binds complementarily to a host target binding site located in an untranslated region of VGAM1902 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1902 host target RNA into VGAM1902 host target protein, herein schematically represented by VGAM1 HOST TARGET PROTEIN through VGAM3 HOST TARGET PROTEIN, all of FIG. 1.

VGAM1903 RNA, herein schematically represented by VGAM1 RNA through VGAM3 RNA, binds complementarily to a host target binding site located in an untranslated region of VGAM1903 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1903 host target RNA into VGAM1903 host target protein, herein schematically represented by VGAM1 HOST TARGET PROTEIN through VGAM3 HOST TARGET PROTEIN, all of FIG. 1.

VGAM1904 RNA, herein schematically represented by VGAM1 RNA through VGAM3 RNA, binds complementarily to a host target binding site located in an untranslated region of VGAM1904 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1904 host target RNA into VGAM1904 host target protein, herein schematically represented by VGAM1 HOST TARGET PROTEIN through VGAM3 HOST TARGET PROTEIN, all of FIG. 1.

It is appreciated that a function of VGR3145 gene, herein designated VGR GENE, is inhibition of expression of host target genes, as part of a novel viral mechanism of attacking a host. Accordingly, utilities of VGR3145 gene include diagnosis, prevention and treatment of viral infection by Respiratory Syncytial Virus. Specific functions, and accordingly utilities, of VGR3145 gene correlate with, and may be deduced from, the identity of the host target genes, which are inhibited by VGAM RNAs comprised in the 'operon-like' cluster of VGR3145 gene: VGAM1902 host target protein, VGAM1903 host target protein and VGAM1904 host target protein, herein schematically represented by VGAM1 HOST TARGET PROTEIN through VGAM3 HOST TARGET PROTEIN. The function of these host target genes is elaborated hereinabove with reference to VGAM1902, VGAM1903 and VGAM1904. FIG. 9 further provides a conceptual description of novel bioinformatically detected regulatory viral gene, referred to here as Viral Genomic Record 3146(VGR3146) viral gene, which encodes an 'operon-like' cluster of novel viral micro RNA-like genes, each of which in turn modulates expression of at least one host target gene, the function and utility of which at least one host target gene is known in the art.

VGR3146 gene, herein designated VGR GENE, is a novel bioinformatically detected regulatory, non protein coding, RNA viral gene. The method by which VGR3146 gene was detected is described hereinabove with reference to FIGS. 1-9.

VGR3146 gene encodes VGR3146 precursor RNA, herein designated VGR PRECURSOR RNA, an RNA molecule, typically several hundred nucleotides long.

VGR3146 precursor RNA folds spatially, forming VGR3146 folded precursor RNA, herein designated VGR FOLDED PRECURSOR RNA. It is appreciated that VGR3146 folded precursor RNA comprises a plurality of what is known in the art as 'hairpin' structures. These 'hairpin' structures are due to the fact that the nucleotide sequence of VGR3146 precursor RNA comprises a plurality of segments, the first half of each such segment having a nucleotide sequence which is at least a partial inversed-reversed sequence of the second half thereof, as is well known in the art.

VGR3146 folded precursor RNA is naturally processed by cellular enzymatic activity into at least 2 separate VGAM precursor RNAs, VGAM1905 precursor RNA and VGAM1906 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1905 RNA and VGAM1906 RNA, herein schematically represented by VGAM1 RNA through VGAM3 RNA, each of which VGAM RNAs corresponding to VGAM RNA of FIG. 1.

VGAM1905 RNA, herein schematically represented by VGAM1 RNA through VGAM3 RNA, binds complementarily to a host target binding site located in an untranslated region of VGAM1905 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1905 host target RNA into VGAM1905 host target protein, herein schematically represented by VGAM1 HOST TARGET PROTEIN through VGAM3 HOST TARGET PROTEIN, all of FIG. 1.

VGAM1906 RNA, herein schematically represented by VGAM1 RNA through VGAM3 RNA, binds complementarily to a host target binding site located in an untranslated region of VGAM1906 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1906 host target RNA into VGAM1906 host target protein, herein schematically represented by VGAM1 HOST TARGET PROTEIN through VGAM3 HOST TARGET PROTEIN, all of FIG. 1.

It is appreciated that a function of VGR3146 gene, herein designated VGR GENE, is inhibition of expression of host target genes, as part of a novel viral mechanism of attacking a host. Accordingly, utilities of VGR3146 gene include diagnosis, prevention and treatment of viral infection by Sendai Virus. Specific functions, and accordingly utilities, of VGR3146 gene correlate with, and may be deduced from, the identity of the host target genes, which are inhibited by VGAM RNAs comprised in the 'operon-like' cluster of VGR3146 gene: VGAM1905 host target protein and VGAM1906 host target protein, herein schematically represented by VGAM1 HOST TARGET PROTEIN through VGAM3 HOST TARGET PROTEIN. The function of these host target genes is elaborated hereinabove with reference to VGAM1905 and VGAM1906. FIG. 9 further provides a conceptual description of novel bioinformatically detected regulatory viral gene, referred to here as Viral Genomic Record 3147(VGR3147) viral gene, which encodes an 'operon-like' cluster of novel viral micro RNA-like genes, each of which in turn modulates expression of at least one host target gene, the function and utility of which at least one host target gene is known in the art.

VGR3147 gene, herein designated VGR GENE, is a novel bioinformatically detected regulatory, non protein coding, RNA viral gene. The method by which VGR3147 gene was detected is described hereinabove with reference to FIGS. 1-9.

VGR3147 gene encodes VGR3147 precursor RNA, herein designated VGR PRECURSOR RNA, an RNA molecule, typically several hundred nucleotides long.

VGR3147 precursor RNA folds spatially, forming VGR3147 folded precursor RNA, herein designated VGR FOLDED PRECURSOR RNA. It is appreciated that VGR3147 folded precursor RNA comprises a plurality of what is known in the art as 'hairpin' structures. These 'hairpin' structures are due to the fact that the nucleotide sequence of VGR3147 precursor RNA comprises a plurality of segments, the first half of each such segment having a nucleotide sequence which is at least a partial inversed-reversed sequence of the second half thereof, as is well known in the art.

VGR3147 folded precursor RNA is naturally processed by cellular enzymatic activity into at least 7 separate VGAM precursor RNAs, VGAM1907 precursor RNA, VGAM1908 precursor RNA, VGAM1909 precursor RNA, VGAM1910 precursor RNA, VGAM1911 precursor RNA, VGAM1912 precursor RNA and VGAM1913 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1907 RNA, VGAM1908 RNA, VGAM1909 RNA, VGAM1910 RNA, VGAM1911 RNA, VGAM1912 RNA and VGAM1913 RNA, herein schematically represented by VGAM1 RNA through VGAM3 RNA, each of which VGAM RNAs corresponding to VGAM RNA of FIG. 1.

VGAM1907 RNA, herein schematically represented by VGAM1 RNA through VGAM3 RNA, binds complementarily to a host target binding site located in an untranslated region of VGAM1907 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1907 host target RNA into VGAM1907 host target protein, herein schematically represented by VGAM1 HOST TARGET PROTEIN through VGAM3 HOST TARGET PROTEIN, all of FIG. 1.

VGAM1908 RNA, herein schematically represented by VGAM1 RNA through VGAM3 RNA, binds complementarily to a host target binding site located in an untranslated region of VGAM1908 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1908 host target RNA into VGAM1908 host target protein, herein schematically represented by VGAM1 HOST TARGET PROTEIN through VGAM3 HOST TARGET PROTEIN, all of FIG. 1.

VGAM1909 RNA, herein schematically represented by VGAM1 RNA through VGAM3 RNA, binds complementarily to a host target binding site located in an untranslated region of VGAM1909 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1909 host target RNA into VGAM1909 host target protein, herein schematically represented by VGAM1 HOST TARGET PROTEIN through VGAM3 HOST TARGET PROTEIN, all of FIG. 1.

VGAM1910 RNA, herein schematically represented by VGAM1 RNA through VGAM3 RNA, binds complementarily to a host target binding site located in an untranslated region of VGAM1910 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1910 host target RNA into VGAM1910 host target protein, herein schematically represented by VGAM1 HOST TARGET PROTEIN through VGAM3 HOST TARGET PROTEIN, all of FIG. 1.

VGAM1911 RNA, herein schematically represented by VGAM1 RNA through VGAM3 RNA, binds complementarily to a host target binding site located in an untranslated region of VGAM1911 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1911 host target RNA into VGAM1911 host target protein, herein schematically represented by VGAM1 HOST TARGET PROTEIN through VGAM3 HOST TARGET PROTEIN, all of FIG. 1.

VGAM1912 RNA, herein schematically represented by VGAM1 RNA through VGAM3 RNA, binds complementarily to a host target binding site located in an untranslated region of VGAM1912 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1912 host target RNA into VGAM1912 host target protein, herein schematically represented by VGAM1 HOST TARGET PROTEIN through VGAM3 HOST TARGET PROTEIN, all of FIG. 1.

VGAM1913 RNA, herein schematically represented by VGAM1 RNA through VGAM3 RNA, binds complementarily to a host target binding site located in an untranslated region of VGAM1913 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1913 host target RNA into VGAM1913 host target protein, herein schematically represented by VGAM1 HOST TARGET PROTEIN through VGAM3 HOST TARGET PROTEIN, all of FIG. 1.

It is appreciated that a function of VGR3147 gene, herein designated VGR GENE, is inhibition of expression of host target genes, as part of a novel viral mechanism of attacking a host. Accordingly, utilities of VGR3147 gene include diagnosis, prevention and treatment of viral infection by Human Parainfluenza Virus 3. Specific functions, and accordingly utilities, of VGR3147 gene correlate with, and may be deduced from, the identity of the host target genes, which are inhibited by VGAM RNAs comprised in the 'operon-like' cluster of VGR3147 gene: VGAM1907 host target protein, VGAM1908 host target protein, VGAM1909 host target protein, VGAM1910 host target protein, VGAM1911 host target protein, VGAM1912 host target protein and VGAM1913 host target protein, herein schematically represented by VGAM1 HOST TARGET PROTEIN through VGAM3 HOST TARGET PROTEIN. The function of these host target genes is elaborated hereinabove with reference to VGAM1907, VGAM1908, VGAM1909, VGAM1910, VGAM1911, VGAM1912 and VGAM1913. FIG. 9 further provides a conceptual description of novel bioinformatically detected regulatory viral gene, referred to here as Viral Genomic Record 3148(VGR3148) viral gene, which encodes an 'operon-like' cluster of novel viral micro RNA-like genes, each of which in turn modulates expression of at least one host target gene, the function and utility of which at least one host target gene is known in the art.

VGR3148 gene, herein designated VGR GENE, is a novel bioinformatically detected regulatory, non protein coding, RNA viral gene. The method by which VGR3148 gene was detected is described hereinabove with reference to FIGS. 1-9.

VGR3148 gene encodes VGR3148 precursor RNA, herein designated VGR PRECURSOR RNA, an RNA molecule, typically several hundred nucleotides long.

VGR3148 precursor RNA folds spatially, forming VGR3148 folded precursor RNA, herein designated VGR FOLDED PRECURSOR RNA. It is appreciated that VGR3148 folded precursor RNA comprises a plurality of what is known in the art as 'hairpin' structures. These 'hairpin' structures are due to the fact that the nucleotide sequence of VGR3148 precursor RNA comprises a plurality of segments, the first half of each such segment having a nucleotide sequence which is at least a partial inversed-reversed sequence of the second half thereof, as is well known in the art.

VGR3148 folded precursor RNA is naturally processed by cellular enzymatic activity into at least 2 separate VGAM precursor RNAs, VGAM1914 precursor RNA and VGAM1915 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1914 RNA and VGAM1915 RNA, herein schematically represented by VGAM1 RNA through VGAM3 RNA, each of which VGAM RNAs corresponding to VGAM RNA of FIG. 1.

VGAM1914 RNA, herein schematically represented by VGAM1 RNA through VGAM3 RNA, binds complementarily to a host target binding site located in an untranslated region of VGAM1914 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1914 host target RNA into VGAM1914 host target protein, herein schematically represented by VGAM1 HOST TARGET PROTEIN through VGAM3 HOST TARGET PROTEIN, all of FIG. 1.

VGAM1915 RNA, herein schematically represented by VGAM1 RNA through VGAM3 RNA, binds complementarily to a host target binding site located in an untranslated region of VGAM1915 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1915 host target RNA into VGAM1915 host target protein, herein schematically represented by VGAM1 HOST TARGET PROTEIN through VGAM3 HOST TARGET PROTEIN, all of FIG. 1.

It is appreciated that a function of VGR3148 gene, herein designated VGR GENE, is inhibition of expression of host target genes, as part of a novel viral mechanism of attacking a host. Accordingly, utilities of VGR3148 gene include diagnosis, prevention and treatment of viral infection by Human Parainfluenza Virus 3. Specific functions, and accordingly utilities, of VGR3148 gene correlate with, and may be deduced from, the identity of the host target genes, which are inhibited by VGAM RNAs comprised in the 'operon-like' cluster of VGR3148 gene: VGAM1914 host target protein and VGAM1915 host target protein, herein schematically represented by VGAM1 HOST TARGET PROTEIN through VGAM3 HOST TARGET PROTEIN. The function of these host target genes is elaborated hereinabove with reference to VGAM1914 and VGAM1915. FIG. 9 further provides a conceptual description of novel bioinformatically detected regulatory viral gene, referred to here as Viral Genomic Record 3149(VGR3149) viral gene, which encodes an 'operon-like' cluster of novel viral micro RNA-like genes, each of which in turn modulates expression of at least one host target gene, the function and utility of which at least one host target gene is known in the art.

VGR3149 gene, herein designated VGR GENE, is a novel bioinformatically detected regulatory, non protein coding, RNA viral gene. The method by which VGR3149 gene was detected is described hereinabove with reference to FIGS. 1-9.

VGR3149 gene encodes VGR3149 precursor RNA, herein designated VGR PRECURSOR RNA, an RNA molecule, typically several hundred nucleotides long.

VGR3149 precursor RNA folds spatially, forming VGR3149 folded precursor RNA, herein designated VGR FOLDED PRECURSOR RNA. It is appreciated that VGR3149 folded precursor RNA comprises a plurality of what is known in the art as 'hairpin' structures. These 'hairpin' structures are due to the fact that the nucleotide sequence of VGR3149 precursor RNA comprises a plurality of segments, the first half of each such segment having a nucleotide sequence which is at least a partial inversed-reversed sequence of the second half thereof, as is well known in the art.

VGR3149 folded precursor RNA is naturally processed by cellular enzymatic activity into at least 3 separate VGAM precursor RNAs, VGAM1916 precursor RNA, VGAM1917 precursor RNA and VGAM1918 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1916 RNA, VGAM1917 RNA and VGAM1918 RNA, herein schematically represented by VGAM1 RNA through VGAM3 RNA, each of which VGAM RNAs corresponding to VGAM RNA of FIG. 1.

VGAM1916 RNA, herein schematically represented by VGAM1 RNA through VGAM3 RNA, binds complementarily to a host target binding site located in an untranslated region of VGAM1916 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1916 host target RNA into VGAM1916 host target protein, herein schematically represented by VGAM1 HOST TARGET PROTEIN through VGAM3 HOST TARGET PROTEIN, all of FIG. 1.

VGAM1917 RNA, herein schematically represented by VGAM1 RNA through VGAM3 RNA, binds complementarily to a host target binding site located in an untranslated region of VGAM1917 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1917 host target RNA into VGAM1917 host target protein, herein schematically represented by VGAM1 HOST TARGET PROTEIN through VGAM3 HOST TARGET PROTEIN, all of FIG. 1.

VGAM1918 RNA, herein schematically represented by VGAM1 RNA through VGAM3 RNA, binds complementarily to a host target binding site located in an untranslated region of VGAM1918 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1918 host target RNA into VGAM1918 host target protein, herein schematically represented by VGAM1 HOST TARGET PROTEIN through VGAM3 HOST TARGET PROTEIN, all of FIG. 1.

It is appreciated that a function of VGR3149 gene, herein designated VGR GENE, is inhibition of expression of host target genes, as part of a novel viral mechanism of attacking a host. Accordingly, utilities of VGR3149 gene include diagnosis, prevention and treatment of viral infection by Human Parainfluenza Virus 1 Strain Washington/1964. Specific functions, and accordingly utilities, of VGR3149 gene correlate with, and may be deduced from, the identity of the host target genes, which are inhibited by VGAM RNAs comprised in the 'operon-like' cluster of VGR3149 gene: VGAM1916 host target protein, VGAM1917 host target protein and VGAM1918 host target protein, herein schematically represented by VGAM1 HOST TARGET PROTEIN through VGAM3 HOST TARGET PROTEIN. The function of these host target genes is elaborated hereinabove with reference to VGAM1916, VGAM1917 and VGAM1918. FIG. 9 further provides a conceptual description of novel bioinformatically detected regulatory viral gene, referred to here as Viral Genomic Record 3150(VGR3150) viral gene, which encodes an 'operon-like' cluster of novel viral micro RNA-like genes, each of which in turn modulates expression of at least one host target gene, the function and utility of which at least one host target gene is known in the art.

VGR3150 gene, herein designated VGR GENE, is a novel bioinformatically detected regulatory, non protein coding, RNA viral gene. The method by which VGR3150 gene was detected is described hereinabove with reference to FIGS. 1-9.

VGR3150 gene encodes VGR3150 precursor RNA, herein designated VGR PRECURSOR RNA, an RNA molecule, typically several hundred nucleotides long.

VGR3150 precursor RNA folds spatially, forming VGR3150 folded precursor RNA, herein designated VGR FOLDED PRECURSOR RNA. It is appreciated that VGR3150 folded precursor RNA comprises a plurality of what is known in the art as 'hairpin' structures. These 'hairpin' structures are due to the fact that the nucleotide sequence of VGR3150 precursor RNA comprises a plurality of segments, the first half of each such segment having a nucleotide sequence which is at least a partial inversed-reversed sequence of the second half thereof, as is well known in the art.

VGR3150 folded precursor RNA is naturally processed by cellular enzymatic activity into at least 7 separate VGAM precursor RNAs, VGAM1920 precursor RNA, VGAM1921 precursor RNA, VGAM1922 precursor RNA, VGAM1923 precursor RNA, VGAM1924 precursor RNA, VGAM1925 precursor RNA and VGAM1926 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1920 RNA, VGAM1921 RNA, VGAM1922 RNA, VGAM1923 RNA, VGAM1924 RNA, VGAM1925 RNA and VGAM1926 RNA, herein schematically represented by VGAM1 RNA through VGAM3 RNA, each of which VGAM RNAs corresponding to VGAM RNA of FIG. 1.

VGAM1920 RNA, herein schematically represented by VGAM1 RNA through VGAM3 RNA, binds complementarily to a host target binding site located in an untranslated region of VGAM1920 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1920 host target RNA into VGAM1920 host target protein, herein schematically represented by VGAM1 HOST TARGET PROTEIN through VGAM3 HOST TARGET PROTEIN, all of FIG. 1.

VGAM1921 RNA, herein schematically represented by VGAM1 RNA through VGAM3 RNA, binds complementarily to a host target binding site located in an untranslated region of VGAM1921 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1921 host target RNA into VGAM1921 host target protein, herein schematically represented by VGAM1 HOST TARGET PROTEIN through VGAM3 HOST TARGET PROTEIN, all of FIG. 1.

VGAM1922 RNA, herein schematically represented by VGAM1 RNA through VGAM3 RNA, binds complementarily to a host target binding site located in an untranslated region of VGAM1922 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1922 host target RNA into VGAM1922 host target protein, herein schematically represented by VGAM1 HOST TARGET PROTEIN through VGAM3 HOST TARGET PROTEIN, all of FIG. 1.

VGAM1923 RNA, herein schematically represented by VGAM1 RNA through VGAM3 RNA, binds complementarily to a host target binding site located in an untranslated region of VGAM1923 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1923 host target RNA into VGAM1923 host target protein, herein schematically represented by VGAM1 HOST TARGET PROTEIN through VGAM3 HOST TARGET PROTEIN, all of FIG. 1.

VGAM1924 RNA, herein schematically represented by VGAM1 RNA through VGAM3 RNA, binds complementarily to a host target binding site located in an untranslated region of VGAM1924 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1924 host target RNA into VGAM1924 host target protein, herein schematically represented by VGAM1 HOST TARGET PROTEIN through VGAM3 HOST TARGET PROTEIN, all of FIG. 1.

VGAM1925 RNA, herein schematically represented by VGAM1 RNA through VGAM3 RNA, binds complementarily to a host target binding site located in an untranslated region of VGAM1925 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1925 host target RNA into VGAM1925 host target protein, herein schematically represented by VGAM1 HOST TARGET PROTEIN through VGAM3 HOST TARGET PROTEIN, all of FIG. 1.

VGAM1926 RNA, herein schematically represented by VGAM1 RNA through VGAM3 RNA, binds complementarily to a host target binding site located in an untranslated region of VGAM1926 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1926 host target RNA into VGAM1926 host target protein, herein schematically represented by VGAM1 HOST TARGET PROTEIN through VGAM3 HOST TARGET PROTEIN, all of FIG. 1.

It is appreciated that a function of VGR3150 gene, herein designated VGR GENE, is inhibition of expression of host target genes, as part of a novel viral mechanism of attacking a host. Accordingly, utilities of VGR3150 gene include diagnosis, prevention and treatment of viral infection by Canine Distemper Virus. Specific functions, and accordingly utilities, of VGR3150 gene correlate with, and may be deduced from, the identity of the host target genes, which are inhibited by VGAM RNAs comprised in the 'operon-like' cluster of VGR3150 gene: VGAM1920 host target protein, VGAM1921 host target protein, VGAM1922 host target protein, VGAM1923 host target protein, VGAM1924 host target protein, VGAM1925 host target protein and VGAM1926 host target protein, herein schematically represented by VGAM1 HOST TARGET PROTEIN through VGAM3 HOST TAR- GET PROTEIN. The function of these host target genes is elaborated hereinabove with reference to VGAM1920, VGAM1921, VGAM1922, VGAM1923, VGAM1924, VGAM1925 and VGAM1926. FIG. 9 further provides a conceptual description of novel bioinformatically detected regulatory viral gene, referred to here as Viral Genomic Record 3151(VGR3151) viral gene, which encodes an 'operon-like' cluster of novel viral micro RNA-like genes, each of which in turn modulates expression of at least one host target gene, the function and utility of which at least one host target gene is known in the art.

VGR3151 gene, herein designated VGR GENE, is a novel bioinformatically detected regulatory, non protein coding, RNA viral gene. The method by which VGR3151 gene was detected is described hereinabove with reference to FIGS. 1-9.

VGR3151 gene encodes VGR3151 precursor RNA, herein designated VGR PRECURSOR RNA, an RNA molecule, typically several hundred nucleotides long.

VGR3151 precursor RNA folds spatially, forming VGR3151 folded precursor RNA, herein designated VGR FOLDED PRECURSOR RNA. It is appreciated that VGR3151 folded precursor RNA comprises a plurality of what is known in the art as 'hairpin' structures. These 'hairpin' structures are due to the fact that the nucleotide sequence of VGR3151 precursor RNA comprises a plurality of segments, the first half of each such segment having a nucleotide sequence which is at least a partial inversed-reversed sequence of the second half thereof, as is well known in the art.

VGR3151 folded precursor RNA is naturally processed by cellular enzymatic activity into at least 2 separate VGAM precursor RNAs, VGAM1927 precursor RNA and VGAM1928 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1927 RNA and VGAM1928 RNA, herein schematically represented by VGAM1 RNA through VGAM3 RNA, each of which VGAM RNAs corresponding to VGAM RNA of FIG. 1.

VGAM1927 RNA, herein schematically represented by VGAM1 RNA through VGAM3 RNA, binds complementarily to a host target binding site located in an untranslated region of VGAM1927 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1927 host target RNA into VGAM1927 host target protein, herein schematically represented by VGAM1 HOST TARGET PROTEIN through VGAM3 HOST TARGET PROTEIN, all of FIG. 1.

VGAM1928 RNA, herein schematically represented by VGAM1 RNA through VGAM3 RNA, binds complementarily to a host target binding site located in an untranslated region of VGAM1928 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1928 host target RNA into VGAM1928 host target protein, herein schematically represented by VGAM1 HOST TARGET PROTEIN through VGAM3 HOST TARGET PROTEIN, all of FIG. 1.

It is appreciated that a function of VGR3151 gene, herein designated VGR GENE, is inhibition of expression of host target genes, as part of a novel viral mechanism of attacking a host. Accordingly, utilities of VGR3151 gene include diagnosis, prevention and treatment of viral infection by Canine Distemper Virus. Specific functions, and accordingly utilities, of VGR3151 gene correlate with, and may be deduced from, the identity of the host target genes, which are inhibited by VGAM RNAs comprised in the 'operon-like' cluster of VGR3151 gene: VGAM1927 host target protein and VGAM1928 host target protein, herein schematically represented by VGAM1 HOST TARGET PROTEIN through VGAM3 HOST TARGET PROTEIN. The function of these host target genes is elaborated hereinabove with reference to VGAM1927 and VGAM1928. FIG. 9 further provides a conceptual description of novel bioinformatically detected regulatory viral gene, referred to here as Viral Genomic Record 3152(VGR3152) viral gene, which encodes an 'operon-like' cluster of novel viral micro RNA-like genes, each of which in turn modulates expression of at least one host target gene, the function and utility of which at least one host target gene is known in the art.

VGR3152 gene, herein designated VGR GENE, is a novel bioinformatically detected regulatory, non protein coding, RNA viral gene. The method by which VGR3152 gene was detected is described hereinabove with reference to FIGS. 1-9.

VGR3152 gene encodes VGR3152 precursor RNA, herein designated VGR PRECURSOR RNA, an RNA molecule, typically several hundred nucleotides long.

VGR3152 precursor RNA folds spatially, forming VGR3152 folded precursor RNA, herein designated VGR FOLDED PRECURSOR RNA. It is appreciated that VGR3152 folded precursor RNA comprises a plurality of what is known in the art as 'hairpin' structures. These 'hairpin' structures are due to the fact that the nucleotide sequence of VGR3152 precursor RNA comprises a plurality of segments, the first half of each such segment having a nucleotide sequence which is at least a partial inversed-reversed sequence of the second half thereof, as is well known in the art.

VGR3152 folded precursor RNA is naturally processed by cellular enzymatic activity into at least 7 separate VGAM precursor RNAs, VGAM1930 precursor RNA, VGAM1931 precursor RNA, VGAM1932 precursor RNA, VGAM1933 precursor RNA, VGAM1934 precursor RNA, VGAM1935 precursor RNA and VGAM1936 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1930 RNA, VGAM1931 RNA, VGAM1932 RNA, VGAM1933 RNA, VGAM1934 RNA, VGAM1935 RNA and VGAM1936 RNA, herein schematically represented by VGAM1 RNA through VGAM3 RNA, each of which VGAM RNAs corresponding to VGAM RNA of FIG. 1.

VGAM1930 RNA, herein schematically represented by VGAM1 RNA through VGAM3 RNA, binds complementarily to a host target binding site located in an untranslated region of VGAM1930 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1930 host target RNA into VGAM1930 host target protein, herein schematically represented by VGAM1 HOST TARGET PROTEIN through VGAM3 HOST TARGET PROTEIN, all of FIG. 1.

VGAM1931 RNA, herein schematically represented by VGAM1 RNA through VGAM3 RNA, binds complementarily to a host target binding site located in an untranslated region of VGAM1931 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1931 host target RNA into VGAM1931 host target protein, herein schematically represented by VGAM1 HOST TARGET PROTEIN through VGAM3 HOST TARGET PROTEIN, all of FIG. 1.

VGAM1932 RNA, herein schematically represented by VGAM1 RNA through VGAM3 RNA, binds complementarily to a host target binding site located in an untranslated region of VGAM1932 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1932 host target RNA into VGAM1932 host target protein, herein schematically represented by VGAM1 HOST TARGET PROTEIN through VGAM3 HOST TARGET PROTEIN, all of FIG. 1.

VGAM1933 RNA, herein schematically represented by VGAM1 RNA through VGAM3 RNA, binds complementarily to a host target binding site located in an untranslated region of VGAM1933 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1933 host target RNA into VGAM1933 host target protein, herein schematically represented by VGAM1 HOST TARGET PROTEIN through VGAM3 HOST TARGET PROTEIN, all of FIG. 1.

VGAM1934 RNA, herein schematically represented by VGAM1 RNA through VGAM3 RNA, binds complementarily to a host target binding site located in an untranslated region of VGAM1934 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1934 host target RNA into VGAM1934 host target protein, herein schematically represented by VGAM1 HOST TARGET PROTEIN through VGAM3 HOST TARGET PROTEIN, all of FIG. 1.

VGAM1935 RNA, herein schematically represented by VGAM1 RNA through VGAM3 RNA, binds complementarily to a host target binding site located in an untranslated region of VGAM1935 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1935 host target RNA into VGAM1935 host target protein, herein schematically represented by VGAM1 HOST TARGET PROTEIN through VGAM3 HOST TARGET PROTEIN, all of FIG. 1.

VGAM1936 RNA, herein schematically represented by VGAM1 RNA through VGAM3 RNA, binds complementarily to a host target binding site located in an untranslated region of VGAM1936 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1936 host target RNA into VGAM1936 host target protein, herein schematically represented by VGAM1 HOST TARGET PROTEIN through VGAM3 HOST TARGET PROTEIN, all of FIG. 1.

It is appreciated that a function of VGR3152 gene, herein designated VGR GENE, is inhibition of expression of host target genes, as part of a novel viral mechanism of attacking a host. Accordingly, utilities of VGR3152 gene include diagnosis, prevention and treatment of viral infection by Human Herpesvirus 4. Specific functions, and accordingly utilities, of VGR3152 gene correlate with, and may be deduced from, the identity of the host target genes, which are inhibited by VGAM RNAs comprised in the 'operon-like' cluster of VGR3152 gene: VGAM1930 host target protein, VGAM1931 host target protein, VGAM1932 host target protein, VGAM1933 host target protein, VGAM1934 host target protein, VGAM1935 host target protein and VGAM1936 host target protein, herein schematically represented by VGAM1 HOST TARGET PROTEIN through VGAM3 HOST TARGET PROTEIN. The function of these host target genes is elaborated hereinabove with reference to VGAM1930, VGAM1931, VGAM1932, VGAM1933, VGAM1934, VGAM1935 and VGAM1936. FIG. 9 further provides a conceptual description of novel bioinformatically detected regulatory viral gene, referred to here as Viral Genomic Record 3153(VGR3153) viral gene, which encodes an 'operon-like' cluster of novel viral micro RNA-like genes, each of which in turn modulates expression of at least one host target gene, the function and utility of which at least one host target gene is known in the art.

VGR3153 gene, herein designated VGR GENE, is a novel bioinformatically detected regulatory, non protein coding, RNA viral gene. The method by which VGR3153 gene was detected is described hereinabove with reference to FIGS. 1-9.

VGR3153 gene encodes VGR3153 precursor RNA, herein designated VGR PRECURSOR RNA, an RNA molecule, typically several hundred nucleotides long.

VGR3153 precursor RNA folds spatially, forming VGR3153 folded precursor RNA, herein designated VGR FOLDED PRECURSOR RNA. It is appreciated that VGR3153 folded precursor RNA comprises a plurality of what is known in the art as 'hairpin' structures. These 'hairpin' structures are due to the fact that the nucleotide sequence of VGR3153 precursor RNA comprises a plurality of segments, the first half of each such segment having a nucleotide sequence which is at least a partial inversed-reversed sequence of the second half thereof, as is well known in the art.

VGR3153 folded precursor RNA is naturally processed by cellular enzymatic activity into at least 2 separate VGAM precursor RNAs, VGAM1937 precursor RNA and VGAM1938 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1937 RNA and VGAM1938 RNA, herein schematically represented by VGAM1 RNA through VGAM3 RNA, each of which VGAM RNAs corresponding to VGAM RNA of FIG. 1.

VGAM1937 RNA, herein schematically represented by VGAM1 RNA through VGAM3 RNA, binds complementarily to a host target binding site located in an untranslated region of VGAM1937 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1937 host target RNA into VGAM1937 host target protein, herein schematically represented by VGAM1 HOST TARGET PROTEIN through VGAM3 HOST TARGET PROTEIN, all of FIG. 1.

VGAM1938 RNA, herein schematically represented by VGAM1 RNA through VGAM3 RNA, binds complementarily to a host target binding site located in an untranslated region of VGAM1938 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1938 host target RNA into VGAM1938 host target protein, herein schematically represented by VGAM1 HOST TARGET PROTEIN through VGAM3 HOST TARGET PROTEIN, all of FIG. 1.

It is appreciated that a function of VGR3153 gene, herein designated VGR GENE, is inhibition of expression of host target genes, as part of a novel viral mechanism of attacking a host. Accordingly, utilities of VGR3153 gene include diagnosis, prevention and treatment of viral infection by Human Herpesvirus 4. Specific functions, and accordingly utilities, of VGR3153 gene correlate with, and may be deduced from, the identity of the host target genes, which are inhibited by VGAM RNAs comprised in the 'operon-like' cluster of VGR3153 gene: VGAM1937 host target protein and VGAM1938 host target protein, herein schematically represented by VGAM1 HOST TARGET PROTEIN through VGAM3 HOST TARGET PROTEIN. The function of these host target genes is elaborated hereinabove with reference to VGAM1937 and VGAM1938. FIG. 9 further provides a conceptual description of novel bioinformatically detected regulatory viral gene, referred to here as Viral Genomic Record 3154(VGR3154) viral gene, which encodes an 'operon-like' cluster of novel viral micro RNA-like genes, each of which in turn modulates expression of at least one host target gene, the function and utility of which at least one host target gene is known in the art.

VGR3154 gene, herein designated VGR GENE, is a novel bioinformatically detected regulatory, non protein coding, RNA viral gene. The method by which VGR3154 gene was detected is described hereinabove with reference to FIGS. 1-9.

VGR3154 gene encodes VGR3154 precursor RNA, herein designated VGR PRECURSOR RNA, an RNA molecule, typically several hundred nucleotides long.

VGR3154 precursor RNA folds spatially, forming VGR3154 folded precursor RNA, herein designated VGR FOLDED PRECURSOR RNA. It is appreciated that VGR3154 folded precursor RNA comprises a plurality of what is known in the art as 'hairpin' structures. These 'hairpin' structures are due to the fact that the nucleotide sequence of VGR3154 precursor RNA comprises a plurality of segments, the first half of each such segment having a nucleotide sequence which is at least a partial inversed-reversed sequence of the second half thereof, as is well known in the art.

VGR3154 folded precursor RNA is naturally processed by cellular enzymatic activity into at least 8 separate VGAM precursor RNAs, VGAM1940 precursor RNA, VGAM1941 precursor RNA, VGAM1942 precursor RNA, VGAM1943 precursor RNA, VGAM1944 precursor RNA, VGAM1945 precursor RNA, VGAM1946 precursor RNA and VGAM1947 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1940 RNA, VGAM1941 RNA, VGAM1942 RNA, VGAM1943 RNA, VGAM1944 RNA, VGAM1945 RNA, VGAM1946 RNA and VGAM1947 RNA, herein schematically represented by VGAM1 RNA through VGAM3 RNA, each of which VGAM RNAs corresponding to VGAM RNA of FIG. 1.

VGAM1940 RNA, herein schematically represented by VGAM1 RNA through VGAM3 RNA, binds complementarily to a host target binding site located in an untranslated region of VGAM1940 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1940 host target RNA into VGAM1940 host target protein, herein schematically represented by VGAM1 HOST TARGET PROTEIN through VGAM3 HOST TARGET PROTEIN, all of FIG. 1.

VGAM1941 RNA, herein schematically represented by VGAM1 RNA through VGAM3 RNA, binds complementarily to a host target binding site located in an untranslated region of VGAM1941 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1941 host target RNA into VGAM1941 host target protein, herein schematically represented by VGAM1 HOST TARGET PROTEIN through VGAM3 HOST TARGET PROTEIN, all of FIG. 1.

VGAM1942 RNA, herein schematically represented by VGAM1 RNA through VGAM3 RNA, binds complementarily to a host target binding site located in an untranslated region of VGAM1942 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1942 host target RNA into VGAM1942 host target protein, herein schematically represented by VGAM1 HOST TARGET PROTEIN through VGAM3 HOST TARGET PROTEIN, all of FIG. 1.

VGAM1943 RNA, herein schematically represented by VGAM1 RNA through VGAM3 RNA, binds complementarily to a host target binding site located in an untranslated region of VGAM1943 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1943 host target RNA into VGAM1943 host target protein, herein schematically represented by VGAM1 HOST TARGET PROTEIN through VGAM3 HOST TARGET PROTEIN, all of FIG. 1.

VGAM1944 RNA, herein schematically represented by VGAM1 RNA through VGAM3 RNA, binds complementarily to a host target binding site located in an untranslated region of VGAM1944 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1944 host target RNA into VGAM1944 host target protein, herein schematically represented by VGAM1 HOST TARGET PROTEIN through VGAM3 HOST TARGET PROTEIN, all of FIG. 1.

VGAM1945 RNA, herein schematically represented by VGAM1 RNA through VGAM3 RNA, binds complementarily to a host target binding site located in an untranslated region of VGAM1945 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1945 host target RNA into VGAM1945 host target protein, herein schematically represented by VGAM1 HOST TARGET PROTEIN through VGAM3 HOST TARGET PROTEIN, all of FIG. 1.

VGAM1946 RNA, herein schematically represented by VGAM1 RNA through VGAM3 RNA, binds complementarily to a host target binding site located in an untranslated region of VGAM1946 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1946 host target RNA into VGAM1946 host target protein, herein schematically represented by VGAM1 HOST TARGET PROTEIN through VGAM3 HOST TARGET PROTEIN, all of FIG. 1.

VGAM1947 RNA, herein schematically represented by VGAM1 RNA through VGAM3 RNA, binds complementarily to a host target binding site located in an untranslated region of VGAM1947 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1947 host target RNA into VGAM1947 host target protein, herein schematically represented by VGAM1 HOST TARGET PROTEIN through VGAM3 HOST TARGET PROTEIN, all of FIG. 1.

It is appreciated that a function of VGR3154 gene, herein designated VGR GENE, is inhibition of expression of host target genes, as part of a novel viral mechanism of attacking a host. Accordingly, utilities of VGR3154 gene include diagnosis, prevention and treatment of viral infection by Variola Virus. Specific functions, and accordingly utilities, of VGR3154 gene correlate with, and may be deduced from, the identity of the host target genes, which are inhibited by VGAM RNAs comprised in the 'operon-like' cluster of VGR3154 gene: VGAM1940 host target protein, VGAM1941 host target protein, VGAM1942 host target protein, VGAM1943 host target protein, VGAM1944 host target protein, VGAM1945 host target protein, VGAM1946 host target protein and VGAM1947 host target protein, herein schematically represented by VGAM1 HOST TARGET PROTEIN through VGAM3 HOST TARGET PROTEIN. The function of these host target genes is elaborated hereinabove with reference to VGAM1940, VGAM1941, VGAM1942, VGAM1943, VGAM1944, VGAM1945, VGAM1946 and VGAM1947. FIG. 9 further provides a conceptual description of novel bioinformatically detected regulatory viral gene, referred to here as Viral Genomic Record 3155(VGR3155) viral gene, which encodes an 'operon-like' cluster of novel viral micro RNA-like genes, each of which in turn modulates expression of at least one host target gene, the function and utility of which at least one host target gene is known in the art.

VGR3155 gene, herein designated VGR GENE, is a novel bioinformatically detected regulatory, non protein coding, RNA viral gene. The method by which VGR3155 gene was detected is described hereinabove with reference to FIGS. 1-9.

VGR3155 gene encodes VGR3155 precursor RNA, herein designated VGR PRECURSOR RNA, an RNA molecule, typically several hundred nucleotides long.

VGR3155 precursor RNA folds spatially, forming VGR3155 folded precursor RNA, herein designated VGR FOLDED PRECURSOR RNA. It is appreciated that VGR3155 folded precursor RNA comprises a plurality of what is known in the art as 'hairpin' structures. These 'hairpin' structures are due to the fact that the nucleotide sequence of VGR3155 precursor RNA comprises a plurality of segments, the first half of each such segment having a nucleotide sequence which is at least a partial inversed-reversed sequence of the second half thereof, as is well known in the art.

VGR3155 folded precursor RNA is naturally processed by cellular enzymatic activity into at least 7 separate VGAM precursor RNAs, VGAM1948 precursor RNA, VGAM1949 precursor RNA, VGAM1950 precursor RNA, VGAM1951 precursor RNA, VGAM1952 precursor RNA, VGAM1953 precursor RNA and VGAM1954 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1948 RNA, VGAM1949 RNA, VGAM1950 RNA, VGAM1951 RNA, VGAM1952 RNA, VGAM1953 RNA and VGAM1954 RNA, herein schematically represented by VGAM1 RNA through VGAM3 RNA, each of which VGAM RNAs corresponding to VGAM RNA of FIG. 1.

VGAM1948 RNA, herein schematically represented by VGAM1 RNA through VGAM3 RNA, binds complementarily to a host target binding site located in an untranslated region of VGAM1948 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1948 host target RNA into VGAM1948 host target protein, herein schematically represented by VGAM1 HOST TARGET PROTEIN through VGAM3 HOST TARGET PROTEIN, all of FIG. 1.

VGAM1949 RNA, herein schematically represented by VGAM1 RNA through VGAM3 RNA, binds complementarily to a host target binding site located in an untranslated region of VGAM1949 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1949 host target RNA into VGAM1949 host target protein, herein schematically represented by VGAM1 HOST TARGET PROTEIN through VGAM3 HOST TARGET PROTEIN, all of FIG. 1.

VGAM1950 RNA, herein schematically represented by VGAM1 RNA through VGAM3 RNA, binds complementarily to a host target binding site located in an untranslated region of VGAM1950 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1950 host target RNA into VGAM1950 host target protein, herein schematically represented by VGAM1 HOST TARGET PROTEIN through VGAM3 HOST TARGET PROTEIN, all of FIG. 1.

VGAM1951 RNA, herein schematically represented by VGAM1 RNA through VGAM3 RNA, binds complementarily to a host target binding site located in an untranslated region of VGAM1951 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1951 host target RNA into VGAM1951 host target protein, herein schematically represented by VGAM1 HOST TARGET PROTEIN through VGAM3 HOST TARGET PROTEIN, all of FIG. 1.

VGAM1952 RNA, herein schematically represented by VGAM1 RNA through VGAM3 RNA, binds complementarily to a host target binding site located in an untranslated region of VGAM1952 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1952 host target RNA into VGAM1952 host target protein, herein schematically represented by VGAM1 HOST TARGET PROTEIN through VGAM3 HOST TARGET PROTEIN, all of FIG. 1.

VGAM1953 RNA, herein schematically represented by VGAM1 RNA through VGAM3 RNA, binds complementarily to a host target binding site located in an untranslated region of VGAM1953 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1953 host target RNA into VGAM1953 host target protein, herein schematically represented by VGAM1 HOST TARGET PROTEIN through VGAM3 HOST TARGET PROTEIN, all of FIG. 1.

VGAM1954 RNA, herein schematically represented by VGAM1 RNA through VGAM3 RNA, binds complementarily to a host target binding site located in an untranslated region of VGAM1954 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1954 host target RNA into VGAM1954 host target protein, herein schematically represented by VGAM1 HOST TARGET PROTEIN through VGAM3 HOST TARGET PROTEIN, all of FIG. 1.

It is appreciated that a function of VGR3155 gene, herein designated VGR GENE, is inhibition of expression of host target genes, as part of a novel viral mechanism of attacking a host. Accordingly, utilities of VGR3155 gene include diagnosis, prevention and treatment of viral infection by Avian Paramyxovirus 6. Specific functions, and accordingly utilities, of VGR3155 gene correlate with, and may be deduced from, the identity of the host target genes, which are inhibited by VGAM RNAs comprised in the 'operon-like' cluster of VGR3155 gene: VGAM1948 host target protein, VGAM1949 host target protein, VGAM1950 host target protein, VGAM1951 host target protein, VGAM1952 host target protein, VGAM1953 host target protein and VGAM1954 host target protein, herein schematically represented by VGAM1 HOST TARGET PROTEIN through VGAM3 HOST TARGET PROTEIN. The function of these host target genes is elaborated hereinabove with reference to VGAM1948, VGAM1949, VGAM1950, VGAM1951, VGAM1952, VGAM1953 and VGAM1954. FIG. 9 further provides a conceptual description of novel bioinformatically detected regulatory viral gene, referred to here as Viral Genomic Record 3156(VGR3156) viral gene, which encodes an 'operon-like' cluster of novel viral micro RNA-like genes, each of which in turn modulates expression of at least one host target gene, the function and utility of which at least one host target gene is known in the art.

VGR3156 gene, herein designated VGR GENE, is a novel bioinformatically detected regulatory, non protein coding, RNA viral gene. The method by which VGR3156 gene was detected is described hereinabove with reference to FIGS. 1-9.

VGR3156 gene encodes VGR3156 precursor RNA, herein designated VGR PRECURSOR RNA, an RNA molecule, typically several hundred nucleotides long.

VGR3156 precursor RNA folds spatially, forming VGR3156 folded precursor RNA, herein designated VGR FOLDED PRECURSOR RNA. It is appreciated that VGR3156 folded precursor RNA comprises a plurality of what is known in the art as 'hairpin' structures. These 'hairpin' structures are due to the fact that the nucleotide sequence of VGR3156 precursor RNA comprises a plurality of segments, the first half of each such segment having a nucleotide sequence which is at least a partial inversed-reversed sequence of the second half thereof, as is well known in the art.

VGR3156 folded precursor RNA is naturally processed by cellular enzymatic activity into at least 6 separate VGAM precursor RNAs, VGAM1955 precursor RNA, VGAM1956 precursor RNA, VGAM1957 precursor RNA, VGAM1958 precursor RNA, VGAM1959 precursor RNA and VGAM1960 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1955 RNA, VGAM1956 RNA, VGAM1957 RNA, VGAM1958 RNA, VGAM1959 RNA and VGAM1960 RNA, herein schematically represented by VGAM1 RNA through VGAM3 RNA, each of which VGAM RNAs corresponding to VGAM RNA of FIG. 1.

VGAM1955 RNA, herein schematically represented by VGAM1 RNA through VGAM3 RNA, binds complementarily to a host target binding site located in an untranslated region of VGAM1955 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1955 host target RNA into VGAM1955 host target protein, herein schematically represented by VGAM1 HOST TARGET PROTEIN through VGAM3 HOST TARGET PROTEIN, all of FIG. 1.

VGAM1956 RNA, herein schematically represented by VGAM1 RNA through VGAM3 RNA, binds complementarily to a host target binding site located in an untranslated region of VGAM1956 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1956 host target RNA into VGAM1956 host target protein, herein schematically represented by VGAM1 HOST TARGET PROTEIN through VGAM3 HOST TARGET PROTEIN, all of FIG. 1.

VGAM1957 RNA, herein schematically represented by VGAM1 RNA through VGAM3 RNA, binds complementarily to a host target binding site located in an untranslated region of VGAM1957 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1957 host target RNA into VGAM1957 host target protein, herein schematically represented by VGAM1 HOST TARGET PROTEIN through VGAM3 HOST TARGET PROTEIN, all of FIG. 1.

VGAM1958 RNA, herein schematically represented by VGAM1 RNA through VGAM3 RNA, binds complementarily to a host target binding site located in an untranslated region of VGAM1958 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1958 host target RNA into VGAM1958 host target protein, herein schematically represented by VGAM1 HOST TARGET PROTEIN through VGAM3 HOST TARGET PROTEIN, all of FIG. 1.

VGAM1959 RNA, herein schematically represented by VGAM1 RNA through VGAM3 RNA, binds complementarily to a host target binding site located in an untranslated region of VGAM1959 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1959 host target RNA into VGAM1959 host target protein, herein schematically represented by VGAM1 HOST TARGET PROTEIN through VGAM3 HOST TARGET PROTEIN, all of FIG. 1.

VGAM1960 RNA, herein schematically represented by VGAM1 RNA through VGAM3 RNA, binds complementarily to a host target binding site located in an untranslated region of VGAM1960 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1960 host target RNA into VGAM1960 host target protein, herein schematically represented by VGAM1 HOST TARGET PROTEIN through VGAM3 HOST TARGET PROTEIN, all of FIG. 1.

It is appreciated that a function of VGR3156 gene, herein designated VGR GENE, is inhibition of expression of host target genes, as part of a novel viral mechanism of attacking a host. Accordingly, utilities of VGR3156 gene include diagnosis, prevention and treatment of viral infection by Macaca Mulatta Rhadinovirus. Specific functions, and accordingly utilities, of VGR3156 gene correlate with, and may be deduced from, the identity of the host target genes, which are inhibited by VGAM RNAs comprised in the 'operon-like' cluster of VGR3156 gene: VGAM1955 host target protein, VGAM1956 host target protein, VGAM1957 host target protein, VGAM1958 host target protein, VGAM1959 host target protein and VGAM1960 host target protein, herein schematically represented by VGAM1 HOST TARGET PROTEIN through VGAM3 HOST TARGET PROTEIN. The function of these host target genes is elaborated hereinabove with reference to VGAM1955, VGAM1956, VGAM1957, VGAM1958, VGAM1959 and VGAM1960. FIG. 9 further provides a conceptual description of novel bioinformatically detected regulatory viral gene, referred to here as Viral Genomic Record 3157(VGR3157) viral gene, which encodes an 'operon-like' cluster of novel viral micro RNA-like genes, each of which in turn modulates expression of at least one host target gene, the function and utility of which at least one host target gene is known in the art.

VGR3157 gene, herein designated VGR GENE, is a novel bioinformatically detected regulatory, non protein coding, RNA viral gene. The method by which VGR3157 gene was detected is described hereinabove with reference to FIGS. 1-9.

VGR3157 gene encodes VGR3157 precursor RNA, herein designated VGR PRECURSOR RNA, an RNA molecule, typically several hundred nucleotides long.

VGR3157 precursor RNA folds spatially, forming VGR3157 folded precursor RNA, herein designated VGR FOLDED PRECURSOR RNA. It is appreciated that VGR3157 folded precursor RNA comprises a plurality of what is known in the art as 'hairpin' structures. These 'hairpin' structures are due to the fact that the nucleotide sequence of VGR3157 precursor RNA comprises a plurality of segments, the first half of each such segment having a nucleotide sequence which is at least a partial inversed-reversed sequence of the second half thereof, as is well known in the art.

VGR3157 folded precursor RNA is naturally processed by cellular enzymatic activity into at least 3 separate VGAM precursor RNAs, VGAM1961 precursor RNA, VGAM1962 precursor RNA and VGAM1963 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1961 RNA, VGAM1962 RNA and VGAM1963 RNA, herein schematically represented by VGAM1 RNA through VGAM3 RNA, each of which VGAM RNAs corresponding to VGAM RNA of FIG. 1.

VGAM1961 RNA, herein schematically represented by VGAM1 RNA through VGAM3 RNA, binds complementarily to a host target binding site located in an untranslated region of VGAM1961 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1961 host target RNA into VGAM1961 host target protein, herein schematically represented by VGAM1 HOST TARGET PROTEIN through VGAM3 HOST TARGET PROTEIN, all of FIG. 1.

VGAM1962 RNA, herein schematically represented by VGAM1 RNA through VGAM3 RNA, binds complementarily to a host target binding site located in an untranslated region of VGAM1962 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1962 host target RNA into VGAM1962 host target protein, herein schematically represented by VGAM1 HOST TARGET PROTEIN through VGAM3 HOST TARGET PROTEIN, all of FIG. 1.

VGAM1963 RNA, herein schematically represented by VGAM1 RNA through VGAM3 RNA, binds complementarily to a host target binding site located in an untranslated region of VGAM1963 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1963 host target RNA into VGAM1963 host target protein, herein schematically represented by VGAM1 HOST TARGET PROTEIN through VGAM3 HOST TARGET PROTEIN, all of FIG. 1.

It is appreciated that a function of VGR3157 gene, herein designated VGR GENE, is inhibition of expression of host target genes, as part of a novel viral mechanism of attacking a host. Accordingly, utilities of VGR3157 gene include diagnosis, prevention and treatment of viral infection by Camelpox Virus. Specific functions, and accordingly utilities, of VGR3157 gene correlate with, and may be deduced from, the identity of the host target genes, which are inhibited by VGAM RNAs comprised in the 'operon-like' cluster of VGR3157 gene: VGAM1961 host target protein, VGAM1962 host target protein and VGAM1963 host target protein, herein schematically represented by VGAM1 HOST TARGET PROTEIN through VGAM3 HOST TARGET PROTEIN. The function of these host target genes is elaborated hereinabove with reference to VGAM1961, VGAM1962 and VGAM1963. FIG. 9 further provides a conceptual description of novel bioinformatically detected regulatory viral gene, referred to here as Viral Genomic Record 3158(VGR3158) viral gene, which encodes an 'operon-like' cluster of novel viral micro RNA-like genes, each of which in turn modulates expression of at least one host target gene, the function and utility of which at least one host target gene is known in the art.

VGR3158 gene, herein designated VGR GENE, is a novel bioinformatically detected regulatory, non protein coding, RNA viral gene. The method by which VGR3158 gene was detected is described hereinabove with reference to FIGS. 1-9.

VGR3158 gene encodes VGR3158 precursor RNA, herein designated VGR PRECURSOR RNA, an RNA molecule, typically several hundred nucleotides long.

VGR3158 precursor RNA folds spatially, forming VGR3158 folded precursor RNA, herein designated VGR FOLDED PRECURSOR RNA. It is appreciated that VGR3158 folded precursor RNA comprises a plurality of what is known in the art as 'hairpin' structures. These 'hairpin' structures are due to the fact that the nucleotide sequence of VGR3158 precursor RNA comprises a plurality of segments, the first half of each such segment having a nucleotide sequence which is at least a partial inversed-reversed sequence of the second half thereof, as is well known in the art.

VGR3158 folded precursor RNA is naturally processed by cellular enzymatic activity into at least 8 separate VGAM precursor RNAs, VGAM1964 precursor RNA, VGAM1965 precursor RNA, VGAM1966 precursor RNA, VGAM1967 precursor RNA, VGAM1968 precursor RNA, VGAM1969 precursor RNA, VGAM1970 precursor RNA and VGAM1971 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1964 RNA, VGAM1965 RNA, VGAM1966 RNA, VGAM1967 RNA, VGAM1968 RNA, VGAM1969 RNA, VGAM1970 RNA and VGAM1971 RNA, herein schematically represented by VGAM1 RNA through VGAM3 RNA, each of which VGAM RNAs corresponding to VGAM RNA of FIG. 1.

VGAM1964 RNA, herein schematically represented by VGAM1 RNA through VGAM3 RNA, binds complementarily to a host target binding site located in an untranslated region of VGAM1964 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1964 host target RNA into VGAM1964 host target protein, herein schematically represented by VGAM1 HOST TARGET PROTEIN through VGAM3 HOST TARGET PROTEIN, all of FIG. 1.

VGAM1965 RNA, herein schematically represented by VGAM1 RNA through VGAM3 RNA, binds complementarily to a host target binding site located in an untranslated region of VGAM1965 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1965 host target RNA into VGAM1965 host target protein, herein schematically represented by VGAM1 HOST TARGET PROTEIN through VGAM3 HOST TARGET PROTEIN, all of FIG. 1.

VGAM1966 RNA, herein schematically represented by VGAM1 RNA through VGAM3 RNA, binds complementarily to a host target binding site located in an untranslated region of VGAM1966 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1966 host target RNA into VGAM1966 host target protein, herein schematically represented by VGAM1 HOST TARGET PROTEIN through VGAM3 HOST TARGET PROTEIN, all of FIG. 1.

VGAM1967 RNA, herein schematically represented by VGAM1 RNA through VGAM3 RNA, binds complementarily to a host target binding site located in an untranslated region of VGAM1967 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1967 host target RNA into VGAM1967 host target protein, herein schematically represented by VGAM1 HOST TARGET PROTEIN through VGAM3 HOST TARGET PROTEIN, all of FIG. 1.

VGAM1968 RNA, herein schematically represented by VGAM1 RNA through VGAM3 RNA, binds complementarily to a host target binding site located in an untranslated region of VGAM1968 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1968 host target RNA into VGAM1968 host target protein, herein schematically represented by VGAM1 HOST TARGET PROTEIN through VGAM3 HOST TARGET PROTEIN, all of FIG. 1.

VGAM1969 RNA, herein schematically represented by VGAM1 RNA through VGAM3 RNA, binds complementarily to a host target binding site located in an untranslated region of VGAM1969 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1969 host target RNA into VGAM1969 host target protein, herein schematically represented by VGAM1 HOST TARGET PROTEIN through VGAM3 HOST TARGET PROTEIN, all of FIG. 1.

VGAM1970 RNA, herein schematically represented by VGAM1 RNA through VGAM3 RNA, binds complementarily to a host target binding site located in an untranslated region of VGAM1970 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1970 host target RNA into VGAM1970 host target protein, herein schematically represented by VGAM1 HOST TARGET PROTEIN through VGAM3 HOST TARGET PROTEIN, all of FIG. 1.

VGAM1971 RNA, herein schematically represented by VGAM1 RNA through VGAM3 RNA, binds complementarily to a host target binding site located in an untranslated region of VGAM1971 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1971 host target RNA into VGAM1971 host target protein, herein schematically represented by VGAM1 HOST TARGET PROTEIN through VGAM3 HOST TARGET PROTEIN, all of FIG. 1.

It is appreciated that a function of VGR3158 gene, herein designated VGR GENE, is inhibition of expression of host target genes, as part of a novel viral mechanism of attacking a host. Accordingly, utilities of VGR3158 gene include diagnosis, prevention and treatment of viral infection by Rana Tigrina Ranavirus. Specific functions, and accordingly utilities, of VGR3158 gene correlate with, and may be deduced from, the identity of the host target genes, which are inhibited by VGAM RNAs comprised in the 'operon-like' cluster of VGR3158 gene: VGAM1964 host target protein, VGAM1965 host target protein, VGAM1966 host target protein, VGAM1967 host target protein, VGAM1968 host target protein, VGAM1969 host target protein, VGAM1970 host target protein and VGAM1971 host target protein, herein schematically represented by VGAM1 HOST TARGET PROTEIN through VGAM3 HOST TARGET PROTEIN. The function of these host target genes is elaborated hereinabove with reference to VGAM1964, VGAM1965, VGAM1966, VGAM1967, VGAM1968, VGAM1969, VGAM1970 and VGAM1971. FIG. 9 further provides a conceptual description of novel bioinformatically detected regulatory viral gene, referred to here as Viral Genomic Record 3159(VGR3159) viral gene, which encodes an 'operon-like' cluster of novel viral micro RNA-like genes, each of which in turn modulates expression of at least one host target gene, the function and utility of which at least one host target gene is known in the art.

VGR3159 gene, herein designated VGR GENE, is a novel bioinformatically detected regulatory, non protein coding, RNA viral gene. The method by which VGR3159 gene was detected is described hereinabove with reference to FIGS. 1-9.

VGR3159 gene encodes VGR3159 precursor RNA, herein designated VGR PRECURSOR RNA, an RNA molecule, typically several hundred nucleotides long.

VGR3159 precursor RNA folds spatially, forming VGR3159 folded precursor RNA, herein designated VGR FOLDED PRECURSOR RNA. It is appreciated that VGR3159 folded precursor RNA comprises a plurality of what is known in the art as 'hairpin' structures. These 'hairpin' structures are due to the fact that the nucleotide sequence of VGR3159 precursor RNA comprises a plurality of segments, the first half of each such segment having a nucleotide sequence which is at least a partial inversed-reversed sequence of the second half thereof, as is well known in the art.

VGR3159 folded precursor RNA is naturally processed by cellular enzymatic activity into at least 7 separate VGAM precursor RNAs, VGAM1972 precursor RNA, VGAM1973 precursor RNA, VGAM1974 precursor RNA, VGAM1975 precursor RNA, VGAM1976 precursor RNA, VGAM1977 precursor RNA and VGAM1978 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1972 RNA, VGAM1973 RNA, VGAM1974 RNA, VGAM1975 RNA, VGAM1976 RNA, VGAM1977 RNA and VGAM1978 RNA, herein schematically represented by VGAM1 RNA through VGAM3 RNA, each of which VGAM RNAs corresponding to VGAM RNA of FIG. 1.

VGAM1972 RNA, herein schematically represented by VGAM1 RNA through VGAM3 RNA, binds complementarily to a host target binding site located in an untranslated region of VGAM1972 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM1972 host target RNA into VGAM1972 host target protein, herein schematically represented by VGAM1 HOST TARGET PROTEIN through VGAM3 HOST TARGET PROTEIN, all of FIG. 1.

VGAM1973 RNA, herein schematically represented by VGAM1 RNA through VGAM3 RNA, binds complementarily to a host target binding site located in an untranslated region of VGAM1973 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1973 host target RNA into VGAM1973 host target protein, herein schematically represented by VGAM1 HOST TARGET PROTEIN through VGAM3 HOST TARGET PROTEIN, all of FIG. 1.

VGAM1974 RNA, herein schematically represented by VGAM1 RNA through VGAM3 RNA, binds complementarily to a host target binding site located in an untranslated region of VGAM1974 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1974 host target RNA into VGAM1974 host target protein, herein schematically represented by VGAM1 HOST TARGET PROTEIN through VGAM3 HOST TARGET PROTEIN, all of FIG. 1.

VGAM1975 RNA, herein schematically represented by VGAM1 RNA through VGAM3 RNA, binds complementarily to a host target binding site located in an untranslated region of VGAM1975 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1975 host target RNA into VGAM1975 host target protein, herein schematically represented by VGAM1 HOST TARGET PROTEIN through VGAM3 HOST TARGET PROTEIN, all of FIG. 1.

VGAM1976 RNA, herein schematically represented by VGAM1 RNA through VGAM3 RNA, binds complementarily to a host target binding site located in an untranslated region of VGAM1976 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1976 host target RNA into VGAM1976 host target protein, herein schematically represented by VGAM1 HOST TARGET PROTEIN through VGAM3 HOST TARGET PROTEIN, all of FIG. 1.

VGAM1977 RNA, herein schematically represented by VGAM1 RNA through VGAM3 RNA, binds complementarily to a host target binding site located in an untranslated region of VGAM1977 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1977 host target RNA into VGAM1977 host target protein, herein schematically represented by VGAM1 HOST TARGET PROTEIN through VGAM3 HOST TARGET PROTEIN, all of FIG. 1.

VGAM1978 RNA, herein schematically represented by VGAM1 RNA through VGAM3 RNA, binds complementarily to a host target binding site located in an untranslated region of VGAM1978 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1978 host target RNA into VGAM1978 host target protein, herein schematically represented by VGAM1 HOST TARGET PROTEIN through VGAM3 HOST TARGET PROTEIN, all of FIG. 1.

It is appreciated that a function of VGR3159 gene, herein designated VGR GENE, is inhibition of expression of host target genes, as part of a novel viral mechanism of attacking a host. Accordingly, utilities of VGR3159 gene include diagnosis, prevention and treatment of viral infection by Bovine Herpesvirus 4. Specific functions, and accordingly utilities, of VGR3159 gene correlate with, and may be deduced from, the identity of the host target genes, which are inhibited by VGAM RNAs comprised in the 'operon-like' cluster of VGR3159 gene: VGAM1972 host target protein, VGAM1973 host target protein, VGAM1974 host target protein, VGAM1975 host target protein, VGAM1976 host target protein, VGAM1977 host target protein and VGAM1978 host target protein, herein schematically represented by VGAM1 HOST TARGET PROTEIN through VGAM3 HOST TARGET PROTEIN. The function of these host target genes is elaborated hereinabove with reference to VGAM1972, VGAM1973, VGAM1974, VGAM1975, VGAM1976, VGAM1977 and VGAM1978. FIG. 9 further provides a conceptual description of novel bioinformatically detected regulatory viral gene, referred to here as Viral Genomic Record 3160(VGR3160) viral gene, which encodes an 'operon-like' cluster of novel viral micro RNA-like genes, each of which in turn modulates expression of at least one host target gene, the function and utility of which at least one host target gene is known in the art.

VGR3160 gene, herein designated VGR GENE, is a novel bioinformatically detected regulatory, non protein coding, RNA viral gene. The method by which VGR3160 gene was detected is described hereinabove with reference to FIGS. 1-9.

VGR3160 gene encodes VGR3160 precursor RNA, herein designated VGR PRECURSOR RNA, an RNA molecule, typically several hundred nucleotides long.

VGR3160 precursor RNA folds spatially, forming VGR3160 folded precursor RNA, herein designated VGR FOLDED PRECURSOR RNA. It is appreciated that VGR3160 folded precursor RNA comprises a plurality of what is known in the art as 'hairpin' structures. These 'hairpin' structures are due to the fact that the nucleotide sequence of VGR3160 precursor RNA comprises a plurality of segments, the first half of each such segment having a nucleotide sequence which is at least a partial inversed-reversed sequence of the second half thereof, as is well known in the art.

VGR3160 folded precursor RNA is naturally processed by cellular enzymatic activity into at least 2 separate VGAM precursor RNAs, VGAM1979 precursor RNA and VGAM1980 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1979 RNA and VGAM1980 RNA, herein schematically represented by VGAM1 RNA through VGAM3 RNA, each of which VGAM RNAs corresponding to VGAM RNA of FIG. 1.

VGAM1979 RNA, herein schematically represented by VGAM1 RNA through VGAM3 RNA, binds complementarily to a host target binding site located in an untranslated region of VGAM1979 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1979 host target RNA into VGAM1979 host target protein, herein schematically represented by VGAM1 HOST TARGET PROTEIN through VGAM3 HOST TARGET PROTEIN, all of FIG. 1.

VGAM1980 RNA, herein schematically represented by VGAM1 RNA through VGAM3 RNA, binds complementarily to a host target binding site located in an untranslated region of VGAM1980 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1980 host target RNA into VGAM1980 host target protein, herein schematically represented by VGAM1 HOST TARGET PROTEIN through VGAM3 HOST TARGET PROTEIN, all of FIG. 1.

It is appreciated that a function of VGR3160 gene, herein designated VGR GENE, is inhibition of expression of host target genes, as part of a novel viral mechanism of attacking a host. Accordingly, utilities of VGR3160 gene include diagnosis, prevention and treatment of viral infection by Bovine Herpesvirus 4. Specific functions, and accordingly utilities, of VGR3160 gene correlate with, and may be deduced from, the identity of the host target genes, which are inhibited by VGAM RNAs comprised in the 'operon-like' cluster of VGR3160 gene: VGAM1979 host target protein and VGAM1980 host target protein, herein schematically represented by VGAM1 HOST TARGET PROTEIN through VGAM3 HOST TARGET PROTEIN. The function of these host target genes is elaborated hereinabove with reference to VGAM1979 and VGAM1980. FIG. 9 further provides a conceptual description of novel bioinformatically detected regulatory viral gene, referred to here as Viral Genomic Record 3161(VGR3161) viral gene, which encodes an 'operon-like' cluster of novel viral micro RNA-like genes, each of which in turn modulates expression of at least one host target gene, the function and utility of which at least one host target gene is known in the art.

VGR3161 gene, herein designated VGR GENE, is a novel bioinformatically detected regulatory, non protein coding, RNA viral gene. The method by which VGR3161 gene was detected is described hereinabove with reference to FIGS. 1-9.

VGR3161 gene encodes VGR3161 precursor RNA, herein designated VGR PRECURSOR RNA, an RNA molecule, typically several hundred nucleotides long.

VGR3161 precursor RNA folds spatially, forming VGR3161 folded precursor RNA, herein designated VGR FOLDED PRECURSOR RNA. It is appreciated that VGR3161 folded precursor RNA comprises a plurality of what is known in the art as 'hairpin' structures. These 'hairpin' structures are due to the fact that the nucleotide sequence of VGR3161 precursor RNA comprises a plurality of segments, the first half of each such segment having a nucleotide sequence which is at least a partial inversed-reversed sequence of the second half thereof, as is well known in the art.

VGR3161 folded precursor RNA is naturally processed by cellular enzymatic activity into at least 7 separate VGAM precursor RNAs, VGAM1981 precursor RNA, VGAM1982 precursor RNA, VGAM1983 precursor RNA, VGAM1984 precursor RNA, VGAM1985 precursor RNA, VGAM1986 precursor RNA and VGAM1987 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1981 RNA, VGAM1982 RNA, VGAM1983 RNA, VGAM1984 RNA, VGAM1985 RNA, VGAM1986 RNA and VGAM1987 RNA, herein schematically represented by VGAM1 RNA through VGAM3 RNA, each of which VGAM RNAs corresponding to VGAM RNA of FIG. 1.

VGAM1981 RNA, herein schematically represented by VGAM1 RNA through VGAM3 RNA, binds complementarily to a host target binding site located in an untranslated region of VGAM1981 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1981 host target RNA into VGAM1981 host target protein, herein schematically represented by VGAM1 HOST TARGET PROTEIN through VGAM3 HOST TARGET PROTEIN, all of FIG. 1.

VGAM1982 RNA, herein schematically represented by VGAM1 RNA through VGAM3 RNA, binds complementarily to a host target binding site located in an untranslated region of VGAM1982 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1982 host target RNA into VGAM1982 host target protein, herein schematically represented by VGAM1 HOST TARGET PROTEIN through VGAM3 HOST TARGET PROTEIN, all of FIG. 1.

VGAM1983 RNA, herein schematically represented by VGAM1 RNA through VGAM3 RNA, binds complementarily to a host target binding site located in an untranslated region of VGAM1983 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1983 host target RNA into VGAM1983 host target protein, herein schematically represented by VGAM1 HOST TARGET PROTEIN through VGAM3 HOST TARGET PROTEIN, all of FIG. 1.

VGAM1984 RNA, herein schematically represented by VGAM1 RNA through VGAM3 RNA, binds complementarily to a host target binding site located in an untranslated region of VGAM1984 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1984 host target RNA into VGAM1984 host target protein, herein schematically represented by VGAM1 HOST TARGET PROTEIN through VGAM3 HOST TARGET PROTEIN, all of FIG. 1.

VGAM1985 RNA, herein schematically represented by VGAM1 RNA through VGAM3 RNA, binds complementarily to a host target binding site located in an untranslated region of VGAM1985 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1985 host target RNA into VGAM1985 host target protein, herein schematically represented by VGAM1 HOST TARGET PROTEIN through VGAM3 HOST TARGET PROTEIN, all of FIG. 1.

VGAM1986 RNA, herein schematically represented by VGAM1 RNA through VGAM3 RNA, binds complementarily to a host target binding site located in an untranslated region of VGAM1986 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1986 host target RNA into VGAM1986 host target protein, herein schematically represented by VGAM1 HOST TARGET PROTEIN through VGAM3 HOST TARGET PROTEIN, all of FIG. 1.

VGAM1987 RNA, herein schematically represented by VGAM1 RNA through VGAM3 RNA, binds complementarily to a host target binding site located in an untranslated region of VGAM1987 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1987 host target RNA into VGAM1987 host target protein, herein schematically represented by VGAM1 HOST TARGET PROTEIN through VGAM3 HOST TARGET PROTEIN, all of FIG. 1.

It is appreciated that a function of VGR3161 gene, herein designated VGR GENE, is inhibition of expression of host target genes, as part of a novel viral mechanism of attacking a host. Accordingly, utilities of VGR3161 gene include diagnosis, prevention and treatment of viral infection by Hendra Virus. Specific functions, and accordingly utilities, of VGR3161 gene correlate with, and may be deduced from, the identity of the host target genes, which are inhibited by VGAM RNAs comprised in the 'operon-like' cluster of VGR3161 gene: VGAM1981 host target protein, VGAM1982 host target protein, VGAM1983 host target protein, VGAM1984 host target protein, VGAM1985 host target protein, VGAM1986 host target protein and VGAM1987 host target protein, herein schematically represented by VGAM1 HOST TARGET PROTEIN through VGAM3 HOST TARGET PROTEIN. The function of these host target genes is elaborated hereinabove with reference to VGAM1981, VGAM1982, VGAM1983, VGAM1984, VGAM1985, VGAM1986 and VGAM1987. FIG. 9 further provides a conceptual description of novel bioinformatically detected regulatory viral gene, referred to here as Viral Genomic Record 3162(VGR3162) viral gene, which encodes an 'operon-like' cluster of novel viral micro RNA-like genes, each of which in turn modulates expression of at least one host target gene, the function and utility of which at least one host target gene is known in the art.

VGR3162 gene, herein designated VGR GENE, is a novel bioinformatically detected regulatory, non protein coding, RNA viral gene. The method by which VGR3162 gene was detected is described hereinabove with reference to FIGS. 1-9.

VGR3162 gene encodes VGR3162 precursor RNA, herein designated VGR PRECURSOR RNA, an RNA molecule, typically several hundred nucleotides long.

VGR3162 precursor RNA folds spatially, forming VGR3162 folded precursor RNA, herein designated VGR FOLDED PRECURSOR RNA. It is appreciated that VGR3162 folded precursor RNA comprises a plurality of what is known in the art as 'hairpin' structures. These 'hairpin' structures are due to the fact that the nucleotide sequence of VGR3162 precursor RNA comprises a plurality of segments, the first half of each such segment having a nucleotide sequence which is at least a partial inversed-reversed sequence of the second half thereof, as is well known in the art.

VGR3162 folded precursor RNA is naturally processed by cellular enzymatic activity into at least 2 separate VGAM precursor RNAs, VGAM1988 precursor RNA and VGAM1989 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1988 RNA and VGAM1989 RNA, herein schematically represented by VGAM1 RNA through VGAM3 RNA, each of which VGAM RNAs corresponding to VGAM RNA of FIG. 1.

VGAM1988 RNA, herein schematically represented by VGAM1 RNA through VGAM3 RNA, binds complementarily to a host target binding site located in an untranslated region of VGAM1988 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1988 host target RNA into VGAM1988 host target protein, herein schematically represented by VGAM1 HOST TARGET PROTEIN through VGAM3 HOST TARGET PROTEIN, all of FIG. 1.

VGAM1989 RNA, herein schematically represented by VGAM1 RNA through VGAM3 RNA, binds complementarily to a host target binding site located in an untranslated region of VGAM1989 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1989 host target RNA into VGAM1989 host target protein, herein schematically represented by VGAM1 HOST TARGET PROTEIN through VGAM3 HOST TARGET PROTEIN, all of FIG. 1.

It is appreciated that a function of VGR3162 gene, herein designated VGR GENE, is inhibition of expression of host target genes, as part of a novel viral mechanism of attacking a host. Accordingly, utilities of VGR3162 gene include diagnosis, prevention and treatment of viral infection by Hendra Virus. Specific functions, and accordingly utilities, of VGR3162 gene correlate with, and may be deduced from, the identity of the host target genes, which are inhibited by VGAM RNAs comprised in the 'operon-like' cluster of VGR3162 gene: VGAM1988 host target protein and VGAM1989 host target protein, herein schematically represented by VGAM1 HOST TARGET PROTEIN through VGAM3 HOST TARGET PROTEIN. The function of these host target genes is elaborated hereinabove with reference to VGAM1988 and VGAM1989. FIG. 9 further provides a conceptual description of novel bioinformatically detected regulatory viral gene, referred to here as Viral Genomic Record 3163(VGR3163) viral gene, which encodes an 'operon-like' cluster of novel viral micro RNA-like genes, each of which in turn modulates expression of at least one host target gene, the function and utility of which at least one host target gene is known in the art.

VGR3163 gene, herein designated VGR GENE, is a novel bioinformatically detected regulatory, non protein coding, RNA viral gene. The method by which VGR3163 gene was detected is described hereinabove with reference to FIGS. 1-9.

VGR3163 gene encodes VGR3163 precursor RNA, herein designated VGR PRECURSOR RNA, an RNA molecule, typically several hundred nucleotides long.

VGR3163 precursor RNA folds spatially, forming VGR3163 folded precursor RNA, herein designated VGR FOLDED PRECURSOR RNA. It is appreciated that VGR3163 folded precursor RNA comprises a plurality of what is known in the art as 'hairpin' structures. These 'hairpin' structures are due to the fact that the nucleotide sequence of VGR3163 precursor RNA comprises a plurality of segments, the first half of each such segment having a nucleotide sequence which is at least a partial inversed-reversed sequence of the second half thereof, as is well known in the art.

VGR3163 folded precursor RNA is naturally processed by cellular enzymatic activity into at least 8 separate VGAM precursor RNAs, VGAM1990 precursor RNA, VGAM1991 precursor RNA, VGAM1992 precursor RNA, VGAM1993 precursor RNA, VGAM1994 precursor RNA, VGAM1995 precursor RNA, VGAM1996 precursor RNA and VGAM1997 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1990 RNA, VGAM1991 RNA, VGAM1992 RNA, VGAM1993 RNA, VGAM1994 RNA, VGAM1995 RNA, VGAM1996 RNA and VGAM1997 RNA, herein schematically represented by VGAM1 RNA through VGAM3 RNA, each of which VGAM RNAs corresponding to VGAM RNA of FIG. 1.

VGAM1990 RNA, herein schematically represented by VGAM1 RNA through VGAM3 RNA, binds complementarily to a host target binding site located in an untranslated region of VGAM1990 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1990 host target RNA into VGAM1990 host target protein, herein schematically represented by VGAM1 HOST TARGET PROTEIN through VGAM3 HOST TARGET PROTEIN, all of FIG. 1.

VGAM1991 RNA, herein schematically represented by VGAM1 RNA through VGAM3 RNA, binds complementarily to a host target binding site located in an untranslated region of VGAM1991 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1991 host target RNA into VGAM1991 host target protein, herein schematically represented by VGAM1 HOST TARGET PROTEIN through VGAM3 HOST TARGET PROTEIN, all of FIG. 1.

VGAM1992 RNA, herein schematically represented by VGAM1 RNA through VGAM3 RNA, binds complementarily to a host target binding site located in an untranslated region of VGAM1992 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1992 host target RNA into VGAM1992 host target protein, herein schematically represented by VGAM1 HOST TARGET PROTEIN through VGAM3 HOST TARGET PROTEIN, all of FIG. 1.

VGAM1993 RNA, herein schematically represented by VGAM1 RNA through VGAM3 RNA, binds complementarily to a host target binding site located in an untranslated region of VGAM1993 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1993 host target RNA into VGAM1993 host target protein, herein schematically represented by VGAM1 HOST TARGET PROTEIN through VGAM3 HOST TARGET PROTEIN, all of FIG. 1.

VGAM1994 RNA, herein schematically represented by VGAM1 RNA through VGAM3 RNA, binds complementarily to a host target binding site located in an untranslated region of VGAM1994 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1994 host target RNA into VGAM1994 host target protein, herein schematically represented by VGAM1 HOST TARGET PROTEIN through VGAM3 HOST TARGET PROTEIN, all of FIG. 1.

VGAM1995 RNA, herein schematically represented by VGAM1 RNA through VGAM3 RNA, binds complementarily to a host target binding site located in an untranslated region of VGAM1995 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1995 host target RNA into VGAM1995 host target protein, herein schematically represented by VGAM1 HOST TARGET PROTEIN through VGAM3 HOST TARGET PROTEIN, all of FIG. 1.

VGAM1996 RNA, herein schematically represented by VGAM1 RNA through VGAM3 RNA, binds complementarily to a host target binding site located in an untranslated region of VGAM1996 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1996 host target RNA into VGAM1996 host target protein, herein schematically represented by VGAM1 HOST TARGET PROTEIN through VGAM3 HOST TARGET PROTEIN, all of FIG. 1.

VGAM1997 RNA, herein schematically represented by VGAM1 RNA through VGAM3 RNA, binds complementarily to a host target binding site located in an untranslated region of VGAM1997 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1997 host target RNA into VGAM1997 host target protein, herein schematically represented by VGAM1 HOST TARGET PROTEIN through VGAM3 HOST TARGET PROTEIN, all of FIG. 1.

It is appreciated that a function of VGR3163 gene, herein designated VGR GENE, is inhibition of expression of host target genes, as part of a novel viral mechanism of attacking a host. Accordingly, utilities of VGR3163 gene include diagnosis, prevention and treatment of viral infection by Nipah Virus. Specific functions, and accordingly utilities, of VGR3163 gene correlate with, and may be deduced from, the identity of the host target genes, which are inhibited by VGAM RNAs comprised in the 'operon-like' cluster of VGR3163 gene: VGAM1990 host target protein, VGAM1991 host target protein, VGAM1992 host target protein, VGAM1993 host target protein, VGAM1994 host target protein, VGAM1995 host target protein, VGAM1996 host target protein and VGAM1997 host target protein, herein schematically represented by VGAM1 HOST TARGET PROTEIN through VGAM3 HOST TARGET PROTEIN. The function of these host target genes is elaborated hereinabove with reference to VGAM1990, VGAM1991, VGAM1992, VGAM1993, VGAM1994, VGAM1995, VGAM1996 and VGAM1997. FIG. 9 further provides a conceptual description of novel bioinformatically detected regulatory viral gene, referred to here as Viral Genomic Record 3164(VGR3164) viral gene, which encodes an 'operon-like' cluster of novel viral micro RNA-like genes, each of which in turn modulates expression of at least one host target gene, the function and utility of which at least one host target gene is known in the art.

VGR3164 gene, herein designated VGR GENE, is a novel bioinformatically detected regulatory, non protein coding, RNA viral gene. The method by which VGR3164 gene was detected is described hereinabove with reference to FIGS. 1-9.

VGR3164 gene encodes VGR3164 precursor RNA, herein designated VGR PRECURSOR RNA, an RNA molecule, typically several hundred nucleotides long.

VGR3164 precursor RNA folds spatially, forming VGR3164 folded precursor RNA, herein designated VGR FOLDED PRECURSOR RNA. It is appreciated that VGR3164 folded precursor RNA comprises a plurality of what is known in the art as 'hairpin' structures. These 'hairpin' structures are due to the fact that the nucleotide sequence of VGR3164 precursor RNA comprises a plurality of segments, the first half of each such segment having a nucleotide sequence which is at least a partial inversed-reversed sequence of the second half thereof, as is well known in the art.

VGR3164 folded precursor RNA is naturally processed by cellular enzymatic activity into at least 6 separate VGAM precursor RNAs, VGAM1998 precursor RNA, VGAM1999 precursor RNA, VGAM2000 precursor RNA, VGAM2001 precursor RNA, VGAM2002 precursor RNA and VGAM2003 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM1998 RNA, VGAM1999 RNA, VGAM2000 RNA, VGAM2001 RNA, VGAM2002 RNA and VGAM2003 RNA, herein schematically represented by VGAM1 RNA through VGAM3 RNA, each of which VGAM RNAs corresponding to VGAM RNA of FIG. 1.

VGAM1998 RNA, herein schematically represented by VGAM1 RNA through VGAM3 RNA, binds complementarily to a host target binding site located in an untranslated region of VGAM1998 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1998 host target RNA into VGAM1998 host target protein, herein schematically represented by VGAM1 HOST TARGET PROTEIN through VGAM3 HOST TARGET PROTEIN, all of FIG. 1.

VGAM1999 RNA, herein schematically represented by VGAM1 RNA through VGAM3 RNA, binds complementarily to a host target binding site located in an untranslated region of VGAM1999 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM1999 host target RNA into VGAM1999 host target protein, herein schematically represented by VGAM1 HOST TARGET PROTEIN through VGAM3 HOST TARGET PROTEIN, all of FIG. 1.

VGAM2000 RNA, herein schematically represented by VGAM1 RNA through VGAM3 RNA, binds complementarily to a host target binding site located in an untranslated region of VGAM2000 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2000 host target RNA into VGAM2000 host target protein, herein schematically represented by VGAM1 HOST TARGET PROTEIN through VGAM3 HOST TARGET PROTEIN, all of FIG. 1.

VGAM2001 RNA, herein schematically represented by VGAM1 RNA through VGAM3 RNA, binds complementarily to a host target binding site located in an untranslated region of VGAM2001 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2001 host target RNA into VGAM2001 host target protein, herein schematically represented by VGAM1 HOST TARGET PROTEIN through VGAM3 HOST TARGET PROTEIN, all of FIG. 1.

VGAM2002 RNA, herein schematically represented by VGAM1 RNA through VGAM3 RNA, binds complementarily to a host target binding site located in an untranslated region of VGAM2002 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2002 host target RNA into VGAM2002 host target protein, herein schematically represented by VGAM1 HOST TARGET PROTEIN through VGAM3 HOST TARGET PROTEIN, all of FIG. 1.

VGAM2003 RNA, herein schematically represented by VGAM1 RNA through VGAM3 RNA, binds complementarily to a host target binding site located in an untranslated region of VGAM2003 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2003 host target RNA into VGAM2003 host target protein, herein schematically represented by VGAM1 HOST TARGET PROTEIN through VGAM3 HOST TARGET PROTEIN, all of FIG. 1.

It is appreciated that a function of VGR3164 gene, herein designated VGR GENE, is inhibition of expression of host target genes, as part of a novel viral mechanism of attacking a host. Accordingly, utilities of VGR3164 gene include diagnosis, prevention and treatment of viral infection by Nipah Virus. Specific functions, and accordingly utilities, of VGR3164 gene correlate with, and may be deduced from, the identity of the host target genes, which are inhibited by VGAM RNAs comprised in the 'operon-like' cluster of VGR3164 gene: VGAM1998 host target protein, VGAM1999 host target protein, VGAM2000 host target protein, VGAM2001 host target protein, VGAM2002 host target protein and VGAM2003 host target protein, herein schematically represented by VGAM1 HOST TARGET PROTEIN through VGAM3 HOST TARGET PROTEIN. The function of these host target genes is elaborated hereinabove with reference to VGAM1998, VGAM1999, VGAM2000, VGAM2001, VGAM2002 and VGAM2003. FIG. 9 further provides a conceptual description of novel bioinformatically detected regulatory viral gene, referred to here as Viral Genomic Record 3165(VGR3165) viral gene, which encodes an 'operon-like' cluster of novel viral micro RNA-like genes, each of which in turn modulates expression of at least one host target gene, the function and utility of which at least one host target gene is known in the art.

VGR3165 gene, herein designated VGR GENE, is a novel bioinformatically detected regulatory, non protein coding, RNA viral gene. The method by which VGR3165 gene was detected is described hereinabove with reference to FIGS. 1-9.

VGR3165 gene encodes VGR3165 precursor RNA, herein designated VGR PRECURSOR RNA, an RNA molecule, typically several hundred nucleotides long.

VGR3165 precursor RNA folds spatially, forming VGR3165 folded precursor RNA, herein designated VGR FOLDED PRECURSOR RNA. It is appreciated that VGR3165 folded precursor RNA comprises a plurality of what is known in the art as 'hairpin' structures. These 'hairpin' structures are due to the fact that the nucleotide sequence of VGR3165 precursor RNA comprises a plurality of segments, the first half of each such segment having a nucleotide sequence which is at least a partial inversed-reversed sequence of the second half thereof, as is well known in the art.

VGR3165 folded precursor RNA is naturally processed by cellular enzymatic activity into at least 3 separate VGAM precursor RNAs, VGAM2004 precursor RNA, VGAM2005 precursor RNA and VGAM2006 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2004 RNA, VGAM2005 RNA and VGAM2006 RNA, herein schematically represented by VGAM1 RNA through VGAM3 RNA, each of which VGAM RNAs corresponding to VGAM RNA of FIG. 1.

VGAM2004 RNA, herein schematically represented by VGAM1 RNA through VGAM3 RNA, binds complementarily to a host target binding site located in an untranslated region of VGAM2004 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2004 host target RNA into VGAM2004 host target protein, herein schematically represented by VGAM1 HOST TARGET PROTEIN through VGAM3 HOST TARGET PROTEIN, all of FIG. 1.

VGAM2005 RNA, herein schematically represented by VGAM1 RNA through VGAM3 RNA, binds complementarily to a host target binding site located in an untranslated region of VGAM2005 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2005 host target RNA into VGAM2005 host target protein, herein schematically represented by VGAM1 HOST TARGET PROTEIN through VGAM3 HOST TARGET PROTEIN, all of FIG. 1.

VGAM2006 RNA, herein schematically represented by VGAM1 RNA through VGAM3 RNA, binds complementarily to a host target binding site located in an untranslated region of VGAM2006 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2006 host target RNA into VGAM2006 host target protein, herein schematically represented by VGAM1 HOST TARGET PROTEIN through VGAM3 HOST TARGET PROTEIN, all of FIG. 1.

It is appreciated that a function of VGR3165 gene, herein designated VGR GENE, is inhibition of expression of host target genes, as part of a novel viral mechanism of attacking a host. Accordingly, utilities of VGR3165 gene include diagnosis, prevention and treatment of viral infection by Chimpanzee Cytomegalovirus. Specific functions, and accordingly utilities, of VGR3165 gene correlate with, and may be deduced from, the identity of the host target genes, which are inhibited by VGAM RNAs comprised in the 'operon-like' cluster of VGR3165 gene: VGAM2004 host target protein, VGAM2005 host target protein and VGAM2006 host target protein, herein schematically represented by VGAM1 HOST TARGET PROTEIN through VGAM3 HOST TARGET PROTEIN. The function of these host target genes is elaborated hereinabove with reference to VGAM2004, VGAM2005 and VGAM2006. FIG. 9 further provides a conceptual description of novel bioinformatically detected regulatory viral gene, referred to here as Viral Genomic Record 3166(VGR3166) viral gene, which encodes an 'operon-like' cluster of novel viral micro RNA-like genes, each of which in turn modulates expression of at least one host target gene, the function and utility of which at least one host target gene is known in the art.

VGR3166 gene, herein designated VGR GENE, is a novel bioinformatically detected regulatory, non protein coding, RNA viral gene. The method by which VGR3166 gene was detected is described hereinabove with reference to FIGS. 1-9.

VGR3166 gene encodes VGR3166 precursor RNA, herein designated VGR PRECURSOR RNA, an RNA molecule, typically several hundred nucleotides long.

VGR3166 precursor RNA folds spatially, forming VGR3166 folded precursor RNA, herein designated VGR FOLDED PRECURSOR RNA. It is appreciated that VGR3166 folded precursor RNA comprises a plurality of what is known in the art as 'hairpin' structures. These 'hairpin' structures are due to the fact that the nucleotide sequence of VGR3166 precursor RNA comprises a plurality of segments, the first half of each such segment having a nucleotide sequence which is at least a partial inversed-reversed sequence of the second half thereof, as is well known in the art.

VGR3166 folded precursor RNA is naturally processed by cellular enzymatic activity into at least 8 separate VGAM precursor RNAs, VGAM2007 precursor RNA, VGAM2008 precursor RNA, VGAM2009 precursor RNA, VGAM2010 precursor RNA, VGAM2011 precursor RNA, VGAM2012 precursor RNA, VGAM2013 precursor RNA and VGAM2014 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2007 RNA, VGAM2008 RNA, VGAM2009 RNA, VGAM2010 RNA, VGAM2011 RNA, VGAM2012 RNA, VGAM2013 RNA and VGAM2014 RNA, herein schematically represented by VGAM1 RNA through VGAM3 RNA, each of which VGAM RNAs corresponding to VGAM RNA of FIG. 1.

VGAM2007 RNA, herein schematically represented by VGAM1 RNA through VGAM3 RNA, binds complementarily to a host target binding site located in an untranslated region of VGAM2007 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2007 host target RNA into VGAM2007 host target protein, herein schematically represented by VGAM1 HOST TARGET PROTEIN through VGAM3 HOST TARGET PROTEIN, all of FIG. 1.

VGAM2008 RNA, herein schematically represented by VGAM1 RNA through VGAM3 RNA, binds complementarily to a host target binding site located in an untranslated region of VGAM2008 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2008 host target RNA into VGAM2008 host target protein, herein schematically represented by VGAM1 HOST TARGET PROTEIN through VGAM3 HOST TARGET PROTEIN, all of FIG. 1.

VGAM2009 RNA, herein schematically represented by VGAM1 RNA through VGAM3 RNA, binds complementarily to a host target binding site located in an untranslated region of VGAM2009 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2009 host target RNA into VGAM2009 host target protein, herein schematically represented by VGAM1 HOST TARGET PROTEIN through VGAM3 HOST TARGET PROTEIN, all of FIG. 1.

VGAM2010 RNA, herein schematically represented by VGAM1 RNA through VGAM3 RNA, binds complementarily to a host target binding site located in an untranslated region of VGAM2010 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2010 host target RNA into VGAM2010 host target protein, herein schematically represented by VGAM1 HOST TARGET PROTEIN through VGAM3 HOST TARGET PROTEIN, all of FIG. 1.

VGAM2011 RNA, herein schematically represented by VGAM1 RNA through VGAM3 RNA, binds complementarily to a host target binding site located in an untranslated region of VGAM2011 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2011 host target RNA into VGAM2011 host target protein, herein schematically represented by VGAM1 HOST TARGET PROTEIN through VGAM3 HOST TARGET PROTEIN, all of FIG. 1.

VGAM2012 RNA, herein schematically represented by VGAM1 RNA through VGAM3 RNA, binds complementarily to a host target binding site located in an untranslated region of VGAM2012 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2012 host target RNA into VGAM2012 host target protein, herein schematically represented by VGAM1 HOST TARGET PROTEIN through VGAM3 HOST TARGET PROTEIN, all of FIG. 1.

VGAM2013 RNA, herein schematically represented by VGAM1 RNA through VGAM3 RNA, binds complementarily to a host target binding site located in an untranslated region of VGAM2013 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2013 host target RNA into VGAM2013 host target protein, herein schematically represented by VGAM1 HOST TARGET PROTEIN through VGAM3 HOST TARGET PROTEIN, all of FIG. 1.

VGAM2014 RNA, herein schematically represented by VGAM1 RNA through VGAM3 RNA, binds complementarily to a host target binding site located in an untranslated region of VGAM2014 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2014 host target RNA into VGAM2014 host target protein, herein schematically represented by VGAM1 HOST TARGET PROTEIN through VGAM3 HOST TARGET PROTEIN, all of FIG. 1.

It is appreciated that a function of VGR3166 gene, herein designated VGR GENE, is inhibition of expression of host target genes, as part of a novel viral mechanism of attacking a host. Accordingly, utilities of VGR3166 gene include diagnosis, prevention and treatment of viral infection by Reston Ebola Virus (REBOV). Specific functions, and accordingly utilities, of VGR3166 gene correlate with, and may be deduced from, the identity of the host target genes, which are inhibited by VGAM RNAs comprised in the 'operon-like' cluster of VGR3166 gene: VGAM2007 host target protein, VGAM2008 host target protein, VGAM2009 host target protein, VGAM2010 host target protein, VGAM2011 host target protein, VGAM2012 host target protein, VGAM2013 host target protein and VGAM2014 host target protein, herein schematically represented by VGAM1 HOST TARGET PROTEIN through VGAM3 HOST TARGET PROTEIN. The function of these host target genes is elaborated hereinabove with reference to VGAM2007, VGAM2008, VGAM2009, VGAM2010, VGAM2011, VGAM2012, VGAM2013 and VGAM2014. FIG. 9 further provides a conceptual description of novel bioinformatically detected regulatory viral gene, referred to here as Viral Genomic Record 3167(VGR3167) viral gene, which encodes an 'operon-like' cluster of novel viral micro RNA-like genes, each of which in turn modulates expression of at least one host target gene, the function and utility of which at least one host target gene is known in the art.

VGR3167 gene, herein designated VGR GENE, is a novel bioinformatically detected regulatory, non protein coding, RNA viral gene. The method by which VGR3167 gene was detected is described hereinabove with reference to FIGS. 1-9.

VGR3167 gene encodes VGR3167 precursor RNA, herein designated VGR PRECURSOR RNA, an RNA molecule, typically several hundred nucleotides long.

VGR3167 precursor RNA folds spatially, forming VGR3167 folded precursor RNA, herein designated VGR FOLDED PRECURSOR RNA. It is appreciated that VGR3167 folded precursor RNA comprises a plurality of what is known in the art as 'hairpin' structures. These 'hairpin' structures are due to the fact that the nucleotide sequence of VGR3167 precursor RNA comprises a plurality of segments, the first half of each such segment having a nucleotide sequence which is at least a partial inversed-reversed sequence of the second half thereof, as is well known in the art.

VGR3167 folded precursor RNA is naturally processed by cellular enzymatic activity into at least 8 separate VGAM precursor RNAs, VGAM2015 precursor RNA, VGAM2016 precursor RNA, VGAM2017 precursor RNA, VGAM2018 precursor RNA, VGAM2019 precursor RNA, VGAM2020 precursor RNA, VGAM2021 precursor RNA and VGAM2022 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2015 RNA, VGAM2016 RNA, VGAM2017 RNA, VGAM2018 RNA, VGAM2019 RNA, VGAM2020 RNA, VGAM2021 RNA and VGAM2022 RNA, herein schematically represented by VGAM1 RNA through VGAM3 RNA, each of which VGAM RNAs corresponding to VGAM RNA of FIG. 1.

VGAM2015 RNA, herein schematically represented by VGAM1 RNA through VGAM3 RNA, binds complementarily to a host target binding site located in an untranslated region of VGAM2015 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2015 host target RNA into VGAM2015 host target protein, herein schematically represented by VGAM1 HOST TARGET PROTEIN through VGAM3 HOST TARGET PROTEIN, all of FIG. 1.

VGAM2016 RNA, herein schematically represented by VGAM1 RNA through VGAM3 RNA, binds complementarily to a host target binding site located in an untranslated region of VGAM2016 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2016 host target RNA into VGAM2016 host target protein, herein schematically represented by VGAM1 HOST TARGET PROTEIN through VGAM3 HOST TARGET PROTEIN, all of FIG. 1.

VGAM2017 RNA, herein schematically represented by VGAM1 RNA through VGAM3 RNA, binds complementarily to a host target binding site located in an untranslated region of VGAM2017 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2017 host target RNA into VGAM2017 host target protein, herein schematically represented by VGAM1 HOST TARGET PROTEIN through VGAM3 HOST TARGET PROTEIN, all of FIG. 1.

VGAM2018 RNA, herein schematically represented by VGAM1 RNA through VGAM3 RNA, binds complementarily to a host target binding site located in an untranslated region of VGAM2018 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2018 host target RNA into VGAM2018 host target protein, herein schematically represented by VGAM1 HOST TARGET PROTEIN through VGAM3 HOST TARGET PROTEIN, all of FIG. 1.

VGAM2019 RNA, herein schematically represented by VGAM1 RNA through VGAM3 RNA, binds complementarily to a host target binding site located in an untranslated region of VGAM2019 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2019 host target RNA into VGAM2019 host target protein, herein schematically represented by VGAM1 HOST TARGET PROTEIN through VGAM3 HOST TARGET PROTEIN, all of FIG. 1.

VGAM2020 RNA, herein schematically represented by VGAM1 RNA through VGAM3 RNA, binds complementarily to a host target binding site located in an untranslated region of VGAM2020 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2020 host target RNA into VGAM2020 host target protein, herein schematically represented by VGAM1 HOST TARGET PROTEIN through VGAM3 HOST TARGET PROTEIN, all of FIG. 1.

VGAM2021 RNA, herein schematically represented by VGAM1 RNA through VGAM3 RNA, binds complementarily to a host target binding site located in an untranslated region of VGAM2021 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2021 host target RNA into VGAM2021 host target protein, herein schematically represented by VGAM1 HOST TARGET PROTEIN through VGAM3 HOST TARGET PROTEIN, all of FIG. 1.

VGAM2022 RNA, herein schematically represented by VGAM1 RNA through VGAM3 RNA, binds complementarily to a host target binding site located in an untranslated region of VGAM2022 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2022 host target RNA into VGAM2022 host target protein, herein schematically represented by VGAM1 HOST TARGET PROTEIN through VGAM3 HOST TARGET PROTEIN, all of FIG. 1.

It is appreciated that a function of VGR3167 gene, herein designated VGR GENE, is inhibition of expression of host target genes, as part of a novel viral mechanism of attacking a host. Accordingly, utilities of VGR3167 gene include diagnosis, prevention and treatment of viral infection by Kyuri Green Mottle Mosaic Virus. Specific functions, and accordingly utilities, of VGR3167 gene correlate with, and may be deduced from, the identity of the host target genes, which are inhibited by VGAM RNAs comprised in the 'operon-like' cluster of VGR3167 gene: VGAM2015 host target protein, VGAM2016 host target protein, VGAM2017 host target protein, VGAM2018 host target protein, VGAM2019 host target protein, VGAM2020 host target protein, VGAM2021 host target protein and VGAM2022 host target protein, herein schematically represented by VGAM1 HOST TARGET PROTEIN through VGAM3 HOST TARGET PROTEIN. The function of these host target genes is elaborated hereinabove with reference to VGAM2015, VGAM2016, VGAM2017, VGAM2018, VGAM2019, VGAM2020, VGAM2021 and VGAM2022. FIG. 9 further provides a conceptual description of novel bioinformatically detected regulatory viral gene, referred to here as Viral Genomic Record 3168(VGR3168) viral gene, which encodes an 'operon-like' cluster of novel viral micro RNA-like genes, each of which in turn modulates expression of at least one host target gene, the function and utility of which at least one host target gene is known in the art.

VGR3168 gene, herein designated VGR GENE, is a novel bioinformatically detected regulatory, non protein coding, RNA viral gene. The method by which VGR3168 gene was detected is described hereinabove with reference to FIGS. 1-9.

VGR3168 gene encodes VGR3168 precursor RNA, herein designated VGR PRECURSOR RNA, an RNA molecule, typically several hundred nucleotides long.

VGR3168 precursor RNA folds spatially, forming VGR3168 folded precursor RNA, herein designated VGR FOLDED PRECURSOR RNA. It is appreciated that VGR3168 folded precursor RNA comprises a plurality of what is known in the art as 'hairpin' structures. These 'hairpin' structures are due to the fact that the nucleotide sequence of VGR3168 precursor RNA comprises a plurality of segments, the first half of each such segment having a nucleotide sequence which is at least a partial inversed-reversed sequence of the second half thereof, as is well known in the art.

VGR3168 folded precursor RNA is naturally processed by cellular enzymatic activity into at least 8 separate VGAM precursor RNAs, VGAM2023 precursor RNA, VGAM2024 precursor RNA, VGAM2025 precursor RNA, VGAM2026 precursor RNA, VGAM2027 precursor RNA, VGAM2028 precursor RNA, VGAM2029 precursor RNA and VGAM2030 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2023 RNA, VGAM2024 RNA, VGAM2025 RNA, VGAM2026 RNA, VGAM2027 RNA, VGAM2028 RNA, VGAM2029 RNA and VGAM2030 RNA, herein schematically represented by VGAM1 RNA through VGAM3 RNA, each of which VGAM RNAs corresponding to VGAM RNA of FIG. 1.

VGAM2023 RNA, herein schematically represented by VGAM1 RNA through VGAM3 RNA, binds complementarily to a host target binding site located in an untranslated region of VGAM2023 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2023 host target RNA into VGAM2023 host target protein, herein schematically represented by VGAM1 HOST TARGET PROTEIN through VGAM3 HOST TARGET PROTEIN, all of FIG. 1.

VGAM2024 RNA, herein schematically represented by VGAM1 RNA through VGAM3 RNA, binds complementarily to a host target binding site located in an untranslated region of VGAM2024 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2024 host target RNA into VGAM2024 host target protein, herein schematically represented by VGAM1 HOST TARGET PROTEIN through VGAM3 HOST TARGET PROTEIN, all of FIG. 1.

VGAM2025 RNA, herein schematically represented by VGAM1 RNA through VGAM3 RNA, binds complementarily to a host target binding site located in an untranslated region of VGAM2025 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM2025 host target RNA into VGAM2025 host target protein, herein schematically represented by VGAM1 HOST TARGET PROTEIN through VGAM3 HOST TARGET PROTEIN, all of FIG. 1.

VGAM2026 RNA, herein schematically represented by VGAM1 RNA through VGAM3 RNA, binds complementarily to a host target binding site located in an untranslated region of VGAM2026 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2026 host target RNA into VGAM2026 host target protein, herein schematically represented by VGAM1 HOST TARGET PROTEIN through VGAM3 HOST TARGET PROTEIN, all of FIG. 1.

VGAM2027 RNA, herein schematically represented by VGAM1 RNA through VGAM3 RNA, binds complementarily to a host target binding site located in an untranslated region of VGAM2027 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2027 host target RNA into VGAM2027 host target protein, herein schematically represented by VGAM1 HOST TARGET PROTEIN through VGAM3 HOST TARGET PROTEIN, all of FIG. 1.

VGAM2028 RNA, herein schematically represented by VGAM1 RNA through VGAM3 RNA, binds complementarily to a host target binding site located in an untranslated region of VGAM2028 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2028 host target RNA into VGAM2028 host target protein, herein schematically represented by VGAM1 HOST TARGET PROTEIN through VGAM3 HOST TARGET PROTEIN, all of FIG. 1.

VGAM2029 RNA, herein schematically represented by VGAM1 RNA through VGAM3 RNA, binds complementarily to a host target binding site located in an untranslated region of VGAM2029 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2029 host target RNA into VGAM2029 host target protein, herein schematically represented by VGAM1 HOST TARGET PROTEIN through VGAM3 HOST TARGET PROTEIN, all of FIG. 1.

VGAM2030 RNA, herein schematically represented by VGAM1 RNA through VGAM3 RNA, binds complementarily to a host target binding site located in an untranslated region of VGAM2030 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2030 host target RNA into VGAM2030 host target protein, herein schematically represented by VGAM1 HOST TARGET PROTEIN through VGAM3 HOST TARGET PROTEIN, all of FIG. 1.

It is appreciated that a function of VGR3168 gene, herein designated VGR GENE, is inhibition of expression of host target genes, as part of a novel viral mechanism of attacking a host. Accordingly, utilities of VGR3168 gene include diagnosis, prevention and treatment of viral infection by Zaire Ebola Virus (ZEBOV). Specific functions, and accordingly utilities, of VGR3168 gene correlate with, and may be deduced from, the identity of the host target genes, which are inhibited by VGAM RNAs comprised in the 'operon-like' cluster of VGR3168 gene: VGAM2023 host target protein, VGAM2024 host target protein, VGAM2025 host target protein, VGAM2026 host target protein, VGAM2027 host target protein, VGAM2028 host target protein, VGAM2029 host target protein and VGAM2030 host target protein, herein schematically represented by VGAM1 HOST TARGET PROTEIN through VGAM3 HOST TARGET PROTEIN. The function of these host target genes is elaborated hereinabove with reference to VGAM2023, VGAM2024, VGAM2025, VGAM2026, VGAM2027, VGAM2028, VGAM2029 and VGAM2030. FIG. 9 further provides a conceptual description of novel bioinformatically detected regulatory viral gene, referred to here as Viral Genomic Record 3169(VGR3169) viral gene, which encodes an 'operon-like' cluster of novel viral micro RNA-like genes, each of which in turn modulates expression of at least one host target gene, the function and utility of which at least one host target gene is known in the art.

VGR3169 gene, herein designated VGR GENE, is a novel bioinformatically detected regulatory, non protein coding, RNA viral gene. The method by which VGR3169 gene was detected is described hereinabove with reference to FIGS. 1-9.

VGR3169 gene encodes VGR3169 precursor RNA, herein designated VGR PRECURSOR RNA, an RNA molecule, typically several hundred nucleotides long.

VGR3169 precursor RNA folds spatially, forming VGR3169 folded precursor RNA, herein designated VGR FOLDED PRECURSOR RNA. It is appreciated that VGR3169 folded precursor RNA comprises a plurality of what is known in the art as 'hairpin' structures. These 'hairpin' structures are due to the fact that the nucleotide sequence of VGR3169 precursor RNA comprises a plurality of segments, the first half of each such segment having a nucleotide sequence which is at least a partial inversed-reversed sequence of the second half thereof, as is well known in the art.

VGR3169 folded precursor RNA is naturally processed by cellular enzymatic activity into at least 5 separate VGAM precursor RNAs, VGAM2031 precursor RNA, VGAM2032 precursor RNA, VGAM2033 precursor RNA, VGAM2034 precursor RNA and VGAM2035 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2031 RNA, VGAM2032 RNA, VGAM2033 RNA, VGAM2034 RNA and VGAM2035 RNA, herein schematically represented by VGAM1 RNA through VGAM3 RNA, each of which VGAM RNAs corresponding to VGAM RNA of FIG. 1.

VGAM2031 RNA, herein schematically represented by VGAM1 RNA through VGAM3 RNA, binds complementarily to a host target binding site located in an untranslated region of VGAM2031 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2031 host target RNA into VGAM2031 host target protein, herein schematically represented by VGAM1 HOST TARGET PROTEIN through VGAM3 HOST TARGET PROTEIN, all of FIG. 1.

VGAM2032 RNA, herein schematically represented by VGAM1 RNA through VGAM3 RNA, binds complementarily to a host target binding site located in an untranslated region of VGAM2032 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2032 host target RNA into VGAM2032 host target protein, herein schematically represented by VGAM1 HOST TARGET PROTEIN through VGAM3 HOST TARGET PROTEIN, all of FIG. 1.

VGAM2033 RNA, herein schematically represented by VGAM1 RNA through VGAM3 RNA, binds complementarily to a host target binding site located in an untranslated region of VGAM2033 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2033 host target RNA into VGAM2033 host target protein, herein schematically represented by VGAM1 HOST TARGET PROTEIN through VGAM3 HOST TARGET PROTEIN, all of FIG. 1.

VGAM2034 RNA, herein schematically represented by VGAM1 RNA through VGAM3 RNA, binds complementarily to a host target binding site located in an untranslated region of VGAM2034 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2034 host target RNA into VGAM2034 host target protein, herein schematically represented by VGAM1 HOST TARGET PROTEIN through VGAM3 HOST TARGET PROTEIN, all of FIG. 1.

VGAM2035 RNA, herein schematically represented by VGAM1 RNA through VGAM3 RNA, binds complementarily to a host target binding site located in an untranslated region of VGAM2035 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2035 host target RNA into VGAM2035 host target protein, herein schematically represented by VGAM1 HOST TARGET PROTEIN through VGAM3 HOST TARGET PROTEIN, all of FIG. 1.

It is appreciated that a function of VGR3169 gene, herein designated VGR GENE, is inhibition of expression of host target genes, as part of a novel viral mechanism of attacking a host. Accordingly, utilities of VGR3169 gene include diagnosis, prevention and treatment of viral infection by Zaire Ebola Virus (ZEBOV). Specific functions, and accordingly utilities, of VGR3169 gene correlate with, and may be deduced from, the identity of the host target genes, which are inhibited by VGAM RNAs comprised in the 'operon-like' cluster of VGR3169 gene: VGAM2031 host target protein, VGAM2032 host target protein, VGAM2033 host target protein, VGAM2034 host target protein and VGAM2035 host target protein, herein schematically represented by VGAM1 HOST TARGET PROTEIN through VGAM3 HOST TARGET PROTEIN. The function of these host target genes is elaborated hereinabove with reference to VGAM2031, VGAM2032, VGAM2033, VGAM2034 and VGAM2035.

FIG. 9 further provides a conceptual description of novel bioinformatically detected regulatory viral gene, referred to here as Viral Genomic Record 3170(VGR3170) viral gene, which encodes an 'operon-like' cluster of novel viral micro RNA-like genes, each of which in turn modulates expression of at least one host target gene, the function and utility of which at least one host target gene is known in the art.

VGR3170 gene, herein designated VGR GENE, is a novel bioinformatically detected regulatory, non protein coding, RNA viral gene. The method by which VGR3170 gene was detected is described hereinabove with reference to FIGS. 1-9.

VGR3170 gene encodes VGR3170 precursor RNA, herein designated VGR PRECURSOR RNA, an RNA molecule, typically several hundred nucleotides long.

VGR3170 precursor RNA folds spatially, forming VGR3170 folded precursor RNA, herein designated VGR FOLDED PRECURSOR RNA. It is appreciated that VGR3170 folded precursor RNA comprises a plurality of what is known in the art as 'hairpin' structures. These 'hairpin' structures are due to the fact that the nucleotide sequence of VGR3170 precursor RNA comprises a plurality of segments, the first half of each such segment having a nucleotide sequence which is at least a partial inversed-reversed sequence of the second half thereof, as is well known in the art.

VGR3170 folded precursor RNA is naturally processed by cellular enzymatic activity into at least 6 separate VGAM precursor RNAs, VGAM2036 precursor RNA, VGAM2037 precursor RNA, VGAM2038 precursor RNA, VGAM2039 precursor RNA, VGAM2040 precursor RNA and VGAM2041 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2036 RNA, VGAM2037 RNA, VGAM2038 RNA, VGAM2039 RNA, VGAM2040 RNA and VGAM2041 RNA, herein schematically represented by VGAM1 RNA through VGAM3 RNA, each of which VGAM RNAs corresponding to VGAM RNA of FIG. 1.

VGAM2036 RNA, herein schematically represented by VGAM1 RNA through VGAM3 RNA, binds complementarily to a host target binding site located in an untranslated region of VGAM2036 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2036 host target RNA into VGAM2036 host target protein, herein schematically represented by VGAM1 HOST TARGET PROTEIN through VGAM3 HOST TARGET PROTEIN, all of FIG. 1.

VGAM2037 RNA, herein schematically represented by VGAM1 RNA through VGAM3 RNA, binds complementarily to a host target binding site located in an untranslated region of VGAM2037 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2037 host target RNA into VGAM2037 host target protein, herein schematically represented by VGAM1 HOST TARGET PROTEIN through VGAM3 HOST TARGET PROTEIN, all of FIG. 1.

VGAM2038 RNA, herein schematically represented by VGAM1 RNA through VGAM3 RNA, binds complementarily to a host target binding site located in an untranslated region of VGAM2038 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2038 host target RNA into VGAM2038 host target protein, herein schematically represented by VGAM1 HOST TARGET PROTEIN through VGAM3 HOST TARGET PROTEIN, all of FIG. 1.

VGAM2039 RNA, herein schematically represented by VGAM1 RNA through VGAM3 RNA, binds complementarily to a host target binding site located in an untranslated region of VGAM2039 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2039 host target RNA into VGAM2039 host target protein, herein schematically represented by VGAM1 HOST TARGET PROTEIN through VGAM3 HOST TARGET PROTEIN, all of FIG. 1.

VGAM2040 RNA, herein schematically represented by VGAM1 RNA through VGAM3 RNA, binds complementarily to a host target binding site located in an untranslated region of VGAM2040 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2040 host target RNA into VGAM2040 host target protein, herein schematically represented by VGAM1 HOST TARGET PROTEIN through VGAM3 HOST TARGET PROTEIN, all of FIG. 1.

VGAM2041 RNA, herein schematically represented by VGAM1 RNA through VGAM3 RNA, binds complementarily to a host target binding site located in an untranslated region of VGAM2041 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2041 host target RNA into VGAM2041 host target protein, herein schematically represented by VGAM1 HOST TARGET PROTEIN through VGAM3 HOST TARGET PROTEIN, all of FIG. 1.

It is appreciated that a function of VGR3170 gene, herein designated VGR GENE, is inhibition of expression of host target genes, as part of a novel viral mechanism of attacking a host. Accordingly, utilities of VGR3170 gene include diagnosis, prevention and treatment of viral infection by Marburg Virus. Specific functions, and accordingly utilities, of VGR3170 gene correlate with, and may be deduced from, the identity of the host target genes, which are inhibited by VGAM RNAs comprised in the 'operon-like' cluster of VGR3170 gene: VGAM2036 host target protein, VGAM2037 host target protein, VGAM2038 host target protein, VGAM2039 host target protein, VGAM2040 host target protein and VGAM2041 host target protein, herein schematically represented by VGAM1 HOST TARGET PROTEIN through VGAM3 HOST TARGET PROTEIN. The function of these host target genes is elaborated hereinabove with reference to VGAM2036, VGAM2037, VGAM2038, VGAM2039, VGAM2040 and VGAM2041. FIG. 9 further provides a conceptual description of novel bioinformatically detected regulatory viral gene, referred to here as Viral Genomic Record 3171 (VGR3171) viral gene, which encodes an 'operon-like' cluster of novel viral micro RNA-like genes, each of which in turn modulates expression of at least one host target gene, the function and utility of which at least one host target gene is known in the art.

VGR3171 gene, herein designated VGR GENE, is a novel bioinformatically detected regulatory, non protein coding, RNA viral gene. The method by which VGR3171 gene was detected is described hereinabove with reference to FIGS. 1-9.

VGR3171 gene encodes VGR3171 precursor RNA, herein designated VGR PRECURSOR RNA, an RNA molecule, typically several hundred nucleotides long.

VGR3171 precursor RNA folds spatially, forming VGR3171 folded precursor RNA, herein designated VGR FOLDED PRECURSOR RNA. It is appreciated that VGR3171 folded precursor RNA comprises a plurality of what is known in the art as 'hairpin' structures. These 'hairpin' structures are due to the fact that the nucleotide sequence of VGR3171 precursor RNA comprises a plurality of segments, the first half of each such segment having a nucleotide sequence which is at least a partial inversed-reversed sequence of the second half thereof, as is well known in the art.

VGR3171 folded precursor RNA is naturally processed by cellular enzymatic activity into at least 8 separate VGAM precursor RNAs, VGAM2042 precursor RNA, VGAM2043 precursor RNA, VGAM2044 precursor RNA, VGAM2045 precursor RNA, VGAM2046 precursor RNA, VGAM2047 precursor RNA, VGAM2048 precursor RNA and VGAM2049 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2042 RNA, VGAM2043 RNA, VGAM2044 RNA, VGAM2045 RNA, VGAM2046 RNA, VGAM2047 RNA, VGAM2048 RNA and VGAM2049 RNA, herein schematically represented by VGAM1 RNA through VGAM3 RNA, each of which VGAM RNAs corresponding to VGAM RNA of FIG. 1.

VGAM2042 RNA, herein schematically represented by VGAM1 RNA through VGAM3 RNA, binds complementarily to a host target binding site located in an untranslated region of VGAM2042 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2042 host target RNA into VGAM2042 host target protein, herein schematically represented by VGAM1 HOST TARGET PROTEIN through VGAM3 HOST TARGET PROTEIN, all of FIG. 1.

VGAM2043 RNA, herein schematically represented by VGAM1 RNA through VGAM3 RNA, binds complementarily to a host target binding site located in an untranslated region of VGAM2043 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2043 host target RNA into VGAM2043 host target protein, herein schematically represented by VGAM1 HOST TARGET PROTEIN through VGAM3 HOST TARGET PROTEIN, all of FIG. 1.

VGAM2044 RNA, herein schematically represented by VGAM1 RNA through VGAM3 RNA, binds complementarily to a host target binding site located in an untranslated region of VGAM2044 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2044 host target RNA into VGAM2044 host target protein, herein schematically represented by VGAM1 HOST TARGET PROTEIN through VGAM3 HOST TARGET PROTEIN, all of FIG. 1.

VGAM2045 RNA, herein schematically represented by VGAM1 RNA through VGAM3 RNA, binds complementarily to a host target binding site located in an untranslated region of VGAM2045 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2045 host target RNA into VGAM2045 host target protein, herein schematically represented by VGAM1 HOST TARGET PROTEIN through VGAM3 HOST TARGET PROTEIN, all of FIG. 1.

VGAM2046 RNA, herein schematically represented by VGAM1 RNA through VGAM3 RNA, binds complementarily to a host target binding site located in an untranslated region of VGAM2046 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2046 host target RNA into VGAM2046 host target protein, herein schematically represented by VGAM1 HOST TARGET PROTEIN through VGAM3 HOST TARGET PROTEIN, all of FIG. 1.

VGAM2047 RNA, herein schematically represented by VGAM1 RNA through VGAM3 RNA, binds complementarily to a host target binding site located in an untranslated region of VGAM2047 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2047 host target RNA into VGAM2047 host target protein, herein schematically represented by VGAM1 HOST TARGET PROTEIN through VGAM3 HOST TARGET PROTEIN, all of FIG. 1.

VGAM2048 RNA, herein schematically represented by VGAM1 RNA through VGAM3 RNA, binds complementarily to a host target binding site located in an untranslated region of VGAM2048 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2048 host target RNA into VGAM2048 host target protein, herein schematically represented by VGAM1 HOST TARGET PROTEIN through VGAM3 HOST TARGET PROTEIN, all of FIG. 1.

VGAM2049 RNA, herein schematically represented by VGAM1 RNA through VGAM3 RNA, binds complementarily to a host target binding site located in an untranslated region of VGAM2049 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2049 host target RNA into VGAM2049 host target protein, herein schematically represented by VGAM1 HOST TARGET PROTEIN through VGAM3 HOST TARGET PROTEIN, all of FIG. 1.

It is appreciated that a function of VGR3171 gene, herein designated VGR GENE, is inhibition of expression of host target genes, as part of a novel viral mechanism of attacking a host. Accordingly, utilities of VGR3171 gene include diagnosis, prevention and treatment of viral infection by Human Herpesvirus 5. Specific functions, and accordingly utilities, of VGR3171 gene correlate with, and may be deduced from, the identity of the host target genes, which are inhibited by VGAM RNAs comprised in the 'operon-like' cluster of VGR3171 gene: VGAM2042 host target protein, VGAM2043 host target protein, VGAM2044 host target protein, VGAM2045 host target protein, VGAM2046 host target protein, VGAM2047 host target protein, VGAM2048 host target protein and VGAM2049 host target protein, herein schematically represented by VGAM1 HOST TARGET PROTEIN through VGAM3 HOST TARGET PROTEIN. The function of these host target genes is elaborated hereinabove with reference to VGAM2042, VGAM2043, VGAM2044, VGAM2045, VGAM2046, VGAM2047, VGAM2048 and VGAM2049. FIG. 9 further provides a conceptual description of novel bioinformatically detected regulatory viral gene, referred to here as Viral Genomic Record 3172(VGR3172) viral gene, which encodes an 'operon-like' cluster of novel viral micro RNA-like genes, each of which in turn modulates expression of at least one host target gene, the function and utility of which at least one host target gene is known in the art.

VGR3172 gene, herein designated VGR GENE, is a novel bioinformatically detected regulatory, non protein coding, RNA viral gene. The method by which VGR3172 gene was detected is described hereinabove with reference to FIGS. 1-9.

VGR3172 gene encodes VGR3172 precursor RNA, herein designated VGR PRECURSOR RNA, an RNA molecule, typically several hundred nucleotides long.

VGR3172 precursor RNA folds spatially, forming VGR3172 folded precursor RNA, herein designated VGR FOLDED PRECURSOR RNA. It is appreciated that VGR3172 folded precursor RNA comprises a plurality of what is known in the art as 'hairpin' structures. These 'hairpin' structures are due to the fact that the nucleotide sequence of VGR3172 precursor RNA comprises a plurality of segments, the first half of each such segment having a nucleotide sequence which is at least a partial inversed-reversed sequence of the second half thereof, as is well known in the art.

VGR3172 folded precursor RNA is naturally processed by cellular enzymatic activity into at least 4 separate VGAM precursor RNAs, VGAM2050 precursor RNA, VGAM2051 precursor RNA, VGAM2052 precursor RNA and VGAM2053 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2050 RNA, VGAM2051 RNA, VGAM2052 RNA and VGAM2053 RNA, herein schematically represented by VGAM1 RNA through VGAM3 RNA, each of which VGAM RNAs corresponding to VGAM RNA of FIG. 1.

VGAM2050 RNA, herein schematically represented by VGAM1 RNA through VGAM3 RNA, binds complementarily to a host target binding site located in an untranslated region of VGAM2050 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2050 host target RNA into VGAM2050 host target protein, herein schematically represented by VGAM1 HOST TARGET PROTEIN through VGAM3 HOST TARGET PROTEIN, all of FIG. 1.

VGAM2051 RNA, herein schematically represented by VGAM1 RNA through VGAM3 RNA, binds complementarily to a host target binding site located in an untranslated region of VGAM2051 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2051 host target RNA into VGAM2051 host target protein, herein schematically represented by VGAM1 HOST TARGET PROTEIN through VGAM3 HOST TARGET PROTEIN, all of FIG. 1.

VGAM2052 RNA, herein schematically represented by VGAM1 RNA through VGAM3 RNA, binds complementarily to a host target binding site located in an untranslated region of VGAM2052 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2052 host target RNA into VGAM2052 host target protein, herein schematically represented by VGAM1 HOST TARGET PROTEIN through VGAM3 HOST TARGET PROTEIN, all of FIG. 1.

VGAM2053 RNA, herein schematically represented by VGAM1 RNA through VGAM3 RNA, binds complementarily to a host target binding site located in an untranslated region of VGAM2053 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2053 host target RNA into VGAM2053 host target protein, herein schematically represented by VGAM1 HOST TARGET PROTEIN through VGAM3 HOST TARGET PROTEIN, all of FIG. 1.

It is appreciated that a function of VGR3172 gene, herein designated VGR GENE, is inhibition of expression of host target genes, as part of a novel viral mechanism of attacking a host. Accordingly, utilities of VGR3172 gene include diagnosis, prevention and treatment of viral infection by Ovine Adenovirus A. Specific functions, and accordingly utilities, of VGR3172 gene correlate with, and may be deduced from, the identity of the host target genes, which are inhibited by VGAM RNAs comprised in the 'operon-like' cluster of VGR3172 gene: VGAM2050 host target protein, VGAM2051 host target protein, VGAM2052 host target protein and VGAM2053 host target protein, herein schematically represented by VGAM1 HOST TARGET PROTEIN through VGAM3 HOST TARGET PROTEIN. The function of these host target genes is elaborated hereinabove with reference to VGAM2050, VGAM2051, VGAM2052 and VGAM2053.

FIG. 9 further provides a conceptual description of novel bioinformatically detected regulatory viral gene, referred to here as Viral Genomic Record 3173(VGR3173) viral gene, which encodes an 'operon-like' cluster of novel viral micro RNA-like genes, each of which in turn modulates expression of at least one host target gene, the function and utility of which at least one host target gene is known in the art.

VGR3173 gene, herein designated VGR GENE, is a novel bioinformatically detected regulatory, non protein coding, RNA viral gene. The method by which VGR3173 gene was detected is described hereinabove with reference to FIGS. 1-9.

VGR3173 gene encodes VGR3173 precursor RNA, herein designated VGR PRECURSOR RNA, an RNA molecule, typically several hundred nucleotides long.

VGR3173 precursor RNA folds spatially, forming VGR3173 folded precursor RNA, herein designated VGR FOLDED PRECURSOR RNA. It is appreciated that VGR3173 folded precursor RNA comprises a plurality of what is known in the art as 'hairpin' structures. These 'hairpin' structures are due to the fact that the nucleotide sequence of VGR3173 precursor RNA comprises a plurality of segments, the first half of each such segment having a nucleotide sequence which is at least a partial inversed-reversed sequence of the second half thereof, as is well known in the art.

VGR3173 folded precursor RNA is naturally processed by cellular enzymatic activity into at least 8 separate VGAM precursor RNAs, VGAM2054 precursor RNA, VGAM2055 precursor RNA, VGAM2056 precursor RNA, VGAM2057 precursor RNA, VGAM2058 precursor RNA, VGAM2059 precursor RNA, VGAM2060 precursor RNA and VGAM2061 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2054 RNA, VGAM2055 RNA, VGAM2056 RNA, VGAM2057 RNA, VGAM2058 RNA, VGAM2059 RNA, VGAM2060 RNA and VGAM2061 RNA, herein schematically represented by VGAM1 RNA through VGAM3 RNA, each of which VGAM RNAs corresponding to VGAM RNA of FIG. 1.

VGAM2054 RNA, herein schematically represented by VGAM1 RNA through VGAM3 RNA, binds complementarily to a host target binding site located in an untranslated region of VGAM2054 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2054 host target RNA into VGAM2054 host target protein, herein schematically represented by VGAM1 HOST TARGET PROTEIN through VGAM3 HOST TARGET PROTEIN, all of FIG. 1.

VGAM2055 RNA, herein schematically represented by VGAM1 RNA through VGAM3 RNA, binds complementarily to a host target binding site located in an untranslated region of VGAM2055 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2055 host target RNA into VGAM2055 host target protein, herein schematically represented by VGAM1 HOST TARGET PROTEIN through VGAM3 HOST TARGET PROTEIN, all of FIG. 1.

VGAM2056 RNA, herein schematically represented by VGAM1 RNA through VGAM3 RNA, binds complementarily to a host target binding site located in an untranslated region of VGAM2056 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2056 host target RNA into VGAM2056 host target protein, herein schematically represented by VGAM1 HOST TARGET PROTEIN through VGAM3 HOST TARGET PROTEIN, all of FIG. 1.

VGAM2057 RNA, herein schematically represented by VGAM1 RNA through VGAM3 RNA, binds complementarily to a host target binding site located in an untranslated region of VGAM2057 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2057 host target RNA into VGAM2057 host target protein, herein schematically represented by VGAM1 HOST TARGET PROTEIN through VGAM3 HOST TARGET PROTEIN, all of FIG. 1.

VGAM2058 RNA, herein schematically represented by VGAM1 RNA through VGAM3 RNA, binds complementarily to a host target binding site located in an untranslated region of VGAM2058 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2058 host target RNA into VGAM2058 host target protein, herein schematically represented by VGAM1 HOST TARGET PROTEIN through VGAM3 HOST TARGET PROTEIN, all of FIG. 1.

VGAM2059 RNA, herein schematically represented by VGAM1 RNA through VGAM3 RNA, binds complementarily to a host target binding site located in an untranslated region of VGAM2059 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2059 host target RNA into VGAM2059 host target protein, herein schematically represented by VGAM1 HOST TARGET PROTEIN through VGAM3 HOST TARGET PROTEIN, all of FIG. 1.

VGAM2060 RNA, herein schematically represented by VGAM1 RNA through VGAM3 RNA, binds complementarily to a host target binding site located in an untranslated region of VGAM2060 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2060 host target RNA into VGAM2060 host target protein, herein schematically represented by VGAM1 HOST TARGET PROTEIN through VGAM3 HOST TARGET PROTEIN, all of FIG. 1.

VGAM2061 RNA, herein schematically represented by VGAM1 RNA through VGAM3 RNA, binds complementarily to a host target binding site located in an untranslated region of VGAM2061 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2061 host target RNA into VGAM2061 host target protein, herein schematically represented by VGAM1 HOST TARGET PROTEIN through VGAM3 HOST TARGET PROTEIN, all of FIG. 1.

It is appreciated that a function of VGR3173 gene, herein designated VGR GENE, is inhibition of expression of host target genes, as part of a novel viral mechanism of attacking a host. Accordingly, utilities of VGR3173 gene include diagnosis, prevention and treatment of viral infection by Ectromelia Virus. Specific functions, and accordingly utilities, of VGR3173 gene correlate with, and may be deduced from, the identity of the host target genes, which are inhibited by VGAM RNAs comprised in the 'operon-like' cluster of VGR3173 gene: VGAM2054 host target protein, VGAM2055 host target protein, VGAM2056 host target protein, VGAM2057 host target protein, VGAM2058 host target protein, VGAM2059 host target protein, VGAM2060 host target protein and VGAM2061 host target protein, herein schematically represented by VGAM1 HOST TARGET PROTEIN through VGAM3 HOST TARGET PROTEIN. The function of these host target genes is elaborated hereinabove with reference to VGAM2054, VGAM2055, VGAM2056, VGAM2057, VGAM2058, VGAM2059, VGAM2060 and VGAM2061. FIG. 9 further provides a conceptual description of novel bioinformatically detected regulatory viral gene, referred to here as Viral Genomic Record 3174(VGR3174) viral gene, which encodes an 'operon-like' cluster of novel viral micro RNA-like genes, each of which in turn modulates expression of at least one host target gene, the function and utility of which at least one host target gene is known in the art.

VGR3174 gene, herein designated VGR GENE, is a novel bioinformatically detected regulatory, non protein coding, RNA viral gene. The method by which VGR3174 gene was detected is described hereinabove with reference to FIGS. 1-9.

VGR3174 gene encodes VGR3174 precursor RNA, herein designated VGR PRECURSOR RNA, an RNA molecule, typically several hundred nucleotides long.

VGR3174 precursor RNA folds spatially, forming VGR3174 folded precursor RNA, herein designated VGR FOLDED PRECURSOR RNA. It is appreciated that VGR3174 folded precursor RNA comprises a plurality of what is known in the art as 'hairpin' structures. These 'hairpin' structures are due to the fact that the nucleotide sequence of VGR3174 precursor RNA comprises a plurality of segments, the first half of each such segment having a nucleotide sequence which is at least a partial inversed-reversed sequence of the second half thereof, as is well known in the art.

VGR3174 folded precursor RNA is naturally processed by cellular enzymatic activity into at least 6 separate VGAM precursor RNAs, VGAM2062 precursor RNA, VGAM2063 precursor RNA, VGAM2064 precursor RNA, VGAM2065 precursor RNA, VGAM2066 precursor RNA and VGAM2067 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2062 RNA, VGAM2063 RNA, VGAM2064 RNA, VGAM2065 RNA, VGAM2066 RNA and VGAM2067 RNA, herein schematically represented by VGAM1 RNA through VGAM3 RNA, each of which VGAM RNAs corresponding to VGAM RNA of FIG. 1.

VGAM2062 RNA, herein schematically represented by VGAM1 RNA through VGAM3 RNA, binds complementarily to a host target binding site located in an untranslated region of VGAM2062 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2062 host target RNA into VGAM2062 host target protein, herein schematically represented by VGAM1 HOST TARGET PROTEIN through VGAM3 HOST TARGET PROTEIN, all of FIG. 1.

VGAM2063 RNA, herein schematically represented by VGAM1 RNA through VGAM3 RNA, binds complementarily to a host target binding site located in an untranslated region of VGAM2063 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2063 host target RNA into VGAM2063 host target protein, herein schematically represented by VGAM1 HOST TARGET PROTEIN through VGAM3 HOST TARGET PROTEIN, all of FIG. 1.

VGAM2064 RNA, herein schematically represented by VGAM1 RNA through VGAM3 RNA, binds complementarily to a host target binding site located in an untranslated region of VGAM2064 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2064 host target RNA into VGAM2064 host target protein, herein schematically represented by VGAM1 HOST TARGET PROTEIN through VGAM3 HOST TARGET PROTEIN, all of FIG. 1.

VGAM2065 RNA, herein schematically represented by VGAM1 RNA through VGAM3 RNA, binds complementarily to a host target binding site located in an untranslated region of VGAM2065 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2065 host target RNA into VGAM2065 host target protein, herein schematically represented by VGAM1 HOST TARGET PROTEIN through VGAM3 HOST TARGET PROTEIN, all of FIG. 1.

VGAM2066 RNA, herein schematically represented by VGAM1 RNA through VGAM3 RNA, binds complementarily to a host target binding site located in an untranslated region of VGAM2066 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2066 host target RNA into VGAM2066 host target protein, herein schematically represented by VGAM1 HOST TARGET PROTEIN through VGAM3 HOST TARGET PROTEIN, all of FIG. 1.

VGAM2067 RNA, herein schematically represented by VGAM1 RNA through VGAM3 RNA, binds complementarily to a host target binding site located in an untranslated region of VGAM2067 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2067 host target RNA into VGAM2067 host target protein, herein schematically represented by VGAM1 HOST TARGET PROTEIN through VGAM3 HOST TARGET PROTEIN, all of FIG. 1.

It is appreciated that a function of VGR3174 gene, herein designated VGR GENE, is inhibition of expression of host target genes, as part of a novel viral mechanism of attacking a host. Accordingly, utilities of VGR3174 gene include diagnosis, prevention and treatment of viral infection by Peanut Bud Necrosis Virus. Specific functions, and accordingly utilities, of VGR3174 gene correlate with, and may be deduced from, the identity of the host target genes, which are inhibited by VGAM RNAs comprised in the 'operon-like' cluster of VGR3174 gene: VGAM2062 host target protein, VGAM2063 host target protein, VGAM2064 host target protein, VGAM2065 host target protein, VGAM2066 host target protein and VGAM2067 host target protein, herein schematically represented by VGAM1 HOST TARGET PROTEIN through VGAM3 HOST TARGET PROTEIN. The function of these host target genes is elaborated hereinabove with reference to VGAM2062, VGAM2063, VGAM2064, VGAM2065, VGAM2066 and VGAM2067. FIG. 9 further provides a conceptual description of novel bioinformatically detected regulatory viral gene, referred to here as Viral Genomic Record 3175(VGR3175) viral gene, which encodes an 'operon-like' cluster of novel viral micro RNA-like genes, each of which in turn modulates expression of at least one host target gene, the function and utility of which at least one host target gene is known in the art.

VGR3175 gene, herein designated VGR GENE, is a novel bioinformatically detected regulatory, non protein coding, RNA viral gene. The method by which VGR3175 gene was detected is described hereinabove with reference to FIGS. 1-9.

VGR3175 gene encodes VGR3175 precursor RNA, herein designated VGR PRECURSOR RNA, an RNA molecule, typically several hundred nucleotides long.

VGR3175 precursor RNA folds spatially, forming VGR3175 folded precursor RNA, herein designated VGR FOLDED PRECURSOR RNA. It is appreciated that VGR3175 folded precursor RNA comprises a plurality of what is known in the art as 'hairpin' structures. These 'hairpin' structures are due to the fact that the nucleotide sequence of VGR3175 precursor RNA comprises a plurality of segments, the first half of each such segment having a nucleotide sequence which is at least a partial inversed-reversed sequence of the second half thereof, as is well known in the art.

VGR3175 folded precursor RNA is naturally processed by cellular enzymatic activity into at least 7 separate VGAM precursor RNAs, VGAM2068 precursor RNA, VGAM2069 precursor RNA, VGAM2070 precursor RNA, VGAM2071 precursor RNA, VGAM2072 precursor RNA, VGAM2073 precursor RNA and VGAM2074 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2068 RNA, VGAM2069 RNA, VGAM2070 RNA, VGAM2071 RNA, VGAM2072 RNA, VGAM2073 RNA and VGAM2074 RNA, herein schematically represented by VGAM1 RNA through VGAM3 RNA, each of which VGAM RNAs corresponding to VGAM RNA of FIG. 1.

VGAM2068 RNA, herein schematically represented by VGAM1 RNA through VGAM3 RNA, binds complementarily to a host target binding site located in an untranslated region of VGAM2068 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2068 host target RNA into VGAM2068 host target protein, herein schematically represented by VGAM1 HOST TARGET PROTEIN through VGAM3 HOST TARGET PROTEIN, all of FIG. 1.

VGAM2069 RNA, herein schematically represented by VGAM1 RNA through VGAM3 RNA, binds complementarily to a host target binding site located in an untranslated region of VGAM2069 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2069 host target RNA into VGAM2069 host target protein, herein schematically represented by VGAM1 HOST TARGET PROTEIN through VGAM3 HOST TARGET PROTEIN, all of FIG. 1.

VGAM2070 RNA, herein schematically represented by VGAM1 RNA through VGAM3 RNA, binds complementarily to a host target binding site located in an untranslated region of VGAM2070 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2070 host target RNA into VGAM2070 host target protein, herein schematically represented by VGAM1 HOST TARGET PROTEIN through VGAM3 HOST TARGET PROTEIN, all of FIG. 1.

VGAM2071 RNA, herein schematically represented by VGAM1 RNA through VGAM3 RNA, binds complementarily to a host target binding site located in an untranslated region of VGAM2071 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2071 host target RNA into VGAM2071 host target protein, herein schematically represented by VGAM1 HOST TARGET PROTEIN through VGAM3 HOST TARGET PROTEIN, all of FIG. 1.

VGAM2072 RNA, herein schematically represented by VGAM1 RNA through VGAM3 RNA, binds complementarily to a host target binding site located in an untranslated region of VGAM2072 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2072 host target RNA into VGAM2072 host target protein, herein schematically represented by VGAM1 HOST TARGET PROTEIN through VGAM3 HOST TARGET PROTEIN, all of FIG. 1.

VGAM2073 RNA, herein schematically represented by VGAM1 RNA through VGAM3 RNA, binds complementarily to a host target binding site located in an untranslated region of VGAM2073 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2073 host target RNA into VGAM2073 host target protein, herein schematically represented by VGAM1 HOST TARGET PROTEIN through VGAM3 HOST TARGET PROTEIN, all of FIG. 1.

VGAM2074 RNA, herein schematically represented by VGAM1 RNA through VGAM3 RNA, binds complementarily to a host target binding site located in an untranslated region of VGAM2074 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2074 host target RNA into VGAM2074 host target protein, herein schematically represented by VGAM1 HOST TARGET PROTEIN through VGAM3 HOST TARGET PROTEIN, all of FIG. 1.

It is appreciated that a function of VGR3175 gene, herein designated VGR GENE, is inhibition of expression of host target genes, as part of a novel viral mechanism of attacking a host. Accordingly, utilities of VGR3175 gene include diagnosis, prevention and treatment of viral infection by Monkeypox Virus. Specific functions, and accordingly utilities, of VGR3175 gene correlate with, and may be deduced from, the identity of the host target genes, which are inhibited by VGAM RNAs comprised in the 'operon-like' cluster of VGR3175 gene: VGAM2068 host target protein, VGAM2069 host target protein, VGAM2070 host target protein, VGAM2071 host target protein, VGAM2072 host target protein, VGAM2073 host target protein and VGAM2074 host target protein, herein schematically represented by VGAM1 HOST TARGET PROTEIN through VGAM3 HOST TARGET PROTEIN. The function of these host target genes is elaborated hereinabove with reference to VGAM2068, VGAM2069, VGAM2070, VGAM2071, VGAM2072, VGAM2073 and VGAM2074. FIG. 9 further provides a conceptual description of novel bioinformatically detected regulatory viral gene, referred to here as Viral Genomic Record 3176(VGR3176) viral gene, which encodes an 'operon-like' cluster of novel viral micro RNA-like genes, each of which in turn modulates expression of at least one host target gene, the function and utility of which at least one host target gene is known in the art.

VGR3176 gene, herein designated VGR GENE, is a novel bioinformatically detected regulatory, non protein coding, RNA viral gene. The method by which VGR3176 gene was detected is described hereinabove with reference to FIGS. 1-9.

VGR3176 gene encodes VGR3176 precursor RNA, herein designated VGR PRECURSOR RNA, an RNA molecule, typically several hundred nucleotides long.

VGR3176 precursor RNA folds spatially, forming VGR3176 folded precursor RNA, herein designated VGR FOLDED PRECURSOR RNA. It is appreciated that VGR3176 folded precursor RNA comprises a plurality of what is known in the art as 'hairpin' structures. These 'hairpin' structures are due to the fact that the nucleotide sequence of VGR3176 precursor RNA comprises a plurality of segments, the first half of each such segment having a nucleotide sequence which is at least a partial inversed-reversed sequence of the second half thereof, as is well known in the art.

VGR3176 folded precursor RNA is naturally processed by cellular enzymatic activity into at least 8 separate VGAM precursor RNAs, VGAM2075 precursor RNA, VGAM2076 precursor RNA, VGAM2077 precursor RNA, VGAM2078 precursor RNA, VGAM2079 precursor RNA, VGAM2080 precursor RNA, VGAM2081 precursor RNA and VGAM2082 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2075 RNA, VGAM2076 RNA, VGAM2077 RNA, VGAM2078 RNA, VGAM2079 RNA, VGAM2080 RNA, VGAM2081 RNA and VGAM2082 RNA, herein schematically represented by VGAM1 RNA through VGAM3 RNA, each of which VGAM RNAs corresponding to VGAM RNA of FIG. 1.

VGAM2075 RNA, herein schematically represented by VGAM1 RNA through VGAM3 RNA, binds complementarily to a host target binding site located in an untranslated region of VGAM2075 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2075 host target RNA into VGAM2075 host target protein, herein schematically represented by VGAM1 HOST TARGET PROTEIN through VGAM3 HOST TARGET PROTEIN, all of FIG. 1.

VGAM2076 RNA, herein schematically represented by VGAM1 RNA through VGAM3 RNA, binds complementarily to a host target binding site located in an untranslated region of VGAM2076 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2076 host target RNA into VGAM2076 host target protein, herein schematically represented by VGAM1 HOST TARGET PROTEIN through VGAM3 HOST TARGET PROTEIN, all of FIG. 1.

VGAM2077 RNA, herein schematically represented by VGAM1 RNA through VGAM3 RNA, binds complementarily to a host target binding site located in an untranslated region of VGAM2077 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2077 host target RNA into VGAM2077 host target protein, herein schematically represented by VGAM1 HOST TARGET PROTEIN through VGAM3 HOST TARGET PROTEIN, all of FIG. 1.

VGAM2078 RNA, herein schematically represented by VGAM1 RNA through VGAM3 RNA, binds complementarily to a host target binding site located in an untranslated region of VGAM2078 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2078 host target RNA into VGAM2078 host target protein, herein schematically represented by VGAM1 HOST TARGET PROTEIN through VGAM3 HOST TARGET PROTEIN, all of FIG. 1.

VGAM2079 RNA, herein schematically represented by VGAM1 RNA through VGAM3 RNA, binds complementarily to a host target binding site located in an untranslated region of VGAM2079 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2079 host target RNA into VGAM2079 host target protein, herein schematically represented by VGAM1 HOST TARGET PROTEIN through VGAM3 HOST TARGET PROTEIN, all of FIG. 1.

VGAM2080 RNA, herein schematically represented by VGAM1 RNA through VGAM3 RNA, binds complementarily to a host target binding site located in an untranslated region of VGAM2080 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2080 host target RNA into VGAM2080 host target protein, herein schematically represented by VGAM1 HOST TARGET PROTEIN through VGAM3 HOST TARGET PROTEIN, all of FIG. 1.

VGAM2081 RNA, herein schematically represented by VGAM1 RNA through VGAM3 RNA, binds complementarily to a host target binding site located in an untranslated region of VGAM2081 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2081 host target RNA into VGAM2081 host target protein, herein schematically represented by VGAM1 HOST TARGET PROTEIN through VGAM3 HOST TARGET PROTEIN, all of FIG. 1.

VGAM2082 RNA, herein schematically represented by VGAM1 RNA through VGAM3 RNA, binds complementarily to a host target binding site located in an untranslated region of VGAM2082 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2082 host target RNA into VGAM2082 host target protein, herein schematically represented by VGAM1 HOST TARGET PROTEIN through VGAM3 HOST TARGET PROTEIN, all of FIG. 1.

It is appreciated that a function of VGR3176 gene, herein designated VGR GENE, is inhibition of expression of host target genes, as part of a novel viral mechanism of attacking a host. Accordingly, utilities of VGR3176 gene include diagnosis, prevention and treatment of viral infection by Variola Virus. Specific functions, and accordingly utilities, of VGR3176 gene correlate with, and may be deduced from, the identity of the host target genes, which are inhibited by VGAM RNAs comprised in the 'operon-like' cluster of VGR3176 gene: VGAM2075 host target protein, VGAM2076 host target protein, VGAM2077 host target protein, VGAM2078 host target protein, VGAM2079 host target protein, VGAM2080 host target protein, VGAM2081 host target protein and VGAM2082 host target protein, herein schematically represented by VGAM1 HOST TARGET PROTEIN through VGAM3 HOST TARGET PROTEIN. The function of these host target genes is elaborated hereinabove with reference to VGAM2075, VGAM2076, VGAM2077, VGAM2078, VGAM2079, VGAM2080, VGAM2081 and VGAM2082. FIG. 9 further provides a conceptual description of novel bioinformatically detected regulatory viral gene, referred to here as Viral Genomic Record 3177(VGR3177) viral gene, which encodes an 'operon-like' cluster of novel viral micro RNA-like genes, each of which in turn modulates expression of at least one host target gene, the function and utility of which at least one host target gene is known in the art.

VGR3177 gene, herein designated VGR GENE, is a novel bioinformatically detected regulatory, non protein coding, RNA viral gene. The method by which VGR3177 gene was detected is described hereinabove with reference to FIGS. 1-9.

VGR3177 gene encodes VGR3177 precursor RNA, herein designated VGR PRECURSOR RNA, an RNA molecule, typically several hundred nucleotides long.

VGR3177 precursor RNA folds spatially, forming VGR3177 folded precursor RNA, herein designated VGR FOLDED PRECURSOR RNA. It is appreciated that VGR3177 folded precursor RNA comprises a plurality of what is known in the art as 'hairpin' structures. These 'hairpin' structures are due to the fact that the nucleotide sequence of VGR3177 precursor RNA comprises a plurality of segments, the first half of each such segment having a nucleotide sequence which is at least a partial inversed-reversed sequence of the second half thereof, as is well known in the art.

VGR3177 folded precursor RNA is naturally processed by cellular enzymatic activity into at least 2 separate VGAM precursor RNAs, VGAM2083 precursor RNA and VGAM2084 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2083 RNA and VGAM2084 RNA, herein schematically represented by VGAM1 RNA through VGAM3 RNA, each of which VGAM RNAs corresponding to VGAM RNA of FIG. 1.

VGAM2083 RNA, herein schematically represented by VGAM1 RNA through VGAM3 RNA, binds complementarily to a host target binding site located in an untranslated region of VGAM2083 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2083 host target RNA into VGAM2083 host target protein, herein schematically represented by VGAM1 HOST TARGET PROTEIN through VGAM3 HOST TARGET PROTEIN, all of FIG. 1.

VGAM2084 RNA, herein schematically represented by VGAM1 RNA through VGAM3 RNA, binds complementarily to a host target binding site located in an untranslated region of VGAM2084 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2084 host target RNA into VGAM2084 host target protein, herein schematically represented by VGAM1 HOST TARGET PROTEIN through VGAM3 HOST TARGET PROTEIN, all of FIG. 1.

It is appreciated that a function of VGR3177 gene, herein designated VGR GENE, is inhibition of expression of host target genes, as part of a novel viral mechanism of attacking a host. Accordingly, utilities of VGR3177 gene include diagnosis, prevention and treatment of viral infection by Camelpox Virus. Specific functions, and accordingly utilities, of VGR3177 gene correlate with, and may be deduced from, the identity of the host target genes, which are inhibited by VGAM RNAs comprised in the 'operon-like' cluster of VGR3177 gene: VGAM2083 host target protein and VGAM2084 host target protein, herein schematically represented by VGAM1 HOST TARGET PROTEIN through VGAM3 HOST TARGET PROTEIN. The function of these host target genes is elaborated hereinabove with reference to VGAM2083 and VGAM2084. FIG. 9 further provides a conceptual description of novel bioinformatically detected regulatory viral gene, referred to here as Viral Genomic Record 3178(VGR3178) viral gene, which encodes an 'operon-like' cluster of novel viral micro RNA-like genes, each of which in turn modulates expression of at least one host target gene, the function and utility of which at least one host target gene is known in the art.

VGR3178 gene, herein designated VGR GENE, is a novel bioinformatically detected regulatory, non protein coding, RNA viral gene. The method by which VGR3178 gene was detected is described hereinabove with reference to FIGS. 1-9.

VGR3178 gene encodes VGR3178 precursor RNA, herein designated VGR PRECURSOR RNA, an RNA molecule, typically several hundred nucleotides long.

VGR3178 precursor RNA folds spatially, forming VGR3178 folded precursor RNA, herein designated VGR FOLDED PRECURSOR RNA. It is appreciated that VGR3178 folded precursor RNA comprises a plurality of what is known in the art as 'hairpin' structures. These 'hairpin' structures are due to the fact that the nucleotide sequence of VGR3178 precursor RNA comprises a plurality of segments, the first half of each such segment having a nucleotide sequence which is at least a partial inversed-reversed sequence of the second half thereof, as is well known in the art.

VGR3178 folded precursor RNA is naturally processed by cellular enzymatic activity into at least 8 separate VGAM precursor RNAs, VGAM2085 precursor RNA, VGAM2086 precursor RNA, VGAM2087 precursor RNA, VGAM2088 precursor RNA, VGAM2089 precursor RNA, VGAM2090 precursor RNA, VGAM2091 precursor RNA and VGAM2092 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2085 RNA, VGAM2086 RNA, VGAM2087 RNA, VGAM2088 RNA, VGAM2089 RNA, VGAM2090 RNA, VGAM2091 RNA and VGAM2092 RNA, herein schematically represented by VGAM1 RNA through VGAM3 RNA, each of which VGAM RNAs corresponding to VGAM RNA of FIG. 1.

VGAM2085 RNA, herein schematically represented by VGAM1 RNA through VGAM3 RNA, binds complementarily to a host target binding site located in an untranslated region of VGAM2085 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2085 host target RNA into VGAM2085 host target protein, herein schematically represented by VGAM1 HOST TARGET PROTEIN through VGAM3 HOST TARGET PROTEIN, all of FIG. 1.

VGAM2086 RNA, herein schematically represented by VGAM1 RNA through VGAM3 RNA, binds complementarily to a host target binding site located in an untranslated region of VGAM2086 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2086 host target RNA into VGAM2086 host target protein, herein schematically represented by VGAM1 HOST TARGET PROTEIN through VGAM3 HOST TARGET PROTEIN, all of FIG. 1.

VGAM2087 RNA, herein schematically represented by VGAM1 RNA through VGAM3 RNA, binds complementarily to a host target binding site located in an untranslated region of VGAM2087 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2087 host target RNA into VGAM2087 host target protein, herein schematically represented by VGAM1 HOST TARGET PROTEIN through VGAM3 HOST TARGET PROTEIN, all of FIG. 1.

VGAM2088 RNA, herein schematically represented by VGAM1 RNA through VGAM3 RNA, binds complementarily to a host target binding site located in an untranslated region of VGAM2088 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2088 host target RNA into VGAM2088 host target protein, herein schematically represented by VGAM1 HOST TARGET PROTEIN through VGAM3 HOST TARGET PROTEIN, all of FIG. 1.

VGAM2089 RNA, herein schematically represented by VGAM1 RNA through VGAM3 RNA, binds complementarily to a host target binding site located in an untranslated region of VGAM2089 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2089 host target RNA into VGAM2089 host target protein, herein schematically represented by VGAM1 HOST TARGET PROTEIN through VGAM3 HOST TARGET PROTEIN, all of FIG. 1.

VGAM2090 RNA, herein schematically represented by VGAM1 RNA through VGAM3 RNA, binds complementarily to a host target binding site located in an untranslated region of VGAM2090 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2090 host target RNA into VGAM2090 host target protein, herein schematically represented by VGAM1 HOST TARGET PROTEIN through VGAM3 HOST TARGET PROTEIN, all of FIG. 1.

VGAM2091 RNA, herein schematically represented by VGAM1 RNA through VGAM3 RNA, binds complementarily to a host target binding site located in an untranslated region of VGAM2091 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2091 host target RNA into VGAM2091 host target protein, herein schematically represented by VGAM1 HOST TARGET PROTEIN through VGAM3 HOST TARGET PROTEIN, all of FIG. 1.

VGAM2092 RNA, herein schematically represented by VGAM1 RNA through VGAM3 RNA, binds complementarily to a host target binding site located in an untranslated region of VGAM2092 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2092 host target RNA into VGAM2092 host target protein, herein schematically represented by VGAM1 HOST TARGET PROTEIN through VGAM3 HOST TARGET PROTEIN, all of FIG. 1.

It is appreciated that a function of VGR3178 gene, herein designated VGR GENE, is inhibition of expression of host target genes, as part of a novel viral mechanism of attacking a host. Accordingly, utilities of VGR3178 gene include diagnosis, prevention and treatment of viral infection by Fowlpox Virus. Specific functions, and accordingly utilities, of VGR3178 gene correlate with, and may be deduced from, the identity of the host target genes, which are inhibited by VGAM RNAs comprised in the 'operon-like' cluster of VGR3178 gene: VGAM2085 host target protein, VGAM2086 host target protein, VGAM2087 host target protein, VGAM2088 host target protein, VGAM2089 host target protein, VGAM2090 host target protein, VGAM2091 host target protein and VGAM2092 host target protein, herein schematically represented by VGAM1 HOST TARGET PROTEIN through VGAM3 HOST TARGET PROTEIN. The function of these host target genes is elaborated hereinabove with reference to VGAM2085, VGAM2086, VGAM2087, VGAM2088, VGAM2089, VGAM2090, VGAM2091 and VGAM2092. FIG. 9 further provides a conceptual description of novel bioinformatically detected regulatory viral gene, referred to here as Viral Genomic Record 3179(VGR3179) viral gene, which encodes an 'operon-like' cluster of novel viral micro RNA-like genes, each of which in turn modulates expression of at least one host target gene, the function and utility of which at least one host target gene is known in the art.

VGR3179 gene, herein designated VGR GENE, is a novel bioinformatically detected regulatory, non protein coding, RNA viral gene. The method by which VGR3179 gene was detected is described hereinabove with reference to FIGS. 1-9.

VGR3179 gene encodes VGR3179 precursor RNA, herein designated VGR PRECURSOR RNA, an RNA molecule, typically several hundred nucleotides long.

VGR3179 precursor RNA folds spatially, forming VGR3179 folded precursor RNA, herein designated VGR FOLDED PRECURSOR RNA. It is appreciated that VGR3179 folded precursor RNA comprises a plurality of what is known in the art as 'hairpin' structures. These 'hairpin' structures are due to the fact that the nucleotide sequence of VGR3179 precursor RNA comprises a plurality of segments, the first half of each such segment having a nucleotide sequence which is at least a partial inversed-reversed sequence of the second half thereof, as is well known in the art.

VGR3179 folded precursor RNA is naturally processed by cellular enzymatic activity into at least 8 separate VGAM precursor RNAs, VGAM2093 precursor RNA, VGAM2094 precursor RNA, VGAM2095 precursor RNA, VGAM2096 precursor RNA, VGAM2097 precursor RNA, VGAM2098 precursor RNA, VGAM2099 precursor RNA and VGAM2100 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2093 RNA, VGAM2094 RNA, VGAM2095 RNA, VGAM2096 RNA, VGAM2097 RNA, VGAM2098 RNA, VGAM2099 RNA and VGAM2100 RNA, herein schematically represented by VGAM1 RNA through VGAM3 RNA, each of which VGAM RNAs corresponding to VGAM RNA of FIG. 1.

VGAM2093 RNA, herein schematically represented by VGAM1 RNA through VGAM3 RNA, binds complementarily to a host target binding site located in an untranslated region of VGAM2093 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2093 host target RNA into VGAM2093 host target protein, herein schematically represented by VGAM1 HOST TARGET PROTEIN through VGAM3 HOST TARGET PROTEIN, all of FIG. 1.

VGAM2094 RNA, herein schematically represented by VGAM1 RNA through VGAM3 RNA, binds complementarily to a host target binding site located in an untranslated region of VGAM2094 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2094 host target RNA into VGAM2094 host target protein, herein schematically represented by VGAM1 HOST TARGET PROTEIN through VGAM3 HOST TARGET PROTEIN, all of FIG. 1.

VGAM2095 RNA, herein schematically represented by VGAM1 RNA through VGAM3 RNA, binds complementarily to a host target binding site located in an untranslated region of VGAM2095 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2095 host target RNA into VGAM2095 host target protein, herein schematically represented by VGAM1 HOST TARGET PROTEIN through VGAM3 HOST TARGET PROTEIN, all of FIG. 1.

VGAM2096 RNA, herein schematically represented by VGAM1 RNA through VGAM3 RNA, binds complementarily to a host target binding site located in an untranslated region of VGAM2096 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2096 host target RNA into VGAM2096 host target protein, herein schematically represented by VGAM1 HOST TARGET PROTEIN through VGAM3 HOST TARGET PROTEIN, all of FIG. 1.

VGAM2097 RNA, herein schematically represented by VGAM1 RNA through VGAM3 RNA, binds complementarily to a host target binding site located in an untranslated region of VGAM2097 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2097 host target RNA into VGAM2097 host target protein, herein schematically represented by VGAM1 HOST TARGET PROTEIN through VGAM3 HOST TARGET PROTEIN, all of FIG. 1.

VGAM2098 RNA, herein schematically represented by VGAM1 RNA through VGAM3 RNA, binds complementarily to a host target binding site located in an untranslated region of VGAM2098 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2098 host target RNA into VGAM2098 host target protein, herein schematically represented by VGAM1 HOST TARGET PROTEIN through VGAM3 HOST TARGET PROTEIN, all of FIG. 1.

VGAM2099 RNA, herein schematically represented by VGAM1 RNA through VGAM3 RNA, binds complementarily to a host target binding site located in an untranslated region of VGAM2099 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2099 host target RNA into VGAM2099 host target protein, herein schematically represented by VGAM1 HOST TARGET PROTEIN through VGAM3 HOST TARGET PROTEIN, all of FIG. 1.

VGAM2100 RNA, herein schematically represented by VGAM1 RNA through VGAM3 RNA, binds complementarily to a host target binding site located in an untranslated region of VGAM2100 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2100 host target RNA into VGAM2100 host target protein, herein schematically represented by VGAM1 HOST TARGET PROTEIN through VGAM3 HOST TARGET PROTEIN, all of FIG. 1.

It is appreciated that a function of VGR3179 gene, herein designated VGR GENE, is inhibition of expression of host target genes, as part of a novel viral mechanism of attacking a host. Accordingly, utilities of VGR3179 gene include diagnosis, prevention and treatment of viral infection by Camelpox Virus. Specific functions, and accordingly utilities, of VGR3179 gene correlate with, and may be deduced from, the identity of the host target genes, which are inhibited by VGAM RNAs comprised in the 'operon-like' cluster of VGR3179 gene: VGAM2093 host target protein, VGAM2094 host target protein, VGAM2095 host target protein, VGAM2096 host target protein, VGAM2097 host target protein, VGAM2098 host target protein, VGAM2099 host target protein and VGAM2100 host target protein, herein schematically represented by VGAM1 HOST TARGET PROTEIN through VGAM3 HOST TARGET PROTEIN. The function of these host target genes is elaborated hereinabove with reference to VGAM2093, VGAM2094, VGAM2095, VGAM2096, VGAM2097, VGAM2098, VGAM2099 and VGAM2100. FIG. 9 further provides a conceptual description of novel bioinformatically detected regulatory viral gene, referred to here as Viral Genomic Record 3180(VGR3180) viral gene, which encodes an 'operon-like' cluster of novel viral micro RNA-like genes, each of which in turn modulates expression of at least one host target gene, the function and utility of which at least one host target gene is known in the art.

VGR3180 gene, herein designated VGR GENE, is a novel bioinformatically detected regulatory, non protein coding, RNA viral gene. The method by which VGR3180 gene was detected is described hereinabove with reference to FIGS. 1-9.

VGR3180 gene encodes VGR3180 precursor RNA, herein designated VGR PRECURSOR RNA, an RNA molecule, typically several hundred nucleotides long.

VGR3180 precursor RNA folds spatially, forming VGR3180 folded precursor RNA, herein designated VGR FOLDED PRECURSOR RNA. It is appreciated that VGR3180 folded precursor RNA comprises a plurality of what is known in the art as 'hairpin' structures. These 'hairpin' structures are due to the fact that the nucleotide sequence of VGR3180 precursor RNA comprises a plurality of segments, the first half of each such segment having a nucleotide sequence which is at least a partial inversed-reversed sequence of the second half thereof, as is well known in the art.

VGR3180 folded precursor RNA is naturally processed by cellular enzymatic activity into at least 4 separate VGAM precursor RNAs, VGAM2101 precursor RNA, VGAM2102 precursor RNA, VGAM2103 precursor RNA and VGAM2104 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2101 RNA, VGAM2102 RNA, VGAM2103 RNA and VGAM2104 RNA, herein schematically represented by VGAM1 RNA through VGAM3 RNA, each of which VGAM RNAs corresponding to VGAM RNA of FIG. 1.

VGAM2101 RNA, herein schematically represented by VGAM1 RNA through VGAM3 RNA, binds complementarily to a host target binding site located in an untranslated region of VGAM2101 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2101 host target RNA into VGAM2101 host target protein, herein schematically represented by VGAM1 HOST TARGET PROTEIN through VGAM3 HOST TARGET PROTEIN, all of FIG. 1.

VGAM2102 RNA, herein schematically represented by VGAM1 RNA through VGAM3 RNA, binds complementarily to a host target binding site located in an untranslated region of VGAM2102 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2102 host target RNA into VGAM2102 host target protein, herein schematically represented by VGAM1 HOST TARGET PROTEIN through VGAM3 HOST TARGET PROTEIN, all of FIG. 1.

VGAM2103 RNA, herein schematically represented by VGAM1 RNA through VGAM3 RNA, binds complementarily to a host target binding site located in an untranslated region of VGAM2103 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2103 host target RNA into VGAM2103 host target protein, herein schematically represented by VGAM1 HOST TARGET PROTEIN through VGAM3 HOST TARGET PROTEIN, all of FIG. 1.

VGAM2104 RNA, herein schematically represented by VGAM1 RNA through VGAM3 RNA, binds complementarily to a host target binding site located in an untranslated region of VGAM2104 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2104 host target RNA into VGAM2104 host target protein, herein schematically represented by VGAM1 HOST TARGET PROTEIN through VGAM3 HOST TARGET PROTEIN, all of FIG. 1.

It is appreciated that a function of VGR3180 gene, herein designated VGR GENE, is inhibition of expression of host target genes, as part of a novel viral mechanism of attacking a host. Accordingly, utilities of VGR3180 gene include diagnosis, prevention and treatment of viral infection by Camelpox Virus. Specific functions, and accordingly utilities, of VGR3180 gene correlate with, and may be deduced from, the identity of the host target genes, which are inhibited by VGAM RNAs comprised in the 'operon-like' cluster of VGR3180 gene: VGAM2101 host target protein, VGAM2102 host target protein, VGAM2103 host target protein and VGAM2104 host target protein, herein schematically represented by VGAM1 HOST TARGET PROTEIN through VGAM3 HOST TARGET PROTEIN. The function of these host target genes is elaborated hereinabove with reference to VGAM2101, VGAM2102, VGAM2103 and VGAM2104. FIG. 9 further provides a conceptual description of novel bioinformatically detected regulatory viral gene, referred to here as Viral Genomic Record 3181(VGR3181) viral gene, which encodes an 'operon-like' cluster of novel viral micro RNA-like genes, each of which in turn modulates expression of at least one host target gene, the function and utility of which at least one host target gene is known in the art.

VGR3181 gene, herein designated VGR GENE, is a novel bioinformatically detected regulatory, non protein coding, RNA viral gene. The method by which VGR3181 gene was detected is described hereinabove with reference to FIGS. 1-9.

VGR3181 gene encodes VGR3181 precursor RNA, herein designated VGR PRECURSOR RNA, an RNA molecule, typically several hundred nucleotides long.

VGR3181 precursor RNA folds spatially, forming VGR3181 folded precursor RNA, herein designated VGR FOLDED PRECURSOR RNA. It is appreciated that VGR3181 folded precursor RNA comprises a plurality of what is known in the art as 'hairpin' structures. These 'hairpin' structures are due to the fact that the nucleotide sequence of VGR3181 precursor RNA comprises a plurality of segments, the first half of each such segment having a nucleotide sequence which is at least a partial inversed-reversed sequence of the second half thereof, as is well known in the art.

VGR3181 folded precursor RNA is naturally processed by cellular enzymatic activity into at least 7 separate VGAM precursor RNAs, VGAM2105 precursor RNA, VGAM2106 precursor RNA, VGAM2107 precursor RNA, VGAM2108 precursor RNA, VGAM2109 precursor RNA, VGAM2110 precursor RNA and VGAM2111 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2105 RNA, VGAM2106 RNA, VGAM2107 RNA, VGAM2108 RNA, VGAM2109 RNA, VGAM2110 RNA and VGAM2111 RNA, herein schematically represented by VGAM1 RNA through VGAM3 RNA, each of which VGAM RNAs corresponding to VGAM RNA of FIG. 1.

VGAM2105 RNA, herein schematically represented by VGAM1 RNA through VGAM3 RNA, binds complementarily to a host target binding site located in an untranslated region of VGAM2105 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2105 host target RNA into VGAM2105 host target protein, herein schematically represented by VGAM1 HOST TARGET PROTEIN through VGAM3 HOST TARGET PROTEIN, all of FIG. 1.

VGAM2106 RNA, herein schematically represented by VGAM1 RNA through VGAM3 RNA, binds complementarily to a host target binding site located in an untranslated region of VGAM2106 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2106 host target RNA into VGAM2106 host target protein, herein schematically represented by VGAM1 HOST TARGET PROTEIN through VGAM3 HOST TARGET PROTEIN, all of FIG. 1.

VGAM2107 RNA, herein schematically represented by VGAM1 RNA through VGAM3 RNA, binds complementarily to a host target binding site located in an untranslated region of VGAM2107 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2107 host target RNA into VGAM2107 host target protein, herein schematically represented by VGAM1 HOST TARGET PROTEIN through VGAM3 HOST TARGET PROTEIN, all of FIG. 1.

VGAM2108 RNA, herein schematically represented by VGAM1 RNA through VGAM3 RNA, binds complementarily to a host target binding site located in an untranslated region of VGAM2108 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2108 host target RNA into VGAM2108 host target protein, herein schematically represented by VGAM1 HOST TARGET PROTEIN through VGAM3 HOST TARGET PROTEIN, all of FIG. 1.

VGAM2109 RNA, herein schematically represented by VGAM1 RNA through VGAM3 RNA, binds complementarily to a host target binding site located in an untranslated region of VGAM2109 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2109 host target RNA into VGAM2109 host target protein, herein schematically represented by VGAM1 HOST TARGET PROTEIN through VGAM3 HOST TARGET PROTEIN, all of FIG. 1.

VGAM2110 RNA, herein schematically represented by VGAM1 RNA through VGAM3 RNA, binds complementarily to a host target binding site located in an untranslated region of VGAM2110 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2110 host target RNA into VGAM2110 host target protein, herein schematically represented by VGAM1 HOST TARGET PROTEIN through VGAM3 HOST TARGET PROTEIN, all of FIG. 1.

VGAM2111 RNA, herein schematically represented by VGAM1 RNA through VGAM3 RNA, binds complementarily to a host target binding site located in an untranslated region of VGAM2111 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2111 host target RNA into VGAM2111 host target protein, herein schematically represented by VGAM1 HOST TARGET PROTEIN through VGAM3 HOST TARGET PROTEIN, all of FIG. 1.

It is appreciated that a function of VGR3181 gene, herein designated VGR GENE, is inhibition of expression of host target genes, as part of a novel viral mechanism of attacking a host. Accordingly, utilities of VGR3181 gene include diagnosis, prevention and treatment of viral infection by Grapevine Chrome Mosaic Virus. Specific functions, and accordingly utilities, of VGR3181 gene correlate with, and may be deduced from, the identity of the host target genes, which are inhibited by VGAM RNAs comprised in the 'operon-like' cluster of VGR3181 gene: VGAM2105 host target protein, VGAM2106 host target protein, VGAM2107 host target protein, VGAM2108 host target protein, VGAM2109 host target protein, VGAM2110 host target protein and VGAM2111 host target protein, herein schematically represented by VGAM1 HOST TARGET PROTEIN through VGAM3 HOST TARGET PROTEIN. The function of these host target genes is elaborated hereinabove with reference to VGAM2105, VGAM2106, VGAM2107, VGAM2108, VGAM2109, VGAM2110 and VGAM2111. FIG. 9 further provides a conceptual description of novel bioinformatically detected regulatory viral gene, referred to here as Viral Genomic Record 3182(VGR3182) viral gene, which encodes an 'operon-like' cluster of novel viral micro RNA-like genes, each of which in turn modulates expression of at least one host target gene, the function and utility of which at least one host target gene is known in the art.

VGR3182 gene, herein designated VGR GENE, is a novel bioinformatically detected regulatory, non protein coding, RNA viral gene. The method by which VGR3182 gene was detected is described hereinabove with reference to FIGS. 1-9.

VGR3182 gene encodes VGR3182 precursor RNA, herein designated VGR PRECURSOR RNA, an RNA molecule, typically several hundred nucleotides long.

VGR3182 precursor RNA folds spatially, forming VGR3182 folded precursor RNA, herein designated VGR FOLDED PRECURSOR RNA. It is appreciated that VGR3182 folded precursor RNA comprises a plurality of what is known in the art as 'hairpin' structures. These 'hairpin' structures are due to the fact that the nucleotide sequence of VGR3182 precursor RNA comprises a plurality of segments, the first half of each such segment having a nucleotide sequence which is at least a partial inversed-reversed sequence of the second half thereof, as is well known in the art.

VGR3182 folded precursor RNA is naturally processed by cellular enzymatic activity into at least 2 separate VGAM precursor RNAs, VGAM2112 precursor RNA and VGAM2113 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2112 RNA and VGAM2113 RNA, herein schematically represented by VGAM1 RNA through VGAM3 RNA, each of which VGAM RNAs corresponding to VGAM RNA of FIG. 1.

VGAM2112 RNA, herein schematically represented by VGAM1 RNA through VGAM3 RNA, binds complementarily to a host target binding site located in an untranslated region of VGAM2112 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2112 host target RNA into VGAM2112 host target protein, herein schematically represented by VGAM1 HOST TARGET PROTEIN through VGAM3 HOST TARGET PROTEIN, all of FIG. 1.

VGAM2113 RNA, herein schematically represented by VGAM1 RNA through VGAM3 RNA, binds complementarily to a host target binding site located in an untranslated region of VGAM2113 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2113 host target RNA into VGAM2113 host target protein, herein schematically represented by VGAM1 HOST TARGET PROTEIN through VGAM3 HOST TARGET PROTEIN, all of FIG. 1.

It is appreciated that a function of VGR3182 gene, herein designated VGR GENE, is inhibition of expression of host target genes, as part of a novel viral mechanism of attacking a host. Accordingly, utilities of VGR3182 gene include diagnosis, prevention and treatment of viral infection by Grapevine Chrome Mosaic Virus. Specific functions, and accordingly utilities, of VGR3182 gene correlate with, and may be deduced from, the identity of the host target genes, which are inhibited by VGAM RNAs comprised in the 'operon-like' cluster of VGR3182 gene: VGAM2112 host target protein and VGAM2113 host target protein, herein schematically represented by VGAM1 HOST TARGET PROTEIN through VGAM3 HOST TARGET PROTEIN. The function of these host target genes is elaborated hereinabove with reference to VGAM2112 and VGAM2113. FIG. 9 further provides a conceptual description of novel bioinformatically detected regulatory viral gene, referred to here as Viral Genomic Record 3183(VGR3183) viral gene, which encodes an 'operon-like' cluster of novel viral micro RNA-like genes, each of which in turn modulates expression of at least one host target gene, the function and utility of which at least one host target gene is known in the art.

VGR3183 gene, herein designated VGR GENE, is a novel bioinformatically detected regulatory, non protein coding, RNA viral gene. The method by which VGR3183 gene was detected is described hereinabove with reference to FIGS. 1-9.

VGR3183 gene encodes VGR3183 precursor RNA, herein designated VGR PRECURSOR RNA, an RNA molecule, typically several hundred nucleotides long.

VGR3183 precursor RNA folds spatially, forming VGR3183 folded precursor RNA, herein designated VGR FOLDED PRECURSOR RNA. It is appreciated that VGR3183 folded precursor RNA comprises a plurality of what is known in the art as 'hairpin' structures. These 'hairpin' structures are due to the fact that the nucleotide sequence of VGR3183 precursor RNA comprises a plurality of segments, the first half of each such segment having a nucleotide sequence which is at least a partial inversed-reversed sequence of the second half thereof, as is well known in the art.

VGR3183 folded precursor RNA is naturally processed by cellular enzymatic activity into at least 8 separate VGAM precursor RNAs, VGAM2114 precursor RNA, VGAM2115 precursor RNA, VGAM2116 precursor RNA, VGAM2117 precursor RNA, VGAM2118 precursor RNA, VGAM2119 precursor RNA, VGAM2120 precursor RNA and VGAM2121 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2114 RNA, VGAM2115 RNA, VGAM2116 RNA, VGAM2117 RNA, VGAM2118 RNA, VGAM2119 RNA, VGAM2120 RNA and VGAM2121 RNA, herein schematically represented by VGAM1 RNA through VGAM3 RNA, each of which VGAM RNAs corresponding to VGAM RNA of FIG. 1.

VGAM2114 RNA, herein schematically represented by VGAM1 RNA through VGAM3 RNA, binds complementarily to a host target binding site located in an untranslated region of VGAM2114 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2114 host target RNA into VGAM2114 host target protein, herein schematically represented by VGAM1 HOST TARGET PROTEIN through VGAM3 HOST TARGET PROTEIN, all of FIG. 1.

VGAM2115 RNA, herein schematically represented by VGAM1 RNA through VGAM3 RNA, binds complementarily to a host target binding site located in an untranslated region of VGAM2115 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2115 host target RNA into VGAM2115 host target protein, herein schematically represented by VGAM1 HOST TARGET PROTEIN through VGAM3 HOST TARGET PROTEIN, all of FIG. 1.

VGAM2116 RNA, herein schematically represented by VGAM1 RNA through VGAM3 RNA, binds complementarily to a host target binding site located in an untranslated region of VGAM2116 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2116 host target RNA into VGAM2116 host target protein, herein schematically represented by VGAM1 HOST TARGET PROTEIN through VGAM3 HOST TARGET PROTEIN, all of FIG. 1.

VGAM2117 RNA, herein schematically represented by VGAM1 RNA through VGAM3 RNA, binds complementarily to a host target binding site located in an untranslated region of VGAM2117 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2117 host target RNA into VGAM2117 host target protein, herein schematically represented by VGAM1 HOST TARGET PROTEIN through VGAM3 HOST TARGET PROTEIN, all of FIG. 1.

VGAM2118 RNA, herein schematically represented by VGAM1 RNA through VGAM3 RNA, binds complementarily to a host target binding site located in an untranslated region of VGAM2118 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2118 host target RNA into VGAM2118 host target protein, herein schematically represented by VGAM1 HOST TARGET PROTEIN through VGAM3 HOST TARGET PROTEIN, all of FIG. 1.

VGAM2119 RNA, herein schematically represented by VGAM1 RNA through VGAM3 RNA, binds complementarily to a host target binding site located in an untranslated region of VGAM2119 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2119 host target RNA into VGAM2119 host target protein, herein schematically represented by VGAM1 HOST TARGET PROTEIN through VGAM3 HOST TARGET PROTEIN, all of FIG. 1.

VGAM2120 RNA, herein schematically represented by VGAM1 RNA through VGAM3 RNA, binds complementarily to a host target binding site located in an untranslated region of VGAM2120 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2120 host target RNA into VGAM2120 host target protein, herein schematically represented by VGAM1 HOST TARGET PROTEIN through VGAM3 HOST TARGET PROTEIN, all of FIG. 1.

VGAM2121 RNA, herein schematically represented by VGAM1 RNA through VGAM3 RNA, binds complementarily to a host target binding site located in an untranslated region of VGAM2121 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2121 host target RNA into VGAM2121 host target protein, herein schematically represented by VGAM1 HOST TARGET PROTEIN through VGAM3 HOST TARGET PROTEIN, all of FIG. 1.

It is appreciated that a function of VGR3183 gene, herein designated VGR GENE, is inhibition of expression of host target genes, as part of a novel viral mechanism of attacking a host. Accordingly, utilities of VGR3183 gene include diagnosis, prevention and treatment of viral infection by Cowpox Virus. Specific functions, and accordingly utilities, of VGR3183 gene correlate with, and may be deduced from, the identity of the host target genes, which are inhibited by VGAM RNAs comprised in the 'operon-like' cluster of VGR3183 gene: VGAM2114 host target protein, VGAM2115 host target protein, VGAM2116 host target protein, VGAM2117 host target protein, VGAM2118 host target protein, VGAM2119 host target protein, VGAM2120 host target protein and VGAM2121 host target protein, herein schematically represented by VGAM1 HOST TARGET PROTEIN through VGAM3 HOST TARGET PROTEIN. The function of these host target genes is elaborated hereinabove with reference to VGAM2114, VGAM2115, VGAM2116, VGAM2117, VGAM2118, VGAM2119, VGAM2120 and VGAM2121. FIG. 9 further provides a conceptual description of novel bioinformatically detected regulatory viral gene, referred to here as Viral Genomic Record 3184(VGR3184) viral gene, which encodes an 'operon-like' cluster of novel viral micro RNA-like genes, each of which in turn modulates expression of at least one host target gene, the function and utility of which at least one host target gene is known in the art.

VGR3184 gene, herein designated VGR GENE, is a novel bioinformatically detected regulatory, non protein coding, RNA viral gene. The method by which VGR3184 gene was detected is described hereinabove with reference to FIGS. 1-9.

VGR3184 gene encodes VGR3184 precursor RNA, herein designated VGR PRECURSOR RNA, an RNA molecule, typically several hundred nucleotides long.

VGR3184 precursor RNA folds spatially, forming VGR3184 folded precursor RNA, herein designated VGR FOLDED PRECURSOR RNA. It is appreciated that VGR3184 folded precursor RNA comprises a plurality of what is known in the art as 'hairpin' structures. These 'hairpin' structures are due to the fact that the nucleotide sequence of VGR3184 precursor RNA comprises a plurality of segments, the first half of each such segment having a nucleotide sequence which is at least a partial inversed-reversed sequence of the second half thereof, as is well known in the art.

VGR3184 folded precursor RNA is naturally processed by cellular enzymatic activity into at least 3 separate VGAM precursor RNAs, VGAM2122 precursor RNA, VGAM2123 precursor RNA and VGAM2124 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2122 RNA, VGAM2123 RNA and VGAM2124 RNA, herein schematically represented by VGAM1 RNA through VGAM3 RNA, each of which VGAM RNAs corresponding to VGAM RNA of FIG. 1.

VGAM2122 RNA, herein schematically represented by VGAM1 RNA through VGAM3 RNA, binds complementarily to a host target binding site located in an untranslated region of VGAM2122 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2122 host target RNA into VGAM2122 host target protein, herein schematically represented by VGAM1 HOST TARGET PROTEIN through VGAM3 HOST TARGET PROTEIN, all of FIG. 1.

VGAM2123 RNA, herein schematically represented by VGAM1 RNA through VGAM3 RNA, binds complementarily to a host target binding site located in an untranslated region of VGAM2123 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2123 host target RNA into VGAM2123 host target protein, herein schematically represented by VGAM1 HOST TARGET PROTEIN through VGAM3 HOST TARGET PROTEIN, all of FIG. 1.

VGAM2124 RNA, herein schematically represented by VGAM1 RNA through VGAM3 RNA, binds complementarily to a host target binding site located in an untranslated region of VGAM2124 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2124 host target RNA into VGAM2124 host target protein, herein schematically represented by VGAM1 HOST TARGET PROTEIN through VGAM3 HOST TARGET PROTEIN, all of FIG. 1.

It is appreciated that a function of VGR3184 gene, herein designated VGR GENE, is inhibition of expression of host target genes, as part of a novel viral mechanism of attacking a host. Accordingly, utilities of VGR3184 gene include diagnosis, prevention and treatment of viral infection by Cowpox Virus. Specific functions, and accordingly utilities, of VGR3184 gene correlate with, and may be deduced from, the identity of the host target genes, which are inhibited by VGAM RNAs comprised in the 'operon-like' cluster of VGR3184 gene: VGAM2122 host target protein, VGAM2123 host target protein and VGAM2124 host target protein, herein schematically represented by VGAM1 HOST TARGET PROTEIN through VGAM3 HOST TARGET PROTEIN. The function of these host target genes is elaborated hereinabove with reference to VGAM2122, VGAM2123 and VGAM2124. FIG. 9 further provides a conceptual description of novel bioinformatically detected regulatory viral gene, referred to here as Viral Genomic Record 3185(VGR3185) viral gene, which encodes an 'operon-like' cluster of novel viral micro RNA-like genes, each of which in turn modulates expression of at least one host target gene, the function and utility of which at least one host target gene is known in the art.

VGR3185 gene, herein designated VGR GENE, is a novel bioinformatically detected regulatory, non protein coding, RNA viral gene. The method by which VGR3185 gene was detected is described hereinabove with reference to FIGS. 1-9.

VGR3185 gene encodes VGR3185 precursor RNA, herein designated VGR PRECURSOR RNA, an RNA molecule, typically several hundred nucleotides long.

VGR3185 precursor RNA folds spatially, forming VGR3185 folded precursor RNA, herein designated VGR FOLDED PRECURSOR RNA. It is appreciated that VGR3185 folded precursor RNA comprises a plurality of what is known in the art as 'hairpin' structures. These 'hairpin' structures are due to the fact that the nucleotide sequence of VGR3185 precursor RNA comprises a plurality of segments, the first half of each such segment having a nucleotide sequence which is at least a partial inversed-reversed sequence of the second half thereof, as is well known in the art.

VGR3185 folded precursor RNA is naturally processed by cellular enzymatic activity into at least 8 separate VGAM precursor RNAs, VGAM2125 precursor RNA, VGAM2126 precursor RNA, VGAM2127 precursor RNA, VGAM2128 precursor RNA, VGAM2129 precursor RNA, VGAM2130 precursor RNA, VGAM2131 precursor RNA and VGAM2132 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2125 RNA, VGAM2126 RNA, VGAM2127 RNA, VGAM2128 RNA, VGAM2129 RNA, VGAM2130 RNA, VGAM2131 RNA and VGAM2132 RNA, herein schematically represented by VGAM1 RNA through VGAM3 RNA, each of which VGAM RNAs corresponding to VGAM RNA of FIG. 1.

VGAM2125 RNA, herein schematically represented by VGAM1 RNA through VGAM3 RNA, binds complementarily to a host target binding site located in an untranslated region of VGAM2125 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM2125 host target RNA into VGAM2125 host target protein, herein schematically represented by VGAM1 HOST TARGET PROTEIN through VGAM3 HOST TARGET PROTEIN, all of FIG. 1.

VGAM2126 RNA, herein schematically represented by VGAM1 RNA through VGAM3 RNA, binds complementarily to a host target binding site located in an untranslated region of VGAM2126 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2126 host target RNA into VGAM2126 host target protein, herein schematically represented by VGAM1 HOST TARGET PROTEIN through VGAM3 HOST TARGET PROTEIN, all of FIG. 1.

VGAM2127 RNA, herein schematically represented by VGAM1 RNA through VGAM3 RNA, binds complementarily to a host target binding site located in an untranslated region of VGAM2127 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2127 host target RNA into VGAM2127 host target protein, herein schematically represented by VGAM1 HOST TARGET PROTEIN through VGAM3 HOST TARGET PROTEIN, all of FIG. 1.

VGAM2128 RNA, herein schematically represented by VGAM1 RNA through VGAM3 RNA, binds complementarily to a host target binding site located in an untranslated region of VGAM2128 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2128 host target RNA into VGAM2128 host target protein, herein schematically represented by VGAM1 HOST TARGET PROTEIN through VGAM3 HOST TARGET PROTEIN, all of FIG. 1.

VGAM2129 RNA, herein schematically represented by VGAM1 RNA through VGAM3 RNA, binds complementarily to a host target binding site located in an untranslated region of VGAM2129 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2129 host target RNA into VGAM2129 host target protein, herein schematically represented by VGAM1 HOST TARGET PROTEIN through VGAM3 HOST TARGET PROTEIN, all of FIG. 1.

VGAM2130 RNA, herein schematically represented by VGAM1 RNA through VGAM3 RNA, binds complementarily to a host target binding site located in an untranslated region of VGAM2130 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2130 host target RNA into VGAM2130 host target protein, herein schematically represented by VGAM1 HOST TARGET PROTEIN through VGAM3 HOST TARGET PROTEIN, all of FIG. 1.

VGAM2131 RNA, herein schematically represented by VGAM1 RNA through VGAM3 RNA, binds complementarily to a host target binding site located in an untranslated region of VGAM2131 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2131 host target RNA into VGAM2131 host target protein, herein schematically represented by VGAM1 HOST TARGET PROTEIN through VGAM3 HOST TARGET PROTEIN, all of FIG. 1.

VGAM2132 RNA, herein schematically represented by VGAM1 RNA through VGAM3 RNA, binds complementarily to a host target binding site located in an untranslated region of VGAM2132 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2132 host target RNA into VGAM2132 host target protein, herein schematically represented by VGAM1 HOST TARGET PROTEIN through VGAM3 HOST TARGET PROTEIN, all of FIG. 1.

It is appreciated that a function of VGR3185 gene, herein designated VGR GENE, is inhibition of expression of host target genes, as part of a novel viral mechanism of attacking a host. Accordingly, utilities of VGR3185 gene include diagnosis, prevention and treatment of viral infection by Ateline Herpesvirus 3. Specific functions, and accordingly utilities, of VGR3185 gene correlate with, and may be deduced from, the identity of the host target genes, which are inhibited by VGAM RNAs comprised in the 'operon-like' cluster of VGR3185 gene: VGAM2125 host target protein, VGAM2126 host target protein, VGAM2127 host target protein, VGAM2128 host target protein, VGAM2129 host target protein, VGAM2130 host target protein, VGAM2131 host target protein and VGAM2132 host target protein, herein schematically represented by VGAM1 HOST TARGET PROTEIN through VGAM3 HOST TARGET PROTEIN. The function of these host target genes is elaborated hereinabove with reference to VGAM2125, VGAM2126, VGAM2127, VGAM2128, VGAM2129, VGAM2130, VGAM2131 and VGAM2132. FIG. 9 further provides a conceptual description of novel bioinformatically detected regulatory viral gene, referred to here as Viral Genomic Record 3186(VGR3186) viral gene, which encodes an 'operon-like' cluster of novel viral micro RNA-like genes, each of which in turn modulates expression of at least one host target gene, the function and utility of which at least one host target gene is known in the art.

VGR3186 gene, herein designated VGR GENE, is a novel bioinformatically detected regulatory, non protein coding, RNA viral gene. The method by which VGR3186 gene was detected is described hereinabove with reference to FIGS. 1-9.

VGR3186 gene encodes VGR3186 precursor RNA, herein designated VGR PRECURSOR RNA, an RNA molecule, typically several hundred nucleotides long.

VGR3186 precursor RNA folds spatially, forming VGR3186 folded precursor RNA, herein designated VGR FOLDED PRECURSOR RNA. It is appreciated that VGR3186 folded precursor RNA comprises a plurality of what is known in the art as 'hairpin' structures. These 'hairpin' structures are due to the fact that the nucleotide sequence of VGR3186 precursor RNA comprises a plurality of segments, the first half of each such segment having a nucleotide sequence which is at least a partial inversed-reversed sequence of the second half thereof, as is well known in the art.

VGR3186 folded precursor RNA is naturally processed by cellular enzymatic activity into at least 3 separate VGAM precursor RNAs, VGAM2133 precursor RNA, VGAM2134 precursor RNA and VGAM2135 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2133 RNA, VGAM2134 RNA and VGAM2135 RNA, herein schematically represented by VGAM1 RNA through VGAM3 RNA, each of which VGAM RNAs corresponding to VGAM RNA of FIG. 1.

VGAM2133 RNA, herein schematically represented by VGAM1 RNA through VGAM3 RNA, binds complementarily to a host target binding site located in an untranslated region of VGAM2133 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2133 host target RNA into VGAM2133 host target protein, herein schematically represented by VGAM1 HOST TARGET PROTEIN through VGAM3 HOST TARGET PROTEIN, all of FIG. 1.

VGAM2134 RNA, herein schematically represented by VGAM1 RNA through VGAM3 RNA, binds complementarily to a host target binding site located in an untranslated region of VGAM2134 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2134 host target RNA into VGAM2134 host target protein, herein schematically represented by VGAM1 HOST TARGET PROTEIN through VGAM3 HOST TARGET PROTEIN, all of FIG. 1.

VGAM2135 RNA, herein schematically represented by VGAM1 RNA through VGAM3 RNA, binds complementarily to a host target binding site located in an untranslated region of VGAM2135 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2135 host target RNA into VGAM2135 host target protein, herein schematically represented by VGAM1 HOST TARGET PROTEIN through VGAM3 HOST TARGET PROTEIN, all of FIG. 1.

It is appreciated that a function of VGR3186 gene, herein designated VGR GENE, is inhibition of expression of host target genes, as part of a novel viral mechanism of attacking a host. Accordingly, utilities of VGR3186 gene include diagnosis, prevention and treatment of viral infection by Ateline Herpesvirus 3. Specific functions, and accordingly utilities, of VGR3186 gene correlate with, and may be deduced from, the identity of the host target genes, which are inhibited by VGAM RNAs comprised in the 'operon-like' cluster of VGR3186 gene: VGAM2133 host target protein, VGAM2134 host target protein and VGAM2135 host target protein, herein schematically represented by VGAM1 HOST TARGET PROTEIN through VGAM3 HOST TARGET PROTEIN. The function of these host target genes is elaborated hereinabove with reference to VGAM2133, VGAM2134 and VGAM2135. FIG. 9 further provides a conceptual description of novel bioinformatically detected regulatory viral gene, referred to here as Viral Genomic Record 3187(VGR3187) viral gene, which encodes an 'operon-like' cluster of novel viral micro RNA-like genes, each of which in turn modulates expression of at least one host target gene, the function and utility of which at least one host target gene is known in the art.

VGR3187 gene, herein designated VGR GENE, is a novel bioinformatically detected regulatory, non protein coding, RNA viral gene. The method by which VGR3187 gene was detected is described hereinabove with reference to FIGS. 1-9.

VGR3187 gene encodes VGR3187 precursor RNA, herein designated VGR PRECURSOR RNA, an RNA molecule, typically several hundred nucleotides long.

VGR3187 precursor RNA folds spatially, forming VGR3187 folded precursor RNA, herein designated VGR FOLDED PRECURSOR RNA. It is appreciated that VGR3187 folded precursor RNA comprises a plurality of what is known in the art as 'hairpin' structures. These 'hairpin' structures are due to the fact that the nucleotide sequence of VGR3187 precursor RNA comprises a plurality of segments, the first half of each such segment having a nucleotide sequence which is at least a partial inversed-reversed sequence of the second half thereof, as is well known in the art.

VGR3187 folded precursor RNA is naturally processed by cellular enzymatic activity into at least 8 separate VGAM precursor RNAs, VGAM2136 precursor RNA, VGAM2137 precursor RNA, VGAM2138 precursor RNA, VGAM2139 precursor RNA, VGAM2140 precursor RNA, VGAM2141 precursor RNA, VGAM2142 precursor RNA and VGAM2143 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2136 RNA, VGAM2137 RNA, VGAM2138 RNA, VGAM2139 RNA, VGAM2140 RNA, VGAM2141 RNA, VGAM2142 RNA and VGAM2143 RNA, herein schematically represented by VGAM1 RNA through VGAM3 RNA, each of which VGAM RNAs corresponding to VGAM RNA of FIG. 1.

VGAM2136 RNA, herein schematically represented by VGAM1 RNA through VGAM3 RNA, binds complementarily to a host target binding site located in an untranslated region of VGAM2136 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2136 host target RNA into VGAM2136 host target protein, herein schematically represented by VGAM1 HOST TARGET PROTEIN through VGAM3 HOST TARGET PROTEIN, all of FIG. 1.

VGAM2137 RNA, herein schematically represented by VGAM1 RNA through VGAM3 RNA, binds complementarily to a host target binding site located in an untranslated region of VGAM2137 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2137 host target RNA into VGAM2137 host target protein, herein schematically represented by VGAM1 HOST TARGET PROTEIN through VGAM3 HOST TARGET PROTEIN, all of FIG. 1.

VGAM2138 RNA, herein schematically represented by VGAM1 RNA through VGAM3 RNA, binds complementarily to a host target binding site located in an untranslated region of VGAM2138 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2138 host target RNA into VGAM2138 host target protein, herein schematically represented by VGAM1 HOST TARGET PROTEIN through VGAM3 HOST TARGET PROTEIN, all of FIG. 1.

VGAM2139 RNA, herein schematically represented by VGAM1 RNA through VGAM3 RNA, binds complementarily to a host target binding site located in an untranslated region of VGAM2139 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2139 host target RNA into VGAM2139 host target protein, herein schematically represented by VGAM1 HOST TARGET PROTEIN through VGAM3 HOST TARGET PROTEIN, all of FIG. 1.

VGAM2140 RNA, herein schematically represented by VGAM1 RNA through VGAM3 RNA, binds complementarily to a host target binding site located in an untranslated region of VGAM2140 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2140 host target RNA into VGAM2140 host target protein, herein schematically represented by VGAM1 HOST TARGET PROTEIN through VGAM3 HOST TARGET PROTEIN, all of FIG. 1.

VGAM2141 RNA, herein schematically represented by VGAM1 RNA through VGAM3 RNA, binds complementarily to a host target binding site located in an untranslated region of VGAM2141 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2141 host target RNA into VGAM2141 host target protein, herein schematically represented by VGAM1 HOST TARGET PROTEIN through VGAM3 HOST TARGET PROTEIN, all of FIG. 1.

VGAM2142 RNA, herein schematically represented by VGAM1 RNA through VGAM3 RNA, binds complementarily to a host target binding site located in an untranslated region of VGAM2142 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2142 host target RNA into VGAM2142 host target protein, herein schematically represented by VGAM1 HOST TARGET PROTEIN through VGAM3 HOST TARGET PROTEIN, all of FIG. 1.

VGAM2143 RNA, herein schematically represented by VGAM1 RNA through VGAM3 RNA, binds complementarily to a host target binding site located in an untranslated region of VGAM2143 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2143 host target RNA into VGAM2143 host target protein, herein schematically represented by VGAM1 HOST TARGET PROTEIN through VGAM3 HOST TARGET PROTEIN, all of FIG. 1.

It is appreciated that a function of VGR3187 gene, herein designated VGR GENE, is inhibition of expression of host target genes, as part of a novel viral mechanism of attacking a host. Accordingly, utilities of VGR3187 gene include diagnosis, prevention and treatment of viral infection by Ectromelia Virus. Specific functions, and accordingly utilities, of VGR3187 gene correlate with, and may be deduced from, the identity of the host target genes, which are inhibited by VGAM RNAs comprised in the 'operon-like' cluster of VGR3187 gene: VGAM2136 host target protein, VGAM2137 host target protein, VGAM2138 host target protein, VGAM2139 host target protein, VGAM2140 host target protein, VGAM2141 host target protein, VGAM2142 host target protein and VGAM2143 host target protein, herein schematically represented by VGAM1 HOST TARGET PROTEIN through VGAM3 HOST TARGET PROTEIN. The function of these host target genes is elaborated hereinabove with reference to VGAM2136, VGAM2137, VGAM2138, VGAM2139, VGAM2140, VGAM2141, VGAM2142 and VGAM2143. FIG. 9 further provides a conceptual description of novel bioinformatically detected regulatory viral gene, referred to here as Viral Genomic Record 3188(VGR3188) viral gene, which encodes an 'operon-like' cluster of novel viral micro RNA-like genes, each of which in turn modulates expression of at least one host target gene, the function and utility of which at least one host target gene is known in the art.

VGR3188 gene, herein designated VGR GENE, is a novel bioinformatically detected regulatory, non protein coding, RNA viral gene. The method by which VGR3188 gene was detected is described hereinabove with reference to FIGS. 1-9.

VGR3188 gene encodes VGR3188 precursor RNA, herein designated VGR PRECURSOR RNA, an RNA molecule, typically several hundred nucleotides long.

VGR3188 precursor RNA folds spatially, forming VGR3188 folded precursor RNA, herein designated VGR FOLDED PRECURSOR RNA. It is appreciated that VGR3188 folded precursor RNA comprises a plurality of what is known in the art as 'hairpin' structures. These 'hairpin' structures are due to the fact that the nucleotide sequence of VGR3188 precursor RNA comprises a plurality of segments, the first half of each such segment having a nucleotide sequence which is at least a partial inversed-reversed sequence of the second half thereof, as is well known in the art.

VGR3188 folded precursor RNA is naturally processed by cellular enzymatic activity into at least 2 separate VGAM precursor RNAs, VGAM2144 precursor RNA and VGAM2145 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2144 RNA and VGAM2145 RNA, herein schematically represented by VGAM1 RNA through VGAM3 RNA, each of which VGAM RNAs corresponding to VGAM RNA of FIG. 1.

VGAM2144 RNA, herein schematically represented by VGAM1 RNA through VGAM3 RNA, binds complementarily to a host target binding site located in an untranslated region of VGAM2144 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2144 host target RNA into VGAM2144 host target protein, herein schematically represented by VGAM1 HOST TARGET PROTEIN through VGAM3 HOST TARGET PROTEIN, all of FIG. 1.

VGAM2145 RNA, herein schematically represented by VGAM1 RNA through VGAM3 RNA, binds complementarily to a host target binding site located in an untranslated region of VGAM2145 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2145 host target RNA into VGAM2145 host target protein, herein schematically represented by VGAM1 HOST TARGET PROTEIN through VGAM3 HOST TARGET PROTEIN, all of FIG. 1.

It is appreciated that a function of VGR3188 gene, herein designated VGR GENE, is inhibition of expression of host target genes, as part of a novel viral mechanism of attacking a host. Accordingly, utilities of VGR3188 gene include diagnosis, prevention and treatment of viral infection by Ectromelia Virus. Specific functions, and accordingly utilities, of VGR3188 gene correlate with, and may be deduced from, the identity of the host target genes, which are inhibited by VGAM RNAs comprised in the 'operon-like' cluster of VGR3188 gene: VGAM2144 host target protein and VGAM2145 host target protein, herein schematically represented by VGAM1 HOST TARGET PROTEIN through VGAM3 HOST TARGET PROTEIN. The function of these host target genes is elaborated hereinabove with reference to VGAM2144 and VGAM2145. FIG. 9 further provides a conceptual description of novel bioinformatically detected regulatory viral gene, referred to here as Viral Genomic Record 3189(VGR3189) viral gene, which encodes an 'operon-like' cluster of novel viral micro RNA-like genes, each of which in turn modulates expression of at least one host target gene, the function and utility of which at least one host target gene is known in the art.

VGR3189 gene, herein designated VGR GENE, is a novel bioinformatically detected regulatory, non protein coding, RNA viral gene. The method by which VGR3189 gene was detected is described hereinabove with reference to FIGS. 1-9.

VGR3189 gene encodes VGR3189 precursor RNA, herein designated VGR PRECURSOR RNA, an RNA molecule, typically several hundred nucleotides long.

VGR3189 precursor RNA folds spatially, forming VGR3189 folded precursor RNA, herein designated VGR FOLDED PRECURSOR RNA. It is appreciated that VGR3189 folded precursor RNA comprises a plurality of what is known in the art as 'hairpin' structures. These 'hairpin' structures are due to the fact that the nucleotide sequence of VGR3189 precursor RNA comprises a plurality of segments, the first half of each such segment having a nucleotide sequence which is at least a partial inversed-reversed sequence of the second half thereof, as is well known in the art.

VGR3189 folded precursor RNA is naturally processed by cellular enzymatic activity into at least 7 separate VGAM precursor RNAs, VGAM2146 precursor RNA, VGAM2147 precursor RNA, VGAM2148 precursor RNA, VGAM2149 precursor RNA, VGAM2150 precursor RNA, VGAM2151 precursor RNA and VGAM2152 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2146 RNA, VGAM2147 RNA, VGAM2148 RNA, VGAM2149 RNA, VGAM2150 RNA, VGAM2151 RNA and VGAM2152 RNA, herein schematically represented by VGAM1 RNA through VGAM3 RNA, each of which VGAM RNAs corresponding to VGAM RNA of FIG. 1.

VGAM2146 RNA, herein schematically represented by VGAM1 RNA through VGAM3 RNA, binds complementarily to a host target binding site located in an untranslated region of VGAM2146 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2146 host target RNA into VGAM2146 host target protein, herein schematically represented by VGAM1 HOST TARGET PROTEIN through VGAM3 HOST TARGET PROTEIN, all of FIG. 1.

VGAM2147 RNA, herein schematically represented by VGAM1 RNA through VGAM3 RNA, binds complementarily to a host target binding site located in an untranslated region of VGAM2147 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2147 host target RNA into VGAM2147 host target protein, herein schematically represented by VGAM1 HOST TARGET PROTEIN through VGAM3 HOST TARGET PROTEIN, all of FIG. 1.

VGAM2148 RNA, herein schematically represented by VGAM1 RNA through VGAM3 RNA, binds complementarily to a host target binding site located in an untranslated region of VGAM2148 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2148 host target RNA into VGAM2148 host target protein, herein schematically represented by VGAM1 HOST TARGET PROTEIN through VGAM3 HOST TARGET PROTEIN, all of FIG. 1.

VGAM2149 RNA, herein schematically represented by VGAM1 RNA through VGAM3 RNA, binds complementarily to a host target binding site located in an untranslated region of VGAM2149 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2149 host target RNA into VGAM2149 host target protein, herein schematically represented by VGAM1 HOST TARGET PROTEIN through VGAM3 HOST TARGET PROTEIN, all of FIG. 1.

VGAM2150 RNA, herein schematically represented by VGAM1 RNA through VGAM3 RNA, binds complementarily to a host target binding site located in an untranslated region of VGAM2150 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2150 host target RNA into VGAM2150 host target protein, herein schematically represented by VGAM1 HOST TARGET PROTEIN through VGAM3 HOST TARGET PROTEIN, all of FIG. 1.

VGAM2151 RNA, herein schematically represented by VGAM1 RNA through VGAM3 RNA, binds complementarily to a host target binding site located in an untranslated region of VGAM2151 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2151 host target RNA into VGAM2151 host target protein, herein schematically represented by VGAM1 HOST TARGET PROTEIN through VGAM3 HOST TARGET PROTEIN, all of FIG. 1.

VGAM2152 RNA, herein schematically represented by VGAM1 RNA through VGAM3 RNA, binds complementarily to a host target binding site located in an untranslated region of VGAM2152 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2152 host target RNA into VGAM2152 host target protein, herein schematically represented by VGAM1 HOST TARGET PROTEIN through VGAM3 HOST TARGET PROTEIN, all of FIG. 1.

It is appreciated that a function of VGR3189 gene, herein designated VGR GENE, is inhibition of expression of host target genes, as part of a novel viral mechanism of attacking a host. Accordingly, utilities of VGR3189 gene include diagnosis, prevention and treatment of viral infection by Rana Tigrina Ranavirus. Specific functions, and accordingly utilities, of VGR3189 gene correlate with, and may be deduced from, the identity of the host target genes, which are inhibited by VGAM RNAs comprised in the 'operon-like' cluster of VGR3189 gene: VGAM2146 host target protein, VGAM2147 host target protein, VGAM2148 host target protein, VGAM2149 host target protein, VGAM2150 host target protein, VGAM2151 host target protein and VGAM2152 host target protein, herein schematically represented by VGAM1 HOST TARGET PROTEIN through VGAM3 HOST TARGET PROTEIN. The function of these host target genes is elaborated hereinabove with reference to VGAM2146, VGAM2147, VGAM2148, VGAM2149, VGAM2150, VGAM2151 and VGAM2152. FIG. 9 further provides a conceptual description of novel bioinformatically detected regulatory viral gene, referred to here as Viral Genomic Record 3190(VGR3190) viral gene, which encodes an 'operon-like' cluster of novel viral micro RNA-like genes, each of which in turn modulates expression of at least one host target gene, the function and utility of which at least one host target gene is known in the art.

VGR3190 gene, herein designated VGR GENE, is a novel bioinformatically detected regulatory, non protein coding, RNA viral gene. The method by which VGR3190 gene was detected is described hereinabove with reference to FIGS. 1-9.

VGR3190 gene encodes VGR3190 precursor RNA, herein designated VGR PRECURSOR RNA, an RNA molecule, typically several hundred nucleotides long.

VGR3190 precursor RNA folds spatially, forming VGR3190 folded precursor RNA, herein designated VGR FOLDED PRECURSOR RNA. It is appreciated that VGR3190 folded precursor RNA comprises a plurality of what is known in the art as 'hairpin' structures. These 'hairpin' structures are due to the fact that the nucleotide sequence of VGR3190 precursor RNA comprises a plurality of segments, the first half of each such segment having a nucleotide sequence which is at least a partial inversed-reversed sequence of the second half thereof, as is well known in the art.

VGR3190 folded precursor RNA is naturally processed by cellular enzymatic activity into at least 2 separate VGAM precursor RNAs, VGAM2153 precursor RNA and VGAM2154 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2153 RNA and VGAM2154 RNA, herein schematically represented by VGAM1 RNA through VGAM3 RNA, each of which VGAM RNAs corresponding to VGAM RNA of FIG. 1.

VGAM2153 RNA, herein schematically represented by VGAM1 RNA through VGAM3 RNA, binds complementarily to a host target binding site located in an untranslated region of VGAM2153 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2153 host target RNA into VGAM2153 host target protein, herein schematically represented by VGAM1 HOST TARGET PROTEIN through VGAM3 HOST TARGET PROTEIN, all of FIG. 1.

VGAM2154 RNA, herein schematically represented by VGAM1 RNA through VGAM3 RNA, binds complementarily to a host target binding site located in an untranslated region of VGAM2154 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2154 host target RNA into VGAM2154 host target protein, herein schematically represented by VGAM1 HOST TARGET PROTEIN through VGAM3 HOST TARGET PROTEIN, all of FIG. 1.

It is appreciated that a function of VGR3190 gene, herein designated VGR GENE, is inhibition of expression of host target genes, as part of a novel viral mechanism of attacking a host. Accordingly, utilities of VGR3190 gene include diagnosis, prevention and treatment of viral infection by Rana Tigrina Ranavirus. Specific functions, and accordingly utilities, of VGR3190 gene correlate with, and may be deduced from, the identity of the host target genes, which are inhibited by VGAM RNAs comprised in the 'operon-like' cluster of VGR3190 gene: VGAM2153 host target protein and VGAM2154 host target protein, herein schematically represented by VGAM1 HOST TARGET PROTEIN through VGAM3 HOST TARGET PROTEIN. The function of these host target genes is elaborated hereinabove with reference to VGAM2153 and VGAM2154. FIG. 9 further provides a conceptual description of novel bioinformatically detected regulatory viral gene, referred to here as Viral Genomic Record 3191(VGR3191) viral gene, which encodes an 'operon-like' cluster of novel viral micro RNA-like genes, each of which in turn modulates expression of at least one host target gene, the function and utility of which at least one host target gene is known in the art.

VGR3191 gene, herein designated VGR GENE, is a novel bioinformatically detected regulatory, non protein coding, RNA viral gene. The method by which VGR3191 gene was detected is described hereinabove with reference to FIGS. 1-9.

VGR3191 gene encodes VGR3191 precursor RNA, herein designated VGR PRECURSOR RNA, an RNA molecule, typically several hundred nucleotides long.

VGR3191 precursor RNA folds spatially, forming VGR3191 folded precursor RNA, herein designated VGR FOLDED PRECURSOR RNA. It is appreciated that VGR3191 folded precursor RNA comprises a plurality of what is known in the art as 'hairpin' structures. These 'hairpin' structures are due to the fact that the nucleotide sequence of VGR3191 precursor RNA comprises a plurality of segments, the first half of each such segment having a nucleotide sequence which is at least a partial inversed-reversed sequence of the second half thereof, as is well known in the art.

VGR3191 folded precursor RNA is naturally processed by cellular enzymatic activity into at least 6 separate VGAM precursor RNAs, VGAM2155 precursor RNA, VGAM2156 precursor RNA, VGAM2157 precursor RNA, VGAM2158 precursor RNA, VGAM2159 precursor RNA and VGAM2160 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2155 RNA, VGAM2156 RNA, VGAM2157 RNA, VGAM2158 RNA, VGAM2159 RNA and VGAM2160 RNA, herein schematically represented by VGAM1 RNA through VGAM3 RNA, each of which VGAM RNAs corresponding to VGAM RNA of FIG. 1.

VGAM2155 RNA, herein schematically represented by VGAM1 RNA through VGAM3 RNA, binds complementarily to a host target binding site located in an untranslated region of VGAM2155 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2155 host target RNA into VGAM2155 host target protein, herein schematically represented by VGAM1 HOST TARGET PROTEIN through VGAM3 HOST TARGET PROTEIN, all of FIG. 1.

VGAM2156 RNA, herein schematically represented by VGAM1 RNA through VGAM3 RNA, binds complementarily to a host target binding site located in an untranslated region of VGAM2156 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2156 host target RNA into VGAM2156 host target protein, herein schematically represented by VGAM1 HOST TARGET PROTEIN through VGAM3 HOST TARGET PROTEIN, all of FIG. 1.

VGAM2157 RNA, herein schematically represented by VGAM1 RNA through VGAM3 RNA, binds complementarily to a host target binding site located in an untranslated region of VGAM2157 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2157 host target RNA into VGAM2157 host target protein, herein schematically represented by VGAM1 HOST TARGET PROTEIN through VGAM3 HOST TARGET PROTEIN, all of FIG. 1.

VGAM2158 RNA, herein schematically represented by VGAM1 RNA through VGAM3 RNA, binds complementarily to a host target binding site located in an untranslated region of VGAM2158 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2158 host target RNA into VGAM2158 host target protein, herein schematically represented by VGAM1 HOST TARGET PROTEIN through VGAM3 HOST TARGET PROTEIN, all of FIG. 1.

VGAM2159 RNA, herein schematically represented by VGAM1 RNA through VGAM3 RNA, binds complementarily to a host target binding site located in an untranslated region of VGAM2159 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2159 host target RNA into VGAM2159 host target protein, herein schematically represented by VGAM1 HOST TARGET PROTEIN through VGAM3 HOST TARGET PROTEIN, all of FIG. 1.

VGAM2160 RNA, herein schematically represented by VGAM1 RNA through VGAM3 RNA, binds complementarily to a host target binding site located in an untranslated region of VGAM2160 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2160 host target RNA into VGAM2160 host target protein, herein schematically represented by VGAM1 HOST TARGET PROTEIN through VGAM3 HOST TARGET PROTEIN, all of FIG. 1.

It is appreciated that a function of VGR3191 gene, herein designated VGR GENE, is inhibition of expression of host target genes, as part of a novel viral mechanism of attacking a host. Accordingly, utilities of VGR3191 gene include diagnosis, prevention and treatment of viral infection by Monkeypox Virus. Specific functions, and accordingly utilities, of VGR3191 gene correlate with, and may be deduced from, the identity of the host target genes, which are inhibited by VGAM RNAs comprised in the 'operon-like' cluster of VGR3191 gene: VGAM2155 host target protein, VGAM2156 host target protein, VGAM2157 host target protein, VGAM2158 host target protein, VGAM2159 host target protein and VGAM2160 host target protein, herein schematically represented by VGAM1 HOST TARGET PROTEIN through VGAM3 HOST TARGET PROTEIN. The function of these host target genes is elaborated hereinabove with reference to VGAM2155, VGAM2156, VGAM2157, VGAM2158, VGAM2159 and VGAM2160. FIG. 9 further provides a conceptual description of novel bioinformatically detected regulatory viral gene, referred to here as Viral Genomic Record 3192(VGR3192) viral gene, which encodes an 'operon-like' cluster of novel viral micro RNA-like genes, each of which in turn modulates expression of at least one host target gene, the function and utility of which at least one host target gene is known in the art.

VGR3192 gene, herein designated VGR GENE, is a novel bioinformatically detected regulatory, non protein coding, RNA viral gene. The method by which VGR3192 gene was detected is described hereinabove with reference to FIGS. 1-9.

VGR3192 gene encodes VGR3192 precursor RNA, herein designated VGR PRECURSOR RNA, an RNA molecule, typically several hundred nucleotides long.

VGR3192 precursor RNA folds spatially, forming VGR3192 folded precursor RNA, herein designated VGR FOLDED PRECURSOR RNA. It is appreciated that VGR3192 folded precursor RNA comprises a plurality of what is known in the art as 'hairpin' structures. These 'hairpin' structures are due to the fact that the nucleotide sequence of VGR3192 precursor RNA comprises a plurality of segments, the first half of each such segment having a nucleotide sequence which is at least a partial inversed-reversed sequence of the second half thereof, as is well known in the art.

VGR3192 folded precursor RNA is naturally processed by cellular enzymatic activity into at least 8 separate VGAM precursor RNAs, VGAM2161 precursor RNA, VGAM2162 precursor RNA, VGAM2163 precursor RNA, VGAM2164 precursor RNA, VGAM2165 precursor RNA, VGAM2166 precursor RNA, VGAM2167 precursor RNA and VGAM2168 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2161 RNA, VGAM2162 RNA, VGAM2163 RNA, VGAM2164 RNA, VGAM2165 RNA, VGAM2166 RNA, VGAM2167 RNA and VGAM2168 RNA, herein schematically represented by VGAM1 RNA through VGAM3 RNA, each of which VGAM RNAs corresponding to VGAM RNA of FIG. 1.

VGAM2161 RNA, herein schematically represented by VGAM1 RNA through VGAM3 RNA, binds complementarily to a host target binding site located in an untranslated region of VGAM2161 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2161 host target RNA into VGAM2161 host target protein, herein schematically represented by VGAM1 HOST TARGET PROTEIN through VGAM3 HOST TARGET PROTEIN, all of FIG. 1.

VGAM2162 RNA, herein schematically represented by VGAM1 RNA through VGAM3 RNA, binds complementarily to a host target binding site located in an untranslated region of VGAM2162 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2162 host target RNA into VGAM2162 host target protein, herein schematically represented by VGAM1 HOST TARGET PROTEIN through VGAM3 HOST TARGET PROTEIN, all of FIG. 1.

VGAM2163 RNA, herein schematically represented by VGAM1 RNA through VGAM3 RNA, binds complementarily to a host target binding site located in an untranslated region of VGAM2163 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2163 host target RNA into VGAM2163 host target protein, herein schematically represented by VGAM1 HOST TARGET PROTEIN through VGAM3 HOST TARGET PROTEIN, all of FIG. 1.

VGAM2164 RNA, herein schematically represented by VGAM1 RNA through VGAM3 RNA, binds complementarily to a host target binding site located in an untranslated region of VGAM2164 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2164 host target RNA into VGAM2164 host target protein, herein schematically represented by VGAM1 HOST TARGET PROTEIN through VGAM3 HOST TARGET PROTEIN, all of FIG. 1.

VGAM2165 RNA, herein schematically represented by VGAM1 RNA through VGAM3 RNA, binds complementarily to a host target binding site located in an untranslated region of VGAM2165 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2165 host target RNA into VGAM2165 host target protein, herein schematically represented by VGAM1 HOST TARGET PROTEIN through VGAM3 HOST TARGET PROTEIN, all of FIG. 1.

VGAM2166 RNA, herein schematically represented by VGAM1 RNA through VGAM3 RNA, binds complementarily to a host target binding site located in an untranslated region of VGAM2166 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2166 host target RNA into VGAM2166 host target protein, herein schematically represented by VGAM1 HOST TARGET PROTEIN through VGAM3 HOST TARGET PROTEIN, all of FIG. 1.

VGAM2167 RNA, herein schematically represented by VGAM1 RNA through VGAM3 RNA, binds complementarily to a host target binding site located in an untranslated region of VGAM2167 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2167 host target RNA into VGAM2167 host target protein, herein schematically represented by VGAM1 HOST TARGET PROTEIN through VGAM3 HOST TARGET PROTEIN, all of FIG. 1.

VGAM2168 RNA, herein schematically represented by VGAM1 RNA through VGAM3 RNA, binds complementarily to a host target binding site located in an untranslated region of VGAM2168 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2168 host target RNA into VGAM2168 host target protein, herein schematically represented by VGAM1 HOST TARGET PROTEIN through VGAM3 HOST TARGET PROTEIN, all of FIG. 1.

It is appreciated that a function of VGR3192 gene, herein designated VGR GENE, is inhibition of expression of host target genes, as part of a novel viral mechanism of attacking a host. Accordingly, utilities of VGR3192 gene include diagnosis, prevention and treatment of viral infection by Camelpox Virus. Specific functions, and accordingly utilities, of VGR3192 gene correlate with, and may be deduced from, the identity of the host target genes, which are inhibited by VGAM RNAs comprised in the 'operon-like' cluster of VGR3192 gene: VGAM2161 host target protein, VGAM2162 host target protein, VGAM2163 host target protein, VGAM2164 host target protein, VGAM2165 host target protein, VGAM2166 host target protein, VGAM2167 host target protein and VGAM2168 host target protein, herein schematically represented by VGAM1 HOST TARGET PROTEIN through VGAM3 HOST TARGET PROTEIN. The function of these host target genes is elaborated hereinabove with reference to VGAM2161, VGAM2162, VGAM2163, VGAM2164, VGAM2165, VGAM2166, VGAM2167 and VGAM2168. FIG. 9 further provides a conceptual description of novel bioinformatically detected regulatory viral gene, referred to here as Viral Genomic Record 3193(VGR3193) viral gene, which encodes an 'operon-like' cluster of novel viral micro RNA-like genes, each of which in turn modulates expression of at least one host target gene, the function and utility of which at least one host target gene is known in the art.

VGR3193 gene, herein designated VGR GENE, is a novel bioinformatically detected regulatory, non protein coding, RNA viral gene. The method by which VGR3193 gene was detected is described hereinabove with reference to FIGS. 1-9.

VGR3193 gene encodes VGR3193 precursor RNA, herein designated VGR PRECURSOR RNA, an RNA molecule, typically several hundred nucleotides long.

VGR3193 precursor RNA folds spatially, forming VGR3193 folded precursor RNA, herein designated VGR FOLDED PRECURSOR RNA. It is appreciated that VGR3193 folded precursor RNA comprises a plurality of what is known in the art as 'hairpin' structures. These 'hairpin' structures are due to the fact that the nucleotide sequence of VGR3193 precursor RNA comprises a plurality of segments, the first half of each such segment having a nucleotide sequence which is at least a partial inversed-reversed sequence of the second half thereof, as is well known in the art.

VGR3193 folded precursor RNA is naturally processed by cellular enzymatic activity into at least 5 separate VGAM precursor RNAs, VGAM2169 precursor RNA, VGAM2170 precursor RNA, VGAM2171 precursor RNA, VGAM2172 precursor RNA and VGAM2173 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2169 RNA, VGAM2170 RNA, VGAM2171 RNA, VGAM2172 RNA and VGAM2173 RNA, herein schematically represented by VGAM1 RNA through VGAM3 RNA, each of which VGAM RNAs corresponding to VGAM RNA of FIG. 1.

VGAM2169 RNA, herein schematically represented by VGAM1 RNA through VGAM3 RNA, binds complementarily to a host target binding site located in an untranslated region of VGAM2169 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2169 host target RNA into VGAM2169 host target protein, herein schematically represented by VGAM1 HOST TARGET PROTEIN through VGAM3 HOST TARGET PROTEIN, all of FIG. 1.

VGAM2170 RNA, herein schematically represented by VGAM1 RNA through VGAM3 RNA, binds complementarily to a host target binding site located in an untranslated region of VGAM2170 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2170 host target RNA into VGAM2170 host target protein, herein schematically represented by VGAM1 HOST TARGET PROTEIN through VGAM3 HOST TARGET PROTEIN, all of FIG. 1.

VGAM2171 RNA, herein schematically represented by VGAM1 RNA through VGAM3 RNA, binds complementarily to a host target binding site located in an untranslated region of VGAM2171 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2171 host target RNA into VGAM2171 host target protein, herein schematically represented by VGAM1 HOST TARGET PROTEIN through VGAM3 HOST TARGET PROTEIN, all of FIG. 1.

VGAM2172 RNA, herein schematically represented by VGAM1 RNA through VGAM3 RNA, binds complementarily to a host target binding site located in an untranslated region of VGAM2172 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2172 host target RNA into VGAM2172 host target protein, herein schematically represented by VGAM1 HOST TARGET PROTEIN through VGAM3 HOST TARGET PROTEIN, all of FIG. 1.

VGAM2173 RNA, herein schematically represented by VGAM1 RNA through VGAM3 RNA, binds complementarily to a host target binding site located in an untranslated region of VGAM2173 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2173 host target RNA into VGAM2173 host target protein, herein schematically represented by VGAM1 HOST TARGET PROTEIN through VGAM3 HOST TARGET PROTEIN, all of FIG. 1.

It is appreciated that a function of VGR3193 gene, herein designated VGR GENE, is inhibition of expression of host target genes, as part of a novel viral mechanism of attacking a host. Accordingly, utilities of VGR3193 gene include diagnosis, prevention and treatment of viral infection by Camelpox Virus. Specific functions, and accordingly utilities, of VGR3193 gene correlate with, and may be deduced from, the identity of the host target genes, which are inhibited by VGAM RNAs comprised in the 'operon-like' cluster of VGR3193 gene: VGAM2169 host target protein, VGAM2170 host target protein, VGAM2171 host target protein, VGAM2172 host target protein and VGAM2173 host target protein, herein schematically represented by VGAM1 HOST TARGET PROTEIN through VGAM3 HOST TARGET PROTEIN. The function of these host target genes is elaborated hereinabove with reference to VGAM2169, VGAM2170, VGAM2171, VGAM2172 and VGAM2173.

FIG. 9 further provides a conceptual description of novel bioinformatically detected regulatory viral gene, referred to here as Viral Genomic Record 3194(VGR3194) viral gene, which encodes an 'operon-like' cluster of novel viral micro RNA-like genes, each of which in turn modulates expression of at least one host target gene, the function and utility of which at least one host target gene is known in the art.

VGR3194 gene, herein designated VGR GENE, is a novel bioinformatically detected regulatory, non protein coding, RNA viral gene. The method by which VGR3194 gene was detected is described hereinabove with reference to FIGS. 1-9.

VGR3194 gene encodes VGR3194 precursor RNA, herein designated VGR PRECURSOR RNA, an RNA molecule, typically several hundred nucleotides long.

VGR3194 precursor RNA folds spatially, forming VGR3194 folded precursor RNA, herein designated VGR FOLDED PRECURSOR RNA. It is appreciated that VGR3194 folded precursor RNA comprises a plurality of what is known in the art as 'hairpin' structures. These 'hairpin' structures are due to the fact that the nucleotide sequence of VGR3194 precursor RNA comprises a plurality of segments, the first half of each such segment having a nucleotide sequence which is at least a partial inversed-reversed sequence of the second half thereof, as is well known in the art.

VGR3194 folded precursor RNA is naturally processed by cellular enzymatic activity into at least 6 separate VGAM precursor RNAs, VGAM2174 precursor RNA, VGAM2175 precursor RNA, VGAM2176 precursor RNA, VGAM2177 precursor RNA, VGAM2178 precursor RNA and VGAM2179 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2174 RNA, VGAM2175 RNA, VGAM2176 RNA, VGAM2177 RNA, VGAM2178 RNA and VGAM2179 RNA, herein schematically represented by VGAM1 RNA through VGAM3 RNA, each of which VGAM RNAs corresponding to VGAM RNA of FIG. 1.

VGAM2174 RNA, herein schematically represented by VGAM1 RNA through VGAM3 RNA, binds complementarily to a host target binding site located in an untranslated region of VGAM2174 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2174 host target RNA into VGAM2174 host target protein, herein schematically represented by VGAM1 HOST TARGET PROTEIN through VGAM3 HOST TARGET PROTEIN, all of FIG. 1.

VGAM2175 RNA, herein schematically represented by VGAM1 RNA through VGAM3 RNA, binds complementarily to a host target binding site located in an untranslated region of VGAM2175 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2175 host target RNA into VGAM2175 host target protein, herein schematically represented by VGAM1 HOST TARGET PROTEIN through VGAM3 HOST TARGET PROTEIN, all of FIG. 1.

VGAM2176 RNA, herein schematically represented by VGAM1 RNA through VGAM3 RNA, binds complementarily to a host target binding site located in an untranslated region of VGAM2176 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2176 host target RNA into VGAM2176 host target protein, herein schematically represented by VGAM1 HOST TARGET PROTEIN through VGAM3 HOST TARGET PROTEIN, all of FIG. 1.

VGAM2177 RNA, herein schematically represented by VGAM1 RNA through VGAM3 RNA, binds complementarily to a host target binding site located in an untranslated region of VGAM2177 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2177 host target RNA into VGAM2177 host target protein, herein schematically represented by VGAM1 HOST TARGET PROTEIN through VGAM3 HOST TARGET PROTEIN, all of FIG. 1.

VGAM2178 RNA, herein schematically represented by VGAM1 RNA through VGAM3 RNA, binds complementarily to a host target binding site located in an untranslated region of VGAM2178 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2178 host target RNA into VGAM2178 host target protein, herein schematically represented by VGAM1 HOST TARGET PROTEIN through VGAM3 HOST TARGET PROTEIN, all of FIG. 1.

VGAM2179 RNA, herein schematically represented by VGAM1 RNA through VGAM3 RNA, binds complementarily to a host target binding site located in an untranslated region of VGAM2179 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2179 host target RNA into VGAM2179 host target protein, herein schematically represented by VGAM1 HOST TARGET PROTEIN through VGAM3 HOST TARGET PROTEIN, all of FIG. 1.

It is appreciated that a function of VGR3194 gene, herein designated VGR GENE, is inhibition of expression of host target genes, as part of a novel viral mechanism of attacking a host. Accordingly, utilities of VGR3194 gene include diagnosis, prevention and treatment of viral infection by Rabbit Fibroma Virus. Specific functions, and accordingly utilities, of VGR3194 gene correlate with, and may be deduced from, the identity of the host target genes, which are inhibited by VGAM RNAs comprised in the 'operon-like' cluster of VGR3194 gene: VGAM2174 host target protein, VGAM2175 host target protein, VGAM2176 host target protein, VGAM2177 host target protein, VGAM2178 host target protein and VGAM2179 host target protein, herein schematically represented by VGAM1 HOST TARGET PROTEIN through VGAM3 HOST TARGET PROTEIN. The function of these host target genes is elaborated hereinabove with reference to VGAM2174, VGAM2175, VGAM2176, VGAM2177, VGAM2178 and VGAM2179. FIG. 9 further provides a conceptual description of novel bioinformatically detected regulatory viral gene, referred to here as Viral Genomic Record 3195(VGR3195) viral gene, which encodes an 'operon-like' cluster of novel viral micro RNA-like genes, each of which in turn modulates expression of at least one host target gene, the function and utility of which at least one host target gene is known in the art.

VGR3195 gene, herein designated VGR GENE, is a novel bioinformatically detected regulatory, non protein coding, RNA viral gene. The method by which VGR3195 gene was detected is described hereinabove with reference to FIGS. 1-9.

VGR3195 gene encodes VGR3195 precursor RNA, herein designated VGR PRECURSOR RNA, an RNA molecule, typically several hundred nucleotides long.

VGR3195 precursor RNA folds spatially, forming VGR3195 folded precursor RNA, herein designated VGR FOLDED PRECURSOR RNA. It is appreciated that VGR3195 folded precursor RNA comprises a plurality of what is known in the art as 'hairpin' structures. These 'hairpin' structures are due to the fact that the nucleotide sequence of VGR3195 precursor RNA comprises a plurality of segments, the first half of each such segment having a nucleotide sequence which is at least a partial inversed-reversed sequence of the second half thereof, as is well known in the art.

VGR3195 folded precursor RNA is naturally processed by cellular enzymatic activity into at least 4 separate VGAM precursor RNAs, VGAM2180 precursor RNA, VGAM2181 precursor RNA, VGAM2182 precursor RNA and VGAM2183 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2180 RNA, VGAM2181 RNA, VGAM2182 RNA and VGAM2183 RNA, herein schematically represented by VGAM1 RNA through VGAM3 RNA, each of which VGAM RNAs corresponding to VGAM RNA of FIG. 1.

VGAM2180 RNA, herein schematically represented by VGAM1 RNA through VGAM3 RNA, binds complementarily to a host target binding site located in an untranslated region of VGAM2180 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2180 host target RNA into VGAM2180 host target protein, herein schematically represented by VGAM1 HOST TARGET PROTEIN through VGAM3 HOST TARGET PROTEIN, all of FIG. 1.

VGAM2181 RNA, herein schematically represented by VGAM1 RNA through VGAM3 RNA, binds complementarily to a host target binding site located in an untranslated region of VGAM2181 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2181 host target RNA into VGAM2181 host target protein, herein schematically represented by VGAM1 HOST TARGET PROTEIN through VGAM3 HOST TARGET PROTEIN, all of FIG. 1.

VGAM2182 RNA, herein schematically represented by VGAM1 RNA through VGAM3 RNA, binds complementarily to a host target binding site located in an untranslated region of VGAM2182 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2182 host target RNA into VGAM2182 host target protein, herein schematically represented by VGAM1 HOST TARGET PROTEIN through VGAM3 HOST TARGET PROTEIN, all of FIG. 1.

VGAM2183 RNA, herein schematically represented by VGAM1 RNA through VGAM3 RNA, binds complementarily to a host target binding site located in an untranslated region of VGAM2183 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2183 host target RNA into VGAM2183 host target protein, herein schematically represented by VGAM1 HOST TARGET PROTEIN through VGAM3 HOST TARGET PROTEIN, all of FIG. 1.

It is appreciated that a function of VGR3195 gene, herein designated VGR GENE, is inhibition of expression of host target genes, as part of a novel viral mechanism of attacking a host. Accordingly, utilities of VGR3195 gene include diagnosis, prevention and treatment of viral infection by Yaba-like Disease Virus. Specific functions, and accordingly utilities, of VGR3195 gene correlate with, and may be deduced from, the identity of the host target genes, which are inhibited by VGAM RNAs comprised in the 'operon-like' cluster of VGR3195 gene: VGAM2180 host target protein, VGAM2181 host target protein, VGAM2182 host target protein and VGAM2183 host target protein, herein schematically represented by VGAM1 HOST TARGET PROTEIN through VGAM3 HOST TARGET PROTEIN. The function of these host target genes is elaborated hereinabove with reference to VGAM2180, VGAM2181, VGAM2182 and VGAM2183. FIG. 9 further provides a conceptual description of novel bioinformatically detected regulatory viral gene, referred to here as Viral Genomic Record 3196(VGR3196) viral gene, which encodes an 'operon-like' cluster of novel viral micro RNA-like genes, each of which in turn modulates expression of at least one host target gene, the function and utility of which at least one host target gene is known in the art.

VGR3196 gene, herein designated VGR GENE, is a novel bioinformatically detected regulatory, non protein coding, RNA viral gene. The method by which VGR3196 gene was detected is described hereinabove with reference to FIGS. 1-9.

VGR3196 gene encodes VGR3196 precursor RNA, herein designated VGR PRECURSOR RNA, an RNA molecule, typically several hundred nucleotides long.

VGR3196 precursor RNA folds spatially, forming VGR3196 folded precursor RNA, herein designated VGR FOLDED PRECURSOR RNA. It is appreciated that VGR3196 folded precursor RNA comprises a plurality of what is known in the art as 'hairpin' structures. These 'hairpin' structures are due to the fact that the nucleotide sequence of VGR3196 precursor RNA comprises a plurality of segments, the first half of each such segment having a nucleotide sequence which is at least a partial inversed-reversed sequence of the second half thereof, as is well known in the art.

VGR3196 folded precursor RNA is naturally processed by cellular enzymatic activity into at least 8 separate VGAM precursor RNAs, VGAM2184 precursor RNA, VGAM2185 precursor RNA, VGAM2186 precursor RNA, VGAM2187 precursor RNA, VGAM2188 precursor RNA, VGAM2189 precursor RNA, VGAM2190 precursor RNA and VGAM2191 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2184 RNA, VGAM2185 RNA, VGAM2186 RNA, VGAM2187 RNA, VGAM2188 RNA, VGAM2189 RNA, VGAM2190 RNA and VGAM2191 RNA, herein schematically represented by VGAM1 RNA through VGAM3 RNA, each of which VGAM RNAs corresponding to VGAM RNA of FIG. 1.

VGAM2184 RNA, herein schematically represented by VGAM1 RNA through VGAM3 RNA, binds complementarily to a host target binding site located in an untranslated region of VGAM2184 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2184 host target RNA into VGAM2184 host target protein, herein schematically represented by VGAM1 HOST TARGET PROTEIN through VGAM3 HOST TARGET PROTEIN, all of FIG. 1.

VGAM2185 RNA, herein schematically represented by VGAM1 RNA through VGAM3 RNA, binds complementarily to a host target binding site located in an untranslated region of VGAM2185 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2185 host target RNA into VGAM2185 host target protein, herein schematically represented by VGAM1 HOST TARGET PROTEIN through VGAM3 HOST TARGET PROTEIN, all of FIG. 1.

VGAM2186 RNA, herein schematically represented by VGAM1 RNA through VGAM3 RNA, binds complementarily to a host target binding site located in an untranslated region of VGAM2186 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2186 host target RNA into VGAM2186 host target protein, herein schematically represented by VGAM1 HOST TARGET PROTEIN through VGAM3 HOST TARGET PROTEIN, all of FIG. 1.

VGAM2187 RNA, herein schematically represented by VGAM1 RNA through VGAM3 RNA, binds complementarily to a host target binding site located in an untranslated region of VGAM2187 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2187 host target RNA into VGAM2187 host target protein, herein schematically represented by VGAM1 HOST TARGET PROTEIN through VGAM3 HOST TARGET PROTEIN, all of FIG. 1.

VGAM2188 RNA, herein schematically represented by VGAM1 RNA through VGAM3 RNA, binds complementarily to a host target binding site located in an untranslated region of VGAM2188 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2188 host target RNA into VGAM2188 host target protein, herein schematically represented by VGAM1 HOST TARGET PROTEIN through VGAM3 HOST TARGET PROTEIN, all of FIG. 1.

VGAM2189 RNA, herein schematically represented by VGAM1 RNA through VGAM3 RNA, binds complementarily to a host target binding site located in an untranslated region of VGAM2189 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2189 host target RNA into VGAM2189 host target protein, herein schematically represented by VGAM1 HOST TARGET PROTEIN through VGAM3 HOST TARGET PROTEIN, all of FIG. 1.

VGAM2190 RNA, herein schematically represented by VGAM1 RNA through VGAM3 RNA, binds complementarily to a host target binding site located in an untranslated region of VGAM2190 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2190 host target RNA into VGAM2190 host target protein, herein schematically represented by VGAM1 HOST TARGET PROTEIN through VGAM3 HOST TARGET PROTEIN, all of FIG. 1.

VGAM2191 RNA, herein schematically represented by VGAM1 RNA through VGAM3 RNA, binds complementarily to a host target binding site located in an untranslated region of VGAM2191 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2191 host target RNA into VGAM2191 host target protein, herein schematically represented by VGAM1 HOST TARGET PROTEIN through VGAM3 HOST TARGET PROTEIN, all of FIG. 1.

It is appreciated that a function of VGR3196 gene, herein designated VGR GENE, is inhibition of expression of host target genes, as part of a novel viral mechanism of attacking a host. Accordingly, utilities of VGR3196 gene include diagnosis, prevention and treatment of viral infection by Monkeypox Virus. Specific functions, and accordingly utilities, of VGR3196 gene correlate with, and may be deduced from, the identity of the host target genes, which are inhibited by VGAM RNAs comprised in the 'operon-like' cluster of VGR3196 gene: VGAM2184 host target protein, VGAM2185 host target protein, VGAM2186 host target protein, VGAM2187 host target protein, VGAM2188 host target protein, VGAM2189 host target protein, VGAM2190 host target protein and VGAM2191 host target protein, herein schematically represented by VGAM1 HOST TARGET PROTEIN through VGAM3 HOST TARGET PROTEIN. The function of these host target genes is elaborated hereinabove with reference to VGAM2184, VGAM2185, VGAM2186, VGAM2187, VGAM2188, VGAM2189, VGAM2190 and VGAM2191. FIG. 9 further provides a conceptual description of novel bioinformatically detected regulatory viral gene, referred to here as Viral Genomic Record 3197(VGR3197) viral gene, which encodes an 'operon-like' cluster of novel viral micro RNA-like genes, each of which in turn modulates expression of at least one host target gene, the function and utility of which at least one host target gene is known in the art.

VGR3197 gene, herein designated VGR GENE, is a novel bioinformatically detected regulatory, non protein coding, RNA viral gene. The method by which VGR3197 gene was detected is described hereinabove with reference to FIGS. 1-9.

VGR3197 gene encodes VGR3197 precursor RNA, herein designated VGR PRECURSOR RNA, an RNA molecule, typically several hundred nucleotides long.

VGR3197 precursor RNA folds spatially, forming VGR3197 folded precursor RNA, herein designated VGR FOLDED PRECURSOR RNA. It is appreciated that VGR3197 folded precursor RNA comprises a plurality of what is known in the art as 'hairpin' structures. These 'hairpin' structures are due to the fact that the nucleotide sequence of VGR3197 precursor RNA comprises a plurality of segments, the first half of each such segment having a nucleotide sequence which is at least a partial inversed-reversed sequence of the second half thereof, as is well known in the art.

VGR3197 folded precursor RNA is naturally processed by cellular enzymatic activity into at least 3 separate VGAM precursor RNAs, VGAM2192 precursor RNA, VGAM2193 precursor RNA and VGAM2194 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2192 RNA, VGAM2193 RNA and VGAM2194 RNA, herein schematically represented by VGAM1 RNA through VGAM3 RNA, each of which VGAM RNAs corresponding to VGAM RNA of FIG. 1.

VGAM2192 RNA, herein schematically represented by VGAM1 RNA through VGAM3 RNA, binds complementarily to a host target binding site located in an untranslated region of VGAM2192 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2192 host target RNA into VGAM2192 host target protein, herein schematically represented by VGAM1 HOST TARGET PROTEIN through VGAM3 HOST TARGET PROTEIN, all of FIG. 1.

VGAM2193 RNA, herein schematically represented by VGAM1 RNA through VGAM3 RNA, binds complementarily to a host target binding site located in an untranslated region of VGAM2193 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2193 host target RNA into VGAM2193 host target protein, herein schematically represented by VGAM1 HOST TARGET PROTEIN through VGAM3 HOST TARGET PROTEIN, all of FIG. 1.

VGAM2194 RNA, herein schematically represented by VGAM1 RNA through VGAM3 RNA, binds complementarily to a host target binding site located in an untranslated region of VGAM2194 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2194 host target RNA into VGAM2194 host target protein, herein schematically represented by VGAM1 HOST TARGET PROTEIN through VGAM3 HOST TARGET PROTEIN, all of FIG. 1.

It is appreciated that a function of VGR3197 gene, herein designated VGR GENE, is inhibition of expression of host target genes, as part of a novel viral mechanism of attacking a host. Accordingly, utilities of VGR3197 gene include diagnosis, prevention and treatment of viral infection by Monkeypox Virus. Specific functions, and accordingly utilities, of VGR3197 gene correlate with, and may be deduced from, the identity of the host target genes, which are inhibited by VGAM RNAs comprised in the 'operon-like' cluster of VGR3197 gene: VGAM2192 host target protein, VGAM2193 host target protein and VGAM2194 host target protein, herein schematically represented by VGAM1 HOST TARGET PROTEIN through VGAM3 HOST TARGET PROTEIN. The function of these host target genes is elaborated hereinabove with reference to VGAM2192, VGAM2193 and VGAM2194. FIG. 9 further provides a conceptual description of novel bioinformatically detected regulatory viral gene, referred to here as Viral Genomic Record 3198(VGR3198) viral gene, which encodes an 'operon-like' cluster of novel viral micro RNA-like genes, each of which in turn modulates expression of at least one host target gene, the function and utility of which at least one host target gene is known in the art.

VGR3198 gene, herein designated VGR GENE, is a novel bioinformatically detected regulatory, non protein coding, RNA viral gene. The method by which VGR3198 gene was detected is described hereinabove with reference to FIGS. 1-9.

VGR3198 gene encodes VGR3198 precursor RNA, herein designated VGR PRECURSOR RNA, an RNA molecule, typically several hundred nucleotides long.

VGR3198 precursor RNA folds spatially, forming VGR3198 folded precursor RNA, herein designated VGR FOLDED PRECURSOR RNA. It is appreciated that VGR3198 folded precursor RNA comprises a plurality of what is known in the art as 'hairpin' structures. These 'hairpin' structures are due to the fact that the nucleotide sequence of VGR3198 precursor RNA comprises a plurality of segments, the first half of each such segment having a nucleotide sequence which is at least a partial inversed-reversed sequence of the second half thereof, as is well known in the art.

VGR3198 folded precursor RNA is naturally processed by cellular enzymatic activity into at least 5 separate VGAM precursor RNAs, VGAM2195 precursor RNA, VGAM2196 precursor RNA, VGAM2197 precursor RNA, VGAM2198 precursor RNA and VGAM2199 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2195 RNA, VGAM2196 RNA, VGAM2197 RNA, VGAM2198 RNA and VGAM2199 RNA, herein schematically represented by VGAM1 RNA through VGAM3 RNA, each of which VGAM RNAs corresponding to VGAM RNA of FIG. 1.

VGAM2195 RNA, herein schematically represented by VGAM1 RNA through VGAM3 RNA, binds complementarily to a host target binding site located in an untranslated region of VGAM2195 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2195 host target RNA into VGAM2195 host target protein, herein schematically represented by VGAM1 HOST TARGET PROTEIN through VGAM3 HOST TARGET PROTEIN, all of FIG. 1.

VGAM2196 RNA, herein schematically represented by VGAM1 RNA through VGAM3 RNA, binds complementarily to a host target binding site located in an untranslated region of VGAM2196 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2196 host target RNA into VGAM2196 host target protein, herein schematically represented by VGAM1 HOST TARGET PROTEIN through VGAM3 HOST TARGET PROTEIN, all of FIG. 1.

VGAM2197 RNA, herein schematically represented by VGAM1 RNA through VGAM3 RNA, binds complementarily to a host target binding site located in an untranslated region of VGAM2197 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2197 host target RNA into VGAM2197 host target protein, herein schematically represented by VGAM1 HOST TARGET PROTEIN through VGAM3 HOST TARGET PROTEIN, all of FIG. 1.

VGAM2198 RNA, herein schematically represented by VGAM1 RNA through VGAM3 RNA, binds complementarily to a host target binding site located in an untranslated region of VGAM2198 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2198 host target RNA into VGAM2198 host target protein, herein schematically represented by VGAM1 HOST TARGET PROTEIN through VGAM3 HOST TARGET PROTEIN, all of FIG. 1.

VGAM2199 RNA, herein schematically represented by VGAM1 RNA through VGAM3 RNA, binds complementarily to a host target binding site located in an untranslated region of VGAM2199 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2199 host target RNA into VGAM2199 host target protein, herein schematically represented by VGAM1 HOST TARGET PROTEIN through VGAM3 HOST TARGET PROTEIN, all of FIG. 1.

It is appreciated that a function of VGR3198 gene, herein designated VGR GENE, is inhibition of expression of host target genes, as part of a novel viral mechanism of attacking a host. Accordingly, utilities of VGR3198 gene include diagnosis, prevention and treatment of viral infection by Yaba-like Disease Virus. Specific functions, and accordingly utilities, of VGR3198 gene correlate with, and may be deduced from, the identity of the host target genes, which are inhibited by VGAM RNAs comprised in the 'operon-like' cluster of VGR3198 gene: VGAM2195 host target protein, VGAM2196 host target protein, VGAM2197 host target protein, VGAM2198 host target protein and VGAM2199 host target protein, herein schematically represented by VGAM1 HOST TARGET PROTEIN through VGAM3 HOST TARGET PROTEIN. The function of these host target genes is elaborated hereinabove with reference to VGAM2195, VGAM2196, VGAM2197, VGAM2198 and VGAM2199. FIG. 9 further provides a conceptual description of novel bioinformatically detected regulatory viral gene, referred to here as Viral Genomic Record 3199(VGR3199) viral gene, which encodes an 'operon-like' cluster of novel viral micro RNA-like genes, each of which in turn modulates expression of at least one host target gene, the function and utility of which at least one host target gene is known in the art.

VGR3199 gene, herein designated VGR GENE, is a novel bioinformatically detected regulatory, non protein coding, RNA viral gene. The method by which VGR3199 gene was detected is described hereinabove with reference to FIGS. 1-9.

VGR3199 gene encodes VGR3199 precursor RNA, herein designated VGR PRECURSOR RNA, an RNA molecule, typically several hundred nucleotides long.

VGR3199 precursor RNA folds spatially, forming VGR3199 folded precursor RNA, herein designated VGR FOLDED PRECURSOR RNA. It is appreciated that VGR3199 folded precursor RNA comprises a plurality of what is known in the art as 'hairpin' structures. These 'hairpin' structures are due to the fact that the nucleotide sequence of VGR3199 precursor RNA comprises a plurality of segments, the first half of each such segment having a nucleotide sequence which is at least a partial inversed-reversed sequence of the second half thereof, as is well known in the art.

VGR3199 folded precursor RNA is naturally processed by cellular enzymatic activity into at least 7 separate VGAM precursor RNAs, VGAM2200 precursor RNA, VGAM2201 precursor RNA, VGAM2202 precursor RNA, VGAM2203 precursor RNA, VGAM2204 precursor RNA, VGAM2205 precursor RNA and VGAM2206 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2200 RNA, VGAM2201 RNA, VGAM2202 RNA, VGAM2203 RNA, VGAM2204 RNA, VGAM2205 RNA and VGAM2206 RNA, herein schematically represented by VGAM1 RNA through VGAM3 RNA, each of which VGAM RNAs corresponding to VGAM RNA of FIG. 1.

VGAM2200 RNA, herein schematically represented by VGAM1 RNA through VGAM3 RNA, binds complementarily to a host target binding site located in an untranslated region of VGAM2200 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2200 host target RNA into VGAM2200 host target protein, herein schematically represented by VGAM1 HOST TARGET PROTEIN through VGAM3 HOST TARGET PROTEIN, all of FIG. 1.

VGAM2201 RNA, herein schematically represented by VGAM1 RNA through VGAM3 RNA, binds complementarily to a host target binding site located in an untranslated region of VGAM2201 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2201 host target RNA into VGAM2201 host target protein, herein schematically represented by VGAM1 HOST TARGET PROTEIN through VGAM3 HOST TARGET PROTEIN, all of FIG. 1.

VGAM2202 RNA, herein schematically represented by VGAM1 RNA through VGAM3 RNA, binds complementarily to a host target binding site located in an untranslated region of VGAM2202 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2202 host target RNA into VGAM2202 host target protein, herein schematically represented by VGAM1 HOST TARGET PROTEIN through VGAM3 HOST TARGET PROTEIN, all of FIG. 1.

VGAM2203 RNA, herein schematically represented by VGAM1 RNA through VGAM3 RNA, binds complementarily to a host target binding site located in an untranslated region of VGAM2203 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2203 host target RNA into VGAM2203 host target protein, herein schematically represented by VGAM1 HOST TARGET PROTEIN through VGAM3 HOST TARGET PROTEIN, all of FIG. 1.

VGAM2204 RNA, herein schematically represented by VGAM1 RNA through VGAM3 RNA, binds complementarily to a host target binding site located in an untranslated region of VGAM2204 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2204 host target RNA into VGAM2204 host target protein, herein schematically represented by VGAM1 HOST TARGET PROTEIN through VGAM3 HOST TARGET PROTEIN, all of FIG. 1.

VGAM2205 RNA, herein schematically represented by VGAM1 RNA through VGAM3 RNA, binds complementarily to a host target binding site located in an untranslated region of VGAM2205 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2205 host target RNA into VGAM2205 host target protein, herein schematically represented by VGAM1 HOST TARGET PROTEIN through VGAM3 HOST TARGET PROTEIN, all of FIG. 1.

VGAM2206 RNA, herein schematically represented by VGAM1 RNA through VGAM3 RNA, binds complementarily to a host target binding site located in an untranslated region of VGAM2206 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2206 host target RNA into VGAM2206 host target protein, herein schematically represented by VGAM1 HOST TARGET PROTEIN through VGAM3 HOST TARGET PROTEIN, all of FIG. 1.

It is appreciated that a function of VGR3199 gene, herein designated VGR GENE, is inhibition of expression of host target genes, as part of a novel viral mechanism of attacking a host. Accordingly, utilities of VGR3199 gene include diagnosis, prevention and treatment of viral infection by Cowpox Virus. Specific functions, and accordingly utilities, of VGR3199 gene correlate with, and may be deduced from, the identity of the host target genes, which are inhibited by VGAM RNAs comprised in the 'operon-like' cluster of VGR3199 gene: VGAM2200 host target protein, VGAM2201 host target protein, VGAM2202 host target protein, VGAM2203 host target protein, VGAM2204 host target protein, VGAM2205 host target protein and VGAM2206 host target protein, herein schematically represented by VGAM1 HOST TARGET PROTEIN through VGAM3 HOST TARGET PROTEIN. The function of these host target genes is elaborated hereinabove with reference to VGAM2200, VGAM2201, VGAM2202, VGAM2203, VGAM2204, VGAM2205 and VGAM2206. FIG. 9 further provides a conceptual description of novel bioinformatically detected regulatory viral gene, referred to here as Viral Genomic Record 3200(VGR3200) viral gene, which encodes an 'operon-like' cluster of novel viral micro RNA-like genes, each of which in turn modulates expression of at least one host target gene, the function and utility of which at least one host target gene is known in the art.

VGR3200 gene, herein designated VGR GENE, is a novel bioinformatically detected regulatory, non protein coding, RNA viral gene. The method by which VGR3200 gene was detected is described hereinabove with reference to FIGS. 1-9.

VGR3200 gene encodes VGR3200 precursor RNA, herein designated VGR PRECURSOR RNA, an RNA molecule, typically several hundred nucleotides long.

VGR3200 precursor RNA folds spatially, forming VGR3200 folded precursor RNA, herein designated VGR FOLDED PRECURSOR RNA. It is appreciated that VGR3200 folded precursor RNA comprises a plurality of what is known in the art as 'hairpin' structures. These 'hairpin' structures are due to the fact that the nucleotide sequence of VGR3200 precursor RNA comprises a plurality of segments, the first half of each such segment having a nucleotide sequence which is at least a partial inversed-reversed sequence of the second half thereof, as is well known in the art.

VGR3200 folded precursor RNA is naturally processed by cellular enzymatic activity into at least 8 separate VGAM precursor RNAs, VGAM2207 precursor RNA, VGAM2208 precursor RNA, VGAM2209 precursor RNA, VGAM2210 precursor RNA, VGAM2211 precursor RNA, VGAM2212 precursor RNA, VGAM2213 precursor RNA and VGAM2214 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2207 RNA, VGAM2208 RNA, VGAM2209 RNA, VGAM2210 RNA, VGAM2211 RNA, VGAM2212 RNA, VGAM2213 RNA and VGAM2214 RNA, herein schematically represented by VGAM1 RNA through VGAM3 RNA, each of which VGAM RNAs corresponding to VGAM RNA of FIG. 1.

VGAM2207 RNA, herein schematically represented by VGAM1 RNA through VGAM3 RNA, binds complementarily to a host target binding site located in an untranslated region of VGAM2207 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2207 host target RNA into VGAM2207 host target protein, herein schematically represented by VGAM1 HOST TARGET PROTEIN through VGAM3 HOST TARGET PROTEIN, all of FIG. 1.

VGAM2208 RNA, herein schematically represented by VGAM1 RNA through VGAM3 RNA, binds complementarily to a host target binding site located in an untranslated region of VGAM2208 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2208 host target RNA into VGAM2208 host target protein, herein schematically represented by VGAM1 HOST TARGET PROTEIN through VGAM3 HOST TARGET PROTEIN, all of FIG. 1.

VGAM2209 RNA, herein schematically represented by VGAM1 RNA through VGAM3 RNA, binds complementarily to a host target binding site located in an untranslated region of VGAM2209 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2209 host target RNA into VGAM2209 host target protein, herein schematically represented by VGAM1 HOST TARGET PROTEIN through VGAM3 HOST TARGET PROTEIN, all of FIG. 1.

VGAM2210 RNA, herein schematically represented by VGAM1 RNA through VGAM3 RNA, binds complementarily to a host target binding site located in an untranslated region of VGAM2210 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2210 host target RNA into VGAM2210 host target protein, herein schematically represented by VGAM1 HOST TARGET PROTEIN through VGAM3 HOST TARGET PROTEIN, all of FIG. 1.

VGAM2211 RNA, herein schematically represented by VGAM1 RNA through VGAM3 RNA, binds complementarily to a host target binding site located in an untranslated region of VGAM2211 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2211 host target RNA into VGAM2211 host target protein, herein schematically represented by VGAM1 HOST TARGET PROTEIN through VGAM3 HOST TARGET PROTEIN, all of FIG. 1.

VGAM2212 RNA, herein schematically represented by VGAM1 RNA through VGAM3 RNA, binds complementarily to a host target binding site located in an untranslated region of VGAM2212 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2212 host target RNA into VGAM2212 host target protein, herein schematically represented by VGAM1 HOST TARGET PROTEIN through VGAM3 HOST TARGET PROTEIN, all of FIG. 1.

VGAM2213 RNA, herein schematically represented by VGAM1 RNA through VGAM3 RNA, binds complementarily to a host target binding site located in an untranslated region of VGAM2213 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2213 host target RNA into VGAM2213 host target protein, herein schematically represented by VGAM1 HOST TARGET PROTEIN through VGAM3 HOST TARGET PROTEIN, all of FIG. 1.

VGAM2214 RNA, herein schematically represented by VGAM1 RNA through VGAM3 RNA, binds complementarily to a host target binding site located in an untranslated region of VGAM2214 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2214 host target RNA into VGAM2214 host target protein, herein schematically represented by VGAM1 HOST TARGET PROTEIN through VGAM3 HOST TARGET PROTEIN, all of FIG. 1.

It is appreciated that a function of VGR3200 gene, herein designated VGR GENE, is inhibition of expression of host target genes, as part of a novel viral mechanism of attacking a host. Accordingly, utilities of VGR3200 gene include diagnosis, prevention and treatment of viral infection by Myxoma Virus. Specific functions, and accordingly utilities, of VGR3200 gene correlate with, and may be deduced from, the identity of the host target genes, which are inhibited by VGAM RNAs comprised in the 'operon-like' cluster of VGR3200 gene: VGAM2207 host target protein, VGAM2208 host target protein, VGAM2209 host target protein, VGAM2210 host target protein, VGAM2211 host target protein, VGAM2212 host target protein, VGAM2213 host target protein and VGAM2214 host target protein, herein schematically represented by VGAM1 HOST TARGET PROTEIN through VGAM3 HOST TARGET PROTEIN. The function of these host target genes is elaborated hereinabove with reference to VGAM2207, VGAM2208, VGAM2209, VGAM2210, VGAM2211, VGAM2212, VGAM2213 and VGAM2214. FIG. 9 further provides a conceptual description of novel bioinformatically detected regulatory viral gene, referred to here as Viral Genomic Record 3201(VGR3201) viral gene, which encodes an 'operon-like' cluster of novel viral micro RNA-like genes, each of which in turn modulates expression of at least one host target gene, the function and utility of which at least one host target gene is known in the art.

VGR3201 gene, herein designated VGR GENE, is a novel bioinformatically detected regulatory, non protein coding, RNA viral gene. The method by which VGR3201 gene was detected is described hereinabove with reference to FIGS. 1-9.

VGR3201 gene encodes VGR3201 precursor RNA, herein designated VGR PRECURSOR RNA, an RNA molecule, typically several hundred nucleotides long.

VGR3201 precursor RNA folds spatially, forming VGR3201 folded precursor RNA, herein designated VGR FOLDED PRECURSOR RNA. It is appreciated that VGR3201 folded precursor RNA comprises a plurality of what is known in the art as 'hairpin' structures. These 'hairpin' structures are due to the fact that the nucleotide sequence of VGR3201 precursor RNA comprises a plurality of segments, the first half of each such segment having a nucleotide sequence which is at least a partial inversed-reversed sequence of the second half thereof, as is well known in the art.

VGR3201 folded precursor RNA is naturally processed by cellular enzymatic activity into at least 6 separate VGAM precursor RNAs, VGAM2215 precursor RNA, VGAM2216 precursor RNA, VGAM2217 precursor RNA, VGAM2218 precursor RNA, VGAM2219 precursor RNA and VGAM2220 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2215 RNA, VGAM2216 RNA, VGAM2217 RNA, VGAM2218 RNA, VGAM2219 RNA and VGAM2220 RNA, herein schematically represented by VGAM1 RNA through VGAM3 RNA, each of which VGAM RNAs corresponding to VGAM RNA of FIG. 1.

VGAM2215 RNA, herein schematically represented by VGAM1 RNA through VGAM3 RNA, binds complementarily to a host target binding site located in an untranslated region of VGAM2215 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2215 host target RNA into VGAM2215 host target protein, herein schematically represented by VGAM1 HOST TARGET PROTEIN through VGAM3 HOST TARGET PROTEIN, all of FIG. 1.

VGAM2216 RNA, herein schematically represented by VGAM1 RNA through VGAM3 RNA, binds complementarily to a host target binding site located in an untranslated region of VGAM2216 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2216 host target RNA into VGAM2216 host target protein, herein schematically represented by VGAM1 HOST TARGET PROTEIN through VGAM3 HOST TARGET PROTEIN, all of FIG. 1.

VGAM2217 RNA, herein schematically represented by VGAM1 RNA through VGAM3 RNA, binds complementarily to a host target binding site located in an untranslated region of VGAM2217 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2217 host target RNA into VGAM2217 host target protein, herein schematically represented by VGAM1 HOST TARGET PROTEIN through VGAM3 HOST TARGET PROTEIN, all of FIG. 1.

VGAM2218 RNA, herein schematically represented by VGAM1 RNA through VGAM3 RNA, binds complementarily to a host target binding site located in an untranslated region of VGAM2218 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2218 host target RNA into VGAM2218 host target protein, herein schematically represented by VGAM1 HOST TARGET PROTEIN through VGAM3 HOST TARGET PROTEIN, all of FIG. 1.

VGAM2219 RNA, herein schematically represented by VGAM1 RNA through VGAM3 RNA, binds complementarily to a host target binding site located in an untranslated region of VGAM2219 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2219 host target RNA into VGAM2219 host target protein, herein schematically represented by VGAM1 HOST TARGET PROTEIN through VGAM3 HOST TARGET PROTEIN, all of FIG. 1.

VGAM2220 RNA, herein schematically represented by VGAM1 RNA through VGAM3 RNA, binds complementarily to a host target binding site located in an untranslated region of VGAM2220 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2220 host target RNA into VGAM2220 host target protein, herein schematically represented by VGAM1 HOST TARGET PROTEIN through VGAM3 HOST TARGET PROTEIN, all of FIG. 1.

It is appreciated that a function of VGR3201 gene, herein designated VGR GENE, is inhibition of expression of host target genes, as part of a novel viral mechanism of attacking a host. Accordingly, utilities of VGR3201 gene include diagnosis, prevention and treatment of viral infection by Ectromelia Virus. Specific functions, and accordingly utilities, of VGR3201 gene correlate with, and may be deduced from, the identity of the host target genes, which are inhibited by VGAM RNAs comprised in the 'operon-like' cluster of VGR3201 gene: VGAM2215 host target protein, VGAM2216 host target protein, VGAM2217 host target protein, VGAM2218 host target protein, VGAM2219 host target protein and VGAM2220 host target protein, herein schematically represented by VGAM1 HOST TARGET PROTEIN through VGAM3 HOST TARGET PROTEIN. The function of these host target genes is elaborated hereinabove with reference to VGAM2215, VGAM2216, VGAM2217, VGAM2218, VGAM2219 and VGAM2220. FIG. 9 further provides a conceptual description of novel bioinformatically detected regulatory viral gene, referred to here as Viral Genomic Record 3202(VGR3202) viral gene, which encodes an 'operon-like' cluster of novel viral micro RNA-like genes, each of which in turn modulates expression of at least one host target gene, the function and utility of which at least one host target gene is known in the art.

VGR3202 gene, herein designated VGR GENE, is a novel bioinformatically detected regulatory, non protein coding, RNA viral gene. The method by which VGR3202 gene was detected is described hereinabove with reference to FIGS. 1-9.

VGR3202 gene encodes VGR3202 precursor RNA, herein designated VGR PRECURSOR RNA, an RNA molecule, typically several hundred nucleotides long.

VGR3202 precursor RNA folds spatially, forming VGR3202 folded precursor RNA, herein designated VGR FOLDED PRECURSOR RNA. It is appreciated that VGR3202 folded precursor RNA comprises a plurality of what is known in the art as 'hairpin' structures. These 'hairpin' structures are due to the fact that the nucleotide sequence of VGR3202 precursor RNA comprises a plurality of segments, the first half of each such segment having a nucleotide sequence which is at least a partial inversed-reversed sequence of the second half thereof, as is well known in the art.

VGR3202 folded precursor RNA is naturally processed by cellular enzymatic activity into at least 8 separate VGAM precursor RNAs, VGAM2221 precursor RNA, VGAM2222 precursor RNA, VGAM2223 precursor RNA, VGAM2224 precursor RNA, VGAM2225 precursor RNA, VGAM2226 precursor RNA, VGAM2227 precursor RNA and VGAM2228 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2221 RNA, VGAM2222 RNA, VGAM2223 RNA, VGAM2224 RNA, VGAM2225 RNA, VGAM2226 RNA, VGAM2227 RNA and VGAM2228 RNA, herein schematically represented by VGAM1 RNA through VGAM3 RNA, each of which VGAM RNAs corresponding to VGAM RNA of FIG. 1.

VGAM2221 RNA, herein schematically represented by VGAM1 RNA through VGAM3 RNA, binds complementarily to a host target binding site located in an untranslated region of VGAM2221 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2221 host target RNA into VGAM2221 host target protein, herein schematically represented by VGAM1 HOST TARGET PROTEIN through VGAM3 HOST TARGET PROTEIN, all of FIG. 1.

VGAM2222 RNA, herein schematically represented by VGAM1 RNA through VGAM3 RNA, binds complementarily to a host target binding site located in an untranslated region of VGAM2222 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2222 host target RNA into VGAM2222 host target protein, herein schematically represented by VGAM1 HOST TARGET PROTEIN through VGAM3 HOST TARGET PROTEIN, all of FIG. 1.

VGAM2223 RNA, herein schematically represented by VGAM1 RNA through VGAM3 RNA, binds complementarily to a host target binding site located in an untranslated region of VGAM2223 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2223 host target RNA into VGAM2223 host target protein, herein schematically represented by VGAM1 HOST TARGET PROTEIN through VGAM3 HOST TARGET PROTEIN, all of FIG. 1.

VGAM2224 RNA, herein schematically represented by VGAM1 RNA through VGAM3 RNA, binds complementarily to a host target binding site located in an untranslated region of VGAM2224 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2224 host target RNA into VGAM2224 host target protein, herein schematically represented by VGAM1 HOST TARGET PROTEIN through VGAM3 HOST TARGET PROTEIN, all of FIG. 1.

VGAM2225 RNA, herein schematically represented by VGAM1 RNA through VGAM3 RNA, binds complementarily to a host target binding site located in an untranslated region of VGAM2225 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2225 host target RNA into VGAM2225 host target protein, herein schematically represented by VGAM1 HOST TARGET PROTEIN through VGAM3 HOST TARGET PROTEIN, all of FIG. 1.

VGAM2226 RNA, herein schematically represented by VGAM1 RNA through VGAM3 RNA, binds complementarily to a host target binding site located in an untranslated region of VGAM2226 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2226 host target RNA into VGAM2226 host target protein, herein schematically represented by VGAM1 HOST TARGET PROTEIN through VGAM3 HOST TARGET PROTEIN, all of FIG. 1.

VGAM2227 RNA, herein schematically represented by VGAM1 RNA through VGAM3 RNA, binds complementarily to a host target binding site located in an untranslated region of VGAM2227 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2227 host target RNA into VGAM2227 host target protein, herein schematically represented by VGAM1 HOST TARGET PROTEIN through VGAM3 HOST TARGET PROTEIN, all of FIG. 1.

VGAM2228 RNA, herein schematically represented by VGAM1 RNA through VGAM3 RNA, binds complementarily to a host target binding site located in an untranslated region of VGAM2228 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2228 host target RNA into VGAM2228 host target protein, herein schematically represented by VGAM1 HOST TARGET PROTEIN through VGAM3 HOST TARGET PROTEIN, all of FIG. 1.

It is appreciated that a function of VGR3202 gene, herein designated VGR GENE, is inhibition of expression of host target genes, as part of a novel viral mechanism of attacking a host. Accordingly, utilities of VGR3202 gene include diagnosis, prevention and treatment of viral infection by Equine Herpesvirus 2. Specific functions, and accordingly utilities, of VGR3202 gene correlate with, and may be deduced from, the identity of the host target genes, which are inhibited by VGAM RNAs comprised in the 'operon-like' cluster of VGR3202 gene: VGAM2221 host target protein, VGAM2222 host target protein, VGAM2223 host target protein, VGAM2224 host target protein, VGAM2225 host target protein, VGAM2226 host target protein, VGAM2227 host target protein and VGAM2228 host target protein, herein schematically represented by VGAM1 HOST TARGET PROTEIN through VGAM3 HOST TARGET PROTEIN. The function of these host target genes is elaborated hereinabove with reference to VGAM2221, VGAM2222, VGAM2223, VGAM2224, VGAM2225, VGAM2226, VGAM2227 and VGAM2228. FIG. 9 further provides a conceptual description of novel bioinformatically detected regulatory viral gene, referred to here as Viral Genomic Record 3203(VGR3203) viral gene, which encodes an 'operon-like' cluster of novel viral micro RNA-like genes, each of which in turn modulates expression of at least one host target gene, the function and utility of which at least one host target gene is known in the art.

VGR3203 gene, herein designated VGR GENE, is a novel bioinformatically detected regulatory, non protein coding, RNA viral gene. The method by which VGR3203 gene was detected is described hereinabove with reference to FIGS. 1-9.

VGR3203 gene encodes VGR3203 precursor RNA, herein designated VGR PRECURSOR RNA, an RNA molecule, typically several hundred nucleotides long.

VGR3203 precursor RNA folds spatially, forming VGR3203 folded precursor RNA, herein designated VGR FOLDED PRECURSOR RNA. It is appreciated that VGR3203 folded precursor RNA comprises a plurality of what is known in the art as 'hairpin' structures. These 'hairpin' structures are due to the fact that the nucleotide sequence of VGR3203 precursor RNA comprises a plurality of segments, the first half of each such segment having a nucleotide sequence which is at least a partial inversed-reversed sequence of the second half thereof, as is well known in the art.

VGR3203 folded precursor RNA is naturally processed by cellular enzymatic activity into at least 3 separate VGAM precursor RNAs, VGAM2229 precursor RNA, VGAM2230 precursor RNA and VGAM2231 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2229 RNA, VGAM2230 RNA and VGAM2231 RNA, herein schematically represented by VGAM1 RNA through VGAM3 RNA, each of which VGAM RNAs corresponding to VGAM RNA of FIG. 1.

VGAM2229 RNA, herein schematically represented by VGAM1 RNA through VGAM3 RNA, binds complementarily to a host target binding site located in an untranslated region of VGAM2229 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2229 host target RNA into VGAM2229 host target protein, herein schematically represented by VGAM1 HOST TARGET PROTEIN through VGAM3 HOST TARGET PROTEIN, all of FIG. 1.

VGAM2230 RNA, herein schematically represented by VGAM1 RNA through VGAM3 RNA, binds complementarily to a host target binding site located in an untranslated region of VGAM2230 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2230 host target RNA into VGAM2230 host target protein, herein schematically represented by VGAM1 HOST TARGET PROTEIN through VGAM3 HOST TARGET PROTEIN, all of FIG. 1.

VGAM2231 RNA, herein schematically represented by VGAM1 RNA through VGAM3 RNA, binds complementarily to a host target binding site located in an untranslated region of VGAM2231 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2231 host target RNA into VGAM2231 host target protein, herein schematically represented by VGAM1 HOST TARGET PROTEIN through VGAM3 HOST TARGET PROTEIN, all of FIG. 1.

It is appreciated that a function of VGR3203 gene, herein designated VGR GENE, is inhibition of expression of host target genes, as part of a novel viral mechanism of attacking a host. Accordingly, utilities of VGR3203 gene include diagnosis, prevention and treatment of viral infection by Potato Aucuba Mosaic Virus. Specific functions, and accordingly utilities, of VGR3203 gene correlate with, and may be deduced from, the identity of the host target genes, which are inhibited by VGAM RNAs comprised in the 'operon-like' cluster of VGR3203 gene: VGAM2229 host target protein, VGAM2230 host target protein and VGAM2231 host target protein, herein schematically represented by VGAM1 HOST TARGET PROTEIN through VGAM3 HOST TARGET PROTEIN. The function of these host target genes is elaborated hereinabove with reference to VGAM2229, VGAM2230 and VGAM2231. FIG. 9 further provides a conceptual description of novel bioinformatically detected regulatory viral gene, referred to here as Viral Genomic Record 3204(VGR3204) viral gene, which encodes an 'operon-like' cluster of novel viral micro RNA-like genes, each of which in turn modulates expression of at least one host target gene, the function and utility of which at least one host target gene is known in the art.

VGR3204 gene, herein designated VGR GENE, is a novel bioinformatically detected regulatory, non protein coding, RNA viral gene. The method by which VGR3204 gene was detected is described hereinabove with reference to FIGS. 1-9.

VGR3204 gene encodes VGR3204 precursor RNA, herein designated VGR PRECURSOR RNA, an RNA molecule, typically several hundred nucleotides long.

VGR3204 precursor RNA folds spatially, forming VGR3204 folded precursor RNA, herein designated VGR FOLDED PRECURSOR RNA. It is appreciated that VGR3204 folded precursor RNA comprises a plurality of what is known in the art as 'hairpin' structures. These 'hairpin' structures are due to the fact that the nucleotide sequence of VGR3204 precursor RNA comprises a plurality of segments, the first half of each such segment having a nucleotide sequence which is at least a partial inversed-reversed sequence of the second half thereof, as is well known in the art.

VGR3204 folded precursor RNA is naturally processed by cellular enzymatic activity into at least 8 separate VGAM precursor RNAs, VGAM2232 precursor RNA, VGAM2233 precursor RNA, VGAM2234 precursor RNA, VGAM2235 precursor RNA, VGAM2236 precursor RNA, VGAM2237 precursor RNA, VGAM2238 precursor RNA and VGAM2239 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2232 RNA, VGAM2233 RNA, VGAM2234 RNA, VGAM2235 RNA, VGAM2236 RNA, VGAM2237 RNA, VGAM2238 RNA and VGAM2239 RNA, herein schematically represented by VGAM1 RNA through VGAM3 RNA, each of which VGAM RNAs corresponding to VGAM RNA of FIG. 1.

VGAM2232 RNA, herein schematically represented by VGAM1 RNA through VGAM3 RNA, binds complementarily to a host target binding site located in an untranslated region of VGAM2232 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2232 host target RNA into VGAM2232 host target protein, herein schematically represented by VGAM1 HOST TARGET PROTEIN through VGAM3 HOST TARGET PROTEIN, all of FIG. 1.

VGAM2233 RNA, herein schematically represented by VGAM1 RNA through VGAM3 RNA, binds complementarily to a host target binding site located in an untranslated region of VGAM2233 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2233 host target RNA into VGAM2233 host target protein, herein schematically represented by VGAM1 HOST TARGET PROTEIN through VGAM3 HOST TARGET PROTEIN, all of FIG. 1.

VGAM2234 RNA, herein schematically represented by VGAM1 RNA through VGAM3 RNA, binds complementarily to a host target binding site located in an untranslated region of VGAM2234 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2234 host target RNA into VGAM2234 host target protein, herein schematically represented by VGAM1 HOST TARGET PROTEIN through VGAM3 HOST TARGET PROTEIN, all of FIG. 1.

VGAM2235 RNA, herein schematically represented by VGAM1 RNA through VGAM3 RNA, binds complementarily to a host target binding site located in an untranslated region of VGAM2235 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2235 host target RNA into VGAM2235 host target protein, herein schematically represented by VGAM1 HOST TARGET PROTEIN through VGAM3 HOST TARGET PROTEIN, all of FIG. 1.

VGAM2236 RNA, herein schematically represented by VGAM1 RNA through VGAM3 RNA, binds complementarily to a host target binding site located in an untranslated region of VGAM2236 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2236 host target RNA into VGAM2236 host target protein, herein schematically represented by VGAM1 HOST TARGET PROTEIN through VGAM3 HOST TARGET PROTEIN, all of FIG. 1.

VGAM2237 RNA, herein schematically represented by VGAM1 RNA through VGAM3 RNA, binds complementarily to a host target binding site located in an untranslated region of VGAM2237 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2237 host target RNA into VGAM2237 host target protein, herein schematically represented by VGAM1 HOST TARGET PROTEIN through VGAM3 HOST TARGET PROTEIN, all of FIG. 1.

VGAM2238 RNA, herein schematically represented by VGAM1 RNA through VGAM3 RNA, binds complementarily to a host target binding site located in an untranslated region of VGAM2238 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2238 host target RNA into VGAM2238 host target protein, herein schematically represented by VGAM1 HOST TARGET PROTEIN through VGAM3 HOST TARGET PROTEIN, all of FIG. 1.

VGAM2239 RNA, herein schematically represented by VGAM1 RNA through VGAM3 RNA, binds complementarily to a host target binding site located in an untranslated region of VGAM2239 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2239 host target RNA into VGAM2239 host target protein, herein schematically represented by VGAM1 HOST TARGET PROTEIN through VGAM3 HOST TARGET PROTEIN, all of FIG. 1.

It is appreciated that a function of VGR3204 gene, herein designated VGR GENE, is inhibition of expression of host target genes, as part of a novel viral mechanism of attacking a host. Accordingly, utilities of VGR3204 gene include diagnosis, prevention and treatment of viral infection by Porcine Epidemic Diarrhea Virus. Specific functions, and accordingly utilities, of VGR3204 gene correlate with, and may be deduced from, the identity of the host target genes, which are inhibited by VGAM RNAs comprised in the 'operon-like' cluster of VGR3204 gene: VGAM2232 host target protein, VGAM2233 host target protein, VGAM2234 host target protein, VGAM2235 host target protein, VGAM2236 host target protein, VGAM2237 host target protein, VGAM2238 host target protein and VGAM2239 host target protein, herein schematically represented by VGAM1 HOST TARGET PROTEIN through VGAM3 HOST TARGET PROTEIN. The function of these host target genes is elaborated hereinabove with reference to VGAM2232, VGAM2233, VGAM2234, VGAM2235, VGAM2236, VGAM2237, VGAM2238 and VGAM2239. FIG. 9 further provides a conceptual description of novel bioinformatically detected regulatory viral gene, referred to here as Viral Genomic Record 3205(VGR3205) viral gene, which encodes an 'operon-like' cluster of novel viral micro RNA-like genes, each of which in turn modulates expression of at least one host target gene, the function and utility of which at least one host target gene is known in the art.

VGR3205 gene, herein designated VGR GENE, is a novel bioinformatically detected regulatory, non protein coding, RNA viral gene. The method by which VGR3205 gene was detected is described hereinabove with reference to FIGS. 1-9.

VGR3205 gene encodes VGR3205 precursor RNA, herein designated VGR PRECURSOR RNA, an RNA molecule, typically several hundred nucleotides long.

VGR3205 precursor RNA folds spatially, forming VGR3205 folded precursor RNA, herein designated VGR FOLDED PRECURSOR RNA. It is appreciated that VGR3205 folded precursor RNA comprises a plurality of what is known in the art as 'hairpin' structures. These 'hairpin' structures are due to the fact that the nucleotide sequence of VGR3205 precursor RNA comprises a plurality of segments, the first half of each such segment having a nucleotide sequence which is at least a partial inversed-reversed sequence of the second half thereof, as is well known in the art.

VGR3205 folded precursor RNA is naturally processed by cellular enzymatic activity into at least 7 separate VGAM precursor RNAs, VGAM2240 precursor RNA, VGAM2241 precursor RNA, VGAM2242 precursor RNA, VGAM2243 precursor RNA, VGAM2244 precursor RNA, VGAM2245 precursor RNA and VGAM2246 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2240 RNA, VGAM2241 RNA, VGAM2242 RNA, VGAM2243 RNA, VGAM2244 RNA, VGAM2245 RNA and VGAM2246 RNA, herein schematically represented by VGAM1 RNA through VGAM3 RNA, each of which VGAM RNAs corresponding to VGAM RNA of FIG. 1.

VGAM2240 RNA, herein schematically represented by VGAM1 RNA through VGAM3 RNA, binds complementarily to a host target binding site located in an untranslated region of VGAM2240 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2240 host target RNA into VGAM2240 host target protein, herein schematically represented by VGAM1 HOST TARGET PROTEIN through VGAM3 HOST TARGET PROTEIN, all of FIG. 1.

VGAM2241 RNA, herein schematically represented by VGAM1 RNA through VGAM3 RNA, binds complementarily to a host target binding site located in an untranslated region of VGAM2241 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2241 host target RNA into VGAM2241 host target protein, herein schematically represented by VGAM1 HOST TARGET PROTEIN through VGAM3 HOST TARGET PROTEIN, all of FIG. 1.

VGAM2242 RNA, herein schematically represented by VGAM1 RNA through VGAM3 RNA, binds complementarily to a host target binding site located in an untranslated region of VGAM2242 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2242 host target RNA into VGAM2242 host target protein, herein schematically represented by VGAM1 HOST TARGET PROTEIN through VGAM3 HOST TARGET PROTEIN, all of FIG. 1.

VGAM2243 RNA, herein schematically represented by VGAM1 RNA through VGAM3 RNA, binds complementarily to a host target binding site located in an untranslated region of VGAM2243 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2243 host target RNA into VGAM2243 host target protein, herein schematically represented by VGAM1 HOST TARGET PROTEIN through VGAM3 HOST TARGET PROTEIN, all of FIG. 1.

VGAM2244 RNA, herein schematically represented by VGAM1 RNA through VGAM3 RNA, binds complementarily to a host target binding site located in an untranslated region of VGAM2244 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2244 host target RNA into VGAM2244 host target protein, herein schematically represented by VGAM1 HOST TARGET PROTEIN through VGAM3 HOST TARGET PROTEIN, all of FIG. 1.

VGAM2245 RNA, herein schematically represented by VGAM1 RNA through VGAM3 RNA, binds complementarily to a host target binding site located in an untranslated region of VGAM2245 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2245 host target RNA into VGAM2245 host target protein, herein schematically represented by VGAM1 HOST TARGET PROTEIN through VGAM3 HOST TARGET PROTEIN, all of FIG. 1.

VGAM2246 RNA, herein schematically represented by VGAM1 RNA through VGAM3 RNA, binds complementarily to a host target binding site located in an untranslated region of VGAM2246 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2246 host target RNA into VGAM2246 host target protein, herein schematically represented by VGAM1 HOST TARGET PROTEIN through VGAM3 HOST TARGET PROTEIN, all of FIG. 1.

It is appreciated that a function of VGR3205 gene, herein designated VGR GENE, is inhibition of expression of host target genes, as part of a novel viral mechanism of attacking a host. Accordingly, utilities of VGR3205 gene include diagnosis, prevention and treatment of viral infection by Porcine Epidemic Diarrhea Virus. Specific functions, and accordingly utilities, of VGR3205 gene correlate with, and may be deduced from, the identity of the host target genes, which are inhibited by VGAM RNAs comprised in the 'operon-like' cluster of VGR3205 gene: VGAM2240 host target protein, VGAM2241 host target protein, VGAM2242 host target protein, VGAM2243 host target protein, VGAM2244 host target protein, VGAM2245 host target protein and VGAM2246 host target protein, herein schematically represented by VGAM1 HOST TARGET PROTEIN through VGAM3 HOST TARGET PROTEIN. The function of these host target genes is elaborated hereinabove with reference to VGAM2240, VGAM2241, VGAM2242, VGAM2243, VGAM2244, VGAM2245 and VGAM2246. FIG. 9 further provides a conceptual description of novel bioinformatically detected regulatory viral gene, referred to here as Viral Genomic Record 3206(VGR3206) viral gene, which encodes an 'operon-like' cluster of novel viral micro RNA-like genes, each of which in turn modulates expression of at least one host target gene, the function and utility of which at least one host target gene is known in the art.

VGR3206 gene, herein designated VGR GENE, is a novel bioinformatically detected regulatory, non protein coding, RNA viral gene. The method by which VGR3206 gene was detected is described hereinabove with reference to FIGS. 1-9.

VGR3206 gene encodes VGR3206 precursor RNA, herein designated VGR PRECURSOR RNA, an RNA molecule, typically several hundred nucleotides long.

VGR3206 precursor RNA folds spatially, forming VGR3206 folded precursor RNA, herein designated VGR FOLDED PRECURSOR RNA. It is appreciated that VGR3206 folded precursor RNA comprises a plurality of what is known in the art as 'hairpin' structures. These 'hairpin' structures are due to the fact that the nucleotide sequence of VGR3206 precursor RNA comprises a plurality of segments, the first half of each such segment having a nucleotide sequence which is at least a partial inversed-reversed sequence of the second half thereof, as is well known in the art.

VGR3206 folded precursor RNA is naturally processed by cellular enzymatic activity into at least 7 separate VGAM precursor RNAs, VGAM2247 precursor RNA, VGAM2248 precursor RNA, VGAM2249 precursor RNA, VGAM2250 precursor RNA, VGAM2251 precursor RNA, VGAM2252 precursor RNA and VGAM2253 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2247 RNA, VGAM2248 RNA, VGAM2249 RNA, VGAM2250 RNA, VGAM2251 RNA, VGAM2252 RNA and VGAM2253 RNA, herein schematically represented by VGAM1 RNA through VGAM3 RNA, each of which VGAM RNAs corresponding to VGAM RNA of FIG. 1.

VGAM2247 RNA, herein schematically represented by VGAM1 RNA through VGAM3 RNA, binds complementarily to a host target binding site located in an untranslated region of VGAM2247 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2247 host target RNA into VGAM2247 host target protein, herein schematically represented by VGAM1 HOST TARGET PROTEIN through VGAM3 HOST TARGET PROTEIN, all of FIG. 1.

VGAM2248 RNA, herein schematically represented by VGAM1 RNA through VGAM3 RNA, binds complementarily to a host target binding site located in an untranslated region of VGAM2248 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2248 host target RNA into VGAM2248 host target protein, herein schematically represented by VGAM1 HOST TARGET PROTEIN through VGAM3 HOST TARGET PROTEIN, all of FIG. 1.

VGAM2249 RNA, herein schematically represented by VGAM1 RNA through VGAM3 RNA, binds complementarily to a host target binding site located in an untranslated region of VGAM2249 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2249 host target RNA into VGAM2249 host target protein, herein schematically represented by VGAM1 HOST TARGET PROTEIN through VGAM3 HOST TARGET PROTEIN, all of FIG. 1.

VGAM2250 RNA, herein schematically represented by VGAM1 RNA through VGAM3 RNA, binds complementarily to a host target binding site located in an untranslated region of VGAM2250 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2250 host target RNA into VGAM2250 host target protein, herein schematically represented by VGAM1 HOST TARGET PROTEIN through VGAM3 HOST TARGET PROTEIN, all of FIG. 1.

VGAM2251 RNA, herein schematically represented by VGAM1 RNA through VGAM3 RNA, binds complementarily to a host target binding site located in an untranslated region of VGAM2251 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2251 host target RNA into VGAM2251 host target protein, herein schematically represented by VGAM1 HOST TARGET PROTEIN through VGAM3 HOST TARGET PROTEIN, all of FIG. 1.

VGAM2252 RNA, herein schematically represented by VGAM1 RNA through VGAM3 RNA, binds complementarily to a host target binding site located in an untranslated region of VGAM2252 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2252 host target RNA into VGAM2252 host target protein, herein schematically represented by VGAM1 HOST TARGET PROTEIN through VGAM3 HOST TARGET PROTEIN, all of FIG. 1.

VGAM2253 RNA, herein schematically represented by VGAM1 RNA through VGAM3 RNA, binds complementarily to a host target binding site located in an untranslated region of VGAM2253 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2253 host target RNA into VGAM2253 host target protein, herein schematically represented by VGAM1 HOST TARGET PROTEIN through VGAM3 HOST TARGET PROTEIN, all of FIG. 1.

It is appreciated that a function of VGR3206 gene, herein designated VGR GENE, is inhibition of expression of host target genes, as part of a novel viral mechanism of attacking a host. Accordingly, utilities of VGR3206 gene include diagnosis, prevention and treatment of viral infection by Transmissible Gastroenteritis Virus. Specific functions, and accordingly utilities, of VGR3206 gene correlate with, and may be deduced from, the identity of the host target genes, which are inhibited by VGAM RNAs comprised in the 'operon-like' cluster of VGR3206 gene: VGAM2247 host target protein, VGAM2248 host target protein, VGAM2249 host target protein, VGAM2250 host target protein, VGAM2251 host target protein, VGAM2252 host target protein and VGAM2253 host target protein, herein schematically represented by VGAM1 HOST TARGET PROTEIN through VGAM3 HOST TARGET PROTEIN. The function of these host target genes is elaborated hereinabove with reference to VGAM2247, VGAM2248, VGAM2249, VGAM2250, VGAM2251, VGAM2252 and VGAM2253. FIG. 9 further provides a conceptual description of novel bioinformatically detected regulatory viral gene, referred to here as Viral Genomic Record 3207(VGR3207) viral gene, which encodes an 'operon-like' cluster of novel viral micro RNA-like genes, each of which in turn modulates expression of at least one host target gene, the function and utility of which at least one host target gene is known in the art.

VGR3207 gene, herein designated VGR GENE, is a novel bioinformatically detected regulatory, non protein coding, RNA viral gene. The method by which VGR3207 gene was detected is described hereinabove with reference to FIGS. 1-9.

VGR3207 gene encodes VGR3207 precursor RNA, herein designated VGR PRECURSOR RNA, an RNA molecule, typically several hundred nucleotides long.

VGR3207 precursor RNA folds spatially, forming VGR3207 folded precursor RNA, herein designated VGR FOLDED PRECURSOR RNA. It is appreciated that VGR3207 folded precursor RNA comprises a plurality of what is known in the art as 'hairpin' structures. These 'hairpin' structures are due to the fact that the nucleotide sequence of VGR3207 precursor RNA comprises a plurality of segments, the first half of each such segment having a nucleotide sequence which is at least a partial inversed-reversed sequence of the second half thereof, as is well known in the art.

VGR3207 folded precursor RNA is naturally processed by cellular enzymatic activity into at least 2 separate VGAM precursor RNAs, VGAM2254 precursor RNA and VGAM2255 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2254 RNA and VGAM2255 RNA, herein schematically represented by VGAM1 RNA through VGAM3 RNA, each of which VGAM RNAs corresponding to VGAM RNA of FIG. 1.

VGAM2254 RNA, herein schematically represented by VGAM1 RNA through VGAM3 RNA, binds complementarily to a host target binding site located in an untranslated region of VGAM2254 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2254 host target RNA into VGAM2254 host target protein, herein schematically represented by VGAM1 HOST TARGET PROTEIN through VGAM3 HOST TARGET PROTEIN, all of FIG. 1.

VGAM2255 RNA, herein schematically represented by VGAM1 RNA through VGAM3 RNA, binds complementarily to a host target binding site located in an untranslated region of VGAM2255 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2255 host target RNA into VGAM2255 host target protein, herein schematically represented by VGAM1 HOST TARGET PROTEIN through VGAM3 HOST TARGET PROTEIN, all of FIG. 1.

It is appreciated that a function of VGR3207 gene, herein designated VGR GENE, is inhibition of expression of host target genes, as part of a novel viral mechanism of attacking a host. Accordingly, utilities of VGR3207 gene include diagnosis, prevention and treatment of viral infection by Transmissible Gastroenteritis Virus. Specific functions, and accordingly utilities, of VGR3207 gene correlate with, and may be deduced from, the identity of the host target genes, which are inhibited by VGAM RNAs comprised in the 'operon-like' cluster of VGR3207 gene: VGAM2254 host target protein and VGAM2255 host target protein, herein schematically represented by VGAM1 HOST TARGET PROTEIN through VGAM3 HOST TARGET PROTEIN. The function of these host target genes is elaborated hereinabove with reference to VGAM2254 and VGAM2255. FIG. 9 further provides a conceptual description of novel bioinformatically detected regulatory viral gene, referred to here as Viral Genomic Record 3208(VGR3208) viral gene, which encodes an 'operon-like' cluster of novel viral micro RNA-like genes, each of which in turn modulates expression of at least one host target gene, the function and utility of which at least one host target gene is known in the art.

VGR3208 gene, herein designated VGR GENE, is a novel bioinformatically detected regulatory, non protein coding, RNA viral gene. The method by which VGR3208 gene was detected is described hereinabove with reference to FIGS. 1-9.

VGR3208 gene encodes VGR3208 precursor RNA, herein designated VGR PRECURSOR RNA, an RNA molecule, typically several hundred nucleotides long.

VGR3208 precursor RNA folds spatially, forming VGR3208 folded precursor RNA, herein designated VGR FOLDED PRECURSOR RNA. It is appreciated that VGR3208 folded precursor RNA comprises a plurality of what is known in the art as 'hairpin' structures. These 'hairpin' structures are due to the fact that the nucleotide sequence of VGR3208 precursor RNA comprises a plurality of segments, the first half of each such segment having a nucleotide sequence which is at least a partial inversed-reversed sequence of the second half thereof, as is well known in the art.

VGR3208 folded precursor RNA is naturally processed by cellular enzymatic activity into at least 3 separate VGAM precursor RNAs, VGAM2256 precursor RNA, VGAM2257 precursor RNA and VGAM2258 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2256 RNA, VGAM2257 RNA and VGAM2258 RNA, herein schematically represented by VGAM1 RNA through VGAM3 RNA, each of which VGAM RNAs corresponding to VGAM RNA of FIG. 1.

VGAM2256 RNA, herein schematically represented by VGAM1 RNA through VGAM3 RNA, binds complementarily to a host target binding site located in an untranslated region of VGAM2256 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2256 host target RNA into VGAM2256 host target protein, herein schematically represented by VGAM1 HOST TARGET PROTEIN through VGAM3 HOST TARGET PROTEIN, all of FIG. 1.

VGAM2257 RNA, herein schematically represented by VGAM1 RNA through VGAM3 RNA, binds complementarily to a host target binding site located in an untranslated region of VGAM2257 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2257 host target RNA into VGAM2257 host target protein, herein schematically represented by VGAM1 HOST TARGET PROTEIN through VGAM3 HOST TARGET PROTEIN, all of FIG. 1.

VGAM2258 RNA, herein schematically represented by VGAM1 RNA through VGAM3 RNA, binds complementarily to a host target binding site located in an untranslated region of VGAM2258 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2258 host target RNA into VGAM2258 host target protein, herein schematically represented by VGAM1 HOST TARGET PROTEIN through VGAM3 HOST TARGET PROTEIN, all of FIG. 1.

It is appreciated that a function of VGR3208 gene, herein designated VGR GENE, is inhibition of expression of host target genes, as part of a novel viral mechanism of attacking a host. Accordingly, utilities of VGR3208 gene include diagnosis, prevention and treatment of viral infection by Oat Chlorotic Stunt Virus. Specific functions, and accordingly utilities, of VGR3208 gene correlate with, and may be deduced from, the identity of the host target genes, which are inhibited by VGAM RNAs comprised in the 'operon-like' cluster of VGR3208 gene: VGAM2256 host target protein, VGAM2257 host target protein and VGAM2258 host target protein, herein schematically represented by VGAM1 HOST TARGET PROTEIN through VGAM3 HOST TARGET PROTEIN. The function of these host target genes is elaborated hereinabove with reference to VGAM2256, VGAM2257 and VGAM2258. FIG. 9 further provides a conceptual description of novel bioinformatically detected regulatory viral gene, referred to here as Viral Genomic Record 3209(VGR3209) viral gene, which encodes an 'operon-like' cluster of novel viral micro RNA-like genes, each of which in turn modulates expression of at least one host target gene, the function and utility of which at least one host target gene is known in the art.

VGR3209 gene, herein designated VGR GENE, is a novel bioinformatically detected regulatory, non protein coding, RNA viral gene. The method by which VGR3209 gene was detected is described hereinabove with reference to FIGS. 1-9.

VGR3209 gene encodes VGR3209 precursor RNA, herein designated VGR PRECURSOR RNA, an RNA molecule, typically several hundred nucleotides long.

VGR3209 precursor RNA folds spatially, forming VGR3209 folded precursor RNA, herein designated VGR FOLDED PRECURSOR RNA. It is appreciated that VGR3209 folded precursor RNA comprises a plurality of what is known in the art as 'hairpin' structures. These 'hairpin' structures are due to the fact that the nucleotide sequence of VGR3209 precursor RNA comprises a plurality of segments, the first half of each such segment having a nucleotide sequence which is at least a partial inversed-reversed sequence of the second half thereof, as is well known in the art.

VGR3209 folded precursor RNA is naturally processed by cellular enzymatic activity into at least 8 separate VGAM precursor RNAs, VGAM2259 precursor RNA, VGAM2260 precursor RNA, VGAM2261 precursor RNA, VGAM2262 precursor RNA, VGAM2263 precursor RNA, VGAM2264 precursor RNA, VGAM2265 precursor RNA and VGAM2266 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2259 RNA, VGAM2260 RNA, VGAM2261 RNA, VGAM2262 RNA, VGAM2263 RNA, VGAM2264 RNA, VGAM2265 RNA and VGAM2266 RNA, herein schematically represented by VGAM1 RNA through VGAM3 RNA, each of which VGAM RNAs corresponding to VGAM RNA of FIG. 1.

VGAM2259 RNA, herein schematically represented by VGAM1 RNA through VGAM3 RNA, binds complementarily to a host target binding site located in an untranslated region of VGAM2259 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2259 host target RNA into VGAM2259 host target protein, herein schematically represented by VGAM1 HOST TARGET PROTEIN through VGAM3 HOST TARGET PROTEIN, all of FIG. 1.

VGAM2260 RNA, herein schematically represented by VGAM1 RNA through VGAM3 RNA, binds complementarily to a host target binding site located in an untranslated region of VGAM2260 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2260 host target RNA into VGAM2260 host target protein, herein schematically represented by VGAM1 HOST TARGET PROTEIN through VGAM3 HOST TARGET PROTEIN, all of FIG. 1.

VGAM2261 RNA, herein schematically represented by VGAM1 RNA through VGAM3 RNA, binds complementarily to a host target binding site located in an untranslated region of VGAM2261 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2261 host target RNA into VGAM2261 host target protein, herein schematically represented by VGAM1 HOST TARGET PROTEIN through VGAM3 HOST TARGET PROTEIN, all of FIG. 1.

VGAM2262 RNA, herein schematically represented by VGAM1 RNA through VGAM3 RNA, binds complementarily to a host target binding site located in an untranslated region of VGAM2262 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2262 host target RNA into VGAM2262 host target protein, herein schematically represented by VGAM1 HOST TARGET PROTEIN through VGAM3 HOST TARGET PROTEIN, all of FIG. 1.

VGAM2263 RNA, herein schematically represented by VGAM1 RNA through VGAM3 RNA, binds complementarily to a host target binding site located in an untranslated region of VGAM2263 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2263 host target RNA into VGAM2263 host target protein, herein schematically represented by VGAM1 HOST TARGET PROTEIN through VGAM3 HOST TARGET PROTEIN, all of FIG. 1.

VGAM2264 RNA, herein schematically represented by VGAM1 RNA through VGAM3 RNA, binds complementarily to a host target binding site located in an untranslated region of VGAM2264 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2264 host target RNA into VGAM2264 host target protein, herein schematically represented by VGAM1 HOST TARGET PROTEIN through VGAM3 HOST TARGET PROTEIN, all of FIG. 1.

VGAM2265 RNA, herein schematically represented by VGAM1 RNA through VGAM3 RNA, binds complementarily to a host target binding site located in an untranslated region of VGAM2265 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2265 host target RNA into VGAM2265 host target protein, herein schematically represented by VGAM1 HOST TARGET PROTEIN through VGAM3 HOST TARGET PROTEIN, all of FIG. 1.

VGAM2266 RNA, herein schematically represented by VGAM1 RNA through VGAM3 RNA, binds complementarily to a host target binding site located in an untranslated region of VGAM2266 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2266 host target RNA into VGAM2266 host target protein, herein schematically represented by VGAM1 HOST TARGET PROTEIN through VGAM3 HOST TARGET PROTEIN, all of FIG. 1.

It is appreciated that a function of VGR3209 gene, herein designated VGR GENE, is inhibition of expression of host target genes, as part of a novel viral mechanism of attacking a host. Accordingly, utilities of VGR3209 gene include diagnosis, prevention and treatment of viral infection by Alcelaphine Herpesvirus 1. Specific functions, and accordingly utilities, of VGR3209 gene correlate with, and may be deduced from, the identity of the host target genes, which are inhibited by VGAM RNAs comprised in the 'operon-like' cluster of VGR3209 gene: VGAM2259 host target protein, VGAM2260 host target protein, VGAM2261 host target protein, VGAM2262 host target protein, VGAM2263 host target protein, VGAM2264 host target protein, VGAM2265 host target protein and VGAM2266 host target protein, herein schematically represented by VGAM1 HOST TARGET PROTEIN through VGAM3 HOST TARGET PROTEIN. The function of these host target genes is elaborated hereinabove with reference to VGAM2259, VGAM2260, VGAM2261, VGAM2262, VGAM2263, VGAM2264, VGAM2265 and VGAM2266. FIG. 9 further provides a conceptual description of novel bioinformatically detected regulatory viral gene, referred to here as Viral Genomic Record 3210(VGR3210) viral gene, which encodes an 'operon-like' cluster of novel viral micro RNA-like genes, each of which in turn modulates expression of at least one host target gene, the function and utility of which at least one host target gene is known in the art.

VGR3210 gene, herein designated VGR GENE, is a novel bioinformatically detected regulatory, non protein coding, RNA viral gene. The method by which VGR3210 gene was detected is described hereinabove with reference to FIGS. 1-9.

VGR3210 gene encodes VGR3210 precursor RNA, herein designated VGR PRECURSOR RNA, an RNA molecule, typically several hundred nucleotides long.

VGR3210 precursor RNA folds spatially, forming VGR3210 folded precursor RNA, herein designated VGR FOLDED PRECURSOR RNA. It is appreciated that VGR3210 folded precursor RNA comprises a plurality of what is known in the art as 'hairpin' structures. These 'hairpin' structures are due to the fact that the nucleotide sequence of VGR3210 precursor RNA comprises a plurality of segments, the first half of each such segment having a nucleotide sequence which is at least a partial inversed-reversed sequence of the second half thereof, as is well known in the art.

VGR3210 folded precursor RNA is naturally processed by cellular enzymatic activity into at least 8 separate VGAM precursor RNAs, VGAM2267 precursor RNA, VGAM2268 precursor RNA, VGAM2269 precursor RNA, VGAM2270 precursor RNA, VGAM2271 precursor RNA, VGAM2272 precursor RNA, VGAM2273 precursor RNA and VGAM2274 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2267 RNA, VGAM2268 RNA, VGAM2269 RNA, VGAM2270 RNA, VGAM2271 RNA, VGAM2272 RNA, VGAM2273 RNA and VGAM2274 RNA, herein schematically represented by VGAM1 RNA through VGAM3 RNA, each of which VGAM RNAs corresponding to VGAM RNA of FIG. 1.

VGAM2267 RNA, herein schematically represented by VGAM1 RNA through VGAM3 RNA, binds complementarily to a host target binding site located in an untranslated region of VGAM2267 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2267 host target RNA into VGAM2267 host target protein, herein schematically represented by VGAM1 HOST TARGET PROTEIN through VGAM3 HOST TARGET PROTEIN, all of FIG. 1.

VGAM2268 RNA, herein schematically represented by VGAM1 RNA through VGAM3 RNA, binds complementarily to a host target binding site located in an untranslated region of VGAM2268 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2268 host target RNA into VGAM2268 host target protein, herein schematically represented by VGAM1 HOST TARGET PROTEIN through VGAM3 HOST TARGET PROTEIN, all of FIG. 1.

VGAM2269 RNA, herein schematically represented by VGAM1 RNA through VGAM3 RNA, binds complementarily to a host target binding site located in an untranslated region of VGAM2269 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2269 host target RNA into VGAM2269 host target protein, herein schematically represented by VGAM1 HOST TARGET PROTEIN through VGAM3 HOST TARGET PROTEIN, all of FIG. 1.

VGAM2270 RNA, herein schematically represented by VGAM1 RNA through VGAM3 RNA, binds complementarily to a host target binding site located in an untranslated region of VGAM2270 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2270 host target RNA into VGAM2270 host target protein, herein schematically represented by VGAM1 HOST TARGET PROTEIN through VGAM3 HOST TARGET PROTEIN, all of FIG. 1.

VGAM2271 RNA, herein schematically represented by VGAM1 RNA through VGAM3 RNA, binds complementarily to a host target binding site located in an untranslated region of VGAM2271 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2271 host target RNA into VGAM2271 host target protein, herein schematically represented by VGAM1 HOST TARGET PROTEIN through VGAM3 HOST TARGET PROTEIN, all of FIG. 1.

VGAM2272 RNA, herein schematically represented by VGAM1 RNA through VGAM3 RNA, binds complementarily to a host target binding site located in an untranslated region of VGAM2272 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2272 host target RNA into VGAM2272 host target protein, herein schematically represented by VGAM1 HOST TARGET PROTEIN through VGAM3 HOST TARGET PROTEIN, all of FIG. 1.

VGAM2273 RNA, herein schematically represented by VGAM1 RNA through VGAM3 RNA, binds complementarily to a host target binding site located in an untranslated region of VGAM2273 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2273 host target RNA into VGAM2273 host target protein, herein schematically represented by VGAM1 HOST TARGET PROTEIN through VGAM3 HOST TARGET PROTEIN, all of FIG. 1.

VGAM2274 RNA, herein schematically represented by VGAM1 RNA through VGAM3 RNA, binds complementarily to a host target binding site located in an untranslated region of VGAM2274 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2274 host target RNA into VGAM2274 host target protein, herein schematically represented by VGAM1 HOST TARGET PROTEIN through VGAM3 HOST TARGET PROTEIN, all of FIG. 1.

It is appreciated that a function of VGR3210 gene, herein designated VGR GENE, is inhibition of expression of host target genes, as part of a novel viral mechanism of attacking a host. Accordingly, utilities of VGR3210 gene include diagnosis, prevention and treatment of viral infection by Alcelaphine Herpesvirus 1. Specific functions, and accordingly utilities, of VGR3210 gene correlate with, and may be deduced from, the identity of the host target genes, which are inhibited by VGAM RNAs comprised in the 'operon-like' cluster of VGR3210 gene: VGAM2267 host target protein, VGAM2268 host target protein, VGAM2269 host target protein, VGAM2270 host target protein, VGAM2271 host target protein, VGAM2272 host target protein, VGAM2273 host target protein and VGAM2274 host target protein, herein schematically represented by VGAM1 HOST TARGET PROTEIN through VGAM3 HOST TARGET PROTEIN. The function of these host target genes is elaborated hereinabove with reference to VGAM2267, VGAM2268, VGAM2269, VGAM2270, VGAM2271, VGAM2272, VGAM2273 and VGAM2274. FIG. 9 further provides a conceptual description of novel bioinformatically detected regulatory viral gene, referred to here as Viral Genomic Record 3211(VGR3211) viral gene, which encodes an 'operon-like' cluster of novel viral micro RNA-like genes, each of which in turn modulates expression of at least one host target gene, the function and utility of which at least one host target gene is known in the art.

VGR3211 gene, herein designated VGR GENE, is a novel bioinformatically detected regulatory, non protein coding, RNA viral gene. The method by which VGR3211 gene was detected is described hereinabove with reference to FIGS. 1-9.

VGR3211 gene encodes VGR3211 precursor RNA, herein designated VGR PRECURSOR RNA, an RNA molecule, typically several hundred nucleotides long.

VGR3211 precursor RNA folds spatially, forming VGR3211 folded precursor RNA, herein designated VGR FOLDED PRECURSOR RNA. It is appreciated that VGR3211 folded precursor RNA comprises a plurality of what is known in the art as 'hairpin' structures. These 'hairpin' structures are due to the fact that the nucleotide sequence of VGR3211 precursor RNA comprises a plurality of segments, the first half of each such segment having a nucleotide sequence which is at least a partial inversed-reversed sequence of the second half thereof, as is well known in the art.

VGR3211 folded precursor RNA is naturally processed by cellular enzymatic activity into at least 6 separate VGAM precursor RNAs, VGAM2275 precursor RNA, VGAM2276 precursor RNA, VGAM2277 precursor RNA, VGAM2278 precursor RNA, VGAM2279 precursor RNA and VGAM2280 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2275 RNA, VGAM2276 RNA, VGAM2277 RNA, VGAM2278 RNA, VGAM2279 RNA and VGAM2280 RNA, herein schematically represented by VGAM1 RNA through VGAM3 RNA, each of which VGAM RNAs corresponding to VGAM RNA of FIG. 1.

VGAM2275 RNA, herein schematically represented by VGAM1 RNA through VGAM3 RNA, binds complementarily to a host target binding site located in an untranslated region of VGAM2275 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2275 host target RNA into VGAM2275 host target protein, herein schematically represented by VGAM1 HOST TARGET PROTEIN through VGAM3 HOST TARGET PROTEIN, all of FIG. 1.

VGAM2276 RNA, herein schematically represented by VGAM1 RNA through VGAM3 RNA, binds complementarily to a host target binding site located in an untranslated region of VGAM2276 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2276 host target RNA into VGAM2276 host target protein, herein schematically represented by VGAM1 HOST TARGET PROTEIN through VGAM3 HOST TARGET PROTEIN, all of FIG. 1.

VGAM2277 RNA, herein schematically represented by VGAM1 RNA through VGAM3 RNA, binds complementarily to a host target binding site located in an untranslated region of VGAM2277 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2277 host target RNA into VGAM2277 host target protein, herein schematically represented by VGAM1 HOST TARGET PROTEIN through VGAM3 HOST TARGET PROTEIN, all of FIG. 1.

VGAM2278 RNA, herein schematically represented by VGAM1 RNA through VGAM3 RNA, binds complementarily to a host target binding site located in an untranslated region of VGAM2278 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2278 host target RNA into VGAM2278 host target protein, herein schematically represented by VGAM1 HOST TARGET PROTEIN through VGAM3 HOST TARGET PROTEIN, all of FIG. 1.

VGAM2279 RNA, herein schematically represented by VGAM1 RNA through VGAM3 RNA, binds complementarily to a host target binding site located in an untranslated region of VGAM2279 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2279 host target RNA into VGAM2279 host target protein, herein schematically represented by VGAM1 HOST TARGET PROTEIN through VGAM3 HOST TARGET PROTEIN, all of FIG. 1.

VGAM2280 RNA, herein schematically represented by VGAM1 RNA through VGAM3 RNA, binds complementarily to a host target binding site located in an untranslated region of VGAM2280 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2280 host target RNA into VGAM2280 host target protein, herein schematically represented by VGAM1 HOST TARGET PROTEIN through VGAM3 HOST TARGET PROTEIN, all of FIG. 1.

It is appreciated that a function of VGR3211 gene, herein designated VGR GENE, is inhibition of expression of host target genes, as part of a novel viral mechanism of attacking a host. Accordingly, utilities of VGR3211 gene include diagnosis, prevention and treatment of viral infection by Alcelaphine Herpesvirus 1. Specific functions, and accordingly utilities, of VGR3211 gene correlate with, and may be deduced from, the identity of the host target genes, which are inhibited by VGAM RNAs comprised in the 'operon-like' cluster of VGR3211 gene: VGAM2275 host target protein, VGAM2276 host target protein, VGAM2277 host target protein, VGAM2278 host target protein, VGAM2279 host target protein and VGAM2280 host target protein, herein schematically represented by VGAM1 HOST TARGET PROTEIN through VGAM3 HOST TARGET PROTEIN. The function of these host target genes is elaborated hereinabove with reference to VGAM2275, VGAM2276, VGAM2277, VGAM2278, VGAM2279 and VGAM2280. FIG. 9 further provides a conceptual description of novel bioinformatically detected regulatory viral gene, referred to here as Viral Genomic Record 3212(VGR3212) viral gene, which encodes an 'operon-like' cluster of novel viral micro RNA-like genes, each of which in turn modulates expression of at least one host target gene, the function and utility of which at least one host target gene is known in the art.

VGR3212 gene, herein designated VGR GENE, is a novel bioinformatically detected regulatory, non protein coding, RNA viral gene. The method by which VGR3212 gene was detected is described hereinabove with reference to FIGS. 1-9.

VGR3212 gene encodes VGR3212 precursor RNA, herein designated VGR PRECURSOR RNA, an RNA molecule, typically several hundred nucleotides long.

VGR3212 precursor RNA folds spatially, forming VGR3212 folded precursor RNA, herein designated VGR FOLDED PRECURSOR RNA. It is appreciated that VGR3212 folded precursor RNA comprises a plurality of what is known in the art as 'hairpin' structures. These 'hairpin' structures are due to the fact that the nucleotide sequence of VGR3212 precursor RNA comprises a plurality of segments, the first half of each such segment having a nucleotide sequence which is at least a partial inversed-reversed sequence of the second half thereof, as is well known in the art.

VGR3212 folded precursor RNA is naturally processed by cellular enzymatic activity into at least 8 separate VGAM precursor RNAs, VGAM2281 precursor RNA, VGAM2282 precursor RNA, VGAM2283 precursor RNA, VGAM2284 precursor RNA, VGAM2285 precursor RNA, VGAM2286 precursor RNA, VGAM2287 precursor RNA and VGAM2288 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2281 RNA, VGAM2282 RNA, VGAM2283 RNA, VGAM2284 RNA, VGAM2285 RNA, VGAM2286 RNA, VGAM2287 RNA and VGAM2288 RNA, herein schematically represented by VGAM1 RNA through VGAM3 RNA, each of which VGAM RNAs corresponding to VGAM RNA of FIG. 1.

VGAM2281 RNA, herein schematically represented by VGAM1 RNA through VGAM3 RNA, binds complementarily to a host target binding site located in an untranslated region of VGAM2281 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2281 host target RNA into VGAM2281 host target protein, herein schematically represented by VGAM1 HOST TARGET PROTEIN through VGAM3 HOST TARGET PROTEIN, all of FIG. 1.

VGAM2282 RNA, herein schematically represented by VGAM1 RNA through VGAM3 RNA, binds complementarily to a host target binding site located in an untranslated region of VGAM2282 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2282 host target RNA into VGAM2282 host target protein, herein schematically represented by VGAM1 HOST TARGET PROTEIN through VGAM3 HOST TARGET PROTEIN, all of FIG. 1.

VGAM2283 RNA, herein schematically represented by VGAM1 RNA through VGAM3 RNA, binds complementarily to a host target binding site located in an untranslated region of VGAM2283 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2283 host target RNA into VGAM2283 host target protein, herein schematically represented by VGAM1 HOST TARGET PROTEIN through VGAM3 HOST TARGET PROTEIN, all of FIG. 1.

VGAM2284 RNA, herein schematically represented by VGAM1 RNA through VGAM3 RNA, binds complementarily to a host target binding site located in an untranslated region of VGAM2284 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2284 host target RNA into VGAM2284 host target protein, herein schematically represented by VGAM1 HOST TARGET PROTEIN through VGAM3 HOST TARGET PROTEIN, all of FIG. 1.

VGAM2285 RNA, herein schematically represented by VGAM1 RNA through VGAM3 RNA, binds complementarily to a host target binding site located in an untranslated region of VGAM2285 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2285 host target RNA into VGAM2285 host target protein, herein schematically represented by VGAM1 HOST TARGET PROTEIN through VGAM3 HOST TARGET PROTEIN, all of FIG. 1.

VGAM2286 RNA, herein schematically represented by VGAM1 RNA through VGAM3 RNA, binds complementarily to a host target binding site located in an untranslated region of VGAM2286 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2286 host target RNA into VGAM2286 host target protein, herein schematically represented by VGAM1 HOST TARGET PROTEIN through VGAM3 HOST TARGET PROTEIN, all of FIG. 1.

VGAM2287 RNA, herein schematically represented by VGAM1 RNA through VGAM3 RNA, binds complementarily to a host target binding site located in an untranslated region of VGAM2287 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2287 host target RNA into VGAM2287 host target protein, herein schematically represented by VGAM1 HOST TARGET PROTEIN through VGAM3 HOST TARGET PROTEIN, all of FIG. 1.

VGAM2288 RNA, herein schematically represented by VGAM1 RNA through VGAM3 RNA, binds complementarily to a host target binding site located in an untranslated region of VGAM2288 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2288 host target RNA into VGAM2288 host target protein, herein schematically represented by VGAM1 HOST TARGET PROTEIN through VGAM3 HOST TARGET PROTEIN, all of FIG. 1.

It is appreciated that a function of VGR3212 gene, herein designated VGR GENE, is inhibition of expression of host target genes, as part of a novel viral mechanism of attacking a host. Accordingly, utilities of VGR3212 gene include diagnosis, prevention and treatment of viral infection by Murine Hepatitis Virus. Specific functions, and accordingly utilities, of VGR3212 gene correlate with, and may be deduced from, the identity of the host target genes, which are inhibited by VGAM RNAs comprised in the 'operon-like' cluster of VGR3212 gene: VGAM2281 host target protein, VGAM2282 host target protein, VGAM2283 host target protein, VGAM2284 host target protein, VGAM2285 host target protein, VGAM2286 host target protein, VGAM2287 host target protein and VGAM2288 host target protein, herein schematically represented by VGAM1 HOST TARGET PROTEIN through VGAM3 HOST TARGET PROTEIN. The function of these host target genes is elaborated hereinabove with reference to VGAM2281, VGAM2282, VGAM2283, VGAM2284, VGAM2285, VGAM2286, VGAM2287 and VGAM2288. FIG. 9 further provides a conceptual description of novel bioinformatically detected regulatory viral gene, referred to here as Viral Genomic Record 3213(VGR3213) viral gene, which encodes an 'operon-like' cluster of novel viral micro RNA-like genes, each of which in turn modulates expression of at least one host target gene, the function and utility of which at least one host target gene is known in the art.

VGR3213 gene, herein designated VGR GENE, is a novel bioinformatically detected regulatory, non protein coding, RNA viral gene. The method by which VGR3213 gene was detected is described hereinabove with reference to FIGS. 1-9.

VGR3213 gene encodes VGR3213 precursor RNA, herein designated VGR PRECURSOR RNA, an RNA molecule, typically several hundred nucleotides long.

VGR3213 precursor RNA folds spatially, forming VGR3213 folded precursor RNA, herein designated VGR FOLDED PRECURSOR RNA. It is appreciated that VGR3213 folded precursor RNA comprises a plurality of what is known in the art as 'hairpin' structures. These 'hairpin' structures are due to the fact that the nucleotide sequence of VGR3213 precursor RNA comprises a plurality of segments, the first half of each such segment having a nucleotide sequence which is at least a partial inversed-reversed sequence of the second half thereof, as is well known in the art.

VGR3213 folded precursor RNA is naturally processed by cellular enzymatic activity into at least 6 separate VGAM precursor RNAs, VGAM2289 precursor RNA, VGAM2290 precursor RNA, VGAM2291 precursor RNA, VGAM2292 precursor RNA, VGAM2293 precursor RNA and VGAM2294 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2289 RNA, VGAM2290 RNA, VGAM2291 RNA, VGAM2292 RNA, VGAM2293 RNA and VGAM2294 RNA, herein schematically represented by VGAM1 RNA through VGAM3 RNA, each of which VGAM RNAs corresponding to VGAM RNA of FIG. 1.

VGAM2289 RNA, herein schematically represented by VGAM1 RNA through VGAM3 RNA, binds complementarily to a host target binding site located in an untranslated region of VGAM2289 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2289 host target RNA into VGAM2289 host target protein, herein schematically represented by VGAM1 HOST TARGET PROTEIN through VGAM3 HOST TARGET PROTEIN, all of FIG. 1.

VGAM2290 RNA, herein schematically represented by VGAM1 RNA through VGAM3 RNA, binds complementarily to a host target binding site located in an untranslated region of VGAM2290 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2290 host target RNA into VGAM2290 host target protein, herein schematically represented by VGAM1 HOST TARGET PROTEIN through VGAM3 HOST TARGET PROTEIN, all of FIG. 1.

VGAM2291 RNA, herein schematically represented by VGAM1 RNA through VGAM3 RNA, binds complementarily to a host target binding site located in an untranslated region of VGAM2291 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2291 host target RNA into VGAM2291 host target protein, herein schematically represented by VGAM1 HOST TARGET PROTEIN through VGAM3 HOST TARGET PROTEIN, all of FIG. 1.

VGAM2292 RNA, herein schematically represented by VGAM1 RNA through VGAM3 RNA, binds complementarily to a host target binding site located in an untranslated region of VGAM2292 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2292 host target RNA into VGAM2292 host target protein, herein schematically represented by VGAM1 HOST TARGET PROTEIN through VGAM3 HOST TARGET PROTEIN, all of FIG. 1.

VGAM2293 RNA, herein schematically represented by VGAM1 RNA through VGAM3 RNA, binds complementarily to a host target binding site located in an untranslated region of VGAM2293 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2293 host target RNA into VGAM2293 host target protein, herein schematically represented by VGAM1 HOST TARGET PROTEIN through VGAM3 HOST TARGET PROTEIN, all of FIG. 1.

VGAM2294 RNA, herein schematically represented by VGAM1 RNA through VGAM3 RNA, binds complementarily to a host target binding site located in an untranslated region of VGAM2294 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2294 host target RNA into VGAM2294 host target protein, herein schematically represented by VGAM1 HOST TARGET PROTEIN through VGAM3 HOST TARGET PROTEIN, all of FIG. 1.

It is appreciated that a function of VGR3213 gene, herein designated VGR GENE, is inhibition of expression of host target genes, as part of a novel viral mechanism of attacking a host. Accordingly, utilities of VGR3213 gene include diagnosis, prevention and treatment of viral infection by Murine Hepatitis Virus. Specific functions, and accordingly utilities, of VGR3213 gene correlate with, and may be deduced from, the identity of the host target genes, which are inhibited by VGAM RNAs comprised in the 'operon-like' cluster of VGR3213 gene: VGAM2289 host target protein, VGAM2290 host target protein, VGAM2291 host target protein, VGAM2292 host target protein, VGAM2293 host target protein and VGAM2294 host target protein, herein schematically represented by VGAM1 HOST TARGET PROTEIN through VGAM3 HOST TARGET PROTEIN. The function of these host target genes is elaborated hereinabove with reference to VGAM2289, VGAM2290, VGAM2291, VGAM2292, VGAM2293 and VGAM2294. FIG. 9 further provides a conceptual description of novel bioinformatically detected regulatory viral gene, referred to here as Viral Genomic Record 3214(VGR3214) viral gene, which encodes an 'operon-like' cluster of novel viral micro RNA-like genes, each of which in turn modulates expression of at least one host target gene, the function and utility of which at least one host target gene is known in the art.

VGR3214 gene, herein designated VGR GENE, is a novel bioinformatically detected regulatory, non protein coding, RNA viral gene. The method by which VGR3214 gene was detected is described hereinabove with reference to FIGS. 1-9.

VGR3214 gene encodes VGR3214 precursor RNA, herein designated VGR PRECURSOR RNA, an RNA molecule, typically several hundred nucleotides long.

VGR3214 precursor RNA folds spatially, forming VGR3214 folded precursor RNA, herein designated VGR FOLDED PRECURSOR RNA. It is appreciated that VGR3214 folded precursor RNA comprises a plurality of what is known in the art as 'hairpin' structures. These 'hairpin' structures are due to the fact that the nucleotide sequence of VGR3214 precursor RNA comprises a plurality of segments, the first half of each such segment having a nucleotide sequence which is at least a partial inversed-reversed sequence of the second half thereof, as is well known in the art.

VGR3214 folded precursor RNA is naturally processed by cellular enzymatic activity into at least 8 separate VGAM precursor RNAs, VGAM2295 precursor RNA, VGAM2296 precursor RNA, VGAM2297 precursor RNA, VGAM2298 precursor RNA, VGAM2299 precursor RNA, VGAM2300 precursor RNA, VGAM2301 precursor RNA and VGAM2302 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2295 RNA, VGAM2296 RNA, VGAM2297 RNA, VGAM2298 RNA, VGAM2299 RNA, VGAM2300 RNA, VGAM2301 RNA and VGAM2302 RNA, herein schematically represented by VGAM1 RNA through VGAM3 RNA, each of which VGAM RNAs corresponding to VGAM RNA of FIG. 1.

VGAM2295 RNA, herein schematically represented by VGAM1 RNA through VGAM3 RNA, binds complementarily to a host target binding site located in an untranslated region of VGAM2295 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2295 host target RNA into VGAM2295 host target protein, herein schematically represented by VGAM1 HOST TARGET PROTEIN through VGAM3 HOST TARGET PROTEIN, all of FIG. 1.

VGAM2296 RNA, herein schematically represented by VGAM1 RNA through VGAM3 RNA, binds complementarily to a host target binding site located in an untranslated region of VGAM2296 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2296 host target RNA into VGAM2296 host target protein, herein schematically represented by VGAM1 HOST TARGET PROTEIN through VGAM3 HOST TARGET PROTEIN, all of FIG. 1.

VGAM2297 RNA, herein schematically represented by VGAM1 RNA through VGAM3 RNA, binds complementarily to a host target binding site located in an untranslated region of VGAM2297 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2297 host target RNA into VGAM2297 host target protein, herein schematically represented by VGAM1 HOST TARGET PROTEIN through VGAM3 HOST TARGET PROTEIN, all of FIG. 1.

VGAM2298 RNA, herein schematically represented by VGAM1 RNA through VGAM3 RNA, binds complementarily to a host target binding site located in an untranslated region of VGAM2298 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2298 host target RNA into VGAM2298 host target protein, herein schematically represented by VGAM1 HOST TARGET PROTEIN through VGAM3 HOST TARGET PROTEIN, all of FIG. 1.

VGAM2299 RNA, herein schematically represented by VGAM1 RNA through VGAM3 RNA, binds complementarily to a host target binding site located in an untranslated region of VGAM2299 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2299 host target RNA into VGAM2299 host target protein, herein schematically represented by VGAM1 HOST TARGET PROTEIN through VGAM3 HOST TARGET PROTEIN, all of FIG. 1.

VGAM2300 RNA, herein schematically represented by VGAM1 RNA through VGAM3 RNA, binds complementarily to a host target binding site located in an untranslated region of VGAM2300 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2300 host target RNA into VGAM2300 host target protein, herein schematically represented by VGAM1 HOST TARGET PROTEIN through VGAM3 HOST TARGET PROTEIN, all of FIG. 1.

VGAM2301 RNA, herein schematically represented by VGAM1 RNA through VGAM3 RNA, binds complementarily to a host target binding site located in an untranslated region of VGAM2301 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2301 host target RNA into VGAM2301 host target protein, herein schematically represented by VGAM1 HOST TARGET PROTEIN through VGAM3 HOST TARGET PROTEIN, all of FIG. 1.

VGAM2302 RNA, herein schematically represented by VGAM1 RNA through VGAM3 RNA, binds complementarily to a host target binding site located in an untranslated region of VGAM2302 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2302 host target RNA into VGAM2302 host target protein, herein schematically represented by VGAM1 HOST TARGET PROTEIN through VGAM3 HOST TARGET PROTEIN, all of FIG. 1.

It is appreciated that a function of VGR3214 gene, herein designated VGR GENE, is inhibition of expression of host target genes, as part of a novel viral mechanism of attacking a host. Accordingly, utilities of VGR3214 gene include diagnosis, prevention and treatment of viral infection by Ectromelia Virus. Specific functions, and accordingly utilities, of VGR3214 gene correlate with, and may be deduced from, the identity of the host target genes, which are inhibited by VGAM RNAs comprised in the 'operon-like' cluster of VGR3214 gene: VGAM2295 host target protein, VGAM2296 host target protein, VGAM2297 host target protein, VGAM2298 host target protein, VGAM2299 host target protein, VGAM2300 host target protein, VGAM2301 host target protein and VGAM2302 host target protein, herein schematically represented by VGAM1 HOST TARGET PROTEIN through VGAM3 HOST TARGET PROTEIN. The function of these host target genes is elaborated hereinabove with reference to VGAM2295, VGAM2296, VGAM2297, VGAM2298, VGAM2299, VGAM2300, VGAM2301 and VGAM2302. FIG. 9 further provides a conceptual description of novel bioinformatically detected regulatory viral gene, referred to here as Viral Genomic Record 3215(VGR3215) viral gene, which encodes an 'operon-like' cluster of novel viral micro RNA-like genes, each of which in turn modulates expression of at least one host target gene, the function and utility of which at least one host target gene is known in the art.

VGR3215 gene, herein designated VGR GENE, is a novel bioinformatically detected regulatory, non protein coding, RNA viral gene. The method by which VGR3215 gene was detected is described hereinabove with reference to FIGS. 1-9.

VGR3215 gene encodes VGR3215 precursor RNA, herein designated VGR PRECURSOR RNA, an RNA molecule, typically several hundred nucleotides long.

VGR3215 precursor RNA folds spatially, forming VGR3215 folded precursor RNA, herein designated VGR FOLDED PRECURSOR RNA. It is appreciated that VGR3215 folded precursor RNA comprises a plurality of what is known in the art as 'hairpin' structures. These 'hairpin' structures are due to the fact that the nucleotide sequence of VGR3215 precursor RNA comprises a plurality of segments, the first half of each such segment having a nucleotide sequence which is at least a partial inversed-reversed sequence of the second half thereof, as is well known in the art.

VGR3215 folded precursor RNA is naturally processed by cellular enzymatic activity into at least 4 separate VGAM precursor RNAs, VGAM2303 precursor RNA, VGAM2304 precursor RNA, VGAM2305 precursor RNA and VGAM2306 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2303 RNA, VGAM2304 RNA, VGAM2305 RNA and VGAM2306 RNA, herein schematically represented by VGAM1 RNA through VGAM3 RNA, each of which VGAM RNAs corresponding to VGAM RNA of FIG. 1.

VGAM2303 RNA, herein schematically represented by VGAM1 RNA through VGAM3 RNA, binds complementarily to a host target binding site located in an untranslated region of VGAM2303 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2303 host target RNA into VGAM2303 host target protein, herein schematically represented by VGAM1 HOST TARGET PROTEIN through VGAM3 HOST TARGET PROTEIN, all of FIG. 1.

VGAM2304 RNA, herein schematically represented by VGAM1 RNA through VGAM3 RNA, binds complementarily to a host target binding site located in an untranslated region of VGAM2304 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2304 host target RNA into VGAM2304 host target protein, herein schematically represented by VGAM1 HOST TARGET PROTEIN through VGAM3 HOST TARGET PROTEIN, all of FIG. 1.

VGAM2305 RNA, herein schematically represented by VGAM1 RNA through VGAM3 RNA, binds complementarily to a host target binding site located in an untranslated region of VGAM2305 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2305 host target RNA into VGAM2305 host target protein, herein schematically represented by VGAM1 HOST TARGET PROTEIN through VGAM3 HOST TARGET PROTEIN, all of FIG. 1.

VGAM2306 RNA, herein schematically represented by VGAM1 RNA through VGAM3 RNA, binds complementarily to a host target binding site located in an untranslated region of VGAM2306 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2306 host target RNA into VGAM2306 host target protein, herein schematically represented by VGAM1 HOST TARGET PROTEIN through VGAM3 HOST TARGET PROTEIN, all of FIG. 1.

It is appreciated that a function of VGR3215 gene, herein designated VGR GENE, is inhibition of expression of host target genes, as part of a novel viral mechanism of attacking a host. Accordingly, utilities of VGR3215 gene include diagnosis, prevention and treatment of viral infection by Ectromelia Virus. Specific functions, and accordingly utilities, of VGR3215 gene correlate with, and may be deduced from, the identity of the host target genes, which are inhibited by VGAM RNAs comprised in the 'operon-like' cluster of VGR3215 gene: VGAM2303 host target protein, VGAM2304 host target protein, VGAM2305 host target protein and VGAM2306 host target protein, herein schematically represented by VGAM1 HOST TARGET PROTEIN through VGAM3 HOST TARGET PROTEIN. The function of these host target genes is elaborated hereinabove with reference to VGAM2303, VGAM2304, VGAM2305 and VGAM2306.

FIG. 9 further provides a conceptual description of novel bioinformatically detected regulatory viral gene, referred to here as Viral Genomic Record 3216(VGR3216) viral gene, which encodes an 'operon-like' cluster of novel viral micro RNA-like genes, each of which in turn modulates expression of at least one host target gene, the function and utility of which at least one host target gene is known in the art.

VGR3216 gene, herein designated VGR GENE, is a novel bioinformatically detected regulatory, non protein coding, RNA viral gene. The method by which VGR3216 gene was detected is described hereinabove with reference to FIGS. 1-9.

VGR3216 gene encodes VGR3216 precursor RNA, herein designated VGR PRECURSOR RNA, an RNA molecule, typically several hundred nucleotides long.

VGR3216 precursor RNA folds spatially, forming VGR3216 folded precursor RNA, herein designated VGR FOLDED PRECURSOR RNA. It is appreciated that VGR3216 folded precursor RNA comprises a plurality of what is known in the art as 'hairpin' structures. These 'hairpin' structures are due to the fact that the nucleotide sequence of VGR3216 precursor RNA comprises a plurality of segments, the first half of each such segment having a nucleotide sequence which is at least a partial inversed-reversed sequence of the second half thereof, as is well known in the art.

VGR3216 folded precursor RNA is naturally processed by cellular enzymatic activity into at least 7 separate VGAM precursor RNAs, VGAM2307 precursor RNA, VGAM2308 precursor RNA, VGAM2309 precursor RNA, VGAM2310 precursor RNA, VGAM2311 precursor RNA, VGAM2312 precursor RNA and VGAM2313 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2307 RNA, VGAM2308 RNA, VGAM2309 RNA, VGAM2310 RNA, VGAM2311 RNA, VGAM2312 RNA and VGAM2313 RNA, herein schematically represented by VGAM1 RNA through VGAM3 RNA, each of which VGAM RNAs corresponding to VGAM RNA of FIG. 1.

VGAM2307 RNA, herein schematically represented by VGAM1 RNA through VGAM3 RNA, binds complementarily to a host target binding site located in an untranslated region of VGAM2307 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2307 host target RNA into VGAM2307 host target protein, herein schematically represented by VGAM1 HOST TARGET PROTEIN through VGAM3 HOST TARGET PROTEIN, all of FIG. 1.

VGAM2308 RNA, herein schematically represented by VGAM1 RNA through VGAM3 RNA, binds complementarily to a host target binding site located in an untranslated region of VGAM2308 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2308 host target RNA into VGAM2308 host target protein, herein schematically represented by VGAM1 HOST TARGET PROTEIN through VGAM3 HOST TARGET PROTEIN, all of FIG. 1.

VGAM2309 RNA, herein schematically represented by VGAM1 RNA through VGAM3 RNA, binds complementarily to a host target binding site located in an untranslated region of VGAM2309 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2309 host target RNA into VGAM2309 host target protein, herein schematically represented by VGAM1 HOST TARGET PROTEIN through VGAM3 HOST TARGET PROTEIN, all of FIG. 1.

VGAM2310 RNA, herein schematically represented by VGAM1 RNA through VGAM3 RNA, binds complementarily to a host target binding site located in an untranslated region of VGAM2310 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2310 host target RNA into VGAM2310 host target protein, herein schematically represented by VGAM1 HOST TARGET PROTEIN through VGAM3 HOST TARGET PROTEIN, all of FIG. 1.

VGAM2311 RNA, herein schematically represented by VGAM1 RNA through VGAM3 RNA, binds complementarily to a host target binding site located in an untranslated region of VGAM2311 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2311 host target RNA into VGAM2311 host target protein, herein schematically represented by VGAM1 HOST TARGET PROTEIN through VGAM3 HOST TARGET PROTEIN, all of FIG. 1.

VGAM2312 RNA, herein schematically represented by VGAM1 RNA through VGAM3 RNA, binds complementarily to a host target binding site located in an untranslated region of VGAM2312 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2312 host target RNA into VGAM2312 host target protein, herein schematically represented by VGAM1 HOST TARGET PROTEIN through VGAM3 HOST TARGET PROTEIN, all of FIG. 1.

VGAM2313 RNA, herein schematically represented by VGAM1 RNA through VGAM3 RNA, binds complementarily to a host target binding site located in an untranslated region of VGAM2313 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2313 host target RNA into VGAM2313 host target protein, herein schematically represented by VGAM1 HOST TARGET PROTEIN through VGAM3 HOST TARGET PROTEIN, all of FIG. 1.

It is appreciated that a function of VGR3216 gene, herein designated VGR GENE, is inhibition of expression of host target genes, as part of a novel viral mechanism of attacking a host. Accordingly, utilities of VGR3216 gene include diagnosis, prevention and treatment of viral infection by Lumpy Skin Disease Virus. Specific functions, and accordingly utilities, of VGR3216 gene correlate with, and may be deduced from, the identity of the host target genes, which are inhibited by VGAM RNAs comprised in the 'operon-like' cluster of VGR3216 gene: VGAM2307 host target protein, VGAM2308 host target protein, VGAM2309 host target protein, VGAM2310 host target protein, VGAM2311 host target protein, VGAM2312 host target protein and VGAM2313 host target protein, herein schematically represented by VGAM1 HOST TARGET PROTEIN through VGAM3 HOST TARGET PROTEIN. The function of these host target genes is elaborated hereinabove with reference to VGAM2307, VGAM2308, VGAM2309, VGAM2310, VGAM2311, VGAM2312 and VGAM2313. FIG. 9 further provides a conceptual description of novel bioinformatically detected regulatory viral gene, referred to here as Viral Genomic Record 3217(VGR3217) viral gene, which encodes an 'operon-like' cluster of novel viral micro RNA-like genes, each of which in turn modulates expression of at least one host target gene, the function and utility of which at least one host target gene is known in the art.

VGR3217 gene, herein designated VGR GENE, is a novel bioinformatically detected regulatory, non protein coding, RNA viral gene. The method by which VGR3217 gene was detected is described hereinabove with reference to FIGS. 1-9.

VGR3217 gene encodes VGR3217 precursor RNA, herein designated VGR PRECURSOR RNA, an RNA molecule, typically several hundred nucleotides long.

VGR3217 precursor RNA folds spatially, forming VGR3217 folded precursor RNA, herein designated VGR FOLDED PRECURSOR RNA. It is appreciated that VGR3217 folded precursor RNA comprises a plurality of what is known in the art as 'hairpin' structures. These 'hairpin' structures are due to the fact that the nucleotide sequence of VGR3217 precursor RNA comprises a plurality of segments, the first half of each such segment having a nucleotide sequence which is at least a partial inversed-reversed sequence of the second half thereof, as is well known in the art.

VGR3217 folded precursor RNA is naturally processed by cellular enzymatic activity into at least 2 separate VGAM precursor RNAs, VGAM2314 precursor RNA and VGAM2315 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2314 RNA and VGAM2315 RNA, herein schematically represented by VGAM1 RNA through VGAM3 RNA, each of which VGAM RNAs corresponding to VGAM RNA of FIG. 1.

VGAM2314 RNA, herein schematically represented by VGAM1 RNA through VGAM3 RNA, binds complementarily to a host target binding site located in an untranslated region of VGAM2314 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2314 host target RNA into VGAM2314 host target protein, herein schematically represented by VGAM1 HOST TARGET PROTEIN through VGAM3 HOST TARGET PROTEIN, all of FIG. 1.

VGAM2315 RNA, herein schematically represented by VGAM1 RNA through VGAM3 RNA, binds complementarily to a host target binding site located in an untranslated region of VGAM2315 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2315 host target RNA into VGAM2315 host target protein, herein schematically represented by VGAM1 HOST TARGET PROTEIN through VGAM3 HOST TARGET PROTEIN, all of FIG. 1.

It is appreciated that a function of VGR3217 gene, herein designated VGR GENE, is inhibition of expression of host target genes, as part of a novel viral mechanism of attacking a host. Accordingly, utilities of VGR3217 gene include diagnosis, prevention and treatment of viral infection by Lumpy Skin Disease Virus. Specific functions, and accordingly utilities, of VGR3217 gene correlate with, and may be deduced from, the identity of the host target genes, which are inhibited by VGAM RNAs comprised in the 'operon-like' cluster of VGR3217 gene: VGAM2314 host target protein and VGAM2315 host target protein, herein schematically represented by VGAM1 HOST TARGET PROTEIN through VGAM3 HOST TARGET PROTEIN. The function of these host target genes is elaborated hereinabove with reference to VGAM2314 and VGAM2315. FIG. 9 further provides a conceptual description of novel bioinformatically detected regulatory viral gene, referred to here as Viral Genomic Record 3218(VGR3218) viral gene, which encodes an 'operon-like' cluster of novel viral micro RNA-like genes, each of which in turn modulates expression of at least one host target gene, the function and utility of which at least one host target gene is known in the art.

VGR3218 gene, herein designated VGR GENE, is a novel bioinformatically detected regulatory, non protein coding, RNA viral gene. The method by which VGR3218 gene was detected is described hereinabove with reference to FIGS. 1-9.

VGR3218 gene encodes VGR3218 precursor RNA, herein designated VGR PRECURSOR RNA, an RNA molecule, typically several hundred nucleotides long.

VGR3218 precursor RNA folds spatially, forming VGR3218 folded precursor RNA, herein designated VGR FOLDED PRECURSOR RNA. It is appreciated that VGR3218 folded precursor RNA comprises a plurality of what is known in the art as 'hairpin' structures. These 'hairpin' structures are due to the fact that the nucleotide sequence of VGR3218 precursor RNA comprises a plurality of segments, the first half of each such segment having a nucleotide sequence which is at least a partial inversed-reversed sequence of the second half thereof, as is well known in the art.

VGR3218 folded precursor RNA is naturally processed by cellular enzymatic activity into at least 8 separate VGAM precursor RNAs, VGAM2316 precursor RNA, VGAM2317 precursor RNA, VGAM2318 precursor RNA, VGAM2319 precursor RNA, VGAM2320 precursor RNA, VGAM2321 precursor RNA, VGAM2322 precursor RNA and VGAM2323 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2316 RNA, VGAM2317 RNA, VGAM2318 RNA, VGAM2319 RNA, VGAM2320 RNA, VGAM2321 RNA, VGAM2322 RNA and VGAM2323 RNA, herein schematically represented by VGAM1 RNA through VGAM3 RNA, each of which VGAM RNAs corresponding to VGAM RNA of FIG. 1.

VGAM2316 RNA, herein schematically represented by VGAM1 RNA through VGAM3 RNA, binds complementarily to a host target binding site located in an untranslated region of VGAM2316 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2316 host target RNA into VGAM2316 host target protein, herein schematically represented by VGAM1 HOST TARGET PROTEIN through VGAM3 HOST TARGET PROTEIN, all of FIG. 1.

VGAM2317 RNA, herein schematically represented by VGAM1 RNA through VGAM3 RNA, binds complementarily to a host target binding site located in an untranslated region of VGAM2317 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2317 host target RNA into VGAM2317 host target protein, herein schematically represented by VGAM1 HOST TARGET PROTEIN through VGAM3 HOST TARGET PROTEIN, all of FIG. 1.

VGAM2318 RNA, herein schematically represented by VGAM1 RNA through VGAM3 RNA, binds complementarily to a host target binding site located in an untranslated region of VGAM2318 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2318 host target RNA into VGAM2318 host target protein, herein schematically represented by VGAM1 HOST TARGET PROTEIN through VGAM3 HOST TARGET PROTEIN, all of FIG. 1.

VGAM2319 RNA, herein schematically represented by VGAM1 RNA through VGAM3 RNA, binds complementarily to a host target binding site located in an untranslated region of VGAM2319 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2319 host target RNA into VGAM2319 host target protein, herein schematically represented by VGAM1 HOST TARGET PROTEIN through VGAM3 HOST TARGET PROTEIN, all of FIG. 1.

VGAM2320 RNA, herein schematically represented by VGAM1 RNA through VGAM3 RNA, binds complementarily to a host target binding site located in an untranslated region of VGAM2320 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2320 host target RNA into VGAM2320 host target protein, herein schematically represented by VGAM1 HOST TARGET PROTEIN through VGAM3 HOST TARGET PROTEIN, all of FIG. 1.

VGAM2321 RNA, herein schematically represented by VGAM1 RNA through VGAM3 RNA, binds complementarily to a host target binding site located in an untranslated region of VGAM2321 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2321 host target RNA into VGAM2321 host target protein, herein schematically represented by VGAM1 HOST TARGET PROTEIN through VGAM3 HOST TARGET PROTEIN, all of FIG. 1.

VGAM2322 RNA, herein schematically represented by VGAM1 RNA through VGAM3 RNA, binds complementarily to a host target binding site located in an untranslated region of VGAM2322 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2322 host target RNA into VGAM2322 host target protein, herein schematically represented by VGAM1 HOST TARGET PROTEIN through VGAM3 HOST TARGET PROTEIN, all of FIG. 1.

VGAM2323 RNA, herein schematically represented by VGAM1 RNA through VGAM3 RNA, binds complementarily to a host target binding site located in an untranslated region of VGAM2323 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2323 host target RNA into VGAM2323 host target protein, herein schematically represented by VGAM1 HOST TARGET PROTEIN through VGAM3 HOST TARGET PROTEIN, all of FIG. 1.

It is appreciated that a function of VGR3218 gene, herein designated VGR GENE, is inhibition of expression of host target genes, as part of a novel viral mechanism of attacking a host. Accordingly, utilities of VGR3218 gene include diagnosis, prevention and treatment of viral infection by Rana Tigrina Ranavirus. Specific functions, and accordingly utilities, of VGR3218 gene correlate with, and may be deduced from, the identity of the host target genes, which are inhibited by VGAM RNAs comprised in the 'operon-like' cluster of VGR3218 gene: VGAM2316 host target protein, VGAM2317 host target protein, VGAM2318 host target protein, VGAM2319 host target protein, VGAM2320 host target protein, VGAM2321 host target protein, VGAM2322 host target protein and VGAM2323 host target protein, herein schematically represented by VGAM1 HOST TARGET PROTEIN through VGAM3 HOST TARGET PROTEIN. The function of these host target genes is elaborated hereinabove with reference to VGAM2316, VGAM2317, VGAM2318, VGAM2319, VGAM2320, VGAM2321, VGAM2322 and VGAM2323. FIG. 9 further provides a conceptual description of novel bioinformatically detected regulatory viral gene, referred to here as Viral Genomic Record 3219(VGR3219) viral gene, which encodes an 'operon-like' cluster of novel viral micro RNA-like genes, each of which in turn modulates expression of at least one host target gene, the function and utility of which at least one host target gene is known in the art.

VGR3219 gene, herein designated VGR GENE, is a novel bioinformatically detected regulatory, non protein coding, RNA viral gene. The method by which VGR3219 gene was detected is described hereinabove with reference to FIGS. 1-9.

VGR3219 gene encodes VGR3219 precursor RNA, herein designated VGR PRECURSOR RNA, an RNA molecule, typically several hundred nucleotides long.

VGR3219 precursor RNA folds spatially, forming VGR3219 folded precursor RNA, herein designated VGR FOLDED PRECURSOR RNA. It is appreciated that VGR3219 folded precursor RNA comprises a plurality of what is known in the art as 'hairpin' structures. These 'hairpin' structures are due to the fact that the nucleotide sequence of VGR3219 precursor RNA comprises a plurality of segments, the first half of each such segment having a nucleotide sequence which is at least a partial inversed-reversed sequence of the second half thereof, as is well known in the art.

VGR3219 folded precursor RNA is naturally processed by cellular enzymatic activity into at least 5 separate VGAM precursor RNAs, VGAM2324 precursor RNA, VGAM2325 precursor RNA, VGAM2326 precursor RNA, VGAM2327 precursor RNA and VGAM2328 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2324 RNA, VGAM2325 RNA, VGAM2326 RNA, VGAM2327 RNA and VGAM2328 RNA, herein schematically represented by VGAM1 RNA through VGAM3 RNA, each of which VGAM RNAs corresponding to VGAM RNA of FIG. 1.

VGAM2324 RNA, herein schematically represented by VGAM1 RNA through VGAM3 RNA, binds complementarily to a host target binding site located in an untranslated region of VGAM2324 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2324 host target RNA into VGAM2324 host target protein, herein schematically represented by VGAM1 HOST TARGET PROTEIN through VGAM3 HOST TARGET PROTEIN, all of FIG. 1.

VGAM2325 RNA, herein schematically represented by VGAM1 RNA through VGAM3 RNA, binds complementarily to a host target binding site located in an untranslated region of VGAM2325 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2325 host target RNA into VGAM2325 host target protein, herein schematically represented by VGAM1 HOST TARGET PROTEIN through VGAM3 HOST TARGET PROTEIN, all of FIG. 1.

VGAM2326 RNA, herein schematically represented by VGAM1 RNA through VGAM3 RNA, binds complementarily to a host target binding site located in an untranslated region of VGAM2326 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM2326 host target RNA into VGAM2326 host target protein, herein schematically represented by VGAM1 HOST TARGET PROTEIN through VGAM3 HOST TARGET PROTEIN, all of FIG. 1.

VGAM2327 RNA, herein schematically represented by VGAM1 RNA through VGAM3 RNA, binds complementarily to a host target binding site located in an untranslated region of VGAM2327 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2327 host target RNA into VGAM2327 host target protein, herein schematically represented by VGAM1 HOST TARGET PROTEIN through VGAM3 HOST TARGET PROTEIN, all of FIG. 1.

VGAM2328 RNA, herein schematically represented by VGAM1 RNA through VGAM3 RNA, binds complementarily to a host target binding site located in an untranslated region of VGAM2328 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2328 host target RNA into VGAM2328 host target protein, herein schematically represented by VGAM1 HOST TARGET PROTEIN through VGAM3 HOST TARGET PROTEIN, all of FIG. 1.

It is appreciated that a function of VGR3219 gene, herein designated VGR GENE, is inhibition of expression of host target genes, as part of a novel viral mechanism of attacking a host. Accordingly, utilities of VGR3219 gene include diagnosis, prevention and treatment of viral infection by Rana Tigrina Ranavirus. Specific functions, and accordingly utilities, of VGR3219 gene correlate with, and may be deduced from, the identity of the host target genes, which are inhibited by VGAM RNAs comprised in the 'operon-like' cluster of VGR3219 gene: VGAM2324 host target protein, VGAM2325 host target protein, VGAM2326 host target protein, VGAM2327 host target protein and VGAM2328 host target protein, herein schematically represented by VGAM1 HOST TARGET PROTEIN through VGAM3 HOST TARGET PROTEIN. The function of these host target genes is elaborated hereinabove with reference to VGAM2324, VGAM2325, VGAM2326, VGAM2327 and VGAM2328. FIG. 9 further provides a conceptual description of novel bioinformatically detected regulatory viral gene, referred to here as Viral Genomic Record 3220(VGR3220) viral gene, which encodes an 'operon-like' cluster of novel viral micro RNA-like genes, each of which in turn modulates expression of at least one host target gene, the function and utility of which at least one host target gene is known in the art.

VGR3220 gene, herein designated VGR GENE, is a novel bioinformatically detected regulatory, non protein coding, RNA viral gene. The method by which VGR3220 gene was detected is described hereinabove with reference to FIGS. 1-9.

VGR3220 gene encodes VGR3220 precursor RNA, herein designated VGR PRECURSOR RNA, an RNA molecule, typically several hundred nucleotides long.

VGR3220 precursor RNA folds spatially, forming VGR3220 folded precursor RNA, herein designated VGR FOLDED PRECURSOR RNA. It is appreciated that VGR3220 folded precursor RNA comprises a plurality of what is known in the art as 'hairpin' structures. These 'hairpin' structures are due to the fact that the nucleotide sequence of VGR3220 precursor RNA comprises a plurality of segments, the first half of each such segment having a nucleotide sequence which is at least a partial inversed-reversed sequence of the second half thereof, as is well known in the art.

VGR3220 folded precursor RNA is naturally processed by cellular enzymatic activity into at least 8 separate VGAM precursor RNAs, VGAM2329 precursor RNA, VGAM2330 precursor RNA, VGAM2331 precursor RNA, VGAM2332 precursor RNA, VGAM2333 precursor RNA, VGAM2334 precursor RNA, VGAM2335 precursor RNA and VGAM2336 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2329 RNA, VGAM2330 RNA, VGAM2331 RNA, VGAM2332 RNA, VGAM2333 RNA, VGAM2334 RNA, VGAM2335 RNA and VGAM2336 RNA, herein schematically represented by VGAM1 RNA through VGAM3 RNA, each of which VGAM RNAs corresponding to VGAM RNA of FIG. 1.

VGAM2329 RNA, herein schematically represented by VGAM1 RNA through VGAM3 RNA, binds complementarily to a host target binding site located in an untranslated region of VGAM2329 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2329 host target RNA into VGAM2329 host target protein, herein schematically represented by VGAM1 HOST TARGET PROTEIN through VGAM3 HOST TARGET PROTEIN, all of FIG. 1.

VGAM2330 RNA, herein schematically represented by VGAM1 RNA through VGAM3 RNA, binds complementarily to a host target binding site located in an untranslated region of VGAM2330 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2330 host target RNA into VGAM2330 host target protein, herein schematically represented by VGAM1 HOST TARGET PROTEIN through VGAM3 HOST TARGET PROTEIN, all of FIG. 1.

VGAM2331 RNA, herein schematically represented by VGAM1 RNA through VGAM3 RNA, binds complementarily to a host target binding site located in an untranslated region of VGAM2331 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2331 host target RNA into VGAM2331 host target protein, herein schematically represented by VGAM1 HOST TARGET PROTEIN through VGAM3 HOST TARGET PROTEIN, all of FIG. 1.

VGAM2332 RNA, herein schematically represented by VGAM1 RNA through VGAM3 RNA, binds complementarily to a host target binding site located in an untranslated region of VGAM2332 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2332 host target RNA into VGAM2332 host target protein, herein schematically represented by VGAM1 HOST TARGET PROTEIN through VGAM3 HOST TARGET PROTEIN, all of FIG. 1.

VGAM2333 RNA, herein schematically represented by VGAM1 RNA through VGAM3 RNA, binds complementarily to a host target binding site located in an untranslated region of VGAM2333 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2333 host target RNA into VGAM2333 host target protein, herein schematically represented by VGAM1 HOST TARGET PROTEIN through VGAM3 HOST TARGET PROTEIN, all of FIG. 1.

VGAM2334 RNA, herein schematically represented by VGAM1 RNA through VGAM3 RNA, binds complementarily to a host target binding site located in an untranslated region of VGAM2334 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2334 host target RNA into VGAM2334 host target protein, herein schematically represented by VGAM1 HOST TARGET PROTEIN through VGAM3 HOST TARGET PROTEIN, all of FIG. 1.

VGAM2335 RNA, herein schematically represented by VGAM1 RNA through VGAM3 RNA, binds complementarily to a host target binding site located in an untranslated region of VGAM2335 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2335 host target RNA into VGAM2335 host target protein, herein schematically represented by VGAM1 HOST TARGET PROTEIN through VGAM3 HOST TARGET PROTEIN, all of FIG. 1.

VGAM2336 RNA, herein schematically represented by VGAM1 RNA through VGAM3 RNA, binds complementarily to a host target binding site located in an untranslated region of VGAM2336 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2336 host target RNA into VGAM2336 host target protein, herein schematically represented by VGAM1 HOST TARGET PROTEIN through VGAM3 HOST TARGET PROTEIN, all of FIG. 1.

It is appreciated that a function of VGR3220 gene, herein designated VGR GENE, is inhibition of expression of host target genes, as part of a novel viral mechanism of attacking a host. Accordingly, utilities of VGR3220 gene include diagnosis, prevention and treatment of viral infection by Equine Herpesvirus 2. Specific functions, and accordingly utilities, of VGR3220 gene correlate with, and may be deduced from, the identity of the host target genes, which are inhibited by VGAM RNAs comprised in the 'operon-like' cluster of VGR3220 gene: VGAM2329 host target protein, VGAM2330 host target protein, VGAM2331 host target protein, VGAM2332 host target protein, VGAM2333 host target protein, VGAM2334 host target protein, VGAM2335 host target protein and VGAM2336 host target protein, herein schematically represented by VGAM1 HOST TARGET PROTEIN through VGAM3 HOST TARGET PROTEIN. The function of these host target genes is elaborated hereinabove with reference to VGAM2329, VGAM2330, VGAM2331, VGAM2332, VGAM2333, VGAM2334, VGAM2335 and VGAM2336. FIG. 9 further provides a conceptual description of novel bioinformatically detected regulatory viral gene, referred to here as Viral Genomic Record 3221(VGR3221) viral gene, which encodes an 'operon-like' cluster of novel viral micro RNA-like genes, each of which in turn modulates expression of at least one host target gene, the function and utility of which at least one host target gene is known in the art.

VGR3221 gene, herein designated VGR GENE, is a novel bioinformatically detected regulatory, non protein coding, RNA viral gene. The method by which VGR3221 gene was detected is described hereinabove with reference to FIGS. 1-9.

VGR3221 gene encodes VGR3221 precursor RNA, herein designated VGR PRECURSOR RNA, an RNA molecule, typically several hundred nucleotides long.

VGR3221 precursor RNA folds spatially, forming VGR3221 folded precursor RNA, herein designated VGR FOLDED PRECURSOR RNA. It is appreciated that VGR3221 folded precursor RNA comprises a plurality of what is known in the art as 'hairpin' structures. These 'hairpin' structures are due to the fact that the nucleotide sequence of VGR3221 precursor RNA comprises a plurality of segments, the first half of each such segment having a nucleotide sequence which is at least a partial inversed-reversed sequence of the second half thereof, as is well known in the art.

VGR3221 folded precursor RNA is naturally processed by cellular enzymatic activity into at least 8 separate VGAM precursor RNAs, VGAM2337 precursor RNA, VGAM2338 precursor RNA, VGAM2339 precursor RNA, VGAM2340 precursor RNA, VGAM2341 precursor RNA, VGAM2342 precursor RNA, VGAM2343 precursor RNA and VGAM2344 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2337 RNA, VGAM2338 RNA, VGAM2339 RNA, VGAM2340 RNA, VGAM2341 RNA, VGAM2342 RNA, VGAM2343 RNA and VGAM2344 RNA, herein schematically represented by VGAM1 RNA through VGAM3 RNA, each of which VGAM RNAs corresponding to VGAM RNA of FIG. 1.

VGAM2337 RNA, herein schematically represented by VGAM1 RNA through VGAM3 RNA, binds complementarily to a host target binding site located in an untranslated region of VGAM2337 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2337 host target RNA into VGAM2337 host target protein, herein schematically represented by VGAM1 HOST TARGET PROTEIN through VGAM3 HOST TARGET PROTEIN, all of FIG. 1.

VGAM2338 RNA, herein schematically represented by VGAM1 RNA through VGAM3 RNA, binds complementarily to a host target binding site located in an untranslated region of VGAM2338 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2338 host target RNA into VGAM2338 host target protein, herein schematically represented by VGAM1 HOST TARGET PROTEIN through VGAM3 HOST TARGET PROTEIN, all of FIG. 1.

VGAM2339 RNA, herein schematically represented by VGAM1 RNA through VGAM3 RNA, binds complementarily to a host target binding site located in an untranslated region of VGAM2339 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2339 host target RNA into VGAM2339 host target protein, herein schematically represented by VGAM1 HOST TARGET PROTEIN through VGAM3 HOST TARGET PROTEIN, all of FIG. 1.

VGAM2340 RNA, herein schematically represented by VGAM1 RNA through VGAM3 RNA, binds complementarily to a host target binding site located in an untranslated region of VGAM2340 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2340 host target RNA into VGAM2340 host target protein, herein schematically represented by VGAM1 HOST TARGET PROTEIN through VGAM3 HOST TARGET PROTEIN, all of FIG. 1.

VGAM2341 RNA, herein schematically represented by VGAM1 RNA through VGAM3 RNA, binds complementarily to a host target binding site located in an untranslated region of VGAM2341 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2341 host target RNA into VGAM2341 host target protein, herein schematically represented by VGAM1 HOST TARGET PROTEIN through VGAM3 HOST TARGET PROTEIN, all of FIG. 1.

VGAM2342 RNA, herein schematically represented by VGAM1 RNA through VGAM3 RNA, binds complementarily to a host target binding site located in an untranslated region of VGAM2342 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2342 host target RNA into VGAM2342 host target protein, herein schematically represented by VGAM1 HOST TARGET PROTEIN through VGAM3 HOST TARGET PROTEIN, all of FIG. 1.

VGAM2343 RNA, herein schematically represented by VGAM1 RNA through VGAM3 RNA, binds complementarily to a host target binding site located in an untranslated region of VGAM2343 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2343 host target RNA into VGAM2343 host target protein, herein schematically represented by VGAM1 HOST TARGET PROTEIN through VGAM3 HOST TARGET PROTEIN, all of FIG. 1.

VGAM2344 RNA, herein schematically represented by VGAM1 RNA through VGAM3 RNA, binds complementarily to a host target binding site located in an untranslated region of VGAM2344 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2344 host target RNA into VGAM2344 host target protein, herein schematically represented by VGAM1 HOST TARGET PROTEIN through VGAM3 HOST TARGET PROTEIN, all of FIG. 1.

It is appreciated that a function of VGR3221 gene, herein designated VGR GENE, is inhibition of expression of host target genes, as part of a novel viral mechanism of attacking a host. Accordingly, utilities of VGR3221 gene include diagnosis, prevention and treatment of viral infection by Equine Herpesvirus 2. Specific functions, and accordingly utilities, of VGR3221 gene correlate with, and may be deduced from, the identity of the host target genes, which are inhibited by VGAM RNAs comprised in the 'operon-like' cluster of VGR3221 gene: VGAM2337 host target protein, VGAM2338 host target protein, VGAM2339 host target protein, VGAM2340 host target protein, VGAM2341 host target protein, VGAM2342 host target protein, VGAM2343 host target protein and VGAM2344 host target protein, herein schematically represented by VGAM1 HOST TARGET PROTEIN through VGAM3 HOST TARGET PROTEIN. The function of these host target genes is elaborated hereinabove with reference to VGAM2337, VGAM2338, VGAM2339, VGAM2340, VGAM2341, VGAM2342, VGAM2343 and VGAM2344. FIG. 9 further provides a conceptual description of novel bioinformatically detected regulatory viral gene, referred to here as Viral Genomic Record 3222(VGR3222) viral gene, which encodes an 'operon-like' cluster of novel viral micro RNA-like genes, each of which in turn modulates expression of at least one host target gene, the function and utility of which at least one host target gene is known in the art.

VGR3222 gene, herein designated VGR GENE, is a novel bioinformatically detected regulatory, non protein coding, RNA viral gene. The method by which VGR3222 gene was detected is described hereinabove with reference to FIGS. 1-9.

VGR3222 gene encodes VGR3222 precursor RNA, herein designated VGR PRECURSOR RNA, an RNA molecule, typically several hundred nucleotides long.

VGR3222 precursor RNA folds spatially, forming VGR3222 folded precursor RNA, herein designated VGR FOLDED PRECURSOR RNA. It is appreciated that VGR3222 folded precursor RNA comprises a plurality of what is known in the art as 'hairpin' structures. These 'hairpin' structures are due to the fact that the nucleotide sequence of VGR3222 precursor RNA comprises a plurality of segments, the first half of each such segment having a nucleotide sequence which is at least a partial inversed-reversed sequence of the second half thereof, as is well known in the art.

VGR3222 folded precursor RNA is naturally processed by cellular enzymatic activity into at least 8 separate VGAM precursor RNAs, VGAM2345 precursor RNA, VGAM2346 precursor RNA, VGAM2347 precursor RNA, VGAM2348 precursor RNA, VGAM2349 precursor RNA, VGAM2350 precursor RNA, VGAM2351 precursor RNA and VGAM2352 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2345 RNA, VGAM2346 RNA, VGAM2347 RNA, VGAM2348 RNA, VGAM2349 RNA, VGAM2350 RNA, VGAM2351 RNA and VGAM2352 RNA, herein schematically represented by VGAM1 RNA through VGAM3 RNA, each of which VGAM RNAs corresponding to VGAM RNA of FIG. 1.

VGAM2345 RNA, herein schematically represented by VGAM1 RNA through VGAM3 RNA, binds complementarily to a host target binding site located in an untranslated region of VGAM2345 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2345 host target RNA into VGAM2345 host target protein, herein schematically represented by VGAM1 HOST TARGET PROTEIN through VGAM3 HOST TARGET PROTEIN, all of FIG. 1.

VGAM2346 RNA, herein schematically represented by VGAM1 RNA through VGAM3 RNA, binds complementarily to a host target binding site located in an untranslated region of VGAM2346 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2346 host target RNA into VGAM2346 host target protein, herein schematically represented by VGAM1 HOST TARGET PROTEIN through VGAM3 HOST TARGET PROTEIN, all of FIG. 1.

VGAM2347 RNA, herein schematically represented by VGAM1 RNA through VGAM3 RNA, binds complementarily to a host target binding site located in an untranslated region of VGAM2347 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2347 host target RNA into VGAM2347 host target protein, herein schematically represented by VGAM1 HOST TARGET PROTEIN through VGAM3 HOST TARGET PROTEIN, all of FIG. 1.

VGAM2348 RNA, herein schematically represented by VGAM1 RNA through VGAM3 RNA, binds complementarily to a host target binding site located in an untranslated region of VGAM2348 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2348 host target RNA into VGAM2348 host target protein, herein schematically represented by VGAM1 HOST TARGET PROTEIN through VGAM3 HOST TARGET PROTEIN, all of FIG. 1.

VGAM2349 RNA, herein schematically represented by VGAM1 RNA through VGAM3 RNA, binds complementarily to a host target binding site located in an untranslated region of VGAM2349 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2349 host target RNA into VGAM2349 host target protein, herein schematically represented by VGAM1 HOST TARGET PROTEIN through VGAM3 HOST TARGET PROTEIN, all of FIG. 1.

VGAM2350 RNA, herein schematically represented by VGAM1 RNA through VGAM3 RNA, binds complementarily to a host target binding site located in an untranslated region of VGAM2350 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2350 host target RNA into VGAM2350 host target protein, herein schematically represented by VGAM1 HOST TARGET PROTEIN through VGAM3 HOST TARGET PROTEIN, all of FIG. 1.

VGAM2351 RNA, herein schematically represented by VGAM1 RNA through VGAM3 RNA, binds complementarily to a host target binding site located in an untranslated region of VGAM2351 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2351 host target RNA into VGAM2351 host target protein, herein schematically represented by VGAM1 HOST TARGET PROTEIN through VGAM3 HOST TARGET PROTEIN, all of FIG. 1.

VGAM2352 RNA, herein schematically represented by VGAM1 RNA through VGAM3 RNA, binds complementarily to a host target binding site located in an untranslated region of VGAM2352 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2352 host target RNA into VGAM2352 host target protein, herein schematically represented by VGAM1 HOST TARGET PROTEIN through VGAM3 HOST TARGET PROTEIN, all of FIG. 1.

It is appreciated that a function of VGR3222 gene, herein designated VGR GENE, is inhibition of expression of host target genes, as part of a novel viral mechanism of attacking a host. Accordingly, utilities of VGR3222 gene include diagnosis, prevention and treatment of viral infection by Equine Herpesvirus 2. Specific functions, and accordingly utilities, of VGR3222 gene correlate with, and may be deduced from, the identity of the host target genes, which are inhibited by VGAM RNAs comprised in the 'operon-like' cluster of VGR3222 gene: VGAM2345 host target protein, VGAM2346 host target protein, VGAM2347 host target protein, VGAM2348 host target protein, VGAM2349 host target protein, VGAM2350 host target protein, VGAM2351 host target protein and VGAM2352 host target protein, herein schematically represented by VGAM1 HOST TARGET PROTEIN through VGAM3 HOST TARGET PROTEIN. The function of these host target genes is elaborated hereinabove with reference to VGAM2345, VGAM2346, VGAM2347, VGAM2348, VGAM2349, VGAM2350, VGAM2351 and VGAM2352. FIG. 9 further provides a conceptual description of novel bioinformatically detected regulatory viral gene, referred to here as Viral Genomic Record 3223(VGR3223) viral gene, which encodes an 'operon-like' cluster of novel viral micro RNA-like genes, each of which in turn modulates expression of at least one host target gene, the function and utility of which at least one host target gene is known in the art.

VGR3223 gene, herein designated VGR GENE, is a novel bioinformatically detected regulatory, non protein coding, RNA viral gene. The method by which VGR3223 gene was detected is described hereinabove with reference to FIGS. 1-9.

VGR3223 gene encodes VGR3223 precursor RNA, herein designated VGR PRECURSOR RNA, an RNA molecule, typically several hundred nucleotides long.

VGR3223 precursor RNA folds spatially, forming VGR3223 folded precursor RNA, herein designated VGR FOLDED PRECURSOR RNA. It is appreciated that VGR3223 folded precursor RNA comprises a plurality of what is known in the art as 'hairpin' structures. These 'hairpin' structures are due to the fact that the nucleotide sequence of VGR3223 precursor RNA comprises a plurality of segments, the first half of each such segment having a nucleotide sequence which is at least a partial inversed-reversed sequence of the second half thereof, as is well known in the art.

VGR3223 folded precursor RNA is naturally processed by cellular enzymatic activity into at least 8 separate VGAM precursor RNAs, VGAM2353 precursor RNA, VGAM2354 precursor RNA, VGAM2355 precursor RNA, VGAM2356 precursor RNA, VGAM2357 precursor RNA, VGAM2358 precursor RNA, VGAM2359 precursor RNA and VGAM2360 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2353 RNA, VGAM2354 RNA, VGAM2355 RNA, VGAM2356 RNA, VGAM2357 RNA, VGAM2358 RNA, VGAM2359 RNA and VGAM2360 RNA, herein schematically represented by VGAM1 RNA through VGAM3 RNA, each of which VGAM RNAs corresponding to VGAM RNA of FIG. 1.

VGAM2353 RNA, herein schematically represented by VGAM1 RNA through VGAM3 RNA, binds complementarily to a host target binding site located in an untranslated region of VGAM2353 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2353 host target RNA into VGAM2353 host target protein, herein schematically represented by VGAM1 HOST TARGET PROTEIN through VGAM3 HOST TARGET PROTEIN, all of FIG. 1.

VGAM2354 RNA, herein schematically represented by VGAM1 RNA through VGAM3 RNA, binds complementarily to a host target binding site located in an untranslated region of VGAM2354 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2354 host target RNA into VGAM2354 host target protein, herein schematically represented by VGAM1 HOST TARGET PROTEIN through VGAM3 HOST TARGET PROTEIN, all of FIG. 1.

VGAM2355 RNA, herein schematically represented by VGAM1 RNA through VGAM3 RNA, binds complementarily to a host target binding site located in an untranslated region of VGAM2355 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2355 host target RNA into VGAM2355 host target protein, herein schematically represented by VGAM1 HOST TARGET PROTEIN through VGAM3 HOST TARGET PROTEIN, all of FIG. 1.

VGAM2356 RNA, herein schematically represented by VGAM1 RNA through VGAM3 RNA, binds complementarily to a host target binding site located in an untranslated region of VGAM2356 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2356 host target RNA into VGAM2356 host target protein, herein schematically represented by VGAM1 HOST TARGET PROTEIN through VGAM3 HOST TARGET PROTEIN, all of FIG. 1.

VGAM2357 RNA, herein schematically represented by VGAM1 RNA through VGAM3 RNA, binds complementarily to a host target binding site located in an untranslated region of VGAM2357 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2357 host target RNA into VGAM2357 host target protein, herein schematically represented by VGAM1 HOST TARGET PROTEIN through VGAM3 HOST TARGET PROTEIN, all of FIG. 1.

VGAM2358 RNA, herein schematically represented by VGAM1 RNA through VGAM3 RNA, binds complementarily to a host target binding site located in an untranslated region of VGAM2358 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2358 host target RNA into VGAM2358 host target protein, herein schematically represented by VGAM1 HOST TARGET PROTEIN through VGAM3 HOST TARGET PROTEIN, all of FIG. 1.

VGAM2359 RNA, herein schematically represented by VGAM1 RNA through VGAM3 RNA, binds complementarily to a host target binding site located in an untranslated region of VGAM2359 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2359 host target RNA into VGAM2359 host target protein, herein schematically represented by VGAM1 HOST TARGET PROTEIN through VGAM3 HOST TARGET PROTEIN, all of FIG. 1.

VGAM2360 RNA, herein schematically represented by VGAM1 RNA through VGAM3 RNA, binds complementarily to a host target binding site located in an untranslated region of VGAM2360 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2360 host target RNA into VGAM2360 host target protein, herein schematically represented by VGAM1 HOST TARGET PROTEIN through VGAM3 HOST TARGET PROTEIN, all of FIG. 1.

It is appreciated that a function of VGR3223 gene, herein designated VGR GENE, is inhibition of expression of host target genes, as part of a novel viral mechanism of attacking a host. Accordingly, utilities of VGR3223 gene include diagnosis, prevention and treatment of viral infection by Equine Herpesvirus 2. Specific functions, and accordingly utilities, of VGR3223 gene correlate with, and may be deduced from, the identity of the host target genes, which are inhibited by VGAM RNAs comprised in the 'operon-like' cluster of VGR3223 gene: VGAM2353 host target protein, VGAM2354 host target protein, VGAM2355 host target protein, VGAM2356 host target protein, VGAM2357 host target protein, VGAM2358 host target protein, VGAM2359 host target protein and VGAM2360 host target protein, herein schematically represented by VGAM1 HOST TARGET PROTEIN through VGAM3 HOST TARGET PROTEIN. The function of these host target genes is elaborated hereinabove with reference to VGAM2353, VGAM2354, VGAM2355, VGAM2356, VGAM2357, VGAM2358, VGAM2359 and VGAM2360. FIG. 9 further provides a conceptual description of novel bioinformatically detected regulatory viral gene, referred to here as Viral Genomic Record 3224(VGR3224) viral gene, which encodes an 'operon-like' cluster of novel viral micro RNA-like genes, each of which in turn modulates expression of at least one host target gene, the function and utility of which at least one host target gene is known in the art.

VGR3224 gene, herein designated VGR GENE, is a novel bioinformatically detected regulatory, non protein coding, RNA viral gene. The method by which VGR3224 gene was detected is described hereinabove with reference to FIGS. 1-9.

VGR3224 gene encodes VGR3224 precursor RNA, herein designated VGR PRECURSOR RNA, an RNA molecule, typically several hundred nucleotides long.

VGR3224 precursor RNA folds spatially, forming VGR3224 folded precursor RNA, herein designated VGR FOLDED PRECURSOR RNA. It is appreciated that VGR3224 folded precursor RNA comprises a plurality of what is known in the art as 'hairpin' structures. These 'hairpin' structures are due to the fact that the nucleotide sequence of VGR3224 precursor RNA comprises a plurality of segments, the first half of each such segment having a nucleotide sequence which is at least a partial inversed-reversed sequence of the second half thereof, as is well known in the art.

VGR3224 folded precursor RNA is naturally processed by cellular enzymatic activity into at least 4 separate VGAM precursor RNAs, VGAM2361 precursor RNA, VGAM2362 precursor RNA, VGAM2363 precursor RNA and VGAM2364 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2361 RNA, VGAM2362 RNA, VGAM2363 RNA and VGAM2364 RNA, herein schematically represented by VGAM1 RNA through VGAM3 RNA, each of which VGAM RNAs corresponding to VGAM RNA of FIG. 1.

VGAM2361 RNA, herein schematically represented by VGAM1 RNA through VGAM3 RNA, binds complementarily to a host target binding site located in an untranslated region of VGAM2361 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2361 host target RNA into VGAM2361 host target protein, herein schematically represented by VGAM1 HOST TARGET PROTEIN through VGAM3 HOST TARGET PROTEIN, all of FIG. 1.

VGAM2362 RNA, herein schematically represented by VGAM1 RNA through VGAM3 RNA, binds complementarily to a host target binding site located in an untranslated region of VGAM2362 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2362 host target RNA into VGAM2362 host target protein, herein schematically represented by VGAM1 HOST TARGET PROTEIN through VGAM3 HOST TARGET PROTEIN, all of FIG. 1.

VGAM2363 RNA, herein schematically represented by VGAM1 RNA through VGAM3 RNA, binds complementarily to a host target binding site located in an untranslated region of VGAM2363 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2363 host target RNA into VGAM2363 host target protein, herein schematically represented by VGAM1 HOST TARGET PROTEIN through VGAM3 HOST TARGET PROTEIN, all of FIG. 1.

VGAM2364 RNA, herein schematically represented by VGAM1 RNA through VGAM3 RNA, binds complementarily to a host target binding site located in an untranslated region of VGAM2364 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2364 host target RNA into VGAM2364 host target protein, herein schematically represented by VGAM1 HOST TARGET PROTEIN through VGAM3 HOST TARGET PROTEIN, all of FIG. 1.

It is appreciated that a function of VGR3224 gene, herein designated VGR GENE, is inhibition of expression of host target genes, as part of a novel viral mechanism of attacking a host. Accordingly, utilities of VGR3224 gene include diagnosis, prevention and treatment of viral infection by Equine Herpesvirus 2. Specific functions, and accordingly utilities, of VGR3224 gene correlate with, and may be deduced from, the identity of the host target genes, which are inhibited by VGAM RNAs comprised in the 'operon-like' cluster of VGR3224 gene: VGAM2361 host target protein, VGAM2362 host target protein, VGAM2363 host target protein and VGAM2364 host target protein, herein schematically represented by VGAM1 HOST TARGET PROTEIN through VGAM3 HOST TARGET PROTEIN. The function of these host target genes is elaborated hereinabove with reference to VGAM2361, VGAM2362, VGAM2363 and VGAM2364. FIG. 9 further provides a conceptual description of novel bioinformatically detected regulatory viral gene, referred to here as Viral Genomic Record 3225(VGR3225) viral gene, which encodes an 'operon-like' cluster of novel viral micro RNA-like genes, each of which in turn modulates expression of at least one host target gene, the function and utility of which at least one host target gene is known in the art.

VGR3225 gene, herein designated VGR GENE, is a novel bioinformatically detected regulatory, non protein coding, RNA viral gene. The method by which VGR3225 gene was detected is described hereinabove with reference to FIGS. 1-9.

VGR3225 gene encodes VGR3225 precursor RNA, herein designated VGR PRECURSOR RNA, an RNA molecule, typically several hundred nucleotides long.

VGR3225 precursor RNA folds spatially, forming VGR3225 folded precursor RNA, herein designated VGR FOLDED PRECURSOR RNA. It is appreciated that VGR3225 folded precursor RNA comprises a plurality of what is known in the art as 'hairpin' structures. These 'hairpin' structures are due to the fact that the nucleotide sequence of VGR3225 precursor RNA comprises a plurality of segments, the first half of each such segment having a nucleotide sequence which is at least a partial inversed-reversed sequence of the second half thereof, as is well known in the art.

VGR3225 folded precursor RNA is naturally processed by cellular enzymatic activity into at least 8 separate VGAM precursor RNAs, VGAM2365 precursor RNA, VGAM2366 precursor RNA, VGAM2367 precursor RNA, VGAM2368 precursor RNA, VGAM2369 precursor RNA, VGAM2370 precursor RNA, VGAM2371 precursor RNA and VGAM2372 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2365 RNA, VGAM2366 RNA, VGAM2367 RNA, VGAM2368 RNA, VGAM2369 RNA, VGAM2370 RNA, VGAM2371 RNA and VGAM2372 RNA, herein schematically represented by VGAM1 RNA through VGAM3 RNA, each of which VGAM RNAs corresponding to VGAM RNA of FIG. 1.

VGAM2365 RNA, herein schematically represented by VGAM1 RNA through VGAM3 RNA, binds complementarily to a host target binding site located in an untranslated region of VGAM2365 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2365 host target RNA into VGAM2365 host target protein, herein schematically represented by VGAM1 HOST TARGET PROTEIN through VGAM3 HOST TARGET PROTEIN, all of FIG. 1.

VGAM2366 RNA, herein schematically represented by VGAM1 RNA through VGAM3 RNA, binds complementarily to a host target binding site located in an untranslated region of VGAM2366 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2366 host target RNA into VGAM2366 host target protein, herein schematically represented by VGAM1 HOST TARGET PROTEIN through VGAM3 HOST TARGET PROTEIN, all of FIG. 1.

VGAM2367 RNA, herein schematically represented by VGAM1 RNA through VGAM3 RNA, binds complementarily to a host target binding site located in an untranslated region of VGAM2367 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2367 host target RNA into VGAM2367 host target protein, herein schematically represented by VGAM1 HOST TARGET PROTEIN through VGAM3 HOST TARGET PROTEIN, all of FIG. 1.

VGAM2368 RNA, herein schematically represented by VGAM1 RNA through VGAM3 RNA, binds complementarily to a host target binding site located in an untranslated region of VGAM2368 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2368 host target RNA into VGAM2368 host target protein, herein schematically represented by VGAM1 HOST TARGET PROTEIN through VGAM3 HOST TARGET PROTEIN, all of FIG. 1.

VGAM2369 RNA, herein schematically represented by VGAM1 RNA through VGAM3 RNA, binds complementarily to a host target binding site located in an untranslated region of VGAM2369 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2369 host target RNA into VGAM2369 host target protein, herein schematically represented by VGAM1 HOST TARGET PROTEIN through VGAM3 HOST TARGET PROTEIN, all of FIG. 1.

VGAM2370 RNA, herein schematically represented by VGAM1 RNA through VGAM3 RNA, binds complementarily to a host target binding site located in an untranslated region of VGAM2370 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2370 host target RNA into VGAM2370 host target protein, herein schematically represented by VGAM1 HOST TARGET PROTEIN through VGAM3 HOST TARGET PROTEIN, all of FIG. 1.

VGAM2371 RNA, herein schematically represented by VGAM1 RNA through VGAM3 RNA, binds complementarily to a host target binding site located in an untranslated region of VGAM2371 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2371 host target RNA into VGAM2371 host target protein, herein schematically represented by VGAM1 HOST TARGET PROTEIN through VGAM3 HOST TARGET PROTEIN, all of FIG. 1.

VGAM2372 RNA, herein schematically represented by VGAM1 RNA through VGAM3 RNA, binds complementarily to a host target binding site located in an untranslated region of VGAM2372 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2372 host target RNA into VGAM2372 host target protein, herein schematically represented by VGAM1 HOST TARGET PROTEIN through VGAM3 HOST TARGET PROTEIN, all of FIG. 1.

It is appreciated that a function of VGR3225 gene, herein designated VGR GENE, is inhibition of expression of host target genes, as part of a novel viral mechanism of attacking a host. Accordingly, utilities of VGR3225 gene include diagnosis, prevention and treatment of viral infection by Rat Cytomegalovirus. Specific functions, and accordingly utilities, of VGR3225 gene correlate with, and may be deduced from, the identity of the host target genes, which are inhibited by VGAM RNAs comprised in the 'operon-like' cluster of VGR3225 gene: VGAM2365 host target protein, VGAM2366 host target protein, VGAM2367 host target protein, VGAM2368 host target protein, VGAM2369 host target protein, VGAM2370 host target protein, VGAM2371 host target protein and VGAM2372 host target protein, herein schematically represented by VGAM1 HOST TARGET PROTEIN through VGAM3 HOST TARGET PROTEIN. The function of these host target genes is elaborated hereinabove with reference to VGAM2365, VGAM2366, VGAM2367, VGAM2368, VGAM2369, VGAM2370, VGAM2371 and VGAM2372. FIG. 9 further provides a conceptual description of novel bioinformatically detected regulatory viral gene, referred to here as Viral Genomic Record 3226(VGR3226) viral gene, which encodes an 'operon-like' cluster of novel viral micro RNA-like genes, each of which in turn modulates expression of at least one host target gene, the function and utility of which at least one host target gene is known in the art.

VGR3226 gene, herein designated VGR GENE, is a novel bioinformatically detected regulatory, non protein coding, RNA viral gene. The method by which VGR3226 gene was detected is described hereinabove with reference to FIGS. 1-9.

VGR3226 gene encodes VGR3226 precursor RNA, herein designated VGR PRECURSOR RNA, an RNA molecule, typically several hundred nucleotides long.

VGR3226 precursor RNA folds spatially, forming VGR3226 folded precursor RNA, herein designated VGR FOLDED PRECURSOR RNA. It is appreciated that VGR3226 folded precursor RNA comprises a plurality of what is known in the art as 'hairpin' structures. These 'hairpin' structures are due to the fact that the nucleotide sequence of VGR3226 precursor RNA comprises a plurality of segments, the first half of each such segment having a nucleotide sequence which is at least a partial inversed-reversed sequence of the second half thereof, as is well known in the art.

VGR3226 folded precursor RNA is naturally processed by cellular enzymatic activity into at least 7 separate VGAM precursor RNAs, VGAM2373 precursor RNA, VGAM2374 precursor RNA, VGAM2375 precursor RNA, VGAM2376 precursor RNA, VGAM2377 precursor RNA, VGAM2378 precursor RNA and VGAM2379 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2373 RNA, VGAM2374 RNA, VGAM2375 RNA, VGAM2376 RNA, VGAM2377 RNA, VGAM2378 RNA and VGAM2379 RNA, herein schematically represented by VGAM1 RNA through VGAM3 RNA, each of which VGAM RNAs corresponding to VGAM RNA of FIG. 1.

VGAM2373 RNA, herein schematically represented by VGAM1 RNA through VGAM3 RNA, binds complementarily to a host target binding site located in an untranslated region of VGAM2373 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2373 host target RNA into VGAM2373 host target protein, herein schematically represented by VGAM1 HOST TARGET PROTEIN through VGAM3 HOST TARGET PROTEIN, all of FIG. 1.

VGAM2374 RNA, herein schematically represented by VGAM1 RNA through VGAM3 RNA, binds complementarily to a host target binding site located in an untranslated region of VGAM2374 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2374 host target RNA into VGAM2374 host target protein, herein schematically represented by VGAM1 HOST TARGET PROTEIN through VGAM3 HOST TARGET PROTEIN, all of FIG. 1.

VGAM2375 RNA, herein schematically represented by VGAM1 RNA through VGAM3 RNA, binds complementarily to a host target binding site located in an untranslated region of VGAM2375 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2375 host target RNA into VGAM2375 host target protein, herein schematically represented by VGAM1 HOST TARGET PROTEIN through VGAM3 HOST TARGET PROTEIN, all of FIG. 1.

VGAM2376 RNA, herein schematically represented by VGAM1 RNA through VGAM3 RNA, binds complementarily to a host target binding site located in an untranslated region of VGAM2376 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2376 host target RNA into VGAM2376 host target protein, herein schematically represented by VGAM1 HOST TARGET PROTEIN through VGAM3 HOST TARGET PROTEIN, all of FIG. 1.

VGAM2377 RNA, herein schematically represented by VGAM1 RNA through VGAM3 RNA, binds complementarily to a host target binding site located in an untranslated region of VGAM2377 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2377 host target RNA into VGAM2377 host target protein, herein schematically represented by VGAM1 HOST TARGET PROTEIN through VGAM3 HOST TARGET PROTEIN, all of FIG. 1.

VGAM2378 RNA, herein schematically represented by VGAM1 RNA through VGAM3 RNA, binds complementarily to a host target binding site located in an untranslated region of VGAM2378 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2378 host target RNA into VGAM2378 host target protein, herein schematically represented by VGAM1 HOST TARGET PROTEIN through VGAM3 HOST TARGET PROTEIN, all of FIG. 1.

VGAM2379 RNA, herein schematically represented by VGAM1 RNA through VGAM3 RNA, binds complementarily to a host target binding site located in an untranslated region of VGAM2379 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2379 host target RNA into VGAM2379 host target protein, herein schematically represented by VGAM1 HOST TARGET PROTEIN through VGAM3 HOST TARGET PROTEIN, all of FIG. 1.

It is appreciated that a function of VGR3226 gene, herein designated VGR GENE, is inhibition of expression of host target genes, as part of a novel viral mechanism of attacking a host. Accordingly, utilities of VGR3226 gene include diagnosis, prevention and treatment of viral infection by Rat Cytomegalovirus. Specific functions, and accordingly utilities, of VGR3226 gene correlate with, and may be deduced from, the identity of the host target genes, which are inhibited by VGAM RNAs comprised in the 'operon-like' cluster of VGR3226 gene: VGAM2373 host target protein, VGAM2374 host target protein, VGAM2375 host target protein, VGAM2376 host target protein, VGAM2377 host target protein, VGAM2378 host target protein and VGAM2379 host target protein, herein schematically represented by VGAM1 HOST TARGET PROTEIN through VGAM3 HOST TARGET PROTEIN. The function of these host target genes is elaborated hereinabove with reference to VGAM2373, VGAM2374, VGAM2375, VGAM2376, VGAM2377, VGAM2378 and VGAM2379. FIG. 9 further provides a conceptual description of novel bioinformatically detected regulatory viral gene, referred to here as Viral Genomic Record 3227(VGR3227) viral gene, which encodes an 'operon-like' cluster of novel viral micro RNA-like genes, each of which in turn modulates expression of at least one host target gene, the function and utility of which at least one host target gene is known in the art.

VGR3227 gene, herein designated VGR GENE, is a novel bioinformatically detected regulatory, non protein coding, RNA viral gene. The method by which VGR3227 gene was detected is described hereinabove with reference to FIGS. 1-9.

VGR3227 gene encodes VGR3227 precursor RNA, herein designated VGR PRECURSOR RNA, an RNA molecule, typically several hundred nucleotides long.

VGR3227 precursor RNA folds spatially, forming VGR3227 folded precursor RNA, herein designated VGR FOLDED PRECURSOR RNA. It is appreciated that VGR3227 folded precursor RNA comprises a plurality of what is known in the art as 'hairpin' structures. These 'hairpin' structures are due to the fact that the nucleotide sequence of VGR3227 precursor RNA comprises a plurality of segments, the first half of each such segment having a nucleotide sequence which is at least a partial inversed-reversed sequence of the second half thereof, as is well known in the art.

VGR3227 folded precursor RNA is naturally processed by cellular enzymatic activity into at least 7 separate VGAM precursor RNAs, VGAM2380 precursor RNA, VGAM2381 precursor RNA, VGAM2382 precursor RNA, VGAM2383 precursor RNA, VGAM2384 precursor RNA, VGAM2385 precursor RNA and VGAM2386 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2380 RNA, VGAM2381 RNA, VGAM2382 RNA, VGAM2383 RNA, VGAM2384 RNA, VGAM2385 RNA and VGAM2386 RNA, herein schematically represented by VGAM1 RNA through VGAM3 RNA, each of which VGAM RNAs corresponding to VGAM RNA of FIG. 1.

VGAM2380 RNA, herein schematically represented by VGAM1 RNA through VGAM3 RNA, binds complementarily to a host target binding site located in an untranslated region of VGAM2380 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2380 host target RNA into VGAM2380 host target protein, herein schematically represented by VGAM1 HOST TARGET PROTEIN through VGAM3 HOST TARGET PROTEIN, all of FIG. 1.

VGAM2381 RNA, herein schematically represented by VGAM1 RNA through VGAM3 RNA, binds complementarily to a host target binding site located in an untranslated region of VGAM2381 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2381 host target RNA into VGAM2381 host target protein, herein schematically represented by VGAM1 HOST TARGET PROTEIN through VGAM3 HOST TARGET PROTEIN, all of FIG. 1.

VGAM2382 RNA, herein schematically represented by VGAM1 RNA through VGAM3 RNA, binds complementarily to a host target binding site located in an untranslated region of VGAM2382 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2382 host target RNA into VGAM2382 host target protein, herein schematically represented by VGAM1 HOST TARGET PROTEIN through VGAM3 HOST TARGET PROTEIN, all of FIG. 1.

VGAM2383 RNA, herein schematically represented by VGAM1 RNA through VGAM3 RNA, binds complementarily to a host target binding site located in an untranslated region of VGAM2383 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM2383 host target RNA into VGAM2383 host target protein, herein schematically represented by VGAM1 HOST TARGET PROTEIN through VGAM3 HOST TARGET PROTEIN, all of FIG. 1.

VGAM2384 RNA, herein schematically represented by VGAM1 RNA through VGAM3 RNA, binds complementarily to a host target binding site located in an untranslated region of VGAM2384 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2384 host target RNA into VGAM2384 host target protein, herein schematically represented by VGAM1 HOST TARGET PROTEIN through VGAM3 HOST TARGET PROTEIN, all of FIG. 1.

VGAM2385 RNA, herein schematically represented by VGAM1 RNA through VGAM3 RNA, binds complementarily to a host target binding site located in an untranslated region of VGAM2385 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2385 host target RNA into VGAM2385 host target protein, herein schematically represented by VGAM1 HOST TARGET PROTEIN through VGAM3 HOST TARGET PROTEIN, all of FIG. 1.

VGAM2386 RNA, herein schematically represented by VGAM1 RNA through VGAM3 RNA, binds complementarily to a host target binding site located in an untranslated region of VGAM2386 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2386 host target RNA into VGAM2386 host target protein, herein schematically represented by VGAM1 HOST TARGET PROTEIN through VGAM3 HOST TARGET PROTEIN, all of FIG. 1.

It is appreciated that a function of VGR3227 gene, herein designated VGR GENE, is inhibition of expression of host target genes, as part of a novel viral mechanism of attacking a host. Accordingly, utilities of VGR3227 gene include diagnosis, prevention and treatment of viral infection by Human Herpesvirus 4. Specific functions, and accordingly utilities, of VGR3227 gene correlate with, and may be deduced from, the identity of the host target genes, which are inhibited by VGAM RNAs comprised in the 'operon-like' cluster of VGR3227 gene: VGAM2380 host target protein, VGAM2381 host target protein, VGAM2382 host target protein, VGAM2383 host target protein, VGAM2384 host target protein, VGAM2385 host target protein and VGAM2386 host target protein, herein schematically represented by VGAM1 HOST TARGET PROTEIN through VGAM3 HOST TARGET PROTEIN. The function of these host target genes is elaborated hereinabove with reference to VGAM2380, VGAM2381, VGAM2382, VGAM2383, VGAM2384, VGAM2385 and VGAM2386. FIG. 9 further provides a conceptual description of novel bioinformatically detected regulatory viral gene, referred to here as Viral Genomic Record 3228(VGR3228) viral gene, which encodes an 'operon-like' cluster of novel micro RNA-like genes, each of which in turn modulates expression of at least one host target gene, the function and utility of which at least one host target gene is known in the art.

VGR3228 gene, herein designated VGR GENE, is a novel bioinformatically detected regulatory, non protein coding, RNA viral gene. The method by which VGR3228 gene was detected is described hereinabove with reference to FIGS. 1-9.

VGR3228 gene encodes VGR3228 precursor RNA, herein designated VGR PRECURSOR RNA, an RNA molecule, typically several hundred nucleotides long.

VGR3228 precursor RNA folds spatially, forming VGR3228 folded precursor RNA, herein designated VGR FOLDED PRECURSOR RNA. It is appreciated that VGR3228 folded precursor RNA comprises a plurality of what is known in the art as 'hairpin' structures. These 'hairpin' structures are due to the fact that the nucleotide sequence of VGR3228 precursor RNA comprises a plurality of segments, the first half of each such segment having a nucleotide sequence which is at least a partial inversed-reversed sequence of the second half thereof, as is well known in the art.

VGR3228 folded precursor RNA is naturally processed by cellular enzymatic activity into at least 2 separate VGAM precursor RNAs, VGAM2387 precursor RNA and VGAM2388 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2387 RNA and VGAM2388 RNA, herein schematically represented by VGAM1 RNA through VGAM3 RNA, each of which VGAM RNAs corresponding to VGAM RNA of FIG. 1.

VGAM2387 RNA, herein schematically represented by VGAM1 RNA through VGAM3 RNA, binds complementarily to a host target binding site located in an untranslated region of VGAM2387 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2387 host target RNA into VGAM2387 host target protein, herein schematically represented by VGAM1 HOST TARGET PROTEIN through VGAM3 HOST TARGET PROTEIN, all of FIG. 1.

VGAM2388 RNA, herein schematically represented by VGAM1 RNA through VGAM3 RNA, binds complementarily to a host target binding site located in an untranslated region of VGAM2388 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2388 host target RNA into VGAM2388 host target protein, herein schematically represented by VGAM1 HOST TARGET PROTEIN through VGAM3 HOST TARGET PROTEIN, all of FIG. 1.

It is appreciated that a function of VGR3228 gene, herein designated VGR GENE, is inhibition of expression of host target genes, as part of a novel viral mechanism of attacking a host. Accordingly, utilities of VGR3228 gene include diagnosis, prevention and treatment of viral infection by Human Herpesvirus 4. Specific functions, and accordingly utilities, of VGR3228 gene correlate with, and may be deduced from, the identity of the host target genes, which are inhibited by VGAM RNAs comprised in the 'operon-like' cluster of VGR3228 gene: VGAM2387 host target protein and VGAM2388 host target protein, herein schematically represented by VGAM1 HOST TARGET PROTEIN through VGAM3 HOST TARGET PROTEIN. The function of these host target genes is elaborated hereinabove with reference to VGAM2387 and VGAM2388. FIG. 9 further provides a conceptual description of novel bioinformatically detected regulatory viral gene, referred to here as Viral Genomic Record 3229(VGR3229) viral gene, which encodes an 'operon-like' cluster of novel viral micro RNA-like genes, each of which in turn modulates expression of at least one host target gene, the function and utility of which at least one host target gene is known in the art.

VGR3229 gene, herein designated VGR GENE, is a novel bioinformatically detected regulatory, non protein coding, RNA viral gene. The method by which VGR3229 gene was detected is described hereinabove with reference to FIGS. 1-9.

VGR3229 gene encodes VGR3229 precursor RNA, herein designated VGR PRECURSOR RNA, an RNA molecule, typically several hundred nucleotides long.

VGR3229 precursor RNA folds spatially, forming VGR3229 folded precursor RNA, herein designated VGR FOLDED PRECURSOR RNA. It is appreciated that VGR3229 folded precursor RNA comprises a plurality of what is known in the art as 'hairpin' structures. These 'hairpin' structures are due to the fact that the nucleotide sequence of VGR3229 precursor RNA comprises a plurality of segments, the first half of each such segment having a nucleotide sequence which is at least a partial inversed-reversed sequence of the second half thereof, as is well known in the art.

VGR3229 folded precursor RNA is naturally processed by cellular enzymatic activity into at least 8 separate VGAM precursor RNAs, VGAM2389 precursor RNA, VGAM2390 precursor RNA, VGAM2391 precursor RNA, VGAM2392 precursor RNA, VGAM2393 precursor RNA, VGAM2394 precursor RNA, VGAM2395 precursor RNA and VGAM2396 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2389 RNA, VGAM2390 RNA, VGAM2391 RNA, VGAM2392 RNA, VGAM2393 RNA, VGAM2394 RNA, VGAM2395 RNA and VGAM2396 RNA, herein schematically represented by VGAM1 RNA through VGAM3 RNA, each of which VGAM RNAs corresponding to VGAM RNA of FIG. 1.

VGAM2389 RNA, herein schematically represented by VGAM1 RNA through VGAM3 RNA, binds complementarily to a host target binding site located in an untranslated region of VGAM2389 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2389 host target RNA into VGAM2389 host target protein, herein schematically represented by VGAM1 HOST TARGET PROTEIN through VGAM3 HOST TARGET PROTEIN, all of FIG. 1.

VGAM2390 RNA, herein schematically represented by VGAM1 RNA through VGAM3 RNA, binds complementarily to a host target binding site located in an untranslated region of VGAM2390 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2390 host target RNA into VGAM2390 host target protein, herein schematically represented by VGAM1 HOST TARGET PROTEIN through VGAM3 HOST TARGET PROTEIN, all of FIG. 1.

VGAM2391 RNA, herein schematically represented by VGAM1 RNA through VGAM3 RNA, binds complementarily to a host target binding site located in an untranslated region of VGAM2391 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2391 host target RNA into VGAM2391 host target protein, herein schematically represented by VGAM1 HOST TARGET PROTEIN through VGAM3 HOST TARGET PROTEIN, all of FIG. 1.

VGAM2392 RNA, herein schematically represented by VGAM1 RNA through VGAM3 RNA, binds complementarily to a host target binding site located in an untranslated region of VGAM2392 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2392 host target RNA into VGAM2392 host target protein, herein schematically represented by VGAM1 HOST TARGET PROTEIN through VGAM3 HOST TARGET PROTEIN, all of FIG. 1.

VGAM2393 RNA, herein schematically represented by VGAM1 RNA through VGAM3 RNA, binds complementarily to a host target binding site located in an untranslated region of VGAM2393 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2393 host target RNA into VGAM2393 host target protein, herein schematically represented by VGAM1 HOST TARGET PROTEIN through VGAM3 HOST TARGET PROTEIN, all of FIG. 1.

VGAM2394 RNA, herein schematically represented by VGAM1 RNA through VGAM3 RNA, binds complementarily to a host target binding site located in an untranslated region of VGAM2394 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2394 host target RNA into VGAM2394 host target protein, herein schematically represented by VGAM1 HOST TARGET PROTEIN through VGAM3 HOST TARGET PROTEIN, all of FIG. 1.

VGAM2395 RNA, herein schematically represented by VGAM1 RNA through VGAM3 RNA, binds complementarily to a host target binding site located in an untranslated region of VGAM2395 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2395 host target RNA into VGAM2395 host target protein, herein schematically represented by VGAM1 HOST TARGET PROTEIN through VGAM3 HOST TARGET PROTEIN, all of FIG. 1.

VGAM2396 RNA, herein schematically represented by VGAM1 RNA through VGAM3 RNA, binds complementarily to a host target binding site located in an untranslated region of VGAM2396 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2396 host target RNA into VGAM2396 host target protein, herein schematically represented by VGAM1 HOST TARGET PROTEIN through VGAM3 HOST TARGET PROTEIN, all of FIG. 1.

It is appreciated that a function of VGR3229 gene, herein designated VGR GENE, is inhibition of expression of host target genes, as part of a novel viral mechanism of attacking a host. Accordingly, utilities of VGR3229 gene include diagnosis, prevention and treatment of viral infection by Goatpox Virus. Specific functions, and accordingly utilities, of VGR3229 gene correlate with, and may be deduced from, the identity of the host target genes, which are inhibited by VGAM RNAs comprised in the 'operon-like' cluster of VGR3229 gene: VGAM2389 host target protein, VGAM2390 host target protein, VGAM2391 host target protein, VGAM2392 host target protein, VGAM2393 host target protein, VGAM2394 host target protein, VGAM2395 host target protein and VGAM2396 host target protein, herein schematically represented by VGAM1 HOST TARGET PROTEIN through VGAM3 HOST TARGET PROTEIN. The function of these host target genes is elaborated hereinabove with reference to VGAM2389, VGAM2390, VGAM2391, VGAM2392, VGAM2393, VGAM2394, VGAM2395 and VGAM2396. FIG. 9 further provides a conceptual description of novel bioinformatically detected regulatory viral gene, referred to here as Viral Genomic Record 3230(VGR3230) viral gene, which encodes an 'operon-like' cluster of novel viral micro RNA-like genes, each of which in turn modulates expression of at least one host target gene, the function and utility of which at least one host target gene is known in the art.

VGR3230 gene, herein designated VGR GENE, is a novel bioinformatically detected regulatory, non protein coding, RNA viral gene. The method by which VGR3230 gene was detected is described hereinabove with reference to FIGS. 1-9.

VGR3230 gene encodes VGR3230 precursor RNA, herein designated VGR PRECURSOR RNA, an RNA molecule, typically several hundred nucleotides long.

VGR3230 precursor RNA folds spatially, forming VGR3230 folded precursor RNA, herein designated VGR FOLDED PRECURSOR RNA. It is appreciated that VGR3230 folded precursor RNA comprises a plurality of what is known in the art as 'hairpin' structures. These 'hairpin' structures are due to the fact that the nucleotide sequence of VGR3230 precursor RNA comprises a plurality of segments, the first half of each such segment having a nucleotide sequence which is at least a partial inversed-reversed sequence of the second half thereof, as is well known in the art.

VGR3230 folded precursor RNA is naturally processed by cellular enzymatic activity into at least 8 separate VGAM precursor RNAs, VGAM2397 precursor RNA, VGAM2398 precursor RNA, VGAM2399 precursor RNA, VGAM2400 precursor RNA, VGAM2401 precursor RNA, VGAM2402 precursor RNA, VGAM2403 precursor RNA and VGAM2404 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2397 RNA, VGAM2398 RNA, VGAM2399 RNA, VGAM2400 RNA, VGAM2401 RNA, VGAM2402 RNA, VGAM2403 RNA and VGAM2404 RNA, herein schematically represented by VGAM1 RNA through VGAM3 RNA, each of which VGAM RNAs corresponding to VGAM RNA of FIG. 1.

VGAM2397 RNA, herein schematically represented by VGAM1 RNA through VGAM3 RNA, binds complementarily to a host target binding site located in an untranslated region of VGAM2397 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2397 host target RNA into VGAM2397 host target protein, herein schematically represented by VGAM1 HOST TARGET PROTEIN through VGAM3 HOST TARGET PROTEIN, all of FIG. 1.

VGAM2398 RNA, herein schematically represented by VGAM1 RNA through VGAM3 RNA, binds complementarily to a host target binding site located in an untranslated region of VGAM2398 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2398 host target RNA into VGAM2398 host target protein, herein schematically represented by VGAM1 HOST TARGET PROTEIN through VGAM3 HOST TARGET PROTEIN, all of FIG. 1.

VGAM2399 RNA, herein schematically represented by VGAM1 RNA through VGAM3 RNA, binds complementarily to a host target binding site located in an untranslated region of VGAM2399 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2399 host target RNA into VGAM2399 host target protein, herein schematically represented by VGAM1 HOST TARGET PROTEIN through VGAM3 HOST TARGET PROTEIN, all of FIG. 1.

VGAM2400 RNA, herein schematically represented by VGAM1 RNA through VGAM3 RNA, binds complementarily to a host target binding site located in an untranslated region of VGAM2400 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2400 host target RNA into VGAM2400 host target protein, herein schematically represented by VGAM1 HOST TARGET PROTEIN through VGAM3 HOST TARGET PROTEIN, all of FIG. 1.

VGAM2401 RNA, herein schematically represented by VGAM1 RNA through VGAM3 RNA, binds complementarily to a host target binding site located in an untranslated region of VGAM2401 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2401 host target RNA into VGAM2401 host target protein, herein schematically represented by VGAM1 HOST TARGET PROTEIN through VGAM3 HOST TARGET PROTEIN, all of FIG. 1.

VGAM2402 RNA, herein schematically represented by VGAM1 RNA through VGAM3 RNA, binds complementarily to a host target binding site located in an untranslated region of VGAM2402 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2402 host target RNA into VGAM2402 host target protein, herein schematically represented by VGAM1 HOST TARGET PROTEIN through VGAM3 HOST TARGET PROTEIN, all of FIG. 1.

VGAM2403 RNA, herein schematically represented by VGAM1 RNA through VGAM3 RNA, binds complementarily to a host target binding site located in an untranslated region of VGAM2403 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2403 host target RNA into VGAM2403 host target protein, herein schematically represented by VGAM1 HOST TARGET PROTEIN through VGAM3 HOST TARGET PROTEIN, all of FIG. 1.

VGAM2404 RNA, herein schematically represented by VGAM1 RNA through VGAM3 RNA, binds complementarily to a host target binding site located in an untranslated region of VGAM2404 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2404 host target RNA into VGAM2404 host target protein, herein schematically represented by VGAM1 HOST TARGET PROTEIN through VGAM3 HOST TARGET PROTEIN, all of FIG. 1.

It is appreciated that a function of VGR3230 gene, herein designated VGR GENE, is inhibition of expression of host target genes, as part of a novel viral mechanism of attacking a host. Accordingly, utilities of VGR3230 gene include diagnosis, prevention and treatment of viral infection by Goatpox Virus. Specific functions, and accordingly utilities, of VGR3230 gene correlate with, and may be deduced from, the identity of the host target genes, which are inhibited by VGAM RNAs comprised in the 'operon-like' cluster of VGR3230 gene: VGAM2397 host target protein, VGAM2398 host target protein, VGAM2399 host target protein, VGAM2400 host target protein, VGAM2401 host target protein, VGAM2402 host target protein, VGAM2403 host target protein and VGAM2404 host target protein, herein schematically represented by VGAM1 HOST TARGET PROTEIN through VGAM3 HOST TARGET PROTEIN. The function of these host target genes is elaborated hereinabove with reference to VGAM2397, VGAM2398, VGAM2399, VGAM2400, VGAM2401, VGAM2402, VGAM2403 and VGAM2404. FIG. 9 further provides a conceptual description of novel bioinformatically detected regulatory viral gene, referred to here as Viral Genomic Record 3231(VGR3231) viral gene, which encodes an 'operon-like' cluster of novel viral micro RNA-like genes, each of which in turn modulates expression of at least one host target gene, the function and utility of which at least one host target gene is known in the art.

VGR3231 gene, herein designated VGR GENE, is a novel bioinformatically detected regulatory, non protein coding, RNA viral gene. The method by which VGR3231 gene was detected is described hereinabove with reference to FIGS. 1-9.

VGR3231 gene encodes VGR3231 precursor RNA, herein designated VGR PRECURSOR RNA, an RNA molecule, typically several hundred nucleotides long.

VGR3231 precursor RNA folds spatially, forming VGR3231 folded precursor RNA, herein designated VGR FOLDED PRECURSOR RNA. It is appreciated that VGR3231 folded precursor RNA comprises a plurality of what is known in the art as 'hairpin' structures. These 'hairpin' structures are due to the fact that the nucleotide sequence of VGR3231 precursor RNA comprises a plurality of segments, the first half of each such segment having a nucleotide sequence which is at least a partial inversed-reversed sequence of the second half thereof, as is well known in the art.

VGR3231 folded precursor RNA is naturally processed by cellular enzymatic activity into at least 8 separate VGAM precursor RNAs, VGAM2405 precursor RNA, VGAM2406 precursor RNA, VGAM2407 precursor RNA, VGAM2408 precursor RNA, VGAM2409 precursor RNA, VGAM2410 precursor RNA, VGAM2411 precursor RNA and VGAM2412 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2405 RNA, VGAM2406 RNA, VGAM2407 RNA, VGAM2408 RNA, VGAM2409 RNA, VGAM2410 RNA, VGAM2411 RNA and VGAM2412 RNA, herein schematically represented by VGAM1 RNA through VGAM3 RNA, each of which VGAM RNAs corresponding to VGAM RNA of FIG. 1.

VGAM2405 RNA, herein schematically represented by VGAM1 RNA through VGAM3 RNA, binds complementarily to a host target binding site located in an untranslated region of VGAM2405 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2405 host target RNA into VGAM2405 host target protein, herein schematically represented by VGAM1 HOST TARGET PROTEIN through VGAM3 HOST TARGET PROTEIN, all of FIG. 1.

VGAM2406 RNA, herein schematically represented by VGAM1 RNA through VGAM3 RNA, binds complementarily to a host target binding site located in an untranslated region of VGAM2406 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2406 host target RNA into VGAM2406 host target protein, herein schematically represented by VGAM1 HOST TARGET PROTEIN through VGAM3 HOST TARGET PROTEIN, all of FIG. 1.

VGAM2407 RNA, herein schematically represented by VGAM1 RNA through VGAM3 RNA, binds complementarily to a host target binding site located in an untranslated region of VGAM2407 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2407 host target RNA into VGAM2407 host target protein, herein schematically represented by VGAM1 HOST TARGET PROTEIN through VGAM3 HOST TARGET PROTEIN, all of FIG. 1.

VGAM2408 RNA, herein schematically represented by VGAM1 RNA through VGAM3 RNA, binds complementarily to a host target binding site located in an untranslated region of VGAM2408 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2408 host target RNA into VGAM2408 host target protein, herein schematically represented by VGAM1 HOST TARGET PROTEIN through VGAM3 HOST TARGET PROTEIN, all of FIG. 1.

VGAM2409 RNA, herein schematically represented by VGAM1 RNA through VGAM3 RNA, binds complementarily to a host target binding site located in an untranslated region of VGAM2409 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2409 host target RNA into VGAM2409 host target protein, herein schematically represented by VGAM1 HOST TARGET PROTEIN through VGAM3 HOST TARGET PROTEIN, all of FIG. 1.

VGAM2410 RNA, herein schematically represented by VGAM1 RNA through VGAM3 RNA, binds complementarily to a host target binding site located in an untranslated region of VGAM2410 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2410 host target RNA into VGAM2410 host target protein, herein schematically represented by VGAM1 HOST TARGET PROTEIN through VGAM3 HOST TARGET PROTEIN, all of FIG. 1.

VGAM2411 RNA, herein schematically represented by VGAM1 RNA through VGAM3 RNA, binds complementarily to a host target binding site located in an untranslated region of VGAM2411 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2411 host target RNA into VGAM2411 host target protein, herein schematically represented by VGAM1 HOST TARGET PROTEIN through VGAM3 HOST TARGET PROTEIN, all of FIG. 1.

VGAM2412 RNA, herein schematically represented by VGAM1 RNA through VGAM3 RNA, binds complementarily to a host target binding site located in an untranslated region of VGAM2412 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2412 host target RNA into VGAM2412 host target protein, herein schematically represented by VGAM1 HOST TARGET PROTEIN through VGAM3 HOST TARGET PROTEIN, all of FIG. 1.

It is appreciated that a function of VGR3231 gene, herein designated VGR GENE, is inhibition of expression of host target genes, as part of a novel viral mechanism of attacking a host. Accordingly, utilities of VGR3231 gene include diagnosis, prevention and treatment of viral infection by Goatpox Virus. Specific functions, and accordingly utilities, of VGR3231 gene correlate with, and may be deduced from, the identity of the host target genes, which are inhibited by VGAM RNAs comprised in the 'operon-like' cluster of VGR3231 gene: VGAM2405 host target protein, VGAM2406 host target protein, VGAM2407 host target protein, VGAM2408 host target protein, VGAM2409 host target protein, VGAM2410 host target protein, VGAM2411 host target protein and VGAM2412 host target protein, herein schematically represented by VGAM1 HOST TARGET PROTEIN through VGAM3 HOST TARGET PROTEIN. The function of these host target genes is elaborated hereinabove with reference to VGAM2405, VGAM2406, VGAM2407, VGAM2408, VGAM2409, VGAM2410, VGAM2411 and VGAM2412. FIG. 9 further provides a conceptual description of novel bioinformatically detected regulatory viral gene, referred to here as Viral Genomic Record 3232(VGR3232) viral gene, which encodes an 'operon-like' cluster of novel viral micro RNA-like genes, each of which in turn modulates expression of at least one host target gene, the function and utility of which at least one host target gene is known in the art.

VGR3232 gene, herein designated VGR GENE, is a novel bioinformatically detected regulatory, non protein coding, RNA viral gene. The method by which VGR3232 gene was detected is described hereinabove with reference to FIGS. 1-9.

VGR3232 gene encodes VGR3232 precursor RNA, herein designated VGR PRECURSOR RNA, an RNA molecule, typically several hundred nucleotides long.

VGR3232 precursor RNA folds spatially, forming VGR3232 folded precursor RNA, herein designated VGR FOLDED PRECURSOR RNA. It is appreciated that VGR3232 folded precursor RNA comprises a plurality of what is known in the art as 'hairpin' structures. These 'hairpin' structures are due to the fact that the nucleotide sequence of VGR3232 precursor RNA comprises a plurality of segments, the first half of each such segment having a nucleotide sequence which is at least a partial inversed-reversed sequence of the second half thereof, as is well known in the art.

VGR3232 folded precursor RNA is naturally processed by cellular enzymatic activity into at least 8 separate VGAM precursor RNAs, VGAM2413 precursor RNA, VGAM2414 precursor RNA, VGAM2415 precursor RNA, VGAM2416 precursor RNA, VGAM2417 precursor RNA, VGAM2418 precursor RNA, VGAM2419 precursor RNA and VGAM2420 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2413 RNA, VGAM2414 RNA, VGAM2415 RNA, VGAM2416 RNA, VGAM2417 RNA, VGAM2418 RNA, VGAM2419 RNA and VGAM2420 RNA, herein schematically represented by VGAM1 RNA through VGAM3 RNA, each of which VGAM RNAs corresponding to VGAM RNA of FIG. 1.

VGAM2413 RNA, herein schematically represented by VGAM1 RNA through VGAM3 RNA, binds complementarily to a host target binding site located in an untranslated region of VGAM2413 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2413 host target RNA into VGAM2413 host target protein, herein schematically represented by VGAM1 HOST TARGET PROTEIN through VGAM3 HOST TARGET PROTEIN, all of FIG. 1.

VGAM2414 RNA, herein schematically represented by VGAM1 RNA through VGAM3 RNA, binds complementarily to a host target binding site located in an untranslated region of VGAM2414 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2414 host target RNA into VGAM2414 host target protein, herein schematically represented by VGAM1 HOST TARGET PROTEIN through VGAM3 HOST TARGET PROTEIN, all of FIG. 1.

VGAM2415 RNA, herein schematically represented by VGAM1 RNA through VGAM3 RNA, binds complementarily to a host target binding site located in an untranslated region of VGAM2415 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2415 host target RNA into VGAM2415 host target protein, herein schematically represented by VGAM1 HOST TARGET PROTEIN through VGAM3 HOST TARGET PROTEIN, all of FIG. 1.

VGAM2416 RNA, herein schematically represented by VGAM1 RNA through VGAM3 RNA, binds complementarily to a host target binding site located in an untranslated region of VGAM2416 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2416 host target RNA into VGAM2416 host target protein, herein schematically represented by VGAM1 HOST TARGET PROTEIN through VGAM3 HOST TARGET PROTEIN, all of FIG. 1.

VGAM2417 RNA, herein schematically represented by VGAM1 RNA through VGAM3 RNA, binds complementarily to a host target binding site located in an untranslated region of VGAM2417 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2417 host target RNA into VGAM2417 host target protein, herein schematically represented by VGAM1 HOST TARGET PROTEIN through VGAM3 HOST TARGET PROTEIN, all of FIG. 1.

VGAM2418 RNA, herein schematically represented by VGAM1 RNA through VGAM3 RNA, binds complementarily to a host target binding site located in an untranslated region of VGAM2418 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2418 host target RNA into VGAM2418 host target protein, herein schematically represented by VGAM1 HOST TARGET PROTEIN through VGAM3 HOST TARGET PROTEIN, all of FIG. 1.

VGAM2419 RNA, herein schematically represented by VGAM1 RNA through VGAM3 RNA, binds complementarily to a host target binding site located in an untranslated region of VGAM2419 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2419 host target RNA into VGAM2419 host target protein, herein schematically represented by VGAM1 HOST TARGET PROTEIN through VGAM3 HOST TARGET PROTEIN, all of FIG. 1.

VGAM2420 RNA, herein schematically represented by VGAM1 RNA through VGAM3 RNA, binds complementarily to a host target binding site located in an untranslated region of VGAM2420 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2420 host target RNA into VGAM2420 host target protein, herein schematically represented by VGAM1 HOST TARGET PROTEIN through VGAM3 HOST TARGET PROTEIN, all of FIG. 1.

It is appreciated that a function of VGR3232 gene, herein designated VGR GENE, is inhibition of expression of host target genes, as part of a novel viral mechanism of attacking a host. Accordingly, utilities of VGR3232 gene include diagnosis, prevention and treatment of viral infection by Goatpox Virus. Specific functions, and accordingly utilities, of VGR3232 gene correlate with, and may be deduced from, the identity of the host target genes, which are inhibited by VGAM RNAs comprised in the 'operon-like' cluster of VGR3232 gene: VGAM2413 host target protein, VGAM2414 host target protein, VGAM2415 host target protein, VGAM2416 host target protein, VGAM2417 host target protein, VGAM2418 host target protein, VGAM2419 host target protein and VGAM2420 host target protein, herein schematically represented by VGAM1 HOST TARGET PROTEIN through VGAM3 HOST TARGET PROTEIN. The function of these host target genes is elaborated hereinabove with reference to VGAM2413, VGAM2414, VGAM2415, VGAM2416, VGAM2417, VGAM2418, VGAM2419 and VGAM2420. FIG. 9 further provides a conceptual description of novel bioinformatically detected regulatory viral gene, referred to here as Viral Genomic Record 3233(VGR3233) viral gene, which encodes an 'operon-like' cluster of novel viral micro RNA-like genes, each of which in turn modulates expression of at least one host target gene, the function and utility of which at least one host target gene is known in the art.

VGR3233 gene, herein designated VGR GENE, is a novel bioinformatically detected regulatory, non protein coding, RNA viral gene. The method by which VGR3233 gene was detected is described hereinabove with reference to FIGS. 1-9.

VGR3233 gene encodes VGR3233 precursor RNA, herein designated VGR PRECURSOR RNA, an RNA molecule, typically several hundred nucleotides long.

VGR3233 precursor RNA folds spatially, forming VGR3233 folded precursor RNA, herein designated VGR FOLDED PRECURSOR RNA. It is appreciated that VGR3233 folded precursor RNA comprises a plurality of what is known in the art as 'hairpin' structures. These 'hairpin' structures are due to the fact that the nucleotide sequence of VGR3233 precursor RNA comprises a plurality of segments, the first half of each such segment having a nucleotide sequence which is at least a partial inversed-reversed sequence of the second half thereof, as is well known in the art.

VGR3233 folded precursor RNA is naturally processed by cellular enzymatic activity into at least 8 separate VGAM precursor RNAs, VGAM2421 precursor RNA, VGAM2422 precursor RNA, VGAM2423 precursor RNA, VGAM2424 precursor RNA, VGAM2425 precursor RNA, VGAM2426 precursor RNA, VGAM2427 precursor RNA and VGAM2428 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2421 RNA, VGAM2422 RNA, VGAM2423 RNA, VGAM2424 RNA, VGAM2425 RNA, VGAM2426 RNA, VGAM2427 RNA and VGAM2428 RNA, herein schematically represented by VGAM1 RNA through VGAM3 RNA, each of which VGAM RNAs corresponding to VGAM RNA of FIG. 1.

VGAM2421 RNA, herein schematically represented by VGAM1 RNA through VGAM3 RNA, binds complementarily to a host target binding site located in an untranslated region of VGAM2421 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2421 host target RNA into VGAM2421 host target protein, herein schematically represented by VGAM1 HOST TARGET PROTEIN through VGAM3 HOST TARGET PROTEIN, all of FIG. 1.

VGAM2422 RNA, herein schematically represented by VGAM1 RNA through VGAM3 RNA, binds complementarily to a host target binding site located in an untranslated region of VGAM2422 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2422 host target RNA into VGAM2422 host target protein, herein schematically represented by VGAM1 HOST TARGET PROTEIN through VGAM3 HOST TARGET PROTEIN, all of FIG. 1.

VGAM2423 RNA, herein schematically represented by VGAM1 RNA through VGAM3 RNA, binds complementarily to a host target binding site located in an untranslated region of VGAM2423 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2423 host target RNA into VGAM2423 host target protein, herein schematically represented by VGAM1 HOST TARGET PROTEIN through VGAM3 HOST TARGET PROTEIN, all of FIG. 1.

VGAM2424 RNA, herein schematically represented by VGAM1 RNA through VGAM3 RNA, binds complementarily to a host target binding site located in an untranslated region of VGAM2424 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2424 host target RNA into VGAM2424 host target protein, herein schematically represented by VGAM1 HOST TARGET PROTEIN through VGAM3 HOST TARGET PROTEIN, all of FIG. 1.

VGAM2425 RNA, herein schematically represented by VGAM1 RNA through VGAM3 RNA, binds complementarily to a host target binding site located in an untranslated region of VGAM2425 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2425 host target RNA into VGAM2425 host target protein, herein schematically represented by VGAM1 HOST TARGET PROTEIN through VGAM3 HOST TARGET PROTEIN, all of FIG. 1.

VGAM2426 RNA, herein schematically represented by VGAM1 RNA through VGAM3 RNA, binds complementarily to a host target binding site located in an untranslated region of VGAM2426 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2426 host target RNA into VGAM2426 host target protein, herein schematically represented by VGAM1 HOST TARGET PROTEIN through VGAM3 HOST TARGET PROTEIN, all of FIG. 1.

VGAM2427 RNA, herein schematically represented by VGAM1 RNA through VGAM3 RNA, binds complementarily to a host target binding site located in an untranslated region of VGAM2427 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2427 host target RNA into VGAM2427 host target protein, herein schematically represented by VGAM1 HOST TARGET PROTEIN through VGAM3 HOST TARGET PROTEIN, all of FIG. 1.

VGAM2428 RNA, herein schematically represented by VGAM1 RNA through VGAM3 RNA, binds complementarily to a host target binding site located in an untranslated region of VGAM2428 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2428 host target RNA into VGAM2428 host target protein, herein schematically represented by VGAM1 HOST TARGET PROTEIN through VGAM3 HOST TARGET PROTEIN, all of FIG. 1.

It is appreciated that a function of VGR3233 gene, herein designated VGR GENE, is inhibition of expression of host target genes, as part of a novel viral mechanism of attacking a host. Accordingly, utilities of VGR3233 gene include diagnosis, prevention and treatment of viral infection by Goatpox Virus. Specific functions, and accordingly utilities, of VGR3233 gene correlate with, and may be deduced from, the identity of the host target genes, which are inhibited by VGAM RNAs comprised in the 'operon-like' cluster of VGR3233 gene: VGAM2421 host target protein, VGAM2422 host target protein, VGAM2423 host target protein, VGAM2424 host target protein, VGAM2425 host target protein, VGAM2426 host target protein, VGAM2427 host target protein and VGAM2428 host target protein, herein schematically represented by VGAM1 HOST TARGET PROTEIN through VGAM3 HOST TARGET PROTEIN. The function of these host target genes is elaborated hereinabove with reference to VGAM2421, VGAM2422, VGAM2423, VGAM2424, VGAM2425, VGAM2426, VGAM2427 and VGAM2428. FIG. 9 further provides a conceptual description of novel bioinformatically detected regulatory viral gene, referred to here as Viral Genomic Record 3234(VGR3234) viral gene, which encodes an 'operon-like' cluster of novel viral micro RNA-like genes, each of which in turn modulates expression of at least one host target gene, the function and utility of which at least one host target gene is known in the art.

VGR3234 gene, herein designated VGR GENE, is a novel bioinformatically detected regulatory, non protein coding, RNA viral gene. The method by which VGR3234 gene was detected is described hereinabove with reference to FIGS. 1-9.

VGR3234 gene encodes VGR3234 precursor RNA, herein designated VGR PRECURSOR RNA, an RNA molecule, typically several hundred nucleotides long.

VGR3234 precursor RNA folds spatially, forming VGR3234 folded precursor RNA, herein designated VGR FOLDED PRECURSOR RNA. It is appreciated that VGR3234 folded precursor RNA comprises a plurality of what is known in the art as 'hairpin' structures. These 'hairpin' structures are due to the fact that the nucleotide sequence of VGR3234 precursor RNA comprises a plurality of segments, the first half of each such segment having a nucleotide sequence which is at least a partial inversed-reversed sequence of the second half thereof, as is well known in the art.

VGR3234 folded precursor RNA is naturally processed by cellular enzymatic activity into at least 8 separate VGAM precursor RNAs, VGAM2429 precursor RNA, VGAM2430 precursor RNA, VGAM2431 precursor RNA, VGAM2432 precursor RNA, VGAM2433 precursor RNA, VGAM2434 precursor RNA, VGAM2435 precursor RNA and VGAM2436 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2429 RNA, VGAM2430 RNA, VGAM2431 RNA, VGAM2432 RNA, VGAM2433 RNA, VGAM2434 RNA, VGAM2435 RNA and VGAM2436 RNA, herein schematically represented by VGAM1 RNA through VGAM3 RNA, each of which VGAM RNAs corresponding to VGAM RNA of FIG. 1.

VGAM2429 RNA, herein schematically represented by VGAM1 RNA through VGAM3 RNA, binds complementarily to a host target binding site located in an untranslated region of VGAM2429 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2429 host target RNA into VGAM2429 host target protein, herein schematically represented by VGAM1 HOST TARGET PROTEIN through VGAM3 HOST TARGET PROTEIN, all of FIG. 1.

VGAM2430 RNA, herein schematically represented by VGAM1 RNA through VGAM3 RNA, binds complementarily to a host target binding site located in an untranslated region of VGAM2430 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2430 host target RNA into VGAM2430 host target protein, herein schematically represented by VGAM1 HOST TARGET PROTEIN through VGAM3 HOST TARGET PROTEIN, all of FIG. 1.

VGAM2431 RNA, herein schematically represented by VGAM1 RNA through VGAM3 RNA, binds complementarily to a host target binding site located in an untranslated region of VGAM2431 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2431 host target RNA into VGAM2431 host target protein, herein schematically represented by VGAM1 HOST TARGET PROTEIN through VGAM3 HOST TARGET PROTEIN, all of FIG. 1.

VGAM2432 RNA, herein schematically represented by VGAM1 RNA through VGAM3 RNA, binds complementarily to a host target binding site located in an untranslated region of VGAM2432 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2432 host target RNA into VGAM2432 host target protein, herein schematically represented by VGAM1 HOST TARGET PROTEIN through VGAM3 HOST TARGET PROTEIN, all of FIG. 1.

VGAM2433 RNA, herein schematically represented by VGAM1 RNA through VGAM3 RNA, binds complementarily to a host target binding site located in an untranslated region of VGAM2433 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2433 host target RNA into VGAM2433 host target protein, herein schematically represented by VGAM1 HOST TARGET PROTEIN through VGAM3 HOST TARGET PROTEIN, all of FIG. 1.

VGAM2434 RNA, herein schematically represented by VGAM1 RNA through VGAM3 RNA, binds complementarily to a host target binding site located in an untranslated region of VGAM2434 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2434 host target RNA into VGAM2434 host target protein, herein schematically represented by VGAM1 HOST TARGET PROTEIN through VGAM3 HOST TARGET PROTEIN, all of FIG. 1.

VGAM2435 RNA, herein schematically represented by VGAM1 RNA through VGAM3 RNA, binds complementarily to a host target binding site located in an untranslated region of VGAM2435 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2435 host target RNA into VGAM2435 host target protein, herein schematically represented by VGAM1 HOST TARGET PROTEIN through VGAM3 HOST TARGET PROTEIN, all of FIG. 1.

VGAM2436 RNA, herein schematically represented by VGAM1 RNA through VGAM3 RNA, binds complementarily to a host target binding site located in an untranslated region of VGAM2436 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2436 host target RNA into VGAM2436 host target protein, herein schematically represented by VGAM1 HOST TARGET PROTEIN through VGAM3 HOST TARGET PROTEIN, all of FIG. 1.

It is appreciated that a function of VGR3234 gene, herein designated VGR GENE, is inhibition of expression of host target genes, as part of a novel viral mechanism of attacking a host. Accordingly, utilities of VGR3234 gene include diagnosis, prevention and treatment of viral infection by Goatpox Virus. Specific functions, and accordingly utilities, of VGR3234 gene correlate with, and may be deduced from, the identity of the host target genes, which are inhibited by VGAM RNAs comprised in the 'operon-like' cluster of VGR3234 gene: VGAM2429 host target protein, VGAM2430 host target protein, VGAM2431 host target protein, VGAM2432 host target protein, VGAM2433 host target protein, VGAM2434 host target protein, VGAM2435 host target protein and VGAM2436 host target protein, herein schematically represented by VGAM1 HOST TARGET PROTEIN through VGAM3 HOST TARGET PROTEIN. The function of these host target genes is elaborated hereinabove with reference to VGAM2429, VGAM2430, VGAM2431, VGAM2432, VGAM2433, VGAM2434, VGAM2435 and VGAM2436. FIG. 9 further provides a conceptual description of novel bioinformatically detected regulatory viral gene, referred to here as Viral Genomic Record 3235(VGR3235) viral gene, which encodes an 'operon-like' cluster of novel viral micro RNA-like genes, each of which in turn modulates expression of at least one host target gene, the function and utility of which at least one host target gene is known in the art.

VGR3235 gene, herein designated VGR GENE, is a novel bioinformatically detected regulatory, non protein coding, RNA viral gene. The method by which VGR3235 gene was detected is described hereinabove with reference to FIGS. 1-9.

VGR3235 gene encodes VGR3235 precursor RNA, herein designated VGR PRECURSOR RNA, an RNA molecule, typically several hundred nucleotides long.

VGR3235 precursor RNA folds spatially, forming VGR3235 folded precursor RNA, herein designated VGR FOLDED PRECURSOR RNA. It is appreciated that VGR3235 folded precursor RNA comprises a plurality of what is known in the art as 'hairpin' structures. These 'hairpin' structures are due to the fact that the nucleotide sequence of VGR3235 precursor RNA comprises a plurality of segments, the first half of each such segment having a nucleotide sequence which is at least a partial inversed-reversed sequence of the second half thereof, as is well known in the art.

VGR3235 folded precursor RNA is naturally processed by cellular enzymatic activity into at least 6 separate VGAM precursor RNAs, VGAM2437 precursor RNA, VGAM2438 precursor RNA, VGAM2439 precursor RNA, VGAM2440 precursor RNA, VGAM2441 precursor RNA and VGAM2442 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2437 RNA, VGAM2438 RNA, VGAM2439 RNA, VGAM2440 RNA, VGAM2441 RNA and VGAM2442 RNA, herein schematically represented by VGAM1 RNA through VGAM3 RNA, each of which VGAM RNAs corresponding to VGAM RNA of FIG. 1.

VGAM2437 RNA, herein schematically represented by VGAM1 RNA through VGAM3 RNA, binds complementarily to a host target binding site located in an untranslated region of VGAM2437 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2437 host target RNA into VGAM2437 host target protein, herein schematically represented by VGAM1 HOST TARGET PROTEIN through VGAM3 HOST TARGET PROTEIN, all of FIG. 1.

VGAM2438 RNA, herein schematically represented by VGAM1 RNA through VGAM3 RNA, binds complementarily to a host target binding site located in an untranslated region of VGAM2438 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2438 host target RNA into VGAM2438 host target protein, herein schematically represented by VGAM1 HOST TARGET PROTEIN through VGAM3 HOST TARGET PROTEIN, all of FIG. 1.

VGAM2439 RNA, herein schematically represented by VGAM1 RNA through VGAM3 RNA, binds complementarily to a host target binding site located in an untranslated region of VGAM2439 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2439 host target RNA into VGAM2439 host target protein, herein schematically represented by VGAM1 HOST TARGET PROTEIN through VGAM3 HOST TARGET PROTEIN, all of FIG. 1.

VGAM2440 RNA, herein schematically represented by VGAM1 RNA through VGAM3 RNA, binds complementarily to a host target binding site located in an untranslated region of VGAM2440 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2440 host target RNA into VGAM2440 host target protein, herein schematically represented by VGAM1 HOST TARGET PROTEIN through VGAM3 HOST TARGET PROTEIN, all of FIG. 1.

VGAM2441 RNA, herein schematically represented by VGAM1 RNA through VGAM3 RNA, binds complementarily to a host target binding site located in an untranslated region of VGAM2441 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2441 host target RNA into VGAM2441 host target protein, herein schematically represented by VGAM1 HOST TARGET PROTEIN through VGAM3 HOST TARGET PROTEIN, all of FIG. 1.

VGAM2442 RNA, herein schematically represented by VGAM1 RNA through VGAM3 RNA, binds complementarily to a host target binding site located in an untranslated region of VGAM2442 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2442 host target RNA into VGAM2442 host target protein, herein schematically represented by VGAM1 HOST TARGET PROTEIN through VGAM3 HOST TARGET PROTEIN, all of FIG. 1.

It is appreciated that a function of VGR3235 gene, herein designated VGR GENE, is inhibition of expression of host target genes, as part of a novel viral mechanism of attacking a host. Accordingly, utilities of VGR3235 gene include diagnosis, prevention and treatment of viral infection by Goatpox Virus. Specific functions, and accordingly utilities, of VGR3235 gene correlate with, and may be deduced from, the identity of the host target genes, which are inhibited by VGAM RNAs comprised in the 'operon-like' cluster of VGR3235 gene: VGAM2437 host target protein, VGAM2438 host target protein, VGAM2439 host target protein, VGAM2440 host target protein, VGAM2441 host target protein and VGAM2442 host target protein, herein schematically represented by VGAM1 HOST TARGET PROTEIN through VGAM3 HOST TARGET PROTEIN. The function of these host target genes is elaborated hereinabove with reference to VGAM2437, VGAM2438, VGAM2439, VGAM2440, VGAM2441 and VGAM2442. FIG. 9 further provides a conceptual description of novel bioinformatically detected regulatory viral gene, referred to here as Viral Genomic Record 3236(VGR3236) viral gene, which encodes an 'operon-like' cluster of novel viral micro RNA-like genes, each of which in turn modulates expression of at least one host target gene, the function and utility of which at least one host target gene is known in the art.

VGR3236 gene, herein designated VGR GENE, is a novel bioinformatically detected regulatory, non protein coding, RNA viral gene. The method by which VGR3236 gene was detected is described hereinabove with reference to FIGS. 1-9.

VGR3236 gene encodes VGR3236 precursor RNA, herein designated VGR PRECURSOR RNA, an RNA molecule, typically several hundred nucleotides long.

VGR3236 precursor RNA folds spatially, forming VGR3236 folded precursor RNA, herein designated VGR FOLDED PRECURSOR RNA. It is appreciated that VGR3236 folded precursor RNA comprises a plurality of what is known in the art as 'hairpin' structures. These 'hairpin' structures are due to the fact that the nucleotide sequence of VGR3236 precursor RNA comprises a plurality of segments, the first half of each such segment having a nucleotide sequence which is at least a partial inversed-reversed sequence of the second half thereof, as is well known in the art.

VGR3236 folded precursor RNA is naturally processed by cellular enzymatic activity into at least 8 separate VGAM precursor RNAs, VGAM2443 precursor RNA, VGAM2444 precursor RNA, VGAM2445 precursor RNA, VGAM2446 precursor RNA, VGAM2447 precursor RNA, VGAM2448 precursor RNA, VGAM2449 precursor RNA and VGAM2450 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2443 RNA, VGAM2444 RNA, VGAM2445 RNA, VGAM2446 RNA, VGAM2447 RNA, VGAM2448 RNA, VGAM2449 RNA and VGAM2450 RNA, herein schematically represented by VGAM1 RNA through VGAM3 RNA, each of which VGAM RNAs corresponding to VGAM RNA of FIG. 1.

VGAM2443 RNA, herein schematically represented by VGAM1 RNA through VGAM3 RNA, binds complementarily to a host target binding site located in an untranslated region of VGAM2443 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2443 host target RNA into VGAM2443 host target protein, herein schematically represented by VGAM1 HOST TARGET PROTEIN through VGAM3 HOST TARGET PROTEIN, all of FIG. 1.

VGAM2444 RNA, herein schematically represented by VGAM1 RNA through VGAM3 RNA, binds complementarily to a host target binding site located in an untranslated region of VGAM2444 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2444 host target RNA into VGAM2444 host target protein, herein schematically represented by VGAM1 HOST TARGET PROTEIN through VGAM3 HOST TARGET PROTEIN, all of FIG. 1.

VGAM2445 RNA, herein schematically represented by VGAM1 RNA through VGAM3 RNA, binds complementarily to a host target binding site located in an untranslated region of VGAM2445 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2445 host target RNA into VGAM2445 host target protein, herein schematically represented by VGAM1 HOST TARGET PROTEIN through VGAM3 HOST TARGET PROTEIN, all of FIG. 1.

VGAM2446 RNA, herein schematically represented by

VGAM1 RNA through VGAM3 RNA, binds complementarily to a host target binding site located in an untranslated region of VGAM2446 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2446 host target RNA into VGAM2446 host target protein, herein schematically represented by VGAM1 HOST TARGET PROTEIN through VGAM3 HOST TARGET PROTEIN, all of FIG. 1.

VGAM2447 RNA, herein schematically represented by VGAM1 RNA through VGAM3 RNA, binds complementarily to a host target binding site located in an untranslated region of VGAM2447 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2447 host target RNA into VGAM2447 host target protein, herein schematically represented by VGAM1 HOST TARGET PROTEIN through VGAM3 HOST TARGET PROTEIN, all of FIG. 1.

VGAM2448 RNA, herein schematically represented by VGAM1 RNA through VGAM3 RNA, binds complementarily to a host target binding site located in an untranslated region of VGAM2448 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2448 host target RNA into VGAM2448 host target protein, herein schematically represented by VGAM1 HOST TARGET PROTEIN through VGAM3 HOST TARGET PROTEIN, all of FIG. 1.

VGAM2449 RNA, herein schematically represented by VGAM1 RNA through VGAM3 RNA, binds complementarily to a host target binding site located in an untranslated region of VGAM2449 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2449 host target RNA into VGAM2449 host target protein, herein schematically represented by VGAM1 HOST TARGET PROTEIN through VGAM3 HOST TARGET PROTEIN, all of FIG. 1.

VGAM2450 RNA, herein schematically represented by VGAM1 RNA through VGAM3 RNA, binds complementarily to a host target binding site located in an untranslated region of VGAM2450 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2450 host target RNA into VGAM2450 host target protein, herein schematically represented by VGAM1 HOST TARGET PROTEIN through VGAM3 HOST TARGET PROTEIN, all of FIG. 1.

It is appreciated that a function of VGR3236 gene, herein designated VGR GENE, is inhibition of expression of host target genes, as part of a novel viral mechanism of attacking a host. Accordingly, utilities of VGR3236 gene include diagnosis, prevention and treatment of viral infection by Mouse Cytomegalovirus 1. Specific functions, and accordingly utilities, of VGR3236 gene correlate with, and may be deduced from, the identity of the host target genes, which are inhibited by VGAM RNAs comprised in the 'operon-like' cluster of VGR3236 gene: VGAM2443 host target protein, VGAM2444 host target protein, VGAM2445 host target protein, VGAM2446 host target protein, VGAM2447 host target protein, VGAM2448 host target protein, VGAM2449 host target protein and VGAM2450 host target protein, herein schematically represented by VGAM1 HOST TARGET PROTEIN through VGAM3 HOST TARGET PROTEIN. The function of these host target genes is elaborated hereinabove with reference to VGAM2443, VGAM2444, VGAM2445, VGAM2446, VGAM2447, VGAM2448, VGAM2449 and VGAM2450. FIG. 9 further provides a conceptual description of novel bioinformatically detected regulatory viral gene, referred to here as Viral Genomic Record 3237(VGR3237) viral gene, which encodes an 'operon-like' cluster of novel viral micro RNA-like genes, each of which in turn modulates expression of at least one host target gene, the function and utility of which at least one host target gene is known in the art.

VGR3237 gene, herein designated VGR GENE, is a novel bioinformatically detected regulatory, non protein coding, RNA viral gene. The method by which VGR3237 gene was detected is described hereinabove with reference to FIGS. 1-9.

VGR3237 gene encodes VGR3237 precursor RNA, herein designated VGR PRECURSOR RNA, an RNA molecule, typically several hundred nucleotides long.

VGR3237 precursor RNA folds spatially, forming VGR3237 folded precursor RNA, herein designated VGR FOLDED PRECURSOR RNA. It is appreciated that VGR3237 folded precursor RNA comprises a plurality of what is known in the art as 'hairpin' structures. These 'hairpin' structures are due to the fact that the nucleotide sequence of VGR3237 precursor RNA comprises a plurality of segments, the first half of each such segment having a nucleotide sequence which is at least a partial inversed-reversed sequence of the second half thereof, as is well known in the art.

VGR3237 folded precursor RNA is naturally processed by cellular enzymatic activity into at least 8 separate VGAM precursor RNAs, VGAM2451 precursor RNA, VGAM2452 precursor RNA, VGAM2453 precursor RNA, VGAM2454 precursor RNA, VGAM2455 precursor RNA, VGAM2456 precursor RNA, VGAM2457 precursor RNA and VGAM2458 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2451 RNA, VGAM2452 RNA, VGAM2453 RNA, VGAM2454 RNA, VGAM2455 RNA, VGAM2456 RNA, VGAM2457 RNA and VGAM2458 RNA, herein schematically represented by VGAM1 RNA through VGAM3 RNA, each of which VGAM RNAs corresponding to VGAM RNA of FIG. 1.

VGAM2451 RNA, herein schematically represented by VGAM1 RNA through VGAM3 RNA, binds complementarily to a host target binding site located in an untranslated region of VGAM2451 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM2451 host target RNA into VGAM2451 host target protein, herein schematically represented by VGAM1 HOST TARGET PROTEIN through VGAM3 HOST TARGET PROTEIN, all of FIG. 1.

VGAM2452 RNA, herein schematically represented by VGAM1 RNA through VGAM3 RNA, binds complementarily to a host target binding site located in an untranslated region of VGAM2452 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2452 host target RNA into VGAM2452 host target protein, herein schematically represented by VGAM1 HOST TARGET PROTEIN through VGAM3 HOST TARGET PROTEIN, all of FIG. 1.

VGAM2453 RNA, herein schematically represented by VGAM1 RNA through VGAM3 RNA, binds complementarily to a host target binding site located in an untranslated region of VGAM2453 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2453 host target RNA into VGAM2453 host target protein, herein schematically represented by VGAM1 HOST TARGET PROTEIN through VGAM3 HOST TARGET PROTEIN, all of FIG. 1.

VGAM2454 RNA, herein schematically represented by VGAM1 RNA through VGAM3 RNA, binds complementarily to a host target binding site located in an untranslated region of VGAM2454 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2454 host target RNA into VGAM2454 host target protein, herein schematically represented by VGAM1 HOST TARGET PROTEIN through VGAM3 HOST TARGET PROTEIN, all of FIG. 1.

VGAM2455 RNA, herein schematically represented by VGAM1 RNA through VGAM3 RNA, binds complementarily to a host target binding site located in an untranslated region of VGAM2455 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2455 host target RNA into VGAM2455 host target protein, herein schematically represented by VGAM1 HOST TARGET PROTEIN through VGAM3 HOST TARGET PROTEIN, all of FIG. 1.

VGAM2456 RNA, herein schematically represented by VGAM1 RNA through VGAM3 RNA, binds complementarily to a host target binding site located in an untranslated region of VGAM2456 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2456 host target RNA into VGAM2456 host target protein, herein schematically represented by VGAM1 HOST TARGET PROTEIN through VGAM3 HOST TARGET PROTEIN, all of FIG. 1.

VGAM2457 RNA, herein schematically represented by VGAM1 RNA through VGAM3 RNA, binds complementarily to a host target binding site located in an untranslated region of VGAM2457 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2457 host target RNA into VGAM2457 host target protein, herein schematically represented by VGAM1 HOST TARGET PROTEIN through VGAM3 HOST TARGET PROTEIN, all of FIG. 1.

VGAM2458 RNA, herein schematically represented by VGAM1 RNA through VGAM3 RNA, binds complementarily to a host target binding site located in an untranslated region of VGAM2458 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2458 host target RNA into VGAM2458 host target protein, herein schematically represented by VGAM1 HOST TARGET PROTEIN through VGAM3 HOST TARGET PROTEIN, all of FIG. 1.

It is appreciated that a function of VGR3237 gene, herein designated VGR GENE, is inhibition of expression of host target genes, as part of a novel viral mechanism of attacking a host. Accordingly, utilities of VGR3237 gene include diagnosis, prevention and treatment of viral infection by Mouse Cytomegalovirus 1. Specific functions, and accordingly utilities, of VGR3237 gene correlate with, and may be deduced from, the identity of the host target genes, which are inhibited by VGAM RNAs comprised in the 'operon-like' cluster of VGR3237 gene: VGAM2451 host target protein, VGAM2452 host target protein, VGAM2453 host target protein, VGAM2454 host target protein, VGAM2455 host target protein, VGAM2456 host target protein, VGAM2457 host target protein and VGAM2458 host target protein, herein schematically represented by VGAM1 HOST TARGET PROTEIN through VGAM3 HOST TARGET PROTEIN. The function of these host target genes is elaborated hereinabove with reference to VGAM2451, VGAM2452, VGAM2453, VGAM2454, VGAM2455, VGAM2456, VGAM2457 and VGAM2458. FIG. 9 further provides a conceptual description of novel bioinformatically detected regulatory viral gene, referred to here as Viral Genomic Record 3238(VGR3238) viral gene, which encodes an 'operon-like' cluster of novel viral micro RNA-like genes, each of which in turn modulates expression of at least one host target gene, the function and utility of which at least one host target gene is known in the art.

VGR3238 gene, herein designated VGR GENE, is a novel bioinformatically detected regulatory, non protein coding, RNA viral gene. The method by which VGR3238 gene was detected is described hereinabove with reference to FIGS. 1-9.

VGR3238 gene encodes VGR3238 precursor RNA, herein designated VGR PRECURSOR RNA, an RNA molecule, typically several hundred nucleotides long.

VGR3238 precursor RNA folds spatially, forming VGR3238 folded precursor RNA, herein designated VGR FOLDED PRECURSOR RNA. It is appreciated that VGR3238 folded precursor RNA comprises a plurality of what is known in the art as 'hairpin' structures. These 'hairpin' structures are due to the fact that the nucleotide sequence of VGR3238 precursor RNA comprises a plurality of segments, the first half of each such segment having a nucleotide sequence which is at least a partial inversed-reversed sequence of the second half thereof, as is well known in the art.

VGR3238 folded precursor RNA is naturally processed by cellular enzymatic activity into at least 8 separate VGAM precursor RNAs, VGAM2459 precursor RNA, VGAM2460 precursor RNA, VGAM2461 precursor RNA, VGAM2462 precursor RNA, VGAM2463 precursor RNA, VGAM2464 precursor RNA, VGAM2465 precursor RNA and VGAM2466 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2459 RNA, VGAM2460 RNA, VGAM2461 RNA, VGAM2462 RNA, VGAM2463 RNA, VGAM2464 RNA, VGAM2465 RNA and VGAM2466 RNA, herein schematically represented by VGAM1 RNA through VGAM3 RNA, each of which VGAM RNAs corresponding to VGAM RNA of FIG. 1.

VGAM2459 RNA, herein schematically represented by VGAM1 RNA through VGAM3 RNA, binds complementarily to a host target binding site located in an untranslated region of VGAM2459 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2459 host target RNA into VGAM2459 host target protein, herein schematically represented by VGAM1 HOST TARGET PROTEIN through VGAM3 HOST TARGET PROTEIN, all of FIG. 1.

VGAM2460 RNA, herein schematically represented by VGAM1 RNA through VGAM3 RNA, binds complementarily to a host target binding site located in an untranslated region of VGAM2460 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2460 host target RNA into VGAM2460 host target protein, herein schematically represented by VGAM1 HOST TARGET PROTEIN through VGAM3 HOST TARGET PROTEIN, all of FIG. 1.

VGAM2461 RNA, herein schematically represented by VGAM1 RNA through VGAM3 RNA, binds complementarily to a host target binding site located in an untranslated region of VGAM2461 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2461 host target RNA into VGAM2461 host target protein, herein schematically represented by VGAM1 HOST TARGET PROTEIN through VGAM3 HOST TARGET PROTEIN, all of FIG. 1.

VGAM2462 RNA, herein schematically represented by VGAM1 RNA through VGAM3 RNA, binds complementarily to a host target binding site located in an untranslated region of VGAM2462 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2462 host target RNA into VGAM2462 host target protein, herein schematically represented by VGAM1 HOST TARGET PROTEIN through VGAM3 HOST TARGET PROTEIN, all of FIG. 1.

VGAM2463 RNA, herein schematically represented by VGAM1 RNA through VGAM3 RNA, binds complementarily to a host target binding site located in an untranslated region of VGAM2463 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2463 host target RNA into VGAM2463 host target protein, herein schematically represented by VGAM1 HOST TARGET PROTEIN through VGAM3 HOST TARGET PROTEIN, all of FIG. 1.

VGAM2464 RNA, herein schematically represented by VGAM1 RNA through VGAM3 RNA, binds complementarily to a host target binding site located in an untranslated region of VGAM2464 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2464 host target RNA into VGAM2464 host target protein, herein schematically represented by VGAM1 HOST TARGET PROTEIN through VGAM3 HOST TARGET PROTEIN, all of FIG. 1.

VGAM2465 RNA, herein schematically represented by VGAM1 RNA through VGAM3 RNA, binds complementarily to a host target binding site located in an untranslated region of VGAM2465 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2465 host target RNA into VGAM2465 host target protein, herein schematically represented by VGAM1 HOST TARGET PROTEIN through VGAM3 HOST TARGET PROTEIN, all of FIG. 1.

VGAM2466 RNA, herein schematically represented by VGAM1 RNA through VGAM3 RNA, binds complementarily to a host target binding site located in an untranslated region of VGAM2466 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2466 host target RNA into VGAM2466 host target protein, herein schematically represented by VGAM1 HOST TARGET PROTEIN through VGAM3 HOST TARGET PROTEIN, all of FIG. 1.

It is appreciated that a function of VGR3238 gene, herein designated VGR GENE, is inhibition of expression of host target genes, as part of a novel viral mechanism of attacking a host. Accordingly, utilities of VGR3238 gene include diagnosis, prevention and treatment of viral infection by Mouse Cytomegalovirus 1. Specific functions, and accordingly utilities, of VGR3238 gene correlate with, and may be deduced from, the identity of the host target genes, which are inhibited by VGAM RNAs comprised in the 'operon-like' cluster of VGR3238 gene: VGAM2459 host target protein, VGAM2460 host target protein, VGAM2461 host target protein, VGAM2462 host target protein, VGAM2463 host target protein, VGAM2464 host target protein, VGAM2465 host target protein and VGAM2466 host target protein, herein schematically represented by VGAM1 HOST TARGET PROTEIN through VGAM3 HOST TARGET PROTEIN. The function of these host target genes is elaborated hereinabove with reference to VGAM2459, VGAM2460, VGAM2461, VGAM2462, VGAM2463, VGAM2464, VGAM2465 and VGAM2466. FIG. 9 further provides a conceptual description of novel bioinformatically detected regulatory viral gene, referred to here as Viral Genomic Record 3239(VGR3239) viral gene, which encodes an 'operon-like' cluster of novel viral micro RNA-like genes, each of which in turn modulates expression of at least one host target gene, the function and utility of which at least one host target gene is known in the art.

VGR3239 gene, herein designated VGR GENE, is a novel bioinformatically detected regulatory, non protein coding, RNA viral gene. The method by which VGR3239 gene was detected is described hereinabove with reference to FIGS. 1-9.

VGR3239 gene encodes VGR3239 precursor RNA, herein designated VGR PRECURSOR RNA, an RNA molecule, typically several hundred nucleotides long.

VGR3239 precursor RNA folds spatially, forming VGR3239 folded precursor RNA, herein designated VGR FOLDED PRECURSOR RNA. It is appreciated that VGR3239 folded precursor RNA comprises a plurality of what is known in the art as 'hairpin' structures. These 'hairpin' structures are due to the fact that the nucleotide sequence of VGR3239 precursor RNA comprises a plurality of segments, the first half of each such segment having a nucleotide sequence which is at least a partial inversed-reversed sequence of the second half thereof, as is well known in the art.

VGR3239 folded precursor RNA is naturally processed by cellular enzymatic activity into at least 8 separate VGAM precursor RNAs, VGAM2467 precursor RNA, VGAM2468 precursor RNA, VGAM2469 precursor RNA, VGAM2470 precursor RNA, VGAM2471 precursor RNA, VGAM2472 precursor RNA, VGAM2473 precursor RNA and VGAM2474 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2467 RNA, VGAM2468 RNA, VGAM2469 RNA, VGAM2470 RNA, VGAM2471 RNA, VGAM2472 RNA, VGAM2473 RNA and VGAM2474 RNA, herein schematically represented by VGAM1 RNA through VGAM3 RNA, each of which VGAM RNAs corresponding to VGAM RNA of FIG. 1.

VGAM2467 RNA, herein schematically represented by VGAM1 RNA through VGAM3 RNA, binds complementarily to a host target binding site located in an untranslated region of VGAM2467 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2467 host target RNA into VGAM2467 host target protein, herein schematically represented by VGAM1 HOST TARGET PROTEIN through VGAM3 HOST TARGET PROTEIN, all of FIG. 1.

VGAM2468 RNA, herein schematically represented by VGAM1 RNA through VGAM3 RNA, binds complementarily to a host target binding site located in an untranslated region of VGAM2468 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2468 host target RNA into VGAM2468 host target protein, herein schematically represented by VGAM1 HOST TARGET PROTEIN through VGAM3 HOST TARGET PROTEIN, all of FIG. 1.

VGAM2469 RNA, herein schematically represented by VGAM1 RNA through VGAM3 RNA, binds complementarily to a host target binding site located in an untranslated region of VGAM2469 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2469 host target RNA into VGAM2469 host target protein, herein schematically represented by VGAM1 HOST TARGET PROTEIN through VGAM3 HOST TARGET PROTEIN, all of FIG. 1.

VGAM2470 RNA, herein schematically represented by VGAM1 RNA through VGAM3 RNA, binds complementarily to a host target binding site located in an untranslated region of VGAM2470 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2470 host target RNA into VGAM2470 host target protein, herein schematically represented by VGAM1 HOST TARGET PROTEIN through VGAM3 HOST TARGET PROTEIN, all of FIG. 1.

VGAM2471 RNA, herein schematically represented by VGAM1 RNA through VGAM3 RNA, binds complementarily to a host target binding site located in an untranslated region of VGAM2471 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2471 host target RNA into VGAM2471 host target protein, herein schematically represented by VGAM1 HOST TARGET PROTEIN through VGAM3 HOST TARGET PROTEIN, all of FIG. 1.

VGAM2472 RNA, herein schematically represented by VGAM1 RNA through VGAM3 RNA, binds complementarily to a host target binding site located in an untranslated region of VGAM2472 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2472 host target RNA into VGAM2472 host target protein, herein schematically represented by VGAM1 HOST TARGET PROTEIN through VGAM3 HOST TARGET PROTEIN, all of FIG. 1.

VGAM2473 RNA, herein schematically represented by VGAM1 RNA through VGAM3 RNA, binds complementarily to a host target binding site located in an untranslated region of VGAM2473 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2473 host target RNA into VGAM2473 host target protein, herein schematically represented by VGAM1 HOST TARGET PROTEIN through VGAM3 HOST TARGET PROTEIN, all of FIG. 1.

VGAM2474 RNA, herein schematically represented by VGAM1 RNA through VGAM3 RNA, binds complementarily to a host target binding site located in an untranslated region of VGAM2474 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2474 host target RNA into VGAM2474 host target protein, herein schematically represented by VGAM1 HOST TARGET PROTEIN through VGAM3 HOST TARGET PROTEIN, all of FIG. 1.

It is appreciated that a function of VGR3239 gene, herein designated VGR GENE, is inhibition of expression of host target genes, as part of a novel viral mechanism of attacking a host. Accordingly, utilities of VGR3239 gene include diagnosis, prevention and treatment of viral infection by Mouse Cytomegalovirus 1. Specific functions, and accordingly utilities, of VGR3239 gene correlate with, and may be deduced from, the identity of the host target genes, which are inhibited by VGAM RNAs comprised in the 'operon-like' cluster of VGR3239 gene: VGAM2467 host target protein, VGAM2468 host target protein, VGAM2469 host target protein, VGAM2470 host target protein, VGAM2471 host target protein, VGAM2472 host target protein, VGAM2473 host target protein and VGAM2474 host target protein, herein schematically represented by VGAM1 HOST TARGET PROTEIN through VGAM3 HOST TARGET PROTEIN. The function of these host target genes is elaborated hereinabove with reference to VGAM2467, VGAM2468, VGAM2469, VGAM2470, VGAM2471, VGAM2472, VGAM2473 and VGAM2474. FIG. 9 further provides a conceptual description of novel bioinformatically detected regulatory viral gene, referred to here as Viral Genomic Record 3240(VGR3240) viral gene, which encodes an 'operon-like' cluster of novel viral micro RNA-like genes, each of which in turn modulates expression of at least one host target gene, the function and utility of which at least one host target gene is known in the art.

VGR3240 gene, herein designated VGR GENE, is a novel bioinformatically detected regulatory, non protein coding, RNA viral gene. The method by which VGR3240 gene was detected is described hereinabove with reference to FIGS. 1-9.

VGR3240 gene encodes VGR3240 precursor RNA, herein designated VGR PRECURSOR RNA, an RNA molecule, typically several hundred nucleotides long.

VGR3240 precursor RNA folds spatially, forming VGR3240 folded precursor RNA, herein designated VGR FOLDED PRECURSOR RNA. It is appreciated that VGR3240 folded precursor RNA comprises a plurality of what is known in the art as 'hairpin' structures. These 'hairpin' structures are due to the fact that the nucleotide sequence of VGR3240 precursor RNA comprises a plurality of segments, the first half of each such segment having a nucleotide sequence which is at least a partial inversed-reversed sequence of the second half thereof, as is well known in the art.

VGR3240 folded precursor RNA is naturally processed by cellular enzymatic activity into at least 8 separate VGAM precursor RNAs, VGAM2475 precursor RNA, VGAM2476 precursor RNA, VGAM2477 precursor RNA, VGAM2478 precursor RNA, VGAM2479 precursor RNA, VGAM2480 precursor RNA, VGAM2481 precursor RNA and VGAM2482 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2475 RNA, VGAM2476 RNA, VGAM2477 RNA, VGAM2478 RNA, VGAM2479 RNA, VGAM2480 RNA, VGAM2481 RNA and VGAM2482 RNA, herein schematically represented by VGAM1 RNA through VGAM3 RNA, each of which VGAM RNAs corresponding to VGAM RNA of FIG. 1.

VGAM2475 RNA, herein schematically represented by VGAM1 RNA through VGAM3 RNA, binds complementarily to a host target binding site located in an untranslated region of VGAM2475 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2475 host target RNA into VGAM2475 host target protein, herein schematically represented by VGAM1 HOST TARGET PROTEIN through VGAM3 HOST TARGET PROTEIN, all of FIG. 1.

VGAM2476 RNA, herein schematically represented by VGAM1 RNA through VGAM3 RNA, binds complementarily to a host target binding site located in an untranslated region of VGAM2476 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2476 host target RNA into VGAM2476 host target protein, herein schematically represented by VGAM1 HOST TARGET PROTEIN through VGAM3 HOST TARGET PROTEIN, all of FIG. 1.

VGAM2477 RNA, herein schematically represented by VGAM1 RNA through VGAM3 RNA, binds complementarily to a host target binding site located in an untranslated region of VGAM2477 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2477 host target RNA into VGAM2477 host target protein, herein schematically represented by VGAM1 HOST TARGET PROTEIN through VGAM3 HOST TARGET PROTEIN, all of FIG. 1.

VGAM2478 RNA, herein schematically represented by VGAM1 RNA through VGAM3 RNA, binds complementarily to a host target binding site located in an untranslated region of VGAM2478 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2478 host target RNA into VGAM2478 host target protein, herein schematically represented by VGAM1 HOST TARGET PROTEIN through VGAM3 HOST TARGET PROTEIN, all of FIG. 1.

VGAM2479 RNA, herein schematically represented by VGAM1 RNA through VGAM3 RNA, binds complementarily to a host target binding site located in an untranslated region of VGAM2479 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2479 host target RNA into VGAM2479 host target protein, herein schematically represented by VGAM1 HOST TARGET PROTEIN through VGAM3 HOST TARGET PROTEIN, all of FIG. 1.

VGAM2480 RNA, herein schematically represented by VGAM1 RNA through VGAM3 RNA, binds complementarily to a host target binding site located in an untranslated region of VGAM2480 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2480 host target RNA into VGAM2480 host target protein, herein schematically represented by VGAM1 HOST TARGET PROTEIN through VGAM3 HOST TARGET PROTEIN, all of FIG. 1.

VGAM2481 RNA, herein schematically represented by VGAM1 RNA through VGAM3 RNA, binds complementarily to a host target binding site located in an untranslated region of VGAM2481 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2481 host target RNA into VGAM2481 host target protein, herein schematically represented by VGAM1 HOST TARGET PROTEIN through VGAM3 HOST TARGET PROTEIN, all of FIG. 1.

VGAM2482 RNA, herein schematically represented by VGAM1 RNA through VGAM3 RNA, binds complementarily to a host target binding site located in an untranslated region of VGAM2482 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2482 host target RNA into VGAM2482 host target protein, herein schematically represented by VGAM1 HOST TARGET PROTEIN through VGAM3 HOST TARGET PROTEIN, all of FIG. 1.

It is appreciated that a function of VGR3240 gene, herein designated VGR GENE, is inhibition of expression of host target genes, as part of a novel viral mechanism of attacking a host. Accordingly, utilities of VGR3240 gene include diagnosis, prevention and treatment of viral infection by Mouse Cytomegalovirus 1. Specific functions, and accordingly utilities, of VGR3240 gene correlate with, and may be deduced from, the identity of the host target genes, which are inhibited by VGAM RNAs comprised in the 'operon-like' cluster of VGR3240 gene: VGAM2475 host target protein, VGAM2476 host target protein, VGAM2477 host target protein, VGAM2478 host target protein, VGAM2479 host target protein, VGAM2480 host target protein, VGAM2481 host target protein and VGAM2482 host target protein, herein schematically represented by VGAM1 HOST TARGET PROTEIN through VGAM3 HOST TARGET PROTEIN. The function of these host target genes is elaborated hereinabove with reference to VGAM2475, VGAM2476, VGAM2477, VGAM2478, VGAM2479, VGAM2480, VGAM2481 and VGAM2482. FIG. 9 further provides a conceptual description of novel bioinformatically detected regulatory viral gene, referred to here as Viral Genomic Record 3241(VGR3241) viral gene, which encodes an 'operon-like' cluster of novel viral micro RNA-like genes, each of which in turn modulates expression of at least one host target gene, the function and utility of which at least one host target gene is known in the art.

VGR3241 gene, herein designated VGR GENE, is a novel bioinformatically detected regulatory, non protein coding, RNA viral gene. The method by which VGR3241 gene was detected is described hereinabove with reference to FIGS. 1-9.

VGR3241 gene encodes VGR3241 precursor RNA, herein designated VGR PRECURSOR RNA, an RNA molecule, typically several hundred nucleotides long.

VGR3241 precursor RNA folds spatially, forming VGR3241 folded precursor RNA, herein designated VGR FOLDED PRECURSOR RNA. It is appreciated that VGR3241 folded precursor RNA comprises a plurality of what is known in the art as 'hairpin' structures. These 'hairpin' structures are due to the fact that the nucleotide sequence of VGR3241 precursor RNA comprises a plurality of segments, the first half of each such segment having a nucleotide sequence which is at least a partial inversed-reversed sequence of the second half thereof, as is well known in the art.

VGR3241 folded precursor RNA is naturally processed by cellular enzymatic activity into at least 8 separate VGAM precursor RNAs, VGAM2483 precursor RNA, VGAM2484 precursor RNA, VGAM2485 precursor RNA, VGAM2486 precursor RNA, VGAM2487 precursor RNA, VGAM2488 precursor RNA, VGAM2489 precursor RNA and VGAM2490 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2483 RNA, VGAM2484 RNA, VGAM2485 RNA, VGAM2486 RNA, VGAM2487 RNA, VGAM2488 RNA, VGAM2489 RNA and VGAM2490 RNA, herein schematically represented by VGAM1 RNA through VGAM3 RNA, each of which VGAM RNAs corresponding to VGAM RNA of FIG. 1.

VGAM2483 RNA, herein schematically represented by VGAM1 RNA through VGAM3 RNA, binds complementarily to a host target binding site located in an untranslated region of VGAM2483 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2483 host target RNA into VGAM2483 host target protein, herein schematically represented by VGAM1 HOST TARGET PROTEIN through VGAM3 HOST TARGET PROTEIN, all of FIG. 1.

VGAM2484 RNA, herein schematically represented by VGAM1 RNA through VGAM3 RNA, binds complementarily to a host target binding site located in an untranslated region of VGAM2484 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2484 host target RNA into VGAM2484 host target protein, herein schematically represented by VGAM1 HOST TARGET PROTEIN through VGAM3 HOST TARGET PROTEIN, all of FIG. 1.

VGAM2485 RNA, herein schematically represented by VGAM1 RNA through VGAM3 RNA, binds complementarily to a host target binding site located in an untranslated region of VGAM2485 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2485 host target RNA into VGAM2485 host target protein, herein schematically represented by VGAM1 HOST TARGET PROTEIN through VGAM3 HOST TARGET PROTEIN, all of FIG. 1.

VGAM2486 RNA, herein schematically represented by VGAM1 RNA through VGAM3 RNA, binds complementarily to a host target binding site located in an untranslated region of VGAM2486 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2486 host target RNA into VGAM2486 host target protein, herein schematically represented by VGAM1 HOST TARGET PROTEIN through VGAM3 HOST TARGET PROTEIN, all of FIG. 1.

VGAM2487 RNA, herein schematically represented by VGAM1 RNA through VGAM3 RNA, binds complementarily to a host target binding site located in an untranslated region of VGAM2487 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2487 host target RNA into VGAM2487 host target protein, herein schematically represented by VGAM1 HOST TARGET PROTEIN through VGAM3 HOST TARGET PROTEIN, all of FIG. 1.

VGAM2488 RNA, herein schematically represented by VGAM1 RNA through VGAM3 RNA, binds complementarily to a host target binding site located in an untranslated region of VGAM2488 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2488 host target RNA into VGAM2488 host target protein, herein schematically represented by VGAM1 HOST TARGET PROTEIN through VGAM3 HOST TARGET PROTEIN, all of FIG. 1.

VGAM2489 RNA, herein schematically represented by VGAM1 RNA through VGAM3 RNA, binds complementarily to a host target binding site located in an untranslated region of VGAM2489 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2489 host target RNA into VGAM2489 host target protein, herein schematically represented by VGAM1 HOST TARGET PROTEIN through VGAM3 HOST TARGET PROTEIN, all of FIG. 1.

VGAM2490 RNA, herein schematically represented by VGAM1 RNA through VGAM3 RNA, binds complementarily to a host target binding site located in an untranslated region of VGAM2490 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2490 host target RNA into VGAM2490 host target protein, herein schematically represented by VGAM1 HOST TARGET PROTEIN through VGAM3 HOST TARGET PROTEIN, all of FIG. 1.

It is appreciated that a function of VGR3241 gene, herein designated VGR GENE, is inhibition of expression of host target genes, as part of a novel viral mechanism of attacking a host. Accordingly, utilities of VGR3241 gene include diagnosis, prevention and treatment of viral infection by Mouse Cytomegalovirus 1. Specific functions, and accordingly utilities, of VGR3241 gene correlate with, and may be deduced from, the identity of the host target genes, which are inhibited by VGAM RNAs comprised in the 'operon-like' cluster of VGR3241 gene: VGAM2483 host target protein, VGAM2484 host target protein, VGAM2485 host target protein, VGAM2486 host target protein, VGAM2487 host target protein, VGAM2488 host target protein, VGAM2489 host target protein and VGAM2490 host target protein, herein schematically represented by VGAM1 HOST TARGET PROTEIN through VGAM3 HOST TARGET PROTEIN. The function of these host target genes is elaborated hereinabove with reference to VGAM2483, VGAM2484, VGAM2485, VGAM2486, VGAM2487, VGAM2488, VGAM2489 and VGAM2490. FIG. 9 further provides a conceptual description of novel bioinformatically detected regulatory viral gene, referred to here as Viral Genomic Record 3242(VGR3242) viral gene, which encodes an 'operon-like' cluster of novel viral micro RNA-like genes, each of which in turn modulates expression of at least one host target gene, the function and utility of which at least one host target gene is known in the art.

VGR3242 gene, herein designated VGR GENE, is a novel bioinformatically detected regulatory, non protein coding, RNA viral gene. The method by which VGR3242 gene was detected is described hereinabove with reference to FIGS. 1-9.

VGR3242 gene encodes VGR3242 precursor RNA, herein designated VGR PRECURSOR RNA, an RNA molecule, typically several hundred nucleotides long.

VGR3242 precursor RNA folds spatially, forming VGR3242 folded precursor RNA, herein designated VGR FOLDED PRECURSOR RNA. It is appreciated that VGR3242 folded precursor RNA comprises a plurality of what is known in the art as 'hairpin' structures. These 'hairpin' structures are due to the fact that the nucleotide sequence of VGR3242 precursor RNA comprises a plurality of segments, the first half of each such segment having a nucleotide sequence which is at least a partial inversed-reversed sequence of the second half thereof, as is well known in the art.

VGR3242 folded precursor RNA is naturally processed by cellular enzymatic activity into at least 8 separate VGAM precursor RNAs, VGAM2491 precursor RNA, VGAM2492 precursor RNA, VGAM2493 precursor RNA, VGAM2494 precursor RNA, VGAM2495 precursor RNA, VGAM2496 precursor RNA, VGAM2497 precursor RNA and VGAM2498 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2491 RNA, VGAM2492 RNA, VGAM2493 RNA, VGAM2494 RNA, VGAM2495 RNA, VGAM2496 RNA, VGAM2497 RNA and VGAM2498 RNA, herein schematically represented by VGAM1 RNA through VGAM3 RNA, each of which VGAM RNAs corresponding to VGAM RNA of FIG. 1.

VGAM2491 RNA, herein schematically represented by VGAM1 RNA through VGAM3 RNA, binds complementarily to a host target binding site located in an untranslated region of VGAM2491 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2491 host target RNA into VGAM2491 host target protein, herein schematically represented by VGAM1 HOST TARGET PROTEIN through VGAM3 HOST TARGET PROTEIN, all of FIG. 1.

VGAM2492 RNA, herein schematically represented by VGAM1 RNA through VGAM3 RNA, binds complementarily to a host target binding site located in an untranslated region of VGAM2492 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2492 host target RNA into VGAM2492 host target protein, herein schematically represented by VGAM1 HOST TARGET PROTEIN through VGAM3 HOST TARGET PROTEIN, all of FIG. 1.

VGAM2493 RNA, herein schematically represented by VGAM1 RNA through VGAM3 RNA, binds complementarily to a host target binding site located in an untranslated region of VGAM2493 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2493 host target RNA into VGAM2493 host target protein, herein schematically represented by VGAM1 HOST TARGET PROTEIN through VGAM3 HOST TARGET PROTEIN, all of FIG. 1.

VGAM2494 RNA, herein schematically represented by VGAM1 RNA through VGAM3 RNA, binds complementarily to a host target binding site located in an untranslated region of VGAM2494 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2494 host target RNA into VGAM2494 host target protein, herein schematically represented by VGAM1 HOST TARGET PROTEIN through VGAM3 HOST TARGET PROTEIN, all of FIG. 1.

VGAM2495 RNA, herein schematically represented by VGAM1 RNA through VGAM3 RNA, binds complementarily to a host target binding site located in an untranslated region of VGAM2495 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2495 host target RNA into VGAM2495 host target protein, herein schematically represented by VGAM1 HOST TARGET PROTEIN through VGAM3 HOST TARGET PROTEIN, all of FIG. 1.

VGAM2496 RNA, herein schematically represented by VGAM1 RNA through VGAM3 RNA, binds complementarily to a host target binding site located in an untranslated region of VGAM2496 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2496 host target RNA into VGAM2496 host target protein, herein schematically represented by VGAM1 HOST TARGET PROTEIN through VGAM3 HOST TARGET PROTEIN, all of FIG. 1.

VGAM2497 RNA, herein schematically represented by VGAM1 RNA through VGAM3 RNA, binds complementarily to a host target binding site located in an untranslated region of VGAM2497 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2497 host target RNA into VGAM2497 host target protein, herein schematically represented by VGAM1 HOST TARGET PROTEIN through VGAM3 HOST TARGET PROTEIN, all of FIG. 1.

VGAM2498 RNA, herein schematically represented by VGAM1 RNA through VGAM3 RNA, binds complementarily to a host target binding site located in an untranslated region of VGAM2498 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2498 host target RNA into VGAM2498 host target protein, herein schematically represented by VGAM1 HOST TARGET PROTEIN through VGAM3 HOST TARGET PROTEIN, all of FIG. 1.

It is appreciated that a function of VGR3242 gene, herein designated VGR GENE, is inhibition of expression of host target genes, as part of a novel viral mechanism of attacking a host. Accordingly, utilities of VGR3242 gene include diagnosis, prevention and treatment of viral infection by Mouse Cytomegalovirus 1. Specific functions, and accordingly utilities, of VGR3242 gene correlate with, and may be deduced from, the identity of the host target genes, which are inhibited by VGAM RNAs comprised in the 'operon-like' cluster of VGR3242 gene: VGAM2491 host target protein, VGAM2492 host target protein, VGAM2493 host target protein, VGAM2494 host target protein, VGAM2495 host target protein, VGAM2496 host target protein, VGAM2497 host target protein and VGAM2498 host target protein, herein schematically represented by VGAM1 HOST TARGET PROTEIN through VGAM3 HOST TARGET PROTEIN. The function of these host target genes is elaborated hereinabove with reference to VGAM2491, VGAM2492, VGAM2493, VGAM2494, VGAM2495, VGAM2496, VGAM2497 and VGAM2498. FIG. 9 further provides a conceptual description of novel bioinformatically detected regulatory viral gene, referred to here as Viral Genomic Record 3243(VGR3243) viral gene, which encodes an 'operon-like' cluster of novel viral micro RNA-like genes, each of which in turn modulates expression of at least one host target gene, the function and utility of which at least one host target gene is known in the art.

VGR3243 gene, herein designated VGR GENE, is a novel bioinformatically detected regulatory, non protein coding, RNA viral gene. The method by which VGR3243 gene was detected is described hereinabove with reference to FIGS. 1-9.

VGR3243 gene encodes VGR3243 precursor RNA, herein designated VGR PRECURSOR RNA, an RNA molecule, typically several hundred nucleotides long.

VGR3243 precursor RNA folds spatially, forming VGR3243 folded precursor RNA, herein designated VGR FOLDED PRECURSOR RNA. It is appreciated that VGR3243 folded precursor RNA comprises a plurality of what is known in the art as 'hairpin' structures. These 'hairpin' structures are due to the fact that the nucleotide sequence of VGR3243 precursor RNA comprises a plurality of segments, the first half of each such segment having a nucleotide sequence which is at least a partial inversed-reversed sequence of the second half thereof, as is well known in the art.

VGR3243 folded precursor RNA is naturally processed by cellular enzymatic activity into at least 8 separate VGAM precursor RNAs, VGAM2499 precursor RNA, VGAM2500 precursor RNA, VGAM2501 precursor RNA, VGAM2502 precursor RNA, VGAM2503 precursor RNA, VGAM2504 precursor RNA, VGAM2505 precursor RNA and VGAM2506 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2499 RNA, VGAM2500 RNA, VGAM2501 RNA, VGAM2502 RNA, VGAM2503 RNA, VGAM2504 RNA, VGAM2505 RNA and VGAM2506 RNA, herein schematically represented by VGAM1 RNA through VGAM3 RNA, each of which VGAM RNAs corresponding to VGAM RNA of FIG. 1.

VGAM2499 RNA, herein schematically represented by VGAM1 RNA through VGAM3 RNA, binds complementarily to a host target binding site located in an untranslated region of VGAM2499 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2499 host target RNA into VGAM2499 host target protein, herein schematically represented by VGAM1 HOST TARGET PROTEIN through VGAM3 HOST TARGET PROTEIN, all of FIG. 1.

VGAM2500 RNA, herein schematically represented by VGAM1 RNA through VGAM3 RNA, binds complementarily to a host target binding site located in an untranslated region of VGAM2500 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2500 host target RNA into VGAM2500 host target protein, herein schematically represented by VGAM1 HOST TARGET PROTEIN through VGAM3 HOST TARGET PROTEIN, all of FIG. 1.

VGAM2501 RNA, herein schematically represented by VGAM1 RNA through VGAM3 RNA, binds complementarily to a host target binding site located in an untranslated region of VGAM2501 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2501 host target RNA into VGAM2501 host target protein, herein schematically represented by VGAM1 HOST TARGET PROTEIN through VGAM3 HOST TARGET PROTEIN, all of FIG. 1.

VGAM2502 RNA, herein schematically represented by VGAM1 RNA through VGAM3 RNA, binds complementarily to a host target binding site located in an untranslated region of VGAM2502 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2502 host target RNA into VGAM2502 host target protein, herein schematically represented by VGAM1 HOST TARGET PROTEIN through VGAM3 HOST TARGET PROTEIN, all of FIG. 1.

VGAM2503 RNA, herein schematically represented by VGAM1 RNA through VGAM3 RNA, binds complementarily to a host target binding site located in an untranslated region of VGAM2503 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2503 host target RNA into VGAM2503 host target protein, herein schematically represented by VGAM1 HOST TARGET PROTEIN through VGAM3 HOST TARGET PROTEIN, all of FIG. 1.

VGAM2504 RNA, herein schematically represented by VGAM1 RNA through VGAM3 RNA, binds complementarily to a host target binding site located in an untranslated region of VGAM2504 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2504 host target RNA into VGAM2504 host target protein, herein schematically represented by VGAM1 HOST TARGET PROTEIN through VGAM3 HOST TARGET PROTEIN, all of FIG. 1.

VGAM2505 RNA, herein schematically represented by VGAM1 RNA through VGAM3 RNA, binds complementarily to a host target binding site located in an untranslated region of VGAM2505 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2505 host target RNA into VGAM2505 host target protein, herein schematically represented by VGAM1 HOST TARGET PROTEIN through VGAM3 HOST TARGET PROTEIN, all of FIG. 1.

VGAM2506 RNA, herein schematically represented by VGAM1 RNA through VGAM3 RNA, binds complementarily to a host target binding site located in an untranslated region of VGAM2506 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2506 host target RNA into VGAM2506 host target protein, herein schematically represented by VGAM1 HOST TARGET PROTEIN through VGAM3 HOST TARGET PROTEIN, all of FIG. 1.

It is appreciated that a function of VGR3243 gene, herein designated VGR GENE, is inhibition of expression of host target genes, as part of a novel viral mechanism of attacking a host. Accordingly, utilities of VGR3243 gene include diagnosis, prevention and treatment of viral infection by Mouse Cytomegalovirus 1. Specific functions, and accordingly utilities, of VGR3243 gene correlate with, and may be deduced from, the identity of the host target genes, which are inhibited by VGAM RNAs comprised in the 'operon-like' cluster of VGR3243 gene: VGAM2499 host target protein, VGAM2500 host target protein, VGAM2501 host target protein, VGAM2502 host target protein, VGAM2503 host target protein, VGAM2504 host target protein, VGAM2505 host target protein and VGAM2506 host target protein, herein schematically represented by VGAM1 HOST TARGET PROTEIN through VGAM3 HOST TARGET PROTEIN. The function of these host target genes is elaborated hereinabove with reference to VGAM2499, VGAM2500, VGAM2501, VGAM2502, VGAM2503, VGAM2504, VGAM2505 and VGAM2506. FIG. 9 further provides a conceptual description of novel bioinformatically detected regulatory viral gene, referred to here as Viral Genomic Record 3244(VGR3244) viral gene, which encodes an 'operon-like' cluster of novel viral micro RNA-like genes, each of which in turn modulates expression of at least one host target gene, the function and utility of which at least one host target gene is known in the art.

VGR3244 gene, herein designated VGR GENE, is a novel bioinformatically detected regulatory, non protein coding, RNA viral gene. The method by which VGR3244 gene was detected is described hereinabove with reference to FIGS. 1-9.

VGR3244 gene encodes VGR3244 precursor RNA, herein designated VGR PRECURSOR RNA, an RNA molecule, typically several hundred nucleotides long.

VGR3244 precursor RNA folds spatially, forming VGR3244 folded precursor RNA, herein designated VGR FOLDED PRECURSOR RNA. It is appreciated that VGR3244 folded precursor RNA comprises a plurality of what is known in the art as 'hairpin' structures. These 'hairpin' structures are due to the fact that the nucleotide sequence of VGR3244 precursor RNA comprises a plurality of segments, the first half of each such segment having a nucleotide sequence which is at least a partial inversed-reversed sequence of the second half thereof, as is well known in the art.

VGR3244 folded precursor RNA is naturally processed by cellular enzymatic activity into at least 8 separate VGAM precursor RNAs, VGAM2507 precursor RNA, VGAM2508 precursor RNA, VGAM2509 precursor RNA, VGAM2510 precursor RNA, VGAM2511 precursor RNA, VGAM2512 precursor RNA, VGAM2513 precursor RNA and VGAM2514 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2507 RNA, VGAM2508 RNA, VGAM2509 RNA, VGAM2510 RNA, VGAM2511 RNA, VGAM2512 RNA, VGAM2513 RNA and VGAM2514 RNA, herein schematically represented by VGAM1 RNA through VGAM3 RNA, each of which VGAM RNAs corresponding to VGAM RNA of FIG. 1.

VGAM2507 RNA, herein schematically represented by VGAM1 RNA through VGAM3 RNA, binds complementarily to a host target binding site located in an untranslated region of VGAM2507 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2507 host target RNA into VGAM2507 host target protein, herein schematically represented by VGAM1 HOST TARGET PROTEIN through VGAM3 HOST TARGET PROTEIN, all of FIG. 1.

VGAM2508 RNA, herein schematically represented by VGAM1 RNA through VGAM3 RNA, binds complementarily to a host target binding site located in an untranslated region of VGAM2508 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2508 host target RNA into VGAM2508 host target protein, herein schematically represented by VGAM1 HOST TARGET PROTEIN through VGAM3 HOST TARGET PROTEIN, all of FIG. 1.

VGAM2509 RNA, herein schematically represented by VGAM1 RNA through VGAM3 RNA, binds complementarily to a host target binding site located in an untranslated region of VGAM2509 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2509 host target RNA into VGAM2509 host target protein, herein schematically represented by VGAM1 HOST TARGET PROTEIN through VGAM3 HOST TARGET PROTEIN, all of FIG. 1.

VGAM2510 RNA, herein schematically represented by VGAM1 RNA through VGAM3 RNA, binds complementarily to a host target binding site located in an untranslated region of VGAM2510 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2510 host target RNA into VGAM2510 host target protein, herein schematically represented by VGAM1 HOST TARGET PROTEIN through VGAM3 HOST TARGET PROTEIN, all of FIG. 1.

VGAM2511 RNA, herein schematically represented by VGAM1 RNA through VGAM3 RNA, binds complementarily to a host target binding site located in an untranslated region of VGAM2511 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2511 host target RNA into VGAM2511 host target protein, herein schematically represented by VGAM1 HOST TARGET PROTEIN through VGAM3 HOST TARGET PROTEIN, all of FIG. 1.

VGAM2512 RNA, herein schematically represented by VGAM1 RNA through VGAM3 RNA, binds complementarily to a host target binding site located in an untranslated region of VGAM2512 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2512 host target RNA into VGAM2512 host target protein, herein schematically represented by VGAM1 HOST TARGET PROTEIN through VGAM3 HOST TARGET PROTEIN, all of FIG. 1.

VGAM2513 RNA, herein schematically represented by VGAM1 RNA through VGAM3 RNA, binds complementarily to a host target binding site located in an untranslated region of VGAM2513 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2513 host target RNA into VGAM2513 host target protein, herein schematically represented by VGAM1 HOST TARGET PROTEIN through VGAM3 HOST TARGET PROTEIN, all of FIG. 1.

VGAM2514 RNA, herein schematically represented by VGAM1 RNA through VGAM3 RNA, binds complementarily to a host target binding site located in an untranslated region of VGAM2514 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2514 host target RNA into VGAM2514 host target protein, herein schematically represented by VGAM1 HOST TARGET PROTEIN through VGAM3 HOST TARGET PROTEIN, all of FIG. 1.

It is appreciated that a function of VGR3244 gene, herein designated VGR GENE, is inhibition of expression of host target genes, as part of a novel viral mechanism of attacking a host. Accordingly, utilities of VGR3244 gene include diagnosis, prevention and treatment of viral infection by Mouse Cytomegalovirus 1. Specific functions, and accordingly utilities, of VGR3244 gene correlate with, and may be deduced from, the identity of the host target genes, which are inhibited by VGAM RNAs comprised in the 'operon-like' cluster of VGR3244 gene: VGAM2507 host target protein, VGAM2508 host target protein, VGAM2509 host target protein, VGAM2510 host target protein, VGAM2511 host target protein, VGAM2512 host target protein, VGAM2513 host target protein and VGAM2514 host target protein, herein schematically represented by VGAM1 HOST TARGET PROTEIN through VGAM3 HOST TARGET PROTEIN. The function of these host target genes is elaborated hereinabove with reference to VGAM2507, VGAM2508, VGAM2509, VGAM2510, VGAM2511, VGAM2512, VGAM2513 and VGAM2514. FIG. 9 further provides a conceptual description of novel bioinformatically detected regulatory viral gene, referred to here as Viral Genomic Record 3245(VGR3245) viral gene, which encodes an 'operon-like' cluster of novel viral micro RNA-like genes, each of which in turn modulates expression of at least one host target gene, the function and utility of which at least one host target gene is known in the art.

VGR3245 gene, herein designated VGR GENE, is a novel bioinformatically detected regulatory, non protein coding, RNA viral gene. The method by which VGR3245 gene was detected is described hereinabove with reference to FIGS. 1-9.

VGR3245 gene encodes VGR3245 precursor RNA, herein designated VGR PRECURSOR RNA, an RNA molecule, typically several hundred nucleotides long.

VGR3245 precursor RNA folds spatially, forming VGR3245 folded precursor RNA, herein designated VGR FOLDED PRECURSOR RNA. It is appreciated that VGR3245 folded precursor RNA comprises a plurality of what is known in the art as 'hairpin' structures. These 'hairpin' structures are due to the fact that the nucleotide sequence of VGR3245 precursor RNA comprises a plurality of segments, the first half of each such segment having a nucleotide sequence which is at least a partial inversed-reversed sequence of the second half thereof, as is well known in the art.

VGR3245 folded precursor RNA is naturally processed by cellular enzymatic activity into at least 8 separate VGAM precursor RNAs, VGAM2515 precursor RNA, VGAM2516 precursor RNA, VGAM2517 precursor RNA, VGAM2518 precursor RNA, VGAM2519 precursor RNA, VGAM2520 precursor RNA, VGAM2521 precursor RNA and VGAM2522 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2515 RNA, VGAM2516 RNA, VGAM2517 RNA, VGAM2518 RNA, VGAM2519 RNA, VGAM2520 RNA, VGAM2521 RNA and VGAM2522 RNA, herein schematically represented by VGAM1 RNA through VGAM3 RNA, each of which VGAM RNAs corresponding to VGAM RNA of FIG. 1.

VGAM2515 RNA, herein schematically represented by VGAM1 RNA through VGAM3 RNA, binds complementarily to a host target binding site located in an untranslated region of VGAM2515 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2515 host target RNA into VGAM2515 host target protein, herein schematically represented by VGAM1 HOST TARGET PROTEIN through VGAM3 HOST TARGET PROTEIN, all of FIG. 1.

VGAM2516 RNA, herein schematically represented by VGAM1 RNA through VGAM3 RNA, binds complementarily to a host target binding site located in an untranslated region of VGAM2516 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2516 host target RNA into VGAM2516 host target protein, herein schematically represented by VGAM1 HOST TARGET PROTEIN through VGAM3 HOST TARGET PROTEIN, all of FIG. 1.

VGAM2517 RNA, herein schematically represented by VGAM1 RNA through VGAM3 RNA, binds complementarily to a host target binding site located in an untranslated region of VGAM2517 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2517 host target RNA into VGAM2517 host target protein, herein schematically represented by VGAM1 HOST TARGET PROTEIN through VGAM3 HOST TARGET PROTEIN, all of FIG. 1.

VGAM2518 RNA, herein schematically represented by VGAM1 RNA through VGAM3 RNA, binds complementarily to a host target binding site located in an untranslated region of VGAM2518 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2518 host target RNA into VGAM2518 host target protein, herein schematically represented by VGAM1 HOST TARGET PROTEIN through VGAM3 HOST TARGET PROTEIN, all of FIG. 1.

VGAM2519 RNA, herein schematically represented by VGAM1 RNA through VGAM3 RNA, binds complementarily to a host target binding site located in an untranslated region of VGAM2519 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2519 host target RNA into VGAM2519 host target protein, herein schematically represented by VGAM1 HOST TARGET PROTEIN through VGAM3 HOST TARGET PROTEIN, all of FIG. 1.

VGAM2520 RNA, herein schematically represented by VGAM1 RNA through VGAM3 RNA, binds complementarily to a host target binding site located in an untranslated region of VGAM2520 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2520 host target RNA into VGAM2520 host target protein, herein schematically represented by VGAM1 HOST TARGET PROTEIN through VGAM3 HOST TARGET PROTEIN, all of FIG. 1.

VGAM2521 RNA, herein schematically represented by VGAM1 RNA through VGAM3 RNA, binds complementarily to a host target binding site located in an untranslated region of VGAM2521 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2521 host target RNA into VGAM2521 host target protein, herein schematically represented by VGAM1 HOST TARGET PROTEIN through VGAM3 HOST TARGET PROTEIN, all of FIG. 1.

VGAM2522 RNA, herein schematically represented by VGAM1 RNA through VGAM3 RNA, binds complementarily to a host target binding site located in an untranslated region of VGAM2522 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2522 host target RNA into VGAM2522 host target protein, herein schematically represented by VGAM1 HOST TARGET PROTEIN through VGAM3 HOST TARGET PROTEIN, all of FIG. 1.

It is appreciated that a function of VGR3245 gene, herein designated VGR GENE, is inhibition of expression of host target genes, as part of a novel viral mechanism of attacking a host. Accordingly, utilities of VGR3245 gene include diagnosis, prevention and treatment of viral infection by Mouse Cytomegalovirus 1. Specific functions, and accordingly utilities, of VGR3245 gene correlate with, and may be deduced from, the identity of the host target genes, which are inhibited by VGAM RNAs comprised in the 'operon-like' cluster of VGR3245 gene: VGAM2515 host target protein, VGAM2516 host target protein, VGAM2517 host target protein, VGAM2518 host target protein, VGAM2519 host target protein, VGAM2520 host target protein, VGAM2521 host target protein and VGAM2522 host target protein, herein schematically represented by VGAM1 HOST TARGET PROTEIN through VGAM3 HOST TARGET PROTEIN. The function of these host target genes is elaborated hereinabove with reference to VGAM2515, VGAM2516, VGAM2517, VGAM2518, VGAM2519, VGAM2520, VGAM2521 and VGAM2522. FIG. 9 further provides a conceptual description of novel bioinformatically detected regulatory viral gene, referred to here as Viral Genomic Record 3246(VGR3246) viral gene, which encodes an 'operon-like' cluster of novel viral micro RNA-like genes, each of which in turn modulates expression of at least one host target gene, the function and utility of which at least one host target gene is known in the art.

VGR3246 gene, herein designated VGR GENE, is a novel bioinformatically detected regulatory, non protein coding, RNA viral gene. The method by which VGR3246 gene was detected is described hereinabove with reference to FIGS. 1-9.

VGR3246 gene encodes VGR3246 precursor RNA, herein designated VGR PRECURSOR RNA, an RNA molecule, typically several hundred nucleotides long.

VGR3246 precursor RNA folds spatially, forming VGR3246 folded precursor RNA, herein designated VGR FOLDED PRECURSOR RNA. It is appreciated that VGR3246 folded precursor RNA comprises a plurality of what is known in the art as 'hairpin' structures. These 'hairpin' structures are due to the fact that the nucleotide sequence of VGR3246 precursor RNA comprises a plurality of segments, the first half of each such segment having a nucleotide sequence which is at least a partial inversed-reversed sequence of the second half thereof, as is well known in the art.

VGR3246 folded precursor RNA is naturally processed by cellular enzymatic activity into at least 5 separate VGAM precursor RNAs, VGAM2523 precursor RNA, VGAM2524 precursor RNA, VGAM2525 precursor RNA, VGAM2526 precursor RNA and VGAM2527 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2523 RNA, VGAM2524 RNA, VGAM2525 RNA, VGAM2526 RNA and VGAM2527 RNA, herein schematically represented by VGAM1 RNA through VGAM3 RNA, each of which VGAM RNAs corresponding to VGAM RNA of FIG. 1.

VGAM2523 RNA, herein schematically represented by VGAM1 RNA through VGAM3 RNA, binds complementarily to a host target binding site located in an untranslated region of VGAM2523 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2523 host target RNA into VGAM2523 host target protein, herein schematically represented by VGAM1 HOST TARGET PROTEIN through VGAM3 HOST TARGET PROTEIN, all of FIG. 1.

VGAM2524 RNA, herein schematically represented by VGAM1 RNA through VGAM3 RNA, binds complementarily to a host target binding site located in an untranslated region of VGAM2524 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2524 host target RNA into VGAM2524 host target protein, herein schematically represented by VGAM1 HOST TARGET PROTEIN through VGAM3 HOST TARGET PROTEIN, all of FIG. 1.

VGAM2525 RNA, herein schematically represented by VGAM1 RNA through VGAM3 RNA, binds complementarily to a host target binding site located in an untranslated region of VGAM2525 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2525 host target RNA into VGAM2525 host target protein, herein schematically represented by VGAM1 HOST TARGET PROTEIN through VGAM3 HOST TARGET PROTEIN, all of FIG. 1.

VGAM2526 RNA, herein schematically represented by VGAM1 RNA through VGAM3 RNA, binds complementarily to a host target binding site located in an untranslated region of VGAM2526 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2526 host target RNA into VGAM2526 host target protein, herein schematically represented by VGAM1 HOST TARGET PROTEIN through VGAM3 HOST TARGET PROTEIN, all of FIG. 1.

VGAM2527 RNA, herein schematically represented by VGAM1 RNA through VGAM3 RNA, binds complementarily to a host target binding site located in an untranslated region of VGAM2527 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2527 host target RNA into VGAM2527 host target protein, herein schematically represented by VGAM1 HOST TARGET PROTEIN through VGAM3 HOST TARGET PROTEIN, all of FIG. 1.

It is appreciated that a function of VGR3246 gene, herein designated VGR GENE, is inhibition of expression of host target genes, as part of a novel viral mechanism of attacking a host. Accordingly, utilities of VGR3246 gene include diagnosis, prevention and treatment of viral infection by Mouse Cytomegalovirus 1. Specific functions, and accordingly utilities, of VGR3246 gene correlate with, and may be deduced from, the identity of the host target genes, which are inhibited by VGAM RNAs comprised in the 'operon-like' cluster of VGR3246 gene: VGAM2523 host target protein, VGAM2524 host target protein, VGAM2525 host target protein, VGAM2526 host target protein and VGAM2527 host target protein, herein schematically represented by VGAM1 HOST TARGET PROTEIN through VGAM3 HOST TARGET PROTEIN. The function of these host target genes is elaborated hereinabove with reference to VGAM2523, VGAM2524, VGAM2525, VGAM2526 and VGAM2527.

FIG. 9 further provides a conceptual description of novel bioinformatically detected regulatory viral gene, referred to here as Viral Genomic Record 3247(VGR3247) viral gene, which encodes an 'operon-like' cluster of novel viral micro RNA-like genes, each of which in turn modulates expression of at least one host target gene, the function and utility of which at least one host target gene is known in the art.

VGR3247 gene, herein designated VGR GENE, is a novel bioinformatically detected regulatory, non protein coding, RNA viral gene. The method by which VGR3247 gene was detected is described hereinabove with reference to FIGS. 1-9.

VGR3247 gene encodes VGR3247 precursor RNA, herein designated VGR PRECURSOR RNA, an RNA molecule, typically several hundred nucleotides long.

VGR3247 precursor RNA folds spatially, forming VGR3247 folded precursor RNA, herein designated VGR FOLDED PRECURSOR RNA. It is appreciated that VGR3247 folded precursor RNA comprises a plurality of what is known in the art as 'hairpin' structures. These 'hairpin' structures are due to the fact that the nucleotide sequence of VGR3247 precursor RNA comprises a plurality of segments, the first half of each such segment having a nucleotide sequence which is at least a partial inversed-reversed sequence of the second half thereof, as is well known in the art.

VGR3247 folded precursor RNA is naturally processed by cellular enzymatic activity into at least 2 separate VGAM precursor RNAs, VGAM2530 precursor RNA and VGAM2531 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2530 RNA and VGAM2531 RNA, herein schematically represented by VGAM1 RNA through VGAM3 RNA, each of which VGAM RNAs corresponding to VGAM RNA of FIG. 1.

VGAM2530 RNA, herein schematically represented by VGAM1 RNA through VGAM3 RNA, binds complementarily to a host target binding site located in an untranslated region of VGAM2530 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2530 host target RNA into VGAM2530 host target protein, herein schematically represented by VGAM1 HOST TARGET PROTEIN through VGAM3 HOST TARGET PROTEIN, all of FIG. 1.

VGAM2531 RNA, herein schematically represented by VGAM1 RNA through VGAM3 RNA, binds complementarily to a host target binding site located in an untranslated region of VGAM2531 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2531 host target RNA into VGAM2531 host target protein, herein schematically represented by VGAM1 HOST TARGET PROTEIN through VGAM3 HOST TARGET PROTEIN, all of FIG. 1.

It is appreciated that a function of VGR3247 gene, herein designated VGR GENE, is inhibition of expression of host target genes, as part of a novel viral mechanism of attacking a host. Accordingly, utilities of VGR3247 gene include diagnosis, prevention and treatment of viral infection by Pepper Ringspot Virus. Specific functions, and accordingly utilities, of VGR3247 gene correlate with, and may be deduced from, the identity of the host target genes, which are inhibited by VGAM RNAs comprised in the 'operon-like' cluster of VGR3247 gene: VGAM2530 host target protein and VGAM2531 host target protein, herein schematically represented by VGAM1 HOST TARGET PROTEIN through VGAM3 HOST TARGET PROTEIN. The function of these host target genes is elaborated hereinabove with reference to VGAM2530 and VGAM2531. FIG. 9 further provides a conceptual description of novel bioinformatically detected regulatory viral gene, referred to here as Viral Genomic Record 3248(VGR3248) viral gene, which encodes an 'operon-like' cluster of novel viral micro RNA-like genes, each of which in turn modulates expression of at least one host target gene, the function and utility of which at least one host target gene is known in the art.

VGR3248 gene, herein designated VGR GENE, is a novel bioinformatically detected regulatory, non protein coding, RNA viral gene. The method by which VGR3248 gene was detected is described hereinabove with reference to FIGS. 1-9.

VGR3248 gene encodes VGR3248 precursor RNA, herein designated VGR PRECURSOR RNA, an RNA molecule, typically several hundred nucleotides long.

VGR3248 precursor RNA folds spatially, forming VGR3248 folded precursor RNA, herein designated VGR FOLDED PRECURSOR RNA. It is appreciated that VGR3248 folded precursor RNA comprises a plurality of what is known in the art as 'hairpin' structures. These 'hairpin' structures are due to the fact that the nucleotide sequence of VGR3248 precursor RNA comprises a plurality of segments, the first half of each such segment having a nucleotide sequence which is at least a partial inversed-reversed sequence of the second half thereof, as is well known in the art.

VGR3248 folded precursor RNA is naturally processed by cellular enzymatic activity into at least 4 separate VGAM precursor RNAs, VGAM2532 precursor RNA, VGAM2533 precursor RNA, VGAM2534 precursor RNA and VGAM2535 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2532 RNA, VGAM2533 RNA, VGAM2534 RNA and VGAM2535 RNA, herein schematically represented by VGAM1 RNA through VGAM3 RNA, each of which VGAM RNAs corresponding to VGAM RNA of FIG. 1.

VGAM2532 RNA, herein schematically represented by VGAM1 RNA through VGAM3 RNA, binds complementarily to a host target binding site located in an untranslated region of VGAM2532 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2532 host target RNA into VGAM2532 host target protein, herein schematically represented by VGAM1 HOST TARGET PROTEIN through VGAM3 HOST TARGET PROTEIN, all of FIG. 1.

VGAM2533 RNA, herein schematically represented by VGAM1 RNA through VGAM3 RNA, binds complementarily to a host target binding site located in an untranslated region of VGAM2533 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2533 host target RNA into VGAM2533 host target protein, herein schematically represented by VGAM1 HOST TARGET PROTEIN through VGAM3 HOST TARGET PROTEIN, all of FIG. 1.

VGAM2534 RNA, herein schematically represented by VGAM1 RNA through VGAM3 RNA, binds complementarily to a host target binding site located in an untranslated region of VGAM2534 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2534 host target RNA into VGAM2534 host target protein, herein schematically represented by VGAM1 HOST TARGET PROTEIN through VGAM3 HOST TARGET PROTEIN, all of FIG. 1.

VGAM2535 RNA, herein schematically represented by VGAM1 RNA through VGAM3 RNA, binds complementarily to a host target binding site located in an untranslated region of VGAM2535 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2535 host target RNA into VGAM2535 host target protein, herein schematically represented by VGAM1 HOST TARGET PROTEIN through VGAM3 HOST TARGET PROTEIN, all of FIG. 1.

It is appreciated that a function of VGR3248 gene, herein designated VGR GENE, is inhibition of expression of host target genes, as part of a novel viral mechanism of attacking a host. Accordingly, utilities of VGR3248 gene include diagnosis, prevention and treatment of viral infection by Rio Bravo Virus. Specific functions, and accordingly utilities, of VGR3248 gene correlate with, and may be deduced from, the identity of the host target genes, which are inhibited by VGAM RNAs comprised in the 'operon-like' cluster of VGR3248 gene: VGAM2532 host target protein, VGAM2533 host target protein, VGAM2534 host target protein and VGAM2535 host target protein, herein schematically represented by VGAM1 HOST TARGET PROTEIN through VGAM3 HOST TARGET PROTEIN. The function of these host target genes is elaborated hereinabove with reference to VGAM2532, VGAM2533, VGAM2534 and VGAM2535. FIG. 9 further provides a conceptual description of novel bioinformatically detected regulatory viral gene, referred to here as Viral Genomic Record 3249(VGR3249) viral gene, which encodes an 'operon-like' cluster of novel viral micro RNA-like genes, each of which in turn modulates expression of at least one host target gene, the function and utility of which at least one host target gene is known in the art.

VGR3249 gene, herein designated VGR GENE, is a novel bioinformatically detected regulatory, non protein coding, RNA viral gene. The method by which VGR3249 gene was detected is described hereinabove with reference to FIGS. 1-9.

VGR3249 gene encodes VGR3249 precursor RNA, herein designated VGR PRECURSOR RNA, an RNA molecule, typically several hundred nucleotides long.

VGR3249 precursor RNA folds spatially, forming VGR3249 folded precursor RNA, herein designated VGR FOLDED PRECURSOR RNA. It is appreciated that VGR3249 folded precursor RNA comprises a plurality of what is known in the art as 'hairpin' structures. These 'hairpin' structures are due to the fact that the nucleotide sequence of VGR3249 precursor RNA comprises a plurality of segments, the first half of each such segment having a nucleotide sequence which is at least a partial inversed-reversed sequence of the second half thereof, as is well known in the art.

VGR3249 folded precursor RNA is naturally processed by cellular enzymatic activity into at least 3 separate VGAM precursor RNAs, VGAM2536 precursor RNA, VGAM2537 precursor RNA and VGAM2538 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2536 RNA, VGAM2537 RNA and VGAM2538 RNA, herein schematically represented by VGAM1 RNA through VGAM3 RNA, each of which VGAM RNAs corresponding to VGAM RNA of FIG. 1.

VGAM2536 RNA, herein schematically represented by VGAM1 RNA through VGAM3 RNA, binds complementarily to a host target binding site located in an untranslated region of VGAM2536 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2536 host target RNA into VGAM2536 host target protein, herein schematically represented by VGAM1 HOST TARGET PROTEIN through VGAM3 HOST TARGET PROTEIN, all of FIG. 1.

VGAM2537 RNA, herein schematically represented by VGAM1 RNA through VGAM3 RNA, binds complementarily to a host target binding site located in an untranslated region of VGAM2537 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2537 host target RNA into VGAM2537 host target protein, herein schematically represented by VGAM1 HOST TARGET PROTEIN through VGAM3 HOST TARGET PROTEIN, all of FIG. 1.

VGAM2538 RNA, herein schematically represented by VGAM1 RNA through VGAM3 RNA, binds complementarily to a host target binding site located in an untranslated region of VGAM2538 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2538 host target RNA into VGAM2538 host target protein, herein schematically represented by VGAM1 HOST TARGET PROTEIN through VGAM3 HOST TARGET PROTEIN, all of FIG. 1.

It is appreciated that a function of VGR3249 gene, herein designated VGR GENE, is inhibition of expression of host target genes, as part of a novel viral mechanism of attacking a host. Accordingly, utilities of VGR3249 gene include diagnosis, prevention and treatment of viral infection by Pestivirus Reindeer-1. Specific functions, and accordingly utilities, of VGR3249 gene correlate with, and may be deduced from, the identity of the host target genes, which are inhibited by VGAM RNAs comprised in the 'operon-like' cluster of VGR3249 gene: VGAM2536 host target protein, VGAM2537 host target protein and VGAM2538 host target protein, herein schematically represented by VGAM1 HOST TARGET PROTEIN through VGAM3 HOST TARGET PROTEIN. The function of these host target genes is elaborated hereinabove with reference to VGAM2536, VGAM2537 and VGAM2538. FIG. 9 further provides a conceptual description of novel bioinformatically detected regulatory viral gene, referred to here as Viral Genomic Record 3250(VGR3250) viral gene, which encodes an 'operon-like' cluster of novel viral micro RNA-like genes, each of which in turn modulates expression of at least one host target gene, the function and utility of which at least one host target gene is known in the art.

VGR3250 gene, herein designated VGR GENE, is a novel bioinformatically detected regulatory, non protein coding, RNA viral gene. The method by which VGR3250 gene was detected is described hereinabove with reference to FIGS. 1-9.

VGR3250 gene encodes VGR3250 precursor RNA, herein designated VGR PRECURSOR RNA, an RNA molecule, typically several hundred nucleotides long.

VGR3250 precursor RNA folds spatially, forming VGR3250 folded precursor RNA, herein designated VGR FOLDED PRECURSOR RNA. It is appreciated that VGR3250 folded precursor RNA comprises a plurality of what is known in the art as 'hairpin' structures. These 'hairpin' structures are due to the fact that the nucleotide sequence of VGR3250 precursor RNA comprises a plurality of segments, the first half of each such segment having a nucleotide sequence which is at least a partial inversed-reversed sequence of the second half thereof, as is well known in the art.

VGR3250 folded precursor RNA is naturally processed by cellular enzymatic activity into at least 2 separate VGAM precursor RNAs, VGAM2539 precursor RNA and VGAM2540 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2539 RNA and VGAM2540 RNA, herein schematically represented by VGAM1 RNA through VGAM3 RNA, each of which VGAM RNAs corresponding to VGAM RNA of FIG. 1.

VGAM2539 RNA, herein schematically represented by VGAM1 RNA through VGAM3 RNA, binds complementarily to a host target binding site located in an untranslated region of VGAM2539 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2539 host target RNA into VGAM2539 host target protein, herein schematically represented by VGAM1 HOST TARGET PROTEIN through VGAM3 HOST TARGET PROTEIN, all of FIG. 1.

VGAM2540 RNA, herein schematically represented by VGAM1 RNA through VGAM3 RNA, binds complementarily to a host target binding site located in an untranslated region of VGAM2540 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2540 host target RNA into VGAM2540 host target protein, herein schematically represented by VGAM1 HOST TARGET PROTEIN through VGAM3 HOST TARGET PROTEIN, all of FIG. 1.

It is appreciated that a function of VGR3250 gene, herein designated VGR GENE, is inhibition of expression of host target genes, as part of a novel viral mechanism of attacking a host. Accordingly, utilities of VGR3250 gene include diagnosis, prevention and treatment of viral infection by Pestivirus Giraffe-1. Specific functions, and accordingly utilities, of VGR3250 gene correlate with, and may be deduced from, the identity of the host target genes, which are inhibited by VGAM RNAs comprised in the 'operon-like' cluster of VGR3250 gene: VGAM2539 host target protein and VGAM2540 host target protein, herein schematically represented by VGAM1 HOST TARGET PROTEIN through VGAM3 HOST TARGET PROTEIN. The function of these host target genes is elaborated hereinabove with reference to VGAM2539 and VGAM2540. FIG. 9 further provides a conceptual description of novel bioinformatically detected regulatory viral gene, referred to here as Viral Genomic Record 3251(VGR3251) viral gene, which encodes an 'operon-like' cluster of novel viral micro RNA-like genes, each of which in turn modulates expression of at least one host target gene, the function and utility of which at least one host target gene is known in the art.

VGR3251 gene, herein designated VGR GENE, is a novel bioinformatically detected regulatory, non protein coding, RNA viral gene. The method by which VGR3251 gene was detected is described hereinabove with reference to FIGS. 1-9.

VGR3251 gene encodes VGR3251 precursor RNA, herein designated VGR PRECURSOR RNA, an RNA molecule, typically several hundred nucleotides long.

VGR3251 precursor RNA folds spatially, forming VGR3251 folded precursor RNA, herein designated VGR FOLDED PRECURSOR RNA. It is appreciated that VGR3251 folded precursor RNA comprises a plurality of what is known in the art as 'hairpin' structures. These 'hairpin' structures are due to the fact that the nucleotide sequence of VGR3251 precursor RNA comprises a plurality of segments, the first half of each such segment having a nucleotide sequence which is at least a partial inversed-reversed sequence of the second half thereof, as is well known in the art.

VGR3251 folded precursor RNA is naturally processed by cellular enzymatic activity into at least 7 separate VGAM precursor RNAs, VGAM2541 precursor RNA, VGAM2542 precursor RNA, VGAM2543 precursor RNA, VGAM2544 precursor RNA, VGAM2545 precursor RNA, VGAM2546 precursor RNA and VGAM2547 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2541 RNA, VGAM2542 RNA, VGAM2543 RNA, VGAM2544 RNA, VGAM2545 RNA, VGAM2546 RNA and VGAM2547 RNA, herein schematically represented by VGAM1 RNA through VGAM3 RNA, each of which VGAM RNAs corresponding to VGAM RNA of FIG. 1.

VGAM2541 RNA, herein schematically represented by VGAM1 RNA through VGAM3 RNA, binds complementarily to a host target binding site located in an untranslated region of VGAM2541 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2541 host target RNA into VGAM2541 host target protein, herein schematically represented by VGAM1 HOST TARGET PROTEIN through VGAM3 HOST TARGET PROTEIN, all of FIG. 1.

VGAM2542 RNA, herein schematically represented by VGAM1 RNA through VGAM3 RNA, binds complementarily to a host target binding site located in an untranslated region of VGAM2542 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2542 host target RNA into VGAM2542 host target protein, herein schematically represented by VGAM1 HOST TARGET PROTEIN through VGAM3 HOST TARGET PROTEIN, all of FIG. 1.

VGAM2543 RNA, herein schematically represented by VGAM1 RNA through VGAM3 RNA, binds complementarily to a host target binding site located in an untranslated region of VGAM2543 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2543 host target RNA into VGAM2543 host target protein, herein schematically represented by VGAM1 HOST TARGET PROTEIN through VGAM3 HOST TARGET PROTEIN, all of FIG. 1.

VGAM2544 RNA, herein schematically represented by VGAM1 RNA through VGAM3 RNA, binds complementarily to a host target binding site located in an untranslated region of VGAM2544 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2544 host target RNA into VGAM2544 host target protein, herein schematically represented by VGAM1 HOST TARGET PROTEIN through VGAM3 HOST TARGET PROTEIN, all of FIG. 1.

VGAM2545 RNA, herein schematically represented by VGAM1 RNA through VGAM3 RNA, binds complementarily to a host target binding site located in an untranslated region of VGAM2545 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2545 host target RNA into VGAM2545 host target protein, herein schematically represented by VGAM1 HOST TARGET PROTEIN through VGAM3 HOST TARGET PROTEIN, all of FIG. 1.

VGAM2546 RNA, herein schematically represented by VGAM1 RNA through VGAM3 RNA, binds complementarily to a host target binding site located in an untranslated region of VGAM2546 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2546 host target RNA into VGAM2546 host target protein, herein schematically represented by VGAM1 HOST TARGET PROTEIN through VGAM3 HOST TARGET PROTEIN, all of FIG. 1.

VGAM2547 RNA, herein schematically represented by VGAM1 RNA through VGAM3 RNA, binds complementarily to a host target binding site located in an untranslated region of VGAM2547 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2547 host target RNA into VGAM2547 host target protein, herein schematically represented by VGAM1 HOST TARGET PROTEIN through VGAM3 HOST TARGET PROTEIN, all of FIG. 1.

It is appreciated that a function of VGR3251 gene, herein designated VGR GENE, is inhibition of expression of host target genes, as part of a novel viral mechanism of attacking a host. Accordingly, utilities of VGR3251 gene include diagnosis, prevention and treatment of viral infection by Langat Virus. Specific functions, and accordingly utilities, of VGR3251 gene correlate with, and may be deduced from, the identity of the host target genes, which are inhibited by VGAM RNAs comprised in the 'operon-like' cluster of VGR3251 gene: VGAM2541 host target protein, VGAM2542 host target protein, VGAM2543 host target protein, VGAM2544 host target protein, VGAM2545 host target protein, VGAM2546 host target protein and VGAM2547 host target protein, herein schematically represented by VGAM1 HOST TARGET PROTEIN through VGAM3 HOST TARGET PROTEIN. The function of these host target genes is elaborated hereinabove with reference to VGAM2541, VGAM2542, VGAM2543, VGAM2544, VGAM2545, VGAM2546 and VGAM2547. FIG. 9 further provides a conceptual description of novel bioinformatically detected regulatory viral gene, referred to here as Viral Genomic Record 3252(VGR3252) viral gene, which encodes an 'operon-like' cluster of novel viral micro RNA-like genes, each of which in turn modulates expression of at least one host target gene, the function and utility of which at least one host target gene is known in the art.

VGR3252 gene, herein designated VGR GENE, is a novel bioinformatically detected regulatory, non protein coding, RNA viral gene. The method by which VGR3252 gene was detected is described hereinabove with reference to FIGS. 1-9.

VGR3252 gene encodes VGR3252 precursor RNA, herein designated VGR PRECURSOR RNA, an RNA molecule, typically several hundred nucleotides long.

VGR3252 precursor RNA folds spatially, forming VGR3252 folded precursor RNA, herein designated VGR FOLDED PRECURSOR RNA. It is appreciated that VGR3252 folded precursor RNA comprises a plurality of what is known in the art as 'hairpin' structures. These 'hairpin' structures are due to the fact that the nucleotide sequence of VGR3252 precursor RNA comprises a plurality of segments, the first half of each such segment having a nucleotide sequence which is at least a partial inversed-reversed sequence of the second half thereof, as is well known in the art.

VGR3252 folded precursor RNA is naturally processed by cellular enzymatic activity into at least 3 separate VGAM precursor RNAs, VGAM2548 precursor RNA, VGAM2549 precursor RNA and VGAM2550 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2548 RNA, VGAM2549 RNA and VGAM2550 RNA, herein schematically represented by VGAM1 RNA through VGAM3 RNA, each of which VGAM RNAs corresponding to VGAM RNA of FIG. 1.

VGAM2548 RNA, herein schematically represented by VGAM1 RNA through VGAM3 RNA, binds complementarily to a host target binding site located in an untranslated region of VGAM2548 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2548 host target RNA into VGAM2548 host target protein, herein schematically represented by VGAM1 HOST TARGET PROTEIN through VGAM3 HOST TARGET PROTEIN, all of FIG. 1.

VGAM2549 RNA, herein schematically represented by VGAM1 RNA through VGAM3 RNA, binds complementarily to a host target binding site located in an untranslated region of VGAM2549 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2549 host target RNA into VGAM2549 host target protein, herein schematically represented by VGAM1 HOST TARGET PROTEIN through VGAM3 HOST TARGET PROTEIN, all of FIG. 1.

VGAM2550 RNA, herein schematically represented by VGAM1 RNA through VGAM3 RNA, binds complementarily to a host target binding site located in an untranslated region of VGAM2550 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2550 host target RNA into VGAM2550 host target protein, herein schematically represented by VGAM1 HOST TARGET PROTEIN through VGAM3 HOST TARGET PROTEIN, all of FIG. 1.

It is appreciated that a function of VGR3252 gene, herein designated VGR GENE, is inhibition of expression of host target genes, as part of a novel viral mechanism of attacking a host. Accordingly, utilities of VGR3252 gene include diagnosis, prevention and treatment of viral infection by Saccharomyces Cerevisiae Virus L-A. Specific functions, and accordingly utilities, of VGR3252 gene correlate with, and may be deduced from, the identity of the host target genes, which are inhibited by VGAM RNAs comprised in the 'operon-like' cluster of VGR3252 gene: VGAM2548 host target protein, VGAM2549 host target protein and VGAM2550 host target protein, herein schematically represented by VGAM1 HOST TARGET PROTEIN through VGAM3 HOST TARGET PROTEIN. The function of these host target genes is elaborated hereinabove with reference to VGAM2548, VGAM2549 and VGAM2550. FIG. 9 further provides a conceptual description of novel bioinformatically detected regulatory viral gene, referred to here as Viral Genomic Record 3253(VGR3253) viral gene, which encodes an 'operon-like' cluster of novel viral micro RNA-like genes, each of which in turn modulates expression of at least one host target gene, the function and utility of which at least one host target gene is known in the art.

VGR3253 gene, herein designated VGR GENE, is a novel bioinformatically detected regulatory, non protein coding, RNA viral gene. The method by which VGR3253 gene was detected is described hereinabove with reference to FIGS. 1-9.

VGR3253 gene encodes VGR3253 precursor RNA, herein designated VGR PRECURSOR RNA, an RNA molecule, typically several hundred nucleotides long.

VGR3253 precursor RNA folds spatially, forming VGR3253 folded precursor RNA, herein designated VGR FOLDED PRECURSOR RNA. It is appreciated that VGR3253 folded precursor RNA comprises a plurality of what is known in the art as 'hairpin' structures. These 'hairpin' structures are due to the fact that the nucleotide sequence of VGR3253 precursor RNA comprises a plurality of segments, the first half of each such segment having a nucleotide sequence which is at least a partial inversed-reversed sequence of the second half thereof, as is well known in the art.

VGR3253 folded precursor RNA is naturally processed by cellular enzymatic activity into at least 2 separate VGAM precursor RNAs, VGAM2552 precursor RNA and VGAM2553 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2552 RNA and VGAM2553 RNA, herein schematically represented by VGAM1 RNA through VGAM3 RNA, each of which VGAM RNAs corresponding to VGAM RNA of FIG. 1.

VGAM2552 RNA, herein schematically represented by VGAM1 RNA through VGAM3 RNA, binds complementarily to a host target binding site located in an untranslated region of VGAM2552 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2552 host target RNA into VGAM2552 host target protein, herein schematically represented by VGAM1 HOST TARGET PROTEIN through VGAM3 HOST TARGET PROTEIN, all of FIG. 1.

VGAM2553 RNA, herein schematically represented by VGAM1 RNA through VGAM3 RNA, binds complementarily to a host target binding site located in an untranslated region of VGAM2553 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2553 host target RNA into VGAM2553 host target protein, herein schematically represented by VGAM1 HOST TARGET PROTEIN through VGAM3 HOST TARGET PROTEIN, all of FIG. 1.

It is appreciated that a function of VGR3253 gene, herein designated VGR GENE, is inhibition of expression of host target genes, as part of a novel viral mechanism of attacking a host. Accordingly, utilities of VGR3253 gene include diagnosis, prevention and treatment of viral infection by Rice Ragged Stunt Virus. Specific functions, and accordingly utilities, of VGR3253 gene correlate with, and may be deduced from, the identity of the host target genes, which are inhibited by VGAM RNAs comprised in the 'operon-like' cluster of VGR3253 gene: VGAM2552 host target protein and VGAM2553 host target protein, herein schematically represented by VGAM1 HOST TARGET PROTEIN through VGAM3 HOST TARGET PROTEIN. The function of these host target genes is elaborated hereinabove with reference to VGAM2552 and VGAM2553. FIG. 9 further provides a conceptual description of novel bioinformatically detected regulatory viral gene, referred to here as Viral Genomic Record 3254(VGR3254) viral gene, which encodes an 'operon-like' cluster of novel viral micro RNA-like genes, each of which in turn modulates expression of at least one host target gene, the function and utility of which at least one host target gene is known in the art.

VGR3254 gene, herein designated VGR GENE, is a novel bioinformatically detected regulatory, non protein coding, RNA viral gene. The method by which VGR3254 gene was detected is described hereinabove with reference to FIGS. 1-9.

VGR3254 gene encodes VGR3254 precursor RNA, herein designated VGR PRECURSOR RNA, an RNA molecule, typically several hundred nucleotides long.

VGR3254 precursor RNA folds spatially, forming VGR3254 folded precursor RNA, herein designated VGR FOLDED PRECURSOR RNA. It is appreciated that VGR3254 folded precursor RNA comprises a plurality of what is known in the art as 'hairpin' structures. These 'hairpin' structures are due to the fact that the nucleotide sequence of VGR3254 precursor RNA comprises a plurality of segments, the first half of each such segment having a nucleotide sequence which is at least a partial inversed-reversed sequence of the second half thereof, as is well known in the art.

VGR3254 folded precursor RNA is naturally processed by cellular enzymatic activity into at least 3 separate VGAM precursor RNAs, VGAM2554 precursor RNA, VGAM2555 precursor RNA and VGAM2556 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2554 RNA, VGAM2555 RNA and VGAM2556 RNA, herein schematically represented by VGAM1 RNA through VGAM3 RNA, each of which VGAM RNAs corresponding to VGAM RNA of FIG. 1.

VGAM2554 RNA, herein schematically represented by VGAM1 RNA through VGAM3 RNA, binds complementarily to a host target binding site located in an untranslated region of VGAM2554 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2554 host target RNA into VGAM2554 host target protein, herein schematically represented by VGAM1 HOST TARGET PROTEIN through VGAM3 HOST TARGET PROTEIN, all of FIG. 1.

VGAM2555 RNA, herein schematically represented by VGAM1 RNA through VGAM3 RNA, binds complementarily to a host target binding site located in an untranslated region of VGAM2555 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2555 host target RNA into VGAM2555 host target protein, herein schematically represented by VGAM1 HOST TARGET PROTEIN through VGAM3 HOST TARGET PROTEIN, all of FIG. 1.

VGAM2556 RNA, herein schematically represented by VGAM1 RNA through VGAM3 RNA, binds complementarily to a host target binding site located in an untranslated region of VGAM2556 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2556 host target RNA into VGAM2556 host target protein, herein schematically represented by VGAM1 HOST TARGET PROTEIN through VGAM3 HOST TARGET PROTEIN, all of FIG. 1.

It is appreciated that a function of VGR3254 gene, herein designated VGR GENE, is inhibition of expression of host target genes, as part of a novel viral mechanism of attacking a host. Accordingly, utilities of VGR3254 gene include diagnosis, prevention and treatment of viral infection by Plautia Stali Intestine Virus. Specific functions, and accordingly utilities, of VGR3254 gene correlate with, and may be deduced from, the identity of the host target genes, which are inhibited by VGAM RNAs comprised in the 'operon-like' cluster of VGR3254 gene: VGAM2554 host target protein, VGAM2555 host target protein and VGAM2556 host target protein, herein schematically represented by VGAM1 HOST TARGET PROTEIN through VGAM3 HOST TARGET PROTEIN. The function of these host target genes is elaborated hereinabove with reference to VGAM2554, VGAM2555 and VGAM2556. FIG. 9 further provides a conceptual description of novel bioinformatically detected regulatory viral gene, referred to here as Viral Genomic Record 3255(VGR3255) viral gene, which encodes an 'operon-like' cluster of novel viral micro RNA-like genes, each of which in turn modulates expression of at least one host target gene, the function and utility of which at least one host target gene is known in the art.

VGR3255 gene, herein designated VGR GENE, is a novel bioinformatically detected regulatory, non protein coding, RNA viral gene. The method by which VGR3255 gene was detected is described hereinabove with reference to FIGS. 1-9.

VGR3255 gene encodes VGR3255 precursor RNA, herein designated VGR PRECURSOR RNA, an RNA molecule, typically several hundred nucleotides long.

VGR3255 precursor RNA folds spatially, forming VGR3255 folded precursor RNA, herein designated VGR FOLDED PRECURSOR RNA. It is appreciated that VGR3255 folded precursor RNA comprises a plurality of what is known in the art as 'hairpin' structures. These 'hairpin' structures are due to the fact that the nucleotide sequence of VGR3255 precursor RNA comprises a plurality of segments, the first half of each such segment having a nucleotide sequence which is at least a partial inversed-reversed sequence of the second half thereof, as is well known in the art.

VGR3255 folded precursor RNA is naturally processed by cellular enzymatic activity into at least 7 separate VGAM precursor RNAs, VGAM2557 precursor RNA, VGAM2558 precursor RNA, VGAM2559 precursor RNA, VGAM2560 precursor RNA, VGAM2561 precursor RNA, VGAM2562 precursor RNA and VGAM2563 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2557 RNA, VGAM2558 RNA, VGAM2559 RNA, VGAM2560 RNA, VGAM2561 RNA, VGAM2562 RNA and VGAM2563 RNA, herein schematically represented by VGAM1 RNA through VGAM3 RNA, each of which VGAM RNAs corresponding to VGAM RNA of FIG. 1.

VGAM2557 RNA, herein schematically represented by VGAM1 RNA through VGAM3 RNA, binds complementarily to a host target binding site located in an untranslated region of VGAM2557 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2557 host target RNA into VGAM2557 host target protein, herein schematically represented by VGAM1 HOST TARGET PROTEIN through VGAM3 HOST TARGET PROTEIN, all of FIG. 1.

VGAM2558 RNA, herein schematically represented by VGAM1 RNA through VGAM3 RNA, binds complementarily to a host target binding site located in an untranslated region of VGAM2558 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2558 host target RNA into VGAM2558 host target protein, herein schematically represented by VGAM1 HOST TARGET PROTEIN through VGAM3 HOST TARGET PROTEIN, all of FIG. 1.

VGAM2559 RNA, herein schematically represented by VGAM1 RNA through VGAM3 RNA, binds complementarily to a host target binding site located in an untranslated region of VGAM2559 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2559 host target RNA into VGAM2559 host target protein, herein schematically represented by VGAM1 HOST TARGET PROTEIN through VGAM3 HOST TARGET PROTEIN, all of FIG. 1.

VGAM2560 RNA, herein schematically represented by VGAM1 RNA through VGAM3 RNA, binds complementarily to a host target binding site located in an untranslated region of VGAM2560 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2560 host target RNA into VGAM2560 host target protein, herein schematically represented by VGAM1 HOST TARGET PROTEIN through VGAM3 HOST TARGET PROTEIN, all of FIG. 1.

VGAM2561 RNA, herein schematically represented by VGAM1 RNA through VGAM3 RNA, binds complementarily to a host target binding site located in an untranslated region of VGAM2561 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2561 host target RNA into VGAM2561 host target protein, herein schematically represented by VGAM1 HOST TARGET PROTEIN through VGAM3 HOST TARGET PROTEIN, all of FIG. 1.

VGAM2562 RNA, herein schematically represented by VGAM1 RNA through VGAM3 RNA, binds complementarily to a host target binding site located in an untranslated region of VGAM2562 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2562 host target RNA into VGAM2562 host target protein, herein schematically represented by VGAM1 HOST TARGET PROTEIN through VGAM3 HOST TARGET PROTEIN, all of FIG. 1.

VGAM2563 RNA, herein schematically represented by VGAM1 RNA through VGAM3 RNA, binds complementarily to a host target binding site located in an untranslated region of VGAM2563 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2563 host target RNA into VGAM2563 host target protein, herein schematically represented by VGAM1 HOST TARGET PROTEIN through VGAM3 HOST TARGET PROTEIN, all of FIG. 1.

It is appreciated that a function of VGR3255 gene, herein designated VGR GENE, is inhibition of expression of host target genes, as part of a novel viral mechanism of attacking a host. Accordingly, utilities of VGR3255 gene include diagnosis, prevention and treatment of viral infection by Himetobi P Virus. Specific functions, and accordingly utilities, of VGR3255 gene correlate with, and may be deduced from, the identity of the host target genes, which are inhibited by VGAM RNAs comprised in the 'operon-like' cluster of VGR3255 gene: VGAM2557 host target protein, VGAM2558 host target protein, VGAM2559 host target protein, VGAM2560 host target protein, VGAM2561 host target protein, VGAM2562 host target protein and VGAM2563 host target protein, herein schematically represented by VGAM1 HOST TARGET PROTEIN through VGAM3 HOST TARGET PROTEIN. The function of these host target genes is elaborated hereinabove with reference to VGAM2557, VGAM2558, VGAM2559, VGAM2560, VGAM2561, VGAM2562 and VGAM2563. FIG. 9 further provides a conceptual description of novel bioinformatically detected regulatory viral gene, referred to here as Viral Genomic Record 3256(VGR3256) viral gene, which encodes an 'operon-like' cluster of novel viral micro RNA-like genes, each of which in turn modulates expression of at least one host target gene, the function and utility of which at least one host target gene is known in the art.

VGR3256 gene, herein designated VGR GENE, is a novel bioinformatically detected regulatory, non protein coding, RNA viral gene. The method by which VGR3256 gene was detected is described hereinabove with reference to FIGS. 1-9.

VGR3256 gene encodes VGR3256 precursor RNA, herein designated VGR PRECURSOR RNA, an RNA molecule, typically several hundred nucleotides long.

VGR3256 precursor RNA folds spatially, forming VGR3256 folded precursor RNA, herein designated VGR FOLDED PRECURSOR RNA. It is appreciated that VGR3256 folded precursor RNA comprises a plurality of what is known in the art as 'hairpin' structures. These 'hairpin' structures are due to the fact that the nucleotide sequence of VGR3256 precursor RNA comprises a plurality of segments, the first half of each such segment having a nucleotide sequence which is at least a partial inversed-reversed sequence of the second half thereof, as is well known in the art.

VGR3256 folded precursor RNA is naturally processed by cellular enzymatic activity into at least 8 separate VGAM precursor RNAs, VGAM2564 precursor RNA, VGAM2565 precursor RNA, VGAM2566 precursor RNA, VGAM2567 precursor RNA, VGAM2568 precursor RNA, VGAM2569 precursor RNA, VGAM2570 precursor RNA and VGAM2571 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2564 RNA, VGAM2565 RNA, VGAM2566 RNA, VGAM2567 RNA, VGAM2568 RNA, VGAM2569 RNA, VGAM2570 RNA and VGAM2571 RNA, herein schematically represented by VGAM1 RNA through VGAM3 RNA, each of which VGAM RNAs corresponding to VGAM RNA of FIG. 1.

VGAM2564 RNA, herein schematically represented by VGAM1 RNA through VGAM3 RNA, binds complementarily to a host target binding site located in an untranslated region of VGAM2564 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2564 host target RNA into VGAM2564 host target protein, herein schematically represented by VGAM1 HOST TARGET PROTEIN through VGAM3 HOST TARGET PROTEIN, all of FIG. 1.

VGAM2565 RNA, herein schematically represented by VGAM1 RNA through VGAM3 RNA, binds complementarily to a host target binding site located in an untranslated region of VGAM2565 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2565 host target RNA into VGAM2565 host target protein, herein schematically represented by VGAM1 HOST TARGET PROTEIN through VGAM3 HOST TARGET PROTEIN, all of FIG. 1.

VGAM2566 RNA, herein schematically represented by VGAM1 RNA through VGAM3 RNA, binds complementarily to a host target binding site located in an untranslated region of VGAM2566 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM2566 host target RNA into VGAM2566 host target protein, herein schematically represented by VGAM1 HOST TARGET PROTEIN through VGAM3 HOST TARGET PROTEIN, all of FIG. 1.

VGAM2567 RNA, herein schematically represented by VGAM1 RNA through VGAM3 RNA, binds complementarily to a host target binding site located in an untranslated region of VGAM2567 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2567 host target RNA into VGAM2567 host target protein, herein schematically represented by VGAM1 HOST TARGET PROTEIN through VGAM3 HOST TARGET PROTEIN, all of FIG. 1.

VGAM2568 RNA, herein schematically represented by VGAM1 RNA through VGAM3 RNA, binds complementarily to a host target binding site located in an untranslated region of VGAM2568 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2568 host target RNA into VGAM2568 host target protein, herein schematically represented by VGAM1 HOST TARGET PROTEIN through VGAM3 HOST TARGET PROTEIN, all of FIG. 1.

VGAM2569 RNA, herein schematically represented by VGAM1 RNA through VGAM3 RNA, binds complementarily to a host target binding site located in an untranslated region of VGAM2569 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2569 host target RNA into VGAM2569 host target protein, herein schematically represented by VGAM1 HOST TARGET PROTEIN through VGAM3 HOST TARGET PROTEIN, all of FIG. 1.

VGAM2570 RNA, herein schematically represented by VGAM1 RNA through VGAM3 RNA, binds complementarily to a host target binding site located in an untranslated region of VGAM2570 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2570 host target RNA into VGAM2570 host target protein, herein schematically represented by VGAM1 HOST TARGET PROTEIN through VGAM3 HOST TARGET PROTEIN, all of FIG. 1.

VGAM2571 RNA, herein schematically represented by VGAM1 RNA through VGAM3 RNA, binds complementarily to a host target binding site located in an untranslated region of VGAM2571 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2571 host target RNA into VGAM2571 host target protein, herein schematically represented by VGAM1 HOST TARGET PROTEIN through VGAM3 HOST TARGET PROTEIN, all of FIG. 1.

It is appreciated that a function of VGR3256 gene, herein designated VGR GENE, is inhibition of expression of host target genes, as part of a novel viral mechanism of attacking a host. Accordingly, utilities of VGR3256 gene include diagnosis, prevention and treatment of viral infection by Triatoma Virus. Specific functions, and accordingly utilities, of VGR3256 gene correlate with, and may be deduced from, the identity of the host target genes, which are inhibited by VGAM RNAs comprised in the 'operon-like' cluster of VGR3256 gene: VGAM2564 host target protein, VGAM2565 host target protein, VGAM2566 host target protein, VGAM2567 host target protein, VGAM2568 host target protein, VGAM2569 host target protein, VGAM2570 host target protein and VGAM2571 host target protein, herein schematically represented by VGAM1 HOST TARGET PROTEIN through VGAM3 HOST TARGET PROTEIN. The function of these host target genes is elaborated hereinabove with reference to VGAM2564, VGAM2565, VGAM2566, VGAM2567, VGAM2568, VGAM2569, VGAM2570 and VGAM2571. FIG. 9 further provides a conceptual description of novel bioinformatically detected regulatory viral gene, referred to here as Viral Genomic Record 3257(VGR3257) viral gene, which encodes an 'operon-like' cluster of novel viral micro RNA-like genes, each of which in turn modulates expression of at least one host target gene, the function and utility of which at least one host target gene is known in the art.

VGR3257 gene, herein designated VGR GENE, is a novel bioinformatically detected regulatory, non protein coding, RNA viral gene. The method by which VGR3257 gene was detected is described hereinabove with reference to FIGS. 1-9.

VGR3257 gene encodes VGR3257 precursor RNA, herein designated VGR PRECURSOR RNA, an RNA molecule, typically several hundred nucleotides long.

VGR3257 precursor RNA folds spatially, forming VGR3257 folded precursor RNA, herein designated VGR FOLDED PRECURSOR RNA. It is appreciated that VGR3257 folded precursor RNA comprises a plurality of what is known in the art as 'hairpin' structures. These 'hairpin' structures are due to the fact that the nucleotide sequence of VGR3257 precursor RNA comprises a plurality of segments, the first half of each such segment having a nucleotide sequence which is at least a partial inversed-reversed sequence of the second half thereof, as is well known in the art.

VGR3257 folded precursor RNA is naturally processed by cellular enzymatic activity into at least 7 separate VGAM precursor RNAs, VGAM2572 precursor RNA, VGAM2573 precursor RNA, VGAM2574 precursor RNA, VGAM2575 precursor RNA, VGAM2576 precursor RNA, VGAM2577 precursor RNA and VGAM2578 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2572 RNA, VGAM2573 RNA, VGAM2574 RNA, VGAM2575 RNA, VGAM2576 RNA, VGAM2577 RNA and VGAM2578 RNA, herein schematically represented by VGAM1 RNA through VGAM3 RNA, each of which VGAM RNAs corresponding to VGAM RNA of FIG. 1.

VGAM2572 RNA, herein schematically represented by VGAM1 RNA through VGAM3 RNA, binds complementarily to a host target binding site located in an untranslated region of VGAM2572 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2572 host target RNA into VGAM2572 host target protein, herein schematically represented by VGAM1 HOST TARGET PROTEIN through VGAM3 HOST TARGET PROTEIN, all of FIG. 1.

VGAM2573 RNA, herein schematically represented by VGAM1 RNA through VGAM3 RNA, binds complementarily to a host target binding site located in an untranslated region of VGAM2573 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2573 host target RNA into VGAM2573 host target protein, herein schematically represented by VGAM1 HOST TARGET PROTEIN through VGAM3 HOST TARGET PROTEIN, all of FIG. 1.

VGAM2574 RNA, herein schematically represented by VGAM1 RNA through VGAM3 RNA, binds complementarily to a host target binding site located in an untranslated region of VGAM2574 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2574 host target RNA into VGAM2574 host target protein, herein schematically represented by VGAM1 HOST TARGET PROTEIN through VGAM3 HOST TARGET PROTEIN, all of FIG. 1.

VGAM2575 RNA, herein schematically represented by VGAM1 RNA through VGAM3 RNA, binds complementarily to a host target binding site located in an untranslated region of VGAM2575 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2575 host target RNA into VGAM2575 host target protein, herein schematically represented by VGAM1 HOST TARGET PROTEIN through VGAM3 HOST TARGET PROTEIN, all of FIG. 1.

VGAM2576 RNA, herein schematically represented by VGAM1 RNA through VGAM3 RNA, binds complementarily to a host target binding site located in an untranslated region of VGAM2576 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2576 host target RNA into VGAM2576 host target protein, herein schematically represented by VGAM1 HOST TARGET PROTEIN through VGAM3 HOST TARGET PROTEIN, all of FIG. 1.

VGAM2577 RNA, herein schematically represented by VGAM1 RNA through VGAM3 RNA, binds complementarily to a host target binding site located in an untranslated region of VGAM2577 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2577 host target RNA into VGAM2577 host target protein, herein schematically represented by VGAM1 HOST TARGET PROTEIN through VGAM3 HOST TARGET PROTEIN, all of FIG. 1.

VGAM2578 RNA, herein schematically represented by VGAM1 RNA through VGAM3 RNA, binds complementarily to a host target binding site located in an untranslated region of VGAM2578 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2578 host target RNA into VGAM2578 host target protein, herein schematically represented by VGAM1 HOST TARGET PROTEIN through VGAM3 HOST TARGET PROTEIN, all of FIG. 1.

It is appreciated that a function of VGR3257 gene, herein designated VGR GENE, is inhibition of expression of host target genes, as part of a novel viral mechanism of attacking a host. Accordingly, utilities of VGR3257 gene include diagnosis, prevention and treatment of viral infection by Triatoma Virus. Specific functions, and accordingly utilities, of VGR3257 gene correlate with, and may be deduced from, the identity of the host target genes, which are inhibited by VGAM RNAs comprised in the 'operon-like' cluster of VGR3257 gene: VGAM2572 host target protein, VGAM2573 host target protein, VGAM2574 host target protein, VGAM2575 host target protein, VGAM2576 host target protein, VGAM2577 host target protein and VGAM2578 host target protein, herein schematically represented by VGAM1 HOST TARGET PROTEIN through VGAM3 HOST TARGET PROTEIN. The function of these host target genes is elaborated hereinabove with reference to VGAM2572, VGAM2573, VGAM2574, VGAM2575, VGAM2576, VGAM2577 and VGAM2578. FIG. 9 further provides a conceptual description of novel bioinformatically detected regulatory viral gene, referred to here as Viral Genomic Record 3258(VGR3258) viral gene, which encodes an 'operon-like' cluster of novel viral micro RNA-like genes, each of which in turn modulates expression of at least one host target gene, the function and utility of which at least one host target gene is known in the art.

VGR3258 gene, herein designated VGR GENE, is a novel bioinformatically detected regulatory, non protein coding, RNA viral gene. The method by which VGR3258 gene was detected is described hereinabove with reference to FIGS. 1-9.

VGR3258 gene encodes VGR3258 precursor RNA, herein designated VGR PRECURSOR RNA, an RNA molecule, typically several hundred nucleotides long.

VGR3258 precursor RNA folds spatially, forming VGR3258 folded precursor RNA, herein designated VGR FOLDED PRECURSOR RNA. It is appreciated that VGR3258 folded precursor RNA comprises a plurality of what is known in the art as 'hairpin' structures. These 'hairpin' structures are due to the fact that the nucleotide sequence of VGR3258 precursor RNA comprises a plurality of segments, the first half of each such segment having a nucleotide sequence which is at least a partial inversed-reversed sequence of the second half thereof, as is well known in the art.

VGR3258 folded precursor RNA is naturally processed by cellular enzymatic activity into at least 5 separate VGAM precursor RNAs, VGAM2579 precursor RNA, VGAM2580 precursor RNA, VGAM2581 precursor RNA, VGAM2582 precursor RNA and VGAM2583 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2579 RNA, VGAM2580 RNA, VGAM2581 RNA, VGAM2582 RNA and VGAM2583 RNA, herein schematically represented by VGAM1 RNA through VGAM3 RNA, each of which VGAM RNAs corresponding to VGAM RNA of FIG. 1.

VGAM2579 RNA, herein schematically represented by VGAM1 RNA through VGAM3 RNA, binds complementarily to a host target binding site located in an untranslated region of VGAM2579 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2579 host target RNA into VGAM2579 host target protein, herein schematically represented by VGAM1 HOST TARGET PROTEIN through VGAM3 HOST TARGET PROTEIN, all of FIG. 1.

VGAM2580 RNA, herein schematically represented by VGAM1 RNA through VGAM3 RNA, binds complementarily to a host target binding site located in an untranslated region of VGAM2580 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2580 host target RNA into VGAM2580 host target protein, herein schematically represented by VGAM1 HOST TARGET PROTEIN through VGAM3 HOST TARGET PROTEIN, all of FIG. 1.

VGAM2581 RNA, herein schematically represented by VGAM1 RNA through VGAM3 RNA, binds complementarily to a host target binding site located in an untranslated region of VGAM2581 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2581 host target RNA into VGAM2581 host target protein, herein schematically represented by VGAM1 HOST TARGET PROTEIN through VGAM3 HOST TARGET PROTEIN, all of FIG. 1.

VGAM2582 RNA, herein schematically represented by VGAM1 RNA through VGAM3 RNA, binds complementarily to a host target binding site located in an untranslated region of VGAM2582 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2582 host target RNA into VGAM2582 host target protein, herein schematically represented by VGAM1 HOST TARGET PROTEIN through VGAM3 HOST TARGET PROTEIN, all of FIG. 1.

VGAM2583 RNA, herein schematically represented by VGAM1 RNA through VGAM3 RNA, binds complementarily to a host target binding site located in an untranslated region of VGAM2583 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2583 host target RNA into VGAM2583 host target protein, herein schematically represented by VGAM1 HOST TARGET PROTEIN through VGAM3 HOST TARGET PROTEIN, all of FIG. 1.

It is appreciated that a function of VGR3258 gene, herein designated VGR GENE, is inhibition of expression of host target genes, as part of a novel viral mechanism of attacking a host. Accordingly, utilities of VGR3258 gene include diagnosis, prevention and treatment of viral infection by Triatoma Virus. Specific functions, and accordingly utilities, of VGR3258 gene correlate with, and may be deduced from, the identity of the host target genes, which are inhibited by VGAM RNAs comprised in the 'operon-like' cluster of VGR3258 gene: VGAM2579 host target protein, VGAM2580 host target protein, VGAM2581 host target protein, VGAM2582 host target protein and VGAM2583 host target protein, herein schematically represented by VGAM1 HOST TARGET PROTEIN through VGAM3 HOST TARGET PROTEIN. The function of these host target genes is elaborated hereinabove with reference to VGAM2579, VGAM2580, VGAM2581, VGAM2582 and VGAM2583.

FIG. 9 further provides a conceptual description of novel bioinformatically detected regulatory viral gene, referred to here as Viral Genomic Record 3259(VGR3259) viral gene, which encodes an 'operon-like' cluster of novel viral micro RNA-like genes, each of which in turn modulates expression of at least one host target gene, the function and utility of which at least one host target gene is known in the art.

VGR3259 gene, herein designated VGR GENE, is a novel bioinformatically detected regulatory, non protein coding, RNA viral gene. The method by which VGR3259 gene was detected is described hereinabove with reference to FIGS. 1-9.

VGR3259 gene encodes VGR3259 precursor RNA, herein designated VGR PRECURSOR RNA, an RNA molecule, typically several hundred nucleotides long.

VGR3259 precursor RNA folds spatially, forming VGR3259 folded precursor RNA, herein designated VGR FOLDED PRECURSOR RNA. It is appreciated that VGR3259 folded precursor RNA comprises a plurality of what is known in the art as 'hairpin' structures. These 'hairpin' structures are due to the fact that the nucleotide sequence of VGR3259 precursor RNA comprises a plurality of segments, the first half of each such segment having a nucleotide sequence which is at least a partial inversed-reversed sequence of the second half thereof, as is well known in the art.

VGR3259 folded precursor RNA is naturally processed by cellular enzymatic activity into at least 5 separate VGAM precursor RNAs, VGAM2584 precursor RNA, VGAM2585 precursor RNA, VGAM2586 precursor RNA, VGAM2587 precursor RNA and VGAM2588 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2584 RNA, VGAM2585 RNA, VGAM2586 RNA, VGAM2587 RNA and VGAM2588 RNA, herein schematically represented by VGAM1 RNA through VGAM3 RNA, each of which VGAM RNAs corresponding to VGAM RNA of FIG. 1.

VGAM2584 RNA, herein schematically represented by VGAM1 RNA through VGAM3 RNA, binds complementarily to a host target binding site located in an untranslated region of VGAM2584 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2584 host target RNA into VGAM2584 host target protein, herein schematically represented by VGAM1 HOST TARGET PROTEIN through VGAM3 HOST TARGET PROTEIN, all of FIG. 1.

VGAM2585 RNA, herein schematically represented by VGAM1 RNA through VGAM3 RNA, binds complementarily to a host target binding site located in an untranslated region of VGAM2585 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2585 host target RNA into VGAM2585 host target protein, herein schematically represented by VGAM1 HOST TARGET PROTEIN through VGAM3 HOST TARGET PROTEIN, all of FIG. 1.

VGAM2586 RNA, herein schematically represented by VGAM1 RNA through VGAM3 RNA, binds complementarily to a host target binding site located in an untranslated region of VGAM2586 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2586 host target RNA into VGAM2586 host target protein, herein schematically represented by VGAM1 HOST TARGET PROTEIN through VGAM3 HOST TARGET PROTEIN, all of FIG. 1.

VGAM2587 RNA, herein schematically represented by VGAM1 RNA through VGAM3 RNA, binds complementarily to a host target binding site located in an untranslated region of VGAM2587 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2587 host target RNA into VGAM2587 host target protein, herein schematically represented by VGAM1 HOST TARGET PROTEIN through VGAM3 HOST TARGET PROTEIN, all of FIG. 1.

VGAM2588 RNA, herein schematically represented by VGAM1 RNA through VGAM3 RNA, binds complementarily to a host target binding site located in an untranslated region of VGAM2588 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2588 host target RNA into VGAM2588 host target protein, herein schematically represented by VGAM1 HOST TARGET PROTEIN through VGAM3 HOST TARGET PROTEIN, all of FIG. 1.

It is appreciated that a function of VGR3259 gene, herein designated VGR GENE, is inhibition of expression of host target genes, as part of a novel viral mechanism of attacking a host. Accordingly, utilities of VGR3259 gene include diagnosis, prevention and treatment of viral infection by Satsuma Dwarf Virus. Specific functions, and accordingly utilities, of VGR3259 gene correlate with, and may be deduced from, the identity of the host target genes, which are inhibited by VGAM RNAs comprised in the 'operon-like' cluster of VGR3259 gene: VGAM2584 host target protein, VGAM2585 host target protein, VGAM2586 host target protein, VGAM2587 host target protein and VGAM2588 host target protein, herein schematically represented by VGAM1 HOST TARGET PROTEIN through VGAM3 HOST TARGET PROTEIN. The function of these host target genes is elaborated hereinabove with reference to VGAM2584, VGAM2585, VGAM2586, VGAM2587 and VGAM2588.

FIG. 9 further provides a conceptual description of novel bioinformatically detected regulatory viral gene, referred to here as Viral Genomic Record 3260(VGR3260) viral gene, which encodes an 'operon-like' cluster of novel viral micro RNA-like genes, each of which in turn modulates expression of at least one host target gene, the function and utility of which at least one host target gene is known in the art.

VGR3260 gene, herein designated VGR GENE, is a novel bioinformatically detected regulatory, non protein coding, RNA viral gene. The method by which VGR3260 gene was detected is described hereinabove with reference to FIGS. 1-9.

VGR3260 gene encodes VGR3260 precursor RNA, herein designated VGR PRECURSOR RNA, an RNA molecule, typically several hundred nucleotides long.

VGR3260 precursor RNA folds spatially, forming VGR3260 folded precursor RNA, herein designated VGR FOLDED PRECURSOR RNA. It is appreciated that VGR3260 folded precursor RNA comprises a plurality of what is known in the art as 'hairpin' structures. These 'hairpin' structures are due to the fact that the nucleotide sequence of VGR3260 precursor RNA comprises a plurality of segments, the first half of each such segment having a nucleotide sequence which is at least a partial inversed-reversed sequence of the second half thereof, as is well known in the art.

VGR3260 folded precursor RNA is naturally processed by cellular enzymatic activity into at least 7 separate VGAM precursor RNAs, VGAM2589 precursor RNA, VGAM2590 precursor RNA, VGAM2591 precursor RNA, VGAM2592 precursor RNA, VGAM2593 precursor RNA, VGAM2594 precursor RNA and VGAM2595 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2589 RNA, VGAM2590 RNA, VGAM2591 RNA, VGAM2592 RNA, VGAM2593 RNA, VGAM2594 RNA and VGAM2595 RNA, herein schematically represented by VGAM1 RNA through VGAM3 RNA, each of which VGAM RNAs corresponding to VGAM RNA of FIG. 1.

VGAM2589 RNA, herein schematically represented by VGAM1 RNA through VGAM3 RNA, binds complementarily to a host target binding site located in an untranslated region of VGAM2589 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2589 host target RNA into VGAM2589 host target protein, herein schematically represented by VGAM1 HOST TARGET PROTEIN through VGAM3 HOST TARGET PROTEIN, all of FIG. 1.

VGAM2590 RNA, herein schematically represented by VGAM1 RNA through VGAM3 RNA, binds complementarily to a host target binding site located in an untranslated region of VGAM2590 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2590 host target RNA into VGAM2590 host target protein, herein schematically represented by VGAM1 HOST TARGET PROTEIN through VGAM3 HOST TARGET PROTEIN, all of FIG. 1.

VGAM2591 RNA, herein schematically represented by VGAM1 RNA through VGAM3 RNA, binds complementarily to a host target binding site located in an untranslated region of VGAM2591 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2591 host target RNA into VGAM2591 host target protein, herein schematically represented by VGAM1 HOST TARGET PROTEIN through VGAM3 HOST TARGET PROTEIN, all of FIG. 1.

VGAM2592 RNA, herein schematically represented by VGAM1 RNA through VGAM3 RNA, binds complementarily to a host target binding site located in an untranslated region of VGAM2592 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2592 host target RNA into VGAM2592 host target protein, herein schematically represented by VGAM1 HOST TARGET PROTEIN through VGAM3 HOST TARGET PROTEIN, all of FIG. 1.

VGAM2593 RNA, herein schematically represented by VGAM1 RNA through VGAM3 RNA, binds complementarily to a host target binding site located in an untranslated region of VGAM2593 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2593 host target RNA into VGAM2593 host target protein, herein schematically represented by VGAM1 HOST TARGET PROTEIN through VGAM3 HOST TARGET PROTEIN, all of FIG. 1.

VGAM2594 RNA, herein schematically represented by VGAM1 RNA through VGAM3 RNA, binds complementarily to a host target binding site located in an untranslated region of VGAM2594 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2594 host target RNA into VGAM2594 host target protein, herein schematically represented by VGAM1 HOST TARGET PROTEIN through VGAM3 HOST TARGET PROTEIN, all of FIG. 1.

VGAM2595 RNA, herein schematically represented by VGAM1 RNA through VGAM3 RNA, binds complementarily to a host target binding site located in an untranslated region of VGAM2595 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2595 host target RNA into VGAM2595 host target protein, herein schematically represented by VGAM1 HOST TARGET PROTEIN through VGAM3 HOST TARGET PROTEIN, all of FIG. 1.

It is appreciated that a function of VGR3260 gene, herein designated VGR GENE, is inhibition of expression of host target genes, as part of a novel viral mechanism of attacking a host. Accordingly, utilities of VGR3260 gene include diagnosis, prevention and treatment of viral infection by Apple Latent Spherical Virus. Specific functions, and accordingly utilities, of VGR3260 gene correlate with, and may be deduced from, the identity of the host target genes, which are inhibited by VGAM RNAs comprised in the 'operon-like' cluster of VGR3260 gene: VGAM2589 host target protein, VGAM2590 host target protein, VGAM2591 host target protein, VGAM2592 host target protein, VGAM2593 host target protein, VGAM2594 host target protein and VGAM2595 host target protein, herein schematically represented by VGAM1 HOST TARGET PROTEIN through VGAM3 HOST TARGET PROTEIN. The function of these host target genes is elaborated hereinabove with reference to VGAM2589, VGAM2590, VGAM2591, VGAM2592, VGAM2593, VGAM2594 and VGAM2595. FIG. 9 further provides a conceptual description of novel bioinformatically detected regulatory viral gene, referred to here as Viral Genomic Record 3261 (VGR3261) viral gene, which encodes an 'operon-like' cluster of novel viral micro RNA-like genes, each of which in turn modulates expression of at least one host target gene, the function and utility of which at least one host target gene is known in the art.

VGR3261 gene, herein designated VGR GENE, is a novel bioinformatically detected regulatory, non protein coding, RNA viral gene. The method by which VGR3261 gene was detected is described hereinabove with reference to FIGS. 1-9.

VGR3261 gene encodes VGR3261 precursor RNA, herein designated VGR PRECURSOR RNA, an RNA molecule, typically several hundred nucleotides long.

VGR3261 precursor RNA folds spatially, forming VGR3261 folded precursor RNA, herein designated VGR FOLDED PRECURSOR RNA. It is appreciated that VGR3261 folded precursor RNA comprises a plurality of what is known in the art as 'hairpin' structures. These 'hairpin' structures are due to the fact that the nucleotide sequence of VGR3261 precursor RNA comprises a plurality of segments, the first half of each such segment having a nucleotide sequence which is at least a partial inversed-reversed sequence of the second half thereof, as is well known in the art.

VGR3261 folded precursor RNA is naturally processed by cellular enzymatic activity into at least 3 separate VGAM precursor RNAs, VGAM2596 precursor RNA, VGAM2597 precursor RNA and VGAM2598 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2596 RNA, VGAM2597 RNA and VGAM2598 RNA, herein schematically represented by VGAM1 RNA through VGAM3 RNA, each of which VGAM RNAs corresponding to VGAM RNA of FIG. 1.

VGAM2596 RNA, herein schematically represented by VGAM1 RNA through VGAM3 RNA, binds complementarily to a host target binding site located in an untranslated region of VGAM2596 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2596 host target RNA into VGAM2596 host target protein, herein schematically represented by VGAM1 HOST TARGET PROTEIN through VGAM3 HOST TARGET PROTEIN, all of FIG. 1.

VGAM2597 RNA, herein schematically represented by VGAM1 RNA through VGAM3 RNA, binds complementarily to a host target binding site located in an untranslated region of VGAM2597 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2597 host target RNA into VGAM2597 host target protein, herein schematically represented by VGAM1 HOST TARGET PROTEIN through VGAM3 HOST TARGET PROTEIN, all of FIG. 1.

VGAM2598 RNA, herein schematically represented by VGAM1 RNA through VGAM3 RNA, binds complementarily to a host target binding site located in an untranslated region of VGAM2598 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2598 host target RNA into VGAM2598 host target protein, herein schematically represented by VGAM1 HOST TARGET PROTEIN through VGAM3 HOST TARGET PROTEIN, all of FIG. 1.

It is appreciated that a function of VGR3261 gene, herein designated VGR GENE, is inhibition of expression of host target genes, as part of a novel viral mechanism of attacking a host. Accordingly, utilities of VGR3261 gene include diagnosis, prevention and treatment of viral infection by Tobacco Rattle Virus. Specific functions, and accordingly utilities, of VGR3261 gene correlate with, and may be deduced from, the identity of the host target genes, which are inhibited by VGAM RNAs comprised in the 'operon-like' cluster of VGR3261 gene: VGAM2596 host target protein, VGAM2597 host target protein and VGAM2598 host target protein, herein schematically represented by VGAM1 HOST TARGET PROTEIN through VGAM3 HOST TARGET PROTEIN. The function of these host target genes is elaborated hereinabove with reference to VGAM2596, VGAM2597 and VGAM2598. FIG. 9 further provides a conceptual description of novel bioinformatically detected regulatory viral gene, referred to here as Viral Genomic Record 3262(VGR3262) viral gene, which encodes an 'operon-like' cluster of novel viral micro RNA-like genes, each of which in turn modulates expression of at least one host target gene, the function and utility of which at least one host target gene is known in the art.

VGR3262 gene, herein designated VGR GENE, is a novel bioinformatically detected regulatory, non protein coding, RNA viral gene. The method by which VGR3262 gene was detected is described hereinabove with reference to FIGS. 1-9.

VGR3262 gene encodes VGR3262 precursor RNA, herein designated VGR PRECURSOR RNA, an RNA molecule, typically several hundred nucleotides long.

VGR3262 precursor RNA folds spatially, forming VGR3262 folded precursor RNA, herein designated VGR FOLDED PRECURSOR RNA. It is appreciated that VGR3262 folded precursor RNA comprises a plurality of what is known in the art as 'hairpin' structures. These 'hairpin' structures are due to the fact that the nucleotide sequence of VGR3262 precursor RNA comprises a plurality of segments, the first half of each such segment having a nucleotide sequence which is at least a partial inversed-reversed sequence of the second half thereof, as is well known in the art.

VGR3262 folded precursor RNA is naturally processed by cellular enzymatic activity into at least 4 separate VGAM precursor RNAs, VGAM2599 precursor RNA, VGAM2600 precursor RNA, VGAM2601 precursor RNA and VGAM2602 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2599 RNA, VGAM2600 RNA, VGAM2601 RNA and VGAM2602 RNA, herein schematically represented by VGAM1 RNA through VGAM3 RNA, each of which VGAM RNAs corresponding to VGAM RNA of FIG. 1.

VGAM2599 RNA, herein schematically represented by VGAM1 RNA through VGAM3 RNA, binds complementarily to a host target binding site located in an untranslated region of VGAM2599 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2599 host target RNA into VGAM2599 host target protein, herein schematically represented by VGAM1 HOST TARGET PROTEIN through VGAM3 HOST TARGET PROTEIN, all of FIG. 1.

VGAM2600 RNA, herein schematically represented by VGAM1 RNA through VGAM3 RNA, binds complementarily to a host target binding site located in an untranslated region of VGAM2600 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2600 host target RNA into VGAM2600 host target protein, herein schematically represented by VGAM1 HOST TARGET PROTEIN through VGAM3 HOST TARGET PROTEIN, all of FIG. 1.

VGAM2601 RNA, herein schematically represented by VGAM1 RNA through VGAM3 RNA, binds complementarily to a host target binding site located in an untranslated region of VGAM2601 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2601 host target RNA into VGAM2601 host target protein, herein schematically represented by VGAM1 HOST TARGET PROTEIN through VGAM3 HOST TARGET PROTEIN, all of FIG. 1.

VGAM2602 RNA, herein schematically represented by VGAM1 RNA through VGAM3 RNA, binds complementarily to a host target binding site located in an untranslated region of VGAM2602 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2602 host target RNA into VGAM2602 host target protein, herein schematically represented by VGAM1 HOST TARGET PROTEIN through VGAM3 HOST TARGET PROTEIN, all of FIG. 1.

It is appreciated that a function of VGR3262 gene, herein designated VGR GENE, is inhibition of expression of host target genes, as part of a novel viral mechanism of attacking a host. Accordingly, utilities of VGR3262 gene include diagnosis, prevention and treatment of viral infection by Obuda Pepper Virus. Specific functions, and accordingly utilities, of VGR3262 gene correlate with, and may be deduced from, the identity of the host target genes, which are inhibited by VGAM RNAs comprised in the 'operon-like' cluster of VGR3262 gene: VGAM2599 host target protein, VGAM2600 host target protein, VGAM2601 host target protein and VGAM2602 host target protein, herein schematically represented by VGAM1 HOST TARGET PROTEIN through VGAM3 HOST TARGET PROTEIN. The function of these host target genes is elaborated hereinabove with reference to VGAM2599, VGAM2600, VGAM2601 and VGAM2602. FIG. 9 further provides a conceptual description of novel bioinformatically detected regulatory viral gene, referred to here as Viral Genomic Record 3263(VGR3263) viral gene, which encodes an 'operon-like' cluster of novel viral micro RNA-like genes, each of which in turn modulates expression of at least one host target gene, the function and utility of which at least one host target gene is known in the art.

VGR3263 gene, herein designated VGR GENE, is a novel bioinformatically detected regulatory, non protein coding, RNA viral gene. The method by which VGR3263 gene was detected is described hereinabove with reference to FIGS. 1-9.

VGR3263 gene encodes VGR3263 precursor RNA, herein designated VGR PRECURSOR RNA, an RNA molecule, typically several hundred nucleotides long.

VGR3263 precursor RNA folds spatially, forming VGR3263 folded precursor RNA, herein designated VGR FOLDED PRECURSOR RNA. It is appreciated that VGR3263 folded precursor RNA comprises a plurality of what is known in the art as 'hairpin' structures. These 'hairpin' structures are due to the fact that the nucleotide sequence of VGR3263 precursor RNA comprises a plurality of segments, the first half of each such segment having a nucleotide sequence which is at least a partial inversed-reversed sequence of the second half thereof, as is well known in the art.

VGR3263 folded precursor RNA is naturally processed by cellular enzymatic activity into at least 2 separate VGAM precursor RNAs, VGAM2603 precursor RNA and VGAM2604 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2603 RNA and VGAM2604 RNA, herein schematically represented by VGAM1 RNA through VGAM3 RNA, each of which VGAM RNAs corresponding to VGAM RNA of FIG. 1.

VGAM2603 RNA, herein schematically represented by VGAM1 RNA through VGAM3 RNA, binds complementarily to a host target binding site located in an untranslated region of VGAM2603 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2603 host target RNA into VGAM2603 host target protein, herein schematically represented by VGAM1 HOST TARGET PROTEIN through VGAM3 HOST TARGET PROTEIN, all of FIG. 1.

VGAM2604 RNA, herein schematically represented by VGAM1 RNA through VGAM3 RNA, binds complementarily to a host target binding site located in an untranslated region of VGAM2604 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2604 host target RNA into VGAM2604 host target protein, herein schematically represented by VGAM1 HOST TARGET PROTEIN through VGAM3 HOST TARGET PROTEIN, all of FIG. 1.

It is appreciated that a function of VGR3263 gene, herein designated VGR GENE, is inhibition of expression of host target genes, as part of a novel viral mechanism of attacking a host. Accordingly, utilities of VGR3263 gene include diagnosis, prevention and treatment of viral infection by Sugarcane Striate Mosaic Associated Virus. Specific functions, and accordingly utilities, of VGR3263 gene correlate with, and may be deduced from, the identity of the host target genes, which are inhibited by VGAM RNAs comprised in the 'operon-like' cluster of VGR3263 gene: VGAM2603 host target protein and VGAM2604 host target protein, herein schematically represented by VGAM1 HOST TARGET PROTEIN through VGAM3 HOST TARGET PROTEIN. The function of these host target genes is elaborated hereinabove with reference to VGAM2603 and VGAM2604. FIG. 9 further provides a conceptual description of novel bioinformatically detected regulatory viral gene, referred to here as Viral Genomic Record 3264(VGR3264) viral gene, which encodes an 'operon-like' cluster of novel viral micro RNA-like genes, each of which in turn modulates expression of at least one host target gene, the function and utility of which at least one host target gene is known in the art.

VGR3264 gene, herein designated VGR GENE, is a novel bioinformatically detected regulatory, non protein coding, RNA viral gene. The method by which VGR3264 gene was detected is described hereinabove with reference to FIGS. 1-9.

VGR3264 gene encodes VGR3264 precursor RNA, herein designated VGR PRECURSOR RNA, an RNA molecule, typically several hundred nucleotides long.

VGR3264 precursor RNA folds spatially, forming VGR3264 folded precursor RNA, herein designated VGR FOLDED PRECURSOR RNA. It is appreciated that VGR3264 folded precursor RNA comprises a plurality of what is known in the art as 'hairpin' structures. These 'hairpin' structures are due to the fact that the nucleotide sequence of VGR3264 precursor RNA comprises a plurality of segments, the first half of each such segment having a nucleotide sequence which is at least a partial inversed-reversed sequence of the second half thereof, as is well known in the art.

VGR3264 folded precursor RNA is naturally processed by cellular enzymatic activity into at least 2 separate VGAM precursor RNAs, VGAM2605 precursor RNA and VGAM2606 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2605 RNA and VGAM2606 RNA, herein schematically represented by VGAM1 RNA through VGAM3 RNA, each of which VGAM RNAs corresponding to VGAM RNA of FIG. 1.

VGAM2605 RNA, herein schematically represented by VGAM1 RNA through VGAM3 RNA, binds complementarily to a host target binding site located in an untranslated region of VGAM2605 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2605 host target RNA into VGAM2605 host target protein, herein schematically represented by VGAM1 HOST TARGET PROTEIN through VGAM3 HOST TARGET PROTEIN, all of FIG. 1.

VGAM2606 RNA, herein schematically represented by VGAM1 RNA through VGAM3 RNA, binds complementarily to a host target binding site located in an untranslated region of VGAM2606 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2606 host target RNA into VGAM2606 host target protein, herein schematically represented by VGAM1 HOST TARGET PROTEIN through VGAM3 HOST TARGET PROTEIN, all of FIG. 1.

It is appreciated that a function of VGR3264 gene, herein designated VGR GENE, is inhibition of expression of host target genes, as part of a novel viral mechanism of attacking a host. Accordingly, utilities of VGR3264 gene include diagnosis, prevention and treatment of viral infection by Salmon Pancreas Disease Virus. Specific functions, and accordingly utilities, of VGR3264 gene correlate with, and may be deduced from, the identity of the host target genes, which are inhibited by VGAM RNAs comprised in the 'operon-like' cluster of VGR3264 gene: VGAM2605 host target protein and VGAM2606 host target protein, herein schematically represented by VGAM1 HOST TARGET PROTEIN through VGAM3 HOST TARGET PROTEIN. The function of these host target genes is elaborated hereinabove with reference to VGAM2605 and VGAM2606. FIG. 9 further provides a conceptual description of novel bioinformatically detected regulatory viral gene, referred to here as Viral Genomic Record 3265(VGR3265) viral gene, which encodes an 'operon-like' cluster of novel viral micro RNA-like genes, each of which in turn modulates expression of at least one host target gene, the function and utility of which at least one host target gene is known in the art.

VGR3265 gene, herein designated VGR GENE, is a novel bioinformatically detected regulatory, non protein coding, RNA viral gene. The method by which VGR3265 gene was detected is described hereinabove with reference to FIGS. 1-9.

VGR3265 gene encodes VGR3265 precursor RNA, herein designated VGR PRECURSOR RNA, an RNA molecule, typically several hundred nucleotides long.

VGR3265 precursor RNA folds spatially, forming VGR3265 folded precursor RNA, herein designated VGR FOLDED PRECURSOR RNA. It is appreciated that VGR3265 folded precursor RNA comprises a plurality of what is known in the art as 'hairpin' structures. These 'hairpin' structures are due to the fact that the nucleotide sequence of VGR3265 precursor RNA comprises a plurality of segments, the first half of each such segment having a nucleotide sequence which is at least a partial inversed-reversed sequence of the second half thereof, as is well known in the art.

VGR3265 folded precursor RNA is naturally processed by cellular enzymatic activity into at least 4 separate VGAM precursor RNAs, VGAM2607 precursor RNA, VGAM2608 precursor RNA, VGAM2609 precursor RNA and VGAM2610 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2607 RNA, VGAM2608 RNA, VGAM2609 RNA and VGAM2610 RNA, herein schematically represented by VGAM1 RNA through VGAM3 RNA, each of which VGAM RNAs corresponding to VGAM RNA of FIG. 1.

VGAM2607 RNA, herein schematically represented by VGAM1 RNA through VGAM3 RNA, binds complementarily to a host target binding site located in an untranslated region of VGAM2607 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2607 host target RNA into VGAM2607 host target protein, herein schematically represented by VGAM1 HOST TARGET PROTEIN through VGAM3 HOST TARGET PROTEIN, all of FIG. 1.

VGAM2608 RNA, herein schematically represented by VGAM1 RNA through VGAM3 RNA, binds complementarily to a host target binding site located in an untranslated region of VGAM2608 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2608 host target RNA into VGAM2608 host target protein, herein schematically represented by VGAM1 HOST TARGET PROTEIN through VGAM3 HOST TARGET PROTEIN, all of FIG. 1.

VGAM2609 RNA, herein schematically represented by VGAM1 RNA through VGAM3 RNA, binds complementarily to a host target binding site located in an untranslated region of VGAM2609 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2609 host target RNA into VGAM2609 host target protein, herein schematically represented by VGAM1 HOST TARGET PROTEIN through VGAM3 HOST TARGET PROTEIN, all of FIG. 1.

VGAM2610 RNA, herein schematically represented by VGAM1 RNA through VGAM3 RNA, binds complementarily to a host target binding site located in an untranslated region of VGAM2610 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2610 host target RNA into VGAM2610 host target protein, herein schematically represented by VGAM1 HOST TARGET PROTEIN through VGAM3 HOST TARGET PROTEIN, all of FIG. 1.

It is appreciated that a function of VGR3265 gene, herein designated VGR GENE, is inhibition of expression of host target genes, as part of a novel viral mechanism of attacking a host. Accordingly, utilities of VGR3265 gene include diagnosis, prevention and treatment of viral infection by Ljungan Virus. Specific functions, and accordingly utilities, of VGR3265 gene correlate with, and may be deduced from, the identity of the host target genes, which are inhibited by VGAM RNAs comprised in the 'operon-like' cluster of VGR3265 gene: VGAM2607 host target protein, VGAM2608 host target protein, VGAM2609 host target protein and VGAM2610 host target protein, herein schematically represented by VGAM1 HOST TARGET PROTEIN through VGAM3 HOST TARGET PROTEIN. The function of these host target genes is elaborated hereinabove with reference to VGAM2607, VGAM2608, VGAM2609 and VGAM2610. FIG. 9 further provides a conceptual description of novel bioinformatically detected regulatory viral gene, referred to here as Viral Genomic Record 3266(VGR3266) viral gene, which encodes an 'operon-like' cluster of novel viral micro RNA-like genes, each of which in turn modulates expression of at least one host target gene, the function and utility of which at least one host target gene is known in the art.

VGR3266 gene, herein designated VGR GENE, is a novel bioinformatically detected regulatory, non protein coding, RNA viral gene. The method by which VGR3266 gene was detected is described hereinabove with reference to FIGS. 1-9.

VGR3266 gene encodes VGR3266 precursor RNA, herein designated VGR PRECURSOR RNA, an RNA molecule, typically several hundred nucleotides long.

VGR3266 precursor RNA folds spatially, forming VGR3266 folded precursor RNA, herein designated VGR FOLDED PRECURSOR RNA. It is appreciated that VGR3266 folded precursor RNA comprises a plurality of what is known in the art as 'hairpin' structures. These 'hairpin' structures are due to the fact that the nucleotide sequence of VGR3266 precursor RNA comprises a plurality of segments, the first half of each such segment having a nucleotide sequence which is at least a partial inversed-reversed sequence of the second half thereof, as is well known in the art.

VGR3266 folded precursor RNA is naturally processed by cellular enzymatic activity into at least 2 separate VGAM precursor RNAs, VGAM2611 precursor RNA and VGAM2612 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2611 RNA and VGAM2612 RNA, herein schematically represented by VGAM1 RNA through VGAM3 RNA, each of which VGAM RNAs corresponding to VGAM RNA of FIG. 1.

VGAM2611 RNA, herein schematically represented by VGAM1 RNA through VGAM3 RNA, binds complementarily to a host target binding site located in an untranslated region of VGAM2611 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2611 host target RNA into VGAM2611 host target protein, herein schematically represented by VGAM1 HOST TARGET PROTEIN through VGAM3 HOST TARGET PROTEIN, all of FIG. 1.

VGAM2612 RNA, herein schematically represented by VGAM1 RNA through VGAM3 RNA, binds complementarily to a host target binding site located in an untranslated region of VGAM2612 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2612 host target RNA into VGAM2612 host target protein, herein schematically represented by VGAM1 HOST TARGET PROTEIN through VGAM3 HOST TARGET PROTEIN, all of FIG. 1.

It is appreciated that a function of VGR3266 gene, herein designated VGR GENE, is inhibition of expression of host target genes, as part of a novel viral mechanism of attacking a host. Accordingly, utilities of VGR3266 gene include diagnosis, prevention and treatment of viral infection by Equine Rhinitis A Virus. Specific functions, and accordingly utilities, of VGR3266 gene correlate with, and may be deduced from, the identity of the host target genes, which are inhibited by VGAM RNAs comprised in the 'operon-like' cluster of VGR3266 gene: VGAM2611 host target protein and VGAM2612 host target protein, herein schematically represented by VGAM1 HOST TARGET PROTEIN through VGAM3 HOST TARGET PROTEIN. The function of these host target genes is elaborated hereinabove with reference to VGAM2611 and VGAM2612. FIG. 9 further provides a conceptual description of novel bioinformatically detected regulatory viral gene, referred to here as Viral Genomic Record 3267(VGR3267) viral gene, which encodes an 'operon-like' cluster of novel viral micro RNA-like genes, each of which in turn modulates expression of at least one host target gene, the function and utility of which at least one host target gene is known in the art.

VGR3267 gene, herein designated VGR GENE, is a novel bioinformatically detected regulatory, non protein coding, RNA viral gene. The method by which VGR3267 gene was detected is described hereinabove with reference to FIGS. 1-9.

VGR3267 gene encodes VGR3267 precursor RNA, herein designated VGR PRECURSOR RNA, an RNA molecule, typically several hundred nucleotides long.

VGR3267 precursor RNA folds spatially, forming VGR3267 folded precursor RNA, herein designated VGR FOLDED PRECURSOR RNA. It is appreciated that VGR3267 folded precursor RNA comprises a plurality of what is known in the art as 'hairpin' structures. These 'hairpin' structures are due to the fact that the nucleotide sequence of VGR3267 precursor RNA comprises a plurality of segments, the first half of each such segment having a nucleotide sequence which is at least a partial inversed-reversed sequence of the second half thereof, as is well known in the art.

VGR3267 folded precursor RNA is naturally processed by cellular enzymatic activity into at least 6 separate VGAM precursor RNAs, VGAM2614 precursor RNA, VGAM2615 precursor RNA, VGAM2616 precursor RNA, VGAM2617 precursor RNA, VGAM2618 precursor RNA and VGAM2619 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2614 RNA, VGAM2615 RNA, VGAM2616 RNA, VGAM2617 RNA, VGAM2618 RNA and VGAM2619 RNA, herein schematically represented by VGAM1 RNA through VGAM3 RNA, each of which VGAM RNAs corresponding to VGAM RNA of FIG. 1.

VGAM2614 RNA, herein schematically represented by VGAM1 RNA through VGAM3 RNA, binds complementarily to a host target binding site located in an untranslated region of VGAM2614 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2614 host target RNA into VGAM2614 host target protein, herein schematically represented by VGAM1 HOST TARGET PROTEIN through VGAM3 HOST TARGET PROTEIN, all of FIG. 1.

VGAM2615 RNA, herein schematically represented by VGAM1 RNA through VGAM3 RNA, binds complementarily to a host target binding site located in an untranslated region of VGAM2615 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2615 host target RNA into VGAM2615 host target protein, herein schematically represented by VGAM1 HOST TARGET PROTEIN through VGAM3 HOST TARGET PROTEIN, all of FIG. 1.

VGAM2616 RNA, herein schematically represented by VGAM1 RNA through VGAM3 RNA, binds complementarily to a host target binding site located in an untranslated region of VGAM2616 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2616 host target RNA into VGAM2616 host target protein, herein schematically represented by VGAM1 HOST TARGET PROTEIN through VGAM3 HOST TARGET PROTEIN, all of FIG. 1.

VGAM2617 RNA, herein schematically represented by VGAM1 RNA through VGAM3 RNA, binds complementarily to a host target binding site located in an untranslated region of VGAM2617 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2617 host target RNA into VGAM2617 host target protein, herein schematically represented by VGAM1 HOST TARGET PROTEIN through VGAM3 HOST TARGET PROTEIN, all of FIG. 1.

VGAM2618 RNA, herein schematically represented by VGAM1 RNA through VGAM3 RNA, binds complementarily to a host target binding site located in an untranslated region of VGAM2618 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2618 host target RNA into VGAM2618 host target protein, herein schematically represented by VGAM1 HOST TARGET PROTEIN through VGAM3 HOST TARGET PROTEIN, all of FIG. 1.

VGAM2619 RNA, herein schematically represented by VGAM1 RNA through VGAM3 RNA, binds complementarily to a host target binding site located in an untranslated region of VGAM2619 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2619 host target RNA into VGAM2619 host target protein, herein schematically represented by VGAM1 HOST TARGET PROTEIN through VGAM3 HOST TARGET PROTEIN, all of FIG. 1.

It is appreciated that a function of VGR3267 gene, herein designated VGR GENE, is inhibition of expression of host target genes, as part of a novel viral mechanism of attacking a host. Accordingly, utilities of VGR3267 gene include diagnosis, prevention and treatment of viral infection by Equine Rhinitis B Virus. Specific functions, and accordingly utilities, of VGR3267 gene correlate with, and may be deduced from, the identity of the host target genes, which are inhibited by VGAM RNAs comprised in the 'operon-like' cluster of VGR3267 gene: VGAM2614 host target protein, VGAM2615 host target protein, VGAM2616 host target protein, VGAM2617 host target protein, VGAM2618 host target protein and VGAM2619 host target protein, herein schematically represented by VGAM1 HOST TARGET PROTEIN through VGAM3 HOST TARGET PROTEIN. The function of these host target genes is elaborated hereinabove with reference to VGAM2614, VGAM2615, VGAM2616, VGAM2617, VGAM2618 and VGAM2619. FIG. 9 further provides a conceptual description of novel bioinformatically detected regulatory viral gene, referred to here as Viral Genomic Record 3268(VGR3268) viral gene, which encodes an 'operon-like' cluster of novel viral micro RNA-like genes, each of which in turn modulates expression of at least one host target gene, the function and utility of which at least one host target gene is known in the art.

VGR3268 gene, herein designated VGR GENE, is a novel bioinformatically detected regulatory, non protein coding, RNA viral gene. The method by which VGR3268 gene was detected is described hereinabove with reference to FIGS. 1-9.

VGR3268 gene encodes VGR3268 precursor RNA, herein designated VGR PRECURSOR RNA, an RNA molecule, typically several hundred nucleotides long.

VGR3268 precursor RNA folds spatially, forming VGR3268 folded precursor RNA, herein designated VGR FOLDED PRECURSOR RNA. It is appreciated that VGR3268 folded precursor RNA comprises a plurality of what is known in the art as 'hairpin' structures. These 'hairpin' structures are due to the fact that the nucleotide sequence of VGR3268 precursor RNA comprises a plurality of segments, the first half of each such segment having a nucleotide sequence which is at least a partial inversed-reversed sequence of the second half thereof, as is well known in the art.

VGR3268 folded precursor RNA is naturally processed by cellular enzymatic activity into at least 3 separate VGAM precursor RNAs, VGAM2620 precursor RNA, VGAM2621 precursor RNA and VGAM2622 precursor RNA, herein schematically represented by VGAM1 FOLDED PRECUR- SOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2620 RNA, VGAM2621 RNA and VGAM2622 RNA, herein schematically represented by VGAM1 RNA through VGAM3 RNA, each of which VGAM RNAs corresponding to VGAM RNA of FIG. 1.

VGAM2620 RNA, herein schematically represented by VGAM1 RNA through VGAM3 RNA, binds complementarily to a host target binding site located in an untranslated region of VGAM2620 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2620 host target RNA into VGAM2620 host target protein, herein schematically represented by VGAM1 HOST TARGET PROTEIN through VGAM3 HOST TARGET PROTEIN, all of FIG. 1.

VGAM2621 RNA, herein schematically represented by VGAM1 RNA through VGAM3 RNA, binds complementarily to a host target binding site located in an untranslated region of VGAM2621 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2621 host target RNA into VGAM2621 host target protein, herein schematically represented by VGAM1 HOST TARGET PROTEIN through VGAM3 HOST TARGET PROTEIN, all of FIG. 1.

VGAM2622 RNA, herein schematically represented by VGAM1 RNA through VGAM3 RNA, binds complementarily to a host target binding site located in an untranslated region of VGAM2622 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2622 host target RNA into VGAM2622 host target protein, herein schematically represented by VGAM1 HOST TARGET PROTEIN through VGAM3 HOST TARGET PROTEIN, all of FIG. 1.

It is appreciated that a function of VGR3268 gene, herein designated VGR GENE, is inhibition of expression of host target genes, as part of a novel viral mechanism of attacking a host. Accordingly, utilities of VGR3268 gene include diagnosis, prevention and treatment of viral infection by Porcine Enterovirus A (PEV8). Specific functions, and accordingly utilities, of VGR3268 gene correlate with, and may be deduced from, the identity of the host target genes, which are inhibited by VGAM RNAs comprised in the 'operon-like' cluster of VGR3268 gene: VGAM2620 host target protein, VGAM2621 host target protein and VGAM2622 host target protein, herein schematically represented by VGAM1 HOST TARGET PROTEIN through VGAM3 HOST TARGET PROTEIN. The function of these host target genes is elaborated hereinabove with reference to VGAM2620, VGAM2621 and VGAM2622. FIG. 9 further provides a conceptual description of novel bioinformatically detected regulatory viral gene, referred to here as Viral Genomic Record 3269(VGR3269) viral gene, which encodes an 'operon-like' cluster of novel viral micro RNA-like genes, each of which in turn modulates expression of at least one host target gene, the function and utility of which at least one host target gene is known in the art.

VGR3269 gene, herein designated VGR GENE, is a novel bioinformatically detected regulatory, non protein coding, RNA viral gene. The method by which VGR3269 gene was detected is described hereinabove with reference to FIGS. 1-9.

VGR3269 gene encodes VGR3269 precursor RNA, herein designated VGR PRECURSOR RNA, an RNA molecule, typically several hundred nucleotides long.

VGR3269 precursor RNA folds spatially, forming VGR3269 folded precursor RNA, herein designated VGR FOLDED PRECURSOR RNA. It is appreciated that VGR3269 folded precursor RNA comprises a plurality of what is known in the art as 'hairpin' structures. These 'hairpin' structures are due to the fact that the nucleotide sequence of VGR3269 precursor RNA comprises a plurality of segments, the first half of each such segment having a nucleotide sequence which is at least a partial inversed-reversed sequence of the second half thereof, as is well known in the art.

VGR3269 folded precursor RNA is naturally processed by cellular enzymatic activity into at least 3 separate VGAM precursor RNAs, VGAM2623 precursor RNA, VGAM2624 precursor RNA and VGAM2625 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2623 RNA, VGAM2624 RNA and VGAM2625 RNA, herein schematically represented by VGAM1 RNA through VGAM3 RNA, each of which VGAM RNAs corresponding to VGAM RNA of FIG. 1.

VGAM2623 RNA, herein schematically represented by VGAM1 RNA through VGAM3 RNA, binds complementarily to a host target binding site located in an untranslated region of VGAM2623 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2623 host target RNA into VGAM2623 host target protein, herein schematically represented by VGAM1 HOST TARGET PROTEIN through VGAM3 HOST TARGET PROTEIN, all of FIG. 1.

VGAM2624 RNA, herein schematically represented by VGAM1 RNA through VGAM3 RNA, binds complementarily to a host target binding site located in an untranslated region of VGAM2624 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2624 host target RNA into VGAM2624 host target protein, herein schematically represented by VGAM1 HOST TARGET PROTEIN through VGAM3 HOST TARGET PROTEIN, all of FIG. 1.

VGAM2625 RNA, herein schematically represented by VGAM1 RNA through VGAM3 RNA, binds complementarily to a host target binding site located in an untranslated region of VGAM2625 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2625 host target RNA into VGAM2625 host target protein, herein schematically represented by VGAM1 HOST TARGET PROTEIN through VGAM3 HOST TARGET PROTEIN, all of FIG. 1.

It is appreciated that a function of VGR3269 gene, herein designated VGR GENE, is inhibition of expression of host target genes, as part of a novel viral mechanism of attacking a host. Accordingly, utilities of VGR3269 gene include diagnosis, prevention and treatment of viral infection by A-2 Plaque Virus. Specific functions, and accordingly utilities, of VGR3269 gene correlate with, and may be deduced from, the identity of the host target genes, which are inhibited by VGAM RNAs comprised in the 'operon-like' cluster of VGR3269 gene: VGAM2623 host target protein, VGAM2624 host target protein and VGAM2625 host target protein, herein schematically represented by VGAM1 HOST TARGET PROTEIN through VGAM3 HOST TARGET PROTEIN. The function of these host target genes is elaborated hereinabove with reference to VGAM2623, VGAM2624 and VGAM2625. FIG. 9 further provides a conceptual description of novel bioinformatically detected regulatory viral gene, referred to here as Viral Genomic Record 3270(VGR3270) viral gene, which encodes an 'operon-like' cluster of novel viral micro RNA-like genes, each of which in turn modulates expression of at least one host target gene, the function and utility of which at least one host target gene is known in the art.

VGR3270 gene, herein designated VGR GENE, is a novel bioinformatically detected regulatory, non protein coding, RNA viral gene. The method by which VGR3270 gene was detected is described hereinabove with reference to FIGS. 1-9.

VGR3270 gene encodes VGR3270 precursor RNA, herein designated VGR PRECURSOR RNA, an RNA molecule, typically several hundred nucleotides long.

VGR3270 precursor RNA folds spatially, forming VGR3270 folded precursor RNA, herein designated VGR FOLDED PRECURSOR RNA. It is appreciated that VGR3270 folded precursor RNA comprises a plurality of what is known in the art as 'hairpin' structures. These 'hairpin' structures are due to the fact that the nucleotide sequence of VGR3270 precursor RNA comprises a plurality of segments, the first half of each such segment having a nucleotide sequence which is at least a partial inversed-reversed sequence of the second half thereof, as is well known in the art.

VGR3270 folded precursor RNA is naturally processed by cellular enzymatic activity into at least 4 separate VGAM precursor RNAs, VGAM2626 precursor RNA, VGAM2627 precursor RNA, VGAM2628 precursor RNA and VGAM2629 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2626 RNA, VGAM2627 RNA, VGAM2628 RNA and VGAM2629 RNA, herein schematically represented by VGAM1 RNA through VGAM3 RNA, each of which VGAM RNAs corresponding to VGAM RNA of FIG. 1.

VGAM2626 RNA, herein schematically represented by VGAM1 RNA through VGAM3 RNA, binds complementarily to a host target binding site located in an untranslated region of VGAM2626 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2626 host target RNA into VGAM2626 host target protein, herein schematically represented by VGAM1 HOST TARGET PROTEIN through VGAM3 HOST TARGET PROTEIN, all of FIG. 1.

VGAM2627 RNA, herein schematically represented by VGAM1 RNA through VGAM3 RNA, binds complementarily to a host target binding site located in an untranslated region of VGAM2627 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2627 host target RNA into VGAM2627 host target protein, herein schematically represented by VGAM1 HOST TARGET PROTEIN through VGAM3 HOST TARGET PROTEIN, all of FIG. 1.

VGAM2628 RNA, herein schematically represented by VGAM1 RNA through VGAM3 RNA, binds complementarily to a host target binding site located in an untranslated region of VGAM2628 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2628 host target RNA into VGAM2628 host target protein, herein schematically represented by VGAM1 HOST TARGET PROTEIN through VGAM3 HOST TARGET PROTEIN, all of FIG. 1.

VGAM2629 RNA, herein schematically represented by VGAM1 RNA through VGAM3 RNA, binds complementarily to a host target binding site located in an untranslated region of VGAM2629 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2629 host target RNA into VGAM2629 host target protein, herein schematically represented by VGAM1 HOST TARGET PROTEIN through VGAM3 HOST TARGET PROTEIN, all of FIG. 1.

It is appreciated that a function of VGR3270 gene, herein designated VGR GENE, is inhibition of expression of host target genes, as part of a novel viral mechanism of attacking a host. Accordingly, utilities of VGR3270 gene include diagnosis, prevention and treatment of viral infection by Avian Encephalomyelitis Virus. Specific functions, and accordingly utilities, of VGR3270 gene correlate with, and may be deduced from, the identity of the host target genes, which are inhibited by VGAM RNAs comprised in the 'operon-like' cluster of VGR3270 gene: VGAM2626 host target protein, VGAM2627 host target protein, VGAM2628 host target protein and VGAM2629 host target protein, herein schematically represented by VGAM1 HOST TARGET PROTEIN through VGAM3 HOST TARGET PROTEIN. The function of these host target genes is elaborated hereinabove with reference to VGAM2626, VGAM2627, VGAM2628 and VGAM2629. FIG. 9 further provides a conceptual description of novel bioinformatically detected regulatory viral gene, referred to here as Viral Genomic Record 3271(VGR3271) viral gene, which encodes an 'operon-like' cluster of novel viral micro RNA-like genes, each of which in turn modulates expression of at least one host target gene, the function and utility of which at least one host target gene is known in the art.

VGR3271 gene, herein designated VGR GENE, is a novel bioinformatically detected regulatory, non protein coding, RNA viral gene. The method by which VGR3271 gene was detected is described hereinabove with reference to FIGS. 1-9.

VGR3271 gene encodes VGR3271 precursor RNA, herein designated VGR PRECURSOR RNA, an RNA molecule, typically several hundred nucleotides long.

VGR3271 precursor RNA folds spatially, forming VGR3271 folded precursor RNA, herein designated VGR FOLDED PRECURSOR RNA. It is appreciated that VGR3271 folded precursor RNA comprises a plurality of what is known in the art as 'hairpin' structures. These 'hairpin' structures are due to the fact that the nucleotide sequence of VGR3271 precursor RNA comprises a plurality of segments, the first half of each such segment having a nucleotide sequence which is at least a partial inversed-reversed sequence of the second half thereof, as is well known in the art.

VGR3271 folded precursor RNA is naturally processed by cellular enzymatic activity into at least 6 separate VGAM precursor RNAs, VGAM2630 precursor RNA, VGAM2631 precursor RNA, VGAM2632 precursor RNA, VGAM2633 precursor RNA, VGAM2634 precursor RNA and VGAM2635 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2630 RNA, VGAM2631 RNA, VGAM2632 RNA, VGAM2633 RNA, VGAM2634 RNA and VGAM2635 RNA, herein schematically represented by VGAM1 RNA through VGAM3 RNA, each of which VGAM RNAs corresponding to VGAM RNA of FIG. 1.

VGAM2630 RNA, herein schematically represented by VGAM1 RNA through VGAM3 RNA, binds complementarily to a host target binding site located in an untranslated region of VGAM2630 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2630 host target RNA into VGAM2630 host target protein, herein schematically represented by VGAM1 HOST TARGET PROTEIN through VGAM3 HOST TARGET PROTEIN, all of FIG. 1.

VGAM2631 RNA, herein schematically represented by VGAM1 RNA through VGAM3 RNA, binds complementarily to a host target binding site located in an untranslated region of VGAM2631 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2631 host target RNA into VGAM2631 host target protein, herein schematically represented by VGAM1 HOST TARGET PROTEIN through VGAM3 HOST TARGET PROTEIN, all of FIG. 1.

VGAM2632 RNA, herein schematically represented by VGAM1 RNA through VGAM3 RNA, binds complementarily to a host target binding site located in an untranslated region of VGAM2632 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2632 host target RNA into VGAM2632 host target protein, herein schematically represented by VGAM1 HOST TARGET PROTEIN through VGAM3 HOST TARGET PROTEIN, all of FIG. 1.

VGAM2633 RNA, herein schematically represented by VGAM1 RNA through VGAM3 RNA, binds complementarily to a host target binding site located in an untranslated region of VGAM2633 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2633 host target RNA into VGAM2633 host target protein, herein schematically represented by VGAM1 HOST TARGET PROTEIN through VGAM3 HOST TARGET PROTEIN, all of FIG. 1.

VGAM2634 RNA, herein schematically represented by VGAM1 RNA through VGAM3 RNA, binds complementarily to a host target binding site located in an untranslated region of VGAM2634 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2634 host target RNA into VGAM2634 host target protein, herein schematically represented by VGAM1 HOST TARGET PROTEIN through VGAM3 HOST TARGET PROTEIN, all of FIG. 1.

VGAM2635 RNA, herein schematically represented by VGAM1 RNA through VGAM3 RNA, binds complementarily to a host target binding site located in an untranslated region of VGAM2635 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2635 host target RNA into VGAM2635 host target protein, herein schematically represented by VGAM1 HOST TARGET PROTEIN through VGAM3 HOST TARGET PROTEIN, all of FIG. 1.

It is appreciated that a function of VGR3271 gene, herein designated VGR GENE, is inhibition of expression of host target genes, as part of a novel viral mechanism of attacking a host. Accordingly, utilities of VGR3271 gene include diagnosis, prevention and treatment of viral infection by Tamana Bat Virus. Specific functions, and accordingly utilities, of VGR3271 gene correlate with, and may be deduced from, the identity of the host target genes, which are inhibited by VGAM RNAs comprised in the 'operon-like' cluster of VGR3271 gene: VGAM2630 host target protein, VGAM2631 host target protein, VGAM2632 host target protein, VGAM2633 host target protein, VGAM2634 host target protein and VGAM2635 host target protein, herein schematically represented by VGAM1 HOST TARGET PROTEIN through VGAM3 HOST TARGET PROTEIN. The function of these host target genes is elaborated hereinabove with reference to VGAM2630, VGAM2631, VGAM2632, VGAM2633, VGAM2634 and VGAM2635. FIG. 9 further provides a conceptual description of novel bioinformatically detected regulatory viral gene, referred to here as Viral Genomic Record 3272(VGR3272) viral gene, which encodes an 'operon-like' cluster of novel viral micro RNA-like genes, each of which in turn modulates expression of at least one host target gene, the function and utility of which at least one host target gene is known in the art.

VGR3272 gene, herein designated VGR GENE, is a novel bioinformatically detected regulatory, non protein coding, RNA viral gene. The method by which VGR3272 gene was detected is described hereinabove with reference to FIGS. 1-9.

VGR3272 gene encodes VGR3272 precursor RNA, herein designated VGR PRECURSOR RNA, an RNA molecule, typically several hundred nucleotides long.

VGR3272 precursor RNA folds spatially, forming VGR3272 folded precursor RNA, herein designated VGR FOLDED PRECURSOR RNA. It is appreciated that VGR3272 folded precursor RNA comprises a plurality of what is known in the art as 'hairpin' structures. These 'hairpin' structures are due to the fact that the nucleotide sequence of VGR3272 precursor RNA comprises a plurality of segments, the first half of each such segment having a nucleotide sequence which is at least a partial inversed-reversed sequence of the second half thereof, as is well known in the art.

VGR3272 folded precursor RNA is naturally processed by cellular enzymatic activity into at least 2 separate VGAM precursor RNAs, VGAM2636 precursor RNA and VGAM2637 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2636 RNA and VGAM2637 RNA, herein schematically represented by VGAM1 RNA through VGAM3 RNA, each of which VGAM RNAs corresponding to VGAM RNA of FIG. 1.

VGAM2636 RNA, herein schematically represented by VGAM1 RNA through VGAM3 RNA, binds complementarily to a host target binding site located in an untranslated region of VGAM2636 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2636 host target RNA into VGAM2636 host target protein, herein schematically represented by VGAM1 HOST TARGET PROTEIN through VGAM3 HOST TARGET PROTEIN, all of FIG. 1.

VGAM2637 RNA, herein schematically represented by VGAM1 RNA through VGAM3 RNA, binds complementarily to a host target binding site located in an untranslated region of VGAM2637 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2637 host target RNA into VGAM2637 host target protein, herein schematically represented by VGAM1 HOST TARGET PROTEIN through VGAM3 HOST TARGET PROTEIN, all of FIG. 1.

It is appreciated that a function of VGR3272 gene, herein designated VGR GENE, is inhibition of expression of host target genes, as part of a novel viral mechanism of attacking a host. Accordingly, utilities of VGR3272 gene include diagnosis, prevention and treatment of viral infection by Sheeppox Virus. Specific functions, and accordingly utilities, of VGR3272 gene correlate with, and may be deduced from, the identity of the host target genes, which are inhibited by VGAM RNAs comprised in the 'operon-like' cluster of VGR3272 gene: VGAM2636 host target protein and VGAM2637 host target protein, herein schematically represented by VGAM1 HOST TARGET PROTEIN through VGAM3 HOST TARGET PROTEIN. The function of these host target genes is elaborated hereinabove with reference to VGAM2636 and VGAM2637. FIG. 9 further provides a conceptual description of novel bioinformatically detected regulatory viral gene, referred to here as Viral Genomic Record 3273(VGR3273) viral gene, which encodes an 'operon-like' cluster of novel viral micro RNA-like genes, each of which in turn modulates expression of at least one host target gene, the function and utility of which at least one host target gene is known in the art.

VGR3273 gene, herein designated VGR GENE, is a novel bioinformatically detected regulatory, non protein coding, RNA viral gene. The method by which VGR3273 gene was detected is described hereinabove with reference to FIGS. 1-9.

VGR3273 gene encodes VGR3273 precursor RNA, herein designated VGR PRECURSOR RNA, an RNA molecule, typically several hundred nucleotides long.

VGR3273 precursor RNA folds spatially, forming VGR3273 folded precursor RNA, herein designated VGR FOLDED PRECURSOR RNA. It is appreciated that VGR3273 folded precursor RNA comprises a plurality of what is known in the art as 'hairpin' structures. These 'hairpin' structures are due to the fact that the nucleotide sequence of VGR3273 precursor RNA comprises a plurality of segments, the first half of each such segment having a nucleotide sequence which is at least a partial inversed-reversed sequence of the second half thereof, as is well known in the art.

VGR3273 folded precursor RNA is naturally processed by cellular enzymatic activity into at least 5 separate VGAM precursor RNAs, VGAM2638 precursor RNA, VGAM2639 precursor RNA, VGAM2640 precursor RNA, VGAM2641 precursor RNA and VGAM2642 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2638 RNA, VGAM2639 RNA, VGAM2640 RNA, VGAM2641 RNA and VGAM2642 RNA, herein schematically represented by VGAM1 RNA through VGAM3 RNA, each of which VGAM RNAs corresponding to VGAM RNA of FIG. 1.

VGAM2638 RNA, herein schematically represented by VGAM1 RNA through VGAM3 RNA, binds complementarily to a host target binding site located in an untranslated region of VGAM2638 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2638 host target RNA into VGAM2638 host target protein, herein schematically represented by VGAM1 HOST TARGET PROTEIN through VGAM3 HOST TARGET PROTEIN, all of FIG. 1.

VGAM2639 RNA, herein schematically represented by VGAM1 RNA through VGAM3 RNA, binds complementarily to a host target binding site located in an untranslated region of VGAM2639 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2639 host target RNA into VGAM2639 host target protein, herein schematically represented by VGAM1 HOST TARGET PROTEIN through VGAM3 HOST TARGET PROTEIN, all of FIG. 1.

VGAM2640 RNA, herein schematically represented by VGAM1 RNA through VGAM3 RNA, binds complementarily to a host target binding site located in an untranslated region of VGAM2640 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2640 host target RNA into VGAM2640 host target protein, herein schematically represented by VGAM1 HOST TARGET PROTEIN through VGAM3 HOST TARGET PROTEIN, all of FIG. 1.

VGAM2641 RNA, herein schematically represented by VGAM1 RNA through VGAM3 RNA, binds complementarily to a host target binding site located in an untranslated region of VGAM2641 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2641 host target RNA into VGAM2641 host target protein, herein schematically represented by VGAM1 HOST TARGET PROTEIN through VGAM3 HOST TARGET PROTEIN, all of FIG. 1.

VGAM2642 RNA, herein schematically represented by VGAM1 RNA through VGAM3 RNA, binds complementarily to a host target binding site located in an untranslated region of VGAM2642 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2642 host target RNA into VGAM2642 host target protein, herein schematically represented by VGAM1 HOST TARGET PROTEIN through VGAM3 HOST TARGET PROTEIN, all of FIG. 1.

It is appreciated that a function of VGR3273 gene, herein designated VGR GENE, is inhibition of expression of host target genes, as part of a novel viral mechanism of attacking a host. Accordingly, utilities of VGR3273 gene include diagnosis, prevention and treatment of viral infection by Foot-and-mouth Disease Virus O. Specific functions, and accordingly utilities, of VGR3273 gene correlate with, and may be deduced from, the identity of the host target genes, which are inhibited by VGAM RNAs comprised in the 'operon-like' cluster of VGR3273 gene: VGAM2638 host target protein, VGAM2639 host target protein, VGAM2640 host target protein, VGAM2641 host target protein and VGAM2642 host target protein, herein schematically represented by VGAM1 HOST TARGET PROTEIN through VGAM3 HOST TARGET PROTEIN. The function of these host target genes is elaborated hereinabove with reference to VGAM2638, VGAM2639, VGAM2640, VGAM2641 and VGAM2642.

FIG. 9 further provides a conceptual description of novel bioinformatically detected regulatory viral gene, referred to here as Viral Genomic Record 3274(VGR3274) viral gene, which encodes an 'operon-like' cluster of novel viral micro RNA-like genes, each of which in turn modulates expression of at least one host target gene, the function and utility of which at least one host target gene is known in the art.

VGR3274 gene, herein designated VGR GENE, is a novel bioinformatically detected regulatory, non protein coding, RNA viral gene. The method by which VGR3274 gene was detected is described hereinabove with reference to FIGS. 1-9.

VGR3274 gene encodes VGR3274 precursor RNA, herein designated VGR PRECURSOR RNA, an RNA molecule, typically several hundred nucleotides long.

VGR3274 precursor RNA folds spatially, forming VGR3274 folded precursor RNA, herein designated VGR FOLDED PRECURSOR RNA. It is appreciated that VGR3274 folded precursor RNA comprises a plurality of what is known in the art as 'hairpin' structures. These 'hairpin' structures are due to the fact that the nucleotide sequence of VGR3274 precursor RNA comprises a plurality of segments, the first half of each such segment having a nucleotide sequence which is at least a partial inversed-reversed sequence of the second half thereof, as is well known in the art.

VGR3274 folded precursor RNA is naturally processed by cellular enzymatic activity into at least 7 separate VGAM precursor RNAs, VGAM2643 precursor RNA, VGAM2644 precursor RNA, VGAM2645 precursor RNA, VGAM2646 precursor RNA, VGAM2647 precursor RNA, VGAM2648 precursor RNA and VGAM2649 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2643 RNA, VGAM2644 RNA, VGAM2645 RNA, VGAM2646 RNA, VGAM2647 RNA, VGAM2648 RNA and VGAM2649 RNA, herein schematically represented by VGAM1 RNA through VGAM3 RNA, each of which VGAM RNAs corresponding to VGAM RNA of FIG. 1.

VGAM2643 RNA, herein schematically represented by VGAM1 RNA through VGAM3 RNA, binds complementarily to a host target binding site located in an untranslated region of VGAM2643 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2643 host target RNA into VGAM2643 host target protein, herein schematically represented by VGAM1 HOST TARGET PROTEIN through VGAM3 HOST TARGET PROTEIN, all of FIG. 1.

VGAM2644 RNA, herein schematically represented by VGAM1 RNA through VGAM3 RNA, binds complementarily to a host target binding site located in an untranslated region of VGAM2644 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2644 host target RNA into VGAM2644 host target protein, herein schematically represented by VGAM1 HOST TARGET PROTEIN through VGAM3 HOST TARGET PROTEIN, all of FIG. 1.

VGAM2645 RNA, herein schematically represented by VGAM1 RNA through VGAM3 RNA, binds complementarily to a host target binding site located in an untranslated region of VGAM2645 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2645 host target RNA into VGAM2645 host target protein, herein schematically represented by VGAM1 HOST TARGET PROTEIN through VGAM3 HOST TARGET PROTEIN, all of FIG. 1.

VGAM2646 RNA, herein schematically represented by VGAM1 RNA through VGAM3 RNA, binds complementarily to a host target binding site located in an untranslated region of VGAM2646 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2646 host target RNA into VGAM2646 host target protein, herein schematically represented by VGAM1 HOST TARGET PROTEIN through VGAM3 HOST TARGET PROTEIN, all of FIG. 1.

VGAM2647 RNA, herein schematically represented by VGAM1 RNA through VGAM3 RNA, binds complementarily to a host target binding site located in an untranslated region of VGAM2647 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2647 host target RNA into VGAM2647 host target protein, herein schematically represented by VGAM1 HOST TARGET PROTEIN through VGAM3 HOST TARGET PROTEIN, all of FIG. 1.

VGAM2648 RNA, herein schematically represented by VGAM1 RNA through VGAM3 RNA, binds complementarily to a host target binding site located in an untranslated region of VGAM2648 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2648 host target RNA into VGAM2648 host target protein, herein schematically represented by VGAM1 HOST TARGET PROTEIN through VGAM3 HOST TARGET PROTEIN, all of FIG. 1.

VGAM2649 RNA, herein schematically represented by VGAM1 RNA through VGAM3 RNA, binds complementarily to a host target binding site located in an untranslated region of VGAM2649 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2649 host target RNA into VGAM2649 host target protein, herein schematically represented by VGAM1 HOST TARGET PROTEIN through VGAM3 HOST TARGET PROTEIN, all of FIG. 1.

It is appreciated that a function of VGR3274 gene, herein designated VGR GENE, is inhibition of expression of host target genes, as part of a novel viral mechanism of attacking a host. Accordingly, utilities of VGR3274 gene include diagnosis, prevention and treatment of viral infection by Cowpea Aphid-borne Mosaic Virus. Specific functions, and accordingly utilities, of VGR3274 gene correlate with, and may be deduced from, the identity of the host target genes, which are inhibited by VGAM RNAs comprised in the 'operon-like' cluster of VGR3274 gene: VGAM2643 host target protein, VGAM2644 host target protein, VGAM2645 host target protein, VGAM2646 host target protein, VGAM2647 host target protein, VGAM2648 host target protein and VGAM2649 host target protein, herein schematically represented by VGAM1 HOST TARGET PROTEIN through VGAM3 HOST TARGET PROTEIN. The function of these host target genes is elaborated hereinabove with reference to VGAM2643, VGAM2644, VGAM2645, VGAM2646, VGAM2647, VGAM2648 and VGAM2649. FIG. 9 further provides a conceptual description of novel bioinformatically detected regulatory viral gene, referred to here as Viral Genomic Record 3275(VGR3275) viral gene, which encodes an 'operon-like' cluster of novel viral micro RNA-like genes, each of which in turn modulates expression of at least one host target gene, the function and utility of which at least one host target gene is known in the art.

VGR3275 gene, herein designated VGR GENE, is a novel bioinformatically detected regulatory, non protein coding, RNA viral gene. The method by which VGR3275 gene was detected is described hereinabove with reference to FIGS. 1-9.

VGR3275 gene encodes VGR3275 precursor RNA, herein designated VGR PRECURSOR RNA, an RNA molecule, typically several hundred nucleotides long.

VGR3275 precursor RNA folds spatially, forming VGR3275 folded precursor RNA, herein designated VGR FOLDED PRECURSOR RNA. It is appreciated that VGR3275 folded precursor RNA comprises a plurality of what is known in the art as 'hairpin' structures. These 'hairpin' structures are due to the fact that the nucleotide sequence of VGR3275 precursor RNA comprises a plurality of segments, the first half of each such segment having a nucleotide sequence which is at least a partial inversed-reversed sequence of the second half thereof, as is well known in the art.

VGR3275 folded precursor RNA is naturally processed by cellular enzymatic activity into at least 2 separate VGAM precursor RNAs, VGAM2650 precursor RNA and VGAM2651 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2650 RNA and VGAM2651 RNA, herein schematically represented by VGAM1 RNA through VGAM3 RNA, each of which VGAM RNAs corresponding to VGAM RNA of FIG. 1.

VGAM2650 RNA, herein schematically represented by VGAM1 RNA through VGAM3 RNA, binds complementarily to a host target binding site located in an untranslated region of VGAM2650 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2650 host target RNA into VGAM2650 host target protein, herein schematically represented by VGAM1 HOST TARGET PROTEIN through VGAM3 HOST TARGET PROTEIN, all of FIG. 1.

VGAM2651 RNA, herein schematically represented by VGAM1 RNA through VGAM3 RNA, binds complementarily to a host target binding site located in an untranslated region of VGAM2651 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2651 host target RNA into VGAM2651 host target protein, herein schematically represented by VGAM1 HOST TARGET PROTEIN through VGAM3 HOST TARGET PROTEIN, all of FIG. 1.

It is appreciated that a function of VGR3275 gene, herein designated VGR GENE, is inhibition of expression of host target genes, as part of a novel viral mechanism of attacking a host. Accordingly, utilities of VGR3275 gene include diagnosis, prevention and treatment of viral infection by Trichomonas Vaginalis Virus 3. Specific functions, and accordingly utilities, of VGR3275 gene correlate with, and may be deduced from, the identity of the host target genes, which are inhibited by VGAM RNAs comprised in the 'operon-like' cluster of VGR3275 gene: VGAM2650 host target protein and VGAM2651 host target protein, herein schematically represented by VGAM1 HOST TARGET PROTEIN through VGAM3 HOST TARGET PROTEIN. The function of these host target genes is elaborated hereinabove with reference to VGAM2650 and VGAM2651. FIG. 9 further provides a conceptual description of novel bioinformatically detected regulatory viral gene, referred to here as Viral Genomic Record 3276(VGR3276) viral gene, which encodes an 'operon-like' cluster of novel viral micro RNA-like genes, each of which in turn modulates expression of at least one host target gene, the function and utility of which at least one host target gene is known in the art.

VGR3276 gene, herein designated VGR GENE, is a novel bioinformatically detected regulatory, non protein coding, RNA viral gene. The method by which VGR3276 gene was detected is described hereinabove with reference to FIGS. 1-9.

VGR3276 gene encodes VGR3276 precursor RNA, herein designated VGR PRECURSOR RNA, an RNA molecule, typically several hundred nucleotides long.

VGR3276 precursor RNA folds spatially, forming VGR3276 folded precursor RNA, herein designated VGR FOLDED PRECURSOR RNA. It is appreciated that VGR3276 folded precursor RNA comprises a plurality of what is known in the art as 'hairpin' structures. These 'hairpin' structures are due to the fact that the nucleotide sequence of VGR3276 precursor RNA comprises a plurality of segments, the first half of each such segment having a nucleotide sequence which is at least a partial inversed-reversed sequence of the second half thereof, as is well known in the art.

VGR3276 folded precursor RNA is naturally processed by cellular enzymatic activity into at least 4 separate VGAM precursor RNAs, VGAM2652 precursor RNA, VGAM2653 precursor RNA, VGAM2654 precursor RNA and VGAM2655 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2652 RNA, VGAM2653 RNA, VGAM2654 RNA and VGAM2655 RNA, herein schematically represented by VGAM1 RNA through VGAM3 RNA, each of which VGAM RNAs corresponding to VGAM RNA of FIG. 1.

VGAM2652 RNA, herein schematically represented by VGAM1 RNA through VGAM3 RNA, binds complementarily to a host target binding site located in an untranslated region of VGAM2652 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2652 host target RNA into VGAM2652 host target protein, herein schematically represented by VGAM1 HOST TARGET PROTEIN through VGAM3 HOST TARGET PROTEIN, all of FIG. 1.

VGAM2653 RNA, herein schematically represented by VGAM1 RNA through VGAM3 RNA, binds complementarily to a host target binding site located in an untranslated region of VGAM2653 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2653 host target RNA into VGAM2653 host target protein, herein schematically represented by VGAM1 HOST TARGET PROTEIN through VGAM3 HOST TARGET PROTEIN, all of FIG. 1.

VGAM2654 RNA, herein schematically represented by VGAM1 RNA through VGAM3 RNA, binds complementarily to a host target binding site located in an untranslated region of VGAM2654 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2654 host target RNA into VGAM2654 host target protein, herein schematically represented by VGAM1 HOST TARGET PROTEIN through VGAM3 HOST TARGET PROTEIN, all of FIG. 1.

VGAM2655 RNA, herein schematically represented by VGAM1 RNA through VGAM3 RNA, binds complementarily to a host target binding site located in an untranslated region of VGAM2655 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2655 host target RNA into VGAM2655 host target protein, herein schematically represented by VGAM1 HOST TARGET PROTEIN through VGAM3 HOST TARGET PROTEIN, all of FIG. 1.

It is appreciated that a function of VGR3276 gene, herein designated VGR GENE, is inhibition of expression of host target genes, as part of a novel viral mechanism of attacking a host. Accordingly, utilities of VGR3276 gene include diagnosis, prevention and treatment of viral infection by Sorghum Mosaic Virus. Specific functions, and accordingly utilities, of VGR3276 gene correlate with, and may be deduced from, the identity of the host target genes, which are inhibited by VGAM RNAs comprised in the 'operon-like' cluster of VGR3276 gene: VGAM2652 host target protein, VGAM2653 host target protein, VGAM2654 host target protein and VGAM2655 host target protein, herein schematically represented by VGAM1 HOST TARGET PROTEIN through VGAM3 HOST TARGET PROTEIN. The function of these host target genes is elaborated hereinabove with reference to VGAM2652, VGAM2653, VGAM2654 and VGAM2655. FIG. 9 further provides a conceptual description of novel bioinformatically detected regulatory viral gene, referred to here as Viral Genomic Record 3277(VGR3277) viral gene, which encodes an 'operon-like' cluster of novel viral micro RNA-like genes, each of which in turn modulates expression of at least one host target gene, the function and utility of which at least one host target gene is known in the art.

VGR3277 gene, herein designated VGR GENE, is a novel bioinformatically detected regulatory, non protein coding, RNA viral gene. The method by which VGR3277 gene was detected is described hereinabove with reference to FIGS. 1-9.

VGR3277 gene encodes VGR3277 precursor RNA, herein designated VGR PRECURSOR RNA, an RNA molecule, typically several hundred nucleotides long.

VGR3277 precursor RNA folds spatially, forming VGR3277 folded precursor RNA, herein designated VGR FOLDED PRECURSOR RNA. It is appreciated that VGR3277 folded precursor RNA comprises a plurality of what is known in the art as 'hairpin' structures. These 'hairpin' structures are due to the fact that the nucleotide sequence of VGR3277 precursor RNA comprises a plurality of segments, the first half of each such segment having a nucleotide sequence which is at least a partial inversed-reversed sequence of the second half thereof, as is well known in the art.

VGR3277 folded precursor RNA is naturally processed by cellular enzymatic activity into at least 8 separate VGAM precursor RNAs, VGAM2656 precursor RNA, VGAM2657 precursor RNA, VGAM2658 precursor RNA, VGAM2659 precursor RNA, VGAM2660 precursor RNA, VGAM2661 precursor RNA, VGAM2662 precursor RNA and VGAM2663 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2656 RNA, VGAM2657 RNA, VGAM2658 RNA, VGAM2659 RNA, VGAM2660 RNA, VGAM2661 RNA, VGAM2662 RNA and VGAM2663 RNA, herein schematically represented by VGAM1 RNA through VGAM3 RNA, each of which VGAM RNAs corresponding to VGAM RNA of FIG. 1.

VGAM2656 RNA, herein schematically represented by VGAM1 RNA through VGAM3 RNA, binds complementarily to a host target binding site located in an untranslated region of VGAM2656 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2656 host target RNA into VGAM2656 host target protein, herein schematically represented by VGAM1 HOST TARGET PROTEIN through VGAM3 HOST TARGET PROTEIN, all of FIG. 1.

VGAM2657 RNA, herein schematically represented by VGAM1 RNA through VGAM3 RNA, binds complementarily to a host target binding site located in an untranslated region of VGAM2657 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2657 host target RNA into VGAM2657 host target protein, herein schematically represented by VGAM1 HOST TARGET PROTEIN through VGAM3 HOST TARGET PROTEIN, all of FIG. 1.

VGAM2658 RNA, herein schematically represented by VGAM1 RNA through VGAM3 RNA, binds complementarily to a host target binding site located in an untranslated region of VGAM2658 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2658 host target RNA into VGAM2658 host target protein, herein schematically represented by VGAM1 HOST TARGET PROTEIN through VGAM3 HOST TARGET PROTEIN, all of FIG. 1.

VGAM2659 RNA, herein schematically represented by VGAM1 RNA through VGAM3 RNA, binds complementarily to a host target binding site located in an untranslated region of VGAM2659 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2659 host target RNA into VGAM2659 host target protein, herein schematically represented by VGAM1 HOST TARGET PROTEIN through VGAM3 HOST TARGET PROTEIN, all of FIG. 1.

VGAM2660 RNA, herein schematically represented by VGAM1 RNA through VGAM3 RNA, binds complementarily to a host target binding site located in an untranslated region of VGAM2660 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2660 host target RNA into VGAM2660 host target protein, herein schematically represented by VGAM1 HOST TARGET PROTEIN through VGAM3 HOST TARGET PROTEIN, all of FIG. 1.

VGAM2661 RNA, herein schematically represented by VGAM1 RNA through VGAM3 RNA, binds complementarily to a host target binding site located in an untranslated region of VGAM2661 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2661 host target RNA into VGAM2661 host target protein, herein schematically represented by VGAM1 HOST TARGET PROTEIN through VGAM3 HOST TARGET PROTEIN, all of FIG. 1.

VGAM2662 RNA, herein schematically represented by VGAM1 RNA through VGAM3 RNA, binds complementarily to a host target binding site located in an untranslated region of VGAM2662 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2662 host target RNA into VGAM2662 host target protein, herein schematically represented by VGAM1 HOST TARGET PROTEIN through VGAM3 HOST TARGET PROTEIN, all of FIG. 1.

VGAM2663 RNA, herein schematically represented by VGAM1 RNA through VGAM3 RNA, binds complementarily to a host target binding site located in an untranslated region of VGAM2663 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2663 host target RNA into VGAM2663 host target protein, herein schematically represented by VGAM1 HOST TARGET PROTEIN through VGAM3 HOST TARGET PROTEIN, all of FIG. 1.

It is appreciated that a function of VGR3277 gene, herein designated VGR GENE, is inhibition of expression of host target genes, as part of a novel viral mechanism of attacking a host. Accordingly, utilities of VGR3277 gene include diagnosis, prevention and treatment of viral infection by Potato Virus A. Specific functions, and accordingly utilities, of VGR3277 gene correlate with, and may be deduced from, the identity of the host target genes, which are inhibited by VGAM RNAs comprised in the 'operon-like' cluster of VGR3277 gene: VGAM2656 host target protein, VGAM2657 host target protein, VGAM2658 host target protein, VGAM2659 host target protein, VGAM2660 host target protein, VGAM2661 host target protein, VGAM2662 host target protein and VGAM2663 host target protein, herein schematically represented by VGAM1 HOST TARGET PROTEIN through VGAM3 HOST TARGET PROTEIN. The function of these host target genes is elaborated hereinabove with reference to VGAM2656, VGAM2657, VGAM2658, VGAM2659, VGAM2660, VGAM2661, VGAM2662 and VGAM2663. FIG. 9 further provides a conceptual description of novel bioinformatically detected regulatory viral gene, referred to here as Viral Genomic Record 3278(VGR3278) viral gene, which encodes an 'operon-like' cluster of novel viral micro RNA-like genes, each of which in turn modulates expression of at least one host target gene, the function and utility of which at least one host target gene is known in the art.

VGR3278 gene, herein designated VGR GENE, is a novel bioinformatically detected regulatory, non protein coding, RNA viral gene. The method by which VGR3278 gene was detected is described hereinabove with reference to FIGS. 1-9.

VGR3278 gene encodes VGR3278 precursor RNA, herein designated VGR PRECURSOR RNA, an RNA molecule, typically several hundred nucleotides long.

VGR3278 precursor RNA folds spatially, forming VGR3278 folded precursor RNA, herein designated VGR FOLDED PRECURSOR RNA. It is appreciated that VGR3278 folded precursor RNA comprises a plurality of what is known in the art as 'hairpin' structures. These 'hairpin' structures are due to the fact that the nucleotide sequence of VGR3278 precursor RNA comprises a plurality of segments, the first half of each such segment having a nucleotide sequence which is at least a partial inversed-reversed sequence of the second half thereof, as is well known in the art.

VGR3278 folded precursor RNA is naturally processed by cellular enzymatic activity into at least 3 separate VGAM precursor RNAs, VGAM2664 precursor RNA, VGAM2665 precursor RNA and VGAM2666 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2664 RNA, VGAM2665 RNA and VGAM2666 RNA, herein schematically represented by VGAM1 RNA through VGAM3 RNA, each of which VGAM RNAs corresponding to VGAM RNA of FIG. 1.

VGAM2664 RNA, herein schematically represented by VGAM1 RNA through VGAM3 RNA, binds complementarily to a host target binding site located in an untranslated region of VGAM2664 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2664 host target RNA into VGAM2664 host target protein, herein schematically represented by VGAM1 HOST TARGET PROTEIN through VGAM3 HOST TARGET PROTEIN, all of FIG. 1.

VGAM2665 RNA, herein schematically represented by VGAM1 RNA through VGAM3 RNA, binds complementarily to a host target binding site located in an untranslated region of VGAM2665 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2665 host target RNA into VGAM2665 host target protein, herein schematically represented by VGAM1 HOST TARGET PROTEIN through VGAM3 HOST TARGET PROTEIN, all of FIG. 1.

VGAM2666 RNA, herein schematically represented by VGAM1 RNA through VGAM3 RNA, binds complementarily to a host target binding site located in an untranslated region of VGAM2666 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2666 host target RNA into VGAM2666 host target protein, herein schematically represented by VGAM1 HOST TARGET PROTEIN through VGAM3 HOST TARGET PROTEIN, all of FIG. 1.

It is appreciated that a function of VGR3278 gene, herein designated VGR GENE, is inhibition of expression of host target genes, as part of a novel viral mechanism of attacking a host. Accordingly, utilities of VGR3278 gene include diagnosis, prevention and treatment of viral infection by Cryphonectria Parasitica Mitovirus 1-NB631. Specific functions, and accordingly utilities, of VGR3278 gene correlate with, and may be deduced from, the identity of the host target genes, which are inhibited by VGAM RNAs comprised in the 'operon-like' cluster of VGR3278 gene: VGAM2664 host target protein, VGAM2665 host target protein and VGAM2666 host target protein, herein schematically represented by VGAM1 HOST TARGET PROTEIN through VGAM3 HOST TARGET PROTEIN. The function of these host target genes is elaborated hereinabove with reference to VGAM2664, VGAM2665 and VGAM2666. FIG. 9 further provides a conceptual description of novel bioinformatically detected regulatory viral gene, referred to here as Viral Genomic Record 3279(VGR3279) viral gene, which encodes an 'operon-like' cluster of novel viral micro RNA-like genes, each of which in turn modulates expression of at least one host target gene, the function and utility of which at least one host target gene is known in the art.

VGR3279 gene, herein designated VGR GENE, is a novel bioinformatically detected regulatory, non protein coding, RNA viral gene. The method by which VGR3279 gene was detected is described hereinabove with reference to FIGS. 1-9.

VGR3279 gene encodes VGR3279 precursor RNA, herein designated VGR PRECURSOR RNA, an RNA molecule, typically several hundred nucleotides long.

VGR3279 precursor RNA folds spatially, forming VGR3279 folded precursor RNA, herein designated VGR FOLDED PRECURSOR RNA. It is appreciated that VGR3279 folded precursor RNA comprises a plurality of what is known in the art as 'hairpin' structures. These 'hairpin' structures are due to the fact that the nucleotide sequence of VGR3279 precursor RNA comprises a plurality of segments, the first half of each such segment having a nucleotide sequence which is at least a partial inversed-reversed sequence of the second half thereof, as is well known in the art.

VGR3279 folded precursor RNA is naturally processed by cellular enzymatic activity into at least 4 separate VGAM precursor RNAs, VGAM2667 precursor RNA, VGAM2668 precursor RNA, VGAM2669 precursor RNA and VGAM2670 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2667 RNA, VGAM2668 RNA, VGAM2669 RNA and VGAM2670 RNA, herein schematically represented by VGAM1 RNA through VGAM3 RNA, each of which VGAM RNAs corresponding to VGAM RNA of FIG. 1.

VGAM2667 RNA, herein schematically represented by VGAM1 RNA through VGAM3 RNA, binds complementarily to a host target binding site located in an untranslated region of VGAM2667 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2667 host target RNA into VGAM2667 host target protein, herein schematically represented by VGAM1 HOST TARGET PROTEIN through VGAM3 HOST TARGET PROTEIN, all of FIG. 1.

VGAM2668 RNA, herein schematically represented by VGAM1 RNA through VGAM3 RNA, binds complementarily to a host target binding site located in an untranslated region of VGAM2668 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2668 host target RNA into VGAM2668 host target protein, herein schematically represented by VGAM1 HOST TARGET PROTEIN through VGAM3 HOST TARGET PROTEIN, all of FIG. 1.

VGAM2669 RNA, herein schematically represented by VGAM1 RNA through VGAM3 RNA, binds complementarily to a host target binding site located in an untranslated region of VGAM2669 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2669 host target RNA into VGAM2669 host target protein, herein schematically represented by VGAM1 HOST TARGET PROTEIN through VGAM3 HOST TARGET PROTEIN, all of FIG. 1.

VGAM2670 RNA, herein schematically represented by VGAM1 RNA through VGAM3 RNA, binds complementarily to a host target binding site located in an untranslated region of VGAM2670 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2670 host target RNA into VGAM2670 host target protein, herein schematically represented by VGAM1 HOST TARGET PROTEIN through VGAM3 HOST TARGET PROTEIN, all of FIG. 1.

It is appreciated that a function of VGR3279 gene, herein designated VGR GENE, is inhibition of expression of host target genes, as part of a novel viral mechanism of attacking a host. Accordingly, utilities of VGR3279 gene include diagnosis, prevention and treatment of viral infection by Bean Common Mosaic Necrosis Virus. Specific functions, and accordingly utilities, of VGR3279 gene correlate with, and may be deduced from, the identity of the host target genes, which are inhibited by VGAM RNAs comprised in the 'operon-like' cluster of VGR3279 gene: VGAM2667 host target protein, VGAM2668 host target protein, VGAM2669 host target protein and VGAM2670 host target protein, herein schematically represented by VGAM1 HOST TARGET PROTEIN through VGAM3 HOST TARGET PROTEIN. The function of these host target genes is elaborated hereinabove with reference to VGAM2667, VGAM2668, VGAM2669 and VGAM2670. FIG. 9 further provides a conceptual description of novel bioinformatically detected regulatory viral gene, referred to here as Viral Genomic Record 3280(VGR3280) viral gene, which encodes an 'operon-like' cluster of novel viral micro RNA-like genes, each of which in turn modulates expression of at least one host target gene, the function and utility of which at least one host target gene is known in the art.

VGR3280 gene, herein designated VGR GENE, is a novel bioinformatically detected regulatory, non protein coding, RNA viral gene. The method by which VGR3280 gene was detected is described hereinabove with reference to FIGS. 1-9.

VGR3280 gene encodes VGR3280 precursor RNA, herein designated VGR PRECURSOR RNA, an RNA molecule, typically several hundred nucleotides long.

VGR3280 precursor RNA folds spatially, forming VGR3280 folded precursor RNA, herein designated VGR FOLDED PRECURSOR RNA. It is appreciated that VGR3280 folded precursor RNA comprises a plurality of what is known in the art as 'hairpin' structures. These 'hairpin' structures are due to the fact that the nucleotide sequence of VGR3280 precursor RNA comprises a plurality of segments, the first half of each such segment having a nucleotide sequence which is at least a partial inversed-reversed sequence of the second half thereof, as is well known in the art.

VGR3280 folded precursor RNA is naturally processed by cellular enzymatic activity into at least 7 separate VGAM precursor RNAs, VGAM2671 precursor RNA, VGAM2672 precursor RNA, VGAM2673 precursor RNA, VGAM2674 precursor RNA, VGAM2675 precursor RNA, VGAM2676 precursor RNA and VGAM2677 precursor RNA, herein schematically represented by VGAM1 FOLDED PRECUR- SOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2671 RNA, VGAM2672 RNA, VGAM2673 RNA, VGAM2674 RNA, VGAM2675 RNA, VGAM2676 RNA and VGAM2677 RNA, herein schematically represented by VGAM1 RNA through VGAM3 RNA, each of which VGAM RNAs corresponding to VGAM RNA of FIG. 1.

VGAM2671 RNA, herein schematically represented by VGAM1 RNA through VGAM3 RNA, binds complementarily to a host target binding site located in an untranslated region of VGAM2671 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2671 host target RNA into VGAM2671 host target protein, herein schematically represented by VGAM1 HOST TARGET PROTEIN through VGAM3 HOST TARGET PROTEIN, all of FIG. 1.

VGAM2672 RNA, herein schematically represented by VGAM1 RNA through VGAM3 RNA, binds complementarily to a host target binding site located in an untranslated region of VGAM2672 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2672 host target RNA into VGAM2672 host target protein, herein schematically represented by VGAM1 HOST TARGET PROTEIN through VGAM3 HOST TARGET PROTEIN, all of FIG. 1.

VGAM2673 RNA, herein schematically represented by VGAM1 RNA through VGAM3 RNA, binds complementarily to a host target binding site located in an untranslated region of VGAM2673 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2673 host target RNA into VGAM2673 host target protein, herein schematically represented by VGAM1 HOST TARGET PROTEIN through VGAM3 HOST TARGET PROTEIN, all of FIG. 1.

VGAM2674 RNA, herein schematically represented by VGAM1 RNA through VGAM3 RNA, binds complementarily to a host target binding site located in an untranslated region of VGAM2674 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2674 host target RNA into VGAM2674 host target protein, herein schematically represented by VGAM1 HOST TARGET PROTEIN through VGAM3 HOST TARGET PROTEIN, all of FIG. 1.

VGAM2675 RNA, herein schematically represented by VGAM1 RNA through VGAM3 RNA, binds complementarily to a host target binding site located in an untranslated region of VGAM2675 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2675 host target RNA into VGAM2675 host target protein, herein schematically represented by VGAM1 HOST TARGET PROTEIN through VGAM3 HOST TARGET PROTEIN, all of FIG. 1.

VGAM2676 RNA, herein schematically represented by VGAM1 RNA through VGAM3 RNA, binds complementarily to a host target binding site located in an untranslated region of VGAM2676 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2676 host target RNA into VGAM2676 host target protein, herein schematically represented by VGAM1 HOST TARGET PROTEIN through VGAM3 HOST TARGET PROTEIN, all of FIG. 1.

VGAM2677 RNA, herein schematically represented by VGAM1 RNA through VGAM3 RNA, binds complementarily to a host target binding site located in an untranslated region of VGAM2677 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2677 host target RNA into VGAM2677 host target protein, herein schematically represented by VGAM1 HOST TARGET PROTEIN through VGAM3 HOST TARGET PROTEIN, all of FIG. 1.

It is appreciated that a function of VGR3280 gene, herein designated VGR GENE, is inhibition of expression of host target genes, as part of a novel viral mechanism of attacking a host. Accordingly, utilities of VGR3280 gene include diagnosis, prevention and treatment of viral infection by Ophiostoma Mitovirus 3a. Specific functions, and accordingly utilities, of VGR3280 gene correlate with, and may be deduced from, the identity of the host target genes, which are inhibited by VGAM RNAs comprised in the 'operon-like' cluster of VGR3280 gene: VGAM2671 host target protein, VGAM2672 host target protein, VGAM2673 host target protein, VGAM2674 host target protein, VGAM2675 host target protein, VGAM2676 host target protein and VGAM2677 host target protein, herein schematically represented by VGAM1 HOST TARGET PROTEIN through VGAM3 HOST TARGET PROTEIN. The function of these host target genes is elaborated hereinabove with reference to VGAM2671, VGAM2672, VGAM2673, VGAM2674, VGAM2675, VGAM2676 and VGAM2677. FIG. 9 further provides a conceptual description of novel bioinformatically detected regulatory viral gene, referred to here as Viral Genomic Record 3281(VGR3281) viral gene, which encodes an 'operon-like' cluster of novel viral micro RNA-like genes, each of which in turn modulates expression of at least one host target gene, the function and utility of which at least one host target gene is known in the art.

VGR3281 gene, herein designated VGR GENE, is a novel bioinformatically detected regulatory, non protein coding, RNA viral gene. The method by which VGR3281 gene was detected is described hereinabove with reference to FIGS. 1-9.

VGR3281 gene encodes VGR3281 precursor RNA, herein designated VGR PRECURSOR RNA, an RNA molecule, typically several hundred nucleotides long.

VGR3281 precursor RNA folds spatially, forming VGR3281 folded precursor RNA, herein designated VGR FOLDED PRECURSOR RNA. It is appreciated that VGR3281 folded precursor RNA comprises a plurality of what is known in the art as 'hairpin' structures. These 'hairpin' structures are due to the fact that the nucleotide sequence of VGR3281 precursor RNA comprises a plurality of segments, the first half of each such segment having a nucleotide sequence which is at least a partial inversed-reversed sequence of the second half thereof, as is well known in the art.

VGR3281 folded precursor RNA is naturally processed by cellular enzymatic activity into at least 6 separate VGAM precursor RNAs, VGAM2678 precursor RNA, VGAM2679 precursor RNA, VGAM2680 precursor RNA, VGAM2681 precursor RNA, VGAM2682 precursor RNA and VGAM2683 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2678 RNA, VGAM2679 RNA, VGAM2680 RNA, VGAM2681 RNA, VGAM2682 RNA and VGAM2683 RNA, herein schematically represented by VGAM1 RNA through VGAM3 RNA, each of which VGAM RNAs corresponding to VGAM RNA of FIG. 1.

VGAM2678 RNA, herein schematically represented by VGAM1 RNA through VGAM3 RNA, binds complementarily to a host target binding site located in an untranslated region of VGAM2678 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2678 host target RNA into VGAM2678 host target protein, herein schematically represented by VGAM1 HOST TARGET PROTEIN through VGAM3 HOST TARGET PROTEIN, all of FIG. 1.

VGAM2679 RNA, herein schematically represented by VGAM1 RNA through VGAM3 RNA, binds complementarily to a host target binding site located in an untranslated region of VGAM2679 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2679 host target RNA into VGAM2679 host target protein, herein schematically represented by VGAM1 HOST TARGET PROTEIN through VGAM3 HOST TARGET PROTEIN, all of FIG. 1.

VGAM2680 RNA, herein schematically represented by VGAM1 RNA through VGAM3 RNA, binds complementarily to a host target binding site located in an untranslated region of VGAM2680 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2680 host target RNA into VGAM2680 host target protein, herein schematically represented by VGAM1 HOST TARGET PROTEIN through VGAM3 HOST TARGET PROTEIN, all of FIG. 1.

VGAM2681 RNA, herein schematically represented by VGAM1 RNA through VGAM3 RNA, binds complementarily to a host target binding site located in an untranslated region of VGAM2681 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2681 host target RNA into VGAM2681 host target protein, herein schematically represented by VGAM1 HOST TARGET PROTEIN through VGAM3 HOST TARGET PROTEIN, all of FIG. 1.

VGAM2682 RNA, herein schematically represented by VGAM1 RNA through VGAM3 RNA, binds complementarily to a host target binding site located in an untranslated region of VGAM2682 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2682 host target RNA into VGAM2682 host target protein, herein schematically represented by VGAM1 HOST TARGET PROTEIN through VGAM3 HOST TARGET PROTEIN, all of FIG. 1.

VGAM2683 RNA, herein schematically represented by VGAM1 RNA through VGAM3 RNA, binds complementarily to a host target binding site located in an untranslated region of VGAM2683 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2683 host target RNA into VGAM2683 host target protein, herein schematically represented by VGAM1 HOST TARGET PROTEIN through VGAM3 HOST TARGET PROTEIN, all of FIG. 1.

It is appreciated that a function of VGR3281 gene, herein designated VGR GENE, is inhibition of expression of host target genes, as part of a novel viral mechanism of attacking a host. Accordingly, utilities of VGR3281 gene include diagnosis, prevention and treatment of viral infection by Ophiostoma Novo-ulmi Mitovirus 4-Ld. Specific functions, and accordingly utilities, of VGR3281 gene correlate with, and may be deduced from, the identity of the host target genes, which are inhibited by VGAM RNAs comprised in the 'operon-like' cluster of VGR3281 gene: VGAM2678 host target protein, VGAM2679 host target protein, VGAM2680 host target protein, VGAM2681 host target protein, VGAM2682 host target protein and VGAM2683 host target protein, herein schematically represented by VGAM1 HOST TARGET PROTEIN through VGAM3 HOST TARGET PROTEIN. The function of these host target genes is elaborated hereinabove with reference to VGAM2678, VGAM2679, VGAM2680, VGAM2681, VGAM2682 and VGAM2683. FIG. 9 further provides a conceptual description of novel bioinformatically detected regulatory viral gene, referred to here as Viral Genomic Record 3282(VGR3282) viral gene, which encodes an 'operon-like' cluster of novel viral micro RNA-like genes, each of which in turn modulates expression of at least one host target gene, the function and utility of which at least one host target gene is known in the art.

VGR3282 gene, herein designated VGR GENE, is a novel bioinformatically detected regulatory, non protein coding, RNA viral gene. The method by which VGR3282 gene was detected is described hereinabove with reference to FIGS. 1-9.

VGR3282 gene encodes VGR3282 precursor RNA, herein designated VGR PRECURSOR RNA, an RNA molecule, typically several hundred nucleotides long.

VGR3282 precursor RNA folds spatially, forming VGR3282 folded precursor RNA, herein designated VGR FOLDED PRECURSOR RNA. It is appreciated that VGR3282 folded precursor RNA comprises a plurality of what is known in the art as 'hairpin' structures. These 'hairpin' structures are due to the fact that the nucleotide sequence of VGR3282 precursor RNA comprises a plurality of segments, the first half of each such segment having a nucleotide sequence which is at least a partial inversed-reversed sequence of the second half thereof, as is well known in the art.

VGR3282 folded precursor RNA is naturally processed by cellular enzymatic activity into at least 3 separate VGAM precursor RNAs, VGAM2684 precursor RNA, VGAM2685 precursor RNA and VGAM2686 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2684 RNA, VGAM2685 RNA and VGAM2686 RNA, herein schematically represented by VGAM1 RNA through VGAM3 RNA, each of which VGAM RNAs corresponding to VGAM RNA of FIG. 1.

VGAM2684 RNA, herein schematically represented by VGAM1 RNA through VGAM3 RNA, binds complementarily to a host target binding site located in an untranslated region of VGAM2684 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2684 host target RNA into VGAM2684 host target protein, herein schematically represented by VGAM1 HOST TARGET PROTEIN through VGAM3 HOST TARGET PROTEIN, all of FIG. 1.

VGAM2685 RNA, herein schematically represented by VGAM1 RNA through VGAM3 RNA, binds complementarily to a host target binding site located in an untranslated region of VGAM2685 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2685 host target RNA into VGAM2685 host target protein, herein schematically represented by VGAM1 HOST TARGET PROTEIN through VGAM3 HOST TARGET PROTEIN, all of FIG. 1.

VGAM2686 RNA, herein schematically represented by VGAM1 RNA through VGAM3 RNA, binds complementarily to a host target binding site located in an untranslated region of VGAM2686 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2686 host target RNA into VGAM2686 host target protein, herein schematically represented by VGAM1 HOST TARGET PROTEIN through VGAM3 HOST TARGET PROTEIN, all of FIG. 1.

It is appreciated that a function of VGR3282 gene, herein designated VGR GENE, is inhibition of expression of host target genes, as part of a novel viral mechanism of attacking a host. Accordingly, utilities of VGR3282 gene include diagnosis, prevention and treatment of viral infection by Ophiostoma Novo-ulmi Mitovirus 5-Ld. Specific functions, and accordingly utilities, of VGR3282 gene correlate with, and may be deduced from, the identity of the host target genes, which are inhibited by VGAM RNAs comprised in the 'operon-like' cluster of VGR3282 gene: VGAM2684 host target protein, VGAM2685 host target protein and VGAM2686 host target protein, herein schematically represented by VGAM1 HOST TARGET PROTEIN through VGAM3 HOST TARGET PROTEIN. The function of these host target genes is elaborated hereinabove with reference to VGAM2684, VGAM2685 and VGAM2686. FIG. 9 further provides a conceptual description of novel bioinformatically detected regulatory viral gene, referred to here as Viral Genomic Record 3283(VGR3283) viral gene, which encodes an 'operon-like' cluster of novel viral micro RNA-like genes, each of which in turn modulates expression of at least one host target gene, the function and utility of which at least one host target gene is known in the art.

VGR3283 gene, herein designated VGR GENE, is a novel bioinformatically detected regulatory, non protein coding, RNA viral gene. The method by which VGR3283 gene was detected is described hereinabove with reference to FIGS. 1-9.

VGR3283 gene encodes VGR3283 precursor RNA, herein designated VGR PRECURSOR RNA, an RNA molecule, typically several hundred nucleotides long.

VGR3283 precursor RNA folds spatially, forming VGR3283 folded precursor RNA, herein designated VGR FOLDED PRECURSOR RNA. It is appreciated that VGR3283 folded precursor RNA comprises a plurality of what is known in the art as 'hairpin' structures. These 'hairpin' structures are due to the fact that the nucleotide sequence of VGR3283 precursor RNA comprises a plurality of segments, the first half of each such segment having a nucleotide sequence which is at least a partial inversed-reversed sequence of the second half thereof, as is well known in the art.

VGR3283 folded precursor RNA is naturally processed by cellular enzymatic activity into at least 3 separate VGAM precursor RNAs, VGAM2687 precursor RNA, VGAM2688 precursor RNA and VGAM2689 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2687 RNA, VGAM2688 RNA and VGAM2689 RNA, herein schematically represented by VGAM1 RNA through VGAM3 RNA, each of which VGAM RNAs corresponding to VGAM RNA of FIG. 1.

VGAM2687 RNA, herein schematically represented by VGAM1 RNA through VGAM3 RNA, binds complementarily to a host target binding site located in an untranslated region of VGAM2687 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2687 host target RNA into VGAM2687 host target protein, herein schematically represented by VGAM1 HOST TARGET PROTEIN through VGAM3 HOST TARGET PROTEIN, all of FIG. 1.

VGAM2688 RNA, herein schematically represented by VGAM1 RNA through VGAM3 RNA, binds complementarily to a host target binding site located in an untranslated region of VGAM2688 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2688 host target RNA into VGAM2688 host target protein, herein schematically represented by VGAM1 HOST TARGET PROTEIN through VGAM3 HOST TARGET PROTEIN, all of FIG. 1.

VGAM2689 RNA, herein schematically represented by VGAM1 RNA through VGAM3 RNA, binds complementarily to a host target binding site located in an untranslated region of VGAM2689 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2689 host target RNA into VGAM2689 host target protein, herein schematically represented by VGAM1 HOST TARGET PROTEIN through VGAM3 HOST TARGET PROTEIN, all of FIG. 1.

It is appreciated that a function of VGR3283 gene, herein designated VGR GENE, is inhibition of expression of host target genes, as part of a novel viral mechanism of attacking a host. Accordingly, utilities of VGR3283 gene include diagnosis, prevention and treatment of viral infection by Southern Bean Mosaic Virus. Specific functions, and accordingly utilities, of VGR3283 gene correlate with, and may be deduced from, the identity of the host target genes, which are inhibited by VGAM RNAs comprised in the 'operon-like' cluster of VGR3283 gene: VGAM2687 host target protein, VGAM2688 host target protein and VGAM2689 host target protein, herein schematically represented by VGAM1 HOST TARGET PROTEIN through VGAM3 HOST TARGET PROTEIN. The function of these host target genes is elaborated hereinabove with reference to VGAM2687, VGAM2688 and VGAM2689. FIG. 9 further provides a conceptual description of novel bioinformatically detected regulatory viral gene, referred to here as Viral Genomic Record 3284(VGR3284) viral gene, which encodes an 'operon-like' cluster of novel viral micro RNA-like genes, each of which in turn modulates expression of at least one host target gene, the function and utility of which at least one host target gene is known in the art.

VGR3284 gene, herein designated VGR GENE, is a novel bioinformatically detected regulatory, non protein coding, RNA viral gene. The method by which VGR3284 gene was detected is described hereinabove with reference to FIGS. 1-9.

VGR3284 gene encodes VGR3284 precursor RNA, herein designated VGR PRECURSOR RNA, an RNA molecule, typically several hundred nucleotides long.

VGR3284 precursor RNA folds spatially, forming VGR3284 folded precursor RNA, herein designated VGR FOLDED PRECURSOR RNA. It is appreciated that VGR3284 folded precursor RNA comprises a plurality of what is known in the art as 'hairpin' structures. These 'hairpin' structures are due to the fact that the nucleotide sequence of VGR3284 precursor RNA comprises a plurality of segments, the first half of each such segment having a nucleotide sequence which is at least a partial inversed-reversed sequence of the second half thereof, as is well known in the art.

VGR3284 folded precursor RNA is naturally processed by cellular enzymatic activity into at least 5 separate VGAM precursor RNAs, VGAM2690 precursor RNA, VGAM2691 precursor RNA, VGAM2692 precursor RNA, VGAM2693 precursor RNA and VGAM2694 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2690 RNA, VGAM2691 RNA, VGAM2692 RNA, VGAM2693 RNA and VGAM2694 RNA, herein schematically represented by VGAM1 RNA through VGAM3 RNA, each of which VGAM RNAs corresponding to VGAM RNA of FIG. 1.

VGAM2690 RNA, herein schematically represented by VGAM1 RNA through VGAM3 RNA, binds complementarily to a host target binding site located in an untranslated region of VGAM2690 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2690 host target RNA into VGAM2690 host target protein, herein schematically represented by VGAM1 HOST TARGET PROTEIN through VGAM3 HOST TARGET PROTEIN, all of FIG. 1.

VGAM2691 RNA, herein schematically represented by VGAM1 RNA through VGAM3 RNA, binds complementarily to a host target binding site located in an untranslated region of VGAM2691 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2691 host target RNA into VGAM2691 host target protein, herein schematically represented by VGAM1 HOST TARGET PROTEIN through VGAM3 HOST TARGET PROTEIN, all of FIG. 1.

VGAM2692 RNA, herein schematically represented by VGAM1 RNA through VGAM3 RNA, binds complementarily to a host target binding site located in an untranslated region of VGAM2692 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2692 host target RNA into VGAM2692 host target protein, herein schematically represented by VGAM1 HOST TARGET PROTEIN through VGAM3 HOST TARGET PROTEIN, all of FIG. 1.

VGAM2693 RNA, herein schematically represented by VGAM1 RNA through VGAM3 RNA, binds complementarily to a host target binding site located in an untranslated region of VGAM2693 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2693 host target RNA into VGAM2693 host target protein, herein schematically represented by VGAM1 HOST TARGET PROTEIN through VGAM3 HOST TARGET PROTEIN, all of FIG. 1.

VGAM2694 RNA, herein schematically represented by VGAM1 RNA through VGAM3 RNA, binds complementarily to a host target binding site located in an untranslated region of VGAM2694 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2694 host target RNA into VGAM2694 host target protein, herein schematically represented by VGAM1 HOST TARGET PROTEIN through VGAM3 HOST TARGET PROTEIN, all of FIG. 1.

It is appreciated that a function of VGR3284 gene, herein designated VGR GENE, is inhibition of expression of host target genes, as part of a novel viral mechanism of attacking a host. Accordingly, utilities of VGR3284 gene include diagnosis, prevention and treatment of viral infection by Phthorimaea Operculella Granulovirus. Specific functions, and accordingly utilities, of VGR3284 gene correlate with, and may be deduced from, the identity of the host target genes, which are inhibited by VGAM RNAs comprised in the 'operon-like' cluster of VGR3284 gene: VGAM2690 host target protein, VGAM2691 host target protein, VGAM2692 host target protein, VGAM2693 host target protein and VGAM2694 host target protein, herein schematically represented by VGAM1 HOST TARGET PROTEIN through VGAM3 HOST TARGET PROTEIN. The function of these host target genes is elaborated hereinabove with reference to VGAM2690, VGAM2691, VGAM2692, VGAM2693 and VGAM2694. FIG. 9 further provides a conceptual description of novel bioinformatically detected regulatory viral gene, referred to here as Viral Genomic Record 3285(VGR3285) viral gene, which encodes an 'operon-like' cluster of novel viral micro RNA-like genes, each of which in turn modulates expression of at least one host target gene, the function and utility of which at least one host target gene is known in the art.

VGR3285 gene, herein designated VGR GENE, is a novel bioinformatically detected regulatory, non protein coding, RNA viral gene. The method by which VGR3285 gene was detected is described hereinabove with reference to FIGS. 1-9.

VGR3285 gene encodes VGR3285 precursor RNA, herein designated VGR PRECURSOR RNA, an RNA molecule, typically several hundred nucleotides long.

VGR3285 precursor RNA folds spatially, forming VGR3285 folded precursor RNA, herein designated VGR FOLDED PRECURSOR RNA. It is appreciated that VGR3285 folded precursor RNA comprises a plurality of what is known in the art as 'hairpin' structures. These 'hairpin' structures are due to the fact that the nucleotide sequence of VGR3285 precursor RNA comprises a plurality of segments, the first half of each such segment having a nucleotide sequence which is at least a partial inversed-reversed sequence of the second half thereof, as is well known in the art.

VGR3285 folded precursor RNA is naturally processed by cellular enzymatic activity into at least 4 separate VGAM precursor RNAs, VGAM2696 precursor RNA, VGAM2697 precursor RNA, VGAM2698 precursor RNA and VGAM2699 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2696 RNA, VGAM2697 RNA, VGAM2698 RNA and VGAM2699 RNA, herein schematically represented by VGAM1 RNA through VGAM3 RNA, each of which VGAM RNAs corresponding to VGAM RNA of FIG. 1.

VGAM2696 RNA, herein schematically represented by VGAM1 RNA through VGAM3 RNA, binds complementarily to a host target binding site located in an untranslated region of VGAM2696 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2696 host target RNA into VGAM2696 host target protein, herein schematically represented by VGAM1 HOST TARGET PROTEIN through VGAM3 HOST TARGET PROTEIN, all of FIG. 1.

VGAM2697 RNA, herein schematically represented by VGAM1 RNA through VGAM3 RNA, binds complementarily to a host target binding site located in an untranslated region of VGAM2697 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2697 host target RNA into VGAM2697 host target protein, herein schematically represented by VGAM1 HOST TARGET PROTEIN through VGAM3 HOST TARGET PROTEIN, all of FIG. 1.

VGAM2698 RNA, herein schematically represented by VGAM1 RNA through VGAM3 RNA, binds complementarily to a host target binding site located in an untranslated region of VGAM2698 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2698 host target RNA into VGAM2698 host target protein, herein schematically represented by VGAM1 HOST TARGET PROTEIN through VGAM3 HOST TARGET PROTEIN, all of FIG. 1.

VGAM2699 RNA, herein schematically represented by VGAM1 RNA through VGAM3 RNA, binds complementarily to a host target binding site located in an untranslated region of VGAM2699 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2699 host target RNA into VGAM2699 host target protein, herein schematically represented by VGAM1 HOST TARGET PROTEIN through VGAM3 HOST TARGET PROTEIN, all of FIG. 1.

It is appreciated that a function of VGR3285 gene, herein designated VGR GENE, is inhibition of expression of host target genes, as part of a novel viral mechanism of attacking a host. Accordingly, utilities of VGR3285 gene include diagnosis, prevention and treatment of viral infection by Paprika Mild Mottle Virus. Specific functions, and accordingly utilities, of VGR3285 gene correlate with, and may be deduced from, the identity of the host target genes, which are inhibited by VGAM RNAs comprised in the 'operon-like' cluster of VGR3285 gene: VGAM2696 host target protein, VGAM2697 host target protein, VGAM2698 host target protein and VGAM2699 host target protein, herein schematically represented by VGAM1 HOST TARGET PROTEIN through VGAM3 HOST TARGET PROTEIN. The function of these host target genes is elaborated hereinabove with reference to VGAM2696, VGAM2697, VGAM2698 and VGAM2699. FIG. 9 further provides a conceptual description of novel bioinformatically detected regulatory viral gene, referred to here as Viral Genomic Record 3286(VGR3286) viral gene, which encodes an 'operon-like' cluster of novel viral micro RNA-like genes, each of which in turn modulates expression of at least one host target gene, the function and utility of which at least one host target gene is known in the art.

VGR3286 gene, herein designated VGR GENE, is a novel bioinformatically detected regulatory, non protein coding, RNA viral gene. The method by which VGR3286 gene was detected is described hereinabove with reference to FIGS. 1-9.

VGR3286 gene encodes VGR3286 precursor RNA, herein designated VGR PRECURSOR RNA, an RNA molecule, typically several hundred nucleotides long.

VGR3286 precursor RNA folds spatially, forming VGR3286 folded precursor RNA, herein designated VGR FOLDED PRECURSOR RNA. It is appreciated that VGR3286 folded precursor RNA comprises a plurality of what is known in the art as 'hairpin' structures. These 'hairpin' structures are due to the fact that the nucleotide sequence of VGR3286 precursor RNA comprises a plurality of segments, the first half of each such segment having a nucleotide sequence which is at least a partial inversed-reversed sequence of the second half thereof, as is well known in the art.

VGR3286 folded precursor RNA is naturally processed by cellular enzymatic activity into at least 3 separate VGAM precursor RNAs, VGAM2700 precursor RNA, VGAM2701 precursor RNA and VGAM2702 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2700 RNA, VGAM2701 RNA and VGAM2702 RNA, herein schematically represented by VGAM1 RNA through VGAM3 RNA, each of which VGAM RNAs corresponding to VGAM RNA of FIG. 1.

VGAM2700 RNA, herein schematically represented by VGAM1 RNA through VGAM3 RNA, binds complementarily to a host target binding site located in an untranslated region of VGAM2700 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2700 host target RNA into VGAM2700 host target protein, herein schematically represented by VGAM1 HOST TARGET PROTEIN through VGAM3 HOST TARGET PROTEIN, all of FIG. 1.

VGAM2701 RNA, herein schematically represented by VGAM1 RNA through VGAM3 RNA, binds complementarily to a host target binding site located in an untranslated region of VGAM2701 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2701 host target RNA into VGAM2701 host target protein, herein schematically represented by VGAM1 HOST TARGET PROTEIN through VGAM3 HOST TARGET PROTEIN, all of FIG. 1.

VGAM2702 RNA, herein schematically represented by VGAM1 RNA through VGAM3 RNA, binds complementarily to a host target binding site located in an untranslated region of VGAM2702 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2702 host target RNA into VGAM2702 host target protein, herein schematically represented by VGAM1 HOST TARGET PROTEIN through VGAM3 HOST TARGET PROTEIN, all of FIG. 1.

It is appreciated that a function of VGR3286 gene, herein designated VGR GENE, is inhibition of expression of host target genes, as part of a novel viral mechanism of attacking a host. Accordingly, utilities of VGR3286 gene include diagnosis, prevention and treatment of viral infection by La Crosse Virus. Specific functions, and accordingly utilities, of VGR3286 gene correlate with, and may be deduced from, the identity of the host target genes, which are inhibited by VGAM RNAs comprised in the 'operon-like' cluster of VGR3286 gene: VGAM2700 host target protein, VGAM2701 host target protein and VGAM2702 host target protein, herein schematically represented by VGAM1 HOST TARGET PROTEIN through VGAM3 HOST TARGET PROTEIN. The function of these host target genes is elaborated hereinabove with reference to VGAM2700, VGAM2701 and VGAM2702. FIG. 9 further provides a conceptual description of novel bioinformatically detected regulatory viral gene, referred to here as Viral Genomic Record 3287(VGR3287) viral gene, which encodes an 'operon-like' cluster of novel viral micro RNA-like genes, each of which in turn modulates expression of at least one host target gene, the function and utility of which at least one host target gene is known in the art.

VGR3287 gene, herein designated VGR GENE, is a novel bioinformatically detected regulatory, non protein coding, RNA viral gene. The method by which VGR3287 gene was detected is described hereinabove with reference to FIGS. 1-9.

VGR3287 gene encodes VGR3287 precursor RNA, herein designated VGR PRECURSOR RNA, an RNA molecule, typically several hundred nucleotides long.

VGR3287 precursor RNA folds spatially, forming VGR3287 folded precursor RNA, herein designated VGR FOLDED PRECURSOR RNA. It is appreciated that VGR3287 folded precursor RNA comprises a plurality of what is known in the art as 'hairpin' structures. These 'hairpin' structures are due to the fact that the nucleotide sequence of VGR3287 precursor RNA comprises a plurality of segments, the first half of each such segment having a nucleotide sequence which is at least a partial inversed-reversed sequence of the second half thereof, as is well known in the art.

VGR3287 folded precursor RNA is naturally processed by cellular enzymatic activity into at least 2 separate VGAM precursor RNAs, VGAM2703 precursor RNA and VGAM2704 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2703 RNA and VGAM2704 RNA, herein schematically represented by VGAM1 RNA through VGAM3 RNA, each of which VGAM RNAs corresponding to VGAM RNA of FIG. 1.

VGAM2703 RNA, herein schematically represented by VGAM1 RNA through VGAM3 RNA, binds complementarily to a host target binding site located in an untranslated region of VGAM2703 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2703 host target RNA into VGAM2703 host target protein, herein schematically represented by VGAM1 HOST TARGET PROTEIN through VGAM3 HOST TARGET PROTEIN, all of FIG. 1.

VGAM2704 RNA, herein schematically represented by VGAM1 RNA through VGAM3 RNA, binds complementarily to a host target binding site located in an untranslated region of VGAM2704 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2704 host target RNA into VGAM2704 host target protein, herein schematically represented by VGAM1 HOST TARGET PROTEIN through VGAM3 HOST TARGET PROTEIN, all of FIG. 1.

It is appreciated that a function of VGR3287 gene, herein designated VGR GENE, is inhibition of expression of host target genes, as part of a novel viral mechanism of attacking a host. Accordingly, utilities of VGR3287 gene include diagnosis, prevention and treatment of viral infection by Mamestra Configurata Nucleopolyhedrovirus B. Specific functions, and accordingly utilities, of VGR3287 gene correlate with, and may be deduced from, the identity of the host target genes, which are inhibited by VGAM RNAs comprised in the 'operon-like' cluster of VGR3287 gene: VGAM2703 host target protein and VGAM2704 host target protein, herein schematically represented by VGAM1 HOST TARGET PROTEIN through VGAM3 HOST TARGET PROTEIN. The function of these host target genes is elaborated hereinabove with reference to VGAM2703 and VGAM2704. FIG. 9 further provides a conceptual description of novel bioinformatically detected regulatory viral gene, referred to here as Viral Genomic Record 3288(VGR3288) viral gene, which encodes an 'operon-like' cluster of novel viral micro RNA-like genes, each of which in turn modulates expression of at least one host target gene, the function and utility of which at least one host target gene is known in the art.

VGR3288 gene, herein designated VGR GENE, is a novel bioinformatically detected regulatory, non protein coding, RNA viral gene. The method by which VGR3288 gene was detected is described hereinabove with reference to FIGS. 1-9.

VGR3288 gene encodes VGR3288 precursor RNA, herein designated VGR PRECURSOR RNA, an RNA molecule, typically several hundred nucleotides long.

VGR3288 precursor RNA folds spatially, forming VGR3288 folded precursor RNA, herein designated VGR FOLDED PRECURSOR RNA. It is appreciated that VGR3288 folded precursor RNA comprises a plurality of what is known in the art as 'hairpin' structures. These 'hairpin' structures are due to the fact that the nucleotide sequence of VGR3288 precursor RNA comprises a plurality of segments, the first half of each such segment having a nucleotide sequence which is at least a partial inversed-reversed sequence of the second half thereof, as is well known in the art.

VGR3288 folded precursor RNA is naturally processed by cellular enzymatic activity into at least 2 separate VGAM precursor RNAs, VGAM2706 precursor RNA and VGAM2707 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2706 RNA and VGAM2707 RNA, herein schematically represented by VGAM1 RNA through VGAM3 RNA, each of which VGAM RNAs corresponding to VGAM RNA of FIG. 1.

VGAM2706 RNA, herein schematically represented by VGAM1 RNA through VGAM3 RNA, binds complementarily to a host target binding site located in an untranslated region of VGAM2706 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2706 host target RNA into VGAM2706 host target protein, herein schematically represented by VGAM1 HOST TARGET PROTEIN through VGAM3 HOST TARGET PROTEIN, all of FIG. 1.

VGAM2707 RNA, herein schematically represented by VGAM1 RNA through VGAM3 RNA, binds complementarily to a host target binding site located in an untranslated region of VGAM2707 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2707 host target RNA into VGAM2707 host target protein, herein schematically represented by VGAM1 HOST TARGET PROTEIN through VGAM3 HOST TARGET PROTEIN, all of FIG. 1.

It is appreciated that a function of VGR3288 gene, herein designated VGR GENE, is inhibition of expression of host target genes, as part of a novel viral mechanism of attacking a host. Accordingly, utilities of VGR3288 gene include diagnosis, prevention and treatment of viral infection by Heliothis Zea Virus 1 (HZV-1). Specific functions, and accordingly utilities, of VGR3288 gene correlate with, and may be deduced from, the identity of the host target genes, which are inhibited by VGAM RNAs comprised in the 'operon-like' cluster of VGR3288 gene: VGAM2706 host target protein and VGAM2707 host target protein, herein schematically represented by VGAM1 HOST TARGET PROTEIN through VGAM3 HOST TARGET PROTEIN. The function of these host target genes is elaborated hereinabove with reference to VGAM2706 and VGAM2707. FIG. 9 further provides a conceptual description of novel bioinformatically detected regulatory viral gene, referred to here as Viral Genomic Record 3289(VGR3289) viral gene, which encodes an 'operon-like' cluster of novel viral micro RNA-like genes, each of which in turn modulates expression of at least one host target gene, the function and utility of which at least one host target gene is known in the art.

VGR3289 gene, herein designated VGR GENE, is a novel bioinformatically detected regulatory, non protein coding, RNA viral gene. The method by which VGR3289 gene was detected is described hereinabove with reference to FIGS. 1-9.

VGR3289 gene encodes VGR3289 precursor RNA, herein designated VGR PRECURSOR RNA, an RNA molecule, typically several hundred nucleotides long.

VGR3289 precursor RNA folds spatially, forming VGR3289 folded precursor RNA, herein designated VGR FOLDED PRECURSOR RNA. It is appreciated that VGR3289 folded precursor RNA comprises a plurality of what is known in the art as 'hairpin' structures. These 'hairpin' structures are due to the fact that the nucleotide sequence of VGR3289 precursor RNA comprises a plurality of segments, the first half of each such segment having a nucleotide sequence which is at least a partial inversed-reversed sequence of the second half thereof, as is well known in the art.

VGR3289 folded precursor RNA is naturally processed by cellular enzymatic activity into at least 2 separate VGAM precursor RNAs, VGAM2708 precursor RNA and VGAM2709 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2708 RNA and VGAM2709 RNA, herein schematically represented by VGAM1 RNA through VGAM3 RNA, each of which VGAM RNAs corresponding to VGAM RNA of FIG. 1.

VGAM2708 RNA, herein schematically represented by VGAM1 RNA through VGAM3 RNA, binds complementarily to a host target binding site located in an untranslated region of VGAM2708 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2708 host target RNA into VGAM2708 host target protein, herein schematically represented by VGAM1 HOST TARGET PROTEIN through VGAM3 HOST TARGET PROTEIN, all of FIG. 1.

VGAM2709 RNA, herein schematically represented by VGAM1 RNA through VGAM3 RNA, binds complementarily to a host target binding site located in an untranslated region of VGAM2709 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2709 host target RNA into VGAM2709 host target protein, herein schematically represented by VGAM1 HOST TARGET PROTEIN through VGAM3 HOST TARGET PROTEIN, all of FIG. 1.

It is appreciated that a function of VGR3289 gene, herein designated VGR GENE, is inhibition of expression of host target genes, as part of a novel viral mechanism of attacking a host. Accordingly, utilities of VGR3289 gene include diagnosis, prevention and treatment of viral infection by Heliothis Zea Virus 1 (HZV-1). Specific functions, and accordingly utilities, of VGR3289 gene correlate with, and may be deduced from, the identity of the host target genes, which are inhibited by VGAM RNAs comprised in the 'operon-like' cluster of VGR3289 gene: VGAM2708 host target protein and VGAM2709 host target protein, herein schematically represented by VGAM1 HOST TARGET PROTEIN through VGAM3 HOST TARGET PROTEIN. The function of these host target genes is elaborated hereinabove with reference to VGAM2708 and VGAM2709. FIG. 9 further provides a conceptual description of novel bioinformatically detected regulatory viral gene, referred to here as Viral Genomic Record 3290(VGR3290) viral gene, which encodes an 'operon-like' cluster of novel viral micro RNA-like genes, each of which in turn modulates expression of at least one host target gene, the function and utility of which at least one host target gene is known in the art.

VGR3290 gene, herein designated VGR GENE, is a novel bioinformatically detected regulatory, non protein coding, RNA viral gene. The method by which VGR3290 gene was detected is described hereinabove with reference to FIGS. 1-9.

VGR3290 gene encodes VGR3290 precursor RNA, herein designated VGR PRECURSOR RNA, an RNA molecule, typically several hundred nucleotides long.

VGR3290 precursor RNA folds spatially, forming VGR3290 folded precursor RNA, herein designated VGR FOLDED PRECURSOR RNA. It is appreciated that VGR3290 folded precursor RNA comprises a plurality of what is known in the art as 'hairpin' structures. These 'hairpin' structures are due to the fact that the nucleotide sequence of VGR3290 precursor RNA comprises a plurality of segments, the first half of each such segment having a nucleotide sequence which is at least a partial inversed-reversed sequence of the second half thereof, as is well known in the art.

VGR3290 folded precursor RNA is naturally processed by cellular enzymatic activity into at least 2 separate VGAM precursor RNAs, VGAM2711 precursor RNA and VGAM2712 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2711 RNA and VGAM2712 RNA, herein schematically represented by VGAM1 RNA through VGAM3 RNA, each of which VGAM RNAs corresponding to VGAM RNA of FIG. 1.

VGAM2711 RNA, herein schematically represented by VGAM1 RNA through VGAM3 RNA, binds complementarily to a host target binding site located in an untranslated region of VGAM2711 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2711 host target RNA into VGAM2711 host target protein, herein schematically represented by VGAM1 HOST TARGET PROTEIN through VGAM3 HOST TARGET PROTEIN, all of FIG. 1.

VGAM2712 RNA, herein schematically represented by VGAM1 RNA through VGAM3 RNA, binds complementarily to a host target binding site located in an untranslated region of VGAM2712 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2712 host target RNA into VGAM2712 host target protein, herein schematically represented by VGAM1 HOST TARGET PROTEIN through VGAM3 HOST TARGET PROTEIN, all of FIG. 1.

It is appreciated that a function of VGR3290 gene, herein designated VGR GENE, is inhibition of expression of host target genes, as part of a novel viral mechanism of attacking a host. Accordingly, utilities of VGR3290 gene include diagnosis, prevention and treatment of viral infection by Chikungunya Virus. Specific functions, and accordingly utilities, of VGR3290 gene correlate with, and may be deduced from, the identity of the host target genes, which are inhibited by VGAM RNAs comprised in the 'operon-like' cluster of VGR3290 gene: VGAM2711 host target protein and VGAM2712 host target protein, herein schematically represented by VGAM1 HOST TARGET PROTEIN through VGAM3 HOST TARGET PROTEIN. The function of these host target genes is elaborated hereinabove with reference to VGAM2711 and VGAM2712. FIG. 9 further provides a conceptual description of novel bioinformatically detected regulatory viral gene, referred to here as Viral Genomic Record 3291(VGR3291) viral gene, which encodes an 'operon-like' cluster of novel viral micro RNA-like genes, each of which in turn modulates expression of at least one host target gene, the function and utility of which at least one host target gene is known in the art.

VGR3291 gene, herein designated VGR GENE, is a novel bioinformatically detected regulatory, non protein coding, RNA viral gene. The method by which VGR3291 gene was detected is described hereinabove with reference to FIGS. 1-9.

VGR3291 gene encodes VGR3291 precursor RNA, herein designated VGR PRECURSOR RNA, an RNA molecule, typically several hundred nucleotides long.

VGR3291 precursor RNA folds spatially, forming VGR3291 folded precursor RNA, herein designated VGR FOLDED PRECURSOR RNA. It is appreciated that VGR3291 folded precursor RNA comprises a plurality of what is known in the art as 'hairpin' structures. These 'hairpin' structures are due to the fact that the nucleotide sequence of VGR3291 precursor RNA comprises a plurality of segments, the first half of each such segment having a nucleotide sequence which is at least a partial inversed-reversed sequence of the second half thereof, as is well known in the art.

VGR3291 folded precursor RNA is naturally processed by cellular enzymatic activity into at least 3 separate VGAM precursor RNAs, VGAM2713 precursor RNA, VGAM2714 precursor RNA and VGAM2715 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2713 RNA, VGAM2714 RNA and VGAM2715 RNA, herein schematically represented by VGAM1 RNA through VGAM3 RNA, each of which VGAM RNAs corresponding to VGAM RNA of FIG. 1.

VGAM2713 RNA, herein schematically represented by VGAM1 RNA through VGAM3 RNA, binds complementarily to a host target binding site located in an untranslated region of VGAM2713 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2713 host target RNA into VGAM2713 host target protein, herein schematically represented by VGAM1 HOST TARGET PROTEIN through VGAM3 HOST TARGET PROTEIN, all of FIG. 1.

VGAM2714 RNA, herein schematically represented by VGAM1 RNA through VGAM3 RNA, binds complementarily to a host target binding site located in an untranslated region of VGAM2714 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2714 host target RNA into VGAM2714 host target protein, herein schematically represented by VGAM1 HOST TARGET PROTEIN through VGAM3 HOST TARGET PROTEIN, all of FIG. 1.

VGAM2715 RNA, herein schematically represented by VGAM1 RNA through VGAM3 RNA, binds complementarily to a host target binding site located in an untranslated region of VGAM2715 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2715 host target RNA into VGAM2715 host target protein, herein schematically represented by VGAM1 HOST TARGET PROTEIN through VGAM3 HOST TARGET PROTEIN, all of FIG. 1.

It is appreciated that a function of VGR3291 gene, herein designated VGR GENE, is inhibition of expression of host target genes, as part of a novel viral mechanism of attacking a host. Accordingly, utilities of VGR3291 gene include diagnosis, prevention and treatment of viral infection by Mammalian Orthoreovirus 2. Specific functions, and accordingly utilities, of VGR3291 gene correlate with, and may be deduced from, the identity of the host target genes, which are inhibited by VGAM RNAs comprised in the 'operon-like' cluster of VGR3291 gene: VGAM2713 host target protein, VGAM2714 host target protein and VGAM2715 host target protein, herein schematically represented by VGAM1 HOST TARGET PROTEIN through VGAM3 HOST TARGET PROTEIN. The function of these host target genes is elaborated hereinabove with reference to VGAM2713, VGAM2714 and VGAM2715. FIG. 9 further provides a conceptual description of novel bioinformatically detected regulatory viral gene, referred to here as Viral Genomic Record 3292(VGR3292) viral gene, which encodes an 'operon-like' cluster of novel viral micro RNA-like genes, each of which in turn modulates expression of at least one host target gene, the function and utility of which at least one host target gene is known in the art.

VGR3292 gene, herein designated VGR GENE, is a novel bioinformatically detected regulatory, non protein coding, RNA viral gene. The method by which VGR3292 gene was detected is described hereinabove with reference to FIGS. 1-9.

VGR3292 gene encodes VGR3292 precursor RNA, herein designated VGR PRECURSOR RNA, an RNA molecule, typically several hundred nucleotides long.

VGR3292 precursor RNA folds spatially, forming VGR3292 folded precursor RNA, herein designated VGR FOLDED PRECURSOR RNA. It is appreciated that VGR3292 folded precursor RNA comprises a plurality of what is known in the art as 'hairpin' structures. These 'hairpin' structures are due to the fact that the nucleotide sequence of VGR3292 precursor RNA comprises a plurality of segments, the first half of each such segment having a nucleotide sequence which is at least a partial inversed-reversed sequence of the second half thereof, as is well known in the art.

VGR3292 folded precursor RNA is naturally processed by cellular enzymatic activity into at least 2 separate VGAM precursor RNAs, VGAM2717 precursor RNA and VGAM2718 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2717 RNA and VGAM2718 RNA, herein schematically represented by VGAM1 RNA through VGAM3 RNA, each of which VGAM RNAs corresponding to VGAM RNA of FIG. 1.

VGAM2717 RNA, herein schematically represented by VGAM1 RNA through VGAM3 RNA, binds complementarily to a host target binding site located in an untranslated region of VGAM2717 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2717 host target RNA into VGAM2717 host target protein, herein schematically represented by VGAM1 HOST TARGET PROTEIN through VGAM3 HOST TARGET PROTEIN, all of FIG. 1.

VGAM2718 RNA, herein schematically represented by VGAM1 RNA through VGAM3 RNA, binds complementarily to a host target binding site located in an untranslated region of VGAM2718 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2718 host target RNA into VGAM2718 host target protein, herein schematically represented by VGAM1 HOST TARGET PROTEIN through VGAM3 HOST TARGET PROTEIN, all of FIG. 1.

It is appreciated that a function of VGR3292 gene, herein designated VGR GENE, is inhibition of expression of host target genes, as part of a novel viral mechanism of attacking a host. Accordingly, utilities of VGR3292 gene include diagnosis, prevention and treatment of viral infection by Rachiplusia Ou Multiple Nucleopolyhedrovirus. Specific functions, and accordingly utilities, of VGR3292 gene correlate with, and may be deduced from, the identity of the host target genes, which are inhibited by VGAM RNAs comprised in the 'operon-like' cluster of VGR3292 gene: VGAM2717 host target protein and VGAM2718 host target protein, herein schematically represented by VGAM1 HOST TARGET PROTEIN through VGAM3 HOST TARGET PROTEIN. The function of these host target genes is elaborated hereinabove with reference to VGAM2717 and VGAM2718. FIG. 9 further provides a conceptual description of novel bioinformatically detected regulatory viral gene, referred to here as Viral Genomic Record 3293(VGR3293) viral gene, which encodes an 'operon-like' cluster of novel viral micro RNA-like genes, each of which in turn modulates expression of at least one host target gene, the function and utility of which at least one host target gene is known in the art.

VGR3293 gene, herein designated VGR GENE, is a novel bioinformatically detected regulatory, non protein coding, RNA viral gene. The method by which VGR3293 gene was detected is described hereinabove with reference to FIGS. 1-9.

VGR3293 gene encodes VGR3293 precursor RNA, herein designated VGR PRECURSOR RNA, an RNA molecule, typically several hundred nucleotides long.

VGR3293 precursor RNA folds spatially, forming VGR3293 folded precursor RNA, herein designated VGR FOLDED PRECURSOR RNA. It is appreciated that VGR3293 folded precursor RNA comprises a plurality of what is known in the art as 'hairpin' structures. These 'hairpin' structures are due to the fact that the nucleotide sequence of VGR3293 precursor RNA comprises a plurality of segments, the first half of each such segment having a nucleotide sequence which is at least a partial inversed-reversed sequence of the second half thereof, as is well known in the art.

VGR3293 folded precursor RNA is naturally processed by cellular enzymatic activity into at least 7 separate VGAM precursor RNAs, VGAM2719 precursor RNA, VGAM2720 precursor RNA, VGAM2721 precursor RNA, VGAM2722 precursor RNA, VGAM2723 precursor RNA, VGAM2724 precursor RNA and VGAM2725 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2719 RNA, VGAM2720 RNA, VGAM2721 RNA, VGAM2722 RNA, VGAM2723 RNA, VGAM2724 RNA and VGAM2725 RNA, herein schematically represented by VGAM1 RNA through VGAM3 RNA, each of which VGAM RNAs corresponding to VGAM RNA of FIG. 1.

VGAM2719 RNA, herein schematically represented by VGAM1 RNA through VGAM3 RNA, binds complementarily to a host target binding site located in an untranslated region of VGAM2719 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2719 host target RNA into VGAM2719 host target protein, herein schematically represented by VGAM1 HOST TARGET PROTEIN through VGAM3 HOST TARGET PROTEIN, all of FIG. 1.

VGAM2720 RNA, herein schematically represented by VGAM1 RNA through VGAM3 RNA, binds complementarily to a host target binding site located in an untranslated region of VGAM2720 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2720 host target RNA into VGAM2720 host target protein, herein schematically represented by VGAM1 HOST TARGET PROTEIN through VGAM3 HOST TARGET PROTEIN, all of FIG. 1.

VGAM2721 RNA, herein schematically represented by VGAM1 RNA through VGAM3 RNA, binds complementarily to a host target binding site located in an untranslated region of VGAM2721 host target RNA, herein schematically represented by VGAM1 HOST TARGET RNA through VGAM3 HOST TARGET RNA, which host target binding site corresponds to a host target binding site such as BIND- ING SITE I, BINDING SITE II or BINDING SITE III of FIG. 1, thereby inhibiting translation of VGAM2721 host target RNA into VGAM2721 host target protein, herein schematically represented by VGAM1 HOST TARGET PROTEIN through VGAM3 HOST TARGET PROTEIN, all of FIG. 1.

VGAM2722 RNA, herein schematically represented by VGAM1 RNA through VGAM3 RNA, binds complementarily to a host target binding site located in an untranslated region of VGAM2722 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2722 host target RNA into VGAM2722 host target protein, herein schematically represented by VGAM1 HOST TARGET PROTEIN through VGAM3 HOST TARGET PROTEIN, all of FIG. 1.

VGAM2723 RNA, herein schematically represented by VGAM1 RNA through VGAM3 RNA, binds complementarily to a host target binding site located in an untranslated region of VGAM2723 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2723 host target RNA into VGAM2723 host target protein, herein schematically represented by VGAM1 HOST TARGET PROTEIN through VGAM3 HOST TARGET PROTEIN, all of FIG. 1.

VGAM2724 RNA, herein schematically represented by VGAM1 RNA through VGAM3 RNA, binds complementarily to a host target binding site located in an untranslated region of VGAM2724 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2724 host target RNA into VGAM2724 host target protein, herein schematically represented by VGAM1 HOST TARGET PROTEIN through VGAM3 HOST TARGET PROTEIN, all of FIG. 1.

VGAM2725 RNA, herein schematically represented by VGAM1 RNA through VGAM3 RNA, binds complementarily to a host target binding site located in an untranslated region of VGAM2725 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2725 host target RNA into VGAM2725 host target protein, herein schematically represented by VGAM1 HOST TARGET PROTEIN through VGAM3 HOST TARGET PROTEIN, all of FIG. 1.

It is appreciated that a function of VGR3293 gene, herein designated VGR GENE, is inhibition of expression of host target genes, as part of a novel viral mechanism of attacking a host. Accordingly, utilities of VGR3293 gene include diagnosis, prevention and treatment of viral infection by Aphid Lethal Paralysis Virus. Specific functions, and accordingly utilities, of VGR3293 gene correlate with, and may be deduced from, the identity of the host target genes, which are inhibited by VGAM RNAs comprised in the 'operon-like' cluster of VGR3293 gene: VGAM2719 host target protein, VGAM2720 host target protein, VGAM2721 host target protein, VGAM2722 host target protein, VGAM2723 host target protein, VGAM2724 host target protein and VGAM2725 host target protein, herein schematically represented by VGAM1 HOST TARGET PROTEIN through VGAM3 HOST TARGET PROTEIN. The function of these host target genes is elaborated hereinabove with reference to VGAM2719, VGAM2720, VGAM2721, VGAM2722, VGAM2723, VGAM2724 and VGAM2725. FIG. 9 further provides a conceptual description of novel bioinformatically detected regulatory viral gene, referred to here as Viral Genomic Record 3294(VGR3294) viral gene, which encodes an 'operon-like' cluster of novel viral micro RNA-like genes, each of which in turn modulates expression of at least one host target gene, the function and utility of which at least one host target gene is known in the art.

VGR3294 gene, herein designated VGR GENE, is a novel bioinformatically detected regulatory, non protein coding, RNA viral gene. The method by which VGR3294 gene was detected is described hereinabove with reference to FIGS. 1-9.

VGR3294 gene encodes VGR3294 precursor RNA, herein designated VGR PRECURSOR RNA, an RNA molecule, typically several hundred nucleotides long.

VGR3294 precursor RNA folds spatially, forming VGR3294 folded precursor RNA, herein designated VGR FOLDED PRECURSOR RNA. It is appreciated that VGR3294 folded precursor RNA comprises a plurality of what is known in the art as 'hairpin' structures. These 'hairpin' structures are due to the fact that the nucleotide sequence of VGR3294 precursor RNA comprises a plurality of segments, the first half of each such segment having a nucleotide sequence which is at least a partial inversed-reversed sequence of the second half thereof, as is well known in the art.

VGR3294 folded precursor RNA is naturally processed by cellular enzymatic activity into at least 2 separate VGAM precursor RNAs, VGAM2726 precursor RNA and VGAM2727 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2726 RNA and VGAM2727 RNA, herein schematically represented by VGAM1 RNA through VGAM3 RNA, each of which VGAM RNAs corresponding to VGAM RNA of FIG. 1.

VGAM2726 RNA, herein schematically represented by VGAM1 RNA through VGAM3 RNA, binds complementarily to a host target binding site located in an untranslated region of VGAM2726 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2726 host target RNA into VGAM2726 host target protein, herein schematically represented by VGAM1 HOST TARGET PROTEIN through VGAM3 HOST TARGET PROTEIN, all of FIG. 1.

VGAM2727 RNA, herein schematically represented by VGAM1 RNA through VGAM3 RNA, binds complementarily to a host target binding site located in an untranslated region of VGAM2727 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG.

1, thereby inhibiting translation of VGAM2727 host target RNA into VGAM2727 host target protein, herein schematically represented by VGAM1 HOST TARGET PROTEIN through VGAM3 HOST TARGET PROTEIN, all of FIG. 1.

It is appreciated that a function of VGR3294 gene, herein designated VGR GENE, is inhibition of expression of host target genes, as part of a novel viral mechanism of attacking a host. Accordingly, utilities of VGR3294 gene include diagnosis, prevention and treatment of viral infection by Aphid Lethal Paralysis Virus. Specific functions, and accordingly utilities, of VGR3294 gene correlate with, and may be deduced from, the identity of the host target genes, which are inhibited by VGAM RNAs comprised in the 'operon-like' cluster of VGR3294 gene: VGAM2726 host target protein and VGAM2727 host target protein, herein schematically represented by VGAM1 HOST TARGET PROTEIN through VGAM3 HOST TARGET PROTEIN. The function of these host target genes is elaborated hereinabove with reference to VGAM2726 and VGAM2727. FIG. 9 further provides a conceptual description of novel bioinformatically detected regulatory viral gene, referred to here as Viral Genomic Record 3295(VGR3295) viral gene, which encodes an 'operon-like' cluster of novel viral micro RNA-like genes, each of which in turn modulates expression of at least one host target gene, the function and utility of which at least one host target gene is known in the art.

VGR3295 gene, herein designated VGR GENE, is a novel bioinformatically detected regulatory, non protein coding, RNA viral gene. The method by which VGR3295 gene was detected is described hereinabove with reference to FIGS. 1-9.

VGR3295 gene encodes VGR3295 precursor RNA, herein designated VGR PRECURSOR RNA, an RNA molecule, typically several hundred nucleotides long.

VGR3295 precursor RNA folds spatially, forming VGR3295 folded precursor RNA, herein designated VGR FOLDED PRECURSOR RNA. It is appreciated that VGR3295 folded precursor RNA comprises a plurality of what is known in the art as 'hairpin' structures. These 'hairpin' structures are due to the fact that the nucleotide sequence of VGR3295 precursor RNA comprises a plurality of segments, the first half of each such segment having a nucleotide sequence which is at least a partial inversed-reversed sequence of the second half thereof, as is well known in the art.

VGR3295 folded precursor RNA is naturally processed by cellular enzymatic activity into at least 2 separate VGAM precursor RNAs, VGAM2728 precursor RNA and VGAM2729 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2728 RNA and VGAM2729 RNA, herein schematically represented by VGAM1 RNA through VGAM3 RNA, each of which VGAM RNAs corresponding to VGAM RNA of FIG. 1.

VGAM2728 RNA, herein schematically represented by VGAM1 RNA through VGAM3 RNA, binds complementarily to a host target binding site located in an untranslated region of VGAM2728 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2728 host target RNA into VGAM2728 host target protein, herein schematically represented by VGAM1 HOST TARGET PROTEIN through VGAM3 HOST TARGET PROTEIN, all of FIG. 1.

VGAM2729 RNA, herein schematically represented by VGAM1 RNA through VGAM3 RNA, binds complementarily to a host target binding site located in an untranslated region of VGAM2729 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2729 host target RNA into VGAM2729 host target protein, herein schematically represented by VGAM1 HOST TARGET PROTEIN through VGAM3 HOST TARGET PROTEIN, all of FIG. 1.

It is appreciated that a function of VGR3295 gene, herein designated VGR GENE, is inhibition of expression of host target genes, as part of a novel viral mechanism of attacking a host. Accordingly, utilities of VGR3295 gene include diagnosis, prevention and treatment of viral infection by Aphid Lethal Paralysis Virus. Specific functions, and accordingly utilities, of VGR3295 gene correlate with, and may be deduced from, the identity of the host target genes, which are inhibited by VGAM RNAs comprised in the 'operon-like' cluster of VGR3295 gene: VGAM2728 host target protein and VGAM2729 host target protein, herein schematically represented by VGAM1 HOST TARGET PROTEIN through VGAM3 HOST TARGET PROTEIN. The function of these host target genes is elaborated hereinabove with reference to VGAM2728 and VGAM2729. FIG. 9 further provides a conceptual description of novel bioinformatically detected regulatory viral gene, referred to here as Viral Genomic Record 3296(VGR3296) viral gene, which encodes an 'operon-like' cluster of novel viral micro RNA-like genes, each of which in turn modulates expression of at least one host target gene, the function and utility of which at least one host target gene is known in the art.

VGR3296 gene, herein designated VGR GENE, is a novel bioinformatically detected regulatory, non protein coding, RNA viral gene. The method by which VGR3296 gene was detected is described hereinabove with reference to FIGS. 1-9.

VGR3296 gene encodes VGR3296 precursor RNA, herein designated VGR PRECURSOR RNA, an RNA molecule, typically several hundred nucleotides long.

VGR3296 precursor RNA folds spatially, forming VGR3296 folded precursor RNA, herein designated VGR FOLDED PRECURSOR RNA. It is appreciated that VGR3296 folded precursor RNA comprises a plurality of what is known in the art as 'hairpin' structures. These 'hairpin' structures are due to the fact that the nucleotide sequence of VGR3296 precursor RNA comprises a plurality of segments, the first half of each such segment having a nucleotide sequence which is at least a partial inversed-reversed sequence of the second half thereof, as is well known in the art.

VGR3296 folded precursor RNA is naturally processed by cellular enzymatic activity into at least 2 separate VGAM precursor RNAs, VGAM2730 precursor RNA and VGAM2731 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2730 RNA and VGAM2731 RNA, herein schematically represented by VGAM1 RNA through VGAM3 RNA, each of which VGAM RNAs corresponding to VGAM RNA of FIG. 1.

VGAM2730 RNA, herein schematically represented by VGAM1 RNA through VGAM3 RNA, binds complementarily to a host target binding site located in an untranslated region of VGAM2730 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2730 host target RNA into VGAM2730 host target protein, herein schematically represented by VGAM1 HOST TARGET PROTEIN through VGAM3 HOST TARGET PROTEIN, all of FIG. 1.

VGAM2731 RNA, herein schematically represented by VGAM1 RNA through VGAM3 RNA, binds complementarily to a host target binding site located in an untranslated region of VGAM2731 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2731 host target RNA into VGAM2731 host target protein, herein schematically represented by VGAM1 HOST TARGET PROTEIN through VGAM3 HOST TARGET PROTEIN, all of FIG. 1.

It is appreciated that a function of VGR3296 gene, herein designated VGR GENE, is inhibition of expression of host target genes, as part of a novel viral mechanism of attacking a host. Accordingly, utilities of VGR3296 gene include diagnosis, prevention and treatment of viral infection by Callitrichine Herpesvirus 3. Specific functions, and accordingly utilities, of VGR3296 gene correlate with, and may be deduced from, the identity of the host target genes, which are inhibited by VGAM RNAs comprised in the 'operon-like' cluster of VGR3296 gene: VGAM2730 host target protein and VGAM2731 host target protein, herein schematically represented by VGAM1 HOST TARGET PROTEIN through VGAM3 HOST TARGET PROTEIN. The function of these host target genes is elaborated hereinabove with reference to VGAM2730 and VGAM2731. FIG. 9 further provides a conceptual description of novel bioinformatically detected regulatory viral gene, referred to here as Viral Genomic Record 3297(VGR3297) viral gene, which encodes an 'operon-like' cluster of novel viral micro RNA-like genes, each of which in turn modulates expression of at least one host target gene, the function and utility of which at least one host target gene is known in the art.

VGR3297 gene, herein designated VGR GENE, is a novel bioinformatically detected regulatory, non protein coding, RNA viral gene. The method by which VGR3297 gene was detected is described hereinabove with reference to FIGS. 1-9.

VGR3297 gene encodes VGR3297 precursor RNA, herein designated VGR PRECURSOR RNA, an RNA molecule, typically several hundred nucleotides long.

VGR3297 precursor RNA folds spatially, forming VGR3297 folded precursor RNA, herein designated VGR FOLDED PRECURSOR RNA. It is appreciated that VGR3297 folded precursor RNA comprises a plurality of what is known in the art as 'hairpin' structures. These 'hairpin' structures are due to the fact that the nucleotide sequence of VGR3297 precursor RNA comprises a plurality of segments, the first half of each such segment having a nucleotide sequence which is at least a partial inversed-reversed sequence of the second half thereof, as is well known in the art.

VGR3297 folded precursor RNA is naturally processed by cellular enzymatic activity into at least 6 separate VGAM precursor RNAs, VGAM2733 precursor RNA, VGAM2734 precursor RNA, VGAM2735 precursor RNA, VGAM2736 precursor RNA, VGAM2737 precursor RNA and VGAM2738 precursor RNA, herein schematically represented by VGAM1 FOLDED PRECURSOR through VGAM3 FOLDED PRECURSOR, each of which VGAM precursor RNAs being a hairpin shaped RNA segment, corresponding to VGAM FOLDED PRECURSOR RNA of FIG. 1.

The above mentioned VGAM precursor RNAs are 'diced' by DICER COMPLEX of FIG. 1, yielding respective short RNA segments of about 22 nucleotides in length, VGAM2733 RNA, VGAM2734 RNA, VGAM2735 RNA, VGAM2736 RNA, VGAM2737 RNA and VGAM2738 RNA, herein schematically represented by VGAM1 RNA through VGAM3 RNA, each of which VGAM RNAs corresponding to VGAM RNA of FIG. 1.

VGAM2733 RNA, herein schematically represented by VGAM1 RNA through VGAM3 RNA, binds complementarily to a host target binding site located in an untranslated region of VGAM2733 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2733 host target RNA into VGAM2733 host target protein, herein schematically represented by VGAM1 HOST TARGET PROTEIN through VGAM3 HOST TARGET PROTEIN, all of FIG. 1.

VGAM2734 RNA, herein schematically represented by VGAM1 RNA through VGAM3 RNA, binds complementarily to a host target binding site located in an untranslated region of VGAM2734 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2734 host target RNA into VGAM2734 host target protein, herein schematically represented by VGAM1 HOST TARGET PROTEIN through VGAM3 HOST TARGET PROTEIN, all of FIG. 1.

VGAM2735 RNA, herein schematically represented by VGAM1 RNA through VGAM3 RNA, binds complementarily to a host target binding site located in an untranslated region of VGAM2735 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2735 host target RNA into VGAM2735 host target protein, herein schematically represented by VGAM1 HOST TARGET PROTEIN through VGAM3 HOST TARGET PROTEIN, all of FIG. 1.

VGAM2736 RNA, herein schematically represented by VGAM1 RNA through VGAM3 RNA, binds complementarily to a host target binding site located in an untranslated region of VGAM2736 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2736 host target RNA into VGAM2736 host target protein, herein schematically represented by VGAM1 HOST TARGET PROTEIN through VGAM3 HOST TARGET PROTEIN, all of FIG. 1.

VGAM2737 RNA, herein schematically represented by VGAM1 RNA through VGAM3 RNA, binds complementarily to a host target binding site located in an untranslated region of VGAM2737 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2737 host target RNA into VGAM2737 host target protein, herein schematically represented by VGAM1 HOST TARGET PROTEIN through VGAM3 HOST TARGET PROTEIN, all of FIG. 1.

VGAM2738 RNA, herein schematically represented by VGAM1 RNA through VGAM3 RNA, binds complementarily to a host target binding site located in an untranslated region of VGAM2738 host target RNA, herein schematically represented by VGAM1 HOST TARGET RNA through VGAM3 HOST TARGET RNA, which host target binding site corresponds to a host target binding site such as BINDING SITE I, BINDING SITE II or BINDING SITE III of FIG. 1, thereby inhibiting translation of VGAM2738 host target RNA into VGAM2738 host target protein, herein schematically represented by VGAM1 HOST TARGET PROTEIN through VGAM3 HOST TARGET PROTEIN, all of FIG. 1.

It is appreciated that a function of VGR3297 gene, herein designated VGR GENE, is inhibition of expression of host target genes, as part of a novel viral mechanism of attacking a host. Accordingly, utilities of VGR3297 gene include diagnosis, prevention and treatment of viral infection by Broad Bean Necrosis Virus. Specific functions, and accordingly utilities, of VGR3297 gene correlate with, and may be deduced from, the identity of the host target genes, which are inhibited by VGAM RNAs comprised in the 'operon-like' cluster of VGR3297 gene: VGAM2733 host target protein, VGAM2734 host target protein, VGAM2735 host target protein, VGAM2736 host target protein, VGAM2737 host target protein and VGAM2738 host target protein, herein schematically represented by VGAM1 HOST TARGET PROTEIN through VGAM3 HOST TARGET PROTEIN. The function of these host target genes is elaborated hereinabove with reference to VGAM2733, VGAM2734, VGAM2735, VGAM2736, VGAM2737 and VGAM2738.

It is appreciated by persons skilled in the art that the present invention is not limited by what has been particularly shown and described hereinabove. Rather the scope of the present invention includes both combinations and subcombinations of the various features described hereinabove as well as variations and modifications which would occur to persons skilled in the art upon reading the specifications and which are not in the prior art.

BIBLIOGRAPHY

Zuker, C. S.: On the evolution of eyes: would you like it simpleor compound? Science 265:742-743, 1994.

Sen Gupta, B.; Friedberg, F.; Detera-Wadleigh, S. D.: Molecular analysis of human and rat calmodulin complementary DNA clones: evidence for additional active genes in these species. J. Biol. Chem. 262:16663-16670, 1987.

Jeffrey, P. D.; Russo, A. A.; Polyak, K.; Gibbs, E.; Hurwitz, J.; Massague, J.; Pavletich, N. P.: Mechanism of CDK activation revealed by the structure of a cyclinA-CDK2 complex. Nature 376:313-320,1995.

Fishman, G. I.; Moreno, A. P.; Spray, D. C.; Leinwand, L. A.:Functional analysis of human cardiac gap junction channel mutants. Proc. Nat. Acad. Sci. 88:3525-3529, 1991.

Kida, S.; Josselyn, S. A.; Pena de Ortiz, S.; Kogan, J. H.; Chevere, I.; Masushige, S.; Silva, A. J.: CREB required for the stability of new and reactivated fear memories. Nature Neurosci. 5:348-355,2002.

Yamauchi, M.; Yamauchi, N.; Meuth, M.: Molecular cloning of the human CTP synthetase gene by functional complementation with purified human metaphase chromosomes. EMBO J. 9:2095-2099, 1990.

Holm, C.; Kirchgessner, T. G.; Svenson, K. L.; Fredrikson, G.; Nilsson, S.; Miller, C. G.; Shively, J. E.; Heinzmann, C.; Sparkes, R. S.; Mohandas, T.; Lusis, A. J.; Belfrage, P.; Schotz, M. C.: Hormone-sensitive lipase: sequence, expression, and chromosomal localization to 19cent-q13.3. Science 241:1503-1506, 1988.

Sander, M.; Chavoshan, B.; Harris, S. A.; Iannaccone, S. T.; Stull, J. T.; Thomas, G. D.; Victor, R. G.: Functional muscle ischemia inneuronal nitric oxide synthase-deficient skeletal muscle of children with Duchenne muscular dystrophy. Proc. Nat. Acad. Sci. 97:13818-13823,2000.

Eiberg, H.; Mohr, J.; Schmiegelow, K.; Nielsen, L. S.; Williamson, R.: Linkage relationships of paraoxonase (PON) with other markers:indication of PON-cystic fibrosis synteny. Clin. Genet. 28:265-271,1985.

Berger, J.; Garattini, E.; Hua, J.-C.; Udenfriend, S.: Cloningand sequencing of human intestinal alkaline phosphatase cDNA. Proc. Nat. Acad. Sci. 84:695-698, 1987.

Simard, J.; Berube, D.; Sandberg, M.; Grzeschik, K.-H.; Gagne, R.; Hansson, V.; Jahnsen, T.: Assignment of the gene encoding the catalytic subunit C-beta of cAMP-dependent protein kinase to the p36 band on chromosome 1. Hum. Genet. 88:653-657, 1992.

Grimmond, S.; Van Hateren, N.; Siggers, P.; Arkell, R.; Larder, R.; Soares, M. B.; de Fatima Bonaldo, M.; Smith, L.; Tymowska-Lalanne, Z.; Wells, C.; Greenfield, A.: Sexually dimorphic expression of proteasenexin-1 and vanin-1 in the developing mouse gonad prior to overt differentiationsuggests a role in mammalian sexual development. Hum. Molec. Genet. 9:1553-1560, 2000.

ADHR Consortium: Autosomal dominant hypophosphataemic rickets is associated with mutations in FGF23. Nature Genet. 26:345-348,2000.

Conlon, M. G.; Tomasini, B. R.; Schultz, R. L.; Mosher, D. F.:Plasma vitronectin polymorphism in normal subjects and patients with disseminated intravascular coagulation. Blood 72:185-190, 1988.

Fink, T. M.; Jenne, D. E.; Lichter, P.: The human vitronectin (complement S-protein) gene maps to the centromeric region of 17q. Hum. Genet. 88:569-572, 1992.

Jenne, D.; Stanley, K. K.: Molecular cloning of S-protein, a link between complement, coagulation and cell-substrate adhesion. EMBO J. 4:3153-3157, 1985.

Kubota, K.; Katayama, S.; Matsuda, M.; Hayashi, M.: Three types of vitronectin in human blood. Cell Struct. Funct. 13:123-128,1988.

Preissner, K. T.; Heimburger, N.; Anders, E.; Muller-Berghaus, G.: Physicochemical, immunological and functional comparison of human S-protein and vitronectin: evidence for the identity of both plasmaproteins. Biochem. Biophys. Res. Commun. 134:951-956, 1986.

Sun, W. H.; Mosher, D. F.: Polymorphism of vitronectin. (Letter) Blood 73:353-354, 1989.

Gao, Y.; Ferguson, D. O.; Xie, W.; Manis, J. P.; Sekiguchi, J.; Frank, K. M.; Chaudhuri, J.; Horner, J.; DePinho, R. A.; Alt, F. W.: Interplay of p53 and DNA-repair protein XRCC4 in tumorigenesis, genomic stability and development. Nature 404:897-900, 2000.

Kaname, T.; Miyauchi, T.; Kuwano, A.; Matsuda, Y.; Muramatsu, T.; Kajii, T.: Mapping basigin (BSG), a member of the immunoglobulin superfamily, to 19p13.3. Cytogenet. Cell Genet. 64:195-197, 1993.

Kanekura, T.; Miyauchi, T.; Tashiro, M.; Muramatsu, T.: Basigin, a new member of the immunoglobulin superfamily: genes in different mammalian species, glycosylation changes in the molecule from adultorgans and possible variation in the N-terminal sequences. Cell Struct. Funct. 16:23-30, 1991.

Kuno, N.; Kadomatsu, K.; Fan, Q.-W.; Hagihara, M.; Senda, T.; Mizutani, S.; Muramatsu, T.: Female sterility in mice lacking the basigin gene, which encodes a transmembrane glycoprotein belonging to the immunoglobulin superfamily. FEBS Lett. 425:191-194, 1998.

Miyauchi, T.; Kanekura, T.; Yamaoka, A.; Ozawa, M.; Miyazawa, S.; Muramatsu, T.: Basigin, a new, broadly distributed member of the immunoglobulin superfamily, has strong homology with both the immunoglobulinV domain and the beta-chain of major histocompatibility complex classII antigen. J. Biochem. 107:316-323, 1990.

Miyauchi, T.; Masuzawa, Y.; Muramatsu, T.: The basigin group of the immunoglobulin superfamily: complete conservation of a segmentin and around transmembrane domains of human and mouse basigin andchicken HT7 antigen. J. Biochem. 110:770-774, 1991.

Naruhashi, K.; Kadomatsu, K.; Igakura, T.; Fan, Q.-W.; Kuno, N.; Muramatsu, H.; Miyauchi, T.; Hasegawa, T.; Itoh, A.; Muramatsu, T.; Nabeshima, T.: Abnormalities of sensory and memory functions in micelacking Bsg gene. Biochem. Biophsy. Res. Commun. 236:733-737, 1997.

Patten, J. L.; Smallwood, P. M.; Eil, C.; Johns, D. R.; Valle, D.; Steel, G.; Levine, M. A.: An initiator codon mutation in the gene encoding the alpha subunit of Gs in pseudohypoparathyroidismtype IA (PHP IA). (Abstract) Am. J. Hum. Genet. 45 (suppl.): A212 only, 1989.

Yu, S.; Yu, D.; Lee, E.; Eckhaus, M.; Lee, R.; Corria, Z.; Accili, D.; Westphal, H.; Weinstein, L. S.: Variable and tissue-specifichormone resistance in heterotrimeric Gs protein alpha-subunit (Gs-alpha) knockout mice is due to tissue-specific imprinting of the Gs-alphagene. Proc. Nat. Acad. Sci. 95:8715-8720, 1998.

Shozu, M.; Akasofu, K.; Harada, T.; Kubota, Y.: A new cause offemale pseudohermaphroditism: placental aromatase deficiency. J. Clin. Endocr. Metab. 72:560-566, 1991.

Gorn, A. H.; Rudolph, S. M.; Flannery, M. R.; Morton, C. C.; Weremowicz, S.; Wang, J.-T.; Krane, S. M.; Goldring, S. R.: Expression of two human skeletal calcitonin receptor isoforms cloned from a giant cell tumor of bone. J. Clin. Invest. 95:2680-2691, 1995.

Dudhia, J.; Bayliss, M. T.; Hardingham, T. E.: Human link protein gene: structure and transcription pattern in chondrocytes. Biochem. J. 303:329-333, 1994.

Dalla Venezia, N.; Gilsanz, F.; Alloisio, N.; Ducluzeau, M.-T.; Benz, E. J., Jr.; Delaunay, J.: Homozygous 4.1(-) hereditary elliptocytosis associated with a point mutation in the downstream initiation codon of protein 4.1 gene. J. Clin. Invest. 90:1713-1717, 1992.

Elliott, K. J.; Ellis, S. B.; Berckhan, K. J.; Urrutia, A.; Chavez-Noriega, L. E.; Johnson, E. C.; Velicelebi, G.; Harpold, M. M.: Comparative structure of human neuronal alpha (2)-alpha (7) and beta (2)-beta (4) nicotinic acetylcholine receptor subunits and functional expression of the alpha (2), alpha (3), alpha (4), alpha (7), beta (2), and beta (4) subunits. J. Molec. Neurosci. 7:217-228, 1996.

Budarf, M. L.; Korenberg, J. R.; Simon, M.; Emanuel, B. S.: Regional assignment of the guanine nucleotide binding protein, GNAZ, to chromosome 22 (22q11.1-q11.2). (Abstract) Cytogenet. Cell Genet. 58:2046-2047,1991.

Jayawardena-Wolf, J.; Benlagha, K.; Chiu, Y.-H.; Mehr, R.; Bendelac, A.: CD1d endosomal trafficking is independently regulated by an intrinsicCD1d-encoded tyrosine motif and by the invariant chain. Immunity 15:897-908, 2001.

Yang, W.-S.; Nevin, D. N.; Peng, R.; Brunzell, J. D.; Deeb, S. S.: A mutation in the promoter of the lipoprotein lipase (LPL) genein a patient with familial combined hyperlipidemia and low LPL activity. Proc. Nat. Acad. Sci. 92:4462-4466, 1995.

Lloyd, A.; Modi, W.; Sprenger, H.; Cevario, S.; Oppenheim, J.; Kelvin, D.: Assignment of genes for interleukin-8 receptors (IL8R) A and B to human chromosome band 2q35. Cytogenet. Cell Genet. 63:238-240, 1993.

Murgia, C.; Blaikie, P.; Kim, N.; Dans, M.; Petrie, H. T.; Giancotti, F. G.: Cell cycle and adhesion defects in mice carrying a targeted deletion of the integrin beta-4 cytoplasmic domain. EMBO J. 17:3940-3951, 1998.

Bouhouche, A.; Benomar, A.; Birouk, N.; Mularoni, A.; Meggouh, F.; Tassin, J.; Grid, D.; Vandenberghe, A.; Yahyaoui, M.; Chkili, T.; Brice, A.; LeGuern, E.: A locus for an axonal form of autosomal recessive Charcot-Marie-Tooth disease maps to chromosome 1q21.2-q21.3. Am. J. Hum. Genet. 65:722-727, 1999.

Curran, M. E.; Splawski, I.; Timothy, K. W.; Vincent, G. M.; Green, E. D.; Keating, M. T.: A molecular basis for cardiac arrhythmia: HERG mutations cause long QT syndrome. Cell 80:795-803, 1995.

Harada, T.; Harada, C.; Nakayama, N.; Okuyama, S.; Yoshida, K.; Kohsaka, S.; Matsuda, H.; Wada, K.: Modification of glial-neuronalcell interactions prevents photoreceptor apoptosis during light-inducedretinal degeneration. Neuron 26:533-541, 2000.

Barnett, T.; Goebel, S. J.; Nothdurft, M. A.; Elting, J. J.: Carcinoembryonic antigen family: characterization of cDNAs coding for NCA and CEA and suggestion of nonrandom sequence variation in their conserved loop-domains. Genomics 3:59-66, 1988.

Bonaiti-Pellie, C.; Briard-Guillemot, M. L.; Feingold, J.; Frezal, J.: Associated congenital malformations in retinoblastoma. Clin. Genet. 7:37-39, 1975.

Radford, D. M.; Nakai, H.; Pegg, A. E.; Shows, T. B.: Mapping genes for rate-limiting enzymes in polyamine biosynthesis. (Abstract) Am. J. Hum. Genet. 41:A35 only, 1987.

Ruppert, J. M.; Kinzler, K. W.; Wong, A. J.; Bigner, S. H.; Kao, F.-T.; Law, M. L.; Seuanez, H. N.; O'Brien, S. J.; Vogelstein, B.: The GLI-Kruppel family of human genes. Molec. Cell. Biol. 8:3104-3113,1988.

Grachtchouk, M.; Mo, R.; Yu, S.; Zhang, X.; Sasaki, H.; Hui, C.; Dlugosz, A. A.: Basal cell carcinomas in mice overexpressing Gli2in skin. (Letter) Nature Genet. 24:216-217, 2000.

Matsumoto, N.; Fujimoto, M.; Kato, R.; Niikawa, N.: Assignmentof the human GLI2 gene to 2q14 by fluorescence in situ hybridization. Genomics 36:220-221, 1996.

Ishikawa, T.; Kibe, T.; Wada, Y.: Deletion of small nuclear ribonucleoprotein polypeptide N (SNRPN) in Prader-Willi syndrome detected by fluorescencein situ hybridization: two sibs with the typical phenotype without a cytogenetic deletion in chromosome 15q. Am. J. Med. Genet. 62:350-352, 1996.

Gubina, E.; Ruiz-Hidalgo, M. J.; Baladron, V.; Laborda, J.: Assignment of DLK1 to human chromosome band 14q32 by in situ hybridization. Cytogenet. Cell Genet. 84:206-207, 1999.

Helman, L. J.; Thiele, C. J.; Linehan, W. M.; Nelkin, B. D.; Baylin, S. B.; Israel, M. A.: Molecular markers of neuroendocrine development and evidence of environmental regulation. Proc. Nat. Acad. Sci. 84:2336-2339, 1987.

Aguzzi, A.: Personal Communication. Zurich, Switzerland Mar. 20, 1997.

Aguzzi, A.; Brandner, S.: The genetics of prions--a contradiction in terms? Lancet 354:22-25, 1999.

Basler, K.; Oesch, B.; Scott, M.; Westaway, D.; Walchli, M.; Groth, D. F.; McKinley, M. P.; Prusiner, S. B.; Weissmann, C.: Scrapie and cellular PrP isoforms are encoded by the same chromosomal gene. Cell 46:417-428, 1986.

Jensen, C. H.; Krogh, T. N.; Hojrup, P.; Clausen, P. P.; Skjodt, K.; Larsson, L.-I.; Enghild, J. J.; Teisner, B.: Protein structure of fetal antigen 1 (FA1): a novel circulating human epidermal-growth-factor-like protein expressed in neuroendocrine tumors and its relation to the gene products of dlk and pG2. Europ. J. Biochem. 225:83-92, 1994.

Bertoni, J. M.; Brown, P.; Goldfarb, L. G.; Rubenstein, R.; Gajdusek, D. C.: Familial Creutzfeldt-Jakob disease (codon 200 mutation) with supranuclear palsy. J. A. M. A. 268:2413-2415, 1992.

Beyreuther, K.; Masters, C. L.: Catching the culprit prion. Nature 370:419-420, 1994.

Bosque, P. J.; Vnencak-Jones, C. L.; Johnson, M. D.; Whitlock, J. A.; McLean, M. J.: A PrP gene codon 178 base substitution and a 24-bp interstitial deletion in familial Creutzfeldt-Jakob disease. Neurology 42:1864-1870, 1992.

Bounhar, Y.; Zhang, Y.; Goodyer, C. G.; LeBlanc, A.: Prion protein protects human neurons against Bax-mediated apoptosis. J. Biol. Chem. 276:39145-39149, 2001.

Brown, P.; Galvez, S.; Goldfarb, L. G.; Nieto, A.; Cartier, L.; Gibbs, C. J., Jr.; Gajdusek, D. C.: Familial Creutzfeldt-Jakob disease in Chile is associated with the codon 200 mutation of the PRNP amyloid precursor gene on chromosome 20. J. Neurol. Sci. 112:65-67, 1992.

Brown, P.; Goldfarb, L. G.; Gajdusek, D. C.: The new biology of spongiform encephalopathy: infectious amyloidoses with a genetic twist. Lancet 337:1019-1022, 1991.

Brown, P.; Goldfarb, L. G.; Kovanen, J.; Haltia, M.; Cathala, F.; Sulima, M.; Gibbs, C. J., Jr.; Gajdusek, D. C.: Phenotypic characteristics of familial Creutzfeldt-Jakob disease associated with the codon 178-asn PRNP mutation. Ann. Neurol. 31:282-285, 1992.

Brown, P.; Goldfarb, L. G.; McCombie, W. R.; Nieto, A.; Squillacote, D.; Sheremata, W.; Little, B. W.; Godec, M. S.; Gibbs, C. J., Jr.; Gajdusek, D. C.: Atypical Creutzfeldt-Jakob disease in an American family with an insert mutation in the PRNP amyloid precursor gene. Neurology 42:422-427, 1992.

Bueler, H.; Aguzzi, A.; Sailer, A.; Greiner, R.-A.; Autenried, P.; Aguet, M.; Weissman, C.: Mice devoid of PrP are resistant to scrapie. Cell 73:1339-1347, 1993.

Bueler, H.; Raeber, A.; Sailer, A.; Fischer, M.; Aguzzi, A.; Weissmann, C.: High prion and PrP(Sc) levels but delayed onset of disease in scrapie-inoculated mice heterozygous for a disrupted PrP gene. Molec. Med. 1:19-30, 1994.

Campbell, T. A.; Palmer, M. S.; Will, R. G.; Gibb, W. R. G.; Luthert, P. J.; Collinge, J.: A prion disease with a novel 96-base pair insertional mutation in the prion protein gene. Neurology 46:761-766, 1996.

Carlson, G. A.; Kingsbury, D. T.; Goodman, P. A.; Coleman, S.; Marshall, S. T.; DeArmond, S.; Westaway, D.; Prusiner, S. B.: Linkage of prion protein and scrapie incubation time genes. Cell 46:503-511, 1986.

Chapman, J.; Arlazoroff, A.; Goldfarb, L. G.; Cervenakova, L.; Neufeld, M. Y.; Werber, E.; Herbert, M.; Brown, P.; Gajdusek, D. C.; Korczyn, A. D.: Fatal insomnia in a case of familial Creutzfeldt-Jakob disease with the codon 200(lys) mutation. Neurology 46:758-761, 1996.

Chapman, J.; Ben-Israel, J.; Goldhammer, Y.; Korczyn, A. D.: The risk of developing Creutzfeldt-Jakob disease in subjects with the PRNP gene codon 200 point mutation. Neurology 44:1683-1686, 1994.

Chapman, J.; Brown, P.; Rabey, J. M.; Goldfarb, L. G.; Inzelberg, R.; Gibbs, C. J., Jr.; Gajdusek, D. C.; Korczyn, A. D.: Transmission of spongiform encephalopathy from a familial Creutzfeldt-Jakob disease patient of Jewish Libyan origin carrying the PRNP codon 200 mutation. Neurology 42:1249-1250, 1992.

Chapman, J.; Korczyn, A. D.: Genetic and environmental factors determining the development of Creutzfeldt-Jakob disease in Libyan Jews. Neuroepidemiology 10:228-231, 1991.

Chiesa, R.; Drisaldi, B.; Quaglio, E.; Migheli, A.; Piccardo, P.; Ghetti, B.; Harris, D. A.: Accumulation of protease-resistant prion protein (PrP) and apoptosis of cerebellar granule cells in transgenic mice expressing a PrP insertional mutation. Proc. Nat. Acad. Sci. 97:5574-5579, 2000.

Chiesa, R.; Piccardo, P.; Ghetti, B.; Harris, D. A.: Neurological illness in transgenic mice expressing a prion protein with an insertional mutation. Neuron 21:1339-1351, 1998.

Collinge, J.: Human prion diseases and bovine spongiform encephalopathy (BSE). Hum. Mol. Genet. 6:1699-1705, 1997.

Collinge, J.; Harding, A. E.; Owen, F.; Poulter, M.; Lofthouse, R.; Boughey, A. M.; Shah, T.; Crow, T. J.: Diagnosis of Gerstmann-Straussler syndrome in familial dementia with prion protein gene analysis. Lancet II:15-17, 1989.

Collinge, J.; Brown, J.; Hardy, J.; Mullan, M.; Rossor, M. N.; Baker, H.; Crow, T. J.; Lofthouse, R.; Poulter, M.; Ridley, R.; Owen, F.; Bennett, C.; Dunn, G.; Harding, A. E.; Quinn, N.; Doshi, B.; Roberts, G. W.; Honavar, M.; Janota, I.; Lantos, P. L.: Inherited prion disease with 144 base pair gene insertion. 2. Clinical and pathological features. Brain 115:687-710, 1992.

Collinge, J.; Owen, F.; Poulter, M.; Leach, M.; Crow, T. J.; Rossor, M. N.; Hardy, J.; Mullan, M. J.; Janota, I.; Lantos, P. L.: Prion dementia without characteristic pathology. Lancet 336:7-9, 1990.

Collinge, J.; Palmer, M. S.; Dryden, A. J.: Genetic predisposition to iatrogenic Creutzfeldt-Jakob disease. Lancet 337:1441-1442, 1991.

Collinge, J.; Poulter, M.; Davis, M. B.; Baraitser, M.; Owen, F.; Crow, T. J.; Harding, A. E.: Presymptomatic detection or exclusion of prion protein gene defects in families with inherited prion diseases. Am. J. Hum. Genet. 49:1351-1354, 1991.

Collinge, J.; Whittington, M.; Sidle, K. C. L.; Smith, C. J.; Palmer, M.; Clarke, A. R.; Jefferys, J. G. R.: Prion protein is necessary for normal synaptic function. (Letter) Nature 370:295-297, 1994.

Schulz, P.; Stucka, R.; Feldmann, H.; Combriato, G.; Klobeck, H.-G.; Fittler, F.: Sequence of a cDNA clone encompassing the complete mature human prostate specific antigen (PSA) and an unspliced leader sequence. Nucleic Acids Res. 16:6226 only, 1988.

Sutherland, G. R.; Baker, E.; Hyland, V. J.; Callen, D. F.; Close, J. A.; Tregear, G. W.; Evans, B. A.; Richards, R. I.: Human prostate-specific antigen (APS) is a member of the glandular kallikrein gene family at 19q13. Cytogenet. Cell Genet. 48:205-207, 1988.

Bookstein, R.; Lee, E. Y.-H. P.; To, H.; Young, L.-J.; Sery, T. W.; Hayes, R. C.; Friedmann, T.; Lee, W.-H.: Human retinoblastoma susceptibility gene: genomic organization and analysis of heterozygous intragenic deletion mutants. Proc. Nat. Acad. Sci. 85:2210-2214,1988.

Brantley, M. A.; Worley, L.; Harbour, J. W.: Altered expression of Rb and p53 in uveal melanomas following plaque radiotherapy. Am. J. Ophthal. 133:242-248, 2002.

Bremner, R.; Du, D. C.; Connolly-Wilson, M. J.; Bridge, P.; Ahmad, K. F.; Mostachfi, H.; Rushlow, D.; Dunn, J. M.; Gallie, B. L.: Deletion of RB exons 24 and 25 causes lowpenetrance retinoblastoma. Am. J. Hum. Genet. 61:556-570, 1997.

Briard-Guillemot, M. L.; Bonaiti-Pellie, C.; Feingold, J.; Frezal, J.: Etude genetique du retinoblastome. human genetik 24:271-284,1974.

Brownstein, S.; de Chadarevian, J.-P.; Little, J. M.: Trilateralretinoblastoma: report of two cases. Arch. Ophthal. 102: 257-262,1984.

Buchkovich, K.; Duffy, L. A.; Harlow, E.: The retinoblastomaprotein is phosphorylated during specific phases of the cell cycle. Cell 58:1097-1105, 1989.

Scarpati, E. M.; Sadler, J. E.; O'Connell, P.; Nakamura, Y.; Leppert, M.; Ballard, L.; Lathrop, G. M.; Lalouel, J.-M.; White, R.: Identification and mapping of RFLPs for human tissue factor (HTF) to chromosome 1p. NucleicAcids Res. 15:9098 only, 1987.

Scarpati, E. M.; Wen, D.; Broze, G. J., Jr.; Miletich, J. P.; Flandermeyer, R. R.; Siegel, N. R.; Sadler, J. E.: Human tissue factor: cDNA sequence and chromosome localization of the gene. Biochemistry 26:5234-5238,1987.

Spicer, E. K.; Horton, R.; Bloem, L.; Bach, R.; Williams, K. R.; Guha, A.; Kraus, J.; Lin, T.-C.; Nemerson, Y.; Konigsberg, W. H.:Isolation of cDNA clones coding for human tissue factor: primary structure of the protein and cDNA. Proc. Nat. Acad. Sci. 84:5148-5152, 1987.

Toomey, J. R.; Kratzer, K. E.; Lasky, N. M.; Broze, G. J., Jr.: Effect of tissue factor deficiency on mouse and tumor development. Proc. Nat. Acad. Sci. 94:6922-6926, 1997.

Lohr, G. W.; Waller, H. D.: Zur Biochemie einiger angeborenerhaemolytischer Anaemien. Folia Haemat. 8:377-397, 1963.

Chu, F.-F.: The human glutathione peroxidase genes GPX2, GPX3, and GPX4 map to chromosomes 14, 5, and 19, respectively. Cytogenet. Cell Genet. 66:96-98, 1994.

Seldin, M. F.: Personal Communication. Durham, N. C. Mar. 13, 1989.

Carson, S. D.; Henry, W. M.; Haley, L.; Byers, M.; Shows, T.:The gene for tissue factor (coagulation factor III) is localized on human chromosome 1pter-1p21. (Abstract) Cytogenet. Cell Genet. 40:600 only, 1985.

Carson, S. D.; Henry, W. M.; Shows, T. B.: Tissue factor genelocalized to humanchromosome 1 (1pter-1p21). Science 229:991-993,1985.

Kao, F.-T.; Hartz, J.; Horton, R.; Nemerson, Y.; Carson, S. D.: Regional assignment of human tissue factor gene (F3) to chromosome 1p21-p22. Somat. Cell Molec. Genet. 14:407-410, 1988.

Mackman, N.; Fowler, B. J.; Edgington, T. S.; Morrissey, J. H.: Functional analysis of the human tissue factor promoter and induction by serum. Proc. Nat. Acad. Sci. 87:2254-2258, 1990.

Wroe, S. F.; Kelsey, G.; Skinner, J. A.; Bodle, D.; Ball, S. T.; Beechey, C. V.; Peters, J.; Williamson, C. M.: An imprinted transcript, antisense to Nesp, adds complexity to the cluster of imprinted genes at the mouse Gnas locus. Proc. Nat. Acad. Sci. 97:3342-3346, 2000.

Wrong, O.: Tegernsee giant. (Letter) Lancet 339:194 only, 1992.

Yang, I.; Park, S.; Ryu, M.; Woo, J.; Kim, S.; Kim, J.; Kim, Y.; Choi, Y.: Characteristics of gsp-positive growth hormone-secretingpituitary tumors in Korean acromegalic patients. Europ. J. Endocr. 134:720-726, 1996.

Yu, D.; Yu, S.; Schuster, V.; Kruse, K.; Clericuzio, C. L.; Weinstein, L. S.: Identification of two novel deletion mutations within theGs-alpha gene (GNAS1) in Albright hereditary osteodystrophy. J. Clin. Endocr. Metab. 84:3254-3259, 1999.

Lerman, M. I.; Minna, J. D.: The 630-kb lung cancer homozygous deletion region on human chromosome 3p21.3: identification and evaluation of the resident candidate tumor suppressor genes. Cancer Res. 60:6116-6133, 2000.

Hobbs, H. H.; Leitersdorf, E.; Leffert, C. C.; Cryer, D. R.; Brown, M. S.; Goldstein, J. L.: Evidence for a dominant gene that suppresseshypercholesterolemia in a family with defective low density lipoproteinreceptors. J. Clin. Invest. 84:656-664, 1989.

Auffray, C.; Korman, A. J.; Roux-Dosseto, M.; Bono, R.; Strominger, J. L.: cDNA clone for the heavy chain of the human B cell alloantigen DC1: strong sequence homology to the HLA-DR heavy chain. Proc. Nat. Acad. Sci. 79:6337-6341, 1982.

Benacerraf, B.: Role of MHC gene products in immune response. (Nobel Lecture). Science 212:1229-1238, 1981.

Bono, M. R.; Strominger, J. L.: Direct evidence of homology between DC-1 antigen and murine I-A molecules. Nature 299:836-840, 1982.

Bradley, D. S.; Nabozny, G. H.; Cheng, S.; Zhou, P.; Griffiths, M. M.; Luthra, H. S.; David, C. S.: HLA-DQB1 polymorphism determines incidence, onset, and severity of collagen-induced arthritis in transgenic mice: implications in human rheumatoid arthritis. J. Clin. Invest. 100:2227-2234, 1997.

Briata, P.; Radka, S. F.; Sartoris, S.; Lee, J. S.: Alternativesplicing of HLA-DQB transcripts and secretion of HLA-DQ beta-chainproteins: allelic polymorphism in splicing and polyadenylylation (sic) sites. Proc. Nat. Acad. Sci. 86:1003-1007, 1989.

Cohen, D.; Cohen, O.; Marcadet, A.; Massart, C.; Lathrop, M.; Deschamps, I.; Hors, J.; Schuller, E.; Dausset, J.: Class II HLA-DC beta-chainDNA restriction fragments differentiate among HLA-DR2 individualsin insulin-dependent diabetes and multiple sclerosis. Proc. Nat. Acad. Sci. 81:1774-1778, 1984.

Corte, G.; Calabi, F.; Damiani, G.; Bargellesi, A.; Tosi, R.; Sorrentino, R.: Human Ia molecules carrying DC1 determinants differ in both alpha-and beta-subunits from Ia molecules carrying DR determinants. Nature 292:357-360, 1981.

Cucca, F.; Lampis, R.; Congia, M.; Angius, E.; Nutland, S.; Bain, S. C.; Barnett, A. H.; Todd, J. A.: A correlation between the relativepre disposition of MHC class II alleles to type 1 diabetes and the structure of their proteins. Hum. Molec. Genet. 10:2025-2037, 2001.

Duquesnoy, R. J.; Marrari, M.; Annen, K.: Identification of anHLA-DR associated system of B cell alloantigens. Transplant. Proc. 11:1757-1760, 1979.

Gyllensten, U. B.; Erlich, H. A.: Generation of single-stranded DNA by the polymerase chain reaction and its application to direct sequencing of the HLA-DQA locus. Proc. Nat. Acad. Sci. 85:7652-7656,1988.

Helmuth, R.; Fildes, N.; Blake, E.; Luce, M. C.; Chimera, J.; Madej, R.; Gorodezky, C.; Stoneking, M.; Schmill, N.;

Klitz, W.; Higuchi, R.; Erlich, H. A.: HLA-DQ-alpha allele and genotype frequencies invarious human populations, determined by using enzymatic amplification and oligonucleotide probes. Am. J. Hum. Genet. 47:515-523, 1990.

Hsu, S. H.; Chan, M. M.; Bias, W. B.: Genetic control of major histocompatibility complex-linked immune responses to synthetic polypeptides in man. Proc. Nat. Acad. Sci. 78:440-444, 1981.

Kwok, W. W.; Lotshaw, C.; Milner, E. C. B.; Knitter-Jack, N.; Nepom, G. T.: Mutational analysis of the HLA-DQ3.2 insulin-dependent diabetes mellitus susceptibility gene. Proc. Nat. Acad. Sci. 86:1027-1030, 1989.

Lambert, N. C.; Evans, P. C.; Hashizumi, T. L.; Maloney, S.; Gooley, T.; Furst, D. E.; Nelson, J. L.: Cutting edge: persistent fetal microchimerismin T lymphocytes is associated with HLA-DQA1*0501: implications inautoimmunity. J. Immun. 164:5545-5548, 2000.

Levine, F.; Mach, B.; Long, E.; Erlich, H.; Pious, D.: Mappingin the HLA-D region with deletion variants and cloned genes. (Abstract) Cytogenet. Cell Genet. 37:523, 1984.

Meyer, C. G.; Gallin, M.; Erttmann, K. D.; Brattig, N.; Schnittger, L.; Gelhaus, A.; Tannich, E.; Begovich, A. B.; Erlich, H. A.; Horstmann, R. D.: HLA-D alleles associated with generalized disease, localized disease, and putative immunity in Onchocerca volvulus infection. Proc. Nat. Acad. Sci. 91:7515-7519, 1994.

Moriuchi, J.; Moriuchi, T.; Silver, J.: Nucleotide sequence ofan HLA-DQ alpha chain derived from a DRw9 cell line: genetic and evolutionary implications. Proc. Nat. Acad. Sci. 82:3420-3424, 1985.

Nabozny, G. H.; Baisch, J. M.; Cheng, S.; Cosgrove, D.; Griffiths, M. M.; Luthra, H. S.; David, C. S.: HLA-DQ8 transgenic mice are highly susceptible to collagen-induced arthritis: a novel model for human polyarthritis. J. Exp. Med. 183:27-37, 1996.

Nadler, L. M.; Stashenko, P.; Hardy, R.; Tomaselli, K. J.; Yunis, E. J.; Schlossman, S. F.; Pesando, J. M.: Monoclonal antibody identifiesa new Ia-like (p29,34) polymorphic system linked to the HLA-D/DR region. Nature 290:591-593, 1981.

Okada, K.; Boss, J. M.; Prentice, H.; Spies, T.; Mengler, R.; Auffray, C.; Lillie, J.; Grossberger, D.; Strominger, J. L.: Geneorganization of DC and DX subregions of the human major histocompatibility complex. Proc. Nat. Acad. Sci. 82:3410-3414, 1985.

Schenning, L.; Larhammar, D.; Bill, P.; Wiman, K.; Jonsson, A.-K.; Rask, L.; Peterson, P. A.: Both alpha and beta chains of HLA-DC classII histocompatibility antigens display extensive polymorphism in theiramino-terminal domains. EMBO J. 3:447-452, 1984.

Shackelford, D. A.; Kaufman, J. F.; Korman, A. J.; Strominger, J. L.: HLA-DR antigens: structure, separation of subpopulations, gene cloning and function. Immun. Rev. 66:129-183, 1982.

Erneux, C.; Roeckel, N.; Takazawa, K.; Mailleux, P.; Vassart, G.; Mattei, M. G.: Localization of the genes for human inositol 1,4,5-trisphosphate3-kinase A (ITPKA) and B (ITPKB) to chromosome regions 15q14-q21 and1q41-q43, respectively, by in situ hybridization. Genomics 14:546-547, 1992.

Takazawa, K.; Perret, J.; Dumont, J. E.; Erneux, C.: molecular cloning and expression of a new putative inositol 1,4,5-trisphosphate3-kinase isoenzyme. Biochem. J. 278:883-886, 1991.

't Hart, L. M.; Stolk, R. P.; Dekker, J. M.; Nijpels, G.; Grobbee, D. E.; Heine, R. J.; Maassen, J. A.: Prevalence of variants in candidategenes for type 2 diabetes mellitus in the Netherlands: the Rotterdamstudy and the Hoorn study. J. Clin. Endocr. Metab. 84:1002-1006,1999.

Abe, H.; Yamada, N.; Kamata, K.; Kuwaki, T.; Shimada, M.; Osuga, J.; Shionoiri, F.; Yahagi, N.; Kadowaki, T.; Tamemoto, H.; Ishibashi, S.; Yazaki, Y.; Makuuchi, M.: Hypertension, hypertriglyceridemia, and impaired endothelium-dependent vascular relaxation in mice lacking insulin receptor substrate-1. J. Clin. Invest. 101:1784-1788, 1998.

Almind, K.; Bjorbaek, C.; Vestergaard, H.; Hansen, T.; Echwald, S.; Pedersen, O.: Amino acid polymorphisms of insulin receptor substrate-1in non-insulin-dependent diabetes mellitus. Lancet 342:828-832,1993.

Almind, K.; Inoue, G.; Pedersen, O.; Kahn, C. R.: A common aminoacid polymorphism in insulin receptor substrate-1 causes impaired insulin signaling: evidence from transfection studies. J. Clin. Invest. 97:2569-2575, 1996.

Araki, E.; Sun, X.-J.; Haag, B. L., III; Chuang, L.-M.; Zhang, Y.; Yang-Feng, T. L.; White, M. F.; Kahn, C. R.: Human skeletal muscleinsulin receptor substrate-1: characterization of the cDNA, gene, and chromosomal localization. Diabetes 42:1041-1054, 1993.

Baroni, M. G.; d'Andrea, M. P.; Montali, A.; Pannitteri, G.; Barilla, F.; Campagna, F.; Mazzei, E.; Lovari, S.; Seccareccia, F.; Campa, P. P.; Ricci, G.; Pozzilli, P.; Urbinati, G.; Arca, M.: A common mutation of the insulin receptor substrate-1 gene is a risk factorfor coronary artery disease. Arterioscler. Thromb. Vasc. Biol. 19:2975-2980, 1999.

Bohni, R.; Riesgo-Escovar, J.; Oldham, S.; Brogiolo, W.; Stocker, H.; Andruss, B. F.; Beckingham, K.; Hafen, E.: Autonomous control of cell and organ size by CHICO, a Drosophila homolog of vertebrate IRS1-4. Cell 97:865-875, 1999.

Fletcher, W. H.; Britz-Cunningham, S. H.; Zuppan, C. W.: Connexin 43 mutations in sporadic and familial defects of laterality. (Letter) NewEng. J. Med. 333:941-942, 1995.

Gebbia, M.; Towbin, J. A.; Casey, B.: Failure to detect Connexin 43 mutations in 38 cases of sporadic and familial heterotaxy. Circulation 94:1909-1912, 1996.

Gebbia, M.; Towbin, J. A.; Casey, B.: Connexin 43 gene mutations and heterotaxy. Response. (Letter) Circulation 97:118 only, 1998.

Guerrero, P. A.; Schuessler, R. B.; Davis, L. M.; Beyer, E. C.; Johnson, C. M.; Yamada, K. A.; Saffitz, J. E.: Slow ventricular conductionin mice heterozygous for a connexin43 null mutation. J. Clin. Invest. 99:1991-1998, 1997.

Li, J.-Y.; Hou, X.-E.; Dahlstrom, A.: GAP-43 and its relationto autonomic and sensory neurons in sciatic nerve and gastrocnemius muscle in the rat. J. Auton. Nerv. Syst. 50:299-309, 1995.

Liao, Y.; Day, K. H.; Damon, D. N.; Duling, B. R.: Endothelialcell-specific knockout of connexin 43 causes hypotension and bradycardiain mice. Proc. Nat. Acad. Sci. 98:9989-9994, 2001.

Liu, X. Z.; Xia, X. J.; Adams, J.; Chen, Z. Y.; Welch, K. O.; Tekin, M.; Ouyang, X. M.; Kristiansen, A.; Pandya, A.; Balkany, T.; Arnos, K. S.; Nance, W. E.: Mutations in GJA1 (connexin 43) are associated with non-syndromic autosomal recessive deafness. Hum. Molec. Genet. 10:2945-2951, 2001.

Reaume, A. G.; de Sousa, P. A.; Kulkarni, S.; Langille, B. L.; Zhu, D.; Davies, T. C.; Juneja, S. C.; Kidder, G. M.; Rossant, J.: Cardiac malformation in neonatal mice lacking Connexin 43 . Science 267:1831-1834, 1995.

Splitt, M. P.; Burn, J.; Goodship, J.: Connexin 43 mutations insporadic and familial defects of laterality. (Letter) New Eng. J. Med. 333:941, 1995.

Splitt, M. P.; Tsai, M. Y.; Burn, J.; Goodship, J. A.: Absence of mutations in the regulatory domain of the gap junction proteinconnexin 43 in patients with visceroatrial heterotaxy. Heart 77:369-370, 1997.

Toth, T.; Hajdu, J.; Marton, T.; Nagy, B.; Papp, Z.: Connexin 43 gene mutations and heterotaxy. (Letter) Circulation 97:117-118,1998.

Ya, J.; Erdstieck-Ernste, E. B. H. W.; de Boer, P. A. J.; vanKempen, M. J. A.; Jongsma, H.; Gros, D.; Moorman, A. F. M.; Lamers, W. H.: Heart defects in Connexin 43 -deficient mice. Circ. Res. 82:360-366, 1998.

Anderson, R. A.; Koch, S.; Camerini-Otero, R. D.: Cardiovascular findings in congenital contractural arachnodactyly: report of an affectedkindred. Am. J. Med. Genet. 18:265-271, 1984.

Babcock, D.; Gasner, C.; Francke, U.; Maslen, C.: A single mutationthat results in an asp-to-his substitution and partial exon skipping in a family with congenital contractual arachnodactyly. Hum. Genet. 103:22-28, 1998.

Mantamadiotis, T.; Lemberger, T.; Bleckmann, S. C.; Kern, H.; Kretz, O.; Villalba, A. M.; Tronche, F.; Kellendonk, C.; Gau, D.; Kapfhammer, J.; Otto, C.; Schmid, W.; Schutz, G.: Disruption of CREB function in brain leads to neurodegeneration. Nature Genet. 31:47-54, 2002.

Montminy, M. R.; Bilezikjian, L. M.: Binding of a nuclear proteinto the cyclic-AMP response element of the somatostatin gene. Nature 328:175-178, 1987.

Montminy, M. R.; Sevarino, K. A.; Wagner, J. A.; Mandel, G.; Goodman, R. H.: Identification of a cyclic-AMP-responsive element within the rat somatostatin gene. Proc. Nat. Acad. Sci. 83:6682-6686, 1986.

Nguyen, L. Q.; Kopp, P.; Martinson, F.; Stanfield, K.; Roth, S. I.; Jameson, J. L.: A dominant negative CREB (cAMP response element-bindingprotein) isoform inhibits thyrocyte growth, thyroid-specific geneexpression, differentiation, and function. Molec. Endocr. 14:1448-1461,2000.

Parker, D.; Ferreri, K.; Nakajima, T.; LaMorte, V. J.; Evans, R.; Koerber, S. C.; Hoeger, C.; Montminy, M. R.: Phosphorylationof CREB at ser-133 induces complex formation with CREB-binding proteinvia a direct mechanism. Molec. Cell. Biol. 16:694-703, 1996.

Radhakrishnan, I.; Perez-Alvarado, G. C.; Parker, D.; Dyson, H. J.; Montminy, M. R.; Wright, P. E.: Solution structure of the KIXdomain of CBP bound to the transactivation domain of CREB: a modelfor activator:coactivator interactions. Cell 91:741-752, 1997.

Solomou, E. E.; Juang, Y.-T.; Gourley, M. F.; Kammer, G. M.; Tsokos, G. C.: Molecular basis of deficient IL-2 production in T cells from patients with systemic lupus erythematosus. J. Immun. 166:4216-4222,2001.

Taylor, A. K.; Klisak, I.; Mohandas, T.; Sparkes, R. S.; Li, C.; Gaynor, R.; Lusis, A. J.: Assignment of the human gene for CREB1to chromosome 2q32.3-q34. Genomics 7:416-421, 1990.

Meyerson, M.; Enders, G. H.; Wu, C.-L.; Su, L.-K.; Gorka, C.; Nelson, C.; Harlow, E.; Tsai, L.-H.: A family of human cdc2-related proteinkinases. EMBO J. 11:2909-2917, 1992.

Demetrick, D. J.; Zhang, H.; Beach, D. H.: Chromosomal mapping of human CDK2, CDK4, and CDK5 cell cycle kinase genes. Cytogenet. Cell Genet. 66:72-74, 1994.

Harbour, J. W.; Luo, R. X.; Dei Santi, A.; Postigo, A. A.; Dean, D. C.: Cdk phosphorylation triggers sequential intramolecular interactions that progressively block Rb functions as cells move through G1. Cell 98:859-869, 1999.

Bullrich, F.; MacLachlan, T. K.; Sang, N.; Druck, T.; Veronese, M. L.; Allen, S. L.; Chiorazzi, N.; Koff, A.; Heubner, K.; Croce, C. M.; Giordano, A.: Chromosomal mapping of members of the cdc2 familyof protein kinases, cdk3, cdk6, PISSLRE, and PITALRE, and a cdk inhibitor, p27-Kip1, to regions involved in human cancer. Cancer Res. 55:1199-1205,1995.

Modi, W. S.; Chen, Z.-Q.: Localization of the human CXC chemokine subfamily on the long arm of chromosome 4 using radiation hybrids. Genomics 47:136-139, 1998.

Proost, P.; Wuyts, A.; Conings, R.; Lenaerts, J.-P.; Billiau, A.; Opdenakker, G.; Van Damme, J.: Human and bovine granulocyte chemotacticprotein-2: complete amino acid sequence and functional characterizationas chemokines. Biochemistry 32:10170-10177, 1993.

Rovai, L. E.; Herschman, H. R.; Smith, J. B.: Cloning and characterization of the human granulocyte chemotactic protein-2 gene. J. Immun. 158:5257-5266, 1997.

Wuyts, A.; van Osselaer, N.; Haelens, A.; Samson, I.; Herdewijn, P.; Ben-Baruch, A.; Oppenheim, J. J.; Proost, P.; van Damme, J.: Characterization of synthetic human granulocyte chemotactic protein2: usage of chemokine receptors CXCR1 and CXCR2 and in vivo inflammatoryproperties. Biochemistry 36:2716-2723, 1997.

Abraham, J. A.; Mergia, A.; Whang, J. L.; Tumolo, A.; Friedman, J.; Hjerild, K. A.; Gospodarowicz, D.; Fiddes, J. C.: Nucleotide sequence of a bovine clone encoding the angiogenic protein, basicfibroblast growth factor. Science 233:545-548, 1986.

Abraham, J. A.; Whang, J. L.; Tumolo, A.; Mergia, A.; Friedman, J.; Gospodarowicz, D.; Fiddes, J. C.: Human basic fibroblast growth factor: nucleotide sequence and genomic organization. EMBO J. 5:2523-2528, 1986.

Doniach, T.: Basic FGF as an inducer of anteroposterior neural pattern. Cell 83:1067-1070, 1995.

Dono, R.; Texido, G.; Dussel, R.; Ehmke, H.; Zeller, R.: Impaired cerebral cortex development and blood pressure regulation in FGF2-deficientmice. EMBO J. 17:4213-4225, 1998.

Fukushima, Y.; Byers, M. G.; Fiddes, J. C.; Shows, T. B.: Thehuman basic fibroblast growth factor gene (FGFB) is assigned to chromosome 4q25. Cytogenet. Cell Genet. 54:159-160, 1990.

Gritti, A.; Parati, E. A.; Cova, L.; Frolichsthal, P.; Galli, R.; Wanke, E.; Faravelli, L.; Morassutti, D. J.; Roisen, F.; Nickel, D. D.; Vescovi, A. L.: Multipotential stem cells from the adult mouse brain proliferate and self-renew in response to basic fibroblast growth factor. J. Neurosci. 16:1091-1100, 1996.

Kawaguchi, H.; Nakamura, K.; Tabata, Y.; Ikada, Y.; Aoyama, I.; Anzai, J.; Nakamura, T.; Hiyama, Y.; Tamura, M.: Acceleration offracture healing in non human primates by fibroblast growth factor-2. J. Clin. Endocr. Metab. 86:875-880, 2001.

Kurokawa, T.; Sasada, R.; Iwane, M.; Igarashi, K.: Cloning and expression of cDNA encoding human basic fibroblast growth factor. FEBSLett. 213:189-194, 1987.

Lafage-Pochitaloff, M.; Galland, F.; Simonetti, J.; Prats, H.; Mattei, M.-G.; Birnbaum, D.: The human basic fibroblast growth factor gene is located on the long arm of chromosome 4 at bands q26-q27. OncogeneRes. 5:241-244, 1990.

Mattei, M.-G.; Pebusque, M.-J.; Birnbaum, D.: Chromosomal localizations of mouse Fgf2 and Fgf5 genes. Mammalian Genome 2:135-137, 1992.

Montero, A.; Okada, Y.; Tomita, M.; Ito, M.; Tsurukami, H.; Nakamura, T.; Doetschman, T.; Coffin, J. D.; Hurley, M. M.: Disruption of the fibroblast growth factor-2 gene results in decreased bone mass and bone formation. J. Clin. Invest. 105:1085-1093, 2000.

Ortega, S.; Ittmann, M.; Tsang, S. H.; Ehrlich, M.; Basilico, C.: Neuronal defects and delayed wound healing in mice lacking fibroblast growth factor 2. Proc. Nat. Acad. Sci. 95:5672-5677, 1998.

Plotnikov, A. N.; Schlessinger, J.; Hubbard, S. R.; Mohammadi, M.: Structural basis for FGF receptor dimerization and activation. Cell 98:641-650, 1999.

Aerssens, J.; Chaffanet, M.; Baens, M.; Matthijs, G.; Van Den Berghe, H.; Cassiman, J.-J.; Marynen, P.: Regional assignment of seven locito 12p13.2-pter by PCR analysis of somatic cell hybrids containing the der (12) or the der (X) chromosome from a mesothelioma showing t (X;12)(q22;p13). Genomics 20:119-121, 1994.

Slaughter, C. A.; Hopkinson, D. A.; Harris, H.: Aconitase polymorphismin man. Ann. Hum. Genet. 39:193-202, 1975.

Azevedo, E. S.; Da Silva, M. C. B. O.; Lima, A. M. V.; Fonseca, E. F.; Conseicao, M. M.: Human aconitase polymorphism in three samplesfrom northeastern Brazil. Ann. Hum. Genet. 43:7-10, 1979.

Hentze, M. W.; Seuanez, H. N.; O'Brien, S. J.; Harford, J. B.; Klausner, R. D.: Chromosomal localization of nucleic acid-binding proteins by affinity mapping: assignment of the IRE-binding protein gene to human chromosome 9. Nucleic Acids Res. 17:6103-6108, 1989.

Mohandas, T.; Sparkes, R. S.; Sparkes, M. C.; Shulkin, J. D.; Toomey, K. E.; Funderburk, S. J.: Regional localization of human gene locion chromosome 9: studies of somatic cell hybrids containing human translocations. Am. J. Hum. Genet. 31:586-600, 1979.

Robson, E. B.; Cook, P. J. L.; Buckton, K. E.: Family studieswith the chromosome 9 markers ABO, AK-1, ACON-S and 9qh. Ann. Hum. Genet. 41:53-60, 1977.

Shay, J. W.; Werbin, H.: New evidence for the insertion of mitochondrial DNA into the human genome: significance for cancer and aging. Mutat. Res. 275:227-235, 1992.

Shows, T. B.; Brown, J. A.: Mapping AK-1, ACON-S, and AK-3 tochromosome 9 in man employing an X-9 translocation and somatic cellhybrids. Cytogenet. Cell Genet. 19:26-37, 1977.

Westerveld, A.; van Henegouwen, B. H. M. A.; Van Someren, H.:Evidence for synteny between the human loci for galactose-1-phosphateuridyl transferase and aconitase in man-Chinese hamster somatic cellhybrids. Cytogenet. Cell Genet. 14:453-454, 1975.

Drury, A. N.; Szent-Gyorgyi, A.: The physiological activity ofadenine compounds with especial reference to their action upon the mammalian heart. J. Physiol. 68:213-237, 1929.

Libert, F.; Passage, E.; Parmentier, M.; Simons, M.-J.; Vassart, G.; Mattei, M.-G.: Chromosomal mapping of A1 and A2 adenosine receptors, VIP receptor, and a new subtype of serotonin receptor. Genomics 11:225-227, 1991.

Stiles, G. L.: Adenosine receptors. J. Biol. Chem. 267: 6451-6454,1992.

Sun, D.; Samuelson, L. C.; Yang, T.; Huang, Y.; Paliege, A.; Saunders, T.; Briggs, J.; Schnermann, J.: Mediation of tubuloglomerular feedback by adenosine: evidence from mice lacking adenosine 1 receptors. Proc. Nat. Acad. Sci. 98:9983-9988, 2001.

Townsend-Nicholson, A.; Baker, E.; Schofield, P. R.; Sutherland, G. R.: Localization of the adenosine A1 receptor subtype gene (ADORA1) to chromosome 1q32.1. Genomics 26:423-425, 1995.

Chen, J.-F.; Huang, Z.; Ma, J.; Zhu, J.; Moratalla, R.; Standaert, D.; Moskowitz, M. A.; Fink, J. S.; Schwarzschild, M. A.: A2A adenosinereceptor deficiency attenuates brain injury induced by transient focalischemia in mice. J. Neurosci. 19:9192-9200, 1999.

Gaudray, P.: Personal Communication. Nice, France Jun. 1, 1994.

Gusella, J. F.: Personal Communication. Boston, Mass. Apr. 17, 1994.

Le, F.; Townsend-Nicholson, A.; Baker, E.; Sutherland, G. R.; Schofield, P. R.: Characterization and chromosomal localization of the human A2a adenosine receptor gene: ADORA2A. Biochem. Biophys. Res. Commun. 223:461-467, 1996.

Ledent, C.; Vaugeois, J.-M.; Schiffmann, S. N.; Pedrazzini, T.; El Yacoubi, M. E.; Vanderhaeghen, J.-J.; Costentin, J.; Heath, J. K.; Vassart, G.; Parmentier, M.: Aggressiveness, hypoalgesia and high blood pressure in mice lacking the adenosine A2a receptor. Nature 388:674-678, 1997.

Libert, F.; Passage, E.; Parmentier, M.; Simons, M.-J.; Vassart, G.; Mattei, M.-G.: Chromosomal mapping of A1 and A2 adenosine receptors, VIP receptor, and a new subtype of serotonin receptor. Genomics 11:225-227, 1991. Note: Erratum: Genomics 23:305 only, 1994.

MacCollin, M.; Peterfreund, R.; MacDonald, M.; Fink, J. S.; Gusella, J.: Mapping of a human A2a adenosine receptor (ADORA2) to chromosome 22. Genomics 20:332-333, 1994.

Ohta, A.; Sitkovsky, M.: Role of G-protein-coupled adenosine receptorsin down regulation of inflammation and protection from tissue damage. Nature 916-920,2001.

Szepetowski, P.; Perucca-Lostanlen, D.; Gaudray, P.: Mapping genes according to their amplification status in tumor cells: contribution to the map of 11q13. Genomics 16:745-750, 1993.

Barbry, P.; Champe, M.; Chassande, O.; Munemitsu, S.; Champigny, G.; Lingueglia, E.; Maes, P.; Frelin, C.; Tartar, A.; Ullrich, A.; Lazdunski, M.: Human kidney amiloride-binding protein: cDNA structure and functional expression. Proc. Nat. Acad. Sci. 87:7347-7351,1990.

Barbry, P.; Simon-Bouy, B.; Mattei, M.-G.; Le Guern, E.; Jaume-Roig, B.; Chassande, O.; Ullrich, A.; Lazdunski, M.: Localization of the gene for amiloride binding protein on chromosome 7 and RFLP analysisin cystic fibrosis families. Hum. Genet. 85:587-589, 1990.

Chassande, O.; Renard, S.; Barbry, P.; Lazdunski, M.: The human gene for diamine oxidase, an amiloride binding protein: molecular cloning, sequencing, and characterization of the promoter. J. Biol. Chem. 269:14484-14489, 1994.

Novotny, W. F.; Chassande, O.; Baker, M.; Lazdunski, M.; Barbry, P.: Diamine oxidase is the amiloride-binding protein and is inhibitedby amiloride analogues. J. Biol. Chem. 269: 9921-9925, 1994.

Brinkman-Van der Linden, E. C. M.; Sjoberg, E. R.; Juneja, L. R.; Crocker, P. R.; Varki, N.; Varki, A.: Loss of N-glycolylneuraminic acid in human evolution: implications for sialic acid recognitionby siglecs. J. Biol. Chem. 275:8633-8640, 2000.

O'Keefe, T. L.; Williams, G. T.; Davies, S. L.; Neuberger, M. S.: Hyper responsive B cells in CD22-deficient mice. Science 274:798-801,1996.

Wilson, G. L.; Fox, C. H.; Fauchi, A. S.; Kehrl, J. H.: cDNA cloningof the B cell membrane protein CD22: a mediator of B-B cell interactions. J. Exp. Med. 173:137-146, 1991.

Wilson, G. L.; Najfeld, V.; Kozlow, E.; Menniger, J.; Ward, D.; Kehrl, J. H.: Genomic structure and chromosomal mapping of the human CD22 gene. J. Immun. 150:5013-5024, 1993.

Ala-Kapee, M.; Forsberg, U. H.; Jalkanen, S.; Schroder, J.: mapping of gene for human lymphocyte homing receptor to the short arm of chromosome 11. (Abstract) Cytogenet. Cell Genet. 51:948-949, 1989.

Aruffo, A.; Stamenkovic, I.; Melnick, M.; Underhill, C. B.; Seed, B.: CD44 is the principal cell surface receptor for hyaluronate. Cell 61:1303-1313, 1990.

Cianfriglia, M.; Viora, M.; Tombesi, M.; Merendino, N.; Esposito, G.; Samoggia, P.; Forsberg, U. H.; Schroder, J.: The gene encoding for MC56 determinant (drug-sensitivity marker) is located on the short arm of human chromosome 11. Int. J. Cancer 52:585-587, 1992.

Cywes, C.; Wessels, M. R.: Group A Streptococcus tissue invasion by CD44-mediated cell signalling. Nature 414:648-652, 2001.

Forsberg, U. H.; Ala-Kapee, M. M.; Jalkanen, S.; Andersson, L. C.; Schroder, J.: The gene for human lymphocyte homing receptor islocated on chromosome 11. Europ. J. Immun. 19:409-412, 1989.

Forsberg, U. H.; Jalkanen, S.; Schroder, J.: Assignment of the human lymphocyte homing receptor gene to the short arm of chromosome 11. Immunogenetics 29:405-407, 1989.

Haynes, B. F.: Personal Communication. Durham, N. C. Feb. 28, 1986.

Krainer, A. R.; Mayeda, A.; Kozak, D.; Binns, G.: Functional expression of cloned human splicing factor SF2: homology to RNA-binding proteins, U1 70K, and Drosophila splicing regulators. Cell 66:383-394, 1991.

Matsumura, Y.; Tarin, D.: Significance of CD44 gene productsfor cancer diagnosis and disease evaluation. Lancet 340:1053-1058,1992.

Mayer, B.; Jauch, K. W.; Gunthert, U.; Figdor, C. G.; Schildberg, F. W.; Funke, I.; Johnson, J. P.: De-novo expression of CD44 and survival in gastric cancer. Lancet 342:1019-1022, 1993.

Omary, M. B.; Trowbridge, I. S.; Letarte, M.; Kagnoff, M. F.; Isacke, C. M.: Structural heterogeneity of human Pgp-1 and its relationship with p85. Immunogenetics 27:460-464, 1988.

Schlossman, S. F.; Boumsell, L.; Gilks, W.; Harlan, J. M.; Kishimoto, T.; Morimoto, C.; Ritz, J.; Shaw, S.; Silverstein, R. L.; Springer, T. A.; Tedder, T. F.; Todd, R. F.: CD antigens 1993. Immun. Today 15:98-99, 1994.

Schmits, R.; Filmus, J.; Gerwin, N.; Senaldi, G.; Kiefer, F.; Kundig, T.; Wakeham, A.; Shahinian, A.; Catzavelos, C.; Rak, J.; Furlonger, C.; Zakarian, A.; Simard, J. J.; Ohashi, P. S.; Paige, C. J.; Gutierrez-Romas, J. C.; Mak, T. W.: CD44 regulates hematopoietic progenitor distribution, granuloma formation, and tumorigenicity. Blood 90:2217-2233, 1997.

Screaton, G. R.; Bell, M. V.; Jackson, D. G.; Cornelis, F. B.; Gerth, U.; Bell, J. I.: Genomic structure of DNA encoding the lymphocytehoming receptor CD44 reveals at least 12 alternatively spliced exons. Proc. Nat. Acad. Sci. 89:12160-12164, 1992.

Spring, F. A.; Holmes, C. H.; Simpson, K. L.; Mawby, W. J.; Mattes, M. J.; Okubo, Y.; Parsons, S. F.: The Ok(a) blood group antigen is a marker for the M6 leukocyte activation antigen, the human homolog of OX-47 antigen, basigin and neurothelin, an immunoglobulin superfamily molecule that is widely expressed in human cells and tissues. Europ. J. Immun. 27:891-897, 1997.

Brown, M. H.; Boles, K.; van der Merwe, P. A.; Kumar, V.; Mathew, P. A.; Barclay, A. N.:2B4, the natural killer and T cell immunoglobulin superfamily surface protein, is a ligand for CD48. J. Exp. Med. 188:2083-2093, 1998.

Olives, B.; Neau, P.; Bailly, P.; Hediger, M. A.; Rousselet, G.; Cartron, J.-P.; Ripoche, P.: Cloning and functional expression of a urea transporter from human bone marrow cells. J. Biol. Chem. 269:31649-31652, 1994.

Pausch, V.; Mayr, W. R.: Analysis of the linkage JK-IGK, MNS-GC and of two other possible linkage groups. Hum. Hered. 37:260-262,1987.

Promeneur, D.; Rousselet, G.; Bankir, L.; et al: Evidence for distinct vascular and tubular urea transporters in the rat kidney. J. Am. Soc. Nephrol. 7:852-860, 1996.

Sands, J. M.; Gargus, J. J.; Frohlich, O.; Gunn, R. B.; Kokko, J. P.: Urinary concentrating ability in patients with Jk(a/b) bloodtype who lack carrier-mediated urea transport. J. Am. Soc. Nephrol. 2:1689-1696, 1992.

Sherman, S. L.; Simpson, S. P.: Evidence for the location of JK and CO on chromosome 2 based on family studies. (Abstract) Cytogenet. Cell Genet. 40:743, 1985.

Shokeir, M. H. K.; Ying, K. L.; Pabello, P.: Deletion of the long arm of chromosome no. 7: tentative assignment of the Kidd (Jk) locus. Clin. Genet. 4:360-368, 1973.

Sidoux-Walter, F.; Lucien, N.; Nissinen, R.; Sistonen, P.; Henry, S.; Moulds, J.; Cartron, J.-P.; Bailly, P.: Molecular heterogeneity of the Jk-null phenotype: expression analysis of the Jk(S291P) mutation found in Finns. Blood 96:1566-1573, 2000.

Tsukaguchi, H.; Shayakul, C.; Berger, U. V.; Tokui, T.; Brown, D.; Hediger, M. A.: Cloning and characterization of the urea transportation UT3: localization in rat kidney and testis. J. Clin. Invest. 99:1506-1515, 1997.

Xu, Y.; Olives, B.; Bailly, P.; et al: Endothelial cells of the kidney vasa recta express the urea transporter HUT11. Kidney Int. 51:138-146, 1997.

Grollman, E. F.; Kobata, A.; Ginsburg, V.: An enzymatic basisfor Lewis blood types in man. J. Clin. Invest. 48:1489-1494, 1969.

Koda, Y.; Kimura, H.; Mekada, E.: Analysis of Lewis fucosyltransferasegenes from the human gastric mucosa of Lewis-positive and -negativeindividuals. Blood 82:2915-2919, 1993.

Koprowski, H.; Blaszczyk, M.; Steplewski, Z.; Brockhaus, M.; Magnani, J.; Ginsburg, V.: Lewis blood-type may affect the incidence of gastrointestinalcancer. Lancet I:1332-1333, 1982.

Nishihara, S.; Narimatsu, H.; Iwasaki, H.; Yazawa, S.; Akamatsu, S.; Ando, T.; Seno, T.; Narimatsu, I.: Molecular genetic analysis of the human lewis histo-blood group system. J. Biol. Chem. 269:29271-29278, 1994.

Orntoft, T. F.; Vestergaard, E. M.; Holmes, E.; Jakobsen, J. S.; Grunnet, N.; Mortensen, M.; Johnson, P.; Bross, P.; Gregersen, N.; Skorstengaard, K.; Jensen, U. B.; Bolund, L.; Wolf, H.: Influence of Lewis alpha-1-3/4-L-fucosyltransferase (FUT3) gene mutations onenzyme activity, erythrocyte phenotyping, and circulating tumor markersialyl-Lewis a levels. J. Biol. Chem. 271:32260-32268, 1996.

Pang, H.; Liu, Y.; Koda, Y.; Soejima, M.; Jia, J.; Schlaphoff, T.; du Toit, E. D.; Kimura, H.: Five novel missense mutations of the Lewis gene (FUT3) in African (Xhosa) and Caucasian populations in South Africa. Hum. Genet. 102:675-680, 1998.

Reguigne-Arnould, I.; Couillin, P.; Mollicone, R.; Faure, S.; Fletcher, A.; Kelly, R. J.; Lowe, J. B.; Oriol, R.: Relative positions of twoclusters of human alpha-L-fucosyltransferases in 19q (FUT1-FUT2) and19p (FUT6-FUT3-FUT5) within the microsatellite genetic map of chromosome 19. Cytogenet. Cell Genet. 71:158-162, 1995.

Sheinfeld, J.; Schaeffer, A. J.; Cordon-Cardo, C.; Rogatko, A.; Fair, W. R.: Association of the Lewis blood-group phenotype with recurrent urinary tract infections in women. New Eng. J. Med. 320:773-777, 1989.

Weitkamp, L. R.; Johnston, E.; Guttormsen, S. A.: Probable genetic linkage between the loci for the Lewis blood group and complement C3. Cytogenet. Cell Genet. 13:183-184, 1974.

Yazawa, S.; Oh-Kawara, H.; Nakajima, T.; Hosomi, O.; Akamatsu, S.; Kishi, K.: Histo-blood group Lewis genotyping from human hairs and blood. Jpn. J. Hum. Genet. 41:177-188, 1996.

Engel, A. G.; Ohno, K.; Milone, M.; Wang, H.-L.; Nakano, S.; Bouzat, C.; Pruitt, J. N., II; Hutchinson, D. O.; Brengman, J. M.; Bren, N.; Sieb, J. P.; Sine, S. M.: New mutations in acetylcholine receptor subunit genes reveal heterogeneity in the slow-channel congenital myasthenic syndrome. Hum. Molec. Genet. 5:1217-1227, 1996.

Lobos, E. A.: Five subunit genes of the human muscle nicotinicacetylcholine receptor are mapped to two linkage groups on chromosomes 2 and 17. Genomics 17:642-650, 1993.

Deftos, L. J.; Murray, S. S.; Burton, D. W.; Parmer, R. J.; O'Connor, D. T.; Delegeane, A. M.; Mellon, P. L.: A cloned chromogranin A (CgA) cDNA detects a 2.3kb mRNA in diverse neuroendocrine tissues. Biochem. Biophys. Res. Commun. 137:418-423, 1986.

Granberg, D.; Stridsberg, M.; Seensalu, R.; Eriksson, B.; Lundqvist, G.; Oberg, K.; Skogseid, B.: Plasma chromogranin A in patients withmultiple endocrine neoplasia type 1. J. Clin. Endocr. Metab. 84:2712-2717, 1999.

Hagn, C.; Schmid, K. W.; Fischer-Colbrie, R.; Winkler, H.: Chromogranin A, B, and C in human adrenal medulla and endocrine tissues. Lab. Invest. 55:405-411, 1986.

Kim, T.; Tao-Cheng, J.-H.; Eiden, L. E.; Loh, Y. P.: Chromogranin A, an 'on/off' switch controlling dense-core secretory granule biogenesis. Cell 106:499-509, 2001.

Konecki, D. S.; Benedum, U. M.; Gerdes, H.-H.; Huttner, W. B.:The primary structure of human chromogranin A and pancreastatin. J. Biol. Chem. 262:17026-17030, 1987.

Kruggel, W.; O'Connor, D. T.; Lewis, R. V.: The amino terminal sequences of bovine and human chromogranin A and secretory proteinI are identical. Biochem. Biophys. Res. Commun. 127:380-383, 1985.

Modi, W. S.; Levine, M. A.; Dean, M.; Seuanez, H.; O'Brien, S. J.: The chromogranin A gene: chromosome assignment and RFLP analysis. (Abstract) Cytogenet. Cell Genet. 51:1046 only, 1989.

Modi, W. S.; Levine, M. A.; Seuanez, H. N.; Dean, M.; O'Brien, S. J.: The human chromogranin A gene: chromosome assignment and RFLP analysis. Am. J. Hum. Genet. 45:814-818, 1989.

Murray, S. S.; Deaven, L. L.; Burton, D. W.; O'Connor, D. T.; Mellon, P. L.; Deftos, L. J.: The gene for human chromogranin A (CgA) is located on chromosome 14. Biochem. Biophys. Res. Commun. 142:141-146, 1987.

Nobels, F. R. E.; Kwekkeboom, D. J.; Coopmans, W.; Schoenmakers, C. H. H.; Lindemans, J.; De Herder, W. W.; Krenning, E. P.; Bouillon, R.; Lamberts, S. W. J.: Chromogranin A as serum marker for neuroendocrineneoplasia: comparison with neuron-specific enolase and the alpha-subunit of glycoprotein hormones. J. Clin. Endocr. Metab. 82:2622-2628,1997.

O'Connor, D. T.; Deftos, L. J.: Secretion of chromogranin A bypeptide-producing endocrine neoplasms. New Eng. J. Med. 314:1145-1151,1986.

Simon-Chazottes, D.; Wu, H.; Parmer, R. J.; Rozansky, D. J.; Szpirer, J.; Levan, G.; Kurtz, T. W.; Szpirer, C.; Guenet, J. L.; O'Connor, D. T.: Assignment of the chromogranin A (Chga) locus to homologous regions on mouse chromosome 12 and rat chromosome 6. Genomics 17:252-255, 1993.

Wu, H.-J.; Rozansky, D. J.; Parmer, R. J.; Gill, B. M.; O'Connor, D. T.: Structure and function of the chromogranin A gene: clues to evolution and tissue-specific expression. J. Biol. Chem. 266:13130-13134,1991.

Higashiyama, S.; Lau, K.; Besner, G. E.; Abraham, J. A.; Klagsbrun, M.: Structure of heparin-binding EGF-like growth factor: multipleforms, primary structure, and glycosylation of the mature protein. J. Biol. Chem. 267:6205-6212, 1992.

Naglich, J. G.; Metherall, J. E.; Russell, D. W.; Eidels, L.:Expression cloning of a diphtheria toxin receptor: identity with a heparin-binding EGF-like growth factor precursor. Cell 69:1051-1061,1992.

Pappenheimer, A. M., Jr.: Diphtheria toxin. Ann. Rev. Biochem. 46:69-94, 1977.

Pappenheimer, A. M., Jr.; Gill, D. M.: Diphtheria. Science 182:353-358, 1973.

Pathak, B. G.; Gilbert, D. J.; Harrison, C. A.; Luetteke, N. C.; Chen, X.; Klagsbrun, M.; Plowman, G. D.; Copeland, N. G.; Jenkins, N. A.; Lee, D. C.: Mouse chromosomal location of three EGF receptor ligands: amphiregulin (Areg), betacellulin (Btc), and heparin-bindingEGF (Hegfl). Genomics 28:116-118, 1995.

Roberts, M.; Ruddle, F. H.: The Chinese hamster gene map: assignment of four genes (DTS, PGM2, 6PGD, Eno1) to chromosome 2. Exp. CellRes. 127:47-54, 1980.

Bowcock, A. M.; Hebert, J. M.; Christiano, A. M.; Wijsman, E.; Cavalli-Sforza, L. L.; Boyd, C. D.: The pro alpha 1 (IV) collagengene is linked to the D13S3 locus at the distal end of human chromosome 13q. Cytogenet. Cell Genet. 45:234-236, 1987.

Bowcock, A. M.; Hebert, J. M.; Wijsman, E.; Gadi, I.; Cavalli-Sforza, L. L.; Boyd, C. D.: High recombination between two physically closehuman basement membrane collagen genes at the distal end of chromosome 13q. Proc. Nat. Acad. Sci. 85:2701-2705, 1988.

Boyd, C. D.; Weliky, K.; Toth-Fejel, S.; Deak, S. B.; Christiano, A. M.; Mackenzie, J. W.; Sandell, L. J.; Tryggvason, K.; Magenis, E.: The single copy gene coding for human alpha-1(IV) procollagenis located at the terminal end of the long arm of chromosome 13. Hum. Genet. 74:121-125, 1986.

Brinker, J. M.; Gudas, L. J.; Loidl, H. R.; Wang, S.-Y.; Rosenbloom, J.; Kefalides, N. A.; Myers, J. C.: Restricted homology between human alpha-1 type IV and other procollagen chains. Proc. Nat. Acad. Sci. 82:3649-3653, 1985.

Burbelo, P. D.; Martin, G. R.; Yamada, Y.: Alpha-1(IV) and alpha-2(IV) collagen genes are regulated by a bidirectional promoter and a shared enhancer. Proc. Nat. Acad. Sci. 85:9679-9682, 1988.

Crouch, E.; Sage, H.; Bornstein, P.: Structural basis for apparent heterogeneity of collagens in human basement membranes: type IV procollagencontains two distinct chains. Proc. Nat. Acad. Sci. 77:745-749,1980.

Cutting, G. R.; Kazazian, H. H., Jr.; Antonarakis, S. E.; Killen, P. D.; Yamada, Y.; Francomano, C. A.: Macrorestriction analysis maps COL4A1 and COL4A2 collagen genes within a 400 kb region on chromosome 13q34. (Abstract) Am. J. Hum. Genet. 41:A163, 1987.

Cutting, G. R.; Kazazian, H. H., Jr.; Antonarakis, S. E.; Killen, P. D.; Yamada, Y.; Francomano, C. A.: Macrorestriction mapping of COL4A1 and COL4A2 collagen genes on human chromosome 13q34. Genomics 3:256-263, 1988.

Emanuel, B. S.; Sellinger, B. T.; Gudas, L. J.; Myers, J. C.:Localization of the human procollagen alpha-1(IV) gene to chromosome 13q34 by in situ hybridization. Am. J. Hum. Genet. 38:38-44, 1986.

Hebert, J. M.; Bowcock, A. M.; Wijsman, E.; Gadi, I.; Boyd, C.; Cavalli-Sforza, L. L.: The genes for pro-alpha-1 (IV) collagen, pro-alpha-2(IV) collagen and the D13S3 locus are linked at 13q34. (Abstract)Am. J. Hum. Genet. 41: A169, 1987.

Kuhn, K.: Personal Communication. Munich, Germany Jan. 7, 1982.

Mayne, R.; Wiedemann, H.; Irwin, M. H.; Sanderson, R. D.; Fitch, J. M.; Linsenmayer, T. F.; Kuhn, K.: Monoclonal antibodies against chicken type IV and V collagens: electron microscopic mapping of theepitopes after rotary shadowing. J. Cell Biol. 98:1637-1644, 1984.

Pihlajaniemi, T.; Tryggvason, K.; Myers, J. C.; Kurkinen, M.; Lebo, R.; Cheung, M.-C.; Prockop, D. J.; Boyd, C. D.: cDNA clones coding for the pro-alpha-1(IV) chain of human type IV procollagenreveal an unusual homology of amino acid sequences in two halves of the carboxyl terminal domain. J. Biol. Chem. 260:7681-7687, 1985.

Poschl, E.; Pollner, R.; Kuhn, K.: The genes for the alpha-1(IV) and alpha-2(IV) chains of human basement membrane collagen type IV are arranged head-to-head and separated by a bidirectional promoter of unique structure. EMBO J. 7:2687-2695, 1988.

Soininen, R.; Chow, L.; Kurkinen, M.; Tryggvason, K.; Prockop, D. J.: The gene for the alpha-1(IV) chain of human type IV procollagen:the exon structures do not coincide with the two structural subdomains in the globular carboxy-terminus of the protein. EMBO J. 5:2821-2823,1986.

Soininen, R.; Huotari, M.; Hostikka, S. L.; Prockop, D. J.; Tryggvason, K.: The structural genes for alpha-1 and alpha-2 chains of human Type IV collagen are divergently encoded on opposite DNA strands and have an overlapping promoter region. J. Biol. Chem. 263:17217-17220,1988.

Soininen, R.; Tikka, L.; Chow, L.; Pihlajaniemi, T.; Kurkinen, M.; Prockop, D. J.; Boyd, C. D.; Tryggvason, K.: Large introns in the 3-prime end of the gene for the pro-alpha1(IV) chain of human basement membrane collagen. Proc. Nat. Acad. Sci. 83:1568-1572,1986.

Sorrentino, R.; Corte, G.; Calabi, F.; Tanigaki, N.; Tosi, R.: Microfingerprinting analysis of human Ia molecules favours a threeloci model. Molec. Immun. 20:333-343, 1983.

Jutel, M.; Watanabe, T.; Klunker, S.; Akdis, M.; Thomet, O. A. R.; Malolepszy, J.; Zak-Nejmark, T.; Koga, R.; Kobayashi, T.; Blaser, K.; Akdis, C. A.: Histamine regulates T-cell and antibody responses by differential expression of H1 and H2 receptors. Nature 413:420-425,2001.

Doenecke, D.; Tonjes, R.: Differential distribution of lysine and arginine residues in the closely related histones H1 and H5. Analysis of a human H1 gene. J. Molec. Biol. 187: 461-464, 1986.

Castellani, L. W.; Weinreb, A.; Bodnar, J.; Goto, A. M.; Doolittle, M.; Mehrabian, M.; Demant, P.; Lusis, A. J.: Mapping a gene for combined hyperlipidaemia in a mutant mouse strain. Nature Genet. 18:374-377, 1998.

Geurts, J. M. W.; Janssen, R. G. J. H.; van Greevenbroek, M. M. J.; van der Kallen, C. J. H.; Cantor, R. M.; Bu, X.; Aouizerat, B. E.; Allayee, H.; Rotter, J. I.; de Bruin, T. W. A.: Identification of TNFRSF1B as a novel modifier gene in familial combined hyperlipidemia. Hum. Molec. Genet. 9:2067-2074, 2000.

Suzuki, Y.; Wong, S.-Y.; Grumet, F. C.; Fessel, J.; Montoya, J. G.; Zolopa, A. R.; Portmore, A.; Schumacher-Perdreau, F.; Schrappe, M.; Koppen, S.; Ruf, B.; Brown, B. W.; Remington, J. S.: Evidence for genetic regulation of susceptibility to toxoplasmic encephalitisin AIDS patients. J. Infect. Dis. 173: 265-268, 1996.

Tanigaki, N.; Tosi, R.; Pressman, D.; Ferrara, G. B.: Molecular identification of human Ia antigens coded for by a gene closely linked to HLA-DR locus. Immunogenetics 10:151-167, 1980.

Todd, J. A.; Bell, J. I.; McDevitt, H. O.: HLA-DQ(beta) gene contributes to susceptibility and resistance to insulin-dependent diabetes mellitus. Nature 329:599-604, 1987.

Todd, J. A.; Fukui, Y.; Kitagawa, T.; Sasazuki, T.: The A3 allele of the HLA-DQA1 locus is associated with susceptibility to type 1diabetes in Japanese. Proc. Nat. Acad. Sci. 87:1094-1098, 1990.

Tosi, R.; Tanigaki, N.; Cantis, D.; Ferrara, G. B.; Pressman, D.: Immunological dissection of human Ia molecules. J. Exp. Med. 148:1592-1611, 1978.

Wen, L.; Wong, F. S.; Tang, J.; Chen, N.-Y.; Altieri, M.; David, C.; Flavell, R.; Sherwin, R.: In vivo evidence for the contribution of human histocompatibility leukocyte antigen (HLA)-DQ molecules to the development of diabetes. J. Exp. Med. 191:97-104, 2000.

Hatzivassiliou, G.; Miller, I.; Takizawa, J.; Palanisamy, N.; Rao, P. H.; Iida, S.; Tagawa, S.; Taniwaki, M.; Russo, J.; Neri, A.; Cattoretti, G.; Clynes, R.; Mendelsohn, C.; Chaganti, R. S. K.; Dalla-Favera, R.: IRTA1 and IRTA2, novel immunoglobulin superfamily receptors expressed in B cells and involved in chromosome 1q21 abnormalities in B cellmalignancy. Immunity 14:277-289, 2001.

Mollereau, C.; Muscatelli, F.; Mattei, M.-G.; Vassart, G.; Parmentier, M.: The high-affinity interleukin 8 receptor gene (IL8RA) maps to the 2q33-q36 region of the human genome: cloning of a pseudogene (IL8RBP) for the low-affinity receptor. Genomics 16:248-251, 1993.

Morris, S. W.; Nelson, N.; Valentine, M. B.; Shapiro, D. N.; Look, A. T.; Kozlosky, C. J.; Beckmann, M. P.; Cerretti, D. P.: Assignment of the genes encoding human interleukin-8 receptor types 1 and 2 and an interleukin-8 receptor pseudogene to chromosome 2q35. Genomics 14:685-691, 1992.

Palter, S. F.; Mulayim, N.; Senturk, L.; Arici, A.: Interleukin-8 in the human fallopian tube. J. Clin. Endocr. Metab. 86:2660-2667,2001.

Bass, H. N.; Sparkes, R. S.; Crandall, B. F.; Marcy, S. M.: Congenital contractural arachnodactyly, keratoconus, and probable Marfan syndromein the same pedigree. J. Pediat. 98:591-593, 1981.

Bawle, E.; Quigg, M. H.: Ectopia lentis and aortic root dilatationin congenital contractural arachnodactyly. Am. J. Med. Genet. 42:19-21, 1992.

Beals, R. K.; Hecht, F.: Congenital contractural arachnodactyly: a heritable disorder of connective tissue. J. Bone Joint Surg. 53A:987-993, 1971.

Belleh, S.; Zhou, G.; Wang, M.; Der Kaloustian, V. M.; Pagon, R. A.; Godfrey, M.: Two novel fibrillin-2 mutations in congenital contracturalarachnodactyly. Am. J. Med. Genet. 92:7-12, 2000.

Beyer, P.; Klein, M. L.; Iszepy, E.: Maladie de Marfan avec raideursarticulaires importantes atteignant les quatre enfants de la memefratrie et leur mere. Arch. Franc. Pediat. 22:210-216, 1965.

Bistritzer, T.; Fried, K.; Lahat, E.; Dvir, M.; Goldberg, M.:Congenital contractural arachnodactyly in two double second cousins:possible homozygosity. Clin. Genet. 44:15-19, 1993.

Chaudhry, S. S.; Gazzard, J.; Baldock, C.; Dixon, J.; Rock, M. J.; Skinner, G. C.; Steel, K. P.; Kielty, C. M.; Dixon, M. J.: Mutation of the gene encoding fibrillin-2 results in syndactyly in mice. Hum. Molec. Genet. 10:835-843, 2001.

Cole, T. R. P.; Hughes, H. E.: Congenital contractural arachnodactyly with unilateral lower limb deficiency. Am. J. Med. Genet. 44:72-74,1992.

Currarino, G.; Friedman, J. M.: A severe form of congenital contracturalarachnodactyly in two newborn infants. Am. J. Med. Genet. 25:763-773,1986.

Delemarre-van de Waal, H. A.; van Benthem, L. H. B. M.; Bleeker-Wagemakers, E. M.: Congenitale contracturele arachnodactylie. Ned. Tijdschr. Geneeskd. 124:348-351, 1980.

Dixon, M. J.; Gazzard, J.; Chaudhry, S. S.; Sampson, N.; Schulte, B. A.; Steel, K. P.: Mutation of the Na-K-Cl co-transporter gene Slc12a2 results in deafness in mice. Hum. Molec. Genet. 8:1579-1584,1999.

Epstein, C. J.; Graham, C. B.; Hodgkin, W. E.; Hecht, F.; Motulsky, A. G.: Hereditary dysplasia of bone with kyphoscoliosis, contractures, and abnormally shaped ears. J. Pediat. 73:379-386, 1968.

Gruber, M. A.; Graham, T. P., Jr.; Engel, E.; Smith, C.: Marfan syndrome with contractural arachnodactyly and severe mitral regurgitation in a premature infant. J. Pediat. 93:80-82, 1978.

Hecht, F.; Beals, R. K.: 'New' syndrome of congenital contractural arachnodactyly originally described by Marfan in 1896. Pediatrics 49:574-579, 1972.

Huggon, I. C.; Burke, J. P.; Talbot, J. F.: Contractural arachnodactyly with mitral regurgitation and iridodonesis. Arch. Dis. Child. 65:317-319, 1990.

Godfrey, M.; Raghunath, M.; Cisler, J.; Bevins, C. L.; DePaepe, A.; Di Rocco, M.; Gregoritch, J.; Imaizumi, K.; Kaplan, P.; Kuroki, Y.; Silberbach, M.; Superti-Furga, A.; Van Thienen, M.-N.; Vetter, U.; Steinmann, B: Abnormal morphology of fibrillin microfibrils in fibroblast cultures from patients with neonatal Marfan syndrome. Am. J. Path. 146:1414-1421, 1995.

Gupta, P. A.; Putnam, E. A.; Carmical, S. G.; Kaitila, I.; Steinmann, B.; Child, A.; Danesino, C.; Metcalfe, K.; Berry, S. A.; Chen, E.; Delorme, C. V.; Thong, M.-K.; Ades, L. C.; Milewicz, D. M.: Ten novel FBN2 mutations in congenital contractural arachnodactyly: delineation of the molecular pathogenesis and clinical phenotype. Hum. Mutat. 19:39-48, 2002.

Kainulainen, K.; Karttunen, L.; Puhakka, L.; Sakai, L.; Peltonen, L.: Mutations in the fibrillin gene responsible for dominant ectopialentis and neonatal Marfan syndrome. Nature Genet. 6:64-69, 1994.

Kingsley-Pillers, E. M.: Arachnodactyly with amyoplasia congenita. Proc. Roy. Soc. Med. 39:696-697, 1946.

Langenskiold, A.: Congenital contractural arachnodactyly: reportof a case and of an operation for knee contracture. J. Bone Joint Surg. 67:44-46, 1985.

Lee, B.; Godfrey, M.; Vitale, E.; Hori, H.; Mattei, M.-G.; Sarfarazi, M.; Tsipouras, P.; Ramirez, F.; Hollister, D. W.: Linkage of Marfan syndrome and a phenotypically related disorder to two different fibrillin genes. Nature 352:330-334, 1991.

Li, X.; Pereira, L.; Zhang, H.; Sanguineti, C.; Ramirez, F.; Bonadio, J.; Francke, U.: Fibrillin genes map to regions of conserved mouse/human synteny on mouse chromosomes 2 and 18. Genomics 18:667-672, 1993.

Lipson, E. H.; Viseskul, C.; Herrmann, J.: The clinical spectrum of congenital contractural arachnodactyly: a case with congenital heart disease. Z. Kinderheilk. 118:1-8, 1974.

Lowry, R. B.; Guichon, V. C.: Congenital contractural arachnodactyly:a syndrome simulating Marfan's syndrome. Canad. Med. Assoc. J. 107:531-533, 1972.

Marfan, M. A. B.: Un cas de deformation congenitale des quatremembres plus prononcee aux extremites, caracterisee par l'allongementdes os avec un certain degre d'amincissement. Bull. Mem. Soc. Med. Hop. Paris 13:220-226, 1896.

Maslen, C.; Babcock, D.; Raghunath, M.; Steinmann, B.: A rarebranch-point mutation is associated with missplicing of fibrillin-2 in a large family with congenital contractural arachnodactyly. Am. J. Hum. Genet. 60:1389-1398, 1997.

Mirise, R. T.; Shear, S.: Congenital contractual arachnodactyly:description of a new kindred. Arthritis Rheum. 22:542-546, 1979.

Park, E.-S.; Putnam, E. A.; Chitayat, D.; Child, A.; Milewicz, D. M.: Clustering of FBN2 mutations in patients with congenital contractural arachnodactyly indicates an important role of the domains encoded by exons 24 through 34 during human development. Am. J. Med. Genet. 78:350-355, 1998.

Putnam, E. A.; Milewicz, D. M.: A mutation in the FBN2 gene indermal fibroblasts from a congenital contractural arachnodactyly patient. (Abstract) Am. J. Hum. Genet. 57:A225, 1995.

Putnam, E. A.; Park, E.-S.; Aalfs, C. M.; Hennekam, R. C. M.; Milewicz, D. M.: Parental somatic and germ-line mosaicism for a FBN2 mutation and analysis of FBN2 transcript levels in dermal fibroblasts. Am. J. Hum. Genet. 60:818-827, 1997.

Putnam, E. A.; Zhang, H.; Ramirez, F.; Milewicz, D. M.: Fibrillin-2(FBN2) mutations result in the Marfan-like disorder, congenital contractural arachnodactyly. Nature Genet. 11:456-458, 1995.

Pyeritz, R. E.: Personal Communication. Baltimore, Md. Apr. 28, 1986.

Ramos Arroyo, M. A.; Weaver, D. D.; Beals, R. K.: Congenitalcontractural arachnodactyly: report of four additional families and review of literature. Clin. Genet. 27:570-581, 1985.

Rose, P. M.; Fernandes, P.; Lynch, J. S.; Frazier, S. T.; Fisher, S. M.; Kodukula, K.; Kienzle, B.; Seethala, R.: Cloning and functional expression of a cDNA encoding a human type 2 neuropeptide Y receptor. J. Biol. Chem. 270:22661-22664, 1995.

Hovnanian, A.; Rebouillat, D.; Mattei, M.-G.; Levy, E. R.; Marie, I.; Monaco, A. P.; Hovanessian, A. G.: The human 2-prime,5-prime-oligoadenylate synthetase locus is composed of three distinct genes clustered on chromosome 12q24.2 encoding the 100-, 69-, and 40-kDa forms. Genomics 52:267-277, 1998.

Wang, Y. A.; Elson, A.; Leder, P.: Loss of p21 increases sensitivity to ionizing radiation and delays the onset of lymphoma in atm-deficient mice. Proc. Nat. Acad. Sci. 94:14590-14595, 1997.

Zakut, R.; Givol, D.: The tumor suppression function of p21(Waf) is contained in its N-terminal half ('half-WAF'). Oncogene 11:393-395,1995.

Bourne, Y.; Watson, M. H.; Hickey, M. J.; Holmes, W.; Rocque, W.; Reed, S. I.; Turner, J. A.: Crystal structure and mutational analysis of the human CDK2 kinase complex with cell cycle-regulatory protein CksHs1. Cell 84:863-874, 1996.

Boden, P.; Hall, M. D.; Hughes, J.: Cholecystokinin receptors. Cell. Molec. Neurobiol. 15:545-559, 1995.

de Weerth, A.; Pisegna, J. R.; Huppi, K.; Wank, S. A.: molecular cloning, functional expression and chromosomal localization of the human cholecystokinin type A receptor. Biochem. Biophys. Res. Commun. 194:811-818, 1993.

Funakoshi, A.; Miyasaka, K.; Shinozaki, H.; Masuda, M.; Kawanami, T.; Takata, Y.; Kono, A.: An animal model of congenital defect of gene expression of cholecystokinin (CCK)-A receptor. Biochem. Biophys. Res. Commun. 210:787-796, 1995.

Hamann, A.; Busing, B.; Munzberg, H.; de Weerth, A.; Hinney, A.; Mayer, H.; Siegfried, W.; Hebebrand, J.; Greten, H.: Missense variants in the human cholecystokinin type A receptor gene: no evidence for association with early-onset obesity. Horm. Metab. Res. 31:287-288,1999.

Huppi, K.; Siwarski, D.; Pisegna, J. R.; Wank, S.: Chromosomal localization of the gastric and brain receptors for cholecystokinin (CCKAR and CCKBR) in human and mouse. Genomics 25:727-729, 1995.

Inoue, H.; Iannotti, C. A.; Welling, C. M.; Veile, R.; Donis-Keller, H.; Permutt, M. A.: Human cholecystokinin type A receptor gene: cytogeneticlocalization, physical mapping, and identification of two missen sevariants in patients with obesity and non-insulin-dependent diabetes mellitus (NIDDM). Genomics 42:331-335, 1997.

Marchal-Victorion, S.; Vionnet, N.; Escrieut, C.; Dematos, F.; Dina, C.; Dufresne, M.; Vaysse, N.; Pradayrol, L.; Froguel, P.; Fourmy, D.: Genetic, pharmacological and functional analysis of cholecystokinin-1 and cholecystokinin-2 receptor polymorphism in type 2 diabetes and obese patients. Pharmacogenetics 12:23-30, 2002.

Miller, L. J.; Holicky, E. L.; Ulrich, C. D.; Wieben, E. D.: Abnormal processing of the human cholecystokinin receptor gene in association with gallstones and obesity. Gastroenterology 109:1375-1380, 1995.

Samuelson, L. C.; Isakoff, M. S.; Lacourse, K. A.: Localization of the murine cholecystokinin A and B receptor genes. Mammalian Genome 6:242-246, 1995.

Ulrich, C. D.; Ferber, I.; Holicky, E.; Hadac, E.; Buell, G.; Miller, L. J.: Molecular cloning and functional expression of the human gallbladder cholecystokinin A receptor. Biochem. Biophys. Res. Commun. 193:204-211, 1993.

Butkowski, R. J.; Langeveld, J. P. M.; Wieslander, J.; Hamilton, J.; Hudson, B. G.: Localization of the Goodpasture epitope to a novel chain of basement membrane collagen. J. Biol. Chem. 262:7874-7877,1987.

Bora, N. S.; Lublin, D. M.; Kumar, B. V.; Hockett, R. D.; Holers, V. M.; Atkinson, J. P.: Structural gene for human membrane cofactor protein (MCP) of complement maps to within 100 kb of the 3-prime end of the C3b/C4b receptor gene. J. Exp. Med. 169:597-602, 1989.

Cui, W.; Hourcade, D.; Post, T.; Greenlund, A. C.; Atkinson, J. P.; Kumar, V.: Characterization of the promoter region of the membrane cofactor protein (CD46) gene of the human complement system and comparison to a membrane cofactor protein-like genetic element. J. Immun. 151:4137-4146, 1993.

Dorig, R. E.; Marcil, A.; Chopra, A.; Richardson, C. D.: The human CD46 molecule is a receptor for measles virus (Edmonston strain). Cell 75:295-305, 1993.

Kallstrom, H.; Gill, D. B.; Albiger, B.; Liszewski, M. K.; Atkinson, J. P.; Jonsson, A.-B.: Attachment of Neisseria gonorrhoeae to the cellular pilus receptor CD46: identification of domains important for bacterial adherence. Cell. Microbiol. 3:133-143, 2001.

Lublin, D. M.; Liszewski, M. K.; Post, T. W.; Arce, M. A.; LeBeau, M. M.; Rebentisch, M. B.; Lemons, R. S.; Seya, T.; Atkinson, J. P.: Molecular cloning and chromosomal localization of human complementmembrane cofactor protein (MCP): evidence for inclusion in the multigenefamily of complement-regulatory proteins. J. Exp. Med. 168:181-194, 1988.

Marie, J. C.; Astier, A. L.; Rivailler, P.; Rabourdin-Combe, C.; Wild, T. F.; Horvat, B.: Linking innate and acquired immunity: divergent role of CD46 cytoplasmic domains in T cell-induced inflammation. Nature Immun. 3:659-666, 2002.

Post, T. W.; Liszewski, M. K.; Adams, E. M.; Tedja, I.; Miller, E. A.; Atkinson, J. P.: Membrane cofactor protein of the complementsystem: alternative splicing of serine/threonine/proline-rich exons and cytoplasmic tails produces multiple isoforms that correlate with protein phenotype. J. Exp. Med. 174:93-102, 1991.

Purcell, D. F. J.; Johnstone, R. W.; McKenzie, I. F. C.: Identification of four different CD46 (MCP) molecules with anti-peptide antibodies. Biochem. Biophys. Res. Commun. 180:1091-1097, 1991.

Santoro, F.; Kennedy, P. E.; Locatelli, G.; Malnati, M. S.; Berger, E. A.; Lusso, P.: CD46 is a cellular receptor for human herpesvirus 6. Cell 99:817-827, 1999.

Tatsuo, H.; Ono, N.; Tanaka, K.; Yanagi, Y.: SLAM (CDw150) is a cellular receptor for measles virus. Nature 406:893-897, 2000.

Goldfarb, L. G.; Brown, P.; Goldgaber, D.; Asher, D. M.; Rubenstein, R.; Brown, W. T.; Piccardo, P.; Kascsak, R. J.; Boellaard, J. W.; Gajdusek, D. C.: Creutzfeldt-Jakob disease and kuru patients lack a mutation consistently found in the Gerstmann-Straussler-Scheinkersyndrome. Exp. Neurol. 108:247-250, 1990.

Manuelidis, L.; Sklaviadis, T.; Manuelidis, E. E.: Evidence suggesting that PrP is not the infectious agent in Creutzfeldt-Jakob disease. EMBO J. 6:341-347, 1987.

King, I. A.; Arnemann, J.; Spurr, N. K.; Buxton, R. S.: Cloning of the cDNA (DSC1) coding for human type 1 desmocollin and its assignment to chromosome 18. Genomics 18:185-194, 1993.

Troyanovsky, S. M.; Eshkind, L. G.; Troyanovsky, R. B.; Leube, R. E.; Franke, W. W.: Contributions of cytoplasmic domains of desmosomal cadherins to desmosome assembly and intermediate filament anchorage. Cell 72:561-574, 1993.

Arnemann, J.; Spurr, N. K.; Wheeler, G. N.; Parker, A. E.; Buxton, R. S.: Chromosomal assignment of the human genes coding for the major proteins of the desmosome junction, desmoglein DGI (DSG), desmocollins DGII/III (DSC), desmoplakins DPI/II (DSP), and plakoglobin DPIII (JUP). Genomics 10:640-645, 1991.

Buxton, R. S.; Cowin, P.; Franke, W. W.; Garrod, D. R.; Green, K. J.; King, I. A.; Koch, P. J.; Magee, A. I.; Rees, D. A.; Stanley, J. R.; Steinberg, M. S.: Nomenclature of the desmosomal cadherins. J. Cell Biol. 121:481-483, 1993.

Buxton, R. S.; Wheeler, G. N.; Pidsley, S. C.; Marsden, M. D.; Adams, M. J.; Jenkins, N. A.; Gilbert, D. J.; Copeland, N. G.: Mouse desmocollin (Dsc3) and desmoglein (Dsg1) genes are closely linked in the proximal region of chromosome 18. Genomics 21:510-516, 1994.

Greenwood, M. D.; Marsden, M. D.; Cowley, C. M. E.; Sahota, V. K.; Buxton, R. S.: Exon-intron organization of the human type 2 desmocollingene (DSC2): desmocollin gene structure is closer to 'classical' cadherins than to desmogleins. Genomics 44:330-335, 1997.

Schneider, S. S.; Schick, C.; Fish, K. E.; Miller, E.; Pena, J. C.; Treter, S. D.; Hui, S. M.; Silverman, G. A.: A serine proteinase inhibitor locus at 18q21.3 contains a tandem duplication of the human squamous cell carcinoma antigen gene. Proc. Nat. Acad. Sci. 92:3147-3151, 1995.

Ninomiya-Tsuji, J.; Nomoto, S.; Yasuda, H.; Reed, S. I.; Matsumoto, K.: Cloning of a human cDNA encoding a CDC2-related kinase by complementation of a budding yeast cdc28 mutation. Proc. Nat. Acad. Sci. 88:9006-9010,1991.

Shiffman, D.; Brooks, E. E.; Brooks, A. R.; Chan, C. S.; Milner, P. G.: Characterization of the human cyclin-dependent kinase 2 gene: promoter analysis and gene structure. J. Biol. Chem. 271:12199-12204,1996.

Tsai, L.-H.; Harlow, E.; Meyerson, M.: Isolation of the human cdk2 gene that encodes the cyclin A- and adenovirus E1A-associated p33 kinase. Nature 353:174-177, 1991.

Davies, R. L.; Grosse, V. A.; Kucherlapati, R.; Bothwell, M.: Genetic analysis of epidermal growth factor action:

assignment of human epidermal growth factor receptor gene to chromosome 7. Proc. Nat. Acad. Sci. 77:4188-4192, 1980.

Downward, J.; Yarden, Y.; Mayes, E.; Scrace, G.; Totty, N.; Stockwell, P.; Ullrich, A.; Schlessinger, J.; Waterfield, M. D.: Close similarity of epidermal growth factor receptor and v-erb-B oncogene protein sequences. Nature 307:521-527, 1984.

Haley, J.; Whittle, N.; Bennett, P.; Kinchington, D.; Ullrich, A.; Waterfield, M.: The human EGF receptor gene: structure of the 110 kb locus and identification of sequences regulating its transcription. OncogeneRes. 1:375-396, 1987.

Henn, W.; Blin, N.; Zang, K. D.: Polysomy of chromosome 7 is correlated with overexpression of the erbB oncogene in human glioblastoma celllines. Hum. Genet. 74:104-106, 1986.

Kondo, I.; Shimizu, N.: Mapping of the human gene for epidermal growth factor receptor (EGFR) on the p13-q22 region of chromosome 7. Cytogenet. Cell Genet. 35:9-14, 1983.

Kramer, A.; Yang, F.-C.; Snodgrass, P.; Li, X.; Scammell, T. E.; Davis, F. C.; Weitz, C. J.: Regulation of daily locomotor activity and sleep by hypothalamic EGF receptor signaling. Science 294:2511-2515,2001.

Lanzetti, L.; Rybin, V.; Malabarba, M. G.; Christoforidis, S.; Scita, G.; Zerial, M.; Di Fiore, P. P.: The Eps8 protein coordinates EGF receptor signalling through Rac and trafficking through Rab5. Nature 408:374-377, 2000.

Maciag, T.: The human epidermal growth factor receptor-kinasecomplex. Trends Biochem. Sci. 7:1-2, 1982.

Pai, R.; Soreghan, B.; Szabo, I. L.; Pavelka, M.; Baatar, D.; Tarnawski, A. S.: Prostaglandin E2 transactivates EGF receptor: anovel mechanism for promoting colon cancer growth and gastrointestinal hypertrophy. Nature Med. 8:289-293, 2002.

Mannick, J. B.; Hausladen, A.; Liu, L.; Hess, D. T.; Zeng, M.; Miao, Q. X.; Kane, L. S.; Gow, A. J.; Stamler, J. S.: Fas-induced caspase denitrosylation. Science 284:651-654, 1999.

Volpert, O. V.; Zaichuk, T.; Zhou, W.; Reiher, F.; Ferguson, T. A.; Stuart, P. M.; Amin, M.; Bouck, N. P.: Inducer-stimulated Fastargets activated endothelium for destruction by anti-angiogenic thrombospondin-1 and pigment epithelium-derived factor. Nature Med. 8:349-357, 2002.

Xu, S.; Wang, Y.; Roe, B.; Pearson, W. R.: Characterization of the human class mu glutathione S-transferase gene cluster and theGSTM1 deletion. J. Biol. Chem. 273:3517-3527, 1998.

Takahashi, Y.; Campbell, E. A.; Hirata, Y.; Takayama, T.; Listowsky, I.: A basis for differentiating among the multiple human mu-glutathione S-transferases and molecular cloning of brain GSTM5. J. Biol. Chem. 268:8893-8898, 1993.

Elliott, K. J.; Ellis, S. B.; Berckhan, K. J.; Urrutia, A.; Chavez-Noriega, L. E.; Johnson, E. C.; Velicelebi, G.; Harpold, M. M.: Comparative structure of human neuronal alpha (2)-alpha (7) and beta (2)-beta (4) nicotinic acetylcholine receptor subunits and functional expression of the alpha (2), alpha (3), alpha (4), alpha (7), beta (2), and beta (4) subunits. J. Molec. Neurosci. 7:217-228, 1996.

Solomon, E.; Hiorns, L. R.; Spurr, N.; Kurkinen, M.; Barlow, D.; Hogan, B. L. M.; Dalgleish, R.: Chromosomal assignments of the genes coding for human types II, III and IV collagen: a dispersed gene family. Proc. Nat. Acad. Sci. 82:3330-3334, 1985.

Reeve, R.; Silver, H. K.; Ferrier, P.: Marfan's syndrome (arachnodactyly) with arthrogryposis (amyoplasia congenita). Am. J. Dis. Child. 99:101-106, 1960.

Nieuwenhuis, E. E. S.; Matsumoto, T.; Exley, M.; Schleipman, R. A.; Glickman, J.; Bailey, D. T.; Corazza, N.; Colgan, S. P.; Onderdonk, A. B.; Blumberg, R. S.: CD1d-dependent macrophage-mediated clearanceof Pseudomonas aeruginosa from lung. Nature Med. 8:588-593, 2002.

Yang, J.; Patil, R. V.; Yu, H.; Gordon, M.; Wax, M. B.: T cell subsets and sIL-2R/IL-2 levels in patients with glaucoma. Am. J. Ophthal. 131:421-426, 2001.

Eng, C. M.; Kozak, C. A.; Beaudet, A. L.; Zoghbi, H. Y.: Mapping of multiple subunits of the neuronal nicotinic acetylcholine receptorto chromosome 15 in man and chromosome 9 in mouse. Genomics 9:278-282,1991.

Flora, A.; Schulz, R.; Benfante, R.; Battaglioli, E.; Terzano, S.; Clementi, F.; Fornasari, D.: Transcriptional regulation of the human alpha5 nicotinic receptor subunit gene in neuronal and non-neuronal tissues. Europ. J. Pharm. 393:85-95, 2000.

Fornasari, D.; Chini, B.; Tarroni, P.; Clementi, F.: molecular cloning of human neuronal nicotinic receptor alpha (3)-subunit. Neurosci. Lett. 111:351-356, 1990.

Groot Kormelink, P. J.; Luyten, W. H. M. L.: Cloning and sequence of full-length cDNAs encoding the human neuronal nicotinic acetylcholinereceptor (nAChR) subunits beta-3 and beta-4 and expression of sevennAChR subunits in the human neuroblastoma cell line SH-SY5Y and/orIMR-32. FEBS Lett. 400:309-314, 1997.

Mihovilovic, M.; Roses, A. D.: Expression of mRNAs in human thymuscoding for the alpha-3 subunit of a neuronal acetylcholine receptor. Exp. Neurol. 111:175-180, 1991.

Raimondi, E.; Rubboli, F.; Moralli, D.; Chini, B.; Fornasari, D.; Tarroni, P.; De Carli, L.; Clementi, F.: Chromosomal localization and physical linkage of the genes encoding the human alpha-3, alpha-5, and beta-4 neuronal nicotinic receptor subunits. Genomics 12:849-850,1992.

Rempel, N.; Heyers, S.; Engels, H.; Sleegers, E.; Steinlein, O. K.: The structures of the human neuronal nicotinic acetylcholinereceptor beta-2- and alpha-3-subunit genes (CHRNB2 and CHRNA3). Hum. Genet. 103:645-653, 1998.

Forman, S. A.; Miller, K. W.; Yellen, G.: A discrete site for general anesthetics on a postsynaptic receptor. Molec. Pharm. 48:574-581, 1995.

Forman, S. A.; Yellen, G.; Thiele, E. A.: Alternative mechanism for pathogenesis of an inherited epilepsy by a nicotinic AChR mutation.(Letter) Nature Genet. 13:396-397, 1996.

Hirose, S.; Iwata, H.; Akiyoshi, H.; Kobayashi, K.; Ito, M.; Wada, K.; Kaneko, S.; Mitsudome, A.: A novel mutation of CHRNA4 responsible for autosomal dominant nocturnal frontal lobe epilepsy. Neurology 53:1749-1753, 1999.

Marubio, L. M.; del Mar Arroyo-Jimenez, M.; Cordero-Erausquin, M.; Lena, C.; Le Novere, N.; de Kerchove d'Exaerde, A.; Huchet, M.; Damaj, M. I.; Changeux, J.-P.: Reduced antinociception in mice lacking neuronal nicotinic receptor subunits. Nature 398:805-810, 1999.

Monteggia, L. M.; Gopalakrishnan, M.; Touma, E.; Idler, K. B.; Nash, N.; Arneric, S. P.; Sullivan, J. P.; Giordano, T.: Cloningand transient expression of genes encoding the human alpha-4 and beta-2 neuronal nicotinic acetylcholine receptor (nAChR) subunits. Gene 155:189-193, 1995.

Pilz, A. J.; Willer, E.; Povey, S.; Abbott, C. M.: The genes coding for phosphoenolpyruvate carboxykinase-1 (PCK1) and neuronal nicotinic acetylcholine receptor alpha-4 subunit (CHRNA4) map to human chromosome 20, extending the known region of homology with mouse chromosome 2. Ann. Hum. Genet. 56:289-293, 1992.

Steinlein, O.; Smigrodzki, R.; Lindstrom, J.; Anand, R.; Kohler, M.; Tocharoentanaphol, C.; Vogel, F.: Refinement of the localization of the gene for neuronal nicotinic acetylcholine receptor alpha-4 subunit (CHRNA4) to human chromosome 20q13.2-q13.3. Genomics 22:493-495, 1994.

Steinlein, O.; Weiland, S.; Stoodt, J.; Propping, P.: Exon-intron structure of the human neuronal nicotinic acetylcholine receptor alpha-4 subunit (CHRNA4). Genomics 32:289-294, 1996.

Steinlein, O. K.; Magnusson, A.; Stoodt, J.; Bertrand, S.; Weiland, S.; Berkovic, S. F.; Nakken, K. O.; Propping, P.; Bertrand, D.: An insertion mutation of the CHRNA4 gene in a family with autosomal dominant nocturnal frontal lobe epilepsy. Hum. Molec. Genet. 6:943-947, 1997.

Steinlein, O. K.; Mulley, J. C.; Propping, P.; Wallace, R. H.; Phillips, H. A.; Sutherland, G. R.; Scheffer, I. E.; Berkovic, S. F.: A missense mutation in the neuronal nicotinic acetylcholine receptor alpha-4 subunit is associated with autosomal dominant nocturnal frontal lobe epilepsy. Nature Genet. 11:201-203, 1995.

Tsonis, P.; Goetinck, P. F.: The Drosophila homoeotic gene spaltis structurally related to collagen alpha-1(IV) chain. (Letter) Collagen Rel. Res. 8:451-452, 1988.

Wieslander, J.; Barr, J. F.; Butkowski, R. J.; Edwards, S. J.; Bygren, P.; Heinegard, D.; Hudson, B. G.: Goodpasture antigen of the glomerular basement membrane: localization to noncollagenous regions of type IV collagen. Proc. Nat. Acad. Sci. 81:3838-3842, 1984.

Wieslander, J.; Langeveld, J.; Butkowski, R.; Jodlowski, M.; Noelken, M.; Hudson, B. G.: Physical and immunochemical studies of the globulardomain of type IV collagen: cryptic properties of the Good pasture antigen. J. Biol. Chem. 260:8564-8570, 1985.

Prekeris, R.; Klumperman, J.; Scheller, R. H.: A Rab11/Rip11 protein complex regulates apical membrane trafficking via recycling endosomes. Molec. Cell 6:1437-1448, 2000.

Scott, A. F.: Personal Communication. Baltimore, Md. Feb. 26, 2001.

Cenciarelli, C.; Chiaur, D. S.; Guardavaccaro, D.; Parks, W.; Vidal, M.; Pagano, M.: Identification of a family of human f-box proteins. Curr. Biol. 9:1177-1179, 1999.

Winston, J. T.; Koepp, D. M.; Zhu, C.; Elledge, S. J.; Harper, J. W.: A family of mammalian F-box proteins. Curr. Biol. 9:1180-1182, 1999.

Gerlach, V. L.; Aravind, L.; Gotway, G.; Schultz, R. A.; Koonin, E. V.; Friedberg, E. C.: Human and mouse homologs of Escherichia coli DinB (DNA polymerase IV), members of the UmuC/DinB superfamily. Proc. Nat. Acad. Sci. 96:11922-11927, 1999.

Johnson, R. E.; Prakash, S.; Prakash, L.: The human DINB1 gene encodes the DNA polymerase Pol-theta. Proc. Nat. Acad. Sci. 97:3838-3843, 2000.

Ogi, T.; Kato, T., Jr.; Kato, T.; Ohmori, H.: Mutation enhancement by DINB1, a mammalian homologue of the Escherichia coli mutagenesis protein dinB. Genes Cells 4:607-618, 1999.

Ohashi, E.; Ogi, T.; Kusumoto, R.; Iwai, S.; Masutani, C.; Hanaoka, F.; Ohmori, H.: Error-prone bypass of certain DNA lesions by the human DNA polymerase kappa. Genes Dev. 14:1589-1594, 2000.

Koike, J.; Sagara, N.; Kirikoshi, H.; Takagi, A.; Miwa, T.; Hirai, M.; Katoh, M.: Molecular cloning and genomic structure of the beta-TRCP2 gene on chromosome 5q35.1. Biochem. Biophys. Res. Commun. 269:103-109, 2000.

Chiaur, D. S.; Murthy, S.; Cenciarelli, C.; Parks, W.; Loda, M.; Inghirami, G.; Demetrick, D.; Pagano, M.: Five human genes encoding F-box proteins: chromosome mapping and analysis in human tumors. Cytogenet. Cell Genet. 88:255-258, 2000.

Bauer, H.; Mayer, H.; Marchler-Bauer, A.; Salzer, U.; Prohaska, R.: Characterization of p40/GPR69A as a peripheral membrane protein related to the lantibiotic synthetase component C. Biochem. Biophys. Res. Commun. 275:69-74, 2000.

Mayer, H.; Bauer, H.; Prohaska, R.: Organization and chromosomal localization of the human and mouse genes coding for LanC-like protein1 (LANCL1). Cytogenet. Cell Genet. 93:100-104, 2001.

Mayer, H.; Salzer, U.; Breuss, J.; Ziegler, S.; Marchler-Bauer, A.; Prohaska, R.: Isolation, molecular characterization, and tissue-specific expression of a novel putative G protein-coupled receptor. Biochim. Biophys. Acta 1395:301-308, 1998.

Baylin, S. B.; Herman, J. G.: DNA hypermethylation in tumorigenesis:epigenetics joins genetics. Trends Genet. 16:168-174, 2000.

Cameron, E. E.; Bachman, K. E.; Myohanen, S.; Herman, J. G.; Baylin, S. B.: Synergy of demethylation and histone deacetylase inhibition in the re-expression of genes silenced in cancer. Nature Genet. 21:103-107, 1999.

Finch, P. W.; He, X.; Kelley, M. J.; Uren, A.; Schaudies, R. P.; Popescu, N. C.; Rudikoff, S.; Aaronson, S. A.; Varmus, H. E.; Rubin, J. S.: Purification and molecular cloning of a secreted, frizzled-related antagonist of Wnt action. Proc. Nat. Acad. Sci. 94:6770-6775, 1997.

Fukuhara, K.; Kariya, M.; Kita, M.; Shime, H.; Kanamori, T.; Kosaka, C.; Orii, A.; Fujita, J.; Fujii, S.: Secreted frizzled related protein 1 is overexpressed in uterine leiomyomas, associated with a high estrogenic environment and unrelated to proliferative activity. J. Clin. Endocr. Metab. 87:1729-1736, 2002.

Melkonyan, H. S.; Chang, W. C.; Shapiro, J. P.; Mahadevappa, M.; Fitzpatrick, P. A.; Kiefer, M. C.; Tomei, L. D.; Umansky, S. R.:SARPs: a family of secreted apoptosis-related proteins. Proc. Nat. Acad. Sci. 94:13636-13641, 1997.

Suzuki, H.; Gabrielson, E.; Chen, W.; Anbazhagan, R.; van Engeland, M.; Weijenberg, M. P.; Herman, J. G.; Baylin, S. B.: A genomic screen for genes upregulated by demethylation and histone deacetylase inhibition in human colorectal cancer. Nature Genet. 31:141.-149, 2002.

Rattner, A.; Hsieh, J.-C.; Smallwood, P. M.; Gilbert, D. J.; Copeland, N. G.; Jenkins, N. A.; Nathans, J.: A family of secreted proteins contains homology to the cysteine-rich ligand-binding domain of frizzled receptors. Proc. Nat. Acad. Sci. 94:2859-2863, 1997.

Gallagher, M. J.; Burgess, L. H.; Brunden, K. R.: Characterization of multiple forms of the human glycine transporter type-2. Molec. Brain Res. 70:101-115, 1999.

Liu, Q. R.; Lopez-Corcuera, B.; Mandiyan, S.; Nelson, H.; Nelson, N.: Cloning and expression of a spinal cord- and brain-specific glycine transporter with novel structural features. J. Biol. Chem. 268:22802-22808, 1993.

Bach, I.; Galcheva-Gargova, Z.; Mattei, M.-G.; Simon-Chazottes, D.; Guenet, J.-L.; Cereghini, S.; Yaniv, M.: Cloning of human hepatic nuclear factor 1 (HNF1) and chromosomal localization of its gene in man and mouse. Genomics 8:155-164, 1990.

Byrne, M. M.; Sturis, J.; Menzel, S.; Yamagata, K.; Fajans, S. S.; Dronsfield, M. J.; Bain, S. C.; Hattersley, A. T.; Velho, G.; Froguel, P.; Bell, G. I.; Polonsky, K. S.: Altered insulin secretory responses to glucose in diabetic and nondiabetic subjects with mutations in the diabetes susceptibility gene MODY3 on chromosome 12. Diabetes 45:1503-1510, 1996.

Chiu, K. C.; Chuang, L.-M.; Ryu, J. M.; Tsai, G. P.; Saad, M. F.: The I27L amino acid polymorphism of hepatic nuclear factor-1-alphais associated with insulin resistance. J. Clin. Endocr. Metab. 85:2178-2183, 2000.

Collet, C.; et al.; et al.: Prevalence of the missense mutation Gly574Ser in the hepatocyte nuclear factor-1-alpha in Africans with diabetes. Diabetes Metab. 28:39-44, 2002.

Courtois, G.; Morgan, J. G.; Campbell, L. A.; Fourel, G.; Crabtree, G. R.: Interaction of a liver-specific nuclear factor with the fibrinogen and alpha-1-antitrypsin promoters. Science 238:688-692, 1987.

De Simone, V.; De Magistris, L.; Lazzaro, D.; Gerstner, J.; Monaci, P.; Nicosia, A.; Cortese, R.: LFB3, a heterodimer-forming homeoprotein of the LFB1 family, is expressed in specialized epithelia. EMBO J. 10:1435-1443, 1991.

Ellard, S.: Hepatocyte nuclear factor 1 alpha (HNF-1-alpha) mutations in maturity-onset diabetes of the young. Hum. Mutat. 16:377-385,2000.

Frayling, T. M.; Bulman, M. P.; Appleton, M.; Hattersley, A. T.; Ellard, S.: A rapid screening method for hepatocyte nuclear factor 1 alpha frameshift mutations; prevalence in maturity-onset diabetes of the young and late-onset non-insulin dependent diabetes. Hum. Genet. 101:351-354, 1997.

Frayling, T. M.; Bulman, M. P.; Ellard, S.; Appleton, M.; Dronsfield, M. J.; Mackie, A. D. R.; Baird, J. D.; Kaisaki, P. J.; Yamagata, K.; Bell, G. I.; Bain, S. C.; Hattersley, A. T.: Mutations in the hepatocytenuclear factor-1-alpha gene are a common cause of maturity-onset diabetes of the young in the U. K. Diabetes 46:720-725, 1997.

Godart, F.; Bellanne-Chantelot, C.; Clauin, S.; Gragnoli, C.; Abderrahmani, A.; Blanche, H.; Boutin, P.; Chevre, J. C.; Froguel, P.; Bailleul, B.: Identification of seven novel nucleotide variants in the hepatocyte nuclear factor-1-alpha (TCF1) promoter region in MODY patients. Hum. Mutat. 15:173-180, 2000.

Gonzalez, F. J.; Liu, S.-Y.; Kozak, C. A.; Nebert, D. W.: Decreased Hnf-1 gene expression in mice homozygous for a 1.2-centimorgan deletionon chromosome 7. DNA Cell Biol. 9:771-776, 1990.

Gragnoli, C.; Lindner, T.; Cockburn, B. N.; Kaisaki, P. J.; Gragnoli, F.; Marozzi, G.; Bell, G. I.: Maturity-onset diabetes of the young due to a mutation in the hepatocyte nuclear factor-4-alpha binding site in the promoter of the hepatocyte nuclear factor-1-alpha gene. Diabetes 46:1648-1651, 1997.

Hansen, T.; Eiberg, H.; Rouard, M.; Vaxillaire, M.; Moller, A. M.; Rasmussen, S. K.; Fridberg, M.; Urhammer, S. A.; Holst, J. J.; Almind, K.; Echwald, S. M.; Hansen, L.; Bell, G. I.; Pedersen, O.: Novel MODY3 mutations in the hepatocyte nuclear factor-1-alpha gene:evidence for a hyperexcitability of pancreatic beta-cells to intravenous secretagogues in a glucose-tolerant carrier of a P447L mutation. Diabetes 46:726-730, 1997.

Hegele, R. A.; Cao, H.; Harris, S. B.; Hanley, A. J. G.; Zinman, B.: The hepatic nuclear factor-1-alpha G319S variant is associated with early-onset type 2 diabetes in Canadian Oji-Cree. J. Clin. Endocr. Metab. 84:1077-1082, 1999.

Hegele, R. A.; Cao, H.; Harris, S. B.; Zinman, B.; Hanley, A. J. G.; Anderson, C. M.: Peroxisome proliferator-activated receptor-gamma-2P12A and type 2 diabetes in Canadian Oji-Cree. J. Clin. Endocr. Metab. 85:2014-2019, 2000.

Hiraiwa, H.; Pan, C.-J.; Lin, B.; Akiyama, T. E.; Gonzalez, F. J.; Chou, J. Y.: A molecular link between the common phenotypes oftype 1 glycogen storage disease and HNF1-alpha-null mice. J. Biol. Chem. 276:7963-7967, 2001.

Hua, Q.-X.; Zhao, M.; Narayana, N.; Nakagawa, S. H.; Jia, W.; Weiss, M. A.: Diabetes-associated mutations in a beta-cell transcription factor destabilize an antiparallel 'mini-zipper' in a dimerization interface. Proc. Nat. Acad. Sci. 97:1999-2004, 2000.

Kaisaki, P. J.; Menzel, S.; Lindner, T.; Oda, N.; Rjasanowski, I.; Sahm, J.; Meincke, G.; Schulze, J.; Schmechel, H.; Petzold, C.; Ledermann, H. M.; Sachse, G.; Boriraj, V. V.; Menzel, R.; Kerner, W.; Turner, R. C.; Yamagata, K.; Bell, G. I.: Mutations in the hepatocytenuclear factor-1-alpha gene in MODY and early-onset NIDDM: evidence for a mutational hotspot in exon 4. Diabetes 46:528-535, 1997.

Kuo, C. J.; Conley, P. B.; Hsieh, C.-L.; Francke, U.; Crabtree, G. R.: Molecular cloning, functional expression, and chromosomal localization of mouse hepatocyte nuclear factor 1. Proc. Nat. Acad. Sci. 87:9838-9842, 1990.

Mendel, D. B.; Hansen, L. P.; Graves, M. K.; Conley, P. B.; Crabtree, G. R.: HNF-1-alpha and HNF-1-beta (vHNF-1) share dimerization and homeo domains, but not activation domains, and form heterodimers invitro. Genes Dev. 5:1042-1056, 1991.

Miedzybrodzka, Z.; Hattersley, A. T.; Ellard, S.; Pearson, D.; de Silva, D.; Harvey, R.; Haites, N.: Non-penetrance in a MODY 3 family with a mutation in the hepatic nuclear factor 1a gene: implications for predictive testing. Europ. J. Hum. Genet. 7:729-732, 1999.

Pontoglio, M.; Barra, J.; Hadchouel, M.; Doyen, A.; Kress, C.; Bach, J. P.; Babinet, C.; Yaniv, M.: Hepatocyte nuclear factor 1 inactivation results in hepatic dysfunction, phenylketonuria, and renal Fanconi syndrome. Cell 84:575-585, 1996.

Carroll, M. C.; Katzman, P.; Alicot, E. M.; Koller, B. H.; Geraghty, D. E.; Orr, H. T.; Strominger, J. L.; Spies, T.: Linkage map of the human major histocompatibility complex including the tumor necrosisfactor genes. Proc. Nat. Acad. Sci. 84:8535-8539, 1987.

Miki, T.; Kawamata, N.; Arai, A.; Ohashi, K.; Nakamura, Y.; Kato, A.; Hirosawa, S.; Aoki, N.: Molecular cloning of the breakpoint for 3q27 translocation in B-cell lymphomas and leukemias. Blood 83:217-222, 1994.

Ferrari, A. C.; Seuanez, H. N.; Hanash, S. M.; Atweh, G. F.: Agene that encodes for a leukemia-associated phosphoprotein (p18) mapsto chromosome bands 1p35-36.1. Genes Chromosomes Cancer 2:125-129,1990.

Hanash, S. M.; Strahler, J. R.; Kuick, R.; Chu, E. H. Y.; Nichols, D.: Identification of a polypeptide associated with the malignant phenotype in acute leukemia. J. Biol. Chem. 263:12813-12815, 1988.

Kumar, R.; Haugen, J. D.: Human and rat osteoblast-like cells express stathmin, a growth-regulatory protein. Biochem. Biophys. Res. Commun. 201:861-865, 1994.

Maucuer, A.; Camonis, J. H.; Sobel, A.: Stathmin interaction witha putative kinase and coiled-coil-forming protein domains. Proc. Nat. Acad. Sci. 92:3100-3104, 1995.

Mock, B. A.; Krall, M. M.; Padlan, C.; Dosik, J. K.; Schubart, U. K.: The gene for Lap18, leukemia-associated phosphoprotein p18 (metablastin), maps to distal mouse chromosome 4. Mammalian Genome 4:461-462, 1993.

Okazaki, T.; Yoshida, B. N.; Avraham, K. B.; Wang, H.; Wuenschell, C. W.; Jenkins, N. A.; Copeland, N. G.; Anderson, D. J.; Mori, N.: Molecular diversity of the SCG10/stathmin gene family in the mouse. Genomics 18:360-373, 1993. Note: Erratum: Genomics 21:298 only, 1994.

Sobel, A.: Stathmin: a relay phosphoprotein for multiple signaltransduction? Trends Biochem. Sci. 16:301-305, 1991.

Sobel, A.; Boutterin, M.-C.; Beretta, L.; Chneiweiss, H.; Doye, V.; Peyro-Saint-Paul, H.: Intracellular substrates for extracellular signaling: characterization of a ubiquitous, neuron-enriched phosphoprotein (stathmin). J. Biol. Chem. 264: 3765-3772, 1989.

Zhu, X. X.; Kozarsky, K.; Strahler, J. R.; Eckerskorn, C.; Lottspeich, F.; Melhem, R.; Lowe, J.; Fox, D. A.; Hanash, S. M.; Atweh, G. F.: Molecular cloning of a novel human leukemia-associated gene: evidence of conservation in animal species. J. Biol. Chem. 264:14556-14560,1989.

Li, S.-H.; Lam, S.; Cheng, A. L.; Li, X.-J.: Intranuclear huntingt in increases the expression of caspase-1 and induces apoptosis. Hum. Molec. Genet. 9:2859-2867, 2000.

Mangiarini, L.; Sathasivam, K.; Seller, M.; Cozens, B.; Harper, A.; Hetherington, C.; Lawton, M.; Trottier, Y.; Lehrach, H.; Davies, S. W.; Bates, G. P.: Exon 1 of the HD gene with an expanded CAG repeatis sufficient to cause a progressive neurological phenotype in transgenic mice. Cell 87:493-506, 1996.

Ona, V. O.; Li, M.; Vonsattel, J. P. G.; Andrews, L. J.; Khan, S. Q.; Chung, W. M.; Frey, A. S.; Menon, A. S.; Li, X.-J.; Stieg, P. E.; Yuan, J.; Penney, J. B.; Young, A. B.; Cha, J.-H. J.; Friedlander, R. M.: Inhibition of caspase-1 slows disease progression in a mouse model of Huntington's disease. Nature 399:263-267, 1999.

Arend, W. P.: Interleukin 1 receptor antagonist: a new member of the interleukin 1 family. J. Clin. Invest. 88:1445-1451, 1991.

Blakemore, A. I. F.; Cox, A.; Gonzalez, A.-M.; Maskill, J. K.; Hughes, M. E.; Wilson, R. M.; Ward, J. D.; Duff, G. W.: Interleukin-1 receptor antagonist allele (IL1RN*2) associated with nephropathy indiabetes mellitus. Hum. Genet. 97:369-374, 1996.

Blakemore, A. I. F.; Tarlow, J. K.; Cork, M. J.; Gordon, C.; Emery, P.; Duff, G. W.: Interleukin-1 receptor antagonist gene polymorphismas a disease severity factor in systemic lupus erythematosus. ArthritisRheum. 37:1380-1385, 1994.

Dinarello, C. A.; Wolff, S. M.: The role of interleukin-1 in disease. NewEng. J. Med. 328:106-113, 1993.

Carter, D. B.; Deibel, M. R., Jr.; Dunn, C. J.; Tomich, C.-S. C.; Laborde, A. L.; Slightom, J. L.; Berger, A. E.; Bienkowski, M. J.; Sun, F. F.; McEwan, R. N.; Harris, P. K. W.; Yem, A. W.; Waszak, G. A.; Chosay, J. G.; Sieu, L. C.; Hardee, M. M.; Zurcher-Neely, H. A.; Reardon, I. M.; Heinrikson, R. L.; Truesdell, S. E.; Shelly, J. A.; Eessalu, T. E.; Taylor, B. M.; Tracey, D. E.: Purification, cloning, expression and biological characterization of an interleukin-1 receptorantagonist protein. Nature 344:633-638, 1990.

El-Omar, E. M.; Carrington, M.; Chow, W.-H.; McColl, K. E. L.; Bream, J. H.; Young, H. A.; Herrera, J.; Lissowska, J.; Yuan, C.-C.; Rothman, N.; Lanyon, G.; Martin, M.; Fraumeni, J. F., Jr.; Rabkin, C. S.: Interleukin-1 polymorphisms associated with increased risk of gastric cancer. Nature 404:398-402, 2000.

Gabay, C.; Smith, M. F., Jr.; Eidlen, D.; Arend, W. P.: Interleukin1 receptor antagonist (IL-1Ra) is an acute-phase protein. J. Clin. Invest. 99:2930-2940, 1997.

Langdahl, B. L.; Lokke, E.; Carstens, M.; Stenkjaer, L. L.; Eriksen, E. F.: Osteoporotic fractures are associated with an 86-base pairrepeat polymorphism in the interleukin-1-receptor antagonist genebut not with polymorphisms in the interleukin-1 beta gene. J. BoneMiner. Res. 15:402-414, 2000.

Anzick, S. L.; Kononen, J.; Walker, R. L.; Azorsa, D. O.; Tanner, M. M.; Guan, X.-Y.; Sauter, G.; Kallioniemi, O.-P.; Trent, J. M.; Meltzer, P. S.: AIB1, a steroid receptor coactivator amplified in breast and ovarian cancer. Science 277:965-968, 1997.

Tetteroo, P. A. T.; de Heij, H. T.; Van den Eijnden, D. H.; Visser, F. J.; Schoenmaker, E.; Geurts van Kessel, A. H. M.: A GDP-fucose:(Gal-beta-1-to-4)GlcNAcalpha-1-to-3-fucosyltransferase activity is correlated with the presence of human chromosome 11 and the expression of the Le (x), Le (y), andsialyl-Le (x) antigens in human-mouse cell hybrids. J. Biol. Chem. 262:15984-15989, 1987.

Chang, M.-L.; Eddy, R. L.; Shows, T. B.; Lau, J. T. Y.: Threegenes that encode human beta-galactoside alpha-2,3-sialyl transferases. Structural analysis and chromosomal mapping studies. Glycobiology 5:319-325, 1995.

de Heij, H. T.; Tetteroo, P. A. T.; Geurts van Kessel, A. H. M.; Schoenmaker, E.; Visser, F. J.; van den Eijnden, D. H.: Specific expression of a myeloid-associated CMP-NeuAc: Gal-beta-1-3GalNAc-alpha-R-alpha-2-3-sialyl transferase and the sialyl-X determinant in myeloid human-mouse cell hybrids containing human chromosome 11. Cancer Res. 48:1489-1493, 1988.

Kitagawa, H.; Mattei, M.-G.; Paulson, J. C.: Genomic organization and chromosomal mapping of the Gal-beta-1, 3GalNAc/Gal-beta-1,4GlcNAcalpha-2,3-sialyl transferase. J. Biol. Chem. 271:931-938, 1996.

Regan, J. W.; Kobilka, T. S.; Yang-Feng, T. L.; Caron, M. G.; Lefkowitz, R. J.; Kobilka, B. K.: Cloning and expression of a human kidney cDNA for an alpha-2-adrenergic receptor subtype. Proc. Nat. Acad. Sci. 85:6301-6305, 1988.

Heinonen, P.; Koulu, M.; Pesonen, U.; Karvonen, M. K.; Rissanen, A.; Laakso, M.; Valve, R.; Uusitupa, M.; Scheinin, M.: Identification of a three-amino acid deletion in the alpha-2B-adrenergic receptor that is associated with reduced basal metabolic rate in obese subjects. J. Clin. Endocr. Metab. 84:2429-2433, 1999.

Lomasney, J. W.; Lorenz, W.; Allen, L. F.; King, K.; Regan, J. W.; Yang-Feng, T. L.; Caron, M. G.; Lefkowitz, R. J.: Expansion of the alpha-2-adrenergic receptor family: cloning and characterization of a human alpha-2-adrenergic receptor subtype, the gene for which is located on chromosome 2. Proc. Nat. Acad. Sci. 87:5094-5098,1990.

Baek, S. H.; Ohgi, K. A.; Rose, D. W.; Koo, E. H.; Glass, C. K.; Rosenfeld, M. G.: Exchange of N-CoR corepressor and Tip60 coactivator complexes links gene expression by NF-kappa-B and beta-amyloid precursor protein. Cell 110:55-67, 2002.

Nasir, J.; Lin, B.; Bucan, M.; Koizumi, T.; Nadeau, J. H.; Hayden, M. R.: The murine homologues of the Huntington disease gene (Hdh) and the alpha-adducin gene (Add1) map to mouse chromosome 5 withina region of conserved synteny with human chromosome 4p16.3. Genomics 22:198-201, 1994.

Peters, L. L.; Birkenmeier, C. S.; Bronson, R. T.; White, R. A.; Lux, S. E.; Otto, E.; Bennett, V.; Higgins, A.; Barker, J. E.: Purkinjecell degeneration associated with erythroid ankyrin deficiency innb/nb mice. J. Cell Biol. 114:1233-1241, 1991.

Taylor, S. A. M.; Snell, R. G.; Buckler, A.; Ambrose, C.; Duyao, M.; Church, D.; Lin, C. S.; Altherr, M.; Bates, G. P.; Groot, N.; Barnes, G.; Shaw, D. J.; Lehrach, H.; Wasmuth, J. J.; Harper, P. S.; Housman, D. E.; MacDonald, M. E.; Gusella, J. F.: Cloning of the alpha-adducin gene from the Huntington's disease candidate region of chromosome 4 by exon amplification. Nature Genet. 2:223-227,1992.

Gilligan, D. M.; Lieman, J.; Bennett, V.: Assignment of the human beta-adducin gene (ADD2) to 2p13-p14 by in situ hybridization. Genomics 28:610-612, 1995.

Muro, A. F.; Marro, M. L.; Gajovic, S.; Porro, F.; Luzzatto, L.; Baralle, F. E.: Mild spherocytic hereditary elliptocytosis and altered levels of alpha- and gamma-adducins in beta-adducin-deficient mice. Blood 95:3978-3985, 2000.

Tisminetzky, S.; Devescovi, G.; Tripodi, G.; Muro, A.; Bianchi, G.; Colombi, M.; Moro, L.; Barlati, S.; Tuteja, R.; Baralle, F. E.: Genomic organisation and chromosomal localisation of the gene encoding human beta adducin. Gene 167:313-316, 1995.

White, R. A.; Angeloni, S. V.; Pasztor, L. M.: Chromosomal localization of the beta-adducin gene to mouse chromosome 6 and human chromosome 2. Mammalian Genome 6:741-743, 1995.

Lai, L.; Hart, I.; Patterson, D.: Human chromosome 1 corrects the defect in the CHO mutant (Ade-H) deficient in a branch point enzyme in purine de novo biosynthesis. (Abstract) Cytogenet. Cell Genet. 51:1028 only, 1989.

Lai, L.-W.; Hart, I. M.; Patterson, D.: A gene correcting the defect in the CHO mutant Ade (-)H, deficient in a branch point enzyme (adenylosuccinate synthetase) of de novo purine biosynthesis, is located on the long arm of chromosome 1. Genomics 9:322-328, 1991.

Powell, S. M.; Zalkin, H.; Dixon, J. E.: Cloning and characterization of the cDNA encoding human adenylosuccinate synthetase. FEBS Lett. 303:4-10, 1992.

Parma, J.; Stengel, D.; Gannage, M.-H.; Poyard, M.; Barouki, R.; Hanoune, J.: Sequence of a human brain adenylyl cyclase partial cDNA: evidence for a consensus cyclase domain. Biochem. Biophys. Res. Commun. 179:455-462, 1991.

Stengel, D.; Parma, J.; Gannage, M.-H.; Roeckel, N.; Mattei, M.-G.; Barouki, R.; Hanoune, J.: Different chromosomal localization of two adenylyl cyclase genes expressed in human brain. Hum. Genet. 90:126-130, 1992.

Edelhoff, S.; Villacres, E. C.; Storm, D. R.; Disteche, C. M.: Mapping of adenylyl cyclase genes type I, II, III, IV, V, and VI in mouse. Mammalian Genome 6:111-113, 1995.

Gaudin, C.; Homcy, C. J.; Ishikawa, Y.: Mammalian adenylyl cyclase family members are randomly located on different chromosomes. Hum. Genet. 94:527-529, 1994.

Wong, S. T.; Trinh, K.; Hacker, B.; Chan, G. C. K.; Lowe, G.; Gaggar, A.; Xia, Z.; Gold, G. H.; Storm, D. R.: Disruption of the type III adenylyl cyclase gene leads to peripheral and behavioral anosmia intransgenic mice. Neuron 27:487-497, 2000.

Reich, T.; Edenberg, H. J.; Goate, A.; Williams, J. T.; Rice, J. P.; Van Eerdewegh, P.; Foroud, T.; et al: Genome-wide search for genes affecting the risk for alcohol dependence. Am. J. Med. Genet. 81:207-215, 1998.

Shea, S. H.; Wall, T. L.; Carr, L. G.; Li, T.-K.: ADH2 and alcohol-related phenotypes in Ashkenazic Jewish American college students. Behav. Genet. 31:231-239, 2001.

Takeshita, T.; Mao, X.-Q.; Morimoto, K.: The contribution of polymorphism in the alcohol dehydrogenase beta subunit to alcohol sensitivity in a Japanese population. Hum. Genet. 97:409-413, 1996.

Trezise, A. E. O.; Godfrey, E. A.; Holmes, R. S.; Beacham, I. F.: Cloning and sequencing of cDNA encoding baboon liver alcohol dehydrogenase: evidence for a common ancestral lineage with the human alcohol dehydrogenase beta subunit and for class I ADH gene duplication spredating primate radiation. Proc. Nat. Acad. Sci. 86:5454-5458, 1989.

Xu, Y.; Carr, L. G.; Bosron, W. F.; Li, T.-K.; Edenberg, H. J.: Genotyping of human alcohol dehydrogenases at the ADH2 and ADH3 loci following DNA sequence amplification. Genomics 2:209-214, 1988.

Yin, S.-J.; Bosron, W. F.; Li, T.-K.; Ohnishi, K.; Okuda, K.; Ishii, H.; Tsuchiya, M.: Polymorphism of human liver alcohol dehydrogenase: identification of ADH(2)2-1 and ADH(2)2-2 phenotypes in the Japaneseby isoelectric focusing. Biochem. Genet. 22:169-180, 1984.

Yokoyama, S.; Yokoyama, R.; Rotwein, P.: Molecular characterization of cDNA clones encoding the human alcohol dehydrogenase beta-1 and the evolutionary relationship to the other class I subunits alpha and gamma. Jpn. J. Genet. 62:241-256, 1987.

Huebner, K.; Kastury, K.; Druck, T.; Salcini, A. E.; Lanfrancone, L.; Pelicci, G.; Lowenstein, E.; Li, W.; Park, S.-H.; Cannizzaro, L.; Pelicci, P. G.; Schlessinger, J.: Chromosome locations of genes encoding human signal transduction adapter proteins, Nck (NCK), Shc (SHC1), and Grb2 (GRB2). Genomics 22:281-287, 1994.

Tangye, S. G.; Phillips, J. H.; Lanier, L. L.; Nichols, K. E.: Cutting edge: functional requirement for SAP in 2B4-mediated activation of human natural killer cells as revealed by the X-linked lymphoproliferative syndrome. J. Immun. 165:2932-2936, 2000.

Gras, M. P.; Laabi, Y.; Linares-Cruz, G.; Blondel, M. O.; Rigaut, J. P.; Brouet, J. C.; Leca, G.; Haguenauer-Tsapis, R.; Tsapis, A.: BCMAp: an integral membrane protein in the Golgi apparatus of human mature B lymphocytes. Int. Immun. 7:1093 only, 1995.

Laabi, Y.; Gras, M. P.; Carbonnel, F.; Brouet, J. C.; Berger, R.; Larsen, C. J.; Tsapis, A.: A new gene, BCM, on chromosome 16 is fused to the interleukin 2 gene by a t (4;16)(q26; p13) translocation in a malignant T cell lymphoma. EMBO J. 11:3897-3904, 1992.

Hatzoglou, A.; Roussel, J.; Bourgeade, M.-F.; Rogier, E.; Madry, C.; Inoue, J.; Devergne, O.; Tsapis, A.: TNF receptor family member BCMA (B cell maturation) associates with TNF receptor-associated factor (TRAF) 1, TRAF2, and TRAF3 and activates NF-kappa-B, Elk-1, c-JunN-terminal kinase, and p38 mitogen-activated protein kinase. J. Immun. 165:1322-1330, 2000.

Anstee, D. J.: The blood group MNSs-active sialoglycoproteins. Seminars Hemat. 18:13-31, 1981.

Bias, W. B.; Meyers, D. A.: Segregation and linkage analysis of the Stoltzfus blood group (SF). (Abstract) Cytogenet. Cell Genet. 25:137, 1979.

Blumenfeld, O. O.; Adamany, A. M.: Structural (glycophorins) of the human erythrocyte membrane. Proc. Nat. Acad. Sci. 75:2727-2731, 1978.

Blumenfeld, O. O.; Huang, C.-H.: Molecular genetics of the glycophorin gene family, the antigens for MNSs blood groups: multiple gene rearrangements and modulation of splice site usage result in extensive diversification. Hum. Mutat. 6:199-209, 1995.

Cook, P. J. L.; Lindenbaum, R. H.; Salonen, R.; de la Chapelle, A.; Daker, M. G.; Buckton, K. E.; Noades, J. E.; Tippett, P.: The MNSs blood groups of families with chromosome 4 rearrangements. Ann. Hum. Genet. 45:39-47, 1981.

Cook, P. J. L.; Noades, J. E.; Lomas, C. G.; Buckton, K. E.; Robson, E. B.: Exclusion mapping illustrated by the MNSs blood group. Ann. Hum. Genet. 44:61-73, 1980.

Cook, P. J. L.; Robson, E. B.; Buckton, K. E.; Slaughter, C. A.; Gray, J. E.; Blank, C. E.; James, F. E.; Ridler, M. A. C.; Insley, J.; Hulten, M.: Segregation of ABO, AK-1 and ACON-S in families with abnormalities of chromosome 9. Ann. Hum. Genet. 41:365-377, 1978.

Divelbiss, J.; Shiang, R.; German, J.; Moore, J.; Murray, J. C.; Patil, S. R.: Refinement of the physical location of glycophorin A and beta fibrinogen using in situ hybridization and RFLP analysis. (Abstract) Cytogenet. Cell Genet. 51:991, 1989.

Evans, R. M.: The steroid and thyroid hormone receptor superfamily. Science 240:889-895, 1988.

Bader, B. L.; Rayburn, H.; Crowley, D.; Hynes, R. O.: Extensive vasculogenesis, angiogenesis, and organogenesis precede lethality in mice lacking all alpha-V integrins. Cell 95:507-519, 1998.

Fernandez-Ruiz, E.; de Villena, F. P.-M.; Rodriguez de Cordoba, S.; Sanchez-Madrid, F.: Regional localization of the human vitronectin receptor alpha-subunit gene (VNRA) to chromosome 2q31-q32. Cytogenet. Cell Genet. 62:26-28, 1993.

Sims, M. A.; Field, S. D.; Barnes, M. R.; Shaikh, N.; Ellington, K.; Murphy, K. E.; Spurr, N.; Campbell, D. A.: Cloning and characterisation of ITGAV, the genomic sequence for human cell adhesion protein (vitronectin) receptor alpha subunit, CD51. Cytogenet. Cell Genet. 89:268-271, 2000.

Suzuki, S.; Argraves, W. S.; Pytela, R.; Arai, H.; Krusius, T.; Pierschbacher, M. D.; Ruoslahti, E.: cDNA and amino acid sequences of the cell adhesion protein receptor recognizing vitronectin reveal a transmembrane domain and homologies with other adhesion protein receptors. Proc. Nat. Acad. Sci. 83:8614-8618, 1986.

Hromas, R.; Collins, S. J.; Hickstein, D.; Raskind, W.; Deaven, L. L.; O'Hara, P.; Hagen, F. S.; Kaushansky, K.: A retinoic acid-responsive human zinc finger gene, MZF-1, preferentially expressed in myeloid cells. J. Biol. Chem. 266: 14183-14187, 1991.

Morris, J. F.; Rauscher, F. J., III; Davis, B.; Klemsz, M.; Xu, D.; Tenen, D.; Hromas, R.: The myeloid zinc finger gene, MZF-1, regulates the CD34 promoter in vitro. Blood 86:3640-3647, 1995.

Tommerup, N.; Aagaard, L.; Lund, C. L.; Boel, E.; Baxendale, S.; Bates, G. P.; Lehrach, H.; Vissing, H.: A zinc-finger gene ZNF141 mapping at 4p16.3/D4S90 is a candidate gene for the Wolf-Hirschhorn (4p-) syndrome. Hum. Molec. Genet. 2:1571-1575, 1993.

McAlpine, P. J.; Coopland, G.; Guy, C.; James, S.; Komarnicki, L.; MacDonald, M.; Stranc, L.; Lewis, M.; Philipps, S.; Coghlan, G.; Kaita, H.; Cox, D. W.; Guinto, E. R.; MacGillivray, R.: Mapping the genes for erythrocytic alpha-spectrin 1 (SPTA1) and coagulation factor V (F5). (Abstract) Cytogenet. Cell Genet. 51:1042, 1989.

de Silva, H. V.; Harmony, J. A. K.; Stuart, W. D.; Gil, C. M.; Robbins, J.: Apolipoprotein J: structure and tissue distribution. Biochemistry 29:5380-5389, 1990.

de Silva, H. V.; Stuart, W. D.; Park, Y. B.; Mao, S. J. T.; Gil, C. M.; Wetterau, J. R.; Busch, S. J.; Harmony, J. A. K.: Purification and characterization of a polipoprotein J. J. Biol. Chem. 265:14292-14297,1990.

Dietzsch, E.; Murphy, B. F.; Kirszbaum, L.; Walker, I. D.; Garson, O. M.: Regional localization of the gene for clusterin (SP-40,40; gene symbol CLI) to human chromosome 8p12-p21. Cytogenet. Cell Genet. 61:178-179, 1992.

Dragunow, M.; Preston, K.; Dodd, J.; Young, D.; Lawlor, P.; Christie, D.: Clusterin accumulates in dying neurons following status epilepticus. Molec. Brain Res. 32:279-290, 1995.

Duguid, J. R.; Bohmont, C. W.; Liu, N.; Tourtellotte, W. W.: Changesin brain gene expression shared by scrapie and Alzheimer disease. Proc. Nat. Acad. Sci. 86:7260-7264, 1989.

Fink, T. M.; Zimmer, M.; Tschopp, J.; Etienne, J.; Jenne, D. E.; Lichter, P.: Human clusterin (CLI) maps to 8p21 in proximity to the lipoprotein lipase (LPL) gene. Genomics 16:526-528, 1993.

Han, B. H.; DeMattos, R. B.; Dugan, L. L.; Kim-Han, J. S.; Brendza, R. P.; Fryer, J. D.; Kierson, M.; Cirrito, J.; Quick, K.; Harmony, J. A. K.; Aronow, B. J.; Holtzman, D. M.: Clusterin contributes tocaspase-3-independent brain injury following neonatal hypoxia-ischemia. Nature Med. 7:338-343, 2001.

Jenne, D. E.; Tschopp, J.: Clusterin: the intriguing guises of a widely expressed glycoprotein. Trends Biochem. Sci. 17:154-159,1992.

Kamboh, M. I.; Harmony, J. A. K.; Sepehrnia, B.; Nwankwo, M.; Ferrell, R. E.: Genetic studies of human apolipoproteins. XX. Geneticpolymorphism of apolipoprotein J and its impact on quantitative lipid traits in normolipidemic subjects. Am. J. Hum. Genet. 49:1167-1173,1991.

Kirszbaum, L.; Sharpe, J. A.; Murphy, B.; d'Apice, A. J. F.; Classon, B.; Hudson, P.; Walker, I. D.: Molecular cloning and characterization of the novel, human complement-associated protein, SP-40,40: a link between the complement and reproductive systems. EMBO J. 8:711-718,1989.

Murphy, B. F.; Kirszbaum, L.; Walker, I. D.; d'Apice, A. J. F.: SP-40,40, a newly identified normal human serum protein found in the SC5b-9 complex of complement and in the immune deposits in glomerulonephritis. J. Clin. Invest. 81:1858-1864, 1988.

O'Bryan, M. K.; Baker, H. W. G.; Saunders, J. R.; Kirszbaum, L.; Walker, I. D.; Hudson, P.; Liu, D. Y.; Glew, M. D.; d'Apice, A. J. F.; Murphy, B. F.: Human seminal clusterin (SP-40,40): isolation and characterization. J. Clin. Invest. 85:1477-1486, 1990.

Purrello, M.; Bettuzzi, S.; Di Pietro, C.; Mirabile, E.; Di Blasi, M.; Rimini, R.; Grzeschik, K.-H.; Ingletti, C.; Corti, A.; Sichel, G.: The gene for SP-40,40, human homolog of rat sulfated glycoprotein 2, rat clusterin, and rat testosterone-repressed prostate message 2, maps to chromosome 8. Genomics 10:151-156, 1991.

Slawin, K.; Sawczuk, I. S.; Olsson, C. A.; Buttyan, R.: Chromosomal assignment of the human homologue encoding SGP-2. Biochem. Biophys. Res. Commun. 172:160-164, 1990.

Alves, S.; Prata, M.-J.; Ferreira, F.; Amorim, A.: Thiopurinemethyl transferase pharmacogenetics: alternative molecular diagnosis and preliminary data from Northern Portugal. Pharmacogenetics 9:257-261, 1999.

Ameyaw, M.-M.; Collie-Duguid, E. S. R.; Powrie, R. H.; Ofori-Adjei, D.; McLeod, H. L.: Thiopurine methyltransferase alleles in Britishand Ghanaian populations. Hum. Molec. Genet. 8:367-370, 1999.

Collie-Duguid, E. S. R.; Pritchard, S. C.; Powrie, R. H.; Sludden, J.; Collier, D. A.; Li, T.; McLeod, H. L.: The frequency and distribution of thiopurine methyltransferase alleles in Caucasian and Asian populations. Pharmacogenetics 9:37-42, 1999.

Evans, W. E.; Horner, M.; Chu, Y. Q.; Kalwinsky, D.; Roberts, W. M.: Altered mercaptopurine metabolism, toxic effects, and dosage requirement in a thiopurine methyltransferase-deficient child with acute lymphocytic leukemia. J. Pediat. 119:985-989, 1991.

Hon, Y. Y.; Fessing, M. Y.; Pui, C.-H.; Relling, M. V.; Krynetski, E. Y.; Evans, W. E.: Polymorphism of the thiopurine S-methyltransferase gene in African-Americans. Hum. Molec. Genet. 8:371-376, 1999.

Honchel, R.; Aksoy, I. A.; Szumlanski, C.; Wood, T. C.; Otterness, D. M.; Wieben, E. D.; Weinshilboum, R. M.: Human thiopurine methyltransferase:molecular cloning and expression of T84 colon carcinoma cell cDNA. Molec. Pharm. 43:878-887, 1993.

Klemetsdal, B.; Wist, E.; Aarbakke, J.: Gender difference in redblood cell thiopurine methyltransferase activity. Scand. J. Clin. Lab. Invest. 53:747-749, 1993.

Krynetski, E. Y.; Schuetz, J. D.; Galpin, A. J.; Pui, C.-H.; Relling, M. V.; Evans, W. E.: A single point mutation leading to loss of catalytic activity in human thiopurine S-methyltransferase. Proc. Nat. Acad. Sci. 92:949-953, 1995.

Lennard, L.; Lilleyman, J. S.; Van Loon, J.; Weinshilboum, R. M.: Genetic variation in response to 6-mercaptopurine for childhood acute lymphoblastic leukaemia. Lancet 336:225-229, 1990.

Lennard, L.; Van Loon, J. A.; Weinshilboum, R. M.: Pharmacogeneticsof acute azathioprine toxicity: relationship to thiopurine methyltransferase genetic polymorphism. Clin. Pharm. Therap. 46:149-154, 1989.

McLeod, H. L.; Pritchard, S. C.; Githang'a, J.; Indalo, A.; Ameyaw, M.-M.; Powrie, R. H.; Booth, L.; Collie-Duguid, E. S. R.: Ethnic differences in thiopurine methyltransferase pharmacogenetics: evidence for allele specificity in Caucasian and Kenyan individuals. Pharmacogenetics 9:773-776, 1999.

Otterness, D.; Szumlanski, C.; Lennard, L. Klemetsdal, B.; Aarbakke, J.; Park-Hah, J. O.; Iven, H.; Schmiegelow, K.; Branum, E.; O'Brien, J.; Weinshilboum, R.: Human thiopurine methyltransferase pharmacogenetics:gene sequence polymorphisms. Clin. Pharm. Therap. 62:60-73, 1997.

Otterness, D. M.; Szumlanski, C. L.; Wood, T. C.; Weinshilboum, R. M.: Human thiopurine methyltransferase pharmacogenetics: kindred with a terminal exon splice junction mutation that results in loss of activity. J. Clin. Invest. 101: 1036-1044, 1998.

Szumlanski, C.; Otterness, D.; Her, C.; Lee, D.; Brandriff, B.; Kelsell, D.; Spurr, N.; Lennard, L.; Wieben, E.; Weinshilboum, R.: Thiopurine methyltransferase pharmacogenetics: human gene cloning and characterization of a common polymorphism. DNA Cell Biol. 15:17-30, 1996.

Tai, H.-L.; Krynetski, E. Y.; Schuetz, E. G.; Yanishevski, Y.; Evans, W. E.: Enhanced proteolysis of thiopurine S-methyltransferase (TPMT) encoded by mutant alleles in human S (TPMT*3A, TPMT*2): mechanisms for the genetic polymorphism of TPMT activity. Proc. Nat. Acad. Sci. 94:6444-6449, 1997.

Tai, H.-L.; Krynetski, E. Y.; Yates, C. R.; Loennechen, T.; Fessing, M. Y.; Krynetskaia, N. F.; Evans, W. E.: Thiopurine S-methyltransferase deficiency: two nucleotide transitions define the most prevalent mutant allele associated with loss of catalytic activity in Caucasians. Am. J. Hum. Genet. 58:694-702, 1996.

Weinshilboum, R. M.; Sladek, S. L.: Mercaptopurine pharmacogenetics:monogenic inheritance of erythrocyte thiopurine methyltransferase activity. Am. J. Hum. Genet. 32:651-662, 1980.

Cook, P. J. L.; Robson, E. B.; Buckton, K. E.; Jacobs, P. A.; Polani, P. E.: Segregation of genetic markers in families with chromosome polymorphisms and structural rearrangements involving chromosome 1. Ann. Hum. Genet. 37:261-274, 1974.

Herbich, J.; Szilvassy, J.; Schnedl, W.: Gene localisation of the PGM-1 enzyme system and the Duffy blood groups on chromosome no.1 by means of a new fragile site at 1p31. Hum. Genet. 70:178-180,1985.

Sutherland, R.; Delia, D.; Schneider, C.; Newman, R.; Kemshead, J.; Greaves, M.: Ubiquitous cell-surface glycoprotein on tumor cells is proliferation-associated receptor for transferrin. Proc. Nat. Acad. Sci. 78:4515-4519, 1981.

Gallou, C.; Joly, D.; Mejean, A.; Staroz, F.; Martin, N.; Tarlet, G.; Orfanelli, M. T.; Bouvier, R.; Droz, D.; Chretien, Y.; Marechal, J. M.; Richard, S.; Junien, C.; Beroud, C.: Mutations of the VHL gene in sporadic renal cell carcinoma: definition of a risk factor for VHL patients to develop an RCC. Hum. Mutat. 13:464-475, 1999.

Garcia, A.; Matias-Guiu, X.; Cabezas, R.; Chico, A.; Prat, J.; Baiget, M.; De Leiva, A.: Molecular diagnosis of von Hippel-Lindau disease in a kindred with a predominance of familial phaeochromocytoma. Clin. Endocr. 46:359-363, 1997.

Erbe, R. W.: Cabot case. New Eng. J. Med. 298:95-101, 1978.

Feldman, D. E.; Thulasiraman, V.; Ferreyra, R. G.; Frydman, J.: Formation of the VHL-elongin BC tumor suppressor complex is mediated by the chaperonin TRiC. Molec. Cell 1051-1061, 1999.

Fill, W. L.; Lamiell, J. M.; Polk, N. O.: The radiographic manifestations of von Hippel-Lindau disease. Radiology 133:289-295, 1979.

Fishman, R. S.; Bartholomew, L. G.: Severe pancreatic involvementin three generations in von Hippel-Lindau disease. Mayo Clin. Proc. 54:329-331, 1979.

Friedrich, C. A.: Genotype/phenotype correlation in von Hippel-Lindau syndrome. Hum. Molec. Genet. 10:763-767, 2001.

Fukino, K.; Teramoto, A.; Adachi, K.; Takahashi, H.; Emi, M.:A family with hydrocephalus as a complication of cerebellar hemangioblastoma:identification of pro157leu mutation in the VHL gene. J. Hum. Genet. 45:47-51, 2000.

Fulton, J. F.: Harvey Cushing: A Biography. Springfield, Illinois:Charles C Thomas (pub.) 1946.

Funk, K. C.; Heiken, J. P.: Papillary cystadenoma of the broad ligament in a patient with von Hippel-Lindau disease. Am. J. Radiol. 153:527-528, 1989.

Gaffey, M. J.; Mills, S. E.; Boyd, J. C.: Aggressive papillary tumor of middle ear/temporal bone and adnexal papillary cystadenoma. Am. J. Surg. Path. 18:1254-1260, 1994.

Gemmill, R. M.; Bemis, L. T.; Lee, J. P.; Sozen, M. A.; Baron, A.; Zeng, C.; Erickson, P. F.; Hooper, J. E.; Drabkin, H. A.: TheTRC8 hereditary kidney cancer gene suppresses growth and functions with VHL in a common pathway. Oncogene 21:3507-3516, 2002.

Gersell, D. J.; King, T. C.: Papillary cystadenoma of the mesosalpinxin von Hippel-Lindau disease. Am. J. Surg. Path. 12:145-149, 1988.

Gilcrease, M. Z.; Schmidt, L.; Zbar, B.; Truong, L.; Rutledge, M.; Wheeler, T. M.: Somatic von Hippel-Lindau mutation in clear cell papillary cystadenoma of the epididymis. Hum. Path. 26:1341-1346,1995.

Glenn, G. M.; Daniel, L. N.; Choyke, P.; Linehan, W. M.; Oldfield, E.; Gorin, M. B.; Hosoe, S.; Latif, F.; Weiss, G.; Walther, M.; Lerman, M. I.; Zbar, B.: Von Hippel-Lindau (VHL) disease: distinct phenotypes suggest more than one mutant allele at the VHL locus. Hum. Genet. 87:207-210, 1991.

Glenn, G. M.; Linehan, W. M.; Hosoe, S.; Latif, F.; Yao, M.; Choyke, P.; Gorin, M. B.; Chew, E.; Oldfield, E.; Manolatos, C.; Orcutt, M. L.; Walther, M. M.; Weiss, G. H.; Tory, K.; Jensson, O.; Lerman, M. I.; Zbar, B.: Screening for von Hippel-Lindau disease by DNA polymorphism analysis. J. A. M. A. 267:1226-1231, 1992.

Gnarra, J. R.; Ward, J. M.; Porter, F. D.; Wagner, J. R.; Devor, D. E.; Grinberg, A.; Emmert-Buck, M. R.; Westphal, H.; Klausner, R. D.; Marston Linehan, W.: Defective placental vasculogenesis causes embryonic lethality in VHL-deficient mice. Proc. Nat. Acad. Sci. 94:9102-9107, 1997.

Go, R. C. P.; Lamiell, J. M.; Hsia, Y. E.; Yuen, J. W.-M.; Paik, Y.: Segregation and linkage analyses of von Hippel Lindau disease among 220 descendants from one kindred. Am. J. Hum. Genet. 36:131-142,1984.

Goldberg, M. F.; Duke, J. R.: Von Hippel-Lindau disease: histopathologic findings in a treated and untreated eye. Am. J. Ophthal. 66:693-705,1968.

Graff, J. W.: Personal Communication. Brookline, Mass. Oct. 4, 1998.

Green, J. S.; Bowmer, M. I.; Johnson, G. J.: Von Hippel-Lindau disease in a Newfoundland kindred. Canad. Med. Assoc. J. 134:133-138 and 146, 1986.

Gross, D. J.; Avishai, N.; Meiner, V.; Filon, D.; Zbar, B.; Abeliovich, D.: Familial pheochromocytoma associated with a novel mutation in the von Hippel-Lindau gene. J. Clin. Endocr. Metab. 81:147-149,1996.

Grossman, M.; Melmon, K. L.: Von Hippel-Lindau disease. In: Vinken, P. J.; Bruyn, G. W.: Handbook of Clinical Neurology. The Phakomatoses. Amsterdam: North Holland (pub.) 14:1972. Pp. 241-259.

Haase, V. H.; Glickman, J. N.; Socolovsky, M.; Jaenisch, R.:Vascular tumors in livers with targeted in activation of the von Hippel-Lindau tumor suppressor. Proc. Nat. Acad. Sci. 98:1583-1588, 2001.

Hagler, W. S.; Hyman, B. N.; Waters, W. C., III: Von Hippel'sangiomatosis retinae and pheochromocytoma. Trans. Am. Acad. Ophthal. Otolaryng. 75:1022-1034, 1971.

Hennessy, T. G.; Stern, W. E.; Herrick, S. E.: Cerebellar hemangioblastoma:erythropoietic activity by radioion assay. J. Nucl. Med. 8:601-606,1967.

Herman, J. G.; Latif, F.; Weng, Y.; Lerman, M. I.; Zbar, B.; Liu, S.; Samid, D.; Duan, D.-S. R.; Guarra, J. R.; Linehan, W. M.; Baylin, S. B.: Silencing of the VHL tumor-suppressor gene by DNA methylation in renal carcinomas. Proc. Nat. Acad. Sci. 91:9700-9704, 1994.

Hes, F.; Zewald, R.; Peeters, T.; Sijmons, R.; Links, T.; Verheij, J.; Matthijs, G.; Legius, E.; Mortier, G.; van der Torren, K.; Rosman, M.; Lips, C.; Pearson, P.; van der Luijt, R.: Genotype-phenotype correlations in families with deletions in the von Hippel-Lindau (VHL) gene. Hum. Genet. 106:425-431, 2000.

Hes, F. J.; McKee, S.; Taphoorn, M. J. B.; Rehal, P.; van derLuijt, R. B.; McMahon, R.; van der Smagt, J. J.; Dow, D.; Zewald, R. A.; Whittaker, J.; Lips, C. J. M.; MacDonald, F.; Pearson, P. L.; Maher, E. R.: Cryptic von Hippel-Lindau disease: germ line mutations in patients with haemangioblastoma only. J. Med. Genet. 37:939-943,2000.

Hoffman, M. A.; Ohh, M.; Yang, H. Kico, J. M.; Ivan, M.; Kaelin, W. G., Jr.: von Hippel-Lindau, protein mutants linked to type 2CVHL disease preserve the ability to downregulated HIF. Hum. Molec. Genet. 10:1019-1027, 2001.

Francke, U.; Darras, B. T.; Zander, N. F.; Kilimann, M. W.: Assignmentof human genes for phosphorylase kinase subunits alpha (PHKA) to Xq12-q13 and beta (PHKB) to 16q12-q13. Am. J. Hum. Genet. 45:276-282, 1989.

Rocchi, M.; Archidiacono, N.; Romeo, G.; Saginati, M.; Zardi, L.: Assignment of the gene for human tenascin to the region q32-q34 of chromosome 9. Hum. Genet. 86:621-623, 1991.

Steindler, D. A.; Settles, D.; Erickson, H. P.; Laywell, E. D.; Yoshiki, A.; Faissner, A.; Kusakabe, M.: Tenascin knockout mice:barrels, boundary molecules, and glial scars. J. Neurosci. 15:1971-1983,1995.

Bamford, R. N.; Roessler, E.; Burdine, R. D.; Saplakoglu, U.; delaCruz, J.; Splitt, M.; Towbin, J.; Bowers, P.; Marino, B.; Schier, A. F.; Shen, M. M.; Muenke, M.; Casey, B.: Loss-of-function mutations in the EGF-CFC gene CFC1 are associated with human left-right laterality defects. Nature Genet. 26:365-369, 2000.

Ciccodicola, A.; Dono, R.; Obici, S.; Simeone, A.; Zollo, M.; Persico, M. G.: Molecular characterization of a gene of the 'EGF family' expressed in undifferentiated human NTERA2 teratocarcinoma cells. EMBO J. 8:1987-1991, 1989.

de la Cruz, J. M.; Bamford, R. N.; Burdine, R. D.; Roessler, E.; Barkovich, A. J.; Donnai, D.; Schier, A. F.; Muenke, M.: A loss-of-function mutation in the CFC domain of TDGF1 is associated with human fore brain defects. Hum. Genet. 110: 422-428, 2002.

Dono, R.; Montuori, N.; Rocchi, M.; De Ponti-Zilli, L.; Ciccodicola, A.; Persico, M. G.: Isolation and characterization of the CRIPTO autosomal gene and its X-linked related sequence. Am. J. Hum. Genet. 49:555-565, 1991.

Liguori, G.; De Gregorio, L.; Tucci, M.; Lago, C. T.; Barra, A.; Dragani, T. A.; Persico, M.: Mapping of the mouse Tdgf1 gene andTdgf pseudogenes. Mammalian Genome 8:502-505, 1997.

Liguori, G.; Tucci, M.; Montuori, N.; Dono, R.; Lago, C. T.; Pacifico, F.; Armenante, F.; Persico, M. G.: Characterization of the mouseTdgf1 gene and Tdgf pseudogenes. Mammalian Genome 7:344-348, 1996.

Saccone, S.; Rapisarda, A.; Motta, S.; Dono, R.; Persico, G. M.; Della Valle, G.: Regional localization of the human EGF-like growth factor CRIPTO gene (TDGF-1) to chromosome 3p21. Hum. Genet. 95:229-230, 1995.

Shen, M. M.; Schier, A. F.: The EGF-CFC gene family in vertebrate development. Trends Genet. 16:303-309, 2000.

Gonzatti-Haces, M.; Seth, A.; Park, M.; Copeland, T.; Oroszlan, S.; Vande Woude, G. F.: Characterization of the TPR-MET oncogenep65 and the MET proto-oncogene p140 protein-tyrosine kinases. Proc. Nat. Acad. Sci. 85:21-25, 1988.

Miranda, C.; Minoletti, F.; Greco, A.; Sozzi, G.; Pierotti, M. A.: Refined localization of the human TPR gene to chromosome 1q25by in situ hybridization. Genomics 23:714-715, 1994.

Harding, D.; Jeremiah, S. J.; Povey, S.; Burchell, B.: Chromosomal mapping of a human phenol UDP-glucuronosyltransferase, GNT1. Ann. Hum. Genet. 54:17-21, 1990.

Harding, D.; Jeremiah, S. J.; Povey, S.; Burchell, B.: PhenolUDP-glucuronosyl transferase is coded by a gene on human chromosome 2. (Abstract) Cytogenet. Cell Genet. 51:1011, 1989.

Sirotkin, H.; Morrow, B.; DasGupta, R.; Goldberg, R.; Patanjali, S. R.; Shi, G.; Cannizzaro, L.; Shprintzen, R.; Weissman, S. M.; Kucherlapati, R.: Isolation of a new clathrin heavy chain gene with muscle-specificexpression from the region commonly deleted in velo-cardio-facial syndrome. Hum. Molec. Genet. 5:617-624, 1996.

Raftery, M. J.; Schwab, M.; Eibert, S. M.; Samstag, Y.; Walczak, H.; Schonrich, G.: Targeting the function of mature dendritic cells by human cytomegalo virus: a multilayered viral defense strategy. Immunity 15:997-1009, 2001.

Galiegue-Zouitina, S.; Quief, S.; Hildebrand, M.-P.; Denis, C.; Detourmignies, L.; Lai, J.-L.; Kerckaert, J.-P.: Nonrandom fusionof L-plastin (LCP1) and LAZ3 (BCL6) genes by t (3;13)(q27; q14) chromosome translocation in two cases of B-cell non-Hodgkin lymphoma. Genes Chromosomes Cancer 26:97-105, 1999.

Giometti, C. S.; Anderson, N. L.: A variant of human nonmuscle tropomyosin found in fibroblasts by using two-dimensional electrophoresis. J. Biol. Chem. 256:11840-11846, 1981.

Hamaguchi, H.; Ohta, A.; Mukai, R.; Yabe, T.; Yamada, M.: Geneticanalysis of human lymphocyte proteins by two-dimensional gel electrophoresis:1. Detection of genetic variant polypeptides in PHA-stimulated peripheral blood lymphocyte. Hum. Genet. 59:215-220, 1981.

Hamaguchi, H.; Yamada, M.; Noguchi, A.; Fujii, K.; Shibasaki, M.; Mukai, R.; Yabe, T.; Kondo, I.: Genetic analysis of human lymphocyte proteins by two-dimensional gel electrophoresis:2. Genetic polymorphism of lymphocyte cytosol 64K polypeptide. Hum. Genet. 60:176-180,1982.

Hamaguchi, H.; Yamada, M.; Shibasaki, M.; Kondo, I.: Genetic analysis of human lymphocyte proteins by two-dimensional gel electrophoresis:4. Genetic polymorphism of cytosol 100 k polypeptide. Hum. Genet. 62:148-151, 1982.

Hamaguchi, H.; Yamada, M.; Shibasaki, M.; Mukai, R.; Yabe, T.; Kondo, I.: Genetic analysis of human lymphocyte proteins by two-dimensional gel electrophoresis:3. Frequent occurrence of genetic variants insome abundant polypeptides of PHA-stimulated peripheral blood lymphocytes. Hum. Genet. 62:142-147, 1982.

Klose, J.: Protein mapping by combined isoelectric focusing and electrophoresis of mouse tissue: a novel approach to testing for induced point mutations in mammals. human genetik 26:231-243, 1975.

Klose, J.; Feller, M.: Genetic variability of proteins from plasma membranes and cytosols of mouse organs. Biochem. Genet. 19:859-870,1981.

Kondo, I.; Hamaguchi, H.: Evidence for the close linkage between lymphocyte cytosol polypeptide with molecular weight of 64,000 (LCP1) and esterase D. Am. J. Hum. Genet. 37:1106-1111, 1985.

Kondo, I.; Hamaguchi, H.: Study of the linkage relationship between LCP1 and ESD. (Abstract) Cytogenet. Cell Genet. 40:672 only, 1985.

Baier, L. J.; Sacchettini, J. C.; Knowler, W. C.; Eads, J.; Paolisso, G.; Tataranni, P. A.; Mochizuki, H.; Bennett, P. H.; Bogardus, C.; Prochazka, M.: An amino acid substitution in the human intestinal fatty acid binding protein is associated with increased fatty acidbinding, increased fat oxidation, and insulin resistance. J. Clin. Invest. 95:1281-1287, 1995.

Carlsson, M.; Orho-Melander, M.; Hedenbro, J.; Almgren, P.; Groop, L. C.: The T54 allele of the intestinal fatty acid-binding protein 2 is associated with a parental history of stroke. J. Clin. Endocr. Metab. 85:2801-2804, 2000.

Georgopoulos, A.; Aras, O.; Tsai, M. Y.: Codon-54 polymorphism of the fatty acid-binding protein 2 gene is associated with elevation of fasting and post prandial triglyceride in type 2 diabetes. J. Clin. Endocr. Metab. 85:3155-3160, 2000.

Hegele, R. A.; Harris, S. B.; Hanley, A. J. G.; Sadikian, S.; Connelly, P. W.; Zinman, B.: Genetic variation of intestinal fatty acid-binding protein associated with variation in body mass in aboriginal Canadians. J. Clin. Endocr. Metab. 81:4334-4337, 1996.

Polymeropoulos, M. H.; Rath, D. S.; Xiao, H.; Merril, C. R.: Trinucleotiderepeat polymorphism at the human intestinal fatty acid binding protein gene (FABP2). Nucleic Acids Res. 18:7198 only, 1991.

Prochazka, M.; Lillioja, S.; Tait, J. F.; Knowler, W. C.; Mott, D. M.; Spraul, M.; Bennett, P. H.; Bogardus, C.: Linkage of chromosomal markers on 4q with a putative gene determining maximal insulin actionin Pima Indians. Diabetes 42:514-519, 1993.

Sipilainen, R.; Uusitupa, M.; Heikkinen, S.; Rissanen, A.; Laakso, M.: Variants in the human intestinal fatty acid binding protein 2 gene in obese subjects. J. Clin. Endocr. Metab. 82:2629-2632, 1997.

Sparkes, R. S.; Mohandas, T.; Heinzmann, C.; Gordon, J. I.; Klisak, I.; Zollman, S.; Sweetser, D. A.; Ragunathan, L.; Winokur, S.; Lusis, A. J.: Human fatty acid binding protein assignments intestinal to 4q28-4q31 and liver to 2p11. (Abstract) Cytogenet. Cell Genet. 46:697 only, 1987.

Sweetser, D. A.; Birkenmeier, E. H.; Klisak, I. J.; Zollman, S.; Sparkes, R. S.; Mohandas, T.; Lusis, A. J.; Gordon, J. I.: The human and rodent intestinal fatty acid binding protein genes: a comparative analysis of their structure, expression, and linkage relationships. J. Biol. Chem. 262:16060-16071, 1987.

Weber, J. L.; Kwitek, A. E.; May, P. E.; Polymeropoulos, M.:Dinucleotide repeat polymorphism at the D12S43 locus. Nucleic AcidsRes. 18:4637 only, 1990.

Weber, J. L.; May, P. E.: Abundant class of human DNA polymorphisms which can be typed using the polymerase chain reaction. Am. J. Hum. Genet. 44:388-396, 1989.

Glatt, K.; Glatt, H.; Lalande, M.: Structure and organizationof GABRB3 and GABRA5. Genomics 41:63-69, 1997.

Glatt, K. A.; Sinnett, D.; Lalande, M.: Dinucleotide repeat polymorphism at the GABA-A receptor alpha-5 (GABRA5) locus at chromosome 15q11-q13. Hum. Molec. Genet. 1:348 only, 1992.

Knoll, J. H. M.; Sinnett, D.; Wagstaff, J.; Glatt, K.; Wilcox, A. S.; Whiting, P.; Wingrove, P.; Sikela, J.; Lalande, M.: FISH orderingof DNA markers within the Angelman/Prader-Willi chromosomal regions:mapping of a second GABA-A receptor subunit gene, GABRA5. (Abstract) Am. J. Hum. Genet. 51 (suppl.): A9 only, 1992.

Papadimitriou, G. N.; Dikeos, D. G.; Karadima, G.; Avramopoulos, D.; Daskalopoulou, E. G.; Vassilopoulos, D.; Stefanis, C. N.: Association between the GABA-A receptor alpha-5 subunit gene locus (GABRA5) and bipolar affective disorder. Am. J. Med. Genet. 81:73-80, 1998.

Ritchie, R. J.; Mattei, M.-G.; Lalande, M.: A large polymorphic repeat in the pericentromeric region of human chromosome 15q contains three partial gene duplications. Hum. Molec. Genet. 7:1253-1260,1998.

Russek, S. J.; Farb, D. H.: Mapping of the beta-2 subunit gene (GABRB2) to microdissected human chromosome 5q34-q35 defines a genecluster for the most abundant GABA-A receptor isoform. Genomics 23:528-533, 1994.

Wingrove, P.; Hadingham, K.; Wafford, K.; Kemp, J. A.; Ragan, C. I.; Whiting, P.: Cloning and expression of a cDNA encoding the human GABA-A receptor alpha-5 subunit. Biochem. Soc. Trans. 20:18S only,1991.

Futamura, M.; Nishimori, H.; Shiratsuchi, T.; Saji, S.; Nakamura, Y.; Tokino, T.: Molecular cloning, mapping, and characterization of a novel human gene, MTA1-L1, showing homology to a metastasis-associated gene, MTA1. J. Hum. Genet. 44:52-56, 1999.

Goto, K.; Kondo, H.: Molecular cloning and expression of a 90-kD adiacylglycerol kinase that predominantly localizes in neurons. Proc. Nat. Acad. Sci. 90:7598-7602, 1993.

Ding, L.; Traer, E.; McIntyre, T. M.; Zimmerman, G. A.; Prescott, S. M.: The cloning and characterization of a novel human diacylglycerolkinase, DGK-iota. J. Biol. Chem. 273: 32746-32752, 1998.

Nothwang, H. G.; Kim, H. G.; Aoki, J.; Geisterfer, M.; Kubart, S.; Wegner, R. D.; van Moers, A.; Ashworth, L. K.; Haaf, T.; Bell, J.; Arai, H.; Tommerup, N.; Ropers, H. H.; Wirth, J.: Functional hemizygosity of PAFAH1B3 due to a PAFAH1B3-CLK2 fusion gene in a female with mental retardation, ataxia and atrophy of the brain. Hum. Molec. Genet. 10:797-806, 2001.

Katsanis, N.; Fisher, E. M. C.: Identification, expression, and chromosomal localization of ubiquitin conjugating enzyme 7 (UBE2G2), a human homologue of the Saccharomyces cerevisiae Ubc7 gene. Genomics 51:128-131, 1998.

Rose, S. A.; Leek, J. P.; Moynihan, T. P.; Ardley, H. C.; Markham, A. F.; Robinson, P. A.: Assignment of the ubiquitin conjugating enzyme gene, UBE2G2, to human chromosome band 21q22.3 by in situ hybridization. Cytogenet. Cell Genet. 83:98-99, 1998.

Ju, Y.-T.; Chang, A. C. Y.; She, B.-R.; Tsaur, M.-L.; Hwang, H.-M.; Chao, C. C.-K.; Cohen, S. N.; Lin-Chao, S.: Gas7: a gene expressed preferentially in growth-arrested fibroblasts and terminally differentiated Purkinje neurons affects neurite formation. Proc. Nat. Acad. Sci. 95:11423-11428, 1998.

Kurtz, A.; Zimmer, A.: Interspecies fluorescence in situ hybridization further defines synteny homology between mouse chromosome 11 and human chromosome 17. Mammalian Genome 6:379-380, 1995.

Chrast, R.; Scott, H. S.; Chen, H.; Kudoh, J.; Rossier, C.; Minoshima, S.; Wang, Y.; Shimizu, N.; Antonarakis, S. E.: Cloning of two human homologs of the Drosophila single-minded gene SIM1 on chromosome 6q and SIM2 on 21q within the Down syndrome chromosomal region. GenomeRes. 7:615-624, 1997.

Megonigal, M. D.; Cheung, N.-K. V.; Rappaport, E. F.; Nowell, P. C.; Wilson, R. B.; Jones, D. H.; Addya, K.; Leonard, D. G. B.; Kushner, B. H.; Williams, T. M.; Lange, B. J.; Felix, C. A.: Detection of leukemia-associated MLL-GAS7 translocation early during chemotherapy with DNA topoisomerase II inhibitors. Proc. Nat. Acad. Sci. 97:2814-2819, 2000.

Holder, J. L., Jr.; Butte, N. F.; Zinn, A. R.: Profound obesity associated with a balanced translocation that disrupts the SIM1 gene. Hum. Molec. Genet. 9:101-108, 2000.

Michaud, J. L.; Boucher, F.; Melnyk, A.; Gauthier, F.; Goshu, E.; Levy, E.; Mitchell, G. A.; Himms-Hagen, J.; Fan, C.-M.: Sim1 haploin sufficiency causes hyperphagia, obesity and reduction of the paraventricular nucleus of the hypothalamus. Hum. Molec. Genet. 10:1465-1473, 2001.

Fan, C. M.; Kuwana, E.; Bulfone, A.; Fletcher, C. F.; Copeland, N. G.; Jenkins, N. A.; Crews, S.; Martinez, S.; Puelles, L.; Rubenstein, J. L.; Tessier-Lavigne, M.: Expression patterns of two murine homologs of Drosophila single-minded suggest possible roles in embryonic patterning and in the pathogenesis of Down syndrome. Molec. Cell. Neurosci. 7:1-16, 1996.

Duke-Cohan, J. S.; Gu, J.; McLaughlin, D. F.; Xu, Y.; Freeman, G. J.; Schlossman, S. F.: Attractin (DPPT-L), a member of the CUB family of cell adhesion and guidance proteins, is secreted by activated human T lymphocytes and modulates immune cell interactions. Proc. Nat. Acad. Sci. 95:11336-11341, 1998.

Gunn, T. M.; Miller, K. A.; He, L.; Hyman, R. W.; Davis, R. W.; Azarani, A.; Schlessman, S. F.; Duke-Cohan, J. S.; Barsh, G. S.:The mouse mahogany locus encodes a transmembrane form of human attractin. Nature 398:152-156, 1999.

He, L.; Gunn, T. M.; Bouley, D. M.; Lu, X.-Y.; Watson, S. J.; Schlossman, S. F.; Duke-Cohan, J. S.; Barsh, G. S.: A biochemical function for attractin in agouti-induced pigmentation and obesity. Nature Genet. 27:40-47, 2001.

Tang, W.; Gunn, T. M.; McLaughlin, D. F.; Barsh, G. S.; Schlossman, S. F.; Duke-Cohan, J. S.: Secreted and membrane attractin result from alternative splicing of the human ATRN gene. Proc. Nat. Acad. Sci. 97:6025-6030, 2000.

Kondo, I.; Ikeuchi, T.; Nishigaki, I.; Takita, H.; Fujiki, K.; Takahashi, Y.; Hamaguchi, H.: Assignment of the gene for LCP1 on chromosome 13. (Abstract) Cytogenet. Cell Genet. 40:673 only, 1985.

Kondo, I.; Shin, K.; Honmura, S.; Nakajima, H.; Yamamura, E.; Satoh, H.; Terauchi, M.; Usuki, Y.; Takita, H.; Hamaguchi, H.: A case report of a patient with retinoblastoma and chromosome 13q deletion:assignment of a new gene (gene for LCP1) on human chromosome 13. Hum. Genet. 71:263-266, 1985.

Lin, C.-S.; Aebersold, R. H.; Kent, S. B.; Varma, M.; Leavitt, J.: Molecular cloning and characterization of plastin, a human leukocyteprotein expressed in transformed human fibroblasts. Molec. Cell. Biol. 8:4659-4668, 1988.

Lin, C.-S.; Chang, C.-H.; Huynh, T.: The murine L-plastin gene promoter: identification and comparison with the human L-plastin gene promoter. DNA Cell Biol. 16:9-16, 1997.

Lin, C.-S.; Park, T.; Chen, Z. P.; Leavitt, J.: Human plastingenes: comparative gene structure, chromosome location, and differential expression in normal and neoplastic cells. J. Biol. Chem. 268:2781-2792,1993.

McConkey, E. H.; Taylor, B. J.; Phan, D.: Human heterozygosity:a new estimate. Proc. Nat. Acad. Sci. 76:6500-6504, 1979.

Murayama, N.; Tanaka, Y.; Hanyu, M.; Kobayashi, K.; Hamaguchi, H.; Kondo, I.: Assignment of 1-plastin to 13q14.3. (Abstract) Human Genome Mapping Workshop 93 27 only, 1993.

O'Farrell, P. Z.; Goodman, H. M.; O'Farrell, P. H.: High resolution two-dimensional electrophoresis of basic as well as acidic proteins. Cell 12:1133-1142, 1977.

Walton, K. E.; Steyer, D.; Gruenstein, E. I.: Genetic polymorphismin normal human fibroblasts as analyzed by two-dimensional polyacrylamide gel electrophoresis. J. Biol. Chem. 254:7951-7960, 1979.

Zu, Y.; Kohno, M.; Kubota, I.; Nishida, E.; Hanaoka, M.; Namba, Y.: Characterization of interleukin 2 stimulated 65-kilodalton phosphoprotein in human T cells. Biochemistry 29:1055-1062, 1990.

Zu, Y.; Shigesada, K.; Nishida, E.; Kubota, I.; Kohno, M.; Hanaoka, M.; Namba, Y.:65-kilodalton protein phosphorylated by interleukin 2 stimulation bears two putative actin-binding sites and two calcium-binding sites. Biochemistry 29:8319-8324, 1990.

Aggarwal, B. B.; Eessalu, T. E.; Hass, P. E.: characterization of receptors for human tumour necrosis factor and their regulation by gamma-interferon. Nature 318:665-667, 1985.

Evans, A. M.; Petersen, J. W.; Sekhon, G. S.; DeMars, R.: mapping of prolactin and tumor necrosis factor-beta genes on human chromosome 6p using lymphoblastoid cell deletion mutants. Somat. Cell Molec. Genet. 15:203-213, 1989.

Gray, P. W.; Aggarwal, B. B.; Benton, C. V.; Bringman, T. S.; Henzel, W. J.; Jarrett, J. A.; Leung, D. W.; Moffat, B.; Ng, P.; Svedersky, L. P.; Palladino, M. A.; Nedwin, G. E.: Cloning and expression of cDNA for human lymphotoxin, a lymphokine with tumour necrosis activity. Nature 312:721-724, 1984.

Jongeneel, C. V.; Briant, L.; Udalova, I. A.; Sevin, A.; Nedospasov, S. A.; Cambon-Thomsen, A.: Extensive genetic polymorphism in the human tumor necrosis factor region and relation to extended HLA haplotypes. Proc. Nat. Acad. Sci. 88:9717-9721, 1991.

Koss, K.; Satsangi, J.; Fanning, G. C.; Welsh, K. I.; Jewell, D. P.: Cytokine (TNF-alpha, LT-alpha, and IL-10) polymorphisms in inflammatory bowel diseases and normal controls: differential effects on production and allele frequencies. Genes Immun. 1:185-190, 2000.

Camara, V. M.; Harding, J. W.; Prieur, D. J.: Inherited lysozymedeficiency in rabbits: the absence of a primary isozyme of lysozymeas the cause of the condition. Lab. Invest. 63:544-550, 1990.

Canet, D.; Sunde, M.; Last, A. M.; Miranker, A.; Spencer, A.; Robinson, C. V.; Dobson, C. M.: Mechanistic studies of the folding of human lysozyme and the origin of amyloidogenic behavior in its disease-related variants. Biochemistry 38:6419-6427, 1999.

Dayhoff, M. O.: Atlas of Protein Sequence and Structure. Lactalbumin and Lysozyme. Washington: National Biomedical Research Foundation (pub.) 5:1972. Pp. D133-D140.

Fleming, A.: On a remarkable bacteriolytic element found in tissues and secretions. Proc. Roy. Soc. Ser. B. 93:306-317, 1922.

Fleming, A.; Allison, V. D.: Observations on a bacteriolytic substance ('lysozyme') found in secretions and tissues. Brit. J. Exp. Path. 3:252-260, 1922.

Greenwald, R. A.; Cantor, J. O.; Prieur, D. J.; Young, D. M.: Composition of cartilage from lysozyme-deficient rabbits. Biochim. Biophys. Acta 385:435-437, 1975.

Neufeld, E. L.: Personal Communication. Bethesda, Maryland 1972.

Pepys, M. B.; Hawkins, P. N.; Booth, D. R.; Vigushin, D. M.; Tennent, G. A.; Soutar, A. K.; Totty, N.; Nguyen, O.; Blake, C. C. F.; Terry, C. J.; Feest, T. G.; Zalin, A. M.; Hsuan, J. J.: Human lysozyme gene mutations cause hereditary systemic amyloidosis. Nature 362:553-557, 1993.

Peters, C. W. B.; Kruse, U.; Pollwein, R.; Grzeschik, K.-H.; Sippel, A. E.: The human lysozyme gene: sequence organization and chromosomal localization. (Abstract) Cytogenet. Cell Genet. 51:1059 only, 1989.

Prieur, D. J.: Personal Communication. Pullman, Washington May 13, 1975.

Prieur, D. J.; Olson, H. M.; Young, D. M.: Lysozyme deficiency--an inherited disorder of rabbits. Am. J. Path. 77:283-296, 1974.

Spitznagel, J. K.; Cooper, M. R.; McCall, A. E.; DeChatelet, L. R.; Welsh, I. R.: Selective deficiency of granules associated with lysozyme and lactoferrin in human polymorphs (PMN) with reduced microbicidal capacity. (Abstract) J. Clin. Invest. 51:93A only, 1972.

Leonard, W. J.; Donlon, T. A.; Lebo, R. V.; Greene, W. C.: Localization of the gene encoding the human interleukin-2 receptor on chromosome 10. Science 228:1547-1549, 1985.

Webb, G. C.; Campbell, H. D.; Lee, J. S.; Young, I. G.: Mapping the gene for murine T-cell growth factor, Il-2, to bands B-C on chromosome 3 and for the alpha chain of the IL2-receptor, Il-2ra, to bands A2-A3 on chromosome 2. Cytogenet. Cell Genet. 54:164-168, 1990.

Du, X.; Williams, D. A.: Interleukin-11: review of molecular, cell biology, and clinical use. Blood 89:3897-3908, 1997.

Du, X. X.; Williams, D. A.: Interleukin-11: a multifunctional growth factor derived from the hematopoietic microenvironment. Blood 83:2023-2030, 1994.

McKinley, D.; Wu, Q.; Yang-Feng, T.; Yang, Y.-C.: Genomic sequence and chromosomal location of human interleukin-11 gene (IL11). Genomics 13:814-819, 1992.

Paul, S. R.; Bennett, F.; Calvetti, J. A.; Kelleher, K.; Wood, C. R.; O'Hara, R. M., Jr.; Leary, A. C.; Sibley, B.; Clark, S. C.; Williams, D. A.; Yang, Y.-C.: Molecular cloning of a cDNA encoding interleukin 11, a stromal cell-derived lymphopoietic and hematopoietic cytokine. Proc. Nat. Acad. Sci. 87:7512-7516, 1990.

Yang-Feng, T. L.; Gibson, L.; Yang, Y. C.: Assignment of the gene encoding human interleukin-11 to chromosome 19q13.3-q13.4. (Abstract) Cytogenet. Cell Genet. 58:2027 only, 1991.

Heinzmann, H.; Mao, X.-Q.; Akaiwa, M.; Kreomer, R. T.; Gao, P.-S.; Ohshima, K.; Umeshita, R.; Abe, Y.; Braun, S.; Yamashita, T.; Roberts, M. H.; Sugimoto, R.; and 20 others: Genetic variants of IL-13 signalling and human asthma and atopy. Hum. Molec. Genet. 9:549-559, 2000.

Howard, T. D.; Koppelman, G. H.; Xu, J.; Zheng, S. L.; Postma, D. S.; Meyers, D. A.; Bleecker, E. R.: Gene-gene interaction in asthma: IL4RA and IL13 in a Dutch population with asthma. Am. J. Hum. Genet. 70:230-236, 2002.

Burshtyn, D. N.; Scharenberg, A. M.; Wagtmann, N.; Rajagopalan, S.; Berrada, K.; Yi, T.; Kinet, J.-P.; Long, E. O.: Recruitment of tyrosine phosphatase HCP by the killer cell inhibitor receptor. Immunity 4:77-85, 1996.

Dean, F. B.; Lian, L.; O'Donnell, M.: cDNA cloning and gene mapping of human homologs for Schizosaccharomyces pombe rad17, rad1, and hus 1 and cloning of homologs from mouse, Caenorhabditis elegans, and Drosophilamelanogaster. Genomics 54:424-436, 1998.

Macdonald, D. H. C.; Lahiri, D.; Sampath, A.; Chase, A.; Sohal, J.; Cross, N. C. P.: Cloning and characterization of RNF6, a novel RING finger gene mapping to 13q12. Genomics 58:94-97, 1999.

Moreira, E. F.; Jaworski, C. J.; Rodriguez, I. R.: Cloning of a novel member of the reticulon gene family (RTN3): gene structure and chromosomal localization to 11q13. Genomics 58:73-81, 1999.

Kissel, K.; Santoso, S.; Hofmann, C.; Stroncek, D.; Bux, J.: Molecular basis of the neutrophil glycoprotein NB1 (CD177) involved in the pathogenesis of immune neutropenias and transfusion reactions. Europ. J. Immun. 31:1301-1309, 2001.

Kissel, K.; Scheffler, S.; Kerowgan, M.; Bux, J.: Molecular basis of NB1 (HNA-2a, CD177) deficiency. Blood 99:4231-4233, 2002.

Lalezari, P.; Murphy, G. B.; Allan, F. H.: NB1, a new neutrophil specific antigen involved in the pathogenesis of neonatal neutropenia. J. Clin. Invest. 50:1108-1115, 1971.

Temerinac, S.; Klippel, S.; Strunck, E.; Roder, S.; Lubbert, M.; Lange, W.; Azemar, M.; Meinhardt, G.; Schaefer, H.-E.; Pahl, H. L.: Cloning of PRV-1, a novel member of the uPAR receptor superfamily, which is overexpressed in polycythemia rubra vera. Blood 95:2569-2576, 2000.

Van Cong, N.; Ray, D.; Gross, M. S.; de Tand, M. F.; Frezal, J.; Moreau-Gachelin, F.: Localization of the human oncogene SPI1 on chromosome 11, region p11.22. Hum. Genet. 84:542-546, 1990.

Dionne, C. A.; Kaplan, R.; Seuanez, H.; O'Brien, S. J.; Jaye, M.: Chromosome assignment by polymerase chain reaction techniques: assignment of the oncogene FGF-5 to human chromosome 4. Biotechniques 8:190-194, 1990.

Hebert, J. M.; Rosenquist, T.; Gotz, J.; Martin, G. R.: FGF5 as a regulator of the hair growth cycle: evidence from targeted and spontaneous mutations. Cell 78:1017-1025, 1994.

Nguyen, C.; Roux, D.; Mattei, M.-G.; de Lapeyriere, O.; Goldfarb, M.; Birnbaum, D.; Jordan, B. R.: The FGF-related oncogenes hst and int.2, and the bcl.1 locus are contained within one megabase in band q13 of chromosome 11, while the fgf.5 oncogene maps to 4q21. Oncogene 3:703-708, 1988.

Zhan, X.; Bates, B.; Hu, X.; Goldfarb, M.: The human FGF-5 oncogene en codes a novel protein related to fibroblast growth factors. Molec. Cell. Biol. 8:3487-3495, 1988.

Bartoshuk, L. M.; Duffy, V. B.; Miller, I. J.: PTC/PROP tasting: anatomy, psychophysics, and sex effects. Physiol. Behav. 56:1165-1171, 1994.

Chautard-Freire-Maia, E. A.: Linkage relationships between 22 autosomal markers. Ann. Hum. Genet. 38:191-198, 1974.

Laborda, J.; Sausville, E. A.; Hoffman, T.; Notario, V.: dlk, a putative mammalian homeotic gene differentially expressed in small cell lung carcinoma and neuroen docrine tumor cell line. J. Biol. Chem. 268:3817-3820, 1993.

Dryja, T. P.; Rapaport, J.; McGee, T. L.; Nork, T. M.; Schwartz, T. L.: Molecular etiology of low-penetrance retinoblastoma in two pedigrees. Am. J. Hum. Genet. 52:1122-1128, 1993.

Dryja, T. P.; Rapaport, J. M.; Joyce, J. M.; Petersen, R. A.: Molecular detection of deletions involving band q14 of chromosome 13 in retinoblastomas. Proc. Nat. Acad. Sci. 83:7391-7394, 1986.

Dryja, T. P.; Rapaport, J. M.; Weichselbaum, R.; Bruns, G. A. P.: Chromosome 13 restriction fragment length polymorphisms. Hum. Genet. 65:320-324, 1984.

Duane, T. B.: Clinical Ophthalmology. Hagerstown: Harper and Row (pub.) 3:1980. Pp. 13 only.

Duncan, A. M. V.; Morgan, C.; Gallie, B. L.; Phillips, R. A.; Squire, J.: Re-evaluation of the sublocalization of esterase D and its relation to the retinoblastoma locus by in situ hybridization. Cytogenet. Cell Genet. 44:153-157, 1987.

Dunn, J. M.; Phillips, R. A.; Becker, A. J.; Gallie, B. L.: Identification of germline and somatic mutations affecting the retinoblastoma gene. Science 241:1797-1800, 1988.

Dunn, J. M.; Phillips, R. A.; Zhu, X.; Becker, A.; Gallie, B. L.: Mutations in the RB1 gene and their effects on transcription. Molec. Cell. Biol. 9:4596-4604, 1989.

Ejima, Y.; Sasaki, M. S.; Kaneko, A.; Tanooka, H.: Types, rates, origin and expressivity of chromosome mutations involving 13q14 in retinoblastoma patients. Hum. Genet. 79:118-123, 1988.

Ejima, Y.; Sasaki, M. S.; Kaneko, A.; Tanooka, H.; Hara, Y.; Hida, T.; Kinoshita, Y.: Possible inactivation of part of chromosome 13 due to 13qXp translocation associated with retinoblastoma. Clin. Genet. 21:357-361, 1982.

Eldridge, R.; O'Meara, K.; Kitchin, D.: Superior intelligence in sighted retinoblastoma patients and their families. J. Med. Genet. 9:331-335, 1972.

Falls, H. F.; Neel, J. V.: Genetics of retinoblastoma. Arch. Ophthal. 46:367-389, 1951.

Fitzgerald, P. H.; Stewart, J.; Suckling, R. D.: Retinoblastoma mutation rate in New Zealand and support for the two-hit model. Hum. Genet. 64:128-130, 1983.

Francke, U.: Retinoblastoma and chromosome 13. Cytogenet. Cell Genet. 14:131-134, 1976.

Francois, J.: Retinoblastoma and osteogenic sarcoma. Ophthalmologica 175:185-191, 1977.

Francois, J.: Hereditary malignant tumor of the eye. Congenital Anomalies of The Eye. St. Louis: C. V. Mosby Co. (pub.) 1968. Pp. 205-246.

Francois, J.; Matton, M. T.; De Bie, S.; Tanaka, Y.; Vandenbulcke, D.: Genesis and genetics of retinoblastoma. Ophthalmologica 170:405-425, 1975.

Friend, S. H.; Bernards, R.; Rogelj, S.; Weinberg, R. A.; Rapaport, J. M.; Albert, D. M.; Dryja, T. P.: A human DNA segment with properties of the gene that predisposes to retinoblastoma and osteosarcoma. Nature 323:643-646, 1986.

Friend, S. H.; Dryja, T. P.; Weinberg, R. A.: Oncogenes and tumor-suppressing genes. New Eng. J. Med. 318:618-622, 1988.

Friend, S. H.; Horowitz, J. M.; Gerber, M. R.; Wang, X.-F.; Bogenmann, E.; Li, F. P.; Weinberg, R. A.: Deletions of a DNA sequence in retinoblastomas and mesenchymal tumors: organization of the sequence and its encoded protein. Proc. Nat. Acad. Sci. 84:9059-9063, 1987. Note: Correction: Proc. Nat. Acad. Sci. 85:2234 only, 1988.

Fukushima, Y.; Kuroki, Y.; Ito, T.; Kondo, I.; Nishigaki, I.: Familial retinoblastoma (mother and son) with 13q14 deletion. Hum. Genet. 77:104-107, 1987.

Fung, Y.-K. T.; Murphree, A. L.; T'Ang, A.; Qian, J.; Hinrichs, S. H.; Benedict, W. F.: Structural evidence for the authenticity of the human retinoblastoma gene. Science 236: 1657-1661, 1987.

Gallie, B. L.: Predictive testing for retinoblastoma comes of age. (Editorial) Am. J. Hum. Genet. 61:279-281, 1997.

Gallie, B. L.; Ellsworth, R. M.; Abramson, D. M.; Phillips, R. A.: Retinoma: spontaneous regression of retinoblastoma or benign manifestation of the mutation? Brit. J. Cancer 45:513-521, 1982.

Gallie, B. L.; Phillips, R. A.: Multiple manifestations of the retinoblastoma gene. Birth Defects Orig. Art. Ser. 18(6): 689-701, 1982.

Garcia-Cao, M.; Gonzalo, S.; Dean, D.; Blasco, M. A.: A role for the Rb family of proteins in controlling telomere length. Nature Genet. 15 Oct. 2002. Note: Advance Electronic Publication.

Gey, W.: Dq-, multiple Missbildungen und Retinoblastom. human genetik 10:362-365, 1970.

Huang, Y. Z.; Wang, Q.; Xiong, W. C.; Mei, L.: Erbin is a protein concentrated at post synaptic membranes that interacts with PSD-95. J. Biol. Chem. 276:19318-19326, 2001.

Aalto-Setala, K.; Helve, E.; Kovanen, P. T.; Kontula, K.: Finnish type of low density lipoprotein receptor gene mutation (FH-Helsinki) deletes exons encoding the carboxy-terminal part of the receptor and creates an internalization-defective phenotype. J. Clin. Invest. 84:499-505, 1989.

Aalto-Setala, K.; Koivisto, U.-M.; Miettinen, T. A.; Gylling, H.; Kesaniemi, Y. A.; Savolainen, M.; Pyorala, K.; Ebeling, T.; Mononen, I.; Turtola, H.; Viikari, J.; Kontula, K.: Prevalence and geographical distribution of major LDL receptor gene rearrangements in Finland. J. Intern. Med. 231: 227-234, 1992.

Juwana, J.-P.; Henderikx, P.; Mischo, A.; Wadle, A.; Fadle, N.; Gerlach, K.; Arends, J. W.; Hoogenboom, H.; Pfreundschuh, M.; Renner, C.: EB/RP gene family encodes tubulin binding proteins. Int. J. Cancer 81:275-284, 1999.

Renner, C.; Pfitzenmeier, J.-P.; Gerlach, K.; Held, G.; Ohnesorge, S.; Sahin, U.; Bauer, S.; Pfreundschuh, M.: RP1, a new member of the adenomatous polyposis coli-binding EB1-like gene family, is differently expressed in activated T cells. J. Immun. 159:1276-1283, 1997.

Wadle, A.; Thiel, G.; Mischo, A.; Jung, V.; Pfreundschuh, M.; Renner, C.: Chromosomal localization and promoter analysis of the adenomatous polyposis coli binding protein RP1. Oncogene 20:5920-5929, 2001.

Awasthi, S.; Cheng, J.; Singhal, S. S.; Saini, M. K.; Pandya, U.; Pikula, S.; Bandorowicz-Pikula, J.; Singh, S. V.; Zimniak, P.; Awasthi, Y. C.: Novel function of human RLIP76: ATP-dependent transport of glutathione conjugates and doxorubicin. Biochemistry 39:9327-9334, 2000.

Jullien-Flores, V.; Dorseuil, O.; Romero, R.; Letourneur, F.; Saragosti, S.; Berger, R.; Tavitian, A.; Gacon, G.; Camonis, J. H.: Bridging Ral GTPase to Rho pathways: RLIP76, a Ral effector with CDC42/Rac GTPase-activating protein activity. J. Biol. Chem. 270:22473-22477, 1995.

Mas, C.; Bourgeois, F.; Bulfone, A.; Levacher, B.; Mugnier, C.; Simonneau, M.: Cloning and expression analysis of a novel gene, RP42, mapping to an autism susceptibility locus on 6q16. Genomics 65:70-74, 2000.

Faulkner, G.; Pallavicini, A.; Formentin, E.; Comelli, A.; Ievolella, C.; Trevisan, S.; Bortoletto, G.; Scannapieco, P.; Salamon, M.; Mouly, V.; Valle, G.; Lanfranchi, G.: ZASP: a new Z-band alternatively spliced PDZ-motif protein. J. Cell Biol. 146:465-475, 1999.

Zhou, Q.; Ruiz-Lozano, P.; Martone, M. E.; Chen, J.: Cypher, a striated muscle-restricted PDZ and LIM domain-containing protein, binds to alpha-actinin-2 and protein kinase C. J. Biol. Chem. 274:19807-19813, 1999.

Burgener, R.; Wolf, M.; Ganz, T.; Baggiolini, M.: Purification and characterization of a major phosphatidyl serine-binding phosphoprotein from human platelets. Biochem. J. 269:729-734, 1990.

Gustincich, S.; Schneider, C.: Serum deprivation response gene is induced by serum starvation but not by contact inhibition. Cell Growth Diff. 4:753-760, 1993.

Gustincich, S.; Vatta, P.; Goruppi, S.; Wolf, M.; Saccone, S.; Della Valle, G.; Baggiolini, M.; Schneider, C.: The human serum deprivation response gene (SDPR) maps to 2q32-q33 and codes for a phosphatidyl serine-binding protein. Genomics 57:120-129, 1999.

Eder, P. S.; Kekuda, R.; Stolc, V.; Altman, S.: characterization of two scleroderma autoimmune antigens that copurify with human ribonuclease P. Proc. Nat. Acad. Sci. 94:1101-1106, 1997.

Barton, D. E.; Spritz, R. A.; Francke, U.: RPU1 encoding the 68 kDaU1 snRNP-associated protein is located on chromosome 19. (Abstract) Cytogenet. Cell Genet. 46:577 only, 1987.

Du, H.; Rosbash, M.: The U1 snRNP protein U1C recognizes the 5-prime splice site in the absence of base pairing. Nature 419:86-90, 2002.

Montzka, K. A.; Steitz, J. A.: Additional low-abundance human small nuclear ribonucleoproteins: U11, U12, etc. Proc. Nat. Acad. Sci. 85:8885-8889, 1988.

Nelissen, R. L.; Sillekens, P. T.; Beijer, R. P.; Geurts van Kessel, A. H.; van Venrooij, W. J.: Structure, chromosomal localization and evolutionary conservation of the gene encoding human U1 snRNP-specificA protein. Gene 102:189-196, 1991.

Spritz, R. A.; Strunk, K.; Surowy, C. S.; Hoch, S. O.; Barton, D. E.; Francke, U.:The human 70-kD SnRNP protein: cDNA cloning, chromosomal localization, and expression. (Abstract) Am. J. Hum. Genet. 41: A239 only, 1987.

Spritz, R. A.; Strunk, K.; Surowy, C. S.; Hoch, S. O.; Barton, D. E.; Francke, U.:Human U1-70K snRNP protein: cDNA cloning, chromosomallocalization, expression, alternative splicing and RNA-binding. NucleicAcids Res. 15:10373-10391, 1987.

Ruiz-Perez, V. L.; Ide, S. E.; Strom, T. M.; Lorenz, B.; Wilson, D.; Woods, K.; King, L.; Francomano, C.; Freisinger, P.; Spranger, S.; Marino, B.; Dallapiccola, B.; Wright, M.; Meitinger, T.; Polymeropoulos, M. H.; Goodship, J.: Mutations in a new gene in Ellis-van Creveldsyndrome and Weyers acrodental dysostosis. Nature Genet. 24:283-286,2000. Note: Erratum: Nature Genet. 25:125 only, 2000.

Douhan, J., III; Hauber, I.; Eibl, M. M.; Glimcher, L. H.: Geneticevidence for a new type of major histocompatibility complex classII combined immunodeficiency characterized by a dyscoordinate regulation of HLA-D alpha and beta chains. J. Exp. Med. 183:1063-1069, 1996.

Ahmed, C. M. I.; Ware, D. H.; Lee, S. C.; Patten, C. D.; Ferrer-Montiel, A. V.; Schinder, A. F.; McPherson, J. D.; Wagner-McPherson, C. B.; Wasmuth, J. J.; Evans, G. A.; Montal, M.: Primary structure, chromosomallocalization, and functional expression of a voltage-gated sodiumchannel from human brain. Proc. Nat. Acad. Sci. 89:8220-8224, 1992.

Bertrand, P.; Poirier, J.; Oda, T.; Finch, C. E.; Pasinetti, G. M.: Association of apolipoprotein E genotype with brain levels ofapolipoprotein E and apolipoprotein J (clusterin) in Alzheimer disease. Molec. Brain Res. 33:174-178, 1995.

Birkenmeier, E. H.; Letts, V. A.; Frankel, W. N.; Magenheimer, B. S.; Calvet, J. P.: Sulfated glycoprotein-2 (Sgp-2) maps to mouse chromosome 14. Mammalian Genome 4:131-132, 1993.

Danik, M.; Chabot, J.-G.; Hassan-Gonzalez, D.; Suh, M.; Quirion, R.: Localization of sulfated glycoprotein-2/cluster in mRNA in the rat brain by in situ hybridization. J. Comp. Neurol. 334:209-227,1993.

Pan, H.; Yin, C.; Dyson, N. J.; Harlow, E.; Yamasaki, L.; VanDyke, T.: Key roles for E2F1 in signaling p53-dependent apoptosis and in cell division within developing tumors. Molec. Cell 2:283-292,1998.

Phillips, A. C.; Ernst, M. K.; Bates, S.; Rice, N. R.; Vousden, K. H.: E2F-1 potentiates cell death by blocking antiapoptotic signaling pathways. Molec. Cell 4:771-781, 1999.

Saenz Robles, M. T.; Symonds, H.; Chen, J.; Van Dyke, T.: Induction versus progression of brain tumor development: differential functions for the pRB- and p53-targeting domains of simian virus 40 T antigen. Molec. Cell. Biol. 14:2686-2698, 1994.

Sherr, C. J.: Tumor surveillance via the ARF-p53 pathway. GenesDev. 12:2984-2991, 1998.

Tsai, K. Y.; Hu, Y.; Macleod, K. F.; Crowley, D.; Yamasaki, L.; Jacks, T.: Mutation of E2f-1 suppresses apoptosis and inappropriate S phase entry and extends survival of Rb-deficient mouse embryos. Molec. Cell 2:293-304, 1998.

Weinberg, R. A.: E2F and cell proliferation: a world turned upsidedown. Cell 85:457-459, 1996.

Wu, L.; Timmers, C.; Maiti, B.; Saavedra, H. I.; Sang, L.; Chong, G. T.; Nuckolls, F.; Giangrande, P.; Wright, F. A.; Field, S. J.; Greenberg, M. E.; Orkin, S.; Nevins, J. R.; Robinson, M. L.; Leone, G.: The E2F1-3 transcription factors are essential for cellular proliferation. Nature 414:457-462, 2001.

Yamasaki, L.; Jacks, T.; Bronson, R.; Goillot, E.; Harlow, E.; Dyson, N. J.: Tumor induction and tissue atrophy in mice lackingE2F-1. Cell 85:537-548, 1996.

Zhang, H. S.; Postigo, A. A.; Dean, D. C.: Active transcriptional repression by the Rb-E2F complex mediates G1 arrest triggered by p16(INK4a), TGF-beta, and contact inhibition. Cell 97:53-61, 1999.

Zhang, Y.; Chellappan, S. P.: Cloning and characterization of human DP2, a novel dimerization partner of E2F. Oncogene 10:2085-2093,1995.

Fantes, J. A.; Oghene, K.; Boyle, S.; Danes, S.; Fletcher, J. M.; Bruford, E. A.; Williamson, K.; Seawright, A.; Schedl, A.; Hanson, I.; Zehetner, G.; Bhogal, R.; Lehrach, H.; Gregory, S.; Williams, J.; Little, P. F. R.; Sellar, G. C.; Hoovers, J.; Mannens, M.; Weissenbach, J.; Junien, C.; van Heyningen, V.; Bickmore, W. A.: A high-resolution integrated physical, cytogenetic, and genetic map of human chromosome11: distal p13 to proximal p15.1. Genomics 25:447-461, 1995.

Flores, O.; Lu, H.; Reinberg, D.: Factors involved in specific transcription by mammalian RNA polymerase II: identification and characterization of factor IIH. J. Biol. Chem. 267:2786-2793, 1992.

Heng, H. H. Q.; Xiao, H.; Shi, X.-M.; Greenblatt, J.; Tsui, L.-C.: Genes encoding general initiation factors for RNA polymerase I Itranscription are dispersed in the human genome. Hum. Molec. Genet. 3:61-64, 1994.

Lu, H.; Zawel, L.; Fisher, L.; Egly, J.-M.; Reinberg, D.: Human general transcription factor IIH phosphorylates the C-terminal domain of RNA polymerase II. Nature 358:641-645, 1992.

Marinoni, J.-C.; Roy, R.; Vermeulen, W.; Miniou, P.; Lutz, Y.; Weeda, G.; Seroz, T.; Gomez, D. M.; Hoeijmakers, J. H. J.; Egly, J.-M.: Cloning and characterization of p52, the fifth subunit of the core of the transcription/DNA repair factor TFIIH. EMBO J. 16:1093-1102,1997.

Shiekhattar, R.; Mermelstein, F.; Fisher, R. P.; Drapkin, R.; Dynlacht, B.; Wessling, H. C.; Morgan, D. O.; Reinberg, D.: Cdk-activating kinase complex is a component of human transcription factor TFIIH. Nature 374:283-287, 1995.

Altafaj, X.; Dierssen, M.; Baamonde, C.; Marti, E.; Visa, J.; Guimera, J.; Oset, M.; Gonzalez, J. R.; Florez, J.; Fillat, C.; Estivill, X.: Neurodevelopmental delay, motor abnormalities and cognitive deficits in transgenic mice overexpressing Dyrk1A (minibrain), a murine model of Down's syndrome. Hum. Molec. Genet. 10:1915-1923, 2001.

Tanaka, T.; Nakahara, K.; Kato, N.; Imai, T.; Yamazaki, T.; Tomita, H.; Shimokawa, H.; Matsuhashi, H.; Sato, N.; Matsui, M.; Kihira, S.; Shimizu, A.; Sano, T.; Haneda, N.; Kino, M.; Miyakita, Y.; Matsuoka, R.; Nagai, R.; Yazaki, Y.; Nakamura, Y.: Genetic linkage analyses of Romano-Ward syndrome (RWS) in 13 Japanese families. Hum. Genet. 94:380-384, 1994.

Towbin, J. A.; Li, H.; Taggart, T. R.; Lehmann, M. H.; Schwartz, P. J.; Satler, C. A.; Ayyagari, R.; Robinson, J. L.; Moss, A.; Hejtmancik, J. F.: Evidence of genetic heterogeneity in Romano-Ward long QT syndrome:analysis of 23 families. Circulation 90:2635-2644, 1994.

Tye, K.-H.; Desser, K. B.; Benchimol, A.: Survival following spontaneous ventricular flutter-fibrillation associated with QT syndrome:documentation during ambulatory monitoring. Arch. Intern. Med. 140:255-256, 1980.

Tyson, J.; Tranebjaerg, L.; McEntagart, M.; Larsen, L. A.; Christiansen, M.; Whiteford, M. L.; Bathen, J.; Aslaksen, B.; Sorland, S. J.; Lund, O.; Pembrey, M. E.; Malcolm, S.; Bitner-Glindzicz, M.: Mutational spectrum in the cardio auditory syndrome of Jervell and Lange-Nielsen. Hum. Genet. 107: 499-503, 2000.

Van der Straaten, P. J. C.; Bruins, C. L. D.: A family with heritable electrocardiographic Q-T prolongation. J. Med. Genet. 10:158-160,1973.

Vincent, G. M.: The heart rate of Romano-Ward syndrome patients. Am. Heart J. 112:61-64, 1986.

Vincent, G. M.; Timothy, K. W.; Leppert, M.; Keating, M.: The spectrum of symptoms and QT intervals in carriers of the gene for the long-QT syndrome. New Eng. J. Med. 327:846-852, 1992.

Ward, O. C.: A new familial cardiac syndrome in children. J. Irish Med. Assoc. 54:103-106, 1964.

Weitkamp, L. R.; Moss, A. J.: The long QT (Romano-Ward) syndrome locus, LQT, is probably linked to the HLA loci. (Abstract) Cytogenet. Cell Genet. 40:775 only, 1985.

Weitkamp, L. R.; Moss, A. J.; Lewis, R. A.; Hall, W. J.; MacCluer, J. W.; Schwartz, P. J.; Locati, E. H.; Tzivoni, D.; Vincent, G. M.; Robinson, J. L.; Guttormsen, S. A.: Analysis of HLA and disease susceptibility:chromosome 6 genes and sex influence long-QT phenotype. Am. J. Hum. Genet. 55:1230-1241, 1994.

Weitkamp, L. R.; Moss, A. J.; Schwartz, P. J.; Locati, E.; Tzivoni, D.; Vincent, G. M.; Robinson, J.; Guttormsen, S.: Analysis of HL Ahaplotypes in long QT syndrome: withdrawal of the preliminary assignment of LQT to the HLA linkage group. (Abstract) Cytogenet. Cell Genet. 51:1106 only, 1989.

Yang, W.-P.; Levesque, P. C.; Little, W. A.; Conder, M. L.; Shalaby, F. Y.; Blanar, M. A.: KvLQT1, a voltage-gated potassium channel responsible for human cardiac arrhythmias. Proc. Nat. Acad. Sci. 94:4017-4021,1997.

Samilchuk, E. I.; Chuchalin, A. G.: Mis-sense mutation of alpha-1-antichymotrypsin gene and chronic lung disease. (Letter) Lancet 342:624, 1993.

Hildebrand, C. E.; Gonzalez, F. J.; McBride, O. W.; Nebert, D. W.: Assignment of the human 2,3,7,8-tetrachlorodibenzo-p-dioxin-inducible cytochrome P1-450 gene to chromosome 15. Nucleic Acids Res. 13:2009-2016, 1985.

Olives, B.; Merriman, M.; Bailly, P.; Bain, S.; Barnett, A.; Todd, J.; Cartron, J.-P.; Merriman, T.: The molecular basis of the Kiddblood group polymorphism and its lack of association with type 1 diabetes susceptibility. Hum. Molec. Genet. 6:1017-1020, 1997.

Cohn, D. V.; Zangerle, R.; Fischer-Colbrie, R. R.; Chu, L. L. H.; Elting, J. J.; Hamilton, J. W.; Winkler, H.: Similarity of secretory protein I from parathyroid gland to chromogranin A from the adrenal medulla. Proc. Nat. Acad. Sci. 79:6056-6059, 1982.

Bianchi, G.; Tripodi, G.; Casari, G.; Salardi, S.; Barber, B. R.; Garcia, R.; Leoni, P.; Torielli, L.; Cusi, D.; Ferrandi, M.; Pinna, L. A.; Baralle, F. E.; Ferrari, P.: Two point mutations within the adducin genes are involved in blood pressure variation. Proc. Nat. Acad. Sci. 91:3999-4003, 1994.

Cusi, D.; Barlassina, C.; Azzani, T.; Casari, G.; Citterio, L.; Devoto, M.; Glorioso, N.; Lanzani, C.; Manunta, P.; Righetti, M.; Rivera, R.; Stella, P.; Troffa, C.; Zagato, L.; Bianchi, G.: Polymorphisms of alpha-adducin and salt sensitivity in patients with essential hypertension. Lancet 349:1353-1357, 1997.

Gardner, K.; Bennett, V.: A new erythrocyte membrane-associated protein with calmodulin binding activity: identification and purification. J. Biol. Chem. 261:1339-1348, 1986.

Goldberg, Y. P.; Lin, B.-Y.; Andrew, S. E.; Nasir, J.; Graham, R.; Glaves, M. L.; Hutchinson, G.; Theilmann, J.; Ginzinger, D. G.; Schappert, K.; Clarke, L.; Rommens, J. M.; Hayden, M. R.: Cloningand mapping of the alpha-adducin gene close to D4S95 and assessment of its relationship to Huntington disease. Hum. Molec. Genet. 1:669-675, 1992.

Hayden, M. R.: Huntington's Chorea. New York: Springer-Verlag (pub.) 1981.

Joshi, R.; Bennett, V.: Mapping the domain structure of human erythrocyte adducin. J. Biol. Chem. 265:13130-13136, 1990.

Joshi, R.; Gilligan, D. M.; Otto, E.; McLaughlin, T.; Bennett, V.: Primary structure and domain organization of human alpha and beta adducin. J. Cell Biol. 115:665-675, 1991.

Bruns, G. A. P.; Regina, V. M.: Adenylate kinase-2, a mitochondrialenzyme. Biochem. Genet. 15:477-486, 1977.

Carritt, B.; King, J.; Welch, H. M.: Gene order and localizationof enzyme loci on the short arm of chromosome 1. Ann. Hum. Genet. 46:329-335, 1982.

Goss, S. J.; Harris, H.: Gene transfer by means of cell fusion. II. The mapping of 8 loci on human chromosome 1 by statistical analysis of gene assortment in somatic cell hybrids. J. Cell Sci. 25:39-57,1977.

Van Cong, N.; Billardon, C.; Rebourcet, R.; Kaouel, C. L.-B.; Picard, J. Y.; Weil, D.; Frezal, J.: The existence of a second adenylate kinase locus linked to PGM-1 and peptidase-C. Ann. Genet. 15:213-218,1972.

Cook, P. J. L.; Buckton, K. E.; Spowart, G.: Family studies on chromosome 9. Cytogenet. Cell Genet. 16:284-288, 1976.

Mohandas, T.; Sparkes, R. S.; Sparkes, M. C.; Shulkin, J. D.; Toomey, K. E.; Funderburk, S. J.: Regional localization of human gene locion chromosome 9: studies of somatic cell hybrids containing human translocation. Am. J. Hum. Genet. 31:586-600, 1979.

Pilz, A.; Woodward, K.; Povey, S.; Abbott, C.: Comparative mapping of 50 human chromosome 9 loci in the laboratory mouse. Genomics 25:139-149, 1995.

Povey, S.; Slaughter, C. A.; Wilson, D. E.; Gormley, I. P.; Buckton, K. E.; Perry, P.; Bobrow, M.: Evidence for the assignment of the loci AK 1, AK 3 and ACON to chromosome 9 in man. Ann. Hum. Genet. 39:413-422, 1976.

Robson, E. B.; Meera Khan, P.: Report of the committee on the genetic constitution of chromosomes 7, 8, and 9. Cytogenet. Cell Genet. 32:144-152, 1982.

Steinbach, P.; Benz, R.: Demonstration of gene dosage effectsf or AK3 and GALT in fibroblasts from a fetus with 9p trisomy. Hum. Genet. 63:290-291, 1983.

Viskochil, D.; Buchberg, A. M.; Xu, G.; Cawthon, R. M.; Stevens, J.; Wolff, R. K.; Culver, M.; Carey, J. C.; Copeland, N. G.; Jenkins, N. A.; White, R.; O'Connell, P.: Deletions and a translocation interrupt a cloned gene at the neurofibromatosis type 1 locus. Cell 62:187-192,1990.

Wilson, D. E., Jr.; Povey, S.; Harris, H.: Adenylate kinases inman: evidence for a third locus. Ann. Hum. Genet. 39:305-313, 1976.

Xu, G.; O'Connell, P.; Stevens, J.; White, R.: characterization of human adenylate kinase 3 (AK3) cDNA and mapping of the AK3 pseudogene to an intron of the NF1 gene. Genomics 13:537-542, 1992.

Adinolfi, A.; Adinolfi, M.; Hopkinson, D. A.: Immunological and biochemical characterization of the human alcohol dehydrogenase chi-ADH isozyme. Ann. Hum. Genet. 48:1-10, 1984.

Beisswenger, T. B.; Holmquist, B.; Vallee, B. L.: Chi-ADH is the sole alcohol dehydrogenase isozyme of mammalian brains: implications and inferences. Proc. Nat. Acad. Sci. 82:8369-8373, 1985.

Carlock, L.; Hiroshige, S.; Wasmuth, J.; Smith, M.: Assignment of the gene coding for class III ADH to human chromosome 4:4q21-4q25.(Abstract) Cytogenet. Cell Genet. 40:598 only, 1985.

Engeland, K.; Hoog, J.-O.; Holmquist, B.; Estonius, M.; Jornvall, H.; Vallee, B. L.: Mutation of arg-115 of human class III alcohol dehydrogenase: a binding site required for formaldehyde dehydrogenase activity and fatty acid activation. Proc. Nat. Acad. Sci. 90:2491-2494,1993.

Giri, P.; Krug, J. F.; Kozak, C.; Moretti, T.; O'Brien, S. J.; Seuanez, H. N.; Goldman, D.: Cloning and comparative mapping of a human class III (chi) alcohol dehydrogenase cDNA. Biochem. Biophys. Res. Commun. 164:453-460, 1989.

Goldman, D.; RathnaGiri, P.; Moretti, T. R.; Krug, J. F.; Kozak, C.; Dean, M.; Seuanez, H. N.; O'Brien, S. J.: Class III alcohol dehydrogenase (ADH5): widespread expression and synteny with other ADHs in both mouse and man. (Abstract) Am. J. Hum. Genet. 45 (suppl.): A141only, 1989.

Matsuo, Y.; Yokoyama, S.: Cloning and sequencing of a processed pseudogene derived from a human class III alcohol dehydrogenase gene. Am. J. Hum. Genet. 46:85-91, 1990.

Smith, M.: Genetics of human alcohol and aldehyde dehydrogenases. Adv. Hum. Genet. 15:249-290, 1986.

Agarwal, D. P.; Meier-Tackmann, D.; Harada, S.; Goedde, H. W.: A search for the Indianapolis-variant of human alcohol dehydrogenase in liver autopsy samples from North Germany and Japan. Hum. Genet. 59:170-171, 1981.

Bosron, W. F.; Li, T.-K.; Vallee, B. L.: New molecular forms of human liver alcohol dehydrogenase: isolation and characterization of ADH (Indianapolis). Proc. Nat. Acad. Sci. 77:5784-5788, 1980.

Bosron, W. F.; Magnes, L. J.; Li, T.-K.: Human liver alcohol dehydrogenase: ADH(Indianapolis) results from genetic polymorphism at the ADH-2 genelocus. Biochem. Genet. 21:735-744, 1983.

Burnell, J. C.; Carr, L. G.; Dwulet, F. E.; Edenberg, H. J.; Li, T.-K.; Bosron, W. F.: The human beta (3) alcohol dehydrogenase subunit differs from beta-1 by a cys for arg-369 substitution which decreases NAD(H) binding. Biochem. Biophys. Res. Commun. 146:1227-1233, 1987.

Duester, G.; Hatfield, G. W.; Buhler, R.; Hempel, J.; Jornvall, H.; Smith, M.: Molecular cloning and characterization of cDNA for the beta subunit of human alcohol dehydrogenase. Proc. Nat. Acad. Sci. 81:4055-4059, 1984.

Heden, L.-O.; Hoog, J.-O.; Larsson, K.; Lake, M.; Lagerholm, E.; Holmgren, A.; Vallee, B. L.; Jornvall, H.; von Bahr-Lindstrom, H.: cDNA clones coding for the beta-subunit of human liver alcohol dehydrogenase have differently sized 3-prime-non-coding regions. FEBS Lett. 194:327-332, 1986.

Hempel, J.; Holmquist, B.; Fleetwood, L.; Kaiser, R.; Barros-Soderling, J.; Buhler, R.; Vallee, B. L.; Jornvall, H.: Structural relationships among class I isozymes of human liver alcohol dehydrogenase. Biochemistry 24:5303-5307, 1985.

Higuchi, S.; Muramatsu, T.; Matsushita, S.; Murayama, M.; Hayashida, M.: Polymorphisms of ethanol-oxidizing enzymes in alcoholics within active ALDH2. Hum. Genet. 97:413-434, 1996.

Hurley, T. D.; Edenberg, H. J.; Bosron, W. F.: Expression andkinetic characterization of variants of human beta-1/beta-1 alcoholdehydrogenase containing substitutions at amino acid 47. J. Biol. Chem. 265:16366-16372, 1990.

Long, J. C.; Knowler, W. C.; Hanson, R. L.; Robin, R. W.; Urbanek, M.; Moore, E.; Bennett, P. H.; Goldman, D.: Evidence for genetic linkage to alcohol dependence on chromosomes 4 and 11 from an autosome-widescan in an American Indian population. Am. J. Med. Genet. 81:216-221,1998.

Matsuo, Y.; Yokoyama, R.; Yokoyama, S.: The genes for human alcohol dehydrogenases beta-1 and beta-2 differ by only one nucleotide. Europ. J. Biochem. 183:317-320, 1989.

Osier, M.; Pakstis, A. J.; Kidd, J. R.; Lee, J.-F.; Yin, S.-J.; Ko, H.-C.; Edenberg, H. J.; Lu, R.-B.; Kidd, K. K.: Linkage disequilibrium at the ADH2 and ADH3 loci and risk of alcoholism. Am. J. Hum. Genet. 64:1147-1157, 1999.

Herz, J.; Hamann, U.; Rogne, S.; Myklebost, O.; Gausepohl, H.; Stanley, K. K.: Surface location and high affinity for calcium of a 500 kd liver membrane protein closely related to the LDL-receptor suggest a physiological role as lipoprotein receptor. EMBO J. 7:4119-4127, 1988.

Cailleau-Thomas, A.; Coullin, P.; Candelier, J.-J.; Balanzino, L.; Mennesson, B.; Oriol, R.; Mollicone, R.: FUT4 and FUT9 genes are expressed early in human embryogenesis. Glycobiology 10:789-802,2000.

Sefton, L.; Kearney, P.; Kelsey, G.; Povey, S.; Wolfe, J.: Physical linkage of the genes PI and AACT. (Abstract) Cytogenet. Cell Genet. 51:1076, 1989.

Sefton, L.; Kelsey, G.; Kearney, P.; Povey, S.; Wolfe, J.: A physical map of the human PI and AACT genes. Genomics 7:382-388,1990.

Tachikawa, H.; Tsuda, M.; Onoe, K.; Ueno, M.; Takagi, S.; Shinohara, Y.: Alpha-1-antichymotrypsin gene A1252G variant (ACT Isehara-1) is associated with a lacunar type of ischemic cerebrovascular disease. J. Hum. Genet. 46:45-47, 2001.

Tsuda, M.; Sei, Y.; Matsumoto, M.; Kamiguchi, H.; Yamamoto, M.; Shinohara, Y.; Igarashi, T.; Yamamura, M.: Alpha-1-antichymotrypsin variant detected by PCR-single strand conformation polymorphism (PCR-SSCP) and direct sequencing. Hum. Genet. 90:467-468, 1992.

Tsuda, M.; Sei, Y.; Yamamura, M.; Yamamoto, M.; Shinohara, Y.: Detection of a new mutant alpha-1-antichymotrypsin in patients with occlusive-cerebrovascular disease. FEBS Lett. 304:66-68, 1992.

Wang, X.; DeKosky, S. T.; Luedecking-Zimmer, E.; Ganguli, M.; Kamboh, M. I.: Genetic variation in alpha-1-antichymotrypsin and its association with Alzheimer's disease. Hum. Genet. 110:356-365,2002.

Yamamoto, M.; Kondo, I.; Ogawa, N.; Asanuma, M.; Yamashita, Y.; Mizuno, Y.: Genetic association between susceptibility to Parkinson's disease and alpha-1-antichymotrypsin polymorphism. Brain Res. 759:153-155, 1997.

Azem, A.; Kessel, M.; Goloubinoff, P.: Characterization of a functional GroEL-14(GroES-7)-2 chaperonin hetero-oligomer. Science 265:653-656,1994.

Cheng, M. Y.; Hartl, F.-U.; Martin, J.; Pollock, R. A.; Kalousek, F.; Neupert, W.; Hallberg, E. M.; Hallberg, R. L.; Horwich, A. L.: Mitochondrial heat-shock protein hsp60 is essential for assembly of proteins imported into yeast mitochondria. Nature 337:620-625,1989.

Ellis, R. J.: The molecular chaperone concept. Semin. Cell Biol. 1:1-9, 1990.

Fontaine, B.; Davoine, C.-S.; Durr, A.; Paternotte, C.; Feki, I.; Weissenbach, J.; Hazan, J.; Brice, A.: A new locus for autosomal dominant pure spastic paraplegia, on chromosome 2q24-q34. Am. J. Hum. Genet. 66:702-707, 2000.

Rothman, J. E.: Polypeptide chain binding proteins: catalystsof protein folding and related processes in cells. Cell 59:591-601,1989.

Saibil, H.; Dong, Z.; Wood, S.; auf der Mauer, A.: Binding of chaperonins. Nature 353:25-26, 1991.

Schmidt, M.; Rutkat, K.; Rachel, R.; Pfeifer, G.; Jaenicke, R.; Viitanen, P.; Lorimer, G.; Buchner, J.: Symmetric complexes of GroEchaperonins as part of the functional cycle. Science 265:656-659,1994.

Venner, T. J.; Singh, B.; Gupta, R. S.: Nucleotide sequencesand novel structural features of human and Chinese hamster hsp60 (chaperonin) gene families. DNA Cell Biol. 9:545-552, 1990.

Jaiswal, A. K.; Gonzalez, F. J.; Nebert, D. W.: Comparison of human mouse P(1)450 upstream regulatory sequences in liver- and nonliver-derived cell lines. Molec. Endocr. 1:312-320, 1987.

Jaiswal, A. K.; Gonzalez, F. J.; Nebert, D. W.: Human P(1)-450 gene sequence and correlation of mRNA with genetic differences inbenzo (a) pyrene metabolism. Nucleic Acids Res. 13:4503-4520, 1985.

Jaiswal, A. K.; Gonzalez, F. J.; Nebert, D. W.: Human dioxin-inducible cytochrome P1-450: complementary DNA and amino acid sequence. Science 228:80-83, 1985.

Jaiswal, A. K.; Nebert, D. W.: Two RFLPs associated with the human P(1)450 gene linked to the MPI locus on chromosome 15 (HGM8D15S8). Nucleic Acids Res. 14:4376, 1986.

Jaiswal, A. K.; Nebert, D. W.; Gonzalez, F. J.: Human P(3)450:cDNA and complete amino acid sequence. Nucleic Acids Res. 14:6773-6774,1986.

Jones, S. N.; Jones, P. G.; Ibarguen, H.; Caskey, C. T.; Craigen, W. J.: Induction of the Cyp1a-1 dioxin-responsive enhancer in transgenic mice. Nucleic Acids Res. 19:6547-6551, 1991.

Kawajiri, K.; Eguchi, H.; Nakachi, K.; Sekiya, T.; Yamamoto, M.: Association of CYP1A1 germ line polymorphisms with mutations of the p53 gene in lung cancer. Cancer Res. 56:72-76, 1996.

Kawajiri, K.; Nakachi, K.; Imai, K.; Yoshii, A.; Shinoda, N.; Watanabe, J.: Identification of genetically high risk individuals to lung cancer by DNA polymorphisms of the cytochrome P450IA1 gene. FEBSLett. 263:131-133, 1990.

Kawajiri, K.; Watanabe, J.; Gotoh, O.; Tagashira, Y.; Sogawa, K.; Fujii-Kuriyama, Y.: Structure and drug inducibility of the human cytochrome P-450c gene. Europ. J. Biochem. 159:219-225, 1986.

Kouri, R. E.; McKinney, C. E.; Slomiany, D. J.; Snodgrass, D. R.; Wray, N. P.; McLemore, T. L.: Positive correlation between high aryl hydrocarbon hydroxylase activity and primary lung cancer as analyzed in cryopreserved lymphocytes. Cancer Res. 42:5030-5037, 1982.

McBride, O. W.: Personal Communication. Bethesda, Md. Sep. 16, 1985.

Mooney, L. A.; Bell, D. A.; Santella, R. M.; Van Bennekum, A. M.; Ottman, R.; Paik, M.; Blaner, W. S.; Lucier, G. W.; Covey, L.; Young, T. L.; Cooper, T. B.; Glassman, A. H.; Perera, F. P.: Contribution of genetic and nutritional factors to DNA damage in heavy smokers. Carcinogenesis 18:503-509, 1997.

Nakachi, K.; Imai, K.; Hayashi, S.; Watanabe, J.; Kawajiri, K.: Genetic susceptibility to squamous cell carcinoma of the lung in relation to cigarette smoking dose. Cancer Res. 51:5177-5180, 1991.

Nebert, D. W.: Personal Communication. Bethesda, Md. Feb. 1, 1988.

Ocraft, K. P.; Muskett, J. M.; Brown, S.: Localization of the human aryl hydrocarbon hydroxylase gene to the 2q31-2pter region ofchromosome 2. Ann. Hum. Genet. 49:237-239, 1985.

Perera, F. P.: Environment and cancer: who are susceptible? Science 278:1068-1073, 1997.

Petersen, D. D.; McKinney, C. E.; Ikeya, K.; Smith, H. H.; Bale, A. E.; McBride, O. W.; Nebert, D. W.: Human CYP1A1 gene: cosegregation of the enzyme inducibility phenotype and an RFLP. Am. J. Hum. Genet. 48:720-725, 1991.

Quattrochi, L. C.; Okino, S. T.; Pendurthi, U. R.; Tukey, R. H.: Cloning and isolation of human cytochrome P-450 cDNAs homologous to dioxin-inducible rabbit mRNAs encoding P-450 4 and P-450 6. DNA 4:395-400, 1985.

Tukey, R. H.; Lalley, P. A.; Nebert, D. W.: Localization of cytochromeP1-450 and P3-450 genes to mouse chromosome 9. Proc. Nat. Acad. Sci. 81:3163-3166, 1984.

Wang, X.; Zuckerman, B.; Pearson, C.; Kaufman, G.; Chen, C.; Wang, G.; Niu, T.; Wise, P. H.; Bauchner, H.; Xu, X.: Maternal cigarette smoking, metabolic gene polymorphism, and infant birth weight. J. A. M. A. 287:195-202, 2002.

Wiebel, F. J.; Hlavica, P.; Grzeschik, K. H.: Expression of aromaticpolycyclic hydrocarbon-induced monooxygenase (aryl hydrocarbon hydroxylase) in man-mouse hybrids is associated with human chromosome 2. Hum. Genet. 59:277-280, 1981.

Xu, X.; Kelsey, K. T.; Wiencke, J. K.; Wain, J. C.; Christiani, D. C.: Cytochrome P450 CYP1A1 MspI polymorphism and lung cancer susceptibility. Cancer Epidemiol. Biomarkers Prev. 5:687-692, 1996.

Berne, R. M.: Cardiac nucleotides in hypoxia: possible role inregulation of coronary blood flow. Am. J. Physiol. 204:317-322,1963.

Livingstone, F. B.: The Duffy blood groups, vivax malaria, and malaria selection in human populations: a review. Hum. Biol. 56:413-425, 1984.

Yang-Feng, T. L.; Naiman, T.; Kopatz, I.; Eli, D.; Dafni, N.; Canaani, D.: Assignment of the human casein kinase II alpha-prime subunit gene (CSNK2A1) to chromosome 16p13.2-p13.3. Genomics 19:173 only,1994.

Bonner, T. I.; Young, A. C.; Brann, M. R.; Buckley, N. J.: Cloning and expression of the human and rat m5 muscarinic acetylcholine genes. Neuron 1:403-410, 1988.

Arnaudo, E.; Hirano, M.; Seelan, R. S.; Milatovich, A.; Hsieh, C.-L.; Fabrizi, G. M.; Grossman, L. I.; Francke, U.; Schon, E. A.: Tissue-specific expression and chromosome assignment of genes specifying two isoforms of subunit VIIa of human cytochrome c oxidase. Gene 119:299-305, 1992.

Aman, P.; Ron, D.; Mandahl, N.; Fioretos, T.; Heim, S.; Arheden, K.; Willen, H.; Rydholm, A.; Mitelman, F.: Rearrangement of the transcription factor gene CHOP in myxoid liposarcomas with t (12;16)(q13; p11). Genes Chromosomes Cancer 5:278-285, 1992.

Pizzuti, A.; Gennarelli, M.; Novelli, G.; Colosimo, A.; Cicero, S. L.; Caskey, C. T.; Dallapiccola, B.: Human elongation factor EF-1-beta:cloning and characterization of the EF1-beta-5a gene and assignment of EF-1-beta isoforms to chromosomes 2, 5, 15 and X. Biochem. Biophys. Res. Commun. 197:154-162, 1993.

Jones, M. E. E.; Thorburn, A. W.; Britt, K. L.; Hewitt, K. N.; Wreford, N. G.; Proietto, J.; Oz, O. K.; Leury, B. J.; Robertson, K. M.; Yao, S.; Simpson, E. R.: Aromatase-deficient (ArKO) mice have a phenotype of increased adiposity. Proc. Nat. Acad. Sci. 97:12735-12740,2000.

Sakai, T.; Johnson, K. J.; Murozono, M.; Sakai, K.; Magnuson, M. A.; Wieloch, T.; Cronberg, T.; Isshiki, A.; Erickson, H. P.; Fassler, R.: Plasma fibronectin supports neuronal survival and reduces brain injury following transient focal cerebral ischemia but is not essential for skin-wound healing and hemostasis. Nature Med. 7:324-330, 2001.

Geurts, J. M.; Schoenmakers, E. F.; Roijer, E.; Stenman, G.; Vande Ven, W. J. M.: Expression of reciprocal hybrid transcripts of HMGIC and FHIT in a pleomorphic adenoma of the parotid gland. CancerRes. 57:13-17, 1997.

Tan, J. C.; Indelicato, S. R.; Narula, S. K.; Zavodny, P. J.; Chou, C.-C.: Characterization of interleukin-10 receptors on human and mouse cells. J. Biol. Chem. 268:21053-21059, 1993.

Baumann, P.; West, S. C.: DNA end-joining catalyzed by human cell-free extracts. Proc. Nat. Acad. Sci. 95:14066-14070, 1998.

Tsukamoto, A. S.; Grosschedl, R.; Guzman, R. C.; Parslow, T.; Varmus, H. E.: Expression of the int-1 gene in transgenic mice is associated with mammary gland hyperplasia and adenocarcinomas in male and female mice. Cell 55:619-625, 1988.

Kawagishi, J.; Kumabe, T.; Yoshimoto, T.; Yamamoto, T.: Structure, organization, and transcription units of the human alpha-platelet-derived growth factor receptor gene, PDGFRA. Genomics 30:224-232, 1995.

Pearson, C. A.; Pearson, D.; Shibahara, S.; Hofsteenge, J.; Chiquet-Ehrismann, R.: Tenascin: cDNA cloning and induction by TGF-beta. EMBO J. 7:2977-2981, 1988.

Malo, D.; Schurr, E.; Dorfman, J.; Canfield, V.; Levenson, R.; Gros, P.: Three brain sodium channel alpha-subunit genes are clustered on the proximal segment of mouse chromosome 2. Genomics 10:666-672,1991.

Malo, M. S.; Srivastava, K.; Andresen, J. M.; Chen, X.-N.; Korenberg, J. R.; Ingram, V. M.: Targeted gene walking by low stringency polymerase chain reaction: assignment of a putative human brain sodium channel gene (SCN3A) to chromosome 2q24-31. Proc. Nat. Acad. Sci. 91:2975-2979,1994.

Tunnacliffe, A.; McGuire, R. S.: A physical linkage group in human chromosome band 11q23 covering a region implicated in leukocyteneoplasia. Genomics 8:447-453, 1990.

Allore, R.; O'Hanlon, D.; Price, R.; Neilson, K.; Willard, H. F.; Cox, D. R.; Marks, A.; Dunn, R. J.: Gene encoding the beta-subunit of S100 protein is on chromosome 21: implications for Down syndrome. Science 239:1311-1313, 1988.

Allore, R. J.; Friend, W. C.; O'Hanlon, D.; Neilson, K. M.; Baumal, R.; Dunn, R. J.; Marks, A.: Cloning and expression of the human S100-betagene. J. Biol. Chem. 265:15537-15543, 1990.

Duncan, A. M. V.; Higgins, J.; Dunn, R. J.; Allore, R.; Marks, A.: Refined sublocalization of the human gene encoding the beta subunit of the S100 protein (S100B) and confirmation of a subtle t (9;21) translocation using in situ hybridization. Cytogenet. Cell Genet. 50:234-235,1989.

Reeves, R. H.; Yao, J.; Crowley, M. R.; Buck, S.; Zhang, X.; Yarowsky, P.; Gearhart, J. D.; Hilt, D. C.: Astrocytosis and axonal proliferationin the hippocampus of S100b transgenic mice. Proc. Nat. Acad. Sci. 91:5359-5363, 1994.

Kurlan, R.; Behr, J.; Medved, L.; Shoulson, I.; Pauls, D.; Kidd, J. R.; Kidd, K. K.: Familial Tourette's syndrome: report of a large pedigree and potential for linkage analysis. Neurology 36:772-776,1986.

Kurihara, Y.; Kurihara, H.; Suzuki, H.; Kodama, T.; Maemura, K.; Nagai, R.; Oda, H.; Kuwaki, T.; Cao, W.-H.; Kamada, N.; Jishage, K.; Ouchi, Y.; Azuma, S.; Toyoda, Y.; Ishikawa, T.; Kumada, M.; Yazaki, Y.: Elevated blood pressure and craniofacial abnormalities in mice deficient in endothelin-1. Nature 368:703-710, 1994.

Nakae, J.; Biggs, W. H., III; Kitamura, T.; Cavenee, W. K.; Wright, C. V. E.; Arden, K. C.; Accili, D.: Regulation of insulin action and pancreatic beta-cell function by mutated alleles of the gene encoding forkhead transcription factor Foxo1. Nature Genet. 32:245-253,2002.

Fischer, J. A.; Egert, F.; Werder, E.; Born, W.: An inheritedmutation associated with functional deficiency of the alpha-subunit of the guanine nucleotide-binding protein Gs in pseudo- and pseudopseudohypoparathyroidism. J. Clin. Endocr. Metab. 83:935-938, 1998.

Zhuang, Y.; Soriano, P.; Weintraub, H.: The helix-loop-helixgene E2A is required for B cell formation. Cell 79:875-884, 1994.

Jarrous, N.; Eder, P. S.; Guerrier-Takada, C.; Hoog, C.; Altman, S.: Autoantigenic properties of some protein subunits of catalytically active complexes of human ribonuclease P. RNA 4:407-417, 1998.

Hauf, S.; Waizenegger, I. C.; Peters, J.-M.: Cohesin cleavageby separase required for anaphase and cytokinesis in human cells. Science 293:1320-1323, 2001.

Hoque, M. T.; Ishikawa, F.: Human chromatid cohesin componenth Rad21 is phosphorylated in M phase and associated with metaphase centromeres. J. Biol. Chem. 276:5059-5067, 2001.

McKay, M. J.; Troelstra, C.; van der Spek, P.; Kanaar, R.; Smit, B.; Hagemeijer, A.; Bootsma, D.; Hoeijmakers, J. H. J.: Sequence conservation of the rad21 Schizosaccharomyces pombe DNA double-strandbreak repair gene in human and mouse. Genomics 36:305-315, 1996.

Sadano, H.; Sugimoto, H.; Sakai, F.; Nomura, N.; Osumi, T.: NXP-1, a human protein related to Rad21/Scc1/Mcd1, is a component of then uclear matrix. Biochem. Biophys. Res. Commun. 267:418-422, 2000.

Fujimoto, K.; Shen, M.; Noshiro, M.; Matsubara, K.; Shingu, S.; Honda, K.; Yoshida, E.; Suardita, K.; Matsuda, Y.; Kato, Y.: Molecular cloning and characterization of DEC2, a new member of basic helix-loop-helixproteins. Biochem. Biophys. Res. Commun. 280:164-171, 2001.

Garriga-Canut, M.; Roopra, A.; Buckley, N. J.: The basic helix-loop-helixprotein, SHARP-1, represses transcription by a histone deacetylase-dependent and histone deacetylase-independent mechanism. J. Biol. Chem. 276:14821-14828, 2001.

Fukamachi, S.; Shimada, A.; Shima, A.: Mutations in the gene encodingB, a novel transporter protein, reduce melanin content in medaka. Nature Genet. 28:381-385, 2001.

Harada, M.; Li, Y. F.; El-Gamil, M.; Rosenberg, S. A.; Robbins, P. F.: Use of an in vitro immuno selected tumor line to identify shared melanoma antigens recognized by HLA-A*0201-restricted T cells. CancerRes. 61:1089-1094, 2001.

Newton, J. M.; Cohen-Barak, O.; Hagiwara, N.; Gardner, J. M.; Davisson, M. T.; King, R. A.; Brilliant, M. H.: Mutations in the human orthologue of the mouse under white gene (uw) underlie a new form of oculocutaneousalbinism, OCA4. Am. J. Hum. Genet. 69:981-988, 2001.

Gu, H.; Saito, K.; Klaman, L. D.; Shen, J.; Fleming, T.; Wang, Y.-P.; Pratt, J. C.; Lin, G.; Lim, B.; Kinet, J.-P.; Neel, B. G.:Essential role for Gab2 in the allergic response. Nature 412:186-190, 2001.

Appel, S.; Reichwald, K.; Zimmermann, W.; Reis, A.; Rosenthal, A.; Hennies, H. C.: Identification and localization of a new human myotubularin-related protein gene, MTMR8, on 8p22-p23. Genomics 75:6-8, 2001.

Laporte, J.; Blondeau, F.; Buj-Bello, A.; Mandel, J.-L.: The myotubularin family: from genetic disease to phosphoinositide metabolism. TrendsGenet. 17:221-228, 2001.

Ariizumi, K.; Shen, G.-L.; Shikano, S.; Xu, S.; Ritter, R., III; Kumamoto, T.; Edelbaum, D.; Morita, A.; Bergstresser, P. R.; Takashima, A.: Identification of a novel, dendritic cell-associated molecule, dectin-1, by subtractive cDNA cloning. J. Biol. Chem. 275:20157-20167, 2000.

Brown, G. D.; Gordon, S.: A new receptor for beta-glucans. Nature 413:36-37, 2001.

Hernanz-Falcon, P.; Arce, I.; Roda-Navarro, P.; Fernandez-Ruiz, E.: Cloning of human dectin-1, a novel C-type lectin-like receptorgene expressed on dendritic cells. Immunogenetics 53:288-295, 2001.

Yokota, K.; Takashima, A.; Bergstresser, P. R.; Ariizumi, K.: Identification of a human homologue of the dendritic cell-associated C-type lectin-1, dectin-1. Gene 272:51-60, 2001.

Hagen, G.; Muller, S.; Beato, M.; Suske, G.: Sp1-mediated transcriptional activation is repressed by Sp3. EMBO J. 13:3843-3851, 1994.

Kalff-Suske, M.; Kunz, J.; Grzeschik, K.-H.; Suske, G.: human Sp3 transcriptional regulator gene (SP3) maps to chromosome 2q31. Genomics 37:410-412, 1996.

Kingsley, C.; Winoto, A.: Cloning of GT box-binding proteins: a novel Sp1 multigene family regulating T-cell receptor gene expression. Molec. Cell. Biol. 12:4251-44261, 1992.

Carmeci, C.; Thompson, D. A.; Ring, H. Z.; Francke, U.; Weigel, R. J.: Identification of a gene (GPR30) with homology to the G-protein-coupled receptor superfamily associated with estrogen receptor expression in breast cancer. Genomics 45:607-617, 1997.

Feng, Y.; Gregor, P.: Cloning of a novel member of the G protein-coupled receptor family related to peptide receptors. Biochem. Biophys. Res. Commun. 231:651-654, 1997.

Kvingedal, A. M.; Smeland, E. B.: A novel putative G-protein-coupled receptor expressed in lung, heart and lymphoid tissue. FEBS Lett. 407:59-62, 1997.

Owman, C.; Blay, P.; Nilsson, C.; Lolait, S. J.: Cloning of human CDNA encoding a novel heptahelix receptor expressed in Burkitt's lymphoma and widely distributed in brain and peripheral tissues. Biochem. Biophys. Res. Commun. 228:285-292, 1996.

Takada, Y.; Kato, C.; Kondo, S.; Korenaga, R.; Ando, J.: Cloningof cDNAs encoding G protein-coupled receptor expressed in human endothelial cells exposed to fluid shear stress. Biochem. Biophys. Res. Commun. 240-737-741, 1997.

Liu, X.; Zou, H.; Slaughter, C.; Wang, X.: DFF, a heterodimeric protein that functions downstream of caspase-3 to trigger DNA fragmentation during apoptosis. Cell 89:175-184, 1997.

Judson, H.; van Roy, N.; Strain, L.; Vandesompele, J.; Van Gele, M.; Speleman, F.; Bonthron, D. T.: Structure and mutation analysis of the gene encoding DNA fragmentation factor 40 (caspase-activated nuclease), a candidate neuroblastoma tumour suppressor gene. Hum. Genet. 106:406-413, 2000.

Liu, X.; Li, P.; Widlak, P.; Zou, H.; Luo, X.; Garrard, W. T.; Wang, X.: The 40-kDa subunit of DNA fragmentation factor inducesDNA fragmentation and chromatin condensation during apoptosis. Proc. Nat. Acad. Sci. 95:8461-8466, 1998.

Mukae, N.; Enari, M.; Sakahira, H.; Fukuda, Y.; Inazawa, J.; Toh, H.; Nagata, S.: Molecular cloning and characterization of human caspase-activated DNase. Proc. Nat. Acad. Sci. 95:9123-9128, 1998.

Garrett-Sinha, L. A.; Eberspaecher, H.; Seldin, M. F.; de Crombrugghe, B.: A gene for a novel zinc-finger protein expressed in differentiated epithelial cells and transiently in certain mesenchymal cells. J. Biol. Chem. 271:31384-31390, 1996.

Segre, J. A.; Bauer, C.; Fuchs, E.: Klf4 is a transcription factorr equired for establishing the barrier function of the skin. Nature Genet. 22:356-360, 1999.

Shields, J. M.; Christy, R. J.; Yang, V. W.: Identification and characterization of a gene encoding a gut-enriched Kruppel-like factor expressed during growth arrest. J. Biol. Chem. 271:20009-20017, 1996.

Yet, S.-F.; McA'Nulty, M. M.; Folta, S. C.; Yen, H.-W.; Yoshizumi, M.; Hsieh, C.-M.; Layne, M. D.; Chin, M. T.; Wang, H.; Perrella, M. A.; Jain, M. K.; Lee, M.-E.: Human EZF, a Kruppel-like zinc finger protein, is expressed in vascular endothelial cells and contains transcriptional activation and repression domains. J. Biol. Chem. 273:1026-1031, 1998.

Sherman, P. M.; Sun, H.; Macke, J. P.; Williams, J.; Smallwood, P. M.; Nathans, J.: Identification and characterization of a conserved family of protein serine/threonine phosphatases homologous to Drosophilaretinal degeneration C (rdgC). Proc. Nat. Acad. Sci. 94:11639-11644, 1997.

Ohira, M.; Ootsuyama A.; Suzuki, E.; Ichikawa, H.; Seki, N.; Nagase, T.; Monura, N.; Ohki, M.: Identification of a novel human gene containing the tetratricopeptide repeat domain from the Down syndrome region of chromosome 21. DNA Res. 3:9-16, 1996.

Tsukahara, F.; Hattori, M.; Muraki, T.; Sakaki, Y.: Identification and cloning of a novel cDNA belonging to tetratricopeptide repeat gene family from Down syndrome-critical region 21q22.2. J. Biochem. 120:820-827, 1996.

Albrecht, U.; Sun, Z. S.; Eichele, G.; Lee, C. C.: A differential response to two putative mammalian circadian regulators, mper1 andmper2, to light. Cell 91:1055-1064, 1997.

Johnstone, R. W.; See, R. H.; Sells, S. F.; Wang, J.; Muthukkumar, S.; Englert, C.; Haber, D. A.; Licht, J. D.; Sugrue, S. P.; Roberts, T.; Rangnekar, V. M.; Shi, Y.: A novel repressor, par-4, modulates transcription and growth suppression functions of the Wilms' tumor suppressor WT1. Molec. Cell. Biol. 16:6945-6956, 1996.

Bai, J.; Uehara, Y.; Montell, D. J.: Regulation of invasive cell behavior by taiman, a Drosophila protein related to AIB1, a steroid receptor coactivator amplified in breast cancer. Cell 103:1047-1058, 2000.

Chen, H.; Lin, R. J.; Schiltz, R. L.; Chakravarti, D.; Nash, A.; Nagy, L.; Privalsky, M. L.; Nakatani, Y.; Evans, R. M.: Nuclear receptor coactivator ACTR is a novel histone acetyltransferase and forms a multimeric activation complex with P/CAF and CBP/p300. Cell 90:569-580, 1997.

Guan, X.-Y.; Xu, J.; Anzick, S. L.; Zhang, H.; Trent, J. M.; Meltzer, P. S.: Hybrid selection of transcribed sequences from micro dissected DNA: isolation of genes within amplified region at 20q11-q13.2 inbreast cancer. Cancer Res. 56:3446-3450, 1996.

Shirazi, S. K.; Bober, M. A.; Coetzee, G. A.: Polymorphic exonicCAG microsatellites in the gene amplified in breast cancer (AIB1 gene). Clin. Genet. 54:102-103, 1998.

Takeshita, A.; Cardona, G. R.; Koibuchi, N.; Suen, C.-S.; Chin, W. W.: TRAM-1, a novel 160-kDa thyroid hormone receptor activator molecule, exhibits distinct properties from steroid receptor coactivator-1. J. Biol. Chem. 272:27629-27634, 1997.

Stoss, O.; Schwaiger, F.-W.; Cooper, T. A.; Stamm, S.: Alternative splicing determines the intracellular localization of the novel nuclear protein Nop30 and its interaction with the splicing factor SRp30c. J. Biol. Chem. 274:10951-10962, 1999.

Giguere, V.; Yang, N.; Segui, P.; Evans, R. M.: Identification of a new class of steroid hormone receptors. Nature 331:91-94, 1988.

Sladek, R.; Beatty, B.; Squire, J.; Copeland, N. G.; Gilbert, D. J.; Jenkins, N. A.; Giguere, V.: Chromosomal mapping of the human and murine orphan receptors ERR-alpha (ESRRA) and ERR-beta (ESRRB) and identification of a novel human ERR-alpha-related pseudogene. Genomics 45:320-326, 1997.

Bale, T. L.; Contarino, A.; Smith, G. W.; Chan, R.; Gold, L. H.; Sawchenko, P. E.; Koob, G. F.; Vale, W. W.; Lee, K.-F.: Mice deficient for corticotropin-releasing hormone receptor-2 display anxiety-like behaviour and are hypersensitive to stress. Nature Genet. 24:410-414,2000.

Coste, S. C.; Kesterson, R. A.; Heldwein, K. A.; Stevens, S. L.; Heard, A. D.; Hollis, J. H.; Murray, S. E.; Hill, J. K.; Pantely, G. A.; Hohimer, A. R.; Hatton, D. C.; Phillips, T. J.; Finn, D. A.; Low, M. J.; Rittenberg, M. B.; Stenzel, P.; Stenzel-Poore, M. P.:Abnormal adaptations to stress and impaired cardio vascular function in mice lacking corticotropin-releasing hormone receptor-2. Nature Genet. 24:403-409, 2000.

Hsu, S. Y.; Hsueh, A. J. W.: Human stresscopin and stresscopin-related peptide are selective ligands for the type 2 corticotropin-releasing hormone receptor. Nature Med. 7:605-611, 2001.

Kishimoto, T.; Radulovic, J.; Radulovic, M.; Lin, C. R.; Schrick, C.; Hooshmand, F.; Hermanson, O.; Rosenfeld, M. G.; Spiess, J.: Deletion of Crhr2 reveals an anxiolytic role for corticotropin-releasing hormonereceptor-2. Nature Genet. 24:415-419, 2000.

Kostich, W. A.; Chen, A.; Sperle, K.; Largent, B. L.: Molecular identification and analysis of a novel human corticotropin-releasing factor (CRF) receptor: the CRF2-gamma receptor. Molec. Endocr. 12:1077-1085, 1998.

Lesh, J. S.; Burrows, H. L.; Seasholtz, A. F.; Camper, S. A.:Mapping of the mouse corticotropin-releasing hormone receptor 2 gene (Crhr2) to chromosome 6. Mammalian Genome 8:944-945, 1997.

Liaw, C. W.; Lovenberg, T. W.; Barry, G.; Oltersdorf, T.; Grigoriadis, D. E.; De Souza, E. B.: Cloning and characterization of the human corticotropin-releasing factor-2 receptor complementary deoxyribonucleic acid. Endocrinology 137: 72-77, 1996.

Meyer, A. H.; Ullmer, C.; Schmuck, K.; Morel, C.; Wishart, W.; Lubbert, H.; Engels, P.: Localization of the human CRF2 receptor to 7p21-p15 by radiation hybrid mapping and FISH analysis. Genomics 40:189-190, 1997.

Dallery, E.; Galiegue-Zouitina, S.; Collyn-d'Hooghe, M.; Quief, S.; Denis, C.; Hildebrand, M.-P.; Lantoine, D.; Deweindt, C.; Tilly, H.; Bastard, C.; Kerckaert, J.-P.: TTF, a gene encoding a novel small G protein, fuses to the lymphoma-associated LAZ3 gene by t (3;4) chromosomal translocation. Oncogene 10:2171-2178, 1995.

Dallery-Prudhomme, E.; Roumier, C.; Denis, C.; Preudhomme, C.; Kerckaert, J.-P.; Galiegue-Zouitina, S.: Genomic structure and assignment of the RhoH/TTF small GTPase gene (ARHH) to 4p13 by in situ hybridization. Genomics 43:89-94, 1997.

Ensinger, C.; Obrist, P.; Mikuz, G.; Merkx, G.; Smeets, D.; Banziger, R.; Bachmann, F.; Burger, M.: Assignment of the p150 subunit of the eukaryotic initiation factor 3A gene (EIF3A) to human chromosome band 10q26 by in situ hybridisation. Cytogenet. Cell Genet. 83:74-75,1998.

Johnson, K. R.; Merrick, W. C.; Zoll, W. L.; Zhu, Y.: Identification of cDNA clones for the large subunit of eukaryotic translation initiation factor 3: comparison of homologues from human, Nicotiana tabacum, Caenorhabditis elegans, and Saccharomyces cerevisiae. J. Biol. Chem. 272:7106-7113, 1997.

Tsai, H.-M.: Physiologic cleavage of von Willebrand factor by a plasma protease is dependent on its conformation and requires calcium ion. Blood 87:4235-4244, 1996.

Tsai, H.-M.; Lian, E. C.-Y.: Antibodies to von Willebrand factor-cleaving protease in acute thrombotic thrombocytopenic purpura. New Eng. J. Med. 339:1585-1594, 1998.

Nagase, T.; Ishikawa, K.; Nakajima, D.; Ohira, M.; Seki, N.; Miyajima, N.; Tanaka, A.; Kotani, H.; Nomura, N.; Ohara, O.: Prediction of the coding sequences of unidentified human genes. VII. The complete sequences of 100 new cDNA clones from brain which can code for large proteins in vitro. DNA Res. 4:141-150, 1997.

Prueitt, R. L.; Ross, J. L.; Zinn, A. R.: Physical mapping of nine Xq translocation break points and identification of XPNPEP2 as a premature ovarian failure candidate gene. Cytogenet. Cell Genet. 89:44-50, 2000.

Sprinkle, T. J.; Stone, A. A.; Venema, R. C.; Denslow, N. D.; Caldwell, C.; Ryan, J. W.: Assignment of the membrane-bound human amino peptidaseP gene (XPNPEP2) to chromosome Xq25. Genomics 50:114-116, 1998.

Venema, R. C.; Ju, H.; Zou, R.; Venema, V. J.; Ryan, J. W.: Cloning and tissue distribution of human membrane-bound amino peptidase P. Biochim. Biophys. Acta 1354:45-48, 1997.

Whiting, P. J.; Bonnert, T. P.; McKernan, R. M.; Farrar, S.; leBourdelles, B.; Heavens, R. P.; Smith, D. W.; Hewson, L.; Rigby, M. R.; Sirinathsinghji, D. J. S.; Thompson, S. A.; Wafford, K. A.: Molecular and functional diversity of the expanding GABA-A receptor gene family. Ann. N. Y. Acad. Sci. 645-653, 1999.

Zhang, F.; Zhang, W.; Liu, L.; Fisher, C. L.; Hui, D.; Childs, S.; Dorovini-Zis, K.; Ling, V.: Characterization of ABCB9, an ATP binding cassette protein associated with lysosomes. J. Biol. Chem. 275:23287-23294, 2000.

Allikmets, R.; Gerrard, B.; Glavac, D.; Ravnik-Glavac, M.; Jenkins, N. A.; Gilbert, D. J.; Copeland, N. G.; Modi, W.; Dean, M.: Characterization and mapping of three new mammalian ATP-binding transporter genes from an EST database. Mammalian Genome 6:114-117, 1995.

Zhang, F.; Hogue, D. L.; Liu, L.; Fisher, C. L.; Hui, D.; Childs, S.; Ling, V.: M-ABC2, a new human mitochondrial ATP-binding cassette membrane protein. FEBS Lett. 478:89-94, 2000.

Lee, J.; Ho, W.-H.; Maruoka, M.; Corpuz, R. T.; Baldwin, D. T.; Foster, J. S.; Goddard, A. D.; Yansura, D. G.; Vandlen, R. L.; Wood, W. L.; Gurney, A. L.: IL-17E, a novel proinflammatory ligand for the IL-17 receptor homolog IL-17Rh1. J. Biol. Chem. 276:1660-1664,2001.

Ueki, N.; Oda, T.; Kondo, M.; Yano, K.; Noguchi, T.; Muramatsu, M.: Selection system for genes encoding nuclear-targeted proteins. Nat. Biotech. 16:1338-1342, 1998.

Ueki, N.; Seki, N.; Yano, K.; Masuho, Y.; Saito, T.; Muramatsu, M.: Isolation and characterization of a novel human gene (HFB30) which encodes a protein with a RING finger motif. Biochim. Biophys. Acta 232-236, 1999.

Oikawa, E.; Iijima, H.; Suzuki, T.; Sasano, H.; Sato, H.; Kamataki, A.; Nagura, H.; Kang, M. J.; Fujino, T.; Suzuki, H.; Yamamoto, T. T.: A novel acyl-CoA synthetase, ACS5, expressed in intestinal epithelial cells and proliferating preadipocytes. J. Biochem. 124:679-685,1998.

Yamashita, Y.; Kumabe, T.; Cho, Y.-Y.; Watanabe, M.; Kawagishi, J.; Yoshimoto, T.; Fujino, T.; Kang, M.-J.; Yamamoto, T. T. Fatty acid induced glioma cell growth is mediated by the acyl-CoA synthetase 5 gene located on chromosome 10q25.1-q25.2, a region frequently deleted in malignant gliomas. Oncogene 19:5919-5925, 2000.

Meng, X.; Lu, X.; Li, Z.; Green, E. D.; Massa, H.; Trask, B. J.; Morris, C. A.; Keating, M. T.: Complete physical map of the common deletion region in Williams syndrome and identification and characterization of three novel genes. Hum. Genet. 103:590-599, 1998.

Jones, M. H.; Hamana, N.; Nezu, J.; Shimane, M.: A novel family of bromodomain genes. Genomics 63:40-45, 2000.

Nakajima, H.; Cella, M.; Langen, H.; Friedlein, A.; Colonna, M.: Activating interactions in human NK cell recognition: the role of 2B4-CD48. Europ. J. Immun. 29:1676-1683, 1999.

Watzl, C.; Stebbins, C. C.; Long, E. O.: Cutting edge: NK cell inhibitory receptors prevent tyrosine phosphorylation of the activation receptor 2B4 (CD244). J. Immun. 165:3545-3548, 2000.

Mitchelmore, C.; Troelsen, J. T.; Sjostrom, H.; Noren, O.: TheHOXC11 homeodomain protein interacts with the lactose-phlorizin hydrolase promoter and stimulates HNF1-alpha-dependent transcription. J. Biol. Chem. 273:13297-13306, 1998.

Heidebrecht, H. J.; Buck, F.; Steinmann, J.; Sprenger, R.; Wacker, H. H.; Parwaresch, R.: p100: a novel proliferation-associated nuclear protein specifically restricted to cell cycle phases S, G2, and M. Blood 90:226-233, 1997.

Hu, X.; Ray, P. N.; Murphy, E. G.; Thompson, M. W.; Worton, R. G.: Duplicational mutation at the Duchenne muscular dystrophy locus:its frequency, distribution, origin, and phenotype-genotype correlation. Am. J. Hum. Genet. 46:682-695, 1990.

Hu, X.; Ray, P. N.; Worton, R. G.: Mechanisms of tandem duplication in the Duchenne muscular dystrophy gene include both homologous and nonhomologous intrachromosomal recombination. EMBO J. 10:2471-2477,1991.

Hu, X.; Worton, R. G.: Partial gene duplication as a cause of human disease. Hum. Mutat. 1:3-12, 1992.

Ingram, V. M.: Gene evolution and the haemoglobins. Nature 189:704-708, 1961.

Itagaki, Y.; Saida, K.; Iwamura, K.: Regenerative capacity of mdx mouse muscles after repeated applications of myonecrotic bupivacaine. ActaNeuropath. 89:380-384, 1995.

Kaplan, J.-C.; Kahn, A.; Chelly, J.: Illegitimate transcription:its use in the study of inherited disease. Hum. Mutat. 1:357-360,1992.

Kavaslar, G. N.; Telatar, M.; Serdaroglu, P.; Deymeer, F.; Ozdemir, C.; Tolun, A.: Identification of a one-base pair deletion in exon 6 of the dystrophin gene. Hum. Mutat. 6:85-86, 1995.

Kilimann, M. W.; Pizzuti, A.; Grompe, M.; Caskey, C. T.: Point mutations and polymorphisms in the human dystrophin gene identified in genomic DNA sequences amplified by multiplex PCR. Hum. Genet. 89:253-258, 1992.

Kim, T.-W.; Wu, K.; Black, I. B.: Deficiency of brain synaptic dystrophin in human Duchenne muscular dystrophy. Ann. Neurol. 38:446-449, 1995.

Kneppers, A. L. J.; Deutz-Terlouw, P. P.; van Ommen, G. J. B.; Bakker, E.: Point mutation screening for Duchenne muscular dystrophy (DMD) by SSCP-analysis of multiplex PCR products by use of the Phast System (TM). Am. J. Hum. Genet. Suppl. 53: Abstract-1493, 1993.

Ostendorff, H. P.; Bossenz, M.; Mincheva, A.; Copeland, N. G.; Gilbert, D. J.; Jenkins, N. A.; Lichter, P.; Bach, I.: Functional characterization of the gene encoding RLIM, the corepressor of LIM homeodomain factors. Genomics 69:120-130, 2000.

Ostendorff, H. P.; Peirano, R. I.; Peters, M. A.; Schluter, A.; Bossenz, M.; Scheffner, M.; Bach, I.: Ubiquitination-dependent cofactor exchange on LIM homeodomain transcription factors. Nature 416:99-103,2002.

Koenig, M.: Personal Communication. Boston, Mass. Oct. 8, 1987.100. Koenig, M.; Beggs, A. H.; Moyer, M.; Scherpf, S.; Heindrich, K.; Bettecken, T.; Meng, G.; Muller, C. R.; Lindlof, M.; Kaariainen, H.; de la Chapelle, A.; Kiuru, A.; and 24 others: The molecular basis for Duchenne versus Becker muscular dystrophy: correlation of severity with type of deletion. Am. J. Hum. Genet. 45:498-506,1989.101. Koenig, M.; Bertelson, C. J.; Monaco, A. P.; Hoffman, E.; Feener, C. C.; Kunkel, L. M.: Complete cloning of the Duchenne muscular dystrophycDNA and an analysis of the entire DMD locus. (Abstract) Am. J. Hum. Genet. 41: A222, 1987.102. Koenig, M.; Hoffman, E. P.; Bertelson, C. J.; Monaco, A. P.; Feener, C.; Kunkel, L. M.: Complete cloning of the Duchenne muscular dystrophy (DMD) cDNA and preliminary genomic organization of the DMD gene in normal and affected individuals. Cell 50:509-517, 1987.103. Koenig, M.; Monaco, A. P.; Kunkel, L. M.: The complete sequence of dystrophin predicts a rod-shaped cytoskeletal protein. Cell 53:219-228, 1988.104. Koh, J.; Bartlett, R. J.; Pericak-Vance, M. A.; Speer, M. C.; Yamaoka, L. H.; Phillips, K.; Hung, W.-Y.; Ray, P. N.; Worton, R. G.; Gilbert, J. R.; Lee, J. E.; Siddique, T.; Kandt, R. S.; Roses, A. D.: Inherited deletion at Duchenne dystrophy locus in normal male. (Letter) Lancet II:1154-1155, 1987.105. Kunkel, L. M.: Analysis of deletions in DNA from patients with Becker and Duchenne muscular dystrophy. Nature 322:73-77, 1986.106. Kunkel, L. M.; Monaco, A. P.; Middlesworth, W.; Ochs, H. D.; Latt, S. A.: Specific cloning of DNA fragments absent from the DNA of a male patient with an X chromosome deletion. Proc. Nat. Acad. Sci. 82:4778-4782, 1985.107. Laing, N. G.; Layton, M. G.; Johnsen, R. D.; Chandler, D. C.; Mears, M. E.; Goldblatt, J.; Kakulas, B. A.: Two distinct mutations in a single dystrophin gene: chance occurrence or premutation? Am. J. Med. Genet. 42:688-692, 1992.108. Lederfein, D.; Levy, Z.; Augier, N.; Mornet, D.; Morris, G.; Fuchs, O.; Yaffe, D.; Nudel, U.: A 71-kilodalton protein is a major product of the Duchenne muscular dystrophy gene in brain and other nonmuscle tissues. Proc. Nat. Acad. Sci. 89:5346-5350, 1992.109. Lederfein, D.; Yaffe, D.; Nudel, U.: A housekeeping type promoter, located in the 3-prime region of the Duchenne muscular dystrophy gene, controls the expression of Dp71, a major product of the gene. Hum. Molec. Genet. 2:1883-1888, 1993.110. Lee, C. C.; Pearlman, J. A.; Chamberlain, J. S.; Caskey, C. T.: Expression of recombinant dystrophin and its localization to the cell membrane. Nature 349:334-336, 1991.111. Lee, G.-H.; Badorff, C.; Knowlton, K. U.: Dissociation of sarcoglycans and the dystrophin carboxyl terminus from the sarcolemma in enteroviral cardiomyopathy. Circ. Res. 87:489-495, 2000.112. Lenk, U.; Hanke, R.; Kraft, U.; Grade, K.; Grunewald, I.; Speer, A.: Non-isotopic analysis of single strand conformation polymorphism (SSCP) in the exon 13 region of the human dystrophin gene. J. Med. Genet. 30:951-954, 1993.113. Lenk, U.; Hanke, R.; Speer, A.: Carrier detection in DMD families with point mutations, using PCR-SSCP and direct sequencing. Neuromusc. Disord. 4:411-418, 1994.114. Lenk, U.; Hanke, R.; Thiele, H.; Speer, A.: Point mutations at the carboxy terminus of the human dystrophin gene: implications for an association with mental retardation in DMD patients. Hum. Molec. Genet. 2:1877-1881, 1993.115. Lenk, U.; Oexle, K.; Voit, T.; Ancker, U.; Hellner, K.-A.; Speer, A.; Hubner, C.: A cysteine 3340 substitution in the dystroglycan-binding domain of dystrophin associated with Duchenne muscular dystrophy mental retardation and absence of the ERG b-wave. Hum. Molec. Genet. 973-975, 1996.116. Liechti-Gallati, S.; Braga, S.; Hirsiger, H.; Moser, H.: Familial deletion in Becker type muscular dystrophy within the pXJ region. Hum. Genet. 77:267-268, 1987.117. Lindlof, M.; Kaariainen, H.; van Ommen, G. J. B.; de la Chapelle, A.: Microdeletions in patients with X-linked muscular dystrophy:molecular-clinical correlations. Clin. Genet. 33:131-139, 1988.118. Lindlof, M.; Kiuru, A.; Kaariainen, H.; Kalimo, H.; Lang, H.; Pihko, H.; Rapola, J.; Somer, H.; Somer, M.; Savontaus, M.-L.; dela Chapelle, A.: Gene deletions in X-linked muscular dystrophy. Am. J. Hum. Genet. 44:496-503, 1989.119. Mankin, A. S.; Liebman, S. W.: Baby, don't stop! Nature Genet. 23:8-10, 1999.120. Mao, Y.; Cremer, M.: Detection of Duchenne muscular dystrophy carriers by dosage analysis using the DMD cDNA clone 8. Hum. Genet. 81:193-195, 1989.121. Matsuo, M.; Masumura, T.; Nakajima, T.; Kitoh, Y.; Takumi, T.; Nishio, H.; Koga, J.; Nakamura, H.: A very small frame-shifting deletion within exon 19 of the Duchenne muscular dystrophy gene. Biochem. Biophys. Res. Commun. 170:963-967, 1990.122. Matsuo, M.; Masumura, T.; Nishio, H.; Nakajima, T.; Kitoh, Y.; Takumi, T.; Koga, J.; Nakamura, H.: Exon skipping during splicing of dystrophin mRNA precursor due to an intraexon deletion in the dystrophin gene of Duchenne muscular dystrophy. J. Clin. Invest. 87:2127-2131,1991.123. McArdle, A.; Edwards, R. H. T.; Jackson, M. J.: Time courseof changes in plasma membrane permeability in the dystrophin-deficient-mdx mouse. Muscle Nerve 17:1378-1384, 1994.124. McCabe, E. R. B.; Towbin, J.; Chamberlain, J.; Baumbach, L.; Witkowski, J.; van Ommen, G. J. B.; Koenig, M.; Kunkel, L. M.; Seltzer, W. K.: Complementary DNA probes for the Duchenne muscular dystrophylocus demonstrate a previously undetectable deletion in a patient with dystrophic myopathy, glycerol kinase deficiency, and congenital adrenal hypoplasia. J. Clin. Invest. 83:95-99, 1989.125. Milasin, J.; Muntoni, F.; Severini, G. M.; Bartoloni, L.; Vatta, M.; Krajinovic, M.; Mateddu, A.; Angelini, C.; Camerini, F.; Falaschi, A.; Mestroni, L.; Giacca, M.; Heart Muscle Disease Study Group:A point mutation in the 5-prime splice site of the dystrophin gene first intron responsible for X-linked dilated cardiomyopathy. Hum. Molec. Genet. 5:73-79, 1996.126. Minetti, C.; Bonilla, E.: Mosaic expression of dystrophin incarriers of Becker's muscular dystrophy and the X-linked syndrome of myalgia and cramps. (Letter) New Eng. J. Med. 327:1100, 1992.127. Moizard, M.-P.; Toutain, A.; Fournier, D.; Berret, F.; Raynaud, M.; Billard, C.; Andres, C.; Moraine, C.: Severe cognitive impairment in DMD: obvious clinical indication for Dp71 isoform point mutation screening. Europ. J. Hum. Genet. 8:552-556, 2000.128. Monaco, A. P.; Bertelson, C. J.; Liechti-Gallati, S.; Moser, H.; Kunkel, L. M.: An explanation for phenotypic differences between patients bearing partial deletions of DMD locus. Genomics 2:90-95, 1988.129. Monaco, A. P.; Kunkel, L. M.: A giant locus for the Duchenne and Becker muscular dystrophy gene. Trends Genet. 3:33-37, 1987.130. Monaco, A. P.; Neve, R. L.; Colletti-Feener, C.; Bertelson, C. J.; Kurnit, D. M.; Kunkel, L. M.: Isolation of candidate cDNAs forportions of the Duchenne muscular dystrophy gene. Nature 323:646-650, 1986.131. Muntoni, F.; Cau, M.; Ganau, A.; Congiu, R.; Arvedi, G.; Mateddu, A.; Marrosu, M. G.; Cianchetti, C.; Realdi, G.; Cao, A.; Melis, M. A.: Deletion of the dystrophin muscle-promoter region associated with X-linked dilated cardiomyopathy. New Eng. J. Med. 329:921-925,1993.132. Muntoni, F.; Melis, M. A.; Ganau, A.; Dubowitz, V.: Transcription of the dystrophin gene in normal tissues and in skeletal muscle of a family with X-linked dilated cardiomyopathy. Am. J. Hum. Genet. 56:151-157, 1995.133. Muntoni, F.; Wilson, L.; Marrosu, G.; Marrosu, M. G.; Cianchetti, C.; Mestroni, L.; Ganau, A.; Dubowitz, V.; Sewry, C.: A mutation in the dystrophin gene selectively affecting dystrophin expression in the heart. J. Clin. Invest. 96:693-699, 1995.134. Nevin, N. C.; Hughes, A. E.; Calwell, M.; Lim, J. H. K.: Duchenne muscular dystrophy in a female with a translocation involving Xp21. J. Med. Genet. 23:171-187, 1986.135. Nigro, V.; Politano, L.; Nigro, G.; Romano, S. C.; Molinari, A. M.; Puca, G. A.: Detection of a nonsense mutation in the dystrophin gene by multiple SSCP. Hum. Molec. Genet. 1:517-520, 1992.136. Nobile, C.; Marchi, J.; Nigro, V.; Roberts, R. G.; Danieli, G. A.: Exon-intron organization of the human dystrophin gene. Genomics 45:421-424, 1997.137. Nobile, C.; Toffolatti, L.; Rizzi, F.; Simionati, B.; Nigro, V.; Cardazzo, B.; Patarnello, T.; Valle, G.; Danieli, G. A.: analysis of 22 deletion break points in dystrophin intron 49. Hum. Genet. 110:418-421, 2002.138. Norman, A.; Harper, P.: A survey of manifesting carriers of Duchenne and Becker muscular dystrophy in Wales. Clin. Genet. 36:31-37, 1989.139. Ohno, S.: Evolution by Gene Duplication. Berlin: Springer-Verlag (pub.) 1970.140. Ortiz-Lopez, R.; Li, H.; Su, J.; Goytia, V.; Towbin, J. A.:Evidence for a dystrophin missense mutation as a cause of X-linkeddilated cardiomyopathy. Circulation 95:2434-2440, 1997.141. Palmucci, L.; Doriguzzi, C.; Mongini, T.; Restagno, G.; Chiado-Piat, L.; Maniscalco, M.: Unusual expression and very mild course of Xp21muscular dystrophy (Becker type) in a 60-year-old man with 26 percent deletion of the dystrophin gene. Neurology 44:541-543, 1994.142. Passos-Bueno, M. R.; Bakker, E.; Kneppers, A. L. J.; Takata, R. I.; Rapaport, D.; den Dunnen, J. T.; Zatz, M.; van Ommen, G. J. B.: Different mosaicism frequencies for proximal and distal Duchenne muscular dystrophy (DMD) mutations indicate difference in etiology and recurrence risk. Am. J. Hum. Genet. 51:1150-1155, 1992.143. Paulson, K. E.; Deka, N.; Schmid, C. W.; Misra, R.; Schindler, C. W.; Rush, M. G.; Kadyk, L.; Leinwand, L.: A transposon-like element in human DNA. Nature 316:359-361, 1985.144. Pernelle, J.-J.; Chafey, P.; Chelly, J.; Wahrmann, J. P.; Kaplan, J.-C.; Tome, F.; Fardeau, M.: Nebulin seen in DMD males including one patient with a large DNA deletion encompassing the DMD gene. Hum. Genet. 78:285, 1988.145. Pillers, D.-A. M.; Fitzgerald, K. M.; Duncan, N. M.; Rash, S. M.; White, R. A.; Dwinnell, S. J.; Powell, B. R.; Schnur, R. E.; Ray, P. N.; Cibis, G. W.; Weleber, R. G.: Duchenne/Becker muscular dystrophy:correlation of phenotype by electroretinography with sites of dystrophin mutations. Hum. Genet. 105:2-9, 1999.146. Pizzuti, A.; Pieretti, M.; Fenwick, R. G.; Gibbs, R. A.; Caskey, C. T.: A transposon-like element in the deletion-prone region of the dystrophin gene. Genomics 13:594-600, 1992.147. Porter, J. D.; Khanna, S.; Kaminski, H. J.; Rao, J. S.; Merriam, A. P.; Richmonds, C. R.; Leahy, P.; Li, J.; Guo, W.; Andrade, F. H.: A chronic inflammatory response dominates the skeletal muscle molecular signature in dystrophin-deficient mdx mice. Hum. Molec. Genet. 11:263-272, 2002.148. Prior, T. W.; Papp, A. C.; Snyder, P. J.; Burghes, A. H. M.; Bartolo, C.; Sedra, M. S.; Western, L. M.; Mendell, J. R.: A missense mutation in the dystrophin gene in a Duchenne muscular dystrophy patient. Nature Genet. 4:357-360, 1993.149. Prior, T. W.; Papp, A. C.; Snyder, P. J.; Burghes, A. H. M.; Sedra, M. S.; Western, L. M.; Bartello, C.; Mendell, J. R.: Identification of two point mutations and a one base deletion in exon 19 of the dystrophin gene by heteroduplex formation. Hum. Molec. Genet. 2:311-313, 1993.150. Prior, T. W.; Papp, A. C.; Snyder, P. J.; Burghes, A. H. M.; Sedra, M. S.; Western, L. M.; Bartolo, C.; Mendell, J. R.: Exon 44 nonsense mutation in two-Duchenne muscular dystrophy brothers detected by heteroduplex analysis. Hum. Mutat. 2:192-195, 1993.151. Prior, T. W.; Papp, A. C.; Snyder, P. J.; Sedra, M. S.; Western, L. M.;

Bartolo, C.; Moxley, R. T.; Mendell, J. R.: Heteroduplex analysis of the dystrophin gene: application to point mutation and carrier detection. Am. J. Med. Genet. 50:68-73, 1994.152. Rafael, J. A.; Sunada, Y.; Cole, N. M.; Campbell, K. P.; Faulkner, J. A.; Chamberlain, J. S.: Prevention of dystrophic pathology in mdx mice by a truncated dystrophin isoform. Hum. Molec. Genet. 3:1725-1733, 1994.153. Rafael, J. A.; Townsend, E. R.; Squire, S. E.; Potter, A. C.; Chamberlain, J. S.; Davies, K. E.: Dystrophin and utrophin influence fiber type composition and post-synaptic membrane structure. Hum. Molec. Genet. 9:1357-1367, 2000.154. Ray, P. N.; Belfall, B.; Duff, C.; Logan, C.; Kean, V.; Thompson, M. W.; Sylvester, J. E.; Gorski, J. L.; Schmickel, R. D.; Worton, R. G.: Cloning of the breakpoint of an X;21 translocation associated with Duchenne muscular dystrophy. Nature 318:672-675, 1985.155. Read, A. P.; Mountford, R. C.; Forrest, S. M.; Kenwrick, S. J.; Davies, K. E.; Harris, R.: Patterns of exon deletions in Duchenne and Becker muscular dystrophy. Hum. Genet. 80:152-156, 1988.156. Rininsland, F.; Hahn, A.; Niemann-Seyde, S.; Slomski, R.; Hanefeld, F.; Reiss, J.: Identification of a new DMD gene deletion by ectopic transcript analysis. J. Med. Genet. 29:647-651, 1992.157. Roberts, R. G.; Bentley, D. R.; Bobrow, M.: Infidelity in the structure of ectopic transcripts: a novel exon in lymphocyte dystrophin transcripts. Hum. Mutat. 2:293-299, 1993.158. Roberts, R. G.; Bobrow, M.; Bentley, D. R.: The spectrum of mild X-linked recessive muscular dystrophy. Arch. Neurol. 34:408-416,1992.159. Roberts, R. G.; Bobrow, M.; Bentley, D. R.: Point mutations in the dystrophin gene. Proc. Nat. Acad. Sci. 89:2331-2335, 1992.160. Roberts, R. G.; Gardner, R. J.; Bobrow, M.: Searching for the1 in 2,400,000: a review of dystrophin gene point mutations. Hum. Mutat. 4:1-11, 1994.161. Roberts, R. G.; Passos-Bueno, M. R.; Bobrow, M.; Vainzof, M.; Zatz, M.: Point mutation in a Becker muscular dystrophy patient. Hum. Molec. Genet. 2:75-77, 1992.162. Rowland, L. P.: Biochemistry of muscle membranes in Duchennemuscular dystrophy. Muscle Nerve 3:3-20, 1980.163. Ryder-Cook, A. S.; Sicinski, P.; Thomas, K.; Davies, K. E.; Worton, R. G.; Barnard, E. A.; Darlison, M. G.; Barnard, P. J.: Localizationof the mdx mutation within the mouse dystrophin gene. EMBO J. 7:3017-3021, 1988.164. Saad, F. A.; Vita, G.; Mora, M.; Morandi. L.; Vitiello, L.; Oliviero, S.; Danieli, G. A.: A novel nonsense mutation in the human dystrophingene. Hum. Mutat. 2:314-316, 1993.165. Saad, F. A.; Vita, G.; Toffolatti, L.; Danieli, G. A.: A possible missense mutation detected in the dystrophin gene by double strand conformation analysis (DSCA). Neuromusc. Disord. 4:335-341, 1994.166. Sakamoto, M.; Yuasa, K.; Yoshimura, M.; Yokota, T.; Ikemoto, T.; Suzuki, M.; Dickson, G.; Miyagoe-Suzuki, Y.; Takeda, S.: Micro-dystrophincDNA ameliorates dystrophic phenotypes when introduced into mdx mice as a transgene. Biochem. Biophys. Res. Commun. 293:1265-1272, 2002.167. Sarig, R.; Mezger-Lallemand, V.; Gitelman, I.; Davis, C.; Fuchs, O.; Yaffe, D.; Nudel, U.: Targeted inactivation of Dp71, the major non-muscle product of the DMD gene: differential activity of the Dp71 promoter during development. Hum. Molec. Genet. 8:1-10, 1999.168. Sarkar, G.; Sommer, S. S.: Access to a messenger RNA sequence or its protein product is not limited by tissue or species specificity. Science 244:331-334, 1989.169. Schwartz, L. S.; Tarleton, J.; Popovich, B.; Seltzer, W. K.; Hoffman, E. P.: Fluorescent multiplex linkage analysis and carrier detection for Duchenne/Becker muscular dystrophy. Am. J. Hum. Genet. 51:721-729, 1992.170. Scott, M. O.; Sylvester, J. E.; Heiman-Patterson, T.; Shi, Y.-J.; Fieles, W.; Stedman, H.; Burghes, A.; Ray, P.; Worton, R.; Fischbeck, K. H.: Duchenne muscular dystrophy gene expression in normal and diseased human muscle. Science 239:1418-1420, 1988.171. Sharp, N. J. H.; Kornegay, J. N.; Van Camp, S. D.; Herbstreith, M. H.; Secore, S. L.; Kettle, S.; Hung, W.-Y.; Constantinou, C. D.; Dykstra, M. J.; Roses, A. D.; Bartlett, R. J.: An error in dystrophin mRNA processing in golden retriever muscular dystrophy, an animal homologue of Duchenne muscular dystrophy. Genomics 13:115-121,1992.172. Shiga, N.; Takeshima, Y.; Sakamoto, H.; Inoue, K.; Yokota, Y.; Yokoyama, M.; Matsuo, M.: Disruption of the splicing enhancer sequence within exon 27 of the dystrophin gene by a nonsense mutation induces partial skipping of the exon and is responsible for Becker muscular dystrophy. J. Clin. Invest. 100:2204-2210, 1997.173. Sicinski, P.; Geng, Y.; Ryder-Cook, A. S.; Barnard, E. A.; Darlison, M. G.; Barnard, P. J.: The molecular basis of muscular dystrophy in the mdx mouse: a point mutation. Science 244:1578-1580, 1989.174. Smithies, O.; Connell, G. E.; Dixon, G. H.: Chromosomal rearrangements and the evolution of haptoglobin genes. Nature 196:232-236, 1962.175. Southern, E. M.: Detection of specific sequences among DNA fragments separated by gel electrophoresis. J. Molec. Biol. 98:503-517, 1975.176. Stratford-Perricaudet, L. D.; Makeh, I.; Perricaudet, M.; Briand, P.: Widespread long-term gene transfer to mouse skeletal muscles and heart. J. Clin. Invest. 90:626-630, 1992.177. Takeshima, Y.; Nishio, H.; Narita, N.; Wada, H.; Ishikawa, Y.; Ishikawa, Y.; Minami, R.; Nakamura, H.; Matsuo, M.: Amino-terminal deletion of 53% of dystrophin results in an intermediate Duchenne-Becker-muscular dystrophy phenotype. Neurology 44:1648-1651, 1994.178. Tennyson, C. N.; Klamut, H. J.; Worton, R. G.: The human dystrophin gene requires 16 hours to be transcribed and is cotranscriptionally spliced. Nature Genet. 9:184-190, 1995.179. Tinsley, J. M.; Blake, D. J.; Davies, K. E.: Apo-dystrophin-3:a 2.2 kb transcript from the DMD locus encoding the dystrophin glycoprotein binding site. Hum. Molec. Genet. 2:521-524, 1993.180. Tinsley, J. M.; Potter, A. C.; Phelps, S. R.; Fisher, R.; Trickett, J. I.; Davies, K. E.: Amelioration of the dystrophic phenotype of mdx mice using a truncated utrophin transgene. Nature 384:349-353,1996.181. Todorova, A.; Danieli, G. A.: Large majority of single-nucleotide mutations along the dystrophin gene can be explained by more thanone mechanism of mutagenesis. Hum. Mutat. 9:537-547, 1997.182. Torelli, S.; Muntoni, F.: Alternative splicing of dystrophin exon 4 in normal human muscle. Hum. Genet. 97:521-523, 1996.183. Towbin, J. A.; Hejtmancik, J. F.; Brink, P.; Gelb, B.; Zhu, X. M.; Chamberlain, J. S.; McCabe, E. R. B.; Swift, M.: X-linked dilated cardiomyopathy: molecular genetic evidence of linkage to the Duchenne-muscular dystrophy (dystrophin) gene at the Xp21 locus. Circulation 87:1854-1865, 1993.184. Towbin, J. A.; Ortiz-Lopez, R.: X-linked dilated cardiomyopathy. (Letter) New Eng. J. Med. 330:369-370, 1994.185. Towbin, J. A.; Zhu, X. M.; Gelb, B.; Bies, R.; Chamberlain, J.; Maichele, A.; Ohlendieck, K.; Campbell, K.; McCabe, E. R. B.; Swift, M.: X-linked dilated cardiomyopathy (XLCM): molecular characterization. (Abstract) Am. J. Hum. Genet. 49 (suppl.):421, 1991.186. Tuffery, S.; Lenk, U.; Roberts, R. G.; Coubes, C.; Demaille, J.; Claustres, M.: Protein truncation test: analysis of two novel point mutations at the carboxy-terminus of the human dystrophin gene associated with mental retardation. Hum. Mutat. 6:126-135, 1995.187. Valentine, B. A.; Winand, N. J.; Pradhan, D.; Moise, N. S.; deLahunta, A.; Kornegay, J. N.; Cooper, B. J.: Canine X-linked muscular dystrophy as an animal model of Duchenne muscular dystrophy: a review. Am. J. Med. Genet. 42:352-356, 1992.188. Verellen-Dumoulin, C.; Freund, M.; De Meyer, R.; Laterre, C.; Frederic, J.; Thompson, M. W.; Markovic, V. D.; Worton, R. G.: Expressionof an X-linked muscular dystrophy in a female due to translocation involving Xp21 and non-random inactivation of the normal X chromosome. Hum. Genet. 67:115-119, 1984.189. Wehling, M.; Spencer, M. J.; Tidball, J. G.: A nitric oxide synthase transgene ameliorates muscular dystrophy in mdx mice. J. Cell Biol. 155:123-131, 2001.190. Werner, W.; Spiegler, A. W. J.: Inherited deletion of sub band Xp21.13 in a male with Duchenne muscular dystrophy. J. Med. Genet. 25:377-382, 1988.191. Wilton, S. D.; Chandler, D. C.; Kakulas, B. A.; Laing, N. G.: Identification of a point mutation and germinal mosaicism in a Duchenne muscular dystrophy family. Hum. Mutat. 3:133-140, 1994.192. Wilton, S. D.; Johnsen, R. D.; Pedretti, J. R.; Laing, N. G.: Two distinct mutations in a single dystrophin gene: identification of an altered splice-site as the primary Becker muscular dystrophymutation. Am. J. Med. Genet. 46:563-569, 1993.193. Winnard, A. V.; Jia-Hsu, Y.; Gibbs, R. A.; Mendell, J. R.; Burghes, A. H. M.: Identification of a 2 base pair nonsense mutation causing a cryptic splice site in a DMD patient. Hum. Molec. Genet. 1:645-646,1992.194. Wood, D. S.; Zeviani, M.; Prelle, A.; Bonilla, E.; Salviati, G.; Miranda, A. F.; DiMauro, S.; Rowland, L. P.: Is nebulin the defective gene product in Duchenne muscular dystrophy? (Letter) New Eng. J. Med. 316:107-108, 1987.195. Worton, R. G.: Dystrophin: the long and short of it. (Editorial) J. Clin. Invest. 93:4, 1994.196. Worton, R. G.: Personal Communication. Toronto, Ontario, Canada Sep. 12, 1987.197. Xiong, D.; Lee, G.-H.; Badorff, C.; Dorner, A.; Lee, S.; Wolf, P.; Knowlton, K. U.: Dystrophin deficiency markedly increases enterovirus-induced cardiomyopathy: a genetic predisposition to viral heart disease. NatureMed. 8:872-877, 2002.198. Yang, T. P.; Patel, P. I.; Chinault, A. C.; Stout, J. T.; Jackson, L. G.; Hildebrand, B. M.; Caskey, C. T.: Molecular evidence for new mutation at the HPRT locus in Lesch-Nyhan patients. Nature 310:412-414, 1984.199. Yoshida, K.; Ikeda, S.; Nakamura, A.; Kagoshima, M.; Takeda, S.; Shoji, S.; Yanagisawa, N.: Molecular analysis of the Duchenne muscular dystrophy gene in patients with Becker muscular dystrophy presenting with dilated cardiomyopathy. Muscle Nerve 16:1161-1166, 1993.200. Yoshida, K.; Nakamura, A.; Yazaki, M.; Ikeda, S.; Takeda, S.: Insertional mutation by transposable element, L1, in the DMD gene results in X-linked dilated cardiomyopathy. Hum. Molec. Genet. 7:1129-1132, 1998.201. Zubrzycka-Gaarn, E. E.; Bulman, D. E.; Karpati, G.; Burghes, A. H. M.; Belfall, B.; Klamut, H. J.; Talbot, J.; Hodges, R. S.; Ray, P. N.; Worton, R. G.: The Duchenne muscular dystrophy gene productis localized in sarcolemma of human skeletal muscle. Nature 333:466-469, 1988.

Crackower, M. A.; Sinasac, D. S.; Lee, J. R.; Herbrick, J.-A.; Tsui, L.-C.; Scherer, S. W.: Assignment of the SLC25A12 gene coding for the human calcium-binding mitochondrial solute carrier proteinaralar to human chromosome 2q24. Cytogenet. Cell Genet. 87:197-198,1999.

del Arco, A.; Satrustegui, J.: Molecular cloning of aralar, anew member of the mitochondrial carrier superfamily that binds calcium and is present in human muscle and brain. J. Biol. Chem. 273:23327-23334,1998.

Sanz, R.; del Arco, A.; Ayuso, C.; Ramos, C.; Satrustegui, J.:Assignment of the calcium-binding mitochondrial carrier Aralar 1 gene (SLC25A12) to human chromosome band 2q31 by in situ hybridization. Cytogenet. Cell Genet. 89:143-144, 2000.

Tanner, S.; Stagljar, I.; Georgiev, O.; Schaffner, W.; Bourquin, J.-P.: A novel SR-related protein specifically interacts with the carboxy-terminal domain (CTD) of RNA polymerase II through a conserved interaction domain. Biol. Chem. 378:565-571, 1997.

Zhang, W.-J.; Wu, J. Y.: Sip1, a novel RS domain-containing protein essential for pre-mRNA splicing. Molec. Cell. Biol. 18:676-684,1998.

Fukuta, M.; Inazawa, J.; Torii, T.; Tsuzuki, K.; Shimada, E.; Habuchi, O.: Molecular cloning and characterization of human keratan sulfategal-6-sulfotransferase. J. Biol. Chem. 272:32321-32328, 1997.

Iida, A.; Saito, S.; Sekine, A.; Mishima, C.; Kitamura, Y.; Kondo, K.; Harigae, S.; Osawa, S.; Nakamura, Y.: Catalog of 77 single-nucleotide polymorphisms (SNPs) in the carbohydrate sulfotransferase 1 (CHST1) and carbohydrate sulfotransferase 3 (CHST3) genes. J. Hum. Genet. 47:14-19, 2002.

Mazany, K. D.; Peng, T.; Watson, C. E.; Tabas, I.; Williams, K. J.: Human chondroitin 6-sulfotransferase: cloning, gene structure, and chromosomal localization. Biochim. Biophys. Acta 1407:92-97,1998.

Li, X.; Tedder, T. F.: CHST1 and CHST2 sulfotransferases expressed by human vascular endothelial cells: cDNA cloning, expression, and chromosomal localization. Genomics 55:345-347, 1999.

Uchimura, K.; Muramatsu, H.; Kadomatsu, K.; Fan, Q.-W.; Kurosawa, N.; Mitsuoka, C.; Kannagi, R.; Habuchi, O.; Muramatsu, T.: Molecular cloning and characterization of an N-acetylglucosamine-6-O-sulfotransferase. J. Biol. Chem. 273:22577-22583, 1998.

Uchimura, K.; Muramatsu, H.; Kaname, T.; Ogawa, H.; Yamakawa, T.; Fan, Q.-W.; Mitsuoka, C.; Kannagi, R.; Habuchi, O.; Yokoyama, I.; Yamamura, K.; Ozaki, T.; Nakagawara, A.; Kadomatsu, K.; Muramatsu, T.: Human N-acetylglucosamine-6-O-sulfotransferase involved in the biosynthesis of 6-sulfo sialyl Lewis X: molecular cloning, chromosomal-mapping, and expression in various organs and tumor cells. J. Biochem. 124:670-678, 1998.

Ayres, J. A.; Shum, L.; Akarsu, A. N.; Dashner, R.; Takahashi, K.; Ikura, T.; Slavkin, H. C.; Nuckolls, G. H.: DACH: genomic characterization, evaluation as a candidate for post-axial polydactyly type A2, and developmental expression pattern of the mouse homologue. Genomics 77:18-26, 2001.

Davis, R. J.; Shen, W.; Sandler, Y. I.; Amoui, M.; Purcell, P.; Maas, R.; Ou, C.-N.; Vogel, H.; Beaudet, A. L.; Mardon, G.: Dach1 mutant mice bear no gross abnormalities in eye, limb, and brain development and exhibit postnatal lethality. Molec. Cell. Biol. 21:1484-1490,2001.

Hammond, K. L.; Hanson, I. M.; Brown, A. G.; Lettice, L. A.; Hill, R. E.: Mammalian and Drosophila dachshund genes are related to the Ski proto-oncogene and are expressed in eye and limb. Mech. Dev. 74:121-131, 1998.

Hammond, K. L.; Lettice, L. A.; Hill, R. E.; Lee, M.; Boyle, S.; Hanson, I. M.: Human (DACH) and mouse (Dach) homologues of Drosophiladachshund map to chromosomes 13q22 and 14E3, respectively. Genomics 55:252-253, 1999.

Li, X.; Perissi, V.; Liu, F.; Rose, D. W.; Rosenfeld, M. G.: Tissue-specific regulation of retinal and pituitary precursor cell proliferation. Science 297:1180-1183, 2002.

Kuramochi, S.; Matsuda, Y.; Okamoto, M.; Kitamura, F.; Yonekawa, H.; Karasuyama, H.: Molecular cloning of the human gene STK10 encoding lymphocyte-oriented kinase, and comparative chromosomal mapping of the human, mouse, and rat homologues. Immunogenetics 49:369-375, 1999.

Kuramochi, S.; Moriguchi, T.; Kuida, K.; Endo, J.; Semba, K.; Nishida, E.; Karasuyama, H.: LOK is a novel mouse STE20-like protein kinase that is expressed predominantly in lymphocytes. J. Biol. Chem. 272:22679-22684, 1997.

Berg, L.-P.; Shamsher, M. K.; El-Daher, S. S.; Kakkar, V. V.; Authi, K. S.: Expression of human TRPC genes in the megakaryocytic cell lines MEG01, DAMI and HEL. FEBS Lett. 403:83-86, 1997.

Wes, P. D.; Chevesich, J.; Jeromin, A.; Rosenberg, C.; Stetten, G.; Montell, C.: TRPC1, a human homolog of a Drosophila store-operated channel. Proc. Nat. Acad. Sci. 92:9652-9656, 1995.

Xu, X.-Z. S.; Li, H.-S.; Guggino, W. B.; Montell, C.: Coassembly of TRP and TRPL produces a distinct store-operated conductance. Cell 89:1155-1164, 1997.

Zhu, X.; Chu, P. B.; Peyton, M.; Birnbaumer, L.: Molecular cloning of a widely expressed human homologue for the Drosophila trp gene. FEBSLett. 373:193-198, 1995.

Zhu, X.; Jiang, M.; Peyton, M.; Boulay, G.; Hurst, R.; Stefani, E.; Birnbaumer, L.: trp, a novel mammalian gene family essential for agonist-activated capacitative Ca (2+) entry. Cell 85:661-671,1996.

Zitt, C.; Zobel, A.; Obukhov, A. G.; Harteneck, C.; Kalkbrenner, F.; Luckhoff, A.; Schultz, G.: Cloning and functional expression of a human Ca (2+)-permeable cation channel activated by calcium store depletion. Neuron 16:1189-1196, 1996.

Martinez de Arrieta, C.; Morte, B.; Coloma, A.; Bernal, J.: The human RC3 gene homolog, NRGN contains a thyroid hormone-responsive element located in the first intron. Endocrinology 140:335-343,1999.

Martinez de Arrieta, C.; Perez Jurado, L.; Bernal, J.; Coloma, A.: Structure, organization, and chromosomal mapping of the human neurogranin gene (NRGN). Genomics 41:243-249, 1997.

Gantz, I.; Konda, Y.; Yang, Y.-K.; Miller, D. E.; Dierick, H. A.; Yamada, T.: Molecular cloning of a novel receptor (CMKLR1) with homology to the chemotactic factor receptors. Cytogenet. Cell Genet. 74:286-290, 1996.

Methner, A.; Hermey, G.; Schinke, B.; Hermans-Borgmeyer, I.: A novel G protein-coupled receptor with homology to neuropeptide and chemoattractant receptors expressed during bone development. Biochem. Biophys. Res. Commun. 233:336-342, 1997.

Baudier, J.; Deloulme, J. C.; Van Dorsselaer, A.; Black, D.; Matthes, H. W. D.: Purification and characterization of a brain-specific protein kinase C substrate, neurogranin (p17): identification of a consensus amino acid sequence between neurogranin and neuromodulin (GAP43) that corresponds to the protein kinase C phosphorylation site and the calmodulin-binding domain. J. Biol. Chem. 266:229-237, 1991.

Owman, C.; Lolait, S. J.; Santen, S.; Olde, B.: Molecular cloning and tissue distribution of cDNA encoding a novel chemo attractant-like receptor. Biochem. Biophys. Res. Commun. 241:390-394, 1997.

Blanco, G.; Irving, N. G.; Brown, S. D. M.; Miller, C. C. J.; McLoughlin, D. M.: Mapping of the human and murine X11-like genes (APBA2 and Apba2), the murine Fe65 gene (Apbb1), and the human Fe65-like gene (APBB2): genes encoding phosphotyrosine-binding domain proteins that interact with the Alzheimer's disease amyloid precursor protein. Mammalian Genome 9:473-475, 1998.

Butz, S.; Okamoto, M.; Sudhof, T. C.: A tripartite protein complex with the potential to couple synaptic vesicle exocytosis to cell adhesion in brain. Cell 94:773-782, 1998.

Chen, W.-J.; Goldstein, J. L.; Brown, M. S.: NPXY, a sequence often found in cytoplasmic tails, is required for coated pit-mediated internalization of the low density lipoprotein receptor. J. Biol. Chem. 265:3116-3123, 1990.

Duclos, F.; Boschert, U.; Sirugo, G.; Mandel, J.-L.; Hen, R.; Koenig, M.: Gene in the region of the Friedreich ataxia locus encodes a putative transmembrane protein expressed in the nervous system. Proc. Nat. Acad. Sci. 90:109-113, 1993.

Duclos, F.; Koenig, M.: Comparison of primary structure of a neuron-specific protein, X11, between human and mouse. Mammalian Genome 6:57-58,1995.

Okamoto, M.; Sudhof, T. C.: Mints, Munc18-interacting proteins in synaptic vesicle exocytosis. J. Biol. Chem. 272:31459-31464,1997.

van der Geer, P.; Pawson, T.: The PTB domain: a new protein module implicated in signal transduction. Trends Biochem. Sci. 20:277-280,1995.

Loh, N. Y.; Ambrose, H. J.; Guay-Woodford, L. M.; DasGupta, S.; Nawrotzki, R. A.; Blake, D. J.; Davies, K. E.: Genomic organization and refined mapping of the mouse beta-dystrobrevin gene. Mammalian Genome 9:857-862, 1998.

Rodius, F.; Duclos, F.; Wrogemann, K.; Le Paslier, D.; Ougen, P.; Billault, A.; Belal, S.; Musenger, C.; Brice, A.; Durr, A.; Mignard, C.; Sirugo, G.; Weissenbach, J.; Cohen, D.; Hentati, F.; Ben Hamida, M.; Mandel, J.-L.; Koenig, M.: Recombinations in individuals homozygous by descent localize the Friedreich ataxia locus in a cloned 450-kb interval. Am. J. Hum. Genet. 54:1050-1059, 1994.

Peters, M. F.; O'Brien, K. F.; Sadoulet-Puccio, H. M.; Kunkel, L. M.; Adams, M. E.; Froehner, S. C.: Beta-dystrobrevin, a new member of the dystrophin family: identification, cloning, and protein associations. J. Biol. Chem. 272:50-31561-31569, 1997.

Morris, M. E.; Viswanathan, N.; Kuhlman, S.; Davis, F. C.; Weitz, C. J.: A screen for genes induced in the suprachiasmatic nucleus by light. Science 279:1544-1547, 1998.

Patwardhan, S.; Gashler, A.; Siegel, M. G.; Chang, L. C.; Joseph, L. J.; Shows, T. B.; Le Beau, M. M.; Sukhatme, V. P.: EGR3, a novel member of the Egr family of genes encoding immediate-early transcription factors. Oncogene 6:917-928, 1991.

Tourtellotte, W. G.; Milbrandt, J.: Sensory ataxia and muscle spindle agenesis in mice lacking the transcription factor Egr3. Nature Genet. 20:87-91, 1998.

Basile, A.; Sica, A.; d'Aniello, E.; Breviario, F.; Garrido, G.; Castellano, M.; Mantovani, A.; Introna, M.: Characterization of the promoter for the human long pentraxin PTX3: role of NF-kappa-B in tumor necrosis factor-alpha and interleukin-1-beta regulation. J. Biol. Chem. 272:8172-8178, 1997.

Brown, J. L.; Stowers, L.; Baer, M.; Trejo, J.; Coughlin, S.; Chant, J.: Human Ste20 homologue hPAK1 links GTPases to the JNK MAP kinase pathway. Curr. Biol. 6:598-605, 1996.

Knaus, U. G.; Morris, S.; Dong, H.-J.; Chernoff, J.; Bokoch, G. M.: Regulation of human leukocyte p21-activated kinases through G protein-coupled receptors. Science 269:221-223, 1995.

Lei, M.; Lu, W.; Meng, W.; Parrini, M.-C.; Eck, M. J.; Mayer, B. J.; Harrison, S. C.: Structure of PAK1 in an autoinhibited conformation reveals a multistage activation switch. Cell 102:387-397, 2000.

Cavailles, V.; Dauvois, S.; Horset, L. F.; Lopez, G.; Hoare, S.; Kushner, P. J.; Parker, M. G.: Nuclear factor RIP140 modulates transcriptional activation by the estrogen receptor. EMBO J. 14:3741-3751, 1995.

Katsanis, N.; Ives, J. H.; Groet, J.; Nizetic, D.; Fisher, E. M. C.: Localisation of receptor interacting protein 140 (RIP140) within 100 kb of D21S13 on 21q11, a gene-poor region of the human genome. Hum. Genet. 102:221-223, 1998.

Bodnar, J. S.; Chatterjee, A.; Castellani, L. W.; Ross, D. A.; Ohmen, J.; Cavalcoli, J.; Wu, C.; Dains, K. M.; Catanese, J.; Chu, M.; Sheth, S. S.; Charugundla, K.; Demant, P.; West, D. B.; de Jong, P.; Lusis, A. J.: Positional cloning of the combined hyperlipidemia gene Hyplip1. Nature Genet. 30:110-116, 2002.

Parrini, M. C.; Lei, M.; Harrison, S. C.; Mayer, B. J.: Pak1 kinasehomodimers are autoinhibited in trans and dissociated upon activation by Cdc42 and Rac1. Molec. Cell 9:73-83, 2002.

Sanders, L. C.; Matsumura, F.; Bokoch, G. M.; de Lanerolle, P.: Inhibition of myosin light chain kinase by p21-activated kinase. Science 283:2083-2085, 1999.

Arany, Z.; Sellers, W. R.; Livingston, D. M.; Eckner, R.: E1A-associated p300 and CREB-associated CBP belong to a conserved family of coactivators. (Letter) Cell 77:799-800, 1994.

Gayther, S. A.; Batley, S. J.; Linger, L.; Bannister, A.; Thorpe, K.; Chin, S.-F.; Daigo, Y.; Russell, P.; Wilson, A.; Sowter, H. M.; Delhanty, J. D. A.; Ponder, B. A. J.; Kouzarides, T.; Caldas, C.:Mutations truncating the EP300 acetylase in human cancers. Nature Genet. 24:300-303, 2000.

Ida, K.; Kitabayashi, I.; Taki, T.; Taniwaki, M.; Noro, K.; Yamamoto, M.; Ohki, M.; Hayashi, Y.: Adenoviral E1A-associated protein p300 is involved in acute myeloid leukemia with t (11;22)(q23; q13). Blood 90:4699-4704, 1997.

Muraoka, M.; Konishi, M.; Kikuchi-Yanoshita, R.; Tanaka, K.; Shitara, N.; Chong, J.-M.; Iwama, T.; Miyaki, M.: p300 gene alterations incolorectal and gastric carcinomas. Oncogene 12:1565-1569, 1996.

Yao, T. P.; Oh, S. P.; Fuchs, M.; Zhou, N.-D.; Ch'ng, L.-E.; Newsome, D.; Bronson, R. T.; Li, E.; Livingston, D. M.; Eckner, R.: Gene dosage-dependentembryonic development and proliferation defects in mice lacking thetranscriptional integrator p300. Cell 93:361-372, 1998.

Parant, J.; Chavez-Reyes, A.; Little, N. A.; Yan, W.; Reinke, V.; Jochemsen, A. G.; Lozano, G.: Rescue of embryonic lethality in Mdm4-nullmice by loss of Trp53 suggests a nonoverlapping pathway with MDM2 to regulate p53. Nature Genet. 29:92-95, 2001.

Shvarts, A.; Bazuine, M.; Dekker, P.; Ramos, Y. F. M.; Steegenga, W. T.; Merckx, G.; van Ham, R. C. A.; van der Houven van Oordt, W.; van der Eb, A. J.; Jochemsen, A. G.: Isolation and identification of the human homolog of a new p53-binding protein, Mdmx. Genomics 43:34-42, 1997.

Hosaka, M.; Sudhof, T. C.: Synapsin III, a novel synapsin withan unusual regulation by Ca (2)+. J. Biol. Chem. 273: 13371-13374,1998.

Kao, H.-T.; Porton, B.; Czernik, A. J.; Feng, J.; Yiu, G.; Haring, M.; Benfenati, F.; Greengard, P.: A third member of the synapsin gene family. Proc. Nat. Acad. Sci. 95:4667-4672, 1998.

Schizophrenia Collaborative Linkage Group (Chromosome 22): A combined analysis of D22S278 marker alleles in affected sib-pairs:support for a susceptibility locus for schizophrenia at chromosome 22q12. Am. J. Med. Genet. 67:40-45, 1996.

Tsai, M.-T.; Hung, C.-C.; Tsai, C.-Y.; Liu, M.-Y.; Su, Y.-C.; Chen, Y.-H.; Hsaio, K.-J.; Chen, C.-H.: Mutation analysis of synapsin IIIgene in schizophrenia. Am. J. Med. Genet. (Neuropsychiat. Genet.) 114:79-83, 2002.

Kull, F. J.; Sablin, E. P.; Lau, R.; Fletterick, R. J.; Vale, R. D.: Crystal structure of the kinesin motor domain reveals a structural similarity to myosin. Nature 380:550-555, 1996.

Navone, F.; Niclas, J.; Hom-Booher, N.; Sparks, L.; Bernstein, H. D.; McCaffrey, G.; Vale, R. D.: Cloning and expression of a human kinesin heavy chain gene: interaction of the COOH-terminal domainwith cytoplasmic microtubules in transfected CV-1 cells. J. CellBiol. 117:1263-1275, 1992.

Niclas, J.; Navone, F.; Hom-Booher, N.; Vale, R. D.: Cloning and localization of a conventional kinesin motor expressed exclusively in neurons. Neuron 12:1059-1072, 1994.

Tanaka, Y.; Kanai, Y.; Okada, Y.; Nonaka, S.; Takeda, S.; Harada, A.; Hirokawa, N.: Targeted disruption of mouse conventional kinesin heavy chain, kif5B, results in abnormal perinuclear clustering of mitochondria. Cell 93:1147-1158, 1998.

Albala, J. S.; Thelen, M. P.; Prange, C.; Fan, W.; Christensen, M.; Thompson, L. H.; Lennon, G. G.: Identification of a novel human RAD51 homolog, RAD51B. Genomics 46:476-479, 1997.

Cartwright, R.; Dunn, A. M.; Simpson, P. J.; Tambini, C. E.; Thacker, J.: Isolation of novel human and mouse genes of the recA/RAD51 recombination-repair gene family. Nucleic Acids Res. 26:1653-1659, 1998.

Rice, M. C.; Smith, S. T.; Bullrich, F.; Havre, P.; Kmiec, E. B.: Isolation of human and mouse genes based on homology to REC2, are combinational repair gene from the fungus Ustilago maydis. Proc. Nat. Acad. Sci. 94:7417-7422, 1997.

Richelda, R.; Ronchetti, D.; Baldini, L.; Cro, L.; Viggiano, L.; Marzella, R.; Rocchi, M.; Otsuki, T.; Lombardi, L.; Maiolo, A. T.; Neri, A.: A novel chromosomal translocation t (4;14)(p16.3; q32) in multiple myeloma involves the fibroblast growth-factor receptor 3 gene. Blood 90:4062-4070, 1997.

Baxendale, S.; MacDonald, M. E.; Mott, R.; Francis, F.; Lin, C.; Kirby, S. F.; James, M.; Zehetner, G.; Hummerich, H.; Valdes, J.; Collins, F. S.; Deaven, L. J.; Gusella, J. F.; Lehrach, H.; Bates, G. P.: A cosmid contig and high resolution restriction map of the 2 megabase region containing the Huntington's disease gene. Nature Genet. 4:181-186, 1993.

Wright, T. J.; Ricke, D. O.; Denison, K.; Abmayr, S.; Cotter, P. D.; Hirschhorn, K.; Keinanen, M.; McDonald-McGinn, D.; Somer, M.; Spinner, N.; Yang-Feng, T.; Zackai, E.; Altherr, M. R.: A transcript map of the newly defined 165 kb Wolf-Hirschhorn syndrome critical region. Hum. Molec. Genet. 6:317-324, 1997.

Chen, H.; Rossier, C.; Lalioti, M. D.; Lynn, A.; Chakravarti, A.; Perrin, G.; Antonarakis, S. E.: Cloning of the cDNA for a human homologue of the Drosophila white gene and mapping to chromosome 21q22.3. Am. J. Hum. Genet. 59:66-75, 1996.

Croop, J. M.; Tiller, G. E.; Fletcher, J. A.; Lux, M. L.; Raab, E.; Goldenson, D.; Son, D.; Arciniegas, S.; Wu, R. L.: Isolation and characterization of a mammalian homolog of the Drosophila white gene. Gene 185:77-85, 1997.

Klucken, J.; Buchler, C.; Orso, E.; Kaminski, W. E.; Porsch-Ozcurumez, M.; Liebisch, G.; Kapinsky, M.; Diederich, W.; Drobnik, W.; Dean, M.; Allikmets, R.; Schmitz, G.: ABCG1 (ABC8), the human homolog of the Drosophila white gene, is a regulator of macrophage cholesteroland phospholipid transport. Proc. Nat. Acad. Sci. 97:817-822, 2000.

Langmann, T.; Porsch-Ozcurumez, M.; Unkelbach, U.; Klucken, J.; Schmitz, G.: Genomic organization and characterization of the promoter of the human ATP-binding cassette transporter-G1 (ABCG1) gene. Biochim. Biophys. Acta 1494:175-180, 2000.

Lorkowski, S.; Rust, S.; Engel, T.; Jung, E.; Tegelkamp, K.; Galinski, E. A.; Assmann, G.; Cullen, P.: Genomic sequence and structure of the human ABCG1 (ABC8) gene. Biochem. Biophys. Res. Commun. 280:121-131, 2001.

Savary, S.; Denizot, F.; Luciani, M.-F.; Mattei, M.-G.; Chimini, G.: Molecular cloning of a mammalian ABC transporter homologous to Drosophila white gene. Mammalian Genome 7:673-676, 1996.

Borden, L. A.; Smith, K. E.; Gustafson, E. L.; Branchek, T. A.; Weinshank, R. L.: Cloning and expression of a betaine/

GABA transporter from human brain. J. Neurochem. 64:977-984, 1995.

Rasola, A.; Galietta, L. J. V.; Barone, V.; Romeo, G.; Bagnasco, S.: Molecular cloning and functional characterization of a GABA/betaine transporter from human kidney. FEBS Lett. 373:229-233, 1995.

Yamauchi, A.; Uchida, S.; Kwon, H. M.; Preston, A. S.; Robey, R. B.; Garcia-Perez, A.; Burg, M. B.; Handler, J. S.: Cloning of a Na (+) and Cl (-)-dependent betaine transporter that is regulated by hypertonicity. J. Biol. Chem. 267:649-652, 1992.

Eisses, J. F.; Kaplan, J. H.: Molecular characterization of hCTR1, the human copper uptake protein. J. Biol. Chem. 277:29162-29171,2002.

Klomp, A. E. M.; Tops, B. B. J.; van den Berg, I. E. T.; Berger, R.; Klomp, L. W. J.: Biochemical characterization and subcellular localization of human copper transporter 1 (hCTR1). Biochem. J. 364:497-505, 2002.

Kuo, Y.-M.; Zhou, B.; Cosco, D.; Gitschier, J.: The copper transporterCTR1 provides an essential function in mammalian embryonic development. Proc. Nat. Acad. Sci. 98:6836-6841, 2001.

Lee, J.; Pena, M. M. O.; Nose, Y.; Thiele, D. J.: Biochemical characterization of the human copper transporter Ctr1. J. Biol. Chem. 277:4380-4387, 2002.

Lee, J.; Prohaska, J. R.; Thiele, D. J.: Essential role for mammalian copper transporter Ctr1 in copper homeostasis and embryonic development. Proc. Nat. Acad. Sci. 98:6842-6847, 2001.

Moller, L. B.; Petersen, C.; Lund, C.; Horn, N.: characterization of the hCTR1 gene: genomic organization, functional expression, and identification of a highly homologous processed gene. Gene 257:13-22, 2000.

Zhou, B.; Gitschier, J.: hCTR1: a human gene for copper uptake identified by complementation in yeast. Proc. Nat. Acad. Sci. 94:7481-7486, 1997.

Schwienbacher, C.; Sabbioni, S.; Campi, M.; Veronese, A.; Bernardi, G.; Menegatti, A.; Hatada, I.; Mukai, T.; Ohashi, H.; Barbanti-Brodano, G; Croce, C. M.; Negrini, M.: Transcriptional map of 170-kb region at chromosome 11p15.5: identification and mutational analysis of theBWR1A gene reveals the presence of mutations in tumor samples. Proc. Nat. Acad. Sci. 95:3873-3878, 1998.

Hirono, Y.; Fushida, S.; Yonemura, Y.; Yamamoto, H.; Watanabe, H.; Raz, A.: Expression of autocrine motility factor receptor correlates with disease progression in human gastric cancer. Brit. J. Cancer 74:2003-2007, 1996.

Huang, B.; Xie, Y.; Raz, A.: Identification of an upstream region that controls the transcription of the human autocrine motility factor receptor. Biochem. Biophys. Res. Commun. 212:727-742, 1995.

Silletti, S.; Yao, J.; Sanford, J.; Mohammed, A. N.; Otto, T.; Wolman, S. R.; Raz, A.: Autocrine motility factor receptor in human bladder carcinoma: gene expression, loss of cell-contact regulation and chromosomal mapping. Int. J. Oncol. 3:801-807, 1993.

Watanabe, H.; Carmi, P.; Hogan, V.; Raz, T.; Silletti, S.; Nabi, I. R.; Raz, A.: Purification of human tumor cell autocrine motility factor and molecular cloning of its receptor. J. Biol. Chem. 266:13442-13448, 1991.

Amlal, H.; Burnham, C. E.; Soleimani, M.: Characterization ofNa (+)/HCO(3-) cotransporter isoform NBC-3. Am. J. Physiol. 276:F903-F913, 1999.

Burnham, C. E.; Wang, Z.; Soleimani, M.: Personal Communication. Cincinnati, Oh. Jun. 1, 2000.

Choi, I.; Aalkjaer, C.; Boulpaep, E. L.; Boron, W. F.: An electroneutral sodium/bicarbonate cotransporter NBCn1 and associated sodium channel. Nature 405:571-575, 2000.

Ishibashi, K.; Sasaki, S.; Marumo, F.: Molecular cloning of anew sodium bicarbonate cotransporter cDNA from human retina. Biochem. Biophys. Res. Commun. 246:535-538, 1998.

Pushkin, A.; Abuladze, N.; Lee, I.; Newman, D.; Hwang, J.; Kurtz, I.: Mapping of the human NBC3 (SLC4A7) gene to chromosome 3p22. Genomics 57:321-322, 1999. Note: Correction: Genomics 58:216 and 321-322, 1999.

Pushkin, A.; Abuladze, N.; Lee, I.; Newman, D.; Hwang, J.; Kurtz, I.: Cloning, tissue distribution, genomic organization, and functional characterization of NBC3, a new member of the sodium bicarbonate cotransporter family. J. Biol. Chem. 274:16569-16575, 1999.

Nagase, T.; Miyajima, N.; Tanaka, A.; Sazuka, T.; Seki, N.; Sato, S.; Tabata, S.; Ishikawa, K.; Kawarabayasi, Y.; Kotani, H.; Nomura, N.: Prediction of the coding sequences of unidentified human genes. III. The coding sequences of 40 new genes (KIAA0081-KIAA0120) deduced by analysis of cDNA clones from human cell line KG-1. DNA Res. 2:37-43, 1995.

Watt, S. M.; Buhring, H.-J.; Rappold, I.; Chan, J. Y.-H.; Lee-Prudhoe, J.; Jones, T.; Zannettino, A. C. W.; Simmons, P. J.; Doyonnas, R.; Sheer, D.; Butler, L. H.: CD164, a novel sialomucin on CD34+ anderythroid subsets, is located on human chromosome 6q21. Blood 92:849-866, 1998.

Zannettino, A. C. W.; Buhring, H.-J.; Niutta, S.; Watt, S. M.; Benton, M. A.; Simmons, P. J.: The sialomucin CD164 (MGC-24v) is an adhesive glycoprotein expressed by human hematopoietic progenitors and bone marrow stromal cells that serves as a potent negative regulator of hematopoiesis. Blood 92:2613-2628, 1998.

Abts, H. F.; Breuhahn, K.; Michel, G.; Kohrer, K.; Esser, P.; Ruzicka, T.: Analysis of UVB modulated gene expression in human keratinocytes by mRNA differential display polymerase chain reaction. Photochem. Photobiol. 66:363-367, 1997.

Abts, H. F.; Welss, T.; Mirmohammadsadegh, A.; Kohrer, K.; Michel, G.; Ruzicka, T.: Cloning and characterization of hurpin (proteaseinhibitor 13): a new skin-specific, UV-repressible serine proteinase inhibitor of the ovalbumin serpin family. J. Molec. Biol. 293:29-39,1999.

Nakashima, T.; Pak, S. C.; Silverman, G. A.; Spring, P. M.; Frederick, M. J.; Clayman, G. L.: Genomic cloning, mapping, structure and promoter analysis of HEADPIN, a serpin which is down-regulated in head and neck cancer cells. Biochim. Biophys. Acta 1492:441-446, 2000.

Spring, P.; Nakashima, T.; Frederick, M.; Henderson, Y.; Clayman, G.: Identification and cDNA cloning of headpin, a novel differentially expressed serpin that maps to chromosome 18q. Biochem. Biophys. Res. Commun. 264:299-304, 1999.

Alimova-Kost, M. V.; Imreh, S.; Buchman, V. L.; Ninkina, N. N.: Assignment of phosphotriesterase-related gene (PTER) to human chromosome band 10p12 by in situ hybridization. Cytogenet. Cell Genet. 83:16-17, 1998.

Davies, J. A.; Buchman, V. L.; Krylova, O.; Ninkina, N. N.: molecular cloning and expression pattern of rpr-1, a resiniferatoxin-binding, phosphotriesterase-related protein, expressed in rat kidney tubules. FEBSLett. 410:378-382, 1997.

Dixon, B.; Sahely, B.; Liu, L.; Pohajdak, B.: Cloning a cDNA from human NK/T cells which codes for an unusual leucine zipper containing protein. Biochim. Biophys. Acta 1216:321-324, 1993.

Kim, H.-S.: Assignment of the human B3-1 gene (PSCDBP) to chromosome 2 band q11.2 by radiation hybrid mapping. Cytogenet. Cell Genet. 84:95 only, 1999.

Tang, P.; Cheng, T. P.; Agnello, D.; Wu, C.-Y.; Hissong, B. D.; Watford, W. T.; Ahn, H.-J.; Galon, J.; Moss, J.; Vaughan, M.; O'Shea, J. J.; Gadina, M.: Cybr, a cytokine-inducible protein that binds cytohesin-1 and regulates its activity. Proc. Nat. Acad. Sci. 99:2625-2629, 2002.

Nakayama, Y.; Goebl, M.; O'Brine Greco, B.; Lemmon, S.; PingchangChow, E.; Kirchhausen, T.: The medium chains of the mammalian clathrin-associatedproteins have a homolog in yeast. Europ. J. Biochem. 202:569-574,1991.

Hiramoto, T.; Nakanishi, T.; Sumiyoshi, T.; Fukuda, T.; Matsuura, S.; Tauchi, H.; Komatsu, K.; Shibasaki, Y.; Inui, H.; Watatani, M.; Yasutomi, M.; Sumii, K.; Kajiyama, G.; Kamada, N.; Miyagawa, K.; Kamiya, K.: Mutations of a novel human RAD54 homologue, RAD54B, in primarycancer. Oncogene 18:3422-3426, 1999.

Miyagawa, K.; Tsuruga, T.; Kinomura, A.; Usui, K.; Katsura, M.; Tashiro, S.; Mishima, H.; Tanaka, K.: A role for RAD54B in homologousrecombination in human cells. EMBO J. 21:175-180, 2002.

Tanaka, K.; Hiramoto, T.; Fukuda, T.; Miyagawa, K.: A novel human Rad54 homologue, Rad54B, associates with Rad51. J. Biol. Chem. 275:26316-26321, 2000.

Pillutla, R. C.; Shimamoto, A.; Furuichi, Y.; Shatkin, A. J.:Human mRNA capping enzyme (RNGTT) and cap methyltransferase (RNMT) map to 6q16 and 18p11.22-p11.23, respectively. Genomics 54:351-353,1998.

Tsukamoto, T.; Shibagaki, Y.; Murakoshi, T.; Suzuki, M.; Nakamura, A.; Gotoh, H.; Mizumoto, K.: Cloning and characterization of two human cDNAs encoding the mRNA capping enzyme. Biochem. Biophys. Res. Commun. 243:101-108, 1998.

Yamada-Okabe, T.; Doi, R.; Shimmi, O.; Arisawa, M.; Yamada-Okabe, H.: Isolation and characterization of a human cDNA for mRNA 5-prime-cappingenzyme. Nucleic Acids Res. 26:1700-1706, 1998.

Yue, Z.; Maldonado, E.; Pillutla, R.; Cho, H.; Reinberg, D.; Shatkin, A. J.: Mammalian capping enzyme complements mutant Saccharomycescerevisiae lacking mRNA guanylyltransferase and selectively bindsthe elongating form of RNA polymerase II. Proc. Nat. Acad. Sci. 94:12898-12903, 1997.

Ishikawa, K.; Nagase, T.; Nakajima, D.; Seki, N.; Ohira, M.; Miyajima, N.; Tanaka, A.; Kotani, H.; Nomura, N.; Ohara, O.: Prediction of the coding sequences of unidentified human genes. VIII. 78 new cDNAclones from brain which code for large proteins in vitro. DNA Res. 4:307-313, 1997.

Pillutla, R. C.; Yue, Z.; Maldonado, E.; Shatkin, A. J.: Recombinanthuman mRNA cap methyltransferase binds capping enzyme/RNA polymeraseIIo complexes. J. Biol. Chem. 273:21443-21446, 1998.

Tsukamoto, T.; Shibagaki, Y.; Niikura, Y.; Mizumoto, K.: Cloningand characterization of three human cDNAs encoding mRNA (guanine-7)-methyltransferase, an mRNA cap methylase. Biochem. Biophys. Res. Commun. 251:27-34, 1998.

Sawamura, T.; Kume, N.; Aoyama, T.; Moriwaki, H.; Hoshikawa, H.; Aiba, Y.; Tanaka, T.; Miwa, S.; Katsura, Y.; Kita, T.; Masaki, T.: An endothelial receptor for oxidized low-density lipoprotein. Nature 386:73-77, 1997.

Yamanaka, S.; Zhang, X.-Y.; Miura, K.; Kim, S.; Iwao, H.: Thehuman gene encoding the lectin-type oxidized LDL receptor (OLR1) is a novel member of the natural killer gene complex with a unique expression profile. Genomics 54:191-199, 1998.

Gorboulev, V.; Ulzheimer, J. C.; Akhoundova, A.; Ulzheimer-Teuber, I.; Karbach, U.; Quester, S.; Baumann, C.; Lang, F.; Busch, A. E.; Koepsell, H.: Cloning and characterization of two human polyspecific organic cation transporters. DNA Cell Biol. 16:871-881, 1997.

Koehler, M. R.; Wissinger, B.; Gorboulev, V.; Koepsell, H.; Schmid, M.: The two human organic cation transporter genes SLC22A1 and SLC22A2 are located on chromosome 6q26. Cytogenet. Cell Genet. 79:198-200,1997.

Grundemann, D.; Schomig, E.: Gene structures of the human non-neuronal monoamine transporters EMT and OCT2. Hum. Genet. 106:627-635, 2000.

Mooslehner, K. A.; Allen, N. D.: Cloning of the mouse organiccation transporter 2 gene, Slc22a2, from an enhancer-trap transgene integration locus. Mammalian Genome 10:218-224, 1999.

McLoughlin, D. M.; Miller, C. C. J.: The intracellular cytoplasmic domain of the Alzheimer's disease amyloid precursor protein interacts with phosphotyrosine-binding domain proteins in the yeast two-hybrid system. FEBS Lett. 397:197-200, 1996.

Guenette, S. Y.; Chen, J.; Jondro, P. D.; Tanzi, R. E.: Association of a novel human FE65-like protein with the cytoplasmic domain of the beta-amyloid precursor protein. Proc. Nat. Acad. Sci. 93:10832-10837,1996.

Duilio, A.; Faraonio, R.; Minopoli, G.; Zambrano, N.; Russo, T.: Fe65L2: a new member of the Fe65 protein family interacting with the intracellular domain of the Alzheimer's beta-amyloid precursor protein. Biochem. J. 330:513-519, 1998.

Tanahashi, H.; Tabira, T.: Genome structure and chromosomal mapping of the gene for Fe65L2 interacting with Alzheimer's beta-amyloid precursor protein. Biochem. Biophys. Res. Commun. 258:385-389, 1999.

Tanahashi, H.; Tabira, T.: Molecular cloning of human Fe65L2 and its interaction with the Alzheimer's beta-amyloid precursor protein. Neurosci. Lett. 261:143-146, 1999.

Howard, L.; Nelson, K. K.; Maciewicz, R. A.; Blobel, C. P.: Interaction of the metallo protease disintegrins MDC9 and MDC15 with two SH3 domain-containing proteins, endophilin I and SH3PX1. J. Biol. Chem. 274:31693-31699,1999.

Galliano, M.-F.; Huet, C.; Frygelius, J.; Polgren, A.; Wewer, U. M.; Engvall, E.: Binding of ADAM12, a marker of skeletal muscle regeneration, to the muscle-specific actin-binding protein, alpha-actinin-2, is required for myoblast fusion. J. Biol. Chem. 275:13933-13939, 2000.

Gilpin, B. J.; Loechel, F.; Mattei, M.-G.; Engvall, E.; Albrechtsen, R.; Wewer, U. M.: A novel, secreted form of human ADAM 12 (meltrinalpha) provokes myogenesis in vivo. J. Biol. Chem. 273:157-166,1998.

Yagami-Hiromasa, T.; Sato, T.; Kurisaki, T.; Kamijo, K.; Nabeshima, Y.; Fujisawa-Sehara, A.: A metalloprotease-disintegrin participating in myoblast fusion. Nature 377:652-656, 1995.

Chantry, D.; Vojtek, A.; Kashishian, A.; Holtzman, D. A.; Wood, C.; Gray, P. W.; Cooper, J. A.; Hoekstra, M. F.: p110-delta, a novel phosphatidylinositol 3-kinase catalytic subunit that associates with p85 and is expressed predominantly in leukocytes. J. Biol. Chem. 272:19236-19241, 1997.

Okkenhaug, K.; Bilancio, A.; Farjot, G.; Priddle, H.; Sancho, S.; Peskett, E.; Pearce, W.; Meek, S. E.; Salpekar, A.; Waterfield, M. D.; Smith, A. J. H.; Vanhaesebroeck, B.: Impaired B and T cell antigenreceptor signaling in p110-delta PI 3-kinase mutant mice. Science 297:1031-1034, 2002.

Seki, N.; Nimura, Y.; Ohira, M.; Saito, T.; Ichimiya, S.; Nomura, N.; Nakagawara, A.: Identification and chromosome assignment of a human gene encoding a novel phosphatidylinositol-3 kinase. DNA Res. 4:355-358, 1997.

Vanhaesebroeck, B.; Welham, M. J.; Kotani, K.; Stein, R.; Warne, P. H.; Zvelebil, M. J.; Higashi, K.; Volinia, S.; Downward, J.; Waterfield, M. D.: p110-delta, a novel phosphoinositide 3-kinase in leukocytes. Proc. Nat. Acad. Sci. 94:4330-4335, 1997.

Berger, R.; Mezey, E.; Clancy, K. P.; Harta, G.; Wright, R. M.; Repine, J. E.; Brown, R. H.; Brownstein, M.; Patterson, D.: analysis of aldehyde oxidase and xanthine dehydrogenase/oxidase as possible candidate genes for autosomal recessive familial amyotrophic lateral sclerosis. Somat. Cell Molec. Genet. 21:121-131, 1995.

Turner, N. A.; Doyle, W. A.; Ventom, A. M.; Bray, R. C.: Propertiesof rabbit liver aldehyde oxidase and the relationship of the enzyme to xanthine oxidase and dehydrogenase. Europ. J. Biochem. 232:646-657,1995.

Cheng, G.; Ye, Z.-S.; Baltimore, D.: Binding of Bruton's tyrosine kinase to Fyn, Lyn, or Hck through a Src homology 3 domain-mediated interaction. Proc. Nat. Acad. Sci. 91:8152-8155, 1994.

Gibson, S.; Leung, B.; Squire, J. A.; Hill, M.; Arima, N.; Goss, P.; Hogg, D.; Mills, G. B.: Identification, cloning, and characterization of a novel human T-cell-specific tyrosine kinase located at the hematopoietin complex on chromosome 5q. Blood 82:1561-1572, 1993.

Janis, E. M.; Siliciano, J. D.; Isaac, D. D.; Griffin, C. A.; Hawkins, A. L.; Kozak, C. A.; Desiderio, S.: Mapping of the gene for the tyrosine kinase Itk to a region of conserved synteny between mouse chromosome 11 and human chromosome 5q. Genomics 23:269-271, 1994.

Schaeffer, E. M.; Debnath, J.; Yap, G.; McVicar, D.; Liao, X. C.; Littman, D. R.; Sher, A.; Varmus, H. E.; Lenardo, M. J.; Schwartzberg, P. L.: Requirement for Tec kinases Rlk and Itk in T cell receptor signaling and immunity. Science 284:638-641, 1999.

Woods, M. L.; Kivens, W. J.; Adelsman, M. A.; Qiu, Y.; August, A.; Shimizu, Y.: A novel function for the Tec family tyrosine kinase Itk in activation of beta-1 integrins by the T-cell receptor. EMBOJ. 20:1232-1244, 2001.

Bisbal, C.; Martinand, C.; Silhol, M.; Lebleu, B.; Salehzada, T.: Cloning and characterization of a RNase L inhibitor: a new component of the interferon-regulated 2-5A pathway. J. Biol. Chem. 270:13308-13317,1995.

Elliott, R. W.; Samuelson, L. C.; Lambert, M. S.; Meisler, M. H.: Assignment of pancreatic ribonuclease gene to mouse chromosome 14. Cytogenet. Cell Genet. 42:110-112, 1986.

Piccoli, R.; Di Gaetano, S.; De Lorenzo, C.; Grauso, M.; Monaco, C.; Spalletti-Cernia, D.; Laccetti, P.; Cinatl, J.; Matousek, J.; D'Alessio, G.: A dimeric mutant of human pancreatic ribonuclease with selective cytotoxicity toward malignant cells. Proc. Nat. Acad. Sci. 96:7768-7773, 1999.

Zhang, J.; Zhang, Y.; Rosenberg, H. F.: Adaptive evolution of a duplicated pancreatic ribonuclease gene in a leaf-eating monkey. Nature Genet. 30:416-420, 2002.

Byrne, P. C.; Shipley, J. M.; Chave, K. J.; Sanders, P. G.; Snell, K.: Characterisation of a human serine hydroxymethyltransferase pseudogene and its localisation of 1p32.3-33. Hum. Genet. 97:340-344, 1996.

Elsea, S. H.; Juyal, R. C.; Jiralerspong, S.; Finucane, B. M.; Pandolfo, M.; Greenberg, F.; Baldini, A.; Stover, P.; Patel, P. I.: Haploin sufficiency of cytosolic serine hydroxymethyltransferase in the Smith-Magenis syndrome. Am. J. Hum. Genet. 57:1342-1350,1995.

Delon, J.; Kaibuchi, K.; Germain, R. N.: Exclusion of CD43 from the immunological synapse is mediated by phosphorylation-regulated relocation of the cytoskeletal adaptor moesin. Immunity 15:691-701,2001.

Tong, Q.; Xing, S.; Jhiang, S. M.: Leucine zipper-mediated dimerization is essential for the PTC1 oncogenic activity. J. Biol. Chem. 272:9043-9047, 1997.

Vellucci, V. F.; Reiss, M.: Cloning and genomic organization of the human transforming growth factor-beta type I receptor gene. Genomics 46:278-283, 1997.

Allen, R. C.; Webster, A. R.; Sui, R.; Brown, J.; Taylor, C. M.; Stone, E. M.: Molecular characterization and ophthalmic investigation of a large family with type 2A von Hippel-Lindau disease. Arch. Ophthal. 119:1659-1665, 2001.

Orstavik, S.; Natarajan, V.; Tasken, K.; Jahnsen, T.; Sandberg, M.: Characterization of the human gene encoding the type I-alpha and type I-beta cGMP-dependent protein kinase (PRKG1). Genomics 42:311-318, 1997.

Orstavik, S.; Sandberg, M.; Berube, D.; Natarajan, V.; Simard, J.; Walter, U.; Gagne, R.; Hansson, V.; Jahnsen, T.: Localization of the human gene for type I cyclic GMP-dependent protein kinase to chromosome 10. Cytogenet. Cell Genet. 59:270-273, 1992.

Osborne, K. A; Robichon, A.; Burgess, E.; Butland, S.; Shaw, R. A.; Coulthard, A.; Pereira, H. S.; Greenspan, R. J.; Sokolowski, M. B.: Natural behavior polymorphism due to a cGMP-dependent protein kinase of Drosophila. Science 277: 834-836, 1997.

Pfeifer, A.; Klatt, P.; Massberg, S.; Ny, L.; Sausbier, M.; Hirneill, C.; Wang, G.-X.; Korth, M.; Aszodi, A.; Andersson, K.-E.; Krombach, F.; Mayerhofer, A.; Ruth, P.; Fassler, R.; Hofmann, F.: Defective smooth muscle regulation in cGMP kinase I-deficient mice. EMBO J. 17:3045-3051, 1998.

Sandberg, M.; Natarajan, V.; Ronander, I.; Kalderon, D.; Walter, U.; Lohmann, S. M.; Jahnsen, T.: Molecular cloning and predicted full-length amino acid sequence of the type I beta isozyme of cGMP-dependent protein kinase from human placenta: tissue distribution and developmental changes in rat. FEBS Lett. 255:321-329, 1989.

Tamura, N.; Itoh, H.; Ogawa, Y.; Nakagawa, O.; Harada, M.; Chun, T.-H.; Suga, S.; Yoshimasa, T.; Nakao, K.: cDNA cloning and gene expression of human type I-alpha cGMP-dependent protein kinase. Hypertension 27:552-557, 1996.

Oyen, O.; Myklebust, F.; Scott, J. D.; Hansson, V.; Jahnsen, T.: Human test is cDNA for the regulatory subunit RII alpha of cAMP-dependent protein kinase encodes an alternate amino-terminal region. FEBS Lett. 246:57-64, 1989.

Tasken, K.; Naylor, S. L.; Solberg, R.; Jahnsen, T.: Mapping of the gene encoding the regulatory subunit RII-alpha of cAMP-dependent protein kinase (locus PRKAR2A) to human chromosome region 3p21.3-p21.2. Genomics 50:378-381, 1998.

Solberg, R.; Sistonen, P.; Traskelin, A.-L.; Berube, D.; Simard, J.; Krajci, P.; Jahnsen, T.; de la Chapelle, A.: Mapping of the regulatory subunits RI-beta and RII-beta of cAMP-dependent protein kinase genes on human chromosome 7. Genomics 14:63-69, 1992.

Cummings, D. E.; Brandon, E. P.; Planas, J. V.; Motamed, K.; Idzerda, R. L.; McKnight, G. S.: Genetically lean mice result from targeted disruption of the RII-beta subunit of protein kinase A. Nature 382:622-626, 1996.

Scambler, P.; Oyen, O.; Wainwright, B.; Farrall, M.; Law, H.-Y.; Estivill, X.; Sandberg, M.; Williamson, R.; Jahnsen, T.: exclusion of catalytic and regulatory subunits of cAMP-dependent protein kinases as candidate genes for the defect causing cystic fibrosis. Am. J. Hum. Genet. 41:925-932, 1987.

Wainwright, B.; Lench, N.; Davies, K.; Scambler, P.; Kruyer, H.; Williamson, R.; Jahnsen, T.; Farrall, M.: A human regulatory subunit of type II cAMP-dependent protein kinase localized by its linkage relationship to several cloned chromosome 7q markers. Cytogenet. Cell Genet. 45:237-239, 1987.

McGrogan, M.; Kennedy, J.; Li, M. P.; Hsu, C.; Scott, R. W.; Simonsen, C. C.; Baker, J. B.: Molecular cloning and expression of two forms of human protease nexin I. Bio/Technology 6:172-177, 1988.

Sommer, J.; Gloor, S.; Rovelli, G. F.; Hofsteenge, J.; Nick, H.; Meier, R.; Monard, D.: cDNA sequence coding for a rat glia-derived nexin and its homology to members of the serpin family. Biochemistry 26:6407-6410, 1987.

Sugawara, S.; Uehara, A.; Nochi, T.; Yamaguchi, T.; Ueda, H.; Sugiyama, A.; Hanzawa, K.; Kumagai, K.; Okamura, H.; Takada, H.:Neutrophil proteinase 3-mediated induction of bioactive IL-18 secretion by human oral epithelial cells. J. Immun. 167:6568-6575, 2001.

Alliel, P. M.; Perin, J. P.; Maillet, P.; Bonnet, F.; Rosa, J. P.; Jolles, P.: Complete amino acid sequence of a human platelet-proteoglycan. FEBS Lett. 236:123-126, 1988.

Austen, K. F.: Personal Communication. Boston, Mass. Jan. 29, 1990.

Avraham, S.; Stevens, R. L.; Gartner, M. C.; Austen, K. F.; Lalley, P. A.; Weis, J. H.: Isolation of a cDNA that encodes the peptide core of the secretory granule proteo glycan of rat basophilic leukemia-1 cells and assessment of its homology to the human analogue. J. Biol. Chem. 263:7292-7296, 1988.

Avraham, S.; Stevens, R. L.; Nicodemus, C. F.; Gartner, M. C.; Austen, K. F.; Weis, J. H.: Molecular cloning of a cDNA that encodes the peptide core of a mouse mast cell secretory granule proteoglycan and comparison with the analogous rat and human cDNA. Proc. Nat. Acad. Sci. 86:3763-3767, 1989.

Humphries, D. E.; Nicodemus, C. F.; Schiller, V.; Stevens, R. L.: The human serglycin gene: nucleotide sequence and methylation pattern in human promyelocytic leukemia HL-60 cells and T-lymphoblast Molt-4cells. J. Biol. Chem. 267:13558-13563, 1992.

Mattei, M. G.; Perin, J.-P.; Alliel, P. M.; Bonnet, F.; Maillet, P.; Passage, E.; Mattei, J.-F.; Jolles, P.: Localization of human platelet proteoglycan gene to chromosome 10, band q22.1, by in situ hybridization. Hum. Genet. 82:87-88, 1989.

Perin, J. P.; Bonnet, F.; Maillet, P.; Jolles, P.: Characterization and N-terminal sequence of human platelet proteoglycan. Biochem. J. 255:1007-1013, 1988.

Rothenberg, M. E.; Pomerantz, J. L.; Owen, W. F., Jr.; Avraham, S.; Soberman, R. J.; Austen, K. F.; Stevens, R. L.: characterization of a human eosinophil proteoglycan, and augmentation of its biosynthesis and size by interleukin 3, interleukin 5, and granulocyte/macrophage colony stimulating factor. J. Biol. Chem. 263:13901-13908, 1988.

Stevens, R. L.; Avraham, S.; Gartner, M. C.; Bruns, G. A. P.; Austen, K. F.; Weis, J. H.: Isolation and characterization of a cDNA that encodes the peptide core of the secretory granule proteoglycan of human promyelocytic leukemia HL-60 cells. J. Biol. Chem. 263:7287-7291,1988.

Akiyama, K.; Yokota, K.; Kagawa, S.; Shimbara, N.; Tamura, T.; Akioka, H.; Nothwang, H. G.; Noda, C.; Tanaka, K.; Ichihara, A.:cDNA cloning and interferon gamma down-regulation of proteasomal subunitsX and Y. Science 265: 1231-1234, 1994.

Driscoll, J.; Brown, M. G.; Finley, D.; Monaco, J. J.: MHC-linkedLMP gene products specifically alter peptidase activities of the proteasome. Nature 365:262-264, 1993.

Gaczynska, M.; Rock, K. L.; Goldberg, A. L.: Gamma-interferon and expression of MHC genes regulate peptide hydrolysis by proteasomes. Nature 365:264-267, 1993.

Glynne, R.; Powis, S. H.; Beck, S.; Kelly, A.; Kerr, L. A.; Trowsdale, J.: A proteasome-related gene between the two ABC transporter loci in the class II region of the human MHC. Nature 353:357-360, 1991.

Milatovich, A.; Song, K.; Heller, R. A.; Francke, U.: Tumor necrosis factor receptor genes, TNFR1 and TNFR2, on human chromosomes 12 and 1. Somat. Cell Molec. Genet. 17:519-523, 1991.

Schall, T. J.; Lewis, M.; Koller, K. J.; Lee, A.; Rice, G. C.; Wong, G. H. W.; Gatanaga, T.; Granger, G. A.; Lentz, R.; Raab, H.; Kohr, W. J.; Goeddel, D. V.: Molecular cloning and expression of a receptor for human tumor necrosis factor. Cell 61:361-370, 1990.

Schievella, A. R.; Chen, J. H.; Graham, J. R.; Lin, L.-L.: MADD, a novel death domain protein that interacts with the type 1 tumor necrosis factor receptor and activates mitogen-activated protein kinase. J. Biol. Chem. 272:12069-12075, 1997.

Beltinger, C. P.; White, P. S.; Maris, J. M.; Sulman, E. P.; Jensen, S. J.; LePaslier, D.; Stallard, B. J.; Goeddel, D. V.; de Sauvage, F. J.; Brodeur, G. M.: Physical mapping and genomic structure of the human TNFR2 gene. Genomics 35:94-100, 1996.

Kaufman, B. A.; White, P. S.; Steinbrueck, T.; Donis-Keller, H.; Brodeur, G. M.: Linkage mapping of the tumor necrosis factor receptor 2 (TNFR2) gene to 1p36.2 using the single-strand conformation polymorphism technique. Hum. Genet. 94:418-422, 1994.

Kemper, O.; Derre, J.; Cherif, D.; Engelmann, H.; Wallach, D.; Berger, R.: The gene for the type II (p75) tumor necrosis factor receptor (TNF-RII) is localized on band 1p36.2-p36.3. Hum. Genet. 87:623-624, 1991.

Li, X.; Yang, Y.; Ashwell, J. D.: TNF-RII and c-IAP1 mediate ubiquitination and degradation of TRAF2. Nature 416: 345-349, 2002.

Santee, S. M.; Owen-Schaub, L. B.: Human tumor necrosis factor receptor p75/80 (CD120b) gene structure and promoter characterization. J. Biol. Chem. 271:21151-21159, 1996.

Mochizuki, N.; Yamashita, S.; Kurokawa, K.; Ohba, Y.; Nagai, T.; Miyawaki, A.; Matsuda, M.: Spatio-temporal images of growth-factor-induced activation of Ras and Rap1. Nature 411:1065-1068, 2001.

Hon, W.-C.; Wilson, M. I.; Harlos, K.; Claridge, T. D. W.; Schofield, C. J.; Pugh, C. W.; Maxwell, P. H.; Ratcliffe, P. J.; Stuart, D. I.; Jones, E. Y.: Structural basis for the recognition of hydroxyprolinein HIF-1-alpha by pVHL. Nature 417:975-978, 2002.

Williams, J. M.; Chen, G.-C.; Zhu, L.; Rest, R. F.: Using theyeast two-hybrid system to identify human epithelial cell proteinsthat bind gonococcal Opa proteins: intracellular gonococci bind pyruvatekinase via their Opa proteins and require host pyruvate for growth. Molec. Microbiol. 27:171-186, 1998.

Seabra, M. C.; Brown, M. S.; Goldstein, J. L.: Retinal degeneration in choroideremia: deficiency of Rab geranylgeranyl transferase. Science 259:377-381, 1993.

Seabra, M. C.; Brown, M. S.; Slaughter, C. A.; Sudhof, T. C.; Goldstein, J. L.: Purification of component A of Rab geranylgeranyl transferase:possible identity with the choroideremia gene product. Cell 70:1049-1057, 1992.

Seabra, M. C.; Reiss, Y.; Casey, P. J.; Brown, M. S.; Goldstein, J. L.: Protein farnesyltransferase and geranylgeranyl-transferase share a common alpha subunit. Cell 65:429-434, 1991.

van Bokhoven, H.; Rawson, R. B.; Merkx, G. F. M.; Cremers, F. P. M.; Seabra, M. C.: cDNA cloning and chromosomal localization of the genes encoding the alpha- and beta-subunits of human Rab geranylgeranyltransferase: the 3-prime end of the alpha-subunit gene overlaps with the transglutaminase 1 gene promoter. Genomics 38:133-140, 1996.

Koken, M. H. M.; Smit, E. M. E.; Jaspers-Dekker, I.; Oostra, B. A.; Hagemeijer, A.; Bootsma, D.; Hoeijmakers, J. H. J.: Localization of two human homologs, HHR6A and HHR6B, of the yeast DNA repair gene RAD6 to chromosomes Xq24-q25 and 5q23-q31. Genomics 12:447-453, 1992.

Lench, N. J.; Thompson, J.; Markham, A. F.; Robinson, P. A.: (CGG) trinucleotide repeat polymorphism in the 5-prime region of the HHR6B gene: the human homolog of the yeast DNA repair gene RAD6. Hum. Genet. 96:369-370, 1995.

Roest, H. P.; van Klaveren, J.; de Wit, J.; van Gurp, C. G.; Koken, M. H. M.; Vermey, M.; van Roijen, J. H.; Hoogerbrugge, J. W.; Vreeburg, J. T. M.; Baarends, W. M.; Bootsma, D.; Grootegoed, J. A.; Hoeijmakers, J. H. J.: Inactivation of the HR6B ubiquitin-conjugating DNA repair enzyme in mice causes male sterility associated with chromatin modification. Cell 86:799-810, 1996.

Roller, M. L.; Lossie, A. C.; Koken, M. H. M.; Smit, E. M. E.; Hagemeijer, A.; Camper, S. A.: Localization of sequences related to the human RAD6 DNA repair gene on mouse chromosomes 11 and 13. Mammalian Genome 6:305-306, 1995.

Cmarik, J. L.; Hegamyer, G.; Gerrard, B.; Dean, M.; Colburn, N. H.: cDNA cloning and mapping of mouse pleckstrin (Plek), a gene upregulated in transformation-resistant cells. Genomics 66:204-212, 2000.

Tyers, M.; Haslam, R. J.; Rachubinski, R. A.; Harley, C. B.: Molecular analysis of pleckstrin: the major protein kinase C substrate of platelets. J. Cell. Biochem. 40:133-145, 1989.

Tyers, M.; Rachubinski, R. A.; Stewart, M. I.; Varrichio, A. M.; Shorr, R. G. L.; Haslam, R. J.; Harley, C. B.: Molecular cloning and expression of the major protein kinase C substrate of platelets. Nature 333:470-473, 1988.

Tobe, T.; Minoshima, S.; Yamase, S.; Choi, N.-H.; Tomita, M.; Shimizu, N.: Assignment of a human serum glycoprotein SP-40,40 gene (CLI) to chromosome 8. Cytogenet. Cell Genet. 57:193-195, 1991.

Wong, P.; Pineault, J.; Lakins, J.; Taillefer, D.; Leger, J.; Wang, C.; Tenniswood, M.: Genomic organization and expression of the rat TRPM-2 (clusterin) gene, a gene implicated in apoptosis. J. Biol. Chem. 268:5021-5031, 1993.

Wong, P.; Taillefer, D.; Lakins, J.; Pineault, J.; Chader, G.; Tenniswood, M.: Molecular characterization of human TRPM-2/clusterin, a gene associated with sperm maturation, apoptosis and neurodegeneration. Europ. J. Biochem. 221:917-925, 1994.

Nadeau, J. H.: Modifier genes in mice and human S. Nature Rev. 2:165-174, 2001.

Phillips, S. A.; Barr, V. A.; Haft, D. H.; Taylor, S. I.; Haft, C. R.: Identification and characterization of SNX15, a novel sorting nexin involved in protein trafficking. J. Biol. Chem. 276:5074-5084, 2001.

Roberts, W. M.; Look, A. T.; Ruossel, M. F.; Sherr, C. J.: Tandem linkage of human CSF-1 receptor (c-fms) and PDGF receptor genes. Cell 55:655-661, 1988.

Smith, E. A.; Seldin, M. F.; Martinez, L.; Watson, M. L.; Ghosh Choudhury, G.; Lalley, P. A.; Pierce, J.; Aaronson, S.; Barker, J.; Naylor, S. L.; Sakaguchi, A. Y.: Mouse platelet-derived growth factor receptor alpha gene is deleted in W-19H and patch mutations on chromosome 5. Proc. Nat. Acad. Sci. 88:4811-4815, 1991.

Stenman, G.; Eriksson, A.; Claesson-Welsh, L.: Human PDGFA receptor gene maps to the same region on chromosome 4 as the KIT oncogene. Genes Chromosomes Cancer 1:155-158, 1989.

Stephenson, D. A.; Mercola, M.; Anderson, E.; Wang, C.; Stiles, C. D.; Bowen-Pope, D. F.; Chapman, V. M.: Platelet-derived growth factor receptor alpha-subunit gene (Pdgfra) is deleted in the mousepatch (Ph) mutation. Proc. Nat. Acad. Sci. 88:6-10, 1991.

Xie, J.; Aszterbaum, M.; Zhang, X.; Bonifas, J. M.; Zachary, C.; Epstein, E.; McCormick, F.: A role of PDGFR-alpha in basal cell carcinoma proliferation. Proc. Nat. Acad. Sci. 98:9255-9259, 2001.

Nekrep, N.; Jabrane-Ferrat, N.; Wolf, H. M.; Eibl, M. M.; Geyer, M.; Peterlin, B. M.: Mutation in a winged-helix DNA-binding motif causes atypical bare lymphocyte syndrome. Nature Immun. 30 Sept., 2002. Note: Advance Electronic Publication.

Hoffman, H. M.; Mueller, J. L.; Broide, D. H.; Wanderer, A. A.; Kolodner, R. D.: Mutation of a new gene encoding a putative pyrin-like protein causes familial cold autoinflammatory syndrome and Muckle-Wells syndrome. Nature Genet. 29:301-305, 2001.

Leibiger, B.; Leibiger, I. B.; Moede, T.; Kemper, S.; Kulkarni, R. N.; Kahn, C. R.; de Vargas, L. M.; Berggren, P.-O.: Selective insulin signaling through A and B insulin receptors regulates transcription of insulin and glucokinase genes in pancreatic beta cells. Molec. Cell 7:559-570, 2001.

Gervais, F. G.; Xu, D.; Robertson, G. S.; Vaillancourt, J. P.; Zhu, Y.; Huang, J.; LeBlanc, A.; Smith, D.; Rigby, M.; Shearman, M. S.; Clarke, E. E.; Zheng, H.; Van Der Ploeg, L. H. T.; Ruffolo, S. C.; Thornberry, N. A.; Xanthoudakis, S.; Zamboni, R. J.; Roy, S.; Nicholson, D. W.: Involvement of caspases in proteolytic cleavage of Alzheimer's amyloid-beta precursor protein and amyloidogenic A-betapeptide formation. Cell 97:395-406, 1999.

Gotz, J.; Chen, F.; van Dorpe, J.; Nitsch, R. M.: Formation of neurofibrillary tangles in P301L tau transgenic mice induced by A-beta42 fibrils. Science 293:1491-1495, 2001.

Borrow, J.; Shearman, A. M.; Stanton, V. P., Jr.; Becher, R.; Collins, T.; Williams, A. J.; Dube, I.; Katz, F.; Kwong, Y. L.; Morris, C.; Ohyashiki, K.; Toyama, K.; Rowley, J.; Housman, D. E.: The t(7;11)(p15;p15) translocation in acute myeloid leukaemia fuses the genes for nucleoporin NUP98 and class I homeoprotein HOXA9. Nature Genet. 12:159-167, 1996.

Aburatani, H.; Hippo, Y.; Ishida, T.; Takashima, R.; Matsuba, C.; Kodama, T.; Takao, M.; Yasui, A.; Yamamoto, K.; Asano, M.; Fukasawa, K.; Yoshinari, T.; Inoue, H.; Ohtsuka, E.; Nishimura, S.: Cloning and characterization of mammalian 8-hydroxyguanine-specific DNA glycosylase/apurinic, a pyrimidinic lyase, a functional mutM homologue. Cancer Res. 57:2151-2156, 1997.

Arai, K.; Morishita, K.; Shinmura, K.; Kohno, T.; Kim, S.-R.; Nohmi, T.; Taniwaki, M.; Ohwada, S.; Yokota, J.: Cloning of a human homolog of the yeast OGG1 gene that is involved in the repair of oxidative DNA damage. Oncogene 14:2857-2861, 1997.

Audebert, M.; Chevillard, S.; Levalois, C.; Gyapay, G.; Vieillefond, A.; Klijanienko, J.; Vielh, P.; El Naggar, A. K.; Oudard, S.; Boiteux, S.; Radicella, J. P.: Alterations of the DNA repair gene OGG1 in human clear cell carcinomas of the kidney. Cancer Res. 60:4740-4744, 2000.

Bjoras, M.; Luna, L.; Johnsen, B.; Hoff, E.; Haug, T.; Rognes, T.; Seeberg, E.: Opposite base-dependent reactions of a human base excision repair enzyme on DNA containing 7,8-dihydro-8-oxoguanine and abasic sites. EMBO J. 16:6314-6322, 1997.

Ishida, T.; Hippo, Y.; Nakahori, Y.; Matsushita, I.; Kodama, T.; Nishimura, S.; Aburatani, H.: Structure and chromosome location of human OGG1. Cytogenet. Cell Genet. 85:232-236, 1999.

Kohno, T.; Shinmura, K.; Tosaka, M.; Tani, M.; Kim, S.-R.; Sugimura, H.; Nohmi, T.; Kasai, H.; Yokota, J.: Genetic polymorphisms and alternative splicing of the hOGG1 gene, that is involved in the repair of 8-hydroxyguanine in damaged DNA. Oncogene 16:3219-3225, 1998.

Kuo, F. C.; Sklar, J.: Augmented expression of a human gene for 8-oxoguanine DNA glycosylase (MutM) in B lymphocytes of the dark zone in lymph node germinal centers. J. Exp. Med. 186:1547-1556, 1997.

Lu, R.; Nash, H. M.; Verdine, G. L.: A mammalian DNA repair enzyme that excises oxidatively damaged guanines maps to a locus frequently lost in lung cancer. Curr. Biol. 7:397-407, 1997.

Radicella, J. P.; Dherin, C.; Desmaze, C.; Fox, M. S.; Boiteux, S.: Cloning and characterization of hOGG1, a human homolog of the OGG1 gene of Saccharomyces cerevisiae. Proc. Nat. Acad. Sci. 94:8010-8015, 1997.

Burtis, K. C.; Baker, B. S.: Drosophila double sex gene controls somatic sexual differentiation by producing alternatively spliced mRNAs encoding related sex-specific polypeptides. Cell 56:997-1010,1989.

Simon, A. R.; Vikis, H. G.; Stewart, S.; Fanburg, B. L.; Cochran, B. H.; Guan, K.-L.: Regulation of STAT3 by direct binding to the Rac1 GTPase. Science 290:144-147, 2000.

Schenker, T.; Lach, C.; Kessler, B.; Calderara, S.; Trueb, B.:A novel GTP-binding protein which is selectively repressed in SV40 transformed fibroblasts. J. Biol. Chem. 269:25447-25453, 1994.

Daigo, Y.; Suzuki, K.; Maruyama, O.; Miyoshi, Y.; Yasuda, T.; Kabuto, T.; Imaoka, S.; Fujiwara, T.; Takahashi, E.; Fujino, M. A.; Nakamura, Y.: Isolation, mapping, and mutation analysis of a human cDNA homologous to the doc-1 gene of the Chinese hamster, a candidate tumor suppressor for oral cancer. Genes Chromosomes Cancer 20:204-207, 1997.

Todd, R.; McBride, J.; Tsuji, T.; Donoff, R. B.; Nagai, M.; Chou, M. Y.; Chiang, T.; Wong, D. T. W.: Deleted in oral cancer-1 (doc-1), a novel oral tumor suppressor gene. FASEB J. 1362-1370, 1995.

Yamagata, T.; Tsuru, T.; Momoi, M. Y.; Suwa, K.; Nozaki, Y.; Mukasa, T.; Ohashi, H.; Fukushima, Y.; Momoi, T.: Genome organization of human 48-kDa oligosaccharyltransferase (DDOST). Genomics 45:535-540,1997.

Caplen, N. J.; Taylor, J. P.; Statham, V. S.; Tanaka, F.; Fire, A.; Morgan, R. A.: Rescue of polyglutamine-mediated cytotoxicity by double-stranded RNA-mediated RNA interference. Hum. Molec. Genet. 11:175-184, 2002.

La Spada, A. R.; Wilson, E. M.; Lubahn, D. B.; Harding, A. E.; Fischbeck, K. H.: Androgen receptor gene mutations in X-linked spinal and bulbar muscular atrophy. Nature 352:77-79, 1991.

Iizasa, T.; Taira, M.; Shimada, H.; Ishijima, S.; Tatibana, M.: Molecular cloning and sequencing of human cDNA for phosphoribosylpyrophosphate synthetase subunit II. FEBS Lett. 244:47-50, 1989.

Taira, M.; Ishijima, S.; Kita, K.; Yamada, K.; Iizasa, T.; Tatibana, M.: Nucleotide and deduced amino acid sequences of two distinct cDNAsfor rat phosphoribosylpyrophosphate synthetase. J. Biol. Chem. 262:14867-14870, 1987.

Taira, M.; Kudoh, J.; Minoshima, S.; Iizasa, T.; Shimada, H.; Shimizu, Y.; Tatibana, M.; Shimizu, N.: Localization of human phosphoribosylpyrophosphate synthetase subunit I and II genes (PRPS1 and PRPS2) to different regions of the X chromosome and assignment of two PRPS1-related genes to autosomes. Somat. Cell Molec. Genet. 15:29-37, 1989.

Wang, J. C.; Passage, M. B.; Ellison, J.; Becker, M. A.; Yen, P. H.; Shapiro, L. J.; Mohandas, T. K.: Physical mapping of loci in the distal half of the short arm of the human X chromosome: implications for the spreading of X-chromosome inactivation. Somat. Cell Molec. Genet. 18:195-200, 1992.

Sullivan, J. L.; Byron, K. S.; Brewster, F. E.; Baker, S. M.; Ochs, H. D.: X-linked lympho proliferative syndrome: natural history of the immuno deficiency. J. Clin. Invest. 71:1765-1778, 1983.

Sullivan, J. L.; Byron, K. S.; Brewster, F. E.; Purtilo, D. T.: Deficient natural killer cell activity in X-linked lymphoproliferative syndrome. Science 210:543-545, 1980.

Sumazaki, R.; Kanegane, H.; Osaki, M.; Fukushima, T.; Tsuchida, M.; Matsukura, H.; Shinozaki, K.; Kimura, H.; Matsui, A.; Miyawaki, T.: SH2D1A mutations in Japanese males with severe Epstein-Barr virus-associated illnesses. Blood 98:1268-1270, 2001.

Sumegi, J.; Gross, T. G.; Seemayer, T. A.: The molecular geneticsof X-linked lymphoproliferative (Duncan's) disease. Cancer J. Sci. Am. 5:57-62, 1999.

Sumegi, J.; Huang, D.; Lanyi, A.; Davis, J. D.; Seemayer, T. A.; Maeda, A.; Klein, G.; Seri, M.; Wakiguchi, H.; Purtilo, D. T.; Gross, T. G.: Correlation of mutations of the SH2D1A gene and Epstein-Barr virus infection with clinical phenotype and outcome in X-linked lympho proliferative disease. Blood 96:3118-3125, 2000.

Xiang, X.; Benson, K. F.; Chada, K.: Mini-mouse: disruption of the pygmy locus in a transgenic insertional mutant. Science 247:967-969, 1990.

Scriver, C. R.: Vitamin B6 deficiency and dependency in man. Am. J. Dis. Child. 113:109-114, 1967.

Scriver, C. R.; Hutchison, J. H.: The vitamin B6 deficiency syndrome in human infancy: biochemical and clinical observations. Pediatrics 31:240-250, 1963.

Wolpert, S. M.; Barnes, P. D.: MRI in Pediatric Neuroradiology. MosbyYear Book, St. Louis , 1992.

Aagaard, L.; Laible, G.; Selenko, P.; Schmid, M.; Dorn, R.; Schotta, G.; Kuhfittig, S.; Wolf, A.; Lebersorger, A.; Singh, P. B.; Reuter, G.; Jenuwein, T.: Functional mammalian homologues of the DrosophilaPEV-modifier Su (var)3-9 encode centromere-associated proteins which complex with the heterochromatin component M31. EMBO J. 18:1923-1938, 1999.

Bannister, A. J.; Zegerman, P.; Partridge, J. F.; Miska, E. A.; Thomas, J. O.; Allshire, R. C.; Kouzarides, T.: Selective recognition of methylated lysine 9 on histone H3 by the HP1 chromo domain. Nature 410:120-124, 2001.

Connors, T. D.; Van Raay, T. J.; Petry, L. R.; Klinger, K. W.; Landes, G. M.; Burn, T. C.: The cloning of a human ABC gene (ABC3) mapping to chromosome 16p13.3. Genomics 39:231-234, 1997.

Klugbauer, N.; Hofmann, F.: Primary structure of a novel ABC transporter with a chromosomal localization on the band encoding the multidrug resistance-associated protein. FEBS Lett. 391:61-65, 1996.

Wu, Y.-C.; Horvitz, H. R.: The C. elegans cell corpse engulfment gene ced-7 encodes a protein similar to ABC transporters. Cell 93:951-960, 1998.

Toshima, J.; Ohashi, K.; Okano, I.; Nunoue, K.; Kishioka, M.; Kuma, K.; Miyata, T.; Hirai, M.; Baba, T.; Mizuno, K.: Identification and characterization of a novel protein kinase, TESK1, specifically expressed in testicular germ cells. J. Biol. Chem. 270:31331-31337, 1995.

Toshima, J.; Toshima, J. Y.; Suzuki, M.; Noda, T.; Mizuno, K.:Cell-type-specific expression of a TESK1 promoter-linked lacZ gene in transgenic mice. Biochem. Biophys. Res. Commun. 286:566-573,2001.

Garcia-Anoveros, J.; Derfler, B.; Neville-Golden, J.; Hyman, B. T.; Corey, D. P.: BNaC1 and BNaC2 constitute a new family of human neuronal sodium channels related to degenerins and epithelial sodium channels. Proc. Nat. Acad. Sci. 94:1459-1464, 1997.

Price, M. P.; Lewin, G. R.; McIlwrath, S. L.; Cheng, C.; Xie, J.; Heppenstall, P. A.; Stucky, C. L.; Mannsfeldt, A. G.; Brennan, T. J.; Drummond, H. A.; Qiao, J.; Benson, C. J.; Tarr, D. E.; Hrstka, R. F.; Yang, B.; Williamson, R. A.; Welsh, M. J.: The mammalian sodium channel BNC1 is required for normal touch sensation. Nature 407:1007-1011, 2000.

Price, M. P.; Snyder, P. M.; Welsh, M. J.: Cloning and expression of a novel human brain Na+ channel. J. Biol. Chem. 271:7879-7882,1996.

Waldmann, R.; Champigny, G.; Voilley, N.; Lauritzen, I.; Lazdunski, M.: The mammalian degenerin MDEG, an amiloride-sensitive cation channel activated by mutations causing neuro degeneration in Caenorhabditiselegans. J. Biol. Chem. 271:10433-10436, 1996.

Waldmann, R.; Voilley, N.; Mattei, M.-G.; Lazdunski, M.: The human degenerin MDEG, an amiloride-sensitive neuronal cation channel, is localized on chromosome 17q11.2-17q12 close to the microsatellite D17S798. Genomics 37:269-270, 1996.

Shearman, L. P.; Sriram, S.; Weaver, D. R.; Maywood, E. S.; Chaves, I.; Zheng, B.; Kume, K.; Lee, C. C.; van der Horst, G. T. J.; Hastings, M. H.; Reppert, S. M.: Interacting molecular loops in the mammalian circadian clock. Science 288: 1013-1019, 2000.

Langbein, L.; Rogers, M. A.; Winter, H.; Silke, P.; Beckhaus, U.; Rackwitz, H.-R.; Schweizer, J.: The catalog of human hair keratins. I. Expression of the nine type I members in the hair follicle. J. Biol. Chem. 274:19874-19884, 1999.

Rogers, M. A.; Winter, H.; Wolf, C.; Heck, M.; Schweizer, J.: Characterization of a 190-kilobase pair domain of human type I hair keratin genes. J. Biol. Chem. 273:26683-26691, 1998.

Broccardo, C.; Troffer-Charlier, N.; Savary, S.; Mandel, J. L.; Chimini, G.: Exon organisation of the mouse gene encoding the adrenoleuko dystrophy related protein (ALDRP). Europ. J. Hum. Genet. 6:638-641, 1998.

Lombard-Platet, G.; Savary, S.; Sarde, C.-O.; Mandel, J.-L.; Chimini, G.: A close relative of the adrenoleuko dystrophy (ALD) gene codes for a peroxisomal protein with a specific expression pattern. Proc. Nat. Acad. Sci. 93:1265-1269, 1996.

Savary, S.; Troffer-Charlier, N.; Gyapay, G.; Mattei, M.-G.; Chimini, G.: Chromosomal localization of the adrenoleuko dystrophy-related gene in man and mice. Europ. J. Hum. Genet. 5:99-101, 1997.

Kaiser, P.; Seufert, W.; Hofferer, L.; Kofler, B.; Sachsenmaier, C.; Herzog, H.; Jentsch, S.; Schweiger, M.; Schneider, R.: human ubiquitin-conjugating enzyme homologous to yeast UBC8. J. Biol. Chem. 269:8797-8802, 1994.

Gray, G. E.; Mann, R. S.; Mitsiadis, E.; Henrique, D.; Carcangiu, M.-L.; Banks, A.; Leiman, J.; Ward, D.; Ish-Horowitz, D.; Artavanis-Tsakonas, S.: Human ligands of the Notch receptor. Am. J. Path. 154:785-794,1999.

Wishart, M. J.; Taylor, G. S.; Slama, J. T.; Dixon, J. E.: PTEN and myotubularin phosphoinositide phosphatases: bringing bioinformatics to the lab bench. Cell Biol. 13:172-181, 2001.

Jacquemin, P.; Depetris, D.; Mattei, M.-G.; Martial, J. A.; Davidson, I.: Localization of human transcription factor TEF-4 and TEF-5 (TEAD2, TEAD3) genes to chromosomes 19q13.3 and 6p21.2 using fluorescence in situ hybridization and radiation hybrid analysis. Genomics 55:127-129, 1999.

Kai, M.; Sakane, F.; Imai, S.; Wada, I.; Kanoh, H.: molecular cloning of a diacyl glycerol kinase isozyme predominantly expressed in human retina with a truncated and inactive enzyme expression in most other human cells. J. Biol. Chem. 269:18492-18498, 1994.

Masai, I.; Okazaki, A.; Hosoya, T.; Hotta, Y.: Drosophila retinal degeneration A gene encodes an eye-specific diacylglycerol kinase with cysteine-rich zinc-finger motifs and ankyrin repeats. Proc. Nat. Acad. Sci. 90:11157-11161, 1993.

Stohr, H.; Klein, J.; Gehrig, A.; Koehler, M. R.; Jurklies, B.; Kellner, U.; Leo-Kottler, B.; Schmid, M.; Weber, B. H. F.: Mapping and genomic characterization of the gene encoding diacyl glycerol kinase gamma (DAGK3): assessment of its role in dominant optic atrophy (OPA1). Hum. Genet. 104:99-105, 1999.

Chan, J. Y.; Han, X.-L.; Kan, Y. W.: Isolation of cDNA encoding the human NF-E2 protein. Proc. Nat. Acad. Sci. 90:11366-11370,1993.

Peters, L. L.; Andrews, N. C.; Eicher, E. M.; Davidson, M. B.; Orkin, S. H.; Lux, S. E.: Mouse microcytic anaemia caused by a defect in the gene encoding the globin enhancer-binding protein NF-E2. Nature 362:768-770, 1993.

Peters, L. L.; Bishop, T. R.; Andrews, N. C.: Globin-enhancer binding factor NF-E2 is implicated in the regulation of heme biosynthesis and iron uptake in mk/mk mice. (Abstract) Blood 82 (suppl. 1):179a,1993.

Shivdasani, R. A.; Orkin, S. H.: Erythropoiesis and globin gene expression in mice lacking the transcription factor NF-E2. Proc. Nat. Acad. Sci. 92:8690-8694, 1995.

Shivdasani, R. A.; Rosenblatt, M. F.; Zucker-Franklin, D.; Jackson, C. W.; Hunt, P.; Saris, C. J. M.; Orkin, S. H.: Transcription factor NF-E2 is required for platelet formation independent of the actions of thrombopoietin/MGDF in megakaryocyte development. Cell 81:695-704,1995.

Weremowicz, S.; Andrews, N. C.; Orkin, S. H.; Morton, C. C.: Mapping the p45 subunit of human NFE2 to 12q13. (Abstract) Human Genome MappingWorkshop 93 25, 1993.

Fogli, A.; Giglio, S.; Arrigo, G.; Lo Nigro, C.; Zollo, M.; Viggiano, L.; Rocchi, M.; Archidiacono, N.; Zuffardi, O.; Carrozzo, R.: Identification of two paralogous regions mapping to the short and long arms of human chromosome 2 comprising LIS1 pseudogenes. Cytogenet. Cell Genet. 86:225-232, 1999.

Dubrovskaya, V.; Lavigne, A.-C.; Davidson, I.; Acker, J.; Staub, A.; Tora, L.: Distinct domains of hTAFII100 are required for functional interaction with transcription factor TFIIF-beta (RAP30) and incorporation into the TFIID complex. EMBO J. 15:3702-3712, 1996.

Dubrovskaya, V.; Mattei, M.-G.; Tora, L.: Localization of the gene (TAF2D) encoding the 100-kDa subunit (hTAFII100) of the human TFIID complex to chromosome 10 band q24-q25.2. Genomics 36:556-557,1996.

Tanese, N.; Saluja, D.; Vassallo, M. F.; Chen, J.-L.; Admon, A.: Molecular cloning and analysis of two subunits of the human TFIID complex: hTAFII130 and hTAFII100. Proc. Nat. Acad. Sci. 93:13611-13616,1996.

Tao, Y.; Guermah, M.; Martinez, E.; Oelgeschlager, T.; Hasegawa, S.; Takada, R.; Yamamoto, T.; Horikoshi, M.; Roeder, R. G.: Specific interactions and potential functions of human TAF(II)100. J. Biol. Chem. 272:6714-6721, 1997.

Charlier, C.; Coppieters, W.; Farnir, F.; Grobet, L.; Leroy, P. L.; Michaux, C.; Mni, M.; Schwers, A.; Vanmanshoven, P.; Hanset, R.; Georges, M.: The mh gene causing double-muscling in cattle maps tobovine chromosome 2. Mammalian Genome 6:788-792, 1995.

Ferrell, R. E.; Conte, V.; Lawrence, E. C.; Roth, S. M.; Hagberg, J. M.; Hurley, B. F.: Frequent sequence variation in the human myostatin (GDF8) gene as a marker for analysis of muscle-related phenotypes. Genomics 62:203-207, 1999.

Gonzalez-Cadavid, N. F.; Taylor, W. E.; Yarasheski, K.; Sinha-Hikim, I.; Ma, K.; Ezzat, S.; Shen, R.; Lalani, R.; Asa, S.; Mamita, M.; Nair, G.; Arver, S.; Bhasin, S.: Organization of the human myostatin gene and expression in healthy men and HIV-infected men with musclewasting. Proc. Nat. Acad. Sci. 95:14938-14943, 1998.

Grobet, L.; Martin, L. J. R.; Poncelet, D.; Pirottin, D.; Brouwers, B.; Riquet, J.; Schoeberlein, A.; Dunner, S.; Menissier, F.; Massabanda, J.; Fries, R.; Hanset, R.; Georges, M.: A deletion in the bovine myostatin gene causes the double-muscled phenotype in cattle. Nature Genet. 17:71-74, 1997.

Orstavik, S.; Solberg, R.; Tasken, K.; Nordahl, M.; Altherr, M. R.; Hansson, V.; Jahnsen, T.; Sandberg, M.: Molecular cloning, cDNAstructure, and chromosomal localization of the human type II cGMP-dependent protein kinase. Biochem. Biophys. Res. Commun. 220:759-765, 1996.

Pfeifer, A.; Aszodi, A.; Seidler, U.; Ruth, P.; Hofmann, F.; Fassler, R.: Intestinal secretory defects and dwarfism in mice lacking cGMP-dependent protein kinase II. Science 274: 2082-2084, 1996.

Berge-Lefranc, J.-L.; Jay, P.; Massacrier, A.; Cau, P.; Mattei, M. G.; Bauer, S.; Marsollier, C.; Berta, P.; Fontes, M.: characterization of the human jumonji gene. Hum. Molec. Genet. 5:1637-1641, 1996.

Toyoda, M.; Kojima, M.; Takeuchi, T.: Jumonji is a nuclear protein that participates in the negative regulation of cell growth. Biochem. Biophys. Res. Commun. 274:332-336, 2000.

Clarke, E. P.; Sanwal, B. D.: Cloning of a human collagen-binding protein, and its homology with rat gp46, chick hsp47 and mouse J6 proteins. Biochim. Biophys. Acta 1129:246-248, 1992.

Ikegawa, S.; Nakamura, Y.: Structure of the gene encoding human colligin-2 (CBP2). Gene 194:301-303, 1997.

Ikegawa, S.; Sudo, K.; Okui, K.; Nakamura, Y.: Isolation, characterization and chromosomal assignment of human colligin-2 gene (CBP2). Cytogenet. Cell Genet. 71:182-186, 1995.

Furukawa, K.; Soejima, H.; Niikawa, N.; Shiku, H.; Furukawa, K.: Genomic organization and chromosomal assignment of the human beta-1,4-N-acetylgalactosaminyl-transferase gene. J. Biol. Chem. 271:20836-20844, 1996.

Nagata, Y.; Yamashiro, S.; Yodoi, J.; Lloyd, K. O.; Shiku, H.; Furukawa, K.: Expression cloning of beta-1,4-N-acetyl-galactosaminyltransferasec DNAs that determine the expression of G(M2) and G(D2) gangliosides. J. Biol. Chem. 267: 12082-12089, 1992.

Hamlin, P. J.; Jones, P. F.; Leek, J. P.; Bransfield, K.; Lench, N. J.; Aldersley, M. A.; Howdle, P. D.; Markham, A. F.; Robinson, P. A.: Assignment of GALGT encoding beta-1,4N-acetylgalactosaminyl-transferase (GalNAc-T) and KIF5A encoding neuronal kinesin (D12S1889) to human chromosome band 12q13 by assignment to ICI YAC 26EG10 and in situ hybridization. Cytogenet. Cell Genet. 82:267-268, 1998.

Kosaki, K.; Bassi, M. T.; Kosaki, R.; Lewin, M.; Belmont, J.; Schauer, G.; Casey, B.: Characterization and mutation analysis of human LEFTYA and LEFTY B, homologues of murine genes implicated in left-right axis development. Am. J. Hum. Genet. 64:712-721, 1999.

Kothapalli, R.; Buyuksal, I.; Wu, S.-Q.; Chegini, N.; Tabibzadeh, S.: Detection of ebaf, a novel human gene of the transforming growth factor beta superfamily: association of gene expression with endometrial bleeding. J. Clin. Invest. 99:2342-2350, 1997.

Meno, C.; Itoh, Y.; Saijoh, Y.; Matsuda, Y.; Tashiro, K.; Kuhara, S.; Hamada, H.: Two closely-related left-right asymmetrically expressed genes, lefty-1 and lefty-2: their distinct expression domains, chromosomallinkage and direct neuralizing activity in Xenopus embryos. Genes Cells 2:513-524, 1997.

Meno, C.; Saijoh, Y.; Fujii, H.; Ikeda, M.; Yokoyama, T.; Yokoyama, M.; Toyoda, Y.; Hamada, H.: Left-right asymmetric expression of the TGF-beta-family member lefty in mouse embryos. Nature 381:151-155,1996.

Meno, C.; Shimono, A.; Saijoh, Y.; Yashiro, K.; Mochida, K.; Ohishi, S.; Noji, S.; Kondoh, H.; Hamada, H.: Lefty-1 is required for left-right determination as a regulator of lefty-2 and nodal. Cell 94:287-297,1998.

Tabibzadeh, S.; Mason, J. M.; Shea, W.; Cai, Y.; Murray, M. J.; Lessey, B.: Dysregulated expression of ebaf, a novel molecular defectin the endometria of patients with infertility. J. Clin. Endocr. Metab. 85:2526-2536, 2000.

Caterina, M. J.; Leffler, A.; Malmberg, A. B.; Martin, W. J.; Trafton, J.; Petersen-Zeltz, K. R.; Koltzenburg, M.; Basbaum, A. I.; Julius, D.: Impaired nociception and pain sensation in mice lacking the capsaicinreceptor. Science 288:306-313, 2000.

Caterina, M. J.; Schumacher, M. A.; Tominaga, M.; Rosen, T. A.; Levine, J. D.; Julius, D.: The capsaicin receptor: a heat-activatedion channel in the pain pathway. Nature 389: 816-824, 1997.

Jordt, S.-E.; Julius, D.: Molecular basis for species-specific sensitivity to 'hot' chili peppers. Cell 108:421-430, 2002.

Liedtke, W.; Choe, Y.; Marti-Renom, M. A.; Bell, A. M.; Denis, C. S.; Sali, A.; Hudspeth, A. J.; Friedman, J. M.; Heller, S.: Vanilloidreceptor-related osmotically activated channel (VR-OAC), a candidate vertebrate osmoreceptor. Cell 103: 525-535, 2000.

Liu, L.; Simon, S. A.: Similarities and differences in the currents activated by capsaicin, piperine, and zingerone in rat trigeminal ganglion cells. J. Neurophysiol. 76:1858-1869, 1996.

Prescott, J.; Stevenson, R. J.: Psychophysical responses to single and multiple presentations of the oral irritant zingerone: relationship to frequency of chili consumption. Physiol. Behav. 60:617-624,1996.

Stevenson, R. J.; Prescott, J.: The effects of prior experience with capsaicin on ratings of its burn. Chem. Senses 19:651-656,1994.

Stevenson, R. J.; Yeomans, M. R.: Differences in ratings of intensity and pleasantness for the capsaicin burn between chili likers and non-likers:implications for liking development. Chem. Senses 18:471-482, 1993.

Trevisani, M.; Smart, D.; Gunthorpe, M. J.; Tognetto, M.; Barbieri, M.; Campi, B.; Amadesi, S.; Gray, J.; Jerman, J. C.; Brough, S. J.; Owen, D.; Smith, G. D.; Randall, A. D.; Harrison, S.; Bianchi, A.; Davis, J. B.; Geppetti, P.: Ethanol elicits and potentiates nociceptor responses via the vanilloid receptor-1. Nature Neurosci. 5:546-551,2002.

Wang, Y.; Macke, J. P.; Abella, B. S.; Andreasson, K.; Worley, P.; Gilbert, D. J.; Copeland, N. G.; Jenkins, N. A.; Nathans, J.:A large family of putative transmembrane receptors homologous to the product of the Drosophila tissue polarity gene frizzled. J. Biol. Chem. 271:4468-4476, 1996.

Bell, S. P.; Learned, R. M.; Jantzen, H.-M.; Tjian, R.: Functional cooperativity between transcription factors UBF1 and SL1 mediates human ribosomal RNA synthesis. Science 241:1192-1197, 1988.

Chan, E. K. L.; Imai, H.; Hamel, J. C.; Tan, E. M.: Human autoantibody to RNA polymerase I transcription factor hUBF: molecular identity of nucleolus organizer region autoantigen NOR-90 and ribosomal RNA transcription upstream binding factor. J. Exp. Med. 174:1239-1244,1991.

Hisatake, K.; Nishimura, T.; Maeda, Y.; Hanada, K.; Song, C.-Z.; Muramatsu, M.: Cloning and structural analysis of cDNA and the gene for mouse transcription factor UBF. Nuc. Acids Res. 19:4631-4637,1991.

Jantzen, H.-M.; Admon, A.; Bell, S. P.; Tjian, R.: Nucleolar transcription factor hUBF contains a DNA-binding motif with homology to HMG proteins. Nature 344:830-836, 1990.

Jones, K. A.; Black, D. M.; Griffiths, B. L.; Solomon, E.: Localization of the human RNA polymerase I transcription factor gene (UBTF) to the S17S183 locus on chromosome 17q21 and construction of a long-range restriction map of the region. Genomics 30:602-604, 1995.

Matera, A. G.; Wu, W.; Imai, H.; O'Keefe, C. L.; Chan, E. K. L.: Molecular cloning of the RNA polymerase I transcription factor hUBF/NOR-90(UBTF) gene and localization to 17q21.3 by fluorescence in situ hybridization and radiation hybrid mapping. Genomics 41:135-138, 1997.

O'Mahony, D. J.; Rothblum, L. I.: Identification of two formsof the RNA polymerase I transcription factor UBF. Proc. Nat. Acad. Sci. 88:3180-3184, 1991.

Konishi, H.; Tsutsui, H.; Murakami, T.; Yumikura-Futatsugi, S.; Yamanaka, K.; Tanaka, M.; Iwakura, Y.; Suzuki, N.; Takeda, K.; Akira, S.; Nakanishi, K.; Mizutani, H.: IL-18 contributes to the spontaneous development of atopic dermatitis-like inflammatory skin lesion independently of IgE/stat6 under specific pathogen-free conditions. Proc. Nat. Acad. Sci. 99:11340-11345, 2002.

Nolan, K. F.; Greaves, D. R.; Waldmann, H.: The human interleukin 18 gene IL18 maps to 11q22.2-q22.3, closely linked to the DRD2 genelocus and distinct from mapped IDDM loci. Genomics 51:161-163,1998.

Okamoto, I.; Kohno, K.; Tanimoto, T.; Iwaki, K.; Ishihara, T.; Akamatsu, S.; Ikegami, H.; Kurimoto, M.: IL-18 prevents the development of chronic graft-versus-host disease in mice. J. Immun. 164:6067-6074,2000.

Okamura, H.; Tsutsui, H.; Komatsu, T.; Yutsudo, M.; Hakura, A.; Tanimoto, T.; Torigoe, K.; Okura, T.; Nukada, Y.; Hattori, K.; Akita, K.; Namba, M.; Tanabe, F.; Konishi, K.; Fukuda, S.; Kurimoto, M.:Cloning of a new cytokine that induces IFN-gamma production by T cells. Nature 378:88-91, 1995.

Reddy, P.; Teshima, T.; Kukuruga, M.; Ordemann, R.; Liu, C.; Lowler, K.; Ferrara, J. L. M.: Interleukin-18 regulates acute graft-versus-host disease by enhancing Fas-mediated donor T cell apoptosis. J. Exp. Med. 194:1433-1440, 2001.

Rothe, H.; Jenkins, N. A.; Copeland, N. G.; Kolb, H.: Active stage of autoimmune diabetes is associated with the expression of a novel cytokine, IGIF, which is located near Idd2. J. Clin. Invest. 99:469-474, 1997.

Sarvetnick, N.: IFN-gamma, IGIF, and IDDM. (Editorial) J. Clin. Invest. 99:371-372, 1997.

Shida, K.; Shiratori, I.; Matsumoto, M.; Fukumori, Y.; Matsuhisa, A.; Kikkawa, S.; Tsuji, S.; Okamura, H.; Toyoshima, K.; Seya, T.:An alternative form of IL-18 in human blood plasma: complex formation with IgM defined by monoclonal antibodies. J. Immun. 166:6671-6679,2001.

Zhao, J.; Dynlacht, B.; Imai, T.; Hori, T.; Harlow, E.: Expression of NPAT, a novel substrate of cyclin E-CDK2, promotes S-phase entry. Genes Dev. 12:456-461, 1998.

Margolis, R. L.; Stine, O. C.; Ward, C. M.; Franz, M. L.; Rosenblatt, A.; Callahan, C.; Sherr, M.; Ross, C. A.; Potter, N. T.: Unstable expansion of the CAG trinucleotide repeat in MAB21L1: report of a second pedigree and effect on protein expression. J. Med. Genet. 36:62-64, 1999.

Mariani, M.; Baldessari, D.; Francisconi, S.; Viggiano, L.; Rocchi, M.; Zappavigna, V.; Malgaretti, N.; Consalez, G. G.: Two murine and human homologs of mab-21, a cell fate determination gene involved in Caenorhabditis elegans neural development. Hum. Molec. Genet. 8:2397-2406, 1999.

Potter, N. T.: Meiotic instability associated with the CAGR1 trinucleotide repeat at 13q13. J. Med. Genet. 34:411-413, 1997.

Margolis, R. L.; Stine, O. C.; McInnis, M. G.; Ranen, N. G.; Rubinsztein, D. C.; Leggo, J.; Brando, L. V. J.; Kidwai, A. S.; Loev, S. J.; Breschel, T. S.; Callahan, C.; Simpson, S. G.; and 12 others: cDNA cloning of a human homologue of the Caenorhabditis elegans cell fate-determininggene mab-21: expression, chromosomal localization and analysis of a highly polymorphic (CAG) n trinucleotide repeat. Hum. Molec. Genet. 5:607-616, 1996.

Altshuler, D.; Daly, M.; Kruglyak, L.: Guilt by association. Nature Genet. 26:135-137, 2000.

Cox, N. J.: Challenges in identifying genetic variation affecting susceptibility to type 2 diabetes: examples from studies of the calpain-10 gene. Hum. Molec. Genet. 10:2301-2305, 2001.

Horikawa, Y.; Oda, N.; Cox, N. J.; Li, X.; Orho-Melander, M.; Hara, M.; Hinokio, Y.; Lindner, T. H.; Mashima, H.; Schwarz, P. E. H.; delBosque-Plata, L.; Horikawa, Y.; and 14 others: Genetic variation in the gene encoding calpain-10 is associated with type 2 diabetes mellitus. Nature Genet. 26:163-175, 2000.

Berg, J. N.; Gallione, C. J.; Stenzel, T. T.; Johnson, D. W.; Allen, W. P.; Schwartz, C. E.; Jackson, C. E.; Porteous, M. E. M.; Marchuk, D. A.: The activin receptor-like kinase 1 gene: genomic structure and mutations in hereditary hemorrhagic telangiectasia type 2. Am. J. Hum. Genet. 61:60-67, 1997.

d'Abronzo, F. H.; Swearingen, B.; Klibanski, A.; Alexander, J. M.: Mutational analysis of activin/transforming growth factor-beta type I and type II receptor kinases in human pituitary tumors. J. Clin. Endocr. Metab. 84:1716-1721, 1999.

Futreal, P. A.; Cochran, C.; Rosenthal, J.; Miki, Y.; Swenson, J.; Hobbs, M.; Bennett, L. M.; Haugen-Strano, A.; Marks, J.; Barrett, J. C.; Tavtigian, S. V.; Shattuck-Eidens, D.; Kamb, A.; Skolnick, M.; Wiseman, R. W.: Isolation of a diverged homeobox gene, MOX1, from the BRCA1 region on 17q21 by solution hybrid capture. Hum. Molec. Genet. 3:1359-1364, 1994.

Jones, K. A.; Black, D. M.; Brown, M. A.; Griffiths, B. L.; Nicolai, H. M.; Chambers, J. A.; Bonjardim, M.; Xu, C.-F.; Boyd, M.; McFarlane, R.; Korn, B.; Poustka, A.; North, M. A.; Schalkwyk, L.; Lehrach, H.; Solomon, E.: The detailed characterisation of a 400 kb cosmid walkin the BRCA1 region: identification and localisation of 10 genes including a dual-specificity phosphatase. Hum. Molec. Genet. 3:1927-1934,1994.

Kamitani, T.; Chang, H.-M.; Rollins, C.; Waneck, G. L.; Yeh, E. T. H.: Correction of the class A defect in glycosylphosphatidylinositol anchor biosynthesis in Ltk-cells by human cDNA clone. J. Biol. Chem. 268:20733-20736, 1993.

Horton, Y. M.; Sullivan, M.; Houslay, M. D.: Molecular cloning of a novel splice variant of human type IVA (PDE-IVA) cyclic AMP phosphodiesterase and localization of the gene to the p13.2-q12 region of human chromosome 19. Biochem. J. 308:683-691, 1995.

Huston, E.; Pooley, L.; Julien, P.; Scotland, G.; McPhee, I.; Sullivan, M.; Bolger, G.; Houslay, M. D.: The human cyclic AMP-specific phosphodiesterase PDE-46 (HSPDE4A4B) expressed in transfected COS7 cells occurs as both particulate and cytosolic species that exhibit distinct kinetics of inhibition by the antidepressant rolipram. J. Biol. Chem. 271: 31334-31344,1996.

Livi, G. P.; Kmetz, P.; McHale, M. M.; Cieslinski, L. B.; Sathe, G. M.; Taylor, D. P.; Davis, R. L.; Torphy, T. J.; Balcarek, J. M.: Cloning and expression of cDNA for a human low-K(m), rolipram-sensitive cyclic AMP phosphodiesterase. Molec. Cell. Biol. 10:2678-2686,1990.

Obernolte, R.; Bhakta, S.; Alvarez, R.; Bach, C.; Zuppan, P.; Mulkins, M.; Jarnagin, K.; Shelton, E. R.: The cDNA of a human lymphocytecyclic-AMP phosphodiesterase (PDE IV) reveals a multigene family. Gene 129:239-247, 1993.

Sullivan, M.; Egerton, M.; Shakur, Y.; Marquardsen, A.; Houslay, M. D.: Molecular cloning and expression, in both COS-1 cells and S. cerevisiae, of a human cytosolic type-IVA, cyclic AMP specific phosphodiesterase (hPDE-IVA-h6.1). Cell. Signal. 6:793-812, 1994.

Sullivan, M.; Rena, G.; Begg, F.; Gordon, L.; Olsen, A. S.; Houslay, M. D.: Identification and characterization of the human homologue of the short PDE4A cAMP-specific phosphodiesterase RD1 (PDE4A1) by analysis of the human HSPDE4A gene locus located at chromosome 19p13.2. Biochem. J. 333:693-703, 1998.

Wilson, M.; Sullivan, M.; Brown, N.; Houslay, M. D.: Purification, characterization and analysis of rolipram inhibition of a human-type IVA cyclic AMP-specific phosphodiesterase expressed in yeast. Biochem. J. 304:407-415, 1994.

Huston, E.; Lumb, S.; Russell, A.; Catterall, C.; Ross, A. H.; Steele, M. R.; Bolger, G. B.; Perry, M. J.; Owens, R. J.; Houslay, M. D.: Molecular cloning and transient expression in COS7 cells of a novel human PDE4B cAMP-specific phosphodiesterase, HSPDE4B3. Biochem. J. 328:549-558, 1997.

Szpirer, C.; Szpirer, J.; Riviere, M.; Swinnen, J.; Vicini, E.; Conti, M.: Chromosomal localization of the human and rat genes (PDE4D and PDE4B) encoding the cAMP-specific phosphodiesterases 3 and 4. Cytogenet. Cell Genet. 69:11-14, 1995.

Xu, R. X.; Hassell, A. M.; Vanderwall, D.; Lambert, M. H.; Holmes, W. D.; Luther, M. A.; Rocque, W. J.; Milburn, M. V.; Zhao, Y.; Ke, H.; Nolte, R. T.: Atomic structure of PDE4: insights into phosphodiesterase mechanism and specificity. Science 288:1822-1825, 2000.

Bolger, G. B.; Erdogan, S.; Jones, R. E.; Loughney, K.; Scotland, G.; Hoffmann, R.; Wilkinson, I.; Farrell, C.; Houslay, M. D.: characterization of five different proteins produced by alternatively spliced mRNAsfrom the human cAMP-specific phosphodiesterase PDE4D gene. Biochem. J. 328:539-548, 1997.

Dudai, Y.; Jan, Y.-N.; Byers, D.; Quinn, W. G.; Benzer, S.: dunce, a mutant of Drosophila deficient in learning. Proc. Nat. Acad. Sci. 73:1684-1688, 1976.

Hansen, G.; Jin, S.-L. C.; Umetsu, D. T.; Conti, M.: Absence of muscarinic cholinergic airway responses in mice deficient in the cyclicnucleotide phosphodiesterase PDE4D. Proc. Nat. Acad. Sci. 97:6751-6756,2000.

Jin, S.-L. C.; Richard, F. J.; Kuo, W.-P.; d'Ercole, A. J.; Conti, M.: Impaired growth and fertility of cAMP-specific phosphodiesterase PDE4D-deficient mice. Proc. Nat. Acad. Sci. 96:11998-12003, 1999.

Zhao, J.; Kennedy, B. K.; Lawrence, B. D.; Barbie, D. A.; Matera, A. G.; Fletcher, J. A.; Harlow, E.: NPAT links cyclin E-Cdk2 to the regulation of replication-dependent histone gene transcription. GenesDev. 14:2283-2297, 2000.

Kalaydjieva, L.; Gresham, D.; Gooding, R.; Heather, L.; Baas, F.; de Jonge, R.; Blechschmidt, K.; Angelicheva, D.; Chandler, D.; Worsley, P.; Rosenthal, A.; King, R. H. M.; Thomas, P. K.: N-myc downstream-regulated gene 1 is mutated in hereditary motor and sensory neuropathy-Lom. Am. J. Hum. Genet. 67:47-58, 2000.

Kalaydjieva, L.; Hallmayer, J.; Chandler, D.; Savov, A.; Nikolova, A.; Angelicheva, D.; King, R. H. H.; Ishpekova, B.; Honeyman, K.; Calafell, F.; Shmarov, A.; Petrova, J.; Turnev, I.; Hristova, A.; Moskov, M.; Stancheva, S.; Petkova, I.; Bittles, A. H.; Georgieva, V.; Middleton, L.; Thomas, P. K.: Gene mapping in Gypsies identifies a novel demyelinating neuropathy on chromosome 8q24. Nature Genet. 14:214-217, 1996.

Tsujikawa, M.; Kurahashi, H.; Tanaka, T.; Okada, M.; Yamamoto, S.; Maeda, N.; Watanabe, H.; Inoue, Y.; Kiridoshi, A.; Matsumoto, K.; Ohashi, Y.; Kinoshita, S.; Shimomura, Y.; Nakamura, Y.; Tano, Y.: Homozygosity mapping of a gene responsible for gelatinous drop-like corneal dystrophy to chromosome 1p. Am. J. Hum. Genet. 63:1073-1077,1998.

Sanford, J. P.; Eddy, R. L.; Doyle, D.; Shows, T. B.: Assignment of human asialoglycoprotein receptor gene (ASGR1) to chromosome 17p11-13. Genomics 11:779-781, 1991.

Falk, C. T.: New family data supporting the MN/GC linkage. (Abstract) Cytogenet. Cell Genet. 37:466, 1984.

Sanford, J. P.; Elliott, R. W.; Doyle, D.: Asialoglycoprotein receptor genes are linked on chromosome 11 in the mouse. DNA 7:721-728, 1988.

Spiess, M.; Schwartz, A. L.; Lodish, H. F.: Sequence of human asialoglycoprotein receptor cDNA: an internal signal sequence for membrane insertion. J. Biol. Chem. 260:1979-1982, 1985.

Cirullo, R. E.; Arredondo-Vega, F. X.; Smith, M.; Wasmuth, J. J.: Isolation and characterization of interspecific heat-resistant hybrids between a temperature-sensitive Chinese hamster cell asparaginyl-tRNA synthetase mutant and normal human leukocytes: assignment of human AsnS gene to chromosome 18. Somat. Cell Genet. 9:215-233, 1983.

Shows, T. B.: Personal Communication. Buffalo, N. Y. Jan. 11, 1983.

Akasaka, T.; Miura, I.; Takahashi, N.; Akasaka, H.; Yonetani, N.; Ohno, H.; Fukuhara, S.; Okuma, M.: A recurring translocation, t (3;6)(q27; p21), in non-Hodgkin's lymphoma results in replacement of the 5-prime regulatory region of BCL6 with a novel H4 histone gene. Cancer Res. 57:7-12, 1997.

Baron, B. W.; Nucifora, G.; McCabe, N.; Espinosa, R., III; Le Beau, M. M.; McKeithan, T. W.: Identification of the gene associated with the recurring chromosomal translocations t (3;14)(q27; q32) and t (3;22)(q27; q11) in B-cell lymphomas. Proc. Nat. Acad. Sci. 90:5262-5266, 1993.

Capello, D.; Carbone, A.; Pastore, C.; Gloghini, A.; Saglio, G.; Gaidano, G.: Point mutations of the BCL-6 gene in Burkitt's syndrome. Brit. J. Haemat. 99:168-170, 1997.

Cattoretti, G.; Chang, C.-C.; Cechova, K.; Zhang, J.; Ye, B. H.; Falini, B.; Louie, D. C.; Offit, K.; Chaganti, R. S. K.; Dalla-Favera, R.: BCL-6 protein is expressed in germinal-center B cells. Blood 86:45-53, 1995.

Cesarman, E.; Chadburn, A.; Liu, Y.-F.; Migliazza, A.; Dalla-Favera, R.; Knowles, D. M.: BCL-6 gene mutations in post transplantation lympho proliferative disorders predict response to therapy and clinical outcome. Blood 92:2294-2302, 1998.

Chaganti, S. R.; Chen, W.; Parsa, N.; Offit, K.; Louie, D. C.; Dalla-Favera, R.; Chaganti, R. S. K.: Involvement of BCL6 in chromosomal aberrations affecting band 3q27 in B-cell non-Hodgkin lymphoma. Genes Chromosomes Cancer 23:323-327, 1998.

Chaganti, S. R.; Rao, P. H.; Chen, W.; Dyomin, V.; Jhanwar, S. C.; Parsa, N. Z.; Dalla-Favera, R.; Chaganti, R. S. K.: Deregulation of BCL6 in non-Hodgkin lymphoma by insertion of IGH sequences in complex translocations involving band 3q27. Genes Chromosomes Cancer 23:328-336, 1998.

Chang, C.-C.; Ye, B. H.; Chaganti, R. S. K.; Dalla-Favera, R.:BCL-6, a POZ/zinc-finger protein, is a sequence-specific transcriptional repressor. Proc. Nat. Acad. Sci. 93:6947-6952, 1996.

Dhordain, P.; Albagli, O.; Honore, N.; Guidez, F.; Lantoine, D.; Schmid, M.; De The, H.; Zelent, A.; Koken, M. H. M.: Colocalization and heteromerization between the two human oncogene POZ/zinc fingerproteins, LAZ3 (BCL6) and PLZF. Oncogene 19:6240-6250, 2000.

Gaidano, G.; Capello, D.; Gloghini, A.; Fassone, L.; Vivenza, D.; Ariatti, C.; Migliazza, A.; Saglio, G.; Carbone, A.: Frequent mutation of bcl-6 proto-oncogene in high grade, but not low grade, MALT lymphomas of the gastro intestinal tract. Haematologica 84:582-588, 1999.

Hamblin, T. J.; Davis, Z.; Gardiner, A.; Oscier, D. G.; Stevenson, F. K.: Unmutated Ig V(H) genes are associated with a more aggressive form of chronic lymphocytic leukemia. Blood 94:1848-1854, 1999.

Hosokawa, Y.; Maeda, Y.; Ichinohasama, R.; Miura, I.; Taniwaki, M.; Seto, M.: The Ikaros gene, a central regulator of lymphoid differentiation, fuses to the BCL6 gene as a result of t (3;7)(q27; p12) translocation in a patient with diffuse large B-cell lymphoma. Blood 95:2719-2721,2000.

Ichii, H.; Sakamoto, A.; Hatano, M.; Okada, S.; Toyama, H.; Taki, S.; Arima, M.; Kuroda, Y.; Tokuhisa, T.: Role of Bcl-6 in the generation and maintenance of memory CD8+ T cells. Nature Immun. 3:558-563,2002.

Ichinohasama, R.; Miura, I.; Funato, T.; Sato, I.; Suzuki, C.; Saito, Y.; Decoteau, J. F.; Myers, J. B.; Kadin, M. E.; Sawai, T.; Ooya, K.: A recurrent nonrandom translocation (3;7)(q27; p12) associated with BCL-6 gene rearrangement in B-cell diffuse large cell lymphoma. Cancer Genet. Cytogenet. 104:19-27, 1998.

Kerckaert, J.-P.; Deweindt, C.; Tilly, H.; Quief, S.; Lecocq, G.; Bastard, C.: LAZ3, a novel zinc-finger encoding gene, is disrupted by recurring chromosome 3q27 translocations in human lymphomas. Nature Genet. 5:66-70, 1993.

Liao, X.; Gilbert, D. J.; Dent, A.; Staudt, L. M.; Jenkins, N. A.; Copeland, N. G.: Mapping of the mouse Bcl6 gene to chromosome 16 . Mammalian Genome 7:621-622, 1996.

Migliazza, A.; Martinotti, S.; Chen, W.; Fusco, C.; Ye, B. H.; Knowles, D. M.; Offit, K.; Changanti, R. S. K.; Dalla-Favera, R.:Frequent somatic hypermutation of the 5-prime noncoding region of the BCL6 gene in B-cell lymphoma. Proc. Nat. Acad. Sci. 92:12520-12524,1995.

Miki, T.; Kawamata, N.; Hirosawa, S.; Aoki, N.: Gene involved in the 3q27 translocation associated with B-cell lymphoma, BCL5, encodesa Kruppel-like zinc-finger protein. Blood 83:26-32, 1994.

Sahota, S. S.; Davis, Z.; Hamblin, T. J.; Stevenson, F. K.: Somatic mutation of bcl-6 genes can occur in the absence of V-H mutations in chronic lymphocytic leukemia. Blood 95:3534-3540, 2000.

Shaffer, A. L.; Yu, X.; He, Y.; Boldrick, J.; Chan, E. P.; Staudt, L. M.: BCL-6 represses genes that function in lymphocyte differentiation, inflammation, and cell cycle control. Immunity 13:199-212, 2000.

Shen, H. M.; Peters, A.; Baron, B.; Zhu, X.; Storb, U.: Mutation of BCL-6 gene in normal B cells by the process of somatic hypermutation of Ig genes. Science 280:1750-1752, 1998.

Ueda, C.; Akasaka, T.; Kurata, M.; Maesako, Y.; Nishikori, M.; Ichinohasama, R.; Imada, K.; Uchiyama, T.; Ohno, H.: The gene for interleukin-21 receptor is the partner of BCL6 in t (13;16)(q27; p11), which is recurrently observed in diffuse large B-cell lymphoma. Oncogene 21:368-376, 2002.

Ye, B. H.; Cattoretti, G.; Shen, Q.; Zhang, J.; Hawe, N.; de Waard, R.; Leung, C.; Nouri-Shirazi, M.; Orazi, A.; Chaganti, R. S. K.; Rothman, P.; Stall, A. M.; Pandolfi, P.-P.; Dalla-Favera, R.: The BCL-6 proto-oncogene controls germinal-centre formation and Th2-type inflammation. Nature Genet. 16:161-170, 1997.

Ye, B. H.; Lista, F.; Lo Coco, F.; Knowles, D. M.; Offit, K.; Chaganti, R. S. K.; Dalla-Favera, R.: Alterations of a zinc finger-encoding gene, BCL-6, in diffuse large-cell lymphoma. Science 262:747-750,1993.

Ye, B. H.; Rao, P. H.; Chaganti, R. S. K.; Dalla-Favera, R.:Cloning of bcl-6, the locus involved in chromosome translocations affecting band 3q27 in B-cell lymphoma. Cancer Res. 53:2732-2735,1993.

Rimokh, R.; Rouault, J. P.; Wahbi, K.; Gadoux, M.; Lafage, M.; Archimbaud, E.; Charrin, C.; Gentilhomme, O.; Germain, D.; Samarut, J.; Magaud, J. P.: A chromosome 12 coding region is juxtaposed to the MYC proto-oncogene locus in a t (8;12)(q24; q22) translocation ina case of B-cell chronic lymphocytic leukemia. Genes Chromosomes Cancer 3:24-36, 1991.

Gejman, P. V.; Weinstein, L. S.; Martinez, M.; Spiegel, A. M.; Cao, Q.; Hsieh, W.-T.; Hoehe, M. R.; Gershon, E. S.: Genetic mapping of the Gs-alpha subunit gene (GNAS1) to the distal long arm of chromosome 20 using a polymorphism detected by denaturing gradient gel electrophoresis. Genomics 9:782-783, 1991.

Gopal Rao, V. V. N.; Schnittger, S.; Hansmann, I.: G proteinGs-alpha (GNAS1), the probable candidate gene for Albright hereditary osteodystrophy, is assigned to human chromosome 20q12-q13.2. Genomics 10:257-261, 1991.

Gorelov, V. N.; Dumon, K.; Barteneva, N. S.; Palm, D.; Roher, H.-D.; Goretzki, P. E.: Overexpression of Gs-alpha subunit in thyroid tumors bearing a mutated Gs-alpha gene. J. Cancer Res. Clin. Oncol. 121:219-224, 1995.

Happle, R.: The McCune-Albright syndrome: a lethal gene surviving by mosaicism. Clin. Genet. 29:321-324, 1986.

Harris, B. A.; Robishaw, J. D.; Mumby, S. M.; Gilman, A. G.:Molecular cloning of complementary DNA for the alpha subunit of the G protein that stimulates adenylate cyclase. Science 229:1274-1277,1985.

Hayward, B.; Kamiya, M.; Takada, S.; Moran, V.; Strain, L.; Hayashizaki, Y.; Bonthron, D. T.: XL alpha s is a paternally derived protein product of the human GNAS1 gene. (Abstract) Europ. J. Hum. Genet. 6 (suppl.1):36 only, 1998.

Fragoso, M. C. B. V.; Latronico, A. C.; Carvalho, F. M.; Zerbini, M. C. N.; Marcondes, J. A. M.; Araujo, L. M. B.; Lando, V. S.; Frazzatto, E. T.; Mendonca, B. B.; Villares, S. M. F.: Activating mutation of the stimulatory G protein (gsp) as a putative cause of ovarian and testicular human stromal Leydig cell tumors. J. Clin. Endocr. Metab. 83:2074-2078, 1998.

Hayward, B. E.; Bonthron, D. T.: An imprinted antisense transcript at the human GNAS1 locus. Hum. Molec. Genet. 9:835-841, 2000.

Hayward, B. E.; Kamiya, M.; Strain, L.; Moran, V.; Campbell, R.; Hayashizaki, Y.; Bonthron, D. T.: The human GNAS1 gene is imprinted and encodes distinct paternally and biallelically expressed G proteins. Proc. Nat. Acad. Sci. 95:10038-10043, 1998.

Hayward, B. E.; Moran, V.; Strain, L.; Bonthron, D. T.: Bidirectional imprinting of a single gene: GNAS1 encodes maternally, paternally, and biallelically derived proteins. Proc. Nat. Acad. Sci. 95:15475-15480,1998.

Hurowitz, E. H.; Melnyk, J. M.; Chen, Y.-J.; Kouros-Mehr, H.; Simon, M. I.; Shizuya, H.: Genomic characterization of the human heterotrimeric G protein alpha, beta, and gamma subunit genes. DNA Res. 7:111-120, 2000.

Iiri, T.; Farfel, Z.; Bourne, H. R.: Conditional activation defect of a human Gs-alpha mutant. Proc. Nat. Acad. Sci. 94:5656-5661,1997.

Iiri, T.; Herzmark, P.; Nakamoto, J. M.; Van Dop, C.; Bourne, H. R.: Rapid GDP release from Gs-alpha in patients with gain and loss of endocrine function. Nature 371:164-168, 1994.

Ishikawa, Y.; Tajima, T.; Nakae, J.; Nagashima, T.; Satoh, K.; Okuhara, K.; Fujieda, K.: Two mutations of the Gs-alpha gene in two Japanese patients with sporadic pseudohypoparathyroidism type Ia. J. Hum. Genet. 46:426-430, 2001.

Jia, H.; Hingorani, A. D.; Sharma, P.; Hopper, R.; Dickerson, C.; Trutwein, D.; Lloyd, D. D.; Brown, M. J.: Association of theG(s)-alpha gene with essential hypertension and response to beta-blockade. Hypertension 34:8-14, 1999.

Kehlenbach, R. H.; Matthey, J.; Huttner, W. B.: XL alpha S is a new type of G protein. Nature 372:804-809, 1994.

Kikyo, N.; Williamson, C. M.; John, R. M.; Barton, S. C.; Beechey, C. V.; Ball, S. T.; Cattanach, B. M.; Surani, M. A.; Peters, J.: Genetic and functional analysis of neuronatin in mice with maternal or paternal duplication of distal chr. 2. Dev. Biol. 190:66-77,1997.

Kinard, R. E.; Walton, J. E.; Buckwalter, J. A.: Pseudohypoparathyroidism. Arch. Intern. Med. 139:204-207, 1979.

Kozasa, T.; Itoh, H.; Tsukamoto, T.; Kaziro, Y.: Isolation and characterization of the human Gs-alpha gene. Proc. Nat. Acad. Sci. 85:2081-2085, 1988.

Juppner, H.; Schipani, E.; Bastepe, M.; Cole, D. E. C.; Lawson, M. L.; Mannstadt, M.; Hendy, G. N.; Plotkin, H.; Koshiyama, H.; Koh, T.; Crawford, J. D.; Olsen, B. R.; Vikkula, M.: The gene responsible for pseudohypoparathyroidism type Ib is paternally imprinted and maps in four unrelated kindreds to chromosome 20q13.3. Proc. Nat. Acad. Sci. 95:11798-11803, 1998.

Landis, C. A.; Masters, S. B.; Spada, A.; Pace, A. M.; Bourne, H. R.; Vallar, L.: GTPase inhibiting mutations activate the alpha chain of Gs and stimulate adenylyl cyclase in human pituitary tumours. Nature 340:692-696, 1989.

Levine, M. A.; Deily, J. R.: Identification of multiple mutations in the gene encoding the alpha subunit of Gs in patients with pseudohypoparathyroidism type IA. (Abstract) J. Bone Miner. Res. 5: S142 only, 1990.

Levine, M. A.; Modi, W. S.; O'Brien, S. J.: Mapping of the gene encoding the alpha subunit of the stimulatory G protein of adenylylcyclase (GNAS1) to 20q13.2-q13.3 in human by in situ hybridization. Genomics 11:478-479, 1991.

Levine, M. A.; Vechio, J. D.: Personal Communication. Baltimore, Md. Aug. 1, 1990.

Lin, C. K.; Hakakha, M. J.; Nakamoto, J. M.; Englund, A. T.; Brickman, A. S.; Scott, M. L.; Van Dop, C.: Prevalence of three mutations in the Gs-alpha gene among 24 families with pseudohypoparathyroidism type Ia. Biochem. Biophys. Res. Commun. 189:343-349, 1992.

Linglart, A.; Carel, J. C.; Garabedian, M.; Le, T.; Mallet, E.; Kottler, M. L.: GNAS1 lesions in pseudohypoparathyroidism Ia and Ic: genotype phenotype relationship and evidence of the maternal Transmission of the hormonal resistance. J. Clin. Endocr. Metab. 87:189-197,2002.

Malchoff, C. D.; Reardon, G.; MacGillivray, D. C.; Yamase, H.; Rogol, A. D.; Malchoff, D. M.: An unusual presentation of McCune-Albright syndrome confirmed by an activating mutation of the Gs alpha-subunit from a bone lesion. J. Clin. Endocr. Metab. 78:803-806, 1994.

Mantovani, G.; Romoli, R.; Weber, G.; Brunelli, V.; De Menis, E.; Beccio, S.; Beck-Peccoz, P.; Spada, A.: Mutational analysis of GNAS1 in patients with pseudohypoparathyroidism: identification of two novel mutations. J. Clin. Endocr. Metab. 85:4243-4248, 2000.

Falk, C. T.; Martin, M. D.; Walker, M. E.; Chen, T.; Rubinstein, P.; Allen, F. H., Jr.: Family data suggesting a linkage between MN and Gc. (Abstract) Cytogenet. Cell Genet. 25:152, 1979.

Furthmayr, H.; Metaxas, M. N.; Metaxas-Buhler, M.: M(g) and M(c):mutations within the amino-terminal region of glycophorin A. Proc. Nat. Acad. Sci. 78:631-635, 1981.

Gedde-Dahl, T., Jr.; Olaisen, B.: MN:Ss--GC more likely than Ss:MN--GC? (Abstract) Cytogenet. Cell Genet. 32:277-278, 1981.

German, J.; Chaganti, R. S. K.: Mapping human autosomes: assignment of the MN locus to a specific segment in the long arm of chromosomeno. 2. Science 182:1261-1262, 1973.

German, J.; Metaxas, M. N.; Metaxas-Buhler, M.; Louie, E.; Chaganti, R. S. K.: Further evaluation of a child with the M(k) phenotype and a translocation affecting the long arms of chromosomes 2 and 4. (Abstract) Cytogenet. Cell Genet. 25:160, 1979.

German, J.; Walker, M. E.; Steifel, F. H.; Allen, F. H., Jr.:Autoradiographic studies of human chromosomes. II. Data concerning the position of the MN locus. Vox Sang. 16:130-145, 1969.

German, J.; Walker, M. E.; Stiefel, F. H.; Allen, F. H., Jr.:MN blood-group locus: data concerning the possible chromosomal location. Science 162:1014-1015, 1968.

Grant, S. G.; Bigbee, W. L.: Bone marrow somatic mutation after genotoxic cancer therapy. (Letter) Lancet 343: 1507-1508, 1994.

Heiberg, A.; Berg, K.: Linkage data on the MNSs blood group-red cell acid phosphatase relationship. Hum. Hered. 25:93-94, 1975.

Huang, C.-H.; Chen, Y.; Blumenfeld, O. O.: A novel St (a) glycophorin produced via gene conversion of pseudoexon III from glycophorin E to glycophorin A gene. Hum. Mutat. 15:533-540, 2000.

Huang, C.-H.; Guizzo, M. L.; Kikuchi, M.; Blumenfeld, O. O.:Molecular genetic analysis of a hybrid gene encoding St (a) glycophorin of the human erythrocyte membrane. Blood 74:836-843, 1989.

Huang, C.-H.; Puglia, K. V.; Bigbee, W. L.; Guizzo, M. L.; Hoffman, M.; Blumenfeld, O. O.: A family study of multiple mutations of alpha and delta glycophorins (glycophorins A and B). Hum. Genet. 81:26-30,1988.

Huang, C.-H.; Reid, M.; Daniels, G.; Blumenfeld, O. O.: Alteration of splice site selection by an exon mutation in the human glycophorinA gene. J. Biol. Chem. 268:25902-25908, 1993.

Huang, C.-H.; Spruell, P.; Moulds, J. J.; Blumenfeld, O. O.:Molecular basis for the human erythrocyte glycophorin specifying the Miltenberger class I (MiI) phenotype. Blood 80:257-263, 1992.

Kudo, S.; Chagnovich, D.; Rearden, A.; Mattei, M. G.; Fukuda, M.: Molecular analysis of a hybrid gene encoding human glycophorin variant Miltenberger V-like molecule. J. Biol. Chem. 265:13825-13829,1990.

Langlois, R. G.; Bigbee, W. L.; Jensen, R. H.: Measurements of the frequency of human erythrocytes with gene expression loss phenotypes at the glycophorin A locus. Hum. Genet. 74:353-362, 1986.

Langlois, R. G.; Bigbee, W. L.; Kyoizumi, S.; Nakamura, N.; Bean, M. A.; Akiyama, M.; Jensen, R. H.: Evidence for increased somatic cell mutations at the glycophorin A locus in atomic bomb survivors. Science 236:445-448, 1987.

Mattei, M. G.; London, J.; Rahuel, C.; d'Auriol, L.; Colin, Y.; Le Van Kim, C.; Mattei, J. F.; Galibert, F.; Cartron, J. P.: Chromosome localization by in situ hybridization of the gene for human erythrocyte glycophorin to region 4q28-q31. (Abstract) Cytogenet. Cell Genet. 46:658, 1987.

Mawby, W. J.; Anstee, D. J.; Tanner, M. J. A.: Immunochemical evidence for hybrid sialoglycoproteins of human erythrocytes. Nature 291:161-162, 1981.

Okubo, Y.; Daniels, G. L.; Parsons, S. F.; Anstee, D. J.; Yamaguchi, H.; Tomita, T.; Seno, T.: A Japanese family with two sisters apparently homozygous for M(k). Vox Sang. 54:107-111, 1988.

Onda, M.; Fukuda, M.: Detailed physical mapping of the genes encoding glycophorins A, B, and E, as revealed by P1 plasmids containing human genomic DNA. Gene 159:225-230, 1995.

Pasvol, G.; Wainscoat, J. S.; Weatherall, D. J.: Erythrocytes deficient in glycophorin resist invasion by the malarial parasite Plasmodium falciparum. Nature 297:64-66, 1982.

Prohaska, R.; Koerner, T. A. W., Jr.; Armitage, I. M.; Furthmayr, H.: Chemical and carbon-13 nuclear magnetic resonance studies of the blood group M and N active sialoglycopeptides from human glycophorin A. J. Biol. Chem. 256: 5781-5791, 1986.

Rahuel, C.; London, J.; d'Auriol, L.; Mattei, M.-G.; Tournamille, C.; Skrzynia, C.; Lebouc, Y.; Galibert, F.; Cartron, J.-P.: characterization of cDNA clones for human glycophorin A: use for gene localization and for analysis of normal of glycophorin-A-deficient (Finnish type) genomic DNA. Europ. J. Biochem. 172:147-153, 1988.

Rahuel, C.; London, J.; Vignal, A.; Cherif-Zahar, B.; Colin, Y.; Siebert, P.; Fukuda, M.; Cartron, J.-P.: Alteration of the genes for glycophorin A and B in glycophorin-A-deficient individuals. Europ. J. Biochem. 177:605-614, 1988.

Rothman, N.; Haas, R.; Hayes, R. B.; Li, G.-L.; Wiemels, J.; Campleman, S.; Quintana, P. J. E.; Xi, L.-J.; Dosemeci, M.; Titenko-Holland, N.; Meyer, K. B.; Lu, W.; Zhang, L. P.; Bechtold, W.; Wang, Y.-Z.; Kolachana, P.; Yin, S.-N.; Blot, W.; Smith, M. T.: Benzene induces gene-duplicating but not gene-inactivating mutations at the glycophorin A locus in exposed human S. Proc. Nat. Acad. Sci. 92:4069-4073,1995.

Siebert, P. D.; Fukuda, M.: Isolation and characterization of human glycophorin A cDNA clones by a synthetic oligonucleotide approach:nucleotide sequence and mRNA structure. Proc. Nat. Acad. Sci. 83:1665-1669, 1986.

Spence, M. A.; Field, L. L.; Marazita, M. L.; Joseph, J.; Sparkes, M.; Crist, M.; Crandall, B. F.; Anderson, C. E.; Bateman, J. B.; Rotter, J. I.; Kidd, K. K.; Hodge, S. E.; Sparkes, R. S.: Estimating the recombination frequency for the MN and the Ss loci. Hum. Hered. 34:343-347, 1984.

Springer, G. F.; Tegtmeyer, H.: Further evidence that carbohydrates are the immunodeterminant structures of blood group M and N specificities. Immun. Commun. 10:157-171, 1981.

Rouault, J.-P.; Rimokh, R.; Tessa, C.; Paranhos, G.; Ffrench, M.; Duret, L.; Garoccio, M.; Germain, D.; Samarut, J.; Magaud, J.-P.:BTG1, a member of a new family of antiproliferative genes. EMBO J. 11:1663-1670, 1992.

Bachman, E. S.; Dhillon, H.; Zhang, C.-Y.; Cinti, S.; Bianco, A. C.; Kobilka, B. K.; Lowell, B. B.: Beta-AR signaling required for diet-induced thermogenesis and obesity resistance. Science 297:843-845, 2002.

Benovic, J. L.; Stone, W. C.; Huebner, K.; Croce, C.; Caron, M. G.; Lefkowitz, R. J.: cDNA cloning and chromosomal localization of the human beta-adrenergic receptor kinase. FEBS Lett. 283:122-126,1991.

Harding, V. B.; Jones, L. R.; Lefkowitz, R. J.; Koch, W. J.; Rockman, H. A.: Cardiac beta-ARK1 inhibition prolongs survival and augments beta blocker therapy in a mouse model of severe heart failure. Proc. Nat. Acad. Sci. 98:5809-5814, 2001.

Penn, R. B.; Benovic, J. L.: Structure of the human gene encoding the beta-adrenergic receptor kinase. J. Biol. Chem. 269:14924-14930,1994.

Rockman, H. A.; Chien, K. R.; Choi, D.-J.; Iaccarino, G.; Hunter, J. J.; Ross, J., Jr.; Lefkowitz, R. J.; Koch, W. J.: Expression of a beta-adrenergic receptor kinase 1 inhibitor prevents the development of myocardial failure in gene-targeted mice. Proc. Nat. Acad. Sci. 95:7000-7005, 1998.

Spurney, R. F.; Flannery, P. J.; Garner, S. C.; Athirakul, K.; Liu, S.; Guilak, F.; Quarles, L. D.: Anabolic effects of a G protein-coupled receptor kinase inhibitor expressed in osteoblasts. J. Clin. Invest. 109:1361-1371, 2002.

Benovic, J. L.; Onorato, J. J.; Arriza, J. L.; Stone, W. C.; Lohse, M.; Jenkins, N. A.; Gilbert, D. J.; Copeland, N. G.; Caron, M. G.; Lefkowitz, R. J.: Cloning, expression, and chromosomal localization of beta-adrenergic receptor kinase 2: a new member of the receptor kinase family. J. Biol. Chem. 266:14939-14946, 1991.

Li, S.; Ting, N. S.Y.; Zheng, L.; Chen, P.-L.; Ziv,Y.; Shiloh, Y.; Lee, E. Y.-H. P.; Lee, W.-H.: Functional link of BRCA1 and ataxia telangiectasia gene product in DNA damage response. Nature 406:210-215, 2000.

Hess, S. D.; Daggett, L. P.; Crona, J.; Deal, C.; Lu, C.-C.; Urrutia, A.; Chavez-Noriega, L.; Ellis, S. B.; Johnson, E. C.; Velicelebi, G.: Cloning and functional characterization of human heteromeric N-methyl-D-aspartate receptors. J. Pharm. Exp. Ther. 278:808-816,1996.

Setou, M.; Nakagawa, T.; Seog, D.-H.; Hirokawa, N.: Kinesin superfamily motor protein KIF17 and mLin-10 in NMDA receptor-containing vesicle transport. Science 288: 1796-1802, 2000.

Sprengel, R.; Suchanek, B.; Amico, C.; Brusa, R.; Burnashev, N.; Rozov, A.; Hvalby, O.; Jensen, V.; Paulsen, O.; Andersen, P.; Kim, J. J.; Thompson, R. F.; Sun, W.; Webster, L. C.; Grant, S. G. N.; Eilers, J.; Konnerth, A.; Li, J.; McNamara, J. O.; Seeburg, P. H.: Importance of the intracellular domain of NR2 subunits for NMDA receptor function in vivo. Cell 92:279-289, 1998.

Ishii, T.; Moriyoshi, K.; Sugihara, H.; Sakurada, K.; Kadotani, H.; Yokoi, M.; Akazawa, C.; Shigemoto, R.; Mizuno, N.; Masu, M.; Nakanishi, S.: Molecular characterization of the family of the N-methyl-D-aspartate receptor subunits. J. Biol. Chem. 268:2836-2843, 1993.

Kalsi, G.; Whiting, P.; Le Bourdelles, B.; Callen, D.; Barnard, E. A.; Gurling, H.: Localization of the human NMDAR2D receptor subunit gene (GRIN2D) to 19q13.1-qter, the NMDAR2A subunit gene to 16p13.2(GRIN2A), and the NMDAR2C subunit gene (GRIN2C) to 17q24-q25 using somatic cell hybrid and radiation hybrid mapping panels. Genomics 47:423-425, 1998.

Monyer, H.; Sprengel, R.; Schoepfer, R.; Herb, A.; Higuchi, M.; Lomeli, H.; Burnashev, N.; Sakmann, B.; Seeburg, P. H.: Heteromeric NMDA receptors: molecular and functional distinction of subtypes. Science 256:1217-1221, 1992.

Sakimura, K.; Kutsuwada, T.; Ito, I.; Manabe, T.; Takayama, C.; Kushiya, E.; Yagi, T.; Aizawa, S.; Inoue, Y.; Sugiyama, H.; Mishina, M.: Reduced hippocampal LTP and spatial learning in mice lacking NMDA receptor epsilon 1 subunit. Nature 373:151-155, 1995.

DeChiara, T. M.; Vejsada, R.; Poueymirou, W. T.; Acheson, A.; Suri, C.; Conover, J. C. Friedman, B.; McClain, J.; Pan, L.; Stahl, N.; Ip, N. Y.; Kato, A.; Yancopoulos, G. D.: Mice lacking the CNTF receptor, unlike mice lacking CNTF, exhibit profound motor neuron deficits at birth. Cell 83:313-322, 1995.

Davis, S.; Aldrich, T. H.; Valenzuela, D. M.; Wong, V.; Furth, M. E.; Squinto, S. P.; Yancopoulos, G. D.: The receptor for ciliary neurotrophic factor. Science 253:59-63, 1991.

Donaldson, D. H.; Britt, D. E.; Jones, C.; Jackson, C. L.; Patterson, D.: Localization of the gene for the ciliary neurotrophic factor receptor (CNTFR) to human chromosome 9. Genomics 17:782-784, 1993.

Valenzuela, D. M.; Rojas, E.; Le Beau, M. M.; Espinosa, R., III; Brannan, C. I.; McClain, J.; Masiakowski, P.; Ip, N. Y.; Copeland, N. G.; Jenkins, N. A.; Yancopoulos, G. D.: Genomic organization and chromosomal localization of the human and mouse genes encoding the alpha receptor component for ciliary neurotrophic factor. Genomics 25:157-163, 1995.

Wakui, K.; Nishida, T.; Masuda, J.; Itoh, T.; Katsumata, D.; Ohno, T.; Fukushima, Y.: De novo interstitial deletion of 4q [46, XX,del (4)(q27q28.2) ]with intact blood group-MN locus, confining its locus to 4q28.2-4q31.1. Jpn. J. Hum. Genet. 36:149-153, 1991.

Mattera, R.; Graziano, M. P.; Yatani, A.; Zhou, Z.; Graf, R.; Codina, J.; Birnbaumer, L.; Gilman, A. G.; Brown, A. M.: Splice variants of the alpha subunit of the G protein G(8) activate both adenylylcyclase and calcium channels. Science 243:804-807, 1989.

Mehlmann, L. M.; Jones, T. L. Z.; Jaffe, L. A.: Meiotic arrest in the mouse follicle maintained by a GS protein in the oocyte. Science 297:1343-1345, 2002.

Nerlich, A.; Peschel, O.; Lohrs, U.; Parsche, F.; Betz, P.: Juvenile gigantism plus polyostotic fibrous dysplasia in the Tegernsee giant.(Letter) Lancet 338:886-887, 1991.

Patten, J. L.; Johns, D. R.; Valle, D.; Eil, C.; Gruppuso, P. A.; Steele, G.; Smallwood, P. M.; Levine, M. A.: Mutation in the gene encoding the stimulatory G protein of adenylate cyclase in Albright's hereditary osteodystrophy. New Eng. J. Med. 322:1412-1419, 1990.

Persani, L.; Borgato, S.; Lania, A.; Filopanti, M.; Mantovani, G.; Conti, M.; Spada, A.: Relevant cAMP-specific phosphodiesterase isoforms in human pituitary: effect of Gs-alpha mutations. J. Clin. Endocr. Metab. 86:3795-3800, 2001.

Peters, J.; Beechey, C. V.; Ball, S. T.; Evans, E. P.: Mapping studies of the distal imprinting region of mouse chromosome 2. Genet. Res. 63:169-174, 1994.

Premawardhana, L. D. K. E.; Vora, J. P.; Mills, R.; Scanlon, M. F.: Acromegaly and its treatment in the McCune-Albright syndrome. Clin. Endocr. 36:605-608, 1992.

Riminucci, M.; Fisher, L. W.; Majolagbe, A.; Corsi, A.; Lala, R.; De Sanctis, C.; Robey, P. G.; Bianco, P.: A novel GNAS1 mutation, R201G, in McCune-Albright syndrome. J. Bone Miner. Res. 14:1987-1989,1999.

Schwindinger, W. F.; Francomano, C. A.; Levine, M. A.: Identification of a mutation in the gene encoding the alpha subunit of the stimulatory G-protein of adenylyl cyclase in McCune-Albright syndrome. Proc. Nat. Acad. Sci. 89:5152-5156, 1992.

Schwindinger, W. F.; Francomano, C. A.; Levine, M. A.; McKusick, V. A.: DNA light on the Tegernsee giant. (Letter) Lancet 338:1454-1455,1991.

Shapira, H.; Mouallem, M.; Shapiro, M. S.; Weisman, Y.; Farfel, Z.: Pseudohypoparathyroidism type Ia: two new heterozygous frame shift mutations in exons 5 and 10 of the Gs alpha gene. Human Genet. 97:73-75, 1995.

Shenker, A.; Chanson, P.; Weinstein, L. S.; Chi, P.; Spiegel, A. M.; Lomri, A.; Marie, P. J.: Osteoblastic cells derived from isolated lesions of fibrous dysplasia contain activating somatic mutations of the G(S)-alpha gene. Hum. Molec. Genet. 4:1675-1676, 1995.

Shenker, A.; Weinstein, L. S.; Moran, A.; Pescovitz, O. H.; Charest, N. J.; Boney, C. M.; Van Wyk, J. J.; Merino, M. J.; Feuillan, P. P.; Spiegel, A. M.: Severe endocrine and nonendocrine manifestations of the McCune-Albright syndrome associated with activating mutations of stimulatory G protein Gs. J. Pediat. 123:509-518, 1993.

Shore, E. M.; Ahn, J.; Jan de Beur, S.; Li, M.; Xu, M.; Gardiner, R. J. M.; Zasloff, M. A.; Whyte, M. P.; Levine, M. A.; Kaplan, F. S.: Paternally inherited inactivating mutations of the GNAS1 gene in progressive osseous heteroplasia. New Eng. J. Med. 346:99-106,2002.

Shore, E. M.; Kaplan, F. S.; Levine, M. A.: GNAS1 mutations and progressive osseous heteroplasia. (Letter) New Eng. J. Med. 346:1670-1671, 2002.

Sparkes, R. S.; Cohn, V. H.; Mohandas, T.; Zollman, S.; Cire-Eversole, P.; Amatruda, T. T.; Reed, R. R.; Lochrie, M. A.; Simon, M. I.: mapping of genes encoding the subunits of guanine nucleotide-binding protein (G-proteins) in human S. (Abstract) Cytogenet. Cell Genet. 46:696only, 1987.

Tinschert, S.; Gerl, H.; Gewies, A.; Jung, H.-P.; Nurnberg, P.: McCune-Albright syndrome: clinical and molecular evidence of mosaicism in an unusual giant patient. Am. J. Med. Genet. 83:100-108, 1999.

Vallar, L.; Spada, A.; Giannattasio, G.: Altered Gs and adenylate cyclase activity in human GH-secreting pituitary adenomas. Nature 330:566-568, 1987.

Warner, D. R.; Gejman, P. V.; Collins, R. M.; Weinstein, L. S.: A novel mutation adjacent to the switch III domain of Gs-alpha in a patient with pseudohypoparathyroidism. Molec. Endocr. 11:1718-1727,1997.

Warner, D. R.; Weinstein, L. S.: A mutation in the heterotrimeric stimulatory guanine nucleotide binding protein alpha-subunit with impaired receptor-mediated activation because of elevated GTPase activity. Proc. Nat. Acad. Sci. 96:4268-4272, 1999.

Warner, D. R.; Weng, G.; Yu, S.; Matalon, R.; Weinstein, L. S.: A novel mutation in the switch 3 region of Gs-alpha in a patient with Albright hereditary osteodystrophy impairs GDP binding and receptor activation. J. Biol. Chem. 273:23976-23983, 1998.

Weinstein, L. S.; Gejman, P. V.; de Mazancourt, P.; American, N.; Spiegel, A. M.: A heterozygous 4-bp deletion mutation in the Gs-alpha gene (GNAS1) in a patient with Albright hereditary osteodystrophy. Genomics 13:1319-1321, 1992.

Weinstein, L. S.; Gejman, P. V.; Friedman, E.; Kadowaki, T.; Collins, R. M.; Gershon, E. S.; Spiegel, A. M.: Mutations of the Gs alpha-subunit gene in Albright hereditary osteodystrophy detected by denaturing gradient gel electrophoresis. Proc. Nat. Acad. Sci. 87:8287-8290,1990.

Weinstein, L. S.; Shenker, A.; Gejman, P. V.; Merino, M. J.; Friedman, E.; Spiegel, A. M.: Activating mutations of the stimulatory G protein in the McCune-Albright syndrome. New Eng. J. Med. 325:1688-1695,1991.

Weinstein, L. S.; Yu, S.: The role of genomic imprinting of GS-alpha in the pathogenesis of Albright hereditary osteodystrophy. Trends Endocr. Metab. 10:81-85, 1999.

Walker, M. E.; Rubinstein, P.; Allen, F. H., Jr.: Biochemical genetics of MN. Vox Sang. 32:111-120, 1977.

Weitkamp, L. R.; Adams, M. S.; Rowley, P. T.: Linkage between the MN and Hb beta loci. Hum. Hered. 22:566-572, 1972.

Weitkamp, L. R.; Lovrien, E. W.; Olaisen, B.; Fenger, K.; Gedde-Dahl, T., Jr.; Sorensen, S. A.; Conneally, P. M.; Bias, W. B.; Ott, J.:Linkage relations of the loci for the MN blood group and red cell phosphate. Birth Defects Orig. Art. Ser.

XI(3):276-280, 1975. Note:Alternate: Cytogenet. Cell Genet. 14:446-450, 1975...

Byrd, P. J.; McConville, C. M.; Cooper, P.; Parkhill, J.; Stankovic, T.; McGuire, G. M.; Thick, J. A.; Taylor, A. M. R.: Mutations revealed by sequencing the 5-prime half of the gene for ataxia telangiectasia. Hum. Molec. Genet. 5:145-149, 1996.

Falck, J.; Mailand, N.; Syljuasen, R. G.; Bartek, J.; Lukas, J.: The ATM-Chk2-Cdc25A checkpoint pathway guards against radio resistant DNA synthesis. Nature 410:842-847, 2001.

Falck, J.; Petrini, J. H. J.; Williams, B. R.; Lukas, J.; Bartek, J.: The DNA damage-dependent intra-S phase checkpoint is regulated by parallel pathways. Nature Genet. 30:290-294, 2002.

Kanters, J. K.; Larsen, L. A.; Orholm, M.; Agner, E.; Anderson, P. S.; Vuust, J.; Christiansen, M.: Novel donor splice site mutation in the KVLQT1 gene is associated with the long QT syndrome. J. Cardiovasc. Electrophysiol. 9:620-624, 1998.

Itoh, T.; Kikuchi, K.; Odagawa, Y.; Takata, S.; Yano, K.; Okada, S.; Haneda, N.; Ogawa, S.; Nakano, O.; Kawahara, Y.; Kasai, H.; Nakayama, T.; Fukutomi, T.; Sakurada, H.; Shimizu, A.; Yazaki, Y.; Nagai, R.; Nakamura, Y.; Tanaka, T.: Correlation of genetic etiology with response to beta-adrenergic blockade among symptomatic patients with familial long-QT syndrome. J. Hum. Genet. 46:38-40, 2001.

Keating, M.: Response to Benhorin et al. (1993). Science 260:1962 only, 1993.

Keating, M.; Atkinson, D.; Dunn, C.; Timothy, K.; Vincent, G. M.; Leppert, M.: Linkage of a cardiac arrhythmia, the long QT syndrome, and the Harvey RAS-1 gene. Science 252:704-706, 1991.

Keating, M.; Atkinson, D.; Dunn, C.; Timothy, K.; Vincent, G. M.; Leppert, M.: Long QT syndrome is closely linked to the Harvey RAS-1 gene on chromosome 11. (Abstract) Clin. Res. 39:317A only,1991.

Keating, M.; Dunn, C.; Atkinson, D.; Timothy, K.; Vincent, G. M.; Leppert, M.: Consistent linkage of the long-QT syndrome to the Harvey Ras-1 locus on chromosome 11. Am. J. Hum. Genet. 49:1335-1339,1991.

Kerem, B.; Benhorin, J.; Kalman, Y. M.; Medina, A.; Dyer, T. D.; Blangero, J.; MacCluer, J. W.: Evidence for genetic heterogeneity in the long QT syndrome. (Abstract) Am. J. Hum. Genet. 51 (suppl.):A192 only, 1992.

Klein, H. O.; Levi, A.; Kaplinsky, E.; Di Segni, E.; David, D.: Congenital long-QT syndrome: deleterious effect of long-term high-rate ventricular pacing and definitive treatment by cardiac transplantation. Am. Heart J. 132:1079-1081, 1996.

Ko, Y.-L.; Chen, S.-A.; Tang, T. K.; Lin, J.-L.; Chiang, C.-E.; Chen, J.-J.; Teng, M.-S.; Chang, M.-S.; Lien, W.-P.; Wu, C.-W.: No evidence for linkage of long QT syndrome and chromosome 11p15.5 markers in a Chinese family: evidence for genetic heterogeneity. Hum. Genet. 94:364-366, 1994.

Kukolich, M. K.; Telsey, A.; Ott, J.; Motulsky, A. G.: Sudden infant death syndrome: normal QT intervals on ECGs of relatives. Pediatrics 60:51-54, 1977.

Larsen, L. A.; Fosdal, I.; Andersen, P. S.; Kanters, J. K.; Vuust, J.; Wettrell, G.; Christiansen, M.: Recessive Romano-Ward syndrome associated with compound heterozygosity for two mutations in the KVLQT1gene. Europ. J. Hum. Genet. 7:724-728, 1999.

Lee, M. P.; et al.; et al.: Loss of imprinting of a paternally expressed transcript, with antisense orientation to KVLQT1, occurs frequently in Beckwith-Wiedemann syndrome and is independent of insulin-like growth factor II imprinting. Proc. Nat. Acad. Sci. 96:5203-5208,1999.

Lee, M. P.; Hu, R.-J.; Johnson, L. A.; Feinberg, A. P.: human KVLQT1 gene shows tissue-specific imprinting and encompasses Beckwith-Wiedemann syndrome chromosomal rearrangements. Nature Genet. 15:181-185,1997.

Li, H.; Chen, Q.; Moss, A. J.; Robinson, J.; Goytia, V.; Perry, J. C.; Vincent, G. M.; Priori, S. G.; Lehmann, M. H.; Denfield, S. W.; Duff, D.; Kaine, S.; Shimizu, W.; Schwartz, P. J.; Wang, Q.; Towbin, J. A.: New mutations in the KVLQT1 potassium channel that cause long QT syndrome. Circulation 97:1264-1269, 1998.

Locati, E. H.; Zareba, W.; Moss, A. J.; Schwartz, P. J.; Vincent, G. M.; Lehmann, M. H.; Towbin, J. A.; Priori, S. G.; Napolitano, C.; Robinson, J. L.; Andrews, M.; Timothy, K.; Hall, W. J.: Age- and sex-related differences in clinical manifestations in patients with congenital long-QT syndrome. Circulation 97:2237-2244, 1998.

Mannens, M.; Wilde, A.: KVLQT1, the rhythm of imprinting. Nature Genet. 15:113-115, 1997.

Martini, B.: Personal Communication. Thiene, Italy Nov. 9, 1998.

Melki, J.; Kaplan, J.; Lucet, V.; Halley, L.; Clemenceau, S.; Kaplan, C.; Baule, M. S.; Frezal, J.: Long QT (Romano-Ward) syndrome:further definition of the linkage to the HLA loci. (Abstract) Cytogenet. Cell Genet. 46:661 only, 1987.

Milne, J. R.; Ward, D. E.; Spurrell, R. A. J.; Camm, A. J.: the long QT syndrome: effects of drugs and left stellate ganglion block. Am. Heart J. 104:194-198, 1982.

Mitsutake, A.; Takeshita, A.; Kuroiwa, A.; Nakamura, M.: Usefulness of the Valsalva maneuver in management of the long QT syndrome. Circulation 63:1029-1035, 1981.

Moss, A. J.; McDonald, J.: Unilateral cervico-thoracic sympathetic ganglionectomy for the treatment of long Q-T interval syndrome. New Eng. J. Med. 285:903-904, 1971.

Moss, A. J.; Schwartz, P. J.: Sudden death and the idiopathic long Q-T syndrome. (Editorial) Am. J. Med. 66:6-7, 1979.

Moss, A. J.; Schwartz, P. J.; Crampton, R. S.; Tzivoni, D.; Locati, E. H.; MacCluer, J.; Hall, W. J.; Weitkamp, L.; Vincent, G. M.; Garson, A., Jr.; Robinson, J. L.; Benhorin, J.; Choi, S.: The long QT syndrome:prospective longitudinal study of 328 families. Circulation 84:1136-1144, 1991.

Murray, A.; Donger, C.; Fenske, C.; Spillman, I.; Richard, P.; Dong, Y. B.; Neyroud, N.; Chevalier, P.; Denjoy, I.; Carter, N.; Syrris, P.; Afzal, A. P.; Patton, M. A.; Guicheney, P.; Jeffery, S.: Splicing mutations in KCNQ1: a mutation hot spot at codon 344 that produces in frame transcripts. Circulation 100:1077-1084, 1999.

Neyroud, N.; Denjoy, I.; Donger, C.; Gary, F.; Villain, E.; Leenhardt, A.; Benali, K.; Schwartz, K.; Coumel, P.; Guicheney, P.: Heterozygous mutation in the pore of potassium channel gene KvLQT1 causes an apparently normal phenotype in long QT syndrome. Europ. J. Hum. Genet. 6:129-133,1998.

Neyroud, N.; Richard, P.; Vignier, N.; Donger, C.; Denjoy, I.; Demay, L.; Shkolnikova, M.; Pesce, R.; Chevalier, P.; Hainque, B.; Coumel, P.; Schwartz, K.; Guicheney, P.: Genomic organization of the KCNQ1 K+ channel gene and identification of C-terminal mutations in the long-QT syndrome. Circ. Res. 84:290-297, 1999.

Annunen, P.; Helaakoski, T.; Myllyharju, J.; Veijola, J.; Pihlajaniemi, T.; Kivirikko, K. I.: Cloning of the human prolyl 4-hydroxylase alpha subunit isoform alpha (II) and characterization of the type II enzymetetramer: the alpha (I) and alpha (II) subunits do not form a mixedalpha (I) alpha (II) beta2 tetramer. J. Biol. Chem. 272:17342-17348,1997.

Friedman, L.; Higgin, J. J.; Moulder, G.; Barstead, R.; Raines, R. T.; Kimble, J.: Prolyl 4-hydroxylase is required for viability and morphogenesis in Caenorhabditis elegans. Proc. Nat. Acad. Sci. 97:4736-4741, 2000.

Helaakoski, T.; Annunen, P.; Vuori, K.; MacNeil, I. A.; Pihlajaniemi, T.; Kivirikko, K. I.: Cloning, baculovirus expression, and characterization of a second mouse prolyl 4-hydroxylase alpha-subunit isoform: formation of an alpha (2) beta (2) tetramer with the protein disulfide-isomerase/beta subunit. Proc. Nat. Acad. Sci. 92:4427-4431, 1995.

Helaakoski, T.; Vuori, K.; Myllyla, R.; Kivirikko, K. I.; Pihlajaniemi, T.: Molecular cloning of the alpha-subunit of human prolyl 4-hydroxylase:the complete cDNA-derived amino acid sequence and evidence for alternative splicing of RNA transcripts. Proc. Nat. Acad. Sci. 86:4392-4396, 1989.

Pajunen, L.; Jones, T. A.; Helaakoski, T.; Pihlajaniemi, T.; Solomon, E.; Sheer, D.; Kivirikko, K. I.: Assignment of the gene coding for the alpha-subunit of prolyl 4-hydroxylase to human chromosome region 10q21.3-23.1. Am. J. Hum. Genet. 45:829-834, 1989.

Helaakoski, T.; Veijola, J.; Vuori, K.; Rehn, M.; Chow, L. T.; Taillon-Miller, P.; Kivirikko, K. I.; Pihlajaniemi, T.: Structure and expression of the human gene for the alpha subunit of prolyl 4-hydroxylase:the two alternatively spliced types of mRNA correspond to two homologous exons the sequences of which are expressed in a variety of tissues. J. Biol. Chem. 269:27847-27854, 1994.

Bhalla, U. S.; Ram, P. T.; Iyengar, R.: MAP kinase phosphataseas a locus of flexibility in a mitogen-activated protein kinase signaling network. Science 297:1018-1023, 2002.

Boulton, T. G.; Nye, S. H.; Robbins, D. J.; Ip, N. Y.; Radziejewska, E.; Morgenbesser, S. D.; DePinho, R. A.; Panayotatos, N.; Cobb, M. H.; Yancopoulos, G. D.: ERKs: a family of protein-serine/threonine kinases that are activated and tyrosine phosphorylated in response to insulin and NGF. Cell 65:663-675, 1991.

Cobb, M. H.; Boulton, T. G.; Robbins, D. J.: Extracellular signal-regulated kinases: ERKs in progress. Cell Regul. 2:965-978, 1991.

Di Cristo, G.; Berardi, N.; Cancedda, L.; Pizzorusso, T.; Putignano, E.; Ratto, G. M.; Maffei, L.: Requirement of ERK activation for visual cortical plasticity. Science 292:2337-2340, 2001.

Forcet, C.; Stein, E.; Pays, L.; Corset, V.; Llambi, F.; Tessier-Lavigne, M.; Mehlen, P.: Netrin-1-mediated axon outgrowth requires deleted in colorectal cancer-dependent MAPK activation. Nature 417:443-447, 2002.

Khokhlatchev, A. V.; Canagarajah, B.; Wilsbacher, J.; Robinson, M.; Atkinson, M.; Goldsmith, E.; Cobb, M. H.: Phosphorylation of the MAP kinase ERK2 promotes its homodimerization and nuclear translocation. Cell 93:605-615, 1998.

Li, L.; Wysk, M.; Gonzalez, F. A.; Davis, R. J.: Genomic loci of human mitogen-activated protein kinases. Oncogene 9:647-649, 1994.

Owaki, H.; Makar, R.; Boulton, T. G.; Cobb, M. H.; Geppert, T. D.: Extracellular signal-regulated kinases in T cells: characterization of human ERK1 and ERK2 cDNAs. Biochem. Biophys. Res. Commun. 182:1416-1422, 1992.

Saba-El-Leil, M. K.; Malo, D.; Meloche, S.: Chromosomal localization of the mouse genes encoding the ERK1 and ERK2 isoforms of MAP kinases. Mammalian Genome 8:141-142, 1997.

Stefanovsky, V. Y.; Pelletier, G.; Hannan, R.; Gagnon-Kugler, T.; Rothblum, L. I.; Moss, T.: An immediate response of ribosomal transcription to growth factor stimulation in mammals is mediated by ERK phosphorylation of UBF. Molec. Cell 8:1063-1073, 2001.

Thomas, G.: MAP kinase by any other name smells just as sweet. Cell 68:3-6, 1992.

Garcia, J. I.; Zalba, G.; Detera-Wadleigh, S. D.; de Miguel, C.: Isolation of a cDNA encoding the rat MAP-kinase homolog of human P63mapk. Mammalian Genome 7:810-814, 1996.

Gonzalez, F. A.; Raden, D. L.; Rigby, M. R.; Davis, R. J.: Heterogeneous expression of four MAP kinase isoforms in human tissues. FEBS Lett. 304:170-178, 1992.

Zhu, A. X.; Zhao, Y.; Moller, D. E.; Flier, J. S.: Cloning and characterization of p97(MAPK), a novel human homolog of rat ERK-3. Molec. Cell. Biol. 14:8202-8211, 1994.

Coussens, L.; Parker, P. J.; Rhee, L.; Yang-Feng, T. L.; Chen, E.; Waterfield, M. D.; Francke, U.; Ullrich, A.: Multiple, distinct forms of bovine and human protein kinase C suggest diversity in cellular signaling pathways. Science 233: 859-866, 1986.

Greenham, J.; Adams, M.; Doggett, N.; Mole, S.: Elucidation of the exon-intron structure and size of the human protein kinase C beta gene (PRKCB). Hum. Genet. 103:483-487, 1998.

Leitges, M.; Schmedt, C.; Guinamard, R.; Davoust, J.; Schaal, S.; Stabel, S.; Tarakhovsky, A.: Immunodeficiency in protein kinase C-beta-deficient mice. Science 273:788-791, 1996.

Su, T. T.; Guo, B.; Kawakami, Y.; Sommer, K.; Chae, K.; Humphries, L. A.; Kato, R. M.; Kang, S.; Patrone, L.; Wall, R.; Teitell, M.; Leitges, M.; Kawakami, T.; Rawlings, D. J.: PKC-beta controls I-kappa-B kinase lipid raft recruitment and activation in response to BCR signaling. Nature Immun. 3:780-786, 2002.

Premkumar, L. S.; Ahern, G. P.: Induction of vanilloid receptor channel activity by protein kinase C. Nature 408: 985-990, 2000.

Gong, J.; Xu, J.; Bezanilla, M.; van Huizen, R.; Derin, R.; Li, M.: Differential stimulation of PKC phosphorylation of potassium channels by ZIP1 and ZIP2. Science 285:1565-1569, 1999.

Spritz, R. A.; Strunk, K.; Surowy, C. S.; Mohrenweiser, H. W.:Human U1-70K ribonucleoprotein antigen gene: organization, Nucleotide sequence, and mapping to locus 19q13.3. Genomics 8:371-379, 1990.

Epstein, A. C. R.; Gleadle, J. M.; McNeill, L. A.; Hewitson, K. S.; O'Rourke, J.; Mole, D. R.; Mukherji, M.; Metzen, E.; Wilson, M. I.; Dhanda, A.; Tian, Y.-M.; Masson, N.; Hamilton, D. L.; Jaakkola, P.; Barstead, R.; Hodgkin, J.; Maxwell, P. H.; Pugh, C. W.; Schofield, C. J.; Ratcliffe, P. J.: C. elegans EGL-9 and mammalian homologs define a family of dioxygenases that regulate HIF by prolyl hydroxylation. Cell 107: 43-54, 2001.

Gatei, M.; Young, D.; Cerosaletti, K. M.; Desai-Mehta, A.; Spring, K.; Kozlov, S.; Lavin, M. F.; Gatti, R. A.; Concannon, P.; Khanna, K.: ATM-dependent phosphorylation of nibrin in response to radiation exposure. Nature Genet. 25:115-119, 2000.

Naggert, J. K.; Mu, J.-L.: The mouse very low density lipoprotein receptor (Vldlr) gene maps to chromosome 19. Mammalian Genome 5:453-455, 1994.

Meloni, A. M.; Dobbs, R. M.; Pontes, J. E.; Sandberg, A. A.: Translocation (X;1) in papillary renal cell carcinoma: a new cytogenetic subtype. Cancer Genet. Cytogenet. 65:1-6, 1993.

Zbar, B.; Tory, K.; Merino, M.; Schmidt, L.; Glenn, G.; Choyke, P.; Walther, M. M.; Lerman, M.; Linehan, W. M.: Hereditary papillary renal cell carcinoma. J. Urol. 151:561-566, 1994.

Adachi, H.; Tawaragi, Y.; Inuzuka, C.; Kubota, I.; Tsujimoto, M.; Nishihara, T.; Nakazato, H.: Primary structure of human microsomaldipeptidase deduced from molecular cloning. J. Biol. Chem. 265:3992-3995, 1990.

Austruy, E.; Jeanpierre, C.; Antignac, C.; Whitmore, S. A.; VanCong, N.; Bernheim, A.; Callen, D. F.; Junien, C.: Physical and genetic mapping of the dipeptidase gene DPEP1 to 16q24.3. Genomics 15:684-687,1993.

Campbell, B. J.; Forrester, L. J.; Zahler, W. L.; Burks, M.: Beta-lactamase activity of purified and partially characterized human renal dipeptidase. J. Biol. Chem. 259:14586-14590, 1984.

Kozak, E. M.; Tate, S. S.: Glutathione-degrading enzymes of microvillus membranes. J. Biol. Chem. 257:6322-6327, 1982.

Nakagawa, H.; Inazawa, J.; Inoue, K.; Misawa, S.; Kashima, K.; Adachi, H.; Nakazato, H.; Abe, T.: Assignment of the human renal dipeptidase gene (DPEP1) to band q24 of chromosome 16. (Abstract) Cytogenet. Cell Genet. 58:2002 only, 1991.

Pscherer, A.; Dorflinger, U.; Kirfel, J.; Gawlas, K.; Ruschoff, J.; Buettner, R.; Schule, R.: The helix-loop-helix transcription factor SEF-2 regulates the activity of a novel initiator element in the promoter of the human somatostatin receptor II gene. EMBO J. 15:6680-6690, 1996.

McNew, J. A.; Parlati, F.; Fukuda, R.; Johnston, R. J.; Paz, K.; Paumet, F.; Sollner, T. H.; Rothman, J. E.: Compartmental specificity of cellular membrane fusion encoded in SNARE proteins. Nature 407:153-159, 2000.

Weber, T.; Zemelman, B. V.; McNew, J. A.; Westermann, B.; Gmachi, M.; Parlati, F.; Sollner, T. H.; Rothman, J. E.: SNAREpins: minimal machinery for membrane fusion. Cell 92:759-772, 1998.

Baier, L.; The Pima Diabetes Genes Group: Suggestive linkage of genetic markers on chromosome 4q12 to NIDDM and insulin action in Pima Indians: new evidence to extend associations reported in other populations. (Abstract) Diabetes 45 (suppl. 2):30A only, 1996.

Baier, L. J.; Dobberfuhl, A. M.; Pratley, R. E.; Hanson, R. L.; Bogardus, C.: Variations in the vitamin D-binding protein (Gc locus) are associated with oral glucose tolerance in nondiabetic Pima Indians. J. Clin. Endocr. Metab. 83:2993-2996, 1998.

Bearn, A. G.; Bowman, B. H.; Kitchin, F. D.: Genetic and biochemical consideration of the serum group-specific component. Cold Spring Harbor Symp. Quant. Biol. 29:435-442, 1964.

Bowman, B. H.; Brune, J. L.; McCombs, J. L.; Moore, C. M.; Lum, J. B.; Wieder, K.; Barnett, D. R.; Yang, F.: Human group-specific component: a member of the albumin and alpha-feto protein gene family. (Abstract) Am. J. Hum. Genet. 37: A145 only, 1985.

Braun, A.; Bichlmaier, R.; Cleve, H.: Molecular analysis of the gene for the human vitamin-D-binding protein (group-specific component): allelic differences of the common genetic GC types. Hum. Genet. 89:401-406, 1992.

Borsani, G.; Bassi, M. T.; Sperandeo, M. P.; De Grandi, A.; Buoninconti, A.; Riboni, M.; Manzoni, M.; Incerti, B.; Pepe, A.; Andria, G.; Ballabio, A.; Sebastio, G.: SLC7A7, encoding a putative permease-related protein, is mutated in patients with lysinuric protein intolerance. Nature Genet. 21:297-301, 1999.

Brose, N.; Petrenko, A. G.; Sudhof, T. C.; Jahn, R.: Synaptotagmin:a calcium sensor on the synaptic vesicle surface. Science 256:1021-1025,1992.

Fernandez-Chacon, R.; Konigstorfer, A.; Gerber, S. H.; Garcia, J.; Matos, M. F.; Stevens, C. F.; Brose, N.; Rizo, J.; Rosenmund, C.; Sudhof, T. C.: Synaptotagmin I functions as a calcium regulator of release probability. Nature 410:41-49, 2001.

Geppert, M.; Archer, B. T., III; Sudhof, T. C.: SynaptotagminII: a novel differentially distributed form of synaptotagmin. J. Biol. Chem. 266:13548-13552, 1991.

Hilbush, B. S.; Morgan, J. I.: A third synaptotagmin gene, Syt3, in the mouse. Proc. Nat. Acad. Sci. 91:8195-8199, 1994.

Jones, J. M.; Popma, S. J.; Mizuta, M.; Seino, S.; Meisler, M. H.: Synaptotagmin genes on mouse chromosomes 1, 7, and 10 and human chromosome 19. Mammalian Genome 6:212-213, 1995.

Kwon, O.-J.; Adamson, M. C.; Chin, H.; Kozak, C. A.: Genetic mapping of five mouse genes encoding synaptotagmins. Mammalian Genome 6:880-881, 1995.

Mackler, J. M.; Drummond, J. A.; Loewen, C. A.; Robinson, I. M.; Reist, N. E.: The C2B Ca (2+)-binding motif of synaptotagmin is required for synaptic transmission in vivo. Nature 418:340-344, 2002.

Perin, M. S.; Fried, V. A.; Mignery, G. A.; Jahn, R.; Sudhof, T. C.: Phospholipid binding by a synaptic vesicle protein homologous to the regulatory region of protein kinase C. Nature 345:260-263,1990.

Perin, M. S.; Johnston, P. A.; Ozcelik, T.; Jahn, R.; Francke, U.; Sudhof, T. C.: Structural and functional conservation of synaptotagmin (p65) in Drosophila and human S. J. Biol. Chem. 266:615-622, 1991.

Robinson, I. M.; Ranjan, R.; Schwarz, T. L.: Synaptotagmins I and IV promote transmitter release independently of Ca (2+) binding in the C2A domain. Nature 418:336-340, 2002.

Shin, O.-H.; Rizo, J.; Sudhof, T. C.: Synaptotagmin function in dense core vesicle exocytosis studied in cracked PC12 cells. Nature Neurosci. 5:649-656, 2002.

Wang, C.-T.; Grishanin, R.; Earles, C. A.; Chang, P. Y.; Martin, T. F. J.; Chapman, E. R.; Jackson, M. B.: Synaptotagmin modulation of fusion pore kinetics in regulated exocytosis of dense-core vesicles. Science 294:1111-1115, 2001.

Begley, C. G.; Aplan, P. D.; Davey, M. P.; Nakahara, K.; Tchorz, K.; Kurtzberg, J.; Hershfield, M. S.; Haynes, B. F.; Cohen, D. I.; Waldmann, T. A.; Kirsch, I. R.: Chromosomal translocation in a human leukemic stem-cell line disrupts the T-cell antigen receptor delta-chain diversity region and results in a previously unreported fusion transcript. Proc. Nat. Acad. Sci. 86:2031-2035, 1989.

Watanabe, T.; Mukouyama, Y.; Rhodes, M.; Thomas, M.; Kume, T.; Oishi, M.: Chromosomal location of murine protein tyrosine phosphatase (Ptprj and Ptpre) genes. Genomics 29:793-795, 1995.

Ruivenkamp, C. A. L.; van Wezel, T.; Zanon, C.; Stassen, A. P. M.; Vlcek, C.; Csikos, T.; Klous, A. M.; Tripodis, N.; Perrakis, A.; Boerrigter, L.; Groot, P. C.; Lindeman, J.; Mooi, W. J.; Meijjer, G. A.; Scholten, G.; Dauwerse, H.; Paces, V.; van Zandwijk, N.; vanOmmen, G. J. B.; Demant, P.: Ptprj is a candidate for the mouse colon-cancer susceptibility locus Scc1 and is frequently deleted in human cancers. Nature Genet. 31:295-300, 2002.

Iivanainen, A.; Sainio, K.; Sariola, H.; Tryggvason, K.: Primary structure and expression of a novel human laminin alpha-4 chain. FEBSLett. 365:183-188, 1995.

Richards, A. J.; Al-Imara, L.; Carter, N. P.; Lloyd, J. C.; Leversha, M. A.; Pope, F. M.: Localization of the gene (LAMA4) to chromosome 6q21 and isolation of a partial cDNA encoding a variant laminin A chain. Genomics 22:237-239, 1994.

Richards, A. J.; Al-Imara, L.; Carter, N. P.; Lloyd, J. C.; Pope, F. M.: A laminin A variant gene (LAMA3) is present on chromosome 6q21 (Abstract) J. Med. Genet. 31:164, 1994.

Dorow, D. S.; Devereux, L.; Dietzsch, E.; De Kretser, T.: Identification of a new family of human epithelial protein kinases containing two leucine/isoleucine-zipper domains. Europ. J. Biochem. 213:701-710,1993.

Hanks, S. K.: Eukaryotic protein kinases. Curr. Opin. Struct. Biol. 1:369-383, 1991.

Balczon, R.; Bao, L.; Zimmer, W. E.: PCM-1, a 228-kD centrosome autoantigen with a distinct cell cycle distribution. J. Cell Biol. 124:783-793, 1994.

Graham, M.; Shutter, J. R.; Sarmiento, U.; Sarosi, I.; Stark, K. L.: Over expression of Agrt leads to obesity in transgenic mice. (Letter) Nature Genet. 17:273-274, 1997.

Fazioli, F.; Minichiello, L.; Matoska, V.; Castagnino, P.; Miki, T.; Wong, W. T.; Di Fiore, P. P.: Eps8, a substrate for the epidermal growth factor receptor kinase, enhances EGF-dependent mitogenic signals. EMBO J. 12:3799-3808, 1993.

Corvi, R.; Berger, N.; Balczon, R.; Romeo, G.: RET/PCM-1: a novel fusion gene in papillary thyroid carcinoma. Oncogene 19:4236-4242,2000.

Ohata, H.; Fujiwara, Y.; Koyama, K.; Nakamura, Y.: Mapping of the human autoantigen pericentriolar material 1 (PCM1) gene to chromosome 8p21.3-p22. Genomics 24:404-406, 1994.

Takai, S.; Tanaka, M.; Sugimura, H.; Yamada, K.; Naito, Y.; Kino, I.; Matsuda, M.: Mapping of the human C3G gene coding a guanine nucleotide releasing protein for Ras family to 9q34.3 by fluorescence in situ hybridization. Hum. Genet. 94:549-550, 1994.

Tanaka, S.; Morishita, T.; Hashimoto, Y.; Hattori, S.; Nakamura, S.; Shibuya, M.; Matsuoka, K.; Takenawa, T.; Kurata, T.; Nagashima, K.; Matsuda, M.: C3G, a guanine nucleotide-releasing protein expressed ubiquitously, binds to the Src homology 3 domains of CRK and GRB2/ASH proteins. Proc. Nat. Acad. Sci. 91:3443-3447, 1994.

Kumar, S.; Tomooka, Y.; Noda, M.: Identification of a set of genes with developmentally down-regulated expression in the mouse brain. Biochem. Biophys. Res. Commun. 185: 1155-1161, 1992.

Braybrooke, J. P.; Spink, K. G.; Thacker, J.; Hickson, I. D.:The RAD51 family member, RAD51L3, is a DNA-stimulated ATPase that forms a complex with XRCC2. J. Biol. Chem. 275:29100-29106, 2000.

Johnson, R. D.; Liu, N.; Jasin, M.: Mammalian XRCC2 promotes the repair of DNA double-strand breaks by homologous recombination. Nature 401:397-399, 1999.

Jones, N. J.; Cox, R.; Thacker, J.: Isolation and cross-sensitivity of x-ray-sensitive mutants of V79-4 hamster cells. Mutat. Res. 183:279-286, 1987.

Jones, N. J.; Zhao, Y.; Siciliano, M. J.; Thompson, L. H.: Assignment of the XRCC2 human DNA repair gene to chromosome 7q36 by complementation analysis. Genomics 26:619-622, 1995.

Kurumizaka, H.; Ikawa, S.; Nakada, M.; Enomoto, R.; Kagawa, W.; Kinebuchi, T.; Yamazoe, M.; Yokoyama, S.; Shibata, T.: Homologous pairing and ring and filament structure formation activities of the human Xrcc2-Rad51D complex. J. Biol. Chem. 277:14315-14320, 2002.

Liu, N.; Schild, D.; Thelen, M. P.; Thompson, L. H.: Involvement of Rad51C in two distinct protein complexes of Rad51 paralogs in human cells. Nucleic Acids Res. 30:1009-1015, 2002.

Masson, J.-Y.; Tarsounas, M. C.; Stasiak, A. Z.; Stasiak, A.; Shah, R.; McIlwraith, M. J.; Benson, F. E.; West, S. C.: Identification and purification of two distinct complexes containing the five RAD51 paralogs. Genes Dev. 15:3296-3307, 2001.

Tambini, C. E.; George, A. M.; Rommens, J. M.; Tsui, L.-C.; Scherer, S. W.; Thacker, J.: The XRCC2 DNA repair gene: identification of a positional candidate. Genomics 41:84-92, 1997.

Thacker, J.; Tambini, C. E.; Simpson, P. J.; Tsui, L.-C.; Scherer, S. W.: Localization to chromosome 7q36.1 of the human XRCC2 gene, determining sensitivity to DNA-damaging agents. Hum. Molec. Genet. 4:113-120, 1995.

Kjeldsen, A. D.; Brusgaard, K.; Poulsen, L.; Kruse, T.; Rasmussen, K.; Green, A.: Mutations in the ALK-1 gene and the phenotype of hereditary hemorrhagic telangiectasia in two large Danish families. Am. J. Med. Genet. 98:298-302, 2001.

Kapfhamer, D.; Miller, D. E.; Lambert, S.; Bennett, V.; Glover, T. W.; Burmeister, M.: Chromosomal localization of the ankyrin-G gene (ANK3/Ank3) to human 10q21 and mouse 10. Genomics 27:189-191,1995.

Nakagawara, A.; Liu, X.-G.; Ikegaki, N.; White, P. S.; Yamashiro, D. J.; Nycum, L. M.; Biegel, J. A.; Brodeur, G. M.: Cloning and chromosomal localization of the human TRK-B tyrosine kinase receptor gene (NTRK2). Genomics 25:538-546, 1995.

Rico, B.; Xu, B.; Reichardt, L. F.: TrkB receptor signaling is required for establishment of GABAergic synapses in the cerebellum. Nature Neurosci. 5:225-233, 2002.

Slaugenhaupt, S. A.; Blumenfeld, A.; Liebert, C. B.; Mull, J.; Lucente, D. E.; Monahan, M.; Breakefield, X. O.; Maayan, C.; Parada, L.; Axelrod, F. B.; Gusella, J. F.: The human gene for neurotrophic tyrosine kinase receptor type 2 (NTRK2) is located on chromosome 9 but is not the familial dysautonomia gene. Genomics 25:730-732,1995.

Soppet, D.; Escandon, E.; Maragos, J.; Middlemas, D. S.; Reid, S. W.; Blair, J.; Burton, L. E.; Stanton, B. R.; Kaplan, D. R.; Hunter, T.; Nikolics, K.; Parada, L. F.: The neurotrophic factors brain-derived neurotrophic factor and neurotrophin-3 are ligands for the trkB tyrosine kinase receptor. Cell 65:895-903, 1991.

Squinto, S. P.; Stitt, S. N.; Aldrich, T. H.; Davis, S.; Bianco, S. M.; Radziejewski, C.; Glass, D. J.; Masiakowski, P.; Furth, M. E.; Valenzuela, D. M.; DiStefano, P. S.; Yancopoulos, G. D.: trkB encodes a functional receptor for brain-derived neurotrophic factor and neurotrophin-3 but not nerve growth factor. Cell 65:885-893,1991.

Grun, F.; Hirose, Y.; Kawauchi, S.; Ogura, T.; Umesono, K.: Aldehydedehydrogenase 6, a cytosolic retinaldehyde dehydrogenase prominently expressed in sensory neuroepithelia during development. J. Biol. Chem. 275:41210-41218, 2000.

Hsu, L. C.; Chang, W.-C.; Hiraoka, L.; Hsieh, C.-L.: molecular cloning, genomic organization, and chromosomal localization of an additional human aldehyde dehydrogenase gene, ALDH6. Genomics 24:333-341, 1994.

Burks, D. J.; Font de Mora, J.; Schubert, M.; Withers, D. J.; Myers, M. G.; Towery, H. H.; Altamuro, S. L.; Flint, C. L.; White, M. F.: IRS-2 pathways integrate female reproduction and energy homeostasis. Nature 407:377-382, 2000.

Fritsche, A.; Madaus, A.; Renn, W.; Tschritter, O.; Teigeler, A.; Weisser, M.; Maerker, E.; Machicao, F.; Haring, H.; Stumvoll, M.:The prevalent Gly1057Asp polymorphism in the insulin receptor substrate-2 gene is not associated with impaired insulin secretion. J. Clin. Endocr. Metab. 86:4822-4825, 2001.

Kubota, N.; Tobe, K.; Terauchi, Y.; Eto, K.; Yamauchi, T.; Suzuki, R.; Tsubamoto, Y.; Komeda, K.; Nakano, R.; Miki, H.; Satoh, S.; Sekihara, H.; Sciacchitano, S.; Lesniak, M.;

Aizawa, S.; Nagai, R.; Kimura, S.; Akanuma, Y.; Taylor, S. I.; Kadowaki, T.: Disruption of insulin receptor substrate 2 causes type 2 diabetes because of liver insulin resistance and lack of compensatory beta-cell hyperplasia. Diabetes 49:1880-1889, 2000.

Sun, X. J.; Wang, L.-M.; Zhang, Y.; Yenush, L.; Myers, M. G., Jr.; Glasheen, E.; Lane, W. S.; Pierce, J. H.; White, M. F.: Role of IRS-2 in insulin and cytokine signalling. Nature 377: 173-177, 1995.

Withers, D. J.; Burks, D. J.; Towery, H. H.; Altamuro, S. L.; Flint, C. L.; White, M. F.: Irs-2 coordinates Igf-1 receptor-mediated beta-cell development and peripheral insulin signalling. Nature Genet. 23:32-40, 1999.

Withers, D. J.; Gutierrez, J. S.; Towery, H.; Burks, D. J.; Ren, J.-M.; Previs, S.; Zhang, Y.; Bernal, D.; Pons, S.; Shulman, G. I.; Bonner-Weir, S.; White, M. F.: Disruption of IRS-2 causes type 2 diabetes in mice. Nature 391:900-902, 1998.

Wong, W. T.; Carlomagno, F.; Druck, T.; Barletta, C.; Croce, C. M.; Huebner, K.; Kraus, M. H.; Di Fiore, P. P.: Evolutionary conservation of the EPS8 gene and its mapping to human chromosome 12q23-q24. Oncogene 9:3057-3061, 1994.

Avraham, K. B.; Levanon, D.; Negreanu, V.; Bernstein, Y.; Groner, Y.; Copeland, N. G.; Jenkins, N. A.: Mapping of the mouse homolog of the human runt domain gene, AML2, to the distal region of mouse chromosome 4. Genomics 25:603-605, 1995.

Bae, S.-C.; Takahashi, E.; Zhang, Y. W.; Ogawa, E.; Shigesada, K.; Namba, Y.; Satake, M.; Ito, Y.: Cloning, mapping and expression of PEBP2-alpha-C, a third gene encoding the mammalian Runt domain. Gene 159:245-248, 1995.

Inoue, K.; Ozaki, S.; Shiga, T.; Ito, K.; Masuda, T.; Okado, N.; Iseda, T.; Kawaguchi, S.; Ogawa, M.; Bae, S.-C.; Yamashita, N.; Itohara, S.; Kudo, N.; Ito, Y.: Runx3 controls the axonal projection of proprioceptive dorsal root ganglion neurons. Nature Neurosci. 23 Sept., 2002. Note:Advance Electronic Publication.

Li, Q.-L.; Ito, K.; Sakakura, C.; Fukamachi, H.; Inoue, K.; Chi, X.-Z.; Lee, K.-Y.; Nomura, S.; Lee, C.-W.; Han, S.-B.; Kim, H.-M.; Kim, W.-J.; and 15 others: Causal relationship between the loss of RUNX3 expression and gastric cancer. Cell 109:113-124, 2002.

Wijmenga, C.; Speck, N. A.; Dracopoli, N. C.; Hofker, M. H.; Liu, P.; Collins, F. S.: Identification of a new murine runt domain-containing gene, Cbfa3, and localization of the human homolog, CBFA3, to chromosome 1 p35-pter. Genomics 26:611-614, 1995.

Cody, J. D.; Hale, D. E.; Brkanac, Z.; Kaye, C. I.; Leach, R. J.: Growth hormone insufficiency associated with haplo insufficiency at 18q23. Am. J. Med. Genet. 71:420-425, 1997.

Habert-Ortoli, E.; Amiranoff, B.; Loquet, I.; Laburthe, M.; Mayaux, J.-F.: Molecular cloning of a functional human galanin receptor. Proc. Nat. Acad. Sci. 91:9780-9783, 1994.

Hecht, G.; Marrero, J. A.; Danilkovich, A.; Matkowskyj, K. A.; Savkovic, S. D.; Koutsouris, A.; Benya, R. V.: Pathogenic Escherichia coli increase Cl- secretion from intestinal epithelia by upregulating galanin-1 receptor expression. J. Clin. Invest. 104:253-262, 1999.

Levanon, D.; Negreanu, V.; Bernstein, Y.; Bar-Am, I.; Avivi, L.; Groner, Y.: AML1, AML2, and AML3, the human members of the runt domain gene-family: cDNA structure, expression, and chromosomal localization. Genomics 23:425-432, 1994.

Bielinska, B.; Blaydes, S. M.; Buiting, K.; Yang, T.; Krajewska-Walasek, M.; Horsthemke, B.; Brannan, C. I.: De novo deletions of SNRPN exon1 in early human and mouse embryos result in a paternal to maternal imprint switch. Nature Genet. 25:74-78, 2000. Note: Erratum: Nature Genet. 25:241 only, 2000.

Raeymaekers, P.; Van Broeckhoven, C.; Backhovens, H.; Wehnert, A.; Muylle, L.; De Jonghe, P.; Gheuens, J.; Vandenberghe, A.: The Duffy blood group is linked to the alpha-spectrin locus in a large pedigree with autosomal dominant inheritance of Charcot-Marie-Tooth disease type 1. Hum. Genet. 78:76-78, 1988.

Eagle, L. R.; Yin, X.; Brothman, A. R.; Williams, B. J.; Atkin, N. B.; Prochownik, E. V.: Mutation of the MXI1 gene in prostate cancer. Nature Genet. 9:249-255, 1995.

Edwards, A.; Hammond, H. A.; Jin, L.; Caskey, C. T.; Chakraborty, R.: Genetic variation at five trimeric and tetrameric tandem repeat loci in four human population groups. Genomics 12:241-253, 1992.

Ichikawa, T.; Ichikawa, Y.; Dong, J.; Hawkins, A. L.; Griffin, C. A.; Isaacs, W. B.; Oshimura, M.; Barrett, J. C.; Isaacs, J. T.: Localization of metastasis suppressor gene (s) for prostatic cancer to the short arm of human chromosome 11. Cancer Res. 52:3486-3490,1992.

Ichikawa, T.; Ichikawa, Y.; Isaacs, J. T.: Genetic factors and suppression of metastatic ability of prostatic cancer. Cancer Res. 51:3788-3792, 1991.

Irvine, R. A.; Yu, M. C.; Ross, R. K.; Coetzee, G. A.: The CAG and GGC micro satellites of the androgen receptor gene are in linkage disequilibrium in men with prostate cancer. Cancer. Res. 55:1937-1940,1995.

Peters, M. A.; Ostrander, E. A.: Prostate cancer: more than two to tango. Nature Genet. 27:134-135, 2001.

Bansal, A.; Murray, D. K.; Wu, J. T.; Stephenson, R. A.; Middleton, R. G.; Meikle, A. W.: Heritability of prostate-specific antigen and relationship with zonal prostate volumes in aging twins. J. Clin. Endocr. Metab. 85:1272-1276, 2000.

Cleutjens, K. B. J. M.; van der Korput, H. A. G. M.; van Eekelen, C. C. E. M.; van Rooij, H. C. J.; Faber, P. W.; Trapman, J.: An androgen response element in a far upstream enhancer region is essential for high, androgen-regulated activity of the prostate-specific antigen promoter. Molec. Endocr. 11:148-161, 1997.

Nelson, R. J.; Demas, G. E.; Huang, P. L.; Fishman, M. C.; Dawson, V. L.; Dawson, T. M.; Snyder, S. H.: Behavioural abnormalities in male mice lacking neuronal nitric oxide synthase. Nature 378:383-386,1995.

Henry, J. G.; Mitnick, M.; Dann, P. R.; Stewart, A. F.: Parathyroid hormone-related protein-(1-36) is biologically active when administered subcutaneously to human S. J. Clin. Endocr. Metab. 82:900-906, 1997.

Holick, M. F.; Ray, S.; Chen, T. C.; Tian, X.; Persons, K. S.: A parathyroid hormone antagonist stimulates epidermal proliferation and hair growth in mice. Proc. Nat. Acad. Sci. 91:8014-8016, 1994.

Lanske, B.; Amling, M.; Neff, L.; Guiducci, J.; Baron, R.; Kronenberg, H. M.: Ablation of the PTHrP gene or the PTH/PTHrP receptor gene leads to distinct abnormalities in bone development. J. Clin. Invest. 104:399-407, 1999.

Mangin, M.; Ikeda, K.; Dreyer, B. E.; Broadus, A. E.: Isolation and characterization of the human parathyroid hormone-like peptide gene. Proc. Nat. Acad. Sci. 86:2408-2412, 1989.

Mangin, M.; Webb, A. C.; Dreyer, B. E.; Posillico, J. T.; Ikeda, K.; Weir, E. C.; Stewart, A. F.; Bander, N. H.; Milstone, L.; Barton, D. E.; Francke, U.; Broadus, A. E.: Identification of a cDNA encoding a parathyroid hormone-like peptide from a human tumor associated with humoral hypercalcemia of malignancy. Proc. Nat. Acad. Sci. 85:597-601,1988.

Moseley, J. M.; Kubota, M.; Diefenbach-Jagger, H.; Wettenhall, R. E. H.; Kemp, B. E.; Suva, L. J.; Rodda, C. P.; Ebeling, P. R.; Hudson, P. J.; Zajac, J. D.; Martin, T. J.: Parathyroid hormone-related protein purified from a human lung cancer cell line. Proc. Nat. Acad. Sci. 84:5048-5052, 1987.

Philbrick, W. M.; Dreyer, B. E.; Nakchbandi, I. A.; Karaplis, A. C.: Parathyroid hormone-related protein is required for tooth eruption. Proc. Nat. Acad. Sci. 95:11846-11851, 1998.

Strewler, G. J.: The physiology of parathyroid hormone-related protein. New Eng. J. Med. 342:177-185, 2000.

Suva, L. J.; Winslow, G. A.; Wettenhall, R. E. H.; Hammonds, R. G.; Moseley, J. M.; Diefenbach-Jagger, H.; Rodda, C. P.; Kemp, B. E.; Rodriguez, H.; Chen, E. Y.; Hudson, P. J.; Martin, T. J.; Wood, W. I.: A parathyroid hormone-related protein implicated in malignant hypercalcemia: cloning and expression. Science 237:893-896, 1987.

Vortkamp, A.; Lee, K.; Lanske, B.; Segre, G. V.; Kronenberg, H. M.; Tabin, C. J.: Regulation of rate of cartilage differentiation by Indian hedgehog and PTH-related protein. Science 273:613-622,1996.

Wysolmerski, J. J.; Cormier, S.; Philbrick, W. M.; Dann, P.; Zhang, J.-P.; Roume, J.; Delezoide, A.-L.; Silve, C.: Absence of functional type 1 parathyroid hormone (PTH)/PTH-related protein receptors in human S is associated with abnormal breast development and tooth impaction. J. Clin. Endocr. Metab. 86:1788-1794, 2001.

Wysolmerski, J. J.; Philbrick, W. M.; Dunbar, M. E.; Lanske, B.; Kronenberg, H.; Broadus, A. E.: Rescue of the parathyroid hormone-related protein knockout mouse demonstrates that parathyroid hormone-related protein is essential for mammary gland development. Development 125:1285-1294, 1998.

Yasuda, T.; Banville, D.; Hendy, G. N.; Goltzman, D.: characterization of the human parathyroid hormone-like peptide gene: functional and evolutionary aspects. J. Biol. Chem. 264:7720-7725, 1989.

Fischer, M. B.; Roeckl, C.; Parizek, P.; Schwarz, H. P.; Aguzzi, A.: Binding of disease-associated prion protein to plasminogen. Nature 408:479-483, 2000.

Lemyre, E.; Russo, P.; Melancon, S. B.; Gagne, R.; Potier, M.; Lambert, M.: Clinical spectrum of infantile free sialic acid storage disease. Am. J. Med. Genet. 82:385-391, 1999.

Mancini, G. M. S.; Beerens, C. E. M. T.; Aula, P. P.; Verheijen, F. W.: Sialic acid storage diseases: a multiple lysosomal transport defect for acidic monosaccharides. J. Clin. Invest. 87:1329-1335,1991.

Schleutker, J.; Laine, A.-P.; Haataja, L.; Renlund, M.; Weissenbach, J.; Aula, P.; Peltonen, L.: Linkage disequilibrium utilized to establish a refined genetic position of the Salla disease locus on 6q14-q15. Genomics 27:286-292, 1995.

Schleutker, J.; Leppanen, P.; Mansson, J.-E.; Erikson, A.; Weissenbach, J.; Peltonen, L.; Aula, P.: Lysosomal free sialic acid storage disorders with different phenotypic presentations--infantile-form sialic acid storage disease and Salla disease--represent allelic disorders on6q14-15. Am. J. Hum. Genet. 57:893-901, 1995.

Tondeur, M.; Libert, J.; Vamos, E.; Van Hoof, F.; Thomas, G. H.; Strecker, G.: Infantile form of sialic acid storage disorder: clinical, ultrastructural, and biochemical studies in two siblings. Europ. J. Pediat. 139:142-147, 1982.

Verheijen, F. W.; Verbeek, E.; Aula, N.; Beerens, C. E. M. T.; Havelaar, A. C.; Joosse, M.; Peltonen, L.; Aula, P.; Galjaard, H.; van der Spek, P. J.; Mancini, G. M. S.: A new gene, encoding an anion transporter, is mutated in sialic acid storage diseases. Nature Genet. 23:462-465, 1999.

Krasnewich, D. M.; Tietze, F.; Krause, W.; Pretzlaff, R.; Wenger, D. A.; Diwadkar, V.; Gahl, W. A.: Clinical and biochemical studies in an American child with sialuria. Biochem. Med. Metab. Biol. 49:90-96, 1993.

Leroy, J. G.; Seppala, R.; Huizing, M.; Dacremont, G.; De Simpel, H.; Van Coster, R. N.; Orvisky, E.; Krasnewich, D. M.; Gahl, W. A.: Dominant inheritance of sialuria, an inborn error of feedback inhibition. Am. J. Hum. Genet. 68:1419-1427, 2001.

Seppala, R.; Lehto, V.-P.; Gahl, W. A.: Mutations in the human UDP-N-acetylglucosamine 2-epimerase gene define the disease sialuria and the allosteric site of the enzyme. Am. J. Hum. Genet. 64:1563-1569,1999.

Murrell, J. R.; Spillantini, M. G.; Zolo, P.; Guazzelli, M.; Smith, M. J.; Hasegawa, M.; Redi, F.; Crowther, R. A.; Pietrini, P.; Ghetti, B.; Goedert, M.: Tau gene mutation G389R causes a tauopathy with abundant Pick body-like inclusions and axonal deposits. J. Neuropath. Exp. Neurol. 58:1207-1226, 1999.

Nagase, T.; Ishikawa, K.; Kikuno, R.; Hirosawa, M.; Nomura, N.; Ohara, O.: Prediction of the coding sequences of unidentified human genes. XV. The complete sequences of 100 new cDNA clones from brain which code for large proteins in vitro. DNA Res. 6:337-345, 1999.

Neumann, M.; Schulz-Schaeffer, W.; Crowther, R. A.; Smith, M. J.; Spillantini, M. G.; Goedert, M.; Kretzschmar, H. A.: Pick's disease associated with the novel tau gene mutation K369I. Ann. Neurol. 50:503-513, 2001.

Neve, R. L.; Harris, P.; Kosik, K. S.; Kurnit, D. M.; Donlon, T. A.: Identification of cDNA clones for the human microtubule-associated protein tau and chromosomal localization of the genes for tau and microtubule-associated protein 2. Molec. Brain Res. 1:271-280,1986.

Pickering-Brown, S.; Baker, M.; Yen, S.-H.; Liu, W.-K.; Hasegawa, M.; Cairns, N.; Lantos, P. L.; Rossor, M.; Iwatsubo, T.; Davies, Y.; Allsop, D.; Furlong, R.; Owen, F.; Hardy, J.; Mann, D.; Hutton, M.: Pick's disease is associated with mutations in the tau gene. Ann. Neurol. 48:859-867, 2000.

Poorkaj, P.: Personal Communication. Seattle, Wash. Nov. 10, 1998.

Poorkaj, P.; Bird, T. D.; Wijsman, E.; Nemens, E.; Garruto, R. M.; Anderson, L.; Andreadis, A.; Wiederholt, W. C.; Raskind, M.; Schellenberg, G. D.: Tau is a candidate gene for chromosome 17 frontotemporal dementia. Ann. Neurol. 43:815-825, 1998.

Poorkaj, P.; Kas, A.; D'Souza, I.; Zhou, Y.; Pham, Q.; Stone, M.; Olson, M. V.; Schellenberg, G. D.: A genomic sequence analysis of the mouse and human microtubule-associated protein tau. Mammalian Genome 12:700-712, 2001.

Rapoport, M.; Dawson, H. N.; Binder, L. I.; Vitek, M. P.; Ferreira, A.: Tau is essential to beta-amyloid-induced neurotoxicity. Proc. Nat. Acad. Sci. 99:6364-6369, 2002.

Rizzu, P.; Van Swieten, J. C.; Joosse, M.; Hasegawa, M.; Stevens, M.; Tibben, A.; Niermeijer, M. F.; Hillebrand, M.; Ravid, R.; Oostra, B. A.; Goedert, M.; van Duijn, C. M.; Heutink, P.: High prevalence of mutations in the microtubule-associated protein tau in a population study of frontotemporal dementia in the Netherlands. Am. J. Hum. Genet. 64:414-421, 1999.

Spillantini, M. G.; Murrell, J. R.; Goedert, M.; Farlow, M. R.; Klug, A.; Ghetti, B.: Mutation in the tau gene in familial multiple system tauopathy with presenile dementia. Proc. Nat. Acad. Sci. 95:7737-7741, 1998.

Spillantini, M. G.; Yoshida, H.; Rizzini, C.; Lantos, P. L.; Khan, N.; Rossor, M. N.; Goedert, M.; Brown, J.: A novel tau mutation (N296N) in familial dementia with swollen achromatic neurons and corticobasal inclusion bodies. Ann. Neurol. 48:939-943, 2000.

Stambolic, V.; Ruel, L.; Woodgett, J. R.: Lithium inhibits glycogen synthase kinase-3 activity and mimics Wingless signalling in intact cells. Curr. Biol. 6:1664-1668, 1996. Note: Erratum: Curr. Biol.7:196 only, 1997.

Stamer, K.; Vogel, R.; Thies, E.; Mandelkow, E.; Mandelkow, E.-M.: Tau blocks traffic of organelles, neurofilaments, and APP vesicles in neurons and enhances oxidative stress. J. Cell Biol. 156:1051-1063,2002.

Varani, L.; Hasegawa, M.; Spillantini, M. G.; Smith, M. J.; Murrell, J. R.; Ghetti, B.; Klug, A.; Goedert, M.; Varani, G.: Structure of tau exon 10 splicing regulatory element RNA and destabilization by mutations of frontotemporal dementia and parkinsonism linked to chromosome 17. Proc. Nat. Acad. Sci. 96:8229-8234, 1999.

Verpillat, P.; Camuzat, A.; Hannequin, D.; Thomas-Anterion, C.; Puel, M.; Belliard, S.; Dubois, B.; Didic, M.; Michel, B.-F.; Lacomblez, L.; Moreaud, O.; Sellal, F.; Golfier, V.; Campion, D.; Clerget-Darpoux, F.; Brice, A.: Association between the extended tau haplotype and frontotemporal dementia. Arch. Neurol. 59:935-939, 2002.

Wilhelmsen, K. C.; Lynch, T.; Pavlou, E.; Higgins, M.; Hygaard, T. G.: Localization of disinhibition-dementia-parkinsonism-amyotrophy complex to 17q21-22. Am. J. Hum. Genet. 55:1159-1165, 1994.

Yasuda, M.; Yokoyama, K.; Nakayasu, T.; Nishimura, Y.; Matsui, M.; Yokoyama, T.; Miyoshi, K.; Tanaka, C.: A Japanese patient with frontotemporal dementia and parkinsonism by a tau P301S mutation. Neurology 55:1224-1227, 2000.

Zhukareva, V.; Mann, D.; Pickering-Brown, S.; Uryu, K.; Shuck, T.; Shah, K.; Grossman, M.; Miller, B. L.; Hulette, C. M.; Feinstein, S. C.; Trojanowski, J. Q.; Lee, V. M.-Y.: Sporadic Pick's disease:a tauopathy characterized by a spectrum of pathological tau isoforms in gray and white matter. Ann. Neurol. 51:730-739, 2002.

Amack, J. D.; Mahadevan, M. S.: The myotonic dystrophy expanded CUG repeat tract is necessary but not sufficient to disrupt C2C12 myoblast differentiation. Hum. Molec. Genet. 10:1879-1887, 2001.

Chen, S. L.; Dowhan, D. H.; Hosking, B. M.; Muscat, G. E. O.:The steroid receptor coactivator, GRIP-1, is necessary for MEF-2C-dependent gene expression and skeletal muscle differentiation. Genes Dev. 14:1209-1228, 2000.

Hasty, P.; Bradley, A.; Morris, J. H.; Edmondson, D. G.; Venuti, J. M.; Olson, E. N.; Klein, W. H.: Muscle deficiency and neonatal death in mice with a targeted mutation in the myogenin gene. Nature 364:501-506, 1993.

Nabeshima, Y.; Hanaoka, K.; Hayasaka, M.; Esumi, E.; Li, S.; Nonaka, I.; Nabeshima, Y.-I.: Myogenin gene disruption results in perinatal lethality because of severe muscle defect. Nature 364:532-535,1993.

Olson, E.; Edmondson, D.; Wright, W. E.; Lin, V. K.; Guenet, J.-L.; Simon-Chazottes, D.; Thompson, L. H.; Stallings, R. L.; Schroeder, W. T.; Duvic, M.; Brock, D.; Helin, D.; Siciliano, M. J.: Myogeninis in an evolutionarily conserved linkage group on human chromosome 1q31-q41 and unlinked to other mapped muscle regulatory factor genes. Genomics 8:427-434, 1990.

Schindler, C.; Fu, X.-Y.; Improta, T.; Aebersold, R.; Darnell, J. E., Jr.: Proteins of transcription factor ISGF-3: one gene encodes the 91- and 84-kDa ISGF-3 proteins that are activated by interferon alpha. Proc. Nat. Acad. Sci. 89:7836-7839, 1992.

Eason, D. D.; Shepherd, A. T.; Blanck, G.: Interferon regulatory factor 1 tryptophan 11 to arginine point mutation abolishes DNA binding. Biochim. Biophys. Acta 1446:140-144, 1999.

Wang, N.; Perkins, K. L.: Involvement of band 3p14 in t (3;8) hereditary renal carcinoma. Cancer Genet. Cytogenet. 11:479-481,1984.

Schoenmakers, E. F. P. M.; Huysmans, C.; Van de Ven, W. J. M.:Allelic knockout of novel splice variants of human recombination repair gene RAD51B in t (12;14) uterine leiomyomas. Cancer Res. 59:19-23,1999.

Funk, C. D.; Funk, L. B.; FitzGerald, G. A.; Samuelsson, B.: characterization of human 12-lipoxygenase genes. Proc. Nat. Acad. Sci. 89:3962-3966,1992.

Yoshida, M. C.; Sasaki, M.; Mise, K.; Semba, K.; Nishizawa, M.; Yamamoto, T.; Toyoshima, K.: Regional mapping of the human proto-oncogenec-yes-1 to chromosome 18 at band q21.3. Jpn. J. Cancer Res. 76:559-562, 1985.

Goossens, M.; Brauner, R.; Czernichow, P.; Duquesnoy, P.; Rappaport, R.: Isolated growth hormone (GH) deficiency type 1A associated with a double deletion in the human GH gene cluster. J. Clin. Endocr. Metab. 62:712-716, 1986.

Hendershot, L. M.; Valentine, V. A.; Lee, A. S.; Morris, S. W.; Shapiro, D. N.: Localization of the gene encoding human BiP/GRP78, the endoplasmic reticulum cognate of the HSP70 family, to chromosome 9q34. Genomics 20:281-284, 1994.

Law, M. L.; Seeliger, M. B.; Lee, A. S.; Kao, F. T.: Genetic mapping of the structural gene coding for a glucose-regulated protein (GRP78) of 78k-dalton to the long arm of human chromosome 9. (Abstract) Cytogenet. Cell Genet. 37:518-519, 1984.

Lee, A. S.; Delegeane, A.; Scharff, D.: Highly conserved glucose-regulated protein in hamster and chicken cells: preliminary characterization of its cDNA clone. Proc. Nat. Acad. Sci. 78:4922-4925, 1981.

Lee, A. S.; Delegeane, A. M.; Baker, V.; Chow, P. C.: Transcriptional regulation of two genes specifically induced by glucose starvation in hamster mutant fibroblast cell line. J. Biol. Chem. 258:597-603,1983.

Muresan, Z.; Arvan, P.: Enhanced binding to the molecular chaperone BiP slows thyroglobulin export from the endoplasmic reticulum. Molec. Endocr. 12:458-467, 1998.

McCombie, R. R.; Dolphin, C. T.; Povey, S.; Phillips, I. R.; Shephard, E. A.: Localization of human flavin-containing monooxygenase genes FMO2 and FMO5 to chromosome 1q. Genomics 34:426-429, 1996.

Bevilacqua, M. P.; Nelson, R. M.: Selectins. J. Clin. Invest. 91:379-387, 1993.

Florian, V.; Schluter, T.; Bohnensack, R.: A new member of the sorting nexin family interacts with the C-terminus of P-selectin. Biochem. Biophys. Res. Commun. 281:1045-1050, 2001.

Herrmann, S.-M.; Ricard, S.; Nicaud, V.; Mallet, C.; Evans, A.; Ruidavets, J.-B.; Arveiler, D.; Luc, G.; Cambien, F.: The P-selectin gene is highly polymorphic: reduced frequency of the pro715 allele carriers in patients with myocardial infarction. Hum. Molec. Genet. 7:1277-1284, 1998.

Johnston, G. I.; Bliss, G. A.; Newman, P. J.; McEver, R. P.: Structure of the human gene encoding granule membrane protein-140, a member of the selectin family of adhesion receptors for leukocytes. J. Biol. Chem. 265:21381-21385, 1990.

Johnston, G. I.; Cook, R. G.; McEver, R. P.: Cloning of GMP-140, a granule membrane protein of platelets and endothelium: sequence similarity to proteins involved in cell adhesion and inflammation. Cell 56:1033-1044, 1989.

Johnston, G. I.; Le Beau, M. M.; Lemons, R. S.; McEver, R. P.:Cloning of GMP-140: chromosomal localization, molecular heterogeneity and identification of cDNAs predicting both membrane bound and soluble proteins. (Abstract) Blood 72 (suppl.):327a only, 1988.

Lages, B.; Shattil, S. J.; Bainton, D. F.; Weiss, H. J.: Decreased content and surface expression of alpha-granule membrane protein GMP-140 in one of two types of platelet alpha-delta storage pool deficiency. J. Clin. Invest. 87:919-929, 1991.

Mayadas, T. N.; Johnson, R. C.; Rayburn, H.; Hynes, R. O.; Wagner, D. D.: Leukocyte rolling and extravasation are severely compromised in P selectin-deficient mice. Cell 74:541-554, 1993.

Mazurov, A. V.; Vinogradov, D. V.; Khaspekova, S. G.; Krushinsky, A. V.; Gerdeva, L. V.; Vasiliev, S. A.: Deficiency of P-selectin in a patient with grey platelet syndrome. Europ. J. Haemat. 57:38-41, 1996.

Simon-Chazottes, D.; Matsubara, S.; Miyauchi, T.; Muramatsu, T.; Guenet, J.-L.: Chromosomal localization of two cell surface-associated molecules of potential importance in development: midkine (Mdk) and basigin (Bsg). Mammalian Genome 2:269-271, 1992.

Cool, D. R.; Normant, E.; Shen, F.; Chen, H.-C.; Pannell, L.; Zhang, Y.; Loh, Y. P.: Carboxypeptidase E is a regulated secretory pathway sorting receptor: genetic obliteration leads to endocrine disorders in Cpe (fat) mice. Cell 88:73-83, 1997.

Beg, A. A.; Sha, W. C.; Bronson, R. T.; Ghosh, S.; Baltimore, D.: Embryonic lethality and liver degeneration in mice lacking the RelA component of NF-kappa B. Nature 376:167-170, 1995.

Chen, L.; Fischle, W.; Verdin, E.; Greene, W. C.: Duration of nuclear NF-kappa-B action regulated by reversible acetylation. Science 293:1653-1657, 2001.

Deloukas, P.; Dauwerse, J. G.; van Ommen, G. J. B.; van Loon, A. P. G. M.: The human NFKB3 gene encoding the p65 subunit of transcription factor NF-kappa-B is located on chromosome 11q12. Genomics 19:592-594,1994.

Deloukas, P.; van Loon, A. P. G. M.: Genomic organization of the gene encoding the p65 subunit of NF-kappa-B: multiple variants of the p65 protein may be generated by alternative splicing. Hum. Molec. Genet. 2:1895-1900, 1993.

Neurath, M. F.; Pettersson, S.; Myer zum Buschenfelde, K.-H.; Strober, W.: Local administration of antisense phosphorothioate oligonucleotides to the p65 subunit of NF-kappa-B abrogates established experimental colitis in mice. Nature Med. 2:998-1004, 1996.

Zhong, H.; Voll, R. E.; Ghosh, S.: Phosphorylation of NF-kappaB by PKA stimulates transcriptional activity by promoting a novel bivalent interaction with the coactivator CBP/p300. Molec. Cell 1:661-671, 1998.

Biamonti, G.; Buvoli, M.; Bassi, M. T.; Morandi, C.; Cobianchi, F.; Riva, S.: Isolation of an active gene encoding human hnRNP protein A1: evidence for alternative splicing. J. Molec. Biol. 207:491-503,1989.

Buvoli, M.; Biamonti, G.; Tsoulfas, P.; Bassi, M. T.; Ghetti, A.; Riva, S.; Morandi, C.: cDNA cloning of human hnRNP protein A1 reveals the existence of multiple mRNA isoforms. Nucleic Acids Res. 16:3751-3770, 1988.

Michael, W. M.; Choi, M.; Dreyfuss, G.: A nuclear export signal in hnRNP A1: a signal-mediated, temperature-dependent nuclear protein export pathway. Cell 83:415-422, 1995.

Saccone, S.; Biamonti, G.; Maugeri, S.; Bassi, M. T.; Bunone, G.; Riva, S.; Della Valle, G.: Assignment of the human heterogeneous nuclear ribonucleoprotein A1 gene (HNRPA1) to chromosome 12q13.1 bycDNA competitive in situ hybridization. Genomics 12:171-174, 1992.

Pollard, A. J.; Sparey, C.; Robson, S. C.; Krainer, A. R.; Europe-Finner, G. N.: Spatio-temporal expression of the trans-acting splicing factors SF2/ASF and heterogeneous ribonuclear proteins A1/A1B in the myometrium of the pregnant human uterus: a molecular mechanism for regulating regional protein isoform expression in vivo. J. Clin. Endocr. Metab. 85:1928-1936, 2000.

Turc-Carel, C.; Pietrzak, E.; Kakati, S.; Kinniburgh, A. J.; Sandberg, A. A.: INT1 maps to 12q12-12q13. (Abstract) Cytogenet. Cell Genet. 46:706 only, 1987.

van't Veer, L. J.; Geurts van Kessel, A. H. M.; van Heerikhuizen, H.; van Ooyen, A.; Nusse, R.: Molecular cloning and chromosomal assignment of the human homolog of int-1, a mouse gene implicated in mammary tumorigenesis. Molec. Cell. Biol. 4:2532-2534, 1984.

van Ooyen, A.; Kwee, V.; Nusse, R.: The nucleotide sequence of the human int-1 mammary oncogene; evolutionary conservation of coding and non-coding sequences. EMBO J. 4:2905-2909, 1985.

Wolda, S. L.; Moon, R. T.: Cloning and developmental expression in Xenopus laevis of seven additional members of the Wnt family. Oncogene 7:1941-1947, 1992.

Armstrong, B. C.; Krystal, G. W.: Isolation and characterization of complementary DNA for N-cym, a gene encoded by the DNA strand opposite to N-myc. Cell Growth Differ. 3:385-390, 1992.

Brodeur, G. M.; Seeger, R. C.: Gene amplification in human neuroblastomas:basic mechanisms and clinical implications. Cancer Genet. Cytogenet. 19:101-111, 1986.

Brodeur, G. M.; Seeger, R. C.; Schwab, M.; Varmus, H. E.; Bishop, J. M.: Amplification of N-myc in untreated human neuroblastomas correlates with advanced disease stage. Science 224:1121-1124, 1984.

Campbell, G. R.; Zimmerman, K.; Blank, R. D.; Alt, F. W.; d'Eustachio, P.: Chromosomal location of N-myc and L-myc genes in the mouse. Oncogene Res. 4:47-54, 1989.

Corvi, R.; Amler, L. C.; Savelyeva, L.; Gehring, M.; Schwab, M.: MYCN is retained in single copy at chromosome 2 band p23-24 during amplification in human neuroblastoma cells. Proc. Nat. Acad. Sci. 91:5523-5527, 1994.

Emanuel, B. S.; Balaban, G.; Boyd, J. P.; Grossman, A.; Negishi, M.; Parmiter, A.; Glick, M. C.: N-myc amplification in multiple homogeneously staining regions in two human neuroblastomas. Proc. Nat. Acad. Sci. 82:3736-3740, 1985.

Garson, J. A.; van den Berghe, J. A.; Kemshead, J. T.: Novel non-isotopic in situ hybridization technique detects small (1 kb) unique sequences in routinely G-banded human chromosomes: fine mapping of N-myc and beta-NGF genes. Nucleic Acids Res. 15:4761-4770, 1987.

Guo, C.; White, P. S.; Weiss, M. J.; Hogarty, M. D.; Thompson, P. M.; Stram, D. O.; Gerbing, R.; Matthay, K. K.; Seeger, R. C.; Brodeur, G. M.; Maris, J. M.: Allelic deletion at 11q23 is common in MYCN single copy neuroblastomas. Oncogene 18:4948-4957, 1999.

Kanda, N.; Schreck, R.; Alt, F.; Bruns, G.; Baltimore, D.; Latt, S.: Isolation of amplified DNA sequences from IMR-32 human neuroblastoma cells: facilitation by fluorescence-activated flow sorting of metaphase chromosomes. Proc. Nat. Acad. Sci. 80:4069-4073, 1983.

Kohl, N. E.; Gee, C. E.; Alt, F. W.: Activated expression of the N-myc gene in human neuroblastomas and related tumors. Science 226:1335-1337, 1984.

Kohl, N. E.; Kanda, N.; Schreck, R. R.; Bruns, G.; Latt, S. A.; Gilbert, F.; Alt, F. W.: Transposition and amplification of oncogene-related sequences in human neuroblastomas. Cell 35:359-367, 1983.

Kohl, N. E.; Legouy, E.; DePinho, R. A.; Nisen, P. D.; Smith, R. K.; Gee, C. E.; Alt, F. W.: Human N-myc is closely related in organization and nucleotide sequence to c-myc. Nature 319:73-77, 1986.

Lee, W.-H.; Murphree, A. L.; Benedict, W. F.: Expression and amplification of the N-myc gene in primary retinoblastoma. Nature 309:458-460, 1984.

Michitsch, R. W.; Melera, P. W.: Nucleotide sequence of the 3-prime exon of the human N-myc gene. Nucleic Acids Res. 13:2545-2558, 1985.

Ramsay, G.; Stanton, L.; Schwab, M.; Bishop, J. M.: Human proto-oncogene N-myc encodes nuclear proteins that bind DNA. Molec. Cell. Biol. 6:4450-4457, 1986.

Reiter, J. L.; Brodeur, G. M.: High-resolution mapping of a 130-kb core region of the MYCN amplicon in neuroblastomas. Genomics 32:97-103, 1996.

Schwab, M.: Amplification of N-myc in human neuroblastomas. Trends Genet. 1:271-275, 1985.

Schwab, M.; Alitalo, K.; Klempnauer, K.-H.; Varmus, H. E.; Bishop, J. M.; Gilbert, F.; Brodeur, G.; Goldstein, M.; Trent, J.: Amplified DNA with limited homology to myc cellular oncogene is shared by human neuroblastoma cell lines and a neuroblastoma tumour. Nature 305:245-248, 1983.

Schwab, M.; Ellison, J.; Busch, M.; Rosenau, W.; Varmus, H. E.; Bishop, J. M.: Enhanced expression of the human gene N-myc consequent to amplification of DNA may contribute to malignant progression of neuroblastoma. Proc. Nat. Acad. Sci. 81:4940-4944, 1984.

Schwab, M.; Varmus, H. E.; Bishop, J. M.; Grzeschik, K.-H.; Naylor, S. L.; Sakaguchi, A. Y.; Brodeur, G.; Trent, J.: Chromosome localization in normal human cells and neuroblastomas of a gene related to c-myc. Nature 308:288-291, 1984.

Seeger, R. C.; Brodeur, G. M.; Sather, H.; Dalton, A.; Siegel, S. E.; Wong, K. Y.; Hammond, D.: Association of multiple copies of the N-myc oncogene with rapid progression of neuroblastomas. NewEng. J. Med. 313:1111-1116, 1985.

Shiloh, Y.; Shipley, J.; Brodeur, G. M.; Bruns, G.; Korf, B.; Donlon, T.; Schreck, R. R.; Seeger, R.; Sakai, K.; Latt, S. A.: Differential amplification, assembly, and relocation of multiple DNA sequences in human neuroblastomas and neuroblastoma cell lines. Proc. Nat. Acad. Sci. 82:3761-3765, 1985.

Bahou, W. F.; Nierman, W. C.; Durkin, A. S.; Potter, C. L.; Demetrick, D. J.: Chromosomal assignment of the human thrombin receptor gene:localization to region q13 of chromosome 5. Blood 82:1532-1537, 1993.

Coughlin, S. R.; Vu, T.-K. H.; Hung, D. T.; Wheaton, V. I.: characterization of a functional thrombin receptor: issues and opportunities. J. Clin. Invest. 89:351-355, 1992.

Griffin, C. T.; Srinivasan, Y.; Zheng, Y.-W.; Huang, W.; Coughlin, S. R.: A role for thrombin receptor signaling in endothelial cells during embryonic development. Science 293:1666-1670, 2001.

Poirier, C.; O'Brien, E. P.; Bueno Brunialti, A. L.; Chambard, J.-C.; Swank, R. T.; Guenet, J.-L.: The gene encoding the thrombin receptor (Cf2r) maps to mouse chromosome 13. Mammalian Genome 7:322, 1996.

Schmidt, V. A.; Nierman, W. C.; Feldblyum, T. V.; Maglott, D. R.; Bahou, W. F.: The human thrombin receptor and proteinase activated receptor-2 genes are tightly linked on chromosome 5q13. Brit. J. Haemat. 97:523-529, 1997.

Schmidt, V. A.; Vitale, E.; Bahou, W. F.: Genomic cloning and characterization of the human thrombin receptor gene: structural similarity to the proteinase activated receptor-2 gene. J. Biol. Chem. 271:9307-9312, 1996.

Vu, T.-K. H.; Hung, D. T.; Wheaton, V. I.; Coughlin, S. R.: molecular cloning of a functional thrombin receptor reveals a novel proteolytic mechanism of receptor activation. Cell 64:1057-1068, 1991.

Dean, G.: The Porphyrias. A Story of Inheritance and Environment. Philadelphia: J. B. Lippincott (pub.) (2nd ed.):1972.

Bennett, M. K.; Calakos, N.; Scheller, R. H.: Syntaxin: a synaptic protein implicated in docking of synaptic vesicles at presynaptic active zones. Science 257:255-259, 1992.

Bennett, M. K.; Garcia-Arraras, J. E.; Elferink, L. A.; Peterson, K.; Fleming, A. M.; Hazuka, C. D.; Scheller, R. H.: The syntaxin family of vesicular transport receptors. Cell 74:863-873, 1993.

Fernandez, I.; Ubach, J.; Dulubova, I.; Zhang, X.; Sudof, T. C.; Rizo, J.: Three-dimensional structure of an evolutionarily conserved N-terminal domain of syntaxin 1A. Cell 94:841-849, 1998.

Fisher, R. J.; Pevsner, J.; Burgoyne, R. D.: Control of fusion pore dynamics during exocytosis by Munc18. Science 291:875-878, 2001.

Martin-Martin, B.; Nabokina, S. M.; Lazo, P. A.; Mollinedo, F.: Co-expression of several human syntaxin genes in neutrophils and differentiating HL-60 cells: various isoforms and detection of syntaxin1. J. Leuko. Biol. 65:397-406, 1999.

Nakayama, T.; Fujiwara, T.; Miyazawa, A.; Asakawa, S.; Shimizu, N.; Shimizu, Y.; Mikoshiba, K.; Akagawa, K.: Mapping of the human HPC-1/syntaxin 1A gene (STX1A) to chromosome 7 band q11.2. Genomics 42:173-176, 1997.

Naren, A. P.; Di, A.; Cormet-Boyaka, E.; Boyaka, P. N.; McGhee, J. R.; Zhou, W.; Akagawa, K.; Fujiwara, T.; Thome, U.; Engelhardt, J. F.; Nelson, D. J.; Kirk, K. L.: Syntaxin 1A is expressed in airway epithelial cells, where it modulates CFTR Cl- currents. J. Clin. Invest. 105:377-386, 2000.

Richmond, J. E.; Weimer, R. M.; Jorgensen, E. M.: An open form of syntaxin bypasses the requirement for UNC-13 in vesicle priming. Nature 412:338-341, 2001.

Zhang, R.; Maksymowych, A. B.; Simpson, L. L.: Cloning and sequence analysis of a cDNA encoding human syntaxin 1A, a polypeptide essential for exocytosis. Gene 159:293-294, 1995.

Shepley, M. P.; Sherry, B.; Weiner, H. L.: Monoclonal antibody identification of a 100-kDa membrane protein in HeLa cells and human spinal cord involved in poliovirus attachment. Proc. Nat. Acad. Sci. 85:7743-7747, 1988.

Siddique, T.; Bartlett, R. J.; McKinney, R.; Hung, W.-Y.; Bruns, G.; Wilfert, C.; Roses, A. D.: The polio virus sensitivity (PVS) is on chromosome 19q13-qter. (Abstract) Cytogenet. Cell Genet. 40:745 only, 1985.

Siddique, T.; McKinney, R.; Hung, W.-Y.; Bartlett, R. J.; Bruns, G.; Mohandas, T. K.; Ropers, H.-H.; Wilfert, C.; Roses, A. D.: The polio virus sensitivity (PVS) gene is on chromosome 19q12-q13.2. Genomics 3:156-160, 1988.

Solecki, D. J.; Gromeier, M.; Mueller, S.; Bernhardt, G.; Wimmer, E.: Expression of the human polio virus receptor/CD155 gene is activated by Sonic hedgehog. J. Biol. Chem. 277:25697-25702, 2002.

Morris, C. M.; Bodger, M. P.: Localization of the human poly (A)-binding protein gene (PAB1) to chromosomal regions 3q22-q25, 12q13-q14, and13q12-q13 by in situ hybridization. Genomics 15:209-211, 1993.

Alkhatib, H. M.; Chen, D.; Cherney, B.; Bhatia, K.; Notario, V.; Giri, C.; Stein, G.; Slattery, E.; Roeder, R. G.; Smulson, M. E.:Cloning and expression of cDNA for human poly (ADP-ribose) polymerase. Proc. Nat. Acad. Sci. 84:1224-1228, 1987.

Auer, B.; Nagl, U.; Herzog, H.; Schneider, R.; Schweiger, M.: Human nuclear NAD+ ADP-ribosyltransferase (polymerizing): organization of the gene. DNA 8:575-580, 1989.

Baumgartner, M.; Schneider, R.; Auer, B.; Herzog, H.; Schweiger, M.; Hirsch-Kauffmann, M.: Fluorescence in situ mapping of the human nuclear NAD+ ADP-ribosyltransferase gene (ADPRT) and two secondary sites to human chromosomal bands 1q42, 13q34, and 14q24. Cytogenet. Cell Genet. 61:172-174, 1992.

Cherney, B. W.; McBride, O. W.; Chen, D.; Alkhatib, H.; Bhatia, K.; Hensley, P.; Smulson, M. E.: cDNA sequence, protein structure, and chromosomal location of the human gene for poly (ADP-ribose) polymerase. Proc. Nat. Acad. Sci. 84:8370-8374, 1987.

d'Adda di Fagagna, F.; Hande, M. P.; Tong, W.-M.; Lansdorp, P. M.; Wang, Z.-Q.; Jackson, S. P.: Functions of poly (ADP-ribose) polymerase in controlling telomere length and chromosomal stability. Nature Genet. 23:76-80, 1999.

Doll, J. A.; Suarez, B. K.; Donis-Keller, H.: Association between prostate cancer in black Americans and an allele of the PADPRP pseudogene locus on chromosome 13. (Letter) Am. J. Hum. Genet. 58:425-428, 1996.

Bhatia, K. G.; Cherney, B. W.; Huppi, K.; Magrath, I. T.; Cossman, J.; Sausville, E.; Barriga, F.; Johnson, B.; Gause, B.; Bonney, G.; Neequayi, J.; DeBernardi, M.; Smulson, M.: A deletion linked to a poly (ADP-ribose) polymerase gene on chromosome 3q33-qter occurs frequently in the normal black population as well as in multiple tumor DNA. CancerRes. 50:5406-5413, 1990.

Flick, K.; Schneider, R.; Auer, B.; Hirsch-Kauffmann, M.; Schweiger, M.: No abnormalities in the NAD(+) ADP-ribosyltransferase (polymerizing) gene of transformed cells from a Fanconi's anemia patient. (Letter) Hum. Genet. 89:690-691, 1992.

Grube, K.; Burkle, A.: Poly (ADP-ribose) polymerase activity in mononuclear leukocytes of 13 mammalian species correlates with species-specific life span. Proc. Nat. Acad. Sci. 89:11759-11763, 1992.

Herzog, H.; Zabel, B.; Schneider, R.; Auer, B.; Hirsch-Kauffmann, M.; Schweiger, M.: Human NAD(+):protein ADP ribosyltransferase (ADPRT):synthesis of active enzyme in E. coli, sequence of its cDNA from Helacells and chromosomal localization. Biol. Chem. Hoppe-Seyler 369:836-837, 1988.

Herzog, H.; Zabel, B. U.; Schneider, R.; Auer, B.; Hirsch-Kauffmann, M.; Schweiger, M.: Human nuclear NAD(+) ADP-ribosyltransferase: localization of the gene on chromosome 1q41-q42 and expression of an active human enzyme in Escherichia coli. Proc. Nat. Acad. Sci. 86:3514-3518, 1989.

Keijzer, W.; Stefanini, M.; Bootsma, D.; Verkerk, A.; Geurts vanKessel, A. H. M.; Jongkind, J. F.; Westerveld, A.: Localization of a gene involved in complementation of the defect in xeroderma pigmentosum group A cells on human chromosome 1. Exp. Cell Res. 169:490-501, 1987.

Kurosaki, T.; Ushiro, H.; Mitsuuchi, Y.; Suzuki, S.; Matsuda, M.; Matsuda, Y.; Katunuma, N.; Kangawa, K.; Matsuo, H.; Hirose, T.; Inayama, S.; Shizuta, Y.: Primary structure of human poly (ADP-ribose) synthetase as deduced from cDNA sequence. J. Biol. Chem. 262:15990-15997, 1987.

Loetscher, P.; Alvarez-Gonzalez, R.; Althaus, F. R.: Poly (ADP-ribose) may signal changing metabolic conditions to the chromatin of mammalian cells. Proc. Nat. Acad. Sci. 84:1286-1289, 1987.

Lyn, D.; Cherney, B. W.; Lalande, M.; Berenson, J. R.; Lichtenstein, A.; Lupold, S.; Bhatia, K. G.; Smulson, M.: A duplicated region is responsible for the poly (ADP-ribose) polymerase polymorphism, on chromosome 13, associated with a predisposition to cancer. Am. J. Hum. Genet. 52:124-134, 1993.

McBride, O. W.; Cherney, B.; Takourdin, C.; Smulson, M. E.: human poly (ADP-ribose) polymerase sequences are located on chromosomes 1,13, and 14. (Abstract) Cytogenet. Cell Genet. 46:659-660, 1987.

Pieper, A. A.; Brat, D. J.; Krug, D. K.; Watkins, C. C.; Gupta, A.; Blackshaw, S.; Verma, A.; Wang, Z.-Q.; Snyder, S. H.: Poly (ADP-ribose) polymerase-deficient mice are protected from streptozotocin-induced diabetes. Proc. Nat. Acad. Sci. 96:3059-3064, 1999.

Schweiger, M.; Auer, B.; Burtscher, H. J.; Hirsch-Kauffmann, M.; Klocker, H.; Schneider, R.: DNA repair in human cells: biochemistry of the hereditary diseases Fanconi's anaemia and Cockayne syndrome. Europ. J. Biochem. 165:235-242, 1987.

Simbulan-Rosenthal, C. M.; Haddad, B. R.; Rosenthal, D. S.; Weaver, Z.; Coleman, A.; Luo, R.; Young, H. M.; Wang, Z.-Q.; Ried, T.; Smulson, M. E.: Chromosomal aberrations in PARP -/- mice: genome stabilization in immortalized cells by reintroduction of poly (ADP-ribose) polymerase cDNA. Proc. Nat. Acad. Sci. 96:13191-13196, 1999.

Smithies, O.; Gregg, R. G.; Boggs, S. S.; Koralewski, M. A.; Kucherlapati, R. S.: Nature (London) 317:230-234, 1985.

Hasan, S.; Hassa, P. O.; Imhof, R.; Hottiger, M. O.: Transcription coactivator p300 binds PCNA and may have a role in DNA repair synthesis. Nature 410:387-391, 2001.

Hoege, C.; Pfander, B.; Moldovan, G.-L.; Pyrowolakis, G.; Jentsch, S.: RAD6-dependent DNA repair is linked to modification of PCNA by ubiquitin and SUMO. Nature 419:135-141, 2002.

Fonatsch, C.; Duchrow, M.; Rieder, H.; Schluter, C.; Gerdes, J.: Assignment of the human Ki-67 gene (MKI67) to 10q25-qter. Genomics 11:476-477, 1991.

Schluter, C.; Duchrow, M.; Wohlenberg, C.; Becker, M. H. G; Key, G.; Flad, H.-D.; Gerdes, J.: The cell proliferation-associated antigen of antibody Ki-67: a very large, ubiquitous nuclear protein with numerous repeated elements, representing a new kind of cell cycle-maintaining proteins. J. Cell. Biol. 123:513-522, 1993.

Schonk, D. M.; Kuijpers, H. J. H.; vanDrunen, E.; van-Dalen, C. H.; Geurts van Kessel, A. H. M.; Verheijen, R.; Ramaekers, F. C. S.: Assignment of the gene (s) involved in the expression of the proliferation-related Ki-67 antigen to human chromosome 10. Hum. Genet. 83:297-299, 1989.

Traut, W.; Scholzen, T.; Winking, H.; Kubbutat, M. H. G.; Gerdes, J.: Assignment of the murine Ki-67 gene (Mki67) to chromosome band7F3-F5 by in situ hybridization. Cytogenet. Cell Genet. 83:12-13, 1998.

Erdile, L. F.; Heyer, W.-D.; Kolodner, R.; Kelly, T. J.: characterization of a cDNA encoding the 70-kDa single-stranded DNA-binding subunit of human replication protein A and the role of the protein in DNA replication. J. Biol. Chem. 266:12090-12098, 1991.

Gomes, X. V.; Wold, M. S.: Functional domains of the 70-kilodalton subunit of human replication protein A. Biochemistry 35:10558-10568, 1996.

Shen, L. X.; Basilion, J. P.; Stanton, V. P., Jr.: Single-nucleotide polymorphisms can cause different structural folds of mRNA. Proc. Nat. Acad. Sci. 96:7871-7876, 1999.

Umbricht, C. B.; Erdile, L. F.; Jabs, E. W.; Kelly, T. J.: Cloning, overexpression, and genomic mapping of the 14-kDa subunit of human Replication protein A. J. Biol. Chem. 268:6131-6138, 1993.

Umbricht, C. B.; Griffin, C. A.; Hawkins, A. L.; Grzeschik, K. H.; O'Connell, P.; Leach, R.; Green, E. D.; Kelly, T. J.: High-resolution genomic mapping of the three human replication protein A genes (RPA1, RPA2, and RPA3). Genomics 20:249-257, 1994.

Bilbe, G.; Delabie, J.; Bruggen, J.; Richener, H.; Asselbergs, F. A. M.; Cerletti, N.; Sorg, C.; Odink, K.; Tarcsay, L.; Wiesendanger, W.; DeWolf-Peeters, C.; Shipman, R.: Restin: a novel intermediate filament-associated protein highly expressed in the Reed-Sternberg cells of Hodgkin's disease. EMBO J. 11:2103-2113, 1992.

Delabie, J.; Shipman, R.; Bruggen, J.; De Strooper, B.; van Leuven, F.; Tarcsay, L.; Cerletti, N.; Odink, K.; Diehl, V.; Bilbe, G.; DeWolf-Peeters, C.: Expression of the novel intermediate filament-associated protein restin in Hodgkin's disease and anaplastic large-cell lymphoma. Blood 80:2891-2896, 1992.

Fukata, M.; Watanabe, T.; Noritake, J.; Nakagawa, M.; Yamaga, M.; Kuroda, S.; Matsuura, Y.; Iwamatsu, A.; Perez, F.; Kaibuchi, K.:Rac1 and Cdc42 capture microtubules through IQGAP1 and CLIP-170. Cell 109:873-885, 2002.

Griparic, L.; Keller, T. C. S., III: Identification and expression of two novel CLIP-170/restin isoforms expressed predominantly in muscle. Biochim. Biophys. Acta 1405:35-46, 1998.

Hilliker, C.; Delabie, J.; Speleman, F.; Bilbe, G.; Bruggen, J.; Van Leuven, F.; Van Den Berghe, H.: Localization of the gene (RSN) coding for restin, a marker for Reed-Sternberg cells in Hodgkin's disease, to human chromosome band 12q24.3 and YAC cloning of the locus. Cytogenet. Cell Genet. 65:172-176, 1994.

Meyaard, L.; van der Vuurst de Vries, A.-R.; de Ruiter, T.; Lanier, L. L.; Phillips, J. H.; Clevers, H.: The epithelial cellular adhesion molecule (Ep-CAM) is a ligand for the leukocyte-associated immunoglobulin-like receptor (LAIR). J. Exp. Med. 194:107-112, 2001.

Hitchins, M. P.; Monk, D.; Bell, G. M.; Ali, Z.; Preece, M. A.; Stanier, P.; Moore, G. E.: Maternal repression of the human GRB10 gene in the developing central nervous system; evaluation of the role for GRB10 in Silver-Russell syndrome. Europ. J. Hum. Genet. 9:82-90,2001.

McCann, J. A.; Zheng, H.; Islam, A.; Goodyer, C. G.; Polychronakos, C.: Evidence against GRB10 as the gene responsible for Silver-Russell syndrome. Biochem. Biophys. Res. Commun. 286:943-948, 2001.

Miyoshi, N.; Kuroiwa, Y.; Kohda, T.; Shitara, H.; Yonekawa, H.; Kawabe, T.; Hasegawa, H.; Barton, S. C.; Surani, M. A.; Kaneko-Ishino, T.; Ishino, F.: Identification of the Meg1/Grb10 imprinted gene on mouse proximal chromosome 11, a candidate for the Silver-Russell syndrome gene. Proc. Nat. Acad. Sci. 95:1102-1107, 1998.

Yoshihashi, H.; Maeyama, K.; Kosaki, R.; Ogata, T.; Tsukahara, M.; Goto, Y.; Hata, J.; Matsuo, N.; Smith, R. J.; Kosaki, K.: Imprinting of human GRB10 and its mutations in two patients with Russell-Silver syndrome. Am. J. Hum. Genet. 67:476-482, 2000.

Grob, P. M.; Ross, A. H.; Koprowski, H.; Bothwell, M.: characterization of the human melanoma nerve growth factor receptor. J. Biol. Chem. 260:8044-8049, 1985.

Stanton, L. W.; Schwab, M.; Bishop, J. M.: Nucleotide sequence of the human N-myc gene. Proc. Nat. Acad. Sci. 83:1772-1776, 1986.

Brown, M. A.; Nicolai, H.; Xu, C.-F.; Griffiths, B. L.; Jones, K. A.; Solomon, E.; Hosking, L.; Trowsdale, J.; Black, D. M.; McFarlane, R.: Regulation of BRCA1. (Letter) Nature 372:733 only, 1994.

Brown, M. A.; Xu, C.-F.; Nicolai, H.; Griffiths, B.; Chambers, J. A.; Black, D.; Solomon, E.: The 5-prime end of the BRCA1 gene lies within a duplicated region of human chromosome 17q21. Oncogene 12:2507-2513, 1996.

Campbell, I. G.; Nicolai, H. M.; Foulkes, W. D.; Senger, G.; Stamp, G. W.; Allan, G.; Boyer, C.; Jones, K.; Bast, R. C., Jr.; Solomon, E.; Trowsdale, J.; Black, D. M.: A novel gene encoding a B-box protein within the BRCA1 region at 17q21.1. Hum. Molec. Genet. 3:589-594,1994.

Kawashima, K.; Shikama, H.; Imoto, K.; Izawa, M.; Naruke, T.; Okabayashi, K.; Nishimura, S.: Close correlation between restriction fragment length polymorphism of the L-MYC gene and metastasis of human lung cancer to the lymph nodes and other organs. Proc. Nat. Acad. Sci. 85:2353-2356, 1988.

Kaye, F.; Battey, J.; Nau, M.; Brooks, B.; Seifter, E.; De Greve, J.; Birrer, M.; Sausville, E.; Minna, J.: Structure and expression of the human L-myc gene reveal a complex pattern of alternative mRNA processing. Molec. Cell. Biol. 8:186-195, 1988.

McBride, O. W.; Kirsch, I.; Hollis, G.; Nau, M.; Battey, J.; Minna, J.: Human L-myc (MYCL) proto-oncogene is on chromosome 1p32.(Abstract) Cytogenet. Cell Genet. 40:694 only, 1985.

Nau, M. M.; Brooks, B. J.; Battey, J.; Sausville, E.; Gazdar, A. F.; Kirsch, I. R.; McBride, O. W.; Bertness, V.; Hollis, G. F.; Minna, J. D.: L-myc, a new myc-related gene amplified and expressed in human small cell lung cancer. Nature 318:69-73, 1985.

Rouleau, G. A.; Bazanowski, A.; Gusella, J. F.; Haines, J. L.:A genetic map of chromosome 1: comparison of different data sets and linkage programs. Genomics 7:313-318, 1990.

Speleman, F.; Van Camp, G.; Van Roy, N.: Reassignment of MYCL1to human chromosome 1p34.3 by fluorescence in situ hybridization. Cytogenet. Cell Genet. 72:189-190, 1996.

Van Roy, N.; Cheng, N. C.; Laureys, G.; Opdenakker, G.; Versteeg, R.; Speleman, F.: Molecular cytogenetic analysis of 1;17 translocations in neuroblastoma. Europ. J. Cancer 31A: 530-535, 1995.

Dean, M.; Park, M.; Le Beau, M. M.; Robins, T. S.; Diaz, M. O.; Rowley, J. D.; Blair, D. G.; Vande Woude, G. F.: The human met oncogeneis related to the tyrosine kinase oncogenes. Nature 318:385-388,1985.

Akiyama, T.; Sudo, C.; Ogawara, H.; Toyoshima, K.; Yamamoto, T.: The product of the human c-erbB-2 gene: a 185-kilodalton glycoprotein with tyrosine kinase activity. Science 232:1644-1646, 1986.

Ameyaw, M.-M.; Tayeb, M.; Thornton, N.; Folayan, G.; Tariq, M.; Mobarek, A.; Evans, D. A. P.; Ofori-Adjei, D.; McLeod, H. L.: Ethnic variation in the HER-2 codon 655 genetic polymorphism previously associated with breast cancer. J. Hum. Genet. 47:172-175, 2002.

Chan, J. Y. C.; Lerman, M. I.; Prabhakar, B. S.; Isozaki, O.; Santisteban, P.; Kuppers, R. C.; Oates, E. L.; Notkins, A. L.; Kohn, L. D.: Cloning and characterization of a cDNA that encodes a 70-kDa novel human thyroid autoantigen. J. Biol. Chem. 264:3651-3654, 1989.

Goedecke, W.; Eijpe, M.; Offenberg, H. H.; van Aalderen, M.; Heyting, C.: Mre11 and Ku70 interact in somatic cells, but are differentially expressed in early meiosis. Nature Genet. 23:194-198, 1999.

Hartley, K. O.; Gell, D.; Smith, G. C. M.; Zhang, H.; Divecha, N.; Connelly, M. A.; Admon, A.; Lees-Miller, S. P.; Anderson, C. W.; Jackson, S. P.: DNA-dependent protein kinase catalytic subunit: a relative of phosphatidylinositol 3-kinase and the ataxia telangiectasia gene product. Cell 82:849-856, 1995.

Koike, M.; Matsuda, Y.; Mimori, T.; Harada, Y.-N.; Shiomi, N.; Shiomi, T.: Chromosomal localization of the mouse and rat DNA double-strand break repair genes Ku p70 and Ku p80/XRCC5 and their mRNA expression in various mouse tissues. Genomics 38:38-44, 1996.

Kusano, K.; Johnson-Schlitz, D. M.; Engels, W. R.: Sterility of Drosophila with mutations in the Bloom syndrome gene--complementation by Ku70. Science 291:2600-2602, 2001.

Li, G. C.; Ouyang, H.; Li, X.; Nagasawa, H.; Little, J. B.; Chen, D. J.; Ling, C. C.; Fuks, Z.; Cordon-Cardo, C.: Ku70: a candidate tumor suppressor gene for murine T cell lymphoma. Molec. Cell 2:1-8, 1998.

McBride, O. W.; Chan, J. Y. C.; Notkins, A. L.; Kohn, L. D.; Lerman, M.: The TSH receptor gene is located on human chromosome 22 and homologous sequences are present on chromosomes 1q, 8, 10, and Xq. (Abstract) Am. J. Hum. Genet. 41: A177, 1987.

Mitchell, A. L.; Bale, A. E.; Chan, J.; Kohn, L.; Gonzalez, F.; McBride, O. W.: Localization of TSHR gene and cytochrome p450 IID subfamily on chromosome 22 by linkage analysis. (Abstract) Cytogenet. Cell Genet. 51:1045, 1989.

Reeves, W. H.; Sthoeger, Z. M.: Molecular cloning of cDNA encoding the p70 (Ku) lupus autoantigen. J. Biol. Chem. 264:5047-5052, 1989.

Takata, M.; Sasaki, M. S.; Sonoda, E.; Morrison, C.; Hashimoto, M.; Utsumi, H.; Yamaguchi-Iwai, Y.; Shinohara, A.; Takeda, S.: Homologous recombination and non-homologous end-joining pathways of DNA double-strandbreak repair have overlapping roles in the maintenance of chromosomal integrity in vertebrate cells. EMBO J. 17:5497-5508, 1998.

Takiguchi, Y.; Kurimasa, A.; Chen, F.; Pardington, P. E.; Kuriyama, T.; Okinaka, R. T.; Moyzis, R.; Chen, D. J.: Genomic structure and chromosomal assignment of the mouse Ku70 gene. Genomics 35:129-135,1996.

Tuteja, N.; Tuteja, R.; Ochem, A.; Taneja, P.; Huang, N. W.; Simoncsits, A.; Susic, S.; Rahman, K.; Marusic, L.; Chen, J.; Zhang, J.; Wang, S.; Pongor, S.; Falaschi, A.: Human DNA helicase II: a novel DNA unwinding enzyme identified as the Ku autoantigen. EMBO J. 13:4991-5001,1994.

Walker, J. R.; Corpina, R. A.; Goldberg, J.: Structure of the Ku heterodimer bound to DNA and its implications for double-strand break repair. Nature 412:607-614, 2001.

Chen, S.-H.; Anderson, J. E.; Giblett, E. R.: Human red cell 2,3-diphosphoglycerate mutase and monophosphoglycerate mutase: genetic evidence for two separate loci. Am. J. Hum. Genet. 29:405-407, 1977.

Strissel, P. L.; Strick, R.; Tomek, R. J.; Roe, B. A.; Rowley, J. D.; Zeleznik-Le, N. J.: DNA structural properties of AF9 are similar to MLL and could act as recombination hot spots resulting in MLL/AF9 translocations and leukemogenesis. Hum. Molec. Genet. 9:1671-1679,2000.

Isnard, P.; Depetris, D.; Mattei, M.-G.; Ferrier, P.; Djabali, M.: cDNA cloning, expression and chromosomal localization of the murine AF-4 gene involved in human leukemia. Mammalian Genome 9:1065-1068, 1998.

Lovett, B. D.; Lo Nigro, L.; Rappaport, E. F.; Blair, I. A.; Osheroff, N.; Zheng, N.; Megonigal, M. D.; Williams, W. R.; Nowell, P. C.; Felix, C. A.: Near-precise interchromosomal recombination and functional DNA topoisomerase II cleavage sites at MLL and AF-4 genomic breakpoints in treatment-related acute lymphoblastic leukemia with t (4;11) translocation. Proc. Nat. Acad. Sci. 98:9802-9807, 2001.

Uckun, F. M.; Herman-Hatten, K.; Crotty, M.-L.; Sensel, M. G.; Sather, H. N.; Tuel-Ahlgren, L.; Sarquis, M. B.; Bostrom, B.; Nachman, J. B.; Steinherz, P. G.; Gaynon, P. S.; Heerema, N.: Clinical significance of MLL-AF4 fusion transcript expression in the absence of a cytogenetically detectable t (4;11)(q21; q23) chromosomal translocation. Blood 92:810-821, 1998.

Prasad, R.; Gu, Y.; Alder, H.; Nakamura, T.; Canaani, O.; Saito, H.; Huebner, K.; Gale, R. P.; Nowell, P. C.; Kuriyama, K.; Miyazaki, Y.; Croce, C. M.; Canaani, E.: Cloning of the ALL-1 fusion partner, the AF-6 gene, involved in acute myeloid leukemias with the t (6;11) chromosome translocation. Cancer Res. 53:5624-5628, 1993.

Saha, V.; Lillington, D. M.; Shelling, A. N.; Chaplin, T.; Yaspo, M.-L.; Ganesan, T. S.; Young, B. D.: AF6 gene on chromosome band 6q27 maps distal to the minimal region of deletion in epithelial ovarian cancer. Genes Chromosomes Cancer 14:220-222, 1995.

Van Cong, N.; Moullec, J.: Linkage probable entre les groupes de phosphatase acide des globules rouges et le systeme Lewis. Ann. Genet. 14:121-125, 1971.

Wakita, Y.; Narahara, K.; Takahashi, Y.; Kikkawa, K.; Kimura, S.; Oda, M.; Kimoto, H.: Duplication of 2p25: confirmation of the assignment of soluble acid phosphatase (ACP1) locus to 2p25. Hum. Genet. 71:259-260, 1985.

Weitkamp, L. R.; Janzen, M. K.; Guttormsen, S. A.; Gershowitz, H.: Inherited pericentric inversion of chromosome number two: a linkage study. Ann. Hum. Genet. 33:53-59, 1969.

Weitkamp, L. R.; Lovrien, E. W.; Olaisen, B.; Fenger, K.; Gedde-Dahl, T., Jr.; Sorensen, S. A.; Conneally, P. M.; Bias, W. B.; Ott, J.:Linkage relations of the loci for the MN blood group and red cell phosphate. Birth Defects Orig. Art. Ser. 11(3):276-280, 1975. Note:Alternate: Cytogenet. Cell Genet. 14:446-450, 1975..

Wo, Y.-Y. P.; McCormack, A. L.; Shabanowitz, J.; Hunt, D. F.; Davis, J. P.; Mitchell, G. L.; Van Etten, R. L.: Sequencing, cloning, and expression of human red cell-type acid phosphatase, a cytoplasmicphosphotyrosyl protein phosphatase. J. Biol. Chem. 267:10856-10865,1992.

Yoshihara, C. M.; Mohrenweiser, H. W.: Characterization of ACP1(TIC-1), an electrophoretic variant of erythrocyte acid phosphatase restricted to the Ticuna Indians of Central Amazonas. Am. J. Hum. Genet. 32:898-907, 1980.

Lowenstein, C. J.; Glatt, C. S.; Bredt, D. S.; Snyder, S. H.:Cloned and expressed macrophage nitric oxide synthase contrasts with the brain enzyme. Proc. Nat. Acad. Sci. 89:6711-6715, 1992.

Bredt, D. S.; Hwang, P. M.; Glatt, C. E.; Lowenstein, C.; Reed, R. R.; Snyder, S. H.: Cloned and expressed nitric oxide synthase structurally resembles cytochrome P-450 reductase. Nature 351:714-718,1991.

Brenman, J. E.; Chao, D. S.; Xia, H.; Aldape, K.; Bredt, D. S.: Nitric oxide synthase complexed with dystrophin and absent from skeletal muscle sarcolemma in Duchenne muscular dystrophy. Cell 82:743-752, 1995.

Burnett, A. L.; Lowenstein, C. J.; Bredt, D. S.; Chang, T. S. K.; Snyder, S. H.: Nitric oxide: a physiologic mediator of penile erection. Science 257:401-403, 1992.

Day, B. J.; Patel, M.; Calavetta, L.; Chang, L.-Y.; Stamler, J. S.: A mechanism of paraquat toxicity involving nitric oxide synthase. Proc. Nat. Acad. Sci. 96:12760-12765, 1999.

Deans, Z.; Dawson, S. J.; Xie, J.; Young, A. P.; Wallace, D.; Latchman, D. S.: Differential regulation of the two neuronal nitric-oxide synthase gene promoters by the Oct-2 transcription factor. J. Biol. Chem. 271:32153-32158, 1996.

Gu, Z.; Kaul, M.; Yan, B.; Kridel, S. J.; Cui, J.; Strongin, A.; Smith, J. W.; Liddington, R. C.; Lipton, S. A.: S-nitrosylation of matrix metalloproteinases: signaling pathway to neuronal cell death. Science 297:1186-1190, 2002.

Kharazia, V. N.; Schmidt, H. H. H. W.; Weinberg, R. J.: Type I nitric oxide synthase fully accounts for NADPH-diaphorase in rat striatum, but not cortex. Neuroscience 62:983-987, 1994.

Kishimoto, J.; Spurr, N.; Liao, M.; Lizhi, L.; Emson, P.; Xu, W.: Localization of brain nitric oxide synthase (NOS) to human chromosome 12. Genomics 14:802-804, 1992.

Kuo, R. C.; Baxter, G. T.; Thompson, S. H.; Stricker, S. A.; Patton, C.; Bonaventura, J.; Epel, D.: NO is necessary and sufficient for egg activation at fertilization. Nature 406:633-636, 2000.

Lee, C. G. L.; Gregg, A. R.; O'Brien, W. E.: Localization of the neuronal form of nitric oxide synthase to mouse chromosome 5. Mammalian Genome 6:56-57, 1995.

Magee, T.; Fuentes, A. M.; Garban, H.; Rajavashisth, T.; Marquez, D.; Rodriguez, J. A.; Rajfer, J.; Gonzalez-Cadavid, N. F.: Cloning of a novel neuronal nitric oxide synthase expressed in penis and lower urinary tract. Biochem. Biophys. Res. Commun. 226:145-151, 1996.

Devlin, R.; Henderson, H.; Monsalve, V.; Brunzell, J.; Deeb, S.; Hayden, M. R.: The molecular biology of hypertriglyceridemia: characterization of mutations in patients with lipoprotein lipase deficiency. (Abstract) Am. J. Hum. Genet. 45 (suppl.): A4, 1989.

Chynn, E. W.; Walton, D. S.; Hahn, L. B.; Dryja, T. P.: Norriedisease: diagnosis of a simplex case by DNA analysis. Arch. Ophthal. 114:1136-1138, 1996.

Thomas, S. A.; Palmiter, R. D.: Impaired maternal behavior in mice lacking norepinephrine and epinephrine. Cell 91:583-592, 1997.

Thomas, S. A.; Palmiter, R. D.: Thermoregulatory and metabolic phenotypes of mice lacking noradrenaline and adrenaline. Nature 387:94-97, 1997.

Weinshilboum, R. M.: Catecholamine biochemical genetics in human populations. In: Breakefield, X. O.: Neurogenetics: Genetic Approaches to the Nervous System. New York: Elsevier/North Holland (pub.) 1979. Pp. 257-282.

Weinshilboum, R. M.; Schrott, H. G.; Raymond, F. A.; Weidman, W. H.; Elveback, L. R.: Inheritance of very low serum dopamine-beta-hydroxylase activity. Am. J. Hum. Genet. 27:573-585, 1975.

Wilson, A. F.; Elston, R. C.; Siervogel, R. M.; Tran, L. D.:Linkage of a gene regulating dopamine-beta-hydroxylase activity and the ABO blood group locus. Am. J. Hum. Genet. 42:160-166, 1988.

Wilson, A. F.; Elston, R. C.; Siervogel, R. M.; Tran, L. D.:Linkage of a gene regulating dopamine-beta-hydroxylase activity and the ABO blood group locus. (Abstract) Am. J. Hum. Genet. 41: A191only, 1987.

Zabetian, C. P.; Anderson, G. M.; Buxbaum, S. G.; Elston, R. C.; Ichinose, H.; Nagatsu, T.; Kim, K.-S.; Kim, C.-H.; Malison, R. T.; Gelernter, J.; Cubells, J. F.: A quantitative-trait analysis of human plasma-dopamine beta-hydroxylase activity: evidence for a major functional polymorphism at the DBH locus. Am. J. Hum. Genet. 68:515-522, 2001.

Shiomi, T.; Harada, Y.; Saito, T.; Shiomi, N.; Okuno, Y.; Yamaizumi, M.: An ERCC5 gene with homology to yeast RAD2 is involved in groupG xeroderma pigmentosum. Mutat. Res. 314:167-175, 1994.

Siciliano, M. J.: Personal Communication. Houston, Texas Feb. 2, 1987.

Takahashi, E.; Shiomi, N.; Shiomi, T.: Precise localization of the excision repair gene, ERCC5, to human chromosome 13q32.3-q33.1 by direct R-banding fluorescence in situ hybridization. Jpn. J. Cancer Res. 83:1117-1119, 1992.

Vermeulen, W.; Jaeken, J.; Jaspers, N. G. J.; Bootsma, D.; Hoeijmakers, J. H. J.: Xeroderma pigmentosum complementation group G associated with Cockayne syndrome. Am. J. Hum. Genet. 53:185-192, 1993.

Warburton, D.; Yu, M.-T.; Richardson, C.; Mudgett, J. S.; MacInnes, M. A.: Human excision repair gene ERCC5 maps to 13q32-q33 by in situ hybridization and also cross-hybridizes to 10q11, the site of ERCC6.(Abstract) Cytogenet. Cell Genet. 58:1984 only, 1991.

Zafeiriou, D. I.; Thorel, F.; Andreou, A.; Kleijer, W. J.; Raams, A.; Garritsen, V. H.; Gombakis, N.; Jaspers, N. G. J.; Clarkson, S. G.: Xeroderma pigmentosum group G with severe neurological involvement and features of Cockayne syndrome in infancy. Pediat. Res. 49:407-412,2001.

Thomas, W.; Rubenstein, M.; Goto, M.; Drayna, D.: A genetic analysis of the Werner syndrome region on human chromosome 8p. Genomics 16:685-690, 1993.

Pol, S.; Bousquet-Lemercier, B.; Pave-Preux, M.; Pawlak, A.; Nalpas, B.; Berthelot, P.; Hanoune, J.; Barouki, R.: Nucleotide sequence and tissue distribution of the human mitochondrial aspartate amino transferase mRNA. Biochem. Biophys. Res. Commun. 157:1309-1315, 1988.

Hoshino, S.; Miyazawa, H.; Enomoto, T.; Hanaoka, F.; Kikuchi, Y.; Kikuchi, A.; Ui, M.: A human homologue of the yeast GST1 gene codes for a GTP-binding protein and is expressed in a proliferation-dependent manner in mammalian cells. EMBO J. 8:3807-3814, 1989.

Kikuchi, Y.; Shimatake, H.; Kikucki, A.: A yeast gene requiredfor the G1-to-S transition encodes a protein containing an A-kinase target site and GTPase domain. EMBO J. 7:1175-1182, 1988.

Ozawa, K.; Murakami, Y.; Eki, T.; Yokoyama, K.; Soeda, E.; Hoshino, S.; Ui, M.; Hanaoka, F.: Mapping of the human GSPT1 gene, a human homolog of the yeast GST1 gene, to chromosomal band 16p13.1. Somat. Cell Molec. Genet. 18:189-194, 1992.

Harris, H.; Hopkinson, D. A.; Robson, E. B.: The incidence of rare alleles determining electrophoretic variants: data on 43 enzymeloci in man. Ann. Hum. Genet. 37:237-253, 1974.

Kajiwara, K.; Berson, E. L.; Dryja, T. P.: Digenic retinitis pigmentosa due to mutations at the unlinked peripherin/RDS and ROM1loci. Science 264:1604-1608, 1994.

Kajiwara, K.; Hahn, L. B.; Mukai, S.; Travis, G. H.; Berson, E. L.; Dryja, T. P.: Mutations in the human retinal degeneration slow gene in autosomal dominant retinitis pigmentosa. Nature 354:480-483,1991.

Kajiwara, K.; Sandberg, M. A.; Berson, E. L.; Dryja, T. P.: A null mutation in the human RDS/peripherin gene in a family with autosomal dominant retinitis punctata albescens. (Abstract) Am. J. Hum. Genet. 51(suppl.): A6 only, 1992.

Kajiwara, K.; Sandberg, M. A.; Berson, E. L.; Dryja, T. P.: A null mutation in the human peripherin/RDS gene in a family with autosomal dominant retinitis punctata albescens. Nature Genet. 3:208-212,1993.

Kedzierski, W.; Nusinowitz, S.; Birch, D.; Clarke, G.; McInnes, R. R.; Bok, D.; Travis, G. H.: Deficiency of rds/peripherin causes photoreceptor death in mouse models of digenic and dominant retinitis pigmentosa. Proc. Nat. Acad. Sci. 98:7718-7723, 2001.

Keen, T. J.; Inglehearn, C. F.: Mutations and polymorphisms in the human peripherin-RDS gene and their involvement in inherited retinal degeneration. Hum. Mutat. 8:297-303, 1996.

Kikawa, E.; Nakazawa, M.; Chida, Y.; Shiono, T.; Tamai, M.: A novel mutation (asn244-to-lys) in the peripherin/RDS gene causing autosomal dominant retinitis pigmentosa associated with bull's-eye maculopathy detected by nonradioisotopic SSCP. Genomics 20:137-139,1994.

Kim, R.Y.; Dollfus, H.; Keen, T. J.; Fitzke, F. W.; Arden, G. B.; Bhattacharya, S. S.; Bird, A. C.: Autosomal dominant pattern dystrophy of the retina associated with a 4-base pair insertion at codon 140 in the peripherin/RDS gene. Arch. Ophthal. 113:451-455,1995.

Kohl, S.; Christ-Adler, M.; Apfelstedt-Sylla, E.; Kellner, U.; Eckstein, A.; Zrenner, E.; Wissinger, B.: RDS/peripherin gene mutations are frequent causes of central retinal dystrophies. J. Med. Genet. 34:620-626, 1997.

Ma, J.; Norton, J. C.; Allen, A. C.; Burns, J. B.; Hasel, K. W.; Burns, J. L.; Sutcliffe, J. G.; Travis, G. H.: Retinal degeneration slow (rds) in mouse results from simple insertion of a t haplotype-specific element into protein-coding exon II. Genomics 28:212-219, 1995.

Nichols, B. E.; Drack, A. V.; Vandenburgh, K.; Kimura, A. E.; Sheffield, V. C.; Stone, E. M.: A 2 base pair deletion in the RDS gene associated with butterfly-shaped pigment dystrophy of the fovea. Hum. Molec. Genet. 2:601-603, 1993.

Nichols, B. E.; Sheffield, V. C.; Vandenburgh, K.; Drack, A. V.; Kimura, A. E.; Stone, E. M.: Butterfly-shaped pigment dystrophy of the fovea caused by a point mutation in codon 167 of the RDS gene. Nature Genet. 3:202-207, 1993.

Payne, A. M.; Downes, S. M.; Bessant, D. A. R.; Bird, A. C.; Bhattacharya, S. S.: Founder effect, seen in the British population, of the 172 peripherin/RDS mutation--and further refinement of genetic positioning of the peripherin/RDS gene. (Letter) Am. J. Hum. Genet. 192-195,1998.

Pendleton, J. W.; Violette, S. M.; Hunihan, L. W.; Greene, L. A.; Ruddle, F. H.: The peripherin gene maps to mouse chromosome 15. Genomics 9:369-372, 1991.

Reig, C.; Serra, A.; Gean, E.; Vidal, M.; Arumi, J.; De la Calzada, M. D.; Antich, J.; Carballo, M.: A point mutation in the RDS-peripherin gene in a Spanish family with central areolar choroidal dystrophy. Ophthal. Genet. 16:35-44, 1995.

Sarra, G.-M.; Stephens, C.; de Alwis, M.; Bainbridge, J. W. B.; Smith, A. J.; Thrasher, A. J.; Ali, R. R.: Gene replacement therapy in the retinal degeneration slow (rds) mouse: the effect on retinal degeneration following partial transduction of the retina. Hum. Molec. Genet. 10:2353-2361, 2001.

Travis, G. H.; Brennan, M. B.; Danielson, P. E.; Kozak, C. A.; Sutcliffe, J. G.: Identification of a photoreceptor-specific mRNA encoded by the gene responsible for retinal degeneration slow (rds). Nature 338:70-73, 1989.

Travis, G. H.; Christerson, L.; Danielson, P. E.; Klisak, I.; Sparkes, R. S.; Hahn, L. B.; Dryja, T. P.; Sutcliffe, J. G.: The human retinal degeneration slow (RDS) gene: chromosome assignment and structure of the mRNA. Genomics 10:733-739, 1991.

Travis, G. H.; Hepler, J. E.: A medley of retinal dystrophies. Nature Genet. 3:191-192, 1993.

Cramer, P.; Bushnell, D. A.; Fu, J.; Gnatt, A. L.; Maier-Davis, B.; Thompson, N. E.; Burgess, R. R.; Edwards, A. M.; David, P. R.; Kornberg, R. D.: Architecture of RNA polymerase II and implications for the transcription mechanism. Science 288:640-648, 2000.

Yudkovsky, N.; Ranish, J. A.; Hahn, S.: A transcription reinitiation intermediate that is stabilized by activator. Nature 408:225-229,2000.

Jakimiuk, A. J.; Weitsman, S. R.; Magoffin, D. A.:5-alpha-reductase activity in women with polycystic ovary syndrome. J. Clin. Endocr. Metab. 84:2414-2418, 1999.

Reddi, A. H.: BMP-1: resurrection as pro collagen C-proteinase. Science 271:5-6, 1996.

Takahara, K.; Lee, S.; Wood, S.; Greenspan, D. S.: Structural organization and genetic localization of the human bone morphogenetic protein 1/mammalian tolloid gene. Genomics 29:9-15, 1995.

Takahara, K.; Lyons, G. E.; Greenspan, D. S.: Bone morphogenetic protein-1 and a mammalian tolloid homologue (mTld) are encoded by alternatively spliced transcripts which are differentially expressed in some tissues. J. Biol. Chem. 269:32572-32578, 1994.

Scott, I. C.; Blitz, I. L.; Pappano, W. N.; Imamura, Y.; Clark, T. G.; Steiglitz, B. M.; Thomas, C. L.; Maas, S. A.; Takahara, K.; Cho, K. W. Y.; Greenspan, D. S.: Mammalian BMP-1/Tolloid-related metalloproteinases, including novel family member mammalian Tolloid-like2, have differential enzymatic activities and distributions of expression relevant to patterning and skeletogenesis. Dev. Biol. 213:283-300, 1999.

Yoshiura, K.; Tamura, T.; Hong, H.-S.; Ohta, T.; Soejima, H.; Kishino, T.; Jinno, Y.; Niikawa, N.: Mapping of the bone morphogenetic protein 1 gene (BMP1) to 8p21: removal of BMP1 from candidacy for the bone disorder in Langer-Giedion syndrome. Cytogenet. Cell Genet. 64:208-209, 1993.

Hahn, G. V.; Cohen, R. B.; Wozney, J. M.; Levitz, C. L.; Shore, E. M.; Zasloff, M. A.; Kaplan, F. S.: A bone morphogenetic protein subfamily: chromosomal localization of human genes for BMP5, BMP6, and BMP7. Genomics 14:759-762, 1992.

Lyons, K.; Graycar, J. L.; Lee, A.; Hashmi, S.; Lindquist, P. B.; Chen, E. Y.; Hogan, B. L. M.; Derynck, R.: Vgr-1, a mammalian gene related to Xenopus Vg-1, is a member of the transforming growth factor beta gene superfamily. Proc. Nat. Acad. Sci. 86:4554-4558, 1989.

Rickard, D. J.; Hofbauer, L. C.; Bonde, S. K.; Gori, F.; Spelsberg, T. C.; Riggs, B. L.: Bone morphogenetic protein-6 production in human Osteoblastic cell lines: selective regulation by estrogen. J. Clin. Invest. 101:413-422, 1998.

Modi, W. S.; Dean, M.; Pollock, D. D.; Seuanez, H. N.; Christakos, S.: Chromosomal localization of the calbindin gene. (Abstract) Cytogenet. Cell Genet. 58:1930 only, 1991.

Parmentier, M.; De Vijlder, J. J. M.; Muir, E.; Szpirer, C.; Islam, M. Q.; Geurts van Kessel, A.; Lawson, D. E. M.; Vassart, G.: The human calbindin 27 kDa gene: structural organization of the 5-prime and 3-prime regions, chromosomal assignment and restriction fragment length polymorphism. Genomics 4:309-319, 1989.

Parmentier, M.; Lawson, D. E. M.; Vassart, G.: Human 27-kDa calbindin complementary DNA sequence: evolutionary and functional implications. Europ. J. Biochem. 170:207-215, 1987.

Parmentier, M.; Passage, E.; Vassart, G.; Mattei, M.-G.: The human calbindin D28k (CALB1) and calretinin (CALB2) genes are located at 8q21.3-q22.1 and 16q22-q23, respectively, suggesting a common duplication with the carbonic anhydrase isozyme loci. Cytogenet. Cell Genet. 57:41-43, 1991.

Parmentier, M.; Vassart, G.: HindIII RFLP on chromosome 8 detected with a calbindin 27 kDa cDNA probe, HBSC21. Nucleic Acids Res. 16:9373 only, 1988.

Seto-Ohshima, A.; Emson, P. C.; Lawson, E.; Mountjoy, C. Q.; Carrasco, L. H.: Loss of matrix calcium-binding protein-containing neurons in Huntington's disease. Lancet I:1252-1254, 1988.

Blow, J. J.; Laskey, R. A.: A role for the nuclear envelope in controlling DNA replication within the cell cycle. Nature 332:546-548,1988.

Burkhart, R.; Schulte, D.; Hu, D.; Musahl, C.; Gohring, F.; Knippers, R.: Interactions of human nuclear proteins P1Mcm3 and P1Cdc46. Europ. J. Biochem. 228:431-438, 1995.

Chong, J. P.; Mahbubani, H. M.; Khoo, C. Y.; Blow, J. J.: Purification of an MCM-containing complex as a component of the DNA replication licensing system. Nature 375:418-421, 1995.

Hu, B.; Burkhart, R.; Schulte, D.; Musahl, C.; Knippers, R.: TheP1 family: a new class of nuclear mammalian proteins related to the yeast Mcm replication proteins. Nucleic Acids Res. 21:5289-5293,1993.

Kubota, Y.; Mimura, S.; Nishimoto, S.; Takisawa, H.; Nojima, H.: Identification of the yeast MCM3-related protein as a component of Xenopus DNA replication licensing factor. Cell 81:601-609, 1995.

Labib, K.; Tercero, J. A.; Diffley, J. F. X.: DNA replication fork progression requires uninterrupted MCM2-7 function. Science 288:1643-1647, 2000.

Madine, M. A.; Khoo, C. Y.; Mills, A. D.; Laskey, R. A.: MCM3complex required for cell cycle regulation of DNA replication in vertebrate cells. Nature 375:421-424, 1995.

Mincheva, A.; Todorov, I.; Werner, D.; Fink, T. M.; Lichter, P.: The human gene for nuclear protein BM28 (CDCL1), a new member of the early S-phase family of proteins, maps to chromosome band 3q21. Cytogenet. Cell Genet. 65:276-277, 1994.

Tsuruga, H.; Yabuta, N.; Hashizume, K.; Ikeda, M.; Endo, Y.; Nojima, H.: Expression, nuclear localization and interactions of human MCM/P1proteins. Biochem. Biophys. Res. Commun. 236:118-125, 1997.

Demetrick, D. J.; Beach, D. H.: Chromosome mapping of human CDC25A and CDC25B phosphatases. Genomics 18:144-147, 1993.

Fauman, E. B.; Cogswell, J. P.; Lovejoy, B.; Rocque, W. J.; Holmes, W.; Montana, V. G.; Piwnica-Worms, H.; Rink, M. J.; Saper, M. A.:Crystal structure of the catalytic domain of the human cell cycle control phosphatase, Cdc25A. Cell 93:617-625, 1998.

Galaktionov, K.; Lee, A. K.; Eckstein, J.; Draetta, G.; Meckler, J.; Loda, M.; Beach, D.: CDC25 phosphatases as potential human oncogenes. Science 269:1575-1577, 1995.

Mailand, N.; Falck, J.; Lukas, C.; Syljuasen, R. G.; Welcker, M.; Bartek, J.; Lukas, J.: Rapid destruction of human Cdc25A in response to DNA damage. Science 288:1425-1429, 2000.

Lane, S. A.; Baker, E.; Sutherland, G. R.; Tonks, I.; Hayward, N.; Ellem, K.: The human cell cycle gene CDC25B is located at 20p13. Genomics 15:693-694, 1993.

Lincoln, A. J.; Wickramasinghe, D.; Stein, P.; Schultz, R. M.; Palko, M. E.; De Miguel, M. P.; Tessarollo, L.; Donovan, P. J.: Cdc25b phosphatase is required for resumption of meiosis during oocyte maturation. Nature Genet. 30:446-449, 2002.

Bentley, K. L.; Ferguson-Smith, A. C.; Miki, T.; Kidd, K. K.; Ruddle, F. H.: Physical linkage of Hox 2.1 and nerve growth factor receptor. (Abstract) Cytogenet. Cell Genet. 51:961 only, 1989.

Bibel, M.; Barde, Y.-A.: Neurotrophins: key regulators of cell fate and cell shape in the vertebrate nervous system. Genes Dev. 14:2919-2937, 2000.

Bothwell, M.: p75(NTR): a receptor after all. Science 272: 506-507,1996.

Carter, B. D.; Kaltschmidt, C.; Kaltschmidt, B.; Offenhauser, N.; Bohm-Matthaei, R.; Baeuerle, P. A.; Barde, Y.-A.: Selective activation of NF-kappa-B by nerve growth factor through the neurotrophin receptor p75. Science 272:542-545, 1996.

Carter, B. D.; Lewin, G. R.: Neurotrophins live or let die: does p75(NTR) decide? Neuron 18:187-190, 1997.

Chao, M. V.; Bothwell, M. A.; Ross, A. H.; Koprowski, H.; Lanahan, A. A.; Buck, C. R.; Sehgal, A.: Gene transfer and molecular cloning of the human NGF receptor. Science 232: 518-521, 1986.

Dobrowsky, R. T.; Werner, M. H.; Castellino, A. M.; Chao, M. V.; Hannun, Y. A.: Activation of the sphingomyelin cycle through the low-affinity neurotrophin receptor. Science 265: 1596-1599, 1994.

Colonna, M.; Bresnahan, M.; Bahram, S.; Strominger, J. L.; Spies, T.: Allelic variants of the human putative peptide transporter involved in antigen processing. Proc. Nat. Acad. Sci. 89:3932-3936, 1992.

Huh, G. S.; Boulanger, L. M.; Du, H.; Riquelme, P. A.; Brotz, T. M.; Shatz, C. J.: Functional requirement for class I MHC in CNS development and plasticity. Science 290:2155-2159, 2000.

Karttunen, J. T.; Lehner, P. J.; Gupta, S. S.; Hewitt, E. W.; Cresswell, P.: Distinct functions and cooperative interaction of the subunits of the transporter associated with antigen processing (TAP). Proc. Nat. Acad. Sci. 98:7431-7436, 2001.

Cullen, M.; Erlich, H.; Klitz, W.; Carrington, M.: Molecular mapping of a recombination hotspot located in the second intron of the human TAP2 locus. Am. J. Hum. Genet. 56:1350-1358, 1995.

de la Salle, H.; Donato, L.; Zimmer, J; Plebani, A.; Hanau, D.; Bonneville, M.; Tongio, M.-M.: HLA class I deficiencies. In: Ochs, H. D.; Smith, C. I. E.; Puck, J. M. (eds.): Primary Immunodeficiency Diseases: A Molecular and Genetic Approach. New York: Oxford University Press 1999. Pp. 181-188.

de la Salle, H.; Hanau, D.; Fricker, D.; Urlacher, A.; Kelly, A.; Salamero, J.; Powis, S. H.; Donato, L.; Bausinger, H.; Laforet, M.; Jeras, M.; Spehner, D.; Bieber, T.; Falkenrodt, A.; Cazenave, J.-P.; Trowsdale, J.; Tongio, M.-M.: Homozygous human TAP peptide transporter mutation in HLA class I deficiency. Science 265:237-241, 1994.

Jeffreys, A. J.; Ritchie, A.; Neumann, R.: High resolution analysis of haplotype diversity and meiotic crossover in the human TAP2 recombination hotspot. Hum. Molec. Genet. 9:725-733, 2000.

Powis, S. H.; Mockridge, I.; Kelly, A.; Kerr, L.-A.; Glynne, R.; Gileadi, U.; Beck, S.; Trowsdale, J.: Polymorphism in a second ABC transporter gene located within the class II region of the human major histocompatibility complex. Proc. Nat. Acad. Sci. 89:1463-1467,1992.

Jackson, R. S.; Creemers, J. W. M.; Ohagi, S.; Raffin-Sanson, M.-L.; Sanders, L.; Montague, C. T.; Hutton, J. C.; O'Rahilly, S.: Obesity and impaired prohormone processing associated with mutations in the human prohormone convertase 1 gene. Nature Genet. 16:303-306, 1997.

Naggert, J. K.; Fricker, L. D.; Varlamov, O.; Nishina, P. M.; Rouille, Y.; Steiner, D. F.; Carroll, R. J.; Paigen, B. J.; Leiter, E. H.:Hyperproinsulinaemia in obese fat/fat mice associated with a carboxy peptidaseE mutation which reduces enzyme activity. Nature Genet. 10:135-142,1995.

O'Rahilly, S.; Gray, H.; Humphreys, P. J.; Krook, A.; Polonsky, K. S.; White, A.; Gibson, S.; Taylor, K.; Carr, C.: Brief report:impaired processing of prohormones associated with abnormalities of glucose homeostasis and adrenal function. New Eng. J. Med. 333:1386-1390, 1995.

Ohagi, S.; Sakaguchi, H.; Sanke, T.; Tatsuta, H.; Hanabusa, T.; Nanjo, K.: Human prohormone convertase 3 gene: exon-intron organization and molecular scanning for mutations in Japanese subjects with NIDDM. Diabetes 45:897-901, 1996.

Furuta, M.; Carroll, R.; Martin, S.; Swift, H.; Ravazzola, M.; Orci, L.; Steiner, D.: Incomplete processing of proinsulin to insulin accompanied by elevation of Des-31,32 proinsulin intermediates in islets of mice lacking active PC2. J. Biol. Chem. 273:3431-3437,1998.

Furuta, M.; Yano, H.; Zhou, A.; Rouille, Y.; Holst, J.; Caroll, R.; Ravazzola, M.; Orci, L.; Furuta, H.; Steiner, D.:

Defective prohormone processing and altered pancreatic islet morphology in mice lacking active SPC2. Proc. Nat. Acad. Sci. 94:6646-6651, 1997.

Furuta, M.; Zhou, A.; Webb, G.; Carroll, R.; Ravazzola, M.; Orci, L.; Steiner, D. F.: Severe defect in proglucagon processing in islet A-cells of prohormone convertase 2 null mice. J. Biol. Chem. 276:27197-27202, 2001.

Maglott, D. R.; Feldblyum, T. V.; Durkin, A. S.; Nierman, W. C.: Radiation hybrid mapping of SNAP, PCSK2, and THBD (human chromosome 20p). Mammalian Genome 7:400-401, 1996.

Ohagi, S.; LaMendola, J.; LeBeau, M. M.; Espinosa, R., III; Takeda, J.; Smeekens, S. P.; Chan, S. J.; Steiner, D. F.: Identification and analysis of the gene encoding human PC2, a prohormone convertase expressed in neuroendocrine tissues. Proc. Nat. Acad. Sci. 89:4977-4981,1992.

Taylor, N. A.; Shennan, K. I. J.; Cutler, D. F.; Docherty, K.: Mutations within the propeptide, the primary cleavage site or the catalytic site, or deletion of C-terminal sequences, prevents secretion of proPC2 from transfected COS-7 cells. Biochem. J. 321:367-373,1997.

Gabreels, B. A. T. F.; Swaab, D. F.; de Kleijn, D. P. V.; Seidah, N. G.; Van de Loo, J.-W.; Van de Ven, W. J. M.; Martens, G. J. M. And van Leeuwen, F. W.: Attenuation of the polypeptide 7B2, prohormone convertase PC2, and vasopressin in the hypothalamus of some Prader-Willi patients: indications for a processing defect. J. Clin. Endocr. Metab. 83:591-599, 1998.

Arbiser, J. L.; Morton, C. C.; Bruns, G. A. P.; Majzoub, J. A.: Human corticotropin releasing hormone gene is located on the long arm of chromosome 8. Cytogenet. Cell Genet. 47:113-116, 1988.

Behan, D. P.; Heinrichs, S. C.; Troncoso, J. C.; Liu, X.-J.; Kawas, C. H.; Ling, N.; De Souza, E. B.: Displacement of corticotropin releasing factor from its binding protein as a possible treatment for Alzheimer's disease. Nature 378:284-287, 1995.

Cheng, Y.-H.; Nicholson, R. C.; King, B.; Chan, E.-C.; Fitter, J. T.; Smith, R.: Corticotropin-releasing hormone gene expression in primary placental cells is modulated by cyclic adenosine 3-prime,5-prime-monophosphate. J. Clin. Endocr. Metab. 85:1239-1244, 2000.

Habib, K. E.; Weld, K. P.; Rice, K. C.; Pushkas, J.; Champoux, M.; Listwak, S.; Webster, E. L.; Atkinson, A. J.; Schulkin, J.; Contoreggi, C.; Chrousos, G. P.; McCann, S. M.; Suomi, S. J.; Higley, J. D.; Gold, P. W.: Oral administration of a corticotropin-releasing hormone receptor antagonist significantly attenuates behavioral, neuroendocrine, and autonomic responses to stress in primates. Proc. Nat. Acad. Sci. 97:6079-6084, 2000.

Inder, W. J.; Prickett, T. C. R.; Ellis, M. J.; Hull, L.; Reid, R.; Benny, P. S.; Livesey, J. H.; Donald, R. A.: The utility of plasma CRH as a predictor of preterm delivery. J. Clin. Endocr. Metab. 86:5706-5710, 2001.

Kellogg, J.; Luty, J. A.; Thompson, R.; Luo, X. Y.; Magenis, R. E.; Litt, M.: Corticotropin releasing hormone (CRH) maps to human chromosome 8 and identifies a TaqI RFLP. Cytogenet. Cell Genet. 51:1022, 1989.

Knapp, L. T.; Keegan, C. E.; Seasholtz, A. F.; Camper, S. A.: Corticotropin-releasing hormone (Crh) maps to mouse chromosome 3. Mammalian Genome 4:615-617, 1993.

Kyllo, J. H.; Collins, M. M.; Vetter, K. L.; Cuttler, L.; Rosenfield, R. L.; Donohoue, P. A.: Linkage of congenital isolated adrenocorticotropic hormone deficiency to the corticotropin releasing hormone locus using simple sequence repeat polymorphisms. Am. J. Med. Genet. 62:262-267,1996.

Majzoub, J. A.: Personal Communication. Boston, Mass. Mar. 3. 1995.

Mandel, H.; Berant, M.; Gotfried, E.; Hochberg, Z.: Autosomal recessive hypothalamic corticotropin deficiency: a new entity and its metabolic consequences. (Abstract) Am. J. Hum. Genet. 47 (suppl.):A66, 1990.

McLean, M.; Bisits, A.; Davies, J.; Woods, R.; Lowry, P.; Smith, R.: A placental clock controlling the length of human pregnancy. NatureMed. 1:460-463, 1995.

Muglia, L.; Jacobson, L.; Dikkes, P.; Majzoub, J. A.: Corticotropin-releasing hormone deficiency reveals major fetal but not adult glucocorticoid need. Nature 373:427-432, 1995.

Robinson, B. G.; Emanuel, R. L.; Frim, D. M.; Majzoub, J. A.: Glucocorticoid stimulates expression of corticotropin-releasing hormone gene in human placenta. Proc. Nat. Acad. Sci. 85:5244-5248, 1988.

Scatena, C. D.; Adler, S.: Trans-acting factors dictate the species-specific placental expression of corticotropin-releasing factor genes in choriocarcinoma cell lines. Endocrinology 137:3000-3008, 1996.

Scatena, C. D.; Adler, S.: Characterization of a human-specific regulator of placental corticotropin-releasing hormone. Molec. Endocr. 12:1228-1240, 1998.

Shibahara, S.; Morimoto, Y.; Furutani, Y.; Notake, M.; Takahashi, H.; Shimizu, S.; Horikawa, S.; Numa, S.: Isolation and sequence analysis of the human corticotropin-releasing factor precursor gene. EMBO J. 2:775-779, 1983.

Stratakis, C. A.; Chrousos, G. P.: Neuroendocrinology and pathophysiology of the stress system. Ann. N. Y. Acad. Sci. 771:1-18, 1995.

Stratakis, C. A.; Sarlis, N. J.; Berrettini, W. H.; Badner, J. A.; Chrousos, G. P.; Gershon, E. S.; Detera-Wadleigh, S. D.: Lack of linkage between the corticotropin-releasing hormone (CRH) gene and bipolar affective disorder. Molec. Psychiat. 2:483-485, 1997.

Xu, B.; Sano, T.; Yamada, S.; Li, C. C.; Hirokawa, M.: Expression of corticotropin-releasing hormone messenger ribonucleic acid in human pituitary corticotroph adenomas associated with proliferative potential. J. Clin. Endocr. Metab. 85:1220-1225, 2000.

Zouboulis, C. C.; Seltmann, H.; Hiroi, N.; Chen, W.; Young, M.; Oeff, M.; Scherbaum, W. A.; Orfanos, C. E.; McCann, S. M.; Bornstein, S. R.: Corticotropin-releasing hormone: an autocrine hormone that promotes lipogenesis in human sebocytes. Proc. Nat. Acad. Sci. 99:7148-7153, 2002.

Chen, R.; Lewis, K. A.; Perrin, M. H.; Vale, W. W.: Expression cloning of a human corticotropin-releasing-factor receptor. Proc. Nat. Acad. Sci. 90:8967-8971, 1993.

Dieterich, K. D.; Gundelfinger, E. D.; Ludecke, D. K.; Lehnert, H.: Mutation and expression analysis of corticotropin-releasing factor 1 receptor in adrenocorticotropin-secreting pituitary adenomas. J. Clin. Endocr. Metab. 83:3327-3331, 1998.

Grammatopoulos, D.; Dai, Y.; Chen, J.; Karteris, E.; Papadopoulou, N.; Easton, A. J.; Hillhouse, E. W.: Human corticotropin-releasing hormone receptor: differences in subtype expression between pregnant and nonpregnant myometria. J. Clin. Endocr. Metab. 83:2539-2544,1998.

Leproult, R.; Colecchia, E. F.; L'Hermite-Baleriaux, M.; Van Cauter, E.: Transition from dim to bright light in the morning induces an immediate elevation of cortisol levels. J. Clin. Endocr. Metab. 86:151-157, 2001.

Liaw, C. W.; Grigoriadis, D. E.; Lovenberg, T. W.; De Souza, E. B.; Maki, R. A.: Localization of ligand-binding domains of human corticotropin-releasing factor receptor: a chimeric receptor approach. Molec. Endocr. 11:980-985, 1997.

Danielson, K. G.; Fazzio, A.; Cohen, I.; Cannizzaro, L. A.; Eichstetter, I.; Iozzo, R. V.: The human decorin gene: intron-exon organization, discovery of two alternatively spliced exons in the 5-prime untranslated region, and mapping of the gene to chromosome 12q23. Genomics 15:146-160, 1993.

Dyne, K. M.; Valli, M.; Forlino, A.; Mottes, M.; Kresse, H.; Cetta, G.: Deficient expression of the small proteoglycan decorin in a case of severe/lethal osteogenesis imperfecta. Am. J. Med. Genet. 63:161-166, 1996.

Ion, A.; Crosby, A. H.; Kremer, H.; Kenmochi, N.; Van Reen, M.; Fenske, C.; Van Der Burgt, I.; Brunner, H. G.; Montgomery, K.: Detailed mapping, mutation analysis, and intragenic polymorphism identification in candidate Noonan syndrome genes MYL2, DCN, EPS8, and RPL6. J. Med. Genet. 37:884-886, 2000.

McBride, O. W.; Fisher, L. W.; Young, M. F.: Localization of PGI (biglycan, BGN) and PGII (decorin, DCN, PG-40) genes on human chromosomes Xq13-qter and 12q, respectively. Genomics 6:219-255, 1990.

Moscatello, D. K.; Santra, M.; Mann, D. M.; McQuillan, D. J.; Wong, A. J.; Iozzo, R. V.: Decorin suppresses tumor cell growth by activating the epidermal growth factor receptor. J. Clin. Invest. 101:406-412,1998.

Pulkkinen, L.; Alitalo, T.; Krusius, T.; Peltonen, L.: Expression of decorin in human tissues and cell lines and defined chromosomal assignment of the gene locus (DCN). Cytogenet. Cell Genet. 60:107-111,1992.

Pulkkinen, L.; Kainulainen, K.; Krusius, T.; Makinen, P.; Schollin, J.; Gustavsson, K.-H.; Peltonen, L.: Deficient expression of the gene coding for decorin in a lethal form of Marfan syndrome. J. Biol. Chem. 265:17780-17785, 1990.

Schollin, J.; Bjarke, B.; Gustavson, K.-H.: Probable homozygotic form of the Marfan syndrome in a newborn child. Acta Paediat. Scand. 77:452-456, 1988.

Scholzen, T.; Solursh, M.; Suzuki, S.; Reiter, R.; Morgan, J. L.; Buchberg, A. M.; Siracusa, L. D.; Iozzo, R. V.: The murine decorin:complete cDNA cloning, genomic organization, chromosomal assignment, and expression during organogenesis and tissue differentiation. J. Biol. Chem. 269: 28270-28281, 1994.

Vogel, K. G.; Clark, P. E.: Small proteoglycan synthesis by skin fibroblasts cultured from elderly donors and patients with defined defects in types I and III collagen metabolism. Europ. J. Cell Biol. 49:236-243, 1989.

Comer, K. A.; Falany, J. L.; Falany, C. N.: Cloning and expression of human liver dehydroepiandrosterone sulphotransferase. Biochem. J. 289:233-240, 1993.

Durocher, F.; Morissette, J.; Dufort, I.; Simard, J.; Luu-The, V.: Genetic linkage mapping of the dehydroepiandrosterone sulfotransferase (STD) gene on the chromosome 19q13.3 region. Genomics 29:781-783,1995.

Kong, A.-N. T.; Yang, L.; Ma, M.; Tao, D.; Bjornsson, T. D.: molecular cloning of the alcohol/hydroxysteroid form (hSTa) of sulfotransferase from human liver. Biochem. Biophys. Res. Commun. 187:448-454, 1992.

Otterness, D.; Mohrenweiser, H. W.; Brandriff, B. F.; Weinshilboum, R. M.: Dehydroepiandrosterone sulfotransferase gene (STD): localization to human chromosome 19q13.3. Cytogenet. Cell Genet. 70:45-47, 1995.

Otterness, D. M.; Her, C.; Aksoy, S.; Kimura, S.; Wieben, E. D.; Weinshilboum, R. M.: Human dehydroepiandrosterone sulfotransferase gene: molecular cloning and structural characterization. DNA CellBiol. 14:331-341, 1995.

Otterness, D. M.; Wieben, E. D.; Wood, T. C.; Watson, W. G.; Madden, B. J.; McCormick, D. J.; Weinshilboum, R. M.: Human liver dehydroepiandrosternesulfotransferase: molecular cloning and expression of cDNA. Molec. Pharm. 41:865-872, 1992.

Alexiadis, V.; Waldmann, T.; Andersen, J.; Mann, M.; Knippers, R.; Gruss, C.: The protein encoded by the proto-oncogene DEK changes the topology of chromatin and reduces the efficiency of DNA replication in a chromatin-specific manner. Genes Dev. 14:1308-1312, 2000.

Fu, G. K.; Grosveld, G.; Markovitz, D. M.: DEK, an autoantigen involved in a chromosomal translocation in acute myelogenous leukemia, binds to the HIV-2 enhancer. Proc. Nat. Acad. Sci. 94:1811-1815,1997.

Kappes, F.; Burger, K.; Baack, M.; Fackelmayer, F. O.; Gruss, C.: Subcellular localization of the human proto-oncogene protein DEK. J. Biol. Chem. 276:26317-26323, 2001.

McGarvey, T.; Rosonina, E.; McCracken, S.; Li, Q.; Arnaout, R.; Mientjes, E.; Nickerson, J. A.; Awrey, D.; Greenblatt, J.; Grosveld, G.; Blencowe, B. J.: The acute myeloid leukemia-associated protein, DEK, forms a splicing-dependent interaction with exon-product complexes. J. Cell Biol. 150:309-320, 2000.

von Lindern, M.; Fornerod, M.; van Baal, S.; Jaegle, M.; de Wit, T.; Buijs, A.; Grosveld, G.: The translocation (6;9), associated with a specific subtype of acute myeloid leukemia, results in the fusion of two genes, dek and can, and the expression of a chimeric, leukemia-specific dek-can mRNA. Molec. Cell. Biol. 12:1687-1697,1992.

Yoon, J.-W.; Yoon, C.-S.; Lim, H.-W.; Huang, Q. Q.; Kang, Y.; Pyun, K. H.; Hirasawa, K.; Sherwin, R. S.; Jun, H.-S.: Control of autoimmune diabetes in NOD mice by GAD expression or suppression in beta cells. Science 284:1183-1187, 1999.

Nagase, T.; Ishikawa, K.; Suyama, M.; Kikuno, R.; Hirosawa, M.; Miyajima, N.; Tanaka, A.; Kotani, H.; Nomura, N.; Oharo, O.: Prediction of the coding sequences of unidentified human genes. XII. The complete sequences of 100 new cDNA clones from brain which code for large proteins in vitro. DNA Res. 5:355-364, 1998.

Clancy, K. P.; Berger, R.; Cox, M.; Bleskan, J.; Walton, K. A.; Hart, I.; Patterson, D.: Localization of the L-glutamine synthetase gene to chromosome 1q23. Genomics 38:418-420, 1996.

Gibbs, C. S.; Campbell, K. E.; Wilson, R. H.: Sequence of a human glutamine synthetase cDNA. Nucleic Acids Res. 15:6293 only, 1987.

Gunnersen, D.; Haley, B.: Detection of glutamine synthetase in the cerebrospinal fluid of Alzheimer diseased patients: a potential diagnostic biochemical marker. Proc. Nat. Acad. Sci. 89:11949-11953,1992.

Helou, K.; Das, A. T.; Lamers, W. H.; Hoovers, J. M. N.; Szpirer, C.; Szpirer, J.; Klinga-Levan, K.; Levan, G.: FISH mapping of three ammonia metabolism genes (Glul, Cps1, Glud1) in rat, and the chromosomal localization of GLUL in human and Cps1 in mouse. Mammalian Genome 8:362-364, 1997.

Pesole, G.; Bozzetti, M. P.; Lanave, C.; Preparata, G.; Saccone, C.: Glutamine synthetase gene evolution: a good molecular clock. Proc. Nat. Acad. Sci. 88:522-526, 1991.

Wang, Y.; Kudoh, J.; Kubota, R.; Asakawa, S.; Minoshima, S.; Shimizu, N.: Chromosomal mapping of a family of human glutamine synthetase genes: functional gene (GLUL) on 1q25, pseudogene (GLULP) on 9p13, and three related genes (GLULL1, GLULL2, GLULL3) on 5q33, 11p15, and 11q24. Genomics 37:195-199, 1996.

Smith, M. D.; Dawson, S. J.; Latchman, D. S.: Inhibition of neuronal process outgrowth and neuronal specific gene activation by the Brn-3b transcription factor. J. Biol. Chem. 272: 1382-1388, 1997.

Horisberger, M. A.; Wathelet, M.; Szpirer, J.; Szpirer, C.; Islam, Q.; Levan, G.; Huez, G.; Content, J.: cDNA cloning and assignment to chromosome 21 of IFI-78K gene, the human equivalent of murine Mx gene. Somat. Cell Molec. Genet. 14:123-131, 1988.

Huber, P.; Aebi, M.; Grob, R.; Pravtcheva, D.; Ruddle, F.; Haller, O.: Chromosomal localization of two human Mx genes. (Abstract) Experientia 44:A84 only, 1988.

Li, Y.; Youssoufian, H.: MxA overexpression reveals a common genetic link in four Fanconi anemia complementation groups. J. Clin. Invest. 100:2873-2880, 1997.

Bu, L.; Jin, Y.; Shi, Y.; Chu, R.; Ban, A.; Eiberg, H.; Andres, L.; Jiang, H.; Zheng, G.; Qian, M.; Cui, B.; Xia, Y.; Liu, J.; Hu, L.; Zhao, G.; Hayden, M. R.; Kong, X.: Mutant DNA-binding domain of HSF4 is associated with autosomal dominant lamellar and Marner cataract. Nature Genet. 31:276-278, 2002.

Eiberg, H.; Marner, E.; Rosenberg, T.; Mohr, J.: Marner's cataract (CAM) assigned to chromosome 16: linkage to haptoglobin. Clin. Genet. 34:272-275, 1988.

Marner, E.: A family with eight generations of hereditary cataract. ActaOphthal. 27:537-551, 1949.

Furukawa, Y.; Nakatsuru, S.; Nagafuchi, A.; Tsukita, S.; Muto, T.; Nakamura, Y.; Horii, A.: Structure, expression and chromosome assignment of the human catenin (cadherin-associated protein) alpha1 gene (CTNNA1). Cytogenet. Cell Genet. 65:74-78, 1994.

Hirano, S.; Kimoto, N.; Shimoyama, Y.; Hirohashi, S.; Takeichi, M.: Identification of a neural alpha-catenin as a key regulator of cadherin function and multicellular organization. Cell 70:293-301,1992.

McPherson, J. D.; Morton, R. A.; Ewing, C. M.; Wasmuth, J. J.; Overhauser, J.; Nagafuchi, A.; Tsukita, S.; Isaacs, W. B.: Assignment of the human alpha-catenin gene (CTNNA1) to chromosome 5q21-q22. Genomics 19:188-190, 1994.

Nagafuchi, A.; Takeichi, M.; Tsukita, S.: The 102 kd cadherin-associated protein: similarity to vinculin and posttranscriptional regulation of expression. Cell 65:849-857, 1991.

Nollet, F.; van Hengel, J.; Berx, G.; Molemans, F.; van Roy, F.: Isolation and characterization of a human pseudogene (CTNNAP1) for alpha-E-catenin (CTNNA1): assignment of the pseudogene to 5q22 and the alpha-E-catenin gene to 5q31. Genomics 26:410-413, 1995.

Oda, T.; Kanai, Y.; Shimoyama, Y.; Nagafuchi, A.; Tsukita, S.; Hirohashi, S.: Cloning of the human alpha-catenin cDNA and its aberrant mRNA in a human cancer cell line. Biochem. Biophys. Res. Commun. 193:897-904, 1993.

Pokutta, S.; Weis, W. I.: Structure of the dimerization and beta-catenin-binding region of alpha-catenin. Molec. Cell 5:533-543, 2000.

Shimoyama, Y.; Nagafuchi, A.; Fujita, S.; Gotoh, M.; Takeichi, M.; Tsukita, S.; Hirohashi, S.: Cadherin dysfunction in a human cancer cell line: possible involvement of loss of alpha-catenin expression in reduced cell-cell adhesiveness. Cancer Res. 52:5770-5774, 1992.

Vasioukhin, V.; Bauer, C.; Degenstein, L.; Wise, B.; Fuchs, E.: Hyperproliferation and defects in epithelial polarity upon conditional ablation of alpha-catenin in skin. Cell 104:605-617, 2001.

Asakura, H.; Zwain, I. H.; Yen, S. S. C.: Expression of genes encoding corticotropin-releasing factor (CRF), type 1 CRF receptor, and CRF-binding protein and localization of the gene products in the human ovary. J. Clin. Endocr. Metab. 82:2720-2725, 1997.

Lynch, E. D.; Lee, M. K.; Morrow, J. E.; Welcsh, P. L.; Leon, P. E.; King, M.-C.: Nonsyndromic deafness DFNA1 associated with mutation of the human homolog of the Drosophila gene diaphanous. Science 278:1315-1318, 1997.

Grosson, C. L. S.; MacDonald, M. E.; Duyao, M. P.; Ambrose, C. M.; Roffler-Tarlov, S.; Gusella, J. F.: Synteny conservation of the Huntington's disease gene and surrounding loci on mouse chromosome 5. Mammalian Genome 5:424-428, 1994.

Weinshank, R. L.; Adham, N.; Macchi, M.; Olsen, M. A.; Branchek, T. A.; Hartig, P. R.: Molecular cloning and characterization of a high affinity dopamine receptor (D-1-beta) and its pseudogene. J. Biol. Chem. 266:22427-22435, 1991.

Byerley, W.; Hoff, M.; Holik, J.; Caron, M. G.; Giros, B.: VNTR polymorphism for the human dopamine transporter gene (DAT1). Hum. Molec. Genet. 2:335, 1993.

Cook, E. H., Jr.; Stein, M. A.; Krasowski, M. D.; Cox, N. J.; Olkon, D. M.; Kieffer, J. E.; Leventhal, B. L.: Association of attention-deficit disorder and the dopamine transporter gene. Am. J. Hum. Genet. 56:993-998, 1995.

Doucette-Stamm, L.; Blakely, D. J.; Tian, J.; Mockus, S.; Mao, J.: Population genetic study of the human dopamine transporter gene (DAT1). Genet. Epidemiol. 12:303-308, 1995.

Gainetdinov, R. R.; Wetsel, W. C.; Jones, S. R.; Levin, E. D.; Jaber, M.; Caron, M. G.: Role of serotonin in the paradoxical calming effect of psychostimulants on hyperactivity. Science 283:397-401,1999.

Gelernter, J.; Vandenbergh, D.; Kruger, S. D.; Pauls, D. L.; Kurlan, R.; Pakstis, A. J.; Kidd, K. K.; Uhl, G.: The dopamine transporter protein gene (SLC6A3): primary linkage mapping and linkage studies in Tourette syndrome. Genomics 30:459-463, 1995.

Gill, M.; Daly, G.; Heron, S.; Hawi, Z.; Fitgerald, M.: Confirmation of association between attention deficit hyperactivity disorder and a dopamine transporter polymorphism. Molec. Psychiat. 2:311-313,1997.

Giros, B.; El Mestikawy, S.; Godinot, N.; Zheng, K.; Han, H.; Yang-Feng, T.; Caron, M. G.: Cloning, pharmacological characterization, and chromosome assignment of the human dopamine transporter. Molec. Pharm. 42:383-390, 1992.

Giros, B.; Jaber, M.; Jones, S. R.; Wightman, R. M.; Caron, M. G.: Hyperlocomotion and indifference to cocaine and amphetamine in mice lacking the dopamine receptor. Nature 370:606-612, 1996.

Goldman, D.: Dopamine transporter, alcoholism and other diseases. Nature Med. 1:624-625, 1995.

Korn, W. T.; Schatzki, S. C.; DiSciullo, A. J.; Scully, R. E.: Papillary cystadenoma of the broad ligament in von Hippel-Lindau disease. Am. J. Obstet. Gynec. 163:596-598, 1990.

Baker, E.; Chen, L. Z.; Smith, C. A.; Callen, D. F.; Goodwin, R.; Sutherland, G. R.: Chromosomal location of the human tumor necrosis factor receptor genes. Cytogenet. Cell Genet. 57:117-118, 1991.

Chan, F. K.-M.; Chun, H. J.; Zheng, L.; Siegel, R. M.; Bui, K. L.; Lenardo, M. J.:A domain in TNF receptors that mediates ligand-independent receptor assembly and signaling. Science 288:2351-2354, 2000.

Atuk, N. O.; McDonald, T.; Wood, T.; Carpenter, J. T.; Walzak, M. P.; Donaldson, M.; Gillenwater, J. Y.; Turner, S. M.; Westfall, V.: Familial pheochromocytoma, hypercalcemia, and von Hippel-Lindau disease: a ten-year study of a large family. Medicine 58:209-218,1979.

Bender, B. U.; Altehofer, C.; Januszewicz, A.; Gartner, R.; Schmidt, H.; Hoffmann, M. M.; Heidemann, P. H.; Neumann, H. P. H.: Functioning thoracic paraganglioma: association with Von Hippel-Lindau syndrome. J. Clin. Endocr. Metab. 82:3356-3360, 1997.

Bender, B. U.; Eng, C.; Olschewski, M.; Berger, D. P.; Laubenberger, J.; Altehofer, C.; Kirste, G.; Orszagh, M.; van Velthoven, V.; Miosczka, H.; Schmidt, D.; Neumann, H. P. H.: VHL c.505 T-C mutation confers a high age related penetrance but no increased overall mortality. J. Med. Genet. 38:508-514, 2001.

Bender, B. U.; Gutsche, M.; Glasker, S.; Muller, B.; Kirste, G.; Eng, C.; Neumann, H. P. H.: Differential genetic alterations in vonHippel-Lindau syndrome-associated and sporadic pheochromocytomas. J. Clin. Endocr. Metab. 85:4568-4574, 2000.

Bonnet, P.; Dechaume, J.; Blanc, E.: L'anevrisme cirsoide de laretine l'anevrisme racemeux, ses relations avec l'anevrisme cirsoidede la face et l'anevrisme cirsoid du cerveau. Bull. Soc. Ophtal. Franc. 51:521-524, 1938.

Bradley, J. F.; Collins, D. L.; Schimke, R. N.; Parrott, H. N.; Rothberg, P. G.: Two distinct phenotypes caused by two different missense mutations in the same codon of the VHL gene. Am. J. Med. Genet. 87:163-167, 1999.

Brauch, H.; Kishida, T.; Glavac, D.; Chen, F.; Pausch, F.; Hofler, H.; Latif, F.; Lerman, M. I.; Zbar, B.; Neumann, H. P. H.: Von Hippel-Lindau (VHL) disease with pheochromocytoma in the Black Forest region of Germany: evidence for a founder effect. Hum. Genet. 95:551-556,1995.

Brown, D. G.; Hilal, S. K.; Tenner, M. S.: Wyburn-Mason syndrome. Arch. Neurol. 28:67-68, 1973.

Cahill, G. F.; Melicow, M. M.; Guerry, D.: The renal lesions in von Hippel-Lindau's disease. Trans. Am. Assoc. Genitourinary Surg. 35:271-281, 1942.

Cameron, S. J.; Doig, A.: Cerebellar tumors presented with clinical features of phaeochromocytoma. Lancet I:492-494, 1970.

Chapman, R. C.; Diaz-Perez, R.: Pheochromocytoma associated with cerebellar hemangioblastoma. J. A. M. A. 182:1014-1017, 1962.

Chen, F.; Slife, L.; Kishida, T.; Mulvihill, J.; Tisherman, S. E.; Zbar, B.: Genotype-phenotype correlation in von Hippel-Lindau disease: identification of a mutation associated with VHL type 2A. J. Med. Genet. 33:716-717, 1996.

Christoferson, L. A.; Gustafson, M. B.; Petersen, A. G.: VonHippel-Lindau's disease. J. A. M. A. 178:280-282, 1961.

Chen, F.; Kishida, T.; Yao, M.; Hustad, T.; Glavac, D.; Dean, M.; Gnarra, J. R.; Orcutt, M. L.; Duh, F. M.; Glenn, G.; Green, J.; Hsia, Y. E.; Lamiell, J.; Li, H.; Wei, M. H.; Schmidt, L.; Tory, K.; Kuzman, I.; Stackhouse, T.; Latif, F.; Linehan, W. M.; Lerman, M.; Zbar, B.: Germline mutations in the von Hippel-Lindau disease tumor suppressor gene: correlations with phenotype. Hum. Mutat. 5:66-75,1995.

Collins, E. T.: Intra-ocular growths (two cases, brother and sister, with peculiar vascular new growth, probably primarily retinal, affecting both eyes). Trans. Ophthal. Soc. U. K. 14:141-149, 1894.

Crossey, P. A.; Foster, K.; Richards, F. M.; Phipps, M. E.; Latif, F.; Tory, K.; Jones, M. H.; Bentley, E.; Kumar, R.; Lerman, M. I.; Zbar, B.; Affara, N. A.; Ferguson-Smith, M. A.; Maher, E. R.: Molecular genetic investigations of the mechanism of tumourigenesis in von Hippel-Lindau disease: analysis of allele loss in VHL tumours. Hum. Genet. 93:53-58, 1994.

Crossey, P. A.; Richards, F. M.; Foster, K.; Green, J. S.; Prowse, A.; Latif, F.; Lerman, M. I.; Zbar, B.; Affara, N. A.; Ferguson-Smith, M. A.; Maher, E. R.: Identification of intragenic mutations in the von Hippel-Lindau disease tumour suppressor gene and correlation with disease phenotype. Hum. Molec. Genet. 3:1303-1308, 1994.

Cushing, H.; Bailey, P.: Hemangiomas of cerebellum and retina (Lindau's disease), with the report of a case. Arch. Ophthal. 57:447-463, 1928.

Davies, D. R.; Norman, A. M.; Whitehouse, R. W.; Evans, D. G. R.: Non-expression of von Hippel-Lindau phenotype in an obligate gene carrier. Clin. Genet. 45:104-106, 1994.

Decker, H.-J. H.; Neumann, H. P. H.; Walter, T. A.; Sandberg, A. A.:3p involvement in a renal cell carcinoma in von Hippel-Lindau syndrome: region of tumor breakpoint clustering on 3p? Cancer Genet. Cytogenet. 33:59-65, 1988.

Duan, D. R.; Humphrey, J. S.; Chen, D. Y. T.; Weng, Y.; Sukegawa, J.; Lee, S.; Gnarra, J. R.; Linehan, W. M.; Klausner, R. D.: characterization of the VHL tumor suppressor gene product: localization, complex formation, and the effect of natural inactivating mutations. Proc. Nat. Acad. Sci. 92:6459-6463, 1995.

Duan, D. R.; Pause, A.; Burgess, W. H.; Aso, T.; Chen, D. Y. T.; Garrett, K. P.; Conaway, R. C.; Conaway, J. W.; Linehan, W. M.; Klausner, R. D.: Inhibition of transcription elongation by the VHL tumor suppressor protein. Science 269:1402-1406, 1995.

Schoof, E.; Girstl, M.; Frobenius, W.; Kirschbaum, M.; Dorr, H. G.; Rascher, W.; Dotsch, J.: Decreased gene expression of 11-beta-hydroxysteroid dehydrogenase type 2 and 15-hydroxyprostaglandin dehydrogenase in human placenta of patients with preeclampsia. J. Clin. Endocr. Metab. 86:1313-1317, 2001.

Bahabri, S. A.; Suwairi, W. M.; Laxer, R. M.; Polinkovsky, A.; Dalaan, A. A.; Warman, M. L.: The camptodactyly-arthropathy-coxavara-pericarditis syndrome: clinical features and genetic mapping to human chromosome 1. Arthritis Rheum. 41:730-735, 1998.

Marcelino, J.; Carpten, J. D.; Suwairi, W. M.; Gutierrez, O. M.; Schwartz, S.; Robbins, C.; Sood, R.; Makalowska, I.; Baxevanis, A.; Johnstone, B.; Laxer, R. M.; Zemel, L.; and 13 others: CACP, encoding a secreted proteoglycan, is mutated in camptodactyly-arthropathy-coxavara-pericarditis syndrome. Nature Genet. 23:319-322, 1999.

Andrechek, E. R.; Hardy, W. R.; Girgis-Gabardo, A. A.; Perry, R. L. S.; Butler, R.; Graham, F. L.; Kahn, R. C.; Rudnicki, M. A.; Muller, W. J.: ErbB2 is required for muscle spindle and myoblast cell survival. Molec. Cell. Biol. 22:4714-4722, 2002.

Bargmann, C. I.; Hung, M.-C.; Weinberg, R. A.: The NEU oncogene encodes an epidermal growth factor receptor-related protein. Nature 319:226-230, 1986.

Chan, R.; Hardy, W. R.; Laing, M. A.; Hardy, S. E.; Muller, W. J.: The catalytic activity of the ErbB-2 receptor tyrosine kinase is essential for embryonic development. Molec. Cell. Biol. 22:1073-1078,2002.

Coussens, L.; Yang-Feng, T. L.; Liao, Y.-C.; Chen, E.; Gray, A.; McGrath, J.; Seeburg, P. H.; Libermann, T. A.; Schlessinger, J.; Francke, U.; Levinson, A.; Ullrich, A.: Tyrosine kinase receptor with extensive homology to EGF receptor shares chromosomal location with NEU oncogene. Science 230:1132-1139, 1985.

Crone, S. A.; Zhao, Y.-Y.; Fan, L.; Gu, Y.; Minamisawa, S.; Liu, Y.; Peterson, K. L.; Chen, J.; Kahn, R.; Condorelli, G.; Ross, J., Jr.; Chien, K. R.; Lee, K.-F.: ErbB2 is essential in the prevention of dilated cardiomyopathy. Nature Med. 8:459-465, 2002.

Dankort, D.; Maslikowski, B.; Warner, N.; Kanno, N.; Kim, H.; Wang, Z.; Moran, M. F.; Oshima, R. G.; Cardiff, R. D.; Muller, W. J.: Grb2 and Shc adapter proteins play distinct roles in Neu (ErbB-2) induced mammary tumorigenesis: implications for human breast cancer. Molec. Cell. Biol. 21:1540-1551, 2001.

De Boer, J. G.: A new mutator phenotype in breast cancer? (Commentary) Proc. Nat. Acad. Sci. 99:3368-3369, 2002.

De Placido, S.; Carlomagno, C.; De Laurentiis, M.; Bianco, A. R.: C-erbB2 expression predicts tamoxifen efficacy in breast cancer patients. Breast Cancer Res. Treat. 52:55-64, 1998.

Di Fiore, P. P.; Pierce, J. H.; Kraus, M. H.; Segatto, O.; King, C. R.; Aaronson, S. A.: erbB-2 is a potent oncogene when overexpressed in NIH/3T3 cells. Science 237:178-182, 1987.

Doherty, J. K.; Bond, C.; Jardim, A.; Adelman, J. P.; Clinton, G. M.: The HER-2/neu receptor tyrosine kinase gene encodes a secreted autoinhibitor. Proc. Nat. Acad. Sci. 96:10869-10874, 1999.

Ehsani, A.; Low, J.; Wallace, R. B.; Wu, A. M.: characterization of a new allele of the human ERBB2 gene by allele-specific competition hybridization. Genomics 15:426-429, 1993.

Francke, U.: Personal Communication. New Haven, Connecticut Apr. 1988.

Fukushige, S.-I.; Matsubara, K.-I.; Yoshida, M.; Sasaki, M.; Suzuki, T.; Semba, K.; Toyoshima, K.; Yamamoto, T.: Localization of a novel v-erbB-related gene, c-erbB-2, on human chromosome 17 and its amplification in a gastric cancer cell line. Molec. Cell. Biol. 6:955-958, 1986.

Kaneko, Y.; Homma, C.; Maseki, N.; Sakurai, M.; Toyoshima, K.; Yamamoto, T.: Human c-erbB-2 remains on chromosome 17 in band q21in the 15;17 translocation associated with acute promyelocytic leukemia. Jpn. J. Cancer Res. 78:16-19, 1987.

Lin, W.; Sanchez, H. B.; Deerinck, T.; Morris, J. K.; Ellisman, M.; Lee, K. F.: Aberrant development of motor axons and neuromuscular synapses in erbB2-deficient mice. Proc. Nat. Acad. Sci. 97:1299-1304,2000.

Liu, S.; Liu, W.; Jakubczak, J. L.; Erexson, G. L.; Tindall, K. R.; Chan, R.; Muller, W. J.; Adhya, S.; Garges, S.; Merlino, G.: Genetic instability favoring transversions associated with ErbB2-induced mammary tumorigenesis. Proc. Nat. Acad. Sci. 99:3770-3775, 2002.

Mehta, R. R.; McDermott, J. H.; Hieken, T. J.; Marler, K. C.; Patel, M. K.; Wild, L. D.; Das Gupta, T. K.: Plasma c-erbB2 levels in breast cancer patients: prognostic significance in predicting response to chemotherapy. J. Clin. Oncol. 16:2409-2416, 1998.

Morris, J. K.; Lin, W.; Hauser, C.; Marchuk, Y.; Getman, D.; Lee, K.-F.: Rescue of the cardiac defect in ErbB2 mutant mice reveals essential roles of ErbB2 in peripheral nervous system development. Neuron 23:273-283, 1999.

Muleris, M.; Almeida, A.; Malfoy, B.; Dutrillaux, B.: Assignment of v-erb-b2 avian erythroblastic leukemia viral oncogene homolog 2(ERBB2) to human chromosome band 17q21.1 by in situ hybridization. Cytogenet. Cell Genet. 76:34-35, 1997.

Ozcelik, C.; Erdmann, B.; Pilz, B.; Wettschureck, N.; Britsch, S.; Hubner, N.; Chien, K. R.; Birchmeier, C.; Garratt, A. N.: Conditional mutation of the ErbB2 (HER2) receptor in cardiomyocytes leads to dilated cardiomyopathy. Proc. Nat. Acad. Sci. 99:8880-8885, 2002.

Papewalis, J.; Nikitin, A. Y.; Rajewsky, M. F.: G to A polymorphism at amino acid codon 655 of the human erbB-2/HER2 gene. Nucleic Acids Res. 19:5452 only, 1991.

Pegram, M. D.; Finn, R. S.; Arzoo, K.; Beryt, M.; Pietras, R. J.; Slamon, D. J.: The effect of HER-2/neu overexpression on chemotherapeutic drug sensitivity in human breast and ovarian cancer cells. Oncogene 15:537-547, 1997.

Pietras, R. J.; Pegram, M. D.; Finn, R. S.; Maneval, D. A.; Slamon, D. J.: Remission of human breast cancer xenografts on therapy with humanized monoclonal antibody to HER-2 receptor and DNA-reactive drugs. Oncogene 17:2235-2249, 1998.

Popescu, N. C.; King, C. R.; Kraus, M. H.: Localization of the human erbB-2 gene on normal and rearranged chromosomes 17 to bandsq12-21.32. Genomics 4:362-366, 1989.

Qiu, Y.; Ravi, L.; Kung, H.-J.: Requirement of ErbB2 for signalling by interleukin-6 in prostate carcinoma cells. Nature 393:83-85,1998.

Semba, K.; Kamata, N.; Toyoshima, K.; Yamamoto, T.: A v-erbB-related proto-oncogene, c-erbB-2, is distinct from the c-erbB-1/epidermal growth factor-receptor gene and is amplified in a human salivary gland adenocarcinoma. Proc. Nat. Acad. Sci. 82:6497-6501, 1985.

Slamon, D. J.; Godolphin, W.; Jones, L. A.; Holt, J. A.; Wong, S. G.; Keith, D. E.; Levin, W. J.; Stuart, S. G.; Udove, J.; Ullrich, A.; Press, M. F.: Studies of the HER-2/neu proto-oncogene in human breast and ovarian cancer. Science 244: 707-712, 1989.

Slamon, D. J.; Leyland-Jones, B.; Shak, S.; Fuchs, H.; Paton, V.; Bajamonde, A.; Fleming, T.; Eiermann, W.; Wolter, J.; Pegram, M.; Baselga, J.; Norton, L.: Use of chemotherapy plus a monoclonal antibody against HER2 for metastatic breast cancer that overexpresses HER2. New Eng. J. Med. 344:783-792, 2001.

Beutler, E.; Kuhl, W.; Gelbart, T.:6-Phosphogluconolactonase deficiency, a hereditary erythrocyte enzyme deficiency: possible interaction with glucose-6-phosphate dehydrogenase deficiency. Proc. Nat. Acad. Sci. 82:3876-3878, 1985.

Benkmann, H.-G.; Paik, Y. K.; Chen, L. Z.; Goedde, H. W.: Polymorphism of 6-PGD in South Korea: a new genetic variant 6-PGD Korea. Hum. Genet. 74:204-205, 1986.

Blake, N. M.; Kirk, R. L.: New genetic variant of 6-phosphogluconate dehydrogenase in Australian aborigines. Nature 221:278 only, 1969.

Bowman, J. E.; Carson, P. E.; Frischer, H.; De Garay, A. L.: Genetics of starch-gel electrophoretic variants of human 6-phosphogluconic dehydrogenase: population and family studies in the United States and in Mexico. Nature 210:811-812, 1966.

Brewer, G. J.; Dern, R. J.: A new inherited enzymatic deficiency of human erythrocytes:6-phosphogluconate dehydrogenase deficiency. Am. J. Hum. Genet. 16:472-476, 1964.

Burgerhout, W.; Van Someren, H.; Bootsma, D.: Cytological mapping of the genes assigned to the human A1 chromosome by use of radiation-induced chromosome breakage in a human-Chinese hamster hybrid cell line. human genetik 20:159-162, 1973.

Davidson, R. G.: Electrophoretic variants of human 6-phosphogluconate dehydrogenase: population and family studies and description of a new variant. Ann. Hum. Genet. 30:355-362, 1967.

Dern, R. J.; Brewer, G. J.; Tashian, R. E.; Shows, T. B.: Hereditary variation of erythrocytic 6-phosphogluconate dehydrogenase. J. Lab. Clin. Med. 67:255-264, 1966.

Douglas, G. R.; McAlpine, P. J.; Hamerton, J. L.: Regional localization of loci for human PGM-1 and 6PGD on human chromosome 1 by use of hybrids of Chinese hamster-human somatic cells. Proc. Nat. Acad. Sci. 70:2737-2740, 1973.

Fildes, R. A.; Parr, C. W.: Human red-cell phosphogluconate dehydrogenases. Nature 200:890-891, 1963.

Nelson, M. S.: Biochemical and genetic characterization of the Lowell variant: a new phenotype of 6-phosphogluconate dehydrogenase. Hum. Genet. 62:333-336, 1982.

Nevo, S.: A new rare PGD variant, PGD Mediterranean. Hum. Genet. 81:199 only, 1989.

Parr, C. W.: Erythrocyte phosphogluconate dehydrogenase polymorphism. Nature 210:487-489, 1966.

Parr, C. W.; Fitch, L. I.: Inherited quantitative variations of human phosphogluconate dehydrogenase. Ann. Hum. Genet. 30:339-353,1967.

Ritter, H.; Toriverdiau, G.; Wendt, G. G.; Zilch, I.: Genetic and linkage analysis on 6-PGD. human genetik 14:73-75, 1971.

Tariverdian, G.; Ropers, H.-H.; Op't Hof, J.; Ritter, H.: ZurGenetik der 6-Phosphogluconat dehydrogenase (EC: 1.1.1.44): Eine neueVariante F (Freiburg). human genetik 10:355-357, 1970.

Weitkamp, L. R.: Genetic linkage relationships of the ADA and6-PGD loci in 'human genetik.' (Letter) human genetik 15:359-360,1972.

Weitkamp, L. R.; Guttormsen, S. A.; Greendyke, R. M.: genetic linkage between a locus for 6-PGD and the Rh locus: evaluation of possible heterogeneity in the recombination fraction between sexes and among families. Am. J. Hum. Genet. 23:462-470, 1971.

Weitkamp, L. R.; Guttormsen, S. A.; Shreffler, D. C.; Sing, C. F.; Napier, J. A.: Genetic linkage relations of the loci for 6-phosphogluconate dehydrogenase and adenosine deaminase in man. Am. J. Hum. Genet. 22:216-220, 1970.

Westerveld, A.; Meera Khan, P.: Evidence for linkage between human loci for 6-phosphogluconate dehydrogenase and phosphoglucomutase (1) in man-Chinese hamster somatic cell hybrids. Nature 236:30-32,1972.

McEver, R. P.; Beckstead, J. H.; Moore, K. L.; Marshall-Carlson, L.; Bainton, D. F.: GMP-140, a platelet alpha-granule membrane protein, is also synthesized by vascular endothelial cells and is localized in Weibel-Palade bodies. J. Clin. Invest. 84:92-99, 1989.

Thomas, K. R.; Capecchi, M. R.:Cell 51:503-512, 1987.

Scita, G.; Nordstrom, J.; Carbone, R.; Tenca, P.; Giardina, G.; Gutkind, S.; Bjarnegard, M.; Betsholtz, C.; Di Fiore, P. P.: EPS8 and E3B1 transduce signals from Ras to Rac. Nature 401:290-293,1999.

Scheidler, S.; Fredericks, W. J.; Rauscher, F. J., III; Barr, F. G.; Vogt, P. K.: The hybrid PAX3-FKHR fusion protein of alveolar rhabdomyosarcoma transforms fibroblasts in culture. Proc. Nat. Acad. Sci. 93:9805-9809, 1996.

Sublett, J. E.; Jeon, I-S.; Shapiro, D. N.: The alveolar rhabdomyosarcoma PAX3/FKHR fusion protein is a transcriptional activator. Oncogene 11:545-552, 1995.

Whang-Peng, J.; Knutsen, T.; Theil, K.; Horowitz, M. E.; Triche, T.: Cytogenetic studies in subgroups of rhabdomyosarcoma. Genes Chromosomes Cancer 5:299-310, 1992.

Richard, I.; Broux, O.; Chiannilkulchai, N.; Fougerousse, F.; Allamand, V.; Bourg, N.; Brenguier, L.; Devaud, C.; Pasturaud, P.; Roudaut, C.; Lorenzo, F.; Sebastiani-Kabatchis, C.; Schultz, R. A.; Polymeropoulos, M. H.; Gyapay, G.; Auffray, C.; Beckmann, J. S.: Regional localization of human chromosome 15 loci. Genomics 23:619-627, 1994.

Zuniga, A.; Haramis, A.-P. G.; McMahon, A. P.; Zeller, R.: Signal relay by BMP antagonism controls the SHH/FGF4 feedback loop in vertebrate limb buds. Nature 401:598-602, 1999.

Bao, L.; Gerard, N. P.; Eddy, R. L., Jr.; Shows, T. B.; Gerard, C.: Mapping of genes for the human C5a receptor (C5AR), human FML Preceptor (FPR), and two FMLP receptor homologue orphan receptors (FPRH1, FPRH2) to chromosome 19. Genomics 13:437-440, 1992.

Andersen, T. I.; Wooster, R.; Laake, K.; Collins, N.; Warren, W.; Skrede, M.; Eeles, R.; Tveit, K. M.; Johnston, S. R. D.; Dowsett, M.; Olsen, A. O.; Moller, P.; Stratton, M. R.; Borresen-Dale, A.-L.: Screening for ESR mutations in breast and ovarian cancer patients. Hum. Mutat. 9:531-536, 1997.

Auboeuf, D.; Honig, A.; Berget, S. M.; O'Malley, B. W.: Coordinate regulation of transcription and splicing by steroid receptor coregulators. Science 298:416-419, 2002.

Balleine, R. L.; Hunt, S. M. N.; Clarke, C. L.: Coexpression of alternatively spliced estrogen and progesterone receptor transcripts in human breast cancer. J. Clin. Endocr. Metab. 84:1370-1377, 1999.

Becherini, L.; Gennari, L.; Masi, L.; Mansani, R.; Massart, F.; Morelli, A.; Falchetti, A.; Gonnelli, S.; Fiorelli, G.; Tanini, A.; Brandi, M. L.: Evidence of a linkage disequilibrium between polymorphisms in the human estrogen receptor-alpha gene and their relationship to bone mass variation in postmenopausal Italian women. Hum. Molec. Genet. 9:2043-2050, 2000.

Bord, S.; Horner, A.; Beavan, S.; Compston, J.: Estrogen receptors alpha and beta are differentially expressed in developing human bone. J. Clin. Endocr. Metab. 86:2309-2314, 2001.

Castagnoli, A.; Maestri, I.; Bernardi, F.; Del Senno, L.: PvuIIRFLP inside the human estrogen receptor gene. Nucleic Acids Res. 15:866 only, 1987.

Chaidarun, S. S.; Alexander, J. M.: A tumor-specific truncated estrogen receptor splice variant enhances estrogen-stimulated gene expression. Molec. Endocr. 12:1355-1366, 1998.

Chiang, C.-H.; Cheng, K. W.; Igarashi, S.; Nathwani, P. S.; Leung, P. C. K.: Hormonal regulation of estrogen receptor alpha and beta gene expression in human granulosa-luteal cells in vitro. J. Clin. Endocr. Metab. 85:3828-3839, 2000.

Clark, G. M.; McGuire, W. L.: Steroid receptors and other prognostic factors in primary breast cancer. Semin. Oncol. 15 (suppl. 1):20-25,1988.

Couse, J. F.; Hewitt, S. C.; Bunch, D. O.; Sar, M.; Walker, V. R.; Davis, B. J.; Korach, K. S.: Postnatal sex reversal of the ovaries in mice lacking estrogen receptors alpha and beta. Science 286:2328-2331, 1999.

Davis, V. L.; Chan, C.-C.; Schoen, T. J.; Couse, J. F.; Chader, G. J.; Korach, K. S.: An estrogen receptor repressor induces cataract formation in transgenic mice. Proc. Nat. Acad. Sci. 99:9427-9432,2002.

Esmaeli, B.; Harvey, J. T.; Hewlett, B.: Immunohistochemical evidence for estrogen receptors in meibomian glands. Ophthalmology 107:180-184, 2000.

Fan, S.; Wang, J.-A.;Yuan, R.; Ma,Y.; Meng, Q.; Erdos, M. R.; Pestell, R. G.; Yuan, F.; Auborn, K. J.; Goldberg, I. D.; Rosen, E. M.: BRCA1 inhibition of estrogen receptor signaling in transfected cells. Science 284:1354-1356, 1999.

Fuqua, S. A. W.; Chamness, G. C.; McGuire, W. L.: Estrogen receptor mutations in breast cancer. J. Cell. Biochem. 51:135-139, 1993.

Gosden, J. R.; Middleton, P. G.; Rout, D.: Localization of the human oestrogen receptor gene to chromosome 6q24-q27 by in situ hybridization. Cytogenet. Cell Genet. 43:218-220, 1986.

Green, S.; Walter, P.; Kumar, V.; Krust, A.; Bornert, J.-M.; Argos, P.; Chambon, P.: Human oestrogen receptor cDNA: sequence, expression and homology to v-erb-A. Nature 320: 134-139, 1986.

Greene, G. L.; Gilna, P.; Waterfield, M.; Baker, A.; Hort,Y.; Shine, J.: Sequence and expression of human estrogen receptor complementary DNA. Science 231:1150-1154, 1986.

Heine, P. A.; Taylor, J. A.; Iwamoto, G. A.; Lubahn, D. B.; Cooke, P. S.: Increased adipose tissue in male and female estrogen receptor-alpha knockout mice. Proc. Nat. Acad. Sci. 97:12729-12734, 2000.

Herrington, D. M.; Howard, T. D.; Hawkins, G. A.; Reboussin, D. M.; Xu, J.; Zheng, S. L.; Brosnihan, K. B.; Meyers, D. A.; Bleecker, E. R.: Estrogen-receptor polymorphisms and effects of estrogen replacement on high-density lipoprotein cholesterol in women with coronary disease. NewEng. J. Med. 346:967-974, 2002.

Issa, J.-P. J.; Ottaviano, Y. L.; Celano, P.; Hamilton, S. R.; Davidson, N. E.; Baylin, S. B.: Methylation of the oestrogen receptor CpG island links ageing and neoplasia in human colon. Nature Genet. 7:536-540, 1994.

Jeltsch, J. M.; Roberts, M.; Schatz, C.; Garnier, J. M.; Brown, A. M. C.; Chambon, P.: Structure of the human oestrogen-responsive gene pS2. Nucleic Acids Res. 15:1401-1414, 1987.

Bing, D. H.; Almeda, S.; Isliker, H.; Lahav, J.; Hynes, R. O.:Fibronectin binds to the C1q component of complement. Proc. Nat. Acad. Sci. 79:4198-4201, 1982.

Bittner, M.; Meltzer, P.; Chen, Y.; Jiang, Y.; Seftor, E.; Hendrix, M.; Radmacher, M.; Simon, R.; Yakhini, Z.; Ben-Dor, A.; Sampas, N.; Dougherty, E.; and 16 others: Molecular classification of cutaneous malignant melanoma by gene expression profiling. Nature 406:536-540,2000.

Clark, E. A.; Golub, T. R.; Lander, E. S.; Hynes, R. O.: Genomic analysis of metastasis reveals an essential role for RhoC. Nature 406:532-535, 2000.

Clemmensen, I.: Fibronectin and its role in connective tissue diseases. (Editorial) Europ. J. Clin. Invest. 11:145-146, 1981.

Croce, C. M.: Personal Communication. Philadelphia, Pa. Jan. 12, 1983.

Eun, C. K.; Klinger, H. P.: Human chromosome 11 affects the expression of fibronectin fibers in human-times-mouse cell hybrids. Cytogenet. Cell Genet. 27:57-65, 1980.

Gutman, A.; Kornblihtt, A. R.: Identification of a third region of cell-specific alternative splicing in human fibronectin mRNA. Proc. Nat. Acad. Sci. 84:7179-7182, 1987.

Henry, I.; Jeanpierre, M.; Weil, D.; Grzeschik, K. H.; Ramirez, F.; Junien, C.: The structural gene for fibronectin (FN) maps to 2q323-qter. (Abstract) Cytogenet. Cell Genet. 40:650 only, 1985.

Hirano, H.; Yamada, Y.; Sullivan, M.; de Crombrugghe, B.; Pastan, I.; Yamada, K. M.: Isolation of genomic DNA clones spanning the entire fibronectin gene. Proc. Nat. Acad. Sci. 80:46-50, 1983.

Jhanwar, S. C.; Jensen, J. T.; Kaelbling, M.; Chaganti, R. S. K.; Klinger, H. P.: In situ localization of human fibronectin (FN) genes to chromosome regions 2p14-p16, 2q34-q36, and 11q12.1-q13.5 in germ line cells, but to chromosome 2 sites only in somatic cells. Cytogenet. Cell Genet. 41:47-53, 1986.

Koch, G. A.; Schoen, R. C.; Klebe, R. J.; Shows, T. B.: Assignment of a fibronectin gene to human chromosome 2 using monoclonal antibodies. Exp. Cell Res. 141:293-302, 1982.

Kornblihtt, A. R.; Umezawa, K.; Vibe-Pedersen, K.; Baralle, F. E.: Primary structure of human fibronectin: differential splicing may generate at least 10 polypeptides from a single gene. EMBO J. 4:1755-1759, 1985.

Kornblihtt, A. R.; Vibe-Pedersen, K.; Baralle, F. E.: Isolation and characterization of cDNA clones for human and bovine fibronectins. Proc. Nat. Acad. Sci. 80:3218-3222, 1983.

Kornblihtt, A. R.; Vibe-Pedersen, K.; Baralle, F. E.: Human fibronectin:molecular cloning evidence for two mRNA species differing by an internal segment coding for a structural domain. EMBO J. 3:221-226, 1984.

Kurkinen, M.; Vartio, T.; Vaheri, A.: Polypeptides of human plasma fibronectin are similar but not identical. Biochim. Biophys. Acta 624:490-498, 1980.

Matsuura, H.; Takio, K.; Titani, K.; Greene, T.; Levery, S. B.; Salyan, M. E. K.; Hakomori, S.: The oncofetal structure of human fibronectin defined by monoclonal antibody FDC-6. J. Biol. Chem. 263:3314-3322, 1988.

McDonagh, J.: Fibronectin: a molecular glue. Arch. Path. Lab. Med. 105:393-396, 1981.

Mosesson, M. W.; Amrani, D. L.: The structure and biologic activities of plasma fibronectin. Blood 56:145-158, 1980.

Odermatt, E.; Tamkun, J. W.; Hynes, R. O.: Repeating modular structure of the fibronectin gene: relationship to protein structure and subunit variation. Proc. Nat. Acad. Sci. 82:6571-6575, 1985.

Owerbach, D.; Doyle, D.; Shows, T. B.: Genetics of the large, external, transformation-sensitive (LETS) protein: assignment of a gene coding for expression of LETS to human chromosome 8. Proc. Nat. Acad. Sci. 75:5640-5644, 1978.

Prowse, K.; Tricoli, J.; Klebe, R.; Shows, T.: Chromosome 2 assignment of the structural gene for fibronectin (FN) using a cloned probe.(Abstract) Cytogenet. Cell Genet. 40:724 only, 1985.

Prowse, K. R.; Tricoli, J. V.; Klebe, R. J.; Shows, T. B.: Assignment of the human fibronectin structural gene to chromosome 2. Cytogenet. Cell Genet. 41:42-46, 1986.

Rennard, S. I.; Church, R. L.; Rohrbach, D. H.; Shupp, D. E.; Abe, S.; Hewitt, A. T.; Murray, J. C.; Martin, G. R.: Localization of the human fibronectin (FN) gene on chromosome 8 by a specific enzyme immunoassay. Biochem. Genet. 19:551-566, 1981.

Ridley, A.: Molecular switches in metastasis. Nature 406: 466-467,2000.

McCurley, R. S.; Recinos, A., III; Olsen, A. S.; Gingrich, J. C.; Szczepaniak, D.; Cameron, H. S.; Krauss, R.; Weston, B. W.: Physical maps of human alpha (1,3) fucosyltransferase genes FUT3-FUT6 on chromosomes 19p13.3 and 11q21. Genomics 26:142-146, 1995.

Weston, B. W.; Nair, R. P.; Larsen, R. D.; Lowe, J. B.: Isolation of a novel human alpha (1,3) fucosyltransferase gene and molecular comparison to the human lewis blood group alpha (1,3/1,4) fucosyltransferase gene:syntenic, homologous, nonallelic genes encoding enzymes with distinct acceptor substrate specificities. J. Biol. Chem. 267: 4152-4160,1992.

Weston, B. W.; Smith, P. L.; Kelly, R. J.; Lowe, J. B.: molecular cloning of a fourth member of a human alpha (1,3) fucosyltransferasegene family: multiple homologous sequences that determine expression of the Lewis x, sialyl Lewis x, and difucosyl sialyl Lewis x epitopes. J. Biol. Chem. 267:24575-24584, 1992.

Brinkman-Van der Linden, E. C. M.; Mollicone, R.; Oriol, R.; Larson, G.; Van den Eijnden, D. H.; Van Dijk, W.: A missense mutation in the FUT6 gene results in total absence of alpha-3-fucosylation of human alpha-1-acid glycoprotein. J. Biol. Chem. 271:14492-14495,1996.

Bingham, C.; Bulman, M. P.; Ellard, S.; Allen, L. I. S.; Lipkin, G. W.; van't Hoff, W. G.; Woolf, A. S.; Rizzoni, G.; Novelli, G.; Nicholls, A. J.; Hattersley, A. T.: Mutations in the hepatocyte nuclear factor-1-beta gene are associated with familial hypoplastic glomerulocystic kidney disease. Am. J. Hum. Genet. 68:219-224, 2001.

Kaplan, B. S.; Gordon, I.; Pincott, J.; Barratt, T. M.: Familial hypoplastic glomerulocystic kidney disease: a definite entity with dominant inheritance. Am. J. Med. Genet. 34:569-573, 1989.

Rizzoni, G.; Loirat, C.; Levy, M.; Milanesi, C.; Zachello, G.; Mathieu, H.: Familial hypoplastic glomerulocystic kidney: a new entity? Clin. Nephrol. 18:263-268, 1982.

Fong, H. K. W.; Yoshimoto, K. K.; Eversole-Cire, P.; Simon, M. I.: Identification of a GTP-binding protein alpha subunit that lacks an apparent ADP-ribosylation site for pertussis toxin. Proc. Nat. Acad. Sci. 85:3066-3070, 1988.

Matsuoka, M.; Itoh, H.; Kozasa, T.; Kaziro, Y.: Sequence analysis of cDNA and genomic DNA for a putative pertussis toxin-insensitive guanine nucleotide-binding regulatory protein alpha subunit. Proc. Nat. Acad. Sci. 85:5384-5388, 1988.

Wilkie, T. M.; Gilbert, D. J.; Olsen, A. S.; Chen, X.-N.; Amatruda, T. T.; Korenberg, J. R.; Trask, B. J.; de Jong, P.; Reed, R. R.; Simon, M. I.; Jenkins, N. A.; Copeland, N. G.: Evolution of the mammalian G protein alpha subunit multigene family. Nature Genet. 1:85-91,1992.

Neer, E. J.; Michel, T.; Eddy, R.; Shows, T.; Seidman, J. G.:Genes for two homologous G-protein alpha subunits map to different human chromosomes. Hum. Genet. 77:259-262, 1987.

Colombo, M. P.; Martinotti, A.; Howard, T. A.; Schneider, C.; d'Eustachio, P.; Seldin, M. F.: Localization of growth arrest-specific genes on mouse chromosomes 1, 7, 8, 11, 13, and 16. Mammalian Genome 2:130-134,1992.

Del Sal, G.; Collavin, L.; Ruaro, M. E.; Edomi, P.; Saccone, S.; Della Valle, G.; Schneider, C.: Structure, function, and chromosome mapping of the growth-suppressing human homologue of the murine gas1gene. Proc. Nat. Acad. Sci. 91:1848-1852, 1994.

Del Sal, G.; Ruaro, M. E.; Philipson, L.; Schneider, C.: The growth arrest-specific gene, gas1, is involved in growth suppression. Cell 70:595-607, 1992.

Evdokiou, A.; Webb, G. C.; Peters, G. B.; Dobrovic, A.; O'Keefe, D. S.; Forbes, I. J.; Cowled, P. A.: Localization of the human growth arrest-specific gene (GAS1) to chromosome bands 9q21.3-q22, a region frequently deleted in myeloid malignancies. Genomics 18:731-733,1993.

Schneider, C.; King, R. M.; Philipson, L.: Genes specifically expressed at growth arrest of mammalian cells. Cell 54:787-793,1988.

Webb, G. C.; Cowled, P. A.; Evdokiou, A.; Ford, J. H.; Forbes, I. J.: Assignment, by in situ hybridization, of the growth arrest-specific gene, Gas-1, to mouse chromosome 13, bands B3-C2. Genomics 14:548-549,1992.

Riese, R. J.; Shi, G.-P.; Villadangos, J.; Stetson, D.; Driessen, C.; Lennon-Dumenil, A.-M.; Chu, C.-L.; Naumov, Y.; Behar, S. M.; Ploegh, H.; Locksley, R.; Chapman, H. A.: Regulation of CD1 function and NK1.1+ T cell selection and maturation by cathepsin S. Immunity 15:909-919, 2001.

Ion, R.; Telvi, L.; Chaussain, J.-L.; Barbet, J. P.; Nunes, M.; Safar, A.; Rethore, M.-O.; Fellous, M.; McElreavey, K.: Failure of testicular development associated with a rearrangement of 9p24.1 proximal to the SNF2 gene. Hum. Genet. 102:151-156, 1998.

Matsushime, H.; Jinno, A.; Takagi, N.; Shibuya, M.: A novel mammalian protein kinase gene (mak) is highly expressed in testicular germ cells at and after meiosis. Molec. Cell. Biol. 10:2261-2268, 1990.

Taketo, M.; Jinno, A.; Yamaguchi, S.; Matushime, H.; Shibuya, M.; Seldin, M. F.: Mouse Mak gene for male germ cell-associated kinase maps to chromosome 13. Genomics 19:397-398, 1994.

Itoh, T.; Tanaka, T.; Nagai, R.; Kamiya, T.; Sawayama, T.; Nakayama, T.; Tomoike, H.; Sakurada, H.; Yazaki, Y.; Nakamura, Y.: Genomic organization and mutational analysis of HERG, a gene responsible for familial long QT syndrome. Hum. Genet. 102:435-439, 1998.

Jiang, C.; Atkinson, D.; Towbin, J. A.; Splawski, I.; Lehmann, M. H.; Li, H.; Timothy, K.; Taggart, R. T.; Schwartz, P. J.; Vincent, G. M.; Moss, A. J.; Keating, M. T.: Two long QT syndrome loci map to chromosomes 3 and 7 with evidence for further heterogeneity. Nature Genet. 8:141-147, 1994.

Jongbloed, R. J. E.; Wilde, A. A. M.; Geelen, J. L. M. C.; Doevendans, P.; Schaap, C.; Van Langen, I.; van Tintelen, J. P.; Cobben, J. M.; Beaufort-Krol, G. C. M.; Geraedts, J. P. M.; Smeets, H. J. M.: Novel KCNQ1 and HERG missense mutations in Dutch long-QT families. Hum. Mutat. 13:301-310, 1999.

Kagan, A.; Yu, Z.; Fishman, G. I.; McDonald, T. V.: The dominant negative LQT2 mutation A561V reduces wild-type HERG expression. J. Biol. Chem. 275:11241-11248, 2000.

Kuperschmidt, S.; Yang, T.; Chanthaphaychith, S.; Wang, Z.; Towbin, J. A.; Roden, D. M.: Defective human ether-a-go-go-related gene trafficking linked to an endoplasmic reticulum retention signal in the C terminus. J. Biol. Chem. 277:27442-27448, 2002.

Larsen, L. A.; Svendsen, I. H.; Jensen, A. M.; Kanters, J. K.; Andersen, P. S.; Moller, M.; Sorensen, S. A.; Sandoe, E.; Jacobsen, J. R.; Vuust, J.; Christiansen, M.: Long QT syndrome with a high mortality rate caused by a novel G572R missense mutation in KCNH2. Clin. Genet. 57:125-130, 2000.

Li, X.; Xu, J.; Li, M.: The human delta-1261 mutation of the HERG potassium channel results in a truncated protein that contains a subunit interaction domain and decreases the channel expression. J. Biol. Chem. 272:705-708, 1997.

Miller, C.: The inconstancy of the human heart. Nature 379:767-768, 1996.

Moss, A. J.; Zareba, W.; Kaufman, E. S.; Gartman, E.; Peterson, D. R.; Benhorin, J.; Towbin, J. A.; Keating, M. T.; Priori, S. G.; Schwartz, P. J.; Vincent, G. M.; Robinson, J. L.; Andrews, M. L.; Feng, C.; Hall, W. J.; Medina, A.; Zhang, L.; Wang, Z.: Increased risk of arrhythmic events in long-QT syndrome with mutations in the pore region of the human ether-a-go-go-related gene potassium channel. Circulation 105:794-799, 2002.

Nakajima, T.; Kurabayashi, M.; Ohyama, Y.; Kaneko, Y.; Furukawa, T.; Itoh, T.; Taniguchi, Y.; Tanaka, T.; Nakamura, Y.; Hiraoka, M.; Nagai, R.: Characterization of S818L mutation in HERG C-terminus in LQT2: modification of activation-deactivation gating properties. FEBSLett. 481:197-203, 2000.

Priori, S. G.; Barhanin, J.; Hauer, R. N. W.; Haverkamp, W.; Jongsma, H. J.; Kleber, A. G.; McKenna, W. J.; Roden, D. M.; Rudy, Y.; Schwartz, K.; Schwartz, P. J.; Towbin, J. A.; Wilde, A. M.: Genetic and molecular basis of cardiac arrhythmias: impact on clinical management. Parts I and II. Circulation 99:518-528, 1999.

Priori, S. G.; Barhanin, J.; Hauer, R. N. W.; Haverkamp, W.; Jongsma, H. J.; Kleber, A. G.; McKenna, W. J.; Roden, D. M.; Rudy, Y.; Schwartz, K.; Schwartz, P. J.; Towbin, J. A.; Wilde, A. M.: Genetic and molecular basis of cardiac arrhythmias: impact on clinical management. Part III. Circulation 99:674-681, 1999.

Priori, S. G.; Napolitano, C.; Schwartz, P. J.: Low penetrancein the long QT syndrome: clinical impact. Circulation 99:529-533,1999.

Rajamani, S.; Anderson, C. L.; Anson, B. D.; January, C. T.:Pharmacological rescue of human K+ channel long-QT2 mutations. Circulation 105:2830-2835, 2002.

Sanguinetti, M. C.; Jiang, C.; Curran, M. E.; Keating, M. T.:A mechanistic link between an inherited and an acquired cardiac arrhythmia:HERG encodes the I(Kr) potassium channel. Cell 81:299-307, 1995.

Satler, C. A.; Vesely, M. R.; Duggal, P.; Ginsburg, G. S.; Beggs, A. H.: Multiple different missense mutations in the pore region of HERG in patients with long QT syndrome. Hum. Genet. 102:265-272,1998.

Satler, C. A.; Walsh, E. P.; Vesely, M. R.; Plummer, M. H.; Ginsburg, G. S.; Jacob, H. J.: Novel missense mutation in the cyclic nucleotide-binding domain of HERG causes long QT syndrome. Am. J. Med. Genet. 65:27-35,1996.

Smith, P. L.; Baukrowtiz, T.; Yellen, G.: The inward rectification mechanism of the HERG cardiac potassium channel. Nature 379:833-835,1996.

Splawski, I.; Shen, J.; Timothy, K. W.; Vincent, G. M.; Lehmann, M. H.; Keating, M. T.: Genomic structure of three long QT syndrome genes: KVLQT1, HERG, and KCNE1. Genomics 51:86-97, 1998.

Tanaka, T.; Nagai, R.; Tomoike, H.; Takata, S.; Yano, K.; Yabuta, K.; Haneda, N. Nakano, O.; Shibata, A.; Sawayama, T.; Kasai, H.; Yazaki, Y.; Nakamura, Y.: Four novel KVLQT1 and four novel HERG mutations in familial long-QT syndrome. Circulation 95:565-567, 1997.

Thomas, P. J.; Qu, B.-H.; Pedersen, P. L.: Defective protein folding as a basis of human disease. Trends Biochem. Sci. 20:456-459,1995.

Trudeau, M. C.; Warmke, J. W.; Ganetzky, B.; Robertson, G. A.: HERG, a human inward rectifier in the voltage-gated potassium channel family. Science 269:92-95, 1995.

Warmke, J. W.; Ganetzky, B.: A family of potassium channel genes related to eag in Drosophila and mammals. Proc. Nat. Acad. Sci. 91:3438-3442, 1994.

Yoshida, H.; Horie, M.; Otani, H.; Kawashima, T.; Onishi, Y.; Sasayama, S.: Bradycardia-induced long QT syndrome caused by a denovo missense mutation in the S2-S3 inner loop of HERG. Am. J. Med. Genet. 98:348-352, 2001.

Zareba, W.; Moss, A. J.; Schwartz, P. J.; Vincent, G. M.; Robinson, J. L.; Priori, S. G.; Benhorin, J.; Locati, E. H.; Towbin, J. A.; Keating, M. T.; Lehmann, M. H.; Hall, W. J.; International Long-QT Syndrome Registry Research Group: Influence of the genotype on the clinical course of the long-QT syndrome. New Eng. J. Med. 339:960-965,1998.

Zhou, Z.; Gong, Q.; Epstein, M. L.; January, C. T.: HERG channel dysfunction in human long QT syndrome: intracellular transport and functional defects. J. Biol. Chem. 273: 21061-21066, 1998.

Boyes, J.; Bird, A.: DNA methylation inhibits transcription indirectly via a methyl-CpG binding protein. Cell 64:1123-1134, 1991.

Cross, S. H.; Meehan, R. R.; Nan, X.; Bird, A.: A component of the transcriptional repressor MeCP1 shares a motif with DNA methyltransferase and HRX proteins. Nature Genet. 16:256-259, 1997.

Hendrich, B.; Abbott, C.; McQueen, H.; Chambers, D.; Cross, S.; Bird, A.: Genomic structure and chromosomal mapping of the murine and human Mbd1, Mbd2, Mbd3, and Mbd4 genes. Mammalian Genome 10:906-912, 1999.

Hempstead, B. L.; Martin-Zanca, D.; Kaplan, D. R.; Parada, L. F.; Chao, M. V.: High-affinity NGF binding requires coexpression of the trk proto-oncogene and the low-affinity NGF receptor. Nature 350:678-683, 1991.

Huebner, K.; Isobe, M.; Chao, M.; Bothwell, M.; Ross, A. H.; Finan, J.; Hoxie, J. A.; Sehgal, A.; Buck, C. R.; Lanahan, A.; Nowell, P. C.; Koprowski, H.; Croce, C. M.: The nerve growth factor receptor gene is at human chromosome region 17q12-17q22, distal to the chromosome 17 breakpoint in acute leukemias. Proc. Nat. Acad. Sci. 83:1403-1407,1986.

Ip, N. Y.; Stitt, T. N.; Tapley, P.; Klein, R.; Glass, D. J.; Fandl, J.; Greene, L. A.; Barbacid, M.; Yancopoulos, G. D.: Similarities and differences in the way neurotrophins interact with the Trk receptors in neuronal and nonneuronal cells. Neuron 10:137-149, 1993.

Johnson, D.; Lanahan, A.; Buck, C. R.; Sehgal, A.; Morgan, C.; Mercer, E.; Bothwell, M.; Chao, M.: Expression and structure of the human NGF receptor. Cell 47:545-554, 1986.

Lee, K. F.; Li, E.; Huber, J.; Landis, S. C.; Sharpe, A. H.; Chao, M. V.; Jaenisch, R.: Targeted mutation of the gene encoding the low affinity NGF receptor p75 leads to deficits in the peripheral sensory nervous system. Cell 69:737-749, 1992.

Mischel, P. S.; Smith, S. G.; Vining, E. R.; Valletta, J. S.; Mobley, W. C.; Reichardt, L. F.: The extracellular domain of p75(NTR) is necessary to inhibit neurotrophin-3 signaling through TrkA. J. Biol. Chem. 276:11294-11301, 2001.

Rettig, W. J.; Thomson, T. M.; Spengler, B. A.; Biedler, J. L.; Old, L. J.: Assignment of human nerve growth factor receptor gene to chromosome 17 and regulation of receptor expression in somatic cell hybrids. Somat. Cell Molec. Genet. 12:441-447, 1986.

Tuffereau, C.; Benejean, J.; Blondel, D.; Kieffer, B.; Flamand, A.: Low-affinity nerve-growth factor receptor (p75NTR) can serve as a receptor for rabies virus. EMBO J. 17:7250-7259, 1998.

Welcher, A. A.; Bitler, C. M.; Radeke, M. J.; Shooter, E. M.:Nerve growth factor binding domain of the nerve growth factor receptor. Proc. Nat. Acad. Sci. 88:159-163, 1991.

Chuang, H.; Prescott, E. D.; Kong, H.; Shields, S.; Jordt, S.-E.; Basbaum, A. I.; Chao, M. V.; Julius, D.: Bradykinin and nerve growth factor release the capsaicin receptor from PtdIns (4,5)P2-mediated inhibition. Nature 411:957-962, 2001.

Jacobs, M. D.; Harrison, S. C.: Structure of an I-kappa-B-alpha/NF-kappa-Bcomplex. Cell 95:749-758, 1998.

Mitchell, E. L. D.; Jones, D.; White, G. R. M.; Varley, J. M.; Santibanez Koref, M. F.: Determination of the gene order of the three loci CD2, NGFB, and NRAS at human chromosome band 1p13 and refinement of their localisation at the subband level by fluorescence in situ hybridization. Cytogenet. Cell Genet. 70:183-185, 1995.

Munke, M.; Lindgren, V.; de Martinville, B.; Francke, U.: Comparative analysis of mouse-human hybrids with rearranged chromosomes 1 by in situ hybridization and Southern blotting: high-resolution mapping of NRAS, NGFB, and AMY on human chromosome 1. Somat. Cell Molec. Genet. 10:589-599, 1984.

Beauchemin, N.; Draber, P.; Dveksler, G.; Gold, P.; Gray-Owen, S.; Grunert, F.; Hammarstrom, S.; Holmes, K. V.; Karlsson, A.; Kuroki, M.; Lin, S.-H.; Lucka, L.; and 13 others: Redefined nomenclature for members of the carcinoembryonic antigen family. Exp. Cell Res. 252:243-249, 1999.

Inazawa, J.; Abe, T.; Inoue, K.; Misawa, S.; Oikawa, S.; Nakazato, H.; Yoshida, M. C.: Regional assignment of nonspecific cross-reacting antigen (NCA) of the CEA gene family to chromosome 19 at band q13.2. Cytogenet. Cell Genet. 52:28-31, 1989.

Willcocks, T. C.; Craig, S. P.; Craig, I. W.: Assignment of the coding sequence for carcinoembryonic antigen (CEA) and normal cross-reacting antigen (NCA) to human chromosome 19q13. Ann. Hum. Genet. 53:141-148,1989.

Qian, F.; Kruse, U.; Lichter, P.; Sippel, A. E.: Chromosomal localization of the four genes (NFIA, B, C, and X) for the human transcription factor nuclear factor I by FISH. Genomics 28:66-73, 1995.

Baeuerle, P. A.: I-kappa-B--NF-kappa-B structures: at the interface of inflammation control. Cell 95:729-731, 1998.

Huxford, T.; Huang, D.-B.; Malek, S.; Ghosh, G.: The crystal structure of the I-kappa-B-alpha/NF-kappa-B complex reveals mechanisms of NF-kappa-Binactivation. Cell 95:759-770, 1998.

Compton, D. A.; Szilak, I.; Cleveland, D. W.: Primary structure of NuMA, an intranuclear protein that defines a novel pathway for segregation of proteins at mitosis. J. Cell Biol. 116:1395-1408,1992.

Lydersen, B. K.; Pettijohn, D. E.: Human-specific nuclear protein that associates with the polar region of the mitotic apparatus: distribution in a human/hamster hybrid cell. Cell 22:489-499, 1980.

Merdes, A.; Ramyar, K.; Vechio, J. D.; Cleveland, D. W.: A complex of NuMA and cytoplasmic dynein is essential for mitotic spindle assembly. Cell 87:447-458, 1996.

Sparks, C. A.; Bangs, P. L.; McNeil, G. P.; Lawrence, J. B.; Fey, E. G.: Assignment of the nuclear mitotic apparatus protein NuMA gene to human chromosome 11q13. Genomics 17:222-224, 1993.

Wells, R. A.; Catzavelos, C.; Kamel-Reid, S.: Fusion of retinoic acid receptor alpha to NuMA, the nuclear mitotic apparatus protein, by a variant translocation in acute promyelocytic leukaemia. Nature Genet. 17:109-113, 1997.

Wiese, C.; Wilde, A.; Moore, M. S.; Adam, S. A.; Merdes, A.; Zheng, Y.: Role of importin-beta in coupling Ran to downstream targets in microtubule assembly. Science 291:653-656, 2001.

Yang, C. H.; Lambie, E. J.; Snyder, M.: NuMA: an unusually longcoiled-coil related protein in the mammalian nucleus. J. Cell Biol. 116:1303-1317, 1992.

Halila, R.; Apostolou, S.; Winqvist, R.; Callen, D.; Prockop, D. J.; Peltonen, L.: Isolation and genomic assignment of a candidate cDNA clone for type III procollagen N-proteinase. (Abstract) Am. J. Hum. Genet. 51 (suppl.): A128 only, 1992.

Halila, R.; Peltonen, L.; Prockop, D. J.: Isolation of a candidate cDNA clone for type III procollagen N-proteinase from human placental cDNA library. (Abstract) Am. J. Hum. Genet. 45 (suppl.): A192 only,1989.

Nomura, N.; Nagase, T.; Miyajima, N.; Sazuka, T.; Tanaka, A.; Sato, S.; Seki, N.; Kawarabayasi, Y.; Ishikawa, K.; Tabata, S.: Prediction of the coding sequences of unidentified human genes. II. The coding sequences of 40 new genes (KIAA0041-KIAA0080) deduced by analysis of cDNA clones from human cell line KG-1. DNA Res. 1:223-229, 1994.

Fuchs, S. Y.; Adler, V.; Buschmann, T.; Yin, Z.; Wu, X.; Jones, S. N.; Ronai, Z.: JNK targets p53 ubiquitination and degradation in nonstressed cells. Genes Dev. 12:2658-2663, 1998.

Balazs, I.: Personal Communication. New York, N.Y. Aug. 23, 1983.

Bezieau, S.; Devilder, M.-C.; Avet-Loiseau, H.; Mellerin, M.-P.; Puthier, D.; Pennarun, E.; Rapp, M.-J.; Harousseau, J.-L.; Moisan, J.-P.; Bataille, R.: High incidence of N and K-Ras activating mutations in multiple myeloma and primary plasma cell leukemia at diagnosis. Hum. Mutat. 18:212-224, 2001.

Bos, J. L.; Toksoz, D.; Marshall, C. J.; Verlaan-de Vries, M.; Veeneman, G. H.; van der Eb, A. J.; van Boom, J. H.; Janssen, J. W. G.; Steenvoorden, A. C. M.: Amino-acid substitutions at codon 13 of the N-ras oncogene in human acute myeloid leukaemia. Nature 315:726-730, 1985.

Davis, M.; Malcolm, S.; Hall, A.: The N-ras oncogene is located on the short arm of chromosome 1. (Abstract) Cytogenet. Cell Genet. 37:448-449, 1984.

Davis, M.; Malcolm, S.; Hall, A.; Marshall, C. J.: Localisation of the human N-ras oncogene to chromosome 1cen-p21 by in situ hybridisation. EMBO J. 2:2281-2283, 1983.

Deka, R.; Majumder, P. P.; Warren, A. C.; Surti, U.; Hoffner, L.; Hauselman, E.; Antonarakis, S. E.; Ferrell, R. E.; Chakravarti, A.: Gene-centromere mapping using ovarian teratomas: results from chromosomes 1p, 13q and 21q. (Abstract) Am. J. Hum. Genet. 45 (suppl.): A137only, 1989.

de Martinville, B.; Cunningham, J. M.; Murray, M. J.; Francke, U.: The N-ras oncogene assigned to chromosome 1 (p31-cen) by somatic cell hybrid analysis. (Abstract) Cytogenet. Cell Genet. 37:531 only, 1984.

Hall, A.; Brown, R.: Human N-ras: cDNA cloning and gene structure. Nucleic Acids Res. 13:5255-5268, 1985.

Hall, A.; Marshall, C. J.; Spurr, N. K.; Weiss, R. A.: Identification of transforming gene in two human sarcoma cell lines as a new member of the ras gene family located on chromosome 1. Nature 303:396-400,1983.

Linder, D.; McCaw, B. F.; Hecht, F.: Parthenogenic origin of benign ovarian teratomas. New Eng. J. Med. 292:63-66, 1975.

Nitta, N.; Ochiai, M.; Nagao, M.; Sugimura, T.: Amino-acid substitution at codon 13 of the N-ras oncogene in rectal cancer in a Japanese patient. Jpn. J. Cancer Res. 78:21-26, 1987.

Nobori, T.; Hexdall, L. E.; Carson, D. A.: A polymorphic region defined by pCN2 (the 3-prime nontranslated region of N-ras) maps to chromosome 9cen-p12. Hum. Genet. 87:433-437, 1991.

Parrington, J. M.; West, L. F.; Povey, S.: The origin of ovarian teratomas. J. Med. Genet. 21:4-12, 1984.

Popescu, N. C.; Amsbaugh, S. C.; DiPaolo, J. A.; Tronick, S. R.; Aaronson, S. A.; Swan, D. C.: Chromosomal localization of three human Ras genes by in situ molecular hybridization. Somat. Cell Molec. Genet. 11:149-155, 1985.

Povey, S.; Morton, N. E.; Sherman, S. L.: Report of the committee on the genetic constitution of chromosomes 1 and 2 (HGM8). Cytogenet. Cell Genet. 40:67-106, 1985.

Rabin, M.; Watson, M.; Barker, P.; Ryan, J.; Breg, W. R.; Ruddle, F. H.: Chromosomal assignment of human c-fos and N-ras oncogenes. (Abstract) Am. J. Hum. Genet. 35:148A only, 1983.

Rabin, M.; Watson, M.; Barker, P. E.; Ryan, J.; Breg, W. R.; Ruddle, F. H.: NRAS transforming gene maps to region p11-p13 on chromosome 1 by in situ hybridization. Cytogenet. Cell Genet. 38:70-72, 1984.

Ryan, J.; Barker, P. E.; Shimizu, K.; Wigler, M.; Ruddle, F. H.: Chromosomal assignment of a family of human oncogenes. Proc. Nat. Acad. Sci. 80:4460-4463, 1983.

Weber, G. F.; Ashkar, S.; Glimcher, M. J.; Cantor, H.: Receptor-ligand interaction between CD44 and osteopontin (Eta-1). Science 271:509-512,1996.

Zhao, C.; Takita, J.; Tanaka, Y.; Setou, M.; Nakagawa, T.; Takeda, S.; Yang, H. W.; Terada, S.; Nakata, T.; Takei, Y.; Saito, M.; Tsuji, S.; Hayashi, Y.; Hirokawa, N.: Charcot-Marie-Tooth disease type 2A caused by mutation in a microtubule motor KIF1B-beta. Cell 105:587-597, 2001.

Maemura, K.; Kurihara, H.; Kurihara, Y.; Oda, H.; Ishikawa, T.; Copeland, N. G.; Gilbert, D. J.; Jenkins, N. A.; Yazaki, Y.: Sequence analysis, chromosomal location, and developmental expression of the mouse preproendothelin-1 gene. Genomics 31:177-184, 1996.

Maggi, M.; Barni, T.; Fantoni, G.; Mancina, R.; Pupilli, C.; Luconi, M.; Crescioli, C.; Serio, M.; Vannelli, G. B.: Expression and biological effects of endothelin-1 in human gonadotropin-releasing hormone-secreting neurons. J. Clin. Endocr. Metab. 85:1658-1665, 2000.

Napolitano, M.; Miceli, F.; Calce, A.; Vacca, A.; Gulino, A.; Apa, R.; Lanzone, A.: Expression and relationship between endothelin-1messenger ribonucleic acid (mRNA) and inducible/endothelial nitric oxide synthase mRNA isoforms from normal and preeclamptic placentas. J. Clin. Endocr. Metab. 85:2318-2323, 2000.

Okafor, M. C.; Delamere, N. A.: The inhibitory influence of endothelin on active sodium-potassium transport in porcine lens. Invest. Ophthal. Vis. Sci. 42:1018-1023, 2001.

Pache, M.; Kaiser, H. J.; Haufschild, T.; Lubeck, P.; Flammer, J.: Increased endothelin-1 plasma levels in giant cell arteritis:a report on four patients. Am. J. Ophthal. 133:160-162, 2002.

Pages, J.-C.; Drieu, C.; Blanche, H.; Beckmann, J.; Cann, H. M.: A short tandem repeat polymorphism at the endothelin 1 (EDN1) locus. Hum. Molec. Genet. 2:90, 1993.

Pezzetti, F.; Scapoli, L.; Martinelli, M.; Carinci, F.; Brunelli, G.; Carls, F. P.; Palomba, F.; Gombos, F.; Carinci, P.; Tognon, M.: Linkage analysis of candidate endothelin pathway genes in nonsyndromic familial orofacial cleft. Ann. Hum. Genet. 64:341-347, 2000.

Yanagisawa, H.; Hammer, R. E.; Richardson, J. A.; Williams, S. C.; Clouthier, D. E.; Yanagisawa, M.: Role of endothelin-1/endothelin-Areceptor-mediated signaling pathway in the aortic arch patterning in mice. J. Clin. Invest. 102:22-33, 1998.

Yanagisawa, H.; Yanagisawa, M.; Kapur, R. P.; Richardson, J. A.; Williams, S. C.; Clouthier, D. E.; de Wit, D.; Emoto, N.; Hammer, R. E.: Dual genetic pathways of endothelin-mediated intercellular signaling revealed by targeted disruption of endothelin converting enzyme-1 gene. Development 125:825-836, 1998.

Zeidel, M. L.; Brady, H. R.; Kone, B. C.; Gullans, S. R.; Brenner, B. M.: Endothelin, a peptide inhibitor of Na (+)-K (+)-ATPase in intact renal tubular epithelial cells. Am. J. Physiol. 257: C1101-C1107,1989.

Bloch, K. D.; Hong, C. C.; Eddy, R. L.; Shows, T. B.; Quertermous, T.: cDNA cloning and chromosomal assignment of the endothelin 2 gene:vasoactive intestinal contractor peptide is rat endothelin 2. Genomics 10:236-242, 1991.

Deng, A. Y.; Dene, H.; Pravenec, M.; Rapp, J. P.: Genetic mapping of two new blood pressure quantitative trait loci in the rat by genotyping endothelin system genes. J. Clin. Invest. 93:2701-2709, 1994.

Ohkubo, S.; Ogi, K.; Hosoya, M.; Matsumoto, H.; Suzuki, N.; Kimura, C.; Onda, H.; Fujino, M.: Specific expression of human endothelin-2(ET-2) gene in a renal adenocarcinoma cell line: molecular cloning of cDNA encoding the precursor of ET-2 and its characterization. FEBSLett. 274:136-140, 1990.

Baynash, A. G.; Hosoda, K.; Giaid, A.; Richardson, J. A.; Emoto, N.; Hammer, R. E.; Yanagisawa, M.: Interaction of endothelin-3 with endothelin-B receptor is essential for development of epidermal melanocytes and enteric neurons. Cell 79:1277-1285, 1994.

Gros, P.; Croop, J.; Housman, D.: Mammalian multidrug resistance gene: complete cDNA sequence indicates strong homology to bacterial transport proteins. Cell 47:371-380, 1986.

Gros, P.; Neriah, Y. B.; Croop, J. M.; Housman, D. E.: Isolation and expression of a complementary DNA that confers multidrug resistance. Nature 323:728-731, 1986.

Lerman, C.; Caporaso, N. E.; Audrain, J.; Main, D.; Bowman, E. D.; Lockshin, B.; Boyd, N. R.; Shields, P. G.: Evidence suggesting the role of specific genetic factors in cigarette smoking. HealthPsych. 18:14-20, 1999.

Lossie, A. C.; Vandenbergh, D. J.; Uhl, G. R.; Camper, S. A.:Localization of the dopamine transporter gene, Dat1, on mouse chromosome Mammalian Genome 5:117-118, 1994.13. Sabol, S. Z.; Nelson, M. L.; Fisher, C.; Gunzerath, L.; Brody, C. L.; Hu, S.; Sirota, L. A.; Marcus, S. E.; Greenberg, B. D.; Lucas, F. R., IV; Benjamin, J.; Murphy, D. L.; Hamer, D. H.: A genetic association for cigarette smoking behavior. Health Psych. 18:7-13, 1999.

Tiihonen, J.; Kuikka, J.; Bergstrom, K.; Hakola, P.; Karhu, J.; Ryynanen, O.-P.; Fohr, J.: Altered striatal dopamine reuptake site densities in habitually violent and non-violent alcoholics. NatureMed. 1:654-657, 1995.

Vandenbergh, D. J.; Persico, A. M.; Hawkins, A. L.; Griffin, C. A.; Li, X.; Jabs, E. W.; Uhl, G. R.: Human dopamine transporter gene (DAT1) maps to chromosome 5p15.3 and displays a VNTR. Genomics 14:1104-1106, 1992.

Vandenbergh, D. J.; Persico, A. M.; Uhl, G. R.: A human dopamine transporter cDNA predicts reduced glycosylation, displays a novel repetitive element and provides racially-dimorphic TaqI RFLPs. Molec. Brain Res. 15:161-166, 1992.

Waldman, I. D.; Rowe, D. C.; Abramowitz, A.; Kozel, S. T.; Mohr, J. H.; Sherman, S. L.; Cleveland, H. H.; Sanders, M. L.; Gard, J. M. C.; Stever, C.: Association and linkage of the dopamine transporter gene and attention-deficit hyperactivity disorder in children: heterogeneity owing to diagnostic subtype and severity. Am. J. Hum. Genet. 63:1767-1776, 1998.

von Boehmer, H.; Sarukhan, A.: GAD, a single autoantigen for diabetes. Science 284:1135-1136, 1999.

Williamson, E. A.; Ince, P. G.; Harrison, D.; Kendall-Taylor, P.; Harris, P. E.: G-protein mutations in human pituitary adrenocorticotrophic hormone-secreting adenomas. Europ. J. Clin. Invest. 25:128-131,1995.

Marsden, V. S.; O'Connor, L.; O'Reilly, L. A.; Silke, J.; Metcalf, D.; Ekert, P. G.; Huang, D. C. S.; Cecconi, F.; Kuida, K.; Tomaselli, K. J.; Roy, S.; Nicholson, D. W.; Vaux, D. L.; Bouillet, P.; Adams, J. M.; Strasser, A.: Apoptosis initiated by Bcl-2-regulated caspase activation independently of the cytochrome c/Apaf-1/caspase-9 apoptosome. Nature 419:634-637, 2002.

Korinek, V.; Barker, N.; Morin, P. J.; van Wichen, D.; de Weger, R.; Kinzler, K. W.; Vogelstein, B.; Clevers, H.: Constitutive transcriptional activation by a beta-catenin-Tcf complex in APC-/- colon carcinoma. Science 275:1784-1787, 1997.

Morin, P. J.; Sparks, A. B.; Korinek, V.; Barker, N.; Clevers, H.; Vogelstein, B.; Kinzler, K. W.: Activation of beta-catenin-Tcf signaling in colon cancer by mutations in beta-catenin or APC. Science 275:1787-1790, 1997.

Rodova, M.; Islam, M. R.; Maser, R. L.; Calvet, J. P.: The polycystic kidney disease-1 promoter is a target of the beta-catenin/T-cell factor pathway. J. Biol. Chem. 277:29577-29583, 2002.

Geck, P.; Sonnenschein, C.; Soto, A. M.: The D13S171 marker, misannotated to BRCA2, links the AS3 gene to various cancers. (Letter) Am. J. Hum. Genet. 69:461-463, 2001.

Geck, P.; Szelei, J.; Jimenez, J.; Sonnenschein, C.; Soto, A. M.: Early gene expression during androgen-induced inhibition of proliferation of prostate cancer cells: a new suppressor candidate on chromosome 13, in the BRCA2-Rb1 locus. J. Steroid Biochem. Molec. Biol. 68:41-50, 1999.

Bontekoe, C. J. M.; McIlwain, K. L.; Nieuwenhuizen, I. M.; Yuva-Paylor, L. A.; Nellis, A.; Willemsen, R.; Fang, Z.; Kirkpatrick, L.; Bakker, C. E.; McAninch, R.; Cheng, N. C.; Merriweather, M.; Hoogeveen, A. T.; Nelson, D.; Paylor, R.;

Oostra, B. A.: Knockout mouse model for Fxr2: a model for mental retardation. Hum. Molec. Genet. 11:487-498,2002.

Tamanini, F.; Willemsen, R.; van Unen, L.; Bontekoe, C.; Galjaard, H.; Oostra, B. A.; Hoogeveen, A. T.: Differential expression of FMR1, FXR1 and FXR2 proteins in human brain and testis. Hum. Molec. Genet. 6:1315-1322, 1997.

Zhang, Y.; O'Connor, J. P.; Siomi, M. C.; Srinivasan, S.; Dutra, A.; Nussbaum, R. L.; Dreyfuss, G.: The fragile X mental retardation syndrome protein interacts with novel homologs FXR1 and FXR2. EMBO J. 14:5358-5366, 1995.

Lee, J. K.; Bhakta, S.; Rosen, S. D.; Hemmerich, S.: Cloning and characterization of a mammalian N-acetylglucosamine-6-sulfotransferase that is highly restricted to intestinal tissue. Biochem. Biophys. Res. Commun. 263:543-549, 1999.

Raymond, C. S.; Parker, E. D.; Kettlewell, J. R.; Brown, L. G.; Page, D. C.; Kusz, K.; Jaruzelska, J.; Reinberg, Y.; Fletjer, W. L.; Bardwell, V. J.; Hirsch, B.; Zarkower, D.: A region of human chromosome 9p required for testis development contains two genes related to known sexual regulators. Hum. Molec. Genet. 8:989-996, 1999.

Matsumoto, N.; Laub, F.; Aldabe, R.; Zhang, W.; Ramirez, F.; Yoshida, T.; Terada, M.: Cloning the cDNA for a new human zinc finger protein defines a group of closely related Kruppel-like transcription factors. J. Biol. Chem. 273:28229-28237, 1998.

Okazaki, I.; Kinoshita, K.; Muramatsu, M.; Yoshikawa, K.; Honjo, T.: The AID enzyme induces class switch recombination in fibroblasts. Nature 416:340-345, 2002.

Petersen-Mahrt, S. K.; Harris, R. S.; Neuberger, M. S.: AID mutates E. coli suggesting a DNA deamination mechanism for antibody diversification. Nature 418:99-104, 2002.

Revy, P.; Muto, T.; Levy, Y.; Geissmann, F.; Plebani, A.; Sanal, O.; Catalan, N.; Forveille, M.; Dufourcq-Lagelouse, R.; Gennery, A.; Tezcan, I.; Ersoy, F.; and 9 others: Activation-induced cytidinedeaminase (AID) deficiency causes the autosomal recessive form of the hyper-IgM syndrome (HIGM2). Cell 102:565-575, 2000.

Yoshikawa, K.; Okazaki, I.; Eto, T.; Kinoshita, K.; Muramatsu, M.; Nagaoka, H.; Honjo, T.: AID enzyme-induced hypermutation in an actively transcribed gene in fibroblasts. Science 296:2033-2036,2002.

Kokame, K.; Kato, H.; Miyata, T.: Homocysteine-respondent genes in vascular endothelial cells identified by differential display analysis:GRP78/BiP and novel genes. J. Biol. Chem. 271:29659-29665, 1996.

Park, H,; Adams, M. A.; Lachat, P.; Bosman, F.; Pang, S. C.; Graham, C. H.: Hypoxia induces the expression of a 43-kDa protein (PROXY-1) in normal and malignant cells. Biochem. Biophys. Res. Commun. 276:321-328, 2000.

Shimono, A.; Okuda, T.; Kondoh, H.: N-myc-dependent repression of Ndr1, a gene identified by direct subtraction of whole mouse embryo cDNAs between wild type and N-myc mutant. Mech. Dev. 83:39-52,1999.

van Belzen, N.; Dinjens, W. N. M.; Diesveld, M. P. G.; Groen, N. A.; van der Made, A. C. J.; Nozawa, Y.; Vliestra, R.; Trapman, J.; Bosman, F. T.: A novel gene which is up-regulated during colon epithelial cell differentiation and down-regulated in colorectal neoplasms. Lab. Invest. 77:85-92, 1997.

Zhou, D.; Salnikow, K.; Costa, M.: Cap43, a novel gene specifically induced by Ni2+ compounds. Cancer Res. 58:2182-2189, 1998.

Tamari, M.; Daigo, Y.; Nakamura, Y.: Isolation and characterization of a novel serine threonine kinase gene on chromosome 3q22-21.3. J. Hum. Genet. 44:116-120, 1999.

Tamari, M.; Daigo, Y.; Ishikawa, S.; Nakamura, Y.: Genomic structure of a novel human gene (XYLB) on chromosome 3p22-p21.3 encoding a xylulokinase-like protein. Cytogenet. Cell Genet. 82:101-104, 1998.

Migone, T.-S.; Zhang, J.; Luo, X.; Zhuang, L.; Chen, C.; Hu, B.; Hong, J. S.; Perry, J. W.; Chen, S.-F.; Zhou, J. X. H.; Cho, Y. H.; Ullrich, S.; and 14 others: TL1A is a TNF-like ligand for DR3 and TR6/DcR3 and functions as a T cell costimulator. Immunity 16:479-492,2002.

Zhai, Y.; Ni, J.; Jiang, G.-W.; Lu, J.; Xing, L.; Lincoln, C.; Carter, K. C.; Janat, F.; Kozak, D.; Xu, S.; Rojas, L.; Aggarwal, B. B.; Ruben, S.; Li, L.-Y.; Gentz, R.; Yu, G.-L.: VEGI, a novel cytokine of the tumor necrosis factor family, is an angiogenesis inhibitor that suppresses the growth of colon carcinomas in vivo. FASEB J. 13:181-189, 1999.

Yue, T.-L.; Ni, J.; Romanic, A. M.; Gu, J.-L.; Keller, P.; Wang, C.; Kumar, S.; Yu, G.; Hart, T. K.; Wang, X.; Xia, Z.; DeWolf, W. E., Jr.; Feuerstein, G. Z.: TL1, a novel tumor necrosis factor-like cytokine, induces apoptosis in endothelial cells: involvement of activation of stress protein kinases (stress-activated protein kinase and p38 mitogen-activated protein kinase) and caspase-3-like protease. J. Biol. Chem. 274:1479-1486, 1999.

Gu, Z.; Flemington, C.; Chittenden, T.; Zambetti, G. P.: Ei24, a p53 response gene involved in growth suppression and apoptosis. Molec. Cell. Biol. 20:233-241, 2000.

Gu, Z.; Gilbert, D. J.; Valentine, V. A.; Jenkins, N. A.; Copeland, N. G.; Zambetti, G. P.: The p53-inducible gene EI24/PIG8 localizes to human chromosome 11q23 and the proximal region of mouse chromosome 9. Cytogenet. Cell Genet. 89:230-233, 2000.

Polyak, K.; Xia, Y.; Zweier, J. L.; Kinzler, K. W.; Vogelstein, B.: A model for p53-induced apoptosis. Nature 389:300-305, 1997.

Contente, A.; Dittmer, A.; Koch, M. C.; Roth, J.; Dobbelstein, M.: A polymorphic microsatellite that mediates induction of PIG3 by p53. Nature Genet. 30:315-320, 2002.

Hernandez, M.-C.; Andres-Barquin, P. J.; Holt, I.; Israel, M. A.: Cloning of human ENC-1 and evaluation of its expression and regulation in nervous system tumors. Exp. Cell Res. 242:470-477, 1998.

Hernandez, M.-C.; Andres-Barquin, P. J.; Israel, M. A.: Assignment of the ectodermal-neural cortex 1 gene (Enc1) to mouse chromosome band 13D1 by fluorescence in situ hybridization. Cytogenet. Cell Genet. 89:158-159, 2000.

Hernandez, M.-C.; Andres-Barquin, P. J.; Kuo, W. L.; Israel, M. A.: Assignment of the ectodermal-neural cortex 1 gene (ENC1) to human chromosome band 5q13 by in situ hybridization. Cytogenet. Cell Genet. 87:89-90, 1999.

Kim, T.-A.; Lim, J.; Ota, S.; Raja, S.; Rogers, R.; Rivnay, B.; Avraham, H.; Avraham, S.: NRP/B, a novel nuclear matrix protein, associates with p110 (RB) and is involved in neuronal differentiation. J. Cell Biol. 141:553-566, 1998.

Christopoulos, G.; Perry, K. J.; Morfis, M.; Tilakaratne, N.; Gao, Y.; Fraser, N. J.; Main, M. J.; Foord, S. M.; Sexton, P. M.: Multiple amylin receptors arise from receptor activity-modifying protein interaction with the calcitonin receptor gene product. Molec. Pharm. 56:235-242,1999.

de Vernejoul, M.-C.: Personal Communication. Paris, France Jan. 19, 1999.

Gorn, A. H.; Lin, H. Y.; Yamin, M.; Auron, P. E.; Flannery, M. R.; Tapp, D. R.; Manning, C. A.; Lodish, H. F.; Krane, S. M.; Goldring, S. R.: Cloning, characterization, and expression of a human calcitonin receptor from an ovarian carcinoma cell line. J. Clin. Invest. 90:1726-1735, 1992.

Akira, S.; Nishio, Y.; Inoue, M.; Wang, X.-J.; Wei, S.; Matsusaka, T.; Yoshida, K.; Sudo, T.; Naruto, M.; Kishimoto, T.: Molecular cloning of APRF, a novel IFN-stimulated gene factor 3 p91-related transcription factor involved in the gp130-mediated signaling pathway. Cell 77:63-71, 1994.

Bromberg, J. F.; Wrzeszczynska, M. H.; Devgan, G.; Zhao, Y.; Pestell, R. G.; Albanese, C.; Darnell, J. E., Jr.: Stat3 as an oncogene. Cell 98:295-303, 1999.

Caldenhoven, E.; van Dijk, T. B.; Solari, R.; Armstrong, J.; Raaijmakers, J. A. M.; Lammers, J.-W. J.; Koenderman, L.; de Groot, R. P.: STAT3-beta, a splice variant of transcription factor STAT3, is a dominant negative regulator of transcription. J. Biol. Chem. 271:13221-13227, 1996.

Choi, J. Y.; Li, W. L.; Kouri, R. E.; Yu, J.; Kao, F. T.; Ruano, G.: Assignment of the acute phase response factor (APRF) gene to 17q21 by microdissection clone sequencing and fluorescence in situ hybridization of a p1 clone. Genomics 37:264-265, 1996.

Chung, C. D.; Liao, J.; Liu, B.; Rao, X.; Jay, P.; Berta, P.; Shuai, K.: Specific inhibition of Stat3 signal transduction by PIAS3. Science 278:1803-1805, 1997.

Lutticken, C.; Wegenka, U. M.; Yuan, J.; Buschmann, J.; Schindler, C.; Ziemiecki, A.; Harpur, A. G.; Wilks, A. F.; Yasukawa, K.; Taga, T.; Kishimoto, T.; Barbieri, G.; Pellegrini, S.; Sendtner, M.; Heinrich, P. C.; Horn, F.: Association of transcription factor APRF and protein kinase Jak1 with the interleukin-6 signal transducer gp130. Science 263:89-92, 1994.

Pfeffer, L. M.; Mullersman, J. E.; Pfeffer, S. R.; Murti, A.; Shi, W.; Yang, C. H.: STAT3 as an adapter to couple phosphatidylinositol3-kinase to the IFNAR1 chain of the type I interferon receptor. Science 276:1418-1420, 1997.

Yoo, J.-Y.; Huso, D. L.; Nathans, D.; Desiderio, S.: Specific ablation of Stat3-beta distorts the pattern of Stat3-responsive gene expression and impairs recovery from endotoxic shock. Cell 108:331-344, 2002.

Abbott, C. A.; Baker, E.; Sutherland, G. R.; McCaughan, G. W.: Genomic organization, exact localization, and tissue expression of the human CD26 (dipeptidyl peptidase IV) gene. Immunogenetics 40:331-338, 1994.

Callebaut, C.; Krust, B.; Jacotot, E.; Hovanessian, A. G.: T cell activation antigen, CD26, as a cofactor for entry of HIV in CD4+ cells. Science 262:2045-2050, 1993.

Darmoul, D.; Lacasa, M.; Chantret, I.; Swallow, D. M.; Trugnan, G.: Isolation of a cDNA probe for the human intestinal dipeptidylpeptidase IV and assignment of the gene locus DPP4 to chromosome 2. Ann. Hum. Genet. 54:191-197, 1990.

Herbschleb-Voogt, E.; Grzeschik, K.-H.; Pearson, P. L.; Meera Khan, P.: Assignment of adenosine deaminase complexing protein (ADCP) gene(s) to human chromosome 2 in rodent-human somatic cell hybrids. Hum. Genet. 59:317-323, 1981.

Kameoka, J.; Tanaka, T.; Nojima, Y.; Schlossman, S. F.; Morimoto, C.: Direct association of adenosine deaminase with a T cell activation antigen, CD26. Science 261:466-469, 1993.

Koch, G. A.; Shows, T. B.: Genes on human chromosomes 2 and 6 are required for expression of the adenosine deaminase complexing protein (ADCP) in human-mouse somatic cell hybrids. (Abstract) Cytogenet. Cell Genet. 25:174, 1979.

Marguet, D.; Baggio, L.; Kobayashi, T.; Bernard, A.-M.; Pierres, M.; Nielsen, P. F.; Ribel, U.; Watanabe, T.; Drucker, D. J.; Wagtmann, N.: Enhanced insulin secretion and improved glucose tolerance in mice lacking CD26. Proc. Nat. Acad. Sci. 97:6874-6879, 2000.

Mathew, S.; Morrison, M. E.; Murty, V. V. V. S.; Houghton, A. N.; Chaganti, R. S. K.: Assignment of the DPP4 gene encoding adenosine deaminase binding protein (CD26/ dipeptidylpeptidase IV) to 2q23. Genomics 22:211-212, 1994.

Misumi, Y.; Hayashi, Y.; Arakawa, F.; Ikehara, Y.: molecular cloning and sequence analysis of human dipeptidyl peptidase IV, aserine proteinase on the cell surface. Biochim. Biophys. Acta 1131:333-336, 1992.

Morrison, M. E.; Vijayasaradhi, S.; Engelstein, D.; Albino, A. P.; Houghton, A. N.: A marker for neoplastic progression of human melanocytes is a cell surface ectopeptidase. J. Exp. Med. 117:1135-1143,1993.

Van Cong, N.; Weil, D.; Gross, M.-S.; Foubert, C.; Jami, J.; Frezal, J.: Controle genetique et epigenetique de l'expression de l'adenosine deaminase. Analyse des cellules humaines et hybrides homme-rongeur. Ann. Genet. 24:141-147, 1981.

Bundey, S.: Recent views on genetic factors in retinoblastoma.(Abstract) J. Med. Genet. 17:386-387, 1980.

Bundey, S.; Morten, J. E. N.: An unusual pedigree with retinoblastoma. Does it shed light on the delayed mutation and host resistance theories? Hum. Genet. 59:434-436, 1981.

Cance, W. G.; Brennan, M. F.; Dudas, M. E.; Huang, C.-M.; Cordon-Cardo, C.: Altered expression of the retinoblastoma gene product in human sarcomas. New Eng. J. Med. 323:1457-1462, 1990.

Canning, S.; Dryja, T. P.: Short, direct repeats at the breakpoints of deletions of the retinoblastoma gene. Proc. Nat. Acad. Sci. 86:5044-5048, 1989.

Carlson, E. A.; Desnick, R. J.: Mutational mosaicism and genetic counseling in retinoblastoma. Am. J. Med. Genet. 4:365-381, 1979.

Cavenee, W. K.: The genetic basis of neoplasia: the retinoblastoma paradigm. Trends Genet. 2:299-300, 1986.

Cavenee, W. K.; Dryja, T. P.; Phillips, R. A.; Benedict, W. F.; Godbout, R.; Gallie, B. L.; Murphree, A. L.; Strong, L. C.; White, R. L.: Expression of recessive alleles by chromosomal mechanisms in retinoblastoma. Nature 305:779-784, 1983.

Cavenee, W. K.; Hansen, M. F.; Nordenskjold, M.; Kock, E.; Maumenee, I.; Squire, J. A.; Phillips, R. A.; Gallie, B. L.: Genetic origin of mutations predisposing to retinoblastoma. Science 228:501-503,1985.

Cavenee, W. K.; Murphree, A. L.; Shull, M. M.; Benedict, W. F.; Sparkes, R. S.; Kock, E.; Nordenskjold, M.: Prediction of familial predisposition to retinoblastoma. New Eng. J. Med. 314:1201-1207,1986.

Chano, T.; Ikegawa, S.; Kontani, K.; Okabe, H.; Baldini, N.; Saeki, Y.: Identification of RB1CC1, a novel human gene that can induce RB1 in various human cells. Oncogene 21:1295-1298, 2002.

Chauveinc, L.; Mosseri, V.; Quintana, E.; Desjardins, L.; Schlienger, P.; Doz, F.; Dutrillaux, B.: Osteosarcoma following retinoblastoma:age at onset and latency period. Ophthalmic Genet. 22:77-88, 2001.

Chen, P.-L.; Scully, P.; Shew, J.-Y.; Wang, J. Y. J.; Lee, W.-H.: Phosphorylation of the retinoblastoma gene product is modulated during the cell cycle and cellular differentiation. Cell 58:1193-1198,1989.

Connolly, M. J.; Payne, R. H.; Johnson, G.; Gallie, B. L.; Allderdice, P. W.; Marshall, W. H.; Lawton, R. D.: Familial, EsD-linked, retinoblastoma with reduced penetrance and variable expressivity. Hum. Genet. 65:122-124, 1983.

Cowell, J. K.; Bia, B.: A novel missense mutation in patients from a retinoblastoma pedigree showing only mild expression of the tumor phenotype. Oncogene 16:3211-3213, 1998.

Cowell, J. K.; Rutland, P.; Hungerford, J.; Jay, M.: Deletion of chromosome region 13q14 is transmissible and does not always predispose to retinoblastoma. Hum. Genet. 80:43-45, 1988.

Cowell, J. K.; Rutland, P.; Jay, M.; Hungerford, J.: Deletions of the esterase D locus from a survey of 200 retinoblastoma patients. Hum. Genet. 72:164-167, 1986.

Cowell, J. K.; Smith, T.; Bia, B.: Frequent constitutional C to T mutations in CGA-arginine codons in the RB1 gene produce premature stop codons in patients with bilateral (hereditary) retinoblastoma. Europ. J. Hum. Genet. 2:281-290, 1994.

Dahiya, A.; Wong, S.; Gonzalo, S.; Gavin, M.; Dean, D. C.: Linking the Rb and Polycomb pathways. Molec. Cell 8:557-568, 2001.

Davison, E. V.; Gibbons, B.; Aherne, G. E. S.; Roberts, D. F.: Chromosomes in retinoblastoma patients. Clin. Genet. 15:505-508, 1979.

DeCaprio, J. A.; Ludlow, J. W.; Lynch, D.; Furukawa, Y.; Griffin, J.; Piwnica-Worms, H.; Huang, C.-M.; Livingston, D. M.: The product of the retinoblastoma susceptibility gene has properties of a cell cycle regulatory element. Cell 58:1085-1095, 1989.

de Grouchy, J.; Turleau, C.; Cabanis, M. O.; Richardet, J. M.: Retinoblastome et deletion intercalaire du chromosome 13. Arch. Franc. Pediat. 37:531-535, 1980.

Dryja, T.; Cavenee, W.; Epstein, J.; Rapaport, J.; Goorin, A.; Koufos, A.: Chromosome 13 homozygosity in osteogenic sarcoma without retinoblastoma. (Abstract) Am. J. Hum. Genet. 36:28S, 1984.

Dryja, T. P.; Bruns, G. A. P.; Gallie, B.; Petersen, R.; Green, W.; Rapaport, J. M.; Albert, D. M.; Gerald, P. S.: Low incidence of deletion of the esterase D locus in retinoblastoma patients. Hum. Genet. 64:151-155, 1983.

Dryja, T. P.; Cavenee, W.; White, R.; Rapaport, J. M.; Petersen, R.; Albert, D. M.; Bruns, G. A. P.: Homozygosity of chromosome 13 in retinoblastoma. New Eng. J. Med. 310:550-553, 1984.

Dryja, T. P.; Friend, S.; Weinberg, R. A.: Isolation of a cDNA fragment derived from human retina mRNA which detects a locus within 13q14 often deleted in retinoblastomas. (Abstract) Am. J. Hum. Genet. 39:A29, 1986.

Dryja, T. P.; Mukai, S.; Petersen, R.; Rapaport, J. M.; Walton, D.; Yandell, D. W.: Parental origin of mutations of the retinoblastoma gene. Nature 339:556-558, 1989.

Dryja, T. P.; Mukai, S.; Rapaport, J. M.; Yandell, D. W.: Parental origin of mutations of the retinoblastoma gene. (Abstract) Am. J. Hum. Genet. 45 (suppl.): A19, 1989.

Van Cong, N.; Moreau-Gachelin, F.; Ray, D.; Gross, M. S.; de Tand, M. F.; Tavitian, A.; Frezal, J.: Assignment of SPI1 oncogene to chromosome 11 (somatic cell hybrid analysis), region p11.22 (in situ hybridization). (Abstract) Cytogenet. Cell Genet. 51:1097 only, 1989.

Fletcher, C. F.; Okano, H. J.; Gilbert, D. J.; Yang, Y.; Yang, C.; Copeland, N. G.; Jenkins, N. A.; Darnell, R. B.: Mouse chromosomal locations of nine genes encoding homologs of human paraneoplastic neurologic disorder antigens. Genomics 45:313-319, 1997.

Clinton, M.; Frangou-Lazaridis, M.; Panneerselvam, C.; Horecker, B. L.: The sequence of human parathymosin deduced from a cloned human kidney cDNA. Biochem. Biophys. Res. Commun. 158:855-862, 1989.

Szabo, P.; Clinton, M.; Macera, M.; Horecker, B. L.: Localization of the gene coding for parathymosin to chromosome 17 in human S. Cytogenet. Cell Genet. 50:91-92, 1989.

Arnold, A.; Kim, H. G.; Gaz, R. D.; Eddy, R. L.; Fukushima, Y.; Byers, M. G.; Shows, T. B.; Kronenberg, H. M.: Molecular cloning and chromosomal mapping of DNA rearranged with the parathyroid hormone gene in a parathyroid adenoma. J. Clin. Invest. 83:2034-2040, 1989.

Anderson, D. M.; Maraskovsky, E.; Billingsley, W. L.; Dougall, W. C.; Tometsko, M. E.; Roux, E. R.; Teepe, M. C.; DuBose, R. F.; Cosman, D.; Galibert, L.: A homologue of the TNF receptor and its ligand enhance T-cell growth and dendritic-cell function. Nature 390:175-179, 1997.

Croucher, P. I.; Shipman, C. M.; Lippitt, J.; Perry, M.; Asosingh, K.; Hijzen, A.; Brabbs, A. C.; van Beek, E. J. R.; Holen, I.; Skerry, T. M.; Dunstan, C. R.; Russell, G. R.; Van Camp, B.; Vanderkerken, K.: Osteoprotegerin inhibits the development of osteolytic bone disease in multiple myeloma. Blood 98:3534-3540, 2001.

Fata, J. E.; Kong, Y.-Y.; Li, J.; Sasaki, T.; Irie-Sasaki, J.; Moorehead, R. A.; Elliott, R.; Scully, S.; Voura, E. B.; Lacey, D. L.; Boyle, W. J.; Khokha, R.; Penninger, J. M.: The osteoclast differentiation factor osteoprotegerin-ligand is essential for mammary gland development. Cell 103:41-50, 2000.

Kim, N.; Odgren, P. R.; Kim, D.-K.; Marks, S. C., Jr.; Choi, Y.: Diverse roles of the tumor necrosis factor family member TRANCE in skeletal physiology revealed by TRANCE deficiency and partial rescue by a lymphocyte-expressed TRANCE transgene. Proc. Nat. Acad. Sci. 97:10905-10910, 2000.

Kong, Y.-Y.; Feige, U.; Sarosi, I.; Bolon, B.; Tafuri, A.; Morony, S.; Capparelli, C.; Li, J.; Elliott, R.; McCabe, S.; Wong, T.; Campagnuolo, G.; and 9 others: Activated T cells regulate bone loss and joint destruction in adjuvant arthritis through osteoprotegerin ligand. Nature 402:304-309, 1999.

Lacey, D. L.; Timms, E.; Tan, H.-L.; Kelley, M. J.; Dunstan, C. R.; Burgess, T.; Elliott, R.; Colombero, A.; Elliott, G.; Scully, S.; Hsu, H.; Sullivan, J.; Hawkins, N.; Davy, E.; Capparelli, C.; Eli, A.; Qian, Y.-X.; Kaufman, S.; Sarosi, I.; Shalhoub, V.; Senaldi, G.; Guo, J.; Delaney, J.; Boyle, W. J.: Osteoprotegerin ligand is a cytokine that regulates osteoclast differentiation and activation. Cell 93:165-176, 1998.

Pearse, R. N.; Sordillo, E. M.; Yaccoby, S.; Wong, B. R.; Liau, D. F.; Colman, N.; Michaeli, J.; Epstein, J.; Choi, Y.: Multiple myeloma disrupts the TRANCE/osteoprotegerin cytokine axis to trigger bone destruction and promote tumor progression. Proc. Nat. Acad. Sci. 98:11581-11586, 2001.

Wong, B. R.; Rho, J.; Arron, J.; Robinson, E.; Orlinick, J.; Chao, M.; Kalachikov, S.; Cayani, E.; Bartlett, F. S., III; Frankel, W. N.; Lee, S. Y.; Choi, Y.: TRANCE is a novel ligand of the tumor necrosis factor receptor family that activates c-Jun N-terminal kinase in T cells. J. Biol. Chem. 272:25190-25194, 1997.

Udell, C. M.; Lee, S. K.; Davey, S.: HRAD1 and MRAD1 encode mammalian homologues of the fission yeast rad1+ cell cycle checkpoint control gene. Nucleic Acids Res. 26:3971-3976, 1998.

Carvajal, J. J.; Pook, M. A.; dos Santos, M.; Doudney, K.; Hillermann, R.; Minogue, S.; Williamson, R.; Hsuan, J. J.; Chamberlain, S.: The Friedreich's ataxia gene encodes a novel phosphatidylinositol-4-phosphate 5-kinase. Nature Genet. 14:157-162, 1996.

Carvajal, J. J.; Pook, M. A.; Doudney, K.; Hillermann, R.; Wilkes, D.; Al-Mahdawi, S.; Williamson, R.; Chamberlain, S.: Friedreich's ataxia: a defect in signal transduction? Hum. Molec. Genet. 4:1411-1419, 1995.

Pook, M. A.; Carvajal, J. J; Doudney, K.; Hillermann, R.; Chamberlain, S.: Exon-intron structure of a 2.7-kb transcript of the STM7 gene with phosphatidylinositol-4-phosphate 5-kinase activity. Genomics 42:170-172, 1997.

Carfi, A.; Willis, S. H.; Whitbeck, J. C.; Krummenacher, C.; Cohen, G. H.; Eisenberg, R. J.; Wiley, D. C.: Herpes simplex virus glycoprotein D bound to the human receptor HveA. Molec. Cell 8:169-179, 2001.

Hsu, H.; Solovyev, I.; Colombero, A.; Elliott, R.; Kelley, M.; Boyle, W. J.: ATAR, a novel tumor necrosis factor receptor family member, signals through TRAF2 and TRAF5. J. Biol. Chem. 272:13471-13474,1997.

Marsters, S. A.; Ayres, T. M.; Skubatch, M.; Gray, C. L.; Rothe, M.; Ashkenazi, A.: Herpesvirus entry mediator, a member of the tumor necrosis factor receptor (TNFR) family, interacts with members of the TNFR-associated factor family and activates the transcription factors NF-kappa-B and AP-1. J. Biol. Chem. 272:14029-14032, 1997.

Montgomery, R. I.; Warner, M. S.; Lum, B. J.; Spear, P. G.: Herpes simplex virus-1 entry into cells mediated by a novel member of the TNF/NGF receptor family. Cell 87:427-436, 1996.

Kwon, B. S.; Tan, K. B.; Ni, J.; Oh, K.-O.; Lee, Z. H.; Kim, K. K.; Kim, Y.-J.; Wang, S.; Gentz, R.; Yu, G.-L.; Harrop, J.; Lyn, S. D.; Silverman, C.; Porter, T. G.; Truneh, A.; Young, P. R.: A newly identified member of the tumor necrosis factor receptor superfamily with a wide tissue distribution and involvement in lymphocyte activation. J. Biol. Chem. 272: 14272-14276, 1997.

Morel, Y.; Schiano de Colella, J.-M.; Harrop, J.; Deen, K. C.; Holmes, S. D.; Wattam, T. A.; Khandekar, S. S.; Truneh, A.; Sweet, R. W.; Gastaut, J.-A.; Olive, D.; Costello, R. T.: Reciprocal expression of the TNF family receptor herpes virus entry mediator and its ligand LIGHT on activated T cells: LIGHT down-regulates its own receptor. J. Immun. 165:4397-4404, 2000.

Guan, K.-L.; Butch, E.: Isolation and characterization of a novel dual specific phosphatase, HVH2, which selectively dephosphorylates the mitogen-activated protein kinase. J. Biol. Chem. 270:7197-7203,1995.

Smith, A.; Price, C.; Cullen, M.; Muda, M.; King, A.; Ozanne, B.; Arkinstall, S.; Ashworth, A.: Chromosomal localization of three human dual specificity phosphatase genes (DUSP4, DUSP6, and DUSP7). Genomics 42:524-527, 1997.

Furukawa, T.; Yatsuoka, T.; Youssef, E. M.; Abe, T.; Yokoyama, T.; Fukushige, S.; Soeda, E.; Hoshi, M.; Hayashi, Y.; Sunamura, M.; Kobari, M.; Horii, A.: Genomic analysis of DUSP6, a dual specificity MAP kinase phosphatase, in pancreatic cancer. Cytogenet. Cell Genet. 82:156-159, 1998.

Groom, L. A.; Sneddon, A. A.; Alessi, D. R.; Dowd, S.; Keyse, S. M.: Differential regulation of the MAP, SAP and RK/p38 kinases by Pyst1, a novel cytosolic dual-specificity phosphatase. EMBO J. 15:3621-3632, 1996.

Muda, M.; Boschert, U.; Dickinson, R.; Martinou, J.-C.; Martinou, I.; Camps, M.; Schlegel, W.; Arkinstall, S.: MKP-3, a novel cytosolic protein-tyrosine phosphatase that exemplifies a new class of mitogen-activated protein kinase phosphatase. J. Biol. Chem. 271:4319-4326, 1996.

Smith, A.; Price, C.; Cullen, M.; Muda, M.; King, A.; Ozanne, B.; Arkinstall, S.; Ahsworth, A.: Chromosomal localization of three human dual specificity phosphatase genes (DUSP4, DUSP6, and DUSP7). Genomics 42:524-527, 1997.

Blouin, J.-L.; Sail, G. D.; Guipponi, M.; Rossier, C.; Pappasavas, M.-P.; Antonarakis, S. E.: Isolation of the human BACH1 transcription regulator gene, which maps to chromosome 21q22.1. Hum. Genet. 102:282-288, 1998.

Ohbayashi, N.; Hoshikawa, M.; Kimura, S.; Yamasaki, M.; Fukui, S.; Itoh, N.: Structure and expression of the mRNA encoding a novel fibroblast growth factor, FGF-18. J. Biol. Chem. 273:18161-18164,1998.

Jackson, A.; Panayiotidis, P.; Foroni, L.: The human homologue of the Drosophila tailless gene (TLX): characterization and mapping to a region of common deletion in human lymphoid leukemia on chromosome 6q21. Genomics 50:34-43, 1998.

Monaghan, A. P.; Bock, D.; Gass, P.; Schwager, A.; Wolfer, D. P.; Lipp, H.-P.; Schutz, G.: Defective limbic system in mice lacking the tailless gene. Nature 390:515-517, 1997.

Yu, R. T.; McKeown, M.; Evans, R. M.; Umesono, K.: Relationship between Drosophila gap gene tailless and a vertebrate nuclear receptor Tlx. Nature 370:375-379, 1994.

Plougastel, B.; Trowsdale, J.: Cloning of NKG2-F, a new member of the NKG2 family of human natural killer cell receptor genes. Europ. J. Immun. 27:2835-2839, 1997.

Sutherland, C. L.; Chalupny, N. J.; Schooley, K.; Vanden-Bos, T.; Kubin, M.; Cosman, D.: UL16-binding proteins, novel MHC class I-related proteins, bind to NKG2D and activate multiple signaling pathways in primary NK cells. J. Immun. 168:671-679, 2002.

Wu, J.; Song, Y.; Bakker, A. B. H.; Bauer, S.; Spies, T.; Lanier, L. L.; Phillips, J. H.: An activating immunoreceptor complex formed by NKG2D and DAP10. Science 285:730-732, 1999.

Volkmer, E.; Karnitz, L. M.: Human homologs of Schizosaccharomycespombe Rad1, Hus1, and Rad9 form a DNA damage-responsive protein complex. J. Biol. Chem. 274:567-570, 1999.

Brandner, J. M.; Reidenbach, S.; Franke, W. W.: Evidence that 'pinin,' reportedly a differentiation-specific desmosomal protein, is actually a widespread nuclear protein. Differentiation 62:119-127,1997.

Brandner, J. M.; Reidenbach, S.; Kuhn, C.; Franke, W. W.: Identification and characterization of a novel kind of nuclear protein occurring free in nucleoplasm and in ribonucleoprotein structures of the 'speckle' type. Europ. J. Cell Biol. 75:295-308, 1998.

Degen, W. G. J.; Agterbos, M. A.; Muyrers, J. P. P.; Bloemers, H. P. J.; Swart, G. W. M.: memA/DRS, a putative mediator of multiprotein complexes, is overexpressed in the metastasizing human melanoma cell lines BLM and MV3. Biochim. Biophys. Acta 1444:384-394, 1999.

Ouyang, P.; Sugrue, S. P.: Characterization of pinin, a novel protein associated with the desmosome-intermediate filament complex. J. Cell Biol. 135:1027-1042, 1996.

Janssen, J. W. G.; Schleithoff, L.; Bartram, C. R.; Schulz, A. S.: An oncogenic fusion product of the phosphatidylinositol 3-kinasep85-beta subunit and HUMORF8, a putative deubiquitinating enzyme. Oncogene 16:1767-1772, 1998.

Chadwick, B. P.; Williamson, J.; Sheer, D.; Frischauf, A.-M.: cDNA cloning and chromosomal mapping of a mouse gene with homology to NTPases. Mammalian Genome 9:162-164, 1998.

Yeung, G.; Mulero, J. J.; McGowan, D. W.; Bajwa, S. S.; Ford, J. E.: CD39L2, a gene encoding a human nucleoside diphosphatase, predominantly expressed in the heart. Biochemistry 39:12916-12923, 2000.

Seroussi, E.; Pan, H.-Q.; Kedra, D.; Roe, B. A.; Dumanski, J. P.: Characterization of the human NIPSNAP1 gene from 22q12: a member of a novel gene family. Gene 212:13-20, 1998.

Wang, X.-Y.; Smith, D. I.; Lui, W.; James, C. D.: GBAS, a novel gene encoding a protein with tyrosine phosphorylation sites and a transmembrane domain, is co-amplified with EGFR. Genomics 49:448-451,1998.

Holzinger, A.; Kammerer, S.; Roscher, A. A.: Primary structure of human PMP69, a putative peroxisomal ABC-transporter. Biochem. Biophys. Res. Commun. 237:152-157, 1997.

Holzinger, A.; Roscher, A. A.; Landgraf, P.; Lichtner, P.; Kammerer, S.: Genomic organization and chromosomal localization of the human peroxisomal membrane protein-1-like protein (PXMP1-L) gene encoding a peroxisomal ABC transporter. FEBS Lett. 426:238-242, 1998.

Shani, N.; Jimenez-Sanchez, G.; Steel, G.; Dean, M.; Valle, D.: Identification of a fourth half ABC transporter in the human peroxisomal membrane. Hum. Molec. Genet. 6:1925-1931, 1997.

Lesage, F.; Lazdunski, M.: Mapping of human potassium channel genes TREK-1 (KCNK2) and TASK (KCNK3) to chromosomes 1q41 and 2p23. Genomics 51:478-479, 1998.

Duprat, F.; Lesage, F.; Fink, M.; Reyes, R.; Heurteaux, C.; Lazdunski, M.: TASK, a human background K+ channel to sense external pH variations near physiological pH. EMBO J. 16:5464-5471, 1997.

Manjunath, N. A.; Bray-Ward, P.; Goldstein, S. A. N.; Gallagher, P. G.: Assignment of the 2P domain, acid-sensitive potassium channel OAT1 gene KCNK3 to human chromosome bands 2p24.1-p23.3 and murine 5B by in situ hybridization. Cytogenet. Cell Genet. 86:242-243,1999.

Hacker, B. M.; Tomlinson, J. E.; Wayman, G. A.; Sultana, R.; Chan, G.; Villacres, E.; Disteche, C.; Storm, D. R.: Cloning, chromosomal mapping, and regulatory properties of the human type 9 adenylyl cyclase (ADCY9). Genomics 50:97-104, 1998.

Paterson, J. M.; Smith, S. M.; Harmar, A. J.; Antoni, F. A.: control of a novel adenylyl cyclase by calcineurin. Biochem. Biophys. Res. Commun. 214:1000-1008, 1995.

Premont, R. T.; Matsuoka, I.; Mattei, M. G.; Pouille, Y.; Defer, N.; Hanoune, J.: Identification and characterization of a widely expressed form of adenylyl cyclase. J. Biol. Chem. 271:13900-13907,1996.

Toyota, T.; Hattori, E.; Meerabux, J.; Yamada, K.; Saito, K.; Shibuya, H.; Nankai, M.; Yoshikawa, T.: Molecular analysis, mutation screening, and association study of adenylate cyclase type 9 gene (ADCY9) in mood disorders. Am. J. Med. Genet. (Neuropsychiat. Genet.) 114:84-92, 2002.

Hidai, H.; Bardales, R.; Goodwin, R.; Quertermous, T.; Quertermous, E. E.: Cloning of capsulin, a basic helix-loop-helix factor expressed in progenitor cells of the pericardium and the coronary arteries. Mech. Dev. 73:33-43, 1998.

Lu, J.; Chang, P.; Richardson, J. A.; Gan, L.; Weiler, H.; Olson, E. N.: The basic helix-loop-helix transcription factor capsulin controls spleen organogenesis. Proc. Nat. Acad. Sci. 97:9525-9530, 2000.

Lu, J.; Richardson, J. A.; Olson, E. N.: Capsulin: a novel bHLH transcription factor expressed in epicardial progenitors and mesenchyme of visceral organs. Mech. Dev. 73:23-32, 1998.

Quaggin, S. E.; Vanden Heuvel, G. B.; Igarashi, P.: Pod-1, a mesoderm-specific basic-helix-loop-helix protein expressed in mesenchymal and glomerular epithelial cells in the developing kidney. Mech. Dev. 71:37-48,1998.

Robb, L.; Mifsud, L.; Hartley, L.; Biben, C.; Copeland, N. G.; Gilbert, D. J.; Jenkins, N. A.; Harvey, R. P.: Epicardin: a novel basic helix-loop-helix transcription factor gene expressed in epicardium, branchial arch myoblasts, and mesenchyme of developing lung, gut, kidney, and gonads. Dev. Dyn. 213:105-113, 1998.

Hess, G. F.; Drong, R. F.; Weiland, K. L.; Slightom, J. L.; Sclafani, R. A.; Hollingsworth, R. E.: A human homolog of the yeast CDC7 gene is overexpressed in some tumors and transformed cell lines. Gene 211:133-140, 1998.

Jiang, W.; Hunter, T.: Identification and characterization of a human protein kinase related to budding yeast Cdc7p. Proc. Nat. Acad. Sci. 94:14320-14325, 1997.

Engelender, S.; Kaminsky, Z.; Guo, X.; Sharp, A. H.; Amaravi, R. K.; Kleiderlein, J. J.; Margolis, R. L.; Troncoso, J. C.; Lanahan, A. A.; Worley, P. F.; Dawson, V. L.; Dawson, T. M.; Ross, C. A.:Synphilin-1 associates with alpha-synuclein and promotes the formation of cytosolic inclusions. Nature Genet. 22:110-114,1999.

Tory, K.; Latif, F.; Modi, W.; Schmidt, L.; Wei, M. H.; Li, H.; Cobler, P.; Orcutt, M. L.; Delisio, J.; Geil, L.; Zbar, B.; Lerman, M. I.: A genetic linkage map of 96 loci on the short arm of human chromosome 3. Genomics 13:275-286, 1992.

Amiel, J.; Salomon, R.; Attie, T.; Pelet, A.; Trang, H.; Mokhtari, M.; Gaultier, C.; Munnich, A.; Lyonnet, S.: Mutations of the RET-GDNF signaling pathway in Ondine's curse. (Letter) Am. J. Hum. Genet. 62:715-717, 1998.

Angrist, M.; Bolk, S.; Thiel, B.; Puffenberger, E. G.; Hofstra, R. M.; Buys, C. H. C. M.; Cass, D. T.; Chakravarti, A.: Mutation analysis of the RET receptor tyrosine kinase in Hirschsprung disease. Hum. Molec. Genet. 4:821-830, 1995.

Antinolo, G.; Marcos, I.; Fernandez, R. M.; Romero, M.; Borrego, S.: A novel germline point mutation, c.2304G(T, in codon 768 of the RET proto-oncogene in a patient with medullary thyroid carcinoma.(Letter)Am. J. Med. Genet. 110:85-87, 2002.

Attie, T.; Pelet, A.; Edery, P.; Eng, C.; Mulligan, L. M.; Amiel, J.; Boutrand, L.; Beldjord, C.; Nihoul-Fekete, C.; Munnich, A.; Ponder, B. A. J.; Lyonnet, S.: Diversity of RET proto-oncogene mutations in familial and sporadic Hirschsprung disease. Hum. Molec. Genet. 4:1381-1386, 1995.

Attie-Bitach, T.; Abitbol, M.; Gerard, M.; Delezoide, A.-L.; Auge, J.; Pelet, A.; Amiel, J.; Pachnis, V.; Munnich, A.; Lyonnet, S.; Vekemans, M.: Expression of the RET proto-oncogene in human embryos. Am. J. Med. Genet. 80:481-486, 1998.

Batourina, E.; Choi, C.; Paragas, N.; Bello, N.; Hensle, T.; Costantini, F. D.; Schuchardt, A.; Bacallao, R. L.; Mendelsohn, C. L.: Distal ureter morphogenesis depends on epithelial cell remodeling mediated by vitamin A and Ret. Nature Genet. 32:109-115, 2002. Note: Erratum:Nature Genet. 32:331 only, 2002.

Batourina, E.; et al; et al: Vitamin A controls epithelial/mesenchymal interactions through Ret expression. Nature Genet. 27:74-78, 2001.

Berndt, I.; Reuter, M.; Saller, B.; Frank-Raue, K.; Groth, P.:Grubendorf, M.; Raue, F.; Ritter, M. M.; Hoppner, W.: A new hot spot for mutations in the ret proto-oncogene causing familial medullary thyroid carcinoma and multiple endocrine neoplasia type 2A. J. Clin. Endocr. Metab. 83:770-774, 1998.

Auricchio, A.; Griseri, P.; Carpentieri, M. L.; Betsos, N.; Staiano, A.; Tozzi, A.; Priolo, M.; Thompson, H.; Bocciardi, R.; Romeo, G.; Ballabio, A.; Ceccherini, I.: Double heterozygosity for a RET substitution interfering with splicing and an EDNRB missense mutation in Hirschsprung disease. (Letter) Am. J. Hum. Genet. 64:1216-1221, 1999.

Boccia, L. M.; Green, J. S.; Joyce, C.; Eng, C.; Taylor, S. A. M.; Mulligan, L. M.: Mutation of RET codon 768 is associated with the FMTC phenotype. Clin. Genet. 51:81-85, 1997.

Bolino, A.; Schuffenecker, I.; Luo, Y.; Seri, M.; Silengo, M.; Tocco, T.; Chabrier, G.; Houdent, C.; Murat, A.; Schlumberger, M.; Tourniaire, J.; Lenoir, G. M.; Romeo, G.: RET mutations in exons 13 and 14 of FMTC patients. Oncogene 10:2415-2419, 1995.

Bolk, S.; Angrist, M.; Schwartz, S.; Silvestri, J. M.; Weese-Mayer, D. E.; Chakravarti, A.: Congenital central hypoventilation syndrome:mutation analysis of the receptor tyrosine kinase RET. Am. J. Med. Genet. 63:603-609, 1996.

Bolk Gabriel, S.; Salomon, R.; Pelet, A.; Angrist, M.; Amiel, J.; Fornage, M.; Attie-Bitach, T.; Olson, J. M.; Hofstra, R.; Buys, C.; Steffann, J.; Munnich, A.; Lyonnet, S.; Chakravarti, A.: Segregation at three loci explains familial and population risk in Hirschsprung disease. Nature Genet. 31:89-93, 2002.

Ceccherini, I.; Hofstra, R. M.; Luo, Y.; Stulp, R. P.; Barone, V.; Stelwagen, T.; Bocciardi, R.; Nijveen, H.; Bolino, A.; Seri, M.; Ronchetto, P.; Pasini, B.; Bozzano, M.; Buys, C. H. C. M.; Romeo, G.: DNA polymorphisms and conditions for SSCP analysis of the 20 exons of the Ret proto-oncogene. Oncogene 9:3025-3029, 1994.

Furlong, C. E.; Richter, R. J.; Chapline, C.; Crabb, J. W.: Purification of rabbit and human serum paraoxonase. Biochemistry 30:10133-10140, 1991.

Furlong, C. E.; Richter, R. J.; Seidel, S. L.; Motulsky, A. G.: Role of genetic polymorphism of human plasma paraoxonase/arylesterase in hydrolysis of the insecticide metabolites chlorpyrifos oxon and paraoxon. Am. J. Hum. Genet. 43:230-238, 1988.

Garin, M.-C. B.; James, R. W.; Dussoix, P.; Blanche, H.; Passa, P.; Froguel, P.; Ruiz, J.: Paraoxonase polymorphism met-leu54 is associated with modified serum concentrations of the enzyme: a possible link between the paraoxonase gene and increased risk of cardiovascular disease in diabetes. J. Clin. Invest. 99:62-66, 1997.

Geldmacher-von Mallinckrodt, M.: Polymorphism of human serum paraoxonase. Hum. Genet. 45 (suppl. 1):65-68, 1978.

Geldmacher-von Mallinckrodt, M.; Lindorft, H. H.; Petenyi, M.; Flugel, M.; Fischer, T.; Hiller, T.: Genetisch determinierter Polymorphismusde menschlichen Serum-Paroxonase (E. C.3.1.1.2). human genetik 17:331-335, 1973.

Hassett, C.; Richter, R. J.; Humbert, R.; Chapline, C.; Crabb, J. W.; Omiecinski, C. J.; Furlong, C. E.: Characterization of cDNA clones encoding rabbit and human serum paraoxonase: the mature protein retains its signal sequence. Biochemistry 30:10141-10149, 1991.

Humbert, R.; Adler, D. A.; Disteche, C. M.; Hassett, C.; Omiecinski, C. J.; Furlong, C. E.: The molecular basis of the human serum paraoxonase activity polymorphism. Nature Genet. 3:73-76, 1993.

Ito, T.; Yasue, H.; Yoshimura, M.; Nakamura, S.; Nakayama, M.; Shimasaki, Y.; Harada, E.; Mizuno, Y.; Kawano, H.; Ogawa, H.: Paraoxonase gene gln192-to-arg (Q192R) polymorphism is associated with coronary artery spasm. Hum. Genet. 110:89-94, 2002.

Kao, Y.-L.; Donaghue, K.; Chan, A.; Knight, J.; Silink, M.: A variant of paraoxonase (PON1) gene is associated with diabetic retinopathy in IDDM. J. Clin. Endocr. Metab. 83:2589-2592, 1998.

La Du, B. N.: The human serum paraoxonase/arylesterase polymorphism. (Editorial) Am. J. Hum. Genet. 43:227-229, 1988.

Li, W.-F.; Furlong, C. E.; Costa, L. G.: Paraoxonase protects against chlorpyrifos toxicity in mice. Toxic. Lett. 76:219-226, 1995.

Li, W.-F.; Matthews, C.; Disteche, C. M.; Costa, L. G.; Furlong, C. E.: Paraoxonase (Pon1) gene in mice: sequencing, chromosomal localization and developmental expression. Pharmacogenetics 7:137-144, 1997.

Mackness, B.; Mackness, M. I.; Arrol, S.; Turkie, W.; Durrington, P. N.: Effect of the human serum paraoxonase 55 and 192 genetic polymorphisms on the protection by high density lipoprotein against low density lipoprotein oxidative modification. FEBS Lett. 423:57-60, 1998.

Mochizuki, H.; Scherer, S. W.; Xi, T.; Nickle, D. C.; Majer, M.; Huizenga, J. J.; Tsui, L.-C.; Prochazka, M.: Human PON2 gene at 7q21.3:cloning, multiple mRNA forms, and missense polymorphisms in the coding sequence. Gene 213: 149-157, 1998.

Mueller, R. F.; Hornung, S.; Furlong, C. E.; Anderson, J.; Giblett, E. R.; Motulsky, A. G.: Plasma paraoxonase polymorphism: a new enzyme assay, population, family, biochemical, and linkage studies. Am. J. Hum. Genet. 35:393-408, 1983.

Navab, M.; Hama-Levy, S.; Van Lenten, B. J.; Fonarow, G. C.; Cardinez, C. J.; Castellani, L. W.; Brennan, M.-L.; Lusis, A. J.; Fogelman, A. M.: Mildly oxidized LDL induces an increased apolipoprotein J/paraoxonaseratio. J. Clin. Invest. 99:2005-2019, 1997.

Neel, J. V.; Tanis, R. J.; Migliazza, E. C.; Spielman, R. S.; Salzano, F. M.; Oliver, W. J.; Morrow, M.; Bachofer, S.: Genetic studies of the Macushi and Wapishana Indians. I. Rare genetic variants and a 'private polymorphism' of esterase A. Hum. Genet. 36:81-108, 1977.

Nielsen, A.; Eiberg, H.; Mohr, J.: Number of loci responsible for the inheritance of high and low activity of paraoxonase. Clin. Genet. 29:216-221, 1986.

Odawara, M.; Tachi, Y.; Yamashita, K.: Paraoxonase polymorphism Gln192-Arg is associated with coronary heart disease in Japanese noninsulin-dependent diabetes mellitus. J. Clin. Endocr. Metab. 82:2257-2260, 1997.

Ortigoza-Ferado, J.; Richter, R. J.; Hornung, S. K.; Motulsky, A. G.; Furlong, C. E.: Paraoxon hydrolysis in human serum mediated by a genetically variable arylesterase and albumin. Am. J. Hum. Genet. 36:295-305, 1984.

Paolisso, G.; Manzella, D.; Tagliamonte, M. R.; Barbieri, M.; Marfella, R.; Zito, G.; Bonafe, M.; Giugliano, D.; Franceschi, C.; Varricchio, M.: The BB-paraoxonase genotype is associated with impaired brachial reactivity after acute hypertriglyceridemia in healthy subjects. J. Clin. Endocr. Metab. 86:1078-1082, 2001.

Playfer, J. R.; Eze, L. C.; Bullen, M. F.; Evans, D. A. P.: Genetic polymorphism and interethnic variability of plasma paroxonase activity. J. Med. Genet. 13:337-342, 1976.

Schmiegelow, K.; Eiberg, H.; Tsui, L.-C.; Buchwald, M.; Phelan, P. D.; Williamson, R.; Warwick, W.; Niebuhr, E.; Mohr, J.; Schwartz, M.; Koch, C.: Linkage between the loci for cystic fibrosis and paraoxonase. Clin. Genet. 29:374-377, 1986.

Serrato, M.; Marian, A. J.: A variant of human paraoxonase/arylesterase (HUMPONA) gene is a risk factor for coronary artery disease. J. Clin. Invest. 96:3005-3008, 1995.

Shih, D. M.; Gu, L.; Xia, Y.-R.; Navab, M.; Li, W.-F.; Hama, S.; Castellani, L. W.; Furlong, C. E.; Costa, L. G.; Fogelman, A. M.; Lusis, A. J.: Mice lacking serum paraoxonase are susceptible to organophosphate toxicity and atherosclerosis. Nature 394:284-287, 1998.

Simpson, N. E.: Serum aryl esterase levels of activity in twins and their parents. Am. J. Hum. Genet. 23:375-382, 1971.

Sorenson, R. C.; Primo-Parmo, S. L.; Camper, S.; La Du, B. N.: The genetic mapping and gene structure of mouse paraoxonase/aryl esterase. Genomics 30:431-438, 1995.

Tashian, R. E.: Genetic variation and evolution of the carboxylic esterases and carbonic anhydrases of primate erythrocytes. Am. J. Hum. Genet. 17:257-272, 1965.

Tashian, R. E.; Shaw, M. W.: Inheritance of an erythrocyte acetylesterase variant of man. Am. J. Hum. Genet. 14:295-300, 1962.

Tsui, L.-C.; Buchwald, M.; Barker, D.; Braman, J. C.; Knowlton, R.; Schumm, J. W.; Eiberg, H.; Mohr, J.; Kennedy, D.; Plavsic, N.; Zsiga, M.; Markiewicz, D.; Akots, G.; Brown, V.; Helms, C.; Gravius, T.; Parker, C.; Rediker, K.; Donis-Keller, H.: Cystic fibrosis locus defined by a genetically linked polymorphic DNA marker. Science 230:1054-1057, 1985.

Gogolin, K. J.; Wray, L. K.; Slaughter, C. A.; Harris, H.: A monoclonal antibody that reacts with nonallelic enzyme glycoproteins. Science 216:59-61, 1982.

Goldstein, D. J.; Rogers, C. E.; Harris, H.: Expression of alkaline phosphatase loci in mammalian tissues. Proc. Nat. Acad. Sci. 77:2857-2860, 1980.

Gould, B. S.: Studies on the source of serum phosphatase: the nature of the increased serum phosphatase in rats after fat feeding. Arch. Biochem. 4:175-181, 1944.

Griffin, C. A.; Smith, M.; Henthorn, P. S.; Harris, H.; Weiss, M. J.; Raducha, M.; Emanuel, B. S.: Human placental and intestinal alkaline phosphatase genes map to 2q34-q37. Am. J. Hum. Genet. 41:1025-1034, 1987.

Henthorn, P. S.; Raducha, M.; Edwards, Y. H.; Weiss, M. J.; Slaughter, C.; Lafferty, M. A.; Harris, H.: Nucleotide and amino acid sequences of human intestinal alkaline phosphatase: close homology to placental alkaline phosphatase. Proc. Nat. Acad. Sci. 84:1234-1238, 1987.

Henthorn, P. S.; Raducha, M.; Kadesch, T.; Weiss, M. J.; Harris, H.: Sequence and characterization of the human intestinal alkaline phosphatase gene. J. Biol. Chem. 263:12011-12019, 1988.

Langman, M. J. S.; Leuthold, E.; Robson, E. B.; Harris, J.; Luffman, J. E.; Harris, H.: Influence of diet on the 'intestinal' component of serum alkaline phosphatase in people of different ABO blood groups and secretor status. Nature 212:41-43, 1966.

Lehmann, F.-G.: Human alkaline phosphatases: evidence of three isoenzymes (placental, intestinal and liver-bone-kidney-type) by lectin-binding affinity and immunological specificity. Biochim. Biophys. Acta 616:41-59, 1980.

Lang, F.; Klingel, K.; Wagner, C. A.; Stegen, C.; Warntges, S.; Friedrich, B.; Lanzendorfer, M.; Melzig, J.; Moschen, I.; Steuer, S.; Waldegger, S.; Sauter, M.; and 9 others: Deranged transcriptional regulation of cell-volume-sensitive kinase hSGK in diabetic nephropathy. Proc. Nat. Acad. Sci. 97:8157-8162, 2000.

Ebner, R.; Chen, R.-H.; Shum, L.; Lawler, S.; Zioncheck, T. F.; Lee, A.; Lopez, A. R.; Derynck, R.: Cloning of a type I TGF-beta receptor and its effect on TGF-beta binding to the type II receptor. Science 260:1344-1348, 1993.

Franzen, P.; ten Dijke, P.; Ichijo, H.; Yamashita, H.; Schulz, P.; Heldin, C.-H.; Miyazono, K.: Cloning of a TGF-beta type I receptor that forms a heteromeric complex with the TGF-beta type II receptor. Cell 75:681-692, 1993.

Inman, G. J.; Nicolas, F. J.; Hill, C. S.: Nucleocytoplasmic shuttling of Smads 2, 3, and 4 permits sensing of TGF-beta receptor activity. Molec. Cell 10:283-294, 2002.

Johnson, D. W.; Qumsiyeh, M.; Benkhalifa, M.; Marchuk, D. A.: Assignment of human transforming growth factor-beta type I and type III receptor genes (TGFBR1 and TGFBR3) to 9q33-q34 and 1p32-p33, respectively. Genomics 28:356-357, 1995.

Kuan, J.; Kono, D. H.: Tgfbr1 maps to chromosome 4. Mammalian Genome 9:95-96, 1998.

Pasche, B.; Luo, Y.; Rao, P. H.; Nimer, S. D.; Dmitrovsky, E.; Caron, P.; Luzzatto, L.; Offit, K.; Cordon-Cardo, C.; Renault, B.; Satagopan, J. M.; Murty, V. V.; Massague, J.: Type I transforming growth factor beta receptor maps to 9q22 and exhibits a polymorphism and a rare variant within a polyalanine tract. Cancer Res. 58:2727-2732,1998.

Begley, C. G.; Visvader, J.; Green, A. R.; Aplan, P. D.; Metcalf, D.; Kirsch, I. R.; Gough, N. M.: Molecular cloning and chromosomal localization of the murine homolog of the human helix-loop-helix gene SCL. Proc. Nat. Acad. Sci. 88:869-873, 1991.

Finger, L. R.; Kagan, J.; Christopher, G.; Kurtzberg, J.; Hershfield, M. S.; Nowell, P. C.; Croce, C. M.: Involvement of the TCL5 gene on human chromosome 1 in T-cell leukemia and melanoma. Proc. Nat. Acad. Sci. 86:5039-5043, 1989.

Gottgens, B.; Barton, L. M.; Chapman, M. A.; Sinclair, A. M.; Knudsen, B.; Grafham, D.; Gilbert, J. G. R.; Rogers, J.; Bentley, D. R.; Green, A. R.: Transcriptional regulation of the stem cell leukemia gene (SCL)--comparative analysis of five vertebrate SCL loci. Genome Res. 12:749-759, 2002.

Gottgens, B.; Gilbert, J. G.; Barton, L. M.; Grafham, D.; Rogers, J.; Bentley, D. R.; Green, A. R.: Long-range comparison of human and mouse SCL loci: localized regions of sensitivity to restriction endonucleases correspond precisely with peaks of conserved noncoding sequences. Genome Res. 11:87-97, 2001.

Kocher, O.; Cheresh, P.; Lee, S. W.: Identification and partial characterization of a novel membrane-associated protein (MAP17) up-regulated in human carcinomas and modulating cell replication and tumor growth. Am. J. Path. 149: 493-500, 1996.

Kozak, M.: An analysis of 5-prime-noncoding sequences from 699 vertebrate messenger RNAs. Nucleic Acids Res. 15:8125-8148, 1987.

Kurtzberg, J.; Bigner, S. H.; Hershfield, M. S.: Establishment of the DU.528 human lymphohemopoietic stem cell line. J. Exp. Med. 162:1561-1578, 1985.

Robb, L.; Lyons, I.; Li, R.; Hartley, L.; Kontgen, F.; Harvey, R. P.; Metcalf, D.; Begley, C. G.: Absence of yolk sac hematopoiesis from mice with a targeted disruption of the scl gene. Proc. Nat. Acad. Sci. 92:7075-7079, 1995.

Shivdasani, R. A.; Mayer, E. L.; Orkin, S. H.: Absence of blood formation in mice lacking the T-cell leukaemia oncoprotein tal-1/SCL. Nature 373:432-434, 1995.

Sinclair, A. M.; Bench, A. J.; Bloor, A. J. C.; Li, J.; Gottgens, B.; Stanley, M. L.; Miller, J.; Piltz, S.; Hunter, S.; Nacheva, E. P.; Sanchez, M.-J.; Green, A. R.: Rescue of the lethal scl-/- phenotype by the human SCL locus. Blood 99:3931-3938, 2002.

Williams, M.; Lyu, M. S.; Yang, Y. L.; Lin, E. P.; Dunbrack, R.; Birren, B.; Cunningham, J.; Hunter, K.: Ier5, a novel member of the slow-kinetics immediate-early genes. Genomics 44:327-334, 1999.

Xia, Y.; Brown, L.; Yang, C. Y.-C.; Tsou Tsan, J.; Siciliano, M. J.; Espinosa, R., III; Le Beau, M. M.; Baer, R. J.: TAL2, a helix-loop-helix gene activated by the (7;9)(q34; q32) translocation in human T-cell leukemia. Proc. Nat. Acad. Sci. 88:11416-11420, 1991.

Cohen, P.; Cohen, P. T. W.: Protein phosphatases come of age. J. Biol. Chem. 264:21435-21438, 1989.

Groves, M. R.; Hanlon, N.; Turowski, P.; Hemmings, B. A.; Barford, D.: The structure of the protein phosphatase 2A PR65/A subunit reveals the conformation of its 15 tandemly repeated HEAT motifs. Cell 96:99-110, 1999.

Jones, T. A.; Barker, H. M.; da Cruz e Silva, E. F.; Mayer-Jaekel, R. E.; Hemmings, B. A.; Spurr, N. K.; Sheer, D.; Cohen, P. T. W.: Localization of the genes encoding the catalytic subunits of protein phosphatase 2A to human chromosome bands 5q23-q31 and 8p12-p11.2, respectively. Cytogenet. Cell Genet. 63:35-41, 1993.

Stone, S. R.; Mayer, R.; Wernet, W.; Maurer, F.; Hofsteenge, J.; Hemmings, B. A.: The nucleotide sequence of the cDNA encoding the human lung protein phosphatase 2A alpha catalytic subunit. Nucleic Acids Res. 16:11365 only, 1988.

Houchins, J. P.; Yabe, T.; McSherry, C.; Bach, F. H.: DNA sequence analysis of NKG2, a family of related cDNA clones encoding type II integral membrane proteins on human natural killer cells. J. Exp. Med. 173:1017-1020, 1991.

Plougastel, B.; Trowsdale, J.: Sequence analysis of a 62-kb region overlapping the human KLRC cluster of genes. Genomics 49:193-199,1998.

Yabe, T.; McSherry, C.; Bach, F. H.; Fisch, P.; Schall, R. P.; Sondel, P. M.; Houchins, J. P.: A multigene family on human chromosome 12 encodes natural killer-cell lectins. Immunogenetics 37:455-460,1993.

Lindner, T. H.; Njolstad, P. R.; Horikawa, Y.; Bostad, L.; Bell, G. I.; Sovik, O.: A novel syndrome of diabetes mellitus, renal dysfunction and genital malformation associated with a partial deletion of the pseudo-POU domain of hepatocyte nuclear factor-1-beta. Hum. Molec. Genet. 8:2001-2008, 1999.

Cole, S. P. C.; Bhardwaj, G.; Gerlach, J. H.; Mackie, J. E.; Grant, C. E.; Almquist, K. C.; Stewart, A. J.; Kurz, E. U.; Duncan, A. M. V.; Deeley, R. G.: Over expression of a transporter gene in a multidrug-resistant human lung cancer cell line. Science 258:1650-1654, 1992.

Conrad, S.; Kauffmann, H.-M.; Ito, K.; Deeley, R. G.; Cole, S. P. C.; Schrenk, D.: Identification of human multidrug resistance protein 1 (MRP1) mutations and characterization of a G671V substitution. J. Hum. Genet. 46:656-663, 2001.

Grant, C. E.; Kurz, E. U.; Cole, S. P. C.; Deeley, R. G.: analysis of the intron-exon organization of the human multidrug-resistance protein gene (MRP) and alternative splicing of its mRNA. Genomics 45:368-378, 1997.

Lorico, A.; Bertola, A.; Baum, C.; Fodstad, O.; Rappa, G.: Role of multidrug resistance protein 1 in protection from heavy metal oxyanions:investigations in vitro and in Mrp1-deficient mice. Biochem. Biophys. Res. Commun. 291:617-622, 2002.

Robbiani, D. F.; Finch, R. A.; Jager, D.; Muller, W. A.; Sartorelli, A. C.; Randolph, G. J.: The leukotriene C4 transporter MRP1 regulates CCL19 (MIP-3-beta, ELC)-dependent mobilization of dendritic cells to lymph nodes. Cell 103:757-768, 2000.

Schultz, M. J.; Wijnholds, J.; Peppelenbosch, M. P.; Vervoordeldonk, M. J. B. M.; Speelman, P.; van Deventer, S. J. H.; Borst, P.; vander Poll, T.: Mice lacking the multidrug resistance protein 1 are resistant to Streptococcus pneumoniae-induced pneumonia. J. Immun. 166:4059-4064, 2001.

Zaman, G. J. R.; Flens, M. J.; van Leusden, M. R.; de Haas, M.; Mulder, H. S.; Lankelma, J.; Pinedo, H. M.; Scheper, R. J.; Baas, F.; Broxterman, H. J.; Borst, P.: The human multidrug resistance-associated protein MRP is a plasma membrane drug-efflux pump. Proc. Nat. Acad. Sci. 91:8822-8826, 1994.

Allan, B. B.; Moyer, B. D.; Balch, W. E.: Rab1 recruitment of p115 into a cis-SNARE complex: programming budding COPII vesicles for fusion. Science 289:444-448, 2000.

Wedemeyer, N.; Lengeling, A.; Ronsiek, M.; Korthaus, D.; Baer, K.; Wuttke, M.; Jockusch, H.: YAC contigs of the Rab1 and wobbler (wr) spinal muscular atrophy gene region on proximal mouse chromosome 11 and of the homologous region on human chromosome 2p. Genomics 32:447-454, 1996.

Rousseau-Merck, M. F.; Zahraoui, A.; Touchot, N.; Tavitian, A.; Berger, R.: Chromosome assignment of four RAS-related RAB genes. Hum. Genet. 86:350-354, 1991.

Barbosa, M. D. F. S.; Johnson, S. A.; Achey, K.; Gutierrez, M.; Wakeland, E. K.; Zerial, M.; Kingsmore, S. F.: The Rab protein family:genetic mapping of six Rab genes in the mouse. Genomics 30:439-444,1995.

Rousseau-Merck, M.-F.; Zahraoui, A.; Touchot, N.; Tavitian, A.; Berger, R.: Chromosome assignment of four RAS-related RAB genes. Hum. Genet. 86:350-354, 1991.

Bucci, C.; Parton, R. G.; Mather, I. H.; Stunnenberg, H.; Simons, K.; Hoflack, B.; Zerial, M.: The small GTPase rab5 functions as a regulatory factor in the early endocytic pathway. Cell 70:715-728,1992.

Stenmark, H.; Vitale, G.; Ullrich, O.; Zerial, M.: Rabaptin-5 is a direct effector of the small GTPase Rab5 in endocytic membrane fusion. Cell 83:423-432, 1995.

Xiao, G.-H.; Shoarinejad, F.; Jin, F.; Golemis, E. A.; Yeung, R. S.: The tuberous sclerosis 2 gene product, tuberin, functions as a Rab5 GTPase activating protein (GAP) in modulating endocytosis. J. Biol. Chem. 272:6097-6100, 1997.

Korenberg, J. R.; Chen, X.-N.; Adams, M. D.; Venter, J. C.: Toward a cDNA map of the human genome. Genomics 29:364-370, 1995.

Wilson, D. B.; Wilson, M. P.: Identification and subcellular localization of human rab5b, a new member of the ras-related superfamily of GTPases. J. Clin. Invest. 89:996-1005, 1992.

Asha, H.; de Ruiter, N. D.; Wang, M.-G.; Hariharan, I. K.: TheRap1 GTPase functions as a regulator of morphogenesis in vivo. EMBO J. 18:605-615, 1999.

Boussiotis, V. A.; Freeman, G. J.; Berezovskaya, A.; Barber, D. L.; Nadler, L. M.: Maintenance of human T cell anergy: blocking of IL-2 gene transcription by activated Rap1. Science 278:124-128,1997.

Kitayama, H.; Sugimoto, Y.; Matsuzaki, T.; Ikawa, Y.; Noda, M.: A ras-related gene with transformation suppressor activity. Cell 56:77-84, 1989.

Knox, A. L.; Brown, N. H.: Rap1 GTPase regulation of adherens junction positioning and cell adhesion. Science 295:1285-1288,2002.

Muller-Ladner, U.; Judex, M.; Ballhorn, W.; Kullmann, F.; Distler, O.; Schlottmann, K.; Gay, R. E.; Scholmerich, J.; Gay, S.: Activation of the IL-4 STAT pathway in rheumatoid synovium. J. Immun. 164:3894-3901, 2000.

Aita, N.; Ishii, K.; Akamatsu, Y.; Ogasawara, Y.; Tanabe, S.:Cloning and expression of human liver rhodanese cDNA. Biochem. Biophys. Res. Commun. 231:56-60, 1997.

Cagianut, B.; Rhyner, K.; Furrer, W.; Schnebli, H. P.: Thiosulphate-sulphur transferase (rhodanese) deficiency in Leber's hereditary optic atrophy. (Letter) Lancet II:981-982, 1981.

Nikoskelainen, E.: New aspects of the genetic, etiologic, and clinical puzzle of Leber's disease. Neurology 34:1482-1484, 1984.

Scott, E. M.; Wright, R. C.: Genetic polymorphism of rhodanese from human erythrocytes. Am. J. Hum. Genet. 32:112-114, 1980.

Weng, L.; Heinrikson, R. L.; Westley, J.: Active site cysteinyl and arginyl residues of rhodanese. J. Biol. Chem. 253:8109-8119,1978.

Whitehouse, D. B.; Pilz, A. J.; Porta, G.; Hopkinson, D. A.: Rhodanese isozymes in human tissues. Ann. Hum. Genet. 52:1-10, 1988.

Whitehouse, D. B.; Poole, C. J. M.; Kind, P. R. N.; Hopkinson, D. A.: Rhodanese isozymes in three subjects with Leber's optic neuropathy. J. Med. Genet. 26:113-115, 1989.

Bouchard, B.; Del Marmol, V.; Jackson, I. J.; Cherif, D.; Dubertret, L.: Molecular characterization of a human tyrosinase-related-protein-2cDNA: patterns of expression in melanocytic cells. Europ. J. Biochem. 219:127-134, 1994.

Budd, P. S.; Jackson, I. J.: Structure of the mouse tyrosinase-related protein-2/dopachrome tautomerase (Tyrp2/Dct) gene and sequence of two novel slaty alleles. Genomics 29:35-43, 1995.

Cassady, J. L.; Sturm, R. A.: Sequence of the human dopachrometautomerase-encoding TRP-2 cDNA. Gene 143: 295-298, 1994.

Jackson, I. J.; Chambers, D. M.; Tsukamoto, K.; Copeland, N. G.; Gilbert, D. J.; Jenkins, N. A.; Hearing, V.: A second tyrosinase-related protein, TRP-2, maps to and is mutated at the mouse slaty locus. EMBO J. 11:527-535, 1992.

Khong, H. T.; Rosenberg, S. A.: Pre-existing immunity to tyrosinase-related protein (TRP)-2, a new TRP-2 isoform, and the NY-ESO-1 melanoma antigen in a patient with a dramatic response to immunotherapy. J. Immun. 168:951-956, 2002.

Kwon, B. S.: Pigmentation genes: the tyrosinase gene family and the pmel 17 gene family. J. Invest. Derm. 100:134S-140S, 1993.

Sturm, R. A.; Baker, E.; Sutherland, G. R.: Assignment of the tyrosinase-related protein-2 gene (TYRP2) to human chromosome 13q31-q32 by fluorescence in situ hybridization: extended synteny with mouse chromosome 14. Genomics 21:293-296, 1994.

Sturm, R. A.; O'Sullivan B. J.; Box, N. F.; Smith, A. G.; Smit, S. E.; Puttick, E. R. J.; Parsons, P. G.; Dunn, I. S.: Chromosomal structure of the human TYRP1 and TYRP2 loci and comparison of the tyrosinase-related protein gene family. Genomics 29:24-34, 1995.

King, C. R.; Schimke, R. N.; Arthur, T.; Davoren, B.; Collins, D.: Proximal 3p deletion in renal cell carcinoma cells from a patient with von Hippel-Lindau disease. Cancer Genet. Cytogenet. 27:345-348,1987.

Ohta, M.; Inoue, H.; Cotticelli, M. G.; Kastury, K.; Baffa, R.; Palazzo, J.; Siprashvili, Z.; Mori, M.; McCue, P.; Druck, T.; Croce, C. M.; Huebner, K.: The FHIT gene, spanning the chromosome 3p14.2 fragile site and renal carcinoma-associated t (3;8) breakpoint, is abnormal in digestive tract cancers. Cell 84:587-597, 1996.

Wood, J. D.; Yuan, J.; Margolis, R. L.; Colomer, V.; Duan, K.; Kushi, J.; Kaminsky, Z.; Kleiderlein, J. J., Jr.; Sharp, A. H.; Ross, C. A.: Atrophin-1, the DRPLA gene product, interacts with two families of WW domain-containing proteins. Molec. Cell. Neurosci. 11:149-160,1998.

Aksoy, M.; Erdem, S.: Combination of hereditary elliptocytosis and heterozygous beta-thalassemia: a family study. J. Med. Genet. 5:298-301, 1968.

Alloisio, N.; Dorleac, E.; Delaunay, J.; Girot, R.; Galand, C.; Boivin, P.: A shortened variant of red cell membrane protein 4.1. Blood 60:265-267, 1982.

Alloisio, N.; Dorleac, E.; Girot, R.; Delaunay, J.: Analysis of red cell membrane in a family with hereditary elliptocytosis: total or partial absence of protein 4.1. Hum. Genet. 59:68-71, 1981.

Alloisio, N.; Morle, L.; Dorleac, E.; Gentilhomme, O.; Bachir, D.; Guetarni, D.; Colonna, P.; Bost, M.; Zouaoui, Z.; Roda, L.; Roussel, D.; Delaunay, J.: The heterozygous form of 4.1(-) hereditary elliptocytosis [the 4.1(-) trait]. Blood 65:46-51, 1985.

Bahary, N.; Zorich, G.; Pachter, J. E.; Leibel, R. L.; Friedman, J. M.: Molecular genetic linkage maps of mouse chromosomes 4 and Genomics 11:33-47, 1991.6. Baklouti, F.; Huang, S.-C.; Vulliamy, T. J.; Delaunay, J.; Benz, E. J., Jr.: Organization of the human protein 4.1 genomic locus:new insights into the tissue-specific alternative splicing of the pre-mRNA. Genomics 39:289-302, 1997.

Bannerman, R. M.; Renwick, J. H.: The hereditary elliptocytoses:clinical and linkage data. Ann. Hum. Genet. 26:23-38, 1962.

Clarke, C. A.; Donohoe, W. T. A.; Finn, R.; McConnell, R. B.; Sheppard, P. M.; Nicol, D. S. H.: Data on linkage in man: ovalocytosis, sickling and the Rhesus blood group complex. Ann. Hum. Genet. 24:283-287,1960.

Conboy, J.; Kan, Y. W.; Shohet, S. B.; Mohandas, N.: molecular cloning of protein 4.1, a major structural element of the human erythrocyte membrane skeleton. Proc. Nat. Acad. Sci. 83:9512-9516, 1986.

Conboy, J.; Marchesi, S.; Kim, R.; Agre, P.; Kan, Y. W.; Mohandas, N.: Molecular analysis of insertion/deletion mutations in protein 4.1 in elliptocytosis. II. Determination of molecular genetic origins of rearrangements. J. Clin. Invest. 86:524-530, 1990.

Conboy, J.; Mohandas, N.; Tchernia, G.; Kan, Y. W.: Molecular basis of hereditary elliptocytosis due to protein 4.1 deficiency. New Eng. J. Med. 315:680-685, 1986.

Conboy, J. G.: Structure, function, and molecular genetics of erythroid membrane skeletal protein 4.1 in normal and abnormal red blood cells. Seminars Hemat. 30:58-73, 1993.

Conboy, J. G.; Chan, J.; Mohandas, N.; Kan, Y. W.: Multiple protein 4.1 isoforms produced by alternative splicing in human erythroid cells. Proc. Nat. Acad. Sci. 85:9062-9065, 1988.

Conboy, J. G.; Chasis, J. A.; Winardi, R.; Tchernia, G.; Kan, Y. W.; Mohandas, N.: An isoform-specific mutation in the protein 4.1 gene results in hereditary elliptocytosis and complete deficiency of protein 4.1 in erythrocytes but not in nonerythroid cells. J. Clin. Invest. 91:77-82, 1993.

Conboy, J. G.; Mohandas, N.; Wang, C.; Tchernia, G.; Shohet, S. B.; Kan, Y. W.: Molecular cloning and characterization of the gene coding for red cell membrane skeletal protein 4.1. (Abstract) Blood 66 (suppl. 1):31A, 1985.

Cook, P. J. L.; Noades, J. E.; Newton, M. S.; de Mey, R.: On the orientation of the Rh:E1-1 linkage group. Ann. Hum. Genet. 41:157-162, 1977.

Lane, P. W.: Association of megacolon with two recessive spotting genes in the mouse. J. Hered. 57:29-31, 1966.

Matsushima, Y.; Shinkai, Y.; Kobayashi, Y.; Sakamoto, M.; Kunieda, T.; Tachibana, M.: A mouse model of Waardenburg syndrome type 4 with a new spontaneous mutation of the endothelin-B receptor gene. Mammalian Genome 13:30-35, 2002.

Metallinos, D. L.; Bowling, A. T.; Rine, J.: A missense mutation in the endothelin-B receptor gene is associated with lethal white foal syndrome: an equine version of Hirschsprung disease. Mammalian Genome 9:426-431, 1998.

Nakamuta, M.; Takayanagi, R.; Sakai, Y.; Sakamoto, S.; Hagiwara, H.; Mizuno, T.; Saito, Y.; Hirose, S.; Yamamoto, M.; Nawata, H.:Cloning and sequence analysis of a cDNA encoding human non-selective type of endothelin receptor. Biochem. Biophys. Res. Commun. 177:34-39, 1991.

Ogawa, Y.; Nakao, K.; Arai, H.; Nakagawa, O.; Hosoda, K.; Suga, S.; Nakanishi, S.; Imura, H.: Molecular cloning of a non-isopeptide-selective human endothelin receptor. Biochem. Biophys. Res. Commun. 178:248-255,1991.

Pao, M. M.; Tsutsumi, M.; Liang, G.; Uzvolgyi, E.; Gonzales, F. A.; Jones, P. A.: The endothelin receptor B (EDNRB) promoter displays heterogeneous, site specific methylation patterns in normal and tumor cells. Hum. Molec. Genet. 10:903-910, 2001.

Puffenberger, E. G.; Hosoda, K.; Washington, S. S.; Nakao, K.; deWit, D.; Yanagisawa, M.; Chakravarti, A.: A missense mutation of the endothelin-B receptor gene in multigenic Hirschsprung's disease. Cell 79:1257-1266, 1994.

Santschi, E. M.; Purdy, A. K.; Valberg, S. J.; Vrotsos, P. D.; Kaese, H.; Mickelson, J. R.: Endothelin receptor B polymorphism associated with lethal white foal syndrome in horses. Mammalian Genome 9:306-309,1998.

Shin, M. K.; Levorse, J. M.; Ingram, R. S.; Tilghman, S. M.:The temporal requirement for endothelin receptor-B signalling during neural crest development. Nature 402:496-501, 1999.

Shin, M. K.; Russell, L. B.; Tilghman, S. M.: Molecular characterization of four induced alleles at the Ednrb locus. Proc. Nat. Acad. Sci. 94:13105-13110, 1997.

Svensson, P.-J.; Anvret, M.; Molander, M.-L.; Nordenskjold, A.: Phenotypic variation in a family with mutations in two Hirschsprung-related genes (RET and endothelin receptor B). Hum. Genet. 103:145-148,1998.

Syrris, P.; Carter, N. D.; Patton, M. A.: Novel nonsense mutation of the endothelin-B receptor gene in a family with Waardenburg-Hirschsprung disease. Am. J. Med. Genet. 87:69-71, 1999.

Takayanagi, R.; Ohnaka, K.; Takasaki, C.; Ohashi, M.; Nawata, H.: Multiple subtypes of endothelin receptors in porcine tissues:characterization by ligand binding, affinity labeling and regional distribution. Regul. Pept. 32:23-37, 1991.

Tanaka, H.; Moroi, K.; Iwai, J.; Takahashi, H.; Ohnuma, N.; Hori, S.; Takimoto, M.; Nishiyama, M.; Masaki, T.; Yanagisawa, M.; Sekiya, S.; Kimura, S.: Novel mutations of the endothelin B receptor gene in patients with Hirschsprung's disease and their characterization. J. Biol. Chem. 273:11378-11383, 1998.

Vane, J. R.: Endothelins come home to roost. Nature 348:673,1990.

Verheij, J. B. G. M.; Kunze, J.; Osinga, J.; van Essen, A. J.; Hofstra, R. M. W.: ABCD syndrome is caused by a homozygous mutation in the EDNRB gene. Am. J. Med. Genet. 108:223-225, 2002.

Yang, G. C.; Croaker, D.; Zhang, A. L.; Manglick, P.; Cartmill, T.; Cass, D.: A dinucleotide mutation in the endothelin-B receptor gene is associated with lethal white foal syndrome (LWFS); a horse variant of Hirschsprung disease (HSCR). Hum. Molec. Genet. 7:1047-1052,1998.

Hanks, M.; Wurst, W.; Anson-Cartwright, L.; Auerbach, A. B.; Joyner, A. L.: Rescue of the En-1 mutant phenotype by replacement of En-1with En-2. Science 269:679-682, 1995.

Johnson, R. L.; Tabin, C. J.: Molecular models for vertebrate limb development. Cell 90:979-990, 1997.

Kohler, A.; Logan, C.; Joyner, A. L.; Muenke, M.: Regional assignment of the human homeo box-containing gene EN1 to chromosome 2q13-q21. Genomics 15:233-235, 1993.

Logan, C.; Hanks, M. C.; Noble-Topham, S.; Nallainathan, D.; Provart, N. J.; Joyner, A. L.: Cloning and sequence comparison of the mouse, human, and chicken engrailed genes reveal potential functional domains and regulatory regions. Dev. Genet. 13:345-358, 1992.

Logan, C.; Willard, H. F.; Rommens, J. M.; Joyner, A. L.: Chromosomal localization of the human homeo box-containing genes, EN1 and EN2. Genomics 4:206-209, 1989.

Loomis, C. A.; Harris, E.; Michaud, J.; Wurst, W.; Hanks, M.; Joyner, A. L.: The mouse engrailed-1 gene and ventral limb patterning. Nature 382:360-363, 1996.

Martin, G. R.; Richman, M.; Reinsch, S.; Nadeau, J. H.; Joyner, A.: Mapping of the two mouse engrailed-like genes: close linkage of En-1 to dominant hemimelia (Dh) on chromosome 1 and of En-2 to hemimelic extra-toes (Hx) on chromosome 5. Genomics 6:302-308,1990.

Matsui, T.; Hirai, M.; Hirano, M.; Kurosawa, Y.: The HOX complex neighbored by the EVX gene, as well as two other homeo box-containing genes, the GBX-class and the EN class, are located on the same chromosomes 2 and 7 in human S. FEBS Lett. 336:107-110, 1993.

Wurst, W.; Auerbach, A. B.; Joyner, A. L.: Multiple developmental defects in Engrailed-1 mutant mice: an early mid-hind brain deletion and patterning defects in forelimbs and sternum. Development 120:2065-2075, 1994.

Le Marchand-Brustel, Y.; Gremeaux, T.; Ballotti, R.; van Obberghen, E.: Insulin receptor tyrosine kinase is defective in skeletal muscle of insulin-resistant obese mice. Nature 315:676-679, 1985.

Leme, C. E.; Wajchenberg, B. L.; Lerario, A. C.; Goldman, J.; Borges, J. L. C.: Acanthosis nigricans, hirsutism, insulin resistance and insulin receptor defect. Clin. Endocr. 17:43-49, 1982.

Longo, N.; Langley, S. D.; Griffin, L. D.; Elsas, L. J.: Activation of glucose transport by a natural mutation in the human insulin receptor. Proc. Nat. Acad. Sci. 90:60-64, 1993.

Longo, N.; Langley, S. D.; Griffin, L. D.; Elsas, L. J., II:Reduced mRNA and a nonsense mutation in the insulin-receptor gene produce heritable severe insulin resistance. Am. J. Hum. Genet. 50:998-1007, 1992.

Maassen, J. A.; Klinkhamer, M. P.; Odink, R. J. H.; Sips, H.; van der Zon, G. C. M.; Wieringa, T.; Krans, H. M. J.; Moller, W.:Improper expression of insulin receptors on fibroblasts from a leprechaun patient. Europ. J. Biochem. 172:725-729, 1988.

Mariani, S.; Pedone, A.; Meschi, F.; Di Natale, B.; Caputo, R.; Broggi, U.; Chiumello, G.: Insulin resistance in a child with acanthosis nigricans type A. Acta Paediat. Scand. 71:667-670, 1982.

Michael, M. D.; Kulkarni, R. N.; Postic, C.; Previs, S. F.; Shulman, G. I.; Magnuson, M. A.; Kahn, C. R.: Loss of insulin signaling in hepatocytes leads to severe insulin resistance and progressive hepatic dysfunction. Molec. Cell 6:87-97, 2000.

Moller, D. E.; Cohen, O.; Yamaguchi, Y.; Assiz, R.; Grigorescu, F.; Eberle, A.; Morrow, L. A.; Moses, A. C.; Flier, J. S.: Prevalence of mutations in the insulin receptor gene in subjects with features of the type A syndrome of insulin resistance. Diabetes 43:247-255,1994.

Moller, D. E.; Flier, J. S.: Insulin resistance--mechanisms, syndromes, and implications. New Eng. J. Med. 325:938-948, 1991.

Moller, D. E.; Flier, J. S.: Detection of an alteration in the insulin-receptor gene in a patient with insulin resistance, acanthosis nigricans, and the polycystic ovary syndrome (type A insulin resistance). New Eng. J. Med. 319:1526-1529, 1988.

Moller, D. E.; Yokota, A.; Ginsberg-Fellner, F.; Flier, J. S.: Functional properties of a naturally occurring trp (1200)-to-ser (1200) mutation of the insulin receptor. Molec. Endocr. 4:1183-1191, 1990.

Moller, D. E.; Yokota, A.; Pazianos, A.; Flier, J. S.: A missense mutation in one allele of the tyrosine kinase domain of the insulin receptor gene is associated with dominantly inherited insulin resistance. (Abstract) Clin. Res. 38:435A only, 1990.

Moller, D. E.; Yokota, A.; White, M. F.; Pazianos, A. G.; Flier, J. S.: A naturally occurring mutation of insulin receptor alanine 1134 impairs tyrosine kinase function and is associated with dominantly inherited insulin resistance. J. Biol. Chem. 265:14979-14985, 1990.

Moncada, V. Y.; Hedo, J. A.; Serrano-Rios, M.; Taylor, S. I.:Insulin-receptor biosynthesis in cultured lymphocytes from an insulin-resistant patient (Rabson-Mendenhall syndrome): evidence for defect before insertion of receptor into plasma membrane. Diabetes 35:802-807, 1986.

Norton, K. I.; Glicklich, M.; Kupchik, G.; Gray, C. E.; Ludman, M.: Leprechaunism: a case report with radiographic features. Dysmorph. Clin. Genet. 4:57-62, 1990.

Odawara, M.; Kadowaki, T.; Yamamoto, R.; Shibasaki, Y.; Tobe, K.; Accili, D.; Bevins, C.; Mikami, Y.; Matsuura, N.; Akanuma, Y.; Takaku, F.; Taylor, S. I.; Kasuga, M.: Human diabetes associated with a mutation in the tyrosine kinase domain of the insulin receptor. Science 245:66-68, 1989.

Ojamaa, K.; Hedo, J. A.; Roberts, C. T., Jr.; Moncada, V. Y.; Gorden, P.; Ullrich, A.; Taylor, S. I.: Defects in human insulin receptor gene expression. Molec. Endocr. 2:242-247, 1988.

Prince, M. J.; Smith, F. E.; Peters, E. J.; Stuart, C. A.: Functional characteristics of decreased insulin receptors on fibroblasts obtained from a subject with severe insulin resistance and acanthosis nigricans. Diabetes 35:148-154, 1986.

Quin, J. D.; Fisher, B. M.; Paterson, K. R.; Inoue, A.; Beastall, G. H.; MacCuish, A. C.: Acute response to recombinant insulin-like growth factor-I in a patient with Mendenhall's syndrome. New Eng. J. Med. 323:1425-1426, 1991.

Quon, M. J.; Guerre-Millo, M.; Zarnowski, M. J.; Butte, A. J.; Em, M.; Cushman, S. W.; Taylor, S. I.: Tyrosine kinase-deficient mutant human insulin receptors (met1153-to-ile) overexpressed in transfected rat adipose cells fail to mediate translocation of epitope-tagged GLUT4. Proc. Nat. Acad. Sci. 91:5587-5591, 1994.

Rabson, S. M.; Mendenhall, E. N.: Familial hypertrophy of pineal body, hyperplasia of adrenal cortex and diabetes mellitus. Am. J. Clin. Path. 26:283-290, 1956.

Rajala, R. V. S.; Anderson, R. E.: Interaction of the insulin receptor beta-subunit with phosphatidyl inositol 3-kinase in bovine ROS. Invest. Ophthal. Vis. Sci. 42:3110-3117, 2001.

Roth, R. A.; Cassell, D. J.: Insulin receptor: evidence that it is a protein kinase. Science 219:299-301, 1983.

Rubin, C. S.: Personal Communication. Bronx, N. Y. Dec. 8, 1984.

Rudiger, H. W.; Ahrens, P.; Dreyer, M.; Frorath, B.; Loffel, C.; Schmidt-Preuss, U.: Impaired insulin-induced RNA synthesis secondary to a genetically defective insulin receptor. Hum. Genet. 69:76-78, 1985.

Rudiger, H. W.; Dreyer, M.; Kuhnau, J.; Bartelheimer, H.: Familial insulin-resistant diabetes secondary to an affinity defect of the insulin receptor. Hum. Genet. 64:407-411, 1983.

Salmeen, A.; Andersen, J. N.; Myers, M. P.; Tonks, N. K.; Barford, D.: Molecular basis for the dephosphorylation of the activation segment of the insulin receptor by protein tyrosine phosphatase 1B. Molec. Cell 6:1401-1412, 2000.

Scarlett, J. A.; Kolterman, O. G.; Moore, P.; Saekow, M.; Insel, J.; Griffin, J.; Mako, M.; Rubenstein, A. H.; Olefsky, J. M.: Insulin resistance and diabetes due to a genetic defect in insulin receptors. J. Clin. Endocr. Metab. 55:123-132, 1982.

Seino, S.; Seino, M.; Nishi, S.; Bell, G. I.: Structure of the human insulin receptor gene and characterization of its promoter. Proc. Nat. Acad. Sci. 86:114-118, 1989.

Polymeropoulos, M. H.; Torres, R.; Yanovski, J. A.; Chandrasekharappa, S. C.; Ledbetter, D. H.: The human corticotropin-releasing factor receptor (CRHR) gene maps to chromosome 17q12-q22. Genomics 28:123-124, 1995.

Kusafuka, T.; Wang, Y.; Puri, P.: Novel mutations of the endothelin-B receptor gene in isolated patients with Hirschsprung's disease. Hum. Molec. Genet. 5:347-349, 1996.

Comings, D. E.: Evidence for ancient tetraploidy and conservation of linkage groups in mammalian chromosomes. Nature 238:455-467, 1972.

Deol, M. S.: Genetical studies on the skeleton of the mouse. XXVIII. Tail-short. Proc. Roy. Soc. Ser. B. 155:78-95, 1961.

Hart, C. P.; Awgulewitsch, A.; Fainsod, A.; McGinnis, W.; Ruddle, F. H.: Homeo box gene complex on mouse chromosome 11: molecular cloning, expression in embryogenesis, and homology to a human homeo box locus. Cell 43:9-18, 1985.

Hauser, C. A.; Joyner, A. L.; Klein, R. D.; Learned, T. K.; Martin, G. R.; Tjian, R.: Expression of homologous homeobox-containing genes in differentiated human teratocarcinoma cells and mouse embryos. Cell 43:19-28, 1985.

Levine, M.; Rubin, G. M.; Tjian, R.: Human DNA sequences homologous to a protein coding region conserved between homeotic genes of Drosophila. Cell 38:667-673, 1984.

Manley, J. L.; Levine, M. S.: The homeo box and mammalian development. Cell 43:1-2, 1985.

Meijlink, F.; de Laaf, R.; Verrijzer, P.; Destree, O.; Kroezen, V.; Hilkens, J.; Deschamps, J.: A mouse homeobox containing gene on chromosome 11: sequence and tissue-specific expression. NucleicAcids Res. 15:6773-6786, 1987.

Miki, T.; Murphy, P. D.; Pletcher, B. A.; Kidd, J. R.; Ferguson-Smith, A. C.; Ruddle, F. H.; Kidd, K. K.: HOX2 maps to 17q near PPY and NGFR. (Abstract) Cytogenet. Cell Genet. 46:662 only, 1987.

Munke, M.; Cox, D. R.; Jackson, I. J.; Hogan, B. L. M.; Francke, U.: The murine Hox-2 cluster of homeo box containing genes maps distal on chromosome 11 near the tail-short (Ts) locus. Cytogenet. Cell Genet. 42:236-240, 1986.

Ruddle, F. H.: Personal Communication. New Haven, Conn. 1987.

Ruddle, F. H.: Personal Communication. New Haven, Conn. 1985.

Schughart, K.; Utset, M. F.; Awgulewitsch, A.; Ruddle, F. H.: Structure and expression of Hox-2.2, a murine homeobox-containing gene. Proc. Nat. Acad. Sci. 85:5582-5586, 1988.

Trainor, P. A.; Ariza-McNaughton, L.; Krumlauf, R.: Role of the isthmus and FGFs in resolving the paradox of neural crest plasticity and prepatterning. Science 295:1288-1291, 2002.

Kaur, S.; Singh, G.; Stock, J. L.; Schreiner, C. M.; Kier, A. B.; Yager, K. L.; Mucenski, M. L.; Scott, W. J., Jr.; Potter, S. S.: Dominant mutation of the murine Hox-2.2 gene results in developmental abnormalities. J. Exp. Zool. 264:323-336, 1992.

Lill, M. C.; Fuller, J. F.; Herzig, R.; Crooks, G. M.; Gasson, J. C.: The role of the homeobox gene, HOX B7, in human myelomonocytic differentiation. Blood 85:692-697, 1995.

Simeone, A.; Mavilio, F.; Acampora, D.; Giampaolo, A.; Faiella, A.; Zappavigna, V.; D'Esposito, M.; Pannese, M.; Russo, G.; Boncinelli, E.; Peschle, C.: Two human homeobox genes, c1 and c8: structure analysis and expression in embryonic development. Proc. Nat. Acad. Sci. 84:4914-4918, 1987.

Yaron, Y.; McAdara, J. K.; Lynch, M.; Hughes, E.; Gasson, J. C.: Identification of novel functional regions important for the activity of HOXB7 in mammalian cells. J. Immun. 166:5058-5067, 2001.

Sakai, K.; Yamada, M.; Horiba, N.; Wakui, M.; Demura, H.; Suda, T.: The genomic organization of the human corticotropin-releasing factor type-1 receptor. Gene 219:125-130, 1998.

Sillaber, I.; Rammes, G.; Zimmermann, S.; Mahal, B.; Zieglgansberger, W.; Wurst, W.; Holsboer, F.; Spanagel, R.: Enhanced and delayed stress-induced alcohol drinking in mice lacking functional CRH1 receptors. Science 296:931-933, 2002.

Smith, G. W.; Aubry, J.-M.; Dellu, F.; Contarino, A.; Bilezikjian, L. M.; Gold, L. H.; Chen, R.; Marchuk, Y.; Hauser, C.; Bentley, C. A.; Sawchenko, P. E.; Koob, G. F.; Vale, W.; Lee, K.-F.: Corticotropin releasing factor receptor 1-deficient mice display decreased anxiety, impaired stress response, and aberrant neuro endocrine development. Neuron 20:1093-1102, 1998.

Timpl, P.; Spanagel, R.; Sillaber, I.; Kresse, A.; Reul, J. M. H. M.; Stalla, G. K.; Blanquet, V.; Steckler, T.; Holsboer, F.; Wurst, W.: Impaired stress response and reduced anxiety in mice lacking a functional corticotropin-releasing hormone receptor 1. Nature Genet. 19:162-166, 1998.

Azim, A. C.; Knoll, J. H. M.; Beggs, A. H.; Chisti, A. H.: Isoform cloning, actin binding, and chromosomal localization of human erythroid dematin, a member of the villin superfamily. J. Biol. Chem. 270:17407-17413, 1995.

Azim, A. C.; Marfatia, S. M.; Korsgren, C.; Dotimas, E.; Cohen, C. M.; Chishti, A. H.: Human erythrocyte dematin and protein 4.2 (pallidin) are ATP binding proteins. Biochemistry 35:3001-3006,1996.

Chishti, A. H.; Faquin, W.; Wu, C.-C.; Branton, D.: Purification of erythrocyte dematin (protein 4.9) reveals an endogenous protein kinase that modulates actin-bundling activity. J. Biol. Chem. 264:8985-8991, 1989.

Gilligan, D. M.; Bennett, V.: The junctional complex of the membrane skeleton. Seminars Hemat. 30:74-83, 1993.

Khanna, R.; Chang, S. H.; Andrabi, S.; Azam, M.; Kim, A.; Rivera, A.; Brugnara, C.; Low, P. S.; Liu, S.-C.; Chishti, A. H.: Headpiece domain of dematin is required for the stability of the erythrocyte membrane. Proc. Nat. Acad. Sci. 99:6637-6642, 2002.

Peters, L. L.; Eicher, E. M.; Azim, A. C.; Chishti, A. H.: The gene encoding the erythrocyte membrane skeleton protein dematin (Epb4.9) maps to mouse chromosome 14. Genomics 26:634-635, 1995.

Rana, A. P.; Ruff, P.; Maalouf, G. J.; Speicher, D. W.; Chishti, A. H.: Cloning of human erythroid dematin reveals another member of the villin family. Proc. Nat. Acad. Sci. 90:6651-6655, 1993.

Correas, I.; Speicher, D. W.; Marchesi, V. T.: Structure of the spectrin-actin binding site of erythrocyte protein 4.1. J. Biol. Chem. 261:13362-13366, 1986.

Albig, W.; Drabent, B.; Kunz, J.; Kalff-Suske, M.; Grzeschik, K.-H.; Doenecke, D.: All known human H1 histone genes except the H1(0) gene are clustered on chromosome 6. Genomics 16:649-654, 1993.

Cheng, J.; Baumhueter, S.; Cacalano, G.; Carver-Moore, K.; Thibodeaux, H.; Thomas, R.; Broxmeyer, H. E.; Cooper, S.; Hague, N.; Moore, M.; Lasky, L. A.: Hematopoietic defects in mice lacking the sialomucin CD34. Blood 87:479-490, 1996.

He, X.-Y.; Antao, V. P.; Basila, D.; Marx, J. C.; Davis, B. R.: Isolation and molecular characterization of the human CD34 gene. Blood 79:2296-2302, 1992.

Howell, S. M.; Molgaard, H. V.; Greaves, M. F.; Spurr, N. K.:Localisation of the gene coding for the haemopoietic stem cell antigen CD34 to chromosome 1q32. Hum. Genet. 87:625-627, 1991.

Okuno, Y.; Iwasaki, H.; Huettner, C. S.; Radomska, H. S.; Gonzalez, D. A.; Tenen, D. G.; Akashi, K.: Differential regulation of the human and murine CD34 genes in hematopoietic stem cells. Proc. Nat. Acad. Sci. 99:6246-6251, 2002.

Satterthwaite, A. B.; Burn, T. C.; Le Beau, M. M.; Tenen, D. G.: Structure of the gene encoding CD34, a human hematopoietic stem cell antigen. Genomics 12:788-794, 1992.

Simmons, D. L.; Satterthwaite, A. B.; Tenen, D. G.; Seed, B.:Molecular cloning of a cDNA encoding CD34, a sialomucin of human hematopoietic stem cells. J. Immun. 148:267-271, 1992.

Sutherland, D. R.; Stewart, A. K.; Keating, A.: CD34 antigen:molecular features and potential clinical applications. Stem Cells 11(suppl. 3):50-57, 1993.

Sutherland, D. R.; Watt, S. M.; Dowden, G.; Karhi, K.; Baker, M. A.; Greaves, M. F.; Smart, J. E.: Structural and partial amino acid sequence analysis of the human hemopoietic progenitor cell antigen CD34. Leukemia 2:793-803, 1988.

Tenen, D. G.; Satterthwaite, A. B.; Borson, R.; Simmons, D.; Eddy, R. L.; Shows, T. B.: Chromosome 1 localization of the gene for CD34, a surface antigen of human stem cells. Cytogenet. Cell Genet. 53:55-57, 1990.

Kelleher, D. J.; Kreibich, G.; Gilmore, R.: Oligosaccharyl transferase activity is associated with a protein complex composed of ribophorins I and II and a 48 kd protein. Cell 69:55-65, 1992.

Horbach, J. M. L. M.; Brenninkmeyer, S. J.; van de Velde, C. J. H.; Nieuwenhuyzen Kruseman, A. C.: A forme fruste of von Hippel-Lindau disease--a combination of adrenal pheochromocytoma and ipsilateral renal cell carcinoma: a case report. Surgery 105:436-441, 1989.

Horton, W. A.; Wong, V.; Eldridge, R.: Von Hippel-Lindau disease--clinical and pathological manifestations in 9 families with 50 affected members. Arch. Intern. Med. 136:769-777, 1976.

Hull, M. T.; Roth, L. M.; Glover, J. L.; Walker, P. D.: Metastatic carotid body paraganglioma in von Hippel-Lindau disease: an electron microscopic study. Arch. Path. Lab. Med. 106:235-239, 1982.

Hosoe, S.; Brauch, H.; Latif, F.; Glenn, G.; Daniel, L.; Bale, S.; Choyke, P.; Gorin, M.; Oldfield, E.; Berman, A.; Goodman, J.; Orcutt, M. L.; Hampsch, K.; Delisio, J.; Modi, W.; McBride, W.; Anglard, P.; Weiss, G.; Walther, M. M.; Linehan, W. M.; Lerman, M. I.; Zbar, B.: Localization of the von Hippel-Lindau disease gene to a small region of chromosome 3. Genomics 8:634-640, 1990.

Huson, S. M.; Harper, P. S.; Hourihan, M. D.; Cole, G.; Weeks, R. D.; Compston, D. A. S.: Cerebellar haemangioblastoma and von Hippel-Lindau disease. Brain 109:1297-1310, 1986.

Iliopoulos, O.; Kibel, A.; Gray, S.; Kaelin, W. G., Jr.: Tumour suppression by the human von Hippel-Lindau gene product. Nature Med. 1:822-826, 1995.

Iliopoulos, O.; Levy, A. P.; Jiang, C.; Kaelin, W. G., Jr.; Goldberg, M. A.: Negative regulation of hypoxia-inducible genes by the von Hippel-Lindau protein. Proc. Nat. Acad. Sci. 93:10595-10599, 1996.

Iliopoulos, O.; Ohh, M.; Kaelin, W. G., Jr.: pVHL(19) is a biologically active product of the von Hippel-Lindau gene arising from internal translation initiation. Proc. Nat. Acad. Sci. 95:11661-11666, 1998.

Ivan, M.; Kondo, K.; Yang, H.; Kim, W.; Valiando, J.; Ohh, M.; Salic, A.; Asara, J. M.; Lane, W. S.; Kaelin, W. G., Jr.: HIF-alpha targeted for VHL-mediated destruction by proline hydroxylation: implications for O(2) sensing. Science 292: 464-468, 2001.

Ivanov, S. V.; Kuzmin, I.; Wei, M.-H.; Pack, S.; Geil, L.; Johnson, B. E.; Stanbridge, E. J.; Lerman, M. I.: Downregulation of transmembrane carbonic anhydrases in renal cell carcinoma cell lines by wild-type von Hippel-Lindau transgenes. Proc. Nat. Acad. Sci. 95:12596-12601,1998.

Jaakkola, P.; Mole, D. R.; Tian, Y.-M.; Wilson, M. I.; Gielbert, J.; Gaskell, S. J.; von Kriegsheim, A.; Hebestreit, H. F.; Mukherji, M.; Schofield, C. J.; Maxwell, P. H.; Pugh, C. W.; Ratcliffe, P. J.: Targeting of HIF-alpha to the von Hippel-Lindau ubiquitylation complex by O(2)-regulated prolyl hydroxylation. Science 292:468-472, 2001.

James, G. P.: Personal Communication. Springfield, Ohio Aug. 15, 1998.

Jennings, A. M.; Smith, C.; Cole, D. R.; Jennings, C.; Shortland, J. R.; Williams, J. L.; Brown, C. B.: Von Hippel-Lindau disease in a large British family: clinicopathological features and recommendations for screening and follow-up. Quart. J. Med. 66:233-249, 1988.

Kanno, H.; Kondo, K.; Ito, S.; Yamamoto, I.; Fujii, S.; Torigoe, S.; Sakai, N.; Hosaka, M.; Shuin, T.; Yao, M.: Somatic mutations of the von Hippel-Lindau tumor suppressor gene in sporadic central nervous system hemangioblastomas. Cancer Res. 54:4845-4847, 1994.

Kanno, H.; Saljooque, F.; Yamamoto, I.; Hattori, S.; Yao, M.; Shuin, T.; U, H.-S.: Role of the von Hippel-Lindau tumor suppressor protein during neuronal differentiation. Cancer Res. 60:2820-2824, 2000.

Kaplan, C.; Sayre, G. P.; Greene, L. F.: Bilateral nephrogenic carcinomas in Lindau-von Hippel disease. J. Urol. 86:36-42, 1961.

Karsdorp, N.; Elderson, A.; Wittebol-Post, D.; Hene, R. J.; Vos, J.; Feldberg, M. A. M.; van Gils, A. P. G.; Jansen-Schillhorn vanVeen, J. M.; Vroom, T. M.; Hoppener, J. W. M.; Lips, C. J. M.: Von Hippel-Lindau disease: new strategies in early detection and treatment. Am. J. Med. 97:158-168, 1994.

Keeler, L. L., III; Klauber, G. T.: von Hippel-Lindau disease and renal cell carcinoma in a 16-year-old boy. J. Urol. 147:1588-1591, 1992.

Kenck, C.; Wilhelm, M.; Bugert, P.; Staehler, G.; Kovacs, G.: Mutation of the VHL gene is associated exclusively with the development of non-papillary renal cell carcinomas. J. Path. 179:157-161, 1996.

Kerr, D. J.; Scheithauer, B. W.; Miller, G. M.; Ebersold, M. J.; McPhee, T. J.: Hemangioblastoma of the optic nerve: case report. Neurosurgery 36:573-581, 1995.

Kibel, A.; Iliopoulos, O.; DeCaprio, J. A.; Kaelin, W. G., Jr.: Binding of the von Hippel-Lindau tumor suppressor protein to elongin B and C. Science 269:1444-1446, 1995.

Kiechle-Schwarz, M.; Neumann, H. P. H.; Decker, H.-J. H.; Dietrich, C.; Wullich, B.; Schempp, W.: Cytogenetic studies on three pheochromocytomas derived from patients with von Hippel-Lindau syndrome. Hum. Genet. 82:127-130, 1989.

Brissenden, J. E.; Derynck, R.; Francke, U.: Transforming growth factor alpha gene (TGFA) maps to human chromosome 2 close to the breakpoint of the t (2;8) variant translocation in Burkitt lymphoma. (Abstract) Cytogenet. Cell Genet. 40:589 only, 1985.

Collin, G. B.; Marshall, J. D.; Naggert, J. K.; Nishina, P. M.: TGFA: exon-intron structure and evaluation as a candidate gene for Alstrom syndrome. (Letter) Clin. Genet. 55:61-62, 1999.

Ellis, D. L.; Kafka, S. P.; Chow, J. C.; Nanney, L. B.; Inman, W. H.; McCadden, M. E.; King, L. E., Jr.: Melanoma, growth factors, acanthosis nigricans, the sign of Leser-Trelat, and multiple acrochordons: a possible role for alpha-transforming growth factor in cutaneous paraneoplastic syndromes. New Eng. J. Med. 317:1582-1587, 1987.

Fernandez-Larrea, J.; Merlos-Suarez, A.; Urena, J. M.; Baselga, J.; Arribas, J.: A role for a PDZ protein in the early secretory pathway for the targeting of pro TGF-alpha to the cell surface. Molec. Cell 3:423-433, 1999.

Fowler, K. J.; Mann, G. B.; Dunn, A. R.: Linkage of the murine transforming growth factor-alpha gene with Igk, Ly-2, and Fabp1 on chromosome 6. Genomics 16:782-784, 1993.

Tam, J. P.; Scheikh, M. A.; Solomon, D. S.; Ossowski, L.: Efficient synthesis of human type alpha transforming growth factor: its physical and biological characterization. Proc. Nat. Acad. Sci. 83:8082-8086, 1986.

Tricoli, J. V.; Nakai, H.; Byers, M. G.; Rall, L. B.; Bell, G. I.; Shows, T. B.: Assignment of the gene coding for human TGF-alpha to chromosome 2p13. (Abstract) Cytogenet. Cell Genet. 40:762 only, 1985.

Tricoli, J. V.; Nakai, H.; Byers, M. G.; Rall, L. B.; Bell, G. I.; Shows, T. B.: The gene for human transforming growth factor alpha is on the short arm of chromosome 2. Cytogenet. Cell Genet. 42:94-98, 1986.

Dong, C.; Zhu, S.; Wang, T.; Yoon, W.; Li, Z.; Alvarez, R. J.; ten Dijke, P.; White, B.; Wigley, F. M.; Goldschmidt-Clermont, P. J.: Deficient Smad7 expression: a putative molecular defect in scleroderma. Proc. Nat. Acad. Sci. 99:3908-3913, 2002.

Dickinson, M. E.; Kobrin, M. S.; Silan, C. M.; Kingsley, D. M.; Justice, M. J.; Miller, D. A.; Ceci, J. D.; Lock, L. F.; Lee, A.; Buchberg, A. M.; Siracusa, L. D.; Lyons, K. M.; Derynck, R.; Hogan, B. L. M.; Copeland, N. G.; Jenkins, N. A.: Chromosomal localization of seven members of the murine TGF-beta superfamily suggests close linkage to several morphogenetic mutant loci. Genomics 6:505-520, 1990.

Thomas, S. A.; Matsumoto, A. M.; Palmiter, R. D.: Noradrenaline is essential for mouse fetal development. Nature 374:643-646, 1995.

Kikuchi, S.; Hata, M.; Fukumoto, K.; Yamane, Y.; Matsui, T.; Tamura, A.; Yonemura, S.; Yamagishi, H.; Keppler, D.; Tsukita, S.; Tsukita, S.: Radixin deficiency causes conjugated hyperbilirubinemia with loss of Mrp2 from bile canalicular membranes. Nature Genet. 31:320-325, 2002.

Wilgenbus, K. K.; Milatovich, A.; Francke, U.; Furthmayr, H.: Molecular cloning, cDNA sequence, and chromosomal assignment of the human radixin gene and two dispersed pseudogenes. Genomics 16:199-206, 1993.

Geppert, M.; Goda, Y.; Stevens, C. F.; Sudhof, T. C.: The small GTP-binding protein Rab3A regulates a late step in synaptic vesicle fusion. Nature 387:810-814, 1997.

Kapfhamer, D.; Valladares, O.; Sun, Y.; Nolan, P. M.; Rux, J. J.; Arnold, S. E.; Veasey, S. C.; Bucan, M.: Mutations in Rab3a alter circadian period and homeostatic response to sleep loss in the mouse. Nature Genet. 32:290-295, 2002.

Rousseau-Merck, M. F.; Zahraoui, A.; Bernheim, A.; Touchot, N.; Miglierina, R.; Tavitian, A.; Berger, R.: Chromosome mapping of the human RAS related RAB3A and RAB3B genes to chromosomes 19p13.2 and1p31-p32, respectively. (Abstract) Cytogenet. Cell Genet. 51:1070 only, 1989.

Rousseau-Merck, M. F.; Zahraoui, A.; Bernheim, A.; Touchot, N.; Miglierina, R.; Tavitian, A.; Berger, R.: Chromosome mapping of the human RAS-related RAB3A gene to 19p13.2. Genomics 5:694-698, 1989.

Zahraoui, A.; Touchot, N.; Chardin, P.; Tavitian, A.: The human Rab genes encode a family of GTP-binding proteins related to yeast YPT1 and SEC4 products involved in secretion. J. Biol. Chem. 264:12394-12401, 1989.

Hussey, D. J.; Nicola, M.; Moore, S.; Peters, G. B.; Dobrovic, A.: The (4;11)(q21; p15) translocation fuses the NUP98 and RAP1GDS1 genes and is recurrent in T-cell acute lymphocytic leukemia. Blood 94:2072-2079, 1999.

Germain, P.; Iyer, J.; Zechel, C.; Gronemeyer, H.: Co-regulator recruitment and the mechanism of retinoic acid receptor synergy. Nature 415:187-192, 2002.

McNamara, P.; Seo, S.; Rudic, R. D.; Sehgal, A.; Chakravarti, D.; FitzGerald, G. A.: Regulation of CLOCK and MOP4 by nuclear hormone receptors in the vasculature: a humoral mechanism to reset a peripheral clock. Cell 105:877-889, 2001.

Almasan, A.; Mangelsdorf, D. J.; Ong, E. S.; Wahl, G. M.; Evans, R. M.: Chromosomal localization of the human retinoid X receptors. Genomics 20:397-403, 1994.

Claudel, T.; Leibowitz, M. D.; Fievet, C.; Tailleux, A.; Wagner, B.; Repa, J. J.; Torpier, G.; Lobaccaro, J.-M.; Paterniti, J. R.; Mangelsdorf, D. J.; Heyman, R. A.; Auwerx, J.: Reduction of atherosclerosis in apolipoprotein E knockout mice by activation of the retinoid X receptor. Proc. Nat. Acad. Sci. 98:2610-2615, 2001.

de Urquiza, A. M.; Liu, S.; Sjoberg, M.; Zetterstrom, R. H.; Griffiths, W.; Sjovall, J.; Perlmann, T.: Docosahexaenoic acid, a ligand for the retinoid X receptor in mouse brain. Science 290:2140-2144,2000.

Thomas, G. D.; Sander, M.; Lau, K. S.; Huang, P. L.; Stull, J. T.; Victor, R. G.: Impaired metabolic modulation of alpha-adrenergic vasoconstriction in dystrophin-deficient skeletal muscle. Proc. Nat. Acad. Sci. 95:15090-15095, 1998.

Xie, J.; Roddy, P.; Rife, T. K.; Murad, F.; Young, A. P.: Two closely linked but separable promoters for human neuronal nitric oxide synthase gene transcription. Proc. Nat. Acad. Sci. 92:1242-1246,1995.

Xu, W.; Gorman, P.; Sheer, D.; Bates, G.; Kishimoto, J.; Lizhi, L.; Emson, P.: Regional localization of the gene coding for human brain nitric oxide synthase (NOS1) to 12q24.2-24.31 by fluorescent in situ hybridization. Cytogenet. Cell Genet. 64:62-63, 1993.

Taniyama, T.; Takai, S.; Miyazaki, E.; Fukumura, R.; Sato, J.; Kobayashi, Y.; Hirakawa, T.; Moore, K. W.; Yamada, K.: The human interleukin-10 receptor gene maps to chromosome 11q23.3. Hum. Genet. 95:99-101, 1995.

Bono, M. R.; Alcaide-Loridan, C.; Couillin, P.; Letouze, B.; Grisard, M. C.; Jouin, H.; Fellous, M.: Human chromosome 16 encodes a factor involved in induction of class II major histocompatibility antigens by interferon gamma. Proc. Nat. Acad. Sci. 88:6077-6081, 1991.

Bono, R.; Hatat, D.; Couillin, P.; Grisard, M. C.; Van Cong, N.; Fisher, D.; Fellous, M.: Receptor for human gamma interferon is specified by human chromosomes 6 and 21. (Abstract) Cytogenet. Cell Genet. 46:584, 1987.

Dorman, S. E.; Holland, S. M.: Mutation in the signal-transducing chain of the interferon-gamma receptor and susceptibility to mycobacterial infection. J. Clin. Invest. 101:2364-2369, 1998.

Jung, V.; Rashidbaigi, A.; Jones, C.; Tischfield, J. A.; Shows, T. B.; Pestka, S.: Human chromosomes 6 and 21 are required for sensitivity to human interferon gamma. Proc. Nat. Acad. Sci. 84:4151-4155,1987.

Langer, J. A.; Rashidbaigi, A.; Lai, L.-W.; Patterson, D.; Jones, C.: Sublocalization on chromosome 21 of human interferon-alpha receptor gene and the gene for an interferon-gamma response protein. Somat. Cell Molec. Genet. 16:231-240, 1990.

Mariano, T. M.; Muthukumaran, G.; Donnelly, R. J.; Wang, N.; Adamson, M. C.; Pestka, S.; Kozak, C. A.: Genetic mapping of the gene for the mouse interferon-gamma receptor signaling subunit to the distal end of chromosome 16. Mammalian Genome 7:321-322, 1996.

Rhee, S.; Ebensperger, C.; Dembic, Z.; Pestka, S.: The structure of the gene for the second chain of the human interferon-gamma receptor. J. Biol. Chem. 271:28947-28952, 1996.

Soh, J.; Donnelly, R. J.; Mariano, T. M.; Cook, J. R.; Schwartz, B.; Pestka, S.: Identification of a yeast artificial chromosome clone encoding an accessory factor for the human interferon gamma receptor:evidence for multiple accessory factors. Proc. Nat. Acad. Sci. 90:8737-8741, 1993.

Ben-Asouli, Y.; Banai, Y.; Pel-Or, Y.; Shir, A.; Kaempfer, R.:Human interferon-gamma mRNA autoregulates its translation through a pseudoknot that activates the interferon-inducible protein kinase PKR. Cell 108:221-232, 2002.

Shimizu, A.; Sakai, Y.; Ohno, K.; Masaki, S.; Kuwano, R.; Takahashi, Y.; Miyashita, N.; Watanabe, T.: A molecular genetic linkage map of mouse chromosome 10, including the Myb, S100b, Pah, Sl, and Ifg genes. Biochem. Genet. 30:529-535, 1992.

Heim, S.; Nilbert, M.; Vanni, R.; Floderus, U.-M.; Mandahl, N.; Liedgren, S.; Lecca, U.; Mitelman, F.: A specific translocation, t (12;14)(q14-15; q23-24), characterizes a subgroup of uterine leiomyomas. Cancer Genet. Cytogenet. 32:13-17, 1988.

Tan, M.; Jing, T.; Lan, K.-H.; Neal, C. L.; Li, P.; Lee, S.; Fang, D.; Nagata, Y.; Liu, J.; Arlinghaus, R.; Hung, M.-C.; Yu, D.: Phosphorylation on tyrosine-15 of p34(Cdc2) by ErbB2 inhibits p34(Cdc2) activation and is involved in resistance to taxol-induced apoptosis. Molec. Cell 9:993-1004, 2002.

Gromeier, M.; Solecki, D.; Patel, D. D.; Wimmer, E.: Expression of the human poliovirus receptor/CD155 gene during development of the central nervous system: implications for the pathogenesis of polio myelitis. Virology 273: 248-257, 2000.

He, Y.; Bowman, V. D.; Mueller, S.; Bator, C. M.; Bella, J.; Peng, X.; Baker, T. S.; Wimmer, E.; Kuhn, R. J.; Rossmann, M. G.: Interaction of the polio virus receptor with polio virus. Proc. Nat. Acad. Sci. 97:79-84, 2000.

Koike, S.; Horie, H.; Ise, I.; Okitsu, A.; Yoshida, M.; Iizuka, N.; Takeuchi, K.; Takegami, T.; Nomoto, A.: The polio virus receptor protein is produced both as membrane-bound and secreted forms. EMBO J. 9:3217-3224, 1990.

Koike, S.; Taya, C.; Kurata, T.; Abe, S.; Ise, I.; Yonekawa, H.; Nomoto, A.: Transgenic mice susceptible to polio virus. Proc. Nat. Acad. Sci. 88:951-955, 1991.

Mendelsohn, C.; Johnson, B.; Lionetti, K. A.; Nobis, P.; Wimmer, E.; Racaniello, V. R.: Transformation of a human polio virus receptor gene into mouse cells. Proc. Nat. Acad. Sci. 83:7845-7849, 1986.

Mendelsohn, C. L.; Wimmer, E.; Racaniello, V. R.: Cellular receptor for polio virus: molecular cloning, nucleotide sequence, and expression of a new member of the immunoglobulin superfamily. Cell 56:855-865,1989.

Miller, D. A.; Miller, O. J.; Dev, V. G.; Hashmi, S.; Tantravahi, R. R.; Medrano, L.; Green, H.: Human chromosome 19 carries a polio virus receptor gene. Cell 1:167-174, 1974.

Carter, R. E.; Cerosaletti, K. M.; Burkin, D. J.; Fournier, R. E. K.; Jones, C.; Greenberg, B. D.; Citron, B. A.; Festoff, B. W.: The gene for the serpin thrombin inhibitor (PI7), protease nexin1, is located on human chromosome 2q33-q35 and on syntenic regions in the mouse and sheep genomes. Genomics 27:196-199, 1995.

Gloor, S.; Odink, K.; Guenther, J.; Nick, H.; Monard, D.: A glia-derived neurite promoting factor with protease inhibitory activity belongs to the protease nexins. Cell 47:687-693, 1986.

Spicer, A. P.; Seldin, M. F.; Olsen, A. S.; Brown, N.; Wells, D. E.; Doggett, N. A.; Itano, N.; Kimata, K.; Inazawa, J.; McDonald, J. A.: Chromosomal localization of the human and mouse hyaluronan synthase genes. Genomics 41:493-497, 1997.

Watanabe, K.; Yamaguchi, Y.: Molecular identification of a putative human hyaluronan synthase. J. Biol. Chem. 271: 22945-22948, 1996.

Johansson, M.; Karlsson, A.: Cloning and expression of human deoxyguanosine kinase cDNA. Proc. Nat. Acad. Sci. 93:7258-7262, 1996.

Taanman, J.-W.; Kateeb, I.; Muntau, A. C.; Jaksch, M.; Cohen, N.; Mandel, H.: A novel mutation in the deoxyguanosine kinase gene causing depletion of mitochondrial DNA. Ann. Neurol. 52:237-239, 2002.

Cahill, D. P.; da Costa, L. T.; Carson-Walter, E. B.; Kinzler, K. W.; Vogelstein, B.; Lengauer, C.: Characterization of MAD2B and other mitotic spindle checkpoint genes. Genomics 58:181-187, 1999.

Chen, R.-H.; Waters, J. C.; Salmon, E. D.; Murray, A. W.: Association of spindle assembly checkpoint component XMAD2 with unattached kinetochores. Science 274:242-245, 1996.

Dobles, M.; Liberal, V.; Scott, M. L.; Benezra, R.; Sorger, P. K.: Chromosome missegregation and apoptosis in mice lacking the mitotic checkpoint protein Mad2. Cell 101:635-645, 2000.

Krishnan, R.; Goodman, B.; Jin, D.-Y.; Jeang, K.-T.; Collins, C.; Stetten, G.; Spencer, F.: Map location and gene structure of the Homo sapiens mitotic arrest deficient 2 (MAD2L1) gene at 4q27. Genomics 49:475-478, 1998.

Li, X.; Nicklas, R. B.: Mitotic forces control a cell-cycle checkpoint. Nature 373:630-632, 1995.

Li, Y.; Benezra, R.: Identification of a human mitotic checkpoint gene: hsMAD2. Science 274:246-248, 1996.

Luo, X.; Tang, Z.; Rizo, J.; Yu, H.: The Mad2 spindle checkpoint protein undergoes similar major conformational changes upon binding to either Mad1 or Cdc20. Molec. Cell 9:59-71, 2002.

Michel, L. S.; Liberal, V.; Chatterjee, A.; Kirchwegger, R.; Pasche, B.; Gerald, W.; Dobles, M.; Sorger, P. K.; Murty, V. V. V. S.; Benezra, R.: MAD2 haplo-insufficiency causes premature anaphase and chromosome instability in mammalian cells. Nature 409:355-359, 2001.

Nelson, K. K.; Schlondorff, J.; Blobel, C. P.: Evidence for an interaction of the metalloprotease-disintegrin tumour necrosis factor alpha convertase (TACE) with mitotic arrest deficient 2 (MAD2), and of the metalloprotease-disintegrin MDC9 with a novel MAD2-related protein, MAD2-beta. Biochem. J. 343:673-680, 1999.

Shonn, M. A.; McCarroll, R.; Murray, A. W.: Requirement of the spindle checkpoint for proper chromosome segregation in budding yeast meiosis. Science 289:300-303, 2000.

Xu, L.; Deng, H. X.; Yang, Y.; Xia, J. H.; Hung, W. Y.; Siddque, T.: Assignment of mitotic arrest deficient protein 2 (MAD2L1) to human chromosome band 5q23.3 by in situ hybridization. Cytogenet. Cell Genet. 78:63-64, 1997.

De La Rosa, J.; Ostrowski, J.; Hryniewicz, M. M.; Kredich, N. M.; Kotb, M.; LeGros, H. L., Jr.; Valentine, M.; Geller, A. M.: Chromosomal localization and catalytic properties of the recombinant alpha subunit of human lymphocyte methionine adenosyl transferase. J. Biol. Chem. 270:21860-21868, 1995.

Hou, J.; Schindler, U.; Henzel, W. J.; Ho, T. C.; Brasseur, M.; McKnight, S. L.: An interleukin-4-induced transcription factor: IL-4Stat. Science 265:1701-1706, 1994.

Leek, J. P.; Hamlin, P. J.; Bell, S. M.; Lench, N. J.: Assignment of the STAT6 gene (STAT6) to human chromosome band 12q13 by in situ hybridization. Cytogenet. Cell Genet. 79:208-209, 1997.

Patel, B. K. R.; Keck, C. L.; O'Leary, R. S.; Popescu, N. C.; LaRochelle, W. J.: Localization of the human stat6 gene to chromosome 12q13.3-q14.1, a region implicated in multiple solid tumors. Genomics 52:192-200, 1998.

Patel, B. K. R.; Pierce, J. H.; LaRochelle, W. J.: Regulation of interleukin 4-mediated signaling by naturally occurring dominant negative and attenuated forms of human Stat6. Proc. Nat. Acad. Sci. 95:172-177, 1998.

Quelle, F. W.; Shimoda, K.; Thierfelder, W.; Fischer, C.; Kim, A.; Ruben, S. M.; Cleveland, J. L.; Pierce, J. H.; Keegan, A. D.; Nelms, K.; Paul, W. E.; Ihle, J. N.: Cloning of murine Stat6 and human stat6, Stat proteins that are tyrosine phosphorylated in responses to IL-4 and IL-4 but are not required for mitogenesis. Molec. Cell. Biol. 15:3336-3343, 1995.

Liu, Y.; Chiu, I.-M.: Assignment of FGF12, the human FGF homologous factor 1 gene, to chromosome 3q29-3qter by fluorescence in situ hybridization. Cytogenet. Cell Genet. 78:48-49, 1997.

Caslini, C.; Spinelli, O.; Cazzaniga, G.; Golay, J.; De Gioia, L.; Pedretti, A.; Breviario, F.; Amaru, R.; Barbui, T.; Biondi, A.; Introna, M.; Rambaldi, A.: Identification of two novel isoforms of the ZNF162 gene: a growing family of signal transduction and activator of RNA proteins. Genomics 42:268-277, 1997.

Kramer, A.; Quentin, M.; Mulhauser, F.: Diverse modes of alternative splicing of human splicing factor SF1 deduced from the exon-intron structure of the gene. Gene 211:29-37, 1998.

Gong, Y.; Chitayat, D.; Kerr, B.; Chen, T.; Babul-Hirji, R.; Pal, A.; Reiss, M.; Warman, M. L.: Brachydactyly type B: clinical description, genetic mapping to chromosome 9q, and evidence for a shared ancestral mutation. Am. J. Hum. Genet. 64:578-585, 1999.

Breschel, T. S.; McInnis, M. G.; Margolis, R. L.; Sirugo, G.; Corneliussen, B.; Simpson, S. G.; McMahon, F. J.; MacKinnon, D. F.; Xu, J. F.; Pleasant, N.; Huo, Y.; Ashworth, R. G.; Grundstrom, C.; Grundstrom, T.; Kidd, K. K.; DePaulo, J. R.; Ross, C. A.: A novel, heritable, expanding CTG repeat in an intron of the SEF2-1 gene on chromosome 18q21.1. Hum. Molec. Genet. 6:1855-1863, 1997.

Innis, J. W.; Mortlock, D. P.: Limb development: molecular dysmorphology is at hand! Clin. Genet. 53:337-348, 1998.

Manouvrier-Hanu, S.; Holder-Espinasse, M.; Lyonnet, S.: Genetics of limb anomalies in humans. Trends Genet. 15:409-417, 1999.

Oishi, I.; Takeuchi, S.; Hashimoto, R.; Nagabukuro, A.; Ueda, T.; Liu, Z.-J.; Hatta, T.; Akira, S.; Matsuda, Y.; Yamamura, H.; Otani, H.; Minami, Y.: Spatio-temporally regulated expression of receptor tyrosine kinases, mRor1, mRor2, during mouse development: implications in development and function of the nervous system. Genes Cells 4:41-56, 1999.

Schwabe, G. C.; Tinschert, S.; Buschow, C.; Meinecke, P.; Wolff, G.; Gillessen-Kaesbach, G.; Oldridge, M.; Wilkie, A. O. M.; Komec, R.; Mundlos, S.: Distinct mutations in the receptor tyrosine kinase gene ROR2 cause brachydactyly type B. Am. J. Hum. Genet. 67:822-831,2000.

Takeuchi, S.; Takeda, K.; Oishi, I.; Nomi, M.; Ikeya, M.; Itoh, K.; Tamura, S.; Ueda, T.; Hatta, T.; Otani, H.; Terashima, T.; Takada, S.; Yamamura, H.; Akira, S.; Minami, Y.: Mouse Ror2 receptor tyrosine kinase is required for the heart development and limb formation. Genes Cells 5:71-78, 2000.

van Bokhoven, H.; Brunner, H. G.: Splitting p63. Am. J. Hum. Genet. 71:1-13, 2002.

Jaffrey, S. R.; Snyder, S. H.: PIN: an associated protein inhibitor of neuronal nitric oxide synthase. Science 274:774-777, 1996.

Garkavtsev, I.; Demetrick, D.; Riabowol, K.: Cellular localization and chromosome mapping of a novel candidate tumor suppressor gene (ING1). Cytogenet. Cell Genet. 76:176-178, 1997.

Garkavtsev, I.; Kazarov, A.; Gudkov, A.; Riabowol, K.: Suppression of the novel growth inhibitor p33 (ING1) promotes neoplastic transformation. Nature Genet. 14:415-420, 1996. Note: Erratum: Nature Genet. 23:373 only, 1999.

Saito, A.; Furukawa, T.; Fukushige, S.; Koyama, S.; Hoshi, M.; Hayashi, Y.; Horii, A.: p24/ING1-ALT1 and p47/ING1-ALT2, distinct alternative transcripts of p33/ING1. J. Hum. Genet. 45:177-181,2000.

Zeremski, M.; Horrigan, S. K.; Grigorian, I. A.; Westbrook, C. A.; Gudkov, A. V.: Localization of the candidate tumor suppressor gene ING1 to human chromosome 13q34. Somat. Cell Molec. Genet. 23:233-236, 1997.

Gilligan, D. M.; Lozovatsky, L.; Gwynn, B.; Brugnara, C.; Mohandas, N.; Peters, L. L.: Targeted disruption of the beta adducin gene (Add2) causes red blood cell spherocytosis in mice. Proc. Nat. Acad. Sci. 96:10717-10722, 1999.

Katagiri, T.; Ozaki, K.; Fujiwara, T.; Shimizu, F.; Kawai, A.; Okuno, S.; Suzuki, M.; Nakamura, Y.; Takahashi, E.; Hirai, Y.: Cloning, expression and chromosome mapping of adducin-like 70 (ADDL), a human C DNA highly homologous to human erythrocyte adducin. Cytogenet. Cell Genet. 74:90-95, 1996.

Pichaud, F.; Delage-Mourroux, R.; Pidoux, E.; Jullienne, A.; Rousseau-Merck, M.-F.: Chromosomal localization of the type-I 15-PGDH gene to 4q34-q35. Hum. Genet. 99:279-281, 1997.

Walder, K.; Norman, R. A.; Hanson, R. L.; Schrauwen, P.; Neverova, M.; Jenkinson, C. P.; Easlick, J.; Warden, C. H.; Pecqueur, C.; Raimbault, S.; Ricquier, D.; Harper, M.; Silver, K.; Shuldiner, A. R.; Solanes, G.; Lowell, B. B.; Chung, W. K.; Leibel, R. L.; Pratley, R.; Ravussin, E.: Association between uncoupling protein polymorphisms (UCP2-UCP3) and energy metabolism/obesity in Pima Indians. Hum. Molec. Genet. 7:1431-1435, 1998.

Corneliussen, B.; Thornell, A.; Hallberg, B.; Grundstrom, T.:Helix-loop-helix transcriptional activators bind to a sequence in glucocorticoid response elements of retrovirus enhancers. J. Virol. 65:6084-6093, 1991.

Henthorn, P.; McCarrick-Walmsley, R.; Kadesch, T.: Sequence of the cDNA encoding ITF-2, a positive-acting transcription factor. Nucleic Acids Res. 18:678, 1990.

Takai, S.; Hinoda, Y.; Adachi, T.; Imai, K.; Oshima, M.: A human UPD (sic)-GalNAc: polypeptide, N-acetylgalactosaminyl transferase type1 gene is located at the chromosomal region 18q12.1. Hum. Genet. 99:293-294, 1997.

White, T.; Bennett, E. P.; Takio, K.; Sorensen, T.; Bonding, N.; Clausen, H.: Purification and cDNA cloning of a human UDP-N-acetyl-alpha-D-galactosamine:polypeptideN-acetylgalactosaminyl transferase. J. Biol. Chem. 270:24156-24165,1995.

Candau, R.; Moore, P. A.; Wang, L.; Barlev, N.; Ying, C. Y.; Rosen, C. A.; Berger, S. L.: Identification of human proteins functionally conserved with the yeast putative adaptors ADA2 and GCN5. Molec. Cell. Biol. 16:593-602, 1996.

Carter, K. C.; Wang, L.; Shell, B. K.; Zamir, I.; Berger, S. L.; Moore, P. A.: The human transcriptional adaptor genes TADA2L and GCN5L2 colocalize to chromosome 17q12-q21 and display a similar tissue expression pattern. Genomics 40:497-500, 1997.

Ogryzko, V. V.; Kotani, T.; Zhang, X.; Schiltz, R. L.; Howard, T.; Yang, X.-J.; Howard, B. H.; Qin, J.; Nakatani, Y.: Histone-like TAFs within the PCAF histone acetylase complex. Cell 94:35-44,1998.

Struhl, K.; Moqtaderi, Z.: The TAFs in the HAT. Cell 94:1-4,1998.

Imhof, M. O.; McDonnell, D. P.: Yeast RSP5 and its human homolog hRPF1 potentiate hormone-dependent activation of transcription by human progesterone and glucocorticoid receptors. Molec. Cell. Biol. 16:2594-2605, 1996.

Kumar, S.; Harvey, K. F.; Kinoshita, M.; Copeland, N. G.; Noda, M.; Jenkins, N. A.: cDNA cloning, expression analysis, and mapping of the mouse Nedd4 gene. Genomics 40:435-443, 1997.

Collum, R. G.; Fisher, P. E.; Datta, M.; Mellis, S.; Thiele, C.; Huebner, K.; Croce, C. M.; Israel, M. A.; Theil, T.: Moroy, T.; DePinho, R.; Alt, F. W.: A novel POU homeodomain gene specifically expressed in cells of the developing mammalian nervous system. Nucleic Acids Res. 20:4919-4925, 1992.

Gerrero, M. R.; McEvilly, R. J.; Turner, E.; Lin, C. R.; O'Connell, S.; Jenne, K. J.; Hobbs, M. V.; Rosenfeld, M. G.: Brn-3.0: a POU-domain protein expressed in the sensory immune and endocrine systems that functions on elements distinct from known octamer motifs. Proc. Nat. Acad. Sci. 90:10841-10845, 1993.

Still, I. H.; Cowell, J.: The Brn-3a transcription factor gene (POU4F1) maps close to the locus for the variant late infantile form of neuronal ceroid-lipofuscinosis. Cytogenet. Cell Genet. 74:225-226,1996.

Block, M. R.; Glick, B. S.; Wilcox, C. A.; Wieland, F. T.; Rothman, J. E.: Purification of an N-ethylmaleimide-sensitive protein catalyzing vesicular transport. Proc. Nat. Acad. Sci. 85:7852-7856, 1988.

Glick, B. S.; Rothman, J. E.: Possible role for fatty acyl-coenzyme A in intracellular protein transport. Nature 326: 309-312, 1987.

Hoyle, J.; Phelan, J. P.; Bermingham, N.; Fisher, E. M. C.: Localization of human and mouse N-ethylmaleimide-sensitive factor (NSF) gene: a two-domain member of the AAA family that is involved in membrane fusion. Mammalian Genome 7:850-852, 1996.

Rothman, J. E.: Mechanisms of intracellular protein transport. Nature 372:55-63, 1994.

Wilson, D. W.; Wilcox, C. A.; Flynn, G. C.; Chen, E.; Kuang, W.-J.; Henzel, W. J.; Block, M. R.; Ullrich, A.; Rothman, J. E.: A fusion protein required for vesicle-mediated transport in both mammalian cells and yeast. Nature 339:355-359, 1989.

Hiramoto, M.; Yoshida, H.; Imaizumi, T.; Yoshimizu, N.; Satoh, K.: A mutation in plasma platelet-activating factor acetylhydrolase (val279 to phe) is a genetic risk factor for stroke. Stroke 28:2417-2420, 1997.

Kruse, S.; Mao, X.-Q.; Heinzmann, A.; Blattmann, S.; Roberts, M. H.; Braun, S.; Gao, P.-S.; Forster, J.; Kuehr, J.; Hopkin, J. M.; Shirakawa, T.; Deichmann, K. A.: The ile198tothr and ala379 toval variants of plasmatic Paf-acetyl-hydrolase impair catalytical activities and are associated with atopy and asthma. Am. J. Hum. Genet. 66:1522-1530, 2000.

Miwa, M.; Miyake, T.; Yamanaka, T.; Sugatani, J.; Suzuki, Y.; Sakata, S.; Araki, Y.; Matsumoto, M.: Characterization of serum platelet-activating factor (PAF) acetylhydrolase: correlation between deficiency of serum PAF acetylhydrolase and respiratory symptoms in asthmatic children. J. Clin. Invest. 82:1983-1991, 1988.

Nadel, J. A.: Genetics reveals importance of platelet activating factor in asthma and possibly other inflammatory states. (Editorial) J. Clin. Invest. 97:2689-2690, 1996.

Packard, C. J.; O'Reilly, D. S. J.; Caslake, M. J.; McMahon, A. D.; Ford, I.; Cooney, J.; Macphee, C. H. Suckling, K. E.; Krishna, M.; Wilkinson, F. E.; Rumley, A.; Lowe, G. D. O.: Lipoprotein-associated phospholipase A2 as an independent predictor of coronary heart disease. New Eng. J. Med. 343:1148-1155, 2000.

Stafforini, D. M.; Numao, T.; Tsodikov, A.; Vaitkus, D.; Fukuda, T.; Watanabe, N.; Fueki, N.; McIntyre, T. M.; Zimmerman, G. A.; Makino, S.; Prescott, S. M.: Deficiency of platelet-activating factor acetylhydrolase is a severity factor for asthma. J. Clin. Invest. 103:989-997, 1999.

Tjoelker, L. W.; Wilder, C.; Eberhardt, C.; Stafforini, D. M.; Dietsch, G.; Schimpf, B.; Hooper, S.; Trong, H. L.; Cousens, L. S.; Zimmerman, G. A.; Yamada, Y.; McIntyre, T. M.; Prescott, S. M.; Gray, P. W.: Anti-inflammatory properties of a platelet-activating factor acetylhydrolase. Nature 374:549-553, 1995.

Stafforini, D. M.; Satoh, K.; Atkinson, D. L.; Tjoelker, L. W.; Eberhardt, C.; Yoshida, H.; Imaizumi, T.; Takamatsu, S.; Zimmerman, G. A.; McIntyre, T. M.; Gray, P. W.; Prescott, S. M.: Platelet-activating factor acetylhydrolase deficiency: a missense mutation near the active site of an anti-inflammatory phospholipase. J. Clin. Invest. 97:2784-2791, 1996.

Wjst, M.; Fischer, G.; Immervoll, T.; Jung, M.; Saar, K.; Rueschendorf, F.; Reis, A.; Ulbrecht, M.; Gomolka, M.; Weiss, E. H.; Jaeger, L.; Nickel, R.: A genome-wide search for linkage to asthma. Genomics 58:1-8, 1999.

Allikmets, R.; Gerrard, B.; Hutchinson, A.; Dean, M.: characterization of the human ABC superfamily: isolation and mapping of 21 new genes using the expressed sequence tags database. Hum. Molec. Genet. 5:1649-1655, 1996.

Bennett, E. P.; Hassan, H,.; Clausen, H.: cDNA cloning and expression of a novel human UDP-N-acetyl-alpha-D-galactosamine. J. Biol. Chem. 271:17006-17012, 1996.

Bennett, E. P.; Weghuis, D. O.; Merkx, G.; Geurts van Kessel, A.; Eiberg, H.; Clausen, H.: Genomic organization and chromosomal localization of three members of the UDP-N-acetylgalactosamine:polypeptide N-acetylgalactosaminyl transferase family. Glycobiology 8:547-555, 1998.

Zara, J.; Hagen, F. K.; Ten Hagen, K. G.; Van Wuyckhuyse, B. C.; Tabak, L. A.: Cloning and expression of mouse UDP-GalNAc:polypeptideN-acetylgalactosaminyl transferase-T3. Biochem. Biophys. Res. Commun. 228:38-44, 1996.

Zhao,Y.-Y.; Liu,Y.; Stan, R.-V.; Fan, L.; Gu,Y.; Dalton, N.; Chu, P.-H.; Peterson, K.; Ross, J., Jr.; Chien, K. R.: Defects in caveolin-1 cause dilated cardiomyopathy and pulmonary hypertension in knockout mice. Proc. Nat. Acad. Sci. 99:11375-11380, 2002.

Mok, S. C.; Wong, K.-K.; Chan, R. K. W.; Lau, C. C.; Tsao, S.-W.; Knapp, R. C.; Berkowitz, R. S.: Molecular cloning of differentially expressed genes in human epithelial ovarian cancer. Gynecol. Oncol. 52:247-252, 1994.

Xu, X.-X.; Yang, W.; Jackowski, S.; Rock, C. O.: Cloning of a novel phosphoprotein regulated by colony-stimulating factor 1 shares a domain with the Drosophila disabled gene product. J. Biol. Chem. 270:14184-14191, 1995.

Takahashi, T.; Fournier, A.; Nakamura, F.; Wang, L.-H.; Murakami, Y.; Kalb, R. G.; Fujisawa, H.; Strittmatter, S. M.: Plexin-neuropilin-1complexes form functional semaphorin-3A receptors. Cell 99:59-69,1999.

Santagata, S.; Boggon, T. J.; Baird, C. L.; Gomez, C. A.; Zhao, J.; Shan, W. S.; Myszka, D. G.; Shapiro, L.: G-protein signaling through tubby proteins. Science 292:2041-2050, 2001.

Sasaki, T.; Irie-Sasaki, J.; Horie,Y.; Bachmaier, K.; Fata, J. E.; Li, M.; Suzuki, A.; Bouchard, D.; Ho, A.; Redston, M.; Gallinger, S.; Khokha, R.; Mak, T. W.; Hawkins, P. T.; Stephens, L.; Scherer, S. W.; Tsao, M.; Penninger, J. M.: Colorectal carcinomas in mice lacking the catalytic subunit of PI(3)K-gamma. Nature 406:897-902,2000.

Sasaki, T.; Irie-Sasaki, J.; Jones, R. G.; Oliveira-dos-Santos, A. J.; Stanford, W. L.; Bolon, B.; Wakeham, A.; Itie, A.; Bouchard, D.; Kozieradzki, I.; Joza, N.; Mak, T. W.; Ohashi, P. S.; Suzuki, A.; Penninger, J. M.: Function of PI3K-gamma in thymocyte development, T cell activation, and neutrophil migration. Science 287:1040-1046,2000.

Stoyanov, B.; Volinia, S.; Hanck, T.; Rubio, I.; Loubtchenkov, M.; Malek, D.; Stoyanova, S.; Vanhaesebroeck, B.; Dhand, R.; Nurnberg, B.; Gierschik, P.; Seedorf, K.; Hsuan, J. J.; Waterfield, M. D.; Wetzker, R.: Cloning and characterization of a G protein-activated human phosphoinositide-3kinase. Science 269:690-693, 1995.

Hotten, G.; Neidhardt, H.; Schneider, C.; Pohl, J.: Cloning of a new member of the TGF-beta family: a putative new activin betaC chain. Biochem. Biophys. Res. Commun. 206: 608-613, 1995.

Ling, N.; Ying, S. Y.; Ueno, N.; Shimasaki, S.; Esch, F.; Hotta, M.; Guillemin, R.: Pituitary FSH is released by a heterodimer of the beta-subunits from the two forms of inhibin. Nature 321:779-782,1986.

Schmitt, J.; Hotten, G.; Jenkins, N. A.; Gilbert, D. J.; Copeland, N. G.; Pohl, J.; Schrewe, H.: Structure, chromosomal localization, and expression analysis of the mouse inhibin/activin betaC (Inhbc) gene. Genomics 32:358-366, 1996.

Albertsen, H. M.; Smith, S. A.; Melis, R.; Williams, B.; Holik, P.; Stevens, J.; White, R.: Sequence, genomic structure, and chromosomal assignment of human DOC-2. Genomics 33:207-213, 1996.

Mok, S. C.; Chan, W. Y.; Wong, K. K.; Cheung, K. K.; Lau, C. C.; Ng, S. W.; Baldini, A.; Colitti, C. V.; Rock, C. O.; Berkowitz, R. S.: DOC-2, a candidate tumor suppressor gene in human epithelial ovarian cancer. Oncogene 16:2381-2387, 1998.

Kimura, T.; Arakawa, Y.; Inoue, S.; Fukushima, Y.; Kondo, I.; Koyama, K.; Hosoi, T.; Orimo, A.; Muramatsu, M.; Nakamura, Y.; Abe, T.; Inazawa, J.: The brain finger protein gene (ZNF179), a member of the RING finger family, maps within the Smith-Magenis syndrome region at 17p11.2. Am. J. Med. Genet. 69:320-324, 1997.

Matsuda,Y.; Inue, S.; Seki, N.; Hosoi, T.; Orimo, A.; Muramatsu, M.; Hori, T.: Chromosome mapping of human (ZNF179), mouse, and rat genes for brain finger protein (bfp), a member of the RING finger family. Genomics 33:325-327, 1996.

Ambrose, H. J.; Blake, D. J.; Nawrotzki, R. A.; Davies, K. E.:Genomic organization of the mouse dystrobrevin gene: comparative analysis with the dystrophin gene. Genomics 39:359-369, 1997.

Blake, D. J.; Nawrotzki, R.; Loh, N. Y.; Gorecki, D. C.; Davies, K. E.: Beta-dystrobrevin, a member of the dystrophin-related protein family. Proc. Nat. Acad. Sci. 95:241-246, 1998.

Ichida, F.; Tsubata, S.; Bowles, K. R.; Haneda, N.; Uese, K.; Miyawaki, T.; Dreyer, W. J.; Messina, J.; Li, H.; Bowles, N. E.; Towbin, J. A.: Novel gene mutations in patients with left ventricular noncompaction or Barth syndrome. Circulation 103:1256-1263, 2001.

England, S. K.; Uebele, V. N.; Shear, H.; Kodali, J.; Bennett, P. B.; Tamkun, M. M.: Characterization of a voltage-gated K+ channel beta subunit expressed in human heart. Proc. Nat. Acad. Sci. 92:6309-6313, 1995.

Jones, J. M.; Bentley, E.; Meisler, M. H.; Darling, S. M.: Genetic mapping of the voltage-gated shaker potassium channel beta subunit Kcnab1 to mouse chromosome 3. Mammalian Genome 9:260 only, 1998.

Leicher, T.; Bahring, R.; Isbrandt, D.; Pongs, O.: Coexpression of the KCNA3B gene product with Kv1.5 leads to a novel A-type potassium channel. J. Biol. Chem. 273:35095-35101, 1998.

Leicher, T. Roeper, J.; Weber, K.; Wang, X.; Pongs, O.: Structural and functional characterization of human potassium channel subunit beta-1 (KCNA1B). Neuropharmacology 35:787-795, 1996.

McCormack, K.; McCormack, T.; Tanouye, M.; Rudy, B.; Stuhmer, W.: Alternative splicing of the human Shaker K+ channel beta-1 gene and functional expression of the beta-2 gene product. FEBS Lett. 370:32-36, 1995.

Schultz, D.; Litt, M.; Smith, L.; Thayer, M.; McCormack, K.: Localization of two potassium channel beta subunit genes, KCNA1B and KCNA2B. Genomics 31:389-391, 1996.

Collin, G. B.; Nishina, P. M.; Marshall, J. D.; Naggert, J. K.: Human DCTN1: genomic structure and evaluation as a candidate for Alstrom syndrome. Genomics 53:359-364, 1998.

Holzbaur, E. L. F.; Tokito, M. K.: Localization of the DCTN1 gene encoding p150(Glued) to human chromosome 2p13 by fluorescence in situ hybridization. Genomics 31:398-399, 1996.

Holzbaur, E. L. F.; Vallee, R. B.: Dyneins: molecular structure and cellular function. Ann. Rev. Cell Biol. 10:339-372, 1994.

Jang, W.; Weber, J. S.; Tokito, M. K.; Holzbaur, E. L. F.; Meisler, M. H.: Mouse p150(Glued) (dynactin 1) cDNA sequence and evaluation as a candidate for the neuromuscular disease mutation mnd2. Biochem. Biophys. Res. Commun. 231:344-347, 1997.

Korthaus, D.; Wedemeyer, N.; Lengeling, A.; Ronsiek, M.; Jockusch, H.; Schmitt-John, T.: Integrated radiation hybrid map of human chromosome 2p13: possible involvement of dynactin in neuromuscular diseases. Genomics 43:242-244, 1997.

Pushkin, A.; Abuladze, N.; Newman, D.; Tatishchev, S.; Kurtz, I.: Genomic organization of the DCTN1-SLC4A5 locus encoding both NBC4 and p150 (Glued). Cytogenet. Cell Genet. 95:163-168, 2001.

Miyata, A.; Hara, S.; Yokoyama, C.; Inoue, H.; Ullrich, V.; Tanabe, T.: Molecular cloning and expression of human prostacyclin synthase. Biochem. Biophys. Res. Commun. 200:1728-1734, 1994.

Inoue, H.; Ishii, H.; Alder, H.; Snyder, E.; Druck, T.; Huebner, K.; Croce, C. M.: Sequence of the FRA3B common fragile region: implications for the mechanism of FHIT deletion. Proc. Nat. Acad. Sci. 94:14584-14589,1997.

Morikawa, H.; Nakagawa, Y.; Hashimoto, K.; Niki, M.; Egashira, Y.; Hirata, I.; Katsu, K.; Akao, Y.: Frequent altered expression of fragile histidine triad protein in human colorectal adenomas. Biochem. Biophys. Res. Commun. 278:205-210, 2000.

Nelson, D. R.; Koymans, L.; Kamataki, T.; Stegeman, J. J.; Feyereisen, R.; Waxman, D. J.; Waterman, M. R.; Gotoh, O.; Coon, M. J.; Estabrook, R. W.; Gunsalus, I. C.; Nebert, D. W.: P450 superfamily: update on new sequences, gene mapping, accession numbers and nomenclature. Pharmacogenetics 6:1-42, 1996.

Wang, L.-H.; Chen, L.: Organization of the gene encoding human prostacyclin synthase. Biochem. Biophys. Res. Commun. 226:631-637,1996.

Yokoyama, C.; Yabuki, T.; Inoue, H.; Tone, Y.; Hara, S.; Hatae, T.; Nagata, M.; Takahashi, E.-I.; Tanabe, T.: Human gene encoding prostacyclin synthase (PTGIS): genomic organization, chromosomal localization, and promoter activity. Genomics 36:296-304, 1996.

Brindle, N. P. J.; Holt, M. R.; Davies, J. E.; Price, C. J.; Critchley, D. R.: The focal-adhesion vasodilator-stimulated phosphoprotein (VASP) binds to the proline-rich domain in vinculin. Biochem. J. 318:753-757,1996.

Haffner, C.; Jarchau, T.; Reinhard, M.; Hoppe, J.; Lohmann, S. M.; Walter, V.: Molecular cloning, structural analysis and functional expression of the proline-rich focal adhesion and microfilament-associated protein VASP. EMBO J. 14:19-27, 1995.

Zimmer, M.; Fink, T.; Fischer, L.; Hauser, W.; Scherer, K.; Lichter, P.; Walter, U.: Cloning of the VASP (vasodilator-stimulated phosphoprotein) genes in human and mouse: structure, sequence, and chromosomal localization. Genomics 36:227-233, 1996.

Hackam, A. S.; Yassa, A. S.; Singaraja, R.; Metzler, M.; Gutekunst, C.-A.; Gan, L.; Warby, S.; Wellington, C. L.; Vaillancourt, J.; Chen, N.; Gervais, F. G.; Raymond, L.; Nicholson, D. W.; Hayden, M. R.:Huntingtin interacting protein 1 induces apoptosis via a novel caspase-dependent death effector domain. J. Biol. Chem. 275:41299-41308, 2000.

Himmelbauer, H.; Wedemeyer, N.; Haaf, T.; Wanker, E. E.; Schalkwyk, L. C.; Lehrach, H.: IRS-PCR-based genetic mapping of the huntingtin interacting protein gene (HIP1) on mouse chromosome 5. Mammalian Genome 9:26-31, 1998.

Kanai, N.; Lu, R.; Satriano, J. A.; Bao, Y.; Wolkoff, A. W.; Schuster, V. L.: Identification and characterization of a prostaglandin transporter. Science 268:866-869, 1995.

Lu, R.; Kanai, N.; Bao, Y.; Schuster, V. L.: Cloning, in vitro expression, and tissue distribution of a human prostaglandin transporter cDNA (hPGT). J. Clin. Invest. 98:1142-1149, 1996.

Lu, R.; Schuster, V. L.: Molecular cloning of the gene for the human prostaglandin transporter hPGT: gene organization, promoter activity, and chromosomal localization. Biochem. Biophys. Res. Commun. 246:805-812, 1998.

Loughna, S.; Sato, T. N.: A combinatorial role of angiopoietin-1 and orphan receptor TIE1 pathways in establishing vascular polarity during angiogenesis. Molec. Cell 7:233-239, 2001.

Tafuri, A.; Shahinian, A.; Bladt, F.; Yoshinaga, S. K.; Jordana, M.; Wakeham, A.; Boucher, L.-M.; Bouchard, D.; Chan, V. S. F.; Duncan, G.; Odermatt, B.; Ho, A.; Itie, A.; Horan, T.; Whoriskey, J. S.; Pawson, T.; Penninger, J. M.; Ohashi, P. S.; Mak, T. W.: ICOS is essential for effective T-helper-cell responses. Nature 409:105-109, 2001.

Yoshinaga, S. K.; Whoriskey, J. S.; Khare, S. D.; Sarmiento, U.; Guo, J.; Horan, T.; Shih, G.; Zhang, M.; Coccia, M. A.; Kohno, T.; Tafuri-Bladt, A.; Brankow, D.; and 14 others: T-cell co-stimulation through B7RP-1 and ICOS. Nature 402:827-832, 1999.

Paige, A. J. W.; Taylor, K. J.; Taylor, C.; Hillier, S. G.; Farrington, S.; Scott, D.; Porteous, D. J.; Smyth, J. F.; Gabra, H.; Watson, J. E. V.: WWOX: a candidate tumor suppressor gene involved in multiple tumor types. Proc. Nat. Acad. Sci. 98:11417-11422, 2001.

Ried, K.; Finnis, M.; Hobson, L.; Mangelsdorf, M.; Dayan, S.; Nancarrow, J. K.; Woollatt, E.; Kremmidiotis, G.; Gardner, A.; Venter, D.; Baker, E.; Richards, R. I.: Common chromosomal fragile site FRA16D sequence:identification of the FOR gene spanning FRA16D and homozygous deletions and translocation breakpoints in cancer cells. Hum. Molec. Genet. 9:1651-1663, 2000.

Clark, S. W.; Staub, O.; Clark, I. B.; Holzbaur, E. L. F.; Paschal, B. M.; Vallee, R. B.; Meyer, D. I.: Beta-centractin: characterization and distribution of a new member of the centractin family of actin-related proteins. Molec. Biol. Cell 5:1301-1310, 1994.

Elsea, S. H.; Clark, I. B.; Juyal, R. C.; Meyer, D. J.; Meyer, D. I.; Patel, P. I.: Assignment of beta-centractin (CTRN2) to human chromosome 2 bands q11.1-q11.2 with somatic cell hybrids and in situ hybridization. Cytogenet. Cell Genet. 84:48-49, 1999.

Ho, A. M.; Johnson, M. D.; Kingsley, D. M.: Role of the mouse ank gene in control of tissue calcification and arthritis. Science 289:265-270, 2000.

Yu, H.; Peters, J.-M.; King, R. W.; Page, A. M.; Hieter, P.; Kirschner, M. W.: Identification of a cullin homology region in a subunit of the anaphase-promoting complex. Science 279:1219-1222, 1998.

Zhao, N.; Lai, F.; Fernald, A. A.; Eisenbart, J. D.; Espinosa, R., III.; Wang, P. W.; Le Beau, M. M.: Human CDC23: cDNA cloning, mapping to 5q31, genomic structure, and evaluation as a candidate tumor suppressor gene in myeloid leukemias. Genomics 53:184-190,1998.

Brambilla, R.; Draetta, G.: Molecular cloning of PISSLRE, a novel putative member of the cdk family of protein serine/threonine kinases. Oncogene 9:3037-3041, 1994.

Grana, X.; Claudio, P. P.; De Luca, A.; Sang, N.; Giordano, A.: PISSLRE, a human novel CDC2-related protein kinase. Oncogene 9:2097-2103, 1994.

Underwood, K. W.; Song, C.; Kriz, R. W.; Chang, X. J.; Knopf, J. L.; Lin, L.-L.: A novel calcium-independent phospholipase A(2), cPLA(2)-gamma, that is prenylated and contains homology to cPLA(2). J. Biol. Chem. 273:21926-21932, 1998.

Deak, M.; Clifton, A. D.; Lucocq, J. M.; Alessi, D. R.: Mitogen-and stress-activated protein kinase-1 (MSK1) is directly activated by MAPK and SAPK2/p38, and may mediate activation of CREB. EMBO J. 17:4426-4441, 1998.

Jiang, C.; Yu, L.; Tu, Q.; Zhao, Y.; Zhang, H.; Zhao, S.: Assignment of a member of the ribosomal protein S6 kinase family, RPS6KA5, to human chromosome 14q31-q32.1 by radiation hybrid mapping. Cytogenet. Cell Genet. 87:261-261, 1999.

Ackerman, S. L.; Knowles, B. B.: Cloning and mapping of the UNC5C gene to human chromosome 4q21-q23. Genomics 52:205-208, 1998.

Ackerman, S. L.; Kozak, L. P.; Przyborski, S. A.; Rund, L. A.; Boyer, B. B.; Knowles, B. B.: The mouse rostral cerebellar malformation gene encodes an UNC-5-like protein. Nature 386:838-842, 1997.

Lane, P. W.; Bronson, R. T.; Spencer, C. A.: Rostral cerebellar malformation, (rcm): a new recessive mutation on chromosome 3 of themouse. J. Hered. 83:315-318, 1992.

Leonardo, E. D.; Hinck, L.; Masu, M.; Keino-Masu, K.; Ackerman, S. L.; Tessier-Lavigne, M.: Vertebrate homologues of C. elegans UNC-5 are candidate netrin receptors. Nature 386:833-838, 1997.

Przyborski, S. A.; Knowles, B. B.; Ackerman, S. L.: Embryonic phenotype of Unc5h3 mutant mice suggests chemorepulsion during the formation of the rostral cerebellar boundary. Development 125:41-50,1998.

Marsters, S. A.; Sheridan, J. P.; Pitti, R. M.; Huang, A.; Skubatch, M.; Baldwin, D.; Yuan, J.; Gurney, A.; Goddard, A. D.; Godowski, P.; Ashkenazi, A.: A novel receptor for Apo2L/TRAIL contains a truncated death domain. Curr. Biol. 7:1003-1006, 1997.

MacFarlane, M.; Ahmad, M.; Srinivasula, S. M.; Fernandes-Alnemri, T.; Cohen, G. M.; Alnemri, E. S.: Identification and molecular cloning of two novel receptors for the cytotoxic ligand TRAIL. J. Biol. Chem. 272:25417-25420, 1997.

Pai, S. I.; Wu, G. S.; Ozoren, N.; Wu, L.; Jen, J.; Sidransky, D.; El-Deiry, W. S.: Rare loss-of-function mutation of a death receptor gene in head and neck cancer. Cancer Res. 58:3513-3518, 1998.

Pan, G.; Ni, J.; Wei, Y.-F.; Yu, G.; Gentz, R.; Dixit, V. M.: An antagonist decoy receptor and a death domain-containing receptor for TRAIL. Science 277:815-818, 1997.

Schneider, P.; Bodmer, J.-L.; Thome, M.; Hofmann, K.; Holler, N.; Tschopp, J.: Characterization of two receptors for TRAIL. FEBS Lett. 416:329-334, 1997.

Screaton, G. R.; Mongkolsapaya, J.; Xu, X.-N.; Cowper, A. E.; McMichael, A. J.; Bell, J. I.: TRICK2, a new alternatively spliced receptor that transduces the cytotoxic signal from TRAIL. Curr. Biol. 7:693-696, 1997.

Sheridan, J. P.; Marsters, S. A.; Pitti, R. M.; Gurney, A.; Skubatch, M.; Baldwin, D.; Ramakrishnan, L.; Gray, C. L.; Baker, K.; Wood, W. I.; Goddard, A. D.; Godowski, P.; Ashkenazi, A.: Control of TRAIL-induced apoptosis by a family of signaling and decoy receptors. Science 277:818-821, 1997.

Boeglin, W. E.; Kim, R. B.; Brash, A. R.: A 12R-lipoxygenase in human skin: mechanistic evidence, molecular cloning, and expression. Proc. Nat. Acad. Sci. 95:6744-6749, 1998.

Sun, D.; McDonnell, M.; Chen, X.-S.; Lakkis, M. M.; Li, H.; Isaacs, S. N.; Elsea, S. H.; Patel, P. I.; Funk, C. D.: Human 12(R)-lipoxygenase and the mouse ortholog: molecular cloning, expression, and gene chromosomal assignment. J. Biol. Chem. 273:33540-33547, 1998.

Duchateau, P. N.; Pullinger, C. R.; Cho, M. H.; Eng, C.; Kane, J. P.: Apolipoprotein L gene family: tissue-specific expression, splicing, promoter regions; discovery of a new gene. J. Lipid Res. 42:620-630, 2001.

Duchateau, P. N.; Pullinger, C. R.; Orellana, R. E.; Kunitake, S. T.; Naya-Vigne, J.; O'Connor, P. M.; Malloy, M. J.; Kane, J. P.: Apolipoprotein L, a new human high density lipoprotein apolipoprotein expressed by the pancreas: identification, cloning, characterization, and plasma distribution of apolipoprotein L. J. Biol. Chem. 272:25576-25582, 1997.

Monajemi, H.; Fontijn, R. D.; Pannekoek, H.; Horrevoets, A. J. G.: The apolipoprotein L gene cluster has emerged recently in evolution and is expressed in human vascular tissue. Genomics 79:539-546,2002.

Page, N. M.; Butlin, D. J.; Lomthaisong, K.; Lowry, P. J.: The human apolipoprotein L gene cluster: identification, classification, and sites of distribution. Genomics 74:71-78, 2001.

Lin, C.-Y.; Huang, P.-H.; Liao, W.-L.; Cheng, H.-J.; Huang, C.-F.; Kuo, J.-C.; Patton, W. A.; Massenburg, D.; Moss, J.; Lee, F.-J. S.: ARL4, an ARF-like protein that is developmentally regulated and localized to nuclei and nucleoli. J. Biol. Chem. 275:37815-37823,2000.

Schurmann, A.; Breiner, M.; Becker, W.; Huppertz, C.; Kainulainen, H.; Kentrup, H.; Joost, H.-G.: Cloning of two novel ADP-ribosylation factor-like proteins and characterization of their differential expression in 3T3-L1 cells. J. Biol. Chem. 269:15683-15688, 1994.

Schurmann, A.; Koling, S.; Jacobs, S.; Saftig, P.; Kraub, S.; Wennemuth, G.; Kluge, R.; Joost, H.-G.: Reduced sperm count and normal fertility in male mice with targeted disruption of the ADP-ribosylation factor-like 4 (Arl4) gene. Molec. Cell. Biol. 22:2761-2768, 2002.

Lehnert, K.; Ni, J.; Leung, E.; Gough, S. M.; Weaver, A.; Yao, W.-P.; Liu, D.; Wang, S.-X.; Morris, C. M.; Krissansen, G. W.: Cloning, sequence analysis, and chromosomal localization of the novel human integrin alpha-11 subunit (ITGA11). Genomics 60:179-187, 1999.

Velling, T.; Kusche-Gullberg, M.; Sejersen, T.; Gullberg, D.: cDNA cloning and chromosomal localization of human alpha-11 integrin: a collagen-binding, I domain-containing, beta-1-associated integrin alpha-chain present in muscle tissues. J. Biol. Chem. 274:25735-25742,1999.

Mital, R.; Kobayashi, R.; Hernandez, N.: RNA polymerase III transcription from the human U6 and adenovirus type 2 VAI promoters has different requirements for human BRF, a subunit of human TFIIIB. Molec. Cell. Biol. 16:7031-7042, 1996.

Wang, Z.; Roeder, R. G.: Structure and function of a human transcription factor TFIIIB subunit that is evolutionarily conserved and contains both TFIIB- and high-mobility-group protein 2-related domains. Proc. Nat. Acad. Sci. 92:7026-7030, 1995.

Comai, L.; Zomerdijk, J. C. B. M.; Beckmann, H.; Zhou, S.; Admon, A.; Tjian, R.: Reconstitution of transcription factor SL1: exclusive binding of TBP by SL1 or TFIID subunits. Science 266:1966-1972, 1994.

Di Pietro, C.; Rapisarda, A.; Amico, V.; Bonaiuto, C.; Viola, A.; Scalia, M.; Motta, S.; Amato, A.; Engel, H.; Messina, A.; Sichel, G.; Grzeschik, K.-H.; Purrello, M.: Genomic localization of the human genes TAF1A, TAF1B and TAF1C, encoding TAFI48, TAFI63 and TAFI110subunits of class I general transcription initiation factor SL1. Cytogenet. Cell Genet. 89:133-136, 2000.

Nakamura, T.; Takeuchi, K.; Muraoka, S.; Takezoe, H.; Takahashi, N.; Mori, N.: A neurally enriched coronin-like protein, ClipnC, is a novel candidate for an actin cytoskeleton-cortical membrane-linking protein. J. Biol. Chem. 274: 13322-13327, 1999.

Kim, K. I.; Baek, S. H.; Jeon, Y.-J.; Nishimori, S.; Suzuki, T.; Uchida, S.; Shimbara, N.; Saitoh, H.; Tanaka, K.; Chung, C. H.: A new SUMO-1-specific protease, SUSP1, that is highly expressed in reproductive organs. J. Biol. Chem. 275: 14102-14106, 2000.

Saitoh, T.; Moriwaki, J.; Koike, J.; Takagi, A.; Miwa, T.; Shiokawa, K.; Katoh, M.: Molecular cloning and characterization of FRAT2, encoding a positive regulator of the WNT signaling pathway. Biochem. Biophys. Res. Commun. 281: 815-820, 2001.

Abbaszade, I.; Liu, R.-Q.; Yang, F.; Rosenfeld, S. A.; Ross, O. H.; Link, J. R.; Ellis, D. M.; Tortorella, M. D.; Pratta, M. A.; Hollis, J. M.; Wynn, R.; Duke, J. L.; and 15 others: Cloning and characterization of ADAMTS11, an aggrecanase from the ADAMTS family. J. Biol. Chem. 274:23443-23450, 1999.

Ellison, J.; Passage, M.; Yu, L.-C.; Yen, P.; Mohandas, T. K.; Shapiro, L.: Directed isolation of human genes that escape X inactivation. Somat. Cell Molec. Genet. 18:259-268, 1992.

Ellison, J. W.; Ramos, C.; Yen, P. H.; Shapiro, L. J.: Structure and expression of the human pseudoautosomal gene XE7. Hum. Molec. Genet. 1:691-696, 1992.

Hagiwara, T.; Tanaka, K.; Takai, S.; Maeno-Hikichi, Y.; Mukainaka, Y.; Wada, K.: Genomic organization, promoter analysis, and chromosomal localization of the gene for the mouse glial high-affinity glutamate transporter Slc1a3. Genomics 33:508-515, 1996.

Harada, T.; Harada, C.; Watanabe, M.; Inoue, Y.; Sakagawa, T.; Nakayama, N.; Sasaki, S.; Okuyama, S.; Watase, K.; Wada, K.; Tanaka, K.: Functions of the two glutamate transporters GLAST and GLT-1 in the retina. Proc. Nat. Acad. Sci. 95:4663-4666, 1998.

Keppen, L. D.; Gollin, S. M.; Edwards, D.; Sawyer, J.; Wilson, W.; Overhauser, J.: Clinical phenotype and molecular analysis of a three-generation family with an interstitial deletion of the short arm of chromosome 5. Am. J. Med. Genet. 44:356-360, 1992.

Kirschner, M. A.; Arriza, J. L.; Copeland, N. G.; Gilbert, D. J.; Jenkins, N. A.; Magenis, E.; Amara, S. G.: The mouse and human excitatory amino acid transporter gene (EAAT1) maps to mouse chromosome 15 and a region of syntenic homology on human chromosome 5. Genomics 22:631-633, 1994.

Shashidharan, P.; Huntley, G. W.; Meyer, T.; Morrison, J. H.; Plaitakis, A.: Neuron-specific human glutamate transporter: molecular cloning, characterization and expression in human brain. Brain Res. 662:245-250, 1994.

Stoffel, W.; Sasse, J.; Duker, M.; Muller, R.; Hofmann, K.; Fink, T.; Lichter, P.: Human high affinity, Na (+)-dependent L-glutamate/L-aspartate transporter GLAST-1 (EAAT-1): gene structure and localization to chromosome 5p11-p12. FEBS Lett. 386:189-193, 1996.

Takai, S.; Yamada, K.; Kawakami, H.; Tanaka, K.; Nakamura, S.: Localization of the gene (SLC1A3) encoding human glutamate transporter (GluT-1) to 5p13 by fluorescence in situ hybridization. Cytogenet. Cell Genet. 69:209-210, 1995.

Agulnik, A. I.; Mitchell, M. J.; Lerner, J. L.; Woods, D. R.; Bishop, C. E.: A mouse Y chromosome gene encoded by a region essential for spermatogenesis and expression of male-specific minor histocompatibility antigens. Hum. Molec. Genet. 3:873-878, 1994.

Agulnik, A. I.; Mitchell, M. J.; Mattei, M.-G.; Borsani, G.; Avner, P. A.; Lerner, J. L.; Bishop, C. E.: A novel X gene with a widely transcribed Y-linked homologue escapes X-inactivation in mouse and human. Hum. Molec. Genet. 3:879-884, 1994.

Lingenfelter, P. A.; Adler, D. A.; Poslinski, D.; Thomas, S.; Elliott, R. W.; Chapman, V. M.; Disteche, C. M.: Escape from X inactivation of Smcx is preceded by silencing during mouse development. Nature Genet. 18:212-213, 1998.

Wu, J.; Ellison, J.; Salido, E.; Yen, P.; Mohandas, T.; Shapiro, L. J.: Isolation and characterization of XE169, a novel human gene that escapes X-inactivation. Hum. Molec. Genet. 3:153-160, 1994.

Wu, J.; Salido, E. C.; Yen, P. H.; Mohandas, T. K.; Heng, H. H. Q.; Tsui, L.-C.; Park, J.; Chapman, V. M.; Shapiro, L. J.: The murine Xe169 gene escapes X-inactivation like its human homologue. Nature Genet. 7:491-496, 1994.

Hu, X.; Burghes, A. H. M.; Ray, P. N.; Thompson, M. W.; Murphy, E. G.; Worton, R. G.: Partial gene duplication in Duchenne and Becker muscular dystrophies. J. Med. Genet. 25:369-376, 1988.

Berger, W.; van de Pol, D.; Warburg, M.; Gal, A.; Bleeker-Wagemakers, L.; de Silva, H.; Meindl, A.; Meitinger, T.; Cremers, F.; Ropers, H.-H.: Mutations in the candidate gene for Norrie disease. Hum. Molec. Genet. 1:461-465, 1992.

Bleeker-Wagemakers, L. M.; Friedrich, U.; Gal, A.; Wienker, T. F.; Warburg, M.; Ropers, H.-H.: Close linkage between Norrie disease, a cloned DNA sequence from the proximal short arm, and the centromere of the X chromosome. Hum. Genet. 71:211-214, 1985.

Chen, Z.-Y.; Battinelli, E. M.; Hendriks, R. W.; Powell, J. F.; Middleton-Price, H.; Sims, K. B.; Breakefield, X. O.; Craig, I. W.: Norrie disease gene: characterization of deletions and possible function. Genomics 16:533-535, 1993.

Chen, Z.-Y.; Battinelli, E. M.; Woodruff, G.; Young, I.; Breakefield, X. O.; Craig, I. W.: Characterization of a mutation within the NDP gene in a family with a manifesting female carrier. Hum. Molec. Genet. 2:1727-1729, 1993.

Chen, Z.-Y.; Hendriks, R. W.; Jobling, M. A.; Powell, J. F.; Breakefield, X. O.; Sims, K. B.; Craig, I. W.: Isolation and characterization of a candidate gene for Norrie disease. Nature Genet. 1:204-208, 1992.

Chen, Z.-Y.; Sims, K. B.; Coleman, M.; Donnai, D.; Monaco, A.; Breakefield, X. O.; Davies, K. E.; Craig, I. W.: characterization of a YAC containing part or all of the Norrie disease locus. Hum. Molec. Genet. 1:161-164, 1992.

Clarke, E.: 'Pseudo-glioma' in both eyes. Trans. Ophthal. Soc. U. K. 18:136-138, 1898.

Dahlberg-Parrow, R.: Congenital sex-linked pseudoglioma and grave mental deficiency. Acta Ophthal. 34:250-254, 1956.

Diergaarde, P. J.; Wieringa, B.; Bleeker-Wagemakers, E. M.; Sims, K. B.; Breakefield, X. O.; Ropers, H.-H.: Physical fine-mapping of a deletion spanning the Norrie gene. Hum. Genet. 84:22-26, 1989.

Donnai, D.; Mountford, R. C.; Read, A. P.: Norrie disease resulting from a gene deletion: clinical features and DNA studies. J. Med. Genet. 25:73-78, 1988.

Duke-Elder, J. R.: Pseudoglioma in children: aspects of clinical and pathological diagnosis. Sth. Med. J. 51:754-759, 1958.

Forssman, H.: Mental deficiency and pseudoglioma, a syndrome inherited as an X-linked recessive. Am. J. Ment. Defic. 64:984-987,1960.

Fuchs, S.; Kellner, U.; Wedemann, H.; Gal, A.: Missense mutation (Arg121Trp) in the Norrie disease gene associated with X-linked exudative vitreoretinopathy. Hum. Mutat. 6:257-259, 1995.

Fuchs, S.; Xu, S. Y.; Caballero, M.; Salcedo, M.; La O, A.; Wedemann, H.; Gal, A.: A missense point mutation (Leu13Arg) of the Norrie disease gene in a large Cuban kindred with Norrie disease. Hum. Molec. Genet. 3:655-656, 1994.

Collins, F. A.; Murphy, D. L.; Reiss, A. L.; Sims, K. B.; Lewis, J. G.; Freund, L.; Karoum, F.; Zhu, D.; Maumenee, I. H.; Antonarakis, S. E.: Clinical, biochemical, and neuropsychiatric evaluation of a patient with a contiguous gene syndrome due to a microdeletion Xp11.3 including the Norrie disease locus and monoamine oxidase (MAOA andMAOB) genes. Am. J. Med. Genet. 42:127-134, 1992.

Fullwood, P.; Jones, J.; Bundey, S.; Dudgeon, J.; Fielder, A. R.; Kilpatrick, M. W.: X linked exudative vitreoretinopathy: clinical features and genetic linkage analysis. Brit. J. Ophthal. 77:168-170,1993.

Gal, A.; Bleeker-Wagemakers, L.; Wienker, T. F.; Warburg, M.; Ropers, H.-H.: Localization of the gene for Norrie disease by linkage to the DXS7 locus. (Abstract) Cytogenet. Cell Genet. 40:633, 1985.

Gal, A.; Stolzenberger, C.; Wienker, T.; Wieacker, P.; Ropers, H.-H.; Friedrich, U.; Bleeker-Wagemakers, L.; Pearson, P.; Warburg, M.: Norrie's disease: close linkage with genetic markers from the proximal short arm of the X chromosome. Clin. Genet. 27:282-283,1985.

Gal, A.; Uhlhaas, S.; Glaser, D.; Grimm, T.: Prenatal exclusion of Norrie disease with flanking DNA markers. Am. J. Med. Genet. 31:449-453, 1988.

Harendra de Silva, D. G.; de Silva, D. B. K.: Norrie's disease in an Asian family. Brit. J. Ophthal. 72:62-64, 1988.

Bermingham, N. A.; Martin, J. E.; Fisher, E. M. C.: The mouse lysosomal membrane protein 1 gene as a candidate for the motorneuron degeneration (mnd) locus. Genomics 32:266-271, 1996.

Howe, C. L.; Granger, B. L.; Hull, M.; Green, S. A.; Gabel, C. A.; Helenius, A.; Mellman, I.: Derived protein sequence, oligosaccharides, and membrane insertion of the 120-kDa lysosomal membrane glycoprotein (lgp120): identification of a highly conserved family of lysosomal membrane glycoproteins. Proc. Nat. Acad. Sci. 85:7577-7581, 1988.

Mattei, M.-G.; Matterson, J.; Chen, J. W.; Williams, M. A.; Fukuda, M.: Two human lysosomal membrane glycoproteins, h-lamp-1 and h-lamp-2, are encoded by genes localized to chromosome 13q34 and chromosome Xq24-25, respectively. J. Biol. Chem. 265:7548-7551, 1990.

Schleutker, J.; Haataja, L.; Renlund, M.; Puhakka, L.; Viitala, J.; Peltonen, L.; Aula, P.: Confirmation of the chromosomal localization of human lamp genes and their exclusion as candidate genes for Salla disease. Hum. Genet. 88:95-97, 1991.

Viitala, J.; Carlsson, S. R.; Siebert, P. D.; Fukuda, M.: molecular cloning of cDNAs encoding lamp A, a human lysosomal membrane glycoprotein with apparent M(r) about 120,000. Proc. Nat. Acad. Sci. 85:3743-3747,1988.

Andreae, S.; Piras, F.; Burdin, N.; Triebel, F.: Maturation and activation of dendritic cells induced by lymphocyte activation gene-3(CD223). J. Immun. 168:3874-3880, 2002.

Triebel, F.; Jitsukawa, S.; Baixeras, E.; Roman-Roman, S.; Genevee, C.; Viegas-Pequignot, E.; Hercend, T.: LAG-3, a novel lymphocyte activation gene closely related to CD4. J. Exp. Med. 171:1393-1405,1990.

LeClair, K. P.; Rabin, M.; Nesbitt, M. N.; Pravtcheva, D.; Ruddle, F. H.; Palfree, R. G. E.; Bothwell, A.: Murine Ly-6 multigene family is located on chromosome 15. Proc. Nat. Acad. Sci. 84:1638-1642,1987.

Ravetch, J. V.; Lanier, L. L.: Immune inhibitory receptors. Science 290:84-89, 2000.

Fischer, A.; Durandy, A.; Sterkers, G.; Griscelli, C.: Role of the LFA-1 molecule in cellular interactions required for antibody production in humans. J. Immun. 136:3198-3203, 1986.

Marlin, S. D.; Morton, C. C.; Anderson, D. C.; Springer, T. A.: LFA-1 immunodeficiency disease: definition of the genetic defect and chromosomal mapping of alpha and beta subunits of the lymphocyte function-associated antigen 1 (LFA-1) by complementation in hybrid cells. J. Exp. Med. 164:855-867, 1986.

Futscher, B. W.; Oshiro, M. M.; Wozniak, R. J.; Holtan, N.; Hanigan, C. L.; Duan, H.; Domann, F. E.: Role for DNA methylation in the control of cell type-specific maspin expression. Nature Genet. 31:175-179,2002.

Ngamkitidechakul, C.; Burke, J. M.; O'Brien, W. J.; Twining, S. S.: Maspin: synthesis by human cornea and regulation of in vitro stromal cell adhesion to extracellular matrix. Invest. Ophthal. Vis. Sci. 42:3135-3141, 2001.

Zou, Z.; Anisowicz, A.; Hendrix, M. J. C.; Thor, A.; Neveu, M.; Sheng, S.; Rafidi, K.; Seftor, E.; Sager, R.: Maspin, a serpin with tumor-suppressing activity in human mammary epithelial cells. Science 263:526-529, 1994.

Blackwood, E.; Eisenman, R. N.: Max: a helix-loop-helix zipper protein that forms a sequence-specific DNA-binding complex with Myc. Science 251:1211-1217, 1991.

Eisenman, R. N.: Personal Communication. Seattle, Wash. Jul. 27, 1994.

Gilladoga, A. D.; Edelhoff, S.; Blackwood, E. M.; Eisenman, R. N.; Disteche, C. M.: Mapping of MAX to human chromosome 14 and mouse chromosome 12 by in situ hybridization. Oncogene 7:1249-1251, 1992.

Bulavin, D. V.; Higashimoto, Y.; Popoff, I. J.; Gaarde, W. A.; Basrur, V.; Potapova, O.; Appella, E.; Fornace, A. J., Jr.: Initiation of a G2/M checkpoint after ultraviolet radiation requires p38 kinase. Nature 411:102-107, 2001.

Raj, K.; Ogston, P.; Beard, P.: Virus-mediated killing of cells that lack p53 activity. Nature 412:914-917, 2001. Note: Addendum: Nature 416:202 only, 2002.

Miles, S. A.; Martinez-Maza, O.; Rezai, A.; Magpantay, L.; Kishimoto, T.; Nakamura, S.; Radka, S. F.; Linsley, P. S.: Oncostatin M as a potent mitogen for AIDS-Kaposi's sarcoma-derived cells. Science 255:1432-1434, 1992.

Modur, V.; Feldhaus, M. J.; Weyrich, A. S.; Jicha, D. L.; Prescott, S. M.; Zimmerman, G. A.; McIntyre, T. M.: Oncostatin M is a proinflammatory mediator: in vivo effects correlate with endothelial cell expression of inflammatory cytokines and adhesion molecules. J. Clin. Invest. 100:158-168, 1997.

Nair, B. C.; DeVico, A. L.; Nakamura, S.; Copeland, T. D.; Chen, Y.; Patel, A.; O'Neil, T.; Oroszlan, S.; Gallo, R. C.; Sarngadharan, M. G.: Identification of a major growth factor for AIDS-Kaposi's sarcoma cells as oncostatin M. Science 255:1430-1432, 1992.

Rose, T. M.; Bruce, A. G.: Oncostatin M is a member of a cytokine family that includes leukemia-inhibitory factor, granulocyte colony-stimulating factor, and interleukin 6. Proc. Nat. Acad. Sci. 88:8641-8645,1991.

Rose, T. M.; Lagrou, M. J.; Fransson, I.; Werelius, B.; Delattre, O.; Thomas, G.; de Jong, P. J.; Todaro, G. J.; Dumanski, J. P.: The genes for oncostatin M (OSM) and leukemia inhibitory factor (LIF) are tightly linked on human chromosome 22. Genomics 17:136-140,1993.

Zarling, J. M.; Shoyab, M.; Marquardt, H.; Hanson, M. B.; Lioubin, M. N.; Todaro, G. J.: Oncostatin M: a growth regulator produced by differentiated histiocytic lymphoma cells. Proc. Nat. Acad. Sci. 83:9739-9743, 1986.

Harder, K. W.; Parsons, L. M.; Armes, J.; Evans, N.; Kountouri, N.; Clark, R.; Quillici, C.; Grail, D.; Hodgson, G. S.; Dunn, A. R.; Hibbs, M. L.: Gain- and loss-of-function Lyn mutant mice define a critical inhibitory role for Lyn in the myeloid lineage. Immunity 15:603-615, 2001.

Joyner, A. L.; Herrup, K.; Auerbach, B. A.; Davis, C. A.; Rossant, J.: Subtle cerebellar phenotype in mice homozygous for a targeted deletion of the En-2 homeobox. Science 251:1239-1243, 1991.

Joyner, A. L.; Skarnes, W. C.; Rossant, J.: Production of a mutation in mouse En-2 gene by homologous recombination in embryonic stem cells. Nature 338:153-156, 1989.

Poole, S. J.; Law, M. L.; Kao, F.-T.; Lau, Y.-F.: Isolation and chromosomal localization of the human En-2 gene. Genomics 4:225-231,1989.

Kiss, C.; Li, J.; Szeles, A.; Gizatullin, R. Z.; Kashuba, V. I.; Lushnikova, T.; Protopopov, A. I.; Kelve, M.; Kiss, H.; Kholodnyuk, I. D.; Imreh, S.; Klein, G.; Zabarovsky, E. R.: Assignment of the ARHA and GPX1 genes to human chromosome bands 3p21.3 by in situ hybridization and with somatic cell hybrids. Cytogenet. Cell Genet. 79:228-230, 1997.

Ma, J. J.; Nishimura, M.; Mine, H.; Kuroki, S.; Nukina, M.; Ohta, M.; Saji, H.; Obayashi, H.; Kawakami, H.; Saida, T.; Uchiyama, T.: Genetic contribution of the tumor necrosis factor region in Guillain-Barre syndrome. Ann. Neurol. 44:815-818, 1998.

Giuili, G.; Roechel, N.; Scholl, U.; Mattei, M.-G.; Guellaen, G.: Colocalization of the genes coding for the alpha-3 and beta-3 subunits of soluble guanylyl cyclase to human chromosome 4 at q31.3-q33. Hum. Genet. 91:257-260, 1993.

Cameron, H. S.; Szczepaniak, D.; Weston, B. W.: Expression of human chromosome 19p alpha-(1,3)-fucosyltransferase genes in normal tissues: alternative splicing, polyadenylation, and isoforms. J. Biol. Chem. 270:20112-20122, 1995.

Koszdin, K. L.; Bowen, B. R.: The cloning and expression of a human alpha-1,3 fucosyl transferase capable of forming the E-selectin ligand. Biochem. Biophys. Res. Commun. 187:152-157, 1992.

Mollicone, R.; Reguigne, I.; Fletcher, A.; Aziz, A.; Rustam, M.; Weston, B. W.; Kelly, R. J.; Lowe, J. B.; Oriol, R.: Molecular basis for plasma alpha (1,3)-fucosyl transferase gene deficiency (FUT6). J. Biol. Chem. 269:12662-12671, 1994.

Pang, H.; Koda, Y.; Soejima, M.; Schlaphoff, T.; Du Toit, E. D.; Kimura, H.: Allelic diversity of the human plasma alpha (1,3) fucosyl transferase gene (FUT6). Ann. Hum. Genet. 63:277-284, 1999.

Schnyder-Candrian, S.; Borsig, L.; Moser, R.; Berger, E. G.: Localization of alpha-1,3 fucosyl transferase VI in Weibel-Palade bodies of human endothelial cells. Proc. Nat. Acad. Sci. 97:8369-8374, 2000.

Doonan, S.; Barra, D.; Bossa, F.: Structural and genetic relationships between cytosolic and mitochondrial isoenzymes. Int. J. Biochem. 16:1193-1199, 1984.

Allen, S. J.; O'Donnell, A.; Alexander, N. D. E.; Alpers, M. P.; Peto, T. E. A.; Clegg, J. B.; Weatherall, D. J.: Alpha (+)-thalassemia protects children against disease caused by other infections as well as malaria. Proc. Nat. Acad. Sci. 94:14736-14741, 1997.

Keats, B. J. B.; Morton, N. E.; Rao, D. C.: Possible linkages (lod score over 1.5) and a tentative map of the Jk-Km linkage group. Cytogenet. Cell Genet. 22:304-308, 1978.

Keats, B. J. B.; Morton, N. E.; Rao, D. C.: Likely linkage: InV with Jk. Hum. Genet. 39:157-159, 1977.

Cannizzaro, L. A.; Croce, C. M.; Griffin, C. A.; Simeone, A.; Boncinelli, E.; Huebner, K.: Human homeo box-containing genes located at chromosome regions 2q31-2q37 and 12q12-12q13. Am. J. Hum. Genet. 41:1-15,1987.

Bressler, J.; Tsai, T.-F.; Wu, M.-Y.; Tsai, S.-F.; Ramirez, M. A.; Armstrong, D.; Beaudet, A. L.: The SNRPN promoter is not required for genomic imprinting of the Prader-Willi/Angelman domain in mice. Nature Genet. 28:232-240, 2001.

Buiting, K.; Saitoh, S.; Gross, S.; Dittrich, B.; Schwartz, S.; Nicholls, R. D.; Horsthemke, B.: Inherited microdeletions in the Angelman and Prader-Willi syndromes define an imprinting centre on human chromosome 15. Nature Genet. 9:395-400, 1995.

Dittrich, B.; Buiting, K.; Korn, B.; Rickard, S.; Buxton, J.; Saitoh, S.; Nicholls, R. D.; Poustka, A.; Winterpacht, A.; Zabel, B.; Horsthemke, B.: Imprint switching on human chromosome 15 may involve alternative transcripts of the SNRPN gene. Nature Genet. 14:163-170, 1996.

Gallagher, R. C.; Pils, B.; Albalwi, M.; Francke, U.: Evidence for the role of PWCR1/HBII-85 C/D box small nucleolar RNAs in Prader-Willi syndrome. Am. J. Hum. Genet. 71:669-678, 2002.

Glenn, C. C.; Porter, K. A.; Jong, M. T. C.; Nicholls, R. D.; Driscoll, D. J.: Functional imprinting and epigenetic modification of the human SNRPN gene. Hum. Molec. Genet. 2:2001-2005, 1993.

Gray, T. A.; Saitoh, S.; Nicholls, R. D.: An imprinted, mammalian bicistronic transcript encodes two independent proteins. Proc. Nat. Acad. Sci. 96:5616-5621, 1999.

Kuslich, C. D.; Kobori, J. A.; Mohapatra, G.; Gregorio-King, C.; Donlon, T. A.: Prader-Willi syndrome is caused by disruption of the SNRPN gene. Am. J. Hum. Genet. 64:70-76, 1999.

Leff, S. E.; Brannan, C. I.; Reed, M. L.; Ozcelik, T.; Francke, U.; Copeland, N. G.; Jenkins, N. A.: Maternal imprinting of the mouse Snrpn gene and conserved linkage homology with the human Prader-Willi syndrome region. Nature Genet. 2:259-264, 1992.

Li, S.; Klein, E. S.; Russo, A. F.; Simmons, D. M.; Rosenfeld, M. G.: Isolation of cDNA clones encoding small nuclear ribonucleoparticle-associated proteins with different tissue specificities. Proc. Nat. Acad. Sci. 86:9778-9782, 1989.

Lyko, F.; Buiting, K.; Horsthemke, B.; Paro, R.: Identification of a silencing element in the human 15q11-q13 imprinting center by using transgenic Drosophila. Proc. Nat. Acad. Sci. 95:1698-1702,1998.

McAllister, G.; Amara, S. G.; Lerner, M. R.: Tissue-specific expression and cDNA cloning of small nuclear ribonucleoprotein-associated polypeptide N. Proc. Nat. Acad. Sci. 85:5296-5300, 1988.

Mutirangura, A.; Jayakumar, A.; Sutcliffe, J. S.; Nakao, M.; McKinney, M. J.; Buiting, K.; Horsthemke, B.; Beaudet, A. L.; Chinault, A. C.; Ledbetter, D. H.: A complete YAC contig of the Prader-Willi/Angelman chromosome region (15q11-q13) and refined localization of the SNRPN gene. Genomics 18:546-552, 1993.

Ozcelik, T.; Leff, S.; Robinson, W.; Donlon, T.; Lalande, M.; Sanjines, E.; Schinzel, A.; Francke, U.: Small nuclear ribonucleoprotein polypeptide N (SNRPN), an expressed gene in the Prader-Willi syndrome critical region. Nature Genet. 2:265-269, 1992.

Reed, M. L.; Leff, S. E.: Maternal imprinting of human SNRPN, a gene deleted in Prader-Willi syndrome. Nature Genet. 6:163-167,1994.

Saitoh, S.; Wada, T.: Parent-of-origin specific histone acetylation and reactivation of a key imprinted gene locus in Prader-Willi syndrome. Am. J. Hum. Genet. 66:1958-1962, 2000.

Laing, N. G.; Wilton, S. D.; Akkari, P. A.; Dorosz, S.; Boundy, K.; Kneebone, C.; Blumbergs, P.; White, S.; Watkins, H.; Love, D. R.; Haan, E.: A mutation in the alpha tropomyosin gene TPM3 associated with autosomal dominant nemaline myopathy. Nature Genet. 9:75-79,1995.

Shirakawa, H.; Yoshida, M.: Structure of a gene coding for human HMG2 protein. J. Biol. Chem. 267:6641-6645, 1992.

Wanschura, S.; Schoenmakers, E. F. P. M.; Huysmans, C.; Bartnitzke, S.; Van de Ven, W. J. M.; Bullerdiek, J.: Mapping of the human HMG2 gene to 4q31. Genomics 31:264-265, 1996.

Bustin, M.: Regulation of DNA-dependent activities by the functional motifs of the high-mobility-group chromosomal proteins. Molec. Cell. Biol. 19:5237-5246, 1999.

Landsman, D.; Bustin, M.: Chromosomal proteins HMG-14 and HMG-17: distinct multigene families coding for similar types of transcripts. J. Biol. Chem. 261:16087-16091, 1986.

Landsman, D.; Soares, N.; Gonzalez, F. J.; Bustin, M.: Chromosomal protein HMG-17: complete human cDNA sequence and evidence for a multigene family. J. Biol. Chem. 261:7479-7484, 1986.

Mitchell, A.; McBride, W.; Landsman, D.; Bustin, M.: Chromosomal mapping of HMG-17 gene to human chromosome 1p. (Abstract) Am. J. Hum. Genet. 43: A152 only, 1988.

Mitchell, A. L.; Bale, A. E.; Bustin, M.; Landsman, D.; Popescu, N.; McBride, O. W.: Localization of HMG17 gene to chromosome 1p35-36.1.(Abstract) Cytogenet. Cell Genet. 51:1045 only, 1989.

Popescu, N.; Landsman, D.; Bustin, M.: Mapping the human gene coding for chromosomal protein HMG-17. Hum. Genet. 85:376-378,1990.

Porkka, K.; Laakkonen, P.; Hoffman, J. A.; Bernasconi, M.; Ruoslahti, E.: A fragment of the HMGN2 protein homes to the nuclei of tumor cells and tumor endothelial cells in vivo. Proc. Nat. Acad. Sci. 99:7444-7449, 2002.

Srikantha, J.; Landsman, D.; Bustin, M.: Retropseudogenes for human chromosomal protein HMG-17. J. Molec. Biol. 197:405-413,1987.

Ding, H.-F.; Rimsky, S.; Batson, S. C.; Bustin, M.; Hansen, U.: Stimulation of RNA polymerase II elongation by chromosomal protein HMG-14. Science 265:796-799, 1994.

Landsman, D.; McBride, O. W.; Soares, N.; Crippa, M. P.; Srikantha, T.; Bustin, M.: Chromosomal protein HMG-14: identification, characterization, and chromosome localization of a functional gene from the large human multigene family. J. Biol. Chem. 264:3421-3427, 1989.

Pash, J.; Popescu, N.; Matocha, M.; Rapoport, S.; Bustin, M.:Chromosomal protein HMG-14 gene maps to the Down syndrome region of human chromosome 21 and is overexpressed in mouse trisomy 16. Proc. Nat. Acad. Sci. 87:3836-3840, 1990.

Petersen, M. B.; Economou, E. P.; Slaugenhaupt, S. A.; Chakravarti, A.; Antonarakis, S. E.: Linkage analysis of the human HMG14 gene on chromosome 21 using a GT dinucleotide repeat as polymorphic marker. Genomics 7:136-138, 1990.

Bajalica, S.; Allander, S. V.; Ehrenborg, E.; Brondum-Nielsen, K.; Luthman, H.; Larsson, C.: Localization of the human insulin-like growth-factor-binding protein 4 gene to chromosomal region 17q12-21.1. Hum. Genet. 89:234-236, 1992.

Kiefer, M. C.; Schmid, C.; Waldvogel, M.; Schlapfer, I.; Futo, E.; Masiarz, F. R.; Green, K.; Barr, P. J.; Zapf, J.: characterization of recombinant human insulin-like growth factor binding proteins 4, 5, and 6 produced in yeast. J. Biol. Chem. 267:12692-12699, 1992.

Shimasaki, S.; Uchiyama, F.; Shimonaka, M.; Ling, N.: molecular cloning of the cDNAs encoding a novel insulin-like growth factor-binding protein from rat and human. Molec. Endocr. 4:1451-1458, 1990.

Tonin, P.; Ehrenborg, E.; Lenoir, G.; Feunteun, J.; Lynch, H.; Morgan, K.; Zazzi, H.; Vivier, A.; Pollak, M.; Huynh, H.; Luthman, H.; Larsson, C.; Narod, S.: The human insulin-like growth factor-binding protein 4 gene maps to chromosome region 17q12-q21.1 and is close to the gene for hereditary breast-ovarian cancer. Genomics 18:414-417,1993.

Zazzi, H.; Nikoshkov, A.; Hall, K.; Luthman, H.: Structure and transcription regulation of the human insulin-like growth factor binding protein 4 gene (IGFBP4). Genomics 49:401-410, 1998.

Kou, K.; James, P. L.; Clemmons, D. R.; Copeland, N. G.; Gilbert, D. J.; Jenkins, N. A.; Rotwein, P.: Identification of two clusters of mouse insulin-like growth factor binding protein genes on chromosomes 1 and 11. Genomics 21:653-655, 1994.

Brink, P. A.; Steyn, L. T.; Coetzee, G. A.; van der Westhuyzen, D. R.: Familial hypercholesterolemia in South African Afrikaners: PvuII and StuI DNA polymorphisms in the LDL-receptor gene consistent with a predominating founder gene effect. Hum. Genet. 77:32-35,1987.

Brown, M. S.; Goldstein, J. L.: Analysis of a mutant strain of human fibroblasts with a defect in the internalization of receptor-bound low density lipoproteins. Cell 9:663-674, 1976.

Brown, M. S.; Goldstein, J. L.: Familial hypercholesterolemia:defective binding of lipoproteins to cultured fibroblasts associated with impaired regulation of 3-hydroxy-3-methylglutaryl coenzyme at reductase activity. Proc. Nat. Acad. Sci. 71:788-792, 1974.

Davis, C. G.; Lehrman, M. A.; Russell, D. W.; Anderson, R. G. W.; Brown, M. S.; Goldstein, J. L.: The J. D. mutation in familial hypercholesterolemia: amino acid substitution in cytoplasmic domain impedes internalization of LDL receptors. Cell 45:15-24, 1986.

De Braekeleer, M.: Hereditary disorders in Saguenay-Lac-St-Jean (Quebec, Canada). Hum. Hered. 41:141-146, 1991.

Defesche, J. C.; Kastelein, J. J. P.: Molecular epidemiology of familial hypercholesterolaemia. (Letter) Lancet 352:1643-1644,1998.

Durst, R.; Colombo, R.; Shpitzen, S.; Ben Avi, L.; Friedlander, Y.; Wexler, R.; Raal, F. J.; Marais, D. A.; Defesche, J. C.; Mandelshtam, M. Y.; Kotze, M. J.; Leitersdorf, E.; Meiner, V.: Recent origin and spread of a common Lithuanian mutation, G197del LDLR, causing familial hypercholesterolemia: positive selection is not always necessary to account for disease incidence among Ashkenazi Jews. Am. J. Hum. Genet. 68:1172-1188, 2001.

Ekstrom, U.; Abrahamson, M.; Floren, C.-H.; Tollig, H.; Wettrell, G.; Nilsson, G.; Sun, X.-M.; Soutar, A. K.; Nilsson-Ehle, P.: An individual with a healthy phenotype in spite of a pathogenic LDL receptor mutation (C240F). Clin. Genet. 55:332-339, 1999.

Elston, R. C.; Namboodiri, K. K.; Go, R. C. P.; Siervogel, R. M.; Glueck, C. J.: Probable linkage between essential familial hypercholesterolemia and third complement component (C3). Cytogenet. Cell Genet. 16:294-297, 1976.

Feussner, G.; Dobmeyer, J.; Nissen, H.; Hansen, T. S.: Unusual Xanthomas in a young patient with heterozygous familial hypercholesterolemia and type III hyperlipoproteinemia. Am. J. Med. Genet. 65:149-154,1996.

Francke, U.; Brown, M. S.; Goldstein, J. L.: Assignment of the human gene for the low density lipoprotein receptor to chromosome 19: synteny of a receptor, a ligand, and a genetic disease. Proc. Nat. Acad. Sci. 81:2826-2830, 1984.

Frank, S. L.; Taylor, B. A.; Lusis, A. J.: Linkage of the mouse LDL receptor gene on chromosome 9. Genomics 5:646-648, 1989.

Copeland, N. G.; Silan, C. M.; Kingsley, D. M.; Jenkins, N. A.; Cannizzaro, L. A.; Croce, C. M.; Huebner, K.; Sims, J. E.: Chromosomal location of murine and human IL-1 receptor genes. Genomics 9:44-50,1991.

Dale, M.; Nicklin, M. J.: Interleukin-1 receptor cluster: gene organization of IL1R2, IL1R1, IL1RL2 (IL-1Rrp2), IL1RL1 (T1/ST2), and IL18R1 (IL-1Rrp) on human chromosome 2q. Genomics 57:177-179,1999.

Dower, S. K.; Kronheim, S. R.; Hopp, T. P.; Cantrell, M.; Deeley, M.; Gillis, S.; Henney, C. S.; Urdal, D. L.: The cell surface receptors for interleukin-1 (alpha) and interleukin-1 (beta) are identical. Nature 324:266-268, 1986.

Sims, J. E.; Acres, R. B.; Grubin, C. E.; McMahan, C. J.; Wignall, J. M.; March, C. J.; Dower, S. K.: Cloning the interleukin 1 receptor from human T cells. Proc. Nat. Acad. Sci. 86:8946-8950, 1989.

Ballantyne, C. M.; Kozak, C. A.; O'Brien, W. E.; Beaudet, A. L.: Assignment of the gene for intercellular adhesion molecule-1 (Icam-1) to proximal mouse chromosome 9. Genomics 9:547-550, 1991.

Bella, J.; Kolatkar, P. R.; Marlor, C. W.; Greve, J. M.; Rossmann, M. G.: The structure of the two amino-terminal domains of human ICAM-1 suggests how it functions as a rhinovirus receptor and as an LFA-1integrin ligand. Proc. Nat. Acad. Sci. 95:4140-4145, 1998.

Bellamy, R.; Kwiatkowski, D.; and Hill, A. V. S.: Absence of an association between intercellular adhesion molecule 1, complement receptor 1 and interleukin 1 receptor antagonist gene polymorphisms and severe malaria in a West African population. Trans. R. Soc. Trop. Med. Hyg. 92:312-316, 1998.

Craig, A.; Fernandez-Reyes, D.; Mesri, M.; McDowall, A.; Altieri, D. C.; Hogg, N.; Newbold, C.: A functional analysis of a natural variant of intercellular adhesion molecule-1 (ICAM-1-Kilifi). Hum. Molec. Genet. 9:525-530, 2000.

Fernandez-Reyes, D.; Craig, A. G.; Kyes, S. A.; Peshu, N.; Snow, R. W.; Berendt, A. R.; Marsh, K.; Newbold, C. I.: A high frequency African coding polymorphism in the N-terminal domain of ICAM-1 predisposing to cerebral malaria in Kenya. Hum. Molec. Genet. 6:1357-1360, 1997.

Greve, J. M.; Davis, G.; Meyer, A. M.; Forte, C. P.; Yost, S. C.; Marlor, C. W.; Kamarck, M. E.; McClelland, A.: The major human rhinovirus receptor is ICAM-1. Cell 56:839-847, 1989.

Hill, A. V. S.: The immunogenetics of resistance to malaria. Proc. Assoc. Am. Phys. 111:272-277, 1999.

Katz, F. E.; Parkar, M.; Stanley, K.; Murray, L. J.; Clark, E. A.; Greaves, M. F.: Chromosome mapping of cell membrane antigens expressed on activated B cells. Europ. J. Immun. 15:103-106, 1985.

Le Beau, M. M.; Ryan, D., Jr.; Pericak-Vance, M. A.: Report of the committee on the genetic constitution of chromosomes 18 and 19. Cytogenet. Cell Genet. 51:338-357, 1989.

Lu, T. T.; Cyster, J. G.: Integrin-mediated long-term B cell retention in the splenic marginal zone. Science 297:409-412, 2002.

Prieto, J.; Takei, F.; Gendelman, R.; Christenson, B.; Biberfeld, P.; Patarroyo, M.: MALA-2, mouse homologue of human adhesion molecule ICAM-1 (CD54). Europ. J. Immun. 19:1551-1557, 1989.

Simmons, D.; Makgoba, M. W.; Seed, B.: ICAM, an adhesion ligand of LFA-1, is homologous to the neural cell adhesion molecule NCAM. Nature 331:624-627, 1988.

Gedde-Dahl, T., Jr.; Dupuy, B. M.; Jonassen, R.; Winberg, J.-O.; Anton-Lamprecht, I.; Olaisen, B.: Junctional epidermolysis bullosain versa (locus EBR2A) assigned to 1q31 by linkage and association of LAMC1. Hum. Molec. Genet. 3:1387-1391, 1994.

Kallunki, T.; Ikonen, J.; Chow, L. T.; Kallunki, P.; Tryggvason, K.: Structure of the human laminin B2 chain gene reveals extensive divergence from the laminin B1 chain gene. J. Biol. Chem. 266:221-228,1991.

Kallunki, T.; Pikkarainen, T.; Tryggvason, K.; Savolainen, E.-R.: A Pst I polymorphism in the human laminin B2 chain gene on 1q25-q31. Nucleic Acids Res. 17:4423 only, 1989.

Mattei, M.-G.; Weil, D.; Passage, E.; Van Cong, N.; Pribula-Conway, D.; Timpl, R.; Chu, M.-L.: Human gene for laminin B2 chain (LAMB2) maps to the long arm of chromosome 1. (Abstract) Cytogenet. Cell Genet. 46:659 only, 1987.

Mattei, M.-G.; Weil, D.; Pribula-Conway, D.; Bernard, M. P.; Passage, E.; Van Cong, N.; Timpl, R.; Chu, M.-L.: cDNA cloning, expression and mapping of human laminin B2 gene to chromosome 1q31. Hum. Genet. 79:235-241, 1988.

Miner, J. H.; Patton, B. L.; Lentz, S. I.; Gilbert, D. J.; Jenkins, N. A.; Copeland, N. G.; Sanes, J. R.: The laminin alpha chains: expression, developmental transitions, and chromosomal locations of alpha 1-5, identification of heterodimeric laminins 8-11, and cloning of a novel alpha3 isoform. J. Cell Biol. 137:685-701, 1997.

Braun, A.; Kofler, A.; Morawietz, S.; Cleve, H.: Sequence and organization of the human vitamin D-binding protein gene. Biochim. Biophys. Acta 1216:385-394, 1993.

Chautard-Freire-Maia, E. A.: Concerning the linkage relationships of the Gc and MNSs loci (Hum. Genet. 43:215-220, 1978): disentangling part of the data overlap. (Letter) Hum. Genet. 49:115-116, 1979.

Cleve, H.; Kirk, R. L.; Gajdusek, D. C.; Guiart, J.: On the distribution of the Gc variant Gc Aborigine in Melanesian populations: determination of Gc-types in sera from Tongariki Island, New Hebrides. Acta Genet. Statist. Med. 17:511-517, 1967.

Cleve, H.; Kirk, R. L.; Parker, W. C.; Bearn, A. G.; Schacht, L. E.; Kleinman, H.; Horsfall, W. R.: Two genetic variants of the group-specific component of human serum: Gc Chippewa and Gc Aborigine. Am. J. Hum. Genet. 15:368-379, 1963.

Cleve, H.; Patutschnick, W.: The vitamin D binding of the common rare variants of the group-specific component (Gc): an autoradiographic study. Hum. Genet. 38:289-296, 1977.

Constans, J.; Cleve, H.; Dykes, D.; Fischer, M.; Kirk, R. L.; Papiha, S. S.; Scheffran, W.; Scherz, R.; Thymann, M.; Weber, W.:The polymorphism of the vitamin D-binding protein (Gc); isoelectric focusing in 3 M urea as additional method for identification of genetic variants. Hum. Genet. 65:176-180, 1983.

Constans, J.; Viau, M.: Group-specific component: evidence for two subtypes of the Gc (1) gene. Science 198:1070-1071, 1977.

Cooke, N. E.; David, E. V.: Serum vitamin D-binding protein is a third member of the albumin and alpha fetoprotein gene family. J. Clin. Invest. 76:2420-2424, 1985.

Cooke, N. E.; Willard, H. F.; David, E. V.; George, D. L.: Direct regional assignment of the gene for vitamin D binding protein (Gc-globulin) to human chromosome 4q11-q13 and identification of an associated DNA polymorphism. Hum. Genet. 73:225-229, 1986.

Daiger, S. P.; Brewton, G. W.; Rios, A. A.; Mansell, P. W. A.; Reuben, J. M.: Genetic susceptibility to AIDS: absence of an association with group-specific component (Gc). (Letter) New Eng. J. Med. 317:631-632, 1987.

Daiger, S. P.; Cavalli-Sforza, L. L.: Detection of genetic variation with radioactive ligands. II. Genetic variants of vitamin D-labeled group-specific component (Gc) proteins. Am. J. Hum. Genet. 29:593-604,1977.

Daiger, S. P.; Miller, M.; Chakraborty, R.: Heritability of quantitative variation at the group-specific component (Gc) locus. Am. J. Hum. Genet. 36:663-676, 1984.

Daiger, S. P.; Schanfield, M. S.; Cavalli-Sforza, L. L.: Group-specific component (Gc) proteins bind vitamin D and 25-hydroxy vitamin D. Proc. Nat. Acad. Sci. 72:2076-2080, 1975.

Dykes, D.; Copouls, B.; Polesky, H.: Description of six new Gc variants. Hum. Genet. 63:35-37, 1983.

Dykes, D. D.; Polesky, H. F.: Gc1C12: a new Gc variant. Hum. Hered. 32:136-138, 1982.

Eales, L.-J.; Nye, K. E.; Parkin, J. M.; Weber, J. N.; Forster, S. M.; Harris, J. R. W.; Pinching, A. J.: Association of different allelic forms of group specific component with susceptibility to and clinical manifestation of human immunodeficiency virus infection. Lancet I:999-1002, 1987.

Falk, C. T.; Martin, M. D.; Walker, M. E.; Chen, T.; Rubinstein, P.; Allen, F. H., Jr.: Family data suggesting a linkage between MN and Gc. (Abstract) Cytogenet. Cell Genet. 25:152 only, 1979.

German, J. L.; Walker, M. E.; Stiefel, F. H.; Allen, F. H., Jr.: Autoradiographic studies of human chromosomes. II. Data concerning the position of the MN locus. Vox Sang. 16:130-145, 1969.

Gilles, K.; Louie, L.; Newman, B.; Crandall, J.; King, M.-C.:Genetic susceptibility to AIDS: absence of an association with group-specific component (Gc). (Letter) New Eng. J. Med. 317:630-631, 1987.

Henningsen, K.; Jacobsen, P.; Mikkelsen, M.: B-F chromosome translocation associated with father-child incompatibility within the Gc-system. Hum. Hered. 19:283-287, 1969.

Hirschfeld, J.: The Gc-system: immuno-electrophoretic studies of normal human sera with special reference to a new genetically determined serum system (GC). Prog. Allergy 6:155-186, 1962.

Hirschfeld, J.: Immune-electrophoretic demonstration of qualitative differences in human sera and their relation to the haptoglobins. ActaPath. Microbiol. Scand. 47:160-168, 1959.

Johnson, A. M.; Cleve, H.; Alper, C. A.: Variants of the group-specified component system as demonstrated by immuno fixation electrophoresis:report of a new variant, Gc Boston (Gc B). Am. J. Hum. Genet. 27:728-736, 1975.

Karlsson, S.; Arnason, A.; Thordarson, G.; Olaisen, B.: Frequency of Gc alleles and a variant Gc allele in Iceland. Hum. Hered. 30:119-121, 1980.

Kofler, A.; Braun, A.; Jenkins, T.; Serjeantson, S. W.; Cleve, H.: Characterization of mutants of the vitamin-D-binding protein/group specific component: GC Aborigine (1A1) from Australian Aborigines and South African blacks, and 2A9 from South Germany. Vox Sang. 68:50-54, 1995.

Magenis, R. E.; Eoff, J. S.; Toth-Fejel, S.; Lovrien, E.: Probable linkage of GC to a chromosome 4 inversion and localization to 4q12.(Abstract) Cytogenet. Cell Genet. 40:684 only, 1985.

Mars, M.; Farrant, S.; Roberts, G. J.: Dentinogenesis imperfecta, report of a 5-generation family. Brit. Dent. J. 140:206-209, 1976.

McCombs, J. L.; Yang, F.; Bowman, B. H.; McGill, J. R.; Moore, C. M.: Chromosomal localization of group-specific component by in situ hybridization. Cytogenet. Cell Genet. 42:62-64, 1986.

Mikkelsen, M.; Jacobsen, P.; Henningsen, K.: Possible localization of Gc-system on chromosome 4. Loss of long arm 4 material associated with father-child incompatibility within the Gc-system. Hum. Hered. 27:105-107, 1977.

Mourant, A. E.; Tills, D.; Domaniewska-Sobczak, K.: Sunshine and the geographical distribution of the alleles of the Gc system of plasma proteins. Hum. Genet. 33:307-314, 1976.

Parker, W. C.; Cleve, H.; Bearn, A. G.: Determination of phenotypes in the human group-specific component (Gc) system by starch gel electrophoresis. Am. J. Hum. Genet. 15:353-367, 1963.

Petrini, M.; Emerson, D. L.; Galbraith, R. M.: Linkage between surface immunoglobulin and cytoskeleton of B lymphocytes may involve Gc protein. Nature 306:73-74, 1983.

Crozat, A.; Aman, P.; Mandahl, N.; Ron, D.: Fusion of CHOP to a novel RNA-binding protein in human myxoid liposarcoma. Nature 363:640-644, 1993.

Mrozek, K.; Karakousis, C. P.; Bloomfield, C. D.: Chromosome 12 breakpoints are cytogenetically different in benign and malignant lipogenic tumors: localization of breakpoints in lipoma to 12q15 and in myxoid liposarcoma to 12q13.3. Cancer Res. 53:1670-1675, 1993.

Panagopoulos, I.; Aman, P.; Mertens, F.; Mandahl, N.; Rydholm, A.; Bauer, H. F. C.; Mitelman, F.: Genomic PCR detects tumor cells in peripheral blood from patients with myxoid liposarcoma. Genes Chromosomes Cancer 17:102-107, 1996.

Park, J. S.; Luethy, J. D.; Wang, M. G.; Fargnoli, J.; Fornace, A. J., Jr.; McBride, O. W.; Holbrook, N. J.: Isolation, characterization and chromosomal localization of the human GADD153 gene. Gene 116:259-267, 1992.

Rabbitts, T. H.; Forster, A.; Larson, R.; Nathan, P.: Fusion of the dominant negative transcription regulator CHOP with a novel gene FUS by translocation t (12;16) in malignant liposarcoma. Nature Genet. 4:175-180, 1993.

Ron, D.; Habener, J. F.: CHOP, a novel developmentally regulated nuclear protein that dimerizes with transcription factors C/EBP and LAP and functions as a dominant-negative inhibitor of gene transcription. Genes Dev. 6:439-453, 1992.

Cleaver, J. E.; Thompson, L. H.; Richardson, A. S.; States, J. C.: A summary of mutations in the UV-sensitive disorders: xeroderma pigmentosum, Cockayne syndrome, and trichothiodystrophy. Hum. Mutat. 14:9-22, 1999.

Graham, J. M., Jr.; Anyane-Yeboa, K.; Raams, A.; Appeldoorn, E.; Kleijer, W. J.; Garritsen, V. H.; Busch, D.; Edersheim, T. G.; Jaspers, N. G. J.: Cerebro-oculo-facio-skeletal syndrome with a nucleotide excision-repair defect and a mutated XPD gene, with prenatal diagnosis in a triplet pregnancy. Am. J. Hum. Genet. 69:291-300, 2001.

Kenmochi, N.; Kawaguchi, T.; Rozen, S.; Davis, E.; Goodman, N.; Hudson, T. J.; Tanaka, T.; Page, D. C.: A map of 75 human ribosomal protein genes. Genome Res. 8:509-523, 1998.

Justice, M. J.; Siracusa, L. D.; Gilbert, D. J.; Heisterkamp, N.; Groffen, J.; Chada, K.; Silan, C. M.; Copeland, N. G.; Jenkins, N. A.: A genetic linkage map of mouse chromosome 10: localization of eighteen molecular markers using a single interspecific backcross. Genetics 125:855-866, 1990.

King, M. C.: Personal Communication. Berkeley, Calif. May 1996.

Korach, K. S.: Insights from the study of animals lacking functional estrogen receptor. Science 266:1524-1527, 1994.

Kos, M.; Reid, G.; Denger, S.; Gannon, F.: Minireview: genomic organization of the human ER-alpha gene promoter region. Molec. Endocr. 15:2057-2063, 2001.

Kumar, R.; Wang, R.-A.; Mazumdar, A.; Talukder, A. H.; Mandal, M.; Yang, Z.; Bagheri-Yarmand, R.; Sahin, A.; Hortobagyi, G.; Adam, L.; Barnes, C. J.; Vadlamudi, R. K.: A naturally occurring MTA1 variant sequesters oestrogen receptor-alpha in the cytoplasm. Nature 418:654-657, 2002.

Lawson, J. S.; Field, A. S.; Champion, S.; Tran, D.; Ishikura, H.; Trichopoulos, D.: Low oestrogen receptor alpha expression in normal breast tissue underlies low breast cancer incidence in Japan.(Letter) Lancet 354:1787-1788, 1999.

Lonard, D. M.; Nawaz, Z.; Smith, C. L.; O'Malley, B. W.: The 26S proteasome is required for estrogen receptor-alpha and coactivator turnover and for efficient estrogen receptor-alpha transactivation. Molec. Cell 5:939-948, 2000.

Lorentzon, M.; Lorentzon, R.; Backstrom, T.; Nordstrom, P.: Estrogen receptor gene polymorphism, but not estradiol levels, is related to bone density in healthy adolescent boys: a cross-sectional and longitudinal study. J. Clin. Endocr. Metab. 84:4597-4601, 1999.

Mader, S.; Kumar, V.; de Verneuil, H.; Chambon, P.: Three amino acids of the oestrogen receptor are essential to its ability to distinguish an oestrogen from a glucocorticoid-responsive element. Nature 338:271-274, 1989.

McGuire, W. L.; Chamness, G. C.; Fuqua, S. A. W.: Estrogen receptor variants in clinical breast cancer. Molec. Endocr. 5:1571-1577,1991.

McGuire, W. L.; Chamness, G. C.; Fuqua, S. A. W.: Abnormal estrogen receptor in clinical breast cancer. J. Steroid Biochem. Molec. Biol. 43:243-247, 1992.

McInerney, E. M.; Ince, B. A.; Shapiro, D. J.; Katzenellenbogen, B. S.: A transcriptionally active estrogen receptor mutant is a novel type of dominant negative inhibitor of estrogen action. Molec. Endocr. 10:1519-1526, 1996.

Menasce, L. P.; White, G. R. M.; Harrison, C. J.; Boyle, J. M.: Localization of the estrogen receptor locus (ESR) to chromosome 6q25.1 by FISH and a simple post-FISH banding technique. Genomics 17:263-265, 1993.

Metzger, D.; White, J. H.; Chambon, P.: The human oestrogen receptor functions in yeast. Nature 334:31-36, 1988.

Murphy, L. C.; Wang, M.; Coutt, A.; Dotzlaw, H.: Novel mutations in the estrogen receptor messenger RNA in human breast cancers. J. Clin. Endocr. Metab. 81:1420-1427, 1996.

Pelletier, G.; El-Alfy, M.: Immunocyto chemical localization of estrogen receptors alpha and beta in the human reproductive organs. J. Clin. Endocr. Metab. 85:4835-4840, 2000.

Ponglikitmongkol, M.; Green, S.; Chambon, P.: Genomic organization of the human oestrogen receptor gene. EMBO J. 7:3385-3388, 1988.

Reese, J. C.; Katzenellenbogen, B. S.: Characterization of a temperature-sensitive mutation in the hormone binding domain of the human estrogen receptor: studies in cell extracts and intact cells and their implications for hormone-dependent transcriptional activation. J. Biol. Chem. 267: 9868-9873, 1992.

Reese, J. C.; Katzenellenbogen, B. S.: Mutagenesis of cysteines in the hormone binding domain of the human estrogen receptor: alterations in binding and transcriptional activation by covalently and reversibly attaching ligands. J. Biol. Chem. 266:10880-10887, 1991.

Scott, G. K.; Kushner, P.; Vigne, J.-L.; Benz, C. C.: Truncated forms of DNA-binding estrogen receptors in human breast cancer. J. Clin. Invest. 88:700-706, 1991.

Shang, Y.; Brown, M.: Molecular determinants for the tissue specificity of SERMs. Science 295:2465-2468, 2002.

Shiau, A. K.; Barstad, D.; Loria, P. M.; Cheng, L.; Kushner, P. J.; Agard, D. A.; Greene, G. L.: The structural basis of estrogen receptor/coactivator recognition and the antagonism of this interaction by tamoxifen. Cell 95:927-937, 1998.

Shupnik, M. A.; Pitt, L. K.; Soh, A. Y.; Anderson, A.; Lopes, M. B.; Laws, E. R., Jr.: Selective expression of estrogen receptor alpha and beta isoforms in human pituitary tumors. J. Clin. Endocr. Metab. 83:3965-3972, 1998.

Simoncini, T.; Hafezi-Moghadam, A.; Brazil, D. P.; Ley, K.; Chin, W. W.; Liao, J. K.: Interaction of oestrogen receptor with the regulatory subunit of phosphatidyl inositol-3-OH kinase. Nature 407:538-541,2000.

Sluyser, M.: Mutations in the estrogen receptor gene. Hum. Mutat. 6:97-103, 1995.

Sluyser, M.; Mester, J.: Oncogenes homologous to steroid receptors ?(Letter) Nature 315:546 only, 1985.

Smith, E. P.; Boyd, J.; Frank, G. R.; Takahashi, H.; Cohen, R. M.; Specker, B.; Williams, T. C.; Lubahn, D. B.; Korach, K. S.: Estrogen resistance caused by a mutation in the estrogen-receptor gene in a man. New Eng. J. Med. 331:1056-1061, 1994.

Sudhir, K.; Chou, T. M.; Chatterjee, K.; Smith, E. P.; Williams, T. C.; Kane, J. P.; Malloy, M. J.; Korach, K. S.; Rubanyi, G. M.:Premature coronary artery disease associated with a disruptive mutation in the estrogen receptor gene in a man. Circulation 96:3774-3777,1997.

Takeyama, J.; Suzuki, T.; Inoue, S.; Kaneko, C.; Nagura, H.; Harada, N.; Sasano, H.: Expression and cellular localization of estrogen receptors alpha and beta in the human fetus. J. Clin. Endocr. Metab. 86:2258-2262, 2001.

Walter, P.; Green, S.; Greene, G.; Krust, A.; Bornert, J.-M.; Jeltsch, J.-M.; Staub, A.; Jensen, E.; Scrace, G.; Waterfield, M.; Chambon, P.: Cloning of the human estrogen receptor cDNA. Proc. Nat. Acad. Sci. 82:7889-7893, 1985.

Weel, A. E. A. M.; Uitterlinden, A. G.; Westendorp, I. C. D.; Burger, H.; Schuit, S. C. E.; Hofman, A.; Helmerhorst, T. J. M.; vanLeeuwen, J. P. T. M.; Pols, H. A. P.: Estrogen receptor polymorphism predicts the onset of natural and surgical menopause. J. Clin. Endocr. Metab. 84:3146-3150, 1999.

Weis, K. E.; Ekena, K.; Thomas, J. A.; Lazennec, G.; Katzenellenbogen, B. S.: Constitutively active human estrogen receptors containing amino acid substitutions for tyrosine 537 in the receptor protein. Molec. Endocr. 10:1388-1398, 1996.

van de Vijver, M. J.; Peterse, J. L.; Mooi, W. J.; Wisman, P.; Lomans, J.; Dalesio, O.; Nusse, R.: NEU-protein overexpression in breast cancer: association with comedo-type ductal carcinoma in situ and limited prognostic value in stage II breast cancer. New Eng. J. Med. 319:1239-1245, 1988.

Xie, D.; Shu, X. O.; Deng, Z.; Wen, W.-Q.; Creek, K. E.; Dai, Q., Gao, Y.-T.; Jin, F.; Zheng, W.: Population-based, case-control study of HER2 genetic polymorphism and breast cancer risk. J. Nat. Cancer Inst. 92:412-417, 2000.

Yamamoto, T.; Ikawa, S.; Akiyama, T.; Semba, K.; Nomura, N.; Miyajima, N.; Saito, T.; Toyoshima, K.: Similarity of protein encoded by the human c-erb-B-2 gene to epidermal growth factor receptor. Nature 319:230-234, 1986.

Yang-Feng, T. L.; Schechter, A. L.; Weinberg, R. A.; Francke, U.: Oncogene from rat neuro/glioblastomas (human gene symbol NGL) is located on the proximal long arm of human chromosome 17 and EGFRis confirmed at 7p13-q11.2. (Abstract) Cytogenet. Cell Genet. 40:784 only, 1985.

Yu, D.; Jing, T.; Liu, B.; Yao, J.; Tan, M.; McDonnell, T. J.; Hung, M.-C.: Overexpression of ErbB2 blocks Taxol-induced apoptosis by upregulation of p21Cip1, which inhibits p34Cdc2 kinase. Molec. Cell 2:581-591, 1998.

Klappacher, G. W.; Lunyak, V. V.; Sykes, D. B.; Sawka-Verhelle, D.; Sage, J.; Brard, G.; Ngo, S. D.; Gangadharan, D.; Jacks, T.; Kamps, M. P.; Rose, D. W.; Rosenfeld, M. G.: An induced Ets repressor complex regulates growth arrest during terminal macrophage differentiation. Cell 109:169-180, 2002.

Klemsz, M.; Hromas, R.; Raskind, W.; Bruno, E.; Hoffman, R.: PE-1, a novel ETS oncogene family member, localizes to chromosome 1q21-q23. Genomics 20:291-294, 1994.

Kastury, K.; Li, J.; Druck, T.; Su, H.; Vogt, P. K.; Croce, C. M.; Huebner, K.: The human homologue of the retroviral oncogene qinmaps to chromosome 14q13. Proc. Nat. Acad. Sci. 91:3616-3618, 1994.

Li, J.; Chang, H. W.; Lai, E.; Parker, E. J.; Vogt, P. K.: The oncogene qin codes for a transcriptional repressor. Cancer Res. 55:5540-5544, 1995.

Li, J.; Vogt, P. K.: The retroviral oncogene qin belongs to the transcription factor family that includes the homeotic gene fork head. Proc. Nat. Acad. Sci. 90:4490-4494, 1993.

Murphy, D. B.; Wiese, S.; Burfeind, P.; Schmundt, D.; Mattei, M.-G.; Schulz-Schaeffer, W.; Thies, U.: Human brain factor 1, a new member of the fork head gene family. Genomics 21:551-557, 1994.

Wiese, S.; Murphy, D. B.; Schlung, A.; Burfeind, P.; Schmundt, D.; Schnulle, V.; Mattei, M.-G.; Thies, U.: The genes for human brain factor 1 and 2, members of the fork head gene family, are clustered on chromosome 14q. Biochim. Biophys. Acta 1262:105-112, 1995.

Fukuhara, S.; Rowley, J. D.; Variakojis, D.; Sweet, D. L.: Chromosome abnormalities in poorly differentiated lymphocytic lymphoma. CancerRes. 39:3119-3128, 1979.

Ohno, H.; Fukuhara, S.; Takahashi, R.; Mihara, K.; Sugiyama, T.; Doi, S.; Uchino, H.; Toyoshima, K.: c-yes and bcl-2 genes located on 18q21.3 in a follicular lymphoma cell line carrying a t (14;18) chromosomal translocation. Int. J. Cancer 39:785-788, 1987.

Semba, K.; Nishizawa, M.; Satoh, H.; Fukushige, S.; Yoshida, M. C.; Sasaki, M.; Matsubara, K.; Yamamoto, T.; Toyoshima, K.: Nucleotide sequence and chromosomal mapping of the human c-yes-2 gene. Jpn. J. Cancer Res. 79:710-717, 1988.

Semba, K.; Yamanashi, Y.; Nishizawa, M.; Sukegawa, J.; Yoshida, M.; Sasaki, M.; Yamamoto, T.; Toyoshima, K.: Location of the c-yes gene on the human chromosome and its expression in various tissues. Science 227:1038-1040, 1985.

Silverman, G. A.; Kuo, W.-L.; Taillon-Miller, P.; Gray, J. W.:Chromosomal reassignment: YACs containing both YES1 and thymidylate synthase map to the short arm of chromosome 18. Genomics 15:442-445,1993.

Sukegawa, J.; Semba, K.; Yamanashi, Y.; Nishizawa, M.; Miyajima, N.; Yamamoto, T.; Toyoshima, K.: Characterization of cDNA clones for the human c-yes gene. Molec. Cell. Biol. 7:41-47, 1987.

Inoue, T.; Kimura, T.; Azuma, C.; Inazawa, J.; Takemura, M.; Kikuchi, T.; Kubota, Y.; Ogita, K.; Saji, F.: Structural organization of the human oxytocin receptor gene. J. Biol. Chem. 269:32451-32456, 1994.

Kimura, T.; Tanizawa, O.; Mori, K.; Brownstein, M. J.; Okayama, H.: Structure and expression of a human oxytocin receptor. Nature 356:526-529, 1992.

Simmons, C. F., Jr.; Clancy, T. E.; Quan, R.; Knoll, J. H. M.:The oxytocin receptor gene (OXTR) localizes to human chromosome 3p25 by fluorescence in situ hybridization and PCR analysis of somatic cell hybrids. Genomics 26:623-625, 1995.

Yang, M.; Wang, W.; Zhong, M.; Philippi, A.; Lichtarge, O.; Sanborn, B. M.: Lysine 270 in the third intracellular domain of the oxytocin receptor is an important determinant for G-alpha-q coupling specificity. Molec. Endocr. 16:814-823, 2002.

Monteiro, R. C.; Hostoffer, R. W.; Cooper, M. D.; Bonner, J. R.; Gartland, G. L.; Kubagawa, H.: Definition of immunoglobulin A receptors on eosinophils and their enhanced expression in allergic individuals. J. Clin. Invest. 92:1681-1685, 1993.

Narita, I.; Goto, S.; Saito, N.; Sakatsume, M.; Jin, S.; Omori, K.; Gejyo, F.: Genetic polymorphisms in the promoter and 5-prime UTR region of the Fc alpha receptor (CD89) are not associated with a risk of IgA nephropathy. J. Hum. Genet. 46:694-698, 2001.

Pleass, R. J.; Andrews, P. D.; Kerr, M. A.; Woof, J. M.: Alternative splicing of the human IgA Fc receptor CD89 in neutrophils and eosinophils. Biochem. J. 318:771-777, 1996.

Gross, J. A.; Johnston, J.; Mudri, S.; Enselman, R.; Dillon, S. R.; Madden, K.; Xu, W.; Parrish-Novak, J.; Foster, D.; Lofton-Day, C.; Moore, M.; Littau, A.; Grossman, A.; Haugen, H.; Foley, K.; Blumberg, H.; Harrison, K.; Kindsvogel, W.; Clegg, C. H.: TACI and BCMA are receptors for a TNF homologue implicated in B-cell autoimmune disease. Nature 404:995-999, 2000.

de Wit, T. P. M.; Morton, H. C.; Capel, P. J. A.; van de Winkel, J. G. J.: Structure of the gene for the human myeloid IgA Fc receptor (CD89). J. Immun. 155:1203-1209, 1995.

Kremer, E. J.; Kalatzis, V.; Baker, E.; Callen, D. F.; Sutherland, G. R.; Maliszewski, C. R.: The gene for the human IgA Fc receptor maps to 19q13.4. Hum. Genet. 89:107-108, 1992.

Maliszewski, C. R.; March, C. J.; Schoenborn, M. A.; Gimpel, S.; Shen, L.: Expression cloning of a human Fc receptor for IgA. J. Exp. Med. 172:1665-1672, 1990.

Shimokawa, T.; Tsuge, T.; Okumura, K.; Ra, C.: Identification and characterization of the promoter for the gene encoding the human Myeloid IgA Fc receptor (Fc-alpha-R, CD89). Immunogenetics 51:945-954,2000.

Tsuge, T.; Shimokawa, T.; Horikoshi, S.; Tomino, Y.; Ra, C.: Polymorphism in promoter region of Fc-alpha receptor gene in patients with IgA nephropathy. Hum. Genet. 108:128-133, 2001.

Dillon, J. S.; Tanizawa, Y.; Wheeler, M. B.; Leng, X.-H.; Ligon, B. B.; Rabin, D. U.; Yoo-Warren, H.; Permutt, M. A.; Boyd, A. E., III: Cloning and functional expression of the human glucagon-like peptide-1 (GLP-1) receptor. Endocrinology 133:1907-1910, 1993.

Kershaw, E. E.; Chua, S. C., Jr.; Leibel, R. L.: Localization of a (CA) n repeat in glucagon-like peptide-1 receptor gene (Glp1r) to proximal mouse chromosome 17 and its linkage to other markers. Mammalian Genome 6:301-303, 1995.

Stoffel, M.; Espinosa, R., III; Le Beau, M. M.; Bell, G. I.: human glucagon-like peptide-1 receptor gene: localization to chromosome band 6p21 by fluorescence in situ hybridization and linkage of a highly polymorphic simple tandem repeat DNA polymorphism to other markers on chromosome 6. Diabetes 42:1215-1218, 1993.

Thorens, B.: Expression cloning of the pancreatic beta cell receptor for the gluco-incretin hormone glucagon-like peptide 1. Proc. Nat. Acad. Sci. 89:8641-8645, 1992.

Cohen, P.; Miyazaki, M.; Socci, N. D.; Hagge-Greenberg, A. Liedtke, W.; Soukas, A. A.; Sharma, R.; Hudgins, L. C.; Ntambi, J. M.; Friedman, J. M.: Role for stearoyl-CoA desaturase-1 in leptin-mediated weight loss. Science 297:240-243, 2002.

Comuzzie, A. G.; Hixson, J. E.; Almasy, L.; Mitchell, B. D.; Mahaney, M. C.; Dyer, T. D.; Stern, M. P.; MacCluer, J. W.; Blangero, J.: A major quantitative trait locus determining serum leptin levels and fat mass is located on human chromosome 2. Nature Genet. 15:273-276,1997.

Dahms, N. M.; Lobel, P.; Breitmeyer, J.; Chirgwin, J. M.; Kornfeld, S.: 46 kd mannose 6-phosphate receptor: cloning, expression, and homology to the 215 kd mannose 6-phosphate receptor. Cell 50:181-192,1987.

Ludwig, T.; Ruther, U.; Metzger, R.; Copeland, N. G.; Jenkins, N. A.; Lobel, P.; Hoflack, B.: Gene and pseudogene of the mouse cation-dependent mannose 6-phosphate receptor: genomic organization, expression, and chromosomal localization. J. Biol. Chem. 267:12211-12219, 1992.

Pohlmann, R.; Boeker, M. W. C.; von Figura, K.: The two mannose 6-phosphate receptors transport distinct complements of lysosomal proteins. J. Biol. Chem. 270:27311-27318, 1995.

Pohlmann, R.; Nagel, G.; Schmidt, B.; Stein, M.; Lorkowski, G.; Krentler, C.; Cully, J.; Meyer, H. E.; Grzeschik, K.-H.; Mersmann, G.; Hasilik, A.; von Figura, K.: Cloning of a cDNA encoding the human cation-dependent mannose 6-phosphate-specific receptor. Proc. Nat. Acad. Sci. 84:5575-5579, 1987.

Roberts, D. L.; Weix, D. J.; Dahms, N. M.; Kim, J.-J. P.: Molecular basis of lysosomal enzyme recognition: three-dimensional structure of the cation-dependent mannose 6-phosphate receptor. Cell 93:639-648,1998.

Watanabe, H.; Grubb, J. H.; Sly, W. S.: The overexpressed human 46-kDa mannose 6-phosphate receptor mediates endocytosis and sorting of beta-glucuronidase. Proc. Nat. Acad. Sci. 87:8036-8040, 1990.

Bucan, M.; Gatalica, B.; Nolan, P.; Chung, A.; Leroux, A.; Grossman, M. H.; Nadeau, J. H.; Emanuel, B. S.; Budarf, M.: Comparative mapping of 9 human chromosome 22q loci in the laboratory mouse. Hum. Molec. Genet. 2:1245-1252, 1993.

Griffiths, D. F. R.; Williams, G. T.; Williams, E. D.: Duodenal carcinoid tumours, phaeochromocytoma and neurofibromatosis: islet cell tumour, phaeochromocytoma and the von Hippel-Lindau complex:two distinctive neuroendocrine syndromes. Quart. J. Med. 245:769-782,1987.

Mackman, N.; Morrissey, J. H.; Fowler, B.; Edgington, T. S.: Complete sequence of the human tissue factor gene, a highly regulated cellular receptor that initiates the coagulation protease cascade. Biochemistry 28:1755-1762, 1989.

Baron, B.; Fernandez, M. A.; Toledo, F.; Le Roscouet, D.; Mayau, V.; Martin, N.; Buttin, G.; Debatisse, M.: The highly conserved Chinese hamster GNAI3 gene maps less than 60 kb from the AMPD2 gene and lacks the intronic U6 snRNA present in its human counterpart. Genomics 24:288-294, 1994.

Goodman, F. R.: Limb malformations and the human HOX genes. Am. J. Med. Genet. 112:256-265, 2002.

Magli, M. C.; Barba, P.; Celetti, A.; De Vita, G.; Cillo, C.; Boncinelli, E.: Coordinate regulation of HOX genes in human hematopoietic cells. Proc. Nat. Acad. Sci. 88:6348-6352, 1991.

Pravtcheva, D.; Newman, M.; Hunihan, L.; Lonai, P.; Ruddle, F. H.: Chromosome assignment of the murine Hox-4.1 gene. Genomics 5:541-545, 1989.

Taniguchi, Y.; Komatsu, N.; Moriuchi, T.: Overexpression of the HOX4A (HOXD3) homeobox gene in human erythroleukemia HEL cells results in altered adhesive properties. Blood 85:2786-2794, 1995.

Zakany, J.; Duboule, D.: Hox genes and the making of sphincters. Nature 401:761-762, 1999.

Mavilio, F.; Simeone, A.; Giampaolo, A.; Faiella, A.; Zappavigna, V.; Acampora, D.; Poiana, G.; Russo, G.; Peschle, C.; Boncinelli, E.: Differential and stage-related expression in embryonic tissues of a new human homoeobox gene. Nature 324:664-668, 1986.

Oliver, G.; Sidell, N.; Fiske, W.; Heinzmann, C.; Mohandas, T.; Sparkes, R. S.; De Robertis, E. M.: Complementary homeo protein gradients in developing limb buds. Genes Dev. 3:641-650, 1989.

Shaw, D. J.; Meredith, A. L.; Brook, J. D.; Sarfarazi, M.; Harley, H. G.; Huson, S. M.; Bell, G. I.; Harper, P. S.: Linkage relationships of the insulin receptor gene with the complement component 3, LDL receptor, apolipoprotein C2 and myotonic dystrophy loci on chromosome 19. Hum. Genet. 74:267-269, 1986.

Blangy, A.; Lane, H. A.; d'Herin, P.; Harper, M.; Kress, M.; Nigg, E. A.: Phosphorylation by p34(cdc2) regulates spindle association of human Eg5, a kinesin-related motor essential for bipolar spindle formation in vivo. Cell 83:1159-1169, 1995.

Shimada, F.; Suzuki, Y.; Taira, M.; Hashimoto, N.; Nozaki, O.; Makino, H.; Yoshida, S.: Abnormal messenger ribonucleic acid (mRNA) transcribed from a mutant insulin receptor gene in a patient with type A insulin resistance. Diabetologia 35:639-644, 1992.

Shimada, F.; Taira, M.; Suzuki, Y.; Hashimoto, N.; Nozaki, O.; Taira, M.; Tatibana, M.; Ebina, Y.; Tawata, M.; Onaya, T.; Makino, H.; Yoshida, S.: Insulin-resistant diabetes associated with partial deletion of insulin-receptor gene. Lancet 335:1179-1181, 1990.

Taira, M.; Taira, M.; Hashimoto, N.; Shimada, F.; Suzuki, Y.; Kanatsuka, A.; Nakamura, F.; Ebina, Y.; Tatibana, M.; Makino, H.; Yoshida, S.: Human diabetes associated with a deletion of the tyrosine kinase domain of the insulin receptor. Science 245:63-66, 1989.

Takahashi, Y.; Kadowaki, H.; Ando, A.; Quin, J. D.; MacCuish, A. C.; Yazaki, Y.; Akanuma, Y.; Kadowaki, T.: Two aberrant splicings caused by mutations in the insulin receptor gene in cultured lymphocytes from a patient with Rabson-Mendenhall's syndrome. J. Clin. Invest. 101:588-594, 1998.

Taylor, S. I.; Cama, A.; Accili, D.; Barbetti, F.; Imano, E.; Kadowaki, H.; Kadowaki, T.: Genetic basis of endocrine disease 1:molecular genetics of insulin resistant diabetes mellitus. J. Clin. Endocr. Metab. 73:1158-1163, 1991.

Taylor, S. I.; Marcus-Samuels, B.; Ryan-Young, J.; Leventhal, S.; Elders, M. J.: Genetics of the insulin receptor defect in a patient with extreme insulin resistance. J. Clin. Endocr. Metab. 62:1130-1135,1986.

Taylor, S. I.; Underhill, L. H.; Hedo, J. A.; Roth, J.; SerranoRios, M.; Blizzard, R. M.: Decreased insulin binding to cultured cells from a patient with the Rabson-Mendenhall syndrome: dichotomy between studies with cultured lymphocytes and cultured fibroblasts. J. Clin. Endocr. Metab. 56:856-861, 1983.

Tevaarwerk, G. J. M.; Strickland, K. P.; Lin, C. H.; Hudson, A. J.: Studies on insulin resistance and insulin receptor binding in myotonia dystrophica. J. Clin. Endocr. Metab. 49:216-222, 1979.

Ullrich, A.; Bell, J. R.; Chen, E. Y.; Herrera, R.; Petruzzelli, L. M.; Dull, T. J.; Gray, A.; Coussens, L.; Liao, Y.-C.; Tsubokawa, M.; Mason, A.; Seeburg, P. H.; Grunfeld, C.; Rosen, O. M.; Ramachandran, J.: Human insulin receptor and its relationship to the tyrosine kinase family of oncogenes. Nature 313:756-761, 1985.

van der Vorm, E. R.; Kuipers, A.; Kielkopf-Renner, S.; Krans, H. M. J.; Moller, W.; Maassen, J. A.: A mutation in the insulin receptor that impairs proreceptor processing but not insulin binding. J. Biol. Chem. 269:14297-14302, 1994.

van der Vorm, E. R.; van der Zon, G. C. M.; Moller, W.; Krans, H. M. J.; Lindhout, D.; Maassen, J. A.: An arg for gly substitution at position 31 in the insulin receptor, linked to insulin resistance, inhibits receptor processing and transport. J. Biol. Chem. 267:66-71, 1992.

Ward, G. M.; Harrison, L. C.: Structure of the human erythrocyte insulin receptor. Diabetes 35:101-105, 1986.

Wertheimer, E.; Lu, S.-P.; Backeljauw, P. F.; Davenport, M. L.; Taylor, S. I.: Homozygous deletion of the human insulin receptor gene results in leprechaunism. Nature Genet. 5:71-73, 1993.

Williams, D. L.; Look, A. T.; Melvin, S. L.; Roberson, P. K.; Dahl, G.; Flake, T.; Stass, S.: New chromosomal translocations correlate with specific immunophenotypes of childhood acute lymphoblastic leukemia. Cell 36:101-109, 1984.

Williams, J. F.; McClain, D. A.; Dull, T. J.; Ullrich, A.; Olefsky, J. M.: Characterization of an insulin receptor mutant lacking the subunit processing site. J. Biol. Chem. 265:8463-8469, 1990.

Yamamoto-Honda, R.; Koshio, O.; Tobe, K.; Shibasaki, Y.; Momomura, K.; Odawara, M.; Kadowaki, T.; Takaku, F.; Akanuma, Y.; Kasuga, M.: Phosphorylation state and biological function of a mutant human insulin receptor val (996). J. Biol. Chem. 265:14777-14783, 1990.

Yang-Feng, T. L.; Francke, U.; Ullrich, A.: Gene for human insulin receptor: localization to site on chromosome 19 involved in pre-B-cell leukemia. Science 228:728-731, 1985.

Yoshimasa, Y.; Seino, S.; Whittaker, J.; Kakehi, T.; Kosaki, A.; Kuzuya, H.; Imura, H.; Bell, G. I.; Steiner, D. F.: Insulin-resistant diabetes due to a point mutation that prevents insulin proreceptor processing. Science 240:784-787, 1988.

Kurachi, H.; Jobo, K.; Ohta, M.; Kawasaki, T.; Itoh, N.: A new member of the insulin receptor family, insulin receptor-related receptor, is expressed preferentially in the kidney. Biochem. Biophys. Res. Commun. 187:934-939, 1992.

Shier, P.; Watt, V. M.: Primary structure of a putative receptor for a ligand of the insulin family. J. Biol. Chem. 264: 14605-14608, 1989.

Shier, P.; Willard, H. F.; Watt, V. M.: Localization of the insulin receptor-related receptor gene to human chromosome 1. Cytogenet. Cell Genet. 54:80-81, 1990.

Whitmore, T. E.; Maurer, M. F.; Day, H. L.; Jelmberg, A. C.; Dasovich, M. M.; Sundborg, L. M.; Burkhead, S. K.; Heipel, M. D.; Madden, K. L.; Kramer, J. M.; Kuijper, J. L.; Xu, W. F.; Jaspers, S. R.; Holly, R. D.; Lok, S.: The assignment of the human insulin receptor-related receptor gene (INSRR) to chromosome 1q21-q23 by the use of radiation hybrid mapping. Cytogenet. Cell Genet. 87:93-94, 1999.

Herzog, H.; Baumgartner, M.; Vivero, C.; Selbie, L. A.; Auer, B.; Shine, J.: Genomic organization, localization, and allelic differences in the gene for the human neuropeptide Y Y1 receptor. J. Biol. Chem. 268:6703-6707, 1993.

Herzog, H.; Darby, K.; Ball, H.; Hort, Y.; Beck-Sickinger, A.; Shine, J.: Overlapping gene structure of the human neuropeptide Y receptor subtypes Y1 and Y5 suggests coordinate transcriptional regulation. Genomics 41:315-319, 1997.

Herzog, H.; Hort, Y. J.; Ball, H. J.; Hayes, G.; Shine, J.; Selbie, L. A.: Cloned human neuropeptide Y receptor couples to two different second messenger systems. Proc. Nat. Acad. Sci. 89:5794-5798, 1992.

Larhammar, D.; Blomqvist, A. G.; Yee, F.; Jazin, E.; Yoo, H.; Wahlestedt, C.: Cloning and functional expression of a human neuropeptide Y/peptide YY receptor of the Y1 type. J. Biol. Chem. 267:10935-10938, 1992.

Lutz, C. M.; Frankel, W. N.; Richards, J. E.; Thompson, D. A.: Neuropeptide Y receptor genes on human chromosome 4q31-q32 map to conserved linkage groups on mouse chromosomes 3 and 8. Genomics 41:498-500, 1997.

Naveilhan, P.; Hassani, H.; Lucas, G.; Blakeman, K. H.; Hao, J.-X.; Xu, X.-J.; Wiesenfeld-Hallin, Z.; Thoren, P.; Ernfors, P.: Reduced antinociception and plasma extravasation in mice lacking a neuropeptide Y receptor. Nature 409:513-517, 2001.

Ammar, D. A.; Eadie, D. M.; Wong, D. J.; Ma, Y.-Y.; Kolakowski, L. F., Jr.; Yang-Feng, T. L.; Thompson, D. A.: Characterization of the human type 2 neuropeptide Y receptor gene (NPY2R) and localization to the chromosome 4q region containing the type 1 neuropeptide Y receptor gene. Genomics 38:392-398, 1996.

Gerald, C.; Walker, M. W.; Vaysse, P. J.-J.; He, C.; Branchek, T. A.; Weinshank, R. L.: Expression cloning and pharmacological characterization of a human hippocampal neuropeptide Y/peptide YY Y2 receptor subtype. J. Biol. Chem. 270:26758-26761, 1995.

Castilla, L. H.; Garrett, L.; Adya, N.; Orlic, D.; Dutra, A.; Anderson, S.; Owens, J.; Eckhaus, M.; Bodine, D.; Liu, P. P.: The fusion gene Cbfb-MYH11 blocks myeloid differentiation and predisposes mice to acute myelomonocytic leukaemia. (Letter) Nature Genet. 23:144-146, 1999.

Deng, Z.; Liu, P.; Marlton, P.; Claxton, D. F.; Lane, S.; Callen, D. F.; Collins, F. S.; Siciliano, M. J.: Smooth muscle myosin heavy chain locus (MYH11) maps to 16p13.13-p13.12 and establishes a new region of conserved synteny between human 16p and mouse 16. Genomics 18:156-159, 1993.

Stewart, R. J.; Pesavento, P. A.; Woerpel, D. N.; Goldstein, L. S. B.: Identification and partial characterization of six members of the kinesin superfamily in Drosophila. Proc. Nat. Acad. Sci. 88:8470-8474, 1991.

Tihy, F.; Kress, M.; Harper, M.; Dutrillaux, B.; Lemieux, N.: Localization of the human kinesin-related gene to band 10q24 by fluorescence in situ hybridization. Genomics 13:1371-1372, 1992.

Shimura, H.; Schlossmacher, M. G.; Hattori, N.; Frosch, M. P.; Trockenbacher, A.; Schneider, R.; Mizuno, Y.; Kosik, K. S.; Selkoe, D. J.: Ubiquitination of a new form of alpha-synuclein by parkin from human brain: implications for Parkinson's disease. Science 293:263-269, 2001.

Taguchi, A.; Blood, D. C.; del Toro, G.; Canet, A.; Lee, D. C.; Qu, W.; Tanji, N.; Lu, Y.; Lalla, E.; Fu, C.; Hofmann, M. A.; Kislinger, T.; Ingram, M.; Lu, A.; Tanaka, H.; Hori, O.; Ogawa, S.; Stern, D. M.; Schmidt, A. M.: Blockade of RAGE-amphoterin signalling suppresses tumour growth and metastases. Nature 405:354-360, 2000.

Cetta, F.; Chiappetta, G.; Melillo, R. M.; Petracci, M.; Montalto, G.; Santoro, M.; Fusco, A.: The ret/ptc1 oncogene is activated in familial adenomatous polyposis-associated thyroid papillary carcinomas. J. Clin. Endocr. Metab. 83:1003-1006, 1998.

Decker, R. A.; Peacock, M. L.; Watson, P.: Hirschsprung disease in MEN 2A: increased spectrum of RET exon 10 genotypes and strong genotype-phenotype correlation. Hum. Molec. Genet. 7:129-134, 1998.

Donis-Keller, H.; Dou, S.; Chi, D.; Carlson, K. M.; Toshima, K.; Lairmore, T. C.; Howe, J. R.; Moley, J. F.; Goodfellow, P.; Wells, S. A., Jr.: Mutations in the RET proto-oncogene are associated with MEN 2A and FMTC. Hum. Molec. Genet. 2:851-856, 1993.

Doray, B.; Salomon, R.; Amiel, J.; Pelet, A.; Touraine, R.; Billaud, M.; Attie, T.; Bachy, B.; Munnich, A.; Lyonnet, S.: Mutation of the RET ligand, neurturin, supports multigenic inheritance in Hirschsprung disease. Hum. Molec. Genet. 7:1449-1452, 1998.

Edery, P.; Lyonnet, S.; Mulligan, L. M.; Pelet, A.; Dow, E.; Abel, L.; Holder, S.; Nihoul-Fekete, C.; Ponder, B. A. J.; Munnich, A.:Mutations of the RET proto-oncogene in Hirschsprung's disease. Nature 367:378-380, 1994.

Eng, C.: The RET proto-oncogene in multiple endocrine neoplasia type 2 and Hirschsprung's disease. New Eng. J. Med. 335:943-951,1996.

Eng, C.; Crossey, P. A.; Mulligan, L. M.; Healey, C. S.; Houghton, C.; Prowse, A.; Chew, S. L.; Dahia, P. L. M.; O'Riordan, J. L. H.; Toledo, S. P. A.; Smith, D. P.; Maher, E. R.; Ponder, B. A. J.: Mutations in the RET proto-oncogene and the von Hippel-Lindau disease tumour suppressor gene in sporadic and syndromic phaeochromocytomas. J. Clin. Genet. 32:934-937, 1995.

Eng, C.; Mulligan, L. M.: Mutations of the RET proto-oncogene in the multiple endocrine neoplasia type 2 syndromes, related sporadic tumours, and Hirschsprung disease. Hum. Mutat. 9:97-109, 1997.

Eng, C.; Mulligan, L. M.; Smith, D. P.; Healey, C. S.; Frilling, A.; Raue, F.; Neumann, H. P. H.; Pfragner, R.; Behmel, A.; Lorenzo, M. J.; Stonehouse, T. J.; Ponder, M. A.; Ponder, B. A. J.: Mutation of the RET proto-oncogene in sporadic medullary thyroid carcinoma. Genes Chromosomes Cancer 12:209-212, 1995.

Eng, C.; Smith, D. P.; Mulligan, L. M.; Healey, C. S.; Zvelebil, M. J.; Stonehouse, T. J.; Ponder, M. A.; Jackson, C. E.; Waterfield, M. D.; Ponder, B. A. J.: A novel point mutation in the tyrosine kinase domain of the RET proto-oncogene in sporadic medullary thyroid carcinoma and in a family with FMTC. Oncogene 10:509-513, 1995.

Eng, C.; Smith, D. P.; Mulligan, L. M.; Nagai, M. A.; Healey, C. S.; Ponder, M. A.; Gardner, E.; Scheumann, G. F. W.; Jackson, C. E.; Tunnacliffe, A.; Ponder, B. A. J.: Point mutation within the tyrosine kinase domain of the RET proto-oncogene in multiple endocrine neoplasia type 2B and related sporadic tumors. Hum. Molec. Genet. 3:237-241, 1994.

Fearon, E. R.: Human cancer syndromes: clues to the origin and nature of cancer. Science 278:1043-1050, 1997.

Fitze, G.; Schreiber, M.; Kuhlisch, E.; Schackert, H. K.; Roesner, D.: Association of RET proto-oncogene codon 45 polymorphism with Hirschsprung disease. (Letter) Am. J. Hum. Genet. 65:1469-1473, 1999.

Gardner, E.; Mulligan, L. M.; Eng, C.; Healey, C. S.; Kwok, J. B. J.; Ponder, M. A.; Ponder, B. A. J.: Haplotype analysis of MEN2 mutations. Hum. Molec. Genet. 3:1771-1774, 1994.

Grieco, M.; Santoro, M.; Berlingieri, M. T.; Melillo, R. M.; Donghi, R.; Bongarzone, I.; Pierotti, M. A.; Della Porta, G.; Fusco, A.; Vecchio, G.: PTC is a novel rearranged form of the ret proto-oncogene and is frequently detected in vivo in human thyroid papillary carcinomas. Cell 60:557-563, 1990.

Hofstra, R. M. W.; Landsvater, R. M.; Ceccherini, I.; Stulp, R. P.; Stelwagen, T.; Luo, Y.; Pasini, B.; Hoppener, J. W. M.; Ploosvan Amstel, H. K.; Romeo, G.; Lips, C. J. M.; Buys, C. H. C. M.:A mutation in the RET proto-oncogene associated with multiple endocrine neoplasia type 2B and sporadic medullary thyroid carcinoma. Nature 367:375-376, 1994.

Hoppener, J. W. M.; Lips, C. J. M.: RET receptor tyrosine kinase gene mutations: molecular biological, physiological and clinical aspects. Europ. J. Clin. Invest. 26:613-624, 1996.

Hoppner, W.; Ritter, M. M.: A duplication of 12 bp in the critical cysteine rich domain of the RET proto-oncogene results in a distinct phenotype of multiple endocrine neoplasia type 2A. Hum. Molec. Genet. 6:587-590, 1997.

Ikeda, I.; Ishizaka, Y.; Tahira, T.; Suzuki, T.; Onda, M.; Sugimura, T.; Nagao, M.: Specific expression of the ret proto-oncogene in human Neuroblastoma cell lines. Oncogene 5:1291-1296, 1990.

Ishizaka, Y.; Itoh, F.; Tahira, T.; Ikeda, I.; Sugimura, T.; Tucker, J.; Fertitta, A.; Carrano, A. V.; Nagao, M.: Human ret proto-oncogene mapped to chromosome 10q11.2. Oncogene 4:1519-1521, 1989.

Japon, M. A.; Urbano, A. G.; Saez, C.; Segura, D. I.; Cerro, A. L.; Dieguez, C.; Alvarez, C. V.: Glial-derived neurotropic factor and RET gene expression in normal human anterior pituitary cell types and in pituitary tumors. J. Clin. Endocr. Metab. 87:1879-1884,2002.

Julies, M. G.; Moore, S. W.; Kotze, M. J.; du Plessis, L.: Novel RET mutations in Hirschsprung's disease patients from the diverse South African population. Europ. J. Hum. Genet. 9:419-423, 2001.

Klugbauer, S.; Demidchik, E. P.; Lengfelder, E.; Rabes, H. M.: Detection of a novel type of RET rearrangement (PTC5) in thyroid carcinomas after Chernobyl and analysis of the involved RET-fused gene RFG5. Cancer Res. 58:198-203, 1998.

Watson, C. E.; Draganov, D. I.; Billecke, S. S.; Bisgaier, C. L.; La Du, B. N.: Rabbits possess a serum paraoxonase polymorphism similar to the human Q192R. Pharmacogenetics 11:123-134, 2001.

Yamasaki, Y.; Sakamoto, K.; Watada, H.; Kajimoto, Y.; Hori, M.: The arg-192 isoform of paraoxonase with low sarin-hydrolyzing activity is dominant in the Japanese. Hum. Genet. 101:67-68, 1997.

Badger, K. S.; Sussman, H. H.: Structural evidence that human liver and placental alkaline phosphatase isoenzymes are coded by different genes. Proc. Nat. Acad. Sci. 73:2201-2205, 1976.

Beckman, L.; Beckman, G.; Christodoulou, C.; Ifekwunigwe, A.:Variations in human placental alkaline phosphatase. Acta Genet. Statist. Med. 17:406-412, 1967.

Beckman, L.; Bjorling, G.; Christodoulou, C.: Pregnancy enzymes and placental polymorphism: alkaline phosphatase. Acta Genet. Statist. Med. 16:59-73, 1966.

Boyer, S. H.: Alkaline phosphatase in human sera and placenta. Science 134:1002-1004, 1961.

Brecher, R.; Bird, A. C.: Adult vitelliform macular dystrophy. Eye 4:210-215, 1990.

Cullen, T. S.: Embryology, Anatomy, and Diseases of the Umbilicus Together with Diseases of the Urachus. Philadelphia: W. B. Saunders (pub.) 1916.

Friedman, J. M.: Umbilical dysmorphology: the importance of contemplating the belly button. Clin. Genet. 28:343-347, 1985.

Legius, E.; de Die-Smulders, C. E. M.; Verbraak, F.; Habex, H.; Decorte, R.; Marynen, P.; Fryns, J. P.; Cassiman, J. J.: Genetic heterogeneity in Rieger eye malformation. J. Med. Genet. 31:340-341,1994.

Phillips, J. C.; Del Bono, E. A.; Haines, J. L.; Pralea, A. M.; Cohen, J. S.; Greff, L. J.; Wiggs, J. L.: A second locus for Rieger syndrome maps to chromosome 13q14. Am. J. Hum. Genet. 59:613-619,1996.

Chu, X.; Thompson, D.; Yee, L. J.; Sung, L. A.: Genomic organization of mouse and human erythrocyte tropomodulin genes encoding the pointed end capping protein for the actin filaments. Gene 256:271-281,2000.

Fowler, V. M.; Sussmann, M. A.; Miller, P. G.; Flucher, B. E.; Daniels, M. P.: Tropomodulin is associated with the free (pointed) ends of the thin filaments in rat skeletal muscle. J. Cell Biol. 120:411-420, 1993.

Gilligan, D. M.; Bennett, V.: The junctional complex of the membrane skeleton. Semin. Hemat. 30:74-83, 1993.

Lench, N. J.; Telford, E. A.; Andersen, S. E.; Moynihan, T. P.; Robinson, P. A.; Markham, A. F.: An EST and STS-based YAC contigmap of human chromosome 9q22.3 Genomics 38:199-205, 1996.

Sung, L. A.; Fan, Y.-S.; Lin, C. C.: Gene assignment, expression, and homology of human tropomodulin. Genomics 34:92-96, 1996.

Sung, L. A.; Fan, Y. S.; Lambert, K.; Fowler, V.; Chien, S.; Lin, C.: Assignment of human erythrocyte tropomodulin gene to q22 of chromosome 9. (Abstract) Cytogenet. Cell Genet. 58:1944, 1991.

Sung, L. A.; Fowler, V. M.; Lambert, K.; Chien, S.: molecular cloning of human erythroid tropomodulin. (Abstract) FASEB J. 5:A1625, 1991.

Sung, L. A.; Fowler, V. M.; Lambert, K.; Sussman, M. A.; Karr, D.; Chien, S.: Molecular cloning and characterization of human fetal liver tropomodulin: a tropomyosin-binding protein. J. Biol. Chem. 267:2616-2621, 1992.

White, R. A.; Dowler, L. L.; Woo, M.; Adkison, L. R.; Pal, S.; Gershon, D.; Fowler, V. M.: The tropomodulin (Tmod) gene maps to chromosome 4, closely linked to Mup1. Mammalian Genome 6:332-333,1995.

Tauchi, H.; Matsuura, S.; Isomura, M.; Kinjo, T.; Nakamura, A.; Sakamoto, S.; Kondo, N.; Endo, S.; Komatsu, K.; Nakamura, Y.: Sequence analysis of an 800-kb genomic DNA region on chromosome 8q21 that contains the Nijmegen breakage syndrome gene, NBS1. Genomics 55:242-247, 1999.

Hamajima, N.; Matsuda, K.; Sakata, S.; Tamaki, N.; Sasaki, M.; Nonaka, M.: A novel gene family defined by human dihydropyrimidinase and three related proteins with differential tissue distribution. Gene 180:157-163, 1996.

Bardwick, P. A.; Zvaifler, N. J.; Gill, G. N.; Newman, D.; Greenway, G. D.; Resnick, D. L.: Plasma cell dyscrasia with polyneuropathy, organomegaly, endocrinopathy, M protein, and skin changes: the POEMS syndrome. Report on two cases and a review of the literature. Medicine 59:311-322, 1980.

Bandmann, O.; Davis, M. B.; Marsden, C. D.; Wood, N. W.: The human homologue of the weaver mouse gene in familial and sporadic Parkinson's disease. Neuroscience 72:877-879, 1996.

Domer, P. H.; Fakharzadeh, S. S.; Chen, C.-S.; Jockel, J.; Johansen, L.; Silverman, G. A.; Kersey, J. H.; Korsmeyer, S. J.: Acute mixed-lineage leukemia t (4;11)(q21; q23) generates an MLL-AF4 fusion product. Proc. Nat. Acad. Sci. 90:7884-7888, 1993.

Gu, Y.; Nakamura, T.; Alder, H.; Prasad, R.; Canaani, O.; Cimino, G.; Croce, C. M.; Canaani, E.: The t (4;11) chromosome translocation of human acute leukemias fuses the ALL-1 gene, related to Drosophila trithorax, to the AF-4 gene. Cell 71:701-708, 1992.

Nakamura, T.; Alder, H.; Gu, Y.; Prasad, R.; Canaani, O.; Kamada, N.; Gale, R. P.; Lange, B.; Crist, W. M.; Nowell, P. C.; Croce, C. M.; Canaani, E.: Genes on chromosomes 4, 9, and 19 involved in 11q23 abnormalities in acute leukemia share sequence homology and/or common motifs. Proc. Nat. Acad. Sci. 90:4631-4635, 1993.

Harroch, S.; Furtado, G. C.; Brueck, W.; Rosenbluth, J.; Lafaille, J.; Chao, M.; Buxbaum, J. D.; Schlessinger, J.: A critical role for the protein tyrosine phosphatase receptor type Z in functional recovery from demyelinating lesions. Nature Genet. 30 Sept., 2002. Note: Advance Electronic Publication.

Marsden, P. A.; Heng, H. H. Q.; Scherer, S. W.; Stewart, R. J.; Hall, A. V.; Shi, X.-M.; Tsui, L.-C.; Schappert, K. T.: Structure and chromosomal localization of the human constitutive endothelial nitric oxide synthase gene. J. Biol. Chem. 268:17478-17488, 1993.

Miyamoto, Y.; Saito, Y.; Nakayama, M.; Shimasaki, Y.; Yoshimura, T.; Yoshimura, M.; Harada, M.; Kajiyama, N.; Kishimoto, I.; Kuwahara, K.; Hino, J.; Ogawa, E.; Hamanaka, I.; Kamitani, S.; Takahashi, N.; Kawakami, R.; Kangawa, K.; Yasue, H.; Nakao, K.: Replication protein A1 reduces transcription of the endothelial nitric oxide synthase gene containing a -786T-C mutation associated with coronary spastic angina. Hum. Molec. Genet. 9:2629-2637, 2000.

Nakayama, M.; Yasue, H.; Yoshimura, M.; Shimasaki, Y.; Kugiyama, K.; Ogawa, H.; Motoyama, T.; Saito, Y.; Ogawa, Y.; Miyamoto, Y.; Nakao, K.: T(-786)-C mutation in the 5-prime-flanking region of the endothelial nitric oxide synthase gene is associated with coronary spasm. Circulation 99:2864-2870, 1999.

Clark, C. C.; Cohen, I.; Eichstetter, I.; Cannizzaro, L. A.; McPherson, J. D.; Wasmuth, J. J.; Iozzo, R. V.: Molecular cloning of the human proto-oncogene Wnt-5A and mapping of the gene (WNT5A) to chromosome 3p14-p21. Genomics 18:249-260, 1993.

He, X.; Saint-Jeannet, J.-P.; Wang, Y.; Nathans, J.; Dawid, I.; Varmus, H.: A member of the frizzled protein family mediating axis induction by Wnt-5A. Science 275:1652-1654, 1997.

Adelaide, J.; Mattei, M.-G.; Marics, I.; Raybaud, F.; Planche, J.; De Lapeyriere, O.; Birnbaum, D.: Chromosomal localization of the hst oncogene and its co-amplification with the int.2 oncogene in a human melanoma. Oncogene 2:413-416, 1988.

Dudley, A. T.; Ros, M. A.; Tabin, C. J.: A re-examination of proximodistal patterning during vertebrate limb development. Nature 418:539-544,2002.

Feldman, B.; Poueymirou, W.; Papaionnou, V. E.; DeChiara, T. M.; Goldfarb, M.: Requirement of FGF-4 for post implantation mouse development. Science 267:246-249, 1995.

Huebner, K.; Ferrari, A. C.; Delli Bovi, P.; Croce, C. M.; Basilico, C.: The FGF-related oncogene, K-FGF, maps to human chromosome region11q13, possibly near int-2. Oncogene Res. 3:263-270, 1988.

Sakamoto, H.; Mori, M.; Taira, M.; Yoshida, T.; Matsukawa, S.; Shimizu, K.; Sekiguchi, M.; Terada, M.; Sugimura, T.: Transforming gene from human stomach cancers and a noncancerous portion of stomach mucosa. Proc. Nat. Acad. Sci. 83:3997-4001, 1986.

Sun, X.; Lewandoski, M.; Meyers, E. N.; Liu, Y.-H.; Maxson, R. E., Jr.; Martin, G. R.: Conditional inactivation of Fgf4 reveals complexity of signalling during limb bud development. Nature Genet. 25:83-86, 2000.

Sun, X.; Mariani, F. V.; Martin, G. R.: Functions of FGF signalling from the apical ectodermal ridge in limb development. Nature 418:501-508, 2002.

Sharp, D.; Blinderman, L.; Combs, K. A.; Kienzle, B.; Ricci, B.; Wager-Smith, K.; Gil, C. M.; Turck, C. W.; Bouma, M.-E.; Rader, D. J.; Aggerbeck, L. P.; Gregg, R. E.; Gordon, D. A.; Wetterau, J. R.: Cloning and gene defects in microsomal triglyceride transfer protein associated with abeta lipoproteinaemia. Nature 365:65-69, 1993.

Julier, C.; Lathrop, M.; Lalouel, J. M.; Kaplan, J. C.: Use of multilocus tests of gene order: example for chromosome 22. (Abstract) Cytogenet. Cell Genet. 40:663-664, 1985.

Julier, C.; Lathrop, M.; Lalouel, J. M.; Reghis, A.; Szajnert, M. F.; Kaplan, J. C.: New restriction fragment length polymorphisms on human chromosome 22 at loci SIS, MB and IGLV. (Abstract) Cytogenet. Cell Genet. 40:664 only, 1985.

Julier, C.; Reghis, A.; Szajnert, M. F.; Kaplan, J. C.; Lathrop, G. M.; Lalouel, J. M.: A preliminary linkage map of human chromosome 22. (Abstract) Cytogenet. Cell Genet. 40:665 only, 1985.

Bodmer, J. G.; Marsh, S. G. E.; Albert, E.: Nomenclature for factors of the HLA system, 1989. Immun. Today 11:3-10, 1990.

Ferber, K. M.; Keller, E.; Albert, E. D.; Ziegler, A.-G.: Predictive value of human leukocyte antigen class II typing for the development of islet autoantibodies and insulin-dependent diabetes postpartum in women with gestational diabetes. J. Clin. Endocr. Metab. 84:2342-2348, 1999.

Disteche, C. M.; Adler, D. A.; Tedder, T. F.; Saito, H.: mapping of the genes for LYAM1, a new lymphocyte adhesion molecule, and for LAR, a new receptor-linked protein tyrosine phosphatase, to human chromosome 1. (Abstract) Cytogenet. Cell Genet. 51:990 only, 1989.

Wijmenga, C.; Hansen, R. S.; Gimelli, G.; Bjorck, E. J.; Davies, E. G.; Valentine, D.; Belohradsky, B. H.; van Dongen, J. J.; Smeets, D. F. C. M.; van den Heuvel, L. P. W. J.; Luyten, J. A. F. M.; Strengman, E.; Weemaes, C.; Pearson, P. L.: Genetic variation in ICF syndrome:evidence for genetic heterogeneity. Hum. Mutat. 16:509-517, 2000.

Ehrlich, M.; Buchanan, K. L.; Tsien, F.; Jiang, G.; Sun, B.; Uicker, W.; Weemaes, C. M. R.; Smeets, D.; Sperling, K.; Belohradsky, B. H.; Tommerup, N.; Misek, D. E.; Rouillard, J.-M.; Kuick, R.; Hanash, S. M.: DNA methyltransferase 3B mutations linked to the ICF syndrome cause dysregulation of lymphogenesis genes. Hum. Molec. Genet. 10:2917-2931, 2001.

Fredrickson, D. S.; Levy, R. I.: Familial hyperlipoproteinemia. In:Stanbury, J. B.; Wyngaarden, J. B.; Fredrickson, D. S.: The Metabolic Basis of Inherited Disease. New York: McGraw-Hill (pub.) (3rded.):1972. Pp. 545-614.

Ameis, D.; Kobayashi, J.; Davis, R. C.; Ben-Zeev, O.; Malloy, M. J.; Kane, J. P.; Lee, G.; Wong, H.; Havel, R. J.; Schotz, M. C.:Familial chylomicronemia (type I hyperlipoproteinemia) due to a single missense mutation in the lipoprotein lipase gene. J. Clin. Invest. 87:1165-1170, 1991.

Auwerx, J. H.; Babirak, S. P.; Fujimoto, W. Y.; Iverius, P. H.; Brunzell, J. D.: Defective enzyme protein in lipoprotein lipase deficiency. Europ. J. Clin. Invest. 19:433-437, 1989.

Beg, O. U.; Meng, M. S.; Skarlatos, S. I.; Previato, L.; Brunzell, J. D.; Brewer, H. B., Jr.; Fojo, S. S.: Lipoprotein lipase (Bethesda):a single amino acid substitution (ala176-to-thr) leads to abnormal heparin binding and loss of enzymic activity. Proc. Nat. Acad. Sci. 87:3474-3478, 1990.

Benlian, P.; De Gennes, J. L.; Foubert, L.; Zhang, H.; Gagne, S. E.; Hayden, M.: Premature atherosclerosis in patients with familial chylomicronemia caused by mutations in the lipoprotein lipase gene. NewEng. J. Med. 335:848-854, 1996.

Berger, G. M. B.: An incomplete form of familial lipoprotein lipase deficiency presenting with type I hyperlipoproteinemia. Am. J. Clin. Path. 88:369-373, 1987.

Berger, H.; Richter, A.; Gilardi, A.; Wagner, H.: Essential familial hyperlipaemia in a 2-year-old child. Ann. Paediat. 199:445-466,1962.

Bergeron, J.; Normand, T.; Bharucha, A.; Ven Murthy, M. R.; Julien, P.; Gagne, C.; Dionne, C.; De Braekeleer, M.; Brun, D.; Hayden, M. R.; Lupien, P. J.: Prevalence, geographical distribution and genealogical investigations of mutation 188 of lipoprotein lipase gene in the French Canadian population of Quebec. Clin. Genet. 41:206-210, 1992.

Bertolini, S.; Simone, M. L.; Pes, G. M.; Ghisellini, M.; Rolleri, M.; Bellocchio, A.; Elicio, N.; Masturzo, P.; Calandra, S.: Pseudodominance of lipoprotein lipase (LPL) deficiency due to a nonsense mutation (tyr302-to-term) in exon 6 of LPL gene in an Italian family from Sardinia (LPL-Olbia). Clin. Genet. 57:140-147, 2000.

Boer, J. M. A.; Kuivenhoven, J. A.; Feskens, E. J. M.; Schouten, E. G.; Havekes, L. M.; Seidell, J. C.; Kastelein, J. J. P.; Kromhout, D.: Physical activity modulates the effect of a lipoprotein lipase mutation (D9N) on plasma lipids and lipoproteins. Clin. Genet. 56:158-163, 1999.

Boggs, J. D.; Hsia, D. Y.-Y.; Mais, R. F.; Bigler, J. A.: The genetic mechanism of idiopathic hyperlipemia. New Eng. J. Med. 257:1101-1108, 1957.

Breckenridge, W. C.; Little, A. C.; Steiner, G.; Chow, A.; Poapst, M.: Hypertriglyceridemia associated with deficiency of C-II apoprotein in plasma lipoproteins. New Eng. J. Med. 298:1265-1273, 1978.

Brunzell, J. D.; Chait, A.; Nikkila, E. A.; Ehnholm, C.; Huttunen, J. K.; Steiner, G.: Heterogeneity of primary lipoprotein lipase deficiency. Metabolism 29:624-629, 1980.

Busca, R.; Martinez, M.; Vilella, E.; Pognonec, P.; Deeb, S.; Auwerx, J.; Reina, M.; Vilaro, S.: The mutation gly142-to-glu in human lipoprotein lipase produces a missorted protein that is diverted to lysosomes. J. Biol. Chem. 271:2139-2146, 1996.

Cantin, B.; Boudriau, S.; Bertrand, M.; Brun, L.-D.; Gagne, C.; Rogers, P. A.; Ven Murthy, M. R.; Lupien, P.-J.; Julien, P.: Hemolysis in primary lipoprotein lipase deficiency. Metabolism 44:652-658,1995.

Chimienti, G.; Capurso, A.; Resta, F.; Pepe, G.: A G-to-C change at the donor splice site of intron 1 causes lipoprotein lipase deficiency in a Southern-Italian family. Biochem. Biophys. Res. Commun. 187:620-627, 1992.

Clark, A. G.; Weiss, K. M.; Nickerson, D. A.; Taylor, S. L.; Buchanan, A.; Stengard, J.; Salomaa, V.; Vartiainen, E.; Perola, M.; Boerwinkle, E.; Sing, C. F.: Haplotype structure and population genetic inferences from nucleotide-sequence variation in human lipoprotein lipase. Am. J. Hum. Genet. 63:595-612, 1998.

Clee, S. M.; Loubser, O.; Collins, J.; Kastelein, J. J. P.; Hayden, M. R.: The LPL S447X cSNP is associated with decreased blood pressure and plasma triglycerides, and reduced risk of coronary artery disease. Clin. Genet. 60:293-300, 2001.

De Braekeleer, M.; Dionne, C.; Gagne, C.; Julien, P.; Brun, D.; Ven Murthy, M. R.; Lupien, P.-J.: Founder effect in familial hyperchylomicronemia among French Canadians of Quebec. Hum. Hered. 41:168-173, 1991.

De Bruin, T. W. A.; Mailly, F.; Van Barlingen, H. H. J. J.; Fisher, R.; Castro Cabezas, M.; Talmud, P.; Dallinga-Thie, G. M.; Humphries, S. E.: Lipoprotein lipase gene mutations D9N and N291S in four pedigrees with familial combined hyperlipidaemia. Europ. J. Clin. Invest. 26:631-639, 1996.

Deeb, S. S.; Peng, R.: Structure of the human lipoprotein lipasegene. Biochemistry 28:4131-4135, 1989.

Henderson, H. E.; Hassan, F.; Berger, G. M. B.; Hayden, M. R.: The lipoprotein lipase gly 188-to-glu mutation in South Africans of Indian descent: evidence suggesting common origins and an increased frequency. J. Med. Genet. 29:119-122, 1992.

Henderson, H. E.; Hassan, F.; Marais, D.; Hayden, M. R.: A new mutation destroying disulphide bridging in the C-terminal domain of lipoprotein lipase. Biochem. Biophys. Res. Commun. 227:189-194,1996.

Henderson, H. E.; Ma, Y.; Hassan, M. F.; Monsalve, M. V.; Marais, A. D.; Winkler, F.; Gubernator, K.; Peterson, J.; Brunzell, J. D.; Hayden, M. R.: Amino acid substitution (ile194-to-thr) in exon 5 of the lipoprotein lipase gene causes lipoprotein lipase deficiency in three unrelated probands: support for a multicentric origin. J. Clin. Invest. 87:2005-2011, 1991.

Sekiguchi, K.; Klos, A. M.; Kurachi, K.; Yoshitake, S.; Hakomori, S.: Human liver fibronectin complementary DNAs: identification of two different messenger RNAs possibly encoding the alpha and beta subunits of plasma fibronectin. Biochemistry 25:4936-4941, 1986.

Shirakami, A.; Shigekiyo, T.; Hirai, Y.; Takeichi, T.; Kawauchi, S.; Saito, S.; Miyoshi, K.: Plasma fibronectin deficiency in eight members of one family. Lancet I:473-474, 1986.

Shows, T. B.: Personal Communication. Buffalo, N. Y. 1982.

Skow, L. C.; Adkison, L.; Womack, J. E.; Beamer, W. G.; Taylor, B. A.: Mapping of the mouse fibronectin gene (Fn-1) to chromosome 1: conservation of the Idh-1--Cryg--Fn-1 synteny group in mammals. Genomics 1:283-286, 1987.

Smith, M.; Gold, L. I.; Pearlstein, E.; Krinsky, A.: Expression of mouse and human fibronectin in hybrid cells. (Abstract) Cytogenet. Cell Genet. 25:205 only, 1979.

Smith, M.; Krinsky, A. M.; Arredondo-Vega, F. X.; Pearlstein, E.: Production of soluble fibronectin by RAG x human fibroblast hybrids. (Abstract) Cytogenet. Cell Genet. 32:318 only, 1982.

Wu, B.-L.; Milunsky, A.; Wyandt, H.; Hoth, C.; Baldwin, C.; Skare, J.: In situ hybridization applied to Waardenburg syndrome. Cytogenet. Cell Genet. 63:29-32, 1993.

Zardi, L.; Cianfriglia, M.; Balza, E.; Carnemolla, B.; Siri, A.; Croce, C. M.: Species-specific monoclonal antibodies in the assignment of the gene for human fibronectin to chromosome 2. EMBO J. 1:929-933,1982.

Zardi, L.; Siri, A.; Carnemolla, B.; Santi, L.; Gardner, W. D.; Hoch, S. O.: Fibronectin: a chromatin-associated protein? Cell 18:649-657, 1979.

Adkison, L. R.; White, R. A.; Haney, D. M.; Lee, J. C.; Pusey, K. T.; Gardner, J.: The fibronectin receptor, alpha subunit (Itga5) maps to murine chromosome 15, distal to D15Mit16. Mammalian Genome 5:456-457, 1994.

Argraves, W. S.; Pytela, R.; Suzuki, S.; Millan, J. L.; Pierschbacher, M. D.; Ruoslahti, E.: cDNA sequences from the alpha subunit of the fibronectin receptor predict a transmembrane domain and a short cytoplasmic peptide. J. Biol. Chem. 261:12922-12924, 1986.

Argraves, W. S.; Suzuki, S.; Arai, H.; Thompson, K.; Pierschbacher, M. D.; Ruoslahti, E.: Amino acid sequence of the human fibronectin receptor. J. Cell Biol. 105:1183-1190, 1987.

Fitzgerald, L. A.; Poncz, M.; Steiner, B.; Rall, S. C., Jr.; Bennett, J. S.; Phillips, D. R.: Comparison of cDNA-derived protein sequences of the human fibronectin and vitronectin receptor alpha-subunits and platelet glycoprotein IIb. Biochemistry 26:8158-8165, 1987.

Krissansen, G. W.; Yuan, Q.; Jenkins, D.; Jiang, W.-M.; Rooke, L.; Spurr, N. K.; Eccles, M.; Leung, E.; Watson, J. D.: Chromosomal locations of the genes coding for the integrin beta-6 and beta-7 subunits. Immunogenetics 35:58-61, 1992.

Sosnoski, D.; Emanuel, B. S.; Hawkins, A. L.; van Tuinen, P.; Ledbetter, D. H.; Nussbaum, R. L.; Kaos, F.-T.; Schwartz, E.; Phillips, D.; Bennett, J. S.; Fitzgerald, L. A.; Poncz, M.: Chromosomal localization of the genes for the vitronectin and fibronectin receptors alpha-subunits and for platelet glycoproteins IIb and IIIa. J. Clin. Invest. 81:1993-1998, 1988.

Spurr, N. K.; Rooke, L.: Confirmation of the assignment of the vitronectin (VNRA) and fibronectin (FNRA) receptor alpha-subunits. Ann. Hum. Genet. 55:217-223, 1991.

Akula, S. M.; Pramod, N. P.; Wang, F.-Z.; Chandran, B.: Integrin alpha-3/beta-1 (CD 49c/29) is a cellular receptor for Kaposi's sarcoma-associated herpes virus (KSHV/HHV-8) entry into the target cells. Cell 108:407-419, 2002.

Arregui, C.; Pathre, P.; Lilien, J.; Balsamo, J.: The nonreceptor tyrosine kinase Fer mediates cross-talk between N-cadherin and beta-1-integrins. J. Cell Biol. 149:1263-1273, 2000.

Giuffra, L. A.; Lichter, P.; Wu, J.; Kennedy, J. L.; Pakstis, A. J.; Rogers, J.; Kidd, J. R.; Harley, H.; Jenkins, T.; Ward, D. C.; Kidd, K. K.: Genetic and physical mapping and population studies of a fibronectin receptor beta-subunit-like sequence on human chromosome 19. Genomics 8:340-346, 1990.

Giuffra, L. A.; Wu, J.; Lichter, P.; Kennedy, J. L.; Castiglione, C.; Pakstis, A. J.; Ward, D.; Kidd, K. K.: Mapping of a fibronectin receptor beta subunit-like sequence to chromosome 19. (Abstract) Am. J. Hum. Genet. 45 (suppl.): A141 only, 1989.

Goodfellow, P. J.; Nevanlinna, H. A.; Gorman, P.; Sheer, D.; Lam, G.; Goodfellow, P. N.: Assignment of the gene encoding the beta-subunit of the human fibronectin receptor (beta-FNR) to chromosome 10p11.2. Ann. Hum. Genet. 53:15-22, 1989.

Graus-Porta, D.; Blaess, S.; Senften, M.; Littlewood-Evans, A.; Damsky, C.; Huang, Z.; Orban, P.; Klein, R.; Schittny, J. C.; Muller, U.: Beta-1-class integrins regulate the development of laminae and folia in the cerebral and cerebellar cortex. Neuron 31:367-379, 2001.

Hynes, R. O.: Integrins: a family of cell surface receptors. Cell 48:549-554, 1987.

Johansson, S.; Forsberg, E.; Lundgren, B.: Comparison of fibronectin receptors from rat hepatocytes and fibroblasts. J. Biol. Chem. 262:7819-7824, 1987.

Lu, T. T.; Cyster, J. G.: Integrin-mediated long-term B cell retention in the splenic marginal zone. Science 297:409-412, 2002.

Messer Peters, P.; Kamarck, M. E.; Hemler, M. E.; Strominger, J. L.; Ruddle, F. H.: Genetic and biochemical characterization of human lymphocyte cell surface antigens: the A-1A5 and A-3A4 determinants. J. Exp. Med. 159:1441-1454, 1984.

Pytela, R.; Pierschbacher, M. D.; Ginsberg, M. H.; Plow, E. F.; Ruoslahti, E.: Platelet membrane glycoprotein IIb/IIIa: member of a family of arg-gly-asp-specific adhesion receptors. Science 231:1159-1162, 1986.

Woods, V. L., Jr.; Pischel, K. D.; Avery, E. D.; Bluestein, H. G.: Antigenic polymorphism of human very late activation protein-2 (platelet glycoprotein Ia-IIa): platelet alloantigen Hc (a). J. Clin. Invest. 83:978-985, 1989.

Wu, J. S.; Giuffra, L. A.; Goodfellow, P. J.; Myers, S.; Carson, N. L.; Anderson, L.; Hoyle, L. S.; Simpson, N. E.; Kidd, K. K.: The beta subunit locus of the human fibronectin receptor: DNA restriction fragment length polymorphism and linkage mapping studies. Hum. Genet. 83:383-390, 1989.

Figlewicz, D. A.; Delattre, O.; Guellaen, G.; Krizus, A.; Thomas, G.; Zucman, J.; Rouleau, G. A.: Mapping of human gamma-glutamyl transpeptidase genes on chromosome 22 and other human autosomes. Genomics 17:299-305,1993.

Pawlak, A.; Wu, S.-J.; Bulle, F.; Suzuki, A.; Chikhi, N.; Ferry, N.; Baik, J.-H.; Siegrist, S.; Guellaen, G.: Different gamma-glutamyl transpeptidase mRNAs are expressed in human liver and kidney. Biochem. Biophys. Res. Commun. 164:912-918, 1989.

Rajpert-De Meyts, E.; Heisterkamp, N.; Groffen, J.: Cloning and nucleotide sequence of human gamma-glutamyl transpeptidase. Proc. Nat. Acad. Sci. 85:8840-8844, 1988.

Wildhage, I.; Trusheim, H.; Goke, B.; Lankat-Buttgereit, B.: Gene expression of the human glucagon-like peptide-1 receptor is regulated by Sp1 and Sp3. Endocrinology 140: 624-631, 1999.

Chambers, S. M.; Morris, B. J.: Glucagon receptor gene mutation in essential hypertension. (Letter) Nature Genet. 12:122, 1996.

Rucknagel, D. L.; Shreffler, D. C.; Halstead, S. B.: The Bangkok variant of the serum group-specific component (Gc) and the frequency of the Gc alleles in Thailand. Am. J. Hum. Genet. 20:478-485, 1968.

Hager, J.; Hansen, L.; Vaisse, C.; Vionnet, N.; Philippi, A.; Poller, W.; Velho, G.; Carcassi, C.; Contu, L.; Julier, C.; Cambien, F.; Passa, P.; Lathrop, M.; Kindsvogel, W.; Demenais, F.; Nishimura, E.; Froguel, P.: A missense mutation in the glucagon receptor gene is associated with non-insulin-dependent diabetes mellitus. Nature Genet. 9:299-304,1995.

Lok, S.; Kuijper, J. L.; Jelinek, L. J.; Kramer, J. M.; Whitmore, T. E.; Sprecher, C. A.; Mathewes, S.; Grant, F. J.; Biggs, S. H.; Rosenberg, G. B.; Sheppard, P. O.; O'Hara, P. J.; Foster, D. C.; Kindsvogel, W.: The human glucagon receptor encoding gene: structure, cDNA sequence and chromosomal localization. Gene 140:203-209, 1994.

Menzel, S.; Stoffel, M.; Espinosa, R., III; Fernald, A. A.; LeBeau, M. M.; Bell, G. I.: Localization of the glucagon receptor gene to human chromosome band 17q25. Genomics 20:327-328, 1994.

Pierce, E. A.; Dame, M. C.; Bouillon, R.; Van Baelen, H.; DeLuca, H. F.: Monoclonal antibodies to human vitamin D-binding protein. Proc. Nat. Acad. Sci. 82:8429-8433, 1985.

Schoentgen, F.; Metz-Boutigue, M.-H.; Jolles, J.; Constans, J.; Jolles, P.: Homology between the human vitamin D-binding protein (group specific component), alpha-fetoprotein and serum albumin. FEBSLett. 185:47-50, 1985.

Seppala, M.; Ruoslahti, E.; Makela, O.: Inheritance and genetic linkage of Gc and TF groups. Acta Genet. Statist. Med. 17:47-54,1967.

Shibata, T.; Abe, T.: Linkage between the loci for serum albumin and vitamin D binding protein (GC) in the Japanese quail. Animal Genet. 27:195-197, 1996.

Svasti, J.; Kurosky, A.; Bennett, A.; Bowman, B. H.: Molecular basis for the three major forms of human serum vitamin D binding protein (group-specific component). Biochemistry 18:1611-1617, 1979.

Szathmary, E. J. E.: The effect of Gc genotype on fasting insulin level in Dogrib Indians. Hum. Genet. 75:368-372, 1987.

Thymann, M.; Hjalmarsson, K.; Svensson, M.: Five new Gc variants detected by isoelectric focusing in agarose gel. Hum. Genet. 60:340-343, 1982.

Vavrusa, B.; Cleve, H.; Constans, J.: A deficiency mutant of the Gc system. Hum. Genet. 65:102-107, 1983.

Weitkamp, L. R.: Comparative gene mapping: linkage between the albumin and Gc loci in the horse. (Abstract) Am. J. Hum. Genet. 30:128A only, 1978.

Weitkamp, L. R.: Concerning the linkage relationships of the Gc and MNSs loci. Hum. Genet. 43:215-220, 1978.

Weitkamp, L. R.; Rucknagel, D. L.; Gershowitz, H.: Genetic linkage between structural loci for albumin and group specific component (Gc). Am. J. Hum. Genet. 18:559-571, 1966.

Witke, F. W.; Gibbs, P. E. M.; Zielinski, R.; Yang, F.; Bowman, B. H.; Dugaiczyk, A.: Complete structure of the human Gc gene: differences and similarities between members of the albumin gene family. Genomics 16:751-754, 1993.

Yamamoto, N.; Homma, S.: Vitamin D-3 binding protein (group-specific component) is a precursor for the macrophage-activating signal factor from lysophosphatidylcholine-treated lymphocytes. Proc. Nat. Acad. Sci. 88:8539-8543, 1991.

Yamamoto, Y.; Nishimoto, H.; Ikemoto, S.: Interstitial Deletion of the proximal long arm of chromosome 4 associated with father-child incompatibility within the Gc-system: probable reduced gene dosage effect and partial piebald trait. Am. J. Med. Genet. 32:520-523,1989.

Yang, F.; Bergeron, J. M.; Linehan, L. A.; Lalley, P. A.; Sakaguchi, A. Y.; Bowman, B. H.: Mapping and conservation of the group-specific component gene in mouse. Genomics 7:509-516, 1990.

Yang, F.; Brune, J. L.; Naylor, S. L.; Cupples, R. L.; Naberhaus, K. H.; Bowman, B. H.: Human group-specific component (Gc) is a member of the albumin family. Proc. Nat. Acad. Sci. 82:7994-7998, 1985.

Yang, F.; Luna, V. J.; McAnelly, R. D.; Naberhaus, K. H.; Cupples, R. L.; Bowman, B. H.: Evolutionary and structural relationships among the group-specific component, albumin and alpha-fetoprotein. Nucleic Acids Res. 13:8007-8017, 1985.

Yasuda, T.; Ikehara, Y.; Takagi, S.; Mizuta, K.; Kishi, K.: A hereditary double double-banded variation in the vitamin D-binding protein (GC) system analyzed by immunoblotting: duplication of the1F and 1A2 genes? Hum. Genet. 82:89-91, 1989.

Harada, H.; Fujita, T.; Miyamoto, M.; Kimura, Y.; Maruyama, M.; Furia, A.; Miyata, T.; Taniguchi, T.: Structurally similar but functionally distinct factors, IRF-1 and IRF-2, bind to the same regulatory elements of IFN and IFN-inducible genes. Cell 58:729-739, 1989.

Nakashima, K.; Yanagisawa, M.; Arakawa, H.; Kimura, N.; Hisatsune, T.; Kawabata, M.; Miyazono, K.; Taga, T.: Synergistic signaling in fetal brain by STAT3-Smad1 complex bridged by p300. Science 284:479-482, 1999.

Bae, J.; Leo, C. P.; Hsu, S. Y.; Hsueh, A. J. W.: MCL-1S, a splicing variant of the anti apoptotic BCL-2 family member MCL-1, encodes a pro apoptotic protein possessing only the BH3 domain. J. Biol. Chem. 275:25255-25261, 2000.

Craig, R. W.; Jabs, E. W.; Zhou, P.; Kozopas, K. M.; Hawkins, A. L.; Rochelle, J. M.; Seldin, M. F.; Griffin, C. A.: Human and mouse chromosomal mapping of the myeloid cell leukemia-1 gene: MCL1 maps to human chromosome 1q21, a region that is frequently altered in preneoplastic and neoplastic disease. Genomics 23:457-463, 1994.

Kozopas, K. M.; Yang, T.; Buchan, H. L.; Zhou, P.; Craig, R. W.: MCL1, a gene expressed in programmed myeloid cell differentiation, has sequence similarity to BCL2. Proc. Nat. Acad. Sci. 90:3516-3520,1993.

Rinkenberger, J. L.; Horning, S.; Klocke, B.; Roth, K.; Korsmeyer, S. J.: Mcl-1 deficiency results in peri-implantation embryonic lethality. GenesDev. 14:23-27, 2000.

Hizawa, N.; Yamaguchi, E.; Furuya, K.; Ohnuma, N.; Kodama, N.; Kojima, J.; Ohe, M.; Kawakami, Y.: Association between high serum total IgE levels and D11S97 on chromosome 11q13 in Japanese subjects. J. Med. Genet. 32:363-369, 1995.

Sandford, A. J.; Shirakawa, T.; Moffatt, M. F.; Daniels, S. E.; Ra, C.; Faux, J. A.; Young, R. P.; Nakamura, Y.; Lathrop, G. M.; Cookson, W. O. C. M.; Hopkin, J. M.: Localisation of atopy and beta subunit of high-affinity IgE receptor (FCER1) on chromosome 11q. Lancet 341:332-334, 1993.

Harada, H.; Kondo, T.; Ogawa, S.; Tamura, T.; Kitagawa, M.; Tanaka, N.; Lamphier, M. S.; Hirai, H.; Taniguchi, T.: Accelerated exon skipping of IRF-1 mRNA in human myelodysplasia/leukemia: a possible mechanism of tumor suppressor inactivation Oncogene 9:3313-3320, 1994.

Harada, H.; Willison, K.; Sakakibara, J.; Miyamoto, M.; Fujita, T.; Taniguchi, T.: Absence of the type I IFN system in EC cells:transcriptional activator (IRF-1) and repressor (IRF-2) genes are developmentally regulated. Cell 63:303-312, 1990.

Itoh, S.; Harada, H.; Nakamura, Y.; White, R.; Taniguchi, T.:Assignment of the human interferon regulatory factor-1 (IRF1) gene to chromosome 5q23-q31. Genomics 10:1097-1099, 1991.

Ko, J.; Gendron-Fitzpatrick, A.; Splitter, G. A.: Susceptibility of IFN regulatory factor-1 and IFN consensus sequence binding protein-deficient mice to brucellosis. J. Immun. 168: 2433-2440, 2002.

Miyamoto, M.; Fujita, T.; Kimura, Y.; Maruyama, M.; Harada, H.; Sudo, Y.; Miyata, T.; Taniguchi, T.: Regulated expression of a gene encoding a nuclear factor, IRF-1, that specifically binds to IFN-beta gene regulatory elements. Cell 54:903-913, 1988.

Nozawa, H.; Oda, E.; Ueda, S.; Tamura, G.; Maesawa, C.; Muto, T.; Taniguchi, T.; Tanaka, N.: Functionally inactivating point mutation in the tumor-suppressor IRF-1 gene identified in human gastric cancer. Int. J. Cancer 77:522-527, 1998.

Tamura, G.; Sakata, K.; Nishizuka, S.; Maesawa, C.; Suzuki, Y.; Terashima, M.; Eda, Y.; Satodate, R.: Allelotype of adenoma and differentiated adenocarcinoma of the stomach. J. Path. 180:371-377, 1996.

Willman, C. L.; Sever, C. E.; Pallavicini, M. G.; Harada, H.; Tanaka, N.; Slovak, M. L.; Yamamoto, H.; Harada, K.; Meeker, T. C.; List, A. F.; Taniguchi, T.: Deletion of IRF-1, mapping to chromosome 5q31.1, in human leukemia and preleukemic myelodysplasia. Science 259:968-971, 1993.

Yamada, G.; Ogawa, M.; Akagi, K.; Miyamoto, H.; Nakano, N.; Itoh, S.; Miyazaki, J.; Nishikawa, S.; Yamamura, K.; Taniguchi, T.: Specific depletion of the B-cell population induced by aberrant expression of human interferon regulatory factor 1 gene in transgenic mice. Proc. Nat. Acad. Sci. 88:532-536, 1991.

Harada, H.; Kitagawa, M.; Tanaka, N.; Yamamoto, H.; Harada, K.; Ishihara, M.; Taniguchi, T.: Anti-oncogenic and oncogenic potentials of interferon regulatory factors-1 and -2. Science 259:971-974,1993.

Harada, H.; Takahashi, E.-I.; Itoh, S.; Harada, K.; Hori, T.-A.; Taniguchi, T.: Structure and regulation of the human interferon regulatory factor 1 (IRF-1) and IRF-2 genes: implications for a gene network in the interferon system. Molec. Cell. Biol. 14:1500-1509, 1994.

Hida, S.; Ogasawara, K.; Sato, K.; Abe, M.; Takayanagi, H.; Yokochi, T.; Sato, T.; Hirose, S.; Shirai, T.; Taki, S.; Taniguchi, T.: CD8+T cell-mediated skin disease in mice lacking IRF-2, the transcriptional attenuator of interferon-alpha/beta signaling. Immunity 13:643-655,2000.

Nishio, Y.; Noguchi, E.; Ito, S.; Ichikawa, E.; Umebayashi, Y.; Otsuka, F.; Arinami, T.: Mutation and association analysis of the interferon regulatory factor 2 gene (IRF2) with atopic dermatitis. J. Hum. Genet. 46:664-667, 2001.

Rouault, T. A.; Tang, C. K.; Kaptain, S.; Burgess, W. H.; Haile, D. J.; Samaniego, F.; McBride, O. W.; Harford, J. B.;

Klausner, R. D.: Cloning of the cDNA encoding an RNA regulatory protein: the human iron-responsive element-binding protein. Proc. Nat. Acad. Sci. 87:7958-7962, 1990.

Kogan, S. C.; Lagasse, E.; Atwater, S.; Bae, S.; Weissman, I.; Ito, Y.; Bishop, J. M.: The PEBP2-beta-MYH11 fusion created by inv (16)(p13; q22) in myeloid leukemia impairs neutrophil maturation and contributes to granulocytic dysplasia. Proc. Nat. Acad. Sci. 95:11863-11868,1998.

Liu, P.; Tarle, S. A.; Hajra, A.; Claxton, D. F.; Marlton, P.; Freedman, M.; Siciliano, M. J.; Collins, F. S.: Fusion between transcription factor CBF-beta/PEBP2-beta and a myosin heavy chain in acute myeloid leukemia. Science 261:1041-1044, 1993.

Liu, P. P.; Hajra, A.; Wijmenga, C.; Collins, F. S.: Molecular pathogenesis of the chromosome 16 inversion in the M4Eo subtype of acute myeloid leukemia. Blood 85:2289-2302, 1995.

Lutterbach, B.; Hou, Y.; Durst, K. L.; Hiebert, S. W.: The inv (16) encodes an acute myeloid leukemia 1 transcriptional co repressor. Proc. Nat. Acad. Sci. 96:12822-12827, 1999.

O'Reilly, J.; Chipper, L.; Springall, F.; Herrmann, R.: A unique structural abnormality of chromosome 16 resulting in a CBF-beta-MYH11fusion transcript in a patient with acute myeloid leukemia, FAB M4. Cancer Genet. Cytogenet. 121: 52-55, 2000.

Ogawa, E.; Inuzuka, M.; Maruyama, M.; Satake, M.; Naito-Fujimoto, M.; Ito, Y.; Shigesada, K.: Molecular cloning and characterization of PEBP2-beta, the heterodimeric partner of a novel Drosophila runt-related DNA binding protein PEBP2-alpha. Virology 194:314-331, 1993.

Wang, S.; Wang, Q.; Crute, B. E.; Melnikova, I. N.; Keller, S. R.; Speck, N. A.: Cloning and characterization of subunits of the T-cell receptor and murine leukemia virus enhancer core-binding factor. Molec. Cell. Biol. 13:3324-3339, 1993.

Pellegata, N. S.; Dieguez-Lucena, J. L.; Joensuu, T.; Lau, S.; Montgomery, K. T.; Krahe, R.; Kivela, T.; Kucherlapati, R.; Forsius, H.; de la Chapelle, A.: Mutations in KERA, encoding keratocan, cause cornea plana. Nature Genet. 25:91-95, 2000.

Fabrizi, G. M.; Rizzuto, R.; Nakase, H.; Mita, S.; Lomax, M. I.; Grossman, L. I.; Schon, E. A.: Sequence of a cDNA specifying subunit VIIa of human cytochrome c oxidase. Nucleic Acids Res. 17:7107 only, 1989.

Wolz, W.; Kress, W.; Mueller, C. R.: Genomic sequence structure and organization of the human gene for cytochrome c oxidase subunit (COX7A1) VIIa-M. Genomics 45:438-442, 1997.

Brooks, B. A.; McBride, O. W.; Dolphin, C. T.; Farrall, M.; Scambler, P. J.; Gonzalez, F. J.; Idle, J. R.: The gene CYP3 encoding P450PCN1(nifedipine oxidase) is tightly linked to the gene COL1A2 encoding collagen type 1 alpha on 7q21-q22.1. Am. J. Hum. Genet. 43:280-284,1988.

Chen, H.; Sandler, D. P.; Taylor, J. A.; Shore, D. L.; Liu, E.; Bloomfield, C. D.; Bell, D. A.: Increased risk for myelodysplastic syndromes in individuals with glutathione transferase theta 1 (GSTT1) gene defect. Lancet 347:295-297, 1996.

Daly, A. K.; Salh, B. S.; Bilton, D.; Allen, J.; Knight, A. D.; Webb, A. K.; Braganza, J. M.; Idle, J. R.: Deficient nifedipine oxidation:a rare inherited trait associated with cystic fibrosis kindreds. Pharmacogenetics 2:19-24, 1992.

Elshourbagy, N. A.; Guzelian, P. S.: Separation, purification, and characterization of a novel form of hepatic cytochrome P-450 from rats treated with pregnenolone-16-alpha-carbonitrile. J. Biol. Chem. 255:1279-1285, 1980.

Felix, C. A.; Walker, A. H.; Lange, B. J.; Williams, T. M.; Winick, N. J.; Cheung, N.-K. V.; Lovett, B. D.; Nowell, P. C.; Blair, I. A.; Rebbeck, T. R.: Association of CYP3A4 genotype with treatment-related leukemia. Proc. Nat. Acad. Sci. 95:13176-13181, 1998.

Forrester, L. M.; Neal, G. E.; Judah, D. J.; Glancey, M. J.; Wolf, C. R.: Evidence for involvement of multiple forms of cytochrome P-450 in aflatoxin B(1) metabolism in human liver. Proc. Nat. Acad. Sci. 87:8306-8310, 1990.

Gonzalez, F. J.; Schmid, B. J.; Umeno, M.; McBride, O. W.; Hardwick, J. P.; Meyer, U. A.; Gelboin, H. V.; Idle, J. R.: Human P450PCN1:sequence, chromosome localization, and direct evidence through cDNA expression that P450PCN1 is nifedipine oxidase. DNA 7:79-86, 1988.

Hoyo-Vadillo, C.; Castaneda-Hernandez, G.; Herrera, J. E.; Vidal-Garate, J.; Moreno-Ramos, A.; Chavez, F.; Hong, E.: Pharmacokinetics of nifedipine slow release tablet in Mexican subjects: further evidence for an oxidation polymorphism. J. Clin. Pharm. 29:816-820, 1989.

Inoue, K.; Inazawa, J.; Nakagawa, H.; Shimada, T.; Yamazaki, H.; Guengerich, F. P.; Abe, T.: Assignment of the human cytochrome P-450 nifedipine oxidase gene (CYP3A4) to chromosome 7 at band q22.1 by fluorescence in situ hybridization. Jpn. J. Hum. Genet. 37:133-138,1992.

Kittles, R. A.; Chen, W.; Panguluri, R. K.; Ahaghotu, C.; Jackson, A.; Adebamowo, C. A.; Griffin, R.; Williams, T.; Ukoli, F.; Adams-Campbell, L.; Kwagyan, J.; Isaacs, W.; Freeman, V.; Dunston, G. M.: CYP3A4-Vand prostate cancer in African Americans: causal or confounding association because of population stratification? Hum. Genet. 110:553-560,2002.

Kleinbloesem, C. H.; van Brummelen, P.; Faber, H.; Danhof, M.; Vermeulen, N. P. E.; Breimer, D. D.: Variability in nifedipine pharmacokinetics and dynamics: a new oxidation polymorphism in man. Biochem. Pharm. 33:3721-3724, 1984.

Lehmann, J. M.; McKee, D. D.; Watson, M. A.; Willson, T. M.; Moore, J. T.; Kliewer, S. A.: The human orphan nuclear receptor PXR is activated by compounds that regulate CYP3A4 gene expression and cause drug interactions. J. Clin. Invest. 102:1016-1023, 1998.

Lown, K. S.; Bailey, D. G.; Fontana, R. J.; Janardan, S. K.; Adair, C. H.; Fortlage, L. A.; Brown, M. B.; Guo, W.; Watkins, P. B.: Grapefruit juice increases felodipine oral availability in human S by decreasing intestinal CYP3A protein expression. J. Clin. Invest. 99:2545-2553,1997.

Molowa, D. T.; Schuetz, E. G.; Wrighton, S. A.; Watkins, P. B.; Kremers, P.; Mendez-Picon, G.; Parker, G. A.; Guzelian, P. S.: Complete cDNA sequence of a cytochrome P-450 inducible by glucocorticoids in human liver. Proc. Nat. Acad. Sci. 83:5311-5315, 1986.

Paris, P. L.; Kupelian, P. A.; Hall, J. M.; Williams, T. L.; Levin, H.; Klein, E. A.; Casey, G.; Witte, J. S.: Association between a CYP3A4 genetic variant and clinical presentation in African-American prostate cancer patients. Cancer Epidemiol. Biomarkers Prev. 8:901-905, 1999.

Rebbeck, T. R.; Jaffe, J. M.; Walker, A. H.; Wein, A. J.; Malkowicz, S. B.: Modification of clinical presentation of prostate tumors by a novel genetic variant in CYP3A4. J. Nat. Cancer Inst. 90:1225-1229,1998.

Renwick, A. G.; Robertson, D. R. C.; Macklin, B.; Challenor, V.; Waller, D. G.; George, C. F.: The pharmacokinetics of oral nifedipine--a population study. Brit. J. Clin. Pharm. 25:701-708, 1988.

Thum, T.; Borlak, J.: Gene expression in distinct regions of the heart. Lancet 355:979-983, 2000.

Kelavkar, U. P.; Badr, K. F.: Effects of mutant p53 expression on human 15-lipoxygenase-promoter activity and murine 12/15-lipoxygenase gene expression: evidence that 15-lipoxygenase is a mutator gene. Proc. Nat. Acad. Sci. 96:4378-4383, 1999.

Sigal, E.; Craik, C. S.; Highland, E.; Grunberger, D.; Costello, L. L.; Dixon, R. A. F.; Nadel, J. A.: Molecular cloning and primary structure of human 15-lipoxygenase. Biochem. Biophys. Res. Commun. 157:457-464, 1988.

Yoshimoto, T.; Suzuki, H.; Yamamoto, S.; Takai, T.; Yokoyama, C.; Tanabe, T.: Cloning and sequence analysis of the cDNA for arachidonate12-lipoxygenase of porcine leukocytes. Proc. Nat. Acad. Sci. 87:2142-2146, 1990.

Minoshima, S.; Fukuyama, R.; Yamamoto, T.; Shimizu, N.: mapping of human long-chain acyl-CoA synthetase to chromosome 4. (Abstract) Cytogenet. Cell Genet. 58:1888 only, 1991.

Cantu, E. S.; Sprinkle, T. J.; Ghosh, B.; Singh, I.: The human Palmitoyl-CoA ligase (FACL2) gene maps to the chromosome 4q34-q35 region by fluorescence in situ hybridization (FISH) and somatic cell hybrid panels. Genomics 28:600-602, 1995.

Benson, D. W.; MacRae, C. A.; Vesely, M. R.; Walsh, E. P.; Seidman, J. G.; Seidman, C. E.; Satler, C. A.: Missense mutation in the pore region of HERG causes familial long QT syndrome. Circulation 93:1791-1795, 1996.

Brook, J. D.; Shaw, D. J.; Meredith, A. L.; Bruns, G. A. P.; Harper, P. S.: Localisation of genetic markers and orientation of the linkage group on chromosome 19. Hum. Genet. 68:282-285, 1984.

Bruns, G. A. P.; Regina, V. M.; Gerald, P. S.: Lysosomal DNase and chromosome 19 .(Abstract) J. Cell Biol. 83:444a only, 1979.

Kawane, K.; Fukuyama, H.; Kondoh, G.; Takeda, J.; Ohsawa, Y.; Uchiyama, Y.; Nagata, S.: Requirement of DNase II for definitive erythropoiesis in the mouse fetal liver. Science 292:1546-1549, 2001.

Yasuda, T.; Nadano, D.; Sawazaki, K.; Kishi, K.: Genetic polymorphism of human deoxyribonuclease II (DNase II): low activity levels in urine and leukocytes are due to an autosomal recessive allele. Ann. Hum. Genet. 56:1-10, 1992.

Yasuda, T.; Takeshita, H.; Iida, R.; Nakajima, T.; Hosomi, O.; Nakashima, Y.; Kishi, K.: Molecular cloning of the cDNA encoding human deoxyribonuclease II. J. Biol. Chem. 273: 2610-2616, 1998.

Yasuda, T.; Takeshita, H.; Iida, R.; Nakajima, T.; Hosomi, O.; Nakashima, Y.; Mogi, K.; Kishi, K.: Chromosomal localization of a human deoxyribonuclease II gene (DNASE2) to 19p13.2-p13.1 using both the polymerase chain reaction and fluorescence in situ hybridization analysis. Biochem. Biophys. Res. Commun. 244:815-818, 1998.

Lyko, F.; Ramsahoye, B. H.; Kashevsky, H.; Tudor, M.; Mastrangelo, M.-A.; Orr-Weaver, T. L.; Jaenisch, R.: Mammalian (cytosine-5) methyltransferases cause genomic DNA methylation and lethality in Drosophila. Nature Genet. 23:363-366, 1999.

Rhee, I.; Bachman, K. E.; Park, B. H.; Jair, K.-W.; Yen, R.-W. C.; Schuebel, K. E.; Cui, H.; Feinberg, A. P.; Lengauer, C.; Kinzler, K. W.; Baylin, S. B.; Vogelstein, B.: DNMT1 and DNMT3b cooperate to silence genes in human cancer cells. Nature 416:552-556, 2002.

Ye, Q.; Chung, L. W. K.; Li, S.; Zhau, H. E.: Identification of a novel FAS/ER-alpha fusion transcript expressed in human cancer cells. Biochim. Biophys. Acta 1493:373-377, 2000.

Zuppan, P.; Hall, J. M.; Lee, M. K.; Ponglikitmongkol, M.; King, M.-C.: Possible linkage of the estrogen receptor gene to breast cancer in a family with late-onset disease. Am. J. Hum. Genet. 48:1065-1068,1991.

Zuppan, P. J.; Hall, J. M.; Ponglikitmongkol, M.; Spielman, R.; King, M. C.: Polymorphisms at the estrogen receptor (ESR) locus and linkage relationships on chromosome 6q. (Abstract) Cytogenet. Cell Genet. 51:1116 only, 1989.

Calabi, F.; Cilli, V.: CBFA2T1, a gene rearranged in human leukemia, is a member of a multigene family. Genomics 52:332-341, 1998.

Erickson, P.; Gao, J.; Chang, K.-S.; Look, T.; Whisenant, E.; Raimondo, S.; Lasher, R.; Trujillo, J.; Rowley, J. D.; Drabkin, H. A.: Identification of breakpoints in t (8;21) acute myelogenous leukemia and isolation of a fusion transcript, AML1/ETO, with similarity to Drosophila segmentation gene, runt. Blood 80:1825-1831, 1992.

Miyamoto, T.; Weissman, I. L.; Akashi, K.: AML1/ETO-expressing nonleukemic stem cells in acute myelogenous leukemia with 8;21 chromosomal translocation. Proc. Nat. Acad. Sci. 97:7521-7526, 2000.

Miyoshi, H.; Kozu, T.; Shimizu, K.; Enomoto, K.; Maseki, N.; Kaneko, Y.; Kamada, N.; Ohki, M.: The t (8;21) translocation in acute myeloid leukemia results in production of an AML1-MTG8 fusion transcript. EMBO J. 12:2715-2721, 1993.

Miyoshi, H.; Shimizu, K.; Kozu, T.; Maseki, N.; Kaneko, Y.; Ohki, M.: t (8;21) breakpoints on chromosome 21 in acute myeloid leukemia are clustered within a limited region of a single gene, AML1. Proc. Nat. Acad. Sci. 88:10431-10434, 1991.

Linggi, B.; Muller-Tidow, C.; van de Locht, L.; Hu, M.; Nip, J.; Serve, H.; Berdel, W. E.; van der Reijden, B.; Quelle, D. E.; Rowley, J. D.; Cleveland, J.; Jansen, J. H.; Pandolfi, P. P.; Hiebert, S. W.: The t (8;21) fusion protein, AML1-ETO, specifically represses the transcription of the p14 (ARF) tumor suppressor in acute myeloid leukemia. Nature Med. 8:743-750, 2002.

Minucci, S.; Maccarana, M.; Cioce, M.; De Luca, P.; Gelmetti, V.; Segalla, S.; Di Croce, L.; Giavara, S.; Matteucci, C.; Gobbi, A.; Bianchini, A.; Colombo, E.; Schiavoni, I.; Badaracco, G.; Hu, X.; Lazar, M. A.; Landsberger, N.; Nervi, C.; Pelicci, P. G.: Oligomerization of RAR and AML1 transcription factors as a novel mechanism of oncogenic activation. Molec. Cell 5:811-820, 2000.

Niwa-Kawakita, M.; Miyoshi, H.; Gotoh, O.; Matsushima, Y.; Nishimura, M.; Shisa, H.; Ohki, M.: Cloning and gene mapping of the mouse homologue of the CBFA2T1 gene associated with human acute myeloid leukemia. Genomics 29:755-759, 1995.

Nucifora, G.; Rowley, J. D.: The AML1 and ETO genes in acute myeloid leukemia with a t (8;21). Leukemia Lymphoma 14:353-362, 1994.

Schoch, C.; Kohlmann, A.; Schnittger, S.; Brors, B.; Dugas, M.; Mergenthaler, S.; Kern, W.; Hiddemann, S.; Eils, R.; Haferlach, T.: Acute myeloid leukemias with reciprocal rearrangements can be distinguished by specific gene expression profiles. Proc. Nat. Acad. Sci. 99:10008-10013, 2002.

Wolford, J. K.; Bogardus, C.; Prochazka, M.: Polymorphism in the 3-prime untranslated region of MTG8 is associated with obesity in Pima Indian males. Biochem. Biophys. Res. Commun. 246:624-626,1998.

Wolford, J. K.; Prochazka, M.: Structure and expression of the human MTG8/ETO gene. Gene 212:103-109, 1998.

Yergeau, D. A.; Hetherington, C. J.; Wang, Q.; Zhang, P.; Sharpe, A. H.; Binder, M.; Marin-Padilla, M.; Tenen, D. G.; Speck, N. A.; Zhang, D.-E.: Embryonic lethality and impairment of haematopoiesis in mice heterozygous for an AML1-ETO fusion gene. Nature Genet. 15:303-306, 1997.

Pause, A.; Belsham, G. J.; Gingras, A.-C.; Donze, O.; Lin, T.-A.; Lawrence, J. C., Jr.; Sonenberg, N.: Insulin-dependent stimulation of protein synthesis by phosphorylation of a regulator of 5-prime-cap function. Nature 371:762-767, 1994.

Pyronnet, S.; Imataka, H.; Gingras, A.-C.; Fukunaga, R.; Hunter, T.; Sonenberg, N.: Human eukaryotic translation initiation factor 4G (eIF4G) recruits Mnk1 to phosphorylate eIF4E. EMBO J. 18:270-279,1999.

Waskiewicz, A. J.; Flynn, A.; Proud, C. G.; Cooper, J. A.: Mitogen-activated protein kinases activate the serine/threonine kinases Mnk1 and Mnk2. EMBO J. 16:1909-1920, 1997.

Zhang, Y.; Saison, M.; Spaepen, M.; De Strooper, B.; Van Leuven, F.; David, G.; Van den Berghe, H.; Cassiman, J.-J.: Mapping of human fibronectin receptor beta subunit gene to chromosome 10. Somat. Cell Molec. Genet. 14:99-104, 1988.

Argraves, W. S.; Dickerson, K.; Burgess, W. H.; Ruoslahti, E.:Fibulin, a novel protein that interacts with the fibronectin receptor-beta subunit cytoplasmic domain. Cell 58:623-629, 1989.

Korenberg, J. R.; Chen, X.-N.; Tran, H.; Argraves, W. S.: Localization of the human gene for fibulin-1 (FBLN1) to chromosome band 22q13.3. Cytogenet. Cell Genet. 68:192-193, 1995.

Mattei, M.-G.; Pan, T.-C.; Zhang, R.-Z.; Timpl, R.; Chu, M.-L.: The fibulin-1 gene (FBLN1) is located on human chromosome 22 and on mouse chromosome 15. Genomics 22:437-438, 1994.

Geijsen, N.; Uings, I. J.; Pals, C.; Armstrong, J.; McKinnon, M.; Raaijmakers, J. A. M.; Lammers, J.-W. J.; Koenderman, L.; Coffer, P. J.: Cytokine-specific transcriptional regulation through an IL-5R-alpha interacting protein. Science 293:1136-1138, 2001.

Povey, S.; Morton, N. E.; Sherman, S. L.: Report of the committee on the genetic constitution of chromosomes 1 and 2. Cytogenet. Cell Genet. 40:67-106, 1985.

Bird, A.; Taggart, M.; Frommer, M.; Miller, O. J.; Macleod, D.: A fraction of the mouse genome that is derived from islands of nonmethylated, CpG-rich DNA. Cell 40:91-99, 1985.

Pikkarainen, T.; Kallunki, T.; Tryggvason, K.: Human laminin B2 chain: comparison of the complete amino acid sequence with the B1 chain reveals variability in sequence homology between different structural domains. J. Biol. Chem. 263:6751-6758, 1988.

Sasaki, M.; Yamada, Y.: The laminin B2 chain has a multidomain structure homologous to the B1 chain. J. Biol. Chem. 262:17111-17117,1987.

Smyth, N.; Vatansever, H. S.; Murray, P.; Meyer, M.; Frie, C.; Paulsson, M.; Edgar, D.: Absence of basement membranes after targeting the LAMC1 gene results in embryonic lethality due to failure of endoderm differentiation. J. Cell Biol. 144:151-160, 1999.

Benlian, P.; Foubert, L.; Gagne, E.; Bernard, L.; De Gennes, J. L.; Langlois, S.; Robinson, W.; Hayden, M.: Complete paternal isodisomy for chromosome 8 unmasked by lipoprotein lipase deficiency. Am. J. Hum. Genet. 59:431-436, 1996.

Schoenmakers, E. P. P. M.; Wanschura, S.; Mols, R.; Bullerdiek, J.; Van den Berghe, H.; Van de Ven, W. J. M.: Recurrent rearrangements in the high mobility group protein gene, HMGI-C, in benign mesenchymal tumours. Nature Genet. 10:436-444, 1995.

Turc-Carel, C.; Pietrzak, E.; Kakati, S.; Kinniburgh, A. J.; Sandberg, A. A.: The human int-1 gene is located at chromosome region 12q12-12q13 and is not rearranged in myxoid liposarcoma with t (12;16)(q13; p11). Oncogene Res. 1:397-405, 1987.

Fonatsch, C.; Latza, U.; Durkop, H.; Rieder, H.; Stein, H.: Assignment of the human CD30 (Ki-1) gene to 1p36. Genomics 14:825-826, 1992.

Ma, T.; Yang, B.; Umenishi, F.; Verkman, A. S.: Closely spaced tandem arrangement of AQP2, AQP5, and AQP6 genes in a 27-kilo base segment at chromosome locus 12q13. Genomics 43:387-389, 1997.

Larson, L. M.; Bruce, A. W.; Saumur, J. H.; Wasdahl, W. A.: Further evidence by gene dosage for the regional assignment of erythrocyte acid phosphatase (ACP1) and malate dehydrogenase (MDH1) loci on chromosome 2p. Clin. Genet. 22:220-225, 1982.

Klugbauer, S.; Rabes, H. M.: The transcription coactivator HTIF1 and a related protein are fused to the RET receptor tyrosine kinase in childhood papillary thyroid carcinomas. Oncogene 18:4388-4393, 1999.

Lairmore, T. C.; Dou, S.; Howe, J. R.; Chi, D.; Carlson, K.; Veile, R.; Mishra, S. K.; Wells, S. A., Jr.; Donis-Keller, H.: A 1.5-megabase yeast artificial chromosome contig from human chromosome 10q11.2 connecting three genetic loci (RET, D10S94, and D10S102) closely linked to the MEN2A locus. Proc. Nat. Acad. Sci. 90:492-496, 1993.

Lombardo, F.; Baudin, E.; Chiefari, E.; Arturi, F.; Bardet, S.; Caillou, B.; Conte, C.; Dallapiccola, B.; Giuffrida, D.; Bidart, J.-M.; Schlumberger, M.; Filetti, S.: Familial medullary thyroid carcinoma:clinical variability and low aggressiveness associated with RET mutation at codon 804. J. Clin. Endocr. Metab. 87:1674-1680, 2002.

Lore, F.; Di Cairano, G.; Talidis, F.: Unilateral renal agenesis in a family with medullary thyroid carcinoma. (Letter) New Eng. J. Med. 342:1218-1219, 2000.

Machens, A.; Gimm, O.; Hinze, R.; Hoppner, W.; Boehm, B. O.; Dralle, H.: Genotype-phenotype correlations in hereditary medullary thyroid carcinoma: oncological features and biochemical properties. J. Clin. Endocr. Metab. 86:1104-1109, 2001.

Mendelsohn, C.; et al; et al: Function of the retinoic acid receptors (RARs) during development (II). Multiple abnormalities at various stages of organogenesis in RAR double mutants. Development 120:2749-2771, 1994.

Menko, F. H.; van der Luijt, R. B.; de Valk, I. A. J.; Toorians, A. W. F. T.; Sepers, J. M.; van Diest, P. J.; Lips, C. J. M.: Atypical MEN type 2B associated with two germline RET mutations on the same allele not involving codon 918. J. Clin. Endocr. Metab. 87:393-397, 2002.

Mulligan, L. M.; Kwok, J. B. J.; Healey, C. S.; Elsdon, M. J.; Eng, C.; Gardner, E.; Love, D. R.; Mole, S. E.; Moore, J. K.; Papi, L.; Ponder, M. A.; Telenius, H.; Tunnacliffe, A.; Ponder, B. A. J.: Germ-line mutations of the RET proto-oncogene in multiple endocrine neoplasia type 2A. Nature 363:458-460, 1993.

Munnes, M.; Fanaei, S.; Schmitz, B.; Muiznieks, I.; Holschneider, A. M.; Doerfler, W.: Familial form of Hirschsprung disease: Nucleotide sequence studies reveal point mutations in the RET proto-oncogene in two of six families but not in other candidate genes. Am. J. Med. Genet. 94:19-27, 2000.

Nakata, T.; Kitamura, Y.; Shimizu, K.; Tanaka, S.; Fujimori, M.; Yokoyama, S.; Ito, K.; Emi, M.: Fusion of a novel gene, ELKS, to RET due to translocation t (10;12)(q11; p13) in a papillary thyroid carcinoma. Genes Chromosomes Cancer 25:97-103, 1999.

Niccoli-Sire, P.; Murat, A.; Rohmer, V.; Franc, S.; Chabrier, G.; Baldet, L.; Maes, B.; Savagner, F.; Giraud, A.; Bezieau, S.; Kottler, M.-L.; Morange, S.; Conte-Devolx, B.: The French Calcitonin Tumors Study Group (GETC).: Familial medullary thyroid carcinoma with noncysteine RET mutations: phenotype-genotype relationship in a large series of patients. J. Clin. Endocr. Metab. 86:3746-3753, 2001.

Pachnis, V.; Mankoo, B.; Costantini, F.: Expression of the c-ret proto-oncogene during mouse embryogenesis. Development 119:1005-1017, 1993.

Pasini, B.; Hofstra, R. M. W.; Yin, L.; Bocciardi, R.; Santamaria, G.; Grootscholten, P. M.; Ceccherini, I.; Patrone, G.; Priolo, M.; Buys, C. H. C. M.; Romeo, G.: The physical map of the human RET proto-oncogene. Oncogene 11:1737-1743, 1995.

Pelet, A.; Geneste, O.; Edery, P.; Pasini, A.; Chappuis, S.; Attie, T.; Munnich, A.; Lenoir, G.; Lyonnet, S.; Billaud, M.: Various mechanisms cause RET-mediated signaling defects in Hirschsprung's disease. J. Clin. Invest. 101:1415-1423, 1998.

Pigny, P.; Bauters, C.; Wemeau, J.-L.; Houcke, M. L.; Crepin, M.; Caron, P.; Giraud, S.; Calender, A.; Buisine, M.-P.; Kerckaert, J.-P.; Porchet, N.: A novel 9-base pair duplication in RET exon 8 in familial medullary thyroid carcinoma. J. Clin. Endocr. Metab. 84:1700-1704, 1999.

Pierotti, M. A.; Santoro, M.; Jenkins, R. B.; Sozzi, G.; Bongarzone, I.; Grieco, M.; Monzini, N.; Miozzo, M.; Herrmann, M. A.; Fusco, A.; Hay, I. D.; Della Porta, G.; Vecchio, G.: Characterization of an inversion on the long arm of chromosome 10 juxtaposing D10S170 and RET and creating the oncogenic sequence RET/PTC. Proc. Nat. Acad. Sci. 89:1616-1620, 1992.

Rodrigues, G. A.; Park, M.: Dimerization mediated through a leucine zipper activates the oncogenic potential of the met receptor tyrosine kinase. Molec. Cell. Biol. 13:6711-6722, 1993.

Romeo, G.; Ronchetto, P.; Luo, Y.; Barone, V.; Seri, M.; Ceccherini, I.; Pasini, B.; Bocciardi, R.; Lerone, M.; Kaariainen, H.; Martucciello, G.: Point mutations affecting the tyrosine kinase domain of the RET proto-oncogene in Hirschsprung's disease. Nature 367:377-378, 1994.

Salvatore, D.; Barone, M. V.; Salvatore, G.; Melillo, R. M.; Chiappetta, G.; Mineo, A.; Fenzi, G.; Vecchio, G.; Fusco, A.; Santoro, M.: Tyrosines 1015 and 1062 are in vivo autophosphorylation sites in Ret and Ret-derived oncoproteins. J. Clin. Endocr. Metab. 85:3898-3907, 2000.

Robinson, M. F.; Cote, G. J.; Nunziata, V.; Brandi, M. L.; Ferrer, J. P.; Martins Bugalho, M. J. G.; Almeida Ruas, M. M.; Chik, C.; Colantuoni, V.; Gagel, R. F.: Mutation of a specific codon of the RET proto-oncogene in the multiple endocrine neoplasia type 2A/cutaneous lichen amyloidosis syndrome. (Abstract) Fifth International Workshop on Multiple Endocrine Neoplasia, Stockholm, Archipelago, 1994.

Boyer, S. H.: Human organ alkaline phosphatases: discrimination by several means including starch gel electrophoresis of antienzyme-enzyme supernatant fluids. Ann. N.Y. Acad. Sci. 103:938-950, 1963.

Deutman, A. F.; van Blommestein, J. D. A.; Henkes, H. E.; Waardenburg, P. J.; Solleveld-van Driest, E.: Butterfly-shaped pigment dystrophy of the fovea. Arch. Ophthal. 83:558-569, 1970.

Okuda, T.; Cleveland, J. L.; Downing, J. R.: PCTAIRE-1 and PCTAIRE-3, two members of a novel cdc2/CDC28-related protein kinase gene family. Oncogene 7:2249-2258, 1992.

Okuda, T.; Valentine, V. A.; Shapiro, D. N.; Downing, J. R.: Cloning of genomic loci and chromosomal localization of the human PCTAIRE-1 and -3 protein kinase genes. Genomics 21:217-221, 1994.

Donald, L. J.: The genetics of placental alkaline phosphatase:a possible 'null' allele. Ann. Hum. Genet. 38:7-18, 1974.

Donald, L. J.; Robson, E. B.: Rare variants of placental alkaline phosphatase. Ann. Hum. Genet. 37:303-313, 1974.

Edwards, J. H.; Wingham, J.: Data on linkage between the locus determining placental alkaline phosphatase and other markers. Ann. Hum. Genet. 30:233-237, 1967.

Garattini, E.; Margolis, J.; Heimer, E.; Felix, A.; Udenfriend, S.: Human placental alkaline phosphatase in liver and intestine. Proc. Nat. Acad. Sci. 82:6080-6084, 1985.

Gogolin, K. J.; Slaughter, C. A.; Harris, H.: Electrophoresis of enzyme-monoclonal antibody complexes: studies of human placental alkaline phosphatase polymorphism. Proc. Nat. Acad. Sci. 78:5061-5065,1981.

Henthorn, P. S.; Knoll, B. J.; Raducha, M.; Rothblum, K. N.; Slaughter, C.; Weiss, M.; Lafferty, M. A.; Fischer, T.; Harris, H.: Products of two common alleles at the locus for human placental alkaline phosphatase differ by seven amino acids. Proc. Nat. Acad. Sci. 83:5597-5601,1986.

Kam, W.; Clauser, E.; Kim, Y. S.; Kan, Y. W.; Rutter, W. J.:Cloning, sequencing, and chromosomal localization of human term placental alkaline phosphatase cDNA. Proc. Nat. Acad. Sci. 82:8715-8719,1985.

Knoll, B. J.; Rothblum, K. N.; Longley, M.: Nucleotide sequence of the human placental alkaline phosphatase gene: evolution of the 5-prime flanking region by deletion/substitution. J. Biol. Chem. 263:12020-12027, 1988.

Lucarelli, P.; Scacchi, R.; Corbo, R. M.; Beninscasa, A.; Palmarino, R.: Human placental alkaline phosphatase electrophoretic alleles:quantitative studies. Am. J. Hum. Genet. 34:331-336, 1982.

Martin, D.; Spurr, N. K.; Trowsdale, J.: RFLP of the human placental alkaline phosphatase gene (PLAP). Nucleic Acids Res. 15:9104 only,1987.

Martin, D.; Tucker, D. F.; Gorman, P.; Sheer, D.; Spurr, N. K.; Trowsdale, J.: The human placental alkaline phosphatase gene and related sequences map to chromosome 2 band q37. Ann. Hum. Genet. 51:145-152, 1987.

Millan, J. L.; Beckman, G.; Jeppsson, A.; Stigbrand, T.: Genetic variants of placental alkaline phosphatase as detected by a monoclonal antibody. Hum. Genet. 60:145-149, 1982.

Millan, J. L.; Stigbrand, T.: Antigenic determinants of human placental and testicular placental-like alkaline phosphatases as mapped by monoclonal antibodies. Europ. J. Biochem. 136:1-7, 1983.

Palmarino, R.; Corbo, R. M.; Lucarelli, P.: Human placental alkaline phosphatase: analysis of genetically determined rare variants. Hum. Biol. 51:341-352, 1979.

Raimondi, E.; Talarico, D.; Moro, L.; Rutter, W. J.; Della Valle, G.; De Carli, L.: Regional mapping of the human placental alkaline phosphatase gene (ALPP) to 2q37 by in situ hybridization. Cytogenet. Cell Genet. 47:98-99, 1988.

Robinson, J. C.; Goldsmith, L. A.: Genetically determined variants of serum alkaline phosphatase: a review. Vox Sang. 13:289-307,1967.

Robson, E. B.; Harris, H.: Genetics of the alkaline phosphatase polymorphism of the human placenta. Nature 207: 1257-1259, 1965.

Slaughter, C. A.; Gogolin, K. J.; Coseo, M. C.; Meyer, L. J.; Lesko, J.; Harris, H.: Discrimination of human placental alkaline phosphatase allelic variants by monoclonal antibodies. Am. J. Hum. Genet. 35:1-20, 1983.

Almind, K.; Delahaye, L.; Hansen, T.; Van Obberghen, E.; Pedersen, O.; Kahn, C. R.: Characterization of the Met326Ile variant of phosphatidyl inositol3-kinase p85-alpha. Proc. Nat. Acad. Sci. 99:2124-2128, 2002.

Cannizzaro, L. A.; Skolnik, E. Y.; Margolis, B.; Croce, C. M.; Schlesinger, J.; Huebner, K.: The human gene encoding phosphatidyl inositol3-kinase associated p85-alpha is at chromosome region 5q12-13. Cancer Res. 51:3818-3820, 1991.

Chase, P. B.; Yang, J.-M.; Thompson, F. H.; Halonen, M.; Regan, J. W.: Regional mapping of the human platelet-activating factor receptor gene (PTAFR) to 1p35-p34.3 by fluorescence in situ hybridization. Cytogenet. Cell Genet. 72:205-207, 1996.

Prescott, S. M.; Zimmerman, G. A.; McIntyre, T. M.: Platelet-activating factor. J. Biol. Chem. 265:17381-17384, 1990.

Seyfried, C. E.; Schweickart, V. L.; Godiska, R.; Gray, P. W.:The human platelet-activating factor receptor gene (PTAFR) contains no introns and maps to chromosome 1. Genomics 13:832-834, 1992.

Abe, A.; Emi, N.; Tanimoto, M.; Terasaki, H.; Marunouchi, T.; Saito, H.: Fusion of the platelet-derived growth factor receptor beta to a novel gene CEV14 in acute myelogenous leukemia after clonal evolution. Blood 90:4271-4277, 1997.

Buchberg, A. M.; Jenkins, N. A.; Copeland, N. G.: Localization of the murine macrophage colony-stimulating factor gene to chromosome 3 using interspecific backcross analysis. Genomics 5:363-367, 1989.

Claesson-Welsh, L.; Eriksson, A.; Moren, A.; Severinsson, L.; Ek, B.; Ostman, A.; Betsholtz, C.; Heldin, C.-H.: cDNA cloning and expression of a human platelet-derived growth factor (PDGF) receptor specific for B-chain-containing PDGF molecules. Molec. Cell. Biol. 8:3476-3486,1988.

Escobedo, J. A.; Fried, V. A.; Daniel, T. O.; Williams, L. T.:Primary structure of the platelet-derived growth factor. (Abstract) Clin. Res. 34:544A, 1986.

Gronwald, R. G. K.; Grant, F. J.; Haldeman, B. A.; Hart, C. E.; O'Hara, P. J.; Hagen, F. S.; Ross, R.; Bowen-Pope, D. F.; Murray, M. J.: Cloning and expression of a cDNA coding for the human platelet-derived growth factor receptor: evidence for more than one receptor class. Proc. Nat. Acad. Sci. 85:3435-3439, 1988.

Klinghoffer, R. A.; Mueting-Nelsen, P. F.; Faerman, A.; Shani, M.; Soriano, P.: The two PDGF receptors maintain conserved signaling in vivo despite divergent embryological functions. Molec. Cell 7:343-354, 2001.

Kulkarni, S.; Heath, C.; Parker, S.; Chase, A.; Iqbal, S.; Pocock, C. F.; Kaeda, J.; Cwynarski, K.; Goldman, J. M.; Cross, N. C. P.:Fusion of H4/D10S170 to the platelet-derived growth factor receptor beta in BCR-ABL-negative myeloproliferative disorders with a t (5;10)(q33; q21). CancerRes. 60:3592-3598, 2000.

Leal, F.; Williams, L. T.; Robbins, K. C.; Aaronson, S. A.: Evidence that the v-sis gene product transforms by interaction with the receptor for platelet-derived growth factor. Science 230:327-330, 1985.

Magnusson, M. K.; Meade, K. E.; Brown, K. E., Arthur, D. C.; Krueger, L. A.; Barrett, A. J.; Dunbar, C. E.: Rabaptin-5 is a novel fusion partner to platelet-derived growth factor beta receptor in chronic myelomonocytic leukemia. Blood 98:2518-2525, 2001.

Matsui, T.; Heidaran, M.; Miki, T.; Popescu, N.; La Rochelle, W.; Kraus, M.; Pierce, J.; Aaronson, S.: Isolation of a novel receptor cDNA establishes the existence of two PDGF receptor genes. Science 243:800-804, 1989.

Ross, T. S.; Bernard, O. A.; Berger, R.; Gilliland, D. G.: Fusion of Huntingtin interacting protein 1 to platelet-derived growth factor-beta receptor (PDGF-beta-R) in chronic myelomonocytic leukemia with t (5;7)(q33; q11.2). Blood 91:4419-4426, 1998.

Steer, E. J.; Cross, N. C. P.: Myeloproliferative disorders with translocations of chromosome 5q31-35: role of the platelet-derived growth factor receptor beta. Acta Haemat. 107:113-122, 2002.

Treacher Collins Syndrome Collaborative Group: Positional cloning of a gene involved in the pathogenesis of Treacher Collins syndrome. Nature Genet. 12:130-136, 1996.

Yarden, Y.; Escobedo, J. A.; Kuang, W.-J.; Yang-Feng, T. L.; Daniel, T. O.; Tremble, P. M.; Chen, E. Y.; Ando, M. E.; Harkins, R. N.; Francke, U.; Fried, V. A.; Ullrich, A.; Williams, L. T.: Structure of the receptor for platelet-derived growth factor helps define a family of closely related growth factor receptors. Nature 323:226-232, 1986.

Berthet, M.; Denjoy, I.; Donger, C.; Demay, L.; Hammoude, H.; Klug, D.; Schulze-Bahr, E.; Richard, P.; Funke, H.; Schwartz, K.; Coumel, P.; Hainque, B.; Guicheney, P.: C-terminal HERG mutations: the role of hypokalemia and a KCNQ1-associated mutation in cardiac event occurrence. Circulation 99:1464-1470, 1999.

Allcock, R. J. N.; Williams, J. H.; Price, P.: The central MHC gene, BAT1, may encode a protein that down-regulates cytokine production. Genes Cells 6:487-494, 2001.

Nunes, M.; Peelman, L.; Vaiman, M.; Bourgeaux, N.; Chardon, P.: Characterization of six new loci within the swine major histocompatibility complex class III region. Mammalian Genome 5:616-622, 1994.

Peelman, L. J.; Chardon, P.; Nunes, M.; Renard, C.; Geffrotin, C.; Vaiman, M.; Van Zeveren, A.; Coppieters, W.; van de Weghe, A.; Bouquet, Y.; Choy, W. W.; Strominger, J. L.; Spies, T.: The BAT1gene in the MHC encodes an evolutionarily conserved putative nuclear RNA helicase of the DEAD family. Genomics 26:210-218, 1995.

Spies, T.; Blanck, G.; Bresnahan, M.; Sands, J.; Strominger, J. L.: A new cluster of genes within the human major histocompatibility complex. Science 243:214-217, 1989.

Spies, T.; Bresnahan, M.; Strominger, J. L.: Human major histocompatibility complex contains a minimum of 19 genes between the complement cluster and HLA-B. Proc. Nat. Acad. Sci. 86:8955-8958, 1989.

Boerkoel, C. F.; Takashima, H.; Stankiewicz, P.; Garcia, C. A.; Leber, S. M.; Rhee-Morris, L.; Lupski, J. R.: Periaxin mutations cause recessive Dejerine-Sottas neuropathy. Am. J. Hum. Genet. 68:325-333, 2001. Note: Erratum: Am. J. Hum. Genet. 68:557 only, 2001.

Pischel, K. D.; Marlin, S. D.; Springer, T. A.; Woods, V. L., Jr.; Bluestein, H. G.: Polymorphism of lymphocyte function-associated antigen-1 demonstrated by a lupus patient's alloantiserum. J. Clin. Invest. 79:1607-1614, 1987.

Chottiner, E. G.; Shewach, D. S.; Datta, N. S.; Ashcraft, E.; Gribbin, D.; Ginsburg, D.; Fox, I. H.; Mitchell, B. S.: Cloning and expression of human deoxycytidine kinase cDNA. Proc. Nat. Acad. Sci. 88:1531-1535,1991.

Huang, S.-H.; Tomich, J. M.; Wu, H.; Jong, A.; Holcenberg, J.:Human deoxycytidine kinase: sequence of cDNA clones and analysis of expression in cell lines with and without enzyme activity. J. Biol. Chem. 264:14762-14768, 1989. Note: Correction: J. Biol. Chem. 266:5353 only, 1991.

Johansson, M.; Brismar, S.; Karlsson, A.: Human deoxycytidine kinase is located in the cell nucleus. Proc. Nat. Acad. Sci. 94:11941-11945, 1997.

Song, J. J.; Walker, S.; Chen, E.; Johnson, E. E., II; Spychala, J.; Gribbin, T.; Mitchell, B. S.: Genomic structure and chromosomal localization of the human deoxycytidine kinase gene. Proc. Nat. Acad. Sci. 90:431-434, 1993.

Nurnberg, P.; Thiele, H.; Chandler, D.; Hohne, W.; Cunningham, M. L.; Ritter, H.; Leschik, G.; Uhlmann, K.; Mischung, C.; Harrop, K.; Goldblatt, J.; Borochowitz, Z. U.; Kotzot, D.; Westermann, F.; Mundlos, S.; Braun, H.-S.; Laing, N.; Tinschert, S.: Heterozygous mutations in ANKH, the human ortholog of the mouse progressive ankylosis gene, result in craniometaphyseal dysplasia. Nature Genet. 28:37-41,2001.

Nurnberg, P.; Tinschert, S.; Mrug, M.; Hampe, J.; Muller, C. R.; Fuhrmann, E.; Braun, H.-S.; Reis, A.: The gene for autosomal dominant craniometaphyseal dysplasia maps to chromosome 5q and is distinct from the growth hormone-receptor gene. Am. J. Hum. Genet. 61:918-923,1997.

Soriano, P.; Montgomery, C.; Geske, R.; Bradley, A.: Targeted disruption of the c-src proto-oncogene leads to osteopetrosis in mice. Cell 64:693-702, 1991.

Stegmann, A. P. A.; Honders, M. W.; Bolk, M. W. J.; Wessels, J.; Willemze, R.; Landegent, J. E.: Assignment of the human deoxycytidine kinase (DCK) gene to chromosome 4 band q13.3-q21.1. Genomics 17:528-529, 1993.

Sanchez-Madrid, F.; Nagy, J.; Robbins, E.; Simon, P.; Springer, T. A.: A human leukocyte differentiation antigen family with distinct alpha subunits and a common beta subunit: the lymphocyte function-associated antigen (LFA-1), the C3bi complement receptor (OKM1/Mac-1), and the p150, 95 molecule. J. Exp. Med. 158:1785-1803, 1983.

Delague, V.; Bareil, C.; Tuffery, S.; Bouvagnet, P.; Chouery, E.; Koussa, S.; Maisonobe, T.; Loiselet, J.; Megarbane, A.; Claustres, M.: Mapping of a new locus for autosomal recessive demyelinating Charcot-Marie-Tooth disease to 19q13.1-13.3 in a large consanguineous Lebanese family: exclusion of MAG as a candidate gene. Am. J. Hum. Genet. 67:236-243, 2000.

Guilbot, A.; Williams, A.; Ravise, N.; Verny, C.; Brice, A.; Sherman, D. L.; Brophy, P. J.; LeGuern, E.; Delague, V.; Bareil, C.; Megarbane, A.; Claustres, M.: A mutation in peri-axin is responsible for CMT4F, an autosomal recessive form of Charcot-Marie-Tooth disease. Hum. Molec. Genet. 10:415-421, 2001.

Cleary, M. L.; Mellentin, J. D.; Spies, J.; Smith, S. D.: Chromosomal translocation involving the beta T cell receptor gene in acute leukemia. J. Exp. Med. 167:682-687, 1988.

Kuo, S. S.; Mellentin, J. D.; Copeland, N. G.; Gilbert, D. J.; Jenkins, N. A.; Cleary, M. L.: Structure, chromosome mapping, and expression of the mouse Lyl-1 gene. Oncogene 6:961-968, 1991.

Inoguchi, K.; Yoshioka, H.; Khaleduzzaman, M.; Ninomiya, Y.: The mRNA for alpha-1(XIX) collagen chain, a new member of FACITs, contains a long unusual 3-prime untranslated region and displays many unique splicing variants. J. Biochem. 117:137-146, 1995.

Khaleduzzaman, M.; Sumiyoshi, H.; Ueki, Y.; Inoguchi, K.; Ninomiya, Y.; Yoshioka, H.: Structure of the human type XIX collagen (COL19A1) gene, which suggests it has arisen from an ancestor gene of the FACIT family. Genomics 45:304-312, 1997.

Myers, J. C.; Sun, M. J.; d'Ippolito, J. A.; Jabs, E. W.; Neilson, E. G.; Dion, A. S.: Human cDNA clones transcribed from an unusually high molecular weight RNA encode a new collagen chain. Gene 123:211-217, 1993.

Yoshioka, H.; Zhang, H.; Ramirez, F.; Mattei, M.-G.; Moradi-Ameli, M.; van der Rest, M.; Gordon, M. K.: Synteny between the loci for a novel FACIT-like collagen (D6S228E) and alpha 1(IX) collagen (COL9A1) on 6q12-q14 in human S. Genomics 13:884-886, 1992.

Gerecke, D. R.; Olson, P. F.; Koch, M.; Knoll, J. H. M.; Taylor, R.; Hudson, D. L.; Champliaud, M.-F.; Olsen, B. R.; Burgeson, R. E.: Complete primary structure of two splice variants of collagen XII, and assignment of alpha-1(XII) collagen (COL12A1), alpha-1 (IX) collagen (COL9A1), and alpha-1 (XIX) collagen (COL19A1) to human chromosome 6q12-q13. Genomics 41:236-242, 1997.

Litt, M.; Buroker, N. E.; Kondoleon, S.; Douglass, J.; Liston, D.; Sheehy, R.; Magenis, R. E.: Chromosomal localization of the human proenkephalin and prodynorphin genes. Am. J. Hum. Genet. 42:327-334, 1988.

Litt, M.; Buroker, N. E.; Kondoleon, S. K.; Liston, D.; Douglass, J.; Sheehy, R.; Magenis, R. E.: Chromosomal localization of the human proenkephalin and prodynorphin genes. (Abstract) Cytogenet. Cell Genet. 46:651 only, 1987.

Berkovic, S. F.; McIntosh, A.; Howell, R. A.; Mitchell, A.; Sheffield, L. J.; Hopper, J. L.: Familial temporal lobe epilepsy: a common disorder identified in twins. Ann. Neurol. 40:227-235, 1996.

Cendes, F.; Lopes-Cendes, I.; Andermann, E.; Andermann, F.: Familial temporal lobe epilepsy: a clinically heterogeneous syndrome. Neurology 50:554-557, 1998.

Horikawa, S.; Takai, T.; Toyosato, M.; Takahashi, H.; Noda, M.; Kakidani, H.; Kubo, T.; Hirose, T.; Inayama, S.; Hayashida, H.; Miyata, T.; Numa, S.: Isolation and structural organization of the human preproenkephalin B gene. Nature 306:611-614, 1983.

Giuili, G.; Scholl, U.; Bulle, F.; Guellaen, G.: Molecular cloning of the cDNAs coding for the two subunits of soluble guanylyl cyclase from human brain. FEBS Lett. 304:83-88, 1992.

Feder, J. N.; Li, L.; Jan, L. Y.; Jan, Y. N.: Genomic cloning and chromosomal localization of HRY, the human homolog of the Drosophila segmentation gene, hairy. Genomics 20:56-61, 1994.

Votruba, M.; Payne, A.; Moore, A. T.; Bhattacharya, S. S.: Dominant optic atrophy: exclusion and fine genetic mapping of the candidate gene, HRY. Mammalian Genome 9:784-787, 1998.

Yan, B.; Heus, J.; Lu, N.; Nichols, R. C.; Raben, N.; Plotz, P. H.: Transcriptional regulation of the human acid alpha-glucosidase gene: identification of a repressor element and its transcription factors Hes-1 and YY1. J. Biol. Chem. 276:1789-1793, 2001.

Yan, B.; Raben, N.; Plotz, P. H.: Hes-1, a known transcriptional repressor, acts as a transcriptional activator for the human acid alpha-glucosidase gene in human fibroblast cells. Biochem. Biophys. Res. Commun. 291:582-587, 2002.

Blanchette, F.; Day, R.; Dong, W.; Laprise, M.-H.; Dubois, C. M.: TGF-beta-1 regulates gene expression of its own converting enzyme furin. J. Clin. Invest. 99:1974-1983, 1997.

Copeland, N. G.; Gilbert, D. J.; Chretien, M.; Seidah, N. G.; Jenkins, N. A.: Regional localization of three convertases, PC1 (Nec-1), PC2(Nec-2), and furin (Fur), on mouse chromosomes. Genomics 13:1356-1358, 1992.

Dubois, C. M.; Laprise, M.-H.; Blanchette, F.; Gentry, L. E.; Leduc, R.: Processing of transforming growth factor beta-1 precursor by human furin convertase. J. Biol. Chem. 270:10618-10624, 1995.

Hendy, G. N.; Bennett, H. P. J.; Gibbs, B. F.; Lazure, C.; Day, R.; Seidah, N. G.: Proparathyroid hormone is preferentially cleaved to parathyroid hormone by the prohormone convertase furin: a mass spectrometric study. J. Biol. Chem. 270:9517-9525, 1995.

Mbikay, M.; Seidah, N. G.; Chretien, M.; Simpson, E. M.: Chromosomal assignment of the genes for proprotein convertases PC4, PC5, and PACE4 in mouse and human. Genomics 26:123-129, 1995.

Roebroek, A. J. M.; Schalken, J. A.; Leunissen, J. A. M.; Onnekink, C.; Bloemers, H. P. J.; Van de Ven, W. J. M.: Evolutionary conserved close linkage of the c-fes/fps proto-oncogene and genetic sequences encoding a receptor-like protein. EMBO J. 5:2197-2202, 1986.

Schalken, J. A.; Roebroek, A. J. M.; Oomen, P. P. C. A.; Wagenaar, S. S.; Debruyne, F. M. J.; Bloemers, H. P. J.; Van de Ven, W. J. M.: FUR gene expression as a discriminating marker for small cell and nonsmall cell lung carcinomas. J. Clin. Invest. 80:1545-1549, 1987.

Seidah, N. G.; Mattei, M. G.; Gaspar, L.; Benjannet, S.; Mbikay, M.; Chretien, M.: Chromosomal assignments of the genes for neuroendocrine convertase PC1 (NEC1) to human 5q15-21, neuroendocrine convertasePC2 (NEC2) to human 20p11.1-11.2, and furin (mouse 7[D1-E2] region). Genomics 11:103-107, 1991.

Curtis, E. J.; Fraser, F. C.; Warburton, D.: Congenital cleft lip and palate. Am. J. Dis. Child. 102:853-857, 1961.

Kanai, Y.; Hediger, M. A.: Primary structure and functional characterization of a high-affinity glutamate transporter. Nature 360:467-471, 1992.

Lin, C. G.; Orlov, I.; Ruggiero, A. M.; Dykes-Hoberg, M.; Lee, A.; Jackson, M.; Rothstein, J. D.: Modulation of the neuronal glutamate transporter EAAC1 by the interacting protein GTRAP3-18. Nature 410:84-88, 2001.

Smith, C. P.; Weremowicz, S.; Kanai, Y.; Stelzner, M.; Morton, C. C.; Hediger, M. A.: Assignment of the gene coding for the human high-affinity glutamate transporter EAAC1 to 9p24: potential role in dicarboxylic amino acid uria and neurodegenerative disorders. Genomics 20:335-336, 1994.

Hall, C. R.; Cole, W. G.; Haynes, R.; Hecht, J. T.: Reevaluation of a genetic model for the development of exostosis in hereditary multiple exostosis. Am. J. Med. Genet. 112:1-5, 2002.

Kirby, M. L.; Waldo, K. L.: Neural crest and cardiovascular patterning. Circ. Res. 77:211-215, 1995.

Kurihara, Y.; Kurihara, H.; Oda, H.; Maemura, K.; Nagai, R.; Ishikawa, T.; Yazaki, Y.: Aortic arch malformations and ventricular septal defect in mice deficient in endothelin-1. J. Clin. Invest. 96:293-300, 1995.

Lacey, S. W.; Sanders, J. M.; Rothberg, K. G.; Anderson, R. G. W.; Kamen, B. A.: Complementary DNA for the folate binding protein correctly predicts anchoring to the membrane by glycosyl-phosphatidyl inositol. J. Clin. Invest. 84:715-720, 1989.

Istvan, E. S.; Deisenhofer, J.: Structural mechanism for statin inhibition of HMG-CoA reductase. Science 292:1160-1164, 2001.

Piedrahita, J. A.; Oetama, B.; Bennett, G. D.; van Waes, J.; Kamen, B. A.; Richardson, J.; Lacey, S. W.; Anderson, R. G. W.; Finnell, R. H.: Mice lacking the folic acid-binding protein Folbp1 are defective in early embryonic development. Nature Genet. 23:228-232, 1999.

Shaw, G. M.; Jensvold, N. G.; Wasserman, C. R.; Lammer, E. J.: Epidemiologic characteristics of phenotypically distinct neural tube defects among 0.7 million California births, 1983-1987. Teratology 49:143-149, 1994.

Werler, M. M.; Shapiro, S.; Mitchell, A. A.: Periconceptional folic acid exposure and risk of occurrent neural tube defects. J. A. M. A. 269:1257-1261, 1993.

Sipila, K.; Aula, P.: Database for the mutations of the Finnish disease heritage. Hum. Mutat. 19:16-22, 2002.

Tortoriello, D. V.; Sidis, Y.; Holtzman, D. A.; Holmes, W. E.; Schneyer, A. L.: Human follistatin-related protein: a structural homologue of follistatin with nuclear localization. Endocrinology 142:3426-3434, 2001.

Hardingham, G. E.; Fukunaga, Y.; Bading, H.: Extrasynaptic NMDARs oppose synaptic NMDARs by triggering CREB shut-off and cell death pathways. Nature Neurosci. 5:405-414, 2002.

Takano, H.; Onodera, O.; Tanaka, H.; Mori, H.; Sakimura, K.; Hori, T.; Kobayashi, H.; Mishina, M.; Tsuji, S.: Chromosomal localization of the epsilon-1, epsilon-3, and zeta-1 subunit genes of the human NMDA receptor channel. Biochem. Biophys. Res. Commun. 197:922-926,1993.

Berkovitz, G. D.; Guerami, A.; Brown, T. R.; MacDonald, P. C.; Migeon, C. J.: Familial gynecomastia with increased extraglandular aromatization of plasma carbon (19)-steroids. J. Clin. Invest. 75:1763-1769, 1985.

Bloch, D. B.; Bloch, K. D.; Iannuzzi, M.; Collins, F. S.; Neer, E. J.; Seidman, J. G.; Morton, C. C.: The gene for the alpha-i-1 subunit of human guanine nucleotide binding protein maps near the cystic fibrosis locus. Am. J. Hum. Genet. 42:884-888, 1988.

Bray, P.; Carter, A.; Guo, V.; Puckett, C.; Kamholz, J.; Spiegel, A.; Nirenberg, M.: Human cDNA clones for an alpha subunit of G(i) signal-transduction protein. Proc. Nat. Acad. Sci. 84:5115-5119,1987.

Itoh, H.; Toyama, R.; Kozasa, T.; Tsukamoto, T.; Matsuoka, M.; Kaziro, Y.: Presence of three distinct molecular species of G(i) protein alpha subunit: structure of rat cDNAs and human genomic DNAs. J. Biol. Chem. 263:6656-6664, 1988.

Suki, W. N.; Abramowitz, J.; Mattera, R.; Codina, J.; Birnbaumer, L.: The human genome encodes at least three nonallelic G proteins with alpha-i-type subunits. FEBS Lett. 220: 187-192, 1987.

Sullivan, K. A.; Liao, Y.-C.; Alborzi, A.; Beiderman, B.; Chang, F.-H.; Masters, S. B.; Levinson, A. D.; Bourne, H. R.: Inhibitory and stimulatory G proteins of adenylate cyclase: cDNA and amino acid sequences of the alpha chains. Proc. Nat. Acad. Sci. 83:6687-6691,1986.

Jiang, M.; Gold, M. S.; Boulay, G.; Spicher, K.; Peyton, M.; Brabet, P.; Srinivasan, Y.; Rudolph, U.; Ellison, G.; Birnbaumer, L.: Multiple neurological abnormalities in mice deficient in the G protein G(o). Proc. Nat. Acad. Sci. 95:3269-3274, 1998.

Kroll, S. D.; Chen, J.; De Vivo, M.; Carty, D. J.; Buku, A.; Premont, R. T.; Iyengar, R.: The Q205LGo-alpha subunit expressed in NIH-3T3 cells induces transformation. J. Biol. Chem. 267:23183-23188, 1992.

Murtagh, J. J., Jr.; Eddy, R.; Shows, T. B.; Moss, J.; Vaughan, M.: Different forms of Go alpha mRNA arise by alternative splicing of transcripts from a single gene on human chromosome 16. Molec. Cell. Biol. 11:1146-1155, 1991.

Ram, P. T.; Horvath, C. M.; Iyengar, R.: Stat3-mediated transformation of NIH-3T3 cells by the constitutively active Q205L G-alpha (O) protein. Science 287:142-144, 2000.

Strathmann, M.; Wilkie, T. M.; Simon, M. I.: Alternative splicing produces transcripts encoding two forms of the alpha subunit of GTP-binding protein G(o). Proc. Nat. Acad. Sci. 87:6477-6481, 1990.

Tsukamoto, T.; Toyama, R.; Itoh, H.; Kozasa, T.; Matsuoka, M.; Kaziro, Y.: Structure of the human gene and two rat cDNAs encoding the alpha chain of GTP-binding regulatory protein G(o): two different mRNAs are generated by alternative splicing. Proc. Nat. Acad. Sci. 88:2974-2978, 1991.

Valenzuela, D.; Han, X.; Mende, U.; Fankhauser, C.; Mashimo, H.; Huang, P.; Pfeffer, J.; Neer, E. J.; Fishman, M. C.: G-alpha-o is necessary for muscarinic regulation of Ca (2+) channels in mouse heart. Proc. Nat. Acad. Sci. 94:1727-2732, 1997.

Foley, H. A.; Ofori-Acquah, S. F.; Yoshimura, A.; Critz, S.; Baliga, B. S.; Pace, B. S.: Stat-3 beta inhibits gamma-globin gene expression in erythroid cells. J. Biol. Chem. 277:16211-16219, 2002.

Lindgren, V.; Luskey, K. L.; Russell, D. W.; Francke, U.: human genes involved in cholesterol metabolism: chromosomal mapping of the loci for the low density lipoprotein receptor and 3-hydroxy-3-methylglutaryl-coenzyme A reductase with cDNA probes. Proc. Nat. Acad. Sci. 82:8567-8571,1985.

Luskey, K. L.: Conservation of promoter sequence but not complex intron splicing pattern in human and hamster genes for 3-hydroxy-3-methylglutaryl coenzyme A reductase. Molec. Cell. Biol. 7:1881-1893, 1987.

Mohandas, T.; Heinzmann, C.; Sparkes, R. S.; Wasmuth, J.; Edwards, P.; Lusis, A. J.: Assignment of human 3-hydroxy-3-methylglutaryl coenzyme A reductase gene to q13-q23 region of chromosome 5. Somat. Cell Molec. Genet. 12:89-94, 1986.

Osborne, T. F.; Goldstein, J. L.; Brown, M. S.:5-prime end of HMG CoA reductase gene contains sequences responsible for cholesterol-mediated inhibition of transcription. Cell 42:203-212, 1985.

Van Doren, M.; Broihier, H. T.; Moore, L. A.; Lehmann, R.: HMG-CoA reductase guides migrating primordial germ cells. Nature 396:466-469,1998.

Hou, J.; Parrish, J.; Ludecke, H.-J.; Sapru, M.; Wang, Y.; Chen, W.; Hill, A.; Siegel-Bartelt, J.; Northrup, H.; Elder, F. F. B.; Chinault, C.; Horsthemke, B.; Wagner, M. J.; Wells, D. E.: A 4-megabase YACcontig that spans the Langer-Giedion syndrome region on human chromosome 8q24.1: use in refining the location of the trichorhinophalangeal syndrome and multiple exostoses genes (TRPS1 and EXT1). Genomics 29:87-97, 1995.

Ludecke, H.-J.; Wagner, M. J.; Nardmann, J.; La Pillo, B.; Parrish, J. E.; Willems, P. J.; Haan, E. A.; Frydman, M.; Hamers, G. J. H.; Wells, D. E.; Horsthemke, B.: Molecular dissection of a contiguous gene syndrome: localization of the genes involved in the Langer-Giedion syndrome. Hum. Molec. Genet. 4:31-36, 1995.

Koizumi, T.; Hendel, E.; Lalley, P. A.; Tchetgen, M.-B. N.; Nadeau, J. H.: Homologs of genes and anonymous loci on human chromosome 13 map to mouse chromosomes 8 and 14. Mammalian Genome 6:263-268,1995.

Buckler, A. J.; Chang, D. D.; Graw, S. L.; Brook, J. D.; Haber, D. A.; Sharp, P. A.; Housman, D. E.: Exon amplification: a strategy to isolate mammalian genes based on RNA splicing. Proc. Nat. Acad. Sci. 88:4005-4009, 1991.

Dorner, M. H.; Salfeld, J.; Will, H.; Leibold, E. A.; Vass, J. K.; Munro, H. N.: Structure of human ferritin light subunit messenger RNA: comparison with heavy subunit message and functional implications. Proc. Nat. Acad. Sci. 82:3139-3143, 1985.

Filie, J. D.; Buckler, C. E.; Kozak, C. A.: Genetic mapping of the mouse ferritin light chain gene and 11 pseudogenes on 11 mouse chromosomes. Mammalian Genome 9:111-113, 1998.

Girelli, D.; Bozzini, C.; Zecchina, G.; Tinazzi, E.; Bosio, S.; Piperno, A.; Ramenghi, U.; Peters, J.; Levi, S.; Camaschella, C.; Corrocher, R.: Clinical, biochemical and molecular findings in a series of families with hereditary hyperferritinaemia-cataract syndrome. Brit. J. Haemat. 115: 334-340, 2001.

Girelli, D.; Corrocher, R.; Bisceglia, L.; Olivieri, O.; De Franceschi, L.; Zelante, L.; Gasparini, P.: Molecular basis for the recently described hereditary hyperferritinemia-cataract syndrome: A mutation in the iron-responsive element of ferritin L-subunit gene (the 'Veronamutation'). Blood 86:4050-453, 1995.

Girelli, D.; Corrocher, R.; Bisceglia, L.; Olivieri, O.; Zelante, L.; Panozzo, G.; Gasparini, P.: Hereditary hyperferritinemia-cataract syndrome caused by a 29-base pair deletion in the iron responsive element of ferritin L-subunit gene. Blood 90:2084-2088, 1997.

Girelli, D.; Olivieri, O.; De Franceschi, L.; Corrocher, R.; Bergamaschi, G.; Cazzola, M.: A linkage between hereditary hyperferritinaemia not related to iron overload and autosomal dominant congenital cataract. Brit. J. Haemat. 90:931-934, 1995.

Lebo, R. V.; Kan, Y. W.; Cheung, M.-C.; Jain, S. K.; Drysdale, J.: Human ferritin light chain gene sequences mapped to several sorted chromosomes. Hum. Genet. 71:325-328, 1985.

Martin, M. E.; Fargion, S.; Brissot, P.; Pellat, B.; Beaumont, C.: A point mutation in the bulge of the iron-responsive element of the L ferritin gene in two families with the hereditary hyperferritinemia-cataract syndrome. Blood 91:319-323, 1998.

McGill, J. R.; Boyd, D.; Barrett, K. J.; Drysdale, J. W.; Moore, C. M.: Localization of human ferritin H (heavy) and L (light) subunits by in situ hybridization. (Abstract) Am. J. Hum. Genet. 36:146S,1984.

McLeod, J. L.; Craig, J.; Gumley, S.; Roberts, S.; Kirkland, M. A.: Mutation spectrum in Australian pedigrees with hereditary hyperferritinaemia-cataract syndrome reveals novel and de novo mutations. Brit. J. Haemat. 118:1179-1182, 2002.

Mumford, A. D.; Vulliamy, T.; Lindsay, J.; Watson, A.: Hereditary hyperferritinemia-cataract syndrome: two novel mutations in the L-ferritin iron-responsive element. (Letter) Blood 91:367-368, 1998.

Munro, H. N.; Aziz, N.; Leibold, E. A.; Murray, M.; Rogers, J.; Vass, J. K.; White, K.: The ferritin genes: structure, expression, and regulation. Ann. N. Y. Acad. Sci. 526:113-123, 1988.

Santoro, C.; Marone, M.; Ferrone, M.; Costanzo, F.; Colombo, M.; Minganti, C.; Cortese, R.; Silengo, L.: Cloning of the gene coding for human L apoferritin. Nucleic Acids Res. 14:2863-2876, 1986.

Watanabe, N.; Drysdale, J. W.: Evidence for distinct mRNAs for ferritin subunits. Biochem. Biophys. Res. Commun. 98:507-511, 1981.

Zalin, A. M.; Jones, S.; Fitch, N. J. S.; Ramsden, D. B.: Familial nephropathic non-neuropathic amyloidosis: clinical features, immunohistochemistry and chemistry. Quart. J. Med. 81:945-956, 1991.

Ceccherini, I.; Romei, C.; Barone, V.; Pacini, F.; Martino, E.; Loviselli, A.; Pinchera, A.; Romeo, G.: Identification of the cys634-to-tyrmutation of the RET proto-oncogene in a pedigree with multiple endocrine neoplasia type 2A and localized cutaneous lichen amyloidosis. J. Endocr. Invest. 17:201-204, 1994.

Axton, R.; Hanson, I.; Danes, S.; Sellar, G.; van Heyningen, V.; Prosser, J.: The incidence of PAX6 mutation in patients with simple aniridia: an evaluation of mutation detection in 12 cases. J. Med. Genet. 34:279-286, 1997.

Beauchamp, G. R.: Anterior segment dysgenesis keratolenticular adhesion and aniridia. J. Pediat. Ophthal. Strabismus 17:55-58,1978.

Crolla, J. A.; Cross, I.; Atkey, N.; Wright, M.; Oley, C. A.:FISH studies in a patient with sporadic aniridia and t (7;11)(q31.2; p13). J. Med. Genet. 33:66-68, 1996.

Fantes, J.; Redeker, B.; Breen, M.; Boyle, S.; Brown, J.; Fletcher, J.; Jones, S.; Bickmore, W.; Fukushima, Y.; Mannens, M.; Danes, S.; van Heyningen, V.; Hanson, I.: Aniridia-associated cytogenetic rearrangements suggest that a position effect may cause the mutant phenotype. Hum. Molec. Genet. 4:415-422, 1995.

Sarkar, F. H.; Gupta, S. L.: Receptors for human gamma interferon:binding and crosslinking of 125-I-labeled recombinant human gamma interferon to receptors on WISH cells. Proc. Nat. Acad. Sci. 81:5160-5164, 1984.

Slate, D. L.; Ruddle, F. H.: Antibodies to chromosome 21 coded cell surface components can block response to human interferon. Cytogenet. Cell Genet. 22:265-269, 1978.

Slate, D. L.; Shulman, L.; Lawrence, J. B.; Revel, M.; Ruddle, F. H.: Presence of human chromosome 21 alone is sufficient for hybrid cell sensitivity to human interferon. J. Virol. 25:319-325, 1978.

Takaoka, A.; Mitani, Y.; Suemori, H.; Sato, M.; Yokochi, T.; Noguchi, S.; Tanaka, N.; Taniguchi, T.: Cross talk between interferon-gamma and -alpha/beta signaling components in caveolar membrane domains. Science 288:2357-2360, 2000.

Tan, Y. H.: Chromosome 21 and the cell growth inhibitory effect of human interferon preparations. Nature 260:141-143, 1976.

Tan, Y. H.; Schneider, E. L.; Tischfield, J.; Epstein, C. J.; Ruddle, F. H.: Human chromosome 21 dosage: effect on the expression of the interferon induced antiviral state. Science 186:61-63, 1974.

Tan, Y. H.; Tischfield, J.; Ruddle, F. H.: The linkage of genes for the human interferon-induced antiviral protein and indophenoloxidase-B traits to chromosome G-21. J. Exp. Med. 37:317-330, 1973.

Weil, J.; Tucker, G.; Epstein, L. B.; Epstein, C. J.: Interferon induction of (2-prime-5-prime) oligoisoadenylate synthetase in diploid and trisomy 21 human fibroblasts: relation to dosage of the interferon receptor gene (IFRC). Hum. Genet. 65:108-111, 1983.

Wiranowska-Stewart, M.; Stewart, W. E., II: The role of human chromosome 21 in sensitivity to interferons. J. Gen. Virol. 37:629-633, 1977.

Lee, W. M.; Galbraith, R. M.: The extracellular actin-scavenger system and actin toxicity. New Eng. J. Med. 326:1335-1341, 1992.

Pilz, A.; Moseley, H.; Peters, J.; Abbott, C.: Comparative mapping of mouse chromosome 2 and human chromosome 9q: the genes for gelsolin and dopamine beta-hydroxylase map to mouse chromosome 2. Genomics 12:715-719, 1992.

Brahe, C.; Servidei, S.; Zappata, S.; Ricci, E.; Tonali, P.; Neri, G.: Genetic homogeneity between childhood-onset and adult-onset autosomal recessive spinal muscular atrophy. Lancet 346:741-742, 1995.

Eglen, R. M.; Whiting, R. L.: Muscarinic receptor subtypes: a critique of the current classification and a proposal for a working nomenclature. J. Auton. Pharm. 6:323-346, 1986.

Goyal, R. K.: Muscarinic receptor subtypes: physiology and clinical implications. New Eng. J. Med. 321:1022-1029, 1989.

Liao, C. F.; Themmen, A. P.; Joho, R.; Barberis, C.; Birnbaumer, M.; Birnbaumer, L.: Molecular cloning and expression of a fifth muscarinic acetylcholine receptor. J. Biol. Chem. 264:7328-7337, 1989.

Peralta, E. G.; Ashkenazi, A.; Winslow, J. W.; Smith, D. H.; Ramachandran, J.; Capon, D. J.: Distinct primary structures, ligand-binding properties and tissue-specific expression of four human muscarinic acetylcholine receptors. EMBO J. 6:3923-3929, 1987.

Griffin, C. A.; McKeon, C.; Israel, M. A.; Gegonne, A.; Ghysdael, J.; Stehelin, D.; Douglass, E. C.; Green, A. A.; Emanuel, B. S.:Comparison of constitutional and tumor-associated 11;22 translocations:nonidentical breakpoints on chromosomes 11 and 22. Proc. Nat. Acad. Sci. 83:6122-6126, 1986.

Mastrangelo, T.; Modena, P.; Tornielli, S.; Bullrich, F.; Testi, M. A.; Mezzelani, A.; Radice, P.; Azzarelli, A.; Pilotti, S.; Croce, C. M.; Pierotti, M. A.; Sozzi, G.: A novel zinc finger gene is fused to EWS in small round cell tumor. Oncogene 19:3799-3804, 2000.

Baden, H. P.; Roth, S. I.; Goldsmith, L. A.; Lee, L. D.: Keratohyalin protein in disorders of keratinization. J. Invest. Derm. 62:411-414,1974.

Gan, S.-Q.; McBride, O. W.; Idler, W. W.; Markova, N.; Steinert, P. M.: Organization, structure, and polymorphisms of the human profilaggrin gene. Biochemistry 29:9432-9440, 1990.

Holbrook, K. A.; Dale, B. A.; Brown, K. S.: Abnormal epidermal keratinization in the repeated epilation mutant mouse. J. Cell Biol. 92:387-397, 1982.

McKinley-Grant, L. J.; Idler, W. W.; Bernstein, I. A.; Parry, D. A. D.; Cannizzaro, L.; Croce, C. M.; Huebner, K.; Lessin, S. R.; Steinert, P. M.: Characterization of a cDNA clone encoding human filaggrin and localization of the gene to chromosome region 1q21. Proc. Nat. Acad. Sci. 86:4848-4852, 1989.

Rothnagel, J. A.; Longley, M. A.; Bundman, D. S.; Naylor, S. L.; Lalley, P. A.; Jenkins, N. A.; Gilbert, D. J.; Copeland, N. G.; Roop, D. R.: Characterization of the mouse loricrin gene: linkage with profilaggrin and the flaky tail and soft coat mutant loci on chromosome 3. Genomics 23:450-456, 1994.

Sybert, V. P.; Dale, B. A.; Holbrook, K. A.: Ichthyosis vulgaris:identification of a defect in synthesis of filaggrin correlated with an absence of keratohyaline granules. J. Invest. Derm. 84:191-194,1985.

Volz, A.; Korge, B. P.; Compton, J. G.; Ziegler, A.; Steinert, P. M.; Mischke, D.: Physical mapping of a functional cluster of epidermal differentiation genes on chromosome 1q21. Genomics 18:92-99, 1993.

Barbosa, C. A. A.; Koury, W. H.; Krieger, H.: Linkage data on MN and the Hb beta locus. Am. J. Hum. Genet. 27:797-801, 1975.

Riddell, D. C.; Wang, H.; Umbenhauer, D. R.; Beaume, P. H.; Guengerich, F. P.; Hamerton, J. L.: Regional assignment for the genes encoding human P450IIIA3 (CYP3) and P450IIC9 (CYP2C). (Abstract) Cytogenet. Cell Genet. 46:682, 1987.

Martin-Gallardo, A.; McCombie, W. R.; Gocayne, J. D.; FitzGerald, M. G.; Wallace, S.; Lee, B. M. B.; Lamerdin, J.; Trapp, S.; Kelley, J. M.; Liu, L.-I.; Dubnick, M.; Johnston-Dow, L. A.; Kerlavage, A. R.; de Jong, P.; Carrano, A.; Fields, C.; Venter, J. C.: Automated DNA sequencing and analysis of 106 kilobases from human chromosome 19q13.3. Nature Genet. 1:34-39, 1992.

Volker, M.; Mone, M. J.; Karmakar, P.; van Hoffen, A.; Schul, W.; Vermeulen, W.; Hoeijmakers, J. H. J.; van Driel, R.; van Zeeland, A. A.; Mullenders, L. H. F.: Sequential assembly of the nucleotide excision repair factors in vivo. Molec. Cell 8:213-224, 2001.

Schellens, J. H. M.; Soons, P. A.; Breimer, D. D.: Lack of bimodality in nifedipine plasma kinetics in a large population of healthy subjects. Biochem. Pharm. 37:2507-2510, 1988.

Shet, M. S.; Fisher, C. W.; Holmans, P. L.; Estabrook, R. W.:Human cytochrome P450 3A4: enzymatic properties of a purified recombinant fusion protein containing NADPH-P450 reductase. Proc. Nat. Acad. Sci. 90:11748-11752, 1993.

Shimada, T.; Guengerich, F. P.: Evidence for cytochrome P-450(NF), the nifedipine oxidase, being the principal enzyme involved in the bioactivation of aflatoxins in human liver. Proc. Nat. Acad. Sci. 86:462-465, 1989.

Spurr, N. K.; Gough, A. C.; Stevenson, K.; Wolf, C. R.: The human cytochrome P450 CYP3 locus: assignment to chromosome 7q22-qter. Hum. Genet. 81:171-174, 1989.

Walker, A. H.; Jaffe, J. M.; Gunasegaram, S.; Cummings, S. A.; Huang, C.-S.; Chern, H.-D.; Olopade, O. I.; Weber, B. L.; Rebbeck, T. R.: Characterization of an allelic variant in the nifedipine-specific element of CYP3A4: ethnic distribution and implications for prostate cancer risk. Hum. Mutat. 12:289-293, 1998.

Watkins, P. B.; Wrighton, S. A.; Maurel, P.; Schuetz, E. G.; Mendez-Picon, G.; Parker, G. A.; Guzelian, P. S.: Identification of an inducible form of cytochrome P-450 in human liver. Proc. Nat. Acad. Sci. 82:6310-6314, 1985.

Wolf, C. R.; Smith, C. A. D.; Gough, A. C.; Moss, J. E.; Vallis, K. A.; Howard, G.; Carey, F. J.; Mills, K.; McNee, W.; Carmichael, J.; Spurr, N. K.: Relationship between the debrisoquine hydroxylase polymorphism and cancer susceptibility. Carcinogenesis 13:1035-1038,1992.

Wrighton, S. A.; Stevens, J. C.: The human hepatic cytochromes P450 involved in drug metabolism. Crit. Rev. Toxicol. 22:1-21,1992.

Wrighton, S. A.; Vandenbranden, M.: Isolation and characterization of human fetal liver cytochrome P450HLp2: a third member of the P450III gene family. Arch. Biochem. Biophys. 268:144-151, 1989.

Xie, W.; Barwick, J. L.; Downes, M.; Blumberg, B.; Simon, C. M.; Nelson, M. C.; Neuschwander-Tetri, B. A.; Brunt, E. M.; Guzelian, P. S.; Evans, R. M.: humanized xenobiotic response in mice expressing nuclear receptor SXR. Nature 406:435-439, 2000.

Guengerich, F. P.; Distlerath, L. M.; Reilly, P. E. B.; Wolff, T.; Shimada, T.; Umbenhauer, D. R.; Martin, M. V.: Human-liver cytochromes P-450 involved in polymorphisms of drug oxidation. Xenobiotica 16:367-378, 1986.

Akbari, O.; Freeman, G. J.; Meyer, E. H.; Greenfield, E. A.; Chang, T. T.; Sharpe, A. H.; Berry, G.; DeKruyff, R. H.; Umetsu, D. T.:Antigen-specific regulatory T cells develop via the ICOS-ICOS-ligand pathway and inhibit allergen-induced airway hyper reactivity. NatureMed. 8:1024-1032, 2002.

Franchimont, D.; Martens, H.; Hagelstein, M.-T.; Louis, E.; Dewe, W.; Chrousos, G. P.; Belaiche, J.; Geenen, V.: Tumor necrosis factor alpha decreases, and interleukin-10 increases, the sensitivity of human monocytes to dexamethasone: potential regulation of the glucocorticoid receptor. J. Clin. Endocr. Metab. 84:2834-2839, 1999.

Armstrong, E.; Cannizzaro, L.; Bergman, M.; Huebner, K.; Alitalo, K.: The c-src tyrosine kinase (CSK) gene, a potential anti oncogene, localizes to human chromosome region 15q23-q25. Cytogenet. Cell Genet. 60:119-120, 1992.

Cloutier, J.-F.; Veillette, A.: Association of inhibitory tyrosine protein kinase p50(csk) with protein tyrosine phosphatase PEP in Tcells and other hemopoietic cells. EMBO J. 15:4909-4918, 1996.

Partanen, J.; Armstrong, E.; Bergman, M.; Makela, T. P.; Hirvonen, H.; Huebner, K.; Alitalo, K.: Cyl encodes a putative cytoplasmic tyrosine kinase lacking the conserved tyrosine autophosphorylation site (Y416-src). Oncogene 6:2013-2018, 1991.

Choubey, D.; Snoddy, J.; Chaturvedi, V.; Toniato, E.; Opdenakker, G.; Thakur, A.; Samanta, H.; Engel, D. A.; Lengyel, P.: Interferons as gene activators: indications for repeated gene duplication during the evolution of a cluster of interferon-activatable genes on murine chromosome 1. J. Biol. Chem. 264:17182-17189, 1989.

Ahuja, H. G.; Felix, C. A.; Aplan, P. D.: The t (11;20)(p15; q11) chromosomal translocation associated with therapy-related myelodysplastic syndrome results in an NUP98-TOP1 fusion. Blood 94:3258-3261, 1999.

Siciliano, M. J.; Bachinski, L.; Dolf, G.; Carrano, A. V.; Thompson, L. H.: Chromosomal assignments of human DNA repair genes that complement Chinese hamster ovary (CHO)

cell mutants. (Abstract) Cytogenet. Cell Genet. 46:691-692, 1987.

Thompson, L. H.; Carrano, A. V.; Sato, K.; Salazar, E. P.; White, B. F.; Stewart, S. A.; Minkler, J. L.; Siciliano, M. J.: Identification of nucleotide-excision-repair genes on human chromosomes 2 and 13by functional complementation in hamster-human hybrids. Somat. Cell Molec. Genet. 13:539-551, 1987.

Brandt, P.; Ibrahim, E.; Bruns, G. A. P.; Neve, R. L.: Determination of the nucleotide sequence and chromosomal localization of the ATP2B2 gene encoding human Ca (2+)-pumping ATPase isoform PMCA2. Genomics 14:484-487, 1992.

Kozel, P. J.; Friedman, R. A.; Erway, L. C.; Yamoah, E. N.; Liu, L. H.; Riddle, T.; Duffy, J. J.; Doetschman, T.; Miller, M. L.; Cardell, E. L.; Shull, G. E.: Balance and hearing deficits in mice with a null mutation in the gene encoding plasma membrane Ca (2+)-ATPase isoform 2. J. Biol. Chem. 273:18693-18696, 1998.

Richards, F. M.; Phipps, M. E.; Latif, F.; Yao, M.; Crossey, P. A.; Foster, K.; Linehan, W. M.; Affara, N. A.; Lerman, M. I.; Zbar, B.; Ferguson-Smith, M. A.; Maher, E. R.: Mapping the von Hippel-Lindau disease tumour suppressor gene: identification of germline deletions by pulsed field gel electrophoresis. Hum. Molec. Genet. 2:879-882,1993.

Street, V. A.; McKee-Johnson, J. W.; Fonseca, R. C.; Tempel, B. L.; Noben-Trauth, K.: Mutations in a plasma membrane Ca (2+)-ATPase gene cause deafness in deaf waddler mice. Nature Genet. 19:390-394,1998.

Wang, M. G.; Yi, H.; Hilfiker, H.; Carafoli, E.; Strehler, E. E.; McBride, O. W.: Localization of two genes encoding plasma membrane Ca (2+)-ATPases isoforms 2 (ATP2B2) and 3 (ATP2B3) to human chromosomes 3p26-p25 and Xq28, respectively. Cytogenet. Cell Genet. 67:41-45,1994.

Grundmann, U.; Nerlich, C.; Rein, T.; Zettlmeissl, G.: Complete cDNA sequence encoding human beta-galactoside alpha-2,6-sialyl transferase. Nucleic Acids Res. 18:667 only, 1990.

Wang, X.; Vertino, A.; Eddy, R. L.; Byers, M. G.; Jani-Sait, S. N.; Shows, T. B.; Lau, J. T. Y.: Chromosome mapping and organization of the human beta-galactoside alpha-2,6-sialyl transferase gene: differential and cell-type specific usage of upstream exon sequences in B-lymphoblastoid cells. J. Biol. Chem. 268:4355-4361, 1993.

Xiang, M.; Zhou, L.; Macke, J. P.; Yoshioka, T.; Hendry, S. H. C.; Eddy, R. L.; Shows, T. B.; Nathans, J.: The Brn-3 family of POU-domain factors: primary structure, binding specificity, and expression in subsets of retinal ganglion cells and somatosensory neurons. J. Neurosci. 15:4762-4785, 1995.

Echtay, K. S.; Roussel, D.; St-Pierre, J.; Jekabsons, M. B.; Cadenas, S.; Stuart, J. A.; Harper, J. A.; Roebuck, S. J.; Morrison, A.; Pickering, S.; Clapham, J. C.; Brand, M. D.: Superoxide activates mitochondrial uncoupling proteins. Nature 415:96-99, 2002.

Enerback, S.; Jacobsson, A.; Simpson, E. M.; Guerra, C.; Yamashita, H.; Harper, M.-E.; Kozak, L. P.: Mice lacking mitochondrial uncoupling protein are cold-sensitive but not obese. Nature 387:90-93, 1997.

Di Marzo, V.; Goparaju, S. K.; Wang, L.; Liu, J.; Batkai, S.; Jarai, Z.; Fezza, F.; Miura, G. I.; Palmiter, R. D.; Sugiura, T.; Kunos, G.: Leptin-regulated endocannabinoids are involved in maintaining food intake. Nature 410:822-825, 2001.

Gerard, C. M.; Mollereau, C.; Vassart, G.; Parmentier, M.: molecular cloning of a human cannabinoid receptor which is also expressed in testis. Biochem. J. 279:129-134, 1991.

Hoehe, M. R.; Caenazzo, L.; Martinez, M. M.; Hsieh, W.-T.; Modi, W. S.; Gershon, E. S.; Bonner, T. I.: Genetic and physical mapping of the human cannabinoid receptor gene to chromosome 6q14-q15. New Biologist 3:880-885, 1991.

Ledent, C.; Valverde, O.; Cossu, G.; Petitet, F.; Aubert, J.-F.; Beslot, F.; Bohme, G. A.; Imperato, A.; Pedrazzini, T.; Roques, B. P.; Vassart, G.; Fratta, W.; Parmentier, M.: Unresponsiveness to cannabinoids and reduced addictive effects of opiates in CB(1) receptor knockout mice. Science 283:401-404, 1999.

Marsicano, G.; Wotjak, C. T.; Azad, S. C.; Bisogno, T.; Rammes, G.; Cascio, M. G.; Hermann, H.; Tang, J.; Hofmann, C.; Zieglgansberger, W.; Di Marzo, V.; Lutz, B.: The endogenous cannabinoid system controls extinction of aversive memories. Nature 418:530-534, 2002.

Matsuda, L. A.; Lolait, S. J.; Brownstein, M. J.; Young, A. C.; Bonner, T. I.: Structure of a cannabinoid receptor and functional expression of the cloned cDNA. Nature 346:561-564, 1990.

Modi, W. S.; Bonner, T. I.: Localization of the cannabanoid (sic) receptor locus using non-isotopic in situ hybridization. (Abstract) Cytogenet. Cell Genet. 58:1915 only, 1991.

Panikashvili, D.; Simeonidou, C.; Ben-Shabat, S.; Hanus, L.; Breuer, A.; Mechoulam, R.; Shohami, E.: An endogenous cannabinoid (2-AG) is neuroprotective after brain injury. Nature 413:527-531, 2001.

Beechey, C.; Tweedie, S.; Spurr, N.; Ball, S.; Peters, J.; Edwards,Y.: Mapping of mouse carbonic anhydrase-3, Car-3: another locus in the homologous region of mouse chromosome 3 and human chromosome 8. Genomics 6:692-696, 1990.

Carter, N.; Jeffery, S.; Shiels, A.; Edwards, Y.; Tipler, T.; Hopkinson, D. A.: Characterization of human carbonic anhydrase III from skeletal muscle. Biochem. Genet. 17:837-854, 1979.

Edwards, Y. H.; Lloyd, J.; Parkar, M.; Povey, S.: Human muscle specific carbonic anhydrase, CA3, is on chromosome 8. (Abstract) Cytogenet. Cell Genet. 40:621 only, 1985.

Edwards, Y. H.; Lloyd, J. C.; Parkar, M.; Povey, S.: The gene for human muscle specific carbonic anhydrase (CAIII) is assigned to chromosome 8. Ann. Hum. Genet. 50:41-47, 1986.

Heath, R.; Carter, N. D.; Jeffery, S.; Edwards, R. J.; Watts, D. C.; Watts, R. L.: Evaluation of carrier detection of Duchenne muscular dystrophy using carbonic anhydrase III and creatine kinase. Am. J. Med. Genet. 21:291-296, 1985.

Lloyd, J.; Brownson, C.; Tweedie, S.; Charlton, J.; Edwards, Y. H.: Human muscle carbonic anhydrase: gene structure and DNA methylation patterns in fetal and adult tissues. Genes Dev. 1:594-602, 1987.

Lloyd, J.; McMillan, S.; Hopkinson, D.; Edwards, Y. H.: Nucleotide sequence and derived amino acid sequence of a cDNA encoding human muscle carbonic anhydrase. Gene 41:233-239, 1986.

Lloyd, J. C.; Isenberg, H.; Hopkinson, D. A.; Edwards, Y. H.:Isolation of a cDNA clone for the human muscle specific carbonic anhydrase, CA III. Ann. Hum. Genet. 49:241-251, 1985.

Wade, R.; Gunning, P.; Eddy, R.; Shows, T.; Kedes, L.: Nucleotide sequence, tissue-specific expression, and chromosome location of human carbonic anhydrase III: the human CAIII gene is located on the same chromosome as the closely linked CAI and CAII genes. Proc. Nat. Acad. Sci. 83:9571-9575, 1986.

Hall, C.; Monfries, C.; Smith, P.; Lim, H. H.; Kozma, R.; Ahmed, S.; Vanniasingham, V.; Leung, T.; Lim, L.: Novel human brain cDNA encoding a 34,000 M(r) protein n-chimaerin, related to both the regulatory domain of protein kinase C and BCR, the product of the breakpoint cluster region gene. J. Molec. Biol. 211:11-16, 1990.

Hall, C.; Sin, W. C.; Teo, M.; Michael, G. J.; Smith, P.; Dong, J. M.; Lim, H. H.; Manser, E.; Spurr, N. K.; Jones, T. A.; Lim, L.: Alpha-2-chimerin, an SH2-containing GTPase-activating protein for the ras-related protein p21-rac derived by alternate splicing of the human n-chimerin gene, is selectively expressed in brain regions and testes. Molec. Cell. Biol. 13:4986-4998, 1993.

Brewer, C.; Holloway, S.; Zawalnyski, P.; Schinzel, A.; FitzPatrick, D.: A chromosomal deletion map of human malformations. Am. J. Hum. Genet. 63:1153-1159, 1998.

Brewer, C. M.; Leek, J. P.; Green, A. J.; Holloway, S.; Bonthron, D. T.; Markham, A. F.; FitzPatrick, D. R.: A locus for isolated cleft palate, located on human chromosome 2q32. Am. J. Hum. Genet. 65:387-396, 1999.

Carter, C. O.; Evans, K.; Coffey, R.; Roberts, J. A. F.; Buck, A.; Roberts, M. F.: A family study of isolated cleft palate. J. Med. Genet. 19:329-331, 1982.

Christensen, K.; Holm, N. V.; Olsen, J.; Kock, K.; Fogh-Andersen, P.: Selection bias in genetic-epidemiological studies of cleft lip and palate. Am. J. Hum. Genet. 51:654-659, 1992.

Christensen, K.; Mitchell, L. E.: Familial recurrence-pattern analysis of nonsyndromic isolated cleft palate: a Danish registry study. Am. J. Hum. Genet. 58:182-190, 1996.

Jenkins, M.; Stady, C.: Dominant inheritance of cleft of the soft palate. Hum. Genet. 53:341-342, 1980.

Shields, E. D.; Bixler, D.; Fogh-Andersen, P.: Cleft palate: a genetic and epidemiologic investigation. Clin. Genet. 20:13-24, 1981.

Hwang, S. J.; Beaty, T. H.; Panny, S. R.; Street, N. A.; Joseph, J. M.; Gordon, S.; McIntosh, I.; Francomano, C. A.: Association study of transforming growth factor alpha (TGF-alpha) TaqI polymorphism and oral clefts: indication of gene-environment interaction in a population-based sample of infants with birth defects. Am. J. Epidemiol. 141:629-636, 1995.

Van Dyke, D. C.; Goldman, A. S.; Spielman, R. S.; Zmijewski, C. M.: Segregation of HLA in families with oral clefts: evidence against linkage between isolated cleft palate and HLA. Am. J. Med. Genet. 15:85-88, 1983.

Pearson, W. R.; Vorachek, W. R.; Xu, S.; Berger, R.; Hart, I.; Vannais, D.; Patterson, D.: Identification of class-mu glutathione transferase genes GSTM1-GSTM5 on human chromosome 1p13. Am. J. Hum. Genet. 53:220-233, 1993.

Collaborative Study on the Genetics of Asthma: A genome-wide search for asthma susceptibility loci in ethnically diverse populations. Nature Genet. 15:389-392, 1997.

Gavett, S. H.; O'Hearn, D. J.; Li, X.; Huang, S. K.; Finkelman, F. D.; Wills-Karp, M.: Interleukin 12 inhibits antigen-induced airway hyperresponsiveness, inflammation, and Th2 cytokine expression in mice. J. Exp. Med. 182:1527-1536, 1995.

Karp, C. L.; Grupe, A.; Schadt, E.; Ewart, S. L.; Keane-Moore, M.; Cuomo, P. J.; Kohl, J.; Wahl, L.; Kuperman, D.; Germer, S.; Aud, D.; Peltz, G.; Wills-Karp, M.: Identification of complement factor 5 as a susceptibility locus for experimental allergic asthma. Nature Immun. 1:221-226, 2000.

Ober, C.; Cox, N. J.; Abney, M.; Di Rienzo, A.; Lander, E. S.; Changyaleket, B.; Gidley, H.; Kurtz, B.; Lee, J.; Nance, M.; Pettersson, A.; Prescott, J.; Richardson, A.; Schlenker, E.; Summerhill, E.; Willadsen, S.; Parry, R.; Collaborative Study on the Genetics of Asthma: Genome-wide search for asthma susceptibility loci in a founder population. Hum. Molec. Genet. 7:1393-1398, 1998.

Aguzzi, A.; Weissmann, C.: A suspicious signature. Nature 383:666-667, 1996.

Collinge, J.; Sidle, K. C. L.; Heads, J.; Ironside, J.; Hill, A. F.: Molecular analysis of prion strain variation and the aetiology of 'new variant' CJD. Nature 383:685-690, 1996.

Kishi, K.; Yasuda, T.; Awazu, S.; Mizuta, K.: Genetic polymorphism of human urine deoxyribonuclease I. Hum. Genet. 81:295-297, 1989.

Kishi, K.; Yasuda, T.; Ikehara, Y.; Sawazaki, K.; Sato, W.; Iida, R.: Human serum deoxyribonuclease I (DNase I) polymorphism: pattern similarities among isozymes from serum, urine, kidney, liver, and pancreas. Am. J. Hum. Genet. 47:121-126, 1990.

Napirei, M.; Karsunky, H.; Zevnik, B.; Stephan, H.; Mannherz, H. G.; Moroy, T.: Features of systemic lupus erythematosus in Dnase1-deficient mice. Nature Genet. 25:177-181, 2000.

Yasuda, T.; Awazu, S.; Sato, W.; Iida, R.; Tanaka, Y.; Kishi, K.: Human genetically polymorphic deoxyribonuclease: purification, characterization, and multiplicity of urine deoxyribonuclease I. J. Biochem. 108:393-398, 1990.

Yasuda, T.; Kishi, K.; Yanagawa, Y.; Yoshida, A.: Structure of the human deoxyribonuclease I (DNase I) gene: identification of the nucleotide substitution that generates its classical genetic polymorphism. Ann. Hum. Genet. 59:1-15, 1995.

Yasuda, T.; Nadano, D.; Iida, R.; Takeshita, H.; Lane, S. A.; Callen, D. F.; Kishi, K.: Chromosomal assignment of the human deoxyribonuclease I gene, DNASE1 (DNL1), to band 16p13.3 using the polymerase chain reaction. Cytogenet. Cell Genet. 70:221-223, 1995.

Yasutomo, K.; Horiuchi, T.; Kagami, S.; Tsukamoto, H.; Hashimura, C.; Urushihara, M.; Kuroda, Y.: Mutation of DNASE1 in people with systemic lupus erythematosus. Nature Genet. 28:313-314, 2001.

Chambers, I.; Frampton, J.; Goldfarb, P.; Affara, N.; McBain, W.; Harrison, P. R.: The structure of the mouse glutathione peroxidase gene: the selenocysteine in the active site is encoded by the 'termination' codon, TGA. EMBO J. 5:1221-1227, 1986.

Chu, F.-F.; Esworthy, R. S.; Doroshow, J. H.; Doan, K.; Liu, X.-F.: Expression of glutathione peroxidase in human liver in addition to kidney, heart, lung, and breast in human S and rodents. Blood 79:3233-3238, 1992.

Takahashi, K.; Akasaka, M.; Yamamoto, Y.; Kobayashi, C.; Mizoguchi, J.; Koyama, J.: Primary structure of human plasma glutathione peroxidase deduced from cDNA sequences. J. Biochem. 108:145-148, 1990.

Arce, M. A.; Thompson, E. S.; Wagner, S.; Coyne, K. E.; Ferdman, B. A.; Lublin, D. M.: Molecular cloning of RhD cDNA derived from a gene present in RhD-positive, but not RhD-negative individuals. Blood 82:651-655, 1993.

Bennett, P. R.; Le Van Kim, C.; Colin, Y.; Warwick, R. M.; Cherif-Zahar, B.; Fisk, N. M.; Cartron, J.-P.: Prenatal determination of fetal RhD type by DNA amplification. New Eng. J. Med. 329:607-610, 1993.

Bowman, J. M.: RhD hemolytic disease of the newborn. (Editorial) New Eng. J. Med. 339:1775-1777, 1998.

Cartron, J.-P.: Defining the Rh blood group antigens: biochemistry and molecular genetics. Blood Rev. 8:199-212, 1994.

Colin, Y.; Cherif-Zahar, B.; Le Van Kim, C.; Raynal, V.; Van Huffel, V.; Cartron, J.-P.: Genetic basis of the RhD-positive and RhD-negative blood group polymorphism as determined by Southern analysis. Blood 78:2747-2752, 1991.

Diamond, L. K.; Blackfan, K. D.; Baty, J. M.: Erythroblastosis fetalis and its association with universal edema of the fetus, icterus gravis neonatorum and anemia of the newborn. J. Pediat. 1:269-309,1932.

du Toit, E. D.; Martell, R. W.; Botha, I.; Kriel, C. J.: Anti-D antibodies in the Rh-positive mothers. S. Afr. Med. J. 75:452,1989.

Garratty, G.: Severe reactions associated with transfusion of patients with sickle cell disease. Transfusion 37:357-361, 1997.

Huang, C.-H.: Personal Communication. New York City, N. Y. Oct. 11, 1996.

Huang, C.-H.; Chen, Y.; Reid, M.; Ghosh, S.: Genetic recombination at the human RH locus: a family study of the red-cell Evans phenotype reveals a transfer of exons 2-6 from the RHD to the RHCE gene. Am. J. Hum. Genet. 59:825-833, 1996.

Huang, C.-H.; Reid, M. E.; Chen, Y.; Coghlan, G.; Okubo, Y.:Molecular definition of red cell Rh haplotypes by tightly linked SphIRFLPs. Am. J. Hum. Genet. 58:133-142, 1996.

Hyland, C. A.; Wolter, L. C.; Liew, Y. W.; Saul, A.: A Southern analysis of Rh blood group genes: association between restriction fragment length polymorphism patterns and Rh serotypes. Blood 83:566-572, 1994.

Issitt, P. D.: The Rh blood group system, 1988: eight new antigens in nine years and some observations on the biochemistry and genetics of the system. Transfusion Med. Rev. 3:1-12, 1989.

Kemp, T. J.; Poulter, M.; Carritt, B.: A recombination hot spot in the Rh genes revealed by analysis of unrelated donors with the rare D-- phenotype. Am. J. Hum. Genet. 59:1066-1073, 1996.

Legler, T. J.; Eber, S. W.; Lakomek, M.; Lynen, R.; Maas, J. H.; Pekrun, A.; Repas-Humpe, M.; Schroter, W.; Kohler, M.: Application of RHD and RHCE genotyping for correct blood group determination in chronically transfused patients. Transfusion 39:852-855, 1999.

Le Van Kim, C.; Cherif-Zahar, B.; Raynal, V.; Mouro, I.; Lopez, M.; Cartron, J. P.; Colin, Y.: Multiple Rh messenger RNA isoforms are produced by alternative splicing. Blood 80:1074-1078, 1992.

Le Van Kim, C.; Mouro, I.; Cherif-Zahar, B.; Raynal, V.; Cherrier, C.; Cartron, J.-P.; Colin, Y.: Molecular cloning and primary structure of the human blood group RhD polypeptide. Proc. Nat. Acad. Sci. 89:10925-10929, 1992.

Levine, P.; Katzin, E. M.; Burnham, L.: Isoimmunization in pregnancy:its possible bearing on the etiology of erythroblastosis foetalis. J. A. M. A. 116:825-827, 1941.

Lo, Y. M. D.; Hjelm, N. M.; Fidler, C.; Sargent, I. L.; Murphy, M. F.; Chamberlain, P. F.; Poon, P. M. K.; Redman, C. W. G.; Wainscoat, J. S.: Prenatal diagnosis of fetal RhD status by molecular analysis of maternal plasma. New Eng. J. Med. 339:1734-1738, 1998.

Miyoshi, O.; Yabe, R.; Wakui, K.; Fukushima, Y.; Koizumi, S.; Uchikawa, M.; Kajii, T.; Numakura, C.; Takahashi, S.; Hayasaka, K.; Niikawa, N.: Two cases of mosaic RhD blood-group phenotypes and paternal isodisomy for chromosome 1. Am. J. Med. Genet. 104:250-256, 2001.

Okuda, H.; Kawano, M.; Iwamoto, S.; Tanaka, M.; Seno, T.; Okubo, Y.; Kajii, E.: The RHD gene is highly detectable in RhD-negative Japanese donors. J. Clin. Invest. 100:373-379, 1997.

Race, R. R.: An 'incomplete' antibody in human serum. (Letter) Nature 153:771-772, 1944.

Race, R. R.; Sanger, R.: Blood Groups in Man. Oxford: Blackwell (pub.) (6th ed.):1975.

Rouillac, C.; Le Van Kim, C.; Beolet, M.; Cartron, J.-P.; Colin, Y.: Leu110-to-pro substitution in the RhD polypeptide is responsible for the D(VII) category blood group phenotype. Am. J. Hemat. 49:87-88, 1995.

Smythe, J. S.; Avent, N. D.; Judson, P. A.; Parsons, S. F.; Martin, P. G.; Anstee, D. J.: Expression of RHD and RHCE gene products using retroviral transduction of K562 cells establishes the molecular basis of Rh blood group antigens. Blood 87:2968-2973, 1996.

Spanos, T.; Karageorga, M.; Ladis, V.; Peristeri, J.; Hatziliami, A.; Kattamis, C.: Red cell alloantibodies in patients with thalassemia. VoxSang. 58:50-55, 1990.

Wagner, F. F.; Flegel, W. A.: RHD gene deletion occurred in the Rhesus box. Blood 95:3662-3668, 2000.

Wagner, F. F.; Gassner, C.; Muller, T. H.; Schonitzer, D.; Schunter, F.; Flegel, W. A.: Molecular basis of weak D phenotypes. Blood 93:385-393, 1999.

Wagner, F. F.; Ladewig, B.; Angert, K. S.; Heymann, G. A.; Eicher, N. I.; Flegel, W. A.: The DAU allele cluster of the RHD gene. Blood 100:306-311, 2002.

Wiener, A. S.: The Rh series of allelic genes. Science 100:595-597, 1944.

Tyynela, J.; Sohar, I.; Sleat, D. E.; Gin, R. M.; Donnelly, R. J.; Baumann, M.; Haltia, M.; Lobel, P.: A mutation in the ovine cathepsin D gene causes a congenital lysosomal storage disease with profound neurodegeneration. EMBO J. 19:2786-2792, 2000.

Shiang, R.; Lidral, A. C.; Ardinger, H. H.; Buetow, K. H.; Romitti, P. A.; Munger, R. G.; Murray, J. C.: Association of transforming growth-factor alpha gene polymorphisms with nonsyndromic cleft palate only (CPO). Am. J. Hum. Genet. 53:836-843, 1993.

Shields, E. D.; Bixler, D.; Fogh-Andersen, P.: Facial clefts in Danish twins. Cleft Palate J. 16:1-6, 1979.

Roychoudhury, A. K.; Nei, M.: Human Polymorphic Genes: World Distribution. New York: Oxford Univ. Press (pub.) 1988.

Rodriguez de Cordoba, S.; Lublin, D. M.; Rubinstein, P.; Atkinson, J. P.: Human genes for three complement components that regulate the activation of C3 are tightly linked. J. Exp. Med. 161:1189-1195,1985.

Mouillet-Richard, S.; Ermonval, M.; Chebassier, C.; Laplanche, J. L.; Lehmann, S.; Launay, J. M.; Kellermann, O.: Signal transduction through prion protein. Science 289: 1925-1928, 2000.

Parravicini, V.; Gadina, M.; Kovarova, M.; Odom, S.; Gonzalez-Espinosa, C.; Furumoto, Y.; Saitoh, S.; Samelson, L. E.; O'Shea, J. J.; Rivera, J.: Fyn kinase initiates complementary signals required for IgE-dependent mast cell degranulation. Nature Immun. 3:741-748, 2002.

Casari, G.; Barlassina, C.; Cusi, D.; Zagato, L.; Muirhead, R.; Righetti, M.; Nembri, P.; Amar, K.; Gatti, M.; Macciardi, F.; Binelli, G.; Bianchi, G.: Association of the alpha-adducin locus with essential hypertension. Hypertension 25:320-326, 1995.

Ball, S. P.; Cook, P. J. L.; Mars, M.; Buckton, K. E.: Linkage between dentinogenesis imperfecta and Gc. Ann. Hum. Genet. 46:35-40,1982.

Abernethy, T. J.; Avery, O. T.: The occurrence during acute infections of a protein not normally present in the blood. I. Distribution of the reactive protein in patients' sera and the effect of calcium on the flocculation reaction with C polysaccharide of pneumococcus. J. Exp. Med. 73:173-182, 1941.

Tillett, W. S.; Francis, T., Jr.: Serological reactions in pneumonia with a nonprotein somatic fraction of pneumococcus. J. Exp. Med. 52:561-585, 1930.

Holst, L. S.; Langin, D.; Mulder, H.; Laurell, H.; Grober, J.; Bergh, A.; Mohrenweiser, H. W.; Edgren, G.; Holm, C.: Molecular cloning, genomic organization, and expression of a testicular isoform of hormone-sensitive lipase. Genomics 35:441-447, 1996.

Levitt, R. C.; Liu, Z.; Nouri, N.; Meyers, D. A.; Brandriff, B.; Mohrenweiser, H. M.: Mapping of the gene for hormone sensitive lipase (LIPE) to chromosome 19q13.1-q13.2. Cytogenet. Cell Genet. 69:211-214,1995.

Li, Z.; Sumida, M.; Birchbauer, A.; Schotz, M. C.; Reue, K.: Isolation and characterization of the gene for mouse hormone-sensitive lipase. Genomics 24:259-265, 1994.

Osuga, J.; Ishibashi, S.; Oka, T.; Yagyu, H.; Tozawa, R.; Fujimoto, A.; Shionoiri, F.; Yahagi, N.; Kraemer, F. B.; Tsutsumi, O.; Yamada, N.: Targeted disruption of hormone-sensitive lipase results in male sterility and adipocyte hypertrophy, but not in obesity. Proc. Nat. Acad. Sci. 97:787-792, 2000.

Schonk, D.; van Dijk, P.; Riegmann, P.; Trapman, J.; Holm, C.; Willcocks, T. C.; Sillekens, P.; van Venrooij, W.; Wimmer, E.; Geurtsvan Kessel, A.; Ropers, H.-H.; Wieringa, B.: Assignment of seven genes to distinct intervals on the midportion of human chromosome 19q surrounding the myotonic dystrophy gene region. Cytogenet. Cell Genet. 54:15-19, 1990.

Wang, S.; Lapierre, P.; Robert, M.-F.; Nadeau, J. H.; Mitchell, G. A.: Hormone-sensitive lipase maps to proximal chromosome 7 in mice and is genetically distinct from the Ad and Tub loci. Genomics 24:416-417, 1994.

Coles, L. S.; Diamond, P.; Occhiodoro, F.; Vadas, M. A.; Shannon, M. F.: Cold shock domain proteins repress transcription from the GM-CSF promoter. Nucleic Acids Res. 24:2311-2317, 1996.

Kudo, S.; Mattei, M.-G.; Fukuda, M.: Characterization of the gene for dbpA, a family member of the nucleic-acid-binding proteins containing a cold-shock domain. Europ. J. Biochem. 231:72-82, 1995.

Sakura, H.; Maekawa, T.; Imamoto, F.; Yasuda, K.; Ishii, S.: Two human genes isolated by a novel method encode DNA-binding proteins containing a common region of homology. Gene 73:499-507, 1988.

Gross, M.-S.; Guyonnet-Duperat, V.; Porchet, N.; Bernheim, A.; Aubert, J. P.; Nguyen, V. C.: Mucin 4 (MUC4) gene: regional assignment (3q29) and RFLP analysis. Ann. Genet. 35:21-26, 1992.

Porchet, N.; Van Cong, N.; Dufosse, J.; Audie, J. P.; Guyonnet-Duperat, V.; Gross, M. S.; Denis, C.; Degand, P.; Bernheim, A.; Aubert, J. P.: Molecular cloning and chromosomal localization of a novel human Tracheo-bronchial mucin cDNA containing tandemly repeated sequences of 48 base pairs. Biochem. Biophys. Res. Commun. 175:414-422,1991.

Van Cong, N.; Aubert, J.-P.; Gross, M.-S.; Porchet, N.; Degand, P.; Bernheim, A.: Tracheobronchial mucin 4 (MUC4) gene: assignment to 3q29 and polymorphism of VNTR type. (Abstract) Cytogenet. Cell Genet. 58:1879-1880, 1991.

Garcia, J. V.; Jones, C.; Miller, A. D.: Localization of the amphotropic murine leukemia virus receptor gene to the pericentromeric region of human chromosome 8. J. Virol. 65:6316-6319, 1991.

van Zeijl, M.; Johann, S. V.; Closs, E.; Cunningham, J.; Eddy, R.; Shows, T. B.; O'Hara, B.: A human amphotropic retrovirus receptor is a second member of the gibbon ape leukemia virus receptor family. Proc. Nat. Acad. Sci. 91:1168-1172, 1994.

van Zeijl, M.; Johann, S. V.; Eddy, R. L.; Shows, T. B.; O'Hara, B.: Assignment of GLVR2, a receptor for murine amphotropic virus to human chromosome 8. (Abstract) Human Genome Mapping Workshop 93 18 only, 1993.

Cawthon, R. M.; O'Connell, P.; Buchberg, A. M.; Viskochil, D.; Weiss, R. B.; Culver, M.; Stevens, J.; Jenkins, N. A.; Copeland, N. G.; White, R.: Identification and characterization of transcripts from the neurofibromatosis 1 region: the sequence and genomic structure of EVI2 and mapping of other transcripts. Genomics 7:555-565, 1990.

Collins, F. S.: Personal Communication. Bethesda, Md. Nov. 17, 1993.

O'Connell, P.; Buchberg, A.; Cawthon, R. M.; Culver, M.; Stevens, J.; Viskochil, D.; Carey, J. C.; Fountain, J.; Wallace, M.; Jenkins, N.; Copeland, N.; Collins, F. S.; White, R.: The human homologue of the murine Evi-2 oncogene lies between von Recklinghausen NF translocation breakpoints. (Abstract) Am. J. Hum. Genet. 45 (suppl.): A210 only,1989.

O'Connell, P.; Viskochil, D.; Buchberg, A. M.; Fountain, J.; Cawthon, R. M.; Culver, M.; Stevens, J.; Rich, D. C.; Ledbetter, D. H.; Wallace, M.; Carey, J. C.; Jenkins, N. A.; Copeland, N. G.; Collins, F. S.; White, R.: The human homolog of murine Evi-2 lies between two vonRecklinghausen neurofibromatosis translocations. Genomics 7:547-554,1990.

Hull, E.; Sarkar, M.; Spruijt, M. P. N.; Hoppener, J. W. M.; Dunn, R.; Schachter, H.: Organization and localization to chromosome 5 of the human UDP-N-acetylglucosamine:alpha-3-D-mannoside beta-1,2-N-acetylglucosaminyl transferase 1 gene. Biochem. Biophys. Res. Commun. 176:608-615, 1991.

Ioffe, E.; Stanley, P.: Mice lacking N-acetylglucosaminyl transferase I activity die at mid-gestation, revealing an essential role for complex or hybrid N-linked carbohydrates. Proc. Nat. Acad. Sci. 91:728-732,1994.

Kumar, R.; Stanley, P.: Transfection of a human gene that corrects the Lec1 glycosylation defect: evidence for transfer of the structural gene for N-acetylglucosaminyl transferase I. Molec. Cell. Biol. 9:5713-5717, 1989. Note: Erratum: Molec. Cell. Biol. 10:3857 only,1990.

Kumar, R.; Yang, J.; Eddy, R. L.; Byers, M. G.; Shows, T. B.; Stanley, P.: Cloning and expression of the murine gene and chromosomal location of the human gene encoding N-acetylglucosaminyl transferase I. Glycobiology 2:383-393, 1992.

Kumar, R.; Yang, J.; Larsen, R. D.; Stanley, P.: Cloning and expression of N-acetylglucosaminyl transferase I, the medial Golgi transferase that initiates complex N-linked carbohydrate formation. Proc. Nat. Acad. Sci. 87:9948-9952, 1990.

Metzler, M.; Gertz, A.; Sarkar, M.; Schachter, H.; Schrader, J. W.; Marth, J. D.: Complex asparagine-linked oligosaccharides are required for morphogenic events during post-implantation development. EMBO J. 13:2056-2065, 1994.

Pownall, S.; Kozak, C. A.; Schappert, K.; Sarkar, M.; Hull, E.; Schachter, H.; Marth, J. D.: Molecular cloning and characterization of the mouse UDP-N-acetylglucosamine:alpha-3-D-mannoside beta-1,2-N-acetylglucosaminyl transferaseI gene. Genomics 12:699-704, 1992.

Puthalakath, H.; Burke, J.; Gleeson, P. A.: Glycosylation defect in lec1 Chinese hamster ovary mutant is due to a point mutation in N-acetylglucosaminyl transferase 1 gene. J. Biol. Chem. 271:27818-27822,1996.

Shows, T. B.: Personal Communication. Buffalo, N.Y. Apr. 13, 1999.

Yip, B.; Chen, S.-H.; Mulder, H.; Hoppener, J. W. M.; Schachter, H.: Organization of the human beta-1,2-N-acetylglucosaminyl transferase I gene (MGAT1), which controls complex and hybrid N-glycan synthesis. Biochem. J. 321: 465-474, 1997.

Tan, J.; d'Agostaro, G. A. F.; Bendiak, B.; Reck, F.; Sarkar, M.; Squire, J. A.; Leong, P.; Schachter, H.: The human UDP-N-acetylglucosamine:alpha-6-D-mannoside-beta-1,2-N- acetylglucosaminyl transferase II gene (MGAT2): cloning of genomic DNA, localization to chromosome 14q21, expression in insect cells and purification of the recombinant protein. Europ. J. Biochem. 231:317-328, 1995.

Kondo, M.; Scherer, D. C.; Miyamoto, T.; King, A. G.; Akashi, K.; Sugamura, K.; Weissman, I. L.: Cell-fate conversion of lymphoid-committed progenitors by instructive actions of cytokines. Nature 407:383-386,2000.

Le Beau, M. M.; Westbrook, C. A.; Diaz, M. O.; Larson, R. A.; Rowley, J. D.; Gasson, J. C.; Golde, D. W.; Sherr, C. J.: Evidence for the involvement of GM-CSF and FMS in the deletion (5q) in myeloid disorders. Science 231:984-987, 1986.

Morgan, R.; Hecht, B. K.; Sandberg, A. A.; Hecht, F.; Smith, S. D.: Chromosome 5q35 breakpoint in malignant histiocytosis. (Letter) NewEng. J. Med. 314:1322 only, 1986.

Ridge, S. A.; Worwood, M.; Oscier, D.; Jacobs, A.; Padua, R. A.: FMS mutations in myelodysplastic, leukemic, and normal subjects. Proc. Nat. Acad. Sci. 87:1377-1380, 1990.

Roberts, W. M.; Look, A. T.; Roussel, M. F.; Sherr, C. J.: Tandem linkage of human CSF-1 receptor (c-fms) and PDGF receptor genes. Cell 55:655-661, 1988.

Sapi, E.; Flick, M. B.; Kacinski, B. M.: The first intron of human c-fms proto-oncogene contains a processed pseudogene (RPL7P) for ribosomal protein L7. Genomics 22:641-645, 1994.

Verbeek, J. S.; Roebroek, A. J. M.; van den Ouweland, A. M. W.; Bloemers, H. P. J.; Van de Ven, W. J. M.: Human c-fms proto-oncogene:comparative analysis with an abnormal allele. Molec. Cell. Biol. 5:422-426, 1985.

Verbeek, J. S.; van Heerikhuizen, H.; de Pauw, B. E.; Haanen, C.; Bloemers, H. P. J.; Van de Ven, W. J. M.: A hereditary abnormal c-fms proto-oncogene in a patient with acute lymphocytic leukaemia and congenital hypothyroidism. Brit. J. Haemat. 61:135-138, 1985.

Yarden, Y.; Ullrich, A.: Growth factor receptor tyrosine kinases. Ann. Rev. Biochem. 57:443-478, 1988.

Brown, J. R.; Ye, H.; Bronson, R. T.; Dikkes, P.; Greenberg, M. E.: A defect in nurturing in mice lacking the immediate early gene fosB. Cell 86:297-309, 1996.

Forsdyke, D.: Personal Communication. Kingston, Ontario, Canada Jun. 8, 1992.

Lazo, P. S.; Dorfman, K.; Noguchi, T.; Mattei, M. G.; Bravo, R.: Structure and mapping of the fosB gene: FosB down regulates the activity of the fosB promoter. Nucleic Acids Res. 20:343-350, 1992.

Nakabeppu, Y.; Nathans, D.: A naturally occurring truncated form of FosB that inhibits Fos/Jun transcriptional activity. Cell 64:751-759, 1991.

Siderovski, D. P.; Blum, S.; Forsdyke, R. E.; Forsdyke, D. R.:A set of human putative lymphocyte G0/G1 switch genes includes genes homologous to rodent cytokine and zinc finger protein-encoding genes. DNA Cell Biol. 9:579-587, 1990.

Kelz, M. B.; Chen, J.; Carlezon, W. A., Jr.; Whisler, K.; Gilden, L.; Beckmann, A. M.; Steffen, C.; Zhang, Y.-J.; Marotti, L.; Self, D. W.; Tkatch, T.; Baranauskas, G.; Surmeier, D. J.; Neve, R. L.; Duman, R. S.; Picciotto, M. R.; Nestler, E. J.: Expression of the transcription factor delta-FosB in the brain controls sensitivity to cocaine. Nature 401: 272-276, 1999.

Hoffmeyer, S.; Burk, O.; von Richter, O.; Arnold, H. P.; Brockmoller, J.; Johne, A.; Cascorbi, I.; Gerloff, T.; Roots, I.; Eichelbaum, M.; Brinkmann, U.: Functional polymorphisms of the human multidrug-resistance gene: multiple sequence variations and correlation of one allele with P-glycoprotein expression and activity in vivo. Proc. Nat. Acad. Sci. 97:3473-3478, 2000.

Fruman, D. A.; Snapper, S. B.; Yballe, C. M.; Davidson, L.; Yu, J. Y.; Alt, F. W.; Cantley, L. C.: Impaired B cell development and proliferation in absence of phosphoinositide 3-kinase p85-alpha. Science 283:393-397, 1999.

Fukao, T.; Tanabe, M.; Terauchi, Y.; Ota, T.; Matsuda, S.; Asano, T.; Kadowaki, T.; Takeuchi, T.; Koyasu, S.: PI3K-mediated negative feedback regulation of IL-12 production in DCs. Nature Immun. 3:875-881, 2002.

Fukao, T.; Yamada, T.; Tanabe, M.; Terauchi, Y.; Ota, T.; Takayama, T.; Asano, T.; Takeuchi, T.; Kadowaki, T.; Hata, J.; Koyasu, S.:Selective loss of gastrointestinal mast cells and impaired immunity in PI3K-deficient mice. Nature Immun. 3:295-304, 2002.

Hoyle, J.; Yulug, I. G.; Egan, S. E.; Fisher, E. M. C.: The gene that encodes the phosphatidyl inositol-3 kinase regulatory subunit (p85-alpha) maps to chromosome 13 in the mouse. Genomics 24:400-402,1994.

Otsu, M.; Hiles, I.; Gout, I.; Fry, M. J.; Ruiz-Larrea, F.; Panayotou, G.; Thompson, A.; Dhand, R.; Hsuan, J.; Totty, N.; Smith, A. D.; Morgan, S. J.; Courtneidge, S. A.; Parker, P. J.; Waterfield, M. D.: characterization of two 85 kd proteins that associate with receptor tyrosine kinases, middle-T/pp60 (c-src) complexes, and PI3-kinase. Cell 65:91-104,1991.

Skolnik, E. Y.; Margolis, B.; Mohammadi, M.; Lowenstein, E.; Fischer, R.; Drepps, A.; Ullrich, A.; Schlessinger, J.: Cloning of PI3-kinase associated p85 utilizing a novel method for expression/cloning of target proteins for receptor tyrosine kinases. Cell 65:83-90, 1991.

Suzuki, H.; Terauchi, Y.; Fujiwara, M.; Aizawa, S.; Yazaki, Y.; Kadowaki, T.; Koyasu, S.: Xid-like immunodeficiency in mice with disruption of the p85-alpha subunit of phosphoinositide 3-kinase. Science 283:390-392, 1999.

Terauchi, Y.; Tsuji, Y.; Satoh, S.; Minoura, H.; Murakami, K.; Okuno, A.; Inukai, K.; Asano, T.; Kaburagi, Y.; Ueki, K.; Nakajima, H.; Hanafusa, T.; and 18 others: Increased insulin sensitivity and hypoglycaemia in mice lacking the p85-alpha subunit of phosphoinositide3-kinase. Nature Genet. 21:230-235, 1999.

Volinia, S.; Patracchini, P.; Otsu, M.; Hiles, I.; Gout, I.; Calzolari, E.; Bernardi, F.; Rooke, L.; Waterfield, M. D.: Chromosomal localization of human p85-alpha, a subunit of phosphatidyl inositol 3-kinase, and its homologue p85-beta. Oncogene 7:789-793, 1992.

Bonne, G.; Di Barletta, M. R.; Varnous, S.; Becane, H.-M.; Hammouda, E.-H.; Merlini, L.; Muntoni, F.; Greenberg, C. R.; Gary, F.; Urtizberea, J.-A.; Duboc, D.; Fardeau, M.; Toniolo, D.; Schwartz, K.: Mutations in the gene encoding lamin A/C cause autosomal dominant Emery-Dreifuss muscular dystrophy. Nature Genet. 21:285-288, 1999.

Bakker, E.; Pearson, P. L.; Meera Khan, P.; Schreuder, G. M. T.; Madan, K.: Orientation of major histocompatibility (MHC) genes relative to the centromere of human chromosome 6. Clin. Genet. 15:198-202,1979.

Bender, K.; Grzeschik, K. H.: Assignment of the genes for human glyoxalase I to chromosome 6 and for human esterase D to chromosome 13. Cytogenet. Cell Genet. 16:93-96, 1976.

Beretta, M.; Schiliro, G.; Russo, A.; Barbujani, G.; Mazzetti, P.; Russo, G.; Barrai, I.: A new rare variant of the glyoxalase I system of the red cell: GLO-Sicily. Am. J. Hum. Genet. 35:1042-1047,1983.

Blanche, H.; Zoghbi, H. Y.; Jabs, E. W.; de Gouyon, B.; Zunec, R.; Dausset, J.; Cann, H. M.: A centromere-based genetic map of the short arm of human chromosome 6. Genomics 9:420-428, 1991.

Carter, N. D.; West, C. M.; Bernard, J. M.; Farid, N. R.; Larsen, B.; Marshall, W. H.: Linkage of glyoxalase I and HLA in two Newfoundland communities. Hum. Hered. 28:397-400, 1978.

Giblett, E. R.; Lewis, M.: Gene linkage studies on glyoxalase I. Cytogenet. Cell Genet. 16:313 only, 1976.

Goldman, D.; O'Brien, S. J.; Lucas-Derse, S.; Dean, M.: Linkage mapping of human polymorphic proteins identified by two-dimensional electrophoresis. Genomics 11:875-884, 1991.

Hansen, H. E.; Eriksen, B.: HLA-GLO linkage analysis in 57 informative families. Hum. Hered. 29:355-360, 1979.

Karlsson, S.; Arnason, A.; Jensson, O.: GLO polymorphism in Iceland. Hum. Hered. 30:383-385, 1980.

Kavathas, P.; DeMars, R.: A new variant glyoxalase I allele that is readily detectable in stimulated lymphocytes and lymphoblastoid cell lines but not in circulating lymphocytes or erythrocytes. Am. J. Hum. Genet. 33:935-945, 1981.

Kompf, J.; Bissbort, S.; Gussmann, S.; Ritter, H.: Polymorphism of red cell glyoxalase I (E. C.4.4.1.5), a new genetic marker in man:investigation of 169 mother-child combinations. human genetik 27:141-143, 1975.

Kompf, J.; Bissbort, S.; Ritter, H.: Red cell glyoxalase I (E. C.4.4.1.5):formal genetics and linkage relations. human genetik 28:249-251,1975.

Kompf, J.; Siebert, G.; Ritter, H.; Heilbronner, H.; Schunter, F.; Wernet, P.; Gupta, D.; Moeller, H.: Data on linkage relations between GLO and 21-hydroxylase. Hum. Genet. 54:419-420, 1980.

Meo, T.; Douglas, T.; Rijnbeek, A.-M.: Glyoxalase I polymorphism in the mouse: a new genetic marker linked to H-2. Science 198:311-313, 1977.

Olaisen, B.; Gedde-Dahl, T., Jr.; Thorsby, E.: Localization of the human GLO gene locus. Hum. Genet. 32:301-304, 1976.

Parr, C. W.; Bagster, I. A.; Welch, S. G.: Human red cell glyoxalase I polymorphism. Biochem. Genet. 15:109-114, 1977.

Reinsmoen, N. L.; Friend, P. S.; Miller, W. V.; Burgdorf, A.; Giblett, E. R.; Yunis, E. J.: Inheritance of recombinant HLA-GLO haplotype suggesting the gene sequence. Nature 267: 276-278, 1977.

Rubinstein, P.; Suciu-Foca, N.: Glyoxalase 1: a possible 'null' allele. Hum. Hered. 29:217-220, 1979.

Schimandle, C. M.; Vander Jagt, D. L.: Isolation and kinetic analysis of the multiple forms of glyoxalase-1 from human erythrocytes. Arch. Biochem. Biophys. 195:261-268, 1979.

Sparkes, R. S.; Sparkes, M. C.; Crist, M.; Anderson, C. E.: GlyoxalaseI 'null' allele in a new family: identification by abnormal segregation pattern and quantitative assay. Hum. Genet. 64:146-147, 1983.

Teng, Y. S.; Tan, S. G.; Lopez, C. G.: Red cell glyoxalase I and placental soluble aconitase polymorphisms in the three major ethnic groups of Malaysia. Jpn. J. Hum. Genet. 23:211-215, 1978.

Kartner, N.; Evernden-Porelle, D.; Bradley, G.; Ling, V.: Detection of P-glycoprotein in multidrug-resistant cell lines by monoclonal antibodies. Nature 316:820-823, 1985.

Kim, R. B.; Fromm, M. F.; Wandel, C.; Leake, B.; Wood, A. J. J.; Roden, D. M.; Wilkinson, G. R.: The drug transporter P-glycoprotein limits oral absorption and brain entry of HIV-1 protease inhibitors. J. Clin. Invest. 101:289-294, 1998.

Lankas, G. R.; Wise, L. D.; Cartwright, M. E.; Pippert, T.; Umbenhauer, D. R.: Placental P-glycoprotein deficiency enhances susceptibility to chemically induced birth defects in mice. Reprod. Toxicol. 12:457-463, 1998.

Martinsson, T.; Levan, G.: Localization of the multidrug resistance-associated 170 kDa P-glycoprotein gene to mouse chromosome 5 and to homogeneously staining regions in multidrug-resistant mouse cells by in situ hybridization. Cytogenet. Cell Genet. 45:99-101, 1987.

Mealey, K. L.; Bentjen, S. A.; Gay, J. M.; Cantor, G. H.: Ivermectin sensitivity in collies is associated with a deletion mutation of the mdr1 gene. Pharmacogenetics 11:727-733, 2001.

Mickley, L. A.; Spengler, B. A.; Knutsen, T. A.; Biedler, J. L.; Fojo, T.: Gene rearrangement: a novel mechanism for MDR-1 gene activation. J. Clin. Invest. 99:1947-1957, 1997.

Pastan, I.; Gottesman, M.: Multiple-drug resistance in human cancer. New Eng. J. Med. 316:1388-1393, 1987.

Pulliam, J. D.; Seward, R. L.; Henry, R. T.; Steinberg, S. A.: Investigating ivermectin toxicity in collies. Vet. Med. 80:33-40,1985.

Randolph, G. J.; Beaulieu, S.; Pope, M.; Sugawara, I.; Hoffman, L.; Steinman, R. M.; Muller, W. A.: A physiologic function for p-glycoprotein (MDR-1) during the migration of dendritic cells from skin via afferent lymphatic vessels. Proc. Nat. Acad. Sci. 95:6924-6929, 1998.

Riordan, J. R.; Deuchars, K.; Kartner, N.; Alon, N.; Trent, J.; Ling, V.: Amplification of P-glycoprotein genes in multidrug-resistant mammalian cell lines. Nature 316:817-819, 1985.

Roninson, I. B.; Chin, J. E.; Choi, K.; Gros, P.; Housman, D. E.; Fojo, A.; Shen, D.; Gottesman, M. M.; Pastan, I.: Isolation of human mdr DNA sequences amplified in multidrug-resistant KB carcinoma cells. Proc. Nat. Acad. Sci. 83:4538-4542, 1986.

Ruiz, J. C.; Choi, K.; Von Hoff, D. D.; Roninson, I. B.; Wahl, G. M.: Autonomously replicating episomes contain MDR1 genes in a multidrug-resistant human cell line. Molec. Cell. Biol. 9:109-115,1989.

Safa, A. R.; Stern, R. K.; Choi, K.; Agresti, M.; Tamai, I.; Mehta, N. D.; Roninson, I. B.: Molecular basis of preferential resistance to colchicine in multidrug-resistant human cells conferred by gly185-to-val 185 substitution in P-glycoprotein. Proc. Nat. Acad. Sci. 87:7225-7229,1990.

Schinkel, A. H.; Smit, J. J. M.; van Tellingen, O.; Beijnen, J. H.; Wagenaar, E.; van Deemter, L.; Mol, C. A. A. M.; van der Valk, M. A.; Robanus-Maandag, E. C.; te Riele, H. P. J.; Berns, A. J. M.; Borst, P.: Disruption of the mouse mdr1a P-glycoprotein gene leads to a deficiency in the blood-brain barrier and to increased sensitivity to drugs. Cell 77:491-502, 1994.

Shen, D.-W.; Fojo, A.; Chin, J. E.; Roninson, I. B.; Richert, N.; Pastan, I.; Gottesman, M. M.: Human multidrug-resistant cell lines: increased mdr1 expression can precede gene amplification. Science 232:643-645, 1986.

Slovak, M. L.; Hoeltge, G. A.; Trent, J. M.: Cytogenetic alterations associated with the acquisition of doxorubicin resistance: possible significance of chromosome 7 alterations. Cancer Res. 47:6646-6652,1987.

Smit, J. W.; Huisman, M. T.; van Tellingen, O.; Wiltshire, H. R.; Schinkel, A. H.: Absence or pharmacological blocking of placental P-glycoprotein profoundly increases fetal drug exposure. J. Clin. Invest. 104:1441-1447, 1999.

Synold, T. W.; Dussault, I.; Forman, B. M.: The orphan nuclear receptor SXR coordinately regulates drug metabolism and efflux. Nature Med. 7:584-590, 2001.

Taylor, H. R.; Pacque, M.; Munoz, B.; Greene, B. M.: Impact of mass treatment of onchocerciasis with ivermectin on the Transmission of infection. Science 250:116-118, 1990.

Trent, J.; Bell, D.; Willard, H.; Ling, V.: Chromosomal localization in normal human cells and CHO cells of a sequence derived from P-glycoprotein (PGY1). (Abstract) Cytogenet. Cell Genet. 40:761-762, 1985.

Trent, J. M.; Witkowski, C. M.: Clarification of the chromosomal assignment of the human P-glycoprotein/mdr1 gene: possible coincidence with the cystic fibrosis and c-met oncogene. Cancer Genet. Cytogenet. 26:187-190, 1987.

Trezise, A. E. O.; Romano, P. R.; Gill, D. R.; Hyde, S. C.; Sepulveda, F. V.; Buchwald, M.; Higgins, C. F.: The multidrug resistance and cystic fibrosis genes have complementary patterns of epithelial expression. EMBO J. 11:4291-4303, 1992.

Ueda, K.; Cardarelli, C.; Gottesman, M. M.; Pastan, I.: Expression of a full-length cDNA for the human 'MDR1' gene confers resistance to colchicine, doxorubicin, and vinblastine. Proc. Nat. Acad. Sci. 84:3004-3008, 1987.

Ueda, K.; Clark, D. P.; Chen, C.; Roninson, I. B.; Gottesman, M. M.; Pastan, I.: The human multidrug resistance (mdr1) gene: cDNA cloning and transcription initiation. J. Biol. Chem. 262:505-508, 1987.

Ueda, K.; Cornwell, M. M.; Gottesman, M. M.; Pastan, I.; Roninson, I. B.; Ling, V.; Riordan, J. R.: The mdr1 gene, responsible for multidrug-resistance, codes for P-glycoprotein. Biochem. Biophys. Res. Commun. 141:956-962, 1986.

Ueda, K.; Pastan, I.; Gottesman, M. M.: Isolation and sequence of the promoter region of the human multidrug-resistance (P-glycoprotein) gene. J. Biol. Chem. 262:17432-17436, 1987.

Umbenhauer, D. R.; Lankas, G. R.; Pippert, T. R.; Wise, L. D.; Cartwright, M. E.; Hall, S. J.; Beare, C. M.: Identification of a P-glycoprotein-deficient subpopulation in the CF-1 mouse strain using a restriction fragment length polymorphism. Toxicol. Appl. Pharm. 146:88-94, 1997.

van Helvoort, A.; Smith, A. J.; Sprong, H.; Fritzsche, I.; Schinkel, A. H.; Borst, P.; van Meer, G.: MDR1 P-glycoprotein is a lipid translocase of broad specificity, while MDR3 P-glycoprotein specifically translocates phosphatidylcholine. Cell 87:507-517, 1996.

Kobayashi, M.; Takamatsu, K.; Saitoh, S.; Miura, M.; Noguchi, T.: Molecular cloning of hippocalcin, a novel calcium-binding protein of the recoverin family exclusively expressed in hippocampus. Biochem. Biophys. Res. Commun. 189:511-517, 1992.

Takamatsu, K.; Kobayashi, M.; Saitoh, S.; Fujishiro, M.; Noguchi, T.: Molecular cloning of human hippocalcin cDNA and chromosomal mapping of its gene. Biochem. Biophys. Res. Commun. 200:606-611, 1994.

Borrego, S.; Ruiz, A.; Saez, M. E.; Gimm, O.; Gao, X.; Lopez-Alonso, M.; Hernandez, A.; Wright, F. A.; Antinolo, G.; Eng, C.: RET genotypes comprising specific haplotypes of polymorphic variants predispose to isolated Hirschsprung disease. J. Med. Genet. 37:572-578, 2000.

Borrego, S.; Saez, M. E.; Ruiz, A.; Gimm, O.; Lopez-Alonso, M.; Antinolo, G.; Eng, C.: Specific polymorphisms in the RET proto-oncogene are over-represented in patients with Hirschsprung disease and may represent loci modifying phenotypic expression. J. Med. Genet. 36:771-774, 1999.

Goldstein, J. L.; Brown, M. S.; Stone, N. J.: Genetics of the LDL receptor: evidence that the mutations affecting binding and internalization are allelic. Cell 12:629-641, 1977.

Goldstein, J. L.; Dana, S. E.; Brunschede, G. Y.; Brown, M. S.: Genetic heterogeneity in familial hypercholesterolemia: evidence for two different mutations affecting functions of low-density lipoprotein receptor. Proc. Nat. Acad. Sci. 72:1092-1096, 1975.

Hobbs, H. H.; Brown, M. S.; Goldstein, J. L.: Molecular genetics of the LDL receptor gene in familial hypercholesterolemia. Hum. Mutat. 1:445-466, 1992.

Hobbs, H. H.; Brown, M. S.; Goldstein, J. L.; Russell, D. W.: Deletion of exon encoding cysteine-rich repeat of low density lipoprotein receptor alters its binding specificity in a subject with familial hypercholesterolemia. J. Biol. Chem. 261:13114-13120, 1986.

Hobbs, H. H.; Russell, D. W.; Brown, M. S.; Goldstein, J. L.: The LDL receptor locus in familial hypercholesterolemia: mutational analysis of a membrane protein. Annu. Rev. Genet. 24:133-170, 1990.

Horsthemke, B.; Beisiegel, U.; Dunning, A.; Havinga, J. R.; Williamson, R.; Humphries, S.: Unequal crossing-over between two Alu-repetitive DNA sequences in the low-density-lipoprotein-receptor gene: a possible mechanism for the defect in a patient with familial hypercholesterolaemia. Europ. J. Biochem. 164:77-81, 1987.

Khachadurian, A. K.: The inheritance of essential familial hypercholesterolemia. Am. J. Med. 37:402-407, 1964.

Kingsley, D. M.; Krieger, M.: Receptor-mediated endocytosis of low density lipoprotein: somatic cell mutants define multiple genes required for expression of surface-receptor activity. Proc. Nat. Acad. Sci. 81:5454-5458, 1984.

Knight, B. L.; Gavigan, S. J. P.; Soutar, A. K.; Patel, D. D.: Defective processing and binding of low-density lipoprotein receptors in fibroblasts from a familial hypercholesterolaemic subject. Europ. J. Biochem. 179:693-698, 1989.

Knoblauch, H.; Muller-Myhsok, B.; Busjahn, A.; Ben Avi, L.; Bahring, S.; Baron, H.; Heath, S. C.; Uhlmann, R.; Faulhaber, H.-D.; Shpitzen, S.; Aydin, A.; Reshef, A.; and 11 others: A cholesterol-lowering gene maps to chromosome 13q. Am. J. Hum. Genet. 66:157-166, 2000.

Komuro, I.; Kato, H.; Nakagawa, T.; Takahashi, K.; Mimori, A.; Takeuchi, F.; Nishida, Y.; Miyamoto, T.: Case report: the longest-lived patient with homozygous familial hypercholesterolemia secondary to a defect in internalization of the LDL receptor. Am. J. Med. Sci. 294:341-345, 1987.

Kotze, M. J.; Langenhoven, E.; Retief, A. E.; Steyn, K.; Marais, M. P.; Grobbelaar, J. J.; Oosthuizen, C. J. J.; Weich, H. F. H.; Benade, A. J. S.: Haplotype associations of three DNA polymorphisms at the human low density lipoprotein receptor gene locus in familial hypercholesterolemia. J. Med. Genet. 24:750-755, 1987.

Grundy, H. O.; Peltz, G.; Moore, K. W.; Golbus, M. S.; Jackson, L. G.; Lebo, R. V.: The polymorphic Fc-gamma receptor II gene maps to human chromosome 1q. Immunogenetics 29:331-339, 1989.

Lin, P.-F.; Slate, D. L.; Lawyer, F. C.; Ruddle, F. H.: Assignment of the murine interferon sensitivity and cytoplasmic superoxide dismutase genes to chromosome 16. Science 209:285-287, 1980.

Holmes, W. E.; Lee, J.; Kuang, W.-J.; Rice, G. C.; Wood, W. I.: Structure and functional expression of a human interleukin-8 receptor. Science 253:1278-1280, 1991.

Sligh, J. E., Jr.; Ballantyne, C. M.; Rich, S. S.; Hawkins, H. K.; Smith, C. W.; Bradley, A.; Beaudet, A. L.: Inflammatory and immune responses are impaired in mice deficient in intercellular adhesion molecule 1. Proc. Nat. Acad. Sci. 90:8529-8533, 1993.

Nishimura, D.; Buetow, K. H.; Yamada, Y.; Murray, J. C.: RFLPs and linkage relationships of the human laminin B2 gene. Genomics 3:393-395, 1988.

Karaplis, A. C.; Luz, A.; Glowacki, J.; Bronson, R. T.; Tybulewicz, V. L. J.; Kronenberg, H. M.; Mulligan, R. C.: Lethal skeletal dysplasia from targeted disruption of the parathyroid hormone-related peptide gene. Genes Dev. 8:277-289, 1994.

Whittington, J. E.; Keats, B. J. B.; Jackson, J. F.; Currier, R. D.; Terasaki, P. I.: Linkage studies on glyoxalase I (GLO), pepsinogen (PG), spinocerebellar ataxia (SCA1), and HLA. Cytogenet. Cell Genet. 28:145-150, 1980.

Ziegler, A.; Fonatsch, C.; Kompf, J.: Mapping of the locus for glyoxalase 1 (GLO1) on human chromosome 6 using mutant cell lines. (Abstract) Cytogenet. Cell Genet. 40:787 only, 1985.

Beranova, M.; Oliveira, L. M. B.; Bedecarrats, G. Y.; Schipani, E.; Vallejo, M.; Ammini, A. C.; Quintos, J. B.; Hall, J. E.; Martin, K. A.; Hayes, F. J.; Pitteloud, N.; Kaiser, U. B.; Crowley, W. F., Jr.; Seminara, S. B.: Prevalence, phenotypic spectrum, and modes of inheritance of gonadotropin-releasing hormone receptor mutations in idiopathic hypogonadotropic hypogonadism. J. Clin. Endocr. Metab. 86:1580-1588, 2001.

Caron, P.; Chauvin, S.; Christin-Maitre, S.; Bennet, A.; Lahlou, N.; Counis, R.; Bouchard, P.; Kottler, M.-L.: Resistance of hypogonadic patients with mutated GnRH receptor genes to pulsatile GnRH administration. J. Clin. Endocr. Metab. 84:990-996, 1999.

Costa, E. M. F.; Bedecarrats, G. Y.; Mendonca, B. B.; Arnhold, I. J. P.; Kaiser, U. B.; Latronico, A. C.: Two novel mutations in the gonadotropin-releasing hormone receptor gene in Brazilian patients with hypogonadotropic hypogonadism and normal olfaction. J. Clin. Endocr. Metab. 86:2680-2686, 2001.

de Roux, N.; Young, J.; Brailly-Tabard, S.; Misrahi, M.; Milgrom, E.; Schaison, G.: The same molecular defects of the gonadotropin-releasing hormone receptor determine a variable degree of hypogonadism in affected kindred. J. Clin. Endocr. Metab. 84:567-572, 1999.

de Roux, N.; Young, J.; Misrahi, M.; Genet, R.; Chanson, P.; Schaison, G.; Milgrom, E.: A family with hypogonadotropic hypogonadism and mutations in the gonadotropin-releasing hormone receptor. New Eng. J. Med. 337:1597-1602, 1997.

Fan, N. C.; Jeung, E.-B.; Peng, C.; Olofsson, J. I.; Krisinger, J.; Leung, P. C. K.: The human gonadotropin-releasing hormone (GnRH) receptor gene: cloning, genomic organization and chromosomal assignment. Molec. Cell. Endocr. 103:R1-R6, 1994.

Iwashita, T.; Murakami, H.; Asai, N.; Takahashi, M.: Mechanism of Ret dysfunction by Hirschsprung mutations affecting its extracellular domain. Hum. Molec. Genet. 5:1577-1580, 1996.

Lehrman, M. A.; Goldstein, J. L.; Brown, M. S.; Russell, D. W.; Schneider, W. J.: Internalization-defective LDL receptors produced by genes with nonsense and frame shift mutations that truncate the cytoplasmic domain. Cell 41:735-743, 1985.

Bird, A. P.: CpG islands as gene markers in the vertebrate nucleus. Trends Genet. 3:342-347, 1987.

Maartmann-Moe, K.; Wang, H. S.; Donald, L. J.; Hamerton, J. L.; Berg, K.: Data from hybrid cell lines raise the possibility that factors controlling the low density lipoprotein receptor activity may reside on human chromosome 21, 5 or both. (Abstract) Cytogenet. Cell Genet. 32:295-296, 1982.

Miyake, Y.; Tajima, S.; Funahashi, T.; Yamamoto, A.: analysis of a recycling-impaired mutant of low density lipoprotein receptor in familial hypercholesterolemia. J. Biol. Chem. 264:16584-16590,1989.

Seftel, H. C.; Baker, S. G.; Sandler, M. P.; Forman, M. B.; Joffe, B. I.; Mendelsohn, D.; Jenkins, T.; Mieny, C. J.: A host of hypercholesterolaemichomozygotes in South Africa. Brit. Med. J. 281:633-636, 1980.

Grundy, H. O.; Peltz, G.; Barsh, G.; Moore, K.; Golbus, M. S.; Lebo, R. V.: Immunoglobulin G Fc receptor II and Fc receptor III genes map to chromosome 1 by spot-blot chromosome analysis. (Abstract) Am. J. Hum. Genet. 43: A145, 1988.

Hibbs, M. L.; Bonadonna, L.; Scott, B. M.; McKenzie, I. F. C.; Hogarth, P. M.: Molecular cloning of a human immunoglobulin G Fc receptor. Proc. Nat. Acad. Sci. 85:2240-2244, 1988.

Hibbs, M. L.; Hogarth, P. M.; McKenzie, I. F. C.: The mouse Ly-17 locus identifies a polymorphism of the Fc receptor. Immunogenetics 22:335-348, 1985.

Lebo, R. V.; Lynch, E. D.; Wiegant, J.; Moore, K.; Trounstine, M.; van der Ploeg, M.: Multicolor fluorescence in situ hybridization and pulsed field electrophoresis dissect CMT1B gene region. Hum. Genet. 88:13-20, 1991.

Moser, K. L.; Neas, B. R.; Salmon, J. E.; Yu, H.; Gray-McGuire, C.; Asundi, N.; Bruner, G. R.; Fox, J.; Kelly, J.; Henshall, S.; Bacino, D.; Dietz, M.; Hogue, R.; Koelsch, G.; Nightingale, L.; Shaver, T.; Abdou, N. I.; Albert, D. A.; Carson, C.; Petri, M.; Treadwell, E. L.; James, J. A.; Harley, J. B.: Genome scan of human systemic lupus erythematosus: evidence for linkage on chromosome 1q in African-American pedigrees. Proc. Nat. Acad. Sci. 95:14869-14874, 1998.

Oakey, R. J.; Watson, M. L.; Seldin, M. F.: Construction of a physical map on mouse and human chromosome 1: comparison of 13 Mb of mouse and 11 Mb of human DNA. Hum. Molec. Genet. 1:613-620,1992.

Peltz, G. A.; Grundy, H. O.; Lebo, R. V.; Yssel, H.; Barsh, G. S.; Moore, K. W.: Human Fc-gamma-RIII: cloning, expression, and identification of the chromosomal locus of two Fc receptors for IgG. Proc. Nat. Acad. Sci. 86:1013-1017, 1989.

Qiu, W. Q.; de Bruin, D.; Brownstein, B. H.; Pearse, R.; Ravetch, J. V.: Organization of the human and mouse low-affinity Fc-gamma-R genes: duplication and recombination. Science 248:732-735, 1990.

Salmon, J. E.; Millard, S.; Schachter, L. A.; Arnett, F. C.; Ginzler, E. M.; Gourley, M. F.; Ramsey-Goldman, R.; Peterson, M. G. E.; Kimberly, R. P.: Fc-gamma-RIIA alleles are heritable risk factors for lupus nephritis in African Americans. J. Clin. Invest. 97:1348-1354,1996.

Sammartino, L.; Webber, L. M.; Hogarth, P. M.; McKenzie, I. F. C.; Garson, O. M.: Assignment of the gene coding for human FcRII (CD32) to bands q23q24 on chromosome 1. Immunogenetics 28:380-381,1988.

Stein, M.-P.; Edberg, J. C.; Kimberly, R. P.; Mangan, E. K.; Bharadwaj, D.; Mold, C.; Du Clos, T. W.: C-reactive protein binding to Fc-gamma-RIIa on human monocytes and neutrophils is allele-specific. J. Clin. Invest. 105:369-376, 2000.

Unkeless, J. C.: Function and heterogeneity of human Fc receptors for immunoglobulin G. J. Clin. Invest. 83:355-361, 1989.

Cama, A.; de la Luz Sierra, M.; Quon, M. J.; Ottini, L.; Gorden, P.; Taylor, S. I.: Substitution of glutamic acid for alanine 1135 in the putative 'catalytic loop' of the tyrosine kinase domain of the human insulin receptor: a mutation that impairs proteolytic processing into subunits and inhibits receptor tyrosine kinase activity. J. Biol. Chem. 268:8060-8069, 1993.

Cama, A.; Quon, M. J.; de la Luz Sierra, M.; Taylor, S. I.: Substitution of isoleucine for methionine at position 1153 in the beta-subunit of the human insulin receptor. J. Biol. Chem. 267:8383-8389, 1992.

Caro, J. F.; Raju, S. M.; Sinha, M. K.; Goldfine, I. D.; Dohm, G. L.: Heterogeneity of human liver, muscle, and adipose tissue insulin receptor. Biochem. Biophys. Res. Commun. 151:123-129, 1988.

Christiansen, K.; Tranum-Jensen, J.; Carlsen, J.; Vinten, J.: A model for the quaternary structure of human placental insulin receptor deduced from electron microscopy. Proc. Nat. Acad. Sci. 88:249-252,1991.

Cocozza, S.; Porcellini, A.; Riccardi, G.; Monticelli, A.; Condorelli, G.; Ferrara, A.; Pianese, L.; Miele, C.; Capaldo, B.; Beguinot, F.; Varrone, S.: NIDDM associated with mutation in tyrosine kinase domain of insulin receptor gene. Diabetes 41:521-526, 1992.

Due, C.; Simonsen, M.; Olsson, L.: The major histocompatibility complex class I heavy chain as a structural subunit of the human cell membrane insulin receptor: implications for the range of biological functions of histocompatibility antigens. Proc. Nat. Acad. Sci. 83:6007-6011, 1986.

Ebina, Y.; Ellis, L.; Jarnagin, K.; Edery, M.; Graf, L.; Clauser, E.; Ou, J.-H.; Masiarz, F.; Kan, Y. W.; Goldfine, I. D.; Roth, R. A.; Rutter, W. J.: The human insulin receptor cDNA: the structural basis for hormone activated transmembrane signalling. Cell 40:747-758,1985.

Elbein, S. C.; Corsetti, L.; Ullrich, A.; Permutt, M. A.: Multiple restriction fragment length polymorphisms at the insulin receptor locus: a highly informative marker for linkage analysis. Proc. Nat. Acad. Sci. 83:5223-5227, 1986.

Elbein, S. C.; Sorensen, L. K.; Schumacher, M. C.: Methionine for valine substitution in exon 17 of the insulin receptor gene in a pedigree with familial NIDDM. Diabetes 42:429-434, 1993.

Ferrannini, E.; Muggeo, M.; Navalesi, R.; Pilo, A.: impaired insulin degradation in a patient with insulin resistance and acanthosis nigricans. Am. J. Med. 73:148-154, 1982.

Grigorescu, F.; Flier, J. S.; Kahn, C. R.: Characterization of binding and phosphorylation defects of erythrocyte insulin receptors in the type A syndrome of insulin resistance. Diabetes 35:127-138,1986.

Grigorescu, F.; Flier, J. S.; Kahn, C. R.: Defect in insulin receptor phosphorylation in erythrocytes and fibroblasts associated with severe insulin resistance. J. Biol. Chem. 259:15003-15006,1984.

Grunberger, G.; Zick, Y.; Gordon, G.: Defect in phosphorylation of insulin receptors in cells from an insulin-resistant patient with normal insulin binding. Science 223:932-934, 1984.

Hone, J.; Accili, D.; Al-Gazali, L. I.; Lestringant, G.; Orban, T.; Taylor, S. I.: Homozygosity for a new mutation (ile119-to-met) in the insulin receptor gene in five sibs with familial insulin resistance. J. Med. Genet. 31:715-716, 1994.

Kadowaki, T.; Bevins, C. L.; Cama, A.; Ojamaa, K.; Marcus-Samuels, B.; Kadowaki, H.; Beitz, L.; McKeon, C.; Taylor, S. I.: Two mutant alleles of the insulin receptor gene in a patient with extreme insulin resistance. Science 240:787-790, 1988.

Kadowaki, T.; Kadowaki, H.; Accili, D.; Taylor, S. I.: Substitution of lysine for asparagine at position 15 in the alpha-subunit of the human insulin receptor: a mutation that impairs transport of receptors to the cell surface and decreases the affinity of insulin binding. J. Biol. Chem. 265:19143-19150, 1990.

Kadowaki, T.; Kadowaki, H.; Accili, D.; Yazaki, Y.; Taylor, S. I.: Substitution of arginine for histidine at position 209 in the alpha-subunit of the human insulin receptor: a mutation that impairs receptor dimerization and transport of receptors to the cell surface. J. Biol. Chem. 266:21224-21231, 1991.

Kadowaki, T.; Kadowaki, H.; Rechler, M. M.; Serrano-Rios, M.; Roth, J.; Gorden, P.; Taylor, S. I.: Five mutant alleles of the insulin receptor gene in patients with genetic forms of insulin resistance. J. Clin. Invest. 86:254-264, 1990.

Kadowaki, T.; Kadowaki, H.; Taylor, S. I.: A nonsense mutation causing decreased levels of insulin receptor mRNA: detection by a simplified technique for direct sequencing of genomic DNA amplified by the polymerase chain reaction. Proc. Nat. Acad. Sci. 87:658-662,1990.

Kahn, C. R.; Flier, J. S.; Bar, R. S.; Archer, J. A.; Gorden, P.; Martin, M. M.; Roth, J.: The syndromes of insulin resistance and acanthosis nigricans: insulin receptor disorders in man. New Eng. J. Med. 294:739-745, 1976.

Kahn, C. R.; Goldstein, B. J.: Molecular defects in insulin action. Science 245:13 only, 1989.

Kahn, C. R.; White, M. F.: The insulin receptor and the molecular mechanism of insulin action. J. Clin. Invest. 82:1151-1156, 1988.

Kakehi, T.; Hisatomi, A.; Kuzuya, H.; Yoshimasa, Y.; Okamoto, M.; Yamada, K.; Nishimura, H.; Kosaki, A.; Nawata, H.; Umeda, F.; Ibayashi, H.; Imura, H.: Defective processing of insulin-receptor precursor in cultured lymphocytes from a patient with extreme insulin resistance. J. Clin. Invest. 81:2020-2022, 1988.

Kittur, D.; Shimizu, Y.; DeMars, R.; Edidin, M.: Insulin binding to human B lymphoblasts is a function of HLA haplotype. Proc. Nat. Acad. Sci. 84:1351-1355, 1987.

Klinkhamer, M. P.; Groen, N. A.; van der Zon, G. C. M.; Lindhout, D.; Sandkuyl, L. A.; Krans, H. M. J.; Moller, W.; Maassen, J. A.:A leucine-to-proline mutation in the insulin receptor in a family with insulin resistance. EMBO J. 8:2503-2507, 1989.

Krook, A.; Brueton, L.; O'Rahilly, S.: Homozygous nonsense mutation in the insulin receptor gene in infant with leprechaunism. Lancet 342:277-278, 1993.

Kulkarni, R. N.; Bruning, J. C.; Winnay, J. N.; Postic, C.; Magnuson, M. A.; Kahn, C. R.: Tissue-specific knockout of the insulin receptor in pancreatic beta cells creates an insulin secretory defect similar to that in type 2 diabetes. Cell 96:329-339, 1999.

Chan, A. M.-L.; Hilkens, J.; Kroezen, V.; Mitchell, P. J.; Scambler, P.; Wainwright, B. J.; Williamson, R.; Cooper, C. S.: Molecular cloning and localization to chromosome 6 of mouse INT1L1 gene. Somat. Cell Molec. Genet. 15:555-562, 1989.

Huguet, E. L.; McMahon, J. A.; McMahon, A. P.; Bicknell, R.; Harris, A. L.: Differential expression of human Wnt genes 2, 3, 4, and 7B in human breast cell lines and normal and disease states of human breast tissue. Cancer Res. 54:2615-2621, 1994.

McCoy, P. A.; Shao, Y.; Wolpert, C. M.; Donnelly, S. L.; Ashley-Koch, A.; Abel, H. L.; Ravan, S. A.; Abramson, R. K.; Wright, H. H.; DeLong, G. R.; Cuccaro, M. L.; Gilbert, J. R.; Pericak-Vance, M. A.: No association between the WNT2 gene and autistic disorder. Am. J. Med. Genet. (Neuropsychiat. Genet.) 114:106-109, 2002.

Nusse, R.; Brown, A.; Papkoff, J.; Scambler, P.; Shackleford, G.; McMahon, A.; Moon, R.; Varmus, H.: A new nomenclature for int-1 and related genes: the Wnt gene family. Cell 64:231-232, 1991.

Wainwright, B. J.; Scambler, P. J.; Stanier, P.; Watson, E. K.; Bell, G.; Wicking, C.; Estivill, X.; Courtney, M.; Bour, A.; Pedersen, P. S.; Williamson, R.; Farrall, M.: Isolation of a human gene with protein sequence similarity to human and murine int-1 and the Drosophila segment polarity mutant wingless. EMBO J. 7:1743-1748, 1988.

Wassink, T. H.; Piven, J.; Vieland, V. J.; Huang, J.; Swiderski, R. E.; Pietila, J.; Braun, T.; Beck, G.; Folstein, S. E.; Haines, J. L.; Sheffield, V. C.: Evidence supporting WNT2 as an autism susceptibility gene. Am. J. Med. Genet. 105:406-413, 2001.

Kluck, P. M. C.; Wiegant, J.; Jansen, R. P. M.; Bolk, M. W. J.; Raap, A. K.; Willemze, R.; Landegent, J. E.: The human interleukin-6 receptor alpha-chain gene is localized on chromosome 1 band q21. Hum. Genet. 90:542-544, 1993.

Yamasaki, K.; Taga, T.; Hirata, Y.; Yawata, H.; Kawanishi, Y.; Seed, B.; Taniguchi, T.; Hirano, T.; Kishimoto, T.: Cloning and expression of the human interleukin-6 (BSF-2/IFN-beta-2) receptor. Science 241:825-828, 1988.

Szpirer, J.; Szpirer, C.; Riviere, M.; Houart, C.; Baumann, M.; Fey, G. H.; Poli, V.; Cortese, R.; Islam, M. Q.; Levan, G.: The interleukin-6-dependent DNA-binding protein gene (transcription factor 5: TCF5) maps to human chromosome 20 and rat chromosome 3, the IL6 receptor locus (IL6R) to human chromosome 1 and rat chromosome 2, and the rat IL6 gene to rat chromosome 4. Genomics 10:539-546, 1991.

Alli, C.; Consalez, G. G.: Linkage mapping of Csrp to proximal mouse chromosome 3. Mammalian Genome 9:172 only, 1998.

Erdel, M.; Weiskirchen, R.: Assignment of CSRP1 encoding the LIM domain protein CRP1, to human chromosome 1q32 by fluorescence in situ hybridization. Cytogenet. Cell Genet. 83:10-11, 1998.

Liebhaber, S. A.; Emery, J. G.; Urbanek, M.; Wang, X.; Cooke, N. E.: Characterization of a human cDNA encoding a widely expressed and highly conserved cysteine-rich protein with an unusual zinc-finger motif. Nucleic Acids Res. 18:3871-3879, 1990.

Weiskirchen, R.; Pino, J. D.; Macalma, T.; Bister, K.; Beckerle, M. C.: The cysteine-rich protein family of highly related LIM domain proteins. J. Biol. Chem. 270:28946-28954, 1995.

Yamauchi, M.; Yamauchi, N.; Phear, G.; Spurr, N. K.; Martinsson, T.; Weith, A.; Meuth, M.: Genomic organization and chromosomal localization of the human CTP synthetase gene (CTPS). Genomics 11:1088-1096,1991.

Wang, X.; Lee, G.; Liebhaber, S. A.; Cooke, N. E.: Human cysteine-rich protein: a member of the LIM/double-finger family displaying coordinate serum induction with c-myc. J. Biol. Chem. 267:9176-9184, 1992.

Wang, X.; Ray, K.; Szpirer, J.; Levan, G.; Liebhaber, S. A.; Cooke, N. E.: Analysis of the human cysteine-rich protein gene (CSRP), assignment to chromosome 1q24-1q32, and identification of an associated MspI polymorphism. Genomics 14:391-397, 1992.

Courseaux, A.; Grosgeorge, J.; Gaudray, P.; Pannett, A. A. J.; Forbes, S. A.; Williamson, C.; Bassett, D.; Thakker, R. V.; Teh, B. T.; Farnebo, F.; Shepherd, J.; Skogseid, B.; Larsson, C.; Giraud, S.; Zhang, C. X.; Salandre, J.; Calender, A.: Definition of the minimal MEN1 candidate area based on a 5-Mb integrated map of proximal 11q13. Genomics 37:354-365, 1996.

Anagnou, N. P.; Antonarakis, S. E.; O'Brien, S. J.; Modi, W. S.; Nienhuis, A. W.: Chromosomal localization and racial distribution of the polymorphic human dihydrofolate reductase pseudogene (DHFRPI). Am. J. Hum. Genet. 42:345-352, 1988.

Anagnou, N. P.; Antonarakis, S. E.; O'Brien, S. J.; Nienhuis, A. W.: Chromosomal localization and racial distribution of the polymorphich DHFR-psi-1 pseudogene. (Abstract) Clin. Res. 33:328A only, 1985.

Anagnou, N. P.; Antonarakis, S. E.; O'Brien, S. J.; Nienhuis, A. W.: A novel form of human polymorphism involving the hDHFR-psi-1 pseudogene identifies three RFLPs. Nucleic Acids Res. 15:5501 only,1987.

Anagnou, N. P.; O'Brien, S. J.; Shimada, T.; Nash, W. G.; Chen, M.-J.; Nienhuis, A. W.: Chromosomal organization of the human dihydrofolate reductase genes: dispersion, selective amplification and a novel form of polymorphism. Proc. Nat. Acad. Sci. 81:5170-5174, 1984.

Blakley, R. L.; Sorrentino, B. P.: In vitro mutations in dihydrofolate reductase that confer resistance to methotrexate: potential for clinical application. Hum. Mutat. 11:259-263, 1998.

Chen, M.-J.; Shimada, T.; Moulton, A. D.; Harrison, M.; Nienhuis, A. W.: Intronless human dihydrofolate reductase genes are derived from processed RNA molecules. Proc. Nat. Acad. Sci. 79:7435-7439,1982.

Craik, C. S.; Rutter, W. J.; Fletterick, R.: Splice junctions: association with variation in protein structure. Science 220: 1125-1129,1983.

Erbe, R. W.: Inborn errors of folate metabolism. New Eng. J. Med. 293:753-757 and 807-812, 1975.

Funanage, V. L.; Myoda, T. T.; Moses, P. A.; Cowell, H. R.: Assignment of the human dihydrofolate reductase gene to the q11-q22 region of chromosome 5. Molec. Cell. Biol. 4:2010-2016, 1984.

Hoffbrand, A. V.; Tripp, E.; Jackson, B. F. A.; Luck, W. E.; Frater-Schroder, M.: Hereditary abnormal transcobalamin II previously diagnosed as congenital dihydrofolate reductase deficiency. (Letter) New Eng. J. Med. 310:789-790, 1984.

Killary, A. M.; Leach, R. J.; Moran, R. G.; Fournier, R. E. K.: Assignment of genes encoding dihydrofolate reductase and hexosaminidase B to Mus musculus chromosome 13. Somat. Cell Molec. Genet. 12:641-648,1986.

Maurer, B.; Barker, P. E.; Masters, J. N.; d'Eustachio, P.; Ruddle, F. H.; Attardi, G.: Chromosomal location of the normal human DHFR gene and of its amplified copies in methotrexate resistant cell variants. (Abstract) Cytogenet. Cell Genet. 37:534 only, 1984.

Maurer, B. J.; Barker, P. E.; Masters, J. N.; Ruddle, F. H.; Attardi, G.: Human dihydrofolate reductase gene is located in chromosome 5 and is unlinked to the related pseudogenes. Proc. Nat. Acad. Sci. 81:1484-1488, 1984.

Maurer, B. J.; Carlock, L.; Wasmuth, J.; Attardi, G.: Assignment of human dihydrofolate reductase gene to band q23 of chromosome 5 and of related pseudogene psiHD1 to chromosome 3. Somat. Cell Molec. Genet. 11:79-85, 1985.

Myoda, T. T.; Funanage, V. L.: Personal Communication. Wilmington, Del. Oct. 7, 1983.

Singer, M. J.; Mesner, L. D.; Friedman, C. L.; Trask, B. J.; Hamlin, J. L.: Amplification of the human dihydrofolate reductase gene via double minutes is initiated by chromosome breaks. Proc. Nat. Acad. Sci. 97:7921-7926, 2000.

Tauro, G. P.; Danks, D. M.; Rowe, P. B.; Van der Weyden, M. B.; Schwarz, M. A.; Collins, V. L.; Neal, B. W.: Dihydrofolate reductase deficiency causing megaloblastic anemia in two families. New Eng. J. Med. 294:466-470, 1976.

Walters, T. R.: Congenital megaloblastic anemia responsive to N(5)-formyltetrahydrofolic acid administration. J. Pediat. 70:686-687,1967.

Ali, G.; Wasco, W.; Cai, X.; Szabo, P.; Sheu, K.-F. R.; Cooper, A. J. L.; Gaston, S. M.; Gusella, J. F.; Tanzi, R. E.; Blass, J. P.: Isolation, characterization, and mapping of gene encoding dihydrolipoylsuccinyl transferase (E2k) of human alpha-ketoglutarate dehydrogenase complex. Somat. Cell Molec. Genet. 20:99-105, 1994.

Nakano, K.; Matuda, S.; Sakamoto, T.; Takase, C.; Nakagawa, S.; Ohta, S.; Ariyama, T.; Inazawa, J.; Abe, T.; Miyata, T.: Human dihydrolipoamidesuccinyl transferase: cDNA cloning and localization on chromosome 14q24.2-q24.3. Biochim. Biophys. Acta 1216:360-368, 1993.

Nakano, K.; Takase, C.; Sakamoto, T.; Ohta, S.; Nakagawa, S.; Ariyama, T.; Inazawa, J.; Abe, T.; Matuda, S.: An unspliced cDNA for human dihydrolipoamide succinyl transferase: characterization and mapping of the gene to chromosome 14q24.2-q24.3. Biochem. Biophys. Res. Commun. 196:527-533, 1993.

Patel, M. S.; Harris, R. A.: Mammalian alpha-keto acid dehydrogenase complexes: gene regulation and genetic defects. FASEB J. 9:1164-1172,1995.

Palmer, G.; Manen, D.; Bonjour, J.-P.; Caverzasio, J.: characterization of the human Glvr-1 phosphate transporter/retrovirus receptor gene and promoter region. Gene 226:25-33, 1999.

Fan, N. C.; Peng, C.; Krisinger, J.; Leung, P. C. K.: The human gonadotropin-releasing hormone receptor gene: complete structure including multiple promoters, transcription initiation sites, and polyadenylation signals. Molec. Cell. Endocr. 107: R1-R8, 1995.

Grosse, R.; Schoneberg, T.; Schultz, G.; Gudermann, T.: Inhibition of gonadotropin-releasing hormone receptor signaling by expression of a splice variant of the human receptor. Molec. Endocr. 11:1305-1318,1997.

Kaiser, U. B.; Dushkin, H.; Altherr, M. R.; Beier, D. R.; Chin, W. W.: Chromosomal localization of the gonadotropin-releasing hormone receptor gene to human chromosome 4q13.1-q21.1 and mouse chromosome 5. Genomics 20:506-508, 1994.

Kakar, S. S.; Musgrove, L. C.; Devor, D. C.; Sellers, J. C.; Neill, J. D.: Cloning, sequencing, and expression of human gonadotropin releasing hormone (GnRH) receptor. Biochem. Biophys. Res. Commun. 189:289-295, 1992.

Kakar, S. S.; Neill, J. D.: The human gonadotropin-releasing hormone receptor gene (GNRHR) maps to chromosome band 4q13. Cytogenet. Cell Genet. 70:211-214, 1995.

Kottler, M.-L.; Chauvin, S.; Lahlou, N.; Harris, C. E.; Johnston, C. J.; Lagarde, J.-P.; Bouchard, P.; Farid, N. R.; Counis, R.: A new compound heterozygous mutation of the gonadotropin-releasing hormone receptor (L314X, Q106R) in a woman with complete hypogonadotropic hypogonadism: chronic estrogen administration amplifies the gonadotropin defect. J. Clin. Endocr. Metab. 85:3002-3008, 2000.

Kottler, M.-L.; Counis, R.; Bouchard, P.: Mutations of the GnRH receptor gene: a new cause of autosomal-recessive hypogonadotropic hypogonadism. Arch. Med. Res. 30:481-485, 1999.

Kottler, M. L.; Lorenzo, F.; Bergametti, F.; Commercon, P.; Souchier, C.; Counis, R.: Subregional mapping of the human gonadotropin-releasing hormone receptor (GnRH-R) gene to 4q between the markers D4S392 and D4S409. Hum. Genet. 96:477-480, 1995.

Layman, L. C.; Cohen, D. P.; Jin, M.; Xie, J.; Li, Z.; Reindollar, R. H.; Bolbolan, S.; Bick, D. P.; Sherins, R. R.; Duck, L. W.; Musgrove, L. C.; Sellers, J. C.; Neill, J. D.: Mutations in gonadotropin-releasing hormone receptor gene cause hypogonadotropic hypogonadism. (Letter) Nature Genet. 18:14-15, 1998.

Leung, P. C. K.; Squire, J.; Peng, C.; Fan, N.; Hayden, M. R.; Olofsson, J. I.: Mapping of the gonadotropin-releasing hormone (GnRH) receptor gene to human chromosome 4q21.2 by fluorescence in situ hybridization. Mammalian Genome 6:309-310, 1995.

Mason, A. J.; Hayflick, J. S.; Zoeller, R. T.; Young, W. S., III; Phillips, H. S.; Nikolics, K.; Seeburg, P. H.: A deletion truncating the gonadotropin-releasing hormone gene is responsible for hypogonadism in the 'hpg' mouse. Science 234:1366-1371, 1986.

Morrison, N.; Sellar, R. E.; Boyd, E.; Eidne, K. A.; Connor, J. M.: Assignment of the gene encoding the human gonadotropin-releasing hormone receptor to 4q13.2-13.3 by fluorescence in situ hybridization. Hum. Genet. 93:714-715, 1994.

Pitteloud, N.; Boepple, P. A.; DeCruz, S.; Valkenburgh, S. B.; Crowley, W. F., Jr.; Hayes, F. J.: The fertile eunuch variant of idiopathic hypogonadotropic hypogonadism: spontaneous reversal associated with a homozygous mutation in the gonadotropin-releasing hormone receptor. J. Clin. Endocr. Metab. 86:2470-2475, 2001.

Pralong, F. P.; Gomez, F.; Castillo, E.; Cotecchia, S.; Abuin, L.; Aubert, M. L.; Portmann, L.; Gaillard, R. C.: Complete hypogonadotropic hypogonadism associated with a novel inactivating mutation of the gonadotropin-releasing hormone receptor. J. Clin. Endocr. Metab. 84:3811-3816, 1999.

Szende, B.; Srkalovic, G.; Timar, J.; Mulchahey, J. J.; Neill, J. D.; Lapis, K.; Csikos, A.; Szepeshazi, K.; Schally, A. V.: Localization of receptors for luteinizing hormone-releasing hormone in pancreatic and mammary cancer cells. Proc. Nat. Acad. Sci. 88:4153-4156, 1991.

Spemann, H.; Mangold, H.: Ueber induktion von embryonalanlagendurch implantation artfremder organisatoren. Arch. Mikroskopische Anat. Entwicklungsmechanik 100:599-638, 1924.

Bahler, M.; Kehrer, I.; Gordon, L.; Stoffler, H.-E.; Olsen, A. S.: Physical mapping of human myosin-IXB (MYO9B), the human orthologue of the rat myosin myr 5, to chromosome 19p13.1. Genomics 43:107-109,1997.

Qiu, Y.; Krishnan, V.; Zeng, Z.; Gilbert, D. J.; Copeland, N. G.; Gibson, L.; Yang-Feng, T.; Jenkins, N. A.; Tsai, M.-J.; Tsai, S. Y.: Isolation, characterization, and chromosomal localization of mouse and human COUP-TF I and II genes. Genomics 29:240-246, 1995.

Kaelbling, M.; Eddy, R.; Shows, T. B.; Copeland, N. G.; Gilbert, D. J.; Jenkins, N. A.; Klinger, H. P.; O'Hara, B.: Localization of the human gene allowing infection by gibbon ape leukemia virus to human chromosome region 2q11-q14 and to the homologous region on mouse chromosome 2. J. Virol. 65:1743-1747, 1991.

Kavanaugh, M. P.; Miller, D. G.; Zhang, W.; Law, W.; Kozak, S. L.; Kabat, D.; Miller, A. D.: Cell-surface receptors for gibbon ape leukemia virus and amphotropic murine retrovirus are inducible sodium-dependent phosphate symporters. Proc. Nat. Acad. Sci. 91:7071-7075, 1994.

O'Hara, B.; Johann, S. V.; Klinger, H. P.; Blair, D. G.; Rubinson, H.; Dunn, K. J.; Sass, P.; Vitek, S. M.; Robins, T.: characterization of a human gene conferring sensitivity to infection by gibbon ape leukemia virus. Cell Growth Differ. 1:119-127, 1990.

Palmer, G.; Manen, D.; Bonjour, J.-P.; Caverzasio, J.: Species-specific mechanisms control the activity of the Pit1/PIT1 phosphate transporter gene promoter in mouse and human. Gene 279:49-62, 2001.

Hayashi, K.; Yano, H.; Hashida, T.; Takeuchi, R.; Takeda, O.; Asada, K.; Takahashi, E.; Kato, I.; Sobue, K.: Genomic structure of the human caldesmon gene. Proc. Nat. Acad. Sci. 89:12122-12126, 1992.

Humphrey, M. B.; Herrera-Sosa, H.; Gonzalez, G.; Lee, R.; Bryan, J.: Cloning of cDNAs encoding human caldesmons. Gene 112:197-204,1992.

Dickson, K. M.; Bergeron, J. J. M.; Shames, I.; Colby, J.; Nguyen, D. T.; Chevet, E.; Thomas, D. Y.; Snipes, G. J.: Association of calnexin with mutant peripheral myelin protein-22 ex vivo: a basis for 'gain-of-function' ER diseases. Proc. Nat. Acad. Sci. 99:9852-9857, 2002.

Gray, P. W.; Byers, M. G.; Eddy, R. L.; Shows, T. B.: The assignment of the calnexin gene to the q35 region of chromosome 5. (Abstract) human Genome Mapping Workshop 93 9 only, 1993.

Schrag, J. D.; Bergeron, J. J. M.; Li, Y.; Borisova, S.; Hahn, M.; Thomas, D. Y.; Cygler, M.: The structure of calnexin, an ER chaperone involved in quality control of protein folding. Molec. Cell 8:633-644,2001.

Tjoelker, L. W.; Seyfried, C. E.; Eddy, R. L., Jr.; Byers, M. G.; Shows, T. B.; Calderon, J.; Schreiber, R. B.; Gray, P. W.: Human, mouse, and rat calnexin cDNA cloning: identification of potential calcium binding motifs and gene localization to human chromosome 5. Biochemistry 33:3229-3236, 1994.

Richard, I.; Beckmann, J. S.: Molecular cloning of mouse canp3, the gene associated with limb-girdle muscular dystrophy 2A in human. Mammalian Genome 7:377-379, 1996.

Cyr, C.; Huebner, K.; Druck, T.; Kris, R.: Cloning and chromosomal localization of a human endothelin ETA receptor. Biochem. Biophys. Res. Commun. 181:184-190, 1991.

Hosoda, K.; Nakao, K.; Tamura, N.; Arai, H.; Ogawa, Y.; Suga, S.; Nakanishi, S.; Imura, H.: Organization, structure, chromosomal assignment, and expression of the gene encoding the human endothelin-A receptor. J. Biol. Chem. 267: 18797-18804, 1992.

Tzourio, C.; El Amrani, M.; Poirier, O.; Nicaud, V.; Bousser, M.-G.; Alperovitch, A.: Association between migraine and endothelin type A receptor (ETA -231 A/G) gene polymorphism. Neurology 56:1273-1277,2001.

Amiel, J.; Attie, T.; Jan, D.; Pelet, A.; Edery, P.; Bidaud, C.; Lacombe, D.; Tam, P.; Simeoni, J.; Flori, E.; Nihoul-Fekete, C.; Munnich, A.; Lyonnet, S.: Heterozygous endothelin receptor B (EDNRB) mutations in isolated Hirschsprung disease. Hum. Molec. Genet. 5:355-357,1996.

Arai, H.; Nakao, K.; Takaya, K.; Hosoda, K.; Ogawa, Y.; Nakanishi, S.; Imura, H.: The human endothelin-B receptor gene: structural organization and chromosomal assignment. J. Biol. Chem. 268:3463-3470, 1993.

Attie, T.; Till, M.; Pelet, A.; Amiel, J.; Edery, P.; Boutrand, L.; Munnich, A.; Lyonnet, S.: Mutation of the endothelin-receptor B gene in Waardenburg-Hirschsprung disease. Hum. Molec. Genet. 4:2407-2409, 1995.

Auricchio, A.; Griseri, P.; Carpentieri, M. L.; Betsos, N.; Staiano, A.; Tozzi, A.; Priolo, M.; Thompson, H.; Bocciardi, R.; Romeo, G.; Ballabio, A.; Ceccherini, I.: Double heterozygosity for a RET substitution inferring with splicing and an EDNRB missense mutation in Hirschsprung disease. (Letter) Am. J. Hum. Genet. 64:1216-1221, 1999.

Carrasquillo, M. M.; McCallion, A. S.; Puffenberger, E. G.; Kashuk, C. S.; Nouri, N.; Chakravarti, A.: Genome-wide association study and mouse model identify interaction between RET and EDNRB pathways in Hirschsprung disease. Nature Genet. 32:237-244, 2002.

Ceccherini, I.; Zhang, A. L.; Matera, I.; Yang, G.; Devoto, M.; Romeo, G.; Cass, D. T.: Interstitial deletion of the endothelin-B receptor gene in the spotting lethal (sl) rat. Hum. Molec. Genet. 4:2089-2096, 1995.

Chakravarti, A.: Endothelin receptor-mediated signaling in Hirschsprung disease. Hum. Molec. Genet. 5:303-307, 1996.

Elshourbagy, N. A.; Adamou, J. E.; Gagnon. A. W.; Wu, H.-L.; Pullen, M.; Nambi, P.: Molecular characterization of a novel human endothelin receptor splice variant. J. Biol. Chem. 271:25300-25307, 1996.

Gariepy, C. E.; Cass, D. T.; Yanagisawa, M.: Null mutation of endothelin receptor type B gene in spotting lethal rats causes a ganglionic megacolon and white coat color. Proc. Nat. Acad. Sci. 93:867-872,1996.

Gariepy, C. E.; Ohuchi, T.; Williams, S. C.; Richardson, J. A.; Yanagisawa, M.: Salt-sensitive hypertension in endothelin-B receptor-deficient rats. J. Clin. Invest. 105:925-933, 2000.

Gariepy, C. E.; Williams, S. C.; Richardson, J. A.; Hammer, R. E.; Yanagisawa, M.: Transgenic expression of the endothelin-B receptor prevents congenital intestinal aganglionosis in a rat model of Hirschsprung disease. J. Clin. Invest. 102: 1092-1101, 1998.

Gross, A.; Kunze, J.; Maier, R. F.; Stoltenburg-Didinger, G.; Grimmer, I.; Obladen, M.: Autosomal-recessive neural crest syndrome with albinism, black lock, cell migration disorder of the neurocytes of the gut, and deafness: ABCD syndrome. Am. J. Med. Genet. 56:322-326, 1995.

Hofstra, R. M. W.; Osinga, J.; Buys, C. H. C. M.: Mutations in Hirschsprung disease: when does a mutation contribute to the phenotype? Europ. J. Hum. Genet. 5:180-185, 1997.

Hosoda, K.; Hammer, R. E.; Richardson, J. A.; Baynash, A. G.; Cheung, J. C.; Giaid, A.; Yanagisawa, M.: Targeted and natural (piebald-lethal) mutations of endothelin-B receptor gene produce megacolon associated with spotted coat color in mice. Cell 79:1267-1276, 1994.

Charlton, P.; Guida, L.; Copeland, N.; Jenkins, N.; Munroe, D.; Greenberg, F.; Fiedorek, F. T.; Nicholls, R. D.: Genetic approach to function of the neuropeptide galanin. (Abstract) Am. J. Hum. Genet. 53 (suppl.): A1137, 1993.

Evans, H.; Baumgartner, M.; Shine, J.; Herzog, H.: Genomic organization and localization of the gene encoding human preprogalanin. Genomics 18:473-477, 1993.

Evans, H. F.; Shine, J.: Human galanin: molecular cloning reveals a unique structure. Endocrinology 129:1682-1684, 1991.

Harris, G. W.: Neural control of the pituitary gland. Physiol. Rev. 28:139-179, 1948.

Holmes, F. E.; Mahoney, S.; King, V. R.; Bacon, A.; Kerr, N. C. H.; Pachnis, V.; Curtis, R.; Priestley, J. V.; Wynick, D.: Targeted disruption of the galanin gene reduces the number of sensory neurons and their regenerative capacity. Proc. Nat. Acad. Sci. 97:11563-11568,2000.

Lopez, F. J.; Merchenthaler, I.; Ching, M.; Wisniewski, M. G.; Negro-Vilar, A.: Galanin: a hypothalamic-hypophysiotropic hormone modulating reproductive functions. Proc. Nat. Acad. Sci. 88:4508-4512,1991.

Lundkvist, J.; Land, T.; Kahl, U.; Bedecs, K.; Bartfai, T.: cDNA sequence, ligand binding, and regulation of galanin/GMAP in mouse brain. Neurosci. Lett. 200:121-124, 1995.

O'Meara, G.; Coumis, U.; Ma, S. Y.; Kehr, J.; Mahoney, S.; Bacon, A.; Allen, S. J.; Holmes, F.; Kahl, U.; Wang, F. H.; Kearns, I. R.; Ove-Ogren, S.; Dawbarn, D.; Mufson, E. J.; Davies, C.; Dawson, G.; Wynick, D.: Galanin regulates the postnatal survival of a subset of basal forebrain cholinergic neurons. Proc. Nat. Acad. Sci. 97:11569-11574, 2000.

Rattan, S.: Role of galanin in the gut. Gastroenterology 100:1762-1768, 1991.

Schmidt, W. E.; Kratzin, H.; Eckart, K.; Drevs, D.; Mundkowski, G.; Clemens, A.; Katsoulis, S.; Schafer, H.; Gallwitz, B.; Creutzfeldt, W.: Isolation and primary structure of pituitary human galanin, a 30-residue nonamidated neuropeptide. Proc. Nat. Acad. Sci. 88:11435-11439,1991.

Steiner, R. A.; Hohmann, J. G.; Holmes, A.; Wrenn, C. C.; Cadd, G.; Jureus, A.; Clifton, D. K.; Luo, M.; Gutshall, M.; Ma, S. Y.; Mufson, E. J.; Crawley, J. N.: Galanin transgenic mice display cognitive and neurochemical deficits characteristic of Alzheimer's disease. Proc. Nat. Acad. Sci. 98:4184-4189, 2001.

Wynick, D.; Small, C. J.; Bacon, A.; Holmes, F. E.; Norman, M.; Ormandy, C. J.; Kilic, E.; Kerr, N. C. H.; Ghatei, M.; Talamantes, F.; Bloom, S. R.; Pachnis, V.: Galanin regulates prolactin release and lactotroph proliferation. Proc. Nat. Acad. Sci. 95:12671-12676,1998.

Puech, A.; Saint-Jore, B.; Funke, B.; Gilbert, D. J.; Sirotkin, H.; Copeland, N. G.; Jenkins, N. A.; Kucherlapati, R.; Morrow, B.; Skoultchi, A. I.: Comparative mapping of the human 22q11 chromosomal region and the orthologous region in mice reveals complex changes in gene organization. Proc. Nat. Acad. Sci. 94:14608-14613, 1997.

Lewis, J.; Dickson, D. W.; Lin, W.-L.; Chisholm, L.; Corral, A.; Jones, G.; Yen, S.-H.; Sahara, N.; Skipper, L.; Yager, D.; Eckman, C.; Hardy, J.; Hutton, M.; McGowan, E.: Enhanced neurofibrillary degeneration in transgenic mice expressing mutant tau and APP. Science 293:1487-1491, 2001.

Denker, S. P.; Huang, D. C.; Orlowski, J.; Furthmayr, H.; Barber, D. L.: Direct binding of the Na-H exchanger NHE1 to ERM proteins regulates the cortical cytoskeleton and cell shape independently of H(+) translocation. Molec. Cell 6:1425-1436, 2000.

Dudley, C. R. K.; Giuffra, L. A.; Tippett, P.; Kidd, K. K.; Reeders, S. T.: The Na+/H+ antiporter: a 'melt' polymorphism allows regional mapping to the short arm of chromosome 1. Hum. Genet. 86:79-83,1990.

Franchi, A.; Perucca-Lostanlen, D.; Pouyssegur, J.: Functional expression of a human Na+/H+ antiporter gene transfected into antiporter-deficient mouse L cells. Proc. Nat. Acad. Sci. 83:9388-9392, 1986.

Lifton, R. P.; Sardet, C.; Pouyssegur, J.; Lalouel, J.-M.: Cloning of the human genomic amiloride-sensitive Na+/H+ antiporter gene, identification of genetic polymorphisms, and localization on the genetic map of chromosome 1p. Genomics 7:131-135, 1990.

Mattei, M.-G.; Galloni, M.; Sardet, C.; Franchi, A.; Counillon, L.; Passage, E.; Pouyssegur, J.: Localization of the antiporter gene (APNH) and chromosomal homology between human 1p, mouse 4 and Chinese hamster 2q. (Abstract) Cytogenet. Cell Genet. 51:1041, 1989.

Mattei, M.-G.; Sardet, C.; Franchi, A.; Pouyssegur, J.: Chromosomal mapping of the amiloride-sensitive Na+/H+ antiporter gene. (Abstract) Cytogenet. Cell Genet. 46:658-659, 1987.

Mattei, M.-G.; Sardet, C.; Franchi, A.; Pouyssegur, J.: The human amiloride-sensitive Na+/H+ antiporter: localization to chromosome 1 by in situ hybridization. Cytogenet. Cell Genet. 48:6-8, 1988.

Mendoza, S. A.: The Na+/H+ antiport is a mediator of cell proliferation. Acta Paediat. Scand. 76:545-547, 1987.

Morahan, G.; Rakar, S.: Localization of the mouse Na+/H+ exchanger gene on distal chromosome 4. Genomics 15:231-232, 1993.

Sardet, C.; Franchi, A.; Pouyssegur, J.: Molecular cloning, primary structure, and expression of the human growth factor-activatable Na (+)/H(+) antiporter. Cell 56:271-280, 1989.

Jacobs, P. A.; Brunton, M.; Frackiewicz, A.; Newton, M.; Cook, P. J. L.; Robson, E. B.: Studies on a family with three cytogenetic markers. Ann. Hum. Genet. 33:325-336, 1970.

Brown, A.; Bernier, G.; Mathieu, M.; Rossant, J.; Kothary, R.:The mouse dystonia musculorum gene is a neural isoform of bullous pemphigoid antigen 1. Nature Genet. 10:301-306, 1995.

Brown, A.; Dalpe, G.; Mathieu, M.; Kothary, R.: Cloning and characterization of the neural isoforms of human dystonin. Genomics 29:777-780,1995.

Copeland, N. G.; Gilbert, D. J.; Li, K.; Sawamura, D.; Giudice, G. J.; Chu, M.-L.; Jenkins, N. A.; Uitto, J.: Chromosomal localization of mouse bullous pemphigoid antigens, BPAG1 and BPAG2: identification of a new region of homology between mouse and human chromosomes. Genomics 15:180-181, 1993.

Diaz, L. A.; Ratrie, H., III; Saunders, W. S.; Futamura, S.; Squiquera, H. L.; Anhalt, G. J.; Giudice, G. J.: Isolation of a human epidermal cDNA corresponding to the 180-kD autoantigen recognized by bullous pemphigoid and herpes gestation is sera: immunolocalization of this protein to the hemidesmosome. J. Clin. Invest. 86:1088-1094, 1990.

Guo, L.; Degenstein, L.; Dowling, J.; Yu, Q.-C.; Wollmann, R.; Perman, B.; Fuchs, E.: Gene targeting of BPAG1: abnormalities in mechanical strength and cell migration in stratified epithelia and neurologic degeneration. Cell 81:233-243, 1995.

Minoshima, S.; Amagai, M.; Kudoh, J.; Fukuyama, R.; Hashimoto, T.; Nishikawa, T.; Shimizu, N.: Localization of the human gene for 230-kDa bullous pemphigoid autoantigen to the pter-q15 region of chromosome 6. (Abstract) Cytogenet. Cell Genet. 58:1914-1915, 1991.

Minoshima, S.; Amagai, M.; Kudoh, J.; Fukuyama, R.; Hashimoto, T.; Nishikawa, T.; Shimizu, N.: Localization of the human gene for 230-kDal bullous pemphigoid autoantigen (BPAG1) to chromosome 6pter-q15. Cytogenet. Cell Genet. 57:30-32, 1991.

Ryynanen, M.; Knowlton, R. G.; Kero, M.; Sawamura, D.; Li, K.; Giudice, G. J.; Diaz, L. A.; Uitto, J.: Bullous pemphigoid antigens (BPAGs): identification of RFLPs in human BPAG1 and BPAG2, and exclusion as candidate genes in a large kindred with dominant epidermolysis bullosa simplex. Genomics 11:1025-1029, 1991.

Sawamura, D.; Nomura, K.; Sugita, Y.; Mattei, M.-G.; Chu, M.-L.; Knowlton, R.; Uitto, J.: Bullous pemphigoid antigen (BPAG1): cDNA cloning and mapping of the gene to the short arm of human chromosome 6. Genomics 8:722-726, 1990.

Stanley, J. R.; Tanaka, T.; Mueller, S.; Klaus-Kovtun, V.; Roop, D.: Isolation of complementary DNA for bullous pemphigoid antigen by use of patients' autoantibodies. J. Clin. Invest. 82:1864-1870,1988.

Tamai, K.; Sawamura, D.; Do, H. C.; Tamai, Y.; Li, K.; Uitto, J.: The human 230-kD bullous pemphigoid antigen gene (BPAG1): exon-intron organization and identification of regulatory tissue specific elements in the promoter region. J. Clin. Invest. 92:814-822, 1993.

Yang, Y.; Bauer, C.; Strasser, G.; Wollman, R.; Julien, J.-P.; Fuchs, E.: Integrators of the cytoskeleton that stabilize microtubules. Cell 98:229-238, 1999.

Montgomery, J. C.; Shows, T. B.; Venta, P. J.; Tashian, R. E.:Gene for novel human carbonic anhydrase (CA) isozyme on chromosome 16 is unlinked to the CA1/CA2/CA3 gene cluster. (Abstract) Am. J. Hum. Genet. 41: A229 only, 1987.

Montgomery, J. C.; Venta, P. J.; Eddy, R. L.; Fukushima, Y.-S.; Shows, T. B.; Tashian, R. E.: Characterization of the human gene for a newly discovered carbonic anhydrase, CA VII, and its localization to chromosome 16. Genomics 11:835-848, 1991.

Venta, P. J.; Montgomery, J. C.; Tashian, R. E.: Molecular genetics of carbonic anhydrase isozymes. Isozymes: Curr. Top. Biol. Med. Res. 14:59-72, 1987.

Kere, J.; Ruutu, T.; Davies, K. A.; Roninson, I. B.; Watkins, P. C.; Winqvist, R.; de la Chapelle, A.: Chromosome 7 long arm deletion in myeloid disorders: a narrow breakpoint region in 7q22 defined by molecular mapping. Blood 73:230-234, 1989.

Neufeld, E. J.: Personal Communication. Boston, Mass. Feb. 21, 1995.

Neufeld, E. J.; Skalnik, D. G.; Lievens, P. M.-J.; Orkin, S. H.: Human CCAAT displacement protein is homologous to the Drosophila homeoprotein, cut. Nature Genet. 1:50-55, 1992.

Scherer, S. W.; Neufeld, E. J.; Lievens, P. M.-J.; Orkin, S. H.; Kim, J.; Tsui, L.-C.: Regional localization of the CCAAT displacement protein gene (CUTL1) to 7q22 by analysis of somatic cell hybrids. Genomics 15:695-696, 1993.

Snyder, S. R.; Wang, J.; Waring, J. F.; Ginder, G. D.: Identification of CCAAT displacement protein (CDP/cut) as a locus-specific repressor of major histocompatibility complex gene expression in human tumor cells. J. Biol. Chem. 276: 5323-5330, 2001.

Zeng, W. R.; Scherer, S. W.; Koutsilieris, M.; Huizenga, J. J.; Filteau, F.; Tsui, L.-C.; Nepveu, A.: Loss of heterozygosity and reduced expression of the CUTL1 gene in uterine leiomyomas. Oncogene 14:2355-2365, 1997.

Presley, J. F.; Ward, T. H.; Pfeifer, A. C.; Siggia, E. D.; Phair, R. D.; Lippincott-Schwartz, J.: Dissection of COPI and Arf1 dynamics in vivo and role in Golgi membrane transport. Nature 417:187-193,2002.

Chang, C.-Y.; Wu, D.-A.; Lai, C.-C.; Miller, W. L.; Chung, B.-C.: Cloning and structure of the human adrenodoxin gene. DNA 7:609-615,1988.

Chang, C.-Y.; Wu, D.-A.; Mohandas, T. K.; Chung, B.-C.: Structure, sequence, chromosomal location, and evolution of the human ferredoxin gene family. DNA Cell Biol. 9:205-212, 1990.

Frade, R.; Balbo, M.; Barel, M.: RB18A, whose gene is localized on chromosome 17q12-q21.1, regulates in vivo p53 transactivating activity. CancerRes. 60:6585-6589, 2000.

Wolffe, A. P.: Transcriptional control: sinful repression. Nature 387:16-17, 1997.

Wu, L.; Aster, J. C.; Blacklow, S. C.; Lake, R.; Artavanis-Tsakonas, S.; Griffin, J. D.: MAML1, a human homologue of Drosophila mastermind, is a transcriptional co-activator for NOTCH receptors. Nature Genet. 26:484-489, 2000.

Inohara, N.; Koseki, T.; del Peso, L.; Hu, Y.; Yee, C.; Chen, S.; Carrio, R.; Merino, J.; Liu, D.; Ni, J.; Nunez, G.: Nod1, an Apaf-1-like activator of caspase-9 and nuclear factor-kappa-B. J. Biol. Chem. 274:14560-14567, 1999.

Weng, Z.; Fluckiger, A.-C.; Nisitani, S.; Wahl, M. I.; Le, L. Q.; Hunter, C. A.; Fernal, A. A.; le Beau, M. M.; Witte, O. N.: A DNA damage and stress inducible G protein-coupled receptor blocks cells in G2/M. Proc. Nat. Acad. Sci. 95:12334-12339, 1998.

Charroux, B.; Pellizzoni, L.; Perkinson, R. A.; Shevchenko, A.; Mann, M.; Dreyfuss, G.: Gemin3: a novel DEAD box protein that interacts with SMN, the spinal muscular atrophy gene product, and is a component of gems. J. Cell Biol. 147:1181-1193, 1999.

Grundhoff, A. T.; Kremmer, E.; Tureci, O.; Glieden, A.; Gindorf, C.; Atz, J.; Mueller-Lantzsch, N.; Schubach, W. H.; Grasser, F. A.: Characterization of DP103, a novel DEAD box protein that binds to the Epstein-Barr virus nuclear proteins EBNA2 and EBNA3C. J. Biol. Chem. 274:19136-19144, 1999.

Levy, C.; Nechushtan, H.; Razin, E.: A new role for the STAT3 inhibitor, PIAS3: a repressor of microphthalmia transcription factor. J. Biol. Chem. 277:1962-1966, 2002.

Ueki, N.; Seki, N.; Yano, K.; Saito, T.; Masuho, Y.; Muramatsu, M.: Isolation and chromosomal assignment of a human gene endoding protein inhibitor of activated STAT3 (PIAS3). J. Hum. Genet. 44:193-196, 1999.

Pasteris, N. G.; Trask, B. J.; Sheldon, S.; Gorski, J. L.: Discordant phenotype of two overlapping deletions involving the PAX3 gene in chromosome 2q35. Hum. Molec. Genet. 2:953-959, 1993.

Beeson, D.; Brydson, M.; Betty, M.; Jeremiah, S.; Povey, S.; Vincent, A.; Newsom-Davis, J.: Primary structure of the human muscle acetylcholine receptor cDNA cloning of the gamma and epsilon subunits. Europ. J. Biochem. 215:229-238, 1993.

Ohno, K.; Hutchinson, D. O.; Milone, M.; Brengman, J. M.; Bouzat, C.; Sine, S. M.; Engel, A. G.: Congenital myasthenic syndrome caused by prolonged acetylcholine receptor channel openings due to a mutation in the M2 domain of the epsilon subunit. Proc. Nat. Acad. Sci. 92:758-762, 1995.

Ohno, K.; Quiram, P. A.; Milone, M.; Wang, H.-L.; Harper, M. C.; Pruitt, J. N., II; Brengman, J. M.; Pao, L.; Fischbeck, K. H.; Crawford, T. O.; Sine, S. M.; Engel, A. G.: Congenital myasthenic syndromes due to heteroallelic nonsense/missense mutations in the acetylcholine receptor epsilon subunit gene: identification and functional characterization of six new mutations. Hum. Molec. Genet. 6:753-766, 1997.

Ohno, K.; Wang, H.-L.; Milone, M.; Bren, N.; Brengman, J. M.; Nakano, S.; Quiram, P.; Pruitt, J. N.; Sine, S. M.; Engel, A. G.: congenital myasthenic syndrome caused by decreased agonist binding affinity due to a mutation in the acetylcholine receptor epsilon subunit. Neuron 17:157-170, 1996.

Sieb, J. P.; Dorfler, P.; Tzartos, S.; Wewer, U. M.; Ruegg, M. A.; Meyer, D.; Baumann, I.; Lindemuth, R.; Jakschik, J.; Ries, F.: Congenital myasthenic syndromes in two kinships with end-plate acetylcholine receptor and utrophin deficiency. Neurology 50:54-61, 1998.

Sieb, J. P.; Kraner, S.; Rauch, M.; Steinlein, O. K.: Immature end-plates and utrophin deficiency in congenital myasthenic syndrome caused by epsilon-AChR subunit truncating mutations. Hum. Genet. 107:160-164, 2000.

Witzemann, V.; Schwarz, H.; Koenen, M.; Berberich, C.; Villarroel, A.; Wernig, A.; Brenner, H. R.; Sakmann, B.: Acetylcholine receptor epsilon-subunit deletion causes muscle weakness and atrophy in juvenile and adult mice. Proc. Nat. Acad. Sci. 93:13286-13291, 1996.

Bartels, C. F.; Zelinski, T.; Lockridge, O.: Mutation at codon 322 in the human acetylcholinesterase (ACHE) gene accounts for YT blood group polymorphism. Am. J. Hum. Genet. 52:928-936, 1993.

Coates, P. M.; Simpson, N. E.: Genetic variation in human erythrocyte acetylcholinesterase. Science 175:1466-1467, 1972.

Ehrlich, G.; Viegas-Pequignot, E.; Ginzberg, D.; Sindel, L.; Soreq, H.; Zakut, H.: Mapping the human acetylcholinesterase gene to chromosome 7q22 by fluorescent in situ hybridization coupled with selective PCR amplification from a somatic hybrid cell panel and chromosome-sorted DNA libraries. Genomics 13:1192-1197, 1992.

Feng, G.; Krejci, E.; Molgo, J.; Cunningham, J. M.; Massoulie, J.; Sanes, J. R.: Genetic analysis of collagen Q: roles in acetylcholinesterase and butyrylcholinesterase assembly and in synaptic structure and function. J. Cell Biol. 144:1349-1360, 1999.

Getman, D. K.; Eubanks, J. H.; Camp, S.; Evans, G. A.; Taylor, P.: The human gene encoding acetylcholinesterase is located on the long arm of chromosome 7. Am. J. Hum. Genet. 51:170-177, 1992.

Lapidot-Lifson, Y.; Prody, C. A.; Ginzberg, D.; Meytes, D.; Zakut, H.; Soreq, H.: Coamplification of human acetylcholinesterase and butyrylcholinesterase genes in blood cells: correlation with various leukemias and abnormal megakaryocytopoiesis. Proc. Nat. Acad. Sci. 86:4715-4719, 1989.

Meshorer, E.; Erb, C.; Gazit, R.; Pavlovsky, L.; Kaufer, D.; Friedman, A.; Glick, D.; Ben-Arie, N.; Soreq, H.: Alternative splicing and neuritic mRNA translocation under long-term neuronal hypersensitivity. Science 295:508-512, 2002.

Rachinsky, T. L.; Crenshaw, E. B., III; Taylor, P.: Assignment of the gene for acetylcholinesterase to distal mouse chromosome 5. Genomics 14:511-514, 1992.

Rotundo, R. L.; Gomez, A. M.; Fernandez-Valle, C.; Randall, W. R.: Allelic variants of acetylcholinesterase: genetic evidence that all acetylcholinesterase forms in avian nerves and muscles are encoded by a single gene. Proc. Nat. Acad. Sci. 85:7805-7809, 1988.

Shapira, M.; Tur-Kaspa, I.; Bosgraaf, L.; Livni, N.; Grant, A. D.; Grisaru, D.; Korner, M.; Ebstein, R. P.; Soreq, H.: A transcription-activating polymorphism in the ACHE promoter associated with acute sensitivity to anti-acetylcholinesterases. Hum. Molec. Genet. 9:1273-1281,2000.

Al-Awqati, Q.; Preisig, P. A.: Size does matter: will knockout of p21(WAF1/CIP1) save the kidney by limiting compensatory renal growth ?(Commentary) Proc. Nat. Acad. Sci. 96:10551-10553, 1999.

Chedid, M.; Michieli, P.; Lengel, C.; Huppi, K.; Givol, D.: A single nucleotide substitution at codon 31 (ser/arg) defines a polymorphism in a highly conserved region of the p53-inducible gene WAF1/CIP1. Oncogene 9:3021-3024, 1994.

Cheng, T.; Rodrigues, N.; Shen, H.; Yang, Y.; Dombkowski, D.; Sykes, M.; Scadden, D. T.: Hematopoietic stem cell quiescence maintained by p21(cip1/waf1). Science 287: 1804-1808, 2000.

Harper, J. W.; Adami, G. R.; Wei, N.; Keyomarsi, K.; Elledge, S. J.: The p21 Cdk-interacting protein Cip1 is a potent inhibitor of G1 cyclin-dependent kinases. Cell 75:805-816, 1993.

Huppi, K.; Siwarski, D.; Dosik, J.; Michieli, P.; Chedid, M.; Reed, S.; Mock, B.; Givol, D.; Mushinski, J. F.: Molecular cloning, sequencing, chromosomal localization and expression of mouse p21 (Waf1). Oncogene 9:3017-3020, 1994.

Megyesi, J.; Price, P. M.; Tamayo, E.; Safirstein, R. L.: The lack of a functional p21(WAF1/CIP1) gene ameliorates progression to chronic renal failure. Proc. Nat. Acad. Sci. 96:10830-10835, 1999.

Mousses, S.; Ozcelik, H.; Lee, P. D.; Malkin, D.; Bull, S. B.; Andrulis, I. L.: Two variants of the CIP1/WAF1 gene occur together and are associated with human cancer. Hum. Molec. Genet. 4:1089-1092,1995.

Iwata, N.; Tsubuki, S.; Takaki, Y.; Shirotani, K.; Lu, B.; Gerard, N. P.; Gerard, C.; Hama, E.; Lee, H.-J.; Saido, T. C.: Metabolic regulation of brain A-beta by neprilysin. Science 292:1550-1552,2001.

Lu, P.-J.; Wulf, G.; Zhou, X. Z.; Davies, P.; Lu, K. P.: The prolyl isomerase Pin1 restores the function of Alzheimer-associated phosphorylated tau protein. Nature 399:784-788, 1999.

McGeer, P. L.; McGeer, E. G.: Polymorphisms in inflammatory genes and the risk of Alzheimer disease. Arch. Neurol. 58:1790-1792,2001.

Modi, W. S.; Masuda, A.; Yamada, M.; Oppenheim, J. J.; Matsushima, K.; O'Brien, S. J.: Chromosomal localization of the human interleukin1 alpha (IL-1-alpha) gene. Genomics 2:310-314, 1988.

Mosley, B.; Urdal, D. L.; Prickett, K. S.; Larsen, A.; Cosman, D.; Conlon, P. J.; Gillis, S.; Dower, S. K.: The interleukin-1 receptor binds the human interleukin-1-alpha precursor but not the interleukin-1-betaprecursor. J. Biol. Chem. 262: 2941-2944, 1987.

Bailly, S.; di Giovine, F. S.; Blakemore, A. I. F.; Duff, G. W.: Genetic polymorphism of human interleukin-1-alpha. Europ. J. Immun. 23:1240-1245, 1993.

Boultwood, J.; Breckon, G.; Birch, D.; Cox, R.: Chromosomal localization of murine interleukin-1 alpha and beta genes. Genomics 5:481-485,1989.

Cox, A.; Camp, N. J.; Cannings, C.; di Giovine, F. S.; Dale, M.; Worthington, J.; John, S.; Ollier, W. E. R.; Silman, A. J.; Duff, G. W.: Combined sib-TDT and TDT provide evidence for linkage of the interleukin-1 gene cluster to erosive rheumatoid arthritis. Hum. Molec. Genet. 8:1707-1713, 1999.

Cox, A.; Camp, N. J.; Nicklin, M. J. H.; di Giovine, F. S.; Duff, G. W.: An analysis of linkage disequilibrium in the interleukin-1 gene cluster, using a novel grouping method for multiallelic markers. Am. J. Hum. Genet. 62:1180-1188, 1998.

Diehl, S. R.; Wang, Y.; Brooks, C. N.; Burmeister, J. A.; Califano, J. V.; Wang, S.; Schenkein, H. A.: Linkage disequilibrium of interleukin-1 genetic polymorphisms with early-onset periodontitis. J. Periodont. 70:418-430, 1999.

Du, Y.; Dodel, R. C.; Eastwood, B. J.; Bales, K. R.; Gao, F.; Lohmuller, F.; Muller, U.; Kurz, A.; Zimmer, R.; Evans, R. M.; Hake, A.; Gasser, T.; Oertel, W. H.; Griffin, W. S. T.; Paul, S. M.; Farlow, M. R.:Association of an interleukin 1-alpha polymorphism with Alzheimer's disease. Neurology 55:480-484, 2000.

Furutani, Y.; Notake, M.; Fukui, T.; Ohue, M.; Nomura, H.; Yamada, M.; Nakamura, S.: Complete nucleotide sequence of the gene for human interleukin 1 alpha. Nucleic Acids Res. 14:3167-3179, 1986.

Gray, P. W.; Glaister, D.; Chen, E.; Goeddel, D. V.; Pennica, D.: Two interleukin 1 genes in the mouse: cloning and expression of the cDNA for murine interleukin 1-beta. J. Immun. 137:3644-3648,1986.

Grimaldi, L. M. E.; Casadei, V. M.; Ferri, C.; Veglia, F.; Licastro, F.; Annoni, G.; Biunno, I.; De Bellis, G.; Sorbi, S.; Mariani, C.; Canal, N.; Griffin, W. S. T.: Association of early-onset Alzheimer's disease with an interleukin-1-alpha gene polymorphism. Ann. Neurol. 47:361-365, 2000.

Hogquist, K. A.; Nett, M. A.; Unanue, E. R.; Chaplin, D. D.:Interleukin 1 is processed and released during apoptosis. Proc. Nat. Acad. Sci. 88:8485-8489, 1991.

Hurwitz, A.; Loukides, J.; Ricciarelli, E.; Botero, L.; Katz, E.; McAllister, J. M.; Garcia, J. E.; Rohan, R.; Adashi, E. Y.; Hernandez, E. R.: Human intraovarian interleukin-1 (IL-1) system: highly compartmentalized and hormonally dependent regulation of the genes encoding IL-1, its receptor, and its receptor antagonist. J. Clin. Invest. 89:1746-1754,1992.

Ki, C.-S.; Na, D. L.; Kim, D. K.; Kim, H. J.; Kim, J.-W.: Lack of association of the interleukin-1-alpha gene polymorphism with Alzheimer's disease in a Korean population. (Letter) Ann. Neurol. 49:817-818,2001.

Kolsch, H.; Ptok, U.; Bagli, M.; Papassotiropoulos, A.; Schmitz, S.; Barkow, K.; Kockler, M.; Rao, M. L.; Maier, W.; Heun, R.: Gene polymorphisms of interleukin-1-alpha influence the course of Alzheimer's disease. (Letter) Ann. Neurol. 49:818-819, 2001.

Kornman, K. S.; Crane, A.; Wang, H.-Y.; di Giovine, F. S.; Newman, M. G.; Pirk, F. W.; Wilson, T. G., Jr.; Higginbottom, F. L.; Duff, G. W.: The interleukin-1 genotype as a severity factor in adult periodontal disease. J. Clin. Periodont. 24:72-77, 1997.

Lafage, M.; Maroc, N.; Dubreuil, P.; de Waal Malefijt, R.; Pebusque, M.-J.; Carcassonne, Y.; Mannoni, P.: The human interleukin-1-alpha gene is located on the long arm of chromosome 2 at band q13. Blood 73:104-107, 1989.

Lord, P. C. W.; Wilmoth, L. M. G.; Mizel, S. B.; McCall, C. E.: Expression of interleukin-1 alpha and beta genes by human blood polymorphonuclear leukocytes. J. Clin. Invest. 87:1312-1321, 1991.

Murphy, G. M., Jr.; Claassen, J. D.; DeVoss, J. J.; Pascoe, N.; Taylor, J.; Tinklenberg, J. R.; Yesavage, J. A.: Rate of cognitive decline in AD is accelerated by the interleukin-1-alpha -889 *1 allele. Neurology 56:1595-1597, 2001.

Stamey, T. A.; Yang, N.; Hay, A. R.; McNeal, J. E.; Freiha, F. S.; Redwine, E.: Prostate-specific antigen as a serum marker for adenocarcinoma of the prostate. New Eng. J. Med. 317:909-916, 1987.

Stamatoyannopoulos, G.; Chen, S.-H.; Fukui, M.: Liver alcohol dehydrogenase in Japanese: high population frequency of a typical form and its possible role in alcohol sensitivity. Am. J. Hum. Genet. 27:789-796, 1975.

Chen, C.-C.; Lu, R.-B.; Chen, Y.-C.; Wang, M.-F.; Chang, Y.-C.; Li, T.-K.; Yin, S.-J.: Interaction between the functional polymorphisms of the alcohol-metabolism genes in protection against alcoholism. Am. J. Hum. Genet. 65:795-807, 1999.

Goedde, H. W.; Agarwal, D. P.; Fritze, G.; Meier-Tackmann, D.; Singh, S.; Beckmann, G.; Bhatia, K.; Chen, L. Z.; Fang, B.; Lisker, R.; Paik, Y. K.; Rothhammer, F.; Saha, N.; Segal, B.; Srivastava, L. M.; Czeizel, A.: Distribution of ADH-2 and ALDH2 genotypes in different populations. Hum. Genet. 88:344-346, 1992.

Seldin, M. F.: Personal Communication. Durham, N. C. Sep. 19, 1990.

Sherman, L.; Wainwright, D.; Ponta, H.; Herrlich, P.: A splice variant of CD44 expressed in the apical ectodermal ridge presents fibroblast growth factors to limb mesenchyme and is required for limb outgrowth. Genes Dev. 12:1058-1071, 1998.

Stefanova, I.; Hilgert, I.; Bazil, V.; Kristofova, H.; Horejsi, V.: Human leucocyte surface glycoprotein CDw44 and lymphocyte homing receptor are identical molecules. Immunogenetics 29:402-404, 1989.

Teder, P.; Vandivier, R. W.; Jiang, D.; Liang, J.; Cohn, L.; Pure, E.; Henson, P. M.; Noble, P. W.: Resolution of lung inflammation by CD44. Science 296:155-158, 2002.

Telen, M. J.: Personal Communication. Durham, N. C. Dec. 30, 1992.

Telen, M. J.; Eisenbarth, G. S.; Haynes, B. F.: Human erythrocyte antigens: regulation of expression of a novel erythrocyte surface antigen by the inhibitor Lutheran In (Lu) gene. J. Clin. Invest. 71:1878-1886, 1983.

Mallinson, G.; Soo, K. S.; Schall, T. J.; Pisacka, M.; Anstee, D. J.: Mutations in the erythrocyte chemokine receptor (Duffy) gene:the molecular basis of the Fy (a)/Fy (b) antigens and identification of a deletion in the Duffy gene of an apparently healthy individual with the Fy (a-b-) phenotype. Brit. J. Haemat. 90:823-829, 1995.

Miller, L. H.; Mason, S. J.; Clyde, D. F.; McGinnis, M. H.: The resistance factor to Plasmodium vivax in blacks: the Duffy blood group genotype, FyFy. New Eng. J. Med. 295:302-304, 1976.

Miller, L. H.; Mason, S. J.; Dvorak, J. A.: Erythrocyte receptors of Plasmodium knowlesi malaria: Duffy blood group determinants. Science 189:561-562, 1975.

Nance, W. E.; Conneally, M.; Kang, K. W.; Reed, T. E.; Schroder, J.; Rose, S.: Genetic linkage analysis of human hemoglobin variants. Am. J. Hum. Genet. 22:453-459, 1970.

Nichols, M. E.; Rubinstein, P.; Barnwell, J.; Rodriguez de Cordoba, S.; Rosenfield, R. E.: A new human duffy blood group specificity defined by a murine monoclonal antibody: immunogenetics and association with susceptibility to Plasmodium vivax. J. Exp. Med. 166:776-785,1987.

Olsson, M. L.; Smythe, J. S.; Hansson, C.; Poole, J.; Mallinson, G.; Jones, J.; Avent, N. D.; Daniels, G.: The Fy (x) phenotype is associated with a missense mutation in the Fy (b) allele predicting Arg89Cys in the Duffy glycoprotein. Brit. J. Haemat. 103:1184-1191,1998.

Palmer, C. G.; Christian, J. C.; Merritt, A. D.: Partial trisomy 1 due to a 'shift' and probable location of the Duffy (Fy) locus. Am. J. Hum. Genet. 29:371-377, 1977.

Parasol, N.; Reid, M.; Rios, M.; Castilho, L.; Harari, I.; Kosower, N. S.: A novel mutation in the coding sequence of the FY*B allele of the Duffy chemokine receptor gene is associated with an altered erythrocyte phenotype. Blood 92:2237-2243, 1998.

Pasvol, G.; Wilson, R. J. M.: The interaction of malaria parasites with red blood cells. Brit. Med. Bull. 38:133-140, 1982.

Peiper, S. C.; Wang, Z.; Neote, K.; Martin, A. W.; Showell, H. J.; Conklyn, M. J.; Ogborne, K.; Hadley, T. J.; Lu, Z.; Hesselgesser, J.; Horuk, R.: The Duffy antigen/receptor for chemokines (DARC) is expressed in endothelial cells of Duffy negative individuals who lack the erythrocyte receptor. J. Exp. Med. 181:1311-1317, 1995.

Ritter, H.: Zur formalen Genetik des Duffy-systems. Untersuchungvon 247 Familien. human genetik 4:59-61, 1967.

Robson, E. B.; Cook, P. J. L.; Corney, G.; Hopkinson, D. A.; Noades, J.; Cleghorn, T. E.: Linkage data on Rh, PGM, PGD, peptidase C and Fy from family studies. Ann. Hum. Genet. 36:393-399, 1973.

Szabo, M. C.; Soo, K. S.; Zlotnik, A.; Schall, T. J.: Chemokine class differences in binding to the Duffy antigen-erythrocyte chemokine receptor. J. Biol. Chem. 270:25348-25351, 1995.

Tamasauskas, D.; Powell, V.; Saksela, K.; Yazdanbakhsh, K.: A homologous naturally occurring mutation in Duffy and CCR5 leading to reduced receptor expression. Blood 97:3651-3654, 2001.

Tang, T.; Owen, J. D.; Du, J.; Walker, C. L.; Richmond, A.: molecular cloning and characterization of a mouse gene with homology to the Duffy-antigen receptor for chemokines. DNA Seq. 9:129-143, 1999.

Tournamille, C.; Kim Le Van, C.; Gane, P.; Le Pennec, P. Y.; Roubinet, F.; Babinet, J.; Cartron, J. P.; Colin, Y.: Arg89Cys substitution results in very low membrane expression of the Duffy antigen/receptor for chemokines in Fy (x) individuals. Blood 92:2147-2156, 1998. Note: Erratum. Blood 95:2753 only, 2000.

Tournamille, C.; Le Van Kim, C.; Gane, P.; Cartron, J.-P.; Colin, Y.: Molecular basis and PCR-DNA typing of the Fya/fyb blood group polymorphism. Hum. Genet. 95:407-410, 1995.

Weitkamp, L. R.: Personal Communication. Rochester, N. Y. 1972.

Zimmerman, P. A.; Woolley, I.; Masinde, G. L.; Miller, S. M.; McNamara, D. T.; Hazlett, F.; Mgone, C. S.; Alpers, M. P.; Genton, B.; Boatin, B. A.; Kazura, J. W.: Emergence of FY*A(null) in a Plasmodiumvivax-endemic region of Papua New Guinea. Proc. Nat. Acad. Sci. 96:13973-13977, 1999.

Ichimura-Ohshima, Y.; Morii, K.; Ichimura, T.; Araki, K.; Takahashi, Y.; Isobe, T.; Minoshima, S.; Fukuyama, R.; Shimizu, N.; Kuwano, R.: cDNA cloning and chromosome assignment of the gene for human brain 14-3-3 protein eta chain. J. Neurosci. Res. 31:600-605, 1992.

Muratake, T.; Hayashi, S.; Ichikawa, T.; Kumanishi, T.; Ichimura, Y.; Kuwano, R.; Isobe, T.; Wang, Y.; Minoshima, S.; Shimizu, N.; Takahashi, Y.: Structural organization and chromosomal assignment of the human 14-3-3-eta chain gene (YWHAH). Genomics 36:63-69, 1996.

Tommerup, N.; Leffers, H.: Assignment of the human genes encoding 14-3-3 eta (YWHAH) to 22q12, 14-3-3 zeta (YWHAZ) to 2p25.1-p25.2, and 14-3-3 beta (YWHAB) to 20q13.1 by in situ hybridization. Genomics 33:149-150, 1996.

Watanabe, M.; Isobe, T.; Ichimura, T.; Kuwano, R.; Takahashi, Y.; Kondo, H.; Inoue, Y.: Molecular cloning of rat cDNAs for the zeta and theta subtypes of 14-3-3 protein and differential distributions of their mRNAs in the brain. Molec. Brain Res. 25:113-121, 1994.

Yaffe, M. B.; Rittinger, K.; Volinia, S.; Caron, P. R.; Aitken, A.; Leffers, H.; Gamblin, S. J.; Smerdon, S. J.; Cantley, L. C.:The structural basis for 14-3-3:phosphopeptide binding specificity. Cell 91:961-971, 1997.

Zupan, L. A.; Steffens, D. L.; Berry, C. A.; Landt, M.; Gross, R. W.: Cloning and expression of a human 14-3-3 protein mediating phospholipolysis. J. Biol. Chem. 267: 8707-8710, 1992.

Ben-Yosef, T.; Eden, A.; Benvenisty, N.: Characterization of murine BCAT genes: Bcat1, a c-Myc target, and its homolog, Bcat2. Mammalian Genome 9:595-597, 1998.

Benvenisty, N.; Leder, A.; Kuo, A.; Leder, P.: An embryonically expressed gene is a target for c-Myc regulation via the c-Myc-binding sequence. Genes Dev. 6:2513-2523, 1992.

Eden, A.; Simchen, G.; Benvenisty, N.: Two yeast homologs of ECA39, a target for c-Myc regulation, code for cytosolic and mitochondrial branched-chain amino acid amino transferases. J. Biol. Chem. 271:20242-20245, 1996.

Jones, C.; Moore, E. E.: Isolation of mutants lacking branched-chain amino acid transaminase. Somat. Cell Genet. 2:235-243, 1976.

Jones, C.; Moore, E. E.: Assignment of the human gene complementing the auxotrophic marker TRANS-minus (BCT1) to chromosome 12. (Abstract) Cytogenet. Cell Genet. 25:168 only, 1979.

Jones, C.; Moore, E. E.: Localization of a gene which complements branched-chain amino acid transaminase deficiency to the short arm of human chromosome 12. Hum. Genet. 66:206-211, 1984.

Naylor, S. L.; Shows, T. B.: Branched-chain aminotransferase genes (BCT-1 and BCT-2) assigned to human chromosomes 12 and 19 using alpha-keto acid selection media. (Abstract) Cytogenet. Cell Genet. 25:191-192,1979.

Naylor, S. L.; Shows, T. B.: Branched-chain aminotransferase deficiency in Chinese hamster cells complemented by two independent genes on human chromosomes 12 and 19. Somat. Cell Genet. 6:641-652, 1980.

Schuldiner, O.; Eden, A.; Ben-Yosef, T.; Yanuka, O.; Simchen, G.; Benvenisty, N.: ECA39, a conserved gene regulated by c-Myc in mice, is involved in G1/S cell cycle regulation in yeast. Proc. Nat. Acad. Sci. 93:7143-7148, 1996.

Tanaka, K.; Rosenberg, L. E.: Disorders of branched chain amino acid and organic acid metabolism. In: Stanbury, J. B.; Wyngaarden, J. B.; Fredrickson, D. S.; Goldstein, J. L.; Brown, M. S.: The Metabolic Basis of Inherited Disease. New York: McGraw-Hill (pub.) (5thed.):1983. Pp. 450-451.

Cattanach, B. M.; Barr, J. A.; Evans, E. P.; Burtenshaw, M.; Beechey, C. V.; Leff, S. E.; Brannan, C. I.; Copeland, N. G.; Jenkins, N. A.; Jones, J.: A candidate mouse model for Prader-Willi syndrome which shows an absence of Snrpn expression. Nature Genet. 2:270-274,1992.

Telen, M. J.; Palker, T. J.; Haynes, B. F.: Human erythrocyte antigens: II. The In (Lu) gene regulates expression of an antigen on an 80-kilodalton protein of human erythrocytes. Blood 64:599-606,1984.

Accolla, R. S.; Gross, N.; Carrel, S.; Corte, G.: Distinct forms of both alpha and beta subunits are present in the human Ia molecular pool. Proc. Nat. Acad. Sci. 78:4549-4551, 1981.

Kingsmore, S. F.; Snoddy, J.; Choubey, D.; Lengyel, P.; Seldin, M. F.: Physical mapping of a family of interferon-activated genes, serum amyloid P-component, and alpha-spectrin on mouse chromosome 1. Immunogenetics 30:169-174, 1989.

Thomas, K. R.; Folger, K. R.; Capecchi, M. R.:Cell 44:419-428,1986.

Guillon, H.; de Massy, B.: An initiation site for meiotic crossing-over and gene conversion in the mouse. Nature Genet. 32:296-299, 2002.

Irsch, J.; Nitsch, S.; Hansmann, M.-L.; Rajewsky, K.; Tesch, H.; Diehl, V.; Jox, A.; Kuppers, R.; Radbruch, A.: Isolation of viable Hodgkin and Reed-Sternberg cells from Hodgkin disease tissues. Proc. Nat. Acad. Sci. 95:10117-10122, 1998.

Hoeg, J. M.; Osborne, J. C., Jr.; Gregg, R. E.; Brewer, H. B., Jr.: Initial diagnosis of lipoprotein lipase deficiency in a 75-year-old man. Am. J. Med. 75:889-892, 1983.

Batischev, A. I.; Chernyak, N. B.; Torakev, Y. N.: Detection of a new abnormal variant of glucose-6-phosphate dehydrogenase in human red cells. Bulleten Eksperimental Noi Biologii I Meditsiny 84:728-731, 1977.

Parolini, S.; Bottino, C.; Falco, M.; Augugliaro, R.; Giliani, S.; Franceschini, R.; Ochs, H. D.; Wolf, H.; Bonnefoy, J.-Y.; Biassoni, R.; Moretta, L.; Notarangelo, L. D.; Moretta, A.: X-linked lymphoproliferative disease:2B4 molecules displaying inhibitory rather than activating function are responsible for the inability of natural killer cells to kill Epstein-Barr virus-infected cells. J. Exp. Med. 192:337-346,2000.

Harrington, J. J.; Lieber, M. R.: The characterization of a mammalian DNA structure-specific endonuclease. EMBO J. 13:1235-1246, 1994.

Amano, M.; Mukai, H.; Ono, Y.; Chihara, K.; Matsui, T.; Hamajima, Y.; Okawa, K.; Iwamatsu, A.; Kaibuchi, K.: Identification of a putative target for rho as the serine-threonine kinase protein kinase N. Science 271:648-651, 1996.

Gorlatov, S. N.; Stadtman, T. C.: Human thioredoxin reductase from HeLa cells: selective alkylation of selenocysteine in the protein inhibits enzyme activity and reduction with NADPH influences affinity to heparin. Proc. Nat. Acad. Sci. 95:8520-8525, 1998.

ten Dijke, P.; Franzen, P.; Yamashita, H.; Ichijo, H.; Heldin, C. H.; Miyazono, K.: Serine/threonine kinase receptors. Prog. growth factor Res. 5:55-72, 1994.

McPherron, A. C.; Lee, S.-J.: Suppression of body fat accumulation in myostatin-deficient mice. J. Clin. Invest. 109:595-601, 2002.

Klein, R. D.; Sherman, D.; Ho, W.-H.; Stone, D.; Bennett, G. L.; Moffat, B.; Vandlen, R.; Simmons, L.; Gu, Q.; Hongo, J.-A.; Devaux, B.; Poulsen, K.; Armanini, M.; Nozaki, C.; Asai, N.; Goddard, A.; Phillips, H.; Henderson, C. E.; Takahashi, M.; Rosenthal, A.: A GPI-linked protein that interacts with Ret to form a candidate neurturin receptor. Nature 387: 717-721, 1997.

Masuda, H.; Tanaka, K.; Takagi, M.; Ohgami, K.; Sakamaki, T.; Shibata, N.; Takahashi, K.: Molecular cloning and characterization of human non-smooth muscle calponin. J. Biochem. 120:415-424, 1996.

Vlangos, C. N.; Das, P.; Patel, P. I.; Elsea, S. H.: Assignment of developmentally regulated GTP-binding protein (DRG2) to human chromosome band 17p11.2 with somatic cell hybrids and localization to the Smith-Magenis syndrome critical interval. Cytogenet. Cell Genet. 88:283-285,2000.

Peyrard, M.: Personal Communication. Stockholm, Sweden Jan. 7, 1999.

Ware, F. E.; Lehrman, M. A.: Expression cloning of a novel suppressor of the Lec15 and Lec35 glycosylation mutations of Chinese hamster ovary cells. J. Biol. Chem. 271:13935-13938, 1996.

Telen, M. J.; Whitsett, C. F.: Erythrocyte acetylcholinesterase bears the Cartwright blood group antigens. (Abstract) Clin. Res. 40:170A only, 1992.

Wjst, M.; Fischer, G.; Immervoll, T.; Jung, M.; Saar, K.; Rueschendorf, F.; Reis, A.; Ulbrecht, M.; Gomolka, M.; Weiss, E. H.; Jaeger, L.; Nickel, R.; and 14 others: A genome-wide search for linkage to asthma. Genomics 58:1-8, 1999.

Privalsky, M. L.; Ralston, R.; Bishop, J. M.: The membrane glycoprotein encoded by the retroviral oncogene v-erb-B is structurally related to tyrosine-specific protein kinases. Proc. Nat. Acad. Sci. 81:704-707, 1984.

Kalachikov, S.; Evgrafov, O.; Ross, B.; Winawer, M.; Barker-Cummings, C.; Boneschi, F. M.; Choi, C.; Morozov, P.; Das, K.; Teplitskaya, E.; Yu, A.; Cayanis, E.; Penchaszadeh, G.; Kottmann, A. H.; Pedley, T. A.; Hauser, W. A.; Ottman, R.; Gilliam, T. C.: Mutations in LGI1 cause autosomal-dominant partial epilepsy with auditory features. Nature Genet. 30:335-341, 2002.

Kumar, B. V.; Aleman-Gomez, J. A.; Colwell, N.; Lopez-Candales, A.; Bosner, M. S.; Spilburg, C. A.; Lowe, M.; Lange, L. G.: Structure of the human pancreatic cholesterol esterase gene. Biochemistry 31:6077-6081, 1992.

Lidberg, U.; Nilsson, J.; Stromberg, K.; Stenman, G.; Sahlin, P.; Enerback, S.; Bjursell, G.: Genomic organization, sequence analysis, and chromosomal localization of the human carboxyl ester lipase (CEL) gene and a CEL-like (CELL) gene. Genomics 13:630-640, 1992.

Galland, F.; Stefanova, M.; Pirisi, V.; Birnbaum, D.: characterization of a murine glyceraldehyde-3-phosphate dehydrogenase pseudogene. Biochimie 72:759-762, 1990.

Lidmer, A.-S.; Kannius, M.; Lundberg, L.; Bjursell, G.; Nilsson, J.: Molecular cloning and characterization of the mouse carboxylester lipase gene and evidence for expression in the lactating mammary gland. Genomics 29:115-122, 1995.

Nilsson, J.; Hellquist, M.; Bjursell, G.: The human carboxyl esterlipase-like (CELL) gene is ubiquitously expressed and contains a hypervariable region. Genomics 17:416-422, 1993.

Taylor, A. K.; Zambaux, J. L.; Klisak, I.; Mohandas, T.; Sparkes, R. S.; Schotz, M. C.; Lusis, A. J.: Carboxyl-ester lipase: a highly polymorphic locus on chromosome 9qter. Genomics 10:425-431, 1991.

Vanin, E. F.: Processed pseudogenes: characteristics and evolution. Annu. Rev. Genet. 19:253-272, 1985.

Ferrari, P.; Weidmann, P.; Ferrier, C.; Dietler, R.; Hollmann, R.; Piso, R. J.; Wey, J.; Shaw, S.: Dysregulation of atrial natriuretic factor in hypertension-prone man. J. Clin. Endocr. Metab. 71:944-951,1990.

Kishimoto, I.; Rossi, K.; Garbers, D. L.: A genetic model provides evidence that the receptor for atrial natriuretic peptide (guanylylcyclase-A) inhibits cardiac ventricular myocyte hypertrophy. Proc. Nat. Acad. Sci. 98:2703-2706, 2001.

Lowe, D. G.; Klisak, I.; Sparkes, R. S.; Mohandas, T.; Goeddel, D. V.: Chromosomal distribution of three members of the human natriuretic peptide receptor/guanylyl cyclase gene family. Genomics 8:304-312,1990.

AbdAlla, S.; Lother, H.; Quitterer, U.: AT(1)-receptor heterodimers show enhanced G-protein activation and altered receptor sequestration. Nature 407:94-98, 2000.

Bergsma, D. J.; Ellis, C.; Kumar, C.; Nuthulaganti, P.; Kersten, H.; Elshourbagy, N.; Griffin, E.; Stadel, J. M.; Aiyar, N.: Cloning and characterization of a human angiotensin II type 1 receptor. Biochem. Biophys. Res. Commun. 183:989-995, 1992.

Bonnardeaux, A.; Davies, E.; Jeunemaitre, X.; Fery, I.; Charru, A.; Clauser, E.; Tiret, L.; Cambien, F.; Corvol, P.; Soubrier, F.: Angiotensin II type 1 receptor gene polymorphisms in human essential hypertension. Hypertension 24:63-69, 1994.

Curnow, K. M.; Pascoe, L.; White, P. C.: Genetic analysis of the human type-1 angiotensin II receptor. Molec. Endocr. 6:1113-1118,1992.

Elton, T. S.; Stephan, C. C.; Taylor, G. R.; Kimball, M. G.; Martin, M. M.; Durand, J. N.; Oparil, S.: Isolation of two distinct type I angiotensin II receptor genes. Biochem. Biophys. Res. Commun. 184:1067-1073, 1992.

Furuta, H.; Guo, D.-F.; Inagami, T.: Molecular cloning and sequencing of the gene encoding human angiotensin II type 1 receptor. Biochem. Biophys. Res. Commun. 183:8-13, 1992.

Gemmill, R. M.; Drabkin, H. A.: Report of The Second International Workshop on Human Chromosome 3 Mapping. Cytogenet. Cell Genet. 57:162-166, 1991.

Guo, D.-F.; Furuta, H.; Mizukoshi, M.; Inagami, T.: The genomic organization of human angiotensin II type 1 receptor. Biochem. Biophys. Res. Commun. 200:313-319, 1994.

Harada, K.; Komuro, I.; Hayashi, D.; Sugaya, T.; Murakami, K.; Yazaki, Y.: Angiotensin II type 1a receptor is involved in the occurrence of reperfusion arrhythmias. Circulation 97:315-317, 1998.

Haywood, G. A.; Gullestad, L.; Katsuya, T.; Hutchinson, H. G.; Pratt, R. E.; Horiuchi, M.; Fowler, M. B.: AT(1) and AT(2) angiotensin receptor gene expression in human heart failure. Circulation 95:1201-1206, 1997.

Herzig, T. C.; Jobe, S. M.; Aoki, H.; Molkentin, J. D.; Cowley, A. W., Jr.; Izumo, S.; Markham, B. E.: Angiotensin II type-1a receptor gene expression in the heart: AP-1 and GATA-4 participate in the response to pressure overload. Proc. Nat. Acad. Sci. 94:7543-7548, 1997.

Ito, M.; Oliverio, M. I.; Mannon, P. J.; Best, C. F.; Maeda, N.; Smithies, O.; Coffman, T. M.: Regulation of blood pressure by type 1A angiotensin II receptor gene. Proc. Nat. Acad. Sci. 92:3521-3525,1995.

Iyer, S. N.; Lu, D.; Katovich, M. J.; Raizada, M. K.: Chronic control of high blood pressure in the spontaneously hypertensive rat by delivery of angiotensin type 1 receptor antisense. Proc. Nat. Acad. Sci. 93:9960-9965, 1996.

Konishi, H.; Kuroda, S.; Inada, Y.; Fujisawa, Y.: Novel subtype of human angiotensin II type 1 receptor: cDNA cloning and expression. Biochem. Biophys. Res. Commun. 199: 467-474, 1994.

Martens, J. R.; Reaves, P. Y.; Lu, D.; Katovich, M. J.; Berecek, K. H.; Bishop, S. P.; Raizada, M. K.; Gelband, C. H.: Prevention of renovascular and cardiac pathophysiological changes in hypertension by angiotensin II type 1 receptor antisense gene therapy. Proc. Nat. Acad. Sci. 95:2664-2669, 1998.

Martin, M. M.; Willardson, B. M.; Burton, G. F.; White, C. R.; McLaughlin, J. N.; Bray, S. M.; Ogilvie, J. W., Jr.; Elton, T. S.: Human angiotensin II type 1 receptor isoforms encoded by messenger RNA splice variants are functionally distinct. Molec. Endocr. 15:281-293, 2001.

Mauzy, C. A.; Hwang, O.; Egloff, A. M.; Wu, L.-H.; Chung, F.-Z.: Cloning, expression, and characterization of a gene encoding the human angiotensin II type 1A receptor. Biochem. Biophys. Res. Commun. 186:277-284, 1992.

Murphy, T. J.; Alexander, R. W.; Griendling, K. K.; Runge, M. S.; Bernstein, K. E.: Isolation of a cDNA encoding the vascular type-1 angiotensin II receptor. Nature 351:233-236, 1991.

Paradis, P.; Dali-Youcef, N.; Paradis, F. W.; Thibault, G.; Nemer, M.: Overexpression of angiotensin II type I receptor in cardiomyocytes induces cardiac hypertrophy and remodeling. Proc. Nat. Acad. Sci. 97:931-936, 2000.

Sasaki, K.; Murohara, T.; Ikeda, H.; Sugaya, T.; Shimada, T.; Shintani, S.; Imaizumi, T.: Evidence for the importance of angiotensin II type 1 receptor in ischemia-induced angiogenesis. J. Clin. Invest. 109:603-611, 2002.

Oliverio, M. I.; Kim, H-S.; Ito, M.; Le, T.; Audoly, L.; Best, C. F.; Hiller, S.; Kluckman, K.; Maeda, N.; Smithies, O.; Coffman, T. M.: Reduced growth, abnormal kidney structure, and type 2 (AT2) angiotensin receptor-mediated blood pressure regulation in mice lacking both AT1A and AT1B receptors for angiotensin II. Proc. Nat. Acad. Sci. 95:15496-15501, 1998.

Sasaki, K.; Yamano, Y.; Bardhan, S.; Iwai, N.; Murray, J. J.; Hasegawa, M.; Matsuda, Y.; Inagami, T.: Cloning and expression of a complementary DNA encoding a bovine adrenal angiotensin II type-1receptor. Nature 351:230-233, 1991.

Scott, A. F.: Personal Communication. Baltimore, Md. Mar. 20, 2001.

Szpirer, C.; Riviere, M.; Szpirer, J.; Levan, G.; Guo, D. F.; Iwai, N.; Inagami, T.: Chromosomal assignment of human and rat hypertension candidate genes: type 1 angiotensin II receptor genes and the SA gene. J. Hypertension 11:919-925, 1993.

Takayanagi, R.; Ohnaka, K.; Sakai, Y.; Nakao, R.; Yanase, T.; Haji, M.; Inagami, T.; Furuta, H.; Gou, D.-F.; Nakamuta, M.; Nawata, H.: Molecular cloning, sequence analysis and expression of a cDNA encoding human type-1 angiotensin II receptor. Biochem. Biophys. Res. Commun. 183:910-916, 1992.

Tsuchida, S.; Matsusaka, T.; Chen, X.; Okubo, S.; Niimura, F.; Nishimura, H.; Fogo, A.; Utsunomiya, H.; Inagami, T.; Ichikawa, I.: Murine double nullizygotes of the angiotensin type 1A and 1B receptor genes duplicate severe abnormal phenotypes of angiotensinogen nullizygotes. J. Clin. Invest. 101:755-760, 1998.

Beggs, A. H.; Byers, T. J.; Knoll, J. H. M.; Boyce, F. M.; Bruns, G. A. P.; Kunkel, L. M.: Cloning and characterization of two human skeletal muscle alpha-actinin genes located on chromosomes 1 and 11. J. Biol. Chem. 267:9281-9288, 1992.

Beggs, A. H.; Phillips, H. A.; Kozman, H.; Mulley, J. C.; Wilton, S. D.; Kunkel, L. M.; Laing, N. G.: A (CA) n repeat polymorphism for the human skeletal muscle alpha-actinin gene ACTN2 and its localization on the linkage map of chromosome 1. Genomics 13:1314-1315, 1992.

Mills, M. A.; Yang, N.; Weinberger, R. P.; Vander Woude, D. L.; Beggs, A. H.; Easteal, S.; North, K. N.: Differential expression of the actin-binding proteins, alpha-actinin-2 and -3, in different species: implications for the evolution of functional redundancy. Hum. Molec. Genet. 10:1335-1346, 2001.

Attisano, L.; Carcamo, J.; Ventura, F.; Weis, F. M. B.; Massague, J.; Wrana, J. L.: Identification of human activin and TGF-beta type I receptors that form heteromeric kinase complexes with type II receptors. Cell 75:671-680, 1993.

Mathews, L. S.; Vale, W. W.: Expression cloning of an activin receptor, a predicted transmembrane serine kinase. Cell 65:973-982,1991.

Matsuzaki, K.; Xu, J.; Wang, F.; McKeehan, W. L.; Krummen, L.; Kan, M.: A widely expressed transmembrane serine/threonine kinase that does not bind activin, inhibin, transforming growth factor beta, or bone morphogenic factor. J. Biol. Chem. 268:12719-12723, 1993.

Roijer, E.; Miyazono, K.; Astrom, A.-K.; Geurts van Kessel, A.; ten Dijke, P.; Stenman, G.: Chromosomal localization of three human genes encoding members of the TGF-beta superfamily of type I serine/threonine kinase receptors. Mammalian Genome 9:266-268, 1998.

ten Dijke, P.; Ichijo, H.; Franzen, P.; Schulz, P.; Saras, J.; Toyoshima, H.; Heldin, C.-H.; Miyazono, K.: Activin receptor-like kinases: a novel subclass of cell-surface receptors with predicted serine/threonine kinase activity. Oncogene 8:2879-2887, 1993.

Chen, M.; Pan, Z.-Q.; Hurwitz, J.: Studies of the cloned 37-kDa subunit of activator 1 (replication factor C) of HeLa cells. Proc. Nat. Acad. Sci. 89:5211-5215, 1992.

Buettner, R.; Schaffler, A.; Arndt, H.; Rogler, G.; Nusser, J.; Zietz, B.; Enger, I.; Hugl, S.; Cuk, A.; Scholmerich, J.; Palitzsch, K.-D.: The trp64arg polymorphism of the beta-3-adrenergic receptor gene is not associated with obesity or type 2 diabetes mellitus in a large population-based Caucasian cohort. J. Clin. Endocr. Metab. 83:2892-2897, 1998.

Clement, K.; Vaisse, C.; Manning, B. S. J.; Basdevant, A.; Guy-Grand, B.; Ruiz, J.; Silver, K. D.; Shuldiner, A. R.; Froguel, P.; Strosberg, A. D.: Genetic variation in the beta-3-adrenergic receptor and an increased capacity to gain weight in patients with morbid obesity. New Eng. J. Med. 333:352-354, 1995.

Elbein, S. C.; Hoffman, M.; Barrett, K.; Wegner, K.; Miles, C.; Bachman, K.; Berkowitz, D.; Shuldiner, A. R.; Leppert, M. F.; Hasstedt, S.: Role of the beta-3-adrenergic receptor locus in obesity and noninsulin-dependent diabetes among members of Caucasian families with a diabetic sibling pair. J. Clin. Endocr. Metab. 81:4422-4427, 1996.

Emorine, L. J.; Marullo, S.; Briend-Sutren, M.-M.; Patey, G.; Tate, K.; Delavier-Klutchko, C.; Strosberg, A. D.: Molecular characterization of the human beta-3-adrenergic receptor. Science 245:1118-1121,1989.

Festa, A.; Krugluger, W.; Shnawa, N.; Hopmeier, P.; Haffner, S. M.; Schernthaner, G.: Trp64Arg polymorphism of the beta-3-adrenergic receptor gene in pregnancy: association with mild gestational diabetes mellitus. J. Clin. Endocr. Metab. 84:1695-1699, 1999.

Gagnon, J.; Mauriege, P.; Roy, S.; Sjostrom, D.; Chagnon, Y. C.; Dionne, F. T.; Oppert, J.-M.; Perusse, L.; Sjostrom, L.; Bouchard, C.: The trp64arg mutation of the beta-3 adrenergic receptor gene has no effect on obesity phenotypes in the Quebec Family Study and Swedish Obese Subjects cohorts. J. Clin. Invest. 98:2086-2093,1996.

Garcia-Rubi, E.; Starling, R. D.; Tchernof, A.; Matthews, D. E.; Walston, J. D.; Shuldiner, A. R.; Silver, K.; Poehlman, E. T.; Calles-Escandon, J.: Trp64Arg variant of the beta-3-adrenoceptor and insulin resistance in obese postmenopausal women. J. Clin. Endocr. Metab. 83:4002-4005,1998.

Hoffstedt, J.; Poirier, O.; Thorne, A.; Lonnqvist, F.; Herrmann, S. M.; Cambien, F.; Arner, P.: Polymorphism of the human beta-3-adrenoceptor gene forms a well-conserved haplotype that is associated with moderate obesity and altered receptor function. Diabetes 48:203-205, 1999.

Kim-Motoyama, H.; Yasuda, K.; Yamaguchi, T.; Yamada, N.; Katakura, T.; Shuldiner, A. R.; Akanuma, Y.; Ohashi, Y.; Yazaki, Y.; Kadowaki, T.: A mutation of the beta-3-adrenergic receptor is associated with visceral obesity but decreased serum triglyceride. Diabetologia 40:469-472, 1997.

Mitchell, B. D.; Blangero, J.; Comuzzie, A. G.; Almasy, L. A.; Shuldiner, A. R.; Silver, K.; Stern, M. P.; MacCluer, J. W.; Hixson, J. E.: A paired sibling analysis of the beta-3 adrenergic receptor and obesity in Mexican Americans. J. Clin. Invest. 101:584-587,1998.

Nagase, T.; Aoki, A.; Yamamoto, M.; Yasuda, H.; Kado, S.; Nishikawa, M.; Kugai, N.; Akatsu, T.; Nagata, N.: Lack of association between the trp64arg mutation in the beta-3-adrenergic receptor gene and obesity in Japanese men: a longitudinal analysis. J. Clin. Endocr. Metab. 82:1284-1287, 1997.

Shihara, N.; Yasuda, K.; Moritani, T.; Ue, H.; Adachi, T.; Tanaka, H.; Tsuda, K.; Seino, Y.: The association between Trp64Arg polymorphism of the beta-3-adrenergic receptor and autonomic nervous system activity. J. Clin. Endocr. Metab. 84:1623-1627, 1999.

Van Spronsen, A.; Nahmias, C.; Krief, S.; Briend-Sutren, M.-M.; Strosberg, A. D.; Emorine, L. J.: The promoter and intron/exon structure of the human and mouse beta-3-adrenergic-receptor genes. Europ. J. Biochem. 213:1117-1124, 1993.

Urhammer, S. A.; Hansen, T.; Borch-Johnsen, K.; Pedersen, O.:Studies of the synergistic effect of the trp/arg64 polymorphism of the beta-3-adrenergic receptor gene and the -3826 A-G variant of the uncoupling protein-1 gene on features of obesity and insulin resistance in a population-based sample of 379 young Danish subjects. J. Clin. Endocr. Metab. 85:3151-3154, 2000.

Walston, J.; Silver, K.; Bogardus, C.; Knowler, W. C.; Celi, F. S.; Austin, S.; Manning, B.; Strosberg, A. D.; Stern, M. P.; Raben, N.; Sorkin, J. D.; Roth, J.; Shuldiner, A. R.: Time of onset of non-insulin-dependent diabetes mellitus and genetic variation in the beta-3-adrenergic-receptor gene. New Eng. J. Med. 333:343-347, 1995.

Walston, J.; Silver, K.; Hilfiker, H.; Andersen, R. E.; Seibert, M.; Beamer, B.; Roth, J.; Poehlman, E.; Shuldiner, A. R.: Insulin response to glucose is lower in individuals homozygous for the arg64 variant of the beta-3-andrenergic receptor. J. Clin. Endocr. Metab. 85:4019-4022, 2000.

Chashchin, V. L.; Lapko, V. N.; Adamovich, T. B.; Kirillova, N. M.; Lapko, A. G.; Akhrem, A. A.: The primary structure of hepatoredoxin from bovine liver mitochondria. Bioorg. Khim. 12:1286-1289, 1986.

Jefcoate, C. R.; McNamara, B. C.; DiBartolomeis, M. J.: control of steroid synthesis in adrenal fasciculata cells. Endocr. Res. 12:314-350, 1986.

Maruya, N.; Hiwatashi, A.; Ichikawa, Y.; Yamano, T.: Purification and characterization of renal ferredoxin from bovine renal mitochondria. J. Biochem. 93:1239-1247, 1983.

Mittal, S.; Zhu, Y. Z.; Vickery, L. E.: Molecular cloning and sequence analysis of human placental ferredoxin. Arch. Biochem. Biophys. 264:383-391, 1988.

Morel, Y.; Picado-Leonard, J.; Mohandas, T. K.; Miller, W. L.:Two highly homologous genes for adrenodoxin lie on human chromosomes 11 and 20. (Abstract) Am. J. Hum. Genet. 41: A178 only, 1987.

Morel, Y.; Picado-Leonard, J.; Wu, D.-A.; Chang, C.-Y.; Mohandas, T. K.; Chung, B.-C.; Miller, W. L.: Assignment of the functional gene for human adrenodoxin to chromosome 11q13-qter and of adrenodoxin pseudogenes to chromosome 20cen-q13.1. Am. J. Hum. Genet. 43:52-59,1988.

Okamura, T.; John, M. E.; Zuber, M. X.; Simpson, E. R.; Waterman, M. R.: Molecular cloning and amino acid sequence of the precursor form of bovine adrenodoxin: evidence for a previously unidentified COOH-terminal peptide. Proc. Nat. Acad. Sci. 82:5705-5709, 1985.

Picado-Leonard, J.; Voutilainen, R.; Kao, L.-C.; Chung, B.-C.; Strauss, J. F., III; Miller, W. L.: Human adrenodoxin: cloning of three cDNAs and cycloheximide enhancement in JEG-3 cells. J. Biol. Chem. 263:3240-3244, 1988.

Sparkes, R. S.; Klisak, I.; Miller, W. L.: Regional mapping of genes encoding human steroidogenic enzymes: P450scc to 15q23-q24; adrenodoxin to 11q22; adrenodoxin reductase to 17q24-q25; and P450c17to 10q24-q25. DNA Cell Biol. 10:359-365, 1991.

Caron, K. M.; Smithies, O.: Extreme hydrops fetalis and cardiovascular abnormalities in mice lacking a functional adrenomedullin gene. Proc. Nat. Acad. Sci. 98:615-619, 2001.

Ishimitsu, T.; Kojima, M.; Kangawa, K.; Hino, J.; Matsuoka, H.; Kitamura, K.; Eto, T.; Matsuo, H.: Genomic structure of human adrenomedullin gene. Biochem. Biophys. Res. Commun. 203:631-639, 1994.

Kitamura, K.; Sakata, J.; Kangawa, K.; Kojima, M.; Matsuo, H.; Eto, T.: Cloning and characterization of cDNA encoding a precursor for human adrenomedullin. Biochem. Biophys. Res. Commun. 194:720-725,1993.

Makino, Y.; Shibata, K.; Makino, I.; Kangawa, K.; Kawarabayashi, T.: Alteration of the adrenomedullin receptor components gene expression associated with the blood pressure in pregnancy-induced hypertension. J. Clin. Endocr. Metab. 86:5079-5082, 2001.

McLatchie, L. M.; Fraser, N. J.; Main, M. J.; Wise, A.; Brown, J.; Thompson, N.; Solari, R.; Lee, M. G.; Foord, S. M.: RAMPs regulate the transport and ligand specificity of the calcitonin-receptor-like receptor. Nature 393:333-339, 1998.

Okazaki, T.; Ogawa, Y.; Tamura, N.; Mori, K.; Isse, N.; Aoki, T.; Rochelle, J. M.; Taketo, M. M.; Seldin, M. F.; Nakao, K.: Genomic organization, expression, and chromosomal mapping of the mouse adrenomedullin gene. Genomics 37:395-399, 1996.

Richards, A. M.; Nicholls, M. G.; Lewis, L.; Lainchbury, J. G.: Adrenomedullin. Clin. Sci. 91:3-16, 1996.

Udono, T.; Takahashi, K.; Nakayama, M.; Yoshinoya, A.; Totsune, K.; Murakami, O.; Durlu, Y. K.; Tamai, M.; Shibahara, S.: Induction of adrenomedullin by hypoxia in cultured retinal pigment epithelial cells. Invest. Ophthal. Vis. Sci. 42:1080-1086, 2001.

van Heyningen, V.; Jones, C.: Report of the committee on the genetic constitution of chromosome 11. In: Cuticchia, A. J.; Pearson, P. L.; Klinger, H. P. (eds.): Chromosome coordinating meeting, 1992. Genome Priority Reports, Vol 1. Basel: S. Karger (pub.) 1993. Pp. 365-401.

Ferguson-Smith, A. C.; Cattanach, B. M.; Barton, S. C.; Beechey, C. V.; Surani, M. A.: Embryological and molecular investigations of parental imprinting on mouse chromosome 7. Nature 351:667-670,1991.

Roberds, S. L.; Anderson, J.; Basi, G.; Bienkowski, M. J.; Branstetter, D. G.; Chen, K. S.; Freedman, S. B.; Frigon, N. L.; Games, D.; Hu, K.; Johnson-Wood, K.; Kappenman, K. E.; and 20 others: BACE knockout mice are healthy despite lacking the primary beta-secretase activity in brain: implications for Alzheimer's disease therapeutics. Hum. Molec. Genet. 10:1317-1324, 2001.

Wasco, W.; Brook, J. D.; Tanzi, R. E.: The amyloid precursor-like protein (APLP) gene maps to the long arm of human chromosome 19. Genomics 15:237-239, 1993.

Leach, R.; Ko, M.; Krawetz, S. A.: Assignment of amyloid-precursor-like protein 2 gene (APLP2) to 11q24 by fluorescent in situ hybridization. Cytogenet. Cell Genet. 87:215-216, 1999.

von der Kammer, H.; Loffler, C.; Hanes, J.; Klaudiny, J.; Scheit, K. H.; Hansmann, I.: The gene for the amyloid precursor-like protein APLP2 is assigned to human chromosome 11q23-25. Genomics 10:308-311,1994.

von Koch, C. S.; Lahiri, D. K.; Mammen, A. L.; Copeland, N. G.; Gilbert, D. J.; Jenkins, N. A.; Sisodia, S. S.: The mouse APLP2 gene:chromosomal localization and promoter characterization. J. Biol. Chem. 270:25475-25480, 1995.

Yan, Y. C.; Bai, Y.; Wang, L.; Miao, S.; Koide, S. S.: characterization of cDNA encoding a human sperm membrane protein related to A4 amyloid protein. Proc. Nat. Acad. Sci. 87:2405-2408, 1990.

Yang, Y.; Martin, L.; Cuzin, F.; Mattei, M.-G.; Rassoulzadegan, M.: Genomic structure and chromosomal localization of the mouse CDEI-binding protein CDEBP (APLP2) gene and promoter sequences. Genomics 35:24-29, 1996.

Wallukat, G.; Homuth, V.; Fischer, T.; Lindschau, C.; Horstkamp, B.; Jupner, A.; Baur, E.; Nissen, E.; Vetter, K.; Neichel, D.; Dudenhausen, J. W.; Haller, H.; Luft, F. C.: Patients with preeclampsia develop agonistic autoantibodies against the angiotensin AT-1 receptor. J. Clin. Invest. 103: 945-952, 1999.

Wang, W. Y. S.; Zee, R. Y. L.; Morris, B. J.: Association of angiotensin II type 1 receptor gene polymorphism with essential hypertension. Clin. Genet. 51:31-34, 1997.

Wilson, G. N.; Dasouki, M.; Barr, M., Jr.: Further delineation of the dup (3q) syndrome. Am. J. Med. Genet. 22:117-123, 1985.

Oliver, P. M.; Fox, J. E.; Kim, R.; Rockman, H. A.; Kim, H.-S.; Reddick, R. L.; Pandey, K. N.; Milgram, S. L.; Smithies, O.; Maeda, N.: Hypertension, cardiac hypertrophy, and sudden death in mice lacking natriuretic peptide receptor A. Proc. Nat. Acad. Sci. 94:14730-14735,1997.

Oliver, P. M.; John, S. W. M.; Purdy, K. E.; Kim, R.; Maeda, N.; Goy, M. F.; Smithies, O.: Natriuretic peptide receptor 1 expression influences blood pressures of mice in a dose-dependent manner. Proc. Nat. Acad. Sci. 95:2547-2551, 1998.

Wada, K.; Yokotani, N.; Hunter, C.; Doi, K.; Wenthold, R. J.; Shimasaki, S.: Differential expression of two distinct forms of mRNA encoding members of a dipeptidyl aminopeptidase family. Proc. Nat. Acad. Sci. 89:197-201, 1992.

Wada, K.; Zimmerman, K. L.; Adamson, M. C.; Yokotani, N.; Wenthold, R. J.; Kozak, C. A.: Genetic mapping of the mouse gene encoding dipeptidyl aminopeptidase-like proteins. Mammalian Genome 4:234-237, 1993.

Yokotani, N.; Doi, K.; Wenthold, R. J.; Wada, K.: Non-conservation of a catalytic residue in a depeptidyl aminopeptidase IV-related protein encoded by a gene on human chromosome 7. Hum. Molec. Genet. 2:1037-1039,1993.

Chang, T.-M.; Neville, D. M., Jr.: Demonstration of diphtheria toxin receptors on surface membranes from both toxin-sensitive and toxin-resistant species. J. Biol. Chem. 253: 6866-6871, 1978.

Creagan, R. P.; Chen, S.-H.; Ruddle, F. H.: Genetic analysis of the cell surface: association of human chromosome 5 with sensitivity to diphtheria toxin in mouse-human somatic cell hybrids. Proc. Nat. Acad. Sci. 72:2237-2241, 1975.

Fen, Z.; Dhadly, M. S.; Yoshizumi, M.; Hilkert, R. J.; Quertermous, T.; Eddy, R. L.; Shows, T. B.; Lee, M.-E.: Structural organization and chromosomal assignment of the gene encoding the human heparin-binding epidermal growth factor-like growth factor/diphtheria toxin receptor. Biochemistry 32:7932-7938, 1993.

George, D. L.; Francke, U.: Regional mapping of human genes for hexosaminidase B and diphtheria toxin sensitivity on chromosome 5 using mouse X human hybrid cells. Somat. Cell Genet. 3:629-638,1977.

Gupta, R. S.; Siminovitch, L.: Isolation and characterization of mutants of human diploid fibroblasts resistant to diphtheria toxin. Proc. Nat. Acad. Sci. 75:3337-3340, 1978.

Hayes, H.; Kaneda, Y.; Uchida, T.; Okada, Y.: Regional assignment of the gene for diphtheria toxin sensitivity using subchromosomal fragments in microcell hybrids. Chromosoma 96:26-32, 1987.

Higashiyama, S.; Abraham, J. A.; Miller, J.; Fiddes, J. C.; Klagsbrun, M.: A heparin-binding growth factor secreted by macrophage-like cells that is related to EGF. Science 251: 936-939, 1991.

Kurihara, T.; Monoh, K.; Sakimura, K.; Takahashi, Y.: Alternative splicing of mouse brain 2-prime,3-prime-cyclic nucleotide 3-prime-phosphodiesterase mRNA. Biochem. Biophys. Res. Commun. 170:1074-1081, 1990.

Monoh, K.; Kurihara, T.; Takahashi, Y.; Ichikawa, T.; Kumanishi, T.; Hayashi, S.; Minoshima, S.; Shimizu, N.: Structure, expression and chromosomal localization of the gene encoding human 2-prime, 3-prime-cyclic-nucleotide 3-prime-phosphodiesterase. Gene 129:297-301, 1993.

Wang, Q.; Curren, M. E.; Splawski, I.; Burn, T. C.; Millholland, J. M.; VanRaay, T. J.; Shen, J.; Timothy, K. W.; Vincent, G. M.; deJager, T.; Schwartz, P. J.; Towbin, J. A.; Moss, A. J.; Atkinson, D. L.; Landes, G. M.; Connors, T. D.; Keating, M. T.: Positional cloning of a novel potassium channel gene: KVLQT1 mutations cause cardiac arrhythmias. Nature Genet. 12:17-23, 1996.

Kondo, M.; Scherer, D. C.; Miyamoto, T.; King, A. G.; Akashi, K.; Sugamura, K.; Weissman, I. L.: Cell-fate conversion of lymphoid-committed progenitors by instructive actions of cytokines. Nature 407:383-386,2000.

Douglas, A. J.; Fox, M. F.; Abbott, C. M.; Hinks, L. J.; Sharpe, G.; Povey, S.; Thompson, R. J.: Structure and chromosomal localization of the human 2-prime, 3-prime-cyclic nucleotide 3-prime-phosphodiesterase gene. Ann. Hum. Genet. 56:243-254, 1992.

Douglas, A. J.; Fox, M. F.; Hinks, L. J.; Povey, S.; Thompson, R. J.: Localization of the myelin specific enzyme 2-prime, 3-prime-cyclic nucleotide-3-prime-phosphohydrolase to 17q21. (Abstract) Cytogenet. Cell Genet. 58:2004 only, 1991.

Bernier, L.; Colman, D. R.; D'Eustachio, P.: Chromosomal locations of genes encoding 2-prime, 3-prime cyclic nucleotide 3-prime-phosphodiesterase and glial fibrillary acidic protein in the mouse. J. Neurosci. Res. 20:497-504, 1988.

Bifulco, M.; Laezza, C.; Stingo, S.; Wolff, J.:2-prime,3-prime-cyclicnucleotide 3-prime-phosphodiesterase: a membrane-bound, microtubule-associated protein and membrane anchor for tubulin. Proc. Nat. Acad. Sci. 99:1807-1812, 2002.

Sprinkle, T. J.; Kouri, R. E.; Fain, P. D.; Stoming, T. A.; Whitney, J. B., III: Chromosomal mapping of the human CNP gene using a meiotic crossover DNA panel, PCR, and allele-specific probes. Genomics 16:542-545, 1993.

Sprinkle, T. J.; Lanclos, K. D.; Lapp, D. F.: Assignment of the human 2-prime, 3-prime-cyclic nucleotide 3-prime-phosphohydrolase gene to chromosome 17. Genomics 13:877-880, 1992.

Vogel, U. S.; Thompson, R. J.: Molecular structure, localization, and possible functions of the myelin-associated enzyme 2-prime, 3-prime-cyclic nucleotide 3-prime-phosphodiesterase. J. Neurochem. 50:1667-1677,1988.

Bibb, J. A.; Chen, J.; Taylor, J. R.; Svenningsson, P.; Nishi, A.; Snyder, G. L.; Yan, Z.; Sagawa, Z. K.; Ouimet, C. C.; Nairn, A. C.; Nestler, E. J.; Greengard, P.: Effects of chronic exposure to cocaine are regulated by the neuronal protein Cdk5. Nature 410:376-380, 2001.

Demetrick, D. J.; Matsumoto, S.; Hannon, G. J.; Okamoto, K.; Xiong, Y.; Zhang, H.; Beach, D. H.: Chromosomal mapping of the genes for the human cell cycle proteins cyclin C (CCNC), cyclin E (CCNE), p21(CDKN1) and KAP (CDKN3). Cytogenet. Cell Genet. 69:190-192, 1995.

Inaba, T.; Matsushime, H.; Valentine, M.; Roussel, M. F.; Sherr, C. J.; Look, A. T.: Genomic organization, chromosomal localization, and independent expression of human cyclin D genes. Genomics 13:565-574, 1992.

Kim, H. A.; Pomeroy, S. L.; Whoriskey, W.; Pawlitzky, I.; Benowitz, L. I.; Sicinski, P.; Stiles, C. D.; Roberts, T. M.: A developmentally regulated switch directs regenerative growth of Schwann cells through cyclin D1. Neuron 26:405-416, 2000.

Xiong, Y.; Menninger, J.; Beach, D.; Ward, D. C.: Molecular cloning and chromosomal mapping of CCND genes encoding human D-type cyclins. Genomics 13:575-584, 1992.

Stamper, C. C.; Zhang, Y.; Tobin, J. F.; Erbe, D. V.; Ikemizu, S.; Davis, S. J.; Stahl, M. L.; Seehra, J.; Somers, W. S.; Mosyak, L.: Crystal structure of the B7-1/CTLA-4 complex that inhibits human immune responses. Nature 410:608-611, 2001. Note: Erratum: Nature 411:617 only, 2001.

Allenspach, E. J.; Cullinan, P.; Tong, J.; Tang, Q.; Tesciuba, A. G.; Cannon, J. L.; Takahashi, S. M.; Morgan, R.; Burkhardt, J. K.; Sperling, A. I.: ERM-dependent movement of CD43 defines a novel protein complex distal to the immunological synapse. Immunity 15:739-750, 2001.

Bonilha, V. L.; Rodriguez-Boulan, E.: Polarity and developmental regulation of two PDZ proteins in the retinal pigment epithelium. Invest. Ophthal. Vis. Sci. 42:3274-3282, 2001.

Gould, K. L.; Bretscher, A.; Esch, F. S.; Hunter, T.: cDNA cloning and sequencing of the protein-tyrosine kinase substrate, ezrin, reveals homology to band 4.1. EMBO J. 8:4133-4142, 1989.

Majander-Nordenswan, P.; Sainio, M.; Turunen, O.; Jaaskelainen, J.; Carpen, O.; Kere, J.; Vaheri, A.: Genomic structure of the human ezrin gene. Hum. Genet. 103:662-665, 1998.

Pakkanen, R.; Vaheri, A.: Cytovillin and other microvillar proteins of human choriocarcinoma cells. J. Cell. Biochem. 41:1-12, 1989.

Rao, P. H.; Murty, V. V. V. S.; Gaidano, G.; Hauptschein, R.; Dalla-Favera, R.; Chaganti, R. S. K.: Subregional mapping of 8 single copy loci to chromosome 6 by fluorescence in situ hybridization. Cytogenet. Cell Genet. 66:272-273, 1994.

Roumier, A.; Olivo-Marin, J. C.; Arpin, M.; Michel, F.; Martin, M.; Mangeat, P.; Acuto, O.; Dautry-Varsat, A.; Alcover, A.: The membrane-microfilament linker ezrin is involved in the formation of the immunological synapse and in T cell activation. Immunity 15:715-728, 2001.

Turunen, O.; Winqvist, R.; Pakkanen, R.; Grzeschik, K.-H.; Wahlstrom, T.; Vaheri, A.: Cytovillin, a microvillar Mr 75,000 protein: cDNA sequence, prokaryotic expression, and chromosomal localization. J. Biol. Chem. 264:16727-16732, 1989.

Winqvist, R.; Turunen, O.; Pakkanen, R.; Grzeschik, K.-H.: Wahlstrom, T. and Vaheri, A.: Localization of the cytovillin gene to region q22-q27 of human chromosome 6. (Abstract) Cytogenet. Cell Genet. 51:1108-1109, 1989.

Schafer, B. W.; Wicki, R.; Engelkamp, D.; Mattei, M.-G.; Heizmann, C. W.: Isolation of a YAC clone covering a cluster of nine S100 genes on human chromosome 1q21: rationale for a new nomenclature of the S100 calcium-binding protein family. Genomics 25:638-643, 1995.

Buonavista, N.; Balzano, C.; Pontarotti, P.; Le Paslier, D.; Golstein, P.: Molecular linkage of the human CTLA4 and CD28 Ig-superfamily genes in yeast artificial chromosomes. Genomics 13:856-861, 1992.

Howard, T. A.; Rochelle, J. M.; Seldin, M. F.: Cd28 and Ctla-4, two related members of the Ig supergene family, are tightly linked on proximal mouse chromosome 1. Immunogenetics 33:74-76, 1991.

Albertson, D. G.; Ylstra, B.; Segraves, R.; Collins, C.; Dairkee, S. H.; Kowbel, D.; Kuo, W.-L.; Gray, J. W.; Pinkel, D.: Quantitative mapping of amplicon structure by array CGH identifies CYP24 as a candidate oncogene. Nature Genet. 25:144-146, 2000.

Chen, K.-S.; Prahl, J. M.; DeLuca, H. F.: Isolation and expression of human 1,25-dihydroxy vitamin D3 24-hydroxylase cDNA. Proc. Nat. Acad. Sci. 90:4543-4547, 1993.

Hahn, C. N.; Baker, E.; Laslo, P.; May, B. K.; Omdahl, J. L.; Sutherland, G. R.: Localization of the human vitamin D 24-hydroxylase gene (CYP24) to chromosome 20q13.2-q13.3. Cytogenet. Cell Genet. 62:192-193,1993.

Labuda, M.; Lemieux, N.; Tihy, F.; Prinster, C.; Glorieux, F. H.: Human 25-hydroxy vitamin D 24-hydroxylase cytochrome P450 subunit maps to a different chromosomal location than that of pseudovitamin D-deficient rickets. J. Bone Miner. Res. 8:1397-1406, 1993.

Malas, S.; Peters, J.; Abbott, C.: The genes for endothelin 3, vitamin D 24-hydroxylase, and melanocortin 3 receptor map to distal mouse chromosome 2, in the region of conserved synteny with human chromosome 20. Mammalian Genome 5:577-579, 1994.

Ohyama, Y.; Noshiro, M.; Okuda, K.: Cloning and expression of cDNA encoding 25-hydroxy vitamin D(3) 24-hydroxylase. FEBS Lett. 278:195-198, 1991.

Mendel, D. B.; Khavari, P. A.; Conley, P. B.; Graves, M. K.; Hansen, L. P.; Admon, A.; Crabtree, G. R.: Characterization of a cofactor that regulates dimerization of a mammalian homeodomain protein. Science 254:1762-1767, 1991.

Hogenesch, J. B.; Chan, W. K.; Jackiw, V. H.; Brown, R. C.; Gu, Y.-Z.; Pray-Grant, M.; Perdew, G. H.; Bradfield, C. A.: characterization of a subset of the basic-helix-loop-helix-PAS superfamily that interacts with components of the dioxin signaling pathway. J. Biol. Chem. 272:8581-8593, 1997.

Wang, G. L.; Jiang, B.-H.; Rue, E. A.; Semenza, G. L.: Hypoxia-inducible factor 1 is a basic-helix-loop-helix-PAS heterodimer regulated by cellular O(2) tension. Proc. Nat. Acad. Sci. 92:5510-5514, 1995.

Haaparanta, T.; Uitto, J.; Ruoslahti, E.; Engvall, E.: molecular cloning of the cDNA encoding human laminin A chain. Matrix 11:151-160,1991.

Gallagher, P. G.; Forget, B. G.: Structure, organization, and expression of the band 7.2b gene, a candidate gene for hereditary hydrocytosis. J. Biol. Chem. 270:26358-26363, 1995.

Gallagher, P. G.; Romana, M.; Lieman, J. H.; Ward, D. C.: cDNA structure, tissue-specific expression, and chromosomal localization of the murine band 7.2b gene. Blood 86:359-365, 1995.

Gallagher, P. G.; Upender, M.; Ward, D. C.; Forget, B. G.: The gene for human erythrocyte membrane protein band 7.2 (EPB72) maps to 9q33-q34 centromeric to the Philadelphia chromosome translocation breakpoint region. Genomics 18:167-169, 1993.

Hiebl-Dirschmied, C. M.; Entler, B.; Glotzmann, C.; Maurer-Fogy, I.; Stratowa, C.; Prohaska, R.: Cloning and nucleotide sequence of cDNA encoding human erythrocyte band 7 integral membrane protein. Biochim. Biophys. Acta 1090:123-124, 1991.

Pilz, A.; Prohaska, R.; Peters, J.; Abbott, C.: Genetic linkage analysis of the Ak1, Col5a1, Epb7.2, Fpgs, Grp78, Pbx3, and Notch1 genes in the region of mouse chromosome 2 homologous to human chromosome 9q. Genomics 21:104-109, 1994.

Unfried, I.; Entler, B.; Prohaska, R.: The organization of the gene (EPB72) encoding the human erythrocyte band 7 integral membrane protein (protein 7.2b). Genomics 30:521-528, 1995.

Westberg, J. A.; Entler, B.; Prohaska, R.; Schroder, J. P.: The gene coding for erythrocyte protein band 7.2b (EPB72) is located in band q34.1 of human chromosome 9. Cytogenet. Cell Genet. 63:241-243,1993.

Zhu, Y.; Paszty, C.; Turetsky, T.; Tsai, S.; Kuypers, F. A.; Lee, G.; Cooper, P.; Gallagher, P. G.; Stevens, M. E.; Rubin, E.; Mohandas, N.; Mentzer, W. C.: Stomatocytosis is absent in 'stomatin'-deficient murine red blood cells. Blood 93:2404-2410, 1999.

Scott, M. P.: Vertebrate homeobox gene nomenclature. Cell 71:551-553, 1992.

Carr, D. W.; Hausken, Z. E.; Fraser, I. D.; Stofko-Hahn, R. E.; Scott, J. D: Association of the type II cAMP-dependent protein kinase with a human thyroid RII-anchoring protein: cloning and characterization of the RII-binding domain. J. Biol. Chem. 267:13376-13382, 1992.

Carr, D. W.; Stofko-Hahn, R. E.; Fraser, I. D.; Bishop, S. M.; Acott, T. S.; Brennan, R. G.; Scott, J. D.: Interaction of the regulatory subunit (RII) of cAMP-dependent protein kinase with RII-anchoring proteins occurs through an amphipathic helix binding motif. J. Biol. Chem. 266:14188-14192, 1991.

Rubino, D.; Driggers, P.; Arbit, D.; Kemp, L.; Miller, B.; Coso, O.; Pagliai, K.; Gray, K.; Gutkind, S.; Segars, J.: characterization of Brx, a novel Dbl family member that modulates estrogen receptor action. Oncogene 16:2513-2526, 1998.

Sterpetti, P.; Hack, A. A.; Bashar, M. P.; Park, B.; Cheng, S.-D.; Knoll, J. H. M.; Urano, T.; Feig, L. A.; Toksoz, D.: Activation of the Lbc Rho exchange factor proto-oncogene by truncation of an extended C terminus that regulates transformation and targeting. Molec. Cell. Biol. 19:1334-1345, 1999.

Toksoz, D.; Williams, D. A.: Novel human oncogene lbc detected by transfection with distinct homology regions to signal transduction products. Oncogene 9:621-628, 1994.

Hirai, H.; Tanaka, K.; Yoshie, O.; Ogawa, K.; Kenmotsu, K.; Takamori, Y.; Ichimasa, M.; Sugamura, K.; Nakamura, M.; Takano, S.; Nagata, K.: Prostaglandin D2 selectively induces chemotaxis in T helper type 2 cells, eosinophils, and basophils via seven-transmembrane receptor CRTH2. J. Exp. Med. 193:255-261, 2001.

Margolis, R. L.; O'Hearn, E.; Rosenblatt, A.; Willour, V.; Holmes, S. E.; Franz, M. L.; Callahan, C.; Hwang, H. S.; Troncoso, J. C.; Ross, C. A.: A disorder similar to Huntington's disease is associated with a novel CAG repeat expansion. Ann. Neurol. 50:373-380, 2001.

Lacy, S. E.; Bonnemann, C. G.; Buzney, E. A.; Kunkel, L. M.: Identification of FLRT1, FLRT2, and FLRT3: a novel family of transmembrane leucine-rich repeat proteins. Genomics 62:417-426, 1999.

Fenster, S. D.; Chung, W. J.; Zhai, R.; Cases-Langhoff, C.; Voss, B.; Garner, A. M.; Kaempf, U.; Kindler, S.; Gundelfinger, E. D.; Garner, C. C.: Piccolo, a presynaptic zinc finger protein structurally related to Bassoon. Neuron 25:203-214, 2000.

Hayashi, T.; Huang, J.; Deeb, S. S.: RINX(VSX1), a novel homeobox gene expressed in the inner nuclear layer of the adult retina. Genomics 67:128-139, 2000.

Ohtoshi, A.; Justice, M. J.; Behringer, R. R.: Isolation and characterization of Vsx1, a novel mouse CVC paired-like homeobox gene expressed during embryogenesis and in the retina. Biochem. Biophys. Res. Commun. 286:133-140, 2001.

Semina, E. V.; Mintz-Hittner, H. A.; Murray, J. C.: Isolation and characterization of a novel human paired-like homeodomain-containing transcription factor gene, VSX1, expressed in ocular tissues. Genomics 63:289-293, 2000.

Horikoshi, N.; Cong, J.; Kley, N.; Shenk, T.: Isolation of differentially expressed cDNAs from p53-dependent apoptotic cells: activation of the human homologue of the Drosophila peroxidasin gene. Biochem. Biophys. Res. Commun. 261:864-869, 1999.

Weiler, S. R.; Taylor, S. M.; Deans, R. J.; Kan-Mitchell, J.; Mitchell, M. S.; Trent, J. M.: Assignment of a human melanoma associated gene MG50 (D2S448) to chromosome 2p25.3 by fluorescence in situ hybridization. Genomics 22:243-244, 1994.

Deng, H.; Unutmaz, D.; KewalRamani, V. N.; Littman, D. R.: Expression cloning of new receptors used by simian and human immunodeficiency viruses. Nature 388:296-300, 1997.

Liao, F.; Alkhatib, G.; Peden, K. W. C.; Sharma, G.; Berger, E. A.; Farber, J. M.: STRL33, a novel chemokine receptor-like protein, functions as a fusion cofactor for both macrophage-tropic and T cell line-tropic HIV-1. J. Exp. Med. 185: 2015-2023, 1997.

Matloubian, M.; David, A.; Engel, S.; Ryan, J. E.; Cyster, J. G.: A transmembrane CXC chemokine is a ligand for HIV-coreceptor Bonzo. Nature Immun. 1:298-304, 2000.

Fedele, M.; Benvenuto, G.; Pero, R.; Majello, B.; Battista, S.; Lembo, F.; Vollono, E.; Day, P. M.; Santoro, M.; Lania, L.; Bruni, C. B.; Fusco, A.; Chiariotti, L.: A novel member of the BTB/POZ family, PATZ, associates with the RNF4 RING finger protein and acts as a transcriptional repressor. J. Biol. Chem. 275:7894-7901, 2000.

Kobayashi, A.; Yamagiwa, H.; Hoshino, H.; Muto, A.; Sato, K.; Morita, M.; Hayashi, N.; Yamamoto, M.; Igarashi, K.: A combinatorial code for gene expression generated by transcription factor Bach 2 and MAZR (MAZ-related factor) through the BTB/POZ domain. Molec. Cell. Biol. 20:1733-1746, 2000.

McAleer, M. A.; Breen, M. A.; White, N. L.; Matthews, N.: pABC11 (also known as MOAT-C and MRP5), a member of the ABC family of proteins, has anion transporter activity but does not confer multidrug resistance when overexpressed in human embryonic kidney 293 cells. J. Biol. Chem. 274: 23541-23548, 1999.

Oguri, T.; Isobe, T.; Suzuki, T.; Nishio, K.; Fujiwara, Y.; Katoh, O.; Yamakido, M.: Increased expression of the MRP5 gene is associated with exposure to platinum drugs in lung cancer. Int. J. Cancer 86:95-100, 2000.

Suzuki, T.; Nishio, K.; Sasaki, H.; Kurokawa, H.; Saito-Ohara, F.; Ikeuchi, T.; Tanabe, S.; Terada, M.; Saijo, N.: cDNA cloning of a short type of multidrug resistance protein homologue, SMRP, from a human lung cancer cell line. Biochem. Biophys. Res. Commun. 238:790-794, 1997.

Suzuki, T.; Sasaki, H.; Kuh, H.-J.; Agui, M.; Tatsumi, Y.; Tanabe, S.; Terada, M.; Saijo, N.; Nishio, K.: Detailed structural analysis on both human MRP5 and mouse mrp5 transcripts. Gene 242:167-173,2000.

Wijnholds, J.; Mol, C. A. A. M.; van Deemter, L.; de Haas, M.; Scheffer, G. L.; Baas, F.; Beijnen, J. H.; Scheper, R. J.; Hatse, S.; De Clercq, E.; Balzarini, J.; Borst, P.: Multidrug-resistance protein 5 is a multispecific organic anion transporter able to transport nucleotide analogs. Proc. Nat. Acad. Sci. 97:7476-7481, 2000.

Dermaut, B.; Theuns, J.; Sleegers, K.; Hasegawa, H.; Van den Broeck, M.; Vennekens, K.; Corsmit, E.; St. George-Hyslop, P.; Cruts, M.; van Duijn, C. M.; Van Broeckhoven, C.: The gene encoding nicastrin, a major gamma-secretase component, modifies risk for familial early-onset Alzheimer disease in a Dutch population-based sample. Am. J. Hum. Genet. 70:1568-1574, 2002.

Feldman, R. G.; Chandler, K. A.; Levy, L. L.; Glaser, G. H.: Familial Alzheimer's disease. Neurology 13:811-824, 1963.

Foncin, J.-F.; Salmon, D.; Supino-Viterbo, V.; Feldman, R. G.; Macchi, G.; Mariotti, P.; Scoppetta, C.; Caruso, G.; Bruni, A. C.: Demence presenile d'Alzheimer transmise dans une famille etendue. Rev. Neurol. (Paris) 141:194-202, 1985.

Hiltunen, M.; Mannermaa, A.; Thompson, D.; Easton, D.; Pirskanen, M.; Helisalmi, S.; Koivisto, A. M.; Lehtovirta, M.; Ryynanen, M.; Soininen, H.: Genome-wide linkage disequilibrium mapping of late-onset Alzheimer's disease in Finland. Neurology 57:1663-1668, 2001.

Kehoe, P.; Wavrant-De Vrieze, F.; Crook, R.; Wu, W. S.; Holmans, P.; Fenton, I.; Spurlock, G.; Norton, N.; Williams, H.; Williams, N.; Lovestone, S.; Perez-Tur, J.; Hutton, J.; and 10 others: A full genome scan for late onset Alzheimer disease. Hum. Molec. Genet. 8:237-245, 1999.

Kopan, R.; Goate, A.: Aph-2/nicastrin: an essential component of gamma-secretase and regulator of Notch signaling and presenilin localization. Neuron 33:321-324, 2002.

Yu, G.; Nishimura, M.; Arawaka, S.; Levitan, D.; Zhang, L.; Tandon, A.; Song, Y.-Q.; Rogaeva, E.; Chen, F.; Kawarai, T.; Supala, A.; Levesque, L.; and 18 others: Nicastrin modulates presenilin-mediated notch/glp-1signal transduction and beta-APP processing. Nature 407:48-54,2000.

Zubenko, G. S.; Hughes, H. B.; Stiffler, J. S.; Hurtt, M. R.; Kaplan, B. B.: A genome survey for novel Alzheimer disease risk loci: results at 10-cM resolution. Genomics 50:121-128, 1998.

Arakawa, H.; Hauschild, J.; Buerstedde, J.-M.: Requirement of the activation-induced deaminase (AID) gene for immunoglobulin gene conversion. Science 295:1301-1306, 2002.

Fagarasan, S.; Kinoshita, K.; Muramatsu, M.; Ikuta, K.; Honjo, T.: In situ class switching and differentiation to IgA producing cells in the gut lamina propria. Nature 413:639-643, 2001.

Muramatsu, M.; Kinoshita, K.; Fagarasan, S.; Yamada, S.; Shinkai, Y.; Honjo, T.: Class switch recombination and hypermutation require activation-induced cytidine deaminase (AID), a potential RNA editing enzyme. Cell 102:553-563, 2000.

Muramatsu, M.; Sankaranand, V. S.; Anant, S.; Sugai, M.; Kinoshita, K.; Davidson, N. O.; Honjo, T.: Specific expression of activation-induced cytidine deaminase (AID), a novel member of the RNA-editing deaminase family in germinal center B cells. J. Biol. Chem. 274:18470-18476,1999.

Kasaian, M. T.; Whitters, M. J.; Carter, L. L.; Lowe, L. D.; Jussif, J. M.; Deng, B.; Johnson, K. A.; Witek, J. S.; Senices, M.; Konz, R. F.; Wurster, A. L.; Donaldson, D. D.; Collins, M.; Young, D. A.; Grusby, M. J.: IL-21 limits NK cell responses and promotes antigen-specific T cell activation: a mediator of the transition from innate to adaptive immunity. Immunity 16:559-569, 2002.

Zheng, P.; Eastman, J.; Vande Pol, S.; Pimplikar, S. W.: PAT1, a microtubule-interacting protein, recognizes the basolateral sorting signal of amyloid precursor protein. Proc. Nat. Acad. Sci. 95:14745-14750,1998.

Ozaki, K.; Kikly, K.; Michalovich, D.; Young, P. R.; Leonard, W. J.: Cloning of a type I cytokine receptor most related to the IL-2 receptor beta chain. Proc. Nat. Acad. Sci. 97:11439-11444, 2000.

Parrish-Novak, J.; Dillon, S. R.; Nelson, A.; Hammond, A.; Sprecher, C.; Gross, J. A.; Johnston, J.; Madden, K.; Xu, W.; West, J.; Schrader, S.; Burkhead, S.; and 26 others: Interleukin 21 and its receptor are involved in NK cell expansion and regulation of lymphocyte function. Nature 408:57-63, 2000.

Caffrey, J. J.; Hidaka, K.; Matsuda, M.; Hirata, M.; Shears, S. B.: The human and rat forms of multiple inositol polyphosphate phosphatase:functional homology with a histidine acid phosphatase up-regulated during endochondral ossification. FEBS Lett. 442:99-104, 1999.

Chi, H.; Tiller, G. E.; Dasouki, M. J.; Romano, P. R.; Wang, J.; O'Keefe, R. J.; Puzas, J. E.; Rosier, R. N.; Reynolds, P. R.: Multiple inositol polyphosphate phosphatase: evolution as a distinct group within the histidine phosphatase family and chromosomal localization of the human and mouse genes to chromosomes 10q23 and 19. Genomics 56:324-336, 1999.

Chi, H.; Yang, X.; Kingsley, P. D.; O'Keefe, R. J.; Puzas, J. E.; Rosier, R. N.; Shears, S. B.; Reynolds, P. R.: Targeted Deletion of Minpp1 provides new insight into the activity of multiple inositol polyphosphate phosphatase in vivo. Molec. Cell. Biol. 20:6496-6507,2000.

Gimm, O.; Chi, H.; Dahia, P. L. M.; Perren, A.; Hinze, R.; Komminoth, P.; Dralle, H.; Reynolds, P. R.; Eng, C.: Somatic mutation and germline variants of MINPP1, a phosphatase gene located in proximity to PTENon 10q23.3, in follicular thyroid carcinomas. J. Clin. Endocr. Metab. 86:1801-1805, 2001.

Reither, A.; Hehlmann, R.; Goldman, J. M.; Cross, N. C.: The 8p11 myeloproliferative syndrome. Med. Klin. 94:207-210, 1999.

Bartholin, L.; Maguer-Satta, V.; Hayette, S.; Martel, S.; Gadoux, M.; Bertrand, S.; Corbo, L.; Lamadon, C.; Morera, A.-M.; Magaud, J.-P.; Rimokh, R.: FLRG, an activin-binding protein, is a new target of TGF-beta transcription activation through Smad proteins. Oncogene 20:5409-5419, 2001.

Rimokh, R.; Berger, F.; Delsol, G.; Charrin, C.; Bertheas, M. F.; Ffrench, M.; Garoscio, M.; Felman, P.; Coiffier, C.; Bryon, P. A.: Rearrangement and overexpression of the BCL-1/PRAD-1 gene in intermediate lymphocytic lymphomas and in t (11q13)-bearing leukemias. Blood 81:3063-3067, 1993.

Bahou, W. F.; Campbell, A. D.; Wicha, M. S.: cDNA cloning and molecular characterization of MSE55, a novel human serum constituent protein that displays bone marrow stromal/endothelial cell-specific expression. J. Biol. Chem. 267:13986-13992, 1992.

Burbelo, P. D.; Drechsel, D.; Hall, A.: A conserved binding motif defines numerous candidate target proteins for both Cdc42 and RacGTPases. J. Biol. Chem. 270:29071-29074, 1995.

Bak, M.; Hansen, C.; Henriksen, K. F.; Tommerup, N.: The human hedgehog-interacting protein gene: structure and chromosome mapping to 4q31.21-q31.3. Cytogenet. Cell Genet. 92:300-303, 2001.

Chuang, P.-T.; McMahon, A. P.: Vertebrate hedgehog signalling modulated by induction of a hedgehog-binding protein. Nature 397:617-621, 1999.

Bacher, N.; Zisman, Y.; Berent, E.; Livneh, E.: Isolation and characterization of PKC-L, a new member of the protein kinase C-related gene family specifically expressed in lung, skin, and heart. Molec. Cell. Biol. 11:126-133, 1991.

Quan, T.; Fisher, G. J.: Cloning and characterization of the human protein kinase C-eta promoter. J. Biol. Chem. 274:28566-28574,1999.

Gong, T.-W. L.; Burmeister, M.; Lomax, M. I.: The novel gene D4Mil1 emaps to mouse chromosome 4 and human chromosome 1p36. Mammalian Genome 7:790-791, 1996.

Nangaku, M.; Sato-Yoshitake, R.; Okada, Y.; Noda, Y.; Takemura, R.; Yamazaki, H.; Hirokawa, N.: KIF1B, a novel microtubule plus end-directed monomeric motor protein for transport of mitochondria. Cell 79:1209-1220, 1994.

Saito, M.; Hayashi, Y.; Suzuki, T.; Tanaka, H.; Hozumi, I.; Tsuji, S.: Linkage mapping of the gene for Charcot-Marie-Tooth disease type2 to chromosome 1p (CMT2A) and the clinical features of CMT2A. Neurology 49:1630-1635, 1997.

Yang, H. W.; Chen, Y. Z.; Takita, J.; Soeda, E.; Piao, H. Y.; Hayashi, Y.: Genomic structure and mutational analysis of the human KIF1Bgene which is homozygously deleted in neuroblastoma at chromosome 1p36.2. Oncogene 20:5075-5083, 2001.

Suzuki, Y.; Demoliere, C.; Kitamura, D.; Takeshita, H.; Deuschle, U.; Watanabe, T.: HAX-1, a novel intracellular protein, localized on mitochondria, directly associates with HS1, a substrate of Src family tyrosine kinases. J. Immun. 158:2736-2744, 1997.

Dell'Angelica, E. C.; Puertollano, R.; Mullins, C.; Aguilar, R. C.; Vargas, J. D.; Hartnell, L. M.; Bonifacino, J. S.: GGAs: a family of ADP ribosylation factor-binding proteins related to adaptors and associated with the Golgi complex. J. Cell Biol. 149:81-93, 2000.

Hirst, J.; Lui, W. W. Y.; Bright, N. A.; Totty, N.; Seaman, M. N. J.; Robinson, M. S.: A family of proteins with gamma-adaptin and VHS domains that facilitate trafficking between the trans-Golgi network and the vacuole/lysosome. J. Cell Biol. 149:67-69, 2000.

Blumberg, H.; Conklin, D.; Xu, W.; Grossmann, A.; Brender, T.; Carollo, S.; Eagan, M.; Foster, D.; Haldeman, B. A.; Hammond, A.; Haugen, H.; Jelinek, L.; and 14 others: Interleukin 20: discovery, receptor identification, and role in epidermal function. Cell 104:9-19, 2001.

Huang, E. Y.; Madireddi, M. T.; Gopalkrishnan, R. V.; Leszczyniecka, M.; Su, Z.; Lebedeva, I. V.; Kang, D.; Jiang, H.; Lin, J. J.; Alexandre, D.; Chen, Y.; Vozhilla, N.: and 9 others: Genomic structure, chromosomal localization and expression profile of a novel melanoma differentiation associated (mda-7) gene with cancer specific growth suppressing and apoptosis inducing properties. Oncogene 20:7051-7063, 2001.

Jiang, H.; Lin, J. J.; Su, Z.-Z.; Goldstein, N. I.; Fisher, P. B.: Subtraction hybridization identifies a novel melanoma differentiation associated gene, mda-7, modulated during human melanoma differentiation, growth and progression. Oncogene 11:2477-2486, 1995.

Jiang, H.; Su, Z.-Z.; Lin, J. J.; Goldstein, N. I.; Young, C. S. H.; Fisher, P. B.: The melanoma differentiation associated gene mda-7 suppresses cancer cell growth. Proc. Nat. Acad. Sci. 93:9160-9165,1996.

Su, Z.; Madireddi, M. T.; Lin, J. J.; Young, C. S. H.; Kitada, S.; Reed, J. C.; Goldstein, N. I.; Fisher, P. B.: The cancer growth suppressor gene mda-7 selectively induces apoptosis in human breast cancer cells and inhibits tumor growth in nude mice. Proc. Nat. Acad. Sci. 95:14400-14405, 1998.

Mansour, S. J.; Skaug, J.; Zhao, X.-H.; Giordano, J.; Scherer, S. W.; Melancon, P.: p200 ARF-GEP1: a Golgi-localized guanine nucleotide exchange protein whose Sec7 domain is targeted by the drug brefeldin A. Proc. Nat. Acad. Sci. 96:7968-7973, 1999.

Morinaga, N.; Moss, J.; Vaughan, M.: Cloning and expression of a cDNA encoding a bovine brain brefeldin A-sensitive guanine nucleotide-exchange protein for ADP-ribosylation factor. Proc. Nat. Acad. Sci. 94:12926-12931,1997.

Morinaga, N.; Tsai, S.-C.; Moss, J.; Vaughan, M.: Isolation of a brefeldin A-inhibited guanine nucleotide-exchange protein for ADP ribosylation factor (ARF) 1 and ARF3 that contains a Sec7-like domain. Proc. Nat. Acad. Sci. 93:12856-12860, 1996.

Togawa, A.; Morinaga, N.; Ogasawara, M.; Moss, J.; Vaughan, M.: Purification and cloning of a brefeldin A-inhibited guanine nucleotide-exchange protein for ADP-ribosylation factors. J. Biol. Chem. 274:12308-12315,1999.

Ewen, M. E.; Xing, Y.; Lawrence, J. B.; Livingston, D. M.: molecular cloning, chromosomal mapping, and expression of the cDNA for p107, a retinoblastoma gene product-related protein. Cell 66:1155-1164,1991.

Huppi, K.; Siwarski, D.; Mock, B. A.; Dosik, J.; Hamel, P. A.:Molecular cloning, chromosomal mapping, and expression of the mouse p107 gene. Mammalian Genome 7:353-355, 1996.

Kim, K. K.; Soonpaa, M. H.; Wang, H.; Field, L. J.: Developmental expression of p107 mRNA and evidence for alternative splicing of the p107 (RBL1) gene product. Genomics 28:520-529, 1995.

LeCouter, J. E.; Kablar, B.; Hardy, W. R.; Ying, C.; Megeney, L. A.; May, L. L.; Rudnicki, M. A.: Strain-dependent myeloid hyperplasia, growth deficiency, and accelerated cell cycle in mice lacking the Rb-related p107 gene. Molec. Cell. Biol. 18:7455-7465, 1998.

Bonner, T. I.; Modi, W. S.; Seuanez, H. N.; O'Brien, S. J.: Chromosomal mapping of five human genes encoding muscarinic acetylcholine receptors. (Abstract) Cytogenet. Cell Genet. 58:1850-1851, 1991.

Anand, R.; Lindstrom, J.: Chromosomal localization of seven neuronal nicotinic acetylcholine receptor subunit genes in human S. Genomics 13:962-967, 1992.

Bessis, A.; Simon-Chazottes, D.; Devillers-Thiery, A.; Guenet, J.-L.; Changeux, J.-P.: Chromosomal localization of the mouse genes coding for alpha-2, alpha-3, alpha-4 and beta-2 subunits of neuronal nicotinic acetylcholine receptor. FEBS Lett. 264:48-52, 1990.

Boulter, J.; O'Shea-Greenfield, A.; Duvoisin, R. M.; Connolly, J. G.; Wada, E.; Jensen, A.; Gardner, P. D.; Ballivet, M.; Deneris, E. S.; McKinnon, D.; Heinemann, S.; Patrick, J.: Alpha 3, alpha 5 and beta 4: three members of the rat neuronal nicotinic acetylcholine receptor-related gene family form a gene cluster. J. Biol. Chem. 265:4472-4482,1990.

Duga, S.; Solda, G.; Asselta, R.; Bonati, M. T.; Dalpra, L.; Malcovati, M.; Tenchini, M. L.: Characterization of the genomic structure of the human neuronal nicotinic acetylcholine receptor CHRNA5/A3/B4 gene cluster and identification of novel intragenic polymorphisms. J. Hum. Genet. 46:640-648, 2001.

Digicaylioglu, M.; Lipton, S. A.: Erythropoietin-mediated neuroprotection involves cross-talk between Jak2 and NF-kappa-B signalling cascades. Nature 412:641-647, 2001.

Clancy, D. J.; Gems, D.; Harshman, L. G.; Oldham, S.; Stocker, H.; Hafen, E.; Leevers, S. J.; Partridge, L.: Extension of life-span by loss of CHICO, a Drosophila insulin receptor substrate protein. Science 292:104-106, 2001.

Bergsagel, P. L.; Chesi, M.; Nardini, E.; Brents, L. A.; Kirby, S. L.; Kuehl, W. M.: Promiscuous translocations into immunoglobulin heavy chain switch regions in multiple myeloma. Proc. Nat. Acad. Sci. 93:13931-13936, 1996.

Clausen, J. O.; Hansen, T.; Bjorbaek, C.; Echwald, S. M.; Urhammer, S. A.; Rasmussen, S.; Andersen, C. B.; Hansen, L.; Almind, K.; Winther, K.; Haraldsdottir, J.; Borch-Johnsen, K.; Pedersen, O.: Insulin resistance:interactions between obesity and a common variant of insulin receptor substrate-1. Lancet 346:397-402, 1995.

Esposito, D. L.; Mammarella, S.; Ranieri, A.; Loggia, F. D.; Capani, F.; Consoli, A.; Mariani-Costantini, R.; Caramia, F. G.; Cama, A.; Battista, P.: Deletion of gly723 in the insulin receptor substrate-1of a patient with noninsulin-dependent diabetes mellitus. Hum. Mutat. 7:364-366, 1996.

Hribal, M. L.; Federici, M.; Porzio, O.; Lauro, D.; Borboni, P.; Accili, D.; Lauro, R.; Sesti, G.: The gly-to-arg (972) amino acid polymorphism in insulin receptor substrate-1 affects glucose metabolism in skeletal muscle cells. J. Clin. Endocr. Metab. 85:2004-2013,2000.

Kido, Y.; Burks, D. J.; Withers, D.; Bruning, J. C.; Kahn, C. R.; White, M. F.; Accili, D.: Tissue-specific insulin resistance in mice with mutations in the insulin receptor, IRS-1, and IRS-2. J. Clin. Invest. 105:199-205, 2000.

Kulkarni, R. N.; Winnay, J. N.; Daniels, M.; Bruning, J. C.; Flier, S. N.; Hanahan, D.; Kahn, C. R.: Altered function of insulin receptor substrate-1-deficient mouse islets and cultured beta-cell lines. J. Clin. Invest. 104: R69-R75, 1999.

Laakso, M.; Malkki, M.; Kekalainen, P.; Kuusisto, J.; Deeb, S. S.: Insulin receptor substrate-1 variants in non-insulin-dependent diabetes. J. Clin. Invest. 94:1141-1146, 1994.

Myers, M. G., Jr.; Sun, X. J.; White, M. F.: The IRS-1 signaling system. Trends Biochem. Sci. 19:289-293, 1994.

Nishiyama, M.; Inazawa, J.; Ariyama, T.; Nakamura, Y.; Matsufuji, S.; Furusaka, A.; Tanaka, T.; Hayashi, S.; Wands, J. R.: The human insulin receptor substrate-1 gene (IRS1) is localized on 2q36. Genomics 20:139-141, 1994.

Nishiyama, M.; Wands, J. R.: Cloning and increased expression of an insulin receptor substrate-1-like gene in human hepatocellular carcinoma. Biochem. Biophys. Res. Commun. 183:280-285, 1992.

Ogata, N.; Chikazu, D.; Kubota, N.; Terauchi, Y.; Tobe, K.; Azuma, Y.; Ohta, T.; Kadowaki, T.; Nakamura, K.; Kawaguchi, H.: Insulin receptor substrate-1 in osteoblast is indispensable for maintaining bone turnover. J. Clin. Invest. 105:935-943, 2000.

Ogihara, T.; Isobe, T.; Ichimura, T.; Taoka, M.; Funaki, M.; Sakoda, H.; Onishi, Y.; Inukai, K.; Anai, M.; Fukushima, Y.; Kikuchi, M.; Yazaki, Y.; Oka, Y.; Asano, T.:14-3-3 protein binds to insulin receptor substrate-1, one of the binding sites of which is in the phosphotyrosine binding domain. J. Biol. Chem. 272:25267-25274, 1997.

Porzio, O.; Federici, M.; Hribal, M. L.; Lauro, D.; Accili, D.; Lauro, R.; Borboni, P.; Sesti, G.: The gly972-to-arg amino acid polymorphism in IRS-1 impairs insulin secretion in pancreatic beta cells. J. Clin. Invest. 104:357-364, 1999.

Stoffel, M.; Espinosa, R., III; Keller, S. R.; Lienhard, G. E.; Le Beau, M. M.; Bell, G. I.: Human insulin receptor substrate-1 gene (IRS1): chromosomal localization to 2q35-q36.1 and identification of a simple tandem repeat DNA polymorphism. Diabetologia 36:335-337,1993.

Sun, X. J.; Rothenberg, P.; Kahn, C. R.; Backer, J. M.; Araki, E.; Wilden, P. A.; Cahill, D. A.; Goldstein, B. J.; White, M. F.:Structure of the insulin receptor substrate IRS-1 defines a unique signal transduction protein. Nature 352:73-77, 1991.

Diaz, M. O.; Bohlander, S.: Nomenclature of the human interferon genes. J. Interferon Res. 13:443-444, 1993.

Henco, K.; Brosius, J.; Fujisawa, A.; Fujisawa, J.-I.; Haynes, J. R.; Hochstadt, J.; Kovacic, T.; Pasek, M.; Schambock, A.; Schmid, J.; Todokoro, K.; Walchli, M.; Nagata, S.; Weissmann, C.: Structural relationship of human interferon alpha genes and pseudogenes. J. Molec. Biol. 185:227-260, 1985.

Olopade, O. I.; Bohlander, S. K.; Pomykala, H.; Maltepe, E.; VanMelle, E.; Le Beau, M. M.; Diaz, M. O.: Mapping of the shortest region of overlap of deletions of the short arm of chromosome 9 associated with human neoplasia. Genomics 14:437-443, 1992.

Hogervorst, F.; Kuikman, I.; Geurts van Kessel, A.; Sonnenberg, A.: Molecular cloning of the human alpha-6 integrin subunit: alternative splicing of alpha-6 mRNA and chromosomal localization of the alpha-6 and beta-4 genes. Europ. J. Biochem. 199:425-433, 1991.

Chavanas, S.; Gache, Y.; Vailly, J.; Kanitakis, J.; Pulkkinen, L.; Uitto, J.; Ortonne, J.-P.; Meneguzzi, G.: Splicing modulation of integrin beta-4 pre-mRNA carrying a branch point mutation underlies epidermolysis bullosa with pyloric atresia undergoing spontaneous amelioration with ageing. Hum. Molec. Genet. 8:2097-2105, 1999.

Inoue, M.; Tamai, K.; Shimizu, H.; Owaribe, K.; Nakama, T.; Hashimoto, T.; McGrath, J. A.: A homozygous missense mutation in the cytoplasmic tail of beta-4 integrin, G931D, that disrupts hemidesmosome assembly and underlies non-Herlitz junctional epidermolysis bullosa without pyloric atresia? J. Invest. Derm. 114:1061-1064, 2000.

Mellerio, J. E.; Pulkkinen, L.; McMillan, J. R.; Lake, B. D.; Horn, H. M.; Tidman, M. J.; Harper, J. I.; McGrath, J. A.; Uitto, J.; Eady, R. A. J.: Pyloric atresia-junctional epidermolysis bullosa syndrome:mutations in the integrin beta-4 gene (ITGB4) in two unrelated patients with mild disease. Brit. J. Derm. 139:862-871, 1998.

Kool, M.; de Haas, M.; Scheffer, G. L.; Scheper, R. J.; van Eijk, M. J.; Juijn, J. A.; Baas, F.; Borst, P.: Analysis of expression of cMOAT (MRP2), MRP3, MRP4, and MRP5, homologues of the multidrug resistance-associated protein gene (MRP1), in human cancer cell lines. Cancer Res. 57:3537-3547, 1997.

Mahlknecht, U.; Schnittger, S.; Ottmann, O. G.; Schoch, C.; Mosebach, M.; Hiddemann, W.; Hoelzer, D.: Chromosomal organization and localization of the human histone deacetylase 5 gene (HDAC5). Biochim. Biophys. Acta 1493: 342-348, 2000.

McKinsey, T. A.; Zhang, C.-L.; Lu, J.; Olson, E. N.: Signal-dependent nuclear export of a histone deacetylase regulates muscle differentiation. Nature 408:106-111, 2000.

Bruce, H. A.; Margolis, R. L.: FOXP2: novel exons, splice variants, and CAG repeat length stability. Hum. Genet. 111: 136-144, 2002.

Enard, W.; Przeworski, M.; Fisher, S. E.; Lai, C. S. L.; Wiebe, V.; Kitano, T.; Monaco, A. P.; Paabo, S.: Molecular evolution of FOXP2, a gene involved in speech and language. Nature 418:869-872,2002.

Chesney, J.; Mitchell, R.; Benigni, F.; Bacher, M.; Spiegel, L.; Al-Abed, Y.; Han, J. H.; Metz, C.; Bucala, R.: An inducible gene product for 6-phosphofructo-2-kinase with an AU-rich instability element:role in tumor cell glycolysis and the Warburg effect. Proc. Nat. Acad. Sci. 96:3047-3052, 1999.

Manzano, A.; Rosa, J. L.; Ventura, F.; Perez, J. X.; Nadal, M.; Estivill, X.; Ambrosio, S.; Gil, J.; Bartrons, R.: Molecular cloning, expression, and chromosomal localization of a ubiquitously expressed human 6-phosphofructo-2-kinase/fructose-2,6-bisphosphatase gene (PFKFB3). Cytogenet. Cell Genet. 83:214-217, 1998.

Nicholl, J.; Hamilton, J. A.; Sutherland, G. R.; Sutherland, R. L.; Watts, C. K. W.: The third human isoform of 6-phosphofructo-2-kinase/fructose-2,6-bisphosphatase (PFKFB3) map position 10p14-p15. Chromosome Res. 5:150 only, 1997.

Sakai, A.; Kato, M.; Fukasawa, M.; Ishiguro, M.; Furuya, E.; Sakakibara, R.: Cloning of cDNA encoding for a novel isozyme of fructose 6-phosphate,2-kinase/fructose2,6-bisphosphatase from human placenta. J. Biochem. 119:506-511, 1996.

Newbury, D. F.; Bonora, E.; Lamb, J. A.; Fisher, S. E.; Lai, C. S. L.; Baird, G.; Jannoun, L.; Slonims, V.; Stott, C. M.; Merricks, M. J.; Bolton, P. F.; Bailey, A. J.; Monaco, A. P.; International Molecular Genetic Study of Autism Consortium: FOXP2 is not a major susceptibility gene for autism or specific language impairment. Am. J. Hum. Genet. 70:1318-1327, 2002.

Sakakibara, R.; Kato, M.; Okamura, N.; Nakagawa, T.; Komada, Y.; Tominaga, N.; Shimojo, M.; Fukasawa, M.: Characterization of a human placental fructose-6-phosphate, 2-kinase/fructose-2,6-bisphosphatase. J. Biochem. 122:122-128, 1997.

Manzano, A.; Perez, J. X.; Nadal, M.; Estivill, X.; Lange, A.; Bartrons, R.: Cloning, expression and chromosomal localization of a human testis 6-phosphofructo-2-kinase/fructose-2,6-bisphosphatase gene. Gene 229:83-89, 1999.

Hildebrand, J. D.; Taylor, J. M.; Parsons, T. J.: An SH3 domain-containing GTPase-activating protein for Rho and Cdc42 associates with focal adhesion kinase. Molec. Cell. Biol. 16:3169-3178, 1996.

Smith, D. E.; Renshaw, B. R.; Ketcham, R. R.; Kubin, M.; Garka, K. E.; Sims, J. E.: Four new members expand the interleukin-1 superfamily. J. Biol. Chem. 275:1169-1175, 2000.

Borkhardt, A.; Bojesen, S.; Haas, O. A.; Fuchs, U.; Bartelheimer, D.; Loncarevic, I. F.; Bohle, R. M.; Harbott, J.; Repp, R.; Jaeger, U.; Viehmann, S.; Henn, T.; Korth, P.; Scharr, D.; Lampert, F.: The human GRAF gene is fused to MLL in a unique t (5;11)(q31; q23) and both alleles are disrupted in three cases of myelodysplastic syndrome/acutemyeloid leukemia with a deletion 5q. Proc. Nat. Acad. Sci. 97:9168-9173, 2000.

Torrents, D.; Estevez, R.; Pineda, M.; Fernandez, E.; Lloberas, J.; Shi, Y.-B.; Zorzano, A.; Palacin, M.: Identification and characterization of a membrane protein (y (+)L amino acid transporter-1) that associates with 4F2hc to encode the amino acid transport activity y (+)L: a candidate gene for lysinuric protein intolerance. J. Biol. Chem. 273: 32437-32445,1998.

Cohen-Salmon, M.; Frenz, D.; Liu, W.; Verpy, E.; Voegeling, S.; Petit, C.: Fdp, a new fibrocyte-derived protein related to MIA/CD-RAP, has an in vitro effect on the early differentiation of the inner ear mesenchyme. J. Biol. Chem. 275:40036-40041, 2000.

Rendtorff, N. D.; Frodin, M.; Attie-Bitach, T.; Vekemans, M.; Tommerup, N.: Identification and characterization of an inner ear-expressed human melanoma inhibitory activity (MIA)-like gene (MIAL) with a frequent polymorphism that abolishes translation. Genomics 71:40-52, 2001.

Robertson, N. G.; Heller, S.; Lin, J. S.; Resendes, B. L.; Weremowicz, S.; Denis, C. S.; Bell, A. M.; Hudspeth, A. J.; Morton, C. C.: A novel conserved cochlear gene, OTOR: identification, expression analysis, and chromosomal mapping. Genomics 66:242-248, 2000.

Haft, C. R.; de la Luz Sierra, M.; Bafford, R.; Lesniak, M. A.; Barr, V. A.; Taylor, S. I.: Human orthologs of yeast vacuolar protein sorting proteins Vps26, 29, and 35: assembly into multimeric complexes. Molec. Biol. Cell 11:4105-4116, 2000.

Busfield, S. J.; Comrack, C. A.; Yu, G.; Chickering, T. W.; Smutko, J. S.; Zhou, H.; Leiby, K. R.; Holmgren, L. M.; Gearing, D. P.; Pan, Y.: Identification and gene organization of three novel members of the IL-1 family on human chromosome 2. Genomics 66:213-216, 2000.

Mulero, J. J.; Pace, A. M.; Nelken, S. T.; Loeb, D. B.; Correa, T. R.; Drmanac, R.; Ford, J. E.: IL1HY1: a novel interleukin-1 receptor antagonist gene. Biochem. Biophys. Res. Commun. 263:702-706, 1999.

Pratt, W. S.; Crawley, S.; Hicks, J.; Ho, J.; Nash, M.; Kim, Y. S.; Gum, J. R.; Swallow, D. M.: Multiple transcripts of MUC3: evidence for two genes, MUC3A and MUC3B. Biochem. Biophys. Res. Commun. 275:916-923, 2000.

Ishida, N.; Ito, M.; Yoshioka, S.; Sun-Wada, G.-H.; Kawakita, M.: Functional expression of human Golgi CMP-sialic acid transporter in the Golgi complex of a transporter-deficient Chinese hamster ovary cell mutant. J. Biochem. 124: 171-178, 1998.

Kobayashi, S.; Akiyama, T.; Nata, K.; Abe, M.; Tajima, M.; Shervani, N. J.; Unno, M.; Matsuno, S.; Sasaki, H.; Takasawa, S.; Okamoto, H.: Identification of a receptor for Reg (regenerating gene) protein, a pancreatic beta-cell regeneration factor. J. Biol. Chem. 275:10723-10726, 2000.

Van Hul, W.; Wuyts, W.; Hendrickx, J.; Speleman, F.; Wauters, J.; De Boulle, K.; Van Roy, N.; Bossuyt, P.; Willems, P. J.: Identification of a third EXT-like gene (EXTL3) belonging to the EXT gene family. Genomics 47:230-237, 1998.

Dowler, S.; Currie, R. A.; Downes, C. P.; Alessi, D. R.: DAPP1:a dual adaptor for phosphotyrosine and 3-phosphoinositides. Biochem. J. 342:7-12, 1999.

Marshall, A. J.; Niiro, H.; Lerner, C. G.; Yun, T. J.; Thomas, S.; Disteche, C. M.; Clark, E. A.: A novel B lymphocyte-associated adaptor protein, Bam 32, regulates antigen receptor signaling downstream of phosphatidyl inositol 3-kinase. J. Exp. Med. 191:1319-1331, 2000.

Black, B. E.; Levesque, L.; Holaska, J. M.; Wood, T. C.; Paschal, B. M.: Identification of an NTF2-related factor that binds Ran-GTP and regulates nuclear protein export. Molec. Cell. Biol. 19:8616-8624,1999.

Katahira, J.; Straber, K.; Podtelejnikov, A.; Mann, M.; Jung, J. U.; Hurt, E.: The Mex67p-mediated nuclear mRNA export pathway is conserved from yeast to human. EMBO J. 18:2593-2609, 1999.

Ossareh-Nazari, B.; Maison, C.; Black, B. E.; Levesque, L.; Paschal, B. M.; Dargemont, C.: RanGTP-binding protein NXT1 facilitates nuclear export of different classes of RNA in vitro. Molec. Cell. Biol. 20:4562-4571, 2000.

Scott, A. F.: Personal Communication. Baltimore, Md. Apr. 3, 2001.

Pati, D.; Meistrich, M. L.; Plon, S. E.: Human Cdc34 and Rad6 Bubiquitin-conjugating enzymes target repressors of cyclic AMP-induced transcription for proteolysis. Molec. Cell. Biol. 19:5001-5013,1999.

Matsuda, S.; Iriyama, C.; Yokozaki, S.; Ichigotani, Y.; Shirafuji, N.; Yamaki, K.; Hayakawa, T.; Hamaguchi, M.: Cloning and sequencing of a novel human gene that encodes a putative target protein of Nesh-SH3. J. Hum. Genet. 46:483-486, 2001.

Matsuyoshi, N.; Tanaka, T.; Toda, K.; Imamura, S.: Identification of novel cadherins expressed in human melanoma cells. J. Invest. Derm. 108:908-913, 1997.

Chen, K.-S.; DeLuca, H. F.: Isolation and characterization of a novel cDNA from HL-60 cells treated with 1,25-dihydroxy vitamin D-3. Biochim. Biophys. Acta 1219:26-32, 1994.

Ludwig, D. L.; Kotanides, H.; Le, T.; Chavkin, D.; Bohlen, P.; Witte, L.: Cloning, genetic characterization, and chromosomal mapping of the mouse VDUP1 gene. Gene 269:103-112, 2001.

Li, Y.; Chin, L.-S.; Weigel, C.; Li, L.: Spring, a novel RING finger protein that regulates synaptic vesicle exocytosis. J. Biol. Chem. 276:40824-40833, 2001.

Reymond, A.; Meroni, G.; Fantozzi, A.; Merla, G.; Cairo, S.; Luzi, L.; Riganelli, D.; Zanaria, E.; Messali, S.; Cainarca, S.; Guffanti, A.; Minucci, S.; Pelicci, P. G.; Ballabio, A.: The tripartite motif family identifies cell compartments. EMBO J. 20:2140-2151, 2001.

Scardigli, R.; Schuurmans, C.; Gradwohl, G.; Guillemot, F.: Cross regulation between neurogenin 2 and pathways specifying neuronal identity in the spinal cord. Neuron 31:203-217, 2001.

Boles, K. S.; Mathew, P. A.: Molecular cloning of CS1, a novel human natural killer cell receptor belonging to the CD2 subset of the immunoglobulin superfamily. Immunogenetics 52:302-307, 2001.

Bouchon, A.; Cella, M.; Grierson, H. L.; Cohen, J. I.; Colonna, M.: Cutting edge: activation of NK cell-mediated cytotoxicity by a SAP-independent receptor of the CD2 family. J. Immun. 167:5517-5521,2001.

Habas, R.; Kato, Y.; He, X.: Wnt/Frizzled activation of Rho regulates vertebrate gastrulation and requires a novel Formin homology protein Daam1. Cell 107:843-854, 2001.

Peters, C. S.; Liang, X.; Li, S.; Kannan, S.; Peng, Y.; Taub, R.; Diamond, R. H.: ATF-7, a novel bZIP protein, interacts with the PRL-1 protein-tyrosine phosphatase. J. Biol. Chem. 276:13718-13726, 2001.

White, J. H.; McIllhinney, R. A. J.; Wise, A.; Ciruela, F.; Chan, W.-Y.; Emson, P. C.; Billinton, A.; Marshall, F. H.: The GABA-B receptor interacts directly with the related transcription factors CREB2 and ATFx. Proc. Nat. Acad. Sci. 97:13967-13972, 2000.

Burgess, D. L.; Davis, C. F.; Gefrides, L. A.; Noebels, J. L.:Identification of three novel Ca (2+) channel gamma subunit genes reveals molecular diversification by tandem and chromosome duplication. Genome Res. 9:1204-1213, 1999.

Burgess, D. L.; Gefrides, L. A.; Foreman, P. J.; Noebels, J. L.: A cluster of three novel Ca (2+) channel gamma subunit genes on chromosome 19q13.4: evolution and expression profile of the gamma subunit gene family. Genomics 71:339-350, 2001.

Chu, P.-J.; Robertson, H. M.; Best, P. M.: Calcium channel gamma subunits provide insights into the evolution of this gene family. Gene 280:37-48, 2001.

Chen, X.; Wen, S.; Fukuda, M. N.; Gavva, N. R.; Hsu, D.; Akama, T. O.; Yang-Feng, T.; Shen, C. K. J.: Human ITCH is a coregulator of the hematopoietic transcription factor NF-E2. Genomics 73:238-241,2001.

D'Andrea, A. D.; Serhan, C. N.: Relieving the Itch. Nature Genet. 18:97-99, 1998.

Perry, W. L.; Hustad, C. M.; Swing, D. A.; O'Sullivan, T. N.; Jenkins, N. A.; Copeland, N. G.: The itchy locus encodes a novel ubiquitin protein ligase that is disrupted in a 18H mice. Nature Genet. 18:143-146, 1998.

Qiu, L.; Joazeiro, C.; Fang, N.; Wang, H.-Y.; Elly, C.; Altman, Y.; Fang, D.; Hunter, T.; Liu, Y.-C.: Recognition and ubiquitination of Notch by Itch, a Hect-type E3 ubiquitin ligase. J. Biol. Chem. 275:35734-35737, 2000.

Winberg, G.; Matskova, L.; Chen, F.; Plant, P.; Rotin, D.; Gish, G.; Ingham, R.; Ernberg, I.; Pawson, T.: Latent membrane protein 2A of Epstein-Barr virus binds WW domain E3 protein-ubiquitin ligases that ubiquitinate B-cell tyrosine kinases. Molec. Cell. Biol. 20:8526-8535, 2000.

Bradley, K. A.; Mogridge, J.; Mourez, M.; Collier, R. J.; Young, J. A. T.: Identification of the cellular receptor for anthrax toxin. Nature 414:160-161, 2001.

Dragon, F.; Pogacic, V.; Filipowicz, W.: In vitro assembly of human H/ACA small nucleolar RNPs reveals unique features of U17 and telomerase RNAs. Molec. Cell. Biol. 20:3037-3048, 2000.

Tollervey, D.; Kiss, T.: Function and synthesis of small nucleolar RNAs. Curr. Opin. Cell Biol. 9:337-342, 1997.

Ichtchenko, K.; Nguyen, T.; Sudhof, T. C.: Structures, alternative splicing, and neurexin binding of multiple neuroligins. J. Biol. Chem. 271:2676-2682, 1996.

Hammarsund, M.; Wilson, W.; Corcoran, M.; Merup, M.; Einhorn, S.; Grander, D.; Sangfelt, O.: Identification and characterization of two novel human mitochondrial elongation factor genes, hEFG2 and hEFG1, phylogenetically conserved through evolution. Hum. Genet. 109:542-550,2001.

Ishibashi, K.; Suzuki, M.; Sasaki, S.; Imai, M.: Identification of a new multigene four-transmembrane family (MS4A) related to CD20, HTm4 and beta subunit of the high-affinity IgE receptor. Gene 264:87-93, 2001.

Liang, Y.; Tedder, T. F.: Identification of a CD20-, Fc-epsilon-RI-beta-related gene family: sixteen new MS4A family members expressed in human and mouse. Genomics 72:119-127, 2001.

Ishii, H.; Vecchione, A.; Murakumo, Y.; Baldassarre, G.; Numata, S.; Trapasso, F.; Alder, H.; Baffa, R.; Croce, C. M.: FEZ1/LZTS1gene at 8p22 suppresses cancer cell growth and regulates mitosis. Proc. Nat. Acad. Sci. 98:10374-10379, 2001.

Druck, T.; Podolski, J.; Byrski, T.; Wyrwicz, L.; Zajaczek, S.; Kata, G.; Borowka, A.; Lubinski, J.; Huebner, K.: The DIRC1 gene at chromosome 2q33 spans a familial RCC-associated t (2;3)(q33; q21) chromosome translocation. J. Hum. Genet. 46:583-589, 2001.

Podolski, J.; Zajaczek, S.; Byrski, T.; Druck, T.; Zimonjic, D. B.; Popescu, N. C.; Lubinski, J.; Huebner, K.: Characterization of a familial RCC-associated t (2;3)(q33; q21) chromosome translocation. J. Hum. Genet. in-press, 2001.

Bruick, R. K.; McKnight, S. L.: A conserved family of prolyl-4-hydroxylases that modify HIF. Science 294:1337-1340, 2001.

Epstein, A. C. R.; Gleadle, J. M.; McNeill, L. A.; Hewitson, K. S.; O'Rourke, J.; Mole, D. R.; Mukherji, M.; Metzen, E.; Wilson, M. I.; Dhanda, A.; Tian, Y.-M.; Masson, N.; Hamilton, D. L.; Jaakkola, P.; Barstead, R.; Hodgkin, J.; Maxwell, P. H.; Pugh, C. W.; Schofield, C. J.; Ratcliffe, P. J.: C. elegans EGL-9 and mammalian homologs define a family of dioxygenases that regulate HIF by prolyl hydroxylation. Cell 107: 43-54, 2001.

Dupuy, D.; Aubert, I.; Duperat, V. G.; Petit, J.; Taine, L.; Stef, M.; Bloch, B.; Arveiler, B.: Mapping, characterization, and expression analysis of the SM-20 human homologue, C1orf12, and identification of a novel related gene, SCAND2. Genomics 69:348-354, 2000.

Ritter, J. K.; Crawford, J. M.; Owens, I. S.: Cloning of two human liver bilirubin UDP-glucuronosyl transferase cDNAs with expression in COS-1 cells. J. Biol. Chem. 266:1043-1047, 1991.

Szostecki, C.; Guldner, H. H.; Netter, H. J.; Will, H.: Isolation and characterization of cDNA encoding a human nuclear antigen predominantly recognized by auto antibodies from patients with primary biliary cirrhosis. J. Immun. 145: 4338-4347, 1990.

Freeman, G. J.; Disteche, C. M.; Gribben, J. G.; Adler, D. A.; Freedman, A. S.; Dougery, J.; Nadler, L. M.: The gene for B7, a costimulatory signal for T-cell activation, maps to chromosomal region 3q13.3-3q21. Blood 79:489-494, 1992.

Reeves, R. H.; Patch, D.; Sharpe, A. H.; Borriello, F.; Freeman, G. J.; Edelhoff, S.; Disteche, C.: The costimulatory genes Cd80 and Cd86 are linked on mouse chromosome 16 and human chromosome 3. Mammalian Genome 8:581-582, 1997.

Selvakumar, A.; Mohanraj, B. K.; Eddy, R. L.; Shows, T. B.; White, P. C.; Dupont, B.: Genomic organization and chromosomal location of the human gene encoding the B-lymphocyte activation antigen B7. Immunogenetics 36:175-181, 1992.

Liang, Y.; Buckley, T. R.; Tu, L.; Langdon, S. D.; Tedder, T. F.: Structural organization of the human MS4A gene cluster on chromosome 11q12. Immunogenetics 53:357-368, 2001.

Tedder, T. F.; Disteche, C. M.; Louie, E.; Adler, D. A.; Croce, C. M.; Schlossman, S. F.; Saito, H.: The gene that encodes the human CD20 (B1) differentiation antigen is located on chromosome 11 near the t (11;14)(q13; q32) translocation site. J. Immun. 142:2555-2559,1989.

Tedder, T. F.; Klejman, G.; Schlossman, S. F.; Saito, H.: Structure of the gene encoding the human B lymphocyte differentiation antigen CD20 (B1). J. Immun. 142:2560-2568, 1989.

Tedder, T. F.; Streuli, M.; Schlossman, S. F.; Saito, H.: Isolation and structure of a cDNA encoding the B1 (CD20) cell-surface antigen of human B lymphocytes. Proc. Nat. Acad. Sci. 85:208-212, 1988.

Hopken, U. E.; Lu, D.; Gerard, N. P.; Gerard, C.: The C5a chemoattractant receptor mediates mucosal defense to infection. Nature 383:86-89,1996.

Gold, P.; Freedman, S. O.: Demonstration of tumor-specific antigens in human colonic carcinomata by immunological tolerance and absorption techniques. J. Exp. Med. 121: 439-462, 1965.

Kamarck, M. E.; Elting, J. J.; Hart, J. T.; Goebel, S. J.; Rae, P. M. M.; Nothdurft, M. A.; Nedwin, J. J.; Barnett, T. R.: Carcinoembryonic antigen family: expression in a mouse L-cell transfectant and characterization of a partial cDNA in bacteriophage lambda-gt11. Proc. Nat. Acad. Sci. 84:5350-5354, 1987.

Nishi, M.; Inazawa, J.; Inoue, K.; Nakagawa, H.; Taniwaki, M.; Misawa, S.; Oikawa, S.; Nakazato, H.; Abe, T.: Regional chromosomal assignment of carcinoembryonic antigen gene (CEA) to chromosome 19at band q13.2. Cancer Genet. Cytogenet. 54:77-81, 1991.

Oikawa, S.; Nakazato, H.; Kosaki, G.: Primary structure of human carcinoembryonic antigen (CEA) deduced from cDNA sequence. Biochem. Biophys. Res. Commun. 142: 511-528, 1987.

Thompson, J.; Zimmermann, W.: The carcinoembryonic antigen gene family: structure, expression and evolution. Tumor Biol. 9:63-83,1988.

Thompson, J. A.; Pande, H.; Paxton, R. J.; Shively, L.; Padma, A.; Simmer, R. L.; Todd, C. W.; Riggs, A. D.; Shively, J. E.: molecular cloning of a gene belonging to the carcinoembryonic antigen gene family and discussion of a domain model. Proc. Nat. Acad. Sci. 84:2965-2969,1987.

Willcocks, T. C.; Craig, I. W.: Characterization of the genomic organization of human carcinoembryonic antigen (CEA): comparison with other family members and sequence analysis of 5-prime controlling region. Genomics 8:492-500, 1990.

Willcocks, T. C.; Craig, S. P.; Coates, D.; Craig, I. W.: Coding sequences for carcinoembryonic antigen (CEA) assigned to human chromosome 19q13. (Abstract) Cytogenet. Cell Genet. 46:716 only, 1987.

Zimmer, R.; Thomas, P.: Mutations in the carcinoembryonic antigen gene in colorectal cancer patients: implications on liver metastasis. Cancer Res. 61:2822-2826, 2001.

Zimmermann, W.; Ortlieb, B.; Friedrich, R.; von Kleist, S.: Isolation and characterization of cDNA clones encoding the human carcinoembryonic antigen reveal a highly conserved repeating structure. Proc. Nat. Acad. Sci. 84:2960-2964, 1987.

Zimmermann, W.; Weber, B.; Ortlieb, B.; Rudert, F.; Schempp, W.; Fiebig, H.-H.; Shively, J. E.; von Kleist, S.; Thompson, J. A.: Chromosomal localization of the carcinoembryonic antigen gene family and differential expression in various tumors. Cancer Res. 48:2550-2554, 1988.

Schuback, D.; Kramer, P.; Ozelius, L.; Holmgren, G.; Forsgren, L.; Kyllerman, M.; Wahlstrom, J.; Craft, C. M.; Nygaard, T.; Brin, M.; de Leon, D.; Bressman, S.; Moskowitz, C. B.; Burke, R. E.; Sanner, G.; Drugge, U.; Gusella, J. F.; Fahn, S.; Breakefield, X. O.: Dopamine beta-hydroxylase gene excluded in four subtypes of hereditary dystonia. Hum. Genet. 87:311-316, 1991.

Arahata, K.; Hayashi, Y. K.; Mizuno, Y.; Yoshida, M.; Ozawa, E.: Dystrophin-associated glycoprotein and dystrophin co-localisation at sarcolemma in Fukuyama congenital muscular dystrophy. (Letter) Lancet 342:623-624, 1993.

Campanelli, J. T.; Roberds, S. L.; Campbell, K. P.; Scheller, R. H.: A role for dystrophin-associated glycoproteins and utrophin in agrin-induced AChR clustering. Cell 77:663-674, 1994.

Cao, W.; Henry, M. D.; Borrow, P.; Yamada, H.; Elder, J. H.; Ravkov, E. V.; Nichol, S. T.; Compans, R. W.; Campbell, K. P.; Oldstone, M. B. A.: Identification of alpha-dystroglycan as a receptor for lymphocytic choriomeningitis virus and Lassa fever virus. Science 282:2079-2081,1998.

Ottman, R.; Risch, N.; Hauser, W. A.; Pedley, T. A.; Lee, J. H.; Barker-Cummings, C.; Lustenberger, A.; Nagle, K. J.; Lee, K. S.; Scheuer, M. L.; Neystat, M.; Susser, M.; Wilhelmsen, K. C.: Localization of a gene for partial epilepsy to chromosome 10q. Nature Genet. 10:56-60, 1995.

Stogmann, E.; Zimprich, A.; Baumgartner, C.; Aull-Watschinger, S.; Hollt, V.; Zimprich, F.: A functional polymorphism in the prodynorphin gene promoter is associated with temporal lobe epilepsy. Ann. Neurol. 51:260-263, 2002.

Summar, M. L.; Phillips, J. A., III; Battey, J.; Castiglione, C. M.; Kidd, K. K.; Maness, K. J.; Weiffenbach, B.; Gravius, T. C.:Linkage relationships of human arginine vasopressin-neurophysin-II and oxytocin-neurophysin-I to prodynorphin and other loci on chromosome 20. Molec. Endocr. 4:947-950, 1990.

Zimprich, A.; Kraus, J.; Woltje, M.; Mayer, P.; Rauch, E.; Hollt, V.: An allelic variation in the human prodynorphin gene promoter alters stimulus-induced expression. J. Neurochem. 74:472-477, 2000.

Craig, S. P.; Day, I. N. M.; Thompson, R. J.; Craig, I. W.: Localization of human neurone-specific enolase to chromosome 12p13. (Abstract) Cytogenet. Cell Genet. 51:980 only, 1989.

Craig, S. P.; Day, I. N. M.; Thompson, R. J.; Craig, I. W.: Localisation of neurone-specific enolase (ENO2) to 12p13. Cytogenet. Cell Genet. 54:71-73, 1990.

Feo, S.; Oliva, D.; Barbieri, G.; Xu, W.; Fried, M.; Giallongo, A.: The gene for the muscle-specific enolase is on the short arm of human chromosome 17. Genomics 6:192-194, 1990.

Grzeschik, K.-H.: Assignment of human genes: beta-glucuronidase to chromosome 7, adenylate kinase-1 to 9, a second enzyme with enolase activity to 12, and mitochondrial IDH to 15. Cytogenet. Cell Genet. 16:142-148, 1976. Note: Alternate: Birth Defects Orig. Art. Ser. 12(7):142-148, 1976.

Herbschleb-Voogt, E.; Monteba-van Heuvel, M.; Wijnen, L. M. M.; Westerveld, A.; Pearson, P. L.; Meera Khan, P.: Chromosomal assignment and regional localization of CS, ENO-2, GAPDH, LDH-B, PEP-B and TPI in man-rodent cell hybrids. Cytogenet. Cell Genet. 22:482-486,1978.

Hinks, L. J.; Day, I. N. M.: Further studies of enolase loci.(Abstract) Cytogenet. Cell Genet. 58:1854 only, 1991.

Law, M. L.; Kao, F.: Regional mapping of the gene coding for enolase-2 on human chromosome 12. J. Cell Sci. 53:245-254, 1982.

Mattei, J. F.; Baeteman, M. A.; Mattei, M. G.; Ardissonne, J. P.; Giraud, F.: Regional assignments of CS and ENO2 on chromosome 12. (Abstract) Cytogenet. Cell Genet. 32:297 only, 1982.

Oliva, D.; Cali, L.; Feo, S.; Giallongo, A.: Complete structure of the human gene encoding neuron-specific enolase. Genomics 10:157-165, 1991.

Jenkins, N. A.; Justice, M. J.; Gilbert, D. J.; Chu, M.-L.; Copeland, N. G.: Nidogen/entactin (Nid) maps to the proximal end of mouse chromosome 13 linked to beige (bg) and identifies a new region of homology between mouse and human chromosomes. Genomics 9:401-403, 1991.

Olavesen, M. G.; Bentley, E.; Mason, R. V. F.; Stephens, R. J.; Ragoussis, J.: Fine mapping of 39 ESTs on human chromosome 6p23-p25. Genomics 46:303-306, 1997.

Griffin, C. A.; Emanuel, B. S.; Hansen, J. R.; Cavenee, W. K.; Myers, J. C.: Human collagen genes encoding basement membrane alpha-1(IV) and alpha-2(IV) chains map to the distal long arm of chromosome 13. Proc. Nat. Acad. Sci. 84:512-516, 1987.

Reynolds, F. H., Jr.; Todaro, G. J.; Fryling, C.; Stephenson, J. R.: Human transforming growth factors induce tyrosine phosphorylation of EGF receptors. Nature 292:259-262, 1981.

Shimizu, N.; Behzadian, M. A.; Shimizu, Y.: Genetics of cell surface receptors for bioactive polypeptides: binding of epidermal growth factor is associated with the presence of human chromosome 7 in human-mouse cell hybrids. Proc. Nat. Acad. Sci. 77:3600-3604,1980.

Sibilia, M.; Fleischmann, A.; Behrens, A.; Stingl, L.; Carroll, J.; Watt, F. M.; Schlessinger, J.; Wagner, E. F.: The EGF receptor provides an essential survival signal for SOS-dependent skin tumor development. Cell 102:211-220, 2000.

Silver, J.; Whitney, J. B., III; Kozak, C.; Hollis, G.; Kirsch, I.: Erbb is linked to the alpha-globin locus on mouse chromosome 11. Molec. Cell. Biol. 5:1784-1786, 1985.

Spurr, N. K.; Goodfellow, P. N.; Solomon, E.; Parkar, M.; Vennstrom, B.; Bodmer, W. F.: Mapping of cellular oncogenes; erb B on chromosome 7. (Abstract) Cytogenet. Cell Genet. 37:590 only, 1984.

Spurr, N. K.; Solomon, E.; Jansson, M.; Sheer, D.; Goodfellow, P. N.; Bodmer, W. F.; Vennstrom, B.: Chromosomal localisation of the human homologues to the oncogenes erb A and B. EMBO J. 3:159-163,1984.

Thaung, C.; West, K.; Clark, B. J.; McKie, L.; Morgan, J. E.; Arnold, K.; Nolan, P. M.; Peters, J.; Hunter, A. J.; Brown, S. D. M.; Jackson, I. J.; Cross, S. H.: Novel ENU-induced eye mutations in the mouse: models for human eye disease. Hum. Molec. Genet. 11:755-767, 2002.

Ullrich, A.; Coussens, L.; Hayflick, J. S.; Dull, T. J.; Gray, A.; Tam, A. W.; Lee, J.; Yarden, Y.; Libermann, T. A.; Schlessinger, J.; Downward, J.; Mayes, E. L. V.; Whittle, N.; Waterfield, M. D.; Seeburg, P. H.: Human epidermal growth factor receptor cDNA sequence and aberrant expression of the amplified gene in A431 epidermoid carcinoma cells. Nature 309:418-425, 1984.

Verveer, P. J.; Wouters, F. S.; Reynolds, A. R.; Bastiaens, P. I. H.: Quantitative imaging of lateral ErbB1 receptor signal propagation in the plasma membrane. Science 290:1567-1570, 2000.

Wakeling, E. L.; Abu-Amero, S. N.; Stanier, P.; Preece, M. A.; Moore, G. E.: Human EGFR, a candidate gene for the Silver-Russell syndrome, is biallelically expressed in a wide range of fetal tissues. Europ. J. Hum. Genet. 6:158-164, 1998.

Yang, E.-B.; Wang, D.-F.; Mack, P.; Cheng, L.-Y.: Genistein, a tyrosine kinase inhibitor, reduces EGF-induced EGF receptor internalization and degradation in human hepatoma HepG2 cells. Biochem. Biophys. Res. Commun. 224:309-317, 1996.

Baumann, C. A.; Ribon, V.; Kanzaki, M.; Thurmond, D. C.; Mora, S.; Shigematsu, S.; Bickel, P. E.; Pessin, J. E.; Saltiel, A. R.:CAP defines a second signalling pathway required for insulin-stimulated glucose transport. Nature 407:202-207, 2000.

Bickel, P. E.; Scherer, P. E.; Schnitzer, J. E.; Oh, P.; Lisanti, M. P.; Lodish, H. F.: Flotillin and epidermal surface antigen define a new family of caveolae-associated integral membrane proteins. J. Biol. Chem. 272:13793-13802, 1997.

Cho, Y.-J.; Chema, D.; Moskow, J. J.; Cho, M.; Schroeder, W. T.; Overbeek, P.; Buchberg, A. M.; Duvic, M.: Epidermal surface antigen (MS17S1) is highly conserved between mouse and human. Genomics 27:251-258, 1995.

Kayes, L. M.; Schroeder, W. T.; Marchuk, D. A.; Collins, F. S.; Riccardi, V. M.; Duvic, M.; Stephens, K.: The gene for a novel epidermal antigen maps near the neurofibromatosis 1 gene. Genomics 14:369-376,1992.

Schroeder, W. T.; Siciliano, M. J.; Stewart-Galetka, S. L.; Duvic, M.: The human gene for an epidermal surface antigen (M17S1) is located at 17q11-12. Genomics 11:481-482, 1991.

Schroeder, W. T.; Stephens, K.; Stewart-Galetka, S.; Riccardi, V.; Duvic, M.: The gene for an epidermal surface antigen is in close proximity to the locus for von Recklinghausen neurofibromatosis. (Abstract) Clin. Res. 39:323A only, 1991.

Cohn, R. D.; Henry, M. D.; Michele, D. E.; Barresi, R.; Saito, F.; Moore, S. A.; Flanagan, J. D.; Skwarchuk, M. W.; Robbins, M. E.; Mendell, J. R.; Williamson, R. A.; Campbell, K. P.: Disruption of Dag1 in differentiated skeletal muscle reveals a role for dystroglycan in muscle regeneration. Cell 110:639-648, 2002.

Matsuoka, R.; Yoshida, M. C.; Furutani, Y.; Imamura, S.; Kanda, N.; Yanagisawa, M.; Masaki, T.; Takao, A.: Human smooth muscle myosin heavy chain gene mapped to chromosomal region 16q12. Am. J. Med. Genet. 46:61-67, 1993.

Apperley, J. F.; Gardembas, M.; Melo, J. V.; Russell-Jones, R.; Bain, B. J.; Baxter, E. J.; Chase, A.; Chessells, J. M.; Colombat, M.; Dearden, C. E.; Dimitrijevic, S.; Mahon, F.-X.; Marin, D.; Nikolova, Z.; Olavarria, E.; Silberman, S.; Schultheis, B.; Cross, N. C. P.; Goldman, J. M.: Response to imatinib mesylate in patients with chronic myeloproliferative diseases with rearrangements of the platelet-derived growth factor receptor beta. New Eng. J. Med. 347:481-487, 2002.

Matsuoka, R.; Yoshida, M. C.; Kanda, N.; Furutani, Y.; Bruns, G.; Yanagisawa, M.; Masaki, T.; Takao, A.: Human smooth muscle myosin heavy-chain gene mapped to chromosomal region 16q12.1-q12.2. (Abstract) Cytogenet. Cell Genet. 58:2000-2001, 1991.

Spear, P. G.: A welcome mat for leprosy and Lassa fever. Science 282:1999-2000, 1998.

Tinsley, J. M.; Blake, D. J.; Zuellig, R. A.; Davies, K. E.:Increasing complexity of the dystrophin-associated protein complex. Proc. Nat. Acad. Sci. 91:8307-8313, 1994.

Williamson, R. A.; Henry, M. D.; Daniels, K. J.; Hrstka, R. F.; Lee, J. C.; Sunada, Y.; Ibraghimov-Beskrovnaya, O.; Campbell, K. P.: Dystroglycan is essential for early embryonic development: disruption of Reichert's membrane in Dag1-null mice. Hum. Molec. Genet. 6:831-841, 1997.

Yamada, H.; Denzer, A. J.; Hori, H.; Tanaka, T.; Anderson, L. V. B.; Fujita, S.; Fukuta-Ohi, H.; Shimizu, T.; Ruegg, M. A.; Matsumura, K.: Dystroglycan is a dual receptor for agrin and laminin-2 in Schwann cell membrane. J. Biol. Chem. 271:23418-23423, 1996.

Rambukkana, A.; Yamada, H.; Zanazzi, G.; Mathus, T.; Salzer, J. L.; Yurchenco, P. D.; Campbell, K. P.; Fischetti, V. A.: Role of alpha-dystroglycan as a Schwann cell receptor for Mycobacterium leprae. Science 282:2076-2078, 1998.

Sealock, R.; Froehner, S. C.: Dystrophin-associated proteins and synapse formation: is alpha-dystroglycan the agrin receptor? Cell 77:617-619, 1994.

Yamada, H.; Saito, F.; Fukuta-Ohi, H.; Zhong, D.; Hase, A.; Arai, K.; Okuyama, A.; Maekawa, R.; Shimizu, T.; Matsumura, K.: Processing of beta-dystroglycan by matrix metalloproteinase disrupts the link between the extracellular matrix and cell membrane via the dystroglycan complex. Hum. Molec. Genet. 10:1563-1569, 2001.

Cote, P. D.; Moukhles, H.; Lindenbaum, M.; Carbonetto, S.: Chimaeric mice deficient in dystroglycans develop muscular dystrophy and have disrupted myoneural synapses. Nature Genet. 23:338-342, 1999.

Gee, S. H.; Montanaro, F.; Lindenbaum, M. H.; Carbonetto, S.:Dystroglycan-alpha, a dystrophin-associated glycoprotein, is a functional agrin receptor. Cell 77:675-686, 1994.

Gorecki, D. C.; Derry, J. M. J.; Barnard, E. A.: Dystroglycan:brain localisation and chromosome mapping in the mouse. Hum. Molec. Genet. 3:1589-1597, 1994.

Hayashi, Y. K.; Ogawa, M.; Tagawa, K.; Noguchi, S.; Ishihara, T.; Nonaka, I.; Arahata, K.: Selective deficiency of alpha-dystroglycan in Fukuyama-type congenital muscular dystrophy. Neurology 57:115-121,2001.

Henry, M. D.; Campbell, K. P.: A role for dystroglycan in basement membrane assembly. Cell 95:859-970, 1998.

Ibraghimov-Beskrovnaya, O.; Ervasti, J. M.; Leveille, C. J.; Slaughter, C. A.; Sernett, S. W.; Campbell, K. P.: Primary structure of dystrophin-associated glycoproteins linking dystrophin to the extracellular matrix. Nature 355:696-702, 1992.

Ibraghimov-Beskrovnaya, O.; Milatovich, A.; Ozcelik, T.; Yang, B.; Francke, U.; Campbell, K. P.: Dystroglycan: tissue distribution, human muscle cDNA, genomic structure and chromosome mapping. (Abstract) Am. J. Hum. Genet. 51 (suppl.): A130 only, 1992.

Ibraghimov-Beskrovnaya, O.; Milatovich, A.; Ozcelik, T.; Yang, B.; Koepnick, K.; Francke, U.; Campbell, K. P.: Human dystroglycan:skeletal muscle cDNA, genomic structure, origin of tissue specific isoforms and chromosomal localization. Hum. Molec. Genet. 2:1651-1657,1993.

Ma, J.; Nastuk, M. A.; McKechnie, B. A.; Fallon, J. R.: The agrin receptor: localization in the postsynaptic membrane, interaction with agrin, and relationship to the acetylcholine receptor. J. Biol. Chem. 268:25108-25117, 1993.

Matsumura, K.; Nonaka, I.; Campbell, K. P.: Abnormal expression of dystrophin-associated proteins in Fukuyama-type congenital muscular dystrophy. Lancet 341:521-522, 1993.

Matsumura, K.; Tome, F. M. S.; Collin, H.; Azibi, K.; Chaouch, M.; Kaplan, J.-C.; Fardeau, M.; Campbell, K. P.: Deficiency of the 50K dystrophin-associated glycoprotein in severe childhood autosomal recessive muscular dystrophy. Nature 359:320-322, 1992.

Matsumura, K.; Tome, F. M. S.; Ionasescu, V.; Ervasti, J. M.; Anderson, R. D.; Romero, N. B.; Simon, D.; Recan, D.; Kaplan, J.-C.; Fardeau, M.; Campbell, K. P.: Deficiency of dystrophin-associated proteins in Duchenne muscular dystrophy patients lacking COOH-terminal domains of dystrophin. J. Clin. Invest. 92:866-871, 1993.

Michele, D. E.; Barresi, R.; Kanagawa, M.; Saito, F.; Cohn, R. D.; Satz, J. S.; Dollar, J.; Nishino, I.; Kelley, R. I.; Somer, H.; Straub, V.; Mathews, K. D.; Moore, S. A.; Campbell, K. P.: Post-translational disruption of dystroglycan-ligand interactions in congenital muscular dystrophies. Nature 418:417-422, 2002.

Moore, S. A.; Saito, F.; Chen, J.; Michele, D. E.; Henry, M. D.; Messing, A.; Cohn, R. D.; Ross-Barta, S. E.; Westra, S.; Williamson, R. A.; Hoshi, T.; Campbell, K. P.: Deletion of brain dystroglycan recapitulates aspects of congenital muscular dystrophy. Nature 418:422-425, 2002.

Blake, D. J.; Love, D. R.; Tinsley, J.; Morris, G. E.; Turley, H.; Gatter, K.; Dickson, G.; Edwards, Y. H.; Davies, K. E.: characterization of a 4.8 kb transcript from the Duchenne muscular dystrophy locus expressed in schwannoma cells. Hum. Molec. Genet. 1:103-109, 1992.

Golub, T. R.; Barker, G. F.; Lovett, M.; Gilliland, D. G.: Fusion of PDGF receptor beta to a novel ets-like gene, tel, in chronic myelomonocytic leukemia with t (5;12) chromosomal translocation. Cell 77:307-316,1994.

Brissenden, J. E.; Ullrich, A.; Francke, U.: Chromosomal mapping of loci for insulin-like growth factors I and II and for epidermal growth factor in man. (Abstract) Am. J. Hum. Genet. 36:133S only,1984.

Brissenden, J. E.; Ullrich, A.; Francke, U.: Human chromosomal mapping of genes for insulin-like growth factors I and II and epidermal growth factor. Nature 310:781-784, 1984.

Carpenter, G.; Cohen, S.: Epidermal growth factor. Ann. Rev. Biochem. 48:193-216, 1979.

Cohen, S.: Isolation of a mouse submaxillary gland protein accelerating incisor eruption and eyelid opening in the newborn animal. J. Biol. Chem. 237:1555-1562, 1962.

Gray, A.; Dull, T. J.; Ullrich, A.: Nucleotide sequence of epidermal growth factor cDNA predicts a 128,000-molecular weight protein precursor. Nature 303:722-725, 1983.

Morton, C. C.; Byers, M. G.; Nakai, H.; Bell, G. I.; Shows, T. B.: Human genes for insulin-like growth factors I and II and epidermal growth factor are located on 12q22-q24.1, 11p15, and 4q25-q27, respectively. Cytogenet. Cell Genet. 41:245-249, 1986.

Sassone-Corsi, P.; Mizzen, C. A.; Cheung, P.; Crosjo, C.; Monaco, L.; Jacquot, S.; Hanauer, A.; Allis, C. D.: Requirement of Rsk-2 for epidermal growth factor-activated phosphorylation of histone H3. Science 285:886-891, 1999.

Scott, A. F.: Personal Communication. Baltimore, Md. Oct. 11, 1999.

Shahbazi, M.; Pravica, V.; Nasreen, N.; Fakhoury, H.; Fryer, A. A.; Strange, R. C.; Hutchinson, P. E.; Osborne, J. E.; Lear, J. T.; Smith, A. G.; Hutchinson, I. V.: Association between functional polymorphism in EGF gene and malignant melanoma. Lancet 359:397-401, 2002.

Smith, J.; Cook, E.; Fotheringham, I.; Pheby, S.; Derbyshire, R.; Eaton, M. A. W.; Doel, M.; Lilley, D. M. J.; Pardon, J. F.; Patel, T.; Lewis, H.; Bell, L. D.: Chemical synthesis and cloning of a gene for human beta-urogastrone. Nucleic Acids Res. 10:4467-4482, 1982.

Sudhof, T. C.; Russell, D. W.; Goldstein, J. L.; Brown, M. S.; Sanchez-Pescador, R.; Bell, G. I.: Cassette of eight exons shared by genes for LDL receptor and EGF precursor. Science 228:893-895,1985.

Tsutsumi, O.; Kurachi, H.; Oka, T.: A physiological role of epidermal growth factor in male reproductive function. Science 233:975-977,1986.

Urdea, M. S.; Merryweather, J. P.; Mullenbach, G. T.; Coit, D.; Heberlein, U.; Valenzuela, P.; Barr, P. J.: Chemical synthesis of a gene for human epidermal growth factor urogastrone and its expression in yeast. Proc. Nat. Acad. Sci. 80:7461-7465, 1983.

Zabel, B. U.; Eddy, R. L.; Lalley, P. A.; Scott, J.; Bell, G. I.; Shows, T. B.: Chromosomal locations of the human and mouse genes for precursors of epidermal growth factor and the beta subunit of nerve growth factor. Proc. Nat. Acad. Sci. 82:469-473, 1985.

Aden, D. P.; Knowles, B. B.: Cell surface antigens coded for by the human chromosome 7. Immunogenetics 3:209-211, 1976.

Carlin, C. R.; Aden, D. P.; Knowles, B. B.: S6 is the human receptor for epidermal growth factor (EGF). (Abstract) Cytogenet. Cell Genet. 32:256 only, 1982.

Carlin, C. R.; Knowles, B. B.: Identity of human epidermal growth factor (EGF) receptor with glycoprotein SA-7: evidence for differential phosphorylation of the two components of the EGF receptor from A431cells. Proc. Nat. Acad. Sci. 79:5026-5030, 1982.

Carpenter, G.: Properties of the receptor for epidermal growth factor. Cell 37:357-358, 1984.

Chen, B.; Bronson, R. T.; Klaman, L. D.; Hampton, T. G.; Wang, J.; Green, P. J.; Magnuson, T.; Douglas, P. S.; Morgan, J. P.; Neel, B. G.: Mice mutant for Egfr and Shp2 have defective cardiac semilunar valvulogenesis. Nature Genet. 24:296-299, 2000.

Ishii, H.; Baffa, R.; Numata, S.-I.; Murakumo, Y.; Rattan, S.; Inoue, H.; Mori, M.; Fidanza, V.; Alder, H.; Croce, C. M.: The FEZ1gene at chromosome 8p22 encodes a leucine-zipper protein, and its expression is altered in multiple human tumors. Proc. Nat. Acad. Sci. 96:3928-3933, 1999.

Kuroki, T.; Trapasso, F.; Shiraishi, T.; Alder, H.; Mimori, K.; Mori, M.; Croce, C. M.: Genetic alterations of the tumor suppressor gene WWOX in esophageal squamous cell carcinoma. Cancer Res. 62:2258-2260, 2002.

Li, G.; Hu, N.; Goldstein, A. M.; Tang, Z.-Z.; Roth, M. J.; Wang, Q.-H.; Dawsey, S. M.; Han, X.-Y.; Ding, T.; Huang, J.; Giffen, C.; Taylor, P. R.; Emmert-Buck, M. R.: Allelic loss on chromosome bands 13q11-q13 in esophageal squamous cell carcinoma. Genes Chromosomes Cancer 31:390-397, 2001.

Lo, H. S.; Hu, N.; Gere, S.; Lu, N.; Su, H.; Goldstein, A. M.; Taylor, P. R.; Lee, M. P.: Identification of somatic mutations of the RNF6 gene in human esophageal squamous cell carcinoma. Cancer Res. 62:4191-4193, 2002.

Su, P.-H.; Hou, J.-W.; Hwu, W.-L.; Wu, M.-H.; Wang, J.-K.; Wang, T.-R.: Congenital contractural arachnodactyly (Beals syndrome). Acta Paediat. 41:59-62, 2000.

Viljoen, D.: Congenital contractural arachnodactyly (Beals syndrome). J. Med. Genet. 31:640-643, 1994.

Viljoen, D.; Ramesar, R.; Behari, D.: Beals syndrome: clinical and molecular investigations in a kindred of Indian descent. Clin. Genet. 39:181-188, 1991.

Wang, M.; Clericuzio, C. L.; Godfrey, M.: Familial occurrence of typical and severe lethal congenital contractural arachnodactyly caused by missplicing of exon 34 of fibrillin-2. Am. J. Hum. Genet. 59:1027-1034, 1996.

Wang, M.; Price, C. E.; Han, J.; Cisler, J.; Imaizumi, K.; VanThienen, M. N.; DePaepe, A.; Godfrey, M.: Recurrent mis-splicing of fibrillin exon 32 in two patients with neonatal Marfan syndrome. Hum. Molec. Genet. 4:607-613, 1995.

Wang, M.; Tsipouras, P.; Godfrey, M.: Fibrillin-2 (FBN2) mutation in congenital contractural arachnodactyly. (Abstract) Am. J. Hum. Genet. 57: A231, 1995.

Zhang, H.; Apfelroth, S. D.; Hu, W.; Davis, E. C.; Sanguineti, C.; Bonadio, J.; Mecham, R. P.; Ramirez, F.: Structure and expression of fibrillin-2, a novel microfibrillar component preferentially located in elastic matrices. J. Cell Biol. 124:855-863, 1994.

Zhang, H.; Hu, W.; Ramirez, F.: Developmental expression of fibrillin genes suggests heterogeneity of extracellular microfibrils. J. CellBiol. 129:1165-1176, 1995.

Beck, C.; Moulard, B.; Steinlein, O.; Guipponi, M.; Vallee, L.; Montpied, P.; Baldy-Moulnier, M.; Malafosse, A.: A nonsense mutation in the alpha-4 subunit of the nicotinic acetylcholine receptor (CHRNA4) cosegregates with 20q-linked benign neonatal familial convulsions (EBN1). Neurobiol. Dis. 1:95-99, 1994.

Singh, N. A.; Charlier, C.; Stauffer, D.; DuPont, B. R.; Leach, R. J.; Melis, R.; Ronen, G. M.; Bjerre, I.; Quattlebaum, T.; Murphy, J. V.; McHarg, M. L.; Gagnon, D.; Rosales, T. O.; Peiffer, A.; Anderson, V. E.; Leppert, M.: A novel potassium channel gene, KCNQ2, is mutated in an inherited epilepsy of newborns. Nature Genet. 18:25-29, 1998.

Charlier, C.; Singh, N. A.; Ryan, S. G.; Lewis, T. B.; Reus, B. E.; Leach, R. J.; Leppert, M.: A pore mutation in a novel KQT-like potassium channel gene in an idiopathic epilepsy family. Nature Genet. 18:53-55, 1998.

Ryan, S. G.; Wiznitzer, M.; Hollman, C. H.; Torres, M. C.; Szekeresova, M.; Schneider, S.: Benign familial neonatal convulsions: evidence for clinical and genetic heterogeneity. Ann. Neurol. 29:469-473,1991.

Earnshaw, W. C.: When is a centromere not a kinetochore? J. CellSci. 99:1-4, 1991.

Fowler, K. J.; Newson, A. J.; MacDonald, A. C.; Kalitsis, P.; Lyu, M. S.; Kozak, C. A.; Choo, K. H. A.: Chromosomal localization of mouse Cenpa gene. Cytogenet. Cell Genet. 79:298-301, 1997.

Howman, E. V.; Fowler, K. J.; Newson, A. J.; Redward, S.; MacDonald, A. C.; Kalitsis, P.; Choo, K. H. A.: Early disruption of centromeric chromatin organization in centromere protein A (Cenpa) null mice. Proc. Nat. Acad. Sci. 97:1148-1153, 2000.

Palmer, D. K.; O'Day, K.; Trong, H. L.; Charbonneau, H.; Margolis, R. L.: Purification of the centromere-specific protein CENP-A and demonstration that it is a distinctive histone. Proc. Nat. Acad. Sci. 88:3734-3738, 1991.

Sullivan, K. F.; Hechenberger, M.; Masri, K.: Human CENP-A contains a histone H3 related histone fold domain that is required for targeting to the centromere. J. Cell Biol. 127:581-592, 1994.

Earnshaw, W. C.; Sullivan, K. F.; Machlin, P. S.; Cooke, C. A.; Kaiser, D. A.; Pollard, T. D.; Rothfield, N. F.; Cleveland, D. W.: Molecular cloning of cDNA for CENP-B, the major human centromere autoantigen. J. Cell Biol. 104:817-829, 1987.

Seki, N.; Saito, T.; Kitagawa, K.; Masumoto, H.; Okazaki, T.; Hori, T.-A.: Mapping of the human centromere protein B gene (CENPB) to chromosome 20p13 by fluorescence in situ hybridization. Genomics 24:187-188, 1994.

Sugimoto, K.; Yata, H.; Himeno, M.: Mapping of the human CENP-B gene to chromosome 20 and the CENP-C gene to chromosome 12 by a rapid cycle DNA amplification procedure. Genomics 17:240-242, 1993.

Williamson, J. A.; Bosher, J. M.; Skinner, A.; Sheer, D.; Williams, T.; Hurst, H. C.: Chromosomal mapping of the human and mouse homologues of two new members of the AP-2 family of transcription factors. Genomics 35:262-264, 1996.

Agarwal, V. R.; Ashanullah, C. I.; Simpson, E. R.; Bulun, S. E.: Alternatively spliced transcripts of the aromatase cytochrome P450(CYP19) gene in adipose tissue of women. J. Clin. Endocr. Metab. 82:70-74, 1997.

Nalabolu, S. R.; Shukla, H.; Nallur, G.; Parimoo, S.; Weissman, S. M.: Genes in a 220-kb region spanning the TNF cluster in human MHC. Genomics 31:215-222, 1996.

DeChiara, T. M.; Kimble, R. B.; Poueymirou, W. T.; Rojas, J.; Masiakowski, P.; Valenzuela, D. M.; Yancopoulos, G. D.: Ror2, encoding a receptor-like tyrosine kinase, is required for cartilage and growth plate development. Nature Genet. 24:271-274, 2000.

Oldridge, M.; Fortuna, A. M.; Maringa, M.; Propping, P.; Mansour, S.; Pollitt, C.; DeChiara, T. M.; Kimble, R. B.; Valenzuela, D. M.; Yancopoulos, G. D.; Wilkie, A. O. M.: Dominant mutations in ROR2, encoding an orphan receptor tyrosine kinase, cause brachydactyly type B. Nature Genet. 24:375-378, 2000.

De Windt, L. J.; Lim, H. W.; Bueno, O. F.; Liang, Q.; Delling, U.; Braz, J. C.; Glascock, B. J.; Kimball, T. F.; del Monte, F.; Hajjar, R. J.; Molkentin, J. D.: Targeted inhibition of calcineurin attenuates cardiac hypertrophy in vivo. Proc. Nat. Acad. Sci. 98:3322-3327,2001.

Fuentes, J. J.; Genesca, L.; Kingsbury, T. J.; Cunningham, K. W.; Perez-Riba, M.; Estivill, X.; de la Luna, S.: DSCR1, overexpressed in Down syndrome, is an inhibitor of calcineurin-mediated signaling pathways. Hum. Molec. Genet. 9:1681-1690, 2000.

Giri, P.; Higuchi, S.; Kincaid, R. L.: Chromosomal mapping of the human genes for the calmodulin-dependent protein phosphatase (calcineurin) catalytic subunit. Biochem. Biophys. Res. Commun. 181:252-258,1991.

Guerini, D.; Klee, C. B.: Cloning of human calcineurin A: evidence for two isozymes and identification of a polyproline structural domain. Proc. Nat. Acad. Sci. 86:9183-9187, 1989.

Leinwand, L. A.: Calcineurin inhibition and cardiac hypertrophy:a matter of balance. Proc. Nat. Acad. Sci. 98:2947-2949, 2001.

Malleret, G.; Haditsch, U.; Genoux, D.; Jones, M. W.; Bliss, T. V. P.; Vanhoose, A. M.; Weitlauf, C.; Kandel, E. R.; Winder, D. G.; Mansuy, I. M.: Inducible and reversible enhancement of learning, memory, and long-term potentiation by genetic inhibition of calcineurin. Cell 104:675-686, 2001.

Mansuy, I. M.; Mayford, M.; Jacob, B.; Kandel, E. R.; Bach, M. E.: Restricted and regulated overexpression reveals calcineurin as a key component in the transition from short-term to long-term memory. Cell 92:39-49, 1998.

Rothermel, B. A.; McKinsey, T. A.; Vega, R. B.; Nicol, R. L.; Mammen, P.; Yang, J.; Antos, C. L.; Shelton, J. M.; Bassel-Duby, R.; Olson, E. N.; Williams, R. S.: Myocyte-enriched calcineurin-interacting protein, MCIP1, inhibits cardiac hypertrophy in vivo. Proc. Nat. Acad. Sci. 98:3328-3333, 2001.

Seitz, D. P.; Pasha, M. K.; Singh, B.; Chu, A.; Sharma, R. K.: Localization and characterization of calcineurin in bovine eye. Invest. Ophthal. Vis. Sci. 43:15-21, 2002.

Wang, M. G.; Yi, H.; Guerini, D.; Klee, C. B.; McBride, O. W.: Calcineurin A alpha (PPP3CA), calcineurin A beta (PPP3CB) and calcineurin B (PPP3R1) are located on human chromosomes 4, 10q21-q22 and 2p16-p15 respectively. Cytogenet. Cell Genet. 72:236-241, 1996.

Winder, D. G.; Mansuy, I. M.; Osman, M.; Moallem, T. M.; Kandel, E. R.: Genetic and pharmacological evidence for a novel, intermediate phase of long-term potentiation suppressed by calcineurin. Cell 92:25-37, 1998.

Bueno, O. F.; Wilkins, B. J.; Tymitz, K. M.; Glascock, B. J.; Kimball, T. F.; Lorenz, J. N.; Molkentin, J. D.: Impaired cardiac hypertrophic response in calcineurin A-beta-deficient mice. Proc. Nat. Acad. Sci. 99:4586-4591, 2002.

Guerini, D.; Krinks, M. H.; Sikela, J. M.; Hahn, W. E.; Klee, C. B.: Isolation and sequence of a cDNA clone for human calcineurin B, the Ca (2+)-binding subunit of the Ca (2+)/calmodulin-stimulated protein phosphatase. DNA 8:675-682, 1989.

Wang, M. G.; Yi, H.; Guerini, D.; Klee, C. B.; McBride, O. W.:Calcineurin A alpha (PPP3CA), calcineurin A beta (PPP3CB) and calcineurin B (PPP3R1) are located on human chromosomes 4, 10q21-q22 and 2p16-p15respectively. Cytogenet. Cell Genet. 72:236-241, 1996.

Aiyar, N.; Rand, K.; Elshourbagy, N. A.; Zeng, Z.; Adamou, J. E.; Bergsma, D. J.; Li, Y.: A cDNA encoding the calcitonin gene-related peptide type 1 receptor. J. Biol. Chem. 271:11325-11329, 1996.

Fluhmann, B.; Muff, R.; Hunziker, W.; Fischer, J. A.; Born, W.: A human orphan calcitonin receptor-like structure. Biochem. Biophys. Res. Commun. 206:341-347, 1995.

Foord, S. M.; Craig, R. K.: Isolation and characterisation of a human calcitonin-gene-related-peptide receptor. Europ. J. Biochem. 170:373-379, 1987.

Foord, S. M.; Marshall, F. H.: RAMPs: accessory proteins for seven transmembrane domain receptors. Trends Pharm. Sci. 20:184-187,1999.

Kamitani, S.; Asakawa, M.; Shimekake, Y.; Kuwasako, K.; Nakahara, K.; Sakata, T.: The RAMP2/CRLR complex is a functional adrenomedullin receptor in human endothelial and vascular smooth muscle cells. FEBSLett. 448:111-114, 1999.

Nakazawa, I.; Nakajima, T.; Harada, H.; Ishigami, T.; Umemura, S.; Emi, M.: Human calcitonin receptor-like receptor for adrenomedullin:genomic structure, eight single-nucleotide polymorphisms, and haplotype analysis. J. Hum. Genet. 46:132-136, 2001.

Dolmetsch, R. E.; Pajvani, U.; Fife, K.; Spotts, J. M.; Greenberg, M. E.: Signaling to the nucleus by an L-type calcium channel-calmodulin complex through the MAP kinase pathway. Science 294:333-339, 2001.

McAlpine, P. J.: Personal Communication. Winnipeg, Manitoba, Canada Feb. 14, 1992.

Powers, P. A.; Gregg, R. G.; Hogan, K.: Linkage mapping of the human gene for the alpha-1 subunit of the cardiac DHP-sensitive Ca (2+) channel (CACNL1A1) to chromosome 12p13.2-pter using a dinucleotide repeat. Genomics 14:206-207, 1992.

Powers, P. A.; Gregg, R. G.; Lalley, P. A.; Liao, M.; Hogan, K.: Assignment of the human gene for the alpha-1 subunit of the cardiac DHP-sensitive Ca (2+) channel (CCHL1A1) to chromosome 12p12-pter. Genomics 10:835-839, 1991.

Geng, Y.; Whoriskey, W.; Park, M. Y.; Bronson, R. T.; Medema, R. H.; Li, T.; Weinberg, R. A.; Sicinski, P.: Rescue of cyclin D1 deficiency by knockin cyclin E. Cell 97:767-777, 1999.

Hinchcliffe, E. H.; Li, C.; Thompson, E. A.; Maller, J. L.; Sluder, G.: Requirement of Cdk2-cyclin E activity for repeated centrosomere production in Xenopus egg extracts. Science 283:851-854, 1999.

Sheaff, R. J.; Groudine, M.; Gordon, M.; Roberts, J. M.; Clurman, B. E.: Cyclin E-CDK2 is a regulator of p27(Kip1). Genes Dev. 11:1464-1478, 1997.

Akoulitchev, S.; Chuikov, S.; Reinberg, D.: TFIIH is negatively regulated by cdk8-containing mediator complexes. Nature 407:102-106,2000.

Motyka, B.; Korbutt, G.; Pinkoski, M. J.; Heibein, J. A.; Caputo, A.; Hobman, M.; Barry, M.; Shostak, I.; Sawchuk, T.; Holmes, C. F. B.; Gauldie, J.; Bleackley, R. C.: Mannose 6-phosphate/insulin-like growth factor II receptor is a death receptor for granzyme B during cytotoxic T cell-induced apoptosis. Cell 103:491-500, 2000.

Miles, J. S.; Spurr, N. K.; Gough, A. C.; Jowett, T.; McLaren, A. W.; Brook, J. D.; Wolf, C. R.: A novel human cytochrome P450 gene (P450IIB): chromosomal localization and evidence for alternative splicing. Nucleic Acids Res. 16:5783-5795, 1988.

Santisteban, I.; Povey, S.; Shephard, E. A.; Phillips, I. R.:The major phenobarbital-inducible cytochrome P-450 gene subfamily (P450IIB) mapped to the long arm of human chromosome 19. Ann. Hum. Genet. 52:129-135, 1988.

Trask, B.; Fertitta, A.; Christensen, M.; Youngblom, J.; Bergmann, A.; Copeland, A.; de Jong, P.; Mohrenweiser, H.; Olsen, A.; Carrano, A.; Tynan, K.: Fluorescence in situ hybridization mapping of human chromosome 19: cytogenetic band location of 540 cosmids and 70 genesor DNA markers. Genomics 15:133-145, 1993.

Schrijver, H. M.; Crusius, J. B. A.; Uitdehaag, B. M. J.; Garcia Gonzalez, M. A.; Kostense, P. J.; Polman, C. H.; Pena, A. S.: Association of interleukin-1-beta and interleukin-1 receptor antagonist genes with disease severity in MS. Neurology 52:595-599, 1999.

Feldman, R. D.; Hegele, R. A.: G-protein polymorphisms and maternal/neonatal metabolism: still a weight for the answer. (Commentary) Lancet 355:1201-1202, 2000.

Holland, E. C.; Celestino, J.; Dai, C.; Schaefer, L.; Sawaya, R. E.; Fuller, G. N.: Combined activation of Ras and Akt in neural progenitors induces glioblastoma formation in mice. Nature Genet. 25:55-57, 2000.

Efstratiadis, A.; Posakony, J. W.; Maniatis, T.; Lawn, R. M.; O'Connell, C.; Spritz, R. A.; DeRiel, J. K.; Forget, B. G.; Weissman, S. M.; Slightom, J. L.; Blechl, A. E.; Smithies, O.; Baralle, F. E.; Shoulders, C. C.; Proudfoot, N. J.: The structure and evolution of the human beta-globin gene family. Cell 21:653-668, 1980.

Gutersohn, A.; Naber, C.; Muller, N.; Erbel, R.; Siffert, W.:G protein beta-3 subunit 825 TT genotype and post-pregnancy weight retention. Lancet 355:1240-1241, 2000.

Hegele, R. A.; Anderson, C.; Young, T. K.; Connelly, P. W.: G-protein beta-3 subunit gene splice variant and body fat distribution in Nunavut Inuit. Genome Res. 9:972-977, 1999.

Hocher, B.; Slowinski, T.; Stolze, T.; Pleschka, A.; Neumayer, H.-H.; Halle, H.: Association of maternal G protein beta-3 subunit 825T allele with low birthweight. Lancet 355: 1241-1242, 2000.

Jin, Y.; Dietz, H. C.; Montgomery, R. A.; Bell, W. R.; McIntosh, I.; Coller, B.; Bray, P. F.: Glanzmann thrombasthenia: cooperation between sequence variants in Cis during splice site selection. J. Clin. Invest. 98:1745-1754, 1996.

Levine, M. A.; Modi, W. S.; O'Brien, S. J.: Chromosomal localization of the genes encoding two forms of the G-protein beta polypeptide, beta-1 and beta-3, in man. Genomics 8:380-386, 1990.

Levine, M. A.; Smallwood, P. M.; Moen, P. T., Jr.; Helman, L. J.; Ahn, T. G.: Molecular cloning of beta-3 subunit, a third form of the G protein beta-subunit polypeptide. Proc. Nat. Acad. Sci. 87:2329-2333, 1990.

Liu, W.; Qian, C.; Francke, U.: Silent mutation induces exon skipping of fibrillin-1 gene in Marfan syndrome. (Letter) Nature Genet. 16:328-329, 1997.

Modi, W. S.; Levine, M. A.; Seuanez, H.; O'Brien, S. J.: Chromosomal localization of the gene encoding a third form of the beta subunit of GTP-binding regulatory proteins. (Abstract) Cytogenet. Cell Genet. 51:1046 only, 1989.

Pietruck, F.; Moritz, A.; Montemurro, M.; Sell, A.; Busch, S.; Rosskopf, D.; Virchow, S.; Esche, H.; Brockmeyer, N.; Jakobs, K. H.; Siffert, W.: Selectively enhanced cellular signaling by G(i) proteins in essential hypertension: G-alpha (i2), G-alpha (i3), G-beta (2) are not mutated. Circ. Res. 79:974-983, 1996.

Siffert, W.; Forster, P.; Jockel, K.-H.; Mvere, D. A.; Brinkmann, B.; Naber, C.; Crookes, R.; Du P. Heyns, A.; Epplen, J. T.; Fridey, J.; Freedman, B. I.; Muller, N.; and 15 others: Worldwide ethnic distribution of the G protein beta-3 subunit 825T allele and its association with obesity in Caucasian, Chinese, and black African individuals. J. Am. Soc. Nephrol. 10:1921-1030, 1999.

Siffert, W.; Rosskopf, D.; Moritz, A.; Wieland, T.; Kaldenberg-Stasch, S.; Kettler, N.; Hartung, K.; Beckmann, S.; Jakobs, K. H.: Enhanced G protein activation in immortalized lymphoblasts from patients with essential hypertension. J. Clin. Invest. 96:759-766, 1995.

Siffert, W.; Rosskopf, D.; Siffert, G.; Busch, S.; Moritz, A.; Erbel, R.; Sharma, A. M.; Ritz, E.; Wichmann, H.-E.; Jakobs, K. H.; Horsthemke, B.: Association of a human G-protein beta-3 subunit variant with hypertension. Nature Genet. 18:45-48, 1998.

Stallings-Mann, M. L.; Ludwiczak, R. L.; Klinger, K. W.; Rottman, F.: Alternative splicing of exon 3 of the human growth hormone receptor is the result of an unusual genetic polymorphism. Proc. Nat. Acad. Sci. 93:12394-12399, 1996.

Chang, C.; Kokontis, J.; Liao, S. S.; Chang, Y.: Isolation and characterization of human TR3 receptor: a member of steroid receptor superfamily. J. Steroid Biochem. 34:391-395, 1989.

DeGroot, L. J.: Personal Communication. Chicago, Ill. Dec. 19, 1991.

Forman, B. M.; Umesono, K.; Chen, J.; Evans, R. M.: Unique response pathways are established by allosteric interactions among nuclear hormone receptors. Cell 81:541-550, 1995.

Labelle, Y.; Bussieres, J.; Courjal, F.; Goldring, M. B.: The EWS/TEC fusion protein encoded by the t (9;22) chromosomal translocation in human chondrosarcomas is a highly potent transcriptional activator. Oncogene 18:3303-3308, 1999.

Li, H.; Kolluri, S. K.; Gu, J.; Dawson, M. I.; Cao, X.; Hobbs, P. D; Lin, B.; Chen, G.; Lu, J.; Lin, F.; Xie, Z.; Fontana, J. A.; Reed, J. C.; Zhang, X.: Cytochrome c release and apoptosis induced by mitochondrial targeting of orphan receptor TR3 nuclear. Science 289:1159-1164, 2000.

Nakai, A.; Kartha, S.; Sakurai, A.; Toback, F. G.; DeGroot, L. J.: A human early response gene homologous to murine nur77 and rat NGFI-B, and related to the nuclear receptor superfamily. Molec. Endocr. 4:1438-1443, 1990.

Perlmann, T.; Jansson, L.: A novel pathway for vitamin A signaling mediated by RXR heterodimerization with NGFI-B and NURR1. Genes Dev. 9:769-782, 1995.

Ryseck, R.-P.; Macdonald-Bravo, H.; Mattei, M. G.; Siegfried, R. L.; Bravo, R.: Structure, mapping and expression of a growth factor inducible gene encoding a putative nuclear hormonal binding receptor. EMBOJ. 8:3327-3335, 1989.

Wu, Q.; Dawson, M. I.; Zheng, Y.; Hobbs, P. D.; Agadir, A.; Jong, L.; Li, Y.; Liu, R.; Lin, B.; Zhang, X. K.: Inhibition of trans-retinoic acid-resistant human breast cancer cell growth by retinoid X receptor-selective retinoids. Molec. Cell. Biol. 17:6598-6608, 1997.

Youn, H.-D.; Sun, L.; Prywes, R.; Liu, J. O.: Apoptosis of T cells mediated by Ca (2+)-induced release of the transcription factor MEF2. Science 286:790-793, 1999.

Friedman, E.; Gejman, P. V.; Martin, G. A.; McCormick, F.: Nonsense mutations in the C-terminal SH2 region of the GTPase activating protein (GAP) gene in human tumours. Nature Genet. 5:242-247, 1993.

Hsieh, C. L.; Francke, U.: The gene for GTPase activating protein (GAP) is on human chromosome 5q and mouse chromosome 13. (Abstract) Cytogenet. Cell Genet. 51:1016 only, 1989.

Hsieh, C. L.; Vogel, U. S.; Dixon, R. A.; Francke, U.: Chromosome localization and cDNA sequence of murine and human genes for ras p21GTPase activating protein (GAP). Somat. Cell Molec. Genet. 15:579-590,1989.

Lemons, R. S.; Espinosa, R., III; Rebentisch, M.; McCormick, F.; Ladner, M.; Le Beau, M. M.: Chromosomal localization of the gene encoding GTPase-activating protein (RASA) to human chromosome 5, bands q13-q15. Genomics 6:383-385, 1990.

Mitsudomi, T.; Friedman, E.; Gejman, P. V.; McCormick, F.; Gazdar, A. F.: Genetic analysis of the catalytic domain of the GAP gene in human lung cancer cell lines. Hum. Genet. 93:27-31, 1994.

Trahey, M.; Wong, G.; Halenbeck, R.; Rubinfeld, B.; Martin, G. A.; Ladner, M.; Long, C. M.; Crosier, W. J.; Watt, K.; Koths, K.; McCormick, F.: Molecular cloning of two types of GAP complementary DNA from human placenta. Science 242:1697-1700, 1988.

Blatt, C.; Eversole-Cire, P.; Cohn, V. H.; Zollman, S.; Fournier, R. E. K.; Mohandas, L. T.; Nesbitt, M.; Lugo, T.; Jones, D. T.; Reed, R. R.; Weiner, L. P.; Sparkes, R. S.; Simon, M. I.: Chromosomal localization of genes encoding guanine nucleotide-binding protein subunits in mouse and human. Proc. Nat. Acad. Sci. 85:7642-7646, 1988.

Doyle, J.; Hoffman, S.; Ucla, C.; Reith, W.; Mach, B.; Stubbs, L.: Locations of human and mouse genes encoding the RFX1 and RFX2 transcription factor proteins. Genomics 35:227-230, 1996.

Pugliatti, L.; Derre, J.; Berger, R.; Ucla, C.; Reith, W.; Mach, B.: The genes for MHC class II regulatory factors RFX1 and RFX2 are located on the short arm of chromosome 19. Genomics 13:1307-1310,1992.

Reith, W.; Ucla, C.; Barras, E.; Gaud, A.; Durand, B.; Herrero-Sanchez, C.; Kobr, M.; Mach, B.: RFX1, a transactivator of hepatitis B virus enhancer I, belongs to a novel family of homodimeric and heterodimeric DNA-binding proteins. Molec. Cell. Biol. 14:1230-1244, 1994.

Driessen, C.; Bryant, R. A.; Lennon-Dumenil, A. M.; Villadangos, J. A.; Bryant, P. W.; Shi, G. P.; Chapman, H. A.; Ploegh, H. L.:Cathepsin S controls the trafficking and maturation of MHC class II molecules in dendritic cells. J. Cell Biol. 147:775-790, 1999.

Bergsma, D. J.; Eder, C.; Gross, M.; Kersten, H.; Sylvester, D.; Appelbaum, E.; Cusimano, D.; Livi, G. P.; McLaughlin, M. M.; Kasyan, K.; Porter, T. G.; Silverman, C.; Dunnington, D.; Hand, A.; Prichett, W. P.; Bossard, M. J.; Brandt, M.; Levy, M. A.: The cyclophilin multigene family of peptidyl-prolyl isomerases: characterization of three separate human isoforms. J. Biol. Chem. 266:23204-23214, 1991.

Bowles, K. R.; Zintz, C.; Abraham, S. E.; Brandon, L.; Bowles, N. E.; Towbin, J. A.: Genomic characterization of the human peptidyl-prolyl-cis-trans-isomerase, mitochondrial precursor gene: assessment of its role in familial dilated cardiomyopathy. Hum. Genet. 105:582-586, 1999.

Bachmaier, K.; Krawczyk, C.; Kozieradzki, I.; Kong, Y.-Y.; Sasaki, T.; Oliveira-dos-Santos, A.; Mariathasan, S.; Bouchard, D.; Wakeham, A.; Itie, A.; Le, J.; Ohashi, P. S.; Sarosi, I.; Nishina, H.; Lipkowitz, S.; Penninger, J. M.: Negative regulation of lymphocyte activation and autoimmunity by the molecular adaptor Cbl-b. Nature 403:211-216,2000.

Chiang, Y. J.; Kole, H. K.; Brown, K.; Naramura, M.; Fukuhara, S.; Hu, R.-J.; Jang, I. K.; Gutkind, J. S.; Shevach, E.; Gu, H.:Cbl-b regulates the CD28 dependence of T-cell activation. Nature 403:216-220, 2000.

Keane, M. M.; Rivero-Lezcano, O. M.; Mitchell, J. A.; Robbins, K. C.; Lipkowitz, S.: Cloning and characterization of cbl-b: a SH3 binding protein with homology to the c-cbl proto-oncogene. Oncogene 10:2367-2377, 1995.

Komeda, K.; et al; et al: Establishment of two substrains, diabetes-prone and nondiabetic, from Long-Evans Tokushima Lean (LETL) rats. Endocr. J. 45:737-744, 1998.

Yokoi, N.; Komeda, K.; Wang, H.-Y.; Yano, H.; Kitada, K.; Saitoh, Y.; Seino, Y.; Yasuda, K.; Serikawa, T.; Seino, S.: Cblb is a major susceptibility gene for rat type 1 diabetes mellitus. Nature Genet. 31:391-394, 2002.

Creutz, C. E.; Tomsig, J. L.; Snyder, S. L.; Gautier, M.-C.; Skouri, F.; Beisson, J.; Cohen, J.: The copines, a novel class of C2 domain-containing, calcium-dependent, phospholipid-binding proteins conserved from Paramecium to human S. J. Biol. Chem. 273:1393-1402, 1998.

Caudell, E. G.; Caudell, J. J.; Tang, C.-H.; Yu, T.-K.; Frederick, M. J.; Grimm, E. A.: Characterization of human copine III as a phosphoprotein with associated kinase activity. Biochemistry 39:13034-13043, 2000.

Ito, M.; Yuan, C.-X.; Okano, H. J.; Darnell, R. B.; Roeder, R. G.: Involvement of the TRAP220 component of the TRAP/SMCC coactivator complex in embryonic development and thyroid hormone action. Molec. Cell 5:683-693, 2000.

Yuan, C.-X.; Ito, M.; Fondell, J. D.; Fu, Z.-Y.; Roeder, R. G.: The TRAP220 component of a thyroid hormone receptor-associated protein (TRAP) coactivator complex interacts directly with nuclear receptors in a ligand-dependent fashion. Proc. Nat. Acad. Sci. 95:7939-7944,1998. Note: Erratum: Proc. Nat. Acad. Sci. 95:14584 only, 1998.

Zhu, Y.; Qi, C.; Jain, S.; Le Beau, M. M.; Espinosa, R., III; Atkins, G. B.; Lazar, M. A.; Yeldandi, A. V.; Rao, M. S.; Reddy, J. K.: Amplification and overexpression of peroxisome proliferator-activated receptor binding protein (PBP/PPARBP) gene in breast cancer. Proc. Nat. Acad. Sci. 96:10848-10853, 1999.

Zhu, Y.; Qi, C.; Jain, S.; Rao, M. S.; Reddy, J. K.: Isolation and characterization of PBP, a protein that interacts with peroxisome proliferator-activated receptor. J. Biol. Chem. 272:25500-25506,1997.

Galarneau, L.; Drouin, R.; Belanger, L.: Assignment of the fetoprotein transcription factor gene (FTF) to human chromosome band 1q32.11 by in situ hybridization. Cytogenet. Cell Genet. 82:269-270, 1998.

Li, M.; Xie, Y.-H.; Kong, Y.-Y.; Wu, X.; Zhu, L.; Wang, Y.: Cloning and characterization of a novel human hepatocyte transcription factor, hB1F, which binds and activates enhancer II of hepatitis B virus. J. Biol. Chem. 273:29022-29031, 1998.

Eschenbrenner, M.; Jorns, M. S.: Cloning and mapping of the cDNA for human sarcosine dehydrogenase, a flavoenzyme defective in patients with sarcosinemia. Genomics 59:300-308, 1999.

Harding, C. O.; Williams, P.; Pflanzer, D. M.; Cowell, R. E.; Lyne, P. W.; Wolff, J. A.: sar: a genetic mouse model for human sarcosinemia generated by ethylnitrosourea mutagenesis. Proc. Nat. Acad. Sci. 89:2644-2648, 1992.

Carim, L.; Sumoy, L.; Andreu, N.; Estivill, X.; Escarceller, M.: Identification and expression analysis of C15orf3, a novel gene on chromosome 15q21.1-q21.2. Cytogenet. Cell Genet. 88:330-332,2000.

MacLellan, W. R.; Xiao, G.; Abdellatif, M.; Schneider, M. D.:A novel Rb- and p300-binding protein inhibits transactivation by MyoD. Molec. Cell. Biol. 20:8903-8915, 2000.

Miyake, S.; Sellers, W. R.; Safran, M.; Li, X.; Zhao, W.; Grossman, S. R.; Gan, J.; DeCaprio, J. A.; Adams, P. D.; Kaelin, W. G., Jr.: Cells degrade a novel inhibitor of differentiation with E1A-like properties upon exiting the cell cycle. Molec. Cell. Biol. 20:8889-8902,2000.

Hengst, U.; Albrecht, H.; Hess, D.; Monard, D.: The phosphatidyl ethanolamine-binding protein is the prototype of a novel family of serine protease inhibitors. J. Biol. Chem. 276:535-540, 2001.

Hori, N.; Chae, K.; Murakawa, K.; Matoba, R.; Fukushima, A.; Okubo, K.; Matsubara, K.: A human cDNA sequence homologue of bovine phosphatidyl ethanolamine-binding protein. Gene 140:293-294, 1994.

Moore, C.; Perry, A. C. F.; Love, S.; Hall, L.: Sequence analysis and immunolocalisation of phosphatidyl ethanolamine binding protein (PBP) in human brain tissue. Molec. Brain Res. 37:74-78, 1996.

Schoentgen, F.; Jolles, P.: From structure to function: possible biological roles of a new widespread protein family binding hydrophobic ligands and displaying a nucleotide binding site. FEBS Lett. 369:22-26, 1995.

Tohdoh, N.; Tojo, S.; Agui, H.; Ojika, K.: Sequence homology of rat and human HCNP precursor proteins, bovine phosphatidyl ethanolamine-binding protein and rat 23-kDa protein associated with the opioid-binding protein. Molec. Brain Res. 30:381-384, 1995.

Yeung, K.; Seitz, T.; Li, S.; Janosch, P.; McFerran, B.; Kaiser, C.; Fee, F.; Katsanakis, K. D.; Rose, D. W.; Mischak, H.; Sedivy, J. M.; Kolch, W.: Suppression of Raf-1 kinase activity and MAP kinase signalling by RKIP. Nature 401: 173-177, 1999.

Heinemann, T.; Bulwin, G. C.; Randall, J.; Schnieders, B.; Sandhoff, K.; Volk, H. D.; Milford, E.; Gullans, S. R.; Utku, N.: Genomic organization of the gene coding for TIRC7, a novel membrane protein essential for T cell activation. Genomics 57:398-406, 1999.

Li, Y.-P.; Chen, W.; Liang, Y.; Li, E.; Stashenko, P.: ATP6i-deficient mice exhibit severe osteopetrosis due to loss of osteoclast-mediated extracellular acidification. Nature Genet. 23:447-451, 1999.

Seddiqi, N.; Bollengier, F.; Alliel, P. M.; Perin, J.-P.; Bonnet, F.; Bucquoy, S.; Jolles, P.; Schoentgen, F.: Amino acid sequence of the Homo sapiens brain 21-23-kDa protein (neuropolypeptide h3), comparison with its counterparts from Rattus norvegicus and Bos tauras species, and expression of its mRNA in different tissues. J. Molec. Evol. 39:655-660, 1994.

Li, Y.-P.; Chen, W.; Stashenko, P.: Molecular cloning and characterization of a putative novel human osteoclast-specific 116-kDa vacuolar proton pump subunit. Biochem. Biophys. Res. Commun. 218:813-821, 1996.

Scimeca, J.-C.; Franchi, A.; Trojani, C.; Parrinello, H.; Grosgeorge, J.; Robert, C.; Jaillon, O.; Poirier, C.; Gaudray, P.; Carle, G. F.: The gene encoding the mouse homologue of the human osteoclast-specific 116-kDa V-ATPase subunit bears a deletion in osteosclerotic (oc/oc) mutants. Bone 26:207-213, 2000.

Sobacchi, C.; Frattini, A.; Orchard, P.; Porras, O.; Tezcan, I.; Andolina, M.; Babul-Hirji, R.; Baric, I.; Canham, N.; Chitayat, D.; Dupuis-Girod, S.; Ellis, I.; and 21 others: The mutational spectrum of human malignant autosomal recessive osteopetrosis. Hum. Molec. Genet. 10:1767-1773, 2001.

Utku, N.; Heinemann, T.; Tullius, S. G.; Bulwin, G. C.; Beinke, S.; Blumberg, R. S.; Beato, F.; Randall, J.; Kojima, R.; Busconi, L.; Robertson, E. S.; Schulein, R.; Volk, H. D.; Milford, E. L.; Gullans, S. R.: Prevention of acute allograft rejection by antibody targeting of TIRC7, a novel T cell membrane protein. Immunity 9:509-518, 1998.

Postma, A. V.; Bezzina, C. R.; de Vries, J. F.; Wilde, A. A. M.; Moorman, A. F. M.; Mannens, M. M. A. M.: Genomic organisation and chromosomal localisation of two members of the KCND ion channel family, KCND2 and KCND3. Hum. Genet. 106:614-619, 2000.

Zhu, X.-R.; Wulf, A.; Schwarz, M.; Isbrandt, D.; Pongs, O.: characterization of human Kv4.2 mediating a rapidly-inactivating transient voltage-sensitive K+ current. Receptors Channels 6:387-400, 1999.

van den Eynde, B. J.; Gaugler, B.; Probst-Kepper, M.; Michaux, L.; Devuyst, O.; Lorge, F.; Weynants, P.; Boon, T.: A new antigen recognized by cytolytic T lymphocytes on a human kidney tumor results from reverse strand transcription. J. Exp. Med. 190:1793-1799, 1999.

Gaugler, B.; Brouwenstijn, N.; Vantomme, V.; Szikora, J.-P.; Vander Spek, C. W.; Patard, J.-J.; Boon, T.; Schrier, P.; Van den Eynde, B. J.: A new gene coding for an antigen recognized by autologous cytolytic T lymphocytes on a human renal carcinoma. Immunogenetics 44:323-330, 1996.

Miyata, Y.; Akashi, M.; Nishida, E.: Molecular cloning and characterization of a novel member of the MAP kinase superfamily. Genes Cells 4:299-309, 1999.

Pappu, R.; Cheng, A. M.; Li, B.; Gong, Q.; Chiu, C.; Griffin, N.; White, M.; Sleckman, B. P.; Chan, A. C.: Requirement for B cell linker protein (BLNK) in B cell development. Science 286:1949-1954, 1999.

Wienands, J.; Schweikert, J.; Wollscheid, B.; Jumaa, H.; Nielsen, P. J.; Reth, M.: SLP-65: a new signaling component in B lymphocytes which requires expression of the antigen receptor for phosphorylation. J. Exp. Med. 188:791-795, 1998.

Agarwal, A. K.; Garg, A.: A novel heterozygous mutation in peroxisome proliferator-activated receptor-gamma gene in a patient with familial partial lipodystrophy. J. Clin. Endocr. Metab. 87:408-411, 2002.

Muto, T.; Muramatsu, M.; Taniwaki, M.; Kinoshita, K.; Honjo, T.: Isolation, tissue distribution, and chromosomal localization of the human activation-induced cytidine deaminase (AID) gene. Genomics 68:85-88, 2000.

Geck, P.; Maffini, M. V.; Szelei, J.; Sonnenschein, C.; Soto, A. M.: Androgen-induced proliferative quiescence in prostate cancer cells: the role of AS3 as its mediator. Proc. Nat. Acad. Sci. 97:10185-10190, 2000.

Kas, K.; Finger, E.; Grall, F.; Gu, X.; Akbarali, Y.; Boltax, J.; Weiss, A.; Oettgen, P.; Kapeller, R.; Libermann, T. A.: ESE-3, a novel member of an epithelium-specific Ets transcription factor subfamily, demonstrates different target gene specificity from ESE-1. J. Biol. Chem. 275:2986-2998, 2000.

Kleinbaum, L. A.; Duggan, C.; Ferreira, E.; Coffey, G. P.; Buttice, G.; Burton, F. H.: Human chromosomal localization, tissue/tumor expression, and regulatory function of the ets family gene EHF. Biochem. Biophys. Res. Commun. 264:119-126, 1999.

Davidson, J. D.; Riley, B.; Burright, E. N.; Duvick, L. A.; Zoghbi, H. Y.; Orr, H. T.: Identification and characterization of an ataxin-1-interacting protein: A1Up, a ubiquitin-like nuclear protein. Hum. Molec. Genet. 9:2305-2312, 2000.

Zhao, L.; Gregoire, F.; Sul, H. S.: Transient induction of ENC-1, a kelch-related actin-binding protein, is required for adipocyte differentiation. J. Biol. Chem. 275:16845-16850, 2000.

Jones, S. D.; van der Flier, A.; Sonnenberg, A.: Genomic organization of the human alpha-3 integrin subunit gene. Biochem. Biophys. Res. Commun. 248:896-898, 1998.

Takada, Y.; Murphy, E.; Pil, P.; Chen, C.; Ginsberg, M. H.; Hemler, M. E.: Molecular cloning and expression of the cDNA for alpha-3 subunit of human alpha-3/beta-1 (VLA-3), an integrin receptor for fibronectin, laminin, and collagen. J. Cell Biol. 115:257-266, 1991.

Tsuji, T.; Hakomori, S.; Osawa, T.: Identification of human galactoprotein b3, an oncogenic transformation-induced membrane glycoprotein, as VLA-3 alpha subunit: the primary structure of human integrin alpha-3. J. Biochem. 109:659-665, 1991.

Donzeau, M.; Kaldi, K.; Adam, A.; Paschen, S.; Wanner, G.; Guiard, B.; Bauer, M. F.; Neupert, W.; Brunner, M.: Tim23 links the inner and outer mitochondrial membranes. Cell 101:401-412, 2000.

Machesky, L. M.; Insall, R. H.: Scar1 and the related Wiskott-Aldrich syndrome protein, WASP, regulate the actin cytoskeleton through the Arp2/3 complex. Curr. Biol. 8:1347-1356, 1998.

Miki, H.; Suetsugu, S.; Takenawa, T.: WAVE, a novel WASP-family protein involved in actin reorganization induced by Rac. EMBO J. 17:6932-6941, 1998.

Scott, A. F.: Personal Communication. Baltimore, Md. Oct. 23, 2001.

Lennard, A.; Gorman, P.; Carrier, M.; Griffiths, S.; Scotney, H.; Sheer, D.; Solari, R.: Cloning and chromosome mapping of the human interleukin-1 receptor antagonist gene. Cytokine 4:83-89, 1992.

Mansfield, J. C.; Holden, H.; Tarlow, J. K.; Di Giovine, F. S.; McDowell, T. L.; Wilson, A. G.; Holdsworth, C. D.; Duff, G. W.: Novel genetic association between ulcerative colitis and the anti-inflammatory cytokine interleukin-1 receptor antagonist. Gastroenterology 106:637-642, 1994.

Patterson, D.; Jones, C.; Hart, I.; Bleskan, J.; Berger, R.; Geyer, D.; Eisenberg, S. P.; Smith, M. F., Jr.; Arend, W. P.: The human interleukin-1 receptor antagonist (IL1RN) gene is located in the chromosome 2q14 region. Genomics 15:173-176, 1993.

Steinkasserer, A.; Spurr, N. K.; Cox, S.; Jeggo, P.; Sim, R. B.: The human IL-1 receptor antagonist gene (IL1RN) maps to chromosome 2q14-q21, in the region of the IL-1-alpha and IL-1-beta loci. Genomics 13:654-657, 1992.

Tarlow, J. K.; Blakemore, A. I. F.; Lennard, A.; Solari, R.; Hughes, H. N.; Steinkasserer, A.; Duff, G. W.: Polymorphism in human IL-1 receptor antagonist gene intron 2 is caused by variable numbers of an 86-bp tandem repeat. Hum. Genet. 91:403-404, 1993.

Tarlow, J. K.; Clay, F. E.; Cork, M. J.; Blakemore, A. I. F.; McDonagh, A. J. G.; Messenger, A. G.; Duff, G. W.: Severity of alopecia areata is associated with a polymorphism in the interleukin-1 receptor antagonist gene. J. Invest. Dermatol. 103:387-390, 1994.

Schild, D.; Brake, A. J.; Kiefer, M. C.; Young, D.; Barr, P. J.: Cloning of three human multifunctional de novo purine biosynthetic genes by functional complementation of yeast mutations. Proc. Nat. Acad. Sci. 87:2916-2920, 1990.

Garrow, T. A.; Brenner, A. A.; Whitehead, V. M.; Chen, X.-N.; Duncan, R. G.; Korenberg, J. R.; Shane, B.: Cloning of human cDNAs encoding mitochondrial and cytosolic serine hydroxymethyl transferases and chromosomal localization. J. Biol. Chem. 268:11910-11916, 1993.

Kao, F.-T.; Chasin, L. A.; Puck, T. T.: Genetics of somatic mammalian cells. X. Complementation analysis of glycine-requiring mutants. Proc. Nat. Acad. Sci. 64:1284-1291, 1969.

Stover, P. J.; Chen, L. H.; Suh, J. R.; Stover, D. M.; Keyomarsi, K.; Shane, B.: Molecular cloning, characterization, and regulation of the human mitochondrial serine hydroxymethyl transferase gene. J. Biol. Chem. 272:1842-1848, 1997.

Seldin, M. F.; Saunders, A. M.; Rochelle, J. M.; Howard, T. A.: A proximal mouse chromosome 9 linkage map that further defines linkage groups homologous with segments of human chromosomes 11, 15, and 19. Genomics 9:678-685, 1991.

Buckwalter, M. S.; Lossie, A. C.; Scarlett, L. M.; Camper, S. A.: Localization of the human chromosome 5q genes Gabra-1, Gabrg-2, Il-4, Il-5, and Irf-1 on mouse chromosome 11. Mammalian Genome 3:604-607, 1992.

Jensen, K. B.; Dredge, B. K.; Stefani, G.; Zhong, R.; Buckanovich, R. J.; Okano, H. J.; Yang, Y. Y. L.; Darnell, R. B.: Nova-1 regulates neuron-specific alternative splicing and is essential for neuronal viability. Neuron 25:359-371, 2000.

Ozcelik, T.; Suedhof, T. C.; Francke, U.: The genes for inositol 1,4,5-triphosphate receptors 1 (ITPR1) and 3 (ITPR3) are localized on human chromosomes 3p and 6pter-p21, respectively. (Abstract) Cytogenet. Cell Genet. 58:1880, 1991.

Woodroofe, M. N.; Tunnacliffe, A.; Pym, B.; Goodfellow, P. N.; Walsh, F. S.: Human muscle cell surface antigen 16-3A5 is encoded by a gene on chromosome 11. Somat. Cell Molec. Genet. 10:535-540, 1984.

Hasegawa, M.; Fujimoto, M.; Poe, J. C.; Steeber, D. A.; Lowell, C. A.; Tedder, T. F.: A CD19-dependent signaling pathway regulates autoimmunity in Lyn-deficient mice. J. Immun. 167:2469-2478, 2001.

Hasegawa, T.; Hasegawa, Y.; Aso, T.; Koto, S.; Nagai, T.; Tsuchiya, Y.; Kim, K. C.; Ohashi, H.; Wakui, K.; Fukushima, Y.: HDR syndrome (hypoparathyroidism, sensorineural deafness, renal dysplasia) associated with del (10)(p13). Am. J. Med. Genet. 73:416-418, 1997.

Yamada, N.; Makino, Y.; Clark, R. A.; Pearson, D. W.; Mattei, M.-G.; Guenet, J.-L.; Ohama, E.; Fujino, I.; Miyawaki, A.; Furuichi, T.; Mikoshiba, K.: Human inositol 1,4,5-triphosphate type-1 receptor, InsP3R1: structure, function, regulation of expression and chromosomal localization. Biochem. J. 302:781-790, 1994.

Maranto, A. R.: Primary structure, ligand binding, and localization of the human type 3 inositol 1,4,5-trisphosphate receptor expressed in intestinal epithelium. J. Biol. Chem. 269:1222-1230, 1994.

Ozcelik, T.; Suedhof, T. C.; Francke, U.: The genes for inositol 1,4,5-triphosphate receptors 1 (ITPR1) and 3 (ITPR3) are localized on human chromosomes 3p and 6pter-p21, respectively. (Abstract) Cytogenet. Cell Genet. 58:1880 only, 1991.

Yamamoto-Hino, M.; Sugiyama, T.; Hikichi, K.; Mattei, M. G.; Hasegawa, K.; Sekine, S.; Sakurada, K.; Miyawaki, A.; Furuichi, T.; Hasegawa, M.; Mikoshiba, K.: Cloning and characterization of human type 2 and type 3 inositol 1,4,5-triphosphate receptors. Receptors Channels 2:9-22, 1994.

Acquati, F.; Malgaretti, N.; Hauptschein, R.; Rao, P.; Gaidano, G.; Taramelli, R.: A 2-Mb YAC contig linking the plasminogen-apoprotein (a) gene family to the insulin-like growth factor 2 receptor (IGF2R) gene on the telomeric region of chromosome 6 (6q26-q27). Genomics 22:664-666, 1994.

Barlow, D. P.; Stoger, R.; Herrmann, B. G.; Saito, K.; Schweifer, N.: The mouse insulin-like growth factor type-2 receptor is imprinted and closely linked to the Tme locus. Nature 349:84-87, 1991.

DeChiara, T. M.; Robertson, E. J.; Efstratiadis, A.: Parental imprinting of the mouse insulin-like growth factor II gene. Cell 64:849-859, 1991.

De Souza, A. T.; Hankins, G. R.; Washington, M. K.; Fine, R. L.; Orton, T. C.; Jirtle, R. L.: Frequent loss of heterozygosity on 6q at the mannose 6-phosphate/insulin-like growth factor II receptor locus in human hepatocellular tumors. Oncogene 10:1725-1729, 1995.

De Souza, A. T.; Hankins, G. R.; Washington, M. K.; Orton, T. C.; Jirtle, R. L.: M6P/IGF2R gene is mutated in human hepatocellular carcinomas with loss of heterozygosity. Nature Genet. 11:447-449, 1995.

Feinberg, A. P.: Genomic imprinting and gene activation in cancer. Nature Genet. 4:110-113, 1993.

Haig, D.; Graham, C.: Genomic imprinting and the strange case of the insulin-like growth factor II receptor. Cell 64:1045-1046, 1991.

Haig, D.; Westoby, M.: Parent-specific gene expression and the triploid endosperm. Am. Nat. 134:147-155, 1989.

Kalscheuer, V. M.; Mariman, E. C.; Schepens, M. T.; Rehder, H.; Ropers, H.-H.: The insulin-like-growth factor type-2 receptor gene is imprinted in the mouse but not in human S. Nature Genet. 5:74-78, 1993.

Kiess, W.; Blickenstaff, G. D.; Sklar, M. M.; Thomas, C. L.; Nissley, S. P.; Sahagian, G. G.: Biochemical evidence that the type II insulin-like growth factor receptor is identical to the cation-independent mannose 6-phosphate receptor. J. Biol. Chem. 263:9339-9344, 1988.

Killian, J. K.; Oka, Y.; Jang, H.-S.; Fu, X.; Waterland, R. A.; Sohda, T.; Sakaguchi, S.; Jirtle, R. L.: Mannose 6-phosphate/insulin-like growth factor 2 receptor (M6P/IGF2R) variants in American and Japanese populations. Hum. Mutat. 18:25-31, 2001.

Kornfeld, S.; Mellman, I.: The biogenesis of lysosomes. Annu. Rev. Cell Biol. 5:483-525, 1989.

Lau, M. M. H.; Stewart, C. E. H.; Liu, Z.; Bhatt, H.; Rotwein, P.; Stewart, C. L.: Loss of the imprinted IGF2/cation-independent mannose 6-phosphate receptor results in fetal overgrowth and perinatal lethality. Genes Dev. 8:2953-2963, 1994.

Laureys, G.; Barton, D. E.; Ullrich, A.; Francke, U.: Chromosomal mapping of the gene for the type II insulin-like growth factor receptor/cation-independent mannose 6-phosphate receptor in man and mouse. Genomics 3:224-229,1988.

MacDonald, R. G.; Pfeffer, S. R.; Coussens, L.; Tepper, M. A.; Brocklebank, C. M.; Mole, J. E.; Anderson, J. K.: A single receptor binds both insulin-like growth factor II and mannose-6-phosphate. Science 239:1134-1137, 1988.

Morgan, D. O.; Edman, J. D.; Standring, D. N.; Fried, V. A.; Smith, M. C.; Roth, R. A.; Rutter, W. J.: Insulin-like growth factor II receptor as a multifunctional binding protein. Nature 329:301-307,1987.

Otto, E.; Kunimoto, M.; McLaughlin, T.; Bennett, V.: Isolation and characterization of cDNAs encoding human brain ankyrins reveal a family of alternatively spliced genes. J. Cell Biol. 114:241-253,1991.

Tse, W. T.; Menninger, J. C.; Yang-Feng, T. L.; Francke, U.; Sahr, K. E.; Lux, S. E.; Ward, D. C.; Forget, B. G.: Isolation and chromosomal localization of a novel non-erythroid ankyrin gene. Genomics 10:858-866, 1991.

Grundmann, U.; Amann, E.; Abel, K.-J.; Kupper, H. A.: Isolation and expression of cDNA coding for a new member of the phospholipase A2 inhibitor family. Behring Inst. Mitt. 82:59-67, 1988.

Hauptmann, R.; Maurer-Fogy, I.; Krystek, E.; Bodo, G.; Andree, H.; Reutelingsperger, C. P. M.: Vascular anticoagulant beta, a novel human Ca (2+)/phospholipid binding protein that inhibits coagulation and phospholipase A-2 activity: its molecular cloning, expression and comparison with VAC-alpha. Europ. J. Biochem. 185:63-71, 1989.

Tait, J. F.; Smith, C.; Frankenberry, D. A.; Miao, C. H.; Adler, D. A.; Disteche, C. M.: Chromosomal mapping of the human annexin IV (ANX4) gene. Genomics 12:313-318, 1992.

Bilezikian, J. P.; Morishima, A.; Bell, J.; Grumbach, M. M.: Increased bone mass as a result of estrogen therapy in a man with aromatase deficiency. New Eng. J. Med. 339:599-603, 1998.

Oldridge, M.; Temple, I. K. Santos, H. G.; Gibbons, R. J.; Mustafa, Z.; Chapman, K. E.; Loughlin, J.; Wilkie, A. O. M.: Brachydactyly type B: linkage to chromosome 9q22 and evidence for genetic heterogeneity. Am. J. Hum. Genet. 64:578-585, 1999.

Soldatov, N. M.: Genomic structure of human L-type Ca (2+) channel. Genomics 22:77-87, 1994.

Sun, W.; McPherson, J. D.; Hoang, D. Q.; Wasmuth, J. J.; Evans, G. A.; Montal, M.: Mapping of a human brain voltage-gated calcium channel to human chromosome 12p13-pter. Genomics 14:1092-1094,1992.

Tsien, R. W.; Ellinor, P. T.; Horne, W. A.: Molecular diversity of voltage-dependent Ca (2+) channels. Trends Pharm. Sci. 12:349-354,1991.

Schultz, D.; Mikala, G.; Yatani, A.; Engle, D. B.; Iles, D. E.; Segers, B.; Sinke, R. J.; Weghuis, D. O.; Klockner, U.; Wakamori, M.; Wang, J.-J.; Melvin, D.; Varadi, G.; Schwartz, A.: Cloning, chromosomal localization, and functional expression of the alpha-1 subunit of the L-type voltage-dependent calcium channel from normal human heart. Proc. Nat. Acad. Sci. 90:6228-6232, 1993.

Powers, P. A.; Liu, S.; Hogan, K.; Gregg, R. G.: Skeletal muscle and brain isoforms of a beta-subunit of human voltage-dependent calcium channels are encoded by a single gene. J. Biol. Chem. 267:22967-22972,1992.

Gregg, R. G.; Messing, A.; Strube, C.; Beurg, M.; Moss, R.; Behan, M.; Sukhareva, M.; Haynes, S.; Powell, J. A.; Coronado, R.; Powers, P. A.: Absence of the beta subunit (cchb1) of the skeletal muscle dihydropyridine receptor alters expression of the alpha-1 subunit and eliminates excitation-contraction coupling. Proc. Nat. Acad. Sci. 93:13961-13966, 1996.

Iles, D. E.; Segers, B.; Sengers, R. C. A.; Monsieurs, K.; Heytens, L.; Halsall, P. J.; Hopkins, P. M.; Ellis, F. R.; Hall-Curran, J. L.; Stewart, A. D.; Wieringa, B.: Genetic mapping of the beta-1-and gamma-subunits of the human skeletal muscle L-type voltage-dependent calcium channel on chromosome 17q and exclusion as candidate genes for malignant hyperthermia susceptibility. Hum. Molec. Genet. 2:863-868, 1993.

Pragnell, M.; Sakamoto, J.; Jay, S. D.; Campbell, K. P.: Cloning and tissue-specific expression of the brain calcium channel beta-subunit. FEBSLett. 291:253-258, 1991.

Bulun, S. E.: Aromatase deficiency in women and men: would you have predicted the phenotypes? J. Clin. Endocr. Metab. 81:867-871,1996.

Carani, C.; Qin, K.; Simoni, M.; Faustini-Fustini, M.; Serpente, S.; Boyd, J.; Korach, K. S.; Simpson, E. R.: Effect of testosterone and estradiol in a man with aromatase deficiency. New Eng. J. Med. 337:91-95, 1997.

Chen, S.; Besman, M. J.; Sparkes, R. S.; Zollman, S.; Klisak, I.; Mohandas, T.; Hall, P. F.; Shively, J. E.: Human aromatase: cDNA cloning, Southern blot analysis, and assignment of the gene to chromosome 15. DNA 7:27-38, 1988.

Chen, S.; Shively, J. E.; Nakajin, S.; Shinoda, M.; Hall, P. F.: Amino terminal sequence analysis of human placenta aromatase. Biochem. Biophys. Res. Commun. 135:713-719, 1986.

Conte, F. A.; Grumbach, M. M.; Ito, Y.; Fisher, C. R.; Simpson, E. R.: A syndrome of female pseudohermaphrodism, hypergonadotropic hypogonadism, and multicystic ovaries associated with missense mutations in the gene encoding aromatase (P450arom). J. Clin. Endocr. Metab. 78:1287-1292, 1994.

Corbin, C. J.; Graham-Lorence, S.; McPhaul, M.; Mason, J. I.; Mendelson, C. R.; Simpson, E. R.: Isolation of a full-length cDNA insert encoding human aromatase system cytochrome P-450 and its expression in nonsteroidogenic cells. Proc. Nat. Acad. Sci. 85:8948-8952, 1988.

Deladoey, J.; Fluck, C.; Bex, M.; Yoshimura, N.; Harada, N.; Mullis, P. E.: Aromatase deficiency caused by a novel P450(arom) gene mutation:impact of absent estrogen production on serum gonadotropin concentration in a boy. J. Clin. Endocr. Metab. 84:4050-4054, 1999.

Ellis, J. A.; Stebbing, M.; Harrap, S. B.: Significant population variation in adult male height associated with the Y chromosome and the aromatase gene. J. Clin. Endocr. Metab. 86:4147-4150, 2001.

Evans, C. T.; Ledesma, D. B.; Schulz, T. Z.; Simpson, E. R.; Mendelson, C. R.: Isolation and characterization of a complementary DNA specific for human aromatase-system cytochrome P-450 mRNA. Proc. Nat. Acad. Sci. 83:6387-6391, 1986.

Fisher, C. R.; Graves, K. H.; Parlow, A. F.; Simpson, E. R.:Characterization of mice deficient in aromatase (ArKO) because of targeted disruption of the cyp19 gene. Proc. Nat. Acad. Sci. 95:6965-6970, 1998.

George, F. W.; Matsumine, H.; McPhaul, M. J.; Somes, R. G., Jr.; Wilson, J. D.: Inheritance of the henny feathering trait in the Golden Campine chicken: evidence for allelism with the gene that causes henny feathering in the Sebright Bantam. J. Hered. 81:107-110, 1990.

George, F. W.; Wilson, J. D.: Pathogenesis of the henny feathering trait in the Sebright Bantam chicken. J. Clin. Invest. 66:57-65,1980.

Harada, N.: Cloning of a complete cDNA encoding human aromatase:immunochemical identification and sequence analysis. Biochem. Biophys. Res. Commun. 156:725-732, 1988.

Harada, N.; Ogawa, H.; Shozu, M.; Yamada, K.: Genetic studies to characterize the origin of the mutation in placental aromatase deficiency. Am. J. Hum. Genet. 51:666-672, 1992.

Harada, N.; Ogawa, H.; Shozu, M.; Yamada, K.; Suhara, K.; Nishida, E.; Takagi, Y.: Biochemical and molecular genetic analyses on placental aromatase (P-450-AROM) deficiency. J. Biol. Chem. 267:4781-4785,1992.

Hemsell, D. L.; Edman, C. D.; Marks, J. F.; Siiteri, P. K.; MacDonald, P. C.: Massive extraglandular aromatization of plasma androstenedione resulting in feminization of a prepubertal boy. J. Clin. Invest. 60:455-464, 1977.

Ito, Y.; Fisher, C. R.; Conte, F. A.; Grumbach, M. M.; Simpson, E. R.: Molecular basis of aromatase deficiency in an adult female with sexual infantilism and polycystic ovaries. Proc. Nat. Acad. Sci. 90:11673-11677, 1993.

Leiberman, E.; Zachmann, M.: Familial adrenal feminization probably due to increased steroid aromatization. Hormone Res. 37:96-102,1992.

Leshin, M.; Baron, J.; George, F. W.; Wilson, J. D.: Increased estrogen formation and aromatase activity in fibroblasts cultured from the skin of chickens with the Henny feathering trait. J. Biol. Chem. 256:4341-4344, 1981.

Leshin, M.; George, F. W.; Wilson, J. D.: Increased estrogen synthesis in the Sebright bantam is due to a mutation that causes increased aromatase activity. Trans. Assoc. Am. Phys. 94:97-105,1981.

Mango, D.; Montemurro, A.; Scirpa, P.; Bompiani, A.; Menini, E.: Four cases of pregnancy with low estrogen production due to placental enzymatic deficiency. Europ. J. Obstet. Gynec. Reprod. Biol. 8:65-71, 1978.

McTernan, P. G.; Anderson. L. A.; Anwar, A. J.; Eggo, M. C.; Crocker, J.; Barnett, A. H.; Stewart, P. M.; Kumar, S.: Glucocorticoid regulation of P450 aromatase activity in human adipose tissue: gender and site differences. J. Clin. Endocr. Metab. 87:1327-1336, 2002.

Morishima, A.; Grumbach, M. M.; Simpson, E. R.; Fisher, C.; Qin, K.: Aromatase deficiency in male and female siblings caused by a novel mutation and the physiological role of estrogens. J. Clin. Endocr. Metab. 80:3689-3698, 1995.

Mullis, P. E.; Yoshimura, N.; Kuhlmann, B.; Lippuner, K.; Jaeger, P.; Harada, H.: Aromatase deficiency in a female who is compound heterozygote for two new point mutations in the P450(arom) gene: impact of estrogens on hypergonadotropic hypogonadism, multicystic ovaries, and bone densitometry in childhood. J. Clin. Endocr. Metab. 82:1739-1745, 1997.

Phornphutkul, C.; Okubo, T.; Wu, K.; Harel, Z.; Tracy, T. F., Jr.; Pinar, H.; Chen, S.; Gruppuso, P. A.; Goodwin, G.: Aromatase P450 expression in a feminizing adrenal adenoma presenting as isosexual precocious puberty. J. Clin. Endocr. Metab. 86:649-652, 2001.

Robertson, K. M.; O'Donnell, L.; Jones, M. E. E.; Meachem, S. J.; Boon, W. C.; Fisher, C. R.; Graves, K. H.; McLachlan, R. I.; Simpson, E. R.: Impairment of spermatogenesis in mice lacking a functional aromatase (cyp 19) gene. Proc. Nat. Acad. Sci. 96:7986-7991, 1999.

Sebastian, S.; Bulun, S. E.: A highly complex organization of the regulatory region of the human CYP19 (aromatase) gene revealed by the Human Genome Project. J. Clin. Endocr. Metab. 86:4600-4602,2001.

Mohr, J.; Eiberg, H.: Colton blood groups: indication of linkage with the Kidd (Jk) system as support for assignment to chromosome 7. Clin. Genet. 11:372-374, 1977.

Pizon, V.; Chardin, P.; Lerosey, I.; Olofsson, B.; Tavitian, A.: Human cDNAs RAP1 and RAP2 homologous to the Drosophila gene Dras3 encode proteins closely related to ras in the 'effector' region. Oncogene 3:201-204, 1988.

Mimmack, M. L.; Ryan, M.; Baba, H.; Navarro-Ruiz, J.; Iritani, S.; Faull, R. L. M.; McKenna, P. J.; Jones, P. B.; Arai, H.; Starkey, M.; Emson, P. C.; Bahn, S.: Gene expression analysis in schizophrenia:reproducible up-regulation of several members of the apolipoprotein L family located in a high-susceptibility locus for schizophrenia on chromosome 22. Proc. Nat. Acad. Sci. 99:4680-4685, 2002.

Schmauss, C.; McAllister, G.; Ohosone, Y.; Hardin, J. A.; Lerner, M. R.: A comparison of snRNP-associated Sm-autoantigens: human N, rat N and human B/B-prime. Nucleic Acids Res. 17:1733-1743, 1989.

Kovacs, G.; Kung, H.: Nonhomologous chromatid exchange in hereditary and sporadic renal cell carcinomas. Proc. Nat. Acad. Sci. 88:194-198,1991.

Johnson, M. D.; Tho, S. P. T.; Behzadian, A.; McDonough, P. G.: Molecular scanning of Yq11 (interval 6) in men with Sertoli-cell-only syndrome. Am. J. Obstet. Gynec. 161:1732-1737, 1989.

Bolger, G.; Michaeli, T.; Martins, T.; St. John, T.; Steiner, B.; Rodgers, L.; Riggs, M.; Wigler, M.; Ferguson, K.: A family of human phosphodiesterases homologous to the dunce learning and memory gene product of Drosophila melanogaster are potential targets for antidepressant drugs. Molec. Cell. Biol. 13:6558-6571, 1993.

Argyrokastritis, A.; Kamakari, S.; Kapsetaki, M.; Kritis, A.; Talianidis, I.; Moschonas, N. K.: Human hepatocyte nuclear factor-4 (hHNF-4) gene maps to 20q12-q13.1 between PLCG1 and D20S17. Hum. Genet. 99:233-236, 1997.

Coovert, D. D.; Le, T. T.; Morris, G. E.; Man, N. T.; Kralewski, M.; Sendtner, M.; Burghes, A. H. M.: Does the survival motor neuron protein (SMN) interact with Bcl-2? (Letter) J. Med. Genet. 37:536-539,2000.

Weaver, D. R.; Rivkees, S. A.; Carlson, L. L.; Reppert, S. M.: Localization of melatonin receptors in mammalian brain. In: Klein, D. C.; Moore, R. Y.; Reppert, S. M.: Suprachiasmatic Nucleus: The Mind's Clock. New York: Oxford Press (pub.) 1991.

Wei, Y.-F.; Robins, P.; Carter, K.; Caldecott, K.; Pappin, D. J. C.; Yu, G.-L.; Wang, R.-P.; Shell, B. K.; Nash, R. A.; Schar, P.; Barnes, D. E.; Haseltine, W. A.; Lindahl, T.: Molecular cloning and expression of human cDNAs encoding a novel DNA ligase IV and DNA ligase III, an enzyme active in DNA repair and recombination. Molec. Cell. Biol. 15:3206-3216, 1995.

Pickard, R. T.; Strifler, B. A.; Kramer, R. M.; Sharp, J. D.: Molecular cloning of two new human paralogs of 85-kDa cytosolic phospholipase A2. J. Biol. Chem. 274:8823-8831, 1999.

Chua, A. O.; Chizzonite, R.; Desai, B. B.; Truitt, T. P.; Nunes, P.; Minetti, L. J.; Warrier, R. R.; Presky, D. H.; Levine, J. F.; Gately, M. K.; Gubler, U.: Expression cloning of a human IL-12 receptor component: a new member of the cytokine receptor superfamily with strong homology to gp130. J. Immun. 153:128-136, 1994.

Wedemeyer, N.; Peoples, R.; Himmelbauer, H.; Lehrach, H.; Francke, U.; Wanker, E. E.: Localization of the human HIP1 gene close to the elastin (ELN) locus on 7q11.23. Genomics 46:313-315, 1997.

Zetterstrom, R. H.; Solomin, L.; Jansson, L.; Hoffer, B. J.; Olson, L.; Perlmann, T.: Dopamine neuron agenesis in Nurr1-deficient mice. Science 276:248-250, 1997.

Gong, D.-W.; Monemdjou, S.; Gavrilova, O.; Leon, L. R.; Marcus-Samuels, B.; Chou, C. J.; Everett, C.; Kozak, L. P.; Li, C.; Deng, C.; Harper, M.-E.; Reitman, M. L.: Lack of obesity and normal response to fasting and thyroid hormone in mice lacking uncoupling protein-3. J. Biol. Chem. 275: 16251-16257, 2000.

Ye, H.; Kelly, T. F.; Samadani, U.; Lim, L.; Rubio, S.; Overdier, D. G.; Roebuck, K. A.; Costa, R. H.: Hepatic nuclear factor 3/fork head homolog 11 is expressed in proliferating epithelial and mesenchymal cells of embryonic and adult tissues. Molec. Cell. Biol. 17:1626-1641,1997.

Bryan, J.; Kane, R. E.: Actin gelation in sea urchin egg extracts. Methods Cell Biol. 25:175-199, 1982.

Bittner, R. E.; Anderson, L. V. B.; Burkhardt, E.; Bashir, R.; Vafiadaki, E.; Ivanova, S.; Raffelsberger, T.; Maerk, I.; Hoger, H.; Jung, M.; Karbasiyan, M.; Storch, M.; Lassmann, H.; Moss, J. A.; Davison, K.; Harrison, R.; Bushby, K. M. D.; Reis, A.: Dysferlin deletion in SJL mice (SJL-Dysf) defines a natural model for limb girdle muscular dystrophy 2B. (Letter) Nature Genet. 23:141-142, 1999.

Koi, M.; Johnson, L. A.; Kalikin, L. M.; Little, P. F. R.; Nakamura, Y.; Feinberg, A. P.: Tumor cell growth arrest caused by subchromosomal transferable DNA fragments from chromosome 11. Science 260:361-364,1993.

Makoff, A.; Pilling, C.; Harrington, K.; Emson, P.: Human metabotropic glutamate receptor type 7: molecular cloning and mRNA distribution in the CNS. Molec. Brain Res. 40:165-170, 1996.

Esterbauer, H.; Oberkofler, H.; Krempler, F.; Patsch, W.: human peroxisome proliferator activated receptor gamma coactivator 1 (PPARGC1) gene: cDNA sequence, genomic organization, chromosomal localization, and tissue expression. Genomics 62:98-102, 1999.

Lietzke, S. E.; Bose, S.; Cronin, T.; Klarlund, J.; Chawla, A.; Czech, M. P.; Lambright, D. G.: Structural basis of 3-phosphoinositide recognition by pleckstrin homology domains. Molec. Cell 6:385-394,2000.

Xu, F.; Xia, W.; Luo, R. Z.; Peng, H.; Zhao, S.; Dai, J.; Long, Y.; Zou, L.; Le, W.; Liu, J.; Parlow, A. F.; Hung, M.-C.; Bast, R. C., Jr.; Yu, Y.: The human ARHI tumor suppressor gene inhibits lactation and growth in transgenic mice. Cancer Res. 60:4913-4920, 2000.

Tsuchida, K.; Arai, K. Y.; Kuramoto, Y.; Yamakawa, N.; Hasegawa, Y.; Sugino, H.: Identification and characterization of a novel follistatin-like protein as a binding protein for the TGF-beta family. J. Biol. Chem. 275:40788-40796, 2000.

Takatsu, H.; Yoshino, K.; Nakayama, K.: Adaptor gamma-ear homology domain conserved in gamma-adaptin and GGA proteins that interact with gamma-synergin. Biochem. Biophys. Res. Commun. 271:719-725, 2000.

Burbelo, P. D.; Snow, D. M.; Bahou, W.; Spiegel, S.: MSE55, a Cdc42 effector protein, induces long cellular extensions in fibroblasts. Proc. Nat. Acad. Sci. 96:9083-9088, 1999.

Tsavaler, L.; Shapero, M. H.; Morkowski, S.; Laus, R.: Trp-p8, a novel prostate-specific gene, is up-regulated in prostate cancer and other malignancies and shares high homology with transient receptor potential calcium channel proteins. Cancer Res. 61:3760-3769, 2001.

Rafi, M. A.; Luzi, P.; Chen, Y. Q.; Wenger, D. A.: A large deletion together with a point mutation in the GALC gene is a common mutant allele in patients with infantile Krabbe disease. Hum. Molec. Genet. 4:1285-1289, 1995.

Okamoto, S.; Matsushima, M.; Nakamura, Y.: Identification, genomic organization, and alternative splicing of KNSL3, a novel human gene encoding a kinesin-like protein. Cytogenet. Cell Genet. 83:25-29,1998.

Andreev, J.; Simon, J.-P.; Sabatini, D. D.; Kam, J.; Plowman, G.; Randazzo, P. A.; Schlessinger, J.: Identification of a new Pyk2 target protein with Arf-GAP activity. Molec. Cell. Biol. 19:2338-2350,1999.

Burden, S.; Yarden, Y.: Neuregulins and their receptors: a versatile signaling module in organogenesis and oncogenesis. Neuron 18:847-855,1997.

Busfield, S. J.; Michnick, D. A.; Chickering, T. W.; Revett, T. L.; Ma, J.; Woolf, E. A.; Comrack, C. A.; Dussault, B. J.; Woolf, J.; Goodearl, A. D. J.; Gearing, D. P.: Characterization of a neuregulin-related gene, Don-1, that is highly expressed in restricted regions of the cerebellum and hippocampus. Molec. Cell. Biol. 17:4007-4014, 1997.

Carraway, K. L., III; Weber, J. L.; Unger, M. J.; Ledesma, J.; Yu, N.; Gassmann, M.; Lai, C.: Neuregulin-2, a new ligand of ErbB3/ErbB4-receptor tyrosine kinases. Nature 387:512-516, 1997.

Chang, H.; Riese, D. J., II; Gilbert, W.; Stern, D. F.; McMahan, U. J.: Ligands for ErbB-family receptors encoded by a neuregulin-like gene. Nature 387:509-512, 1997.

Ring, H. Z.; Chang, H.; Guilbot, A.; Brice, A.; LeGuern, E.; Francke, U.: The human neuregulin-2 (NRG2) gene: cloning, mapping and evaluation as a candidate for the autosomal recessive form of Charcot-Marie-Tooth disease linked to 5q. Hum. Genet. 104:326-332, 1999.

Yamada, K.; Ichino, N.; Nishii, K.; Sawada, H.; Higashiyama, S.; Ishiguro, H.; Nagatsu, T.: Characterization of the human NTAK gene structure and distribution of the isoforms for rat NTAK mRNA. Gene 255:15-24, 2000.

Hu, R.-J.; Lee, M. P.; Connors, T. D.; Johnson, L. A.; Burn, T. C.; Su, K.; Landes, G. M.; Feinberg, A. P.: A 2.5-Mb transcript map of a tumor-suppressing subchromosomal transferable fragment from 11p15.5, and isolation and sequence analysis of three novel genes. Genomics 46:9-17, 1997.

Stephan, D.; Bon, C.; Holzwarth, J. A.; Galvan, M.; Pruss, R. M.: Human metabotropic glutamate receptor 1: mRNA distribution, chromosome localization and functional expression of two splice variants. Neuropharmacology 35:1649-1660, 1996.

Korner, C. G.; Wahle, E.: Poly (A) tail shortening by a mammalian poly (A)-specific 3-prime-exoribonuclease. J. Biol. Chem. 272:10448-10456,1997.

Korner, C. G.; Wormington, M.; Muckenthaler, M.; Schneider, S.; Dehlin, E.; Wahle, E.: The deadenylating nuclease (DAN) is involved in poly (A) tail removal during the meiotic maturation of Xenopus oocytes. EMBO J. 17:5427-5437, 1998.

Schmidt, A.; Wolde, M.; Thiele, C.; Fest, W.; Kratzin, H.; Podtelejnikov, A. V.; Witke, W.; Huttner, W. B.; Soling, H.-D.:

Endophilin I mediates synaptic vesicle formation by transfer of arachidonate to lysophosphatidic acid. Nature 401:133-141, 1999.

Aiba, A.; Chen, C.; Herrup, K.; Rosenmund, C.; Stevens, C. F.; Tonegawa, S.: Reduced hippocampal long-term potentiation and context-specific deficit in associative learning in mGluR1 mutant mice. Cell 79:365-375, 1994.

Aiba, A.; Kano, M.; Chen, C.; Stanton, M. E.; Fox, G. D.; Herrup, K.; Zwingman, T. A.; Tonegawa, S.: Deficient cerebellar long-term depression and impaired motor learning in mGluR1 mutant mice. Cell 79:377-388, 1994.

Conquet, F.; Bashir, Z. I.; Davies, C. H.; Daniel, H.; Ferraguti, F.; Bordi, F.; Franz-Bacon, K.; Reggiani, A.; Matarese, V.; Conde, F.; Collingridge, G. L.; Crepel, F.: Motor deficit and impairment of synaptic plasticity in mice lacking mGluR1. Nature 372:237-243,1994.

Ganesh, S.; Amano, K.; Yamakawa, K.: Assignment of the gene GRM1 coding for metabotropic glutamate receptor 1 to human chromosome band 6q24 by in situ hybridization. Cytogenet. Cell Genet. 88:314-315,2000.

Ichise, T.; Kano, M.; Hashimoto, K.; Yanagihara, D.; Nakao, K.; Shigamoto, R.; Katsuki, M.; Alba, A.: mGluR1 in cerebellar Purkinje cells essential for long-term depression, synapse elimination, and motor coordination. Science 288: 1832-1835, 2000.

Kunishima, N.; Shimada, Y.; Tsuji, Y.; Sato, T.; Yamamoto, M.; Kumasaka, T.; Nakanishi, S.; Jingami, H.; Morikawa, K.: Structural basis of glutamate recognition by a dimeric metabotropic glutamate receptor. Nature 407:971-977, 2000.

Okamoto, T.; Sekiyama, N.; Otsu, M.; Shimada, Y.; Sato, A.; Nakanishi, S.; Jingami, H.: Expression and purification of the extracellular ligand binding region of metabotropic glutamate receptor subtype 1. J. Biol. Chem. 273:13089-13096, 1998.

Smitt, P. S.; Kinoshita, A.; De Leeuw, B.; Moll, W.; Coesmans, M.; Jaarsma, D.; Henzen-Logmans, S.; Vecht, C.; De Zeeuw, C.; Sekiyama, N.; Nakanishi, S.; Shigemoto, R.: Paraneoplastic cerebellar ataxia due to autoantibodies against a glutamate receptor. New Eng. J. Med. 342:21-27, 2000.

Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human genes. XII. The complete sequences of 100 new cDNA clones from brain which code for large proteins in vitro. DNA Res. 5:355-364, 1998.

Chadwick, B. P.; Kidd, T.; Sgouros, J.; Ish-Horowicz, D.; Frischauf, A.-M.: Cloning, mapping and expression of UBL3, a novel ubiquitin-like gene. Gene 233:189-195, 1999.

Hodges, M.; Tissot, C.; Freemont, P. S. Protein regulation: tag wrestling with relatives of ubiquitin. Curr. Biol. 8: R749-R752,1998.

Bora, R. S.; Kanamori, A.; Hirabayashi, Y.: Assignment of a putative acetyl-CoA transporter gene (Acatn) to mouse chromosome band 3E1-E3 by in situ hybridization. Cytogenet. Cell Genet. 83:78-79, 1998.

Kirikoshi, H.; Sagara, N.; Koike, J.; Tanaka, K.; Sekihara, H.; Hirai, M.; Katoh, M.: Molecular cloning and characterization of human frizzled-4 on chromosome 11q14-q21. Biochem. Biophys. Res. Commun. 264:955-961, 1999.

Kowal, R. C.; Jolsin, J. M.; Olson, E. N.; Schultz, R. A.: Assignment of fibulin-5 (FBLN5) to human chromosome 14q31 by in situ hybridization and radiation hybrid mapping. Cytogenet. Cell Genet. 87:2-3, 1999.

Nakamura, T.; Lozano, P. R.; Ikeda, Y.; Iwanaga, Y.; Hinek, A.; Minamisawa, S.; Cheng, C.-F.; Kobuke, K.; Dalton, N.; Takada, Y.; Tashiro, K.; Ross, J., Jr.; Honjo, T.; Chien, K. R.: Fibulin-5/DANCE is essential for elastogenesis in vivo. Nature 415:171-175, 2002.

Nakamura, T.; Ruiz-Lozano, P.; Lindner, V.; Yabe, D.; Taniwaki, M.; Furukawa, Y.; Kobuke, K.; Tashiro, K.; Lu, Z.; Andon, N. L.; Schaub, R.; Matsumori, A.; Sasayama, S.; Chien, K. R.; Honjo, T.: DANCE, a novel secreted RGD protein expressed in developing, atherosclerotic, and balloon-injured arteries. J. Biol. Chem. 274:22476-22483, 1999.

Yanagisawa, H.; Davis, E. C.; Starcher, B. C.; Ouchi, T.; Yanagisawa, M.; Richardson, J. A.; Olson, E. N.: Fibulin-5 is an elastin-binding protein essential for elastic fibre development in vivo. Nature 415:168-171, 2002.

Robitaille, J.; MacDonald, M. L. E.; Kaykas, A.; Sheldahl, L. C.; Zeisler, J.; Dube, M.-P.; Zhang, L.-H.; Singaraja, R. R.; Guernsey, D. L.; Zhang, B.; Siebert, L. F.; Hoskin-Mott, A.; Trese, M. T.; Pimstone, S. N.; Shastry, B. S.; Moon, R. T.; Hayden, M. R.; Goldberg, Y. P.; Samuels, M. E.: Mutant frizzled-4 disrupts retinal angiogenesis in familial exudative vitreoretinopathy. Nature Genet. 32:326-330,2002.

Dong, F.; Feldmesser, M.; Casadevall, A.; Rubin, C. S.: Molecular characterization of a cDNA that encodes six isoforms of a novel murine A kinase anchor protein. J. Biol. Chem. 273:6533-6541, 1998.

Dent, A. L.; Yewdell, J.; Puvion-Dutilleul, F.; Koken, M. H.; deThe, H.; Staudt, L. M.: LYSP100 associated nuclear domains (LANDs):description of a new class of subnuclear structures and their relationship to PML nuclear bodies. Blood 88:1423-1426, 1996.

Seeler, J. S.; Marchio, A.; Sitterlin, D.; Transy, C.; Dejean, A.: Interaction of SP100 with HP1 proteins: a link between the promyelocytic leukemia-associated nuclear bodies and the chromatin compartment. Proc. Nat. Acad. Sci. 95:7316-7321, 1998.

Scanlan, M. J.; Chen, Y.-T.; Williamson, B.; Gure, A. O.; Stockert, E.; Gordan, J. D.; Tureci, O.; Sahin, U.; Pfreundschuh, M.; Old, L. J.: Characterization of human colon cancer antigens recognized by autologous antibodies. Int. J. Cancer 76:652-658, 1998.

Halford, S.; Dulai, K. S.; Daw, S. C.; Fitzgibbon, J.; Hunt, D. M.: Isolation and chromosomal localization of two human CDP-diacylglycerol synthase (CDS) genes. Genomics 54:140-144, 1998.

Volta, M.; Bulfone, A.; Gattuso, C.; Rossi, E.; Mariani, M.; Consalez, G. G.; Zuffardi, O.; Ballabio, A.; Banfi, S.; Franco, B.: Identification and characterization of CDS2, a mammalian homolog of the Drosophila CDP-diacylglycerol synthase gene. Genomics 55:68-77, 1999.

Borsani, G.; DeGrandi, A.; Ballabio, A.; Bulfone, A.; Bernard, L.; Banfi, S.; Gattuso, C.; Mariani, M.; Dixon, M.; Donnai, D.; Metcalfe, K.; Winter, R.; Robertson, M.; Axton, R.; Brown, A.; van Heyningen, V.; Hanson, I.: EYA4, a novel vertebrate gene related to Drosophila eyes absent. Hum. Molec. Genet. 8:11-23, 1999.

Kanamori, A.; Nakayama, J.; Fukuda, M. N.; Stallcup, W. B.; Sasaki, K.; Fukuda, M.; Hirabayashi, Y.: Expression cloning and characterization of a cDNA encoding a novel membrane protein required for the formation of O-acetylated ganglioside: a putative acetyl-CoA transporter. Proc. Nat. Acad. Sci. 94:2897-2902, 1997.

Holmes, M.; Turner, J.; Fox, A.; Chisholm, O.; Crossley, M.; Chong, B.: hFOG-2, a novel zinc finger protein, binds the co-repressor mCtBP2 and modulates GATA-mediated activation. J. Biol. Chem. 274:23491-23498,1999.

Svensson, E. C.; Huggins, G. S.; Lin, H.; Clendenin, C.; Jiang, F.; Tufts, R.; Dardik, F. B.; Leiden, J. M.: A syndrome of tricuspid atresia in mice with a targeted mutation of the gene encoding Fog-2. Nature Genet. 25:353-356, 2000.

Svensson, E. C.; Tufts, R. L.; Polk, C. E.; Leiden, J. M.: molecular cloning of FOG-2: a modulator of transcription factor GATA-4 in cardio myocytes. Proc. Nat. Acad. Sci. 96:956-961, 1999.

Tevosian, S. G.; Deconinck, A. E.; Tanaka, M.; Schinke, M.; Litovsky, S. H.; Izumo, S.; Fujiwara, Y.; Orkin, S. H.: FOG-2, a cofactor for GATA transcription factors, is essential for heart morphogenesis and development of coronary vessels from epicardium. Cell 101:729-739,2000.

Behrends, S.; Kazmierczak, B.; Steenpass, A.; Knauf, B.; Bullerdiek, J.; Scholz, H.; Eiberg, H.: Assignment of GUCY1B2, the gene coding for the beta-2 subunit of human guanylyl cyclase to chromosomal band 13q14.3 between markers D13S168 and D13S155. Genomics 55:126-127, 1999.

Malterer, A.; Gupta, G.; Danziger, R. S.: Assignment of GUCY1B2, the human homologue of a candidate gene for hypertension, to chromosome bands 13q14.2-q14.3 by in situ hybridization. Cytogenet. Cell Genet. 85:256-257, 1999.

Yuen, P. S. T.; Potter, L. R.; Garbers, D. L.: A new form of guanylylcyclase is preferentially expressed in rat kidney. Biochemistry 29:10872-10878, 1990.

Paavola, P.; Horelli-Kuitunen, N.; Palotie, A.; Peltonen, L.:Characterization of a novel gene, PNUTL2, on human chromosome 17q22-q23 and its exclusion as the Meckel syndrome gene. Genomics 55:122-125,1999.

Savov, A.; Angelicheva, D.; Balassopoulou, A.; Jordanova, A.; Noussia-Arvanitakis, S.; Kalaydjieva, L.: Double mutant alleles:are they rare? Hum. Molec. Genet. 4:1169-1171, 1995.

Bahary, N.; Zorich, G.; Pachter, J. E.; Leibel, R. L.; Friedman, J. M.: Molecular genetic linkage maps of mouse chromosomes 4 and 6. Genomics 11:33-47, 1991.

Arnaout, M. A.; Gupta, S. K.; Pierce, M. W.; Tenen, D. G.: Amino acid sequence of the alpha subunit of human leukocyte adhesion receptor Mo1 (complement receptor type 3). J. Cell Biol. 106:2153-2158,1988.

Arnaout, M. A.; Remold-O'Donnell, E.; Pierce, M. W.; Harris, P.; Tenen, D. G.: Molecular cloning of the alpha-subunit of human and guinea pig leukocyte adhesion glycoprotein Mo1: chromosomal localization and homology to the alpha-subunits of integrins. Proc. Nat. Acad. Sci. 85:2776-2780, 1988.

Callen, D. F.; Chen, L. Z.; Nancarrow, J.; Whitmore, S. A.; Apostolou, S.; Thompson, A. D.; Lane, S. A.; Stallings, R. L.; Hildebrand, C. E.; Harris, P. G.; Sutherland, G. R.: Current state of the physical map of human chromosome 16. (Abstract) Cytogenet. Cell Genet. 58:1998 only, 1991.

Corbi, A. L.; Kishimoto, T. K.; Miller, L. J.; Springer, T. A.: The human leukocyte adhesion glycoprotein Mac-1 (complement receptor type 3, CD11b) alpha subunit: cloning, primary structure, and relation to the integrins, von Willebrand factor and factor B. J. Biol. Chem. 263:12403-12411, 1988.

Corbi, A. L.; Larson, R. S.; Kishimoto, T. K.; Springer, T. A.; Morton, C. C.: Chromosomal location of the genes encoding the leukocyte adhesion receptors LFA-1, Mac-1 and p150, 95: identification of a gene cluster involved in cell adhesion. J. Exp. Med. 167:1597-1607,1988.

Pierce, M. W.; Remold-O'Donnell, E.; Todd, R. F., III; Arnaout, M. A.: N-terminal sequence of human leukocyte glycoprotein Mo1: conservation across species and homology to platelet IIb/IIIa. Biochim. Biophys. Acta 874:368-371, 1986.

Simon, D. I.; Chen, Z.; Seifert, P.; Edelman, E. R.; Ballantyne, C. M.; Rogers, C.: Decreased neointimal formation in Mac-1 -/- mice reveals a role for inflammation in vascular repair after angioplasty. J. Clin. Invest. 105:293-300, 2000.

Springer, T. A.; Teplow, D. B.; Dreyer, W. J.: Sequence homology of the LFA-1 and Mac-1 leukocyte adhesion glycoproteins and unexpected relation to leukocyte interferon. Nature 314:540-542, 1985.

Petersen, M. B.; Slaugenhaupt, S. A.; Lewis, J. G.; Warren, A. C.; Chakravarti, A.; Antonarakis, S. E.: A genetic linkage map of 27 markers on human chromosome 21. Genomics 9:407-419, 1991.

Law, M. L.; Kao, F.-T.: Induced segregation of human syntenic genes by 5-bromodeoxyuridine plus near-visible light. Somat. Cell Genet. 4:465-476, 1978.

Okabe, I.; Nussbaum, R. L.: Identification and chromosomal mapping of the mouse inositol polyphosphate 1-phosphatase gene. Genomics 30:358-360, 1995.

Woodcock, E. A.; Wang, B. H.; Arthur, J. F.; Lennard, A.; Matkovich, S. J.; Du, X.-J.; Brown, J. H.; Hannan, R. D.: Inositol polyphosphate 1-phosphatase is a novel antihypertrophic factor. J. Biol. Chem. 277:22734-22742, 2002.

York, J. D.; Veile, R. A.; Donis-Keller, H.; Majerus, P. W.: Cloning, heterologous expression, and chromosomal localization of human inositol polyphosphate 1-phosphatase. Proc. Nat. Acad. Sci. 90:5833-5837,1993.

Janne, P. A.; Dutra, A. S.; Dracopoli, N. C.; Charnas, L. R.; Puck, J. M.; Nussbaum, R. L.: Localization of the 75-kDa inositol polyphosphate-5-phosphatase (INPP5B) to human chromosome band 1p34. Cytogenet. Cell Genet. 66:164-166, 1994.

Janne, P. A.; Rochelle, J. M.; Martin-DeLeon, P. A.; Stambolian, D.; Seldin, M. F.; Nussbaum, R. L.: Mapping of the 75-kDa inositol polyphosphate-5-phosphatase (Inpp5b) to distal mouse chromosome 4 and its exclusion as a candidate gene for dysgenetic lens. Genomics 28:280-285, 1995.

Ross, T. S.; Jefferson, A. B.; Mitchell, C. A.; Majerus, P. W.: Cloning and expression of human 75-kDa inositol polyphosphate-5-phosphatase. J. Biol. Chem. 266:20283-20289, 1991.

Matsumoto, M.; Nakagawa, T.; Inoue, T.; Nagata, E.; Tanaka, K.; Takano, H.; Minowa, O.; Kuno, J.; Sakakibara, S.; Yamada, M.; Yoneshima, H.; Miyawaki, A; Fukuichi, T.; Furuichi, T.; Okano, H.; Mikoshiba, K.; Noda, T.: Ataxia and epileptic seizures in mice lacking type 1 inositol 1,4,5-triphosphate receptor. Nature 379:168-171, 1996.

Nucifora, F. C., Jr.; Li, S.-H.; Danoff, S.; Ullrich, A.; Ross, C. A.: Molecular cloning of a cDNA for the human inositol 1,4,5-trisphosphate receptor type 1, and the identification of a third alternatively spliced variant. Molec. Brain Res. 32:291-296, 1995.

Bradham, D. M.; Igarashi, A.; Potter, R. L.; Grotendorst, G. R.: Connective tissue growth factor: a cysteine-rich mitogen secretedby human vascular endothelial cells is related to the SRC-induced immediate early gene product CEF-10. J. Cell Biol. 114:1285-1294,1991.

Aguilar-Salinas, C. A.; Reyes-Rodriguez, E.; Ordonez-Sanchez, M. L.; Torres, M. A.; Ramirez-Jimenez, S.; Dominguez-Lopez, A.; Martinez-Francois, J. R.; Velasco-Perez, M. L.; Alpizar, M.; Garcia-Garcia, E.; Gomez-Perez, F.; Rull, J.; Tusie-Luna, M. T.: Early-onset type 2 diabetes: metabolic and genetic characterization in the Mexican population. J. Clin. Endocr. Metab. 86:220-226, 2001.

DerKinderen, D. J.; Koten, J. W.; Tan, K. E. W. P.; Beemer, F. A.; Van Romunde, L. K. J.; Den Otter, W.: Parental age in sporadic hereditary retinoblastoma. Am. J. Ophthal. 110:605-609, 1990.

Orphanides, G.; Wu, W.-H.; Lane, W. S.; Hampsey, M.; Reinberg, D.: The chromatin-specific transcription elongation factor FACT comprises human SPT16 and SSRP1 proteins. Nature 400:284-288, 1999.

Friedman, L. S.; Ostermeyer, E. A.; Lynch, E. D.; Welcsh, P.; Szabo, C. I.; Meza, J. E.; Anderson, L. A.; Dowd, P.; Lee, M. K.; Rowell, S. E.; Ellison, J.; Boyd, J.; King, M.-C.:22 genes from chromosome 17q21: cloning, sequencing, and characterization of mutations in breast cancer families and tumors. Genomics 25:256-163, 1995.

Linial, M.; Miller, K.; Scheller, R. H.: VAT-1: an abundant membrane protein from Torpedo cholinergic synaptic vesicles. Neuron 2:1265-1273,1989.

Smith, T. M.; Lee, M. K.; Szabo, C. I.; Jerome, N.; McEuen, M.; Taylor, M.; Hood, L.; King, M.-C.: Complete genomic sequence and analysis of 117 kb of human DNA containing the gene BRCA1. Genome Res. 6:1029-1049, 1996.

Johnstone, R. W.; Tommerup, N.; Hansen, C.; Vissing, H.; Shi, Y.: Structural organization, tissue expression, and chromosomal localization of Ciao 1, a functional modulator of the Wilms' tumor suppressor, WT1. Immunogenetics 49:900-905, 1999.

Johnstone, R. W.; Wang, J.; Tommerup, N.; Vissing, H.; Roberts, T.; Shi, Y.: Ciao 1 is a novel WD40 protein that interacts with the tumor suppressor protein WT1. J. Biol. Chem. 273:10880-10887, 1998.

Huebner, K.; Cannizzaro, L. A.; Nakamura, T.; Hillova, J.; Mariage-Samson, R.; Hecht, F.; Hill, M.; Croce, C. M.: A rearranged transforming gene, tre, is made up of human sequences derived from chromosome regions 5q, 17q and 18q. Oncogene 3:449-455, 1988.

Nakamura, T.; Hillova, J.; Mariage-Samson, R.; Hill, M.: molecular cloning of a novel oncogene generated by DNA recombination during transfection. Oncogene Res. 2:357-370, 1988.

Nakamura, T.; Hillova, J.; Mariage-Samson, R.; Onno, M.; Huebner, K.; Cannizzaro, L. A.; Boghosian-Sell, L.; Croce, C. M.; Hill, M.: A novel transcriptional unit of the tre oncogene widely expressed in human cancer cells. Oncogene 7:733-741, 1992.

Gruber, A. D.; Pauli, B. U.: Molecular cloning and biochemical characterization of a truncated, secreted member of the human family of Ca (2+)-activated Cl- channels. Biochim. Biophys. Acta 1444:418-423,1999.

Bause, E.; Bieberich, E.; Rolfs, A.; Volker, C.; Schmidt, B.:Molecular cloning and primary structure of Man (9)-mannosidase from human kidney. Eur. J. Biochem. 217:535-540, 1993.

Tremblay, L. O; Campbell Dyke, N.; Herscovics, A.: Molecular cloning, chromosomal mapping and tissue-specific expression of a novel human Alpha-1,2-mannosidase gene involved in N-glycan maturation. Glycobiology 8:585-595, 1998.

Ueno, M.; Kimura, N.; Nakashima, K.; Saito-Ohara, F.; Inazawa, J.; Taga, T.: Genomic organization, sequence and chromosomal localization of the mouse Tbr2 gene and a comparative study with Tbr1. Gene 254:29-35, 2000.

Baker, E.; Crawford, J.; Sutherland, G. R.; Freeman, C.; Parish, C. R.; Hulett, M. D.: Human HPA endoglycosidase heparanase. Chromosome Res. 7:319 only, 1999.

Hulett, M. D.; Freeman, C.; Hamdorf, B. J.; Baker, R. T.; Harris, M. J.; Parish, C. R.: Cloning of mammalian heparanase, an important enzyme in tumor invasion and metastasis. Nature Med. 5:803-809,1999.

Kussie, P. H.; Hulmes, J. D.; Ludwig, D. L.; Patel, S.; Navarro, E. C.; Seddon, A. P.; Giorgio, N. A.; Bohlen, P.: Cloning and functional expression of a human heparanase gene. Biochem. Biophys. Res. Commun. 261:183-187, 1999.

Toyoshima, M.; Nakajima, M.: Human heparanase: purification, characterization, cloning, and expression. J. Biol. Chem. 274:24153-24160, 1999.

Vlodavsky, I.; Friedmann, Y.; Elkin, M.; Aingorn, H.; Atzmon, R.; Ishai-Michaeli, R.; Bitan, M.; Pappo, O.; Peretz, T.; Michal, I.; Spector, L.; Pecker, I.: Mammalian heparanase: gene cloning, expression and function in tumor progression and metastasis. Nature Med. 5:793-802, 1999.

Wu, X.; Kekuda, R.; Huang, W.; Fei, Y.-J.; Leibach, F. H.; Chen, J.; Conway, S. J.; Ganapathy, V.: Identity of the organic cation transporter OCT3 as the extraneuronal monoamine transporter (uptake-2) and evidence for the expression of the transporter in the brain. J. Biol. Chem. 273:32776-32786, 1998.

Seki, N.; Ohira, M.; Nagase, T.; Ishikawa, K.; Miyajima, N.; Nakajima, D.; Nomura, N.; Ohara, O.: Characterization of cDNA clones in size-fractionated cDNA libraries from human brain. DNA Res. 4:345-349, 1997.

Hubener, C.; Mincheva, A.; Lichter, P.; Schraven, B.; Bruyns, E.: Genomic organization and chromosomal localization of the human gene encoding the T-cell receptor-interacting molecule (TRIM). Immunogenetics 51:154-158, 2000.

Bruyns, E.; Marie-Cardine, A.; Kirchgessner, H.; Sagolla, K.; Shevchenko, A.; Mann, M.; Autschbach, F.; Bensussan, A.; Meuer, S.; Schraven, B.: T cell receptor (TCR) interacting molecule (TRIM), a novel disulfide-linked dimer associated with the TCR-CD3-zeta complex, recruits intracellular signaling proteins to the plasma membrane. J. Exp. Med. 188: 561-575,1998.

Zhao, R.; Qi, Y.; Chen, J.; Zhao, Z. J.: FYVE-DSP2, a FYVE domain-containing dual specificity protein phosphatase that dephosphorylates phosphotidyl inositol (sic) 3-phosphate. Exp. Cell Res. 265:329-338, 2001.

Cui, X.; DeVivo, I.; Slany, R.; Miyamoto, A.; Firestein, R.; Cleary, M. L.: Association of SET domain and myotubularin-related proteins modulates growth control. Nature Genet. 18:331-337, 1998.

Heisenberg, C.-P.; Tada, M.; Rauch, G.-J.; Saude, L.; Concha, M. L.; Geisler, R.; Stemple, D. L.; Smith, J. C.; Wilson, S. W.: Silberblick/Wnt11 mediates convergent extension movements during zebrafish gastrulation. Nature 405:76-81, 2000.

Lako, M.; Strachan, T.; Bullen, P.; Wilson, D. I.; Robson, S. C.; Lindsay, S.: Isolation, characterisation and embryonic expression of WNT11, a gene which maps to 11q13.5 and has possible roles in the development of skeleton, kidney and lung. Gene 219:101-110, 1998.

Pandur, P.; Lasche, M.; Eisenberg, L. M.; Kuhl, M.: Wnt-11 activation of a non-canonical Wnt signalling pathway is required for cardiogenesis. Nature 418:636-641, 2002.

Frye, R. A.: Characterization of five human cDNAs with homology to the yeast SIR2 gene: Sir2-like proteins (sirtuins) metabolize NAD and may have protein ADP-ribosyl transferase activity. Biochem. Biophys. Res. Commun. 260:273-279, 1999.

Imai, S.; Armstrong, C. M.; Kaeberlein, M.; Guarente, L.: Transcriptional silencing and longevity protein Sir2 is an NAD-dependent histone deacetylase. Nature 403:795-800, 2000.

Kimura, A.; Umehara, T.; Horikoshi, M.: Chromosomal gradient of histone acetylation established by Sas2p and Sir2p functions as a shield against gene silencing. Nature Genet. 15 Oct. 2002 . Note: Advance Electronic Publication.

Aula, N.; Salomaki, P.; Timonen, R.; Verheijen, F.; Mancini, G.; Mansson, J.-E.; Aula, P.; Peltonen, L.: The spectrum of SLC17A5-gene mutations resulting in free sialic acid-storage diseases indicates some genotype-phenotype correlation. Am. J. Hum. Genet. 67:832-840,2000.

Biancheri, R.; Verbeek, E.; Rossi, A.; Gaggero, R.; Roccatagliata, L.; Gatti, R.; van Diggelen, O.; Verheijen, F. W.; Mancini, G. M. S.: An Italian severe Salla disease variant associated with a SLC17A5 mutation earlier described in infantile sialic acid storage disease. Clin. Genet. 61:443-447, 2002.

Belinsky, M. G.; Bain, L. J.; Balsara, B. B.; Testa, J. R.; Kruh, G. D.: Characterization of MOAT-C and MOAT-D, new members of the MRP/cMOAT subfamily of transporter proteins. J. Nat. Cancer Inst. 90:1735-1741, 1998.

Fromm, M. F.; Leake, B.; Roden, D. M.; Wilkinson, G. R.; Kim, R. B.: Human MRP3 transporter: identification of the 5-prime flanking region, genomic organization and alternative splice variants. Biochim. Biophys. Acta 1415:369-374, 1999.

Kiuchi, Y.; Suzuki, H.; Hirohashi, T.; Tyson, C. A.; Sugiyama, Y.: cDNA cloning and inducible expression of human multidrug resistance associated protein 3 (MRP3). FEBS Lett. 433:149-152, 1998.

Konig, J.; Rost, D.; Cui, Y.; Keppler, D.: Characterization of the human multidrug resistance protein isoform MRP3 localized to the basolateral hepatocyte membrane. Hepatology 29:1156-1163, 1999.

Kool, M.; van der Linden, M.; de Haas, M.; Scheffer, G. L.; deVree, J. M. L.; Smith, A. J.; Jansen, G.; Peters, G. J.; Ponne, N.; Scheper, R. J.; Oude Elferink, R. P. J.; Baas, F.; Borst, P.: MRP3, an organic anion transporter able to transport anticancer drugs. Proc. Nat. Acad. Sci. 96:6914-6919, 1999.

Ortiz, D. F.; Li, S.; Iyer, R.; Zhang, X.; Novikoff, P.; Arias, I. M.: MRP3, a new ATP-binding cassette protein localized to the canalicular domain of the hepatocyte. Am. J. Physiol. 276: G1493-G1500,1999.

Arking, D. E.; Krebsova, A.; Macek, M., Sr.; Macek, M., Jr.; Arking, A.; Mian, I. S.; Fried, L.; Hamosh, A.; Dey, S.; McIntosh, I.; Dietz, H. C.: Association of human aging with a functional variant of klotho. Proc. Nat. Acad. Sci. 99:856-861, 2002.

Koh, N.; Fujimori, T.; Nishiguchi, S.; Tamori, A.; Shiomi, S.; Nakatani, T.; Sugimura, K.; Kishimoto, T.; Kinoshita, S.; Kuroki, T.; Nabeshima, Y.: Severely reduced production of Klotho in human chronic renal failure kidney. Biochem. Biophys. Res. Commun. 280:1015-1020, 2001.

Kuro-o, M.; Matsumura, Y.; Aizawa, H.; Kawaguchi, H.; Suga, T.; Utsugi, T.; Ohyama, Y.; Kurabayashi, M.; Kaname, T.; Kume, E.; Iwasaki, H.; Iida, A.; Shiraki-Iida, T.; Nishikawa, S.; Nagai, R.; Nabeshima, Y.: Mutation of the mouse klotho gene leads to a syndrome resembling ageing. Nature 390:45-51, 1997.

Matsumura, Y.; Aizawa, H.; Shiraki-Iida, T.; Nagai, R.; Kuro-o, M.; Nabeshima, Y.: Identification of the human klotho gene and its two transcripts encoding membrane and secreted klotho protein. Biochem. Biophys. Res. Commun. 242:626-630, 1998.

Mori, K.; Yahata, K.; Mukoyama, M.; Suganami, T.; Makino, H.; Nagae, T.; Masuzaki, H.; Ogawa, Y.; Sugawara, A.; Nabeshima, Y.; Nakao, K.: Disruption of klotho gene causes an abnormal energy homeostasis in mice. Biochem. Biophys. Res. Commun. 278:665-670, 2000.

Saito, Y.; Nakamura, T.; Ohyama, Y; Suzuki, T.; Iida, A.; Shiraki-Iida, T.; Kuro-o, M.; Nabeshima, Y.; Kurabayashi, M.; Nagai, R.: In vivo klotho gene delivery protects against endothelial dysfunction in multiple risk factor syndrome. Biochem. Biophys. Res. Commun. 276:767-772,2000.

Little, N. A.; Hastie, N. D.; Davies, R. C.: Identification of WTAP, a novel Wilms' tumour 1-associating protein. Hum. Molec. Genet. 9:2231-2239, 2000.

Sugawara, M.; Nakanishi, T.; Fei, Y.-J.; Huang, W.; Ganapathy, M. E.; Leibach, F. H.; Ganapathy, V.: Cloning of an amino acid transporter with functional characteristics and tissue expression pattern identical to that of system A. J. Biol. Chem. 275:16473-16477, 2000.

Gatignol, A.; Buckler-White, A.; Berkhout, B.; Jeang, K. T.: characterization of a human TAR RNA-binding protein that activates the HIV-1 LTR. Science 251:1597-1600, 1991.

Gatignol, A.; Duarte, M.; Daviet, L.; Chang, Y.-N.; Jeang, K.-T.: Sequential steps in Tat trans-activation of HIV-1 mediated through cellular DNA, RNA, and protein binding factors. Gene Expr. 5:217-228,1996.

Kozak, C. A.; Gatignol, A.; Graham, K.; Jeang, K. T.; McBride, O. W.: Genetic mapping in human and mouse of the locus encoding TRBP, a protein that binds the TAR region of the human immunodeficiency virus (HIV-1). Genomics 25:66-72, 1995.

Bauer, M. F.; Gempel, K.; Reichert, A. S.; Rappold, G. A.; Lichtner, P.; Gerbitz, K. D.; Neupert, W.; Brunner, M.; Hofmann, S.: Genetic and structural characterization of the human mitochondrial inner membrane translocase. J. Molec. Biol. 289:69-82, 1999.

Bomer, U.; Rassow, J.; Zufall, N.; Pfanner, N.; Meijer, M.; Maarse, A. C.: The preprotein translocase of the inner mitochondrial membrane:evolutionary conservation of targeting and assembly of Tim17. J. Molec. Biol. 262:389-395, 1996.

Phornphutkul, C.; Anikster, Y.; Huizing, M.; Braun, P.; Brodie, C.; Chou, J. Y.; Gahl, W. A.: The promoter of a lysosomal membrane transporter gene, CTNS, binds Sp-1, shares sequences with the promoter of an adjacent gene, CARKL, and causes cystinosis if mutated in a critical region. Am. J. Hum. Genet. 69:712-721, 2001.

Lebre, A.-S.; Jamot, L.; Takahashi, J.; Spasskey, N.; Leprince, C.; Ravise, N.; Zander, Fujigasaki, H.; Kussel-Andermann, P.; Duyckaerts, C.; Camonis, J. H.; Brice, A.: Ataxin-7 interacts with a Cbl-associated protein that it recruits into neuronal intranuclear inclusions. Hum. Molec. Genet. 10:10:-1201-1213, 2001.

Lin, W.-H.; Chiu, K. C.; Chang, H.-M.; Lee, K.-C.; Tai, T.-Y.; Chuang, L.-M.: Molecular scanning of the human sorbin and SH3-domain-containing-1(SORBS1) gene: positive association of the T228A polymorphism with obesity and type 2 diabetes. Hum. Molec. Genet. 10:1753-1760, 2001.

Scott, A. F.: Personal Communication. Baltimore, Md. Sep. 13, 2000.

Nishi, M.; Mizushima, A.; Nakagawara, K.; Takeshima, H.: characterization of human junctophilin subtype genes. Biochem. Biophys. Res. Commun. 273:920-927, 2000.

Takeshima, H.; Komazaki, S.; Nishi, M.; Iino, M.; Kangawa, K.:Junctophilins: a novel family of junctional membrane complex proteins. Molec. Cell 6:11-22, 2000.

Holmes, S. E.; O'Hearn, E.; Rosenblatt, A.; Callahan, C.; Hwang, H. S.; Ingersoll-Ashworth, R. G.; Fleisher, A.; Stevanin, G.; Brice, A.; Potter, N. T.; Ross, C. A.; Margolis, R. L.: A repeat expansion in the gene encoding junctophilin-3 is associated with Huntington disease-like 2. Nature Genet. 29:377-378, 2001. Note: Erratum:Nature Genet. 30:123 only, 2002.

Chavez, R. A.; Gray, A. T.; Zhao, B. B.; Kindler, C. H.; Mazurek, M. J.; Mehta, Y.; Forsayeth, J. R.; Yost, C. S.: TWIK-2, a new weak inward rectifying member of the tandem pore domain potassium channel family. J. Biol. Chem. 274:7887-7892, 1999.

Gray, A. T.; Kindler, C. H.; Sampson, E. R.; Yost, C. S.: Assignment of KCNK6 encoding the human weak inward rectifier potassium channel TWIK-2 to chromosome band 19q13.1 by radiation hybrid mapping. Cytogenet. Cell Genet. 84:190-191, 1999.

Pountney, D. J.; Gulkarov, I.; Vega-Saenz de Miera, E.; Holmes, D.; Saganich, M.; Rudy, B.; Artman, M.; Coetzee, W. A.: Identification and cloning of TWIK-originated similarity sequence (TOSS): a novel human 2-pore K(+) channel principal subunit. FEBS Lett. 450:191-196,1999.

Salinas, M.; Reyes, R.; Lesage, F.; Fosset, M.; Heurteaux, C.; Romey, G.; Lazdunski, M.: Cloning of a new mouse two-P domain channel subunit and a human homologue with a unique pore structure. J. Biol. Chem. 274:11751-11760, 1999.

Barbetti, F.; Rocchi, M.; Bossolasco, M.; Cordera, R.; Sbraccia, P.; Finelli, P.; Consalez, G. G.: The human skeletal muscle glycogenin gene: cDNA, tissue expression, and chromosomal localization. Biochem. Biophys. Res. Commun. 220:72-77, 1996.

Luo, J.; Nikolaev, A. Y.; Imai, S.; Chen, D.; Su, F.; Shiloh, A.; Guarente, L.; Gu, W.: Negative control of p53 by Sir2-alpha promotes cell survival under stress. Cell 107:137-148, 2001.

Bulfone, A.; Smiga, S. M.; Shimamura, K.; Peterson, A.; Puelles, L.; Rubenstein, J. L. R.: T-brain-1: a homolog of Brachyury whose expression defines molecularly distinct domains within the cerebral cortex. Neuron 15:63-78, 1995.

Makoff, A.; Lelchuk, R.; Oxer, M.; Harrington, K.; Emson, P.:Molecular characterization and localization of human metabotropic glutamate receptor type 4. Molec. Brain Res. 37:239-248, 1996.

Pekhletski, R.; Gerlai, R.; Overstreet, L. S.; Huang, X. P.; Agopyan, N.; Slater, N. T.; Abramow-Newerly, W.; Roder, J. C.; Hampson, D. R.: Impaired cerebellar synaptic plasticity and motor performance in mice lacking the mGluR4 subtype of metabotropic glutamate receptor. J. Neurosci. 16:6364-6373, 1996.

Barbon, A.; Ferraboli, S.; Barlati, S.: Assignment of the human Metabotropic glutamate receptor gene GRM7 to chromosome 3p26.1-p25.2 by radiation hybrid mapping. Cytogenet. Cell Genet. 88:288 only,2000.

Shore, D.; Squire, M.; Nasmyth, K. A.: Characterization of two genes required for the position-effect control of yeast mating-type genes. EMBO J. 3:2817-2823, 1984.

Suka, N.; Luo, K.; Grunstein, M.: Sir2p and Sas2p opposingly regulate acetylation of yeast histone H4 lysine16 and spreading of heterochromatin. Nature Genet. 15 Oct. 2002. Note: Advance Electronic Publication.

Tanny, J. C.; Dowd, G. J.; Huang, J.; Hilz, H.; Moazed, D.: An enzymatic activity in the yeast Sir2 protein that is essential for gene silencing. Cell 99:735-745, 1999.

Vaziri, H.; Dessain, S. K.; Eaton, E. N.; Imai, S.-I.; Frye, R. A.; Pandita, T. K.; Guarente, L.; Weinberg, R. A.: hSIR2-SIRT1 functions as an NAD-dependent p53 deacetylase. Cell 107:149-159, 2001.

Verhaagh, S.; Schweifer, N.; Barlow, D. P.; Zwart, R.: Cloning of the mouse and human solute carrier 22a3 (Slc22a3/SLC22A3) identifies a conserved cluster of three organic cation transporters on mouse chromosome 17 and human 6q26-q27. Genomics 55:209-218, 1999.

Liu, J.; Shworak, N. W.; Sinay, P.; Schwartz, J. J.; Zhang, L.; Fritze, L. M.; Rosenberg, R. D.: Expression of heparan sulfate D-glucosaminyl3-O-sulfotransferase isoforms reveals novel substrate specificities. J. Biol. Chem. 274:5185-5192, 1999.

Shworak, N. W.; Liu, J.; Petros, L. M.; Zhang, L.; Kobayashi, M.; Copeland, N. G.; Jenkins, N. A.; Rosenberg, R. D.: Multiple isoforms of heparan sulfate D-glucosaminyl 3-O-sulfotransferase: isolation, characterization, and expression of human cDNAs and identification of distinct genomic loci. J. Biol. Chem. 274:5170-5184, 1999.

McIlhatton, M. A.; Burrows, J. F.; Donaghy, P. G.; Chanduloy, S.; Johnston, P. G.; Russell, S. E. H.: Genomic organization, complex splicing pattern and expression of a human septin gene on chromosome 17q25.3. Oncogene 20:5930-5939, 2001.

Osaka, M.; Rowley, J. D.; Zeleznik-Le, N. J.: MSF (MLL septin-like fusion), a fusion partner gene of MLL, in a therapy-related acute myeloid leukemia with a t (11;17)(q23;q25). Proc. Nat. Acad. Sci. 96:6428-6433, 1999.

Russell, S. E. H.; McIlhatton, M. A.; Burrows, J. F.; Donaghy, P. G.; Chanduloy, S.; Petty, E. M.; Kalikin, L. M.; Church, S. W.; McIlroy, S.; Harkin, D. P.; Keilty, G. W.; Cranston, A. N.; Weissenbach, J.; Hickey, I.; Johnston, P. G.: Isolation and mapping of a human septin gene to a region on chromosome 17q, commonly deleted in sporadic epithelial ovarian tumors. Cancer Res. 60:4729-4734, 2000.

Kasukabe, T.; Kobayashi, H.; Kaneko, Y.; Okabe-Kado, J.; Honma, Y.: Identity of human normal counterpart (MmTRA1b) of mouse leukemogenesis-associated gene (MmTRA1a) product as a plasma membrane phospholipid scramblase and chromosome mapping of the human MmTRA1b/phospholipid scramblase gene. Biochem. Biophys. Res. Commun. 249:449-455, 1998.

Zhou, Q.; Sims, P. J.; Wiedmer, T.: Identity of a conserved motifin phospholipid scramblase that is required for Ca2+-accelerated transbilayer movement of membrane phospholipids. Biochemistry 37:2356-2360,1998.

Zhou, Q.; Zhao, J.; Stout, J. G.; Luhm, R. A.; Wiedmer, T.; Sims, P. J.: Molecular cloning of human plasma membrane phospholipid scramblase:a protein mediating transbilayer movement of plasma membrane phospholipids. J. Biol. Chem. 272:18240-18244, 1997.

Michel, J. J.; Xiong, Y.: Human CUL-1, but not other cullin family members, selectively interacts with SKP1 to form a complex with SKP2 and cyclin A. Cell Growth Differ. 9:435-449, 1998.

Du, M.; Sansores-Garcia, L.; Zu, Z.; Wu, K. K.: Cloning and expression analysis of a novel salicylate suppressible gene, Hs-CUL-3, a member of cullin/Cdc53 family. J. Biol. Chem. 273:24289-24292, 1998.

Bao, S.; Shen, X.; Shen, K.; Liu, Y.; Wang, X.-F.: The mammalian Rad24 homologous to yeast Saccharomyces cerevisiae Rad24 and Schizosaccharomyces pombe Rad17 is involved in DNA damage checkpoint. Cell Growth Diff. 9:961-967, 1998.

Bao, S.; Chang, M.-S.; Auclair, D.; Sun, Y.; Wang, Y.; Wong, W.-K.; Zhang, J.; Liu, Y.; Qian, X.; Sutherland, R.; Magi-Galluzi, C.; Weisberg, E.; Cheng, E. Y. S.; Hao, L.; Sasaki, H.; Campbell, M. S.; Kraeft, S.-K.; Loda, M.; Lo, K.-M.; Chen, L. B.: Hrad17, a human homologue of the Schizosaccharomyces pombe checkpoint gene rad17, is overexpressed in colon carcinoma. Cancer Res. 59:2023-2028, 1999.

Bluyssen, H. A. R.; Naus, N. C.; van Os, R. I.; Jaspers, I.; Hoeijmakers, J. H. J.; de Klein, A.: Human and mouse homologues of the Schizosaccharomyces pombe rad17+ cell cycle checkpoint control gene. Genomics 55:219-228,1999.

Loijens, J. C.; Anderson, R. A.: Type I phosphatidyl inositol-4-phosphate 5-kinases are distinct members of this novel lipid kinase family. J. Biol. Chem. 271:32937-32943, 1996.

Xie, Y.; Zhu, L.; Zhao, G.: Assignment of type I phosphatidylinositol-4-phosphate 5-kinase (PIP5K1A) to human chromosome bands 1q22-q24 by in situ hybridization. Cytogenet. Cell Genet. 88:197-199, 2000.

Wade, P. A.; Gegonne, A.; Jones, P. L.; Ballestar, E.; Aubry, F.; Wolffe, A. P.: Mi-2 complex couples DNA methylation to chromatin remodelling and histone deacetylation. Nature Genet. 23:62-66,1999.

Aihara, T.; Miyoshi, Y.; Koyama, K.; Suzuki, M.; Takahashi, E.; Monden, M.; Nakamura, Y.: Cloning and mapping of SMARCA5 encoding hSNF2H, a novel human homologue of Drosophila ISWI. Cytogenet. Cell Genet. 81:191-193, 1998.

Bochar, D. A.; Savard, J.; Wang, W.; Lafleur, D. W.; Moore, P.; Cote, J.; Shiekhattar, R.: A family of chromatin remodeling factors related to Williams syndrome transcription factor. Proc. Nat. Acad. Sci. 97:1038-1043, 2000.

Bozhenok, L.; Wade, P. A.; Varga-Weisz, P.: WSTF-ISWI chromatin remodeling complex targets heterochromatic replication foci. EMBO J. 21:2231-2241, 2002.

LeRoy, G.; Orphanides, G.; Lane, W. S.; Reinberg, D.: Requirement of RSF and FACT for transcription of chromatin templates in vitro. Science 282:1900-1904, 1998.

Poot, R. A.; Dellaire, G.; Hulsmann, B. B.; Grimaldi, M. A.; Corona, D. F. V.; Becker, P. B.; Bickmore, W. A.; Varga-Weisz, P. D.: HuCHRAC, a human ISWI chromatin remodelling complex contains hACF1 and two novel histone-fold proteins. EMBO J. 19:3377-3387, 2000.

Alberati-Giani, D.; Cesura, A. M.; Broger, C.; Warren, W. D.; Rover, S.; Malherbe, P.: Cloning and functional expression of human kynurenine 3-monooxygenase. FEBS Lett. 410:407-412, 1997.

Boyer, S. H.; Fainer, D. C.; Watson-Williams, E. J.: Lactate dehydrogenase variant from human blood: evidence for molecular subunits. Science 141:642-643, 1963.

Ben-Neriah, Y.; Bauskin, A. R.: Leukocytes express a novel gene encoding a putative transmembrane protein-kinase devoid of an extracellular domain.(Letter) Nature 333:672-676, 1988.

Krolewski, J. J.; Lee, R.; Eddy, R.; Shows, T. B.; Dalla-Favera, R.: Identification and chromosomal mapping of new human tyrosine kinase genes. Oncogene 5:277-282, 1990.

Liao, X.; Zhou, R.; Gilbert, D. J.; Copeland, N. G.; Jenkins, N. A.: Receptor tyrosine kinase gene Tyro3 maps to mouse chromosome 2, closely linked to Ltk. Mammalian Genome 7:395-396, 1996.

Toyoshima, H.; Kozutsumi, H.; Maru, Y.; Hagiwara, K.; Furuya, A.; Mioh, H.; Hanai, N.; Takaku, F.; Yazaki, Y.; Hirai, H.: Differently spliced cDNAs of human leukocyte tyrosine kinase receptor tyrosine kinase predict receptor proteins with and without a tyrosine kinase domain and a soluble receptor protein. Proc. Nat. Acad. Sci. 90:5404-5408, 1993.

Virtaneva, K. I.; Angelisova, P.; Baumruker, T.; Horejsi, V.; Nevanlinna, H.; Schroder, J.: The genes for CD37, CD53, and R2, all members of a novel gene family, are located on different chromosomes. Immunogenetics 37:461-465, 1993.

Yoshimura, K.; Toibana, A.; Nakahama, K.: Human lysozyme: sequencing of a cDNA, and expression and secretion by Saccharomyces cerevisiae. Biochem. Biophys. Res. Commun. 150:794-801, 1988.

Salmikangas, P.; Mykkanen, O.-M.; Gronholm, M.; Heiska, L.; Kere, J.; Carpen, O.: Myotilin, a novel sarcomeric protein with two Ig-like domains, is encoded by a candidate gene for limb-girdle muscular dystrophy. Hum. Molec. Genet. 8:1329-1336, 1999.

Hauser, M. A.; Horrigan, S. K.; Salmikangas, P.; Torian, U. M.; Viles, K. D.; Dancel, R.; Tim, R. W.; Taivainen, A.; Bartoloni, L.; Gilchrist, J. M.; Stajich, J. M.; Gaskell, P. C.; Gilbert, J. R.; Vance, J. M.; Pericak-Vance, M. A.; Carpen, O.; Westbrook, C. A.; Speer, M. C.: Myotilin is mutated in limb girdle muscular dystrophy 1A. Hum. Molec. Genet. 9:2141-2147, 2000.

Riegman, P. H. J.; Vlietstra, R. J.; van der Korput, J. A. G. M.; Romijn, J. C.; Trapman, J.: Characterization of the prostate-specific antigen gene: a novel human kallikrein-like gene. Biochem. Biophys. Res. Commun. 159:95-102, 1989.

Santoro, M.; Carlomagno, F.; Hay, I. D.; Herrmann, M. A.; Grieco, M.; Melillo, R.; Pierotti, M. A.; Bongarzone, I.; Della Porta, G.; Berger, N.; Peix, J. L.; Paulin, C.; Fabien, N.; Vecchio, G.; Jenkins, R. B.; Fusco, A.: Ret oncogene activation in human thyroid neoplasms is restricted to the papillary cancer subtype. J. Clin. Invest. 89:1517-1522, 1992.

Santoro, M.; Carlomagno, F.; Romano, A.; Bottaro, D. P.; Dathan, N. A.; Grieco, M.; Fusco, A.; Vecchio, G.; Matoskova, B.; Kraus, M. H.; Di Fiore, P. P.: Activation of RET as a dominant transforming gene by germ line mutations of MEN2A and MEN2B. Science 267:381-383,1995.

Schuchardt, A.; D'Agati, V.; Larsson-Blomberg, L.; Costantini, F.; Pachnis, V.: Defects in the kidney and enteric nervous system of mice lacking the tyrosine kinase receptor Ret. Nature 367:380-383,1994.

Shirahama, S.; Ogura, K.; Takami, H.; Ito, K.; Tohsen, T.; Miyauchi, A.; Nakamura, Y.: Mutational analysis of the RET proto-oncogene in 71 Japanese patients with medullary thyroid carcinoma. J. Hum. Genet. 43:101-106, 1998.

Seri, M.; Yin, L.; Barone, A.; Bolino, A.; Celli, I.; Bocciardi, R.; Pasini, B.; Ceccherini, I.; Lerone, M.; Kristoffersson, U.; Larsson, L. T.; Casasa, J. M.; Cass, D. T.; Abramowicz, M. J.; Vanderwinden, J.-M.; Kravcenkiene, I.; Baric, I.; Silengo, M.; Martucciello, G.; Romeo, G.: Frequency of RET mutations in long- and short-segment Hirschsprung disease. Hum. Mutat. 9:243-249, 1997.

Takahashi, M.; Buma, Y.; Hiai, H.: Isolation of ret proto-oncogene cDNA with an amino-terminal signal sequence. Oncogene 4:805-806,1989.

Takahashi, M.; Buma, Y.; Iwamoto, T.; Inaguma, Y.; Ikeda, H.; Hiai, H.: Cloning and expression of the ret proto-oncogene encoding a tyrosine kinase with two potential transmembrane domains. Oncogene 3:571-578, 1988.

Takahashi, M.; Ritz, J.; Cooper, G. M.: Activation of a novel human transforming gene, ret, by DNA rearrangement. Cell 42:581-588,1985.

Tessitore, A.; Sinisi, A. A.; Pasquali, D.; Cardone, M.; Vitale, D.; Bellastella, A.; Colantuoni, V.: A novel case of multiple endocrine neoplasia type 2A associated with two de novo mutations of the RET proto-oncogene. J. Clin. Endocr. Metab. 84:3522-3527, 1999.

van Heyningen, V.: One gene--four syndromes. Nature 367:319-320,1994.

Xue, F.; Yu, H.; Maurer, L. H.; Memoli, V. A.; Nutile-McMenemey, N.; Schuster, M. K.; Bowden, D. W.; Mao, J.; Noll, W. W.: Germline RET mutations in MEN 2A and FMTC and their detection by simple DNA diagnostic tests. Hum. Molec. Genet. 3:635-638, 1994.

Yin, L.; Ceccherini, I.; Pasini, B.; Matera, I.; Bicocchi, M. P.; Barone, V.; Bocciardi, R.; Kaariainen, H.; Weber, D.; Devoto, M.; Romeo, G.: Close linkage with the RET proto-oncogene and boundaries of deletion mutations in autosomal dominant Hirschsprung disease. Hum. Molec. Genet. 2:1803-1808, 1993.

Schuuring, E.; Verhoeven, E.; Mooi, W. J.; Michalides, R. J. A. M.: Identification and cloning of two overexpressed genes, U21B31/PRAD1 and EMS1, within the amplified chromosome 11q13 region in human carcinomas. Oncogene 7:355-361, 1992.

van Damme, H.; Brok, H.; Schuuring-Scholtes, E.; Schuuring, E.: The redistribution of cortactin into cell-matrix contact sites in human carcinoma cells with 11q13 amplification is associated with both overexpression and post-translational modification. J. Biol. Chem. 272:7374-7380, 1997.

Benz-Lemoine, E.; Brizard, A.; Huret, J.-L.; Babin, P.; Guilhot, F.; Couet, D.; Tanzer, J.: Malignant histiocytosis: a specific t (2;5)(p23; q35) translocation? Review of the literature. Blood 72:1045-1047, 1988.

Boultwood, J.; Rack, K.; Kelly, S.; Madden, J.; Sakaguchi, A. Y.; Wang, L.-M.; Oscier, D. G.; Buckle, V. J.; Wainscoat, J. S.: Loss of both CSF1R (FMS) alleles in patients with myelodysplasia and a chromosome 5 deletion. Proc. Nat. Acad. Sci. 88:6176-6180, 1991.

De Qi Xu; Guilhot, S.; Galibert, F.: Restriction fragment length polymorphism of the human c-fms gene. Proc. Nat. Acad. Sci. 82:2862-2865, 1985.

Eccles, M. R.: Genes encoding the platelet-derived growth factor (PDGF) receptor and colony-stimulating factor 1 (CSF-1) receptor are physically associated in mice as in human S. Gene 108:285-288, 1991.

Gisselbrecht, S.; Fichelson, S.; Sola, B.; Bordereaux, D.; Hampe, A.; Andre, C.; Galibert, F.; Tambourin, P. E.: Frequent c-fms activation by proviral insertion in mouse myeloblastic leukaemias. Nature 329:259-261, 1987.

Groffen, J.; Heisterkamp, N.; Spurr, N. K.; Dana, S. L.; Wasmuth, J. J.; Stephenson, J. R.: Regional assignment of the human c-fms oncogene to band q34 of chromosome 5. (Abstract) Cytogenet. Cell Genet. 37:484 only, 1984.

Hampe, A.; Gobet, M.; Sherr, C. J.; Galibert, F.: Nucleotide sequence of the feline retroviral oncogene v-fms shows unexpected homology with oncogenes encoding tyrosine-specific protein kinases. Proc. Nat. Acad. Sci. 81:85-89, 1984.

Hampe, A.; Shamoon, B.-M.; Gobet, M.; Sherr, C. J.; Galibert, F.: Nucleotide sequence and structural organization of the human FMS proto-oncogene. Oncogene Res. 4:9-17, 1989.

How, G.-F.; Venkatesh, B.; Brenner, S.: Conserved linkage between the puffer fish (Fugu rubripes) and human genes for platelet-derived growth factor receptor and macrophage colony-stimulating factor receptor. Genome Res. 6:1185-1191, 1996.

Hibbs, M. L.; Tarlinton, D. M.; Armes, J.; Grail, D.; Hodgson, G.; Maglitto, R.; Stacker, S. A.; Dunn, A. R.: Multiple defects in the immune system of Lyn-deficient mice, culminating in autoimmune disease. Cell 83:301-311, 1995.

Webster, M. A.; Cardiff, R. D.; Muller, W. J.: Induction of mammary epithelial hyperplasias and mammary tumors in transgenic mice expressing a murine mammary tumor virus/activated c-src fusion gene. Proc. Nat. Acad. Sci. 92:7849-7853, 1995.

Yamanashi, Y.; Fukushige, S.-I.; Semba, K.; Sukegawa, J.; Miyajima, N.; Matsubara, K.-I.; Yamamoto, T.; Toyoshima, K.: The yes-related cellular gene lyn encodes a possible tyrosine kinase similar to p56(lck). Molec. Cell. Biol. 7:237-243, 1987.

Berger, A.; Rosenthal, D.; Spiegel, S.: Sphingosylphosphocholine, a signaling molecule which accumulates in Niemann-Pick disease type A, stimulates DNA-binding activity of the transcription activator protein AP-1. Proc. Nat. Acad. Sci. 92:5885-5889, 1995.

Bohmann, D.; Bos, T. J.; Admon, A.; Nishimura, T.; Vogt, P. K.; Tjian, R.: Human proto-oncogene c-jun encodes a DNA binding protein with structural and functional properties of transcription factor AP-1. Science 238:1386-1392, 1987.

Bos, T. J.; Bohmann, D.; Tsuchie, H.; Tjian, R.; Vogt, P. K.:v-jun encodes a nuclear protein with enhancer binding properties of AP-1. Cell 52:705-712, 1988.

Haluska, F. G.; Huebner, K.; Isobe, M.; Nishimura, T.; Croce, C. M.; Vogt, P. K.: Localization of the human JUN proto-oncogene to chromosome region 1p31-32. Proc. Nat. Acad. Sci. 85:2215-2218, 1988.

Hattori, K.; Angel, P.; Le Beau, M. M.; Karin, M.: Structure and chromosomal localization of the functional intronless human JUN proto-oncogene. Proc. Nat. Acad. Sci. 85:9148-9152, 1988.

Lamph, W. W.; Wamsley, P.; Sassone-Corsi, P.; Verma, I. M.: Induction of proto-oncogene JUN/AP-1 by serum and TPA. Nature 334:629-631,1988.

Marx, J. L.: 'Jun' is bustin' out all over. (Research News). Science 242:1377-1378, 1988.

Mattei, M. G.; Simon-Chazottes, D.; Hirai, S.-I.; Ryseck, R.-P.; Galcheva-Gargova, Z.; Guenet, J. L.; Mattei, J. F.; Bravo, R.; Yaniv, M.: Chromosomal localization of the three members of the jun proto-oncogene family in mouse and man. Oncogene 5:151-156, 1990.

Shaulian, E.; Karin, M.: AP-1 as a regulator of cell life and death. Nature Cell Biol. 4: E131-E136, 2002.

Shaulian, E.; Schreiber, M.; Piu, F.; Beeche, M.; Wagner, E. F.; Karin, M.: The mammalian UV response: c-Jun induction is required for exit from p53-imposed growth arrest. Cell 103:897-907, 2000.

Mattei, M. G.; Simon-Chazottes, D.; Hirai, S.; Ryseck, R. P.; Galcheva-Gargova, Z.; Guenet, J. L.; Mattei, J. F.; Bravo, R.; Yaniv, M.: Chromosomal localization of the three members of the jun proto-oncogene family in mouse and man. Oncogene 5:151-156, 1990.

Passegue, E.; Jochum, W.; Behrens, A.; Ricci, R.; Wagner, E. F.: JunB can substitute for Jun in mouse development and cell proliferation. Nature Genet. 30:158-166, 2002.

Passegue, E.; Jochum, W.; Schorpp-Kistner, M.; Mohle-Steinlein, U.; Wagner, E. F.: Chronic myeloid leukemia with increased granulocyte progenitors in mice lacking JunB expression in the myeloid lineage. Cell 104:21-32, 2001.

Phinney, D. G.; Tseng, S. W.; Ryder, K.: Complex genetic organization of junB: multiple blocks of flanking evolutionarily conserved sequence at the murine and human junB loci. Genomics 28:228-234, 1995.

Sullivan, M.; Olsen, A. S.; Houslay, M. D.: Genomic organisation of the human cyclic AMP-specific phosphodiesterase PDE4C gene and its chromosomal localisation to 19p13.1, between RAB3A and JUND. Cell. Signal. 11:735-742, 1999.

DeKoter, R. P.; Lee, H.-J.; Singh, H.: PU.1 regulates expression of the interleukin-7 receptor in lymphoid progenitors. Immunity 16:297-309, 2002.

DeKoter, R. P.; Singh, H.: Regulation of B lymphocyte and macrophage development by graded expression of PU.1. Science 288:1439-1441,2000.

Li, S.-L.; Valente, A. J.; Zhao, S.-J.; Clark, R. A.: PU.1 is essential for p47(phox) promoter activity in myeloid cells. J. Biol. Chem. 272:17802-17809, 1997.

Moreau-Gachelin, F.; Tavitian, A.; Tambourin, P.: Spi-1 is a putative oncogene in virally induced murine erythroleukaemias. Nature 331:277-280, 1988.

Ray, D.; Culine, S.; Tavitian, A.; Moreau-Gachelin, F.: The human homologue of the putative proto-oncogene Spi-1: characterization and expression in tumors. Oncogene 5:663-667, 1990.

Tondravi, M. M.; McKercher, S. R.; Anderson, K.; Erdmann, J. M.; Quiroz, M.; Maki, R.; Teitelbaum, S. L.: Osteopetrosis in mice lacking haematopoietic transcription factor PU.1 Nature 386:81-84, 1997.

Steiglitz, B. M.; Greenspan, D. S.: Assignment of the mouse Pcolce2 gene, which encodes procollagen C-proteinase enhancer protein 2, to chromosome 9 and localization of PCOLCE2 to human chromosome 3q23. Cytogenet. Cell Genet. 95:244-245, 2001.

Xu, H.; Acott, T. S.; Wirtz, M. K.: Identification and expression of a novel type I procollagen C-proteinase enhancer protein gene from the glaucoma candidate region on 3q21-q24. Genomics 66:264-273, 2000.

Brand, S. H.; Castle, J. D.: SCAMP-37, a new marker within the general cell surface recycling system. EMBO J. 12:3753-3761, 1993.

Singleton, D. R.; Wu, T. T.; Castle, J. D.: Three mammalian SCAMPs (secretory carrier membrane proteins) are highly related products of distinct genes having similar subcellular distributions. J. Cell Sci. 110:2099-2107, 1997.

Yamashita, A.; Ohnishi, T.; Kashima, I.; Taya, Y.; Ohno, S.: human SMG-1, a novel phosphatidyl inositol 3-kinase-related protein kinase, associates with components of the mRNA surveillance complex and is involved in the regulation of nonsense-mediated mRNA decay. Genes Dev. 15:2215-2228, 2001.

Kamberov, E.; Makarova, O.; Roh, M.; Liu, A.; Karnak, D.; Straight, S.; Margolis, B.: Molecular cloning and characterization of Pals, proteins associated with mLin-7. J. Biol. Chem. 275:11425-11431, 2000.

Tseng, T.-C.; Marfatia, S. M.; Bryant, P. J.; Pack, S.; Zhuang, A.; O'Brien, J. E.; Lin, L.; Hanada, T.; Chishti, A. H.: VAM-1: a new member of the MAGUK family binds to human Veli-1 through a conserved domain. Biochim. Biophys. Acta 1518:249-259, 2001.

Wei, X.; Malicki, J. M.: nagie oko, encoding a MAGUK-family protein, is essential for cellular patterning of the retina. Nature Genet. 31:150-157, 2002. Note: Erratum: Nature Genet. 31:439 only, 2002.

Esser, V.; Russell, D. W.: Transport-deficient mutations in the low density lipoprotein receptor: alterations in the cysteine-rich and cysteine-poor regions of the protein block intracellular transport. J. Biol. Chem. 263:13276-13281, 1988.

Fumeron, F.; Grandchamp, B.; Fricker, J.; Krempf, M.; Wolf, L.-M.; Khayat, M.-C.; Boiffard, O.; Apfelbaum, M.: Presence of the French Canadian deletion in a French patient with familial hypercholesterolemia.(Letter) New Eng. J. Med. 326:69 only, 1992.

Gilbert, W.: Genes-in-pieces revisited. Science 228:823-824, 1985.

Goldfarb, L. G.; Petersen, R. B.; Tabaton, M.; Brown, P.; LeBlanc, A. C.; Montagna, P.; Cortelli, P.; Julien, J.; Vital, C.; Pendelbury, W. W.; Haltia, M.; Wills, P. R.; and 9 others: Fatal familial insomnia and familial Creutzfeldt-Jakob disease: disease phenotype determined by a DNA polymorphism. Science 258:806-808, 1992.

Graadt van Roggen, F.; van der Westhuyzen, D. R.; Marais, A. D.; Gevers, W.; Coetzee, G. A.: Low density lipoprotein receptor founder mutations in Afrikaner familial hypercholesterolaemic patients: a comparison of two geographical areas. Hum. Genet. 88:204-208, 1991.

Gudnason, V.; King-Underwood, L.; Seed, M.; Sun, X.-M.; Soutar, A. K.; Humphries, S. E.: Identification of recurrent and novel mutations in exon 4 of the LDL receptor gene in patients with familial hypercholesterolemia in the United Kingdom. Arteriosclerosis Thromb. 13:56-63, 1993.

Gudnason, V.; Sigurdsson, G.; Nissen, H.; Humphries, S. E.: Common founder mutation in the LDL receptor gene causing familial hypercholesterolemia in the Icelandic population. Hum. Mutat. 10:36-44, 1997.

Henderson, H. E.; Berger, G. M. B.; Marais, A. D.: A new LDL receptor gene deletion mutation in the South African population. Hum. Genet. 80:371-374, 1988.

Hobbs, H. H.: Personal Communication. Dallas, Tex. Dec. 1, 1990.

Hobbs, H. H.; Brown, M. S.; Russell, D. W.; Davignon, J.; Goldstein, J. L.: Deletion in the gene for the low-density-lipoprotein receptor in a majority of French Canadians with familial hypercholesterolemia. New Eng. J. Med. 317:734-737, 1987.

Hobbs, H. H.; Lehrman, M. A.; Yamamoto, T.; Russell, D. W.: Polymorphism and evolution of Alu sequences in the human low density lipoprotein receptor gene. Proc. Nat. Acad. Sci. 82:7651-7655, 1985.

Hobbs, H. H.; Leitersdorf, E.; Goldstein, J. L.; Brown, M. S.; Russell, D. W.: Multiple CRM- mutations in familial hypercholesterolemia:evidence for 13 alleles, including four deletions. J. Clin. Invest. 81:909-917, 1988.

Horsthemke, B.; Dunning, A.; Humphries, S.: Identification of deletions in the human low density lipoprotein receptor gene. J. Med. Genet. 24:144-147, 1987.

Horsthemke, B.; Kessling, A. M.; Seed, M.; Wynn, V.; Williamson, R.; Humphries, S. E.: Identification of a deletion in the low density lipoprotein (LDL) receptor gene in a patient with familial hypercholesterolaemia. Hum. Genet. 71:75-78, 1985.

Jensen, H. K.; Jensen, T. G.; Faergeman, O.; Jensen, L. G.; Andresen, B. S.; Corydon, M. J.; Andreasen, P. H.; Hansen, P. S.; Heath, F.; Bolund, L.; Gregersen, N.: Two mutations in the same low-density lipoprotein receptor allele act in synergy to reduce receptor function in heterozygous familial hypercholesterolemia. Hum. Mutat. 9:437-444, 1997.

Jensen, J. M.; Kruse, T. A.; Brorholt-Petersen, J. U.; Christiansen, T. M.; Jensen, H. K.; Kolvraa, S.; Faergeman, O.: Linking genotype to aorto-coronary atherosclerosis: a model using familial hypercholesterolemia and aorto-coronary calcification. Ann. Hum. Genet. 63:511-520, 1999.

Kajinami, K.; Fujita, H.; Koizumi, J.; Mabuchi, H.; Takeda, R.; Ohta, M.: Genetically determined mild type of familial hypercholesterolemia including normocholesterolemic patients: FH-Tonami-2. Circulation 80 (suppl. 2):278 only, 1989.

Kajinami, K.; Mabuchi, H.; Itoh, H.; Michishita, I.; Takeda, M.; Wakasugi, T.; Koizumi, J.; Takeda, R.: New variant of low density lipoprotein receptor gene FH-Tonami. Arteriosclerosis 8:187-192, 1988.

Suvorova, E. S.; Kurten, R. C.; Lupashin, V. V.: Identification of a human orthologue of Sec34p as a component of the cis-Golgi vesicle tethering machinery. J. Biol. Chem. 276:22810-22818, 2001.

Whyte, J. R. C.; Munro, S.: The Sec34/35 Golgi transport complex is related to the exocyst, defining a family of complexes involved in multiple steps of membrane traffic. Dev. Cell 1:527-537, 2001.

Haataja, L.; Groffen, J.; Heisterkamp, N.: Identification of a novel Rac3-interacting protein C1D. Int. J. Molec. Med. 1:665-670, 1998.

Nehls, P.; Keck, T.; Greferath, R.; Spiess, E.; Glaser, T.; Rothbarth, K.; Stammer, H.; Werner, D.: cDNA cloning, recombinant expression and characterization of polypeptides with exceptional DNA affinity. Nucleic Acids Res. 26:1160-1166, 1998.

Rothbarth, K.; Hunziker, A.; Stammer, H.; Werner, D.: Promoter of the gene encoding the 16 kDa DNA-binding and apoptosis-inducing C1D protein. Biochim. Biophys. Acta 1518:271-275, 2001.

Zamir, I.; Dawson, J.; Lavinsky, R. M.; Glass, C. K.; Rosenfeld, M. G.; Lazar, M. A.: Cloning and characterization of a corepressor and potential component of the nuclear hormone receptor repression complex. Proc. Nat. Acad. Sci. 94:14400-14405, 1997.

Tammur, J.; Prades, C.; Arnould, I.; Rzhetsky, A.; Hutchinson, A.; Adachi, M.; Schuetz, J. D.; Swoboda, K. J.; Ptacek, L. J.; Rosier, M.; Dean, M.; Allikmets, R.: Two new genes from the human ATP-binding cassette transporter superfamily, ABCC11 and ABCC12, tandemly duplicated on chromosome 16q12. Gene 273:89-96, 2001.

Yabuuchi, H.; Shimizu, H.; Takayanagi, S.; Ishikawa, T.: Multiple splicing variants of two new human ATP-binding cassette transporters, ABCC11 and ABCC12. Biochem. Biophys. Res. Commun. 288:933-939, 2001.

Nonaka, I.; Sunohara, N.; Ishiura, S.; Satoyoshi, E.: Familial distal myopathy with rimmed vacuole and lamellar (myeloid) body formation. J. Neurol. Sci. 51:141-155, 1981.

Schwarzkopf, M.; Knobeloch, K.-P.; Rohde, E.; Hinderlich, S.; Wiechens, N.; Lucka, L.; Horak, I.; Reutter, W.; Horstkorte, R.:Sialylation is essential for early development in mice. Proc. Nat. Acad. Sci. 99:5267-5270, 2002.

Ramsden, D. B.; Kapadi, A.; Fitch, N. J. S.; Farmer, M. J.; Bennett, P.; Williams, A. C.: Human cysteine dioxygenase type I (CDO-I; EC1.13.11.20):5-prime flanking region and intron-exon structure of the gene. Molec. Path. 50:269-271, 1997.

Hoefler, G.; Forstner, M.; McGuinness, M. C.; Hulla, W.; Hiden, M.; Krisper, P.; Kenner, L.; Ried, T.; Lengauer, C.; Zechner, R.; mOser, H. W.; Chen, G. L.: cDNA cloning of the human peroxisomal enoyl-CoA hydratase:3-hydroxyacyl-CoA dehydrogenase bifunctional enzyme and localization to chromosome 3q26.3-3q28: a free left Alu arm is inserted in the 3-prime noncoding region. Genomics 19:60-67, 1994.

Bera, T. K.; Iavarone, C.; Kumar, V.; Lee, S.; Lee, B.; Pastan, I.: MRP9, an unusual truncated member of the ABC transporter superfamily, is highly expressed in breast cancer. Proc. Nat. Acad. Sci. 99:6997-7002, 2002.

Nagle, D. L.; McGrail, S. H.; Vitale, J.; Woolf, E. A.; Dussault, B. J., Jr.; DiRocco, L.; Holmgren, L.; Montagno, J.; Bork, P.; Huszar, D.; Fairchild-Huntress, V.; Ge, P.; Keilty, J.; Ebelling, C.; Baldini, L.; Gilchrist, J.; Burr, P.; Carlson, G. A.; Moore, K. J.: The mahogany protein is a receptor involved in suppression of obesity. Nature 398:148-151, 1999.

Zhang, Y.; Ng, H.-H.; Erdjument-Bromage, H.; Tempst, P.; Bird, A.; Reinberg, D.: Analysis of the NuRD subunits reveals a histone deacetylase core complex and a connection with DNA methylation. Genes Dev. 13:1924-1935, 1999.

Takafuta, T.; Wu, G.; Murphy, G. F.; Shapiro, S. S.: Human beta-filamin is a new protein that interacts with the cytoplasmic tail of glycoprotein Ib-alpha. J. Biol. Chem. 273:17531-17538, 1998.

Pineda, M.; Fernandez, E.; Torrents, D.; Estevez, R.; Lopez, C.; Camps, M.; Lloberas, J.; Zorzano, A.; Palacin, M.: Identification of a membrane protein, LAT-2, that co-expresses with 4F2 heavy chain, an L-type amino acid transport activity with broad specificity for small and large zwitter ionic amino acids. J. Biol. Chem. 274:19738-19744,1999.

Alexander, W. S.; Rakar, S.; Robb, L.; Farley, A.; Willson, T. A.; Zhang, J.-G.; Hartley, L.; Kikuchi, Y.; Kojima, T.; Nomura, M.; Hasegawa, M.; Maeda, M.; Fabri, L.; Jachno, K.; Nash, A.; Metcalf, D.; Nicola, N. A.; Hilton, D. J.: Suckling defect in mice lacking the soluble haemopoietin receptor NR6. Curr. Biol. 9:605-608, 1999.

Elson, G. C. A.; Graber, P.; Losberger, C.; Herren, S.; Gretener, D.; Menoud, L. N.; Wells, T. N. C.; Kosco-Vilbois, M. H.; Gauchat, J.-F.: Cytokine-like factor-1, a novel soluble protein, shares homology with members of the cytokine type I receptor family. J. Immun. 161:1371-1379, 1998.

Hinderlich, S.; Stasche, R.; Zeitler, R.; Reutter, W.: A bifunctional enzyme catalyzes the first two steps in N-acetylneuraminic acid biosynthesis of rat liver: purification and characterization of UDP-N-acetylglucosamine2-epimerase/N-acetylmannosamine kinase. J. Biol. Chem. 272:24313-24318,1997.

Huizing, M.; Anikster, Y.: Personal Communication. Bethesda, Md. Jan. 10, 2000.

Kayashima, T.; Matsuo, H.; Satoh, A.; Ohta, T.; Yoshiura, K.; Matsumoto, N.; Nakane, Y.; Niikawa, N.; Kishino, T.: Nonaka myopathy is caused by mutations in the UDP-N-acetylglucosamine-2-epimerase/N-acetylmannosamine kinase gene (GNE). J. Hum. Genet. 47:77-79, 2002.

Keppler, O. T.; Hinderlich, S.; Langner, J.; Schwartz-Albiez, R.; Reutter, W.; Pawlita, M.: UDP-GlcNAc 2-epimerase: a regulator of cell surface sialylation. Science 284:1372-1376, 1999.

Stasche, R.; Hinderlich, S.; Weise, C.; Effertz, K.; Lucka, L.; Moormann, P.; Reutter, W.: A bifunctional enzyme catalyzes the first two steps in N-acetylneuraminic acid biosynthesis of rat liver: molecular cloning and functional expression of UDP-N-acetyl-glucosamine 2-epimerase/N-acetylmannosamine kinase. J. Biol. Chem. 272:24319-24324, 1997.

Carter, M. G.; Johns, M. A.; Zeng, X.; Zhou, L.; Zink, M. C.; Mankowski, J. L.; Donovan, D. M.; Baylin, S. B.: Mice deficient in the candidate tumor suppressor gene Hic1 exhibit developmental defects of structures affected in the Miller-Dieker syndrome. Hum. Molec. Genet. 9:413-419,2000.

Chong, S. S.; Tanigami, A.; Roschke, A. V.; Ledbetter, D. H.:14-3-3 epsilon has no homology to LIS1 and lies telomeric to it on chromosome 17p13.3 outside the Miller-Dieker syndrome chromosome region. Genome Res. 6:735-741, 1996.

Grimm, C.; Sporle, R.; Schmid, T. E.; Adler, I.-D.; Adamski, J.; Schughart, K.; Graw, J.: Isolation and embryonic expression of the novel mouse gene Hic1, the homologue of HIC1, a candidate gene for the Miller-Dieker syndrome. Hum. Molec. Genet. 8:697-710, 1999.

Makos Wales, M.; Biel, M. A.; El Deiry, W.; Nelkin, B. D.; Issa, J.-P.; Cavenee, W. K.; Kuerbitz, S. J.; Baylin, S. B.: p53 activates expression of HIC-1, a new candidate tumour suppressor gene on 17p13.3. Nature Med. 1:570-577, 1995.

Smith, D. J.; Salmi, M.; Bono, P.; Hellman, J.; Leu, T.; Jalkanen, S.: Cloning of vascular adhesion protein 1 reveals a novel multifunctional adhesion molecule. J. Exp. Med. 188: 17-27, 1998.

Zhang, X.; McIntire, W. S.: Cloning and sequencing of a copper-containing, top a quinone-containing monoamine oxidase from human placenta. Gene 179:279-286, 1996.

Lomako, J.; Mazuruk, K.; Lomako, W. M.; Alonso, M. D.; Whelan, W. J.; Rodriguez, I. R.: The human intron-containing gene for glycogenin maps to chromosome 3, band q24. Genomics 33:519-522, 1996.

Maas, S.; Gerber, A. P.; Rich, A.: Identification and characterization of a human tRNA-specific adenosine deaminase related to the ADAR family of pre-mRNA editing enzymes. Proc. Nat. Acad. Sci. 96:8895-8900,1999.

Viskupic, E.; Cao, Y.; Zhang, W.; Cheng, C.; DePaoli-Roach, A. A.; Roach, P. J.: Rabbit skeletal muscle glycogenin. Molecular cloning and production of fully functional protein in Escherichia coli. J. Biol. Chem. 267:25759-25763, 1992.

Hosokawa, Y.; Matsumoto, A.; Oka, J.; Itakura, H.; Yamaguchi, K.: Isolation and characterization of a cDNA for rat liver cysteine dioxygenase. Biochem. Biophys. Res. Commun. 168:473-478, 1990.

Jeremiah, S.; McCann, K. P.; Williams, A. C.; Ramsden, D. B.; Pilz, A. J.; Fox, M. F.; Povey, S.: Chromosomal localisation of genes coding for human and mouse liver cytosolic cysteine dioxygenase. Ann. Hum. Genet. 60:29-33, 1996.

McCann, K. P.; Akbari, M. T.; Williams, A. C.; Ramsden, D. B.:Human cysteine dioxygenase type I: primary structure derived from base sequencing of cDNA. Biochim. Biophys. Acta 1209:107-110, 1994.

Fox, M. F.; Lahbib, F.; Pratt, W.; Attwood, J.; Gum, J.; Kim, Y.; Swallow, D. M.: Regional localization of the intestinal mucin gene MUC3 to chromosome 7q22. Ann. Hum. Genet. 56:281-287, 1992.

Kyo, K.; Muto, T.; Nagawa, H.; Lathrop, G. M.; Nakamura, Y.: Associations of distinct variants of the intestinal mucin gene MUC3A with ulcerative colitis and Crohn's disease. J. Hum. Genet. 46:5-20, 2001.

Laurent, P.; Clerc, P.; Mattei, M.-G.; Forgez, P.; Dumont, X.; Ferrara, P.; Caput, D.; Rostene, W.: Chromosomal localization of mouse and human neurotensin receptor genes. Mammalian Genome 5:303-306, 1994.

Le, F.; Groshan, K.; Zeng, X. P.; Richelson, E.: characterization of the genomic structure, promoter region, and a tetranucleotide repeat polymorphism of the human neurotensin receptor gene. J. Biol. Chem. 272:1315-1322, 1997.

Vincent, J.-P.: Neurotensin receptors: binding properties, transduction pathways, and structure. Cell. Molec. Neurobiol. 15:501-512, 1995.

Vita, N.; Laurent, P.; Lefort, S.; Chalon, P.; Dumont, X.; Kaghad, M.; Gully, D.; Le Fur, G.; Ferrara, P.; Caput, D.: Cloning and expression of a complementary DNA encoding a high affinity human neurotensin receptor. FEBS Lett. 317: 139-142, 1993.

Bluteau, O.; Jeannot, E.; Bioulac-Sage, P.; Marques, J. M.; Blanc, J.-F.; Bui, H.; Beaudoin, J.-C.; Franco, D.; Balabaud, C.; Laurent-Puig, P.; Zucman-Rossi, J.: Bi-allelic inactivation of TCF1 in hepatic adenomas. Nature Genet. 32:312-315, 2002.

Foster, J. H.; Donohue, T. A.; Berman, M. M.: Familial liver-cell adenomas and diabetes mellitus. New Eng. J. Med. 299:239-241, 1978.

Honda, H.; Inaba, T.; Suzuki, T.; Oda, H.; Ebihara, Y.; Tsuiji, K.; Nakahata, T.; Ishikawa, T.; Yazaki, Y.; Hirai, H.: Expression of E2A-HLF chimeric protein induced T-cell apoptosis, B-cell maturation arrest, and development of acute lymphoblastic leukemia. Blood 93:2780-2790, 1999.

Hunger, S. P.: Chromosomal translocations involving the E2A gene in acute lymphoblastic leukemia: clinical features and molecular pathogenesis. Blood 87:1211-1224, 1996.

Inaba, T.; Roberts, W. M.; Shapiro, L. H.; Jolly, K. W.; Raimondi, S. C.; Smith, S. D.; Look, A. T.: Fusion of the leucine zipper gene HLF to the E2A gene in human acute B-lineage leukemia. Science 257:531-534, 1992.

Smith, K. S.; Rhee, J. W.; Naumovski, L.; Cleary, M. L.: Disrupted differentiation and oncogenic transformation of lymphoid progenitors in E2A-HLF transgenic mice. Molec. Cell. Biol. 19:4443-4451, 1999.

Acampora, D.; D'Esposito, M.; Faiella, A.; Pannese, M.; Migliaccio, E.; Morelli, F.; Stornaiuolo, A.; Nigro, V.; Simeone, A.; Boncinelli, E.: The human HOX gene family. Nucleic Acids Res. 17:10385-10402,1989.

Balling, R.; Mutter, G.; Gruss, P.; Kessel, M.: Craniofacial abnormalities induced by ectopic expression of the homeobox gene Hox-1.1 in transgenic mice. Cell 58:337-347, 1989.

Bucan, M.; Yang-Feng, T.; Colberg-Poley, A. M.; Wolgemuth, D. J.; Guenet, J.-L.; Francke, U.; Lehrach, H.: Genetic and cytogenetic localisation of the homeo box containing genes on mouse chromosome 6 and human chromosome 7. EMBO J. 5:2899-2905, 1986.

Ferguson-Smith, A. C.; Fienberg, A.; Ruddle, F. H.: Isolation, chromosomal localization, and nucleotide sequence of the human HOX1.4 homeobox. Genomics 5:250-258, 1989.

Gaunt, S. J.; Singh, P. B.: Homeogene expression patterns and chromosomal imprinting. Trends Genet. 6:208-212, 1990.

Gehring, W. J.: The homeo box: a key to the understanding of development? Cell 40:3-5, 1985.

Joyner, A. L.; Lebo, R. V.; Kan, Y. W.; Tjian, R.; Cox, D. R.; Martin, G. R.: Comparative chromosome mapping of a conserved homoeobox region in mouse and human. Nature 314: 173-175, 1985.

McGinnis, W.; Garber, R. L.; Wirz, J.; Kuroiwa, A.; Gehring, W. J.: A homologous protein-coding sequence in Drosophila homeotic genes and its conservation in other metazoans. Cell 37:403-408, 1984.

McGinnis, W.; Levine, M. S.; Hafen, E.; Kuroiwa, A.; Gehring, W. J.: A conserved DNA sequence in homoeotic genes of the Drosophila Antennapedia and bithorax complexes. Nature 308:428-433, 1984.

Ohno, S.: Evolution by Gene Duplication. Heidelberg: Springer (pub.) 1970.

Rabin, M.; Ferguson-Smith, A.; Hart, C. P.; Ruddle, F. H.: Cognate homeo-box loci mapped on homologous human and mouse chromosomes. Proc. Nat. Acad. Sci. 83:9104-9108, 1986.

Rabin, M.; Hart, C. P.; Ferguson-Smith, A.; McGinnis, W.; Levine, M.; Ruddle, F. H.: Two homoeo box loci mapped in evolutionarily related mouse and human chromosomes. Nature 314:175-178, 1985.

Rieger, R.; Michaelis, A.; Green, M. M.: Glossary of Genetics and Cytogenetics. New York: Springer-Verlag (pub.) 1976. Pp.281 only.

Schughart, K.; Kappen, C.; Ruddle, F. H.: Duplication of large genomic regions during the evolution of vertebrate homeobox genes. Proc. Nat. Acad. Sci. 86:7067-7071, 1989.

Scott, M. P.: Vertebrate homeobox gene nomenclature. (Letter) Cell 71:551-553, 1992.

Greer, J. M.; Puetz, J.; Thomas, K. R.; Capecchi, M. R.: Maintenance of functional equivalence during paralogous Hox gene evolution. Nature 403:661-665, 2000.

Apiou, F.; Flagiello, D.; Cillo, C.; Malfoy, B.; Poupon, M.-F.; Dutrillaux, B.: Fine mapping of human HOX gene clusters. Cytogenet. Cell Genet. 73:114-115, 1996.

Chan, H. Y. E.; Warrick, J. M.; Gray-Board, G. L.; Paulson, H. L.; Bonini, N. M.: Mechanisms of chaperone suppression of polyglutamine disease: selectivity, synergy and modulation of protein solubility in Drosophila. Hum. Molec. Genet. 9:2811-2820, 2000.

Dunah, A. W.; Jeong, H.; Griffin, A.; Kim, Y.-M.; Standaert, D. G.; Hersch, S. M.; Mouradian, M. M.; Young, A. B.; Tanese, N.; Krainc, D.: Sp1 and TAFII130 transcriptional activity disrupted in early Huntington's disease. Science 296: 2238-2243, 2002.

Man in't Veld, A. J.; Boomsma, F.; Moleman, P.; Schalekamp, M. A. D. H.: Congenital dopamine-beta-hydroxylase deficiency: a novel orthostatic syndrome. Lancet I:183-188, 1987.

Robertson, D.; Goldberg, M. R.; Onrot, J.; Hollister, A. S.; Wiley, R.; Thompson, J. G., Jr.; Robertson, R. M.: Isolated failure of autonomic noradrenergic neurotransmission: evidence for impaired beta-hydroxylation of dopamine. New Eng. J. Med. 314:1494-1497, 1986.

Ogawa, O.; McNoe, L. A.; Eccles, M. R.; Morison, I. M.; Reeve, A. E.: Human insulin-like growth factor type I and type II receptors are not imprinted. Hum. Molec. Genet. 2:2163-2165, 1993.

Oshima, A.; Nolan, C. M.; Kyle, J. W.; Grubb, J. H.; Sly, W. S.: The human cation-independent mannose 6-phosphate receptor: cloning and sequence of the full-length cDNA and expression of functional receptor in COS cells. J. Biol. Chem. 263:2553-2562, 1988.

Puertollano, R.; Aguilar, R. C.; Gorshkova, I.; Crouch, R. J.; Bonifacino, J. S.: Sorting of mannose 6-phosphate receptors mediated by the GGAs. Science 292:1712-1716, 2001.

Rao, P. H.; Murty, V. V. V. S.; Gaidano, G.; Hauptschein, R.; Dalla-Favera, R.; Chaganti, R. S. K.: Subregional mapping of 8 single copy loci to chromosome 6 by fluorescence in situ hybridization. Cytogenet. Cell Genet. 66:272-273, 1994.

Roth, R. A.: Structure of the receptor for insulin-like growth factor II: the puzzle amplified. Science 239:1269-1271, 1988.

Sleutels, F.; Zwart, R.; Barlow, D. P.: The non-coding Air RNA is required for silencing autosomal imprinted genes. Nature 415:810-813, 2002.

Souza, R. F.; Appel, R.; Yin, J.; Wang, S.; Smolinski, K. N.; Abraham, J. M.; Zou, T.-T.; Shi, Y.-Q.; Lei, J.; Cottrell, J.; Cymes, K.; Biden, K.; Simms, L.; Leggett, B.; Lynch, P. M.; Frazier, M.; Powell, S. M.; Harpaz, N.; Sugimura, H.; Young, J.; Meltzer, S. J.: Microsatellite instability in the insulin-like growth factor II receptor gene in gastrointestinal tumours. (Letter) Nature Genet. 14:255-257, 1996.

Szebeny, G.; Rotwein, P.: The mouse insulin-like growth factor II/cation-independent mannose 6-phosphate (IGF-II/MPR) receptor gene:molecular cloning and genomic organization. Genomics 19:120-129,1994.

Tong, P. Y.; Tollefsen, S. E.; Kornfeld, S.: The cation-independent mannose 6-phosphate receptor binds insulin-like growth factor II. J. Biol. Chem. 263:2585-2588, 1988.

Waheed, A.; Braulke, T.; Junghans, U.; von Figura, K.: Mannose 6-phosphate/insulin like growth factor II receptor: the two types of ligands bind simultaneously to one receptor at different sites. Biochem. Biophys. Res. Commun. 152:1248-1254, 1988.

Xu, Y.; Goodyer, C. G.; Deal, C.; Polychronakos, C.: Functional polymorphism in the parental imprinting of the human IGF2R gene. Biochem. Biophys. Res. Commun. 197:747-754, 1993.

Young, L. E.; Fernandes, K.; McEvoy, T. G.; Butterwith, S. C.; Gutierrez, C. G.; Carolan, C.; Broadbent, P. J.; Robinson, J. J.; Wilmut, I.; Sinclair, K. D.: Epigenetic change in IGF2R is associated with fetal overgrowth after sheep embryo culture. Nature Genet. 27:153-154, 2001.

Zhu, Y.; Doray, B.; Poussu, A.; Lehto, V.-P.; Kornfeld, S.: Binding of GGA2 to the lysosomal enzyme sorting motif of the mannose 6-phosphate receptor. Science 292:1716-1718, 2001.

Brown, C. W.; Houston-Hawkins, D. E.; Woodruff, T. K.; Matzuk, M. M.: Insertion of Inhbb into the Inhba locus rescues the Inhba-null phenotype and reveals new activin functions. Nature Genet. 25:453-457,2000.

Matzuk, M. M.; Kumar, T. R.; Vassalli, A.; Bickenbach, J. R.; Roop, D. R.; Jaenisch, R.; Bradley, A.: Functional analysis of activins during mammalian development. Nature 374:354-356, 1995.

Mellor, S. L.; Cranfield, M.; Ries, R.; Pedersen, J.; Cancilla, B.; de Kretser, D.; Groome, N. P.; Mason, A. J.; Risbridger, G. P.: Localization of activin beta (A)-, beta (B)-, and beta (C)-subunits in human prostate and evidence for formation of new activin heterodimers of beta (C)-subunit. J. Clin. Endocr. Metab. 85:4851-4858, 2000.

You, L.; Kruse, F. E.: Differential effect of activin A and BMP-7on myofibroblast differentiation and the role of the Smad signaling pathway. Invest. Ophthal. Vis. Sci. 43:72-81, 2002.

Taniyama, Y.; Kuroki, R.; Omura, F.; Seko, C.; Kikuchi, M.: Evidence for intramolecular disulfide bond shuffling in the folding of mutant human lysozyme. J. Biol. Chem. 266:6456-6461, 1991.

Li, C.; Lai, C.; Sigman, D. S.; Gaynor, R. B.: Cloning of a cellular factor, interleukin binding factor, that binds to NFAT-like motifs in the human immunodeficiency virus long terminal repeat. Proc. Nat. Acad. Sci. 88:7739-7743, 1991.

Li, C.; Lusis, A. J.; Sparkes, R.; Nirula, A.; Gaynor, R.: Characterization and chromosomal mapping of the gene encoding the cellular DNA binding protein ILF. Genomics 13:665-671, 1992.

Boone, C.; Chen, T.-R.; Ruddle, F. H.: Assignment of three human genes to chromosomes (LDH-A to 11, TK to 17 and IDH to 20) and evidence for translocation between human and mouse chromosomes in somatic cell hybrids. Proc. Nat. Acad. Sci. 68:510-514, 1972.

Chen, S.-H.; Fossum, B. L. G.; Giblett, E. R.: Genetic variation of the soluble form of NADP-dependent isocitric dehydrogenase in man. Am. J. Hum. Genet. 24:325-329, 1972.

Creagan, R. P.; Carritt, B.; Chen, S.-H.; Kucherlapati, R. S.; McMorris, F. A.; Ricciuti, F.; Tan, Y. H.; Tischfield, J. A.; Ruddle, F. H.: Chromosome assignments of genes in man using mouse-human somatic cell hybrids: cytoplasmic isocitrate dehydrogenase (IDH 1) and malatede hydrogenase (MDH 1) to chromosome 2. Am. J. Hum. Genet. 26:604-613, 1974.

Glass, I. A.; Swindlehurst, C. A.; Aitken, D. A.; McCrea, W.; Boyd, E.: Interstitial deletion of the long arm of chromosome 2 with normal levels of isocitrate dehydrogenase. J. Med. Genet. 26:127-130,1989.

Henderson, N. S.: Isozymes of isocitrate dehydrogenase: subunit structure and intracellular location. J. Exp. Zool. 158:263-273,1965.

Henderson, N. S.: Intracellular location and genetic control of isozymes of NADP-dependent isocitrate dehydrogenase and malate dehydrogenase. Ann. N. Y. Acad. Sci. 151:429-440, 1968.

Narahara, K.; Kimura, S.; Kikkawa, K.; Takahashi, Y.; Wakita, Y.; Kasai, R.; Nagai, S.; Nishibayashi, Y.; Kimoto, H.: Probable assignment of soluble isocitrate dehydrogenase (IDH-1) to 2q33.3. Hum. Genet. 71:37-40, 1985.

Ruddle, F. H.: Linkage analysis in man by somatic cell genetics. Nature 242:165-169, 1973.

Shows, T. B.: (Abstract) 4th Int. Cong. Hum. Genet., Paris 165,1971.

Shows, T. B.: Genetics of human-mouse somatic cell hybrids: linkage of human genes for isocitrate dehydrogenase and malate dehydrogenase. Biochem. Genet. 7:193-204, 1972.

Turner, B. M.; Fisher, R. A.; Garthwaite, E.; Whale, R. J.; Harris, H.: An account of two new ICD-S variants not detectable in red blood cells. Ann. Hum. Genet. 37:469-476, 1974.

Van Cong, N.: Personal Communication. Paris, France 1976.

Weil, D.; Van Cong, N.; Finaz, C.; Rebourcet, R.; Cochet, C.; de Grouchy, J.; Frezal, J.: Localisation regionale des genes humains IDH-S, MDH-S, PGK, alpha-GAL, G6PD par l'hybridation cellulaire interspecifique. Hum. Genet. 36:205-211, 1977.

Auron, P. E.; Webb, A. C.; Rosenwasser, L. J.; Mucci, S. F.; Rich, A.; Wolff, S. M.; Dinarello, C. A.: Nucleotide sequence of human monocyte interleukin 1 precursor cDNA. Proc. Nat. Acad. Sci. 81:7907-7911, 1984.

Francke, U.; Foellmer, B. E.; Haynes, B. F.: Chromosome mapping of human cell surface molecules: monoclonal anti-human lymphocyte antibodies 4F2, A3D8, and A1G3 define antigens controlled by different regions of chromosome 11. Somat. Cell Genet. 9:333-344, 1983.

Mastroberardino, L.; Spindler, B.; Pfeiffer, R.; Skelly, P. J.; Loffing, J.; Shoemaker, C. B.; Verrey, F.: Amino-acid transport by heterodimers of 4F2hc/CD98 and members of a permease family. Nature 395:288-291, 1998.

Dooley, T. P.; Huang, Z.: Genomic organization and DNA sequences of two human phenol sulfotransferase genes (STP1 and STP2) on the short arm of chromosome 16. Biochem. Biophys. Res. Commun. 228:134-140, 1996.

Her, C.; Raftogianis, R.; Weinshilboum, R. M.: Human phenol sulfotransferase STP2 gene: molecular cloning, structural characterization, and chromosomal localization. Genomics 33:409-420, 1996.

Barbosa, M. D. F. S.; Nguyen, Q. A.; Tchernev, V. T.; Ashley, J. A.; Detter, J. C.; Blaydes, S. M.; Brandt, S. J.; Chotai, D.; Hodgman, C.; Solari, R. C. E.; Lovett, M.; Kingsmore, S. F.: Identification of the homologous beige and Chediak-Higashi syndrome genes. Nature 382:262-265, 1996.

Fukai, K.; Oh, J.; Karim, M. A.; Moore, K. J.; Kandil, H. H.; Ito, H.; Burger, J.; Spritz, R. A.: Homozygosity mapping of the gene for Chediak-Higashi syndrome to chromosome 1q42-q44 in a segment of conserved synteny that includes the mouse beige locus (bg). Am. J. Hum. Genet. 59:620-624, 1996.

Jackson, I. J.: Homologous pigmentation mutations in human, mouse and other model organisms. Hum. Molec. Genet. 6:1613-1624, 1997.

Karim, M. A.; Nagle, D. L.; Kandil, H. H.; Burger, J.; Moore, K. J.; Spritz, R. A.: Mutations in the Chediak-Higashi syndrome gene (CHS1) indicate requirement for the complete 3801 amino acid CHS protein. Hum. Molec. Genet. 6:1087-1089, 1997.

Nagle, D. L.; Karim, M. A.; Woolf, E. A.; Holmgren, L.; Bork, P.; Misumi, D. J.; McGrail, S. H.; Dussault, B. J., Jr.; Perou, C. M.; Boissy, R. E.; Duyk, G. M.; Spritz, R. A.; Moore, K. J.: Identification and mutation analysis of the complete gene for Chediak-Higashi syndrome. Nature Genet. 14:307-311, 1996.

Perou, C. M.; Moore, K. J.; Nagle, D. L.; Misumi, D. J.; Woolf, E. A.; McGrail, S. H.; Holmgren, L.; Brody, T. H.; Dussault, B. J., Jr.; Monroe, C. A.; Duyk, G. M.; Pryor, R. J.; Li, L.; Justice, M. J.; Kaplan, J.: Identification of the murine beige gene by YAC complementation and positional cloning. Nature Genet. 13:303-308, 1996.

Borg, J.-P.; Marchetto, S.; Le Bivic, A.; Ollendorff, V.; Jaulin-Bastard, F.; Saito, H.; Fournier, E.; Adelaide, J.; Margolis, B.; Birnbaum, D.: ERBIN: a basolateral PDZ protein that interacts with the mammalian ERBB2/HER2 receptor. Nature Cell Biol. 2:407-414, 2000.

Dustin, M. L.; Olszowy, M. W.; Holdorf, A. D.; Li, J.; Bromley, S.; Desai, N.; Widder, P.; Rosenberger, F.; van der Merwe, P. A.; Allen, P. M.; Shaw, A. S.: A novel adaptor protein orchestrates receptor patterning and cytoskeletal polarity in T-cell contacts. Cell 94:667-677, 1998.

Kirsch, K. H.; Georgescu, M.-M.; Ishimaru, S.; Hanafusa, H.: CMS:an adapter molecule involved in cytoskeletal rearrangements. Proc. Nat. Acad. Sci. 96:6211-6216, 1999.

Shih, N.-Y.; Li, J.; Karpitskii, V.; Nguyen, A.; Dustin, M. L.; Kanagawa, O.; Miner, J. H.; Shaw, A. S.: Congenital nephrotic syndrome in mice lacking CD2-associated protein. Science 286:312-315, 1999.

Lee, J.-H.; Miele, M. E.; Hicks, D. J.; Phillips, K. K.; Trent, J. M.; Weissman, B. E.; Welch, D. R.: KiSS-1, a novel human malignant melanoma metastasis-suppressor gene. J. Nat. Cancer Inst. 88:1731-1737,1996. Note: Erratum: J. Nat. Cancer Inst. 89:1549 only, 1997.

Lee, J.-H.; Welch, D. R.: Suppression of metastasis in human breast carcinoma MDA-MB-435 cells after transfection with the metastasis suppressor gene, KiSS-1. Cancer Res. 57:2384-2387, 1997.

Ohtaki, T.; Shintani, Y.; Honda, S.; Matsumoto, H.; Hori, A.; Kanehashi, K.; Terao, Y.; Kumano, S.; Takatsu, Y.; Masuda, Y.; Ishibashi, Y.; Watanabe, T.; and 9 others: Metastasis suppressor gene KiSS-1 encodes peptide ligand of a G-protein-coupled receptor. Nature 411:613-617,2001.

Welch, D. R.; Chen, P.; Miele, M. E.; McGary, C. T.; Bower, J. M.; Stanbridge, E. J.; Weissman, B. E.: Microcell-mediated transfer of chromosome 6 into metastatic human C8161 melanoma cells suppresses metastasis but does not inhibit tumorigenicity. Oncogene 9:255-262,1994.

West, A.; Vojta, P. J.; Welch, D. R.; Weissman, B. E.: Chromosome localization and genomic structure of the KiSS-1 metastasis suppressor gene (KISS1). Genomics 54:145-148, 1998.

Xu, W.; Xie, Z.; Chung, D. W.; Davie, E. W.: A novel human actin-binding protein homologue that binds to platelet glycoprotein Ib-alpha. Blood 92:1268-1276, 1998.

Zhang, W.; Han, S. W.; McKeel, D. W.; Goate, A.; Wu, J. Y.: Interaction of presenilins with the filamin family of actin-binding proteins. J. Neurosci. 18:914-922, 1998.

Kim, J. M.; Sato, N.; Yamada, M.; Arai, K.; Masai, H.: Growth regulation of the expression of mouse cDNA and gene encoding a serine/threonine kinase related to Saccharomyces cerevisiae CDC7 essential for G(1)/Stransition: structure, chromosomal localization, and expression of mouse gene for S. cerevisiae CDC7-related kinase. J. Biol. Chem. 273:23248-23257, 1998.

Gelb, B. D.; Zhang, J.; Cotter, P. D.; Gershin, I. F.; Desnick, R. J.: Physical mapping of the human connexin 40 (GJA5), flavin-containing monooxygenase 5, and natriuretic peptide receptor A genes on 1q21. Genomics 39:409-411, 1997.

Overby, L. H.; Buckpitt, A. R.; Lawton, M. P.; Atta-Asafo-Adjei, E.; Schulze, J.; Philpot, R. M.: Characterization of flavin-containing monooxygenase 5 (FMO5) cloned from human and guinea pig: evidence that the unique catalytic properties of FMO5 are not confined to the rabbit ortholog. Arch. Biochem. Biophys. 317:275-284, 1995.

Poindexter, K.; Nelson, N.; DuBose, R. F.; Black, R. A.; Cerretti, D. P.: The identification of seven metalloproteinase-disintegrin (ADAM) genes from genomic libraries. Gene 237:61-70, 1999.

Granadino, B.; Gallardo, M. E.; Lopez-Rios, J.; Sanz, R.; Ramos, C.; Ayuso, C.; Bovolenta, P.; Rodriguez de Cordoba, S.: Genomic cloning, structure, expression pattern, and chromosomal location of the human SIX3 gene. Genomics 55:100-105, 1999.

Loosli, F.; Winkler, S.; Wittbrodt, J.: Six3 overexpression initiates the formation of ectopic retina. Genes Dev. 13:649-654, 1999.

Oliver, G.; Mailhos, A.; Wehr, R.; Copeland, N. G.; Jenkins, N. A.; Gruss, P.: Six3, a murine homologue of the sine oculis gene, demarcates the most anterior border of the developing neural plate and is expressed during eye development. Development 121:4045-4055,1995.

Pasquier, L.; Dubourg, C.; Blayau, M.; Lazaro, L.; Le Marec, B.; David, V.; Odent, S.: A new mutation in the six-domain of SIX3 gene causes holoprosencephaly. Europ. J. Hum. Genet. 8:797-800, 2000.

Roessler, E.; Muenke, M.: Holoprosencephaly: a paradigm for the complex genetics of brain development. J. Inherit. Metab. Dis. 21:481-497, 1998.

Schell, U.; Wienberg, J.; Kohler, A.; Bray-Ward, P.; Ward, D. E.; Wilson, W. G.; Allen, W. P.; Lebel, R. R.; Sawyer, J. R.; Campbell, P. L.; Aughton, D. J.; Punnett, H. H.; Lammer, E. J.; Kao, F.-T.; Ward, D. C.; Muenke, M.: Molecular characterization of breakpoints in patients with holoprosencephaly and definition of the HPE2 critical region 2p21. Hum. Molec. Genet. 5:223-229, 1996.

Matsumoto-Taniura, N.; Pirollet, F.; Monroe, R.; Gerace, L.; Westendorf, J. M.: Identification of novel M phase phosphoproteins by expression cloning. Molec. Biol. Cell 7:1455-1469, 1996.

Doi, T.; Minami, T.; Itoh, M.; Aburatani, H.; Kawabe, Y.; Kodama, T.; Kondo, N.; Satoh, Y.; Asayama, T.; Imanishi, T.: An alternative form of nucleolysin binds to a T-cluster DNA in the silencer element of platelet factor 4 gene. Biochem. Biophys. Res. Commun. 235:625-630,1997.

Kawakami, A.; Tian, Q.; Duan, X.; Streuli, M.; Schlossman, S. F.; Anderson, P.: Identification and functional characterization of a TIA-1-related nucleolysin. Proc. Nat. Acad. Sci. 89:8681-8685,1992.

Parlati, F.; McNew, J. A.; Fukuda, R.; Miller, R.; Sollner, T. H.; Rothman, J. E.: Topological restriction of SNARE-dependent membrane fusion. Nature 407:194-198, 2000.

Beckstead, R.; Ortiz, J. A.; Sanchez, C.; Prokopenko, S. N.; Chambon, P.; Losson, R.; Bellen, H. J.: Bonus, a Drosophila homolog of TIF1proteins, interacts with nuclear receptors and can inhibit beta-FTZ-F1-dependent transcription. Molec. Cell 7:753-765, 2001.

Le Douarin, B.; Zechel, C.; Garnier, J.-M.; Lutz, Y.; Tora, L.; Pierrat, B.; Heery, D.; Gronemeyer, H.; Chambon, P.; Losson, R.:The N-terminal part of TIF1, a putative mediator of the ligand-dependent activation function (AF-2) of nuclear receptors, is fused to B-rafin the oncogenic protein T18. EMBO J. 14:2020-2033, 1995.

Thenot, S.; Henriquet, C.; Rochefort, H.; Cavailles, V.: Differential interaction of nuclear receptors with the putative human transcriptional coactivator hTIF1. J. Biol. Chem. 272: 12062-12068, 1997.

Feral, C.; Mattei, M. G.; Pawlak, A.; Guellaen, G.: Chromosomal localization of three human poly (A)-binding protein genes and four related pseudogenes. Hum. Genet. 105: 347-353, 1999.

Liu, T.; DeCostanzo, A. J.; Liu, X.; Wang, H.; Hallagan, S.; Moon, R. T.; Malbon, C. C.: G protein signaling from activated rat frizzled-1 to the beta-catenin-Lef-Tcf pathway. Science 292:1718-1722, 2001.

Sagara, N.; Toda, G.; Hirai, M.; Terada, M.; Katoh, M.: molecular cloning, differential expression, and chromosomal localization of human frizzled-1, frizzled-2, and frizzled-7. Biochem. Biophys. Res. Commun. 252:117-122, 1998.

Tanaka, S.; Akiyoshi, T.; Mori, M.; Wands, J. R.; Sugimachi, K.: A novel frizzled gene identified in human esophageal carcinoma mediates APC/beta-catenin signals. Proc. Nat. Acad. Sci. 95:10164-10169,1998.

Winklbauer, R.; Medina, A.; Swain, R. K.; Steinbeisser, H.: Frizzled-7 signalling controls tissue separation during Xenopus gastrulation. Nature 413:856-860, 2001.

Parnet, P.; Garka, K. E.; Bonnert, T. P.; Dower, S. K.; Sims, J. E.: IL-1Rrp is a novel receptor-like molecule similar to the type I interleukin-1 receptor and its homologues T1/ST2 and IL-1R AcP. J. Biol. Chem. 271:3967-3970, 1996.

Torigoe, K.; Ushio, S.; Okura, T.; Kobayashi, S.; Taniai, M.; Kunikata, T.; Murakami, T.; Sanou, O.; Kojima, H.; Fujii, M.; Ohta, T.; Ikeda, M.; Ikegami, H.; Kurimoto, M.: Purification and characterization of the human interleukin-18 receptor. J. Biol. Chem. 272:25737-25742,1997.

Akiba, H.; Atsuta, M.; Yagita, H.; Okumura, K.: Identification of rat OX40 ligand by molecular cloning. Biochem. Biophys. Res. Commun. 251:131-136, 1998.

Baum, P. R.; Gayle, R. B., III; Ramsdell, F.; Srinivasan, S.; Sorensen, R. A.; Watson, M. L.; Seldin, M. F.; Baker, E.; Sutherland, G. R.; Clifford, K. N.; Alderson, M. R.; Goodwin, R. G.; Fanslow, W. C.:Molecular characterization of murine and human OX40/OX40 ligand systems:identification of a human OX40 ligand as the HTLV-1-regulated protein gp34. EMBO J. 13:3992-4001, 1994.

Godfrey, W. R.; Fagnoni, F. F.; Harara, M. A.; Buck, D.; Engleman, E. G.: Identification of a human OX-40 ligand, a costimulator of CD4+ T cells with homology to tumor necrosis factor. J. Exp. Med. 180:757-762, 1994.

Malmstrom, V.; Shipton, D.; Singh, B.; Al-Shamkhani, A.; Puklavec, M. J.; Barclay, A. N.; Powrie, F.: CD134L expression on dendritic cells in the mesenteric lymph nodes drives colitis in T cell-restored SCID mice. J. Immun. 166:6972-6981, 2001.

Miura, S.; Ohtani, K.; Numata, N.; Niki, M.; Ohbo, K.; Ina, Y.; Gojobori, T.; Tanaka, Y.; Tozawa, H.; Nakamura, M.; Sugamura, K.:Molecular cloning and characterization of a novel glycoprotein, gp34, that is specifically induced by the human T-cell leukemia virus type I transactivator p40-tax. Molec. Cell. Biol. 11:1313-1325, 1991.

Cretney, E.; Takeda, K.; Yagita, H.; Glaccum, M.; Peschon, J. J.; Smyth, M. J.: Increased susceptibility to tumor initiation and metastasis in TNF-related apoptosis-inducing ligand-deficient mice. J. Immun. 168:1356-1361, 2002.

Degli-Esposti, M. A.; Dougall, W. C.; Smolak, P. J.; Waugh, J. Y.; Smith, C. A.; Goodwin, R. G.: The novel receptor TRAIL-R4 induces NF-kappa-B and protects against TRAIL-mediated apoptosis, yet retains an incomplete death domain. Immunity 7:813-820, 1997.

Bardoni, B.; Giglio, S.; Schenck, A.; Rocchi, M.; Mandel, J. L.: Assignment of NUFIP1 (nuclear FMRP interacting protein 1) gene to chromosome 13q14 and assignment of a pseudogene to chromosome 6q12. Cytogenet. Cell Genet. 89:11-13, 2000.

Bardoni, B.; Schenck, A.; Mandel, J. L.: A novel RNA-binding nuclear protein that interacts with the fragile X mental retardation (FMR1) protein. Hum. Molec. Genet. 8:2557-2566, 1999.

Maw, M. A.; Corbeil, D.; Koch, J.; Hellwig, A.; Wilson-Wheeler, J. C.; Bridges, R. J.; Kumaramanickavel, G.; John, S.; Nancarrow, D.; Roper, K.; Weigmann, A.; Huttner, W. B.; Denton, M. J.: A frame shift mutation in prominin (mouse)-like 1 causes human retinal degeneration. Hum. Molec. Genet. 9:27-34, 2000.

Miraglia, S.; Godfrey, W.; Yin, A. H.; Atkins, K.; Warnke, R.; Holden, J. T.; Bray, R. A.; Waller, E. K.; Buck, D. W.: A novel five-transmembrane hematopoietic stem cell antigen: isolation, characterization, and molecular cloning. Blood 90:5013-5021, 1997.

Yin, A. H.; Miraglia, S.; Zanjani, E. D.; Almeida-Porada, G.; Ogawa, M.; Leary, A. G.; Olweus, J.; Kearney, J.; Buck, D. W.: AC133, a novel marker for human hematopoietic stem and progenitor cells. Blood 90:5002-5012, 1997.

Taylor, S. S.; Ha, E.; McKeon, F.: The human homologue of Bub3 is required for kinetochore localization of Bub1 and a Mad3/Bub1-related protein kinase. J. Cell Biol. 142:1-11, 1998.

Bonne, S.; van Hengel, J; van Roy, F.: Assignment of the plakophilin-2gene (PKP2) and a plakophilin-2 pseudogene (PKP2P1) to human chromosome bands 12p11 and 12p13, respectively, by in situ hybridization. Cytogenet. Cell Genet. 88:286-287, 2000.

Mertens, C.; Kuhn, C.; Franke, W. W.: Plakophilins 2a and 2b:constitutive proteins of dual location in the karyoplasm and the desmosomal plaque. J. Cell Biol. 135:1009-1025, 1996.

Schmidt, A; Langbein, L.; Pratzel, S.; Rode, M.; Rackwitz, H.-R.; Franke, W. W.: Plakophilin 3--a novel cell-type-specific desmosomal plaque protein. Differentiation 64:291-306, 1999.

Thornton, C.; Snowden, M. A.; Carling, D.: Identification of a novel AMP-activated protein kinase beta subunit isoform that is highly expressed in skeletal muscle. J. Biol. Chem. 273:12443-12450, 1998.

Woods, A.; Cheung, P. C. F.; Smith, F. C.; Davison, M. D.; Scott, J.; Beri, R. K.; Carling, D.: Characterization of AMP-activated protein kinase beta and gamma subunits: assembly of the heterotrimeric complex in vitro. J. Biol. Chem. 271: 10282-10290, 1996.

Kullak-Ublick, G.-A.; Beuers, U.; Meier, P. J.; Domdey, H.; Paumgartner, G.: Assignment of the human organic anion transporting polypeptide (OATP) gene to chromosome 12p12 by fluorescence in situ hybridization. J. Hepatol. 25:985-987, 1996.

Kullak-Ublick, G. A.; Hagenbuch, B.; Stieger, B.; Schteingart, C. D.; Hofmann, A. F.; Wolkoff, A. W.; Meier, P. J.: Molecular and functional characterization of an organic anion transporting polypeptide cloned from human liver.: Gastroenterology 109:1274-1282, 1995.

El-Husseini, A. E.-D.; Schnell, E.; Chetkovich, D. M.; Nicoll, R. A.; Bredt, D. S.: PSD-95 involvement in maturation of excitatory synapses. Science 290:1364-1368, 2000.

El-Husseini, A. E.-D.; Schnell, E.; Dakoji, S.; Sweeney, N.; Zhou, Q.; Prange, O.; Gauthier-Campbell, C.; Aguilera-Moreno, A.; Nicoll, R. A.; Bredt, D. S.: Synaptic strength regulated by palmitate cycling on PSD-95. Cell 108:849-863, 2002.

Kim, E.; Cho, K.-O.; Rothschild, A.; Sheng, M.: Heteromultimerization and NMDA receptor-clustering activity of Chapsyn-110, a member of the PSD-95 family of proteins. Neuron 17:103-113, 1996.

Kim, E.; Niethammer, M.; Rothschild, A.; Jan, Y. N.; Sheng, M.: Clustering of Shaker-type K+ channels by interaction with a family of membrane-associated guanylate kinases. Nature 378:85-88, 1995.

Kistner, U.; Wenzel, B. M.; Veh, R. W.; Cases-Langhoff, C.; Garner, A. M.; Appeltauer, U.; Voss, B.; Gundelfinger, E. D.; Garner, C. C.: SAP90, a rat presynaptic protein related to the product of the Drosophila tumor suppressor gene, dLg-A. J. Biol. Chem. 268:4580-4583, 1993.

Migaud, M.; Charlesworth, P.; Dempster, M.; Webster, L. C.; Watabe, A. M.; Makhinson, M.; He, Y.; Ramsay, M. F.; Morris, R. G. M.; Morrison, J. H.; O'Dell, T. J.; Grant, S. G. N.: Enhanced long-term potentiation and impaired learning in mice with mutant postsynaptic density-95 protein. Nature 396:433-439, 1998.

Sattler, R.; Xiong, Z.; Lu, W.-Y.; Hafner, M.; MacDonald, J. F.; Tymianski, M.: Specific coupling of NMDA receptor activation to nitric oxide neurotoxicity by PSD-95 protein. Science 284:1845-1848, 1999.

Stathakis, D. G.; Hoover, K. B.; You, Z.; Bryant, P. J.: human postsynaptic density-95 (PSD95): location of the gene (DLG4) and possible function in nonneural as well as in neural tissues. Genomics 44:71-82, 1997.

Strippoli, P.; Petrini, M.; Lenzi, L.; Carinci, P.; Zannotti, M.: The murine DSCR1-like (Down syndrome candidate region 1) gene family:conserved synteny with the human orthologous genes. Gene 257:223-232,2000.

Yang, J.; Rothermel, B.; Vega, R. B.; Frey, N.; McKinsey, T. A.; Olson, E. N.; Bassel-Duby, R.; Williams, R. S.: Independent signals control expression of the calcineurin inhibitory proteins MCIP1 and MCIP2 in striated muscles. Circ. Res. 87:61e-68e, 2000.

Zheng, B.; Larkin, D. W.; Albrecht, U.; Sun, Z. S.; Sage, M.; Eichele, G.; Lee, C. C.; Bradley, A.: The mPer2 gene encodes a functional component of the mammalian circadian clock. Nature 400:169-173,1999.

Nakamura, H.; Sudo, T.; Tsuiki, H.; Miyake, H.; Morisaki, T.; Sasaki, J.; Masuko, N.; Kochi, M.; Ushio, Y.; Saya, H.: Identification of a novel human homolog of the Drosophila dlg, P-dlg, specifically expressed in the gland tissues and interacting with p55. FEBS Lett. 433:63-67,1998.

Funderburgh, J. L.; Perchellet, A. L.; Swiergiel, J.; Conrad, G. W.; Justice, M. J.: Keratocan (Kera), a corneal keratan sulfate proteoglycan, maps to the distal end of mouse chromosome 10. Genomics 52:110-111,1998.

Liu, C.-Y.; Shiraishi, A.; Kao, C. W.-C.; Converse, R. L.; Funderburgh, J. L.; Corpuz, L. M.; Conrad, G. W.; Kao, W. W.-Y.: The cloning of mouse keratocan cDNA and genomic DNA and the characterization of its expression during eye development. J. Biol. Chem. 273:22584-22588,1998.

Tasheva, E. S.; Funderburgh, J. L.; Funderburgh, M. L.; Corpuz, L. M.; Conrad, G. W.: Structure and sequence of the gene encoding human keratocan. DNA Seq. 10:67-74, 1999.

Tasheva, E. S.; Pettenati, M.; Von Kap-Her, C.; Conrad, G. W.:Assignment of keratocan gene (KERA) to human chromosome band 12q22 by in situ hybridization. Cytogenet. Cell Genet. 88:244-245, 2000.

Bruick, R. K.: Expression of the gene encoding the proapoptotic Nip3 protein is induced by hypoxia. Proc. Nat. Acad. Sci. 97:9082-9087,2000.

Vaughan, K. T.; Mikami, A.; Paschal, B. M.; Holzbaur, E. L. F.; Hughes, S. M.; Echeverri, C. J.; Moore, K. J.; Gilbert, D. J.; Copeland, N. G.; Jenkins, N. A.; Vallee, R. B.: Multiple mouse chromosomal loci for dynein-based motility. Genomics 36:29-38, 1996.

Soyombo, A. A.; Hofmann, S. L.: Molecular cloning and expression of palmitoyl-protein thioesterase 2 (PPT2), a homolog of lysosomal palmitoyl-protein thioesterase with a distinct substrate specificity. J. Biol. Chem. 272:27456-27463, 1997.

Richter-Cook, N. J.; Dever, T. E.; Hensold, J. O.; Merrick, W. C.: Purification and characterization of a new eukaryotic protein translation factor: eukaryotic initiation factor 4H. J. Biol. Chem. 273:7579-7587, 1998.

Hoogenraad, C. C.; Eussen, B. H. J.; Langeveld, A.; van Haperen, R.; Winterberg, S.; Wouters, C. H.; Grosveld, F.; De Zeeuw, C. I.; Galjart, N.: The murine CYLN2 gene: genomic organization, chromosome localization, and comparison to the human gene that is located within the 7q11.23 Williams syndrome critical region. Genomics 53:348-358,1998.

Araujo, H.; Danziger, N.; Cordier, J.; Glowinski, J.; Chneiweiss, H.: Characterization of PEA-15, a major substrate for protein kinase C in astrocytes. J. Biol. Chem. 268:5911-5920, 1993.

Bera, T. K.; Guzman, R. C.; Miyamoto, S.; Panda, D. K.; Sasaki, M.; Hanyu, K.; Enami, J.; Nandi, S.: Identification of a mammary transforming gene (MAT1) associated with mouse mammary carcinogenesis. Proc. Nat. Acad. Sci. 91:9789-9793, 1994.

Condorelli, G.; Vigliotta, G.; Iavarone, C.; Caruso, M.; Tocchetti, C. G.; Andreozzi, F.; Cafieri, A.; Tecce, M. F.; Formisano, P.; Beguinot, L.; Beguinot, F.: PED/PEA-15 gene controls glucose transport and is overexpressed in type 2 diabetes mellitus. EMBO J. 17:3858-3866,1998.

Danziger, N.; Yokoyama, M.; Jay, T.; Cordier, J.; Glowinski, J.; Chneiweiss, H.: Cellular expression, developmental regulation, and phylogenic conservation of PEA-15, the astrocytic major phosphoprotein and protein kinase C substrate. J. Neurochem. 64:1016-1025, 1995.

Estelles, A.; Yokoyama, M.; Nothias, F.; Vincent, J.-D.; Glowinski, J.; Vernier, P.; Chneiweiss, H.: The major astrocytic phosphoprotein PEA-15 is encoded by two mRNAs conserved on their full length in mouse and human. J. Biol. Chem. 271:14800-14806, 1996.

Hwang, S.; Kuo, W.-L.; Cochran, J. F.; Guzman, R. C.; Tsukamoto, T.; Bandyopadhyay, G.; Myambo, K.; Collins, C. C.: Assignment of HMAT1, the human homolog of the murine mammary transforming gene (MAT1) associated with tumorigenesis, to 1q21.1, a region frequently gained in human breast cancers. Genomics 42:540-542, 1997.

Wolford, J. K.; Bogardus, C.; Ossowski, V.; Prochazka, M.: Molecular characterization of the human PEA15 gene on 1q21-q22 and association with type 2 diabetes mellitus in Pima Indians. Gene 241:143-148,2000.

Aurrand-Lions, M.; Galland, F.; Bazin, H.; Zakharyev, V. M.; Imhof, B. A.; Naquet, P.: Vanin-1, a novel GPI-linked perivascular molecule involved in thymus homing. Immunity 5:391-405, 1996.

Galland, F.; Malergue, F.; Bazin, H.; Mattei, M. G.; Aurrand-Lions, M.; Theillet, C.; Naquet, P.: Two human genes related to murine vanin-1 are located on the long arm of human chromosome 6. Genomics 53:203-213, 1998.

Martin, F.; Malergue, F.; Pitari, G.; Philippe, J. M.; Philips, S.; Chabret, C.; Granjeaud, S.; Mattei, M. G.; Mungall, A. J.; Naquet, P.; Galland, F.: Vanin genes are clustered (human 6q22-24 and mouse10A2B1) and encode isoforms of pantetheinase ectoenzymes. Immunogenetics 53:296-306, 2001.

Pitari, G.; Malergue, F.; Martin, F.; Philippe, J. M.; Massucci, M. T.; Chabret, C.; Maras, B.; Dupre, S.; Naquet, P.; Galland, F.: Pantetheinase activity of membrane-bound vanin-1: lack of free cysteamine in tissues of vanin-1 deficient mice. FEBS Lett. 483:149-154, 2000.

Hendrich, B.; Bird, A.: Identification and characterization of a family of mammalian methyl-CpG binding proteins. Molec. Cell. Biol. 18:6538-6547, 1998.

Rasooly, R. S.: Personal Communication. Baltimore, Md. Feb. 23, 1999.

Zhang, Y.; Ng, H.-H.; Erdjument-Bromage, H; Tempst, P.; Bird, A.; Reinberg, D.: Analysis of the NuRD subunits reveals a histone deacetylase core complex and a connection with DNA methylation. Genes Dev. 13:1924-1935, 1999.

Kalitsis, P.; Earle, E.; Fowler, K. J.; Choo, K. H. A.: Bub3 gene disruption in mice reveals essential mitotic spindle checkpoint function during early embryogenesis. Genes Dev. 14:2277-2282, 2000.

Ardley, H. C.; Moynihan, T. P.; Thompson, J.; Leek, J. P.; Markham, A. F.; Robinson, P. A.: Rapid isolation of genomic clones for individual members of human multigene families: identification and localisation of UBE2L4, a novel member of a ubiquitin conjugating enzyme dispersed gene family. Cytogenet. Cell Genet. 79:188-192, 1997.

Moynihan, T. P.; Cole, C. G.; Dunham, I.; O'Neil, L.; Markham, A. F.; Robinson, P. A.: Fine-mapping, genomic organization, and transcript analysis of the human ubiquitin-conjugating enzyme gene UBE2L3. Genomics 51:124-127, 1998.

Hu, M. C.-T.; Qiu, W. R.; Wang, Y.-P.; Hill, D.; Ring, B. D.; Scully, S.; Bolon, B.; DeRose, M.; Luethy, R.; Simonet, W. S.; Arakawa, T.; Danilenko, D. M.: FGF-18, a novel member of the fibroblast growth factor family, stimulates hepatic and intestinal proliferation. Molec. Cell. Biol. 18:6063-6074, 1998.

La Starza, R.; Wlodarska, I.; Aventin, A.; Falzetti, D.; Crescenzi, B.; Martelli, M. F.; Van den Berghe, H.; Mecucci, C.: Molecular delineation of 13q deletion boundaries in 20 patients with myeloid malignancies. Blood 91:231-237, 1998.

Favre, B.; Fontao, L.; Koster, J.; Shafaatian, R.; Jaunin, F.; Saurat, J.-H.; Sonnenberg, A.; Borradori, L.: The hemidesmosomal protein bullous pemphigoid antigen 1 and the integrin beta-4 subunit bind to ERBIN: molecular cloning of multiple alternative splice variants of ERBIN and analysis of their tissue expression. J. Biol. Chem. 276:32427-32436, 2001.

Agnello, V.; Abel, G.; Elfahal, M.; Knight, G. B.; Zhang, Q.-X.: Hepatitis C virus and other flaviviridae viruses enter cells via low density lipoprotein receptor. Proc. Nat. Acad. Sci. 96:12766-12771,1999.

Allen, J. M.; Thompson, G. R.; Myant, N. B.; Steiner, R.; Oakley, C. M.: Cardiovascular complications of homozygous familial hypercholesterolaemia. Brit. Heart J. 44:361-368, 1980.

Benlian, P.; Amselem, S.; Loux, N.; Pastier, D.; Giraud, G.; deGennes, J. L.; Turpin, G.; Monnier, L.; Rieu, D.; Douste-Blazy, P.; Dastugue, B.; Goossens, M.; Junien, C.: A LDL receptor gene homozygous mutation: PCR amplification, direct genomic sequencing, associated haplotype, rapid screening for frequency. Ann. Genet. 33:65-69,1990.

Bertolini, S.; Lelli, N.; Coviello, D. A.; Ghisellini, M.; Masturzo, P.; Tiozzo, R.; Elicio, N.; Gaddi, A.; Calandra, S.: A large deletion in the LDL receptor gene--the cause of familial hypercholesterolemia in three Italian families: a study that dates back to the 17th century (FH-Pavia). Am. J. Hum. Genet. 51:123-134, 1992.

Betard, C.; Kessling, A. M.; Roy, M.; Chamberland, A.; Lussier-Cacan, S.; Davignon, J.: Molecular genetic evidence for a founder effect in familial hypercholesterolemia among French Canadians. Hum. Genet. 88:529-536, 1992.

Boehnke, M.; Arnheim, N.; Li, H.; Collins, F. S.: Fine-structure genetic mapping of human chromosomes using the polymerase chain reaction on single sperm: experimental design considerations. Am. J. Hum. Genet. 45:21-32, 1989.

Brown, M. S.; Goldstein, J. L.: Receptor-mediated endocytosis:insights from the lipoprotein receptor system. Proc. Nat. Acad. Sci. 76:3330-3337, 1979.

Defesche, J. C.; van Diermen, D. E.; Lansberg, P. J.; Lamping, R. J.; Reymer, P. W. A.; Hayden, M. R.; Kastelein, J. J. P.: South African founder mutations in the low-density lipoprotein receptor gene causing familial hypercholesterolemia in the Dutch population. Hum. Genet. 92:567-570, 1993.

Defesche, J. C.; van de Ree, M. A.; Kastelein, J. J. P.; van Diermen, D. E.; Janssens, N. W. E.; van Doormaal, J. J.; Hayden, M. R.: Detection of the pro664-to-leu mutation in the low-density lipoprotein receptor and its relation to lipoprotein (a) levels in patients with familial hypercholesterolemia of Dutch ancestry from The Netherlands and Canada. Clin. Genet. 42:273-280, 1992.

Hoggard, N.; Brintell, B.; Howell, A.; Weissenbach, J.; Varley, J.: Allelic imbalance on chromosome 1 in human breast cancer. II. Microsatellite repeat analysis. Genes Chromosomes Cancer 12:24-31,1995.

White, G. R. M.; Varley, J. M.; Heighway, J.: Isolation and characterization of a human homologue of the latrophilin gene from a region of 1p31.1 implicated in breast cancer. Oncogene 17:3513-3519, 1998.

Tommasi, S.; Dammann, R.; Jin, S.-G.; Zhang, X.; Avruch, J.; Pfeifer, G. P.: RASSF3 and NORE1: identification and cloning of two human homologues of the putative tumor suppressor gene RASSF1. Oncogene 21:2713-2720, 2002.

Yao, R.; Wang, Y.; You, M.: Chromosome mapping and sequence variation of the murine Ras effector gene Nore1. Cytogenet. Cell Genet. 95:126-128, 2001.

Merrill, R. A.; Plum, L. A.; Kaiser, M. E.; Clagett-Dame, M.:A mammalian homolog of unc-53 is regulated by all-trans retinoic acid in neuroblastoma cells and embryos. Proc. Nat. Acad. Sci. 99:3422-3427,2002.

van Hille, B.; Richener, H.; Evans, D. B.; Green, J. R.; Bilbe, G.: Identification of two subunit A isoforms of the vacuolar H(+)-ATPase in human osteoclastoma. J. Biol. Chem. 268:7075-7080, 1993.

van Hille, B.; Richener, H.; Green, J. R.; Bilbe, G.: The ubiquitous VA68 isoform of subunit A of the vacuolar H(+)-ATPase is highly expressed in human osteoclasts. Biochem. Biophys. Res. Commun. 214:1108-1113,1995.

Boyhan, A.; Casimir, C. M.; French, J. K.; Teahan, C. G.; Segal, A. W.: Molecular cloning and characterization of grancalcin, a novel EF-hand calcium-binding protein abundant in neutrophils and monocytes. J. Biol. Chem. 267:2928-2933, 1992.

Teahan, C. G.; Totty, N. F.; Segal, A. W.: Isolation and characterization of grancalcin, a novel 28 kDa EF-hand calcium-binding protein from human neutrophils. Biochem. J. 286:549-554, 1992.

Denning, G.; Jamieson, L.; Maquat, L. E.; Thompson, E. A.; Fields, A. P.: Cloning of a novel phosphatidyl inositol kinase-related kinase:characterization of the human SMG-1 RNA surveillance protein. J. Biol. Chem. 276:22709-22714, 2001.

Diaz-Meco, M. T.; Municio, M. M.; Sanchez, P.; Lozano, J.; Moscat, J.: Lambda-interacting protein, a novel protein that specifically interacts with the zinc finger domain of the atypical protein kinase C isotype lambda/iota and stimulates its kinase activity in vitro and in vivo. Molec. Cell. Biol. 16:105-114 , 1996.

Kondo, M.; Ji, L.; Kamibayashi, C.; Tomizawa, Y.; Randle, D.; Sekido, Y.; Yokota, J.; Kashuba, V.; Zabarovsky, E.; Kuzmin, I.; Lerman, M.; Roth, J.; Minna, J. D.: Overexpression of candidate tumor suppressor gene FUS1 isolated from the 3p21.3 homozygous deletion region leads to G1 arrest and growth inhibition of lung cancer cells. Oncogene 20:6258-6262, 2001.

Deshpande, K. L.; Seubert, P. H.; Tillman, D. M.; Farkas, W. R.; Katze, J. R.: Cloning and characterization of cDNA encoding the rabbitt RNA-guanine transglycosylase 60-kilodalton subunit. Arch. Biochem. Biophys. 326:1-7, 1996.

Wilson, S. M.; Bhattacharyya, B.; Rachel, R. A.; Coppola, V.; Tessarollo, L.; Householder, D. B.; Fletcher, C. F.; Miller, R. J.; Copeland, N. G.; Jenkins, N. A.: Synaptic defects in ataxia mice result from a mutation in Usp14, encoding a ubiquitin-specific protease. Nature Genet. 7 Oct. 2002. Note: Advance Electronic Publication.

Liang, T. W.; Chiu, H. H.; Gurney, A.; Sidle, A.; Tumas, D. B.; Schow, P.; Foster, J.; Klassen, T.; Dennis, K.; DeMarco, R. A.; Pham, T.; Frantz, G.; Fong, S.: Vascular endothelial-junctional adhesion molecule (VE-JAM)/JAM 2 interacts with T, NK, and dendritic cells through JAM 3. J. Immun. 168:1618-1626, 2002.

Arrate, M. P.; Rodriguez, J. M.; Tran, T. T.; Brock, T. A.; Cunningham, S. A.: Cloning of human junctional adhesion molecule 3 (JAM3) and its identification as the JAM2 counter-receptor. J. Biol. Chem. 276:45826-45832, 2001.

Garrett, R. M.; Bellissimo, D. B.; Rajagopalan, K. V.: molecular cloning of human liver sulfite oxidase. Biochim. Biophys. Acta 1262:147-149, 1995.

Johnson, J. L.; Coyne, K. E.; Garrett, R. M.; Zabot, M.-T.; Dorche, C.; Kisker, C.; Rajagopalan, K. V.: Isolated sulfite oxidase deficiency:identification of 12 novel SUOX mutations in 10 patients. (Abstract) Hum. Mutat. 20:74 only, 2002.

Chen, Y. Q.; Rafi, M. A.; de Gala, G.; Wenger, D. A.: Cloning and expression of cDNA encoding human galactocerebrosidase, the enzyme deficient in globoid cell leukodystrophy. Hum. Molec. Genet. 2:1841-1845, 1993.

Chen, Y. Q.; Wenger, D. A.: Galactocerebrosidase from human urine:purification and partial characterization. Biochim. Biophys. Acta 1170:53-61, 1993.

Fiumara, A.; Pavone, L.; Siciliano, L.; Tine, A.; Parano, E.; Innico, G.: Late-onset globoid cell leukodystrophy: report on 7 new patients. Child's Nerv. Syst. 6:194-197, 1990.

Furuya, H.; Kukita, Y.; Nagano, S.; Sakai, Y.; Yamashita, Y.; Fukuyama, H.; Inatomi, Y.; Saito, Y.; Koike, R.; Tsuji, S.; Fukumaki, Y.; Hayashi, K.; Kobayashi, T.: Adult onset globoid cell leukodystrophy (Krabbedisease): analysis of galactosylceramidase cDNA from four Japanese patients. Hum. Genet. 100:450-456, 1997.

Kodama, S.; Igisu, H.; Siegel, D. A.; Suzuki, K.: Glycosylceramide synthesis in the developing spinal cord and kidney of the twitcher mouse, an enzymatically authentic model of human krabbe disease. J. Neurochem. 39:1314-1318, 1982.

Luzi, P.; Rafi, M. A.; Victoria, T.; Baskin, G. B.; Wenger, D. A.: Characterization of the rhesus monkey galactocerebrosidase (GALC) cDNA and gene and identification of the mutation causing globoid cell leukodystrophy (Krabbe disease) in this primate. Genomics 42:319-324,1997.

Luzi, P.; Rafi, M. A.; Wenger, D. A.: Structure and organization of the human galactocerebrosidase (GALC) gene. Genomics 26:407-409,1995.

Freeman, B. C.; Yamamoto, K. R.: Disassembly of transcriptional regulatory complexes by molecular chaperones. Science 296:2232-2235,2002.

Johnson, J. L.; Beito, T. G.; Krco, C. J.; Toft, D. O.: characterization of a novel 23-kilodalton protein of unactive progesterone receptor complexes. Molec. Cell. Biol. 14:1956-1963, 1994.

Smith, D. F.; Faber, L. E.; Toft, D. O.: Purification of unactivated progesterone receptor and identification of novel receptor-associated proteins. J. Biol. Chem. 265:3996-4003, 1990.

Cai, H.; Wang, Y.; McCarthy, D.; Wen, H.; Borchelt, D. R.; Price, D. L.; Wong, P. C.: BACE1 is the major beta-secretase for generation of A-beta peptides by neurons. Nature Neurosci. 4:233-234, 2001.

Meyaard, L.; Adema, G. J.; Chang, C.; Woollatt, E.; Sutherland, G. R.; Lanier, L. L.; Phillips, J. H.: LAIR-1, a novel inhibitory receptor expressed on human mononuclear leukocytes. Immunity 7:283-290, 1997.

Sathish, J. G.; Johnson, K. G.; Fuller, K. J.; LeRoy, F. G.; Meyaard, L.; Sims, M. J.; Matthews, R. J.: Constitutive association of SHP-1 with leukocyte-associated Ig-like receptor-1 in human T cells. J. Immun. 166:1763-1770, 2001.

Xu, M.; Zhao, R.; Zhao, Z. J.: Identification and characterization of leukocyte-associated Ig-like receptor-1 as a major anchor protein of tyrosine phosphatase SHP-1 in hematopoietic cells. J. Biol. Chem. 275:17440-17446, 2000.

Hofmann, R. M.; Pickart, C. M.: Noncanonical MMS2-encoded ubiquitin-conjugating enzyme functions in assembly of novel polyubiquitin chains for DNA repair. Cell 96:645-653, 1999.

Rothofsky, M. L.; Lin, S. L.: CROC-1 encodes a protein which mediates transcriptional activation of the human FOS promoter. Gene 195:141-149, 1997.

Sancho, E.; Vila, M. R.; Sanchez-Pulido, L.; Lozano, J. J.; Paciucci, R.; Nadal, M.; Fox, M.; Harvey, C.; Bercovich, B.; Loukili, N.; Ciechanover, A.; Lin, S. L.; Sanz, F.; Estivill, X.; Valencia, A.; Thomson, T. M.: Role of UEV-1, an inactive variant of the E2 ubiquitin-conjugating enzymes, in in vitro differentiation and cell cycle behavior of HT-29-M6 intestinal mucosecretory cells. Molec. Cell. Biol. 18:576-589,1998.

Charles, C. H.; Yoon, J. K.; Simske, J. S.; Lau, L. F.: Genomic structure, cDNA sequence, and expression of gly96, a growth factor-inducible immediate-early gene encoding a short-lived glycosylated protein. Oncogene 8:797-801, 1993.

Kondratyev, A. D.; Chung, K.-N.; Jung, M. O.: Identification and characterization of a radiation-inducible glycosylated human early-response gene. Cancer Res. 56:1498-1502, 1996.

Pietzsch, A.; Buchler, C.; Aslanidis, C.; Schmitz, G.: Identification and characterization of a novel monocyte/macrophage differentiation-dependent gene that is responsive to lipo polysaccharide, ceramide, and lysophosphatidyl choline. Biochem. Biophys. Res. Commun. 235:4-9, 1997.

Pietzsch, A.; Buchler, C.; Schmitz, G.: Genomic organization, promoter cloning, and chromosomal localization of the Dif-2 gene. Biochem. Biophys. Res. Commun. 245:651-657, 1998.

Schafer, H.; Trauzold, A.; Siegel, E. G.; Folsch, U. R.; Schmidt, W. E.: PRG1: a novel early-response gene transcriptionally induced by pituitary adenylate cyclase activating polypeptide in a pancreatic carcinoma cell line. Cancer Res. 56:2641, 1996.

Wu, M. X.; Ao, Z.; Prasad, K. V. S.; Wu, R.; Schlossman, S. F.: IEX-1L, an apoptosis inhibitor involved in NF-kappa-B-mediated cell survival. Science 281:998-1001, 1998.

De Strooper, B.; Konig, G.: A firm base for drug development. Nature 402:471-472, 1999.

Fan, W.; Bennett, B. D.; Babu-Khan, S.; Luo, Y.; Louis, J.-C.; McCaleb, M.; Citron, M.; Vassar, R.; Richards, W. G.: Response to Saunders et al. (1999). Science 286:1255a, 1999. Note: Electronic Publication.

Haniu, M.; Denis, P.; Young, Y.; Mendiaz, E. A.; Fuller, J.; Hui, J. O.; Bennett, B. D.; Kahn, S.; Ross, S.; Burgess, T.; Katta, V.; Rogers, G.; Vassar, R.; Citron, M.: Characterization of Alzheimer's beta-secretase protein BACE: a pepsin family member with unusual properties. J. Biol. Chem. 275:21099-21106, 2000.

Hong, L.; Koelsch, G.; Lin, X.; Wu, S.; Terzyan, S.; Ghosh, A. K.; Zhang, X. C.; Tang, J.: Structure of the protease domain of memapsin 2 (beta-secretase) complexed with inhibitor. Science 290:150-153,2000.

Hussain, I.; Powell, D.; Howlett, D. R.; Tew, D. G.; Meek, T. D.; Chapman, C.; Gloger, I. S.; Murphy, K. E.; Southan, C. D.; Ryan, D. M.; Smith, T. S.; Simmons, D. L.; Walsh, F. S.; Dingwall, C.; Christie, G.: Identification of a novel aspartic protease (asp2) as beta-secretase Molec. Cell Neurosci. 14:419-427, 1999.

Parker, A. E.; Van de Weyer, I.; Laus, M. C.; Verhasselt, P.; Luyten, W. H. M. L.: Identification of a human homologue of the Schizosaccharomyces pombe rad17+ checkpoint gene. J. Biol. Chem. 273:18340-18346, 1998. Note: Erratum: J. Biol. Chem. 274:24438-24439, 1999.

von Deimling, F.; Scharf, J. M.; Liehr, T.; Rothe, M.; Kelter, A.-R.; Albers, P.; Dietrich, W. F.; Kunkel, L. M.; Wernert, N.; Wirth, B.: Human and mouse RAD17 genes: identification, localization, genomic structure and histological expression pattern in normal testis and seminoma. Hum. Genet. 105:17-27, 1999.

Serra-Pages, C.; Medley, Q. G.; Tang, M.; Hart, A.; Streuli, M.: Liprins, a family of LAR transmembrane protein-tyrosine phosphatase-interacting proteins. J. Biol. Chem. 273: 15611-15620, 1998.

Thomas, M. K.; Yao, K.-M.; Tenser, M. S.; Wong, G. G.; Habener, J. F.: Bridge-1, a novel PDZ-domain coactivator of E2A-mediated regulation of insulin gene transcription. Molec. Cell. Biol. 19:8492-8504,1999.

Watanabe, T. K.; Saito, A.; Suzuki, M.; Fujiwara, T.; Takahashi, E.; Slaughter, C. A.; DeMartino, G. N.; Hendil, K. B.; Chung, C. H.; Tanahashi, N.; Tanaka, K.: cDNA cloning and characterization of a human proteasomal modulator subunit, p27 (PSMD9). Genomics 50:241-250,1998.

Kennedy, J.; Rossi, D. L.; Zurawski, S. M.; Vega, F., Jr.: Kastelein, R. A.; Wagner, J. L.; Hannum, C. H.; Zlotnick, A.: Mouse IL-17: acytokine preferentially expressed by alpha beta TCR + CD4-CD8-T cells. J. Interferon Cytokine Res. 16:611-617, 1996.

Kotake, S.; Udagawa, N.; Takahashi, N.; Matsuzaki, K.; Itoh, K.; Ishiyama, S.; Saito, S.; Inoue, K.; Kamatani, N.; Gillespie, M. T.; Martin, T. J.; Suda, T.: IL-17 in synovial fluids from patients with rheumatoid arthritis is a potent stimulator of osteoclastogenesis. J. Clin. Invest. 103:1345-1352, 1999.

Rouvier, E.; Luciani, M.-F.; Mattei, M.-G.; Denizot, F.; Golstein, P.: CTLA-8, cloned from an activated T cell, bearing AU-rich messenger RNA instability sequences, and homologous to a Herpes virus saimiri gene. J. Immun. 150: 5445-5456, 1993.

Yao, Z.; Painter, S. L.; Fanslow, W. C.; Ulrich, D.; Macduff, B. M.; Spriggs, M. K.; Armitage, R. J.: Human IL-17: a novel cytokine derived from T cells. J. Immun. 155:5483-5486, 1995.

Higuti, T.; Tsurumi, C.; Kawamura, Y.; Tsujita, H.; Osaka, F.; Yoshihara, Y.; Tani, I.; Tanaka, K.; Ichihara, A.: Molecular cloning of cDNA for the import precursor of human coupling factor 6 of H(+)-ATP synthase in mitochondria. Biochem. Biophys. Res. Commun. 178:793-799,1991.

Javed, A. A.; Ogata, K.; Sanadi, D. R.: Human mitochondrial ATP synthase: cloning cDNA for the nuclear-encoded precursor of coupling factor 6. Gene 97:307-310, 1991.

Webster, K. A.; Oliver, N. A.; Wallace, D. C.: Assignment of an oligomycin-resistance locus to human chromosome 10. Somat. Cell Genet. 8:223-244, 1982.

Parker, A. E.; Van de Weyer, I.; Laus, M. C.; Oostveen, I.; Yon, J.; Verhasselt, P.; Luyten, W. H. M. L.: A human homologue of Schizosaccharomyces pombe rad1+ checkpoint gene encodes an exonuclease. J. Biol. Chem. 273:18332-18339, 1998.

Barbon, A.; Ferraboli, S.; Barlati, S.: Assignment of the human metabotropic glutamate receptor gene GRM4 to chromosome 6 band p21.3 by radiation hybrid mapping. Cytogenet. Cell Genet. 88:210 only,2000.

Morita, R.; Miyazaki, E.; Fong, C. G.; Chen, X.-N.; Korenberg, J. R.; Delgado-Escueta, A. V.; Yamakawa, K.: JH8, a gene highly homologous to the mouse jerky gene, maps to the region for childhood absence epilepsy on 8q24. Biochem. Biophys. Res. Commun. 248:307-314, 1998.

Toth, M.; Grimsby, J.; Buzsaki, G.; Donovan, G. P.: Epileptic seizures caused by inactivation of a novel gene, jerky, related to centromere binding protein-B in transgenic mice. Nature Genet. 11:71-75, 1995. Note: Erratum: Nature Genet. 12:110 only, 1996.

Zeng, Z.; Kyaw, H.; Gakenheimer, K. R.; Augustus, M.; Fan, P.; Zhang, X.; Su, K.; Carter, K. C.; Li, Y.: Cloning, mapping, and tissue distribution of a human homologue of the mouse jerky gene product. Biochem. Biophys. Res. Commun. 236:389-395, 1997.

Kimura, M.; Matsuda, Y.; Eki, T.; Yoshioka, T.; Okumura, K.; Hanaoka, F.; Okano, Y.: Assignment of STK6 to human chromosome 20q13.2-q13.3 and a pseudogene STK6P to 1q41-q42. Cytogenet. Cell Genet. 79:201-203,1997.

Bryan, J.; Edwards, R.; Matsudaira, P.; Otto, J.; Wulfkuhle, J.: Fascin, an echinoid actin-bundling protein, is a homolog of the Drosophila singed gene product. Proc. Nat. Acad. Sci. 90:9115-9119,1993.

Dressel, U.; Thormeyer, D.; Altincicek, B.; Paululat, A.; Eggert, M.; Schneider, S.; Tenbaum, S. P.; Renkawitz, R.; Baniahmad, A.:Alien, a highly conserved protein with characteristics of a corepressor for members of the nuclear hormone receptor superfamily. Molec. Cell. Biol. 19:3383-3394, 1999.

Schaefer, L.; Beermann, M. L.; Miller, J. B.: Coding sequence, genomic organization, chromosomal localization, and expression pattern of the signalosome component Cops2: the mouse homologue of Drosophila alien. Genomics 56:310-316, 1999.

Scott, A. F.: Personal Communication. Baltimore, Md. Nov. 8, 2000.

Seeger, M.; Kraft, R.; Ferrell, K.; Dawadschargal, B.-O.; Dumdey, R.; Schade, R.; Gordon, C.; Naumann, M.; Dubiel, W.: A novel protein complex involved in signal transduction possessing similarities to 26S proteasome subunits. FASEB J. 12:469-478, 1998.

Fu, C.; Turck, C. W.; Kurosaki, T.; Chan, A. C.: BLNK: a central linker protein in B cell activation. Immunity 9:93-103, 1998.

Ishiai, M.; Kurosaki, M.; Pappu, R.; Okawa, K.; Ronko, I.; Fu, C.; Shibata, M.; Iwamatsu, A.; Chan, A. C.; Kurosaki, T.: BLNK required for cloning Syk to PLC-gamma-2 and Rac1-JNK in B cells. Immunity 10:117-125, 1999.

Minegishi, Y.; Rohrer, J.; Coustan-Smith, E.; Lederman, H. M.; Pappu, R.; Campana, D.; Chan, A. C.; Conley, M. E.: An essential role for BLNK in human B cell development. Science 286:1954-1957,1999.

Barbosa, M. D.; Johnson, S. A.; Achey, K.; Gutierrez, M. J.; Wakeland, E. K.; Zerial, M.; Kingsmore, S. F.: The Rab protein family: genetic mapping of six Rab genes in the mouse. Genomics 30:439-444, 1995.

Vitelli, R.; Chiariello, M.; Lattero, D.; Bruni, C. B.; Bucci, C.: Molecular cloning and expression analysis of the human Rab7 GTP-ase complementary deoxyribonucleic acid. Biochem. Biophys. Res. Commun. 229:887-890, 1996.

Miao, D.; He, B.; Karaplis, A. C.; Goltzman, D.: Parathyroid hormone is essential for normal fetal bone formation. J. Clin. Invest. 109:1173-1182, 2002.

Betticher, D. C.; Thatcher, N.; Altermatt, H. J.; Hoban, P.; Ryder, W. D. J.; Heighway, J.: Alternate splicing produces a novel cyclinD1 transcript. Oncogene 11:1005-1011, 1995.

Chesi, M.; Bergsagel, P. L.; Brents, L. A.; Smith, C. M.; Gerhard, D. S.; Kuehl, W. M.: Dysregulation of cyclin D1 by translocation into an IgH gamma switch region in two multiple myeloma cell lines. Blood 88:674-681, 1996.

Gailani, M. R.; Petty, E. M.; Horsthemke, B.; Arnold, A.; Marx, S. J.; Bale, A. E.: Physical mapping of chromosome 11q12-13 by pulsed field gel electrophoresis (PFGE). (Abstract) Cytogenet. Cell Genet. 58:1959, 1991.

Geng, Y.; Yu, Q.; Sicinska, E.; Das, M.; Bronson, R. T.; Sicinski, P.: Deletion of the p27(Kip1) gene restores normal development in cyclin D1-deficient mice. Proc. Nat. Acad. Sci. 98:194-199, 2001.

Hayette, S.; Gadoux, M.; Martel, S.; Bertrand, S.; Tigaud, I.; Magaud, J.-P.; Rimokh, R.: FLRG (follistatin-related gene), a new target of chromosomal rearrangement in malignant blood disorders. Oncogene 16:2949-2954, 1998.

Tajima, T.; Kitagawa, H.; Yokoya, S.; Tachibana, K.; Adachi, M.; Nakae, J.; Suwa, S; Katoh, S.; Fujieda, K.: A novel missense mutation of mineralocorticoid receptor gene in one Japanese family with a renal form of pseudohypoaldosteronism type 1. J. Clin. Endocr. Metab. 85:4690-4694, 2000.

Viemann, M.; Peter, M.; Lopez-Siguero, J. P.; Simic-Schleicher, G.; Sippell, W. G.: Evidence for genetic heterogeneity of pseudohypoaldosteronism type 1: identification of a novel mutation in the human mineralocorticoid receptor in one sporadic case and no mutations in two autosomal dominant kindreds. J. Clin. Endocr. Metab. 86:2056-2059, 2001.

Lee, Y. L.; Helman, L.; Hoffman, T.; Laborda, J.: dlk, pG2 andPref-1 mRNAs encode similar proteins belonging to the EGF-like superfamily. Identification of polymorphic variants of this RNA. Biochim. Biophys. Acta 1261:223-232, 1995.

Smas, C. M.; Sul, H. S.: Pref-1, a protein containing EGF-like repeats, inhibits adipocyte differentiation. Cell 73:725-734, 1993.

Takada, S.; Paulsen, M.; Tevendale, M.; Tsai, C.-E.; Kelsey, G.; Cattanach, B. M.; Ferguson-Smith, A. C.: Epigenetic analysis of the Dlk1-Gtl2 imprinted domain on mouse chromosome 12: implications for imprinting control from comparison with Igf2-H19. Hum. Molec. Genet. 11:77-86, 2002.

Wylie, A. A.; Murphy, S. K.; Orton, T. C.; Jirtle, R. L.: Novel imprinted DLK1/GTL2 domain on human chromosome 14 contains motifs that mimic those implicated in IGF2/H19 regulation. Genome Res. 10:1711-1718, 2000.

Astrom, A.-K.; Voz, M. L.; Kas, K.; Roijer, E.; Wedell, B.; Mandahl, N.; Van de Ven, W.; Mark, J.; Stenman, G.: Conserved mechanism of PLAG1 activation in salivary gland tumors with and without chromosome 8q12 abnormalities: identification of SII as a new fusion partner gene. Cancer Res. 59:918-923, 1999.

Bullerdiek, J.; Bartnitzke, S.; Weinberg, M.; Chilla, R.; Haubrich, J.; Schloot, W.: Rearrangements of chromosome region 12q13-q15 in pleomorphic adenomas of the human salivary gland (PSA). Cytogenet. Cell Genet. 45:187-190, 1987.

Bullerdiek, J.; Raabe, G.; Bartnitzke, S.; Boschen, C.; Schloot, W.: Structural rearrangements of chromosome #8 involving 8q12--a primary event in pleomorphic adenomas of the parotid gland. Genetica 72:85-92, 1987.

Mark, J.; Dahlenfors, R.: Cytogenetical observations in 100 human benign pleomorphic adenomas: specificity of the chromosomal aberrations and their relationship to sites of localized oncogenes. Anticancer Res. 6:299-308, 1986.

Stenman, G.; Sandros, J.; Mark, J.; Nordkvist, A.: High p21(RAS) expression levels correlate with chromosome 8 rearrangements in benign human mixed salivary gland tumors. Genes Chromosomes Cancer 1:59-66,1989.

Hinds, P. W.; Dowdy, S. F.; Eaton, E. N.; Arnold, A.; Weinberg, R. A.: Function of a human cyclin gene as an oncogene. Proc. Nat. Acad. Sci. 91:709-713, 1994.

Goldfarb, L. G.; Petersen, R. B.; Tabaton, M.; Brown, P.; LeBlanc, A. C.; Montagna, P.; Cortelli, P.; Julien, J.; Vital, C.; Pendelbury, W. W.; Haltia, M.; Wills, P. R.; Hauw, J. J.;

McKeever, P. E.; Monari, L.; Schrank, B.; Swergold, G. D.; Autilio-Gambetti, L.; Gajdusek, D. C.; Lugaresi, E.; Gambetti, P.: Fatal familial insomnia and familial Creutzfeldt-Jakob disease: disease phenotype determined by a DNA polymorphism. Science 258:806-808, 1992.

Komatsu, H.; Iida, S.; Yamamoto, K.; Mikuni, C.; Nitta, M.; Takahashi, T.; Ueda, R.; Seto, M.: A variant chromosome translocation at 11q13 identifying PRAD1/cyclin D1 as the BCL-1 gene. Blood 84:1226-1231, 1994.

Kong, S.; Amos, C. I.; Luthra, R.; Lynch, P. M.; Levin, B.; Frazier, M. L.: Effects of cyclin D1 polymorphism on age of onset of hereditary nonpolyposis colorectal cancer. Cancer Res. 60:249-252, 2000.

Kong, S.; Wei, Q.; Amos, C. I.; Lynch, P. M.; Zong, J.; Frazier, M. L.: Cyclin D1 polymorphism and increased risk of colorectal cancer at young age. J. Nat. Cancer Inst. 93:1106-1108, 2001.

Ma, C.; Papermaster, D.; Cepko, C. L.: A unique pattern of photoreceptor degeneration in cyclin D1 mutant mice. Proc. Nat. Acad. Sci. 95:9938-9943, 1998.

Motokura, T.; Bloom, T.; Kim, H. G.; Juppner, H.; Ruderman, J. V.; Kronenberg, H. M.; Arnold, A.: A novel cyclin encoded by a bcl1-linked candidate oncogene. Nature 350:512-515, 1991.

Muller, H.; Lukas, J.; Schneider, A.; Warthoe, P.; Bartek, J.; Eilers, M.; Strauss, M.: Cyclin D1 expression is regulated by the retinoblastoma protein. Proc. Nat. Acad. Sci. 91:2945-2949, 1994.

Richard, C. W., III; Withers, D. A.; Meeker, T. C.; Maurer, S.; Evans, G. A.; Myers, R. M.; Cox, D. R.: A radiation hybrid map of the proximal long arm of human chromosome 11 containing the multiple endocrine neoplasia type I (MEN-1) and bcl-1 disease loci. Am. J. Hum. Genet. 49:1189-1196, 1991.

Rimokh, R.; Berger, F.; Bastard, C.; Klein, B.; French, M.; Archimbaud, E.; Rouault, J. P.; Santa Lucia, B.; Duret, L.; Vuillaume, M.; etal.: Rearrangement of CCND1 (BCL1/PRAD1) 3-prime untranslated region in mantle-cell lymphomas and t (11q13)-associated leukemias. Blood 83:3689-3696, 1994.

Rimokh, R.; Berger, F.; Delsol, G.; Charrin, C.; Bertheas, M. F.; Ffrench, M.; Garoscio, M.; Felman, P.; Coiffier, C.; Bryon, P. A.: Rearrangement and overexpression of the BCL-1/PRAD-1 gene in intermediate lymphocytic lymphomas and in t (11q13)-bearing leukemias. Blood 81:3063-3067, 1993.

Rosenberg, C. L.; Kim, H. G.; Shows, T. B.; Kronenberg, H. M.; Arnold, A.: Rearrangement and overexpression of D11S287E, a candidate oncogene on chromosome 11q13 in benign parathyroid tumors. Oncogene 6:449-453, 1991.

Sicinski, P.; Donaher, J. L.; Parker, S. B.; Li, T.; Fazeli, A.; Gardner, H.; Haslam, S. Z.; Bronson, R. T.; Elledge, S. J.; Weinberg, R. A.: Cyclin D1 provides a link between development and oncogenesis in the retina and breast. Cell 82:621-630, 1995.

Szepetowski, P.; Perucca-Lostanlen, D.; Gaudray, P.: Mapping genes according to their amplification status in tumor cells: contribution to the map of 11q13. Genomics 16:745-750, 1993.

Clark, T. G.; Conway, S. J.; Scott, I. C.; Labosky, P. A.; Winnier, G.; Bundy, J.; Hogan, B. L. M.; Greenspan, D. S.: The mammalian Tolloid-like 1 gene, Tll1, is necessary for normal septation and positioning of the heart. Development 126:126:-2631-2642, 1999.

Scott, I. C.; Clark, T. G.; Takahara, K.; Hoffman, G. G.; Eddy, R. L.; Haley, L. L.; Shows, T. B.; Greenspan, D. S.: Assignment of TLL1 and TLL2, which encode human BMP-1/tolloid-related metalloproteases, to chromosomes 4q32-q33 and 10q23-q24 and assignment of murine Tll2 to chromosome 19. Cytogenet. Cell Genet. 86:64-65, 1999.

Takahara, K.; Brevard, R.; Hoffman, G. G.; Suzuki, N.; Greenspan, D. S.: Characterization of a novel gene product (mammalian tolloid-like) with high sequence similarity to mammalian tolloid/bone morphogenetic protein-1. Genomics 34:157-165, 1996.

Bauer, W. O.; Nanda, I.; Beck, G.; Schmid, M.; Jakob, F.: human puromycin-sensitive amino peptidase: cloning of 3-prime UTR, evidence for a polymorphism at aa 140 and refined chromosomal localization to 17q21. Cytogenet. Cell Genet. 92:221-224, 2001.

Huber, G.; Thompson, A.; Gruninger, F.; Mechler, H.; Hochstrasser, R.; Hauri, H.-P.; Malherbe, P.: cDNA cloning and molecular characterization of human brain metalloprotease MP100: a beta-secretase candidate? J. Neurochem. 72:1215-1223, 1999.

Osada, T.; Sakaki, Y.; Takeuchi, T.: Puromycin-sensitive amino peptidase gene (Psa) maps to mouse chromosome 11. Genomics 56:361-362, 1999.

Schonlein, C.; Loffler, J.; Huber, G.: Purification and characterization of a novel metalloprotease from human brain with the ability to cleave substrates derived from the N-terminus of beta-amyloid protein. Biochem. Biophys. Res. Commun. 201:45-53, 1994.

Thompson, M. W.; Tobler, A.; Fontana, A.; Hersh, L. B.: Cloning and analysis of the gene for the human puromycin-sensitive amino peptidase. Biochem. Biophys. Res. Commun. 258:234-240, 1999.

Tobler, A. R.; Constam, D. B.; Schmitt-Graff, A.; Malipiero, U.; Schlapbach, R.; Fontana, A.: Cloning of the human puromycin-sensitive amino peptidase and evidence for expression in neurons. J. Neurochem. 68:889-897, 1997.

Brodbeck, J.; Davies, A.; Courtney, J.-M.; Meir, A.; Balaguero, N.; Canti, C.; Moss, F. J.; Page, K. M.; Pratt, W. S.; Hunt, S. P.; Barclay, J.; Rees, M.; Dolphin, A. C.: The ducky mutation in Cacna2d2 results in altered Purkinje cell morphology and is associated with the expression of a truncated alpha-2/delta-2 protein with abnormal function. J. Biol. Chem. 277:7684-7693, 2002.

Gao, B.; Sekido, Y.; Maximov, A.; Saad, M.; Forgacs, E.; Latif, F.; Wei, M. H.; Lerman, M.; Lee, J.-H.; Perez-Reyes, E.; Bezprozvanny, I.; Minna, J. D.: Functional properties of a new voltage-dependent calcium channel alpha-2/delta auxiliary subunit gene (CACNA2D2). J. Biol. Chem. 275:12237-12242, 2000.

Angrand, P.-O.; Apiou, F.; Stewart, A. F.; Dutrillaux, B.; Losson, R.; Chambon, P.: NSD3, a new SET domain-containing gene, maps to 8p12 and is amplified in human breast cancer cell lines. Genomics 74:79-88, 2001.

Stec, I.; van Ommen, G.-J. B.; den Dunnen, J. T.: WHSC1L1, on human chromosome 8p11.2, closely resembles WHSC1 and maps to a duplicated region shared with 4p16.3. Genomics 76:5-8, 2001.

Singh, S.; Chao, L. Y.; Mishra, R.; Davies, J.; Saunders, G. F.: Missense mutation at the C-terminus of PAX6 negatively modulates homeodomain function. Hum. Molec. Genet. 10:911-918, 2001.

Singh, S.; Mishra, R.; Arango, N. A.; Deng, J. M.; Behringer, R. R.; Saunders, G. F.: Iris hypoplasia in mice that lack the alternatively spliced Pax6 (5a) isoform. Proc. Nat. Acad. Sci. 99:6812-6815, 2002.

Singh, S.; Tang, H. K.; Lee, J.-Y.; Saunders, G. F.: Truncation mutations in the transactivation region of PAX6 result in dominant-negative mutants. J. Biol. Chem. 273:21531-21541, 1998.

Ton, C. C. T.; Miwa, H.; Saunders, G. F.: Small eye (Sey): cloning and characterization of the murine homolog of the human aniridia gene. Genomics 13:251-256, 1992.

Walther, C.; Gruss, P.: Pax-6, a murine paired box gene, is expressed in the developing CNS. Development 113:1435-1449, 1991.

Wawersik, S.; Maas, R. L.: Vertebrate eye development as modeled in Drosophila. Hum. Molec. Genet. 9:917-925, 2000.

Kawasawa, Y.; Kume, K.; Izumi, T.; Shimizu, T.: Mammalian PSP24s (alpha and beta isoforms) are not responsive to lysophosphatidic acid in mammalian expression systems. Biochem. Biophys. Res. Commun. 276:957-964, 2000.

Kawasawa, Y.; Kume, K.; Nakade, S.; Haga, H.; Izumi, T.; Shimizu, T.: Brain-specific expression of novel G-protein-coupled receptors, with homologies to Xenopus PSP24 and human GPR45. Biochem. Biophys. Res. Commun. 276:952-956, 2000.

Lee, D. K.; George, S. R.; Cheng, R.; Nguyen, T.; Liu, Y.; Brown, M.; Lynch, K. R.; O'Dowd, B. F.: Identification of four novel human G protein-coupled receptors expressed in the brain. Molec. BrainRes. 86:13-22, 2001.

Cikos, S.; Gregor, P.; Koppel, J.: Cloning of a novel biogenic amine receptor-like G protein-coupled receptor expressed in human brain. Biochim. Biophys. Acta 1521:66-72, 2001.

Koivisto, U.-M.; Hubbard, A. L.; Mellman, I.: A novel cellular phenotype for familial hypercholesterolemia due to a defect in polarized targeting of LDL receptor. Cell 105:575-585, 2001.

Koivisto, U.-M.; Turtola, H.; Aalto-Setala, K.; Top, B.; Frants, R. R.; Kovanen, P. T.; Syvanen, A.-C.; Kontula, K.: The familial hypercholesterolemia (FH)-North Karelia mutation of the low density lipoprotein receptor gene deletes seven nucleotides of exon 6 and is a common cause of FH in Finland. J. Clin. Invest. 90:219-228,1992.

Koivisto, U.-M.; Viikari, J. S.; Kontula, K.: Molecular characterization of minor gene rearrangements in Finnish patients with heterozygous familial hypercholesterolemia: identification of two common missense mutations (Gly823-to-Asp and Leu380-to-His) and eight rare mutations of the LDL receptor gene. Am. J. Hum. Genet. 57:789-797, 1995.

Kotze, M. J.; Langenhoven, E.; Warnich, L.; du Plessis, L.; Retief, A. E.: The molecular basis and diagnosis of familial hypercholesterolaemia in South African Afrikaners. Ann. Hum. Genet. 55:115-121, 1991.

Kotze, M. J.; Theart, L.; Peeters, A.; Langenhoven, E.: A de novo duplication in the low density lipoprotein receptor gene. Hum. Mutat. 6:181-183, 1995.

Kotze, M. J.; Warnich, L.; Langenhoven, E.; du Plessis, L.; Retief, A. E.: An exon 4 mutation identified in the majority of South African familial hypercholesterolaemics. J. Med. Genet. 27:298-302, 1990.

Landsberger, D.; Meiner, V.; Reshef, A.; Levy, Y.; van der Westhuyzen, D. R.; Coetzee, G. A.; Leitersdorf, E.: A nonsense mutation in the LDL receptor gene leads to familial hypercholesterolemia in the Druze sect. Am. J. Hum. Genet. 50:427-433, 1992.

Langlois, S.: Personal Communication. Vancouver, British Columbia, Canada 1989.

Langlois, S.; Kastelein, J. J. P.; Hayden, M. R.: characterization of six partial deletions in the low-density-lipoprotein (LDL) receptor gene causing familial hypercholesterolemia (FH). Am. J. Hum. Genet. 43:60-68, 1988.

Lee, W. K.; Haddad, L.; Macleod, M. J.; Dorrance, A. M.; Wilson, D. J.; Gaffney, D.; Dominiczak, M. H.; Packard, C. J.; Day, I. N.; Humphries, S. E.; Dominiczak, A. F.: Identification of a common low density lipoprotein receptor mutation (C163Y) in the West of Scotland. J. Med. Genet. 35:573-578, 1998.

Lehrman, M. A.; Goldstein, J. L.; Russell, D. W.; Brown, M. S.: Duplication of seven exons in LDL receptor gene caused by Alu-Alure combination in a subject with familial hypercholesterolemia. Cell 48:827-835, 1987.

Lehrman, M. A.; Russell, D. W.; Goldstein, J. L.; Brown, M. S.: Alu-Alu recombination deletes splice acceptor sites and produces secreted low density lipoprotein receptor in a subject with familial hypercholesterolemia. J. Biol. Chem. 262:3354-3361, 1987.

Lehrman, M. A.; Russell, D. W.; Goldstein, J. L.; Brown, M. S.: Exon-Alu recombination deletes 5 kilobases from the low density lipoprotein receptor gene, producing a null phenotype in familial hypercholesterolemia. Proc. Nat. Acad. Sci. 83:3679-3683, 1986.

Lehrman, M. A.; Schneider, W. J.; Sudhof, T. C.; Brown, M. S.; Goldstein, J. L.; Russell, D. W.: Mutation in LDL receptor: Alu-Alure combination deletes exons encoding transmembrane and cytoplasmic domains. Science 227:140-146, 1985.

Leitersdorf, E.; Hobbs, H. H.: Personal Communication. Dallas, Tex. Dec. 1990.

Leitersdorf, E.; Hobbs, H. H.; Fourie, A. M.; Jacobs, M.; vander Westhuyzen, D. R.; Coetzee, G. A.: Deletion in the first cysteine-rich repeat of low-density lipoprotein receptor impairs its transport but not lipoprotein binding in fibroblasts from a subject with familial hypercholesterolemia. Proc. Nat. Acad. Sci. 85:7912-7916, 1988.

Leitersdorf, E.; Tobin, E. J.; Davignon, J.; Hobbs, H. H.: Common low-density lipoprotein receptor mutations in the French Canadian population. J. Clin. Invest. 85:1014-1023, 1990.

Leitersdorf, E.; van der Westhuyzen, D. R.; Coetzee, G. A.; Hobbs, H. H.: Two common low density lipoprotein receptor gene mutations cause familial hypercholesterolemia in Afrikaners. J. Clin. Invest. 84:954-961, 1989.

Lelli, N.; Ghisellini, M.; Calandra, S.; Gaddi, A.; Ciarrocchi, A.; Coviello, D. A.; Bertolini, S.: Duplication of exons 13, 14 and 15 of the LDL-receptor gene in a patient with heterozygous familial hypercholesterolemia. Hum. Genet. 86:359-362, 1991.

Leren, T. P.; Solberg, K.; Rodningen, O. K.; Tonstad, S.; Ose, L.: Two founder mutations in the LDL receptor gene in Norwegian familial hypercholesterolemia subjects. Atherosclerosis 111:175-182, 1994.

Li, H.; Gyllensten, U. B.; Cui, X.; Saiki, R. K.; Erlich, H. A.; Arnheim, N.: Amplification and analysis of DNA sequences in single human sperm and diploid cells. Nature 335:414-417, 1988.

Downes, G. B.; Gilbert, D. J.; Copeland, N. G.; Gautam, N.; Jenkins, N. A.: Chromosomal mapping of five mouse G protein gamma subunits. Genomics 57:173-176, 1999.

Modarressi, M. H.; Taylor, K. E.; Wolfe, J.: Cloning, characterization, and mapping of the gene encoding the human G protein gamma-2 subunit. Biochem. Biophys. Res. Commun. 272:610-615, 2000.

Yu, Y.; Zhang, C.; Zhou, G.; Wu, S.; Qu, X.; Wei, H.; Xing, G.; Dong, C.; Zhai, Y.; Wan, J.; Ouyang, S.; Li, L., Zhang, S.; Zhou, K.; Zhang, Y.; Wu, C.; He, F.: Gene expression profiling in human fetal liver and identification of tissue- and developmental-stage-specific genes through compiled expression profiles and efficient cloning of full-length cDNAs. Genome Res. 11:1392-1403, 2001.

Chen, C.-K.; Zhang, K.; Church-Kopish, J.; Huang, W.; Zhang, H.; Chen, Y.-J.; Frederick, J. M.; Baehr, W.: Characterization of human GRK7 as a potential cone opsin kinase. Molec. Vision 7:305-313,2001.

Weiss, E. R.; Ducceschi, M. H.; Horner, T. J.; Li, A.; Craft, C. M.; Osawa, S.: Species-specific differences in expression of G-protein-coupled receptor kinase (GRK) 7 and GRK1 in mammalian cone photoreceptor cells:implications for cone cell phototransduction. J. Neurosci. 21:9175-9184,2001.

Borregaard, N.; Cowland, J. B.: Granules of the human neutrophilic polymorphonuclear leukocyte. Blood 89:3503-3521, 1997.

Chang, K. S.; Schroeder, W.; Siciliano, M. J.; Thompson, L. H.; McCredie, K.; Beran, M.; Freireich, E. J.; Liang, J. C.; Trujillo, J. M.; Stass, S. A.: The localization of the human myeloperoxidase gene is in close proximity to the translocation breakpoint in acute promyelocytic leukemia. Leukemia 1:458-462, 1987.

DeLeo, F. R.; Goedken, M.; McCormick, S. J.; Nauseef, W. M.: A novel form of hereditary myeloperoxidase deficiency linked to endoplasmic reticulum/proteasome degradation. J. Clin. Invest. 101:2900-2909,1998.

Eiserich, J. P.; Baldus, S.; Brennan, M.-L.; Ma, W.; Zhang, C.; Tousson, A.; Castro, L.; Lusis, A. J.; Nauseef, W. M.; White, C. R.; Freeman, B. A.: Myeloperoxidase, a leukocyte-derived vascular NOoxidase. Science 296:2391-2394, 2002.

Inazawa, J.; Inoue, K.; Nishigaki, H.; Tsuda, S.; Taniwaki, M.; Misawa, S.; Abe, T.: Assignment of the human myeloperoxidase gene (MPO) to bands q21.3-q23 of chromosome 17. Cytogenet. Cell Genet. 50:135-136, 1989.

Johnson, K.; Gemperlein, I.; Hudson, S.; Shane, S.; Rovera, G.: Complete nucleotide sequence of the human myeloperoxidase gene. Nucleic Acids Res. 17:7985-7986, 1989.

Kizaki, M.; Miller, C. W.; Selsted, M. E.; Koeffler, H. P.: Myeloperoxidase (MPO) gene mutation in hereditary MPO deficiency. Blood 83:1935-1940,1994.

Klebanoff, S. J.: Myeloperoxidase. Proc. Assoc. Am. Physicians 111:383-389, 1999.

Kudoh, J.; Minoshima, S.; Hashinaka, K.; Nishio, C.; Yamada, M.; Shimizu, Y.; Shimizu, N.: Assignment of the myeloperoxidase gene MPO to human chromosome 17 using somatic cell hybrids and flow-sorted chromosomes. Jpn. J. Hum. Genet. 33:315-324, 1988.

Kudoh, J.; Minoshima, S.; Hashinaka, K.; Nishio, C.; Yamada, M.; Shimizu, Y.; Shimizu, N.: Assignment of the myeloperoxidase (MPO) gene to human chromosome 17. (Abstract) Cytogenet. Cell Genet. 46:641-642, 1987.

Law, D. J.; Prasad, M. A.; King, S. E.; Spranger, K. D.; Lee, Y. H.; Fox, R. E.; Collins, E. E.; Gebuhr, T. C.; Miller, D. E.; Petty, E. M.: Localization of the human estrogen-responsive finger protein (EFP) gene (ZNF147) within a YAC contig containing the myeloperoxidase (MPO) gene. Genomics 28:361-363, 1995.

Williams, M.; Lyu, M.-S.; Yang, Y.-L.; Lin, E. P.; Dunbrack, R.; Birren, B.; Cunningham, J.; Hunter, K.: Ier5, a novel member of the slow-kinetics immediate-early genes. Genomics 55:327-334, 1999.

Arce, I.; Roda-Navarro, P.; Montoya, M. C.; Hernanz-Falcon, P.; Puig-Kroger, A.; Fernandez-Ruiz, E.: Molecular and genomic characterization of human DLEC, a novel member of the C-type lectin receptor gene family preferentially expressed on monocyte-derived dendritic cells. Europ. J. Immun. 31:2733-2740, 2001.

Dzionek, A.; Sohma, Y.; Nagafune, J.; Cella, M.; Colonna, M.; Facchetti, F.; Gunther, G.; Johnston, I.; Lanzavecchia, A.; Nagasaka, T.; Okada, T.; Vermi, W.; Winkels, G.; Yamamoto, T.; Zysk, M.; Yamaguchi, Y.; Schmitz, J.: BDCA-2, a novel plasma cytoid dendritic cell-specific type II C-type lectin, mediates antigen capture and is a potent inhibitor of interferon alpha/beta induction. J. Exp. Med. 194:1823-1834, 2001.

Antonarakis, S. E.: Personal Communication. Baltimore, Md. Mar. 25, 2002.

McKemy, D. D.; Neuhausser, W. M.; Julius, D.: Identification of a cold receptor reveals a general role for TRP channels in thermosensation. Nature 416:52-58, 2002.

Peier, A. M.; Moqrich, A.; Hergarden, A. C.; Reeve, A. J.; Andersson, D. A.; Story, G. M.; Earley, T. J.; Dragoni, I.; McIntyre, P.; Bevan, S.; Patapoutian, A.: A TRP channel that senses cold stimuli and menthol. Cell 108:705-715, 2002.

Ashery-Padan, R.; Marquardt, T.; Zhou, X.; Gruss, P.: Pax6 activity in the lens primordium is required for lens formation and for correct placement of a single retina in the eye. Genes Dev. 14:2701-2711,2000.

Azuma, N.; Yamaguchi, Y.; Handa, H.; Hayakawa, M.; Kanai, A.; Yamada, M.: Missense mutation in the alternative splice region of the PAX6 gene in eye anomalies. Am. J. Hum. Genet. 65:656-663, 1999.

Roginski, R. S.; Mohan Raj, B. K.; Finkernagel, S. W.; Sciorra, L. J.: Assignment of an ionotropic glutamate receptor-like gene (GRINL1A) to human chromosome 15q22.1 by in situ hybridization. Cytogenet. Cell Genet. 93:143-144, 2001.

Wydner, K. S.; Mohan Raj, B. K.; Sciorra, L. J.; Roginski, R. S.: The mouse orthologue of the human ionotropic glutamate receptor-like gene (GRINL1A) maps to mouse chromosome 9. Cytogenet. Cell Genet. 95:240-241, 2001.

Akiyama, H.; Hiraki, Y.; Noda, M.; Shigeno, C.; Ito, H.; Nakamura, T.: Molecular cloning and biological activity of a novel Ha-Ras suppressor gene predominantly expressed in skeletal muscle, heart, brain, and bone marrow by differential display using clonal mouse EC cells, ATDC5. J. Biol. Chem. 274:32192-32197, 1999.

Ito, H.; Akiyama, H.; Shigeno, C.; Nakamura, T.: Isolation, characterization, and chromosome mapping of a human A-C1 Ha-Ras suppressor gene (HRASLS). Cytogenet. Cell Genet. 93:36-39, 2001.

Nakamura, T.; Yamazaki, Y.; Saiki, Y.; Moriyama, M.; Largaespada, D. A.; Jenkins, N. A.; Copeland, N. G.: Evi9 encodes a novel zinc finger protein that physically interacts with BCL6, a known human B-cell proto-oncogene product. Molec. Cell Biol. 20:3178-3186,2000.

Saiki, Y.; Yamazaki, Y.; Yoshida, M.; Katoh, O.; Nakamura, T.:Human EVI9, a homologue of the mouse myeloid leukemia gene, is expressed in the hematopoietic progenitors and down-regulated during myeloid differentiation of HL60 cells. Genomics 70:387-391, 2000.

Satterwhite, E.; Sonoki, T.; Willis, T. G.; Harder, L.; Nowak, R.; Arriola, E. L.; Liu, H.; Price, H. P.; Gesk, S.; Steinemann, D.; Schlegelberger, B.; Oscier, D. G.; Siebert, R.; Tucker, P. W.; Dyer, M. J. S.: The BCL11 gene family: involvement of BCL11A in lymphoid malignancies. Blood 98:3413-3420, 2001.

Kiss, H.; Kedra, D.; Kiss, C.; Kost-Alimova, M.; Yang, Y.; Klein, G.; Imreh, S.; Dumanski, J. P.: The LZTFL1 gene is a part of a transcriptional map covering 250 kb within the common eliminated region 1 (C3CER1) in 3p21.3. Genomics 73:10-19, 2001.

Quentmeier, H.; Drexler, H. G.; Fleckenstein, D.; Zaborski, M.; Armstrong, A.; Sims, J. E.; Lyman, S. D.: Cloning of human thymic stromal lymphopoietin (TSLP) and signaling mechanisms leading to proliferation. Leukemia 15:1286-1292, 2001.

Soumelis, V.; Reche, P. A.; Kanzler, H.; Yuan, W.; Edward, G.; Homey, B.; Gilliet, M.; Ho, S.; Antonenko, S.; Lauerma, A.; Smith, K.; Gorman, D.; Zurawski, S.; Abrams, J.; Menon, S.; McClanahan, T.; de Waal-Malefyt, R.; Bazan, F.; Kastelein, R. A.; Liu, Y.-J.: human epithelial cells trigger dendritic cell-mediated allergic inflammation by producing TSLP. Nature Immun. 3:673-680, 2002.

Guo, D.; Hasham, S.; Kuang, S.-Q.; Vaughan, C. J.; Boerwinkle, E.; Chen, H.; Abuelo, D.; Dietz, H. C.; Basson, C. T.; Shete, S. S.; Milewicz, D. M.: Familial thoracic aortic aneurysms and dissections:genetic heterogeneity with a major locus mapping to 5q13-14. Circulation 103:2461-2468, 2001.

Vaughan, C. J.; Casey, M.; He, J.; Veuglers, M.; Henderson, K.; Guo, D.; Campagna, R.; Roman, M. J.; Milewicz, D. M.; Devereux, R. B.; Basson, C. T.: Identification of a chromosome 11q23.2-q24 locus for familial aortic aneurysm disease, a genetically heterogeneous disorder. Circulation 103:2469-2475, 2001.

Tapon, N.; Harvey, K. F.; Bell, D. W.; Wahrer, D. C. R.; Schiripo, T. A.; Haber, D. A.; Hariharan, I. K.: salvador promotes both cell cycle exit and apoptosis in Drosophila and is mutated in human cancer cell lines. Cell 110:467-478, 2002.

Valverde, P.: Cloning, expression, and mapping of hWW45, a novel human WW domain-containing gene. Biochem. Biophys. Res. Commun. 276:990-998, 2000.

Wang, X.; McLachlan, J.; Zamore, P. D.; Hall, T. M. T.: Modular recognition of RNA by a human pumilio-homology domain. Cell 110:501-512, 2002.

Gaide, O.; Martinon, F.; Micheau, O.; Bonnet, D.; Thome, M.; Tschopp, J.: Carma1, a CARD-containing binding partner of Bcl10, induces Bcl10 phosphorylation and NF-kappa-B activation. FEBS Lett. 496:121-127,2001.

McAllister-Lucas, L. M.; Inohara, N.; Lucas, P. C.; Ruland, J.; Benito, A.; Li, Q.; Chen, S.; Chen, F. F.; Yamaoka, S.; Verma, I. M.; Mak, T. W.; Nunez, G.: Bimp1, a MAGUK family member linking protein kinase C activation to Bcl10-mediated NF-kappa-B induction. J. Biol. Chem. 276:30589-30597, 2001.

Wang, L.; Guo, Y.; Huang, W.-J.; Ke, X.; Poyet, J.-L.; Manji, G. A.; Merriam, S.; Glucksmann, M. A.; DiStefano, P. S.; Alnemri, E. S.; Bertin, J.: CARD10 is a novel caspase recruitment domain/membrane-associated guanylate kinase family member that interacts with BCL10 and activates NF-kappa-B. J. Biol. Chem. 276:21405-21409, 2001.

Loux, N.; Benlian, P.; Pastier, D.; Boileau, C.; Cambou, J. P.; Monnier, L.; Percheron, C.; Junien, C.: Recurrent mutation at aa792 in the LDL receptor gene in a French patient. Hum. Genet. 87:373-375, 1991.

Le Beau, M. M.; Lemons, R. S.; Rosner, G. L.; Carrino, J. C.; Reid, M. S.; Chisholm, R. L.; Diaz, M. O.; Weil, S. C.: Chromosomal localization of the gene encoding myeloperoxidase. (Abstract) Cytogenet. Cell Genet. 46:645, 1987.

De Deken, X.; Wang, D.; Many, M.-C.; Costagliola, S.; Libert, F.; Vassart, G.; Dumont, J. E.; Miot, F.: Cloning of two human thyroid cDNAs encoding new members of the NADPH oxidase family. J. Biol. Chem. 275:23227-23233, 2000.

Lacroix, L.; Nocera, M.; Mian, C.; Caillou, B.; Virion, A.; Dupuy, C.; Filetti, S.; Bidart, J. M.; Schlumberger, M.: Expression of nicotinamide adenine dinucleotide phosphate oxidase flavoprotein DUOX genes and proteins in human papillary and follicular thyroid carcinomas. Thyroid 11:1017-1023, 2001.

Dupuy, C.; Ohayon, R.; Valent, A.; Noel-Hudson, M.-S.; Deme, D.; Virion, A.: Purification of a novel flavoprotein involved in the thyroid NADPH oxidase: cloning of the porcine and human cDNAs. J. Biol. Chem. 274:37265-37269, 1999.

Moreno, J. C.; Bikker, H.; Kempers, M. J. E.; van Trotsenburg, A. S. P.; Baas, F.; de Vijlder, J. J. M.; Vulsma, T.; Ris-Stalpers, C.: Inactivating mutations in the gene for thyroid oxidase 2 (THOX2) and congenital hypothyroidism. New Eng. J. Med. 347:95-102, 2002.

Okajima, T.; Fukumoto, S.; Miyazaki, H.; Ishida, H.; Kiso, M.; Furukawa, K.; Urano, T.; Furukawa, K.: Molecular cloning of a novel alpha-2,3-sialyl transferase (ST3Gal VI) that sialylates type II lactosamine structures on glycoproteins and glycolipids. J. Biol. Chem. 274:11479-11486, 1999.

Richardson, J.; Cvekl, A.; Wistow, G.: Pax-6 is essential for lens-specific expression of zeta-crystallin. Proc. Nat. Acad. Sci. 92:4676-4680, 1995.

Sander, M.; Neubuser, A.; Kalamaras, J.; Ee, H. C.; Martin, G. R.; German, M. S.: Genetic analysis reveals that PAX6 is required for normal transcription of pancreatic hormone genes and islet development. Genes Dev. 11:1662-1673, 1997.

Taniguchi, A.; Kaneta, R.; Morishita, K.; Matsumoto, K.: Gene structure and transcriptional regulation of human Gal beta-1,4(3)GlcNac alpha-2,3-sialyl transferase VI (hST3Gal VI) gene in prostate cancer cell line. Biochem. Biophys. Res. Commun. 287:1148-1156,2001.

Schwientek, T.; Nomoto, M.; Levery, S. B.; Merkx, G.; van Kessel, A. G.; Bennett, E. P.; Hollingsworth, M. A.; Clausen, H.: control of O-glycan branch formation: molecular cloning of human cDNA encoding a novel beta-1,6-N-acetylglucosaminyl transferase forming core 2 and core 4. J. Biol. Chem. 274:4504-4512, 1999.

Chano, T.; et al; et al: Isolation, characterization and mapping of the mouse and human RB1CC1 genes. Gene (in-press), 2002.

Chano, T.; Kontani, K.; Teramoto, K.; Okabe, H.; Ikegawa, S.:Truncating mutations of RB1CC1 in human breast cancers. Nature Genet. 31:285-288, 2002.

Kaneko, M.; Kudo, T.; Iwasaki, H.; Ikehara, Y.; Nishihara, S.; Nakagawa, S.; Sasaki, K.; Shiina, T.; Inoko, H.; Saitou, N.; Narimatsu, H.: Alpha-1,3-fucosyl transferase (sic) IX (Fuc-TIX) is very highly conserved between human and mouse; molecular cloning, characterization and tissue distribution of human Fuc-TIX. FEBS Lett. 452:237-242,1999.

Kaneko, M.; Kudo, T.; Iwasaki, H.; Shiina, T.; Inoko, H.; Kozaki, T.; Saitou, N.; Narimatsu, H.: Assignment of the human alpha-1,3-fucosyl transferase IX gene (FUT9) to chromosome band 6q16 by in situ hybridization. Cytogenet. Cell Genet. 86:329-330, 1999.

Lane, J. D; Lucocq, J.; Pryde, J.; Barr, F. A.; Woodman, P. G.; Allan, V. J.; Lowe, M.: Caspase-mediated cleavage of the stacking protein GRASP65 is required for Golgi fragmentation during apoptosis. J. Cell Biol. 156:495-509, 2002.

Sutterlin, C.; Hsu, P.; Mallabiabarrena, A.; Malhotra, V.: Fragmentation and dispersal of the pericentriolar Golgi complex is required for entry into mitosis in mammalian cells. Cell 109:359-369, 2002.

Davis, A.; Cowell, J. K.: Mutations in the PAX6 gene in patients with hereditary aniridia. Hum. Molec. Genet. 2:2093-2097, 1993.

Gronskov, K.; Rosenberg, T.; Sand, A.; Brondum-Nielsen, K.: Mutational analysis of PAX6:16 novel mutations including 5 missense mutations with a mild aniridia phenotype. Europ. J. Hum. Genet. 7:274-286,1999.

Halder, G.; Callaerts, P.; Gehring, W. J.: Induction of ectopic eyes by targeted expression of the eyeless gene in Drosophila. Science 267:1788-1792, 1995.

Hanson, I.; Brown, A.; van Heyningen, V.: A new PAX6 mutation in familial aniridia. J. Med. Genet. 32:488-489, 1995.

Hanson, I.; Van Heyningen, V.: Pax6: more than meets the eye. Trends Genet. 11:268-272, 1995.

Hanson, I. M.; Fletcher, J. M.; Jordon, T.; Brown, A.; Taylor, D.; Adams, R. J.; Punnett, H. H.; van Heyningen, V.: Mutations at the PAX6 locus are found in heterogeneous anterior segment malformations including Peters' anomaly. Nature Genet. 6:168-173, 1994.

Heins, N.; Malatesta, P.; Cecconi, F.; Nakafuku, M.; Tucker, K. L.; Hack, M. A.; Chapouton, P.; Barde, Y.-A.; Gotz, M.: Glial cells generate neurons: the role of the transcription factor Pax6. Nature Neurosci. 5:308-315, 2002.

Holmstrom, G. E.; Reardon, W. P.; Baraitser, M.; Elston, J. S.; Taylor, D. S.: Heterogeneity in dominant anterior segment malformations. Brit. J. Ophthal. 75:591-597, 1991.

Kioussi, C.; O'Connell, S.; St-Onge, L.; Treier, M.; Gleiberman, A. S.; Gruss, P.; Rosenfeld, M. G.: Pax6 is essential for establishing ventral-dorsal cell boundaries in pituitary gland development. Proc. Nat. Acad. Sci. 96:14378-14382, 1999.

Kleinjan, D. A.; Seawright, A.; Schedl, A.; Quinlan, R. A.; Danes, S.; van Heyningen, V.: Aniridia-associated translocations, DNase hypersensitivity, sequence comparison and transgenic analysis redefine the functional domain of PAX6. Hum. Molec. Genet. 10:2049-2059,2001.

Lauderdale, J. D.; Wilensky, J. S.; Oliver, E. R.; Walton, D. S.; Glaser, T.:3-prime deletions cause aniridia by preventing PAX6 gene expression. Proc. Nat. Acad. Sci. 97:13755-13759, 2000.

Marquardt, T.; Ashery-Padan, R.; Andrejewski, N.; Scardigli, R.; Guillemot, F.; Gruss, P.: Pax6 is required for the multipotent state of retinal progenitor cells. Cell 105:43-55, 2001.

Croze, E.; Russell-Harde, D.; Wagner, T. C.; Pu, H.; Pfeffer, L. M.; Perez, H. D.: The human type I interferon receptor: identification of the interferon beta-specific receptor-associated phosphoprotein. J. Biol. Chem. 271:33165-33168, 1996.

Croze, E.; Usacheva, A.; Asarnow, D.; Minshall, R. D.; Perez, H. D.; Colamonici, O.: Receptor for activated C-kinase (RACK-1), a WD motif-containing protein, specifically associates with the human type I IFN receptor. J. Immun. 165:5127-5132, 2000.

Domanski, P.; Witte, M.; Kellum, M.; Rubinstein, M.; Hackett, R.; Pitha, P.; Colamonici, O. R.: Cloning and expression of a long form of the beta subunit of the interferon alpha/beta receptor that is required for signaling. J. Biol. Chem. 270:21606-21611, 1995.

Platanias, L. C.; Uddin, S.; Domanski, P.; Colamonici, O. R.:Differences in interferon alpha and beta signaling: interferon beta selectively induces the interaction of the alpha and beta (L) subunits of the type I interferon receptor. J. Biol. Chem. 271:23630-23633,1996.

Raz, R.; Cheung, K.; Ling, L.; Levy, D. E.: Three distinct loci on human chromosome 21 contribute to interferon-alpha/beta responsiveness. Somat. Cell Molec. Genet. 21:139-145, 1995.

Klocke, R.; Augustin, A.; Ronsiek, M.; Stief, A.; van der Putten, H.; Jockusch, H.: Dynamin genes Dnm1 and Dnm2 are located on proximal mouse chromosomes 2 and 9, respectively. Genomics 41:290-292, 1997.

Lutfalla, G.; Holland, S. J.; Cinato, E.; Monneron, D.; Reboul, J.; Rogers, N. C.; Smith, J. M.; Stark, G. R.; Gardiner, K.; Mogensen, K. E.; Kerr, I. M.; Uze, G.: Mutant U5A cells are complemented by an interferon-alpha/beta receptor subunit generated by alternative processing of a new member of a cytokine receptor gene cluster. EMBO J. 14:5100-5108, 1995.

Diatloff-Zito, C.; Gordon, A. J. E.; Duchaud, E.; Merlin, G.:Isolation of an ubiquitously expressed cDNA encoding human dynamin II, a member of the large GTP-binding protein family. Gene 163:301-306, 1995.

Bentz, H.; Nathan, R. M.; Rosen, D. M.; Armstrong, R. M.; Thompson, A. Y.; Segarini, P. R.; Mathews, M. C.; Dasch, J. R.; Piez, K. A.; Seyedin, S. M.: Purification and characterization of a unique osteoinductive factor from bovine bone. J. Biol. Chem. 264:20805-20810, 1989.

Madisen, L.; Neubauer, M.; Plowman, G.; Rosen, D.; Segarini, P.; Dasch, J.; Thompson, A.; Ziman, J.; Bentz, H.; Purchio, A. F.: molecular cloning of a novel bone-forming compound: osteoinductive factor. DNA Cell Biol. 9:303-309, 1990.

Fischer, G.; Perez-Rodriguez, M.; Arguello, J. R.; Cox, S. T.; McWhinnie, A.; Travers, P. J.; Madrigal, J. A.: Three novel MICB alleles. Tissue Antigens 55:166-170, 2000.

Groh, V.; Bahram, S.; Bauer, S.; Herman, A.; Beauchamp, M.; Spies, T.: Cell stress-regulated human major histocompatibility complex class I gene expressed in gastrointestinal epithelium. Proc. Nat. Acad. Sci. 93:12445-12450, 1996.

Nakai, A.; Tanabe, M.; Kawazoe, Y.; Inazawa, J.; Morimoto, R. I.; Nagata, K.: HSF4, a new member of the human heat shock factor family which lacks properties of a transcriptional activator. Molec. Cell. Biol. 17:469-481, 1997.

Uchida, K.; Yoshimura, A.; Inazawa, J.; Yanagisawa, K.; Osada, H.; Masuda, A.; Saito, T.; Takahashi, T.; Miyajima, A.; Takahashi, T.: Molecular cloning of CISH, chromosome assignment to 3p21.3, and analysis of expression in fetal and adult tissues. Cytogenet. Cell Genet. 78:209-212, 1997.

Yoshimura, A.; Ohkubo, T.; Kiguchi, T.; Jenkins, N. A.; Gilbert, D. J.; Copeland, N. G.; Hara, T.; Miyajima, A.: A novel cytokine-inducible gene CIS, encodes an SH2-containing protein that binds to tyrosine-phosphorylated interleukin 3 and erythropoietin receptors. EMBO J. 14:2816-2826, 1995.

Chen, H.; Antonarakis, S. E.: The SH3D1A gene maps to human chromosome 21q22.1-q22.2. Cytogenet. Cell Genet. 78:213-215, 1997.

Pucharcos, C.; Estivill, X.; de la Luna, S.: Intersectin 2, a new multimodular protein involved in clathrin-mediated endocytosis. FEBS Lett. 478:43-51, 2000.

Szepetowski, P.; Simon, M.-P.; Grosgeorge, J.; Huebner, K.; Bastard, C.; Evans, G. A.; Tsujimoto, Y.; Birnbaum, D.; Theillet, C.; Gaudray, P.: Localization of 11q13 loci with respect to regional chromosomal break points. Genomics 12:738-744, 1992.

Wang, T. C.; Cardiff, R. D.; Zukerberg, L.; Lees, E.; Arnold, A.; Schmidt, E. V.: Mammary hyperplasia and carcinoma in MMTV-cyclin D1 transgenic mice. Nature 369:669-671, 1994.

Xiong, Y.; Connelly, T.; Futcher, B.; Beach, D.: Human D-type cyclin. Cell 65:691-699, 1991.

Yu, Q.; Geng, Y.; Sicinski, P.: Specific protection against breast cancers by cyclin D1 ablation. Nature 411:1017-1021, 2001.

Zatyka, M.; da Silva, N. F.; Clifford, S. C.; Morris, M. R.; Wiesener, M. S.; Eckardt, K.-U.; Houlston, R. S.; Richards, F. M.; Latif, F.; Maher, E. R.: Identification of cyclin D1 and other novel targets for the von Hippel-Lindau tumor suppressor gene by expression array analysis and investigation of cyclin D1 genotype as a modifier in von Hippel-Lindau disease. Cancer Res. 62:3803-3811, 2002.

Goldgaber, D.; Goldfarb, L. G.; Brown, P.; Asher, D. M.; Brown, W. T.; Lin, S.; Teener, J. W.; Feinstone, S. M.; Rubenstein, R.; Kascsak, R. J.; Boellaard, J. W.; Gajdusek, D. C.: Mutations in familial Creutzfeldt-Jakob disease and Gerstmann-Straussler-Scheinker's syndrome. Exp. Neurol. 106: 204-206, 1989.

Goldhammer, Y.; Gabizon, R.; Meiner, Z.; Sadeh, M.: An Israeli family with Gerstmann-Straussler-Scheinker disease manifesting the codon 102 mutation in the prion protein gene. Neurology 43:2718-2719,1993.

Griffith, J. S.: Self-replication and scrapie. Nature 215: 1043-1044, 1967.

Haltia, M.; Kovanen, J.; Goldfarb, L. G.; Brown, P.; Gajdusek, D. C.: Familial Creutzfeldt-Jakob disease in Finland: epidemiological, clinical, pathological and molecular genetic studies. Europ. J. Epidemiol. 7:494-500, 1991.

Head, M. W.; Tissingh, G.; Uitdehaag, B. M. J.; Barkhof, F.; Bunn, T. J. R.; Ironside, J. W.; Kamphorst, W.; Scheltens, P.: Sporadic Creutzfeldt-Jakob disease in a young Dutch valine homozygote: atypical molecular phenotype. Ann. Neurol. 50:258-261, 2001.

Hegde, R. S.; Mastrianni, J. A.; Scott, M. R.; DeFea, K. A.; Tremblay, P.; Torchia, M.; DeArmond, S. J.; Prusiner, S. B.; Lingappa, V. R.: A transmembrane form of the prion protein in neurodegenerative disease. Science 279:827-834, 1998.

Hegde, R. S.; Tremblay, P.; Groth, D.; DeArmond, S. J.; Prusiner, S. B.; Lingappa, V. R.: Transmissible and genetic prion diseases share a common pathway of neurodegeneration. Nature 402:732-736,1999.

Horwich, A. L.; Weissman, J. S.: Deadly conformations--protein misfolding in prion disease. Cell 89:499-510, 1997.

Hsiao, K.; Baker, H. F.; Crow, T. J.; Poulter, M.; Owen, F.; Terwilliger, J. D.; Westaway, D.; Ott, J.; Prusiner, S. B.: Linkage of a prion protein missense variant to Gerstmann-Straussler syndrome. Nature 338:342-345, 1989.

Hsiao, K.; Cass, C.; Conneally, P. M.; Dlouhy, S. R.; Hodes, M. E.; Farlow, M. R.; Ghetti, B.; Prusiner, S. B.: Atypical Gerstmann-Straussler-Scheinker syndrome with neurofibrillary tangles: no mutation in the prion protein open-reading-frame in a patient of the Indiana kindred. (Abstract) Neurobiol. Aging 11:302, 1990.

Hsiao, K.; Dlouhy, S. R.; Farlow, M. R.; Cass, C.; Da Costa, M.; Conneally, P. M.; Hodes, M. E.; Ghetti, B.; Prusiner, S. B.: Mutant prion proteins in Gerstmann-Straussler-Scheinker disease with neurofibrillary tangles. Nature Genet. 1:68-71, 1992.

Hsiao, K.; Meiner, Z.; Kahana, E.; Cass, C.; Kahana, I.; Avrahami, D.; Scarlato, G.; Abramsky, O.; Prusiner, S. B.; Gabizon, R.: Mutation of the prion protein in Libyan Jews with Creutzfeldt-Jakob disease. New Eng. J. Med. 324:1091-1097, 1991.

Hsiao, K. K.; Groth, D.; Scott, M.; Yang, S.-L.; Serban, H.; Rapp, D.; Foster, D.; Torchia, M.; DeArmond, S. J.; Prusiner, S. B.: Serial transmission in rodents of neurodegeneration from transgenic mice expressing mutant prion protein. Proc. Nat. Acad. Sci. 91:9126-9130,1994.

Ironside, J. W.; Sutherland, K.; Bell, J. E.; McCardle, L.; Barrie, C.; Estebeiro, K.; Zeidler, M.; Will, R. G.: A new variant of Creutzfeldt-Jakob disease: neuropathological and clinical features. Cold Spring Harbor Symp. Quant. Biol. 61:523-530, 1996.

Jendroska, K.; Hoffmann, O.; Schelosky, L.; Lees, A. J.; Poewe, W.; Daniel, S. E.: Absence of disease related prion protein in neurodegenerative disorders presenting with Parkinson's syndrome. J. Neurol. Neurosurg. Psychiat. 57:1249-1251, 1994.

Kaneko, K.; Zulianello, L.; Scott, M.; Cooper, C. M.; Wallace, A. C.; James, T. L.; Cohen, F. E.; Prusiner, S. B.: Evidence for protein X binding to a discontinuous epitope on the cellular prion protein during scrapie prion propagation. Proc. Nat. Acad. Sci. 94:10069-10074, 1997.

Kitamoto, T.; Ohta, M.; Doh-ura, K.; Hitoshi, S.; Terao, Y.; Tateishi, J.: Novel missense variants of prion protein in Creutzfeldt-Jakob disease or Gerstmann-Straussler syndrome. Biochem. Biophys. Res. Commun. 191:709-714, 1993.

Kocisko, D. A.; Come, J. H.; Priola, S. A.; Chesebro, B.; Raymond, G. J.; Lansbury, P. T.; Caughey, B.: Cell-free formation of protease-resistant prion protein. Nature 370:471-474, 1994.

Krasemann, S.; Zerr, I.; Weber, T.; Poser, S.; Kretzschmar, H.; Hunsmann, G.; Bodemer, W.: Prion disease associated with a novel nine octapeptide repeat insertion in the PRNP gene. Molec. BrainRes. 34:173-176, 1995.

Kretzschmar, H. A.; Neumann, M.; Stavrou, D.: Codon 178 mutation of the human prion protein gene in a German family (Backer family):sequencing data from 72-year-old celloidin-embedded brain tissue. Acta Neuropath. 89:96-98, 1995.

Kretzschmar, H. A.; Stowring, L. E.; Westaway, D.; Stubblebine, W. H.; Prusiner, S. B.; DeArmond, S. J.: Molecular cloning of a human prion protein cDNA. DNA 5:315-324, 1986.

Kuwahara, C.; Takeuchi, A. M.; Nishimura, T.; Haraguchi, K.; Kubosaki, A.; Matsumoto, Y.; Saeki, K.; Matsumoto, Y.; Yokoyama, T.; Itohara, S.; Onodera, T.: Prions prevent neuronal cell-line death. (Letter) Nature 400:225-226, 1999.

Laplanche, J.-L.; El Hachimi, K. H.; Durieux, I.; Thuillet, P.; Defebvre, L.; Delasnerie-Laupretre, N.; Peoc'h, K.; Foncin, J.-F.; Destee, A.: Prominent psychiatric features and early onset in an inherited prion disease with a new insertional mutation in the prion protein gene. Brain 122:2375-2386, 1999.

Laplanche, J. L.; Chatelain, J.; Thomas, S.; Launay, J. M.; Gaultier, C.; Derouesne, C.: Uncommon phenotype for a codon 178 mutation of the human PrP gene. (Letter) Ann. Neurol. 31:345, 1992.

Le, Y.; Yazawa, H.; Gong, W.; Yu, Z.; Ferrans, V. J.; Murphy, P. M.; Wang, J. M.: Cutting edge: the neurotoxic prion peptide fragment PrP(106-126) is a chemotactic agonist for the G protein-coupled receptor formyl peptide receptor-like 1. J. Immun. 166:1448-1451, 2001.

Gibbons, B.; Scott, D.; Hungerford, J. L.; Cheung, K. L.; Harrison, C.; Attard-Montalto, S.; Evans, M.; Birch, J. M.; Kingston, J. E.: Retinoblastoma in association with the chromosome breakage syndromes Fanconi's anaemia and Bloom's syndrome: clinical and cytogenetic findings. Clin. Genet. 47:311-317, 1995.

Girardet, A.; McPeek, M. S.; Leeflang, E. P.; Munier, F.; Arnheim, N.; Claustres, M.; Pellestor, F.: Meiotic segregation analysis of RB1 alleles in retinoblastoma pedigrees by use of single-sperm typing. Am. J. Hum. Genet. 66:167-175, 2000.

Godbout, R.; Dryja, T. P.; Squire, J.; Gallie, B. L.; Phillips, R. A.: Somatic inactivation of genes on chromosome 13 is a common event in retinoblastoma. Nature 304:451-453, 1983.

Goodrich, D. W.; Wang, N. P.; Qian, Y.-W.; Lee, E. Y.-H. P.; Lee, W.-H.: The retinoblastoma gene product regulates progression through the G1 phase of the cell cycle. Cell 67:293-302, 1991.

Grace, E.; Drennan, J.; Colver, D.; Gordon, R. R.: The 13q deletion syndrome. J. Med. Genet. 8:351-357, 1971.

Green, A. R.; Wyke, J. A.: Anti-oncogenes: a subset of regulatory genes involved in carcinogenesis? Lancet II:475-477, 1985.

Greger, V.; Kerst, S.; Messmer, E.; Hopping, W.; Passarge, E.; Horsthemke, B.: Application of linkage analysis to genetic counselling in families with hereditary retinoblastoma. J. Med. Genet. 25:217-221,1988.

Greger, V.; Passarge, E.; Horsthemke, B.: Somatic mosaicism in a patient with bilateral retinoblastoma. Am. J. Hum. Genet. 46:1187-1193, 1990.

Hagstrom, S. A.; Dryja, T. P.: Mitotic recombination map of 13cen-13q14 derived from an investigation of loss of heterozygosity in retinoblastomas. Proc. Nat. Acad. Sci. 96:2952-2957, 1999.

Hall, J. G.: Personal Communication. Vancouver, British Columbia, Canada May 29, 1993.

Hanahan, D.; Weinberg, R. A.: The hallmarks of cancer. Cell 100:57-70, 2000.

Harbour, J. W.: Molecular basis of low-penetrance retinoblastoma. Arch. Ophthal. 119:1699-1704, 2001.

Harbour, J. W.; Lai, S.-L.; Whang-Peng, J.; Gazdar, A. F.; Minna, J. D.; Kaye, F. J.: Abnormalities in structure and expression of the human retinoblastoma gene in SCLC. Science 241:353-357, 1988.

Hensel, C.; Hsieh, C.-L.; Lee, W.-H.; Pam-Lee, E.; Gazdar, A.; Sakaguchi, A. Y.; Naylor, S. L.: Allele loss and lack of expression of the RB-1 locus in small cell lung cancer. (Abstract) Am. J. Hum. Genet. 43: A25, 1988.

Henson, J. W.; Schnitker, B. L.; Correa, K. M.; von Diemling, A.; Fassbender, F.; Xu, H.-J.; Benedict, W. F.; Yandell, D. W.; Louis, D. N.: The retinoblastoma gene is involved in malignant progression of astrocytomas. Ann. Neurol. 36:714-721, 1994.

Higgins, M. J.; Hansen, M. F.; Cavenee, W. K.; Lalande, M.: Molecular detection of chromosomal translocations that disrupt the putative retinoblastoma susceptibility locus. Molec. Cell. Biol. 9:1-5,1989.

Hoegerman, S. F.: Chromosome 13 long arm interstitial deletion may result from maternal inverted insertion. Science 205:1035-1036,1979.

Hogg, A.; Bia, B.; Onadim, Z.; Cowell, J. K.: Molecular mechanisms of oncogenic mutations in tumours from patients with bilateral and unilateral retinoblastoma. Proc. Nat. Acad. Sci. 90:7351-7355,1993.

Honavar, S. G.; Shields, C. L.; Shields, J. A.; Demirci, H.; Naduvilath, T. J.: Intraocular surgery after treatment of retinoblastoma. Arch. Ophthal. 119:1613-1621, 2001.

Honavar, S. G.; Singh, A. D.; Shields, C. L.; Meadows, A. T.; Demirci, H.; Cater, J.; Shields, J. A.: Postenucleation adjuvant therapy in high-risk retinoblastoma. Arch. Ophthal. 120:923-931,2002.

Hong, F. D.; Huang, H.-J. S.; To, H.; Young, L.-J. S.; Oro, A.; Bookstein, R.; Lee, E. Y.-H. P.; Lee, W.-H.: Structure of the human retinoblastoma gene. Proc. Nat. Acad. Sci. 86:5502-5506, 1989.100. Horowitz, J. M.; Park, S.-H.; Bogenmann, E.; Cheng, J.-C.; Yandell, D. W.; Kaye, F. J.; Minna, J. D.; Dryja, T. P.; Weinberg, R. A.:Frequent inactivation of the retinoblastoma anti-oncogene is restricted to a subset of human tumor cells. Proc. Nat. Acad. Sci. 87:2775-2779,1990.101. Horowitz, J. M.; Park, S. H.; Yandell, D. W.; Weinberg, R. A.: Involvement of the retinoblastoma gene in the genesis of various human tumors. In: Kavenee, W.; Hastie, N.; Stanbridge, E.: Recessive Oncogenes and Tumor Suppression: Current Communications in Molecular Biology. Cold Spring Harbor, New York: Cold Spring Harbor Laboratory Press (pub.) 1989. Pp. 101-108.102. Horsthemke, B.; Greger, V.; Barnert, H. J.; Hopping, W.; Passarge, E.: Detection of submicroscopic deletions and a DNA polymorphism at the retinoblastoma locus. Hum. Genet. 76:257-261, 1987.103. Horsthemke, B.; Greger, V.; Becher, R.; Passarge, E.: Mechanism of i (6p) formation in retinoblastoma tumor cells. Cancer Genet. Cytogenet. 37:95-102, 1989.104. Hsieh, J.-K.; Chan, F. S. G.; O'Connor, D. J.; Mittnacht, S.; Zhong, S.; Lu, X.: RB regulates the stability and the apoptotic function of p53 via MDM2. Molec. Cell 3:181-193, 1999.105. Huang, H.-J. S.; Yee, J.-K.; Shew, J.-Y.; Chen, P.-L.; Bookstein, R.; Friedmann, T.; Lee, E. Y.-H. P.; Lee, W.-H.: Suppression of the neoplastic phenotype by replacement of the RB gene in human cancer cells. Science 242:1563-1566, 1988.106. Janson, M.; Nordenskjold, M.: A constitutional mutation within the retinoblastoma gene detected by PFGE. Clin. Genet. 45:5-10,1994.107. Jensen, R. D.; Miller, R. W.: Retinoblastoma: epidemiologic characteristics. New Eng. J. Med. 285:307-311, 1971.108. Kimchi, A.; Wang, X.-F.; Weinberg, R. A.; Cheifetz, S.; Massague, J.: Absence of TGF-beta receptors and growth inhibitory responses in retinoblastoma cells. Science 240:196-199, 1988.109. Kitchin, F. D.; Ellsworth, R. M.: Pleiotropic effects of the gene for retinoblastoma. J. Med. Genet. 11:244-246, 1974.110. Kivela, T.: Trilateral retinoblastoma: a meta-analysis of hereditary retinoblastoma associated with primary ectopic intracranial retinoblastoma. J. Clin. Oncol. 17:1829-1837, 1999.111. Kivela, T.; Asko-Seljavaara, S.; Pihkala, U.; Hovi, L.; Heikkonen, J.: Sebaceous carcinoma of the eyelid associated with retinoblastoma. Ophthalmology 108:1124-1128, 2001.112. Klutz, M.; Brockmann, D.; Lohmann, D. R.: A parent-of-origin effect in two families with retinoblastoma is associated with a distinct splice mutation in the RB1 gene. Am. J. Hum. Genet. 71:174-179,2002.113. Knight, L. A.; Gardner, H. A.; Gallie, B. L.: Familial retinoblastoma:segregation of chromosome 13 in four families. Am. J. Hum. Genet. 32:194-201, 1980.114. Knudson, A. G.: Hereditary cancer, oncogenes and anti-oncogenes. Cancer Res. 45:1437-1443, 1985.115. Knudson, A. G., Jr.: Mutation and cancer: statistical study of retinoblastoma. Proc. Nat. Acad. Sci. 68:820-823, 1971.116. Knudson, A. G., Jr.: Genetics of human cancer. Annu. Rev. Genet. 20:231-251, 1986.117. Knudson, A. G., Jr.; Hethcote, H. W.; Brown, B. W.: Mutation and childhood cancer: a probabilistic model for the incidence of retinoblastoma. Proc. Nat. Acad. Sci. 72:5116-5120, 1975.118. Knudson, A. G., Jr.; Meadows, A. T.; Nichols, W. W.; Hill, R.: Chromosomal deletion and retinoblastoma. New Eng. J. Med. 295:1120-1123, 1976.119. Laquis, S. J.; Rodriguez-Galindo, C.; Wilson, M. W.; Fleming, J. C.; Haik, B. G.: Retinoblastoma in a patient with an X;13 translocation and facial abnormalities consistent with 13q-syndrome. Am. J. Ophthal. 133:285-287, 2002.120. Lee, W.-H.; Bookstein, R.; Hong, F.; Young, L.-J.; Shew, J.-Y.; Lee, E. Y.-H. P.: Human retinoblastoma susceptibility gene: cloning, identification, and sequence. Science 235:1394-1399, 1987.121. Lee, W.-H.; Shew, J.-Y.; Hong, F. D.; Sery, T. W.; Donoso, L. A.; Young, L.-J.; Bookstein, R.; Lee, E. Y.-H. P.: The retinoblastoma susceptibility gene encodes a nuclear phosphoprotein associated with DNA binding activity. Nature 329:642-645, 1987.122. Lele, K. P.; Penrose, L. S.; Stallard, H. B.: Chromosome deletion in a case of retinoblastoma. Ann. Hum. Genet. 27:171-174, 1963.123. Lemieux, N.; Messier, P. E.; Jacob, J. L.; Milot, J.; Richer, C. L.: Precise cytogenetic localization of the Rb locus at subband 13q14.11 by ultrastructural detection after immunochemical chromosome banding. (Abstract) Am. J. Hum. Genet. 45 (suppl.): A27, 1989.124. Liu, Z.; Song, Y.; Bia, B.; Cowell, J. K.: Germline mutations in the RB1 gene in patients with hereditary retinoblastoma. Genes Chromosomes Cancer 14:277-284, 1995.125. Lohmann, D. R.; Brandt, B.; Hopping, W.; Passarge, E.; Horsthemke, B.: Spectrum of small length germ line mutations in the RB1 gene. Hum. Molec. Genet. 3:2187-2193, 1994.126. Lohmann, D. R.; Brandt, B.; Hopping, W.; Passarge, E.; Horsthemke, B.: The spectrum of RB1 germline mutations in hereditary retinoblastoma. Am. J. Hum. Genet. 58:940-949, 1996.127. Lohmann, D. R.; Gerick, M.;

Brandt, B.; Oelschlager, U.; Lorenz, B.; Passarge, E.; Horsthemke, B.: Constitutional RB1-gene mutations in patients with isolated unilateral retinoblastoma. Am. J. Hum. Genet. 61:282-294, 1997.128. Lomazzi, M.; Moroni, M. C.; Jensen, M. R.; Frittoli, E.; Helin, K.: Suppression of the p53- or pRB-mediated G1 checkpoint is required for E2F-induced S-phase entry. Nature Genet 31:190-194, 2002.129. Lueder, G. T.; Judisch, G. F.; Wen, B.-C.: Heritable retinoblastoma and pinealoma. Arch. Ophthal. 109:1707-1709, 1991.130. Luo, R. X.; Postigo, A. A.; Dean, D. C.: Rb interacts with histone deacetylase to repress transcription. Cell 92:463-473, 1998.131. Maat-Kievit, J. A.; Oepkes, D.; Hartwig, N. G.; Vermeij-Keers, C.; van Kamp, I. L.; van de Kamp, J. J. P.: A large retinoblastoma detected in a fetus at 21 weeks of gestation. Prenatal Diag. 13:377-384, 1993.132. MacKay, C. J.; Abramson, D. H.; Ellsworth, R. M.: Metastatic patterns of retinoblastoma. Arch. Ophthal. 102:391-396, 1984.133. Macklin, M. T.: A study of retinoblastoma in Ohio. Am. J. Hum. Genet. 12:1-43, 1960.134. Macklin, M. T.: Inheritance of retinoblastoma in Ohio. Arch. Ophthal. 62:842-851, 1959.135. Manchester, P. T., Jr.: Retinoblastoma among offspring of adult survivors. Arch. Ophthal. 65:546-549, 1961.136. Mancini, D.; Singh, S.; Ainsworth, P.; Rodenhiser, D.: Constitutively methylated CpG dinucleotides as mutation hot spots in the retinoblastoma gene (RB1). Am. J. Hum. Genet. 61:80-87, 1997.137. Mancini, M. A.; Shan, B.; Nickerson, J. A.; Penman, S.; Lee, W.-H.: The retinoblastoma gene product is a cell cycle-dependent, nuclear matrix-associated protein. Proc. Nat. Acad. Sci. 91:418-422,1994.138. Marino, S.; Vooijs, M.; van der Gulden, H.; Jonker, J.; Berns, A.: Induction of medulloblastomas in p53-null mutant mice by somatic inactivation of Rb in the external granular layer cells of the cerebellum. Genes Dev. 14:994-1004, 2000.139. Matsunaga, E.: Recurrence risks to relatives of patients with retinoblastoma. Jpn. J. Ophthal. 22:313-319, 1978.140. Matsunaga, E.: Almost synchronous appearance of bilateral retinoblastomas. (Letter) Am. J. Med. Genet. 11:485-487, 1982.141. Matsunaga, E.: Retinoblastoma: mutational mosaicism or host resistance? Am. J. Med. Genet. 8:375-387, 1981.142. Matsunaga, E.: Hereditary retinoblastoma: host resistance and second primary tumors. J. Nat. Cancer Inst. 65:47-51, 1980.143. Matsunaga, E.: Hereditary retinoblastoma: delayed mutation or host resistance? Am. J. Hum. Genet. 30:406-425, 1978.144. Matsunaga, E.; Minoda, K.; Sasaki, M. S.: Parental age and seasonal variation in the births of children with sporadic retinoblastoma: a mutation-epidemiologic study. Hum. Genet. 84:155-158, 1990.145. Michalova, K.; Kloucek, F.; Musilova, J.: Deletion of 13q in two patients with retinoblastoma, one probably due to 13q- mosaicism in the mother. Hum. Genet. 61:264-266, 1982.146. Moll, A. C.; Imhof, S. M.; Schouten-Van Meeteren, A. Y. N.; Kuik, D. J.; Hofman, P.; Boers, M.: Second primary tumors in hereditary retinoblastoma: a register-based study, 1945-1997. Is there an age effect on radiation-related risk? Ophthalmology 108:1109-1114,2001.147. Motegi, T.: Lymphocyte chromosome survey in 42 patients with retinoblastoma: effort to detect 13q14 deletion mosaicism. Hum. Genet. 58:168-173, 1981.148. Motegi, T.: High rate of detection of 13q14 deletion mosaicism among retinoblastoma patients (using more extensive methods). Hum. Genet. 61:95-97, 1982.149. Motegi, T.; Kaga, M.; Yanagawa, Y.; Kadowaki, H.; Watanabe, K.; Inoue, A.; Komatsu, M.; Minoda, K.: A recognizable pattern of the midface of retinoblastoma patients with interstitial deletion of 13q. Hum. Genet. 64:160-162, 1983.150. Motegi, T.; Komatsu, M.; Minoda, K.: Is the interstitial Deletion of 13q in retinoblastoma patients not transmissible? (Letter) Hum. Genet. 64:205, 1983.151. Motegi, T.; Komatsu, M.; Nakazato, Y.; Ohuchi, M.; Minoda, K.: Retinoblastoma in a boy with a de novo mutation of a 13/18 translocation:the assumption that the retinoblastoma locus is at 13q141, particularly at the distal portion of it. Hum. Genet. 60:193-195, 1982.152. Munier, F.; Spence, M. A.; Pescia, G.; Balmer, A.; Gailloud, C.; Thonney, F.; van Melle, G.; Rutz, H. P.: Paternal selection favoring mutant alleles of the retinoblastoma susceptibility gene. Hum. Genet. 89:508-512, 1992.153. Munier, F. L.; Wang, M. X.; Spence, M. A.; Thonney, F.; Balmer, A.; Pescia, G.; Donoso, L. A.; Murphree, A. L.: Pseudo low penetrance in retinoblastoma: fortuitous familial aggregation of sporadic cases caused by independently derived mutations in two large pedigrees. Arch. Ophthal. 111:1507-1511, 1993.154. Murphree, A. L.; Benedict, W. F.: Retinoblastoma: clues to human Oncogenesis. Science 223:1028-1033, 1984.155. Naumova, A.; Hansen, M.; Strong, L.; Jones, P. A.; Hadjistilianou, D.; Mastrangelo, D.; Griegel, S.; Rajewsky, M. F.; Shields, J.; Donoso, L.; Wang, M.; Sapienza, C.: Concordance between parental origin of chromosome 13q loss and chromosome 6p duplication in sporadic retinoblastoma. Am. J. Hum. Genet. 54:274-281, 1994.156. Naumova, A.; Sapienza, C.: The genetics of retinoblastoma, revisited. Am. J. Hum. Genet. 54:264-273, 1994.157. Nevins, J. R.: The Rb/E2F pathway and cancer. Hum. Molec. Genet. 10:699-703, 2001.158. Nichols, W. W.; Miller, R. C.; Sobel, M.; Hoffman, E.; Sparkes, R. S.; Mohandas, T.; Veomett, I.; Davis, J. R.: Further observations on a 13qXp translocation associated with retinoblastoma. Am. J. Ophthal. 89:621-627, 1980.159. Nielsen, S. J.; Schneider, R.; Bauer, U.-M.; Bannister, A. J.; Morrison, A.; O'Carroll, D.; Firestein, R.; Cleary, M.; Jenuwein, T.; Herrera, R. E.; Kouzarides, T.: Rb targets histone H3 methylation and HP1 to promoters. Nature 412:561-565, 2001.160. Nirankari, M. S.; Gulati, G. C.; Chaddah, M. R.: Retinoblastoma:genetics and report of a family. Am. J. Ophthal. 53:523-532, 1962.161. Noorani, H. Z.; Khan, H. N.; Gallie, B. L.; Detsky, A. S.: Cost comparison of molecular versus conventional screening of relatives at risk for retinoblastoma. Am. J. Hum. Genet. 59:301-307, 1996.162. Nussbaum, R.; Puck, J.: Recurrence risks for retinoblastoma:a model for autosomal dominant disorders with complex inheritance. J. Pediat. Ophthal. 13:89-98, 1976.163. Onadim, Z.; Hogg, A.; Baird, P. N.; Cowell, J. K.: Oncogenic point mutations in exon 20 of the RB1 gene in families showing incomplete penetrance and mild expression of the retinoblastoma phenotype. Proc. Nat. Acad. Sci. 89:6177-6181, 1992.164. Onadim, Z.; Woolford, A. J.; Kingston, J. E.; Hungerford, J. L.: The RB1 gene mutation in a child with ectopic intracranial retinoblastoma. Brit. J. Cancer 76:1405-1409, 1997.165. Ono, T.; Yoshida, M. C.: Chromosomal assignment of retinoblastoma1 gene (RB1) to mouse 14D3 and rat 15q12 by fluorescence in situ hybridization. Jpn. J. Genet. 68:617-621, 1993.166. Orye, E.; Benoit, Y.; Coppieters, R.; Jeannin, P.; Vercruysse, C.; Delaey, J.; Delbeke, M.-J.: A case of retinoblastoma, associated with histiocytosis-X and mosaicism of a deleted D-group chromosome (13q14-q31). Clin. Genet. 22:37-39, 1982.167. Orye, E.; Delbeke, M. J.; Vandenabeele, B.: Retinoblastoma and long arm deletion of chromosome 13. Attempts to define the deleted segment. Clin. Genet. 5:457-464, 1974.168. Orye, E.; Delbeke, M. J.; Vandenabeele, B.: Retinoblastoma and D-chromosome deletions. (Letter) Lancet II:1376, 1971.169. Otterson, G. A.; Modi, S.; Nguyen, K.; Coxon, A. B.; Kaye, F. J.: Temperature-sensitive RB mutations linked to incomplete penetrance of familial retinoblastoma in 12 families. Am. J. Hum. Genet. 65:1040-1046, 1999.170. Otterson, G. W.; Chen, W.; Coxon, A. B.; Khleif, S. N.; Kaye, F. J.: Incomplete penetrance of familial retinoblastoma linked to germ-line mutations that result in partial loss of RB function. Proc. Nat. Acad. Sci. 94:12036-12040, 1997. 171. Pendergrass, T. W.; Davis, S.: Incidence of retinoblastoma in the United States. Arch. Ophthal. 98:1204-1210, 1980. 172. Pennaneach, V.; Salles-Passador, I.; Munshi, A.; Brickner, H.; Regazzoni, K.; Dick, F.; Dyson, N.; Chen, T.-T.; Wang, J. Y. J.; Fotedar, R.; Fotedar, A.: The large subunit of replication factor C promotes cell survival after DNA damage in an LxCxE motif- and Rb-dependent manner. Molec. Cell 7:715-727, 2001. 173. Riccardi, V. M.; Hittner, H. M.; Francke, U.; Pippin, S.; Holmquist, G. P.; Kretzer, F. L.; Ferrell, R.: Partial triplication and Deletion of 13q: study of a family presenting with bilateral retinoblastomas. Clin. Genet. 15:332-345, 1979. 174. Rivera, H.; Turleau, C.; de Grouchy, J.; Junien, C.; Despoisse, S.; Zucker, J.-M.: Retinoblastoma-del (13q14): report of two patients, one with a trisomic sib due to maternal insertion; gene-dosage effect for esterase D. Hum. Genet. 59:211-214, 1981. 175. Sakai, T.; Ohtani, N.; McGee, T. L.; Robbins, P. D.; Dryja, T. P.: Oncogenic germ-line mutations in Sp1 and ATF sites in the human retinoblastoma gene. Nature 353:83-86, 1991. 176. Sakai, T.; Ohtani, N.; McGee, T. L.; Robbins, P. D.; Dryja, T. P.: Oncogenic germ-line mutations in Sp1 and ATF sites in the human retinoblastoma gene. Nature 353:83-86, 1991. 177. Sakai, T.; Toguchida, J.; Ohtani, N.; Yandell, D. W.; Rapaport, J. M.; Dryja, T. P.: Allele-specific hypermethylation of the retinoblastoma tumor-suppressor gene. Am. J. Hum. Genet. 48:880-888, 1991. 178. Schappert-Kimmijser, J.; Hemmes, G. D.; Nijland, R.: The heredity of retinoblastoma. Ophthalmologica 151:197-213, 1966. 179. Scheffer, H.; te Meerman, G. J.; Kruize, Y. C. M.; van den Berg, A. H. M.; Penninga, D. P.; Tan, K. E. W. P.; der Kinderen, D. J.; Buys, C. H. C. M.: Linkage analysis of families with hereditary retinoblastoma:nonpenetrance of mutation, revealed by combined use of markers within and flanking the RB1 gene. Am. J. Hum. Genet. 45:252-260, 1989. 180. Schimke, R. N.; Lowman, J.; Cowan, G.: Retinoblastoma and osteogenic sarcoma in sibs. Cancer 34:2077-2079, 1974. 181. Schubert, E. L.; Strong, L. C.; Hansen, M. F.: A splicing mutation in RB1 in low penetrance retinoblastoma. Hum. Genet. 100:557-563, 1997. 182. Shields, C. L.; Honavar, S.; Shields, J. A.; Demirci, H.; Meadows, A. T.: Vitrectomy in eyes with unsuspected retinoblastoma. Ophthalmology 107:2250-2255, 2000. 183. Shiio, Y.; Yamamoto, T.; Yamaguchi, N.: Negative regulation of Rb expression by the p53 gene product. Proc. Nat. Acad. Sci. 89:5206-5210, 1992. 184. Shroeder, W. T.; Chao, L.-Y.; Dao, D. D.; Strong, L. C.; Pathak, S.; Riccardi, V.; Lewis, W. H.; Saunders, G. F.: Nonrandom loss of maternal chromosome 11 alleles in Wilms tumors. Am. J. Hum. Genet. 40:413-420, 1987. 185. Sippel, K. C.; Fraioli, R. E.; Smith, G. D.; Schalkoff, M. E.; Sutherland, J.; Gallie, B. L.; Dryja, T. P.: Frequency of somatic and germ-line mosaicism in retinoblastoma: implications for genetic counseling. Am. J. Hum. Genet. 62:610-619, 1998. 186. Smith, S. M.; Sorsby, A.: Retinoblastoma: some genetic aspects. Ann. Hum. Genet. 23:50-58, 1958. 187. Sparkes, R. S.: The genetics of retinoblastoma. Biochim. Biophys. Acta 780:95-118, 1985. 188. Sparkes, R. S.; Muller, H.; Klisak, I.; Abram, J. A.: Retinoblastoma with 13q; chromosomal deletion associated with maternal paracentric inversion of 13q. Science 203:1027-1029, 1979. 189. Sparkes, R. S.; Murphree, A. L.; Lingua, R. W.; Sparkes, M. C.; Field, L. L.; Funderburk, S. J.; Benedict, W. F.: Gene for hereditary retinoblastoma assigned to human chromosome 13 by linkage to esterase D. Science 219:971-973, 1983. 190. Sparkes, R. S.; Sparkes, M. C.; Wilson, M. G.; Towner, J. W.; Benedict, W.; Murphree, A. L.; Yunis, J. J.: Regional assignment of genes for human esterase D and retinoblastoma to chromosome band 13q14. Science 208:1042-1044, 1980. 191. Sparkes, R. S.; Sparkes, M. C.; Wilson, M. G.; Towner, J. W.; Benedict, W.; Murphree, A. L.; Yunis, J. J.: Regional assignment of genes for human esterase D and retinoblastoma to chromosome band 13q14. (Abstract) Cytogenet. Cell Genet. 25:209, 1979. 192. Squire, J.; Gallie, B. L.; Phillips, R. A.: A detailed analysis of chromosomal changes in heritable and non-heritable retinoblastoma. Hum. Genet. 70:291-301, 1985. 193. Squire, J.; Phillips, R. A.; Boyce, S.; Godbout, R.; Rogers, B.; Gallie, B. L.: Isochromosome 6p, a unique chromosomal abnormality in retinoblastoma: verification by standard staining techniques, new densitometric methods, and somatic cell hybridization. Hum. Genet. 66:46-53, 1984. 194. Stallard, H. B.: The conservation treatment of retinoblastoma. Trans. Ophthal. Soc. 82:473, 1962. 195. Stone, J. C.; Crosby, J. L.; Kozak, C. A.; Schievella, A. R.; Bernards, R.; Nadeau, J. H.: The murine retinoblastoma homolog maps to chromosome 14 near Es-10. Genomics 5:70-75, 1989. 196. Strong, L. C.; Riccardi, V. M.; Ferrell, R. E.; Sparkes, R. S.: Familial retinoblastoma and chromosome 13 deletion transmitted via an insertional translocation. Science 213:1501-1503, 1981. 197. Taylor, A. I.: Dq-, Dr and retinoblastoma. human genetik 10:209-217, 1970. 198. Thomas, D. M.; Carty, S. A.; Piscopo, D. M.; Lee, J.-S.; Wang, W.-F.; Forrester, W. C.; Hinds, P. W.: The retinoblastoma protein acts as a transcriptional coactivator required for osteogenic differentiation. Molec. Cell 8:303-316, 2001. 199. Toguchida, J.; Ishizaki, K.; Sasaki, M. S.; Nakamura, Y.; Ikenaga, M.; Kato, M.; Sugimot, M.; Kotoura, Y.; Yamamuro, T.: Preferential mutation of paternally derived RB gene as the initial event in sporadic osteosarcoma. Nature 338:156-158, 1989. 200. Toguchida, J.; McGee, T. L.; Paterson, J. C.; Eagle, J. R.; Tucker, S.; Yandell, D. W.; Dryja, T. P.: Complete genomic sequence of the human retinoblastoma susceptibility gene. Genomics 17:535-543, 1993. 201. Turleau, C.; de Grouchy, J.; Chavin-Colin, F.; Despoisses, S.; Leblanc, A.: Two cases of del (13q)-retinoblastoma and two cases of partial trisomy due to a familial insertion. Ann. Genet. 26:158-160, 1983. 202. Turleau, C.; de Grouchy, J.; Chavin-Colin, F.; Junien, C.; Seger, J.; Schlienger, P.; Leblanc, A.; Haye, C.: Cytogenetic forms of retinoblastoma:their incidence in a survey of 66 patients. Cancer Genet. Cytogenet. 16:321-334, 1985. 203. Verma, R. S.; Ramesh, K. H.; Samonte, R. V.; Conte, R. A.: Mapping the homolog of the human Rb1 gene to chromosome 14 of higher primates. Mammalian Genome 7:591-592, 1996. 204. Vogel, F.: Genetics of retinoblastoma. Modern Trends in Ophthalmology. (pub.) 1968. 205. Vogel, F.: Genetics of retinoblastoma. In: Genetic Counseling. Heidelberg University, Science Library. Trans. by Sabine Kurth. New York: Springer Verlag (pub.) 1969. 206. Vogel, F.: The genetics of retinoblastoma. Hum. Genet. 52:1-54, 1979. 207. Warburg, M.: Retinoblastoma. In: Goldberg, M. F.: Genetic and Metabolic Eye Disease. Boston: Little, Brown and Co. (pub.) 1974. Pp. 447-461. 208. Weichselbaum, R. R.; Beckett, M.; Diamond, A.: Some retinoblastomas, osteosarcomas, and soft tissue sarcomas may share a common etiology. Proc. Nat. Acad. Sci. 85:2106-2109, 1988. 209. Weichselbaum, R. R.; Nove, J.; Little, J. B.: Fibroblasts from a D-deletion type retinoblastoma patient are abnormally x-ray sensitive. Nature 266:726-727, 1977. 210. Weinberg, R. A.: The retinoblastoma protein and cell cycle control. Cell 81:323-330, 1995. 211. Whyte, P.; Buchkovich, K. J.; Horowitz, J. M.; Friend, S. H.; Raybuck, M.; Weinberg, R. A.; Harlow, E.: Association between an oncogene and an anti-oncogene: the adenovirus E1A proteins bind to the retinoblastoma gene product. Nature 334:124-129, 1988. 212. Wiggs, J.; Nordenskjold, M.; Yandell, D.; Rapaport, J.; Grondin, V.; Janson, M.; Werelius, B.; Petersen, R.; Craft, A.; Riedel, K.; Liberfarb, R.; Walton, D.; Wilson, W.; Dryja, T. P.: Prediction of the risk of hereditary retinoblastoma, using DNA polymorphisms within the retinoblastoma gene. New Eng. J. Med. 318:151-157, 1988.213. Wilson, M. G.; Ebbin, A. J.; Towner, J. W.; Spencer, W. H.:Chromosomal anomalies in patients with retinoblastoma. Clin. Genet. 12:1-8, 1977.214. Wilson, M. G.; Melnyk, J.; Towner, J. W. J.: Retinoblastoma and deletion D(14) syndrome. J. Med. Genet. 6:322-327, 1969.215. Wilson, M. G.; Towner, J. W.; Fujimoto, A.: Retinoblastoma and D-chromosome deletions. Am. J. Hum. Genet. 25:57-61, 1973.216. Windle, J. J.; Albert, D. M.; O'Brien, J. M.; Marcus, D. M.; Disteche, C. M.; Bernards, R.; Mellon, P. L.: Retinoblastoma in transgenic mice. Nature 343:665-669, 1990.217. Yandell, D. W.; Campbell, T. A.; Dayton, S. H.; Petersen, R.; Walton, D.; Little, J. B.; McConkie-Rosell, A.; Buckley, E.; Dryja, T.: Oncogenic point mutations in the human retinoblastoma gene: their application to genetic counseling. New Eng. J. Med. 321:1689-1695,1989.218. Yokota, J.; Akiyama, T.; Fung, Y.-K. T.; Benedict, W. F.; Namba, Y.; Hanaoka, M.; Wada, M.; Terasaki, T.; Shimosato, Y.; Sugimura, T.; Terada, M.: Altered expression of the retinoblastoma (RB) gene in small-cell carcinoma of the lung. Oncogene 3:471-475, 1988.219. Zeschnigk, M.; Lohmann, D.; Horsthemke, B.: A PCR test for the detection of hypermethylated alleles at the retinoblastoma locus. J. Med. Genet. 36:793-794, 1999.220. Zhang, H. S.; Postigo, A. A.; Dean, D. C.: Active transcriptional repression by the Rb-E2F complex mediates G1 arrest triggered by p16 (INK4a), TGF-beta, and contact inhibition. Cell 97:53-61, 1999.221. Zhu, X.; Dunn, J. M.; Phillips, R. A.; Goddard, A. D.; Paton, K. E.; Becker, A.; Gallie, B. L.: Preferential germ line mutation of the paternal allele in retinoblastoma. Nature 340:312-313, 1989.

Baens, M.; Aerssens, J.; Van Zand, K.; Van den Berghe, H.; Marynen, P.: Isolation and regional assignment of human chromosome 12p cDNAs. Genomics 29:44-52, 1995.

Baldi, A.; Boccia, V.; Claudio, P. P.; De Luca, A.; Giordano, A.: Genomic structure of the human retinoblastoma-related Rb2/p130 gene. Proc. Nat. Acad. Sci. 93:4629-4632, 1996.

Mayol, X.; Grana, X.; Baldi, A.; Sang, N.; Hu, Q.; Giordano, A.: Cloning of a new member of the retinoblastoma gene family (pRb2) which binds to the E1A transforming domain. Oncogene 8:2561-2566,1993.

Yeung, R. S.; Bell, D. W.; Testa, J. R.; Mayol, X.; Baldi, A.; Grana, X.; Klinga-Levan, K.; Knudson, A. G.; Giordano, A.: The retinoblastoma-related gene, RB2, maps to human chromosome 16q12 and rat chromosome 19. Oncogene 8:3465-3468, 1993.

Benbrook, D.; Lernhardt, E.; Pfahl, M.: A new retinoic acid receptor identified from a hepatocellular carcinoma. (Letter) Nature 333:669-672, 1988.

Brand, N.; Petkovich, M.; Krust, A.; Chambon, P.; de The, H.; Marchio, A.; Tiollais, P.; Dejean, A.: Identification of a second human retinoic acid receptor. (Letter) Nature 332:850-853, 1988.

Dejean, A.; Bougueleret, L.; Grzeschik, K.-H.; Tiollais, P.: Hepatitis B virus DNA integration in a sequence homologous to v-erb-A and steroid receptor genes in a hepatocellular carcinoma. Nature 322:70-72,1986.

de The, H.; del Mar Vivanco-Ruiz, M.; Tiollais, P.; Stunnenberg, H.; Dejean, A.: Identification of a retinoic acid responsive element in the retinoic acid receptor beta gene. Nature 343:177-180, 1990.

Aruffo, A.; Seed, B.: Molecular cloning of a CD28 cDNA by a high-efficiency COS cell expression system. Proc. Nat. Acad. Sci. 84:8573-8577,1987.

Lafage-Pochitaloff, M.; Costello, R.; Couez, D.; Simonetti, J.; Mannoni, P.; Mawas, C.; Olive, D.: Human CD28 and CTLA-4 Ig superfamily genes are located on chromosome 2 at bands q33-q34. Immunogenetics 31:198-201, 1990.

Lee, K. P.; Taylor, C.; Petryniak, B.; Turka, L. A.; June, C. H.; Thompson, C. B.: The genomic organization of the CD28 gene: implications for the regulation of CD28 mRNA expression and heterogeneity. J. Immun. 145:344-352, 1990.

Lesslauer, W.; Gmunder, H.; Bohlen, P.: Purification and N-terminal amino acid sequence of the human T90/44 (CD28) antigen. Immunogenetics 27:388-391, 1988.

Okkenhaug, K.; Wu, L.; Garza, K. M.; La Rose, J.; Khoo, W.; Odermatt, B.; Mak, T. W.; Ohashi, P. S.; Rottapel, R.: A point mutation in CD28 distinguishes proliferative signals from survival signals. Nature Immun. 2:325-332, 2001.

Dear, T. N.; Colledge, W. H.; Carlton, M. B. L.; Lavenir, I.; Larson, T.; Smith, A. J. H.; Warren, A. J.; Evans, M. J.; Sofroniew, M. V.; Rabbitts, T. H.: The Hox11 gene is essential for cell survival during spleen development. Development 121:2909-2915, 1995.

Dear, T. N.; Sanchez-Garcia, I.; Rabbitts, T. H.: The HOX11 gene encodes a DNA-binding nuclear transcription factor belonging to a distinct family of homeobox genes. Proc. Nat. Acad. Sci. 90:4431-4435,1993.

Dube, I. D.; Kamel-Reid, S.; Yuan, C. C.; Lu, M.; Wu, X.; Corpus, G.; Raimondi, S. C.; Crist, W. M.; Carroll, A. J.; Minowada, J.; Baker, J. B.: A novel human homeobox gene lies at the chromosome 10 break point in lymphoid neoplasias with chromosomal translocation t (10;14). Blood 78:2996-3003, 1991.

Hatano, M.; Roberts, C. W. M.; Minden, M.; Crist, W. M.; Korsmeyer, S. J.: Deregulation of a homeobox gene, HOX11, by the t (10;14) in T cell leukemia. Science 253:79-82, 1991.

Kagan, J.; Finan, J.; Letofsky, J.; Besa, E. C.; Nowell, P. C.; Croce, C. M.: Alpha-chain locus of the T-cell antigen receptor is involved in the t (10;14) chromosome translocation of T-cell acute lymphocytic leukemia. Proc. Nat. Acad. Sci. 84:4543-4546, 1987.

Kennedy, M. A.; Gonzalez-Sarmiento, R.; Kees, U. R.; Lampert, F.; Dear, N.; Boehm, T.; Rabbitts, T. H.: HOX11, a homeobox-containing T-cell oncogene on human chromosome 10q24. Proc. Nat. Acad. Sci. 88:8900-8904, 1991.

Lu, M.; Gong, Z. Y.; Shen, W. F.; Ho, A. D.: The TCL-3 proto-oncogene altered by chromosomal translocation in T-cell leukemia codes for a homeobox protein. EMBO J. 10:2905-2910, 1991.

Roberts, C. W. M.; Shutter, J. R.; Korsmeyer, S. J.: Hox11 controls the genesis of the spleen. Nature 368:747-750, 1994.

Zutter, M.; Hockett, R. D.; Roberts, C. W. M.; McGuire, E. A.; Bloomstone, J.; Morton, C. C.; Deaven, L. L.; Crist, W. M.; Carroll, A. J.; Korsmeyer, S. J.: The t (10;14)(q24; q11) of T-cell acute lymphoblastic leukemia juxtaposes the delta T-cell receptor with TCL3, a conserved and activated locus at 10q24. Proc. Nat. Acad. Sci. 87:3161-3165,1990.

Alarcon, B.; Regueiro, J. R.; Arnaiz-Villena, A.; Terhorst, C.: Familial defect in the surface expression of the T-cell receptor-CD3 complex. New Eng. J. Med. 319:1203-1208, 1988.

Caplan, S.; Zeliger, S.; Wang, L.; Baniyash, M.: Cell-surface-expressed T-cell antigen-receptor epsilon chain is associated with the cytoskeleton. Proc. Nat. Acad. Sci. 92:4768-4772, 1995.

Clevers, H.; Alarcon, B.; Wileman, T.; Terhorst, C.: The T cell receptor/CD3 complex: a dynamic protein ensemble. Annu. Rev. Immun. 6:629-662, 1988.

Grakoui, A.; Bromley, S. K.; Sumen, C.; Davis, M. M.; Shaw, A. S.; Allen, P. M.; Dustin, M. L.: The immunological synapse: a molecular machine controlling T cell activation. Science 285:221-227, 1999.

Krummel, M. F.; Sjaastad, M. D.; Wulfing, C.; Davis, M. M.: Differential clustering of CD4 and CD3-zeta during T cell recognition. Science 289:1349-1352, 2000.

Weissman, A. M.; Baniyash, M.; Hou, D.; Samelson, L. E.; Burgess, W. H.; Klausner, R. D.: Molecular cloning of the zeta chain of the T cell antigen receptor. Science 239:1018-1021, 1988.

Weissman, A. M.; Hou, D.; Orloff, D. G.; Modi, W. S.; Seuanez, H.; O'Brien, S. J.; Klausner, R. D.: Molecular cloning and chromosomal localization of the human T-cell receptor zeta chain: distinction from the molecular CD3 complex. Proc. Nat. Acad. Sci. 85:9709-9713,1988.

Weissman, A. M.; Samelson, L. E.; Klausner, R. D.: A new subunit of the human T-cell antigen receptor complex. Nature 324:480-482,1986.

Yu, C. Y.; Milstein, C.: A physical map linking the five CD1 human thymocyte differentiation antigen genes. EMBO J. 8:3727-3732, 1989.

Zeng, Z.-H.; Castano, A. R.; Segelke, B. W.; Stura, E. A.; Peterson, P. A.; Wilson, I. A.: Crystal structure of mouse CD1: an MHC-like fold with a large hydrophobic binding groove. Science 277:339-345,1997.

Eschenfeldt, W. H.; Berger, S. L.: The human prothymosin alpha gene is polymorphic and induced upon growth stimulation: evidence using a cloned cDNA. Proc. Nat. Acad. Sci. 83:9403-9407, 1986.

Goodall, G. J.; Dominguez, F.; Horecker, B. L.: Molecular cloning of cDNA for human prothymosin alpha. Proc. Nat. Acad. Sci. 83:8926-8928,1986.

Haritos, A. A.; Goodall, G. J.; Horecker, B. L.: Prothymosin alpha:isolation and properties of the major immunoreactive form of thymosin alpha-1 in rat thymus. Proc. Nat. Acad. Sci. 81:1008-1011, 1984.

Manrow, R. E.; Leone, A.; Krug, M. S.; Eschenfeldt, W. H.; Berger, S. L.: The human prothymosin alpha gene family contains several processed pseudogenes lacking deleterious lesions. Genomics 13:319-331, 1992.

Szabo, P.; Panneerselvam, C.; Clinton, M.; Frangou-Lazaridis, M.; Weksler, D.; Whittington, E.; Macera, M. J.; Grzeschik, K.-H.; Selvakumar, A.; Horecker, B. L.: Prothymosin alpha-gene in human S: organization of its promoter region and localization to chromosome 2. Hum. Genet. 90:629-634, 1993.

Demczuk, S.; Aledo, R.; Zucman, J.; Delattre, O.; Desmaze, C.; Dauphinot, L.; Jalbert, P.; Rouleau, G. A.; Thomas, G.; Aurias, A.: Cloning of a balanced translocation break point in the DiGeorge syndrome critical region and isolation of a novel potential adhesion receptor gene in its vicinity. Hum. Molec. Genet. 4:551-558, 1995.

Riewald, M.; Petrovan, R. J.; Donner, A.; Mueller, B. M.; Ruf, W.: Activation of endothelial cell protease activated receptor 1 by the protein C pathway. Science 296:1880-1882, 2002.

Jankowski, S. A.; De Jong, P.; Meltzer, P. S.: Genomic structure of SAS, a member of the transmembrane 4 superfamily amplified in human sarcomas. Genomics 25:501-506, 1995.

Meltzer, P. S.; Jankowski, S. A.; Dal Cin, P.; Sandberg, A. A.; Paz, I. B.; Coccia, M. A.; Smith, S. H.: Identification and cloning of a novel amplified DNA sequence in human malignant fibrous histiocytoma derived from a region of chromosome 12 frequently rearranged in soft tissue tumors. (Abstract) Cytogenet. Cell Genet. 58:1979 only,1991.

Shao, X.; Tarnasky, H. A.; Schalles, U.; Oko, R.; van der Hoorn, F. A.: Interactional cloning of the 84-kDa major outer dense fiber protein Odf84: leucine zippers mediate associations of Odf84 and Odf27. J. Biol. Chem. 272:6105-6113, 1997.

Shao, X.; van der Hoorn, F. A.: Self-interaction of the major 27-kilo dalton outer dense fiber protein is in part mediated by a leucine zipper domain in the rat. Biol. Reprod. 55:1343-1350, 1996.

Lee, H. S.; Sambuughin, N.; Cervenakova, L.; Chapman, J.; Pocchiari, M.; Litvak, S.; Qi, H. Y.; Budka, H.; del Ser, T.; Furukawa, H.; Brown, P.; Gajdusek, D. C.; Long, J. C.; Korczyn, A. D.; Goldfarb, L. G.: Ancestral origins and worldwide distribution of the PRNP 200K mutation causing familial Creutzfeldt-Jakob disease. Am. J. Hum. Genet. 64:1063-1070, 1999.

de The, H.; Marchio, A.; Tiollais, P.; Dejean, A.: A novel steroid thyroid hormone receptor-related gene inappropriately expressed in human hepatocellular carcinoma. Nature 330:667-670, 1987.

Patel, A.; Rochelle, J. M.; Jones, J. M.; Sumegi, J.; Uhl, G. R.; Seldin, M. F.; Meisler, M. H.; Gregor, P.: Mapping of the taurine transporter gene to mouse chromosome 6 and to the short arm of human chromosome 3. Genomics 25:314-317, 1995.

Ramamoorthy, S.; Leibach, F. H.; Mahesh, V. B.; Han, H.; Yang-Feng, T.; Blakely, R. D.; Ganapathy, V.: Functional characterization and chromosomal localization of a cloned taurine transporter from human placenta. Biochem. J. 300: 893-900, 1994.

Liao, Y.-C. J.; Lebo, J.; Lebo, R. V.; Clawson, G. A.; Smuckler, E. A.: Human prion protein cDNA: molecular cloning, chromosomal mapping, and biological implications. Science 233:364-367, 1986.

Lindquist, S.: Mad cows meet Psi-chotic yeast: the expansion of the prion hypothesis. Cell 89:495-498, 1997.

Little, B. W.; Brown, B. W.; Rodgers-Johnson, P.; Perl, D. P.; Gajdusek, D. C.: Familial myoclonic dementia masquerading as Creutzfeldt-Jakob disease. Ann. Neurol. 20:231-239, 1986.

Lloyd, S. E.; Onwuazor, O. N.; Beck, J. A.; Mallinson, G.; Farrall, M.; Targonski, P.; Collinge, J.; Fisher, E. M. C.: Identification of multiple quantitative trait loci linked to prion disease incubation period in mice. Proc. Nat. Acad. Sci. 98:6279-6283, 2001.

Lugaresi, E.; Medori, R.; Montagna, P.; Baruzzi, A.; Cortelli, P.; Lugaresi, A.; Tinuper, P.; Zucconi, M.; Gambetti, P.: Fatal familial insomnia and dysautonomia with selective degeneration of thalamic nuclei. New Eng. J. Med. 315:997-1003, 1986.

Lugaresi, E.; Montagna, P.; Baruzzi, A.; Cortelli, P.; Tinuper, P.; Zucconi, M.; Gambetti, P. L.; Medori, R.: Insomnie familiale a evolution maligne: une nouvelle maladie thalamique. Rev. Neurol. 142:791-792, 1986.

Mahal, S. P.; Asante, E. A.; Antoniou, M.; Collinge, J.: Isolation and functional characterisation of the promoter region of the human prion protein gene. Gene 268:105-114, 2001.

Mallucci, G. R.; Ratte, S.; Asante, E. A.; Linehan, J.; Gowland, I.; Jefferys, J. G. R.; Collinge, J.: Post-natal knockout of prion protein alters hippocampal CA1 properties, but does not result in neurodegeneration. EMBO J. 21:202-210, 2002.

Mallucci, G. R.; Campbell, T. A.; Dickinson, A.; Beck, J.; Holt, M.; Plant, G.; de Pauw, K. W.; Hakin, R. N.; Clarke, C. E.; Howell, S.; Davies-Jones, G. A. B.; Lawden, M.; Smith, C. M. L.; Ince, P.; Ironside, J. W.; Bridges, L. R.; Dean, A.; Weeks, I.; Collinge, J.: Inherited prion disease with an alanine to valine mutation at codon 117 in the prion protein gene. Brain 122:1823-1837, 1999.

Manetto, V.; Medori, R.; Cortelli, P.; Montagna, P.; Tinuper, P.; Baruzzi, A.; Rancurel, G.; Hauw, J.-J.; Vanderhaeghen, J.-J.; Mailleux, P.; Bugiani, O.; Tagliavini, F.; Bouras, C.; Rizzuto, N.; Lugaresi, E.; Gambetti, P.: Fatal familial insomnia: clinical and pathologic study of 5 new cases. Neurology 42:312-319, 1992.

Manolakou, K.; Beaton, J.; McConnell, I.; Farquar, C.; Manson, J.; Hastie, N. D.; Bruce, M.; Jackson, I. J.: Genetic and environmental factors modify bovine spongiform encephalopathy incubation period in mice. Proc. Nat. Acad. Sci. 98:7402-7407, 2001.

Manson, J. C.; Clarke, A. R.; McBride, P. A.; McConnell, I.; Hope, J.: PrP gene dosage determines the timing but not the final intensity or distribution of lesions in scrapie pathology. Neurodegeneration 3:331-340, 1994.

Mastrianni, J. A.; Capellari, S.; Telling, G. C.; Han, D.; Bosque, P.; Prusiner, S. B.; DeArmond, S. J.: Inherited prion disease caused by the V201I mutation: transmission to transgenic mice. Neurology 57:2198-2205, 2001.

Mastrianni, J. A.; Curtis, M. T.; Oberholtzer, J. C.; Da Costa, M. M.; DeArmond, S.; Prusiner, S. B.; Garbern, J. Y.: Prion disease (PrP-A117V) presenting with ataxia instead of dementia. Neurology 45:2042-2050, 1995.

Mead, S.; Mahal, S. P.; Beck, J.; Campbell, T.; Farrall, M.; Fisher, E.; Collinge, J.: Sporadic--but not variant-- Creutzfeldt-Jakob disease is associated with polymorphisms upstream of PRNP exon 1. Am. J. Hum. Genet. 69:1225-1235, 2001.

Medori, R.: Personal Communication. New York, N. Y. May 17, 1990.100. Medori, R.; Montagna, P.; Tritschler, H. J.; LeBlanc, A.; Cortelli, P.; Tinuper, P.; Lugaresi, E.; Gambetti, P.: Fatal familial insomnia: a second kindred with mutation of prion protein gene at codon 178. Neurology 42:669-670, 1992.101. Medori, R.; Tritschler, H.-J.: Prion protein gene analysis in three kindreds with fatal familial insomnia (FFI): codon 178 mutation and codon 129 polymorphism. Am. J. Hum. Genet. 53:822-827, 1993.102. Medori, R.; Tritschler, H.-J.; LeBlanc, A.; Villare, F.; Manetto, V.; Chen, H. Y.; Xue, R.; Leal, S.; Montagna, P.; Cortelli, P.; Tinuper, P.; Avoni, P.; Mochi, M.; Baruzzi, A.; Hauw, J. J.; Ott, J.; Lugaresi, E.; Autilio-Gambetti, L.; Gambetti, P.: Fatal familial insomnia, a prion disease with a mutation at codon 178 of the prion protein gene. New Eng. J. Med. 326:444-449, 1992.103. Meggendorfer, F.: Klinische und genealogische Beobachtungenbei einem Fall von spastischer Pseudosklerose Jakobs. Z. Ges. Neurol. Psychiat. 128:337-341, 1930.104. Meiner, Z.; Gabizon, R.; Prusiner, S. B.: Familial Creutzfeldt-Jakob disease: codon 200 prion disease in Libyan Jews. Medicine 76:227-237,1997.105. Mestel, R.: Putting prions to the test. Science 273:184-189,1996.106. Miele, G.; Jeffrey, M.; Turnbull, D.; Manson, J.; Clinton, M.: Ablation of cellular prion protein expression affects mitochondrial numbers and morphology. Biochem. Biophys. Res. Commun. 291:372-377,2002.107. Mishra, R. S.; Gu, Y.; Bose, S.; Verghese, S.; Kalepu, S.; Singh, N.: Cell surface accumulation of a truncated transmembrane prion protein in Gerstmann-Straussler-Scheinker disease P102L. J. Biol. Chem. 277:24554-24561, 2002.108. Mitrova, E.; Lowenthal, A.; Appeal, B.: Familial Creutzfeldt-Jakob disease with temporal and spatial separation of affected members. Europ. J. Epidemiol. 6:233-238, 1990.109. Monari, L.; Chen, S. G.; Brown, P.; Parchi, P.; Petersen, R. B.; Mikol, J.; Gray, F.; Cortelli, P.; Montagna, P.; Ghetti, B.; Goldfarb, L. G.; Gajdusek, D. C.; Lugaresi, E.; Gambetti, P.; Autilio-Gambetti, L.: Fatal familial insomnia and familial Creutzfeldt-Jakob disease:different prion proteins determined by a DNA polymorphism. Proc. Nat. Acad. Sci. 91:2839-2842, 1994.110. Montrasio, F.; Frigg, R.; Glatzel, M.; Klein, M. A.; Mackay, F.; Aguzzi, A.; Weissmann, C.: Impaired prion replication in spleens of mice lacking functional follicular dendritic cells. Science 288: 1257-1259, 2000.111. Moore, R. C.; Xiang, F.; Monaghan, J.; Han, D.; Zhang, Z.; Edstrom, L.; Anvret, M.; Prusiner, S. B.: Huntington disease phenocopy is a familial prion disease. Am. J. Hum. Genet. 69:1385-1388, 2001.112. Mouillet-Richard, S.; Ermonval, M.; Chebassier, C.; Laplanche, J. L.; Lehmann, S.; Launay, J. M.; Kellermann, O.: Signal transduction through prion protein. Science 289:1925-1928, 2000.113. Mouillet-Richard, S.; Teil, C.; Lenne, M.; Hugon, S.; Taleb, O.; Laplanche, J.-L.: Mutation at codon 210 (V210I) of the prion protein gene in a North African patient with Creutzfeldt-Jakob disease. J. Neurol. Sci. 168:141-144, 1999.114. Nieto, A.; Goldfarb, L. G.; Brown, P.; McCombie, W. R.; Trapp, S.; Asher, D. M.; Gajdusek, D. C.: Codon 178 mutation in ethnically diverse Creutzfeldt-Jakob disease families. (Letter) Lancet 337:622-623, 1991.115. Nitrini, R.; Rosemberg, S.; Passos-Bueno, M. R.; da Silva, L. S. T.; Iughetti, P.; Papadopoulos, M.; Carrilho, P. M.; Caramelli, P.; Albrecht, S.; Zatz, M.; LeBlanc, A.: Familial spongiform encephalopathy associated with a novel prion protein gene mutation. Ann. Neurol. 42:138-146, 1997.116. Oesch, B.; Westaway, D.; Walchli, M.; McKinley, M. P.; Kent, S. B. H.; Aebersold, R.; Barry, R. A.; Tempst, P.; Teplow, D. B.; Hood, L. E.; Prusiner, S. B.; Weissmann, C.: A cellular gene encodes scrapie PrP 27-30 protein. Cell 40:735-746, 1985.117. Owen, F.; Poulter, M.; Collinge, J.; Crow, T. J.: Codon 129 changes in the prion protein gene in Caucasians. (Letter) Am. J. Hum. Genet. 46:1215-1216, 1990.118. Owen, F.; Poulter, M.; Collinge, J.; Crow, T. J.: A codon 129 polymorphism in the PRIP gene. Nucleic Acids Res. 18:3103, 1990.119. Owen, F.; Poulter, M.; Collinge, J.; Leach, M.; Lofthouse, R.; Crow, T. J.; Harding, A. E.: A dementing illness associated with a novel insertion in the prion protein gene. Molec. Brain Res. 13:155-157, 1992.120. Owen, F.; Poulter, M.; Lofthouse, R.; Collinge, J.; Crow, T. J.; Risby, D.; Baker, H. F.; Ridley, R. M.; Hsiao, K.; Prusiner, S. B.: Insertion in prion protein gene in familial Creutzfeldt-Jakob disease. (Letter) Lancet I:51-52, 1989.121. Owen, F.; Poulter, M.; Shah, T.; Collinge, J.; Lofthouse, R.; Baker, H.; Ridley, R.; McVey, J.; Crow, T. J.: An in-frame insertion in the prion protein gene in familial Creutzfeldt-Jakob disease. Molec. Brain Res. 7:273-276, 1990.122. Pablos-Mendez, A.; Netto, E. M.; Defendini, R.: Infectious prions or cytotoxic metabolites? Lancet 341:159-161, 1993.123. Palmer, M. S.; Collinge, J.: Mutations and polymorphisms in the prion protein gene. Hum. Mutat. 2:168-173, 1993.124. Palmer, M. S.; Dryden, A. J.; Hughes, J. T.; Collinge, J.: Homozygous prion protein genotype predisposes to sporadic Creutzfeldt-Jakob disease. Nature 352:340-342, 1991. Note: Erratum: Nature 352:547 only, 1991.125. Panegyres, P. K.; Toufexis, K.; Kakulas, B. A.; Cernevakova, L.; Brown, P.; Ghetti, B.; Piccardo, P.; Dlouhy, S. R.: A new PRNP mutation (G131V) associated with Gerstmann-Straussler-Scheinker disease. Arch. Neurol. 58:1899-1902, 2001.126. Peretz, D.; Williamson, R. A.; Kaneko, K.; Vergara, J.; Leclerc, E.; Schmitt-Ulms, G.; Mehlhorn, I. R.; Legname, G.; Wormald, M. R.; Rudd, P. M.; Dwek, R. A.; Burton, D. R.; Prusiner, S. B.: Antibodies inhibit prion propagation and clear cell cultures of prion infectivity. Nature 412:739-743, 2001.127. Perry, R. T.; Go, R. C. P.; Harrell, L. E.; Acton, R. T.: SSCP analysis and sequencing of the human prion protein gene (PRNP) detects two different 24 bp deletions in an atypical Alzheimer's disease family. Am. J. Med. Genet. 60:12-18, 1995.128. Petchanikow, C.; Saborio, G. P.; Anderes, L.; Frossard, M.-J.; Olmedo, M. I.; Soto, C.: Biochemical and structural studies of the prion protein polymorphism. FEBS Lett. 509:451-456, 2001.
129. Plaitakis, A.; Viskadouraki, A. K.; Tzagournissakis, M.; Zaganas, I.; Verghese-Nikolakaki, S.; Karagiorgis, V.; Panagiotides, I.; Kilindireas, C.; Patsouris, E.; Haberler, C.; Budka, H.; Sklaviadis, T.: Increased incidence of sporadic Creutzfeldt-Jakob disease on the island of Crete associated with a high rate of PRNP 129-methionine homozygosity in the local population. Ann. Neurol. 50:227-233, 2001.
130. Pocchiari, M.; Salvatore, M.; Cutruzzola, F.; Genuardi, M.; Allcatelli, C. T.; Masullo, C.; Macchi, G.; Alema, G.; Galgani, S.; Xi, Y. G.; Petraroli, R.; Silvestrini, M. C.; Brunori, M.: A new point mutation of the prion protein gene in Creutzfeldt-Jakob disease. Ann. Neurol. 34:802-807, 1993.
131. Poulter, M.; Baker, H. F.; Frith, C. D.; Leach, M.; Lofthouse, R.; Ridley, R. M.; Shah, T.; Owen, F.; Collinge, J.; Brown, J.; Hardy, J.; Mullan, M. J.; Harding, A. E.; Bennett, C.; Doshi, R.; Crow, T. J.: Inherited prion disease with 144 base pair gene insertion. 1. Genealogical and molecular studies. Brain 115:675-685, 1992.
132. Prusiner, S. B.: Molecular biology and genetics of prion diseases. Cold Spring Harbor Symp. Quant. Biol. 61:473-493, 1996.
133. Prusiner, S. B.: Prions causing degenerative neurological diseases. Annu. Rev. Med. 38:381-398, 1987.
134. Prusiner, S. B.: Molecular biology of prion diseases. Science 252:1515-1522, 1991.
135. Prusiner, S. B.: Biology and genetics of prion diseases. Ann. Rev. Microbiol. 48:655-686, 1994.
136. Prusiner, S. B.: Novel proteinaceous infectious particles cause scrapie. Science 216:136-144, 1982.
137. Puckett, C.; Concannon, P.; Casey, C.; Hood, L.: Genomic structure of the human prion protein gene. Am. J. Hum. Genet. 49:320-329, 1991.
138. Reder, A. T.; Mednick, A. S.; Brown, P.; Spire, J. P.; Cauter, V.; Wollmann, R. L.; Cervenakova, L.; Goldfarb, L. G.; Garay, A.; Ovsiew, F.; Gajdusek, D. C.; Roos, R. P.: Clinical and genetic studies of fatal familial insomnia. Neurology 45:1068-1075, 1995.
139. Riek, R.; Wider, G.; Billeter, M.; Hornemann, S.; Glockshuber, R.; Wuthrich, K.: Prion protein NMR structure and familial human spongiform encephalopathies. Proc. Nat. Acad. Sci. 95:11667-11672, 1998.
140. Rivera, H.; Zuffardi, O.; Maraschio, P.; Caiulo, A.; Anichini, C.; Scarinci, R.; Vivarelli, R.: Alternate centromere inactivation in a pseudodicentric (15;20)(pter; pter) associated with a progressive neurological disorder. J. Med. Genet. 26:626-630, 1989.
141. Robakis, N. K.; Devine-Gage, E. A.; Jenkins, E. C.; Kascsak, R. J.; Brown, W. T.; Krawczun, M. S.; Silverman, W. P.: Localization of a human gene homologous to the PrP gene on the p arm of chromosome 20 and detection of PrP-related antigens in normal human brain. Biochem. Biophys. Res. Commun. 140:758-765, 1986.
142. Sailer, A.; Bueler, H.; Fischer, M.; Aguzzi, A.; Weissmann, C.: No propagation of prions in mice devoid of PrP. Cell 77:967-968, 1994.
143. Sakaguchi, S.; Katamine, S.; Nishida, N.; Moriuchi, R.; Shigamatsu, K.; Sugimoto, T.; Nakatani, A.; Kataoka, Y.; Houtani, T.; Shirabe, S.; Okada, H.; Hasegawa, S.; Miyamoto, T.; Noda, T.: Loss of cerebellar Purkinje cells in aged mice homozygous for a disrupted PrP gene. Nature 380:528-531, 1996.
144. Samaia, H. B.; Mari, J. J.; Vallada, H. P.; Moura, R. P.; Simpson, A. J. G.; Brentani, R. R.: A prion-linked psychiatric disorder. Nature 390:241 only, 1997.
145. Schellenberg, G. D.; Anderson, L.; O'dahl, S.; Wisjman, E. M.; Sadovnick, A. D.; Ball, M. J.; Larson, E. B.; Kukull, W. A.; Martin, G. M.; Roses, A. D.; Bird, T. D.: APP-717, APP-693, and PRIP gene mutations are rare in Alzheimer disease. Am. J. Hum. Genet. 49:511-517, 1991.
146. Schnittger, S.; Gopal Rao, V. V. N.; Deutsch, U.; Gruss, P.; Balling, R.; Hansmann, I.: PAX1, a member of the paired box-containing class of developmental control genes, is mapped to human chromosome 20p11.2 by in situ hybridization (ISH and FISH). Genomics 14:740-744, 1992.
147. Scott, M.; Foster, D.; Mirenda, C.; Serban, D.; Coufal, F.; Walchli, M.; Torchia, M.; Groth, D.; Carlson, G.; DeArmond, S. J.; Westaway, D.; Prusiner, S. B.: Transgenic mice expressing hamster prion protein produce species-specific scrapie infectivity and amyloid plaques. Cell 59:847-857, 1989.
148. Shibuya, S.; Higuchi, J.; Shin, R.-W.; Tateishi, J.; Kitamoto, T.: Protective prion protein polymorphisms against sporadic Creutzfeldt-Jakob disease. (Letter) Lancet 351:419 only, 1998.
149. Shmerling, D.; Hegyi, I.; Fischer, M.; Blattler, T.; Brandner, S.; Gotz, J.; Rulicke, T.; Flechsig, E.; Cozzio, A.; von Mering, C.; Hangartner, C.; Aguzzi, A.; Weissmann, C.: Expression of amino-terminally truncated PrP in the mouse leading to ataxia and specific cerebellar lesions. Cell 93:203-214, 1998.
150. Simon, E. S.; Kahana, E.; Chapman, J.; Treves, T. A.; Gabizon, R.; Rosenmann, H.; Zilber, N.; Korczyn, A. D.: Creutzfeldt-Jakob disease profile in patients homozygous for the PRNP E200K mutation. Ann. Neurol. 47:257-260, 2000.
151. Sparkes, R. S.; Simon, M.; Cohn, V. H.; Fournier, R. E. K.; Lem, J.; Klisak, I.; Heinzmann, C.; Blatt, C.; Lucero, M.; Mohandas, T.; DeArmond, S. J.; Westaway, D.; Prusiner, S. B.; Weiner, L. P.: Assignment of the human and mouse prion protein genes to homologous chromosomes. Proc. Nat. Acad. Sci. 83:7358-7362, 1986.
152. Speer, M. C.; Goldgaber, D.; Goldfarb, L. G.; Roses, A. D.; Pericak-Vance, M. A.: Support of linkage of Gerstmann-Straussler-Scheinker syndrome to the prion protein gene on chromosome 20p12-pter. Genomics 9:366-368, 1991.
153. Supattapone, S.; Bosque, P.; Muramoto, T.; Wille, H.; Aagaard, C.; Peretz, D.; Nguyen, H.-O. B.; Heinrich, C.; Torchia, M.; Safar, J.; Cohen, F. E.; DeArmond, S. J.; Prusiner, S. B.; Scott, M.: Prion protein of 106 residues creates an artificial transmission barrier for prion replication in transgenic mice. Cell 96:869-878, 1999.
154. Supattapone, S.; Bouzamondo, E.; Ball, H. L.; Wille, H.; Nguyen, H.-O. B.; Cohen, F. E.; DeArmond, S. J.; Prusiner, S. B.; Scott, M.: A protease-resistant 61-residue prion peptide causes neurodegeneration in transgenic mice. Molec. Cell. Biol. 21:2608-2616, 2001.
155. Tagliavini, F.; Lievens, P. M.-J.; Tranchant, C.; Warter, J.-M.; Mohr, M.; Giaccone, G.; Perini, F.; Rossi, G.; Salmona, M.; Piccardo, P.; Ghetti, B.; Beavis, R. C.; Bugiani, O.; Frangione, B.; Prelli, F.: A 7-kDa prion protein (PrP) fragment, an integral component of the PrP region required for infectivity, is the major amyloid proteinin Gerstmann-Straussler-Scheinker disease A117V. J. Biol. Chem. 276:6009-6015, 2001.
156. Tagliavini, F.; Prelli, F.; Ghiso, J.; Bugiani, O.; Serban, D.; Prusiner, S. B.; Farlow, M. R.; Ghetti, B.; Frangione, B.: Amyloid protein of Gerstmann-Straussler-Scheinker disease (Indiana kindred) is an 11 kd fragment of prion protein with an N-terminal glycine atcodon 58. EMBO J. 10:513-519, 1991.
157. Tagliavini, F.; Prelli, F.; Porro, M.; Rossi, G.; Giaccone, G.; Farlow, M. R.; Dlouhy, S. R.; Ghetti, B.; Bugiani, O.; Frangione, B.: Amyloid fibrils in Gerstmann-Straussler-Scheinker disease (Indiana and Swedish kindreds) express only PrP peptides encoded by the mutant allele. Cell 79:695-703, 1994.
158. Tateishi, J.; Brown, P.; Kitamoto, T.; Hoque, Z. M.; Roos, R.; Wollman, R.; Cervenakova, L.; Gajdusek, D. C.: First experimental transmission of fatal familial insomnia. Nature 376:434-435, 1995.
159. Telling, G. C.; Parchi, P.; DeArmond, S. J.; Cortelli, P.; Montagna, P.; Gabizon, R.; Mastrianni, J.; Lugaresi, E.; Gambetti, P.; Prusiner, S. B.: Evidence for the conformation of the pathologic isoform of the prion protein enciphering and propagating prion diversity. Science 274:2079-2082, 1996.
160. Telling, G. C.; Scott, M.; Mastrianni, J.; Gabizon, R.; Torchia, M.; Cohen, F. E.; DeArmond, S. J.; Prusiner, S. B.: Prion propagation in mice expressing human and chimeric PrP transgenes implicates the interaction of cellular PrP with another protein. Cell 83:79-90,1995. 161. Ter-Avanesyan, M. D.; Dagkesamanskaya, A. R.; Kushnirov, V. V.; Smirnov, V. N.: The SUP35 omnipotent suppressor gene is involved in the maintenance of the non-mendelian determinant [psi+] in the yeast Saccharomyces cerevisiae. Genetics 137:671-676, 1994. 162. Tobler, I.; Gaus, S. E.; Deboer, T.; Ackermann, P.; Fischer, M.; Rullcke, T.; Moser, M.; Oesch, B.; McBride, P. A.; Manson, J. C.: Altered circadian activity rhythms and sleep in mice devoid of prion protein. Nature 380:639-642, 1996. 163. Westaway, D.; DeArmond, S. J.; Cayetano-Canlas, J.; Groth, D.; Foster, D.; Yang, S.-L.; Torchia, M.; Carlson, G. A.; Prusiner, S. B.: Degeneration of skeletal muscle, peripheral nerves, and the central nervous system in transgenic mice overexpressing wild-type prion proteins. Cell 76:117-129, 1994. 164. Whittington, M. A.; Sidle, K. C. L.; Gowland, I.; Meads, J.; Hill, A. F.; Palmer, M. S.; Jefferys, J. G. R.; Collinge, J.: Rescue of neurophysiological phenotype seen in PrP null mice by transgene encoding human prion protein. Nature Genet. 9:197-201, 1995. 165. Wickner, R. B.: [URE3] as an altered URE2 protein: evidence for a prior analog in Saccharomyces cerevisiae. Science 264:566-569,1994. 166. Windl, O.; Giese, A.; Schulz-Schaeffer, W.; Zerr, I.; Skworc, K.; Arendt, S.; Oberdieck, C.; Bodemer, M.; Poser, S.; Kretzschmar, H. A.: Molecular genetics of human prion diseases in Germany. Hum. Genet. 105:244-252, 1999. 167. Yamada, M.; Itoh, Y.; Fujigasaki, H.; Naruse, S.; Kaneko, K.; Kitamoto, T.; Tateishi, J.; Otomo, E.; Hayakawa, M.; Tanaka, J.; Matsushita, M.; Miyatake, T.: A missense mutation at codon 105 with codon 129 polymorphism of the prion protein gene in a new variant of Gerstmann-Straussler-Scheinker disease. Neurology 43:2723-2724, 1993.

Kreczel, W.; Ghyselinck, N.; Samad, T. A.; Dupe, V.; Kastner, P.; Borrelli, E.; Chambon, P.: Impaired locomotion and dopamine signaling in retinoid receptor mutant mice. Science 279:863-867, 1998.

Lotan, R.; Xu, X.-C.; Lippman, S. M.; Ro, J. Y.; Lee, J. S.; Lee, J. J.; Hong, W. K.: Suppression of retinoic acid receptor-beta in premalignant oral lesions and its up-regulation by isotretinoin. NewEng. J. Med. 332:1405-1410, 1995.

Mattei, M.-G.; de The, H.; Mattei, J.-F.; Marchio, A.; Tiollais, P.; Dejean, A.: Assignment of the human hap retinoic acid receptor RAR-beta gene to the p24 band of chromosome 3. Hum. Genet. 80:189-190,1988.

Nadeau, J. H.; Compton, J. G.; Giguere, V.; Rossant, J.; Varmuza, S.: Close linkage of retinoic acid receptor genes with homeobox-and keratin-encoding genes on paralogous segments of mouse chromosomes 11 and 15. Mammalian Genome 3:202-208, 1992.

Samad, A.; Kreczel, W.; Chambon, P.; Borrelli, E.: Regulation of dopaminergic pathways by retinoids: activation of the D2 receptor promoter by members of the retinoic acid receptor-retinoid X receptor family. Proc. Nat. Acad. Sci. 94:14349-14354, 1997.

Rickman, D. S.; Tyagi, R.; Zhu, X.-X.; Bobek, M. P.; Song, S.; Blaivas, M.; Misek, D. E.; Israel, M. A.; Kurnit, D. M.; Ross, D. A.; Kish, P. E.; Hanash, S. M.: The gene for the axonal cell adhesion molecule TAX-1 is amplified and aberrantly expressed in malignant gliomas. Cancer Res. 61:2162-2168, 2001.

Tsiotra, P. C.; Karagogeos, D.; Theodorakis, K.; Michaelisis, T. M.; Modi, W. S.; Furley, A. J.; Jessell, T. M.; Papamatheakis, J.: Isolation of the cDNA and chromosomal localization of the gene (TAX1) encoding the human axonal glycoprotein TAG-1. Genomics 18:562-567,1993.

Artavanis-Tsakonas, S.; Matsuono, K.; Fortini, M.: Notch signaling. Science 268:225-232, 1995.

Dieterich, W.; Ehnis, T.; Bauer, M.; Donner, P.; Volta, U.; Riecken, E. O.; Schuppan, D.: Identification of tissue transglutaminase as the autoantigen of celiac disease. Nature Med. 3:797-801, 1997.

Gentile, V.; Davies, P. J. A.; Baldini, A.: The human tissue transglutaminase gene maps on chromosome 20q12 by in situ fluorescence hybridization. Genomics 20:295-297, 1994.

Gentile, V.; Saydak, M.; Chiocca, E. A.; Akande, O.; Birckbichler, P. J.; Lee, K. N.; Stein, J. P.; Davies, P. J. A.: Isolation and characterization of cDNA clones to mouse macrophage and human endothelial cell tissue transglutaminases. J. Biol. Chem. 266:478-483, 1991.

Lu, S.; Saydak, M.; Gentile, V.; Stein, J. P.; Davies, P. J. A.: Isolation and characterization of the human tissue transglutaminase gene promoter. J. Biol. Chem. 270:9748-9756, 1995.

Wang, M.; Kim, I.-G.; Steinert, P. M.; McBride, O. W.: Assignment of the human transglutaminase 2 (TGM2) and transglutaminase 3 (TGM3) genes to chromosome 20q11.2. Genomics 23:721-722, 1994.

Dodd, J.; Morton, S. B.; Karagogeos, D.; Yamamoto, M.; Jessell, T. M.: Spatial regulation of axonal glycoprotein expression on subsets of embryonic spinal neurons. Neuron 1:105-116, 1988.

Freigang, J.; Proba, K.; Leder, L.; Diederichs, K.; Sonderegger, P.; Welte, W.: The crystal structure of the ligand binding module of axonin-1/TAG-1 suggests a zipper mechanism for neural cell adhesion. Cell 101:425-433, 2000.

Kenwrick, S.; Leversha, M.; Rooke, L.; Hasler, T.; Sonderegger, P.: Localization of the human TAX-1 gene to 1q32.1: a region implicated in microcephaly and Van der Woude syndrome. Hum. Molec. Genet. 2:1461-1462, 1993.

Kozlov, S. V.; Giger, R. J.; Hasler, T.; Korvatska, E.; Schorderet, D. F.; Sonderegger, P.: The human TAX1 gene encoding the axon-associated cell adhesion molecule TAG-1/axonin-1: genomic structure and basic promoter. Genomics 30:141-148, 1995.

Brou, C.; Logeat, F.; Gupta, N.; Bessia, C.; LeBail, O.; Doedens, J. R.; Cumano, A.; Roux, P.; Black, R. A.; Israel, A.: A novel proteolytic cleavage involved in Notch signaling: the role of the disintegrin-metalloprotease TACE. Molec. Cell 5:207-216, 2000.

Bruckner, K.; Perez, L.; Clausen, H.; Cohen, S.: Glycosyltransferase activity of Fringe modulates Notch-Delta interactions. Nature 406:411-415, 2000.

Ackerman, M. J.; Clapham, D. E.: Ion channels--basic science and clinical disease. New Eng. J. Med. 336:1575-1586, 1997.

Ackerman, M. J.; Schroeder, J. J.; Berry, R.; Schaid, D. J.; Porter, C.-B. J.; Michels, V. V.; Thibodeau, S. N.: A novel mutation in KVLQT1 is the molecular basis of inherited long QT syndrome in a near-drowning patient's family. Pediat. Res. 44:148-153, 1998.

Ackerman, M. J.; Tester, D. J.; Porter, C. J.; Edwards, W. D.:Molecular diagnosis of the inherited long-QT syndrome in a woman who died after near-drowning. New Eng. J. Med. 341:1121-1125, 1999.

Barlow, D. P.: Box: KVLQT1 complexities in Beckwith-Wiedeman (sic) syndrome. Nature Genet. 15:114 only, 1997.

Barlow, J. B.; Bosman, C. K.; Cochrane, J. W. C.: Congenital cardiac arrhythmia. Lancet II:531 only, 1964.

Baudouy, P.; Andreassian, B.; Attuel, P.; Greze, M.; Soulie, J.; Fruchaud, J.: Syndrome de Romano-Ward et stellectomie gauche: revuegenerale a propos d'un nouveau cas. Arch. Mal. Coeur 70:645-652,1977.

Benhorin, J.; Kalman, Y. M.; Medina, A.; Towbin, J.; Rave-Harel, N.; Dyer, T. D.; Blangero, J.; MacCluer, J. W.; Kerem, B.: Evidence of genetic heterogeneity in the long QT syndrome. Science 260:1960-1962,1993.

Bhandari, A. K.; Scheinman, M.: The long QT syndrome. Mod. Concepts Cardiovasc. Dis. 54:45-50, 1985.

Bonduelle, M.: Personal Communication. Brussels, Belgium May 30, 1993.

Casimiro, M. C.; Knollmann, B. C.; Ebert, S. N.; Vary, J. C., Jr.; Greene, A. E.; Franz, M. R.; Grinberg, A.; Huang, S. P.; Pfeifer, K.: Targeted disruption of the Kcnq1 gene produces a mouse model of Jervell and Lange-Nielsen syndrome. Proc. Nat. Acad. Sci. 98:2526-2531, 2001.

Chen, Q.; Zhang, D.; Gingell, R. L.; Moss, A. J.; Napolitano, C.; Priori, S. G.; Schwartz, P. J.; Kehoe, E.; Robinson, J. L.; Schulze-Bahr, E.; Wang, Q.; Towbin, J. A.: Homozygous deletion in KVLQT1 associated with Jervell and Lange-Nielsen syndrome. Circulation 99:1344-1347,1999.

Cleary, M. A.; van Raamsdonk, C. D.; Levorse, J.; Zheng, B.; Bradley, A.; Tilghman, S. M.: Disruption of an imprinted gene cluster by a targeted chromosomal translocation in mice. Nature Genet. 29:78-82,2001.

Curran, M.; Atkinson, D.; Timothy, K.; Vincent, G. M.; Moss, A. J.; Leppert, M.; Keating, M.: Locus heterogeneity of autosomal dominant long QT syndrome. J. Clin. Invest. 92:799-803, 1993.

DeSilvey, D. L.; Moss, A. J.: Primidone in the treatment of the long QT syndrome: QT shortening and ventricular arrhythmia suppression. Ann. Intern. Med. 93:53-54, 1980.

DiSegni, E.; David, D.; Katzenstein, M.; Klein, H. O.; Kaplinsky, E.; Levy, M. J.: Permanent overdrive pacing for the suppression of recurrent ventricular tachycardia in a newborn with long QT syndrome. J. Electrocardiol. 13:189-192, 1980.

Donger, C.; Denjoy, I.; Berthet, M.; Neyroud, N.; Cruaud, C.; Bennaceur, M.; Chivoret, G.; Schwartz, K.; Coumel, P.; Guicheney, P.: KVLQT1 C-terminal missense mutation causes a forme fruste long-QT syndrome. Circulation 96:2778-2781, 1997.

Engel, J. R.; et al.; et al.: Epigenotype-phenotype correlations in Beckwith-Wiedemann syndrome. J. Med. Genet. 37:921-926, 2000.

Fitzpatrick, G. V.; Soloway, P. D.; Higgins, M. J.: Regional loss of imprinting and growth deficiency in mice with a targeted Deletion of KvDMR1. Nature Genet. 9 Sept. 2002. Note: Advance Electronic Publication.

Flugelman, M. Y.; Pollack, S.; Hammerman, H.; Riss, E.; Barzilai, D.: Congenital prolongation of Q-T interval: a family study of three generations. Cardiology 69:170-174, 1982.

Furgerg, C.; Hornell, H.: Familial QT prolongation and risk of sudden death. Acta Paediat. Scand. 64:777-782, 1975.

Gale, G. E.; Bosman, C. K.; Tucker, R. B. K.; Barlow, J. B.:Hereditary prolongation of Q-T interval: study of two families. Brit. Heart J. 32:505-509, 1970.

Gamstorp, I.; Nilsen, R.; Westling, H.: Congenital cardiac arrhythmia. (Letter) Lancet II:965 only, 1964.

Garza, L. A.; Vick, R. L.; Nora, J. J.; McNamara, D. G.: Heritable Q-T prolongation without deafness. Circulation 41:39-48, 1970.

Giuffre, R. M.; Hejtmancik, J. F.; McCabe, E. R. B.; Towbin, J. A.: Long QT (Romano-Ward) syndrome: molecular genetic evidence against tight HLA linkage. (Abstract) Am. J. Hum. Genet. 47 (suppl.): A180 only, 1990.

Gohl, K.; Feistel, H.; Weikl, A.; Bachmann, K.; Wolf, F.: Congenital myocardial sympathetic dysinnervation (CMSD)--a structural defect of idiopathic long QT syndrome. PACE 14:1544-1553, 1991.

Hashiba, K.: Hereditary QT prolongation syndrome in Japan: genetic analysis and pathological findings of the conduction system. Jpn. Circ. J. 42:1133-1150, 1978.

Horn, C. A.; Beekman, R. H.; Dick, M., II; Lacina, S. J.: The congenital long QT syndrome: an unusual cause of childhood seizures. Am. J. Dis. Child. 140:659-661, 1986.

Itoh, S.; Munemura, S.; Satoh, H.: A study of the inheritance pattern of Romano-Ward syndrome: prolonged Q-T interval, syncope, and sudden death. Clin. Pediat. 21:20-24, 1982.

Bulle, F.; Mattei, M. G.; Siegrist, S.; Pawlak, A.; Passage, E.; Chobert, M. N.; Laperche, Y.; Guellaen, G.: Assignment of the human Gamma-glutamyl transferase gene to the long arm of chromosome 22. Hum. Genet. 76:283-286, 1987.

Uchida, S.; Kwon, H. M.; Yamauchi, A.; Preston, A. S.; Marumo, F.; Handler, J. S.: Molecular cloning of the cDNA for an MDCK cell Na (+)- and Cl (-)-dependent taurine transporter that is regulated by hypertonicity. Proc. Nat. Acad. Sci. 89:8230-8234, 1992.

Neyroud, N.; Tesson, F.; Denjoy, I.; Leibovici, M.; Donger, C.; Barhanin, J.; Faure, S.; Gary, F.; Coumel, P.; Petit, C.; Schwartz, K.; Guicheney, P.: A novel mutation in the potassium channel gene KVLQT1 causes the Jervell and Lange-Nielsen cardioauditory syndrome. Nature Genet. 15:186-189, 1997.

Barber, G. N.; Edelhoff, S.; Katze, M. G.; Disteche, C. M.: Chromosomal assignment of the interferon-inducible double-stranded RNA-dependent protein kinase (PRKR) to human chromosome 2p21-p22 and mouse chromosome 17 E2. Genomics 16:765-767, 1993.

Kuhen, K. L.; Shen, X.; Carlisle, E. R.; Richardson, A. L.; Weier, H.-U. G.; Tanaka, H.; Samuel, C. E.: Structural organization of the human gene (PKR) encoding an interferon-inducible RNA-dependent protein kinase (PKR) and differences from its mouse homolog. Genomics 36:197-201, 1996.

Kuhen, K. L.; Shen, X.; Samuel, C. E.: Mechanism of interferon action: sequence of the human interferon-inducible RNA-dependent protein kinase (PKR) deduced from genomic clones. Gene 178:191-193, 1996.

Hansen, R. S.; Wijmenga, C.; Luo, P.; Stanek, A. M.; Canfield, T. K.; Weemaes, C. M. R.; Gartler, S. M.: The DNMT3B DNA methyltransferase gene is mutated in the ICF immunodeficiency syndrome. Proc. Nat. Acad. Sci. 96:14412-14417, 1999.

Hassan, K. M. A.; Norwood, T.; Gimelli, G.; Gartler, S. M.; Hansen, R. S.: Satellite 2 methylation patterns in normal and ICF syndrome cells and association of hypomethylation with advanced replication. Hum. Genet. 109:452-462, 2001.

Shirohzu, H.; Kubota, T.; Kumazawa, A.; Sado, T.; Chijiwa, T.; Inagaki, K.; Suetake, I.; Tajima, S.; Wakui, K.; Miki, Y.; Hayashi, M.; Fukushima, Y.; Sasaki, H.: Three novel DNMT3B mutations in Japanese patients with ICF syndrome. Am. J. Med. Genet. 112:31-37, 2002.

Salinas, M.; Duprat, F.; Heurteaux, C.; Hugnot, J.-P.; Lazdunski, M.: New modulatory alpha subunits for mammalian Shab K(+) channels. J. Biol. Chem. 272:24371-24379, 1997.

Charest, D. L.; Mordret, G.; Harder, K. W.; Jirik, F.; Pelech, S. L.: Molecular cloning, expression, and characterization of the human mitogen-activated protein kinase p44erk1. Molec. Cell. Biol. 13:4679-4690, 1993.

Kas, K.; Roijer, E.; Voz, M.; Meyen, E.; Stenman, G.; Van de Ven, W. J. M.: A 2-Mb YAC contig and physical map covering the chromosome 8q12 break point cluster region in pleomorphic adenomas of the salivary glands. Genomics 43:349-358, 1997.

Kas, K.; Voz, M. L.; Roijer, E.; Astrom, A.-K.; Meyen, E.; Stenman, G.; Van de Ven, W. J. M.: Promoter swapping between the genes for a novel zinc finger protein and beta-catenin in pleiomorphic adenomas with t (3;8)(p21; q12) translocations. Nature Genet. 15:170-174,1997.

Szabo, G.; Dallmann, G.; Muller, G.; Patthy, L.; Soller, M.; Varga, L.: A deletion in the myostatin gene causes the compact (Cmpt) hypermuscular mutation in mice. Mammalian Genome 9:671-672, 1998.

Zimmers, T. A.; Davies, M. V.; Koniaris, L. G.; Haynes, P.; Esquela, A. F.; Tomkinson, K. N.; McPherron, A. C.; Wolfman, N. M.; Lee, S.-J.: Induction of cachexia in mice by systemically administered myostatin. Science 296:1486-1488, 2002.

Fransen, M.; Terlecky, S. R.; Subramani, S.: Identification of a human PTS1 receptor docking protein directly required for peroxisomal protein import. Proc. Nat. Acad. Sci. 95:8087-8092, 1998.

Albertini, M.; Rehling, P.; Erdmann, R.; Girzalsky, W.; Kiel, J. A. K. W.; Veenhuis, M.; Kunau, W.-H.: Pex14p, a peroxisomal membrane protein binding both receptors of the two PTS-dependent import pathways. Cell 89:83-92, 1997.

Cohen, P.; Rylatt, D. B.; Nimmo, G. A.: The hormonal control of glycogen metabolism: the amino acid sequence at the phosphorylation site of protein phosphatase inhibitor-1. FEBS Lett. 76:182-186,1977.

Helps, N. R.; Street, A. J.; Elledge, S. J.; Cohen, P. T.: Cloning of the complete coding region for human protein phosphatase inhibitor 2 using the two hybrid system and expression of inhibitor 2 in E. Coli. FEBS Lett. 340:93-98, 1994.

Huang, F. L.; Glinsmann, W. H.: Separation and characterization of two phosphorylase phosphatase inhibitors from rabbit skeletal muscle. Europ. J. Biochem. 70:419-426, 1976.

Majer, M.; Mott, D. M.; Mochizuki, H.; Rowles, J. C.; Pedersen, O.; Knowler, W. C.; Bogardus, C.; Prochazka, M.: Association of the glycogen synthase locus on 19q13 with NIDDM in Pima Indians. Diabetologia 39:314-321, 1996.

Permana, P. A.; Mott, D. M.: Genetic analysis of human type 1 protein phosphatase inhibitor 2 in insulin-resistant Pima Indians. Genomics 41:110-114, 1997.

Prochazka, M.; Mochizuki, H.; Baier, L. J.; Cohen, P. T. W.; Bogardus, C.: Molecular and linkage analysis of type-1 protein phosphatase catalytic beta-subunit gene: lack of evidence for its major role in insulin resistance in Pima Indians. Diabetologia 38:461-466, 1995.

Sakagami, H.; Kondo, H.: Molecular cloning of the cDNA for rat phosphatase inhibitor-2 and its wide gene expression in the central nervous system. J. Chem. Neuroanat. 8:259-266, 1995.

Sanseau, P.; Jackson, A.; Alderton, R. P.; Beck, S.; Senger, G.; Sheer, D.; Kelly, A.; Trowsdale, J.: Cloning and characterization of human phosphatase inhibitor-2 (IPP-2) sequences. Mammalian Genome 5:490-496, 1994.

Durand, B.; Sperisen, P.; Emery, P.; Barras, E.; Zufferey, M.; Mach, B.; Reith, W.: RFXAP, a novel subunit of the RFX DNA binding complex is mutated in MHC class II deficiency. EMBO J. 16:1045-1055,1997.

Mach, B.: Personal Communication. Geneva, Switzerland Oct. 28, 1998.

Nekrep, N.; Jabrane-Ferrat, N.; Peterlin, B. M.: Mutations in the bare lymphocyte syndrome define critical steps in the assembly of the regulatory factor X complex. Molec. Cell Biol. 20:4455-4461,2000.

Schwartz, R. S.: The case of the bare lymphocyte syndrome: tracking down faulty transcription factors. (Editorial) New Eng. J. Med. 337:781-783, 1997.

Steimle, V.; Durand, B.; Barras, E.; Zufferey, M.; Hadam, M. R.; Mach, B.; Reith, W.: A novel DNA binding-regulatory factor is mutated in primary MHC class II deficiency (bare lymphocyte syndrome). Genes Dev. 9:1021-1032, 1995.

Touraine, J. L.; Betuel, H.: Immunodeficiency diseases and expression of HLA antigens. Hum. Immun. 2:147-153, 1981.

Villard, J.; Lisowska-Grospierre, B.; van den Elsen, P.; Fischer, A.; Reith, W.; Mach, B.: Mutation of RFXAP, a regulator of MHC class II genes, in primary MHC class II deficiency. New Eng. J. Med. 337:748-753, 1997.

Peijnenburg, A.; Van Eggermond, M. C. J. A.; Van den Berg, R.; Sanal, O.; Vossen, J. M. J. J.; Van den Elsen, P. J.: Molecular analysis of an MHC class II deficiency patient reveals a novel mutation in the RFX5 gene. Immunogenetics 49:338-345, 1999.

Kim, I.; Kim, J.-H.; Ryu, Y. S.; Jung, S. H.; Nah, J. J.; Koh, G. Y.: Characterization and expression of a novel alternatively spliced human angiopoietin-2. J. Biol. Chem. 275:18550-18556, 2000.

Maisonpierre, P. C.; Suri, C.; Jones, P. F.; Bartunkova, S.; Wiegand, S. J.; Radziejewski, C.; Compton, D.; McClain, J.; Aldrich, T. H.; Papadopoulos, N.; Daly, T. J.; Davis, S.; Sato, T. N.; Yancopoulos, G. D.: Angiopoietin-2, a natural antagonist for Tie2 that disrupts in vivo angiogenesis. Science 277: 55-60, 1997.

Tanaka, S.; Mori, M.; Sakamoto, Y.; Makuuchi, M.; Sugimachi, K.; Wands, J. R.: Biologic significance of angiopoietin-2 expression in human hepatocellular carcinoma. J. Clin. Invest. 103:341-345,1999.

Chow, V. T. K.; Quek, H. H.: HEP-COP, a novel human gene whose product is highly homologous to the alpha-subunit of the yeast coatomer protein complex. Gene 169:223-227, 1996.

Quek, H. H.; Chow, V. T. K.: Molecular and cellular studies of the human homolog of the 160-kD alpha-subunit of the coatomer protein complex. DNA Cell Biol. 16:275-280, 1997.

Quek, H. H.; Chow, V. T. K.: Genomic organization and mapping of the human HEP-COP gene (COPA) to 1q. Cytogenet. Cell Genet. 76:139-143, 1997.

Leffers, H.; Nielsen, M. S.; Andersen, A. H.; Honore, B.; Madsen, P.; Vandekerckhove, J.; Celis, J. E.: Identification of two human Rho GDP dissociation inhibitor proteins whose overexpression leads to disruption of the actin cytoskeleton. Exp. Cell Res. 209:165-174,1993.

Wagner, T.; Tommerup, N.; Wirth, J.; Leffers, H.; Zimmer, J.; Back, E.; Weissenbach, J.; Scherer, G.: A somatic cell hybrid panel for distal 17q: GDIA1 maps to 17q25.3. Cytogenet. Cell Genet. 76:172-175,1997.

Sanicola, M.; Hession, C.; Worley, D.; Carmillo, P.; Ehrenfels, C.; Walus, L.; Robinson, S.; Jaworski, G.; Wei, H.; Tizard, R.; Whitty, A.; Pepinsky, R. B.; Cate, R. L.: Glial cell line-derived neurotrophic factor-dependent RET activation can be mediated by two different cell-surface accessory proteins. Proc. Nat. Acad. Sci. 94:6238-6243, 1997.

Suvanto, P.; Wartiovaara, K.; Lindahl, M.; Arumae, U.; Moshnyakov, M.; Horelli-Kuitunen, N.; Airaksinen, M. S.; Palotie, A.; Sariola, H.; Saarma, M.: Cloning, mRNA distribution and chromosomal localisation of the gene for glial cell lined-derived neurotrophic factor receptor beta, a homologue to GDNFR-alpha. Hum. Molec. Genet. 6:1267-1273,1997.

Vanhorne, J. B.; Gimm, O.; Myers, S. M.; Kaushik, A.; von Deimling, A.; Eng, C.; Mulligan, L. M.: Cloning and characterization of the human GFRA2 locus and investigation of the gene in Hirschsprung disease. Hum. Genet. 108:409-415, 2001.

Katsanis, N.; Yaspo, M.-L.; Fisher, E. M. C.: Identification and mapping of a novel human gene, HRMT1L1, homologous to the rat protein arginine N-methyltransferase 1 (PRMT1) gene. Mammalian Genome 8:526-529, 1997.

Lin, W. J.; Gary, J. D.; Yang, M. C.; Clarke, S.; Herschman, H. R.: The mammalian intermediate-early TIS21 protein and the leukemia-associated BTG1 protein interact with a protein-arginine N-methyltransferase. J. Biol. Chem. 271:15034-15044, 1996.

Scott, H. S.; Antonarakis, S. E.; Lalioti, M. D.; Rossier, C.; Silver, P. A.; Henry, M. F.: Identification and characterization of two putative human arginine methyltransferases (HRMT1L1 and HRMT1L2). Genomics 48:330-340, 1998.

Herberg, J. A.; Sgouros, J.; Jones, T.; Copeman, J.; Humphray, S. J.; Sheer, D.; Cresswell, P.; Beck, S.; Trowsdale, J.: Genomic analysis of the Tapasin gene, located close to the TAP loci in the MHC. Europ. J. Immun. 28:459-467, 1998.

Mayer, W. E.; Klein, J.: Is tapasin a modified Mhc class I molecule? Immunogenetics 53:719-723, 2001.

Michalova, V.; Murray, B. W.; Sultmann, H.; Klein, J.: A contig map of the Mhc class I genomic region in the zebrafish reveals ancient synteny. J. Immun. 164:5296-5305, 2000.

Ortmann, B.; Copeman, J.; Lehner, P. J.; Sadasivan, B.; Herberg, J. A.; Grandea, A. G.; Riddell, S. R.; Tampe, R.; Spies, T.; Trowsdale, J.; Cresswell, P.: A critical role for tapasin in the assembly and function of multimeric MHC class I-TAP complexes. Science 277:1306-1309,1997.

Sadasivan, B.; Lehner, P. J.; Ortmann, B.; Spies, T.; Cresswell, P.: Roles for calreticulin and a novel glycoprotein, tapasin, in the interaction of MHC class I molecules with TAP. Immunity 5:103-114,1996.

Teng, M. S.; Stephens, R.; Du Pasquier, L.; Freeman, T.; Lindquist, J. A.; Trowsdale, J.: A human TAPBP (TAPASIN)-related gene, TAPBP-R. Europ. J. Immun. 32:1059-1068, 2002.

Yabe, T.; Kawamura, S.; Sato, M.; Kashiwase, K.; Tanaka, H.; Ishikawa, Y.; Asao, Y.; Oyama, J.; Tsuruta, K.; Tokunaga, K.; Tadokoro, K.; Juji, T.: A subject with a novel type I bare lymphocyte syndrome has tapasin deficiency due to deletion of 4 exons by Alu-mediated recombination. Blood 100:1496-1498, 2002.

Kimura, K.; Ito, M.; Amano, M.; Chihara, K.; Fukata, Y.; Nakafuku, M.; Yamamori, B.; Feng, J.; Nakano, T.; Okawa, K.; Iwamatsu, A.; Kaibuchi, K.: Regulation of myosin phosphatase by Rho and Rho-associated kinase (Rho-kinase). Science 273:245-248, 1996.

Takahashi, N.; Ito, M.; Tanaka, J.; Nakano, T.; Kaibuchi, K.; Odai, H.; Takemura, K.: Localization of the gene coding for myosin phosphatase, target subunit 1 (MYPT1) to human chromosome 12q15-q21. Genomics 44:150-152, 1997.

Brown, A. M.; Willi, S. M.; Argyropoulos, G.; Garvey, W. T.: A novel missense mutation, R70W, in the human uncoupling protein 3 gene in a family with type 2 diabetes. (Abstract) Hum. Mutat. 13:508 only, 1999. Note: Full article online.

Sato, N.; Arai, K.; Masai, H.: Human and Xenopus cDNAs encoding budding yeast Cdc7-related kinases: in vitro phosphorylation of MCM subunits by a putative human homologue of Cdc7. EMBO J. 16:4340-4351,1997.

Liu, J.; Dalmau, J.; Szabo, A.; Rosenfeld, M.; Huber, J.; Furneaux, H.: Paraneoplastic encephalomyelitis antigens bind to the AU-rich elements of mRNA. Neurology 45:544-550, 1995.

Sakai, K.; Gofuku, M.; Kitagawa, Y.; Ogasawara, T.; Hirose, G.; Yamazaki, M.; Koh, C.-S.; Yanagisawa, N.; Steinman, L.: A hippocampal protein associated with paraneoplastic neurologic syndrome and small cell lung carcinoma. Biochem. Biophys. Res. Commun. 199:1200-1208,1994.

Van Tine, B. A.; Knops, J. F.; Butler, A.; Deloukas, P.; Shaw, G. M.; King, P. H.: Localization of HuC (ELAVL3) to chromosome 19p13.2 by fluorescence in situ hybridization utilizing a novel tyramide labeling technique. Genomics 53:296-299, 1998.

Whitmore, T. E.; Maurer, M. F.; Sexson, S.; Raymond, F.; Conklin, D.; Deisher, T. A.: Assignment of fibroblast growth factor 18 (FGF18) to human chromosome 5q34 by use of radiation hybrid mapping and fluorescence in situ hybridization. Cytogenet. Cell Genet. 90:231-233, 2000.

Sherrington, R.; Rogaev, E. I.; Liang, Y.; Rogaeva, E. A.; Levesque, G.; Ikeda, M.; Chi, H.; Lin, C.; Li, G.; Holman, K.; Tsuda, T.; Mar.; and 21 others: Cloning of a gene bearing missense mutations in early-onset familial Alzheimer's disease. Nature 375:754-760, 1995.

Verdi, J. M.; Bashirullah, A.; Goldhawk, D. E.; Kubu, C. J.; Jamali, M.; Meakin, S. O.; Lipshitz, H. D.: Distinct human NUMB isoforms regulate differentiation vs. proliferation in the neuronal lineage. Proc. Nat. Acad. Sci. 96:10472-10476, 1999.

Zhong, W.; Feder, J. N.; Jiang, M.-M.; Jan, L. Y.; Jan, Y. N.: Asymmetric localization of a mammalian Numb homolog during mouse cortical neurogenesis. Neuron 17:43-53, 1996.

Thresher, R. J.; Vitaterna, M. H.; Miyamoto, Y.; Kazantsev, A.; Hsu, D. S.; Petit, C.; Selby, C. P.; Dawut, L.; Smithies, O.; Takahashi, J. S.; Sancar, A.: Role of mouse cryptochrome blue-light photoreceptor in circadian photoresponses. Science 282:1490-1494, 1998.

Chow, V. T. K.; Lee, S. S.: DENN, a novel human gene differentially expressed in normal and neoplastic cells. DNA Seq. 6:263-273, 1996.

Chow, V. T. K.; Lim, K. M.; Lim, D.: The human DENN gene: genomic organization, alternative splicing, and localization to chromosome 11p11.21-p11.22. Genome 41:543-552, 1998.

Peyrard, M.; Seroussi, E.; Sandberg-Nordqvist, A.-C.; Xie, Y.-G.; Han, F.-Y.; Fransson, I.; Collins, J.; Dunham, I.; Kost-Alimova, M.; Imreh, S.; Dumanski, J. P.: The human LARGE gene from 22q12.3-q13.1 is a new, distinct member of the glycosyl transferase gene family. Proc. Nat. Acad. Sci. 96:598-603, 1999.

Gerlai, R.; Roder, J. C.; Hampson, D. R.: Altered spatial learning and memory in mice lacking the mGluR4 subtype of metabotropic glutamate receptor. Behav. Neurosci. 112:525-532, 1998.

Chatterjee, T. K.; Eapen, A.; Kanis, A. B.; Fisher, R. A.: Genomic organization, 5-prime-flanking region, and chromosomal localization of the human RGS3 gene. Genomics 45:429-433, 1997.

Druey, K. M.; Blumer, K. J.; Kang, V. H.; Kehrl, J. H.: Inhibition of G-protein-mediated MAP kinase activation by a new mammalian gene family. Nature 379:742-746, 1996.

Oettgen, P.; Alani, R. M.; Barcinski, M. A.; Brown, L.; Akbarali, Y.; Boltax, J.; Kunsch, C.; Munger, K.; Liebermann, T. A.: Isolation and characterization of a novel epithelium-specific transcription factor, ESE-1, a member of the Ets family. Molec. Cell. Biol. 17:4419-4433, 1997.

Oettgen, P.; Barcinski, M.; Boltax, J.; Stolt, P.; Akbarali, Y.; Libermann, T. A.: Genomic organization of the human ELF3 (ESE-1/ESX) gene, a member of the Ets transcription factor family, and identification of a functional promoter. Genomics 55:358-362, 1999.

Oettgen, P.; Carter, K. C.; Augustus, M.; Barcinski, M.; Boltax, J.; Kunsch, C.; Libermann, T. A.: The novel epithelial-specific Ets transcription factor gene ESX maps to human chromosome 1q32.1. Genomics 45:456-457, 1997.

Lunn, C. A.; Fan, X.; Dalie, B.; Miller, K.; Zavodny, P. J.; Narula, S. K.; Lundell, D.: Purification of ADAM 10 from bovine spleen as a TNF alpha convertase. FEBS Lett. 400: 333-335, 1997.

Tymms, M. J.; Ng, A. Y. N.; Thomas, R. S.; Schutte, B. C.; Zhou, J.; Eyre, H. J.; Sutherland, G. R.; Seth, A.; Rosenberg, M.; Papas, T.; Debouck, C.; Kola, I.: A novel epithelial-expressed ETS gene, ELF3: human and murine cDNA sequences, murine genomic organization, human mapping to 1q32.2 and expression in tissues and cancer. Oncogene 15:2449-2462, 1997.

Wolfsberg, T. G.; Primakoff, P.; Myles, D. G.; White, J. M.: ADAM, a novel family of membrane proteins containing a disintegrin and metalloprotease domain: multipotential functions in cell-cell and cell-matrix interactions. J. Cell Biol. 131:275-278, 1995.

Yamazaki, K.; Mizui, Y.; Tanaka, I.: Radiation hybrid mapping of human ADAM10 gene to chromosome 15. Genomics 45:457-459, 1997.

Choi, D.-S.; Handa, M.; Young, H.; Gordon, A. S.; Diamond, I.; Messing, R. O.: Genomic organization and expression of the mouse equilibrative, nitrobenzyl thioinosine-sensitive nucleoside transporter1 (ENT1) gene. Biochem. Biophys. Res. Commun. 277:200-208, 2000.

Coe, I. R.; Griffiths, M.; Young, J. D.; Baldwin, S. A.; Cass, C. E.: Assignment of the human equilibrative nucleoside transporter (hENT1) to 6p21.1-p21.2. Genomics 45:459-460, 1997.

Griffiths, M.; Beaumont, N.; Yao, S. Y. M.; Sundaram, M.; Boumah, C. E.; Davies, A.; Kwong, F. Y. P.; Coe, I.; Cass, C. E.; Young, J. D.; Baldwin, S. A.: Cloning of a human nucleoside transporter implicated in the cellular uptake of adenosine and chemotherapeutic drugs. Nature Med. 3:89-94, 1997.

D'Esposito, M.; Strazzullo, M.; Cuccurese, M.; Spalluto, C.; Rocchi, M.; D'Urso, M.; Ciccodicola, A.: Identification and assignment of the human transient receptor potential channel 6 gene TRPC6 to chromosome 11q21-q22. Cytogenet. Cell Genet. 83:46-47, 1998.

Hofmann, T.; Obukhov, A. G.; Schaefer, M.; Harteneck, C.; Gudermann, T.; Schultz, G.: Direct activation of human TRPC6 and TRPC3 channels by diacylglycerol. Nature 397:259-263, 1999.

Ong, O. C.; Hu, K.; Rong, H.; Lee, R. H.; Fung, B. K.-K.: Gene structure and chromosome localization of the G-gamma-c subunit of human cone G-protein (GNGT2). Genomics 44:101-109, 1997.

Ong, O. C.; Yamane, H. K.; Phan, K. B.; Fong, H. K.; Bok, D.; Lee, R. H.; Fung, B. K.-K.: Molecular cloning and characterization of the G protein gamma subunit of cone photoreceptors. J. Biol. Chem. 270:8495-8500, 1995.

Tasheva, E. S.; Pettenati, M.; Von Kap-Her, C.; Conrad, G. W.: Assignment of mimecan gene (OGN) to human chromosome band 9q22 by in situ hybridization. Cytogenet. Cell Genet. 88:326-327, 2000.

Pucharcos, C.; Fuentes, J.-J.; Casas, C.; de la Luna, S.; Alcantara, S.; Arbones, M. L.; Soriano, E.; Estivill, X.; Prichard, M.: Alu-splice cloning of human intersectin (ITSN), a putative multivalent binding protein expressed in proliferating and differentiating neurons and overexpressed in Down syndrome. Europ. J. Hum. Genet. 7:704-712,1999.

Kanezaki, R.; Toki, T.; Yokoyama, M.; Yomogida, K.; Sugiyama, K.; Yamamoto, M.; Igarashi, K.; Ito, E.: Transcription factor BACH1 is recruited to the nucleus by its novel alternative spliced isoform. J. Biol. Chem. 276:7278-7284, 2001.

Katz, P.; Whalen, G.; Kehrl, J. H.: Differential expression of a novel protein kinase in human B lymphocytes: preferential localization in the germinal center. J. Biol. Chem. 269: 16802-16809, 1994.

Pombo, C. M.; Kehrl, J. H.; Sanchez, I.; Katz, P.; Avruch, J.; Zon, L. I.; Woodgett, J. R.; Force, T.; Kyriakis, J. M.: Activation of the SAPK pathway by the human STE20 homologue germinal centre kinase. Nature 377:750-754, 1995.

Ren, M.; Zeng, J.; De Lemos-Chiarandini, C.; Rosenfeld, M.; Adesnik, M.; Sabatini, D. D.: In its active form, the GTP-binding protein rab8 interacts with a stress-activated protein kinase. Proc. Nat. Acad. Sci. 93:5151-5155, 1996.

Jacquemin, P.; Chen, Z.; Martial, J. A.; Davidson, I.: Genomic structure and chromosomal mapping of the mouse transcription factor TEF-5 (Tead3) gene. Mammalian Genome 10:632-634, 1999.

Sparks, A. B.; Hoffman, N. G.; McConnell, S. J.; Fowlkes, D. M.; Kay, B. K.: Cloning of ligand targets: systematic isolation of SH3 domain-containing proteins. Nature Biotech. 14:741-744, 1996.

Chang, H. Y.; Nishitoh, H.; Yang, X.; Ichijo, H.; Baltimore, D.: Activation of apoptosis signal-regulating kinase 1 (ASK1) by the adapter protein Daxx. Science 281:1860-1863, 1998.

Geleziunas, R.; Xu, W.; Takeda, K.; Ichijo, H.; Greene, W. C.: HIV-1 Nef inhibits ASK1-dependent death signalling providing a potential mechanism for protecting the infected host cell. Nature 410:834-838,2001.

Ichijo, H.; Nishida, E.; Irie, K.; ten Dijke, P.; Saitoh, M.; Moriguchi, T.; Takagi, M.; Matsumoto, K.; Miyazono, K.; Gotoh, Y.: Induction of apoptosis by ASK1, a mammalian MAPKKK that activates SAPK/JNK and p38 signaling pathways. Science 275:90-94, 1997.

Nishitoh, H.; Saitoh, M.; Mochida, Y.; Takeda, K.; Nakano, H.; Rothe, M.; Miyazono, K.; Ichijo, H.: ASK1 is essential for JNK/SAPK activation by TRAF2. Molec. Cell 2:389-395, 1998.

Fuchs, M.; Muller, T.; Lerch, M. M.; Ullrich, A.: Association of human protein-tyrosine phosphatase kappa with members of the armadillo family. J. Biol. Chem. 271:16712-16719, 1996.

Yang, Y.; Gil, M. C.; Choi, E. Y.; Park, S. H.; Pyun, K. H.; Ha, H.: Molecular cloning and chromosomal localization of a human gene homologous to the murine R-PTP-kappa, a receptor-type protein tyrosine phosphatase. Gene 186:77-82, 1997.

Zhang, Y.; Siebert, R.; Matthiesen, P.; Yang, Y.; Ha, H.; Schlegelberger, B.: Cytogenetical assignment and physical mapping of the human R-PTP-kappa gene (PTPRK) to the putative tumor suppressor gene region 6q22.2-q22.3 Genomics 51:309-311, 1998.

Chalmers, I. J.; Hofler, H.; Atkinson, M. J.: Mapping of a cadherin gene cluster to a region of chromosome 5 subject to frequent allelic loss in carcinoma. Genomics 57:160-163, 1999.

Suzuki, S.; Sano, K.; Tanihara, H.: Diversity of the cadherin family: evidence for eight new cadherins in nervous tissue. Cell Regul. 2:261-270, 1991.

Shimoyama, Y.; Gotoh, M.; Terasaki, T.; Kitajima, M.; Hirohashi, S.: Isolation and sequence analysis of human cadherin-6 complementary DNA for the full coding sequence and its expression in human carcinoma cells. Cancer Res. 55:2206-2211, 1995.

Anderson, L. V. B.; Davison, K.; Moss, J. A.; Young, C.; Cullen, M. J.; Walsh, J.; Johnson, M. A.; Bashir, R.; Britton, S.; Keers, S.; Argov, Z.; Mahjneh, I.; Fougerousse, F.; Beckmann, J. S.; Bushby, K. M. D.: Dysferlin is a plasma membrane protein and is expressed early in human development. Hum. Molec. Genet. 8:855-861, 1999.

Gong, B.; Almasan, A.: Genomic organization and transcriptional regulation of human Apo2/TRAIL gene. Biochem. Biophys. Res. Commun. 278:747-752, 2000.

Ohira, M.; Seki, N.; Nagase, T.; Ishikawa, K.; Nomura, N.; Ohara, O.: Characterization of a human homolog (BACH1) of the mouse Bach1 gene encoding a BTB-basic leucine zipper transcription factor and its mapping to chromosome 21q22.1. Genomics 47:300-306, 1998.

Oyake, T.; Itoh, K.; Motohashi, H.; Hayashi, N.; Hoshino, H.; Nishizawa, M.; Yamamoto, M.; Igarashi, K.: Bach proteins belong to a novel family of BTB-basic leucine zipper transcription factors that interact with MafK and regulate transcription through the NF-E2 site. Molec. Cell. Biol. 16:6083-6095, 1996.

Ghanshani, S.; Coleman, M.; Gustavsson, P.; Wu, A. C.-L.; Gargus, J. J.; Gutman, G. A.; Dahl, N.; Mohrenweiser, H.; Chandy, K. G.:Human calcium-activated potassium channel gene KCNN4 maps to chromosome 19q13.2 in the region deleted in Diamond-Blackfan anemia. Genomics 51:160-161, 1998.

Ishii, T. M.; Silvia, C.; Hirschberg, B.; Bond, C. T.; Adelman, J. P.; Maylie, J.: A human intermediate conductance calcium-activated potassium channel. Proc. Nat. Acad. Sci. 94:11651-11656, 1997.

Joiner, W. J.; Wang, L.-Y.; Tang, M. D.; Kaczmarek, L. K.: hSK4, a member of a novel subfamily of calcium-activated potassium channels. Proc. Nat. Acad. Sci. 94:11013-11018, 1997.

Logsdon, N. J.; Kang, J.; Togo, J. A.; Christian, E. P.; Aiyar, J.: A novel gene, hKCa4, encodes the calcium-activated potassium channel in human T lymphocytes. J. Biol. Chem. 272:32723-32726,1997.

Matsuoka, H.; Iwata, N.; Ito, M.; Shimoyama, M.; Nagata, A.; Chihara, K.; Takai, S.; Matsui, T.: Expression of a kinase-defective Eph-like receptor in the normal human brain. Biochem. Biophys. Res. Commun. 235:487-492, 1997.

Tang, X. X.; Zhao, H.; Robinson, M. E.; Cohen, B.; Cnaan, A.; London, W.; Cohn, S. L.; Cheung, N.-K. V.; Brodeur, G. M.; Evans, A. E.; Ikegaki, N.: Implications of EPHB6, EFNB2, and EFNB3 expressions in human neuroblastoma. Proc. Nat. Acad. Sci. 97:10936-10941, 2000.

Meyers, R.; Cantley, L. C.: Cloning and characterization of a wortmannin-sensitive human phosphatidyl inositol 4-kinase. J. Biol. Chem. 272:4384-4390, 1997.

Nakanishi, S.; Catt, K. J.; Balla, T.: A wortmannin-sensitive phosphatidyl inositol 4-kinase that regulates hormone-sensitive pools of inositol phospholipids. Proc. Nat. Acad. Sci. 92:5317-5321, 1995.

Saito, T.; Seki, N.; Ishii, H.; Ohira, M.; Hayashi, A.; Kozuma, S.; Hori, T.: Complementary DNA cloning and chromosomal mapping of a novel phosphatidyl inositol kinase gene. DNA Res. 4:301-305, 1997.

Suzuki, K.; Hirano, H.; Okutomi, K.; Suzuki, M.; Kuga, Y.; Fujiwara, T.; Kanemoto, N.; Isono, K.; Horie, M.: Identification and characterization of a novel human phosphatidyl inositol 4-kinase. DNA Res. 4:273-280,1997.

Castrop, J.; van Norren, K.; Clevers, H.: A gene family of HMG-box transcription factors with homology to TCF-1. Nucleic Acids Res. 20:611 only, 1992.

Duval, A.; Busson-Leconiat, M.; Berger, R.; Hamelin, R.: Assignment of the TCF-4 (TCF7L2) to human chromosome band 10q25.3. Cytogenet. Cell Genet. 88:264-265, 2000.

Duval, A.; Gayet, J.; Zhou, X.-P.; Iacopetta, B.; Thomas, G.; Hamelin, R.: Frequent frame shift mutations of the TCF-4 gene in colorectal cancers with microsatellite instability. Cancer Res. 59:4213-4215,1999.

Duval, A.; Rolland, S.; Tubacher, E.; Bui, H.; Thomas, G.; Hamelin, R.: The human T-cell transcription factor-4 gene: structure, extensive characterization of alternative splicings, and mutational analysis in colorectal cancer cell lines. Cancer Res. 60:3872-3879, 2000.

Korinek, V.; Barker, N.; Moerer, P.; van Donselaar, E.; Huls, G.; Peters, P. J.; Clevers, H.: Depletion of epithelial stem-cell compartments in the small intestine of mice lacking Tcf-4. Nature Genet. 19:379-383, 1998.

Pirozzi, G.; McConnell, S. J.; Uveges, A. J.; Carter, J. M.; Sparks, A. B.; Kay, B. K.; Fowlkes, D. M.: Identification of novel human WW domain-containing proteins by cloning of ligand targets. J. Biol. Chem. 272:14611-14616, 1997.

Katsuki, A.; Sumida, Y.; Gabazza, E. C.; Murashima, S.; Tanaka, T.; Furuta, M.; Araki-Sasaki, R.; Hori, Y.; Nakatani, K.; Yano, Y.; Adachi, Y.: Plasma levels of agouti-related protein are increased in obese men. J. Clin. Endocr. Metab. 86:1921-1924, 2001.

Ollmann, M. M.; Wilson, B. D.; Yang, Y.-K.; Kerns, J. A.; Chen, Y.; Gantz, I.; Barsh, G. S.: Antagonism of central melanocortin receptors in vitro and in vivo by agouti-related protein. Science 278:135-138,1997.

Shutter, J. R.; Graham, M.; Kinsey, A. C.; Scully, S.; Luthy, R.; Stark, K. L.: Hypothalamic expression of ART, a novel gene related to agouti, is up-regulated in obese and diabetic mutant mice. Genes Dev. 11:593-602, 1997.

Chambers, J. A.; Gardner, E.; Hauptmann, R.; Ponder, B. A.; Mulligan, L. M.: TaqI polymorphisms at the annexin VIII locus (ANX8). Hum. Molec. Genet. 1:550 only, 1992.

Chang, K.-S.; Wang, G.; Freireich, E. J.; Daly, M.; Naylor, S. L.; Trujillo, J. M.; Stass, S. A.: Specific expression of the annexin VIII gene in acute promyelocytic leukemia. Blood 79:1802-1810,1992.

Fernandez, M. P.; Copeland, N. G.; Gilbert, D. J.; Jenkins, N. A.; Morgan, R. O.: The genetic origin of mouse annexin VIII. Mammalian Genome 9:8-14, 1998.

Sarkar, A.; Yang, P.; Fan, Y.-H.; Mu, Z. M.; Hauptmann, R.; Adolf, G. R.; Stass, S. A.; Chang, K.-S.: Regulation of the expression of annexin VIII in acute promyelocytic leukemia. Blood 84:279-286,1994.

Waterham, H. R.; Koster, J.; Romeijn, G. J.; Hennekam, R. C. M.; Vreken, P.; Andersson, H. C.; FitzPatrick, D. R.; Kelley, R. I.; Wanders, R. J. A.: Mutations in the 3-beta-hydroxysterol delta-24-reductase gene cause desmosterolosis, an autosomal recessive disorder of cholesterol biosynthesis. Am. J. Hum. Genet. 69:685-694, 2001.

Hibi, M.; Lin, A.; Smeal, T.; Minden, A.; Karin, M.: Identification of an oncoprotein- and UV-responsive protein kinase that binds and potentiates the c-Jun activation domain. Genes Dev. 7:2135-2148,1993.

Kallunki, T.; Su, B.; Tsigelny, I.; Sluss, H. K.; Derijard, B.; Moore, G.; Davis, R.; Karin, M.: JNK2 contains a specificity-determining region responsible for efficient c-Jun binding and phosphorylation. Genes Dev. 8:2996-3007, 1994.

Sluss, H. K.; Barrett, T.; Derijard, B.; Davis, R. J.: Signal transduction by tumor necrosis factor mediated by JNK protein kinases. Molec. Cell Biol. 14:8376-8384, 1994.

Carpenter, N. J.; Filipovich, A.; Blaese, R. M.; Carey, T. L.; Berkel, A. I.: Variable immunodeficiency with abnormal condensation of the heterochromatin of chromosomes 1, 9, and 16. J. Pediat. 112:757-760, 1988.

Fornerod, M.; van Baal, S.; Valentine, V.; Shapiro, D. N.; Grosveld, G.: Chromosomal localization of genes encoding CAN/Nup214-interacting proteins--human CRM1 localizes to 2p16, whereas Nup88 localizes to 17p13 and is physically linked to SF2p32. Genomics 42:538-540,1997.

Fornerod, M.; Ohno, M.; Yoshida, M.; Mattaj, I. W.: CRM1 is an export receptor for leucine-rich nuclear export signals. Cell 90:1051-1060, 1997.

Munday, N. A.; Vaillancourt, J. P.; Ali, A.; Casano, F. J.; Miller, D. K.; Molineaux, S. M.; Yamin, T.-T.; Yu, V. L.; Nicholson, D. W.: Molecular cloning and pro-apoptotic activity of ICE(rel)II and ICE(rel)III, members of the ICE/CED-3 family of cysteine proteases. J. Biol. Chem. 270:15870-15876, 1995.

Wang, S.; Miura, M.; Jung, Y.; Zhu, H.; Li, E.; Yuan, J.: Murinecaspase-11, an ICE-interacting protease, is essential for the activation of ICE. Cell 92:501-509, 1998.

Faucheu, C.; Diu, A.; Chan, A. W. E.; Blanchet, A.-M.; Miossec, C.; Herve, F.; Collard-Dutilleul, V.; Gu, Y.; Aldape, R. A.; Lippke, J. A.; Rocher, C.; Su, M. S.-S.; Livingston, D. J.; Hercend, T.; Lalanne, J.-L.: A novel human protease similar to the interleukin-1-beta converting enzyme induces apoptosis in transfected cells. EMBO J. 14:1914-1922,1995.

Kamens, J.; Paskind, M.; Hugunin, M.; Talanian, R. V.; Allen, H.; Banach, D.; Bump, N.; Hackett, M.; Johnston, C. G.; Li, P.; Mankovich, J. A.; Terranova, M.; Ghayur, T.: Identification and characterization of ICH-2, a novel member of the interleukin-1-beta-converting enzyme family of cysteine proteases. J. Biol. Chem. 270:15250-15256, 1995.

Liburd, N.; Ghosh, M.; Riazuddin, S.; Naz, S.; Khan, S.; Ahmed, Z.; Riazuddin, S.; Liang, Y.; Menon, P. S. N.; Smith, T.; Smith, A. C. M.; Chen, K.-S.; Lupski, J. R.; Wilcox, E. R.; Potocki, L.; Friedman, T. B.: Novel mutations of MYO15A associated with profound deafness in consanguineous families and moderately severe hearing loss in a patient with Smith-Magenis syndrome. Hum. Genet. 109:535-541, 2001.

Carlomagno, F.; Chang-Claude, J.; Dunning, A. M.; Ponder, B. A. J.: Determination of the frequency of the common 675del5 Nijmegen breakage syndrome mutation in the German population: no association with risk of breast cancer. Genes Chromosomes Cancer 25:393-395,1999.

Kleier, S.; Herrmann, M.; Wittwer, B.; Varon, R.; Reis, A.; Horst, J.: Clinical presentation and mutation identification in the NBS1 gene in a boy with Nijmegen breakage syndrome. Clin. Genet. 57:384-387, 2000.

Lim, D.-S.; Kim, S.-T.; Xu, B.; Maser, R. S.; Lin, J.; Petrini, J. H. J.; Kastan, M. B.: ATM phosphorylates p95/nbs1 in an S-phase checkpoint pathway. Nature 404:613-617, 2000.

Lombard, D. B.; Guarente, L.: Nijmegen breakage syndrome disease protein and MRE11 at PML nuclear bodies and meiotic telomeres. Cancer Res. 60:2331-2334, 2000.

Maser, R. S.; Zinkel, R.; Petrini, J. H. J.: An alternative mode of translation permits production of a variant NBS1 protein from the common Nijmegen breakage syndrome allele. Nature Genet. 27:417-421,2001.

Matsuura, S.; Tauchi, H.; Nakamura, A.; Kondo, N.; Sakamoto, S.; Endo, S.; Smeets, D.; Solder, B.; Belohradsky, B. H.; Der Kaloustian, V. M.; Oshimura, M.; Isomura, M.; Nakamura, Y.; Komatsu, K.: Positional cloning of the gene for Nijmegen breakage syndrome. Nature Genet. 19:179-181, 1998.

Morgan, R. O.; Bell, D. W.; Testa, J. R.; Fernandez, M.-P.: human annexin 31 genetic mapping and origin. Gene 227:33-38, 1999.

Morgan, R. O.; Fernandez, M.-P.: Expression profile and structural divergence of novel human annexin 31. FEBS Lett. 434:300-304, 1998.

Schlingmann, K. P.; Weber, S.; Peters, M.; Nejsum, L. N.; Vitzthum, H.; Klingel, K.; Kratz, M.; Haddad, E.; Ristoff, E.; Dinour, D.; Syrrou, M.; Nielsen, S.; Sassen, M.; Waldegger, S.; Seyberth, H. W.; Konrad, M.: Hypomagnesemia with secondary hypocalcemia is caused by mutations in TRPM6, a new member of the TRPM gene family. Nature Genet. 31:166-170, 2002.

Walder, R. Y.; Shalev, H.; Brennan, T. M. H.; Carmi, R.; Elbedour, K.; Scott, D. A.; Hanauer, A.; Mark, A. L.; Patil, S.; Stone, E. M.; Sheffield, V. C.: Familial hypomagnesemia maps to chromosome 9q,not to the X chromosome: genetic linkage mapping and analysis of a balanced translocation breakpoint. Hum. Molec. Genet. 6:1491-1497,1997.

Brohmann, H.; Pinnecke, S.; Hoyer-Fender, S.: Identification and characterization of new cDNAs encoding outer dense fiber proteins of rat sperm. J. Biol. Chem. 272:10327-10332, 1997.

Scott, A. F.: Personal Communication. Baltimore, Md. Sep. 10, 1997.

Shao, X.; Murthy, S.; Demetrick, D. J.; van der Hoorn, F. A.: Human outer dense fiber gene, ODF2, localizes to chromosome 9q34. Cytogenet. Cell Genet. 83:221-223, 1998.

Calabrese, G.; Sallese, M.; Stornaiuolo, A.; Stuppia, L.; Palka, G.; De Blasi, A.: Chromosome mapping of the human arrestin (SAG), beta-arrestin 2 (ARRB2), and beta-adrenergic receptor kinase 2 (ADRBK2) genes. Genomics 23:286-288, 1994.

Porteous, S.; Torban, E.; Cho, N.-P.; Cunliffe, H.; Chua, L.; McNoe, L.; Ward, T.; Souza, C.; Gus, P.; Giugliani, R.; Sato, T.; Yun, K.; Favor, J.; Sicotte, M.; Goodyer, P.; Eccles, M.: Primary renal hypoplasia in human S and mice with PAX2 mutations: evidence of increased apoptosis in fetal kidneys of Pax2(1Neu) +/- mutant mice. Hum. Molec. Genet. 9:1-11, 2000.

Halford, S.; Wilson, D. I.; Daw, S. C. M.; Roberts, C.; Wadey, R.; Kamath, S.; Wickremasinghe, A.; Burn, J.; Goodship, J.; Mattei, M.-G.; Moorman, A. F. M.; Scambler, P. J.: Isolation of a gene expressed during early embryogenesis from the region of 22q11 commonly deleted in DiGeorge syndrome. Hum. Molec. Genet. 2:1577-1582, 1993.

Dyson, E.; Sucov, H. M.; Kubalak, S. W.; Schmid-Schonbein, G. W.; DeLano, F. A.; Evans, R. M.; Ross, J., Jr.; Chien, K. R.: Atrial-like phenotype is associated with embryonic ventricular failure in retinoid X receptor alpha -/- mice. Proc. Nat. Acad. Sci. 92:7386-7390,1995.

Gampe, R. T., Jr.; Montana, V. G.; Lambert, M. H.; Miller, A. B.; Bledsoe, R. K.; Milburn, M. V.; Kliewer, S. A.; Willson, T. M.; Xu, H. E.: Asymmetry in the PPAR-gamma/RXR-alpha crystal structure reveals the molecular basis of heterodimerization among nuclear receptors. Molec. Cell 5:545-555, 2000.

Gruber, P. J.; Kubalak, S. W.; Pexieder, T.; Sucov, H. M.; Evans, R. M.; Chien, K. R.: RXR-alpha deficiency confers genetic susceptibility for aortic sac, conotruncal, atrioventricular cushion, and ventricular muscle defects in mice. J. Clin. Invest. 98:1332-1343, 1996.

Heyman, R. A.; Mangelsdorf, D. J.; Dyck, J. A.; Stein, R. B.; Eichele, G.; Evans, R. M.; Thaller, C.: 9-cis retinoic acid is a high affinity ligand for the retinoid X receptor. Cell 68:397-406, 1992.

Hoopes, C. W.; Taketo, M.; Ozato, K.; Liu, Q.; Howard, T. A.; Linney, E.; Seldin, M. F.: Mapping the mouse Rxr loci encoding nuclear retinoid X receptors Rxr-alpha, Rxr-beta, and Rxr-gamma. Genomics 14:611-617,1992.

Jones, K. A.; Fitzgibbon, J.; Woodward, K. J.; Goudie, D.; Ferguson-Smith, M. A.; Povey, S.; Wolfe, J.; Solomon, E.: Localization of the retinoid X receptor alpha gene (RXRA) to chromosome 9q34. Ann. Hum. Genet. 57:195-201, 1993.

Li, M.; Indra, A. K.; Warot, X.; Brocard, J.; Messaddeq, N.; Kato, S.; Metzger, D.; Chambon, P.: Skin abnormalities generated by temporally controlled RXR-alpha mutations in mouse epidermis. Nature 407:633-636,2000.

Lu, T. T.; Makishima, M.; Repa, J. J.; Schoonjans, K.; Kerr, T. A.; Auwerx, J.; Mangelsdorf, D. J.: Molecular basis for feedback regulation of bile acid synthesis by nuclear receptors. Molec. Cell 6:507-515, 2000.

Mangelsdorf, D. J.; Ong, E. S.; Dyck, J. A.; Evans, R. M.: Nuclear receptor that identifies a novel retinoic acid response pathway. Nature 345:224-229, 1990.

Mangelsdorf, D. J.; Umesono, K.; Kliewer, S. A.; Borgmeyer, U.; Ong, E. S.; Evans, R. M.: A direct repeat in the cellular retinol-binding protein type II gene confers differential regulation by RXR and RAR. Cell 66:555-561, 1991.

Repa, J. J.; Turley, S. D.; Lobaccaro, J.-M. A.; Medina, J.; Li, L.; Lustig, K.; Shan, B.; Heyman, R. A.; Dletschy, J. M.; Mangelsdorf, D. J.: Regulation of absorption and ABC1-mediated efflux of cholesterol by RXR heterodimers. Science 289:1524-1529, 2000.

Tontonoz, P.; Hu, E.; Spiegelman, B. M.: Stimulation of adipogenesis in fibroblasts by PPAR-gamma-2, a lipid-activated transcription factor. Cell 79:1147-1156, 1994.

Willy, P. J.; Umesono, K.; Ong, E. S.; Evans, R. M.; Heyman, R. A.; Mangelsdorf, D. J.: LXR, a nuclear receptor that defines a distinct retinoid response pathway. Genes Dev. 9:1033-1045, 1995.

Wan, Y.-J. Y.; An, D.; Cai, Y.; Repa, J. J.; Chen, T. H.-P.; Flores, M.; Postic, C.; Magnuson, M. A.; Chen, J.; Chien, K. R.; French, S.; Mangelsdorf, D. J.; Sucov, H. M.: Hepatocyte-specific mutation establishes retinoid X receptor alpha as a heterodimeric integrator of multiple physiological processes in the liver. Molec. Cell. Biol. 20:4436-4444,2000.

Zhou, M. D.; Sucov, H. M.; Evans, R. M.; Chien, K. R.: Retinoid-dependent pathways suppress myocardial cell hypertrophy. Proc. Nat. Acad. Sci. 92:7391-7395, 1995.

Fitzgibbon, J.; Gillett, G. T.; Woodward, K. J.; Boyle, J. M.; Wolfe, J.; Povey, S.: Mapping of RXRB to human chromosome 6p21.3. Ann. Hum. Genet. 57:203-209, 1993.

Fleischhauer, K.; McBride, O. W.; DiSanto, J. P.; Ozato, K.; Yang, S. Y.: Cloning and chromosome mapping of human retinoid X receptor beta: selective amino acid sequence conservation of a nuclear hormone receptor in mammals. Hum. Genet. 90:505-510, 1993.

Nagata, T.; Weiss, E. H.; Abe, K.; Kitagawa, K.; Ando, A.; Yara-Kikuti, Y.; Seldin, M. F.; Ozato, K.; Inoko, H.; Taketo, M.: Physical mapping of the retinoid X receptor B gene in mouse and human. Immunogenetics 41:83-90, 1995.

Yu, V. C.; Delsert, C.; Andersen, B.; Holloway, J. M.; Devary, O. V.; Naar, A. M.; Kim, S. Y.; Boutin, J.-M.; Glass, C. K.; Rosenfeld, M. G.: RXR-beta: a coregulator that enhances binding of retinoic acid, thyroid hormone, and vitamin D receptors to their cognate response elements. Cell 67:1251-1266, 1991.

Graycar, J. L.; Miller, D. A.; Arrick, B. A.; Lyons, R. M.; Moses, H. L.; Derynck, R.: Human transforming growth factor-beta-3: recombinant expression, purification, and biological activities in comparison with transforming growth factors-beta-1 and beta-2. Molec. Endocr. 3:1977-1986, 1989.

Kaartinen, V.; Voncken, J. W.; Shuler, C.; Warburton, D.; Bu, D.; Heisterkamp, N.; Groffen, J.: Abnormal lung development and cleft palate in mice lacking TGF-beta-3 indicates defects of epithelial-mesenchymal interaction. Nature Genet. 11:415-421, 1995.

Lee, B.-S.; Nowak, R. A.: Human leiomyoma smooth muscle cells show increased expression of transforming growth factor-beta-3 (TGF-beta-3) and altered responses to the antiproliferative effects of TGF-beta. J. Clin. Endocr. Metab. 86:913-920, 2001.

Moren, A.; Ichijo, H.; Miyazono, K.: Molecular cloning and characterization of the human and porcine transforming growth factor-beta type III receptors. Biochem. Biophys. Res. Commun. 189:356-362, 1992.

Proetzel, G.; Pawlowski, S. A.; Wiles, M. V.; Yin, M.; Boivin, G. P.; Howles, P. N.; Ding, J.; Ferguson, M. W. J.; Doetschman, T.: Transforming growth factor-beta-3 is required for secondary palate fusion. Nature Genet. 11:409-414, 1995.

ten Dijke, P.; Geurts van Kessel, A. H. M.; Foulkes, J. G.; LeBeau, M. M.: Transforming growth factor type beta-3 maps to human chromosome 14, region q23-q24. Oncogene 3:721-724, 1988.

ten Dijke, P.; Hansen, P.; Iwata, K. K.; Pieler, C.; Foulkes, J. G.: Identification of another member of the transforming growth factor type beta gene family. Proc. Nat. Acad. Sci. 85:4715-4719, 1988.

Clapham, J. C.; Arch, J. R. S.; Chapman, H.; Haynes, A.; Lister, C.; Moore, G. B. T.; Piercy, V.; Carter, S. A.; Lehner, I.; Smith, S. A.; Beeley, L. J.; Godden, R. J.; and 15 others: Mice overexpressing human uncoupling protein-3 in skeletal muscle are hyperphagic and lean. Nature 406:415-418, 2000.

Dalgaard, L. T.; Sorensen, T. I. A.; Drivsholm, T.; Borch-Johnsen, K.; Andersen, T.; Hansen, T.; Pedersen, O.: A prevalent polymorphism in the promoter of the UCP3 gene and its relationship to body mass index and long term body weight change in the Danish population. J. Clin. Endocr. Metab. 86:1398-1402, 2001.

Kim, P. K. M.; Dutra, A. S.; Chandrasekharappa, S. C.; Puck, J. M.: Genomic structure and mapping of human FADD, an intracellular mediator of lymphocyte apoptosis. J. Immun. 157:5461-5466, 1996.

Hymowitz, S. G.; Christinger, H. W.; Fuh, G.; Ultsch, M.; O'Connell, M.; Kelley, R. F.; Ashkenazi, A.; de Vos, A. M.: Triggering cell death: the crystal structure of Apo2L/TRAIL in a complex with death receptor 5. Molec. Cell 4:563-571, 1999.

Nitsch, R.; Bechmann, I.; Deisz, R. A.; Haas, D.; Lehmann, T. N.; Wendling, U.; Zipp, F.: Human brain-cell death induced by tumour-necrosis-factor-related apoptosis-inducing ligand (TRAIL). Lancet 356:827-828, 2000.

Pitti, R. M.; Marsters, S. A.; Ruppert, S.; Donahue, C. J.; Moore, A.; Ashkenazi, A.: Induction of apoptosis by Apo-2 ligand, a new member of the tumor necrosis factor cytokine family. J. Biol. Chem. 271:12687-12690, 1996.

Wiley, S. R.; Schooley, K.; Smolak, P. J.; Din, W. S.; Huang, C.-P.; Nicholl, J. K.; Sutherland, G. R.; Smith, T. D.; Rauch, C.; Smith, C. A.; Goodwin, R. G.: Identification and characterization of a new member of the TNF family that induces apoptosis. Immunity 3:673-682,1995.

Lai, C. S. L.; Fisher, S. E.; Hurst, J. A.; Levy, E. R.; Hodgson, S.; Fox, M.; Jeremiah, S.; Povey, S.; Jamison, D. C.; Green, E. D.; Vargha-Khadem, F.; Monaco, A. P.: The SPCH1 region on human 7q31:genomic characterization of the critical interval and localization of translocations associated with speech and language disorder. Am. J. Hum. Genet. 67:357-368, 2000.

Lai, C. S. L.; Fisher, S. E.; Hurst, J. A.; Vargha-Khadem, F.; Monaco, A. P.: A forkhead-domain gene is mutated in a severe speech and language disorder. Nature 413:519-523, 2001.

Iwabuchi, K.; Bartel, P. L.; Li, B.; Marraccino, R.; Fields, S.: Two cellular proteins that bind to wild-type but not mutant p53. Proc. Nat. Acad. Sci. 91:6098-6102, 1994.

Iwabuchi, K.; Li, B.; Massa, H. F.; Trask, B. J.; Date, T.; Fields, S.: Stimulation of p53-mediated transcriptional activation by the p53-binding proteins, 53BP1 and 53BP2. J. Biol. Chem. 273:26061-26068,1998.

Naumovski, L.; Cleary, M. L.: The p53-binding protein 53BP2 also interacts with Bcl2 and impedes cell cycle progression at G2/M. Molec. Cell Biol. 16:3884-3892, 1996.

Samuels-Lev, Y.; O'Connor, D. J.; Bergamaschi, D.; Trigiante, G.; Hsieh, J.-K.; Zhong, S.; Campargue, I.; Naumovski, L.; Crook, T.; Lu, X.: ASPP proteins specifically stimulate the apoptotic function of p53. Molec. Cell 8:781-794, 2001.

Yang, J.-P.; Ono, T.; Sonta, S.; Kawabe, T.; Okamoto, T.: Assignment of p53 binding protein (TP53BP2) to human chromosome band 1q42.1 by in situ hybridization. Cytogenet. Cell Genet. 78:61-62, 1997.

Cohen, M. E.; Yin, M.; Paznekas, W. A.; Schertzer, M.; Wood, S.; Jabs, E. W.: Human SLUG gene organization, expression, and chromosome map location on 8q. Genomics 51:468-471, 1998.

Inukai, T.; Inoue, A.; Kurosawa, H.; Goi, K.; Shinjyo, T.; Ozawa, K.; Mao, M.; Inaba, T.; Look, A. T.: SLUG, a ces-1-related zinc finger transcription factor gene with antiapoptotic activity, is a downstream target of the E2A-HLF oncoprotein. Molec. Cell 4:343-352, 1999.

Nieto, A. M.; Sargent, M. G.; Wilkinson, D. G.; Cooke, J.: control of cell behavior during vertebrate development by Slug, a zinc finger gene. Science 264:835-839, 1994.

Agulnick, A. D.; Taira, M.; Breen, J. J.; Tanaka, T.; Dawid, I. B.; Westphal, H.: Interactions of the LIM-domain-binding factor Ldb1 with LIM homeodomain proteins. Nature 384:270-272, 1996.

Bach, I.; Carriere, C.; Ostendorff, H. P.; Andersen, B.; Rosenfield, M. G.: A family of LIM domain-associated cofactors confer transcriptional synergism between LIM and Otx homeodomain proteins. Genes Dev. 11:1370-1380, 1997.

Jurata, L. W.; Gill, G. N.: Functional analysis of the nuclear LIM domain interactor NL1. Molec. Cell. Biol. 17:5688-5698, 1997.

Jurata, L. W.; Kenny, D. A.; Gill, G. N.: Nuclear LIM interactor, a rhombotin and LIM homeodomain interacting protein, is expressed early in neuronal development. Proc. Nat. Acad. Sci. 93:11693-11698,1996.

Semina, E. V.; Altherr, M. R.; Murray, J. C.: Cloning and chromosomal localization of two novel human genes encoding LIM-domain binding factors CLIM1 and CLIM2/LDB1/NL1. Mammalian Genome 9:921-924, 1998.

Yamashita, T.; Agulnick, A. D.; Copeland, N. G.; Gilbert, D. J.; Jenkins, N. A.; Westphal, H.: Genomic structure and chromosomal localization of the mouse LIM domain-binding protein 1 gene, Ldb1. Genomics 48:87-92, 1998.

Foley, B. T.; Moehring, J. M.; Moehring, T. J.: Mutations in the elongation factor 2 gene which confer resistance to diphtheria toxin and Pseudomonas exotoxin A: genetic and biochemical analyses. J. Biol. Chem. 270:23218-23225, 1995.

Mattheakis, L. C.; Sor, F.; Collier, R. J.: Diphthamide synthesis in Saccharomyces cerevisiae: structure of the DPH2 gene. Gene 132:149-154, 1993.

Schultz, D. C.; Balasara, B. R.; Testa, J. R.; Godwin, A. K.:Cloning and localization of a human diphthamide biosynthesis-like protein-2 gene, DPH2L2. Genomics 52:186-191, 1998.

Abe, R.; Sakashita, E.; Yamamoto, K.; Sakamoto, H.: Two different RNA binding activities for the AU-rich element and the poly (A) sequence of the mouse neuronal protein mHuC. Nucleic Acids Res. 24:4895-4901,1996.

Rhim, H.; Savagner, P.; Thibaudeau, G.; Thiery, J. P.; Pavan, W. J.: Localization of a neural crest transcription factor, Slug, to mouse chromosome 16 and human chromosome 8. Mammalian Genome 8:872-873, 1997.

Savagner, P.; Yamada, K. M.; Thiery, J. P.: The zinc-finger protein Slug causes desmosome dissociation, an initial and necessary step for growth factor-induced epithelial-mesenchymal transition. J. Cell Biol. 137:1403-1419, 1997.

Buckanovich, R. J.; Posner, J. B.; Darnell, R. B.: Nova, the paraneoplastic Ri antigen, is homologous to an RNA-binding protein and is specifically expressed in the developing motor system. Neuron 11:657-672, 1993.

Buckanovich, R. J.; Yang, Y. Y.; Darnell, R. B.: The onconeural antigen Nova-1 is a neuron-specific RNA-binding protein, the activity of which is inhibited by paraneoplastic antibodies. J. Neurosci. 16:1114-1122, 1996.

Prestigiacomo, C. J.; Balmaceda, C.; Dalmau, J.: Anti-Ri-associated paraneoplastic opsoclonus-ataxia syndrome in a man with transitional cell carcinoma: a case report. Cancer 91:1423-1428, 2001.

Muzio, M.; Ni, J.; Feng, P.; Dixit, V. M.: IRAK (Pelle) family member IRAK-2 and MyD88 as proximal mediators of IL-1 signaling. Science 278:1612-1615, 1997.

Takeuchi, O.; Hoshino, K.; Akira, S.: Cutting edge: TLR2-deficient and MyD88-deficient mice are highly susceptible to Staphylococcus aureus infection. J. Immun. 165:5392-5396, 2000.

Eggertsen, G.; Olin, M.; Andersson, U.; Ishida, H.; Kubota, S.; Hellman, U.; Okuda, K.-I.; Bjorkhem, I.: Molecular cloning and expression of rabbit sterol 12-alpha-hydroxylase. J. Biol. Chem. 271:32269-32275,1996.

Gafvels, M.; Olin, M.; Chowdhary, B. P.; Raudsepp, T.; Andersson, U.; Persson, B.; Jansson, M.; Bjorkhem, I.; Eggertsen, G.: Structure and chromosomal assignment of the sterol 12-alpha-hydroxylase gene (CYP8B1) in human and mouse: eukaryotic cytochrome P-450 gene devoid of introns. Genomics 56:184-196, 1999.

Zhang, M.; Chiang, J. Y. L.: Transcriptional regulation of the human sterol 12-alpha-hydroxylase gene (CYP8B1): roles of hepatocyte nuclear factor 4-alpha in mediating bile acid repression. J. Biol. Chem. 276:41690-41699, 2001.

Soengas, M. S.; Capodieci, P.; Polsky, D.; Mora, J.; Esteller, M.; Opitz-Araya, X.; McCombie, R.; Herman, J. G.; Gerald, W. L.; Lazebnik, Y. A.; Cordon-Cardo, C.; Lowe, S. W.: Inactivation of the apoptosis effector Apaf-1 in malignant melanoma. Nature 409:207-211, 2001.

Srinivasula, S. M.; Ahmad, M.; Fernandes-Alnemri, T.; Alnemri, E. S.: Autoactivation of procaspase-9 by Apaf-1-mediated oligomerization. Molec. Cell 1:949-957, 1998.

Yoshida, H.; Kong, Y.-Y.; Yoshida, R.; Elia, A. J.; Hakem, A.; Hakem, R.; Penninger, J. M.; Mak, T. W.: Apaf1 is required for mitochondrial pathways of apoptosis and brain development. Cell 94:739-750, 1998.

Zou, H.; Henzel, W. J.; Liu, X.; Lutschg, A.; Wang, X.: APAF-1, a human protein homologous to C. elegans CED-4, participates in cytochromec-dependent activation of caspase-3. Cell 90:405-413, 1997.

Chardin, P.; Paris, S.; Antonny, B.; Robineau, S.; Beraud-Dufour, S.; Jackson, C. L.; Chabre, M.: A human exchange factor for ARF contains Sec7- and pleckstrin-homology domains. Nature 384:481-484, 1996.

Perletti, L.; Talarico, D.; Trecca, D.; Ronchetti, D.; Fracchiolla, N. S.; Maiolo, A. T.; Neri, A.: Identification of a novel gene, PSD, adjacent to NFKB2/lyt-10, which contains Sec7 and pleckstrin-homology domains. Genomics 46:251-259, 1997.

Biunno, I.; Appierto, V.; Cattaneo, M.; Leone, B. E.; Balzano, G.; Socci, C.; Saccone, S.; Letizia, A.; Valle, G. D.; Sgaramella, V.: Isolation of a pancreas-specific gene located on human chromosome 14q31: expression analysis in human pancreatic ductal carcinomas. Genomics 46:284-286, 1997.

Donoviel, D. B.; Bernstein, A.: SEL-1L maps to human chromosome 14, near the insulin-dependent diabetes mellitus locus 11. Genomics 56:232-233, 1999.

Grant, B.; Greenwald, I.: The Caenorhabditis. elegans sel-1 gene, a negative regulator of lin-12 and glp-1, encodes a predicted extracellular protein. Genetics 143:237-247, 1996.

Grant, B.; Greenwald, I.: Structure, function and expression of SEL-1, a negative regulator of LIN-12 and GLP-1 in C. elegans. Development 124:637-644, 1997.

Ben Porath, I.; Kozak, C. A.; Benvenisty, N.: Chromosomal mapping of Tmp (Emp1), Xmp (Emp2), and Ymp (Emp3), genes encoding membrane proteins related to Pmp22. Genomics 49:443-447, 1998.

Chen, Y.; Medvedev, A.; Ruzanov, P.; Marvin, K. W.; Jetten, A. M.: cDNA cloning, genomic structure, and chromosome mapping of the human epithelial membrane protein CL-20 gene (EMP1), a member of the PMP22 family. Genomics 41:40-48, 1997.

Liehr, T.; Kuhlenbaumer, G.; Wulf, P.; Taylor, V.; Suter, U.; VanBroeckhoven, C.; Lupski, J. R.; Claussen, U.; Rautenstrauss, B.:Regional localization of the human epithelial membrane protein genes 1, 2, and 3 (EMP1, EMP2, EMP3) to 12p12.3, 16p13.2, and 19q13.3. Genomics 58:106-108, 1999.

Marvin, K. W.; Fujimoto, W.; Jetten, A. M.: Identification and characterization of a novel squamous cell-associated gene related to PMP22. J. Biol. Chem. 270:28910-28916, 1995.

Ruegg, C. L.; Wu, H.; Fagnoni, F. F.; Engleman, E. G.; Laus, R.: B4B, a novel growth-arrest gene, is expressed by a subset of progenitor/pre-B lymphocytes negative for cytoplasmic mu-chain. J. Immun. 157:72-80,1996.

Taylor, V.; Suter, U.: Epithelial membrane protein-2 and epithelial membrane protein-3: two novel members of the peripheral myelin protein 22 gene family. Gene 175:115-120, 1996.

Masiakowski, P.; Carroll, R. D.: A novel family of cell surface receptors with tyrosine kinase-like domain. J. Biol. Chem. 267:26181-26190, 1992.

Gregorini, A.; Sahin, F. I.; Lillington, D. M.; Meerabux, J.; Saha, V.; McCullagh, P.; Bocci, M.; Menevse, S.; Papa, S.; Young, B. D.: Gene BR140, which is related to AF10 and AF17, maps to chromosome band 3p25. Genes Chromosomes Cancer 17:269-272, 1996.

Thompson, K. A.; Wang, B.; Argraves, W. S.; Giancotti, F. G.; Schranck, D. P.; Ruoslahti, E.: BR140, a novel zinc-finger protein with homology to the TAF250 subunit of TFIID. Biochem. Biophys. Res. Commun. 1143-1152,1994.

Saito, T.; Seki, N.; Yamauchi, M.; Tsuji, S.; Hayashi, A.; Kozuma, S.; Hori, T.: Structure, chromosomal location, and expression profile of EXTR1 and EXTR2, new members of the multiple exostoses gene family. Biochem. Biophys. Res. Commun. 243:61-66, 1998.

Wuyts, W.; Van Hul, W.: Characterization and genomic localization of the mouse Extl2 gene. Cytogenet. Cell Genet. 89:185-188, 2000.

Wuyts, W.; Van Hul, W.; Hendrickx, J.; Speleman, F.; Wauters, J.; De Boulle, K.; Van Roy, N.; Van Agtmael, T.; Bossuyt, P.; Willems, P. J.: Identification and characterization of a novel member of the EXT gene family, EXTL2. Europ. J. Hum. Genet. 5:382-389, 1997.

Dick, T.; Ray, K.; Salz, H. K.; Chia, W.: Cytoplasmic dynein (ddlc1) mutations cause morphogenetic defects and apoptotic cell death in Drosophila melanogaster. Molec. Cell. Biol. 16:1966-1977, 1996.

Matsushita, M.; Endo, Y.; Taira, S.; Sato, Y.; Fujita, T.; Ichikawa, N.; Nakata, M.; Misuochi, T.: A novel human lectin with collagen- and fibrinogen-like domains which functions as an opsonin. J. Biol. Chem. 271:2448-2454, 1996.

Banfi, S.; Borsani, G.; Rossi, E.; Bernard, L.; Guffanti, A.; Rubboli, F.; Marchitiello, A.; Giglio, S.; Coluccia, E.; Zollo, M.; Zuffardi, O.; Ballabio, A.: Identification and mapping of human cDNAs homologous to Drosophila mutant genes through EST database searching. Nature Genet. 13:167-174, 1996.

Duncan, M. K.; Kos, L.; Jenkins, N. A.; Gilbert, D. J.; Copeland, N. G.; Tomarev, S. I.: Eyes absent: a gene family found in several metazoan phyla. Mammalian Genome 8:479-485, 1997. Note: Erratum: Mammalian Genome 8:877 only, 1997.

Xu, P.-X.; Cheng, J.; Epstein, J. A.; Maas, R. L.: Mouse Eya genes are expressed during limb tendon development and encode a transcriptional activation function. Proc. Nat. Acad. Sci. 94:11974-11979, 1997.

Zimmerman, J. E.; Bui, Q. T.; Steingrimsson, E.; Nagle, D. L.; Fu, W.; Genin, A.; Spinner, N. B.; Copeland, N. G.; Jenkins, N. A.; Bucan, M.; Bonini, N. M.: Cloning and characterization of two vertebrate homologs of the Drosophila eyes absent gene. Genome Res. 7:128-141,1997.

Meurs, E.; Chong, K.; Galabru, J.; Shaun, N.; Thomas, S. B.; Kerr, I. M.; Williams, B. R. G.; Hovanessian, A. G.: Molecular cloning and characterization of the human double-stranded RNA-activated protein kinase induced by interferon. Cell 62:379-390, 1990.

Bashir, R.; Strachan, T.; Keers, S.; Stephenson, A.; Mahjneh, I.; Marconi, G.; Nashef, L.; Bushby, K. M. D.: A gene for autosomal recessive limb-girdle muscular dystrophy maps to chromosome 2p. Hum. Molec. Genet. 3:455-457, 1994.

Levy, G. G.; Nichols, W. C.; Lian, E. C.; Foroud, T.; McClintick, J. N.; McGee, B. M.;Yang, A. Y.; Slemieniak, D. R.; Stark, K. R.; Gruppo, R.; Sarode, R.; Shurin, S. B.; Chandrasekaran, V.; Stabler, S. P.; Sabio, H.; Bouhassira, E. E.; Upshaw, J. D., Jr.; Ginsburg, D.; Tsai, H.-M.: Mutations in a member of the ADAMTS gene family cause thrombotic thrombocytopenic purpura. Nature 413:488-494,2001.

Amrani, A.; Verdaguer, J.; Serra, P.; Tafuro, S.; Tan, R.; Santamaria, P.: Progression of autoimmune diabetes driven by avidity maturation of a T-cell population. Nature 406:739-742, 2000.

Bowcock, A. M.; Kavathas, P.; Margolskee, R. F.; Herzenberg, L.; Cavalli-Sforza, L. L.: An RFLP associated with pcDLeu2-14, a human T-cell differentiation antigen CD8 (Leu2) cDNA mapped to 2p12. Nucleic Acids Res. 14:7817 only, 1986.

Bruns, G.; Kavathas, P.; Shiloh, Y.; Sakai, K.; Schwaber, J.; Latt, S. A.; Herzenberg, L. A.: The human T cell antigen Leu-2 (T8) is encoded on chromosome 2. Hum. Genet. 70:311-314, 1985.

Giblin, P.; Ledbetter, J. A.; Kavathas, P.: A secreted form of the human lymphocyte cell surface molecule CD8 arises from alternative splicing. Proc. Nat. Acad. Sci. 86:998-1002, 1989.

Kavathas, P.; Sukhatme, V. P.; Herzenberg, L. A.; Parnes, J. R.: Isolation of the gene encoding the human T-lymphocyte differentiation antigen Leu-2 (T8) by gene transfer and cDNA subtraction. Proc. Nat. Acad. Sci. 81:7688-7692, 1984.

Ledbetter, J. A.; Evans, R. L.; Lipinski, M.; Cunningham-Rundles, C.; Good, R. A.; Herzenberg, L. A.: Evolutionary conservation of surface molecules that distinguish T lymphocyte helper-inducer and cytotoxic-suppressor subpopulations in mouse and man. J. Exp. Med. 153:310-323, 1981.

Ledbetter, J. A.; Seaman, W. E.; Tsu, T. T.; Herzenberg, L. A.: Lyt-2 and Lyt-3 antigens are on two different polypeptide subunits linked by disulfide bonds: relationship of subunits to T cell cytolytic activity. J. Exp. Med. 153:1503-1516, 1981.

Leishman, A. J.; Naidenko, O. V.; Attinger, A.; Koning, F.; Lena, C. J.; Xiong, Y.; Chang, H.-C.; Reinherz, E.; Kronenberg, M.; Cheroutre, H.: T cell responses modulated through interaction between CD8-alpha-alpha and the nonclassical MHC class I molecule, TL. Science 294:1936-1939,2001.

Littman, D. R.: The structure of the CD4 and CD8 genes. Annu. Rev. Immun. 5:561-584, 1987.

Littman, D. R.; Thomas, Y.; Maddon, P. J.; Chess, L.; Axel, R.: The isolation and sequence of the gene encoding T8: a molecule defining functional classes of T lymphocytes. Cell 40:237-246, 1985.

Mecucci, C.; Van Den Berghe, H.: OKT8-positive T-cell lymphoma associated with a chromosome rearrangement t (2;17) possibly involving the T8 locus. (Letter) New Eng. J. Med. 313:185-186, 1985.

Nakauchi, H.; Nolan, G. P.; Hsu, C.; Huang, H. S.; Kavathas, P.; Herzenberg, L. A.: Molecular cloning of Lyt-2, a membrane glycoprotein marking a subset of mouse T lymphocytes: molecular homology to its human counterpart, Leu-2/T8, and to immunoglobulin variable regions. Proc. Nat. Acad. Sci. 82:5126-5130, 1985.

Calfon, M.; Zeng, H.; Urano, F.; Till, J. H.; Hubbard, S. R.; Harding, H. P.; Clark, S. G.; Ron, D.: IRE1 couples endoplasmic reticulum load to secretory capacity by processing the XBP-1 mRNA. Nature 415:92-96, 2002.

Liou, H.-C.; Boothby, M. R.; Finn, P. W.; Davidson, R.; Nabavi, N.; Zeleznik-Le, N. J.; Ting, J. P.-Y.; Glimcher, L. H.: A new member of the leucine zipper class of proteins binds to the HLA DR-alpha promoter. Science 247:1581-1584, 1990.

Liou, H.-C.; Eddy, R.; Shows, T.; Lisowska-Grospierre, B.; Griscelli, C.; Doyle, C.; Mannhalter, J.; Eibl, M.; Glimcher, L. H.: An HLA-DR-alpha promoter DNA-binding protein is expressed ubiquitously and maps to human chromosomes 22 and 5. Immunogenetics 34:286-292, 1991.

Reimold, A. M.; Iwakoshi, N. N.; Manis, J.; Vallabhajosyula, P.; Szomolanyi-Tsuda, E.; Gravallese, E. M.; Friend, D.; Grusby, M. J.; Alt, F.; Glimcher, L. H.: Plasma cell differentiation requires the transcription factor XBP-1. Nature 412:300-307, 2001.

Gao, Y.; Sun, Y.; Frank, K. M.; Dikkes, P.; Fujiwara, Y.; Seidl, K. J.; Sekiguchi, J. M.; Rathbun, G. A.; Swat, W.; Wang, J.; Bronson, R. T.; Malynn, B. A.; Bryans, M.; Zhu, C.; Chaudhuri, J.; Davidson, L.; Ferrini, R.; Stamato, T.; Orkin, S. H.; Greenberg, M. E.; Alt, F. W.: A critical role for DNA end-joining proteins in both lymphogenesis and neurogenesis. Cell 95:891-902, 1998.

Giaccia, A. J.; Denko, N.; MacLaren, R.; Mirman, D.; Waldren, C.; Hart, I.; Stamato, T. D.: Human chromosome 5 complements the DNA double-strand break-repair deficiency and gamma-ray sensitivity of the XR-1 hamster variant. Am. J. Hum. Genet. 47:459-469, 1990.

Li, Z.; Otevrel, T.; Gao, Y.; Cheng, H.-L.; Seed, B.; Stamato, T. D.; Taccioli, G. E.; Alt, F. W.: The XRCC4 gene encodes a novel protein involved in DNA double-strand break repair and V(D)J recombination. Cell 83:1079-1089, 1995.

Otevrel, T.; Stamato, T. D.: Regional localization of the XRCC4 human radiation repair gene. Genomics 27:211-214, 1995.

Blunt, T.; Taccioli, G. E.; Priestley, A.; Hafezparast, M.; McMillan, T.; Liu, J.; Cole, C. C.; White, J.; Alt, F. W.; Jackson, S. P.; Schurr, E.; Lehmann, A. R.; Jeggo, P. A.: A YAC contig encompassing the XRCC5 (Ku80) DNA repair gene and complementation defective cells by YAC protoplast fusion. Genomics 30:320-328, 1995.

Fuentes, J.-J.; Pritchard, M. A.; Planas, A. M.; Bosch, A.; Ferrer, I.; Estivill, X.: A new human gene from the Down syndrome critical region encodes a proline-rich protein highly expressed in fetal brain and heart. Hum. Molec. Genet. 4:1935-1944, 1995.

Sukhatme, V. P.; Sizer, K. C.; Vollmer, A. C.; Hunkapiller, T.; Parnes, J. R.: The T cell differentiation antigen leu-2/T8 is homologous to immunoglobulin and T cell receptor variable regions. Cell 40:591-597, 1985.

Chen, D. J.; Marrone, B. L.; Nguyen, T.; Stackhouse, M.; Zhao, Y.; Siciliano, M. J.: Regional assignment of a human DNA repair gene (XRCC5) to 2q35 by x-ray hybrid mapping. Genomics 21:423-427, 1994.

Bettaieb, A.; Fromont, P.; Rodet, M.; Godeau, B.; Duedari, N.; Bierling, P.: Br (b), a platelet alloantigen involved in neonatal alloimmune thrombocytopenia. Vox Sang. 60:230-234, 1991.

Carlsson, L. E.; Santoso, S.; Spitzer, C.; Kessler, C.; Greinacher, A.: The alpha-2 gene coding sequence T807/A873 of the platelet collagen receptor integrin alpha-2/beta-1 might be a genetic risk factor for the development of stroke in younger patients. Blood 93:3583-3586,1999.

Chen, D. J.; Park, M. S.; Campbell, E.; Oshimura, M.; Liu, P.; Zhao, Y.; White, B. F.; Siciliano, M. J.: Assignment of a human DNA double-strand break repair gene (XRCC5) to chromosome 2. Genomics 13:1088-1094, 1992.

Difilippantonio, M. J.; Zhu, J.; Chen, H. T.; Meffre, E.; Nussenzweig, M. C.; Max, E. E.; Ried, T.; Nussenzweig, A.: DNA repair protein Ku80 suppresses chromosomal aberrations and malignant transformation. Nature 404:510-514, 2000.

Jeggo, P. A.; Hafezparast, M.; Thompson, A. F.; Broughton, B. C.; Kaur, G. P.; Zdzienicka, M. Z.; Athwal, R. S.: Localization of a DNA repair gene (XRCC5) involved in double-strand-break rejoining to human chromosome 2. Proc. Nat. Acad. Sci. 89:6423-6427, 1992.

Taccioli, G. E.; Gottlieb, T. M.; Blunt, T.; Priestley, A.; Demengeot, J.; Mizuta, R.; Lehmann, A. R.; Alt, F. W.; Jackson, S. P.; Jeggo, P. A.: Ku80: product of the XRCC5 gene and its role in DNA repair and V(D)J recombination. Science 265:1442-1445, 1994.

Ohkuchi, A.; Shiraishi, H.; Minakami, H.; Eguchi, Y.; Izumi, A.; Sato, I.: Fetus with long QT syndrome manifested by tachyarrhythmia: a case report. Prenat. Diag. 19:990-992, 1999.

Pacia, S. V.; Devinsky, O.; Luciano, D. J.; Vazquez, B.: The prolonged QT syndrome presenting as epilepsy: a report of two cases and literature review. Neurology 44:1408-1410, 1994.

Piippo, K.; Swan, H.; Pasternack, M.; Chapman, H.; Paavonen, K.; Viitasalo, M.; Toivonen, L.; Kontula, K.: A founder mutation of the potassium channel KCNQ1 in long QT syndrome: implications for estimation of disease prevalence and molecular diagnostics. J. Am. Coll. Cardiol. 37:562-568, 2001.

Pony, J. C.; Matheyses, M.; Daubert, J. C.; Fourdilis, M.; Gouffault, J.: Le syndrome QT long-syncope familial: deux observations de syndromede Romano et Ward. Arch. Mal. Coeur 70:1105-1114, 1977.

Priori, S. G.; Schwartz, P. J.; Napolitano, C.; Bianchi, L.; Dennis, A.; De Fusco, M.; Brown, A. M.; Casari, G.: A recessive variant of the Romano-Ward Long-QT syndrome? Circulation 97:2420-2425, 1998.

Romano, C.: Congenital cardiac arrhythmia. (Letter) Lancet I:658-659, 1965.

Romano, C.; Gemme, G.; Pongiglione, R.: Aritmie cardiache raredell' eta pediatrica. II. Accessi sincopali per fibrillazione ventricolareparossistica. (Presentazione del primo caso della letteratura pediatrica Italiana.) Clin. Pediat. 45:656-683, 1963.

Roy, N.; Kahlem, P.; Dausse, E.; Bennaceur, M.; Faure, S.; Weissenbach, J.; Komajda, M.; Denjoy, I.; Coumel, P.; Schwartz, K.; Guicheney, P.: Exclusion of HRAS from long QT locus. (Letter) Nature Genet. 8:113-114, 1994.

Roy, P. R.; Emanuel, R.; Ismail, S. A.; Tayib, M. H.: Hereditary prolongation of the Q-T interval: genetic observations and management in three families with 12 affected members. Am. J. Cardiol. 37:237-243, 1976.

Russell, M. W.; Dick, M., II; Collins, F. S.; Brody, L. C.: KVLQT1 mutations in three families with familial or sporadic long QT syndrome. Hum. Molec. Genet. 5:1319-1324, 1996.

Schmitt, N.; Schwarz, M.; Peretz, A.; Abitbol, I.; Attali, B.; Pongs, O.: A recessive C-terminal Jervell and Lange-Nielsen mutation of the KCNQ1 channel impairs subunit assembly. EMBO J. 19:332-340, 2000.

Schwartz, P. J.: Cardiac sympathetic innervation and the sudden infant death syndrome: a possible pathogenetic link. Am. J. Med. 60:167-172, 1976.

Schwartz, P. J.; Priori, S. G.; Bloise, R.; Napolitano, C.; Ronchetti, E.; Piccinini, A.; Goj, C.; Breithardt, G.; Schulze-Bahr, E.; Wedekind, H.; Nastoli, J.: Molecular diagnosis in a child with sudden infant death syndrome. (Letter) Lancet 358:1342-1343, 2001.

Schwartz, P. J.; Stramba-Badiale, M.; Segantini, A.; Austoni, P.; Bosi, G.; Giorgetti, R.; Grancini, F.; Marni, E. D.; Perticone, F.; Rosti, D.; Salice, P.: Prolongation of the QT interval and the sudden infant death syndrome. New Eng. J. Med. 338:1709-1714, 1998.

Shalaby, F. Y.; Levesque, P. C.; Yang, W.-P.; Little, W. A.; Conder, M. L.; Jenkins-West, T.; Blanar, M. A.: Dominant-negative KvLQT1 mutations underlie the LQT1 form of long QT syndrome. Circulation 96:1733-1736, 1997.

Shimizu, W.; Kurita, T.; Matsuo, K.; Suyama, K.; Aihara, N.; Kamakura, S.; Towbin, J. A.; Shimomura, K.: Improvement of repolarization abnormalities by a K+ channel opener in the LQT1 form of congenital long-QT syndrome. Circulation 97:1581-1588, 1998.

Singer, P. A.; Crampton, R. S.; Bass, N. H.: Familial Q-T prolongation syndrome: convulsive seizures and paroxysmal ventricular fibrillation. Arch. Neurol. 31:64-66, 1974.

Smilinich, N. J.; Day, C. D.; Fitzpatrick, G. V.; Caldwell, G. M.; Lossie, A. C.; Cooper, P. R.; Smallwood, A. C.; Joyce, J. A.; Schofield, P. N.; Reik, W.; Nicholls, R. D.; Weksberg, R.; Driscoll, D. J.; Maher, E. R.; Shows, T. B.; Higgins, M. J.: A maternally methylated CpG island in KvLQT1 is associated with an antisense paternal transcript and loss of imprinting in Beckwith-Wiedemann syndrome. Proc. Nat. Acad. Sci. 96:8064-8069, 1999.

Splawski, I.; Timothy, K. W.; Vincent, G. M.; Atkinson, D. L.; Keating, M. T.: Molecular basis of the long-QT syndrome associated with deafness. New Eng. J. Med. 336:1562-1567, 1997.

Touraine, J. L.; Betuel, H.; Souillet, G.; Jeune, M.: Combined immunodeficiency disease associated with absence of cell-surface HLA-A and -B antigens. J. Pediat. 93:47-51, 1978.

Wolf, H. M.; Hauber, I.; Gulle, H.; Thon, V.; Eggenbauer, H.; Fischer, M. B.; Fiala, S.; Eibl, M. M.: Brief report: Twin boys with major histocompatibility complex class II deficiency but inducible immune responses. New Eng. J. Med. 332:86-90, 1995.

Dupuis, S.; Dargemont, C.; Fieschi, C.; Thomassin, N.; Rosenzweig, S.; Harris, J.; Holland, S. M.; Schreiber, R. D.; Casanova, J.-L.: Impairment of mycobacterial but not viral immunity by a germline human STAT1 mutation. Science 293:300-303, 2001.

Findlay, K. A. B.; Kaptein, E.; Visser, T. J.; Burchell, B.: characterization of the uridine diphosphate-glucuronosyl transferase-catalyzing thyroid hormone glucuronidation in man. J. Clin. Endocr. Metab. 85:2879-2883, 2000.

Wooster, R.; Sutherland, L.; Ebner, T.; Clarke, D.; Da Cruz e Silva, O.; Burchell, B.: Cloning and stable expression of a new member of the human liver phenol/bilirubin:UDP-glucuronosyl transferase cDNA family. Biochem. J. 278:465-469, 1991.

Tanaka, S.; Yamashita, S.; Hosaka, K.: Cloning and expression of human cDNA encoding phosphatidyl inositol transfer protein beta. Biochim. Biophys. Acta 1259:199-202, 1995.

Choi, Y.-H.; Kim, K.-B.; Kim, H.-H.; Hong, G.-S.; Kwon, Y.-K.; Chung, C.-W.; Park, Y.-M.; Shen, Z.-J.; Kim, B. J.; Lee, S.-Y.; Jung, Y.-K.: FLASH coordinates NF-kappa-B activity via TRAF2. J. Biol. Chem. 276:25073-25077, 2001.

Imai, Y.; Kimura, T.; Murakami, A.; Yajima, N.; Sakamaki, K.; Yonehara, S.: The CED-4-homologous protein FLASH is involved in Fas-mediated activation of caspase-8 during apoptosis. Nature 398:777-785, 1999.

Doi, A.; Shiosaka, T.; Takaoka, Y.; Yanagisawa, K.; Fujita, S.: Molecular cloning of the cDNA encoding A+U-rich element RNA binding factor. Biochim. Biophys. Acta 1396:51-56, 1998.

Kamei, D.; Tsuchiya, N.; Yamazaki, M.; Meguro, H.; Yamada, M.:Two forms of expression and genomic structure of the human heterogeneous nuclear ribonucleoprotein D-like JKTBP gene (HNRPDL). Gene 228:13-22, 1999.

Tsuchiya, N.; Kamei, D.; Takano, A.; Matsui, T.; Yamada, M.: Cloning and characterization of a cDNA encoding a novel heterogeneous nuclear ribonucleoprotein-like protein and its expression in myeloid leukemia cells. J. Biochem. 123:499-507, 1998.

Ma, Y. H.; Betard, C.; Roy, M.; Davignon, J.; Kessling, A. M.: Identification of a second 'French Canadian' LDL receptor gene deletion and development of a rapid method to detect both deletions. Clin. Genet. 36:219-228, 1989.

Mandelshtam, M.; Chakir, K.; Shevtsov, S.; Golubkov, V.; Skobeleva, N.; Lipovetsky, B.; Konstantinov, V.; Denisenko, A.; Gaitskhoki, V.; Schwartz, E.: Prevalence of Lithuanian mutation among St. Petersburg Jews with familial hypercholesterolemia. Hum. Mutat. 12:255-258, 1998.

Meiner, V.; Landsberger, D.; Berkman, N.; Reshef, A.; Segal, P.; Seftel, H. C.; van der Westhuyzen, D. R.; Jeenah, M. S.; Coetzee, G. A.; Leitersdorf, E.: A common Lithuanian mutation causing familial hypercholesterolemia in Ashkenazi Jews. Am. J. Hum. Genet. 49:443-449, 1991.

Miyake, Y.; Tajima, S.; Funahashi, T.; Yamamura, T.; Yamamoto, A.: A point mutation of low-density-lipoprotein receptor causing rapid degradation of the receptor. Europ. J. Biochem. 210:1-7, 1992.

Moorjani, S.; Roy, M.; Torres, A.; Betard, C.; Gagne, C.; Lambert, M.; Brun, D.; Davignon, J.; Lupien, P.: Mutations of low-density-lipoprotein-receptor gene, variation in plasma cholesterol, and expression of coronary heart disease in homozygous familial hypercholesterolaemia. Lancet 341:1303-1306, 1993.

Oppenheim, A.; Friedlander, Y.; Dann, E. J.; Berkman, N.; Schwartz, S. P.; Leitersdorf, E.: Hypercholesterolemia in five Israeli Christian-Arab kindreds is caused by the 'Lebanese' allele at the low density lipoprotein receptor gene locus and by an additional independent major factor. Hum. Genet. 88:75-84, 1991.

Pisciotta, L.; Cantafora, A.; De Stefano, F.; Langheim, S.; Calandra, S.; Bertolini, S.: A 'de novO' mutation of the LDL-receptor gene as the cause of familial hypercholesterolemia. Biochim. Biophys. Acta 1587:7-11, 2002.

Rodningen, O. K.; Rosby, O.; Tonstad, S.; Ose, L.; Berg, K.; Leren, T. P.: A 9.6 kilobase deletion in the low density lipoprotein receptor gene in Norwegian familial hypercholesterolemia subjects. Clin. Genet. 42:288-295, 1992.

Rubinsztein, D. C.; Coetzee, G. A.; Marais, A. D.; Leitersdorf, E.; Seftel, H. C.; van der Westhuyzen, D. R.: Identification and properties of the proline-644-to-leucine mutant LDL receptor in South Africans of Indian origin. J. Lipid Res. 33:1647-1655, 1992.

Rudiger, N. S.; Heinsvig, E. M.; Hansen, F. A.; Faergeman, O.; Bolund, L.; Gregersen, N.: DNA deletions in the low density lipoprotein (LDL) receptor gene in Danish families with familial hypercholesterolemia. Clin. Genet. 39:451-462, 1991.

Ruffner, D. E.; Sprung, C. N.; Minghetti, P. P.; Gibbs, P. E. M.; Dugaiczyk, A.: Invasion of the human albumin-alpha-fetoprotein gene family by Alu, Kpn, and two novel repetitive DNA elements. Molec. Biol. Evol. 4:1-9, 1987.

Russell, D. W.; Lehrman, M. A.; Sudhof, T. C.; Yamamoto, T.; Davis, C. G.; Hobbs, H. H.; Brown, M. S.; Goldstein, J. L.: The LDL receptor in familial hypercholesterolemia: use of human mutations to dissect a membrane protein. Cold Spring Harbor Symp. Quant. Biol. 51:811-819,1986.

Russell, D. W.; Schneider, W. J.; Yamamoto, T.; Luskey, K. L.; Brown, M. S.; Goldstein, J. L.: Domain map of the LDL receptor: sequence homology with the epidermal growth factor precursor. Cell 37:577-585,1984.

Schuster, H.; Manke, C.; Fischer, J.; Keller, C.; Wolfram, G.; Zollner, N.: Identification of the valine 408 to methionine mutation in the LDL receptor in a Greek patient with homozygous familial hypercholesterolemia. Clin. Genet. 48:90-92, 1995.

Schuster, H.; Ostwald, P.; Keller, P.; Wolfram, G.; Keller, C.: Identification of the serine-156 to leucine mutation in the low-density lipoprotein receptor in a German family with familial hypercholesterolemia. Clin. Investig. 71:172-175, 1993.

Slagel, V.; Flemington, E.; Traina-Dorge, V.; Bradshaw, H.; Deininger, P.: Clustering and subfamily relationships of the Alu family in the human genome. Molec. Biol. Evol. 4:19-29, 1987.100. Soutar, A. K.; Knight, B. L.; Patel, D. D.: Identification of a point mutation in growth repeat C of the low density lipoprotein-receptor gene in a patient with homozygous familial hypercholesterolemia that affects ligand binding and intracellular movement of receptors. Proc. Nat. Acad. Sci. 86:4166-4170, 1989.101. Soutar, A. K.; McCarthy, S. N.; Seed, M.; Knight, B. L.: Relationship between apolipoprotein (a) phenotype, lipoprotein (a) concentration in plasma, and low density lipoprotein receptor function in a large kindred with familial hypercholesterolemia due to the pro664-to-leu-mutation in the LDL receptor gene. J. Clin. Invest. 88:483-492,1991.102. Steyn, K.; Weight, M. J.; Dando, B. R.; Christopher, K. J.; Rossouw, J. E.: The use of low density lipoprotein receptor activity of lymphocytes to determine the prevalence of familial hypercholesterolaemia in a rural South African community. J. Med. Genet. 26:32-36, 1989.103. Sudhof, T. C.; Goldstein, J. L.; Brown, M. S.; Russell, D. W.: The LDL receptor gene: a mosaic of exons shared with different proteins. Science 228:815-822, 1985.104. Sudhof, T. C.; Russell, D. W.; Goldstein, J. L.; Brown, M. S.; Sanchez-Pescador, R.; Bell, G. I.: Cassette of eight exons shared by genes for LDL receptor and EGF precursor. Science 228:893-895, 1985.105. Sun, X.-M.; Patel, D. D.; Bhatnager, D.; Knight, B. L.; Soutar, A. K.: Characterization of a splice-site mutation in the gene for the LDL receptor associated with an unpredictably severe clinical phenotype in English patients with heterozygous FH. Arterioscler. Thromb. Vasc. Biol. 15:219-227, 1995.106. Takahashi, M.; Ikeda, U.; Takahashi, S.; Hattori, H.; Iwasaki, T.; Ishihara, M.; Egashira, T.; Honma, S.; Asano, Y.; Shimada, K.: A novel mutation in exon 2 of the low-density lipoprotein-receptor gene in a patient with homozygous familial hypercholesterolemia. (Letter) Clin. Genet. 59:290-292, 2001.107. Taylor, R.; Bryant, J.; Gudnason, V.; Sigurdsson, G.; Humphries, S.: A study of familial hypercholesterolaemia in Iceland using RFLPs. J. Med. Genet. 26:494-498, 1989.108. Thiart, R.; Scholtz, C. L.; Vergotine, J.; Hoogendijk, C. F.; de Villiers, J. N. P.; Nissen, H.; Brusgaard, K.; Gaffney, D.; Hoffs, M. S.; Vermaak, W. J. H.; Kotze, M. J.: Predominance of a 6 bp deletion in exon 2 of the LDL receptor gene in Africans with familial hypercholesterolaemia. J. Med. Genet. 37:514-519, 2000.109. Tolleshaug, H.; Goldstein, J. L.; Schneider, W. J.; Brown, M. S.: Post-translational processing of the LDL receptor and its genetic disruption in familial hypercholesterolemia. Cell 30:715-724, 1982.110. Top, B.; Koeleman, B. P. C.; Gevers Leuven, J. A.; Havekes, L. M.; Frants, R. R.: Rearrangements in the LDL receptor gene in Dutch familial hypercholesterolemic patients and the presence of a common 4 kb deletion. Atherosclerosis 83:127-136, 1990.111. Top, B.; Uitterlinden, A. G.; van der Zee, A.; Kastelein, J. J. P.; Gevers Leuven, J. A.; Havekes, L. M.; Frants, R. R.: Absence of mutations in the promoter region of the low density lipoprotein receptor gene in a large number of familial hypercholesterolaemia patients as revealed by denaturing gradient gel electrophoresis. Hum. Genet. 89:561-565, 1992.112. Torrington, M.; Botha, J. L.: Familial hypercholesterolaemia and church affiliation. (Letter) Lancet II:1120 only, 1981.113. Ullu, E.; Tschudi, C.: Alu sequences are processed 7SL RNA genes. Nature 312:171-172, 1984.114. Varret, M.; Rabes, J.-P.; Collod-Beroud, G.; Junien, C.; Boileau, C.; Beroud, C.: Software and database for the analysis of mutations in the human LDL receptor gene. Nucleic Acids Res. 25:172-180,1997.115. Vergopoulos, A.; Bajari, T.; Jouma, M.; Knoblauch, H.; Aydin, A.; Bahring, S.; Mueller-Myhsok, B.; Dresel, A.; Joubran, R.; Luft, F. C.; Schuster, H.: A xanthomatosis-susceptibility gene may exist in a Syrian family with familial hypercholesterolemia. Europ. J. Hum. Genet. 5:315-323, 1997.116. Vergotine, J.; Thiart, R.; Langenhoven, E.; Hillermann, R.; DeJong, G.; Kotze, M. J.: Prenatal diagnosis of familial hypercholesterolemia:importance of DNA analysis in the high-risk South African population. Genet. Counsel. 12:121-127, 2001.117. Vuorio, A. F.; Turtola, H.; Piilahti, K.-M.; Repo, P.; Kanninen, T.; Kontula, K.: Familial hypercholesterolemia in the Finnish North Karelia: a molecular, clinical, and genealogical study. Arterioscler. Thromb. Vasc. Biol. 17:3127-3138, 1997.118. Wilson, D. J.; Gahan, M.; Haddad, L.; Heath, K.; Whittall, R. A.; Williams, R. R.; Humphries, S. E.; Day, I. N. M.: A World Wide Web site for low-density lipoprotein receptor gene mutations in familial hypercholesterolemia: sequence-based, tabular, and direct submission data handling. Am. J. Cardiol. 81:1509-1511, 1998.119. Yamakawa, K.; Okafuji, T.; Iwamura, Y.; Yuzawa, K.; Satoh, J.; Hattori, N.; Yamanouchi, Y.; Yanagi, H.; Kawai, K.; Tsuchiya, S.; Russell, D. W.; Hamaguchi, H.: TaqI polymorphism in the LDL receptor gene and a TaqI 1.5-kb band associated with familial hypercholesterolemia. Hum. Genet. 80:1-5, 1988.120. Yamakawa, K.; Takada, K.; Yanagi, H.; Tsuchiya, S.; Kawai, K.; Nakagawa, S.; Kajiyama, G.; Hamaguchi, H.: Three novel partial deletions of the low-density lipoprotein (LDL) receptor gene in familial hypercholesterolemia. Hum. Genet. 82:317-321, 1989.121. Yamamoto, T.; Davis, C. G.; Brown, M. S.; Schneider, W. J.; Casey, M. L.; Goldstein, J. L.; Russell, D. W.: The human LDL receptor:a cysteine-rich protein with multiple Alu sequences in its mRNA. Cell 39:27-38, 1984.122. Zuliani, G.; Hobbs, H. H.: Personal Communication. Dallas, Tex. 1990.

Nagase, T.; Kikuno, R.; Hattori, A.; Kondo, Y.; Okumura, K.; Ohara, O.: Prediction of the coding sequences of unidentified human genes. XIX. The complete sequences of 100 new cDNA clones from brain which code for large proteins in vitro. DNA Res. 7:347-355, 2000.

O'Carroll, D.; Scherthan, H.; Peters, A. H. F. M.; Opravil, S.; Haynes, A. R.; Laible, G.; Rea, S.; Schmid, M.; Lebersorger, A.; Jerratsch, M.; Sattler, L.; Mattei, M. G.; Denny, P.; Brown, S. D. M.; Schweizer, D.; Jenuwein, T.: Isolation and characterization of Suv39h2, a second histone H3 methyltransferase gene that displays testis-specific expression. Molec. Cell. Biol. 20:9423-9433, 2000.

Davis, R. S.; Wang, Y.-H.; Kubagawa, H.; Cooper, M. D.: Identification of a family of Fc receptor homologs with preferential B cell expression. Proc. Nat. Acad. Sci. 98:9772-9777, 2001.

Xu, M.; Zhao, R.; Zhao, Z. J.: Molecular cloning and characterization of SPAP1, an inhibitory receptor. Biochem. Biophys. Res. Commun. 280:768-775, 2001.

Anneren, C.; Reedquist, K. A.; Bos, J. L.; Welsh, M.: GTK, a Src-related tyrosine kinase, induces nerve growth factor-independent neurite outgrowth in PC12 cells through activation of the Rap1 pathway: relationship to Shb tyrosine phosphorylation and elevated levels of focal adhesion kinase. J. Biol. Chem. 275:29153-29161, 2000.

Cance, W. G.; Craven, R. J.; Bergman, M.; Xu, L.; Alitalo, K.; Liu, E. T.: Rak, a novel nuclear tyrosine kinase expressed in epithelial cells. Cell Growth Differ. 5:1347-1355, 1994.

Cance, W. G.; Craven, R. J.; Weiner, T. M.; Liu, E. T.: Novel protein kinases expressed in human breast cancer. Int. J. Cancer 54:571-577, 1993.

Lee, J.; Wang, Z.; Luoh, S.-M.; Wood, W. I.; Scadden, D. T.: Cloning of FRK, a novel human intracellular SRC-like tyrosine kinase-encoding gene. Gene 138:247-251, 1994.

Scott, A. F.: Personal Communication. Baltimore, Md. Dec. 19, 2001.

Betz, A.; Thakur, P.; Junge, H. J.; Ashery, U.; Rhee, J.-S.; Scheuss, V.; Rosenmund, C.; Rettig, J.; Brose, N.: Functional interaction of the active zone proteins Munc13-1 and RIM1 in synaptic vesicle priming. Neuron 30:183-196, 2001.

Castillo, P. E.; Schoch, S.; Schmitz, F.; Sudhof, T. C.; Malenka, R. C.: RIM1-alpha is required for presynaptic long-term potentiation. Nature 415:327-330, 2002.

Coppola, T.; Magnin-Luthi, S.; Perret-Menoud, V.; Gattesco, S.; Schiavo, G.; Regazzi, R.: Direct interaction of the Rab3 effector RIM with Ca (2+) channels, SNAP-25, and synaptotagmin. J. Biol. Chem. 276:32756-32762, 2001.

Schoch, S.; Castillo, P. E.; Jo, T.; Mukherjee, K.; Geppert, M.; Wang, Y.; Schmitz, F.; Malenka, R. C.; Sudhof, T. C.: RIM1-alphaforms a protein scaffold for regulating neurotransmitter release at the active zone. Nature 415:321-326, 2002.

Wang, Y.; Sugita, S.; Sudhof, T. C.: The RIM/NIM family of neuronal C-2 domain proteins: interactions with Rab3 and a new class of Srchomology 3 domain proteins. J. Biol. Chem. 275:20033-20044, 2000.

Vreugde, S.; Erven, A.; Kros, C. J.; Marcotti, W.; Fuches, H.; Kurima, K.; Wilcox, E. R.; Friedman, T. B.; Griffith, A. J.; Balling, R.; de Angelis, M. H.; Avraham, K. B.; Steel, K. P.: Beethoven, a mouse model for dominant, progressive hearing loss DFNA36. Nature Genet. 30:257-258, 2002.

Grunder, S.; Geissler, H.-S.; Bassler, E.-L.; Ruppersberg, J. P.: A new member of acid-sensing ion channels from pituitary gland. Neuroreport 11:1607-1611, 2000.

Tatarelli, C.; Linnenbach, A.; Mimori, K.; Croce, C. M.: characterization of the human TESTIN gene localized in the FRA7G region at 7q31.2. Genomics 68:1-12, 2000.

Tobias, E. S.; Hurlstone, A. F. L.; MacKenzie, E.; McFarlane, R.; Black, D. M.: The TES gene at 7q31.1 is methylated in tumours and encodes a novel growth-suppressing LIM domain protein. Oncogene 20:2844-2853, 2001.

Ferdinandusse, S.; Mulders, J.; IJlst, L.; Denis, S.; Dacremont, G.; Waterham, H. R.; Wanders, R. J. A.: Molecular cloning and expression of human carnitine octanoyltransferase: evidence for its role in the peroxisomal beta-oxidation of branched-chain fatty acids. Biochem. Biophys. Res. Commun. 263:213-218, 1999.

Nestel, F. P.; Colwill, K.; Harper, S.; Pawson, T.; Anderson, S. K.: RS cyclophilins: identification of an NK-TR(1)-related cyclophilin. Gene 180:151-155, 1996.

Gao, J.; Yu, L.; Zhang, P.; Jiang, J.; Chen, J.; Peng, J.; Wei, Y.; Zhao, S.: Cloning and characterization of human and mouse mitochondrial elongation factor G, GFM and Gfm, and mapping of GFM to human chromosome 3q25.1-q26.2. Genomics 74:109-114, 2001.

Clark, K. L; Zeng, Z.; Langford, A. L; Bowen, S. M; Todd, S. C.: PGRL is a major CD81-associated protein on lymphocytes and distinguishes a new family of cell surface proteins. J. Immun. 167:5115-5121,2001.

Stipp, C. S.; Kolesnikova, T. V.; Hemler, M. E.: EWI-2 is a major CD9 and CD81 partner and member of a novel Ig protein subfamily. J. Biol. Chem. 276:40545-40554, 2001.

Miura, K.; Jacques, K. M.; Stauffer, S.; Kubosaki, A.; Zhu, K.; Hirsch, D. S.; Resau, J.; Zheng, Y.; Randazzo, P. A.: ARAP1: a point of convergence for Arf and Rho signaling. Molec. Cell 9:109-119,2002.

Dumoutier, L.; Lejeune, D.; Colau, D.; Renauld, J. C.: Cloning and characterization of IL-22 binding protein, a natural antagonist of IL-10-related T cell-derived inducible factor/IL 22. J. Immun. 166:7090-7095, 2001.

Kotenko, S. V.; Izotova, L. S.; Mirochnitchenko, O. V.; Esterova, E.; Dickensheets, H.; Donnelly, R. P.; Pestka, S.: Identification, cloning, and characterization of a novel soluble receptor that binds IL-22 and neutralizes its activity. J. Immun. 166:7096-7103, 2001.

Xu, W.; Presnell, S. R.; Parrish-Novak, J.; Kindsvogel, W.; Jaspers, S.; Chen, Z.; Dillon, SR.; Gao, Z.; Gilbert, T.; Madden, K.; Schlutsmeyer, S.; Yao, L.; and 11 others: A soluble class II cytokine receptor, IL-22RA2, is a naturally occurring IL-22 antagonist. Proc. Nat. Acad. Sci. 98:9511-9516, 2001.

Hicar, M. D.; Liu, Y.; Allen, C. E.; Wu, L.-C.: Structure of the human zinc finger protein HIVEP3: molecular cloning, expression, exon-intron structure, and comparison with paralogous genes HIVEP1 and HIVEP2. Genomics 71:89-100, 2001.

Bates, E. E. M.; Fridman, W. H.; Mueller, C. G. F.: The ADAMDEC1(decysin) gene structure: evolution by duplication in a metalloprotease gene cluster on chromosome 8p12. Immunogenetics 54:96-105, 2002.

Bridges, L. C.; Tani, P. H.; Hanson, K. R.; Roberts, C. M.; Judkins, M. B.; Bowditch, R. D.: The lymphocyte metalloprotease MDC-L (ADAM28) is a ligand for the integrin alpha-4/beta-1. J. Biol. Chem. 277:3784-3792, 2002.

Jury, J. A.; Perry, A. C. F.; Hall, L.: Identification, sequence analysis and expression of transcripts encoding a putative metalloproteinase, eMDC II, in human and macaque epididymis. Molec. Hum. Reprod. 5:1127-1134, 1999.

Roberts, C. M.; Tani, P. H.; Bridges, L. C.; Laszik, Z.; Bowditch, R. D.: MDC-L, a novel metalloprotease disintegrin cysteine-rich protein family member expressed by human lymphocytes. J. Biol. Chem. 274:29251-29259, 1999.

Koontz, J. I.; Soreng, A. L.; Nucci, M.; Kuo, F. C.; Pauwels, P.; van den Berghe, H.; Cin, P. D.; Fletcher, J. A.; Sklar, J.: Frequent fusion of the JAZF1 and JJAZ1 genes in endometrial stromal tumors. Proc. Nat. Acad. Sci. 98:6348-6353, 2001.

Fitzgerald, K. A.; Palsson-McDermott, E. M.; Bowie, A. G.; Jefferies, C. A.; Mansell, A. S.; Brady, G.; Brint, E.; Dunne, A.; Gray, P.; Harte, M. T.; McMurray, D.; Smith, D. E.; Sims, J. E.; Bird, T. A.; O'Neill, L. A. J.: Mal (MyD88-adapter-like) is required for Toll-like receptor-4 signal transduction. Nature 413:78-83, 2001.

Horng, T.; Barton, G. M.; Medzhitov, R.: TIRAP: an adapter molecule in the Toll signaling pathway. Nature Immun. 2:835-841, 2001.

Mirzayans, F.; Pearce, W. G.; MacDonald, I. M.; Walter, M. A.: Mutation of the PAX6 gene in patients with autosomal dominant keratitis. Am. J. Hum. Genet. 57:539-548, 1995.

Dose, A. C.; Burnside, B.: Cloning and chromosomal localization of a human class III myosin. Genomics 67:333-342, 2000.

Walsh, T.; Walsh, V.; Vreugde, S.; Hertzano, R.; Shahin, H.; Haika, S.; Lee, M. K.; Kanaan, M.; King, M.-C.; Avraham, K. B.: From flies' eyes to our ears: mutations in a human class III myosin cause progressive nonsyndromic hearing loss DFNB30. Proc. Nat. Acad. Sci. 99:7518-7523, 2002.

Leo, C. P.; Hsu, S. Y.; McGee, E. A.; Salanova, M.; Hsueh, A. J. W.: DEFT, a novel death effector domain-containing molecule predominantly expressed in testicular germ cells. Endocrinology 139:4839-4848, 1998.

Stegh, A. H.; Schickling, O.; Ehret, A.; Scaffidi, C.; Peterhansel, C.; Hofmann, T. G.; Grummt, I.; Krammer, P. H.; Peter, M. E.: DEDD, a novel death effector domain-containing protein, targeted to the nucleolus. EMBO J. 17:5974-5986, 1998.

Oukka, M.; Kim, S. T.; Lugo, G.; Sun, J.; Wu, L.-C.; Glimcher, L. H.: A mammalian homolog of Drosophila schnurri, KRC, regulates TNF receptor-driven responses and interacts with TRAF2. Molec. Cell 9:121-131, 2002.

Walder, R. Y.; Landau, D.; Meyer, P.; Shalev, H.; Tsolia, M.; Borochowitz, Z.; Boettger, M. B.; Beck, G. E.; Englehardt, R. K.; Carmi, R.; Sheffield, V. C.: Mutation of TRPM6 causes familial hypomagnesemia with secondary hypocalcemia. Nature Genet. 31:171-174, 2002.

Liang, J. C.; Chang, K. S.; Schroeder, W.; Siciliano, M.; Trujillo, J.; Stass, S.: The human myeloperoxidase gene locates on chromosome 17q22-24 and is translocated in acute promyelocytic leukemia. (Abstract) Am. J. Hum. Genet. 41:A226, 1987.

Liang, J. C.; Chang, K. S.; Schroeder, W. T.; Freireich, E. J.; Stass, S. A.; Trujillo, J. M.: The myeloperoxidase gene is translocated from chromosome 17 to 15 in a patient with acute promyelocytic leukemia. Cancer Genet. Cytogenet. 30:103-107, 1988.

Miki, T.; Weil, S. C.; Rosner, G. L.; Reid, M. S.; Kidd, K. K.: An MPO cDNA clone identifies an RFLP with PstI. Nucleic Acids Res. 16:1649, 1988.

Morishita, K.; Kubota, N.; Asano, S.; Kaziro, Y.; Nagata, S.: Molecular cloning and characterization of cDNA for human myeloperoxidase. J. Biol. Chem. 262:3844-3851, 1987.

Murao, S.-I.; Stevens, F. J.; Ito, A.; Huberman, E.: Myeloperoxidase: a myeloid cell nuclear antigen with DNA-binding properties. Proc. Nat. Acad. Sci. 85:1232-1236, 1988.

Nauseef, W.; Cogley, M.; McCormick, S.: Effect of the R569W missense mutation on the biosynthesis of myeloperoxidase. J. Biol. Chem. 271:9546-9549, 1996.

Nauseef, W. M.; Olsson, I.; Arnljots, K.: Biosynthesis and processing of myeloperoxidase--a marker for myeloid cell differentiation. Europ. J. Haemat. 40:97-110, 1988.

Reynolds, W. F.; Hiltunen, M.; Pirskanen, M.; Mannermaa, A.; Helisalmi, S.; Lehtovirta, M.; Alafuzoff, I.; Soininen, H.: MPO and APOE epsilon-4 polymorphisms interact to increase risk for AD in Finnish males. Neurology 55:1284-1290, 2000.

Robinson, T. J.; Morris, D. J.; Ledbetter, D. H.: Chromosomal assignment and regional localization of myeloperoxidase in the mouse. Cytogenet. Cell Genet. 53:83-86, 1990.

Romano, M.; Dri, P.; Dadalt, L.; Patriarca, P.; Baralle, F. E.: Biochemical and molecular characterization of hereditary myeloproliferative deficiency. Blood 90:4126-4134, 1997.

van Tuinen, P.; Johnson, K. R.; Ledbetter, S. A.; Nussbaum, R. L.; Rovera, G.; Ledbetter, D. H.: Localization of myeloperoxidase to the long arm of human chromosome 17: relationship to the 15;17 translocation of acute promyelocytic leukemia. Oncogene 1:319-322, 1987.

Weil, S. C.; Rosner, G. L.; Reid, M. S.; Chisholm, R. L.; Farber, N. M.; Spitznagel, J. K.; Swanson, M. S.: cDNA cloning of human myeloperoxidase: decrease in myeloperoxidase mRNA upon induction of HL-60 cells. Proc. Nat. Acad. Sci. 84:2057-2061, 1987.

Weil, S. C.; Rosner, G. L.; Reid, M. S.; Chisholm, R. L.; Lemons, R. S.; Swanson, M. S.; Carrino, J. J.; Diaz, M. O.; Le Beau, M. M.: Translocation and rearrangement of myeloperoxidase gene in acute promyelocytic leukemia. Science 240: 790-792, 1988.

Yamada, M.; Hur, S.-J.; Hashinaka, K.; Tsuneoka, K.; Saeki, T.; Nishio, C.; Sakiyama, F.; Tsunasawa, S.: Isolation and characterization of a cDNA coding for human myeloperoxidase. Arch. Biochem. Biophys. 255:147-155, 1987.

Zaki, S. R.; Austin, G. E.; Chan, W. C.; Conaty, A. L.; Trusler, S.; Trappier, S.; Lindsey, R. B.; Swan, D. C.: Chromosomal localization of the human myeloperoxidase gene by in situ hybridization using oligonucleotide probes. Genes Chromosomes Cancer 2:266-270, 1990.

Saiardi, A.; Erdjument-Bromage, H.; Snowman, A. M.; Tempst, P.; Snyder, S. H.: Synthesis of diphosphoinositol pentakisphosphate by a newly identified family of higher inositol polyphosphate kinases. Curr. Biol. 9:1323-1326, 1999.

Saiardi, A.; Nagata, E.; Luo, H. R.; Snowman, A. M.; Snyder, S. H.: Identification and characterization of a novel inositol hexakisphosphate kinase. J. Biol. Chem. 276:39179-39185, 2001.

Nishida, K.; Yoshida, Y.; Itoh, M.; Fukada, T.; Ohtani, T.; Shirogane, T.; Atsumi, T.; Takahashi-Tezuka, M.; Ishihara, K.; Hibi, M.; Hirano, T.: Gab-family adapter proteins act downstream of cytokine and growth factor receptors and T- and B-cell antigen receptors. Blood 93:1809-1816, 1999.

Zhao, C.; Yu, D.-H.; Shen, R.; Feng, G.-S.: Gab2, a new pleckstrin homology domain-containing adapter protein, acts to uncouple signaling from ERK kinase to Elk-1. J. Biol. Chem. 274:19649-19654, 1999.

Lescure, A.; Gautheret, D.; Carbon, P.; Krol, A.: Novel selenoproteins identified in silico and in vivo by using a conserved RNA structural motif. J. Biol. Chem. 274:38147-38154, 1999.

Berghs, S.; Aggujaro, D.; Dirkx, R., Jr.; Maksimova, E.; Stabach, P.; Hermel, J.-M.; Zhang, J.-P.; Philbrick, W.; Slepnev, V.; Ort, T.; Slimena, M.: Beta-IV spectrin, a new spectrin localized at axon initial segments and nodes of Ranvier in the central and peripheral nervous system. J. Cell Biol. 151:985-1001, 2000.

Bock, G. R.; Frank, M. P.; Steel, K. P.; Deol, M. S.: The quivering mutant mouse: hereditary deafness of central origin. Acta Otolaryng. 96:371-377, 1983.

Deol, M. S.; Frank, M. P.; Steel, K. P.; Bock, G. R.: Genetic deafness of central origin. Brain Res. 258:177-179, 1983.

Parkinson, N. J.; Olsson, C. L.; Hallows, J. L.; McKee-Johnson, J.; Keogh, B. P.; Noben-Trauth, K.; Kujawa, S. G.; Tempel, B. L.:Mutant beta-spectrin 4 causes auditory and motor neuropathies in quivering mice. Nature Genet. 29:61-65, 2001.

Tse, W. T.; Tang, J.; Jin, O.; Korsgren, C.; John, K. M.; Kung, A. L.; Gwynn, B.; Peters, L. L.; Lux, S. E.: A new spectrin, beta-IV, has a major truncated isoform that associates with promyelocytic leukemia protein nuclear bodies and the nuclear matrix. J. Biol. Chem. 276:23974-23985, 2001.

Yoon, C. H.; Les, E. P.: Quivering, a new first chromosome mutation in mice. J. Hered. 48:176-180, 1957.

Petek, E.; Windpassinger, C.; Egger, H.; Kroisel, P. M.; Wagner, K.: Localization of the human anterior gradient-2 gene (AGR2) to chromosome band 7p21.3 by radiation hybrid mapping and fluorescence in situ hybridisation. Cytogenet. Cell Genet. 89:141-142, 2000.

Thompson, D. A.; Weigel, R. J.: hAG-2, the human homologue of the Xenopus laevis cement gland gene XAG-2, is coexpressed with estrogen receptor in breast cancer cell lines. Biochem. Biophys. Res. Commun. 251:111-116, 1998.

Saitoh, T.; Katoh, M.: Molecular cloning and characterization of human WNT5B on chromosome 12p13.3 region. Int. J. Oncol. 19:347-351, 2001.

Miyazaki, K.; Matsuda, S.; Ichigotani, Y.; Takenouchi, Y.; Hayashi, K.; Fukuda, Y.; Nimura, Y.; Hamaguchi, M.: Isolation and characterization of a novel human gene (NESH) which encodes a putative signaling molecule similar to e3B1 protein. Biochim. Biophys. Acta 1493:237-241, 2000.

Nosaka, K.; Onozuka, M.; Kakazu, N.; Hibi, S.; Nishimura, H.; Nishino, H.; Abe, T.: Isolation and characterization of a human thiamine pyrophosphokinase cDNA. Biochem. Biophys. Acta 1517:293-297, 2001.

Nosaka, K.; Onozuka, M.; Nishino, H.; Nishimura, H.; Kawasaki, Y.; Ueyama, H.: Molecular cloning and expression of a mouse thiamin pyrophosphokinase cDNA. J. Biol. Chem. 274:34129-34133, 1999.

Zhao, R.; Gao, F.; Goldman, I. D.: Molecular cloning of human thiamin pyrophosphokinase. Biochim. Biophys. Acta 1517:320-322,2001.

Reboul, J.; Gardiner, K.; Monneron, D.; Uze, G.; Lutfalla, G.:Comparative genomic analysis of the interferon/interleukin-10 receptor gene cluster. Genome Res. 9:242-250, 1999.

Chen, Q.; Ghilardi, N.; Wang, H.; Baker, T.; Xie, M.-H.; Gurney, A.; Grewal, I. S.; de Sauvage, F. J.: Development of Th1-type immune responses requires the type 1 cytokine receptor TCCR. Nature 407:916-920, 2000.

Sprecher, C. A.; Grant, F. J.; Baumgartner, J. W.; Presnell, S. R.; Schrader, S. K.; Yamagiwa, T.; Whitmore, T. E.; O'Hara, P. J.; Foster, D. F.: Cloning and characterization of a novel class I cytokine receptor. Biochem. Biophys. Res. Comm. 246:82-90, 1998.

Yoshida, H.; Hamano, S.; Senaldi, G.; Covey, T.; Faggioni, R.; Mu, S.; Xia, M.; Wakeham, A. C.; Nishina, H.; Potter, J.; Saris, C. J. M.; Mak, T. W.: WSX-1 is required for the initiation of Th1 responses and resistance to L. major infection. Immunity 15:569-578, 2001.

Autieri, M. V.; Carbone, C. J.:14-3-3-Gamma interacts with and is phosphorylated by multiple protein kinase C isoforms in PDGF-stimulated human vascular smooth muscle cells. DNA Cell Biol. 18:555-564,1999.

Yeh, W.-C.; de la Pompa, J. L.; McCurrach, M. E.; Shu, H.-B.; Elia, A. J.; Shahinian, A.; Ng, M.; Wakeham, A.; Khoo, W.; Mitchell, K.; El-Deiry, W. S.; Lowe, S. W.; Goeddel, D. V.; Mak, T. W.: FADD: essential for embryo development and signaling from some, but not all, inducers of apoptosis. Science 279:1954-1958, 1998.

Zhang, J.; Cado, D.; Chen, A.; Kabra, N. H.; Winoto, A.: Fas-mediated apoptosis and activation-induced T-cell proliferation are defective in mice lacking FADD/Mort1. Nature 392:296-300, 1998.

Torres, R.; Polymeropoulos, M. H.: Genomic organization and localization of the human CRMP-1 gene. DNA Res. 5:393-395, 1998.

Koyama, K.; Sudo, K.; Nakamura, Y.: Isolation of 115 human chromosome 8-specific expressed-sequence tags by exon amplification. Genomics 26:245-253, 1995.

Black, J. L., III; Lennon, V. A.: Identification and cloning of putative human neuronal voltage-gated calcium channel gamma-2 and gamma-3 subunits: neurologic implications. Mayo Clin. Proc. 74:357-361, 1999.

Chen, L.; Chetkovich, D. M.; Petralla, R. S.; Sweeney, N. T.; Kawasaki, Y.; Wenthold, R. J.; Bredt, D. S.; Nicoli, R. A.: Stargazin regulates synaptic targeting of AMPA receptors by two distinct mechanisms. Nature 408:936-943, 2000.

Letts, V. A.; Felix, R.; Biddlecome, G. H.; Arikkath, J.; Mahaffey, C. L.; Valenzuela, A.; Bartlett, F. S, II; Mori, Y.; Campbell, K. P.; Frankel, W. N.: The mouse stargazer gene encodes a neuronal Ca (2+)-channel gamma subunit. Nature Genet. 19:340-347, 1998.

Nuber, U.; Schwarz, S.; Kaiser, P.; Schneider, R.; Scheffner, M.: Cloning of human ubiquitin-conjugating enzymes UbcH6 and UbcH7 (E2-F1) and characterization of their interaction with E6-AP and RSP5. J. Biol. Chem. 271:2795-2800, 1996.

Fuentes, J. J.; Pritchard, M. A.; Estivill, X.: Genomic organization, alternative splicing, and expression patterns of the DSCR1 (Down syndrome candidate region 1) gene. Genomics 44:358-361, 1997.

Kingsbury, T. J.; Cunningham, K. W.: A conserved family of calcineurin regulators. Genes Dev. 14:1595-1604, 2000.

Rothermel, B.; Vega, R. B.; Yang, J.; Wu, H.; Bassel-Duby, R.; Williams, R. S.: A protein encoded within the Down syndrome critical region is enriched in striated muscles and inhibits calcineurin signaling. J. Biol. Chem. 275:8719-8725, 2000.

Pata, I.; Tensing, K.; Metspalu, A.: A human cDNA encoding the homologue of NADH:ubiquinone oxidoreductase subunit B13. Biochim. Biophys. Acta 1350:115-118, 1997.

Russell, M. W.; du Manoir, S.; Collins, F. S.; Brody, L. C.: Cloning of the human NADH:ubiquinone oxidoreductase subunit B13: localization to chromosome 7q32 and identification of a pseudogene on 11p15. Mammalian Genome 8:60-61, 1997.

Perez Jurado, L. A.; Wang, Y.-K.; Peoples, R.; Coloma, A.; Cruces, J.; Francke, U.:A duplicated gene in the break point regions of the 7q11.23 Williams-Beuren syndrome deletion encodes the initiator binding protein TFII-I and BAP-135, a phosphorylation target of BTK. Hum. Molec. Genet. 7:325-334, 1998.

Yang, W.; Desiderio, S.: BAP-135, a target for Bruton's tyrosine kinase in response to B cell receptor engagement. Proc. Nat. Acad. Sci. 94:604-609, 1997.

Lee, J. W.; Choi, H.-S.; Gyuris, J.; Brent, R.; Moore, D. D.:Two classes of proteins dependent on either the presence or absence of thyroid hormone for interaction with the thyroid hormone receptor. Molec. Endocr. 9:243-254, 1995.

Burnatowska-Hledin, M. A.; Spielman, W. S.; Smith, W. L.; Shi, P.; Meyer, J. M.; Dewitt, D. L.: Expression cloning of an AVP-activated, calcium-mobilizing receptor from rabbit kidney medulla. Am. J. Physiol. 268:F1198-F1210, 1995.

Byrd, P. J.; Stankovic, T.; McConville, C. M.; Smith, A. D.; Cooper, P. R.; Taylor, A. M. R.: Identification and analysis of expression of human VACM-1, a cullin gene family member located on chromosome 11q22-23. Genome Res. 7:71-75, 1997.

Venturini, L.; You, J.; Stadler, M.; Galien, R.; Lallemand, V.; Koken, M. H. M.; Mattei, M. G.; Ganser, A.; Chambon, P.; Losson, R.; de The, H.: TIF1-gamma, a novel member of the transcriptional intermediary factor 1 family. Oncogene 18:1209-1217, 1999.

Lesage, F.; Guillemare, E.; Fink, M.; Duprat, F.; Lazdunski, M.; Romey, G.; Barhanin, J.: TWIK-1, a ubiquitous human weakly inward rectifying K+ channel with a novel structure. EMBO J. 15:1004-1011,1996.

Lesage, F.; Mattei, M.-G.; Fink, M.; Barhanin, J.; Lazdunski, M.: Assignment of the human weak inward rectifier K+ channel TWIK-1gene to chromosome 1q42-q43. Genomics 34:153-155, 1996.

Alderson, M. R.; Smith, C. A.; Tough, T. W.; Davis-Smith, T.; Armitage, R. J.; Falk, B.; Roux, E.; Baker, E.; Sutherland, G. R.; Din, W. S.; Goodwin, R. G.: Molecular and biological characterization of human 4-1BB and its ligand. Europ. J. Immun. 24:2219-2227, 1994.

Kwon, B. S.; Weissman, S. M.: cDNA sequences of two inducible T-cell genes. Proc. Nat. Acad. Sci. 86:1963-1967, 1989.

Loo, D. T.; Chalupny, N. J.; Bajorath, J.; Shuford, W. W.; Mittler, R. S.; Aruffo, A.: Analysis of 4-1BBL and laminin binding to murine 4-1BB, a member of the tumor necrosis factor receptor superfamily, and comparison with human 4-1BB. J. Biol. Chem. 272:6448-6456,1997.

Schwarz, H.; Arden, K.; Lotz, M.: CD137, a member of the tumor necrosis factor receptor family, is located on chromosome 1p36, in a cluster of related genes, and colocalizes with several malignancies. Biochem. Biophys. Res. Commun. 235:699-703, 1997.

Schwarz, H.; Blanco, F. J.; von Kempis, J.; Valbracht, J.; Lotz, M.: ILA, a member of the human nerve growth factor/tumor necrosis factor receptor family, regulates T-lymphocyte proliferation and survival. Blood 87:2839-2845, 1996.

Schwarz, H.; Tuckwell, J.; Lotz, M.: A receptor induced by lymphocyte activation (ILA): a new member of the human nerve-growth-factor/tumor-necrosis-factor receptor family. Gene 134:295-298, 1993.

Feuchter-Murthy, A. E.; Freeman, J. D.; Mager, D. L.: Splicing of a human endogenous retrovirus to a novel phospholipase A2 related gene. Nucleic Acids Res. 21:135-143, 1993.

Kowalski, P. E.; Freeman, J. D.; Mager, D. L.: Intergenic splicing between a HERV-H endogenous retrovirus and two adjacent human genes. Genomics 57:371-379, 1999.

Baylin, S. B.; Herman, J. G.; Graff, J. R.; Vertino, P. M.; Issa, J. P.: Alterations in DNA methylation: a fundamental aspect of neoplasia. Adv. Cancer Res. 72:141-196, 1998.

Lei, H.; Oh, S. P.; Okano, M.; Juttermann, R.; Goss, K. A.; Jaenisch, R.; Li, E.: De novo DNA cytosine methyltransferase activities in mouse embryonic stem cells. Development 122: 3195-3205, 1996.

Okano, M.; Xie, S.; Li, E.: Cloning and characterization of a family of novel mammalian DNA (cytosine-5) methyltransferases. (Letter) Nature Genet. 19:219-220, 1998.

Robertson, K. D.; Uzvolgyi, E.; Liang, G.; Talmadge, C.; Sumegi, J.; Gonzales, F. A.; Jones, P. A.: The human DNA methyltransferases (DNMTs) 1, 3a and 3b: coordinate mRNA expression in normal tissues and overexpression in tumors. Nucleic Acids Res. 27:2291-2298,1999.

Xie, S.; Wang, Z.; Okano, M.; Nogami, M.; Li, Y.; He, W.-W.; Okumura, K.; Li, E.: Cloning, expression and chromosome locations of the human DNMT3 gene family. Gene 236:87-95, 1999.

Jiang, R.; Lan, Y.; Chapman, H. D.; Shawber, C.; Norton, C. R.; Serreze, D. V.; Weinmaster, G.; Gridley, T.: Defects in limb, craniofacial, and thymic development in Jagged2 mutant mice. Genes Dev. 12:1046-1057,1998.

Lan, Y.; Jiang, R.; Shawber, C.; Weinmaster, G.; Gridley, T.:The Jagged2 gene maps to chromosome 12 and is a candidate for the lgl and sm mutations. Mammalian Genome 8:875-876, 1997.

Lanford, P. J.; Lan, Y.; Jiang, R.; Lindsell, C.; Weinmaster, G.; Gridley, T.; Kelley, M. W.: Notch signalling pathway mediates hair cell development in mammalian cochlea. Nature Genet. 21:289-292,1999.

Luo, B.; Aster, J. C.; Hasserjian, R. P.; Kuo, F.; Sklar, J.:Isolation and functional analysis of a cDNA for human jagged2, a gene encoding a ligand for the Notch1 receptor. Molec. Cell. Biol. 17:6057-6067, 1997.

Ono, T.; Kawabe, T.; Sonta, S.; Okamoto, T.: Assignment of MARK3 alias KP78 to human chromosome band 14q32.3 by in situ hybridization. Cytogenet. Cell Genet. 79:101-102, 1997.

Parsa, I.: Loss of Mr 78,000 marker in chemically induced transplantable carcinomas and primary carcinoma of human pancreas. Cancer Res. 48:2265-2272, 1988.

Peng, C.-Y.; Graves, P. R.; Ogg, S.; Thoma, R. S.; Byrnes, M. J., III; Wu, Z.; Stephenson, M. T.; Piwnica-Worms, H.: C-TAK1 protein kinase phosphorylates human Cdc25C on serine 216 and promotes 14-3-3 protein binding. Cell Growth Differ. 9:197-208, 1998.

Kimura, M.; Kotani, S.; Hattori, T.; Sumi, N.; Yoshioka, T.; Todokoro, T.; Okano, Y.: Cell cycle-dependent expression and spindle pole localization of a novel human protein kinase Aik, related to Aurora of Drosophila and yeast Ipl1. J. Biol. Chem. 272:13766-13771, 1997.

Goustin, A. S.: Personal Communication. Detroit, Mich. Aug. 17, 1998.

Harrington, L.; McPhail, T.; Mar, V.; Zhou, W.; Oulton, R.; Bass, M. B.; Arruda, I.; Robinson, M. O.: A mammalian telomerase-associated protein. Science 275:973-976, 1997.

Saito, T.; Matsuda, Y.; Suzuki, T.; Hayashi, A.; Yuan, X.; Saito, M.; Nakayama, J.; Hori, T.; Ishikawa, F.: Comparative gene mapping of the human and mouse TEP1 genes, which encode one protein component of telomerases. Genomics 46:46-50, 1997.

Coggins, K. G.; Latour, A.; Nguyen, M. S.; Audoly, L.; Coffman, T. M.; Koller, B. H.: Metabolism of PGE2 by prostaglandin dehydrogenase is essential for remodeling the ductus arteriosus. (Letter) Nature Med. 8:91-92, 2002.

Ensor, C. M.; Yang, J. Y.; Okita, R. T.; Tai, H. H.: Cloning and sequence analysis of the cDNA for human placental NAD(+)-dependent 15-hydroxyprostaglandin dehydrogenase. J. Biol. Chem. 265:14888-14891,1990.

Krook, M.; Marekov, L.; Jornvall, H.: Purification and structural characterization of placental NAD(+)-linked 15-hydroxyprostaglandin dehydrogenase: the primary structure reveals the enzyme to belong to the short-chain alcohol dehydrogenase family. Biochemistry 29:738-743, 1990.

Chadwick, B. P.; Frischauf, A.-M.: The CD39-like gene family:identification of three new human members (CD39L2, CD39L3, and CD39L4), their murine homologues, and a member of the gene family from Drosophila melanogaster. Genomics 50:357-367, 1998.

Pizutti, A.; Novelli, G.; Ratti, A.; Amati, F.; Mari, A.; Calabrese, G.; Nicolis, S.; Silani, V.; Marino, B.; Scarlato, G.; Ottolenghi, S.; Dallapiccola, B.: UFD1L, a developmentally expressed ubiquitination gene, is deleted in CATCH 22 syndrome. Hum. Molec. Genet. 6:259-265,1997.

Yamagishi, H.; Garg, V.; Matsuoka, R.; Thomas, T.; Srivastava, D.: A molecular pathway revealing a genetic basis for human cardiac and craniofacial defects. Science 283:1158-1161, 1999.

Fukunaga, R.; Hunter, T.: MNK1, a new MAP kinase-activated protein kinase, isolated by a novel expression screening method for identifying protein kinase substrates. EMBO J. 16:1921-1933, 1997.

Pages, G.; Guerin, S.; Grall, D.; Bonino, F.; Smith, A.; Anjuere, F.; Auberger, P.; Pouyssegur, J.: Defective thymocyte maturation in p44 MAP kinase (Erk 1) knockout mice. Science 286:1374-1378,1999.

Stefanovsky, V. Y.; Pelletier, G.; Hannan, R.; Gagnon-Kugler, T.; Rothblum, L. I.; Moss, T.: An immediate response of ribosomal transcription to growth factor stimulation in mammals is mediated by ERK phosphorylation of UBF. Molec. Cell 8:1063-1073, 2001.

Mengus, G.; May, M.; Carre, L.; Chambon, P.; Davidson, I.: human TAF(II)135 potentiates transcriptional activation by the AF-2s of the retinoic acid, vitamin D3, and thyroid hormone receptors in mammalian cells. Genes Dev. 11:1381-1395, 1997.

Shimohata, T.; Nakajima, T.; Yamada, M.; Uchida, C.; Onodera, O.; Naruse, S.; Kimura, T.; Koide, R.; Nozaki, K.; Sano, Y.; Ishiguro, H.; Sakoe, K.; and 16 others: Expanded polyglutamine stretches interact with TAF(II)130, interfering with CREB-dependent transcription. Nature Genet. 26:29-36, 2000.

Ray, M. E.; Su, Y. A.; Meltzer, P. S.; Trent, J. M.: Isolation and characterization of genes associated with chromosome-6 mediated tumor suppression in human malignant melanoma. Oncogene 12:2527-2533,1996.

Ray, M. E.; Wistow, G.; Su, Y. A.; Meltzer, P. S.; Trent, J. M.: AIM1, a novel non-lens member of the beta-gamma-crystallin superfamily, is associated with the control of tumorigenicity in human malignant melanoma. Proc. Nat. Acad. Sci. 94:3229-3234, 1997.

Teichmann, U.; Ray, M. E.; Ellison, J.; Graham, C.; Wistow, G.; Meltzer, P. S.; Trent, J. M.; Pavan, W. J.: Cloning and tissue expression of the mouse ortholog of AIM1, a beta-gamma-crystallin superfamily member. Mammalian Genome 9:715-720, 1998.

Trent, J. M.; Stanbridge, E. J.; McBride, H. L.; Meese, E. U.; Casey, G.; Araujo, D. E.; Witkowski, C. M.; Nagle, R. B.: Tumorigenicity in human melanoma cell lines controlled by introduction of human chromosome 6. Science 247:568-571, 1990.

Nakamura, Y.; Miura, K.; Fujino, Y.; Iwao, H.; Ogita, S.; Yamanaka, S.: Evolution, structure, and expression of GNPI/oscillin orthologous genes. Genomics 68:179-186, 2000.

Rogers, M. J.; Ohgi, T.; Plumbridge, J.; Soll, D.: Nucleotide sequences of the E. coli nagE and nagB genes: the structural genes for the N-acetylglucosamine transport protein of the bacterial phosphoenolpyruvate:sugar phosphotransferase system and for glucosamine 6-phosphate deaminase. Gene 62:197-207, 1988.

Shevchenko, V.; Hogben, M.; Ekong, R.; Parrington, J.; Lai, F. A.: The human glucosamine-6-phosphate deaminase gene: cDNA cloning and expression, genomic organization and chromosomal localization. Gene 216:31-38, 1998.

Weidanz, J. A.; Campbell, P.; DeLucas, L. J.; Jin, J.; Moore, D.; Roden, L.; Yu, H.; Heilmann, E.; Vezza, A. C.: Glucosamine 6-phosphate deaminase in normal human erythrocytes. Brit. J. Haemat. 91:72-79,1995.

Bladergroen, B. A.; Strik, M. C. M.; Bovenschen, N.; van Berkum, O.; Scheffer, G. L.; Meijer, C. J. L. M.; Hack, C. E.; Kummer, J. A.: The granzyme B inhibitor, protease inhibitor 9, is mainly expressed by dendritic cells and at immune-privileged sites. J. Immun. 166:3218-3225, 2001.

Eyre, H. J.; Sun, J.; Sutherland, G. R.; Bird, P.: Chromosomal mapping of the gene (PI9) encoding the intracellular serpin proteinase inhibitor 9 to 6p25 by fluorescence in situ hybridization. Genomics 37:406-408, 1996.

Krieg, S. A.; Krieg, A. J.; Shapiro, D. J.: A unique downstream estrogen responsive unit mediates estrogen induction of proteinase inhibitor-9, a cellular inhibitor of IL-1-beta-converting enzyme (caspase1). Molec. Endocr. 15:1971-1982, 2001.

Sun, J.; Bird, C. H.; Sutton, V.; McDonald, L.; Coughlin, P. B.; De Jong, T. A.; Trapani, J. A.; Bird, P. I.: A cytosolic granzymeB inhibitor related to the viral apoptotic regulator cytokine response modifier A is present in cytotoxic lymphocytes. J. Biol. Chem. 271:27802-27809, 1996.

Steimle, V.; Durand, B.; Barras, E.; Zuffrey, M.; Hadam, M. R.; Mach, B.; Reith, W.: A novel DNA binding regulatory factor is mutated in primary MHC class II deficiency (bare lymphocyte syndrome). Genes Dev. 9:1021-1032, 1995.

Teumer, J.; Tseng, H.; Green, H.: The human basonuclin gene. Gene 188:1-7, 1997.

Tseng, H.; Green, H.: Basonuclin: a keratinocyte protein with multiple paired zinc fingers. Proc. Nat. Acad. Sci. 89:10311-10315,1992.

Tseng, H.; Green, H.: Association of basonuclin with ability of keratinocytes to multiply and with absence of terminal differentiation. J. Cell Biol. 126:495-506, 1994.

Gibson, L.; Holmgreen, S. P.; Huang, D. C. S.; Bernard, O.; Copeland, N. G.; Jenkins, N. A.; Sutherland, G. R.; Baker, E.; Adams, J. M.; Cory, S.: bcl-w, a novel member of the bcl-2 family, promotes cell survival. Oncogene 13:665-675, 1996.

Ross, A. J.; Waymire, K. G.; Moss, J. E.; Parlow, A. F.; Skinner, M. K.; Russell, L. D.; MacGregor, G. R.: Testicular degeneration in Bclw-deficient mice. Nature Genet. 18:251-256, 1998.

Freedman, M. S.; Lucas, R. J.; Soni, B.; von Schantz, M.; Munoz, M.; David-Gray, Z.; Foster, R.: Regulation of mammalian circadian behavior by non-rod, non-cone, ocular photoreceptors. Science 284:502-504, 1999.

Griffin, E. A., Jr.; Staknis, D.; Weitz, C. J.: Light-independent role of CRY1 and CRY2 in the mammalian circadian clock. Science 286:768-771, 1999.

Hsu, D. S.; Zhao, X.; Zhao, S.; Kazantsev, A.; Wang, R.-P.; Todo, T.; Wei, Y.-F.; Sancar, A.: Putative human blue-light photoreceptors hCRY1 and hCRY2 are flavoproteins. Biochemistry 35:13871-13877,1996.

Kobayashi, K.; Kanno, S.; Smit, B.; van der Horst, G. T. J.; Takao, M.; Yasui, A.: Characterization of photolyase/blue-light receptor homologs in mouse and human cells. Nucleic Acids Res. 26:5086-5092,1998.

Kume, K.; Zylka, M. J.; Sriram, S.; Shearman, L. P.; Weaver, D. R.; Jin, X.; Maywood, E. S.; Hastings, M. H.; Reppert, S. M.: mCRY1and mCRY2 are essential components of the negative limb of the circadian clock feedback loop. Cell 98:193-205, 1999.

Lucas, R. J.; Freedman, M. S.; Munoz, M.; Garcia-Fernandez, J.-M.; Foster, R. G.: Regulation of the mammalian pineal by non-rod, non-cone, ocular photoreceptors. Science 284:505-507, 1999.

Okamura, H.; Miyake, S.; Sumi, Y.; Yamaguchi, S.; Yasui, A.; Muijtjens, M.; Hoeijmakers, J. H. J.; van der Horst, G. T. J.: Photic induction of mPer1 and mPer2 in Cry-deficient mice lacking a biological clock. Science 286:2531-2534, 1999.

Reick, M.; Garcia, J. A.; Dudley, C.; McKnight, S. L.: NPAS2:an analog of clock operative in the mammalian forebrain. Science 293:506-509, 2001.

van der Horst, G. T. J.; Muijtjens, M.; Kobayashi, K.; Takano, R.; Kanno, S.; Takao, M.; de Wit, J.; Verkerk, A.; Eker, A. P. M.; van Leenen, D.; Buijs, R.; Bootsma, D.; Hoeijmakers, J. H. J.; Yasui, A.: Mammalian Cry1 and Cry2 are essential for maintenance of circadian rhythms. Nature 398:627-630, 1999.

Yagita, K.; Tamanini, F.; van der Horst, G. T. J.; Okamura, H.: Molecular mechanisms of the biological clock in cultured fibroblasts. Science 292:278-281, 2001.

Villard, J.; Reith, W.; Barras, E.; Gos, A.; Morris, M. A.; Antonarakis, S. E.; Van den Elsen, P. J.; Mach, B.: Analysis of mutations and chromosomal localisation of the gene encoding RFX5, a novel transcription factor affected in major histocompatibility complex class II deficiency. Hum. Mutat. 10:430-435, 1997.

Sipila, L.; Szatanik, M.; Vainionpaa, H.; Ruotsalainen, H.; Myllyla, R.; Guenet, J.-L.: The genes encoding mouse lysyl hydroxylase isoforms map to chromosomes 4, 5, and 9. Mammalian Genome 11:1132-1134,2000.

Szpirer, C.; Szpirer, J.; Riviere, M.; Vanvooren, P.; Valtavaara, M.; Myllyla, R.: Localization of the gene encoding a novel isoform of lysyl hydroxylase. Mammalian Genome 8:707-708, 1997.

Valtavaara, M.; Papponen, H.; Pirttila, A.-M.; Hiltunen, K.; Helander, H.; Myllyla, R.: Cloning and characterization of a novel human lysyl hydroxylase isoform highly expressed in pancreas and muscle. J. Biol. Chem. 272:6831-6834, 1997.

Hellborg, F.; Qian, W.; Mendez-Vidal, C.; Asker, C.; Kost-Alimova, M.; Wilhelm, M.; Imreh, S.; Wiman, K. G.: Human wig-1, a p53 target gene that encodes a growth inhibitory zinc finger protein. Oncogene 20:5466-5474, 2001.

Varmeh-Ziaie, S.; Okan, I.; Wang, Y.; Magnusson, K. P.; Warthoe, P.; Strauss, M.; Wiman, K. G.: Wig-1, a new p53-induced gene encoding a zinc finger protein. Oncogene 15:2699-2704, 1997.

Fardaei, M.; Rogers, M. T.; Thorpe, H. M.; Larkin, K.; Hamshere, M. G.; Harper, P. S.; Brook, J. D.: Three proteins, MBNL, MBLL and MBXL, co-localize in vivo with nuclear foci of expanded-repeat transcripts in DM1 and DM2 cells. Hum. Molec. Genet. 11:805-814, 2002.

Miller, J. W.; Urbinati, C. R.; Teng-umnuay, P.; Stenberg, M. G.; Byrne, B. J.; Thornton, C. A.; Swanson, M. S.: Recruitment of human muscle blind proteins to (CUG) n expansions associated with myotonic dystrophy. EMBO J. 19:4439-4448, 2000.

Kutty, R. K.; Kutty, G.; Samuel, W.; Duncan, T.; Bridges, C. C.; El-Sherbeeny, A.; Nagineni, C. N.; Smith, S. B.; Wiggert, B.: Molecular characterization and developmental expression of NORPEG, a novel gene induced by retinoic acid. J. Biol. Chem. 276:2831-2840, 2001.

Aapola, U.; Shibuya, K.; Scott, H. S.; Ollila, J.; Vihinen, M.; Heino, M.; Shintani, A.; Kawasaki, K.; Minoshima, S.; Krohn, K.; Antonarakis, S. E.; Shimizu, N.; Kudoh, J.; Peterson, P.: Isolation and initial characterization of a novel zinc finger gene, DNMT3L, on 21q22.3, related to the cysteine-5-methyltransferase 3 gene family. Genomics 65:293-298, 2000.

Bourc'his, D.; Xu, G.-L.; Lin, C.-S.; Bollman, B.; Bestor, T. H.: Dnmt3L and the establishment of maternal genomic imprints. Science 294:2536-2539, 2001.

Monney, L.; Sabatos, C.; Gaglia, J. L.; Ryu, A.; Waldner, H.; Chernova, T.; Manning, S.; Greenfield, E. A.; Coyle, A. J.; Sobel, R. A.; Freeman, G. J.; Kuchroo, V. K.: Th1-specific cell surface protein regulates macrophage activation and severity of an autoimmune disease. Nature 415:536-541, 2002.

Jourdan-Le Saux, C.; Le Saux, O.; Donlon, T.; Boyd, C. D.; Csiszar, K.: The human lysyl oxidase-related gene (LOXL2) maps between markers D8S280 and D8S278 on chromosome 8p21.2-p21.3. Genomics 51:305-307,1998.

Jourdan-Le Saux, C.; Tronecker, H.; Bogic, L.; Bryant-Greenwood, G. D.; Boyd, C. D.; Csiszar, K.: The LOXL2 gene encodes a new lysyloxidase-like protein and is expressed at high levels in reproductive tissues. J. Biol. Chem. 274:12939-12944, 1999.

Nakagawa, H.; Koyama, K.; Murata, Y.; Morito, M.; Akiyama, T.; Nakamura, Y.: EB3, a novel member of the EB1 family preferentially expressed in the central nervous system, binds to a CNS-specific APC homologue. Oncogene 19:210-216, 2000.

Dunbar, D. R.; Shibasaki, Y.; Dobbie, L.; Andersson, B.; Brookes, A. J.: In situ hybridisation mapping of genomic clones for five human respiratory chain complex I genes. Cytogenet. Cell Genet. 78:21-24,1997.

Emahazion, T.; Brookes, A. J.: Mapping of the NDUFA2, NDUFA6, NDUFA7, NDUFB8, and NDUFS8 electron transport chain genes by intron based radiation hybrid mapping. Cytogenet. Cell Genet. 82:114 only,1998.

Ton, C.; Hwang, D. M.; Dempsey, A. A.; Liew, C.-C.: Identification and primary structure of five human NADH-ubiquinone oxidoreductase subunits. Biochem. Biophys. Res. Commun. 241:589-594, 1997.

Tsukiyama-Kohara, K.; Vidal, S. M.; Gingras, A.-C.; Glover, T. W.; Hanash, S. M.; Heng, H.; Sonenberg, N.: Tissue distribution, genomic structure, and chromosome mapping of mouse and human eukaryotic initiation factor 4E-binding proteins 1 and 2. Genomics 38:353-363,1996.

Meluh, P. B.; Koshland, D.: Suppressors of MIF2, a putative centromere protein gene in Saccharomyces cerevisiae. (Abstract) Molec. Biol. Cell 6 (supp.):360a only, 1995.

Meluh, P. B.; Koshland, D.: Evidence that the MIF2 gene of Saccharomyces cerevisiae encodes a centromere protein with homology to the mammalian centromere protein CENP-C. Molec. Biol. Cell 6:793-807, 1995.

Cooper, E. C.; Aldape, K. D.; Abosch, A.; Barbaro, N. M.; Berger, M. S.; Peacock, W. S.; Jan, Y. N.; Jan, L. Y.: Colocalization and coassembly of two human brain M-type potassium channel subunits that are mutated in epilepsy. Proc. Nat. Acad. Sci. 97:4914-4919, 2000.

Wang, H.-S.; Pan, Z.; Shi, W.; Brown, B. S.; Wymore, R. S.; Cohen, I. S.; Dixon, J. E.; McKinnon, D.: KCNQ2 and KCNQ3 potassium channel subunits: molecular correlates of the M-channel. Science 282:1890-1893,1998.

Yang, W.-P.; Levesque, P. C.; Little, W. A.; Conder, M. L.; Ramakrishnan, P.; Neubauer, M. G.; Blanar, M. A.: Functional expression of two KvLQT1-related potassium channels responsible for an inherited idiopathic epilepsy. J. Biol. Chem. 273:19419-19423, 1998.

Cecconi, F.; Alvarez-Bolado, G.; Meyer, B. I.; Roth, K. A.; Gruss, P.: Apaf1 (CED-4 homolog) regulates programmed cell death in mammalian development. Cell 94:727-737, 1998.

Hahn, C.; Hirsch, B.; Jahnke, D.; Durkop, H.; Stein, H.: Three new types of Apaf-1 in mammalian cells. Biochem. Biophys. Res. Commun. 261:746-749, 1999.

Honarpour, N.; Du, C.; Richardson, J. A.; Hammer, R. E.; Wang, X.; Herz, J.: Adult Apaf-1-deficient mice exhibit male infertility. Dev. Biol. 218:248-258, 2000.

Honarpour, N.; Gilbert, S. L.; Lahn, B. T.; Wang, X.; Herz, J.: Apaf-1 deficiency and neural tube closure defects are found in fog mice. Proc. Nat. Acad. Sci. 98:9683-9687, 2001.

Kim, H.; Jung, Y. K.; Kwon, Y. K.; Park, S. H.: Assignment of apoptotic protease activating factor-1 gene (APAF1) to human chromosome band 12q23 by fluorescence in situ hybridization. Cytogenet. Cell Genet. 87:252-253, 1999.

Kawai, J.; Suzuki, H.; Hara, A.; Hirose, K.; Watanabe, S.: Human and mouse chromosomal mapping of Stac, a neuron-specific protein with an SH3 domain. Genomics 47:140-142, 1998.

Suzuki, H.; Kawai, J.; Taga, C.; Yaoi, T.; Hara, A.; Hirose, K.; Hayashizaki, Y.; Watanabe, S.: Stac, a novel neuron-specific protein with cysteine-rich and SH3 domains. Biochem. Biophys. Res. Commun. 229:902-909, 1996.

Bradshaw, T.; Graves, T.; Biewald, T.: Personal Communication. St. Louis, Mo. Jan. 29, 1998.

Daga, A.; Micol, V.; Hess, D.; Aebersold, R.; Attardi, G.: Molecular characterization of the transcription termination factor from human mitochondria. J. Biol. Chem. 268:8123-8130, 1993.

Fernandez-Silva, P.; Martinez-Azorin, F.; Micol, V.; Attardi, G.: The human mitochondrial transcription termination factor (mTERF) is a multizipper protein but binds to DNA as a monomer, with evidence pointing to intramolecular leucine zipper interactions. EMBO J. 16:1066-1079, 1997.

Imataka, H.; Olsen, H. S.; Sonenberg. N.: A new translational regulator with homology to eukaryotic translation initiation factor 4G. EMBO J. 16:817-825, 1997.

Levy-Strumpf, N.; Deiss, L. P.; Berissi, H.; Kimchi, A.: DAP-5, a novel homolog of eukaryotic translation initiation factor 4G isolatedas a putative modulator of gamma interferon-induced programmed cell death. Molec. Cell. Biol. 17:1615-1625, 1997.

Shaughnessy, J. D., Jr.; Jenkins, N. A.; Copeland, N. G.: cDNA cloning, expression analysis, and chromosomal localization of a gene with high homology to wheat eIF-(iso)4F and mammalian eIF-4G. Genomics 39:192-197, 1997.

Yamanaka, S.; Poksay, K. S.; Arnold, K. S.; Innerarity, T. L.:A novel translational repressor mRNA is edited extensively in livers containing tumors caused by the transgene expression of the apoB mRNA-editing enzyme. Genes Dev. 11:321-333, 1997.

Korver, W.; Roose, J.; Heinen, K.; Weghuis, D. O.; de Bruijn, D.; Geurts van Kessel, A.; Clevers, H.: The human TRIDENT/HFH-11/FKHL16 gene: structure, localization, and promoter characterization. Genomics 46:435-442, 1997.

Ly, D. H.; Lockhart, D. J.; Lerner, R. A.; Schultz, P. G.: Mitotic misregulation and human aging. Science 287:2486-2492, 2000.

Wang, X.; Quail, E.; Hung, N.-J.; Tan, Y.; Ye, H.; Costa, R. H.: Increased levels of forkhead box M1B transcription factor in transgenic mouse hepatocytes prevent age-related proliferation defects in regenerating liver. Proc. Nat. Acad. Sci. 98:11468-11473, 2001.

Westendorf, J. M.; Rao, P. N.; Gerace, L.: Cloning of cDNAs for M-phase phosphoproteins recognized by the MPM2 monoclonal antibody and determination of the phosphorylated epitope. Proc. Nat. Acad. Sci. 91:714-718, 1994.

Nomi, M.; Oishi, I.; Kani, S.; Suzuki, H.; Matsuda, T.; Yoda, A.; Kitamura, M.; Itoh, K.; Takeuchi, S.; Takeda, K.; Akira, S.; Ikeya, M.; Takada, S.; Minami, Y.: Loss of mRor1 enhances the heart and skeletal abnormalities in mR or 2-deficient mice: redundant and pleiotropic functions of mR or 1 and mR or 2 receptor tyrosine kinases. Molec. Cell. Biol. 21:8329-8335, 2001.

Yao, K.-M.; Sha, M.; Lu, Z.; Wong, G. G.: Molecular analysis of a novel winged helix protein, WIN: expression pattern, DNA binding property, and alternative splicing within the DNA binding domain. J. Biol. Chem. 272:19827-19836, 1997.

Wang, X. S.; Diener, K.; Jannuzzi, D.; Trollinger, D.; Tan, T.-H.; Lichenstein, H.; Zukowski, M.; Yao, Z.: Molecular cloning and characterization of a novel protein kinase with a catalytic domain homologous to mitogen-activated protein kinase kinase kinase. J. Biol. Chem. 271:31607-31611, 1996.

Bono, P.; Salmi, M.; Smith, D. J.; Leppanen, I.; Horelli-Kuitunen, N.; Palotie, A.; Jalkanen, S.: Isolation, structural characterization, and chromosomal mapping of the mouse vascular adhesion protein-1 gene and promoter. J. Immun. 161:2953-2960, 1998.

Morris, N. J.; Ducret, A.; Aebersold, R.; Ross, S. A.; Keller, S. R.; Lienhard, G. E.: Membrane amine oxidase cloning and identification as a major protein in the adipocyte plasma membrane. J. Biol. Chem. 272:9388-9392, 1997.

Xu, X.-N.; Screaton, G. R.; Gotch, F. M.; Dong, T.; Tan, R.; Almond, N.; Walker, B.; Stebbings, R.; Kent, K.; Nagata, S.; Stott, J. E.; McMichael, A. J.: Evasion of cytotoxic T lymphocyte (CTL) responses by Nef-dependent induction of Fas ligand (CD95L) expression on simian immunodeficiency virus-infected cells. J. Exp. Med. 186:7-16, 1997.

Huang, L. J.; Durick, K.; Weiner, J. A.; Chun, J.; Taylor, S. S.: Identification of a novel protein kinase A anchoring protein that binds both type I and type II regulatory subunits. J. Biol. Chem. 272:8057-8064, 1997.

Lin, R.-Y.; Moss, S. B.; Rubin, C. S.: Characterization of S-AKAP84, a novel developmentally regulated A kinase anchor protein of male germ cells. J. Biol. Chem. 270:27804-27811, 1995.

Trendelenburg, G.; Hummel, M.; Riecken, E.-O.; Hanski, C.: Molecular characterization of AKAP149, a novel A kinase anchor protein with a KH domain. Biochem. Biophys. Res. Commun. 225:313-319, 1996.

Chang, K.; Hanaoka, K.; Kumada, M.; Takuwa, Y.: Molecular cloning and functional analysis of a novel P2 nucleotide receptor. J. Biol. Chem. 270:26152-26158, 1995.

Communi, D.; Parmentier, M.; Boeynaems, J.-M.: Cloning, functional expression and tissue distribution of the human P2Y6 receptor. Biochem. Biophys. Res. Commun. 222:303-308, 1996.

Maier, R.; Glatz, A.; Mosbacher, J.; Bilbe, G.: Cloning of P2Y6cDNAs and identification of a pseudogene: comparison of P2Y receptor subtype expression in bone and brain tissues. Biochem. Biophys. Res. Commun. 237:297-302, 1997.

Pidlaoan, L. V.; Jin, J.; Sandhu, A. K.; Athwal, R. S.; Kunapuli, S. P.: Colocalization of P2Y2 and P2Y6 receptor genes at human chromosome 11q13.3-14.1. Somat. Cell Molec. Genet. 23:291-296, 1997.

Wang, B.; Kishihara, K.; Zhang, D.; Hara, H.; Nomoto, K.: molecular cloning and characterization of a novel human receptor protein tyrosine phosphatase gene, hPTP-J: downregulation of gene expression by PMA and calcium ionophore in Jurkat T lymphoma cells. Biochem. Biophys. Res. Commun. 231:77-81, 1997.

Wang, H; Lian, Z; Lerch, M. M.; Chen, Z; Xie, W; Ullrich, A.:Characterization of PCP-2, a novel receptor protein tyrosine phosphatase of the MAM domain family. Oncogene 12:2555-2562, 1996.

Chinnaiyan, A. M.; O'Rourke, K.; Tewari, M.; Dixit, V. M.: FADD, a novel death domain-containing protein, interacts with the death domain of Fas and initiates apoptosis. Cell 81:505-512, 1995.

Kabra, N. H.; Kang, C.; Hsing, L. C.; Zhang, J.; Winoto, A.: T cell-specific FADD-deficient mice: FADD is required for early T cell development. Proc. Nat. Acad. Sci. 98:6307-6312, 2001.

Sahin, U.; Tureci, O.; Schmitt, H.; Cochlovius, B.; Johannes, T.; Schmits, R.; Stenner, F.; Luo, G.; Schobert, I.; Pfreundschuh, M.: Human neoplasms elicit multiple specific immune responses in the autologous host. Proc. Nat. Acad. Sci. 92:11810-11813, 1995.

Tureci, O.; Sahin, U.; Vollmar, E.; Siemer, S.; Gottert, E.; Seitz, G.; Parkkila, A. K.; Shah, G. N.; Grubb, J. H.; Pfreundschuh, M.; Sly, W. S.: Human carbonic anhydrase XII: cDNA cloning, expression, and chromosomal localization of a carbonic anhydrase gene that is overexpressed in some renal cell cancers. Proc. Nat. Acad. Sci. 95:7608-7613, 1998.

Herrscher, R. F.; Kaplan, M. H.; Lelsz, D. L.; Das, C.; Scheuermann, R.; Tucker, P. W.: The immunoglobulin heavy-chain matrix-associating regions are bound by Bright: a B cell-specific trans-activator that describes a new DNA-binding protein family. Genes Dev. 9:3067-3082,1995.

Kortschak, R. D.; Reimann, H.; Zimmer, M.; Eyre, H. J.; Saint, R.; Jenne, D. E.: The human dead ringer/bright homolog, DRIL1: cDNA cloning, gene structure, and mapping to D19S886, a marker on 19p13.3 that is strictly linked to the Peutz-Jeghers syndrome. Genomics 51:288-292, 1998.

Kamei, M.; Webb, G. C.; Young, I. G.; Campbell, H. D.: SOLH, a human homologue of the Drosophila melanogaster small optic lobes gene is a member of the calpain and zinc-finger gene families and maps to human chromosome 16p13.3 near CATM (cataract with microphthalmia). Genomics 51:197-206, 1998.

Kudo, N.; Khochbin, S.; Nishi, K.; Kitano, K.; Yanagida, M.; Yoshida, M.; Horinouchi, S.: Molecular cloning and cell cycle-dependent expression of mammalian CRM1, a protein involved in nuclear export of proteins. J. Biol. Chem. 272:29742-29751, 1997.

Stade, K.; Ford, C. S.; Guthrie, C.; Weis, K.: Exportin 1 (Crm1p) is an essential nuclear export factor. Cell 90:1041-1050, 1997.

Jacquemin, P.; Martial, J. A.; Davidson, I.: Human TEF-5 is preferentially expressed in placenta and binds to multiple functional elements of the human chorionic somatomammotropin-B gene enhancer. J. Biol. Chem. 272:12928-12937, 1997.

Jiang, S.-W.; Wu, K.; Eberhardt, N. L.: Human placental TEF-5 transactivates the human chorionic somatomammotropin gene enhancer. Molec. Endocr. 13:879-889, 1999.

Rudnick, A.; Ling, T. Y.; Odagiri, H.; Rutter, W. J.; German, M. S.: Pancreatic beta cells express a diverse set of homeobox genes. Proc. Nat. Acad. Sci. 91:12203-12207, 1994.

ten Berge, D.; Brouwer, A.; El Bahi, S.; Guenet, J.-L.; Robert, B.; Meijlink, F.: Mouse Alx3: an aristaless-like homeobox gene expressed during embryogenesis in ectomesenchyme and lateral plate mesoderm. Dev. Biol. 199:11-25, 1998.

Khoja, H.; Wang, G.; Ng, C.-T. L.; Tucker, J.; Brown, T.; Shyamala, V.: Cloning of CCRL1, an orphan seven transmembrane receptor related to chemokine receptors, expressed abundantly in the heart. Gene 246:229-238, 2000.

Schweickart, V. L.; Epp, A.; Raport, C. J.; Gray, P. W.: CCR11 is a functional receptor for the monocyte chemoattractant protein family of chemokines. J. Biol. Chem. 275:9550-9556, 2000. Note:Erratum: J. Biol. Chem. 276:856 only, 2001.

Ungar, D.; Oka, T.; Brittle, E. E.; Vasile, E.; Lupashin, V. V.; Chatterton, J. E.; Heuser, J. E.; Krieger, M.; Waters, M. G.: characterization of a mammalian Golgi-localized protein complex, COG, that is required for normal Golgi morphology and function. J. Cell Biol. 157:405-415,2002.

Baloh, R. H.; Tansey, M. G.; Golden, J. P.; Creedon, D. J.; Heuckeroth, R. O.; Keck, C. L.; Zimonjic, D. B.; Popescu, N. C.; Johnson, E. M., Jr.; Milbrandt, J.: TrnR2, a novel receptor that mediates neurturin and GDNF signaling through Ret. Neuron 18:793-802, 1997.

Blondel, O.; Vandecasteele, G.; Gastineau, M.; Leclerc, S.; Dahmoune, Y.; Langlois, M.; Fischmeister, R.: Molecular and functional characterization of a 5-HT(4) receptor cloned from human atrium. FEBS Lett. 412:465-474, 1997.

Claeysen, S.; Faye, P.; Sebben, M.; Lemaire, S.; Bockaert, J.; Dumuis, A.; Taviaux, S.: Assignment of 5-hydroxytryptamine receptor (HTR4) to human chromosome 5 bands q31-to-q33 by in situ hybridization. Cytogenet. Cell Genet. 78:133-134, 1997.

Dumuis, A.; Bouhelal, R.; Sebben, M.; Cory, R.; Bockaert, J.: A nonclassical 5-hydroxytryptamine receptor positively coupled with adenylate cyclase in the central nervous system. Molec. Pharm. 34:880-887, 1988.

Eglen, R. M.; Wong, E. H. F.; Dumuis, A.; Bockaert, J.: Central 5-HT4 receptors. Trends Pharm. Sci. 16:391-398, 1995.

Isomura, T.; Tamiya-Koizumi, K.; Suzuki, M.; Yoshida, S.; Taniguchi, M.; Matsuyama, M.; Ishigaki, T.; Sakuma, S.; Takahashi, M.: RFP is a DNA binding protein associated with the nuclear matrix. Nucleic Acids Res. 20:5305-5310, 1992.

Szpirer, C.; Szpirer, J.; Riviere, M.; Tazi, R.; Pontarotti, P.: Mapping of the Olf89 and Rfp genes to the rat genome: comparison with the mouse and human and new insights into the evolution of the rodent genome. Cytogenet. Cell Genet. 78:137-139, 1997.

Luo, J.; Sladek, R.; Bader, J. A.; Matthyssen, A.; Rossant, J.; Giguere, V.: Placental abnormalities in mouse embryos lacking orphan nuclear receptor ERR-beta. Nature 388:778-782, 1997.

Adachi, O.; Kawai, T.; Takeda, K.; Matsumoto, M.; Tsutsui, H.; Sakagami, M.; Nakanishi, K.; Akira, S.: Targeted disruption of the MyD88 gene results in loss of IL-1- and IL-18-mediated function. Immunity 143-150,1998.

Bonnert, T. P.; Garka, K. E.; Parnet, P.; Sonoda, G.; Testa, J. R.; Sims, J. E.: The cloning and characterization of human MyD88: a member of an IL-1 receptor related family. FEBS Lett. 402:81-84,1997.

Hardiman, G.; Jenkins, N. A.; Copeland, N. G.; Gilbert, D. J.; Garcia, D. K.; Naylor, S. L.; Kastelein, R. A.; Bazan, J. F.: Genetic structure and chromosomal mapping of MyD88. Genomics 45:332-339,1997.

Hayashi, F.; Smith, K. D.; Ozinsky, A.,; Hawn, T. R.; Yi, E. C.; Goodlett, D. R.; Eng, J. K.; Akira, S.; Underhill, D. M.; Aderem, A.: The innate immune response to bacterial flagellin is mediated by Toll-like receptor 5. Nature 410:1099-1103, 2001.

Kawai, T.; Adachi, O.; Ogawa, T.; Takeda, K.; Akira, S.: Unresponsiveness of MyD88-deficient mice to endotoxin. Immunity 11:115-122, 1999.

Lord, K. A.; Hoffman-Liebermann, B.; Liebermann, D. A.: Complexity of the immediate early response of myeloid cells to terminal differentiation and growth arrest includes ICAM-1, Jun-B and histone variants. Oncogene 5:387-396, 1990.

Medzhitov, R.; Preston-Hurlburt, P.; Kopp, E.; Stadien, A.; Chen, C.; Ghosh, S.; Janeway, C. A., Jr.: MyD88 is an adaptor protein in the hToll/Il-1 receptor family signaling pathways. Molec. Cell 2:253-258, 1998.

Ge, K.; Guermah, M.; Yuan, C.-X.; Ito, M.; Wallberg, A. E.; Spiegelman, B. M.; Roeder, R. G.: Transcription coactivator TRAP220 is required for PPAR-gamma-2-stimulated adipogenesis. Nature 417:563-567, 2002.

Dabovic, B.; Chen, Y.; Colarossi, C.; Obata, H.; Zambuto, L.; Perle, M. A.; Rifkin, D. B.: Bone abnormalities in latent TGF-beta binding protein (Ltbp)-3-null mice indicate a role for Ltbp-3 in modulating TGF-beta bioavailability. J. Cell Biol. 156:227-232, 2002.

Li, X.; Yin, W.; Perez-Jurado, L.; Bonadio, J.; Francke, U.: mapping of human and murine genes for latent TGF-beta binding protein-2 (LTBP2). Mammalian Genome 6:42-45, 1995.

Sawicki, M.; Arnold, E.; Ebrahimi, S.; Duell, T.; Jin, S.; Wood, T.; Chakrabarti, R.; Peters, J.; Wan, Y.; Samara, G.; Weier, H.-U. G.; Udar, N.; Passaro, E., Jr.; Srivatsan, E. S.: A transcript map encompassing the multiple endocrine neoplasia type-1 (MEN1) locus on chromosome 11q13. Genomics 42:405-412, 1997.

Yin, W.; Smiley, E.; Germiller, J.; Mechan, R. P.; Florer, J. B.; Wenstrup, R. J.; Bonadio, J.: Isolation of a novel latent transforming growth factor-beta binding protein gene (LTBP-3). J. Biol. Chem. 270:10147-10160, 1995.

Wu, S.; Wright, R. A.; Rockey, P. K.; Burgett, S. G.; Arnold, J. S.; Rosteck, P. R., Jr.; Johnson, B. G.; Schoepp, D. D.; Belagaje, R. M.: Group III human metabotropic glutamate receptors 4, 7 and8: molecular cloning, functional expression, and comparison of pharmacological properties in RGT cells. Molec. Brain Res. 53:88-97, 1998.

Bussemakers, M. J. G.; van Bokhoven, A.; Voller, M.; Smit, F. P.; Schalken, J. A.: The genes for the calcium-dependent cell adhesion molecules P- and E-cadherin are tandemly arranged in the human genome. Biochem. Biophys. Res. Commun. 203:1291-1294, 1994.

Carmeliet, P.; Lampugnani, M.-G.; Moons, L.; Breviario, F.; Compernolle, V.; Bono, F.; Balconi, G.; Spagnuolo, R.; Oosthuyse, B.; Dewerchin, M.; Zanetti, A.; Angellilo, A.; and 11 others: Targeted deficiency of cytosolic truncation of the VE-cadherin gene in mice impairs VEGF-mediated endothelial survival and angiogenesis. Cell 98:147-157, 1999.

Huber, P.; Dalmon, J.; Engiles, J.; Breviario, F.; Gory, S.; Siracusa, L. D.; Buchberg, A. M.; Dejana, E.: Genomic structure and chromosomal mapping of the mouse VE-cadherin gene (Cdh5). Genomics 32:21-28, 1996.

Salomon, D.; Ayalon, O.; Patel-King, R.; Hynes, R. O.; Geiger, B.: Extra junctional distribution of N-cadherin in cultured human endothelial cells. J. Cell Sci. 102:7-17, 1992.

Carmeliet, P.; Moons, L.; Luttun, A.; Vincenti, V.; Compernolle, V.; De Mol, M.; Wu, Y.; Bono, F.; Devy, L.; Beck, H.; Scholz, D.; Acker, T.; and 17 others: Synergism between vascular endothelial growth factor and placental growth factor contributes to angiogenesis and plasma extravasation in pathological conditions. Nature Med. 7:575-583, 2001.

Luttun, A.; Tjwa, M.; Moons, L.; Wu, Y.; Angelillo-Scherrer, A.; Liao, F.; Nagy, J. A.; Hooper, A.; Priller, J.; De Klerck, B.; Compernolle, V.; Daci, E.; and 10 others: Revascularization of ischemic tissues by PlGF treatment, and inhibition of tumor angiogenesis, arthritis and atherosclerosis by anti-Flt1. Nature Med. 8:831-840, 2002.

Maglione, D.; Guerriero, V.; Viglietto, G.; Delli-Bovi, P.; Persico, M. G.: Isolation of a human placenta cDNA coding for a protein related to the vascular permeability factor. Proc. Nat. Acad. Sci. 88:9267-9271, 1991.

Mattei, M.-G.; Borg, J.-P.; Rosnet, O.; Marme, D.; Birnbaum, D.: Assignment of vascular endothelial growth factor (VEGF) and placenta growth factor (PLGF) genes to human chromosome 6p12-p21 and 14q24-q31 regions, respectively. Genomics 32:168-169, 1996.

Charrin, S.; Le Naour, F.; Oualid, M.; Billard, M.; Faure, G., Hanash, S. M.; Boucheix, C.; Rubinstein, E.: The major CD9 and CD81 molecular partner: identification and characterization of the complexes. J. Biol. Chem. 276:14329-14337, 2001.

Nagase, T.; Kikuno, R.; Ishikawa, K.; Hirosawa, M.; Ohara, O.:Prediction of the coding sequences of unidentified human genes. XVI. The complete sequences of 150 new cDNA clones from brain which code for large proteins in vitro. DNA Res. 7:65-73, 2000.

Orlicky, D. J.; Berry, R.; Sikela, J. M.: Human chromosome 1 localization of the gene for a prostaglandin F-2-alpha receptor negative regulatory protein. Hum. Genet. 97:655-658, 1996.

Stipp, C. S.; Orlicky, D.; Hemler, M. E.: FPRP, a major, highly stoichiometric, highly specific CD81- and CD9-associated protein. J. Biol. Chem. 276:4853-4862, 2001.

Oliver, G.; Wehr, R.; Jenkins, N. A.; Copeland, N. G.; Cheyette, B. N. R.; Hartenstein, V.; Zipursky, S. L.; Gruss, P.: Homeobox genes and connective tissue patterning. Development 121:693-705, 1995.

Casellas, R.; Jankovic, M.; Meyer, G.; Gazumyan, A.; Luo, Y.; Roeder, R. G.; Nussenzweig, M. C.: OcaB is required for normal transcription and V(D)J recombination of a subset of immunoglobulin kappa genes. Cell 110:575-585, 2002.

Gstaiger, M.; Knoepfel, L.; Georgiev, O.; Schaffner, W.; Hovens, C. M.: A B-cell coactivator of octamer-binding transcription factors. Nature 373:360-362, 1995.

Junker, S.; Brondum-Nielsen, K.; Newell, J. W.; Matthias, P.; Tommerup, N.: Assignment of the human gene for Oct-binding factor-1 (OBF1), a B-cell-specific coactivator of octamer-binding transcription factors 1 and 2, to 11q23.1 by somatic cell hybridization and in situ hybridization. Genomics 33:143-145, 1996.

Urness, L. D.; Sorensen, L. K.; Li, D. Y.: Arteriovenous malformations in mice lacking activin receptor-like kinase-1. Nature Genet. 26:328-331, 2000.

Han, L. Wong, D.; Dhaka, A.; Afar, D.; White, M.; Xie, W.; Herschman, H.; Witte, O.; Colicelli, J.: Protein binding and signaling properties of RIN1 suggest a unique effector function. Proc. Nat. Acad. Sci. 94:4954-4959, 1997.

Leffers, H.; Madsen, P.; Rasmussen, H. H.; Honore, B.; Andersen, A. H.; Walbum, E.; Vandekerckhove, J.; Celis, J. E.: Molecular cloning and expression of the transformation sensitive epithelial marker stratifin:a member of a protein family that has been involved in the protein kinase C signalling pathway. J. Molec. Biol. 231:982-998, 1993.

Jaspers, M.; Marynen, P.; Aly, M. S.; Cuppens, H.; Hilliker, C.; Cassiman, J.-J.: Localization of the gene encoding the alpha-2 subunit of the human VLA-2 receptor to chromosome 5q23-31. Somat. Cell Molec. Genet. 17:505-511, 1991.

Hammond, J. W.; Potter, M.; Wilcken, B.; Truscott, R.: Siblings with gamma-glutamyltransferase deficiency. J. Inherit. Metab. Dis. 18:82-83, 1995.

Heisterkamp, N.; Groffen, J.: Duplication of the bcr and gamma-glutamyltranspeptidase genes. Nucleic Acids Res. 16:8045-8056, 1988.

Laperche, Y.; Bulle, F.; Aissani, T.; Chobert, M. N.; Aggerbeck, M.; Hanoune, J.; Guellaen, G.: Molecular cloning and nucleotide sequence of rat kidney gamma-glutamyl transpeptidase cDNA. Proc. Nat. Acad. Sci. 83:937-941, 1986.

O'Daley, S.: An abnormal sulphydryl compound in urine. (Abstract) Irish J. Med. Sci. 7:578-579, 1968.

Pawlak, A.; Lahuna, O.; Bulle, F.; Suzuki, A.; Ferry, N.; Siegrist, S.; Chikhi, N.; Chobert, M. N.; Guellaen, G.;

Laperche, Y.: Gamma-glutamyltranspeptidase: a single copy gene in the rat and a multigene family in the human genome. J. Biol. Chem. 263:9913-9916, 1988.

Rouleau, G. A.; Bazanowski, A.; Cohen, E. H.; Guellaen, G.; Gusella, J. F.: Gamma-glutamyl transferase locus (GGT) displays a PvuII polymorphism. Nucleic Acids Res. 16:11848 only, 1988.

Sakamuro, D.; Yamazoe, M.; Matsuda, Y.; Kangawa, K.; Taniguchi, N.; Matsuo, H.; Yoshikawa, H.; Ogasawara, N.: The primary structure of human gamma-glutamyl transpeptidase. Gene 73:1-9, 1988.

Schulman, J. D.; Goodman, S. I.; Mace, J. W.; Patrick, A. D.; Tietze, F.; Butler, E. J.: Glutathionuria: inborn error of metabolism due to tissue deficiency of gamma-glutamyl transpeptidase. Biochem. Biophys. Res. Commun. 65:68-74, 1975.

Murano, S.; Thweatt, R.; Reis, R. J. S.; Jones, R. A.; Moerman, E. J.; Goldstein, S.: Diverse gene sequences are overexpressed in Werner syndrome fibroblasts undergoing premature replicative senescence. Molec. Cell. Biol. 11:3905-3914, 1991.

Li, S.; Strelow, A.; Fontana, E. J.; Wesche, H.: IRAK-4: a novel member of the IRAK family with the properties of an IRAK-kinase. Proc. Nat. Acad. Sci. 99:5567-5572, 2002.

Scanlan, M. J.; Gordon, J. D.; Williamson, B.; Stockert, E.; Bander, N. H.; Jongeneel, V.; Gure, A. O.; Jager, D.; Jager, E.; Knuth, A.; Chen, Y.-T.; Old, L. J.: Antigens recognized by autologous antibody in patients with renal-cell carcinoma. Int. J. Cancer 83:456-464,1999.

Scott, A. F.: Personal Communication. Baltimore, Md. Apr. 25, 2002.

Suzuki, N.; Suzuki, S.; Duncan, G. S.; Millar, D. G.; Wada, T.; Mirtsos, C.; Takada, H.; Wakeham, A.; Itie, A.; Li, S.; Penninger, J. M.; Wesche, H.; Ohashi, P. S.; Mak, T. W.; Yeh, W.-C.: Severe impairment of interleukin-1 and Toll-like receptor signalling in mice lacking IRAK-4. Nature 416:750-754, 2002.

Popovici, C.; Mattei, M.-G.; Rattner, J. B.; Birnbaum, D.; Pebusque, M.-J.: Assignment of the centrosomal protein 110 gene (Cep110) to mouse chromosome bands 2B-C1 by in situ hybridization. Cytogenet. Cell Genet. 89:216-217, 2000.

Castagnola, P.; Gennari, M.; Morello, R.; Tonachini, L.; Marin, O.; Gaggero, A.; Cancedda, R.: Cartilage associated protein (CASP) is a novel developmentally regulated chick embryo protein. J. Cell Sci. 110:1351-1359, 1997.

Morello, R.; Tonachini, L.; Monticone, M.; Viggiano, L.; Rocchi, M.; Cancedda, R.; Castagnola, P.: cDNA cloning, characterization and chromosome mapping of Crtap encoding the mouse cartilage associated protein. Matrix Biol. 18:319-324, 1999.

Tonachini, L.; Morello, R.; Monticone, M.; Skaug, J.; Scherer, S. W.; Cancedda, R.; Castagnola, P.: cDNA cloning, characterization and chromosome mapping of the gene encoding human cartilage associated protein (CRTAP). Cytogenet. Cell Genet. 87:191-194, 1999.

Shibanuma, M.; Mashimo, J.; Mita, A.; Kuroki, T.; Nose, K.: Cloning from a mouse osteoblastic cell line of a set of transforming-growth-factor-beta-1-regulated genes, one of which seems to encode a follistatin-related polypeptide. Europ. J. Biochem. 217:13-19, 1993.

Tanaka, M.; Ozaki, S.; Osakada, F.; Mori, K.; Okubo, M.; Nakao, K.: Cloning of follistatin-related protein as a novel autoantigen in systemic rheumatic diseases. Int. Immun. 10:1305-1314, 1998.

Zwijsen, A.; Blockx, H.; van Arnhem, W.; Willems, J.; Fransen, L.; Devos, K.; Raymackers, J.; van de Voorde, A.; Slegers, H.: characterization of a rat C6 glioma-secreted follistatin-related protein (FRP): cloning and sequence of the human homologue. Europ. J. Biochem. 225:937-946,1994.

Fang, M.; Jaffrey, S. R.; Sawa, A.; Ye, K.; Luo, X.; Snyder, S. H.: Dexras1: a G protein specifically coupled to neuronal nitric oxide synthase via CAPON. Neuron 28:183-193, 2000.

Kemppainen, R. J.; Behrend, E. N.: Dexamethasone rapidly induces a novel Ras superfamily member-related gene in AtT-20 cells. J. Biol. Chem. 273:3129-3131, 1998.

Tu, Y.; Wu, C.: Cloning, expression and characterization of a novel human Ras-related protein that is regulated by glucocorticoid hormone. Biochim. Biophys. Acta 1489:452-456, 1999.

Jaffrey, S. R.; Snowman, A. M.; Eliasson, M. J. L.; Cohen, N. A.; Snyder, S. H.: CAPON: a protein associated with neuronal nitric oxide synthase that regulates its interactions with PSD95. Neuron 115-124,1998.

Boles, K. S.; Nakajima, H.; Colonna, M.; Chuang, S. S.; Stepp, S. E.; Bennett, M.; Kumar, V.; Mathew, P. A.: Molecular characterization of a novel human natural killer cell receptor homologous to mouse 2B4. Tissue Antigens 54:27-34, 1999.

Fort, M. M.; Cheung, J.; Yen, D.; Li, J.; Zurawski, S. M.; Lo, S.; Menon, S.; Clifford, T.; Hunte, B.; Lesley, R.; Muchamuel, T.; Hurst, S. D.; Zurawski, G.; Leach, M. W.; Gorman, D. M.; Rennick, D. M.: IL-25 induces IL-4, IL-5, and IL-13 and Th2-associated pathologies in vivo. Immunity 15:985-995, 2001.

Scott, A. F.: Personal Communication. Baltimore, Md. Feb. 16, 2001.

Kapanadze, B.; Kashuba, V.; Baranova, A.; Rasool, O.; van Everdink, W.; Liu, Y.; Syomova, A.; Corcoran, M.; Poltaraus, A.; Brodyansky, V.; Syomova, N.; Kazakov, A.; Ibbotson, R.; van den Berg, A.; Gizatullin, R.; Fedorova, L.; Sulimova, G.; Zelenin, A.; Deaven, L.; Lehrach, H.; Grander, D.; Buys, C.; Oscier, D.; Zabarovsky, E. R.; Einhorn, S.; Yankovsky, N.: A cosmid and cDNA fine physical map of a human chromosome 13q14 region frequently lost in B-cell chronic lymphocytic leukemia and identification of a new putative tumor suppressor gene, Leu5. FEBS Lett. 426:266-270, 1998.

Liu, Y.; Hermanson, M.; Grander, D.; Merup, M.; Wu, X.; Heyman, M.; Rasool, O.; Juliusson, G.; Gahrton, G.; Detlofsson, R.: 13q deletions in lymphoid malignancies. Blood 86:1911-1915, 1995.

Liu, Y.; Szekely, L.; Grander, D.; Soderhall, S.; Juliusson, G.; Gahrton, G.; Linder, S.; Einhorn, S.: Chronic lymphocytic leukemia cells with allelic deletions at 13q14 commonly have one intact RB1gene: evidence for a role of an adjacent locus. Proc. Nat. Acad. Sci. 90:8697-8701, 1993.

Mori, T.; Fukuda, Y.; Kuroda, H.; Matsumura, T.; Ota, S.; Sugimoto, T.; Nakamura, Y.; Inazawa, J.: Cloning and characterization of a novel Rab-family gene, Rab36, within the region at 22q11.2 that is homozygously deleted in malignant rhabdoid tumors. Biochem. Biophys. Res. Commun. 254:594-600, 1999.

Zhou, J.-Y.; Fogelgren, B.; Wang, Z.; Roe, B. A.; Biegel, J. A.: Isolation of genes from the rhabdoid tumor deletion region in chromosome band 22q11.2. Gene 241:133-141, 2000.

Acquati, F.; Accarino, M.; Nucci, C.; Fumagalli, P.; Jovine, L.; Ottolenghi, S.; Taramelli, R.: The gene encoding DRAP (BACE2), a glycosylated transmembrane protein of the aspartic protease family, maps to the Down syndrome critical region. FEBS Lett. 468:59-64,2000.

Sood, R.; Makalowska, I.; Carpten, J. D.; Robbins, C. M.; Stephan, D. A.; Connors, T. D.; Morgenbesser, S. D.; Su, K.; Pinkett, H. W.; Graham, C. L.; Quesenberry, M. I.; Baxevanis, A. D.; Klinger, K. W.; Trent, J. M.; Bonner, T. I.: The human RGL (RalGDS-like) gene: cloning, expression analysis and genomic organization. Biochim. Biophys. Acta 1491:285-288, 2000.

Bennett, B. D.; Babu-Khan, S.; Loeloff, R.; Louis, J.-C.; Curran, E.; Citron, M.; Vassar, R.: Expression analysis of BACE2 in brain and peripheral tissues. J. Biol. Chem. 275: 20647-20651, 2000.

Saunders, A. J.; Kim, T.-W.; Tanzi, R. E.: BACE maps to chromosome 11 and a BACE homolog, BACE2, reside in the obligate Down syndrome region of chromosome 21. Science 286:1255A only, 1999.

Solans, A.; Estivill, X.; de la Luna, S.: A new aspartyl protease on 21q22.3, BACE2, is highly similar to Alzheimer's amyloid precursor protein beta-secretase. Cytogenet. Cell Genet. 89:177-184, 2000.

Xin, H.; Stephans, J. C.; Duan, X.; Harrowe, G.; Kim, E.; Grieshammer, U.; Kingsley, C.; Giese, K.: Identification of a novel aspartic-like protease differentially expressed in human breast cancer cell lines. Biochim. Biophys. Acta 1501:125-137, 2000.

Kuang, W. W.; Thompson, D. A.; Hoch, R. V.; Weigel, R. J.: Differential screening and suppression subtractive hybridization identified genes differentially expressed in an estrogen receptor-positive breast carcinoma cell line. Nucleic Acids Res. 26:1116-1123, 1998.

Bartles, J. R.; Wierda, A.; Zheng, L.: Identification and characterization of espin, an actin-binding protein localized to the F-actin-rich junctional plaques of Sertoli cell ectoplasmic specializations. J. Cell Sci. 109:1229-1239, 1996.

Bartles, J. R.; Zheng, L.; Li, A.; Wierda, A.; Chen, B.: Smallespin: a third actin-bundling protein and potential forked protein ortholog in brush border microvilli. J. Cell Biol. 143:107-119,1998.

Chen, B.; Li, A.; Wang, D.; Wang, M.; Zheng, L.; Bartles, J. R.: Espin contains an additional actin-binding site in its N terminus and is a major actin-bundling protein of the Sertoli cell-spermatidectoplasmic specialization junctional plaque. Molec. Biol. Cell 10:4327-4339, 1999.

Zheng, L.; Sekerkova, G.; Vranich, K.; Tilney, L. G.; Mugnaini, E.; Bartles, J. R.: The deaf jerker mouse has a mutation in the gene encoding the espin actin-bundling proteins of hair cell stereocilia and lacks espins. Cell 102:377-385, 2000.

Illarioshkin, S. N.; Ivanova-Smolenskaya, I. A.; Tanaka, H.; Poleshchuk, V. V.; Markova, E. D.; Tsuji, S.: Refined genetic location of the chromosome 2p-linked progressive muscular dystrophy gene. Genomics 42:345-348, 1997.

McNally, E. M.; Ly, C. T.; Rosenmann, H.; Rosenbaum, S. M.; Jiang, W.; Anderson, L. V. B.; Soffer, D.; Argov, Z.: Splicing mutation in dysferlin produces limb-girdle muscular dystrophy with inflammation. Am. J. Med. Genet. 91:305-312, 2000.

Illarioshkin, S. N.; Ivanova-Smolenskaya, I. A.; Tanaka, H.; Vereshchagin, N. V.; Markova, E. D.; Poleshchuk, V. V.; Lozhnikova, S. M.; Sukhorukov, V. S.; Limborska, S. A.; Slominsky, P. A.; Bulayeva, K. B.; Tsuji, S.: Clinical and molecular analysis of a large family with three distinct phenotypes of progressive muscular dystrophy. Brain 119:1895-1909, 1996.

Weiler, T.; Greenberg, C. R.; Nylen, E.; Halliday, W.; Morgan, K.; Eggertson, D.; Wrogemann, K.: Limb-girdle muscular dystrophy and Miyoshi myopathy in an aboriginal Canadian kindred map to LGMD2 Band segregate with the same haplotype. Am. J. Hum. Genet. 59:872-878,1996.

Crosbie, R. H.; Lim, L. E.; Moore, S. A.; Hirano, M.; Hays, A. P.; Maybaum, S. W.; Collin, H.; Dovico, S. A.; Stolle, C. A.; Fardeau, M.; Tome, F. M. S.; Campbell, K. P.: Molecular and genetic characterization of sarcospan: insights into sarcoglycan-sarcospan interactions. Hum. Molec. Genet. 9:2019-2027, 2000.

Augustin, I.; Betz, A.; Herrmann, C.; Jo, T.; Brose, N.: Differential expression of two novel Munc13 proteins in rat brain. Biochem. J. 337:363-371, 1999.

Augustin, I.; Rosenmund, C.; Sudhof, T. C.; Brose, N.: Munc13-1 is essential for fusion competence of glutamatergic synaptic vesicles. Nature 400:457-461, 1999.

Rhee, J.-S.; Betz, A.; Pyott, S.; Reim, K.; Varoqueaux, F.; Augustin, I.; Hesse, D.; Sudhof, T. C.; Takahashi, M.; Rosenmund, C.; Brose, N.: Beta phorbol ester- and diacylglycerol-induced augmentation of transmitter release is mediated by Munc13s and not by PKCs. Cell 108:121-133, 2002.

Rosenmund, C.; Sigler, A.; Augustin, I.; Reim, K.; Brose, N.; Rhee, J.-S.: Differential control of vesicle priming and short-term plasticity by Munc13 isoforms. Neuron 33:411-424, 2002.

Song, Y.; Ailenberg, M.; Silverman, M.: Cloning of a novel gene in the human kidney homologous to rat munc13s: its potential role in diabetic nephropathy. Kidney Int. 53:1689-1695, 1998.

Ji, Y.; Walkowicz, M. J.; Buiting, K.; Johnson, D. K.; Tarvin, R. E.; Rinchik, E. M.; Horsthemke, B.; Stubbs, L.; Nicholls, R. D.: The ancestral gene for transcribed, low-copy repeats in the Prader-Willi/Angelman region encodes a large protein implicated in protein trafficking, which is deficient in mice with neuromuscular and spermiogenic abnormalities. Hum. Molec. Genet. 8:533-542, 1999.

Manda, R.; Kohno, T.; Matsuno, Y.; Takenoshita, S.; Kuwano, H.; Yokota, J.: Identification of genes (SPON2 and C20orf2) differentially expressed between cancerous and noncancerous lung cells by mRNA differential display. Genomics 61:5-14, 1999.

Zhang, Y.; Heidebrecht, H.-J.; Rott, A.; Schlegelberger, B.; Parwaresch, R.: Assignment of human proliferation associated p100 gene (C20orf1) to human chromosomal band 20q11.2 by in situ hybridization. Cytogenet. Cell Genet. 84:182-183, 1999.

Parker, N. J.; Begley, C. G.; Smith, P. J.; Fox, R. M.: molecular cloning of a novel human gene (D11S4896E) at chromosomal region 11p15.5. Genomics 37:253-256, 1996.

Sabbioni, S.; Veronese, A.; Trubia, M.; Taramelli, R.; Barbanti-Brodano, G.; Croce, C. M.; Negrini, M.: Exon structure and promoter identification of STIM1 (alias GOK), a human gene causing growth arrest of the human tumor cell lines G401 and RD. Cytogenet. Cell. Genet. 86:214-218,1999.

Boudin, H.; Doan, A.; Xia, J.; Shigemoto, R.; Huganir, R. L.; Worley, P.; Craig, A. M.: Presynaptic clustering of mGluR7a requires the PICK1 PDZ domain binding site. Neuron 28:485-497, 2000.

Dev, K. K.; Nishimune, A.; Henley, J. M.; Nakanishi, S.: The protein kinase C-alpha binding protein PICK1 interacts with short but not long form alternative splice variants of AMPA receptor subunits. Neuropharmacology 38:635-644, 1999.

Staudinger, J.; Zhou, J.; Burgess, R.; Elledge, S. J.; Olson, E. N.: PICK1: a perinuclear binding protein and substrate for protein kinase C isolated by the yeast two-hybrid system. J. Cell Biol. 128:263-271, 1995.

Takeya, R.; Takeshige, K.; Sumimoto, H.: Interaction of the PDZ domain of human PICK1 with class I ADP-ribosylation factors. Biochem. Biophys. Res. Commun. 267:149-155, 2000.

Xia, J.; Zhang, X.; Staudinger, J.; Huganir, R. L.: Clustering of AMPA receptors by the synaptic PDZ domain-containing protein PICK1. Neuron 22:179-187, 1999.

Hirose, K.; Morita, M.; Ema, M.; Mimura, J.; Hamada, H.; Fujii, H.; Saijo, Y.; Gotoh, O.; Sogawa, K.; Fujii-Kuriyama, Y.: cDNA cloning and tissue-specific expression of a novel basic helix-loop-helix/PAS factor (Arnt2) with close sequence similarity to the aryl hydrocarbon receptor nuclear translocator (Arnt). Molec. Cell. Biol. 16:1706-1713,1996.

Keith, B.; Adelman, D. M.; Simon, M. C.: Targeted mutation of the murine arylhydrocarbon receptor nuclear translocator 2 (Arnt2) gene reveals partial redundancy with Arnt. Proc. Nat. Acad. Sci. 98:6692-6697, 2001.

Michaud, J. L.; DeRossi, C.; May, N. R.; Holdener, B. C.; Fan, C.-M.: ARNT2 acts as the dimerization partner of SIM1 for the development of the hypothalamus. Mech. Dev. 90:253-261, 2000.

Wende, H.; Volz, A.; Ziegler, A.: Extensive gene duplications and a large inversion characterize the human leukocyte receptor cluster. Immunogenetics 51:703-713, 2000.

Fukunaga-Johnson, N.; Lee, S. W.; Liebert, M.; Grossman, H. B.: Molecular analysis of a gene, BB1, overexpressed in bladder and breast carcinoma. Anticancer Res. 16:1085-1090, 1996.

Saito, H.; Papaconstantinou, J.; Sato, H.; Goldstein, S.: Regulation of a novel gene encoding a lysyl oxidase-related protein in cellular adhesion and senescence. J. Biol. Chem. 272:8157-8160, 1997.

Hsu, S. Y.; Liang, S.-G.; Hsueh, A. J. W.: Characterization of two LGR genes homologous to gonadotropin and thyrotropin receptors with extracellular leucine-rich repeats and a G protein-coupled, seven-transmembrane region. Molec. Endocr. 12:1830-1845, 1998.

Loh, E. D.; Broussard, S. R.; Kolakowski, L. F.: Molecular characterization of a novel glycoprotein hormone G-protein-coupled receptor. Biochem. Biophys. Res. Commun. 282: 757-764, 2001.

Loh, E. D.; Broussard, S. R.; Liu, Q.; Copeland, N. G.; Gilbert, D. J.; Jenkins, N. A.; Kolakowski, L. F., Jr. Chromosomal localization of GPR48, a novel glycoprotein hormone receptor like GPCR, in human and mouse with radiation hybrid and interspecific backcross mapping. Cytogenet. Cell Genet. 89:2-5, 2000.

Giffon, T.; Lepourcelet, M.; Pichon, L.; Jezequel, P.; Bouric, P.; Carn, G.; Pontarotti, P.; Le Gall, J.-Y.; David, V.: Cloning of a human homologue of the mouse Tctex-5 gene within the MHC class I region. Immunogenetics 44:331-339, 1996.

Lepourcelet, M.; Andrieux, N.; Giffon, T.; Pichon, L.; Hampe, A.; Galibert, F.; Mosser, J.: Systematic sequencing of the human HLA-A/HLA-Fregion: establishment of a cosmid contig and identification of a new gene cluster within 37 kb of sequence. Genomics 37:316-326, 1996.

Zhang, J.; Zhang, L.; Zhao, S.; Lee, E. Y. C.: Identification and characterization of the human HCG V gene product as a novel inhibitor of protein phosphatase-1. Biochemistry 37:16728-16734, 1998.

Hayakawa, A.; Matsuda, Y.; Daibata, M.; Nakamura, H.; Sano, K.: Genomic organization, tissue expression, and cellular localization of AF3p21, a fusion partner of MLL in therapy-related leukemia. Genes Chromosomes Cancer 30:364-374, 2001.

Sano, K.; Hayakawa, A.; Piao, J.-H.; Kosaka, Y.; Nakamura, H.:Novel SH3 protein encoded by the AF3p21 gene is fused to the mixed lineage leukemia protein in a therapy-related leukemia with t (3;11)(p21; q23). Blood 95:1066-1068, 2000.

Cao, H.; Hegele, R. A.: Identification of single-nucleotide polymorphisms in the human LPIN1 gene. J. Hum. Genet. 47:370-372, 2002.

Peterfy, M.; Phan, J.; Xu, P.; Reue, K.: Lipodystrophy in the fld mouse results from mutation of a new gene encoding a nuclear protein, lipin. Nature Genet. 27:121-124, 2001.

Reue, K.; Xu, P.; Wang, X.-P.; Slavin, B. G.: Adipose tissue deficiency, glucose intolerance, and increased atherosclerosis result from mutation in the mouse fatty liver dystrophy (fld) gene. J. Lipid Res. 41:1067-1076, 2000.

Shakhov, A. N.; Rubtsov, A. V.; Lyakhov, I. G.; Tumanov, A. V.; Nedospasov, S. A.:SPLASH (PLA(2)IID), a novel member of phospholipase A2 family, is associated with lymphotoxin-deficiency. Genes Immun. 1:191-199, 2000.

Domanski, T. L.; Finta, C.; Halpert, J. R.; Zaphiropoulos, P. G.: cDNA cloning and initial characterization of CYP3A43, a novel human cytochrome P450. Molec. Pharm. 59:386-392, 2001.

Gellner, K.; Eiselt, R.; Hustert, E.; Arnold, H.; Koch, I.; Haberl, M.; Deglmann, C. J.; Burk, O.; Buntefuss, D.; Escher, S.; Bishop, C.; Koebe, H.-G.; Brinkmann, U.; Klenk, H.-P.; Kleine, K.; Meyer, U. A.; Wojnowski, L.: Genomic organization of the human CYP3A locus:identification of a new, inducible CYP3A gene. Pharmacogenetics 11:111-121, 2001.

Westlind, A.; Malmebo, S.; Johansson, I.; Otter, C.; Andersson, T. B.; Ingelman-Sundberg, M.; Oscarson, M.: Cloning and tissue distribution of a novel human cytochrome P450 of the CYP3A subfamily, CYP3A43. Biochem. Biophys. Res. Commun. 281:1349-1355, 2001.

Furusawa, M.; Ohnishi, T.; Taira, T.; Iguchi-Ariga, S. M. M.; Ariga, H.: AMY-1, a c-Myc-binding protein, is localized in the mitochondria of sperm by association with S-AKAP84, an anchor protein of cAMP-dependent protein kinase. J. Biol. Chem. 276:36647-36651, 2001.

Taira, T.; Maeda, J.; Onishi, T.; Kitaura, H.; Yoshida, S.; Kato, H.; Ikeda, M.; Tamai, K.; Iguchi-Ariga, S. M. M.; Ariga, H.: AMY-1, a novel C-MYC binding protein that stimulates transcription activity of C-MYC. Genes Cells 3:549-565, 1998.

Holt, J. R.; Gillespie, S. K. H.; Provance, D. W., Jr.; Shah, K.; Shokat, K. M.; Corey, D. P.; Mercer, J. A.; Gillespie, P. G.: A chemical-genetic strategy implicates myosin-1c in adaptation by hair cells. Cell 108:371-381, 2002.

Chen, D.; Guo, J.; Miki, T.; Tachibana, M.; Gahl, W. A.: molecular cloning of two novel rab genes from human melanocytes. Gene 174:129-134, 1996.

Le, L. Q.; Kabarowski, J. H. S.; Weng, Z.; Satterthwaite, A. B.; Harvill, E. T.; Jensen, E. R.; Miller, J. F.; Witte, O. N.: Mice lacking the orphan G protein-coupled receptor G2A develop a late-onset autoimmune syndrome. Immunity 14:561-571, 2001.

Scott, A. F.: Personal Communication. Baltimore, Md. Jul. 20, 2001.

Eggenschwiler, J. T.; Espinoza, E.; Anderson, K. V.: Rab23 is an essential negative regulator of the mouse Sonic hedgehog signalling pathway. Nature 412:194-198, 2001.

Zhang, Q.-H.; Ye, M.; Wu, X.-Y.; Ren, S.-X.; Zhao, M.; Zhao, C.-J.; Fu, G.; Shen, Y.; Fan, H.-Y.; Lu, G.; Zhong, M.; Xu, X.-R.; and 9 others: Cloning and functional analysis of cDNAs with open reading frames for 300 previously undefined genes expressed in CD34+ hematopoietic stem/progenitor cells. Genome Res. 10:1546-1560, 2000.

Saitoh, T.; Hirai, M.; Katoh, M.: Molecular cloning and characterization of human Frizzled-8 gene on chromosome 10p11.2. Int. Oncol. 18:991-996, 2001.

Wittenberger, T.; Schaller, H. C.; Hellebrand, S.: An expressed sequence tag (EST) data mining strategy succeeding in the discovery of new G-protein coupled receptors. J. Molec. Biol. 307:799-813,2001.

Communi, D.; Gonzalez, N. S.; Detheux, M.; Brezillon, S.; Lannoy, V.; Parmentier, M.; Boeynaems, J.-M.: Identification of a novel human ADP receptor coupled to G(i). J. Biol. Chem. 276:41479-41485, 2001.

Chen, H.; Ross, C. A.; Wang, N.; Huo, Y.; MacKinnon, D. F.; Potash, J. B.; Simpson, S. G.; McMahon, F. J.; DePaulo, J. R., Jr.; McInnis, M. G.: NEDD4L on human chromosome 18q21 has multiple forms of transcripts and is a homologue of the mouse Nedd4-2 gene. Europ. J. Hum. Genet. 9:922-930, 2001.

Erdeniz, N.; Rothstein, R.: Rsp5, a ubiquitin-protein ligase, is involved in degradation of the single-stranded-DNA binding protein Rfa1 in Saccharomyces cerevisiae. Molec. Cell. Biol. 20:224-232,2000.

Lu, Q. R.; Park, J. K.; Noll, E.; Chan, J. A.; Alberta, J.; Yuk, D.; Alzamora, M. G.; Louis, D. N.; Stiles, C. D.; Rowitch, D. H.; Black, P. M.: Oligodendrocyte lineage genes (OLIG) as molecular markers for human glial brain tumors. Proc. Nat. Acad. Sci. 98:10851-10856,2001.

Riggins, G. J.; Thiagalingam, S.; Rozenblum, E.; Weinstein, C. L.; Kern, S. E.; Hamilton, S. R.; Willson, J. K. V.; Markowitz, S. D.; Kinzler, K. W.; Vogelstein, B.: Mad-related genes in the human. Nature Genet. 13:347-349, 1996.

Abe, K.; Yamamura, K.; Suzuki, M.: Molecular and embryological characterization of a new transgene-induced null allele of mouse Brachyurylocus. Mammalian Genome 11:238-240, 2000.

European Consortium on MEN1: Mapping of the gene encoding the B56-beta subunit of protein phosphatase 2A (PPP2R5B) to a 0.5-Mb region of chromosome 11q13 and its exclusion as a candidate gene for multiple endocrine neoplasia type 1 (MEN1). Hum. Genet. 100:481-485, 1997.

Arsenijevic, D.; Onuma, H.; Pecqueur, C.; Raimbault, S.; Manning, B. S.; Miroux, B.; Couplan, E.; Alves-Guerra, M.-C.; Goubern, M.; Surwit, R.; Bouillard, F.; Richard, D.; Collins, S.; Ricquier, D.: Disruption of the uncoupling protein-2 gene in mice reveals a role in immunity and reactive oxygen species production. Nature Genet. 26:435-439, 2000.

Bouchard, C.; Perusse, L.; Chagnon, Y. C.; Warden, C.; Ricquier, D.: Linkage between markers in the vicinity of the uncoupling protein 2 gene and resting metabolic rate in human S. Hum. Molec. Genet. 6:1887-1889, 1997.

Brauner, P.; Nibbelink, M.; Flachs, P.; Vitkova, I.; Kopecky, P.; Mertelikova, I.; Janderova, L.; Penicaud, L.; Casteilla, L.; Plavka, R.; Kopecky, J.: Fast decline of hematopoiesis and uncoupling protein 2 content in human liver after birth: location of the protein in Kupffer cells. Pediat. Res. 49:440-447, 2001.

Esterbauer, H.; Schneitler, C.; Oberkofler, H.; Ebenbichler, C.; Paulweber, B.; Sandhofer, F.; Ladurner, G.; Hell, E.; Strosberg, A. D.; Patsch, J. R.; Krempler, F.; Patsch, W.: A common polymorphism in the promoter of UCP2 is associated with decreased risk of obesity in middle-aged humans. Nature Genet. 28:178-183, 2001.

Fleury, C.; Neverova, M.; Collins, S.; Raimbault, S.; Champigny, O.; Levi-Meyrueis, C.; Bouillaud, F.; Seldin, M. F.; Surwit, R. S.; Ricquier, D.; Warden, C. H.: Uncoupling protein-2: a novel gene linked to obesity and hyperinsulinemia. Nature Genet. 15:269-272, 1997.

Flier, J. S.; Lowell, B. B.: Obesity research springs a proton leak. Nature Genet. 15:223-224, 1997.

Millet, L.; Vidal, H.; Andreelli, F.; Larrouy, D.; Riou, J.-P.; Ricquier, D.; Laville, M.; Langin, D.: Increased uncoupling protein-2 and -3 mRNA expression during fasting in obese and lean humans. J. Clin. Invest. 100:2665-2670, 1997.

Edwards, Y. H.; Putt, W.; Lekoape, K. M.; Stott, D.; Fox, M.; Hopkinson, D. A.; Sowden, J.: The human homolog T of the mouse T (Brachyury) gene: gene structure, cDNA sequence, and assignment to chromosome 6q27. Genome Res. 6:226-233, 1996.

Morrison, K.; Papapetrou, C.; Attwood, J.; Hol, F.; Lynch, S. A.; Sampath, A.; Hamel, B.; Burn, J.; Sowden, J.; Stott, D.; Mariman, E.; Edwards, Y. H.: Genetic mapping of the human homologue (T) of mouse T(Brachyury) and a search for allele association between human T and spina bifida. Hum. Molec. Genet. 5:669-674, 1996.

Papapetrou, C.; Drummond, F.; Reardon, W.; Winter, R.; Spitz, L.; Edwards, Y. H.: A genetic study of the human T gene and its exclusion as a major candidate gene for sacral agenesis with anorectal atresia. J. Med. Genet. 36:208-213, 1999.

Shields, D. C.; Ramsbottom, D.; Donoghue, C.; Pinjon, E.; Kirke, P. N.; Molloy, A. M.; Edwards, Y. H.; Mills, J. L.; Mynett-Johnson, L.; Weir, D. G.; Scott, J. M.; Whitehead, A. S.: Association between historically high frequencies of neural tube defects and the human T homologue of mouse T (Brachyury). Am. J. Med. Genet. 92:206-211,2000.

Speer, M. C.; Melvin, E. C.; Viles, K. D.; Bauer, K. A.; Rampersaud, E.; Drake, C.; George, T. M.; Enterline, D. S.; Mackey, J. F.; Worley, G.; Gilbert, J. R.; Nye, J. S.; NTD Collaborative Group: T locus shows no evidence for linkage disequilibrium or mutation in American Caucasian neural tube defect families. Am. J. Med. Genet. 110:215-218,2002.

Trembath, D.; Sherbondy, A. L.; Vandyke, D. C.; Shaw, G. M.; Todoroff, K.; Lammer, E. J.; Finnell, R. H.; Marker, S.; Lerner, G.; Murray, J. C.: Analysis of select folate pathway genes, PAX3, and human T in a midwestern neural tube defect population. Teratology 59:331-341,1999.

Gunduz, M.; Ouchida, M.; Fukushima, K.; Hanafusa, H.; Etani, T.; Nishioka, S.; Nishizaki, K.; Shimizu, K.: Genomic structure of the human ING1 gene and tumor-specific mutations detected in head and neck squamous cell carcinomas. Cancer Res. 60:3143-3146, 2000.

Hasegawa, H.; Kiyokawa, E.; Tanaka, S.; Nagashima, K.; Gotoh, N.; Shibuya, M.; Kurata, T.; Matsuda, M.: DOCK180, a major CRK-binding protein, alters cell morphology upon translocation to the membrane. Molec. Cell Biol. 16:1770-176, 1996.

Savill, J.: Phagocytic docking without shocking. Nature 442-443,1998.

Takai, S.; Hasegawa, H.; Kiyokawa, E.; Yamada, K.; Kurata, T.; Matsuda, M.: Chromosomal mapping of the gene encoding DOCK180, a major Crk-binding protein, to 10q26.13-q26.3 by fluorescence in situ hybridization. Genomics 35:403-404, 1996.

Wu, Y.-C.; Horvitz, H. R.: C. elegans phagocytosis and cell-migration protein CED-5 is similar to human DOCK180. Nature 392:501-504,1998.

Alexander, J. M.; Bikkal, H. A.; Zervas, N. T.; Laws, E. R., Jr.; Klibanski, A.: Tumor-specific expression and alternate splicing of messenger ribonucleic acid encoding activin/ transforming growth factor-beta receptors in human pituitary adenomas. J. Clin. Endocr. Metab. 81:783-790, 1996.

Su, G. H.; Bansal, R.; Murphy, K. M.; Montgomery, E.; Yeo, C. J.; Hruban, R. H.; Kern, S. E.: ACVR1B (ALK4, activin receptor type 1B) gene mutations in pancreatic carcinoma. Proc. Nat. Acad. Sci. 98:3254-3257, 2001.

Xu, J.; Matsuzaki, K.; McKeehan, K.; Wang, F.; Kan, M.; McKeehan, W. L.: Genomic structure and cloned cDNAs predict that four variants in the kinase domain of serine/ threonine kinase receptors arise by alternative splicing and poly (A) addition. Proc. Nat. Acad. Sci. 91:7957-7961, 1994.

Zhou, Y.; Sun, H.; Danila, D. C.; Johnson, S. R.; Sigai, D. P.; Zhang, X.; Klibanski, A.: Truncated activin type I receptor Alk4 isoforms are dominant negative receptors inhibiting activin signaling. Molec. Endocr. 14:2066-2075, 2000.

Mann, S. S.; Pettenati, M. J.; von Kap-herr, C.; Hart, T. C.:Reassignment of peptidyl prolyl isomerase-like 1 gene (PPIL1) to human chromosome region 6p21.1 by radiation hybrid mapping and fluorescence in situ hybridization. Cytogenet. Cell Genet. 83:228-229, 1998.

Ozaki, K.; Fujiwara, T.; Kawai, A.; Shimizu, F.; Takami, S.; Okuno, S.; Takeda, S.; Shimada, Y.; Nagata, M.; Watanabe, T.; Takaichi, A.; Takahashi, E.; Nakamura, Y.; Shin, S.: Cloning, expression and chromosomal mapping of a novel cyclophilin-related gene (PPIL1) from human fetal brain. Cytogenet. Cell Genet. 72:242-245, 1996.

Graef, I. A.; Chen, F.; Chen, L.; Kuo, A.; Crabtree, G. R.: Signals transduced by Ca (2+)/calcineurin and NFATc3/c4 pattern the developing vasculature. Cell 105:863-875, 2001.

Wang, M. G.; Yi, H.; Guerini, D.; Klee, C. B.; McBride, O. W.:Calcineurin A alpha (PPP3CA), calcineurin A beta (PPP3CB) and calcineurin B (PPP3R1) are located on human chromosomes 4, 10q21-q22 and 2p16-p15, respectively. Cytogenet. Cell Genet. 72:236-241, 1996.

Zeng, H.; Chattarji, S.; Barbarosie, M.; Rondi-Reig, L.; Philpot, B. D.; Miyakawa, T.; Bear, M. F.; Tonegawa, S.: Forebrain-specific calcineurin knockout selectively impairs bidirectional synaptic plasticity and working/episodic-like memory. Cell 107:617-629, 2001.

Kolodrubetz, D.; Burgum, A.: Sequence and genetic analysis of NHP2: a moderately abundant high mobility group-like nuclear protein with an essential function in Saccharomyces cerevisiae. Yeast 7:79-90, 1991.

Saito, H.; Fujiwara, T.; Shin, S.; Okui, K.; Nakamura, Y.: Cloning and mapping of a human novel cDNA (NHP2L1) that encodes a protein highly homologous to yeast nuclear protein NHP2. Cytogenet. Cell Genet. 72:191-193, 1996.

Mooseker, M. S.; Cheney, R. E.: Unconventional myosins. Annu. Rev. Cell Dev. Biol. 11:633-675, 1995.

Bement, W. M.; Wirth, J. A.; Mooseker, M. S.: Cloning and mRNA expression of human unconventional myosin-IC: a homologue of amoeboid myosins-I with a single IQ motif and an SH3 domain. J. Molec. Biol. 243:356-363, 1994.

Bement, W. M.; Hasson, T.; Wirth, J. A.; Cheney, R. E.; Mooseker, M. S.: Identification and overlapping expression of multiple unconventional myosin genes in vertebrate cell types. Proc. Nat. Acad. Sci. 91:6549-6553, 1994. Erratum: Proc. Nat. Acad. Sci. 91:11767, 1994.

Crozet, F.; Amraoui, A. E.; Blanchard, S.; Lenoir, M.; Ripoll, C.; Vago, P.; Hamel, C.; Fizames, C.; Levi-Acobas, F.; Depetris, D.; Mattei, M.-G.; Weil, D.; Pujol, R.; Petit, C.: Cloning of the genes encoding two murine and human cochlear unconventional type I myosins. Genomics 40:332-341, 1997.

Goppelt, A.; Stelzer, G.; Lottspeich, F.; Meisterernst, M.: A mechanism for repression of class II gene transcription through specific binding of NC2 to TBP-promoter complexes via heterodimeric histone fold domains. EMBO J. 15:3105-3116, 1996.

Inostroza, J. A.; Mermeistein, F. H.; Ha, I.; Lane, W. S.; Reinberg, D.: Dr1, a TATA-binding protein-associated phosphoprotein and inhibitor of class II gene transcription. Cell 70:477-489, 1992.

Kamada, K.; Shu, F.; Chen, H.; Malik, S.; Stelzer, G.; Roeder, R. G.; Meisterernst, M.; Burley, S. K.: Crystal structure of negative cofactor 2 recognizing the TBP-DNA transcription complex. Cell 106:71-81, 2001.

Mermelstein, F.; Yeung, K.; Cao, J.; Inostroza, J. A.; Erdjument-Bromage, H.; Eagelson, K.; Landsman, D.; Levitt, P.; Tempst, P.; Reinberg, D.: Requirement of a corepressor for Dr1-mediated repression of transcription. Genes Dev. 10:1033-1048, 1996.

Purello, M.; Di Pietro, C.; Rapisarda, A.; Viola, A.; Corsaro, C.; Motta, S.; Grzeschik, K.-H.; Sichel, G.: Genomic localization of the human gene encoding Dr1, a negative modulator of transcription of class II and class III genes. Cytogenet. Cell Genet. 75:186-189,1996.

Rozet, J.-M.; Gerber, S.; Perrault, I.; Camuzat, A.; Calvas, P.; Viegas-Pequignot, E.; Molina-Gomes, D.; Le Paslier, D.; Chumakov, I.; Munnich, A.; Kaplan, J.: Structure and physical mapping of DR1, a TATA-binding protein-associated phosphoprotein gene, to chromosome 1p22.1 and its exclusion in Stargardt disease (STGD). Genomics 36:554-556, 1996.

Willy, P. J.; Kobayashi, R.; Kadonaga, J. T.: A basal transcription factor that activates or represses transcription. Science 290:982-984,2000.

Yeung, K.; Kim, S.; Reinberg, D.: Functional dissection of a human Dr1-DRAP1 repressor complex. Molec. Cell. Biol. 17:36-45, 1997.

Dong, L. Q.; Du, H.; Porter, S. G.; Kolakowski, L. F., Jr.; Lee, A. V.; Mandarino, J.; Fan, J.; Yee, D.; Liu, F.: Cloning, chromosome localization, expression, and characterization of an Src homology2 and pleckstrin homology domain-containing insulin receptor binding protein hGrb10-gamma. J. Biol. Chem. 272:29104-29112, 1997.

Skolnik, E. Y.; Margolis, B.; Mohammadi, M.; Lowenstein, E.; Fischer, R.; Drepps, A.; Ullrich, A.; Schlessinger, J.: Cloning of PI3 kinase-associated p85 utilizing a novel method for expression/cloning of target proteins for receptor tyrosine kinases. Cell 65:83-90, 1991.

Blagitko, N.; Mergenthaler, S.; Schulz, U.; Wollmann, H. A.; Craigen, W.; Eggermann, T.; Ropers, H.-H.; Kalscheuer, V. M.: Human GRB10 is imprinted and expressed from the paternal and maternal allele in a highly tissue- and isoform-specific fashion. Hum. Molec. Genet. 9:1587-1595, 2000.

Frantz, J. D.; Giorgetti-Peraldi, S.; Ottinger, E. A.; Shoelson, S. E.: Human GRB-IR-beta/GRB10: splice variants of an insulin and growth factor receptor-binding protein with PH and SH2 domains. J. Biol. Chem. 272:2659-2667, 1997.

Hannula, K.; Lipsanen-Nyman, M.; Kontiokari, T.; Kere, J.: A narrow segment of maternal uniparental disomy of chromosome 7q31-qter in Silver-Russell syndrome delimits a candidate gene region. Am. J. Hum. Genet. 68:247-253, 2001.

Jerome, C. A.; Scherer, S. W.; Tsui, L.-C.; Gietz, R. D.; Triggs-Raine, B.: Assignment of growth factor receptor-bound protein 10 (GRB10) to human chromosome 7p11.2-p12. Genomics 40:215-216, 1997.

Liu, F.; Roth, R. A.: Grb-IR: a SH2-domain-containing protein that binds to the insulin receptor and inhibits its function. Proc. Nat. Acad. Sci. 92:10287-10291, 1995.

Ooi, J.; Yajnik, V.; Immanuel, D.; Gordon, M.; Moskow, J. J.; Buchberg, A. M.; Margolis, B.: The cloning of Grb10 reveals a new family of SH2 domain proteins. Oncogene 10:1621-1630, 1995.

Daly, R. J.; Sanderson, G. M.; Janes, P. W.; Sutherland, R. L.: Cloning and characterization of GRB14, a novel member of the GRB7 gene family. J. Biol. Chem. 271:12502-12510, 1996.

Hakala, B. E.; White, C.; Recklies, A. D.: Human cartilage gp-39, a major secretory product of articular chondrocytes and synovial cells, is a mammalian member of a chitinase protein family. J. Biol. Chem. 268:25803-25810, 1993.

Rehli, M.; Krause, S. W.; Andreesen, R.: Molecular characterization of the gene for human cartilage gp-39 (CHI3L1), a member of the chitinase protein family and marker for late stages of macrophage differentiation. Genomics 43:221-225, 1997.

Dry, K.; Kenwrick, S.; Rosenthal, A.; Platzer, M.: The complete sequence of the human locus for NgCAM-related cell adhesion molecule reveals a novel alternative exon in chick and man and conserved genomic organization for the L1 subfamily. Gene 273:115-122, 2001.

Grumet, M.; Mauro, V.; Burgoon, M. P.; Edelman, G. M.; Cunningham, B. A.: Structure of a new nervous system glycoprotein, Nr-CAM, and its relationship to subgroups of neural cell adhesion molecules. J. Cell. Biol. 113:1399-1412, 1991.

Kayyem, J. F.; Roman, J. M.; de la Rosa, E. J.; Schwarz, U.; Dreyer, W. J.: Bravo/Nr-CAM is closely related to the cell adhesion molecules L1 and Ng-CAM and has a similar heterodimer structure. J. Cell. Biol. 118:1259-1270, 1992.

Lane, R. P.; Chen, X.-N.; Yamakawa, K.; Vielmetter, J.; Korenberg, J. R.; Dreyer, W. J.: Characterization of a highly conserved human homolog to the chicken neural cell surface protein Bravo/Nr-CAM that maps to chromosome band 7q31. Genomics 35:456-465, 1996.

Wang, B.; Williams, H.; Du, J.-S.; Terrett, J.; Kenwrick, S.:Alternative splicing of human NrCAM in neural and non-neural tissues. Molec. Cell. Neurosci. 10:287-295, 1998.

Damen, J. E.; Liu, L.; Rosten, P.; Humphries, R. K.; Jefferson, A. B.; Majerus, P. W.; Krystal, G.: The 145-kDa protein induced to associate with Shc by multiple cytokines is an inositol tetraphosphate and phosphatidyl inositol 3,4,5-triphosphate 5-phosphatase. Proc. Nat. Acad. Sci. 93:1689-1693, 1996.

Drayer, A. L.; Pesesse, X.; De Smedt, F.; Woscholski, R.; Parker, P.; Erneux, C.: Cloning and expression of a human placenta inositol 1,3,4,5-tetrakisphosphate and phosphatidyl inositol 3,4,5-triphosphate 5-phosphatase. Biochem. Biophys. Res. Commun. 225:243-249, 1996.

Helgason, C. D.; Damen, J. E.; Rosten, P.; Grewal, R.; Sorensen, P.; Chappel, S. M.; Borowski, A.; Jirik, F.; Krystal, G.; Humphries, R. K.: Targeted disruption of SHIP leads to hemopoietic perturbations, lung pathology, and a shortened life span. Genes Dev. 12:1610-1620,1998.

Huber, M.; Helgason, C. D.; Damen, J. E.; Liu, L.; Humphries, R. K.; Krystal, G.: The src homology 2-containing inositol phosphatase (SHIP) is the gatekeeper of mast cell degranulation. Proc. Nat. Acad. Sci. 95:11330-11335, 1998.

Kavanaugh, W. M.; Pot, D. A.; Chin, S. M.; Deuter-Reinhard, M.; Jefferson, A. B.; Norris, F. A.; Masiarz, F. R.; Cousens, L. S.; Majerus, P. W.; Williams, L. T.: Multiple forms of an inositol polyphosphate 5-phosphatase form signaling complexes with Shc and Grb2. Curr. Biol. 6:438-445, 1996.

Lioubin, M. N.; Algate, P. A.; Tsai, S.; Carlberg, K.; Aebersold, R.; Rohrschneider, L. R.: p150(Ship), a signal transduction molecule with inositol polyphosphate-5-phosphatase activity. Genes Dev. 10:1084-1095, 1996.

Liu, Q.; Amgen EST Program; Dumont, D. J.: Molecular cloning and chromosomal localization in human and mouse of the SH2-containing inositol phosphatase, INPP5D (SHIP). Genomics 39:109-112, 1997.

Liu, Q.; Shalaby, F.; Jones, J.; Bouchard, D.; Dumont, D. J.:The SH2-containing inositol polyphosphate 5-phosphatase, Ship, is expressed during hematopoiesis and spermatogenesis. Blood 91:2753-2759,1998.

Takeshita, S.; Namba, N.; Zhao, J. J.; Jiang, Y.; Genant, H. K.; Silva, M. J.; Brodt, M. D.; Helgason, C. D.; Kalesnikoff, J.; Rauh, M. J.; Humphries, R. K.; Krystal, G.; Teitelbaum, S. L.; Ross, F. P.: SHIP-deficient mice are severely osteoporotic due to increased numbers of hyper-resorptive osteoclasts. Nature Med. 8:943-949,2002.

Wang, J.-W.; Howson, J. M.; Ghansah, T.; Desponts, C.; Ninos, J. M.; May, S. L.; Nguyen, K. H. T.; Toyama-Sorimachi, N.; Kerr, W. G.: Influence of SHIP on the NK repertoire and allogeneic bone marrow transplantation. Science 295: 2094-2097, 2002.

Ware, M. D.; Rosten, P.; Damen, J. E.; Liu, L.; Humphries, R. K.; Krystal, G.: Cloning and characterization of human SHIP, the 145-kD inositol 5-phosphatase that associates with SHC after cytokine stimulation. Blood 88:2833-2840, 1996.

Cates, C. A.; Michael, R. L.; Stayrook, K. R.; Harvey, K. A.; Burke, Y. D.; Randall, S. K.; Crowell, P. L.; Crowell, D. N.: Prenylation of oncogenic human PTP(CAAX) protein tyrosine phosphatases. Cancer Lett. 110:49-55, 1996.

Montagna, M.; Serova, O.; Sylla, B. S.; Feunteun, J.; Lenoir, G. M.: A 100-kb physical and transcriptional map around the EDH17B2 gene: identification of three novel genes and a pseudogene of a human homologue of the rat PRL-1 tyrosine phosphatase. Hum. Genet. 96:532-538, 1995.

Zeng, Q.; Hong, W.; Tan, Y. H.: Mouse PRL-2 and PRL-3, two potentially prenylated protein tyrosine phosphatases homologous to PRL-1. Biochem. Biophys. Res. Commun. 244:421-427, 1998.

Muneer, S.; Ramalingam, V.; Wyatt, R.; Schultz, R. A.; Minna, J. D.; Kamibayashi, C.: Genomic organization and mapping of the gene encoding the PP2A B56-gamma regulatory subunit. Genomics 79:344-348,2002.

Deveraux, Q.; Jensen, C.; Rechsteiner, M.: Molecular cloning and expression of a 26 S protease subunit enriched in dileucine repeats. J. Biol. Chem. 270:23726-23729, 1995.

Deveraux, Q.; Ustrell, V.; Pickart, C.; Rechsteiner, M.: A 26S protease subunit that binds ubiquitin conjugates. J. Biol. Chem. 269:7059-7061, 1994.

Hu, R.-J.; Lee, M. P.; Johnson, L. A.; Feinberg, A. P.: A novel human homologue of yeast nucleosome assembly protein, 65 kb centromeric to the p57(KIP2) gene, is biallelically expressed in fetal and adult tissues. Hum. Molec. Genet. 5:1743-1748, 1996.

Rodriguez, P.; Munroe, D.; Prawitt, D.; Chu, L. L.; Bric, E.; Kim, J.; Reid, L. H.; Davies, C.; Nakagama, H.; Loebbert, R.; Winterpacht, A.; Petruzzi, M.-J.; Higgins, M. J.; Nowak, N.; Evans, G.; Shows, T.; Weissman, B. E.; Zabel, B.; Housman, D. E.; Pelletier, J.: Functional characterization of human nucleosome assembly protein-2 (NAP1L4) suggests a role as a histone chaperone. Genomics 44:253-265, 1997.

Stegmaier, K.; Pendse, S.; Barker, G. F.; Bray-Ward, P.; Ward, D. C.; Montgomery, K. T.; Krauter, K. S.; Reynolds, C.; Sklar, J.; Donnelly, M.; Bohlander, S. K.; Rowley, J. D.; Sallan, S. E.; Gilliland, D. G.; Golub, T. R.: Frequent loss of heterozygosity at the TEL genelocus in acute lymphoblastic leukemia of childhood. Blood 86:38-44,1995.

Arakawa, H.; Nagase, H.; Hayashi, N.; Fujiwara, T.; Ogawa, M.; Shin, S.; Nakamura, Y.: Molecular cloning and expression of a novel human gene that is highly homologous to human FK506-binding protein12 kDa (hFKBP-12) and characterization of two alternatively spliced transcripts. Biochem. Biophys. Res. Commun. 200:836-843, 1994.

Xin, H.-B.; Senbonmatsu, T.; Cheng, D.-S.; Wang, Y.-X. Copello, J. A.; Ji, G.-J.; Collier, M. L.; Deng, K.-Y.; Jeyakumar, L. H.; Magnuson, M. A.; Inagami, T.; Kotlikoff, M. I.; Fleischer, S.: Oestrogen protects FKBP12.6 null mice from cardiac hypertrophy. Nature 416:334-337,2002.

Dong, J.-T.; Isaacs, W. B.; Barrett, J. C.; Isaacs, J. T.: Genomic organization of the human KAI1 metastasis-suppressor gene. Genomics 41:25-32, 1997.

Dong, J.-T.; Lamb, P. W.; Rinker-Schaeffer, C. W.; Vukanovic, J.; Ichikawa, T.; Isaacs, J. T.; Barrett, J. C.: KAI1, a metastasis suppressor gene for prostate cancer on human chromosome 11p11.2. Science 268:884-886, 1995.

Guo, X.-Z.; Friess, H.; Di Mola, F. F.; Heinicke, J.-M.; Abou-Shady, M.; Graber, H. U.; Baer, H. U.; Zimmermann, A.; Korc, M.; Buchler, M. W.: KAI1, a new metastasis suppressor gene, is reduced in metastatic hepatocellular carcinoma. Hepatology 28:1481-1488, 1998.

Mashimo, T.; Watabe, M.; Hirota, S.; Hosobe, S.; Miura, K.; Tegtmeyer, P. J.; Rinker-Shaeffer, C. W.; Watabe, K.: The expression of the KAI1 gene, a tumor metastasis suppressor, is directly activated byp53. Proc. Nat. Acad. Sci. 95:11307-11311, 1998.

Miyazaki, T.; Kato, H.; Shitara, Y.; Yoshikawa, M.; Tajima, K.; Masuda, N.; Shouji, H.; Tsukada, K.; Nakajima, T.; Kuwano, H.: Mutation and expression of the metastasis suppressor gene KAI1 in esophageal squamous cell carcinoma. Cancer 89:955-962, 2000.

Gupta, P.; Soyombo, A. A.; Atashband, A.; Wisniewski, K. E.; Shelton, J. M.; Richardson, J. A.; Hammer, R. E.; Hofmann, S. L.: Disruption of PPT1 or PPT2 causes neuronal ceroid lipofuscinosis in knockout mice. Proc. Nat. Acad. Sci. 98:13566-13571, 2001.

Neufeld, E. F.: Personal Communication. Los Angeles, Calif. Jul. 24, 1987.

Blair, H. J.; Ho, M.; Monaco, A. P.; Fisher, S.; Craig, I. W.; Boyd, Y.: High-resolution comparative mapping of the proximal region of the mouse X chromosome. Genomics 28:305-310, 1995.

Cox, J. P. D.; Yamamoto, K.; Christie, P. T.; Wooding, C.; Feest, T.; Flinter, F. A.; Goodyer, P. R.; Leumann, E.; Neuhaus, T.; Reid, C.; Williams, P. F.; Wrong, O.; Thakker, R. V.: Renal chloride channel, CLCN5, mutations in Dent's disease. J. Bone Min. Res. 14:1536-1542,1999.

Craig, I.: Personal Communication. Oxford, England Jan. 31, 1995.

Devuyst, O.; Christie, P. T.; Courtoy, P. J.; Beauwens, R.; Thakker, R. V.: Intra-renal and subcellular distribution of the human chloride channel, CLC-5, reveals a pathophysiological basis for Dent's disease. Hum. Molec. Genet. 8:247-257, 1999.

Dutzler, R.; Campbell, E. B.; Cadene, M.; Chait, B. T.; MacKinnon, R.: X-ray structure of a ClC chloride channel at 3.0 angstrom reveals the molecular basis of anion selectivity. Nature 415:287-294, 2002.

Fisher, S. E.; Black, G. C. M.; Lloyd, S. E.; Hatchwell, E.; Wrong, O.; Thakker, R. V.; Craig, I. W.: Isolation and partial characterization of a chloride channel gene which is expressed in kidney and is a candidate for Dent's disease (an X-linked hereditary nephrolithiasis). Hum. Molec. Genet. 3:2053-2059, 1994.

Fisher, S. E.; Van Bakel, I.; Lloyd, S. E.; Pearce, S. H. S.; Thakker, R. V.; Craig, I. W.: Cloning and characterization of CLCN5, the human kidney chloride channel gene implicated in Dent disease (an X-linked hereditary nephrolithiasis). Genomics 29:598-606, 1995.

Gunther, W.; Luchow, A.; Cluzeaud, F.; Vandewalle, A.; Jentsch, T. J.: ClC-5, the chloride channel mutated in Dent's disease, colocalizes with the proton pump in endocytotically active kidney cells. Proc. Nat. Acad. Sci. 95:8075-8080, 1998.

Igarashi, T.; Hayakawa, H.; Shiraga, H.; Kawato, H.; Yan, K.; Kawaguchi, H.; Yamanake, T.; Tsuchida, S.; Akagi, K.: Hypercalciuria and nephrocalcinosis in patients with idiopathic low molecular weight proteinuria in Japan: is the disease identical to Dent's disease in the United Kingdom? Nephron. 69:242-247, 1995.

Lloyd, S. E.; Gunther, W.; Pearce, S. H. S.; Thomson, A.; Bianchi, M. L.; Bosio, M.; Craig, I. W.; Fisher, S. E.; Scheinman, S. J.; Wrong, O.; Jentsch, T. J.; Thakker, R. V.: Characterisation of renal chloride channel, CLCN5, mutations in hypercalciuric nephrolithiasis (kidney stones) disorders. Hum. Molec. Genet. 6:1233-1239, 1997.

Lloyd, S. E.; Pearce, S. H. S.; Fisher, S. E.; Steinmeyer, K.; Schwappach, B.; Schelnman, S. J.; Harding, B.; Bolino, A.; Devoto, M.; Goodyer, P.; Rigden, S. P. A.; Wrong, O.; Jentsch, T. J.; Craig, I. W.; Thakker, R. V.: A common molecular basis for three inherited kidney stone diseases. Nature 370:445-449, 1996.

Lloyd, S. E.; Pearce, S. H. S.; Gunther, W.; Kawaguchi, H.; Igarashi, T.; Jentsch, T. J.; Thakker, R. V.: Idiopathic low molecular weight proteinuria associated with hypercalciuric nephrocalcinosis in Japanese children is due to mutations of the renal chloride channel (CLCN5). J. Clin. Invest. 99:967-974, 1997.

Oudet, C.; Martin-Coignard, D.; Pannetier, S.; Praud, E.; Champion, G.; Hanauer, A.: A second family with XLRH displays the mutation S244L in the CLCN5 gene. Hum. Genet. 99:781-784, 1997.

Piwon, N.; Gunther, W.; Schwake, M.; Bosl, M. R.; Jentsch, T. J.: ClC-5 Cl (-)-channel disruption impairs endocytosis in a mouse model for Dent's disease. Nature 408:369-373, 2000.

Schurman, S. J.; Norden, A. G. W.; Scheinman, S. J.: X-linked recessive nephrolithiasis: presentation and diagnosis in children. J. Pediat. 132:859-862, 1998.

Mitnick, M.; Reichlin, S.: Enzymatic synthesis of thyrotropin-releasing hormone (TRH) by hypothalamic 'TRH synthetase.'. Endocrinology 91:1145-1153, 1972.

Lu, Q. R.; Sun, T.; Zhu, Z.; Ma, N.; Garcia, M.; Stiles, C. D.; Rowitch, D. H.: Common developmental requirement for Olig function indicates a motor neuron/oligodendrocyte connection. Cell 109:75-86,2002.

Lu, Q. R.; Yuk, D.; Alberta, J. A.; Zhu, Z.; Pawlitzky, I.; Chan, J.; McMahon, A. P.; Stiles, C. D.; Rowitch, D. H.: Sonic hedgehog-regulated oligodendrocyte lineage genes encoding bHLH proteins in the mammalian central nervous system. Neuron 25:317-329, 2000.

Raff, M. C.; Miller, R. H.; Noble, M.: A glial progenitor cell that develops in vitro into an astrocyte or an oligodendrocyte depending on culture medium. Nature 303:390-396, 1983.

Zhou, Q.; Anderson, D. J.: The bHLH transcription factors OLIG2 and OLIG1 couple neuronal and glial subtype specification. Cell 109:61-73, 2002.

Zhou, Q.; Wang, S.; Anderson, D. J.: Identification of a novel family of oligodendrocyte lineage-specific basic helix-loop-helix transcription factors. Neuron 25:331-343, 2000.

Guimaraes, M. J.; Peterson, D.; Vicari, A.; Cocks, B. G.; Copeland, N. G.; Gilbert, D. J.; Jenkins, N. A.; Ferrick, D. A.; Kastelein, R. A.; Bazan, J. F.; Zlotnik, A.: Identification of a novel selD homolog from eukaryotes, bacteria, and archaea: is there an autoregulatory mechanism in selenocysteine metabolism? Proc. Nat. Acad. Sci. 93:15086-15091, 1996.

Koesters, R.; Adams, V.; Betts, D.; Moos, R.; Schmid, M.; Siermann, A.; Hassam, S.; Weitz, S.; Lichter, P.; Heitz, P. U.; von Knebel Doeberitz, M.; Briner, J.: Human eukaryotic initiation factor EIF2C1 gene: cDNA sequence, genomic organization, localization to chromosomal bands 1q34-p35, and expression. Genomics 61:210-218, 1999.

Martinez, J.; Patkaniowska, A.; Urlaub, H.; Luhrmann, R.; Tuschi, T.: Single-stranded antisense siRNAs guide target RNA cleavage in RNAi. Cell 110:563-574, 2002.

Suetsugu, S.; Miki, H.; Takenawa, T.: Identification of two human WAVE/SCAR homologues as general actin regulatory molecules which associate with the Arp2/3 complex. Biochem. Biophys. Res. Commun. 260:296-302,1999.

Hanaoka, E.; Ozaki, T.; Ohira, M.; Nakamura, Y.; Suzuki, M.; Takahashi, E.; Moriya, H.; Nakagawara, A.; Sakiyama, S.: Molecular cloning and expression analysis of the human DA41 gene and its mapping to chromosome 9q21.2-q21.3. J. Hum. Genet. 45:188-191, 2000.

Ozaki, T.; Hishiki, T.; Toyama, Y.; Yuasa, S.; Nakagawara, A.; Sakiyama, S.: Identification of a new cellular protein that can interact specifically with DAN. DNA Cell Biol. 16:985-991, 1997.

Venkateswarlu, K.; Gunn-Moore, F.; Oatey, P. B.; Tavare, J. M.; Cullen, P. J.: Nerve growth factor- and epidermal growth factor-stimulated translocation of the ADP-ribosylation factor-exchange factor GRP1to the plasma membrane of PC12 cells requires activation of phosphatidyl inositol3-kinase and the GRP1 pleckstrin homology domain. Biochem. J. 335:139-146, 1998.

Dammann, R.; Li, C.; Yoon, J.-H.; Chin, P. L.; Bates, S.; Pfeifer, G. P.: Epigenetic inactivation of a RAS association domain family protein from the lung tumour suppressor locus 3p21.3. Nature Genet. 25:315-319, 2000.

Dreijerink, K.; Braga, E.; Kuzmin, I.; Geil, L.; Duh, F.-M.; Angeloni, D.; Zbar, B.; Lerman, M. I.; Stanbridge, E. J.; Minna, J. D.; Protopopov, A.; Li, J.; Kashuba, V.; Klein, G.; Zabarovsky, E. R.: The candidate tumor suppressor gene, RASSF1A, from human chromosome 3p21.3 is involved in kidney tumorigenesis. Proc. Nat. Acad. Sci. 98:7504-7509, 2001.

Harada, K.; Toyooka, S.; Maitra, A.; Maruyama, R.; Toyooka, K. O.; Timmons, C. F.; Tomlinson, G. E.; Mastrangelo, D.; Hay, R. J.; Minna, J. D.; Gazdar, A. F.: Aberrant promoter methylation and silencing of the RASSF1A gene in pediatric tumors and cell lines. Oncogene 21:4345-4349, 2002.

Sekido, Y.; Ahmadian, M.; Wistuba, I. I.; Latif, F.; Bader, S.; Wei, M.-H.; Duh, F.-M.; Gazdar, A. F.; Lerman, M. I.; Minna, J. D.: Cloning of a breast cancer homozygous deletion junction narrows the region of search for a 3p21.3 tumor suppressor gene. Oncogene 16:3151-3157, 1998.

Dann, C. E.; Hsieh, J.-C.; Rattner, A.; Sharma, D.; Nathans, J.; Leahy, D. J.: Insights into Wnt binding and signalling from the structures of two Frizzled cysteine-rich domains. Nature 412:86-90, 2001.

Hoang, B.; Moos, M., Jr.; Vukicevic, S.; Luyten, F. P.: Primary structure and tissue distribution of FRZB, a novel protein related to Drosophila frizzled, suggest a role in skeletal morphogenesis. J. Biol. Chem. 271:26131-26137, 1996.

Leyns, L.; Bouwmeester, T.; Kim, S.-H.; Piccolo, S.; De Robertis, E. M.: Frzb-1 is a secreted antagonist of Wnt signaling expressed in the Spemann organizer. Cell 88:747-756, 1997.

Schuman N, H.; Holtz, J.; Zerkowski, H.-R.; Hatzfeld, M.: Expression of secreted frizzled related proteins 3 and 4 in human ventricular myocardium correlates with apoptosis related gene expression. Cardiovasc. Res. 45:720-728, 2000.

Benghezal, M.; Benachour, A.; Rusconi, S.; Aebi, M.; Conzelmann, A.: Yeast Gpi8p is essential for GPI anchor attachment onto proteins. EMBO J. 15:6575-6583, 1996.

Yu, J.; Nagarajan, S.; Knez, J. J.; Udenfriend, S.; Chen, R.; Medof, M. E.: The affected gene underlying the class K glycosylphosphatidyl inositol (GPI) surface protein defect codes for the GPI transamidase. Proc. Nat. Acad. Sci. 94:12580-12585, 1997.

Yu, Y.; Xu, F.; Peng, H.; Fang, X.; Zhao, S.; Li, Y.; Cuevas, B.; Kuo, W.-L.; Gray, J. W.; Siciliano, M.; Mills, G. B.; Bast, R. C., Jr.: NOEY2 (ARHI), an imprinted putative tumor suppressor gene in ovarian and breast carcinomas. Proc. Nat. Acad. Sci. 96:214-219,1999.

Walowsky, C.; Fitzhugh, D. J.; Castano, I. B.; Ju, J. Y.; Levin, N. A.; Christman, M. F.: The topoisomerase-related function gene TRF4 affects cellular sensitivity to the antitumor agent camptothecin. J. Biol. Chem. 274:7302-7308, 1999.

Wang, Z.; Castano, I. B.; De Las Penas, A.; Adams, C.; Christman, M. F.: Pol kappa: a DNA polymerase required for sister chromatid cohesion. Science 289:774-779, 2000.

Clark, J.; Lu, Y.-J.; Sidhar, S. K.; Parker, C.; Gill, S.; Smedley, D.; Hamoudi, R.; Linehan, W. M.; Shipley, J.; Cooper, C. S.: Fusion of splicing factor genes PSF and NonO (p54-nrb) to the TFE3 gene in papillary renal cell carcinoma. Oncogene 15:2233-2239, 1997.

Patton, J. G.; Porro, E. B.; Galceran, J.; Tempst, P.; Nadal-Ginard, B.: Cloning and characterization of PSF, a novel pre-mRNA splicing factor. Genes Dev. 7:393-406, 1993.

Piquemal, D.; Joulia, D.; Balaguer, P.; Basset, A.; Marti, J.; Commes, T.: Differential expression of the RTP/Drg1/Ndr1 gene product in proliferating and growth arrested cells. Biochim. Biophys. Acta 1450:364-373, 1999.

LeClerc, S.; Palaniswami, R.; Xie, B.; Govdan, M. V.: molecular cloning and characterization of a factor that binds the human glucocorticoid receptor gene and represses its expression. J. Biol. Chem. 266:17333-17340, 1991.

Tikoo, A.; Czekay, S.; Viars, C.; White, S.; Heath, J. K.; Arden, K.; Maruta, H.: p190-A, a human tumor suppressor gene, maps to the chromosomal region 19q13.3 that is reportedly deleted in some gliomas. Gene 257:23-31, 2000.

Choi, D.-K.; Suzuki, Y.; Yoshimura, S.; Togashi, T.; Hida, M.; Taylor, T. D.; Wang, Y.; Sugano, S.; Hattori, M.; Sakaki, Y.: molecular cloning and characterization of a gene expressed in mouse developing tongue, mDscr5 gene, a homolog of human DSCR5 (Down syndrome critical region gene 5). Mammalian Genome 12:347-351, 2001.

Wang, A. H.; Bertos, N. R.; Vezmar, M.; Pelletier, N.; Crosato, M.; Heng, H. H.; Th'ng, J.; Han, J.; Yang, X.-J.: HDAC4, a human histone deacetylase related to yeast HDA1, is a transcriptional corepressor. Molec. Cell. Biol. 19:7816-7827, 1999.

Nishimura, Y.; Hayashi, M.; Inada, H.; Tanaka, T.: Molecular cloning and characterization of mammalian homologues of vesicle-associated membrane protein-associated (VAMP-associated) proteins. Biochem. Biophys. Res. Commun. 254: 21-26, 1999.

Weir, M. L.; Klip, A.; Trimble, W. S.: Identification of a human homologue of the vesicle-associated membrane protein (VAMP)-associated protein of 33 kDa (VAP-33): a broadly expressed protein that binds to VAMP. Biochem. J. 333:247-251, 1998.

Perez Jurado, L. A.; Wang, Y.-K.; Francke, U.; Cruces, J.: TBL2, a novel transducin family member in the WBS deletion: characterization of the complete sequence, genomic structure, transcriptional variants and the mouse ortholog. Cytogenet. Cell Genet. 86:277-284, 1999.

Akhmanova, A.; Hoogenraad, C. C.; Drabek, K.; Stepanova, T.; Dortland, B.; Verkerk, T.; Vermeulen, W.; Burgering, B. M.; De Zeeuw, C. I.; Grosveld, F.; Galjart, N.: CLASPs are CLIP-115 and -170 associating proteins involved in the regional regulation of microtubule dynamics in motile fibroblasts. Cell 104:923-935, 2001.

Cattanach, B. M.; Barr, J. A.; Beechey, C. V.; Martin, J.; Noebels, J.; Jones, J.: A candidate model for Angelman syndrome in the mouse. Mammalian Genome 8:472-478, 1997.

Dhar, M.; Webb, L. S.; Smith, L.; Hauser, L.; Johnson, D.; West, D. B.: A novel ATPase on mouse chromosome 7 is a candidate gene for increased body fat. Physiol. Genomics 4:93-100, 2000.

Halleck, M. S.; Lawler, J. F., Jr.; Blackshaw, S.; Gao, L.; Nagarajan, P.; Hacker, C.; Pyle, S.; Newman, J. T.; Nakanishi, Y.; Ando, H.; Weinstock, D.; Williamson, P.; Schlegel, R. A.: Differential expression of putative transbilayer amphipath transporters. Physiol. Genomics 1:139-150, 1999.

Shibuya, K.; Kudoh, J.; Minoshima, S.; Kawasaki, K.; Asakawa, S.; Shimizu, N.: Isolation of two novel genes, DSCR5 and DSCR6, from Down syndrome critical region on human chromosome 21q22.2. Biochem. Biophys. Res. Commun. 271:693-698, 2000.

Togashi, T.; Choi, D.-K.; Taylor, T. D.; Suzuki, Y.; Sugano, S.; Hattori, M.; Sakaki, Y.: A novel gene, DSCR5, from the distal Down syndrome critical region on chromosome 21q22.2. DNA Res. 7:207-212,2000.

Loftus, B. J.; Kim, U.-J.; Sneddon, V. P.; Kalush, F.; Brandon, R.; Fuhrmann, J.; Mason, T.; Crosby, M. L.; Barnstead, M.; Cronin, L.; Mays, A. D.; Cao, Y.; Xu, R. X.; Kang, H.-L.; Mitchell, S.; Eichler, E. E.; Harris, P. C.; Venter, J. C.; Adams, M. D.: Genome duplications and other features in 12 Mb of DNA sequence from human chromosome 16p and 16q. Genomics 60:295-308, 1999.

Brauner-Osborne, H.; Krogsgaard-Larsen, P.: Sequence and expression pattern of a novel human orphan G-protein-coupled receptor, GPRC5B, a family C receptor with a short amino-terminal domain. Genomics 65:121-128, 2000.

Robbins, M. J.; Michalovich, D.; Hill, J.; Calver, A. R.; Medhurst, A. D.; Gloger, I.; Sims, M.; Middlemiss, D. N.; Pangalos, M. N.:Molecular cloning and characterization of two novel retinoic acid-inducible orphan G-protein-coupled receptors (GPRC5B and GPRC5C). Genomics 67:8-18, 2000.

Autieri, M. V.; Feuerstein, G. Z.; Yue, T.-L.; Ohlstein, E. H.; Douglas, S. A.: Use of differential display to identify differentially expressed mRNAs induced by rat carotid artery balloon angioplasty. Lab. Invest. 72:656-661, 1995.

Autieri, M. V.; Haines, D. S.; Romanic, A. M.; Ohlstein, E. H.: Expression of 14-3-3-gamma in injured arteries and growth factor- and cytokine-stimulated human vascular smooth muscle cells. Cell Growth Diff. 7:1453-1460, 1996.

Horie, M.; Suzuki, M.; Takahashi, E.; Tanigami, A.: Cloning, expression, and chromosomal mapping of the human 14-3-3 gamma gene (YWHAG) to 7q11.23. Genomics 60:241-243, 1999.

Morrison, D.:14-3-3: modulators of signaling proteins? Science 266:56-57, 1994.

Asada, H.; Kawamura, Y.; Maruyama, K.; Kume, H.; Ding, R.-G.; Kanbara, N.; Kuzume, H.; Sanbo, M.; Yagi, T.; Obata, K.: Cleft palate and decreased brain gamma-aminobutyric acid in mice lacking the 67-kDa isoform of glutamic acid decarboxylase. Proc. Nat. Acad. Sci. 94:6496-6499, 1997.

Brilliant, M. H.; Szabo, G.; Katarova, Z.; Kozak, C. A.; Glaser, T. M.; Greenspan, R. J.; Housman, D. E.: Sequences homologous to glutamic acid decarboxylase cDNA are present on mouse chromosomes 2 and 10. Genomics 6:115-122, 1990.

Bu, D.-F.; Tobin, A. J.: The exon-intron organization of the genes (GAD1 and GAD2) encoding two human glutamate decarboxylases (GAD-67and GAD-65) suggests that they derive from a common ancestral GAD. Genomics 21:222-228, 1994.

Condie, B. G.; Bain, G.; Gottlieb, D. I.; Capecchi, M. R.: Cleft palate in mice with a targeted mutation in the gamma-aminobutyric acid-producing enzyme glutamic acid decarboxylase 67. Proc. Nat. Acad. Sci. 94:11451-11455, 1997.

Erlander, M. G.; Tillakaratne, N. J. K.; Feldblum, S.; Patel, N.; Tobin, A. J.: Two genes encode distinct glutamate decarboxylases. Neuron 7:91-100, 1991.

Kelly, C. D.; Edwards, Y.; Johnstone, A. P.; Harfst, E.; Nogradi, A.; Nussey, S. S.; Povey, S.; Carter, N. D.: Nucleotide sequence and chromosomal assignment of a cDNA encoding the large isoform of human glutamate decarboxylase. Ann. Hum. Genet. 56:255-265, 1992.

Krishnamoorthy, K. S.: Pyridoxine-dependency seizure: report of a rare presentation. Ann. Neurol. 13:103-104, 1983.

Sparkes, R. S.; Kaufman, D. L.; Heinzmann, C.; Tobin, A. J.; Mohandas, T.: Brain glutamate decarboxylase (GAD) gene assigned to human chromosome 2 by somatic cell hybrid analysis. (Abstract) Cytogenet. Cell Genet. 46:696 only, 1987.

Hirsch, D. S.; Pirone, D. M.; Burbelo, P. D.: A new family of Cdc42 effector proteins, CEPs, function in fibroblast and epithelial cell shape changes. J. Biol. Chem. 276:875-883, 2001.

Joberty, G.; Perlungher, R. R.; Macara, I. G.: The Borgs, a new family of Cdc42 and TC10 GTPase-interacting proteins. Molec. Cell. Biol. 19:6585-6597, 1999.

Yang, Z.-Q.; Imoto, I.; Fukuda, Y.; Pimkhaokham, A.; Shimada, Y.; Imamura, M.; Sugano, S.; Nakamura, Y.; Inazawa, J.: Identification of a novel gene, GASC1, within an amplicon at 9p23-24 frequently detected in esophageal cancer cell lines. Cancer Res. 60:4735-4739, 2000.

LeCouter, J.; Kowalski, J.; Foster, J.; Hass, P.; Zhang, Z.; Dillard-Telm, L.; Frantz, G.; Rangell, L.; DeGuzman, L.; Keller, G.-A.; Peale, F.; Gurney, P.; Hillan, K. J.; Ferrara, N.: Identification of an angiogenic mitogen selective for endocrine gland endothelium. Nature 412:877-884,2001.

Li, M.; Bullock, C. M.; Knauer, D. J.; Ehlert, F. J.; Zhou, Q. Y.: Identification of two prokinetic in cDNAs: recombinant proteins potently contract gastrointestinal smooth muscle. Molec. Pharm. 59:692-698, 2001.

Nagase, T.; Nakayama, M.; Nakajima, D.; Kikuno, R.; Ohara, O.:Prediction of the coding sequences of unidentified human genes. XX. The complete sequences of 100 new cDNA clones from brain which code for large proteins in vitro. DNA Res. 8:85-95, 2001.

Jaquemar, D.; Schenker, T.; Trueb, B.: An ankyrin-like protein with transmembrane domains is specifically lost after oncogenic transformation of human fibroblasts. J. Biol. Chem. 274:7325-7333, 1999.

Schenker, T.; Trueb, B.: Down-regulated proteins of mesenchymal tumor cells. Exp. Cell Res. 239:161-168, 1998.

Cerretti, D. P.; DuBose, R. F.; Black, R. A.; Nelson, N.: Isolation of two novel metalloproteinase-disintegrin (ADAM) cDNAs that show testis-specific gene expression. Biochem. Biophys. Res. Commun. 263:810-815, 1999.

Xu, R.; Cai, J.; Xu, T.; Zhou, W.; Ying, B.; Deng, K.; Zhao, S.; Li, C.: Molecular cloning and mapping of a novel ADAM gene (ADAM29) to human chromosome 4. Genomics 62:537-539, 1999.

Jacobs, S.; Schilf, C.; Fliegert, F.; Koling, S.; Weber, Y.; Schurmann, A.; Joost, H.-G.: ADP-ribosylation factor (ARF)-like 4, 6, and 7 represent a subgroup of the ARF family characterized by rapid nucleotide exchange and a nuclear localization signal. FEBS Lett. 456:384-388,1999.

Lako, M.; Lindsay, S.; Bullen, P.; Wilson, D. I.; Robson, S. C.; Strachan, T.: A novel mammalian Wnt gene, WNT8B, shows brain-restricted expression in early development, with sharply delimited expression boundaries in the developing forebrain. Hum. Molec. Genet. 7:813-822,1998.

Lako, M.; Strachan, T.; Curtis, A. R. J.; Lindsay, S.: Isolation and characterization of WNT8B, a novel human Wnt gene that maps to 10q24. Genomics 35:386-388, 1996.

Toda, T.; Iida, A.; Miwa, T.; Nakamura, Y.; Imai, T.: Isolation and characterization of a novel gene encoding nuclear protein at a locus (D11S636) tightly linked to multiple endocrine neoplasia type1 (MEN1). Hum. Molec. Genet. 3:465-470, 1994.

Scholler, J. K.; Kanner, S. B.: The human p167 gene encodes a unique structural protein that contains centrosomin A homology and associates with a multicomponent complex. DNA Cell Biol. 16:515-531,1997.

Abdulkadir, S. A.; Magee, J. A.; Peters, T. J.; Kaleem, Z.; Naughton, C. K.; Humphrey, P. A.; Milbrandt, J.: Conditional loss of Nkx3.1 in adult mice induces prostatic intraepithelial neoplasia. Molec. Cell. Biol. 22:1495-1503, 2002.

Bieberich, C. J.; Fujita, K.; He, W. W.; Jay, G.: Prostate-specific and androgen-dependent expression of a novel homeobox gene. J. Biol. Chem. 271:31779-31782, 1996.

Korkmaz, K. S.; Korkmaz, C. G; Ragnhildstveit, E.; Kizildag, S.; Pretlow, T. G.; Saatcioglu, F.: Full-length cDNA sequence and genomic organization of human NKX3A--alternative forms and regulation by both androgens and estrogens. Gene 260:25-36, 2000.

He, W. W.; Sciavolino, P. J.; Wing, J.; Augustus, M.; Hudson, P.; Meissner, P. S.; Curtis, R. T.; Shell, B. K.; Bostwick, D. G.; Tindall, D. J.; Gelmann, E. P.; Abate-Shen, C.; Carter, K. C.: A novel human prostate-specific, androgen-regulated homeobox gene (NKX3.1) that maps to 8p21, a region frequently deleted in prostate cancer. Genomics 43:69-77, 1997.

Argyropoulos, G.; Brown, A. M.; Willi, S. M.; Zhu, J.; He, Y.; Reitman, M.; Gevao, S. M.; Spruill, I.; Garvey, W. T.: Effects of mutations in the human uncoupling protein 3 gene on the respiratory quotient and fat oxidation in severe obesity and type 2 diabetes. J. Clin. Invest. 102:1345-1351, 1998.

Boss, O.; Giacobino, J.-P.; Muzzin, P.: Genomic structure of uncoupling protein-3 (UCP3) and its assignment to chromosome 11q13. Genomics 47:425-426, 1998.

Boss, O.; Samec, S.; Paoloni-Giacobino, A.; Rossier, C.; Dulloo, A.; Seydoux, J.; Muzzin, P.; Giacobino, J.-P.: Uncoupling protein-3:a new member of the mitochondrial carrier family with tissue-specific expression. FEBS Lett. 408:39-42, 1997.

Brown, A. M.; Dolan, J. W.; Willi, S. M.; Garvey, W. T.; Argyropoulos, G.: Endogenous mutations in human uncoupling protein 3 alter its functional properties. FEBS Lett. 464:189-193, 1999.

Bilaud, T.; Brun, C.; Ancelin, K.; Koering, C. E.; Laroche, T.; Gilson, E.: Telomeric localization of TRF2, a novel human telobox protein. Nature Genet. 17:236-239, 1997.

Broccoli, D.; Smogorzewska, A.; Chong, L.; de Lange, T.: human telomeres contain two distinct Myb-related proteins, TRF1 and TRF2. Nature Genet. 17:231-235, 1997.

Karlseder, J.; Smogorzewska, A.; de Lange, T.: Senescence induced by altered telomere state, not telomere loss. Science 295:2446-2449,2002.

Sakaguchi, A. Y.; Padalecki, S. S.; Mattern, V.; Rodriguez, A.; Leach, R. J.; McGill, J. R.; Chavez, M.; Giambernardi, T. A.: Chromosomal sublocalization of the transcribed human telomere repeat binding factor 2 gene and comparative mapping in the mouse. Somat. Cell Molec. Genet. 24:157-163, 1998.

van Steensel, B.; Smogorzewska, A.; de Lange, T.: TRF2 protects human telomeres from end-to-end fusions. Cell 92:401-413, 1998.

Barron-Casella, E. A.; Torres, M. A.; Scherer, S. W.; Heng, H. H. Q.; Tsui, L.-C.; Casella, J. F.: Sequence analysis and chromosomal localization of human Cap Z: conserved residues within the actin-binding domain may link Cap Z to gelsolin/severin and profilin protein families. J. Biol. Chem. 270:21472-21479, 1995.

Hart, M. C.; Korshunova, Y. O.; Cooper, J. A.: Mapping of the mouse actin capping protein alpha subunit genes and pseudogenes. Genomics 39:264-270, 1997.

Cooper, J. A.: Personal Communication. St. Louis, Mo. Mar. 8, 1999.

Cardoso, C.; Mignon, C.; Hetet, G.; Grandchamps, B.; Fontes, M.; Colleaux, L.: The human EZH2 gene: genomic organisation and revised mapping in 7q35 within the critical region for malignant myeloid disorders. Europ. J. Hum. Genet. 8:174-180, 2000.

Chen, H.; Rossier, C.; Antonarakis, S. E.: Cloning of a human homolog of the Drosophila enhancer of zeste gene (EZH2) that maps to chromosome 21q22.2. Genomics 38:30-37, 1996.

Dohner, K.; Brown, J.; Hehmann, U.; Hetzel, C.; Stewart, J.; Lowther, G.; Scholl, C.; Frohling, S.; Cuneo, A.; Tsui, L. C.; Lichter, P.; Scherer, S. W.; Dohner, H.: Molecular cytogenetic characterization of a critical region in bands 7q35-q36 commonly deleted in malignant myeloid disorders. Blood 92:4031-4035, 1998.

Laible, G.; Haynes, A. R.; Lebersorger, A.; O'Carroll, D.; Mattei, M.-G.; Denny, P.; Brown, S. D. M.; Jenuwein, T.: The murine polycomb-group genes Ezh1 and Ezh2 map close to Hox gene clusters on mouse chromosomes 11 and 6. Mammalian Genome 10:311-314, 1999.

Varambally, S.; Dhanasekaran, S. M.; Zhou, M.; Barrette, T. R.; Kumar-Sinha, C.; Sanda, M. G.; Ghosh, D.; Pienta, K. J.; Sewalt, R. G. A. B.; Otte, A. P.; Rubin, M. A.; Chinnaiyan, A. M.: The polycomb group protein EZH2 is involved in progression of prostate cancer. Nature 419:624-629, 2002.

Batt, J.; Asa, S.; Fladd, C.; Rotin, D.: Pituitary, pancreatic and gut neuroendocrine defects in protein tyrosine phosphatase-sigma-deficient mice. Molec. Endocr. 16:155-169, 2002.

Elchebly, M.; Wagner, J.; Kennedy, T. E.; Lanctot, C.; Michaliszyn, E.; Itie, A.; Drouin, J.; Tremblay, M. L.: Neuroendocrine dysplasia in mice lacking protein tyrosine phosphatase sigma. Nature Genet. 21:330-333, 1999.

Pulido, R.; Serra-Pages, C.; Tang, M.; Streuli, M.: The LAR/PTP delta/PTP sigma subfamily of transmembrane protein-tyrosine-phosphatases:multiple human LAR, PTP delta, and PTP sigma isoforms are expressed in a tissue-specific manner and associate with the LAR-interacting protein LIP.1. Proc. Nat. Acad. Sci. 92:11686-11690, 1995.

Wagner, J.; Gordon, L. A.; Heng, H. H. Q.; Tremblay, M. L.; Olsen, A. S.: Physical mapping of receptor type protein tyrosine phosphatase sigma (PTPRS) to human chromosome 19p13.3. Genomics 38:76-78, 1996.

Wallace, M. J.; Batt, J.; Fladd, C. A.; Henderson, J. T.; Skarnes, W.; Rotin, D.: Neuronal defects and posterior pituitary hypoplasia in mice lacking the receptor tyrosine phosphatase PTP-sigma. Nature Genet. 21:334-338, 1999.

Spicer, A. P.; Augustine, M. L.; McDonald, J. A.: Molecular cloning and characterization of a putative mouse hyaluronan synthase. J. Biol. Chem. 271:23400-23406, 1996.

Skalhegg, B. S.; Huang, Y.; Su, T.; Idzerda, R. L.; McKnight, G. S.; Burton, K. A.: Mutation of the C-alpha subunit of PKA leads to growth retardation and sperm dysfunction. Molec. Endocr. 16:630-639,2002.

Tasken, K.; Solberg, R.; Zhao, Y.; Hansson, V.; Jahnsen, T.; Siciliano, M. J.: The gene encoding the catalytic subunit C-alpha of cAMP-dependent protein kinase (locus PRKACA) localizes to human chromosome region 19p13.1. Genomics 36:535-538, 1996.

Kim, J.; Uyemura, K.; Van Dyke, M. K.; Legaspi, A. J.; Rea, T. H.; Shuai, K.; Modlin, R. L.: A role for IL-12 receptor expression and signal transduction in host defense in leprosy. J. Immun. 167:779-786, 2001.

Morton, S. M.; Bocaccio, I.; Depetris, D.; Mattei, M.; Dessein, A.: Assignment of IL12RB2 to human chromosome 1p31.3-p31.2 between D1S230 and D1S198. Cytogenet. Cell Genet. 79:282-283, 1997.

McCright, B.; Brothman, A. R.; Virshup, D. M.: Assignment of human protein phosphatase 2A regulatory subunit genes B56-alpha, B56-beta, B56-gamma, B56-delta, and B56-epsilon (PPP2R5A--PPP2R5E), highly expressed in muscle and brain, to chromosome regions 1q41, 11q12, 3p21, 6p21.1, and 7p11.2-to-p12. Genomics 36:168-170, 1996.

McCright, B.; Virshup, D. M.: Identification of a new family of protein phosphatase 2A regulatory subunits. J. Biol. Chem. 270:26123-26128, 1995.

Horikawa, S.; Tsukada, K.: Molecular cloning and developmental expression of a human kidney S-adenosylmethionine synthetase. FEBS Lett. 312:37-41, 1992.

Mao, Z.; Liu, S.; Cai, J.; Huang, Z.-Z.; Lu, S. C.: Cloning and functional characterization of the 5-prime-flanking region of human methionine adenosyltransferase 2A gene. Biochem. Biophys. Res. Commun. 248:479-484, 1998.

Clark, J. A.; Bonner, T. I.; Kim, A. S.; Usdin, T. B.: Multiple regions of ligand discrimination revealed by analysis of chimeric parathyroid hormone 2 (PTH2) and PTH/PTH-related peptide (PTHrP) receptors. Molec. Endocr. 12:193-206, 1998.

Usdin, T. B.; Gruber, C.; Bonner, T. I.: Identification and functional expression of a receptor selectively recognizing parathyroid hormone, the PTH2 receptor. J. Biol. Chem. 270: 15455-15458, 1995.

Usdin, T. B.; Modi, W.; Bonner, T. I.: Assignment of the human PTH2 receptor gene (PTHR2) to chromosome 2q33 by fluorescence in situ hybridization. Genomics 37:140-141, 1996.

Faure, S.; Meyer, L.; Costagliola, D.; Vaneensberghe, C.; Genin, E.; Autran, B.; French ALT and IMMUNOCO Study Groups; Delfraisay, J.-F.; SEROCO Study Group; McDermott, D. H.; Murphy, P. M.; Debre, P.; Theodorou, I.; Cambadiere, C.: Rapid progression to AIDS in HIV+individuals with a structural variant of the chemokine receptor CX(3) CR1. Science 287:2274-2277, 2000.

Imai, T.; Hieshima, K.; Haskell, C.; Baba, M.; Nagira, M.; Nishimura, M.; Kakizaki, M.; Takagi, S.; Nomiyama, H.; Schall, T. J.; Yoshie, O.: Identification and molecular characterization of fractalkine receptor CX3CR1, which mediates both leukocyte migration and adhesion. Cell 91:521-530, 1997.

Moatti, D.; Faure, S.; Fumeron, F.; Amara, M. E. W.; Seknadji, P.; McDermott, D. H.; Debre, P.; Aumont, M. C.; Murphy, P. M.; deProst, D.; Combadiere, C.: Polymorphism in the fractalkine receptor CX3CR1 as a genetic risk factor for coronary artery disease. Blood 97:1925-1928, 2001.

Raport, C. J.; Schweickart, V. L.; Eddy, R. L., Jr.; Shows, T. B.; Gray, P. W.: The orphan G-protein-coupled receptor-encoding gene V28 is closely related to genes for chemokine receptors and is expressed in lymphoid and neural tissues. Gene 163:295-299, 1995.

Tripp, R. A.; Jones, L. P.; Haynes, L. M.; Zheng, H.; Murphy, P. M.; Anderson, L. J.: CX3C chemokine mimicry by respiratory syncytial virus G glycoprotein. Nature Immun. 2:732-738, 2001.

Hanes, J.; von der Kammer, H.; Klaudiny, J.; Scheit, K. H.: Characterization by cDNA cloning of two new human protein kinases: evidence by sequence comparison of a new family of mammalian protein kinases. J. Molec. Biol. 244:665-672, 1994.

Talmadge, C. B.; Finkernagel, S.; Sumegi, J.; Sciorra, L.; Rabinow, L.: Chromosomal mapping of three human LAMMER protein-kinase-encoding genes. Hum. Genet. 103:523-524, 1998.

Alders, M.; Hodges, M.; Hadjantonakis, A.-K.; Postmus, J.; vanWijk, I.; Bliek, J.; de Meulemeester, M.; Westerveld, A.; Guillemot, F.; Oudejans, C.; Little, P.; Mannens, M.: The human Achaete-Scute homologue 2 (ASCL2, HASH2) maps to chromosome 11p15.5, close to IGF2 and is expressed in extravillus trophoblasts. Hum. Molec. Genet. 6:859-867, 1997.

Guillemot, F.; Nagy, A.; Auerbach, A.; Rossant, J.; Joyner, A. L.: Essential role of Mash-2 in extra embryonic development. Nature 371:333-336, 1994.

Banga, S. S.; Ozer, H. L.; Park, S.-K.; Lee, S.-T.: Assignment of PTK7 encoding a receptor protein tyrosine kinase-like molecule to human chromosome 6p21.1-p12.2 by fluorescence in situ hybridization. Cytogenet. Cell Genet. 76:43-44, 1997.

Lee, S.-T.; Strunk, K. M.; Spritz, R. A.: A survey of protein tyrosine kinase mRNAs expressed in normal human melanocytes. Oncogene 8:3403-3410, 1993.

Mossie, K.; Jallal, B.; Alves, F.; Sures, I.; Plowman, G. D.; Ullrich, A.: Colon carcinoma kinase-4 defines a new subclass of the receptor tyrosine kinase family. Oncogene 11:2179-2184, 1995.

Park, S.-K.; Lee, H.-S.; Lee, S.-T.: Characterization of the human full-length PTK7 cDNA encoding a receptor protein tyrosine kinase-like molecule closely related to chick KLG. J. Biochem. 119:235-239,1996.

Zhang, C.-Y.; Baffy, G.; Perret, P.; Krauss, S.; Peroni, O.; Grujic, D.; Hagen, T.; Vidal-Puig, A.; Boss, O.; Kim, Y.-B.; Zheng, X. X.; Wheeler, M. B.; Shulman, G. I.; Chan, C. B.; Lowell, B. B.: Uncoupling protein-2 negatively regulates insulin secretion and is a major link between obesity, beta cell dysfunction, and type 2 diabetes. Cell 105:745-755, 2001.

Sprecher, C. A.; Morgenstern, K. A.; Mathewes, S.; Dahlen, J. R.; Schrader, S. K.; Foster, D. C.; Kisiel, W.: Molecular cloning, expression, and partial characterization of two novel members of the ovalbumin family of serine proteinase inhibitors. J. Biol. Chem. 270:29854-29861,1995.

Chevalier, D.; Cauffiez, C.; Bernard, C.; Lo-Guidice, J.-M.; Allorge, D.; Fazio, F.; Ferrari, N.; Libersa, C.; Lhermitte, M.; D'Halluin, J.-C.; Broly, F.: Characterization of new mutations in the coding sequence and 5-prime-untranslated region of the human prostacyclin synthase gene (CYP8A1). Hum. Genet. 108:148-155, 2001.

Barrett, A. J.; Rawlings, N. D.: Evolutionary lines of cysteine peptidases. Biol. Chem. 382:727-733, 2001.

Fernandes-Alnemri, T.; Takahashi, A.; Armstrong, R.; Krebs, J.; Fritz, L.; Tomaselli, K. J.; Wang, L.; Yu, Z.; Croce, C. M.; Salveson, G.; Earnshaw, W. C.; Litwack, G.; Alnemri, E. S.: Mch3, a novel human apoptotic cysteine protease highly related to CPP32. Cancer Res. 55:6045-6052, 1995.

Riedl, S. J.; Fuentes-Prior, P.; Renatus, M.; Kairies, N.; Krapp, S.; Huber, R.; Salvesen, G. S.; Bode, W.: Structural basis for the activation of human procaspase-7. Proc. Nat. Acad. Sci. 98:14790-14795,2001.

Park, W. S.; Lee, J. H.; Shin, M. S.; Park, J. Y.; Kim, H. S.; Lee, J. H.; Kim, Y. S.; Lee, S. N.; Xiao, W.; Park, C. H.; Lee, S. H.; Yoo, N. J.; Lee, J. Y.: Inactivating mutations of the caspase-10 gene in gastric cancer. Oncogene 21:2919-2925, 2002.

Shin, M. S.; Kim, H. S.; Kang, C. S.; Park, W. S.; Kim, S. Y.; Lee, S. N.; Lee, J. H.; Park, J. Y.; Jang, J. J.; Kim, C. W.; Kim, S. H.; Lee, J. Y.; Yoo, N. J.; Lee, S. H.: Inactivating mutations of CASP10 gene in non-Hodgkin lymphomas. Blood 99:4094-4099, 2002.

Vincenz, C.; Dixit, V. M.: Fas-associated death domain protein interleukin-1-beta-converting enzyme 2 (FLICE2), an ICE/Ced-3 homologue, is proximally involved in CD95- and p55-mediated death signaling. J. Biol. Chem. 272:6578-6583, 1997.

Wang, J.; Chun, H. J.; Wong, W.; Spencer, D. M.; Lenardo, M. J.: Caspase-10 is an initiator caspase in death receptor signaling. Proc. Nat. Acad. Sci. 98:13884-13888, 2001.

Wang, J.; Zheng, L.; Lobito, A.; Chan, F. K.; Dale, J.; Sneller, M.; Yao, X.; Puck, J. M.; Straus, S. E.; Lenardo, M. J.: Inherited human caspase 10 mutations underlie defective lymphocyte and dendritic cell apoptosis in autoimmune lymphoproliferative syndrome type II. Cell 98:47-58, 1999.

Chun, H. J.; Zheng, L.; Ahmad, M.; Wang, J.; Speirs, C. K.; Siegel, R. M.; Dale, J. K.; Puck, J.; Davis, J.; Hall, C. G.; Skoda-Smith, S.; Atkinson, T. P.; Straus, S. E.; Lenardo, M. J.: Pleiotropic defects in lymphocyte activation caused by caspase-8 mutations lead to human immunodeficiency. Nature 419:395-399, 2002.

Grenet, J.; Teitz, T.; Wei, T.; Valentine, V.; Kidd, V. J.: Structure and chromosome localization of the human CASP8 gene. Gene 226:225-232, 1999.

Kischkel, F. C.; Kioschis, P.; Weitz, S.; Poustka, A.; Lichter, P.; Krammer, P. H.: Assignment of CASP8 to human chromosome band 2q33-q34 and Casp8 to the murine syntenic region on chromosome 1B-proximalC by in situ hybridization. Cytogenet. Cell Genet. 82:95-96, 1998.

Sanchez, I.; Xu, C.-J.; Juo, P.; Kakizaka, A.; Blenis, J.; Yuan, J.: Caspase-8 is required for cell death induced by expanded polyglutamine repeats. Neuron 22:623-633, 1999.

Varfolomeev, E. E.; Schuchmann, M.; Luria, V.; Chiannilkulchai, N.; Beckmann, J. S.; Mett, I. L.; Rebrikov, D.; Brodianski, V. M.; Kemper, O. C.; Kollet, O.; Lapidot, T.; Soffer, D.; Sobe, T.; Avraham, K. B.; Goncharov, T.; Holtmann, H.; Lonai, P.; Wallach, D.: Targeted disruption of the mouse Caspase 8 gene ablates cell death induction by the TNF receptors, Fas/Apo1, and DR3 and is lethal prenatally. Immunity 9:267-276, 1998.

Kalchman, M. A.; Koide, H. B.; McCutcheon, K.; Graham, R. K.; Nichol, K.; Nishiyama, K.; Kazemi-Esfarjani, P.; Lynn, F. C.; Wellington, C.; Metzler, M.; Goldberg, Y. P.; Kanazawa, I.; Gietz, R. D.; Hayden, M. R.: HIP1, a human homologue of S. cerevisiae Slap2, interacts with membrane-associated huntingtin in the brain. Nature Genet. 16:44-53, 1997.

Wanker, E. E.; Rovira, C.; Scherzinger, E.; Hasenbank, R.; Walter, S.; Tait, D.; Colicelli, J.; Lehrach, H.: HIP-I: a huntingtin interacting protein isolated by the yeast two-hybrid system. Hum. Molec. Genet. 6:487-495, 1997.

Eki, T; Okumura, K.; Shiratori, A.; Abe, M.; Nogami, M.; Taguchi, H.; Shibata, T.; Murakami, Y.; Hanaoka, F.: Assignment of the closest human homologue (DNA2L; KIAA0083) of the yeast Dna2 helicase gene to chromosome band 10q21.3-q22.1 Genomics 37:408-410, 1996.

Nagase, T; Miyajima, N; Tanaka, A.; Sazuka, T.; Seki, N.; Sato, S.; Tabata, S.; Ishikawa, K.; Kawarabayashi, Y.; Kotani, H.; Nomura, N.: Prediction of the coding sequences of unidentified human genes. III. The coding sequences of 40 new genes (KIAA0081-KIAA0120) deduced by analysis of cDNA clones from human cell line KG-1. DNA Res. 2:37-43, 1995.

Langkopf, A.; Hammarback, J. A.; Muller, R.; Vallee, R. B.; Garner, C. C.: Microtubule-associated proteins 1A and LC2: Two proteins encoded in one messenger RNA. J. Biol. Chem. 267:16561-16566, 1992.

Kordeli, E.; Bennett, V.: Distinct ankyrin isoforms at neuron cell bodies and nodes of Ranvier resolved using erythrocyte ankyrin-deficient mice. J. Cell Biol. 114:1243-1259, 1991.

Reche, P. A.; Soumelis, V.; Gorman, D. M.; Clifford, T.; Liu, M.; Travis, M.; Zurawski, S. M.; Johnston, J.; Liu, Y.-J.; Spits, H.; de Waal Malefyt, R.; Kastelein, R. A.; Bazan, J. F.: Human thymic stromal lymphopoietin preferentially stimulates myeloid cells. J. Immun. 167:336-343, 2001.

Nagase, T.; Kikuno, R.; Nakayama, M.; Hirosawa, M.; Ohara, O.:Prediction of the coding sequences of unidentified human genes. XVIII. The complete sequences of 100 new cDNA clones from brain which code for large proteins in vitro. DNA Res. 7:273-281, 2000.

Mukai, J.; Hachiya, T.; Shoji-Hoshino, S.; Kimura, M. T.; Nadano, D.; Suvanto, P.; Hanaoka, T.; Li, Y.; Irie, S.; Greene, L. A.; Sato, T.-A.: NADE, a p75NTR-associated cell death executor, is involved in signal transduction mediated by the common neurotrophin receptor p75NTR. J. Biol. Chem. 275: 17566-17570, 2000.

Rapp, G.; Freudenstein, J.; Klaudiny, J.; Mucha, J.; Wempe, F.; Zimmer, M.; Scheit, K. H.: Characterization of three abundant mRNAs from human ovarian granulosa cells. DNA Cell Biol. 9:479-485, 1990.

Scott, A. F.: Personal Communication. Baltimore, Md. Oct. 8, 2001.

Kurochkin, I. V.; Yonemitsu, N.; Funahashi, S.; Nomura, H.: ALEX1, a novel human armadillo repeat protein that is expressed differentially in normal tissues and carcinomas. Biochem. Biophys. Res. Commun. 280:340-347, 2001.

Nagase, T.; Ishikawa, K.; Miyajima, N.; Tanaka, A.; Kotani, H.; Nomura, N.; Ohara, O.: Prediction of the coding sequences of unidentified human genes. IX. The complete sequences of 100 new cDNA clones from brain which can code for large proteins in vitro. DNA Res. 5:31-39,1998.

Kadowaki, N.; Ho, S.; Antonenko, S.; de Waal Malefyt, R.; Kastelein, R. A.; Bazan, F.; Liu, Y.-J.: Subsets of human dendritic cell precursors express different Toll-like receptors and respond to different microbial antigens. J. Exp. Med. 194:863-869, 2001.

Wirth, B.; Schmidt, T.; Hahnen, E.; Rudnik-Schoneborn, S.; Krawczak, M.; Muller-Myhsok, B.; Schonling, J.; Zerres, K.: De novo rearrangements found in 2% of index patients with spinal muscular atrophy: mutational mechanisms, parental origin, mutation rate, and implications for genetic counseling. Am. J. Hum. Genet. 61:1102-1111, 1997.

Frattini, A.; Orchard, P. J.; Sobacchi, C.; Giliani, S.; Abinun, M.; Mattsson, J. P.; Keeling, D. J.; Andersson, A.-K.; Wallbrandt, P.; Zecca, L.; Notarangelo, L. D.; Vezzoni, P.; Villa, A.: Defects in TCIRG1 subunit of the vacuolar proton pump are responsible for a subset of human autosomal recessive osteopetrosis. Nature Genet. 25:343-346, 2000.

Afzal, A. R.; Rajab, A.; Fenske, C. D.; Oldridge, M.; Elanko, N.; Ternes-Pereira, E.; Tuysuz, B.; Murday, V. A.; Patton, M. A.; Wilkie, A. O. M.; Jeffery, S.: Recessive Robinow syndrome, allelic to dominant brachydactyly type B, is caused by mutation of ROR2. Nature Genet. 25:419-422, 2000.

van Bokhoven, H.; Celli, J.; Kayserili, H.; van Beusekom, E.; Balci, S.; Brussel, W.; Skovby, F.; Kerr, B.; Percin, E. F.; Akarsu, N.; Brunner, H. G.: Mutation of the gene encoding the ROR2 tyrosine kinase causes autosomal recessive Robinow syndrome. Nature Genet. 25:423-426, 2000.

den Dunnen, J. T.; Grootscholten, P. M.; Bakker, E.; Blonden, L. A. J.; Ginjaar, H. B.; Wapenaar, M. C.; van Paassen, H. M. B.; van Broeckhoven, C.; Pearson, P. L.; van Ommen, G. J. B.: Topography of the Duchenne muscular dystrophy (DMD) gene: FIGE and cDNA analysis of 194 cases reveals 115 deletions and 13 duplications. Am. J. Hum. Genet. 45:835-847, 1989.

Claudio, J. O.; Liew, C.-C.; Dempsey, A. A.; Cukerman, E.; Stewart, A. K.; Na, E.; Atkins, H. L.; Iscove, N. N.; Hawley, R. G.: Identification of sequence-tagged transcripts differentially expressed within the human hematopoietic hierarchy. Genomics 50:44-52, 1998.

Claudio, J. O.; Liew, C.-C.; Ma, J.; Heng, H. H. Q.; Stewart, A. K.; Hawley, R. G.: Cloning and expression analysis of a novel WD repeat gene, WDR3, mapping to 1p12-p13. Genomics 59:85-89, 1999.

Eng, B. H.; Guerinot, M. L.; Eide, D.; Saier, M. H., Jr.: Sequence analyses and phylogenetic characterization of the ZIP family of metalion transport proteins. J. Membr. Biol. 166:1-7, 1998.

Lioumi, M.; Ferguson, C. A.; Sharpe, P. T.; Freeman, T.; Marenholz, I.; Mischke, D.; Heizmann, C.; Ragoussis, J.: Isolation and characterization of human and mouse ZIRTL, a member of the IRT1 family of transporters, mapping within the epidermal differentiation complex. Genomics 62:272-280, 1999.

Lioumi, M.; Olavesen, M. G.; Nizetic, D.; Ragoussis, J.: High-resolution YAC fragmentation map of 1q21. Genomics 49:200-208, 1998.

Leiper, J. M,; Santa Maria, J.; Chubb, A.; MacAllister, R. J.; Charles, I. G.; Whitley, G. S.; Vallance, P.: Identification of two human dimethylarginine dimethylaminohydrolases with distinct tissue distributions and homology with microbial arginine deiminases. Biochem. J. 343:209-214, 1999.

Tran, C. T. L.; Fox, M. F.; Vallance, P.; Leiper, J. M.: Chromosomal localization, gene structure, and expression pattern of DDAH1: comparison with DDAH2 and implications for evolutionary origins. Genomics 68:101-105, 2000.

Vanhalst, K.; Kools, P.; Eynde, E. V.; van Roy, F.: The human and murine protocadherin-beta one-exon gene families show high evolutionary conservation, despite the difference in gene number. FEBS Lett. 495:120-125, 2001.

Wu, Q.; Maniatis, T.: A striking organization of a large family of human neural cadherin like cell adhesion genes. Cell 97:779-790,1999.

Katayama, H.; Ota, T.; Morita, K.; Terada, Y.; Suzuki, F.; Katoh, O.; Tatsuka, M.: Human AIM-1: cDNA cloning and reduced expression during endomitosis in megakaryocyte-lineage cells. Gene 224:1-7,1998.

Kimura, M.; Matsuda, Y.; Yoshioka, T.; Sumi, N.; Okano, Y.: Identification and characterization of STK12/Aik2: a human gene related to aurora of Drosophila and yeast IPL1. Cytogenet. Cell Genet. 82:147-152,1998.

Tatsuka, M.; Katayama, H.; Ota, T.; Tanaka, T.; Odashima, S.; Suzuki, F.; Terada, Y.: Multinuclearity and increased ploidy caused by overexpression of the aurora- and Ipl1-like midbody-associated protein mitotic kinase in human cancer cells. Cancer Res. 58:4811-4816, 1998.

Butcher, S.; Arney, K. L.; Cook, G. P.: MAFA-L, an ITIM-containing receptor encoded by the human NK cell gene complex and expressed by basophils and NK cells. Europ. J. Immun. 28:3755-3762, 1998.

Hanke, T.; Corral, L.; Vance, R. E.; Raulet, D. H.:2F1 antigen, the mouse homolog of the rat 'mast cell function-associated antigen', is a lectin-like type II transmembrane receptor expressed by natural killer cells. Europ. J. Immun. 28:4409-4417, 1998.

Lamers, M. B. A. C.; Lamont, A. G.; Williams, D. H.: Human MAFA has alternatively spliced variants. Biochim. Biophys. Acta 1399:209-212, 1998.

Voehringer, D.; Kaufmann, M.; Pircher, H.: Genomic structure, alternative splicing, and physical mapping of the killer cell lectin-like receptor G1 gene (KLRG1), the mouse homologue of MAFA. Immunogenetics 52:206-211, 2001.

Dunham, I.; Shimizu, N.; Roe, B. A.; Chissoe, S.; Hunt, A. R.; Collins, J. E.; Bruskiewich, R.; Beare, D. M.; Clamp, M.; Smink, L. J.; Ainscough, R.; Almeida, J. P.; and 205 others: The DNA sequence of human chromosome 22. Nature 402: 489-495, 1999.

Kimura, T.; Ivell, R.; Rust, W.; Mizumoto, Y.; Ogita, K.; Kusui, C.; Matsumura, Y.; Azuma, C.; Murata, Y.: Molecular cloning of a human MafF homologue, which specifically binds to the oxytocin receptor gene in term myometrium. Biochem. Biophys. Res. Commun. 264:86-92,1999.

Mount, D. B.; Mercado, A.; Song, L.; Xu, J.; George, A. L., Jr.; Delpire, E.; Gamba, G.: Cloning and characterization of KCC3 and KCC4, new members of the cation-chloride cotransporter gene family. J. Biol. Chem. 274:16355-16362, 1999.

Herzing, L. B. K.; Kim, S.-J.; Cook, E. H., Jr.; Ledbetter, D. H.: The human aminophospholipid-transporting ATPase gene ATP10C maps adjacent to UBE3A and exhibits similar imprinted expression. Am. J. Hum. Genet. 68:1501-1505, 2001.

Dode, C.; Le Du, N.; Cuisset, L.; Letourneur, F.; Berthelot, J.-M.; Vaudour, G.; Meyrier, A.; Watts, R. A.; Scott, D. G. I.; Nicholls, A.; Granel, B.; Frances, C.; Garcier, F.; Edery, P.; Boulinguez, S.; Domergues, J.-P.; Delpech, M.; Grateau, G.: New mutations of CIAS1that are responsible for Muckle-Wells syndrome and familial cold urticaria:a novel mutation underlies both syndromes. Am. J. Hum. Genet. 70:1498-1506, 2002.

Feldmann, J.; Prieur, A.-M.; Quartier, P.; Berquin, P.; Certain, S.; Cortis, E.; Teillac-Hamel, D.; Fischer, A.; de Saint Basile, G.: Chronic infantile neurological cutaneous and articular syndrome is caused by mutations in CIAS1, a gene highly expressed in polymorphonuclear cells and chondrocytes. Am. J. Hum. Genet. 71:198-203, 2002.

Greeve, I.; Hermans-Borgmeyer, I.; Brellinger, C.; Kasper, D.; Gomez-Isla, T.; Behl, C.; Levkau, B.; Nitsch, R. M.: The human DIMINUTO/DWARF1 homolog seladin-1 confers resistance to Alzheimer's disease-associated neurodegeneration and oxidative stress. J. Neurosci. 20:7345-7352,2000.

Sarkar, D.; Imai, T.; Kambe, F.; Shibata, A.; Ohmori, S.; Siddiq, A.; Hayasaka, S.; Funahashi, H.; Seo, H.: The human homolog of Diminuto/Dwarf1gene (hDiminuto): a novel ACTH-responsive gene overexpressed in benign cortisol-producing adrenocortical adenomas. J. Clin. Endocr. Metab. 86:5130-5137, 2001.

Hattori, M.; Fujiyama, A.; Taylor, T. D.; Watanabe, H.; Yada, T.; Park, H.-S.; Toyoda, A.; Ishii, K.; Totoki, Y.; Choi, D.-K.; Groner, Y.; Soeda, E.; and 52 others: The DNA sequence of human chromosome 21. Nature 405:311-319, 2000. Note: Erratum: Nature:407:110 only, 2000.

Wilcox, E. R.; Burton, Q. L.; Naz, S.; Riazuddin, S.; Smith, T. N.; Ploplis, B.; Belyatseva, I.; Ben-Yosef, T.; Liburd, N. A.; Morell, R. J.; Kachar, B.; Wu, D. K.; Griffith, A. J.; Riazuddin, S.; Friedman, T. B.: Mutations in the gene encoding tight junction claudin-14 cause recessive deafness DFNB29. Cell 104:165-172, 2001.

Dunlevy, J. R.; Berryhill, B. L.; Vergnes, J.-P.; SundarRaj, N.; Hassell, J. R.: Cloning, chromosomal localization, and characterization of cDNA from a novel gene, SH3BP4, expressed by human corneal fibroblasts. Genomics 62:519-524, 1999.

Wong, W. T.; Schumacher, C.; Salcini, A. E.; Romano, A.; Castagnino, P.; Pelicci, P. G.; DiFiore, P. P.: A protein-binding domain, EH, identified in the receptor tyrosine kinase substrate Eps15 and conserved in evolution. Proc. Nat. Acad. Sci. 92:9530-9534, 1995.

Yamadori, T.; Baba, Y.; Matsushita, M.; Hashimoto, S.; Kurosaki, M.; Kurosaki, T.; Kishimoto, T.; Tsukada, S.: Bruton's tyrosine kinase activity is negatively regulated by Sab, the Btk-SH3 domain-binding protein. Proc. Nat. Acad. Sci. 96:6341-6346, 1999.

Engqvist-Goldstein, A. E. Y.; Kessels, M. M.; Chopra, V. S.; Hayden, M. R.; Drubin, D. G.: An actin-binding protein of the Sla2/Huntingtin interacting protein 1 family is a novel component of clathrin-coated pits and vesicles. J. Cell Biol. 147:1503-1518, 1999.

Baba, Y.; Matsushita, M.; Matsuda, Y.; Inazawa, J.; Yamadori, T.; Hashimoto, S.; Kishimoto, T.; Tsukada, S.: Assignment of SH3BP5/Sh3bp5 encoding Sab, an SH3 domain-binding protein which preferentially associates with Bruton's tyrosine kinase, to human chromosome 1q43 and mouse chromosome 14B by in situ hybridization. Cytogenet. Cell Genet. 87:221-222, 1999.

Matsushita, M.; Yamadori, T.; Kato, S.; Takemoto, Y.; Inazawa, J.; Baba, Y.; Hashimoto, S.; Sekine, S.; Arai, S.; Kunikata, T.; Kurimoto, M.; Kishimoto, T.; Tsukada, S.: Identification and characterization of a novel SH3-domain binding protein, Sab, which preferentially associates with Bruton's tyrosine kinase (Btk). Biochem. Biophys. Res. Commun. 245:337-343, 1998.

Itoh, T.; Koshiba, S.; Kigawa, T.; Kikuchi, A.; Yokoyama, S.; Takenawa, T.: Role of the ENTH domain in phosphatidyl inositol-4,5-biphosphate binding and endocytosis. Science 291:1047-1051, 2001.

Seki, N.; Muramatsu, M.; Sugano, S.; Suzuki, Y.; Nakagawara, A.; Ohhira, M.; Hayashi, A.; Hori, T.; Saito, T.: Cloning, expression analysis, and chromosomal localization of HIP1R, an isolog of huntingtin interacting protein (HIP1). J. Hum. Genet. 43:268-271, 1998.

Marton, M. J.; Vazquez de Aldana, C. R.; Qiu, H.; Chakraburtty, K.; Hinnebusch, A. G.: Evidence that GCN1 and GCN20, translational regulators of GCN4, function on elongating ribosomes in activation of eIF2-alpha kinase GCN2. Molec. Cell. Biol. 17:4474-4489, 1997.

Nash, S. R.; Giros, B.; Kingsmore, S. F.; Kim, K. M.; El-Mestikawy, S.; Dong, Q.; Fumagalli, F.; Seldin, M. F.; Caron, M. G.: Cloning, gene structure and genomic localization of an orphan transporter from mouse kidney with six alternatively-spliced isoforms. Receptors Channels 6:113-128, 1998.

Scott, A. F.: Personal Communication. Baltimore, Md. Feb. 5, 2001.

Meguro, M.; Kashiwagi, A.; Mitsuya, K.; Nakao, M.; Kondo, I.; Saitoh, S.; Oshimura, M.: A novel maternally expressed gene, ATP10C, encodes a putative aminophospholipid translocase associated with Angelman syndrome. Nature Genet. 28:19-20, 2001.

Nakakura, E. K.; Watkins, D. N.; Schuebel, K. E.; Sriuranpong, V.; Borges, M. W.; Nelkin, B. D.; Ball, D. W.: Mammalian Scratch:a neural-specific Snail family transcriptional repressor. Proc. Nat. Acad. Sci. 98:4010-4015, 2001.

Scott, A. F.: Personal Communication. Baltimore, Md. Jun. 21, 2001.

Hoatlin, M. E.; Zhi, Y.; Ball, H.; Silvery, K.; Melnick, A.; Stone, S.; Arai, S.; Hawe, N.; Owen, G.; Zelent, A.; Licht, J. D.: A novel BTB/POZ transcriptional repressor protein interacts with the Fanconi anemia group C protein and PLZF. Blood 94:3737-3747, 1999.

Lin, W.; Lai, C.-H.; Tang, C.-J. C.; Huang, C.-J.; Tang, T. K.: Identification and gene structure of a novel human PLZF-related transcription factor gene, TZFP. Biochem. Biophys. Res. Commun. 264:789-795, 1999.

Yokoyama-Kobayashi, M.; Sugano, S.; Kato, T.; Kato, S.: A signal sequence detection system using secreted protease activity as an indicator. Gene 163:193-196, 1995.

Yokoyama-Kobayashi, M.; Yamaguchi, T.; Sekine, S.; Kato, S.: Selection of cDNAs encoding putative type II membrane proteins on the cell surface from a human full-length cDNA bank. Gene 228:161-167, 1999.

Hampe, J.; Grebe, J.; Nikolaus, S.; Solberg, C.; Croucher, P. J. P.; Mascheretti, S.; Jahnsen, J.; Moum, B.; Klump, B.; Krawczak, M.; Mirza, M. M.; Foelsch, U. R.; Vatn, M.; Schreiber, S.: Association of NOD2 (CARD 15) genotype with clinical course of Crohn's disease:a cohort study. Lancet 359:1661-1665, 2002.

Hugot, J.-P.; Chamaillard, M.; Zouali, H.; Lesage, S.; Cezard, J.-P.; Belaiche, J.; Almer, S.; Tysk, C.; O'Morain, C. A.; Gassull, M.; Binder, V.; Finkel, Y.; and 8 others: Association of NOD2 leucine-rich repeat variants with susceptibility to Crohn's disease. Nature 411:599-603, 2001.

Murillo, L.; Crusius, J. B. A.; van Bodegraven, A. A.; Alizadeh, B. Z.; Pena, A. S.: CARD15 gene and the classification of Crohn's disease. Immunogenetics 54:59-61, 2002.

Ogura, Y.; Bonen, D. K.; Inohara, N.; Nicolae, D. L.; Chen, F. F.; Ramos, R.; Britton, H.; Moran, T.; Karaliuskas, R.; Duerr, R. H.; Achkar, J.-P.; Brant, S. R.; Bayless, T. M.; Kirschner, B. S.; Hanauer, S. B.; Nunez, G.; Cho, J. H.: A frame shift mutation in Nod2 associated with susceptibility to Crohn's disease. Nature 411:603-606,2001.

Ogura, Y.; Inohara, N.; Benito, A.; Chen, F. F.; Yamaoka, S.; Nunez, G.: Nod2, a Nod1/Apaf-1 family member that is restricted to monocytes and activates NF-kappa-B. J. Biol. Chem. 276:4812-4818, 2001.

Lesage, S.; Zouali, H.; Cezard, J.-P.; EPWG-IBD Group; Colombel, J.-F.; EPIMAD Group; Belaiche, J.; GETAID Group; Almer, S.; Tysk, C.; O'Morain, C.; Gassull, M.; Binder, V.; Finkel, Y.; Modigliani, R.; Gower-Rousseau, C.; Macry, J.; Merlin, F.; Chamaillard, M.; Jannot, A.-S.; Thomas, G.; Hugot, J.-P.: CARD15/NOD2 mutational analysis and genotype-phenotype correlation in 612 patients with inflammatory bowel disease. Am. J. Hum. Genet. 70:845-857, 2002.

van Heel, D. A.; McGovern, D. P. B.; Cardon, L. R.; Dechairo, B. M.; Lench, N. J.; Carey, A. H.; Jewell, D. P.: Fine mapping of the IBD 1 locus did not identify Crohn disease-associated NOD2 variants:implications for complex disease genetics. Am. J. Med. Genet. 111:253-259, 2002.

Vermeire, S.; Wild, G.; Kocher, K.; Cousineau, J.; Dufresne, L.; Bitton, A.; Langelier, D.; Pare, P.; Lapointe, G.; Cohen, A.; Daly, M. J.; Rioux, J. D.: CARD15 genetic variation in a Quebec population: prevalence, genotype-phenotype relationship, and haplotype structure. Am. J. Hum. Genet. 71:74-83, 2002.

Yamazaki, K.; Takazoe, M.; Tanaka, T.; Kazumori, T.; Nakamura, Y.: Absence of mutation in the NOD2/CARD15 gene among 483 Japanese patients with Crohn's disease. J. Hum. Genet. 47:469-472, 2002.

Fliss, M. S.; Hinkle, P. M.; Bancroft, C.: Expression cloning and characterization of PREB (prolactin regulatory element binding), a novel WD motif DNA-binding protein with a capacity to regulate prolactin promoter activity. Molec. Endocr. 13:644-657, 1999.

Taylor Clelland, C. L.; Levy, B.; McKie, J. M.; Duncan, A. M. V.; Hirschhorn, K.; Bancroft, C.: Cloning and characterization of human PREB; a gene that maps to a genomic region associated with trisomy2p syndrome. Mammalian Genome 11:675-681, 2000.

Li, B.; Oestreich, S.; de Lange, T.: Identification of human Rap1: implications for telomere evolution. Cell 101:471-483, 2000.

Lieb, J. D.; Liu, X.; Botstein, D.; Brown, P. O.: Promoter-specific binding of Rap1 revealed by genome-wide maps of protein-DNA association. Nature Genet. 28:327-334, 2001.

Chong, S. S.; Tanigami, A.; Roschke, A. V.; Ledbetter, D. H.: 14-3-3-epsilon has no homology to LIS1 and lies telomeric to it on chromosome 17p13.3 outside the Miller-Dieker syndrome chromosome region. Genome Res. 6:735-741, 1996.

Conklin, D. S.; Galaktionov, K.; Beach, D.:14-3-3 proteins associate with cdc25 phosphatases. Proc. Nat. Acad. Sci. 92:7892-7896, 1995.

Jin, D.-Y.; Lyu, M. S.; Kozak, C. A.; Jeang, K.-T.: Function of 14-3-3 proteins. Nature 382:308 only, 1996.

Luk, S. C. W.; Garcia-Barcelo, M.; Tsui, S. K. W.; Fung, K. P.; Lee, C. Y.; Waye, M. M. Y.: Assignment of the human 14-3-3 epsilon isoform (YWHAE) to human chromosome 17p13 by in situ hybridization. Cytogenet. Cell Genet. 78:105-106, 1997.

Slentz-Kesler, K.; Moore, J. T.; Lombard, M.; Zhang, J.; Hollingsworth, R.; Weiner, M. P.: Identification of the human Mnk2 gene (MKNK2) through protein interaction with estrogen receptor beta. Genomics 69:63-71, 2000.

Li, Y.; He, X.; Schembri-King, J.; Jakes, S.; Hayashi, J.: Cloning and characterization of human lnk, an adaptor protein with pleckstrin homology and Src homology 2 domains that can inhibit T cell activation. J. Immun. 164:5199-5206, 2000.

Takaki, S.; Sauer, K.; Iritani, B. M.; Chien, S.; Ebihara, Y.; Tsuji, K.; Takatsu, K.; Perlmutter, R. M.: Control of B cell production by the adaptor protein Lnk: definition of a conserved family of signal-modulating proteins. Immunity 13:599-609, 2000.

Li, J.; Yang, Y.; Peng, Y.; Austin, R. J.; van Eyndhoven, W. G.; Nguyen, K. C. Q.; Gabriele, T.; McCurrach, M. E.; Marks, J. R.; Hoey, T.; Lowe, S. W.; Powers, S.: Oncogenic properties of PPM1D located within a breast cancer amplification epicenter at 17q23. Nature Genet. 31:133-134, 2002.

Ferguson, K. M.; Kavran, J. M.; Sankaran, V. G.; Fournier, E.; Isakoff, S. J.; Skolnik, E. Y.; Lemmon, M. A.: Structural basis for discrimination of 3-phosphoinositides by pleckstrin homology domains. Molec. Cell 6:373-384, 2000.

Franco, M.; Boretto, J.; Robineau, S.; Monier, S.; Goud, B.; Chardin, P.; Chavrier, P.: ARNO3, a Sec7-domain guanine nucleotide exchange factor for ADP ribosylation factor 1, is involved in the control of Golgi structure and function. Proc. Nat. Acad. Sci. 95:9926-9931,1998.

Klarlund, J. K.; Guilherme, A.; Holik, J. J.; Virbasius, J. V.; Chawla, A.; Czech, M. P.: Signaling by phosphoinositide-3, 4,5-triphosphate through proteins containing pleckstrin and Sec7 homology domains. Science 275:1927-1930, 1997.

Latchman, Y.; Wood, C. R.; Chernova, T.; Chaudhary, D.; Borde, M.; Chernova, I.; Iwai, Y.; Long, A. J.; Brown, J. A.; Nunes, R.; Greenfield, E. A.; Bourque, K.: PD-L2 is a second ligand for PD-1 and inhibits T cell activation. Nature Immun. 2:261-268, 2001.

Drewes, T.; Senkel, S.; Holewa, B.; Ryffel, G. U.: Human hepatocyte nuclear factor 4 isoforms are encoded by distinct and differentially expressed genes. Molec. Cell. Biol. 16:925-931, 1996.

Taraviras, S.; Mantamadiotis, T.; Dong-Si, T.; Mincheva, A.; Lichter, P.; Drewes, T.; Ryffel, G. U.; Monaghan, A. P.; Schutz, G.: Primary structure, chromosomal mapping, expression and transcriptional activity of murine hepatocyte nuclear factor 4-gamma. Biochim. Biophys. Acta 1490:21-32, 2000.

Gauss, R.; Seifert, R.; Kaupp, U. B.: Molecular identification of a hyperpolarization-activated channel in sea urchin sperm. Nature 393:583-587, 1998.

Seifert, R.; Scholten, A.; Gauss, R.; Mincheva, A.; Lichter, P.; Kaupp, U. B.: Molecular characterization of a slowly gating human hyperpolarization-activated channel predominantly expressed in thalamus, heart, and testis. Proc. Nat. Acad. Sci. 96:9391-9396, 1999.

Aihara, Y.; Mashima, H.; Onda, H.; Hisano, S.; Kasuya, H.; Hori, T.; Yamada, S.; Tomura, H.; Yamada, Y.; Inoue, I.; Kojima, I.; Takeda, J.: Molecular cloning of a novel brain-type Na (+)-dependent inorganic phosphate cotransporter. J. Neurochem. 74:2622-2625, 2000.

Bellocchio, E. E.; Reimer, R. J.; Fremeau, R. T., Jr.; Edwards, R. H.: Uptake of glutamate into synaptic vesicles by an inorganic phosphate transporter. Science 289:957-960, 2000.

Ni, B.; Du, Y.; Wu, X.; DeHoff, B. S.; Rosteck, P. R., Jr.; Paul, S. M.: Molecular cloning, expression, and chromosomal localization of a human brain-specific Na (+)-dependent inorganic phosphate cotransporter. J. Neurochem. 66:2227-2238, 1996.

Takamori, S.; Rhee, J. S.; Rosenmund, C.; Jahn, R.: Identification of a vesicular glutamate transporter that defines a glutamatergic phenotype in neurons. Nature 407:189-194, 2000.

Blackwood, D.: P300, a state and a trait marker in schizophrenia. Lancet 355:771-772, 2000.

Blackwood, D. H. R.; Fordyce, A.; Walker, M. T.; St. Clair, D. M.; Porteous, D. J.; Muir, W. J.: Schizophrenia and affective disorders--cosegretation with a translocation at chromosome 1q42 that directly disrupts brain-expressed genes: clinical and P300 findings in a family. Am. J. Hum. Genet. 69:428-433, 2001.

Ekelund, J.; Hovatta, I.; Parker, A.; Paunio, T.; Varilo, T.; Martin, R.; Suhonen, J.; Ellonen, P.; Chan, G.; Sinsheimer, J. S.; Sobel, E.; Juvonen, H.; Arajarvi, R.; Partonen, T.; Suvisaari, J.; Lonnqvist, J.; Meyer, J.; Peltonen, L.: Chromosome 1 loci in Finnish schizophrenia families. Hum. Molec. Genet. 10:1611-1617, 2001.

Millar, J. K.; Wilson-Annan, J. C.; Anderson, S.; Christie, S.; Taylor, M. S.; Semple, C. A. M.; Devon, R. S.; St. Clair, D. M.; Muir, W. J.; Blackwood, D. H. R.; Porteous, D. J.: Disruption of two novel genes by a translocation co-segregating with schizophrenia. Hum. Molec. Genet. 9:1415-1423, 2000.

St. Clair, D.; Blackwood, D.; Muir, W.; Carothers, A.; Walker, M.; Spowart, G.; Gosden, C.; Evans, H. J.: Association within a family of a balanced autosomal translocation with major mental illness. Lancet 336:13-16, 1990.

Bulfone, A.; Menguzzato, E.; Broccoli, V.; Marchitiello, A.; Gattuso, C.; Mariani, M.; Consalez, G. G.; Martinez, S.; Ballabio, A.; Banfi, S.: Barhl1, a gene belonging to a new subfamily of mammalian homeobox genes, is expressed in migrating neurons of the CNS. Hum. Molec. Genet. 9:1443-1452, 2000.

Bertin, J.; Nir, W.-J.; Fischer, C. M.; Tayber, O. V.; Errada, P. R.; Grant, J. R.; Keilty, J. J.; Gosselin, M. L.; Robison, K. E.; Wong, G. H. W.; Glucksmann, M. A.; DiStefano, P. S.: Human CARD4 protein is a novel CED-4/Apaf-1 cell death family member that activates NF-kappa-B. J. Biol. Chem. 274:12955-12958, 1999.

Cohen, D. E.; Green, R. M.; Wu, M. K.; Beier, D. R.: Cloning, tissue-specific expression, gene structure and chromosomal localization of human phosphatidylcholine transfer protein. Biochim. Biophys. Acta 1447:265-270, 1999.

van Helvoort, A.; de Brouwer, A.; Ottenhoff, R.; Brouwers, J. F. H. M.; Wijnholds, J.; Beijnen, J. H.; Rijneveld, A.; van der Valk, M. A.; Majoor, D.; Voorhout, W.; Wirtz, K. W. A.; Elferink, R. P. J. O.; Borst, P.: Mice without phosphatidylcholine transfer protein have no defects in the secretion of phosphatidylcholine into bile or into lung airspaces. Proc. Nat. Acad. Sci. 96:11501-11506, 1999.

Hill, K. E.; Dasouki, M.; Phillips, J. A., III; Burk, R. F.: human selenoprotein P gene maps to 5q31. Genomics 36:550-551, 1996.

Hill, K. E.; Lloyd, R. S.; Burk, R. F.: Conserved nucleotide sequences in the open reading frame and 3-prime untranslated region of selenoprotein P mRNA. Proc. Nat. Acad. Sci. 90:537-541, 1993.

Keshan Disease Research Group of the Chinese Academy of Medical Sciences: Observations on effect of sodium selenite in prevention of Keshan disease. Chinese Med. J. 92:471-476, 1979.

Eberhart, C. G.; Maines, J. Z.; Wasserman, S. A.: Meiotic cell cycle requirement for a fly homologue of human deleted in Azoospermia. Nature 381:783-785, 1996.

Rugglu, M.; Speed, R.; Taggart, M.; McKay, S. J.; Kilanowski, F.; Saunders, P.; Derin, J.; Cooke, H. J.: The mouse Dazla gene encodes a cytoplasmic protein essential for gametogenesis. Nature 389:73-77,1997.

Shan, Z.; Hirschmann, P.; Seebacher, T.; Edelmann, A.; Jauch, A.; Morell, J.; Urbitsch, P.; Vogt, P. H.: A SPGY copy homologous to the mouse gene Dazla and the Drosophila gene boule is autosomal and expressed only in the human male gonad. Hum. Molec. Genet. 5:2005-2011,1996.

Slee, R.; Grimes, B.; Speed, R. M.; Taggart, M.; Maguire, S. M.; Ross, A.; McGill, N. I.; Saunders, P. T. K.; Cooke, H. J.: A human DAZ transgene confers partial rescue of the mouse Daz1 null phenotype. Proc. Nat. Acad. Sci. 96:8040-8045, 1999.

Yen, P. H.; Chai, N. N.; Salido, E. C.: The human autosomal gene DAZLA: testis specificity and a candidate for male infertility. Hum. Molec. Genet. 5:2013-2017, 1996.

Chakraborti, A.; Lippman, D. L.; Loh, H. H.; Kozak, C. A.; Lee, N. M.: Genetic mapping of opioid binding protein gene (s) to mouse chromosome 9. Mammalian Genome 4:179-182, 1993.

Cho, T. M.; Hasegawa, J.-I.; Ge, B.-l.; Loh, H. H.: Purification to apparent homogeneity of a mu-type opioid receptor from rat brain. Proc. Nat. Acad. Sci. 83:4138-4142, 1986.

Shark, K. B.; Lee, N. M.: Cloning, sequencing and localization to chromosome 11 of a cDNA encoding a human opioid-binding cell adhesion molecule (OBCAM). Gene 155:213-217, 1995.

McIntire, J. J.; Umetsu, S. E.; Akbari, O.; Potter, M.; Kuchroo, V. K.; Barsh, G. S.; Freeman, G. J.; Umetsu, D. T.; DeKruyff, R. H.: Identification of Tapr (an airway hyperreactivity regulatory locus) and the linked Tim gene family. Nature Immun. 2:1109-1116, 2001.

Tahir, S. A.; Yang, G.; Ebara, S.; Timme, T. L.; Satoh, T.; Li, L.; Goltsov, A.; Ittmann, M.; Morriset, J. D.; Thompson, T. C.: Secreted caveolin-1 stimulates cell survival/clonal growth and contributes to metastasis in androgen-insensitive prostate cancer. Cancer Res. 61:3882-3885, 2001.

England, S. K.; Uebele, V. N.; Kodali, J.; Bennett, P. B.; Tamkun, M. M.: A novel K+ channel beta-subunit (hKv-beta-1.3) is produced via alternative mRNA splicing. J. Biol. Chem. 270:28531-28534,1995.

Kratz, C. P.; Emerling, B. M.; Bonifas, J.; Wang, W.; Green, E. D.; Le Beau, M. M.; Shannon, K. M.: Genomic structure of the PIK3CG gene on chromosome band 7q22 and evaluation as a candidate myeloid tumor suppressor. Blood 99:372-374, 2002.

Temple, I. K.; Gardner, R. J.; Robinson, D. O.; Kibirige, M. S.; Ferguson, A. W.; Baum, J. D.; Barber, J. C. K.; James, R. S.; Shield, J. P. H.: Further evidence for an imprinted gene for neonatal diabetes localised to chromosome 6q22-q23. Hum. Molec. Genet. 5:1117-1124,1996.

Goldowitz, D.; Smeyne, R. J.: Tune into the weaver channel. Nature Genet. 11:107-109, 1995.

Hess, E. J.: Identification of the weaver mouse mutation: the end of the beginning. Neuron 16:1073-1076, 1996.

Lane, P. W.: New mutation: Weaver, wv. Mouse News Letter 32-33,1964.

Lesage, F.; Duprat, F.; Fink, M.; Guillemare, E.; Coppola, T.; Lazdunski, M.; Hugnot, J.-P.: Cloning provides evidence for a family of inward rectifier and G-protein coupled K(+) channels in the brain. FEBS Lett. 353:37-42, 1994.

Rakic, P.; Sidman, R. L.: Sequence of developmental abnormalities leading to granule cell deficit in cerebellar cortex of weaver mutant mice. J. Comp. Neurol. 152:103-132, 1973.

Sakura, H.; Bond, C.; Warren-Perry, M.; Horsley, S.; Kearney, L.; Tucker, S.; Adelman, J.; Turner, R.; Ashcroft, F. M.: Characterization and variation of a human inwardly-rectifying K-channel gene (KCNJ6): a putative ATP-sensitive K-channel subunit. FEBS Lett. 367:193-197,1995.

Tsaur, M.-L.; Menzel, S.; Lai, F.-P.; Espinosa, R., III; Concannon, P.; Spielman, R. S.; Hanis, C. L.; Cox, N. J.; Le Beau, M. M.; German, M. S.; Jan, L. Y.; Bell, G. I.; Stoffel, M.: Isolation of a cDNA clone encoding a K(ATP) channel-like protein expressed in insulin-secreting cells, localization of the human gene to chromosome band 21q22.1 and linkage studies with NIDDM. Diabetes 44:592-596, 1995.

Yasuda, K.; Sakura, H.; Mori, Y.; Iwamoto, K.; Shimokawa, K.; Kadowaki, H.; Hagura, R.; Akanuma, Y.; Adelman, J. P.; Yazaki, Y.; Ashcroft, F. M.; Kadowaki, T.: No evidence for mutations in a putative subunit of the beta-cell ATP-sensitive potassium channel (K-ATP channel) in Japanese NIDDM patients. Biochem. Biophys. Res. Commun. 211:1036-1040, 1995.

Efiok, B. J. S.; Chiorini, J. A.; Safer, B.: A key transcription factor for eukaryotic initiation factor-2-alpha is strongly homologous to developmental transcription factors and may link metabolic genes to cellular growth and development. J. Biol. Chem. 269:18921-18930,1994.

Gopalakrishnan, L.; Scarpulla, R. C.: Structure, expression, and chromosomal assignment of the human gene encoding nuclear respiratory factor 1. J. Biol. Chem. 270:18019-18025, 1995.

Spelbrink, J. N.; Van den Bogert, C.: The pre-mRNA of nuclear respiratory factor 1, a regulator of mitochondrial biogenesis, is alternatively spliced in human tissues and cell lines. Hum. Molec. Genet. 4:1591-1596, 1995.

Tiranti, V.; Rossi, E.; Rocchi, M.; DiDonato, S.; Zuffardi, O.; Zeviani, M.: The gene (NFE2L1) for human NRF-1, an activator involved in nuclear-mitochondrial interactions, maps to 7q32. Genomics 27:555-557, 1995.

Wary, K. K.; Mariotti, A.; Zurzolo, C.; Giancotti, F. G.: A requirement for caveolin-1 and associated kinase Fyn in integrin signaling and anchorage-dependent cell growth. Cell 94:625-634, 1998.

Yang, G.; Truong, L. D.; Timme, T. L.; Ren, C.; Wheeler, T. M.; Park, S. H.; Nasu, Y.; Bangma, C. H.; Kattan, M. W.; Scardino, P. T.; Thompson, T. C.: Elevated expression of caveolin is associated with prostate and breast cancer. Clin. Cancer Res. 4:1873-1880,1998.

Siderovski, D. P.; Heximer, S. P.; Forsdyke, D. R.: A human gene encoding a putative basic helix-loop-helix phosphoprotein whose mRNA increases rapidly in cycloheximide-treated blood mononuclear cells. DNA Cell Biol. 13:125-147, 1994.

Hirai, H.; Roussel, M. F.; Kato, J.-Y.; Ashmun, R. A.; Sherr, C. J.: Novel INK4 proteins, p19 and p18, are specific inhibitors of cyclin D-dependent kinases CDK4 and CDK6. Molec. Cell. Biol. 15:2672-2681, 1995.

Okuda, T.; Hirai, H.; Valentine, V. A.; Shurtleff, S. A.; Kidd, V. J.; Lahti, J. M.; Sherr, C. J.; Downing, J. R.: Molecular cloning, expression pattern, and chromosomal localization of human CDKN2D/INK4d, an inhibitor of cyclin D-dependent kinases. Genomics 29:623-630,1995.

Sago, H.; Kitagawa, M.; Obata, S.; Mori, N.; Taketani, S.; Rochelle, J. M.; Seldin, M. F.; Davidson, M.; St. John, T.; Suzuki, S. T.:Cloning, expression, and chromosomal localization of a novel cadherin-related protein, protocadherin-3. Genomics 29:631-640, 1995.

Mukai, H.; Ono, Y.: A novel protein kinase with leucine zipper-like sequences: its catalytic domain is highly homologous to that of protein kinase C. Biochem. Biophys. Res. Commun. 199:897-904, 1994.

Palmer, R. H.; Ridden, J.; Parker, P. J.: Identification of multiple, novel, protein kinase C-related gene products. FEBS Lett. 356:5-8,1994.

Palmer, R. H.; Ridden, J.; Parker, P. J.: Cloning and expressions patterns of two members of a novel protein-kinase-C-related kinase family. Europ. J. Biochem. 227:344-351, 1995.

Beltrame, J. F.; Sasayama, S.; Maseri, A.: Racial heterogeneity in coronary artery vasomotor reactivity: differences between Japanese and Caucasian patients. J. Am. Coll. Cardiol. 33:1442-1452, 1999.

Inagaki, N.; Inazawa, J.; Seino, S.: cDNA sequence, gene structure, and chromosomal localization of the human ATP-sensitive potassium channel, uK(ATP)-1, gene (KCNJ8). Genomics 30:102-104, 1995.

Inagaki, N.; Tsuura, Y.; Namba, N.; Masuda, K.; Gonoi, T.; Horie, M.; Seino, Y.; Mizuta, M.; Seino, S.: Cloning and functional characterization of a novel ATP-sensitive potassium channel ubiquitously expressed in rat tissues, including pancreatic islets, pituitary, skeletal muscle, and heart. J. Biol. Chem. 270:5691-5694, 1995.

MacAlpin, R. N.: Cardiac arrest and sudden unexpected death in variant angina: complications of coronary spasm that can occur in the absence of severe organic coronary stenosis. Am. Heart J. 125:1011-1017, 1993.

Bartsch, J. W.; Mukai, H.; Takahashi, N.; Ronsiek, M.; Fuchs, S.; Jockusch, H.; Ono, Y.: The protein kinase N (PKN) gene PRKCL1/Prkcl1 maps to human chromosome 19p12-p13.1 and mouse chromosome 8 with close linkage to the myodystrophy (myd) mutation. Genomics 49:129-132,1998.

Yu, W.; Liu, J.; Morrice, N. A.; Wettenhall, R. E. H.: Isolation and characterization of a structural homologue of human PRK2 from rat liver. J. Biol. Chem. 272:10030-10034, 1997.

Hernandez, A.; Park, J. P.; Lyon, G. J.; Mohandas, T. K.; St. Germain, D. L.: Localization of the type 3 iodothyronine deiodinase (DIO3) gene to human chromosome 14q32 and mouse chromosome 12F1. Genomics 53:119-121, 1998.

Huang, S. A.; Tu, H. M.; Harney, J. W.; Venihaki, M.; Butte, A. J.; Kozakewich, H. P. W.; Fishman, S. J.; Larsen, P. R.: Severe hypothyroidism caused by type 3 iodothyronine deiodinase in infantile hemangiomas. New Eng. J. Med. 343:185-189, 2000.

Salvatore, D.; Low, S. C.; Berry, M.; Maia, A. L.; Harney, J. W.; Croteau, W.; St. German, D. L.; Larsen, P. R.: Type 3 iodothyronine deiodinase: cloning, in vitro expression, and functional analysis of the placental seleno enzyme. J. Clin. Invest. 96:2421-2430, 1995.

Ardehali, H.; Tiller, G. E.; Printz, R. L.; Mochizuki, H.; Prochazka, M.; Granner, D. K.: A novel (TA)n polymorphism in the hexokinase II gene: application to noninsulin-dependent diabetes mellitus in the Pima Indians. Hum. Genet. 97:482-485, 1996.

Echwald, S. M.; Bjorbaek, C.; Hansen, T.; Clausen, J. O.; Vestergaard, H.; Zierarth, J. R.; Printz, R. L.; Granner, D. K.; Pedersen, O.:Identification of four amino acid substitutions in hexokinase II and studies of relationships to NIDDM, glucose effectiveness, and insulin sensitivity. Diabetes 44:347-353, 1995.

Heikkinen, S.; Suppola, S.; Malkki, M.; Deeb, S. S.; Janne, J.; Laakso, M.: Mouse hexokinase II gene: structure, cDNA, promoter analysis, and expression pattern. Mammalian Genome 11:91-96, 2000.

Laakso, M.; Malkki, M.; Deeb, S. S.: Amino acid substitutions in hexokinase II among patients with NIDDM. Diabetes 44:330-334,1995.

Lehto, M.; Xiang, K.; Stoffel, M.; Espinosa, R., III; Groop, L. C.; Le Beau, M. M.; Bell, G. I.: Human hexokinase II: localization of the polymorphic gene to chromosome 2. Diabetologia 36:1299-1302,1993.

Mathupala, S. P.; Heese, C.; Pedersen, P. L.: Glucose catabolism in cancer cells: the type II hexokinase promoter contains functionally active response elements for the tumor suppressor p53. J. Biol. Chem. 272:22776-22780, 1997.

Mathupala, S. P.; Rempel, A.; Pedersen, P. L.: Glucose catabolism in cancer cells: isolation, sequence, and activity of the promoter for type II hexokinase. J. Biol. Chem. 270: 16918-16925, 1995.

Vidal-Puig, A.; Printz, R. L.; Stratton, I. M.; Granner, D. K.; Moller, D. E.: Analysis of the hexokinase II gene in subjects with insulin resistance and NIDDM and detection of a gln142-to-his substitution. Diabetes 44:340-346, 1995.

Luo, Y.; Roeder, R. G.: Cloning, functional characterization, and mechanism of action of the B-cell-specific transcriptional activator OCA-B. Molec. Cell. Biol. 15:4115-4124, 1995.

Staudt, L. M.; Lenardo, M. J.: Immunoglobulin gene transcription. Ann. Rev. Immun. 9:373-398, 1991.

Strubin, M.; Newell, J. W.; Matthias, P.: OBF-1, a novel B cell-specific coactivator that stimulates immunoglobulin promoter activity through association with octamer-binding proteins. Cell 80:497-506, 1995.

Hahm, K.; Kim, G.; Turck, C. W.; Smale, S. T.: Isolation of a murine gene encoding a nucleic acid-binding protein with homology to hnRNP K. Nucleic Acids Res. 21:3894 only, 1993.

Leffers, H.; Dejgaard, K.; Celis, J. E.: Characterisation of two major cellular poly (rC)-binding human proteins, each containing three K-homologous (KH) domains. Europ. J. Biochem. 230:447-453, 1995.

Bouchard, M. J.; Wang, L.-H.; Schneider, R. J.: Calcium signaling by HBx protein in hepatitis B virus DNA replication. Science 294:2376-2378, 2001.

Calalb, M. B.; Polte, T. R.; Hanks, S. K.: Tyrosine phosphorylation of focal adhesion kinase at sites in the catalytic domain regulates kinase activity: a role for Src family kinases. Molec. Cell. Biol. 15:954-963, 1995.

Ganem, D.: The X files--one step closer to closure. Science 294:2299-2300, 2001.

Herzog, H.; Nicholl, J.; Hort, Y. J.; Sutherland, G. R.; Shine, J.: Molecular cloning and assignment of FAK2, a novel human focal adhesion kinase, to 8p11.2-p22 by nonisotopic in situ hybridization. Genomics 32:484-486, 1996.

Lev, S.; Moreno, H.; Martinez, R.; Canoll, P.; Peles, E.; Musacchio, J. M.; Plowman, G. D.; Rudy, B.; Schlessinger, J.: Protein tyrosine kinase PYK2 involved in Ca (2+)-induced regulation of ion channel and MAP kinase functions. Nature 376:737-745, 1995.

Manser, E.; Leung, T.; Salihuddin, H.; Tan, L.; Lim, L.: A non-receptor tyrosine kinase that inhibits the GTPase activity of p21(cdc42). Nature 363:364-367, 1993.

Matsuya, M.; Sasaki, H.; Aoto, H.; Mitaka, T.; Nagura, K.; Ohba, T.; Ishino, M.; Takahashi, S.; Suzuki, R.; Sasaki, T.: Cell adhesion kinase beta forms a complex with a new member, Hic-5, of proteins localized at focal adhesions. J. Biol. Chem. 273:1003-1014, 1998.

Aubry, F.; Mattei, M.-G.; Barque, J.-P.; Galibert, F.: Chromosomal localization and expression pattern of the RNase L inhibitor gene. FEBS Lett. 381:135-139, 1996.

Diriong, S.; Salehzada, T.; Bisbal, C.; Martin and, C.; Taviaux, S.: Localization of the ribonuclease L inhibitor gene (RNS4I), a new member of the interferon-regulated 2-5A pathway, to 4q31 by fluorescence in situ hybridization. Genomics 32:488-490, 1996.

Meyer, J.; Wirth, J.; Held, M.; Schempp, W.; Scherer, G.: SOX20, a new member of the SOX gene family, is located on chromosome 17p13. Cytogenet. Cell Genet. 72:246-249, 1996.

Vujic, M.; Rajic, T.; Goodfellow, P. N.; Stevanovic, M.: cDNA characterization and high resolution mapping of the human SOX20 gene. Mammalian Genome 9:1059-1061, 1998.

Ide, H.; Saito-Ohara, F.; Ohnami, S.; Osada, Y.; Ikeuchi, T.; Yoshida, T.; Terada, M.: Assignment of the BMPR1A and BMPR1B genes to human chromosome 10q22.3 and 4q23-q24 by in situ hybridization and radiation hybrid mapping. Cytogenet. Cell Genet. 81:285-286, 1998.

Carson-Walter, E. B.; Watkins, D. N.; Nanda, A.; Vogelstein, B.; Kinzler, K. W.; St. Croix, B.: Cell surface tumor endothelial markers are conserved in mice and human S. Cancer Res. 61:6649-6655, 2001.

Schuffenhauer, S.; Lichtner, P.; Peykar-Derakhshandeh, P.; Murken, J.; Haas, O. A.; Back, E.; Wolff, G.; Zabel, B.; Barisic, I.; Rauch, A.; Borochowitz, Z.; Dallapiccola, B.; Ross, M.; Meitinger, T.: Deletion mapping on chromosome 10p and definition of a critical region for the second DiGeorge syndrome locus (DGS2). Europ. J. Hum. Genet. 6:213-225, 1998.

Pizzuti, A.; Amati, F.; Calabrese, G.; Mari, A.; Colosimo, A; Silani, V.; Giardino, L.; Ratti, A.; Penso, D.; Calza, L.; Palka, G.; Scarlato, G.; Novelli, G.; Dallapicolla, B.: cDNA characterization and chromosomal mapping of two human homologs of the Drosophila dishevelled polarity gene. Hum. Molec. Genet. 5:953-958, 1996.

Semenov, M. V.; Snyder, M.: Human dishevelled genes constitute a DHR-containing multigene family. Genomics 42:302-310, 1997.

Qiu, J.; Qian, Y.; Chen, V.; Guan, M.-X.; Shen, B.: Human exonuclease 1 functionally complements its yeast homologues in DNA recombination, RNA primer removal, and mutation avoidance. J. Biol. Chem. 274:17893-17900, 1999.

Schmutte, C.; Marinescu, R. C.; Sadoff, M. M.; Guerrette, S.; Overhauser, J.; Fishel, R.: Human exonuclease I interacts with the mismatch repair protein hMSH2. Cancer Res. 58:4537-4542, 1998.

Tishkoff, D. X.; Amin, N. S.; Viars, C. S.; Arden, K. C.; Kolodner, R. D.: Identification of a human gene encoding a homologue of Saccharomyces cerevisiae EXO1, an exonuclease implicated in mismatch repair and recombination. Cancer Res. 58:5027-5031, 1998.

Wilson, D. M., III; Carney, J. P.; Coleman, M. A.; Adamson, A. W.; Christensen, M.; Lamerdin, J. E.: Hex1: a new human Rad2 nuclease family member with homology to yeast exonuclease 1. Nucleic Acids Res. 26:3762-3768, 1998.

St. Croix, B.; Rago, C.; Velculescu, V.; Traverso, G.; Romans, K. E.; Montgomery, E.; Lal, A.; Riggins, G. J.; Lengauer, C.; Vogelstein, B.; Kinzler, K. W.: Genes expressed in human tumor endothelium. Science 289:1197-1202, 2000.

Gosling, J.; Dairaghi, D. J.; Wang, Y.; Hanley, M.; Talbot, D.; Miao, Z.; Schall, T. J.: Cutting edge: identification of a novel chemokine receptor that binds dendritic cell- and T cell-active chemokines including ELC, SLC, and TECK. J. Immun. 164:2851-2856, 2000.

Tseng, B. S.-Y.; Otsuji, M.; Gorski, K.; Huang, X.; Slansky, J. E.; Pai, S. I.; Shalabi, A.; Shin, T.; Pardoll, D. M.; Tsuchiya, H.: B7-DC, a new dendritic cell molecule with potent costimulatory properties for T cells. J. Exp. Med. 193:839-845, 2001.

Cohn, R. D.; Campbell, K. P.: Molecular basis of muscular dystrophies. Muscle Nerve 23:1456-1471, 2000.

Gillespie, C. S.; Lee, M.; Fantes, J. F.; Brophy, P. J.: The gene encoding the Schwann cell protein periaxin localizes on mouse chromosome 7 (Prx). Genomics 41:297-298, 1997.

Gillespie, C. S.; Sherman, D. L.; Fleetwood-Walker, S. M.; Cottrell, D. F.; Tait, S.; Garry, E. M.; Wallace, V. C. J.; Ure, J.; Griffiths, I. R.; Smith, A. Brophy, P. J.: Peripheral demyelination and neuropathic pain behavior in periaxin-deficient mice. Neuron 26:523-531, 2000.

Schuler, G. D.: Sequence mapping by electronic PCR. Genome Res. 7:541-550, 1997.

Takashima, H.; Boerkoel, C. F.; De Jonghe, P.; Ceuterick, C.; Martin, J.-J.; Voit, T.; Schroder, J.-M.; Williams, A.; Brophy, P. J.; Timmerman, V.; Lupski, J. R.: Periaxin mutations cause a broad spectrum of demyelinating neuropathies. Ann. Neurol. 51:709-715, 2002.

Liu, Q.-Y.; Wang, L. F.; Miao, S. Y.; Catterall, J. F.: Expression and characterization of a novel human sperm membrane protein. Biol. Reprod. 54:323-330, 1996.

Miao, S.; Yan, Y.; Li, Y.; Bai, Y.; Wei, S.; Zong, C.; Zhao, M.; Zong, S.; Wang, L.: cDNA encoding a human sperm membrane protein BS-84. Prog. Natural Sci. 5:119-122, 1995.

Wang, H.; Miao, S.; Chen, D.; Wang, L.; Koide, S. S.: Assignment of chromosomal locus and evidence for alternatively spliced mRNAs of a human sperm membrane protein (hSMP-1). Biochim. Biophys. Acta 1447:119-124, 1999.

Horie, M.; Mitsumoto, Y.; Kyushiki, H.; Kanemoto, N.; Watanabe, A.; Taniguchi, Y.; Nishino, N.; Okamoto, T.; Kondo, M.; Mori, T.; Noguchi, K.; Nakamura, Y.; Takahashi, E.; Tanigami, A.: Identification and characterization of TMEFF2, a novel survival factor for hippocampal and mesencephalic neurons. Genomics 67:146-152, 2000.

Uchida, T.; Wada, K.; Akamatsu, T.; Yonezawa, M.; Noguchi, H.; Mizoguchi, A.; Kasuga, M.; Sakamoto, C.: A novel epidermal growth factor-like molecule containing two follistatin modules stimulates tyrosine phosphorylation of erbB-4 in MKN28 gastric cancer cells. Biochem. Biophys. Res. Commun. 266:593-602, 1999.

Young, J.; Biden, K. G.; Simms, L. A.; Huggard, P.; Karamatic, R.; Eyre, H. J.; Sutherland, G. R.; Herath, N.; Barker, M.; Anderson, G. J.; Fitzpatrick, D. R.; Ramm, G. A.; Jass, J. R.; Leggett, B. A.: HPP1: a transmembrane protein-encoding gene commonly methylated in colorectal polyps and cancers. Proc. Nat. Acad. Sci. 98:265-270,2001.

De, S. K.; Enders, G. C.; Andrews, G. K.: High levels of metallothionein messenger RNAs in male germ cells of the adult mouse. Molec. Endocr. 5:628-636, 1991.

Salehi-Ashtiani, K.; Widrow, R. J.; Markert, C. L.; Goldberg, E.: Testis-specific expression of a metallothionein I-driven transgene correlates with undermethylation of the locus in testicular DNA. Proc. Nat. Acad. Sci. 90:8886-8890, 1993.

Sugihara, T.; Wadhwa, R.; Kaul, S. C.; Mitsui, Y.: A novel testis-specific metallothionein-like protein, tesmin, is an early marker of male germ cell differentiation. Genomics 57:130-136, 1999.

Larrouy, D.; Vidal, H.; Andreelli, F.; Laville, M.; Langin, D.: Cloning and mRNA tissue distribution of human PPAR-gamma coactivator-1. Int. J. Obesity 23:1327-1332, 1999.

Lin, J.; Wu, H.; Tarr, P. T.; Zhang, C.-Y.; Wu, Z.; Boss, O.; Michael, L. F.; Puigserver, P.; Isotani, E.; Olson, E. N.; Lowell, B. B.; Bassel-Duby, R.; Spiegelman, B. M.: Transcriptional co-activator PGC-1-alpha drives the formation of slow-twitch muscle fibres. Nature 418:797-801,2002.

Monsalve, M.; Wu, Z.; Adelmant, G.; Puigserver, P.; Fan, M.; Spiegelman, B. M.: Direct coupling of transcription and mRNA processing through the thermogenic coactivator PGC-1. Molec. Cell 6:307-316, 2000.

Puigserver, P.; Adelmant, G.; Wu, Z.; Fan, M.; Xu, J.; O'Malley, B.; Spiegelman, B. M.: Activation of PPAR-gamma coactivator-1 through transcription factor docking. Science 286:1368-1371, 1999.

Puigserver, P.; Rhee, J.; Lin, J.; Wu, Z.; Yoon, J. C.; Zhang, C.-Y.; Krauss, S.; Mootha, V. K.; Lowell, B. B.; Spiegelman, B. M.: Cytokine stimulation of energy expenditure through p38 MAP kinase activation of PPAR-gamma coactivator-1. Molec. Cell 8:971-982,2001.

Puigserver, P.; Wu, Z.; Park, C. W.; Graves, R.; Wright, M.; Spiegelman, B. M.: A cold-inducible coactivator of nuclear receptors linked to adaptive thermogenesis. Cell 92:829-839, 1998.

Waite, L. L.; Person, E. C.; Zhou, Y.; Lim, K.-H.; Scanlan, T. S.; Taylor, R. N.: Placental peroxisome proliferator-activated receptor-gamma is up-regulated by pregnancy serum. J. Clin. Endocr. Metab. 85:3808-3814, 2000.

Wu, Z.; Puigserver, P.; Andersson, U.; Zhang, C.; Adelmant, G.; Mootha, V.; Troy, A.; Cinti, S.; Lowell, B.; Scarpulla, R. C.; Spiegelman, B. M.: Mechanisms controlling mitochondrial biogenesis and respiration through the thermogenic coactivator PGC-1. Cell 98:115-124, 1999.

Yoon, J. C.; Puigserver, P.; Chen, G.; Donovan, J.; Wu, Z.; Rhee, J.; Adelmant, G.; Stafford, J.; Kahn, C. R.; Granner, D. K.; Newgard, C. B.; Spiegelman, B. M.: Control of hepatic gluconeogenesis through the transcriptional coactivator PGC-1. Nature 413:131-138, 2001.

Hadjantonakis, A.-K.; Formstone, C. J.; Little, P. F. R.: mCelsr1 is an evolutionarily conserved seven-pass transmembrane receptor and is expressed during mouse embryonic development. Mech. Dev. 78:91-95, 1998.

Hadjantonakis, A.-K.; Sheward, W. J.; Harmar, A. J.; de Galan, L.; Hoovers, J. M. N.; Little, P. F. R.: Celsr1, a neural-specific gene encoding an unusual seven-pass transmembrane receptor, maps to mouse chromosome 15 and human chromosome 22qter. Genomics 45:97-104,1997.

Hewett-Emmett, D.; Tashian, R. E.: Functional diversity, conservation, and convergence in the evolution of the alpha-, beta-, and gamma-carbonic anhydrase gene families. Molec. Phylogenet. Evol. 5:50-77, 1996.

Hewett-Emmett, D.; Wiebauer, K.: Personal Communication. Houston, Texas Sep. 1999.

Kleiderlein, J. J.; Nisson, P. E.; Jessee, J.; Li, W.-B.; Becker, K. G.; Derby, M. L.; Ross, C. A.; Margolis, R. L.: CCG repeats inc DNAs from human brain. Hum. Genet. 103:666-673, 1998.

Lovejoy, D. A.; Hewett-Emmett, D.; Porter, C. A.; Cepoi, D.; Sheffield, A.; Vale, W. W.; Tashian, R. E.: Evolutionarily conserved, 'acatalytic' carbonic anhydrase-related protein XI contains a sequence motif present in the neuropeptide sauvagine: the human CA-RP XI gene (CA11) is embedded between the secretor gene cluster and the DBP gene at 19q13.3. Genomics 54:484-493, 1998.

Bellingham, J.; Greogory-Evans, K.; Gregory-Evans, C. Y.: Sequence and tissue expression of a human novel carbonic anhydrase-related protein, CARP-2, mapping to chromosome 19q13.3. Biochem. Biophys. Res. Comm. 253:364-367, 1998.

Fujikawa-Adachi, K.; Nishimori, I.; Taguchi, T.; Yuri, K.; Onishi, S.: cDNA sequence, mRNA expression, and chromosomal localization of human carbonic anhydrase-related protein, CA-RP XI. Biochim. Biophys. Acta 1431:518-524, 1999.

Hirai, H.; Tanaka, K.; Takano, S.; Ichimasa, M.; Nakamura, M.; Nagata, K.: Cutting edge: agonistic effect of indomethacin on a prostaglandin D2 receptor, CRTH2. J. Immun. 168:981-985, 2002.

Nagata, K.; Tanaka, K.; Ogawa, K.; Kemmotsu, K.; Imai, Yoshie, O.; Abe, H.; Tada, K.; Nakamura, M.; Sugamura, K.; Takano, S.: Selective expression of a novel surface molecule by human Th2 cells in vivo. J. Immun. 162:1278-1286, 1999.

Grundemann, D.; Schechinger, B.; Rappold, G. A.; Schomig, E.:Molecular identification of the corticosterone-sensitive extraneuronal catecholamine transporter. Nature Neurosci. 1:349-351, 1998.

Boettger, T.; Hubner, C. A.; Maler, H.; Rust, M. B.; Beck, F. X.; Jentsch, T. J.: Deafness and renal tubular acidosis in mice lacking the K-CI co-transporter Kcc4. Nature 416:874-878, 2002.

Kotake, K.; Ozaki, N.; Mizuta, M.; Sekiya, S.; Inagaki, N.; Seino, S.: Noc2, a putative zinc finger protein involved in exocytosis in endocrine cells. J. Biol. Chem. 272:29407-29410, 1997.

Smith, J. S.; Tachibana, I.; Allen, C.; Chiappa, S. A.; Lee, H. K.; McIver, B.; Jenkins, R. B.; Raffel, C.: Cloning of a human ortholog (RPH3AL) of (RNO)Rph3al from a candidate 17p13.3 medulloblastoma tumor suppressor locus. Genomics 59:97-101, 1999.

Kimura, M.; Okano, Y.: Identification and assignment of the human NIMA-related protein kinase 7 gene (NEK7) to human chromosome 1q31.3. Cytogenet. Cell Genet. 94:33-38, 2001.

Li, M. Z.; Yu, L.; Liu, Q.; Chu, J. Y.; Zhao, S. Y.: Assignment of NEK6, a NIMA-related gene, to human chromosome 9q33.3-q34.11 by radiation hybrid mapping. Cytogenet. Cell Genet. 87:271-272, 1999.

Nomura, N.; Miyajima, N.; Sazuka, T.; Tanaka, A.; Kawarabayasi, Y.; Sato, S.; Nagase, T.; Seki, N.; Ishikawa, K.; Tabata, S.: Prediction of the coding sequences of unidentified human genes. I. The coding sequences of 40 new genes (KIAA0001-KIAA0040) deduced by analysis of randomly sampled cDNA clones from human immature myeloid cell lineKG-1. DNA Res. 1:27-35, 1994.

Gilbert, D. J.; Engel, H.; Wang, X.; Grzeschik, K.-H.; Copeland, N. G.; Jenkins, N. A.; Kilimann, M. W.: The neurobeachin gene (Nbea) identifies a new region of homology between mouse central chromosome 3 and human chromosome 13q13. Mamm. Genome 10:1030-1031, 1999.

Nagle, D. L.; Karim, M. A.; Woolf, E. A.; Holmgren, L.; Bork, P.; Misumi, D. J.; McGrail, S. H.; Dussault, B. J., Jr.; Perou, C. M.; Boissy, R. E.; Duyk, G. M.; Spritz, R. A.; Moore, K. J.: Identification and mutation analysis of the complete gene for Chediak-Higashi syndrome. Nature Genet. 14:307-311, 1996.

Wang, X.; Herberg, F. W.; Laue, M. M.; Wullner, C.; Hu, B.; Petrasch-Parwez, E.; Kilimann, M, W.: Neurobeachin: a protein kinase A-anchoring, beige/Chediak-Higashi protein homolog implicated in neuronal membrane traffic. J. Neurosci. 20:8551-8565, 2000.

Bunn, R. C.; Jensen, M. A.; Reed, B. C.: Protein interactions with the glucose transporter binding protein GLUT1CBP that provide a link between GLUT1 and the cytoskeleton. Molec. Biol. Cell 10:819-832, 1999.

De Vries, L.; Lou, X.; Zhao, G.; Zheng, B.; Farquhar, M. G.: GIPC, a PDZ domain containing protein, interacts specifically with the C terminus of RGS-GAIP. Proc. Nat. Acad. Sci. 95:12340-12345, 1998.

Von Kap-Herr, C.; Kandala, G.; Mann, S. S.; Hart, T. C.; Pettenati, M. J.; Setaluri, V.: Assignment of PDZ domain-containing protein GIPC gene (C19orf3) to human chromosome band 19p13.1 by in situ hybridization and radiation hybrid mapping. Cytogenet. Cell Genet. 89:234-235, 2000.

Ludwig, D.; Lorenz, J.; Dejana, E.; Bohlen, P.; Hicklin, D. J.; Witte, L.; Pytowski, B.: cDNA cloning, chromosomal mapping, and expression analysis of human VE-cadherin-2. Mammalian Genome 11:1030-1033,2000.

Telo, P.; Breviario, F.; Huber, P.; Panzeri, C.; Dejana, E.: Identification of a novel cadherin (vascular endothelial cadherin-2) located at intercellular junctions in endothelial cells. J. Biol. Chem. 273:17565-17572,1998.

Janssen, J. W. G.; Imoto, I.; Inoue, J.; Shimada, Y.; Ueda, M.; Imamura, M.; Bartram, C. R.; Inazawa, J.: MYEOV, a gene at 11q13, is coamplified with CCND1, but epigenetically inactivated in a subset of esophageal squamous cell carcinomas. J. Hum. Genet. 47:460-464,2002.

Janssen, J. W. G.; Vaandrager, J.-W.; Heuser, T.; Jauch, A.; Kluin, P. M.; Geelen, E.; Bergsagel, P. L.; Kuehl, W. M.; Drexler, H. G.; Otsuki, T.; Bartram, C. R.; Schuuring, E.: Concurrent activation of a novel putative transforming gene, myeov, and cyclin D1 in a subset of multiple myeloma cell lines with t (11;14)(q13; q32). Blood 95:2691-2698, 2000.

Di Cunto, F.; Calautti, E.; Hsiao, J.; Ong, L.; Topley, G.; Turco, E.; Dotto, G. P.: Citron Rho-interacting kinase, a novel tissue-specific ser/thr kinase encompassing the Rho-Rac-binding protein citron. J. Biol. Chem. 273:29706-29711, 1998.

Di Cunto, F.; Imarisio, S.; Hirsch, E.; Broccoli, V.; Bulfone, A.; Migheli, A.; Atzori, C.; Turco, E.; Triolo, R.; Dotto, G. P.; Silengo, L.; Altruda, F.: Defective neurogenesis in citron kinase knockout mice by altered cytokinesis and massive apoptosis. Neuron 28:115-127, 2000.

Madaule, P.; Furuyashiki, T.; Reid, T.; Ishizaki, T.; Watanabe, G.; Morii, N.; Narumiya, S.: A novel partner for the GTP-bound forms of rho and rac. FEBS Lett. 377:243-248, 1995.

Ishizaki, J.; Suzuki, N.; Higashino, K.; Yokota, Y.; Ono, T.; Kawamoto, K.; Fujii, N.; Arita, H.; Hanasaki, K.: Cloning and characterization of novel mouse and human secretory phospholipase A(2) s. J. Biol. Chem. 274:24973-24979, 1999.

Lopez-Coviella, I.; Berse, B.; Krauss, R.; Thies, R. S.; Blusztajn, J. K.: Induction and maintenance of the neuronal cholinergic phenotype in the central nervous system by BMP-9. Science 289:313-316, 2000.

Uebele, V. N.; Lagrutta, A.; Wade, T.; Figueroa, D. J.; Liu, Y.; McKenna, E.; Austin, C. P.; Bennett, P. B.; Swanson, R.: Cloning and functional expression of two families of beta-subunits of the large conductance calcium-activated K(+) channel. J. Biol. Chem. 275:23211-23218, 2000.

Kouroku, Y.; Soyama, A.; Fujita, E.; Urase, K.; Tsukahara, T.; Momoi, T.: RA70 is a src kinase-associated protein expressed ubiquitously. Biochem. Biophys. Res. Comm. 252:738-742, 1998.

Liu, J.; Kang, H.; Raab, M.; da Silva, A. J.; Kraeft, S.-K.; Rudd, C. E.: FYB (FYN binding protein) serves as a binding partner for lymphoid protein and FYN kinase substrate SKAP55 and a SKAP55-related protein in T cells. Proc. Nat. Acad. Sci. 95:8779-8784, 1998.

Marie-Cardine, A.; Verhagen, A. M.; Eckerskorn, C.; Schraven, B.: SKAP-HOM, a novel adaptor protein homologous to the FYN-associated protein SKAP55. FEBS Lett. 435:55-60, 1998.

Chai, J.; Du, C.; Wu, J.-W.; Kyin, S.; Wang, X.; Shi, Y.: Structural and biochemical basis of apoptotic activation by Smac/DIABLO. Nature 406:855-862, 2000.

Du, C.; Fang, M.; Li, Y.; Li, L.; Wang, X.: Smac, a mitochondrial protein that promotes cytochrome c-dependent caspase activation by eliminating IAP inhibition. Cell 102:33-42, 2000.

Okada, H.; Suh, W.-K.; Jin, J.; Woo, M.; Du, C.; Elia, A.; Duncan, G. S.; Wakeham, A.; Itie, A.; Lowe, S. W.; Wang, X.; Mak, T. W.: Generation and characterization of Smac/DIABLO-deficient mice. Molec. Cell. Biol. 22:3509-3517, 2002.

Scott, A. F.: Personal Communication. Baltimore, Md. Aug. 18, 2000.

Verhagen, A. M.; Ekert, P. G.; Pakusch, M.; Silke, J.; Connolly, L. M.; Reid, G. E.; Moritz, R. L.; Simpson, R. J.; Vaux, D. L.: Identification of DIABLO, a mammalian protein that promotes apoptosis by binding to and antagonizing IAP proteins. Cell 102:43-53, 2000.

Behrens, R.; Nolting, A.; Reimann, F.; Schwarz, M.; Waldschutz, R.; Pongs, O.: hKCNMB3 and hKCNMB4, cloning and characterization of two members of the large-conductance calcium-activated potassium channel beta subunit family. FEBS Lett. 474:99-106, 2000.

Brenner, R.; Jegla, T. J.; Wickenden, A.; Liu, Y.; Aldrich, R. W.: Cloning and functional characterization of novel large conductance calcium-activated potassium channel beta subunits, hKCNMB3 and hKCNMB4. J. Biol. Chem. 275:6453-6461, 2000.

Riazi, M. A.; Brinkman-Mills, P.; Johnson, A.; Naylor, S. L.; Minoshima, S.; Shimizu, N.; Baldini, A.; McDermid, H. E.: Identification of a putative regulatory subunit of a calcium-activated potassium channel in the dup (3q) syndrome region and a related sequence on 22q11.2. Genomics 62:90-94, 1999.

Bagrodia, S.; Taylor, S. J.; Jordon, K. A.; Van Aelst, L.; Cerione, R. A.: A novel regulator of p21-activated kinases. J. Biol. Chem. 273:23633-23636, 1998.

Oh, W. K.; Yoo, J. C.; Jo, D.; Song, Y. H.; Kim, M. G.; Park, D.: Cloning of a SH3 domain-containing proline-rich protein, p85SPR, and its localization in focal adhesion. Biochem. Biophys. Res. Commun. 235:794-798, 1997.

Ehrmann, D. A.; Schwarz, P. E. H.; Hara, M.; Tang, X.; Horikawa, Y.; Imperial, J.; Bell, G. I.; Cox, N. J.: Relationship of calpain-10 genotype to phenotypic features of polycystic ovary syndrome. J. Clin. Endocr. Metab. 87:1669-1673, 2002.

Elbein, S. C.; Chu, W.; Ren, Q.; Hemphill, C.; Schay, J.; Cox, N. J.; Hanis, C. L.; Hasstedt, S. J.: Role of calpain-10 gene variants in familial type 2 diabetes in Caucasians. J. Clin. Endocr. Metab. 87:650-654, 2002.

Fullerton, S. M.; Bartoszewicz, A.; Ybazeta, G.; Horikawa, Y.; Bell, G. I.; Kidd, K. K.; Cox, N. J.; Hudson, R. R.; Di Rienzo, A.: Geographic and haplotype structure of candidate type 2 diabetes-susceptibility variants at the calpain-10 locus. Am. J. Hum. Genet. 70:1096-1106,2002.

Tsai, H.-J.; Sun, G.; Weeks, D. E.; Kaushal, R.; Wolujewicz, M.; McGarvey, S. T.; Tufa, J.; Viali, S.; Deka, R.: Type 2 diabetes and three calpain-10 gene polymorphisms in Samoans: no evidence of association. Am. J. Hum. Genet. 69:1236-1244, 2001.

Weiss, K. M.; Terwilliger, J. D.: How many diseases does it take to map a gene with SNPs? Nature Genet. 26:151-157, 2000.

Hanis, C. L.; Boerwinkle, E.; Chakraborty, R.; Ellsworth, D. L.; Concannon, P.; Stirling, B.; Morrison, V. A.; Wapelhorst, B.; Spielman, R. S.; Gogolin-Ewens, K. J.; Shephard, J. M.; Williams, S. R.; and 21 others: A genome-wide search for human non-insulin-dependent (type 2) diabetes genes reveals a major susceptibility locus on chromosome 2. Nature Genet. 13:161-166, 1996.

Bousquet, O.; Basseville, M.; Vila-Porcile, E.; Billette de Villemeur, T.; Hauw, J.-J.; Landrieu, P.; Portier, M.-M.: Aggregation of a subpopulation of vimentin filaments in cultured human skin fibroblasts derived from patients with giant axonal neuropathy. Cell. Motil. Cytoskeleton 33:115-129, 1996.

Kuhlenbaumer, G.; Young, P.; Oberwittler, C.; Hunermund, G.; Schirmacher, A.; Domschke, K.; Ringelstein, B.; Stogbauer, F.: Giant axonal neuropathy (GAN): case report and two novel mutations in the gigaxonin gene. Neurology 58:1273-1276, 2002. Note: Erratum: Neurology 58:1444, 2002.

Pena, S. D.: Giant axonal neuropathy: an inborn error of organization of intermediate filaments. Muscle Nerve 5:166-172, 1982.

Prineas, J. W.; Ouvrier, R. A.; Wright, R. G.; Walsh, J. C.; McLeod, J. G.: Giant axonal neuropathy: a generalized disorder of cytoplasmic microfilament formation. J. Neuropath. Exp. Neurol. 35:458-470,1976.

Bowe, A. E.; Finnegan, R.; Jan de Beur, S. M.; Cho, J.; Levine, M. A.; Kumar, R.; Schiavi, S. C.: FGF-23 inhibits renal tubular phosphate transport and is a PHEX substrate. Biochem. Biophys. Res. Commun. 284:977-981, 2001.

Shimada, T.; Mizutani, S.; Muto, T.; Yoneya, T.; Hino, R.; Takeda, S.; Takeuchi, Y.; Fujita, T.; Fukumoto, S.; Yamashita, T.: Cloning and characterization of FGF23 as a causative factor of tumor-induced osteomalacia. Proc. Nat. Acad. Sci. 98:6500-6505, 2001.

Strewler, G. J.: FGF23, hypophosphatemia, and rickets: has phosphorylation been found? (Commentary) Proc. Nat. Acad. Sci. 98:5945-5946, 2001.

White, K. E.; Jonsson, K. B.; Carn, G.; Hampson, G.; Spector, T. D.; Mannstadt, M.; Lorenz-Depiereux, B.; Miyauchi, A.; Yang, I. M.; Ljunggren, O.; Meitinger, T.; Strom, T. M.; Juppner, H.; Econs, M. J.: The autosomal dominant hypophosphatemic rickets (ADHR) gene is a secreted polypeptide overexpressed by tumors that cause phosphate wasting. J. Clin. Endocr. Metab. 86:497-500, 2001.

Yamashita, T.; Yoshioka, M.; Itoh, N.: Identification of a novel fibroblast growth factor, FGF-23, preferentially expressed in the ventrolateral thalamic nucleus of the brain. Biochem. Biophys. Res. Commun. 277:494-498, 2000.

Kabarowski, J. H. S.; Zhu, K.; Le, L. Q.; Witte, O. N.; Xu, Y.: Lysophosphatidylcholine as a ligand for the immunoregulatory receptor G2A. Science 293:702-705, 2001.

Barker, R. L.; Gleich, G. J.; Pease, L. R.: Acidic precursor revealed in human eosinophil granule major basic protein cDNA. J. Exp. Med. 168:1493-1498, 1988.

Li, M.-S.; Sun, L.; Satoh, T.; Fisher, L. M.; Spry, C. J. F.: Human eosinophil major basic protein, a mediator of allergic inflammation, is expressed by alternative splicing from two promoters. Biochem. J. 305:921-927, 1995.

McGrogan, M.; Simonsen, C.; Scott, R.; Griffith, J.; Ellis, N.; Kennedy, J.; Campanelli, D.; Nathan, C.; Gabay, J.: Isolation of a complementary DNA clone encoding a precursor to human eosinophil major basic protein. J. Exp. Med. 168: 2295-2308, 1988.

Plager, D. A.; Weiler, D. A.; Loegering, D. A.; Johnson, W. B.; Haley, L.; Eddy, R. L.; Shows, T. B.; Gleich, G. J.: Comparative structure, proximal promoter elements, and chromosome location of the human eosinophil major basic protein genes. Genomics 71:271-281,2001.

Wasmoen, T. L.; Bell, M. P.; Loegering, D. A.; Gleich, G. J.; Prendergast, F. G.; McKean, D. J.: Biochemical and amino acid sequence analysis of human eosinophil granule major basic protein. J. Biol. Chem. 263:12559-12563, 1988.

Weller, P. F.; Ackerman, S. J.; Smith, J. A.: Eosinophil granule proteins: major basic protein is distinct from the smaller subunit of eosinophil peroxidase. J. Leukoc. Biol. 43:1-4, 1988.

Yoshimatsu, K.; Ohya, Y.; Shikata, Y.; Seto, T.; Hasegawa, Y.; Tanaka, I.; Kawamura, T.; Kitoh, K.; Toyoshima, S.; Osawa, T.: Purification and cDNA cloning of a novel factor produced by a human T-cell hybridoma: sequence homology with animal lectins. Molec. Immun. 29:537-546,1992.

Frey, N.; Richardson, J. A.; Olson, E. N.: Calsarcins, a novel family of sarcomeric calcineurin-binding proteins. Proc. Nat. Acad. Sci. 97:14632-14637, 2000.

Faulkner, G.; Pallavicini, A.; Comelli, A.; Salamon, M.; Bortoletto, G.; Ievolella, C.; Trevisan, S.; Kojic, S.; Dalla Vecchia, F.; Laveder, P.; Valle, G.; Lanfranchi, G.: FATZ, a filamin-, actinin-, and telethonin-binding protein of the Z-disc of skeletal muscle. J. Biol. Chem. 275:41234-41242, 2000.

Takada, F.; Vander Woude, D. L.; Tong, H.-Q.; Thompson, T. G.; Watkins, S. C.; Kunkel, L. M.; Beggs, A. H.: Myozenin: an alpha-actinin-and gamma-filamin-binding protein of skeletal muscle Z lines. Proc. Nat. Acad. Sci. 98:1595-1600, 2001.

Scott, A. F.: Personal Communication. Baltimore, Md. Mar. 13, 2001.

Drane, P.; Barel, M.; Balbo, M.; Frade, R.: Identification of RB18A, a 205 kDa new p53 regulatory protein which shares antigenic and functional properties with p53. Oncogene 15:3013-3024, 1997.

Mansharamani, M.; Hewetson, A.; Chilton, B. S.: Cloning and characterization of an atypical type IV P-type ATPase that binds to the RING motif of RUSH transcription factors. J. Biol. Chem. 276:3641-3649, 2001.

Nakayama, Y.; Weissman, S. M.; Bothwell, A. L. M.: BXMAS1 identifies a cluster of homologous genes differentially expressed in B cells. Biochem. Biophys. Res. Commun. 285:830-837, 2001.

Desai, R.; Peretz, A.; Idelson, H.; Lazarovici, P.; Attali, B.: Ca (2+)-activated K(+) channels in human leukemic Jurkat T cells: molecular cloning, biochemical and functional characterization. J. Biol. Chem. 275:39954-39963, 2000.

Duetsch, G.; Illig, T.; Loesgen, S.; Rohde, K.; Kloop, N.; Herbon, N.; Cohlke, H.; Altmueller, J.; Wjst, M.: STAT6 as an asthma candidate gene: polymorphism-screening, association and haplotype analysis in a Caucasian sib-pair study. Hum. Molec. Genet. 11:613-621, 2002.

Wu, H.-K.; Heng, H. H. Q.; Shi, X.-M.; Forsdyke, D. R.; Tsui, L.-C.; Mak, T. W.; Minden, M. D.; Siderovski, D. P.: Differential expression of a basic helix-loop-helix phosphoprotein gene, G0S8, in acute leukemia and localization to human chromosome 1q31. Leukemia 9:1291-1298,1995.

Salcini, A. E.; Confalonieri, S.; Doria, M.; Santolini, E.; Tassi, E.; Minenkova, O.; Cesareni, G.; Pelicci, P. G.; Di Fiore, P. P.: Binding specificity and in vivo targets of the EH domain, a novel protein-protein interaction module. Genes Dev. 11:2239-2249, 1997.

Fish, K. J.; Cegielska, A.; Getman, M. E.; Landes, G. M.; Virshup, D. M.: Isolation and characterization of human casein kinase I-epsilon (CKI), a novel member of the CKI gene family. J. Biol. Chem. 270:14875-14883, 1995.

Kloss, B.; Price, J. L.; Saez, L.; Blau, J.; Rothenfluh, A.; Wesley, C. S.; Young, M. W.: The Drosophila clock gene double-time encodes a protein closely-related to human casein kinase I-epsilon. Cell 94:97-107, 1998.

Lowrey, P. L.; Shimomura, K.; Antoch, M. P.; Yamazaki, S.; Zamenides, P. D.; Ralph, M. R.; Menaker, M.; Takahashi, J. S.: Positional syntenic cloning and functional characterization of the mammalian circadian mutation tau. Science 288:483-491, 2000.

Kools, P. F. J.; Roebroek, A. J. M.; van de Velde, H. J. K.; Marynen, P.; Bullerdiek, J.; Van de Ven, W. J. M.: Regional mapping of the human NSP gene to chromosome region 14q21-q22 by fluorescence in situ hybridization analysis. Cytogenet. Cell Genet. 66:48-50, 1994.

Roebroek, A. J. M.; Ayoubi, T. A. Y.; van de Velde, H. J. K.; Schoenmakers, E. F. P. M.; Pauli, I. G. L.; Van de Ven, W. J. M.: Genomic organization of the human NSP gene, prototype of a novel gene family encoding reticulons. Genomics 32:191-199, 1996.

Roebroek, A. J. M.; van de Velde, H. J. K.; Van Bokhoven, A.; Broers, J. L. V.; Ramaekers, F. C. S.; Van de Ven, W. J. M.: Cloning and expression of alternative transcripts of a novel neuroendocrine-specific gene and identification of its 135-kDa translational product. J. Biol. Chem. 268:13439-13447, 1993.

Senden, N. H. M.; van de Velde, H. J. K.; Broers, J. L. V.; Timmer, E. D. J.; Roebroek, A. J. M.; van de Ven, W. J. M.; Ramaekers, F. C. S.: Cluster-10 lung-cancer antibodies recognize NSPs, novel neuro-endocrine proteins associated with membranes of the endoplasmic reticulum. Int. J. Cancer (Suppl. 8):84-88, 1994.

van de Velde, H. J. K.; Roebroek, A. J. M.; van Leeuwen, F. W.; Van de Ven, W. J. M.: Molecular analysis of expression in rat brain of NSP-A, a novel neuroendocrine-specific protein of the endoplasmic reticulum. Molec. Brain Res. 23:81-92, 1994.

van de Velde, H. J. K.; Senden, N. H. M.; Roskams, T. A. D.; Broers, J. L. V.; Ramaekers, F. C. S.; Roebroek, A. J. M.; Van de Ven, W. J. M.: NSP-encoded reticulons are neuroendocrine markers of a novel category in human lung cancer diagnosis. Cancer Res. 54:4769-4776,1994.

Bullrich, F.; Druck, T.; Kunapuli, P.; Gomez, J.; Gripp, K. W.; Schlegelberger, B.; Lasota, J.; Aronson, M.; Cannizzaro, L. A.; Huebner, K.; Benovic, J. L.: Chromosomal mapping of the genes GPRK5 and GPRK6 encoding G protein-coupled receptor kinases GRK5 and GRK6. Cytogenet. Cell Genet. 70:250-254, 1995.

Haribabu, B.; Snyderman, R.: Identification of additional members of human G-protein-coupled receptor kinase multigene family. Proc. Nat. Acad. Sci. 90:9398-9402, 1993.

Miki, T.; Suzuki, M.; Shibasaki, T.; Uemura, H.; Sato, T.; Yamaguchi, K.; Koseki, H.; Iwanaga, T.; Nakaya, H.; Seino, S.: Mouse model of Prinzmetal angina by disruption of the inward rectifier Kir6.1. Nature Med. 8:466-472, 2002.

Prinzmetal, M.; Kennamer, R.; Merliss, R.; Wada, T.; Bor, N.: Angina pectoris. 1. A variant form of angina pectoris: preliminary report. Am. J. Med. 27:375-388, 1959.

Pristipino, C.; Beltrame, J. F.; Finocchiaro, M. L.; Hattori, R.; Fujita, M.; Mongiardo, R.; Cianflone, D.; Sanna, T.; Sasayama, S.; Maseri, A.: Major racial differences in coronary constrictor response between Japanese and Caucasians with recent myocardial infarction. Circulation 101:1102-1108, 2000.

Hasson, T.; Skowron, J. F.; Gilbert, D. J.; Avraham, K. B.; Perry, W. L.; Bement, W. M.; Anderson, B. L.; Sherr, E. H.; Chen, Z.-Y.; Greene, L. A.; Ward, D. C.; Corey, D. P.; Mooseker, M. S.; Copeland, N. G.; Jenkins, N. A.: Mapping of unconventional myosins in mouse and human. Genomics 36:431-439, 1996.

Chittum, H. S.; Himeno, S.; Hill, K. E.; Burk, R. F.: Multiple forms of seleno protein P in rat plasma. Arch. Biochem. Biophys. 325:124-128, 1996.

Bonne, S.; van Hengel, J.; van Roy, F.: Chromosomal mapping of human armadillo genes belonging to the p120 (ctn)/plakophilin sub family. Genomics 51:452-454, 1998.

Drab, M.; Verkade, P.; Elger, M.; Kasper, M.; Lohn, M.; Lauterbach, B.; Menne, J.; Lindschau, C.; Mende, F.; Luft, F. C.; Schedl, A.; Haller, H.; Kurzchalia, T. V.: Loss of caveolae, vascular dysfunction, and pulmonary defects in caveolin-1 gene-disrupted mice. Science 293:2449-2452, 2001.

Engelman, J. A.; Zhang, X.; Galbiati, F.; Volonte, D.; Sotgia, F.; Pestell, R. G.; Minetti, C.; Scherer, P. E.; Okamoto, T.; Lisanti, M. P.: Molecular genetics of the caveolin gene family: implications for human cancers, diabetes, Alzheimer disease, and muscular dystrophy. Am. J. Hum. Genet. 63:1578-1587, 1998.

Engelman, J. A.; Zhang, X. L.; Galbiati, F.; Lisanti, M. P.: Chromosomal localization, genomic organization, and developmental expression of the murine caveolin gene family (Cav-1, -2, and -3): Cav-1 and Cav-2 genes map to a known tumor suppressor locus (6-A2/7q31). FEBS Lett. 429:330-336, 1998.

Engelman, J. A.; Zhang, X. L.; Lisanti, M. P.: Genes encoding human caveolin-1 and -2 are co-localized to the D7S522 locus (7q31.1), a known fragile site (FRA7G) that is frequently deleted in human cancers. FEBS Lett. 436:403-410, 1998.

Feron, O.; Dessy, C.; Moniotte, S.; Desager, J.-P.; Balligand, J.-L.: Hypercholesterolemia decreases nitric oxide production by promoting the interaction of caveolin and endothelial nitric oxide synthase. J. Clin. Invest. 103:897-905, 1999.

Giordano, S.; Ponzetto, C.; Di Renzo, M. F.; Cooper, C. S.; Comoglio, P. M.: Tyrosine kinase receptor indistinguishable from the c-met protein. Nature 339:155-156, 1989.

Glenney, J. R., Jr.: The sequence of human caveolin reveals identity with VIP21, a component of transport vesicles. FEBS Lett. 314:45-48,1992.

Kurzchalia, T. V.; Dupree, P.; Parton, R. G.; Kellner, R.; Virta, H.; Lehnert, M.; Simons, K.: VIP21, a 21-kD membrane protein is an integral component of trans-Golgi-network-derived transport vesicles. J. Cell Biol. 118:1003-1014, 1992.

Scherer, P. E.; Okamoto, T.; Chun, M.; Nishimoto, I.; Lodish, H. F.; Lisanti, M. P.: Identification, sequence, and expression of caveolin-2 defines a caveolin gene family. Proc. Nat. Acad. Sci. 93:131-135, 1996.

Scherer, P. E.; Tang, Z.; Chun, M.; Sargiacomo, M.; Lodish, H. F.; Lisanti, M. P.: Caveolin isoforms differ in their N-terminal protein sequence and subcellular distribution: identification and epitope mapping of an isoform-specific monoclonal antibody probe. J. Biol. Chem. 270 16395-16401, 1995.

Razani, B.; Engelman, J. A.; Wang, X. B.; Schubert, W.; Zhang, X. L.; Marks, C. B.; Macaluso, F.; Russell, R. G.; Li, M.; Pestell, R. G.; Di Vizio, D.; Hou, H., Jr.; Kneitz, B.; Lagaud, G.; Christ, G. J.; Edelmann, W.; Lisanti, M. P.: Caveolin-1 null mice are viable but show evidence of hyperproliferative and vascular abnormalities. J. Biol. Chem. 276: 38121-38138, 2001.

Bell, D. R.; Plant, N. J.; Rider, C. G.; Na, L.; Brown, S.; Ateitalla, I.; Acharya, S. K.; Davies, M. H.; Elias, E.; Jenkins, N. A.; Gilbert, D. J.; Copeland, N. G.; Elcombe, C. R.: Species-specific induction of cytochrome P-450 4A RNAs: PCR cloning of partial guinea-pig, human and mouse CYP4A cDNAs. Biochem. J. 294:173-180, 1993.

Imaoka, S.; Ogawa, H.; Kimura, S.; Gonzalez, F. J.: Complete cDNA sequence and cDNA-directed expression of CYP4A11, a fatty acid omega-hydroxylase expressed in human kidney. DNA Cell Biol. 12:893-899, 1993.

Kawashima, H.; Kusunose, E.; Kikuta, Y.; Kinoshita, H.; Tanaka, S.; Yamamoto, S.; Kishimoto, T.; Kusunose, M.: Purification and cDNA cloning of human liver CYP4A fatty acid omega-hydroxylase. J. Biochem. 116:74-80, 1994.

Palmer, C. N. A.; Richardson, T. H.; Griffin, K. J.; Hsu, M.-H.; Muerhoff, A. S.; Clark, J. E.; Johnson, E. F.: Characterization of a cDNA encoding a human kidney, cytochrome P-450 4A fatty acid omega-hydroxylase and the cognate enzyme expressed in Escherichia coli. Biochim. Biophys. Acta 1172:161-166, 1993.

Muller, J.; Ory, S.; Copeland, T.; Piwnica-Worms, H.; Morrison, D. K.: C-TAK1 regulates Ras signaling by phosphorylating the MAPK scaffold, KSR1. Molec. Cell 8:983-993, 2001.

Laporte, J.; Hu, L. J.; Kretz, C.; Mandel, J.-L.; Kioschis, P.; Coy, J. F.; Klauck, S. M.; Poustka, A.; Dahl, N.: A gene mutated in X-linked myotubular myopathy defines a new putative tyrosine phosphatase family conserved in yeast. Nature Genet. 13:175-182, 1996.

Hsueh, Y.-P.; Wang, T.-F.; Yang, F.-C.; Sheng, M.: Nuclear transcription and transcription regulation by the membrane-associated guanylate kinase CASK/LIN-2. Nature 404:298-302, 2000.

Nagase, T.; Ishikawa, K.; Suyama, M.; Kikuno, R.; Miyajima, N.; Tanaka, A.; Kotani, H.; Nomura, N.; Ohara, O.: Prediction of the coding sequences of unidentified human genes. XI. The complete sequences of 100 new cDNA clones from brain which code for large proteins in vitro. DNA Res. 5:277-286, 1998.

Gospe, S. M., Jr.; Lazaro, R. P.; Lava, N. S.; Grootscholten, P. M.; Scott, M. O.; Fischbeck, K. H.: Familial X-linked myalgia and cramps: a nonprogressive myopathy associated with a deletion in the dystrophin gene. Neurology 39:1277-1280, 1989.

Kingston, H. M.; Sarfarazi, M.; Thomas, N. S. T.; Harper, P. S.: Localisation of the Becker muscular dystrophy gene on the short arm of the X chromosome by linkage to cloned DNA sequences. Hum. Genet. 67:6-17, 1984.

Kingston, H. M.; Thomas, N. S. T.; Pearson, P. L.; Sarfarazi, M.; Harper, P. S.: Genetic linkage between Becker muscular dystrophy and a polymorphic DNA sequence on the short arm of the X chromosome. J. Med. Genet. 20:255-258, 1983.

Cardoso, C.; Timsit, S.; Villard, L.; Khrestchatisky, M.; Fontes, M.; Colleaux, L.: Specific interaction between the XNP/ATR-X gene product and the SET domain of the human EZH2 protein. Hum. Molec. Genet. 7:679-684, 1998.

Kamal, A.; Stokin, G. B.; Yang, Z.; Xia, C.-H.; Goldstein, L. S.: Axonal transport of amyloid precursor protein is mediated by direct binding to the kinesin light chain subunit of kinesin-I. Neuron 28:449-459, 2000.

Luo, Y.; Bolon, B.; Kahn, S.; Bennett, B. D.; Babu-Khan, S.; Denis, P.; Fan, W.; Kha, H.; Zhang, J.; Gong, Y.; Martin, L.; Louis, J.-C.; Yan, Q.; Richards, W. G.; Citron, M.; Vassar, R.: Mice deficient in BACE1, the Alzheimer's beta-secretase, have normal phenotype and abolished beta-amyloid generation. Nature Neurosci. 4:231-232,2001.

Okamoto, N.; Hori, S.; Akazawa, C.; Hayashi, Y.; Shigemoto, R.; Mizuno, N.; Nakanishi, S.: Molecular characterization of a new metabotropic glutamate receptor mGluR7 coupled to inhibitory cyclic AMP signal transduction. J. Biol. Chem. 269:1231-1236, 1994.

Ango, F.; Prezeau, L.; Muller, T.; Tu, J. C.; Xiao, B.; Worley, P. F.; Pin, J. P.; Bockaert, J.; Fagni, L.: Agonist-independent activation of metabotropic glutamate receptors by the intracellular protein Homer. Nature 411:962-965, 2001.

Offenberg, H. H.; Schalk, J. A. C.; Meuwissen, R. L. J.; van Aalderen, M.; Kester, H. A.; Dietrich, A. J. J.; Heyting, C.: SCP2: a major protein component of the axial elements of synaptonemal complexes of the rat. Nucleic Acids Res. 26:2572-2579, 1998.

Schalk, J. A. C.; Offenberg, H. H.; Peters, E.; Groot, N. P. B.; Hoovers, J. M. N.; Heyting, C.: Isolation and characterization of the human SCP2 cDNA and chromosomal localization of the gene. Mammalian Genome 10:642-644, 1999.

Komada, M.; McLean, D. J.; Griswold, M. D.; Russell, L. D.; Soriano, P.: E-MAP-115, encoding a microtubule-associated protein, is a retinoic acid-inducible gene required for spermatogenesis. Genes Dev. 14:1332-1342, 2000.

Masson, D.; Kreis, T. E.: Identification and molecular characterization of E-MAP-115, a novel microtubule-associated protein predominantly expressed in epithelial cells. J. Cell Biol. 123:357-371, 1993.

Kowalski, P. E.; Freeman, J. D.; Nelson, D. T.; Mager, D. L.: Genomic structure and evolution of a novel gene (PLA2L) with duplicated phospholipase A2-like domains. Genomics 39:38-46, 1997.

Liu, M.; Parker, R. M. C.; Darby, K.; Eyre, H. J.; Copeland, N. G.; Crawford, J.; Gilbert, D. J.; Sutherland, G. R.; Jenkins, N. A.; Herzog, H.: GPR56, a novel secretin-like human G-protein-coupled receptor gene. Genomics 55:296-305, 1999.

Zendman, A. J. W.; Cornelissen, I. M. H. A.; Weidle, U. H.; Ruiter, D. J.; van Muijen, G. N. P.: TM7XN1, a novel human EGF-TM7-like cDNA, detected with mRNA differential display using human melanoma cell lines with different metastatic potential. FEBS Lett. 446:292-298,1999.

Saunders, A. J.; Kim, T.-W.; Tanzi, R. E.: BACE maps to chromosome 11 and a BACE homolog, BACE2, reside in the obligate Down syndrome region of chromosome 21. Science 286:1255a, 1999. Note: Electronic Publication.

Sinha, S.; Anderson, J. P.; Barbour, R.; Basi, G. S.; Caccavello, R.; Davis, D.; Doan, M.; Dovey, H. F.; Frigon, N.; Hong, J.; Jacobson-Croak, K.; Jewett, N.; and 15 others: Purification and cloning of amyloid precursor protein beta-secretase from human brain. Nature 402:537-540,1999.

Vassar, R.; Bennett, B. D.; Babu-Khan, S.; Kahn, S.; Mendiaz, E. A.; Dents, P.; Taplow, D. B.; Ross, S.; Amaranta, P.; Loeloff, R.; Luo, Y.; Fisher, S.; and 12 others: Beta-secretase cleavage of Alzheimer's amyloid precursor protein by the transmembrane aspartic protease BACE. Science 286:735-741, 1999.

Nicolaou, M.; Song, Y.-Q.; Sato, C. A.; Orlacchio, A.; Kawarai, T.; Medeiros, H.; Liang, Y.; Sorbi, S.; Richard, E.; Rogaev, E. I.; Moliaka, Y.; Bruni, A. C.; Jorge, R.; Percy, M.; Duara, R.; Farrer, L. A.; St George-Hyslop, P.; Rogaeva, E. A.: Mutations in the open reading frame of the beta-site APP cleaving enzyme (BACE) locus are not a common cause of Alzheimer's disease. Neurogenetics 3:203-206,2001.

Yan, R.; Bienkowski, M. J.; Shuck, M. E.; Miao, H.; Tory, M. C.; Pauley, A. M.; Brashler, J. R.; Stratman, N. C.; Mathews, W. R.; Buhl, A. E.; Carter, D. B.; Tomaselli, A. G.; Parodi, L. A.; Heinrikson, R. L.; Gurney, M. E.: Membrane-anchored aspartyl protease with Alzheimer's disease beta-secretase activity. Nature 402:533-536, 1999.

Wilson, P. J.; McGlinn, E.; Marsh, A.; Evans, T.; Arnold, J.; Wright, K.; Biden, K.; Young, J.; Wainwright, B.; Wicking, C.; Chenevix-Trench, G.: Sequence variants of DLC1 in colorectal and ovarian tumours. Hum. Mutat. 15:156-165, 2000.

Yuan, B.-Z.; Miller, M. J.; Keck, C. L.; Zimonjic, D. B.; Thorgeirsson, S. S.; Popescu, N. C.: Cloning, characterization, and chromosomal localization of a gene frequently deleted in human liver cancer (DLC-1) homologous to rat RhoGAP. Cancer Res. 58:2196-2199, 1998.

Yuan, B.-Z.; Yang, Y.; Keck-Waggoner, C. L.; Zimonjic, D. B.; Thorgeirsson, S. S.; Popescu, N. C.: Assignment and cloning of mouse Arhgap7 to chromosome 8A4-B2, a conserved syntenic region of human chromosome 8 p22-p21. Cytogenet. Cell Genet. 87:189-190, 1999.

Shinoura, N.; Shamraj, O. I.; Hugenholz, H.; Zhu, J. G.; McBlack, P.; Warnick, R.; Tew, J. J.; Wani, M. A.; Menon, A. G.: Identification and partial sequence of a cDNA that is differentially expressed in human brain tumors. Cancer Lett. 89:215-221, 1995.

Aita, V. M.; Liang, X. H.; Murty, V. V. V. S.; Pincus, D. L.; Yu, W.; Cayanis, E.; Kalachikov, S.; Gilliam, T. C.; Levine, B.: Cloning and genomic organization of beclin 1, a candidate tumor suppressor gene on chromosome 17q21. Genomics 59:59-65, 1999.

Liang, X. H.; Jackson, S.; Seaman, M.; Brown, K.; Kempkes, B.; Hibshoosh, H.; Levine, B.: Induction of autophagy and inhibition of tumorigenesis by beclin 1. Nature 402:672-676, 1999.

Liang, X. H.; Kleeman, L. K.; Jiang, H. H.; Gordon, G.; Goldman, J. E.; Berry, G.; Herman, B.; Levine, B.: Protection against fatal Sindbis virus encephalitis by beclin, a novel Bcl-2-interacting protein. J. Virol. 72:8586-8596, 1998.

Liang, X. H.; Yu, J.; Brown, K.; Levine, B.: Beclin 1 contains a leucine-rich nuclear export signal that is required for its autophagy and tumor suppressor function. Cancer Res. 61:3443-3449, 2001.

Hatamura, I.; Kanauchi, Y.; Takahara, M.; Fujiwara, M.; Muragaki, Y.; Ooshima, A.; Ogino, T.: A nonsense mutation in TRPS1 in a Japanese family with tricho-rhino-phalangeal syndrome type I. (Letter) Clin. Genet. 59:366-367, 2001.

Hilton, M. J.; Sawyer, J. M.; Gutierrez, L.; Hogart, A.; Kung, T. C.; Wells, D. E.: Analysis of novel and recurrent mutations responsible for the tricho-rhino-phalangeal syndromes. J. Hum. Genet. 47:103-106,2002.

Patel, N.; Brinkman-Van der Linden, E. C. M.; Altmann, S. W.; Gish, K.; Balasubramanian, S.; Timans, J. C.; Peterson, D.; Bell, M. P.; Bazan, J. F.; Varki, A.; Kastelein, R. A.: OB-BP1/Siglec-6: a leptin-and sialic acid-binding protein of the immunoglobulin superfamily. J. Biol. Chem. 274:22729-22738, 1999. Note: Erratum: J. Biol. Chem.274:28058 only, 1999.

Miller, A. F.; Harvey, S. A. K.; Thies, R. S.; Olson, M. S.: Bone morphogenetic protein-9: an autocrine/paracrine cytokine in the liver. J. Biol. Chem. 275:17937-17945, 2000.

Scott, A. F.: Personal Communication. Baltimore, Md. Jul. 13, 2000.

Kandil, E.; Kohda, K.; Ishibashi, T.; Tanaka, K.; Kasahara, M.: PA28 subunits of the mouse proteasome: primary structures and chromosomal localization of the genes. Immunogenetics 46:337-344, 1997.

Nikaido, T.; Shimada, K.; Shibata, M.; Hata, M.; Sakamoto, M.; Takasaki, Y.; Sato, C.; Takahashi, T.; Nishida, Y.: Cloning and Nucleotide sequence of cDNA for Ki antigen, a highly conserved nuclear protein detected with sera from patients with systemic lupus erythematosus. Clin. Exp. Immun. 79:209-214, 1990.

Bednarek, A. K.; Keck-Waggoner, C. L.; Daniel, R. L.; Laflin, K. J.; Bergsagel, P. L.; Kiguchi, K.; Brenner, A. J.; Aldaz, C. M.:WWOX, the FRA16D gene, behaves as a suppressor of tumor growth. Cancer Res. 61:8068-8073, 2001.

Bednarek, A. K.; Laflin, K. J.; Daniel, R. L.; Liao, Q.; Hawkins, K. A.; Aldaz, C. M.: WWOX, a novel WW domain-containing protein mapping to human chromosome 16q23.3-24.1, a region frequently affected in breast cancer. Cancer Res. 60:2140-2145, 2000.

Chang, N.-S.; Pratt, N.; Heath, J.; Schultz, L.; Sleve, D.; Carey, G. B.; Zevotek, N.: Hyaluronidase induction of a WW domain-containing oxidoreductase that enhances tumor necrosis factor cytotoxicity. J. Biol. Chem. 276:3361-3370, 2001.

Krummel, K. A.; Denison, S. R.; Calhoun, E.; Phillips, L. A.; Smith, D. I.: The common fragile site FRA16D and its associated gene WWOX are highly conserved in the mouse at Fra8E1. Genes Chromosomes Cancer 34:154-167, 2002.

Acampora, D.; Postiglione, M. P.; Avantaggiato, V.; Di Bonito, M.; Vaccarino, F. M.; Michaud, J.; Simeone, A.: Progressive impairment of developing neuroendocrine cell lineages in the hypothalamus of mice lacking the Orthopedia gene. Genes Dev. 13:2787-2800, 1999.

Lin, X.; State, M. W.; Vaccarino, F. M.; Greally, J.; Hass, M.; Leckman, J. F.: Identification, chromosomal assignment, and expression analysis of the human homeodomain-containing gene Orthopedia (OTP). Genomics 60:96-104, 1999.

Berchtold, S.; Muhl-Zurbes, P.; Heufler, C.; Winklehner, P.; Schuler, G.; Steinkasserer, A.: Cloning, recombinant expression and biochemical characterization of the murine CD83 molecule which is specifically upregulated during dendritic cell maturation. FEBS Lett. 461:211-216,1999.

Fujimoto, Y.; Tu, L.; Miller, A. S.; Bock, C.; Fujimoto, M.; Doyle, C.; Steeber, D. A.; Tedder, T. F.: CD83 expression influences CD4+T cell development in the thymus. Cell 108: 755-767, 2002.

Kozlow, E. J.; Wilson, G. L.; Fox, C. H.; Kehrl, J. H.: Subtractive cDNA cloning of a novel member of the Ig gene superfamily expressed at high levels in activated B lymphocytes. Blood 81:454-461, 1993.

Olavesen, M. G.; Bentley, E.; Mason, R. V.; Stephens, R. J.; Ragoussis, J.: Fine mapping of 39 ESTs on human chromosome 6p23-p25. Genomics 46:303-306, 1997.

Scholler, N.; Hayden-Ledbetter, M.; Hellstrom, K.-E.; Hellstrom, I.; Ledbetter, J. A.: CD83 is a sialic acid-binding Ig-like lectin (Siglec) adhesion receptor that binds monocytes and a subset of activated CD8(+) T cells. J. Immun. 166:3865-3872, 2001.

Schinkmann, K.; Blenis, J.: Cloning and characterization of a human STE20-like protein kinase with unusual cofactor requirements. J. Biol. Chem. 272:28695-28703, 1997.

Zhou, T.-H.; Ling, K.; Guo, J.; Zhou, H.; Wu, Y.-L.; Jing, Q.; Ma, L.; Pei, G.: Identification of a human brain-specific isoform of mammalian STE20-like kinase 3 that is regulated by cAMP-dependent protein kinase. J. Biol. Chem. 275: 2513-2519, 2000.

St-Pierre, M. V.; Hagenbuch, B.; Ugele, B.; Meier, P. J.; Stallmach, T.: Characterization of an organic anion-transporting polypeptide (OATP-B) in human placenta. J. Clin. Endocr. Metab. 87:1856-1863, 2002.

Murthy, A.; Gonzalez-Agosti, C.; Cordero, E.; Pinney, D.; Candia, C.; Solomon, F.; Gusella, J.; Ramesh, V.: NHE-RF, a regulatory cofactor for Na (+)-H(+) exchange, is a common interactor for merlin and ERM(MERM) proteins. J. Biol. Chem. 273:1273-1276, 1998.

Reczek, D.; Berryman, M.; Bretscher, A.: Identification of EBP50:a PDZ-containing phosphoprotein that associates with members of the ezrin-radixin-moesin family. J. Cell Biol. 139:169-179, 1997.

Shenolikar, S.; Voltz, J. W.; Minkoff, C. M.; Wade, J. B.; Weinman, E. J.: Targeted disruption of the mouse NHERF-1 gene promotes internalization of proximal tubule sodium-phosphate cotransporter type IIa and renal phosphate wasting. Proc. Nat. Acad. Sci. 99:11470-11475, 2002.

Boucher, C. A.; Winchester, C. L.; Hamilton, G. M.; Winter, A. D.; Johnson, K. J.; Bailey, M. E. S.: Structure, mapping and expression of the human gene encoding the homeodomain protein, SIX2. Gene 247:145-151, 2000.

Hasan, S.; Stucki, M.; Hassa, P. O.; Imhof, R.; Gehrig, P.; Hunziker, P.; Hubscher, U.; Hottiger, M. O.: Regulation of human flap endonuclease-1 activity by acetylation through the transcriptional coactivator p300. Molec. Cell 7:1221-1231, 2001.

Hiraoka, L. R.; Harrington, J. J.; Gerhard, D. S.; Lieber, M. R.; Hsieh, C.-L.: Sequence of human FEN-1, a structure-specific endonuclease, and chromosomal localization of the gene (FEN1) in mouse and human. Genomics 25:220-225, 1995.

Hosfield, D. J.; Mol, C. D.; Shen, B.; Tainer, J. A.: Structure of the DNA repair and replication endonuclease and exonuclease FEN-1:coupling DNA and PCNA binding to FEN-1 activity. Cell 95:135-146, 1998.

Kucherlapati, M.; Yang, K.; Kuraguchi, M.; Zhao, J.; Lia, M.; Heyer, J.; Kane, M. F.; Fan, K.; Russell, R.; Brown, A. M. C.; Kneitz, B.; Edelmann, W.; Kolodner, R. D.; Lipkin, M.; Kucherlapati, R.: Haploinsufficiency of Flap endonuclease (Fen1) leads to rapid tumor progression. Proc. Nat. Acad. Sci. 99:9924-9929, 2002.

Otto, C. J.; Almqvist, E.; Hayden, M. R.; Andrew, S. E.: The 'flap' endonuclease gene FEN1 is excluded as a candidate gene implicated in the CAG repeat expansion underlying Huntington disease. Clin. Genet. 59:122-127, 2001.

Spiro, C.; Pelletier, R.; Rolfsmeier, M. L.; Dixon, M. J.; Lahue, R. S.; Gupta, G.; Park, M. S.; Chen, X.; Mariappan, S. V. S.; McMurray, C. T.: Inhibition of FEN-1 processing by DNA secondary structure at trinucleotide repeats. Molec. Cell 4:1079-1085, 1999.

Tishkoff, D. X.; Filosi, N.; Gaida, G. M.; Kolodner, R. D.: A novel mutation avoidance mechanism dependent on S. cerevisiae RAD27 is distinct from DNA mismatch repair. Cell 88:253-263, 1997.

Vermeesch, J. R.; Mertens, G.; David, G.; Marynen, P.: Assignment of the human glypican gene (GPC1) to 2q35-q37 by fluorescence in situ hybridization. Genomics 25:327-329, 1995.

Fulop, V.; Bocskei, Z.; Polgar, L.: Prolyl oligopeptidase: an unusual beta-propeller domain regulates proteolysis. Cell 94:161-170, 1998.

Goossens, F. J.; Wauters, J. G.; Vanhoof, G. C.; Bossuyt, P. J.; Schatteman, K. A.; Loens, K.; Scharpe, S. L.: Subregional mapping of the human lymphocyte prolyl oligopeptidase gene (PREP) to human chromosome 6q22. Cytogenet. Cell Genet. 74:99-101, 1996.

Vanhoof, G.; Goossens, F.; Hendriks, L.; De Meester, I.; Hendriks, D.; Vriend, G.; Van Broeckhoven, C.; Scharpe, S.: Cloning and sequence analysis of the gene encoding human lymphocyte prolyl endopeptidase. Gene 149:363-366, 1994.

Goldstein, L. A.; Ghersi, G.; Pineiro-Sanchez, M. L.; Salamone, M.; Yeh, Y.; Flessate, D.; Chen, W.-T.: Molecular cloning of seprase: a serine integral membrane protease from human melanoma. Biochim. Biophys. Acta 1361:11-19, 1997.

Mathew, S.; Scanlan, M. J.; Mohan Raj, B. K.; Murty, V. V. V. S.; Garin-Chesa, P.; Old, L. J.; Rettig, W. J.; Chaganti, R. S. K.: The gene for fibroblast activation protein alpha (FAP), a putative cell surface-bound serine protease expressed in cancer stroma and wound healing, maps to chromosome band 2q23. Genomics 25:335-337, 1995.

Pineiro-Sanchez, M. L.; Goldstein, L. A.; Dodt, J.; Howard, L.; Yeh, Y.; Tran, H.; Argraves, W. S.; Chen, W.-T.: Identification of the 170-kDa melanoma membrane-bound gelatinase (seprase) as a serine integral membrane protease. J. Biol. Chem. 272:7595-7601, 1997.

Scanlan, M. J.; Raj, B. K. M.; Calvo, B.; Garin-Chesa, P.; Sanz-Moncasi, M. P.; Healey, J. H.; Old, L. J.; Rettig, W. J.: Molecular cloning of fibroblast activation protein alpha, a member of the serine protease family selectively expressed in stromal fibroblasts of epithelial cancers. Proc. Nat. Acad. Sci. 91:5657-5661, 1994.

Okumura, K.; Nogami, M.; Taguchi, H.; Dean, F. B.; Chen, M.; Pan, Z.-Q.; Hurwitz, J.; Shiratori, A.; Murakami, Y.; Ozawa, K.; Eki, T.: Assignment of the 36.5-kDa (RFC5), 37-kDa (RFC4), 38-kDa (RFC3), and 40-kDa (RFC2) subunit genes of human replication factor C to chromosome bands 12q24.2-q24.3, 3q27, 13q12.3-q13, and 7q11.23. Genomics 25:274-278, 1995.

Wang, Y.; Cortez, D.; Yazdi, P.; Neff, N.; Elledge, S. J.; Qin, J.: BASC, a super complex of BRCA1-associated proteins involved in the recognition and repair of aberrant DNA structures. Genes Dev. 14:927-939, 2000.

Fernandes-Alnemri, T.; Armstrong, R. C.; Krebs, J.; Srinivasula, S. M.; Wang, L.; Bullrich, F.; Fritz, L. C.; Trapani, J. A.; Tomaselli, K. J.; Litwack, G.; Alnemri, E. S.: In vitro activation of CPP32 and Mch3 by Mch4, a novel human apoptotic cysteine protease containing two FADD-like domains. Proc. Nat. Acad. Sci. 93:7464-7469, 1996.

Fernandes-Alnemri, T.; Litwack, G.; Alnemri, E. S.: CPP32, a novel human apoptotic protein with homology to Caenorhabditis elegans cell death protein Ced-3 and mammalian interleukin-1 beta-converting enzyme. J. Biol. Chem. 269:30761-30764, 1994.

Fernando, P.; Kelly, J. F.; Balazsi, K.; Slack, R. S.; Megeney, L. A.: Caspase 3 activity is required for skeletal muscle differentiation. Proc. Nat. Acad. Sci. 99:11025-11030, 2002.

Huang, Y.; Shin, N.-H.; Sun, Y.; Wang, K. K. W.: Molecular cloning and characterization of a novel caspase-3 variant that attenuates apoptosis induced by proteasome inhibition. Biochem. Biophys. Res. Commun. 283:762-769, 2001.

Kuida, K.; Zheng, T. S.; Na, S.; Kuan, C.; Yang, D.; Karasuyama, H.; Rakio, P.; Flavell, R. A.: Decreased apoptosis in the brain and premature lethality in CPP32-deficient mice. Nature 384:368-372, 1996.

Levkau, B.; Koyama, H.; Raines, E. W.; Clurman, B. E.; Herren, B.; Orth, K.; Roberts, J. M.; Ross, R.: Cleavage of p21(Cip1/Waf1) and p27(Kip1) mediates apoptosis in endothelial cells through activation of Cdk2: role of a caspase cascade. Molec. Cell 1:553-563, 1998.

Nasir, J.; Theilmann, J. L.; Chopra, V.; Jones, A. M.; Walker, D.; Rasper, D. M.; Vaillancourt, J. P.; Hewitt, J. E.; Nicholson, D. W.; Hayden, M. R.: Localization of the cell death genes CPP32and Mch-2 to human chromosome 4q. Mammalian Genome 8:56-59, 1997.

Tiso, N.; Pallavicini, A.; Muraro, T.; Zimbello, R.; Apolloni, E.; Valle, G.; Lanfranchi, G.; Danieli, G. A.: Chromosomal localization of the human genes, CPP32, Mch2, Mch3, and Ich-1, involved in cellular apoptosis. Biochem. Biophys. Res. Commun. 225:983-989, 1996.

Woo, M.; Hakem, R.; Soengas, M. S.; Duncan, G. S.; Shahinian, A.; Kagi, K.; Hakem, A.; McCurrach, M.; Khoo, W.; Kaufman, S. A.; Senaldi, G.; Howard, T.; Lowe, S. W.; Mak, T. W.: Essential contribution of caspase 3/CPP32 to apoptosis and its associated nuclear changes. Genes Dev. 12:806-819, 1998.

Nicholson, D. W.; Ali, A.; Thornberry, N. A.; Vaillancourt, J. P.; Ding, C. K.; Gallant, M.; Gareau, Y.; Griffin, P. R.; Labelle, M.; Lazebnik, Y. A.; Munday, N. A.; Raju, S. M.; Smulson, M. E.; Yamin, T.-T.; Yu, V. L.; Miller, D. K.: Identification and inhibition of the ICE/CED-3 protease necessary for mammalian apoptosis. Nature 376:37-43, 1995. MEDLINE UID:95319529

Bergeron, L.; Perez, G. I.; Macdonald, G.; Shi, L.; Sun, Y.; Jurisicova, A.; Varmuza, S.; Latham, K. E.; Flaws, J. A.; Salter, J. C. M.; Hara, H.; Moskowitz, M. A.; Li, E.; Greenberg, A.; Tilly, J. L.; Yuan, J.: Defects in regulation of apoptosis in caspase-2-deficient mice. Genes Dev. 12:1304-1314, 1998.

Garcia, C. K.; Goldstein, J. L.; Pathak, R. K.; Anderson, R. G. W.; Brown, M. S.: Molecular characterization of a membrane transporter for lactate, pyruvate, and other monocarboxylates: implications for the Cori cycle. Cell 76:865-873, 1994.

Garcia, C. K.; Li, X.; Luna, J.; Francke, U.: cDNA cloning of the human monocarboxylate transporter 1 and chromosomal localization of the SLC16A1 locus to 1p13.2-p12. Genomics 23:500-503, 1994.

Kim, C. M.; Goldstein, J. L.; Brown, M. S.: cDNA cloning of mev, a mutant protein that facilitates cellular uptake of mevalonate, and identification of the point mutation responsible for its gain of function. J. Biol. Chem. 267:23113-23121, 1992.

Geurts, J. M. W.; Schoenmakers, E. F. P. M.; Roijer, E.; Astrom, A.-K.; Stenman, G.; van de Ven, W. J. M.: Identification of NFIB as recurrent translocation partner gene of HMGIC in pleomorphic adenomas. Oncogene 16:865-872, 1998.

Lin, E. Y.; Kozak, C. A.; Orlofsky, A.; Prystowsky, M. B.: The bcl-2 family member, Bcl2a1, maps to mouse chromosome 9 and human chromosome 15. Mammalian Genome 8:293-294, 1997.

Lin, E. Y.; Orlofsky, A.; Berger, M. S.; Prystowsky, M. B.: characterization of A1, a novel hemopoietic-specific early-response gene with sequence similarity to bcl-2. J. Immun. 151:1979-1988, 1993.

Lin, E. Y.; Orlofsky, A.; Wang, H.-G.; Reed, J. C.; Prystowsky, M. B.: A1, a Bcl-2 family member, prolongs cell survival and permits myeloid differentiation. Blood 87:983-992, 1996.

Xiang, Z.; Ahmed, A. A.; Moller, C.; Nakayama, K.; Hatakeyama, S.; Nilsson, G.: Essential role of the prosurvival bcl-2 homologue A1 in mast cell survival after allergic activation. J. Exp. Med. 194:1561-1569, 2001.

Bermingham, J. R., Jr.; Arden, K. C.; Naumova, A. K.; Sapienza, C.; Viars, C. S.; Fu, X.-D.; Khotz, J.; Manley, J. L.; Rosenfeld, M. G.: Chromosomal localization of mouse and human genes encoding the splicing factors ASF/SF2 (SFRS1) and SC-35 (SFRS2). Genomics 29:70-79, 1995.

Wang, J.; Takagaki, Y.; Manley, J. L.: Targeted disruption of an essential vertebrate gene: ASF/SF2 is required for cell viability. Genes Dev. 10:2588-2599, 1996.

Fu, X.-D.; Maniatis, T.: Isolation of a complementary DNA that encodes the mammalian splicing factor SC35. Science 256:535-538,1992.

Kuhlenbaeumer, G.; Meuleman, J.; Schirmacher, A.; Stoegbauer, F.; Ringelstein, E. B.; Wehnert, M.; Hoeltzenbein, M.; Broeckhoven, C. V.; Timmerman, V.: Mutation analysis of a putative sialyl transferase gene, the SFRS2 splicing factor gene and the c-myb ET-locus in two families with hereditary neuralgic amyotrophy (HNA). Ann. Hum. Genet. 62:397-400, 1998.

Wang, H.-Y.; Xu, X.; Ding, J.-H.; Bermingham, J. R., Jr.; Fu, X.-D.: SC35 plays a role in T cell development and alternative splicing of CD45. Molec. Cell 7:331-342, 2001.

Hopfner, K.-P.; Karcher, A.; Craig, L.; Woo, T. T.; Carney, J. P.; Tainer, J. A.: Structural biochemistry and interaction architecture of the DNA double-strand break repair Mre11 nuclease and Rad50-ATPase. Cell 105:473-485, 2001.

Stracker, T. H.; Carson, C. T.; Weitzman, M. D.: Adenovirus oncoproteins inactivate the Mre11-Rad50-NBS1 DNA repair complex. Nature 418:348-352, 2002.

Zhong, Q.; Chen, C.-F.; Li, S.; Chen, Y.; Wang, C.-C.; Xiao, J.; Chen, P.-L.; Sharp, Z. D.; Lee, W.-H.: Association of BRCA1 with the hRad50-hMre11-p95 complex and the DNA damage response. Science 285:747-750, 1999.

Zhu, X.-D.; Kuster, B.; Mann, M.; Petrini, J. H. J.; de Lange, T.: Cell-cycle-regulated association of RAD50/MRE11/NBS1 with TRF2 and human telomeres. Nature Genet. 25:347-352, 2000.

Virbasius, C. A.; Virbasius, J. V.; Scarpulla, R. C.: NRF-1, an activator involved in nuclear-mitochondrial interactions, utilizes a new DNA-binding domain conserved in a family of developmental regulators. Genes Dev. 7:2431-2445, 1993.

Choi, S. S.; Park, I.-C.; Yun, J. W.; Sung, Y. C.; Hong, S.-I.; Shin, H.-S.: A novel Bcl-2 related gene, Bfl-1, is overexpressed in stomach cancer and preferentially expressed in bone marrow. Oncogene 11:1693-1698, 1995.

Choi, S. S.; Park, S. H.; Kim, U.-J.; Shin, H.-S.: Bfl-1, a Bcl-2-related gene, is the human homolog of the murine A1, and maps to chromosome 15q24.3. Mammalian Genome 8:781-782, 1997.

D'Sa-Eipper, C.; Subramanian, T.; Chinnadurai, G.: Bfl-1, a bcl-2homologue, suppresses p53-induced apoptosis and exhibits potent cooperative transforming activity. Cancer Res. 56:3879-3882, 1996.

Bass, B. L.; Weintraub, H.: An unwinding activity that covalently modifies its double-stranded RNA substrate. Cell 55:1089-1098,1988.

Kim, U.; Wang, Y.; Sanford, T.; Zeng, Y.; Nishikura, K.: molecular cloning of cDNA for double-stranded RNA adenosine deaminase, a candidate enzyme for nuclear RNA editing. Proc. Nat. Acad. Sci. 91:11457-11461,1994.

O'Connell, M. A.; Krause, S.; Higuchi, M.; Hsuan, J. J.; Totty, N. F.; Jenny, A.; Keller, W.: Cloning of cDNAs encoding mammalian double-stranded RNA-specific adenosine deaminase. Molec. Cell. Biol. 15:1389-1397, 1995.

Patterson, J. B.; Samuel, C. E.: Expression and regulation by interferon of a double-stranded-RNA-specific adenosine deaminase from human cells: evidence for two forms of the deaminase. Molec. Cell. Biol. 15:5376-5388, 1995.

Wang, Q.; Khillan, J.; Gadue, P.; Nishikura, K.: Requirement of the RNA editing deaminase ADAR1 gene for embryonic erythropoiesis. Science 290:1765-1768, 2000.

Wang, Y.; Zeng, Y.; Murray, J. M.; Nishikura, K.: Genomic organization and chromosomal location of the human dsRNA adenosine deaminase gene: the enzyme for glutamate-activated ion channel RNA editing. J. Molec. Biol. 254:184-195, 1995.

Weier, H.-U. G.; George, C. X.; Greulich, K. M.; Samuel, C. E.: The interferon-inducible, double-stranded RNA-specific adenosine deaminase gene (DSRAD) maps to human chromosome 1q21.1-21.2. Genomics 30:372-375, 1995.

Weier, H.-U. G.; George, C. X.; Lersch, R. A.; Breitweser, S.; Cheng, J.-F.; Samuel, C. E.: Assignment of the RNA-specific adenosine deaminase gene (Adar) to mouse chromosome 3F2 by in situ hybridization. Cytogenet. Cell Genet. 89:214-215, 2000.

Lin, Q.; Schwarz, J.; Bucana, C.; Olson, E. N.: Control of mouse cardiac morphogenesis and myogenesis by transcription factor MEF2C. Science 276:1404-1407, 1997.

Akama, T. O.; Nakagawa, H.; Sugihara, K.; Narisawa, S.; Ohyama, C.; Nishimura, S.-I.; O'Brien, D. A.; Moremen, K. W.; Millan, J. L.; Fukuda, M. N.: Germ cell survival through carbohydrate-mediated interaction with Sertoli cells. Science 295:124-127, 2002.

Bai, R.-Y.; Koester, C.; Ouyang, T.; Hahn, S. A.; Hammerschmidt, M.; Peschel, C.; Duyster, J.: SMIF, a Smad4-interacting protein that functions as a co-activator in TGF-beta signalling. Nature Cell Biol. 4:181-190, 2002.

Akiyama, Y.; Tsubouchi, N.; Yuasa, Y.: Frequent somatic mutations of hMSH3 with reference to microsatellite instability in hereditary nonpolyposis colorectal cancer. Biochem. Biophys. Res. Commun. 236:248-252, 1997.

Chittenden, T.; Harrington, E. A.; O'Connor, R.; Flemington, C.; Lutz, R. J.; Evan, G. I.; Guild, B. C.: Induction of apoptosis by the Bcl-2 homologue Bak. Nature 374:733-736, 1995.

Herberg, J. A.; Phillips, S.; Beck, S.; Jones, T.; Sheer, D.; Wu, J. J.; Prochazka, V.; Barr, P. J.; Kiefer, M. C.; Trowsdale, J.: Genomic structure and domain organisation of the human Bak gene. Gene 211:87-94, 1998.

Kiefer, M. C.; Brauer, M. J.; Powers, V. C.; Wu, J. J.; Umansky, S. R.; Tomei, L. D.; Barr, P. J.: Modulation of apoptosis by the widely distributed Bcl-2 homologue Bak. Nature 374:736-739, 1995.

Ulrich, E.; Kauffmann-Zeh, A.; Hueber, A.-O.; Williamson, J.; Chittenden, T.; Ma, A.; Evan, G.: Gene structure, cDNA sequence, and expression of murine Bak, a proapoptotic Bcl-2 family member. Genomics 44:195-200, 1997.

Higuchi, M.; Maas, S.; Single, F. N.; Hartner, J.; Rozov, A.; Burnashev, N.; Feldmeyer, D.; Sprengel, R.; Seeburg, P. H.: Point mutation in an AMPA receptor gene rescues lethality in mice deficient in the RNA-editing enzyme ADAR2. Nature 406:78-81, 2000.

Lai, F.; Chen, C.-X.; Carter, K. C.; Nishikura, K.: Editing of glutamate receptor B subunit ion channel RNAs by four alternatively spliced DRADA2 double-stranded RNA adenosine deaminases. Molec. Cell. Biol. 17:2413-2424, 1997.

Melcher, T.; Maas, S.; Herb, A.; Sprengel, R.; Seeburg, P. H.; Higuchi, M.: A mammalian RNA editing enzyme. Nature 379:460-463,1996.

Mittaz, L.; Scott, H. S.; Rossier, C.; Seeburg, P. H.; Higuchi, M.; Antonarakis, S. E.: Cloning of a human RNA editing deaminase (ADARB1) of glutamate receptors that maps to chromosome 21q22.3. Genomics 41:210-217, 1997.

O'Connell, M. A.; Gerber, A.; Keller, W.: Purification of human double-stranded RNA-specific editase 1 (hRED1) involved in editing of brain glutamate receptor B pre-mRNA. J. Biol. Chem. 272:473-478,1997.

Villard, L.; Tassone, F.; Haymowicz, M.; Welborn, R.; Gardiner, K.: Map location, genomic organization and expression patterns of the human RED1 RNA editase. Somat. Cell Molec. Genet. 23:135-145,1997.

Yang, J.-H.; Sklar, P.; Axel, R.; Maniatis, T.: Purification and characterization of a human RNA adenosine deaminase for glutamate receptor B pre-mRNA editing. Proc. Nat. Acad. Sci. 94:4354-4359,1997.

Zhao, Z.; Lee, C.-C.; Monckton, D. G.; Yazdani, A.; Coolbaugh, M. I.; Li, X.; Bailey, J.; Shen, Y.; Caskey, C. T.: Characterization and genomic mapping of genes and pseudogenes of a new human protein tyrosine phosphatase. Genomics 35:172-181, 1996.

Chopra, V. S.; Metzler, M.; Rasper, D. M.; Engqvist-Goldstein, A. E. Y.; Singaraja, R.; Gan, L.; Fichter, K. M.; McCutcheon, K.; Drubin, D.; Nicholson, D. W.; Hayden, M. R.: HIP12 is a non-proapoptotic member of a gene family including HIP1, an interacting protein with huntingtin. Mammalian Genome 11:1006-1015, 2000.

Cerretti, D. P.; Nelson, N.: Characterization of the genes for mouse LERK-3/Ephrin-A3 (Epl3), mouse LERK-4/Ephrin-A4 (Epl4), and human LERK-6/Ephrin-A2 (EPLG6): conservation of intron/exon structure. Genomics 47:131-135, 1998.

Ma, T.; Yang, B.; Kuo, W.-L.; Verkman, A. S.: cDNA cloning and gene structure of a novel water channel expressed exclusively in human kidney: evidence for a gene cluster of aquaporins at chromosome locus12q13. Genomics 35:543-550, 1996.

Yasui, M.; Kwon, T.-H.; Knepper, M. A.; Nielsen, S.; Agre, P.: Aquaporin-6: an intracellular vesicle water channel protein in renal epithelia. Proc. Nat. Acad. Sci. 96:5808-5813, 1999.

An, S.; Yang, J.; Xia, M.; Goetzl, E. J.: Cloning and expression of the EP2 subtype of human receptors for prostaglandin E2. Biochem. Biophys. Res. Comm. 197:263-270, 1993.

Bastien, L.; Sawyer, N.; Grygorczyk, R.; Metters, K. M.; Adam, M.: Cloning, functional expression and characterization of the human Prostaglandin E2 receptor EP2 subtype. J. Biol. Chem. 269:11873-11877,1994.

Coleman, R. A.; Grix, S. P.; Head, S. A.; Louttit, J. B.; Mallett, A.; Sheldrick, R. L. G.: A novel inhibitory prostanoid receptor in piglet saphenous vein. Prostaglandins 47:151-168, 1994.

Foord, S. M.; Marks, B.; Stolz, M.; Bufflier, E.; Fraser, N. J.; Lee, M. G.: The structure of the prostaglandin EP4 receptor gene and related pseudogenes. Genomics 35:182-188, 1996.

Mori, K.; Tanaka, I.; Kotani, M.; Miyaoka, F.; Sando, T.; Muro, S.; Sasaki, Y.; Nakagawa, O.; Ogawa, Y.; Usui, T.; Ozaki, S.; Ichikawa, A.; Narumiya, S.; Nakao, K.: Gene expression of the human prostaglandin E receptor EP4 subtype: differential regulation in monocytoid and lymphoid lineage cells by phorbol ester. J. Molec. Med. 74:333-336,1996.

Regan, J. W.; Bailey, T. J.; Pepperl, D. J.; Pierce, K. L.; Bogardus, A. M.; Donello, J. E.; Fairbairn, C. E.; Kedzie, K. M.; Woodward, D. F.; Gil, D. W.: Cloning of a novel human prostaglandin receptor with characteristics of the pharmacologically defined EP2 subtype. Molec. Pharm. 46:213-220, 1994.

Segi, E.; Sugimoto, Y.; Yamasaki, A.; Aze, Y.; Oida, H.; Nishimura, T.; Murata, T.; Matsuoka, T.; Ushikubi, F.; Hirose, M.; Tanaka, T.; Yoshida, N.; Narumiya, S.; Ichikawa, A.: Patent ductus arteriosus and neonatal death in prostaglandin receptor EP4-deficient mice. Biochem. Biophys. Res. Comm. 246:7-12, 1998.

Yoshida, K.; Oida, H.; Kobayashi, T.; Maruyama, T.; Tanaka, M.; Katayama, T.; Yamaguchi, K.; Segi, E.; Tsuboyama, T.; Matsushita, M.; Ito, K.; Ito, Y.; Sugimoto, Y.; Ushikubi, F.; Ohuchida, S.; Kondo, K.; Nakamura, T.; Narumiya, S.: Stimulation of bone formation and prevention of bone loss by prostaglandin E EP4 receptor activation. Proc. Nat. Acad. Sci. 99:4580-4585, 2002.

Jadayel, D. M.; Osborne, L. R.; Coignet, L. J. A.; Zani, V. J.; Tsui, L.-C.; Scherer, S. W.; Dyer, M. J. S.: The BCL7 gene family: deletion of BCL7B in Williams syndrome. Gene 224: 35-44, 1998.

Arima, T.; Drewell, R. A.; Arney, K. L.; Inoue, J.; Makita, Y.; Hata, A.; Oshimura, M.; Wake, N.; Surani, M. A.: A conserved imprinting control region at the HYMAI/ZAC domain is implicated in transient neonatal diabetes mellitus. Hum. Molec. Genet. 10:1475-1483, 2001.

Joung, I.; Strominger, J. L.; Shin, J.: Molecular cloning of aphosphotyrosine-independent ligand of the p56-lck SH2 domain. Proc. Nat. Acad. Sci. 93:5991-5995, 1996.

Laurin, N.; Brown, J. P.; Morissette, J.; Raymond, V.: Recurrent mutation of the gene encoding sequestosome 1 (SQSTM1/p62) in Paget disease of bone. Am. J. Hum. Genet. 70:1582-1588, 2002.

Park, I.; Chung, J.; Walsh, C. T.; Yun, Y.; Strominger, J. L.; Shin, J.: Phosphotyrosine-independent binding of a 62-kDa protein to the src homology 2 (SH2) domain of p56-lck and its regulation by phosphorylation of ser-59 in the lck unique N-terminal region. Proc. Nat. Acad. Sci. 92:12338-12342, 1995.

Vadlamudi, R. K.; Joung, I.; Strominger, J. L.; Shin, J.: p62, a phosphotyrosine-independent ligand of the SH2 domain of p56-lck, belongs to a new class of ubiquitin-binding proteins. J. Biol. Chem. 271:20235-20237, 1996.

Akbar, G. K. M.; Dasari, V. R.; Webb, T. E.; Ayyanathan, K.; Pillarisetti, K.; Sandhu, A. K.; Athwal, R. S.; Daniel, J. L.; Ashby, B.; Barnard, E. A.; Kunapuli, S. P.: Molecular cloning of a novel P2 purinoceptor from human erythroleukemia cells. J. Biol. Chem. 271:18363-18367,1996.

Chen, X.-S.; Sheller, J. R.; Johnson, E. N.; Funk, C. D.: Role of leukotrienes revealed by targeted disruption of 5-lipoxygenase gene. Nature 372:179-182, 1994.

Devchand, P. R.; Keller, H.; Peters, J. M.; Vazquez, M.; Gonzalez, F. J.; Wahli, W.: The PPAR alpha-leukotriene B4 pathway to inflammation control. Nature 384:39-43, 1996.

Kato, K.; Yokomizo, T.; Izumi, T.; Shimizu, T.: Cell-specific transcriptional regulation of human leukotriene B4 receptor gene. J. Exp. Med. 192:413-420, 2000.

Owman, C.; Nilsson, C.; Lolait, S. J.: Cloning of cDNA encoding a putative chemoattractant receptor. Genomics 37:187-194, 1996.

Samuelsson, B.; Dahlen, S. E.; Lindgren, J. A.; Rouzer, C. A.; Serhan, C. N.: Leukotrienes and lipoxins: structures, biosynthesis, and biological effects. Science 237:1171-1176, 1987.

Yokomizo, T.; Izumi, T.; Chang, K.; Takuwa, Y.; Shimizu, T.: AG-protein-coupled receptor for leukotriene B4 that mediates chemotaxis. Nature 387:620-624, 1997.

Fernandes-Alnemri, T.; Litwack, G.; Alnemri, E. S.: Mch2, a new member of the apoptotic Ced-3/Ice cysteine protease gene family. Cancer Res. 55:2737-2742, 1995.

Orth, K.; Chinnaiyan, A. M.; Garg, M.; Froelich, C. J.; Dixit, V. M.: The CED-3/ICE-like protease Mch2 is activated during apoptosis and cleaves the death substrate lamin A. J. Biol. Chem. 271:16443-16446,1996.

Verhaegh, G. W. C. T.; Jongmans, W.; Jaspers, N. G. J.; Natarajan, A. T.; Oshimura, M.; Lohman, P. H. M.; Zdzienicka, M. Z.: A gene that regulates DNA replication in response to DNA damage is located on human chromosome 4q. Am. J. Hum. Genet. 57:1095-1103, 1995.

Kubo, Y.; Reuveny, E.; Slesinger, P. A.; Jan, Y. N.; Jan, L. Y.: Primary structure and functional expression of a rat G-protein-coupled muscarinic potassium channel. Nature 364:802-806, 1993.

Schoots, O.; Voskoglou, T.; Van Tol, H. H. M.: Genomic organization and promoter analysis of the human G-protein-coupled K+ channel Kir3.1(KCNJ3/HGIRK1). Genomics 39:279-288, 1997.

Schoots, O.; Yue, K.-T.; MacDonald, J. F.; Hampson, D. R.; Nobrega, J. N.; Dixon, L. M.; Van Tol, H. H. M.: Cloning of a G protein-activated inwardly rectifying potassium channel from human cerebellum. Molec. Brain Res. 39:23-30, 1996.

Stoffel, M.; Espinosa, R., III; Powell, K. L.; Philipson, L. H.; Le Beau, M. M.; Bell, G. I.: Human G-protein-coupled inwardly rectifying potassium channel (GIRK1) gene (KCNJ3): localization to chromosome 2 and identification of a simple tandem repeat polymorphism. Genomics 21:254-256, 1994.

Phillips, H. A.; Scheffer, I. E.; Berkovic, S. F.; Hollway, G. E.; Sutherland, G. R.; Mulley, J. C.: Localization of a gene for autosomal dominant nocturnal frontal lobe epilepsy to chromosome 20q13.2. Nature Genet. 10:117-118, 1995.

Phillips, H. A.; Scheffer, I. E.; Crossland, K. M.; Bhatia, K. P.; Fish, D. R.; Marsden, C. D.; Howell, S. J. L.; Stephenson, J. B. P.; Tolmie, J.; Plazzi, G.; Eeg-Olofsson, O.; Singh, R.; Lopes-Cendes, I.; Andermann, E.; Andermann, F.; Berkovic, S. F.; Mulley, J. C.: Autosomal dominant nocturnal frontal-lobe epilepsy: genetic heterogeneity and evidence for a second locus at 15q24. Am. J. Hum. Genet. 63:1108-1116, 1998.

d'Arcangelo, G.: Personal Communication. Nutley, N. J. Jun. 2, 1995.

d'Arcangelo, G.; Homayouni, R.; Keshvara, L.; Rice, D. S.; Sheldon, M.; Curran, T.: Reelin is a ligand for lipoprotein receptors. Neuron 24:471-479, 1999.

d'Arcangelo, G.; Miao, G. G.; Chen, S.-C.; Soares, H. D.; Morgan, J. I.; Curran, T.: A protein related to extracellular matrix proteins deleted in the mouse mutant reeler. Nature 374:719-723, 1995.

DeSilva, U.; d'Arcangelo, G.; Braden, V. V.; Chen, J.; Miao, G. G.; Curran, T.; Green, E. D.: The human reelin gene: isolation, sequencing, and mapping on chromosome 7. Genome Res. 7:157-164, 1997.

Green, M. C.: Catalog of mutant genes and polymorphic loci. In:Lyon, M. F.; Searle, A. G.: Genetic Variants and Strains of the Laboratory Mouse. Oxford: Oxford Univ. Press (pub.) (2nd ed.):1989.

Hack, I.; Bancila, M.; Loulier, K.; Carroll, P.; Cremer, H.: Reelin is a detachment signal in tangential chain-migration during postnatal neurogenesis. Nature Neurosci. 5:939-945, 2002.

Hirotsune, S.; Takahara, T.; Sasaki, N.; Hirose, K.; Yoshiki, A.; Ohashi, T.; Kusakabe, M.; Murakami, Y.; Muramatsu, M.; Watanabe, S.; Nakao, K.; Katsuki, M.; Hayashizaki, Y.: The reeler gene encodes a protein with an EGF-like motif expressed by pioneer neurons. Nature Genet. 10:77-83, 1995.

Hong, S. E.; Shugart, Y. Y.; Huang, D. T.; Al Shahwan, S.; Grant, P. E.; Hourihane, J. O.; Martin, N. D. T.; Walsh, C. A.: Autosomal recessive lissencephaly with cerebellar hypoplasia is associated with human RELN mutations. Nature Genet. 26:93-96, 2000. Note: Erratum: Nature Genet. 27:225 only, 2001.

Hourihane, J. O.; Bennett, C. P.; Chaudhuri, R.; Robb, S. A.; Martin, N. D. T.: A sibship with a neuronal migration defect, cerebellar hypoplasia and congenital lymphedema. Neuropediatrics 24:43-46,1993.

Impagnatiello, F.; Guidotti, A. R.; Pesold, C.; Dwivedi, Y.; Caruncho, H.; Pisu, M. G.; Uzunov, D. P.; Smalheiser, N. R.; Davis, J. M.; Pandey, G. N.; Pappas, G. D.; Tueting, P.; Sharma, R. P.; Costa, E.: A decrease of reelin expression as a putative vulnerability factor in schizophrenia. Proc. Nat. Acad. Sci. 95:15718-15723, 1998.

Magdaleno, S.; Keshvara, L.; Curran, T.: Rescue of ataxia and preplate splitting by ectopic expression of reelin in reeler mice. Neuron 33:573-586, 2002.

Royaux, I.; Lambert de Rouvroit, C.; d'Arcangelo, G.; Demirov, D.; Goffinet, A. M.: Genomic organization of the mouse reelin gene. Genomics 46:240-250, 1997.

Yip, J. W.; Yip, Y. P. L.; Nakajima, K.; Capriotti, C.: Reelin controls position of autonomic neurons in the spinal cord. Proc. Nat. Acad. Sci. 97:8612-8616, 2000.

Anderson, D. W.; Probst, F. J.; Belyantseva, I. A.; Fridell, R. A.; Beyer, L.; Martin, D. M.; Wu, D.; Kachar, B.; Friedman, T. B.; Raphael, Y.; Camper, S. A.: The motor and tail regions of myosin XV are critical for normal structure and function of auditory and vestibular hair cells. Hum. Molec. Genet. 9:1729-1738, 2000.

Probst, F. J.; Fridell, R. A.; Raphael, Y.; Saunders, T. L.; Wang, A.; Liang, Y.; Morell, R. J.; Touchman, J. W.; Lyons, R. H.; Noben-Trauth, K.; Friedman, T. B.; Camper, S. A.: Correction of deafness in shaker-2 mice by an unconventional myosin in a BAC transgene. Science 280:1444-1447, 1998.

Wang, A.; Liang, Y.; Fridell, R. A.; Probst, F. J.; Wilcox, E. R.; Touchman, J. W.; Morton, C. C.; Morell, R. J.; Noben-Trauth, K.; Camper, S. A.; Friedman, T. B.: Association of unconventional myosin MYO15 mutations with human non-syndromic deafness DFNB3. Science 280:1447-1451, 1998.

Wilton, S. D.; Lim, L.; Dorosz, S. D.; Gunn, H. C.; Eyre, H. J.; Callen, D. F.; Laing, N. G.: Assignment of the human alpha-tropomyosin gene TPM4 to band 19p13.1 by fluorescence in situ hybridization. Cytogenet. Cell Genet. 72:294-296, 1996.

Lazzaro, M. A.; Picketts, D. J.: Cloning and characterization of the murine Imitation Switch (ISWI) genes: differential expression patterns suggest distinct developmental roles for Snf2h and Snf2l. J. Neurochem. 77:1145-1156, 2001.

Okabe, I.; Bailey, L. C.; Attree, O.; Srinivasan, S.; Perkel, J. M.; Laurent, B. C.; Carlson, M.; Nelson, D. L.; Nussbaum, R. L.: Cloning of human and bovine homologs of SNF2/SWI2: a global activator of transcription in yeast S. cerevisiae. Nucleic Acids Res. 20:4649-4655, 1992.

De Plaen, E.; Arden, K.; Traversari, C.; Gaforio, J. J.; Szikora, J.-P.; De Smet, C.; Brasseur, F.; van der Bruggen, P.; Lethe, B.; Lurquin, C.; Brasseur, R.; Chomez, P.; De Backer, O.; Cavenee, W.; Boon, T.: Structure, chromosomal localization, and expression of 12 genes of the MAGE family. Immunogenetics 40:360-369, 1994.

Rogner, U. C.; Wilke, K.; Steck, E.; Korn, B.; Poustka, A.: The melanoma antigen gene (MAGE) family is clustered in the chromosomal band Xq28. Genomics 29:725-731, 1995.

Chakarova, C.; Wehnert, M. S.; Uhl, K.; Sakthivel, S.; Vosberg, H.-P.; van der Ven, P. F. M.; Furst, D. O.: Genomic structure and fine mapping of the two human filamin gene paralogues FLNB and FLNC and comparative analysis of the filamin gene family. Hum. Genet. 107:597-611, 2000.

Fink, J. M.; Dobyns, W. B.; Guerrini, R.; Hirsch, B. A.: Identification of a duplication of Xq28 associated with bilateral periventricular nodular heterotopia. Am. J. Hum. Genet. 61:379-387, 1997.

Fox, J. W.; Lamperti, E. D.; Eksioglu, Y. Z.; Hong, S. E.; Feng, Y.; Graham, D. A.; Scheffer, I. E.; Dobyns, W. B.; Hirsch, B. A.; Radtke, R. A.; Berkovic, S. F.; Huttenlocher, P. R.; Walsh, C. A.: Mutations in filamin 1 prevent migration of cerebral cortical neurons in human periventricular heterotopia. Neuron 21:1315-1325, 1998.

Gariboldi, M.; Maestrini, E.; Canzian, F.; Manenti, G.; De Gregorio, L.; Rivella, S.; Chatterjee, A.; Herman, G. E.; Archidiacono, N.; Antonacci, R.; Pierotti, M. A.; Dragani, T. A.; Toniolo, D.: Comparative mapping of the actin-binding protein 280 genes in human and mouse. Genomics 21:428-430, 1994.

Bashir, R.; Britton, S.; Strachan, T.; Keers, S.; Vafiadaki, E.; Lako, M.; Richard, I.; Marchand, S.; Bourg, N.; Argov, Z.; Sadeh, M.; Mahjneh, I.; Marconi, G.; Passos-Bueno, M. R.; Moreira, E. S.; Zatz, M.; Beckmann, J. S.; Bushby, K.: A gene related to Caenorhabditis elegans spermatogenesis factor fer-1 is mutated in limb-girdle muscular dystrophy type 2B. Nature Genet. 20:37-42, 1998.

Liu, J.; Aoki, M.; Illa, I.; Wu, C.; Fardeau, M.; Angelini, C.; Serrano, C.; Urtizberea, J. A.; Hentati, F.; Ben Hamida, M.; Bohlega, S.; Culper, E. J.; Amato, A. A.; Bossie, K.; Oeltjen, J.; Bejaoui, K.; McKenna-Yasek, D.; Hosler, B. A.; Schurr, E.; Arahata, K.; deJong, P. J.; Brown, R. H., Jr.: Dysferlin, a novel skeletal muscle gene, is mutated in Miyoshi myopathy and limb girdle muscular dystrophy. Nature Genet. 20:31-36, 1998.

Foresti, V.; Ferrari, C.: Central hypothyroidism: isolated thyrotropin-releasing hormone deficiency or resistance of pituitary thyrotropes?. (Letter) J. Endocr. Invest. 8:577 only, 1985.

Katakami, H.; Kato, Y.; Inada, M.; Imura, H.: Hypothalamic hypothyroidism due to isolated thyrotropin-releasing hormone (TRH) deficiency. J. Endocr. Invest. 7:231-233, 1984.

Niimi, H.; Inomata, H.; Sasaki, N.; Nakajima, H.: Congenital isolated thyrotrophin releasing hormone deficiency. Arch. Dis. Child. 57:877-878, 1982.

Roller, M. L.; Camper, S. A.: Localization of the thyrotropin-releasing hormone gene, Trh, on mouse chromosome 6. Mammalian Genome 6:443-444,1995.

Yamada, M.; Radovick, S.; Wondisford, F. E.; Nakayama, Y.; Weintraub, B. D.; Wilber, J. F.: Cloning and structure of human genomic DNA and hypothalamic cDNA encoding human preprothyrotropin-releasing hormone. Molec. Endocr. 4:551-556, 1990.

Yamada, M.; Satoh, T.; Monden, T.; Mori, M.: Assignment of the thyrotropin-releasing hormone gene (TRH) to human chromosome 3q13.3-q21 by in situ hybridization. Cytogenet. Cell Genet. 87:275 only, 1999.

Yamada, M.; Wondisford, F. E.; Radovick, S.; Nakayama, Y.; Weintraub, B. D.; Wilber, J. F.: Assignment of human preprothyrotropin-releasing hormone (TRH) gene to chromosome 3. Somat. Cell Molec. Genet. 17:97-100, 1991.

McDermott, J. C.; Cardoso, M. C.; Yu, Y.-T.; Andres, V.; Leifer, D.; Krainc, D.; Lipton, S. A.; Nadal-Ginard, B.: hMEF2C gene encodes skeletal muscle- and brain-specific transcription factors. Molec. Cell. Biol. 13:2564-2577, 1993.

Anderson, G. J.; Murphy, T. L.; Cowley, L.; Evans, B. A.; Halliday, J. W.; McLaren, G. D.: Mapping the gene for sex-linked anemia: an inherited defect of intestinal iron absorption in the mouse. Genomics 48:34-39, 1998.

Bannerman, R. M.: Genetic defects of iron transport. Fed. Proc. 35:2281-2285, 1976.

Edwards, J. A.; Hoke, J. E.; Mattioli, M.; Reichlin, M.: Ferritin distribution and synthesis in sex-linked anemia. J. Lab. Clin. Med. 90:68-76, 1977.

Falconer, D. S.; Isaacson, J. H.: The genetics of sex-linked anaemia in the mouse. Genet. Res. 3:248-250, 1962.

Grewal, M. S.: A sex-linked anaemia in the mouse. Genet. Res. 3:238-247, 1962.

Lee, G. R.; Nacht, S.; Lukens, J. N.; Cartwright, G. E.: Iron metabolism in copper-deficient swine. J. Clin. Invest. 47:2058-2069,1968.

Vulpe, C. D.; Kuo, Y.-M.; Murphy, T. L.; Cowley, L.; Askwith, C.; Libina, N.; Gitschier, J.; Anderson, G. J.: Hephaestin, a ceruloplasmin homologue implicated in intestinal iron transport, is defective in the sla mouse. Nature Genet. 21:195-199, 1999.

Karumanchi, S. A.; Jha, V.; Ramchandran, R.; Karihaloo, A.; Tsiokas, L.; Chan, B.; Dhanabal, M.; Hanai, J.; Venkataraman, G.; Shriver, Z.; Keiser, N.; Kalluri, R.; and 9 others: Cell surface glypicans are low-affinity endostatin receptors. Molec. Cell 7:811-822, 2001.

Veugelers, M.; Vermeesch, J.; Watanabe, K.; Yamaguchi, Y.; Marynen, P.; David, G.: GPC4, the gene for human K-glypican, flanks GPC3 onXq26: deletion of the GPC3-GPC4 gene cluster in one family with Simpson-Golabi-Behmel syndrome. Genomics 53:1-11, 1998.

Emes, R. D.; Ponting, C. P.: A new sequence motif linking lissencephaly, Treacher Collins and oral-facial-digital type 1 syndromes, microtubule dynamics and cell migration. Hum. Molec. Genet. 10:2813-2820, 2001.

Laporte, J.; Blondeau, F.; Buj-Bello, A.; Tentler, D.; Kretz, C.; Dahl, N.; Mandel, J.-L.: Characterization of the myotubularin dual specificity phosphatase gene family from yeast to human. Hum. Molec. Genet. 7:1703-1712, 1998.

Gorlin, J. B.; Henske, E.; Warren, S. T.; Kunst, C. B.; d'urso, M.; Palmieri, G.; Hartwig, J. H.; Bruns, G.; Kwiatkowski, D. J.:Actin-binding protein (ABP-280) filamin gene (FLN) maps telomeric to the color vision locus (R/GCP) and centromeric to G6PD in Xq28. Genomics 17:496-498, 1993.

Gorlin, J. B.; Yamin, R.; Egan, S.; Stewart, M.; Stossel, T. P.; Kwiatkowski, D. J.; Hartwig, J. H.: Human endothelial actin-binding protein (ABP-280, nonmuscle filamin): a molecular leaf spring. J. Cell Biol. 111:1089-1105, 1990.

Huttenlocher, P. R.; Taravath, S.; Mojtahedi, S.: Periventricular heterotopia and epilepsy. Neurology 44:51-55, 1994.

Kunst, C. B.; Henske, E.; Hartwig, J. H.; Kwiatkowski, D. J.; d'urso, M.; Bruns, G.; Warren, S. T.; Gorlin, J. B.: The dystrophin-like actin binding protein 280 gene maps between DXS52 and G6PD overlapping the Emery-Dreifuss muscular dystrophy locus. (Abstract) Am. J. Hum. Genet. 51: A21, 1992.

Maestrini, E.; Patrosso, C.; Mancini, M.; Rivella, S.; Rocchi, M.; Repetto, M.; Villa, A.; Frattini, A.; Zoppe, M.; Vezzoni, P.; Toniolo, D.: Mapping of two genes encoding isoforms of the actin binding protein ABP-280, a dystrophin like protein, to Xq28 and to chromosome 7. Hum. Molec. Genet. 2:761-766, 1993.

Maestrini, E.; Rivella, S.; Tribioli, C.; Purtilo, D.; Rocchi, M.; Archidiacono, N.; Toniolo, D.: Probes for CpG islands on the distal long arm of the human X chromosome are clustered in Xq24 andXq28. Genomics 8:664-670, 1990.

Patrosso, M. C.; Repetto, M.; Villa, A.; Milanesi, L.; Frattini, A.; Faranda, S.; Mancini, M.; Maestrini, E.; Toniolo, D.; Vezzoni, P.: The exon-intron organization of the human X-linked gene (FLN1) encoding actin-binding protein 280. Genomics 21:71-76, 1994.

Sheen, V. L.; Dixon, P. H.; Fox, J. W.; Hong, S. E.; Kinton, L.; Sisodiya, S. M.; Duncan, J. S.; Dubeau, F.; Scheffer, I. E.; Schachter, S. C.; Wilner, A.; Henchy, R.; and 18 others: Mutations in the X-linked filamin 1 gene cause periventricular nodular heterotopiain males as well as in females. Hum. Molec. Genet. 10:1775-1783,2001.

Small, K.; Wagener, M.; Warren, S. T.: Isolation and characterization of the complete mouse emerin gene. Mammalian Genome 8:337-341,1997.

Vadlamudi, R. K.; Li, F.; Adam, L.; Nguyen, D.; Ohta, Y.; Stossel, T. P.; Kumar, R.: Filamin is essential in actin cytoskeletal assembly mediated by p21-activated kinase 1. Nature Cell Biol. 4:681-690,2002.

Faranda, S.; Frattini, A.; Vezzoni, P.: The human genes encoding renin-binding protein and host cell factor are closely linked in Xq28 and transcribed in the same direction. Gene 155:237-239, 1995.

Frattini, A.; Chatterjee, A.; Faranda, S.; Sacco, M. G.; Villa, A.; Herman, G. E.; Vezzoni, P.: The chromosome localization and the HCF repeats of the human host cell factor gene (HCFC1) are conserved in the mouse homologue. Genomics 32:277-280, 1996.

Frattini, A.; Faranda, S.; Redolfi, E.; Zucchi, I.; Villa, A.; Patrosso, M. C.; Strina, D.; Susani, L.; Vezzoni, P.: Genomic organization of the human VP16 accessory protein, a housekeeping gene (HCFC1) mapping to Xq28. Genomics 23:30-35, 1994.

Wilson, A. C.; LaMarco, K.; Peterson, M. G.; Herr, W.: The VP16 accessory protein HCF is a family of polypeptides processed from a large precursor protein. Cell 74:115-125, 1993.

Wilson, A. C.; Parrish, J. E.; Massa, H. F.; Nelson, D. L.; Trask, B. J.; Herr, W.: The gene encoding the VP16-accessory protein HCF (HCFC1) resides in human Xq28 and is highly expressed in fetal tissues and the adult kidney. Genomics 25:462-468, 1995.

Zoppe, M.; Frattini, A.; Faranda, S.; Vezzoni, P.: The complete sequence of the host cell factor 1 (HCFC1) gene and its promoter: a role for YY1 transcription factor in the regulation of its expression. Genomics 34:85-91, 1996.

Maestrini, E.; Tamagnone, L.; Longati, P.; Cremona, O.; Gulisano, M.; Bione, S.; Tamanini, F.; Neel, B. G.; Toniolo, D.; Comoglio, P. M.: A family of transmembrane proteins with homology to the MET-hepatocyte growth factor receptor. Proc. Nat. Acad. Sci. 93:674-678, 1996.

Tamagnone, L.; Artigiani, S.; Chen, H.; He, Z.; Ming, G.; Song, H.; Chedotal, A.; Winberg, M. L.; Goodman, C. S.; Poo, M.; Tessier-Lavigne, M.; Comoglio, P. M.: Plexins are a large family of receptors for transmembrane, secreted, and GPI-anchored semaphorins in vertebrates. Cell 99:71-80, 1999.

Becker, P. E.: Two new families of benign sex-linked recessive muscular dystrophy. Rev. Canad. Biol. 21:551-566, 1962.

Becker, P. E.: Eine neue X-chromosomale Muskel dystrophie. Acta Psychiat. Neurol. Scand. 193:427, 1955.

Becker, P. E.: Neue Ergebnisse der Genetik der Muskel dystrophien. Acta Genet. Statist. Med. 7:303-310, 1957.

Bushby, K. M. D.; Cleghorn, N. J.; Curtis, A.; Haggerty, I. D.; Nicholson, L. V. B.; Johnson, M. A.; Harris, J. B.; Bhattacharya, S. S.: Identification of a mutation in the promoter region of the dystrophin gene in a patient with atypical Becker muscular dystrophy. Hum. Genet. 88:195-199, 1991.

Doriguzzi, C.; Palmucci, L.; Mongini, T.; Chiado-Piat, L.; Restagno, G.; Ferrone, M.: Exercise intolerance and recurrent myoglobinuria as the only expression of Xp21 Becker type muscular dystrophy. J. Neurol. 240:269-271, 1993.

England, S. B.; Nicholson, L. V. B.; Johnson, M. A.; Forrest, S. M.; Love, D. R.; Zubrzycka-Gaarn, E. E.; Bulman, D. E.; Harris, J. B.; Davies, K. E.: Very mild muscular dystrophy associated with the deletion of 46% dystrophin. Nature 343: 180-182, 1990.

Aronsson, F. C.; Magnusson, P.; Andersson, B.; Karsten, S. L.; Shibasaki, Y.; Lendon, C. L.; Goate, A. M.; Brookes, A. J.: The NIK protein kinase and C17orf1 genes: chromosomal mapping, gene structures and mutational screening in frontotemporal dementia and parkinsonism linked to chromosome 17. Hum. Genet. 103:340-345, 1998.

Malinin, N. L.; Boldin, M. P.; Kovalenko, A. V.; Wallach, D.: MAP3K-related kinase involved in NF-kappaB induction by TNF, CD95 and IL-1. Nature 385:540-544, 1997.

Shinkura, R.; Kitada, K.; Matsuda, F.; Tashiro, K.; Ikuta, K.; Suzuki, M.; Kogishi, K.; Serikawa, T.; Honjo, T.: A lymphoplasia is caused by a point mutation in the mouse gene encoding Nf-kappa-b-inducing kinase. Nature Genet. 22:74-77, 1999.

Smith, C.; Andreakos, E.; Crawley, J. B.; Brennan, F. M.; Feldmann, M.; Foxwell, B. M. J.: NF-kappa-B-inducing kinase is dispensable for activation of NF-kappa-B in inflammatory settings but essential for lymphotoxin beta receptor activation of NF-kappa-B in primary human fibroblasts. J. Immun. 167:5895-5903, 2001.

Yin, L.; Wu, L.; Wesche, H.; Arthur, C. D.; White, J. M.; Goeddel, D. V.; Schreiber, R. D.: Defective lymphotoxin-beta receptor-induced NF-kappa-B transcriptional activity in NIK-deficient mice. Science 291:2162-2165, 2001.

Aronsson, F. C.; Magnusson, P.; Andersson, B.; Karsten, S. L.; Shibasaki, Y.; Lendon, C. L.; Goate, A. M.; Brookes, A. J.: The NIK protein kinase and C17orf1 genes: chromosomal mapping, gene structures and mutational screening in frontotemporal dementia and parkinsonism linked to chromosome 17. Hum. Genet. 103:340-345, 1998.

Yayoshi-Yamamoto, S.; Taniuchi, I.; Watanabe, T.: FRL, a novel formin-related protein, binds to Rac and regulates cell motility and survival of macrophages. Molec. Cell. Biol. 20:6872-6881, 2000.

Borggrefe, T.; Masat, L.; Wabl, M.; Riwar, B.; Cattoretti, G.; Jessberger, R.: Cellular, intracellular, and developmental expression patterns of murine SWAP-70. Europ. J. Immun. 29:1812-1822, 1999.

Borggrefe, T.; Wabl, M.; Akhmedov, A. T.; Jessberger, R.: A B-cell-specific DNA recombination complex. J. Biol. Chem. 273:17025-17035, 1998.

Masat, L.; Caldwell, J.; Armstrong, R.; Khoshnevisan, H.; Jessberger, R.; Herndier, B.; Wabl, M.; Ferrick, D.: Association of SWAP-70 with the B cell antigen receptor complex. Proc. Nat. Acad. Sci. 97:2180-2184, 2000.

Masat, L.; Liddell, R. A.; Mock, B. A.; Kuo, W.-L.; Jessberger, R.; Wabl, M.; Morse, H. C., III: Mapping of the SWAP70 gene to mouse chromosome 7 and human chromosome 11p15. Immunogenetics 51:16-19, 2000.

Shinohara, M.; Terada, Y.; Iwamatsu, A.; Shinohara, A.; Mochizuki, N.; Higuchi, M.; Gotoh, Y.; Ihara, S.; Nagata, S.; Itoh, H.; Fukui, Y.; Jessberger, R.: SWAP-70 is a guanine-nucleotide-exchange factor that mediates signalling of membrane ruffling. Nature 416:759-763, 2002.

Miura, K.; Suzuki, K.; Tokino, T.; Isomura, M.; Inazawa, J.; Matsuno, S.; Nakamura, Y.: Detailed deletion mapping in squamous cell carcinomas of the esophagus narrows a region containing a putative tumor suppressor gene to about 200 kilobases on distal chromosome 9q. Cancer Res. 56:1629-1634, 1996.

Nishiwaki, T.; Daigo, Y.; Kawasoe, T.; Nakamura, Y.: Isolation and mutational analysis of a novel human cDNA, DEC1 (deleted in esophageal cancer 1), derived from the tumor suppressor locus in 9q32. Genes Chromosomes Cancer 27:169-176, 2000.

Nemoto, Y.; Yamamoto, T.; Takada, S.; Matsui, Y.; Obinata, M.: Antisense RNA of the latent period gene (MER5) inhibits the differentiation of murine erythroleukemia cells. Gene 91:261-265, 1990.

Shih, S.-F.; Wu, Y.-H.; Hung, C.-H.; Yang, H.-Y.; Lin, J.-Y.: Abrin triggers cell death by inactivating a thiol-specific antioxidant protein. J. Biol. Chem. 276:21870-21877, 2001.

Tsuji, K.; Copeland, N. G.; Jenkins, N. A.; Obinata, M.: Mammalian antioxidant protein complements alkylhydroperoxide reductase (ahpC) mutation in Escherichia coli. Biochem. J. 307:377-381, 1995.

Wonsey, D. R.; Zeller, K. I.; Dang, C. V.: The c-Myc target gene PRDX3 is required for mitochondrial homeostasis and neoplastic transformation. Proc. Nat. Acad. Sci. 99:6649-6654, 2002.

Kamimoto, T.; Zama, T.; Aoki, R.; Muro, Y.; Hagiwara, M.: Identification of a novel kinesin-related protein, KRMP1, as a target for mitotic peptidyl-prolyl isomerase Pin1. J. Biol. Chem. 276:37520-37528, 2001.

Valladeau, J.; Clair-Moninot, V.; Dezutter-Dambuyant, C.; Pin, J.-J.; Kissenpfennig, A.; Mattei, M.-G.; Ait-Yahia, S.; Bates, E. E. M.; Malissen, B.; Koch, F.; Fossiez, F.; Romani, N.; Lebecque, S.; Saeland, S.: Identification of mouse langerin/CD207 in Langerhans cells and some dendritic cells of lymphoid tissues. J. Immun. 168:782-792, 2002.

Valladeau, J.; Ravel, O.; Dezutter-Dambuyant, C.; Moore, K.; Kleijmeer, M.; Liu, Y.; Duvert-Frances, V.; Vincent, C.; Schmitt, D.; Davoust, J.; Caux, C.; Lebecque, S.; Saeland, S.: Langerin, a novel C-type lectin specific to Langerhans cells, is an endocytic receptor that induces the formation of Birbeck granules. Immunity 12:71-81, 2000.

Reichenberger, E.; Tiziani, V.; Watanabe, S.; Park, L.; Ueki, Y.; Santanna, C.; Baur, S. T.; Shiang, R.; Grange, D. K.; Beighton, P.; Gardner, J.; Hamersma, H.; Sellars, S.; Ramesar, R.; Lidral, A. C.; Sommer, A.; Raposo do Amaral, C. M.; Gorlin, R. J.; Mulliken, J. B.; Olsen, B. R.: Autosomal dominant craniometaphyseal dysplasia is caused by mutations in the transmembrane protein ANK. Am. J. Hum. Genet. 68:1321-1326, 2001.

Ansel, K. M.; Harris, R. B. S.; Cyster, J. G.: CXCL13 is required for B1 cell homing, natural antibody production, and body cavity immunity. Immunity 16:67-76, 2002.

Gunn, M. D.; Ngo, V. N.; Ansel, K. M.; Ekland, E. H.; Cyster, J. G.; Williams, L. T.: A B-cell-homing chemokine made in lymphoid follicles activates Burkitt's lymphoma receptor-1. Nature 391:799-803, 1998.

Legler, D. F.; Loetscher, M.; Roos, R. S.; Clark-Lewis, I.; Baggiolini, M.; Moser, B.: B cell-attracting chemokine 1, a human CXC chemokine expressed in lymphoid tissues, selectively attracts B lymphocytes via BLR1/CXCR5. J. Exp. Med. 187:655-660, 1998.

Amler, L. C.; Bauer, A.; Corvi, R.; Dihlmann, S.; Praml, C.; Cavenee, W. K.; Schwab, M.; Hampton, G. M.: Identification and characterization of novel genes located at the t (1;15) (p36.2; q24) translocation breakpoint in the neuroblastoma cell line NGP. Genomics 64:195-202, 2000.

Yanagisawa, H.; Bundo, M.; Miyashita, T.; Okamura-Oho, Y.; Tadokoro, K.; Tokunaga, K.; Yamada, M.: Protein binding of a DRPLA family through arginine-glutamic acid dipeptide repeats is enhanced by extended polyglutamine. Hum. Molec. Genet. 9:1433-1442, 2000.

Oh, J.; Takahashi, R.; Kondo, S.; Mizoguchi, A.; Adachi, E.; Sasahara, R. M.; Nishimura, S.; Imamura, Y.; Kitayama, H.; Alexander, D. B.; Ide, C.; Horan, T. P.; Arakawa, T.; Yoshida, H.; Nishikawa, S.; Itoh, Y.; Seiki, M.; Itohara, S.; Takahashi, C.; Noda, M.: The membrane-anchored MMP inhibitor RECK is a key regulator of extracellular matrix integrity and angiogenesis. Cell 107:789-800, 2001.

Takahashi, C.; Sheng, Z.; Horan, T. P.; Kitayama, H.; Maki, M.; Hitomi, K.; Kitaura, Y.; Takai, S.; Sasahara, R. M.; Horimoto, A.; Ikawa, Y.; Ratzkin, B. J.; Arakawa, T.; Noda, M.: Regulation of matrix metalloproteinase-9 and inhibition of tumor invasion by the membrane-anchored glycoprotein RECK. Proc. Nat. Acad. Sci. 95:13221-13226, 1998.

Nagase, T.; Ishikawa, I.; Nakajima, D.; Ohira, M.; Seki, N.; Miyajima, N.; Tanaka, A.; Kotani, H.; Nomura, N.; O'Hara, O.: Prediction of the coding sequences of unidentified human genes. VII. The complete sequences of 100 new cDNA clones from brain which can code for large proteins in vitro. DNA Res. 4:141-150, 1997.

Koseki, T.; Inohara, N.; Chen, S.; Nunez, G.: ARC, an inhibitor of apoptosis expressed in skeletal muscle and heart that interacts selectively with caspases. Proc. Nat. Acad. Sci. 95:5156-5160,1998.

Li, P.-F.; Li, J.; Muller, E.-C.; Otto, A.; Dietz, R.; von Harsdorf, R.: Phosphorylation by protein kinase CK2: a signaling switch for the caspase-inhibiting protein ARC. Molec. Cell 10:247-258, 2002.

Muto, A.; Hoshino, H.; Madisen, L.; Yanai, N.; Obinata, M.; Karasuyama, H.; Hayashi, N.; Nakauchi, H.; Yamamoto, M.; Groudine, M.; Igarashi, K.: Identification of Bach2 as a B-cell-specific partner for small Maf proteins that negatively regulate the immunoglobulin heavy chain gene 3-prime enhancer. EMBO J. 17:5734-5743, 1998.

Sasaki, S.; Ito, E.; Toki, T.; Maekawa, T.; Kanezaki, R.; Umenai, T.; Muto, A.; Nagai, H.; Kinoshita, T.; Yamamoto, M.; Inazawa, J.; Taketo, M. M.; Nakahata, T.; Igarashi, K.; Yokoyama, M.: Cloning and expression of human B cell-specific transcription factor BACH2 mapped to chromosome 6q15. Oncogene 19:3739-3749, 2000.

Shimaoka, T.; Kume, N.; Minami, M.; Hayashida, K.; Kataoka, H.; Kita, T.; Yonehara, S.: Molecular cloning of a novel scavenger receptor for oxidized low density lipoprotein, SR-PSOX, on macrophages. J. Biol. Chem. 275:40663-40666, 2000.

Wilbanks, A.; Zondlo, S. C.; Murphy, K.; Mak, S.; Soler, D.; Langdon, P.; Andrew, D. P.; Wu, L.; Briskin, M.: Expression cloning of the STRL33/BONZO/TYMSTR ligand reveals elements of CC, CXC, CX3C chemokines. J. Immun. 166:5145-5154, 2001.

Brill, S.; Li, S.; Lyman, C. W.; Church, D. M.; Wasmuth, J. J.; Weissbach, L.; Bernards, A.; Snijders, A. J.: The Ras GTPase-activating-protein-related human protein IQGAP2 harbors a potential actin binding domain and interacts with calmodulin and Rho family GTPases. Molec. Cell. Biol. 16:4869-4878, 1996.

Brown, C. J.; Miller, A. P.; Carrel, L.; Rupert, J. L.; Davies, K. E.; Willard, H. F.: The DXS423E gene in Xp11.21 escapes X chromosome inactivation. Hum. Molec. Genet. 4:251-255, 1995.

Sumara, I.; Vorlaufer, E.; Gieffers, C.; Peters, B. H.; Peters, J.-M.: Characterization of vertebrate cohesin complexes and their regulation in prophase. J. Cell Biol. 151:749-761, 2000.

Bodrug, S. E.; Ray, P. N.; Gonzalez, I. L.; Schmickel, R. D.; Sylvester, J. E.; Worton, R. G.: Molecular analysis of a constitutional X-autosome translocation in a female with muscular dystrophy. Science 237:1620-1624, 1987.

Boyce, F. M.; Beggs, A. H.; Feener, C.; Kunkel, L. M.: Dystrophin is transcribed in brain from a distant upstream promoter. Proc. Nat. Acad. Sci. 88:1276-1280, 1991.

Boyd, Y.; Buckle, V. J.: Cytogenetic heterogeneity of translocations associated with Duchenne muscular dystrophy. Clin. Genet. 29:108-115,1986.

Bulman, D. E.; Gangopadhyay, S. B.; Bebchuck, K. G.; Worton, R. G.; Ray, P. N.: Point mutation in the human dystrophin gene: identification through Western blot analysis. Genomics 10:457-460, 1991.

Burke, J. F.; Mogg, A. E.: Suppression of a nonsense mutationin mammalian cells in vivo by the aminoglycoside antibiotics G-418 and paromomycin. Nucleic Acids Res. 13:6265-6272, 1985.

Burnette, W. N.: 'Western blotting': electrophoretic transfer of proteins from sodium dodecyl sulfate-polyacrylamide gels to unmodified nitrocellulose and radiographic detection with antibody and radioiodinated protein A. Anal. Biochem. 112:195-203, 1981.

Chamberlain, J. S.; Pearlman, J. A.; Muzny, D. M.; Gibbs, R. A.; Ranier, J. E.; Reeves, A. A.; Caskey, C. T.: Expression of the murine Duchenne muscular dystrophy gene in muscle and brain. Science 239:1416-1418, 1988.

Chelly, J.; Concordet, J.-P.; Kaplan, J.-C.; Kahn, A.: Illegitimate transcription: transcription of any gene in any cell type. Proc. Nat. Acad. Sci. 86:2617-2621, 1989.

Chelly, J.; Gilgenkrantz, H.; Hugnot, J. P.; Hamard, G.; Lambert, M.; Recan, D.; Akli, S.; Cometto, M.; Kahn, A.; Kaplan, J. C.: Illegitimate transcription: application to the analysis of truncated transcripts of the dystrophin gene in nonmuscle cultured cells from Duchenne and Becker patients. J. Clin. Invest. 88:1161-1166, 1991.

Chelly, J.; Hamard, G.; Koulakoff, A.; Kaplan, J.-C.; Kahn, A.; Berwald-Netter, Y.: Dystrophin gene transcribed from different promoters in neuronal and glial cells. Nature 344: 64-65, 1990.

Chelly, J.; Kaplan, J.-C.; Maire, P.; Gautron, S.; Kahn, A.: Transcription of the dystrophin gene in human muscle and non-muscle tissues. Nature 333:858-860, 1988.

Clemens, P. R.; Ward, P. A.; Caskey, C. T.; Bulman, D. E.; Fenwick, R. G.: Premature chain termination mutation causing Duchenne muscular dystrophy. Neurology 42:1775-1782, 1992.

Cooper, B. J.; Valentine, B. A.; Wilson, S.; Patterson, D. F.; Concannon, P. W.: Canine muscular dystrophy: confirmation of X-linked inheritance. J. Hered. 79:405-408, 1988.

Covone, A. E.; Lerone, M.; Romeo, G.: Genotype-phenotype correlation and germline mosaicism in DMD/BMD patients with deletions of the dystrophin gene. Hum. Genet. 87:353-360, 1991.

Cox, G. A.; Cole, N. M.; Matsumura, K.; Phelps, S. F.; Hauschka, S. D.; Campbell, K. P.; Faulkner, J. A.; Chamberlain, J. S.: Overexpression of dystrophin in transgenic mdx mice eliminates dystrophic symptoms without toxicity. Nature 364:725-729, 1993.

Cox, G. A.; Sunada, Y.; Campbell, K. P.; Chamberlain, J. S.:Dp71 can restore the dystrophin-associated glycoprotein complex in muscle but fails to prevent dystrophy. Nature Genet. 8:333-339,1994.

Comi, G. P.; Ciafaloni, E.; de Silva, H. A. R.; Prelle, A.; Bardoni, A.; Rigoletto, C.; Robotti, M.; Bresolin, N.; Moggio, M.; Fortunato, F.; Ciscato, P.; Turconi, A.; Rose, A. D.; Scarlato, G.: A G(+1)-to-A transversion at the 5-prime splice site of intron 69 of the dystrophin gene causing the absence of peripheral nerve Dp116 and severe clinical involvement in a DMD patient. Hum. Molec. Genet. 4:2171-2174, 1995.

Crawford, G. E.; Lu, Q. L.; Partridge, T. A.; Chamberlain, J. S.: Suppression of revertant fibers in mdx mice by expression of a functional dystrophin. Hum. Molec. Genet. 10:2745-2750, 2001.

Darras, B. T.; Blattner, P.; Harper, J. F.; Spiro, A. J.; Alter, S.; Francke, U.: Intragenic deletions in 21 Duchenne muscular dystrophy (DMD)/Becker muscular dystrophy (BMD)

families studied with the dystrophin cDNA: location of breakpoints on Hind III and Bgl II exon-containing fragment maps, meiotic and mitotic origin of the mutations. Am. J. Hum. Genet. 43:620-629, 1988.

Darras, B. T.; Francke, U.: Normal human genomic restriction-fragment patterns and polymorphisms revealed by hybridization with the entire dystrophin cDNA. Am. J. Hum. Genet. 43:612-619, 1988.

Darras, B. T.; Francke, U.: A partial deletion of the muscular dystrophy gene transmitted twice by an unaffected male. Nature 329:556-558, 1987.

Davies, K. E.; Smith, T. J.; Bundey, S.; Read, A. P.; Flint, T.; Bell, M.; Speer, A.: Mild and severe muscular dystrophy associated with deletions in Xp21 of the human X chromosome. J. Med. Genet. 25:9-13, 1988.

den Dunnen, J. T.; Bakker, E.; Klein Breteler, E. G.; Pearson, P. L.; van Ommen, G. J. B.: Direct mutation of more than 50% of the Duchenne muscular dystrophy mutations by field inversion gels. Nature 329:640-642, 1987.

Dickson, G.; Pizzey, J. A.; Elsom, V. E.; Love, D.; Davies, K. E.; Walsh, F. S.: Distinct dystrophin mRNA species are expressed in embryonic and adult mouse skeletal muscle. FEBS Lett. 242:47-52,1988.

Dominguez-Steglich, M.; Meng, G.; Bettecken, T.; Muller, C. R.; Schmid, M.: The dystrophin gene is autosomally located on a microchromosome in chicken. Genomics 8:536-540, 1990.

Doolittle, R. F.: Similar amino acid sequences: chance or common ancestry? Science 214:149-159, 1981.

De Angelis, F. G.; Sthandier, O.; Berarducci, B.; Toso, S.; Galluzzi, G.; Ricci, E.; Cossu, G.; Bozzoni, I.: Chimeric snRNA molecules carrying antisense sequences against the splice junctions of exon 51 of the dystrophin pre-mRNA induce exon skipping and restoration of a dystrophin synthesis in delta-48-50 DMD cells. Proc Nat. Acad. Sci. 99:9456-9461, 2002.

Gaugitsch, H. W.; Prieschl, E. E.; Kalthoff, F.; Huber, N. E.; Baumruker, T.: A novel transiently expressed, integral membrane protein linked to cell activation: molecular cloning via the rapid degradation signal AUUUA. J. Biol. Chem 267: 11267-11273, 1992.

Kanai, Y.; Segawa, H.; Miyamoto, K.; Uchino, H.; Takeda, H.; Endou, H.: Expression cloning and characterization of a transporter for large neutral amino acids activated by the heavy chain of 4F2 antigen (CD98). J. Biol. Chem. 273: 23629-23632, 1998.

Amagai, M.; Wang, Y.; Minoshima, S.; Kawamura, K.; Green, K. J.; Nishikawa, T.; Shimizu, N.: Assignment of the human genes for desmocollin 3 (DSC3) and desmocollin 4 (DSC4) to chromosome 18q12. Genomics 25:330-332, 1995.

Kawamura, K.; Watanabe, K.; Suzuki, T.; Yamakawa, T.; Kamiyama, T.; Nakagawa, H.; Tsurufuji, S.: cDNA cloning and expression of a novel human desmocollin. J. Biol. Chem. 269:26295-26302, 1994.

King, I. A.; Sullivan, K. H.; Bennett, R., Jr.; Buxton, R. S.: The desmocollins of human foreskin epidermis: identification and chromosomal assignment of a third gene and expression patterns of the three isoforms. J. Invest. Derm. 105:314-321, 1995.

Warburg, O.: On the origin of cancer cells. Science 123:309-314,1956.

Dubrovsky, A. L.; Taratuto, A. L.; Sevlever, G.; Schultz, M.; Pegoraro, E.; Hoop, R. C.; Hoffman, E. P.: Duchenne muscular dystrophy and myotonic dystrophy in the same patient. Am. J. Med. Genet. 55:342-348, 1995.

Cazzola, M.; Bergamaschi, G.: X-linked Wiskott-Aldrich syndrome in a girl. (Letter) New Eng. J. Med. 338:1850 only, 1998.

Emery, A. E. H.: Duchenne Muscular Dystrophy. Oxford, UK: Oxford University Press (pub.) (2nd ed.):1993.

Fabb, S. A.; Wells, D. J.; Serpente, P.; Dickson, G.: Adeno-associated virus vector gene transfer and sarcolemmal expression of a 144 k Damicro-dystrophin effectively restores the dystrophin-associated protein complex and inhibits myofibre degeneration in nude/mdx mice. Hum. Molec. Genet. 11:733-741, 2002.

Feener, C. A.; Boyce, F. M.; Kunkel, L. M.: Rapid detection of CA polymorphisms in cloned DNA: application to the 5-prime region of the dystrophin gene. Am. J. Hum. Genet. 48:621-627, 1991.

Ferlini, A.; Galie, N.; Merlini, L.; Sewry, C.; Branzi, A.; Muntoni, F.: A novel Alu-like element rearranged in the dystrophin gene causes a splicing mutation in a family with X-linked dilated cardiomyopathy. Am. J. Hum. Genet. 63:436-446, 1998.

Finnegan, D. J.: Eukaryotic transposable elements and genome evolution. Trends Genet. 5:103-107, 1989.

Forrest, S. M.; Cross, G. S.; Speer, A.; Gardner-Medwin, D.; Burn, J.; Davies, K. E.: Preferential deletion of exons in Duchenne and Becker muscular dystrophies. Nature 329: 638-640, 1987.

Francke, U.; Ochs, H. D.; de Martinville, B.; Giacalone, J.; Lindgren, V.; Disteche, C.; Pagon, R. A.; Hofker, M. H.; van Ommen, G.-J. B.; Pearson, P. L.; Wedgwood, R. J.: Minor Xp21 chromosome deletion in a male associated with expression of Duchenne muscular dystrophy, chronic granulomatous disease, retinitis pigmentosa, and McLeod syndrome. Am. J. Hum. Genet. 37:250-267, 1985.

Furst, D.; Nave, R.; Osborn, M.; Weber, K.; Bardosi, A.; Archidiacono, N.; Ferro, M.; Romano, V.; Romeo, G.: Nebulin and titin expression in Duchenne muscular dystrophy appears normal. FEBS Lett. 224:49-53,1987.

Giacalone, J. P.; Francke, U.: Common sequence motifs at the rearrangement sites of a constitutional X/autosome translocation and associated deletion. Am. J. Hum. Genet. 50:725-741, 1992.

Gillard, E. F.; Chamberlain, J. S.; Murphy, E. G.; Duff, C. L.; Smith, B.; Burghes, A. H. M.; Thompson, M. W.; Sutherland, J.; Oss, I.; Bodrug, S. E.; Klamut, H. J.; Ray, P. N.; Worton, R. G.: Molecular and phenotypic analysis of patients with deletions within the deletion-rich region of the Duchenne muscular dystrophy (DMD) gene. Am. J. Hum. Genet. 45:507-520, 1989.

Ginjaar, I. B.; Kneppers, A. L. J.; Meulen, J.-D. M.; Anderson, L. V. B.; Bremmer-Bout, M.; van Deutekom, J. C. T.; Weegenaar, J.; den Dunnen, J. T.; Bakker, E.: Dystrophin nonsense mutation induces different levels of exon 29 skipping and leads to variable phenotypes within one BMD family. Europ. J. Hum. Genet. 8:793-796, 2000.

Greenberg, D. S.; Sunada, Y.; Campbell, K. P.; Yaffe, D.; Nudel, U.: Exogenous Dp71 restores the levels of dystrophin associated proteins but does not alleviate muscle damage in mdx mice. Nature Genet. 8:340-344, 1994.

Gussoni, E.; Soneoka, Y.; Strickland, C. D.; Buzney, E. A.; Khan, M. K.; Flint, A. F.; Kunkel, L. M.; Mulligan, R. C.: Dystrophin expression in the mdx mouse restored by stem cell transplantation. Nature 401:390-394, 1999.

Hagiwara, Y.; Mizuno, Y.; Takemitsu, M.; Matsuzaki, T.; Nonaka, I.; Ozawa, E.: Dystrophin-positive muscle fibers following C2 myoblast transplantation into mdx nude mice. Acta Neuropath. 90:592-600,1995.

Hagiwara, Y.; Nishio, H.; Kitoh, Y.; Takeshima, Y.; Narita, N.; Wada, H.; Yokoyama, M.; Nakamura, H.; Matsuo, M.: A novel point mutation (G(-1) to T) in a 5-prime splice donor site of intron 13 of the dystrophin gene results in exon skipping and is responsible for Becker muscular dystrophy. Am. J. Hum. Genet. 54:53-61, 1994.

Hammonds, R. G., Jr.: Protein sequence of DMD gene is related to actin-binding domain of alpha-actinin. (Letter) Cell 51:1, 1987.

Harper, S. Q.; Hauser, M. A.; DelloRusso, C.; Duan, D.; Crawford, R. W.; Phelps, S. F.; Harper, H. A.; Robinson, A. S.; Engelhardt, J. F.; Brooks, S. V.; Chamberlain, J. S.: Modular flexibility of dystrophin: implications for gene therapy of Duchenne muscular dystrophy. Nature Med. 8:253-261, 2002.

Hart, K. A.; Hodgson, S.; Walker, A.; Cole, C. G.; Johnson, L.; Dubowitz, V.; Bobrow, M.: DNA deletions in mild and severe Becker muscular dystrophy. Hum. Genet. 75:281-285, 1987.

Hodgson, S. V.; Abbs, S.; Clark, S.; Manzur, A.; Heckmatt, J. Z. H.; Dubowitz, V.; Bobrow, M.: Correlation of clinical and deletion data in Duchenne and Becker muscular dystrophy, with special reference to mental ability. Neuromusc. Disord. 2:269-276, 1992.

Hoffman, E. P.; Brown, R. H., Jr.; Kunkel, L. M.: The protein product of the Duchenne muscular dystrophy locus. Cell 51:919-928,1987.

Hoffman, E. P.; Knudson, C. M.; Campbell, K. P.; Kunkel, L. M.: Subcellular fractionation of dystrophin to the triads of skeletal muscle. Nature 330:754-758, 1987.

Hoffman, E. P.; Monaco, A. P.; Feener, C. C.; Kunkel, L. M.: Conservation of the Duchenne muscular dystrophy gene in mice and human S. Science 238:347-350, 1987.

Hoop, R. C.; Russo, L. S.; Riconda, D. L.; Schwartz, L. S.; Hoffman, E. P.: Restoration of half the normal dystrophin sequence in a double-deletion Duchenne muscular dystrophy family. Am. J. Med. Genet. 49:323-327,1994.

Hoffman, E. P.; Fischbeck, K. H.; Brown, R. H.; Johnson, M.; Medori, R.; Loike, J. D.; Harris, J. B.; Waterston, R.; Brooke, M.; Specht, L.; Kupsky, W.; Chamberlain, J.; Caskey, C. T.; Shapiro, F.; Kunkel, L. M.: Characterization of dystrophin in muscle-biopsy specimens from patients with Duchenne's or Becker's muscular dystrophy. New Eng. J. Med. 318:1363-1368, 1988.

Howard, P. L.; Dally, G. Y.; Wong, M. H.; Ho, A.; Weleber, R. G.; Pillers, D.-A. M.; Ray, P. N.: Localization of dystrophin isoform Dp71 to the inner limiting membrane of the retina suggests a unique functional contribution of Dp71 in the retina. Hum. Molec. Genet. 7:1385-1391, 1998.

Hu, X.; Burghes, A. H. M.; Bulman, D. E.; Ray, P. N.; Worton, R. G.: Evidence for mutation by unequal sister chromatid exchange in the Duchenne muscular dystrophy gene. Am. J. Hum. Genet. 44:855-863, 1989.

Birnbaumer, M.: Vasopressin receptors. TEM 11:406-410, 2000.

Coyle, A. J.; Lehar, S.; Lloyd, C.; Tian, J.; Delaney, T.; Manning, S.; Nguyen, T.; Burwell, T.; Schneider, H.; Gonzalo, J. A.; Gosselin, M.; Owen, L. R.; Rudd, C. E.; Gutierriez-Ramos, J. C.: The CD28-related molecule ICOS is required for effective T cell-dependent immune responses. Immunity 13:95-105, 2000.

Dong, C.; Juedes, A. E.; Temann, U. A.; Shresta, S.; Allison, J. P.; Ruddle, N. H.; Flavell, R. A.: ICOS co-stimulatory receptor is essential for T-cell activation and function. Nature 409:97-101,2001.

Haimila, K. E.; Partanen, J. A.; Holopainen, P. M.: Genetic polymorphism of the human ICOS gene. Immunogenetics 53:1028-1032, 2002.

Hutloff, A.; Dittrich, A. M.; Beier, K. C.; Eljaschewitsch, B.; Kraft, R.; Anagnostopoulos, I.; Kroczek, R. A.: ICOS is an inducible T-cell co-stimulator structurally and functionally related to CD28. Nature 397:263-266, 1999.

McAdam, A. J.; Greenwald, R. J.; Levin, M. A.; Chernova, T.; Malenkovich, N.; Ling, V.; Freeman, G. J.; Sharpe, A. H.: ICOS is critical for CD40-mediated antibody class switching. Nature 409:102-105, 2001.

Medina, M.; Marinescu, R. C.; Overhauser, J.; Kosik, K. S.: Hemizygosity of delta-catenin (CTNND2) is associated with severe mental retardation in cri-du-chat syndrome. Genomics 63:157-164, 2000.

Paffenholz, R.; Franke, W. W.: Identification and localization of a neurally expressed member of the plakoglobin/armadillo multigene family. Differentiation 61:293-304, 1997.

Zhou, J.; Liyanage, U.; Medina, M.; Ho, C.; Simmons, A. D.; Lovett. M.; Kosik, K. S.: Presenilin 1 interaction in the brain with a novel member of the armadillo family. Neuroreport 8:2085-2090, 1997.

Burger, J.; Fonknechten, N.; Hoeltzenbein, M.; Neumann, L.; Bratanoff, E.; Hazan, J.; Reis, A.: Hereditary spastic paraplegia caused by mutations in the SPG4 gene. Europ. J. Hum. Genet. 8:771-776, 2000.

Burger, J.; Metzke, H.; Paternotte, C.; Schilling, F.; Hazan, J.; Reis, A.: Autosomal dominant spastic paraplegia with anticipation maps to a 4-cM interval on chromosome 2p21-p24 in a large German family. Hum. Genet. 98:371-375, 1996.

Errico, A.; Ballabio, A.; Rugarli, E. I.: Spastin, the protein mutated in autosomal dominant hereditary spastic paraplegia, is involved in microtubule dynamics. Hum. Molec. Genet. 11:153-163, 2002.

Lindsey, J. C.; Lusher, M. E.; McDermott, C. J.; White, K. D.; Reid, E.; Rubinsztein, D. C.; Bashir, R.; Hazan, J.; Shaw, P. J.; Bushby, K. M. D.: Mutation analysis of the spastin gene (SPG4) in patients with hereditary spastic paraplegia. J. Med. Genet. 37:759-765, 2000.

Takahashi, N.; Tuiki, H.; Saya, H.; Kaibuchi, K.: Localization of the gene coding for ROCK II/Rho kinase on human chromosome 2p24. Genomics 55:235-237, 1999.

Gruber, A. D.; Pauli, B. U.: Clustering of the human CLCA gene family on the short arm of chromosome 1 (1p22-31). Genome 42:1030-1032,1999.

Kedra, D.; Pan, H.-Q.; Seroussi, E.; Fransson, I.; Guilbaud, C.; Collins, J. E.; Dunham, I.; Blennow, E.; Roe, B. A.; Piehl, F.; Dumanski, J. P.: Characterization of the human synaptogyrin gene family. Hum. Genet. 103:131-141, 1998.

Hazan, J.; Davoine, C. S.; Mavel, D.; Fonknechten, N.; Paternotte, C.; Fizames, C.; Cruaud, C.; Samson, D.; Muselet, D.; Vega-Czarny, N.; Brice, A.; Gyapay, G.; Heilig, R.; Fontaine, B.; Weissenbach, J.: A fine integrated map of the SPG4 locus excludes an expanded CAG repeat in chromosome 2p-linked autosomal dominant spastic paraplegia. Genomics 60:309-319, 1999.

Hazan, J.; Fonknechten, N.; Mavel, D.; Paternotte, C.; Samson, D.; Artiguenave, F.; Davoine, C.-S.; Cruaud, C.; Durr, A.; Wincker, P.; Brottier, P.; Cattolico, L.; Barbe, V.; Burgunder, J.-M.; Prud'homme, J.-F.; Brice, A.; Fontaine, B.; Heilig, R.; Weissenbach, J.: Spastin, a new AAA protein, is altered in the most frequent form of autosomal dominant spastic paraplegia. Nature Genet. 23:296-303, 1999.

Bedford, F. K.; Ashworth, A.; Enver, T.; Wiedemann, L. M.: HEX:a novel homeobox gene expressed during haematopoiesis and conserved between mouse and human. Nucleic Acids Res. 21:1245-1249, 1993.

Crompton, M. R.; Bartlett, T. J.; MacGregor, A. D.; Manfioletti, G.; Buratti, E.; Giancotti, V.; Goodwin, G. H.: Identification of a novel vertebrate homeobox gene expressed in haematopoietic cells. Nucleic Acids Res. 20:5661-5667, 1992.

d'Elia, A. V.; Tell, G.; Russo, D.; Arturi, F.; Puglisi, F.; Manfioletti, G.; Gattei, V.; Mack, D. L.; Cataldi, P.; Filetti, S.; Di Loreto, C.; Damante, G.: Expression and localization of the homeodomain-containing protein HEX in human thyroid tumors. J. Clin. Endocr. Metab. 87:1376-1383, 2002.

Hromas, R.; Radich, J.; Collins, S.: PCR cloning of an orphan homeobox gene (PRH) preferentially expressed in myeloid and liver cells. Biochem. Biophys. Res. Commun. 195:976-983, 1993.

Morgutti, M.; Demori, E.; Pecile, V.; Amoroso, A.; Rustighi, A.; Manfioletti, G.: Genomic organization and chromosome mapping of the human homeobox gene HHEX. Cytogenet. Cell Genet. 94:30-32, 2001.

Tanaka, T.; Inazu, T.; Yamada, K.; Myint, Z.; Keng, V. W; Inoue, Y.; Taniguchi, N.; Noguchi, T.: cDNA cloning and expression of rat homeobox gene, Hex, and functional characterization of the protein. Biochem. J. 339:111-117, 1999.

Miles, M. F.; Barhite, S.; Sganga, M.; Elliott, M.: Phosducin-like protein: an ethanol-responsive potential modulator of guanine nucleotide-binding protein function. Proc. Nat. Acad. Sci. 90:10831-10835, 1993.

Thibault, C.; Wang, J. F.; Charnas, R.; Mirel, D.; Barhite, S.; Miles, M. F.: Cloning and characterization of the rat and human phosducin-like protein genes: structure, expression and chromosomal localization. Biochim. Biophys. Acta 1444:346-354, 1999.

Fusco, C.; Reymond, A.; Zervos, A. S.: Molecular cloning and characterization of a novel retinoblastoma-binding protein. Genomics 51:351-358,1998.

Schaeper, U.; Subramanian, T.; Lim, L.; Boyd, J. M.; Chinnadurai, G.: Interaction between a cellular protein that binds to the C-terminal region of adenovirus E1A (CtBP) and a novel cellular protein is disrupted by E1A through a conserved PLDLS motif. J. Biol. Chem. 273:8549-8552,1998.

Wong, A. K. C.; Ormonde, P. A.; Pero, R.; Chen, Y.; Lian, L.; Salada, G.; Berry, S.; Lawrence, Q.; Dayananth, P.; Ha, P.; Tavtigian, S. V.; Teng, D. H.-F.; Bartel, P. L.: Characterization of a carboxy-terminal BRCA1 interacting protein. Oncogene 17:2279-2285, 1998.

Yu, X.; Baer, R.: Nuclear localization and cell cycle-specific expression of CtIP, a protein that associates with the BRCA1 tumor suppressor. J. Biol. Chem. 275:18541-18549, 2000.

Yu, X.; Wu, L. C.; Bowcock, A. M.; Aronheim, A.; Baer, R.: The C-terminal (BRCT) domains of BRCA1 interact in vivo with CtIP, a protein implicated in the CtBP pathway of transcriptional repression. J. Biol. Chem. 273:25388-25392, 1998.

Pope, R. K.; Pestonjamasp, K. N.; Smith, K. P.; Wulfkuhle, J. D.; Strassel, C. P.; Lawrence, J. B.; Luna, E. J.: Cloning, characterization, and chromosomal localization of human supervillin (SVIL). Genomics 52:342-351, 1998.

Ting, H.-J.; Yeh, S.; Nishimura, K.; Chang, C.: Supervillin associates with androgen receptor and modulates its transcriptional activity. Proc. Nat. Acad. Sci. 99:661-666, 2002.

Bianchi, V.; Robles, R.; Alberio, L.; Furlan, M.; Lammle, B.:Von Willebrand factor-cleaving protease (ADAMTS13) in thrombocytopenic disorders: a severely deficient activity is specific for thrombotic thrombocytopenic purpura. Blood 100:710-713, 2002.

Fujikawa, K.; Suzuki, H.; McMullen, B.; Chung, D.: Purification of human von Willebrand factor-cleaving protease and its identification as a new member of the metalloproteinase family. Blood 98:1662-1666,2001.

Furlan, M.; Robles, R.; Solenthaler, M.; Wassmer, M.; Sandoz, Pl; Lammle, B.: Deficient activity of von Willebrand factor-cleaving protease in chronic relapsing thrombotic thrombocytopenic purpura. Blood 89:3097-3103, 1997.

Gerritsen, H. E.; Robles, R.; Lammle, B.; Furlan, M.: Partial amino acid sequence of purified von Willebrand factor-cleaving protease. Blood 98:1654-1661, 2001.

Kokame, K.; Matsumoto, M.; Soejima, K.; Yagi, H.; Ishizashi, H.; Funato, M.; Tamai, H.; Konno, M.; Kamide, K.; Kawano,Y.; Miyata, T.; Fujimura, Y.: Mutations and common polymorphisms in ADAMTS13 gene responsible for von Willebrand factor-cleaving protease activity. Proc. Nat. Acad. Sci. 99:11902-11907, 2002.

Matoskova, B.; Wong, W. T.; Nomura, N.; Robbins, K. C.; Di Fiore, P. P.: RN-tre specifically binds to the SH3 domain of eps8 with high affinity and confers growth advantage to NIH3T3 upon carboxy-terminal truncation. Oncogene 12:2679-2688, 1996.

Matoskova, B.; Wong, W. T.; Seki, N.; Nagase, T.; Nomura, N.; Robbins, K. C.; Di Fiore, P. P.: RN-tre identifies a family of tre-related proteins displaying a novel potential protein binding domain. Oncogene 12:2563-2571, 1996.

Lee, M. P.; Brandenburg, S.; Landes, G. M.; Adams, M.; Miller, G.; Feinberg, A. P.: Two novel genes in the center of the 11p15 imprinted domain escape genomic imprinting. Hum. Molec. Genet. 8:683-690,1999.

Nakamura, M.; Masuda, H.; Horii, J.; Kuma, K.; Yokoyama, N.; Ohba, T.; Nishitani, H.; Miyata, T.; Tanaka, M.; Nishimoto, T.: When overexpressed, a novel centrosomal protein, RanBPM, causes ectopic microtubule nucleation similar to gamma-tubulin. J. Cell Biol. 143:1041-1052, 1998.

Nishitani, H.; Hirose, E.; Uchimura, Y.; Nakamura,; M.; Umeda, M.; Nishii, K.; Mori, N.; Nishimoto, T.: Full-sized RanBPM cDNA encodes a protein possessing a long stretch of proline and glutamine within the N-terminal region, comprising a large protein complex. Gene 272:25-33, 2001.

Miyamoto, T.; Kanazawa, N.; Kato, S.; Kawakami, M.; Inoue, Y.; Kuhara, T.; Inoue, T.; Takeshita, K.; Tsujino, S.: Diagnosis of Japanese patients with HHH syndrome by molecular genetic analysis: a common mutation, R179X. J. Hum. Genet. 46:260-262, 2001.

Nakajima, M.; Ishii, S.; Mito, T.; Takeshita, K.; Takashima, S.; Takakura, H.; Inoue, I.; Saheki, T.; Akiyoshi, H.; Ichihara, K.:Clinical, biochemical and ultrastructural study on the pathogenesis of hyperornithinemia-hyperammonemia-homocitrullinuria syndrome. BrainDev. 10:181-185, 1988.

Tsujino, S.; Kanazawa, N.; Ohashi, T.; Eto, Y.; Saito, T.; Kira, J.; Yamada, T.: Three novel mutations (G27E, insAAC, R179X) in the ORNT1 gene of Japanese patients with hyperornithinemia, hyperammonemia, and homocitrullinuria syndrome. Ann. Neurol. 47:625-631, 2000.

Bellefroid, E. J.; Marine, J. C.; Ried, T.; Lecocq, P. J.; Riviere, M.; Amemiya, C.; Poncelet, D. A.; Coulie, P. G.; de Jong, P.; Szpirer, C.; Ward, D. C.; Martial, J. A.: Clustered organization of homologous KRAB zinc-finger genes with enhanced expression in human T lymphoid cells. EMBO J. 12:1363-1374, 1993.

Bellefroid, E. J.; Poncelet, D. A.; Lecocq, P. J.; Revelant, O.; Martial, J. A.: The evolutionarily conserved Kruppel-associated box domain defines a subfamily of eukaryotic multifingered proteins. Proc. Nat. Acad. Sci. 88:3608-3612, 1991.

Grand, R. J. A.; Milner, A. E.; Mustoe, T.; Johnson, G. D.; Owen, D.; Grant, M. L.; Gregory, C. D.: A novel protein expressed in mammalian cells undergoing apoptosis. Exp. Cell Res. 218:439-451, 1995.

Twist, C. J.; Beier, D. R.; Disteche, C. M.; Edelhoff, S.; Tedder, T. F.: The mouse Cd83 gene: structure, domain organization, and chromosome localization. Immunogenetics 48:383-393, 1998.

Lee, S. B.; Rao, A. K.; Lee, K.-H.; Yang, X.; Bae, Y. S.; Rhee, S. G.: Decreased expression of phospholipase C-b2 isozyme in human platelets with impaired function. Blood 88:1684-1691, 1996.

Mao, G. F.; Vaidyula, V. R.; Kunapuli, S. P.; Rao, A. K.: Lineage-specific defect in gene expression in human platelet phospholipase C-beta-2deficiency. Blood 99:905-911, 2002.

Park, D.; Jhon, D.-Y.; Kriz, R.; Knopf, J.; Rhee, S. G.: Cloning, sequencing, expression, and Gq-independent activation of phospholipase C-beta-2. J. Biol. Chem. 267:16048-16055, 1992.

Park, S. H.; Ryu, S. H.; Suh, P. G.; Kim, H.: Assignment of human PLCB2 encoding PLC-beta-2 to human chromosome 15q15 by fluorescence in situ hybridization. Cytogenet. Cell Genet. 83:48-49, 1998.

Rao, A. K.; Kowalska, M. A.; Disa, J.: Impaired cytoplasmic ionized calcium mobilization in inherited platelet secretion defects. Blood 74:664-672, 1989.

Yang, X.; Sun, L.; Ghosh, S.; Rao, A. K.: Human platelet signaling defect characterized by impaired production of 1,4,5 inositol triphosphate and phosphatic acid, and diminished pleckstrin phosphorylation. Evidence for detective phospholipase C activation. Blood 88:1676-1683, 1996.

Hammond, E. M.; Brunet, C. L.; Johnson, G. D.; Parkhill, J.; Milner, A. E.; Brady, G.; Gregory, C. D.; Grand, R. J. A.: Homology between a human apoptosis specific protein and the product of APG5, a gene involved in autophagy in yeast. FEBS Lett. 425:391-395, 1998.

Schmeiser, K.; Armstrong, S.; Hammond, E. M.; Grand, R. J. A.:Assignment of the yeast APG5 human homologue APG5L to chromosome band 6q21 by fluorescence in situ hybridisation. Cytogenet. Cell Genet. 87:213-214, 1999.

Nakayama, M.; Nakajima, D.; Nagase, T.; Nomura, N.; Seki, N.; Ohara, O.: Identification of high-molecular-weight proteins with multiple EGF-like motifs by motif-trap screening. Genomics 51:27-34, 1998.

Wu, Q.; Maniatis, T.: Large exons encoding multiple ectodomains are a characteristic feature of protocadherin genes. Proc. Nat. Acad. Sci. 97:3124-3129, 2000.

Falcon-Perez, J. M.; Starcevic, M.; Gautam, R.; Dell'Angelica, E. C.: BLOC-1, a novel complex containing the pallidin and muted proteins involved in the biogenesis of melanosomes and platelet-dense granules. J. Biol. Chem. 277:28191-28199, 2002.

Huang, L.: Personal Communication. San Francisco, Calif. Feb. 3, 2000.

Huang, L.; Kuo, Y.-M.; Gitschier, J.: The pallid gene encodes a novel, syntaxin 13-interacting protein involved in platelet storage pool deficiency. Nature Genet. 23:329-332, 1999.

Paine-Saunders, S.; Viviano, B. L.; Saunders, S.: GPC6, a novel member of the glypican gene family, encodes a product structurally related to GPC4 and is colocalized with GPC5 on human chromosome 13. Genomics 57:455-458, 1999.

Veugelers, M.; De Cat, B.; Ceulemans, H.; Bruystens, A. M.; Coomans, C.; Durr, J.; Vermeesch, J.; Marynen, P.; David, G.: Glypican-6, a new member of the glypican family of cell surface heparan sulfate proteoglycans. J. Biol. Chem. 274:26968-26977, 1999.

Takei, Y.; Sasaki, S.; Fujiwara, T.; Takahashi, E.; Muto, T.; Nakamura, Y.: Molecular cloning of a novel gene similar to myeloid antigen CD33 and its specific expression in placenta. Cytogenet. Cell Genet. 78:295-300, 1997.

Jacobs, S.; Schurmann, A.; Becker, W.; Bockers, T. M.; Copeland, N. G.; Jenkins, N. A.; Joost, H.-G.: The mouse ADP-ribosylation factor-like 4 gene: two separate promoters direct specific transcription in tissues and testicular germ cell. Biochem. J. 335:259-265, 1998.

Bootcov, M. R.; Bauskin, A. R.; Valenzuela, S. M.; Moore, A. G.; Bansal, M.; He, X. Y.; Zhang, H. P.; Donnellan, M.; Mahler, S.; Pryor, K.; Walsh, B. J.; Nicholson, R. C.; Fairlie, W. D.; Por, S. B.; Robbins, J. M.; Breit, S. N.: MIC-1, a novel macrophage inhibitory cytokine, is a divergent member of the TGF-beta superfamily. Proc. Nat. Acad. Sci. 94:11514-11519, 1997.

Bottner, M.; Laaff, M.; Schechinger, B.; Rappold, G.; Unsicker, K.; Suter-Crazzolara, C.: Characterization of the rat, mouse, and human genes of growth/differentiation factor-15/macrophage inhibiting cytokine-1 (GDF-15/MIC-1). Gene 237:105-111, 1999.

Brown, D. A.; Breit, S. N.; Buring, J.; Fairlie, W. D.; Bauskin, A. R.; Liu, T.; Ridker, P. M.: Concentration in plasma of macrophage inhibitory cytokine-1 and risk of cardiovascular events in women: a nested case-control study. Lancet 359:2159-2163, 2002.

Fairlie, W. D.; Russell, P. K.; Wu, W. M.; Moore, A. G.; Zhang, H.-P.; Brown, P. K.; Bauskin, A. R.; Breit, S. N.: Epitope mapping of the transforming growth factor-beta superfamily protein, macrophage inhibitory cytokine-1 (MIC-1): identification of at least five distinct epitope specificities. Biochemistry 40:65-73, 2001.

Hromas, R.; Hufford, M.; Sutton, J.; Xu, D.; Li, Y.; Lu, L.: PLAB, a novel placental bone morphogenetic protein. Biochim. Biophys. Acta 1354:40-44, 1997.

Paralkar, V. M.; Vail, A. L.; Grasser, W. A.; Brown, T. A.; Xu, H.; Vukicevic, S.; Ke, H. Z.; Qi, H.; Owen, T. A.; Thompson, D. D.: Cloning and characterization of a novel member of the transforming growth factor-beta/bone morphogenetic protein family. J. Biol. Chem. 273:13760-13767, 1998.

Yokoyama-Kobayashi, M.; Saeki, M.; Sekine, S.; Kato, S.: human CDNA encoding a novel TGF-beta superfamily protein highly expressed in placenta. J. Biochem. 122:622-626, 1997.

Conklin, D. C.; Rixon, M. W.; Kuestner, R. E.; Maurer, M. F.; Whitmore, T. E.; Millar, R. P.: Cloning and gene expression of a novel human ribonucleoprotein. Biochim. Biophys. Acta 1492:465-469, 2000.

Moore, A. G.; Brown, D. A.; Fairlie, W. D.; Bauskin, A. R.; Brown, P. K.; Munier, M. L. C.; Russell, P. K.; Salamonsen, L. A.; Wallace, E. M.; Breit, S. N.: The transforming growth factor-beta superfamily cytokine macrophage inhibitory cytokine-1 is present in high concentrations in the serum of pregnant women. J. Clin. Endocr. Metab. 85:4781-4788, 2000.

Kataoka, N.; Yong, J.; Kim, V. N.; Velazquez, F.; Perkinson, R. A.; Wang, F.; Dreyfuss, G.: Pre-mRNA splicing imprints mRNA in the nucleus with a novel RNA-binding protein that persists in the cytoplasm. Molec. Cell 6:673-682, 2000.

Salicioni, A. M.; Xi. M.; Vanderveer, L. A.; Balsara, B.; Testa, J. R.; Dunbrack, R. L., Jr.; Godwin, A. K.: Identification and structural analysis of human RBM8A and RBM8B: two highly conserved RNA-binding motif proteins that interact with OVCA1, a candidate tumor suppressor. Genomics 69:54-62, 2000.

Zhao, X.-F.; Nowak, N. J.; Shows, T. B.; Aplan, P. D.: MAGOH interacts with a novel RNA-binding protein. Genomics 63:145-148, 2000.

Fischle, W.; Emiliani, S.; Hendzel, M. J.; Nagase, T.; Nomura, N.; Voelter, W.; Verdin, E.: A new family of human histone deacetylases related to Saccharomyces cerevisiae HDA1p. J. Biol. Chem. 274:11713-11720,1999.

Pazin, M. J.; Kadonaga, J. T.: What's up and down with histone deacetylation and transcription? Cell 89:325-328, 1997.

Zhou, L.-J.; Tedder, T. F.: Human blood dendritic cells selectively express CD83, a member of the immunoglobulin superfamily. J. Immun. 154:3821-3835, 1995.

Zhou, L. J.; Schwarting, R.; Smith, H. M.; Tedder, T. F.: A novel cell-surface molecule expressed by human interdigitating reticulum cells, Langerhans cells, and activated lymphocytes is a new member of the Ig superfamily. J. Immun. 149:735-742, 1992.

Bost-Usinger, L.; Chen, R. J.; Hillman, D.; Park, P.; Burnside, B.: Multiple kinesin family members expressed in teleost retina and RPE include a novel C-terminal kinesin. Exp. Eye Res. 64:781-794,1997.

Hoang, E. H.; Whitehead, J. L.; Dose, A. C.; Burnside, B.: Cloning of a novel C-terminal kinesin (KIFC3) that maps to human chromosome 16q13-q21 and thus is a candidate gene for Bardet-Biedl syndrome. Genomics 52:219-222, 1998.

Norman, D. A. M.; Barton, P. J. R.: Isolation, sequence, and chromosomal localisation of the human I(kappa)BR gene. Ann. Hum. Genet. 64:15-23, 2000.

Ray, P.; Zhang, D.-H.; Elias, J. A.; Ray, A.: Cloning of a differentially expressed I-kappa-B-related protein. J. Biol. Chem. 270:10680-10685,1995.

Lovering, R.; Trowsdale, J.: A gene encoding 22 highly related zinc fingers is expressed in lymphoid cell lines. Nucleic Acids Res. 19:2921-2928, 1991.

Uchiumi, T.; Hinoshita, E.; Haga, S.; Nakamura, T.; Tanaka, T.; Toh, S.; Furukawa, M.; Kawabe, T.; Wada, M.; Kagotani, K.; Okumura, K.; Kohno, K.; Akiyama, S.; Kuwano, M.: Isolation of a novel human canalicular multispecific organic anion transporter, cMOAT2/MRP3, and its expression in cisplatin-resistant cancer cells with decreased ATP-dependent drug transport. Biochem. Biophys. Res. Commun. 252:103-110, 1998.

Bruhn, S. L.; Pil, P. M.; Essigmann, J. M.; Housman, D. E.; Lippard, S. J.: Isolation and characterization of human cDNA clones encoding a high mobility group box protein that recognizes structural distortions to DNA caused by binding of the anticancer agent cisplatin. Proc. Nat. Acad. Sci. 89:2307-2311, 1992.

Orphanides, G.; LeRoy, G.; Chang, C.-H.; Luse, D. S.; Reinberg, D.: FACT, a factor that facilitates transcript elongation through nucleosomes. Cell 92:105-116, 1998.

Caira, F.; Antonson, P.; Pelto-Huikko, M.; Treuter, E.; Gustafsson, J.-A.: Cloning and characterization of RAP250, a novel nuclear receptor coactivator. J. Biol. Chem. 275:5308-5317, 2000.

Guan, X. Y.; Xu, J.; Anzick, S. L.; Zhang, H.; Trent, J. M.; Meltzer, P. S.: Hybrid selection of transcribed sequences from microdissected DNA: isolation of genes within amplified region at 20q11-q13.2 in breast cancer. Cancer Res. 56:3446-3450, 1996.

Ko, L.; Cardona, G. R.; Chin, W. W.: Thyroid hormone receptor-binding protein, an LXXLL motif-containing protein, functions as a general coactivator. Proc. Nat. Acad. Sci. 97:6212-6217, 2000.

Lee, S.-K.; Anzick, S. L.; Choi, J.-E.; Bubendorf, L.; Guan, X.-Y.; Jung, Y.-K.; Kallioniemi, O. P.; Kononen, J.; Trent, J. M.; Azorsa, D.; Jhun, B.-H.; Cheong, J. H.; Lee, Y. C.; Meltzer, P. S.; Lee, J. W.: A nuclear factor, ASC-2, as a cancer-amplified transcriptional coactivator essential for ligand-dependent transactivation by nuclear receptors in vivo. J. Biol. Chem. 274:34283-34293, 1999.

Mahajan, M. A.; Samuels, H. H: A new family of nuclear receptor coregulators that integrate nuclear receptor signaling through CREB-binding protein. Molec. Cell. Biol. 20:5048-5063, 2000.

Zhu, Y.; Kan, L.; Qi, C.; Kanwar, Y. S.; Yeldandi, A. V.; Rao, M. S.; Reddy, J. K.: Isolation and characterization of peroxisome proliferator-activated receptor (PPAR) interacting protein (PRIP) as a coactivator for PPAR. J. Biol. Chem. 275: 13510-13516, 2000.

Burmester, T.; Weich, B.; Reinhardt, S.; Hankeln, T.: A vertebrate globin expressed in the brain. Nature 407:520-523, 2000.

Moens, L.; Dewilde, S.: Globins in the brain. Nature 407: 461-462,2000.

Ann, K.; Kowalchyk, J. A.; Loyet, K. M.; Martin, T. F. J.: Novel Ca (2+)-binding protein (CAPS) related to UNC-31 required for Ca (2+)-activated exocytosis. J. Biol. Chem. 272:19637-19640, 1997.

Berwin, B.; Floor, E.; Martin, T. F. J.: CAPS (mammalian UNC-31) protein localizes to membranes involved in dense-core vesicle exocytosis. Neuron 21:137-145, 1998.

Hirosawa, M.; Nagase, T.; Ishikawa, K.; Kikuno, R.; Nomura, N.; Ohara, O.: Characterization of cDNA clones selected by the GeneMark analysis from size-fractionated cDNA libraries from human brain. DNA Res. 6:329-336, 1999.

Walent, J. H.; Porter, B. W.; Martin, T. F. J.: A novel 145kd brain cytosolic protein reconstitutes Ca (2+)-regulated secretion inpermeable neuroendocrine cells. Cell 70:765-775, 1992.

Veldhuisen, B.; Spruit, L.; Dauwerse, H. G.; Breuning, M. H.; Peters, D. J.: Genes homologous to the autosomal dominant polycystic kidney disease genes (PKD1 and PKD2). Europ. J. Hum. Genet. 7:860-872,1999.

Hughes, J.; Ward, C. J.; Aspinwall, R.; Butler, R.; Harris, P. C.: Identification of a human homologue of the sea urchin receptor for egg jelly: a polycystic kidney disease-like protein. Hum. Molec. Genet. 8:543-549, 1999.

Battini, J.-L.; Rasko, J. E. J.; Miller, A. D.: A human cell-surface receptor for xenotropic and polytropic murine leukemia viruses: possible role in G protein-coupled signal transduction. Proc. Nat. Acad. Sci. 96:1385-1390, 1999.

Levy, J. A.: Xenotropism: the elusive viral receptor finally uncovered. Proc. Nat. Acad. Sci. 96:802-804, 1999.

Tailor, C. S.; Nouri, A.; Lee, C. G.; Kozak, C.; Kabat, D.: Cloning and characterization of a cell surface receptor for xenotropic and polytropic murine leukemia viruses. Proc. Nat. Acad. Sci. 96:927-932,1999.

Yang, Y.-L.; Guo, L.; Xu, S.; Holland, C. A.; Kitamura, T.; Hunter, K.; Cunningham, J. M.: Receptors for polytropic and xenotropic mouse leukaemia viruses encoded by a single gene at Rmc1. Nature Genet. 21:216-219, 1999.

Aksoy, S.; Raftogianis, R.; Weinshilboum, R.: Human histamine N-methyltransferase gene: structural characterization and chromosomal localization. Biochem. Biophys. Res. Commun. 219:548-554, 1996.

Preuss, C. V.; Wood, T. C.; Szumlanski, C. L.; Raftogianis, R. B.; Otterness, D. M.; Girard, B.; Scott, M. C.; Weinshilboum, R. M.: Human histamine N-methyltransferase pharmacogenetics: common genetic polymorphisms that alter activity. Molec. Pharm. 53:708-717, 1998.

Price, R. A.; Scott, M. C.; Weinshilboum, R. M.: Genetic segregation analysis of red blood cell (RBC) histamine N-methyltransferase (HNMT) activity. Genet. Epidemiol. 10:123-131, 1993.

Scott, M. C.; Van Loon, J. A.; Weinshilboum, R. M.: Pharmacogenetics of N-methylation: heritability of human erythrocyte histamine N-methyltransferase activity. Clin. Pharm. Ther. 43:256-262, 1988.

Yamauchi, K.; Sekizawa, K.; Suzuki, H.; Nakazawa, H.; Ohkawara, Y.; Katayose, D.; Ohtsu, H.; Tamura, G.; Shibahara, S.; Takemura, M.; Maeyama, K.; Watanabe, T.; Sasaki, H.; Shirato, K.; Takishima, T.: Structure and function of human histamine N-methyltransferase:critical enzyme in histamine metabolism in airway. Am. J. Physiol. 267:L342-L349, 1994.

Yan, L.; Galinsky, R. E.; Bernstein, J. A.; Liggett, S. B.; Weinshilboum, R. M.: Histamine N-methyltransferase pharmacogenetics: association of a common functional polymorphism with asthma. Pharmacogenetics 10:261-266, 2000.

Bartoloni, L.; Blouin, J.-L. C.; Sainsbury, A. J.; Gos, A.; Morris, M. A.; Affara, N. A.; DeLozier-Blanchet, C. D.; Antonarakis, S. E.: Assignment of the human dynein heavy chain gene DNAH17L to human chromosome 17p12 by in situ hybridization and radiation hybrid mapping. Cytogenet. Cell Genet. 84:188-189, 1999.

Bartoloni, L.; Blouin, J.-L.; Maiti, A. K.; Sainsbury, A.; Rossier, C.; Gehrig, C.; She, J.-X.; Marron, M. P.; Lander, E. S.; Meeks, M.; Chung, E.; Armengot, M.; Jorissen, M.; Scott, H. S.; Delozier-Blanchet, C. D.; Gardiner, R. M.; Antonarakis, S. E.: Axonemal beta heavy chain dynein DNAH9: cDNA sequence, genomic structure, and investigation of its role in primary ciliary dyskinesia. Genomics 72:21-33, 2001.

Maiti, A. K.; Mattei, M.-G.; Jorissen, M.; Volz, A.; Zeigler, A.; Bouvagnet, P.: Identification, tissue specific expression, and chromosomal localisation of several human dynein heavy chain genes. Europ. J. Hum. Genet. 8:923-932, 2000.

Milisav, I.; Jones, M. H.; Affara, N. A.: Characterization of a novel human dynein-related gene that is specifically expressed in testis. Mammalian Genome 7:667-672, 1996.

Hart, M. J.; Callow, M. G.; Souza, B.; Polakis, P.: IQGAP1, a calmodulin-binding protein with a rasGAP-related domain, is a potential effector for cdc42Hs. EMBO J. 15:2997-3005, 1996.

Sugimoto, N.; Imoto, I.; Fukuda, Y.; Kurihara, N.; Kuroda, S.; Tanigami, A.; Kaibuchi, K.; Kamiyama, R.; Inazawa, J.: IQGAP1, a negative regulator of cell-cell adhesion, is upregulated by gene amplification at 15q26 in gastric cancer cell lines HSC39 and 40A. J. Hum. Genet. 46:21-25, 2001.

Weissbach, L.; Settleman, J.; Kalady, M. F.; Snijders, A. J.; Murthy, A. E.; Yan, Y.-X.; Bernards, A.: Identification of a human RasGAP-related protein containing calmodulin-binding motifs. J. Biol. Chem. 269:20517-20521, 1994.

Brocker, F.; Bardenheuer, W.; Vieten, L.; Julicher, K.; Werner, N.; Marquitan, G.; Michael, D.; Opalka, B.; Schutte, J.: Assignment of human filamin gene FLNB to human chromosome band 3p14.3 and identification of YACs containing the complete FLNB transcribed region. Cytogenet. Cell Genet. 85:267-268, 1999.

Leedman, P. J.; Faulkner-Jones, B.; Cram, D. S.; Harrison, P. J.; West, J.; O'Brien, E.; Simpson, R.; Coppel, R. L.; Harrison, L. C.: Cloning from the thyroid of a protein related to actin binding protein that is recognized by Graves disease immunoglobulins. Proc. Nat. Acad. Sci. 90:5994-5998, 1993.

Harrington, J. J.; Lieber, M. R.: Functional domains within FEN-1 and RAD2 define a family of structure-specific endonucleases: implications for nucleotide excision repair. Genes Dev. 8:1344-1355, 1994.

Dahl, M. R.; Thiel, S.; Matsushita, M.; Fujita, T.; Willis, A. C.; Christensen, T.; Vorup-Jensen, T.; Jensenius, J. C.: MASP-3 and its association with distinct complexes of the mannan-binding lectin complement activation pathway. Immunity 15:127-135, 2001.

Endo, Y.; Sato, T.; Matsushita, M.; Fujita, T.: Exon structure of the gene encoding the human mannose-binding protein-associated serine protease light chain: comparison with complement C1r and C1sgenes. Int. Immun. 8:1355-1358, 1996.

Matsushita, M.; Thiel, S.; Jensenius, J. C.; Terai, I.; Fujita, T.: Proteolytic activities of two types of mannose-binding lectin-associated serine protease. J. Immun. 165:2637-2642, 2000.

Sato, T.; Endo, Y.; Matsushita, M.; Fujita, T.: Molecular characterization of a novel serine protease involved in activation of the complement system by mannose-binding protein. Int. Immun. 6:665-669, 1994.

Takada, F.; Seki, N.; Matsuda, Y.; Takayama, Y.; Kawakami, M.: Localization of the genes for the 100-kDa complement-activating components of Ra-reactive factor (CRARF and Crarf) to human 3q27-q28 and mouse16B2-B3. Genomics 25:757-759, 1995.

Takada, F.; Takayama, Y.; Hatsuse, H.; Kawakami, M.: A new member of the C1s family of complement proteins found in a bactericidal factor, Ra-reactive factor, in human serum. Biochem. Biophys. Res. Commun. 196:1003-1009, 1993.

Takayama, Y.; Takada, F.; Nowatari, M.; Kawakami, M.; Matsu-ura, N.: Gene structure of the P100 serine-protease component of the human Ra-reactive factor. Molec. Immun. 36:505-514, 1999.

Ashford, M. L. J.; Bond, C. T.; Blair, T. A.; Adelman, J. P.: Cloning and functional expression of a rat heart KATP channel. Nature 370:456-459, 1994.

Bond, C. T.; Pessia, M.; Xia, X.-M.; Lagrutta, A.; Kavanaugh, M. P.; Adelman, J. P.: Cloning and expression of a family of inward rectifier potassium channels. Receptors Channels 2:183-191, 1994.

Tucker, S. J.; James, M. R.; Adelman, J. P.: Assignment of K(ATP)-1, the cardiac ATP-sensitive potassium channel gene (KCNJ5), to human chromosome 11q24. Genomics 28:127-128, 1995.

Wickman, K.; Seldin, M. F.; Gendler, S. J.; Clapham, D. E.: Partial structure, chromosome localization, and expression of the mouse Girk4 gene. Genomics 40:395-401, 1997.

Khurana, T. S.; Engle, E. C.; Bennett, R. R.; Silverman, G. A.; Selig, S.; Bruns, G. A. P.; Kunkel, L. M.: (CA) repeat polymorphism in the chromosome 18 encoded dystrophin-like protein. Hum. Molec. Genet. 3:841 only, 1994.

Eisenberg, I.; Avidan, N.; Potikha, T.; Hochner, H.; Chen, M.; Olender, T.; Barash, M.; Shemesh, M.; Sadeh, M.; Grabov-Nardini, G.; Shmilevich, I.; Friedmann, A.; Karpati, G.; Bradley, W. G.; Baumbach, L.; Lancet, D.; Ben Asher, E.; Beckmann, J. S.; Argov, Z.; Mitrani-Rosenbaum, S.: The UDP-N-acetylglucosamine 2-epimerase/N-acetylmannosamine kinase gene is mutated in recessive hereditary inclusion body myopathy. Nature Genet. 29:83-87, 2001.

Metzinger, L.; Blake, D. J.; Squier, M. V.; Anderson, L. V. B.; Deconinck, A. E.; Nawrotzki, R.; Hilton-Jones, D.; Davies, K. E.: Dystrobrevin deficiency at the sarcolemma of patients with muscular dystrophy. Hum. Molec. Genet. 6:1185-1191, 1997.

Sadoulet-Puccio, H. M.; Feener, C. A.; Schaid, D. J.; Thibodeau, S. N.; Michels, V. V.; Kunkel, L. M.: The genomic organization of human dystrobrevin. Neurogenetics 1:37-42, 1997.

Sadoulet-Puccio, H. M.; Khurana, T. S.; Cohen, J. B.; Kunkel, L. M.: Cloning and characterization of the human homologue of a dystrophin related phosphoprotein found at the Torpedo electric organ post-synaptic membrane. Hum. Molec. Genet. 5:489-496, 1996.

Yoshida, M.; Hama, H.; Ishikawa-Sakurai, M.; Imamura, M.; Mizuno, Y.; Araishi, K.; Wakabayashi-Takai, E.; Noguchi, S.; Sasaoka, T.; Ozawa, E.: Biochemical evidence for association of dystrobrevin with the sarcoglycan-sarcospan complex as a basis for understanding sarcoglycanopathy. Hum. Molec. Genet. 9:1033-1040, 2000.

Luo, J.; Su, F.; Chen, D.; Shiloh, A.; Gu, W.: Deacetylation of p53 modulates its effect on cell growth and apoptosis. Nature 408:377-381, 2000.

Chappell, T. G.; Welch, W. J.; Schlossman, D. M.; Palter, K. B.; Schlesinger, M. J.; Rothman, J. E.: Uncoating ATPase is a member of the 70 kilodalton family of stress proteins. Cell 45:3-13, 1986.

Dworniczak, B.; Mirault, M.-E.: Structure and expression of a human gene coding for a 71 kd heat shock 'cognate' protein. Nucleic Acids Res. 15:5181-5197, 1987.

Tavaria, M.; Gabriele, T.; Anderson, R. L.; Mirault, M.-E.; Baker, E.; Sutherland, G.; Kola, I.: Localization of the gene encoding the human heat shock cognate protein, HSP73, to chromosome 11. Genomics 29:266-268, 1995.

Ungewickell, E.: The 70-kd mammalian heat shock proteins are structurally and functionally related to the uncoating protein that releases clathrintriskelia from coated vesicles. EMBO J. 4:3385-3391, 1985.

Stanier, P.; Abu-Hayyeh, S.; Murdoch, J. N.; Eddleston, J.; Copp, A. J.: Paralogous Sm22-alpha (Tagln) genes map to mouse chromosomes 1 and 9: further evidence for a paralogous relationship. Genomics 51:144-147, 1998.

Tamanini, F.; Bontekoe, C.; Bakker, C. E.; van Unen, L.; Anar, B.; Willemsen, R.; Yoshida, M.; Galjaard, H.; Oostra, B. A.; Hoogeveen, A. T.: Different targets for the fragile X-related proteins revealed by their distinct nuclear localizations. Hum. Molec. Genet. 8:863-869,1999.

Tamanini, F.; Kirkpatrick, L. L.; Schonkeren, J.; van Unen, L.; Bontekoe, C.; Bakker, C.; Nelson, D. L.; Galjaard, H.; Oostra, B. A.; Hoogeveen, A. T.: The fragile X-related proteins FXR1P and FXR2P contain a functional nucleolar-targeting signal equivalent to the HIV-1 regulatory proteins. Hum. Molec. Genet. 9:1487-1493, 2000.

Radice, P.; Pensotti, V.; Jones, C.; Perry, H.; Pierotti, M. A.; Tunnacliffe, A.: The human archain gene, ARCN1, has highly conserved homologs in rice and Drosophila. Genomics 26:101-106, 1995.

Tunnacliffe, A.; van de Vrugt, H.; Pensotti, V.; Radice, P.: The coatomer protein delta-COP, encoded by the archain gene, is conserved across diverse eukaryotes. Mammalian Genome 7:784-786, 1996.

Hawtin, S. R.; Wesley, V. J.; Parslow, R. A.; Simms, J.; Miles, A.; McEwan, K.; Wheatley, M.: A single residue (arg46) located within the N-terminus of the V(1a) vasopressin receptor is critical for binding vasopressin but not peptide or nonpeptide antagonists. Molec. Endocr. 16:600-609, 2002.

Morel, A.; O'Carroll, A.-M.; Brownstein, M. J.; Lolait, S. J.:Molecular cloning and expression of a rat V1a arginine vasopressin receptor. Nature 356:523-526, 1992.

Thibonnier, M.; Auzan, C.; Madhun, Z.; Wilkins, P.; Berti-Mattera, L.; Clauser, E.: Molecular cloning, sequencing, and functional expression of a cDNA encoding the human V1a vasopressin receptor. J. Biol. Chem. 269:3304-3310, 1994.

Thibonnier, M.; Graves, M. K.; Wagner, M. S.; Auzan, C.; Clauser, E.; Willard, H. F.: Structure, sequence, expression, and chromosomal localization of the human V(1a) vasopressin receptor gene. Genomics 31:327-334, 1996.

Young, L. J.; Nilsen, R.; Waymire, K. G.; MacGregor, G. R.; Insel, T. R.: Increased affiliative response to vasopressin in mice expressing the V(1A) receptor from a monogamous vole. Nature 400:766-768,1999.

Evans, S. C.; Foster, C. J.; El-Naggar, A. K.; Lozano, G.: Mapping and mutational analysis of the human TAF2G gene encoding a p53 cofactor. Genomics 57:182-183, 1999.

Klemm, R. D.; Goodrich, J. A.; Zhou, S.; Tjian, R.: molecular cloning and expression of the 32-kDa subunit of human TFIID reveals interactions with VP16 and TFIIB that mediate transcriptional activation. Proc. Nat. Acad. Sci. 92:5788-5792, 1995.

Lu, H.; Levine, A. J.: Human TAFII31 protein is a transcriptional coactivator of the p53 protein. Proc. Nat. Acad. Sci. 92:5154-5158,1995.

Huh, T.-L.; Kim, Y.-O.; Oh, I.-U.; Song, B. J.; Inazawa, J.: Assignment of the human mitochondrial NAD(+)-specific isocitrate dehydrogenase alpha subunit (IDH3A) gene to 15q25.1-q25.2 by in situ hybridization. Genomics 31:295-296, 1996.

Kim, Y.-O.; Oh, I.-U.; Park, H.-S.; Jeng, J.; Song, B. J.; Huh, T.-L.: Characterization of a cDNA clone for human NAD(+)-specific isocitrate dehydrogenase alpha-subunit and structural comparison with its isoenzymes from different species. Biochem. J. 308:63-68, 1995.

Amann, J.; Kidd, V. J.; Lahti, J. M.: Characterization of putative human homologues of the yeast chromosome transmission fidelity gene, CHL1. J. Biol. Chem. 272:3823-3832, 1997.

Amann, J.; Valentine, M.; Kidd, V. J.; Lahti, J. M.: Localization of Chl1-related helicase genes to human chromosome regions 12p11 and12p13: similarity between parts of these genes and conserved human telomeric-associated DNA. Genomics 32:260-265, 1996.

Frank, S.; Werner, S.: The human homologue of the yeast CHL1 geneis a novel keratinocyte growth factor-regulated gene. J. Biol. Chem. 271:24337-24340, 1996.

Barnes, L. D.; Garrison, P. N.; Siprashvili, Z.; Guranowski, A.; Robinson, A. K.; Ingram, S. W.; Croce, C. M.; Ohta, M.; Huebner, K.: Fhit, a putative tumor suppressor in human S, is a dinucleoside 5-prime,5-triple prime-P(1), P(3)-triphosphate hydrolase. Biochemistry 35:11529-11535,1996.

Bernar, J.; Funderburk, S. J.; Sparkes, R. S.: The inducible fragile site on chromosome 3. (Letter) Hum. Genet. 66:373 only, 1984.

Arinami, T.; Kondo, I.; Hamaguchi, H.; Nakajima, S.: Multifocal meningiomas in a patient with a constitutional ring chromosome 22. J. Med. Genet. 23:178-180, 1986.

Petrella, R.; Levine, S.; Wilmot, P. L.; Ashar, K. D.; Casamassima, A. C.; Shapiro, L. R.: Multiple meningiomas in a patient with constitutional ring chromosome 22. Am. J. Med. Genet. 47:184-186, 1993.

Peyrard, M.; Fransson, I.; Xie, Y.-G.; Han, F.-Y.; Ruttledge, M. H.; Swahn, S.; Collins, J. E.; Dunham, I.; Collins, V. P.; Dumanski, J. P.: Characterization of a new member of the human beta-adaptin gene family from chromosome 22q12, a candidate meningioma gene. Hum. Molec. Genet. 3:1393-1399, 1994.

Peyrard, M.; Pan, H.-Q.; Kedra, D.; Fransson, I.; Swahn, S.; Hartman, K.; Clifton, S. W.; Roe, B. A.; Dumanski, J. P.: Structure of the promoter and genomic organization of the human beta-prime-adaptin gene (BAM22) from chromosome 22q12. Genomics 36:112-117, 1996.

Zankl, H.; Zang, K. D.: Correlations between clinical and cytogenetical data in 180 human meningiomas. Cancer Genet. Cytogenet. 1:351-356,1980.

Bai, C.; Sen, P.; Hofmann, K.; Ma, L.; Goebl, M.; Harper, J. W.; Elledge, S. J.: SKP1 connects cell cycle regulators to the ubiquitin proteolysis machinery through a novel motif, the F-box. Cell 86:263-274, 1996.

Kraus, B.; Pohlschmidt, M.; Leung, A. L. S.; Germino, G. G.; Snarey, A.; Schneider, M. C.; Reeders, S. T.; Frischauf, A.-M.: A novel cyclin gene (CCNF) in the region of the polycystic kidney disease gene (PKD1). Genomics 24:27-33, 1994.

Obermayr, F.; Sutherland, H. F.; Kraus, B.; Frischauf, A.-M.:Mouse cyclin F maps to a conserved linkage group on mouse chromosome 17. Mammalian Genome 6:149-150, 1995.

Donaldson, S. H.; Hirsh, A.; Li, D. C.; Holloway, G.; Chao, J.; Boucher, R. C.; Gabriel, S. E.: Regulation of the epithelial sodium channel by serine proteases in human airways. J. Biol. Chem. 277:8338-8345, 2002.

Harvey, K. F.; Dinudom, A.; Cook, D. I.; Kumar, S.: The Nedd4-like protein KIAA0439 is a potential regulator of the epithelial sodium channel. J. Biol. Chem. 276:8597-8601, 2001.

Arriza, J. L.; Kavanaugh, M. P.; Fairman, W. A.; Wu, Y.-N.; Murdoch, G. H.; North, R. A.; Amara, S. G.: Cloning and expression of a human neutral amino acid transporter with structural similarity to the glutamate transporter gene family. J. Biol. Chem. 268:15329-15332, 1993.

Hofmann, K.; Duker, M.; Fink, T.; Lichter, P.; Stoffel, W.: human neutral amino acid transporter ASCT1: structure of the gene (SLC1A4) and localization to chromosome 2p13-p15. Genomics 24:20-26, 1994.

Shafqat, S.; Tamarappoo, B. K.; Kilberg, M. S.; Puranam, R. S.; McNamara, J. O.; Guadano-Ferraz, A.; Fremeau, R. T., Jr.: Cloning and expression of a novel Na (+)-dependent neutral amino acid transporter structurally related to mammalian Na (+)/glutamate cotransporters. J. Biol. Chem. 268: 15351-15355, 1993.

Zerangue, N.; Kavanaugh, M. P.: ASCT-1 is a neutral amino acid exchanger with chloride channel activity. J. Biol. Chem. 271:27991-27994,1996.

Tamimi, R.; Steingrimsson, E.; Copeland, N. G.; Dyer-Montgomery, K.; Lee, J. E.; Hernandez, R.; Jenkins, N. A.; Tapscott, S. J.: The NEUROD gene maps to human chromosome 2q32 and mouse chromosome 2. Genomics 34:418-421, 1996.

Ivey-Hoyle, M.; Conroy, R.; Huber, H. E.; Goodhart, P. J.; Oliff, A.; Heimbrook, D. C.: Cloning and characterization of E2F-2, a novel protein with the biochemical properties of transcription factor E2F. Molec. Cell. Biol. 13:7802-7812, 1993.

Lees, J. A.; Saito, M.; Vidal, M.; Valentine, M.; Look, T.; Harlow, E.; Dyson, N.; Helin, K.: The retinoblastoma protein binds to a family of E2F transcription factors. Molec. Cell. Biol. 13:7813-7825,1993.

Cloud, J. E.; Rogers, C.; Reza, T. L.; Ziebold, U.; Stone, J. R.; Picard, M. H.; Caron, A. M.; Bronson, R. T.; Lees, J. A.: Mutant mouse models reveal the relative roles of E2F1 and E2F3 in vivo. Molec. Cell. Biol. 22:2663-2672, 2002.

He, Y.; Armanious, M. K.; Thomas, M. J.; Cress, W. D.: Identification of E2F-3B, an alternative form of E2F-3 lacking a conserved N-terminal region. Oncogene 19:3422-3433, 2000.

Halford, M. M.; Armes, J.; Buchert, M.; Meskenaite, V.; Grail, D.; Hibbs, M. L.; Wilks, A. F.; Farlie, P. G.; Newgreen, D. F.; Hovens, C. M.; Stacker, S. A.: Ryk-deficient mice exhibit craniofacial defects associated with perturbed Eph receptor crosstalk. Nature Genet. 25:414-418, 2000.

Nakamura, S.; Stock, D. W.; Wydner, K. L.; Bollekens, J. A.; Takeshita, K.; Nagai, B. M.; Chiba, S.; Kitamura, T.; Freeland, T. M.; Zhao, Z.; Minowada, J.; Lawrence, J. B.; Weiss, K. M.; Ruddle, F. H.: Genomic analysis of a new mammalian distal-less gene: Dlx7. Genomics 38:314-324, 1996.

Kumar, S.; Kinoshita, M.; Noda, M.; Copeland, N. G.; Jenkins, N. A.: Induction of apoptosis by the mouse Nedd2 gene, which encodes a protein similar to the product of the Caenorhabditis elegans cell death gene ced-3 and the mammalian IL-1-beta-converting enzyme. Genes Dev. 8:1613-1626, 1994.

Walter, L.; Dirks, B.; Rothermel, E.; Heyens, M.; Szpirer, C.; Levan, G.; Gunther, E.: A novel, conserved gene of the rat that is developmentally regulated in the testis. Mammalian Genome 5:216-221,1994.

Walter, L.; Marynen, P.; Szpirer, J.; Levan, G.; Gunther, E.: Identification of a novel conserved human gene, TEGT. Genomics 28:301-304, 1995.

Xu, Q.; Reed, J. C.: Bax inhibitor-1, a mammalian apoptosis suppressor identified by functional screening in yeast. Molec. Cell 1:337-346,1998.

Hsu, Y.-C.; Perin, M. S.: Human neuronal pentraxin II (NPTX2): conservation, genomic structure, and chromosomal localization. Genomics 28:220-227, 1995.

Schlimgen, A. K.; Helms, J. A.; Vogel, H.; Perin, M. S.: Neuronal pentraxin, a secreted protein with homology to acute phase proteins of the immune system. Neuron 14:519-526, 1995.

Kumar, S.; White, D. L.; Takai, S.; Turczynowicz, S.; Juttner, C. A.; Hughes, T. P.: Apoptosis regulatory gene NEDD2 maps to human chromosome segment 7q34-35, a region frequently affected in haematological neoplasms. Hum. Genet. 95:641-644, 1995.

Lassus, P.; Opitz-Araya, X.; Lazebnik, Y.: Requirement for caspase-2 in stress-induced apoptosis before mitochondrial permeabilization. Science 297:1352-1354, 2002.

Fuhlbrigge, R. C.; Kieffer, J. D.; Armerding, D.; Kupper, T. S.: Cutaneous lymphocyte antigen is a specialized form of PSGL-1 expressed on skin-homing T cells. Nature 389:978-981, 1997.

Herron, M. J.; Nelson, C. M.; Larson, J.; Snapp, K. R.; Kansas, G. S.; Goodman, J. L.: Intracellular parasitism by the human granulocytic ehrlichiosis bacterium through the P-selectin ligand, PSGL-1. Science 288:1653-1656, 2000.

Veldman, G. M.; Bean, K. M.; Cumming, D. A.; Eddy, R. L.; Sait, S. N. J.; Shows, T. B.: Genomic organization and chromosomal localization of the gene encoding human P-selectin glycoprotein ligand. J. Biol. Chem. 270:16470-16475, 1995.

Yang, J.; Galipeau, J.; Kozak, C. A.; Furie, B. C.; Furie, B.:Mouse P-selectin glycoprotein ligand-1: molecular cloning, chromosomal localization, and expression of a functional P-selectin receptor. Blood 87:4176-4186, 1996.

Brown, C. B.; Boyer, A. S.; Runyan, R. B.; Barnett, J. V.: Requirement of type III TGF-beta receptor for endocardial cell transformation in the heart. Science 283:2080-2082, 1999.

Lewis, K. A.; Gray, P. C.; Blount, A. L.; MacConell, L. A.; Wiater, E.; Bilezikjian, L. M.; Vale, W.: Betaglycan binds inhibin and can mediate functional antagonism of activin signalling. Nature 404:411-414, 2000.

Hu, Y.-F.; Luscher, B.; Admon, A.; Mermod, N.; Tjian, R.: Transcription factor AP-4 contains multiple dimerization domains that regulate dimer specificity. Genes Dev. 4:1741-1752, 1990.

Mermod, N.; Williams, T. J.; Tjian, R.: Enhancer binding factors AP-4 and AP-1 act in concert to activate SV40 late transcription in vitro. Nature 332:557-561, 1988.

Carr, C. S.; Sharp, P. A.: A helix-loop-helix protein related to the immunoglobulin E box-binding proteins. Molec. Cell. Biol. 10:4384-4388, 1990.

Bonner, C. A.; Loftus, S. K.; Wasmuth, J. J.: Isolation, characterization, and precise physical localization of human CDX1, a caudal-type homeobox gene. Genomics 28:206-211, 1995.

Subramanian, V.; Meyer, B. I.; Gruss, P.: Disruption of the murine homeobox gene Cdx1 affects axial skeletal identities by altering the mesodermal expression domains of Hox genes. Cell 83:641-653, 1995.

Schwientek, T.; Nomoto, M.; Levery, S. B.; et al: Control of O-glycan branch formation. J. Biol. Chem. 274:4504-4512, 1999.

Walczak, H.; Degli-Esposti, M. A.; Johnson, R. S.; Smolak, P. J.; Waugh, J. Y.; Boiani, N.; Timour, M. S.; Gerhart, M. J.; Schooley, K. A.; Smith, C. A.; Goodwin, R. G.; Rauch, C. T.: TRAIL-R2: a novel apoptosis-mediating receptor for TRAIL. EMBO J. 16:5386-5397, 1997.

Wu, G. S.; Burns, T. F.; McDonald, E. R., III; Jiang, W.; Meng, R.; Krantz, I. D.; Kao, G.; Gan, D.-D.; Zhou, J.-Y.; Muschel, R.; Hamilton, S. R.; Spinner, N. B.; Markowitz, S.; Wu, G.; El-Deiry, W. S.: KILLER/DR5 is a DNA damage-inducible p53-regulated death receptor gene. Nature Genet. 17:141-143, 1997.

Kanaar, R.; Troelstra, C.; Swagemakers, S. M. A.; Essers, J.; Smit, B.; Franssen, J.-H.; Pastink, A.; Bezzubova, O. Y.; Buerstedde, J.-M.; Clever, B.; Heyer, W.-D.; Hoeijmakers, J. H. J.: Human and mouse homologs of the Saccharomyces cerevisiae RAD54 DNA repair gene: evidence for functional conservation. Curr. Biol. 6:828-838, 1996.

Matsuda, M.; Miyagawa, K.; Takahashi, M.; Fukuda, T.; Kataoka, T.; Asahara, T.; Inui, H.; Watatani, M.; Yasutomi, M.; Kamada, N.; Dohi, K.; Kamiya, K.: Mutations in the RAD54 recombination gene in primary cancers. Oncogene 18:3427-3430, 1999.

Tucker, J. E.; Winkfein, R. J.; Cooper, C. B.; Schnetkamp, P. P.: cDNA cloning of the human retinal rod Na-Ca + K exchanger: comparison with a revised bovine sequence. Invest. Ophthal. Vis. Sci. 39:435-440,1998.

Tucker, J. E.; Winkfein, R. J.; Murthy, S. K.; Friedman, J. S.; Walter, M. A.; Demetrick, D. J.; Schnetkamp, P. P. M.: Chromosomal localization and genomic organization of the human retinal rod Na-Ca+K exchanger. Hum. Genet. 103:411-414, 1998.

Hara, Y.; Wakamori, M.; Ishii, M.; Maeno, E.; Nishida, M.; Yoshida, T.; Yamada, H.; Shimizu, S.; Mori, E.; Kudoh, J.; Shimizu, S.; Kurose, H.; Okada, Y.; Imoto, K.; Mori, Y.: LTRPC2 Ca (2+)-permeable channel activated by changes in redox status confers susceptibility to cell death. Molec. Cell 9:163-173, 2002.

Harteneck, C.; Plant, T. D.; Schultz, G.: From worm to man: three subfamilies of TRP channels. Trends Neurosci. 23:159-166, 2000.

Kudoh, J.; Nagamine, K.; Asakawa, S.; Abe, I.; Kawasaki, K.; Maeda, H.; Tsujimoto, S.; Minoshima, S.; Ito, F.; Shimizu, N.: Localization of 16 exons to a 450-kb region involved in the autoimmune polyglandular disease type I (APECED) on human chromosome 21q22.3. DNA Res. 4:45-52, 1997.

Nagamine, K.; Kudoh, J.; Minoshima, S.; Kawasaki, K.; Asakawa, S.; Ito, F.; Shimizu, N.: Molecular cloning of a novel putative Ca (2+) channel protein (TRPC7) highly expressed in brain. Genomics 54:124-131, 1998.

Perraud, A.-L.; Fleig, A.; Dunn, C. A.; Bagley, L. A.; Launay, P.; Schmitz, C.; Stokes, A. J.; Zhu, Q.; Bessman, M. J.; Penner, R.; Kinet, J.-P.; Scharenberg, A. M.: ADP-ribose gating of the calcium-permeable LTRPC2 channel revealed by Nudix motif homology. Nature 411:595-599,2001.

Sano, Y.; Inamura, K.; Miyake, A.; Mochizuki, S.; Yokoi, H.; Matsushime, H.; Furuichi, K.: Immunocyte Ca (2+) influx system mediated by LTRPC2. Science 293:1327-1330, 2001.

Koegl, M.; Hoppe, T.; Schlenker, S.; Ulrich, H. D.; Mayer, T. U.; Jentsch, S.: A novel ubiquitination factor, E4, is involved in multiubiquitin chain assembly. Cell 96:635-644, 1999.

Nonaka, S.; Tanaka, Y.; Okada, Y.; Takeda, S.; Harada, A.; Kanai, Y.; Kido, M.; Hirokawa, N.: Randomization of left-right asymmetry due to loss of nodal cilia generating leftward flow of extraembryonic fluid in mice lacking KIF3B motor protein. Cell 95:829-837, 1998.

Yamazaki, H.; Nakata, T.; Okada, Y.; Hirokawa, N.: KIF3A/B: a heterodimeric kinesin superfamily protein that works as a microtubule plus end-directed motor for membrane organelle transport. J. Cell Biol. 130:1387-1399, 1995.

Cerutti, A.; Schaffer, A.; Goodwin, R. G.; Shah, S.; Zan, H.; Ely, S.; Casali, P.: Engagement of CD153 (CD30 ligand) by CD30-positive T cells inhibits class switch DNA recombination and antibody production in human IgD-positive IgM-positive B cells. J. Immun. 165:786-794,2000.

Croager, E. J.; Abraham, L. J.: Characterisation of the human CD30 ligand gene structure. Biochim. Biophys. Acta 1353:231-235,1997.

Hurskainen, T. L.; Hirohata, S.; Seldin, M. F.; Apte, S. S.: ADAM-TS5, ADAM-TS6, and ADAM-TS7, novel members of a new family of zinc metalloproteases: general features and genomic distribution of the ADAM-TS family. J. Biol. Chem. 274:25555-25563, 1999.

Tang, B. L.; Hong, W.: ADAMTS: a novel family of proteases with an ADAM protease domain and thrombospondin 1 repeats. FEBS Lett. 445:223-225, 1999.

Tortorella, M. D.; Burn, T. C.; Pratta, M. A.; Abbaszade, I.; Hollis, J. M.; Liu, R.; Rosenfeld, S. A.; Copeland, R. A.; Decicco, C. P.; Wynn, R.; Rockwell, A.; Yang, F.; and 16 others: Purification and cloning of aggrecanase-1: a member of the ADAMTS family of proteins. Science 284:1664-1666, 1999.

Smith, C. A.; Gruss, H.-J.; Davis, T.; Anderson, D.; Farrah, T.; Baker, E.; Sutherland, G. R.; Brannan, C. I.; Copeland, N. G.; Jenkins, N. A.; Grabstein, K. H.; Gliniak, B.; and 9 others: CD30 antigen, a marker for Hodgkin's lymphoma, is a receptor whose ligand defines an emerging family of cytokines with homology to TNF. Cell 73:1349-1360,1993.

Higashide, T.; Inana, G.: Characterization of the gene for HRG4(UNC119), a novel photoreceptor synaptic protein homologous to unc-119. Genomics 57:446-450, 1999.

Higashide, T.; McLaren, M. J.; Inana, G.: Localization of HRG4, a photoreceptor protein homologous to unc-119, in ribbon synapse. Invest. Ophthal. Vis. Sci. 39:690-698, 1998.

Higashide, T.; Murakami, A.; McLaren, M. J.; Inana, G.: Cloning of the cDNA for a novel photoreceptor protein. J. Biol. Chem. 271:1797-1804, 1996.

Swanson, D. A.; Chang, J. T.; Campochiaro, P. A.; Zack, D. J.; Valle, D.: Mammalian orthologs of C. elegans unc-119 highly expressed in photoreceptors. Invest. Ophthal. Vis. Sci. 39:2085-2094, 1998.

Gundelfinger, E.: Personal Communication. Madgeburg, FRG. Jan. 8, 1999.

Hashida, H.; Goto, J.; Zhao, N.; Takahashi, N.; Hirai, M.; Kanazawa, I.; Sakaki, Y.: Cloning and mapping of ZNF231, a novel brain-specific gene encoding neuronal double zinc finger protein whose expression is enhanced in a neurodegenerative disorder, multiple system atrophy (MSA). Genomics 54:50-58, 1998.

Santorelli, F. M.; Patrono, C.; Fortini, D.; Tessa, A.; Comanducci, G.; Bertini, E.; Pierallini, A.; Amabile, G. A.; Casali, C.: Intrafamilial variability in hereditary spastic paraplegia associated with an SPG4gene mutation. Neurology 55:702-705, 2000.

Sauter, S.; Miterski, B.; Klimpe, S.; Bonsch, D.; Schols, L.; Visbeck, A.; Papke, T.; Hopf, H. C.; Engel, W.; Deufel, T.; Epplen, J. T.; Neesen, J.: Mutation analysis of the spastin gene (SPG4) in patients in Germany with autosomal dominant hereditary spastic paraplegia. Hum. Mutat. 20:127-132, 2002.

Svenson, I. K.; Ashley-Koch, A. E.; Pericak-Vance, M. A.; Marchuk, D. A.: A second leaky splice-site mutation in the spastin gene. (Letter) Am. J. Hum. Genet. 69:1407-1409, 2001.

Flannery, C. R.; Hughes, C. E.; Schumacher, B. L.; Tudor, D.; Aydelotte, M. B.; Kuettner, K. E.; Caterson, B.: Articular cartilage superficial zone protein (SZP) is homologous to megakaryocyte stimulating factor precursor and is a multifunctional proteoglycan with potential growth-promoting, cytoprotective, and lubricating properties in cartilage metabolism. Biochem. Biophys. Res. Commun. 254:535-541, 1999.

Ikegawa, S.; Sano, M.; Koshizuka, Y.; Nakamura, Y.: Isolation, characterization and mapping of the mouse and human PRG4 (proteoglycan4) genes. Cytogenet. Cell Genet. 90:291-297, 2000.

Merberg, D. M.; Fitz, L. J.; Temple, P.; Giannotti, J.; Murtha, P.; Fitzgerald, M.; Scaltreto, H.; Kelleher, K.; Preissner, K.; Kriz, R.; Jacobs, K.; Turner, K.: In: Preissner, K. T.; Rosenblatt, S.; Kost, C.; Wegerhoff, J.; Mosher, D. F. (eds.): Biology of Vitronectins and Their Receptors. Elsevier Science, B. V. 1993. Pp. 45-53.

Schumacher, B. L.; Block, J. A.; Schmid, T. M.; Aydelotte, M. B.; Kuettner, K. E.: A novel proteoglycan synthesized and secreted by chondrocytes of the superficial zone of articular cartilage. Arch. Biochem. Biophys. 15:144-152, 1994.

Pennica, D.; Swanson, T. A.; Welsh, J. W.; Roy, M. A.; Lawrence, D. A.; Lee, J.; Brush, J.; Taneyhill, L. A.; Deuel, B.; Lew, M.; Watanabe, C.; Cohen, R. L.; Melhem, M. F.; Finley, G. G.; Quirke, P.; Goddard, A. D.; Hillan, K. J.; Gurney, A. L.; Botstein, D.; Levine, A. J.:WISP genes are members of the connective tissue growth factor family that are up-regulated in Wnt-1-transformed cells and aberrantly expressed in human colon tumors. Proc. Nat. Acad. Sci. 95:14717-14722, 1998.

Tanaka, S.; Sugimachi, K.; Saeki, H.; Kinoshita, J.; Ohga, T.; Shimada, M.; Maehara, Y.; Sugimachi, K.: A novel variant of WISP1 lacking a von Willebrand type C module overexpressed in scirrhous gastric carcinoma. Oncogene 20:5525-5532, 2001.

Sano, K.; Tanihara, H.; Heimark, R. L.; Obata, S.; Davidson, M.; St. John, T.; Taketani, S.; Suzuki, S.: Protocadherins: a large family of cadherin-related molecules in central nervous system. EMBO J. 12:2249-2256, 1993.

Dominguez, O.; Ashhab, Y.; Sabater, L.; Belloso, E.; Caro, P.; Pujol-Borrell, R.: Cloning of ARE-containing genes by AU-motif-directed display. Genomics 54:278-286, 1998.

Kostrub, C. F.; Knudsen, K.; Subramani, S.; Enoch, T.: Hus1p, a conserved fission yeast checkpoint protein, interacts with Rad1p and is phosphorylated in response to DNA damage. EMBO J. 17:2055-2066,1998.

Lieberman, H. B.; Hopkins, K. M.; Nass, M.; Demetrick, D.; Davey, S.: A human homolog of the Schizosaccharomyces pombe rad9+ checkpoint control gene. Proc. Nat. Acad. Sci. 93:13890-13895, 1996.

Koike, N.; Hida, A.; Numano, R.; Hirose, M.; Sakaki, Y.; Tei, H.: Identification of the mammalian homologues of the Drosophila timeless gene, timeless1. FEBS Lett. 441:427-431, 1998.

Sangoram, A. M.; Saez, L.; Antoch, M. P.; Gekakis, N.; Staknis, D.; Whiteley, A.; Fruechte, E. M.; Vitaterna, M. H.; Shimomura, K.; King, D. P.; Young, M. W.; Weitz, C. J.; Takahashi, J. S.: Mammalian circadian autoregulatory loop: a timeless ortholog and mPer1 interact and negatively regulate CLOCK-BMAL1-induced transcription. Neuron 21:1101-1113, 1998.

Zylka, M. J.; Shearman, L. P.; Levine, J. D.; Jin, X.; Weaver, D. R.; Reppert, S. M.: Molecular analysis of mammalian timeless. Neuron 21:1115-1122, 1998.

Ardley, H. C.; Rose, S. A.; Tan, N.; Leek, J. P.; Markham, A. F.; Robinson, P. A.: Genomic organization of the human ubiquitin-conjugating enzyme gene, UBE2L6 on chromosome 11q12. Cytogenet. Cell Genet. 89:137-140 , 2000.

Kumar, S.; Kao, W. H.; Howley, P. M.: Physical interaction between specific E2 and Hect E3 enzymes determines functional cooperativity. J. Biol. Chem. 272:13548-13554, 1997.

tom Dieck, S.; Sanmarti-Vila, L.; Langnaese, K.; Richter, K.; Kindler, S.; Soyke, A.; Wex, H.; Smalla, K.-H.; Kampf, U.; Franzer, J.-T.; Stumm, M.; Garner, C. C.; Gundelfinger, E. D.: Bassoon, a novel zinc-finger CAG/glutamine-repeat protein selectively localized at the active zone of presynaptic nerve terminals. J. Cell Biol. 142:499-509, 1998.

Winter, c.; tom Dieck, S.; Boeckers, T. M.; Bockmann, J.; Kampf, U.; Sanmarti-Vila, L.; Langnaese, K.; Altrock, W.; Stumm, M.; Soyke, A.; Wieacker, P.; Garner, C. C.; Gundelfinger, E. D.: The presynaptic cytomatrix protein Bassoon: sequence and chromosomal localization of the human BSN gene. Genomics 57:389-397, 1999.

Hay, J. C.; Chao, D. S.; Kuo, C. S.; Scheller, R. H.: Protein interactions regulating vesicle transport between the endoplasmic reticulum and Golgi apparatus in mammalian cells. Cell 89:149-158,1997.

Li, J.; Ding, S.-F.; Habib, N. A.; Fermor, B. F.; Wood, C. B.; Gilmour, R. S.: Partial characterization of a cDNA for human stearoyl-CoA desaturase and changes in its mRNA expression in some normal and malignant tissues. Int. J. Cancer 57:348-352, 1994.

Ntambi, J. M.; Miyazaki, M.; Stoehr, J. P.; Lan, H.; Kendziorski, C. M.; Yandell, B. S.; Song, Y.; Cohen, P.; Friedman, J. M.; Attie, A. D.: Loss of stearoyl-CoA desaturase-1 function protects mice against adiposity. Proc. Nat. Acad. Sci. 99:11482-11486, 2002.

Thiede, M. A.; Ozols, J.; Strittmatter, P.: Construction and sequence of cDNA for rat liver stearyl coenzyme A desaturase. J. Biol. Chem. 261:13230-13235, 1986.

Zhang, L.; Ge, L.; Parimoo, S.; Stenn, K.; Prouty, S. M.: human Stearoyl-CoA desaturase: alternative transcripts generated from a single gene by usage of tandem polyadenylation sites. Biochem. J. 340:255-264, 1999.

Zheng, Y.; Eilertsen, K. J.; Ge, L.; Zhang, L.; Sundberg, J. P.; Prouty, S. M.; Stenn, K. S.; Parimoo, S.: Scd1 is expressed in sebaceous glands and is disrupted in the asebia mouse. (Letter) Nature Genet. 23:268-270, 1999.

Duh, F.-M.; Latif, F.; Weng, Y.; Geil, L.; Modi, W.; Stackhouse, T.; Matsumura, F.; Duan, D. R.; Linehan, W. M.; Lerman, M. I.; Gnarra, J. R.: cDNA cloning and expression of the human homolog of the sea urchin fascin and Drosophila singed genes which encodes an actin-bundling protein. DNA Cell Biol. 13:821-827, 1994.

Mosialos, G.; Birkenbach, M.; Ayehunie, S.; Matsumura, F.; Pinkus, G. S.; Kieff, E.; Langhoff, E.: Circulating human dendritic cells differentially express high levels of a 55-kd actin-bundling protein. Am. J. Path. 148:593-600, 1996.

Ono, S.; Yamakita, Y.; Yamashiro, S.; Matsudaira, P. T.; Gnarra, J. R.; Obinata, T.; Matsumura, F.: Identification of an actin binding region and a protein kinase C phosphorylation site on human fascin. J. Biol. Chem. 272:2527-2533, 1997.

Pinkus, G. S.; Pinkus, J. L.; Langhoff, E.; Matsumura, F.; Yamashiro, S.; Mosialos, G.; Said, J. W.: Fascin, a sensitive new marker for Reed-Sternberg cells of Hodgkin's disease: evidence for a dendritic or B cell derivation? Am. J. Path. 150:543-562, 1997.

Sonderbye, L.; Magerstadt, R.; Blatman, R. N.; Preffer, F. I.; Langhoff, E.: Selective expression of human fascin (p55) by dendritic leukocytes. Adv. Exp. Med. Biol. 471:41-46, 1997.

Yamakita, Y.; Ono, S.; Matsumura, F.; Yamashiro, S.: Phosphorylation of human fascin inhibits its actin binding and bundling activities. J. Biol. Chem. 271:12632-12638, 1996.

Yamashiro-Matsumura, S.; Matsumura, F.: Intracellular localization of the 55-kD actin-bundling protein in cultured cells: spatial relationships with actin, alpha-actinin, tropomyosin, and fimbrin. J. Cell Biol. 103:631-640, 1986.

Yamashiro-Matsumura, S.; Matsumura, F.: Purification and characterization of an F-actin-bundling 55-kilodalton protein from HeLa cells. J. Biol. Chem. 260:5087-5097, 1985.

Selfors, L. M.; Schutzman, J. L.; Borland, C. Z.; Stern, M. J.: Soc-2 encodes a leucine-rich repeat protein implicated in fibroblast growth factor receptor signaling. Proc. Nat. Acad. Sci. 95:6903-6908,1998.

Sieburth, D. S.; Sun, Q.; Han, M.: SUR-8, a conserved Ras-binding protein with leucine-rich repeats, positively regulates Ras-mediated signaling in C. elegans. Cell 94:119-130, 1998.

Gibbs, P. E. M.; McGregor, W. G.; Maher, V. M.; Nisson, P.; Lawrence, C. W.: A human homolog of the Saccharomyces cerevisiae REV3 gene, which encodes the catalytic subunit of DNA polymerase zeta. Proc. Nat. Acad. Sci. 95:6876-6880, 1998.

Morelli, C.; Mungall, A. J.; Negrini, M.; Barbanti-Brodano, G.; Croce, C. M.: Alternative splicing, genomic structure, and fine chromosome localization of REV3L. Cytogenet. Cell Genet. 83:18-20, 1998.

Xiao, W.; Lechler, T.; Chow, B. L.; Fontanie, T.; Agustus, M.; Carter, K. C.; Wei, Y.-F.: Identification, chromosomal mapping and tissue-specific expression of hREV3 encoding a putative human DNA polymerase zeta. Carcinogenesis 19:945-949, 1998.

Kahn, M. L.; Zheng, Y.-W.; Huang, W.; Bigornia, V.; Zeng, D.; Moff, S.; Farese, R. V., Jr.; Tam, C.; Coughlin, S. R.: A dual thrombin receptor system for platelet activation. Nature 394:690-694, 1998.

Xu, W.-F.; Andersen, H.; Whitmore, T. E.; Presnell, S. R.; Yee, D. P.; Ching, A.; Gilbert, T.; Davie, E. W.; Foster, D. C.: Cloning and characterization of human protease-activated receptor 4. Proc. Nat. Acad. Sci. 95:6642-6646, 1998.

Santoro, B.; Grant, S. G. N.; Bartsch, D.; Kandel, E. R.: Interactive cloning with the SH3 domain of N-src identifies a new brain specific ion channel protein, with homology to Eag and cyclic nucleotide-gated channels. Proc. Nat. Acad. Sci. 94:14815-14820, 1997.

Santoro, B.; Liu, D. T.; Yao, H.; Bartsch, D.; Kandel, E. R.; Siegelbaum, S. A.; Tibbs, G. R.: Identification of a gene encoding a hyperpolarization-activated pacemaker channel of brain. Cell 93:717-729, 1998.

Stevens, D. R.; Seifert, R.; Bufe, B.; Muller, F.; Kremmer, E.; Gauss, R.; Meyerhof, W.; Kaupp, U. B.; Lindemann, B.: Hyperpolarization-activated channels HCN1 and HCN4 mediate responses to sour stimuli. Nature 413:631-635, 2001.

Wainger, B. J.; DeGennaro, M.; Santoro, B.; Siegelbaum, S. A.; Tibbs, G. R.: Molecular mechanism of cAMP modulation of HCN pacemaker channels. Nature 411:805-810, 2001.

Ludwig, A.; Zong, X.; Stieber, J.; Hullin, R.; Hofmann, F.; Biel, M.: Two pacemaker channels from human heart with profoundly different activation kinetics. EMBO J. 18:2323-2329, 1999.

Casari, G.; De Fusco, M.; Ciarmatori, S.; Zeviani, M.; Mora, M.; Fernandez, P.; De Michele, G.; Filla, A.; Cocozza, S.; Marconi, R.; Durr, A.; Fontaine, B.; Ballabio, A.: Spastic paraplegia and OXPHOS impairment caused by mutations in paraplegin, a nuclear-encoded mitochondrial metalloprotease. Cell 93:973-983, 1998.

De Michele, G.; De Fusco, M.; Cavalcanti, F.; Filla, A.; Marconi, R.; Volpe, G.; Monticelli, A.; Ballabio, A.; Casari, G.; Cocozza, S.: A new locus for autosomal recessive hereditary spastic paraplegia maps to chromosome 16q24.3. Am. J. Hum. Genet. 63:135-139, 1998.

Settasatian, C.; Whitmore, S. A.; Crawford, J.; Bilton, R. L.; Cleton-Jansen, A.-M.; Sutherland, G. R.; Callen, D. F.: Genomic structure and expression analysis of the spastic paraplegia gene, SPG7. Hum. Genet. 105:139-144, 1999.

Gostout, B.; Liu, Q.; Sommer, S. S.: 'Cryptic' repeating triplets of purines and pyrimidines (cRRY(i)) are frequent and polymorphic: analysis of coding cRRY(i) in the proopiomelanocortin (POMC) and TATA-binding protein (TBP) genes. Am. J. Hum. Genet. 52:1182-1190, 1993.

Hobbs, N. K.; Bondareva, A. A.; Barnett, S.; Capecchi, M. R.; Schmidt, E. E.: Removing the vertebrate-specific TBP N terminus disrupts placental beta-2M-dependent interactions with the maternal immune system. Cell 110:43-54, 2002.

Imbert, G.; Trottier, Y.; Beckmann, J.; Mandel, J. L.: The gene for the TATA binding protein (TBP) that contains a highly polymorphic protein coding CAG repeat maps to 6q27. Genomics 21:667-668, 1994.

Jones, A. L.; Middle, F.; Guy, C.; Spurlock, G.; Cairns, N. J.; McGuffin, P.; Craddock, N.; Owen, M.; O'Donovan, M. C.: No evidence for expanded polyglutamine sequences in bipolar disorder and schizophrenia. Molec. Psychiat. 2:478-482, 1997.

Kao, C. C.; Lieberman, P. M.; Schmidt, M. C.; Zhou, Q.; Pei, R.; Berk, A. J.: Cloning of a transcriptionally active human TATA binding factor. Science 248:1646-1650, 1990.

Koide, R.; Kobayashi, S.; Shimohata, T.; Ikeuchi, T.; Maruyama, M.; Saito, M.; Yamada, M.; Takahashi, H.; Tsuji, S.: A neurological disease caused by an expanded CAG trinucleotide repeat in the TATA-binding protein gene: a new polyglutamine disease? Hum. Molec. Genet. 8:2047-2053, 1999.

Nakamura, K.; Jeong, S.-Y.; Uchihara, T.; Anno, M.; Nagashima, K.; Nagashima, T.; Ikeda, S.; Tsuji, S.; Kanazawa, I.: SCA17, a novel autosomal dominant cerebellar ataxia caused by an expanded polyglutamine in TATA-binding protein. Hum. Molec. Genet. 10:1441-1448, 2001.

Nikolov, D. B.; Hu, S.-H.; Lin, J.; Gasch, A.; Hoffmann, A.; Horikoshi, M.; Chua, N.-H.; Roeder, R. G.; Burley, S. K.: Crystal structure of TFIID TATA-box binding protein. Nature 360:40-46, 1992.

Peterson, M. G.; Tanese, N.; Pugh, B. F.; Tjian, R.: Functional domains and upstream activation properties of cloned human TATA binding protein. Science 248:1625-1630, 1990.

Polymeropoulos, M. H.; Rath, D. S.; Xiao, H.; Merril, C. R.:Trinucleotide repeat polymorphism at the human transcription factor IID gene. Nucleic Acids Res. 19:4307 only, 1991.

Rosen, D. R.; Trofatter, J. A.; Brown, R. H., Jr.: Mapping of the human TATA-binding protein gene (TBP) to chromosome 6qter. Cytogenet. Cell Genet. 69:279-280, 1995.

Rubinsztein, D. C.; Leggo, J.; Crow, T. J.; DeLisi, L. E.; Walsh, C.; Jain, S.; Paykel, E. S.: Analysis of polyglutamine-coding repeats in the TATA-binding protein in different human populations and inpatients with schizophrenia and bipolar affective disorder. Am. J. Med. Genet. 67:495-498, 1996.

Saito, F.; Yamamoto, T.; Horikoshi, M.; Ikeuchi, T.: Direct mapping of the human TATA box-binding protein (TBP) gene to 6q27 by fluorescence in situ hybridization. Jpn. J. Hum. Genet. 39:421-425, 1994.

Testa, J. R.; Zhou, J.; Bell, D. W.; Yen, T. J.: Chromosomal localization of the genes encoding the kinetochore proteins CENPE and CENPF to human chromosomes 4q24-q25 and 1q32-q41, respectively, by fluorescence in situ hybridization. Genomics 23:691-693, 1994.

Pennica, D.; Swanson, T. A.; Shaw, K. J.; Kuang, W.-J.; Gray, C. L.; Beatty, B. G.; Wood, W. I.: Human cardiotrophin-1: protein and gene structure, biological and binding activities, and chromosomal localization. Cytokine 8:183-189, 1996.

Purrello, M.; Pietro, C. D.; Mirabile, E.; Rapisarda, A.; Rimini, R.; Tine, A.; Pavone, L.; Motta, S.; Grzeschik, K.-H.; Sichel, G.: Physical mapping at 6q27 of the locus for the TATA box-binding protein, the DNA-binding subunit of TFIID and a component of SL1 and TFIIIB, strongly suggests that it is single copy in the human genome. Genomics 22:94-100, 1994.

Candia, A. F.; Hu, J.; Crosby, J.; Lalley, P. A.; Noden, D.; Nadeau, J. H.; Wright, C. V. E.: Mox-1 and Mox-2 define a novel homeobox gene subfamily and are differentially expressed during early mesodermal patterning in mouse embryos. Development 116:1123-1136, 1992.

Gorski, D. H.; LePage, D. F.; Patel, C. V.; Copeland, N. G.; Jenkins, N. A.; Walsh, K.: Molecular cloning of a diverged homeobox gene that is rapidly down-regulated during the G0/G1 transition in vascular smooth muscle cells. Molec. Cell Biol. 13:3722-3733, 1993.

Grigoriou, M.; Kastrinaki, M.-C.; Modi, W. S.; Theodorakis, K.; Mankoo, B.; Pachnis, V.; Karagogeos, D.: Isolation of the human MOX2 homeobox gene and localization to chromosome 7p22.1-p21.3. Genomics 26:550-555, 1995.

LePage, D. F.; Altomare, D. A.; Testa, J. R.; Walsh, K.: molecular cloning and localization of the human GAX gene to 7p21. Genomics 24:535-540, 1994.

Mankoo, B. S.; Collins, N. S.; Ashby, P.; Grigorievea, E.; Pevny, L. H.; Candia, A.; Wright, C. V. E.; Rigby, P. W. J.; Pachnis, V.: Mox2 is a component of the genetic hierarchy controlling limb muscle development. Nature 400:69-73, 1999.

Lindor, N. M.; Furuichi, Y.; Kitao, S.; Shimamoto, A.; Arndt, C.; Jalal, S.: Rothmund-Thomson syndrome due to RECQ4 helicase mutations: report and clinical and molecular comparisons with Bloom syndrome and Werner syndrome. Am. J. Med. Genet. 90:223-228, 2000.

Puranam, K. L.; Blackshear, P. J.: Cloning and characterization of RECQL, a potential human homologue of the Escherichia coli DNA helicase RecQ. J. Biol. Chem. 269: 29838-29845, 1994.

Puranam, K. L.; Kennington, E.; J.-Sait, S. N.; Shows, T. B.; Rochelle, J. M.; Seldin, M. F.; Blackshear, P. J.: Chromosomal localization of the gene encoding the human DNA helicase RECQL and its mouse homologue. Genomics 26:595-598, 1995.

Gollner, H.; Bouwman, P.; Mangold, M.; Karis, A.; Braun, H.; Rohner, I.; Del Rey, A.; Besedovsky, H.-O.; Meinhardt, A.; van den Broek, M.; Cutforth, T.; Grosveld, F.; Philipsen, S.; Suske, G.: Complex phenotype of mice homozygous for a null mutation in the Sp4 transcription factor gene. Genes Cells 6:689-697, 2001.

Hagen, G.; Dennig, J.; Preiss, M.; Beato, M.; Suske, G.: Functional analyses of the transcription factor Sp4 reveal properties distinct from Sp1 and Sp3. J. Biol. Chem. 270: 24989-24994, 1995.

Hagen, G.; Muller, S.; Beato, M.; Suske, G.: Cloning by recognition site screening of two novel GT box binding proteins: a family of Sp1 related genes. Nucleic Acids Res. 20:5519-5525, 1992.

Kalff-Suske, M.; Kunz, J.; Grzeschik, K.-H.; Suske, G.: human Sp4 transcription factor gene (SP4) maps to chromosome 7p15. Genomics 26:631-633, 1995.

Nguyen-Tran, V. T. B.; Kubalak, S. W.; Minamisawa, S.; Fiset, C.; Wollert, K. C.; Brown, A. B.; Ruiz-Lozano, P.; Barrere-Lemaire, S.; Kondo, R.; Norman, L. W.; Gourdie, R. G.; Rahme, M. M.; Feld, G. K.; Clark, R. B.; Giles, W. R.; Chien, K. R.: A novel genetic pathway for sudden cardiac death via defects in the transition between ventricular and conduction system cell lineages. Cell 102:671-682, 2000.

Lamour, V.; Lecluse, Y.; Desmaze, C.; Spector, M.; Bodescot, M.; Aurias, A.; Osley, M. A.; Lipinski, M.: A human homolog of the S. Cerevisiae HIR1 and HIR2 transcriptional repressors cloned from the DiGeorge syndrome critical region. Hum. Molec. Genet. 4:791-799,1995.

Llevadot, R.; Scambler, P.; Estivill, X.; Pritchard, M.: Genomic organization of TUPLE1/HIRA: a gene implicated in DiGeorge syndrome. Mammalian Genome 7:911-914, 1996.

Lorain, S.; Quivy, J.-P.; Monier-Gavelle, F.; Scamps, C.; Lecluse, Y.; Almouzni, G.; Lipinski, M.: Core histones and HIRIP3, a novel histone-binding protein, directly interact with WD repeat protein HIRA. Molec. Cell. Biol. 18:5546-5556, 1998.

Magnaghi, P.; Roberts, C.; Lorain, S.; Lipinski, M.; Scambler, P. J.: HIRA, a mammalian homologue of Saccharomyces cerevisiae transcriptional co-repressors, interacts with Pax3. Nature Genet. 20:74-77, 1998.

Mattei, M.-G.; Halford, S.; Scambler, P. J.: Mapping of the Tuple1 gene to mouse chromosome 16A-B1. Genomics 23:717-718, 1994.

Roberts, C.; Daw, S. C. M.; Halford, S.; Scambler, P. J.: Cloning and developmental expression analysis of chick Hira (Chira), a candidate gene for DiGeorge syndrome. Hum. Molec. Genet. 6:237-245, 1997.

Wilming, L. G.; Snoeren, C. A. S.; van Rijswijk, A.; Grosveld, F.; Meijers, C.: The murine homologue of HIRA, a DiGeorge syndrome candidate gene, is expressed in embryonic structures affected in human CATCH22 patients. Hum. Molec. Genet. 6:247-258, 1997.

Akao, Y.; Matsuda, Y.: Identification and chromosome mapping of the mouse homologue of the human gene (DDX6) that encodes a putative RNA helicase of the DEAD box protein family. Cytogenet. Cell Genet. 75:38-44, 1996.

Akao, Y.; Seto, M.; Takahashi, T.; Kubonishi, I.; Miyoshi, I.; Nakazawa, S.; Tsujimoti, Y.; Croce, C. M.; Ueda, R.:

Molecular cloning of the chromosomal breakpoint of a B-cell lymphoma with the t (11;14)(q23; q32) chromosome translocation. Cancer Res. 51:1574-1576, 1991.

Akao, Y.; Seto, M.; Yamamoto, K.; Iida, S.; Nakazawa, S.; Inazawa, J.; Abe, T.; Takahashi, T.; Ueda, R.: The RCK gene associated with t (11;14) translocation is distinct from the MLL/ALL-1 gene with t (4;11) and t (11;19) translocations. Cancer Res. 52:6083-6087, 1992.

Akao, Y.; Tsujimoto, Y.; Finan, J.; Nowell, P. C.; Croce, C. M.: Molecular characterization of a t (11;14)(q23; q32) chromosome translocation in a B-cell lymphoma. Cancer Res. 50:4856-4859, 1990.

Lu, D.; Yunis, J. J.: Cloning, expression and localization of an RNA helicase gene from a human lymphoid cell line with chromosomal breakpoint 11q23.3. Nucleic Acids Res. 20:1967-1972, 1992.

Seto, M.; Yamamoto, K.; Takahashi, T.; Ueda, R.: Cloning and expression of a murine cDNA homologous to the human RCK/P54, a lymphoma-linked chromosomal translocation junction gene on 11q23. Gene 166:293-296,1995.

Tunnacliffe, A.; Perry, H.; Radice, P.; Budarf, M. L.; Emanuel, B. S.: A panel of sequence tagged sites for chromosome band 11q23. Genomics 17:744-747, 1993.

Tiranti, V.; Rossi, E.; Ruiz-Carrillo, A.; Rossi, G.; Rocchi, M.; DiDonato, S.; Zuffardi, O.; Zeviani, M.: Chromosomal localization of mitochondrial transcription factor A (TCF6), single-stranded DNA-binding protein (SSBP), and endonuclease G (ENDOG), three human housekeeping genes involved in mitochondrial biogenesis. Genomics 25:559-564, 1995.

Li, L. Y.; Luo, X.; Wang, X.: Endonuclease G is an apoptotic DNase when released from mitochondria. Nature 412: 95-99, 2001.

Parrish, J.; Li, L.; Klotz, K.; Ledwich, D.; Wang, X.; Xue, D.: Mitochondrial endonuclease G is important for apoptosis in C. elegans. Nature 412:90-94, 2001.

Dumon, K. R.; Ishii, H.; Fong, L. Y. Y.; Zanesi, N.; Fidanza, V.; Mancini, R.; Vecchione, A.; Baffa, R.; Trapasso, F.; During, M. J.; Huebner, K.; Croce, C. M.: FHIT gene therapy prevents tumor development in Fhit-deficient mice. Proc. Nat. Acad. Sci. 98:3346-3351, 2001.

Ikeda, A.; Zheng, Q. Y.; Zuberi, A. R.; Johnson, K. R.; Naggert, J. K.; Nishina, P. M.: Microtubule-associated protein 1A is a modifier of tubby hearing (moth1). Nature Genet. 30:401-405, 2002.

Roy, S. K.; Hu, J.; Meng, Q.; Xia, Y.; Shapiro, P. S.; Reddy, S. P. M.; Platanias, L. C.; Lindner, D. J.; Johnson, P. F.; Pritchard, C.; Pages, G.; Pouyssegur, J.; Kalvakolanu, D. V.: MEKK1 plays a critical role in activating the transcription factor C/EBP-beta-dependent gene expression in response to IFN-gamma. Proc. Nat. Acad. Sci. 99:7945-7950, 2002.

Lindsten, T.; Ross, A. J.; King, A.; Zong, W.-X.; Rathmell, J. C.; Shiels, H. A.; Ulrich, E.; Waymire, K. G.; Mahar, P.; Frauwirth, K.; Chen, Y.; Wei, M.; and 9 others: The combined functions of proapoptotic Bcl-2 family members Bak and Bax are essential for normal development of multiple tissues. Molec. Cell 6:1389-1399, 2000.

Matikainen, T.; Perez, G. I.; Jurisicova, A.; Pru, J. K.; Schlezinger, J. J.; Ryu, H.-Y.; Laine, J.; Sakai, T.; Korsmeyer, S. J.; Casper, R. F.; Sherr, D. H.; Tilly, J. L.: Aromatic hydrocarbon receptor-driven Bax gene expression is required for premature ovarian failure caused by biohazardous environmental chemicals. Nature Genet. 28:355-360,2001.

Wei, M. C.; Zong, W.-X.; Cheng, E. H.-Y.; Lindsten, T.; Panoutsakopoulou, V.; Ross, A. J.; Roth, K. A.; MacGregor, G. R.; Thompson, C. B.; Korsmeyer, S. J.: Proapoptotic BAX or BAK: a requisite gateway to mitochondrial dysfunction and death. Science 292:727-730, 2001.

Dasari, V. R.; Sandhu, A. K.; Mills, D. C. B.; Athwal, R. S.; Kunapuli, S. P.: Mapping of the P2U purinergic receptor gene to human chromosome 11q13.5-14.1. Somat. Cell Molec. Genet. 22:75-79, 1996.

Katzur, A. C.; Koshimizu, T.-A.; Tomic, M.; Schultze-Mosgau, A.; Ortmann, O.; Stojilkovic, S. S.: Expression and responsiveness of P2Y2 receptors in human endometrial cancer cell lines. J. Clin. Endocr. Metab. 84:4085-4091, 1999.

Parr, C. E.; Sullivan, D. M.; Paradiso, A. M.; Lazarowski, E. R.; Burch, L. H.; Olsen, J. C.; Erb, L.; Weisman, G. A.; Boucher, R. C.; Turner, J. T.: Cloning and expression of a human P(2U) nucleotide receptor, a target for cystic fibrosis pharmacotherapy. Proc. Nat. Acad. Sci. 91:3275-3279, 1994.

Somers, G. R.; Hammet, F.; Woollatt, E.; Richards, R. I.; Southey, M. C.; Venter, D. J.: Chromosomal localization of the human P2Y(6) purinoceptor gene and phylogenetic analysis of the P2y purinoceptor family. Genomics 44:127-130, 1997.

Tai, C.-J.; Kang, S. K.; Cheng, K. W.; Choi, K.-C.; Nathwani, P. S.; Leung, P. C. K.: Expression and regulation of P2U-purinergic receptor in human granulosa-luteal cells. J. Clin. Endocr. Metab. 85:1591-1597, 2000.

Santamarina-Fojo, S.; Peterson, K.; Knapper, C.; Qiu, Y.; Freeman, L.; Cheng, J.-F.; Osorio, J.; Remaley, A.; Yang, X.-P.; Haudenschild, C.; Prades, C.; Chimini, G.; Blackmon, E.; Francois, T.; Duverger, N.; Rubin, E. M.; Rosier, M.; Denefle, P.; Fredrickson, D. S.; Brewer, H. B., Jr.: Complete genomic sequence of the human ABCA1 gene: analysis of the human and mouse ATP-binding cassette A promoter. Proc. Nat. Acad. Sci. 97:7987-7992, 2000. Note: Erratum: Proc. Nat. Acad. Sci.99:1098 only, 2002.

Szakacs, G.; Langmann, T.; Ozvegy, C.; Orso, E.; Schmitz, G.; Varadi, A.; Sarkadi, B.: Characterization of the ATPase cycle of human ABCA1: implications for its function as a regulator rather than an active transporter. Biochem. Biophys. Res. Commun. 288:1258-1264,2001.

Utech, M.; Hobbel, G.; Rust, S.; Reinecke, H.; Assmann, G.; Walter, M.: Accumulation of RhoA, RhoB, RhoG, and Rac1 in fibroblasts from Tangier disease subjects suggests a regulatory role of Rho family proteins in cholesterol efflux. Biochem. Biophys. Res. Commun. 280:229-236, 2001.

Zhao, L.-X.; Zhou, C.-J.; Tanaka, A.; Nakata, M.; Hirabayashi, T.; Amachi, T.; Shioda, S.; Ueda, K.; Inagaki, N.: Cloning, characterization and tissue distribution of the rat ATP-binding cassette (ABC) transporter ABC2/ABCA2. Biochem J. 350:865-872, 2000.

Zwarts, K. Y.; Clee, S. M.; Zwinderman, A. H.; Engert, J. C.; Singaraja, R.; Loubser, O.; James, E.; Roomp, K.; Hudson, T. J.; Jukema, J. W.; Kastelein, J. J. P.; Hayden, M. R.: ABCA1 regulatory variants influence coronary artery disease independent of effects on plasma lipid levels. Clin. Genet. 61:115-125, 2002.

Ing, Y. L.; Leung, I. W. L.; Heng, H. H. Q.; Tsui, L.-C.; Lassam, N. J.: MLK-3: identification of a widely-expressed protein kinase bearing an SH3 domain and a leucine zipper-basic region domain. Oncogene 9:1745-1750, 1994.

Bernard, O. A.; Mauchauffe, M.; Mecucci, C.; Van Den Berghe, H.; Berger, R.: A novel gene, AF-1p, fused to HRX in t (1;11)(p32; q23), is not related to AF-4, AF-9 nor ENL. Oncogene 9:1039-1045, 1994.

Fazioli, F.; Minichiello, L.; Matoska, V.; Castagnino, P.; Miki, T.; Wong, W. T.; Di Fiore, P. P.: Eps8, a substrate for the epidermal growth factor receptor kinase, enhances EGF-dependent mitogenic signals. EMBO J. 12:3799-3808, 1993.

Fazioli, F.; Minichiello, L.; Matoskova, B.; Wong, W. T.; Di Fiore, P. P.: eps 15, a novel tyrosine kinase substrate, exhibits transforming activity. Molec. Cell. Biol. 13:5814-5828, 1993.

Fazioli, F.; Wong, W. T.; Ullrich, S. J.; Sakaguchi, K.; Appella, E.; Di Fiore, P. P.: The ezrin-like family of tyrosine kinase substrates: receptor-specific pattern of tyrosine phosphorylation and relationship to malignant transformation. Oncogene 8:1335-1345, 1993.

Wong, W. T.; Kraus, M. H.; Carlomagno, F.; Zelano, A.; Druck, T.; Croce, C. M.; Huebner, K.; Di Fiore, P. P.: The human eps 15 gene, encoding a tyrosine kinase substrate, is conserved in evolution and maps to 1p31-p32. Oncogene 9:1591-1597, 1994.

Kordeli, E.; Lambert, S.; Bennett, V.: Ankyrin-G: a new ankyrin gene with neural-specific isoforms localized at the axonal initial segment and node of Ranvier. J. Biol. Chem. 270:2352-2359, 1995.

Hsu, L. C.; Chang, W.-C.; Yoshida, A.: Human aldehyde dehydrogenase genes, ALDH7 and ALDH8: genomic organization and gene structure comparison. Gene 189:89-94, 1997.

Hsu, L. C.; Chang, W.-C.; Yoshida, A.: Cloning of a cDNA encoding human ALDH7, a new member of the aldehyde dehydrogenase family. Gene 151:285-289, 1994.

Aruga, J.; Yokota, N.; Hashimoto, M.; Furuichi, T.; Fukuda, M.; Mikoshiba, K.: A novel zinc finger protein, Zic, is involved in neurogenesis, especially in the cell lineage of cerebellar granule cells. J. Neurochem. 63:1880-1890, 1994.

Salero, E.; Perez-Sen, R.; Aruga, J.; Gimenez, C.; Zafra, F.:Transcription factors Zic1 and Zic2 bind and transactivate the apolipoprotein E gene promoter. J. Biol. Chem. 276:1881-1888, 2001.

Yokota, N.; Aruga, J.; Takai, S.; Yamada, K.; Hamazaki, M.; Iwase, T.; Sugimura, H.; Mikoshiba, K.: Predominant expression of human zic in cerebellar granule cell lineage and medulloblastoma. Cancer Res. 56:377-383, 1996.

Tanizawa, Y.; Riggs, A. C.; Dagogo-Jack, S.; Vaxillaire, M.; Froguel, P.; Liu, L.; Donis-Keller, H.; Permutt, M. A.: Isolation of the human LIM/homeodomain gene islet-1 and identification of a simple sequence repeat 1. Diabetes 43:935-941, 1994.

Matsuzono, Y.; Kinoshita, N.; Tamura, S.; Shimozawa, N.; Hamasaki, M.; Ghaedi, K.; Wanders, R. J. A.; Suzuki, Y.; Kondo, N.; Fujiki, Y.: Human PEX19: cDNA cloning by functional complementation, mutation analysis in a patient with Zellweger syndrome, and potential role in peroxisomal membrane assembly. Proc. Nat. Acad. Sci. 96:2116-2121, 1999.

Kinoshita, N.; Ghaedi, K.; Shimozawa, N.; Wanders, R. J. A.; Matsuzono, Y.; Imanaka, T.; Okumoto, K.; Suzuki, Y.; Kondo, N.; Fujiki, Y.: Newly identified Chinese hamster ovary cell mutants are defective in biogenesis of peroxisomal membrane vesicles (peroxisomal ghosts), representing a novel complementation group in mammals J. Biol. Chem. 273:24122-24130, 1998.

Heisterkamp, N.; Kaartinen, V.; van Soest, S.; Bokoch, G. M.; Groffen, J.: Human ABR encodes a protein with GAP-rac activity and homology to the DBL nucleotide exchange factor domain. J. Biol. Chem. 268:16903-16906, 1993.

Heisterkamp, N.; Morris, C.; Groffen, J.: ABR, an active BCR-related gene. Nucleic Acids Res. 17:8821-8831, 1989.

McDonald, J. D.; Daneshvar, L.; Willert, J. R.; Matsumura, K.; Waldman, F.; Cogen, P. H.: Physical mapping of chromosome 17p13.3 in the region of a putative tumor suppressor gene important in medulloblastoma. Genomics 23:229-232, 1994.

Shimomura, H.; Sanke, T.; Hanabusa, T.; Tsunoda, K.; Furuta, H.; Nanjo, K.: Nonsense mutation of islet-1 gene (Q310X) found in a type 2 diabetic patient with a strong family history. Diabetes 49:1597-1600,2000.

Corti, O.; Finocchiaro, G.; Rossi, E.; Zuffardi, O.; DiDonato, S.: Molecular cloning of cDNAs encoding human carnitine acetyltransferase and mapping of the corresponding gene to chromosome 9q34.1. Genomics 23:94-99, 1994.

Kalaria, R. N.; Harik, S. I.: Carnitine acetyltransferase activity in the human brain and its microvessels is decreased in Alzheimer's disease. Ann. Neurol. 32:583-586, 1992.

van der Leij, F. R.; Huijkman, N. C. A.; Boomsma, C.; Kuipers, J. R. G.; Bartelds, B.: Genomics of the human carnitine acyltransferase genes. Molec. Genet. Metab. 71:139-153, 2000.

Gengyo-Ando, K.; Kitayama, H.; Mukaida, M.; Ikawa, Y.: A murine neural-specific homolog corrects cholinergic defects in Caenorhabditis elegans unc-18 mutants. J. Neurosci. 16:6695-6702, 1996.

Pevsner, J.; Hsu, S.-C.; Scheller, R. H.: n-Sec1: a neural-specific syntaxin-binding protein. Proc. Nat. Acad. Sci. 91:1445-1449, 1994.

Swanson, D. A.; Steel, J. M.; Valle, D.: Identification and characterization of the human ortholog of rat STXBP1, a protein implicated in vesicle trafficking and neurotransmitter release. Genomics 48:373-376,1998.

Verhage, M.; Mala, A. S.; Plomp, J. J.; Brussaard, A. B.; Heeroma, J. H.; Vermeer, H.; Toonen, R. F.; Hammer, R. E.; van den Berg, T. K.; Missler, M.; Geuze, H. J.; Sudhof, T. C.: Synaptic assembly of the brain in the absence of neurotransmitter secretion. Science 287:864-869, 2000.

Cox, P. R.; Zoghbi, H. Y.: Sequencing, expression analysis, and mapping of three unique human tropomodulin genes and their mouse orthologs. Genomics 63:97-107, 2000.

Watakabe, A.; Kobayashi, R.; Helfman, D. M.: N-tropomodulin: a novel isoform of tropomodulin identified as the major binding protein to brain tropomyosin. J. Cell Sci. 109: 2299-2310, 1996.

Topper, J. N.; Cai, J.; Qiu, Y.; Anderson, K. R.; Xu, Y.-Y.; Deeds, J. D.; Feeley, R.; Gimeno, C. J.; Woolf, E. A.; Tayber, O.; Mays, G. G.; Sampson, B. A.; Schoen, F. J.; Gimbrone, M. A., Jr.; Falb, D.: Vascular MADs: two novel MAD-related genes selectively inducible by flow in human vascular endothelium. Proc. Nat. Acad. Sci. 94:9314-9319, 1997.

Festing, M. F. W. (ed.): Inbred strains in biomedica research. New York: Oxford University Press , 1979. p. 255.

Illa, I.; Serrano-Munuera, C.; Gallardo, E.; Lasa, A.; Rojas-Garcia, R.; Palmer, J.; Gallano, P.; Baiget, M.; Matsuda, C.; Brown, R. H.: Distal anterior compartment myopathy: a dysferlin mutation causing a new muscular dystrophy phenotype. Ann. Neurol. 49:130-134, 2001.

Illarioshkin, S. N.; Ivanova-Smolenskaya, I. A.; Greenberg, C. R.; Nylen, E.; Sukhorukov, V. S.; Poleshchuk, V. V.; Markova, E. D.; Wrogemann, K.: Identical dysferlin mutation in limb-girdle muscular dystrophy type 2B and distal myopathy. Neurology 55:1931-1933,2000.

Liu, J.; Wu, C.; Bossie, K.; Bejaoui, K.; Hosler, B. A.; Gingrich, J. C.; Ben Hamida, M.; Hentati, F.; Schurr, E.; de Jong, P. J.; Brown, R. H., Jr.: Generation of 3-Mb PAC contig spanning the Miyoshi myopathy/limb girdle muscular dystrophy (MM/LGMD2B) locus on chromosome 2p13. Genomics 49:23-29, 1998.

Mahjneh, I.; Vannelli, G.; Bushby, K.; Marconi, G. P.: A large inbred Palestinian family with two forms of muscular dystrophy. Neuromusc. Disord. 2:277-283, 1992.

Weiler, T.; Bashir, R.; Anderson, L. V. B.; Davison, K.; Moss, J. A.; Britton, S.; Nylen, E.; Keers, S.; Vafiadaki, E.;

Greenberg, C. R.; Bushby, K. M. D.; Wrogemann, K.: Identical mutation in patients with limb girdle muscular dystrophy type 2B or Miyoshi myopathy suggests a role for modifier gene (s). Hum. Molec. Genet. 8:871-877, 1999.

Pennica, D.; Arce, V.; Swanson, T. A.; Vejsada, R.; Pollock, R. A.; Armanini, M.; Dudley, K.; Phillips, H. S.; Rosenthal, A.; Kato, A. C.; Henderson, C. E.: Cardiotrophin-1, a cytokine present in embryonic muscle, supports long-term survival of spinal motoneurons. Neuron 17:63-74, 1996.

Pennica, D.; King, K. L.; Shaw, K. J.; Luis, E.; Rullamas, J.; Luoh, S.-M.; Darbonne, W. C.; Knutzon, D. S.; Yen, R.; Chien, K. R.; Baker, J. B.; Wood, W. I.: Expression cloning of cardiotrophin 1, a cytokine that induces cardiac myocyte hypertrophy. Proc. Nat. Acad. Sci. 92:1142-1146, 1995.

Ghosh, A.: Learning more about NMDA receptor regulation. Science 295:449-451, 2002.

Grunwald, I. C.; Korte, M.; Wolfer, D.; Wilkinson, G. A.; Unsicker, K.; Lipp, H.-P.; Bonhoeffer, T.; Klein, R.: Kinase-independent requirement of EphB2 receptors in hippocampal synaptic plasticity. Neuron 32:1027-1040, 2001.

Henderson, J. T.; Georgiou, J.; Jia, Z.; Robertson, J.; Elowe, S.; Roder, J. C.; Pawson, T.: The receptor tyrosine kinase EphB2 regulates NMDA-dependent synaptic function. Neuron 32:1041-1056,2001.

Himanen, J.-P.; Rajashankar, K. R.; Lackmann, M.; Cowan, C. A.; Henkemeyer, M.; Nikolov, D. B.: Crystal structure of an Eph receptor-ephrin complex. Nature 414:933-938, 2001.

Takasu, M. A.; Dalva, M. B.; Zigmond, R. E.; Greenberg, M. E.: Modulation of NMDA receptor-dependent calcium influx and gene expression through EphB receptors. Science 295:491-495, 2002.

Doudney, K.; Murdoch, J. N.; Paternotte, C.; Bentley, L.; Gregory, S.; Copp, A. J.; Stanier, P.: Comparative physical and transcript maps of approximately 1 Mb around loop-tail, a gene for severe neural tube defects on distal mouse chromosome 1 and human chromosome 1q22-q23. Genomics 72:180-192, 2001.

Kibar, Z.; Vogan, K. J.; Groulx, N.; Justice, M. J.; Underhill, D. A.; Gros, P.: Ltap, a mammalian homolog of Drosophila Strabismus/VanGogh, is altered in the mouse neural tube mutant loop-tail. Nature Genet. 28:251-255, 2001.

Mullick, A.; Trasler, D.; Gros, P.: High-resolution linkage map in the vicinity of the Lp locus. Genomics 26:479-488, 1995.

Murdoch, J. N.; Doudney, K.; Paternotte, C.; Copp, A. J.; Stanier, P.: Severe neural tube defects in the loop-tail mouse result from mutation of Lpp1, a novel gene involved in floor plate specification. Hum. Molec. Genet. 10:2593-2601, 2001.

Stanier, P.; Henson, J. N.; Eddleston, J.; Moore, G. E.; Copp, A. J.: Genetic basis of neural tube defects: the mouse gene loop-tail maps to a region of chromosome 1 syntenic with human 1q21-q23. Genomics 26:473-478, 1995.

Yu, J. X.; Chao, L.; Chao, J.: Prostasin is a novel human serine proteinase from seminal fluid: purification, tissue distribution, and localization in prostate gland. J. Biol. Chem. 269:18843-18848,1994.

Yu, J. X.; Chao, L.; Chao, J.: Molecular cloning, tissue-specific expression, and cellular localization of human prostasin mRNA. J. Biol. Chem. 270:13483-13489, 1995.

Yu, J. X.; Chao, L.; Ward, D. C.; Chao, J.: Structure and chromosomal localization of the human prostasin (PRSS8) gene. Genomics 32:334-340,1996.

Arber, S.; Halder, G.; Caroni, P.: Muscle LIM protein, a novel essential regulator of myogenesis, promotes myogenic differentiation. Cell 79:221-231, 1994.

Fung, Y. W.; Wang, R. X.; Heng, H. H. Q.; Liew, C. C.: mapping of a human LIM protein (CLP) to human chromosome 11p15.1 by fluorescence in situ hybridization. Genomics 28:602-603, 1995.

Carlberg, C.; Hooft van Huijsduijnen, R.; Staple, J. K.; DeLamarter, J. F.; Becker-Andre, M.: RZRs, a new family of retinoid-related orphan receptors that function as both monomers and homodimers. Molec. Endocr. 8:757-770, 1994.

Ueda, H. R.; Chen, W.; Adachi, A.; Wakamatsu, H.; Hayashi, S.; Takasugi, T.; Nagano, M.; Nakahama, K.; Suzuki, Y.; Sugano, S.; Iino, M.; Shigeyoshi, Y.; Hashimoto, S.: A transcription factor response element for gene expression during circadian night. Nature 418:534-539, 2002.

Masternak, K.; Barras, E.; Zufferey, M.; Conrad, B.; Corthals, G.; Aebersold, R.; Sanchez, J.-C.; Hochstrasser, D. F.; Mach, B.; Reith, W.: A gene encoding a novel RFX-associated transactivator is mutated in the majority of MHC class II deficiency patients. Nature Genet. 20:273-277, 1998.

Prange, C. K.; Pennacchio, L. A.; Lieuallen, K.; Fan, W.; Lennon, G. G.: Characterization of the human neurocan gene, CSPG3. Gene 221:199-205, 1998.

Rauch, U.; Grimpe, B.; Kulbe, G.; Arnold-Ammer, I.; Beier, D. R.; Fassler, R.: Structure and chromosomal localization of the mouse neurocan gene. Genomics 28:405-410, 1995.

Rauch, U.; Karthikeyan, L.; Maurel, P.; Margolis, R. U.; Margolis, R. K.: Cloning and primary structure of neurocan, a developmentally regulated, aggregating chondroitin sulfate proteoglycan of brain. J. Biol. Chem. 267:19536-19547, 1992.

Clement, S.; Krause, U.; Desmedt, F.; Tanti, J.-F.; Behrends, J.; Pesesse, X.; Sasaki, T.; Penninger, J.; Doherty, M.; Malaisse, W.; Dumont, J. E.; Le Marchand-Brustel, Y.; Erneux, C.; Hue, L.; Schurmans, S.: The lipid phosphatase SHIP2 controls insulin sensitivity. Nature 409:92-97, 2001.

Habib, T.; Hejna, J. A.; Moses, R. E.; Decker, S. J.: Growth factors and insulin stimulate tyrosine phosphorylation of the 51C/SHIP2 protein. J. Biol. Chem. 273:18605-18609, 1998.

Hejna, J. A.; Saito, H.; Merkens, L. S.; Tittle, T. V.; Jakobs, P. M.; Whitney, M. A.; Grompe, M.; Friedberg, A. S.; Moses, R. E.: Cloning and characterization of a human cDNA (INPPL1) sharing homology with inositol polyphosphate phosphatases. Genomics 29:285-287,1995.

Pesesse, X.; Deleu, S.; De Smedt, F.; Drayer, L.; Erneux, C.:Identification of a second SH2-domain-containing protein closely related to the phosphatidyl inositol polyphosphate 5-phosphatase SHIP. Biochem. Biophys. Res. Commun. 239: 697-700, 1997.

Schurmans, S.; Carrio, R.; Behrends, J.; Pouillon, V.; Merino, J.; Clement, S.: The mouse SHIP2 (Inppl1) gene: complementary DNA, genomic structure, promoter analysis, and gene expression in the embryo and adult mouse. Genomics 62:260-271, 1999.

Drummond, J. T.; Genschel, J.; Wolf, E.; Modrich, P.: DHFR/MSH3amplification in methotrexate-resistant cells alters the hMut S-alpha/hMut S-beta ratio and reduces the efficiency of base-base mismatch repair. Proc. Nat. Acad. Sci. 94:10144-10149, 1997.

Fujii, H.; Shimada, T.: Isolation and characterization of cDNA clones derived from the divergently transcribed gene in the region upstream from the human dihydrofolate reductase gene. J. Biol. Chem. 264:10057-10064, 1989.

Inokuchi, K.; Ikejima, M.; Watanabe, A.; Nakajima, E.; Orimo, H.; Nomura, T.; Shimada, T.: Loss of expression of the human MSH3 gene in hematological malignancies. Biochem. Biophys. Res. Commun. 214:171-179, 1995.

Linton, J. P.; Yen, J. Y.-J.; Selby, E.; Chen, Z.; Chinsky, J. M.; Liu, K.; Kellems, R. E.; Crouse, G. F.: Dual bidirectional promoters at the mouse dhfr locus: cloning and characterization of two mRNA classes of the divergently transcribed Rep-1 gene. Molec. Cell. Biol. 9:3058-3072, 1989.

Marra, G.; Iaccarino, I.; Lettieri, T.; Roscilli, G.; Delmastro, P.; Jiricny, J.: Mismatch repair deficiency associated with overexpression of the MSH3 gene. Proc. Nat. Acad. Sci. 95:8568-8573, 1998.

Nakajima, E.; Orimo, H.; Ikejima, M.; Shimada, T.: Nine-bp repeat polymorphism in exon 1 of the hMSH3 gene. Jpn. J. Hum. Genet. 40:343-345, 1995.

Risinger, J. I.; Umar, A.; Boyd, J.; Berchuck, A.; Kunkel, T. A.; Barrett, J. C.: Mutation of MSH3 in endometrial cancer and evidence for its functional role in heteroduplex repair. Nature Genet. 14:102-109, 1996.

Smith, M. L.; Mitchell, P. J.; Crouse, G. F.: Analysis of the mouse Dhfr/Rep-3 major promoter region by using linker-scanning and internal deletion mutations and DNase I footprinting. Molec. Cell. Biol. 10:6003-6012, 1990.

Watanabe, A.; Ikejima, M.; Suzuki, N.; Shimada, T.: Genomic organization and expression of the human MSH3 gene. Genomics 31:311-318, 1996.

Yin, J.; Kong, D.; Wang, S.; Zou, T.-T. Souza, R. F.; Smolinski, K. N.; Lynch, P. M.; Hamilton, S. R.; Sugimura, H.; Powell, S. M.; Young, J.; Abraham, J. M.; Meltzer, S. J.: Mutation of hMSH3 and hMSH6 mismatch repair genes in genetically unstable human colorectal and gastric carcinomas. Hum. Mutat. 10:474-478, 1997.

Burger, B.; Uhlhaas, S.; Mangold, E.; Propping, P.; Friedl, W.; Jenne, D.; Dockter, G.; Back, W.: Novel de novo mutation of MADH4/SMAD4 in a patient with juvenile polyposis. (Letter) Am. J. Med. Genet. 110:289-291, 2002.

Kurima, K.; Peters. L. M.; Yang, Y.; Riazuddin, S.; Ahmed, Z. M.; Naz, S.; Arnaud, D.; Drury, S.; Mo, J.; Makishima, T.; Ghosh, M.; Menon, P. S. N.; and 13 others: Dominant and recessive deafness caused by mutations of a novel gene, TMC1, required for cochlear hair-cell function. Nature Genet. 30:277-284, 2002.

Bryant, P. J.; Huettner, B.; Held, L. I., Jr.; Ryerse, J.; Szidonya, J.: Mutations at the fat locus interfere with cell proliferation control and epithelial morphogenesis in Drosophila. Dev. Biol. 129:541-554, 1988.

Dunne, J.; Hanby, A. M.; Poulsom, R.; Jones, T. A.; Sheer, D.; Chin, W. G.; Da, S. M.; Zhao, Q.; Beverley, P. C. L.; Owen, M. J.: Molecular cloning and tissue expression of FAT, the human homologue of the Drosophila fat gene that is located on chromosome 4q34-q35 and encodes a putative adhesion molecule. Genomics 30:207-223,1995.

Hortsch, M.; Goodman, C. S.: Cell and substrate adhesion molecules in Drosophila. Ann. Rev. Cell. Biol. 7:505-557, 1991.

Mahoney, P. A.; Weber, U.; Onofrechuk, P.; Biessmann, H.; Bryant, P. J.; Goodman, C. S.: The fat tumor suppressor gene in Drosophila encodes a novel member of the cadherin gene superfamily. Cell 67:853-868, 1991.

Crowe, P. D.; VanArsdale, T. L.; Walter, B. N.; Ware, C. F.; Hession, C.; Ehrenfels, B.; Browning, J. L.; Din, W. S.; Goodwin, R. G; Smith, C. A.: A lymphotoxin-beta-specific receptor. Science 264:707-710,1994.

Nakamura, T.; Tashiro, K.; Nazarea, M.; Nakano, T.; Sasayama, S.; Honjo, T.: The murine lymphotoxin-beta receptor cDNA: isolation by the signal sequence trap and chromosomal mapping. Genomics 30:312-319,1995.

Tashiro, K.; Tada, H.; Heilker, R.; Shirozu, M.; Nakano, T.; Honjo, T.: Signal sequence trap: a cloning strategy for secreted proteins and type I membrane proteins. Science 261: 600-603, 1993.

George, A.; Sabsay, B.; Simonian, P. A.; Veis, A.: characterization of a novel dentin matrix acidic phosphoprotein: implications for induction of biomineralization. J. Biol. Chem. 268:12624-12630, 1993.

Hirst, K. L.; Simmons, D.; Feng, J.; Aplin, H.; Dixon, M. J.; MacDougall, M.: Elucidation of the sequence and the genomic organization of the human dentin matrix acidic phosphoprotein 1 (DMP1) gene: exclusion of the locus from a causative role in the pathogenesis of dentinogenesis imperfecta type II. Genomics 42:38-45, 1997.

MacDougall, M.; DuPont, B. R.; Simmons, D.; Leach, R. J.: Assignment of DMP1 to human chromosome 4 band q21 by in situ hybridization. Cytogenet. Cell. Genet. 74:189 only, 1996.

Lu, Z.; Xu, S.; Joazeiro, C.; Cobb, M. H.; Hunter, T.: The PHD domain of MEKK1 acts as an E3 ubiquitin ligase and mediates ubiquitination and degradation of ERK1/2. Molec. Cell 9:945-956, 2002.

Barnard, R. C.; Pascall, J. C.; Brown, K. D.; McKay, I. A.; Williams, N. S.; Bustin, S. A.: Coding sequence of ERF-1, the human homologue of Tis11b/cMG1, members of the Tis11 family of early response genes. Nucleic Acids Res. 21:3580 only, 1993.

Bustin, S. A.; Xiao-Feng, N.; Barnard, R. C.; Kumar, V.; Pascall, J. C.; Brown, K. D.; Leigh, I. M.; Williams, N. S.; McKay, I. A.: Cloning and characterisation of ERF1, a human member of the Tis11 family of early-response genes. DNA Cell Biol. 13:449-459, 1994.

Maclean, K. N.; See, C. G.; McKay, I. A.; Bustin, S. A.: The human immediate early gene BRF1 maps to chromosome 14q22-q24. Genomics 30:89-90, 1995.

Ning, Z.-Q.; Norton, J. D.; Li, J.; Murphy, J. J.: Distinct mechanisms for rescue from apoptosis in Ramos human B cells by signaling through CD40 and interleukin-4 receptor: a role for inhibition of an early response gene, Berg36. Europ. J. Immun. 26:2356-2363, 1996.

Maas, S.; Kim, Y.-G.; Rich, A.: Genomic clustering of tRNA-specific adenosine deaminase ADAT1 and two tRNA synthetases. Mammalian Genome 12:387-393, 2001.

Derynck, R.; Gelbart, W. M.; Harland, R. M.; Heldin, C.-H.; Kern, S. E.; Massague, J.; Melton, D. A.; Mlodzik, M.; Padgett, R. W.; Roberts, A. B.; Smith, J.; Thomsen, G. H.; Vogelstein, B.; Wang, X.-F.: Nomenclature: vertebrate mediators of TGF-beta family signals. (Letter) Cell 87:173 only, 1996.

Friedl, W.; Kruse, R.; Uhlhaas, S.; Stolte, M.; Schartmann, B.; Keller, K. M.; Jungck, M.; Stern, M.; Loff, S.; Back, W.; Propping, P.; Jenne, D. E.: Frequent 4-bp deletion in exon 9 of the SMAD4/MADH4 gene in familial juvenile polyposis patients. Genes Chromosomes Cancer 25:403-406, 1999.

Hahn, S. A.; Schutte, M.; Hoque, T. M. S.; Moskaluk, C. A.; daCosta, L. T.; Rozenblum, E.; Weinstein, C. L.; Fischer, A.; Yeo, C. J.; Hruban, R. H.; Kern, S. E.: DPC4, a candidate tumor suppressor gene at human chromosome 18q21.1. Science 271:350-354, 1996.

Howe, J. R.; Shellnut, J.; Wagner, B.; Ringold, J. C.; Sayed, M. G.; Ahmed, A. F.; Lynch, P. M.; Amos, C. I.; Sistonen, P.; Aaltonen, L. A.: Common deletion of SMAD4 in juvenile polyposis is a mutational hotspot. Am. J. Hum. Genet. 70:1357-1362, 2002.

Inman, G. J.; Nicolas, F. J.; Hill, C. S.: Nucleocytoplasmic shuttling of Smads 2, 3, and 4 permits sensing of TGF-beta receptor activity. Molec. Cell 10:283-294, 2002.

Kim, S. K.; Fan, Y.; Papadimitrakopoulou, V.; Clayman, G.; Hittelman, W. N.; Hong, W. K.; Lotan, R.; Mao, L.: DPC4, a candidate tumor suppressor gene, is altered infrequently in head and neck squamous cell carcinoma. CancerRes. 56:2519-2521, 1996.

Kinzler, K. W.; Vogelstein, B.: Landscaping the cancer terrain. Science 280:1036-1037, 1998.

MacGrogan, D.; et al.; et al: Comparative mutational analysis of DPC4 (Smad4) in prostatic and colorectal carcinomas. Oncogene 15:1111-1114, 1997.

Roth, S.; Johansson, M.; Loukola, A.; Peltomaki, P.; Jarvinen, H.; Mecklin, J.-P.; Aaltonen, L. A.: Mutation analysis of SMAD2, SMAD3, and SMAD4 genes in hereditary non-polyposis colorectal cancer. J. Med. Genet. 37:298-300, 2000.

Schutte, M.; Hruban, R. H.; Hedrick, L.; Cho, K. R.; Nadasdy, G. M.; Weinstein, C. L.; Bova, G. S.; Isaacs, W. B.; Cairns, P.; Nawroz, H.; Sidransky, D.; Casero, R. A., Jr.; Meltzer, P. S.; Hahn, S. A.; Kern, S. E.: DPC4 gene in various tumor types. Cancer Res. 56:2527-2530, 1996.

Shioda, T.; Lechleider, R. J.; Dunwoodie, S. L.; Li, H.; Yahata, T.; de Caestecker, M. P.; Fenner, M. H.; Roberts, A. B.; Isselbacher, K. J.: Transcriptional activating activity of Smad4: roles of SMAD hetero-oligomerization and enhancement by an associating transactivator. Proc. Nat. Acad. Sci. 95:9785-9790, 1998.

Sirard, C.; de la Pompa, J. L.; Elia, A.; Itie, A.; Mirtsos, C.; Cheung, A.; Hahn, S.; Wakeham, A.; Schwartz, L.; Kern, S. E.; Rossant, J.; Mak, T. W.: The tumor suppressor gene Smad4/Dpc4 is required for gastrulation and later for anterior development of the mouse embryo. Genes Dev. 12:107-119, 1998.

Tagaki, Y.; et al.; et al: Somatic alterations of the DPC4 gene in human colorectal cancers in vivo. Gastroenterology 111:1369-1372,1996.

Takaku, K.; Oshima, M.; Miyoshi, H.; Matsui, M.; Seldin, M. F.; Taketo, M. M.: Intestinal tumorigenesis in compound mutant mice of both Dpc4 (Smad4) and Apc genes. Cell 92:645-656, 1998.

Thiagalingam, S.; Lengauer, C.; Leach, F. S.; Schutte, M.; Hahn, S. A.; Overhauser, J.; Willson, J. K. V.; Markowitz, S.; Hamilton, S. R.; Kern, S. E.; Kinzler, K. W.; Vogelstein, B.: Evaluation of candidate tumour suppressor genes on chromosome 18 in colorectal cancers. Nature Genet. 13:343-346, 1996.

Zawel, L.; Dai, J. L.; Buckhaults, P.; Zhou, S.; Kinzler, K. W.; Vogelstein, B.; Kern, S. E.: Human Smad3 and Smad4 are sequence-specific transcription activators. Molec. Cell 1:611-617, 1998.

Zhou, S.; Buckhaults, P.; Zawel, L.; Bunz, F.; Riggins, G.; LeDai, J.; Kern, S. E.; Kinzler, K. W.; Vogelstein, B.: Targeted Deletion of Smad4 shows it is required for transforming growth factor beta and activin signaling in colorectal cancer cells. Proc. Nat. Acad. Sci. 95:2412-2416, 1998.

Abbs, S.; Roberts, R. G.; Mathew, C. G.; Bentley, D. R.; Bobrow, M.: Accurate assessment of intragenic recombination frequency within the Duchenne muscular dystrophy gene. Genomics 7:602-606, 1990.

Ahn, A. H.; Kunkel, L. M.: The structural and functional diversity of dystrophin. Nature Genet. 3:283-291, 1993.

Alwine, J. C.; Kemp, D. J.; Stark, G. R.: Method for detection of specific RNAs in agarose gels by transfer to diazobenzyloxymethyl-paper and by hybridization with DNA probes. Proc. Nat. Acad. Sci. 74:5350-5354, 1977.

Angelini, C.; Beggs, A. H.; Hoffman, E. P.; Fanin, M.; Kunkel, L. M.: Enormous dystrophin in a patient with Becker muscular dystrophy. Neurology 40:808-812, 1990.

Badorff, C.; Berkely, N.; Mehrotra, S.; Talhouk, J. W.; Rhoads, R. E.; Knowlton, K. U.: Enteroviral protease 2A directly cleaves dystrophin and is inhibited by a dystrophin-based substrate analogue. J. Biol. Chem. 275:11191-11197, 2000.

Badorff, C.; Lee, G.-H.; Lamphear, B. J.; Martone, M. E.; Campbell, K. P.; Rhoads, R. E.; Knowlton, K. U.: Enteroviral protease 2A cleaves dystrophin: evidence of cytoskeletal disruption in an acquired cardiomyopathy. Nature Med. 5:320-326, 1999.

Bakker, E.; Pearson, P. L.: Mutation of the Duchenne muscular dystrophy gene associated with meiotic recombination. (Letter) Clin. Genet. 30:347-349, 1986.

Bakker, E.; Hofker, M. H.; Goor, N.; Mandel, J. L.; Wrogemann, K.; Davies, K. E.; Kunkel, L. M.; Willard, H. F.; Fenton, W. A.; Sandkuyl, L.; Majoor-Krakauer, D.; van Essen, A. J.; Jahoda, M. G. J.; Sachs, E. S.; van Ommen, G. J. B.; Pearson, P. L.: Prenatal diagnosis and carrier detection of Duchenne muscular dystrophy with closely linked RFLPs. Lancet I:655-658, 1985.

Bakker, E.; Van Broeckhoven, C.; Bonten, E. J.; van de Vooren, M. J.; Veenema, H.; Van Hul, W.; Van Ommen, G. J. B.; Vandenberghe, A.; Pearson, P. L.: Germline mosaicism and Duchenne muscular dystrophy mutations. Nature 329: 554-556, 1987.

Bar, S.; Barnea, E.; Levy, Z.; Neuman, S.; Yaffe, D.; Nudel, U.: A novel product of the Duchenne muscular dystrophy gene which greatly differs from the known isoforms in its structure and tissue distribution. Biochem. J. 272:557-560, 1990.

Barbieri, A. M.; Soriani, N.; Tubiello, G. M.; Ferrari, M.; Carrera, P.: A nonsense mutation (gln-673-term) in exon 17 of the human dystrophin gene detected by heteroduplex analysis. Hum. Genet. 96:343-344,1995.

Bartlett, R. J.; Pericak-Vance, M. A.; Koh, J.; Yamaoka, L. H.; Chen, J. C.; Hung, W.-Y.; Speer, M. C.; Wapenaar, M. C.; Van Ommen, G. J. B.; Bakker, E.; Pearson, P. L.; Kandt, R. S.; Siddique, T.; Gilbert, J. R.; Lee, J. E.; Sirotkin-Roses, M. J.; Roses, A. D.:Duchenne muscular dystrophy: high frequency of deletions. Neurology 38:1-4, 1988.

Barton-Davis, E. R.; Cordier, L.; Shoturma, D. I.; Leland, S. E.; Sweeney, H. L.: Aminoglycoside antibiotics restore dystrophin function to skeletal muscles of mdx mice. J. Clin. Invest. 104:375-381, 1999.

Bastianutto, C.; Bestard, J. A.; Lahnakoski, K.; Broere, D.; DeVisser, M.; Zaccolo, M.; Pozzan, T.; Ferlini, A.; Muntoni, F.; Patarnello, T.; Klamut, H. J.: Dystrophin muscle enhancer 1 is implicated in the activation of non-muscle isoforms in the skeletal muscle of patients with X-linked dilated cardiomyopathy. Hum. Molec. Genet. 10:2627-2635,2001.

Baumbach, L. L.; Chamberlain, J. S.; Ward, P. A.; Farwell, N. J.; Caskey, C. T.: Molecular and clinical correlation of deletion leading to Duchenne and Becker muscular dystrophies. Neurology 39:465-474, 1989.

Baumbach, L. L.; Ward, P. A.; Fenwick, R.; Caskey, C. T.: analysis of mutations at the Duchenne muscular dystrophy locus provides no evidence for illegitimate recombination in deletion formation. (Abstract) Am. J. Hum. Genet. 45 (suppl.): A173, 1989.

Beggs, A. H.; Koenig, M.; Boyce, F. M.; Kunkel, L. M.: Detection of 98% of DMD/BMD gene deletions by polymerase chain reaction. Hum. Genet. 86:45-48, 1990.

Berko, B. A.; Swift, M.: X-linked dilated cardiomyopathy. New Eng. J. Med. 316:1186-1191, 1987.

Bettecken, T.; Muller, C. R.: Identification of a 220-kb insertion into the Duchenne gene in a family with an atypical course of muscular dystrophy. Genomics 4:592-596, 1989.

Bies, R. D.: X-linked dilated cardiomyopathy. (Letter) New Eng. J. Med. 330:368-369, 1994.

Bies, R. D.; Caskey, C. T.; Fenwick, R.: An intact cysteine-rich domain is required for dystrophin function. J. Clin. Invest. 90:666-672, 1992.

Bittner, R. E.; Streubel, B.; Shorny, S.; Schaden, G.; Voit, T.; Hoger, H.: Coisogenic all-plus-one immunization: a model for identifying missing proteins in null-mutant conditions. Antibodies to dystrophinin mdx mouse after transplantation of muscle from normal coisogenic donor. Neuropediatrics 25:176-182, 1994.

Ryu, S.; Zhou, S.; Ladurner, A. G.; Tjian, R.: The transcriptional cofactor complex CRSP is required for activity of the enhancer-binding protein Sp1. Nature 397:446-450, 1999.

Dever, T. E.; Wei, C.-L.; Benkowski, L. A.; Browning, K.; Merrick, W. C.; Hershey, J. W. B.: Determination of the amino acid sequence of rabbit, human, and wheat germ protein synthesis factor eIF-4C by cloning and chemical sequencing. J. Biol. Chem. 269:3212-3218,1994.

Lee, S.-H.; Kim, W.-H.; Kim, H.-K.; Woo, K.-M.; Nam, H.-S.; Kim, H.-S.; Kim, J.-G.; Cho, M.-H.: Altered expression of the fragile histidine triad gene in primary gastric adenocarcinomas. Biochem. Biophys. Res. Commun. 284: 850-855, 2001.

Markkanen, A.; Heinonen, K.; Knuutila, S.; de la Chapelle, A.: Methotrexate-induced increase in gap formation in human chromosome band 3p14. Hereditas 96:317-319, 1982.

Markkanen, A.; Knuutila, S.; de la Chapelle, A.: Inducible fragile site on chromosome 3. (Letter) Hum. Genet. 65:217 only, 1983.

Anderson, D. M.; Kumaki, S.; Ahdieh, M.; Bertles, J.; Tometsko, M.; Loomis, A.; Giri, J.; Copeland, N. G.; Gilbert, D. J.; Jenkins, N. A.; Valentine, V.; Shapiro, D. N.; Morris, S. W.; Park, L. S.; Cosman, D.: Functional characterization of the human interleukin-15 receptor alpha chain and close linkage of IL15RA and IL2RA genes. J. Biol. Chem. 270:29862-29869, 1995.

Giri, J. G.; Kumaki, S.; Ahdieh, M.; Friend, D. J.; Loomis, A.; Shanebeck, K.; DuBose, R.; Cosman, D.; Park, L. S.; Anderson, D. M.: Identification and cloning of a novel IL-15 binding protein that is structurally related to the alpha of the IL-2 receptor. EMBO J. 14:3654-3663, 1995.

Yasunaga, S.; Grati, M.; Cohen-Salmon, M.; El-Amraoui, A.; Mustapha, M.; Salem, N.; El-Zir, E.; Loiselet, J.; Petit, C.: A mutation in OTOF, encoding otoferlin, a FER-1-like protein, causes DFNB9, a nonsyndromic form of deafness. Nature Genet. 21:363-369, 1999.

Berry, A.; Scott, H. S.; Kudoh, J.; Talior, I.; Korostishevsky, M.; Wattenhofer, M.; Guipponi, M.; Barras, C.; Rossier, C.; Shibuya, K.; Wang, J.; Kawasaki, K.; Asakawa, S.; Minoshima, S.; Shimizu, N.; Antonarakis, S.; Bonne-Tamir, B.: Refined localization of autosomal recessive nonsyndromic deafness DFNB10 locus using 34 novel microsatellite markers, genomic structure, and exclusion of six known genes in the region. Genomics 68:22-29, 2000.

Li, Z.; Jiang, H.; Xie, W.; Zhang, Z.; Smrcka, A. V.; Wu, D.:Roles of PLC-beta-2 and -beta-3 and PI3K-gamma in chemoattractant-mediated signal transduction. Science 287: 1046-1049, 2000.

Fowler, K. J.; Saffery, R.; Irvine, D. V.; Trowell, H. E.; Choo, K. H. A.: Mouse centromere protein F (Cenpf) gene maps to the distal region of chromosome 1 by interspecific backcross analysis. Cytogenet. Cell Genet. 82:180-181, 1998.

Liao, H.; Winkfein, R. J.; Mack, G.; Rattner, J. B.; Yen, T. J.: CENP-F is a protein of the nuclear matrix that assembles onto kinetochoresat late G2 and is rapidly degraded after mitosis. J. Cell Biol. 130:507-518, 1995.

Rattner, J. B.; Rao, A.; Fritzler, M. J.; Valencia, D. W.; Yen, T. J.: CENP-F is a ca 400 kDa kinetochore protein that exhibits a cell-cycle dependent localization. Cell Motil. Cytoskeleton 26:214-226, 1993.

Gassmann, M.; Casagranda, F.; Orioli, D.; Simon, H.; Lai, C.; Klein, R.; Lemke, G.: Aberrant neural and cardiac development in mice lacking the ErbB4 neuregulin receptor. Nature 378:390-394, 1995.

Golding, J. P.; Trainor, P.; Krumlauf, R.; Gassmann, M.: Defects in pathfinding by cranial neural crest cells in mice lacking the neuregulin receptor ErbB4. Nature Cell Biol. 2:103-109, 2000.

Zimonjic, D. B.; Alimandi, M.; Miki, T.; Popescu, N. C.; Kraus, M. H.: Localization of the human HER4/erbB-4 gene to chromosome 2. Oncogene 10:1235-1237, 1995.

Adibi, S. A.: The oligopeptide transporter (Pept-1) in human intestine:biology and function. Gastroenterology 113: 332-340, 1997.

Fei, Y. -J.; Kanai, Y.; Nussberger, S.; Ganapathy, V.; Leibach, F. H.; Romero, M. F.; Singh, S. K.; Boron, W. F.; Hediger, M. A.:Expression cloning of a mammalian proton-coupled oligopeptide transporter. Nature 368:563-566, 1994.

Liang, R.; Fei, Y.-J.; Prasad, P. D.; Ramamoorthy, S.; Han, H.; Yang-Feng, T. L.; Hediger, M. A.; Ganapathy, V.; Leibach, F. H.: Human intestinal H(+)/peptide cotransporter: cloning, functional expression, and chromosomal localization. J. Biol. Chem. 270:6456-6463, 1995.

Heiber, M.; Docherty, J. M.; Shah, G.; Nguyen, T.; Cheng, R.; Heng, H. H. Q.; Marchese, A.; Tsui, L.-C.; Shi, X.; George, S. R.; O'Dowd, B. F.: Isolation of three novel human genes encoding G protein-coupled receptors. DNA Cell Biol. 14:25-35, 1995.

Mahadevan, M. S.; Baird, S.; Bailly, J. E.; Shutler, G. G.; Sabourin, L. A.; Tsilfidis, C.; Neville, C. E.; Narang, M.; Korneluk, R. G.: Isolation of a novel G protein-coupled receptor (GPR4) localized to chromosome 19q13.3. Genomics 30:84-88, 1995.

Ye, R. D.; Prossnitz, E. R.; Zou, A.; Cochrane, C. G.: characterization of a human cDNA that encodes a functional receptor for platelet activating factor. Biochem. Biophys. Res. Commun. 180:105-111, 1991.

Henkemeyer, M.; Orioli, D.; Henderson, J. T.; Saxton, T. M.; Roder, J.; Pawson, T.; Klein, R.: Nuk controls pathfinding of commissural axons in the mammalian central nervous system. Cell 86:35-46, 1996.

Ikegaki, N.; Tang, X. X.; Liu, X.-G.; Biegel, J. A.; Allen, C.; Yoshioka, A.; Sulman, E. P.; Brodeur, G. M.; Pleasure, D. E.: Molecular characterization and chromosomal localization of DRT (EPHT3): a developmentally regulated human protein-tyrosine kinase gene of the EPH family. Hum. Molec. Genet. 4:2033-2045, 1995.

Saito, T.; Seki, N.; Matsuda, Y.; Kitahara, M.; Murata, M.; Kanda, N.; Nomura, N.; Yamamoto, T.; Hori, T.: Identification of the human ERK gene as a putative receptor tyrosine kinase and its chromosomal localization to 1p36.1: a comparative mapping of human, mouse, and rat chromosomes. Genomics 26:382-384, 1995.

Wybenga-Groot, L. E.; Baskin, B.; Ong, S. H.; Tong, J.; Pawson, T.; Sicheri, F.: Structural basis for autoinhibition of the EphB2 receptor tyrosine kinase by the unphosphorylated juxtamembrane region. Cell 106:745-757, 2001.

Trachtulec, Z.; Forejt, J.: Synteny of orthologous genes conserved in mammals, snake, fly, nematode, and fission yeast. Mammalian Genome 12:227-231, 2001.

Reif, K.; Ekland, E. H.; Ohl, L.; Nakano, H.; Lipp, M.; Forster, R.; Cyster, J. G.: Balanced responsiveness to chemoattractants from adjacent zones determines B-cell position. Nature 416:94-99, 2002.

Zhu, K.; Baudhuin, L. M.; Hong, G.; Williams, F. S.; Cristina, K. L.; Kabarowski, J. H. S.; Witte, O. N.; Xu, Y.: Sphingosylphosphorylcholine and lysophosphatidylcholine are ligands for the G protein-coupled receptor GPR4. J. Biol. Chem. 276:41325-41335, 2001.

Vinik, B. S.; Kay, E. S.; Fiedorek, F. T., Jr.: Mapping of the MEK kinase gene (Mekk) to mouse chromosome 13 and human chromosome 5. Mammalian Genome 6:782-783, 1995.

Yujiri, T.; Sather, S.; Fanger, G. R.; Johnson, G. L.: Role ofMEKK1 in cell survival and activation of JNK and ERK pathways defined by targeted gene disruption. Science 282:1911-1914, 1998.

Arriza, J. L.; Weinberger, C.; Cerelli, G.; Glaser, T. M.; Handelin, B. L.; Housman, D. E.; Evans, R. M.: Cloning of human mineralocorticoid receptor complementary DNA: structural and functional kinship with the glucocorticoid receptor. Science 237:268-275, 1987.

Berger, S.; Bleich, M.; Schmid, W.; Cole, T. J.; Peters, J.; Watanabe, H.; Kriz, W.; Warth, R.; Greger, R.; Schutz, G.: Mineralocorticoid receptor knockout mice: pathophysiology of Na+ metabolism. Proc. Nat. Acad. Sci. 95:9424-9429, 1998.

Fan, Y.-S.; Eddy, R. L.; Byers, M. G.; Haley, L. L.; Henry, W. M.; Nowak, N. J.; Shows, T. B.: The human mineralocorticoid receptor gene (MLR) is located on chromosome 4 at q31.2. Cytogenet. Cell Genet. 52:83-84, 1989.

Geller, D. S.; Farhi, A.; Pinkerton, N.; Fradley, M.; Moritz, M.; Spitzer, A.; Meinke, G.; Tsai, F. T. F.; Sigler, P. B.; Lifton, R. P.: Activating mineralocorticoid receptor mutation in hypertension exacerbated by pregnancy. Science 289:119-123, 2000.

Geller, D. S.; Rodriguez-Soriano, J.; Vallo Boado, A.; Schifter, S.; Bayer, M.; Chang, S. S.; Lifton, R. P.: Mutations in the mineralocorticoid receptor gene cause autosomal dominant pseudohypoaldosteronism type I. Nature Genet. 19:279-281, 1998.

Hellal-Levy, C.; Fagart, J.; Souque, A.; Wurtz, J.-M.; Moras, D.; Rafestin-Oblin, M.-E.: Crucial role of the H11-H12 loop in stabilizing the active conformation of the human mineralocorticoid receptor. Molec. Endocr. 14:1210-1221, 2000.

Le Menuet, D.; Isnard, R.; Bichara, M.; Viengchareun, S.; Muffat-Joly, M.; Walker, F.; Zennaro, M.-C.; Lombes, M.: Alteration of cardiac and renal functions in transgenic mice overexpressing human mineralocorticoid receptor. J. Biol. Chem. 276:38911-38920, 2001.

Morrison, N.; Harrap, S. B.; Arriza, J. L.; Boyd, E.; Connor, J. M.: Regional chromosomal assignment of the human mineralocorticoid receptor gene to 4q31.1. Hum. Genet. 85:130-132, 1990.

Morrison, N.; Harrap, S. B.; Arriza, J. L.; Boyd, E.; Connor, J. M.: Regional chromosomal assignment of the human mineralocorticoid receptor gene to 4q31.1. (Abstract) Cytogenet. Cell Genet. 51:1048,1989.

Veenstra, G. J. C.; Weeks, D. L.; Wolffe, A. P.: Distinct roles for TBP and TBP-like factor in early embryonic gene transcription in Xenopus. Science 290:2312-2314, 2000.

Zuhlke, C.; Hellenbroich, Y.; Dalski, A.; Kononowa, N.; Hagenah, J.; Vieregge, P.; Riess, O.; Klein, C.; Schwinger, E.: Different types of repeat expansion in the TATA-binding protein gene are associated with a new form of inherited ataxia. Europ. J. Hum. Genet. 9:160-164,2001.

Satre, M. A.; Zgombic-Knight, M.; Duester, G.: The complete structure of human class IV alcohol dehydrogenase (retinol dehydrogenase) determined from the ADH7 gene. J. Biol. Chem. 269:15606-15612, 1994.

Yokoyama, H.; Baraona, E.; Lieber, C. S.: Molecular cloning and chromosomal localization of the ADH7 gene encoding human class IV(sigma) ADH. Genomics 31:243-245, 1996.

Zgombic-Knight, M.; Foglio, M. H.; Duester, G.: Genomic structure and expression of the ADH7 gene encoding human class IV alcohol dehydrogenase, the form most efficient for retinol metabolism in vitro. J. Biol. Chem. 270:4305-4311, 1995.

Bashir, M. M.; Abrams, W. R.; Tucker, T.; Sellinger, B.; Budarf, M.; Emanuel, B.; Rosenbloom, J.: Molecular cloning and characterization of the bovine and human tuftelin genes. Connect. Tissue Res. 39:13-24, 1998.

Deutsch, D.: Structure and function of enamel gene products. Anat. Rec. 224:189-210, 1989.

Beguin, P.; Nagashima, K.; Gonoi, T.; Shibasaki, T.; Takahashi, K.; Kashima, Y.; Ozaki, N.; Geering, K.; Iwanaga, T.; Seino, S.: Regulation of Ca (2+) channel expression at the cell surface by the small G-protein kir/Gem. Nature 411:701-706, 2001.

Maguire, J.; Santoro, T.; Jensen, P.; Siebenlist, U.; Yewdell, J.; Kelly, K.: GEM: an induced, immediate early protein belonging to the Ras family. Science 265:241-244, 1994.

Santoro, T.; Maguire, J.; McBride, O. W.; Avraham, K. B.; Copeland, N. G.; Jenkins, N. A.; Kelly, K.: Chromosomal organization and transcriptional regulation of human GEM and localization of the human and mouse Gem loci encoding an inducible Ras-like protein. Genomics 30:558-564,1995.

Inoue, I.; Taniuchi, I.; Kitamura, D.; Jenkins, N. A.; Gilbert, D. J.; Copeland, N. G.; Watanabe, T.: Characteristics of the mouse genomic histamine H1 receptor gene. Genomics 36:178-181, 1996.

Le Coniat, M.; Traiffort, E.; Ruat, M.; Arrang, J.-M.; Berger, R.: Chromosomal localization of the human histamine H1-receptor gene. Hum. Genet. 94:186-188, 1994.

Ma, R. Z.; Gao, J.; Meeker, N. D.; Fillmore, P. D.; Tung, K. S. K.; Watanabe, T.; Zachary, J. F.; Offner, H.; Blankenhorn, E. P.; Teuscher, C.: Identification of Bphs, an autoimmune disease locus, as histamine receptor H-1. Science 297:620-623, 2002.

Yamashita, M.; Fukui, H.; Sugama, K.; Horio, Y.; Ito, S.; Mizuguchi, H.; Wada, H.: Expression cloning of a cDNA encoding the bovine histamine H1 receptor. Proc. Nat. Acad. Sci. 88:11515-11519, 1991.

Bauer, S.; Groh, V.; Wu, J.; Steinle, A.; Phillips, J. H.; Lanier, L. L.; Spies, T.: Activation of NK cells and T cells by NKG2D, a receptor for stress-inducible MICA. Science 285:727-729, 1999.

Diefenbach, A.; Jensen, E. R.; Jamieson, A. M.; Raulet, D. H.:Rae1 and H60 ligands of the NKG2D receptor stimulate tumour immunity. Nature 413:165-171, 2001.

Girardi, M.; Oppenheim, D. E.; Steele, C. R.; Lewis, J. M.; Glusac, E.; Filler, R.; Hobby, P.; Sutton, B.; Tigelaar, R. E.; Hayday, A. C.: Regulation of cutaneous malignancy by gamma-delta T cells. Science 294:605-609, 2001.

Groh, V.; Rhinehart, R.; Randolph-Habecker, J.; Topp, M. S.; Riddell, S. R.; Spies, T.: Costimulation of CD8-alpha-beta T cells by NKG2D via engagement by MIC induced on virus-infected cells. Nature Immun. 2:255-260, 2001.

Groh, V.; Steinle, A.; Bauer, S.; Spies, T.: Recognition of stress-induced MHC molecules by intestinal epithelial gamma-delta T cells. Science 279:1737-1740, 1998.

Groh, V.; Wu, J.; Yee, C.; Spies, T.: Tumour-derived soluble MIC ligands impair expression of NKG2D and T-cell activation. Nature 419:734-738, 2002.

Li, P.; Morris, D. L.; Willcox, B. E.; Steinle, A.; Spies, T.; Strong, R. K.: Complex structure of the activating immunoreceptor NKG2D and its MHC class I-like ligand MICA. Nature Immun. 2:443-451, 2001.

Jepsen, K. J.; Wu, F.; Peragallo, J. H.; Paul, J.; Roberts, L.; Ezura, Y.; Oldberg, A.; Birk, D. E.; Chakravarti, S.: A syndrome of joint laxity and impaired tendon integrity in lumican- and fibromodulin-deficient mice. J. Biol. Chem. 277:35532-35540, 2002.

Sztrolovics, R.; Chen, X.-N.; Grover, J.; Roughley, P. J.; Korenberg, J. R.: Localization of the human fibromodulin gene (FMOD) to chromosome 1q32 and completion of the cDNA sequence. Genomics 23:715-717, 1994.

Dalton, S.; Treisman, R.: Characterization of SAP-1, a protein recruited by serum response factor to the c-fos serum response element. Cell 68:597-612, 1992.

Mo, Y.; Vaessen, B.; Johnston, K.; Marmorstein, R.: Structures of SAP-1 bound to DNA targets from the E74 and c-fos promoters: insights into DNA sequence discrimination by Ets proteins. Molec. Cell 2:201-212, 1998.

Shipley, J.; Sheer, D.; Dalton, S.; Treisman, R.; Patel, K.: mapping of the human SAP1 (SRF accessory protein 1) gene and SAP2, a gene encoding a related protein, to chromosomal bands 1q32 and 12q23, respectively. Genomics 23:710-711, 1994.

Giovane, A.; Pintzas, A.; Maira, S.-M.; Sobieszczuk, P.; Wasylyk, B.: Net, a new ets transcription factor that is activated by Ras. Genes Dev. 8:1502-1513, 1994.

Lopez, M.; Oettgen, P.; Akbarali, Y.; Dendorfer, U.; Libermann, T. A.: ERP, a new member of the ets transcription factor/oncoprotein family: cloning, characterization, and differential expression during B-lymphocyte development. Molec. Cell. Biol. 14:3292-3309, 1994.

Kelner, G. S.; Kennedy, J.; Bacon, K. B.; Kleyensteuber, S.; Largaespada, D. A.; Jenkins, N. A.; Copeland, N. G.; Bazan, J. F.; Moore, K. W.; Schall, T. J.; Zlotnik, A.: Lymphotactin: a cytokine that represents a new class of chemokine. Science 266:1395-1399, 1994.

Kennedy, J.; Kelner, G. S.; Kleyensteuber, S.; Schall, T. J.; Weiss, M. C.; Yssel, H.; Schneider, P. V.; Cocks, B. G.; Bacon, K. B.; Zlotnik, A.: Molecular cloning and functional characterization of human lymphotactin. J. Immun. 155:203-209, 1995.

Muller, S.; Dorner, B.; Korthauer, U.; Mages, H. W.; d'Apuzzo, M.; Senger, G.; Kroczek, R. A.: Cloning of ATAC, an activation-induced, chemokine-related molecule exclusively expressed in CD8+ T lymphocytes. Europ. J. Immun. 25:1744-1748, 1995.

Yoshida, T.; Imai, T.; Kakizaki, M.; Nishimura, M.; Takagi, S.; Yoshie, O.: Identification of single C motif-1/lymphotactin receptor XCR1. J. Biol. Chem. 273:16551-16554, 1998.

Yoshida, T.; Imai, T.; Kakizaki, M.; Nishimura, M.; Yoshie, O.: Molecular cloning of a novel C or gamma type chemokine, SCM-1. FEBS Lett. 360:155-159, 1995.

Yoshida, T.; Imai, T.; Takagi, S.; Nishimura, M.; Ishikawa, I.; Yaoi, T.; Yoshie, O.: Structure and expression of two highly related genes encoding SCM-1/human lymphotactin. FEBS Lett. 395:82-88, 1996.

Ikeuchi, T.; Asaka, T.; Saito, M.; Tanaka, H.; Higuchi, S.; Tanaka, K.; Saida, K.; Uyama, E.; Mizusawa, H.; Fukuhara, N.; Nonaka, I.; Takamori, M.; Tsuji, S.: Gene locus for autosomal recessive distal myopathy with rimmed vacuoles maps to chromosome 9. Ann. Neurol. 41:432-437, 1997.

Sanders, J.; Maassen, J. A.; Amons, R.; Moller, W.: Nucleotide sequence of human elongation factor-1-beta cDNA. Nucleic Acids Res. 19:4551, 1991.

Tanahashi, H.; Tabira, T.: Alzheimer's disease-associated presenilin 2 interacts with DRAL, an LIM-domain protein. Hum. Molec. Genet. 9:2281-2289, 2000.

Erkinheimo, T.-L.; Saukkonen, K.; Narko, K.; Jalkanen, J.; Ylikorkala, O.; Ristimaki, A.: Expression of cyclooxygenase-2 and prostanoid receptors by human myometrium. J. Clin. Endocr. Metab. 85:3468-3475, 2000.

Hla, T.; Neilson, K.: Human cyclooxygenase-2 cDNA. Proc. Nat. Acad. Sci. 89:7384-7388, 1992.

Jones, D. A.; Carlton, D. P.; McIntyre, T. M.; Zimmerman, G. A.; Prescott, S. M.: Molecular cloning of human prostaglandin endoperoxide synthase type II and demonstration of expression in response to cytokines. J. Biol. Chem. 268:9049-9054, 1993.

Kraemer, S. A.; Meade, E. A.; DeWitt, D. L.: Prostaglandin endoperoxide synthase gene structure: identification of the transcriptional start site and 5-prime-flanking regulatory sequences. Arch. Biochem. Biophys. 293:391-400, 1992.

Lassus, P.; Wolff, H.; Andersson, S.: Cyclooxygenase-2 in human perinatal lung. Pediat. Res. 47:602-605, 2000.

Lim, H.; Paria, B. C.; Das, S. K.; Dinchuk, J. E.; Langenbach, R.; Trzaskos, J. M.; Dey, S. K.: Multiple female reproductive failures in cyclooxygenase 2-deficient mice. Cell 91:197-208, 1997.

Morrow, J. A.; Collie, I. T.; Dunbar, D. R.; Walker, G. B.; Shahid, M.; Hill, D. R.: Molecular cloning and functional expression of the human glycine transporter GlyT2 and chromosomal localisation of the gene in the human genome. FEBS Lett. 439:334-340, 1998.

Chaudhry, F. A.; Reimer, R. J.; Krizaj, D.; Barber, D.; Storm-Mathisen, J.; Copenhagen, D. R.; Edwards, R. H.: Molecular analysis of system N suggests novel physiological roles in nitrogen metabolism and synaptic transmission. Cell 99:769-780, 1999.

Yamada, K.; Nishida, K.; Hibi, M.; Hirano, T.; Matsuda, Y.: Comparative FISH mapping of Gab1 and Gab2 genes in human, mouse and rat. Cytogenet. Cell Genet. 94:39-42, 2001.

Afonina, E.; Stauber, R.; Pavlakis, G. N.: The human poly (A)-binding protein 1 shuttles between the nucleus and the cytoplasm. J. Biol. Chem. 273:13015-13021, 1998.

Deo, R. C.; Bonanno, J. B.; Sonenberg, N.; Burley, S. K.: Recognition of polyadenylate RNA by the poly (A)-binding protein. Cell 98:835-845, 1999.

Gorlach, M.; Burd, C. G.; Dreyfuss, G.: The mRNA poly (A)-binding protein: localization, abundance, and RNA-binding specificity. Exp. Cell Res. 211:400-407, 1994.

Grange, T.; Martins de Sa, C.; Oddos, J.; Pictet, R.: Human mRNA polyadenylate binding protein: evolutionary conservation of a nucleic acid binding motif. Nucleic Acids Res. 15:4771-4787, 1987.

Kobayashi, H.; Hino, M.; Shimodahira, M.; Iwakura, T.; Ishihara, T.; Ikekubo, K.; Ogawa, Y.; Nakao, K.; Kurahachi, H.: Missense mutation of TRPS1 in a family of tricho-rhino-phalangeal syndrome type III. Am. J. Med. Genet. 107:26-29, 2002.

Sahara, S.; Aoto, M.; Eguchi, Y.; Imamoto, N.; Yoneda, Y.; Tsujimoto, Y.: Acinus is a caspase-3-activated protein required for apoptotic chromatin condensation. Nature 401:168-173, 1999.

Hata, M.; Ohtsuka, K.: Characterization of HSE sequences in human Hsp40 gene: structural and promoter analysis. Biochim. Biophys. Acta 1397:43-55, 1998.

Hata, M.; Okumura, K.; Seto, M.; Ohtsuka, K.: Genomic cloning of a human heat shock protein 40 (Hsp40) gene (HSPF1) and its chromosomal localization to 19p13.2. Genomics 38:446-449, 1996.

Ohtsuka, K.: Cloning of a cDNA for heat-shock protein hsp40, a human homologue of bacterial Dna J. Biochem. Biophys. Res. Commun. 197:235-240, 1993.

Muravenko, O. V.; Gizatullin, R. Z.; Protopopov, A. I.; Kashuba, V. I.; Zabarovsky, E. R.; Zelenin, A. V.: Assignment of CDK5R2 coding for the cyclin-dependent kinase 5, regulatory subunit 2 (NCK5AI protein) to human chromosome band 2q35 by fluorescent in situ hybridization. Cytogenet. Cell Genet. 89:160-161, 2000.

Nilden, F.; Backstrom, A.; Bark, C.: Molecular cloning and characterisation of a mouse gene encoding an isoform of the neuronal cyclin-dependent kinase 5 (CDK5) activator. Biochim. Biophys. Acta 1398:371-376,1998.

Tang, D.; Yeung, J.; Lee, K-Y.; Matsushita, M.; Matsui, H.; Tomizawa, K.; Hatase, O.; Wang, J. H.: An isoform of the neuronal cyclin-dependent kinase 5 (Cdk5) activator. J. Biol. Chem. 270:26897-26903, 1995.

Chaudhary, P. M.; Ferguson, C.; Nguyen, V.; Nguyen, O.; Massa, H. F.; Eby, M.; Jasmin, A.; Trask, B. J.; Hood, L.; Nelson, P. S.: Cloning and characterization of two Toll/interleukin-1 receptor-like genes TIL3 and TIL4: evidence for a multi-gene receptor family in humans. Blood 91:4020-4027, 1998.

Abuladze, N.; Lee, I.; Newman, D.; Hwang, J.; Boorer, K.; Pushkin, A.; Kurtz, I.: Molecular cloning, chromosomal localization, tissue distribution, and functional expression of the human pancreatic sodium bicarbonate cotransporter. J. Biol. Chem. 273:17689-17695, 1998.

Burnham, C. E.; Amlal, H.; Wang, Z.; Shull, G. E.; Soleimani, M.: Cloning and functional expression of a human kidney Na+:HCO3- cotransporter. J. Biol. Chem. 272:19111-19114, 1997.

Choi, I.; Romero, M. F.; Khandoudi, N.; Bril, A.; Boron, W. F.: Cloning and characterization of a human electrogenic Na (+)-HCO(3-) cotransporter isoform (hhNBC). Am. J. Physiol. 276: C576-C584, 1999.

Igarashi, T.; Inatomi, J.; Sekine, T.; Cha, S. H.; Kanai, Y.; Kunimi, M.; Tsukamoto, K.; Satoh, H.; Shimadzu, M.; Tozawa, F.; Mori, T.; Shiobara, M.; Seki, G.; Endou, H.: Mutations in SLC4A4 cause permanent isolated proximal renal tubular acidosis with ocular abnormalities. (Letter) Nature Genet. 23:264-265, 1999.

Romero, M. F.; Boron, W. F.: Electrogenic Na (+)/HCO(3-) cotransporters: cloning and physiology. Annu. Rev. Physiol. 61:699-723, 1999.

Soleimani, M.; Burnham, C. E.: Physiologic and molecular aspects of the Na (+):HCO(3-) cotransporter in health and disease processes. Kidney Int. 57:371-384, 2000.

Usui, T.; et al.; et al.: Pflugers Arch. 438:458-462, 1999.

Vilain, A.; Apiou, F.; Dutrillaux, B.; Malfoy, B.: Assignment of candidate DNA methyltransferase gene (DNMT2) to human chromosome band 10p15.1 by in situ hybridization. Cytogenet. Cell Genet. 82:120 only, 1998.

Yoder, J. A.; Bestor, T. H.: A candidate mammalian DNA methyltransferase related to pmt1p of fission yeast. Hum. Molec. Genet. 7:279-284,1998.

Avraham, K. B.; Cho, B. C.; Gilbert, D.; Fujii, H.; Okamoto, K.; Shimazaki, T.; Ito, T.; Shoji, H.; Wakamatsu, Y.; Kondoh, H.; Takahashi, N.; Muramatsu, M.; Hamada, H.; Copeland, N. G.; Jenkins, N. A.: Murine chromosomal location of four class III POU transcription factors. Genomics 18:131-133, 1993.

Johnston, S. H.; Rauskolb, C.; Wilson, R.; Prabhakaran, B.; Irvine, K. D.; Vogt, T. F.: A family of mammalian Fringe genes implicated in boundary determination and the Notch pathway. Development 124:2245-2254, 1997.

Moran, J. L.; Johnston, S. H.; Rauskolb, C.; Bhalerao, J.; Bowcock, A. M.; Vogt, T. F.: Genomic structure, mapping, and expression analysis of the mammalian lunatic, manic, and radical fringe genes. Mammalian Genome 10:535-541, 1999.

Laufer, E.; Dahn, R.; Orozco, O. E.; Yeo, C.-Y.; Pisenti, J.; Henrique, D.; Abbott, U. K.; Fallon, J. F.; Tabin, C.: Expression of Radical fringe in limb-bud ectoderm regulates apical ectodermal ridge formation. Nature 386:366-373, 1997.

Rodriguez-Esteban, C.; Schwabe, J. W. R.; De La Pena, J.; Foys, B.; Eshelman, B.; Izpisua Belmonte, J. C.: Radical fringe positions the apical ectodermal ridge at the dorsoventral boundary of the vertebrate limb. Nature 386:360-366, 1997.

Hoey, T.; Sun, Y.-L.; Williamson, K.; Xu, X.: Isolation of two new members of the NF-AT gene family and functional characterization of the NF-AT proteins. Immunity 2:461-472, 1995.

Arany, Z.; Newsome, D.; Oldread, E.; Livingston, D. M.; Eckner, R.: A family of transcriptional adaptor proteins targeted by the E1A oncoprotein. Nature 374:81-84, 1995.

Dong, C.; Zhu, S.; Wang, T.; Yoon, W.; Li, Z.; Alvarez, R. J.; ten Dijke, P.; White, B.; Wigley, F. M.; Goldschmidt-Clermont, P. J.: Deficient Smad7 expression: a putative molecular defect in scleroderma. Proc. Nat. Acad. Sci. 99:3908-3913, 2002.

Kavsak, P.; Rasmussen, R. K.; Causing, C. G.; Bonni, S.; Zhu, H.; Thomsen, G. H.; Wrana, J. L.: Smad7 binds to Smurf2 to form an E3 ubiquitin ligase that targets the TGF-beta receptor for degradation. Molec. Cell 6:1365-1375, 2000.

Lallemand, F.; Mazars, A.; Prunier, C.; Bertrand, F.; Kornprost, M.; Gallea, S.; Roman-Roman, S.; Cherqui, G.; Atfi, A.: Smad7 inhibits the survival nuclear factor kappa-B and potentiates apoptosis in epithelial cells. Oncogene 20:879-884, 2001.

Roijer, E.; Moren, A.; ten Dijke, P.; Stenman, G.: Assignment of the Smad7 gene (MADH7) to human chromosome 18q21.1 by fluorescence in situ hybridization. Cytogenet. Cell Genet. 81:189-190, 1998.

Cravatt, B. F.; Giang, D. K.; Mayfield, S. P.; Boger, D. L.; Lerner, R. A.; Gilula, N. B.: Molecular characterization of an enzyme that degrades neuromodulatory fatty-acid amides. Nature 384:83-87, 1996.

Giang, D. K.; Cravatt, B. F.: Molecular characterization of human and mouse fatty acid amide hydrolases. Proc. Nat. Acad. Sci. 94:2238-2242, 1997.

Sipe, J. C.; Chiang, K.; Gerber, A. L.; Beutler, E.; Cravatt, B. F.: A missense mutation in human fatty acid amide hydrolase associated with problem drug use. Proc. Nat. Acad. Sci. 99:8394-8399, 2002.

Wan, M.; Cravatt, B. F.; Ring, H. Z.; Zhang, X.; Francke, U.: Conserved chromosomal location and genomic structure of human and mouse fatty-acid amide hydrolase genes and evaluation of clasper as a candidate neurological mutation. Genomics 54:408-414, 1998.

Baier, M.; Bannert, N.; Werner, A.; Lang, K.; Kurth, R.: molecular cloning, sequence, expression, and processing of the interleukin 16 precursor. Proc. Nat. Acad. Sci. 94:5273-5277, 1997.

Roh, M. H.; Makarova, O.; Liu, C.-J.; Shin, K.; Lee, S.; Laurinec, S.; Goyal, M.; Wiggins, R.; Margolis, B.: The Maguk protein, Pals1, functions as an adapter, linking mammalian homologues of Crumbs and Discs Lost. J. Cell Biol. 157:161-172, 2002.

Bannert, N.; Baier, M.; Werner, A.; Kurth, R.: Interleukin-16 or not? Nature 381:30 only, 1996.

Bannert, N.; Kurth, R.; Baier, M.: The gene encoding mouse interleukin-16 consists of seven exons and maps to Chromosome 7 D2-D3. Immunogenetics 49:704-706, 1999.

Cruikshank, W.; Center, D. M.: Modulation of lymphocyte migration by human lymphokines. II. Purification of a lymphotactic factor (LCF). J. Immun. 128:2569-2574, 1982.

Cruikshank, W. W.; Center, D. M.; Nisar, N.; Wu, M.; Natke, B.; Theodore, A. C.; Kornfeld, H.: Molecular and functional analysis of a lymphocyte chemoattractant factor: association of biologic function with CD4 expression. Proc. Nat. Acad. Sci. 91:5109-5113, 1994.

Drwinga, H. L.; Toji, L. H.; Kim, C. H.; Greene, A. E.; Mulivor, R. A.: NIGMS human/rodent somatic cell hybrid mapping panels 1 and 2. Genomics 16:311-314, 1993.

Hudson, T. J.; Stein, L. D.; Gerety, S. S.; Ma, J.; Castle, A. B.; Silva, J.; Slonim, D. K.; Baptista, R.; Kruglyak, L.; Xu, S. H.; Hu, X.; Colbert, A. M. E.; and 39 others: An STS-based map of the human genome. Science 270:1945-1954, 1995.

Keane, J.; Nicoll, J.; Kim, S.; Wu, D. M. H.; Cruikshank, W. W.; Brazer, W.; Natke, B.; Zhang, Y.; Center, D. M.; Kornfeld, H.: Conservation of structure and function between human and murine IL-16. J. Immun. 160:5945-5954, 1998.

Stec, I.; Wright, T. J.; van Ommen, G.-J. B.; de Boer, P. A. J.; van Haeringen, A.; Moorman, A. F. M.; Altherr, M. R.; den Dunnen, J. T.: WHSC1, a 90 kb SET domain-containing gene, expressed in early development and homologous to a Drosophila dysmorphy gene maps in the Wolf-Hirschhorn syndrome critical region and is fused to IgH int (4;14) multiple myeloma. Hum. Molec. Genet. 7:1071-1082, 1998.

Ame, J.-C.; Apiou, F.; Jacobson, E. L.; Jacobson, M. K.: Assignment of the poly (ADP-ribose) glycohydrolase gene (PARG) to human chromosome 10q11.23 and mouse chromosome 14B by in situ hybridization. Cytogenet. Cell Genet. 85:269-270, 1999.

Lin, W.; Ame, J.-C.; Aboul-Ela, N.; Jacobson, E. L.; Jacobson, M. K.: Isolation and characterization of the cDNA encoding bovine poly (ADP-ribose) glycohydrolase. J. Biol. Chem. 272:11895-11901, 1997.

Black, R. A.; Rauch, C. T.; Kozlosky, C. J.; Peschon, J. J.; Slack, J. L.; Wolfson, M. F.; Castner, B. J.; Stocking, K. L.; Reddy, P.; Srinivasan, S.; Nelson, N.; Boiani, N.; Schooley, K. A.; Gerhart, M.; Davis, R.; Fitzner, J. N.; Johnson, R. S.; Paxton, R. J.; March, C. J.; Cerretti, D. P.: A metalloproteinase disintegrin that releases tumour-necrosis factor-alpha from cells. Nature 385:729-733, 1997.

Hirohata, S.; Seldin, M. F.; Apte, S. S.: Chromosomal assignment of two ADAM genes, TACE (ADAM17) and MLTNB (ADAM19), to human chromosomes 2 and 5, respectively, and of Mltnb to mouse chromosome 11. Genomics 54:178-179, 1998.

Moss, M. L.; Jin, S.-L. C.; Milla, M. E.; Burkhart, W.; Carter, H. L.; Chen, W.-J.; Clay, W. C.; Didsbury, J. R.; Hassler, D.; Hoffman, C. R.; Kost, T. A.; Lambert, M. H.; and 13 others: Cloning of a disintegrin metalloproteinase that processes precursor tumour-necrosis factor-alpha. Nature 385:733-736, 1997.

Patel, I. R.; Attur, M. G.; Patel, R. N.; Stuchin, S. A.; Abagyan, R. A.; Abramson, S. B.; Amin, A. R.: TNF-alpha convertase enzyme from human arthritis-affected cartilage: isolation of cDNA by differential display, expression of the active enzyme, and regulation of TNF-alpha. J. Immun. 160: 4570-4579, 1998.

Peschon, J. J.; Slack, J. L.; Reddy, P.; Stocking, K. L.; Sunnarborg, S. W.; Lee, D. C.; Russell, W. E.; Castner, B. J.; Johnson, R. S.; Fitzner, J. N.; Boyce, R. W.; Nelson, N.; Kozlosky, C. J.; Wolfson, M. F.; Rauch, C. T.; Cerretti, D. P.; Paxton, R. J.; March, C. J.; Black, R. A.: An essential role for ectodomain shedding in mammalian development. Science 282:1281-1284, 1998.

Yamazaki, K.; Mizui, Y.; Sagane, K.; Tanaka, I.: Genetic mapping of mouse tumor necrosis factor-alpha converting enzyme (Tace) to chromosome 12. Genomics 49:336-337, 1998.

Inoue, D.; Reid, M.; Lum, L.; Kratzschmar, J.; Weskamp, G.; Myung, Y. M.; Baron, R.; Blobel, C. P.: Cloning and initial characterization of mouse meltrin beta and analysis of the expression of four metalloprotease-disintegrins in bone cells. J. Biol. Chem. 273:4180-4187, 1998.

Iyer, N. V.; Leung, S. W.; Semenza, G. L.: The human hypoxia-inducible factor 1-alpha gene: HIF1A structure and evolutionary conservation. Genomics 52:159-165, 1998.

Kline, D. D.; Peng, Y.-J.; Manalo, D. J.; Semenza, G. L.; Prabhakar, N. R.: Defective carotid body function and impaired ventilatory responses to chronic hypoxia in mice partially deficient for hypoxia-inducible factor 1-alpha. Proc. Nat. Acad. Sci. 99:821-826, 2002.

Lando, D.; Peet, D. J.; Whelan, D. A.; Gorman, J. J.; Whitelaw, M. L.: Asparagine hydroxylation of the HIF transactivation domain: a hypoxic switch. Science 295:858-861, 2002.

Marti, H. H.; Katschinski, D. M.; Wagner, K. F.; Schaffer, L.; Stier, B.; Wenger, R. H.: Isoform-specific expression of hypoxia-inducible factor-1-alpha during the late stages of mouse spermiogenesis. Molec. Endocr. 16:234-243, 2002.

Maxwell, P. H.; Wiesener, M. S.; Chang, G.-W.; Clifford, S. C.; Vaux, E. C.; Cockman, M. E.; Wykoff, C. C.; Pugh, C. W.; Maher, E. R.; Ratcliffe, P. J.: The tumour suppressor protein VHL targets hypoxia-inducible factors for oxygen-dependent proteolysis. Nature 399:271-275, 1999.

Min, J.-H.; Yang, H.; Ivan, M.; Gertler, F.; Kaelin, W. G., Jr.; Pavletich, N. P.: Structure of an HIF-1-alpha-pVHL complex: hydroxyproline recognition in signaling. Science 296: 1886-1889, 2002.

Semenza, G. L.: HIF-1 and human disease: one highly involved factor. Genes Dev. 14:1983-1991, 2000.

Semenza, G. L.; Rue, E. A.; Iyer, N. V.; Pang, M. G.; Kearns, W. G.: Assignment of the hypoxia-inducible factor 1-alpha gene to a region of conserved synteny on mouse chromosome 12 and human chromosome 14q. Genomics 34:437-439, 1996.

Sutter, C. H.; Laughner, E.; Semenza, G. L.: Hypoxia-inducible factor 1-alpha protein expression is controlled by oxygen-regulated ubiquitination that is disrupted by deletions and missense mutations. Proc. Nat. Acad. Sci. 97:4748-4753, 2000.

Wenger, R. H.; Rolfs, A.; Kvietikova, I.; Spielmann, P.; Zimmermann, D. R.; Gassmann, M.: The mouse gene for hypoxia-inducible factor-1-alpha--genomic organization, expression and characterization of an alternative first exon and 5-prime flanking sequence. Europ. J. Biochem. 246:155-165, 1997.

Wenger, R. H.; Rolfs, A.; Marti, H. H.; Guenet, J.-L.; Gassmann, M.: Nucleotide sequence, chromosomal assignment and mRNA expression of mouse hypoxia-inducible factor-1-alpha. Biochem. Biophys. Res. Commun. 223:54-59, 1996.

Wenger, R. H.; Rolfs, A.; Spielmann, P.; Zimmermann, D. R.; Gassmann, M.: Mouse hypoxia-inducible factor-1-alpha is encoded by two different mRNA isoforms: expression from a tissue-specific and a housekeeping-type promoter. Blood 91:3471-3480, 1998.

Hovanessian, A. G.; Laurent, A. G.; Chebath, J.; Galabru, J.; Robert, N.; Svab, J.: Identification of 69-kd and 100-kd forms of 2-5A synthetase in interferon-treated human cells by specific monoclonal antibodies. EMBO J. 6:1273-1280, 1987.

Marie, I.; Galabru, J.; Svab, J.; Hovanessian, A. G.: Preparation and characterization of polyclonal antibodies specific for the 69 and 100 k-dalton forms of human 2-5A synthetase. Biochem. Biophys. Res. Commun. 160:580-587, 1989.

Marie, I.; Hovanessian, A. G.: The 69-kDa 2-5A synthetase is composed of two homologous and adjacent functional domains. J. Biol. Chem. 267:9933-9939, 1992.

Kools, P.; Van Imschoot, G.; van Roy, F.: Characterization of three novel human cadherin genes (CDH7, CDH19, and CDH20) clustered on chromosome 18q22-q23 and with high homology to chicken cadherin-7. Genomics 68:283-295, 2000.

Dantzig, A. H.; Hoskins, J.; Tabas, L. B.; Bright, S.; Shepard, R. L.; Jenkins, I. L.; Duckworth, D. C.; Sportsman, J. R.; Mackensen, D.; Rosteck, P. R., Jr.; Skatrud, P. L.: Association of intestinal peptide transport with a protein related to the cadherin superfamily. Science 264:430-433, 1994.

Shibata, T.; Shimoyama, Y.; Gotoh, M.; Hirohashi, S.: Identification of human cadherin-14, a novel neurally specific type II cadherin, by protein interaction cloning. J. Biol. Chem. 272:5236-5240, 1997.

Barabino, S. M. L.; Hubner, W.; Jenny, A.; Minvielle-Sebastia, L.; Keller, W.: The 30 kDa subunit of mammalian cleavage and polyadenylation specificity factor and its yeast homolog are RNA binding zinc finger proteins. Genes Dev. 11:1703-1716, 1997.

Nemeroff, M. E.; Barabino, S. M. L.; Li, Y.; Keller, W.; Krug, R. M.: Influenza virus NS1 protein interacts with the cellular 30 kDa subunit of CPSF and inhibits 3-prime end formation of cellular pre-mRNAs. Molec. Cell 1:991-1000, 1998.

Hsu, D. R.; Economides, A. N.; Wang, X,; Eimon, P. M.; Harland, R. M.: The Xenopus dorsalizing factor gremlin identifies a novel family of secreted proteins that antagonize BMP activities. Molec. Cell 1:673-683, 1998.

Topol, L. Z.; Modi, W. S.; Koochekpour, S.; Blair, D. G.: DRM-Gremlin (CKTSF1B1) maps to human chromosome 15 and is highly expressed in adult and fetal brain. Cytogenet. Cell Genet. 89:79-84, 2000.

Beaconsfield, P.; Rainsbury, R.; Kalton, G.: Glucose-6-phosphate dehydrogenase deficiency and the incidence of cancer. Oncologia 19:11-19, 1965.

Ben-Bassat, J.; Ben-Ishay, D.: Hereditary hemolytic anemia associated with glucose-6-phosphate dehydrogenase deficiency (Mediterranean type). Israel J. Med. Sci. 5:1053-1059, 1969.

Benabadji, M.; Merad, F.; Benmoussa, M.; Trabuchet, G.; Junien, C.; Dreyfus, J. C.; Kaplan, J. C.: Heterogeneity of glucose-6-phosphate dehydrogenase deficiency in Algeria. Hum. Genet. 40:177-184, 1978.

Benohr, H. C.; Klumpp, F.; Waller, H. D.: Glucose-6-phosphat-Dehydrogenase Typ Schwaben. Dtsch. Med. Wschr. 96:1029-1032, 1971.

Benohr, H. C.; Waller, H. D.: Eigenschaften der Glucose-6-p-dehydrogenase, Typ Tubingen. Klin. Wschr. 48:71-74, 1970.

Benohr, H. C.; Waller, H. D.; Arnold, H.; Blume, K. G.; Lohr, G. W.: Glucose-6-P-Dehydrogenase Typ Bodensee (eine neue Enzymvariante). Klin. Wschr. 49:1058-1062, 1971.

Beutler, E.: Glucose 6-phosphate dehydrogenase deficiency, a new Indian variant, G6PD Jammu. In: Sen, N. N.; Basu, A. K.: Trends in Haematology. Calcutta: Chatterjea Memorial Committee (pub.) 1975. Pp. 279-283.

Beutler, E.: Personal Communication. La Jolla, Calif. Nov. 12, 1990.

Beutler, E.: G6PD deficiency. Blood 84:3613-3636, 1994.

Beutler, E.: Glucose-6-phosphate dehydrogenase deficiency. New Eng. J. Med. 324:169-174, 1991.

Beutler, E.: Selectivity of proteases as a basis for tissue distribution of enzymes in hereditary deficiencies. Proc. Nat. Acad. Sci. 80:3767-3768, 1983.

Beutler, E.: Glucose-6-phosphate dehydrogenase deficiency. In: Wintrobe, M. M.: Red Cell Metabolism in Hemolytic Anemia. New York: Plenum Press (pub.) 1978.

Beutler, E.: The hemolytic effect of primaquine and related compounds: a review. Blood 14:103-139, 1959.

Beutler, E.; Grooms, A. M.; Morgan, S. K.; Trinidad, F.: Chronic severe hemolytic anemia due to G-6-PD Charleston: a new deficiency variant. J. Pediat. 80:1005-1009, 1972.

Beutler, E.; Hartman, K.; Gelbart, T.; Forman, L.: G-6-PD Walter Reed: possible insight into 'structural' NADP in G-6-PD. Am. J. Hemat. 23:25-30, 1986.

Beutler, E.; Keller, J. W.; Matsumoto, F.: A new glucose 6-phosphate dehydrogenase (G6PD) variant associated with nonspherocytic hemolytic anemia: G6PD Atlanta. I. R. C. S. 4:479, 1976.

Beutler, E.; Kuhl, W.: The NT 1311 polymorphism of G6PD: G6PD Mediterranean mutation may have originated independently in Europe and Asia. Am. J. Hum. Genet. 47:1008-1012, 1990.

Beutler, E.; Kuhl, W.: Linkage between a Pvu II restriction fragment length polymorphism and G6PD A- (202A/376G): evidence for a single origin of the common G6PD A- mutation. Hum. Genet. 85:9-11, 1990.

Beutler, E.; Kuhl, W.; Gelbart, T.; Forman, L.: DNA sequence abnormalities of human glucose-6-phosphate dehydrogenase variants. J. Biol. Chem. 266:4145-4150, 1991.

Beutler, E.; Kuhl, W.; Ramirez, E.; Lisker, R.: Some Mexican glucose-6-phosphate dehydrogenase variants revisited. Hum. Genet. 86:371-374, 1991.

Beutler, E.; Kuhl, W.; Saenz, G. F.; Rodriguez, W.: Mutation analysis of glucose-6-phosphate dehydrogenase (G6PD) variants in Costa Rica. Hum. Genet. 87:462-464, 1991.

Beutler, E.; Mathai, C. K.; Smith, J. E.: Biochemical variants of glucose-6-phosphate dehydrogenase giving rise to congenital nonspherocytic hemolytic disease. Blood 31:131-150, 1968.

Beutler, E.; Matsumoto, F.: A new glucose 6-phosphate dehydrogenase variant: G6PD (-) Los Angeles. I. R. C. S. 5:89, 1977.

Beutler, E.; Matsumoto, F.; Daiber, A.: Nonspherocytic hemolytic anemia due to G-6-PD Panama. I. R. C. S. 2:1389, 1974.

Beutler, E.; Rosen, R.: Nonspherocytic congenital hemolytic anemia due to a new G-6-PD variant: G-6-PD Alhambra. Pediatrics 45:230-235,1970.

Beutler, E.; Westwood, B.; Prchal, J. T.; Vaca, G.; Bartsocas, C. S.; Baronciani, L.: New glucose-6-phosphate dehydrogenase mutations from various ethnic groups. Blood 80:255-256, 1992.

Beutler, E.; Yoshida, A.: Human glucose-6-phosphate dehydrogenase variants: a supplementary tabulation. Ann. Hum. Genet. 37:151-156,1973.

Boivin, P.; Galand, C.: Nouvelles variantes de la glucose-6-phosphate dehydrogenase erythrocytaire. Rev. Franc. Etud. Clin. Biol. 13:30-39, 1968.

Botha, M. C.; Dern, R. J.; Mitchell, M.; West, C.; Beutler, E.: G6PD Capetown, a variant of glucose-6-phosphate dehydrogenase. Am. J. Hum. Genet. 21:547-551, 1969.

Boyer, S. H.; Graham, J. B.: Linkage between the X chromosome loci for glucose-6-phosphate dehydrogenase electrophoretic variation and hemophilia A. Am. J. Hum. Genet. 17:320-324, 1965.

Boyer, S. H.; Porter, I. H.; Weilbaecher, R. G.: Electrophoretic heterogeneity of glucose-6-phosphate dehydrogenase and its relationship to enzyme deficiency in man. Proc. Nat. Acad. Sci. 48:1868-1876,1962.

Busch, D.; Bote, K.: Glucose-6-phosphate-dehydrogenase-Defect in Deutschland. II. Bigenschabten des Enzyms (Typ Freiburg). Klin. Wschr. 48:74-78, 1970.

Calabro, V.; Giacobbe, A.; Vallone, D.; Montanaro, V.; Cascone, A.; Filosa, S.; Battistuzzi, G.: Genetic heterogeneity at the glucose-6-phosphate dehydrogenase locus in southern Italy: a study on a population from the Matera district. Hum. Genet. 86:49-53, 1990.

Cappadoro, M.; Giribaldi, G.; O'Brien, E.; Turrini, F.; Mannu, F.; Ulliers, D.; Simula, G.; Luzzatto, L.; Arese, P.: Early phagocytosis of glucose-6-phosphate dehydrogenase (G6PD)-deficient erythrocytes parasitized by Plasmodium falciparum may explain malaria protection in G6PD deficiency. Blood 92:2527-2534, 1998.

Cappellini, M. D.; Sampietro, M.; Toniolo, D.; Carandina, G.; Pittalis, S.; Martinez di Montemuros, F.; Tavazzi, D.; Fiorelli, G.: Biochemical and molecular characterization of a new sporadic glucose-6-phosphate dehydrogenase variant described in Italy: G6PD Modena. Brit. J. Haemat. 87:209-211, 1994.

Carandina, G.; Moretto, E.; Zecchi, G.; Conighi, C.: Glucose6-phosphate dehydrogenase Ferrara. A new variant of G6PD identified in Northern Italy. Acta Haemat. 56:116-122, 1976.

Carson, P. E.; Flanagan, C. L.; Ickes, C. E.; Alving, A. S.: Enzymatic deficiency in primaquine-sensitive erythrocytes. Science 124:484-485, 1956.

Poy, F.; Yaffe, M. B.; Sayos, J.; Saxena, K.; Morra, M.; Sumegi, J.; Cantley, L. C.; Terhorst, C.; Eck, M. J.: Crystal structures of the XLP protein SAP reveal a class of SH2 domains with extended, phosphotyrosine-independent sequence recognition. Molec. Cell 4:555-561, 1999.

Provisor, A. J.; Iacuone, J. J.; Chilcote, R. R.; Neiburger, R. G.; Crussi, F. G.; Baehner, R. L.: Acquired agammaglobulinemia after a life-threatening illness with clinical and laboratory features of infectious mononucleosis in three related male children. New Eng. J. Med. 293:62-65, 1975.

Purtilo, D. T.: Pathogenesis and phenotypes of an X-linked recessive lymphoproliferative syndrome. Lancet II:882-885, 1976.

Purtilo, D. T.: X-linked lymphoproliferative syndrome: an immunodeficiency disorder with acquired agammaglobulinemia, fatal infectious mononucleosis, or malignant lymphoma. Arch. Path. Lab. Med. 105:119-121, 1981.

Purtilo, D. T.; Bhawan, J.; Hutt, L. M.; De Nicola, L.; Szymanski, I.; Yang, J. P. S.; Boto, W.; Naier, R.; Thorley-Lawson, D.: Epstein-Barr virus in the X-linked recessive lymphoproliferative syndrome. Lancet I:798-801, 1978.

Purtilo, D. T.; Cassel, C. K.; Yang, J. P. S.: Fatal infectious mononucleosis in familial lymphohistiocytosis. (Letter) New Eng. J. Med. 201:736 only, 1974.

Purtilo, D. T.; Cassel, C. K.; Yang, J. P. S.; Harper, R.; Stephenson, S. R.; Landing, B. H.; Vewter, G. F.: X-linked recessive progressive combined variable immunodeficiency (Duncan's disease). Lancet I:935-941, 1975.

Purtilo, D. T.; DeFlorio, D., Jr.; Hutt, L. M.; Bhawan, J.; Yang, J. P. S.; Otto, R. L.; Edwards, W.: Variable phenotypic expression of an X-linked recessive lymphoproliferative syndrome. New Eng. J. Med. 297:1077-1081, 1977.

Purtilo, D. T.; Grierson, H. L.: Methods of detection of new families with X-linked lymphoproliferative disease. Cancer Genet. Cytogenet. 51:143-153, 1991.

Purtilo, D. T.; Sakamoto, K.; Barnabei, V.; Seeley, J.; Bechtold, T.; Rogers, G.; Yetz, J.; Harada, S.; the XLP collaborators: Epstein-Barr virus-induced diseases in boys with the X-linked lymphoproliferative syndrome (XLP): update on studies of the registry. Am. J. Med. 73:49-56, 1982.

Purtilo, D. T.; Yang, J. P. S.; Allegra, S.; DeFlorio, D.; Hutt, L. M.; Soltani, M.; Vawter, G. F.: Hematopathology and pathogenesis of the X-linked recessive lymphoproliferative syndrome. Am. J. Med. 62:225-233, 1977.

Sanger, W. G.; Grierson, H. L.; Skare, J.; Wyandt, H.; Pirruccello, S.; Fordyce, R.; Purtilo, D. T.: Partial Xq25 deletion in a family with the X-linked lymphoproliferative disease (XLP). Cancer Genet. Cytogenet. 47:163-169, 1990.

Sayos, J.; Wu, C.; Morra, M.; Wang, N.; Zhang, X.; Allen, D.; van Schaik, S.; Notarangelo, L.; Gehat, R.; Roncarolo, M. G.; Oettgen, H.; De Vries, J. E.; Aversall, G.; Terhorst, C.: The X-linked lymphoproliferative-disease gene product SAP regulates signals induced through the co-receptor SLAM. Nature 395:462-469, 1998.

Scher, I.: The CBA/N mouse strain: an experimental model illustrating the influence of the X-chromosome on immunity. Adv. Immun. 33:1-71,1982.

Schuster, V.; Kreth, H. W.: X-linked lymphoproliferative disease. In: Ochs, H. D.; Smith, C. I. E.; Puck, J. M. (eds.): Primary Immunodeficiency Diseases: A Molecular and Genetic Approach. New York: Oxford University Press 1999. Pp. 222-232.

Seemayer, T. A.; Gross, T. G.; Egeler, R. M.; Pirruccello, S. J.; Davis, D. J.; Kelly, C. M.; Okano, M.; Lanyi, A.; Sumegi, J.:X-linked lymphoproliferative disease: twenty-five years after the discovery. Pediat. Res. 38:471-478, 1995.

Skare, J.; Grierson, H.; Wyandt, H.; Sanger, W.; Milunsky, J.; Purtilo, D.; Sullivan, J.; Milunsky, A.: Genetics of the X-linked lymphoproliferative syndrome. (Abstract) Am. J. Hum. Genet. 45 (suppl.):A161 only, 1989.

Skare, J.; Madan, S.; Glaser, J.; Purtilo, D.; Nitowsky, H.; Pulijaal, V.; Milunsky, A.: First prenatal diagnosis of X-linked lymphoproliferative disease. Am. J. Med. Genet. 44:79-81, 1992.

Skare, J.; Milunsky, A.; Byron, K.; Sullivan, J.: The mutation causing X-linked lymphoproliferative syndrome lies in Xq26. (Abstract) Am. J. Hum. Genet. 41: A185 only, 1987.

Skare, J.; Wu, B.-L.; Madan, S.; Pulijaal, V.; Purtilo, D.; Haber, D.; Nelson, D.; Sylla, B.; Grierson, H.; Nitowsky, H.; Glaser, J.; Wissink, J.; White, B.; Holden, J.; Housman, D.; Lenoir, G.; Wyandt, H.; Milunsky, A.: Characterization of three overlapping deletions causing X-linked lymphoproliferative disease. Genomics 16:254-255,1993.

Skare, J. C.; Grierson, H. L.; Sullivan, J. L.; Nussbaum, R. L.; Purtilo, D. T.; Sylla, B. S.; Lenoir, G. M.; Reilly, D. S.; White, B. N.; Milunsky, A.: Linkage analysis of seven kindreds with the X-linked lymphoproliferative syndrome (XLP) confirms that the XLP locus is near DXS42 and DXS37. Hum. Genet. 82:354-358, 1989.

Skare, J. C.; Milunsky, A.; Byron, K. S.; Sullivan, J. L.: Mapping the X-linked lymphoproliferative syndrome. Proc. Nat. Acad. Sci. 84:2015-2018, 1987.

Skare, J. C.; Sullivan, J. L.; Milunsky, A.: Mapping the mutation causing the X-linked lymphoproliferative syndrome in relation to restriction fragment length polymorphisms on Xq. Hum. Genet. 82:349-353, 1989.

Steinherz, R.; Levy, Y.; Litwin, A.; Nitzan, M.; Friedman, E.; Levin, S.: X-linked lymphoproliferative syndrome: a new kindred with variable phenotypic expression. Am. J. Dis. Child. 139:191-193,1985.

Loftin, C. D.; Trivedi, D. B.; Tiano, H. F.; Clark, J. A.; Lee, C. A.; Epstein, J. A.; Morham, S. G.; Breyer, M. D.; Nguyen, M.; Hawkins, B. M.; Goulet, J. L.; Smithies, O.; Koller, B. H.; Langenbach, R.: Failure of ductus arteriosus closure and remodeling in neonatal mice deficient in cyclooxygenase-1 and cyclooxgenase-2. Proc. Nat. Acad. Sci. 98:1059-1064, 2001.

Macchia, L.; Di Paola, R.; Guerrese, M.-C.; Chiechi, L. M.; Tursi, A.; Caiaffa, M. F.; Haeggstrom, J. Z.: Expression of prostaglandin endoperoxide H synthase 1 and 2 in human placenta at term. Biochem. Biophys. Res. Commun. 233:496-501, 1997.

Morham, S. G.; Langenbach, R.; Loftin, C. D.; Tiano, H. F.; Vouloumanos, N.; Jennette, J. C.; Mahler, J. F.; Kluckman, K. D.; Ledford, A.; Lee, C. A.; Smithies, O.: Prostaglandin synthase 2 gene disruption causes severe renal pathology in the mouse. Cell 83:473-482, 1995.

Neufang, G.; Furstenberger, G.; Heidt, M.; Marks, F.; Muller-Decker, K.: Abnormal differentiation of epidermis in transgenic mice constitutively expressing cyclooxygenase-2 in skin. Proc. Nat. Acad. Sci. 98:7629-7634,2001.

O'Banion, M. K.; Sadowski, H. B.; Winn, V.; Young, D. A.: A serum-and glucocorticoid-regulated 4-kilobase mRNA encodes a cyclooxygenase-related protein. J. Biol. Chem. 266:23261-23267, 1991.

O'Banion, M. K.; Winn, V. D.; Young, D. A.: cDNA cloning and functional activity of a glucocorticoid-regulated inflammatory cyclooxygenase. Proc. Nat. Acad. Sci. 89:4888-4892, 1992.

Oshima, M.; Dinchuk, J. E.; Kargman, S. L.; Oshima, H.; Hancock, B.; Kwong, E.; Trzaskos, J. M.; Evans, J. F.; Taketo, M. M.: Suppression of intestinal polyposis in Apc (delta-716) knockout mice by inhibition of cyclooxygenase 2 (COX-2). Cell 87:803-809, 1996.

Salmenkivi, K.; Haglund, C.; Ristimaki, A.; Arola, J.; Heikkila, P.: Increased expression of cyclooxygenase-2 in malignant pheochromocytomas. J. Clin. Endocr. Metab. 86:5615-5619, 2001.

Tay, A.; Squire, J. A.; Goldberg, H.; Skorecki, K.: Assignment of the human prostaglandin-endoperoxide synthase 2 (PTGS2) gene to 1q25 by fluorescence in situ hybridization. Genomics 23:718-719,1994.

Swan, S. K.; Rudy, D. W.; Lasseter, K. C.; Ryan, C. F.; Buechel, K. L.; Lambrecht, L. J.; Pinto, M. B.; Dilzer, S. C.; Obrda, O.; Sundblad, K. J.; Gumbs, C. P.; Ebel, D. L.; Quan, H.; Larson, P. J.; Schwartz, J. I.; Musliner, T. A.; Gertz, B. J.; Brater, D. C.; Yao, S.-L.:Effect of cyclooxygenase-2 inhibition on renal function in elderly persons receiving a low-salt diet: a randomized controlled trial. Ann. Intern. Med. 133:1-9, 2000.

Tazawa, R.; Xu, X.-M.; Wu, K. K.; Wang, L.-H.: characterization of the genomic structure, chromosomal location and promoter of human Prostaglandin H synthase-2 gene. Biochem. Biophys. Res. Commun. 203:190-199, 1994.

Tsujii, M.; DuBois, R. N.: Alterations in cellular adhesion and apoptosis in epithelial cells overexpressing prostaglandin endoperoxide synthase 2. Cell 83:493-501, 1995.

Zhou, X.-L.; Lei, Z. M.; Rao, C. V.: Treatment of human endometrial gland epithelial cells with chorionic gonadotropin/luteinizing hormone increases the expression of the cyclooxygenase-2 gene. J. Clin. Endocr. Metab. 84:3364-3377, 1999.

Maho, A.; Bensimon, A.; Vassart, G.; Parmentier, M.: Mapping of the CCXCR1, CX3CR1, CCBP2 and CCR9 genes to the CCR cluster within the 3p21.3 region of the human genome. Cytogenet. Cell Genet. 87:265-268, 1999.

Roberts, A. I.; Lee, L.; Schwarz, E.; Groh, V.; Spies, T.; Ebert, E. C.; Jabri, B.: Cutting edge: NKG2D receptors induced by IL-15 costimulate CD28-negative effector CTL in the tissue microenvironment. J. Immun. 167:5527-5530, 2001.

Chen, X.; Vinkemeier, U.; Zhao, Y.; Jeruzalmi, D.; Darnell, J. E., Jr.; Kuriyan, J.: Crystal structure of a tyrosine phosphorylated STAT-1 dimer bound to DNA. Cell 93:827-839, 1998.

Copeland, N. G.; Gilbert, D. J.; Schindler, C.; Zhong, Z.; Wen, Z.; Darnell, J. E., Jr.; Mui, A. L.-F.; Miyajima, A.; Quelle, F. W.; Ihle, J. N.; Jenkins, N. A.: Distribution of the mammalian Stat gene family in mouse chromosomes. Genomics 29:225-228, 1995.

Darnell, J. E., Jr.; Kerr, I. M.; Stark, G. M.: Jak-STAT pathways and transcriptional activation in response to IFNs and other extracellular signaling proteins. Science 264:1415-1421, 1994.

Durbin, J. E.; Hackenmiller, R.; Simon, M. C.; Levy, D. E.: Targeted disruption of the mouse Stat1 gene results in compromised innate immunity to viral disease. Cell 84:443-450, 1996.

Haddad, B.; Pabon-Pena, C. R.; Young, H.; Sun, W. H.: Assignment of STAT1 to human chromosome 2q32 by FISH and radiation hybrids. Cytogenet. Cell Genet. 83:58-59, 1998.

Ihle, J. N.: STATs: signal transducers and activators of transcription. Cell 84:331-334, 1996.

Meraz, M. A.; White, J. M.; Sheehan, K. C. F.; Bach, E. A.; Rodig, S. J.; Dighe, A. S.; Kaplan, D. H.; Riley, J. K.; Greenlund, A. C. Campbell, D.; Carver-Moore, K.; DuBois, R. N.; Clark, R.; Aguet, M.; Schreiber, R. D.: Targeted disruption of the Stat1 gene in mice reveals unexpected physiologic specificity in the JAK-STAT signaling pathway. Cell 84:431-442, 1996.

Mowen, K. A.; Tang, J.; Zhu, W.; Schurter, B. T.; Shuai, K.; Herschman, H. R.; David, M.: Arginine methylation of STAT1 modulates IFN-alpha/beta-induced transcription. Cell 104:731-741, 2001.

Ramana, C. V.; Chatterjee-Kishore, M.; Nguyen, H.; Stark, G. R.: Complex roles of Stat1 in regulating gene expression. Oncogene 19:2619-2627, 2000.

Yamamoto, K.; Kobayashi, H.; Arai, A.; Miura, O.; Hirosawa, S.; Miyasaka, N.: cDNA cloning, expression and chromosome mapping of the human STAT4 gene: both STAT4 and STAT1 genes are mapped to 2q32.2-q32.3. Cytogenet. Cell Genet. 77:207-210, 1997.

Ware, R. E.; Howard, T. A.; Kamitani, T.; Chang, H.-M.; Yeh, E. T. H.; Seldin, M. F.: Chromosomal assignment of genes involved in glycosylphosphatidyl inositol anchor biosynthesis: implications for the pathogenesis of paroxysmal nocturnal hemoglobinuria. Blood 83:3753-3757, 1994.

Watanabe, R.; Inoue, N.; Westfall, B.; Taron, C. H.; Orlean, P.; Takeda, J.; Kinoshita, T.: The first step of glycosylphosphatidyl inositol biosynthesis is mediated by a complex of PIG-A, PIG-H, PIG-C and GPI1. EMBO J. 17:877-885, 1998.

Watanabe, R.; Kinoshita, T.; Masaki, R.; Yamamoto, A.; Takeda, J.; Inoue, N.: PIG-A and PIG-H, which participate in glycosylphosphatidyl inositol anchor biosynthesis, form a protein complex in the endoplasmic reticulum. J. Biol. Chem. 271:26868-26875, 1996.

Kamal, A.; Stokin, G. B.; Yang, Z.; Xia, C.; Goldstein, L. S.: Axonal transport of amyloid precursor protein is mediated by direct binding to the kinesin light chain subunit of kinesin-I. Neuron 28:449-459, 2000.

Maglott, D. R.; Durkin, A. S.; Lane, S. A.; Callen, D. F.; Feldblyum, T. V.; Nierman, W. C.: The gene for membrane protein E16 (D16S469E) maps to human chromosome 16q24.3 and is expressed in human brain, thymus, and retina. Genomics 23:303-304, 1994.

Kastury, K.; Druck, T.; Huebner, K.; Barletta, C.; Acampora, D.; Simeone, A.; Faiella, A.; Boncinelli, E.: Chromosome locations of human EMX and OTX genes. Genomics 22:41-45, 1994.

Simeone, A.; Acampora, D.; Gulisano, M.; Stornaiuolo, A.; Boncinelli, E.: Nested expression domains of four homeobox genes in developing rostral brain. Nature 358:687-690, 1992.

Bishop, K. M.; Goudreau, G.; O'Leary, D. D. M.: Regulation of area identity in the mammalian neocortex by Emx2 and Pax6. Science 288:344-349, 2000.

Boncinelli, E.; Gulisano, M.; Spada, F.; Broccoli, V.: Emx and Otx gene expression in the developing mouse brain. Ciba Found. Symp. 193:100-116, 1995.

Bosetti, A.; Faiella, A.; Boncinelli, E.; Consalez, G. G.: Linkage mapping of Emx2 to mouse chromosome 19. Mammalian Genome 8:71-72,1997.

Noonan, F. C.; Mutch, D. G.; Mallon, M. A.; Goodfellow, P. J.: Characterization of the homeodomain gene EMX2: sequence conservation, expression analysis, and a search for mutations in endometrial cancers. Genomics 76:37-44, 2001.

Acampora, D.; Mazan, S.; Avantaggiato, V.; Barone, P.; Tuorto, F.; Lallemand, Y.; Brulet, P.; Simeone, A.: Epilepsy and brain abnormalities in mice lacking the Otx1 gene. Nature Genet. 14:218-222, 1996.

Boncinelli, E.; Gulisano, M.; Broccoli, V.: Emx and Otx homeobox genes in the developing mouse brain. J. Neurobiol. 24:1356-1366,1993.

Frantz, G. D.; Weimann, J. M.; Levin, M. E.; McConnell, S. K.:Otx1 and Otx2 define layers and regions in developing cerebral cortex and cerebellum. J. Neurosci. 14:5725-5740, 1994.

Avraham, S.; Jiang, S.; Ota, S.; Fu, Y.; Deng, B.; Dowler, L. L.; White, R. A.; Avraham, H.: Structural and functional studies of the intracellular tyrosine kinase MATK gene and its translated product. J. Biol. Chem. 270:1833-1842, 1995.

Bennett, B. D.; Cowley, S.; Jiang, S.; London, R.; Deng, B.; Grabarek, J.; Groopman, J. E.; Goeddel, D. V.; Avraham, H.: Identification and characterization of a novel tyrosine kinase from megakaryocytes. J. Biol. Chem. 269:1068-1074, 1994.

Klages, S.; Adam, D.; Class, K.; Fargnoli, J.; Bolen, J. B.; Penhallow, R. C.: Ctk: a protein-tyrosine kinase related to Csk that defines an enzyme family. Proc. Nat. Acad. Sci. 91:2597-2601, 1994.

Sakano, S.; Iwama, A.; Inazawa, J.; Ariyama, T.; Ohno, M.; Suda, T.: Molecular cloning of a novel non-receptor tyrosine kinase, HYL (hematopoietic consensus tyrosine-lacking kinase). Oncogene 9:1155-1161,1994.

Zrihan-Licht, S.; Lim, J.; Keydar, I.; Sliwkowski, M. X.; Groopman, J. E.; Avraham, H.: Association of Csk-homologous kinase (CHK) (formerly MATK) with HER-2/ErbB-2 in breast cancer cells. J. Biol. Chem. 272:1856-1863, 1997.

Shimizu, S.; Narita, M.; Tsujimoto, Y.: Bcl-2 family proteins regulate the release of apoptogenic cytochrome c by the mitochondrial channel VDAC. Nature 399:483-487, 1999.

Harmon, D. L.; Gardner-Medwin, D.; Stirling, J. L.: Two new mutations in a late infantile Tay-Sachs patient are both in exon 1 of the beta-hexosaminidase alpha subunit gene. J. Med. Genet. 30:123-128, 1993.

Slaugenhaupt, S. A.; Roca, A. L.; Liebert, C. B.; Altherr, M. R.; Gusella, J. F.; Reppert, S. M.: Mapping of the gene for the Mel1a-melatonin receptor to human chromosome 4 (MTNR1A) and mouse chromosome 8 (Mtnr1a). Genomics 27:355-357, 1995.

Hattori, Y.; Yamashiro, Y.; Ohba, Y.; Miyaji, T.; Morishita, M.; Yamamoto, K.; Yamamoto, K.; Narai, S.; Kimura, A.: A new beta-thalassemia mutation (initiation codon ATG-to-GTG) found in the Japanese population. Hemoglobin 15:317-325, 1991.

Holmes, L. B.: Norrie's disease--an X-linked syndrome of retinal malformation, mental retardation and deafness. New Eng. J. Med. 284:367-368, 1971.

Isashiki, Y.; Ohba, N.; Yanagita, T.; Hokita, N.; Doi, N.; Nakagawa, M.; Ozawa, M.; Kuroda, N.: Novel mutation at the initiation codon in the Norrie disease gene in two Japanese families. Hum. Genet. 95:105-108, 1995.

Isashiki, Y.; Ohba, N.; Yanagita, T.; Hokita, N.; Hotta, Y.; Hayakawa, M.; Fujiki, K.; Tanabe, U.: Mutations in the Norrie disease gene: a new mutation in a Japanese family. (Letter) Brit. J. Ophthal. 79:703-708, 1995.

Johnson, K.; Mintz-Hittner, H. A.; Conley, Y. P.; Ferrell, R. E.: X-linked exudative vitreoretinopathy caused by an arginine toleucine substitution (R121L) in the Norrie disease protein. Clin. Genet. 50:113-115, 1996.

Johnston, S. S.; Hanna, J. E.; Nevin, N. C.; Bryars, J. H.: Norrie's disease. Birth Defects Orig. Art. Ser. 18(6):729-738, 1982.

Katayama, S.; Wohlferd, M.; Golbus, M. S.: First demonstration of recombination between the gene for Norrie disease and probe L1.28. Am. J. Med. Genet. 30:967-970, 1988.

Kivlin, J. D.; Sanborn, G. E.; Wright, E.; Cannon, L.; Carey, J.: Further linkage data on Norrie disease. Am. J. Med. Genet. 26:733-736, 1987.

Lindsay, S.; Thiselton, D. L.; Bateman, J. B.; Ngo, J. T.; Sparkes, R. S.; Coleman, M.; Davies, K. E.; Bhattacharya, S. S.: Localisation of the gene for Norrie disease to between DXS7 and DXS426 on Xp. Hum. Genet. 88:349-350, 1992.

Meindl, A.; Berger, W.; Meitinger, T.; van de Pol, D.; Achatz, H.; Dorner, C.; Haasemann, M.; Hellebrand, H.; Gal, A.; Cremers, F.; Ropers, H.-H.: Norrie disease is caused by mutations in an extracellular protein resembling C-terminal globular domain of mucins. Nature Genet. 2:139-143, 1992.

Meindl, A.; Lorenz, B.; Achatz, H.; Hellebrand, H.; Schmitz-Valckenberg, P.; Meitinger, T.: Missense mutations in the NDP gene in patients with a less severe course of Norrie disease. Hum. Molec. Genet. 4:489-490, 1995.

Meitinger, T.; Meindl, A.; Bork, P.; Rost, B.; Sander, C.; Haasemann, M.; Murken, J.: Molecular modeling of the Norrie disease protein predicts a cystine knot growth factor tertiary structure. Nature Genet. 5:376-380, 1993.

Moreira-Filho, C. A.; Neustein, I.: A presumptive new variant of Norrie's disease. J. Med. Genet. 16:125-128, 1979.

Nance, W. E.; Hara, S.; Hansen, A.; Elliott, J.; Lewis, M.; Chown, B.: Genetic linkage studies in a Negro kindred with Norrie's disease. Am. J. Hum. Genet. 21:423-429, 1969.

Ngo, J.; Spence, M. A.; Cortessis, V.; Bateman, J. B.; Sparkes, R. S.: Duplicate report crossing over in Norrie disease family. (Letter) Am. J. Med. Genet. 33:286, 1989.

Ngo, J. T.; Bateman, J. B.; Cortessis, V.; Sparkes, R. S.; Mohandas, T.; Inana, G.; Spence, M. A.: Norrie disease: linkage analysis using a 4.2-kb RFLP detected by a human ornithine aminotransferase cDNA probe. Genomics 4:539-545, 1989.

Ngo, J. T.; Spence, M. A.; Cortessis, V.; Sparkes, R. S.; Bateman, J. B.: Recombinational event between Norrie disease and DXS7 loci. Clin. Genet. 34:43-47, 1988.

Norrie, G.: Nogle Blindhedsaarsager: en oversigt. Hospitalstidende 76:141-147, 1933.

Ohba, N.; Yamashita, T.: Primary vitreoretinal dysplasia resembling Norrie's disease in a female: association with X autosome chromosomal translocation. Brit. J. Ophthal. 70:64-71, 1986.

Phillips, C. I.; Newton, M.; Duvall, J.; Holloway, S.; Levy, A. M.: Probably Norrie's disease due to mutation: two sporadic sibships of two males each, a necropsy of one case, and, given Norrie's disease, a calculation of the gene mutation frequency. Brit. J. Ophthal. 70:305-313, 1986.

Rehm, H. L.; Gutierrez-Espeleta, G. A.; Garcia, R.; Jimenez, G.; Khetarpal, U.; Priest, J. M.; Sims, K. B.; Keats, B. J. B.; Morton, C. C.: Norrie disease gene mutation in a large Costa Rican kindred with a novel phenotype including venous insufficiency. Hum. Mutat.9:402-408, 1997.

Schuback, D. E.; Chen, Z. Y.; Craig, I. W.; Breakefield, X. O.; Sims, K. B.: Mutations in the Norrie disease gene. Hum. Mutat. 5:285-292, 1995.

Shastry, B. S.: Identification of a recurrent missense mutation in the Norrie disease gene associated with a simplex case of exudative vitreoretinopathy. Biochem. Biophys. Res. Commun. 246:35-38, 1998.

Shastry, B. S.; Hejtmancik, J. F.; Plager, D. A.; Hartzer, M. K.; Trese, M. T.: Linkage and candidate gene analysis in X-linked familial exudative vitreoretinopathy. Genomics 27:341-344, 1995.

Shastry, B. S.; Hejtmancik, J. F.; Trese, M. T.: Identification of novel missense mutations in the Norrie disease gene associated with one X-linked and four sporadic cases of familial exudative vitreoretinopathy. Hum. Mutat. 9:396-401, 1997.

Sims, K. B.; Lebo, R. V.; Benson, G.; Shalish, C.; Schuback, D.; Chen, Z. Y.; Bruns, G.; Craig, I. W.; Golbus, M. S.; Breakefield, X. O.: The Norrie disease gene maps to a 150 kb region on chromosome Xp11.3. Hum. Molec. Genet. 1:83-89, 1992.

Sims, K. B.; Ozelius, L.; Corey, T.; Rinehart, W. B.; Liberfarb, R.; Haines, J.; Chen, W. J.; Norio, R.; Sankila, E.; de la Chapelle, A.; Murphy, D. L.; Gusella, J.; Breakefield, X. O.: Norrie disease gene is distinct from the monoamine oxidase genes. Am. J. Hum. Genet. 45:424-434, 1989.

Taylor, P. J.; Coates, T.; Newhouse, M. L.: Episkopi blindness: hereditary blindness in a Greek Cypriot family. Brit. J. Ophthal. 43:340-344, 1959.

Torrente, I.; Mangino, M.; Gennarelli, M.; Novelli, G.; Giannotti, A.; Vadala, P.; Dallapiccola, B.: Two new missense mutations (A105Tand C110G) in the norrin gene in two Italian families with Norrie disease and familial exudative vitreoretinopathy. (Letter) Am. J. Med. Genet. 72:242-244, 1997.

Janz, R.; Sudhof, T. C.; Hammer, R. E.; Unni, V.; Siegelbaum, S. A.; Bolshakov, V. Y.: Essential roles in synaptic plasticity for synaptogyrin I and synaptophysin I. Neuron 24:687-700, 1999.

McMahon, H. T.; Bolshakov, V. Y.; Janz, R.; Hammer, R. E.; Siegelbaum, S. A.; Sudhof, T. C.: Synaptophysin, a major synaptic vesicle protein, is not essential for neurotransmitter release. Proc. Nat. Acad. Sci. 93:4760-4764, 1996.

Almind, K.; Ahlgren, M. G.; Hansen, T.; Urhammer, S. A.; Clausen, J. O.; Pedersen, O.: Discovery of a Met300Val variant in Shc and studies of its relationship to birth weight and length, impaired insulin secretion, insulin resistance, and type 2 diabetes mellitus. J. Clin. Endocr. Metab. 84:2241-2244, 1999.

Harun, R. B.; Smith, K. K.; Leek, J. P.; Markham, A. F.; Norris, A.; Morrison, J. F. J.: Characterization of human SHC p66 cDNA and its processed pseudogene mapping to Xq12-q13.1. Genomics 42:349-352,1997.

McGlade, J.; Cheng, A.; Pelicci, G.; Pelicci, P. G.; Pawson, T.: Shc proteins are phosphorylated and regulated by the v-src and v-fps protein-tyrosine-kinases. Proc. Nat. Acad. Sci. 89:8869-8873, 1992.

Migliaccio, E.; Giorgio, M.; Mele, S.; Pelicci, G.; Reboldi, P.; Pandolfi, P. P.; Lanfrancone, L.; Pelicci, P. G.: The p66 (shc) adaptor protein controls oxidative stress response and life span in mammals. Nature 402:309-313, 1999.

Nemoto, S.; Finkel, T.: Redox regulation of forkhead proteins through a p66shc-dependent signaling pathway. Science 295:2450-2452,2002.

Pelicci, G.; Lanfrancone, L.; Grignani, F.; McGlade, J.; Cavallo, F.; Forni, G.; Nicoletti, I.; Grignani, F.; Pawson, T.; Pelicci, P. G.: A novel transforming protein (SHC) with an SH2 domain is implicated in mitogenic signal transduction. Cell 70:93-104, 1992.

Yulug, I. G.; Egan, S. E.; See, C. G.; Fisher, E. M. C.: A human SHC-related sequence maps to chromosome 17, the SHC gene maps to chromosome 1. Hum. Genet. 96:245-248, 1995.

Zhang, L.; Camerini, V.; Bender, T. P.; Ravichandran, K. S.: A nonredundant role for the adapter protein Shc in thymic T cell development. Nature Immun. 3:749-755, 2002.

Abramovitz, M.; Boie, Y.; Nguyen, T.; Rushmore, T. H.; Bayne, M. A.; Metters, K. M.; Slipetz, D. M.; Grygorczyk, R.: Cloning and expression of a cDNA for the human prostanoid FP receptor. J. Biol. Chem. 269:2632-2636, 1994.

Betz, R.; Lagercrantz, J.; Kedra, D.; Dumanski, J. P.; Nordenskjold, A.: Genomic structure, 5-prime flanking sequences, and precise localization in 1p31.1 of the human prostaglandin F receptor gene. Biochem. Biophys. Res. Commun. 254:413-416, 1999.

Sugimoto, Y.; Yamasaki, A.; Segi, E.; Tsuboi, K.; Aze, Y.; Nishimura, T.; Oida, H.; Yoshida, N.; Tanaka, T.; Katsuyama, M.; Hasumoto, K.; Murata, T.; Hirata, M.; Ushikubi, F.; Negishi, M.; Ichikawa, A.; Narumiya, S.: Failure of parturition in mice lacking the prostaglandin F receptor. Science 277:681-683, 1997.

Geppert, M.; Khvotchev, M.; Krasnoperov, V.; Goda, Y.; Missler, M.; Hammer, R. E.; Ichtchenko, K.; Petrenko, A. G.; Sudhof, T. C.: Neurexin I-alpha is a major alpha-latrotoxin receptor that cooperates in alpha-latrotoxin action. J. Biol. Chem. 273:1705-1710, 1998.

Ichtchenko, K.; Hata, Y.; Nguyen, T.; Ullrich, B.; Missler, M.; Moomaw, C.; Sudhof, T. C.: Neuroligin 1: a splice site-specific ligand for beta-neurexins. Cell 81:435-443, 1995.

Kleiderlein, J. J.; Nisson, P. E.; Jessee, J.; Li, W.-B.; Becker, K. G.; Derby, M. L.; Ross, C. A.; Margolis, R. L.: CCG repeats incDNAs from human brain. Hum. Genet. 103:666-673, 1998. Note: Erratum:Hum. Genet. 104:113 only, 1999.

Margolis, R.: Personal Communication. Baltimore, Md. Mar. 29, 2000.

Missler, M.; Sudhof, T. C.: Neurexins: three genes and 1001 products. Trends Genet. 14:20-26, 1998.

Ikeshima, H.; Imai, S.; Shimoda, K.; Hata, J.; Takano, T.: Expression of a MADS box gene, MEF2D, in neurons of the mouse central nervous system: implication of its binary function in myogenic and neurogenic cell lineages. Neurosci. Lett. 200:117-120, 1995.

Delhase, M.; Hayakawa, M.; Chen, Y.; Karin, M.: Positive and negative regulation of I-kappa-B kinase activity through IKK-beta subunit phosphorylation. Science 284:309-312, 1999.

DiDonato, J. A.; Hayakawa, M.; Rothwarf, D. M.; Zandi, E.; Karin, M.: A cytokine-responsive Ikappa B kinase that activates the transcription factor NF-kappa B. Nature 388: 548-554, 1997.

Mercurio, F.; Zhu, H.; Murray, B. W.; Shevchenko, A.; Bennett, B. L.; Li, J.; Young, D. B.; Barbosa, M.; Mann, M.; Manning, A.; Rao, A.: IKK-1 and IKK-2: cytokine-activated I-kappa-B kinases essential for NF-kappa-B activation. Science 278:860-866, 1997.

Matsushima, A.; Kaisho, T.; Rennert, P. D.; Nakano, H.; Kurosawa, K.; Uchida, D.; Takeda, K.; Akira, S.; Matsumoto, M.: Essential role of nuclear factor (NF)-kappa-B-inducing kinase and inhibitor of kappa-B(I-kappa-B) kinase alpha in NF-kappa-B activation through lymphotoxin beta receptor, but not through tumor necrosis factor receptor I. J. Exp. Med. 193:631-636, 2001.

Brzezinski, A.: Melatonin in humans. New Eng. J. Med. 336:186-195,1997.

Liu, R.-Y.; Zhou, J.-N.; van Heerikhuize, J.; Hofman, M. A.; Swaab, D. F.: Decreased melatonin levels in postmortem cerebrospinal fluid in relation to aging, Alzheimer's disease, and apolipoprotein E-epsilon-4/4genotype. J. Clin. Endocr. Metab. 84:323-327, 1999.

Nelson, C. S.; Ikeda, M.; Gompf, H. S.; Robinson, M. L.; Fuchs, N. K.; Yoshioka, T.; Neve, K. A.; Allen, C. N.: Regulation of melatonin1 a receptor signaling and trafficking by asparagine-124. Molec. Endocr. 15:1306-1317, 2001.

Reppert, S. M.; Weaver, D. R.: Melatonin madness. Cell 83:1059-1062,1995.

Reppert, S. M.; Weaver, D. R.; Ebisawa, T.: Cloning and characterization of a mammalian melatonin receptor that mediates reproductive and circadian responses. Neuron 13:1177-1185, 1994.

Muller-Pillasch, F.; Zimmerhackl, F.; Lacher, U.; Schultz, N.; Hameister, H.; Varga, G.; Friess, H.; Buchler, M.; Adler, G.; Gress, T. M.: Cloning of novel transcripts of the human guanine-nucleotide-exchange factor Mss4: in situ chromosomal mapping and expression in pancreatic cancer. Genomics 46:389-396, 1997.

Yu, H.; Schreiber, S. L.: Cloning, Zn (2+) binding, and structural characterization of the guanine nucleotide exchange factor human Mss4. Biochemistry 34:9103-9110, 1995.

Yabe, D.; Nakamura, T.; Kanazawa, N.; Tashiro, K.; Honjo, T.:Calumenin, a Ca (2+)-binding protein retained in the endoplasmic reticulum with a novel carboxyl-terminal sequence, HDEF. J. Biol. Chem. 272:18232-18239, 1997.

Yabe, D.; Taniwaki, M.; Nakamura, T.; Kanazawa, N.; Tashiro, K.; Honjo, T.: Human calumenin gene (CALU): cDNA isolation and chromosomal mapping to 7q32. Genomics 49:331-333, 1998.

Ito, T.; Yang, M.; May, W. S.: RAX, a cellular activator for double-stranded RNA-dependent protein kinase during stress signaling. J. Biol. Chem. 274:15427-15432, 1999.

Patel, R. C.; Sen, G. C.: PACT, a protein activator of the interferon-induced protein kinase, PKR. EMBO J. 17:4379-4390, 1998.

Scott, A. F.: Personal Communication. Baltimore, Md. 2001.

Shearman, L. P.; Zylka, M. J.; Weaver, D. R.; Kolakowski, L. F., Jr.; Reppert, S. M.: Two period homologs: circadian expression and photic regulation in the suprachiasmatic nuclei. Neuron 19:1261-1269,1997.

Toh, K. L.; Jones, C. R.; He, Y.; Eide, E. J.; Hinz, W. A.; Virshup, D. M.; Ptacek, L. J.; Fu, Y.-H.: An hPer2 phosphorylation site mutation in familial advanced sleep phase syndrome. Science 291:1040-1043,2001.

Engelender, S.; Wanner, T.; Kleiderlein, J. J.; Wakabayashi, K.; Tsuji, S.; Takahashi, H.; Ashworth, R.; Margolis, R. L.; Ross, C. A.: Organization of the human synphilin-1 gene, a candidate for Parkinson's disease. Mammalian Genome 11:763-766, 2000.

Chien, W.; Pei, L.: A novel binding factor facilitates nuclear translocation and transcriptional activation function of the pituitary tumor-transforming gene product. J. Biol. Chem. 275:19422-19427,2000.

Yaspo, M.-L.; Aaltonen, J.; Horelli-Kuitunen, N.; Peltonen, L.; Lehrach, H.: Cloning of a novel human putative type Ia integral membrane protein mapping to 21q22.3. Genomics 49:133-136, 1998.

Yaspo, M.-L.; Gellen, L.; Mott, R.; Korn, B.; Nizetic, D.; Poustka, A. M.; Lehrach, H.: Model for a transcript map of human chromosome 21: isolation of new coding sequences from exon and enriched cDNA libraries. Hum. Molec. Genet. 4:1291-1304, 1995.

Ghiso, J. A.; Holton, J.; Miravalle, L.; Calero, M.; Lashley, T.; Vidal, R.; Houlden, H.; Wood, N.; Neubert, T. A.; Rostagno, A.; Plant, G.; Revesz, T.; Frangione, B.: Systemic amyloid deposits in familial British dementia. J. Biol. Chem. 276:43909-43914, 2001.

Stromgrem, E.; Dalby, A.; Dalby, M.; Ranheim, B.:Acta Neurol. Scand. 46 (suppl. 43):97-98, 1970.

Gruber, A. D.; Schreur, K. D.; Ji, H.-L.; Fuller, C. M.; Pauli, B. U.: Molecular cloning and transmembrane structure of hCLCA2 from human lung, trachea, and mammary gland. Am. J. Physiol. 276: C1261-C1270,1999.

Albertsen, H. M.; Smith, S. A.; Mazoyer, S.; Fujimoto, E.; Stevens, J.; Williams, B.; Rodriguez, P.; Cropp, C. S.; Slijepcevic, P.; Carlson, M.; Robertson, M.; Bradley, P.; and 9 others: A physical map and candidate genes in the BRCA1 region on chromosome 17q12-21. Nature Genet. 7:472-479, 1994.

Han, H.-J.; Sudo, K.; Inazawa, J.; Nakamura, Y.: Isolation and mapping of a human gene (RABL) encoding a small GTP-binding protein homologous to the Ras-related RAB gene. Cytogenet. Cell Genet. 73:137-139, 1996.

Heckel, D.; Comtesse, N.; Brass, N.; Blin, N.; Zang, K. D.; Meese, E.: Novel immunogenic antigen homologous to hyaluronidase in meningioma. Hum. Molec. Genet. 7:1859-1872, 1998.

Dolganov, G. M.; Maser, R. S.; Novikov, A.; Tosto, L.; Chong, S.; Bressan, D. A.; Petrini, J. H. J.: Human Rad50 is physically associated with human mre11: identification of a conserved multiprotein complex implicated in recombinational DNA repair. Molec. Cell Biol. 16:4832-4841, 1996.

Hopfner, K.-P.; Craig, L.; Moncalian, G.; Zinkel, R. A.; Usui, T.; Owen, B. A. L.; Karcher, A.; Henderson, B.; Bodmer, J.-L.; McMurray, C. T.; Carney, J. P.; Petrini, J. H. J.; Tainer, J. A.: The Rad50 zinc-hook is a structure joining Mre11 complexes in DNA recombination and repair. Nature 418:562-566, 2002.

Luo, G.; Yao, M. S.; Bender, C. F.; Mills, M.; Bladl, A. R.; Bradley, A.; Petrini, J. H. J.: Disruption of mRad50 causes embryonic stem cell lethality, abnormal embryonic development, and sensitivity to ionizing radiation. Proc. Nat. Acad. Sci. 96:7376-7381, 1999.

Trujillo, K. M.; Yuan, S.-S. F.; Lee, E. Y.-H. P.; Sung, P.: Nuclease activities in a complex of human recombination and DNA repair factors Rad50, Mre11, and p95. J. Biol. Chem. 273:21447-21450, 1998.

Clark, J.; Lu, Y. J.; Sidhar, S. K.; Parker, C.; Gill, S.; Smedley, D.; Hamoudi, R.; Linehan, W.; Shipley, J.; Cooper, C.: Fusion of splicing factor genes PSF and NonO (p54nrb) to the TFE3 gene in papillary renal cell carcinoma. Oncogene 15:2233-2239, 1997.

Heimann, P.; El Housni, H.; Ogur, G.; Weterman, M. A. J.; Petty, E. M.; Vassart, G.: Fusion of a novel gene, RCC17, to the TFE3 gene in t (X;17)(p11.2; q25.3)-bearing papillary renal cell carcinomas. Cancer Res. 61:4130-4135, 2001.

Henthorn, P. S.; Stewart, C. C.; Kadesch, T.; Puck, J. M.: The gene encoding human TFE3, a transcription factor that binds the immunoglobulin heavy-chain enhancer, maps to Xp11.22. Genomics 11:374-378, 1991.

Joyama, S.; Ueda, T.; Shimizu, K.; Kudawara, I.; Mano, M.; Funai, H.; Takemura, K.; Yoshikawa, H.: Chromosome rearrangement at 17q25and Xp11.2 in alveolar soft-part sarcoma: a case report and review of the literature. Cancer 86:1246-1250, 1999.

Ladanyi, M.; Lui, M.Y.; Antonescu, C. R.; Krause-Boehm, A.; Meindl, A.; Argani, P.; Healey, J. H.; Ueda, T.; Yoshikawa, H.; Meloni-Ehrig, A.; Sorensen, P. H. B.; Mertens, F.; Mandahl, N.; van den Berghe, H.; Sciot, R.; Dal Cin, P.; Bridge, J.: The der (17) t (X;17)(p11; q25) of human alveolar soft part sarcoma fuses the TFE3 transcription factor gene to ASPL, a novel gene at 17q25. Oncogene 20:48-57, 2001.

Macchi, P.; Notarangelo, L.; Giliani, S.; Strina, D.; Repetto, M.; Sacco, M. G.; Vezzoni, P.; Villa, A.: The genomic organization of the human transcription factor 3 (TFE3) gene. Genomics 28:491-494,1995.

Shipley, J. M.; Birdsall, S.; Clark, J.; Crew, J.; Gill, S.; Linehan, M.; Gnarra, J.; Gisher, S.; Craig, I. W.; Cooper, C. S.: Mapping the X chromosome breakpoint in two papillary renal cell carcinoma cell lines with a t (X;1)(p11.2; q21.2) and the first report of a female case. Cytogenet. Cell. Genet. 71:280-284, 1995.

Sidhar, S. K.; Clark. J.; Gill, S.; Hamoudi, R.; Crew, A. J.; Gwilliam, R.; Ross, M.; Linehan, W. M.; Birdsall, S.; Shipley, J.; Cooper, C. S.: The t (X;1)(p11.2; q21.2) translocation in papillary renal cell carcinoma fuses a novel gene PRCC to the TFE3 transcription factor gene. Hum. Molec. Genet. 5:1333-1338, 1996.

Larola, G.; Cuesta, R.; Brewer, G.; Schneider, R. J.: control of mRNA decay by heat shock-ubiquitin-proteasome pathway. Science 284:499-502, 1999.

Deutsch, D.; Palmon, A.; Dafni, L.; Fisher, L.; Termine, J. D.; Young, M.: Cloning, sequencing, and characterization of tuftelin: a novel acidic enamel protein. Connect. Tissue Res. 27:121 only,1992.

Deiss, L. P.; Feinstein, E.; Berissi, H.; Cohen, O.; Kimchi, A.: Identification of a novel serine/threonine kinase and a novel 15-kD protein as potential mediators of the gamma interferon-induced cell death. Genes Dev. 9:15-30, 1995.

Feinstein, E.; Druck, T.; Kastury, K.; Berissi, H.; Goodart, S. A.; Overhauser, J.; Kimchi, A.; Huebner, K.: Assignment of DAP1 and DAPK: genes that positively mediate programmed cell death triggered by IFN-gamma--to chromosome regions 5p12.2 (sic) and 9q34.1, respectively. Genomics 29:305-307, 1995.

Hughes, K. A.; Hurlstone, A. F. L.; Tobias, E. S.; McFarlane, R.; Black, D. M.: Absence of ST7 mutations in tumor-derived cell lines and tumors. Nature Genet. 29:380-381, 2001.

Thomas, N. A.; Choong, D. Y. H.; Jokubaitis, V. J.; Neville, P. J.; Campbell, I. G.: Mutation of the ST7 tumor suppressor gene on 7q31.1 is rare in breast, ovarian and colorectal cancers. Nature Genet. 29:379-380, 2001.

Zenklusen, J. C.; Conti, C. J.; Green, E. D.: Mutational and functional analyses reveal that ST7 is a highly conserved tumor-suppressor gene on human chromosome 7q31. Nature Genet. 27:392-398, 2001.

Zenklusen, J. C.; Rodriguez, L. V.; LaCava, M.; Wang, Z.; Goldstein, L. S.; Conti, C. J.: Novel susceptibility locus for mouse hepatomas: evidence for a conserved tumor suppressor gene. Genome Res. 6:1070-1076,1996.

Zenklusen, J. C.; Weitzel, J. N.; Ball, H. G.; Conti, C. J.: Allelic loss at 7q31.1 in human primary ovarian carcinomas suggests the existence of a tumor suppressor gene. Oncogene 11:359-363, 1995.

Deutsch, D.; Palmon, A.; Fisher, L. W.; Kolodny, N.; Termine, J. D.; Young, M. F.: Sequencing of bovine enamelin (tuftelin), a novel acidic enamel protein. J. Biol. Chem. 266: 16021-16028, 1991.

Deutsch, D.; Palmon, A.; Young, M. F.; Selig, S.; Kearns, W. G.; Fisher, L. W.: Mapping of the human tuftelin (TUFT1) gene to chromosome 1 by fluorescence in situ hybridization. (Abstract) Mammalian Genome 5:461-462, 1994.

MacDougall, M.; Simmons, D.; Dodds, A.; Knight, C.; Luan, X.; Zeichner-David, M.; Zhang, C.; Ryu, O. H.; Qian, Q.; Simmer, J. P.; Hu, C.-C.: Cloning, characterization, and tissue expression pattern of mouse tuftelin cDNA. J. Dent. Res. 77:1970-1978, 1998.

Wirtz, K. W. A.: Phospholipid transfer proteins. Annu. Rev. Biochem. 60:73-99, 1991.

Ishida, N.; Miura, N.; Yoshioka, S.; Kawakita, M.: Molecular cloning and characterization of a novel isoform of the human UDP-galactose transporter, and of related complementary DNAs belonging to the nucleotide-sugar transporter gene family. J. Biochem. 120:1074-1078, 1996.

Lund, A.; Udd, B.; Juvonen, V.; Andersen, P. M.; Cederquist, K.; Davis, M.; Gellera, C.; Kolmel, C.; Ronnevi, L.-O.; Sperfeld, A.-D.; Sorensen, S.-A.; Tranebjaerg, L.; Van Maldergem, L.; Watanabe, M.; Weber, M.; Yeung, L.; Savontaus, M.-L.: Multiple founder effects in spinal and bulbar muscular atrophy (SBMA, Kennedy disease) around the world. Europ. J. Hum. Genet. 9:431-436, 2001.

Edelhoff, S.; Ayer, D. E.; Zervos, A. S.; Steingrimsson, E.; Jenkins, N. A.; Copeland, N. G.; Eisenman, R. N.; Brent, R.; Disteche, C. M.: Mapping of two genes encoding members of a distinct subfamily of MAX interacting proteins: MAD to human chromosome 2 and mouse chromosome 6, and MXI1 to chromosome 10 and mouse chromosome 19. Oncogene 9:665-668, 1994.

Ferguson, G. D.; Anagnostaras, S. G.; Silva, A. J.; Herschman, H. R.: Deficits in memory and motor performance in synaptotagmin IV mutant mice. Proc. Nat. Acad. Sci. 97:5598-5603, 2000.

Ferguson, G. D.; Chen, X.-N.; Korenberg, J. R.; Herschman, H. R.: The human synaptotagmin IV gene defines an evolutionary break point between syntenic mouse and human chromosome regions but retains ligand inducibility and tissue specificity. J. Biol. Chem. 275:36920-36926,2000.

Holterhus, P.-M.; Wiebel, J.; Sinnecker, G. H. G.; Bruggenwirth, H. T.; Sippell, W. G.; Brinkmann, A. O.; Kruse, K.; Hiort, O.: Clinical and molecular spectrum of somatic mosaicism in androgen insensitivity syndrome. Pediat. Res. 46:684-690, 1999.

Foresta, C.; Bertella, A.; Moro, E.; Roverato, A.; Merico, M.; Ferlin, A.: Sertoli cell function in infertile patients with and without microdeletions of the azoospermia factors on the Y chromosome long arm. J. Clin. Endocr. Metab. 86:2414-2419, 2001.

Kobayashi, K.; Mizuno, K.; Hida, A.; Komaki, R.; Tomita, K.; Matsushita, I.; Namiki, M.; Iwamoto, T.; Tamura, S.; Minowada, S.; Nakahori, Y.; Nakagome, Y.: PCR analysis of the Y chromosome long arm in azoospermic patients: evidence for a second locus required for spermatogenesis. Hum. Molec. Genet. 3:1965-1967, 1994.

Agulnik, A. I.; Zharkikh, A.; Boettger-Tong, H.; Bourgeron, T.; McElreavey, K.; Bishop, C. E.: Evolution of the DAZ gene family suggests that Y-linked DAZ plays little, or a limited, role in spermatogenesis but underlines a recent African origin for human populations. Hum. Molec. Genet. 7:1371-1377, 1998.

Anonymous: A missing piece on the Y. (Editorial) Nature Genet. 10:367-368, 1995.

Cooke, H. J.; Lee, M.; Kerr, S.; Ruggiu, M.: A murine homologue of the human DAZ gene is autosomal and expressed only in male and female gonads. Hum. Molec. Genet. 5:513-516, 1996.

Foresta, C.; Moro, E.; Garolla, A.; Onisto, M.; Ferlin, A.: Y chromosome microdeletions in cryptorchidism and idiopathic infertility. J. Clin. Endocr. Metab. 84:3660-3665, 1999.

Makova, K. D.; Li, W.-H.: Strong male-driven evolution of DNA sequences in human S and apes. Nature 416:624-626, 2002.

Menke, D. B.; Mutter, G. L.; Page, D. C.: Expression of DAZ, an azoospermia factor candidate, in human spermatogonia. (Letter) Am. J. Hum. Genet. 60:237-241, 1997.

Moro, E.; Ferlin, A.; Yen, P. H.; Franchi, P. G.; Palka, G.; Foresta, C.: Male infertility caused by a de novo partial deletion of the DAZ cluster on the Y chromosome. J. Clin. Endocr. Metab. 85:4069-4073,2000.

Reijo, R.; Lee, T.-Y.; Salo, P.; Alagappan, R.; Brown, L. G.; Rosenberg, M.; Rozen, S.; Jaffe, T.; Straus, D.; Hovatta, O.; de laChapelle, A.; Silber, S.; Page, D. C.: Diverse spermatogenic defects in human S caused by Y chromosome deletions encompassing a novel RNA-binding protein gene. Nature Genet. 10:383-393, 1995.

Reijo, R.; Seligman, J.; Dinulos, M. B.; Jaffe, T.; Brown, L. G.; Disteche, C. M.; Page, D. C.: Mouse autosomal homolog of DAZ, a candidate male sterility gene in human S, is expressed in male germ cells before and after puberty. Genomics 35:346-352, 1996.

Saxena, R.; Brown, L. G.; Hawkins, T.; Alagappan, R. K.; Skaletsky, H.; Reeve, M. P.; Reijo, R.; Rozen, S.; Dinulos, M. B.; Disteche, C. M.; Page, D. C.: The DAZ gene cluster on the human Y chromosome arose from an autosomal gene that was transposed, repeatedly amplified and pruned. Nature Genet. 14:292-299, 1996.

Najmabadi, H.; Huang, V.; Yen, P.; Subbarao, M. N.; Bhasin, D; Banaag, L.; Naseeruddin, S.; de Kretser, D. M.; Baker, H. W. G.; McLachlan, R. I.; Loveland, K. A.; Bhasin, S.: Substantial prevalence of microdeletions of the Y-chromosome in infertile men with idiopathic azoospermia and oligozoospermia detected using a sequence-tagged site-based mapping strategy. J. Clin. Endocr. Metab. 81:1347-1352, 1996.

Wang, G.; Sawai, N.; Kotliarova, S.; Kanazawa, I.; Nukina, N.:Ataxin-3, the MJD1 gene product, interacts with the two human homologs of yeast DNA repair protein RAD23, HHR23A and HHR23B. Hum. Molec. Genet. 9:1795-1803, 2000.

Ng, J. M. Y.; Vrieling, H.; Sugasawa, K.; Ooms, M. P.; Grootegoed, J. A.; Vreeburg, J. T. M.; Visser, P.; Beems, R. B.; Gorgels, T. G. M. F.; Hanaoka, F.; Hoeijmakers, J. H. J.; van der Horst, G. T. J.: Developmental defects and male sterility in mice lacking the ubiquitin-like DNA repair gene mHR23B. Molec. Cell. Biol. 22:1233-1245, 2002.

Volker, M.; Mone, M. J.; Karmakar, P.; van Hoffen, A.; Schul, W.; Vermeulen, W.; Hoeijmakers, J. H. J.; van Driel, R.; van Zeeland, A. A.; Mullenders, L. H. F.: Sequential assembly of the nucleotide excision repair factors in vivo. Molec. Cell 8:213-224, 2001.

Breviario, F.; d'Aniello, E. M.; Golay, J.; Peri, G.; Bottazzi, B.; Bairoch, A.; Saccone, S.; Marzella, R.; Predazzi, V.; Rocchi, M.; Della Valle, G.; Dejana, E.; Mantovani, A.; Introna, M.: Interleukin-1-inducible genes in endothelial cells: cloning of a new gene related to C-reactive protein and serum amyloid P component. J. Biol. Chem. 267:22190-22197, 1992.

Lee, T. H.; Lee, G. W.; Ziff, E. B.; Vilcek, J.: Isolation and characterization of eight tumor necrosis factor-induced gene sequences from human fibroblasts. Molec. Cell. Biol. 10:1982-1988, 1990.

Greco, A.; Mariani, C.; Miranda, C.; Lupas, A.; Pagliardini, S.; Pomati, M.; Pierotti, M. A.: The DNA rearrangement that generates the TRK-T3 oncogene involves a novel gene on chromosome 3 whose product has a potential coiled-coil domain. Molec. Cell Biol. 15:6118-6127,1995.

Mencinger, M.; Panagopoulos, I.; Andreasson, P.; Lassen, C.; Mitelman, F.; Aman, P.: Characterization and chromosomal mapping of the human TFG gene involved in thyroid carcinoma. Genomics 41:327-331, 1997.

Kramps, T.; Peter, O.; Brunner, E.; Nellen, D.; Froesch, B.; Chatterjee, S.; Murone, M.; Zullig, S.; Basler, K.: Wnt/Wingless signaling requires BCL9/legless-mediated recruitment of pygopus to the nuclear beta-catenin-TCF complex. Cell 109:47-60, 2002.

Willis, T. G.; Zalcberg, I. R.; Coignet, L. J. A.; Wlodarska, M.; Stul, D. M.; Jadayel, D. M.; Bastard, C.; Treleaven, J. G.; Catovsky, D.; Silva, M. L. M.; Dyer, M. J. S.: Molecular cloning of translocation t (1;14)(q21; q32) defines a novel gene (BCL9) at chromosome 1q21. Blood 91:1873-1881, 1998.

Kim, D.-H.; Iijima, H.; Goto, K.; Sakai, J.; Ishii, H.; Kim, H.-J.; Suzuki, H.; Kondo, H.; Saeki, S.; Yamamoto, T.: Human apolipoprotein E receptor 2: a novel lipoprotein receptor of the low density lipoprotein receptor family predominantly expressed in brain. J. Biol. Chem. 271:8373-8380, 1996.

Kim, D.-H.; Magoori, K.; Inoue, T. R.; Mao, C. C.; Kim, H.-J.; Suzuki, H.; Fujita, T.; Endo, Y.; Saeki, S.; Yamamoto, T. T.: Exon/intron organization, chromosome localization, alternative splicing, and transcription units of the human apolipoprotein E receptor 2 gene. J. Biol. Chem. 272:8498-8504, 1997.

Davidson, R. G.; Nitowsky, H. M.; Childs, B.: Demonstration of two populations of cells in the human female heterozygous for glucose-6-phosphate dehydrogenase variants. Proc. Nat. Acad. Sci. 50:481-485, 1963.

De Flora, A.; Morelli, A.; Benatti, U.; Giuntini, P.; Ferraris, A. M.; Galiano, S.; Ravazzolo, R.; Gaetani, G. F.: G6PD Napoli and Ferrara II: two new glucose-6-phosphate dehydrogenase variants having similar characteristics but different intracellular lability and specific activity. Brit. J. Haemat. 48:417-423, 1981.

Dern, R. J.; McCurdy, P. R.; Yoshida, A.: A new structural variant of glucose-6-phosphate dehydrogenase with a high production rate (G6PDHektoen). J. Lab. Clin. Med. 73:283-290, 1969.

De Vita, G.; Alcalay, M.; Sampietro, M.; Cappellini, M. D.; Fiorelli, G.; Toniolo, D.: Two point mutations are responsible for G6PD polymorphism in Sardinia. Am. J. Hum. Genet. 44:233-240, 1989.

Du, C.; Xu, Y.; Hua, X.; Wu, Q.; Liu, L.; Wu, M.: Studies on erythrocyte glucose-6-phosphate dehydrogenase variants in Chinese. III: Gd (-) Miaozu-Baisha. Acta Genet. Sinica 11(2): 153-158, 1984.

Du, C.-S.; Hua, X.-Y.; Wu, Q.-L.; Li, C.-Q.; Zheng, J.-F.; Li, H.-L.: Studies on erythrocyte glucose-6-phosphate dehydrogenase variants in Chinese. IV. Gd (-) Gaohe associated with paroxysmal nocturnal hemoglobinuria. Chinese J. Pathophysiol. 1:12-15, 1985.

Du, C. S.; Xu, Y. K.; Hua, X. Y.; Wu, Q. L.; Liu, L. B.: Glucose-6-phosphate dehydrogenase variants and their frequency in Guangdong, China. Hum. Genet. 80:385-388, 1988.

Eber, S. W.; Gahr, M.; Schroter, W.: Glucose-6-phosphate dehydrogenase (G6PD) Iserlohn and G6PD Regensburg: two new severe enzyme defects in German families. Blut 51:109-115, 1985.

Echard, G.; Gillois, M.: G6PD--alpha-GAL-PGK--HPRT synteny in the rabbit, Oryctolagus cunniculus. (Abstract) Cytogenet. Cell Genet. 25:148-149, 1979.

Elizondo, J.; Saenz, G. F.; Paez, C. A.; Ramon, M.; Garcia, M.; Gutierrez, A.; Estrada, M.: G6PD Puerto Limon: a new deficient variant of glucose-6-phosphate dehydrogenase associated with congenital nonspherocytic hemolytic anemia. Hum. Genet. 62:110-112, 1982.

Engstrom, P. F.; Beutler, E.: G-6-PD Tripler: a unique variant associated with chronic hemolytic disease. Blood 36:10-13, 1970.

Epstein, C. J.: Mammalian oocytes: X-chromosome activity. Science 163:1078-1079, 1969.

Ermakov, N. V.; Chernyak, N. B.; Tokarev, Y. N.: Properties of new variant of glucose-6-phosphate dehydrogenase (Regar variant): glucose metabolism in erythrocytes containing abnormal enzyme. Biokhimiia 48:577-583, 1983.

Estrada, M.; Garcia, M.; Gutierrez, A.; Quintero, I.; Gonzalez, R.: G6PD Varadero. Vox Sang. 43:102-104, 1982.

Fairbanks, V. F.; Nepo, A. G.; Beutler, E.; Dickson, E. R.; Honig, G.: Glucose-6-phosphate dehydrogenase variants: reexamination of G6PD Chicago and Cornell and a new variant (G6PD Pea Ridge) resembling G6PD Chicago. Blood 55:216-220, 1980.

Faust, C. J.; Levinson, B.; Gitschier, J.; Herman, G. E.: Extension of the physical map in the region of the mouse X chromosome homologous to human Xq28 and identification of an exception to conserved linkage. Genomics 13:1289-1295, 1992.

Feldman, R.; Gromisch, D. S.; Luhby, A. L.; Beutler, E.: Congenital nonspherocytic hemolytic anemia due to glucose-6-phosphate dehydrogenase East Harlem: a new deficient variant. J. Pediat. 90:89-91, 1977.

Fernandez, M.; Fairbanks, V. F.: Glucose-6-phosphate dehydrogenase deficiency in the Philippines: report of a new variant--G6PD Panay. Mayo Clin. Proc. 43:645-660, 1968.

Ferraris, A. M.; Broccia, G.; Meloni, T.; Forteleoni, G.; Gaetani, G. F.: Glucose-6-phosphate dehydrogenase deficiency and incidence of hematologic malignancy. Am. J. Hum. Genet. 42:516-520, 1988.100. Filosa, E.: Personal Communication. La Jolla, Calif. 1989.101. Filosa, S.; Calabro, V.; Vallone, D.; Poggi, V.; Mason, P.; Pagnini, D.; Alfinito, F.; Rotoli, B.; Martini, G.; Luzzatto, L.; Battistuzzi, G.: Molecular basis of chronic non-spherocytic haemolytic anaemia: a new G6PD variant (393arg-to-his) with abnormal K(m) G6P and marked in vivo instability. Brit. J. Haemat. 80:111-116, 1992.102. Filosa, S.; Giacometti, N.; Wangwei, C.; De Mattia, D.; Pagnini, D.; Alfinito, F.; Schettini, F.; Luzzatto, L.; Martini, G.: Somatic-cell selection is a major determinant of the blood-cell phenotype in heterozygotes for glucose-6-phosphate dehydrogenase mutations causing severe enzyme deficiency. Am. J. Hum. Genet. 59:887-895, 1996.103. Fiorelli, G.; Manoussakis, C.; Sampietro, M.; Pittalis, S.; Guglielmino, C. R.; Cappellini, M. D.: Different polymorphic variants of glucose-6-phosphate dehydrogenase (G6PD) in Italy. Ann. Hum. Genet. 53:229-236, 1989.104. Fite, E.; Morell, F.; Zuazu, J.; Julia, A.; Morera, J.: Leucocyteglucose-6-phosphate dehydrogenase deficiency and necrotizing pneumonia. Europ. J. Resp. Dis. 64:150-154, 1983.105. Francke, U.; Bakay, B.; Connor, J. D.; Coldwell, J. G.; Nyhan, W. L.: Linkage relationships of X-linked enzymes glucose-6-phosphate dehydrogenase and hypoxanthine guanine phosphoribosyl transferase. Am. J. Hum. Genet. 26:512-522, 1974.106. Friedman, M. J.; Trager, W.: The biochemistry of resistance to malaria. Sci. Am. 244(3):154-164, 1981.107. Frigerio, R.; Sole, G.; Olla, N.; Lovicu, M.; Passiu, G.; Carcassi, U.: Cagliari II: a new G-6-PD variant. Haematologica 72:241-243,1987.108. Fujii, H.; Miwa, S.; Takegawa, S.; Takahashi, K.; Hirono, A.; Takizawa, T.; Morisaki, T.; Kanno, H.; Taguchi, T.; Okamura, J.:Gd (-) Gifu and Gd (-) Fukuoka: two new variants of glucose-6-phosphate dehydrogenase found in Japan. Hum. Genet. 66:276-278, 1984.109. Fujii, H.; Miwa, S.; Tani, K.; Takegawa, S.; Fujinami, N.; Takahashi, K.; Nakayama, S.; Konno, M.; Sato, T.: Glucose 6-phosphate dehydrogenase variants: a unique variant (G6PD Kobe) showed an extremely increased affinity for galactose 6-phosphate and a new variant (G6PD Sapporo) resembling G6PD Pea Ridge. Hum. Genet. 58:405-407, 1981.110. Gaetani, G. F.; Galiano, S.; Melani, C.; Miglino, M.; Forni, G. L.; Napoli, G.; Perrone, L.; Ferraris, A. M.: A new glucose-6-phosphate dehydrogenase variant with congenital nonspherocytic hemolytic anemia (G6PD Genova): biochemical characterization and mosaicism expression in the heterozygote. Hum. Genet. 84:337-340, 1990.111. Gahr, M.; Bornhalm, D.; Schroeter, W.: Biochemische Eigenschafteneiner neuen Variante des Glucose-6-phospha dehydrogenase (G6PD) Mangelsmit Favismus: G6PD Bielefeld. Klin. Wschr. 55:379-384, 1977.112. Gahr, M.; Bornhalm, D.; Schroeter, W.: Haemolytic anemia dueto glucose 6-phosphate dehydrogenase (G6PD) deficiency: demonstration of two new biochemical variants, G6PD Hamm and G6PD Tarsus. Brit. J. Haemat. 33:363-370, 1976.113. Gahr, M.; Schroeter, W.: Glucose 6-phosphate dehydrogenase (G6PD) Hamburg, a new variant with chronic nonspherocytic hemolytic anemia. Europ. J. Clin. Invest. 4:187-191, 1974.114. Gahr, M.; Schroeter, W.; Sturzenegger, M.; Bornhalm, D.; Marti, H. R.: Glucose 6-phosphate dehydrogenase (G6PD) deficiency in Switzerland. Helv. Paediat. Acta 31:159-166, 1976.115. Geerdink, R. A.; Horst, R.; Staal, G. E.: An Iraqi Jewish family with a new red cell glucose 6-phosphate dehydrogenase variant (Gd-Bagdad) and kernicterus. Israel J. Med. Sci. 9:1040-1043, 1973.116. Gellin, J.; Benne, F.; Renard, C.; Vaiman, M.; Hors-Cayla, M. C.; Gillois, M.: Pig gene mapping: synteny, attempt to assign the histocompatibility complex (SLA). (Abstract) Cytogenet. Cell Genet. 25:159, 1979.117. Gomez-Gallego, F.; Garrido-Pertierra, A.; Bautista, J. M.: Structural defects underlying protein dysfunction in human glucose-6-phosphate dehydrogenase A- deficiency. J. Biol. Chem. 275:9256-9262, 2000.118. Gonzalez, R.; Estrada, M.; Garcia, M.; Gutierrez, A.: G6PD Ciudadde la Habana: a new slow variant with deficiency found in a Cuban family. Hum. Genet. 55:133-135, 1980.119. Gonzalez, R.; Wade, M.; Estrada, M.; Svarch, E.; Colombo, B.: G6PD Pinar del Rio: a new variant discovered in a Cuban family. Biochem. Genet. 15:909-913, 1977.120. Goss, S. J.; Harris, H.: Gene transfer by means of cell fusion. I. Statistical mapping of the human X-chromosome by analysis of radiation induced gene segregation. J. Cell Sci. 25:17-37, 1977.121. Gourdin, D.; Vergnes, H.; Bouloux, C.; Ruffie, J.; Gherardi, M.: Polymorphism of erythrocyte G6PD in the baboon. Am. J. Phys. Anthrop. 37:281-288, 1972.122. Gray, G. R.; Stamatoyannopoulos, G.; Naiman, S. C.; Kliman, M. R.; Klebanoff, S. J.; Austin, T.; Yoshida, A.; Robinson, G. C. G.: Neutrophil dysfunction, chronic granulomatous disease, and non-spherocytic haemolytic anaemia caused by complete deficiency of glucose-6-phosphate dehydrogenase. Lancet II:530-534, 1973. 123. Grossman, A.; Ramanathan, K.; Justice, P.; Gordon, J.; Shahidi, N. T.; Hsia, D. Y. Y.: Congenital nonspherocytic hemolytic anemia associated with erythrocyte G-6-PD deficiency in a Negro family. Pediatrics 37:624-629, 1966. 124. Gutierrez, A.; Garcia, M.; Estrada, M.; Quintero, I.; Gonzalez, R.: Glucose-6-phosphate dehydrogenase (G6PD) Guantanamo and G6PD Caujeri: two new glucose-6-phosphate dehydrogenase-deficient variants found in Cuba. Biochem. Genet. 25:231-238, 1987. 125. Hall, K.; Schreeder, M. T.; Prchal, J. T.: G6PD Huntsville: a new glucose-6-phosphate dehydrogenase associated with chronic hemolytic anemia. Hum. Genet. 79:90-91, 1988. 126. Harkonen, M.; Vuopio, P.: Red cell glucose-6-phosphate dehydrogenase deficiency in Finland. Ann. Clin. Res. 6:187-197, 1974. 127. Harley, J. D.; Agar, N. S.; Yoshida, A.: Glucose 6-phosphate dehydrogenase variant Gd (+) Alexandra associated with neonatal jaundice and Gd (-) Camperdown in a young man with lamellar cataracts. J. Lab. Clin. Med. 91:295-300, 1978. 128. Helge, H.; Borner, K.: Kongenitale nichtsphaerozytare haemolytische Anaemie, Katarakt und Glucose-6-phosphat-dehydrogenase-mangel. Dtsch. Med. Wschr. 91:1584-1589, 1966. 129. Hirono, A.; Beutler, E.: Alternative splicing of human glucose-6-phosphate dehydrogenase messenger RNA in different tissues. J. Clin. Invest. 83:343-346, 1989. 130. Hirono, A.; Beutler, E.: Molecular cloning and nucleotide sequence of cDNA for human glucose-6-phosphate dehydrogenase variant A(-). Proc. Nat. Acad. Sci. 85:3951-3954, 1988. 131. Hirono, A.; Fujii, H.; Shima, M.; Miwa, S.: G6PD Nara: a new class 1 glucose-6-phosphate dehydrogenase variant with an eight amino acid deletion. Blood 82:3250-3252, 1998. 132. Hirono, A.; Kawate, K.; Honda, A.; Fujii, H.; Miwa, S.: A single mutation 202G-A in the human glucose-6-phosphate dehydrogenase gene (G6PD) can cause acute hemolysis by itself. (Letter) Blood 99:1498only, 2002. 133. Hirono, A.; Kuhl, W.; Gelbart, T.; Forman, L.; Fairbanks, V. F.; Beutler, E.: Identification of the binding domain for NADP(+) of human glucose-6-phosphate dehydrogenase by sequence analysis of mutants. Proc. Nat. Acad. Sci. 86:10015-10017, 1989. 134. Hitzeroth, H. W.; Bender, K.: Age-dependency of somatic selection in South African Negro G-6-PD heterozygotes. Hum. Genet. 58:338-343, 1981. 135. Honig, G. R.; Habacon, E.; Vida, L. N.; Matsumoto, F.; Beutler, E.: Three new variants of glucose-6-phosphate dehydrogenase associated with chronic nonspherocytic hemolytic anemia: G6PD Lincoln Park, G6PD Arlington Heights, and G6PD West Town. Am. J. Hemat. 6:353-360,1979. 136. Hook, E. B.; Stamatoyannopoulos, G.; Yoshida, A.; Motulsky, A. G.: Glucose-6-phosphate dehydrogenase Madrona: a slow electrophoretic glucose-6-phosphate dehydrogenase variant with kinetic characteristics similar to those of normal type. J. Lab. Clin. Med. 72:404-409,1968. 137. Hors-Cayla, M. C.; Heuertz, S.; Van Cong, N.; Benne, F.: Cattle gene mapping by somatic cell hybridization. (Abstract) Cytogenet. Cell Genet. 25:165-166, 1979. 138. Howell, E. B.; Nelson, A. J.; Jones, O. W.: A new G-6-PD variant associated with chronic non-spherocytic haemolytic anaemia in a Negro family. J. Med. Genet. 9:160-164, 1972. 139. Hutz, M. H.; Yoshida, A.; Salzano, F. M.: Three rare G-6-PD variants from Porto Alegre, Brazil. Hum. Genet. 39:191-197, 1977. 140. Ishwad, C. S.; Naik, S. N.: A new glucose-6-phosphate dehydrogenase variant (G-6-PD Kalyan) found in a Koli family. Hum. Genet. 66:171-175, 1984. 141. Johnson, G. J.; Kaplan, M. E.; Beutler, E.: G6PD Long Prairie: a new mutant exhibiting normal sensitivity to inhibition by NADPH and accompanied by nonspherocytic hemolytic anemia. Blood 49:247-251,1977. 142. Johnston, P. G.; VandeBerg, J. L.; Sharman, G. B.: Inheritance of erythrocyte glucose 6-phosphate dehydrogenase in the red-necked wallaby, Macropus rufogriseus (Desmarest) consistent with paternal X inactivation. Biochem. Genet. 13:235-242, 1975. 143. Junien, C.; Kaplan, J.-C.; Meienhofer, M. C.; Maigret, P.; Sender, A.: G6PD Baudelocque: a new unstable variant characterized in cultured fibroblasts. Enzyme 18:48-59, 1974. 144. Kaeda, J. S.; Chhotray, G. P.; Ranjit, M. R.; Bautista, J. M.; Reddy, P. H.; Stevens, D.; Naidu, J. M.; Britt, R. P.; Vulliamy, T. J.; Luzzatto, L.; Mason, P. J.: A new glucose-6-phosphate dehydrogenase variant, G6PD Orissa (44 ala-gly), is the major polymorphic variant in tribal populations in India. Am. J. Hum. Genet. 57:1335-1341,1995. 145. Kageoka, T.; Satoh, C.; Goriki, K.; Fujita, M.; Neriishi, S.; Yamamura, K.; Kaneko, J.; Masunari, N.: Electrophoretic variants of blood proteins in Japanese. IV. Prevalence and enzymologic characteristics of G6PD variants in Hiroshima and Nagasaki. Hum. Genet. 70:101-108,1985. 146. Kahn, A.; Bernard, J.-F.; Cottreau, D.; Mazie, J.; Boivin, P.: Gd (-) Abrami, a deficient G6PD variant with hemizygous expression in blood cells of a woman with primary myelofibrosis. human genetik 30:41-46, 1975. 147. Kahn, A.; Boivin, P.; Hakim, J.; Lagneau, J.: Heterogeneitedes glucose-6-phosphate dehydrogenase erythrocytaire deficitaires dans la race noire: etude cinetique et description de deux nouvelles variants Gd (-) Dakar et Gd (-) Mali. Nouv. Rev. Franc. Hemat. 11:741-758, 1971. 148. Kahn, A.; Boivin, P.; Lagneau, J.: Phenotypes de la glucose-6-phosphate dehydrogenase erythrocytaire dans la race noire. human genetik 18:261-270, 1973. 149. Kahn, A.; Boulard, M.; Hakim, J.; Schaison, G.; Boivin, P.; Bernard, J.: Anemie hemolytique congenitale non spherocytaire par deficiten glucose 6-phosphate dehydrogenase erythrocytaire: description dedeux nouvelles variants: Gd (-) Saint Louis (Paris) et Gd (-) Hayem. Nouv. Rev. Franc. Hemat. 14:587-600, 1974. 150. Kahn, A.; Dao, C.; Cottreau, D.; Bilski-Pasquier, G.: 'Gd (-)Hotel Dieu': a new G-6PD variant with chronic hemolysis in a Negro patient from Senegal. Hum. Genet. 39:353-358, 1977. 151. Kahn, A.; Exters, A.; Habedank, M.: Gd (-) Aachen, a new variant of deficient glucose-6-phosphate dehydrogenase. human genetik 32:171-180, 1976. 152. Kahn, A.; Hakim, J.; Cottreau, D.; Boivin, P.: Gd (-) Matam. An African glucose 6-phosphate dehydrogenase variant with enzyme deficiency. Biochemical and immunological properties in various hemopoietic tissues. Clin. Chim. Acta 59:183-190, 1975. 153. Kahn, A.; North, M. L.; Cottreau, D.; Giron, G.; Lang, J. M.: G6PD Vientiane: a new glucose-6-phosphate dehydrogenase variant with increased stability. Hum. Genet. 43:85-89, 1978. 154. Kahn, A.; North, M. L.; Messer, J.; Boivin, P.: G-6PD 'Ankara': a new G-6PD variant with deficiency found in a Turkish family. human genetik 27:247-250, 1975. 155. Kanno, H.; Huang, I.-Y.; Kan, Y. W.; Yoshida, A.: Two structural genes on different chromosomes are required for encoding the major subunit of human red cell glucose-6-phosphate dehydrogenase. Cell 58:595-606, 1989. 156. Kanno, H.; Takano, T.; Fujii, H.; Tani, K.; Morisaki, T.; Hirono, A.; Kumakawa, T.; Ogura, H.; Takahashi, K.; Tsutsumi, H.; Miwa, S.: A new glucose-6-phosphate variant (G6PD Iwate) associated with congenital nonspherocytic hemolytic anemia. Acta Haemat. Jpn. 51:715-719,1987. 157. Kaplan, J. C.; Hanzlickova-Leroux, A.; Nicholas, A. M.; Rosa, R.; Weiler, C.; Lepercq, G.: A new glucose-6-phosphate dehydrogenase variant (G6PD Port-Royal). Enzyme 12:25-32, 1971. 158. Kaplan, J. C.; Rosa, R.; Seringe, P.; Hoeffel, J. C.: Le polymorphisme genetique de la glucose-6-phosphate deshydrogenase erythrocytairechez l'homme. II. Etude d'une nouvelle variete a activite diminuee:le type 'Kabyle.'. Enzym. Biol. Clin. 8:332-340, 1967. 159. Kaplan, M.; Hammerman, C.; Vreman, H. J.; Stevenson, D. K.; Beutler, E.: Acute hemolysis and severe neonatal hyperbilirubinemia in glucose-6-phosphate dehydrogenase deficient heterozygotes. J. Pediat. 139:137-140, 2001. 160. Kaplan, M.; Renbaum, P.; Levy-Lahad, E.; Hammerman, C.; Lahad, A. Beutler, E.: Gilbert syndrome and glucose-6-phosphate dehydrogenase deficiency: a dose-dependent genetic interaction crucial to neonatal hyperbilirubinemia. Proc. Nat. Acad. Sci. 94:12128-12132, 1997. 161. Kappas, A.; Drummond, G. S.; Valaes, T.: A single dose of Sn-mesoporphyrin prevents development of severe hyperbilirubinemia in glucose-6-phosphate dehydrogenase-deficient newborns. Pediatrics 108:25-30, 2001. 162. Karadsheh, N. S.; Awidi, A. S.; Tarawneh, M. S.: Two new glucose-6phosphate dehydrogenase (G6PD) variants associated with hemolytic anemia: G6PD Amman-1 and G6PD Amman-2. Am. J. Hemat. 22:185-192,1986. 163. Kay, A. C.; Kuhl, W.; Prchal, J.; Beutler, E.: The origin of glucose-6-phosphate-dehydrogenase (G6PD) polymorphisms in African-Americans. Am. J. Hum. Genet. 50:394-398, 1992. 164. Kirkman, H. N.; Kidson, C.; Kennedy, M.: Variants of human glucose-6-phosphate dehydrogenase. Studies of samples from New Guinea. In: Beutler, E.: Hereditary Disorders of Erythrocyte Metabolism. New York: Grune and Stratton (pub.) 1968. Pp. 126-145. 165. Kirkman, H. N.; Lie-Injo, L. E.: Variants of glucose 6-phosphate dehydrogenase in Indonesia. Nature 221:959, 1969. 166. Kirkman, H. N.; McCurdy, P. R.; Naiman, J. L.: Functionally abnormal glucose-6-phosphate dehydrogenases. Cold Spring Harbor Symp. Quant. Biol. 29:391-398, 1964. 167. Kirkman, H. N.; Ramot, B.; Lee, J. T.: Altered aggregational properties in a genetic variant of human glucose-6-phosphate dehydrogenase. Biochem. Genet. 3:137-150, 1969. 168. Kirkman, H. N.; Riley, H. D., Jr.: Congenital nonspherocytic hemolytic anemia. Am. J. Dis. Child. 102: 313-320, 1961. 169. Kirkman, H. N.; Rosenthal, I. M.; Simon, E. B.; Carson, P. E.; Brinson, A. G.: 'Chicago I' variant of glucose-6-phosphate dehydrogenase in congenital hemolytic disease. J. Lab. Clin. Med. 63:715-725,1964. 170. Kirkman, H. N.; Schettini, F.; Pickard, B. M.: Mediterranean variant of glucose-6-phosphate dehydrogenase. J. Lab. Clin. Med. 63:726-735, 1964. 171. Kirkman, H. N.; Simon, E. R.; Pickard, B. M.: Seattle variant of glucose-6-phosphate dehydrogenase. J. Lab. Clin. Med. 66:834-840,1965. 172. Kissin, C.; Cotte, J.: Etude d'un variant de glucose-6-phosphate deshydrogenase: I B type Constantine. Enzyme 11:277-284, 1970. 173. Kitao, T.; Ito, K.; Hattori, K.; Matsuki, T.; Yoneyama, Y.:G6PD Kanazawa: a new variant of glucose-6-phosphate dehydrogenase associated with congenital nonspherocytic hemolytic anemia. Acta Haemat. 68:131-135, 1982. 174. Kojima, H.: Congenital nonspherocytic hemolytic disease (CNHD) due to a G-6-PD variant: G-6-PD Kyoto. Acta Haemat. Jpn. 35:32-38,1972. 175. Koliakos, G.; Kalomenopoulou, M.; Grammatikos, P.; Dimitriadou, A.; Kouzi-Koliakos, K.; Zacharaki, R.; Skaragas, G.; Kokka, A.; Trakatellis, A.: A new glucose 6-phosphate dehydrogenase variant (G6PD Thessaloniki) in a patient with idiopathic myelofibrosis. Hum. Hered. 39:141-149,1989. 176. Krasnopolskaya, K. D.; Bochkov, N. P.: Genetic heterogeneity of hereditary enzymopathies. Vestn. Akad. Med. Nauk. SSSR 9:56-64, 1982. 177. Krasnopolskaya, K. D.; Shatskaya, T. L.; Filippov, I. K.; Annenkov, G. A.; Zakharova, T. V.; Mekhtiev, N. K.; Movsum-Zade, K. M.: Genetic heterogeneity of G6PD deficiency: study of mutant alleles in Shekii district of Azerbaijan. Genetika 13:1455-1461, 1977. 178. Kumakawa, T.; Suzuki, S.; Fujii, H.; Miwa, S.: Frequency of glucose 6-phosphate dehydrogenase (G6PD) deficiency in Tokyo and a new variant: G6PD Musashino. Acta Haemat. Jpn. 50:25-28, 1987. 179. Kurdi-Haidar, B.; Mason, P. J.; Berrebi, A.; Ankra-Badu, G.; Al-Ali, A.; Oppenheim, A.; Luzzatto, L.: Origin and spread of the glucose-6-phosphate dehydrogenase variant (G6PD-Mediterranean) in the Middle East. Am. J. Hum. Genet. 47:1013-1019, 1990. 180. Kwiatkowska, J.; Kacprzak-Bergman, I.: New erythrocyte glucose6-phosphate dehydrogenase variant. Acta Haemat. 46:188-192, 1971. 181. Kwok, C. J.; Martin, A. C. R.; Au, S. W. N.; Lam, V. M. S.:G6PDdb, an integrated database of glucose-6-phosphate dehydrogenase (G6PD) mutations. Hum. Mutat. 19:217-224, 2002. 182. Lee, K. T.; Thomas, W. A.; Janakidevi, K.; Kroms, M.; Reiner, J. M.; Borg, K. Y.: Mosaicism in female hybrid hares heterozygous for glucose-6-phosphate dehydrogenase (G-6-PD). I. General properties of a hybrid hare model with special reference to atherogenesis. Exp. Molec. Path. 34:191-201, 1981. 183. Lenzerini, L.; Meera Khan, P.; Filippi, G.; Rattazzi, M. C.; Rat, A. K.: Characterization of glucose-6-phosphate dehydrogenase variants. I. Occurrence of a G6PD Seattle-like variant in Sardinia and its interaction with G6PD Mediterranean variant. Am. J. Hum. Genet. 21:142-153, 1969. 184. Lisker, R.; Linares, C.; Motulsky, A. G.: Glucose-6-phosphate dehydrogenase Mexico, a new variant with enzyme deficiency, abnormal mobility and absence of hemolysis. J. Lab. Clin. Med. 29:788-793,1972. 185. Lisker, R.; Perez-Briceno, R.; Beutler, E.: A new glucose-6-phosphate dehydrogenase variant, Gd (-) Tepic, characterized by moderate enzyme deficiency and mild episodes of hemolytic anemia. Hum. Genet. 69:19-21, 1985. 186. Lisker, R.; Perez-Briceno, R.; Rave, V.; Yoshida, A.: Glucosa-6-fosfato deshidrogenasa Gd (-) Distrito Federal: nueva variante asociada a deficiencia enzimatica moderada y anemia hemolitica ocasional. Rev. Invest. Clin. 33:209-211, 1981. 187. Lisker, R.; Perez Briceno, R.; Agrilar, L.; Yoshida, A.: A variant glucose-6-phosphate dehydrogenase Gd (-) Chiapas associated with moderate enzyme deficiency and occasional hemolytic anemia. Hum. Genet. 43:81-84, 1978. 188. Lisker, R.; Perez Briceno, R.; Zavala, C.; Navarrette, J. I.; Wessels, M.; Yoshida, A.: A glucose 6-phosphate dehydrogenase Gd (-)Castilla variant characterized by mild deficiency associated with drug-induced hemolytic anemia. J. Lab. Clin. Med. 90:754-759, 1977. 189. Liu, Y.; Phelan, J.; Go, R. C. P.; Prchal, J. F.; Prchal, J. T.: Rapid determination of clonality by detection of two closely-linked X chromosome exonic polymorphisms using allele-specific PCR. J. Clin. Invest. 99:1984-1990, 1997. 190. Long, W. K.; Kirkman, H. N.; Sutton, H. H.: Electrophoretically slow variants of glucose-6-phosphate dehydrogenase from red cells of Negroes. J. Lab. Clin. Med. 65:81-87, 1965. 191. Longo, L.; Vanegas, O. C.; Patel, M.; Rosti, V.; Li, H.; Waka, J.; Merghoub, T.; Pandolfi, P. P.; Notaro, R.; Manova, K.; Luzzatto, L.: Maternally transmitted severe glucose 6-phosphate dehydrogenase deficiency is an embryonic lethal. EMBO J. 21:4229-4239, 2002. 192. Luzzatto, L.: Genetic heterogeneity and pathophysiology of G6PD deficiency. Brit. J. Haemat. 28:151-156, 1974. 193. Luzzatto, L.: Personal Communication. London, England Apr. 1990. 194. Luzzatto, L.; Afolayam, A.: Enzyme properties of different types of human erythrocyte glucose-6-phosphate dehydrogenase with characterization of two new genetic variants. J. Clin. Invest. 47:1833-1842, 1968. 195. Luzzatto, L.; Martini, G.: X-Linked Wiskott-Aldrich syndrome in a girl. (Letter) New Eng. J. Med. 338:1850-1851, 1998. 196. Luzzatto, L.; Usanga, E. A.; Bienzle, U.; Esan, G. F. J.; Fusuan, F. A.: Imbalance in X-chromosome expression: evidence for a human X-linked gene affecting growth of hemopoietic cells. Science 205:1418-1420, 1979. 197. Luzzatto, L.; Usanga, E. A.; Reddy, S.: Glucose-6-phosphate dehydrogenase deficient red cells: resistance to infection by malarial parasites. Science 164:839-842, 1969. 198. MacDonald, D.; Town, M.; Mason, P.; Vulliamy, T.; Luzzatto, L.; Goff, D. K.: Deficiency in red blood cells. (Letter) Nature 350:115, 1991. 199. Maeda, M.; Constantoulakis, P.; Chen, C.-S.; Stamatoyannopoulos, G.; Yoshida, A.: Molecular abnormalities of a human glucose-6-phosphate dehydrogenase variant associated with undetectable enzyme activity and immunologically cross-reacting material. Am. J. Hum. Genet. 51:386-395, 1992. 200. Mallouh, A. A.; Abu-Osba, Y. K.: Bacterial infections in children with glucose-6-phosphate dehydrogenase deficiency. J. Pediat. 111:850-852, 1987. 201. Mamlok, R. J.; Mamlok, V.; Mills, G. C.; Daeschner, C. W., III; Schmalstieg, F. C.; Anderson, D. C.: Glucose-6-phosphate dehydrogenase deficiency, neutrophil dysfunction and Chromobacterium violaceum sepsis. J. Pediat. 111:852-854, 1987. 202. Mamlok, R. J.; Mills, G. C.; Goldblum, R. M.; Daeschner, C. W.: Glucose-6-phosphate dehydrogenase Beaumont: a new variant with severe enzyme deficiency and chronic nonspherocytic hemolytic anemia. Enzyme 34:15-21, 1985. 203. Mandelli, F.; Amadori, S.; DeLaurenzi, A.; Kahn, A.; Isacchi, G.; Papa, G.: Glucose-6-phosphate dehydrogenase Velletri: a new variant with reduced activity in a patient with congenital non-spherocytic haemolytic anemia. Acta Haemat. 57:121-126, 1977. 204. Marks, P. A.; Banks, J.; Gross, R.: Genetic heterogeneity of glucose-6-phosphate dehydrogenase deficiency. Nature 194:454-456, 1962. 205. Martin, S. K.; Miller, L. H.; Alling, D.; Okoye, V. C.; Esan, G. J. F.; Osunkoya, B. O.; Deane, M.: Severe malaria and glucose-6-phosphate-dehydrogenase deficiency: a reappraisal of the malaria-G6PD hypothesis. Lancet I:524-526, 1979. 206. Martini, G.; Toniolo, D.; Vulliamy, T.; Luzzatto, L.; Dono, R.; Viglietto, G.; Paonessa, G.; d'urso, M.; Persico, M. G.: Structural analysis of the X-linked gene encoding human glucose 6-phosphate dehydrogenase. EMBO J. 5:1849-1855, 1986. 207. Mason, P. J.: New insights into G6PD deficiency. (Annotation) Brit. J. Haemat. 94:585-591, 1996. 208. Mason, P. J.; Stevens, D. J.; Luzzatto, L.; Brenner, S.; Aparicio, S.: Genomic structure and sequence of the Fugu rubripes glucose-6-phosphate dehydrogenase gene (G6PD). Genomics 26:587-591, 1995. 209. McCann, S. R.; Smithwick, A. M.; Temperley, I. J.; Tipton, K.: G6PD (Dublin): chronic nonspherocytic haemolytic anaemia resulting from glucose-6-phosphate dehydrogenase deficiency in an Irish kindred. J. Med. Genet. 17:191-193, 1980. 210. McCurdy, P. R.: Use of genetic linkage for the detection of female carriers of hemophilia. New Eng. J. Med. 285:218-219, 1971. 211. McCurdy, P. R.; Blackwell, R. Q.; Todd, D.; Tso, S. C.; Tuchinda, S.: Further studies on glucose-6-phosphate dehydrogenase deficiency in Chinese subjects. J. Lab. Clin. Med. 75:788-797, 1970. 212. McCurdy, P. R.; Kamel, K.; Selim, O.: Heterogeneity of red cell glucose 6-phosphate dehydrogenase (G6PD) deficiency in Egypt. J. Lab. Clin. Med. 84:673-680, 1974. 213. McCurdy, P. R.; Kirkman, H. N.; Naiman, J. L.; Jim, R. T. S.; Pickard, B. M.: A Chinese variant of glucose-6-phosphate dehydrogenase. J. Lab. Clin. Med. 67:374-385, 1966. 214. McCurdy, P. R.; Mahmood, L.: Red cell glucose-6-phosphate dehydrogenase deficiency in Pakistan. J. Lab. Clin. Med. 76:943-948, 1970. 215. McCurdy, P. R.; Maldonado, N. I.; Dillon, D. E.: Variants of glucose-6-phosphate dehydrogenase (G-6-PD) associated with G-6-PD deficiency in Puerto Ricans. J. Lab. Clin. Med. 82:432-437, 1973. 216. McCurdy, P. R.; Maldonado, N. I.; Dillon, D. E.; Conrad, M. E.: Variants of glucose-6-phosphate dehydrogenase (G-6-PD) associated with G-6-PD deficiency in Puerto Ricans. J. Lab. Clin. Med. 82:432-437, 1973. 217. Meloni, T.; Carta, F.; Forteleoni, G.; Carta, A.; Ena, F.; Meloni, G. F.: Glucose 6-phosphate dehydrogenase deficiency and cataract of patients in northern Sardinia. Am. J. Ophthal. 110:661-664, 1990. 218. Mentzer, W. C., Jr.; Warner, R.; Addiego, J.; Smith, B.; Walter, T.: G6PD San Francisco: a new variant of glucose-6-phosphate dehydrogenase associated with congenital nonspherocytic hemolytic anemia. Blood 55:195-198, 1980. 219. Mesbah-Namin, S. A.; Sanati, M. H.; Mowjoodi, A.; Mason, P. J.; Vulliamy, T. J.; Noori-Daloii, M. R.: Three major glucose-6-phosphate dehydrogenase-deficient polymorphic variants identified in Mazandaran state of Iran. Brit. J. Haemat. 117:763-764, 2002. 220. Miller, D. R.; Wollman, M. R.: A new variant of glucose 6-phosphate dehydrogenase deficiency hereditary hemolytic anemia, G6PD Cornell: erythrocyte, leukocyte and platelet studies. Blood 44:277-284, 1974. 221. Mills, G. C.; Alperin, J. B.; Trimmer, K. B.: Studies on variant glucose-6-phosphate dehydrogenase: G6PD Fort Worth. Biochem. Med. 13:264-275, 1975. 222. Milner, G.; Delamore, I. W.; Yoshida, A.: G-6-PD Manchester: a new variant associated with chronic nonspherocytic hemolytic anemia. Blood 43:271-276, 1974. 223. Miwa, S.; Fujii, H.: Molecular basis of erythroenzymopathies associated with hereditary hemolytic anemia: tabulation of mutant enzymes. Am. J. Hemat. 51:122-132, 1996. 224. Miwa, S.; Fujii, H.; Nakashima, K.; Miura, Y.; Yamada, K.; Hagiwara, T.; Fukuda, M.: Three new electrophoretically normal glucose-6-phosphate dehydrogenase variants associated with congenital nonspherocytic hemolytic anemia found in Japan: G6PD Ogikubo, Yokohama, and Akita. Hum. Genet. 45:11-17, 1978. 225. Miwa, S.; Fujii, H.; Nakatsuji, T.; Ishida, Y.; Oda, E.; Kaneto, A.; Motokawa, M.; Ariga, Y.; Fukuchi, S.; Sasai, S.; Hiraoka, K.; Kashii, H.; Kodama, T.: Four new electrophoretically slow-moving glucose-6-phosphate dehydrogenase variants associated with congenital nonspherocytic hemolytic anemia found in Japan: Gd (-) Kurume, Gd (-)Fukushima, Gd (-)Yamaguchi, and Gd (-) Wakayama. Am. J. Hemat. 5:131-138, 1978. 226. Miwa, S.; Nakashima, K.; Ono, J.; Fujii, H.; Suzuki, E.: Three glucose 6-phosphate dehydrogenase variants found in Japan. Hum. Genet. 36:327-334, 1977. 227. Miwa, S.; Ono, J.; Nakashima, K.; Abe, S.; Kageoka, T.; Shinohara, K.; Isobe, J.; Yamaguchi, H.: Two new glucose 6-phosphate dehydrogenase variants associated with congenital nonspherocytic hemolytic anemia found in Japan: Gd (-) Tokushima and Gd (-) Tokyo. Am. J. Hemat. 1:433-442, 1976. 228. Modiano, G.; Battistuzzi, G.; Esan, G. J. F.; Testa, U.; Luzzatto, L.: Genetic heterogeneity of 'normal' human erythrocyte glucose-6-phosphate dehydrogenase: an isoelectrophoretic polymorphism. Proc. Nat. Acad. Sci. 76:852-856, 1979. 229. Mohrenweiser, H. W.; Neel, J. V.: Frequency of thermostability variants: estimation of total 'rare' variant frequency in human populations. Proc. Nat. Acad. Sci. 78:5729-5733, 1981. 230. Morelli, A.; Benatti, U.; Guida, L.; De Flora, A.: G6PD Cagliari: a new low activity glucose 6-phosphate dehydrogenase variant characterized by enhanced intracellular lability. Hum. Genet. 66:62-65, 1984. 231. Morisaki, T.; Fujii, H.; Takegawa, S.; Tani, K.; Hirono, A.; Takizawa, T.; Takahashi, K.; Shinogi, M.; Teshirogi, T.; Miwa, S.: G6PD Sendagi: a new glucose-6-phosphate dehydrogenase variant associated with congenital hemolytic anemia. Hum. Genet. 65:214-215, 1983. 232. Nafa, K.; Reghis, A.; Osmani, N.; Baghli, L.; Benabadji, M.; Kaplan, J.-C.; Vulliamy, T. J.; Luzzatto, L.: G6PD Aures: a new mutation (48 ile-to-thr) causing mild G6PD deficiency is associated with favism. Hum. Molec. Genet. 2:81-82, 1993. 233. Nagel, R. L.; Ranney, H. M.: Genetic epidemiology of structural mutations of the beta-globin gene. Semin. Hemat. 27:342-359, 1990. 234. Nakai, T.; Yoshida, A.: G6PD Heian. A glucose-6-phosphate dehydrogenase variant associated with hemolytic anemia found in Japan. Clin. Chim. Acta 51:199-203, 1974.235. Nakashima, K.; Ono, J.; Abe, S.; Miwa, S.; Yoshida, A.: G6PDUbe: a glucose 6-phosphate dehydrogenase variant found in four unrelated Japanese families. Am. J. Hum. Genet. 29:24-30, 1977.236. Nakatsuji, T.; Miwa, S.: Incidence and characteristics of glucose-6-phosphate dehydrogenase variants in Japan. Hum. Genet. 51:297-305, 1979.237. Nance, W. E.: Turner's syndrome, twinning, and an unusual variant of glucose-6-phosphate dehydrogenase. Am. J. Hum. Genet. 16:380-392,1964.238. Necheles, T. F.; Snyder, L. M.; Strauss, W.: Glucose-6-phosphate dehydrogenase Boston. A new variant associated with congenital nonspherocytic hemolytic disease. human genetik 13:218-221, 1971.239. Niazi, G.; Adeyokunu, A.; Westwood, B.; Beutler, E.: G6PD Aures:a rare mutant of G6PD in Saudi Arabia: molecular and clinical presentations. Saudi Med. J. 17:311-314, 1996.240. Ninfali, P.; Baronciani, L.; Bardoni, A.; Bresolin, N.: Muscle expression of glucose-6-phosphate dehydrogenase deficiency in different variants. Clin. Genet. 48:232-237, 1995.241. Notaro, R.; Afolayan, A.; Luzzatto, L.: Human mutations in glucose6-phosphate dehydrogenase reflect evolutionary history. FASEB J. 14:485-494, 2000.242. Nowicki, L.; Strobel, S.; Martin, H.; Koschwitz, U.: Ueber eineneue erythrocytaere glucose 6-phosphat dehydrogenase Variante, Typ Frankfurt. Klin. Wschr. 52:478-484, 1974.243. Nsouly, G. M.; Prchal, J. T.: Characterization of a new G6PD variant and its associated oxidative damage. Clin. Res. 29:829,1981.244. O'Brien, S. J.: The extent and character of biochemical genetic variation in the domestic cat. J. Hered. 71:2-8, 1980.245. Ogura, H.; Morisaki, T.; Tani, K.; Kanno, H.; Tsutsumi, H.; Takahashi, K.; Miyamori, T.; Fujii, H.; Miwa, S.: A new glucose-6-phosphate dehydrogenase variant (G6PD Tsukui) associated with congenital hemolytic anemia. Hum. Genet. 78:369-371, 1988.246. Ohno, S.: Sex Chromosomes and Sex-linked Genes. Berlin and New York: Springer (pub.) 1967.247. Orzalesi, N.; Sorcinelli, R.; Guiso, G.: Increased incidence of cataracts in male subjects deficient in glucose-6-phosphate dehydrogenase. Arch. Ophthal. 99:69-70, 1981.248. Othieno-Obel, A.: East African variant of glucose-6-phosphate dehydrogenase. East Afr. Med. J. 49:230-234, 1972.249. Pai, G. S.; Sprenkle, J. A.; Do, T. T.; Mareni, C. E.; Migeon, B. R.: Localization of loci for hypoxanthine phosphoribosyl transferase and glucose-6-phosphate dehydrogenase and biochemical evidence of nonrandom X chromosome expression from studies of a human X-autosome translocation. Proc. Nat. Acad. Sci. 77:2810-2813, 1980.250. Panich, V.: G6PD variants in Laotians. Hum. Hered. 24:285-290,1974.251. Panich, V.: G6PD Intanon, a new glucose 6-phosphate dehydrogenase variant. human genetik 21:203-205, 1974.252. Panich, V.: G6PD characterization in Thailand. Genetics 74(suppl.): s208 only, 1973.253. Panich, V.: Glucose-6-phosphate dehydrogenase in Thailand. Hum. Genet. 53:227-228, 1980.254. Panich, V.; Bumrungtrakul, P.; Jitjai, C.; Kamolmatayakul, S.; Khoprasert, B.; Klaisuvan, C.; Kongmuang, U.; Maneechai, P.; Pornpatkul, M.; Ruengrairatanaroje, P.; Surapruk, P.; Viriyayudhakorn, S.: Glucose-6-phosphate dehydrogenase deficiency in South Vietnamese. Hum. Hered. 30:361-364, 1980.255. Panich, V.; Na-Nakorn, S.: G6PD variants in Thailand. J. Med. Assoc. Thai. 63:537-543, 1980.256. Panich, V.; Sungnate, T.: Characterization of glucose 6-phosphate dehydrogenase in Thailand: the occurrence of 6 variants among 50 G6PD deficient Thai. human genetik 18:39-46, 1973.257. Panich, V.; Sungnate, T.; Na-Nakorn, S.: Acute intravascular hemolysis and renal failure in a new glucose 6-phosphate dehydrogenase variant: G6PD Siriraj. J. Med. Assoc. Thai. 55:726-731, 1972.258. Panich, V.; Sungnate, T.; Wasi, P.; Na-Nakorn, S.: G-6-PD Mahidol: the most common glucose-6-phosphate dehydrogenase variant in Thailand. J. Med. Assoc. Thai. 55:576-585, 1972.259. Pawlak, A. L.; Mazurkiewicz, C. A.; Ordynski, J.; Ruzynkowa, D.; Horst, A.: G6PD Poznan, variant with severe enzyme deficiency. human genetik 28:163-165, 1975.260. Pawlak, A. L.; Zagorski, Z.; Rozynkowa, D.; Horst, A.: Polish variant of glucose-6-phosphate dehydrogenase (G-6-PD Lublin). human genetik 10:340-343, 1970.261. Pekrun, A.; Eber, S. W.; Schroter, W.: G6PD Avenches and G6PD Moosburg: biochemical and erythrocyte membrane characterization. Blut 58:11-14, 1989.262. Perroni, L.; Tassara, P.; Baldi, M.; Reali, R.; Scartezzini, P.: G6PD variants detected in Genoa area. In: Weatherall, D. J.; Fiorelli, G.; Gorini, S.: Advances in Red Blood Cell Biology. New York: Raven Press (pub.) 1982. Pp. 409-416.263. Persico, M. G.; Toniolo, D.; Nobile, C.; d'urso, M.; Luzzatto, L.: cDNA sequences of human glucose 6-phosphate dehydrogenase cloned in pBR322. Nature 294:778-780, 1981.264. Persico, M. G.; Viglietto, G.; Martini, G.; Toniolo, D.; Paonessa, G.; Moscatelli, C.; Dono, R.; Vulliamy, T.; Luzzatto, L.; d'urso, M.: Isolation of human glucose-6-phosphate dehydrogenase (G6PD) cDNA clones: primary structure of the protein and unusual 5-prime non-coding region. Nucleic Acids Res. 14:2511-2522, 1986.265. Picat, C.; Etiemble, J.; Boivin, P.; Le Prise, P.-Y.: Gd (-)Rennes, a new deficient variant of glucose-6-phosphate dehydrogenase associated with congenital nonspherocytic hemolytic anemia found in France. Hum. Genet. 55:125-127, 1980.266. Pinto, P. V. C.; Newton, W. A., Jr.; Richardson, K. E.: Evidence for four types of erythrocyte glucose-6-phosphate dehydrogenase from G-6-PD deficient human subjects. J. Clin. Invest. 45:823-831, 1966.267. Poggi, V.: Personal Communication. London, England 1989.268. Poon, M.-C.; Hall, K.; Scott, C. W.; Prchal, J. T.: G6PD Viangchan: a new glucose 6-phosphate dehydrogenase variant from Laos. Hum. Genet. 78:98-99, 1988.269. Porter, I. H.; Boyer, S. H.; Watson-Williams, E. J.; Adam, A.; Szeinberg, A.; Siniscalco, M.: Variation of glucose-6-phosphate dehydrogenase in different populations. Lancet I:895-899, 1964.270. Porter, I. H.; Schulze, J.; McKusick, V. A.: Genetical linkage between the loci for glucose-6-phosphate dehydrogenase deficiency and colour-blindness in American Negroes. Ann. Hum. Genet. 26:107-122,1962.271. Prchal, J.; Moreno, H.; Conrad, M.; Vitek, A.: G-6-PD Dothan:a new variant associated with chronic hemolytic anemia. I. R. C. S. 7:348, 1979.272. Prchal, J. T.: Personal Communication. Birmingham, Ala. 1985.273. Prchal, J. T.; Crist, W. M.; Malluh, A.; Vitek, A.; Tauxe, W. N.; Carroll, A. J.: A new glucose-6-phosphate dehydrogenase deficient variant in a patient with Chediak-Higashi syndrome. Blood 56:476-480, 1980.274. Prchal, J. T.; Hall, K.; Csepreghy, M.; Lilly, M.; Berkow, R.; Scott, C. W.: Two apparent glucose-6-phosphate dehydrogenase variants in normal XY males: G6PD Alabama. Am. J. Med. 84:517-523, 1988.275. Pretsch, W.; Charles, D. J.; Merkle, S.: X-linked glucose-6-phosphate-dehydrogenase deficiency in Mus musculus. Biochem. Genet. 26:89-103, 1988.276. Puck, J. M.; Willard, H. F.: X inactivation in females with X-linked disease. New Eng. J. Med. 338:325-327, 1998.277. Ramot, B.; Ben-Bassat, I.; Shchory, M.: New glucose-6-phosphate dehydrogenase variants observed in Israel and their association with congenital nonspherocytic hemolytic disease. J. Lab. Clin. Med. 74:895-901, 1969.278. Ramot, B.; Brok, F.: A new glucose-6-phosphate dehydrogenase mutant (Tel-Hashomer mutant). Ann. Hum. Genet. 28:167-172, 1964.279. Rattazzi, M. C.; Corash, L. M.; Van Zzanen, G. E.; Jaffe, E. R.; Piomelli, S.: G6PD deficiency and chronic hemolysis: four new mutants--relationships between clinical syndrome and enzyme kinetics.

Blood 38:205-218, 1971.280. Rattazzi, M. C.; Lenzerini, L.; Meera Khan, P.; Luzzatto, L.: Characterization of glucose-6-phosphate dehydrogenase variants. II. G6PD Kephalonia, G6PD Attica, and G6PD 'Seattle-like' found in Greece. Am. J. Hum. Genet. 21:154-167, 1969.281. Ravindranath, Y.; Beutler, E.: Two new variants of glucose-6-phosphate dehydrogenase associated with hereditary non-spherocytic hemolytic anemia: G6PD Wayne and G6PD Huron. Am. J. Hemat. 24:357-363, 1987.282. Reys, L.; Manso, C.; Stamatoyannopoulos, G.: Genetic studies on Southeastern Bantu of Mozambique. I. Variants of glucose-6-phosphate dehydrogenase. Am. J. Hum. Genet. 22:203-215, 1970.283. Rinaldi, A.; Filippi, G.; Siniscalco, M.: Variability of red cell phenotypes between and within individuals in an unbiased sample of 77 heterozygotes for G6PD deficiency in Sardinia. Am. J. Hum. Genet. 28:496-505, 1976.284. Rosenstraus, M.; Chasin, L. A.: Isolation of mammalian cell mutants deficient in glucose-6-phosphate dehydrogenase activity: linkage to hypoxanthine phosphoribosyl transferase. Proc. Nat. Acad. Sci. 72:493-497, 1975.285. Roth, E. F., Jr.; Raventos-Suarez, C.; Rinaldi, A.; Nagel, R. L.: Glucose-6-phosphate dehydrogenase deficiency inhibits in vitro growth of Plasmodium falciparum. Proc. Nat. Acad. Sci. 80:298-299,1983.286. Roychoudhury, A. K.; Nei, M.: Human Polymorphic Genes: World Distribution. New York: Oxford Univ. Press (pub.) 1988.287. Ruwando, C.; Khea, S. C.; Snow, R. W.; Yates, S. N. R.; Kwiatkoweld, D.; Gupta, S.; Warn, P.; Alisopp, G. E. M.; Gilbert, S. C.; Peschu, N.; Newbold, C. I.; Greenwood, S. M.; Marsh, K.; Hill, A. V. S.: Natural selection of hemi- and heterozygotes for G6PD deficiency in Africa by resistance to severe malaria. Nature 376:246-249, 1995.288. Saenz, G. F.; Chaves, M.; Berrantes, A.; Elizondo, J.; Montero, A. G.; Yoshida, A.: A glucose-6-phosphate dehydrogenase variant, Gd (-) Santamaria found in Costa Rica. Acta Haemat. 72:37-40, 1984.289. Saidi, N.; Hors-Cayla, M. C.; Van Cong, N.; Benne, F.: Sheep gene mapping by somatic cell hybridization. (Abstract) Cytogenet. Cell Genet. 25:200, 1979.290. Samuel, A. P. W.; Saha, N.; Omer, A.; Hoffbrand, A. V.: Quantitative expression of G6PD activity of different phenotypes of G6PD and haemoglobin in a Sudanese population. Hum. Hered. 31:110-115, 1981.291. Sansone, G.; Perroni, L.; Testa, U.; Mareni, C.; Luzzatto, L.: New genetic variants of glucose 6-phosphate dehydrogenase (G6PD) in Italy. Ann. Hum. Genet. 45:97-104, 1981.292. Sansone, G.; Perroni, L.; Yoshida, A.: Glucose-6-phosphate dehydrogenase variants from Italian subjects associated with severe neonatal jaundice. Brit. J. Haemat. 31:159-165, 1975.293. Sansone, G.; Perroni, L.; Yoshida, A.; Dave, V.: A new glucose 6-phosphate dehydrogenase variant (Gd Trinacria) in two unrelated families of Sicilian ancestry. Ital. J. Biochem. 26:44-50, 1977.294. Shatskaya, T. L.; Krasnopolskaya, K. D.; Annenkov, G. A.: A description of new mutant forms of erythrocyte glucose-6-phosphate dehydrogenase isolated at the territory of the Soviet Union. Genetika 11:116-122, 1975.295. Shatskaya, T. L.; Krasnopolskaya, K. D.; Idelson, L. J.: The new form of glucose 6-phosphate dehydrogenase (G6PD 'Kaluga') from erythrocytes of a patient with chronic non-spherocytic hemolytic anemia. Vopr. Med. Khim. 22:764-768, 1976.296. Shatskaya, T. L.; Krasnopolskaya, K. D.; Idelson, L. J.: Mutant forms of erythrocyte glucose 6-phosphate dehydrogenase in Ashkenazi: description of two new variants, G6PD Kirovograd and G6PD Zhitomir. human genetik 33:175-178, 1976.297. Shatskaya, T. L.; Krasnopolskaya, K. D.; Tzoneva, M.; Mavrudieva, M.; Toncheva, D.: Variants of erythrocyte glucose-6-phosphate dehydrogenase (G6PD) in Bulgarian populations. Hum. Genet. 54:115-117, 1980.298. Shatskaya, T. L.; Krasnopolskaya, K. D.; Zakharova, T. V.: Regularities of distribution of Gd-alleles in Azerbaijan. II. Identification of G6PD mutant forms. Genetika 16:2217-2225, 1980.299. Shows, T. B.; Brown, J. A.: Human X-linked genes regionally mapped utilizing X-autosome translocations and somatic cell hybrids. Proc. Nat. Acad. Sci. 72:2125-2129, 1975.300. Shows, T. B.; Brown, J. A.; Chapman, V. M.: Comparative gene mapping of HPRT, G6PD and PGK in man, mouse, and Muntjac deer. Birth Defects Orig. Art. Ser. XII(7):436-439, 1976.301. Shows, T. B.; Tashian, R. E.; Brewer, G. J.: Erythrocyte glucose-6-phosphate dehydrogenase in Caucasians: new inherited variant. Science 145:1056-1057, 1964.302. Sidi, Y.; Aderka, D.; Brok-Simoni, F.; Benjamin, D.; Ramot, B.; Pinkhas, J.: Viral hepatitis with extreme hyperbilirubinemia, massive hemolysis and encephalopathy in a patient with a new G6PD variant. Israel J. Med. Sci. 16:130-133, 1980.303. Siegel, N. H.; Beutler, E.: Hemolytic anemia caused by G-6-PD Carswell, a new variant. Ann. Intern. Med. 75:437-439, 1971.304. Smith, J. E.; Ryer, K.; Wallace, L.: Glucose-6-phosphate dehydrogenase deficiency in a dog. Enzyme 21:379-382, 1976.305. Snyder, L. M.; Necheles, T. F.; Reddy, W. J.: G-6-PD Worcester: a new variant, associated with X-linked optic atrophy. Am. J. Med. 49:125-132, 1970.306. Stamatoyannopoulos, G.; Kotsakis, P.; Voigtlander, V.; Akrivakis, A.; Motulsky, A. G.: Electrophoretic diversity of glucose-6-phosphate dehydrogenase among Greeks. Am. J. Hum. Genet. 22:587-596, 1970.307. Stamatoyannopoulos, G.; Voigtlander, V.; Akrivakis, A.: Thessaly variant of glucose-6-phosphate dehydrogenase. human genetik 9:23-25,1970.308. Stamatoyannopoulos, G.; Voigtlander, V.; Kotsakis, P.; Akrivakis, A.: Genetic diversity of the 'Mediterranean' glucose-6-phosphate dehydrogenase deficiency phenotype. J. Clin. Invest. 50:1253-1261,1971.309. Stamatoyannopoulos, G.; Yoshida, A.; Bacopoulos, C.; Motulsky, A. G.: Athens variant of glucose-6-phosphate dehydrogenase. Science 157:831-833, 1967.310. Stevens, D. J.; Wanachiwanawin, W.; Mason, P. J.; Vulliamy, T. J.; Luzzatto, L.: G6PD Canton a common deficient variant in South East Asia caused by a 459 arg-to-leu mutation. Nucleic Acids Res. 18:7190, 1990.311. Stocco dos Santos, R. C.; Barretto, O. C. O.; Nonoyama, K.; Castro, N. H. C.; Ferraz, O. P.; Walter-Moura, J.; Vescio, C. C. S.; Becak, W.: X-linked syndrome: mental retardation, hip luxation, and G6PD variant (Gd (+) Butantan). Am. J. Med. Genet. 39:133-136, 1991.312. Stockham, S. L.; Harvey, J. W.; Kinden, D. A.: Equine glucose-6-phosphate dehydrogenase deficiency. Vet. Path. 31:518-527, 1994.313. Streiff, F.; Vigneron, C.: Anemie hemolytique chronique pardeficit en glucose 6-phosphate deshydrogenase dans une famille d'origine Lorraine. Nouv. Rev. Franc. Hemat. 11:279-290, 1971.314. Takahashi, K.; Fujii, H.; Takegawa, S.; Tani, K.; Hirono, A.; Takizawa, T.; Kawakatsu, T.; Miwa, S.: A new glucose-6-phosphate dehydrogenase variant (G6PD Nagano) associated with congenital hemolytic anemia. Hum. Genet. 62:368-370, 1982.315. Takizawa, T.; Fujii, H.; Takegawa, S.; Takahashi, K.; Hirono, A.; Morisaki, T.; Kanno, H.; Oka, R.; Yoshioka, H.; Miwa, S.: A unique electrophoretic slow-moving glucose 6-phosphate dehydrogenase variant (G6PD Asahikawa) with a markedly acidic pH optimum. Hum. Genet. 68:70-72, 1984.316. Takizawa, T.; Huang, I.-Y.; Ikuta, T.; Yoshida, A.: Human glucose-6-phosphate dehydrogenase: primary structure and cDNA cloning. Proc. Nat. Acad. Sci. 83:4157-4161, 1986.317. Takizawa, T.; Yoneyama, Y.; Miwa, S.; Yoshida, A.: A single nucleotide base transition is the basis of the common human glucose-6-phosphate dehydrogenase variant A(+). Genomics 1:228-231, 1987.318. Takizawa, T.; Yoshida, A.: Molecular abnormality of the common glucose-6-phosphate dehydrogenase variant, G6PD A(+), and restriction-fragment-length polymorphism. (Abstract) Am. J. Hum. Genet. 41: A241, 1987.319. Talalak, P.; Beutler, E.: G-6-PD Bangkok: a new variant found in congenital nonspherocytic hemolytic disease (CNHD). Blood 33:772-776, 1969.320. Tanaka, K. R.; Beutler, E.: Hereditary hemolytic anemia due to glucose-6-phosphate dehydrogenase Torrance: a new variant. J. Lab. Clin. Med. 73:657-667, 1969.321. Tang, T. K.; Huang, C.-S.; Huang, M. J.; Tam, K.-B.; Yeh, C.-H.; Tang, C.-J. C.: Diverse point mutations result in glucose-6-phosphate dehydrogenase (G6PD) polymorphism in Taiwan. Blood 79:2135-2140, 1992.322. Testa, U.; Meloni, T.; Lania, A.; Battistuzzi, G.; Cutillo, S.; Luzzatto, L.: Genetic heterogeneity of glucose-6-phosphate dehydrogenase deficiency in Sardinia. Hum. Genet. 56:99-105, 1980.323. Thigpen, J. T.; Steinberg, M. H.; Beutler, E.; Gillespie, G. T., Jr.; Dreiling, B. J.; Morrison, F. S.: Glucose-6-phosphate dehydrogenase Jackson, a new variant associated with hemolytic anemia. Acta Haemat. 51:310-314, 1974.324. Tishkoff, S. A.; Varkonyi, R.; Cahinhinan, N.; Abbes, S.; Argyropoulos, G.; Destro-Bisol, G.; Drousiotou, A.; Dangerfield, B.; Lefranc, G.; Loiselet, J.; Piro, A.; Stoneking, M.; Tagarelli, A.; Tagarelli, G.; Touma, E. H.; Williams, S. M.; Clark, A. G.: Haplotype diversity and linkage disequilibrium at human G6PD: recent origin of alleles that confer malarial resistance. Science 293:455-462, 2001.325. Tokarev, Y. N.; Chernyak, N. B.; Batischev, A. I.; Lanzina, N. V.; Alexeyev, G. A.: Etude des proprietes electrophoretiques et cinetiquesde la glucose-6-phosphate deshydrogenase (Gd) d'erythrocytes dansles deficits hereditaires de l'enzyme: description d'une nouvelle variante de glucose-6-phosphate deshydrogenase: la Gd Kremenchug. Nouv. Rev. Franc. Hemat. 20:557-564, 1978.326. Toncheva, D.: Variants of glucose-6-phosphate dehydrogenase in a Vietnamese population. Hum. Hered. 36:348-351, 1986.327. Toncheva, D.; Tzoneva, M.: Genetic polymorphism of G6PD in a Bulgarian population. Hum. Genet. 67:340-342, 1984.328. Toniolo, D.; Martini, G.; Migeon, B. R.; Dono, R.: Expression of the G6PD locus on the human X chromosome is associated with demethylation of three CpG islands within 100 kb of DNA. EMBO J. 7:401-406, 1988.329. Town, M.; Athanasiou-Metaxa, M.; Luzzatto, L.: Intragenic interspecific complementation of glucose 6-phosphate dehydrogenase in human-hamster cell hybrids. Somat. Cell Molec. Genet. 16:97-108, 1990.330. Town, M.; Bautista, J. M.; Mason, P. J.; Luzzatto, L.: Both mutations in G6PD A- are necessary to produce the G6PD deficient phenotype. Hum. Molec. Genet. 1:171-174, 1992.331. Usanga, E. A.; Bienzle, U.; Cancedda, K.; Fasuan, F. A.; Ajayi, O.; Luzzatto, L.: Genetic variants of human erythrocyte glucose 6-phosphate dehydrogenase: new variants in West Africa characterized by column chromatography. Ann. Hum. Genet. 40:279-286, 1977.332. Vaca, G.; Ibarra, B.; Garcia Cruz, D.; Medina, C.; Romero, F.; Cantu, J. M.; Beutler, E.: G-6-PD Jalisco and G-6-PD Morelia: two new Mexican variants. Hum. Genet. 71:82-85, 1985.333. Vaca, G.; Ibarra, B.; Romero, F.; Olivares, N.; Cantu, J. M.; Beutler, E.: G-6-PD Guadalajara: a new mutant associated with chronic nonspherocytic hemolytic anemia. Hum. Genet. 61:175-176, 1982.334. Ventura, A.; Panizon, F.; Soranzo, M. R.; Veneziano, G.; Sansone, G.; Testa, U.; Luzzatto, L.: Congenital dyserythropoietic anaemia type II associated with a new type of G6PD deficiency (G6PD Gabrovizza). Acta Haemat. 71:227-234, 1984.335. Vergnes, H.; Gherardi, M.; Bouloux, C.: Erythrocyte glucose-6-phosphate dehydrogenase in the Niokolonko (Malinke of the Niokolo) of the Eastern Senegal: identification of a slow variant with normal activity (Tacoma-like). Hum. Hered. 25:80-87, 1975.336. Vergnes, H.; Gherardi, M.; Quilici, J. C.; Yoshida, A.; Giacardy, R.: G6PD Luz-Saint-Sauveur: a new variant with abnormal electrophoretic mobility, mild enzyme deficiency and absence of hemolytic disorders. I. R. C. S. 7:14, 1973.337. Vergnes, H.; Gherardi, M.; Yoshida, A.: G6PD Lozere and Trinacria-like: segregation of two non-hemolytic variants in a French family. Hum. Genet. 34:293-298, 1976.338. Vergnes, H.; Ribet, A.; Bommelaer, G.; Amadieu, J.; Brun, H.: GD(-) Muret and GD(-) Colomiers, two new variants of glucose-6-phosphate dehydrogenase associated with favism. Hum. Genet. 57:332-334, 1981.339. Vergnes, H.; Yoshida, A.; Gourdin, D.; Gherardi, M.; Bierme, R.; Ruffie, J.: Glucose 6-phosphate dehydrogenase Toulouse: a new variant with marked instability and severe deficiency discovered in a family of Mediterranean ancestry. Acta Haemat. 51:240-249, 1974.340. Viglietto, G.; Montanaro, V.; Calabro, V.; Vallone, D.; d'urso, M.; Persico, M. G.; Battistuzzi, G.: Common glucose-6-phosphate dehydrogenase (G6PD) variants from the Italian population: biochemical and molecular characterization. Ann. Hum. Genet. 54:1-15, 1990.341. Vives-Corrons, J.-L.; Kuhl, W.; Pujades, M. A.; Beutler, E.: Molecular genetics of the glucose-6-phosphate dehydrogenase (G6PD) Mediterranean variant and description of a new G6PD mutant, G6PD Andalus (1361A). Am. J. Hum. Genet. 47:575-579, 1990.342. Vives-Corrons, J. L.; Feliu, E.; Pujades, M. A.; Cardellach, F.; Rozman, C.; Carreras, A.; Jou, J. M.; Vallespi, M. T.; Zuazu, F. J.: Severe glucose-6-phosphate dehydrogenase (G6PD) deficiency associated with chronic hemolytic anemia, granulocyte dysfunction, and increased susceptibility to infections: description of a new molecular variant (G6PD Barcelona). Blood 59:428-434, 1982.343. Vives-Corrons, J. L.; Pujades, A.: Heterogeneity of 'Mediterranean type' glucose-6-phosphate dehydrogenase (G6PD) deficiency in Spain and description of two new variants associated with favism. Hum. Genet. 60:216-221, 1982.344. Vives-Corrons, J. L.; Pujades, A.; Curia, M. D.: Caracterizacion molecular de la glucosa-6-fosfato deshidrogenasa (G6PD) en 24 casosde deficit enzimatico y descripcion de una nueva variante (G6PD-Betica). Sangre 25:1049-1064, 1980.345. Vives-Corrons, J. L.; Pujades, M. A.; Petit, J.; Colomer, D.; Corbella, M.; Aguilar i Bascompte, J. L.; Merino, A.: Chronic nonspherocytic hemolytic anemia (CNSHA) and glucose 6 phosphate dehydrogenase (G6PD) deficiency in a patient with familial amyloidotic polyneuropathy (FAP): molecular study of a new variant (G6PD Clinic) with markedly acidic pH optimum. Hum. Genet. 81:161-164, 1989.346. Vulliamy, T.; Beutler, E.; Luzzatto, L.: Variants of glucose-6-phosphate dehydrogenase are due to missense mutations spread throughout the coding region of the gene. Hum. Mutat. 2:159-167, 1993.347. Vulliamy, T.; Mason, P.; Luzzatto, L.: The molecular basis of glucose-6-phosphate dehydrogenase deficiency. Trends Genet. 8:138-143,1992.348. Vulliamy, T.; Rovira, A.; Yusoff, N.; Colomer, D.; Luzzatto, L.; Vives-Corrons, J.-L.: Independent origin of single and double mutations in the human glucose 6-phosphate dehydrogenase gene. Hum. Mutat. 8:311-318, 1996.349. Vulliamy, T. J.: Personal Communication. London, England 1989.350. Vulliamy, T. J.; d'urso, M.; Battistuzzi, G.; Estrada, M.; Foulkes, N. S.; Martini, G.; Calabro, V.; Poggi, V.; Giordano, R.; Town, M.; Luzzatto, L.; Persico, M. G.: Diverse point mutations in the human glucose-6-phosphate dehydrogenase gene cause enzyme deficiency and mild or severe hemolytic anemia. Proc. Nat. Acad. Sci. 85:5171-5175,1988.351. Vulliamy, T. J.; Kaeda, J. S.; Ait-Chafa, D.; Mangerini, R.; Roper, D.; Barbot, J.; Mehta, A. B.; Athanassiou-Metaxa, M.; Luzzatto, L.; Mason, P. J.: Clinical and haematological consequences of recurrent G6PD mutations and a single new mutation causing chronic nonspherocytic haemolytic anaemia. Brit. J. Haemat. 101:670-675, 1998.352. Vulliamy, T. J.; Othman, A.; Town, M.; Nathwani, A.; Falusi, A. G.; Mason, P. J.; Luzzatto, L.: Polymorphic sites in the African population detected by sequence analysis of the glucose-6-phosphate dehydrogenase gene outline the evolution of the variants A and A-. Proc. Nat. Acad. Sci. 88:8568-8571, 1991.353. Vulliamy, T. J.; Wanachiwanawin, W.; Mason, P. J.; Luzzatto, L.: G6PD Mahidol, a common deficient variant in South East Asia is caused by a (163) glycine-to-serine mutation. Nucleic Acids Res. 17:5868, 1989.354. Vuopio, P.; Harkonen, M.; Helske, T.; Naeveri, H.: Red cell glucose-6-phosphate dehydrogenase deficiency in Finland: characterization of a new variant with severe enzyme deficiency. Scand. J. Haemat. 15:145-152, 1975.355. Vuopio, P.; Harkonen, M.; Johnsson, P.; Nuutinen, M.: Red cell glucose-phosphate dehydrogenase deficiency in Finland. Ann. Clin. Res. 5:168-178, 1973.356. Waitz, R.; Boivin, P.; Oberling, F.; Casenave, J. P.; North, M. L.; Mayer, S.: Variante Gd (-) Strasbourg de la glucose-6-phosphate dehydrogenase. Nouv. Rev. Franc. Hemat. 10:312-314, 1970.357. Wang, Y. M.; Patterson, J. H.; Van Eys, J.: The potential use of xylitol in glucose-6-phosphate dehydrogenase deficiency anemia. J. Clin. Invest. 50:1421-1428, 1971.358. Weimer, T. A.; Salzano, F. M.; Hutz, M. H.: Erythrocyte isozymes and hemoglobin types in a southern Brazilian population. J. Hum. Evol. 10:319-328, 1981.359. Weimer, T. A.; Schuler, L.; Beutler, E.; Salzano, F. M.: Gd (+) Laguna, a new rare glucose-6-phosphate dehydrogenase variant from Brazil. Hum. Genet. 65:402-404, 1984.360. Weinreich, J.; Busch, D.; Gottstein, U.; Schaefer, J.; Rohr, J.: Ueber zwei neue Faelle von hereditaerer nichtsphaerocytaerer haemolytischer Anaemie bei glucose-6-phosphat-dehydrogenase-Defektin einer Nord Deutschen Familie. Klin. Wschr. 46:146-149, 1968.361. Welch, S. G.; McGregor, I. A.; Williams, K.: A new variant of human erythrocyte G6PD occurring at a high frequency amongst the population of two villages in The Gambia, West Africa. Hum. Genet. 40:305-309, 1978.362. Westring, D. W.; Pisciotta, A. V.: Anemia, cataracts, and seizures in patients with glucose-6-phosphate dehydrogenase deficiency. Arch. Intern. Med. 118:385-390, 1966.363. WHO: Nomenclature of glucose-6-phosphate dehydrogenase in man. Bull. WHO 36:319-322, 1967. Note: See Also: Canad. Med. Assoc. J. 97:422-424, 1967.364. WHO: Scientific group on the standardization of procedures for the study of glucose-6-phosphate dehydrogenase. WHO Techn. Rep.(pub.) Ser. No. 366:1967.365. Wilson, W. W.: Congenital hemolytic anemia due to a deficiency of glucose 6-phosphate dehydrogenase. Rocky Mt. Med. J. 73:160-162, 1976.366. Witt, I.; Yoshioka, S.: Biochemical characterization of a glucose-6-phosphate dehydrogenase variant with favism: G-6-PD Zaehringen. Klin. Wschr. 50:205-209, 1972.367. Wong, P. W. K.; Shih, L.-Y.; Hsia, D. Y. Y.: characterization of glucose-6-phosphate dehydrogenase among Chinese. Nature 208:1323-1324, 1965.368. Yermakov, N.; Tokarev, J.; Chernjak, N.; Schoenian, G.; Grieger, M.; Guckler, G.; Jacobasch, G.; Mahmudova, M.; Bahramov, S.: New stable mutant Gd (-) variants: G6PD Tashkent and G6PD Nucus: molecular basis of hereditary enzyme deficiency. Acta Biol. Med. Ger. 40:559-562, 1981.369. Yoshida, A.: Personal Communication. Duarte, Calif. Feb. 26, 1996.370. Yoshida, A.: Amino acid substitution (histidine to tyrosine) in a glucose-6-phosphatate dehydrogenase variant (G6PD Hektoen) associated with over-production. J. Mol. Biol. 52:483-490, 1970.371. Yoshida, A.: A single amino acid substitution (asparagine to aspartic acid) between normal (B plus) and the common Negro variant (A plus) of human glucose-6-phosphate dehydrogenase. Proc. Nat. Acad. Sci. 57:835-840, 1967.372. Yoshida, A.: Human glucose-6-phosphate dehydrogenase: purification and characterization of Negro type variant (A+) and comparison with normal enzyme (B+). Biochem. Genet. 1:81-99, 1967.373. Yoshida, A.; Baur, E. W.; Motulsky, A. G.: A Philippino glucose-6-phosphate dehydrogenase variant (G6PD Union) with enzyme deficiency and altered substrate specificity. Blood 35:506-513, 1970.374. Yoshida, A.; Beutler, E.: Human glucose-6-phosphate dehydrogenase variants: a supplementary tabulation. Ann. Hum. Genet. 41:347-355,1978.375. Yoshida, A.; Beutler, E.; Motulsky, A. G.: Table of human glucose-6-phosphate dehydrogenase variants. Bull. WHO 45:243-253, 1971.376. Yoshida, A.; Stamatoyannopoulos, G.; Motulsky, A. G.: Negro variant of glucose-6-phosphate dehydrogenase deficiency (A-) in man. Science 155:97-99, 1967.377. Yoshida, A.; Takizawa, T.: The same extra FokI cleavage site exists in glucose-6-phosphate dehydrogenase variants A(+) and A(-). Am. J. Hum. Genet. 43:131-133, 1988.378. Yoshida, A.; Takizawa, T.; Prchal, J. T.: RFLP of the X chromosome-linked glucose-6-phosphate dehydrogenase locus in blacks. Am. J. Hum. Genet. 42:872-876, 1988.379. Zinkham, W. H.: A deficiency of glucose-6-phosphate dehydrogenase activity in lens from individuals with primaquine-sensitive erythrocytes. Bull. Johns Hopkins Hosp. 109:206-216, 1961.380. Zuo, L.; Chen, E.; Du, C. S.; Chang, C. N.; Chiu, D. T. Y.:Genetic study of Chinese G6PD variants by direct PCR sequencing. (Abstract) Blood 76(suppl. 1):51A, 1990.

Campuzano, V.; Montermini, L.; Molto, M. D.; Pianese, L.; Cossee, M.; Cavalcanti, F.; Monros, E.; Rodius, F.; Duclos, F.; Monticelli, A.; Zara, F.; Canizares, J.; Koutnikova, H.; Bidichandani, S. I.; Gellera, C.; Brice, A.; Trouillas, P.; De Michele, G.; Filla, A.; De Frutos, R.; Palau, F.; Patel, P. I.; Di Donato, S.; Mandel, J.-L.; Cocozza, S.; Koenig, M.; Pandolfo, M.: Friedreich's ataxia: autosomal recessive disease caused by an intronic GAA triplet repeat expansion. Science 271:1423-1427, 1996.

Ilyin, G. P.; Rialland, M.; Pigeon, C.; Guguen-Guillouzo, C.: cDNA cloning and expression analysis of new members of the mammalian F-box protein family. Genomics 67:40-47, 2000.

Andersson, P.; McGuire, J.; Rubio, C.; Gradin, K.; Whitelaw, M. L.; Pettersson, S.; Hanberg, A.; Poellinger, L.: A constitutively active dioxin/aryl hydrocarbon receptor induces stomach tumors. Proc. Nat. Acad. Sci. 99:9990-9995, 2002.

Ema, M.; Matsushita, N.; Sogawa, K.; Ariyama, T.; Inazawa, J.; Nemoto, T.; Ota, M.; Oshimura, M.; Fujii-Kuriyama, Y.: Human arylhydrocarbon receptor: functional expression and chromosomal assignment to 7p21. J. Biochem. 116:845-851, 1994.

Le Beau, M. M.; Carver, L. A.; Espinosa, R., III; Schmidt, J. V.; Bradfield, C. A.: Chromosomal localization of the human AHR locus encoding the structural gene for the Ah receptor to 7p21-p15. Cytogenet. Cell Genet. 66:172-176, 1994.

Micka, J.; Milatovich, A.; Menon, A.; Grabowski, G. A.; Puga, A.; Nebert, D. W.: Human Ah receptor (AHR) gene: localization to 7p15 and suggestive correlation of polymorphism with CYP1A1 inducibility. Pharmacogenetics 7:95-101, 1997.

Shimizu, Y.; Nakatsuru, Y.; Ichinose, M.; Takahashi, Y.; Kume, H.; Mimura, J.; Fujii-Kuriyama, Y.; Ishikawa, T.: Benzo[a]pyrene carcinogenicity is lost in mice lacking the aryl hydrocarbon receptor. Proc. Nat. Acad. Sci. 97:779-782, 2000.

Asano, H.; Ishida, A.; Hasegawa, M.; Ono, T.; Yoshida, M. C.; Taniguchi, M.; Kanno, M.: The mouse Mel-18 'RING-finger' gene: genomic organization, promoter analysis and chromosomal assignment. DNA Seq. 3:369-377,1993.

Ishida, A.; Asano, H.; Hasegawa, M.; Koseki, H.; Ono, T.; Yoshida, M. C.; Taniguchi, M.; Kanno, M.: Cloning and chromosome mapping of the human Mel-18 gene which encodes a DNA-binding protein with a new 'RING-finger' motif. Gene 129:249-255, 1993.

Polvi, A.; Armstrong, E.; Lai, C.; Lemke, G.; Huebner, K.; Spritz, R. A.; Guida, L. C.; Nicholls, R. D.; Alitalo, K.: The human TYRO3 gene and pseudogene are located in chromosome 15q14-q25. Gene 134:289-293, 1993.

Chen, P.; Hao, W.; Rife, L.; Wang, X. P.; Shen, D.; Chen, J.; Ogden, T.; Van Boemel, G. B.; Wu, L.; Yang, M.; Fong, H. K. W.: A photic visual cycle of rhodopsin regeneration is dependent on Rgr. Nature Genet. 28:256-260, 2001.

Chen, X.-N.; Korenberg, J. R.; Jiang, M.; Shen, D.; Fong, H. K. W.: Localization of the human RGR opsin gene to chromosome 10q23. Hum. Genet. 97:720-722, 1996.

Jiang, M.; Pandey, S.; Fong, H. K. W.: An opsin homologue in the retina and pigment epithelium. Invest. Ophthal. Visual Sci. 34:3669-3678, 1993.

Morimura, H.; Saindelle-Ribeaudeau, F.; Berson, E. L.; Dryja, T. P.: Mutations in RGR, encoding a light-sensitive opsin homologue, in patients with retinitis pigmentosa. (Letter) Nature Genet. 23:393-394, 1999.

Shen, D.; Jiang, M.; Hao, W.; Tao, L.; Salazar, M.; Fong, H. K. W.: A human opsin-related gene that encodes a retinaldehyde-binding protein. Biochemistry 33:13117-13125, 1994.

Tagawa, M.; Sakamoto, T.; Shigemoto, K.; Matsubara, H.; Tamura, Y.; Ito, T.; Nakamura, I.; Okitsu, A.; Imai, K.; Taniguchi, M.: Expression of novel DNA-binding protein with zinc finger structure in various tumor cells. J. Biol. Chem. 265:20021-20026, 1990.

Breitbart, R. E.; Liang, C.; Smoot, L. B.; Laheru, D. A.; Mahdavi, V.; Nadal-Ginard, B.: A fourth human MEF2 transcription factor, hMEF2D, is an early marker of the myogenic lineage. Development 118:1095-1106,1993.

Hobson, G. M.; Krahe, R.; Garcia, E.; Siciliano, M. J.; Funanage, V. L.: Regional chromosomal assignments for four members of the MADS domain transcription enhancer factor 2 (MEF2) gene family to human chromosomes 15q26, 19p12, 5q14, and 1q12-q23. Genomics 29:704-711,1995.

Mao, Z.; Bonni, A.; Xia, F.; Nadal-Vicans, M.; Greenberg, M. E.: Neuronal activity-dependent cell survival mediated by transcription factor MEF2. Science 286:785-790, 1999.

Martin, J. F.; Miano, J. M.; Hustad, C. M.; Copeland, N. G.; Jenkins, N. A.; Olson, E. N.: A Mef2 gene that generates a muscle-specific isoform via alternative mRNA splicing. Molec. Cell. Biol. 14:1647-1656,1994.

Molkentin, J. D.; Black, B. L.; Martin, J. F.; Olson, E. N.: Cooperative activation of muscle gene expression by MEF2 and myogenic bHLH proteins. Cell 83:1125-1136, 1995.

Naya, F. J.; Black, B. L.; Wu, H.; Bassel-Duby, R.; Richardson, J. A.; Hill, J. A.; Olson, E. N.: Mitochondrial deficiency and cardiac sudden death in mice lacking the MEF2A transcription factor. Nature Med. 15Oct, 2002. Note: Advance Electronic Publication.

Pollock, R.; Treisman, R.: Human SRF-related proteins: DNA-binding properties and potential regulatory targets. Genes Dev. 5:2327-2341,1991.

Suzuki, E.; Lowry, J.; Sonoda, G.; Testa, J. R.; Walsh, K.: Structures and chromosome locations of the human MEF2A gene and a pseudogene MEF2AP. Cytogenet. Cell Genet. 73:244-249, 1996.

Yu, Y.-T.; Breitbart, R. E.; Smoot, L. B.; Lee, Y.; Mahdavi, V.; Nadal-Ginard, B.: Human myocyte-specific enhancer factor 2 comprises a group of tissue-restricted MADS box transcription factors. Genes Dev. 6:1783-1798, 1992.

Youn, H.-D.; Sun, L.; Prywes, R.; Liu, J. O.: Apoptosis of T cells mediated by Ca (2+)-induced release of the transcription factor MEF2. Science 286:790-793, 1999.

Krainc, D.; Haas, M.; Ward, D. C.; Lipton, S. A.; Bruns, G.; Leifer, D.: Assignment of human myocyte-specific enhancer binding factor2C (hMEF2C) to human chromosome 5q14 and evidence that MEF2C is evolutionarily conserved. Genomics 29:809-811, 1995.

Leifer, D.; Krainc, D.; Yu, Y.-T.; McDermott, J.; Breitbart, R. E.; Heng, J.; Neve, R. L.; Kosofsky, B.; Nadal-Ginard, B.; Lipton, S. A.: MEF2C, a MADS/MEF2-family transcription factor expressed in a laminar distribution in cerebral cortex. Proc. Nat. Acad. Sci. 90:1546-1550, 1993.

McCright, B.; Rivers, A. M.; Audlin, S.; Virshup, D. M.: The B56family of protein phosphatase 2A (PP2A) regulatory subunits encodes differentiation-induced phosphoproteins that target PP2A to both nucleus and cytoplasm. J. Biol. Chem. 271:22081-22089, 1996.

Van Hoof, C.; Aly, M. S.; Garcia, A.; Cayla, X.; Cassiman, J. J.; Merlevede, W.; Goris, J.: Structure and chromosomal localization of the human gene of the phosphotyrosyl phosphatase activator (PTPA) of protein phosphatase 2A. Genomics 28:261-272, 1995.

Arnemann, J.; Epplen, J. T.; Cooke, H. J.; Sauermann, U.; Engel, W.; Schmidtke, J.: A human Y-chromosomal DNA sequence expressed in testicular tissue. Nucleic Acids Res. 15:8713-8724, 1987.

Arnemann, J.; Jakubiczka, S.; Thuring, S.; Schmidtke, J.: Cloning and sequence analysis of a human Y-chromosome-derived, testicular cDNA, TSPY. Genomics 11:108-114, 1991.

Guttenbach, M.; Muller, U.; Schmid, M.: A human moderately repeated Y-specific DNA sequence is evolutionarily conserved in the Y chromosome of the great apes. Genomics 13:363-367, 1992.

Jakubiczka, S.; Schnieders, F.; Schmidtke, J.: A bovine homologue of the human TSPY gene. Genomics 17:732-735, 1993.

Lau, Y.-F. C.: Sex chromosome genetics '99: gonadoblastoma, testicular and prostate cancers, and the TSPY gene. Am. J. Hum. Genet. 64:921-927, 1999.

Manz, E.; Schnieders, F.; Brechlin, A. M.; Schmidtke, J.: TSPY-related sequences represent a microheterogeneous gene family organized as constitutive elements in DYZ5 tandem repeat units on the human Y chromosome. Genomics 17:726-731, 1993.

Mazeyrat, S.; Mitchell, M. J.: Rodent Y chromosome TSPY gene is functional in rat and non-functional in mouse. Hum. Molec. Genet. 7:557-562, 1998.

Schnieders, F.; Dork, T.; Arnemann, J.; Vogel, T.; Werner, M.; Schmidtke, J.: Testis-specific protein, Y-encoded (TSPY) expression in testicular tissues. Hum. Molec. Genet. 5:1801-1807, 1996.

Vogel, T.; Boettger-Tong, H.; Nanda, I.; Dechend, F.; Agulnik, A. I.; Bishop, C. E.; Schmid, M.; Schmidtke, J.: A murine TSPY. Chromosome Res. 6:35-40, 1998.

Zhang, J. S.; Yang-Feng, T. L.; Muller, U.; Mohandas, T. K.; deJong, P. J.; Lau, Y.-F. C.: Molecular isolation and characterization of an expressed gene from the human Y-chromosome. Hum. Molec. Genet. 1:717-726, 1992.

Mach, B.; Steimle, V.; Martinez-Soria, E.; Reith, W.: Regulation of MHC class II genes: lessons from a disease. Annu. Rev. Immun. 14:301-331, 1996.

Reith, W.: Personal Communication. Geneva, Switzerland May 30, 1997.

Scholl, T.; Mahanta, S. K.; Strominger, J. L.: Specific complex formation between the type II bare lymphocyte syndrome-associated transactivators CIITA and RFX5. Proc. Nat. Acad. Sci. 94:6330-6334,1997.

Emery, P.; Durand, B.; Mach, B.; Reith, W.: RFX proteins, a novel family of DNA binding proteins conserved in the eukaryotic kingdom. Nucleic Acids Res. 24:803-807, 1996.

Pugliati, L.; Reith, W.; Fey, S.; Mach, B.: Mapping the RF-X gene, encoding a DNA-binding protein controlling HLA class II gene expression, to 19p13. (Abstract) Cytogenet. Cell Genet. 51:1061 only, 1989.

Mizuta, M.; Inagaki, N.; Nemoto, Y.; Matsukura, S.; Takahashi, M.; Seino, S.: Synaptotagmin III is a novel isoform of rat synaptotagmin expressed in endocrine and neuronal cells. J. Biol. Chem. 269:11675-11678,1994.

Mumm, S.; Christie, P. T.; Finnegan, P.; Jones, J.; Dixon, P. H.; Pannett, A. A. J.; Harding, B.; Gottesman, G. S.; Thakker, R. V.; Whyte, M. P.: A five-base pair deletion in the sedlin gene causes spondyloepiphyseal dysplasia tarda in a six-generation Arkansas kindred. J. Clin. Endocr. Metab. 85:3343-3347, 2000.

Mumm, S.; Zhang, X.; Vacca, M.; d'Esposito, M.; Whyte, M. P.: The sedlin gene for spondyloepiphyseal dysplasia tarda escapes X-inactivation and contains a non-canonical splice site. Gene 273:285-293, 2001.

Takahashi, T.; Takahashi, I.; Tsuchida, S.; Oyama, K.; Komatsu, M.; Saito, H.; Takada, G.: An SEDL gene mutation in a Japanese kindred of X-linked spondyloepiphyseal dysplasia tarda. (Letter) Clin. Genet. 61:319-320, 2002.

Li, X.-J.; Wang, D.-Y.; Zhu, Y.; Guo, R.-J.; Wang, X.-D.; Lubomir, K.; Mukai, K.; Sasaki, H.; Yoshida, H.; Oka, T.; Machinami, R.; Shinmura, K.; Tanaka, M.; Sugimura, H.: Mxi1 mutations in human neurofibrosarcomas. Jpn. J. Cancer Res. 90:740-746, 1999.

Prochownik, E. V.; Grove, L. E.; Deubler, D.; Zhu, X. L.; Stephenson, R. A.; Rohr, L. R.; Yin, X.; Brothman, A. R.: Commonly occurring loss and mutation of the MXI1 gene in prostate cancer. Genes Chromosomes Cancer 22:295-304, 1998.

Schreiber-Agus, N.; Meng, Y.; Hoang, T.; Hou, H., Jr.; Chen, K.; Greenberg, R.; Cordon-Cardo, C.; Lee, H.-W.; DePinho, R. A.: Role of Mxi1 in ageing organ systems and the regulation of normal and neoplastic growth. Nature 393:483-487, 1998.

Shapiro, D. N.; Valentine, V.; Eagle, L.; Yin, X.; Morris, S. W.; Prochownik, E. V.: Assignment of the human MAD and MXI1 genes to chromosomes 2p12-p13 and 10q24-q25. Genomics 23:282-285, 1994.

Wechsler, D. S.; Hawkins, A. L.; Li, X.; Jabs, E. W.; Griffin, C. A.; Dang, C. V.: Localization of the human Mxi1 transcription factor gene (MXI1) to chromosome 10q24-q25. Genomics 21:669-672,1994.

Wechsler, D. S.; Shelly, C. A.; Dang, C. V.: Genomic organization of human MXI1, a putative tumor suppressor gene. Genomics 32:466-470,1996.

Zervos, A. S.; Gyuris, J.; Brent, R.: Mxi1, a protein that specifically interacts with Max to bind Myc-Max recognition sites. Cell 72:223-232,1993. Note: Erratum: Cell 79:389 only, 1994.

Ishikawa, T.; Tamai, Y.; Rochelle, J. M.; Hirata, M.; Namba, T.; Sugimoto, Y.; Ichikawa, A.; Narumiya, S.; Taketo, M. M.; Seldin, M. F.: Mapping of the genes encoding mouse prostaglandin D, E, and F and prostacyclin receptors. Genomics 32:285-288, 1996.

Hoffman, I.; Balling, R.: Chromosomal localization of the murine cadherin-11. Mammalian Genome 6:304 only, 1995.

Okazaki, M.; Takeshita, S.; Kawai, S.; Kikuno, R.; Tsujimura, A.; Kudo, A.; Amann, E.: Molecular cloning and characterization of OB-cadherin, a new member of cadherin family expressed in osteoblasts. J. Biol. Chem. 269:12092-12098, 1994.

Tanihara, H.; Sano, K.; Heimark, R. L.; St. John, T.; Suzuki, S.: Cloning of five human cadherins clarifies characteristic features of cadherin extracellular domain and provides further evidence for two structurally different types of cadherin. Cell Adhes. Commun. 2:15-26, 1994.

Christie, P. T.; Curley, A.; Nesbit, M. A.; Chapman, C.; Genet, S.; Harper, P. S.; Keeling, S. L.; Wilkie, A. O. M.; Winter, R. M.; Thakker, R. V.: Mutational analysis in X-linked spondyloepiphyseal dysplasia tarda. J. Clin. Endocr. Metab. 86:3233-3236, 2001.

Fiedler, J.; Bittner, M.; Puhl, W.; Brenner, R. E.: Mutations in the X-linked spondyloepiphyseal dysplasia tarda (SEDL) coding sequence are not a common cause of early primary osteoarthritis in men. (Letter) Clin. Genet. 62:94-95, 2002.

Gecz, J.; Hillman, M. A.; Gedeon, A. K.; Cox, T. C.; Baker, E.; Mulley, J. C.: Gene structure and expression study of the SEDL gene for spondyloepiphyseal dysplasia tarda. Genomics 69:242-251, 2000.

Gedeon, A. K.; Colley, A.; Jamieson, R.; Thompson, E. M.; Rogers, J.; Sillence, D.; Tiller, G. E.; Mulley, J. C.; Gecz, J.: Identification of the gene (SEDL) causing X-linked spondyloepiphyseal dysplasia tarda. Nature Genet. 22:400-404, 1999.

Grunebaum, E.; Arpaia, E.; MacKenzie, J. J.; Fitzpatrick, J.; Ray, P. N.; Roifman, C. M.: A missense mutation in the SEDL gene results in delayed onset of X linked spondyloepiphyseal dysplasia in a large pedigree. (Letter) J. Med. Genet. 38:409-411, 2001.

Gedeon, A. K.; Tiller, G. E.; Le Merrer, M.; Heuertz, S.; Tranebjaerg, L.; Chitayat, D.; Robertson, S.; Glass, I. A.; Savirayan, R.; Cole, W. G.; Rimoin, D. L.; Kousseff, B. G.; Ohashi, H.; Zabel, B.; Munnich, A.; Gecz, J.; Mulley, J. C.: The molecular basis of X-linked spondyloepiphyseal dysplasia tarda. Am. J. Hum. Genet. 68:1386-1397, 2001.

Tiller, G. E.; Hannig, V. L.; Dozier, D.; Carrel, L.; Trevarthen, K. C.; Wilcox, W. R.; Mundlos, S.; Haines, J. L.; Gedeon, A. K.; Gecz, J.: A recurrent RNA-splicing mutation in the SEDL gene causes X-linked spondyloepiphyseal dysplasia tarda. Am. J. Hum. Genet. 68:1398-1407,2001.

Whyte, M. P.; Gottesman, G. S.; Eddy, M. C.; McAlister, W. H.: X-linked recessive spondyloepiphyseal dysplasia tarda: clinical and radiographic evolution in a 6-generation kindred and review of the literature. Medicine 78:9-25, 1999.

Becker, M. A.; Heidler, S. A.; Bell, G. I.; Seino, S.; Le Beau, M. M.; Westbrook, C. A.; Neuman, W.; Shapiro, L. J.; Mohandas, T. K.; Roessler, B. J.; Palella, T. D.: Cloning of cDNAs for human phosphoribosyl pyrophosphate synthetases 1 and 2 and X chromosome localization of PRPS1 and PRPS2genes. Genomics 8:555-561, 1990.

Bennett, B. D.; Wang, Z.; Kuang, W.-J.; Wang, A.; Groopman, J. E.; Goeddel, D. V.; Scadden, D. T.: Cloning and characterization of HTK, a novel transmembrane tyrosine kinase of the EPH subfamily. J. Biol. Chem. 269:14211-14218, 1994.

Berclaz, G.; Andres, A.-C.; Albrecht, D.; Dreher, E.; Ziemiecki, A.; Gusterson, B. A.; Crompton, M. R.: Expression of the receptor protein tyrosine kinase myk-1/htk in normal and malignant mammary epithelium. Biochem. Biophys. Res. Commun. 226:869-875, 1996.

Gerety, S. S.; Wang, H. U.; Chen, Z.-F.; Anderson, D. J.: Symmetrical mutant phenotypes of the receptor EphB4 and its specific transmembrane ligand ephrin-B2 in cardiovascular development. Molec. Cell 4:403-414,1999.

Moynihan, T. P.; Ardley, H. C.; Leek, J. P.; Thompson, J.; Brindle, N. S.; Markham, A. F.; Robinson, P. A.: Characterization of a human ubiquitin-conjugating enzyme gene UBE2L3. Mammalian Genome 7:520-525,1996.

Flanagan, J. R.; Becker, K. G.; Ennist, D. L.; Gleason, S. L.; Driggers, P. H.; Levi, B.-Z.; Appella, E.; Ozato, K.: Cloning of a negative transcription factor that binds to the upstream conserved region of Moloney murine leukemia virus. Molec. Cell. Biol. 12:38-44, 1992.

Hariharan, N.; Kelley, D. E.; Perry, R. P.: Delta, a transcription factor that binds to downstream elements in several polymerase II promoters, is a functionally versatile zinc finger protein. Proc. Nat. Acad. Sci. 88:9799-9803, 1991.

Oei, S. L.; Shi, Y.: Transcription factor Yin Yang 1 stimulates poly (ADP-ribosyl)ation and DNA repair. Biochem. Biophys. Res. Commun. 284:450-454, 2001.

Park, K.; Atchison, M. L.: Isolation of a candidate repressor/activator, NF-E1 (YY-1, delta), that binds to the immunoglobulin kappa 3-prime enhancer and the immunoglobulin heavy-chain micro-E1 site. Proc. Nat. Acad. Sci. 88:9804-9808, 1991.

Shi, Y.; Seto, E.; Chang, L.-S.; Shenk, T.: Transcriptional repression by YY1, a human GLI-Kruppel-related protein, and relief of repression by adenovirus E1A protein. Cell 67:377-388, 1991.

Yao, Y.-L.; Dupont, B. R.; Ghosh, S.; Fang, Y.; Leach, R. J.; Seto, E.: Cloning, chromosomal localization and promoter analysis of the human transcription factor YY1. Nucleic Acids Res. 26:3776-3783,1998.

Zhu, W.; Lossie, A. C.; Camper, S. A.; Gumucio, D. L.: Chromosomal localization of the transcription factor YY1 in the mouse and human. Mammalian Genome 5:234-236, 1994.

Hakimi, M.-A.; Bochar, D. A.; Schmiesing, J. A.; Dong, Y.; Barak, O. G.; Speicher, D. W.; Yokomori, K.; Shiekhattar, R.: A chromatin remodelling complex that loads cohesin onto human chromosomes. Nature 418:994-998, 2002.

Muchardt, C.; Reyes, J. C.; Bourachot, B.; Leguoy, E.; Yaniv, M.: The hbrm and BRG-1 proteins, components of the human SNF/SWI complex, are phosphorylated and excluded from the condensed chromosomes during mitosis. EMBO J. 15:3394-3402, 1996.

Muchardt, C.; Yaniv, M.: A human homologue of Saccharomyces cerevisiae SNF2/SWI2 and Drosophila brm genes potentiates transcriptional activation by the glucocorticoid receptor. EMBO J. 12:4279-4290, 1993.

Muchardt, C.; Yaniv, M.; Mattei, M.-G.: Assignment of HBRM, the human homolog of S. cerevisiae SNF2/SWI2 and Drosophila brm genes, to chromosome region 9p23-p24, by in situ hybridization. Mammalian Genome 5:241-243, 1994.

Nomura, N.; Miyajima, N.; Sazuka, T.; Tanaka, A.; Kawarabayasi, Y.; Sato, S.; Nagase, T.; Seki, N.; Ishikawa, K.; Tabata, S.: Prediction of the coding sequences of unidentified human genes. I. The coding sequences of 40 new genes (KIAA0001-KIAA0040) deduced by analysis of randomly samples cDNA clones from human immature myeloid cell lineKG-1. DNA Res. 1:27-35, 1994.

Kikuno, R.; Nagase, T.; Ishikawa, K.; Hirosawa, M.; Miyajima, N.; Tanaka, A.; Kotani, H.; Nomura, N.; Ohara, O.: Prediction of the coding sequences of unidentified human genes. XIV. The complete sequences of 100 new cDNA clones from brain which code for large proteins in vitro. DNA Res. 6:197-205, 1999.

Walker, J. L.; Dixon, J.; Fenton, C. R.; Hungerford, J.; Lynch, S. A.; Stenhouses, S. A. R.; Christian, A.; Craig, I. W.: Two new mutations in exon 3 of the NDP gene: S73X and S101F associated with severe and less severe ocular phenotype, respectively. Hum. Mutat. 9:53-56, 1997.

Battaglia, G.; Princivalle, A.; Forti, F.; Lizier, C.; Zeviani, M.: Expression of the SMN gene, the spinal muscular atrophy determining gene, in the mammalian central nervous system. Hum. Molec. Genet. 6:1961-1971, 1997.

Burglen, L.; Lefebvre, S.; Clermont, O.; Burlet, P.; Viollet, L.; Cruaud, C.; Munnich, A.; Melki, J.: Structure and organization of the human survival motor neurone (SMN) gene. Genomics 32:479-482,1996.

Burglen, L.; Spiegel, R.; Ignatius, J.; Cobben, J. M.; Landrieu, P.; Lefebvre, S.; Munnich, A.; Melki, J.: SMN gene deletion in variant of infantile spinal muscular atrophy. (Letter) Lancet 346:316-317,1995.

Bussaglia, E.; Clermont, O.; Tizzano, E.; Lefebvre, S.; Burglen, L.; Cruaud, C.; Urtizberea, J. A.; Colomer, J.; Munnich, A.; Baiget, M.; Melki, J.: A frame-shift deletion in the survival motor neuron gene in Spanish spinal muscular atrophy patients. Nature Genet. 11:335-337, 1995.

Callebaut, I.; Mornon, J. P.: The human EBNA-2 coactivator p100: multidomain organization and relationship to the staphylococcal nuclease fold and to the tudor protein involved in Drosophila melanogaster development. Biochem. J. 321: 125-132, 1997.

Campbell, L.; Daniels, R. J.; Dubowitz, V.; Davies, K. E.: Maternal mosaicism for a second mutational event in a type I spinal muscular atrophy family. Am. J. Hum. Genet. 63:37-44, 1998.

Campbell, L.; Hunter, K. M. D.; Mohaghegh, P.; Tinsley, J. M.; Brasch, M. A.; Davies, K. E.: Direct interaction of Smn with dp103, a putative RNA helicase: a role for Smn in transcription regulation? Hum. Molec. Genet. 9:1093-1100, 2000.

Chen, K.-L.; Wang, Y. L.; Rennert, H.; Joshi, I.; Mills, J. K.; Leonard, D. G. B.; Wilson, R. B.: Duplications and de novo deletions of the SMNt gene demonstrated by fluorescence-based carrier testing for spinal muscular atrophy. Am. J. Med. Genet. 85:463-469, 1999.

Warburg, M.: Norrie's disease: a new hereditary bilateral pseudotumour of the retina. Acta Ophthal. (Copenh) 39:757-772, 1961.

Warburg, M.: Norrie's disease (atrofia bulborum hereditaria). Acta Ophthal. 41:134-146, 1963.

Warburg, M.: Norrie's disease, a congenital progressive oculo-acoustico-cerebral degeneration. Acta Ophthal. 89 (suppl.):1-147, 1966.

Warburg, M.; Hauge, M.; Sanger, R.: Norrie's disease and the Xg blood group system: linkage data. Acta Genet. Statist. Med. 15:103-115, 1965.

Whitnall, S. E.; Norman, R. M.: Microphthalmia and the visual pathways: a case associated with blindness and imbecility, and sex-linked. Brit. J. Ophthal. 24:229-244, 1940.

Wilson, W. M. G.: Congenital blindness (pseudoglioma) occurring as a sex-linked developmental anomaly. Canad. Med. Assoc. J. 60:580-584, 1949.

Wolff, G.; Mayerova, A.; Wienker, T. F.; Atalianis, P.; Ioannou, P.; Warburg, M.: Clinical reinvestigation and linkage analysis in the family with Episkopi blindness (Norrie disease). J. Med. Genet. 29:816-819, 1992.

Wong, F.; Goldberg, M. F.; Hao, Y.: Identification of a nonsense mutation at codon 128 of the Norrie's disease gene in a male infant. Arch. Ophthal. 111:1553-1557, 1993.

Woodruff, G.; Newbury-Ecob, R.; Plaha, D. S.; Young, I. D.: Manifesting heterozygosity in Norrie's disease?. Brit. J. Ophthal. 77:813-814,1993.

Zhu, D.; Antonarakis, S. E.; Schmeckpeper, B. J.; Diergaarde, P. J.; Greb, A. E.; Maumenee, I. H.: Microdeletion in the X-chromosome and prenatal diagnosis in a family with Norrie disease. Am. J. Med. Genet. 33:485-488, 1989.

Avner, P.; Bucan, M.; Arnaud, D.; Lehrach, H.; Rapp, U.: A-rafonco gene localizes on mouse X chromosome to region some 10-17 centimorgans proximal to hypoxanthine phosphoribosyl transferase gene. Somat. Cell Molec. Genet. 13:267-272, 1987.

Beck, T. W.; Huleihel, M.; Gunnell, M.; Bonner, T. I.; Rapp, U. R.: The complete coding sequence of the human A-raf-1 oncogene and transforming activity of a human A-raf carrying retrovirus. Nucleic Acids Res. 15:595-609, 1987.

Huebner, K.; ar-Rushdi, A.; Griffin, C. A.; Isobe, M.; Kozak, C.; Emanuel, B. S.; Nagarajan, L.; Cleveland, J. L.; Bonner, T. I.; Goldsborough, M. D.; Croce, C. M.; Rapp, U.: Actively transcribed genes in the raf oncogene group, located on the X chromosome in mouse and human. Proc. Nat. Acad. Sci. 83:3934-3938, 1986.

Lee, J.-E.; Beck, T. W.; Brennscheidt, U.; DeGennaro, L. J.; Rapp, U. R.: The complete sequence and promoter activity of the human A-raf-1gene (ARAF1). Genomics 20:43-55, 1994.

Mark, G. E.; Seeley, T. W.; Shows, T. B.; Mountz, J. D.: Pks, a raf-related sequence in human S. Proc. Nat. Acad. Sci. 83:6312-6316,1986.

Popescu, N. C.; Mark, G. E.: Localization of the pKs gene, a raf related sequence on human chromosomes X and 7. Oncogene 4:517-519,1989.

Dowdy, S. F.; Fasching, C. L.; Araujo, D.; Lai, K.-M.; Livanos, E.; Weissman, B. E.; Stanbridge, E. J.: Suppression of tumorigenicity in Wilms' tumor by the p15.5-p14 region of chromosome 11. Science 254:293-295, 1991.

Dowdy, S. F.; Lai, K.-M.; Weissman, B. E.; Matsui, Y.; Hogan, B. L. M.; Stanbridge, E. J.: The isolation and characterization of a novel cDNA demonstrating an altered mRNA level in nontumorigenic Wilms'microcell hybrid cells. Nucleic Acids Res. 19:5763-5769, 1991.

Farmer, A. A.; Loftus, T. M.; Mills, A. A.; Sato, K. Y.; Neill, J. D.; Tron, T.; Yang, M.; Trumpower, B. L.; Stanbridge, E. J.: Extreme evolutionary conservation of QM, a novel c-Jun associated transcription factor. Hum. Molec. Genet. 3:723-728, 1994.

Kaneko, K.; Kobayashi, H.; Onodera, O.; Miyatake, T.; Tsuji, S.: Genomic organization of a cDNA (QM) demonstrating an altered mRNA level in nontumorigenic Wilms' microcell hybrid cells and its localization to Xq28. Hum. Molec. Genet. 1:529-533, 1992.

Korn, B.; Sedlacek, Z.; Manca, A.; Kioschis, P.; Konecki, D.; Lehrach, H.; Poustka, A.: A strategy for the selection of transcribed sequences in the Xq28 region. Hum. Molec. Genet. 1:235-242, 1992.

van den Ouweland, A. M. W.; Verdijk, M.; Mannens, M. M. A. M.; van Oost, B. A.: The QM gene is X-linked and therefore not involved in suppression of tumorigenesis in Wilms' tumor. Hum. Molec. Genet. 90:144-146, 1992.

Weissman, B. E.; Saxon, P. J.; Pasquale, S. R.; Jones, G. R.; Geiser, A. G.; Stanbridge, E. J.: Introduction of a normal human chromosome 11 into a Wilms' tumor cell line controls its tumorigenic expression. Science 236:175-180, 1987.

Abel, A.; Walcott, J.; Woods, J.; Duda, J.; Merry, D. E.: Expression of expanded repeat androgen receptor produces neurologic disease in transgenic mice. Hum. Molec. Genet. 10:107-116, 2001.

Bailey, C. K.; Andriola, I. F. M.; Kampinga, H. H.; Merry, D. E.: Molecular chaperones enhance the degradation of expanded polyglutamine repeat androgen receptor in a cellular model of spinal and bulbar muscular atrophy. Hum. Molec. Genet. 11:515-523, 2002.

Batch, J. A.; Williams, D. M.; Davies, H. R.; Brown, B. D.; Evans, B. A. J.; Hughes, I. A.; Patterson, M. N.: Androgen receptor gene mutations identified by SSCP in fourteen subjects with androgen insensitivity syndrome. Hum. Molec. Genet. 1:497-503, 1992.

Beitel, L. K.; Kazemi-Esfarjani, P.; Kaufman, M.; Lumbroso, R.; DiGeorge, A. M.; Killinger, D. W.; Trifiro, M. A.; Pinsky, L.: Substitution of arginine-839 by cysteine or histidine in the androgen receptor causes different receptor phenotypes in cultured cells and coordinate degrees of clinical androgen resistance. J. Clin. Invest. 94:546-554,1994.

Belsham, D. D.; Pereira, F.; Greenberg, C. R.; Liao, S.; Wrogemann, K.: Leu676-to-pro mutation of the androgen receptor causes complete androgen insensitivity syndrome in a large Hutterite kindred. Hum. Mutat. 5:28-33, 1995.

Bevan, C. L.; Brown, B. B.; Davies, H. R.; Evans, B. A. J.; Hughes, I. A.; Patterson, M. N.: Functional analysis of six androgen receptor mutations identified in patients with partial androgen insensitivity syndrome. Hum. Molec. Genet. 5:265-273, 1996.

Biancalana, V.; Serville, F.; Pommier, J.; Julien, J.; Hanauer, A.; Mandel, J. L.: Moderate instability of the trinucleotide repeat in spinobulbar muscular atrophy. Hum. Molec. Genet. 1:255-258,1992.

Boehmer, A. L. M.; Brinkmann, A. O.; Niermeijer, M. F.; Bakker, L.; Halley, D. J. J.; Drop, S. L. S.: Germ-line and somatic mosaicism in the androgen insensitivity syndrome: implications for genetic counseling. (Letter) Am. J. Hum. Genet. 60:1003-1006, 1997.

Boehmer, A. L. M.; Brinkmann, A. O.; Nijman, R. M.; Verleun-Mooijman, M. C. T.; de Ruiter, P.; Niermeijer, M. F.; Drop, S. L. S.: Phenotypic variation in a family with partial androgen insensitivity syndrome explained by differences in 5-alpha dihydrotestosterone availability. J. Clin. Endocr. Metab. 86:1240-1246, 2001.

Bouvattier, C.; Carel, J.-C.; Lecointre, C.; David, A.; Sultan, C.; Bertrand, A.-M., Morel, Y.; Chaussain, J.-L.: Postnatal changes of T, LH, and FSH in 46, XY infants with mutations in the AR gene. J. Clin. Endocr. Metab. 87:29-32, 2002.

Brown, C. J.; Goss, S. J.; Lubahn, D. B.; Joseph, D. R.; Wilson, E. M.; French, F. S.; Willard, H. F.: Androgen receptor locus on the human X chromosome: regional localization to Xq11-12 and description of a DNA polymorphism. Am. J. Hum. Genet. 44:264-269, 1989.

Brown, T. R.; Lubahn, D. B.; Wilson, E. M.; Joseph, D. R.; French, F. S.; Migeon, C. J.: Deletion of the steroid-binding domain of the human androgen receptor gene in one family with complete androgenin sensitivity syndrome: evidence for further genetic heterogeneity in this syndrome. Proc. Nat. Acad. Sci. 85:8151-8155, 1988.

Bruggenwirth, H. T.; Boehmer, A. L. M.; Ramnarain, S.; Verleun-Mooijman, M. C. T.; Satijn, D. P. E.; Trapman, J.; Grootegoed, J. A.; Brinkmann, A. O.: Molecular analysis of the androgen-receptor gene in a family with receptor-positive partial androgen insensitivity: an unusual type of intronic mutation. Am. J. Hum. Genet. 61:1067-1077, 1997.

Buchanan, G.; Yang, M.; Harris, J. M.; Nahm, H. S.; Han, G.; Moore, N.; Bentel, J. M.; Matusik, R. J.; Horsfall, D. J.; Marshall, V. R.; Greenberg, N. M.; Tilley, W. D.: Mutations at the boundary of the hinge and ligand binding domain of the androgen receptor confer increased transactivation function. Molec. Endocr. 15:46-56, 2001.

Butler, R.; Leigh, P. N.; McPhaul, M. J.; Gallo, J.-M.: Truncated forms of the androgen receptor are associated with polyglutamine expansion in X-linked spinal and bulbar muscular atrophy. Hum. Molec. Genet. 7:121-127, 1998.

Masutani, C.; Sugasawa, K.; Yanagisawa, J.; Sonoyama, T.; Ui, M.; Enomoto, T.; Takio, K.; Tanaka, K.; van der Spek, P. J.; Bootsma, D.; Hoeijmakers, J. H. J.; Hanaoka, F.: Purification and cloning of a nucleotide excision repair complex involving the xeroderma pigmentosum group C protein and a human homologue of yeast RAD23. EMBO J. 13:1831-1843, 1994.

Coovert, D. D.; Le, T. T.; McAndrew, P. E.; Strasswimmer, J.; Crawford, T. O.; Mendell, J. R.; Coulson, S. E.; Androphy, E. J.; Prior, T. W.; Burghes, A. H. M.: The survival motor neuron protein in spinal muscular atrophy. Hum. Molec. Genet. 6:1205-1214, 1997.

Koken, M. H. M.; Reynolds, P.; Jaspers-Dekker, I.; Prakash, L.; Prakash, S.; Bootsma, D.; Hoeijmakers, J. H. J.: Structural and functional conservation of two human homologs of the yeast DNA repair gene RAD6. Proc. Nat. Acad. Sci. 88:8865-8869, 1991.

Calvo, R. M.; Asuncion, M.; Sancho, J.; San Millan, J. L.; Escobar-Morreale, H. F.: The role of the CAG repeat polymorphism in the androgen receptor gene and of skewed X-chromosome inactivation, in the pathogenesis of hirsutism. J. Clin. Endocr. Metab. 85:1735-1740, 2000.

Gao, X.; Copeland, N. G.; Gilbert, D. J.; Jenkins, N. A.; Gridley, T.: Assignment of the murine Notch2 and Notch3 genes to chromosomes 3 and 17. Genomics 49:160-161, 1998.

Larsson, C.; Lardelli, M.; White, I.; Lendahl, U.: The human NOTCH1, 2, and 3 genes are located at chromosome positions 9q34, 1p13-p11, and 19p13.2-p13.1 in regions of neoplasia-associated translocation. Genomics 24:253-258, 1994.

Dichgans, M.; Herzog, J.; Gasser, T.: NOTCH3 mutation involving three cysteine residues in a family with typical CADASIL. Neurology 57:1714-1717, 2001.

Joutel, A.; Corpechot, C.; Ducros, A.; Vahedi, K.; Chabriat, H.; Mouton, P.; Alamowitch, S.; Domenga, V.; Cecillion, M.; Marechal, E.; Maciazek, J.; Vayssiere, C.; Cruaud, C.; Cabanis, E.-A.; Ruchoux, M. M.; Weissenbach, J.; Bach, J. F.; Bousser, M. G.; Tournier-Lasserve, E.: Notch3 mutations in CADASIL, a hereditary adult-onset condition causing stroke and dementia. Nature 383:707-710, 1996.

Joutel, A.; Dodick, D. D.; Parisi, J. E.; Cecillon, M.; Tournier-Lasserve, E.; Bousser, M. G.: De novo mutation in the Notch3 gene causing CADASIL. Ann. Neurol. 47:388-391, 2000.

Joutel, A.; Vahedi, K.; Corpechot, C.; Troesch, A.; Chabriat, H.; Vayssiere, C.; Cruaud, C.; Maciazek, J.; Weissenbach, J.; Bousser, M.-G.; Bach, J.-F.; Tournier-Lasserve, E.: Strong clustering and stereotyped nature of Notch3 mutations in CADASIL patients. Lancet 350:1511-1515, 1997.

Rebay, I.; Fehon, R. G.; Artavanis-Tsakonas, S.: Specific truncations of Drosophila Notch define dominant activated and dominant negative forms of the receptor. Cell 74:319-329, 1993.

Deed, R. W.; Hirose, T.; Mitchell, E. L. D.; Santibanez-Koref, M. F.; Norton, J. D.: Structural organisation and chromosomal mapping of the human Id-3 gene. Gene 151:309-314, 1994.

Ellmeier, W.; Aguzzi, A.; Kleiner, E.; Kurzbauer, R.; Weith, A.: Mutually exclusive expression of a helix-loop-helix gene and N-mycin human neuroblastomas and in normal development. EMBO J. 11:2563-2571,1992.

Kee, B. L.; Rivera, R. R.; Murre, C.: Id3 inhibits B lymphocyte progenitor growth and survival in response to TGF-beta. Nature Immun. 2:242-247, 2001.

Lyden, D.; Young, A. Z.; Zagzag, D.; Yan, W.; Gerald, W.; O'Reilly, R.; Bader, B. L.; Hynes, R. O.; Zhuang, Y.; Manova, K.; Benezra, R.: Id1 and Id3 are required for neurogenesis, angiogenesis and vascularization of tumour xenografts. Nature 401:670-677, 1999.

Pan, L.; Sato, S.; Frederick, J. P.; Sun, X.-H.; Zhuang, Y.: Impaired immune responses and B-cell proliferation in mice lacking the Id3gene. Molec. Cell. Biol. 19:5969-5980, 1999.

Yeh, K.; Lim, R. W.: Genomic organization and promoter analysis of the murine Id3 gene. Gene 254:163-171, 2000.

Braun, A.; Kammerer, S.; Weissenhorn, W.; Weiss, E. H.; Cleve, H.: Sequence of a putative human housekeeping gene (HK33) localized on chromosome 1. Gene 146:291-295, 1994.

Gotte, K.; Girzalsky, W.; Linkert, M.; Baumgart, E.; Kammerer, S.; Kunau, W.-H.; Erdmann, R.: Pex19p, a farnesylated protein essential for peroxisome biogenesis. Molec. Cell. Biol. 18:616-628, 1998.

James, G. L.; Goldstein, J. L.; Pathak, R. K.; Anderson, R. G. W.; Brown, M. S.: PxF, a prenylated protein of peroxisomes J. Biol. Chem. 269:14182-14190, 1994.

Kammerer, S.; Arnold, N.; Gutensohn, W.; Mewes, H.-W.; Kunau, W.-H.; Hofler, G.; Roscher, A. A.; Braun, A.: Genomic organization and molecular characterization of a gene encoding HsPXF, a human peroxisomal farnesylated protein. Genomics 45:200-210, 1997.

Caskey, C. T.; Pizzuti, A.; Fu, Y.-H.; Fenwick, R. G., Jr.; Nelson, D. L.: Triplet repeat mutations in human disease. Science 256:784-789, 1992.

Chang, B.; Zheng, S. L.; Hawkins, G. A.; Isaacs, S. D.; Wiley, K. E.; Turner, A.; Carpten, J. D.; Bleecker, E. R.; Walsh, P. C.; Trent, J. M.; Meyers, D. A.; Isaacs, W. B.; Xu, J.: Polymorphic GGC repeats in the androgen receptor gene are associated with hereditary and sporadic prostate cancer risk. Hum. Genet. 110:122-129, 2002.

Chang, C.; Kokontis, J.; Liao, S.: Molecular cloning of human and rat complementary DNA encoding androgen receptors. Science 240:324-326, 1988.

Choong, C. S.; Kemppainen, J. A.; Zhou, Z.-X.; Wilson, E. M.:Reduced androgen receptor gene expression with first exon CAG repeat expansion. Molec. Endocr. 10:1527-1535, 1996.

Choong, C. S.; Quigley, C. A.; French, F. S.; Wilson, E. M.:A novel missense mutation in the amino-terminal domain of the human androgen receptor gene in a family with partial androgen insensitivity syndrome causes reduced efficiency of protein translation. J. Clin. Invest. 98:1423-1431, 1996.

Chu, J.; Zhang, R.; Zhao, Z.; Zou, W.; Han, Y.; Qi, Q.; Zhang, H.; Wang, J.-C.; Tao, S.; Liu, X.; Luo, Z.: Male fertility is compatible with an Arg840Cys substitution in the AR in a large Chinese family with divergent phenotypes of AR insensitivity syndrome. J. Clin. Endocr. Metab. 87:347-351, 2002.

Coetzee, G. A.; Ross, R. K.: Re: Prostate cancer and the androgen receptor. (Letter) J. Nat. Cancer Inst. 86:872-873, 1994.

Correa-Cerro, L.; Wohr, G.; Haussler, J.; Berthon, P.; Drelon, E.; Mangin, P.; Fournier, G.; Cussenot, O.; Kraus, P.; Just, W.; Paiss, T.; Cantu, J. M.; Vogel, W.: (CAG) nCAA and GGN repeats in the human androgen receptor gene are not associated with prostate cancer in a French-German population. Europ. J. Hum. Genet. 7:347-362, 1999.

Dowsing, A. T.; Yong, E. L.; Clark, M.; McLachlan, R. I.; de Kretser, D. M.; Trounson, A. O.: Linkage between male infertility and trinucleotide repeat expansion in the androgen-receptor gene. Lancet 354:640-643,1999.

Elo, J. P.; Kvist, L.; Leinonen, K.; Isomaa, V.; Hentuu, P.; Lukkarinen, O.; Vihko, P.: Mutated human androgen receptor gene detected in a prostatic cancer patient is also activated by estradiol. J. Clin. Endocr. Metab. 80:3494-3500, 1995.

Gaddipati, J. P.; McLeod, D. G.; Heidenberg, H. B.; Sesterhenn, I. A.; Finger, M. J.; Moul, J. W.; Srivastava, S.: Frequent detection of codon 877 mutation in the androgen receptor gene in advanced prostate cancers. Cancer Res. 54:2861-2864, 1994.

Gehring, U.; Tomkins, G. M.: Characterization of a hormone receptor defect in the androgen-insensitivity mutant. Cell 3:59-64, 1974.

Gingrich, J. R.; Barrios, R. J.; Kattan, M. W.; Nahm, H. S.; Finegold, M. J.; Greenberg, N. M.: Androgen-independent prostate cancer progression in the TRAMP model. Cancer Res. 57:4687-4691, 1997.

Gingrich, J. R.; Greenberg, N. M.: A transgenic mouse prostate cancer model. Toxicol. Path. 24:502-504, 1996.

Giovannucci, E.; Stampfer, M. J.; Krithivas, K.; Brown, M.; Brufsky, A.; Talcott, J.; Hennekens, C. H.; Kantoff, P. W.: The CAG repeat within the androgen receptor gene and its relationship to prostate cancer. Proc. Nat. Acad. Sci. 94:3320-3323, 1997.

Gottlieb, B.; Beitel, L. K.; Trifiro, M. A.: Variable expressivity and mutation databases: the androgen receptor gene mutations database. Hum. Mutat. 17:382-388, 2001.

Gottlieb, B.; Trifiro, M.; Lumbroso, R.; Pinsky, L.: The androgen receptor gene mutations database. Nucleic Acids Res. 25:158-162,1997.

Gottlieb, B.; Trifiro, M.; Lumbroso, R.; Vasiliou, D. M.; Pinsky, L.: The androgen receptor gene mutations database. Nucleic Acids Res. 24:151-154, 1996.

Griffin, J. E.: Androgen resistance--the clinical and molecular spectrum. New Eng. J. Med. 326:611-618, 1992.

Grino, P. B.; Isidro-Gutierrez, R. F.; Griffin, J. E.; Wilson, J. D.: Androgen resistance associated with a qualitative abnormality of the androgen receptor and responsive to high dose androgen therapy. J. Clin. Endocr. Metab. 68:578-584, 1989.

Hardy, D. O.; Scher, H. I.; Bogenreider, T.; Sabbatini, P.; Zhang, Z.-F.; Nanus, D. M.; Catterall, J. F.: Androgen receptor CAG repeat lengths in prostate cancer: correlation with age of onset. J. Clin. Endocr. Metab. 81:4400-4405, 1996.

Hellwinkel, O. J.-C.; Holterhus, P.-M.; Struve, D.; Marschke, C.; Homburg, N.; Hiort, O.: A unique exonic splicing mutation in the human androgen receptor gene indicates a physiologic relevance of regular androgen receptor transcript variants. J. Clin. Endocr. Metab. 86:2569-2575, 2001.

Hickey, T.; Chandy, A.; Norman, R. J.: The androgen receptor CAG repeat polymorphism and X-chromosome inactivation in Australian Caucasian women with infertility related to polycystic ovary syndrome. J. Clin. Endocr. Metab. 87:161-165, 2002.

Hiort, O.; Sinnecker, G. H. G.; Holterhus, P.-M.; Nitsche, E. M.; Kruse, K.: Inherited and de novo androgen receptor gene mutations: investigation of single-case families. J. Pediat. 132:939-943,1998.

Holterhus, P.-M.; Bruggenwirth, H. T.; Hiort, O.; Kleinkauf-Houcken, A.; Kruse, K.; Sinnecker, G. H. G.; Brinkmann, A. O.: Mosaicism due to a somatic mutation of the androgen receptor gene determines phenotype in androgen insensitivity syndrome. J. Clin. Endocr. Metab. 82:3584-3589, 1997.

Shibuya, H.; Yamaguchi, K.; Shirakabe, K.; Tonegawa, A.; Gotoh, Y.; Ueno, N.; Irie, K.; Nishida, E.; Matsumoto, K.: TAB1: an activator of the TAK1 MAPKKK in TGF-beta signal transduction. Science 272:1179-1182, 1996.

Chadwick, B. P.; Obermayr, F.; Frischauf, A.-M.: FKHL15, a new human member of the forkhead gene family located on chromosome 9q22. Genomics 41:390-396, 1997.

De Felice, M.; Ovitt, C.; Biffali, E.; Rodriguez-Mallon, A.; Arra, C.; Anastassiadis, K.; Macchia, P. E.; Mattei, M.-G.; Mariano, A.; Scholer, H.; Macchia, V.; Di Lauro, R.: A mouse model for hereditary thyroid dysgenesis and cleft palate. Nature Genet. 19:395-398,1998.

Kaufmann, E.; Knochel, W.: Five years on the wings of fork head. Mech. Dev. 57:3-20, 1996.

Manley, N. R.; Capecchi, M. R.: Hox group 3 paralogs regulate the development and migration of the thymus, thyroid, and parathyroid gland. Dev. Biol. 195:1-15, 1998.

Toublanc, J. E.: Comparison of epidemiological data on congenital hypothyroidism in Europe with those of other parts in the world. Horm. Res. 38:230-235, 1992.

Zannini, M.; Avantaggiato, V.; Biffali, E.; Arnone, M. I.; Sato, K.; Pischetola, M.; Taylor, B. A.; Phillips, S. J.; Simeone, A.; DiLauro, R.: TTF-2, a new forkhead protein, shows a temporal expression in the developing thyroid which is consistent with a role in controlling the onset of differentiation. EMBO J. 16:3185-3197, 1997.

Boyd, J. M.; Subramanian, T.; Schaeper, U.; La Regina, M.; Bayley, S.; Chinnadurai, G.: A region in the C-terminus of adenovirus 2/5E1a protein is required for association with a cellular phosphoprotein and important for the negative modulation of T24-ras mediated transformation, tumorigenesis and metastasis. EMBO J. 469-478, 1993.

Furusawa, T.; Moribe, H.; Kondoh, H.; Higashi, Y.: Identification of CtBP1 and CtBP2 as corepressors of zinc finger-homeodomain factor delta-EF1. Molec. Cell. Biol. 19:8581-8590, 1999.

Katsanis, N.; Fisher, E. M. C.: A novel C-terminal binding protein (CTBP2) is closely related to CTBP1, an adenovirus E1A-binding protein, and maps to human chromosome 21q21.3. Genomics 47:294-299, 1998.

Schaeper, U.; Boyd, J. M.; Verma, S.; Uhlmann, E.; Subramanian, T.; Chinnadurai, G.: Molecular cloning and characterization of a cellular phosphoprotein that interacts with a conserved C-terminal domain of adenovirus E1A involved in negative modulation of oncogenic transformation. Proc. Nat. Acad. Sci. 92:10467-10471, 1995.

Sewalt, R. G. A. B.; Gunster, M. J.; van der Vlag, J.; Satijn, D. P. E.; Otte, A. P.: C-terminal binding protein is a transcriptional repressor that interacts with a specific class of vertebrate polycomb proteins. Molec. Cell. Biol. 19:777-787, 1999.

Zhang, Q.; Piston, D. W.; Goodman, R. H.: Regulation of corepressor function by nuclear NADH. Science 295:1895-1897, 2002.

Adra, C. N.; Kobayashi, H.; Rowley, J. D.; Lim, B.: Assignment of the human GDID4 gene, a GDP/GTP-exchange regulator, to chromosome 12p12.3. Genomics 24:188-190, 1994.

Leffers, H.; Nielsen, M. S.; Andersen, A. H.; Honore, B.; Madsen, P.; Vandekerckhove, J.; Celis, J. E.: Indentification of two human Rho GDP dissociation inhibitor proteins whose overexpression leads to disruption of the actin cytoskeleton. Exp. Cell Res. 209:165-174,1993.

Lelias, J.-M.; Adra, C. N.; Wulf, G. M.; Guillemot, J.-C.; Khagad, M.; Caput, D.; Lim, B.: cDNA cloning of a human mRNA preferentially expressed in hematopoietic cells and with homology to a GDP-dissociation inhibitor for the rho GTP-binding proteins. Proc. Nat. Acad. Sci. 90:1479-1483, 1993.

Scherle, P.; Behrens, T.; Staudt, L. M.: Ly-GDI, a GDP-dissociation inhibitor of the RhoA GTP-binding protein, is expressed preferentially in lymphocytes. Proc. Nat. Acad. Sci. 90:7568-7572, 1993.

Ishikawa, K.; Nagase, T.; Suyama, M.; Miyajima, N.; Tanaka, A.; Kotani, H.; Nomura, N.; Ohara, O.: Prediction of coding sequences of unidentified human genes. X. The complete sequences of 100 new cDNA clones from brain which can code for large proteins in vitro. DNA Res. 5:169-176, 1998.

Waldegger, S.; Erdel, M.; Nagl, U. O.; Barth, P.; Raber, G.; Steuer, S.; Utermann, G.; Paulmichl, M.; Lang, F.: Genomic organization and chromosomal localization of the human SGK protein kinase gene. Genomics 51:299-302, 1998.

Webster, M. K.; Goya, L.; Ge, Y.; Maiyar, A. C.; Firestone, G. L.: Characterization of sgk, a novel member of the serine/threonine protein kinase gene family which is transcriptionally induced by glucocorticoids and serum. Molec. Cell. Biol. 13:2031-2040, 1993.

Aoki, K.; Ishida, R.; Kasai, M.: Isolation and characterization of a cDNA encoding a translin-like protein, TRAX. FEBS Lett. 401:109-112, 1997.

Meng, G.; Aoki, K.; Tokura, K.; Nakahara, K.; Inazawa, J.; Kasai, M.: Genomic structure and chromosomal localization of the gene encoding TRAX, a translin-associated factor X. J. Hum. Genet. 45:305-308,2000.

Eudy, J. D.; Yao, S.; Weston, M. D.; Ma-Edmonds, M.; Talmadge, C. B.; Cheng, J. J.; Kimberling, W. J.; Sumegi, J.: Isolation of a gene encoding a novel member of the nuclear receptor superfamily from the critical region of Usher syndrome type IIa at 1q41. Genomics 50:382-384, 1998.

Greschik, H.; Wurtz, J.-M.; Sanglier, S.; Bourguet, W.; van Dorsselaer, A.; Moras, D.; Renaud, J.-P.: Structural and functional evidence for ligand-independent transcriptional activation by the estrogen-related receptor 3. Molec. Cell 9:303-313, 2002.

Quintana, D. G.; Hou, Z.; Thome, K. C.; Hendricks, M.; Saha, P.; Dutta, A.: Identification of HsORC4, a member of the human origin of replication recognition complex. J. Biol. Chem. 272:28247-28251,1997.

Eki, T.; Dean, F. B.; Kohda, A.; Okumura, K.; Abe, M.; Murakami, Y.; Ishiai, M.; Satomoto, K.; Hurwitz, J.; O'Donnell, M.; Hanaoka, F.: Assignment1 of the homologue of the yeast origin recognition complex subunit ORC4 (ORC4L) to human chromosome band 2q22-q23 by in situ hybridization and somatic cell hybrid analysis. Cytogenet. Cell Genet. 81:89-90, 1998.

Matsuyoshi, N.; Imamura, S.: Multiple cadherins are expressed in human fibroblasts. Biochem. Biophys. Res. Commun. 235:355-358,1997.

Bertilsson, G.; Heidrich, J.; Svensson, K.; Asman, M.; Jendeberg, L.; Sydow-Backman, M.; Ohlsson, R.; Postlind, H.; Blomquist, P.; Berkenstam, A.: Identification of a human nuclear receptor defines a new signaling pathway for CYP3A induction. Proc. Nat. Acad. Sci. 95:12208-12213,1998.

Blumberg, B.; Sabbagh, W., Jr.; Juguilon, H.; Bolado, J., Jr.; van Meter, C. M.; Ong, E. S.; Evans, R. M.: SXR, a novel steroid and xenobiotic-sensing nuclear receptor. Genes Dev. 12:3195-3205,1998.

Watkins, R. E.; Wisely, G. B.; Moore, L. B.; Collins, J. L.; Lambert, M. H.; Williams, S. P.; Willson, T. M.; Kliewer, S. A.; Redinbo, M. R.: The human nuclear xenobiotic receptor PXR: structural determinants of directed promiscuity. Science 292:2329-2333, 2001.

Adato, A.; Raskin, L.; Petit, C.; Bonne-Tamir, B.: Deafness heterogeneity in a Druze isolate from the Middle East: novel OTOF and PDS mutations, low prevalence of GJB2 35delG mutation and indication for a new DFNB locus. Europ. J. Hum. Genet. 8:437-442, 2000.

Yasunaga, S.; Grati, M.; Chardenoux, S.; Smith, T. N.; Friedman, T. B.; Lalwani, A. K.; Wilcox, E. R.; Petit, C.: OTOF encodes multiple long and short isoforms: genetic evidence that the long ones underlie recessive deafness DFNB9. Am. J. Hum. Genet. 67:591-600, 2000.

Yasunaga, S.; Petit, C.: Physical map of the region surrounding the OTOFERLIN locus on chromosome 2p22-p23. Genomics 66:110-112,2000.

McGwire, G. B.; Tan, F.; Michel, B.; Rehli, M.; Skidgel, R. A.: Identification of a membrane-bound carboxypeptidase as the mammalian homolog of duck gp180, a hepatitis B virus-binding protein. LifeSci. 60:715-724, 1997.

Riley, D. A.; Tan, F.; Miletich, D. J.; Skidgel, R. A.: Chromosomal localization of the genes for human carboxypeptidase D (CPD) and the active 50-kilodalton subunit of human carboxypeptidase N (CPN1). Genomics 50:105-108, 1998.

Tan, F.; Rehli, M.; Krause, S. W.; Skidgel, R. A.: Sequence of human carboxypeptidase D reveals it to be a member of the regulatory carboxypeptidase family with three tandem active site domains. Biochem. J. 327:81-87, 1997.

Gebhard, W.; Schube, M.; Eulitz, M.: cDNA cloning and complete primary structure of the small, active subunit of human carboxypeptidaseN (kininase 1). Eur. J. Biochem. 178:603-607, 1989.

Skidgel, R. A.; Bennett, C. D.; Schilling, J. W.; Tan, F.; Weerasinghe, D. K.; Erdos, E. G.: Amino acid sequence of the N-terminus and selected tryptic peptides of the active subunit of human plasma carboxypeptidaseN: comparison with other carboxypeptidases. Biochem. Biophys. Res. Commun. 154:1323-1329, 1988.

Rajadhyaksha, A. Riviere, M.; Van Vooren, P.; Szpirer, J.; Szpirer, C.; Babin, J.; Bina, M.: Assignment of AR1, transcription factor 20 (TCF20), to human chromosome 22q13.3 with somatic cell hybrids and in situ hybridization. Cytogenet. Cell Genet. 81:176-177, 1998.

Sanz, L.; Moscat, J.; Diaz-Meco, M. T.: Molecular characterization of a novel transcription factor that controls stromelysin expression. Molec. Cell. Biol. 15:3164-3170, 1995.

Ding, H.; Descheemaeker, K.; Marynen, P.; Nelles, L.; Carvalho, T.; Carmo-Fonseca, M.; Collen, D.; Belayew, A.: characterization of a helicase-like transcription factor involved in the expression of the human plasminogen activator inhibitor-1 gene. DNA Cell Biol. 15:429-442, 1996.

Lin, Y.; Sheridan, P. L.; Jones, K. A.; Evans, G. A.: The HIP116SNF2/SWI2-related transcription factor gene (SNF2L3) is located on human chromosome 3q25.1-q26.1 Genomics 27:381-382, 1995.

Moinova, H. R.; Chen, W.-D.; Shen, L.; Smiraglia, D.; Olechnowicz, J.; Ravi, L.; Kasturi, L.; Myeroff, L.; Plass, C.; Parsons, R.; Minna, J.; Willson, J. K. V.; Green, S. B.; Issa, J.-P.; Markowitz, S. D.: HLTF gene silencing in human colon cancer. Proc. Nat. Acad. Sci. 99:4562-4567, 2002.

Sheridan, P. L.; Schorpp, M.; Voz, M. L.; Jones, K. A.: Cloning of an SNF2/SWI2-related protein that binds specifically to the SPH motifs of the SV40 enhancer and to the HIV-1 promoter. J. Biol. Chem. 270:4575-4587, 1995.

Ambros, P. F.; Schmid, J.; Rumpler, S.; Binder, B. R.; de Martin, R.: Localization of the human I-kappa-B kinase-beta (IKBKB) to chromosome 8p11.2 by fluorescence in situ hybridization and radiation hybrid mapping. Genomics 54:575-576, 1998.

Pasparakis, M.; Courtois, G.; Hafner, M.; Schmidt-Supprian, M.; Nenci, A.; Toksoy, A.; Krampert, M.; Goebeler, M.; Gillitzer, R.; Israel, A.; Krieg, T.; Rajewsky, K.; Haase, I.: TNF-mediated inflammatory skin disease in mice with epidermis-specific deletion of IKK2. Nature 417:861-866, 2002.

Rossi, A.; Kapahi, P.; Natoli, G.; Takahashi, T.; Chen, Y.; Karin, M.; Santoro, M. G.: Anti-inflammatory cyclopentenone prostaglandins are direct inhibitors of I-kappa-B kinase. Nature 403:103-108,2000.

Shindo, M.; Nakano, H.; Sakon, S.; Yagita, H.; Mihara, M.; Okumura, K.: Assignment of I-kappa-B kinase beta (IKBKB)

to human chromosome band 8p12-p11 by in situ hybridization. Cytogenet. Cell Genet. 82:32-33, 1998.

Tang, G.; Yang, J.; Minemoto, Y.; Lin, A.: Blocking caspase-3-mediated proteolysis of IKK-beta suppresses TNF-alpha-induced apoptosis. Molec. Cell 8:1005-1016, 2001.

Woronicz, J. D.; Gao, X.; Cao, Z.; Rothe, M.; Goeddel, D. V.: IkappaB kinase-beta: NF-kappa-B activation and complex formation with IkappaB kinase-alpha and NIK. Science 278:866-869, 1997.

Yin, M.-J.; Yamamoto, Y.; Gaynor, R. B.: The anti-inflammatory agents aspirin and salicylate inhibit the activity of I-kappa-B kinase-beta. Nature 396:77-80, 1998.

Zandi, E.; Rothwarf, D. M.; Delhase, M.; Hayakawa, M.; Karin, M.: The IkappaB kinase complex (IKK) contains two kinase subunits, IKK alpha and IKK beta, necessary for IkappaB phosphorylation and NF-kappa-B activation. Cell 91:243-252, 1997.

Aoki, M.; Hamada, F.; Sugimoto, T.; Sumida, S.; Akiyama, T.; Toyoshima, K.: The human cot proto-oncogene encodes two protein serine/threonine kinases with different transforming activities by alternative initiation of translation. J. Biol. Chem. 268:22723-22732, 1993.

Guan, K.-L.; Jenkins, C. W.; Li, Y.; Nichols, M. A.; Wu, X.; O'Keefe, C. L.; Matera, A. G.; Xiong, Y.: Growth suppression by p18, a p16(INK4/MTS1)-and p14(INK4B/MTS2)-related CDK6 inhibitor, correlates with wild-type pRb function. Genes Dev. 8:2939-2952, 1994.

Blais, A.; Labrie, Y.; Pouliot, F.; Lachance, Y.; Labrie, C.: Structure of the gene encoding the human cyclin-dependent kinase inhibitor p18 and mutational analysis in breast cancer. Biochem. Biophys. Res. Commun. 247:146-153, 1998.

Lapointe, J.; Lachance, Y.; Labrie, Y.; Labrie, C.: A p18 mutant defective in CDK6 binding in human breast cancer cells. Cancer Res. 56:4586-4589, 1996.

Bontemps, Y.; Maquart, F.-X.; , Wegrowski, Y.: Human UDP-glucose dehydrogenase gene: complete cloning and transcription start mapping. Biochem. Biophys. Res. Commun. 275:981-985, 2000.

Hempel, J.; Perozich, J.; Romovacek, H.; Hinich, A.; Kuo, I.; Feingold, D. S.: UDP-glucose dehydrogenase from bovine liver: primary structure and relationship to other dehydrogenases. Protein Sci. 3:1074-1080,1994.

Marcu, O.; Stathakis, D. G.; Marsh, J. L.: Assignment of the UGDH locus encoding UDP-glucose dehydrogenase to human chromosome band 4p15.1 by radiation hybrid mapping. Cytogenet. Cell Genet. 86:244-245,1999.

Spicer, A. P.; Kaback, L. A.; Smith, T. J.; Seldin, M. F.: molecular cloning and characterization of the human and mouse UDP-glucose dehydrogenase genes. J. Biol. Chem. 273:25117-25124, 1998.

Walsh, E. C.; Stainier, D. Y. R.: UDP-glucose dehydrogenase required for cardiac valve formation in zebra fish. Science 293:1670-1674,2001.

Bernard, M.; Sanseau, P.; Henry, C.; Couturier, A.; Prigent, C.: Cloning of STK13, a third human protein kinase related to Drosophila Aurora and budding yeast Ipl1 that maps on chromosome 19q13.3-ter. Genomics 53:406-409, 1998.

Tseng, T.-C.; Chen, S.-H.; Hsu, Y.-P. P.; Tang, T. K.: Protein kinase profile of sperm and eggs: cloning and characterization of two novel testis-specific protein kinases (AIE1, AIE2) related to yeast and fly chromosome segregation regulators. DNA Cell Biol. 17:823-833, 1998.

Phillips, N. J.; Zeigler, M. R.; Deaven, L. L.: A cDNA from the ovarian cancer critical region of deletion on chromosome 17p13.3. Cancer Lett. 102:85-90, 1996.

Schultz, D. C.; Vanderveer, L.; Berman, D. B.; Hamilton, T. C.; Wong, A. J.; Godwin, A. K.: Identification of two candidate tumor suppressor genes on chromosome 17p13.3. Cancer Res. 56:1997-2002,1996.

Peyrard, M.; Parveneh, S.; Lagercrantz, S.; Ekman, M.; Fransson, I.; Sahlen, S.; Dumanski, J. P.: Cloning, expression pattern, and chromosomal assignment to 16q23 of the human gamma-adaptin gene (ADTG). Genomics 50:275-280, 1998.

Andre, E.; Conquet, F.; Steinmayr, M.; Stratton, S. C.; Porciatti, V.; Becker-Andre, M.: Disruption of retinoid-related orphan receptor beta changes circadian behavior, causes retinal degeneration and leads to vacillans phenotype in mice. EMBO J. 17:3867-3877, 1998.

Paravicini, G.; Steinmayr, M.; Andre, E.; Becker-Andre, M.: The metastasis suppressor candidate nucleotide diphosphate kinase NM23specifically interacts with members of the ROR/RZR nuclear orphan receptor subfamily. Biochem. Biophys. Res. Commun. 227:82-87, 1996.

Sirlin, J. L.: Vacillans, a neurological mutant in the house mouse linked with brown. J. Genet. 54:42-48, 1956.

Vidal-Puig, A.; Solanes, G.; Grujic, D.; Flier, J. S.; Lowell, B. B.: UCP3: an uncoupling protein homologue expressed preferentially and abundantly in skeletal muscle and brown adipose tissue. Biochem. Biophys. Res. Commun. 235:79-82, 1997.

Vidal-Puig, A. J.; Grujic, D.; Zhang, C.-Y.; Hagen, T.; Boss, O.; Ido, Y.; Szczepanik, A.; Wade, J.; Mootha, V.; Cortright, R.; Muoio, D. M.; Lowell, B. B.: Energy metabolism in uncoupling protein 3 gene knockout mice. J. Biol. Chem. 275:16258-16266, 2000.

Berthelsen, J.; Viggiano, L.; Schulz, H.; Ferretti, E.; Consalez, G. G.; Rocchi, M.; Blasi, F.: PKNOX1, a gene encoding PREP1, a new regulator of Pbx activity, maps on human chromosome 21q22.3 and murine chromosome 17B/C. Genomics 47:323-324, 1998.

Chen, H.; Rossier, C.; Nakamura, Y.; Lynn, A.; Chakravarti, A.; Antonarakis, S. E.: Cloning of a novel homeobox-containing gene, PKNOX1, and mapping to human chromosome 21q22.3. Genomics 41:193-200,1997.

Tribioli, C.; Frasch, M.; Lufkin, T.: Bapx1: an evolutionary conserved homologue of the Drosophila bagpipe homeobox gene is expressed in splanchnic mesoderm and the embryonic skeleton. Mech. Dev. 65:145-162,1997.

Tribioli, C.; Lufkin, T.: Molecular cloning, chromosomal mapping and developmental expression of BAPX1, a novel human homeobox-containing gene homologous to Drosophila bagpipe. Gene 203:225-233, 1997.

Yoshiura, K.-I.; Murray, J. C.: Sequence and chromosomal assignment of human BAPX1, a bagpipe-related gene, to 4p16.1: a candidate gene for skeletal dysplasia. Genomics 45:425-428, 1997.

de Coo, R. F. M.; Buddiger, P.; Smeets, H. J. M.; van Oost, B. A.: Molecular cloning and characterization of the human mitochondrial NADH: oxidoreductase 10-kDa gene (NDUFV3). Genomics 45:434-437,1997.

Fritzler, M. J.; Lung, C.-C.; Hamel, J. C.; Griffith, K. J.; Chan, E. K. L.: Molecular characterization of golgin-245, a novel Golgi complex protein containing a granin signature. J. Biol. Chem. 270:31262-31268, 1995.

Bianchi, M. C.; Tosetti, M.; Fornai, F.; Alessandri, M. G.; Cipriani, P.; De Vito, G.; Canapicchi, R.: Reversible brain creatine deficiency in two sisters with normal blood creatine level. Ann. Neurol. 47:511-513, 2000.

Humm, A.; Fritsche, E.; Mann, K.; Gohl, M.; Huber, R.: Recombinant expression and isolation of human L-arginine: glycine amidinotransferase and identification of its active-site cysteine residue. Biochem. J. 322:771-776, 1997.

Humm, A.; Huber, R.; Mann, K.: The amino acid sequences of human and pig L-arginine:glycine amidinotransferase. FEBS Lett. 339:101-107, 1994.

Item, C. B.; Stockler-Ipsiroglu, S.; Stromberger, C.; Muhl, A.; Alessandri, M. G.; Bianchi, M. C.; Tosetti, M.; Fornai, F.; Cioni, G.: Arginine: glycine amidinotransferase deficiency: the third inborn error of creatine metabolism in humans. Am. J. Hum. Genet. 69:1127-1133, 2001.

Yasuda, H.; Shima, N.; Nakagawa, N.; Yamaguchi, K.; Kinosaki, M.; Mochizuki, S.; Tomoyasu, A.; Yano, K.; Goto, M.; Murakami, A.; Tsuda, E.; Morinaga, T.; Higashio, K.; Udagawa, N.; Takahashi, N.; Suda, T.: Osteoclast differentiation factor is a ligand for osteoprotegerin/osteoclastogenesis-inhibitory factor and is identical to TRANCE/RANKL. Proc. Nat. Acad. Sci. 95:3597-3602, 1998.

Heard, D. J.; Norby, P. L.; Holloway, J.; Vissing, H.: Human ERR-gamma, a third member of the estrogen receptor-related receptor (ERR) subfamily of orphan nuclear receptors: tissue-specific isoforms are expressed during development in the adult. Molec. Endocr. 14:382-392, 2000.

Hong, H.; Yang, L.; Stallcup, M. R.: Hormone-independent transcriptional activation and coactivator binding by novel orphan nuclear receptor ERR3. J. Biol. Chem. 274:22618-22626, 1999.

Billin, A. N.; Eilers, A. L.; Queva, C.; Ayer, D. E.: Mlx, a novel Max-like BHLHZip protein that interacts with the Max network of transcription factors. J. Biol. Chem. 274:36344-36350, 1999.

Bjerknes, M.; Cheng, H.: TCFL4: a gene at 17q21.1 encoding a putative basic helix-loop-helix leucine-zipper transcription factor. Gene 181:7-11, 1996.

Cairo, S.; Merla, G.; Urbinati, F.; Ballabio, A.; Reymond, A.: WBSCR14, a gene mapping to the Williams-Beuren syndrome deleted region, is a new member of the Mlx transcription factor network. Hum. Molec. Genet. 10:617-627, 2001.

Kooy, J.; Toh, B.-H.; Pettitt, J. M.; Erlich, R.; Gleeson, P. A.: Human autoantibodies as reagents to conserved Golgi components: characterization of a peripheral, 230-kDa compartment-specific Golgi protein. J. Biol. Chem. 267:20255-20263, 1992.

Buckbinder, L.; Velasco-Miguel, S.; Chen, Y.; Xu, N.; Talbott, R.; Gelbert, L.; Gao, J.; Seizinger, B. R.; Gutkind, J. S.; Kley, N.: The p53 tumor suppressor targets a novel regulator of G protein signaling. Proc. Nat. Acad. Sci. 94:7868-7872, 1997.

Chen, C.-K.; Wieland, T.; Simon, M. I.: RGS-r, a retinal specific RGS protein, binds an intermediate conformation of transducin and enhances recycling. Proc. Nat. Acad. Sci. 93:12885-12889, 1996.

Snow, B. E.; Antonio, L.; Suggs, S.; Siderovski, D. P.: Cloning of a retinally abundant regulator of G-protein signaling (RGS-r/RGS16): genomic structure and chromosomal localization of the human gene. Gene 206:247-253, 1998.

Zheng, B.; Chen, D.; Farquhar, M. G.: MIR16, a putative membrane glycerophosphodiester phosphodiesterase, interacts with RGS16. Proc. Nat. Acad. Sci. 97:3999-4004, 2000.

LeBoeuf, R. C.; Caldwell, M.; Guo, Y.; Metz, C.; Davitz, M. A.; Olson, L. K.; Deeg, M. A.: Mouse glycosyl phosphatidyl inositol-specific phospholipase D (Gpld1) characterization. Mammalian Genome 9:710-714, 1998.

Scallon, B. J.; Fung, W.-J. C.; Tsang, T. C.; Li, S.; Kado-Fong, H.; Huang, K.-S.; Kochan, J. P.: Primary structure and functional activity of a phosphatidyl inositol-glycan-specific phospholipase D. Science 252:446-448, 1991.

Schofield, J. N.; Rademacher, T. W.: Structure and expression of the human glycosyl phosphatidyl inositol phospholipase D1 (GPLD1) gene. Biochim. Biophys. Acta 1494:189-194, 2000.

Tsang, T. C.; Fung, W.-J.; Levine, J.; Metz, C. N.; Davitz, M. A.; Burns, D. K.; Huang, K.-S.; Kochan, J. P.: Isolation and expression of two human glycosyl phosphatidyl inositol phospholipase D (GPI-PLD) cDNAs. (Abstract) FASEB J. (supp.) 6: A1922 only, 1992.

Schmitz, F.; Konigstorfer, A.; Sudhof, T. C.: RIBEYE, a component of synaptic ribbons: a protein's journey through evolution provides insight into synaptic ribbon function. Neuron 28:857-872, 2000.

Bergelson, J. M.; Cunningham, J. A.; Droguett, G.; Kurt-Jones, E. A.; Krithivas, A.; Hong, J. S.; Horwitz, M. S.; Crowell, R. L.; Finberg, R. W.: Isolation of a common receptor for coxsackie B viruses and adenoviruses 2 and 5. Science 275:1320-1323, 1997.

Bowles, K. R.; Gibson, J.; Wu, J.; Shaffer, L. G.; Towbin, J. A.; Bowles, N. E.: Genomic organization and chromosomal localization of the human coxsackie virus B-adenovirus receptor gene. Hum. Genet. 105:354-359, 1999.

Carson, S. D.; Chapman, N. N.; Tracy, S. M.: Purification of the putative coxsackie virus B receptor from HeLa cells. Biochem. Biophys. Res. Commun. 233:325-328, 1997.

Griffin, J. D.; Kearney, D.; Ni, J.; Jaffe, R.; Fricker, F. J.; Webber, S.; Demmler, G.; Gelb, B. D.; Towbin, J. A.: Analysis of formalin-fixed and frozen myocardial autopsy samples for viral genome in childhood myocarditis and dilated cardiomyopathy with endocardial fibroelastosis using polymerase chain reaction (PCR). Cardiovasc. Path. 4:3-11, 1995.

Martin, A. B.; Webber, S.; Fricker, F. J.; Jaffe, R.; Demmler, G.; Kearney, D.; Zhang, Y.-H.; Bodurtha, J.; Gelb, B.; Ni, J.; Bricker, J. T.; Towbin, J. A.: Acute myocarditis: rapid diagnosis by PCR in children. Circulation 90:330-339, 1994.

Pauschinger, M.; Bowles, N. E.; Fuentes-Garcia, F. J.; Pham, V.; Kuhl, U.; Schwimmbeck, P. L.; Schultheiss, H.-P.; Towbin, J. A.: Detection of adenoviral genome in the myocardium of adult patients with idiopathic left ventricular dysfunction. Circulation 99:1348-1354, 1999.

Tomko, R. P.; Xu, R.; Philipson, L.: HCAR and MCAR: the human and mouse receptors for subgroup C adenoviruses and group B coxsackie viruses. Proc. Nat. Acad. Sci. 94:3352-3356, 1997.

Margolis, R. L.; Abraham, M. R.; Gatchell, S. B.; Li, S.-H.; Kidwai, A. S.; Breschel, T. S.; Stine, O. C.; Callahan, C.; McInnis, M. G.; Ross, C. A.: cDNAs with long CAG trinucleotide repeats from human brain. Hum. Genet. 100:114-122, 1997.

Dale, M.; Hammond, D. W.; Cox, A.; Nicklin, M. J. H.: The human gene encoding the interleukin-1 receptor accessory protein (IL1RAP) maps to chromosome 3q28 by fluorescence in situ hybridization and radiation hybrid mapping. Genomics 47:325-326, 1998.

Huang, J.; Gao, X.; Li, S.; Cao, Z.: Recruitment of IRAK to the interleukin 1 receptor complex requires interleukin 1 receptor accessory protein. Proc. Nat. Acad. Sci. 94:12829-12832, 1997.

Wesche, H.; Korherr, C.; Kracht, M.; Falk, W.; Resch, K.; Martin, M. U.: The interleukin-1 receptor accessory protein (IL-1RAcP) is essential for IL-1-induced activation of interleukin-1 receptor-associated kinase (IRAK) and stress-activated protein kinases (SAP kinases). J. Biol. Chem. 272:7727-7731, 1997.

Saha, P.; Chen, J.; Thome, K. C.; Lawlis, S. J.; Hou, Z.-H.; Hendricks, M.; Parvin, J. D.; Dutta, A.: Human CDC6/Cdc18 associates with Orc1 and cyclin-cdk and is selectively eliminated from the nucleus at the onset of S phase. Molec. Cell. Biol. 18:2758-2767, 1998.

Williams, R. S.; Shohet, R. V.; Stillman, B.: A human protein related to yeast Cdc6p. Proc. Nat. Acad. Sci. 94:142-147, 1997.

Yan, Z.; DeGregori, J.; Shohet, R.; Leone, G.; Stillman, B.; Nevins, J. R.; Williams, R. S.: Cdc6 is regulated by E2F and is essential for DNA replication in mammalian cells. Proc. Nat. Acad. Sci. 95:3603-3608, 1998.

Brais, B.; Bouchard, J.-P.; Xie, Y.-G.; Rochefort, D. L.; Chretien, N.; Tome, F. M. S.; Lafreniere, R. G.; Rommens, J. M.; Uyama, E.; Nohira, O.; Blumen, S.; Korczyn, A. D.; Heutink, P.; Mathieu, J.; Duranceau, A.; Codere, F.; Fardeau, M.; Rouleau, G. A.: Short GCG expansions in the PABP2 gene cause oculopharyngeal muscular dystrophy. Nature Genet. 18:164-167, 1998. Note: Erratum: Nature Genet. 19:404 only,1998.

Calado, A.; Tome, F. M. S.; Brais, B.; Rouleau, G. A.; Kuhn, U.; Wahle, E.; Carmo-Fonseca, M.: Nuclear inclusions in oculopharyngeal muscular dystrophy consist of poly (A) binding protein 2 aggregates which sequester poly (A) RNA. Hum. Molec. Genet. 9:2321-2328, 2000.

Fan, X.; Dion, P.; Laganiere, J.; Brais, B.; Rouleau, G. A.: Oligomerization of polyalanine expanded PABPN1 facilitates nuclear protein aggregation that is associated with cell death. Hum. Molec. Genet. 10:2341-2351,2001.

Aoki, N.; Ishii, T.; Ohira, S.; Yamaguchi, Y.; Negi, M.; Adachi, T.; Nakamura, R.; Matsuda, T.: Stage specific expression of milk fat globule membrane glycoproteins in mouse mammary gland: comparison of MFG-E8, butyrophilin, and CD36 with a major milk protein, beta-casein. Biochim. Biophys. Acta 1334:182-190, 1997.

Collins, C.; Nehlin, J. O.; Stubbs, J. D.; Kowbel, D.; Kuo, W.-L.; Parry, G.: Mapping of a newly discovered human gene homologous to the apoptosis associated-murine mammary protein, MFG-E8, to chromosome 15q25. Genomics 39:117-118, 1997.

Haggqvist, B.; Naslund, J.; Sletten, K.; Westermark, G. T.; Mucchiano, G.; Tjernberg, L. O.; Nordstedt, C.; Engstrom, U.; Westermark, P.: Medin: an integral fragment of aortic smooth muscle cell-produced lactadherin forms the most common human amyloid. Proc. Nat. Acad. Sci. 96:8669-8674, 1999.

Hanayama, R.; Tanaka, M.; Miwa, K.; Shinohara, A.; Iwamatsu, A.; Nagata, S.: Identification of a factor that links apoptotic cells to phagocytes. Nature 417:182-187, 2002.

Larocca, D.; Peterson, J. A.; Urrea, R.; Kuniyoshi, J.; Bistrain, A. M.; Ceriani, R. L.: A M(r) 46,000 human milk fat globule protein that is highly expressed in human breast tumors contains factor VIII-like domains. Cancer Res. 51:4994-4998, 1991.

Stubbs, J. D.; Lekutis, C.; Singer, K. L.; Bui, A.; Yuzuki, D.; Srinivasan, U.; Parry, G.: cDNA cloning of a mouse mammary epithelial cell surface protein reveals the existence of epidermal growth factor-like domains linked to factor VIII-like sequences. Proc. Nat. Acad. Sci. 87:8417-8421, 1990.

Zhang, J.; Kuehl, P.; Green, E. D.; Touchman, J. W.; Watkins, P. B.; Daly, A.; Hall, S. D.; Maurel, P.; Relling, M.; Brimer, C.; Yasuda, K.; Wrighton, S. A.; Hancock, M.; Kim, R. B.; Strom, S.; Thummel, K.; Russell, C. G.; Hudson, J. R., Jr.; Schuetz, E. G.; Boguski, M. S.: The human pregnane X receptor: genomic structure and identification and functional characterization of natural allelic variants. Pharmacogenetics 11:555-572, 2001.

Su, L.-K.; Qi, Y.: Characterization of human MAPRE genes and their proteins. Genomics 71:143-149, 2001.

Arai, T.; Akiyama, Y.; Okabe, S.; Ando, M.; Endo, M.; Yuasa, Y.: Genomic structure of the human Smad3 gene and its infrequent alterations in colorectal cancers. Cancer Lett. 122:157-163, 1998.

Zhang, Y.; Feng, X.-H.; Wu, R.-Y.; Derynck, R.: Receptor-associated Mad homologues synergize as effectors of the TGF-beta response. Nature 383:168-172, 1996.

Zhu, Y.; Richardson, J. A.; Parada, L. F.; Graff, J. M.: Smad3 mutant mice develop metastatic colorectal cancer. Cell 94:703-714,1998.

Bruno, E.; Horrigan, S. K.; Van Den Berg, D.; Rozler, E.; Fitting, P. R.; Moss, S. T.; Westbrook, C.; Hoffman, R.: The Smad5 gene is involved in the intracellular signaling pathways that mediate the inhibitory effects of transforming growth factor-beta on human hematopoiesis. Blood 91:1917-1923, 1998.

Gemma, A.; Hagiwara, K.; Vincent, F.; Ke, Y.; Hancock, A. R.; Nagashima, M.; Bennett, W. P.; Harris, C. C.: hSmad5 gene, a human hSmad family member: its full length cDNA, genomic structure, promoter region and mutation analysis in human tumors. Oncogene 16:951-956, 1998.

Tan, K. B.; Harrop, J.; Reddy, M.; Young, P.; Terrett, J.; Emery, J.; Moore, G.; Truneh, A.: Characterization of a novel TNF-like ligand and recently described TNF ligand and TNF receptor superfamily genes and their constitutive and inducible expression in hematopoietic and non-hematopoietic cells. Gene 204:35-46, 1997.

Bonini, J. A.; Martin, S. K.; Dralyuk, F.; Roe, M. W.; Philipson, L. H.; Steiner, D. F.: Cloning, expression, and chromosomal mapping of a novel human CC-chemokine receptor (CCR10) that displays high-affinity binding for MCP-1 and MCP-3. DNA Cell Biol. 16:1249-1256, 1997.

Nibbs, R. J. B.; Wylie, S. M.; Yang, J.; Landau, N. R.; Graham, G. J.: Cloning and characterization of a novel promiscuous human beta-chemokine receptor D6. J. Biol. Chem. 272:32078-32083, 1997.

Zieger, B.; Tran, H.; Hainmann, I.; Wunderle, D.; Zgaga-Griesz, A.; Blaser, S.; Ware, J.: Characterization and expression analysis of two human septin genes, PNUTL1 and PNUTL2. Gene 261:197-203,2000.

Brandt, S.; Jentsch, T. J.: ClC-6 and ClC-7 are two novel broadly expressed members of the CLC chloride channel family. FEBS Lett. 377:15-20, 1995.

Eggermont, J.; Buyse, G.; Voets, T.; Tytgat, J.; De Smedt, H.; Droogmans, G.: Alternative splicing of ClC-6 (a member of the ClC chloride-channel family) transcripts generates three truncated isoforms one of which, ClC-6c, is kidney-specific. Biochem. J. 325:269-276,1997.

Cleiren, E.; Benichou, O.; Van Hul, E.; Gram, J.; Bollerslav, J.; Singer, F. R.; Beaverson, K.; Aledo, A.; Whyte, M. P.; Yoneyama, T.; deVernejou, M.-C.; Van Hul, W.: Albers-Schonberg disease (autosomal dominant osteopetrosis, type II) results from mutations in the ClCN7chloride channel gene. Hum. Molec. Genet. 10:2861-2867, 2001.

Hedblom, E.; Kirkness, E. F.: A novel class of GABA-A receptor subunit in tissues of the reproductive system. J. Biol. Chem. 272:15346-15350, 1997.

Chung, E.; Hanukoglu, A.; Rees, M.; Thompson, R.; Dillon, M.; Hanukoglu, I.; Bistritzer, T.; Kuhnle, U.; Seckl, J.; Gardiner, R. M.: exclusion of the locus for autosomal recessive pseudohypoaldosteronism type1 from the mineralocorticoid receptor gene region on human chromosome 4q by linkage analysis. J. Clin. Endocr. Metab. 80:3341-3345, 1995.

Nagase, T.; Ishikawa, K.; Suyama, M.; Kikuno, R.; Hirosawa, M.; Miyajima, N.; Tanaka, A.; Kotani, H.; Nomura, N.; Ohara, O.: Prediction of the coding sequences of unidentified human genes. XIII. The complete sequences of 100 new cDNA clones from brain which code for large proteins in vitro. DNA Res. 6:63-70, 1999.

Arico, M.; Imashuku, S.; Clementi, R.; Hibi, S.; Teramura, T.; Danesino, C.; Haber, D. A.; Nichols, K. E.: Hemophagocytic lymphohistiocytosis due to germline mutations in SH2D1A, the X-linked lymphoproliferative disease gene. Blood 97:1131-1133, 2001.

Arkwright, P. D.; Makin, G.; Will, A. M.; Ayres, M.; Gokhale, D. A.; Fergusson, W. D.; Taylor, G. M.: X linked lymphoproliferative disease in a United Kingdom family. Arch. Dis. Child. 79:52-55,1998.

Bar, R. S.; DeLor, C. J.; Clausen, K. P.; Hurtubise, P.; Henle, W.; Hewetson, J. F.: Fatal infectious mononucleosis in a family. NewEng. J. Med. 290:363-367, 1974.

Benoit, L.; Wang, X.; Pabst, H. F.; Dutz, J.; Tan, R.: Cutting edge: defective NK cell activation in X-linked lymphoproliferative disease. J. Immun. 165:3549-3553, 2000.

Coffey, A. J.; Brooksbank, R. A.; Brandau, O.; Oohashi, T.; Howell, G. R.; Bye, J. M.; Cahn, A. P.; Durham, J.; Heath, P.; Wray, P.; Pavitt, R.; Wilkinson, J.; and 31 others: Host response to EBV infection in X-linked lymphoproliferative disease results from mutations in an SH2-domain encoding gene. Nature Genet. 20:129-135, 1998.

Brandau, O.; Schuster, V.; Weiss, M.; Hellebrand, H.; Fink, F. M.; Kreczy, A.; Friedrich, W.; Strahm, B.; Niemeyer, C.; Belohradsky, B. H.; Meindl, A.: Epstein-Barr virus-negative boys with non-Hodgkin lymphoma are mutated in the SH2D1A gene, as are patients with X-linked lymphoproliferative disease (XLP). Hum. Molec. Genet. 8:2407-2413, 1999.

Czar, M. J.; Kersh, E. N.; Mijares, L. A.; Lanier, G.; Lewis, J.; Yap, G.; Chen, A.; Sher, A.; Duckett, C. S.; Ahmed, R.; Schwartzberg, P. L.: Altered lymphocyte responses and cytokine production in mice deficient in the X-linked lymphoproliferative disease gene SH2D1A/DSHP/SAP. Proc. Nat. Acad. Sci. 98:7449-7454, 2001.

Dutz, J. P.; Benoit, L.; Wang, X.; Demetrick, D. J.; Junker, A.; de Sa, D.; Tan, R.: Lymphocytic vasculitis in X-linked lymphoproliferative disease. Blood 97:95-100, 2001.

Grierson, H. L.; Skare, J.; Church, J.; Silberman, T.; Davis, J. R.; Kobrinsky, N.; McGregor, R.; Israels, S.; McCarty, J.; Andrews, L. G.; Blecha, T.; Erdman, S.; Obringer, A.; Scharnhorst, D.; Purtilo, D. T.: Evaluation of families wherein a single male manifests a phenotype of X-linked lymphoproliferative disease (XLP). Am. J. Med. Genet. 47:458-463, 1993.

Hambleton, G.; Cottom, D. G.: Familial lymphoma. Proc. Roy. Soc. Med. 62:1095 only, 1969.

Hamilton, J. K.; Paquin, L. A.; Sullivan, J. L.; Maurer, H. S.; Cruzi, F. G.; Provisor, A. J.; Steuber, C. P.; Hawkins, E.; Yawn, D.; Cornet, J.; Clausen, K.; Finkelstein, G. Z.; Landing, B.; Grunnet, M.; Purtilo, D. T.: X-linked lymphoproliferative syndrome registry report. J. Pediat. 96:669-673, 1980.

Harris, A.; Docherty, Z.: X-linked lymphoproliferative disease: a karyotype analysis. Cytogenet. Cell Genet. 47:92-94, 1988.

Harris, A.; Lenoir, G. M.; Lankester, S. A.: X-linked lymphoproliferative disease: linkage studies using DNA probes. Clin. Genet. 33:162-168,1988.

Hayoz, D.; Lenoir, G. M.; Nicole, A.; Pugin, P.; Regamey, C.: X-linked lymphoproliferative syndrome: identification of a large family in Switzerland. Am. J. Med. 84:529-534, 1988.

Klein, G.; Klein, E.: Sinking surveillance's flagship. Nature 395:441-445, 1998.

Levine, P. H.; Kamaraju, L. S.; Connelly, R. R.; Berard, C. W.; Dorfman, R. F.; Magrath, I.; Easton, J. M.: The American Burkitt's Lymphoma Registry: eight years' experience. Cancer 49:1016-1022,1982.

Loeffel, S.; Chang, C.-H.; Heyn, R.; Harada, S.; Lipscomb, H.; Sinangil, F.; Volsky, D. J.; McClain, K.; Ochs, H.; Purtilo, D. T.: Necrotizing lymphoid vasculitis in X-linked lymphoproliferative syndrome. Arch. Path. Lab. Med. 109:546-550, 1985.

Lyon, M. F.; Loutit, J. F.: X-linked factor in acquired immunodeficiency syndrome?. (Letter) Lancet I:768 only, 1983.

Mulley, J. C.; Turner, A. M.; Gedeon, A. K.; Berdoukas, V. A.; Huang, T. H. M.; Ledbetter, D. H.; Grierson, H.; Purtilo, D. T.:X-linked lymphoproliferative disease: prenatal detection of an unaffected histocompatible male. Clin. Genet. 42:76-79, 1992.

Eva, A.; Aaronson, S. A.: Isolation of a new human oncogene from a diffuse B-cell lymphoma. Nature 316:273-275, 1985.

Anderson, S. R.; Warburg, M.: Norrie's disease. Arch. Ophthal. 66:614-618, 1961.

Bergen, A. A. B.; Wapenaar, M. C.; Schuurman, E. J. M.; Diergaarde, P. J.; Lerach, H.; Monaco, A. P.; Bakker, E.; Bleeker-Wagemakers, E. M.; van Ommen, G. J. B.: Detection of a new submicroscopic Norrie disease deletion interval with a novel DNA probe isolated by differential Alu PCR fingerprint cloning. Cytogenet. Cell Genet. 62:231-235,1993.

Berger, W.; Meindl, A.; van de Pol, T. J. R.; Cremers, F. P. M.; Ropers, H. H.; Doerner, C.; Monaco, A.; Bergen, A. A. B.; Lebo, R.; Warburg, M.; Zergollern, L.; Lorenz, B.; Gal, A.; Bleeker-Wagemakers, E. M.; Meitinger, T.: Isolation of a candidate gene for Norrie disease by positional cloning. Nature Genet. 1:199-203, 1992.

Berger, W.; van de Pol, D.; Bachner, D.; Oerlemans, F.; Winkens, H.; Hameister, H.; Wieringa, B.; Hendriks, W.; Ropers, H.-H.: An animal model for Norrie disease (ND): gene targeting of the mouse ND gene. Hum. Molec. Genet. 5:51-59, 1996.

Eva, A.; Vecchio, G.; Rao, C. D.; Tronick, S. R.; Aaronson, S. A.: The predicted DBL oncogene product defines a distinct class of transforming proteins. Proc. Nat. Acad. Sci. 85:2061-2065, 1988.

Galland, F.; Stefanova, M.; Lafage, M.; Birnbaum, D.: Localization of the 5-prime end of the MCF2 oncogene to human chromosome 15q15-q23. Cytogenet. Cell Genet. 60:114-116, 1992.

Grant, S. G.; Mattei, M.-G.; Galland, F.; Stephenson, D. A.; Keitz, B. T.; Birnbaum, D.; Chapman, V. M.: Localization of the mouse Mcf-2(Dbl) proto-oncogene within a conserved linkage group on the mouse X chromosome. Cytogenet. Cell Genet. 54:175-181, 1990.

Nguyen, C.; Pontarotti, P.; Birnbaum, D.; Chimini, G.; Rey, J. A.; Mattei, J.-F.; Jordan, B. R.: Large scale physical mapping in the q27 region of the human X chromosome: the coagulation factor IX gene and the mcf.2 transforming sequence are separated by at most 270 kilobase pairs and are surrounded by several 'HTF islands.' EMBO J. 6:3285-3289, 1987.

Nguyen, C.; Poustka, A.-M.; Djabali, M.; Roux, D.; Mattei, J.-F.; Lehrach, H.; Jordan, B. R.: Large-scale mapping and chromosome jumping in the q27 region of the human X chromosome. Genomics 5:298-303,1989.

Noguchi, T.; Mattei, M.-G.; Oberle, I.; Planche, J.; Imbert, J.; Pelassy, C.; Birg, F.; Birnbaum, D.: Localization of the mcf.2 transforming sequence to the X chromosome. EMBO J. 6:1301-1307, 1987.

Ron, D.; Tronick, S. R.; Aaronson, S. A.; Eva, A.: Molecular cloning and characterization of the human DBL protooncogene: evidence that its overexpression is sufficient to transform NIH/3T3 cells. EMBO J. 7:2465-2473, 1988.

Srivastava, S. K.; Wheelock, R. H. P.; Aaronson, S. A.; Eva, A.: Identification of the protein encoded by the human diffuse B-cell lymphoma (dbl) oncogene. Proc. Nat. Acad. Sci. 83:8868-8872, 1986.

Tronick, S. R.; McBride, O. W.; Popescu, N. C.; Eva, A.: Chromosomal localization of DBL oncogene sequences. Genomics 5:546-553, 1989.

Giovane, A.; Sobieszczuk, P.; Mignon, C.; Mattei, M.-G.; Wasylyk, B.: Locations of the ets subfamily members net, elk1, and sap1 (ELK3, ELK1, and ELK4) on three homologous regions of the mouse and human genomes. Genomics 29:769-772, 1995.

Janz, M.; Lehmann, U.; Olde Weghuis, D.; de Leeuw, B.; Geurts vanKessel, A.; Gilgenkrantz, S.; Hipskind, R. A.; Nordheim, A.: Refined mapping of the human Ets-related gene Elk-1 to Xp11.2-p11.4, distal to the OATL1 region. Hum. Genet. 94:442-444, 1994.

Rao, V. N.; Huebner, K.; Isobe, M.; ar-Rushdi, A.; Croce, C. M.; Reddy, E. S. P.: Elk, tissue-specific ets-related genes on chromosomes X and 14 near translocation breakpoints. Science 244:66-70, 1989.

Tamai, Y.; Taketo, M.; Nozaki, M.; Seldin, M. F.: Mouse Elk oncogene maps to chromosome X and a novel Elk oncogene (Elk3) maps to chromosome 10. Genomics 26:414-416, 1995.

Yamauchi, T.; Toko, M.; Suga, M.; Hatakeyama, T.; Isobe, M.: Structural organization of the human Elk1 gene and its processed pseudogene Elk2. DNA Res. 6:21-27, 1999.

Bermingham, J. R., Jr.; Scherer, S. S.; O'Connell, S.; Arroyo, E.; Kalla, K. A.; Powell, F. L.; Rosenfeld, M. G.: Tst-1/Oct-6/SCIP regulates a unique step in peripheral myelination and is required for normal respiration. Genes Dev. 10:1751-1762, 1996.

Jaegle, M.; Mandemakers, W.; Broos, L.; Zwart, R.; Karis, A.; Visser, P.; Grosveld, F.; Meijer, D.: The POU factor Oct-6 and Schwann cell differentiation. Science 273:507-510, 1996.

Sumiyama, K.; Washio-Watanabe, K.; Ono, T.; Yoshida, M. C.; Hayakawa, T.; Ueda, S.:Human class III POU genes, POU3F1 and POU3F3, map to chromosomes 1p34.1 and 3p14.1. Mammalian Genome 9:180-181, 1998.

Costache, M.; Apoil, P.-A.; Cailleau, A.; Elmgren, A.; Larson, G.; Henry, S.; Blancher, A.; Iordachescu, D.; Oriol, R.; Mollicone, R.: Evolution of fucosyl transferase genes in vertebrates. J. Biol. Chem. 272:29721-29728, 1997.

Yanagidani, S.; Uozumi, N.; Ihara, Y.; Miyoshi, E.; Yamaguchi, N.; Taniguchi, N.: Purification and cDNA cloning of GDP-L-Fuc:N-acetyl-beta-D-glucosaminide:alpha-1-6 fucosyl transferase (alpha-1-6 FucT) from human gastric cancer MKN45 cells. J. Biochem. 121:626-632, 1997.

Bekri, S.; Adelaide, J.; Merscher, S.; Grosgeorge, J.; Caroli-Bosc, F.; Perucca-Lostanlen, D.; Kelley, P. M.; Pebusque, M.-J.; Theillet, C.; Birnbaum, D.; Gaudray, P.: Detailed map of a region commonly amplified at 11q13-q14 in human breast carcinoma. Cytogenet. Cell Genet. 79:125-131, 1997.

Wright, R. M.; Vaitaitis, G. M.; Wilson, C. M.; Repine, T. B.; Terada, L. S.; Repine, J. E.: cDNA cloning, characterization, and tissue-specific expression of human xanthine dehydrogenase/xanthineoxidase. Proc. Nat. Acad. Sci. 90:10690-10694, 1993.

Kawabata, M.; Saeki, K.: Multiple alternative transcripts of the human homologue of the mouse TRAD/R51H3/RAD51D gene, a member of the rec A/RAD51 gene family. Biochem. Biophys. Res. Commun. 257:156-162,1999.

Pittman, D. L.; Weinberg, L. R.; Schimenti, J. C.: Identification, characterization, and genetic mapping of Rad51d, a new mouse and human RAD51/RecA-related gene. Genomics 49:103-111, 1998.

Bell, B.; Scheer, E.; Tora, L.: Identification of hTAFII80-delta links apoptotic signaling pathways to transcription factor TFIID function. Molec. Cell 8:591-600, 2001.

Hisatake, K.; Ohta, T.; Takada, R.; Guermah, M.; Horikoshi, M.; Nakatani, Y.; Roeder, R. G.: Evolutionary conservation of human TATA-binding-polypeptide-associated factors TAFII31 and TAFII80 and interactions of TAFII80 with other TAFs and with general transcription factors. Proc. Nat. Acad. Sci. 92:8195-8199, 1995.

Weinzierl, R. O. J.; Ruppert, S.; Dynlacht, B. D.; Tanese, N.; Tjian, R.: Cloning and expression of Drosophila TAFII60 and human TAFII70 reveal conserved interactions with other subunits of TFIID. EMBO J. 12:5303-5309, 1993.

Tsai, K. J.; Chen, S. K.; Ma, Y. L.; Hsu, W. L.; Lee, E. H. Y.: sgk, a primary glucocorticoid-induced gene, facilitates memory consolidation of spatial learning in rats. Proc. Nat. Acad. Sci. 99:3990-3995,2002.

Waldegger, S.; Barth, P.; Raber, G.; Lang, F.: Cloning and characterization of a putative human serine/threonine protein kinase transcriptionally modified during anisotonic and isotonic alterations of cell volume. Proc. Nat. Acad. Sci. 94:4440-4445, 1997.

Mackay, D. J. G.; Coupe, A.-M.; Shield, J. P. H.; Storr, J. N. P.; Temple, I. K.; Robinson, D. O.: Relaxation of imprinted expression of ZAC and HYMAI in a patient with transient neonatal diabetes mellitus. Hum. Genet. 110:139-144, 2002.

Spengler, D.; Villalba, M.; Hoffmann, A.; Pantaloni, C.; Houssami, S.; Bockaert, J.; Journot, L.: Regulation of apoptosis and cell cycle arrest by Zac1, a novel zinc finger protein expressed in the pituitary gland and the brain. EMBO J. 16:2814-2825, 1997.

Temple, I. K.; James, R. S.; Crolla, J. A.; Sitch, F. L.; Jacobs, P. A.; Howell, W. M.; Betts, P.; Baum, J. D.; Shield, J. P. H.: An imprinted gene (s) for diabetes? (Letter) Nature Genet. 9:110-112,1995.

Varrault, A.; Ciani, E.; Apiou, F.; Bilanges, B.; Hoffmann, A.; Pantaloni, C.; Bockaert, J.; Spengler, D.; Journot, L.: hZAC encodes a zinc finger protein with antiproliferative properties and maps to a chromosomal region frequently lost in cancer. Proc. Nat. Acad. Sci. 95:8835-8840, 1998.

Jiang, Y.-W.; Veschambre, P.; Erdjument-Bromage, H.; Tempst, P.; Conaway, J. W.; Conaway, R. C.; Kornberg, R. D.: Mammalian mediator of transcriptional regulation and its possible role as an end-point of signal transduction pathways. Proc. Nat. Acad. Sci. 95:8538-8543,1998.

Abdollahi, A.; Godwin, A. K.; Miller, P. D.; Getts, L. A.; Schultz, D. C.; Taguchi, T.; Testa, J. R.; Hamilton, T. C.: Identification of a gene containing zinc-finger motifs based on lost expression in malignantly transformed rat ovarian surface epithelial cells. Cancer Res. 57:2029-2034, 1997.

Abdollahi, A.; Roberts, D.; Godwin, A. K.; Schultz, D. C.; Sonoda, G.; Testa, J. R.; Hamilton, T. C.: Identification of a zinc-finger gene at 6q25: a chromosomal region implicated in development of many solid tumors. Oncogene 14:1973-1979, 1997.

Kamiya, M.; Judson, H.; Okazaki, Y.; Kusakabe, M.; Muramatsu, M.; Takada, S.; Takagi, N.; Arima, T.; Wake, N.; Kamimura, K.; Satomura, K.; Hermann, R.; Bonthron, D. T.; Hayashizaki, Y.: The cell cycle control gene ZAC/PLAGL1 is imprinted: a strong candidate gene for transient neonatal diabetes. Hum. Molec. Genet. 9:453-460, 2000.

Ide, H.; Katoh, M.; Sasaki, H.; Yoshida, T.; Aoki, K.; Nawa, Y.; Osada, Y.; Sugimura, T.; Terada, M.: Cloning of human bone morphogenetic protein type 1B receptor (BMPR-1B) and its expression in prostate cancer in comparison with other BMPRs. Oncogene 14:1377-1382, 1997.

ten Dijke, P.; Yamashita, H.; Ichijo, H.; Franzen, P.; Laiho, M.; Miyazono, K.; Heldin, C.-H.: Characterization of type I receptors for transforming growth factor-beta and activin. Science 264:101-104,1994.

Blixt, A.; Mahlapuu, M.; Bjursell, C.; Darnfors, C.; Johannesson, T.; Enerback, S.; Carlsson, P.: The two-exon gene of the human forkhead transcription factor FREAC-2 (FKHL6) is located at 6p25.3. Genomics 53:387-390, 1998.

Bai, C.; Connolly, B.; Metzker, M. L.; Hilliard, C. A.; Liu, X.; Sandig, V.; Soderman, A.; Galloway, S. M.; Liu, Q.; Austin, C. P.; Caskey, C. T.: Overexpression of M68/DCR3 in human gastrointestinal tract tumors independent of gene amplification and its location in a four-gene cluster. Proc. Nat. Acad. Sci. 97:1230-1235, 2000.

Pitti, R. M.; Marsters, S. A.; Lawrence, D. A.; Roy, M.; Kischkel, F. C.; Dowd, P.; Huang, A.; Donahue, C. J.; Sherwood, S. W.; Baldwin, D. T.; Godowski, P. J.; Wood, W. I.; Gurney, A. L.; Hillan, K. J.; Cohen, R. L.; Goddard, A. D.; Botstein, D.; Ashkenazi, A.: Genomic amplification of a decoy receptor for Fas ligand in lung and colon cancer. Nature 396:699-703, 1998.

Fracchiolla, N. S.; Colombo, G.; Finelli, P.; Maiolo, A. T.; Neri, A.: EHT, a new member of the MTG8/ETO gene family, maps on 20q11region and is deleted in acute myeloid leukemias. (Letter) Blood 92:3481-3484, 1998.

Kitabayashi, I.; Ida, K.; Morohoshi, F.; Yokoyama, A.; Mitsuhashi, N.; Shimizu, K.; Nomura, N.; Hayashi, Y.; Ohki, M.: The AML1-MTG8 leukemic fusion protein forms a complex with a novel member of the MTG8(ETO/CDR) family, MTGR1. Molec. Cell. Biol. 18:846-858, 1998.

Nelson, H.; Mandiyan, S.; Noumi, T.; Moriyama, Y.; Miedel, M. C.; Nelson, N.: Molecular cloning of cDNA encoding the C subunit of H(+)-ATPase from bovine chromaffin granules. J. Biol. Chem. 265:20390-20393,1990.

van Hille, B.; Vanek, M.; Richener, H.; Green, J. R.; Bilbe, G.: Cloning and tissue distribution of subunits C, D, and E of the human vacuolar H(+)-ATPase. Biochem. Biophys. Res. Commun. 197:15-21,1993.

Fakruddin, J. M.; Chaganti, R. S. K.; Murty, V. V. V. S.: Lack of BCL10 mutations in germ cell tumors and B cell lymphomas. Cell 97:683-688, 1999.

Isaacson, P. G.; Spencer, J.: The biology of low grade MALT lymphoma. J. Clin. Path. 48:395-397, 1995.

Ruland, J.; Duncan, G. S.; Elia, A.; del Barco Barrantes, I.; Nguyen, L.; Plyte, S.; Millar, D. G.; Bouchard, D.; Wakeham, A.; Ohashi, P. S.; Mak, T. W.: Bcl10 is a positive regulator of antigen receptor-induced activation of NF-kappa-B and neural tube closure. Cell 104:33-42,2001.

Thome, M.; Martinon, F.; Hofmann, K.; Rubio, V.; Steiner, V.; Schneider, P.; Mattmann, C.; Tschopp, J.: Equine herpes virus-2 E10 gene product, but not its cellular homologue, activates NF-kappa-B transcription factor and c-Jun N-terminal kinase. J. Biol. Chem. 274:9962-9968,1999.

Willis, T. G.; Jadayel, D. M.; Du, M.-Q.; Peng, H.; Perry, A. R.; Abdul-Rauf, M.; Price, H.; Karran, L.; Majekodunmi, O.; Wlodarska, I.; Pan, L.; Crook, T.; Hamoudi, R.; Isaacson, P. G.; Dyer, M. J. S.: Bcl10 is involved in t (1;14)(p22; q32) of MALT B cell lymphoma and mutated in multiple tumor types Cell 96:35-45, 1999.

Wotherspoon, A. C.; Pan, L. X.; Diss, T. C.; Isaacson, P. G.: Cytogenetic study of B-cell lymphoma of mucosa-associated lymphoid tissue. Cancer Genet. Cytogenet. 58:35-38, 1992.

Anderson, P.; Nagler-Anderson, C.; O'Brien, C.; Levine, H.; Watkins, S.; Slayter, H. S.; Blue, M. L.; Schlossman, S. F.: A monoclonal antibody reactive with a 15-kDa cytoplasmic granule-associated protein defines a subpopulation of CD8+ T lymphocytes. J. Immun. 144:574-582,1990.

Forch, P.; Puig, O.; Kedersha, N.; Martinez, C.; Granneman, S.; Seraphin, B.; Anderson, P.; Valcarcel, J.: The apoptosis-promoting factor TIA-1 is a regulator of alternative pre-mRNA splicing. Molec. Cell 6:1089-1098, 2000.

Kawakami, A.; Tian, Q.; Streuli, M.; Poe, M.; Edelhoff, S.; Disteche, C. M.; Anderson, P.: Intron-exon organization and chromosomal localization of the human TIA-1 gene. J. Immun. 152:4937-4945, 1994.

Tian, Q.; Streuli, M.; Saito, H.; Schlossman, S. F.; Anderson, P.: A polyadenylate binding protein localized to the granules of cytolytic lymphocytes induces DNA fragmentation in target cells. Cell 67:629-639, 1991.

Zheng, B.; Albrecht, U.; Kaasik, K.; Sage, M.; Lu, W.; Vaishnav, S.; Li, Q.; Sun, Z. S.; Eichele, G.; Bradley, A.; Lee, C. C.: Nonredundant roles of the mPer1 and mPer2 genes in the mammalian circadian clock. Cell 105:683-694, 2001.

Cheng, J.-F.; Boyartchuk, V.; Zhu, Y.: Isolation and mapping of human chromosome 21 cDNA: progress in constructing a chromosome 21expression map. Genomics 23:75-84, 1994.

Sirotkin, H.; O'Donnell, H.; DasGupta, R.; Halford, S.; St. Jore, B.; Puech, A.; Parimoo, S.; Morrow, B.; Skoultchi, A.; Weissman, S. M.; Scambler, P.; Kucherlapati, R.: Identification of a new human catenin gene family member (ARVCF) from the region deleted in velo-cardio-facial syndrome. Genomics 41:75-83, 1997.

Castro, A. M.; Snyder, L. M.: G6PD San Jose: a new variant characterized by NADPH inhibition studies. human genetik 21:361-363, 1974.

Cayanis, E.; Gomperts, E. D.; Balinsky, D.; Disler, P.; Myers, A.: G6PD Hillbrow: a new variant of glucose-6-phosphate dehydrogenase associated with drug-induced haemolytic anaemia. Brit. J. Haemat. 30:343-350, 1975.

Cayanis, E.; Lane, A. B.; Jenkins, T.; Nurse, G. T.; Balinsky, D.: Glucose-6-phosphate dehydrogenase Porbandar: a new slow variant with slightly reduced activity in a South African family of Indian descent. Biochem. Genet. 15:765-773, 1977.

Cederbaum, A. I.; Beutler, E.: Nonspherocytic hemolytic anemia due to G6PD Grand Prairie. I. R. C. S. 3:579, 1975.

Chan, T. K.; Todd, D.: Characteristics and distribution of glucose-6-phosphate dehydrogenase-deficient variants in South China. Am. J. Hum. Genet. 24:475-484, 1972.

Chan, T. K.; Todd, D.; Lai, M. C. S.: Glucose 6-phosphate dehydrogenase:identity of erythrocyte and leukocyte enzyme with report of a new variant in Chinese. Biochem. Genet. 6:119-124, 1972.

Chang, J.-G.; Chiou, S.-S.; Perng, L.-I.; Chen, T.-C.; Liu, T.-C.; Lee, L.-S.; Chen, P.-H.; Tang, T. K.: Molecular characterization of glucose-6-phosphate dehydrogenase (G6PD) deficiency by natural and amplification created restriction sites: five mutations account for most G6PD deficiency cases in Taiwan. Blood 80:1079-1082, 1992.

Chen, E. Y.; Cheng, A.; Lee, A.; Kuang, W.-J.; Hillier, L.; Green, P.; Schlessinger, D.; Ciccodicola, A.; d'urso, M.: Sequence of human glucose-6-phosphate dehydrogenase cloned in plasmids and a yeast artificial chromosome. Genomics 10:792-800, 1991.

Chen, H.-L.; Huang, M.-J.; Huang, C.-S.; Tang, T. K.: G6PD NanKang (517 T-to-C; 173 phe-to-leu): a new Chinese G6PD variant associated with neonatal jaundice. Hum. Hered. 46:201-204, 1996.

Chernyak, N. B.; Batischev, A. I.; Lanzina, N. V.; Tokarev, Y. N.; Alexeyev, G. A.: Electrophoretic and kinetic properties of glucose-6-phosphate dehydrogenase from erythrocytes or patients with hemolytic anemia, related to deficiency of the enzyme activity. Vopr. Med. Khim. 23:166-171, 1977.

Childs, B.; Zinkham, W.; Browne, E. A.; Kimbro, E. L.; Torbert, J. V.: A genetic study of a defect in glutathione metabolism of the erythrocytes. Bull. Johns Hopkins Hosp. 102:21-37, 1958.

Chiu, D. T. Y.; Zuo, L.; Chao, L.; Chen, E.; Louie, E.; Lubin, B.; Liu, T. Z.; Du, C. S.: Molecular characterization of glucose-6-phosphate dehydrogenase (G6PD) deficiency in patients of Chinese descent and identification of new base substitutions in the human G6PD gene. Blood 81:2150-2154, 1993.

Chockkalingam, K.; Board, P. G.: Further evidence for heterogeneity of glucose-6-phosphate dehydrogenase deficiency in Papua New Guinea. Hum. Genet. 56:209-212, 1980.

Chockkalingam, K.; Board, P. G.; Breguet, G.: Glucose-6-phosphate dehydrogenase variants of Bali Island (Indonesia). Hum. Genet. 60:60-62, 1982.

Chockkalingam, K.; Board, P. G.; Nurse, G. T.: Glucose-6-phosphate dehydrogenase deficiency in Papua New Guinea: the description of 13new variants. Hum. Genet. 60:189-192, 1982.

Chuanshu, D.; Yankang, X.; Lin, W. Q. R.; Xiaoyun, H.: Studies on erythrocyte glucose-6-phosphate dehydrogenase variants in Chinese. I. Gd (-) Lizu-Baisha. Acta Acad. Med. Zhong Shan 2:649-658, 1981.

Cocco, P.; Todde, P.; Fornera, S.; Manca, M. B.; Manca, P. Sias, A. R.: Mortality in a cohort of men expressing the glucose-6-phosphate dehydrogenase deficiency. Blood 91:706-709, 1998.

Cohn, J.; Carter, N.; Warburg, M.: Glucose-6-phosphate dehydrogenase deficiency in a native Danish family: a new variant. Scand. J. Haemat. 23:403-406, 1979.

Colonna-Romano, S.; Iolascon, A.; Lippo, S.; Pinto, L.; Cutillo, S.; Battistuzzi, G.: Genetic heterogeneity at the glucose-6-phosphate dehydrogenase locus in southern Italy: a study on the population of Naples. Hum. Genet. 69:228-232, 1985.

Cooper, D. W.; Johnston, P. G.; Murtagh, C. E.; Sharman, G. B.; Vandeberg, J. L.; Poole, W. E.: Sex-linked isozymes and sex-chromosome evolution and inactivation in kangaroos. In: Markeit, C. L.: Isozymes. Developmental Biology. New York: Academic Press (pub.) III:1975. Pp. 559-573.

Cooper, M. R.; Dechatelet, L. R.; McCall, C. E.; Lavia, M. F.; Spurr, C. L.; Baehner, R. L.: Complete deficiency of leukocyte glucose-6-phosphate dehydrogenase with defective bactericidal activity. J. Clin. Invest. 51:769-778, 1972.

Corash, L.; Spielberg, S.; Bartsocas, C.; Boxer, L.; Steinherz, R.; Sheetz, M.; Egan, M.; Schlessleman, J.; Schulman, J. D.: Reduced chronic hemolysis during high-dose vitamin E administration in Mediterranean-type glucose-6-phosphate dehydrogenase deficiency. New Eng. J. Med. 303:416-420, 1980.

Corcoran, C. M.; Calabro, V.; Tamagnini, G.; Town, M.; Haidar, B.; Vulliamy, T. J.; Mason, P. J.; Luzzatto, L.: Molecular heterogeneity underlying the G6PD Mediterranean phenotype. Hum. Genet. 88:688-690,1992.

Costa, E.; Cabeda, J. M.; Vieira, E.; Pinto, R.; Pereira, S. A.; Ferraz, L.; Santos, R.; Barbot, J.: Glucose-6-phosphate dehydrogenase Aveiro: a de novo mutation associated with chronic nonspherocytic hemolytic anemia. Blood 95:1499-1501, 2000.

Crookston, J. H.; Yoshida, A.; Lin, M.; Booser, D. J.: G6PD Toronto. Biochem. Genet. 8:259-265, 1973.

Csepreghy, M.; Hall, M. K.; Berkow, R. L.; Jackson, S.; Prchal, J. T.: Characterization of a new G6PD variant: G6PD Titusville. Am. J. Med. Sci. 297:114-117, 1989.

Csepreghy, M.; Yeilding, A.; Lilly, M.; Hall, K.; Scott, C. W.; Prchal, J. T.: Characterization of a new glucose-6-phosphate dehydrogenase variant: G6PD Central City. Am. J. Hemat. 28:61-62, 1988.

d'urso, M.; Luzzatto, L.; Perroni, L.; Ciccodicola, A.; Gentile, G.; Peluso, I.; Persico, M. G.; Pizzella, T.; Toniolo, D.; Vulliamy, T. J.: An extensive search for RFLP in the human glucose-6-phosphate dehydrogenase locus has revealed a silent mutation in the coding sequence. Am. J. Hum. Genet. 42:735-741, 1988.

Basse, F.; Stout, J. G.; Sims, P. J.; Wiedmer, T.: Isolation of an erythrocyte membrane protein that mediates Ca (2+)-dependent transbilayer movement of phospholipid. J. Biol. Chem. 271:17205-17210, 1996.

Garrett, R. M.; Johnson, J. L.; Graf, T. N.; Feigenbaum, A.; Rajagopalan, K. V.: Human sulfite oxidase R160Q: identification of the mutation in a sulfite oxidase-deficient patient and expression and characterization of the mutant enzyme. Proc. Nat. Acad. Sci. 95:6394-6398, 1998.

Kisker, C.; Schindelin, H.; Pacheco, A.; Wehbi, W. A.; Garrett, R. M.; Rajagopalan, K. V.; Enemark, J. H.; Rees, D. C.: Molecular basis of sulfite oxidase deficiency from the structure of sulfite oxidase. Cell 91:973-983, 1997.

Corral, J.; Forster, A.; Thompson, S.; Lampert, F.; Kaneko, Y.; Slater, R.; Kroes, W. G.; van der Schoot, C. E.; Ludwig, W.-D.; Karpas, A.; Pocock, C.; Cotter, F.; Rabbitts, T. H.: Acute leukemias of different lineages have similar MLL gene fusions encoding related chimeric proteins resulting from chromosomal translocation. Proc. Nat. Acad. Sci. 90:8538-8542, 1993.

Parry, P.; Wei, Y.; Evans, G.: Cloning and characterization of the t (X;11) breakpoint from a leukemic cell line identify a new member of the forkhead gene family. Genes Chromosomes Cancer 11:79-84,1994.

Peters, U.; Haberhausen, G.; Kostrzewa, M.; Nolte, D.; Muller, U.: AFX1 and p54(nrb): fine mapping, genomic structure, and exclusion as candidate genes of X-linked dystonia parkinsonism. Hum. Genet. 100:569-572, 1997.

Bohme, B.; VandenBos, T.; Cerretti, D. P.; Park, L. S.; Holtrich, U.; Rubsamen-Waigmann, H.; Strebhardt, K.: Cell-cell adhesion mediated by binding of membrane-anchored ligand LERK-2 to the EPH-related receptor human embryonal kinase 2 promotes tyrosine kinase activity. J. Biol. Chem. 271:24747-24752, 1996.

Fletcher, F. A.; Huebner, K.; Shaffer, L. G.; Fairweather, N. D.; Monaco, A. P.; Muller, U.; Druck, T.; Simoneaux, D. K.; Chelly, J.; Belmont, J. W.; Beckmann, M. P.; Lyman, S. D.: Assignment of the gene (EPLG2) encoding a high-affinity binding protein for the receptor tyrosine kinase Elk to a 200-kilobase pair region in human chromosome Xq12. Genomics 25:334-335, 1995.

Fletcher, F. A.; Renshaw, B.; Hollingsworth, T.; Baum, P.; Lyman, S. D.; Jenkins, N. A.; Gilbert, D. J.; Copeland, N. G.; Davison, B. L.: Genomic organization and chromosomal localization of mouse Eplg2, a gene encoding a binding protein for the receptor tyrosine kinase Elk. Genomics 24:127-132, 1994.

Palmer, A.; Zimmer, M.; Erdmann, K. S.; Eulenburg, V.; Porthin, A.; Heumann, R.; Deutsch, U.; Klein, R.: EphrinB phosphorylation and reverse signaling: regulation by Src kinases and PTP-BL phosphatase. Molec. Cell 9:725-737, 2002.

Brunelli, S.; Faiella, A.; Capra, V.; Nigro, V.; Simeone, A.; Cama, A.; Boncinelli, E.: Germline mutation in the homeobox gene EMX2 in patients with severe schizencephaly. Nature Genet. 12:94-96, 1996.

Barton, D. E.; Yang-Feng, T. L.; Francke, U.: The human tyrosine aminotransferase gene mapped to the long arm of chromosome 16 (region16q22-q24) by somatic cell hybrid analysis and in situ hybridization. Hum. Genet. 72:221-224, 1986.

Beinfang, D. C.; Kuwabara, T.; Pueschel, S. M.: The Richner-Hanhart syndrome: report of a case with associated tyrosinemia. Arch. Ophthal. 94:1133-1137, 1976.

Bohnert, A.; Anton-Lamprecht, I.: Richner-Hanhart's syndrome: ultrastructural abnormalities of epidermal keratinization indicating a causal relationship to high intracellular tyrosine levels. J. Invest. Derm. 79:68-74, 1982.

Buist, N.: Phenylketonuria and related problems. In: Nyhan, W. L.: Amino Acid Metabolism and Genetic Variation. New York: McGraw-Hill (pub.) 1967. Pp. 117 only.

Chitayat, D.; Balbul, A.; Hani, V.; Mamer, O. A.; Clow, C.; Scriver, C. R.: Hereditary tyrosinaemia type II in a consanguineous Ashkenazi Jewish family: intrafamilial variation in phenotype; absence of parental phenotype effects on the fetus. J. Inherit. Metab. Dis. 15:198-203,1992.

Crovato, F.; Desirello, G.; Gatti, R.; Babbini, N.; Rebora, A.: Richner-Hanhart syndrome spares a plantar autograft. Arch. Derm. 121:539-540, 1985.

Fellman, J. H.; Vanbellinghen, P. J.; Jones, R. T.; Koler, R. D.: Soluble and mitochondrial forms of tyrosine aminotransferase: relationship to human tyrosinemia. Biochemistry 8:615-622, 1969.

Garibaldi, L. R.; Siliato, F.; De Martini, I.; Scarsi, M. R.; Romano, C.: Oculocutaneous tyrosinosis: report of two cases in the same family. Helv. Paediat. Acta 32:173-180, 1977.

Goldsmith, L. A.; Kang, E. S.; Bienfang, D. C.; Jimbow, K.; Gerald, P. S.; Baden, H. P.: Tyrosinemia with plantar and palmar keratosis and keratitis. J. Pediat. 83:798-805, 1973.

Hanhart, E.: Neue Sonderformen von Keratosis palmoplantaris, u. A. eine regelmaessig-dominante mit systematisierten Lipomen, ferner2 einfach-rezessive mit Schwachsinn und z. T. mit Hornhautveraenderungendes Auges (Ektodermatosyndrom). Dermatologica 94:286-308, 1947.

Hunziker, N.: Richner-Hanhart syndrome and tyrosinemia type II. Dermatologica 160:180-189, 1980.

Kennaway, N. G.; Buist, N. R. M.: Metabolic studies in a patient with hepatic cytosol tyrosine aminotransferase deficiency. Pediat. Res. 5:287-297, 1971.

Muller, G.; Scherer, G.; Zentgraf, H.; Ruppert, S.; Herrmann, B.; Lehrach, H.; Schutz, G.: Isolation, characterization and chromosomal mapping of the mouse tyrosine aminotransferase gene. J. Molec. Biol. 184:367-373, 1985.

Natt, E.; Kao, F.-T.; Rettenmeier, R.; Scherer, G.: Assignment of the human tyrosine aminotransferase gene to chromosome 16. Hum. Genet. 72:225-228, 1986.

Ichinose, H.; Ohye, T.; Suzuki, T.; Sumi-Ichinose, C.; Nomura, T.; Hagino, Y.; Nagatsu, T.: Molecular cloning of the human Nurr1gene: characterization of the human gene and cDNAs. Gene 230:233-239,1999.

Law, S. W.; Conneely, O. M.; DeMayo, F. J.; O'Malley, B. W.: Identification of a new brain-specific transcription factor, NURR1. Molec. Endocr. 6:2129-2135, 1992.

Mages, H. W.; Rilke, O.; Bravo, R.; Senger, G.; Kroczek, R. A.: NOT, a human immediate-early response gene closely related to the steroid/thyroid hormone receptor NAK1/TR3. Molec. Endocr. 8:1583-1591,1994.

McEvoy, A. N.; Murphy, E. A.; Ponnio, T.; Conneely, O. M.; Bresnihan, B.; FitzGerald, O.; Murphy, E. P.: Activation of nuclear orphan receptor NURR1 transcription by NF-kappaB and cyclic adenosine 5-prime-monophosphate response element-binding protein in rheumatoid arthritis synovial tissue. J. Immun. 168:2979-2987, 2002.

Okabe, T.; Takayanagi, R.; Imasaki, K.; Haji, M.; Nawata, H.; Watanabe, T.: cDNA cloning of a NGFI-B/nur77-related transcription factor from an apoptotic human T cell line. J. Immun. 154:3871-3879, 1995.

Torii, T.; Kawarai, T.; Nakamura, S.; Kawakami, H.: Organization of the human orphan nuclear receptor Nurr1 gene. Gene 230:225-232,1999.

Xu, P.-Y.; Liang, R.; Jankovic, J.; Hunter, C.; Zeng, Y.-X.; Ashizawa, T.; Lai, D.; Le, W.-D.: Association of homozygous 7048G7049 variant in the intron six of Nurr1 gene with Parkinson's disease. Neurology 58:881-884, 2002.

Hanahan, D.: Signaling vascular morphogenesis and maintenance. Science 277:48-50, 1997.

Miyoshi, J.; Higashi, T.; Mukai, H.; Ohuchi, T.; Kakunaga, T.:Structure and transforming potential of the human cot oncogene encoding a putative protein kinase. Molec. Cell. Biol. 11:4088-4096, 1991.

Ohara, R.; Miyoshi, J.; Aoki, M.; Toyoshima, K.: The murine cot proto-oncogene: genome structure and tissue-specific expression. Jpn. J. Cancer Res. 84:518-525, 1993.

Gould, D. B.; Walter, M. A.: Cloning, characterization, localization, and mutational screening of the human BARX1 gene. Genomics 68:336-342,2000.

Tissier-Seta, J. P.; Mucchielli, M. L.; Mark, M.; Mattei, M. G.; Goridis, C.; Brunet, J. F.: Barx1, a new mouse homeodomain transcription factor expressed in cranio-facial ectomesenchyme and the stomach. Mech. Dev. 51:3-15, 1995.

Ishihara, H.; Shibasaki, Y.; Kizuki, N.; Wada, T.; Yazaki, Y.; Asano, T.; Oka, Y.: Type I phosphatidyl inositol-4-phosphate 5-kinases: cloning of the third isoform and deletion/substitution analysis of members of this novel lipid kinase family. J. Biol. Chem. 273:8741-8748,1998.

Asao, H.; Sasaki, Y.; Arita, T.; Tanaka, N.; Endo, K.; Kasai, H.; Takeshita, T; Endo, Y.; Fujita, T.; Sugamura, K.: Hrs is associated with STAM, a signal-transducing adaptor molecule: its suppressive effect on cytokine-induced cell growth. J. Biol. Chem. 272:32785-32791,1997.

Takeshita, T.; Arita, T.; Asao, H.; Tanaka, N.; Higuchi, M.; Kuroda, H.; Kaneko, K.; Munakata, H.; Endo, Y.; Fujita, T.; Sugamura, K.: Cloning of a novel signal-transducing adaptor molecule containing an SH3 domain and ITAM. Biochem. Biophys. Res. Commun. 225:1035-1039,1996.

Barlow, G. M.; Chen, X.-N.; Shi, Z. Y.; Lyons, G. E.; Kurnit, D. M.; Celle, L.; Spinner, N. B.; Zackai, E.; Pettenati, M. J.; Van Riper, A. J.; Vekemans, M. J.; Mjaatvedt, C. H.; Korenberg, J. R.: Down syndrome congenital heart disease: a narrowed region and a candidate gene. Genet. Med. 3:91-101, 2001.

Schmucker, D.; Clemens, J. C.; Shu, H.; Worby, C. A.; Xiao, J.; Muda, M.; Dixon, J. E.; Zipursky, S. L.: Drosophila Dscam is an axon guidance receptor exhibiting extraordinary molecular diversity. Cell 101:671-684, 2000.

Yamakawa, K.; Huo, Y.-K.; Haendel, M. A.; Hubert, R.; Chen, X.-N.; Lyons, G. E.; Korenberg, J. R.: DSCAM: a novel member of the immunoglobulin superfamily maps in a Down syndrome region and is involved in the development of the nervous system. Hum. Molec. Genet. 7:227-237,1998.

Zhu, J.; Petersen, S.; Tessarollo, L.; Nussenzweig, A.: Targeted disruption of the Nijmegen breakage syndrome gene NBS1 leads to early embryonic lethality in mice. Curr. Biol. 11:105-109, 2001.

Cooper, P. R.; Smilinich, N. J.; Day, C. D.; Nowak, N. J.; Reid, L. H.; Pearsall, R. S.; Reece, M.; Prawitt, D.; Landers, J.; Housman, D. E.; Winterpacht, A.; Zabel, B. U.; Pelletier, J.; Weissman, B. E.; Shows, T. B.; Higgins, M. J.: Divergently transcribed overlapping genes expressed in liver and kidney and located in the 11p15.5 imprinted domain. Genomics 49:38-51, 1998.

Kershaw, D. B.; Beck, S. G.; Wharram, B. L.; Wiggins, J. E.; Goyal, M.; Thomas, P. E.; Wiggins, R. C.: Molecular cloning and characterization of human podocalyxin-like protein: orthologous relationship to rabbit PCLP1 and rat podocalyxin. J. Biol. Chem. 272:15708-15714, 1997.

Kershaw, D. B.; Wiggins, J. E.; Wharram, B. L.; Wiggins, R. C.: Assignment of the human podocalyxin-like protein (PODXL) gene to 7q32-q33. Genomics 45:239-240, 1997.

Chan, K. K.; Tsui, S. K. W.; Lee, S. M. Y.; Luk, S. C. W.; Liew, C. C.; Fung, K. P.; Waye, M. M. Y.; Lee, C. Y.: Molecular cloning and characterization of FHL2, a novel LIM domain protein preferentially expressed in human heart. Gene 210:345-350, 1998.

Genini, M.; Schwalbe, P.; Scholl, F. A.; Remppis, A.; Mattei, M.-G.; Schafer, B. W.: Subtractive cloning and characterization of DRAL, a novel LIM-domain protein down-regulated in rhabdomyosarcoma. DNA Cell Biol. 16:433-442, 1997.

Claverie-Martin, F.; Wang, M.; Cohen, S. N.: ARD-1 cDNA from human cells encodes a site-specific single-strand endoribonuclease that functionally resembles Escherichia coli RNase E. J. Biol. Chem. 272:13823-13828, 1997.

Van Eynde, A.; Wera, S.; Beullens, M.; Torrekens, S.; Van Leuven, F.; Stalmans, W.; Bollen, M.: Molecular cloning of NIPP-1, a nuclear inhibitor of protein phosphatase-1, reveals homology with polypeptides involved in RNA processing. J. Biol. Chem. 270:28068-28074, 1995.

Tekin, M.; Dogu, F.; Tacyildiz, N.; Akar, E.; Ikinciogullari, A.; Ogur, G.; Yavuz, G.; Babacan, E.; Akar, N.:657del5 mutation in the NBS1 gene is associated with Nijmegen breakage syndrome in a Turkish family. Clin. Genet. 62:84-88, 2002.

Varon, R.; Reis, A.; Henze, G.; Einsiedel, H. G.; Sperling, K.; Seeger, K.: Mutations in the Nijmegen breakage syndrome gene (NBS1) in childhood acute lymphoblastic leukemia (ALL). Cancer Res. 61:3570-3572, 2001.

Wilda, M.; Demuth, I.; Concannon, P.; Sperling, K.; Hameister, H.: Expression pattern of the Nijmegen breakage syndrome gene, Nbs1, during murine development. Hum. Molec. Genet. 9:1739-1744, 2000.

Wu, X.; Ranganathan, V.; Weisman, D. S.; Heine, W. F.; Ciccone, D. N.; O'Neill, T. B.; Crick, K. E.; Pierce, K. A.; Lane, W. S.; Rathbun, G.; Livingston, D. M.; Weaver, D. T.: ATM phosphorylation of Nijmegen breakage syndrome protein is required in a DNA damage response. Nature 405:477-482, 2000.

Zhao, S.; Weng, Y.-C.; Yuan, S.-S. F.; Lin, Y.-T.; Hsu, H.-C.; Lin, S.-C. J.; Gerbino, E.; Song, M.; Zdzienicka, M. Z.; Gatti, R. A.; Shay, J. W.; Ziv, Y.; Shiloh, Y.; Lee, E. Y.-H. P.: Functional link between ataxia-telangiectasia and Nijmegen breakage syndrome gene products. Nature 405:473-477, 2000.

Mankodi, A.; Urbinati, C. R.; Yuan, Q.-P.; Moxley, R. T.; Sansone, V.; Krym, M.; Henderson, D.; Schalling, M.; Swanson, M. S.; Thornton, C. A.: Muscle blind localizes to nuclear foci of aberrant RNA in myotonic dystrophy types 1 and 2. Hum. Molec. Genet. 10:2165-2170, 2001.

Hittner, H. M.; Kretzer, F. L.; Antoszyk, J. H.; Ferrell, R. E.; Mehta, R. S.: Variable expressivity of autosomal dominant anterior segment mesenchymal dysgenesis in six generations. Am. J. Ophthal. 93:57-70, 1982.

Semina, E. V.; Ferrell, R. E.; Mintz-Hittner, H. A.; Bitoun, P.; Alward, W. L. M.; Reiter, R. S.; Funkhauser, C.; Daack-Hirsch, S.; Murray, J. C.: A novel homeobox gene PITX3 is mutated in families with autosomal-dominant cataracts and ASMD. Nature Genet. 19:167-170,1998.

Semina, E. V.; Murray, J. C.; Reiter, R.; Hrstka, R. F.; Graw, J.: Deletion in the promoter region and altered expression of Pitx3 homeobox gene in aphakia mice. Hum. Molec. Genet. 9:1575-1585,2000.

Semina, E. V.; Reiter, R. S.; Murray, J. C.: Isolation of a new homeobox gene belonging to the Pitx/Rieg family: expression during lens development and mapping to the aphakia region on mouse chromosome 19. Hum. Molec. Genet. 6:2109-2116, 1997.

Kent, J.; Lee, M.; Schedl, A.; Boyle, S.; Fantes, J.; Powell, M.; Rushmere, N.; Abbott, C.; van Heyningen, V.; Bickmore, W. A.: The reticulocalbin gene maps to the WAGR region in human and to the Smalleye Harwell deletion in mouse. Genomics 42:260-267, 1997.

Ozawa, M.: Cloning of a human homologue of mouse reticulocalbin reveals conservation of structural domains in the novel endoplasmic reticulum resident Ca2+-binding protein with multiple EF-hand motifs. J. Biochem. 117:1113-1119, 1995.

Ozawa, M.; Muramatsu, T.: Reticulocalbin, a novel endoplasmic reticulum resident Ca2+-binding protein with multiple EF-hand motifs and a carboxyl-terminal HDEL sequence. J. Biol. Chem. 268:699-705,1993.

Luo, G.; Leroy, E.; Kozak, C. A.; Polymeropoulos, M. H.; Horowits, R.: Mapping of the gene (NRAP) encoding N-RAP in the mouse and human genomes. Genomics 45:229-232, 1997.

Luo, G.; Zhang, J. Q.; Nguyen, T.-P.; Herrera, A. H.; Paterson, B.; Horowits, R.: Complete cDNA sequence and tissue localization of N-RAP, a novel nebulin-related protein of striated muscle. Cell Motil. Cytoskeleton 38:75-90, 1997.

Strahm, B.; Rittweiler, K.; Duffner, U.; Brandau, O.; Orlowska-Volk, M.; Karajannis, M. A.; zur Stadt, U.; Tiemann, M.; Reiter, A.; Brandis, M.; Meindl, A.; Niemeyer, C. M.: Recurrent B-cell non-Hodgkin's lymphoma in two brothers with X-linked lymphoproliferative disease without evidence for Epstein-Barr virus infection. Brit. J. Haemat. 108: 377-382, 2000.

Sylla, B. S.; Murphy, K.; Cahir-McFarland, E.; Lane, W. S.; Mosialos, G.; Kieff, E.: The X-linked lymphoproliferative syndrome gene product SH2D1A associates with p62(dok) (Dok1) and activates NF-kappa-beta. Proc. Nat. Acad. Sci. 97:7470-7475, 2000.

Sylla, B. S.; Wang, Q.; Hayoz, D.; Lathrop, G. M.; Lenoir, G. M.: Multipoint linkage mapping of the Xq25-q26 region in a family affected by the X-linked lymphoproliferative syndrome. Clin. Genet. 36:359-462, 1989.

Tangye, S. G.; Lazetic, S.; Woollatt, E.; Sutherland, G. R.; Lanier, L. L.; Phillips, J. H.: Cutting edge: human 2B4, an activating NK cell receptor, recruits the protein tyrosine phosphatase SHP-2 and the adaptor signaling protein SAP. J. Immun. 162:6981-6985, 1999.

Tangye, S. G.; Phillips, J. H.; Lanier, L. L.; Nichols, K. E.: Cutting edge: functional requirement for SAP in 2B4-mediated activation of human natural killer cells as revealed by the X-linked lymphoproliferative syndrome. J. Immun. 165: 2932-2936, 2000.

Thorley-Lawson, D. A.; Schooley, R. T.; Bhan, A. K.; Nadler, L. M.: Epstein-Barr virus superinduces a new human B cell differentiation antigen (B-LAST 1) expressed on transformed lymphoblasts. Cell 30:415-425, 1982.

Vowels, M. R.; Lam-Po-Tang, R.; Berdoukas, V.; Ford, D.; Thierry, D.; Purtilo, D.; Gluckman, E.: Correction of X-linked lymphoproliferative disease by transplantation of cord-blood stem cells. New Eng. J. Med. 329:1623-1625, 1993.

Williams, L. L.; Rooney, C. M.; Conley, M. E.; Brenner, M. K.; Krance, R. A.; Heslop, H. E.: Correction of Duncan's syndrome by allogeneic bone marrow transplantation. Lancet 342:587-588, 1993.

Wu, C.; Nguyen, K. B.; Pien, G. C.; Wang, N.; Gullo, C.; Duncan, H.; Sosa, M. R.; Edwards, M. J.; Borrow, P.; Satoskar, A. R.; Sharpe, A. H.; Biron, C. A.; Terhorst, C.: SAP controls T cell responses to virus and terminal differentiation of T(H)2 cells. Nature Immun. 2:410-414, 2001.

Wyandt, H. E.; Skare, J. C.; Grierson, H. L.; Purtilo, D. T.; Milunsky, A.: Detection of a chromosomal deletion of Xq25 in an affected male with X-linked lymphoproliferative disease. (Abstract) Am. J. Hum. Genet. 45 (suppl.): A108 only, 1989.

Yin, L.; Ferrand, V.; Lavoue, M.-F.; Hayoz, D.; Philippe, N.; Souillet, G.; Seri, M.; Giacchino, R.; Castagnola, E.; Hodgson, S.; Sylla, B. S.; Romeo, G.: SH2D1A mutation analysis for diagnosis of XLP in typical and atypical patients. Hum. Genet. 105:501-505,1999.

Yin, L.; Tocco, T.; Pauly, S.; Lenoir, G. M.; Romeo, G.: Absence of SH2D1A point mutation in 62 Burkitts lymphoma cell lines. Am. J. Hum. Genet. 65 (suppl. 1868): A331 only, 1999.

Laxminarayan, K. M.; Chan, B. K.; Tetaz, T.; Bird, P. I.; Mitchell, C. A.: Characterization of a cDNA encoding the 43-kDa membrane-associated inositol-polyphosphate 5-phosphatase. J. Biol. Chem. 269:17305-17310,1994.

Fink, J. K.; Jones, S. M.; Esposito, C.; Wilkowski, J.: human microtubule-associated protein 1a (MAP1A) gene: genomic organization, cDNA sequence, and developmental- and tissue-specific expression. Genomics 35:577-585, 1996.

Asker, C.; Steinitz, M.; Andersson, K.; Sumegi, J.; Klein, G.; Ingvarsson, S.: Nucleotide sequence of the rat Bmyc gene. Oncogene 4:1523-1527, 1989.

Ingvarsson, S.; Sundaresan, S.; Jin, P.; Francke, U.; Asker, C.; Sumegi, J.; Klein, G.; Sejersen, T.: Chromosome localization and expression pattern of Lmyc and Bmyc in murine embryonal carcinoma cells. Oncogene 3:679-685, 1988.

Kojima, T.; Inazawa, J.; Takamatsu, J.; Rosenberg, R. D.; Saito, H.: Human ryudocan core protein: molecular cloning and characterization of the cDNA, and chromosomal localization of the gene. Biochem. Biophys. Res. Commun. 190:814-822, 1993.

Kojima, T.; Shworak, N. W.; Rosenberg, R. D.: Molecular cloning and expression of two distinct cDNA-encoding heparan sulfate proteoglycan core proteins from a rat endothelial cell line. J. Biol. Chem. 267:4870-4877, 1992.

Yu, H.; Humphries, D. E.; Watkins, M.; Karlinsky, J. B.: molecular cloning of the human ryudocan promoter. Biochem. Biophys. Res. Commun. 212:1139-1144, 1995.

McBride, O. W.; Yi, H. F.; Srivastava, M.: The human cytochrome b561 gene (CYB561) is located at 17q11-qter. Genomics 21:662-663,1994.

Srivastava, M.: Genomic structure and expression of the human gene encoding cytochrome b (561), an integral protein of the cromaffin granule membrane. J. Biol. Chem. 270:22714-22720, 1995.

Albarosa, R.; DiDonato, S.; Finocchiaro, G.: Redefinition of the coding sequence of the MXI1 gene and identification of a polymorphic repeat in the 3-prime non-coding region that allows the detection of loss of heterozygosity of chromosome 10q25 in glioblastomas. Hum. Genet. 95:709-711, 1995.

Mitchell, C. A.; Speed, C. J.; Nicholl, J.; Sutherland, G. R.:Chromosomal mapping of the gene (INPP5A) encoding the 43-kDa membrane-associated inositol polyphosphate 5-phosphatase to 10q26.3 by fluorescence in situ hybridization. Genomics 31:139-140, 1996.

Sugasawa, K.; Ng, J. M. Y.; Masutani, C.; Iwai, S.; van der Spek, P. J.; Eker, A. P. M.; Hanaoka, F.; Bootsma, D.; Hoeijmakers, J. H. J.: Xeroderma pigmentosum group C protein complex is the initiator of global genome nucleotide excision repair. Molec. Cell 2:223-232,1998.

van der Spek, P. J.; Smit, E. M. E.; Beverloo, H. B.; Sugasawa, K.; Masutani, C.; Hanaoka, F.; Hoeijmakers, J. H. J.; Hagemeijer, A.: Chromosomal localization of three repair genes: the xeroderma pigmentosum group C gene and two human homologs of yeast RAD23. Genomics 23:651-658, 1994.

van der Spek, P. J.; Visser, C. E.; Hanaoka, F.; Smit, B.; Hagemeijer, A.; Bootsma, D.; Hoeijmakers, J. H. J.: Cloning, comparative mapping, and RNA expression of the mouse homologues of the Saccharomyces cerevisiae nucleotide excision repair gene RAD23. Genomics 31:20-27, 1996.

Netik, A.; Forss-Petter, S.; Holzinger, A.; Molzer, B.; Unterrainer, G.; Berger, J.: Adrenoleukodystrophy-related protein can compensate functionally for adrenoleukodystrophy protein deficiency (X-ALD):implications for therapy. Hum. Molec. Genet. 8:907-913, 1999.

Dinulos, M. B.; Bassi, M. T.; Rugarli, E. I.; Chapman, V.; Ballabio, A.; Disteche, C. M.: A new region of conservation is defined between human and mouse X chromosomes. Genomics 35:244-247, 1996.

Schiaffino, M. V.; Bassi, M. T.; Rugarli, E. I.; Renieri, A.; Galli, L.; Ballabio, A.: Cloning of a human homologue of the Xenopus laevis APX gene from the ocular albinism type 1 critical region. Hum. Molec. Genet. 4:373-382, 1995.

Bachner, D.; Sedlacek, Z.; Korn, B.; Hameister, H.; Poustka, A.: Expression patterns of two human genes coding for different rab GDP-dissociation inhibitors (GDIs), extremely conserved proteins involved in cellular transport. Hum. Molec. Genet. 4:701-708, 1995.

Black, G. C. M.; Perveen, R.; Bonshek, R.; Cahill, M.; Clayton-Smith, J.; Lloyd, I. C.; McLeod, D.: Coats' disease of the retina (unilateral retinal telangiectasis) caused by somatic mutation in the NDP gene: a role for norrin in retinal angiogenesis. Hum. Molec. Genet. 8:2031-2035, 1999.

Mao, M.; Fu, G.; Wu, J.-S.; Zhang, Q.-H.; Zhou, J.; Kan, L.-X.; Huang, Q.-H.; He, K.-L.; Gu, B.-W.; Han, Z.-G.; Shen, Y.; Gu, J.; Yu, Y.-P.; Xu, S.-H.; Wang, Y.-X.; Chen, S.-J.; Chen, Z.: Identification of genes expressed in human CD34+ hematopoietic stem/progenitor cells by expressed sequence tags and efficient full-length cDNA cloning. Proc. Nat. Acad. Sci. 95:8175-8180, 1998.

Chen, Y.-T.; Gure, A. O.; Tsang, S.; Stockert, E.; Jager, E.; Knuth, A.; Old, L. J.: Identification of multiple cancer/testis antigens by allogeneic antibody screening of a melanoma cell line library. Proc. Nat. Acad. Sci. 95:6919-6923, 1998.

Lucas, S.; De Smet, C.; Arden, K. C.; Viars, C. S.; Lethe, B.; Lurquin, C.; Boon, T.: Identification of a new MAGE gene with tumor-specific expression by representational difference analysis. Cancer Res. 58:743-752, 1998.

Cianfriglia, M.; Miggiano, V. C.; Meo, T.; Muller, H. J.; Muller, E.; Battistuzzi, G.: Evidence for synteny between the rabbit gene loci coding for HPRT, PGK and G6PD in mouse-rabbit somatic cell hybrids.(Abstract) Cytogenet. Cell Genet. 25:142, 1979.

Holterhus, P. M.; Sinnecker, G. H. G.; Wollmann, H. A.; Struve, D.; Homburg, N.; Kruse, K.; Hiort, O.: Expression of two functionally different androgen receptors in a patient with androgen insensitivity. Europ. J. Pediat. 158:702-706, 1999.

Shimmin, L. C.; Chang, B.-H.; Li, W.-H.: Male-driven evolution of DNA sequences. Nature 362:745-747, 1993.

Warburg, M.: Personal Communication. Copenhagen, Denmark 1966.

Imasaki, K.; Okabe, T.; Murakami, H.; Tanaka, Y.; Haji, M.; Takayanagi, R.; Nawata, H.: Androgen insensitivity syndrome due to new mutations in the DNA-binding domain of the androgen receptor. Molec. Cell. Endocr. 120:15-24, 1996.

Jakubiczka, S.; Nedel, S.; Werder, E. A.; Schleiermacher, E.; Theile, U.; Wolff, G.; Wieacker, P.: Mutations of the androgen receptor gene in patients with complete androgen insensitivity. Hum. Mutat. 9:57-61, 1997.

Kang, H.-Y.; Yeh, S.; Fujimoto, N.; Chang, C.: Cloning and characterization of human prostate coactivator ARA54, a novel protein that associates with the androgen receptor. J. Biol. Chem. 274:8570-8576, 1999.

Kazemi-Esfarjani, P.; Beitel, L. K.; Trifiro, M.; Kaufman, M.; Rennie, P.; Sheppard, P.; Matusik, R.; Pinsky, L.: Substitution of valine-865 by methionine or leucine in the human androgen receptor causes complete or partial androgen insensitivity, respectively with distinct androgen receptor phenotypes. Molec. Endocr. 7:37-46,1993.

Kittles, R. A.; Young, D.; Weinrich, S.; Hudson, J.; Argyropoulos, G.; Ukoli, F.; Adams-Campbell, L.; Dunston, G. M.: Extent of linkage disequilibrium between the androgen receptor gene CAG and GGC repeats in human populations: implications for prostate cancer risk. Hum. Genet. 109:253-261, 2001.

Klocker, H.; Kaspar, F.; Eberle, J.; Uberreiter, S.; Radmayr, C.; Bartsch, G.: Point mutation in the DNA binding domain of the androgen receptor in two families with Reifenstein syndrome. Am. J. Med. Genet. 50:1318-1327, 1992.

Knoke, I.; Allera, A.; Wieacker, P.: Significance of the CAG repeat length in the androgen receptor gene (AR) for the transactivation function of an M780I mutant AR. Hum. Genet. 104:257-261, 1999.

Kobayashi, Y.; Miwa, S.; Merry, D. E.; Kume, A.; Mei, L.; Doyu, M.; Sobue, G.: Caspase-3 cleaves the expanded androgen receptor protein of spinal and bulbar muscular atrophy in a polyglutamine repeat length-dependent manner. Biochem. Biophys. Res. Commun. 252:145-150, 1998.

Koivisto, P. A.; Schleutker, J.; Helin, H.; Ehren-van Eekelen, C.; Kallioniemi, O.-P.; Trapman, J.: Androgen receptor gene alterations and chromosomal gains and losses in prostate carcinomas appearing during finasteride treatment for benign prostatic hyperplasia. Clin. Cancer Res. 5:3578-3582, 1999.

Kooy, R. F.; Reyniers, E.; Storm, K.; Vits, L.; van Velzen, D.; de Ruiter, P. E.; Brinkmann, A. O.; de Paepe, A.; Willems, P. J.: CAG repeat contraction in the androgen receptor gene in three brothers with mental retardation. Am. J. Med. Genet. 85:209-213, 1999.

La Spada, A.; Fischbeck, K. H.: Androgen receptor gene defect in X-linked spinal and bulbar muscular atrophy. (Abstract) Am. J. Hum. Genet. 49 (suppl.):20, 1991.

Lewis, M.; Kaita, H.; Giblett, E. R.; Anderson, J.; Philipps, S.; Steinberg, A. G.; McAlpine, P. J.: Multiplicity of genetic polymorphisms of blood in the Schmiedeleut Hutterites. Am. J. Med. Genet. 22:477-485, 1985.

Lim, H. N.; Chen, H.; McBride, S.; Dunning, A. M.; Nixon, R. M.; Hughes, I. A.; Hawkins, J. R.: Longer polyglutamine tracts in the androgen receptor are associated with moderate to severe undermasculinized genitalia in XY males. Hum. Molec. Genet. 9:829-834, 2000.

Lobaccaro, J.-M.; Lumbroso, S.; Belon, C.; Galtier-Dereure, F.; Bringer, J.; Lesimple, T.; Namer, M.; Cutuli, B. F.; Pujol, H.; Sultan, C.: Androgen receptor gene mutation in male breast cancer. Hum. Molec. Genet. 2:1799-1802, 1993.

Lubahn, D. B.; Brown, T. R.; Simental, J. A.; Higgs, H. N.; Migeon, C. J.; Wilson, E. M.; French, F. S.: Sequence of the intron/exon junctions of the coding region of the human androgen receptor gene and identification of a point mutation in a family with complete androgen insensitivity. Proc. Nat. Acad. Sci. 86:9534-9538, 1989.

Lubahn, D. B.; Joseph, D. R.; Sar, M.; Tan, J.; Higgs, H. N.; Larson, R. E.; French, F. S.; Wilson, E. M.: The human androgen receptor: complementary deoxyribonucleic acid cloning, sequence analysis and gene expression in prostate. Molec. Endocr. 2:1265-1275, 1988.

Lubahn, D. B.; Joseph, D. R.; Sullivan, P. M.; Willard, H. F.; French, F. S.; Wilson, E. M.: Cloning of human androgen receptor complementary DNA and localization to the X chromosome. Science 240:327-330, 1988.

Lumbroso, S.; Lobaccaro, J. M.; Georget, V.; Leger, J.; Poujol, N.; Terouanne, B.; Evain-Brion, D.; Czernichow, P.; Sultan, C.: A novel substitution (leu707-to-arg) in exon 4 of the androgen receptor gene causes complete androgen resistance. J. Clin. Endocr. Metab. 81:1984-1988, 1996.

Stuppia, L.; Calabrese, G.; Franchi, P. G.; Mingarelli, R.; Gatta, V.; Palka, G.; Dallapiccola, B.: Widening of a Y-chromosome interval-6 deletion transmitted from a father to his infertile son accounts for an oligozoospermia critical region distal to the RBM1 and DAZ genes.(Letter) Am. J. Hum. Genet. 59:1393-1395, 1996.

Brown, G. M.; Furlong, R. A.; Sargent, C. A.; Erickson, R. P.; Longepied, G.; Mitchell, M.; Jones, M. H.; Hargreave, T. B.; Cooke, H. J.; Affara, N. A.: Characterisation of the coding sequence and fine mapping of the human DFFRY gene and comparative expression analysis and mapping to the Sxr-b interval of the mouse Y chromosome of the Dffry gene. Hum. Molec. Genet. 7:97-107, 1998.

Ferlin, A.; Moro, E.; Garolla, A.; Foresta, C.: Human male infertility and Y chromosome deletions: role of the AZF-candidate genes DAZ, RBm and DFFRY. Hum. Reprod. 14:1710-1716, 1999.

Foresta, C.; Ferlin, A.; Moro, E.: Deletion and expression analysis of AZFa genes on the human Y chromosome revealed a major role for DBY in male infertility. Hum. Molec. Genet. 9:1161-1169, 2000.

Sargent, C. A.; Boucher, C. A.; Kirsch, S.; Brown, G.; Weiss, B.; Trundley, A.; Burgoyne, P.; Saut, N.; Durand, C.; Levy, N.; Terriou, P.; Hargreave, T.; Cooke, H.; Mitchell, M.; Rappold, G. A.; Affara, N. A.: The critical region of overlap defining the AZFa male infertility interval of proximal Yq contains three transcribed sequences. J. Med. Genet. 36:670-677, 1999.

Shen, P.; Wang, F.; Underhill, P. A.; Franco, C.; Yang, W.-H.; Roxas, A.; Sung, R.; Lin, A. A.; Hyman, R. W.; Vollrath, D.; Davis, R. W.; Cavalli-Sforza, L. L.; Oefner, P. J.: Population genetic implications from sequence variation in four Y chromosome genes. Proc. Nat. Acad. Sci. 97:7354-7359, 2000.

Sun, C.; Skaletsky, H.; Birren, B.; Devon, K.; Tang, Z.; Silber, S.; Oates, R.; Page, D. C.: An azoospermic man with a de novo point mutation in the Y-chromosomal gene USP9Y. Nature Genet. 23:429-432,1999.

Thomson, R.; Pritchard, J. K.; Shen, P.; Oefner, P. J.; Feldman, M. W.: Recent common ancestry of human Y chromosomes: evidence from DNA sequence data. Proc. Nat. Acad. Sci. 97:7360-7365, 2000.

Schiebel, K.; Winkelmann, M.; Mertz, A.; Xu, X.; Page, D. C.; Weil, D.; Petit, C.; Rappold,, G. A.: Abnormal XY interchange between a novel isolated protein kinase gene, PRKY, and its homologue, PRKX, accounts for one third of all (Y+) XX males and (Y-)XY females. Hum. Molec. Genet. 6:1985-1989, 1997.

Greenfield, A.; Scott, D.; Pennisi, D.; Ehrmann, I.; Ellis, P.; Cooper, L.; Simpson, E.; Koopman, P.: An H-YDb epitope is encoded by a novel mouse Y chromosome gene. Nature Genet. 14:474-478, 1996.

Scott, D.; Addey, C.; Ellis, P; James, E.; Mitchell, M. J.; Saut, N.; Jurcevic, S.; Simpson, E.: Dendritic cells permit identification of genes encoding MHC class II-restricted epitopes of transplantation antigens. Immunity 12:711-720, 2000.

Wu, G.; Chai, J.; Suber, T. L.; Wu, J.-W.; Du, C.; Wang, X.; Shi, Y.: Structural basis of IAP recognition by Smac/DIABLO. Nature 408:1008-1012, 2000.

Macke, J. P.; Hu, N.; Hu, S.; Bailey, M.; King, V. L.; Brown, T.; Hamer, D.; Nathans, J.: Sequence variation in the androgen receptor gene is not a common determinant of male sexual orientation. Am. J. Hum. Genet. 53:844-852, 1993.

Nakamura, H.; Izumoto, Y.; Kambe, H.; Kuroda, T.; Mori, T.; Kawamura, K.; Yamamoto, H.; Kishimoto, T.: Molecular cloning of complementary DNA for a novel human hepatoma-derived growth factor: its homology with high mobility group-1 protein. J. Biol. Chem. 269:25143-25149, 1994.

Wanschura, S.; Schoenmakers, E. F. P. M.; Huysmans, C.; Bartnitzke, S.; Van de Ven, W. J. M.; Bullerdiek, J.: Mapping of the gene encoding the human hepatoma-derived growth factor (HDGF) with homology to the high-mobility group (HMG)-1 protein to Xq25. Genomics 32:298-300,1996.

McMurtrie, E. B.; Barbosa, M. D. F. S.; Zerial, M.; Kingsmore, S. F.: Rab17 and Rab18, small GTPases with specificity for polarized epithelial cells: genetic mapping in the mouse. Genomics 45:623-625,1997.

Schafer, U.; Seibold, S.; Schneider, A.; Neugebauer, E.: Isolation and characterisation of the human rab18 gene after stimulation of endothelial cells with histamine. FEBS Lett. 466:148-154, 2000.

Doupnik, C. A.; Davidson, N.; Lester, H. A.: The inward rectifier potassium channel family. Curr. Opin. Neurobiol. 5:268-277, 1995.

Tada, Y.; Horio, Y.; Takumi, T.; Terayama, M.; Tsuji, L.; Copeland, N. G.; Jenkins, N. A.; Kurachi, Y.: Assignment of the glial inwardly rectifying potassium channel K(AB)-2/Kir4.1 (Kcnj10) gene to the distal region of mouse chromosome 1. Genomics 45:629-630, 1997.

Takumi, T.; Ishii, T.; Horio, Y.; Morishige, K.-I.; Takahashi, N.; Yamada, M.; Yamashita, T.; Kiyama, H.; Sohmiya, K.; Nakanishi, S.; Kurachi, Y.: A novel ATP-dependent inward rectifier potassium channel expressed predominantly in glial cells. J. Biol. Chem. 270:16339-16436, 1995.

Schenker, T.; Trueb, B.: Assignment of the gene for a developmentally regulated GTP-binding protein (DRG2) to human chromosome bands 17p13-p12by in situ hybridization. Cytogenet. Cell Genet. 79:274-275, 1997.

Rohan, P. J.; Davis, P.; Moskaluk, C. A.; Kearns, M.; Krutzsch, H.; Siebenlist, U.; Kelly, K.: PAC-1: a mitogen-induced nuclear protein tyrosine phosphatase. Science 259: 1763-1766, 1993.

Ward, Y.; Gupta, S.; Jensen, P.; Wartmann, M.; Davis, R. J.; Kelly, K.: Control of MAP kinase activation by the mitogen-induced threonine/tyrosine phosphatase PAC1. Nature 367: 651-654, 1994.

Yi, H.; Morton, C. C.; Weremowicz, S.; McBride, O. W.; Kelly, K.: Genomic organization and chromosomal localization of the DUSP2 gene, encoding a MAP kinase phosphatase, to human 2p11.2-q11. Genomics 28:92-96, 1995.

Ishibashi, T.; Bottaro, D. P.; Michieli, P.; Kelley, C. A.; Aaronson, S. A.: A novel dual specificity phosphatase induced by serum stimulation and heat shock. J. Biol. Chem. 269:29897-29902, 1994.

Kwak, S. P.; Dixon, J. E.: Multiple dual specificity protein tyrosine phosphatases are expressed and regulated differentially in liver cell lines. J. Biol. Chem. 270:1156-1160, 1995.

Shindo, M.; Nakano, H.; Kuroyanagi, H.; Shirasawa, T.; Mihara, M.; Gilbert, D. J.; Jenkins, N. A.; Copeland, N. G.; Yagita, H.; Okumura, K.: cDNA cloning, expression, subcellular localization, and chromosomal assignment of mammalian aurora homologues, aurora-related kinase (ARK)1 and 2. Biochem. Biophys. Res. Commun. 244:285-292, 1998.

Adachi, H.; Tsujimoto, M.; Hattori, M.; Arai, H.; Inoue, K.: cDNA cloning of human cytosolic platelet-activating factor acetylhydrolase gamma-subunit and its mRNA expression in human tissues. Biochem. Biophys. Res. Commun. 214:180-187, 1995.

Presky, D. H.; Yang, H.; Minetti, L. J.; Chua, A. O.; Nabavi, N.; Wu, C.-Y.; Gately, M. K.; Gubler, U.: A functional interleukin 12 receptor complex is composed of two beta-type cytokine receptor subunits. Proc. Nat. Acad. Sci. 93:14002-14007, 1996.

Yamamoto, K.; Kobayashi, H.; Miura, O.; Hirosawa, S.; Miyasaka, N.: Assignment of IL12RB1 and IL12RB2, interleukin-12 receptor beta-1 and beta-2 chains, to human chromosome 19 band p13.1 and chromosome 1 band p31.2, respectively, by in situ hybridization. Cytogenet. Cell Genet. 77:257-258, 1997.

Bernier-Villamor, V.; Sampson, D. A.; Matunis, M. J.; Lima, C. D.: Structural basis for E2-mediated SUMO conjugation revealed by a complex between ubiquitin-conjugating enzyme Ubc9 and RanGAP1. Cell 108:345-356, 2002.

Shi, Y.; Zou, M.; Farid, N. R.; Paterson, M. C.: Association of FHIT (fragile histidine triad), a candidate tumour suppressor gene, with the ubiquitin-conjugating enzyme hUBC9. Biochem. J. 352:443-448,2000.

Tachibana, M.; Iwata, N.; Watanabe, A.; Nobukuni, Y.; Ploplis, B.; Kajigaya, S.: Assignment of the gene for a ubiquitin-conjugating enzyme (UBE2I) to human chromosome band 16p13.3 by in situ hybridization. Cytogenet. Cell Genet. 75:222-223, 1996.

Wang, Z.-Y.; Qiu, Q.-Q.; Seufert, W.; Taguchi, T.; Testa, J. R.; Whitmore, S. A.; Callen, D. F.; Welsh, D.; Shenk, T.; Deuel, T. F.: Molecular cloning of the cDNA and chromosome localization of the gene for human ubiquitin-conjugating enzyme 9. J. Biol. Chem. 271:24811-24816, 1996.

Yasugi, T.; Howley, P. M.: Identification of the structural and functional human homolog of the yeast ubiquitin conjugating enzyme UBC9. Nucleic Acids Res. 24:2005-2010, 1996.

Watanabe, T. K.; Fujiwara, T.; Kawai, A.; Shimizu, F.; Takami, S.; Hirano, H.; Okuno, S.; Ozaki, K.; Takeda, S.; Shimada, Y.; Nagata, M.; Takaichi, A.; Takahashi, E.; Nakamura, Y.; Shin, S.: Cloning, expression, and mapping of UBE2I, a novel gene encoding a human homologue of yeast ubiquitin-conjugating enzymes which are critical for regulating the cell cycle. Cytogenet. Cell Genet. 72:86-89, 1996.

Mosialos, G.; Birkenbach, M.; Yalamanchili, R.; VanArsdale, T.; Ware, C.; Kieff, E.: The Epstein-Barr virus transforming protein LMP1 engages signaling proteins for the tumor necrosis factor receptor family. Cell 80:389-399, 1995.

Rothe, M.; Wong, S. C.; Henzel, W. J.; Goeddel, D. V.: A novel family of putative signal transducers associated with the cytoplasmic domain of the 75 kDa tumor necrosis factor receptor. Cell 78:681-692,1994.

Siemienski, K.; Peters, N.; Scheurich, P.; Wajant, H.: Organization of the human tumour necrosis factor receptor-associated factor 1 (TRAF1) gene and mapping to chromosome 9q33-34. Gene 195:35-39, 1997.

Tsitsikov, E. N.; Laouini, D.; Dunn, I. F.; Sannikova, T. Y.; Davidson, L.; Alt, F. W.; Geha, R. S.: TRAF1 is a negative regulator of TNF signaling: enhanced TNF signaling in TRAF1-deficient mice. Immunity 15:647-657, 2001.

Bejjani, B. A.; Lewis, R. A.; Tomey, K. F.; Anderson, K. L.; Dueker, D. K.; Jabak, M.; Astle, W. F.; Otterud, B.; Leppert, M.; Lupski, J. R.: Mutations in CYP1B1, the gene for cytochrome P4501B1, are the predominant cause of primary congenital glaucoma in Saudi Arabia. Am. J. Hum. Genet. 62:325-333, 1998.

Bejjani, B. A.; Stockton, D. W.; Lewis, R. A.; Tomey, K. F.; Dueker, D. K.; Jabak, M.; Astle, W. F.; Lupski, J. R.: Multiple CYP1B1 mutations and incomplete penetrance in an inbred population segregating primary congenital glaucoma suggest frequent de novo events and a dominant modifier locus. Hum. Molec. Genet. 9:367-374, 2000.

Lin, J.; Arnold, H. B.; Della-Fera, M. A.; Azain, M. J.; Hartzell, D. L.; Baile, C. A.: Myostatin knockout in mice increases myogenesis and decreases adipogenesis. Biochem. Biophys. Res. Commun. 291:701-706, 2002.

McPherron, A. C.; Lawler, A. M.; Lee, S.-J.: Regulation of skeletal muscle mass in mice by a new TGF-beta superfamily member. Nature 387:83-90, 1997.

Robins, P.; Lindahl, T.: DNA ligase IV from HeLa cell nuclei. J. Biol. Chem. 271:24257-24261, 1996.

Roldan-Arjona, T.; Wei, Y.-F.; Carter, K. C.; Klungland, A.; Anselmino, C.; Wang, R.-P.; Augustus, M.; Lindahl, T.: Molecular cloning and functional expression of a human cDNA encoding the antimutator enzyme 8-hydroxyguanine-DNA glycosylase. Proc. Nat. Acad. Sci. 94:8016-8020,1997.

Guo, Z.; Turner, C.; Castle, D.: Relocation of the t-SNARE SNAP-23 from lamellipodia-like cell surface projections regulates compound exocytosis in mast cells. Cell 94:537-548, 1998.

Lazo, P. A.; Nadal, M.; Ferrer, M.; Area, E.; Hernandez-Torres, J.; Nabokina, S. M.; Mollinedo, F.; Estivill, X.: Genomic organization, chromosomal localization, alternative splicing, and isoforms of the human synaptosome-associated protein-23 gene implicated in vesicle-membrane fusion processes. Hum. Genet. 108:211-215, 2001.

Mollinedo, F.; Lazo, P. A.: Identification of two isoforms of the vesicle-membrane fusion protein SNAP-23 in human neutrophils and HL-60 cells. Biochem. Biophys. Res. Commun. 231:808-812, 1997.

Ravichandran, V.; Chawla, A.; Roche, P. A.: Identification of a novel syntaxin- and synaptobrevin/VAMP-binding protein, SNAP-23, expressed in non-neuronal tissues. J. Biol. Chem. 271:13300-13303,1996.

Shukla, A.; Corydon, T. J.; Nielsen, S.; Hoffmann, H. J.; Dahl, R.: Identification of three new splice variants of the SNARE protein SNAP-23. Biochem. Biophys. Res. Commun. 285:320-327, 2001.

Sharpless, N. E.; Ferguson, D. O.; O'Hagan, R. C.; Castrillon, D. H.; Lee, C.; Farazi, P. A.; Alson, S.; Fleming, J.; Morton, C. C.; Frank, K.; Chin, L.; Alt, F. W.; DePinho, R. A.: Impaired nonhomologous end-joining provokes soft tissue sarcomas harboring chromosomal translocations, amplifications, and deletions. Molec. Cell 8:1187-1196, 2001.

Bohme, B.; Holtrich, U.; Wolf, G.; Luzius, H.; Grzeschik, K.-H.; Strebhardt, K.; Rubsamen-Waigmann, H.: PCR mediated detection of a new human receptor-tyrosine-kinase, HEK 2. Oncogene 8:2857-2862,1993.

Ruiz, J. C.; Conlon, F. L.; Robertson, E. J.: Identification of novel protein kinases expressed in the myocardium of the developing mouse heart. Mech. Dev. 48:153-164, 1994.

Ashbourne, K. J.; Byth, B. C.; Meijers, J. C. M.; Cox, D. W.:Polymorphism of the protein C inhibitor (PCI) gene on chromosome 14. Hum. Molec. Genet. 2:92 only, 1993.

Sadler, J. E.: Combined factors V and VIII deficiency climbs onto the map. (Editorial) J. Clin. Invest. 99:555-556, 1997.

Yasuda, T.; Nadano, D.; Iida, R.; Tanaka, Y.; Nakanaga, M.; Kishi, K.: Discovery of a genetic polymorphism of human plasma protein C inhibitor (PCI): genetic survey utilizing isoelectric focusing followed by immunoblotting, immunological and biochemical characterization. Hum. Genet. 89:265-269, 1992.

Detter, J. C.; Zhang, Q.; Mules, E. H.; Novak, E. K.; Mishra, V. S.; Li, W.; McMurtrie, E. B.; Tchernev, V. T.; Wallace, M. R.; Seabra, M. C.; Swank, R. T.; Kingsmore, S. F.: Rab geranylgeranyl transferase alpha mutation in the gunmetal mouse reduces Rab prenylation and platelet synthesis. Proc. Nat. Acad. Sci. 97:4144-4149, 2000.

Novak, E. K.; Reddington, M.; Zhen, L.; Stenberg, P. E.; Jackson, C. W.; McGarry, M. P.; Swank, R. T.:Blood 85:1781-1789, 1995.

Swank, R. T.; Jiang, S. Y.; Reddington, M.; Conway, J.; Stephenson, D.; McGarry, M. P.; Novak, E. K.:Blood 81:2626-2635, 1993.

Bui, T. D.; Rankin, J.; Smith, K.; Huguet, E. L.; Ruben, S.; Strachan, T.; Harris, A. L.; Lindsay, S.: A novel human Wnt gene, WNT10B, mapsto 12q13 and is expressed in human breast carcinomas. Oncogene 14:1249-1253, 1997.

Hardiman, G.; Kastelein, R. A.; Bazan, J. F.: Isolation, characterization and chromosomal localization of human WNT10B. Cytogenet. Cell Genet. 77:278-282, 1997.

Ross, S. E.; Hemati, N.; Longo, K. A.; Bennett, C. N.; Lucas, P. C.; Erickson, R. L.; MacDougald, O. A.: Inhibition of adipogenesis by Wnt signaling. Science 289:950-953, 2000.

Meyerhardt, J. A.; Look, A. T.; Bigner, S. H.; Fearon, E. R.:Identification and characterization of neogenin, a DCC-related gene. Oncogene 14:1129-1136, 1997.

Vielmetter, J.; Chen, X.-N.; Miskevich, F.; Lane, R. P.; Yamakawa, K.; Korenberg, J. R.; Dreyer, W. J.: Molecular characterization of human neogenin, a DCC-related protein, and the mapping of its gene (NEO1) to chromosomal position 15q22.3-q23. Genomics 41:414-421,1997.

Vielmetter, J.; Kayyem, J. F.; Roman, J. M.; Dreyer, W. J.: Neogenin, an avian cell surface protein expressed during terminal neuronal differentiation, is closely related to the human tumor suppressor molecule deleted in colorectal cancer. J. Cell Biol. 127:2009-2020, 1994.

Rosenquist, T. A.; Zharkov, D. O.; Grollman, A. P.: Cloning and characterization of a mammalian 8-oxoguanine DNA glycosylase. Proc. Nat. Acad. Sci. 94:7429-7434, 1997.

Tani, M.; Shinmura, K.; Kohno, T.; Shiroishi, T.; Wakama, S.; Kim, S.-R.; Nohmi, T.; Kasai, H.; Takenoshita, S.; Nagamachi, Y.; Yokota, J.: Genomic structure and chromosomal localization of the mouse Ogg1 gene that is involved in the repair of 8-hydroxyguanine in DNA damage. Mammalian Genome 9:32-37, 1998.

Lim, H. N.; Hawkins, J. R.; Hughes, I. A.: Genetic evidence to exclude the androgen receptor co-factor, ARA70 (NCOA4) as a candidate gene for the causation of undermasculinised genitalia. (Letter) Clin. Genet. 59:284-286, 2001.

Santoro, M.; Dathan, N. A.; Berlingieri, M. T.; Bongarzone, I.; Paulin, C.; Grieco, M.; Pierotti, M. A.; Vecchio, G.; Fusco, A.:Molecular characterization of RET/PTC3: a novel rearranged version of the RET proto-oncogene in a human thyroid papillary carcinoma. Oncogene 9:509-516, 1994.

Yeh, S.; Chang, C.: Cloning and characterization of a specific coactivator, ARA-70, for the androgen receptor in human prostate cells. Proc. Nat. Acad. Sci. 93:5517-5521, 1996.

Donghi, R.; Sozzi, G.; Pierotti, M. A.; Biunno, I.; Miozzo, M.; Fusco, A.; Grieco, M.; Santoro, M.; Vecchio, G.; Spurr, N. K.; DellaPorta, G.: The oncogene associated with human papillary thyroid carcinoma (PTC) is assigned to chromosome 10 q11-q12 in the same region as multiple endocrine neoplasia type 2A (MEN2A). Oncogene 4:521-523, 1989.

Nikiforova, M. N.; Stringer, J. R.; Blough, R.; Medvedovic, M.; Fagin, J. A.; Nikiforov, Y. E.: Proximity of chromosomal loci that participate in radiation-induced rearrangements in human cells. Science 290:138-141, 2000.

Sozzi, G.; Pierotti, M. A.; Miozzo, M.; Donghi, R.; Radice, P.; De Benedetti, V.; Grieco, M.; Santoro, M.; Fusco, A.; Vecchio, G.; Mathew, C. G. P.; Ponder, B. A. J.; Spurr, N. K.: Refined localization to contiguous regions on chromosome 10q of the two genes (H4 and RET) that form the oncogenic sequence PTC. Oncogene 6:339-342, 1991.

Tong, Q.; Li, Y.; Smanik, P. A.; Fithian, L. J.; Xing, S.; Mazzaferri, E. L.; Jhiang, S. M.: Characterization of the promoter region and oligomerization domain of H4 (D10S170), a gene frequently rearranged with the ret proto-oncogene. Oncogene 10:1781-1787, 1995.

Araki, T.; Milbrandt, J.: Ninjurin, a novel adhesion molecule, is induced by nerve injury and promotes axonal growth. Neuron 17:353-361, 1996.

Araki, T.; Zimonjic, D. B.; Popescu, N. C.; Milbrandt, J.: Mechanism of homophilic binding mediated by ninjurin, a novel widely expressed adhesion molecule. J. Biol. Chem. 272:21373-21380, 1997.

Chadwick, B. P.; Heath, S. K.; Williamson, J.; Obermayr, F.; Patel, L.; Sheer, D.; Frischauf, A.-M.: The human homologue of the ninjurin gene maps to the candidate region of hereditary sensory neuropathy type I (HSN1). Genomics 47:58-63, 1998.

Mandich, P.; Bellone, E.; Di Maria, E.; Pigullo, S.; Pizzuti, A.; Schenone, A.; Soriani, S.; Varese, A.; Windebank, A. J.; Ajmar, F.: Exclusion of the ninjurin gene as a candidate for hereditary sensory neuropathies type I and type II. Am. J. Med. Genet. 83:409-410,1999.

McAllister, G.; Whiting, P.; Hammond, E. A.; Knowles, M. R.; Atack, J. R.; Bailey, F. J.; Maigetter, R.; Ragan, C. I.: cDNA cloning of human and rat brain myo-inositol monophosphatase: expression and characterization of the human recombinant enzyme. Biochem. J. 284:749-754, 1992.

Sjoholt, G.; Molven, A.; Lovlie, R.; Wilcox, A.; Sikela, J. M.; Steen, V. M.: Genomic structure and chromosomal localization of a human myo-inositol monophosphatase gene (IMPA). Genomics 45:113-122,1997.

Steen, V. M.; Gulbrandsen, A. K.; Eiken, H. G.; Berle, J. O.: Lack of genetic variation in the coding region of the myo-inositol monophosphatase gene in lithium-treated patients with manic depressive illness. Pharmacogenetics 6:113-116, 1996.

McDonald, M. T.; Flejter, W.; Sheldon, S.; Putzi, M. J.; Gorski, J. L.: XY sex reversal and gonadal dysgenesis due to 9p24 monosomy. Am. J. Med. Genet. 73:321-326, 1997.

Muroya, K.; Okuyama, T.; Goishi, K.; Ogiso, Y.; Fukuda, S.; Kameyama, J.; Sato, H.; Suzuki, Y.; Terasaki, H.; Gomyo, H.; Wakui, K.; Fukushima, Y.; Ogata, T.: Sex-determining gene (s) on distal 9p: clinical and molecular studies in six cases. J. Clin. Endocr. Metab. 85:3094-3100,2000.

Raymond, C. S.; Shamu, C. E.; Shen, M. M.; Seifert, K. J.; Hirsch, B.; Hodgkin, J.; Zarkower, D.: Evidence for evolutionary conservation of sex-determining genes. Nature 391:691-695, 1998.

Shan, Z.; Zabel, B.; Trautmann, U.; Hillig, U.; Ottolenghi, C.; Wang, Y.; Haaf, T.: FISH mapping of the sex-reversal region on human chromosome 9p in two XY females and in primates. Europ. J. Hum. Genet. 8:167-173, 2000.

Shen, M. M.; Hodgkin, J.: mab-3, a gene required for sex-specific yolk protein expression and a male-specific lineage in C. elegans. Cell 54:1019-1031, 1988.

Smith, C. A.; McClive, P. J.; Western, P. S.; Reed, K. J.; Sinclair, A. H.: Conservation of a sex-determining gene. (Letter) Nature 402:601-602, 1999.

Veitia, R.; Nunes, M.; Brauner, R.; Doco-Fenzy, M.; Joanny-Flinois, O.; Jaubert, F.; Lortat-Jacob, S.; Fellous, M.; McElreavey, K.: Deletions of distal 9p associated with 46, XY male to female sex reversal: definition of the breakpoints at 9p23.3-p24.1. Genomics 41:271-274, 1997.

Spicer, A. P.; Olson, J. S.; McDonald, J. A.: Molecular cloning and characterization of a cDNA encoding the third putative mammalian hyaluronan synthase. J. Biol. Chem. 272:8957-8961, 1997.

Bagri, A.; Marin, O.; Plump, A. S.; Mak, J.; Pleasure, S. J.; Rubenstein, J. L. R.; Tessier-Lavigne, M.: Slit proteins prevent midline crossing and determine the dorsoventral position of major axonal pathways in the mammalian forebrain. Neuron 33:233-248, 2002.

Dallol, A.; Forgacs, E.; Martinez, A.; Sekido, Y.; Walker, R.; Kishida, T.; Rabbitts, P.; Maher, E. R.; Minna, J. D.; Latif, F.: Tumour specific promoter region methylation of the human homologue of the Drosophila Roundabout gene DUTT1 (ROBO1) in human cancers. Oncogene 21:3020-3028, 2002.

Kidd, T.; Brose, K.; Mitchell, K. J.; Fetter, R. D.; Tessier-Lavigne, M.; Goodman, C. S.; Tear, G.: Roundabout controls axon crossing of the CNS midline and defines a novel subfamily of evolutionarily conserved guidance receptors. Cell 92:205-215, 1998.

Sundaresan, V.; Chung, G.; Heppell-Parton, A.; Xiong, J.; Grundy, C.; Roberts, I.; James, L.; Cahn, A.; Bench, A.; Douglas, J.; Minna, J.; Sekido, Y.; Lerman, M.; Latif, F.; Bergh, J.; Li, H.; Lowe, N.; Ogilvie, D.; Rabbitts, P.: Homozygous deletions at 3p12 in breast and lung cancer. Oncogene 17:1723-1729, 1998.

Zallen, J. A.; Yi, B. A.; Bargmann, C. I.: The conserved immunoglobulin superfamily member SAX-3/Robo directs multiple aspects of axon guidance in C. elegans. Cell 92:217-227, 1998.

Gerard, M.; Hernandez, L.; Wevrick, R.; Stewart, C. L.: Disruption of the mouse necdin gene results in early postnatal lethality. Nature Genet. 23:199-202, 1999.

Hurst, L. D.; McVean, G.; Moore, T.: Imprinted genes have few and small introns. (Letter) Nature Genet. 12:234-237, 1996.

Jay, P.; Rougeulle, C.; Massacrier, A.; Moncla, A.; Mattei, M.-G.; Malzac, P.; Roeckel, N.; Taviaux, S.; Lefranc, J.-L. B.; Cau, P.; Berta, P.; Lalande, M.; Muscatelli, F.: The human necdin gene, NDN, is maternally imprinted and located in the Prader-Willi syndrome chromosomal region. Nature Genet. 17:357-360, 1997.

MacDonald, H. R.; Wevrick, R.: The necdin gene is deleted in Prader-Willi syndrome and is imprinted in human and mouse. Hum. Molec. Genet. 6:1873-1878, 1997.

Maruyama, K.; Usami, M.; Aizawa, T.; Yoshikawa, K.: A novel brain-specific mRNA encoding nuclear protein (necdin) expressed in neurally differentiated embryonal carcinoma cells. Biochem. Biophys. Res. Comm. 178:291-296, 1991.

Muscatelli, F.; Abrous, D. N.; Massacrier, A.; Boccaccio, I.; LeMoal, M.; Cau, P.; Cremer, H.: Disruption of the mouse Necdin gene results in hypothalamic and behavioral alterations reminiscent of the human Prader-Willi syndrome. Hum. Molec. Genet. 9:3101-3110,2000.

Nakada, Y.; Taniura, H.; Uetsuki, T.; Inazawa, J.; Yoshikawa, K.: The human chromosomal gene for necdin, a neuronal growth suppressor, in the Prader-Willi syndrome deletion region. Gene 213:65-72, 1998.

Nicholls, R. D.: Incriminating gene suspects, Prader-Willi style. Nature Genet. 23:132-134, 1999.

Tsai, T.-F.; Armstrong, D.; Beaudet, A. L.: Necdin-deficient mice do not show lethality or the obesity and infertility of Prader-Willi syndrome. (Letter) Nature Genet. 22:15-16, 1999.

Watrin, F.; Roeckel, N.; Lacroix, L.; Mignon, C.; Mattei, M.-G.; Disteche, C.; Muscatelli, F.: The mouse necdin gene is expressed from the paternal allele only and lies in the 7C region of the mouse chromosome 7, a region of conserved synteny to the human Prader-Willi syndrome region. Europ. J. Hum. Genet. 5:324-332, 1997.

Delmas, V.; Stokes, D. G.; Perry, R. P.: A mammalian DNA-binding protein that contains a chromodomain and an SNF2/SWI2-like helicase domain. Proc. Nat. Acad. Sci. 90:2414-2418, 1993.

Woodage, T.; Basrai, M. A.; Baxevanis, A. D.; Hieter, P.; Collins, F. S.: Characterization of the CHD family of proteins. Proc. Nat. Acad. Sci. 94:11472-11477, 1997.

Omeis, I. A.; Hsu, Y.-C.; Perin, M. S.: Mouse and human neuronal pentraxin 1 (NPXT1): conservation, genomic structure, and chromosomal localization. Genomics 36:543-545, 1996.

Babic, A. M.; Kireeva, M. L.; Kolesnikova, T. V.; Lau, L. F.:CYR61, a product of a growth factor-inducible immediate early gene, promotes angiogenesis and tumor growth. Proc. Nat. Acad. Sci. 95:6355-6360, 1998.

Jay, P.; Berge-Lefranc, J. L.; Marsollier, C.; Mejean, C.; Taviaux, S.; Berta, P.: The human growth factor-inducible immediate early gene, CYR61, maps to chromosome 1p. Oncogene 14:1753-1757, 1997.

Kireeva, M. L.; Lam, S. C.-T.; Lau, L. F.: Adhesion of human umbilical vein endothelial cells to the immediate-early gene product Cyr61 is mediated through integrin alpha (V) beta (3). J. Biol. Chem. 273:3090-3096,1998.

Martinerie, C.; Viegas-Pequignot, E.; Nguyen, V. C.; Perbal, B.: Chromosomal mapping and expression of the human cyr61 gene in tumour cells from the nervous system. J. Clin. Path. 50:310-316, 1997.

Sampath, D.; Zhu,Y.; Winneker, R. C.; Zhang, Z.: Aberrant expression of Cyr61, a member of the CCN (CTGF/Cyr61/ Cef10/NOVH) family, and dysregulation by 17-beta-estradiol and basic fibroblast growth factor in human uterine leiomyomas. J. Clin. Endocr. Metab. 86:1707-1715,2001.

Fujino, T.; Kang, M.-J.; Suzuki, H.; Iijima, H.;Yamamoto, T.:Molecular characterization and expression of rat acyl-CoA synthetase 3. J. Biol. Chem. 271:16748-16752, 1996.

Minekura, H.; Fujino, T.; Kang, M.-J.; Fujita, T.; Endo, Y.; Yamamoto, T. T.: Human acyl-coenzyme A synthetase 3 cDNA and localization of its gene (ACS3) to chromosome band 2q34-q35. Genomics 42:180-181,1997.

Wang, M.: Isolation and characterization of a human gene encoding a single-strand-specific endoribonuclease. Ph. D. Thesis: Stanford Univ., 1995.

Wang, M.; Cohen, S. N.: ard-1: a human gene that reverses the effects of temperature-sensitive and deletion mutations in the Escherichia coli rne gene and encodes an activity producing RNase E-like cleavages. Proc. Nat. Acad. Sci. 91:10591-10595, 1994.

Cushman, L. J.; Camper, S. A.: Molecular basis of pituitary dysfunction in mouse and human. Mammalian Genome 12:485-494, 2001.

Pellegrini-Bouiller, I.; Manrique, C.; Gunz, G.; Grino, M.; Zamora, A. J.; Figarella-Branger, D.; Grisoli, F.; Jaquet, P.; Enjalbert, A.: Expression of the members of the Ptx family of transcription factors in human pituitary adenomas. J. Clin. Endocr. Metab. 84:2212-2220, 1999.

Brinke, A.; Green, P. M.; Giannelli, F.: Characterization of the gene (VBP1) and transcript for the von Hippel-Lindau binding protein and isolation of the highly conserved murine homologue. Genomics 45:105-112, 1997.

Brinke, A.; Tagliavacca, L.; Naylor, J.; Green, P.; Giangrande, P.; Giannelli, F.: Two chimaeric transcription units result from an inversion breaking intron 1 of the factor VIII gene and a region reportedly affected by reciprocal translocations in T-cell leukaemia. Hum. Molec. Genet. 5:1945-1951, 1996.

Clifford, S. C.; Walsh, S.; Hewson, K.; Green, E. K.; Brinke, A.; Green, P. M.; Gianelli, F.; Eng, C.; Maher, E. R.: Genomic organization and chromosomal localization of the human CUL2 gene and the role of von Hippel-Lindau tumor suppressor-binding protein (CUL2 and VBP1) mutation and loss in renal-cell carcinoma development. Genes Chromosomes Cancer 26:20-28, 1999.

Hemberger, M.; Himmelbauer, H.; Neumann, H. P. H.; Plate, K. H.; Schwarzkopf, G.; Fundele, R.: Expression of the von Hippel-Lindau-binding protein-1 (Vbp1) in fetal and adult mouse tissues. Hum. Molec. Genet. 8:229-236, 1999.

Tsuchiya, H.; Iseda, T.; Hino, O.: Identification of a novel protein (VBP-1) binding to the von Hippel-Lindau (VHL) tumor suppressor gene product. Cancer Res. 56:2881-2885, 1996.

Corbaz, A.; ten Hove, T.; Herren, S.; Graber, P.; Schwartsburd, B.; Belzer, I.; Harrison, J.; Plitz, T.; Kosco-Vilbois, M. H.; Kim, S.-H.; Dinarello, C. A.; Novick, D.; van Deventer, S.; Chvatchko, Y.: IL-18-binding protein expression by endothelial cells and macrophagesis up-regulated during active Crohn's disease. J. Immun. 168:3608-3616,2002.

Turner, N.; Mason, P. J.; Brown, R.; Fox, M.; Povey, S.; Rees, A.; Pusey, C. D.: Molecular cloning of the human good pasture antigen demonstrates it to be the alpha-3 chain of type IV collagen. J. Clin. Invest. 89:592-601, 1992.

Hoffmann, M. M.; Jacob, S.; Luft, D.; Schmulling, R.-M.; Rett, K.; Marz, W.; Haring, H.-U.; Matthaei, S.: Type I hyperlipoproteinemia due to a novel loss of function mutation of lipoprotein lipase, cys239-trp, associated with recurrent severe pancreatitis. J. Clin. Endocr. Metab. 85:4795-4798, 2000.

Holt, L. E., Jr.; Aylward, F. X.; Timbers, H. G.: Idiopathic familial lipemia. Bull. Johns Hopkins Hosp. 64:279-314, 1939.

Ishimura-Oka, K.; Faustinella, F.; Kihara, S.; Smith, L. C.; Oka, K.; Chan, L.: A missense mutation (trp86-to-arg) in exon 3 of the lipoprotein lipase gene: a cause of familial chylomicronemia. Am. J. Hum. Genet. 50:1275-1280, 1992.

Kirchgessner, T. G.; Chuat, J.-C.; Heinzmann, C.; Etienne, J.; Guilhot, S.; Svenson, K.; Ameis, D.; Pilon, C.; d'Auriol, L.; Andalibi, A.; Schotz, M. C.; Galibert, F.; Lusis, A. J.: Organization of the human lipoprotein lipase gene and evolution of the lipase gene family. Proc. Nat. Acad. Sci. 86:9647-9651, 1989.

Kirchgessner, T. G.; Svenson, K. L.; Lusis, A. J.; Schotz, M. C.: The sequence of cDNA encoding lipoprotein lipase: a member of a lipase gene family. J. Biol. Chem. 262:8463-8466, 1987.

Kobayashi, J.; Sasaki, N.; Tashiro, J.; Inadera, H.; Saito, Y.; Yoshida, S.: A missense mutation (ala334-to-thr) in exon 7 of the lipoprotein lipase gene in a case with type I hyperlipidemia. Biochem. Biophys. Res. Commun. 191:1046-1054, 1993.

Kastelein, J. J. P.; Groenemeyer, B. E.; Hallman, D. M.; Henderson, H.; Reymer, P. W. A.; Gagne, S. E.; Jansen, H.; Seidell, J. C.; Kromhout, D.; Jukema, J. W.; Bruschke, A. V. G.; Boerwinkle, E.; Hayden, M. R.; The Regress Study Group: The asn9 variant of lipoprotein lipase is associated with the -93G promoter mutation and an increased risk of coronary artery disease. Clin. Genet. 53:27-33, 1998.

Kobayashi, J.; Nishida, T.; Ameis, D.; Stahnke, G.; Schotz, M. C.; Hashimoto, H.; Fukamachi, I.; Shirai, K.; Saito, Y.; Yoshida, S.: A heterozygous mutation (the codon for ser477 to a stop codon) in lipoprotein lipase contributes to a defect in lipid interface recognition in a case with type I hyperlipidemia. Biochem. Biophys. Res. Commun. 182:70-77, 1992.

Langlois, S.; Deeb, S.; Brunzell, J.; Kastelein, J. J.; Hayden, M. R.: A unique insertion accounts for a significant proportion of the mutations in the lipoprotein lipase (LPL) gene.(Abstract) Am. J. Hum. Genet. 43: A191, 1988.

Langlois, S.; Deeb, S.; Brunzell, J. D.; Kastelein, J. J.; Hayden, M. R.: A major insertion accounts for a significant proportion of mutations underlying human lipoprotein lipase deficiency. Proc. Nat. Acad. Sci. 86:948-952, 1989.

Levak-Frank, S.; Radner, H.; Walsh, A.; Stollberger, R.; Knipping, G.; Hoefler, G.; Sattler, W.; Weinstock, P. H.; Breslow, J. L.; Zechner, R.: Muscle-specific overexpression of lipoprotein lipase causes a severe myopathy characterized by proliferation of mitochondria and peroxisomes in transgenic mice. J. Clin. Invest. 96:976-986, 1995.

Li, S.; Oka, K.; Galton, D.; Stocks, J.: Pvu-II RFLP at the human lipoprotein lipase (LPL) gene locus. Nucleic Acids Res. 16:2358,1988.

Lo, J. Y.; Smith, L. C.; Chan, L.: Lipoprotein lipase: role of intramolecular disulfide bonds in enzyme catalysis. Biochem. Biophys. Res. Commun. 206:266-271, 1995.

Ma, Y.; Henderson, H. E.; Julien, P.; Roederer, G.; Brunzell, J.; Hayden, M. R.: A missense mutation (pro-to-leu207) in the human lipoprotein lipase gene is the major cause of type I hyperlipoproteinemia in French Canadians. (Series) Miami Short Reports. Advances in Gene Technology: The Molecular Biology of Human Genetic Disease. New York: IRL Press (pub.) 1:1991. Pp. 34 only.

Ma, Y.; Henderson, H. E.; Ven Murthy, M. R.; Roederer, G.; Monsalve, M. V.; Clarke, L. A.; Normand, T.; Julien, P.; Gagne, C.; Lambert, M.; Davignon, J.; Lupien, P. J.; Brunzell, J.; Hayden, M. R.: A mutation in the human lipoprotein lipase gene as the most common cause of familial chylomicronemia in French Canadians. New Eng. J. Med. 324:1761-1766, 1991.

Ma, Y.; Liu, M.-S.; Chitayat, D.; Bruin, T.; Beisiegel, U.; Benlian, P.; Foubert, L.; De Gennes, J. L.; Funke, H.; Forsythe, I.; Blaichman, S.; Papanikolaou, M.; Erkelens, D. W.; Kastelein, J.; Brunzell, J. D.; Hayden, M. R.: Recurrent missense mutations at the first and second base of codon arg243 in human lipoprotein lipase in patients of different ancestries. Hum. Mutat. 3:52-58, 1994.

Ma, Y.; Liu, M.-S.; Ginzinger, D.; Frohlich, J.; Brunzell, J. D.; Hayden, M. R.: Gene-environment interaction in the conversion of a mild-to-severe phenotype in a patient homozygous for a ser172-to-cysmutation in the lipoprotein lipase gene. J. Clin. Invest. 91:1953-1958,1993.

Ma, Y.; Wilson, B. I.; Bijvoet, S.; Henderson, H. E.; Cramb, E.; Roederer, G.; Ven Murthy, M. R.; Julien, P.; Bakker, H. D.; Kastelein, J. J. P.; Brunzell, J. D.; Hayden, M. R.: A missense mutation (asp250-to-asn) in exon 6 of the human lipoprotein lipase gene causes chylomicronemia in patients of different ancestries. Genomics 13:649-653, 1992.

Mattei, M. G.; Etienne, J.; Chuat, J. C.; Nguyen, V. C.; Brault, D.; Bernheim, A.; Galibert, F.: Assignment of the human lipoprotein lipase (LPL) gene to chromosome band 8p22. Cytogenet. Cell Genet. 63:45-46, 1993.

Miesenbock, G.; Holzl, B.; Foger, B.; Brandstatter, E.; Paulweber, B.; Sandhofer, F.; Patsch, J. R.: Heterozygous lipoprotein lipase deficiency due to a missense mutation as the cause of impaired triglyceride tolerance with multiple lipoprotein abnormalities. J. Clin. Invest. 91:448-455, 1993.

Nevin, D. N.; Brunzell, J. D.; Deeb, S. S.: The LPL gene in individuals with familial combined hyperlipidemia and decreased LPL activity. Arteriosclerosis Thromb. 14:869-873, 1994.

Nevin, N. C.; Slack, J.: Hyperlipidaemic xanthomatosis II: mode of inheritance in 55 families with essential hyperlipidaemia and xanthomatosis. J. Med. Genet. 5:9-28, 1968.

Nickerson, D. A.; Taylor, S. L.; Weiss, K. M.; Clark, A. G.; Hutchinson, R. G.; Stengard, J.; Salomaa, V.; Vartiainen, E.; Boerwinkle, E.; Sing, C. F.: DNA sequence diversity in a 9.7-kb region of the human lipoprotein lipase gene. Nature Genet. 19:233-240, 1998.

Yen, P. H.: A long-range restriction map of deletion interval6 of the human Y chromosome: a region frequently deleted in azoospermic males. Genomics 54:5-12, 1998.

MacLean, H. E.; Chu, S.; Warne, G. L.; Zajac, J. D.: Related individuals with different androgen receptor gene deletions. J. Clin. Invest. 91:1123-1128, 1993.

Madgar, I.; Green, L.; Kent-First, M.; Weissenberg, R.; Gershoni-Baruch, R.; Goldman, B.; Friedman, E.: Genotyping of Israeli infertile men with idiopathic oligozoospermia. Clin. Genet. 62:203-207, 2002.

Marcelli, M.; Tilley, W. D.; Wilson, C. M.; Griffin, J. E.; Wilson, J. D.; McPhaul, M. J.: Definition of the human androgen receptor gene structure permits the identification of mutations that cause androgen resistance: premature termination of the receptor protein at amino acid residue 588 causes complete androgen resistance. Molec. Endocr. 4:1105-1116, 1990.

Marcelli, M.; Tilley, W. D.; Wilson, C. M.; Wilson, J. D.; Griffin, J. E.; McPhaul, M. J.: A single nucleotide substitution introduces a premature termination codon into the androgen receptor gene of a patient with receptor-negative androgen resistance. J. Clin. Invest. 85:1522-1528, 1990.

Marcelli, M.; Tilley, W. D.; Zoppi, S.; Griffin, J. E.; Wilson, J. D.; McPhaul, M. J.: Androgen resistance associated with a mutation of the androgen receptor at amino acid 772 (arg-to-cys) results from a combination of decreased messenger ribonucleic acid levels and impairment of receptor function. J. Clin. Endocr. 73:318-325, 1991.

McCampbell, A.; Taylor, J. P.; Taye, A. A.; Robitschek, J.; Li, M.; Walcott, J.; Merry, D.; Chai, Y.; Paulson, H.; Sobue, G.; Fischbeck, K. H.: CREB-binding protein sequestration by expanded polyglutamine. Hum. Molec. Genet. 9:2197-2202, 2000.

McPhaul, M. J.; Griffin, J. E.: Male pseudohermaphroditism caused by mutations of the human androgen receptor. J. Clin. Endocr. Metab. 84:3435-3441, 1999.

McPhaul, M. J.; Marcelli, M.; Tilley, W. D.; Griffin, J. E.; Isidro-Gutierrez, R. F.; Wilson, J. D.: Molecular basis of androgen resistance in a family with a qualitative abnormality of the androgen receptor and responsive to high-dose androgen therapy. J. Clin. Invest. 87:1413-1421,1991.

McPhaul, M. J.; Marcelli, M.; Zoppi, S.; Griffin, J. E.; Wilson, J. D.: Genetic basis of endocrine disease 4: the spectrum of mutations in the androgen receptor gene that causes androgen resistance. J. Clin. Endocr. Metab. 76:17-23, 1993.

McPhaul, M. J.; Marcelli, M.; Zoppi, S.; Wilson, C. M.; Griffin, J. E.; Wilson, J. D.: Mutations in the ligand-binding domain of the androgen receptor gene cluster in two regions of the gene. J. Clin. Invest. 90:2097-2101, 1992.

McPhaul, M. J.; Schweikert, H.-U.; Allman, D. R.: Assessment of androgen receptor function in genital skin fibroblasts using are combinant adenovirus to deliver an androgen-responsive reporter gene. J. Clin. Endocr. Metab. 82:1944-1948, 1997.

Mifsud, A.; Ramirez, S.; Yong, E. L.: Androgen receptor gene CAG trinucleotide repeats in anovulatory infertility and polycystic ovaries. J. Clin. Endocr. Metab. 85:3484-3488, 2000.

Migeon, B. R.; Brown, T. R.; Axelman, J.; Migeon, C. J.: Studies of the locus for androgen receptor: localization on the human X and evidence for homology with the Tfm locus in the mouse. Proc. Nat. Acad. Sci. 78:6339-6343, 1981.

Mongan, N. P.; Jaaskelainen, J.; Green, K.; Schwabe, J. W.; Shimura, N.; Dattani, M.; Hughes, I. A.: Two de novo mutations in the AR gene cause the complete androgen insensitivity syndrome in a pair of monozygotic twins. J. Clin. Endocr. Metab. 87:1057-1061, 2002.

Mononen, N.; Syrjakoski, K.; Matikainen, M.; Tammela, T. L. J.; Schleutker, J.; Kallioniemi, O.-P.; Trapman, J.; Koivisto, P. A.: Two percent of Finnish prostate cancer patients have a germ-line mutation in the hormone-binding domain of the androgen receptor gene. Cancer Res. 60:6479-6481, 2000.

Murono, K.; Mendonca, B. B.; Arnhold, I. J. P.; Rigon, A. C. M. M.; Migeon, C. J.; Brown, T. R.: Human androgen insensitivity due to point mutations encoding amino acid substitutions in the androgen receptor steroid-binding domain. Hum. Mutat. 6:152-162, 1995.

Nakao, R.; Haji, M.; Yanase, T.; Ogo, A.; Takayanagi, R.; Katsube, T.; Fukumaki, Y.; Nawata, H.: A single amino acid substitution (met786-to-val) in the steroid-binding domain of human androgen receptor leads to complete androgen insensitivity syndrome. J. Clin. Endocr. Metab. 74:1152-1157, 1992.

Newmark, J. R.; Hardy, D. O.; Tonb, D. C.; Carter, B. S.; Epstein, J. I.; Isaacs, W. B.; Brown, T. R.; Barrack, E. R.: Androgen receptor gene mutations in human prostate cancer. Proc. Nat. Acad. Sci. 89:6319-6323, 1992.

Nguyen, D.; Steinberg, S. V.; Rouault, E.; Chagnon, S.; Gottlieb, B.; Pinsky, L.; Trifiro, M.; Mader, S.: A G577R mutation in the human AR P box results in selective decreases in DNA binding and in partial androgen insensitivity syndrome. Molec. Endocr. 15:1790-1802, 2001.

Ohno, S.: The Y-linked antigen locus and the X-linked Tfm locus as major regulatory genes of the mammalian sex determining mechanism. J. Steroid Biochem. 8:585-592, 1977.100. Ohno, S.: Simplicity of mammalian regulatory systems inferred by single gene determination of sex phenotypes. Nature 234:134-137,1971.101. Ong, Y. C.; Wong, H. B.; Adaikan, G.; Yong, E. L.: Directed pharmacological therapy of ambiguous genitalia due to an androgen receptor gene mutation. (Letter) Lancet 354:1444-1445, 1999.102. Patterson, M. N.; Hughes, I. A.; Gottlieb, B.; Pinsky, L.: The androgen receptor gene mutations database. Nucleic Acids Res. 22:3560-3562, 1994.103. Pinsky, L.; Kaufman, M.; Killinger, D. W.; Burko, B.; Shatz, D.; Volpe, R.: Human minimal androgen insensitivity with normal dihydrotestosterone-binding capacity in cultured genital skin fibroblasts: evidence for an androgen-selective qualitative abnormality of the receptor. Am. J. Hum. Genet. 36:965-978, 1984.104. Pinsky, L.; Kaufman, M.; Levitsky, L. L.: Partial androgen resistance due to a distinctive qualitative defect of the androgen receptor. Am. J. Med. Genet. 27:459-466, 1987.105. Pinsky, L.; Kaufman, M.; Summitt, R. L.: Congenital androgen insensitivity due to a qualitatively abnormal androgen receptor. Am. J. Med. Genet. 10:91-99, 1981.106. Pinsky, L.; Trifiro, M.; Sebbaghian, N.; Kaufman, M.; Chang, C.; Trapman, J.; Brinkmann, A. O.; Kuiper, G. G. J. M.; Ris, C. J.; Brown, C. J.; Willard, H. F.; Sergovich, F.: A deletional alteration of the androgen receptor (AR) gene in a sporadic patient with complete androgen insensitivity (CAI) who is mentally retarded. (Abstract) Am. J. Hum. Genet. 45 (suppl.): A212, 1989.107. Prior, L.; Bordet, S.; Trifiro, M. A.; Mhatre, A.; Kaufman, M.; Pinsky, L.; Wrogeman, K.; Belsham, D. D.; Pereira, F.; Greenberg, C.; Trapman, J.; Brinkman, A. O.; Chang, C.; Liao, S.: Replacement of arginine 773 by cysteine or histidine in the human androgen receptor causes complete androgen insensitivity with different receptor phenotypes. Am. J. Hum. Genet. 51:143-155, 1992.108. Quigley, C. A.; Friedman, K. J.; Johnson, A.; Lafreniere, R. G.; Silverman, L. M.; Lubahn, D. B.; Brown, T. R.; Wilson, E. M.; Willard, H. F.; French, F. S.: Complete deletion of the androgen receptor gene: definition of the null phenotype of the androgen insensitivity syndrome and determination of carrier status. J. Clin. Endocr. Metab. 74:927-933, 1992.109. Ris-Stalpers, C.; Kuiper, G. G. J. M.; Faber, P. W.; Schweikert, H. U.; van Rooij, H. C. J.; Zegers, N. D.; Hodgins, M. B.; Degenhart, H. J.; Trapman, J.; Brinkmann, A. O.: Aberrant splicing of androgen receptor mRNA results in synthesis of a nonfunctional receptor protein in a patient with androgen insensitivity. Proc. Nat. Acad. Sci. 87:7866-7870, 1990.110. Rodien, P.; Mebarki, F.; Mowszowicz, I.; Chaussain, J.-L.; Young, J.; Morel, Y.; Schaison, G.: Different phenotypes in a family with androgen insensitivity caused by the same M780I point mutation in the androgen receptor gene. J. Clin. Endocr. Metab. 81:2994-2998, 1996.111. Sai, T.; Seino, S.; Chang, C.; Trifiro, M.; Pinsky, L.; Mhatre, A.; Kaufman, M.; Lambert, B.; Trapman, J.; Brinkmann, A. O.; Rosenfield, R. L.; Liao, S.: An exonic point mutation of the androgen receptor gene in a family with complete androgen insensitivity. Am. J. Hum. Genet. 46:1095-1100, 1990.112. Sammarco, I.; Grimaldi, P.; Rossi, P.; Cappa, M.; Moretti, C.; Frajese, G.; Geremia, R.: Novel point mutation in the splice donor site of exon-intron junction 6 of the androgen receptor gene in a patient with partial androgen insensitivity syndrome. J. Clin. Endocr. Metab. 85:3256-3261, 2000.113. Schoenberg, M. P.; Hakimi, J. M.; Wang, S.; Bova, G. S.; Epstein, J. I.; Fischbeck, K. H.; Isaacs, W. B.; Walsh, P. C.; Barrack, E. R.: Microsatellite mutation (CAG (24-to-18)) in the androgen receptor gene in human prostate cancer Biochem. Biophys. Res. Commun. 198:74-80, 1994.114. Shang, Y.; Myers, M.; Brown, M.: Formation of the androgen receptor transcription complex. Molec. Cell 9:601-610, 2002.115. Simeoni, S.; Mancini, M. A.; Stenoien, D. L.; Marcelli, M.; Weigel, N. L.; Zanisi, M.; Martini, L.; Poletti, A.: Motoneuronal cell death is not correlated with aggregate formation of androgen receptors containing an elongated polyglutamine tract. Hum. Molec. Genet. 9:133-144,2000.116. Sullivan, D. A.; Sullivan, B. D.; Ullman, M. D.; Rocha, E. M.; Krenzer, K. L.; Cermak, J. M.; Toda, I.; Doane, M. G.; Evans, J. E.; Wickham, L. A.: Androgen influence on the meibomian gland. Invest. Ophthal. Vis. Sci. 41:3732-3742, 2000.117. Sultan, C.; Lumbroso, S.; Poujol, N.; Belon, C.; Boudon, C.; Lobaccaro, J.-M.: Mutations of androgen receptor gene in androgen insensitivity syndromes. J. Steroid Biochem. Molec. Biol. 46:519-530,1993.118. Sutherland, R. W.; Wiener, J. S.; Hicks, J. P.; Marcelli, M.; Gonzales, E. T.; Roth, D. R.; Lamb, D. J.: Androgen receptor gene mutations are rarely associated with isolated penile hypospadias. J. Urol. 156:828-831, 1996.119. Taplin, M.-E.; Bubley, G. J.; Shuster, T. D.; Frantz, M. E.; Spooner, A. E.; Ogata, G. K.; Keer, H. N.; Balk, S. P.: Mutation of the androgen-receptor gene in metastatic androgen-independent prostate cancer. New Eng. J. Med. 332:1393-1398, 1995.120. Tilley, W. D.; Marcelli, M.; Wilson, J. D.; McPhaul, M. J.:Characterization and expression of a cDNA encoding the human androgen receptor. Proc. Nat. Acad. Sci. 86:327-331, 1989.121. Trifiro, M.; Prior, L.; Pinsky, L.; Kaufman, M.; Chang, C.; Trapman, J.; Brinkmann, A. O.; Kuiper, G. G. J. M.; Ris, C.: A single transition at an exonic CpG site apparently abolishes androgen receptor (AR)-binding activity in a family with complete androgen insensitivity (CAI). (Abstract) Am. J. Hum. Genet. 45 (suppl.): A225, 1989.122. Trifiro, M.; Prior, R. L.; Sabbaghian, N.; Pinsky, L.; Kaufman, M.; Nylen, E. G.; Belsham, D. D.; Greenberg, C. R.; Wrogemann, K.: Amber mutation creates a diagnostic MaeI site in the androgen receptor gene of a family with complete androgen insensitivity. Am. J. Med. Genet. 40:493-499, 1991.123. Tut, T. G.; Ghadessy, F. J.; Trifiro, M. A.; Pinsky, L.; Yong, E. L.: Long polyglutamine tracts in the androgen receptor are associated with reduced trans-activation, impaired sperm production, and male infertility. J. Clin. Endocr. Metab. 82:3777-3782, 1997.124. Visakorpi, T.; Hyytinen, E.; Koivisto, P.; Tanner, M.; Keinanen, R.; Palmberg, C.; Palotie, A.; Tammela, T.; Isola, J.; Kallioniemi, O.-P.: In vivo amplification of the androgen receptor gene and progression of human prostate cancer. Nature Genet. 9:401-406, 1995.125. Von Eckardstein, S.; Syska, A.; Gromoll, J.; Kamischke, A.; Simoni, M.; Nieschlag, E.: Inverse correlation between sperm concentration and number of androgen receptor CAG repeats in normal men. J. Clin. Endocr. Metab. 86:2585-2590, 2001.126. Wang, Q.; Ghadessy, F. J.; Trounson, A.; de Kretser, D.; McLachlan, R.; Ng, S. C.;Yong, E. L.: Azoospermia associated with a mutation in the ligand-binding domain of an androgen receptor displaying normal ligand binding, but defective trans-activation. J. Clin. Endocr. Metab. 83:4303-4309, 1998.127. Weidemann, W.; Peters, B.; Romalo, G.; Spindler, K.-D.; Schweikert, H.-U.: Response to androgen treatment in a patient with partial androgen insensitivity and a mutation in the deoxyribonucleic acid-binding domain of the androgen receptor. J. Clin. Endocr. Metab. 83:1173-1176,1998.128. Welch, W. J.; Diamond, M. I.: Glucocorticoid modulation of androgen receptor nuclear aggregation and cellular toxicity is associated with distinct forms of soluble expanded polyglutamine protein. Hum. Molec. Genet. 10:3063-3074, 2001.129. Westberg, L.; Baghaei, F.; Rosmond, R.; Hellstrand, M.; Landen, M.; Jansson, M.; Holm, G.; Bjorntorp, P.; Eriksson, E.: Polymorphisms of the androgen receptor gene and the estrogen receptors beta gene are associated with androgen levels in women. J. Clin. Endocr. Metab. 86:2562-2568, 2001.130. Wieacker, P.; Breckwoldt, M.; Gal, A.: Testicular feminization: diagnosis and search for closely linked restriction fragment length polymorphism. Dis. Markers 3:213-218, 1985.131. Wieacker, P.; Griffin, J. E.; Wienker, T.; Lopez, J. M.; Wilson, J. D.; Breckwoldt, M.: Linkage analysis with RFLPs in families with androgen resistance syndromes: evidence for close linkage between the androgen receptor locus and the DXS1 segment. Hum. Genet. 76:248-252, 1987.132. Wilson, C. M.; McPhaul, M. J.: A and B forms of the androgen receptor are present in human genital skin fibroblasts. Proc. Nat. Acad. Sci. 91:1234-1238, 1994.133. Wilson, J. D.: The promiscuous receptor: prostate cancer comes of age. (Editorial) New Eng. J. Med. 332:1440-1441, 1995.134. Wilson, J. D.; Carlson, B. R.; Weaver, D. D.; Kovacs, W. J.; Griffin, J. E.: Endocrine and genetic characterization of cousins with male pseudohermaphroditism: evidence that the Lubs phenotype can result from a mutation that alters the structure of the androgen receptor. Clin. Genet. 26:363-370, 1984.135. Wooster, R.; Mangion, J.; Eeles, R.; Smith, S.; Dowsett, M.; Averill, D.; Barrett-Lee, P.; Easton, D. F.; Ponder, B. A. J.; Stratton, M. R.: A germline mutation in the androgen receptor gene in two brothers with breast cancer and Reifenstein syndrome. Nature Genet. 2:132-134,1992.136. Zhang, L.; Leeflang, E. P.; Yu, J.; Arnheim, N.: Studying human mutations by sperm typing: instability of CAG trinucleotide repeats in the human androgen receptor gene. Nature Genet. 7:531-535, 1994.137. Zhu, Y.-S.; Cai, L.-Q.; Cordero, J. J.; Canovatchel, W. J.; Katz, M. D.; Imperato-McGinley, J.: A novel mutation in the CAG triplet region of exon 1 of androgen receptor gene causes complete androgen insensitivity syndrome in a large kindred. J. Clin. Endocr. Metab. 84:1590-1594, 1999.138. Zoppi, S.; Wilson, C. M.; Harbison, M. D.; Griffin, J. E.; Wilson, J. D.; McPhaul, M. J.; Marcelli, M.: Complete testicular feminization caused by an amino-terminal truncation of the androgen receptor with downstream initiation. J. Clin. Invest. 91:1105-1112, 1993.

Jin, H.; Gardner, R. J.; Viswesvaraiah, R.; Muntoni, F.; Roberts, R. G.: Two novel members of the interleukin-1 receptor gene family, one deleted in Xp22.1-Xp21.3 mental retardation. Europ. J. Hum. Genet. 8:87-94, 2000.

Stoddart, K. L.; Jermak, C.; Nagaraja, R.; Schlessinger, D.; Bech-Hansen, N. T.: Physical map covering a 2 Mb region in human Xp11.3 distal to DX6849. Gene 227:111-116, 1999.

Swanson, D. A.; Freund, C. L.; Ploder, L.; McInnes, R. R.; Valle, D.: A ubiquitin C-terminal hydrolase gene on the proximal short arm of the X chromosome: implications for X-linked retinal disorders. Hum. Molec. Genet. 5:533-538, 1996.

Olinsky, S.; Loop, B. T.; DeKosky, A.; Ripepi, B.; Weng, W.; Cummins, J.; Wenger, S. L.;Yan,Y.; Lagenaur, C.; Narayanan, V.: Chromosomal mapping of the human M6 genes. Genomics 33:532-536, 1996.

Yan,Y.; Lagenaur, C.; Narayanan, V.: Molecular cloning of M6:identification of a PLP/DM20 gene family. Neuron 11:423-431, 1993.

Ciccodicola, A.; d'Esposito, M.; Esposito, T.; Gianfrancesco, F.; Migliaccio, C.; Miano, M. G.; Matarazzo, M. R.; Vacca, M.; Franze, A.; Cuccurese, M.; Cocchia, M.; Curci, A.: Differentially regulated and evolved genes in the fully sequenced Xq/Yq pseudoautosomal region. Hum. Molec. Genet. 9:395-401, 2000.

d'Esposito, M.; Ciccodicola, A.; Gianfrancesco, F.; Esposito, T.; Flagiello, L.; Mazzarella, R.; Schlessinger, D.; d'urso, M.: A synaptobrevin-like gene in the Xq28 pseudoautosomal region undergoes X inactivation. Nature Genet. 13:227-229, 1996.

Muller, D. J.; Schulze, T. G.; Jahnes, E.; Cichon, S.; Krauss, H.; Kesper, K.; Held, T.; Maier, W.; Propping, P.; Nothen, M. M.; Rietschel, M.: Association between a polymorphism in the pseudoautosomal X-linked gene SYBL1 and bipolar affective disorder. Am. J. Med. Genet.(Neuropsychiat. Genet.) 114:74-78, 2002.

Saito, T.; Parsia, S.; Papolos, D. F.; Lachman, H. M.: analysis of the pseudoautosomal X-linked gene SYBL1 in bipolar affective disorder: description of a new candidate allele for psychiatric disorders. Am. J. Med. Genet. (Neuropsychiat. Genet.) 96:317-323, 2000.

Schaefer, L.; Ballabio, A.; Zoghbi, H. Y.: Cloning and characterization of a putative human holocytochrome c-type synthetase gene (HCCS) isolated from the critical region for microphthalmia with linear skin defects (MLS). Genomics 34:166-172, 1996.

Van den Veyver, I. B.; Subramanian, S.; Zoghbi, H. Y.: Genomic structure of a human holocytochrome c-type synthetase gene in Xp22.3 and mutation analysis in patients with Rett syndrome. Am. J. Med. Genet. 78:179-181, 1998.

Andersson, M.; Page, D. C.; Pettay, D.; Subrt, I.; Turleau, C.; de Grouchy, J.; de la Chapelle, A.: Y; autosome translocations and mosaicism in the aetiology of 45, X maleness: assignment of fertility factor to distal Yq11. Hum. Genet. 79:2-7, 1988.

Chandley, A. C.; Gosden, J. R.; Hargreave, T. B.; Spowart, G.; Speed, R. M.; McBeath, S.: Deleted Yq in the sterile son of a man with a satellited Y chromosome (Yqs). J. Med. Genet. 26:145-153,1989.

Franco, B.; Meroni, G.; Parenti, G.; Levilliers, J.; Bernard, L.; Gebbia, M.; Cox, L.; Maroteaux, P.; Sheffield, L.; Rappold, G. A.; Andria, G.; Petit, C.; Ballabio, A.: A cluster of sulfatase geneson Xp22.3: mutations in chondrodysplasia punctata (CDPX) and implications for warfarin embryopathy. Cell 81:1-20, 1995.

Meroni, G.; Franco, B.; Archidiacono, N.; Messali, S.; Andolfi, G.; Rocchi, M.; Ballabio, A.: Characterization of a cluster of sulfatase genes on Xp22.3 suggests gene duplications in an ancestral pseudoautosomal region. Hum. Molec. Genet. 5:423-431, 1996.

Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human genes. VI. The coding sequences of 80 new genes (KIAA0201-KIAA0280) deduced by analysis of cDNA clones from cell line KG-1 and brain. DNA Res. 3:321-329, 1996. Note: Supplement: DNA Res. 3:341-354, 1996.

Numata, M.; Petrecca, K.; Lake, N.; Orlowski, J.: Identification of a mitochondrial Na+/H+ exchanger. J. Biol. Chem. 273:6951-6959,1998.

Buchner, G.; Orfanelli, U.; Quaderi, N.; Bassi, M. T.; Andolfi, G.; Ballabio, A.; Franco, B.: Identification of a new EGF-repeat-containing gene from human Xp22: a candidate for developmental disorders. Genomics 65:16-23, 2000.

Yeung, G.; Mulero, J. J.; Berntsen, R. P.; Loeb, D. B.; Drmanac, R.; Ford, J. E.: Cloning of a novel epidermal growth factor repeat containing gene EGFL6: expressed in tumor and fetal tissues. Genomics 62:304-307, 1999.

Asao, H.; Okuyama, C.; Kumaki, S.; Ishii, N.; Tsuchiya, S.; Foster, D.; Sugamura, K.: Cutting edge: the common gamma-chain is an indispensable subunit of the IL-21 receptor complex. J. Immun. 167:1-5, 2001.

Lankes, W.; Griesmacher, A.; Grunwald, J.; Schwartz-Albiez, R.; Keller, R.: A heparin-binding protein involved in inhibition of smooth-muscle cell proliferation. Biochem. J. 251:831-842, 1988.

Lankes, W. T.; Furthmayr, H.: Moesin: a member of the protein 4.1-talin-ezrin family of proteins. Proc. Nat. Acad. Sci. 88:8297-8301,1991.

Shcherbina, A.; Bretscher, A.; Rosen, F. S.; Kenney, D. M.; Remold-O'Donnell, E.: The cytoskeletal linker protein moesin: decreased levels in Wiskott-Aldrich syndrome platelets and identification of a cleavage pathway in normal platelets. Brit. J. Haemat. 106:216-223, 1999.

Wilgenbus, K. K.; Hsieh, C.-L.; Lankes, W. T.; Milatovich, A.; Francke, U.; Furthmayr, H.: Structure and localization on the X chromosome of the gene coding for the human filopodial protein moesin (MSN). Genomics 19:326-333, 1994.

Deng, L.; Wang, C.; Spencer, E.; Yang, L.; Braun, A.; You, J.; Slaughter, C.; Pickart, C.; Chen, Z. J.: Activation of the I-kappa-B complex by TRAF6 requires a dimeric ubiquitin-conjugating enzyme complex and a unique polyubiquitin chain. Cell 103:351-361, 2000.

Wang, C.; Deng, L.; Hong, M.; Akkaraju, G. R.; Inoue, J.; Chen, Z. J.: TAK1 is a ubiquitin-dependent kinase of MKK and IKK. Nature 412:346-351, 2001.

Wong, B. R.; Besser, D.; Kim, N.; Arron, J. R.; Vologodskaia, M.; Hanafusa, H.; Choi, Y.: TRANCE, a TNF family member, activates Akt/PKB through a signaling complex involving TRAF6 and c-Src. Molec. Cell 4:1041-1049, 1999.

Nakano, H.; Oshima, H.; Chung, W.; Williams-Abbott, L.; Ware, C. F.; Yagita, H.; Okumura, K.: TRAF5, an activator of NF-kappa B and putative signal transducer for the lymphotoxin-beta receptor. J. Biol. Chem. 271:14661-14664, 1996.

Nakano, H.; Sakon, S.; Koseki, H.; Takemori, T.; Tada, K.; Matsumoto, M.; Munechika, E.; Sakai, T.; Shirasawa, T.; Akiba, H; Kobata, T.; Santee, S. M.; Ware, C. F.; Renner, P. D.; Taniguchi, M.; Yagita, H.; Okumura, K.: Targeted disruption of Traf5 gene causes defects in CD40- and CD27-mediated lymphocyte activation. Proc. Nat. Acad. Sci. 96:9803-9808, 1999.

Nakano, H.; Shindo, M.; Yamada, K.; Yoshida, M. C.; Santee, S. M.; Ware, C. F.; Jenkins, N. A.; Gilbert, D. J.; Yagita, H.; Copeland, N. G.; Okumura, K.: Human TNF receptor-associated factor 5 (TRAF5): cDNA cloning, expression and assignment of the TRAF5 gene to chromosome 1q32. Genomics 42:26-32, 1997.

Yost, C.; Farr, G. H., III; Pierce, S. B.; Ferkey, D. M.; Chen, M. M.; Kimelman, D.: GBP, an inhibitor of GSK-3, is implicated in Xenopus development and oncogenesis. Cell 93:1031-1041, 1998.

De Baere, E.; Speleman, F.; Van Roy, N.; De Paepe, A.; Messiaen, L.: Assignment of SHOX2 (alias OG12X and SHOT) to human chromosomebands 3q25-q26.1 by in situ hybridization. Cytogenet. Cell Genet. 82:228-229, 1998.

Fernandez-Valle, C.; Tang, Y.; Ricard, J.; Rodenas-Ruano, A.; Taylor, A.; Hackler, E.; Biggerstaff, J.; Iacovelli, J.: Paxillin binds schwannomin and regulates its density-dependent localization and effect on cell morphology. Nature Genet. 31:354-362, 2002.

Glenney, J. R., Jr.; Zokas, L.: Novel tyrosine kinase substrates from Rous sarcoma virus-transformed cells are present in the membrane skeleton. J. Cell Biol. 108:2401-2408, 1989.

Mazaki, Y.; Hashimoto, S.; Sabe, H.: Monocyte cells and cancer cells express novel paxillin isoforms with different binding properties to focal adhesion proteins. J. Biol. Chem. 272:7437-7444, 1997.

Salgia, R.; Li, J.-L.; Lo, S. H.; Brunkhorst, B.; Kansas, G. S.; Sobhany, E. S.; Sun, Y.; Pisick, E.; Hallek, M.; Ernst, T.; Tantravahi, R.; Chen, L. B.; Griffin, J. D.: Molecular cloning of human paxillin, a focal adhesion protein phosphorylated by P210(BCR/ABL). J. Biol. Chem. 270:5039-5047, 1995.

Turner, C. E.; Glenney, J. R., Jr.; Burridge, K.: Paxillin: a new vinculin-binding protein present in focal adhesions. J. Cell Biol. 111:1059-1068, 1990.

Nguyen, V. T.; Kiss, T.; Michels, A. A.; Bensaude, O.:7SK small nuclear RNA binds to and inhibits the activity of CDK9/cyclin T complexes. Nature 414:322-325, 2001.

Peng, J.; Zhu, Y.; Milton, J. T.; Price, D. H.: Identification of multiple cyclin subunits of human P-TEFb. Genes Dev. 12:755-762,1998.

Yang, Z.; Zhu, Q.; Luo, K.; Zhou, Q.: The 7SK small nuclear RNA inhibits the CDK9/cyclin T1 kinase to control transcription. Nature 414:317-322, 2001.

Moro, F.; Arrigo, G.; Fogli, A.; Bernard, L.; Carrozzo, R.: The beta and gamma subunits of the human platelet-activating factor acetylhydrolase isoform Ib (PAFAH1B2 and PAFAH1B3) map to chromosome 11q23 and 19q13.1, respectively. Genomics 51:157-159, 1998.

Daigo, Y.; Isomura, M.; Nishiwaki, T.; Tamari, M.; Ishikawa, S.; Kai, M.; Murata, Y.; Takeuchi, K.; Yamane, Y.; Hayashi, R.; Minami, M.; Fujino, M. A.; Hojo, Y.; Uchiyama, I.; Takagi, T.; Nakamura, Y.: Characterization of a 1200-kb genomic segment of chromosome 3p22-p21.3. DNA Res. 6:37-44, 1999.

Erlich, R.; Gleeson, P. A.; Campbell, P.; Dietzsch, E.; Toh, B.-H.: Molecular characterization of trans-Golgi p230: a human peripheral membrane protein encoded by a gene on chromosome 6p12-22 contains extensive coiled-coil alpha-helical domains and a granin motif. J. Biol. Chem. 271:8328-8337, 1996.

Barr, F. A.; Nakamura, N.; Warren, G.: Mapping the interaction between GRASP65 and GM130, components of a protein complex involved in the stacking of Golgi cisternae. EMBO J. 17:3258-3268, 1998.

Boguski, M. S.; Lowe, T. M. J.; Tolstochev, C. M.: dbEST: database for 'expressed sequence tags.' (Letter) Nature Genet. 4:332-333,1993.

Izon, D. J.; Aster, J. C.; He, Y.; Weng, A.; Karnell, F. G.; Patriub, V.; Xu, L.; Bakkour, S.; Rodriguez, C.; Allman, D.; Pear, W. S.: Deltex1 redirects lymphoid progenitors to the B cell lineage by antagonizing Notch1. Immunity 16:231-243, 2002.

Lee, L.; Dowhanick-Morrissette, J.; Katz, A.; Jukofsky, L.; Krantz, I. D.: Chromosomal localization, genomic characterization, and mapping to the Noonan syndrome critical region of the human deltex (DTX1) gene. Hum. Genet. 107:577-581, 2000.

Matsuno, K.; Eastman, D.; Mitsiades, T.; Quinn, A. M.; Carcanciu, M. L.; Ordentlich, P.; Kadesch, T.; Artavanis-Tsakonas, S.: human deltex is a conserved regulator of Notch signalling. Nature Genet. 19:74-78, 1998.

Chen, J. J.; Reid, C. E.; Band, V.; Androphy, E. J.: Interaction of papilloma virus E6 oncoproteins with a putative calcium-binding protein. Science 269:529-531, 1995.

Imai, T.; Matsuda, K.; Shimojima, T.; Hashimoto, T.; Masuhiro, Y.; Kitamoto, T.; Sugita, A.; Suzuki, K.; Matsumoto, H.; Masushige, S.; Nogi, Y.; Muramatsu, M.; Handa, H.; Kato, S.: ERC-55, a binding protein for the papilloma virus E6 oncoprotein, specifically interacts with vitamin D receptor among nuclear receptors. Biochem. Biophys. Res. Commun. 233:765-769, 1997.

Wang, J. Y.; Zhen, D. K.; Bianchi, D. W.; Androphy, E. J.; Chen, J. J.: Assignment of the gene for ERC-55 (RCN2) to human chromosome band 15q22.33-q24.1 by in situ hybridization. Cytogenet. Cell Genet. 79:60-61, 1997.

Weis, K.; Griffiths, G.; Lamond, A. I.: The endoplasmic reticulum calcium-binding protein of 55 kDa is a novel EF-hand protein retained in the endoplasmic reticulum by a carboxyl-terminal His-Asp-Glu-Leumotif. J. Biol. Chem. 269: 19142-19150, 1994.

Dempsey, C. E.; Sakurai, H.; Sugita, T.; Guesdon, F.: Alternative splicing and gene structure of the transforming growth factor beta-activated kinase 1. Biochim. Biophys. Acta 1517: 46-52, 2000.

Kondo, M.; Osada, H.; Uchida, K.; Yanagisawa, K.; Masuda, A.; Takagi, K.; Takahashi, T.; Takahashi, T.: Molecular cloning of human TAK1and its mutational analysis in human lung cancer. Int. J. Cancer 75:559-563, 1998.

Sakurai, H.; Shigemori, N.; Hasegawa, K.; Sugita, T.: TGF-beta-activated kinase 1 stimulates NF-kappa-B activation by an NF-kappa-B-inducing kinase-independent mechanism. Biochem. Biophys. Res. Commun. 243:545-549, 1998.

Yamaguchi, K.; Shirakabe, K.; Shibuya, H.; Irie, K.; Oishi, I.; Ueno, N.; Taniguchi, T.; Nishida, E.; Matsumoto, K.: Identification of a member of the MAPKKK family as a potential mediator of TGF-beta signal transduction. Science 270:2008-2011, 1995.

Chan, A. M.-L.; Chedid, M.; McGovern, E. S.; Popescu, N. C.; Miki, T.; Aaronson, S. A.: Expression cDNA cloning of a serine kinase transforming gene. Oncogene 8:1329-1333, 1993.

Frank, K. M.; Sekiguchi, J. M.; Seidl, K. J.; Swat, W.; Rathbun, G. A.; Cheng, H.-L.; Davidson, L.; Kangaloo, L.; Alt, F. W.: Late embryonic lethality and impaired V(D)J recombination in mice lacking DNA ligase IV. Nature 396: 173-177, 1998.

Frank, K. M.; Sharpless, N. E.; Gao, Y.; Sekiguchi, J. M.; Ferguson, D. O.; Zhu, C.; Manis, J. P.; Horner, J.; DePinho, R. A.; Alt, F. W.: DNA ligase IV deficiency in mice leads to defective neurogenesis and embryonic lethality via the p53 pathway. Molec. Cell 5:993-1002,2000.

Grawunder, U.; Zimmer, D.; Fugmann, S.; Schwarz, K.; Lieber, M. R.: DNA ligase IV is essential for V(D)J recombination and DNA double-strand break repair in human precursor lymphocytes. Molec. Cell 2:477-484,1998.

O'Driscoll, M.; Cerosaletti, K. M.; Girard, P.-M.; Dai, Y.; Stumm, M.; Kysela, B.; Hirsch, B.; Gennery, A.; Palmer, S. E.; Seidel, J.; Gatti, R. A.; Varon, R.; Oettinger, M. A.; Neitzel, H.; Jeggo, P. A.; Concannon, P.: DNA ligase IV mutations identified in patients exhibiting developmental delay and immunodeficiency. Molec. Cell 8:1175-1185, 2001.

Riballo, E.; Critchlow, S. E.; Teo, S.-H.; Doherty, A. J.; Priestley, A.; Broughton, B.; Kysela, B.; Beamish, H.; Plowman, N.; Arlett, C. F.; Lehmann, A. R.; Jackson, S. P.; Jeggo, P. A.: Identification of a defect in DNA ligase IV in a radiosensitive leukaemia patient. Curr. Biol. 9:699-702, 1999.

Riballo, E.; Doherty, A. J.; Dai, Y.; Stiff, T.; Oettinger, M. A.; Jeggo, P. A.; Kysela, B.: Cellular and biochemical impact of a mutation in DNA ligase IV conferring clinical radiosensitivity. J. Biol. Chem. 276:31124-31132, 2001.

Giachino, C.; Lantelme, E.; Lanzetti, L.; Saccone, S.; Della Valle, G.; Migone, N.: A novel SH3-containing human gene family preferentially expressed in the central nervous system. Genomics 41:427-434, 1997.

Furlan, M.; Robles, R.; Galbusera, M.; Remuzzi, G.; Kyrle, P. A.; Brenner, B.; Krause, M.; Scharrer, I.; Aumann, V.; Mittler, U.; Solenthaler, M.; Lammle, B.: Von Willebrand factor-cleaving protease in thrombotic thrombocytopenic purpura and the hemolytic-uremic syndrome. New Eng. J. Med. 339:1578-1584, 1998.

Furlan, M.; Robles, R.; Lammle, B.: Partial purification and characterization of a protease from human plasma cleaving von Willebrand factor to fragments produced by in vivo proteolysis. Blood 87:4223-4234,1996.

Shisheva, A.; Sudhof, T. C.; Czech, M. P.: Cloning, characterization, and expression of a novel GDP dissociation inhibitor isoform from skeletal muscle. Molec. Cell. Biol. 14:3459-3468, 1994.

Banfi, S.; Borsani, G.; Bulfone, A.; Ballabio, A.: Drosophila-related expressed sequences. Hum. Molec. Genet. 6:1745-1753, 1997.

Castrillon, D. H.; Wasserman, S. A.: Diaphanous is required for cytokinesis in Drosophila and shares domains of similarity with the products of the limb deformity gene. Development 120:3367-3377, 1994.

Philippe, C.; Cremers, F. P. M.; Chery, M.; Bach, I.; Abbadi, N.; Ropers, H. H.; Gilgenkrantz, S.: Physical mapping of DNA markers in the q13-q22 region of the human X chromosome. Genomics 17:147-152,1993.

Bione, S.; Sala, C.; Manzini, C.; Arrigo, G.; Zuffardi, O.; Banfi, S.; Borsani, G.; Jonveaux, P.; Philippe, C.; Zuccotti, M.; Ballabio, A.; Toniolo, D.: A human homologue of the Drosophila melanogaster diaphanous gene is disrupted in a patient with premature ovarian failure: evidence for conserved function in oogenesis and implications for human sterility. Am. J. Hum. Genet. 62:533-541, 1998.

Sala, C.; Arrigo, G.; Torri, G.; Martinazzi, F.; Riva, P.; Larizza, L.; Philippe, C.; Jonveaux, P.; Sloan, F.; Labella, T.; Toniolo, D.: Eleven X chromosome breakpoints associated with premature ovarian failure (POF) map to a 15-Mb YAC contig spanning Xq21. Genomics 40:123-131, 1997.

Lachner, M.; O'Carroll, D.; Rea, S.; Mechtler, K.; Jenuwein, T.: Methylation of histone H3 lysine 9 creates a binding site for HP1proteins. Nature 410:116-120, 2001.

Melcher, M.; Schmid, M.; Aagaard, L.; Selenko, P.; Laible, G.; Jenuwein, T.: Structure-function analysis of SUV39H1 reveals a dominant role in heterochromatin organization, chromosome segregation, and mitotic progression. Molec. Cell Biol. 20:3728-3841, 2000.

Nielsen, S. J.; Schneider, R.; Bauer, U.-M.; Bannister, A. J.; Morrison, A.; O'Carroll, D.; Firestein, R.; Cleary, M.; Jenuwein, T.; Herrera, R. E.; Kouzarides, T.: Rb targets histone H3 methylation and HP1 to promoters. Nature 412:561-565, 2001.

Peters, A. H. F. M.; O'Carroll, D.; Scherthan, H.; Mechtler, K.; Sauer, S.; Schofer, C.; Weipoltshammer, K.; Pagani, M.; Lachner, M.; Kohlmaier, A.; Opravil, S.; Doyle, M.; Sibilia, M.; Jenuwein, T.:Loss of the Suv39h histone methyltransferases impairs mammalian heterochromatin and genome stability. Cell 107:323-337, 2001.

Rea, S.; Eisenhaber, F.; O'Carroll, D.; Strahl, B. D.; Sun, Z.-W.; Schmid, M.; Opravil, S.; Mechtler, K.; Ponting, C. P.; Allis, C. D.; Jenuwein, T.: Regulation of chromatin structure by site-specific histone H3 methyltransferases. Nature 406: 593-599, 2000.

Scott, A. F.: Personal Communication. Baltimore, Md. Aug. 7, 2000.

Haltiwanger, R. S.; Blomberg, M. A.; Hart, G. W.: Glycosylation of nuclear and cytoplasmic proteins: purification and characterization of a uridine diphospho-N-acetylglucosamine: polypeptide beta-N-acetylglucosaminyl transferase. J. Biol. Chem. 267:9005-9013, 1992.

Kreppel, L. K.; Blomberg, M. A.; Hart, G. W.: Dynamic glycosylation of nuclear and cytosolic proteins: cloning and characterization of a unique O-GlcNAc transferase with multiple tetratricopeptide repeats. J. Biol. Chem. 272:9308-9315, 1997.

Lubas, W. A.; Frank, D. W.; Krause, M.; Hanover, J. A.: O-linked GlcNAc transferase is a conserved nucleocytoplasmic protein containing tetratricopeptide repeats. J. Biol. Chem. 272:9316-9324, 1997.

Shafi, R.; Iyer, S. P. N.; Ellies, L. G.; O'Donnell, N.; Marek, K. W.; Chui, D.; Hart, G. W.; Marth, J. D.: The O-GlcNAc transferase gene resides on the X chromosome and is essential for embryonic stemcell viability and mouse ontogeny. Proc. Nat. Acad. Sci. 97:5735-5739,2000.

Yang, X.; Zhang, F.; Kudlow, J. E.: Recruitment of O-GlcNAc transferase to promoters by corepressor mSin3A: coupling protein O-GlcNAcylation to transcriptional repression. Cell 110:69-80, 2002.

Chamberlin, M. E.; Ubagai, T.; Mudd, S. H.; Wilson, W. G.; Leonard, J. V.; Chou, J. Y.: Demyelination of the brain is associated with methionine adenosyltransferase I/III deficiency. J. Clin. Invest. 98:1021-1027, 1996.

Natt, E.; Kida, K.; Odievre, M.; Di Rocco, M.; Scherer, G.: Point mutations in the tyrosine aminotransferase gene in tyrosinemia type II. Proc. Nat. Acad. Sci. 89:9297-9301, 1992.

Davies, P. A.; Hanna, M. C.; Hales, T. G.; Kirkness, E. F.: Insensitivity to anaesthetic agents conferred by a class of GABA(A) receptor subunit. Nature 385:820-823, 1997.

Sinkkonen, S. T.; Hanna, M. C.; Kirkness, E. F.; Korpi, E. R.:GABA-A receptor epsilon and theta subunits display unusual structural variation between species and are enriched in the rat locus ceruleus. J. Neurosci. 20:3588-3595, 2000.

Wilke, K.; Gaul, R.; Klauck, S. M.; Poustka, A.: A gene in human chromosome band Xq28 (GABRE) defines a putative new subunit class of the GABA(A) neurotransmitter receptor. Genomics 45:1-10, 1997.

Gecz, J.; Baker, E.; Donnelly, A.; Ming, J. E.; McDonald-McGinn, D. M.; Spinner, N. B.; Zackai, E. H.; Sutherland, G. R.; Mulley, J. C.: Fibroblast growth factor homologous factor 2 (FHF2): gene structure, expression and mapping to the Borjeson-Forssman-Lehmann syndrome region in Xq26 delineated by a duplication breakpoint in a BFLS-like patient. Hum. Genet. 104:56-63, 1999.

Lovec, H.; Hartung, H.; Verdier, A.-S.; Mattei, M.-G.; Birnbaum, D.; Goldfarb, M.; Coulier, F.: Assignment of FGF13 to human chromosome band Xq21 by in situ hybridization. Cytogenet. Cell Genet. 76:183-184,1997.

Smallwood, P. M.; Munoz-Sanjuan, I.; Tong, P.; Macke, J. P.; Hendry, S. H. C.; Gilbert, D. J.; Copeland, N. G.; Jenkins, N. A.; Nathans, J.: Fibroblast growth factor (FGF) homologous factors: new members of the FGF family implicated in nervous system development. Proc. Nat. Acad. Sci. 93:9850-9857, 1996.

Jones, M. H.; Furlong, R. A.; Burkin, H.; Chalmers, I. J.; Brown, G. M.; Khwaja, O.; Affara, N. A.: The Drosophila developmental gene fat facets has a human homologue in Xp11.4 which escapes X-inactivation and has related sequences on Yq11.2. Hum. Molec. Genet. 5:1695-1701, 1996.

Natt, E.; Westphal, E.-M.; Toth-Fejel, S. E.; Magenis, R. E.; Buist, N. R. M.; Rettenmeier, R.; Scherer, G.: Inherited and de novo deletion of the tyrosine aminotransferase gene locus at 16q22.1-q22.3in a patient with tyrosinemia type II. Hum. Genet. 77:352-358,1987.

Pelet, B.; Antener, I.; Faggioni, R.; Spahr, A.; Gautier, E.:Tyrosinemia without liver or renal damage with plantar and palmar keratosis and keratitis (hypertyrosinemia type II). Helv. Paediat. Acta 34:177-183, 1979.

Rehak, A.; Selim, M. M.; Yadav, G.: Richner-Hanhart syndrome (tyrosinaemia-II) (report of four cases without ocular involvement). Brit. J. Derm. 104:469-475, 1981.

Rettenmeier, R.; Natt, E.; Zentgraf, H.; Scherer, G.: Isolation and characterization of the human tyrosine aminotransferase gene. Nucleic Acids Res. 18:3853-3861, 1990.

Richner, H.: Hornhautaffektion bei Keratoma palmare et plantare hereditarium. Klin. Mbl. Augenheilk. 100:580-588, 1938.

Schmid, W.; Muller, G.; Schutz, G.; Gluecksohn-Waelsch, S.: Deletions near the albino locus on chromosome 7 of the mouse affect the level of tyrosine aminotransferase mRNA. Proc. Nat. Acad. Sci. 82:2866-2869,1985.

Tallab, T. M.: Richner-Hanhart syndrome: importance of early diagnosis and early intervention. J. Am. Acad. Dermatol. 35:857-859, 1996.

Ventura, G.; Biasini, G.; Petrozzi, M.: Cheratomia palmoplantaredissipatum associato a lesioni corneali in due fratelli. Boll. Oculist. 44:497-510, 1965.

Waardenburg, P. J.; Franceschetti, A.; Klein, D.: Genetics and Ophthalmology. Springfield, Ill.: Charles C Thomas (pub.) 1:1961. Pp. 515-517.

Westphal, E.-M.; Natt, E.; Grimm, T.; Odievre, M.; Scherer, G.: The human tyrosine aminotransferase gene: characterization of restriction fragment length polymorphisms and haplotype analysis in a family with tyrosinemia type II. Hum. Genet. 79:260-264, 1988.

Nauseef, W. M.; Brigham, S.; Cogley, M.: Hereditary myeloperoxidase deficiency due to a missense mutation of arginine 569 to tryptophan. J. Biol. Chem. 269:1212-1216, 1994.

Busard, B. L. S. M.; Renier, W. O.; Gabreels, F. J. M.; Jaspar, H. H. J.; van Haelst, U. J. G.; Slooff, J. L.: Lafora's disease: comparison of inclusion bodies in skin and in brain. Arch. Neurol. 43:296-299, 1986.

Busard, H. L. S. M.; Gabreels-Festen, A. A. W. M.; Renier, W. O.; Gabreels, F. J. M.; Stadhouders, A. M.: Axilla skin biopsy: a reliable test for the diagnosis of Lafora's disease. Ann. Neurol. 21:599-601,1987.

Fluharty, A. L.; Porter, M. T.; Hirsh, G. A.; Pevida, E.; Kihara, H.: Metachromasia in fibroblasts from a patient with Lafora's disease. (Letter) Lancet II:109-110, 1970.

Ganesh, S.; Agarwala, K. L.; Ueda, K.; Akagi, T.; Shoda, K.; Usui, T.; Hashikawa, T.; Osada, H.; Delgado-Escueta, A. V.; Yamakawa, K.: Laforin, defective in the progressive myoclonus epilepsy of Laforatype, is a dual-specificity phosphatase associated with polyribosomes. Hum. Molec. Genet. 9:2251-2261, 2000.

Gomez-Garre, P.; Sanz, Y.; Rodriguez de Cordoba, S.; Serratosa, J. M.: Mutational spectrum of the EPM2A gene in progressive myoclonus epilepsy of Lafora: high degree of allelic heterogeneity and prevalence of deletions. Europ. J. Hum. Genet. 8:946-954, 2000.

Harriman, D. G. F.; Millar, J. H. D.: Progressive familial myoclonic epilepsy in 3 families: its clinical features and pathological basis. Brain 78:325-349, 1955.

Janeway, R.; Ravens, J. R.; Pearce, L. A.; Odor, D. L.; Suzuki, K.: Progressive myoclonus epilepsy with Lafora inclusion bodies. I. Clinical, genetic, histopathologic and biochemical aspects. Arch. Neurol. 16:565-582, 1967.

Lehesjoki, A.-E.; Koskiniemi, M.; Pandolfo, M.; Antonelli, A.; Kyllerman, M.; Wahlstrom, J.; Nergardh, A.; Burmeister, M.; Sistonen, P.; Norio, R.; de la Chapelle, A.: Linkage studies in progressive myoclonus epilepsy: Unverricht-Lundborg and Lafora's diseases. Neurology 42:1545-1550, 1992.

Maddox, L. O.; Descartes, M.; Collins, J.; Keating, J.; Rosenfeld, S.; Palmer, C.; Carroll, A. J.; Kuzniecky, R.: Identification of a recombination event narrowing the Lafora disease gene region. J. Med. Genet. 34:590-591, 1997.

Amadou, C.; Ribouchon, M. T.; Mattei, M. G.; Jenkins, N. A.; Gilbert, D. J.; Copeland, N. G.; Avoustin, P.; Pontarotti, P.: Localization of new genes and markers to the distal part of the human major histocompatibility complex (MHC) region and comparison with the mouse: new insights into the evolution of mammalian genomes. Genomics 26:9-20, 1995.

Solinas-Toldo, S.; Lengauer, C.; Fries, R.: Comparative genome map of human and cattle. Genomics 27:489-496, 1995.

Olives, B.; Martial, S.; Mattei, M.-G.; Matassi, G.; Rousselet, G.; Ripoche, P.; Cartron, J.-P.; Bailly, P.: Molecular characterization of a new urea transporter in the human kidney. FEBS Lett. 386:156-160,1996.

Ranade, K.; Wu, K.-W.; Hwu, C.-M.; Ting, C.-T.; Pei, D.; Pesich, R.; Hebert, J.; Chen, Y.-D. I.; Pratt, R.; Olshen, R.; Masaki, K.; Risch, N.; Cox, D. R.; Botstein, D.: Genetic variation in the human urea transporter-2 is associated with variation in blood pressure. Hum. Molec. Genet. 10:2157-2164, 2001.

Ansel, K. M.; Ngo, V. N.; Hyman, P. L.; Luther, S. A.; Forster, R.; Sedgwick, J. D.; Browning, J. L.; Lipp, M.; Cyster, J. G.: A chemokine-driven positive feedback loop organizes lymphoid follicles. Nature 406:309-314, 2000.

Stein, E.; Tessier-Lavigne, M.: Hierarchical organization of guidance receptors: silencing of netrin attraction by Slit through a Robo/DCC receptor complex. Science 291:1928-1938, 2001.

Hanna, I. H.; Dawling, S.; Roodi, N.; Guengerich, F. P.; Parl, F. F.: Cytochrome P450 1B1 (CYP1B1) pharmacogenetics: association of polymorphisms with functional differences in estrogen hydroxylation activity. Cancer Res. 60:3440-3444, 2000.

DesGroseillers, L.; Lemieux, N.: Localization of a human double-stranded RNA-binding protein gene (STAU) to band 20q13.1 by fluorescence in situ hybridization. Genomics 36:527-529, 1996.

Marion, R. M.; Fortes, P.; Beloso, A.; Dotti, C.; Ortin, J.: A human sequence homologue of staufen is an RNA-binding protein that is associated with polysomes and localizes to the rough endoplasmic reticulum. Molec. Cell. Biol. 19:2212-2219, 1999.

Wickham, L.; Duchaine, T.; Luo, M.; Nabi, I. R.; DesGroseillers, L.: Mammalian staufen is a double-stranded-RNA- and tubulin-binding protein which localizes to the rough endoplasmic reticulum. Molec. Cell. Biol. 19:2220-2230, 1999.

Lee, J. E.; Hollenberg, S. M.; Snider, L.; Turner, D. L.; Lipnick, N.; Weintraub, H.: Conversion of Xenopus ectoderm into neurons by NeuroD, a basic helix-loop-helix protein. Science 268:836-844,1995.

Liu, M.; Pleasure, S. J.; Collins, A. E.; Noebels, J. L.; Naya, F. J.; Tsai, M.-J.; Lowenstein, D. H.: Loss of BETA2/NeuroD leads to malformation of the dentate gyrus and epilepsy. Proc. Nat. Acad. Sci. 97:865-870, 2000.

Malecki, M. T.; Jhala, U. S.; Antonellis, A.; Fields, L.; Doria, A.; Orban, T.; Saad, M.; Warram, J. H.; Montminy, M.; Krolewski, A. S.: Mutations in NEUROD1 are associated with the development of type 2 diabetes mellitus. Nature Genet. 23:323-328, 1999.

Naya, F. J.; Huang, H.-P.; Qiu, Y.; Mutoh, H.; DeMayo, F. J.; Leiter, A. B.; Tsai, M.-J.: Diabetes, defective pancreatic morphogenesis, and abnormal enteroendocrine differentiation in BETA2/neurod-deficient mice. Genes Dev. 11:2323-2334, 1997.

Naya, F. J.; Stellrecht, C. M.; Tsai, M. J.: Tissue-specific regulation of the insulin gene by a novel basic helix-loop-helix transcription factor. Genes Dev. 9:1009-1019, 1995.

Plasilova, M.; Stoilov, I.; Sarfarazi, M.; Kadasi, L.; Ferakova, E.; Ferak, V.: Identification of a single ancestral CYP1B1 mutation in Slovak Gypsies (Roms) affected with primary congenital glaucoma. J. Med. Genet. 36:290-294, 1999.

Schwartzman, M. L.; Balazy, M.; Masferrer, J.; Abraham, N. G.; McGiff, J. C.; Murphy, R. C.:12(R)-hydroxy icosatetraenoic acid: a cytochrome P450-dependent arachidonate metabolite that inhibits Na+, K+-ATPase in the cornea. Proc. Nat. Acad. Sci. 84:8125-8129,1987.

Stoilov, I.; Akarsu, A. N.; Alozie, I.; Child, A.; Barsoum-Homsy, M.; Turacli, M. E.; Or, M.; Lewis, R. A.; Ozdemir, N.; Brice, G.; Aktan, S. G.; Chevrette, L.; Coca-Prados, M.; Sarfarazi, M.: Sequence analysis and homology modeling suggest that primary congenital glaucomaon 2p21 results from mutations disrupting either the hinge region or the conserved core structures of cytochrome P4501B1. Am. J. Hum. Genet. 62:573-584, 1998.

Stoilov, I.; Akarsu, A. N.; Sarfarazi, M.: Identification of three different truncating mutations in cytochrome P4501B1 (CYP1B1) as the principal cause of primary congenital glaucoma (buphthalmos) in families linked to the GLC3A locus on chromosome 2p21. Hum. Molec. Genet. 6:641-647, 1997.

Sutter, T. R.; Tang, Y. M.; Hayes, C. L.; Wo, Y.-Y. P.; Jabs, E. W.; Li, X.; Yin, H.; Cody, C. W.; Greenlee, W. F.: Complete cDNA sequence of a human dioxin-inducible mRNA identifies a new gene subfamily of cytochrome P450 that maps to chromosome 2. J. Biol. Chem. 269:13092-13099, 1994.

Tang, Y. M.; Wo, Y.-Y. P.; Stewart, J.; Hawkins, A. L.; Griffin, C. A.; Sutter, T. R.; Greenlee, W. F.: Isolation and characterization of the human cytochrome P450 CYP1B1 gene. J. Biol. Chem. 271:28324-28330,1996.

Vincent, A.; Billingsley, G.; Priston, M.; Williams-Lyn, D.; Sutherland, J.; Glaser, T.; Oliver, E.; Walter, M. A.; Heathcote, G.; Levin, A.; Heon, E.: Phenotypic heterogeneity of CYP1B1: mutations in a patient with Peters' anomaly. J. Med. Genet. 38:324-326, 2001.

Chen, H. T.; Bhandoola, A.; Difilippantonio, M. J.; Zhu, J.; Brown, M. J.; Tai, X.; Rogakou, E. P.; Brotz, T. M.; Bonner, W. M.; Ried, T.; Nussenzweig, A.: Response to RAG-mediated V(D)J cleavage by NBS1 and gamma-H2AX. Science 290:1962-1964, 2000.

Petersen, S.; Casellas, R.; Reina-San-Martin, B.; Chen, H. T.; Difilippantonio, M. J.; Wilson, P. C.; Hanitsch, L.; Celeste, A.; Muramatsu, M.; Pilch, D. R.; Redon, C.; Ried, T.; Bonner, W. M.; Honjo, T.; Nussenzweig, M. C.; Nussenzweig, A.: AID is required to initiate Nbs1/gamma-H2AX focus formation and mutations at sites of class switching. Nature 414: 660-665, 2001.

Morasso, M. I.; Yonescu, R.; Griffin, C. A.; Sargent, T. D.: Localization of human DLX8 to chromosome 17q21.3-q22 by fluorescence in situ hybridization. Mammalian Genome 8:302-303, 1997.

Quinn, L. M.; Johnson, B. V.; Nicholl, J.; Sutherland, G. R.; Kalionis, B.: Isolation and identification of homeobox genes from the human placenta including a novel member of the Distal-less family, DLX4. Gene 187:55-61, 1997.

Boddy, M. N.; Howe, K.; Etkin, L. D.; Solomon, E.; Freemont, P. S.: PIC 1, a novel ubiquitin-like protein which interacts with the PML component of a multiprotein complex that is disrupted in acute promyelocytic leukaemia. Oncogene 13:971-982, 1996.

Desterro, J. M. P.; Rodriguez, M. S.; Hay, R. T.: SUMO-1 modification of I-kappa-B-alpha inhibits NF-kappa-B activation. Molec. Cell 2:233-239, 1998.

Lapenta, V.; Chiurazzi, P.; van der Spek, P.; Pizzuti, A.; Hanaoka, F.; Brahe, C.:SMT3A, a human homologue of the S. cerevisiae SMT3gene, maps to chromosome 21qter and defines a novel gene family. Genomics 40:362-366, 1997.

Mao, Y.; Sun, M.; Desai, S. D.; Liu, L. F.: SUMO-1 conjugation to topoisomerase I: a possible repair response to topoisomerase-mediated DNA damage. Proc. Nat. Acad. Sci. 97:4046-4051, 2000.

Okura, T.; Gong, L.; Kamitani, T.; Wada, T.; Okura, I.; Wei, C.-F.; Chang, H.-M.; Yeh, E. T. H.: Protection against Fas/APO-1- and tumor necrosis factor-mediated cell death by a novel protein, sentrin. J. Immun. 157:4277-4281, 1996.

Shen, Z.; Pardington-Purtymun, P. E.; Comeaux, J. C.; Moyzis, R. K.; Chen, D. J.: UBL1, a human ubiquitin-like protein associating with human RAD51/RAD52 proteins. Genomics 36:271-279, 1996.

Hsu, L. C.; Chang, W.-C.: Sequencing and expression of the human ALDH8 encoding a new member of the aldehyde dehydrogenase family. Gene 174:319-322, 1996.

Hsu, L. C.; Chang, W.-C.; Lin, S. W.; Yoshida, A.: Cloning and characterization of genes encoding four additional human aldehyde dehydrogenase isozymes. Adv. Exp. Med. Biol. 372:159-168, 1995.

Kim, V. N.; Kataoka, N.; Dreyfuss, G.: Role of the nonsense-mediated decay factor hUpf3 in the splicing-dependent exon-exon junction complex. Science 293:1832-1836, 2001.

Lykke-Andersen, J.; Shu, M.-D.; Steitz, J. A.: Human Upf proteins target an mRNA for nonsense-mediated decay when bound downstream of a termination codon. Cell 103:1121-1131, 2000.

Scott, A. F.: Personal Communication. Baltimore, Md. Feb. 9, 2001.

Serin, G.; Gersappe, A.; Black, J. D.; Aronoff, R.; Maquat, L. E.: Identification and characterization of human orthologues to Saccharomyces cerevisiae Upf2 protein and Upf3 protein (Caenorhabditis elegans SMG-4). Molec. Cell. Biol. 21:209-223, 2001.

de Leeuw, B.; Balemans, M.; Geurts van Kessel, A.: A novel Kruppel-associated box containing the SSX gene (SSX3) on the human X chromosome is not implicated in t (X;18)-positive synovial sarcomas. Cytogenet. Cell Genet. 73:179-183, 1996.

Gure, A. O.; Tureci, O.; Sahin, U.; Tsang, S.; Scanlan, M. J.; Jager, E.; Knuth, A.; Pfreundschuh, M.; Old, L. J.; Chen, Y.-T.: SSX: a multigene family with several members transcribed in normal testis and human cancer. Int. J. Cancer 72:965-971, 1997.

Kawai, A.; Woodruff, J.; Healey, J. H.; Brennan, M. F.; Antonescu, C. R.; Ladanyi, M.: SYT-SSX gene fusion as a determinant of morphology and prognosis in synovial sarcoma. New Eng. J. Med. 338:153-160,1998.

Skytting, B.; Nilsson, G.; Brodin, B.; Xie, Y.; Lundeberg, J.; Uhlen, M.; Larsson, O.: A novel fusion gene, SYT-SSX4, in synovial sarcoma. (Letter) J. Nat. Cancer Inst. 91:974-975, 1999.

Yang, K.; Lui, W.-O.; Xie, Y.; Zhang, A.; Skytting, B.; Mandahl, N.; Larsson, C.; Larsson, O.: Co-existence of SYT-SSX1 and SYT-SSX2 fusions in synovial sarcomas. Oncogene 21:4181-4190, 2002.

Piccini, M.; Vitelli, F.; Seri, M.; Galietta, L. J. V.; Moran, O.; Bulfone, A.; Banfi, S.; Pober, B.; Renieri, A.: KCNE1-like gene is deleted in AMME contiguous gene syndrome: identification and characterization of the human and mouse homologs. Genomics 60:251-257, 1999.

Tipnis, S. R.; Hooper, N. M.; Hyde, R.; Karran, E.; Christie, G.; Turner, A. J.: A human homolog of angiotensin-converting enzyme: cloning and functional expression as a captopril-insensitive carboxypeptidase. J. Biol. Chem. 275: 33238-33243, 2000.

Tiepolo, L.; Zuffardi, O.: Localization of factors controlling spermatogenesis in the nonfluorescent portion of the human Y chromosome long arm. Hum. Genet. 34:119-124, 1976.

Aalfs, C. M.; van den Berg, H.; Barth, P. G.; Hennekam, R. C. M.: The Hoyeraal-Hreidarsson syndrome: the fourth case of a separate entity with prenatal growth retardation, progressive pancytopenia and cerebellar hypoplasia. Europ. J. Pediat. 154:304-308, 1995.

Devriendt, K.; Matthijs, G.; Legius, E.; Schollen, E.; Blockmans, D.; van Geet, C.; Degreef, H.; Cassiman, J.-J.; Fryns, J.-P.: Skewed X-chromosome inactivation in female carriers of dyskeratosis congenita. Am. J. Hum. Genet. 60:581-587, 1997.

Hassock, S.; Vetrie, D.; Giannelli, F.: Mapping and characterization of the X-linked dyskeratosis congenita (DKC) gene. Genomics 55:21-27, 1999.

Heiss, N. S.; Knight, S. W.; Vulliamy, T. J.; Klauck, S. M.; Wiemann, S.; Mason, P. J.; Poustka, A.; Dokal, I.: X-linked dyskeratosis congenita is caused by mutations in a highly conserved gene with putative nucleolar functions. Nature Genet. 19:32-38, 1998.

Heiss, N. S.; Megarbane, A.; Klauck, S. M.; Kreuz, F. R.; Makhoul, E.; Majewski, F.; Poustka, A.: One novel and two recurrent missense DKC1 mutations in patients with dyskeratosis congenita (DKC). Genet. Counsel. 12:129-136, 2001.

Marchese, A.; Sawzdargo, M.; Nguyen, T.; Cheng, R.; Heng, H. H. Q.; Nowak, T.; Im, D-S.; Lynch, K. R.; George, S. R.; O'Dowd, B. F.: Discovery of three novel orphan G-protein-coupled receptors. Genomics 56:12-21, 1999.

Sanchis, D.; Fleury, C.; Chomiki, N.; Goubern, M.; Huang, Q.; Neverova, M.; Gregoire, F.; Easlick, J.; Raimbault, S.; Levi-Meyrueis, C.; Miroux, B.; Collins, S.; Seldin, M.; Richard, D.; Warden, C.; Bouillaud, F.; Ricquier, D.: BMCP1, a novel mitochondrial carrier with high expression in the central nervous system of human S and rodents, and respiration uncoupling activity in recombinant yeast. J. Biol. Chem. 273: 34611-34615,1998.

Blanco, P.; Sargent, C. A.; Boucher, C. A.; Mitchell, M.; Affara, N. A.: Conservation of PCDHX in mammals; expression of X/Y genes predominantly in brain. Mammalian Genome 11:906-914, 2000.

Ciccodicola, A.; d'Esposito, M.; Esposito, T.; Gianfrancesco, F.; Migliaccio, C.; Miano, M. G.; Matarazzo, M. R.; Vacca, M.; Franze, A.; Cuccurese, M.; Cocchia, M.; Curci, A.; and 9 others: Differentially regulated and evolved genes in the fully sequenced Xq/Yq pseudoautosomal region. Hum. Molec. Genet. 9:395-401, 2000.

Mumm, S.; Molini, B.; Terrell, J.; Srivastava, A.; Schlessinger, D.: Evolutionary features of the 4-Mb Xq21.3 XY homology region revealed by a map at 60-kb resolution. Genome Res. 7:307-314, 1997.

Schwartz, A.; Chan, D. C.; Brown, L. G.; Alagappan, R.; Pettay, D.; Disteche, C.; McGillivray, B.; de la Chapelle, A.; Page, D. C.: Reconstructing hominid Y evolution: X-homologous block, created by X-Y transposition, was disrupted by Yp inversion through LINE-LINE recombination. Hum. Molec. Genet. 7:1-11, 1998.

Tilford, C. A.; Kuroda-Kawaguchi, T.; Skaletsky, H.; Rozen, S.; Brown, L. G.; Rosenberg, M.; McPherson, J. D.; Wylie, K.; Sekhon, M.; Kucaba, T. A.; Waterston, R. H.; Page, D. C.: A physical map of the human Y chromosome. Nature 409:943-945, 2001.

Batch, J. A.; Evans, B. A. J.; Hughes, I. A.; Patterson, M. N.: Mutations of the androgen receptor gene identified in perineal hypospadias. J. Med. Genet. 30:198-201, 1993.

Borkhardt, A.; Repp, R.; Haas, O. A.; Leis, T.; Harbott, J.; Kreuder, J.; Hammermann, J.; Henn, T.; Lampert, F.: Cloning and characterization of AFX, the gene that fuses to MLL in acute leukemias with a t (X;11)(q13; q23). Oncogene 14:195-202, 1997.

Chatterjee, A.; Faust, C. J.; Herman, G. E.: Genetic and physical mapping of the biglycan gene on the mouse X chromosome. Mammalian Genome 4:33-36, 1993.

Das, S.; Metzenberg, A.; Pai, G. S.; Gitschier, J.: Mutational analysis of the biglycan gene excludes it as a candidate for X-linked dominant chondrodysplasia punctata, dyskeratosis congenita, and incontinentia pigmenti. (Letter) Am. J. Hum. Genet. 54:922-925, 1994.

Fisher, L. W.; Heegaard, A.-M.; Vetter, U.; Vogel, W.; Just, W.; Termine, J. D.; Young, M. F.: Human biglycan gene: putative promoter, intron-exon junctions, and chromosomal localization. J. Biol. Chem. 266:14371-14377, 1991.

Fisher, L. W.; Termine, J. D.; Young, M. F.: Deduced-protein sequence of bone small proteoglycan I (biglycan) shows homology with proteoglycan II (decorin) and several nonconnective tissue proteins in a variety of species. J. Biol. Chem. 264:4571-4576, 1989.

Geerkens, C.; Vetter, U.; Just, W.; Fedarko, N. S.; Fisher, L. W.; Young, M. F.; Termine, J. D.; Gehron Robey, P.; Wohrle, D.; Vogel, W.: The X-chromosomal human biglycan gene BGN is subject to X inactivation but is transcribed like an X-Y homologous gene. Hum. Genet. 96:44-52, 1995.

McBride, O. W.; Fisher, L. W.; Young, M. F.: Localization of PGI (biglycan, BGN) and PGII (decorin, DCN, PG-40) genes on human chromosomes Xq13-qter and 12q, respectively. Genomics 6:219-225, 1990.

Traupe, H.; van den Ouweland, A. M. W.; van Oost, B. A.; Vogel, W.; Vetter, U.; Warren, S. T.; Rocchi, M.; Darlison, M. G.; Ropers, H.-H.: Fine mapping of the human biglycan (BGN) gene within the Xq28region employing a hybrid cell panel. Genomics 13:481-483, 1992.

Wegrowski, Y.; Pillarisetti, J.; Danielson, K. G.; Suzuki, S.; Iozzo, R. V.: The murine biglycan: complete cDNA cloning, genomic organization, promoter function, and expression. Genomics 30:8-17,1995.

Xu, T.; Bianco, P.; Fisher, L. W.; Longenecker, G.; Smith, E.; Goldstein, S.; Bonadio, J.; Boskey, A.; Heegaard, A.-M.; Sommer, B.; Satomura, K.; Dominguez, P.; Zhao, C.; Kulkarni, A. B.; Robey, P. G.; Young, M. F.: Targeted disruption of the biglycan gene leads to an osteoporosis-like phenotype in mice. Nature Genet. 20:78-82,1998.

Brunialti, A. L. B.; Harding, C. O.; Wolff, J. A.; Guenet, J.-L.: The mouse mutation sarcosinemia (sar) maps to chromosome 2 in a region homologous to human 9q33-q34. Genomics 36:182-184, 1996.

Yoshida, K.; Sugano, S.: Identification of a novel protocadherin gene (PCDH11) on the human XY homology region in Xq21.3. Genomics 62:540-543, 1999.

de la Chapelle, A.; Sankila, E.-M.; Lindlof, M.; Aula, P.; Norio, R.: Norrie disease caused by a gene deletion allowing carrier detection and prenatal diagnosis. Clin. Genet. 28:317-320, 1985.

Sims, K. B.; de la Chapelle, A.; Norio, R.; Sankila, E.-M.; Hsu, Y.-P. P.; Rinehart, W. B.; Corey, T. J.; Ozelius, L.; Powell, J. F.; Bruns, G.; Gusella, J. F.; Murphy, D. L.; Breakefield, X. O.: Monoamine oxidase deficiency in males with an X chromosome deletion. Neuron 2:1069-1076, 1989.

Grino, P. B.; Griffin, J. E.; Cushard, W. G., Jr.; Wilson, J. D.: A mutation of the androgen receptor associated with partial androgen resistance, familial gynecomastia, and fertility. J. Clin. Endocr. Metab. 66:754-761, 1988.

Holterhus, P.-M.; Sinnecker, G. H. G.; Hiort, O.: Phenotypic diversity and testosterone-induced normalization of mutant L712F androgen receptor function in a kindred with androgen insensitivity. J. Clin. Endocr. Metab. 85:3245-3250, 2000.

Hughes, I. A.; Evans, B. A. J.: Complete androgen insensitivity syndrome characterized by increased concentration of a normal androgen receptor in genital skin fibroblasts. J. Clin. Endocr. Metab. 63:309-315, 1986.

Imperato-McGinley, J.; Ip, N. Y.; Gautier, T.; Neuweiler, J.; Gruenspan, H.; Liao, S.; Chang, C.; Balazs, I.: DNA linkage analysis and studies of the androgen receptor gene in a large kindred with complete androgen insensitivity. Am. J. Med. Genet. 36:104-108,1990.

Jukier, L.; Kaufman, M.; Pinsky, L.; Peterson, R. E.: Partial androgen resistance associated with secondary 5-alpha-reductase deficiency: identification of a novel qualitative androgen receptor defect and clinical implications. J. Clin. Endocr. Metab. 59:679-688, 1984.

Kaufman, M.; Pinsky, L.; Bowin, A.; Au, M. W. S.: Familial external genital ambiguity due to a transformation defect of androgen-receptor complexes that is expressed with 5-alpha-dihydrotestosterone and the synthetic androgen methyltrienolone. Am. J. Med. Genet. 18:493-507,1984.

Kaufman, M.; Straisfeld, C.; Pinsky, L.: Male pseudohermaphroditism presumably due to target organ unresponsiveness to androgens: deficient5-alpha-dihydrotestosterone binding in cultured skin fibroblasts. J. Clin. Invest. 58:345-350, 1976.

Keenan, B. S.; Meyer, W. J., III; Hadjian, A. J.; Jones, H. W.; Migeon, C. J.: Syndrome of androgen insensitivity in man: absence of 5-alpha-dihydrotestosterone binding protein in skin fibroblasts. J. Clin. Endocr. 38:1143-1146, 1974.

Liao, S.; Witte, D.: Autoimmune anti-androgen-receptor antibodies in human serum. Proc. Nat. Acad. Sci. 82:8345-8348, 1985.

Lin, S.-Y.; Ohno, S.: The binding of androgen receptor to DNA and RNA. Biochim. Biophys. Acta 654:181-186, 1981.

Aradhya, S.; Bardaro, T.; Galgoczy, P.; Yamagata, T.; Esposito, T.; Patlan, H.; Ciccodicola, A.; Munnich, A.; Kenwrick, S.; Platzer, M.; d'urso, M.; Nelson, D. L.: Multiple pathogenic and benign genomic rearrangements occur at a 35 kb duplication involving the NEMO and LAGE2 genes. Hum. Molec. Genet. 10:2557-2567, 2001.

Aradhya, S.; Courtois, G.; Rajkovic, A.; Lewis, R. A.; Levy, M.; Israel, A.; Nelson, D. L.: Atypical forms of incontinentia pigmenti in male individuals result from mutations of a cytosine tract in exon10 of NEMO (IKK-gamma). Am. J. Hum. Genet. 68:765-771, 2001.

Doffinger, R.; Smahi, A.; Bessia, C.; Geissmann, F.; Feinberg, J.; Durandy, A.; Bodemer, C.; Kenwrick, S.; Dupuis-Girod, S.; Blanche, S.; Wood, P.; Rabia, S. H.; and 16 others: X-linked anhidrotic ectodermal dysplasia with immunodeficiency is caused by impaired NF-kappa-B signaling. Nature Genet. 27:277-285, 2001.

Aradhya, S.; Woffendin, H.; Jakins, T.; Bardaro, T.; Esposito, T.; Smahi, A.; Shaw, C.; Levy, M.; Munnich, A.; d'urso, M.; Lewis, R. A.; Kenwrick, S.; Nelson, D. L.: A recurrent deletion in the ubiquitously expressed NEMO (IKK-gamma) gene accounts for the vast majority of incontinentia pigmenti mutations. Hum. Molec. Genet. 10:2171-2179,2001.

Jain, A.; Ma, C. A.; Liu, S.; Brown, M.; Cohen, J.; Strober, W.: Specific missense mutations in NEMO result in hyper-IgM syndrome with hypohydrotic (sic) ectodermal dysplasia. Nature Immun. 2:223-228,2001.

Jin, D. Y.; Jeang, K. T.: Isolation of full-length cDNA and chromosomal localization of human NF-kappa B modulator NEMO to Xq28. J. Biomed. Sci. 6:115-120, 1999.

Kosaki, K.; Shimasaki, N.; Fukushima, H.; Hara, M.; Ogata, T.; Matsuo, N.: Female patient showing hypohidrotic ectodermal dysplasia and immunodeficiency (HED-ID). (Letter) Am. J. Hum. Genet. 69:664-665,2001.

Li, Q.; Van Antwerp, D.; Mercurio, F.; Lee, K.-F.; Verma, I. M.: Severe liver degeneration in mice lacking the I-kappa-B kinase 2gene. Science 284:321-325, 1999.

Li, Y.; Kang, J.; Friedman, J.; Tarassishin, L.; Ye, J.; Kovalenko, A.; Wallach, D.; Horwitz, M. S.: Identification of a cell protein (FIP-3) as a modulator of NF-kappa-B activity and as a target of an adenovirus inhibitor of tumor necrosis factor alpha-induced apoptosis. Proc. Nat. Acad. Sci. 96:1042-1047, 1999.

Makris, C.; Godfrey, V. L.; Krahn-Senftleben, G.; Takahashi, T.; Roberts, J. L.; Schwarz, T.; Feng, L.; Johnson, R. S.; Karin, M.:Female mice heterozygous for IKK-gamma/NEMO deficiencies develop a dermatopathy similar to the human X-linked disorder incontinentia pigmenti. Molec. Cell 5:969-979, 2000.

May, M. J.; d'Acquisto, F.; Madge, L. A.; Glockner, J.; Pober, J. S.; Ghosh, S.: Selective inhibition of NF-kappa-B activation by a peptide that blocks the interaction of NEMO with the I-kappa-B kinase complex. Science 289:1550-1554, 2000.

Roberts, J. L.; Morrow, B.; Vega-Rich, C.; Salafia, C. M.; Nitowsky, H. M.: Incontinentia pigmenti in a newborn male infant with DNA confirmation. Am. J. Med. Genet. 75:159-163, 1998.

Rothwarf, D. M.; Zandi, E.; Natoli, G.; Karin, M.: IKK-gamma is an essential regulatory subunit of the I-kappa-B kinase complex. Nature 395:297-300, 1998.

Rudolph, D.; Yeh, W.-C.; Wakeham, A.; Rudolph, B.; Nallainathan, D.; Potter, J.; Elia, A. J.; Mak, T. W.: Severe liver degeneration and lack of NF-kappa-B activation in NEMO/IKK-gamma-deficient mice. Genes Dev. 14:854-862, 2000.

Schmidt-Supprian, M.; Bloch, W.; Courtois, G.; Addicks, K.; Israel, A.; Rajewsky, K.; Pasparakis, M.: NEMO/IKK-gamma-deficient mice model incontinentia pigmenti. Molec. Cell 5:981-992, 2000.

The International Incontinentia Pigmenti Consortium: Genomic rearrangement in NEMO impairs NF-kappa-B activation and is a cause of incontinentia pigmenti. Nature 405:466-472, 2000.

The International IP Consortium: Survival of male patients with incontinentia pigmenti carrying a lethal mutation can be explained by somatic mosaicism or Klinefelter syndrome. Am. J. Hum. Genet. 69:1210-1217, 2001.

Yamaoka, S.; Courtois, G.; Bessia, C.; Whiteside, S. T.; Weil, R.; Agou, F.; Kirk, H. E.; Kay, R. J.; Israel, A.: Complementation cloning of NEMO, a component of the I-kappa-B kinase complex essential for NF-kappa-B activation. Cell 93:1231-1240, 1998.

Zonana, J.; Elder, M. E.; Schneider, L. C.; Orlow, S. J.; Moss, C.; Golabi, M.; Shapira, S. K.; Farndon, P. A.; Wara, D. W.; Emmal, S. A.; Ferguson, B. M.: A novel X-linked disorder of immune deficiency and hypohidrotic ectodermal dysplasia is allelic to incontinentia pigmenti and due to mutations in IKK-gamma (NEMO). Am. J. Hum. Genet. 67:1555-1562, 2000.

Bauer, M. F.; Gempel, K.; Reichert, A. S.; Rappold, G. A.; Lichtner, P.; Gerbitz, K.-D.; Neupert, W.; Brunner, M.; Hofmann, S.: Genetic and structural characterization of the human mitochondrial inner membrane translocase. J. Molec. Biol. 289:69-82, 1999.

Moller, D. E.; Xia, C. H.; Tang, W.; Zhu, A. X.; Jakubowski, M.: Human rsk isoforms: cloning and characterization of tissue-specific expression. Am. J. Physiol. 266: C351-C359, 1994.

Zhao, Y.; Bjorbaek, C.; Weremowicz, S.; Morton, C. C.; Moller, D. E.: RSK3 encodes a novel pp90rsk isoform with a unique N-terminal sequence: growth factor-stimulated kinase function and nuclear translocation. Molec. Cell. Biol. 15:4353-4363, 1995.

Liu, Z.; Sun, C.; Olejniczak, E. T.; Meadows, R. P.; Betz, S. F.; Oost, T.; Herrmann, J.; Wu, J. C.; Fesik, S. W.: Structural basis for binding of Smac/DIABLO to the XIAP BIR3 domain. Nature 408:1004-1008, 2000.

Srinivasula, S. M.; Hegde, R.; Saleh, A.; Datta, P.; Shiozaki, E.; Chai, J.; Lee, R.-A.; Robbins, P. D.; Fernandes-Alnemri, T.; Shi, Y.; Alnemri, E. S.: A conserved XIAP-interaction motif in caspase-9 and Smac/DIABLO regulates caspase activity and apoptosis. Nature 410:112-116, 2001.

Bomont, P.; Cavalier, L.; Blondeau, F.; Ben Hamida, C.; Belal, S.; Tazir, M.; Demir, E.; Topaloglu, H.; Korinthenberg, R.; Tuysuz, B.; Landrieu, P.; Hentati, F.; Koenig, M.: The gene encoding gigaxonin, a new member of the cytoskeletal BTB/kelch repeat family, is mutated in giant axonal neuropathy. Nature Genet. 26:370-374, 2000.

Treiber-Held, S.; Budjarjo-Welim, H.; Riemann, D.; Richter, J.; Kretzschmar, H. A.; Hanefeld, F.: Giant axonal neuropathy: a generalized disorder of intermediate filaments with longitudinal grooves in the hair. Neuropediatrics 25:89-93, 1994.

Cannizzaro, L. A.; Chen, Y. Q.; Rafi, M. A.; Wenger, D. A.: Regional mapping of the human galactocerebrosidase gene (GALC) to 14q31 by in situ hybridization. Cytogenet. Cell Genet. 66:244-245, 1994.

De Gasperi, R.; Sosa, M. A. G.; Sartorato, E. L.; Battistini, S.; MacFarlane, H.; Gusella, J. F.; Krivit, W.; Kolodny, E. H.: Molecular heterogeneity of late-onset forms of globoid-cell leukodystrophy. Am. J. Hum. Genet. 59:1233-1242, 1996.

Duchen, L. W.; Eicher, E. M.; Jacobs, J. M.; Scaravilli, F.; Teixeira, F.: Hereditary leucodystrophy in the mouse: the new mutant twitcher. Brain 103:695-710, 1980.

Minassian, B. A.; Lee, J. R.; Herbrick, J.-A.; Huizenga, J.; Soder, S.; Mungall, A. J.; Dunham, I.; Gardner, R.; Fong, C. G.; Carpenter, S.; Jardim, L.; Satishchandra, P.; Andermann, E.; Snead, O. C., III; Lopes-Cendes, I.; Tsui, L.-C.; Delgado-Escueta, A. V.; Rouleau, G. A.; Scherer, S. W.: Mutations in a gene encoding a novel protein tyrosine phosphatase cause progressive myoclonus epilepsy. Nature Genet. 20:171-174, 1998.

Norio, R.; Koskiniemi, M.: Progressive myoclonus epilepsy: genetic and nosological aspects with special reference to 107 Finnish patients. Clin. Genet. 15:382-398, 1979.

Ortiz-Hidalgo, C.: The man behind Lafora's bodies. Am. J. Surg. Path. 10:358-361, 1986.

Sainz, J.; Minassian, B. A.; Serratosa, J. M.; Gee, M. N.; Sakamoto, L. M.; Iranmanesh, R.; Bohlega, S.; Baumann, R. J.; Ryan, S.; Sparkes, R. S.; Delgado-Escueta, A. V.: Lafora progressive myoclonus epilepsy: narrowing the chromosome 6q24 locus by recombinations and homozygosities. (Letter) Am. J. Hum. Genet. 61:1205-1209, 1997.

Sarlin, M. B.; Kloepfer, H. W.; Mickle, W. A.; Heath, R. G.: The detection of carriers in hereditary myoclonic epilepsy. Acta Genet. Med. Gemellol. 9:466-471, 1960.

Schwarz, G. A.; Yanoff, M.: Lafora's disease, distinct clinico-pathologic form of Unverricht's syndrome. Arch. Neurol. 12:172-188, 1965.

Serratosa, J. M.; Delgado-Escueta, A. V.; Posada, I.; Shih, S.; Drury, I.; Berciano, J.; Zabala, J. A.; Antunez, M. C.; Sparkes, R. S.: The gene for progressive myoclonus epilepsy of the Lafora type maps to chromosome 6q. Hum. Molec. Genet. 4:1657-1663, 1995.

Yanoff, M.; Schwarz, G. A.: Lafora's disease: a distinct genetically determined form of Unverricht's syndrome. Genet. Hum. 14:235-244,1965.

Yokoi, S.; Austin, J.; Witmer, F.; Sakai, M.: Studies in myoclonus epilepsy (Lafora body forms). I. Isolation and preliminary characterization of Lafora bodies in two cases. Arch. Neurol. 19:15-33, 1968.

Serratosa, J. M.; Gomez-Garre, P.; Gallardo, M. E.; Anta, B.; Beltran-Valero de Bernabe, D.; Lindhout, D.; Augustijn, P. B.; Tassinari, C. A.; Michelucci, R.; Malafosse, A.; Topcu, M.; Grid, D.; Dravet, C.; Berkovic, S. F.; Rodriguez de Cordoba, S.: A novel protein tyrosine phosphatase gene is mutated in progressive myoclonus epilepsy of the Lafora type (EPM2). Hum. Molec. Genet. 8:345-352, 1999.

Lyerla, T. A.; Konola, J. T.; Skiba, M. C.; Raghavan, S.: Galactocerebrosidase activity in somatic cell hybrids derived from twitcher mouse/control human fibroblasts is associated with human chromosome 17. Am. J. Hum. Genet. 44:198-207, 1989.

Sakai, N.; Inui, K.; Fujii, N.; Fukushima, H.; Nishimoto, J.; Yanagihara, I.; Isegawa, Y.; Iwamatsu, A.; Okada, S.: Krabbe disease: isolation and characterization of a full-length cDNA for human galactocerebrosidase. Biochem. Biophys. Res. Commun. 198:485-491, 1994.

Sweet, H.: Twitcher (twi) is on chromosome 12. Mouse Newsletter 75:30, 1986.

Carney, J. P.; Maser, R. S.; Olivares, H.; Davis, E. M.; Le Beau, M.; Yates, J. R., III; Hays, L.; Morgan, W. F.; Petrini, J. H. J.: The hMre11/hRad50 protein complex and Nijmegen breakage syndrome: linkage of double-strand break repair to the cellular DNA damage response. Cell 93:477-486, 1998.

Mailly, F.; Palmen, J.; Muller, D. P. R.; Gibbs, T.; Lloyd, J.; Brunzell, J.; Durrington, P.; Mitropoulos, K.; Betteridge, J.; Watts, G.; Lithell, H.; Angelico, F.; Humphries, S. E.; Talmud, P. J.: Familial lipoprotein lipase (LPL) deficiency: a catalogue of LPL gene mutations identified in 20 patients from the UK, Sweden, and Italy. Hum. Mutat. 10:465-473, 1997.

Normand, T.; Bergeron, J.; Fernandez-Margallo, T.; Bharucha, A.; Ven Murthy, M. R.; Julien, P.; Gagne, C.; Dionne, C.; De Braekeleer, M.; Ma, R.; Hayden, M. R.; Lupien, P. J.: Geographic distribution and genealogy of mutation 207 of the lipoprotein lipase gene in the French Canadian population of Quebec. Hum. Genet. 89:671-675, 1992.

Monsalve, M. V.; Henderson, H.; Roederer, G.; Julien, P.; Deeb, S.; Kastelein, J. J. P.; Peritz, L.; Devlin, R.; Bruin, T.; Murthy, M. R. V.; Gagne, C.; Davignon, J.; Lupien, P. J.; Brunzell, J. D.; Hayden, M. R.: A missense mutation at codon 188 of the human lipoprotein lipase gene is a frequent cause of lipoprotein lipase deficiency in persons of different ancestries. J. Clin. Invest. 86:728-734, 1990.

Cobben, J. M.; van der Steege, G.; Grootscholten, P.; de Visser, M.; Scheffer, H.; Buys, C. H. C. M.: Deletions of the survival motor neuron gene in unaffected siblings of patients with spinal muscular atrophy. Am. J. Hum. Genet. 57:805-808, 1995.

Hahnen, E.; Schonling, J.; Rudnik-Schoneborn, S.; Zerres, K.; Wirth, B.: Hybrid survival motor neuron genes in patients with autosomal recessive spinal muscular atrophy: new insights into molecular mechanisms responsible for the disease. Am. J. Hum. Genet. 59:1057-1065, 1996.

Lefebvre, S.; Burglen, L.; Reboullet, S.; Clermont, O.; Burlet, P.; Viollet, L.; Benichou, B.; Cruaud, C.; Millasseau, P.; Zeviani, M.; Le Paslier, D.; Frezal, J.; Cohen, D.; Weissenbach, J.; Munnich, A.; Melki, J.: Identification and characterization of a spinal muscular atrophy-determining gene. Cell 80:155-165, 1995.

Matthijs, G.; Schollen, E.; Legius, E.; Devriendt, K.; Goemans, N.; Kayserili, H.; Apak, M. Y.; Cassiman, J.-J.: Unusual molecular findings in autosomal recessive spinal muscular atrophy. J. Med. Genet. 33:469-474, 1996.

Kaplan, J.; Gerber, S.; Larget-Piet, D.; Rozet, J.-M.; Dollfus, H.; Dufier, J.-L.; Odent, S.; Postel-Vinay, A.; Janin, N.; Briard, M.-L.; Frezal, J.; Munnich, A.: A gene for Stargardt's disease (fundus flavimaculatus) maps to the short arm of chromosome 1. Nature Genet. 5:308-311, 1993.

Coppa, G. V.; Giorgi, P. L.; Felici, L.; Gabrielli, O.; Donti, E.; Bernasconi, S.; Kresse, H.; Paschke, E.; Mastropaolo, C.: Clinical heterogeneity in Sanfilippo disease (mucopolysaccharidosis III) typeD: presentation of two new cases. Europ. J. Pediat. 140:130-133,1983.

Dhoot, G. K.; Gustafsson, M. K.; Ai, X.; Sun, W.; Standiford, D. M.; Emerson, C. P., Jr.: Regulation of Wnt signaling and embryo patterning by an extracellular sulfatase. Science 293:1663-1666, 2001.

Freeman, C.; Clements, P. R.; Hopwood, J. J.: Human liver N-acetylglucosamine-6-sulphate sulphatase: purification and characterization. Biochem. J. 246:347-354, 1987.

Freeman, C.; Hopwood, J. J.: Human liver N-acetylglucosamine-6-sulphate sulphatase: catalytic properties. Biochem. J. 246:355-365, 1987.

Gatti, R.; Borrone, C.; Durand, P.; De Virgiliis, S.; Sanna, G.; Cao, A.; von Figura, K.; Kresse, H.; Paschke, E.: Sanfilippo type D disease: clinical findings in two patients with a new variant of mucopolysaccharidosis III. Europ. J. Pediat. 138:168-171, 1982.

Kaplan, P.; Wolfe, L. S.: Sanfilippo syndrome type D. J. Pediat. 110:267-271, 1987.

Kresse, H.; Paschke, E.; von Figura, K.; Gilberg, W.; Fuchs, W.: Sanfilippo disease type D: deficiency of N-acetylglucosamine-6-sulfate sulfatase required for heparan sulfate degradation. Proc. Nat. Acad. Sci. 77:6822-6826, 1980.

Robertson, D. A.; Callen, D. F.; Baker, E. G.; Morris, C. P.; Hopwood, J. J.: Chromosomal localization of the gene for human glucosamine-6-sulphatase to 12q14. Hum. Genet. 79:175-178, 1988.

Robertson, D. A.; Freeman, C.; Nelson, P. V.; Morris, C. P.; Hopwood, J. J.: Human glucosamine-6-sulfatase cDNA reveals homology with steroid sulfatase. Biochem. Biophys. Res. Commun. 157:218-224, 1988.

Siciliano, L.; Fiumara, A.; Pavone, L.; Freeman, C.; Robertson, D.; Morris, C. P.; Hopwood, J. J.; Di Natale, P.; Musumeci, S.; Horwitz, A. L.: Sanfilippo syndrome type D in two adolescent sisters. J. Med. Genet. 28:402-405, 1991.

Thompson, J. N.; Jones, M. Z.; Dawson, G.; Huffman, P. S.: N-acetylglucosamine6-sulphatase deficiency in a Nubian goat: a model of Sanfilippo syndrometype D (mucopolysaccharidosis IIID). J. Inherit. Metab. Dis. 15:760-768, 1992.

Faiella, A.; Brunelli, S.; Granata, T.; d'Incerti, L.; Cardini, R.; Lenti, C.; Battaglia, G.; Boncinelli, E.: A number of schizencephaly patients including 2 brothers are heterozygous for germline mutations in the homeobox gene EMX2. Europ. J. Hum. Genet. 5:186-190, 1997.

Rousseau-Merck, M.-F.; Duro, D.; Berger, R.; Thiesen, H. J.: Chromosomal localization of two KOX zinc finger genes on chromosome bands 7q21-q22. Ann. Genet. 38:81-84, 1995.

Tommerup, N.; Vissing, H.: Isolation and fine mapping of 16 novel human zinc finger-encoding cDNAs identify putative candidate genes for developmental and malignant disorders. Genomics 27:259-264,1995.

Canman, C. E.; Radany, E. H.; Parsels, L. A.; Davis, M. A.; Lawrence, T. S.; Maybaum, J.: Induction of resistance to fluorodeoxyuridine cytotoxicity and DNA damage in human tumor cells by expression of Escherichia coli deoxyuridine triphosphatase. Cancer Res. 54:2296-2298,1994.

Canman, C. E.; Tang, H. Y.; Normolle, D. P.; Lawrence, T. S.; Maybaum, J.: Variations in patterns of DNA damage induced in human colorectal tumor cells by 5-fluorodeoxyuridine: implications for mechanisms of resistance and cytotoxicity. Proc. Nat. Acad. Sci. 89:10474-10478,1992.

Chu, R.; Lin, Y.; Rao, M. S.; Reddy, J. K.: Cloning and identification of rat deoxyuridine triphosphatase as an inhibitor of peroxisome proliferator-activated receptor alpha. J. Biol. Chem. 271:27670-27676, 1996.

Cohen, D.; Heng, H. H. Q.; Shi, X.-M.; McIntosh, E. M.; Tsui, L.-C.; Pearlman, R. E.: Assignment of the human dUTPase gene (DUT) to chromosome 15q15-q21.1 by fluorescence in situ hybridization. Genomics 40:213-215, 1997.

el-Hajj, H. H.; Zhang, H.; Weiss, B.: Lethality of a dut (deoxyuridine triphosphatase) mutation in Escherichia coli. J. Bacteriol. 170:1069-1075, 1988.

Ladner, R. D.; Caradonna, S. J.: The human dUTPase gene encodes both nuclear and mitochondrial isoforms: differential expression of the isoforms and characterization of a cDNA encoding the mitochondrial species. J. Biol. Chem. 272:19072-19080, 1997.

Ladner, R. D.; McNulty, D. E.; Carr, S. A.; Roberts, G. D.; Caradonna, S. J.: Characterization of distinct nuclear and mitochondrial forms of human deoxyuridine triphosphate nucleotidohydrolase. J. Biol. Chem. 271:7745-7751, 1996.

Lindahl, T.: DNA repair enzymes. Annu. Rev. Biochem. 51:61-87,1982.

McIntosh, E. M.; Ager, D. D.; Gadsden, M. H.; Haynes, R. H.: human DUTP pyrophosphatase: cDNA sequence and potential biological importance of the enzyme. Proc. Nat. Acad. Sci. 89:8020-8024, 1992. Note: Erratum: Proc. Nat. Acad. Sci.:90:4328 only, 1993.

Boring, L.; Gosling, J.; Cleary, M.; Charo, I. F.: Decreased lesion formation in CCR2 -/- mice reveals a role for chemokines in the initiation of atherosclerosis. Nature 394:894-897, 1998.

Charo, I. F.; Myers, S. J.; Herman, A.; Franci, C.; Connolly, A. J.; Coughlin, S. R.: Molecular cloning and functional expression of two monocyte chemoattractant protein 1 receptors reveals alternative splicing of the carboxyl-terminal tails. Proc. Nat. Acad. Sci. 91:2752-2756, 1994.

Ullman, K. S.; Powers, M. A.; Forbes, D. J.: Nuclear export receptors: from importin to exportin. Cell 90:967-970, 1997.

Barrett, T. E.; Savva, R.; Panayotou, G.; Barlow, T.; Brown, T.; Jiricny, J.; Pearl, L. H.: Crystal structure of a G:T/U mismatch-specific DNA glycosylase: mismatch recognition by complementary-strand interactions. Cell 92:117-129, 1998.

De Gregorio, L.; Gallinari, P.; Gariboldi, M.; Manenti, G.; Pierotti, M. A.; Jiricny, J.; Dragani, T. A.: Genetic mapping of thymine DNA glycosylase (Tdg) gene and of one pseudogene in the mouse. Mammalian Genome 7:909-910, 1996.

Lindahl, T.: DNA repair enzymes. Ann. Rev. Biochem. 51:61-87,1982.

Neddermann, P.; Gallinari, P.; Lettieri, T.; Schmid, D.; Truong, O.; Hsuan, J. J.; Wiebauer, K.; Jiricny, J.: Cloning and expression of human G/T mismatch-specific thymine-DNA glycosylase. J. Biol. Chem. 271:12767-12774, 1996.

Sard, L.; Tornielli, S.; Gallinari, P.; Minoletti, F.; Jiricny, J.; Lettieri, T.; Pierotti, M. A.; Sozzi, G.; Radice, P.: Chromosomal localizations and molecular analysis of TDG gene-related sequences. Genomics 44:222-226, 1997.

DiMarco, S. P.; Glover, T. W.; Miller, D. E.; Reines, D.; Warren, S. T.: Transcription elongation factor SII (TCEA) maps to human chromosome 3p22-p21.3. Genomics 36:185-188, 1996.

Park, H.; Baek, K.; Jeon, C.; Agarwal, K.; Yoo, O.: characterization of the gene encoding the human transcriptional elongation factor TFIIS. Gene 139:263-267, 1994.

Reines, D.: Nascent RNA cleavage by transcription elongation complexes. In:Conaway, R. C.; Conaway, J. W. (eds.): Transcription: Mechanisms and Regulation. New York: Raven Press 1994. Pp. 263-278.

Thomas, M. J.; Platas, A. A.; Hawley, D. K.: Transcriptional fidelity and proofreading by RNA polymerase II. Cell 93:627-637, 1998.

Applequist, S. E.; Selg, M.; Raman, C.; Jack, H.-M.: Cloning and characterization of HUPF1, a human homolog of the Saccharomyces cerevisiae nonsense mRNA-reducing UPF1 protein. Nucleic Acids Res. 25:814-821,1997.

Medghalchi, S. M.; Frischmeyer, P. A.; Mendell, J. T.; Kelly, A. G.; Lawler, A. M.; Dietz, H. C.: Rent1, a trans-effector of nonsense-mediated mRNA decay, is essential for mammalian embryonic viability. Hum. Molec. Genet. 10:99-105, 2001.

Mendell, J. T.; ap Rhys, C. M. J.; Dietz, H. C.: Separable roles for rent1/hUpf1 in altered splicing and decay of nonsense transcripts. Science 298:419-371, 2002.

Perlick, H. A.; Medghalchi, S. M.; Spencer, F. A.; Dietz, H. C.: Cloning and characterization of a human regulator of nonsense transcript stability. (Abstract) Am. J. Hum. Genet. 59 (suppl.): A32 only,1996.

Perlick, H. A.; Medghalchi, S. M.; Spencer, F. A.; Kendzior, R. J., Jr.; Dietz, H. C.: Mammalian orthologues of a yeast regulator of nonsense transcript stability. Proc. Nat. Acad. Sci. 93:10928-10932,1996.

Sun, X.; Perlick, H. A.; Dietz, H. C.; Maquat, L. E.: A mutated human homologue to yeast Upf1 protein has a dominant-negative effect on the decay of nonsense-containing mRNAs in mammalian cells. Proc. Nat. Acad. Sci. 95:10009-10014, 1998.

Eng, C.; Myers, S. M.; Kogon, M. D.; Sanicola, M.; Hession, C.; Cate, R. L.; Mulligan, L. M.: Genomic structure and chromosomal localization of the human GDNFR-alpha gene. Oncogene 16:597-601, 1998.

GFR-alpha Nomenclature Committee: Nomenclature of GPI-linked receptors for the GDNF ligand family. Neuron 19:485 only, 1997.

Gorodinsky, A.; Zimonjic, D. B.; Popescu, N. C.; Milbrandt, J.: Assignment of the GDNF family receptor alpha-1 (GFRA1) to human chromosome band 10q26 by in situ hybridization. Cytogenet. Cell Genet. 78:289-290, 1997.

Jing, S.; Wen, D.; Yu, Y.; Holst, P. L.; Luo, Y.; Fang, M.; Tamir, R.; Antonio, L.; Hu, Z.; Cupples, R.; Louis, J.-C.; Hu, S.; Altrock, B. W.; Fox, G. M.: GDNF-induced activation of the Ret protein tyrosine kinase is mediated by GDNFR-alpha, a novel receptor for GDNF. Cell 85:1113-1124, 1996.

Paratcha, G.; Ledda, F.; Baars, L.; Coulpier, M.; Besset, V.; Anders, J.; Scott, R.; Ibanez, C. F.: Released GFR-alpha-1 potentiates downstream signaling, neuronal survival, and differentiation via a novel mechanism of recruitment of c-Ret to lipid rafts. Neuron 29:171-184, 2001.

Puliti, A.; Cinti, R.; Seri, M.; Ceccherini, I.; Romeo, G.: Assignment of mouse Gfra1, the homologue of a new human HSCR candidate gene, to the telomeric region of mouse chromosome 19. Cytogenet. Cell Genet. 78:291-294, 1997.

Shefelbine, S. E.; Khorana, S.; Schultz, P. N.; Huang, E.; Thobe, N.; Hu, Z. J.; Fox, G. M.; Jing, S.; Cote, G. J.; Gagel, R. F.: Mutational analysis of the GDNF/RET-GDNFR-alpha signaling complex in a kindred with vesicoureteral reflux. Hum. Genet. 102:474-478, 1998.

Chen, H.; Chrast, R.; Rossier, C.; Gos, A.; Antonarakis, S. E.; Kudoh, J.; Yamaki, A.; Shindoh, N.; Maeda, H.; Minoshima, S.; Shimizu, N.: Single-minded and Down syndrome? (Letter) Nature Genet. 10:9-10, 1995.

Chrast, R.; Scott, H. S.; Madani, R.; Huber, L.; Wolfer, D. P.; Prinz, M.; Aguzzi, A.; Lipp, H.-P.; Antonarakis, S. E.: Mice trisomic for a bacterial artificial chromosome with the single-minded 2 gene (Sim2) show phenotypes similar to some of those present in the partial trisomy 16 mouse models of Down syndrome. Hum. Molec. Genet. 9:1853-1864, 2000.

Dahmane, N.; Charron, G.; Lopes, C.; Yaspo, M.-L.; Maunoury, C.; Decorte, L.; Sinet, P.-M.; Bloch, B.; Delabar, J.-M.: Down syndrome-critical region contains a gene homologous to Drosophila sim expressed during rat and human central nervous system development. Proc. Nat. Acad. Sci. 92:9191-9195, 1995.

Ema, M.; Ikegami, S.; Hosoya, T.; Mimura, J.; Ohtani, H.; Nakao, K.; Inokuchi, K.; Katsuki, M.; Fujii-Kuriyama, Y.: Mild impairment of learning and memory in mice overexpressing the mSim2 gene located on chromosome 16: an animal model of Down's syndrome. Hum. Molec. Genet. 8:1409-1415, 1999.

Moffett, P.; Dayo, M.; Reece, M.; McCormick, M. K.; Pelletier, J.: Characterization of msim, a murine homologue of the Drosophilasim transcription factor. Genomics 35:144-155, 1996.

Yamaki, A.; Noda, S.; Kudoh, J.; Shindoh, N.; Maeda, H.; Minoshima, S.; Kawasaki, K.; Shimizu, Y.; Shimizu, N.: The mammalian single-minded (SIM) gene: mouse cDNA structure and diencephalic expression indicate a candidate gene for Down syndrome. Genomics 35:136-143, 1996.

Muenke, M.; Bone, L. J.; Mitchell, H. F.; Hart, I.; Walton, K.; Hall-Johnson, K.; Ippel, E. F.; Dietz-Band, J.; Kvaloy, K.; Fan, C.-M.; Tessier-Lavigne, M.; Patterson, D.: Physical mapping of the holoprosencephaly critical region in 21q22.3, exclusion of SIM2 as a candidate gene for holoprosencephaly, and mapping of SIM2 to a region of chromosome 21 important for Down syndrome. Am. J. Hum. Genet. 57:1074-1079,1995.

de Winter, J. P.; Leveille, F.; van Berkel, C. G. M.; Rooimans, M. A.; van der Weel, L.; Steltenpool, J.; Demuth, I.; Morgan, N. V.; Alon, N.; Bosnoyan-Collins, L.; Lightfoot, J.; Leegwater, P. A.; Waisfisz, Q.; Komatsu, K.; Arwert, F.; Pronk, J. C.; Mathew, C. G.; Digweed, M.; Buchwald, M.; Joenje, H.: Isolation of a cDNA representing the Fanconi anemia complementation group E gene. Am. J. Hum. Genet. 67:1306-1308, 2000. Note: Erratum: Am. J. Hum. Genet. 67:1365 only,2000.

Sosa-Pineda, B.; Wigle, J. T.; Oliver, G.: Hepatocyte migration during liver development requires Prox1. Nature Genet. 25:254-255,2000.

Wigle, J. T.; Chowdhury, K.; Gruss, P.; Oliver, G.: Prox1 functionis crucial for mouse lens-fibre elongation. Nature Genet. 21:318-322,1999.

Wigle, J. T.; Oliver, G.: Prox1 function is required for the development of the murine lymphatic system. Cell 98:769-778, 1999.

Zinovieva, R. D.; Duncan, M. K.; Johnson, T. R.; Torres, R.; Polymeropoulos, M. H.; Tomarev, S. I.: Structure and chromosomal localization of the human homeobox gene Prox 1. Genomics 35:517-522, 1996.

Joenje, H.; Lo Ten Foe, J. R.; Oostra, A. B.; van Berkel, C. G. M.; Rooimans, M. A.; Schroeder-Kurth, T.; Wegner, R.-D.; Gille, J. J. P.; Buchwald, M.; Arwert, F.: Classification of Fanconi anemia patients by complementation analysis: evidence for a fifth genetic subtype. Blood 86:2156-2160, 1995.

Byk, T.; Dobransky, T.; Cifuentes-Diaz, C.; Sobel, A.: Identification and molecular characterization of Unc-33-like phosphoprotein (Ulip), a putative mammalian homolog of the axonal guidance-associated unc-33gene product. J. Neurosci. 16:688-701, 1996.

Choe, H.; Farzan, M.; Sun, Y.; Sullivan, N.; Rollins, B.; Ponath, P. D.; Wu, L.; Mackay, C. R.; LaRosa, G.; Newman, W.; Gerard, N.; Gerard, C.; Sodroski, J.: The beta-chemokine receptors CCR3 and CCR5facilitate infection by primary HIV-1 isolates. Cell 85:1135-1148,1996.

Ben-Porath, I.; Benvenisty, N.: Characterization of a tumor-associated gene, a member of a novel family of genes encoding membrane glycoproteins. Gene 183:69-75, 1996.

Hong, Y.; Ohishi, K.; Inoue, N.; Endo, Y.; Fujita, T.; Takeda, J.; Kinoshita, T.: Structures and chromosomal localizations of the glycosylphosphatidyl inositol synthesis gene PIGC and its pseudogene PIGCP1. Genomics 44:347-349, 1997.

Gaetano, C; Matsuo, T.; Thiele, C. J.: Identification and characterization of a retinoic acid-regulated human homologue of the unc-33-like phosphoprotein gene (hUlip) from neuroblastoma cells. J. Biol. Chem. 272:12195-12201,1997.

Matsuo, T.; Stauffer, J. K.; Walker, R. L.; Meltzer, P.; Thiele, C. J.: Structure and promoter analysis of the human unc-33-like phosphoprotein gene: E-box required for maximal expression in neuroblastoma and myoblasts. J. Biol. Chem. 275:16560-16568, 2000.

Behm, F. G.; Smith, F. O.; Raimondi, S. C.; Pui, C.-H.; Bernstein, I. D.: Human homologue of the rat chondroitin sulfate proteoglycan, NG2, detected by monoclonal antibody 7.1, identifies childhood acute lymphoblastic leukemias with t (4;11)(q21; q23) or t (11;19)(q23; p13) and MLL gene rearrangements. Blood 87:1134-1139, 1996.

Pluschke, G.; Vanek, M.; Evans, A.; Dittmar, T.; Schmid, P.; Itin, P.; Filardo, E. J.; Reisfeld, R. A.: Molecular cloning of a human melanoma-associated chondroitin sulfate proteoglycan. Proc. Nat. Acad. Sci. 93:9710-9715, 1996.

Rettig, W. J.; Dracopoli, N. C.; Goetzger, T. A.; Spengler, B. A.; Biedler, J. L.; Oettgen, H. F.; Old, L. J.: Somatic cell genetic analysis of human cell surface antigens: chromosomal assignments and regulation of expression in rodent-human hybrid cells. Proc. Nat. Acad. Sci. 81:6437-6441, 1984.

Rettig, W. J.; Real, F. X.; Spengler, B. A.; Biedler, J. L.; Old, L. J.: Human melanoma proteoglycan: expression in hybrids controlled by intrinsic and extrinsic signals. Science 231:1281-1284, 1986.

Smith, F. O.; Rauch, C.; Williams, D. E.; March, C. J.; Arthur, D.; Hilden, J.; Lampkin, B. C.; Buckley, J. D.; Buckley, C. V.; Woods, W. G.; Dinndorf, P. A.; Sorensen, P.; Kersey, J.; Hammond, D.; Bernstein, I. D.: The human homologue of rat NG2, a chondroitin sulfate proteoglycan, is not expressed on the cell surface of normal hematopoietic cells but is expressed by acute myeloid leukemia blasts from poor-prognosis patients with abnormalities of chromosome band 11q23. Blood 87:1123-1133, 1996.

Gipp, J. J.; Bailey, H. H.; Mulcahy, R. T.: Cloning and sequencing of the cDNA for the light subunit of human liver gamma-glutamylcysteine synthetase and relative mRNA levels for heavy and light subunits in human normal tissues. Biochem. Biophys. Res. Commun. 206:584-589,1995.

Huang; C.-S.; Anderson; M. E.; Meister, A.: Amino acid sequence and function of the light subunit of rat kidney gamma-glutamylcysteine synthetase. J. Biol. Chem. 268: 20578-20583, 1993.

Sierra-Rivera, E.; Dasouki, M.; Summar, M. L.; Krishnamani, M. R. S.; Meredith, M.; Rao, P. N.; Phillips, J. A., III; Freeman, M. L.: Assignment of the human gene (GLCLR) that encodes the regulatory subunit of gamma-glutamylcysteine synthetase to chromosome 1p21. Cytogenet. Cell Genet. 72:252-254, 1996.

Tsuchiya, K.; Mulcahy, R. T.; Reid, L. L.; Disteche, C. M.; Kavanagh, T. J.: Mapping of the glutamate-cysteine ligase catalytic subunit gene (GLCLC) to human chromosome 6p12 and mouse chromosome 9D-E and of the regulatory subunit gene (GLCLR) to human chromosome 1p21-p22and mouse chromosome 3H1-3. Genomics 30:630-632, 1995.

Ellis, J. A.; Luzio, J. P.: Identification and characterization of a novel protein (p137) which transcytoses bidirectionally in Caco-2cells. J. Biol. Chem. 270:20717-20723, 1995.

Gessler, M.; Klamt, B.; Tsaoussidou, S.; Ellis, J. A.; Luzio, J. P.: The gene encoding the GPI-anchored membrane protein p137(GPI)(M11S1) maps to human chromosome 11p13 and is highly conserved in the mouse. Genomics 32:169-170, 1996.

Rozet, J.-M.; Gerber, S.; Perrault, I.; Calvas, P.; Souied, E.; Chatelin, S.; Viegas-Pequignot, E.; Molina-Gomez, D.; Munnich, A.; Kaplan, J.: Structure and refinement of the physical mapping of the gamma-glutamylcysteine ligase regulatory subunit (GLCLR) gene to chromosome 1pp22.1 within the critically deleted region of human malignant mesothelioma. Cytogenet. Cell Genet. 82:91-94, 1998.

Inoue, N.; Watanabe, R.; Takeda, J.; Kinoshita, T.: PIG-C, one of the three human genes involved in the first step of glycosylphosphatidyl inositol biosynthesis is a homologue of Saccharomyces cerevisiae GPI2. Biochem. Biophys. Res. Commun. 226:193-199, 1996.

Ring, H. Z.; Vameghi-Meyers, V.; Wang, W.; Crabtree, G. R.; Francke, U.: Five SWI/SNF-related, matrix-associated, actin-dependent regulator of chromatin (SMARC) genes are dispersed in the human genome. Genomics 51:140-143, 1998.

Wang, W.; Xue, Y.; Zhou, S.; Kuo, A.; Cairns, B. R.; Crabtree, G. R.: Diversity and specialization of mammalian SWI/SNF complexes. Genes Dev. 10:2117-2130, 1996.

Kim, B.-T.; Kitagawa, H.; Tamura, J.; Saito, T.; Kusche-Gullberg, M.; Lindahl, U.; Sugahara, K.: Human tumor suppressor EXT gene family members EXTL1 and EXTL3 encode alpha-1,4-N-acetylglucosaminyl transferases that likely are involved in heparan sulfate/heparin biosynthesis. Proc. Nat. Acad. Sci. 98:7176-7181, 2001.

Wise, C. A.; Clines, G. A.; Massa, H.; Trask, B. J.; Lovett, M.: Identification and localization of the gene for EXTL, a third member of the multiple exostoses gene family. Genome Res. 7:10-16, 1997.

Moskow, J. J.; Bullrich, F.; Huebner, K.; Daar, I. O.; Buchberg, A. M.: Meis1, a PBX1-related homeobox gene involved in myeloid leukemia in BXH-2 mice. Molec. Cell. Biol. 15:5434-5443, 1995.

Steelman, S.; Moskow, J. J.; Muzynski, K.; North, C.; Druck, T.; Montgomery, J. C.; Huebner, K.; Daar, I. O.; Buchberg, A. M.: Identification of a conserved family of Meis1-related homeobox genes. Genome Res. 7:142-156, 1997.

Thorsteinsdottir, U.; Kroon, E.; Jerome, L.; Blasi, F.; Sauvageau, G.: Defining roles for HOX and MEIS1 genes in induction of acute myeloid leukemia. Molec. Cell. Biol. 21:224-234, 2001.

Capdevila, J.; Tsukui, T.; Esteban, C. R.; Zappavigna, V.; Belmonte, J. C. I.: Control of vertebrate limb outgrowth by the proximal factor Meis2 and distal antagonism of BMPs by Gremlin. Molec. Cell 4:839-849,1999.

Nakamura, T.; Jenkins, N. A.; Copeland, N. G.: Identification of a new family of Pbx-related homeobox genes. Oncogene 13:2235-2242,1996.

Smith, J. E.; Afonja, O.; Yee, H. T.; Inghirami, G.; Takeshita, K.: Chromosomal mapping to 15q14 and expression analysis of the human MEIS2 homeobox gene. Mammalian Genome 8:951-952, 1997.

Kobayashi, S.; Uemura, H.; Kohda, T.; Nagai, T.; Chinen, Y.; Naritomi, K.; Kinoshita, E.; Ohashi, H.; Imaizumi, K.; Tsukahara, M.; Sugio, Y.; Tonoki, H.; Kishino, T.; Tanaka, T.; Yamada, M.; Tsutsumi, O.; Niikawa, N.; Kaneko-Ishino, T.; Ishino, F.: No evidence of PEG1/MEST gene mutations in Silver-Russell syndrome patients. Am. J. Med. Genet. 104: 225-231, 2001.

Mizuno, K.; Hasegawa, K.; Katagiri, T.; Ogimoto, M.; Ichikawa, T.; Yakura, H.: MPTP-delta, a putative murine homolog of HPTP-delta, is expressed in specialized regions of the brain and in the B-cell lineage. Molec. Cell. Biol. 13:5513-5523, 1993.

Uetani, N.; Kato, K.; Ogura, H.; Mizuno, K.; Kawano, K.; Mikoshiba, K.; Yakura, H.; Asano, M.; Iwakura, Y.: Impaired learning with enhanced hippocampal long-term potentiation in PTP-delta-deficient mice. EMBO J. 19:2775-2785, 2000.

Heighway, J.; Betticher, D. C.; Hoban, P. R.; Altermatt, H. J.; Cowen, R.: Coamplification in tumors of KRAS2, type 2 inositol 1,4,5 triphosphate receptor gene, and a novel human gene, KRAG. Genomics 35:207-214, 1996.

Scott, A. F.; Elizaga, A.; Morrell, J.; Bergen, A.; Penno, M. B.: Characterization of a gene coamplified with Ki-ras in Y1 murine adrenal carcinoma cells that codes for a putative membrane protein. Genomics 20:227-230, 1994.

Monte, D.; Baert, J. L.; Defossez, P. A.; de Launoit, Y.; Stehelin, D.: Molecular cloning and characterization of human ERM, a new member of the Ets family closely related to mouse PEA3 and ER81 transcription factors. Oncogene 9:1397-1406, 1994.

Monte, D.; Coutte, L.; Dewitte, F.; Defossez, P.-A.; Le Coniat, M.; Stehelin, D.; Berger, R.; de Launoit, Y.: Genomic organization of the human ERM (ETV5) gene, a PEA3 group member of ETS transcription factors. Genomics 35:236-240, 1996.

Protopopova, M. V.; Vorobieva, N. V.; Protopopov, A. I.; Gizatullin, R. Z.; Kashuba, V. I.; Klein, G.; Zabarovsky, E. R.; Graphodatsky, A. S.: Assignment of the ERM gene (ETV5) coding for the ets-related protein to human chromosome band 3q28 by in situ hybridization. Cytogenet. Cell Genet. 74:220 only, 1996.

Bosher, J. M.; Williams, T.; Hurst, H. C.: The developmentally regulated transcription factor AP-2 is involved in c-erbB-2 overexpression in human mammary carcinoma. Proc. Nat. Acad. Sci. 92:744-747, 1995.

Combadiere, C.; Ahuja, S. K.; Murphy, P. M.: Cloning, chromosomal localization, and RNA expression of a human beta chemokine receptor-like gene. DNA Cell Biol. 14:673-680, 1995.

Combadiere, C.; Ahuja, S. K.; Van Damme, J.; Tiffany, H. L.; Gao, J.-L.; Murphy, P. M.: Monocyte chemoattractant protein-3 is a functional ligand for CC chemokine receptors 1 and 2B. J. Biol. Chem. 270:29671-29675, 1995.

Doranz, B. J.; Rucker, J.; Yi, Y.; Smyth, R. J.; Samson, M.; Peiper, S. C.; Parmentier, M.; Collman, R. G.; Doms, R. W.: A dual-tropic primary HIV-1 isolate that uses fusin and the beta-chemokine receptors CKR-5, CKR-3, and CKR-2b as fusion cofactors. Cell 85:1149-1158,1996.

Mummidi, S.; Ahuja, S. S.; Gonzalez, E.; Anderson, S. A.; Santiago, E. N.; Stephan, K. T.; Craig, F. E.; O'Connell, P.; Tryon, V.; Clark, R. A.; Dolan, M. J.; Ahuja, S. K.: Genealogy of the CCR5 locus and chemokine system gene variants associated with altered rates of HIV-1 disease progression. Nature Med. 4:786-793, 1998.

Peters, W.; Dupuis, M.; Charo, I. F.: A mechanism for the impaired IFN-gamma production in C-C chemokine receptor 2 (CCR2) knockout mice: role of CCR2 in linking the innate and adaptive immune responses. J. Immun. 165:7072-7077, 2000.

Peters, W.; Scott, H. M.; Chambers, H. F.; Flynn J. L.; Charo, I. F.; Ernst, J. D.: Chemokine receptor 2 serves an early and essential role in resistance to Mycobacterium tuberculosis. Proc. Nat. Acad. Sci. 98:7958-7963, 2001.

Samson, M.; Labbe, O.; Mollereau, C.; Vassart, G.; Parmentier, M.: Molecular cloning and functional expression of a new human CC-chemokine receptor gene. Biochemistry 35:3362-3367, 1996.

Samson, M.; Soularue, P.; Vassart, G.; Parmentier, M.: The genes encoding the human CC-chemokine receptors CC-CKR1 to CC-CKR5 (CMKBR1-CMKBR5) are clustered in the p21.3-p24 region of chromosome 3. Genomics 36:522-526, 1996.

Sanders, S. K.; Crean, S. M.; Boxer, P. A.; Kellner, D.; LaRosa, G. J.; Hunt, S. W., III.: Functional differences between monocyte chemotactic protein-1 receptor A and monocyte chemotactic protein-1 receptor B expressed in a Jurkat T cell. J. Immun. 165:4877-4883,2000.

Smith, M. W.; Dean, M.; Carrington, M.; Winkler, C.; Huttley, G. A.; Lomb, D. A.; Goedert, J. J.; O'Brien, T. R.; Jacobson, L. P.; Kaslow, R.; Buchbinder, S.; Vittinghoff, E.; Vlahov, D.; Hoots, K.; Hilgartner, M. W.; Hemophilia Growth and Development Study (HGDS); Multicenter AIDS Cohort Study (MACS); Multicenter Hemophilia Cohort-Study (MHCS); San Francisco City Cohort (SFCC); ALIVE Study; O'Brien, S. J.: Contrasting genetic influence of CCR2 and CCR5 variants on HIV-1 infection and disease progression. Science 277:959-965,1997.

Wong, L.-M.; Myers, S. J.; Tsou, C.-L.; Gosling, J.; Arai, H.; Charo, I. F.: Organization and differential expression of the human monocyte chemoattractant protein 1 receptor gene: evidence for the role of the carboxyl-terminal tail in receptor trafficking. J. Biol. Chem. 272:1038-1045, 1997.

Donald, L. J.; Wang, H. S.; Hamerton, J. L.: Assignment of the gene for cystathionase (CYS) to human chromosome 16. (Abstract) Cytogenet. Cell Genet. 32:268 only, 1982.

Frimpter, G. W.: Cystathioninuria: nature of the defect. Science 149:1095-1096, 1965.

Frimpter, G. W.: Cystathioninuria, sulfite oxidase deficiency, and 'beta-mercaptolactate-cysteine disulfiduria. In: Stanbury, J. B.; Wyngaarden, J. B.; Fredrickson, D. S.: The Metabolic Basis of Inherited Disease. New York: McGraw-Hill (pub.) (3rd ed.):1972. Pp. 413-425.

Frimpter, G. W.; Haymovitz, A.; Horwith, M.: Cystathioninuria. New Eng. J. Med. 268:333-339, 1963.

Harris, H.; Penrose, L. S.; Thomas, D. H. H.: Cystathioninuria. Ann. Hum. Genet. 23:442-453, 1959.

Lu, Y.; O'Dowd, B. F.; Orrego, H.; Israel, Y.: Cloning and Nucleotide sequence of human liver cDNA encoding for cystathionine gamma-lyase. Biochem. Biophys. Res. Commun. 189:749-758, 1992.

Lyon, I. C. T.; Procopis, P. G.; Turner, B.: Cystathioninuria in a well baby population. Acta Paediat. Scand. 60:324-328, 1971.

Mongeau, J.-G.; Hilgartner, M.; Worthen, H. G.; Frimpter, G. W.: Cystathioninuria: study of an infant with normal mentality, thrombocytopenia, and renal calculi. J. Pediat. 69:1113-1120, 1967.

Pascal, T. A.; Gaull, G. E.; Beratis, N. G.; Gillam, B. M.; Tallan, H. H.: Cystathionase deficiency: evidence for genetic heterogeneity in primary cystathioninuria. Pediat. Res. 12:125-133, 1978.

Perry, T. L.; Hardwick, D. F.; Hansen, S.; Love, D. L.; Israels, S.: Cystathioninuria in two healthy siblings. New Eng. J. Med. 278:590-592, 1968.

Schneiderman, L. J.: Latent cystathioninuria. J. Med. Genet. 4:260-263, 1967.

Scott, C. R.; Dassell, S. W.; Clark, S. H.; Chiang-Teng, C.; Swedberg, K. R.: Cystathioninemia: a benign genetic condition. J. Pediat. 76:571-577, 1970.

Shaw, K. N. F.; Lieberman, E.; Koch, R.; Donnell, G. N.: Cystathioninuria. Am. J. Dis. Child. 113:119-128, 1967.

Tada, K.; Yoshida, T.; Yokoyama, Y.; Sato, T.; Nakagawa, H.; Arakawa, T.: Cystathioninuria not associated with vitamin B6 dependency: a probably new type of cystathioninuria. Tohoku J. Exp. Med. 95:235-242,1968.

Whelan, D. T.; Scriver, C. R.: Cystathioninuria and renal iminoglycinuriain a pedigree: a perspective on counseling. New Eng. J. Med. 278:924-927, 1968.

Joenje, H.: Fanconi anaemia complementation groups in Germany and The Netherlands. Hum. Genet. 97:280-282, 1996.

Joenje, H.; Oostra, A. B.; Wijker, M.; di Summa, F. M.; van Berkel, C. G. M.; Rooimans, M. A.; Ebell, W.; van Weel, M.; Pronk, J. C.; Buchwald, M.; Arwert, F.: Evidence for at least eight Fanconi anemia genes. Am. J. Hum. Genet. 61:940-944, 1997.

Rassool, F. V.; Le Beau, M. M.; Shen, M.-L.; Neilly, M. E.; Espinosa, R., III; Ong, S. T.; Boldog, F.; Drabkin, H.; McCarroll, R.; McKeithan, T. W.: Direct cloning of DNA sequences from the common fragile site region at chromosome band 3p14.2. Genomics 35:109-117, 1996.

Rudduck, C.; Franzen, G.: A new heritable fragile site on human chromosome 3. Hereditas 98:297-299, 1983.

Shi, Y.; Zou, M.; Farid, N. R.; Paterson, M. C.: Association of FHIT (fragile histidine triad), a candidate tumour suppressor gene, with the ubiquitin-conjugating enzyme hUBC9. Biochem. J. 352:443-448,2000.

Shiraishi, T.; Druck, T.; Mimori, K.; Flomenberg, J.; Berk, L.; Alder, H.; Miller, W.; Huebner, K.; Croce, C. M.: Sequence conservation at human and mouse orthologous common fragile regions, FRA3B/FHIT and Fra14A2/Fhit. Proc. Nat. Acad. Sci. 98:5722-5727, 2001.

Sozzi, G.; Veronese, M. L.; Negrini, M.; Baffa, R.; Cotticelli, M. G.; Inoue, H.; Tornielli, S.; Pilotti, S.; De Gregorio, L.; Pastorino, U.; Pierotti, M. A.; Ohta, M.; Huebner, K.; Croce, C. M.: The FHIT gene at 3p14.2 is abnormal in lung cancer. Cell 85:17-26, 1996.

Stein, C. K.; Glover, T. W.; Palmer, J. L.; Glisson, B. S.: Direct correlation between FRA3B expression and cigarette smoking. Genes Chromosomes Cancer 34:333-340, 2002.

Virgilio, L.; Shuster, M.; Gollin, S. M.; Veronese, M. L.; Ohta, M.; Huebner, K.; Croce, C. M.: FHIT gene alterations in head and neck squamous cell carcinomas. Proc. Nat. Acad. Sci. 93:9770-9775,1996.

Wegner, R.-D.: A new inducible fragile site on chromosome 3 (p14.2) in human lymphocytes. Hum. Genet. 63:297-298, 1983.

Wegner, R.-D.: Reply to the letter of A. Markkanen, S. Knuutila, and A. de la Chapelle. (Letter) Hum. Genet. 65:218 only, 1983.

Zanesi, N.; Fidanza, V.; Fong, L. Y.; Mancini, R.; Druck, T.; Valtieri, M.; Rudiger, T.; McCue, P. A.; Croce, C. M.; Huebner, K.: The tumor spectrum in FHIT-deficient mice. Proc. Nat. Acad. Sci. 98:10250-10255, 2001.

Nagase, T.; Seki, N.; Ishikawa, K.; Ohira, M.; Kawarabayasi, Y.; Ohara, O.; Tanaka, A.; Kotani, H.; Miyajima, N.; Nomura, N.: Prediction of the coding sequences of unidentified human genes. VI. The coding sequences of 80 new genes (KIAA0201-KIAA0280) deduced by analysis of cDNA clones from cell line KG-1 and brain. DNA Res. 3:321-329, 1996.

Ishizuka, T.; Ahmad, I.; Kita, K.; Sonoda, T.; Ishijima, S.; Sawa, K.; Suzuki, N.; Tatibana, M.: The human phosphoribosyl pyrophosphate synthetase-associated protein 39 gene (PRPSAP1) is located in the chromosome region 17q24-q25. Genomics 33:332-334, 1996.

Ishizuka, T.; Kita, K.; Sonoda, T.; Ishijima, S.; Sawa, K.; Suzuki, N.; Tatibana, M.: Cloning and sequencing of human complementary DNA for the phosphoribosyl pyrophosphate synthetase-associated protein 39. Biochim. Biophys. Acta 1306:27-30, 1996.

Kita, K.; Ishijima, T.; Ishijima, S.; Sonoda, T.; Tatibana, M.: A novel 39-kDa phosphoribosyl pyrophosphate synthetase-associated protein of rat liver: cloning, high sequence similarity to the catalytic subunits, and a negative regulatory role. J. Biol. Chem. 269:8334-8340,1994.

Endo, Y.; Sato, Y.; Matsushita, M.; Fujita, T.: Cloning and characterization of the human lectin P35 gene and its related gene. Genomics 36:515-521, 1996.

Wayne, S.; Robertson, N. G.; DeClau, F.; Chen, N.; Verhoeven, K.; Prasad, S.; Tranebjarg, L.; Morton, C. C.; Ryan, A. F.; Van Camp, G.; Smith, R. J. H.: Mutations in the transcriptional activator EYA4 cause late-onset deafness at the DFNA10 locus. Hum. Molec. Genet. 10:195-200, 2001.

Kanai, Y.; Miura, K.; Uehara, T.; Amagai, M.; Takeda, O.; Tanuma, S.; Kurosawa, Y.: Natural occurrence of Nuc in the sera of autoimmune-prone MRL/lpr mice. Biochem. Biophys. Res. Commun. 196:729-736, 1993.

Miura, K.; Hirai, M.; Kanai, Y.; Kurosawa, Y.: Organization of the human gene for nucleobindin (NUC) and its chromosomal assignment to 19q13.2-q13.4. Genomics 34:181-186, 1996.

Miura, K.; Titani, K.; Kurosawa, Y.; Kanai, Y.: Molecular cloning of nucleobindin, a novel DNA-binding protein that contains both a signal peptide and a leucine zipper structure. Biochem. Biophys. Res. Commun. 187:375-380, 1992.

Connelly, M. A.; Grady, R. C.; Mushinski, J. F.; Marcu, K. B.:PANG, a gene encoding a neuronal glycoprotein, is ectopically activated by intracisternal A-type particle long terminal repeats in murine plasmacytomas. Proc. Nat. Acad. Sci. 91:1337-1341, 1994.

Mock, B. A.; Connelly, M. A.; McBride, O. W.; Kozak, C. A.; Marcu, K. B.: Plasmacytoma-associated neuronal glycoprotein, Pang, maps to mouse chromosome 6 and human chromosome 3. Genomics 34:226-228,1996.

Ando, A.; Kikuti, Y. Y.; Shigenari, A.; Kawata, H.; Okamoto, N.; Shiina, T.; Chen, L.; Ikemura, T.; Abe, K.; Kimura, M.; Inoko, H.: cDNA cloning of the human homologues of the mouse Ke4 and Ke6 genes at the centromeric end of the human MHC region. Genomics 35:600-602,1996.

Aziz, N.; Maxwell, M. M.; Brenner, B. M.: Coordinate regulation of 11-beta-HSD and Ke6 gene in cpk mouse: implications for steroid metabolic defect in PKD. Am. J. Physiol. 267: F791-F797, 1994.

Aziz, N.; Maxwell, M. M.; St.-Jacques, B.; Brenner, B. M.: down regulation of Ke 6, a novel gene encoded within the major histocompatibility complex, in murine polycystic kidney disease. Molec. Cell. Biol. 13:1847-1853, 1993.

Kikuti, Y. Y.; Tamiya, G.; Ando, A.; Chen, L.; Kimura, M.; Ferreira, E.; Tsuji, K.; Trowsdale, J.; Inoko, H.: Physical mapping 220 kb centromeric of the human MHC and DNA sequence analysis of the 43-kb segment including the RING1, HKE6, and HKE4 genes. Genomics 42:422-435, 1997.

Cheung, A. H.; Stewart, R. J.; Marsden, P. A.: Endothelial Tie2/Tekligands angiopoietin-1 (ANGPT1) and angiopoietin-2 (ANGPT2): regional localization of the human genes to 8q22.3-q23 and 8p23. Genomics 48:389-391, 1998.

Davis, S.; Aldrich, T. H.; Jones, P. F.; Acheson, A.; Compton, D. L.; Jain, V.; Ryan, T. E.; Bruno, J.; Radziejewski, C.; Maisonpierre, P. C.; Yancopoulos, G. D.: Isolation of angiopoietin-1, a ligand for the TIE2 receptor, by secretion-trap expression cloning. Cell 87:1161-1169, 1996.

Folkman, J.; d'Amore, P. A.: Blood vessel formation: what is its molecular basis? Cell 87:1153-1155, 1996.

Marziliano, N.; Crovella, S.; Audero, E.; Pecile, V.; Bussolino, F.; Amoroso, A.; Garagna, S.: Genetic mapping of the mouse homologue of the human angiopoietin-1 gene (Agpt) to mouse chromosome 9E2 by in situ hybridization. Cytogenet. Cell Genet. 87:199-200, 1999.

Sato, T. N.; Tozawa, Y.; Deutsch, U.; Wolburg-Buchholz, K.; Fujiwara, Y.; Gendron-Maguire, M.; Gridley, T.; Wolburg, H.; Risau, W.; Qin, Y.: Distinct roles of the receptor tyrosine kinases Tie-1 and Tie-2in blood vessel formation. Nature 376:70-73, 1995.

Suri, C.; Jones, P. F.; Patan, S.; Bartunkova, S.; Maisonpierre, P. C.; Davis, S.; Sato, T. N.; Yancopoulos, G. D.: Requisite role of angiopoietin-1, a ligand for the TIE2 receptor, during embryonic angiogenesis. Cell 87:1171-1180, 1996.

Suri, C.; McClain, J.; Thurston, G.; McDonald, D. M.; Zhou, H.; Oldmixon, E. H.; Sato, T. N.; Yancopoulos, G. D.: Increased vascularization in mice overexpressing angiopoietin-1. Science 282:468-471, 1998.

Valenzuela, D. M.; Griffiths, J. A.; Rojas, J.; Aldrich, T. H.; Jones, P. F.; Zhou, H.; McClain, J.; Copeland, N. G.; Gilbert, D. J.; Jenkins, N. A.; Huang, T.; Papadopoulos, N.; Maisonpierre, P. C.; Davis, S.; Yancopoulos, G. D.: Angiopoietins 3 and 4: diverging gene counterparts in mice and humans. Proc. Nat. Acad. Sci. 96:1904-1909, 1999.

Chestkov, A. V.; Baka, I. D.; Kost, M. V.; Georgiev, G. P.; Buchman, V. L.: The d4 gene family in the human genome. Genomics 36:174-177,1996.

Gabig, T. G.; Crean, C. D.; Klenk, A.; Long, H.; Copeland, N. G.; Gilbert, D. J.; Jenkins, N. A.; Quincey, D.; Parente, F.; Lespinasse, F.; Carle, G. F.; Gaudray, P.; and 13 others: Expression and chromosomal localization of the Requiem gene. Mammalian Genome 9:660-665, 1998.

Gabig, T. G.; Mantel, P. L.; Rosli, R.; Crean, C. D.: Requiem: a novel zinc finger gene essential for apoptosis in myeloid cells. J. Biol. Chem. 269:29515-29519, 1994.

Smith, J. E., Jr.; Bollekens, J. A.; Inghirami, G.; Takeshita, K.: Cloning and mapping of the MEIS1 gene, the human homolog of a murine leukemogenic gene. Genomics 43:99-103, 1997.

Nakanishi-Matsui, M.; Zheng, Y.-W.; Sulciner, D. J.; Weiss, E. J.; Ludeman, M. J.; Coughlin, S. R.: PAR3 is a cofactor for PAR4 activation by thrombin. Nature 404:609-613, 2000.

Sambrano, G. R.; Weiss, E. J.; Zheng, Y.-W.; Huang, W.; Coughlin, S. R.: Role of thrombin signalling in platelets in haemostasis and thrombosis. Nature 413:74-78, 2001.

Paulweber, B.; Wiebusch, H.; Miesenboeck, G.; Funke, H.; Assmann, G.; Hoelzl, B.; Sippl, M. J.; Friedl, W.; Patsch, J. R.; Sandhofer, F.: Molecular basis of lipoprotein lipase deficiency in two Austrian families with type I hyperlipoproteinemia. Atherosclerosis 86:239-250,1991.

Giralt, M.; Park, E. A.; Gurney, A. L.; Liu, J.; Hakimi, P.; Hanson, R. W.: Identification of a thyroid hormone response element in the phosphoenolpyruvate carboxykinase (GTP) gene: evidence for synergistic interaction between thyroid hormone and cAMP cis-regulatory elements. J. Biol. Chem. 266:21991-21996, 1991.

Pilz, A. J.; Willer, E.; Povey, S.; Abbott, C. M.: The genes coding for phosphoenolpyruvate carboxykinase-1 (PCK1) and neuronal nicotinic acetylcholine receptor alpha-4 subunit (CHRNA4) map to human chromosome 20, extending the known region of homology with mouse chromosome 2. Ann. Hum. Genet. 56:289-293, 1992.

Stoffel, M.; Xiang, K.; Espinosa, R., III; Cox, N. J.; Le Beau, M. M.; Bell, G. I.: cDNA sequence and localization of polymorphic human cytosolic phosphoenolpyruvate carboxykinase gene (PCK1) to chromosome 20, band q13.31: PCK1 is not tightly linked to maturity-onset diabetes of the young. Hum. Molec. Genet. 2:1-4, 1993.

Ting, C.-N.; Burgess, D. L.; Chamberlain, J. S.; Keith, T. P.; Falls, K.; Meisler, M. H.: Phosphoenolpyruvate carboxykinase (GTP): characterization of the human PCK1 gene and localization distal to MODY on chromosome 20. Genomics 16:698-706, 1993.

Olswang, Y.; Cohen, H.; Papo, O.; Cassuto, H.; Croniger, C. M.; Hakimi, P.; Tilghman, S. M.; Hanson, R. W.; Reshef, L.: A mutation in the peroxisome proliferator-activated receptor gamma-binding site in the gene for the cytosolic form of phosphoenolpyruvate carboxykinase reduces adipose tissue size and fat content in mice. Proc. Nat. Acad. Sci. 99:625-630, 2002.

Vidnes, J.; Sovik, O.: Gluconeogenesis in infancy and childhood. III. Deficiency of the extra mitochondrial form of hepatic phosphoenolpyruvate carboxykinase in a case of persistent neonatal hypoglycaemia. Acta Paediat. Scand. 65:301-312, 1976.

Yu, H.; Thun, R.; Chandrasekharappa, S.; Trent, J. M.; Zhang, J.; Meisler, M. H.: Human PCK1 encoding phosphoenolpyruvate carboxykinase is located on chromosome 20q13.2. Genomics 15:219-221, 1993.

Pepe, G.; Chimienti, G.; Resta, F.; Di Perna, V.; Tarricone, C.; Lovecchio, M.; Colacicco, A. M.; Capurso, A.: A new Italian case of lipoprotein lipase deficiency: a leu365-to-val change resulting in loss of enzyme activity. Biochem. Biophys. Res. Commun. 199:570-576, 1994.

Reymer, P. W. A.; Groenemeyer, B. E.; Gagne, E.; Miao, L.; Appelman, E. E. G.; Seidel, J. C.; Kromhout, D.; Bijvoet, S. M.; van de Oever, K.; Bruin, T.; Hayden, M. R.; Kastelein, J. J. P.: A frequently occurring mutation in the lipoprotein lipase gene (Asn291Ser) contributes to the expression of familial combined hyperlipidemia. Hum. Molec. Genet. 4:1543-1549, 1995.

Samuels, M. E.; Forbey, K. C.; Reid, J. E.; Abkevich, V.; Bulka, K.; Wardell, B. R.; Bowen, B. R.; Hopkins, P. N.; Hunt, S. C.; Ballinger, D. G.; Skolnick, M. H.; Wagner, S.: Identification of a common variant in the lipoprotein lipase gene in a large Utah kindred ascertained for coronary heart disease: the -93G/D9N variant predisposes to low HDL-C/high triglycerides. Clin. Genet. 59:88-98, 2001.

Schreibman, P. H.; Arons, D. L.; Saudek, C. D.; Arky, R. A.: Abnormal lipoprotein lipase in familial exogenous hypertriglyceridemia. J. Clin. Invest. 52:2074-2082, 1973.

Sprecher, D. L.; Kobayashi, J.; Rymaszewski, M.; Goldberg, I. J.; Harris, B. V.; Bellet, P. S.; Ameis, D.; Yunker, R. L.; Black, D. M.; Stein, E. A.; Schotz, M. C.; Wiginton, D. A.: Trp64-to-nonsense mutation in the lipoprotein lipase gene. J. Lipid Res. 33:859-866,1992.

Sternowsky, H. J.; Gaertner, U.; Stahnkel, N.; Kaukel, E.: Juvenile familial hypertriglyceridemia and growth retardation: clinical and biochemical observations in three siblings. Europ. J. Pediat. 125:59-70, 1977.

Takagi, A.; Ikeda, Y.; Tsutsumi, Z.; Shoji, T.; Yamamoto, A.: Molecular studies on primary lipoprotein lipase (LPL) deficiency: one base deletion (G-916) in exon 5 of LPL gene causes no detectable LPL protein due to the absence of LPL mRNA transcript. J. Clin. Invest. 89:581-591, 1992.

Weinstock, P. H.; Bisgaier, C. L.; Aalto-Setala, K.; Radner, H.; Ramakrishnan, R.; Levak-Frank, S.; Essenburg, A. D.; Zechner, R.; Breslow, J. L.: Severe hypertriglyceridemia, reduced high density lipoprotein, and neonatal death in lipoprotein lipase knockout mice: mild hypertriglyceridemia with impaired very low density lipoprotein clearance in heterozygotes. J. Clin. Invest. 96:2555-2568, 1995.

Wessler, S.; Avioli, L. A.: Familial hyperlipoproteinemia. J. A. M. A. 207:929-937, 1969.

Wilson, D. E.; Edwards, C. Q.; Chan, I.-F.: Phenotypic heterogeneity in the extended pedigree of a proband with lipoprotein lipase deficiency. Metabolism 32:1107-1114, 1983.

Wilson, D. E.; Emi, M.; Iverius, P.-H.; Hata, A.; Wu, L. L.; Hillas, E.; Williams, R. R.; Lalouel, J.-M.: Phenotypic expression of heterozygous lipoprotein lipase deficiency in the extended pedigree of a proband homozygous for a missense mutation. J. Clin. Invest. 86:735-750,1990.

Wilson, D. E.; Hata, A.; Kwong, L. K.; Lingam, A.; Shuhua, J.; Ridinger, D. N.; Yeager, C.; Kaltenborn, K. C.; Iverius, P.-H.; Lalouel, J.-M.: Mutations in exon 3 of the lipoprotein lipase gene segregating in a family with hypertriglyceridemia, pancreatitis, and non-insulin-dependent diabetes. J. Clin. Invest. 92:203-211, 1993.

Wion, K. L.; Kirchgessner, T. G.; Lusis, A. J.; Schotz, M. C.; Lawn, R. M.: Human lipoprotein lipase complementary DNA sequence. Science 235:1638-1641, 1987.

Wittrup, H. H.; Tybjaerg-Hansen, A.; Abildgaard, S.; Steffensen, R.; Schnohr, P.; Nordestgaard, B. G.: A common substitution (asn291ser) in lipoprotein lipase is associated with increased risk of ischemic heart disease. J. Clin. Invest. 99:1606-1613, 1997.

Wittrup, H. H.; Tybjaerg-Hansen, A.; Steffensen, R.; Deeb, S. S.; Brunzell, J. D.; Jensen, G.; Nordestgaard, B. G.: Mutations in the lipoprotein lipase gene associated with ischemic heart disease in men: the Copenhagen City Heart Study. Arterioscler. Thromb. Vasc. Biol. 19:1535-1540, 1999.

Wood, S.; Schertzer, M.; Hayden, M.; Ma, Y.: Support for founder effect for two lipoprotein lipase (LPL) gene mutations in French Canadians by analysis of GT microsatellites flanking the LPL gene. Hum. Genet. 91:312-316, 1993.

Pace, P.; Johnson, M.; Tan, W. M.; Mosedale, G.; Sng, C.; Hoatlin, M.; de Winter, J.; Joenje, H.; Gergely, F.; Patel, K. J.: FANCE: the link between Fanconi anaemia complex assembly and activity. EMBO J. 21:3414-3423, 2002.

Hodge, S. E.; Anderson, C. E.; Neiswanger, K.; Field, L. L.; Spence, M. A.; Sparkes, R. S.; Sparkes, M. C.; Crist, M.; Terasaki, P. I.; Rimoin, D. L.; Rotter, J. I.: Close genetic linkage between diabetes mellitus and Kidd blood group. Lancet II:893-895, 1981.

Touchman, J. W.; Anikster, Y.; Dietrich, N. L.; Braden Maduro, V. V.; McDowell, G.; Shotelersuk, V.; Bouffard, G. G.; Beckstrom-Sternberg, S. M.; Gahl, W. A.; Green, E. D.: The genomic region encompassing the nephropathic cystinosis gene (CTNS): complete sequencing of a200-kb segment and discovery of a novel gene within the common cystinosis-causing deletion. Genome Res. 10:165-173, 2000.

Shapiro, M. B.; Senapathy, P.: RNA splice junctions of different classes of eukaryotes: sequence statistics and functional implications in gene expression. Nucleic Acids Res. 15:7155-7174, 1987.

Bamforth, J. S.; Hughes, I. A.; Lazarus, J. H.; Weaver, C. M.; Harper, P. S.: Congenital hypothyroidism, spiky hair, and cleft palate. J. Med. Genet. 26:49-60, 1989.

Jobard, F.; Lefevre, C.; Karaduman, A.; Blanchet-Bardon, C.; Emre, S.; Weissenbach, J.; Ozguc, M.; Lathrop, M.; Prud'homme, J.-F.; Fischer, J.: Lipoxygenase-3 (ALOXE3) and 12(R)-lipoxygenase (ALOX12B) are mutated in non-bullous congenital ichthyosiform erythroderma (NCIE) linked to chromosome 17p13.1. Hum. Molec. Genet. 11:107-113, 2002.

Varon, R.; Vissinga, C.; Platzer, M.; Cerosaletti, K. M.; Chrzanowska, K. H.; Saar, K.; Beckmann, G.; Seemanova, E.; Cooper, P. R.; Nowak, N. J.; Stumm, M.; Weemaes, C. M. R.; Gatti, R. A.; Wilson, R. K.; Digweed, M.; Rosenthal, A.; Sperling, K.; Concannon, P.; Reis, A.: Nibrin, a novel DNA double-strand break repair protein, is mutated in Nijmegen breakage syndrome. Cell 93:467-476, 1998.

ten Hove, T.; Corbaz, A.; Amitai, H.; Aloni, S.; Belzer, I.; Graber, P.; Drillenburg, P.; van Deventer, S. J.; Chvatchko, Y.; Te Velde, A. A.: Blockade of endogenous IL-18 ameliorates TNBS-induced colitis by decreasing local TNF-alpha production in mice. Gastroenterology 121:1372-1379, 2001.

Ishikawa, K.; Nagase, T.; Suyama, M.; Miyajima, N.; Tanaka, A.; Kotani, H.; Nomura, N.; Ohara, O.: Prediction of the coding sequences of unidentified human genes. X. The complete sequences of 100 new cDNA clones from brain which can code for large proteins in vitro. DNA Res. 5:169-176, 1998.

Kipreos, E. T.; Lander, L. E.; Wing, J. P.; He, W. W.; Hedgecock, E. M.: cul-1 is required for cell cycle exit in C. elegans and identifies a novel gene family. Cell 85:829-839, 1996.

Rasooly, R. S.: Personal Communication. Baltimore, Md. Sep. 29, 1998.

Wang, P. J.; McCarrey, J. R.; Yang, F.; Page, D. C.: An abundance of X-linked genes expressed in spermatogonia. Nature Genet. 27:422-426, 2001.

Herold, A.; Suyama, M.; Rodrigues, J. P.; Braun, I. C.; Kutay, U.; Carmo-Fonseca, M.; Bork, P.; Izaurralde, E.: TAP (NXF1) belongs to a multigene family of putative RNA export factors with a conserved modular architecture. Molec. Cell. Biol. 20:8996-9008, 2000.

Ikeda, M.; Ishida, O.; Hinoi, T.; Kishida, S.; Kikuchi, A.: Identification and characterization of a novel protein interacting with Ral-binding protein 1, a putative effector protein of Ral. J. Biol. Chem. 273:814-821, 1998.

Koshiba, S.; Kigawa, T.; Iwahara, J.; Kikuchi, A.; Yokoyama, S.: Solution structure of the Eps15 homology domain of a human POB1(partner of RalBP1). FEBS Lett. 442:138-142, 1999.

Crackower, M. A.; Sarao, R.; Oudit, G. Y.; Yagil, C.; Kozieradzki, I.; Scanga, S. E.; Oliveira-dos-Santos, A. J.; da Costa, J.; Zhang, L.; Pei, Y.; Scholey, J.; Ferrario, C. M.; Manoukian, A. S.; Chappell, M. C.; Backx, P. H.; Yagil, Y.; Penninger, J. M.: Angiotensin-converting enzyme 2 is an essential regulator of heart function. Nature 417:822-828, 2002.

Scanlan, M. J.; Gordan, J. D.; Williamson, B.; Stockert, E.; Bander, N. H.; Jongeneel, V.; Gure, A. O.; Jager, D.; Jager, E.; Knuth, A.; Chen, Y.-T.; Old, L. J.: Antigens recognized by autologous antibody in patients with renal-cell carcinoma. Int. J. Cancer 83:456-464,1999.

Yan, Z.; Fedorov, S. A.; Mumby, M. C.; Williams, R. S.: PR48, a novel regulatory subunit of protein phosphatase 2A, interacts with Cdc6 and modulates DNA replication in human cells. Molec. Cell. Biol. 20:1021-1029, 2000.

Camacho, J. A.; Obie, C.; Biery, B.; Goodman, B. K.; Hu, C.-A.; Almashanu, S.; Steel, G.; Casey, R.; Lambert, M.; Mitchell, G. A.; Valle, D.: Hyperornithinaemia-hyperammonaemia-homocitrullinuria syndrome is caused by mutations in a gene encoding a mitochondrial ornithine transporter. Nature Genet. 22:151-158, 1999.

Darnell, J. E., Jr.: Reflections on STAT3, STAT5, and STAT6 asfat STATs. Proc. Nat. Acad. Sci. 93:6221-6224, 1996.

Ghilardi, N.; Ziegler, S.; Wiestner, A.; Stoffel, R.; Heim, M. H.; Skoda, R. C.: Defective STAT signaling by the leptin receptor in diabetic mice. Proc. Nat. Acad. Sci. 93:6231-6235, 1996.

Vaisse, C.; Halaas, J. L.; Horvath, C. M.; Darnell, J. E., Jr.; Stoffel, M.; Friedman, J. M.: Leptin activation of Stat3 in the hypothalamus of wild type and ob/ob mice but not in db/db mice. Nature Genet. 14:95-100, 1996.

Mohandas, T. K.; Chen, X.-N.; Rowe, L. B.; Birkenmeier, E. H.; Fanning, A. S.; Anderson, J. M.; Korenberg, J. R.: Localization of the tight junction protein gene TJP1 to human chromosome 15q13, distal to the Prader-Willi/Angelman region, and to mouse chromosome 7. Genomics 30:594-597, 1995.

Willott, E.; Balda, M. S.; Fanning, A. S.; Jameson, B.; Van Itallie, C.; Anderson, J. M.: The tight junction protein ZO-1 is homologous to the Drosophila discs-large tumor suppressor protein of septate junctions. Proc. Nat. Acad. Sci. 90:7834-7838, 1993.

Clevidence, D. E.; Overdier, D. G.; Peterson, R. S.; Porcella, A.; Ye, H.; Paulson, K. E.; Costa, R. H.: Members of the HNF-3/forkhead family of transcription factors exhibit distinct cellular expression patterns in lung and regulate the surfactant protein B promoter. Dev. Biol. 166:195-209, 1994.

Hellqvist, M.; Mahlapuu, M.; Blixt, A.; Enerback, S.; Carlsson, P.: The human forkhead protein FREAC-2 contains two functionally redundant activation domains and interacts with TBP and TFIIB. J. Biol. Chem. 273:23335-23343, 1998.

Hellqvist, M.; Mahlapuu, M.; Samuelsson, L.; Enerback, S.; Carlsson, P.: Differential activation of lung-specific genes by two forkhead proteins, FREAC-1 and FREAC-2. J. Biol. Chem. 271:4482-4490, 1996.

Larsson, C.; Hellqvist, M.; Pierrou, S.; White, I.; Enerback, S.; Carlsson, P.: Chromosomal localization of six human forkhead genes, freac-1 (FKHL5), -3 (FKHL7), -4 (FKHL8), -5 (FKHL9), -6 (FKHL10), and -8 (FKHL12). Genomics 30:464-469, 1995.

Pierrou, S.; Hellqvist, M.; Samuelsson, L.; Enerback, S.; Carlsson, P.: Cloning and characterization of seven human forkhead proteins: binding site specificity and DNA bending. EMBO J. 13:5002-5012,1994.

Ernstsson, S.; Pierrou, S.; Hulander, M.; Cederberg, A.; Hellqvist, M.; Carlsson, P.; Enerback, S.: Characterization of the human forkhead gene FREAC-4. J. Biol. Chem. 271: 21094-21099, 1996.

Hulander, M.; Wurst, W.; Carlsson, P.; Enerback, S.: The winged helix transcription factor Fkh10 is required for normal development of the inner ear. Nature Genet. 20:374-376, 1998.

Dong, C.; Yang, D. D.; Tournier, C.; Whitmarsh, A. J.; Xu, J.; Davis, R. J.; Flavell, R. A.: JNK is required for effector T-cell function but not for T-cell activation. Nature 405:91-94, 2000.

Gupta, S.; Barrett, T.; Whitmarsh, A. J.; Cavanagh, J.; Sluss, H. K.; Derijard, B.; Davis, R. J.: Selective interaction of JNK protein kinase isoforms with transcription factors. EMBO J. 15:2760-2770,1996.

Tournier, C.; Hess, P.; Yang, D. D.; Xu, J.; Turner, T. K.; Nimnual, A.; Bar-Sagi, D.; Jones, S. N.; Flavell, R. A.; Davis, R. J.: Requirement of JNK for stress-induced activation of the cytochrome c-mediated death pathway. Science 288:870-874, 2000.

Daugherty, B. L.; Springer, M. S.: The beta-chemokine receptor genes CCR1 (CMKBR1), CCR2 (CMKBR2), and CCR3 (CMKBR3) cluster within285 kb on human chromosome 3p21. Genomics 41:294-295, 1997.

Ayyanathan, K.; Naylor, S. L.; Kunapuli, S. P.: Structural characterization and fine chromosomal mapping of the human P2Y(1) purinergic receptor gene (P2RY1). Somat. Cell Molec. Genet. 22:419-424, 1996.

Ayyanathan, K.; Webbs, T. E.; Sandhu, A. K.; Athwal, R. S.; Barnard, E. A.; Kunapuli, S. P.: Cloning and chromosomal localization of the human P2Y1 purinoceptor. Biochem. Biophys. Res. Commun. 218:783-788,1996.

Leon, C.; Hechler, B.; Freund, M.; Eckly, A.; Vial, C.; Ohlmann, P.; Dierich, A.; LeMeur, M.; Cazenave, J.-P.; Gachet, C.: Defective platelet aggregation and increased resistance to thrombosis in purinergic P2Y1 receptor-null mice. J. Clin. Invest. 104:1731-1737, 1999.

Leon, C.; Hechler, B.; Vial, C.; Leray, C.; Cazenave, J.-P.; Gachet, C.: The P2Y(1) receptor is an ADP receptor antagonized by ATP and expressed in platelets and mega karyoblastic cells. FEBS Letts. 403:26-30, 1997.

Leon, C.; Vial, C.; Cazenave, J.-P.; Gachet, C.: Cloning and sequencing of a human cDNA encoding endothelial P2Y1 purinoceptor. Gene 171:295-297, 1996.

Matsuda, C.; Hayashi, Y. K.; Ogawa, M.; Aoki, M.; Murayama, K.; Nishino, I.; Nonaka, I.; Arahata, K.; Brown, R. H., Jr.: The sarcolemmal proteins dysferlin and caveolin-3 interact in skeletal muscle. Hum. Molec. Genet. 10:1761-1766, 2001.

Furlong, R. A.; Zhou, C. Y.; Ferguson-Smith, M. A.; Affara, N. A.: Characterization of a kinesin-related gene ATSV, within the tuberous sclerosis locus (TSC1) candidate region on chromosome 9q34. Genomics 33:421-429, 1996.

Keller, M. P.; Seifried, B. A.; Rabin, B. A.; Chance, P. F.: mapping of the kinesin-related gene ATSV to chromosome 2q37. Hum. Genet. 104:254-256, 1999.

Kikkawa, M.; Okada, Y.; Hirokawa, N.:15-angstrom resolution model of the monomeric kinesin motor, KIF1A. Cell 100:241-252, 2000.

Kikkawa, M.; Sablin, E. P.; Okada, Y.; Yajima, H.; Fletterick, R. J.; Hirokawa, N.: Switch-based mechanism of kinesin motors. Nature 411:439-445, 2001.

Klopfenstein, D. R.; Tomishige, M.; Stuurman, N.; Vale, R. D.:Role of phosphatidyl inositol (4,5) bisphosphate organization in membrane transport by the Unc104 kinesin motor. Cell 109:347-358, 2002.

Okada, Y.; Yamazaki, H.; Sekine-Aizawa, Y.; Hirokawa, N.: The neuron-specific kinesin superfamily protein KIF1A is a unique monomeric motor for anterograde axonal transport of synaptic vesicle precursors. Cell 81:769-780, 1995.

Yonekawa, Y.; Harada, A.; Okada, Y.; Funakoshi, T.; Kanai, Y.; Takei, Y.; Terada, S.; Noda, T.; Hirokawa, N.: Defect in synaptic vesicle precursor transport and neuronal cell death in KIF1A motor protein-deficient mice. J. Cell Biol. 141:431-441, 1998.

Chiang, P.-W.; Wang, S.; Smithivas, P.; Song, W.-J.; Ramamoorthy, S.; Hillman, J.; Puett, S.; Van Keuren, M. L.; Crombez, E.; Kumar, A.; Glover, T. W.; Miller, D. E.; Tsai, C.-H.; Blackburn, C. C.; Chen, X.-N.; Sun, Z.; Cheng, J.-F.; Korenberg, J. R.; Kurnit, D. M.: Identification and analysis of the human and murine putative chromatin structure regulator SUPT6H and Supt6h. Genomics 34:328-333, 1996.

Segre, J. A.; Nemhauser, J. L.; Taylor, B. A.; Nadeau, J. H.; Lander, E. S.: Positional cloning of the nude locus: genetic, physical and transcription maps of the region and mutations in the mouse and rat. Genomics 28:549-559, 1995.

Han, J.; Knops, J. F.; Longshore, J. W.; King, P. H.: Localization of human elav-like neuronal protein 1 (Hel-N1) on chromosome 9p21by chromosome microdissection polymerase chain reaction and fluorescence in situ hybridization. Genomics 36:189-191, 1996.

King, P. H.: Hel-N2: a novel isoform of Hel-N1 which is conserved in rat neural tissue and produced in early embryogenesis. Gene 151:261-265, 1994.

King, P. H.; Levine, T. D.; Fremeau, R. T., Jr.; Keene, J. D.:Mammalian homologs of Drosophila ELAV localized to a neuronal subset can bind in vitro to the 3' UTR of mRNA encoding the Id transcriptional repressor. J. Neurosci. 14:1943-52, 1994.

Abel, K. J.; Brody, L. C.; Valdes, J. M.; Erdos, M. R.; McKinley, D. R.; Castilla, L. H.; Merajver, S. D.; Couch, F. J.; Friedman, L. S.; Ostermeyer, E. A.; Lynch, E. D.; King, M.-C.; Welcsh, P. L.; Osborne-Lawrence, S.; Spillman, M.; Bowcock, A. M.; Collins, F. S.; Weber, B. L.: characterization of EZH1, a human homolog of Drosophila enhancer of zeste near BRCA1. Genomics 37:161-171, 1996.

Akazawa, K.; Yamane, S.; Shiota, H.; Naito, E.: A case of retinoblastoma associated with Rieger's anomaly and 13q deletion. Jpn. J. Ophthal. 25:321-325, 1981.

Stathacopoulos, R. A.; Bateman, J. B.; Sparkes, R. S.; Hepler, R. S.: The Rieger syndrome and a chromosome 13 deletion. J. Pediat. Ophthal. Strabismus 24:198-203, 1987.

Ferbus, D.; Le Chalony, C.; Prosperi, M.-T.; Muleris, M.; Vincent-Salomon, A.; Goubin, G.: Identification, nuclear localization, and binding activities of OZF, a human protein solely composed of zinc finger motifs. Europ. J. Biochem. 236:991-995, 1996.

Le Chalony, C.; Apiou, F.; Pibouin, L.; Dutrillaux, B.; Goubin, G.: Constitutive amplification of a zinc finger protein gene in cattle. DNA Cell Biol. 15:83-88, 1996.

Le Chalony, C.; Prosperi, M.-T.; Haluza, R.; Apiou, F.; Dutrillaux, B.; Goubin, G.: The OZF gene encodes a protein consisting essentially of zinc-finger motifs. J. Molec. Biol. 236:399-404, 1994.

Angrist, M.; Wells, D. E.; Chakravarti, A.; Pandey, A.: Chromosomal localization of the mouse Src-like adapter protein (Slap) gene and its putative human homolog SLA. Genomics 30:623-625, 1995.

Holland, S. J.; Liao, X. C.; Mendenhall, M. K.; Zhou, X.; Pardo, J.; Chu, P.; Spencer, C.; Fu, A.; Sheng, N.; Yu, P.; Pali, E.; Nagin, A.; and 14 others: Functional cloning of Src-like adapter protein-2(SLAP-2), a novel inhibitor of antigen receptor signaling. J. Exp. Med. 194:1263-1276, 2001.

Kratchmarova, I.; Sosinowski, T.; Weiss, A.; Witter, K.; Vincenz, C.; Pandey, A.: Characterization of promoter region and genomic structure of the murine and human genes encoding Src like adapter protein. Gene 262:267-273, 2001.

Meijerink, P. H. S.; Yanakiev, P.; Zorn, I.; Grierson, A. J.; Bikker, H.; Dye, D.; Kalaydjieva, L.; Baas, F.: The gene for the human Src-like adaptor protein (hSLAP) is located within the 64-kb intron of the thyroglobulin gene. Europ. J. Biochem. 254:297-303, 1998.

Sosinowski, T.; Pandey, A.; Dixit, V. M.; Weiss, A.: Src-like adaptor protein (SLAP) is a negative regulator of T cell receptor signaling. J. Exp. Med. 191:463-474, 2000.

Bailey, S. M.; Cornforth, M. N.; Kurimasa, A.; Chen, D. J.; Goodwin, E. H.: Strand-specific post replicative processing of mammalian telomeres. Science 293:2462-2465, 2001.

Hart, T. C.; Price, J. A.; Bobby, P. L.; Pettenati, M. J.; Shashi, V.; Von Kap Herr, C.; Van Dyke, T. E.: Cytogenetic assignment and physical mapping of the human DGKE gene to chromosome 17q22. Genomics 56:233-235, 1999.

Tang, W.; Bunting, M.; Zimmerman, G. A.; McIntyre, T. M.; Prescott, S. M.: Molecular cloning of a novel human diacylglycerol kinase highly selective for arachidonate-containing substrates. J. Biol. Chem. 271:10237-10241, 1996.

Beddow, A. L.; Richards, S. A.; Orem, N. R.; Macara, I. G.: TheRan/TC4 GTPase-binding domain: identification by expression cloning and characterization of a conserved sequence motif. Proc. Nat. Acad. Sci. 92:3328-3332, 1995.

Fauser, S.; Aslanukov, A.; Roepman, R.; Ferreira, P. A.: Genomic organization, expression, and localization of murine Ran-binding protein2 (RanBP2) gene. Mammalian Genome 12:406-415, 2001.

Krebber, H.; Bastians, H.; Hoheisel, J.; Lichter, P.; Ponstingl, H.; Joos, S.: Localization of the gene encoding the Ran-binding protein RanBP2 to human chromosome 2q11-q13 by fluorescence in situ hybridization. Genomics 43:247-248, 1997.

Pichler, A.; Gast, A.; Seeler, J. S.; Dejean, A.; Melchior, F.: The nucleoporin RanBP2 has SUMO1 E3 ligase activity. Cell 108:109-120, 2002.

Wu, J.; Matunis, M. J.; Kraemer, D.; Blobel, G.; Coutavas, E.:Nup358, a cytoplasmically exposed nucleoporin with peptide repeats, Ran-GTP binding sites, zinc fingers, a cyclophilin A homologous domain, and a leucine-rich region. J. Biol. Chem. 270:14209-14213, 1995.

Yokoyama, N.; Hayashi, N.; Seki, T.; Pante, N.; Ohba, T.; Nishii, K.; Kuma, K.; Hayashida, T.; Miyata, T.; Abei, U.; Fukui, M.; Nishimoto, T.: A giant nucleopore protein that binds Ran/TC4. Nature 376:184-188, 1995.

Dhar, S. K.; Yoshida, K.; Machida, Y.; Khaira, P.; Chaudhuri, B.; Wohlschlegel, J. A.; Leffak, M.; Yates, J.; Dutta, A.: Replication from oriP of Epstein-Barr virus requires human ORC and is inhibited by geminin. Cell 106: 287-296, 2001.

Gavin, K. A.; Hidaka, M.; Stillman, B.: Conserved initiator proteins in eukaryotes. Science 270:1667-1671, 1995.

Ohtani, K.; DeGregori, J.; Leone, G.; Herendeen, D. R.; Kelly, T. J.; Nevins, J. R.: Expression of the HsOrc1 gene, a human ORC1homolog, is regulated by cell proliferation via the E2F transcription factor. Molec. Cell. Biol. 16:6977-6984, 1996.

Takahara, K.; Bong, M.; Brevard, R.; Eddy, R. L.; Haley, L. L.; Sait, S. J.; Shows, T. B.; Hoffman, G. G.; Greenspan, D. S.: Mouse and human homologues of the yeast origin of replication recognition complex subunit ORC2 and chromosomal localization of the cognate human gene ORC2L. Genomics 31:119-122, 1996.

Chang, A. C.-M.; Janosi, J.; Hulsbeek, M.; de Jong, D.; Jeffrey, K. J.; Noble, J. R.; Reddel, R. R.: A novel human cDNA highly homologous to the fish hormone stanniocalcin. Molec. Cell. Endocr. 112:241-247,1995.

Chang, A. C.-M.; Jeffrey, K. J.; Tokutake, Y.; Shimamoto, A.; Neumann, A. A.; Dunham, M. A.; Cha, J.; Sugawara, M.; Furuichi, Y.; Reddel, R. R.: Human stanniocalcin (STC): genomic structure, chromosomal localization, and the presence of CAG trinucleotide repeats. Genomics 47:393-398, 1998.

Jellinek, D. A.; Chang, A. C.; Larsen, M. R.; Wang, X.; Robinson, P. J.; Reddel, R. R.: Stanniocalcin 1 and 2 are secreted as phosphoproteins from human fibrosarcoma cells. Biochem. J. 350:453-461, 2000.

Olsen, H. S.; Cepeda, M. A.; Zhang, Q.-Q.; Rosen, C. A.; Vozzolo, B. L.; Wagner, G. F.: Human stanniocalcin: a possible hormonal regulator of mineral metabolism. Proc. Nat. Acad. Sci. 93:1792-1796, 1996.

Varghese, R.; Wong, C. K. C.; Deol, H.; Wagner, G. F.; DiMattia, G. E.: Comparative analysis of mammalian stanniocalcin genes. Endocrinology 139:4714-4725, 1998.

Wagner, G. F.; Guiraudon, C. C.; Milliken, C.; Copp, D. H.: Immunological and biological evidence for a stanniocalcin-like hormone in human kidney. Proc. Nat. Acad. Sci. 92:1871-1875, 1995.

Bartsch, O.; Wagner, A.; Hinkel, G. K.; Lichtner, P.; Murken, J.; Schuffenhauer, S.: No evidence for chromosomal microdeletions at the second DiGeorge syndrome locus on 10p near D10S585. (Letter) Am. J. Med. Genet. 83:425-426, 1999.

Daw, S. C. M.; Taylor, C.; Kraman, M.; Call, K.; Mao, J.; Schuffenhauer, S.; Meitinger, T.; Lipson, T.; Goodship, J.;

Scambler, P.: A common region of 10p deleted in DiGeorge and velocardiofacial syndromes. Nature Genet. 13:458-461, 1996.

Lichtner, P.; Konig, R.; Hasegawa, T.; Van Esch, H.; Meitinger, T.; Schuffenhauer, S.: An HDR (hypoparathyroidism, deafness, renal dysplasia) syndrome locus maps distal to the DiGeorge syndrome region on 10p13/14. J. Med. Genet. 37:33-37, 2000.

Chen, C.-Y.; Gherzi, R.; Ong, S.-E.; Chan, E. L.; Raijmakers, R.; Pruijn, G. J. M.; Stoecklin, G.; Moroni, C.; Mann, M.; Karin, M.: AU binding proteins recruit the exosome to degrade ARE-containing mRNAs. Cell 107:451-464, 2001.

Doyle, K.; Zhang, Y.; Baer, R.; Bina, M.: Distinguishable patterns of protein-DNA interactions involving complexes of basic helix-loop-helix proteins. J. Biol. Chem. 269:12099-12105, 1994.

Hu, J.-S.; Olson, E. N.; Kingston, R. E.: HEB, a helix-loop-helix protein related to E2A and ITF2 that can modulate the DNA-binding ability of myogenic regulatory factors. Molec. Cell. Biol. 12:1031-1042,1992.

Sawada, S.; Littman, D. R.: A heterodimer of HEB and an E12-related protein interacts with the CD4 enhancer and regulates its activity in T-cell lines. Molec. Cell. Biol. 13:5620-5628, 1993.

Zhang, Y.; Babin, J.; Feldhaus, A. L.; Singh, H.; Sharp, P. A.; Bina, M.: HTF4: a new human helix-loop-helix protein. Nucleic Acids Res. 19:4555 only, 1991.

Zhang, Y.; Bina, M.: The nucleotide sequence of the human transcription factor HTF4a cDNA. DNA Sequence 2:397-403, 1992.

Zhang, Y.; Flejter, W. L.; Barcroft, C. L.; Riviere, M.; Szpirer, J.; Szpirer, C.; Bina, M.: Localization of the human HTF4 transcription factors 4 gene (TCF12) to chromosome 15q21. Cytogenet. Cell Genet. 68:235-238, 1995.

Rowen, L.; Young, J.; Birditt, B.; Kaur, A.; Madan, A.; Philipps, D. L.; Qin, S.; Minx, P.; Wilson, R. K.; Hood, L.; Graveley, B. R.: Analysis of the human neurexin genes: alternative splicing and the generation of protein diversity. Genomics 79:587-597, 2002.

Tabuchi, K.; Sudhof, T. C.: Structure and evolution of neurexin genes: insight into the mechanism of alternative splicing. Genomics 79:849-859, 2002.

Ullrich, B.; Ushkaryov, Y. A.; Sudhof, T. C.: Cartography of neurexins: more than 1000 isoforms generated by alternative splicing and expressed in distinct subsets of neurons. Neuron 14:497-507, 1995.

Ushkaryov, Y. A.; Petrenko, A. G.; Geppert, M.; Sudhof, T. C.: Neurexins: synaptic cell surface proteins related to the alpha-latrotoxin receptor and laminin. Science 257:50-56, 1992.

Bergman, L.; Silins, G.; Grimmond, S.; Hummerich, H.; Stewart, C.; Little, P.; Hayward, N.: A 500-kb sequence-ready cosmid contig and transcript map of the MEN1 region on 11q13. Genomics 55:49-56,1999.

Ushkaryov, Y. A.; Petrenko, A. G.; Geppert, M.; Sudhof, T. C.:Neurexins: synaptic cell surface proteins related to the alpha-latrotoxin receptor and laminin. Science 257:50-56, 1992.

Scheiffele, P.; Fan, J.; Choih, J.; Fetter, R.; Serafini, T.:Neuroligin expressed in nonneuronal cells triggers presynaptic development in contacting axons. Cell 101:657-669, 2000.

Cavaloc, Y.; Popielarz, M.; Fuchs, J.-P.; Gattoni, R.; Stevenin, J.: Characterization and cloning of the human splicing factor 9G8:a novel 35 kDa factor of the serine/arginine protein family. EMBOJ. 13:2639-2649, 1994.

Popielarz, M.; Cavaloc, Y.; Mattei, M.-G.; Gattoni, R.; Stevenin, J.: The gene encoding human splicing factor 9G8: structure, chromosomal localization, and expression of alternatively processed transcripts. J. Biol. Chem. 270:17830-17835, 1995.

Chiang, C.-M.; Roeder, R. G.: Cloning of an intrinsic human TFIID subunit that interacts with multiple transcriptional activators. Science 267:531-536, 1995.

Wu, Q.; Zhang, T.; Cheng, J.-F.; Kim, Y.; Grimwood, J.; Schmutz, J.; Dickson, M.; Noonan, J. P.; Zhang, M. Q.; Myers, R. M.; Maniatis, T.: Comparative DNA sequence analysis of mouse and human protocadherin gene clusters. Genome Res. 11:389-404, 2001.

Aoki, K.; Inazawa, J.; Takahashi, T.; Nakahara, K.; Kasai, M.:Genomic structure and chromosomal localization of the gene encoding translin, a recombination hotspot binding protein. Genomics 43:237-241, 1997.

Aoki, K.; Nakahara, K.; Ikegawa, C.; Seto, M.; Takahashi, T.; Minowada, J.; Strominger, J. L.; Maziarz, R. T.; Kasai, M.: Nuclear proteins binding to a novel target sequence within the recombination hotspot regions of Bcl-2 and the immunoglobulin D(H) gene family. Oncogene 9:1109-1115, 1994.

Blair, I. P.; Gibson, R. R.; Bennett, C. L.; Chance, P. F.: Search for genes involved in Joubert syndrome: evidence that one or more major loci are yet to be identified and exclusion of candidate genes EN1, EN2, FGF8, and BARHL1. Am. J. Med. Genet. 107:190-196, 2002.

Bodzioch, M.; Orso, E.; Klucken, J.; Langmann, T.; Bottcher, A.; Diederich, W.; Drobnik, W.; Barlage, S.; Buchler, C.; Porsch-Ozcurumez, M.; Kaminski, W. E.; Hahmann, H. W.; Oette, K.; Rothe, G.; Aslanidis, C.; Lackner, K. J.; Schmitz, G.: The gene encoding ATP-binding cassette transporter 1 is mutated in Tangier disease. Nature Genet. 22:347-351,1999.

Brooks-Wilson, A.; Marcil, M.; Clee, S. M.; Zhang, L.-H.; Roomp, K.; van Dam, M.; Yu, L.; Brewer, C.; Collins, J. A.; Molhuizen, H. O. F.; Loubser, O.; Ouelette, B. F. F.; and 14 others: Mutations in ABC1 in Tangier disease and familial high-density lipoprotein deficiency. Nature Genet. 22:336-345, 1999.

Asamoah, A.; Wilson, A. F.; Elston, R. C.; Dalferes, E., Jr.; Berenson, G. S.: Segregation and linkage analyses of dopamine-beta-hydroxylase activity in a six-generation pedigree. Am. J. Med. Genet. 27:613-621,1987.

Biaggioni, I.; Goldstein, D. S.; Atkinson, T.; Robertson, D.: Dopamine-beta-hydroxylase deficiency in humans. Neurology 40:370-373,1990.

Biaggioni, I.; Robertson, D.: Endogenous restoration of noradrenaline by precursor therapy in dopamine-beta-hydroxylase deficiency. Lancet II:1170-1172, 1987.

Craig, S. P.; Buckle, V. J.; Lamouroux, A.; Mallet, J.; Craig, I. W.: Localization of the human dopamine beta hydroxylase (DBH) gene to chromosome 9q34. Cytogenet. Cell Genet. 48:48-50, 1988.

Dunnette, J.; Weinshilboum, R.: Human serum dopamine beta-hydroxylase: correlation of enzymatic activity with immunoreactive protein in genetically defined samples. Am. J. Hum. Genet. 28:155-166, 1976.

Dunnette, J.; Weinshilboum, R.: Inheritance of low immunoreactive human plasma dopamine-beta-hydroxylase: radioimmunoassay studies. J. Clin. Invest. 60:1080-1087, 1977.

Elston, R. C.; Namboodiri, K. K.; Hames, C. G.: Segregation and linkage analysis of dopamine-beta-hydroxylase activity. Hum. Hered. 29:284-292, 1979.

Gershon, E. S.; Goldin, L. R.: Segregation and linkage studies of plasma dopamine-beta-hydroxylase (DBH), erythrocyte catechol-O-methyltransferase (COMT) and platelet monoamine oxidase (MAO): possible linkage between the ABO locus and a gene controlling DBH activity. (Abstract) Am. J. Hum. Genet. 33:136A only, 1981.

Goldin, L. R.; Gershon, E. S.; Lake, C. R.; Murphy, D. L.; McGinniss, M.; Sparkes, R. S.: Segregation and linkage studies of plasma dopamine-beta-hydroxylase (DBH), erythrocyte catechol-O-methyltransferase (COMT), and platelet monoamine oxidase (MAO): possible linkage between the ABO locus and a gene controlling DBH activity. Am. J. Hum. Genet. 34:250-262,1982.

Joh, T. H.; Baetge, E. E.; Reis, D. J.: Evidence for the existence of a single gene or linked genes coding for catecholamine biosynthetic enzymes. Trans. Assoc. Am. Phys. 96:38-43, 1983.

Joh, T. H.; Baetge, E. E.; Ross, M. E.; Albert, V. R.; Moon, H. M.; Reis, D. J.: Existence of catecholamine biosynthetic enzyme gene family. (Abstract) Clin. Res. 31:528 only, 1983.

Joh, T. H.; Baetge, E. E.; Ross, M. E.; Reis, D. J.: Biochemistry and molecular biology of catecholamine neurons: a single gene or gene family hypothesis. Clin. Exp. Hypertension 6A:11-21, 1984.

Kobayashi, K.; Kurosawa, Y.; Fujita, K.; Nagatsu, T.: Human dopamine beta-hydroxylase gene: two mRNA types having different 3-prime-terminal regions are produced through alternative polyadenylation. Nucleic Acids Res. 17:1089-1102, 1989.

Lamouroux, A.; Vigny, A.; Faucon Biguet, N.; Darmon, M. C.; Franck, R.; Henry, J.-P.; Mallet, J.: The primary structure of human dopamine-beta-hydroxylase: insights into the relationship between the soluble and the membrane-bound forms of the enzyme. EMBO J. 6:3931-3937, 1987.

Lea, R. A.; Dohy, A.; Jordan, K.; Quinlan, S.; Brimage, P. J.; Griffiths, L. R.: Evidence for allelic association of the dopamine beta-hydroxylase gene (DBH) with susceptibility to typical migraine. Neurogenetics 3:35-40, 2000.

Mathias, C. J.; Bannister, R. B.; Cortelli, P.; Heslop, K.; Polak, J. M.; Raimbach, S.; Springall, D. R.; Watson, L.: Clinical, autonomic and therapeutic observations in two siblings with postural hypotension and sympathetic failure due to an inability to synthesize noradrenaline from dopamine because of a deficiency of dopamine beta hydroxylase. Quart. J. Med. 75:617-633, 1990.

McKinney, E. F.; Walton, R. T.; Yudkin, P.; Fuller, A.; Haldar, N. A.; Mant, D.; Murphy, M.; Welsh, K. I.; Marshall, S. E.: Association between polymorphisms in dopamine metabolic enzymes and tobacco consumption in smokers. Pharmacogenetics 10:483-491, 2000.

O'Malley, K. L.; Mauron, A.; Raese, J.; Barchas, J. D.; Kedes, L.: Genes for catecholamine biosynthesis: cloning by expression and identification of the cDNA for rat dopamine beta-hydroxylase. Proc. Nat. Acad. Sci. 80:2161-2165, 1983.

Ogihara, T.; Nugent, C. A., Jr.; Shen, S.-W.; Goldfein, S.: Serum dopamine-beta-hydroxylase activity in parents and children. J. Lab. Clin. Med. 85:566-573, 1975.

Perry, S. E.; Summar, M. L.; Phillips, J. A., III; Robertson, D.: Linkage analysis of the human dopamine beta-hydroxylase gene. Genomics 10:493-495, 1991.

Robertson, D.; Haile, V.; Perry, S. E.; Robertson, R. M.; Phillips, J. A., III; Biaggioni, I.: Dopamine beta-hydroxylase deficiency: a genetic disorder of cardiovascular regulation. Hypertension 18:1-8, 1991.

Ross, S. B.; Wetterberg, L.; Myrhed, M.: Genetic control of plasma dopamine-beta-hydroxylase. Life Sci. 12:529-532, 1973.

Schanberg, S. M.; Stone, R. A.; Kirshner, N.; Gunnells, J. C.; Robinson, R. R.: Plasma dopamine beta-hydroxylase: a possible aid in the study and evaluation of hypertension. Science 183:523-525,1974.

Marlar, R. A.; Griffin, J. H.: Deficiency of protein C inhibitor in combined factor V/VIII deficiency disease. J. Clin. Invest. 66:1186-1189, 1980.

Meijers, J. C.; Chung, D. W.: Organization of the gene coding for human protein C inhibitor (plasminogen activator inhibitor-3): assignment of the gene to chromosome 14. J. Biol. Chem. 266:15028-15034,1991.

Nichols, W. C.; Seligsohn, U.; Zivelin, A.; Terry, V. H.; Arnold, N. D.; Siemieniak, D. R.; Kaufman, R. J.; Ginsburg, D.: Linkage of combined factors V and VIII deficiency to chromosome 18q by homozygosity mapping. J. Clin. Invest. 99:596-601, 1997.

Suzuki, K.; Deyashiki, Y.; Nishioka, J.; Kurachi, K.; Akira, M.; Yamamoto, S.; Hashimoto, S.: Characterization of a cDNA for human protein C inhibitor: a new member of the plasma serine protease inhibitor superfamily. J. Biol. Chem. 262:611-616, 1987.

El Kahloun, A.; Chauvel, B.; Mauvieux, V.; Dorval, I.; Jouanolle, A.-M.; Gicquel, I.; Le Gall, J.-Y.; David, V.: Localization of seven new genes around the HLA-A locus. Hum. Molec. Genet. 2:55-60, 1993.

Beattie, E. C.; Stellwagen, D.; Morishita, W.; Bresnahan, J. C.; Ha, B. K.; Von Zastrow, M.; Beattie, M. S.; Malenka, R. C.: control of synaptic strength by glial TNF-alpha. Science 295:2282-2285,2002.

Beutler, B.; Krochin, N.; Milsark, I. W.; Luedke, C.; Cerami, A.: Control of cachectin (tumor necrosis factor) synthesis: mechanisms of endotoxin resistance. Science 232: 977-980, 1986.

Brenner, D. A.; O'Hara, M.; Angel, P.; Chojkier, M.; Karin, M.: Prolonged activation of JUN and collagenase genes by tumour necrosis factor-alpha. Nature 337:661-663, 1989.

Broudy, V. C.; Kaushansky, K.; Segal, G. M.; Harlan, J. M.; Adamson, J. W.: Tumor necrosis factor type alpha stimulates human endothelial cells to produce granulocyte/macrophage colony-stimulating factor. Proc. Nat. Acad. Sci. 83:7467-7471, 1986.

Bruce, A. J.; Boling, W.; Kindy, M. S.; Peschon, J.; Kraemer, P. J.; Carpenter, M. K.; Holtsberg, F. W.; Mattson, M. P.: Altered neuronal and microglial responses to excitotoxic and ischemic brain injury in mice lacking TNF receptors. Nature Med. 2:788-794, 1996.

Cabrera, M.; Shaw, M. A.; Sharples, C.; Williams, H.; Castes, M.; Convit, J.; Blackwell, J. M.: Polymorphism in tumor necrosis factor genes associated with mucocutaneous leishmaniasis. J. Exp. Med. 182:1259-1264, 1995.

Conway, D. J.; Holland, M. J.; Bailey, R. L.; Campbell, A. E.; Mahdi, O. S.; Jennings, R.; Mbena, E.; Mabey, D. C.: Scarring trachomais associated with polymorphism in the tumor necrosis factor alpha (TNF-alpha) gene promoter and with elevated TNF-alpha levels in tear fluid. Infect. Immun. 65:1003-1006, 1997.

Davis, J. M.; Narachi, M. A.; Alton, N. K.; Arakawa, T.: Structure of human tumor necrosis factor alpha derived from recombinant DNA. Biochemistry 26:1322-1326, 1987.

Escobar-Morreale, H. F.; Calvo, R. M.; Sancho, J.; San Millan, J. L.: TNF-alpha and hyperandrogenism: a clinical, biochemical, and molecular genetic study. J. Clin. Endocr. Metab. 86:3761-3767,2001.

Gorman, J. D.; Sack, K. E.; Davis, J. C., Jr.: Treatment of ankylosing spondylitis by inhibition of tumor necrosis factor-alpha. New Eng. J. Med. 346:1349-1356, 2002.

Herrmann, S.-M.; Ricard, S.; Nicaud, V.; Mallet, C.; Arveiler, D.; Evans, A.; Ruidavets, J.-B.; Luc, G.; Bara, L.; Parra, H.-J.; Poirier, O.; Cambien, F.: Polymorphisms of the tumour necrosis factor-alpha gene, coronary heart disease and obesity. Europ. J. Clin. Invest. 28:59-66, 1998.

Inoko, H.; Trowsdale, J.: Linkage of TNF genes to the HLA-B locus. Nucleic Acids Res. 15:8957-8962, 1987.

Knight, J. C.; Udalova, I.; Hill, A. V. S.; Greenwood, B. M.; Peshu, N.; Marsh, K.; Kwiatkowski, D.: A polymorphism that affects OCT-1 binding to the TNF promoter region is associated with severe malaria. Nature Genet. 22:145-150, 1999.

Koss, K.; Satsangi, J.; Fanning, G. C.; Welsh, K. I.; Jewell, D. P.: Cytokine (TNF-alpha, LT-alpha, and IL-10) polymorphisms in inflammatory bowel diseases and normal controls: differential effects on production and allele frequencies. Genes Immun. 1:185-190, 2000.

Marino, M. W.; Dunn, A.; Grail, D.; Inglese, M.; Noguchi, Y.; Richards, E.; Jungbluth, A.; Wada, H.; Moore, M.; Williamson, B.; Basu, S.; Old, L. J.: Characterization of tumor necrosis factor-deficient mice. Proc. Nat. Acad. Sci. 94:8093-8098, 1997.

McCusker, S. M.; Curran, M. D.; Dynan, K. B.; McCullagh, C. D.; Urquhart, D. D.; Middleton, D.; Patterson, C. C.; McIlroy, S. P.; Passmore, A. P.: Association between polymorphism in regulatory region of gene encoding tumour necrosis factor-alpha and risk of Alzheimer's disease and vascular dementia: a case-control study. Lancet 357:436-439, 2001.

Remaley, A. T.; Rust, S.; Rosier, M.; Knapper, C.; Naudin, L.; Broccardo, C.; Peterson, K. M.; Koch, C.; Arnould, I.; Prades, C.; Duverger, N.; Funke, H.; Assman, G.; Dinger, M.; Dean, M.; Chimini, G.; Santamarina-Fojo, S.; Fredrickson, D. S.; Denefle, P. Brewer, H. B., Jr.: Human ATP-binding cassette transporter 1 (ABC1): genomic organization and identification of the genetic defect in the original Tangier disease kindred. Proc. Nat. Acad. Sci. 96:12685-12690,1999.

Rust, S.; Rosier, M.; Funke, H.; Real, J.; Amoura, Z.; Piette, J.-C.; Deleuze, J.-F.; Brewer, H. B.; Duverger, N.; Denefle, P.; Assmann, G.: Tangier disease is caused by mutations in the gene encoding ATP-binding cassette transporter 1. Nature Genet. 22:352-355, 1999.

Young, S. G.; Fielding, C. J.: The ABCs of cholesterol efflux. Nature Genet. 22:316-318, 1999.

Buchwald, M.: Complementation groups: one or more per gene? Nature Genet. 11:228-230, 1995.

Fujita, R.; Hanauer, A.; Vincent, A.; Mandel, J.-L.; Koenig, M.: Physical mapping of two loci (D9S5 and D9S15) tightly linked to Friedreich ataxia locus (FRDA) and identification of nearby CpG islands by pulse-field gel electrophoresis. Genomics 10:915-920, 1991.

Victoria, T.; Rafi, M. A.; Wenger, D. A.: Cloning of the canine GALC cDNA and identification of the mutation causing globoid cell leukodystrophy in West Highland White and Cairn terriers. Genomics 33:457-462, 1996.

Wenger, D. A.; Rafi, M. A.; Luzi, P.: Molecular genetics of Krabbe disease (globoid cell leukodystrophy): diagnostic and clinical implications. Hum. Mutat. 10:268-279, 1997.

Zlotogora, J.; Chakraborty, S.; Knowlton, R. G.; Wenger, D. A.: Krabbe disease locus mapped to chromosome 14 by genetic linkage. Am. J. Hum. Genet. 47:37-44, 1990.

Zlotogora, J.; Regev, R.; Zeigler, M.; Iancu, T. C.; Bach, G.: Krabbe disease: increased incidence in a highly inbred community. Am. J. Med. Genet. 21:765-770, 1985.

Rushton, A. R.; Dawson, G.: Genetic linkage studies of the human glycosphingolipid beta-galactosidases. Biochem. Genet. 15:1071-1082,1977.

Balciunaite, G.; Keller, M. P.; Balciunaite, E.; Piali, L.; Zuklys, S.; Mathieu, Y. D.; Gill, J.; Boyd, R.; Sussman, D. J.; Hollander, G. A.: Wnt glycoproteins regulate the expression of FoxN1, the gene defective in nude mice. Nature Immun. 15Oct, 2002. Note: Advance Electronic Publication.

Frank, J.; Pignata, C.; Panteleyev, A. A.; Prowse, D. M.; Baden, H.; Weiner, L.; Gaetaniello, L.; Ahmad, W.; Pozzi, N.; Caerhalmi-Friedman, P. B.; Aita, V. M.; Uyttendaele, H.; Gordon, D.; Ott, J.; Brissette, J. L.; Christiano, A. M.: Exposing the human nude phenotype. Nature 398:473-474, 1999.

Nehls, M.; Pfeifer, D.; Schorpp, M.; Hedrich, H.; Boehm, T.: New member of the winged-helix protein family disrupted in mouse and rat nude mutations. Nature 372:103-107, 1994.

Pignata, C.; Fiore, M.; Guzzetta, V.; Castaldo, A.; Sebastio, G.; Porta, F.; Guarino, A.: Congenital alopecia and nail dystrophy associated with severe functional T-cell immunodeficiency in two sibs. Am. J. Med. Genet. 65:167-170, 1996.

Schorpp, M.; Hofmann, M.; Dear, T. N.; Boehm, T.: characterization of mouse and human nude genes. Immunogenetics 46:509-515, 1997.

Segre, J. A.; Nemhauser, J. L.; Taylor, B. A.; Nadeau, J. H.; Lander, E. S.: Positional cloning of the nude locus: genetic, physical, and transcription maps of the region and mutations in the mouse and rat. Genomics 28:549-559, 1995.

Sedlacek, Z.; Konecki, D. S.; Korn, B.; Klauck, S. M.; Poustka, A.: Evolutionary conservation and genomic organization of XAP-4, an Xq28 located gene coding for a human rab GDP-dissociation inhibitor (GDI). Mammalian Genome 5:633-639, 1995.

Sedlacek, Z.; Munstermann, E.; Mincheva, A.; Lichter, P.; Poustka, A.: The human rab GDI beta gene with long retroposon-rich introns maps to 10p15 and its pseudogene to 7p11-p13. Mammalian Genome 9:78-80, 1998.

Birck, C.; Poch, O.; Romier, C.; Ruff, M.; Mengus, G.; Lavigne, A.-C.; Davidson, I.; Moras, D.: Human TAFII28 and TAFII18 interact through a histone fold encoded by atypical evolutionary conserved motifs also found in the SPT3 family. Cell 94:239-249, 1998.

Mengus, G.; May, M.; Jacq, X.; Staub, A.; Tora, L.; Chambon, P.; Davidson, I.: Cloning and characterization of hTAFII18, hTAFII20 and hTAFII28: three subunits of the human transcription factor TFIID. EMBO J. 14:1520-1531, 1995.

Waisfisz, Q.; Saar, K.; Morgan, N. V.; Altay, C.; Leegwater, P. A.; de Winter, J. P.; Komatsu, K.; Evans, G. R.; Wegner, R.-D.; Reis, A.; Joenje, H.; Arwert, F.; Mathew, C. G.; Pronk, J. C.; Digweed, M.: The Fanconi anemia group E gene, FANCE, maps to chromosome 6p. Am. J. Hum. Genet. 64:1400-1405, 1999.

Wegner, R.-D.; Henrichs, I.; Joenje, H.; Schroeder-Kurth, T.: Fanconi anemia complementation group E: clinical and cytogenetic data of the first patient. Clin. Genet. 50:479-482, 1996.

Green, P.; Lipman, D.; Hillier, L.; Waterston, R.; States, D.; Claverie, J.-M.: Ancient conserved regions in new gene sequences and the protein databases. Science 259:1711-1716, 1993.

Schwartz, F.; Eisenman, R.; Knoll, J.; Gessler, M.; Bruns, G.: cDNA sequence, genomic organization, and evolutionary conservation of a novel gene from the WAGR region. Genomics 29:526-532, 1995.

Schwartz, F.; Neve, R.; Eisenman, R.; Gessler, M.; Bruns, G.: A WAGR region gene between PAX-6 and FSHB expressed in fetal brain. Hum. Genet. 94:658-664, 1994.

Krishnan, B. R.; Jamry, I.; Chaplin, D. D.: Feature mapping of the HLA class I region: localization of the POU5F1 and TCF19 genes. Genomics 30:53-58, 1995.

Ku, D.-H.; Chang, C.; Koniecki, J.; Cannizzaro, L. A.; Boghosian-Sell, L.; Alder, H.; Baserga, R.: A new growth-regulated complementary DNA with the sequence of a putative trans-activating factor. Cell Growth Differ. 2:179-186, 1991.

Joseph, R. E.; Walker, J.; Norris, F. A.: Assignment of the inositol polyphosphate 4-phosphatase type I gene (INPP4A) to human chromosome band 2q11.2 by in situ hybridization. Cytogenet. Cell Genet. 87:276-277, 1999.

Norris, F. A.; Auethavekiat, V.; Majerus, P. W.: The isolation and characterization of cDNA encoding human and rat brain inositol polyphosphate 4-phosphatase. J. Biol. Chem. 270:16128-16133, 1995.

Bertaux, F.; Sharp, A. H.; Ross, C. A.; Lehrach, H.; Bates, G. P.; Wanker, E.: HAP1-huntingtin interactions do not contribute to the molecular pathology in Huntington's disease transgenic mice. FEBS Lett. 426:229-232, 1998.

Engelender, S.; Sharp, A. H.; Colomer, V.; Tokito, M. K.; Lanahan, A.; Worley, P.; Holzbaur, E. L. F.; Ross, C. A.: Huntingtin-associated protein 1 (HAP1) interacts with the p150(Glued) subunit of dynactin. Hum. Molec. Genet. 6:2205-2212, 1997.

Li, S.-H.; Hosseini, S. H.; Gutekunst, C.-A.; Hersch, S. M.; Ferrante, R. J.; Li, X.-J.: A human HAP1 homologue: cloning, expression, and interaction with huntingtin. J. Biol. Chem. 273:19220-19227, 1998.

Li, X.-J.; Li, S.-H.; Sharp, A. H.; Nucifora, F. C., Jr.; Schilling, G.; Lanahan, A.; Worley, P.; Snyder, S. H.; Ross, C. A.: A huntingtin-associated protein enriched in brain with implications for pathology. Nature 378:398-402, 1995.

Nasir, J.; Duan, K.; Nichol, K.; Engelender, S.; Ashworth, R.; Colomer, V.; Thomas, S.; Disteche, C. M.; Hayden, M. R.; Ross, C. A.: Gene structure and map location of the murine homolog of the Huntington-associated protein, Hap1. Mammalian Genome 9:565-570,1998.

Nasir, J.; Lafuente, M.-J.; Duan, K.; Colomer, V.; Engelender, S.; Ingersoll, R.; Margolis, R. L.; Ross, C. A.; Hayden, M. R.: human huntingtin-associated protein (HAP-1) gene: genomic organisation and an intragenic polymorphism. Gene 254:181-187, 2000.

Broccoli, D.; Chong, L.; Oelmann, S.; Fernald, A. A.; Marziliano, N.; van Steensel, B.; Kipling, D.; Le Beau, M. M.; de Lange, T.: Comparison of the human and mouse genes encoding the telomeric protein, TRF1: chromosomal localization, expression and conserved protein domains. Hum. Molec. Genet. 6:69-76, 1997.

Chong, L.; van Steensel, B.; Broccoli, D.; Erdjument-Bromage, H.; Hanish, J.; Tempst, P.; de Lange, T.: A human telomeric protein. Science 270:1663-1667, 1995.

Fairall, L.; Chapman, L.; Moss, H.; de Lange, T.; Rhodes, D.: Structure of the TRFH dimerization domain of the human telomeric proteins TRF1 and TRF2. Molec. Cell 8:351-361, 2001.

Griffith, J. D.; Comeau, L.; Rosenfield, S.; Stansel, R. M.; Bianchi, A.; Moss, H.; de Lange, T.: Mammalian telomeres end in a large duplex loop. Cell 97:503-514, 1999.

Kim, S.; Kaminker, P.; Campisi, J.: TIN2, a new regulator of telomere length in human cells. Nature Genet. 23:405-412, 1999.

Marcand, S.; Gilson, E.; Shore, D.: A protein-counting mechanism for telomere length regulation in yeast. Science 275:986-990, 1997.

Okabe, J.; Eguchi, A.; Masago, A.; Hayakawa, T.; Nakanishi, M.: TRF1 is a critical trans-acting factor required for de novo telomere formation in human cells. Hum. Molec. Genet. 9:2639-2650, 2000.

Young, A. C.; Chavez, M.; Giambernardi, T. A.; Mattern, V.; McGill, J. R.; Harris, J. M.; Sarosdy, M. F.; Patel, P.; Sakaguchi, A. Y.: Organization and expression of human telomere repeat binding factor genes. Somat. Cell Molec. Genet. 23:275-286, 1997.

Zakian, V. A.: Telomeres: beginning to understand the end. Science 270:1601-1607, 1995.

Brodsky, G.; Otterson, G. A.; Parry, B. B.; Hart, I.; Patterson, D.; Kaye, F. J.: Localization of STCH to human chromosome 21q11.1. Genomics 30:627-628, 1995.

Otterson, G. A.; Flynn, G. C.; Kratzke, R. A.; Coxon, A.; Johnston, P. G.; Kaye, F. J.: Stch encodes the 'ATPase core' of a microsomal stress 70 protein. EMBO J. 13:1216-1225, 1994.

Reeves, R. H.; Rue, E.; Yu, J.; Kao, F.-T.: Stch maps to mouse chromosome 16, extending the conserved synteny with human chromosome 21. Genomics 49:156-157, 1998.

Nielsen, P. J.; Rochelle, J. M.; Seldin, M. F.: The functional genes for protein synthesis initiation factor 4AI and 4AII map to mouse chromosomes 11 and 16. Mammalian Genome 4:185-186, 1993.

Nielsen, P. J.; Trachsel, H.: The mouse protein synthesis initiation factor 4A gene family includes two related functional genes which are differentially expressed. EMBO J. 7:2097-2105, 1988.

Sudo, K.; Takahashi, E.; Nakamura, Y.: Isolation and mapping of the human EIF4A2 gene homologous to the murine protein synthesis initiation factor 4A-II gene Eif4a2. Cytogenet. Cell Genet. 71:385-388, 1995.

Gladyshev, V. N.; Jeang, K.-T.; Stadtman, T. C.: Selenocysteine, identified as the penultimate C-terminal residue in human T-cell thioredoxin reductase, corresponds to TGA in the human placental gene. Proc. Nat. Acad. Sci. 93:6146-6151, 1996.

Zhang, K.; Lindsberg, P. J.; Tatlisumak, T.; Kaste, M.; Olsen, H. S.; Andersson, L. C.: Stanniocalcin: a molecular guard of neurons during cerebral ischemia. Proc. Nat. Acad. Sci. 97:3637-3642, 2000.

Byrd, P. J.; Cooper, P. R.; Stankovic, T.; Kullar, H. S.; Watts, G. D. J.; Robinson, P. J.; Taylor, M. R.: A gene transcribed from the bidirectional ATM promoter coding for a serine rich protein: amino acid sequence, structure and expression studies. Hum. Molec. Genet. 5:1785-1791, 1996.

Chen, X.; Yang, L.; Udar, N.; Liang, T.; Uhrhammer, N.; Xu, S.; Bay, J.-O.; Wang, Z.; Dandakar, S.; Chiplunkar, S.; Klisak, I.; Telatar, M.; Yang, H.; Concannon, P.; Gatti, R. A.: CAND3: a ubiquitously expressed gene immediately adjacent and in opposite transcriptional orientation to the ATM gene at 11q23.1. Mammalian Genome 8:129-133,1997.

Imai, T.: Personal Communication. Chiba, Japan Sep. 12, 1996.

Imai, T.; Sugawara, T.; Nishiyama, A.; Shimada, R.; Ohki, R.; Seki, N.; Sagara, M.; Ito, H.; Yamauchi, M.; Hori, T.: The structure and organization of the human NPAT gene. Genomics 42:388-392, 1997.

Imai, T.; Yamauchi, M.; Seki, N.; Sugawara, T.; Saito, T.; Matsuda, Y.; Ito, H.; Nagase, T.; Nomura, N.; Hori, T.: Identification and characterization of a new gene physically linked to the ATM gene. Genome Res. 6:439-447, 1996.

Arai, Y.; Hosoda, F.; Kobayashi, H.; Arai, K.; Hayashi, Y.; Kamada, N.; Kaneko, Y.; Ohki, M.: The inv (11)(p15q22) chromosome translocation of de novo and therapy-related myeloid malignancies results in fusion of the nucleoporin gene, NUP98, with the putative RNA helicase gene, DDX10. Blood 89:3936-3944, 1997.

Dash, A. B.; Williams, I. R.; Kutok, J. L.; Tomasson, M. H.; Anastasiadou, E.; Lindahl, K.; Li, S.; Van Etten, R. A.; Borrow, J.; Housman, D.; Druker, B.; Gilliland, D. G.: A murine model of CML blast crisis induced by cooperation between BCR/ABL and NUP98/HOXA9. Proc. Nat. Acad. Sci. 99:7622-7627, 2002.

Enninga, J.; Levy, D. E.; Blobel, G.; Fontoura, B. M. A.: Role of nucleoporin induction in releasing an mRNA nuclear export block. Science 295:1523-1525, 2002.

Fontoura, B. M.; Blobel, G.; Matunis, M. J.: A conserved biogenesis pathway for nucleoporins: proteolytic processing of a 186-kilodalton precursor generates Nup98 and the novel nucleoporin, Nup96. J. Cell Biol. 144:1097-1112, 1999.

Hodel, A. E.; Hodel, M. R.; Griffis, E. R.; Hennig, K. A.; Ratner, G. A.; Xu, S.; Powers, M. A.: The three-dimensional structure of the autoproteolytic, nuclear pore-targeting domain of the human nucleoporin Nup98. Molec. Cell 10:347-358, 2002.

Jaju, R. J.; Fidler, C.; Haas, O. A.; Strickson, A. J.; Watkins, F.; Clark, K.; Cross, N. C. P.; Cheng, J.-F.; Aplan, P. D.; Kearney, L.; Boultwood, J.; Wainscoat, J. S.: A novel gene, NSD1, is fused to NUP98 in the t (5;11)(q35; p15.5) in de novo childhood acute myeloid leukemia. Blood 98:1264-1267, 2001.

Jaju, R. J.; Haas, C. A.; Neat, M.; et al: A new recurrent translocation, t (5;11)(q35p15.5), associated with del (5q) in childhood acute myeloid leukemia. Blood 94:773-780, 1999.

Mizuno, T.; Kaibuchi, K.; Yamamoto, T.; Kawamura, M.; Sakoda, T.; Fujioka, H.; Matsuura, Y.; Takai, Y.: A stimulatory GDP/GTP exchange protein for smg p21 is active on the post-translationally processed form of c-Ki-ras p21 and rhoA p21. Proc. Nat. Acad. Sci. 88:6442-6446,1991.

Nakamura, T.; Largaespada, D. A.; Lee, M. P.; Johnson, L. A.; Ohyashiki, K.; Toyama, K.; Chen, S. J.; Willman, C. L.; Chen, I.-M.; Feinberg, A. P.; Jenkins, N. A.; Copeland, N. G.; Shaughnessy, J. D., Jr.: Fusion of the nucleoporin gene NUP98 to HOXA9 by the chromosome translocation t (7;11) (p15; p15) in human myeloid leukaemia. Nature Genet. 12:154-158, 1996.

Radu, A.; Moore, M. S.; Blobel, G.: The peptide repeat domain of nucleoporin Nup98 functions as a docking site in transport across the nuclear pore complex. Cell 81:215-222, 1995.

Rosati, R.; La Starza, R.; Veronese, A.; Aventin, A.; Schwienbacher, C.; Vallespi, T.; Negrini, M.; Martelli, M. F.; Mecucci, C.: NUP98 is fused to the NSD3 gene in acute myeloid leukemia associated with t (8;11)(p11.2; p15). Blood 99:3857-3860, 2002.

von Kobbe, C.; van Deursen, J. M. A.; Rodrigues, J. P.; Sitterlin, D.; Bachi, A.; Wu, X.; Wilm, M.; Carmo-Fonseca, M.; Izaurralde, E.: Vesicular stomatitis virus matrix protein inhibits host cell gene expression by targeting the nucleoporin Nup98. Molec. Cell 6:1243-1252,2000.

Cheng, Y.; Austin, S. C.; Rocca, B.; Koller, B. H.; Coffman, T. M.; Grosser, T.; Lawson, J. A.; FitzGerald, G. A.: Role of prostacyclin in the cardiovascular response to thromboxane A2. Science 296:539-541,2002.

Fuse, I.; Mito, M.; Hattori, A.; Higuchi, W.; Shibata, A.; Ushikubi, F.; Okuma, M.; Yahata, K.: Defective signal transduction induced by thromboxane A2 in a patient with a mild bleeding disorder: impaired phospholipase C activation despite normal phospholipase A2 activation. Blood 81:994-1000, 1993.

Hirata, M.; Hayashi, Y.; Ushikubi, F.; Yokota, Y.; Kageyama, R.; Nakanishi, S.; Narumiya, S.: Cloning and expression of cDNA for a human thromboxane A2 receptor. Nature 349:617-620, 1991.

Hirata, T.; Kakizuka, A.; Ushikubi, F.; Fuse, I.; Okuma, M.; Narumiya, S.: Arg60-to-leu mutation of the human thromboxane A2 receptor in a dominantly inherited bleeding disorder. J. Clin. Invest. 94:1662-1667,1994.

Watanabe, O.; Maruyama, I.; Arimura, K.; Kitajima, I.; Arimura, H.; Hanatani, M.; Matsuo, K.; Arisato, T.; Osame, M.: Overproduction of vascular endothelial growth factor/vascular permeability factor is causative in Crow-Fukase (POEMS) syndrome. Muscle Nerve 21:1390-1397,1998.

Wei, M.-H.; Popescu, N. C.; Lerman, M. I.; Merrill, M. J.; Zimonjic, D. B.: Localization of the human vascular endothelial growth factor gene, VEGF, at chromosome 6p12. Hum. Genet. 97:794-797, 1996.

Wong, A. K.; Alfert, M.; Castrillon, D. H.; Shen, Q.; Holash, J.; Yancopoulos, G. D.; Chin, L.: Excessive tumor-elaborated VEGF and its neutralization define a lethal paraneoplastic syndrome. Proc. Nat. Acad. Sci. 98:7481-7486, 2001.

Wulff, C.; Wilson, H.; Largue, P.; Duncan, W. C.; Armstrong, D. G.; Fraser, H. M.: Angiogenesis in the human corpus luteum: localization and changes in angiopoietins, Tie-2, and vascular endothelial growth factor messenger ribonucleic acid. J. Clin. Endocr. Metab. 85:4302-4309,2000.

Ylikorkala, A.; Rossi, D. J.; Korsisaari, N.; Luukko, K.; Alitalo, K.; Henkemeyer, M.; Makela, T. P.: Vascular abnormalities and deregulation of VEGF in Lkb1-deficient mice. Science 293:1323-1326, 2001.

Bodner, M.; Fridkin, M.; Gozes, I.: Coding sequences for vasoactive intestinal peptide and PHM-27 peptide are located on two adjacent exons in the human genome. Proc. Nat. Acad. Sci. 82:3548-3551,1985.

Delgado, M.; Abad, C.; Martinez, C.; Leceta, J.; Gomariz, R. P.: Vasoactive intestinal peptide prevents experimental arthritis by downregulating both autoimmune and inflammatory components of the disease. Nature Med. 7:563-568, 2001.

Gotoh, E.; Yamagami, T.; Yamamoto, H.; Okamoto, H.: Chromosomal assignment of human VIP/PHM-27 gene to 6q26-q27 region by spot blot hybridization and in situ hybridization. Biochem. Int. 17:555-562,1988.

Gozes, I.; Avidor, R.; Yahav, Y.; Katznelson, D.; Croce, C. M.; Huebner, K.: The gene encoding vasoactive intestinal peptide is located on human chromosome 6p21-6qter. Hum. Genet. 75:41-44, 1987.

Gozes, I.; Nakai, H.; Byers, M.; Avidor, R.; Weinstein, Y.; Shani, Y.; Shows, T. B.: Sequential expression in the nervous system of C-MYB and VIP genes, located in human chromosomal region 6q24. Somat. Cell Molec. Genet. 13:305-313, 1987.

Heinz-Erian, P.; Dey, R. D.; Flux, M.; Said, S. I.: Deficient vasoactive intestinal peptide innervation in sweat glands of cystic fibrosis patients. Science 229:1407-1408, 1985.

Itoh, N.; Obata, K.; Yanaihara, N.; Okamoto, H.: Human preprovasoactive intestinal polypeptide contains a novel PHI-27-like peptide, PHM-27. Nature 304:547-549, 1983.

Linder, S.; Barkhem, T.; Norberg, A.; Persson, H.; Schalling, M.; Hokfelt, T.; Magnusson, G.: Structure and expression of the gene encoding the vasoactive intestinal peptide precursor. Proc. Nat. Acad. Sci. 84:605-609, 1987.

Omary, M. B.; Kagnoff, M. F.: Identification of nuclear receptors for VIP on a human colonic adenocarcinoma cell line. Science 238:1578-1581, 1987.

Couvineau, A.; Rouyer-Fessard, C.; Darmoul, D.; Maoret, J.-J.; Carrero, I.; Ogier-Denis, E.; Laburthe, M.: Human intestinal VIP receptor: cloning and functional expression of two cDNA encoding proteins with different N-terminal domains. Biochem. Biophys. Res. Commun. 200:769-776, 1994.

Hashimoto, H.; Nishino, A.; Shintani, N.; Hagihara, N.; Copeland, N. G.; Jenkins, N. A.; Yamamoto, K.; Matsuda, T.; Ishihara, T.; Nagata, S.; Baba, A.: Genomic organization and chromosomal location of the mouse vasoactive intestinal polypeptide 1 (VPAC-1) receptor. Genomics 58:90-93, 1999.

Sreedharan, S. P.; Huang, J.-X.; Cheung, M.-C.; Goetzl, E. J.: Structure, expression, and chromosomal localization of the type I human vasoactive intestinal peptide receptor gene. Proc. Nat. Acad. Sci. 92:2939-2943, 1995.

Sreedharan, S. P.; Patel, D. R.; Huang, J.-X.; Goetzl, E. J.: Cloning and functional expression of a human neuroendocrine vasoactive intestinal peptide receptor. Biochem. Biophys. Res. Commun. 193:546-553, 1993.

Sreedharan, S. P.; Robichon, A.; Peterson, K. E.; Goetzl, E. J.: Cloning and expression of the human vasoactive intestinal peptide receptor. Proc. Nat. Acad. Sci. 88:4986-4990, 1991.

Ueno, S.; Maruki, Y.; Nakamura, M.; Tomemori, Y.; Kamae, K.; Tanabe, H.; Yamashita, Y.; Matsuda, S.; Kaneko, S.; Sano, A.: The gene encoding a newly discovered protein, chorein, is mutated in chorea-acanthocytosis. Nature Genet. 28:121-122, 2001.

Hirata, T.; Ushikubi, F.; Kakizuka, A.; Okuma, M.; Narumiya, S.: Two thromboxane A(2) receptor isoforms in human platelets: opposite coupling to adenylyl cyclase with different sensitivity to arg60-to-leu mutation. J. Clin. Invest. 97:949-956, 1996.

Nusing, R. M.; Hirata, M.; Kakizuka, A.; Eki, T.; Ozawa, K.; Narumiya, S.: Characterization and chromosomal mapping of the human thromboxane A2 receptor gene. J. Biol. Chem. 268:25253-25259, 1993.

Schwengel, D. A.; Nouri, N.; Meyers, D. A.; Levitt, R. C.: Linkage mapping of the human thromboxane A2 receptor (TBXA2R) to chromosome 19p13.3 using transcribed 3-prime untranslated DNA sequence polymorphisms. Genomics 18:212-215, 1993.

Thomas, D. W.; Mannon, R. B.; Mannon, P. J.; Latour, A.; Oliver, J. A.; Hoffman, M.; Smithies, O.; Koller, B. H.; Coffman, T. M.:Coagulation defects and altered hemodynamic responses in mice lacking receptors for thromboxane A(2). J. Clin. Invest. 102:1994-2001,1998.

Ushikubi, F.; Nakajima, M.; Hirata, M.; Okuma, M.; Fujiwara, M.; Narumiya, S.: Purification of the thromboxane A2/prostaglandin H2receptor from human blood platelets. J. Biol. Chem. 264:16496-16501,1989.

Ushikubi, F.; Okuma, M.; Kanaji, K.; Sugiyama, T.; Ogorochi, T.; Narumiya, S.; Uchino, H.: Hemorrhagic thrombocytopathy with platelet thromboxane A2 abnormality: defective signal transduction with normal binding activity. Thromb. Haemost. 57:158-164, 1987.

Unoki, M.; Furuta, S.; Onouchi, Y.; Watanabe, O.; Doi, S.; Fujiwara, H.; Miyatake, A.; Fujita, K.; Tamari, M.; Nakamura, Y.: Association studies of 33 single nucleotide polymorphisms (SNPs) in 29 candidate genes for bronchial asthma: positive association a T924C polymorphism in the thromboxane A2 receptor gene. Hum. Genet. 106:440-446, 2000.

Ades, E. W.; Zwerner, R. K.; Acton, R. T.; Balch, C. M.: Isolation and partial characterisation of the human homologue of Thy-1. J. Exp. Med. 151:400-406, 1980.

Bonewald, L.; Ades, E. W.; Tung, E.; Marchalonis, J. J.; Wang, A. C.: Biochemical characterization of human Thy-1. J. Immunogenet. 11:283-296, 1984.

Gatti, R. A.; Lathrop, G. M.; Salser, W.; Silver, J.; Lalouel, J. M.; White, R.: Location of Thy-1 with respect to a primary linkage map of chromosome 11q. (Abstract) Cytogenet. Cell Genet. 46:618only, 1987.

Gatti, R. A.; Shaked, R.; Wei, S.; Koyama, M.; Salser, W.; Silver, J.: DNA polymorphism in the human Thy-1 gene. Hum. Immun. 22:145-150, 1988.

Greenspan, R. J.; O'Brien, M. C.: Genetic evidence for the role of Thy-1 in neurite outgrowth in the mouse. J. Neurogenet. 5:25-36,1989.

Grzeschik, K.-H.; Kazazian, H. H.: Report of the committee on the genetic constitution of chromosomes 10, 11, and 12. Cytogenet. Cell Genet. 40:179-205, 1985.

Letarte-Muirhead, M.; Barclay, A. N.; Williams, A. F.: Purification of the Thy-1 molecule, a major cell surface glycoprotein of rat thymocytes. Biochem. J. 151:685-697, 1975.

Mansour, M. H.; Negm, H. I.; Cooper, E. L.: Thy-1 evolution. Dev. Comp. Immun. 11:3-15, 1987.

McKenzie, J. L.; Fabre, J. W.: Human Thy-1: unusual localization and possible functional significance in lymphoid tissues. J. Immun. 126:843-850, 1981.

Morris, R.: Thy-1 in developing nervous tissue. Dev. Neurosci. 7:133-160, 1985.

Raff, M. C.: Surface antigenic markers for distinguishing T and B lymphocytes in mice. Transplant. Rev. 6:52-80, 1971.

Rettig, W. J.; Dracopoli, N. C.; Chesa, P. G.; Spengler, B. A.; Beresford, H. R.; Davies, P.; Biedler, J. L.; Old, L. J.: Role of human chromosome 11 in determining surface antigenic phenotype of normal and malignant cells: somatic cell genetic analysis of eight antigens, including putative human Thy-1. J. Exp. Med. 162:1603-1619,1985.

Rettig, W. J.; Dracopoli, N. C.; Silver, J.; Old, L. J.: human THY-1: regional mapping on chromosome 11 and comparison with other chromosome 11-encoded cell surface glycoproteins. (Abstract) Cytogenet. Cell Genet. 40:731 only, 1985.

Rettig, W. J.; Dracopoli, N. C.; Spengler, B. A.; Biedler, J. L.; Old, L. J.: Somatic cell genetic analysis of human cell surface antigens, including putative human Thy-1: eight distinct antigenic systems controlled by chromosome 11. (Abstract) Cytogenet. CellGenet. 40:732 only, 1985.

Seki, T.; Spurr, N.; Obata, F.; Goyert, S.; Goodfellow, P.; Silver, J.: The human Thy-1 gene: structure and chromosomal location. Proc. Nat. Acad. Sci. 82:6657-6661, 1985.

Tse, A. G. D.; Barclay, A. N.; Watts, A.; Williams, A. F.: A glycophospholipid tail at the carboxyl terminus of the Thy-1 glycoprotein of neurons and thymocytes. Science 230:1003-1008, 1985.

Aso, T.; Tsai, P.; Kawaguchi, T.; Menninger, J. C.; Kitajima, S.; Yasukochi, Y.; Ward, D. C.; Weissman, S. M.: Assignment of the human GTF2F1 gene to chromosome 19p13.3. Genomics 16:252-253, 1993.

Aso, T.; Vasavada, H. A.; Kawaguchi, T.; Germino, F. J.; Ganguly, S.; Kitajima, S.; Weissman, S. M.; Yasukochi, Y.: characterization of cDNA for the large subunit of the transcription initiation factor TFIIF. Nature 355:461-464, 1992.

Finkelstein, A.; Kostrub, C. F.; Li, J.; Chavez, D. P.; Wang, B. Q.; Fang, S. M.; Greenblatt, J.; Burton, Z. F.: A cDNA encoding RAP74, a general initiation factor for transcription by RNA polymerase II. Nature 355:464-467, 1992.

Joliot, V.; Demma, M.; Prywes, R.: Interaction with RAP74 subunit of TFIIF is required for transcriptional activation by serum response factor. Nature 373:632-635, 1995.

Sopta, M.; Burton, Z. F.; Greenblatt, J.: Structure and associated DNA-helicase activity of a general transcription initiation factor that binds to RNA polymerase II. Nature 341:410-414, 1989.

Field, S. J.; Tsai, F.-Y.; Kuo, F.; Zubiaga, A. M.; Kaelin, W. G., Jr.; Livingston, D. M.; Orkin, S. H.; Greenberg, M. E.: E2F-1functions in mice to promote apoptosis and suppress proliferation. Cell 85:549-561, 1996.

Helin, K.; Lees, J. A.; Vidal, M.; Dyson, N.; Harlow, E.; Fattaey, A.: A cDNA encoding a pRB-binding protein with properties of the transcription factor E2F. Cell 70:337-350, 1992.

Irwin, M.; Marin, M. C.; Phillips, A. C.; Seelan, R. S.; Smith, D. I.; Liu, W.; Flores, E. R.; Tsai, K. Y.; Jacks, T.; Vousden, K. H.; Kaelin, W. G., Jr.: Role for the p53 homologue p73 in E2F-1-induced apoptosis. Nature 407:645-648, 2000.

Jacks, T.; Fazeli, A.; Schmitt, E. M.; Bronson, R. T.; Goodell, M. A.; Weinberg, R. A.: Effects of an Rb mutation in the mouse. Nature 359:295-300, 1992.

Lees, J. A.; Saito, M.; Valentine, M.; Look, T.; Harlow, E.; Dyson, N.; Helin, K.: The retinoblastoma protein binds to a family of E2F transcription factors. Molec. Cell. Biol. 13:7813-7825, 1993.

Leone, G.; Sears, R.; Huang, E.; Rempel, R.; Nuckolls, F.; Park, C.-H.; Giangrande, P.; Wu, L.; Saavedra, H. I.; Field, S. J.; Thompson, M. A.; Yang, H.; Fujiwara, Y.; Greenberg, M. E.; Orkin, S.; Smith, C.; Nevins, J. R.: Myc requires distinct E2F activities to induce S phase and apoptosis. Molec. Cell 8:105-113, 2001.

Lissy, N. A.; Davis, P. K.; Irwin, M.; Kaelin, W. G.; Dowdy, S. F.: A common E2F-1 and p73 pathway mediates cell death induced by TCR activation. Nature 407:642-645, 2000.

Neuman, E.; Sellers, W. R.; McNeil, J. A.; Lawrence, J. B.; Kaelin, W. G., Jr.: Structure and partial genomic sequence of the human E2F1gene. Gene 173:163-169, 1996.

Nevins, J. R.: The Rb/E2F pathway and cancer. Hum. Molec. Genet. 10:699-703, 2001.

Nevins, J. R.: E2F: a link between the Rb tumor suppressor protein and viral oncoproteins. Science 258:424-429, 1992.

Ohtani, K.; DeGregori, J.; Nevins, J. R.: Regulation of the cyclin E gene by transcription factor E2F1. Proc. Nat. Acad. Sci. 92:12146-12150,1995.

Arden, K. C.; Boutin, J.-M.; Djiane, J.; Kelly, P. A.; Cavenee, W. K.: The receptors for prolactin and growth hormone are localized in the same region of human chromosome 5. Cytogenet. Cell Genet. 53:161-165, 1990.

Arden, K. C.; Cavenee, W. K.; Boutin, J.-M.; Kelly, P. A.: The genes encoding the receptors for prolactin and growth hormone map to human chromosome 5. (Abstract) Am. J. Hum. Genet. 45 (suppl.):A129 only, 1989.

Boutin, J.-M.; Edery, M.; Shirota, M.; Jolicoeur, C.; Lesueur, L.; Ali, S.; Gould, D.; Djiane, J.; Kelly, P. A.: Identification of a cDNA encoding a long form of prolactin receptor in human hepatoma and breast cancer cells. Molec. Endocr. 3:1455-1461, 1989.

Cunningham, B. C.; Bass, S.; Fuh, G.; Wells, J. A.: Zinc mediation of the binding of human growth hormone to the human prolactin receptor. Science 250:1709-1712, 1990.

Glasow, A.; Horn, L.-C.; Taymans, S. E.; Stratakis, C. A.; Kelly, P. A.; Kohler, U.; Gillespie, J.; Vonderhaar, B. K.; Bornstein, S. R.: Mutational analysis of the PRL receptor gene in human breast tumors with differential PRL receptor protein expression. J. Clin. Endocr. Metab. 86:3826-3832, 2001.

Hu, Z.-Z.; Zhuang, L.; Meng, J.; Leondires, M.; Dufau, M. L.: The human prolactin receptor gene structure and alternative promoter utilization: the generic promoter hPIII and a novel human promoter hP(N). J. Clin. Endocr. Metab. 84:1153-1156, 1999.

Ormandy, C. J.; Camus, A.; Barra, J.; Damotte, D.; Lucas, B.; Buteau, H.; Edery, M.; Brousse, N.; Babinet, C.; Binart, N.; Kelly, P. A.: Null mutation of the prolactin receptor gene produces multiple reproductive defects in the mouse. Genes Dev. 11:167-178, 1997.

Perrot-Applanat, M.; Gualillo, O.; Pezet, A.; Vincent, V.; Edery, M.; Kelly, P. A.: Dominant negative and cooperative effects of mutant forms of prolactin receptor. Molec. Endocr. 11:1020-1032, 1997.

Cheng, S. Y.; Gong, Q. H.; Parkinson, C.; Robinson, E. A.; Appella, E.; Merlino, G. T.; Pastan, I.: The nucleotide sequence of a human cellular thyroid hormone-binding protein present in endoplasmic reticulum. J. Biol. Chem. 262: 11221-11227, 1987.

Koivu, J.; Myllyla, R.; Halaakoski, T.; Pihlajaniemi, T.; Tasanen, K.; Kivirikko, K. I.: A single polypeptide acts both as the beta subunit of prolyl 4-hydroxylase and as a protein disulfide-isomerase. J. Biol. Chem. 262:6447-6449, 1987.

Morris, J. I.; Varandani, P. T.: Characterization of a cDNA for human glutathione-insulin transhydrogenase (protein-disulfide isomerase/oxidoreductase). Biochim. Biophys. Acta 949:169-180, 1988.

Noiva, R.; Lennarz, W. J.: Protein disulfide isomerase: a multifunctional protein resident in the lumen of the endoplasmic reticulum. J. Biol. Chem. 267:3553-3556, 1992.

Pajunen, L.; Hoyhtya, M.; Tryggvason, K.; Kivirikko, K. I.; Myllyla, R.: Species-specific antibodies in the assignment of the gene for the beta-subunit of human prolyl 4-hydroxylase. (Abstract) Cytogenet. Cell Genet. 40:719 only, 1985.

Pajunen, L.; Jones, T. A.; Goddard, A.; Sheer, D.; Solomon, E.; Pihlajaniemi, T.; Kivirikko, K. I.: Regional assignment of the human gene coding for a multifunctional polypeptide (P4HB) acting as the beta-subunit of prolyl 4-hydroxylase and the enzyme protein disulfide isomerase to 17q25. Cytogenet. Cell Genet. 56:165-168, 1991.

Pajunen, L.; Myllyla, R.; Helaakoski, T.; Pihlajaniemi, T.; Tasanen, K.; Hoyhtya, M.; Tryggvason, K.; Solomon, E.; Kivirikko, K. I.: Assignment of the gene coding for both the beta-subunit of prolyl 4-hydroxylase and protein disulphide isomerase to human chromosome region 17q23-25.(Abstract) Cytogenet. Cell Genet. 46:674 only, 1987.

Pajunen, L.; Myllyla, R.; Helaakoski, T.; Pihlajaniemi, T.; Tasanen, K.; Hoyhtya, M.; Tryggvason, K.; Solomon, E.; Kivirikko, K. I.: Assignment of the gene coding for both the beta-subunit of prolyl 4-hydroxylase and the enzyme disulfide isomerase to human chromosome region 17p11-qter. Cytogenet. Cell Genet. 47:37-41, 1988.

Pihlajaniemi, T.; Helaakoski, T.; Tasanen, K.; Myllyla, R.; Huhtala, M.-L.; Koivu, J.; Kivirikko, K. I.: Molecular cloning of the beta-subunit of human prolyl 4-hydroxylase: this subunit and protein disulphide isomerase are products of the same gene. EMBO J. 6:643-649, 1987.

Popescu, N. C.; Cheng, S.; Pastan, I.: Chromosomal localization of the gene for a human thyroid hormone-binding protein. Am. J. Hum. Genet. 42:560-564, 1988.

Tasanen, K.; Parkkonen, T.; Chow, L. T.; Kivirikko, K. I.; Pihlajaniemi, T.: Characterization of the human gene for a polypeptide that acts both as the beta-subunit of prolyl 4-hydroxylase and as protein disulfide isomerase. J. Biol. Chem. 263:16218-16224, 1988.

Kelly, A.; Powis, S. H.; Glynne, R.; Radley, E.; Beck, S.; Trowsdale, J.: Second proteasome-related gene in the human MHC class II region. Nature 353:667-668, 1991.

Martinez, C. K.; Monaco, J. J.: Homology of proteasome subunits to a major histocompatibility complex-linked LMP gene. Nature 353:664-667, 1991.

Petes, T. D.: Meiotic recombination hot spots and cold spots. Nature Rev. Genet. 2:360-369, 2001.

Van Kaer, L.; Ashton-Rickardt, P. G.; Eichelberger, M.; Gaczynska, M.; Nagashima, K.; Rock, K. L.; Goldberg, A. L.; Doherty, P. C.; Tonegawa, S.: Altered peptidase and viral-specific T cell response in LMP2 mutant mice. Immunity 1:533-541, 1994.

Zhou, P.; Zanelli, E.; Smart, M.; David, C.: Genomic organization and tissue expression of mouse proteasome gene Lmp-2. Genomics 16:664-668, 1993.

Doolittle, R. F.; Hunkapiller, M. W.; Hood, L. E.; Devare, S. G.; Robbins, K. C.; Aaronson, S. A.; Antoniades, H. N.: Simian sarcoma virus onc gene, v-sis, is derived from the gene (or genes) encoding a platelet-derived growth factor. Science 221:275-277, 1983.

Frolova, L. Y.; Sudomoina, M. A.; Grigorieva, A. Y.; Zinovieva, O. L.; Kisselev, L. L.: Cloning and nucleotide sequence of the structural gene encoding for human tryptophanyl-tRNA synthetase. Gene 109:291-296, 1991.

Vassart, G.: Personal Communication. Brussels, Belgium Jan. 15, 1992.

Wenger, G. D.: Personal Communication. Columbus, Ohio Aug. 3, 1993.

Gardner, T. L.; Elston, D. M.; Wotowic, P. J.: A familial dermatofibrosarcoma protuberans. J. Am. Acad. Derm. 39:504-505, 1998.

Groffen, J.; Heisterkamp, N.; Stephenson, J. R.; Geurts van Kessel, A.; de Klein, A.; Grosveld, G.; Bootsma, D.: c-sis is translocated from chromosome 22 to chromosome 9 in chronic myelocytic leukemia. J. Exp. Med. 158:9-15, 1983.

Hermansson, M.; Nister, M.; Betsholtz, C.; Heldin, C.-H.; Westermark, B.; Funa, K.: Endothelial cell hyperplasia in human glioblastoma: coexpression of mRNA for platelet-derived growth factor (PDGF) B chain and PDGF receptor suggests autocrine growth stimulation. Proc. Nat. Acad. Sci. 85:7748-7752, 1988.

Josephs, S. F.; Dalla-Favera, R.; Gelmann, E. P.; Gallo, R. C.; Wong-Staal, F.:5-prime viral and human cellular sequences corresponding to the transforming gene of simian sarcoma virus. Science 219:503-505,1983.

Josephs, S. F.; Guo, C.; Ratner, L.; Wong-Staal, F.: Human proto-oncogene nucleotide sequences corresponding to the transforming region of simian sarcoma virus. Science 223: 487-491, 1984.

Josephs, S. F.; Ratner, L.; Clarke, M. F.; Westin, E. H.; Reitz, M. S.; Wong-Staal, F.: Transforming potential of human c-sis Nucleotide sequences encoding platelet-derived growth factor. Science 225:636-639, 1984.

Kelly, J. D.; Raines, E. W.; Ross, R.; Murray, M. J.: The B chain of PDGF alone is sufficient for mitogenesis. EMBO J. 4:3399-3405,1985.

Kiuru-Kuhlefelt, S.; El-Rifai, W.; Fanburg-Smith, J.; Kere, J.; Miettinen, M.; Knuutila, S.: Concomitant DNA copy number amplification at 17q and 22q in dermatofibrosarcoma protuberans. Cytogenet. Cell Genet. 92:192-195, 2001.

Kozak, C. A.; Sears, J. F.; Hoggan, M. D.: Genetic mapping of the mouse proto-oncogene c-sis to chromosome 15. Science 221:867-869,1983.

Lindahl, P.; Johansson, B. R.; Leveen, P.; Betsholtz, C.: Pericyte loss and microaneurysm formation in PDGF-B-deficient mice. Science 277:242-245, 1997.

Owen, A. J.; Pantazis, P.; Antoniades, H. N.: Simian sarcoma virus-transformed cells secrete a mitogen identical to platelet-derived growth factor. Science 225:54-56, 1984.

Rao, C. D.; Igarashi, H.; Chiu, I.-M.; Robbins, K. C.; Aaronson, S. A.: Structure and sequence of the human c-sis/platelet-derived growth factor 2 (SIS/PDGF2) transcriptional unit. Proc. Nat. Acad. Sci. 83:2392-2396, 1986.

Robbins, K. C.; Antoniades, H. N.; Devare, S. G.; Hunkapiller, M. W.; Aaronson, S. A.: Structural and immunological similarities between simian sarcoma virus gene product (s) and human platelet-derived growth factor. Nature 305:605-608, 1983.

Robbins, K. C.; Devare, S. G.; Reddy, E. P.; Aaronson, S. A.:In vivo identification of the transforming gene product of simian sarcoma virus. Science 218:1131-1133, 1982.

Simon, M.-P.; Navarro, M.; Roux, D.; Pouyssegur, J.: Structural and functional analysis of a chimeric protein COL1A1-PDGFB generated by the translocation t (17;22) (q22; q13.1) in dermatofibrosarcoma protuberans (DP). Oncogene 20:2965-2975, 2001.

Smidt, M.; Kirsch, I.; Ratner, L.: Deletion of Alu sequences in the fifth c-sis intron in individuals with meningiomas. J. Clin. Invest. 86:1151-1157, 1990.

Turc-Carel, C.; Philip, I.; Berger, M. P.; Philip, T.; Lenoir, G. M.: Chromosomal translocations in Ewing's sarcoma. (Letter) New Eng. J. Med. 309:497-498, 1983.

Shimizu, A.; O'Brien, K. P.; Sjoblom, T.; Pietras, K.; Buchdunger, E.; Collins, V. P.; Heldin, C.-H.; Dumanski, J. P.; Ostman, A.: The dermatofibrosarcoma protuberans-associated collagen type I-alpha-1/platelet-derived growth factor (PDGF) beta-chain fusion gene generates a transforming protein that is processed to functional PDGF-BB. Cancer Res. 59:3719-3723, 1999.

Waterfield, M. D.; Scrace, G. T.; Whittle, N.; Stroobant, P.; Johnsson, A.; Wasteson, A.; Westermark, B.; Heldin, C.-H.; Huang, J. S.; Deuel, T. F.: Platelet-derived growth factor is structurally related to the putative transforming protein p28 (sis) of simian sarcomavirus. Nature 304:35-39, 1983.

Simon, M.-P.; Pedeutour, F.; Sirvent, N.; Grosgeorge, J.; Minoletti, F.; Coindre, J.-M.; Terrier-Lacombe, M.-J.; Mandahl, N.; Craver, R. D.; Blin, N.; Sozzi, G.; Turc-Carel, C.; O'Brien, K. P.; Kedra, D.; Fransson, I.; Guilbaud, C.; Dumanski, J. P.: Deregulation of the platelet-derived growth factor B-chain gene via fusion with collagen gene COL1A1 in dermatofibrosarcoma protuberans and giant-cell fibroblastoma. Nature Genet. 15:95-98, 1997.

Graphodatsky, A.; Frolova, L.; Biltueva, L.; Eremina, V.; Lushnikova, T.; Sudomoina, M.; Zinovieva, O.; Kisselev, L.: Localization of the tryptophanyl tRNA synthetase gene (WARS) on human and bovine chromosomes by in situ hybridization. Mammalian Genome 4:183-184, 1993.

Jensen, L. L.; Nielsen, M. M.; Justesen, J.; Hansen, L. L.: Assignment of human NADH dehydrogenase (ubiquinone) 1 beta subcomplex 3 (NDUFB3) and of its four pseudogenes to human chromosomes 2q31.3, 1p13.3-p13.1,9q32-q34.1, 14q22.3-q23.1 and 14q32.2 by radiation hybrid mapping. Cytogenet. Cell Genet. 93:147-150, 2001.

Otani, A.; Slike, B. M.; Dorrell, M. I.; Hood, J.; Kinder, K.; Ewalt, K. L.; Cheresh, D.; Schimmel, P.; Friedlander, M.: A fragment of human TrpRS as a potent antagonist of ocular angiogenesis. Proc. Nat. Acad. Sci. 99:178-183, 2002.

Shimizu, N.; Kucherlapati, R. S.; Ruddle, F. H.: Assignment of a human gene for tryptophanyl-tRNA synthetase to chromosome 14 using human-mouse somatic cell hybrids. Somat. Cell Genet. 2:345-357,1976.

Tolstrup, A. B.; Bejder, A.; Fleckner, J.; Justesen, J.: Transcriptional regulation of the interferon-gamma-inducible tryptophanyl-tRNA synthetase includes alternative splicing. J. Biol. Chem. 270:397-403, 1995.

Turpaev, K. T.; Zakhariev, V. M.; Sokolova, I. V.; Narovlyansky, A. N.; Amchenkova, A. M.; Justesen, J.; Frolova, L. Y.: Alternative processing of the tryptophanyl-tRNA synthetase mRNA from interferon-treated human cells. Europ. J. Biochem. 240:732-737, 1996.

Wakasugi, K.; Slike, B. M.; Hood, J.; Otani, A.; Ewalt, K. L.; Friedlander, M.; Cheresh, D. A.; Schimmel, P.: A human aminoacyl-tRNA synthetase as a regulator of angiogenesis. Proc. Nat. Acad. Sci. 99:173-177, 2002.

Miller, J. S.; Moxley, G.; Schwartz, L. B.: Cloning and characterization of a second complementary DNA for human tryptase. J. Clin. Invest. 86:864-870, 1990.

Miller, J. S.; Westin, E. H.; Schwartz, L. B.: Cloning and characterization of complementary DNA for human tryptase. J. Clin. Invest. 84:1188-1195,1989.

Vanderslice, P.; Ballinger, S. M.; Tam, E. K.; Goldstein, S. M.; Craik, C. S.; Caughey, G. H.: Human mast cell tryptase: multiple cDNAs and genes reveal a multigene serine protease family. Proc. Nat. Acad. Sci. 87:3811-3815, 1990.

Mach, B.; Steimle, V.; Reith, W.: MHC class II-deficient combined immunodeficiency: a disease of gene regulation. Immun. Rev. 138:207-221, 1994.

Sukhatme, V. P.; Vollmer, A. C.; Erikson, J.; Isobe, M.; Croce, C.; Parnes, J. R.: Gene for the human T cell differentiation antigen Leu-2/T8 is closely linked to the kappa light chain locus on chromosome 2. J. Exp. Med. 161:429-434, 1985.

Traver, D.; Akashi, K.; Manz, M.; Merad, M.; Miyamoto, T.; Engleman, E. G.; Weissman, I. L.: Development of CD8-alpha-positive dendritic cells from a common myeloid progenitor. Science 290:2152-2154,2000.

Weichhold, G. M.; Huber, C.; Parnes, J. R.; Zachau, H. G.: TheCD8-alpha locus is located on the telomere side of the immunoglobulin-kappa locus at a distance of 2 Mb. Genomics 16:512-514, 1993.

Balk, S. P.; Burke, S.; Polischuk, J. E.; Frantz, M. E.; Yang, L.; Porcelli, S.; Colgan, S. P.; Blumberg, R. S.: Beta-2-microglobulin-independent MHC class Ib molecule expressed by human intestinal epithelium. Science 265:259-262, 1994.

Benlagha, K.; Kyin, T.; Beavis, A.; Teyton, L.; Bendelac, A.: A thymic precursor to NK T cell lineage. Science 296:553-555, 2002.

Bradbury, A.; Milstein, C.; Kozak, C. A.: Chromosomal localization of Cd1d genes in the mouse. Somat. Cell Molec. Genet. 17:93-96,1991.

Honey, K.; Benlagha, K.; Beers, C.; Forbush, K.; Teyton, L.; Kleijmeer, M. J.; Rudensky, A. Y.; Bendelac, A.: Thymocyte expression of cathepsin L is essential for NKT cell development. Nature Immun. 7Oct, 2002. Note: Advance Electronic Publication.

MacDonald, H. R.: T before NK. Science 296:481-482, 2002.

Pellicci, D. G.; Hammond, K. J. L.; Uldrich, A. P.; Baxter, A. G.; Smyth, M. J.; Godfrey, D. I.: A natural killer T (NKT) cell developmental pathway involving a thymus-dependent NK1.1(-)CD4(+) CD1d-dependent precursor stage. J. Exp. Med. 195:835-844, 2002.

Prigozy, T. I.; Naidenko, O.; Qasba, P.; Elewaut, D.; Brossay, L.; Khurana, A.; Natori, T.; Koezuka, Y.; Kulkarni, A.; Kronenberg, M.: Glycolipid antigen processing for presentation by CD1d molecules. Science 291:664-667, 2001.

Shi, F.-D.; Flodstrom, M.; Balasa, B.; Kim, S. H.; Van Gunst, K.; Strominger, J. L.; Wilson, S. B.; Sarvetnick, N.: Germ line Deletion of the CD1 locus exacerbates diabetes in the NOD mouse. Proc. Nat. Acad. Sci. 98:6777-6782, 2001.

Azarnia, R.; Reddy, S.; Kmiecik, T. E.; Shalloway, D.; Loewenstein, W. R.: The cellular src gene product regulates junctional cell-to-cell communication. Science 239:398-401, 1988.

Czernilofsky, A. P.; Levinson, A. D.; Varmus, H. E.; Bishop, J. M.; Tischer, E.; Goodman, H.: Correction to the nucleotide sequence of the src gene of Rous sarcoma virus. Nature 301:736-738, 1983.

Gibbs, C. P.; Tanaka, A.; Anderson, S. K.; Radul, J.; Baar, J.; Ridgway, A.; Kung, H.-J.; Fujita, D. J.: Isolation and structural mapping of a human c-src gene homologous to the transforming gene (v-src) of Rous sarcoma virus. J. Virol. 53:19-24, 1985.

Irby, R. B.; Mao, W.; Coppola, D.; Kang, J.; Loubeau, J. M.; Trudeau, W.; Karl, R.; Fujita, D. J.; Jove, R.; Yeatman, T. J.: Activating SRC mutation in a subset of advanced human colon cancers. Nature Genet. 21:187-190, 1999.

Le Beau, M. M.; Westbrook, C. A.; Diaz, M. O.; Rowley, J. D.: c-src is consistently conserved in the chromosomal deletion (20q) observed in myeloid disorders. Proc. Nat. Acad. Sci. 82:6692-6696,1985.

Lowe, C.; Yoneda, T.; Boyce, B. F.; Chen, H.; Mundy, G. R.; Soriano, P.: Osteopetrosis in Src-deficient mice is due to an autonomous defect of osteoclasts. Proc. Nat. Acad. Sci. 90:4485-4489, 1993.

Morris, C. M.; Honeybone, L. M.; Hollings, P. E.; Fitzgerald, P. H.: Localization of the SRC oncogene to chromosome band 20q11.2and loss of this gene with deletion (20q) in two leukemic patients. Blood 74:1768-1773, 1989.

Sakaguchi, A. Y.; Mohandas, T.; Naylor, S. L.: A human c-src gene resides on the proximal long arm of chromosome 20 (cen-q13.1). Cancer Genet. Cytogenet. 18:123-129, 1985.

Sakaguchi, A. Y.; Naylor, S. L.; Weinberg, R. A.; Shows, T. B.: Organization of human proto-oncogenes. (Abstract) Am. J. Hum. Genet. 34:175A, 1982.

Sakaguchi, A. Y.; Zabel, B. U.; Grzeschik, K. H.; Law, M. L.; Naylor, S. L.: Human proto-oncogene assignments. (Abstract) Cytogenet. Cell Genet. 37:572-573, 1984.

Wong, B. R.; Besser, D.; Kim, N.; Arron, J. R.; Vologodskaia, M.; Hanafusa, H.; Choi, Y.: TRANCE, a TNF family member, activates Akt/PKB through a signaling complex involving TRAF6 and c-Src. Molec. Cell 4:1041-1049, 1999.

McGuire, W.; Hill, A. V. S.; Allsopp, C. E. M.; Greenwood, B. M.; Kwiatkowski, D.: Variation in the TNF-alpha promoter region associated with susceptibility to cerebral malaria. Nature 371:508-511, 1994.

Benbrook, D.; Pfahl, M.: A novel thyroid hormone receptor encoded by a cDNA clone from a human testis library. Science 238:788-791,1987.

Bernal, J.; Refetoff, S.; DeGroot, L. J.: Abnormalities of triiodothyronine binding to lymphocyte and fibroblast nuclei from a patient with peripheral tissue resistance to thyroid hormone action. J. Clin. Endocr. Metab. 47:1266-1272, 1978.

Dayton, A. I.; Selden, J. R.; Laws, G.; Dorney, D. J.; Finan, J.; Tripputi, P.; Emanuel, B. S.; Rovera, G.; Nowell, P. C.; Croce, C. M.: A human c-erbA oncogene homologue is closely proximal to the chromosome 17 breakpoint in acute promyelocytic leukemia. Proc. Nat. Acad. Sci. 81:4495-4499, 1984.

Debuire, B.; Henry, C.; Benaissa, M.; Biserte, G.; Claverie, J. M.; Saule, S.; Martin, P.; Stehelin, D.: Sequencing the erbA gene of avian erythroblastosis virus reveals a new type of oncogene. Science 224:1456-1459, 1984.

Ferro, M. T.; San Roman, C.: Constitutional t (15;17). Cancer Genet. Cytogenet. 4:89-91, 1981.

Gullberg, H.; Rudling, M.; Forrest, D.; Angelin, B.; Vennstrom, B.: Thyroid hormone receptor beta-deficient mice show complete loss of the normal cholesterol 7-alpha-hydroxylase (CYP7A) response to thyroid hormone but display enhanced resistance to dietary cholesterol. Molec. Endocr. 14:1739-1749, 2000.

Ichikawa, K.; Hughes, I. A.; Horwitz, A. L.; DeGroot, L. J.: characterization of nuclear thyroid hormone receptors of cultured skin fibroblasts from patients with resistance to thyroid hormone. Metabolism 36:392-399, 1987.

Iskaros, J.; Pickard, M.; Evans, I.; Sinha, A.; Hardiman, P.; Ekins, R.: Thyroid hormone receptor gene expression in first trimester human fetal brain. J. Clin. Endocr. Metab. 85:2620-2623, 2000.

Jansson, M.; Philipson, L.; Vennstrom, B.: Isolation and characterization of multiple human genes homologous to the oncogenes of avian erythroblastosis virus. EMBO J. 2:561-565, 1983.

Jhanwar, S. C.; Chaganti, R. S. K.; Croce, C. M.: Germ-line chromosomal localization of human c-erb-A oncogene. Somat. Cell Molec. Genet. 11:99-102, 1985.

Kaneshige, M.; Suzuki, H.; Kaneshige, K.; Cheng, J.; Wimbrow, H.; Barlow, C.; Willingham, M. C.; Cheng, S.: A targeted dominant negative mutation of the thyroid hormone alpha-1 receptor causes increased mortality, infertility, and dwarfism in mice. Proc. Nat. Acad. Sci. 98:15095-15100, 2001.

Laudet, V.; Begue, A.; Henry-Duthoit, C.; Joubel, A.; Martin, P.; Stehelin, D.; Saule, S.: Genomic organization of the human thyroid hormone receptor alpha (c-erbA-1) gene. Nucleic Acids Res. 19:1105-1112,1991.

Le Beau, M. M.; Westbrook, C. A.; Diaz, M. O.; Rowley, J. D.; Oren, M.: Translocation of the p53 gene in t (15;17) in acute promyelocytic leukaemia. Nature 316:826-828, 1985.

Mathieu-Mahul, D.; Xu, D. Q.; Saule, S.; Lidereau, R.; Galibert, F.; Berger, R.; Mauchauffe, M.; Larsen, C. J.: An EcoRI restriction fragment length polymorphism (RFLP) in the human c-erb A locus. Hum. Genet. 71:41-44, 1985.

McCabe, C. J.; Gittoes, N. J.; Sheppard, M. C.; Franklyn, J. A.: Thyroid receptor alpha-1 and alpha-2 mutations in non-functioning pituitary tumors. J. Clin. Endocr. Metab. 84:649-653, 1999.

Menezes-Ferreira, M. M.; Eil, C.; Wortsman, J.; Weintraub, B. D.: Decreased nuclear uptake of [125-I]triiodo-L-thyronine in fibroblasts from patients with peripheral thyroid hormone resistance. J. Clin. Endocr. Metab. 59:1081-1087, 1984.

Mitelman, F.; Manolov, G.; Manolova, Y.; Billstrom, R.; Heim, S.; Kristoffersson, U.; Mandahl, N.; Ferro, M. T.; San Roman, C.: High resolution chromosome analysis of constitutional and acquired t (15;17) maps c-erbA to subband 17q11.2. Cancer Genet. Cytogenet. 22:95-98, 1986.

Miyajima, N.; Horiuchi, R.; Shibuya, Y.; Fukushige, S.; Matsubara, K.; Toyoshima, K.; Yamamoto, T.: Two erbA homologs encoding proteins with different T(3) binding capacities are transcribed from opposite DNA strands of the same genetic locus. Cell 57:31-39, 1989.

Nagaya, T.; Nomura, Y.; Fujieda, M.; Seo, H.: Heterodimerization preferences of thyroid hormone receptor alpha isoforms. Biochem. Biophys. Res. Commun. 226:426-430, 1996.

Nakai, A.; Seino, S.; Sakurai, A.; Szilak, I.; Bell, G. I.; DeGroot, L. J.: Characterization of a thyroid hormone receptor expressed in human kidney and other tissues. Proc. Nat. Acad. Sci. 85:2781-2785,1988.

Ng, L.; Rusch, A.; Amma, L. L.; Nordstrom, K.; Erway, L. C.; Vennstrom, B.; Forrest, D.: Suppression of the deafness and thyroid dysfunction in Thrb-null mice by an independent mutation in the Thra thyroid hormone receptor gene. Hum. Molec. Genet. 10:2701-2708, 2001.

Puzianowska-Kuznicka, M.; Krystyniak, A.; Madej, A.; Cheng, S.-Y.; Nauman, J.: Functionally impaired TR mutants are present in thyroid papillary cancer. J. Clin. Endocr. Metab. 87:1120-1128, 2002.

Refetoff, S.; DeGroot, L. J.; Benard, B.; DeWind, L. T.: Studies of a sibship with apparent hereditary resistance to the intracellular action of thyroid hormone. Metabolism 21:723-756, 1972.

Rider, S. H.; Bailey, C. J.; Voss, R.; Sheer, D.; Hiorns, L. R.; Solomon, E.: RFLP for the human erb-A1 gene. Nucleic Acids Res. 15:863 only, 1987.

Sakurai, A.; Nakai, A.; DeGroot, L. J.: Expression of three forms of thyroid hormone receptor in human tissues. Molec. Endocr. 3:392-399, 1989.

Cerretti, D. P.; Lyman, S. D.; Kozlosky, C. J.; Copeland, N. G.; Gilbert, D. J.; Jenkins, N. A.; Valentine, V.; Kirstein, M. N.; Shapiro, D. N.; Morris, S. W.: The genes encoding the Eph-related receptor tyrosine kinase ligands LERK-1 (EPLG1, Epl1), LERK-3 (EPLG3, Epl3), and LERK-4 (EPLG4, Epl4) are clustered on human chromosome 1 and mouse chromosome 3. Genomics 33:277-282, 1996.

Holzman, L. B.; Marks, R. M.; Dixit, V. M.: A novel immediate-early response gene of endothelium is induced by cytokines and encodes a secreted protein. Molec. Cell. Biol. 10:5830-5838, 1990.

Pandey, A.; Lindberg, R. A.; Dixit, V. M.: Receptor orphans find a family. Curr. Biol. 5:986-989, 1995.

Bunz, F.; Dutriaux, A.; Lengauer, C.; Waldman, T.; Zhou, S.; Brown, J. P.; Sedivy, J. M.; Kinzler, K. W.; Vogelstein, B.: Requirement for p53 and p21 to sustain G2 arrest after DNA damage. Science 282:1497-1501, 1998.

Gimona, M.; Small, J. V.; Moeremans, M.; Van Damme, J.; Puype, M.; Vandekerckhove, J.: Porcine vinculin and metavinculin differ by a 68-residue insert located close to the carboxy-terminal part of the molecule. EMBO J. 7:2329-2334, 1988.

Burglen, L.; Amiel. J.; Viollet, L.; Lefebvre, S.; Burlet, P.; Clermont, O.; Raclin, V.; Landrieu, P.; Verloes, A.; Munnich, A.; Melki, J.: Survival motor neuron gene deletion in the arthrogryposis multiplex congenita-spinal muscular atrophy association. J. Clin. Invest. 98:1130-1132, 1996.

Lee, F. S.; Fox, E. A.; Zhou, H.-M.; Strydom, D. J.; Vallee, B. L.: Primary structure of human placental ribonuclease inhibitor. Biochemistry 27:8545-8553, 1988.

Weremowicz, S.; Fox, E. A.; Morton, C. C.; Vallee, B. L.: The placental ribonuclease inhibitor (RNH) gene is located on chromosome subband 11p15.5. Genomics 8:717-721, 1990.

Zneimer, S. M.; Crawford, D.; Schneider, N. R.; Beutler, B.: mapping of the human ribonuclease inhibitor gene (RNH) to chromosome 11p15by in situ hybridization. Genomics 8:175-178, 1990.

Siu, G.; Wurster, A. L.; Duncan, D. D.; Soliman, T. M.; Hedrick, S. M.: A transcriptional silencer controls the developmental expression of the CD4 gene. EMBO J. 13:3570-3579, 1994.

Zhang, K.; Westberg, J. A.; Paetau, A.; von Boguslawsky, K.; Lindsberg, P.; Erlander, M.; Guo, H.; Su, J.; Olsen, H. S.; Andersson, L. C.: High expression of stanniocalcin in differentiated brain neurons. Am. J. Path. 153:439-445, 1998.

Alexopoulou, L.; Thomas, V.; Schnare, M.; Lobet, Y.; Anguita, J.; Schoen, R. T.; Medzhitov, R.; Fikrig, E.; Flavell, R. A.: Hyporesponsiveness to vaccination with Borrelia burgdorferi OspA in human S and in TLR1-and TLR2-deficient mice. Nature Med. 8:878-884, 2002.

Gay, N. J.; Keith, F. J.: Drosophila Toll and IL-1 receptor. (Letter) Nature 351:355-356, 1991.

Muzio, M.; Bosisio, D.; Polentarutti, N.; d'amico, G.; Stoppacciaro, A.; Mancinelli, R.; van't Veer, C.; Penton-Rol, G.; Ruco, L. P.; Allavena, P.; Mantovani, A.: Differential expression and regulation of Toll-like receptors (TLR) in human leukocytes: selective expression of TLR3 in dendritic cells. J. Immun. 164:5998-6004, 2000.

Rock, F. L.; Hardiman, G.; Timans, J. C.; Kastelein, R. A.; Bazan, J. F.: A family of human receptors structurally related to Drosophila Toll. Proc. Nat. Acad. Sci. 95:588-593, 1998.

Taguchi, T.; Mitcham, J. L.; Dower, S. K.; Sims, J. E.; Testa, J. R.: Chromosomal localization of TIL, a gene encoding a protein related to the Drosophila transmembrane receptor Toll, to human chromosome 4p14. Genomics 32:486-488, 1996.

Xu, Y.; Tao, X.; Shen, B.; Horng, T.; Medzhitov, R.; Manley, J. L.; Tong, L.: Structural basis for signal transduction by the Toll/interleukin-1receptor domains. Nature 408:111-115, 2000.

Perrimon, N.; Mahowald, A. P.: Multiple functions of segment polarity genes in Drosophila. Dev. Biol. 119:587-600, 1987.

Pizzuti, A.; Novelli, G.; Mari, A.; Ratti, A.; Colosimo, A.; Amati, F.; Penso, D.; Sangiuolo, F.; Calabrese, G.; Palka, G.; Silani, V.; Gennarelli, M.; Mingarelli, R.; Scarlato, G.; Scambler, P.; Dallapiccola, B.: Human homologue sequences to the Drosophila dishevelled segment-polarity gene are deleted in the DiGeorge syndrome. Am. J. Hum. Genet. 58:722-729, 1996.

Brown, E. J.; Albers, M. W.; Shin, T. B.; Ichikawa, K.; Keith, C. T.; Lane, W. S.; Schreiber, S. L.: A mammalian protein targeted by G1-arresting rapamycin-receptor complex. Nature 369:756-758,1994.

Dennis, P. B.; Jaeschke, A.; Saitoh, M.; Fowler, B.; Kozma, S. C.; Thomas, G.: Mammalian TOR: a homeostatic ATP sensor. Science 294:1102-1105, 2001.

Fang, Y.; Vilella-Bach, M.; Bachmann, R.; Flanigan, A.; Chen, J.: Phosphatidic acid-mediated mitogenic activation of mTOR signaling. Science 294:1942-1945, 2001.

Hara, K.; Maruki, Y.; Long, X.; Yoshino, K.; Oshiro, N.; Hidayat, S.; Tokunaga, C.; Avruch, J.; Yonezawa, K.: Raptor, a binding partner of target of rapamycin, mediates TOR action. Cell 110:177-189,2002.

Kim, D.-H.; Sarbassov, D. D.; Ali, S. M.; King, J. E.; Latek, R. R.; Erdjument-Bromage, H.; Tempst, P.; Sabatini, D. M.: mTOR interacts with raptor to form a nutrient-sensitive complex that signals to the cell growth machinery. Cell 110:163-175, 2002.

Lench, N. J.; Macadam, R.; Markham, A. F.: The human gene encoding FKBP-rapamycin associated protein (FRAP) maps to chromosomal band 1p36.2. Hum. Genet. 99:547-549, 1997.

Moore, P. A.; Rosen, C. A.; Carter, K. C.: Assignment of the human FKBP12-rapamycin-associated protein (FRAP) gene to chromosome 1p36 by fluorescence in situ hybridization. Genomics 33:331-332, 1996.

Onyango, P.; Lubyova, B.; Gardellin, P.; Kurzbauer, R.; Weith, A.: Molecular cloning and expression analysis of five novel genes in chromosome 1p36. Genomics 50:187-198, 1998.

Sabatini, D. M.; Erdjument-Bromage, H.; Lui, M.; Tempst, P.; Snyder, S. H.: RAFT1: a mammalian protein that binds to FKBP12 in a rapamycin-dependent fashion and is homologous to yeast TORs. Cell 78:35-43, 1994.

Barbier, M.; Attoub, S.; Calvez, R.; Laffargue, M.; Jarry, A.; Mareel, M.; Altruda, F.; Gespach, C.; Wu, D.; Lu, B.; Hirsch, E.; Wymann, M. P.: Weakening link to colorectal cancer? Nature 413:796 only, 2001.

Crackower, M. A.; Oudit, G. Y.; Kozieradzki, I.; Sarao, R.; Sun, H.; Sasaki, T.; Hirsch, E.; Suzuki, A.; Shioi, T.; Irie-Sasaki, J.; Sah, R.; Cheng, H.-Y. M.; and 13 others: Regulation of myocardial contractility and cell size by distinct PI3K-PTEN signaling pathways. Cell 110:737-749, 2002.

Hirsch, E.; Katanaev, V. L.; Garlanda, C.; Azzolino, O.; Pirola, L.; Silengo, L.; Sozzani, S.; Mantovani, A.; Altruda, F.; Wymann, M. P.: Central role for G protein-coupled phosphoinositide 3-kinase gamma in inflammation. Science 287: 1049-1053, 2000.

Jiang, K.; Zhong, B.; Gilvary, D. L.; Corliss, B. C. Hong-Geller, E.; Wei, S; Djeu, J. Y.: Pivotal role of phosphoinositide-3 kinase in regulation of cytotoxicity in natural killer cells. Nature Immun. 1:419-425, 2000.

Kikuta, Y.; Kato, M.; Yamashita, Y.; Miyauchi, Y.; Tanaka, K.; Kamada, N.; Kusunose, M.: Human leukotriene B4 omega-hydroxylase (CYP4F3) gene: molecular cloning and chromosomal localization. DNA Cell Biol. 17:221-230, 1998.

Kikuta, Y.; Kusunose, E.; Endo, K.; Yamamoto, S.; Sogawa, K.; Fujii-Kuriyama,Y.; Kusunose, M.: A novel form of cytochrome P-450 family 4 in human polymorphonuclear leukocytes: cDNA cloning and expression of leukotriene B4 omega-hydroxylase. J. Biol. Chem. 268:9376-9380, 1993.

Klingensmith, J.; Nusse, R.; Perrimon, N.: The Drosophila segment polarity gene dishevelled encodes a novel protein required for response to wingless signal. Genes Dev. 8:118-130, 1994.

Holmes, S. E.; Riazi, M. A.; Gong, W.; McDermid, H. E.; Sellinger, B. T.; Hua, A.; Chen, F.; Wang, Z.; Zhang, G.; Roe, B.; Gonzalez, I.; McDonald-McGinn, D. M.; Zackai, E.; Emanuel, B. S.; Budarf, M. L.: Disruption of the clathrin heavy chain-like gene (CLTCL) associated with features of DGS/VCFS: a balanced (21;22)(p12; q11) translocation. Hum. Molec. Genet. 6:357-367, 1997.

Kedra, D.; Peyrard, M.; Fransson, I.; Collins, J. E.; Dunham, I.; Roe, B. A.; Dumanski, J. P.: Characterization of a second human clathrin heavy chain polypeptide gene (CLH-22) from chromosome 22q11. Hum. Molec. Genet. 5:625-631, 1996.

Long, K. R.; Trofatter, J. A.; Ramesh, V.; McCormick, M. K.; Buckler, A. J.: Cloning and characterization of a novel human clathrin heavy chain gene (CLTCL). Genomics 35:466-472, 1996.

Lagenaur, C.; Kunemund, V.; Fischer, G.; Fushiki, S.; Schachner, M.: Monoclonal M6 antibody interferes with neurite extension of cultured neurons. J. Neurobiol. 23:71-88, 1992.

Shimizu, F.; Watanabe, T. K.; Fujiwara, T.; Takahashi, E.; Nakamura, Y.; Maekawa, H.: Isolation and mapping of the human glycoprotein M6 gene (GPM6A) to 4q33-to-q34. Cytogenet. Cell Genet. 74:138-139,1996.

Bui, T. D.; Beier, D. R.; Jonssen, M.; Smith, K.; Dorrington, S. M.; Kaklamanis, L.; Kearney, L.; Regan, R.; Sussman, D. J.; Harris, A. L.: cDNA cloning of a human dishevelled DVL-3 gene, mapping to 3q27, and expression in human breast and colon carcinomas. Biochem. Biophys. Res. Commun. 239:510-516, 1997.

Cheng, Y.-S. E.; Patterson, C. E.; Staeheli, P.: Interferon-induced guanylate-binding proteins lack an N(T)KXD consensus motif and bind GMP in addition to GDP and GTP. Molec. Cell. Biol. 11:4717-4725,1991.

Kumar, S.; Li, Q.; Dua, A.; Ying, Y.-K.; Bagchi, M. K.; Bagchi, I. C.: Messenger ribonucleic acid encoding interferon-inducible guanylate binding protein 1 is induced in human endometrium within the putative window of implantation. J. Clin. Endocr. Metab. 86:2420-2427, 2001.

Prochazka, M.; Staeheli, P.; Holmes, R. S.; Haller, O.: Interferon-induced guanylate-binding proteins: mapping of the murine Gbp-1 locus to chromosome 3. Virology 145:273-279, 1985.

Strehlow, I.; Lohmann-Matthes, M. L.; Decker, T.: The interferon-inducible GBP1 gene: structure and mapping to human chromosome 1. Gene 144:295-299, 1994.

Avraham, K. B.; Prezioso, V. R.; Chen, W. S.; Lai, E.; Sladek, F. M.; Zhong, W.; Darnell, J. E., Jr.; Jenkins, N. A.; Copeland, N. G.: Murine chromosomal location of four hepatocyte-enriched transcription factors: HNF-3-alpha, HNF3-beta, HNF-3-gamma, and HFN-4. Genomics 13:264-268, 1992.

Chartier, F. L.; Bossu, J.-P.; Laudet, V.; Fruchart, J.-C.: Cloning and sequencing of cDNAs encoding the human hepatocyte nuclear factor 4 indicate the presence of two isoforms in human liver. Gene 147:269-272, 1994.

Eeckhoute, J.; Formstecher, P.; Laine, B.: Maturity-onset diabetes of the young type 1 (MODY1)-associated mutations R154X and E276Q in hepatocyte nuclear factor 4-alpha (HNF4-alpha) gene impair recruitment of p300, a key transcriptional coactivator. Molec. Endocr. 15:1200-1210,2001.

Furuta, H.; Iwasaki, N.; Oda, N.; Hinokio, Y.; Horikawa, Y.; Yamagata, K.; Yano, N.; Sugahiro, J.; Ogata, M.; Ohgawara, H.; Omori, Y.; Iwamoto, Y.; Bell, G. I.: Organization and partial sequence of the hepatocyte nuclear factor-4-alpha/MODY1 gene and identification of a missense mutation, R127W, in a Japanese family with MODY. Diabetes 46:1652-1657,1997.

Hani, E. H.; Suaud, L.; Boutin, P.; Chevre, J.-C.; Durand, E.; Philippi, A.; Demenais, F.; Vionnet, N.; Furuta, H.; Velho, G.; Bell, G. I.; Laine, B.; Froguel, P.: A missense mutation in hepatocyte nuclear factor-4-alpha, resulting in a reduced transactivation activity, in human late-onset non-insulin-dependent diabetes mellitus. J. Clin. Invest. 101:521-526, 1998.

Lausen, J.; Thomas, H.; Lemm, I.; Bulman, M.; Borgschulze, M.; Lingott, A.; Hattersley, A. T.; Ryffel, G. U.: Naturally occurring mutations in the human HNF4-alpha gene impair the function of the transcription factor to a varying degree. Nucleic Acids Res. 28:430-437, 2000.

Li, J.; Ning, G.; Duncan, S. A.: Mammalian hepatocyte differentiation requires the transcription factor HNF-4-alpha. Genes Dev. 14:464-474,2000.

Stoffel, M.; Duncan, S. A.: The maturity-onset diabetes of the young (MODY1) transcription factor HNF4-alpha regulates expression of genes required for glucose transport and metabolism. Proc. Nat. Acad. Sci. 94:13209-13214, 1997.

Yamagata, K.; Furuta, H.; Oda, N.; Kaisaki, P. J.; Menzel, S.; Cox, N. J.; Fajans, S. S.; Signorini, S.; Stoffel, M.; Bell, G. I.: Mutations in the hepatocyte nuclear factor-4-alpha gene in maturity-onset diabetes of the young (MODY1). Nature 384: 458-460, 1996.

Zouali, H.; Hani, E. H.; Philippi, A.; Vionnet, N.; Beckmann, J. S.; Demenais, F.; Froguel, P.: A susceptibility locus for early-onset non-insulin dependent (type 2) diabetes mellitus maps to chromosome 20q, proximal to the phosphoenolpyruvate carboxykinase gene. Hum. Molec. Genet. 6:1401-1408, 1997.

DiDonato, C. J.; Chen, X.-N.; Noya, D.; Korenberg, J. R.; Nadeau, J. H.; Simard, L. R.: Cloning, characterization, and copy number of the murine survival motor neuron gene: homolog of the spinal muscular atrophy-determining gene. Genome Res. 7:339-352, 1997.

DiDonato, C. J.; Morgan, K.; Carpten, J. D.; Fuerst, P.; Ingraham, S. E.; Prescott, G.; McPherson, J. D.; Wirth, B.; Zerres, K.; Hurko, O.; Wasmuth, J. J.; Mendell, J. R.; Burghes, A. H. M.; Simard, L. R.: Association between Ag1-CA alleles and severity of autosomal recessive proximal spinal muscular atrophy. Am. J. Hum. Genet. 55:1218-1229, 1994.

Feldkotter, M.; Schwarzer, V.; Wirth, R.; Wienker, T. F.; Wirth, B.: Quantitative analyses of SMN1 and SMN2 based on real-time light CyclerPCR: fast and highly reliable carrier testing and prediction of severity of spinal muscular atrophy. Am. J. Hum. Genet. 70:358-368, 2002.

Friesen, W. J.; Massenet, S.; Paushkin, S.; Wyce, A.; Dreyfuss, G.: SMN, the product of the spinal muscular atrophy gene, binds preferentially to dimethylarginine-containing protein targets. Molec. Cell 7:1111-1117,2001.

Frugier, T.; Tiziano, F. D.; Cifuentes-Diaz, C.; Miniou, P.; Roblot, N.; Dierich, A.; Le Meur, M.; Melki, J.: Nuclear targeting defect of SMN lacking the C-terminus in a mouse model of spinal muscular atrophy. Hum. Molec. Genet. 9:849-858, 2000.

Gambardella, A.; Mazzei, R.; Toscano, A.; Annesi, G.; Pasqua, A.; Annesi, F.; Quattrone, F.; Oliveri, R. L.; Valentino, P.; Bono, F.; Aguglia, U.; Zappia, M.; Vita, G.; Quattrone, A.: Spinal muscular atrophy due to an isolated deletion of exon 8 of the telomeric survival motor neuron gene. Ann. Neurol. 44:836-839, 1998.

Hahnen, E.; Schonling, J.; Rudnik-Schoneborn, S.; Raschke, H.; Zerres, K.; Wirth, B.: Missense mutations in exon 6 of the survival motor neuron gene in patients with spinal muscular atrophy (SMA). Hum. Molec. Genet. 6:821-825, 1997.

Hannus, S.; Buhler, D.; Romano, M.; Seraphin, B.; Fischer, U.: The Schizosaccharomyces pombe protein Yab8p and a novel factor, Yip1p, share structural and functional similarity with the spinal muscular atrophy-associated proteins SMN and SIP1. Hum. Molec. Genet. 9:663-674, 2000.

Hsieh-Li, H. M.; Chang, J.-G.; Jong, Y.-J.; Wu, M.-H.; Wang, N. M.; Tsai, C. H.; Li, H.: A mouse model for spinal muscular atrophy. Nature Genet. 24:66-70, 2000.

Jablonka, S.; Bandilla, M.; Wiese, S.; Buhler, D.; Wirth, B.; Sendtner, M.; Fischer, U.: Co-regulation of survival of motor neuron (SMN) protein and its interactor SIP1 during development and in spinal muscular atrophy. Hum. Molec. Genet. 10:497-505, 2001.

Liu, Q.; Dreyfuss, G.: A novel nuclear structure containing the survival of motor neurons protein. EMBO J. 15:3555-3565, 1996.

Liu, Q.; Fischer, U.; Wang, F.; Dreyfuss, G.: The spinal muscular atrophy disease gene product, SMN, and its associated protein SIP1are in a complex with spliceosomal snRNP proteins. Cell 90:1013-1021,1997.

Lorson, C. L.; Androphy, E. J.: The domain encoded by exon 2of the survival motor neuron protein mediates nucleic acid binding. Hum. Molec. Genet. 7:1269-1275, 1998.

Lorson, C. L.; Hahnen, E.; Androphy, E. J.; Wirth, B.: A single nucleotide in the SMN gene regulates splicing and is responsible for spinal muscular atrophy. Proc. Nat. Acad. Sci. 96:6307-6311, 1999.

Lorson, C. L.; Strasswimmer, J.; Yao, J.-M.; Baleja, J. D.; Hahnen, E.; Wirth, B.; Le, T.; Burghes, A. H. M.; Androphy, E. J.: SMN oligomerization defect correlates with spinal muscular atrophy severity. Nature Genet. 19:63-66, 1998.

McAndrew, P. E.; Parsons, D. W.; Simard, L. R.; Rochette, C.; Ray, P. N.; Mendell, J. R.; Prior, T. W.; Burghes, A. H.: Identification of proximal spinal muscular atrophy carriers and patients by analysis of SMNT and SMNC gene copy number. Am. J. Hum. Genet. 60:1411-1422,1997.

Meister, G.; Buhler, D.; Laggerbauer, B.; Zobawa, M.; Lottspeich, F.; Fischer, U.: Characterization of a nuclear 20S complex containing the survival of motor neurons (SMN) protein and a specific subset of spliceosomal Sm proteins. Hum. Molec. Genet. 9:1977-1986, 2000.

Mohaghegh, P.; Rodrigues, N. R.; Owen, N.; Ponting, C. P.; Le, T. T.; Burghes, A. H. M.; Davies, K. E.: Analysis of mutations in the tudor domain of the survival motor neuron protein SMN. Europ. J. Hum. Genet. 7:519-525, 1999.

Monani, U. R.; Lorson, C. L.; Parsons, D. W.; Prior, T. W.; Androphy, E. J.; Burghes, A. H. M.; McPherson, J. D.: A single nucleotide difference that alters splicing patterns distinguishes the SMA gene SMN1 from the copy gene SMN2. Hum. Molec. Genet. 8:1177-1183, 1999.

Mourelatos, Z.; Abel, L.; Yong, J.; Kataoka, N.; Dreyfuss, G.: SMN interacts with a novel family of hnRNP and spliceosomal proteins. EMBO J. 20:5443-5452, 2001.

Owen, N.; Doe, C. L.; Mellor, J.; Davies, K. E.: characterization of the Schizosaccharomyces pombe orthologue of the human survival motor neuron (SMN) protein. Hum. Molec. Genet. 9:675-684, 2000.

Pagliardini, S.; Giavazzi, A.; Setola, V.; Lizier, C.; Di Luca, M.; DeBiasi, S.; Battaglia, G.: Subcellular localization and axonal transport of the survival motor neuron (SMN) protein in the developing rat spinal cord. Hum. Molec. Genet. 9:47-56, 2000.

Parsons, D. W.; McAndrew, P. E.; Iannaccone, S. T.; Mendell, J. R.; Burghes, A. H. M.; Prior, T. W.: Intragenic telSMN mutations: frequency, distribution, evidence of a founder effect, and modification of the spinal muscular atrophy phenotype by cen SMN copy number. Am. J. Hum. Genet. 63:1712-1723, 1998.

Parsons, D. W.; McAndrew, P. E.; Monani, U. R.; Mendell, J. R.; Burghes, A. H. M.; Prior, T. W.: An 11 base pair duplication in exon6 of the SMN gene produces a type I spinal muscular atrophy (SMA) phenotype: further evidence for SMN as the primary SMA-determining gene. Hum. Molec. Genet. 5:1727-1732, 1996.

Aramburu, J.; Garcia-Cozar, F.; Raghavan, A.; Okamura, H.; Rao, A.; Hogan, P. G.: Selective inhibition of NFAT activation by a peptide spanning the calcineurin targeting site of NFAT. Molec. Cell 1:627-637, 1998.

Castigli, E.; Pahwa, R.; Good, R. A.; Geha, R. S.; Chatila, T. A.: Molecular basis of a multiple lymphokine deficiency in a patient with severe combined immunodeficiency. Proc. Nat. Acad. Sci. 90:4728-4732, 1993.

Chatila, T.; Castigli, E.; Pahwa, R.; Pahwa, S.; Chirmule, N.; Oyaizu, N.; Good, R. A.; Geha, R. S.: Primary combined immunodeficiency resulting from defective transcription of multiple T-cell lymphokine genes. Proc. Nat. Acad. Sci. 87:10033-10037, 1990.

Horsley, V.; Pavlath, G. K.: NFAT: ubiquitous regulator of cell differentiation and adaptation. J. Cell Biol. 156:771-774, 2002.

Jauliac, S.; Lopez-Rodriguez, C.; Shaw, L. M.; Brown, L. F.; Rao, A.; Toker, A.: The role of NFAT transcription factors in integrin-mediated carcinoma invasion. Nature Cell Biol. 4:540-544, 2002.

Li, X.; Ho, S. N.; Luna, J.; Giacalone, J.; Thomas, D. J.; Timmerman, L. A.; Crabtree, G. R.; Francke, U.: Cloning and chromosomal localization of the human and murine genes for the T-cell transcription factors NFATc and NFATp. Cytogenet. Cell Genet. 68:185-191, 1995.

Northrop, J. P.; Ho, S. N.; Chen, L.; Thomas, D. J.; Timmerman, L. A.; Nolan, G. P.; Admon, A.; Crabtree, G. R.: NF-AT components define a family of transcription factors targeted in T-cell activation. Nature 369:497-502, 1994.

Okamura, H.; Aramburu, J.; Garcia-Rodriguez, C.; Viola, J. P. B.; Raghavan, A.; Tahiliani, M.; Zhang, X.; Qin, J.; Hogan, P. G.; Rao, A.: Concerted dephosphorylation of the transcription factor NFAT1 induces a conformational switch that regulates transcriptional activity. Molec. Cell 6:539-550, 2000.

Pahwa, R.; Chatila, T.; Pahwa, S.; Paradise, C.; Day, N. K.; Geha, R.; Schwartz, S. A.; Slade, H.; Oyaizu, N.; Good, R. A.: Recombinant interleukin 2 therapy in severe combined immunodeficiency disease. Proc. Nat. Acad. Sci. 86:5069-5073, 1989.

Park, J.; Takeuchi, A.; Sharma, S.: Characterization of a new isoform of the NFAT (nuclear factor of activated T cells) gene family member NFATc. J. Biol. Chem. 271:20914-20921, 1996.

Peng, S. L.; Gerth, A. J.; Ranger, A. M.; Glimcher, L. H.: NFATc1 and NFATc2 together control both T and B cell activation and differentiation. Immunity 14:13-20, 2001.

Aoki, K.; Suzuki, K.; Sugano, T.; Tasaka, T.; Nakahara, K.; Kuge, O.; Omori, A.; Kasai, M.: A novel gene, 'Translin,' encodes a recombination hotspot binding protein associated with chromosomal translocations. Nature Genet. 10:167-174, 1995.

Badge, R. M.; Yardley, J.; Jeffreys, A. J.; Armour, J. A. L.:Crossover breakpoint mapping identifies a subtelomeric hotspot for male meiotic recombination. Hum. Molec. Genet. 9:1239-1244, 2000.

Hosaka, T.; Kanoe, H.; Nakayama, T.; Murakami, H.; Yamamoto, H.; Nakamata, T.; Tsuboyama, T.; Oka, M.; Kasai, M.; Sasaki, M. S.; Nakamura, T.; Toguchida, J.: Translin binds to the sequences adjacent to the breakpoints of the TLS and CHOP genes in liposarcomas with translocation t (12;16). Oncogene 19:5821-5825, 2000.

Kasai, M.; Aoki, K.; Matsuo, Y.; Minowada, J.; Maziarz, R. T.; Strominger, J. L.: Recombination hotspot associated factors specifically recognize novel target sequences at the site of interchromosomal rearrangements in T-ALL patients with t (8;14)(q24; q11) and (t (1;14)(p32; q11). Int. Immun. 6:1017-1025, 1994.

Crispino, J. D.; Lodish, M. B.; Thurberg, B. L.; Litovsky, S. H.; Collins, T.; Molkentin, J. D.; Orkin, S. H.: Proper coronary vascular development and heart morphogenesis depend on interaction of GATA-4 with FOG cofactors. Genes Dev. 15:839-844, 2001.

Laitinen, M. P. E.; Anttonen, M.; Ketola, I.; Wilson, D. B.; Ritvos, O.; Butzow, R.; Heikinheimo, M.: Transcription factors GATA-4 and GATA-6 and a GATA family cofactor, FOG-2, are expressed in human ovary and sex cord-derived ovarian tumors. J. Clin. Endocr. Metab. 85:3476-3483, 2000.

Brenneman, M. A.; Wagener, B. M.; Miller, C. A.; Allen, C.; Nickoloff, J. A.: XRCC3 controls the fidelity of homologous recombination: roles for XRCC3 in late stages of recombination. Molec. Cell 10:387-395, 2002.

Liu, N.; Lamerdin, J. E.; Tebbs, R. S.; Schild, D.; Tucker, J. D.; Shen, M. R.; Brookman, K. W.; Siciliano, M. J.; Walter, C. A.; Fan, W.; Narayana, L. S.; Zhou, Z.-Q.; Adamson, A. W.; Sorensen, K. J.; Chen, D. J.; Jones, N. J.; Thompson, L. H.: XRCC2 and XRCC3, new human Rad51-family members, promote chromosome stability and protect against DNA cross-links and other damages. Molec. Cell 1:783-793, 1998.

Tebbs, R. S.; Zhao, Y.; Tucker, J. D.; Scheerer, J. B.; Siciliano, M. J.; Hwang, M.; Liu, N.; Legerski, R. J.; Thompson, L. H.: Correction of chromosomal instability and sensitivity to diverse mutagens by a cloned cDNA of the XRCC3 DNA repair gene. Proc. Nat. Acad. Sci. 92:6354-6358, 1995.

Winsey, S. L.; Haldar, N. A.; Marsh, H. P.; Bunce, M.; Marshall, S. E.; Harris, A. L.; Wojnarowska, F.; Welsh, K. I.: A variant within the DNA repair gene XRCC3 is associated with the development of melanoma skin cancer. Cancer Res. 60:5612-5616, 2000.

Hayashida, S.; Yamasaki, K.; Asada, Y.; Soeda, E.; Niikawa, N.; Kishino, T.: Construction of a physical and transcript map flanking the imprinted MEST/PEG1 region at 7q32. Genomics 66:221-225, 2000.

de Wind, N.; Dekker, M.; Claij, N.; Jansen, L.; van Klink, Y.; Radman, M.; Riggins, G.; van der Valk, M.; van't Wout, K.; te Riele, H.: HNPCC-like cancer predisposition in mice through simultaneous loss of Msh3 and Msh6 mismatch-repair protein functions. Nature Genet. 23:359-362, 1999.

Chen, Y. H.; Hansen, L.; Chen, M. X.; Bjorbaek, C.; Vestergaard, H.; Hansen, T.; Cohen, P. T. W.; Pedersen, O.: Sequence of the human glycogen-associated regulatory subunit of type 1 protein phosphatase and analysis of its coding region and mRNA level in muscle from patients with NIDDM. Diabetes 43:1234-1241, 1994.

Braun-Dullaeus, R. C.; Mann, M. J.; Ziegler, A.; von der Leyen, H. E.; Dzau, V. J.: A novel role for the cyclin-dependent kinase inhibitor p27(Kip1) in angiotensin II-stimulated vascular smooth muscle cell hypertrophy. J. Clin. Invest. 104: 815-823, 1999.

Carrano, A. C.; Eytan, E.; Hershko, A.; Pagano, M.: SKP2 is required for ubiquitin-mediated degradation of the CDK inhibitor p27. Nature Cell Biol. 1:193-199, 1999.

Di Cristofano, A.; De Acetis, M.; Koff, A.; Cordon-Cardo, C.; Pandolfi, P. P.: Pten and p27(KIP1) cooperate in prostate cancer tumor suppression in the mouse. Nature Genet. 27:222-224, 2001.

Fero, M. L.; Rivkin, M.; Tasch, M.; Porter, P.; Carow, C. E.; Firpo, E.; Polyak, K.; Tsai, L.-H.; Broudy, V.; Perlmutter, R. M.; Kaushansky, K.; Roberts, J. M.: A syndrome of multiorgan hyperplasia with features of gigantism, tumorigenesis, and female sterility in p27(Kip1)-deficient mice. Cell 85:733-744, 1996.

Buyse, I. M.; Shao, G.; Huang, S.: The retinoblastoma protein binds to RIZ, a zinc-finger protein that shares an epitope with the adenovirus E1A protein. Proc. Nat. Acad. Sci. 92:4467-4471, 1995.

Buyse, I. M.; Takahashi, E.; Huang, S.: Physical mapping of the retinoblastoma interacting zinc finger gene RIZ to D1S228 on chromosome 1p36. Genomics 34:119-121, 1996.

Chadwick, R. B.; Jiang, G.-L.; Bennington, G. A.; Yuan, B.; Johnson, C. K.; Stevens, M. W.; Niemann, T. H.; Peltomaki, P.; Huang, S.; dela Chapelle, A.: Candidate tumor suppressor RIZ is frequently involved in colorectal carcinogenesis. Proc. Nat. Acad. Sci. 97:2662-2667, 2000.

Mock, B. A.; Coleman, M. P.; Huang, S.: Riz maps to distal chromosome 4 near genes involved in tumorigenesis and nerve degeneration. Mammalian Genome 7:637 only, 1996.

Poetsch, M.; Dittberner, T.; Woenckhaus, C.: Frameshift mutations of RIZ, but no point mutations in RIZ1 exons in malignant melanomas with deletions in 1p36. Oncogene 21:3038-3042, 2002.

Malek, N. P.; Sundberg, H.; McGrew, S.; Nakayama, K.; Kyriakidis, T. R.; Roberts, J. M.: A mouse knock-in model exposes sequential proteolytic pathways that regulate p27 (Kip1) in G1 and S phase. Nature 413:323-327, 2001.

Martin, E.; Cacheux, V.; Cave, H.; Lapierre, J. M.; Le\Paslier, D.; Grandchamp, B.: Localization of the CDKN4/p27(Kip1) gene to human chromosome 12p12.3. Hum. Genet. 96:668-670, 1995.

Mitsuhashi, T.; Aoki, Y.; Eksioglu, Y. Z.; Takahashi, T.; Bhide, P. G.; Reeves, S. A.; Caviness, V. S., Jr.: Overexpression of p27(Kip1) lengthens the G1 phase in a mouse model that targets inducible gene expression to central nervous system progenitor cells. Proc. Nat. Acad. Sci. 98:6435-6440, 2001.

Polyak, K.; Lee, M.-H.; Erdjument-Bromage, H.; Koff, A.; Roberts, J. M.; Tempst, P.; Massague, J.: Cloning of p27 (Kip1), a cyclin-dependent kinase inhibitor and a potential mediator of extracellular antimitogenic signals. Cell 78:59-66, 1994.

Saito, T.; Seki, N.; Hattori, A.; Hayashi, A.; Abe, M.; Araki, R.; Fujimori, A.; Fukumura, R.; Kozuma, S.; Matsuda, Y.: Structure, expression profile, and chromosomal location of a mouse gene homologous to human DNA-PK(cs) interacting protein (KIP) gene. Mammalian Genome 10:315-317, 1999.

Sherr, C. J.; Roberts, J. M.: Inhibitors of mammalian G1 cyclin-dependent kinases. Genes Dev. 9:1149-1163, 1995.

Toyoshima, H.; Hunter, T.: p27, a novel inhibitor of G1 cyclin-Cdk protein kinase activity, is related to p21. Cell 78:67-74, 1994.

Hudson, A. W.; Birnbaum, M. J.: Identification of a non-neuronal isoform of synaptotagmin. Proc. Nat. Acad. Sci. 92:5895-5899, 1995.

Khakh, B. S.; Zhou, X.; Sydes, J.; Galligan, J. J.; Lester, H. A.: State-dependent cross-inhibition between transmitter-gated cation channels. Nature 406:405-410, 2000.

Chen, J. D.; Evans, R. M.: A transcriptional co-repressor that interacts with nuclear hormone receptors. Nature 377: 454-457, 1995.

Fischle, W.; Dequiedt, F.; Hendzel, M. J.; Guenther, M. G.; Lazar, M. A.; Voelter, W.; Verdin, E.: Enzymatic activity associated with class II HDACs is dependent on a multiprotein complex containing HDAC3 and SMRT/N-CoR. Molec. Cell 9:45-57, 2002.

Horlein, A. J.; Naar, A. M.; Heinzel, T.; Torchia, J.; Gloss, B.; Kurokawa, R.; Ryan, A.; Kamel, Y.; Soderstrom, M.; Glass, C. K.; Rosenfeld, M. G.: Ligand-independent repression by the thyroid hormone receptor mediated by a nuclear receptor co-repressor. Nature 377:397-403,1995.

Hu, X.; Lazar, M. A.: The CoRNR motif controls the recruitment of corepressors by nuclear hormone receptors. Nature 402:93-96,1999.

Jiang, Q.; Galiegue-Zouitina, S.; Roumier, C.; Hildebrand, M. P.; Thomas, S.; Coignet, L. J.: Genomic organization and refined mapping of the human nuclear corepressor 2 (NCOR2)/ silencing mediator of retinoid and thyroid hormone receptor (SMRT) gene on chromosome 12q24.3. Cytogenet. Cell Genet. 92:217-220, 2001.

Ordentlich, P.; Downes, M.; Xie, W.; Genin, A.; Spinner, N. B.; Evans, R. M.: Unique forms of human and mouse nuclear receptor corepressor SMRT. Proc. Nat. Acad. Sci. 96:2639-2644, 1999.

Hegele, R. A.; Harris, S. B.; Zinman, B.; Wang, J.; Cao, H.; Hanley, A. J. G.; Tsui, L.-C.; Scherer, S. W.: Variation in the AU(AT)-rich element within the 3-prime-untranslated region of PPP1R3 is associated with variation in plasma glucose in aboriginal Canadians. J. Clin. Endocr. Metab. 83:3980-3983, 1998.

Savage, D. B.; Agostini, M.; Barroso, I.; Gurnell, M.; Luan, J.; Meirhaeghe, A.; Harding, A.-H.; Ihrke, G.; Rajanayagam, O.; Soos, M. A.; George, S.; Berger, D.; and 9 others: Digenic inheritance of severe insulin resistance in a human pedigree. Nature Genet. 31:379-384, 2002.

Hansen, L.; Hansen, T.; Vestergaard, H.; Bjorbaek, C.; Echwald, S. M.; Clausen, J. O.; Chen, Y. H.; Chen, M. X.; Cohen, P. T. W.; Pedersen, O.: A widespread amino acid polymorphism at codon 905 of the glycogen-associated regulatory subunit of protein phosphatase-1is associated with insulin resistance and hypersecretion of insulin. Hum. Molec. Genet. 4:1313-1320, 1995.

Tang, P. M.; Bondor, J. A.; Swiderek, K. M.; DePaoli-Roach, A. A.: Molecular cloning and expression of the regulatory (RG1) subunit of the glycogen-associated protein phosphatase. J. Biol. Chem. 266:15782-15789, 1991.

Colvin, J. S.; Green, R. P.; Schmahl, J.; Capel, B.; Ornitz, D. M.: Male-to-female sex reversal in mice lacking fibroblast growth factor 9. Cell 104:875-889, 2001.

Mattei, M.-G.; Penault-Llorca, F.; Coulier, F.; Birnbaum, D.:The human FGF9 gene maps to chromosomal region 13q11-q12. Genomics 29:811-812, 1995.

Miyamoto, M.; Naruo, K.-I.; Seko, C.; Matsumoto, S.; Kondo, T.; Kurokawa, T.: Molecular cloning of a novel cytokine cDNA encoding the ninth member of the fibroblast growth factor family, which has a unique secretion property. Molec. Cell. Biol. 13:4251-4259, 1993.

Garcia, J. G.; Lazar, V.; Gilbert-McClain, L. I.; Gallagher, P. J.; Verin, A. D.: Myosin light chain kinase in endothelium: molecular cloning and regulation. Am. J. Resp. Cell Molec. Biol. 16:489-494,1997.

Giorgi, D.; Brand-Arpon, V.; Rouquier, S.: The functional myosin light chain kinase (MYLK) gene localizes with marker D3S3552 on human chromosome 3q21 in a greater than 5-Mb yeast artificial chromosome region and is not linked to olfactory receptor genes. Cytogenet. Cell Genet. 92:85-88, 2001.

Lazar, V.; Garcia, J. G. N.: A single human myosin light chain kinase gene (MLCK; MYLK) transcribes multiple non-muscle isoforms. Genomics 57:256-267, 1999.

Potier, M.-C.; Chelot, E.; Pekarsky, Y.; Gardiner, K.; Rossier, J.; Turnell, W. G.: The human myosin light chain kinase (MLCK) from hippocampus: cloning, sequencing, expression, and localization to3cen-q21. Genomics 29:562-570, 1995.

Walker, L. A.; MacDonald, J. A.; Liu, X.; Nakamoto, R. K.; Haystead, T. A. J.; Somlyo, A. V.; Somlyo, A. P.: Site-specific phosphorylation and point mutations of telokin modulate its Ca (2+)-desensitizing effect in smooth muscle. J. Biol. Chem. 276:24519-24524, 2001.

Watterson, D. M.; Schavocky, J. P.; Guo, L.; Weiss, C.; Chlenski, A.; Shirinsky, V. P.; Van Eldik, L. J.; Haiech, J.: Analysis of the kinase-related protein gene found at human chromosome 3q21 in a multi-gene cluster: organization, expression, alternative splicing, and polymorphic marker. J. Cell. Biochem. 75:481-491, 1999.

Druck, T.; Gu, Y.; Prabhala. G.; Cannizzaro, L. A.; Park, S.-H.; Huebner, K.; Keen, J. H.: Chromosome localization of human genes for clathrin adaptor polypeptides AP2-beta and AP50 and the clathrin-binding protein, VCP. Genomics 30:94-97, 1995.

Ponnambalam, S.; Robinson, M. S.; Jackson, A. P.; Peiperl, L.; Parham, P.: Conservation and diversity in families of coated vesicle adaptins. J. Biol. Chem. 265:4814-4820, 1990.

Waelter, S.; Scherzinger, E.; Hasenbank, R.; Nordhoff, E.; Lurz, R.; Goehler, H.; Gauss, C.; Sathasivam, K.; Bates, G. P.; Lehrach, H.; Wanker, E. E.: The huntingtin interacting protein HIP1 is a clathrin and alpha-adaptin-binding protein involved in receptor-mediated endocytosis. Hum. Molec. Genet. 10:1807-1817, 2001.

Kaneko-Ishino, T.; Kuroiwa, Y.; Miyoshi, N.; Kohda, T.; Suzuki, R.; Yokoyama, M.; Viville, S.; Barton, S. C.; Ishino, F.; Surani, M. A.: Peg1/Mest imprinted gene on chromosome 6 identified by cDNA subtraction hybridization. Nature Genet. 11:52-59, 1995.

Kobayashi, S.; Kohda, T.; Miyoshi, N.; Kuroiwa, Y.; Aisaka, K.; Tsutsumi, O.; Kaneko-Ishino, T.; Ishino, F.: Human PEG1/MEST, an imprinted gene on chromosome 7. Hum. Molec. Genet. 6:781-786, 1997.

Kosaki, K.; Kosaki, R.; Craigen, W. J.; Matsuo, N.: Isoform-specific imprinting of the human PEG1/MEST gene. (Letter) Am. J. Hum. Genet. 66:309-312, 2000.

Kotzot, D.; Schmitt, S.; Bernasconi, F.; Robinson, W. P.; Lurie, I. W.; Ilyina, H.; Mehes, K.; Hamel, B. C. J.; Otten, B. J.; Hergersberg, M.; Werder, E.; Shoenle, E.; Schinzel, A.: Uniparental disomy 7 in Silver-Russell syndrome and primordial growth retardation. Hum. Molec. Genet. 4:583-587, 1995.

Lefebvre, L.; Viville, S.; Barton, S. C.; Ishino, F.; Keverne, E. B.; Surani, M. A.: Abnormal maternal behaviour and growth retardation associated with loss of the imprinted gene Mest. Nature Genet. 20:163-169, 1998.

Lefebvre, L.; Viville, S.; Barton, S. C.; Ishino, F.; Surani, M. A.: Genomic structure and parent-of-origin-specific methylation of Peg1. Hum. Molec. Genet. 6:1907-1915, 1997.

Ayala-Madrigal, M. L.; Doerr, S.; Ramirez-Duenas, M. L.; Hansmann, I.: Assignment of karyopherin alpha 1 (KPNA1) to human chromosome band 3q21 by in situ hybridization. Cytogenet. Cell Genet. 90:58-59,2000.

Conti, E.; Uy, M.; Leighton, L.; Blobel, G.; Kuriyan, J.: Crystallographic analysis of the recognition of a nuclear localization signal by the nuclear import factor karyopherin alpha. Cell 94:193-204, 1998.

Cortes, P.; Ye, Z.-S.; Baltimore, D.: RAG-1 interacts with the repeated amino acid motif of the human homologue of the yeast protein SRP1. Proc. Nat. Acad. Sci. 91:7633-7637, 1994.

Chen, H.; Antonarakis, S. E.: Localization of a human homolog of the mouse Tiam-1 gene to chromosome 21q22.1. Genomics 30:123-127,1995.

Habets, G. G. M.; Scholtes, E. H. M.; Zuydgeest, D.; van der Kammen, R. A.; Stam, J. C.; Berns, A.; Collard, J. G.: Identification of an invasion-inducing gene, Tiam-1, that encodes a protein with homology to GDP-GTP exchangers for Rho-like proteins. Cell 77:537-549, 1994.

Habets, G. G. M.; van der Kammen, R. A.; Jenkins, N. A.; Gilbert, D. J.; Copeland, N. G.; Hagemeijer, A.; Collard, J. G.: The invasion-inducing TIAM1 gene maps to human chromosome band 21q22 and mouse chromosome 16. Cytogenet. Cell. Genet. 70:48-51, 1995.

Habets, G. G. M.; van der Kammen, R. A.; Stam, J. C.; Michiels, F.; Collard, J. G.: Sequence of the human invasion-inducing TIAM1gene, its conservation in evolution and its expression in tumor cell lines of different tissue origin. Oncogene 10:1371-1376, 1995.

Malliri, A.; van der Kammen, R. A.; Clark, K.; van der Valk, M.; Michiels, F.; Collard, J. G.: Mice deficient in the Rac activator Tiam1 are resistant to Ras-induced skin tumours. Nature 417:867-871,2002.

Ghetti, A.; Pinol-Roma, S.; Michael, W. M.; Morandi, C.; Dreyfuss, G.: HNRNP I, the polypyrimidine tract-binding protein: distinct nuclear localization and association with hnRNAs. Nucleic Acids Res. 20:3671-3678, 1992.

Raimondi, E.; Romanelli, M. G.; Moralli, D.; Gamberi, C.; Russo, M. P.; Morandi, C.: Assignment of the human gene encoding heterogeneous nuclear RNA ribonucleoprotein I (PTB) to chromosome 14q23-q24.1. Genomics 27:553-555, 1995.

Romanelli, M. G.; Lorenzi, P.; Morandi, C.: Organization of the human gene encoding heterogeneous nuclear ribonucleoprotein type I (hnRNP I) and characterization of hnRNP I related pseudogene. Gene 255:267-272, 2000.

Hoogenraad, C. C.; Koekkoek, B.; Akhmanova, A.; Krugers, H.; Dortland, B.; Miedema, M.; van Alphen, A.; Kistler, W. M.; Jaegle, M.; Koutsourakis, M.; Van Camp, N.;

Verhoye, M.; van der Linden, A.; Kaverina, I.; Grosveld, F.; De Zeeuw, C. I.; Galjart, N.: Targeted mutation of Cyln2 in the Williams syndrome critical region links CLIP-115 haploinsufficiency to neurodevelopmental abnormalities in mice. Nature Genet. 32:116-127,2002. Note: Erratum: Nature Genet. 32:331 only, 2002.

Bannerman, R. M.; Edwards, J. A.; Kreimer-Birnbaum, M.; McFarland, E.; Russell, E. S.: Hereditary microcytic anaemia in the mouse; studies in iron distribution and metabolism. Brit. J. Haemat. 23:235-245,1972.

Vincent, J. B.; Herbrick, J.-A.; Gurling, H. M. D.; Bolton, P. F.; Roberts, W.; Scherer, S. W.: Identification of a novel gene on chromosome 7q31 that is interrupted by a translocation breakpoint in an autistic individual. Am. J. Hum. Genet. 67:510-514, 2000.

Barichard, F.; Joulin, V.; Henry, I.; Garel, M.-C.; Valentin, C.; Rosa, R.; Cohen-Solal, M.; Junien, C.: Chromosomal assignment of the human 2,3-bisphosphoglycerate mutase gene (BPGM) to region 7q34-7q22. Hum. Genet. 77:283-285, 1987.

Bowdler, A. J.; Prankerd, T. A. J.: Studies in congenital non-spherocytic haemolytic anaemias with specific enzyme defects. Acta Haemat. 31:65-78, 1964.

Chen, S.-H.; Anderson, J. E.; Giblett, E. R.:2,3-diphosphoglycerate mutase: its demonstration by electrophoresis and the detection of a genetic variant. Biochem. Genet. 5:481-486, 1971.

Galacteros, F.; Rosa, R.; Prehu, M. O.; Najean, Y.; Calvin, M. C.: Deficit en diphosphoglycerate mutase: nouveaux cas associes aune polyglobulie. Nouv. Rev. Franc. Hemat. 26:69-74, 1984.

Joulin, V.; Barichard, F.; Henry, I.; Garel, M. C.; Valentin, C.; Rosa, R.; Cohen-Solal, M.; Junien, C.: Chromosomal assignment of the human 2,3-bisphosphoglycerate mutase gene (BPGM) to region 7q22-7q34.(Abstract) Cytogenet. Cell Genet. 46:635 only, 1987.

Joulin, V.; Garel, M.-C.; Le Boulch, P.; Valentin, C.; Rosa, R.; Rosa, J.; Cohen-Solal, M.: Isolation and characterization of the human 2,3-bisphosphoglycerate mutase gene. J. Biol. Chem. 263:15785-15790,1988.

Joulin, V.; Peduzzi, J.; Romeo, P.-H.; Rosa, R.; Valentin, C.; Dubart, A.; Lapeyre, B.; Blouquit, Y.; Garel, M.-C.; Goossens, M.; Rosa, J.; Cohen-Solal, M.: Molecular cloning and sequencing of the human erythrocyte 2,3-bisphosphoglycerate mutase cDNA: revised amino acid sequence. EMBO J. 5:2275-2283, 1986.

Labie, D.; Leroux, J.-P.; Najman, A.; Reyrolle, C.: Familial diphosphoglycerate mutase deficiency: influence on the oxygen affinity curves of hemoglobin. FEBS Lett. 9:37-40, 1970.

Lemarchandel, V.; Joulin, V.; Valentin, C.; Rosa, R.; Galacteros, F.; Rosa, J.; Cohen-Solal, M.: Compound heterozygosity in a complete erythrocyte bisphosphoglycerate mutase deficiency. Blood 80:2643-2649,1992.

Rosa, R.; Audit, I.; Rosa, J.: Diphosphoglycerate mutase and 2,3-diphosphoglycerate phosphatase activities of red cells: comparative electrophoretic study. Biochem. Biophys. Res. Commun. 51:536-542,1973.

Rosa, R.; Blouquit, Y.; Calvin, M.-C.; Prome, D.; Prome, J.-C.; Rosa, J.: Isolation, characterization, and structure of a mutant 89 arg-to-cys bisphosphoglycerate mutase: implication of the active site in the mutation. J. Biol. Chem. 264:7837-7843, 1989.

Rosa, R.; Prehu, M.-O.; Beuzard, Y.; Rosa, J.: The first case of a complete deficiency of diphosphoglycerate mutase in human erythrocytes. J. Clin. Invest. 62:907-915, 1978.

Sasaki, R.; Ikura, K.; Sugimoto, E.; Chiba, H.: Purification of bisphosphoglyceromutase, 2,3-bisphosphoglycerate phosphatase and phosphoglyceromutase from human erythrocytes. Europ. J. Biochem. 50:581-593, 1975.

Schroter, W.: Kongenitale nichtsphaerocytaere haemolytische Anaemiebei 2,3-Diphosphoglycerat mutase mangel der Erythrocyten im fruehenSaeuglingsalter. Klin. Wschr. 43:1147-1153, 1965.

Scott, E. M.; Wright, R. C.: An alternate method for demonstration of bisphosphoglyceromutase (DPGM) on starch gels. Am. J. Hum. Genet. 34:1013-1015, 1982.

Yanagawa, S.; Hitomi, K.; Sasaki, R.; Chiba, H.: Isolation and characterization of cDNA encoding rabbit reticulocyte 2,3-bisphosphoglycerate synthase. Gene 44:185-191, 1986.

Jaspers, M.; Zhang, Z.; Marynen, P.; Vekemans, S.; Aly, M. S.; Cuppens, H.; Hillicker, C.; Cassiman, J.-J.: Localization of the genes encoding the alpha-2 and alpha-4 subunits of the human VLA-receptors to chromosome 5q23-31 and 2q31-32 respectively. (Abstract) Cytogenet. Cell Genet. 58:1870 only, 1991.

Kaplan, C.; Morel-Kopp, M. C.; Kroll, H.; Kiefel, V.; Schlegel, N.; Chesnel, N.; Mueller-Eckhardt, C.: HPA-5b (Br-a) neonatal alloimmune thrombocytopenia: clinical and immunological analysis of 39 cases. Brit. J. Haemat. 78:425-429, 1991.

Kiefel, V.; Santoso, S.; Katzmann, B.; Mueller-Eckhardt, C.: A new platelet-specific alloantigen Br (a): report of 4 cases with neonatal alloimmune thrombocytopenia. Vox Sang. 54:101-106, 1988.

Kiefel, V.; Shechter, Y.; Atias, D.; Kroll, H.; Santoso, S.; Mueller-Eckhardt, C.: Neonatal alloimmune thrombocytopenia due to anti-Br (b) (HPA-5a): report of three cases in two families. Vox Sang. 60:244-245, 1991.

Kritzik, M.; Savage, B.; Nugent, D. J.; Santoso, S.; Ruggeri, Z. M.; Kunicki, T. J.: Nucleotide polymorphisms in the alpha-2 gene define multiple alleles that are associated with differences in platelet alpha-2/beta-1 density. Blood 92:2382-2388, 1998.

Kunicki, T. J.; Kritzik, M.; Annis, D. S.; Nugent, D. J.: Hereditary variation in platelet integrin alpha-2-beta-1 density is associated with two silent polymorphisms in the alpha-2 gene coding sequence. Blood 89:1939-1943, 1997.

Mueller-Eckhardt, C.; Kiefel, V.; Grubert, A.; Kroll, H.; Weisheit, M.; Schmidt, S.; Mueller-Eckhardt, G.; Santoso, S.:348 cases of suspected neonatal alloimmune thrombocytopenia. Lancet I:363-366,1989.

Nieuwenhuis, H. K.; Akkerman, J. W. N.; Houdijk, W. P.; Sixma, J. J.: Human blood platelets showing no response to collagen fail to express surface glycoprotein Ia. Nature 318:470-472, 1985.

Santoso, S.; Amrhein, J.; Hofmann, H. A.; Sachs, U. J. H.; Walka, M. M.; Kroll, H.; Kiefel, V.: A point mutation thr799met on the alpha-2 integrin leads to the formation of new human platelet alloantigen Sit (a) and affects collagen-induced aggregation. Blood 94:4103-4111,1999.

Santoso, S.; Kalb, R.; Walka, M.; Kiefel, V.; Mueller-Eckhardt, C.; Newman, P. J.: The human platelet alloantigens Br (a) and Br (b) are associated with a single amino acid polymorphism on glycoproteinIa (integrin subunit alpha-2). J. Clin. Invest. 92:2427-2432, 1993.

Santoso, S.; Kunicki, T. J.; Kroll, H.; Haberbosch, W.; Gardemann, A.: Association of the platelet glycoprotein Ia C807T gene polymorphism with nonfatal myocardial infarction in younger patients. Blood 93:2449-2453, 1999.

Takada, Y.; Hemler, M. E.: The primary structure of the VLA-2/collagen receptor alpha-2 subunit (platelet GPIa): homology to other integrins and the presence of a possible collagen-binding domain. J. Cell Biol. 109:397-407, 1989.

von Beckerath, N.; Koch, W.; Mehilli, J.; Bottiger, C.; Schomig, A.; Kastrati, A.: Glycoprotein Ia gene C807T polymorphism and risk for major adverse cardiac events within the first 30 days after coronary artery stenting. Blood 95:3297-3301, 2000.

Fernandez-Ruiz, E.; Pardo-Manuel de Villena, F.; Rubio, M. A.; Corbi, A. L.; Rodriguez de Cordoba, S.; Sanchez-Madrid, F.: mapping of the human VLA-alpha-4 gene to chromosome 2q31-q32. Europ. J. Immun. 22:587-590, 1992.

Rosemblatt, M.; Vuillet-Gaugler, M. H.; Leroy, C.; Coulombel, L.: Coexpression of two fibronectin receptors, VLA-4 and VLA-5, by immature human erythroblastic precursor cells. J. Clin. Invest. 87:6-11,1991.

Zhang, Z.; Vekemans, S.; Aly, M. S.; Jaspers, M.; Marynen, P.; Cassiman, J.-J.: The gene for the alpha-4 subunit of the VLA-4 integrin maps to chromosome 2q31-32. Blood 78:2396-2399, 1991.

Hiesberger, T.; Trommsdorff, M.; Howell, B. W.; Goffinet, A.; Mumby, M. C.; Cooper, J. A.; Herz, J.: Direct binding of reelin to VLDL receptor and apoE receptor 2 induces tyrosine phosphorylation of disabled-1 and modulates tau phosphorylation. Neuron 24:481-489, 1999.

Oka, K.; Tzung, K.-W.; Sullivan, M.; Lindsay, E.; Baldini, A.; Chan, L.: Human very-low-density lipoprotein receptor complementary DNA and deduced amino acid sequence and localization of its gene (VLDLR) to chromosome band 9q24 by fluorescence in situ hybridization. Genomics 20:298-300, 1994.

Okuizumi, K.; Onodera, O.; Namba, Y.; Ikeda, K.; Yamamoto, T.; Seki, K.; Ueki, A.; Nanko, S.; Tanaka, H.; Takahashi, H.; Oyanagi, K.; Mizusawa, H.; Kanazawa, I.; Tsuji, S.: Genetic association of the very low density lipoprotein (VLDL) receptor gene with sporadic Alzheimer's disease. Nature Genet. 11:207-209, 1995.

Gafvels, M. E.; Paavola, L. G.; Boyd, C. O.; Nolan, P. M.; Wittmaack, F.; Chawla, A.; Lazar, M. A.; Bucan, M.; Angelin, B.; Strauss, J. F., III: Cloning of a complementary deoxyribonucleic acid encoding the murine homolog of the very low density lipoprotein/apolipoprotein-E receptor: expression pattern and assignment of the gene to mouse chromosome 19. Endocrinology 135:387-394, 1994.

Sakai, J.; Hoshino, A.; Takahashi, S.; Miura, Y.; Ishii, H.; Suzuki, H.; Kawarabayasi, Y.; Yamamoto, T.: Structure, chromosome location, and expression of the human very low density lipoprotein receptor gene. J. Biol. Chem. 269:2173-2182, 1994.

Trommsdorff, M.; Gotthardt, M.; Hiesberger, T.; Shelton, J.; Stockinger, W.; Nimpf, J.; Hammer, R. E.; Richardson, J. A.; Herz, J.: Reeler/Disabled-like disruption of neuronal migration in knockout mice lacking the VLDL receptor and ApoE receptor 2. Cell 97:689-701, 1999.

Huebner, K.; Druck, T.; Croce, C. M.; Thiesen, H. J.: Twenty-seven non overlapping zinc finger cDNAs from human T cells map to nine different chromosomes with apparent clustering. Am. J. Hum. Genet. 48:726-740,1991.

Rousseau-Merck, M.-F.; Hillion, J.; Jonveaux, P.; Couillin, P.; Seite, P.; Thiesen, H.-J.; Berger, R.: Chromosomal localization of 9 KOX zinc finger genes: physical linkages suggest clustering of KOX genes on chromosomes 12, 16, and 19. Hum. Genet. 92:583-587, 1993.

Lehmann, O. J.; El-ashry, M. F.; Ebenezer, N. D.; Ocaka, L.; Francis, P. J.; Wilkie, S. E.; Patel, R. J.; Ficker, L.; Jordan, T.; Khaw, P. T.; Bhattacharya, S. S.: A novel keratocan mutation causing autosomal recessive cornea plana. Invest. Ophthal. Vis. Sci. 42:3118-3122,2001.

Stohl, W.; Kunkel, H. G.: Heterogeneity in expression of the T4 epitope in black individuals. Scand. J. Immun. 20:273-278, 1984.

Tishkoff, S. A.; Dietzsch, E.; Speed, W.; Pakstis, A. J.; Kidd, J. R.; Cheung, K.; Bonne-Tamir, B.; Santachiara-Benerecetti, A. S.; Moral, P.; Krings, M.; Paabo, S.; Watson, E.; Risch, N.; Jenkins, T.; Kidd, K. K.: Global patterns of linkage disequilibrium at the CD4 locus and modern human origins. Science 271:1380-1387, 1996.

van Dongen, J. J. M.; Wolvers-Tettero, I. L. M.; Versnel, M. A.; Westerveld, A.; Geurts van Kessel, A. H. M.: Assignment of the genes coding for the T-cell antigens CD7 (Tp41), CD5 (T1) and CD4 (T4) to human chromosome 17, 11, 12 respectively. (Abstract) Cytogenet. Cell Genet. 40:767, 1985.

Zou, Y.-R.; Sunshine, M.-J.; Taniuchi, I.; Hatam, F.; Killeen, N.; Littman, D. R.: Epigenetic silencing of CD4 in T cells committed to the cytotoxic lineage. Nature Genet. 332-336, 2001.

DiLella, A. G.: Chromosomal assignment of the human immunophilin FKBP-12 gene. Biochem. Biophys. Res. Commun. 179:1427-1433, 1991.

DiLella, A. G.; Hawkins, A.; Craig, R. J.; Schreiber, S. L.; Griffin, C. A.: Chromosomal band assignments of the genes encoding human FKBP12 and FKBP13. Biochem. Biophys. Res. Commun. 189:819-823, 1992.

Goebl, M. G.: The peptidyl-prolyl isomerase, FK506-binding protein, is most likely the 12 kd endogenous inhibitor 2 of protein kinase C. (Letter) Cell 64:1051-1052, 1991.

Jin, Y.-J.; Albers, M. W.; Lane, W. S.; Bierer, B. E.; Schreiber, S. L.; Burakoff, S. J.: Molecular cloning of a membrane-associated human FK506- and rapamycin-binding protein, FKBP-13. Proc. Nat. Acad. Sci. 88:6677-6681, 1991.

Maki, N.; Sekiguchi, F.; Nishimaki, J.; Miwa, K.; Hayano, T.; Takahashi, N.; Suzuki, M.: Complementary DNA encoding the human T-cell FK506-binding protein, a peptidylprolyl cis-trans isomerase distinct from cyclophilin. Proc. Nat. Acad. Sci. 87:5440-5443, 1990.

Peattie, D. A.; Hsaio, K.; Benasutti, M.; Lippke, J. A.: Three distinct messenger RNAs can encode the human immunosuppressant-binding protein FKBP12. Gene 150:251-257, 1994.

Shou, W.; Aghdasi, B.; Armstrong, D. L.; Guo, Q.; Bao, S.; Charng, M.-J.; Mathews, L. M.; Schneider, M. D.; Hamilton, S. L.; Matzuk, M. M.: Cardiac defects and altered ryanodine receptor function in mice lacking FKBP12. Nature 391:489-492, 1998.

Standaert, R. F.; Galat, A.; Verdine, G. L.; Schreiber, S. L.: Molecular cloning and overexpression of the human FK506-binding protein FKBP. Nature 346:671-674, 1990.

Wang, T.; Donahoe, P. K.; Zervos, A. S.: Specific interaction of type I receptors of the TGF-beta family with the immunophilin FKBP-12. Science 265:674-676, 1994.

Gasdaska, J. R.; Gasdaska, P. Y.; Gallegos, A.; Powis, G.: human thioredoxin reductase gene localization to chromosomal position 12q23-q24.1 and mRNA distribution in human tissue. Genomics 37:257-259, 1996.

Gasdaska, P. Y.; Gasdaska, J. R.; Cochran, S.; Powis, G.: Cloning and sequencing of a human thioredoxin reductase. FEBS Lett. 373:5-9, 1995.

Russo, M. W.; Sevetson, B. R.; Milbrandt, J.: Identification of NAB1, a repressor of NGFI-A- and Krox20-mediated transcription. Proc. Nat. Acad. Sci. 92:6873-6877, 1995.

Svaren, J.; Apel, E. D.; Simburger, K. S.; Jenkins, N. A.; Gilbert, D. J.; Copeland, N. A.; Milbrandt, J.: The Nab2 and Stat6 genes share a common transcription termination region. Genomics 41:33-39, 1997.

Swirnoff, A. H.; Apel, E. D.; Svaren, J.; Sevetson, B. R.; Zimonjic, D. B.; Popescu, N. C.; Milbrandt, J.: Nab1, a corepressor of NGFI-A(Egr-1), contains an active transcriptional repression domain. Molec. Cell. Biol. 18:512-524, 1998.

Venken, K.; Di Maria, E.; Bellone, E.; Balestra, P.; Cassandrini, D.; Mandich, P.; De Jonghe, P.; Timmerman, V.; Svaren, J.: Search for mutation in the EGR2 corepressor proteins, NAB1 and NAB2, in human peripheral neuropathies. Neurogenetics 4:37-41, 2002.

Nichols, R. C.; Blinder, J.; Pai, S. I.; Ge, Q.; Targoff, I. N.; Plotz, P. H.; Liu, P.: Assignment of two human autoantigen genes: isoleucyl-tRNA synthetase locates to 9q21 and lysyl-tRNA synthetase locates to 16q23-q24. Genomics 36:210-213, 1996.

Nichols, R. C.; Raben, N.; Boerkoel, C. F.; Plotz, P. H.: human isoleucyl-tRNA synthetase: sequence of the cDNA, alternative mRNA splicing, and the characteristics of an unusually long C-terminal extension. Gene 155:299-304, 1995.

Dejgaard, K.; Leffers, H.; Rasmussen, H. H.; Madsen, P.; Kruse, T. A.; Gesser, B.; Nielsen, H.; Celis, J. E.: Identification, molecular cloning, expression and chromosome mapping of a family of transformation upregulated hnRNP-K proteins derived by alternative splicing. J. Molec. Biol. 236: 33-48, 1994.

Tommerup, N.; Leffers, H.: Assignment of human KH-box-containing genes by in situ hybridization: HNRNPK maps to 9q21.32-q21.33, PCBP1to 2p12-p13, and PCBP2 to 12q13.12-q13.13, distal to FRA12A. Genomics 32:297-298, 1996.

Alessi, D. R.; Smythe, C.; Keyse, S. M.: The human CL100 gene encodes a tyr/thr-protein phosphatase which potently and specifically inactivates MAP kinase and suppresses its activation by oncogenicr as in Xenopus oocyte extracts. Oncogene 8:2015-2020, 1993.

Brondello, J.-M.; Pouyssegur, J.; McKenzie, F. R.: Reduced MAP kinase phosphatase-1 degradation after p42/p44(MAPK)-dependent phosphorylation. Science 286:2514-2517, 1999.

Emslie, E. A.; Jones, T. A.; Sheer, D.; Keyse, S. M.: The CL100 gene, which encodes a dual specificity (tyr/thr) MAP kinase phosphatase, is highly conserved and maps to human chromosome 5q34. Hum. Genet. 93:513-516, 1994.

Keyse, S. M.; Emslie, E. A.: Oxidative stress and heat shock induce a human gene encoding a protein-tyrosine phosphatase. Nature 359:644-647, 1992.

Martell, K. J.; Kwak, S.; Hakes, D. J.; Dixon, J. E.; Trent, J. M.: Chromosomal localization of four human VH1-like protein-tyrosine phosphatases. Genomics 22:462-464, 1994.

Chrast, R.; Chen, H.; Morris, M. A.; Antonarakis, S. E.: mapping of the human transcription factor GABPA (E4TF1-60) gene to chromosome 21. Genomics 28:119-122, 1995.

Gugneja, S.; Virbasius, J. V.; Scarpulla, R. C.: Four structurally distinct, non-DNA-binding subunits of human nuclear respiratory factor 2 share a conserved transcriptional activation domain. Molec. Cell. Biol. 15:102-111, 1995.

Guo, A.; Nie, F.; Wong-Riley, M.: Human nuclear respiratory factor2-alpha subunit cDNA: isolation, subcloning, sequencing, and in situ hybridization of transcripts in normal and monocularly deprived macaque visual system. J. Comp. Neurol. 417:221-232, 2000.

Sawada, J.; Goto, M.; Watanabe, H.; Handa, H.; Yoshida, M. C.: Regional mapping of two subunits of transcription factor E4TF1 to human chromosome. Jpn. J. Cancer Res. 86:10-12, 1995.

Virbasius, J. V.; Scarpulla, R. C.: Activation of the human mitochondrial transcription factor A gene by nuclear respiratory factors: a potential regulatory link between nuclear and mitochondrial gene expression in organelle biogenesis. Proc. Nat. Acad. Sci. 91:1309-1313, 1994.

Watanabe, H.; Sawada, J.; Yano, K.-I.; Yamaguchi, K.; Goto, M.; Handa, H.: cDNA cloning of transcription factor E4TF1 subunits with Ets and notch motifs. Molec. Cell. Biol. 13:1385-1391, 1993.

Dixon, J.; Loftus, S. K.; Gladwin, A. J.; Scambler, P. J.; Wasmuth, J. J.; Dixon, M. J.: Cloning of the human heparan sulfate-N-deacetylase/N-sulfotransferase gene from the Treacher Collins syndrome candidate region at 5q32-q33.1. Genomics 26:239-244, 1995.

Gladwin, A. J.; Dixon, J.; Loftus, S. K.; Wasmuth, J. J.; Dixon, M. J.: Genomic organization of the human heparan sulfate-N-deacetylase/N-sulfotransferase gene: exclusion from a causative role in the pathogenesis of Treacher Collins syndrome. Genomics 32:471-473, 1996.

Hashimoto, Y.; Orellana, A.; Gil, G.; Hirschberg, C. B.: molecular cloning and expression of rat liver N-heparan sulfate sulfotransferase. J. Biol. Chem. 267:15744-15750, 1995.

Chen, H.; Antonarakis, S. E.: Localisation of a human homologue of the Drosophila mnb and rat Dyrk genes to chromosome 21q22.2. Hum. Genet. 99:262-265, 1997.

Patil, N.; Cox, D. R.; Bhat, D.; Faham, M.; Myers, R. M.; Peterson, A. S.: A potassium channel mutation in weaver mice implicates membrane excitability in granule cell differentiation. Nature Genet. 11:126-129, 1995.

Shindoh, N.; Kudoh, J.; Maeda, H.; Yamaki, A.; Minoshima, S.; Shimizu, Y.; Shimizu, N.: Cloning of a human homolog of the Drosophila minibrain/rat Dyrk gene from 'the Down syndrome critical region' of chromosome 21. Biochem. Biophys. Res. Commun. 225:92-99, 1996.

Song, W.-J.; Chung, S.-H.; Kurnit, D. M.: The murine Dyrk protein maps to chromosome 16, localizes to the nucleus, and can form multimers. Biochem. Biophys. Res. Commun. 231: 640-644, 1997.

Tejedor, F.; Zhu, X. R.; Kaltenbach, E.; Ackermann, A.; Baumann, A.; Canal, I.; Heisenberg, M.; Fischbach, K. F.; Pongs, O.: Minibrain: a new protein kinase family involved in postembryonic neurogenesis in Drosophila. Neuron 14:287-301, 1995.

Smith, D. J.; Stevens, M. E.; Sudanagunta, S. P.; Bronson, R. T.; Makhinson, M.; Watabe, A. M.; O'Dell, T. J.; Fung, J.; Weier, H.-U. G.; Cheng, J.-F.; Rubin, E. M.: Functional screening of 2 Mb of human chromosome 21q22.2 in transgenic mice implicates minibrain in learning defects associated with Down syndrome. Nature Genet. 16:28-36,1997.

Song, W.-J.; Sternberg, L. R.; Kasten-Sportes, C.; Van Keuren, M. L.; Chung, S.-H.; Slack, A. C.; Miller, D. E.; Glover, T. W.; Chiang, P.-W.; Lou, L.; Kurnit, D. M.: Isolation of human and murine homologues of the Drosophila minibrain gene: human homologue maps to 21q22.2in the Down syndrome 'critical region.' Genomics 38:331-339, 1996.

Redmond, T. M.; Yu, S.; Lee, E.; Bok, D.; Hamasaki, D.; Chen, N.; Goletz, P.; Ma, J.-X.; Crouch, R. K.; Pfeifer, K.: Rpe65 is necessary for production of 11-cis-vitamin A in the retinal visual cycle. Nature Genet. 20:344-351, 1998.

Seeliger, M. W.; Grimm, C.; Stahlberg, F.; Friedburg, C.; Jaissle, G.; Zrenner, E.; Guo, H.; Reme, C. E.; Humphries, P.; Hofmann, F.; Biel, M.; Fariss, R. N.; Redmond, T. M.; Wenzel, A.: New views on RPE65 deficiency: the rod system is the source of vision in a mouse model of Leber congenital amaurosis. Nature Genet. 29:70-74, 2001.

Thompson, D. A.; Gyurus, P.; Fleischer, L.; Bingham, E. L.; McHenry, C. L.; Apfelstedt-Sylla, E.; Zrenner, E.; Lorenz, B.; Richards, J. E.; Jacobson, S. G.; Sieving, P. A.; Gal, A.: Genetics and phenotypes of RPE65 mutations in inherited retinal degeneration. Invest. Ophthal. Vis. Sci. 41:4293-4299, 2000.

Thompson, D. A.; McHenry, C. L.; Li, Y.; Richards, J. E.; Othman, M. I.; Schwinger, E.; Vollrath, D.; Jacobson, S. G.; Gal, A.: Retinal dystrophy due to paternal isodisomy for chromosome 1 or chromosome 2, with homoallelism for mutations in RPE65 or MERTK, respectively. Am. J. Hum. Genet. 70:224-229, 2002.

Wrigstad, A.; Narfstrom, K.; Nilsson, S. E.: Slowly progressive changes of the retina and retinal pigment epithelium in Briard dogs with hereditary retinal dystrophy: a morphological study. Doc. Ophthal. 87:337-354, 1994.

Bogenmann, E.; Lochrie, M. A.; Simon, M. I.: Cone cell-specific genes expressed in retinoblastoma. Science 240:76-78, 1988.

Bonaiti-Pellie, C.; Briard-Guillemot, M. L.: Segregation analysis in hereditary retinoblastoma. Hum. Genet. 57:411-419, 1981.

O'Brien, R. O.; Taske, N. L.; Hansbro, P. M.; Matthaei, K. I.; Hogan, S. P.; Denborough, M. A.; Foster, P. S.: Exclusion of defects in the skeletal muscle specific regions of the DHPR alpha-1 subunit as frequent causes of malignant hyperthermia. J. Med. Genet. 32:913-914, 1995.

Oesterling, J. E.; Chan, D. W.; Epstein, J. I.; Kimball, A. W., Jr.; Bruzek, D. J.; Rock, R. C.; Brendler, C. B.; Walsh, P. C.: Prostate specific antigen in the preoperative and postoperative evaluation of localized prostatic cancer treated with radical prostatectomy. J. Urol. 139:766-772, 1988.

Riegman, P. H. J.; Vlietstra, R. J.; van der Korput, J. A. G. M.; Brinkmann, A. O.; Trapman, J.: The promoter of the prostate-specific antigen gene contains a functional androgen responsive element. Molec. Endocr. 5:1921-1930, 1991.

van den Elsen, P.; Bruns, G.; Gerhard, D. S.; Pravtcheva, D.; Jones, C.; Housman, D.; Ruddle, F. A.; Orkin, S.; Terhorst, C.: Assignment of the gene coding for the T3-delta subunit of the T3--T-cell receptor complex to the long arm of human chromosome 11 and to mouse chromosome 9. Proc. Nat. Acad. Sci. 82:2920-2924, 1985.

van Rijs, J.; Giguere, V.; Hurst, J.; van Agthoven, T.; Geurtsvan Kessel, A.; Goyert, S.; Grosveld, F.: Chromosomal localization of the human Thy-1 gene. Proc. Nat. Acad. Sci. 82:5832-5835, 1985.

Williams, A. F.; Gagnon, J.: Neuronal cell Thy-1 glycoprotein: homology with immunoglobulin. Science 216:696-703, 1982.

Johansson, M.; Karlsson, A.: Cloning of the cDNA and chromosome localization of the gene for human thymidine kinase 2. J. Biol. Chem. 272:8454-8458, 1997.

Mandel, H.; Szargel, R.; Labay, V.; Elpeleg, O.; Saada, A.; Shalata, A.; Anbinder, Y.; Berkowitz, D.; Hartman, C.; Barak, M.; Eriksson, S.; Cohen, N.: The deoxyguanosine kinase gene is mutated in individuals with depleted hepatocerebral mitochondrial DNA. Nature Genet. 29:337-341, 2001. Note: Erratum: Nature Genet. 29:491 only, 2001.

Saada, A.; Shaag, A.; Mandel, H.; Nevo, Y.; Eriksson, S.; Elpeleg, O.: Mutant mitochondrial thymidine kinase in mitochondrial DNA depletion myopathy. Nature Genet. 29:342-344, 2001.

Wang, L.; Munch-Petersen, B.; Herrstrom Sjoberg, A.; Hellman, U.; Bergman, T.; Jornvall, H.; Eriksson, S.: Human thymidine kinase 2: molecular cloning and characterisation of the enzyme activity with antiviral and cytostatic nucleoside substrates. FEBS Lett. 443:170-174, 1999.

Willecke, K.; Reuber, T.; Kucherlapati, R. S.; Ruddle, F. H.: Human mitochondrial thymidine kinase is coded for by a gene on chromosome 16 of the nucleus. Somat. Cell Genet. 3:237-245, 1977.

Chang, J. G.; Scarpa, A.; Eddy, R. L.; Byers, M. G.; Harris, A. S.; Morrow, J. S.; Watkins, P.; Shows, T. B.; Forget, B. G.: Cloning of a portion of the chromosomal gene and cDNA for human beta-fodrin, the non erythroid form of beta-spectrin. Genomics 17:287-293, 1993.

Watkins, P. C.; Eddy, R.; Forget, B. G.; Chang, J. G.; Rochelle, R.; Shows, T. B.: Assignment of a non-erythroid spectrin gene to human chromosome 2. (Abstract) Am. J. Hum. Genet. 43: A161, 1988.

Miceli-Richard, C.; Lesage, S.; Rybojad, M.; Prieur, A.-M.; Manouvrier-Hanu, S.; Hafner, R.; Chamaillard, M.; Zouali, H.; Thomas, G.; Hugot, J.-P.: CARD15 mutations in Blau syndrome. Nature Genet. 29:19-20, 2001.

Han, L. Wong, D.; Dhaka, A.; Afar, D.; White, M.; Xie, W.; Herschman, H.; Witte, O.: Colicelli, J.: Protein binding and signaling properties of RIN1 suggest a unique effector function. Proc. Nat. Acad. Sci. 94:4954-4959, 1997.

Jhanwar, S. C.; Neel, B. G.; Hayward, W. S.; Chaganti, R. S. K.: Localization of the cellular oncogenes ABL, SIS, and FES on human germ-line chromosomes. Cytogenet. Cell Genet. 38:73-75, 1984.

Blank, V.; Andrews, N. C.: The Maf transcription factors: regulators of differentiation. Trends Biochem. Sci. 22:437-441, 1997.

Jamieson, R. V.; Perveen, R.; Kerr, B.; Carette, M.; Yardley, J.; Heon, E.; Wirth, M. G.; van Heyningen, V.; Donnai, D.; Munier, F.; Black, G. C. M.: Domain disruption and mutation of the bZIP transcription factor, MAF, associated with cataract, ocular anterior segment dysgenesis and coloboma. Hum. Molec. Genet. 11:33-42, 2002.

Kim, J. I.; Li, T.; Ho, I. C.; Grusby, M. J.; Glimcher, L. H.: Requirement for the c-Maf transcription factor in crystallin gene regulation and lens development. Proc. Nat. Acad. Sci. 96:3781-3785,1999.

Nishizawa, M.; Kataoka, K.; Goto, N.; Fujiwara, K. T.; Kawai, S.: v-maf, a viral oncogene that encodes a 'leucine zipper' motif. Proc. Nat. Acad. Sci. 86:7711-7715, 1989.

Yoshida, M. C.; Nishizawa, M.; Kataoka, K.; Goto, N.; Fujiwara, K. T.; Kawai, S.: Localization of the human MAF proto-oncogene on chromosome 16 to bands q22-q23. (Abstract) Cytogenet. Cell Genet. 58:2003 only, 1991.

Bao, S.; Tibbetts, R. S.; Brumbaugh, K. M.; Fang, Y.; Richardson, D. A.; Ali, A.; Chen, S. M.; Abraham, R. T.; Wang, X.-F.: ATR/ATM-mediated phosphorylation of human Rad17 is required for genotoxic stress responses. Nature 411: 969-974, 2001.

Barbosa, M. D. F. S.; Barrat, F. J.; Tchernev, V. T.; Nguyen, Q. A.; Mishra, V. S.; Colman, S. D.; Pastural, E.; Dufourcq-Lagelouse, R.; Fischer, A.; Holcombe, R. F.; Wallace, M. R.; Brandt, S. J.; deSaint Basile, G.; Kingsmore S. F.: Identification of mutations in two major mRNA isoforms of the Chediak-Higashi syndrome gene in human and mouse. Hum. Molec. Genet. 6:1091-1098, 1997.

Barrat, F. J.; Auloge, L.; Pastural, E.; Dufourcq Lagelouse, R.; Vilmer, E.; Cant, A. J.; Weissenbach, J.; Le Paslier, D.; Fischer, A.; de Saint Basile, G.: Genetic and physical mapping of the Chediak-Higashi syndrome on chromosome 1q42-43. Am. J. Hum. Genet. 59:625-632,1996.

Dufourcq-Lagelouse, R.; Lambert, N.; Duval, M.; Viot, G.; Vilmer, E.; Fischer, A.; Prieur, M.; de Saint Basile, G.: Chediak-Higashi syndrome associated with maternal uniparental isodisomy of chromosome 1. Europ. J. Hum. Genet. 7:633-637, 1999.

Faigle, W.; Raposo, G.; Tenza, D.; Pinet, V.; Vogt, A. B.; Kropshofer, H.; Fischer, A.; de Saint-Basile, G.; Amigorena, S.: Deficient peptide loading and MHC class II endosomal sorting in a human genetic immunodeficiency disease: the Chediak-Higashi syndrome. J. Cell Biol. 141:1121-1134, 1998.

Karim, M. A.; Suzuki, K.; Fukai, K.; Oh, J.; Nagle, D. L.; Moore, K. J.; Barbosa, E.; Falik-Borenstein, T.; Filipovich, A.; Ishida, Y. Kivrikko, S.; Klein, C.; and 8 others: Apparent genotype-phenotype correlation in childhood, adolescent, and adult Chediak-Higashi syndrome. Am. J. Med. Genet. 108:16-22, 2002.

Kunieda, T.; Ide, H.; Nakagiri, M.; Yoneda, K.; Konfortov, B.; Ogawa, H.: Localization of the locus responsible for Chediak-Higashi syndrome in cattle to bovine chromosome 28. Anim. Genet. 31:87-90,2000.

Akama, T. O.; Nishida, K.; Nakayama, J.; Watanabe, H.; Ozaki, K.; Nakamura, T.; Dota, A.; Kawasaki, S.; Inoue, Y.; Maeda, N.; Yamamoto, S.; Fujiwara, T.; Thonar, E. J.-M. A.; Shimomura, Y.; Kinoshita, S.; Tanigami, A.; Fukuda, M. N.: Macular corneal dystrophy type I and type II are caused by distinct mutations in a new sulphotransferase gene. Nature Genet. 26:237-241, 2000.

Enomoto, A.; Kimura, H.; Chairoungdua, A.; Shigeta, Y.; Jutabha, P.; Cha, S. H.; Hosoyamada, M.; Takeda, M.; Sekine, T.; Igarashi, T.; Matsuo, H.; Kikuchi, Y.; Oda, T.; Ichida, K.; Hosoya, T.; Shimokata, K.; Niwa, T.; Kanai, Y.; Endou, H.: Molecular identification of a renal urate-anion exchanger that regulates blood urate levels. Nature 417:447-452, 2002.

Goedert, M.; Hasegawa, J.; Craxton, M.; Leversha, M. A.; Clegg, S.: Assignment of the human stress-activated protein kinase-3 gene (SAPK3) to chromosome 22q13.3 by fluorescence in situ hybridization. Genomics 41:501-502, 1997.

Koettnitz, K.; Kappel, B.; Baumruker, T.; Hauber, J.; Bevec, D.: The genomic structure encoding human initiation factor eIF-5A. Gene 144:249-252, 1994.

Koettnitz, K.; Wohl, T.; Kappel, B.; Lottspeich, F.; Hauber, J.; Bevec, D.: Identification of a new member of the human eIF-5A gene family. Gene 159:283-284, 1995.

Steinkasserer, A.; Jones, T.; Sheer, D.; Koettnitz, K.; Hauber, J.; Bevec, D.: The eukaryotic cofactor for the human immunodeficiency virus type 1 (HIV-1) rev protein, eIF-5A, maps to chromosome 17p12-p13:three eIF-5A pseudogenes map to 10q23.3, 17q25, and 19q13.2. Genomics 25:749-752, 1995.

Hartley, D. A.; Preiss, A.; Artavanis-Tsakonas, S.: A deduced gene product from the Drosophila neurogenic locus, enhancer of split, shows homology to mammalian G-protein beta subunit. Cell 55:785-795,1988.

Hou, E. W.; Li, S.-L.: Genomic organization and chromosome localization to band 19p13.3 of the human AES gene: gene product exhibits strong similarity to the N-terminal domain of Drosophila enhancer of split Groucho protein. DNA Cell Biol. 17:911-913, 1998.

Miyasaka, H.; Choudhury, B. K.; Hou, E. W.; Li, S. S.-L.: molecular cloning and expression of mouse and human cDNA encoding AES and ESG proteins with strong similarity to Drosophila enhancer of split groucho protein. Europ. J. Biochem. 216:343-352, 1993.

de Bruijn, D. R. H.; Baats, E.; Zechner, U.; de Leeuw, B.; Balemans, M.; Olde Weghuis, D.; Hirning-Folz, U.; Geurts van Kessel, A.: Isolation and characterization of the mouse homolog of SYT, a gene implicated in the development of human synovial sarcomas. Oncogene 13:643-648,1996.

de Bruijn, D. R. H.; Kater-Baats, E.; Eleveld, M.; Merkx, G.; vanKessel, A. G.: Mapping and characterization of the mouse and human SS18 genes, two human SS18-like genes and a mouse Ss18 pseudogene. Cytogenet. Cell Genet. 92:310-319, 2001.

Thaete, C.; Brett, D.; Monaghan, P.; Whitehouse, S.; Rennie, G.; Rayner, E.; Cooper, C. S.; Goodwin, G.: Functional domains of the SYT and SYT-SSX synovial sarcoma translocation proteins and co-localization with the SNF protein BRM in the nucleus. Hum. Molec. Genet. 8:585-591,1999.

Ge, Q.; Trieu, E. P.; Targoff, I. N.: Primary structure and functional expression of human glycyl-tRNA synthetase, an autoantigen in myositis. J. Biol. Chem. 269:28790-28797, 1994.

Nichols, R. C.; Pai, S. I.; Ge, Q.; Targoff, I. N.; Plotz, P. H.; Liu, P.: Localization of two human autoantigen genes by PCR screening and in situ hybridization--Glycyl-tRNA synthetase locates to 7p15 and alanyl-tRNA synthetase locates to 16q22. Genomics 30:131-132,1995.

Shiba, K.; Schimmel, P.; Motegi, H.; Noda, T.: Human glycyl-tRNA synthetase: wide divergence of primary structure from bacterial counterpart and species-specific aminoacylation. J. Biol. Chem. 269:30049-30055,1994.

Williams, J.; Osvath, S.; Khong, T. F.; Pearse, M.; Power, D.:Cloning, sequencing and bacterial expression of human glycine tRNA synthetase. Nucleic Acids Res. 23:1307-1310, 1995.

Adams, R. H.; Porras, A.; Alonso, G.; Jones, M.; Vintersten, K.; Panelli, S.; Valladares, A.; Perez, L.; Klein, R.; Nebreda, A. R.: Essential role of p38-alpha MAP kinase in placental but not embryonic cardiovascular development. Molec. Cell 6:109-116, 2000.

Ge, B.; Gram, H.; Di Padova, F.; Huang, B.; New, L.; Ulevitch, R. J.; Luo, Y.; Han, J.: MAPKK-independent activation of p38-alpha mediated by TAB1-dependent autophosphorylation of p38-alpha. Science 295:1291-1294, 2002.

Han, J.; Lee, J.-D.; Bibbs, L.; Ulevitch, R. J.: A MAP kinase targeted by endotoxin and hyperosmolarity in mammalian cells. Science 265:808-811, 1994.

Kim, D. H.; Feinbaum, R.; Alloing, G.; Emerson, F. E.; Garsin, D. A.; Inoue, H.; Tanaka-Hino, M.; Hisamoto, N.; Matsumoto, K.; Tan, M.-W.; Ausubel, F. M.: A conserved p38 MAP kinase pathway in Caenorhabditis elegans innate immunity. Science 297:623-626, 2002.

Kumar, S.; McLaughlin, M. M.; McDonnell, P. C.; Lee, J. C.; Livi, G. P.; Young, P. R.: Human mitogen-activated protein kinase CSBP1, but not CSBP2, complements a hog1 deletion in yeast. J. Biol. Chem. 270:29043-29046, 1995.

Lee, J. C.; Laydon, J. T.; McDonnell, P. C.; Gallagher, T. F.; Kumar, S.; Green, D.; McNulty, D.; Blumenthal, M. J.; Heys, J. R.; Landvatter, S. W.; Stickler, J. E.; McLaughlin, M. M.; Siemens, I. R.; Fisher, S. M.; Livi, G. P.; White, J. R.; Adams, J. L.; Young, P. R.: A protein kinase involved in the regulation of inflammatory cytokine biosynthesis. Nature 372:739-746, 1994.

Liao, P.; Georgakopoulos, D.; Kovacs, A.; Zheng, M.; Lerner, D.; Pu, H.; Saffitz, J.; Chien, K.; Xiao, R.-P.; Kass, D. A.; Wang, Y.: The in vivo role of p38 MAP kinases in cardiac remodeling and restrictive cardiomyopathy. Proc. Nat. Acad. Sci. 98:12283-12288, 2001.

Maizels, E. T.; Mukherjee, A.; Sithanandam, G.; Peters, C. A.; Cottom, J.; Mayo, K. E.; Hunzicker-Dunn, M.: Developmental regulation of mitogen-activated protein kinase-activated kinases-2 and -3 (MAPKAPK-2/-3) in vivo during corpus luteum formation in the rat. Molec. Endocr. 15:716-733, 2001.

McDonnell, P. C.; DiLella, A. G.; Lee, J. C.; Young, P. R.: Localization of the human stress responsive MAP kinase-like CSAIDs binding protein (CSBP) gene to chromosome 6p21.3/21.2. Genomics 29:301-302, 1995.

New, L.; Jiang, Y.; Zhao, M.; Liu, K.; Zhu, W.; Flood, L. J.; Kato, Y.; Parry, G. C. N.; Han, J.: PRAK, a novel protein kinase regulated by the p38 MAP kinase. EMBO J. 17:3372-3384, 1998.

Ni, H.; Wang, X. S.; Diener, K.; Yao, Z.: MAPKAPK5, a novel mitogen-activated protein kinase (MAPK)-activated protein kinase, is a substrate of the extracellular-regulated kinase (ERK) and p38 kinase. Biochem. Biophys. Res. Commun. 243:492-496, 1998.

Takekawa, M.; Maeda, T.; Saito, H.: Protein phosphatase 2C-alpha inhibits the human stress-responsive p38 and JNK MAPK pathways. EMBO J. 17:4744-4752, 1998.

Tamura, K.; Sudo, T.; Senftleben, U.; Dadak, A. M.; Johnson, R.; Karin, M.: Requirement for p38-alpha in erythropoietin expression: a role for stress kinases in erythropoiesis. Cell 102:221-231, 2000.

Haber, N.; Stengel, D.; Defer, N.; Roeckel, N.; Mattei, M.-G.; Hanoune, J.: Chromosomal mapping of human adenylyl cyclase genes type III, type V and type VI. Hum. Genet. 94:69-73, 1994.

Sinnarajah, S.; Dessauer, C. W.; Srikumar, D.; Chen, J.; Yuen, J.; Yilma, S.; Dennis, J. C.; Morrison, E. E.; Vodyanoy, V.; Kehrl, J. H.: RGS2 regulates signal transduction in olfactory neurons by attenuating activation of adenylyl cyclase III. Nature 409:1051-1055, 2001.

Pellizzoni, L.; Kataoka, N.; Charroux, B.; Dreyfuss, G.: A novel function for SMN, the spinal muscular atrophy gene product, in pre-mRNA splicing. Cell 95:615-624, 1998.

Brown, K. A.; Leek, J. P.; Lench, N. J.; Moynihan, L. M.; Markham, A. F.; Mueller, R. F.: Human sequences homologous to the gene for the cochlear protein Ocp-II do not map to currently known non-syndromic hearing loss loci. Ann. Hum. Genet. 60:385-389, 1996.

Demetrick, D. J.; Zhang, H.; Beach, D. H.: Chromosomal mapping of the genes for the human CDK2/cyclin A-associated proteins p19 (SKP1A and SKP1B) and p45 (SKP2). Cytogenet. Cell Genet. 73:104-107, 1996.

Liang, Y.; Chen, H.; Asher, J. H., Jr.; Chang, C.-C.; Friedman, T. B.: Human inner ear OCP2 cDNA maps to 5q22-5q35.2 with related sequences on chromosomes 4p16.2-4p14, 5p13-5q22, 7pter-q22, 10 and 12p13-12qter. Gene 184:163-167, 1997.

Chen, H.; Thalmann, I.; Adams, J. C.; Avraham, K. B.; Copeland, N. G.; Jenkins, N. A.; Beier, D. R.; Corey, D. P.; Thalmann, R.; Duyk, G. M.: cDNA cloning, tissue distribution, and chromosomal localization of Ocp2, a gene encoding a putative transcription-associated factor predominantly expressed in the auditory organs. Genomics 27:389-398, 1995.

Sowden, J.; Morrison, K.; Schofield, J.; Putt, W.; Edwards, Y.: A novel cDNA with homology to an RNA polymerase II elongation factors maps to human chromosome 5q31 (TCEB1L) and to mouse chromosome 11(Tceb1l). Genomics 29:145-151, 1995.

Thalmann, I.; Rosenthal, H. L.; Moore, B. W.; Thalmann, R.: Organ of Corti-specific polypeptides: OCP-I and OCP-II. Arch. Oto-Rhino-Laryngol. 226:123-128 , 1980.

Thalmann, I.; Takahashi, K.; Varghese, J.; Comegys, T. H.; Thalmann, R.: Biochemical features of major organ of Corti proteins (OCP-I and OCP-II) including partial amino acid sequence. Laryngoscope 100:99-105, 1990.

Zhang, H.; Kobayashi, R.; Galaktionov, K.; Beach, D.: p19Skp1 and p45Skp2 are essential elements of the cyclin A-CDK2 S phase kinase. Cell 82:915-925, 1995.

Anand, A.; Chada, K.: In vivo modulation of Hmgic reduces obesity. Nature Genet. 24:377-380, 2000.

Arlotta, P.; Tai, A. K.-F.; Manfioletti, G.; Clifford, C.; Jay, G.; Ono, S. J.: Transgenic mice expressing a truncated form of the high mobility group I-C protein develop adiposity and an abnormally high prevalence of lipomas. J. Biol. Chem. 275:14394-14400, 2000.

Ashar, H. R.; Cherath, L.; Przybysz, K. M.; Chada, K.: Genomic characterization of human HMGIC, a member of the accessory transcription factor family found at translocation breakpoints in lipomas. Genomics 31:207-214, 1996.

Ashar, H. R.; Schoenberg Fejzo, M.; Tkachenko, A.; Zhou, X.; Fletcher, J. A.; Weremowicz, S.; Morton, C. C.; Chada, K.: Disruption of the architectural factor HMGI-C: DNA-binding AT hook motifs fused in lipomas to distinct transcriptional regulatory domains. Cell 82:57-65, 1995.

Chau, K.-Y.; Patel, U. A.; Lee, K.-L. D.; Lam, H.-Y. P.; Crane-Robinson, C.: The gene for the human architectural transcription factor HMGI-C consists of five exons each coding for a distinct functional element. Nucleic Acids Res. 23:4262-4266, 1995.

Danforth, E., Jr.: Failure of adipocyte differentiation causes type II diabetes mellitus. Nature Genet. 26:13 only, 2000.

Friedmann, M.; Holth, L. T.; Zoghbi, H. Y.; Reeves, R.: Organization, inducible-expression and chromosome localization of the human HMG-I(Y) nonhistone protein gene. Nucleic Acids Res. 21:4259-4267, 1993.

Ishwad, C. S.; Shriver, M. D.; Lassige, D. M.; Ferrell, R. E.: The high mobility group I-C gene (HMGI-C): polymorphism and genetic localization. Hum. Genet. 99:103-105, 1997.

Kazmierczak, B.; Dal Cin, P.; Wanschura, S.; Bartnitzke, S.; Vanden Berghe, H.; Bullerdiek, J.: Cloning and molecular characterization of part of a new gene fused to HMGIC in mesenchymal tumors. Am. J. Path. 152:431-435, 1998.

Kazmierczak, B.; Pohnke, Y.; Bullerdiek, J.: Fusion transcripts between the HMGIC gene and RTVL-H-related sequences in mesenchymal tumors without cytogenetic aberrations. Genomics 38:223-226, 1996.

Manfioletti, G.; Rustighi, A.; Mantovani, F.; Goodwin, G. H.; Giancotti, V.: Isolation and characterization of the gene coding for murine high-mobility-group protein HMGI-C. Gene 167:249-253, 1995.

Mine, N.; Kurose, K.; Nagai, H.; Doi, D.; Ota, Y.; Yoneyama, K.; Konishi, H.; Araki, T.; Emi, M.: Gene fusion involving HMGIC is a frequent aberration in uterine leiomyomas. J. Hum. Genet. 46:408-412, 2001.

Nucci, M. R.; Weremowicz, S.; Neskey, D. M.; Sornberger, K.; Tallini, G.; Morton, C. C.; Quade, B. J.: Chromosomal translocation t (8;12) induces aberrant HMGIC expression in aggressive angiomyxoma of the vulva. Genes Chromosomes Cancer 32:172-176, 2001.

Rodrigues, N. R.; Owen, N.; Talbot, K.; Ignatius, J.; Dubowitz, V.; Davies, K. E.: Deletions in the survival motor neuron gene on 5q13 in autosomal recessive spinal muscular atrophy. Hum. Molec. Genet. 4:631-634, 1995.

Rossoll, W.; Kroning, A.-K.; Ohndorf, U.-M.; Steegborn, C.; Jablonka, S.; Sendtner, M.: Specific interaction of Smn, the spinal muscular atrophy determining gene product, with hnRNP-R and gry-rbp/hnRNP-Q: a role for Smn in RNA processing in motor axons? Hum. Molec. Genet. 11:93-105, 2002.

Simard, L. R.; Rochette, C.; Semionov, A.; Morgan, K.; Vanasse, M.: SMN(T) and NAIP mutations in Canadian families with spinal muscular atrophy (SMA): genotype/phenotype correlations with disease severity. Am. J. Med. Genet. 72:51-58, 1997.

Sossi, V.; Giuli, A.; Vitali, T.; Tiziano, F.; Mirabella, M.; Antonelli, A.; Neri, G.; Brahe, C.: Premature termination mutations in exon 3 of the SMN1 gene are associated with exon skipping and a relatively mild SMA phenotype. Europ. J. Hum. Genet. 9:113-120, 2001.

Stewart, H.; Wallace, A.; McGaughran, J.; Mountford, R.; Kingston, H.: Molecular diagnosis of spinal muscular atrophy. Arch. Dis. Child. 78:531-535, 1998.

Talbot, K.; Ponting, C. P.; Theodosiou, A. M.; Rodrigues, N. R.; Surtees, R.; Mountford, R.; Davies, K. E.: Missense mutation clustering in the survival motor neuron gene: a role for a conserved tyrosine and glycine rich region of the protein in RNA metabolism? Hum. Molec. Genet. 6:497-500, 1997.

van der Steege, G.; Grootschloten, P. M.; Cobben, J. M.; Zappata, S.; Scheffer, H.; den Dunnen, J. T.; van Ommen, G.-J. B.; Brahe, C.; Buys, C. H. C. M.: Apparent gene conversions involving the SMN gene in the region of the spinal muscular atrophy locus on chromosome 5. Am. J. Hum. Genet. 59:834-838, 1996.

Viollet, L.; Bertrandy, S.; Bueno Brunialti, A. L.; Lefebvre, S.; Burlet, P.; Clermont, O.; Cruaud, C.; Guenet, J.-L.; Munnich, A.; Melki, J.: cDNA isolation, expression, and chromosomal localization of the mouse survival motor neuron gene (Smn). Genomics 40:185-188,1997.

Wang, C. H.; Xu, J.; Carter, T. A.; Ross, B. M.; Dominski, M. K.; Bellcross, C. A.; Penchaszadeh, G. K.; Munsat, T. L.; Gilliam, T. C.: Characterization of survival motor neuron (SMNT) gene deletions in asymptomatic carriers of spinal muscular atrophy. Hum. Molec. Genet. 5:359-365, 1996.

Wang, J.; Dreyfuss, G.: A cell system with targeted disruption of the SMN gene: functional conservation of the SMN protein and dependence of Gemin2 on SMN. J. Biol. Chem. 276:9599-9605, 2001.

Wirth, B.: An update of the mutation spectrum of the survival motor neuron gene (SMN1) in autosomal recessive spinal muscular atrophy (SMA). Hum. Mutat. 15:228-237, 2000.

Wirth, B.; Hahnen, E.; Morgan, K.; DiDonato, C. J.; Dadze, A.; Rudnik-Schoneborn, S.; Simard, L. R.; Zerres, K.; Burghes, A. H. M.: Allelic association and deletions in autosomal recessive proximal spinal muscular atrophy: association of marker genotype with disease severity and candidate cDNAs. Hum. Molec. Genet. 4:1273-1284, 1995.

Wirth, B.; Herz, M.; Wetter, A.; Moskau, S.; Hahnen, E.; Rudnik-Schoneborn, S.; Wienker, T.; Zerres, K.: Quantitative analysis of survival motor neuron copies: identification of subtle SMN1 mutations in patients with spinal muscular atrophy, genotype-phenotype correlation, and implications for genetic counseling. Am. J. Hum. Genet. 64:1340-1356,1999.

Young, P. J.; Man, N.; Lorson, C. L.; Le, T. T.; Androphy, E. J.; Burghes, A. H. M.; Morris, G. E.: The exon 2b region of the spinal muscular atrophy protein, SMN, is involved in self-association and SIP1 binding. Hum. Molec. Genet. 9:2869-2877, 2000.

Kingsmore, S. F.; Suh, D.; Seldin, M. F.: Genetic mapping of the glycine receptor alpha-3 subunit on mouse chromosome 8. Mammalian Genome 5:831-832, 1994.

Kuhse, J.; Schmieden, V.; Betz, H.: Identification and functional expression of a novel ligand binding subunit of the inhibitory glycine receptor. J. Biol. Chem. 265:22317-22320, 1990.

Nikolic, Z.; Laube, B.; Weber, R. G.; Lichter, P.; Kioschis, P.; Poustka, A.; Mulhardt, C.; Becker, C.-M.: The human glycine receptor subunit alpha-3: GLRA3 gene structure, chromosomal localization, and functional characterization of alternative transcripts. J. Biol. Chem. 273:19708-19714, 1998.

Johnson, D. W.; Berg, J. N.; Baldwin, M. A.; Gallione, C. J.; Marondel, I.; Yoon, S.-J.; Stenzel, T. T.; Speer, M.; Pericak-Vance, M. A.; Diamond, A.; Guttmacher, A. E.; Jackson, C. E.; Attisano, L.; Kucherlapati, R.; Porteous, M. E. M.; Marchuk, D. A.: Mutations in the activin receptor-like kinase 1 gene in hereditary haemorrhagic telangiectasia type 2. Nature Genet. 13:189-195, 1996.

Seimiya, H.; Sawabe, T.; Inazawa, J.; Tsuruo, T.: Cloning, expression and chromosomal localization of a novel gene for protein tyrosine phosphatase (PTP-U2) induced by various differentiation-inducing agents. Oncogene 10:1731-1738, 1995.

Wiggins, R. C.; Wiggins, J. E.; Goyal, M.; Wharram, B. L.; Thomas, P. E.: Molecular cloning of cDNAs encoding human GLEPP1, a membrane protein tyrosine phosphatase: characterization of the GLEPP1 protein distribution in human kidney and assignment of the GLEPP1 gene to human chromosome 12p12-p13. Genomics 27:174-181, 1995.

Borsani, G.; Rugarli, E. I.; Taglialatela, M.; Wong, C.; Ballabio, A.: Characterization of a human and murine gene (CLCN3) sharing similarities to voltage-gated chloride channels and to a yeast integral membrane protein. Genomics 27:131-141, 1995.

Mills, K. A.; Mathews, K. D.; Scherpbier-Heddema, T.; Buetow, K. H.; Baldini, A.; Ballabio, A.; Borsani, G.: Genetic and physical mapping of a voltage-dependent chloride channel gene to human 4q32and to mouse 8. Genomics 36:374-376, 1996.

Stobrawa, S. M.; Breiderhoff, T.; Takamori, S.; Engel, D.; Schweizer, M.; Zdebik, A. A.; Bosl, M. R.; Ruether, K.; Jahn, H.; Draguhn, A.; Jahn, R.; Jentsch, T. J.: Disruption of ClC-3, a chloride channel expressed on synaptic vesicles, leads to a loss of the hippocampus. Neuron 29:185-196, 2001.

Taine, L.; Coupry, I.; Boisseau, P.; Saura, R.; Lacombe, D.; Arveiler, B.: Refined localisation of the voltage-gated chloride channel, CLCN3, to 4q33. Hum. Genet. 102:178-181, 1998.

Yoshikawa, M.; Uchida, S.; Ezaki, J.; Rai, T.; Hayama, A.; Kobayashi, K.; Kida, Y.; Noda, M.; Koike, M.; Uchiyama, Y.; Marumo, F.; Kominami, E.; Sasaki, S.: CLC-3 deficiency leads to phenotypes similar to human neuronal ceroid lipofuscinosis. Genes Cells 7:597-605, 2002.

Pagliuca, A.; Bartoli, P. C.; Saccone, S.; Valle, G. D.; Lania, L.: Molecular cloning of ID4, a novel dominant negative helix-loop-helix human gene on chromosome 6p21.3-p22. Genomics 27:200-203, 1995.

Rigolet, M.; Rich, T.; Gross-Morand, M.-S.; Molina-Gomes, D.; Viegas-Pequignot, E.; Junien, C.: cDNA cloning, tissue distribution and chromosomal localization of the human ID4 gene. DNA Res. 5:309-313, 1998.

Jia, S.; VanDusen, W. J.; Diehl, R. E.; Kohl, N. E.; Dixon, R. A. F.; Elliston, K. O.; Stern, A. M.; Friedman, P. A.: cDNA cloning and expression of bovine aspartyl (asparaginyl) beta-hydroxylase. J. Biol. Chem. 267:14322-14327, 1992.

Korioth, F.; Gieffers, C.; Frey, J.: Cloning and characterization of the human gene encoding aspartyl beta-hydroxylase. Gene 150:395-399, 1994.

Lavaissiere, L.; Jia, S.; Nishiyama, M.; de la Monte, S.; Stern, A. M.; Wands, J. R.; Friedman, P. A.: Overexpression of human aspartyl (asparaginyl)-beta-hydroxylase in hepatocellular carcinoma and cholangiocarcinoma. J. Clin. Invest. 98:1313-1323, 1996.

Lim, K. Y.; Hong, C.-S.; Kim, D. H.: cDNA cloning and characterization of human cardiac junctin. Gene 255:35-42, 2000.

Scott, A. F.: Personal Communication. Baltimore, Md. Feb. 19, 2001.

Treves, S.; Feriotto, G.; Moccagatta, L.; Gambari, R.; Zorzato, F.: Molecular cloning, expression, functional characterization, chromosomal localization, and gene structure of junctate, a novel integral calcium binding protein of sarco (endo) plasmic reticulum membrane. J. Biol. Chem. 275: 39555-39568, 2000.

Wetzel, G. T.; Ding, S.; Chen, F.: Molecular cloning of junctin from human and developing rabbit heart. Molec. Genet. Metab. 69:252-258, 2000.

Zhou, P.; Sun, L. J.; Dotsch, V.; Wagner, G.; Verdine, G. L.: Solution structure of the core NFATC1/DNA complex. Cell 92:687-696,1998.

Rengarajan, J.; Tang, B.; Glimcher, L. H.: NFATc2 and NFATc3 regulate TH2 differentiation and modulate TCR-responsiveness of naive TH cells. Nature Immun. 3:48-54, 2002.

Xia, Y.-R.; Andersen, B.; Mehrabian, M.; Diep, A. T.; Warden, C. H.; Mohandas, T.; McEvilly, R. J.; Rosenfeld, M. G.; Lusis, A. J.: Chromosomal organization of mammalian POU domain factors. Genomics 18:126-130, 1993.

Brass, N.; Heckel, D.; Sahin, U.; Pfreundschuh, M.; Sybrecht, G. W.; Meese, E.: Translation initiation factor eIF-4gamma is encoded by an amplified gene and induces an immune response in squamous cell lung carcinoma. Hum. Molec. Genet. 6:33-39, 1997.

Gradi, A.; Imataka, H.; Svitkin, Y. V.; Rom, E.; Raught, B.; Morino, S.; Sonenberg, N.: A novel functional human eukaryotic translation initiation factor 4G. Molec. Cell. Biol. 18:334-342, 1998.

Imataka, H.; Gradi, A.; Sonenberg, N.: A newly identified N-terminal amino acid sequence of human eIF4G binds poly (A)-binding protein and functions in poly (A)-dependent translation. EMBO J. 17:7480-7489,1998.

Imataka, H.; Sonenberg, N.: Human eukaryotic translation initiation factor 4G (eIF4G) possesses two separate and independent binding sites for eIF4A. Molec. Cell. Biol. 17:6940-6947, 1997.

Yan, R.; Rhoads, R. E.: Human protein synthesis initiation factor eIF-4-gamma is encoded by a single gene (EIF4G) that maps to chromosome 3q27-qter. Genomics 26:394-398, 1995.

Yan, R.; Rychlik, W.; Etchison, D.; Rhoads, R. E.: Amino acid sequence of the human protein synthesis initiation factor eIF-4-gamma. J. Biol. Chem. 267:23226-23231, 1992.

Corrigall, A. V.; Hift, R. J.; Hancock, V.; Meissner, D.; Davids, L.; Kirsch, R. E.; Meissner, P. N.: Identification and characterisation of a deletion (537delAT) in the protoporphyrinogen oxidase gene in a South African variegate porphyria family. Hum. Mutat. 12:403-407,1998.

Aso, T.; Lane, W. S.; Conaway, J. W.; Conaway, R. C.: Elongin (SIII): a multisubunit regulator of elongation by RNA polymerase II. Science 269:1439-1443, 1995.

Vikkula, M.; Boon, L. M.; Carraway, K. L., III; Calvert, J. T.; Diamonti, A. J.; Goumnerov, B.; Pasyk, K. A.; Marchuk, D. A.; Warman, M. L.; Cantley, L. C.; Mulliken, J. B.; Olsen, B. R.: Vascular dysmorphogenesis caused by an activating mutation in the receptor tyrosine kinase TIE2. Cell 87:1181-1190, 1996.

Iwata, T.; Kogame, K.; Toki, T.; Yokoyama, M.; Yamamoto, M.; Ito, E.: Structure and chromosome mapping of the human small maf genes MAFG and MAFK. Cytogenet. Cell Genet. 82:88-90, 1998.

Motohashi, H.; Katsuoka, F.; Shavit, J. A.; Engel, J. D.; Yamamoto, M.: Positive or negative MARE-dependent transcriptional regulation is determined by the abundance of small Maf proteins. Cell 103:865-875, 2000.

Peters, L. L.; Eicher, E. M.: The ubiquitous subunit of the globin enhancer-binding protein NF-E2 (Nfe2u) maps to mouse chromosome 5. Genomics 22:490-491, 1994.

Shavit, J. A.; Motohashi, H.; Onodera, K.; Akasaka, J.; Yamamoto, M.; Engel, J. D.: Impaired megakaryopoiesis and behavioral defects in mafG-null mutant mice. Genes Dev. 12:2164-2174, 1998.

Toki, T.; Itoh, J.; Kitazawa, J.; Arai, K.; Hatakeyama, K.; Akasaka, J.; Igarashi, K.; Nomura, N.; Yokoyama, M.; Yamamoto, M.; Ito, E.: Human small Maf proteins form heterodimers with CNC family transcription factors and recognize the NF-E2 motif. Oncogene 14:1901-1910, 1997.

Yang, B.; He, B.; Abdel-Halim, S. M.; Tibell, A.; Brendel, M. D.; Bretzel, R. G.; Efendic, S.; Hillert, J.: Molecular cloning of a full-length cDNA for human type 3 adenylyl cyclase and its expression in human islets. Biochem. Biophys. Res. Commun. 254:548-551, 1999.

Dubbink, H. J.; Verkaik, N. S.; Faber, P. W.; Trapman, J.; Schroder, F. H.; Romijn, J. C.: Tissue-specific and androgen-regulated expression of human prostate-specific transglutaminase. Biochem. J. 315:901-908,1996.

Gentile, V.; Grant, F. J.; Porta, R.; Baldini, A.: Localization of the human prostate transglutaminase (type IV) gene (TGM4) to chromosome 3p21.33-p22 by fluorescence in situ hybridization. Genomics 27:219-220, 1995.

Grant, F. J.; Taylor, D. A.; Sheppard, P. O.; Mathewes, S. L.; Lint, W.; Vanaja, E.; Bishop, P. D.; O'Hara, P. J.: Molecular cloning and characterization of a novel transglutaminase cDNA from a human prostate cDNA library. Biochem. Biophys. Res. Commun. 203:1117-1123,1994.

Takai, S.; Long, J. E.; Yamada, K.; Miki, T.: Chromosomal localization of the human ECT2 proto-oncogene to 3q26.1-q26.2 by somatic cell analysis and fluorescence in situ hybridization. Genomics 27:220-222, 1995.

Takai, S.; Lorenzi, M. V.; Long, J. E.; Yamada, K.; Miki, T.: Assignment of the Ect2 proto-oncogene to mouse chromosome band 3B by in situ hybridization. Cytogenet. Cell Genet. 81:83-84, 1998.

Barker, H. M.; Brewis, N. D.; Street, A. J.; Spurr, N. K.; Cohen, P. T. W.: Three genes for protein phosphatase 1 map to different human chromosomes: sequence, expression and gene localisation of protein serine/threonine phosphatase 1 beta (PPP1CB). Biochim. Biophys. Acta 1220:212-218, 1994.

Saadat, M.; Kakinoki, Y.; Mizuno, Y.; Kikuchi, K.; Yoshida, M. C.: Chromosomal localization of human, rat, and mouse protein phosphatase type 1 beta catalytic subunit genes (PPP1CB) by fluorescence in situ hybridization. Jpn. J. Genet. 69:697-700, 1994.

Padilla, C. A.; Bajalica, S.; Lagercrantz, J.; Holmgren, A.: The gene for human glutaredoxin (GLRX) is localized to human chromosome 5q14. Genomics 32:455-457, 1996.

Padilla, C. A.; Martinez-Galisteo, E.; Barcena, J. A.; Spyrou, G.; Holmgren, A.: Purification from placenta, amino acid sequence, structure comparisons and cDNA cloning of human glutaredoxin. Europ. J. Biochem. 227:27-34, 1995.

Raghavachari, N.; Krysan, K.; Xing K.; Lou, M. F.: Regulation of thioltransferase expression in human lens epithelial cells. Invest. Ophthal. Vis. Sci. 42:1002-1008, 2001.

Liang, B. T.; Jacobson, K. A.: A physiological role of the adenosine A3 receptor: sustained cardio protection. Proc. Nat. Acad. Sci. 95:6995-6999, 1998.

Monitto, C. L.; Levitt, R. C.; DiSilvestre, D.; Holroyd, K. J.: Localization of the A(3) adenosine receptor gene (ADORA3) to human chromosome 1p. Genomics 26:637-638, 1995.

Sajjadi, F. G.; Firestein, G. S.: cDNA cloning and sequence analysis of the human A3 adenosine receptor. Biochim. Biophys. Acta 1179:105-107, 1993.

Zhao, Z.; Ravid, S.; Ravid, K.: Chromosomal mapping of the mouse A3 adenosine receptor gene, Adora3. Genomics 30:118-119, 1995.

Zhou, Q.-Y.; Li, C.; Olah, M. E.; Johnson, R. A.; Stiles, G. L.; Civelli, O.: Molecular cloning and characterization of an adenosine receptor: the A3 adenosine receptor. Proc. Nat. Acad. Sci. 89:7432-7436,1992.

von Gall, C.; Garabette, M. L.; Kell, C. A.; Frenzel, S.; Dehghani, F.; Schumm-Draeger, P.-M.; Weaver, D. R.; Korf, H.-W.; Hastings, M. H.; Stehle, J. H.: Rhythmic gene expression in pituitary depends on heterologous sensitization by the neurohormone melatonin. Nature Neurosci. 5:234-238, 2002.

Becq, F.; Hamon, Y.; Bajetto, A.; Gola, M.; Verrier, B.; Chimini, G.: ABC1, an ATP binding cassette transporter required for phagocytosis of apoptotic cells, generates a regulated anion flux after expression in Xenopus laevis oocytes. J. Biol. Chem. 272:2695-2699, 1997.

Decottignies, A.; Goffeau, A.: Complete inventory of the yeast ABC proteins. Nature Genet. 15:137-145, 1997.

Guo, Z.; Inazu, A.; Yu, W.; Suzumura, T.; Okamoto, M.; Nohara, A.; Higashikata, T.; Sano, R.; Wakasugi, K.; Hayakawa, T.; Yoshida, K.; Suehiro, T.; Schmitz, G.; Mabuchi, H.: Double deletions and missense mutations in the first nucleotide-binding fold of the ATP-binding cassette transporter A1 (ABCA1) gene in Japanese patients with Tangier disease. J. Hum. Genet. 47:325-329, 2002.

Hong, S. H.; Rhyne, J.; Zeller, K.; Miller, M.: Novel ABCA1 compound variant associated with HDL cholesterol deficiency. Biochim. Biophys. Acta 1587:60-64, 2002.

Huang, W.; Moriyama, K.; Koga, T.; Hua, H.; Ageta, M.; Kawabata, S.; Mawatari, K.; Imamura, T.; Eto, T.; Kawamura, M.; Teramoto, T.; Sasaki, J.: Novel mutations in ABCA1 gene in Japanese patients with Tangier disease and familial high density lipoprotein deficiency with coronary heart disease. Biochim. Biophys. Acta 1537:71-78, 2001.

Ishii, J.; Nagano, M.; Kujiraoka, T.; Ishihara, M.; Egashira, T.; Takada, D.; Tsuji, M.; Hattori, H.; Emi, M.: Clinical variant of Tangier disease in Japan: mutation of the ABCA1 gene in hypoalphalipoproteinemia with corneal lipidosis. J. Hum. Genet. 47:366-369, 2002.

Jennings, M. W.; Jones, R. W.; Wood, W. G.; Weatherall, D. J.: Analysis of an inversion within the human beta globin gene cluster. Nucleic Acids Res. 13:2897-2906, 1985.

Kulozik, A. E.; Bellan-Koch, A.; Kohne, E.; Kleihauer, E.: A deletion/inversion rearrangement of the beta-globin gene cluster in a Turkish family with delta-beta (0)-thalassemia intermedia. Blood 79:2455-2459, 1992.

Langmann, T.; Klucken, J.; Reil, M.; Liebisch, G.; Luciani, M.-F.; Chimini, G.; Kaminski, W. E.; Schmitz, G.: Molecular cloning of the human ATP-binding cassette transporter 1 (hABC1): evidence for sterol-dependent regulation in macrophages. Biochem. Biophys. Res. Commun. 257:29-33, 1999.

Lawn, R. M.; Wade, D. P.; Garvin, M. R.; Wang, X.; Schwartz, K.; Porter, J. G.; Seilhamer, J. J.; Vaughan, A. M.; Oram, J. F.: The Tangier disease gene product ABC1 controls the cellular apolipoprotein-mediated lipid removal pathway. J. Clin. Invest. 104: R25-R31, 1999.

Luciani, M. F.; Denizot, F.; Savary, S.; Mattei, M. G.; Chimini, G.: Cloning of two novel ABC transporters mapping on human chromosome 9. Genomics 21:150-159, 1994.

Marcil, M.; Boucher, B.; Krimbou, L.; Solymoss, B. C.; Davignon, J.; Frohlich, J.; Genest, J., Jr.: Severe familial HDL deficiency in French-Canadian kindreds: clinical, biochemical, and molecular characterization. Arterioscler. Thromb. Vasc. Biol. 15:1015-1024,1995.

Marcil, M.; Yu, L.; Krimbou, L.; Boucher, B.; Oram, J. F.; Cohn, J. S.; Genest, J., Jr.: Cellular cholesterol transport and efflux in fibroblasts are abnormal in subjects with familial HDL deficiency. Arterioscler. Thromb. Vasc. Biol. 19:159-169, 1999.

Pullinger, C. R.; Hakamata, H.; Duchateau, P. N.; Eng, C.; Aouizerat, B. E.; Cho, M. H.; Fielding, C. J.; Kane, J. P.: Analysis of hABC1gene 5-prime end: additional peptide sequence, promoter region, and four polymorphisms. Biochem. Biophys. Res. Commun. 271:451-455,2000.

Petit, M. M. R.; Schoenmakers, E. F. P. M.; Huysmans, C.; Geurts, J. M. W.; Mandahl, N.; Van de Ven, W. J. M.: LHFP, a novel translocation partner gene of HMGIC in a lipoma, is a member of a new family of LHFP-like genes. Genomics 57:438-441, 1999.

Lapicka-Bodzioch, K.; Bodzioch, M.; Krull, M.; Kielar, D.; Probst, M.; Kiec, B.; Andrikovics, H.; Bottcher, A.; Hubacek, J.; Aslanidis, C.; Suttorp, N.; Schmitz, G.: Homogeneous assay based on 52 primer sets to scan for mutations of the ABCA1 gene and its application in genetic analysis of a new patient with familial high-density lipoprotein deficiency syndrome. Biochim. Biophys. Acta 1537:42-48, 2001.

McNeish, J.; Aiello, R. J.; Guyot, D.; Turi, T.; Gabel, C.; Aldinger, C.; Hoppe, K. L.; Roach, M. L.; Royer, L. J.; de Wet, J.; Broccardo, C.; Chimini, G.; Francone, O. L.: High density lipoprotein deficiency and foam cell accumulation in mice with targeted disruption of ATP-binding cassette transporter-1. Proc. Nat. Acad. Sci. 97:4245-4250, 2000.

Nishita, Y.; Yoshida, I.; Sado, T.; Takagi, N.: Genomic imprinting and chromosomal localization of the human MEST gene. Genomics 36:539-542, 1996.

Kohen, R.; Metcalf, M. A.; Khan, N.; Druck, T.; Huebner, K.; Lachowicz, J. E.; Meltzer, H. Y.; Sibley, D. R.; Roth, B. L.; Hamblin, M. W.: Cloning, characterization, and chromosomal localization of a human 5-HT-6 serotonin receptor. J. Neurochem. 66:47-56, 1996.

Frank, J.; Aita, V. M.; Ahmad, W.; Lam, H.; Wolff, C.; Christiano, A. M.: Identification of a founder mutation in the protoporphyrinogen oxidase gene in variegate porphyria patients from Chile. Hum. Hered. 51:160-168, 2001.

Frank, J.; Jugert, F. K.; Breitkopf, C.; Goerz, G.; Merk, H. F.; Christiano, A. M.: Recurrent missense mutation in the protoporphyrinogen oxidase gene underlies variegate porphyria. Am. J. Med. Genet. 79:22-26, 1998.

Orso, E.; Broccardo, C.; Kaminski, W. E.; Bottcher, A.; Liebisch, G.; Drobnik, W.; Gotz, A.; Chambenoit, O.; Diederich, W.; Langmann, T.; Spruss, T.; Luciani, M.-F.; Rothe, G.; Lackner, K. J.; Chimini, G.; Schmitz, G.: Transport of lipids from Golgi to plasma membrane is defective in Tangier disease patients and Abc1-deficient mice. Nature Genet. 24:192-196, 2000.

Hift, R. J.; Meissner, P. N.; Corrigall, A. V.; Ziman, M. R.; Petersen, L. A.; Meissner, D. M.; Davidson, B. P.; Sutherland, J.; Dailey, H. A.; Kirsch, R. E.: Variegate porphyria in South Africa, 1688-1996: new developments in an old disease. S. Afr. Med. J. 87:722-731,1997.

Hift, R. J.; Meissner, P. N.; Todd, G.; Kirby, P.; Bilsland, D.; Collins, P.; Ferguson, J.; Moore, M. R.: Homozygous variegate porphyria: an evolving clinical syndrome. Postgrad. Med. J. 69:781-786, 1993.

Lam, H.; Dragan, L.; Tsou, H. C.; Merk, H.; Peacocke, M.; Goerz, G.; Sassa, S.; Poh-Fitzpatrick, M.; Bickers, D. R.; Christiano, A. M.: Molecular basis of variegate porphyria: a de novo insertion mutation in the protoporphyrinogen oxidase gene. Hum. Genet. 99:126-129,1997.

Puy, H.; Robreau, A.-M.; Rosipal, R.; Nordmann, Y.; Deybach, J.-C.: Protoporphyrinogen oxidase: complete genomic sequence and polymorphisms in the human gene. Biochem. Biophys. Res. Comm. 226:226-230, 1996.

Roberts, A. G.; Puy, H.; Dailey, T. A.; Morgan, R. R.; Whatley, S. D.; Dailey, H. A.; Martasek, P.; Nordmann, Y.; Deybach, J.-C.; Elder, G. H.: Molecular characterization of homozygous variegate porphyria. Hum. Molec. Genet. 7:1921-1925, 1998.

Honda, H.; Inazawa, J.; Nishida, J.; Yazaki, Y.; Hirai, H.: molecular cloning, characterization, and chromosomal localization of a novel protein-tyrosine phosphatase, HPTP eta. Blood 84:4186-4194, 1994.

Ostman, A.; Yang, Q.; Tonks, N. K.: Expression of DEP-1, a receptor-like protein-tyrosine-phosphatase, is enhanced with increasing cell density. Proc. Nat. Acad. Sci. 91:9680-9684, 1994.

Jacoby, A. S.; Webb, G. C.; Liu, M. L.; Kofler, B.; Hort, Y. J.; Fathi, Z.; Bottema, C. D. K.; Shine, J.; Iismaa, T. P.: Structural organization of the mouse and human GALR1 galanin receptor genes (Galnr and GALNR) and chromosomal localization of the mouse gene. Genomics 45:496-508, 1997.

Tomoda, T.; Kurashige, T.; Moriki, T.; Yamamoto, H.; Fujimoto, S.; Taniguchi, T.: Enhanced expression of poly (ADP-ribose) synthetase gene in malignant lymphoma. Am. J. Hemat. 37:223-227, 1991.

Vasquez, K. M.; Marburger, K.; Intody, Z.; Wilson, J. H.: Manipulating the mammalian genome by homologous recombination. Proc. Nat. Acad. Sci. 98:8403-8410, 2001.

Yu, S.-W.; Wang, H.; Poitras, M. F.; Coombs, C.; Bowers, W. J.; Federoff, H. J.; Poirier, G. G.; Dawson, T. M.; Dawson, V. L.: Mediation of poly (ADP-ribose) polymerase-1-dependent cell death by apoptosis-inducing factor. Science 297: 259-263, 2002.

Zabel, B. U.; Herzog, H.; Schneider, R.; Auer, B.; Hirsch-Kauffmann, M.; Schweiger, M.: Chromosomal sublocalization of the gene for human poly (ADP-ribose) polymerase (NAD+ADP-ribosyltransferase) at 1q41-42.(Abstract) Cytogenet. Cell Genet. 51:1115, 1989.

Hood, L.; Kronenberg, M.; Hunkapiller, T.: T cell antigen receptors and the immunoglobulin supergene family. Cell 40:225-229, 1985.

de Villiers, J. N. P.; Hillermann, R.; Loubser, L.; Kotze, M. J.: Spectrum of mutations in the HFE gene implicated in haemochromatosis and porphyria. Hum. Molec. Genet. 8:1517-1522, 1999.

Deybach, J.-C.; Puy, H.; Robreau, A.-M.; Lamoril, J.; Da Silva, V.; Grandchamp, B.; Nordmann, Y.: Mutations in the protoporphyrinogen oxidase gene in patients with variegate porphyria. Hum. Molec. Genet. 5:407-410, 1996.

Meissner, P. N.; Dailey, T. A.; Hift, R. J.; Ziman, M.; Corrigall, A. V.; Roberts, A. G.; Meissner, D. M.; Kirsch, R. E.; Dailey, H. A.: A R59W mutation in human protoporphyrinogen oxidase results in decreased enzyme activity and is prevalent in South Africans with variegate porphyria. Nature Genet. 13:95-97, 1996.

Kalman, K.; Nguyen, A.; Tseng-Crank, J.; Dukes, I. D.; Chandy, G.; Hustad, C. M.; Copeland, N. G.; Jenkins, N. A.; Mohrenweiser, H.; Brandriff, B.; Cahalan, M.; Gutman, G. A.; Chandy, K. G.: Genomic organization, chromosomal localization, tissue distribution, and biophysical characterization of a novel mammalian Shaker-related voltage-gated potassium channel, Kv1.7. J. Biol. Chem. 273:5851-5857, 1998.

Pulkka, A.; Ihalainen, R.; Suorsa, A.; Riviere, M.; Szpirer, J.; Pajunen, A.: Structures and chromosomal localizations of two rat genes encoding S-adenosylmethionine decarboxylase. Genomics 16:342-349, 1993.

Radford, D. M.; Eddy, R.; Haley, L.; Henry, W. M.; Pegg, A. E.; Pajunen, A.; Shows, T. B.: Gene sequences coding for S-adenosylmethionine decarboxylase are present on human chromosome 6 and the X and are not amplified in colon neoplasia. Cytogenet. Cell Genet. 49:285-288,1989.

Mendez, R.; Hake, L. E.; Andresson, T.; Littlepage, L. E.; Ruderman, J. V.; Richter, J. D.: Phosphorylation of CPE binding factor by Eg2 regulates translation of c-mos mRNA. Nature 404:302-307, 2000.

Wang, S.-Q.; Song, L.-S.; Lakatta, E. G.; Cheng, H.: Ca (2+) signalling between single L-type Ca (2+) channels and ryanodine receptors in heart cells. Nature 410:592-596, 2001.

Marx, S. O.; Reiken, S.; Hisamatsu, Y.; Jayaraman, T.; Burkhoff, D.; Rosemblit, N.; Marks, A. R.: PKA phosphorylation dissociates FKBP12.6 from the calcium release channel (ryanodine receptor): defective regulation in failing hearts. Cell 101:365-376, 2000.

Mattei, M. G.; Giannini, G.; Moscatelli, F.; Sorrentino, V.: Chromosomal localization of murine ryanodine receptor genes RYR1, RYR2, and RYR3by in situ hybridization. Genomics 22:202-204, 1994.

Bertocchini, F.; Ovitt, C. E.; Conti, A.; Barone, V.; Scholer, H. R.; Bottinelli, R.; Reggiani, C.; Sorrentino, V.: Requirement for the ryanodine receptor type 3 for efficient contraction in neonatal skeletal muscles. EMBO J. 16:6956-6963, 1997.

Futatsugi, A.; Kato, K.; Ogura, H.; Li, S.-T.; Nagata, E.; Kuwajima, G.; Tanaka, K.; Itohara, S.; Mikoshiba, K.: Facilitation of NMDAR-independent LTP and spatial learning in mutant mice lacking ryanodine receptor type 3. Neuron 24:701-713, 1999.

Hakamata, Y.; Nakai, J.; Takeshima, H.; Imoto, K.: Primary structure and distribution of a novel ryanodine receptor/calcium release channel from rabbit brain. FEBS Lett. 312:229-235, 1992.

Leeb, T.; Brenig, B.: cDNA cloning and sequencing of the human ryanodine receptor type 3 (RYR3) reveals a novel alternative splice site in the RYR3 gene. FEBS Lett. 423:367-370, 1998.

Sorrentino, V.; Giannini, G.; Malzac, P.; Mattei, M. G.: Localization of a novel ryanodine receptor gene (RYR3) to human chromosome 15q14-q15by in situ hybridization. Genomics 18:163-165, 1993.

Takeshima, H.; Ikemoto, T.; Nishi, M.; Nishiyama, N.; Shimuta, M.; Sugitani, Y.; Kuno, J.; Saito, I.; Saito, H.; Endo, M.; Iino, M.; Noda, T.: Generation and characterization of mutant mice lacking ryanodine receptor type 3. J. Biol. Chem. 271:19649-19652, 1996.

Park, S.-H.; Bendelac, A.: CD1-restricted T-cell responses and microbial infection. Nature 406:788-792, 2000.

Albertson, D. G.; Fishpool, R.; Sherrington, P.; Nacheva, E.; Milstein, C.: Sensitive and high resolution in situ hybridization to human chromosomes using biotin labelled probes: assignment of the human thymocyte CD1 antigen genes to chromosome 1. EMBO J. 7:2801-2805,1988.

Balk, S. P.; Bleicher, P. A.; Terhorst, C.: Isolation and characterization of a cDNA and gene coding for a fourth CD1 molecule. Proc. Nat. Acad. Sci. 86:252-256, 1989.

Calabi, F.; Milstein, C.: A novel family of human major histocompatibility complex-related genes not mapping to chromosome 6. Nature 323:540-543,1986.

Nishimura, K.; Taketani, S.; Inokuchi, H.: Cloning of a human CDNA for protoporphyrinogen oxidase by complementation in vivo of a hemG mutant of Escherichia coli. J. Biol. Chem. 270:8076-8080,1995.

Roberts, A. G.; Whatley, S. D.; Daniels, J.; Holmans, P.; Fenton, I.; Owen, M. J.; Thompson, P.; Long, C.; Elder, G. H.: Partial characterization and assignment of the gene for protoporphyrinogen oxidase and variegate porphyria to human chromosome 1q23. Hum. Molec. Genet. 4:2387-2390,1995.

Taketani, S.; Inazawa, J.; Abe, T.; Furukawa, T.; Kohno, H.; Tokunaga, R.; Nishimura, K.; Inokuchi, H.: The human protoporphyrinogen oxidase gene (PPOX): organization and location to chromosome 1. Genomics 29:698-703, 1995.

Warnich, L.; Kotze, M. J.; Groenewald, I. M.; Groenewald, J. Z.; van Brakel, M. G.; van Heerden, C. J.; de Villiers, J. N. P.; vande Ven, W. J. M.; Schoenmakers, E. F. P. M.; Taketani, S.; Retief, A. E.: Identification of three mutations and associated haplotypes in the protoporphyrinogen oxidase gene in South African families with variegate porphyria. Hum. Molec. Genet. 5:981-984, 1996.

Haas, M.; Ward, D. C.; Lee, J.; Roses, A. D.; Clarke, V.; d'Eustachio, P.; Lau, D.; Vega-Saenz de Miera, E.; Rudy, B.: Localization of Shaw-related K(+) channel genes on mouse and human chromosomes. Mammalian Genome 4:711-715, 1993.

Albrecht, B.; Weber, K.; Pongs, O.: Characterization of a voltage-activated K-channel gene cluster on human chromosome 12p13. Receptors Channels 3:213-220, 1995.

Grupe, A.; Schroter, K. H.; Ruppersberg, J. P.; Stocker, M.; Drewes, T.; Beckh, S.; Pongs, O.: Cloning and expression of a human voltage-gated potassium channel: a novel member of the RCK potassium channel family. EMBO J. 9:1749-1756, 1990.

Klocke, R.; Roberds, S. L.; Tamkun, M. M.; Gronemeier, M.; Augustin, A.; Albrecht, B.; Pongs, O.; Jockusch, H.: Chromosomal mapping in the mouse of eight K(+)-channel genes representing the four Shaker-like subfamilies Shaker, Shab, Shaw, and Shal. Genomics 18:568-574,1993.

Curran, M. E.; Landes, G. M.; Keating, M. T.: Molecular cloning, characterization, and genomic localization of a human potassium channel gene. Genomics 12:729-737, 1992.

Al-Chalabi, A.; Andersen, P. M.; Nilsson, P.; Chioza, B.; Andersson, J. L.; Russ, C.; Shaw, C. E.; Powell, J. F.; Leigh, P. N.: Deletions of the heavy neurofilament subunit tail in amyotrophic lateral sclerosis. Hum. Molec. Genet. 8:157-164, 1999.

Collard, J.-F.; Cote, F.; Julien, J.-P.: Defective axonal transport in a transgenic mouse model of amyotrophic lateral sclerosis. Nature 375:61-64, 1995.

Figlewicz, D. A.; Krizus, A.; Martinoli, M. G.; Meininger, V.; Dib, M.; Rouleau, G. A.; Julien, J.-P.: Variants of the heavy neurofilament subunit are associated with the development of amyotrophic lateral sclerosis. Hum. Molec. Genet. 3:1757-1761, 1994.

Lees, J. F.; Shneidman, P. S.; Skuntz, S. F.; Carden, M. J.; Lazzarini, R. A.: The structure and organization of the human heavy neurofilament subunit (NF-H) and the gene encoding it. EMBO J. 7:1947-1955, 1988.

Mattei, M.-G.; Dautigny, A.; Pham-Dinh, D.; Passage, E.; Mattei, J.-F.; Jolles, P.: The gene encoding the large human neurofilament subunit (NF-H) maps to the q121-q131 region on human chromosome 22. Hum. Genet. 80:293-295, 1988.

Rooke, K.; Figlewicz, D. A.; Han, F.; Rouleau, G. A.: analysis of the KSP repeat of the neurofilament heavy subunit in familial amyotrophic lateral sclerosis. Neurology 46:789-790, 1996.

Rouleau, G. A.; Merel, P.; Lutchman, M.; Sanson, M.; Zucman, J.; Marineau, C.; Hoang-Xuan, K.; Demczuk, S.; Desmaze, C.; Plougastel, B.; Pulst, S. M.; Lenoir, G.; Bijlsma, E.; Fashold, R.; Dumanski, J.; de Jong, P.; Parry, D.; Eldrige, R.; Aurias, A.; Delattre, O.; Thomas, G.: Alteration in a new gene encoding a putative membrane-organizing protein causes neuro-fibromatosis type 2. Nature 363:515-521, 1993.

Tomkins, J.; Usher, P.; Slade, J. Y.; Ince, P. G.; Curtis, A.; Bushby, K.; Shaw, P. J.: Novel insertion in the KSP region of the neurofilament heavy gene in amyotrophic lateral sclerosis. Neuroreport 9:3967-3970, 1998.

Vechio, J. D.; Bruijn, L. I.; Xu, Z.; Brown, R. H., Jr.; Cleveland, D. W.: Sequence variants in human neurofilament proteins: absence of linkage to familial amyotrophic lateral sclerosis. Ann. Neurol. 40:603-610, 1996.

Watson, C. J.; Gaunt, L.; Evans, G.; Patel, K.; Harris, R.; Strachan, T.: A disease-associated germline deletion maps the type 2 neurofibromatosis (NF2) gene between the Ewing sarcoma region and the leukaemia inhibitory factor locus. Hum. Molec. Genet. 2:701-704, 1993.

Barker, P. E.; Besmer, P.; Ruddle, F. H.: Human c-kit oncogene on human chromosome 4. (Abstract) Am. J. Hum. Genet. 37: A143, 1985.

Beghini, A.; Larizza, L.; Cairoli, R.; Morra, E.: c-kit activating mutations and mast cell proliferation in human leukemia. (Letter) Blood 92:701-702, 1998.

Beghini, A.; Tibiletti, M.; Roversi, G.; Chiaravalli, A.; Serio, G.; Capella, C.; Larizza, L.: Germline mutation in the juxtamembrane domain of the KIT gene in a family with gastrointestinal stromal tumors and urticaria pigmentosa. Cancer 92:657-662, 2001.

Blume-Jensen, P.; Jiang, G.; Hyman, R.; Lee, K.-F.; O'Gorman, S.; Hunter, T.: Kit/stem cell factor receptor-induced activation of phosphatidyl inositol 3-prime-kinase is essential for male fertility. Nature Genet. 24:157-162, 2000.

Bolognia, J. L.; Pawelek, J. M.: Biology of hypopigmentation. J. Am. Acad. Derm. 19:217-255, 1988.

Brannan, C. I.; Lyman, S. D.; Williams, D. E.; Eisenman, J.; Anderson, D. M.; Cosman, D.; Bedell, M. A.; Jenkins, N. A.; Copeland, N. G.: Steel-Dickie mutation encodes a c-kit ligand lacking transmembrane and cytoplasmic domains. Proc. Nat. Acad. Sci. 88:4671-4674, 1991.

Chabot, B.; Stephenson, D. A.; Chapman, V. M.; Besmer, P.; Bernstein, A.: The proto-oncogene c-kit encoding a transmembrane tyrosine kinase receptor maps to the mouse W locus. Nature 335:88-89, 1988.

d'Auriol, L.; Mattei, M.-G.; Andre, C.; Galibert, F.: Localization of the human c-kit proto-oncogene on the q11-q12 region of chromosome 4. Hum. Genet. 78:374-376, 1988.

De Miguel, M. P.; Cheng, L.; Holland, E. C.; Federspiel, M. J.; Donovan, P. J.: Dissection of the c-Kit signaling pathway in mouse primordial germ cells by retroviral-mediated gene transfer. Proc. Nat. Acad. Sci. 99:10458-10463, 2002.

Dubreuil, P.; Forrester, L.; Rottapel, R.; Reedijk, M.; Fujita, J.; Bernstein, A.: The c-fms gene complements the mitogenic defect in mast cells derived from mutant W mice but not mi (microphthalmia) mice. Proc. Nat. Acad. Sci. 88:2341-2345, 1991.

el-Omar, M.; Davies, J.; Gupta, S.; Ross, H.; Thompson, R.: Leiomyosarcoma in leiomyomatosis of the small intestine. Postgrad. Med. J. 70:661-664, 1994.

Fleischman, R. A.: Human piebald trait resulting from a dominant negative mutant allele of the c-kit membrane receptor gene. J. Clin. Invest. 89:1713-1717, 1992.

Fleischman, R. A.; Saltman, D. L.; Stastny, V.; Zneimer, S.:Deletion of the c-kit proto-oncogene in the human developmental defect piebald trait. Proc. Nat. Acad. Sci. 88:10885-10889, 1991.

Fritsche-Polanz, R.; Jordan, J.-H.; Feix, A.; Sperr, W. R.; Sunder-Plassmann, G.; Valent, P.; Fodinger, M.: Mutation analysis of C-KIT in patients with myelodysplastic syndromes without mastocytosis and cases of systemic mastocytosis. Brit. J. Haemat. 113:357-364, 2001.

Geissler, E. N.; Ryan, M. A.; Housman, D. E.: The dominant-white spotting (W) locus of the mouse encodes the c-kit proto-oncogene. Cell 55:185-192, 1988.

Giebel, L. B.; Spritz, R. A.: Mutation of the KIT (mast/stem cell growth factor receptor) proto-oncogene in human piebaldism. Proc. Nat. Acad. Sci. 88:8696-8699, 1991.

Hirota, S.; Isozaki, K.; Moriyama, Y.; Hashimoto, K.; Nishida, T.; Ishiguro, S.; Kawano, K.; Hanada, M.; Kurata, A.; Takeda, M.; Tunio, G. M.; Matsuzawa, Y.; Kanakura, Y.; Shinomura, Y.; Kitamura, Y.: Gain-of-function mutations of c-kit in human gastrointestinal stromal tumors. Science 279: 577-580, 1998.

Huizinga, J. D.; Thuneberg, L.; Kluppel, M.; Malysz, J.; Mikkelsen, H. B.; Bernstein, A.: W/kit gene required for interstitial cells of Cajal and for intestinal pacemaker activity. Nature 373:347-349,1995.

Ingram, D. A.; Yang, F.-C.; Travers, J. B.; Wenning, M. J.; Hiatt, K.; New, S.; Hood, A.; Shannon, K.; Williams, D. A.; Clapp, D. W.: Genetic and biochemical evidence that haploinsufficiency of the Nf1 tumor suppressor gene modulates melanocyte and mast cell fates in vivo. J. Exp. Med. 191:181-187, 2000.

Furitsu, T.; Tsujimura, T.; Tono, T.; Ikeda, H.; Kitayama, H.; Koshimizu, U.; Sugahara, H.; Butterfield, J. H.; Ashman, L. K.; Kanayama, Y.; Matsuzawa, Y.; Kitamura, Y.; Kanakura, Y.: Identification of mutations in the coding sequence of the proto-oncogene c-kit in a human mast cell leukemia cell line causing ligand-independent activation of c-kit product. J. Clin. Invest. 92:1736-1744, 1993.

Isozaki, K.; Terris, B.; Belghiti, J.; Schiffmann, S.; Hirota, S.; Vanderwinden, J.-M.: Germline-activating mutation in the kinase domain of KIT gene in familial gastrointestinal stromal tumors. Am. J. Path. 157:1581-1585, 2000.

Joensuu, H.; Roberts, P. J.; Sarlomo-Rikala, M.; Andersson, L. C.; Tervahartiala, P.; Tuveson, D.; Silberman, S. L.; Capdeville, R.; Dimitrijevic, S.; Druker, B.; Demetri, G. D.: Effect of the tyrosine kinase inhibitor STI571 in a patient with a metastatic gastrointestinal stromal tumor. New Eng. J. Med. 344:1052-1056, 2001.

Johansson Moller, M.; Chaudhary, R.; Hellmen, E.; Hoyheim, B.; Chowdhary, B.; Andersson, L.: Pigs with the dominant white coat color phenotype carry a duplication of the KIT gene encoding the mast/stem cell growth factor receptor. Mammalian Genome 7:822-830, 1996.

Lasota, J.; Jasinski, M.; Sarlomo-Rikala, M.; Miettinen, M.: Mutations in exon 11 of c-kit occur preferentially in malignant versus benign gastrointestinal stromal tumors and do not occur in leiomyomas or leiomyosarcomas. Am. J. Path. 154:53-60, 1999.

Longley, B. J.; Tyrrell, L.; Lu, S.-Z.; Ma, Y.-S.; Langley, K.; Ding, T.; Duffy, T.; Jacobs, P.; Tang, L. H.; Modlin, I.: Somatic-KIT activating mutation in urticaria pigmentosa and aggressive mastocytosis: establishment of clonality in a human mast cell neoplasm. Nature Genet. 12:312-314, 1996.

Longley, B. J., Jr.; Metcalfe, D. D.; Tharp, M.; Wang, X.; Tyrrell, L.; Lu, S.-Z.; Heitjan, D.; Ma, Y.: Activating and dominant inactivating c-KIT catalytic domain mutations in distinct clinical forms of human Mastocytosis. Proc. Nat. Acad. Sci. 96:1609-1614, 1999.

Marklund, S.; Kijas, J.; Rodriguez-Martinez, H.; Ronnstrand, L.; Funa, K.; Moller, M.; Lange, D.; Edfors-Lilja, I.; Andersson, L.: Molecular basis for the dominant white phenotype in the domestic pig. Genome Res. 8:826-833, 1998.

Minokoshi, Y.; Kim, Y.-B.; Peroni, O. D.; Fryer, L. G. D.; Muller, C.; Carling, D.; Kahn, B. B.: Leptin stimulates fatty-acid oxidation by activating AMP-activated protein kinase. Nature 415:339-343,2002.

Kiefer, M. C.; Tucker, J. E.; Joh, R.; Landsberg, K. E.; Saltman, D.; Barr, P. J.: Identification of a second human subtilisin-like protease gene in the fes/fps region of chromosome 15. DNA Cell Biol. 10:757-769, 1991.

Amiel, J.; Audollent, S.; Joly, D.; Dureau, P.; Salomon, R.; Tellier, A.-L.; Auge, J.; Bouissou, F.; Antignac, C.; Gubler, M.-C.; Eccles, M. R.; Munnich, A.; Vekemans, M.; Lyonnet, S.; Attie-Bitach, T.:PAX2 mutations in renal-coloboma syndrome: mutational hotspot and germline mosaicism. Europ. J. Hum. Genet. 8:820-826, 2000.

Dehbi, M.; Ghahremani, M.; Lechner, M.; Dressler, G.; Pelletier, J.: The paired-box transcription factor, PAX2, positively modulates expression of the Wilms' tumor suppressor gene. Oncogene 13:447-453,1996.

Devriendt, K.; Matthijs, G.; Van Damme, B.; Van Caesbroeck, D.; Eccles, M.; Vanrenterghem, Y.; Fryns, J.-P.; Leys, A.: Missense mutation and hexanucleotide duplication in the PAX2 gene in two unrelated families with renal-coloboma syndrome (MIM 120330). Hum. Genet. 103:149-153,1998.

Dressler, G. R.; Deutsch, U.; Chowdhury, K.; Nornes, H. O.; Gruss, P.: Pax2, a new murine paired-box-containing gene and its expression in the developing excretory system. Development 109:787-795, 1990.

Ford, B.; Rupps, R.; Lirenman, D.; Van Allen, M. I.; Farquharson, D.; Lyons, C.; Friedman, J. M.: Renal-coloboma syndrome: prenatal detection and clinical spectrum in a large family. Am. J. Med. Genet. 99:137-141, 2001.

Keller, S. A.; Jones, J. M.; Boyle, A.; Barrow, L. L.; Killen, P. D.; Green, D. G.; Kapousta, N. V.; Hitchcock, P. F.; Swank, R. T.; Meisler, M. H.: Kidney and retinal defects (Krd), a transgene-induced mutation with a deletion of mouse chromosome 19 that includes the Pax2 locus. Genomics 23:309-320, 1994.

Narahara, K.; Baker, E.; Ito, S.; Yokoyama, Y.; Yu, S.; Hewitt, D.; Sutherland, G. R.; Eccles, M. R.; Richards, R. I.: Localisation of a 10q breakpoint within the PAX2 gene in a patient with a de novo t (10;13) translocation and optic nerve coloboma-renal disease. J. Med. Genet. 34:213-216, 1997.

Pilz, A. J.; Povey, S.; Gruss, P.; Abbott, C. M.: Mapping of the human homologs of the murine paired-box-containing genes. Mammalian Genome 4:78-82, 1993.

Favor, J.; Sandulache, R.; Neuhauser-Klaus, A.; Pretsch, W.; Chatterjee, B.; Senft, E.; Wurst, W.; Blanquet, V.; Grimes, P.; Sporle, R.; Schughart, K.: The mouse Pax2(1Neu) mutation is identical to a human PAX2 mutation in a family with renal-coloboma syndrome and results in developmental defects of the brain, ear, eye, and kidney. Proc. Nat. Acad. Sci. 93:13870-13875, 1996.

Sap, J.; Munoz, A.; Damm, K.; Goldberg, Y.; Ghysdael, J.; Leutz, A.; Beug, H.; Vennstrom, B.: The c-erb-A protein is a high-affinity receptor for thyroid hormone. Nature 324:635-640, 1986.

Peel, A. L.; Rao, R. V.; Cottrell, B. A.; Hayden, M. R.; Ellerby, L. M.; Bredesen, D. E.: Double-stranded RNA-dependent protein kinase, PKR, binds preferentially to Huntington's disease (HD) transcripts and is activated in HD tissue. Hum. Molec. Genet. 10:1531-1538,2001.

Squire, J.; Meurs, E. F.; Chong, K. L.; McMillan, N. A. J.; Hovanessian, A. G.; Williams, B. R. G.: Localization of the human interferon-induced, ds-RNA activated p68 kinase gene (PRKR) to chromosome 2p21-p22. Genomics 16:768-770, 1993.

Taylor, D. R.; Shi, S. T.; Romano, P. R.; Barber, G. N.; Lal, M. M. C.: Inhibition of the interferon-inducible protein kinase PKR by HCV E2 protein. Science 285:107-110, 1999.

Brott, B. K.; Alessandrini, A.; Largaespada, D. A.; Copeland, N. G.; Jenkins, N. A.; Crews, C. M.; Erikson, R. L.: MEK2 is a kinase related to MEK1 and is differentially expressed in murine tissues. Cell Growth Differ. 4:921-929, 1993.

Crews, C. M.; Alessandrini, A.; Erikson, R. L.: The primary structure of MEK, a protein kinase that phosphorylates the ERK gene product. Science 258:478-480, 1992.

Favata, M. F.; Horiuchi, K. Y.; Manos, E. J.; Daulerio, A. J.; Stradley, D. A.; Feeser, W. S.; Van Dyk, D. E.; Pitts, W. J.; Earl, R. A.; Hobbs, F.; Copeland, R. A.; Magolda, R. L.; Scherle, P. A.; Trzaskos, J. M.: Identification of a novel inhibitor of mitogen-activated protein kinase kinase. J. Biol. Chem. 273:18623-18632, 1998.

Meloche, S.; Gopalbhai, K.; Beatty, B. G.; Scherer, S. W.; Pellerin, J.: Chromosome mapping of the human genes encoding the MAP kinase kinase MEK1 (MAP2K1) to 15q21 and MEK2 (MAP2K2) to 7q32. Cytogenet. Cell Genet. 88:249-252, 2000.

Orth, K.; Palmer, L. E.; Bao, Z. Q.; Stewart, S.; Rudolph, A. E.; Bliska, J. B.; Dixon, J. E.: Inhibition of the mitogen-activated protein kinase kinase superfamily by a Yersinia effector. Science 285:1920-1923, 1999.

Perry, R. L. S.; Parker, M. H.; Rudnicki, M. A.: Activated MEK1 binds the nuclear MyoD transcriptional complex to repress transactivation. Molec. Cell 8:291-301, 2001.

Pleschka, S.; Wolff, T.; Ehrhardt, C.; Hobom, G.; Planz, O.; Rapp, U. R.; Ludwig, S.: Influenza virus propagation is impaired by inhibition of the Raf/MEK/ERK signalling cascade. Nature Cell Biol. 3:301-305,2001.

Rampoldi, L.; Zimbello, R.; Bortoluzzi, S.; Tiso, N.; Valle, G.; Lanfranchi, G.; Danieli, G. A.: Chromosomal localization of four MAPK signaling cascade genes: MEK1, MEK3, MEK4 and MEKK5. Cytogenet. Cell Genet. 78:301-303, 1997.

Ryan, K. M.; Ernst, M. K.; Rice, N. R.; Vousden, K. H.: Role of NF-kappa-B in p53-mediated programmed cell death. Nature 404:892-897,2000.

Sebolt-Leopold, J. S.; Dudley, D. T.; Herrera, R.; Van Becelaere, K.; Wiland, A.; Gowan, R. C.; Tecle, H.; Barrett, S. D.; Bridges, A.; Przybranowski, S.; Leopold, W. R.; Saltiel, A. R.: Blockade of the MAP kinase pathway suppresses growth of colon tumors in vivo. Nature Med. 5:810-816, 1999.

Seger, R.; Krebs, E. G.: The MAPK signaling cascade. FASEB J. 9:726-735, 1995.

Seger, R.; Seger, D.; Lozeman, F. J.; Ahn, N. G.; Graves, L. M.; Campbell, J. S.; Ericsson, L.; Harrylock, M.; Jensen, A. M.; Krebs, E. G.: Human T-cell mitogen-activated protein kinase kinases are related to yeast signal transduction kinases. J. Biol. Chem. 267:25628-25631, 1992.

Zheng, C. F.; Guan, K. L.: Cloning and characterization of two distinct human extracellular signal-regulated kinase activator kinases, MEK1 and MEK2. J. Biol. Chem. 268:11435-11439, 1993.

White, P. S.; Maris, J. M.; Beltinger, C.; Sulman, E.; Marshall, H. N.; Fujimori, M.; Kaufman, B. A.; Biegel, J. A.; Allen, C.; Hilliard, C.; Valentine, M. B.; Look, A. T.; Enomoto, H.; Sakiyama, S.; Brodeur, G. M.: A region of consistent deletion in neuroblastoma maps within human chromosome 1p36.2-36.3. Proc. Nat. Acad. Sci. 92:5520-5524,1995.

Keller, D. M.; Zeng, X.; Wang, Y.; Zhang, Q. H.; Kapoor, M.; Shu, H.; Goodman, R.; Lozano, G.; Zhao, Y.; Lu, H.: A DNA damage-induced p53 serine 392 kinase complex contains CK2, hSpt16, and SSRP1. Molec. Cell 283-292, 2001.

Lanske, B.; Karaplis, A. C.; Lee, K.; Luz, A.; Vortkamp, A.; Pirro, A.; Karperien, M.; Defize, L. H. K.; Ho, C.; Mulligan, R. C.; Abou-Samra, A.-B.; Juppner, H.; Segre, G. V.; Kronenberg, H. M.: PTH/PTHrP receptor in early development and Indian hedgehog-regulated bone growth. Science 273:663-666, 1996.

Albright, F.: Case records of the Massachusetts General Hospital (case 27461). New Eng. J. Med. 225:789-791, 1941.

Bakre, M. M.; Zhu, Y.; Yin, H.; Burton, D. W.; Terkeltaub, R.; Deftos, L. J.; Varner, J. A.: Parathyroid hormone-related peptide is a naturally occurring, protein kinase A-dependent angiogenesis inhibitor. Nature Med. 8:995-1003, 2002.

Broadus, A. E.; Mangin, M.; Ikeda, K.; Insogna, K. L.; Weir, E. C.; Burtis, W. J.; Stewart, A. F.: Humoral hypercalcemia of cancer: identification of a novel parathyroid hormone-like peptide. New Eng. J. Med. 319:556-563, 1988.

Hammonds, R. G., Jr.; McKay, P.; Winslow, G. A.; Diefenbach-Jagger, H.; Grill, V.; Glatz, J.; Rodda, C. P.; Moseley, J. M.; Wood, W. I.; Martin, T. J.: Purification and characterization of recombinant human parathyroid hormone-related protein. J. Biol. Chem. 264:14806-14811,1989.

Hendy, G. N.; Sakaguchi, A. Y.; Lalley, P. A.; Martinez, L.; Yasuda, T.; Banville, D.; Goltzman, D.: Gene for parathyroid hormone-like peptide is on mouse chromosome 6. Cytogenet. Cell Genet. 53:80-82,1990.

Hendy, G. N.; Sakaguchi, A. Y.; Lalley, P. A.; Martinez, L.; Yasuda, T.; Banville, D.; Goltzman, D.: Gene for parathyroid hormone-like peptide is on mouse chromosome 6. (Abstract) Cytogenet. Cell Genet. 51:1003 only, 1989.

Mercader, N.; Leonardo, E.; Azpiazu, N.; Serrano, A.; Morata, G.; Martinez-A, C.; Torres, M.: Conserved regulation of proximodistal limb axis development by Meis1/Hth. Nature 402:425-429, 1999.

Monica, K.; Galili, N.; Nourse, J.; Saltman, D.; Cleary, M. L.: PBX2 and PBX3, new homeobox genes with extensive homology to the human proto-oncogene PBX1. Molec. Cell. Biol. 11:6149-6157, 1991.

Aguado, B.; Campbell, R. D.: The novel gene G17, located in the human major histocompatibility complex, encodes PBX2, a homeodomain-containing protein. Genomics 25:650-659, 1995.

Katsanis, N.; Fitzgibbon, J.; Fisher, E. M. C.: Paralogy mapping: identification of a region in the human MHC triplicated onto human chromosomes 1 and 9 allows the prediction and isolation of novel PBX and NOTCH loci. Genomics 35:101-108, 1996.

Hourvitz, A.; Widger, A. E.; Filho, F. L. T.; Chang, R. J.; Adashi, E. Y.; Erickson, G. F.: Pregnancy-associated plasma protein-A gene expression in human ovaries is restricted to healthy follicles and corpora lutea. J. Clin. Endocr. Metab. 85:4916-4919, 2000.

Lawrence, J. B.; Oxvig, C.; Overgaard, M. T.; Sottrup-Jensen, L.; Gleich, G. J.; Hays, L. G.; Yates, J. R., III; Conover, C. A.: The insulin-like growth factor (IGF)-dependent IGF binding protein-4 protease secreted by human fibroblasts is pregnancy-associated plasma protein-A. Proc. Nat. Acad. Sci. 96:3149-3153, 1999.

Silahtaroglu, A. N.; Tumer, Z.; Kristensen, T.; Sottrup-Jensen, L.; Tommerup, N.: Assignment of the human gene for pregnancy-associated plasma protein A (PAPPA) to 9q33.1 by fluorescence in situ hybridization to mitotic and meiotic chromosomes. Cytogenet. Cell Genet. 62:214-216,1993.

Smith, G. C. S.; Stenhouse, E. J.; Crossley, J. A.; Aitken, D. A.; Cameron, A. D.; Connor, J. M.: Early pregnancy levels of pregnancy-associated plasma protein A and the risk of intrauterine growth restriction, premature birth, preeclampsia, and stillbirth. J. Clin. Endocr. Metab. 87:1762-1767, 2002.

Smith, G. C. S.; Stenhouse, E. J.; Crossley, J. A.; Aitken, D. A.; Cameron, A. D.; Connor, J. M.: Early-pregnancy origins of low birth weight. Nature 417:916 only, 2002.

Eisenhofer, G.; Walther, M. M.; Huynh, T.-T.; Li, S.-T.; Bornstein, S. R.; Vortmeyer, A.; Mannelli, M.; Goldstein, D. S.; Linehan, W. M.; Lenders, J. W. M.; Pacak, K.: Pheochromocytomas in von Hippel-Lindau syndrome and multiple endocrine neoplasia type 2 display distinct biochemical and clinical phenotypes. J. Clin. Endocr. Metab. 86:1999-2008, 2001.

Lorimer, D. D.; Benya, R. V.: Cloning and quantification of galanin-1receptor expression by mucosal cells lining the human gastrointestinal tract. Biochem. Biophys. Res. Commun. 222:379-385, 1996.

Nicholl, J.; Kofler, B.; Sutherland, G. R.; Shine, J.; Iismaa, T. P.: Assignment of the gene encoding human galanin receptor (GALNR) to 18q23 by in situ hybridization. Genomics 30:629-630, 1995.

Parker, E. M.; Izzarelli, D. G.; Nowak, H. P.; Mahle, C. D.; Iben, L. G.; Wang, J.; Goldstein, M. E.: Cloning and characterization of the rat GALR1 galanin receptor from Rin14B insulinoma cells. Molec. Brain Res. 34:179-189, 1995.

Simoneaux, D. K.; Leach, R. J.; O'Connell, P.: Galanin receptor1 gene (Galnr1) is tightly linked to the myelin basic protein gene on chromosome 18 in mouse. Mammalian Genome 8:875 only, 1997.

Walli, R.; Schafer, H.; Morys-Wortmann, C.; Paetzold, G.; Nustede, R.; Schmidt, W. E.: Identification and biochemical characterization of the human brain galanin receptor. J. Molec. Endocr. 13:347-356,1994.

Gordenin, D. A.; Kunkel, T. A.; Resnick, M. A.: Repeat expansion--all in a flap? Nature Genet. 16:116-118, 1997.

Greene, A. L.; Snipe, J. R.; Gordenin, D. A.; Resnick, M. A.:Functional analysis of human FEN1 in Saccharomyces cerevisiae and its role in genome stability. Hum. Molec. Genet. 8:2263-2273, 1999.

Augusseau, S.; Jouk, S.; Jalbert, P.; Prieur, M.: DiGeorge syndrome and 22q11 rearrangements. (Letter) Hum. Genet. 74:206 only, 1986.

Van Esch, H.; Groenen, P.; Daw, S.; Poffyn, A.; Holvoet, M.; Scambler, P.; Fryns, J.-P.; Van de Ven, W.; Devriendt, K.: Partial DiGeorge syndrome in two patients with a 10p rearrangement. Clin. Genet. 55:269-276, 1999.

Wadey, R.; Daw, S.; Taylor, C.; Atif, U.; Kamath, S.; Halford, S.; O'Donnell, H.; Wilson, D.; Goodship, J.; Burn, J.; Scambler, P.: Isolation of a gene encoding an integral membrane protein from the vicinity of a balanced translocation breakpoint associated with DiGeorge syndrome. Hum. Molec. Genet. 4:1027-1033, 1995.

Contractor, A.; Rogers, C.; Maron, C.; Henkemeyer, M.; Swanson, G. T.; Heinemann, S. F.: Trans-synaptic Eph receptor-ephrin signaling in hippocampal mossy fiber LTP. Science 296:1864-1869, 2002.

Tang, X. X.; Biegel, J. A.; Nycum, L. M.; Yoshioka, A.; Brodeur, G. M.; Pleasure, D. E.; Ikegaki, N.: cDNA cloning, molecular characterization, and chromosomal localization of NET (EPHT2), a human EPH-related receptor protein-tyrosine kinase gene preferentially expressed in braiN.: Genomics 29:426-437, 1995.

Kamp, C.; Hirschmann, P.; Voss, H.; Huellen, K.; Vogt, P. H.:Two long homologous retroviral sequence blocks in proximal Yq11 cause AZFa microdeletions as a result of intrachromosomal recombination events. Hum. Molec. Genet. 9:2563-2572, 2000.

Krausz, C.; Meyts, E. R.-D.; Frydelund-Larson, L.; Quintana-Murci, L.; McElreavey, K.; Skakkebaek, N. E.: Double-blind Y chromosome microdeletion analysis in men with known sperm parameters and reproductive hormone profiles: microdeletions are specific for spermatogenic failure. J. Clin. Endocr. Metab. 86:2638-2642, 2001.

Simpson, E.; Chandler, P.; Goulmy, E.; Ma, K.; Hargreave, T. B.; Chandley, A. C.: Loss of the 'azoospermia factor' (AZF) on Yq in man is not associated with loss of HYA. Hum. Molec. Genet. 2:469-471,1993.

Sun, C.; Skaletsky, H.; Rozen, S.; Gromoll, J.; Nieschlag, E.; Oates, R.; Page, D. C.: Deletion of azoospermia factor a (AZFa) region of human Y chromosome caused by recombination between HERV15 proviruses. Hum. Molec. Genet. 9:2291-2296, 2000.

Krausz, C.; Quintana-Murci, L.; Barbaux, S.; Siffroi, J.-P.; Rouba, H.; Delafontaine, D.; Souleyreau-Therville, N.; Arvis, G.; Antoine, J. M.; Erdei, E.; Taar, J. P.; Tar, A.; Jeandidier, E.; Plessis, G.; Bourgeron, T.; Dadoune, J.-P.; Fellous, M.; McElreavey, K.: A high frequency of Y chromosome deletions in males with nonidiopathic infertility. J. Clin. Endocr. Metab. 84:3606-3612, 1999.

Ma, K.; Inglis, J. D.; Sharkey, A.; Bickmore, W. A.; Hill, R. E.; Prosser, E. J.; Speed, R. M.; Thomson, E. J.; Jobling, M.; Taylor, K.; Wolfe, J.; Cooke, H. J.; Hargreave, T. B.; Chandley, A. C.: A Y chromosome gene family with RNA-binding protein homology: candidates for the azoospermia factor AZF controlling human spermatogenesis. Cell 75:1287-1295, 1993.

Vergnaud, G.; Page, D. C.; Simmler, M. C.; Brown, L.; Rouyer, F.; Noel, B.; Botstein, D.; de la Chapelle, A.; Weissenbach, J.: A deletion map of the human Y chromosome based on DNA hybridization. Am. J. Hum. Genet. 38:109-124, 1986.

Vogt, P.; Chandley, A. C.; Hargreave, T. B.; Keil, R.; Ma, K.; Sharkey, A.: Microdeletions in interval 6 of the Y chromosome of males with idiopathic sterility point to disruption of AZF, a human spermatogenesis gene. Hum. Genet. 89:491-496, 1992.

Vogt, P. H.; Edelmann, A.; Kirsch, S.; Henegariu, O.; Hirschmann, P.; Kiesewetter, F.; Kohn, F. M.; Schill, W. B.; Farah, S.; Ramos, C.; Hartmann, M.; Hartschuh, W.; Meschede, D.; Behre, H. M.; Castel, A.; Nieschlag, E.; Weidner, W.; Grone, H.-J.; Jung, A.; Engel, W.; Haidl, G.: Human Y chromosome azoospermia factors (AZF) mapped to different subregions in Yq11. Hum. Molec. Genet. 5:933-943, 1996.

Rohen, C.; Caselitz, J.; Stern, C.; Wanschura, S.; Schoenmakers, E. F.; Van de Ven, W. J.; Barnitzke, S.; Bullerdiek, J.: A hamartoma of the breast with an aberration of 12q mapped to the MAR region by fluorescence in situ hybridization. Genes Chromosomes Cancer 84:82-84, 1995.

Schoenmakers, E. F. P. M.; Huysmans, C.; Van de Ven, W. J. M.: Allelic knockout of novel splice variants of human recombination repair gene RAD51B in t (12;14) uterine leiomyomas. Cancer Res. 59:19-23, 1999.

Zhou, X.; Benson, K. F.; Ashar, H. R.; Chada, K.: Mutation responsible for the mouse pygmy phenotype in the developmentally regulated factor HMGI-C. Nature 377:771-774, 1995.

Burgess, D. L.; Kohrman, D. C.; Galt, J.; Plummer, N. W.; Jones, J. M.; Spear, B.; Meisler, M. H.: Mutation of a new sodium channel gene, Scn8a, in the mouse mutant 'motor endplate disease'. Nature Genet. 10:461-465, 1995.

DeRepentigny, Y.; Cote, P. D.; Pool, M.; Bernier, G.; Girard, S.; Vidal, S. M.; Kothary, R.: Pathological and genetic analysis of the degenerating muscle (dmu) mouse: a new allele of Scn8a. Hum. Molec. Genet. 10:1819-1827, 2001.

Kohrman, D. C.; Harris, J. B.; Meisler, M. H.: Mutation detection in the med and med (J) alleles of the sodium channel Scn8a: unusual splicing due to a minor class AT-AC intron. J. Biol. Chem. 271:17576-17581, 1996.

Kohrman, D. C.; Plummer, N. W.; Schuster, T.; Jones, J. M.; Jang, W.; Burgess, D. L.; Galt, J.; Spear, B. T.; Meisler, M. H.: Insertional mutation of the motor endplate disease (med) locus on mouse chromosome 15. Genomics 26:171-177, 1995.

Kohrman, D. C.; Smith, M. R.; Goldin, A. L.; Harris, J.; Meisler, M. H.: A missense mutation in the sodium channel Scn8a is responsible for cerebellar ataxia in the mouse mutant jolting. J. Neurosci. 16:5993-5999, 1996.

Meisler, M. H.; Sprunger, L. K.; Plummer, N. W.; Escayg, A.; Jones, J. M.: Ion channel mutations in mouse models of inherited neurological disease. Ann. Med. 29:569-574, 1997.

Plummer, N. W.; Galt, J.; Jones, J. M.; Burgess, D. L.; Sprunger, L. K.; Kohrman, D. C.; Meisler, M. H.: Exon organization, coding sequence, physical mapping, and polymorphic intragenic markers for the human neuronal sodium channel gene SCN8A. Genomics 54:287-296,1998.

Plummer, N. W.; McBurney, M. W.; Meisler, M. H.: Alternative splicing of the sodium channel SCN8A predicts a truncated two-domain protein in fetal brain and non-neuronal cells. J. Biol. Chem. 272:24008-24015,1997.

Reid, E.; Escayg, A.; Dearlove, A. M.; Lee, D. D.; Meisler, M. H.; Rubinsztein, D. C.: The spastic paraplegia SPG10 locus: narrowing of critical region and exclusion of sodium channel gene SCN8A as a candidate. J. Med. Genet. 38:65-67, 2001.

Sprunger, L. K.; Escayg, A.; Tallaksen-Greene, S.; Albin, R. L.; Meisler, M. H.: Dystonia associated with mutation of the neuronal sodium channel Scn8a and identification of the modifier locus Scnm1 on mouse chromosome 3. Hum. Molec. Genet. 8:471-479, 1999.

Eden, S.; Rohatgi, R.; Podtelejnikov, A. V.; Mann, M.; Kirschner, M. W.: Mechanism of regulation of WAVE1-induced actin nucleation by Rac1 and Nck. Nature 418:790-793, 2002.

Casey, J. L.; Di Jeso, B.; Rao, K.; Klausner, R. D.; Harford, J. B.: Two genetic loci participate in the regulation by iron of the gene for the human transferrin receptor. Proc. Nat. Acad. Sci. 85:1787-1791, 1988.

Enns, C. A.; Suomalainen, H. A.; Gebhardt, J. E.; Schroder, J.; Sussman, H. H.: Human transferrin receptor: expression of the receptor is assigned to chromosome 3. Proc. Nat. Acad. Sci. 79:3241-3245,1982.

Gareau, R.; Gagnon, M. G.; Thellend, C.; Chenard, C.; Audran, M.; Chanal, J.-L.; Ayotte, C.; Brisson, G. R.: Transferrin soluble receptor: a possible probe for detection of erythropoietin abuse by athletes. Horm. Metab. Res. 26:311-312, 1994.

Goodfellow, P. N.; Banting, G.; Sutherland, R.; Greaves, M.; Solomon, E.; Povey, S.: Expression of human transferrin receptor is controlled by a gene on chromosome 3: assignment using species specificity of a monoclonal antibody. Somat. Cell Genet. 8:197-206, 1982.

Larrick, J. W.; Hyman, E. S.: Acquired iron-deficiency anemia caused by an antibody against the transferrin receptor. New Eng. J. Med. 311:214-218, 1984.

Levy, J. E.; Jin, O.; Fujiwara, Y.; Kuo, F.; Andrews, N. C.: Transferrin receptor is necessary for development of erythrocytes and the nervous system. Nature Genet. 21:396-399, 1999.

Miller, Y. E.; Jones, C.; Scoggin, C.; Morse, H.; Seligman, P.: Chromosome 3q (22-ter) encodes the human transferrin receptor. Am. J. Hum. Genet. 35:573-583, 1983.

Newman, R.; Schneider, C.; Sutherland, R.; Vodinelich, L.; Greaves, M.: The transferrin receptor. Trends Biochem. Sci. 7:397-400,1982.

Nikinmaa, B.; Schroder, J.: Two antigens, the transferrin receptor and p90 assigned to human chromosome 3, are probably the same protein. Hereditas 107:55-58, 1987.

Omary, M. B.; Trowbridge, I. S.: Biosynthesis of the human transferrin receptor in cultured cells. J. Biol. Chem. 256:12888-12892, 1981.

Kashuba, V. I.; Gizatullin, R. Z.; Protopopov, A. I.; Allikmets, R.; Korolev, S.; Li, J.; Boldog, F.; Tory, K.; Zabarovska, V.; Marcsek, Z.; Sumegi, J.; Klein, G.; Zabarovsky, E. R.; Kisselev, L.: NotI linking/jumping clones of human chromosome 3: mapping of the TFRC, RAB7 and HAUSP genes to regions rearranged in leukemia and deleted in solid tumors. FEBS Lett. 419:181-185, 1997.

Rabin, M.; McClelland, A.; Kuhn, L.; Ruddle, F. H.: Regional localization of the human transferrin receptor gene to 3q26.2-qter. Am. J. Hum. Genet. 37:1112-1116, 1985.

Schneider, C.; Kurkinen, M.; Greaves, M.: Isolation of cDNA clones for the human transferrin receptor. EMBO J. 2:2259-2263, 1983.

Schneider, C.; Owen, M. J.; Banville, D.; Williams, J. G.: Primary structure of human transferrin receptor deduced from the mRNA sequence. Nature 311:675-678, 1984.

Valenzuela, C. Y.; Avendano, A.; Harb, Z.: Association between Rh and plasma iron binding (transferrin). Hum. Genet. 87:438-440,1991.

Vodinelich, L.; Sutherland, R.; Schneider, C.; Newman, R.; Greaves, M.: Receptor for transferrin may be a 'target' structure for natural killer cells. Proc. Nat. Acad. Sci. 80:835-839, 1983.

Carmellet, P.; Ferreira, V.; Breler, G.; Pollefeyt, S.; Kleckens, L.; Gertsenstein, M.; Fahrig, M.; Vandenhoeck, A.; Harpal, K.; Eberhardt, C.; Declercq, C.; Pawling, J.; Moons, L.; Collen, D.; Risau, W.; Nagy, A.: Abnormal blood vessel development and lethality in embryos lacking a single VEGF allele. Nature 380:435-439, 1996.

Martin, L. H.; Calabi, F.; Lefebvre, F.-A.; Bilsland, C. A. G.; Milstein, C.: Structure and expression of the human thymocyte antigens CD1a, CD1b, and CD1c. Proc. Nat. Acad. Sci. 84:9189-9193, 1987.

Martin, L. H.; Calabi, F.; Milstein, C.: Isolation of CD1 genes: a family of major histocompatibility complex-related differentiation antigens. Proc. Nat. Acad. Sci. 83:9154-9158, 1986.

Moseley, W. S.; Watson, M. L.; Kingsmore, S. F.; Seldin, M. F.: CD1 defines conserved linkage group border between human chromosomes 1 and mouse chromosomes 1 and 3. Immunogenetics 30:378-382, 1989.

Crow, R. S.: Peripheral neuritis in myelomatosis. Brit. Med. J. 2:802-804, 1956.

Dantz, D.; Bewersdorf, J.; Fruehwald-Schultes, B.; Kern, W.; Jelkmann, W.; Born, J.; Fehm, H. L.; Peters, A.: Vascular endothelial growth factor: a novel endocrine defensive response to hypoglycemia. J. Clin. Endocr. Metab. 87:835-840, 2002.

Ferrara, N.; Carver-Moore, K.; Chen, H.; Dowd, M.; Lu, L.; O'Shea, K. S.; Powell-Braxton, L.; Hillan, K. J.; Moore, M. W.: Heterozygous embryonic lethality induced by targeted inactivation of the VEGF gene. Nature 380:439-442, 1996.

Folkman, J.: Angiogenesis in cancer, vascular, rheumatoid and other disease. Nature Med. 1:27-31, 1995.

Fukumura, D.; Xavier, R.; Sugiura, T.; Chen, Y.; Park, E.-C.; Lu, N.; Selig, M.; Nielsen, G.; Taksir, T.; Jain, R. K.;

Seed, B.: Tumor induction of VEGF promoter activity in stromal cells. Cell 94:715-725,1998.

Gerber, H.-P.; Malik, A. K.; Solar, G. P.; Sherman, D.; Liang, X. H.; Meng, G.; Hong, K.; Marsters, J. C.; Ferrara, N.: VEGF regulates haematopoietic stem cell survival by an internal autocrine loop mechanism. Nature 417:954-958, 2002.

Gerber, H.-P.; Vu, T. H.; Ryan, A. M.; Kowalski, J.; Werb, Z.; Ferrara, N.: VEGF couples hypertrophic cartilage remodeling, ossification and angiogenesis during endochondral bone formation. Nature Med. 5:623-628, 1999.

Giordano, F. J.; Gerber, H.-P.; Williams, S.-P.; Van-Bruggen, N.; Bunting, S.; Ruiz-Lozano, P.; Gu, Y.; Nath, A. K.; Huang, Y.; Hickey, R.; Dalton, N.; Peterson, K. L.; Ross, J., Jr.; Chien, K. R.; Ferrara, N.: A cardiac myocyte vascular endothelial growth factor paracrine pathway is required to maintain cardiac function. Proc. Nat. Acad. Sci. 98:5780-5785, 2001.

Helmlinger, G.; Endo, M.; Ferrara, N.; Hlatky, L.; Jain, R. K.: Formation of endothelial cell networks. Nature 405:139-141, 2000.

Hofman, P.; van Blijswijk, B. C.; Gaillard, P. J.; Vrensen, G. F. J. M.; Schlingemann, R. O.: Endothelial cell hypertrophy induced by vascular endothelial growth factor in the retina: new insights into the pathogenesis of capillary non-perfusion. Arch. Ophthal. 119:861-866, 2001.

Holash, J.; Maisonpierre, P. C.; Compton, D.; Boland, P.; Alexander, C. R.; Zagzag, D.; Yancopoulos, G. D.; Wiegand, S. J.: Vessel cooption, regression, and growth in tumors mediated by angiopoietins and VEGF. Science 284:1994-1998, 1999.

Jin, K.; Zhu, Y.; Sun, Y.; Mao, X. O.; Xie, L.; Greenberg, D. A.: Vascular endothelial growth factor (VEGF) stimulates neurogenesis in vitro and in vivo. Proc. Nat. Acad. Sci. 99:11946-11950, 2002.

Mattei, M.-G.; Borg, J.-P.; Rosnet, O.; Marme, D.; Birnbaum, D.: Assignment of vascular endothelial growth factor (VEGF) and placenta growth factor (PlGF) genes to human chromosome 6p12-p21 and 14q24-q31 regions, respectively. Genomics 32:168-169, 1996.

Miralles, G. D.; O'Fallon, J. R.; Talley, N. J.: Plasma-cell dyscrasia with polyneuropathy: the spectrum of POEMS syndrome. New Eng. J. Med. 327:1919-1923, 1992.

Mueller, M. D.; Vigne, J.-L.; Minchenko, A.; Lebovic, D. I.; Leitman, D. C.; Taylor, R. N.: Regulation of vascular endothelial growth factor (VEGF) gene transcription by estrogen receptors alpha and beta. Proc. Nat. Acad. Sci. 97:10972-10977, 2000.

Nakanishi, T.; Sobue, I.; Toyokura, Y.; Nishitani, H.; Kuroiwa, Y.; Satoyoshi, E.; Tsubaki, T.; Igata, A.; Ozaki, Y.: The Crow-Fukase syndrome: a study of 102 cases in Japan. Neurology 34:712-720,1984.

Niimi, H.; Arimura, K.; Jonosono, M.; Hashiguchi, T.; Kawabata, M.; Osame, M.; Kitajima, I.: VEGF is causative for pulmonary hypertension in a patient with Crow-Fukase (POEMS) syndrome. Intern. Med. 39:1101-1104, 2000.

Oosthuyse, B.; Moons, L.; Storkebaum, E.; Beck, H.; Nuyens, D.; Brusselmans, K.; Van Dorpe, J.; Hellings, P.; Gorselink, M.; Heymans, S.; Theilmeier, G.; Dewerchin, M.; and 20 others: Deletion of the hypoxia-response element in the vascular endothelial growth factor promoter causes motor neuron degeneration. Nature Genet. 28:131-138,2001.

Poltorak, Z.; Cohen, T.; Sivan, R.; Kandelis, Y.; Spira, G.; Vlodavsky, I.; Keshet, E.; Neufeld, G.: VEGF145, a secreted vascular endothelial growth factor isoform that binds to extracellular matrix. J. Biol. Chem. 272:7151-7158, 1997.

Shimpo, S.: Solitary myeloma causing polyneuritis and endocrine disorders. Nippon Rinsho 26:2444-2456, 1968.

Soker, S.; Takashima, S.; Miao, H. Q.; Neufeld, G.; Klagsbrun, M.: Neuropilin-1 is expressed by endothelial and tumor cells as an isoform-specific receptor for vascular endothelial growth factor. Cell 92:735-745, 1998.

Sone, H.; Kawakami, Y.; Sakauchi, M.; Nakamura, Y.; Takahashi, A.; Shimano, H.; Okuda, Y.; Segawa, T.; Suzuki, H.; Yamada, N.: Neutralization of vascular endothelial growth factor prevents collagen-induced arthritis and ameliorates established disease in mice. Biochem. Biophys. Res. Commun. 281:562-568, 2001.

Springer, M. L.; Chen, A. S.; Kraft, P. E.; Bednarski, M.; Blau, H. M.: VEGF gene delivery to muscle: potential role for vasculogenesis in adults. Molec. Cell 2:549-558, 1998.

Thurston, G.; Suri, C.; Smith, K.; McClain, J.; Sato, T. N.; Yancopoulos, G. D.; McDonald, D. M.: Leakage-resistant blood vessels in mice transgenically overexpressing angiopoietin-1. Science 286:2511-2514, 1999.

Tischer, E.; Mitchell, R.; Hartman, T.; Silva, M.; Gospodarowicz, D.; Fiddes, J. C.; Abraham, J. A.: The human gene for vascular endothelial growth factor: multiple protein forms are encoded through alternative exon splicing. J. Biol. Chem. 266:11947-11954, 1991.

Osborne, L. R.; Martindale, D.; Scherer, S. W.; Shi, X.-M.; Huizenga, J.; Heng, H. H. Q.; Costa, T.; Pober, B.; Lew, L.; Brinkman, J.; Rommens, J.; Koop, B.; Tsui, L.-C.: Identification of genes from a 500-kb region at 7q11.23 that is commonly deleted in Williams syndrome patients. Genomics 36:328-336, 1996.

Rampoldi, L.; Dobson-Stone, C.; Rubio, J. P.; Danek, A.; Chalmers, R. M.; Wood, N. W.; Verellen, C.; Ferrer, X.; Malandrini, A.; Fabrizi, G. M.; Brown, R.; Vance, J.; Pericak-Vance, M.; Rudolf, G.; Carre, S.; Alonso, E.; Manfredi, M.; Nemeth, A. H.; Monaco, A. P.: A conserved sorting-associated protein is mutant in chorea-acanthocytosis. Nature Genet. 28:119-120, 2001.

Belden, W. J.; Barlowe, C.: Role of Erv29p in collecting soluble secretory proteins into ER-derived transport vesicles. Science 294:1528-1531, 2001.

Duhig, T.; Ruhrberg, C.; Mor, O.; Fried, M.: The human surfeit locus. Genomics 52:72-78, 1998.

Reeves, J. E.; Fried, M.: The surf-4 gene encodes a novel 30 kDa integral membrane protein. Molec. Membr. Biol. 12:201-208, 1995.

Hu, K.; Carroll, J.; Fedorovich, S.; Rickman, C.; Sukhodub, A.; Davietov, B.: Vesicular restriction of synaptobrevin suggests a role for calcium in membrane fusion. Nature 415:646-650, 2002.

Perez, F.; Diamantopoulos, G. S.; Stalder, R.; Kreis, T. E.: CLIP-170 highlights growing microtubule ends in vivo. Cell 96:517-527, 1999.

Pierre, P.; Pepperkok, R.; Kreis, T. E.: Molecular characterization of two functional domains of CLIP-170 in vivo. J. Cell Sci. 107:1909-1920, 1994.

Pierre, P.; Scheel, J.; Rickard, J. E.; Kreis, T. E.: CLIP-170 links endocytic vesicles to microtubules. Cell 70:887-900, 1992.

Acland, G. M.; Aguirre, G. D.; Ray, J.; Zhang, Q.; Aleman, T. S.; Cideciyan, A. V.; Pearce-Kelling, S. E.; Anand, V.; Zeng, Y.; Maguire, A. M.; Jacobson, S. G.; Hauswirth, W. W.; Bennett, J.: Gene therapy restores vision in a canine model of childhood blindness. Nature 28:92-95, 2001.

Aguirre, G. D.; Baldwin, V.; Pearce-Kelling, S.; Narfstrom, K.; Ray, K.; Acland, G. M.: Congenital stationary night blindness in the dog: common mutation in the RPE65 gene indicates founder effect. Molec. Vision 4:23, 1998. Note: Electronic Article.

Bavik, C.-O.; Busch, C.; Eriksson, U.: Characterization of a plasma retinol-binding protein membrane receptor expressed in the retinal pigment epithelium. J. Biol. Chem. 267:23035-23042, 1992.

Felius, J.; Thompson, D. A.; Khan, N. W.; Bingham, E. L.; Jamison, J. A.; Kemp, J. A.; Sieving P. A.: Clinical course and visual function in a family with mutations in the RPE65 gene. Arch. Ophthal. 120:55-61, 2002.

Grimm, C.; Wenzel, A.; Hafezi, F.; Yu, S.; Redmond, T. M.; Reme, C. E.: Protection of Rpe65-deficient mice identifies rhodopsin as a mediator of light-induced retinal degeneration. Nature Genet. 25:63-66, 2000.

Gu, S.; Thompson, D. A.; Srikumari, C. R. S.; Lorenz, B.; Finckh, U.; Nicoletti, A.; Murthy, K. R.; Rathmann, M.; Kumaramanickavel, G.; Denton, M. J.; Gal, A.: Mutations in RPE65 cause autosomal recessive childhood-onset severe retinal dystrophy. Nature Genet. 17:194-197,1997.

Hamel, C. P.; Jenkins, N. A.; Gilbert, D. J.; Copeland, N. G.; Redmond, T. M.: The gene for the retinal pigment epithelium-specific protein RPE65 is localized to human 1p31 and mouse 3. Genomics 20:509-512, 1994.

Hamel, C. P.; Tsilou, E.; Pfeffer, B. A.; Hooks, J. J.; Detrick, B.; Redmond, T. M.: Molecular cloning and expression of RPE65, a novel retinal pigment epithelium-specific microsomal protein that is post-transcriptionally regulated in vitro. J. Biol. Chem. 268:15751-15757, 1993.

Marlhens, F.; Bareil, C.; Griffoin, J.-M.; Zrenner, E.; Amalric, P.; Eliaou, C.; Liu, S.-Y.; Harris, E.; Redmond, T. M.; Arnaud, B.; Claustres, M.; Hamel, C. P.: Mutations in RPE65 cause Leber's congenital amaurosis. (Letter) Nature Genet. 17:139-141, 1997.

Morimura, H.; Fishman, G. A.; Grover, S. A.; Fulton, A. B.; Berson, E. L.; Dryja, T. P.: Mutations in the RPE65 gene in patients with autosomal recessive retinitis pigmentosa or Leber congenital amaurosis. Proc. Nat. Acad. Sci. 95:3088-3093, 1998.

Narfstrom, K.; Wrigstad, A.; Nilsson, S. E.: The Briard dog: a new animal model of congenital stationary night blindness. Brit. J. Ophthal. 73:750-756, 1989.

Nicoletti, A.; Wong, D. J.; Kawase, K.; Gibson, L. H.; Yang-Feng, T. L.; Richards, J. E.; Thompson, D. A.: Molecular characterization of the human gene encoding an abundant 61 kDa protein specific to the retinal pigment epithelium. Hum. Molec. Genet. 4:641-649, 1995.

Barone, V.; Bertocchini, F.; Bottinelli, R.; Protasi, F.; Allen, P. D.; Armstrong, C. F.; Reggiani, C.; Sorrentino, V.: Contractile impairment and structural alterations of skeletal muscles from knockout mice lacking type 1 and type 3 ryanodine receptors. FEBS Lett. 422:160-164, 1998.

Cheng, H.; Lederer, W. J.; Cannell, M. B.: Calcium sparks: elementary events underlying excitation-contraction coupling in heart muscle. Science 262:740-744, 1993.

Vincenti, V.; Cassano, C.; Rocchi, M.; Persico, M. G.: Assignment of the vascular endothelial growth factor gene to human chromosome 6p21.3. Circulation 93:1493-1495, 1996.

Wong-Staal, F.; Dalla-Favera, R.; Franchini, G.; Gelmann, E. P.; Gallo, R. C.: Three distinct genes in human DNA related to the transforming genes of mammalian sarcoma retroviruses. Science 213:226-228, 1981.

Aurias, A.; Rimbaut, C.; Buffe, D.; Dubousset, J.; Mazabraud, A.: Chromosomal translocations in Ewing's sarcoma. (Letter) New Eng. J. Med. 309:496-497, 1983.

Bartram, C. R.; de Klein, A.; Hagemeijer, A.; Grosveld, G.; Heisterkamp, N.; Groffen, J.: Localization of the human c-sis oncogene in Ph-1-positive and Ph-1-negative chronic myelocytic leukemia by in situ hybridization. Blood 63:223-225, 1984.

Bechet, J.-M.; Bornkamm, G.; Freese, U.-K.; Lenoir, G. M.: The c-sis oncogene is not activated in Ewing's sarcoma. (Letter) New Eng. J. Med. 310:393 only, 1984.

Bishop, J. M.: Enemies within: the genesis of retrovirus oncogenes. Cell 23:5-6, 1981.

Bolger, G. B.; Stamberg, J.; Kirsch, I. R.; Hollis, G. F.; Schwarz, D. F.; Thomas, G. H.: Chromosomal translocation t(14;22) and oncogene (c-sis) variant in a pedigree with familial meningioma. New Eng. J. Med. 312:564-567, 1985.

Cohen, J. B.; Levinson, A. D.: A point mutation in the last intron responsible for increased expression and transforming activity of the c-Ha-ras oncogene. Nature 334:119-124, 1988.

Collins, T.; Ginsburg, D.; Boss, J. M.; Orkin, S. H.; Pober, J. S.: Cultured human endothelial cells express platelet-derived growth factor B chain: cDNA cloning and structural analysis. Nature 316:748-750, 1985.

Dalla-Favera, R.; Gallo, R. C.; Giallongo, A.; Croce, C.: Chromosomal localization of the human homolog (c-sis) of the simian sarcoma virus onc gene. Science 218:686-688, 1982.

Dalla-Favera, R.; Gelmann, E. P.; Gallo, R. C.; Wong-Staal, F.: A human onc gene homologous to the transforming gene (v-sis) of simian sarcoma virus. Nature 292:31-35, 1981.

Deuel, T. F.; Huang, J. S.; Huang, S. S.; Stroobant, P.; Waterfield, M. D.: Expression of a platelet-derived growth factor-like protein in simian sarcoma virus transformed cells. Science 221:1348-1350,1983.

Devare, S. G.; Reddy, E. P.; Law, J. D.; Robbins, K. C.; Aaronson, S. A.: Nucleotide sequence of the simian sarcoma virus genome: demonstration that its acquired cellular sequences encode the transforming gene product p28-sis. Proc. Nat. Acad. Sci. 80:731-735, 1983.

Charlet-B., N.; Logan, P.; Singh, G.; Cooper, T. A.: Dynamic antagonism between ETR-3 and PTB regulates cell type-specific alternative splicing. Molec. Cell 9:649-658, 2002.

Borglum, A. D.; Flint, T.; Tommerup, N.; Fleckner, J.; Justesen, J.; Kruse, T. A.: Assignment of the human tryptophanyl-tRNA synthetase gene (WARS) to chromosome 14q32.2-q32.32. Cytogenet. Cell Genet. 73:99-103, 1996.

Denney, R. M.; Borgaonkar, D.; Ruddle, F. H.: Order of genes for NP and TRPRS on chromosome 14. Cytogenet. Cell Genet. 22:493-497,1978.

Francke, U.; Denney, R. M.; Ruddle, F. H.: Intrachromosomal gene mapping in man: the gene for tryptophanyl-tRNA synthetase maps in region q21-qter of chromosome 14. Somat. Cell Genet. 3:381-389,1977.

Benson, K. F.; Horwitz, M.; Wolff, J.; Friend, K.; Thompson, E.; White, S.; Richards, R. I.; Raskind, W. H.; Bird, T. D.: CAG repeat expansion in autosomal dominant familial spastic paraparesis: novel expansion in a subset of patients. Hum. Molec. Genet. 7:1779-1786,1998.

Fonknechten, N.; Mavel, D.; Byrne, P.; Davoine, C.-S.; Cruaud, C.; Boentsch, D.; Samson, D.; Coutinho, P.; Hutchinson, M.; McMonagle, P.; Burgunder, J.-M.; Tartaglione, A.; and 10 others: Spectrum of SPG4 mutations in autosomal dominant spastic paraplegia. Hum. Molec. Genet. 9:637-644, 2000.

Nielsen, J. E.; Koefoed, P.; Abell, K.; Hasholt, L.; Eiberg, H.; Fenger, K.; Niebuhr, E.; Sorensen, S. A.: CAG repeat expansion in autosomal dominant pure spastic paraplegia linked to chromosome 2p21-p24. Hum. Molec. Genet. 6:1811-1816, 1997.

Svenson, I. K.; Ashley-Koch, A. E.; Gaskell, P. C.; Riney, T. J.; Cumming, W. J. K.; Kingston, H. M.; Hogan, E. L.; Boustany, R.-M. N.; Vance, J. M.; Nance, M. A.; Pericak-Vance, M. A.; Marchuk, D. A.: Identification and expression analysis of spastin gene mutations in hereditary spastic paraplegia. Am. J. Hum. Genet. 68:1077-1085,2001.

Ala-Kapee, M.; Nevanlinna, H.; Mali, M.; Jalkanen, M.; Schroder, J.: Localization of gene for human syndecan, an integral membrane proteoglycan and a matrix receptor, to chromosome 2. Somat. Cell Molec. Genet. 16:501-505, 1990.

Alexander, C. M.; Reichsman, F.; Hinkes, M. T.; Lincecum, J.; Becker, K. A.; Cumberledge, S.; Bernfield, M.: Syndecan-1 is required for Wnt-1-induced mammary tumorigenesis in mice. Nature Genet. 25:329-332,2000.

Mali, M.; Jaakkola, P.; Arvilommi, A.-M.; Jalkanen, M.: Sequence of human syndecan indicates a novel gene family of integral membrane proteoglycans. J. Biol. Chem. 265:6884-6889, 1990.

Oettinger, H. F.; Streeter, H.; Lose, E.; Copeland, N. G.; Gilbert, D. J.; Justice, M. J.; Jenkins, N. A.; Mohandas, T.; Bernfield, M.: Chromosome mapping of the murine syndecan gene. Genomics 11:334-338,1991.

Reizes, O.; Lincecum, J.; Wang, Z.; Goldberger, O.; Huang, L.; Kaksonen, M.; Ahima, R.; Hinkes, M. T.; Barsh, G. S.; Rauvala, H.; Bernfield, M.: Transgenic expression of syndecan-1 uncovers a physiological control of feeding behavior by syndecan-3. Cell 106:105-116, 2001.

Sanderson, R. D.; Lalor, P.; Bernfield, M.: B lymphocytes express and lose syndecan at specific stages of differentiation. Cell Regulation 1:27-35, 1989.

Westman, P.; Hsieh, C.-L.; Mali, M.; Jalkanen, M.; Francke, U.; Schroder, J.: Assignment of the human syndecan (SDC) gene to short arm of chromosome 2. (Abstract) Cytogenet. Cell Genet. 58:1873-1874,1991.

Burns, A. L.; Magendzo, K.; Shirvan, A.; Srivastava, M.; Rojas, E.; Alijani, M. R.; Pollard, H. B.: Calcium channel activity of purified human synexin and structure of the human synexin gene. Proc. Nat. Acad. Sci. 86:3798-3802, 1989.

Caohuy, H.; Srivastava, M.; Pollard, H. B.: Membrane fusion protein synexin (annexin VII) as a Ca (2+)/GTP sensor in exocytotic secretion. Proc. Nat. Acad. Sci. 93:10797-10802, 1996.

Herr, C.; Smyth, N.; Ullrich, S.; Yun, F.; Sasse, P.; Hescheler, J.; Fleischmann, B.; Lasek, K.; Brixius, K.; Schwinger, R. H. G.; Fassler, R.; Schroder, R.; Noegel, A. A.: Loss of annexin A7 leads to alterations in frequency-induced shortening of isolated murine cardiomyocytes. Molec. Cell. Biol. 21:4119-4128, 2001.

Magendzo, K.; Shirvan, A.; Cultraro, C.; Srivastava, M.; Pollard, H. B.; Burns, A. L.: Alternative splicing of human synexin mRNA in brain, cardiac, and skeletal muscle alters the unique N-terminal domain. J. Biol. Chem. 266:3228-3232, 1991.

Shirvan, A.; Srivastava, M.; Wang, M. G.; Cultraro, C.; Magendzo, K.; McBride, O. W.; Pollard, H. B.; Burns, A. L.: Divergent structure of the human synexin (annexin VII) gene and assignment to chromosome 10. Biochemistry 33:6888-6901, 1994.

Srivastava, M.; Atwater, I.; Glasman, M.; Leighton, X.; Goping, G.; Caohuy, H.; Miller, G.; Pichel, J.; Westphal, H.; Mears, D.; Rojas, E.; Pollard, H. B.: Defects in inositol 1,4,5-trisphosphate receptor expression, Ca (2+) signaling, and insulin secretion in the anx 7(+/-) knockout mouse. Proc. Nat. Acad. Sci. 96:13783-13788, 1999.

Srivastava, M.; Bubendorf, L.; Srikantan, V.; Fossom, L.; Nolan, L.; Glasman, M.; Leighton, X.; Fehrle, W.; Pittaluga, S.; Raffeld, M.; Koivisto, P.; Willi, N.; Gasser, T. C.; Kononen, J.; Sauter, G.; Kallioniemi, O. P.; Srivastava, S.; Pollard, H. B.: ANX7, a candidate tumor suppressor gene for prostate cancer. Proc. Nat. Acad. Sci. 98:4575-4580, 2001.

Zhang-Keck, Z.-Y.; Srivastava, M.; Kozak, C. A.; Caohuy, H.; Shirvan, A.; Burns, A. L.; Pollard, H. B.: Genomic organization and chromosomal localization of the mouse synexin gene. Biochem. J. 301:835-845,1994.

Asch, A. S.; Barnwell, J.; Silverstein, R. L.; Nachman, R. L.: Isolation of the thrombospondin membrane receptor. J. Clin. Invest. 79:1054-1061, 1987.

de Fraipont, F.; El Atifi, M.; Gicquel, C.; Bertagna, X.; Chambaz, E. M.; Feige, J. J.: Expression of the angiogenesis markers vascular endothelial growth factor-A, thrombospondin-1, and platelet-derived endothelial cell growth factor in human sporadic adrenocortical tumors: correlation with genotypic alterations. J. Clin. Endocr. Metab. 85:4734-4741, 2000.

Dixit, V. M.; Hennessy, S. W.; Grant, G. A.; Rotwein, P.; Frazier, W. A.: Characterization of a cDNA encoding the heparin and collagen binding domains of human thrombospondin. Proc. Nat. Acad. Sci. 83:5449-5453, 1986.

Frazier, W. A.: Thrombospondin: a modular adhesive glycoprotein of platelets and nucleated cells. J. Cell Biol. 105: 625-632, 1987.

Jaffe, E.; Bornstein, P.; Disteche, C. M.: Mapping of the thrombospondin gene to human chromosome 15 and mouse chromosome 2 by in situ hybridization. Genomics 7:123-126, 1990.

Lawler, J.; Sunday, M.; Thibert, V.; Duquette, M.; George, E. L.; Rayburn, H.; Hynes, R. O.: Thrombospondin-1 is required for normal murine pulmonary homeostasis and its absence causes pneumonia. J. Clin. Invest. 101:982-992, 1998.

Rodriguez-Manzaneque, J. C.; Lane, T. F.; Ortega, M. A.; Hynes, R. O.; Lawler, J.; Iruela-Arispe, M. L.: Thrombospondin-1 suppresses spontaneous tumor growth and inhibits activation of matrix metalloproteinase-9 and mobilization of vascular endothelial growth factor. Proc. Nat. Acad. Sci. 98:12485-12490, 2001.

Wolf, F. W.; Eddy, R. L.; Shows, T. B.; Dixit, V. M.: Structure and chromosomal localization of the human thrombospondin gene. Genomics 6:685-691, 1990.

Mira, J.-P.; Cariou, A.; Grall, F.; Delclaux, C.; Losser, M.-R.; Heshmati, F.; Cheval, C.; Monchi, M.; Teboul, J.-L.; Riche, F.; Leleu, G.; Arbibe, L.; Mignon, A.; Delpech, M.; Dhainaut, J.-F.: Association of TNF2, a TNF-alpha promoter polymorphism, with septic shock susceptibility and mortality: a multicenter study. J. A. M. A. 282:561-568, 1999.

Moffatt, M. F.; Cookson, W. O. C. M.: Tumour necrosis factor haplotypes and asthma. Hum. Molec. Genet. 6:551-554, 1997.

Moraes, M. O.; Duppre, N. C.; Suffys, P. N.; Santos, A. R.; Almeida, A. S.; Nery, J. A. C.; Sampaio, E. P.; Sarno, E. N.: Tumor necrosis factor-alpha promoter polymorphism TNF2 is associated with a stronger delayed-type hypersensitivity reaction in the skin of borderline tuberculoid leprosy patients. Immunogenetics 53:45-47, 2001.

Mulcahy, B.; Waldron-Lynch, F.; McDermott, M. F.; Adams, C.; Amos, C. I.; Zhu, D. K.; Ward, R. H.; Clegg, D. O.; Shanahan, F.; Molloy, M. G.; O'Gara, F.: Genetic variability in the tumor necrosis factor-lymphotoxin region influences susceptibility to rheumatoid arthritis. Am. J. Hum. Genet. 59:676-683, 1996.

Muller, U.; Jongeneel, C. V.; Nedospasov, S. A.; Lindahl, K. F.; Steinmetz, M.: Tumour necrosis factor and lymphotoxin genes map close to H-2D in the mouse major histocompatibility complex. Nature 325:265-267, 1987.

Nadel, S.; Newport, M. J.; Booy, R.; Levin, M.: Variation in the tumor necrosis factor-alpha gene promoter region may be associated with death from meningococcal disease. J. Infect. Dis. 174:878-880,1996.

Nedospasov, S. A.; Hirt, B.; Shakhov, A. N.; Dobrynin, V. N.; Kawashima, E.; Accolla, R. S.; Jongeneel, C. V.: The genes for tumor necrosis factor (TNR-alpha) and lymphotoxin (TNR-beta) are tandemly arranged on chromosome 17 of the mouse. Nucleic Acids Res. 14:7713-7725,1986.

Nedwin, G. E.; Naylor, S. L.; Sakaguchi, A. Y.; Smith, D.; Jarrett-Nedwin, J.; Pennica, D.; Goeddel, D. V.; Gray, P. W.: Human lymphotoxin and tumor necrosis factor genes: structure, homology and chromosomal localization. Nucleic Acids Res. 13:6361-6373, 1985.

Norman, R. A.; Bogardus, C.; Ravussin, E.: Linkage between obesity and a marker near the tumor necrosis factor-alpha locus in Pima Indians. J. Clin. Invest. 96:158-162, 1995.

Obayashi, H.; Hasegawa, G.; Fukui, M.; Kamiuchi, K.; Kitamura, A.; Ogata, M.; Kanaitsuka, T.; Shigeta, H.; Kitagawa, Y.; Nakano, K.; Nishimura, M.; Ohta, M.; Nakamura, N.: Tumor necrosis factor microsatellite polymorphism influences the development of insulin dependency in adult-onset diabetes patients with the DRB1*1502-DQB1*0601allele and anti-glutamic acid decarboxylase antibodies. J. Clin. Endocr. Metab. 85:3348-3351, 2000.

Old, L. J.: Tumor necrosis factor (TNF). Science 230:630-632,1985.

Pennica, D.; Nedwin, G. E.; Hayflick, J. S.; Seeburg, P. H.; Derynck, R.; Palladino, M. A.; Kohr, W. J.; Aggarwal, B. B.; Goeddel, D. V.: Human tumour necrosis factor: precursor structure, expression and homology to lymphotoxin. Nature 312:724-729, 1984.

Ragoussis, J.; Bloemer, K.; Weiss, E. H.; Ziegler, A.: Localization of the genes for tumor necrosis factor and lymphotoxin between the HLA class I and III regions by field inversion gel electrophoresis. Immunogenetics 27:66-69, 1988.

Rasmussen, S. K.; Urhammer, S. A.; Jensen, J. N.; Hansen, T.; Borch-Johnsen, K.; Pedersen, O.: The -238 and -308 G6A polymorphisms of the tumor necrosis factor alpha gene promoter are not associated with features of the insulin resistance syndrome or altered birthweight in Danish Caucasians. J. Clin. Endocr. Metab. 85:1731-1734,2000.

Rosmond, R.; Chagnon, M.; Bouchard, C.; Bjorntorp, P.: G-308A polymorphism of the tumor necrosis factor alpha gene promoter and salivary cortisol secretion. J. Clin. Endocr. Metab. 86:2178-2180,2001.

Roy, S.; McGuire, W.; Mascie-Taylor, C. G.; Saha, B.; Hazra, S. K.; Hill, A. V.; Kwiatkowski, D.: Tumor necrosis factor promoter polymorphism and susceptibility to lepromatous leprosy. J. Infect. Dis. 176:530-532, 1997.

Ruuls, S. R.; Sedgwick, J. D.: Unlinking tumor necrosis factor biology from the major histocompatibility complex: lessons from human genetics and animal models. Am. J. Hum. Genet. 65:294-301, 1999.

Spies, T.; Morton, C. C.; Nedospasov, S. A.; Fiers, W.; Pious, D.; Strominger, J. L.: Genes for the tumor necrosis factors alpha and beta are linked to the human major histocompatibility complex. Proc. Nat. Acad. Sci. 83:8699-8702, 1986.

van Hensbroek, M. B.; Palmer, A.; Onyiorah, E.; Schneider, G.; Jaffar, S.; Dolan, G.; Memming, H.; Frenkel, J.; Enwere, G.; Bennett, S.; Kwiatkowski, D.; Greenwood, B.: The effect of a monoclonal antibody to tumor necrosis factor on survival from childhood cerebral malaria. J. Infect. Dis. 174:1091-1097, 1996.

Sashio, H.; Tamura, K.; Ito, R.; Yamamoto, Y.; Bamba, H.; Kosaka, T.; Fukui, S.; Sawada, K.; Fukuda, Y.; Tamura, K.; Satomi, M.; Shimoyama, T.; Furuyama, J.: Polymorphisms of the TNF gene and the TNF receptor superfamily member 1B gene are associated with susceptibility to ulcerative colitis and Crohn's disease, respectively. Immunogenetics 53:1020-1027,2002.

Van Ostade, X.; Vandenabeele, P.; Everaerdt, B.; Loetscher, H.; Gentz, R.; Brockhaus, M.; Lesslauer, W.; Tavernier, J.; Brouckaert, P.; Fiers, W.: Human TNF mutants with selective activity on the p55 receptor. Nature 361:266-269, 1993.

Wang, A. M.; Creasey, A. A.; Ladner, M. B.; Lin, L. S.; Strickler, J.; Van Arsdell, J. N.; Yamamoto, R.; Mark, D. F.: Molecular cloning of the complementary DNA for human tumor necrosis factor. Science 228:149-154, 1985.

Wilson, A. G.; Symons, J. A.; McDowell, T. L.; et al: Effects of a polymorphism in the human tumor necrosis factor alpha promoteron transcriptional activation. Proc. Nat. Acad. Sci. 94:3195-3199,1997.

Winchester, E. C.; Millwood, I. Y.; Rand, L.; Penny, M. A.; Kessling, A. M.: Association of the TNF-alpha-308 (G-A) polymorphism with self-reported history of childhood asthma. Hum. Genet. 107:591-596, 2000.

Witte, J. S.; Palmer, L. J.; O'Connor, R. D.; Hopkins, P. J.; Hall, J. M.: Relation between tumour necrosis factor polymorphism TNF-alpha-308 and risk of asthma. Europ. J. Hum. Genet. 10:82-85,2002.

Peter, D.; Finn, J. P.; Klisak, I.; Liu, Y.; Kojis, T.; Heinzmann, C.; Roghani, A.; Sparkes, R. S.; Edwards, R. H.: Chromosomal localization of the human vesicular amine transporter genes. Genomics 18:720-723,1993.

Roghani, A.; Welch, C.; Xia, Y.-R.; Liu, Y.; Peter, D.; Finn, J. P.; Edwards, R. H.; Lusis, A. J.: Assignment of the mouse vesicular monoamine transporter genes, Slc18a1 and Slc18a2, to chromosomes 8 and 19 by linkage analysis. Mammalian Genome 7:393-394, 1996.

Seite, P.; Huebner, K.; Rousseau-Merck, M. F.; Berger, R.; Thiesen, H. J.: Two human genes encoding zinc finger proteins, ZNF12 (KOX3) and ZNF26 (KOX20), map to chromosomes 7p22-p21 and 12q24.33, respectively. Hum. Genet. 86:585-590, 1991.

Ansari-Lari, M. A.; Muzny, D. M.; Lu, J.; Lu, F.; Lilley, C. E.; Spanos, S.; Malley, T.; Gibbs, R. A.: A gene-rich cluster between the CD4 and triosephosphate isomerase genes at human chromosome 12p13. Genome Res. 6:314-326, 1996.

Bach, M. A.; Phan-Dinh-Tuy, F.; Bach, J. F.; Wallach, D.; Biddison, W. E.; Sharrow, S. O.; Goldstein, G.; Kung, P. C.: Unusual phenotypes of human inducer T cells as measured by OKT4 and related monoclonal antibodies. J. Immun. 127: 980-982, 1981.

Browning, J.; Horner, J. W.; Pettoello-Mantovani, M.; Raker, C.; Yurasov, S.; DePinho, R. A.; Goldstein, H.: Mice transgenic for human CD4 and CCR5 are susceptible to HIV infection. Proc. Nat. Acad. Sci. 94:14637-14641, 1997.

Buttini, M.; Westland, C. E.; Masliah, E.; Yafeh, A. M.; Wyss-Coray, T.; Mucke, L.: Novel role of human CD4 molecule identified in neurodegeneration. Nature Med. 4:441-446, 1998.

Committee on Human Leukocyte Differentiation Antigens, IUIS WHO Nomenclature Subcommittee: Proposed nomenclature for human leukocyte differentiation antigens. Bull. WHO 5:809-811, 1984. Note: Alternate: Immunology Today 5:280 only, 1984.

Fukuda, T.; Matsunaga, M.; Kurata, A.; Mine, M.; Ikari, N.; Katamine, S.; Kanazawa, H.; Eguchi, K.; Nagataki, S.: Hereditary deficiency of OKT4-positive cells: studies for mode of inheritance and lymphocyte functions. Immunology 53:643-649, 1984.

Fuller, T. C.; Trevithick, J. E.; Fuller, A. A.; Colvin, R. B.; Cosimi, A. B.; Kung, P. C.: Antigenic polymorphism of the T4 differentiation antigen expressed on human T helper/inducer lymphocytes. Hum. Immun. 9:89-102, 1984.

Gill, J. C.; Maples, J.; Nikaein, A.; Kirchner, P.; Lockhart, D.; Snyder, A. J.; Montgomery, R. R.; Casper, J. T.: Inherited absence of OKT4 lymphocyte antigen in a chronically transfused patient with homozygous sickle cell disease. J. Pediat. 107:251-253, 1985.

Irvine, D. J.; Purbhoo, M. A.; Krogsgaard, M.; Davis, M. M.: Direct observation of ligand recognition by T cells. Nature 419:845-849, 2002.

Isobe, M.; Huebner, K.; Maddon, P. J.; Littman, D. R.; Axel, R.; Croce, C. M.: The gene encoding the T-cell surface protein T4 is located on human chromosome 12. Proc. Nat. Acad. Sci. 83:4399-4402,1986.

Karol, R. A.; Eng, J.; Dennison, D. K.; Faris, E.; Marcus, D. M.: Hereditary abnormalities of the OKT4 human lymphocyte epitope in two families. J. Clin. Immun. 4:71-74, 1984.

Kozbor, D.; Finan, J.; Nowell, P. C.; Croce, C. M.: The gene encoding the T4 antigen maps to human chromosome 12. J. Immun. 136:1141-1143, 1986.

Maddon, P. J.; Molineaux, S. M.; Maddon, D. E.; Zimmerman, K. A.; Godfrey, M.; Alt, F. W.; Chess, L.; Axel, R.: Structure and expression of the human and mouse T4 genes. Proc. Nat. Acad. Sci. 84:9155-9159,1987.

Piguet, V.; Gu, F.; Foti, M.; Demaurex, N.; Gruenberg, J.; Carpentier, J.-L.; Trono, D.: Nef-induced CD4 degradation: a diacidic-based motif in Nef functions as a lysosomal targeting signal through the binding of beta-COP in endosomes. Cell 97:63-73, 1999.

Sato, M.; Hayashi, Y.; Yoshida, H.; Yanagawa, T.; Yura, Y.: A family with hereditary lack of T4+ inducer/helper T cell subsets in peripheral blood lymphocytes. J. Immun. 132: 1071-1073, 1984.

Sawada, S.; Scarborough, J. D.; Killeen, N.; Littman, D. R.: A lineage-specific transcriptional silencer regulates CD4 gene expression during T lymphocyte development. Cell 77:917-929, 1994.

Zinman, B.; Hanley, A. J. G.; Harris, S. B.; Kwan, J.; Fantus, I. G.: Circulating tumor necrosis factor-alpha concentrations in a Native Canadian population with high rates of type 2 diabetes mellitus. J. Clin. Endocr. Metab. 84:272-278, 1999.

Spurr, N. K.; Goodfellow, P. N.; Sheer, D.; Bodmer, W. F.; Vennstrom, B.: Mapping of cellular oncogenes: ERBA1 is on chromosome 17. (Abstract) Cytogenet. Cell Genet. 37:591 only, 1984.

Thompson, C. C.; Weinberger, C.; Lebo, R.; Evans, R. M.: Identification of a novel thyroid hormone receptor expressed in the mammalian central nervous system. Science 237:1610-1614, 1987.

Weinberger, C.; Thompson, C. C.; Ong, E. S.; Lebo, R.; Gruol, D. J.; Evans, R. M.: The c-erb-A gene encodes a thyroid hormone receptor. Nature 324:641-646, 1986.

Zabel, B. U.; Fournier, R. E. K.; Lalley, P. A.; Naylor, S. L.; Sakaguchi, A. Y.: Cellular homologs of the avian erythroblastosis virus erb-A and erb-B genes are syntenic in mouse but asyntenic in man. Proc. Nat. Acad. Sci. 81:4874-4878, 1984.

Forsell, P. K. A. L.; Boie, Y.; Montalibet, J.; Collins, S.; Kennedy, B. P.: Genomic characterization of the human and mouse protein tyrosine phosphatase-1B genes. Gene 260: 145-153, 2000.

Gu, H. F.; Almgren, P.; Lindholm, E.; Frittitta, L.; Pizzuti, A.; Trischitta, V.; Groop, L. C.: Association between the human glycoprotein PC-1 gene and elevated glucose and insulin levels in paired-sibling analysis. Diabetes 49:1601-1603, 2000.

Haj, F. G.; Verveer, P. J.; Squire, A.; Neel, B. G.; Bastiaens, P. I. H.: Imaging sites of receptor dephosphorylation by PTP1B on the surface of the endoplasmic reticulum. Science 295:1708-1711,2002.

Jia, Z.; Barford, D.; Flint, A. J.; Tonks, N. K.: Structural basis for phosphotyrosine peptide recognition by protein tyrosine phosphatase 1B. Science 268:1754-1758, 1995.

Kennedy, B. P.; Ramachandran, C.: Protein tyrosine phosphatase-1B in diabetes. Biochem. Pharm. 60:877-883, 2000.

Elchebly, M.; Payette, P.; Michaliszyn, E.; Cromlish, W.; Collins, S.; Loy, A. L.; Normandin, D.; Cheng, A.; Himms-Hagen, J.; Chan, C.-C.; Ramachandran, C.; Gresser, M. J.; Tremblay, M. L.; Kennedy, B. P.: Increased insulin sensitivity and obesity resistance in mice lacking the protein tyrosine phosphatase-1B gene. Science 283:1544-1548,1999.

Mok, A.; Cao, H.; Zinman, B.; Hanley, A. J. G.; Harris, S. B.; Kennedy, B. P.; Hegele, R. A.: A single nucleotide polymorphism in protein tyrosine phosphatase PTP-1B is associated with protection from diabetes or impaired glucose tolerance in Oji-Cree. J. Clin. Endocr. Metab. 87:724-727, 2002.

Tonks, N. K.; Diltz, C. D.; Fischer, E. H.: Purification of the major protein-tyrosine-phosphatases of human placenta. J. Biol. Chem. 263:6722-6730, 1988.

Barnea, G.; Silvennoinen, O.; Shaanan, B.; Honegger, A. M.; Canoll, P. D.; d'Eustachio, P.; Morse, B.; Levy, J. B.; Laforgia, S.; Huebner, K.; Musacchio, J. M.; Sap, J.; Schlessinger, J.: Identification of a carbonic anhydrase-like domain in the extracellular region of RPTP-gamma defines a new subfamily of receptor tyrosine phosphatases. Molec. Cell. Biol. 13:1497-1506, 1993.

Kastury, K.; Ohta, M.; Lasota, J.; Moir, D.; Dorman, T.; LaForgia, S.; Druck, T.; Huebner, K.: Structure of the human receptor tyrosine phosphatase gamma gene (PTPRG) and relation to the familial RCC t (3;8) chromosome translocation. Genomics 32:225-235, 1996.

LaForgia, S.; Morse, B.; Levy, J.; Barnea, G.; Cannizzaro, L. A.; Li, F.; Nowell, P. C.; Boghosian-Sell, L.; Glick, J.; Weston, A.; Harris, C. C.; Drabkin, H.; Patterson, D.; Croce, C. M.; Schlessinger, J.; Huebner, K.: Receptor protein-tyrosine phosphatase gamma is a candidate tumor suppressor gene at human chromosome region 3p21. Proc. Nat. Acad. Sci. 88:5036-5040, 1991.

Latif, F.; Tory, K.; Modi, W.; Geil, L.; LaForgia, S.; Huebner, K.; Zbar, B.; Lerman, M. I.: A Mspl polymorphism and linkage mapping of the human protein-tyrosine phosphatase G (PTPRG) gene. Hum. Molec. Genet. 2:91, 1993.

Ariyama, T.; Hasegawa, K.; Inazawa, J.; Mizuno, K.; Ogimoto, M.; Katagiri, T.; Yakura, H.: Assignment of the human protein tyrosine phosphatase, receptor-type, zeta (PTPRZ) gene to chromosome band 7q31.3. Cytogenet. Cell Genet. 70:52-54, 1995.

Chan, J. Y.; Cheung, M.-C.; Moi, P.; Chan, K.; Kan, Y. W.: Chromosomal localization of the human NF-E2 family of bZIP transcription factors by fluorescence in situ hybridization. Hum. Genet. 95:265-269,1995.

Chan, J. Y.; Han, X.-L.; Kan, Y. W.: Cloning of Nrf1, an NF-E2-related transcription factor, by genetic selection in yeast. Proc. Nat. Acad. Sci. 90:11371-11375, 1993.

Chan, J. Y.; Kwong, M.; Lu, R.; Chang, J.; Wang, B.; Yen, T. S. B.; Kan, Y. W.: Targeted disruption of the ubiquitous CNC-bZIP transcription factor, Nrf-1, results in anemia and embryonic lethality in mice. EMBO J. 17:1779-1787, 1998.

Luna, L.; Johnsen, O.; Skartlien, A.; Pedeutour, F.; Turc-Carel, C.; Prydz, H.; Kolsto, A.-B.: Molecular cloning of a putative novel human bZIP transcription factor on chromosome 17q22. Genomics 22:553-562, 1994.

Luna, L.; Johnsen, O.; Skartlien, A. H.; Pedeutour, F.; Turc-Carel, C.; Prydz, H.; Kolsto, A.-B.: Molecular cloning of a putative novel human bZIP transcription factor on chromosome 17q22. Genomics 22:553-562, 1994.

McKie, J.; Johnstone, K.; Mattei, M.-G.; Scambler, P.: Cloning and mapping of murine Nfe2l1. Genomics 25:716-719, 1995.

McKie, J.; Scambler, P. J.: The Nfe2l1 gene maps to distal mouse chromosome 11. Mammalian Genome 7:89-90, 1996.

Bongarzone, I.; Butti, M. G.; Fugazzola, L.; Pacini, F.; Pinchera, A.; Vorontsova, T. V.; Demidchik, E. P.; Pierotti, M. A.: Comparison of the breakpoint regions of ELE1 and RET genes involved in the generation of RET/PTC3 oncogene in sporadic and in radiation-associated papillary thyroid carcinomas. Genomics 42:252-259, 1997.

Goldblum, S. E.; Ding, X.; Funk, S. E.; Sage, E. H.: SPARC (secreted protein acidic and rich in cysteine) regulates endothelial cell shape and barrier function. Proc. Nat. Acad. Sci. 91:3448-3452, 1994.

Bongarzone, I.; Butti, M. G.; Coronelli, S.; Borrello, M. G.; Santoro, M.; Mondellini, P.; Pilotti, S.; Fusco, A.; Della Porta, G.; Pierotti, M. A.: Frequent activation of ret proto-oncogene by fusion with a new activating gene in papillary thyroid carcinomas. Cancer Res. 54:2979-2985, 1994.

Klein, M.; Vignaud, J.-M.; Hennequin, V.; Toussaint, B.; Bresler, L.; Plenat, F.; Leclere, J.; Duprez, A.; Weryha, G.: Increased expression of the vascular endothelial growth factor is a pejorative prognosis marker in papillary thyroid carcinoma. J. Clin. Endocr. Metab. 86:656-658, 2001.

Katyal, S. L.; Singh, G.; Locker, J.: Characterization of a second human pulmonary surfactant-associated protein SP-A gene. Am. J. Resp. Cell Molec. Biol. 6:446-452, 1992.

Ramet, M.; Lofgren, J.; Albo, O.-P.; Hallman, M.: Surfactant protein-A gene locus associated with recurrent otitis media. J. Pediat. 138:266-268, 2001.

Robinson, P. R.; Cohen, G. B.; Zhukovsky, E. A.; Oprian, D. D.: Constitutively active mutants of rhodopsin. Neuron 9:719-725,1992.

Mason, I. J.; Murphy, D.; Munke, M.; Francke, U.; Elliott, R. W.; Hogan, B. L. M.: Developmental and transformation-sensitive expression of the SPARC gene on mouse chromosome 11. EMBO J. 5:1831-1837,1986.

Mason, I. J.; Taylor, A.; Williams, J. G.; Sage, H.; Hogan, B. L. M.: Evidence from molecular cloning that SPARC, a major product of mouse embryo parietal endoderm, is related to an endothelial cell 'culture shock' glycoprotein of Mr 43,000. EMBO J. 5:1465-1472,1986.

Naylor, S. L.; Helen-Davis, D.; Villarreal, X. C.; Long, G. L.: The human osteonectin gene on chromosome 5 is polymorphic. (Abstract) Cytogenet. Cell Genet. 51:1051 only, 1989.

Schwartz, R. C.; Young, M. F.; Tsipouras, P.: Two RFLPs in the 5-prime end of the human osteonectin (ON) gene. Nucleic Acids Res. 16:9076 only, 1988.

Stenner, D. D.; Tracy, R. P.; Riggs, B. L.; Mann, K. G.: human platelets contain and secrete osteonectin, a major protein of mineralized bone. Proc. Nat. Acad. Sci. 83:6892-6896, 1986.

Swaroop, A.; Francke, U.: Molecular cloning, cDNA sequence, and expression of human SPARC (osteonectin). (Abstract) Am. J. Hum. Genet. 41:A240 only, 1987.

Swaroop, A.; Hogan, B. L. M.; Francke, U.: Molecular analysis of the cDNA for human SPARC/osteonectin/BM-40: sequence, expression, and localization of the gene to chromosome 5q31-q33. Genomics 2:37-47, 1988.

Termine, J. D.; Kleinman, H. K.; Whitson, S. W.; Conn, K. M.; McGarvey, M. L.; Martin, G. R.: Osteonectin, a bone-specific protein linking mineral to collagen. Cell 26:99-105, 1981.

Blau, N.; Thony, B.; Renneberg, A.; Arnold, L. A.; Hyland, K.:Dihydropteridine reductase deficiency localized to the central nervous system. J. Inherit. Metab. Dis. 21:433-434, 1998.

Blau, N.; Thony, B.; Renneberg, A.; Penzien, J. M.; Hyland, K.; Hoffmann, G.: Variant of dihydropteridine reductase deficiency without hyperphenylalaninemia: effect of oral phenylalanine loading. J. Inherit. Metab. Dis. 22:216-220, 1999.

Bonafe, L.; Thony, B.; Penzien, J. M.; Czarnecki, B.; Blau, N.: Mutations in the sepiapterin reductase gene cause a novel tetrahydrobiopterin-dependent monoamine-neurotransmitter deficiency without hyperphenylalaninemia. Am. J. Hum. Genet. 69:269-277, 2001.

Ichinose, H.; Katoh, S.; Sueoka, T.; Titani, K.; Fujita, K.; Nagatsu, T.: Cloning and sequencing of cDNA encoding human sepiapterin reductase: an enzyme involved in tetrahydrobiopterin biosynthesis. Biochem. Biophys. Res. Commun. 179:183-189, 1991.

Murdoch, J. N.; Eddleston, J.; Stanier, P.; Copp, A. J.: Localization of the mouse gene encoding tyrosine kinase receptor type 10 on distal chromosome 1. Mammalian Genome 8:941-952, 1997.

Thony, B.; Heizmann, C. W.; Mattei, M.-G.: Human GTP-cyclohydrolaseI gene and sepiapterin reductase gene map to region 14q21-q22 and2p14-p12, respectively, by in situ hybridization. Genomics 26:168-170,1995.

Jin, H.; Oksenberg, D.; Ashkenazi, A.; Peroutka, S. J.; Duncan, A. M. V.; Rozmahel, R.; Yang, Y.; Mengod, G.; Palacios, J. M.; O'Dowd, B. F.: Characterization of the human 5-hydroxytryptamine (1B) receptor. J. Biol. Chem. 267: 5735-5738, 1992.

Weinshank, R. L.; Zgombick, J. M.; Macchi, M. J.; Branchek, T. A.; Hartig, P. R.: Human serotonin 1D receptor is encoded by a subfamily of two distinct genes:5-HT(1D-alpha) and 5-HT(1D-beta). Proc. Nat. Acad. Sci. 89:3630-3634, 1992.

Chen, Z.-Y.; Battinelli, E. M.; Fielder, A.; Bundey, S.; Sims, K.; Breakefield, X. O.; Craig, I. W.: A mutation in the Norrie disease gene (NDP) associated with X-linked familial exudative vitreoretinopathy. Nature Genet. 5:180-183, 1993.

Dudgeon, J.: Familial exudative vitreo-retinopathy. Trans. Ophthal. Soc. U. K. 99:45-49, 1979.

Sinke, R. J.; de Leeuw, B.; Janssen, H. A. P.; Olde Weghuis, D.; Suijkerbuijk, R. F.; Meloni, A. M.; Gilgenkrantz, S.; Berger, W.; Ropers, H. H.; Sandberg, A. A.; Geurts van Kessel, A.: Localization of X chromosome short arm markers relative to synovial sarcoma- and renal adenocarcinoma-associated translocation breakpoints. Hum. Genet. 92:305-308, 1993.

Brennan, T. J.; Seeley, W. W.; Kilgard, M.; Schreiner, C. E.; Tecott, L. H.: Sound-induced seizures in serotonin 5-HT-2C receptor mutant mice. Nature Genet. 16:387-390, 1997.

Gurevich, I.; Tamir, H.; Arango, V.; Dwork, A. J.; Mann, J. J.; Schmauss, C.: Altered editing of serotonin 2C receptor pre-mRNA in the prefrontal cortex of depressed suicide victims. Neuron 34:349-356,2002.

Hall, C. S.: Genetic differences in fatal audiogenic seizures: between two inbred strains of house mice. J. Hered. 38:3-6, 1947.

Lappalainen, J.; Zhang, L.; Dean, M.; Oz, M.; Ozaki, N.; Yu, D.; Virkkunen, M.; Weight, F.; Linnoila, M.; Goldman, D.: Identification, expression, and pharmacology of a cys (23)-ser (23) substitution in the human 5-HT(2C) receptor gene (HTR2C). Genomics 27:274-279,1995.

Milatovich, A.; Hsieh, C.-L.; Bonaminio, G.; Tecott, L.; Julius, D.; Francke, U.: Serotonin receptor 1c gene assigned to X chromosome in human (band q24) and mouse (bands D-F4). Hum. Molec. Genet. 1:681-684, 1992.

Tecott, L. H.; Sun, L. M.; Akana, S. F.; Strack, A. M.; Lowenstein, D. H.; Dallman, M. F.; Julius, D.: Eating disorder and epilepsy in mice lacking 5-HT2C serotonin receptors. Nature 374:542-546, 1995.

Blaschke, R. J.; Monaghan, A. P.; Schiller, S.; Schechinger, B.; Rao, E.; Padilla-Nash, H.; Ried, T.; Rappold, G. A.: SHOT, a SHOX-related homeobox gene, is implicated in craniofacial, brain, heart, and limb development. Proc. Nat. Acad. Sci. 95:2406-2411, 1998.

Clement-Jones, M.; Schiller, S.; Rao, E.; Blaschke, R. J.; Zuniga, A.; Zeller, R.; Robson, S. C.; Binder, G.; Glass, I.; Strachan, T.; Lindsay, S.; Rappold, G. A.: The short stature homeobox gene SHOX is involved in skeletal abnormalities in Turner syndrome. Hum. Molec. Genet. 9:695-702, 2000.

Clark, J.; Rocques, P. J.; Crew, A. J.; Gill, S.; Shipley, J.; Chan, A. M.-L.; Gusterson, B. A.; Cooper, C. S.: Identification of novel genes, SYT and SSX, involved in the t (X;18) (p11.2; q11.2) translocation found in human synovial sarcoma. Nature Genet. 7:502-508, 1994.

Ramulu, P.; Kennedy, M.; Xiong, W.-H.; Williams, J.; Cowan, M.; Blesh, D.; Yau, K.-W.; Hurley, J. B.; Nathans, J.: Normal light response, photoreceptor integrity, and rhodopsin dephosphorylation in mice lacking both protein phosphatases with EF hands (PPEF-1 and PPEF-2). Molec. Cell. Biol. 21:8605-8614, 2001.

Prakash, S. K.; Paylor, R.; Jenna, S.; Lamarche-Vane, N.; Armstrong, D. L.; Xu, B.; Mancini, M. A.; Zoghbi, H. Y.: Functional analysis of ARHGAP6, a novel GTPase-activating protein for RhoA. Hum. Molec. Genet. 9:477-488, 2000.

Schaefer, L.; Prakash, S.; Zoghbi, H. Y.: Cloning and characterization of a novel rho-type GTPase-activating protein gene (ARHGAP6) from the critical region for microphthalmia with linear skin defects. Genomics 46:268-277, 1997.

Aman, M. J.; Tayebi, N.; Obiri, N. I.; Puri, R. K.; Modi, W. S.; Leonard, W. J.: cDNA cloning and characterization of the human interleukin13 receptor alpha chain. J. Biol. Chem. 271:29265-29270, 1996.

Guo, J.; Apiou, F.; Mellerin, M.-P.; Lebeau, B.; Jacques, Y.; Minvielle, S.: Chromosome mapping and expression of the human interleukin-13 receptor. Genomics 42:141-5, 1997.

Hilton, D. J.; Zhang, J.-G.; Metcalf, D.; Alexander, W. S.; Nicola, N. A.; Willson, T. A.: Cloning and characterization of a binding subunit of the interleukin 13 receptor that is also a component of the interleukin 4 receptor. Proc. Nat. Acad. Sci. 93:497-501, 1996.

Kaye, F. J.; Modi, S.; Ivanovska, I.; Koonin, E. V.; Thress, K.; Kubo, A.; Kornbluth, S.; Rose, M. D.: A family of ubiquitin-like proteins binds the ATPase domain of Hsp70-like Stch. FEBS Lett. 467:348-352, 2000.

Kaye, F. J.; Shows, T. B.: Assignment of ubiquilin 2 (UBQLN2) to human chromosome xp11.23-p11.1 by Gene Bridge radiation hybrids. Cytogenet. Cell Genet. 89:116-117, 2000.

Kleijnen, M. F.; Shih, A. H.; Zhou, P.; Kumar, S.; Soccio, R. E.; Kedersha, N. L.; Gill, G.; Howley, P. M.: The hPLIC proteins may provide a link between the ubiquitination machinery and the proteasome. Molec. Cell 6:409-419, 2000.

Marchand, J.-B.; Kaiser, D. A.; Pollard, T. D.; Higgs, H. N.:Interaction of WASP/Scar proteins with actin and vertebrate Arp2/3complex. Nature Cell Biol. 3:76-82, 2001.

Lee, D. K.; Nguyen, T.; Lynch, K. R.; Cheng, R.; Vanti, W. B.; Arkhitko, O.; Lewis, T.; Evans, J. F.; George, S. R.; O'Dowd, B. F.: Discovery and mapping of ten novel G protein-coupled receptor genes. Gene 275:83-91, 2001.

Furneaux, H. M.; Rosenblum, M. K.; Dalmau, J.; Wong, E.; Woodruff, P.; Graus, F.; Posner, J. B.: Selective expression of Purkinje-cell antigens in tumor tissue from patients with paraneoplastic cerebellar degeneration. New Eng. J. Med. 322:1844-1851, 1990.

Furneaux, H. M.; Wong, E.; Posner, J. B.: Isolation of cDNA clones encoding the major Yo paraneoplastic antigen. (Abstract) Neurology 40(suppl. 1):166 only, 1990.

Knight, J. C.; Renwick, P. J.; Downing, J. R.; Okuda, T.: Physical linkage of the cdc2-related gene (PCTK1) and the ubiquitin-activating enzyme E1 gene (UBE1) on human Xp11.3. Cytogenet. Cell Genet. 71:155-157, 1995.

Aarskog, D.: A familial syndrome of short stature associated with facial dysplasia and genital anomalies. J. Pediat. 77:856-861,1970.

Baldellou, A.; Galve, L.; Bassecourt, M.: Risk of medullary damage in Aarskog-Scott syndrome. (Abstract) Clin. Genet. 23:225 only,1983.

Bawle, E.; Tyrkus, M.; Lipman, S.; Bozimowski, D.: Aarskog syndrome: full male and female expression associated with an X-autosome translocation. Am. J. Med. Genet. 17:595-602, 1984.

Berman, P. A.; Desjardins, C.; Fraser, F. C.: Inheritance of the Aarskog syndrome. Birth Defects Orig. Art. Ser. X(7): 151-159, 1974.

Buechner, M.; Hall, D. H.; Bhatt, H.; Hedgecock, E. M.: Cystic canal mutants in Caenorhabditis elegans are defective in the apical membrane domain of the renal (excretory) cell. Dev. Biol. 214:227-241,1999.

Casteels, M.; Samain, H.; Penninckx, F.; Coremans, G.; Beirinckx, J.; Fryns, J. P.: Megadolichosigmoid in a young male with Aarskog syndrome. Genet. Counsel. 5:81-83, 1994.

Estrada, L.; Caron, E.; Gorski, J. L.: Fgd1, the Cdc42 guaninenucleotide exchange factor responsible for faciogenital dysplasia, is localized to the subcortical actin cytoskeleton and Golgi membrane. Hum. Molec. Genet. 10:485-495, 2001.

Fernandez, I.; Tsukahara, M.; Mito, H.; Yoshii, H.; Uchida, M.; Matsuo, K.; Kajii, T.: Congenital heart defects in Aarskog syndrome. Am. J. Med. Genet. 50:318-322, 1994.

Fryns, J.-P.: Dolichomegasigmoid in Aarskog syndrome. (Letter) Am. J. Med. Genet. 45:122 only, 1993.

Fryns, J. P.: Aarskog syndrome: the changing phenotype with age. Am. J. Med. Genet. 43:420-427, 1992.

Fryns, J. P.; Macken, J.; Vinken, L.; Igodt-Ameye, L.; van denBerghe, H.: The Aarskog syndrome. Hum. Genet. 42:129-135, 1978.

Funderburk, S. J.; Crandall, B. F.: The Aarskog syndrome in three brothers. Clin. Genet. 6:119-124, 1974.

Furukawa, C. T.; Hall, B. D.; Smith, D. W.: The Aarskog syndrome. J. Pediat. 81:1117-1122, 1972.

Gao, J.; Estrada, L.; Cho, S.; Ellis, R. E.; Gorski, J. L.: The Caenorhabditis elegans homolog of FGD1, the human Cdc42 GEF gene responsible for faciogenital dysplasia, is critical for excretory cell morphogenesis. Hum. Molec. Genet. 10:3049-3062, 2001.

Glover, T. W.; Verga, V.; Rafael, J.; Barcroft, C.; Gorski, J. L.; Bawle, E. V.; Higgins, J. V.: Translocation breakpoint in Aarskog syndrome maps to Xp11.21 between ALAS2 and DXS323. Hum. Molec. Genet. 2:1717-1718, 1993.

Grier, R. E.; Farrington, F. H.; Kendig, R.; Mamunes, P.: Autosomal dominant inheritance of the Aarskog phenotype. (Abstract) Am. J. Hum. Genet. 33:64A only, 1981.

Hoo, J. J.: The Aarskog (facio-digito-genital) syndrome. Clin. Genet. 16:269-276, 1979.

Kodama, M.; Fujimoto, S.; Namikawa, T.; Matsuda, I.: Aarskog syndrome with isolated growth hormone deficiency. Europ. J. Pediat. 135:273-276, 1981.

Lebel, R. R.; May, M.; Pouls, S.; Lubs, H. A.; Stevenson, R. E.; Schwartz, C. E.: Non-syndromic X-linked mental retardation associated with a missense mutation (P312L) in the FGD1 gene. Clin. Genet. 61:139-145, 2002.

Logie, L. J.; Porteous, M. E. M.: Intelligence and development in Aarskog syndrome. Arch. Dis. Child. 79:359-360, 1998.

Mikelsaar, R. V.-A.; Lurie, I. W.: Atypical case of Aarskog syndrome. J. Med. Genet. 29:349-350, 1992.

Nielsen, K. B.: Aarskog syndrome in a Danish family: an illustration of the need for dysmorphology in paediatrics. Clin. Genet. 33:315-317, 1988.

Oberiter, V.; Lovrencic, M. K.; Schmutzer, L.; Kraus, O.: The Aarskog syndrome. Acta Paediat. Scand. 69:567-570, 1980.

Orrico, A.; Galli, L.; Falciani, M.; Bracci, M.; Cavaliere, M. L.; Rinaldi, M. M.; Musacchio, A.; Sorrentino, V.: A mutation in the pleckstrin homology (PH) domain of the FGD1 gene in an Italian family with faciogenital dysplasia (Aarskog-Scott syndrome). FEBS Lett. 478:216-220, 2000.

Pasteris, N. G.; Cadle, A.; Logie, L. J.; Porteous, M. E. M.; Schwartz, C. E.; Stevenson, R. E.; Glover, T. W.; Wilroy, R. S.; Gorski, J. L.: Isolation and analysis of the faciogenital dysplasia (Aarskog-Scottsyndrome) gene: a putative, rho/rac guanine nucleotide exchange factor. Cell 79:669-678, 1994.

Pasteris, N. G.; de Gouyon, B.; Cadle A. B.; Campbell, K.; Herman, G. E.; Gorski, J. L.: Cloning and regional localization of the mouse faciogenital dysplasia (Fgd1) gene. Mammalian Genome 6:658-661, 1995.

Pedersen, J. C.; Fryns, J. P.; Bracke, P.; Geeraert, M.; Van DenBerghe, H.: The Aarskog syndrome. Ann. Genet. 23:108-110, 1980.

Porteous, M. E. M.; Goudie, D. R.: Aarskog syndrome. J. Med. Genet. 28:44-47, 1991.

Rafael, J.; Verga, V.; Hall, B.; Burright, E.; Gorski, J.; Bawle, J.; Higgins, J. V.; Glover, T. W.: Assignment of the translocation breakpoint in a patient with Aarskog syndrome to Xp11.21. (Abstract) Am. J. Hum. Genet. 51 (suppl.): A116 only, 1992.

Schwartz, C. E.; Gillessen-Kaesbach, G.; May, M.; Cappa, M.; Gorski, J.; Steindl, K.; Neri, G.: Two novel mutations confirm FGD1 is responsible for the Aarskog syndrome. Europ. J. Hum. Genet. 8:869-874, 2000.

Scott, C. I., Jr.: Unusual facies, joint hypermobility, genital anomaly and short stature: a new dysmorphic syndrome. Birth Defects Orig. Art. Ser. VII(6):240-246, 1971.

Demarest, S. J.; Martinez-Yamout, M.; Chung, J.; Chen, H.; Xu, W.; Dyson, H. J.; Evans, R. M.; Wright, P. E.: Mutual synergistic folding in recruitment of CBP/p300 by p160 nuclear receptor coactivators. Nature 415:549-553, 2002.

Eckner, R.; Ewen, M. E.; Newsome, D.; Gerdes, M.; DeCaprio, J. A.; Lawrence, J. B.; Livingston, D. M.: Molecular cloning and functional analysis of the adenovirus E1A-associated 300-kD protein (p300) reveals a protein with properties of a transcriptional adaptor. Genes Dev. 15:869-884, 1994.

Lin, C. H.; Hare, B. J.; Wagner, G.; Harrison, S. C.; Maniatis, T.; Fraenkel, E.: A small domain of CBP/p300 binds diverse proteins: solution structure and functional studies. Molec. Cell 8:581-590, 2001.

Riesewijk, A. M.; Blagitko, N.; Schinzel, A. A.; Hu, L.; Schulz, U.; Hamel, B. C. J.; Ropers, H.-H.; Kalscheuer, V. M.: Evidence against a major role of PEG1/MEST Silver-Russell syndrome. Europ. J. Hum. Genet. 6:114-120, 1998.

Riesewijk, A. M.; Hu, L.; Schulz, U.; Tariverdian, G.; Hoglund, P.; Kere, J.; Ropers, H.-H.; Kalscheuer, V. M.: Monoallelic expression of human PEG1/MEST is paralleled by parent-specific methylation in fetuses. Genomics 42:236-244, 1997.

Sado, T.; Nakajima, N.; Tada, M.; Takagi, N.: A novel mesoderm-specific cDNA isolated from a mouse embryonal carcinoma cell line. Dev. Growth Differ. 35:551-560, 1993.

Jayakumar, A.; Chirala, S. S.; Chinault, A. C.; Baldini, A.; Abu-Elheiga, L.; Wakil, S. J.: Isolation and chromosomal mapping of genomic clones encoding the human fatty acid synthase gene. Genomics 23:420-424, 1994.

Jayakumar, A.; Tai, M.-H.; Huang, W.-Y.; Al-Feel, W.; Hsu, M.; Abu-Elheiga, L.; Chirala, S. S.; Wakil, S. J.: Human fatty acid synthase: properties and molecular cloning. Proc. Nat. Acad. Sci. 92:8695-8699, 1995.

Loftus, T. M.; Jaworsky, D. E.; Frehywot, G. L.; Townsend, C. A.; Ronnett, G. V.; Lane, M. D.; Kuhajda, F. P.: Reduced food intake and body weight in mice treated with fatty acid synthase inhibitors. Science 288:2379-2381, 2000.

Wakil, S. J.: Fatty acid synthase, a proficient multifunctional enzyme. Biochemistry 28:4523-4530, 1989.

Ye, Q.; Chung, L. W. K.; Li, S.; Zhau, H. E.: Identification of a novel FAS/ER-alpha fusion transcript expressed in human cancer cells. Biochim. Biophys. Acta 1493:373-377, 2000.

Hofmann, M. A.; Drury, S.; Fu, C.; Qu, W.; Taguchi, A.; Lu, Y.; Avila, C.; Kambham, N.; Bierhaus, A.; Nawroth, P.; Neurath, M. F.; Slattery, T.; Beach, D.; McClary, J.; Nagashima, M.; Morser, J.; Stern, D.; Schmidt, A. M.: RAGE mediates a novel proinflammatory axis: a central cell surface receptor for S100/calgranulin polypeptides. Cell 97:889-901, 1999.

Yan, S. D.; Chen, X.; Fu, J.; Chen, M.; Zhu, H.; Roher, A.; Slattery, T.; Zhao, L.; Nagashima, M.; Morser, J.; Migheli, A.; Nawroth, P.; Stern, D.; Schmidt, A. M.: RAGE and amyloid-beta peptide neurotoxicity in Alzheimer's disease. Nature 382:685-691, 1996.

Delot, E.; King, L. M.; Briggs, M. D.; Wilcox, W. R.; Cohn, D. H.: Trinucleotide expansion mutations in the cartilage oligomeric matrix protein (COMP) gene. Hum. Molec. Genet. 8:123-128, 1999.

Tini, M.; Benecke, A.; Um, S.-J.; Torchia, J.; Evans, R. M.; Chambon, P.: Association of CBP/p300 acetylase and thymine DNA glycosylase links DNA repair and transcription. Molec. Cell 9:265-277, 2002.

Weaver, B. K.; Kumar, K. P.; Reich, N. C.: Interferon regulatory factor 3 and CREB-binding protein/p300 are subunits of double-stranded RNA-activated transcription factor DRAF1. Molec. Cell. Biol. 18:1359-1368, 1998.

Hansen, J. J.; Durr, A.; Cournu-Rebeix, I.; Georgopoulos, C.; Ang, D.; Nielsen, M. N.; Davoine, C.-S.; Brice, A.; Fontaine, B.; Gregersen, N.; Bross, P.: Hereditary spastic paraplegia SPG13 is associated with a mutation in the gene encoding the mitochondrial chaperonin Hsp60. Am. J. Hum. Genet. 70:1328-1332, 2002.

Todd, M. J.; Viitanen, P. V.; Lorimer, G. H.: Dynamics of the chaperonin ATPase cycle: implications for facilitated protein folding. Science 265:659-666, 1994.

Hellevuo, K.; Berry, R.; Sikela, J. M.; Tabakoff, B.: Localization of the gene for a novel human adenylyl cyclase (ADCY7) to chromosome 16. Hum. Genet. 95:197-200, 1995.

Hellevuo, K.; Yoshimura, M.; Kao, M.; Hoffman, P. L.; Cooper, D. M. F.; Tabakoff, B.: A novel adenylyl cyclase sequence cloned from the human erythroleukemia cell line. Biochem. Biophys. Res. Commun. 192:311-318, 1993.

Beri, R. K.; Marley, A. E.; See, C. G.; Sopwith, W. F.; Aguan, K.; Carling, D.; Scott, J.; Carey, F.: Molecular cloning, expression and chromosomal localisation of human AMP-activated protein kinase. FEBS Lett. 356:117-121, 1994.

Hardie, D. G.: Regulation of fatty acid and cholesterol metabolism by the AMP-activated protein kinase. Biochim. Biophys. Acta 1123:231-238, 1992.

Hardie, D. G.; MacKintosh, R. W.: AMP-activated protein kinase: an archetypal protein kinase cascade? Bioessays 14:699-704, 1992.

Mu, J.; Brozinick, J. T., Jr.; Valladares, O.; Bucan, M.; Birnbaum, M. J.: A role for AMP-activated protein kinase in contraction- and hypoxia-regulated glucose transport in skeletal muscle. Molec. Cell 7:1085-1094, 2001.

Stapleton, D.; Woollatt, E.; Mitchelhill, K. I.; Nicholl, J. K.; Fernandez, C. S.; Michell, B. J.; Witters, L. A.; Power, D. A.; Sutherland, G. R.; Kemp, B. E.: AMP-activated protein kinase isoenzyme family: subunit structure and chromosomal location. FEBS Lett. 409:452-456,1997.

Gal, A.; Wieringa, B.; Smeets, D. F. C. M.; Bleeker-Wagemakers, L.; Ropers, H. H.: Submicroscopic interstitial deletion of the X chromosome explains a complex genetic syndrome dominated by Norrie disease. Cytogenet. Cell Genet. 42:219-224, 1986.

Di Paola, R.; Frittitta, L.; Miscio, G.; Bozzali, M.; Baratta, R.; Centra, M.; Spampinato, D.; Santagati, M. G.; Ercolino, T.; Cisternino, C.; Soccio, T. Mastroianno, S.; Tassi, V.; Almgren, P.; Pizzuti, A.; Vigneri, R.; Trischitta, V.: A variation in 3-prime UTR of hPTP1B increases specific gene expression and associates with insulin resistance. Am. J. Hum. Genet. 70:806-812, 2002.

Castedo, M.; Ferri, K. F.; Blanco, J.; Roumier, T.; Larochette, N.; Barretina, J.; Amendola, A.; Nardacci, R.; Metivier, D.; Este, J. A.; Piacentini, M.; Kroemer, G.: Human immunodeficiency virus1 envelope glycoprotein complex-induced apoptosis involves mammalian target of rapamycin/FKBP12-rapamycin-associated protein-mediated p53phosphorylation. J. Exp. Med. 194:1097-1110, 2001.

El-Deiry, W. S.; Tokino, T.; Velculescu, V. E.; Levy, D. B.; Parsons, R.; Trent, J. M.; Lin, D.; Mercer, E.; Kinzler, K. W.; Vogelstein, B.: WAF1, a potential mediator of p53 tumor suppression. Cell 75:817-825, 1993.

Kolble, K.; Lu, J.; Mole, S. E.; Kaluz, S.; Reid, K. B. M.: Assignment of the human pulmonary surfactant protein D gene (SFTP4) to 10q22-q23close to the surfactant protein A gene cluster. Genomics 17:294-298,1993.

Gedde-Dahl, T., Jr.; Olaisen, B.; Teisberg, P.; Wilhelmy, M. C.; Mevag, B.; Helland, R.: The locus for apolipoprotein E (apoE) is close to the Lutheran (Lu) blood group locus on chromosome 19. Hum. Genet. 67:178-182, 1984.

Grubb, R.: Zur Genetik des Lewis-Systems. Naturwissenschaften 21:560-561, 1953.

Kolanus, W.; Nagel, W.; Schiller, B.; Zeitlmann, L.; Godar, S.; Stockinger, H.; Seed, B.: Alpha-L-beta-2 integrin/LFA-1 binding to ICAM-1 induced by cytohesin-1, a cytoplasmic regulatory molecule. Cell 86:233-242, 1996.

Ogasawara, M.; Kim, S.-C.; Adamik, R.; Togawa, A.; Ferrans, V. J.; Takeda, K.; Kirby, M.; Moss, J.; Vaughan, M.: Similarities in function and gene structure of cytohesin-4 and cytohesin-1, guanine nucleotide-exchange proteins for ADP-ribosylation factors. J. Biol. Chem. 275:3221-3230, 2000.

Findlay, D. M.; Fisher, L. W.; McQuillan, C. I.; Termine, J. D.; Young, M. F.: Isolation of the osteonectin gene: evidence that a variable region of the osteonectin molecule is encoded within one exon. Biochemistry 27:1483-1489, 1988.

Gilmour, D. T.; Lyon, G. J.; Carlton, M. B. L.; Sanes, J. R.; Cunningham, J. M.; Anderson, J. R.; Hogan, B. L. M.; Evans, M. J.; Colledge, W. H.: Mice deficient for the secreted glycoprotein SPARC/osteonectin/BM40 develop normally but show severe age-onset cataract formation and disruption of the lens. EMBO J. 17:1860-1870, 1998.

Sanyanusin, P.; McNoe, L. A.; Sullivan, M. J.; Weaver, R. G.; Eccles, M. R.: Mutation of PAX2 in two siblings with renal-coloboma syndrome. Hum. Molec. Genet. 4:2183-2184, 1995.

Sanyanusin, P.; Norrish, J. H.; Ward, T. A.; Nebel, A.; McNoe, L. A.; Eccles, M. R.: Genomic structure of the human PAX2 gene. Genomics 35:258-261, 1996.

Sanyanusin, P.; Schimmenti, L. A.; McNoe, L. A.; Ward, T. A.; Pierpont, M. E. M.; Sullivan, M. J.; Dobyns, W. B.; Eccles, M. R.: Mutation of the PAX2 gene in a family with optic nerve colobomas, renal anomalies and vesicoureteral reflux. Nature Genet. 9:358-364,1995.

Schimmenti, L. A.; Cunliffe, H. E.; McNoe, L. A.; Ward, T. A.; French, M. C.; Shim, H. H.; Zhang, Y.-H.; Proesmans, W.; Leys, A.; Byerly, K. A.; Braddock, S. R.; Masuno, M.; Imaizumi, K.; Devriendt, K.; Eccles, M. R.: Further delineation of renal-coloboma syndrome in patients with extreme variability of phenotype and identical PAX2 mutations. Am. J. Hum. Genet. 60:869-878, 1997.

Schimmenti, L. A.; Pierpont, M. E.; Carpenter, B. L. M.; Kashtan, C. E.; Johnson, M. R.; Dobyns, W. B.: Autosomal dominant optic nerve colobomas, vesicoureteral reflux, and renal anomalies. Am. J. Med. Genet. 59:204-208, 1995.

Schimmenti, L. A.; Shim, H. H.; Wirtschafter, J. D.; Panzarino, V. A.; Kashtan, C. E.; Kirkpatrick, S. J.; Wargowski, D. S.; France, T. D.; Michel, E.; Dobyns, W. B.: Homonucleotide expansion and contraction mutations of PAX2 and inclusion of Chiari 1 malformation as part of renal-coloboma syndrome. Hum. Mutat. 14:369-376, 1999.

Stapleton, P.; Weith, A.; Urbanek, P.; Kozmik, Z.; Busslinger, M.: Chromosomal localization of seven PAX genes and cloning of a novel family member, PAX-9. Nature Genet. 3:292-298, 1993.

Tellier, A.-L.; Amiel, J.; Delezoide, A.-L.; Audollent, S.; Auge, J.; Esnault, D.; Encha-Razavi, F.; Munnich, A.; Lyonnet, S.; Vekemans, M.; Attie-Bitach, T.: Expression of the PAX2 gene in human embryos and exclusion in the CHARGE syndrome. Am. J. Med. Genet. 93:85-88,2000.

Tellier, A.-L.; Amiel, J.; Salomon, R.; Jolly, D.; Delezoide, A.-L.; Auge, J.; Gubler, M.-C.; Munnich, A.; Lyonnet, S.; Antignac, C.; Vekemans, M.; Broyer, M.; Attie-Bitach, T.: PAX2 expression during early human development and its mutations in renal hypoplasia with or without coloboma. (Abstract) Am. J. Hum. Genet. 63 (suppl.):A7 only, 1998.

Ward, T. A.; Nebel, A.; Reeve, A. E.; Eccles, M. R.: Alternative messenger RNA forms and open reading frames within an additional conserved region of the human PAX-2 gene. Cell Growth Differ. 5:1015-1021,1994.

Weaver, R. G.; Cashwell, L. F.; Lorentz, W.; Whiteman, D.; Geisinger, K. R.; Ball, M.: Optic nerve coloboma associated with renal disease. Am. J. Med. Genet. 29:597-605, 1988.

Barr, F. G.; Nauta, L. E.; Davis, R. J.; Schafer, B. W.; Nycum, L. M.; Biegel, J. A.: In vivo amplification of the PAX3-FKHR andPAX7-FKHR fusion genes in alveolar rhabdomyosarcoma. Hum. Molec. Genet. 5:15-21, 1996.

Burri, M.; Tromvoukis, Y.; Bopp, D.; Frigerio, G.; Noll, M.: Conservation of the paired domain in metazoans and its structure in three isolated human genes. EMBO J. 8:1183-1190, 1989.

Gruss, P.; Walther, C.: Pax in development. Cell 69:719-722,1992.

Schafer, B. W.; Mattei, M. G.: The human paired domain gene PAX7(Hup1) maps to chromosome 1p35-1p36.2. Genomics 17:249-251, 1993.

Seale, P.; Sabourin, L. A.; Girgis-Gabardo, A.; Mansouri, A.; Gruss, P.; Rudnicki, M. A.: Pax7 is required for the specification of myogenic satellite cells. Cell 102:777-786, 2000.

Shapiro, D. N.; Sublett, J. E.; Li, B.; Valentine, M. B.; Morris, S. W.; Noll, M.: The gene for PAX7, a member of the paired-box-containing genes, is localized on human chromosome arm 1p36. Genomics 17:767-769,1993.

Helwig, U.; Imai, K.; Schmahl, W.; Thomas, B. E.; Varnum, D. S.; Nadeau, J. H.; Balling, R.: Interaction between undulated and Patch leads to an extreme form of spina bifida in double-mutant mice. Nature Genet. 11:60-63, 1995.

Guenet, J.-L.; Simon-Chazottes, D.; Ringwald, M.; Kemler, R.: The genes coding for alpha and beta catenin (Catna1 and Catnb) and plakoglobin (Jup) map to mouse chromosomes 18, 9, and 11, respectively. Mammalian Genome 6:363-366, 1995.

Westergaard, J. G.; Chemnitz, J.; Teisner, B.; Poulsen, H. K.; Ipsen, L.; Beck, B.; Grudzinskas, J. G.: Pregnancy-associated plasma protein A: a possible marker in the classification and prenatal diagnosis of Cornelia de Lange syndrome. Prenatal Diag. 3:225-232, 1983.

Barnett, T.; Pickle, W., II; Rae, P. M. M.; Hart, J.; Kamarck, M.; Elting, J.: Pregnancy-specific beta-1-glycoproteins are related to carcinoembryonic antigens and map to chromosome 19. (Abstract) Cytogenet. Cell Genet. 51:958, 1989.

Barnett, T. R.; Pickle, W., II; Rae, P. M. M.; Hart, J.; Kamarck, M.; Elting, J.: Human pregnancy-specific beta (1)-glycoproteins are coded within chromosome 19. Am. J. Hum. Genet. 44:890-893, 1989.

Bartels, I.; Lindemann, A.: Maternal levels of pregnancy-specific beta-1-glycoprotein (SP-1) are elevated in pregnancies affected by Down's syndrome. Hum. Genet. 80:46-48, 1988.

Brandriff, B. F.; Gordon, L. A.; Tynan, K. T.; Olsen, A. S.; Mohrenweiser, H. W.; Fertitta, A.; Carrano, A. V.; Trask, B. J.: Order and genomic distances among members of the carcinoembryonic antigen (CEA) gene family determined by fluorescence in situ hybridization. Genomics 12:773-779, 1992.

Chan, W.-Y.; Qiu, W.-R.: Human pregnancy-specific beta-1 glycoproteinis encoded by multiple genes localized on two chromosomes. Am. J. Hum. Genet. 43:152-159, 1988.

Khan, W. N.; Teglund, S.; Bremer, K.; Hammarstrom, S.: The pregnancy-specific glycoprotein family of the immunoglobulin superfamily: identification of new members and estimation of family size. Genomics 12:780-787,1992.

Niemann, S. C.; Flake, A.; Bohn, H.; Bartels, I.: Pregnancy-specific beta-1-glycoprotein: cDNA cloning, tissue expression, and species specificity of one member of the PSBG family. Hum. Genet. 82:239-243,1989.

Niemann, S. C.; Schonk, D.; van Dijk, P.; Wieringa, B.; Grzeschik, K.-H.; Bartels, I.: Regional localization of the gene encoding pregnancy specific beta-1-glycoprotein 1 (PSBG1) to human chromosome 19q13.1. Cytogenet. Cell Genet. 52:95-97, 1989.

Niemann, S. C.; Schonk, D.; van Dijk, P. E.; Grzeschik, K.-H.; Bartels, I.: Chromosomal assignment of a cDNA clone encoding pregnancy-specific beta-1-glycoprotein to chromosome 19. (Abstract) Cytogenet. Cell Genet. 51:1053, 1989.

Olsen, A.; Teglund, S.; Nelson, D.; Gordon, L.; Copeland, A.; Georgescu, A.; Carrano, A.; Hammarstrom, S.: Gene organization of the pregnancy-specific glycoprotein region on human chromosome 19: assembly and analysis of a 700-kb cosmid contig spanning the region. Genomics 23:659-668, 1994.

Streydio, C.; Swillens, S.; Georges, M.; Szpirer, C.; Vassart, G.: Structure, evolution and chromosomal localization of the human pregnancy-specific beta-1 glycoprotein gene family. Genomics 6:579-592, 1990. Note: Erratum: Genomics 7:661-662, 1990.

Teglund, S.; Olsen, A.; Khan, W. N.; Frangsmyr, L.; Hammarstrom, S.: The pregnancy-specific glycoprotein (PSG) gene cluster on human chromosome 19: fine structure of the 11 PSG genes and identification of 6 new genes forming a third subgroup within the carcinoembryonic antigen (CEA) family. Genomics 23:669-684, 1994.

Thompson, J.; Koumari, R.; Wagner, K.; Barnert, S.; Schleussner, C.; Schrewe, H.; Zimmermann, W.; Muller, G.; Schempp, W.; Zaninetta, D.; Ammaturo, D.; Hardman, N.: The human pregnancy-specific glycoprotein genes are tightly linked on the long arm of chromosome 19 and are coordinately expressed. Biochem. Biophys. Res. Commun. 167: 848-859,1990.

Watanabe, S.; Chou, J. Y.: Isolation and characterization of complementary DNAs encoding human pregnancy-specific beta-1-glycoprotein. J. Biol. Chem. 263:2049-2054, 1988.

Olsen, A.; Teglund, S.; Nelson, D.; Gordon, L.; Copeland, A.; Georgescu, A.; Carrano, A.; Hammarstrom, S.: Gene organization of the pregnancy-specific glycoprotein region on human chromosome 19: assembly and analysis of a 700-kb cosmid contig spanning the region. Genomics 23:659-668, 1994.

Thompson, J.; Zimmermann, W.; Osthus-Bugat, P.; Schleussner, C.; Eades-Perner, A.-M.; Barnert, S.; von Kleist, S.; Willcocks, T.; Craig, I.; Tynan, K.; Olsen, A.; Mohrenweiser, H.: Long-range chromosomal mapping of the carcinoembryonic antigen (CEA) gene family cluster. Genomics 12:761-772, 1992.

Tynan, K.; Olsen, A.; Trask, B.; de Jong, P.; Thompson, J.; Zimmermann, W.; Carrano, A.; Mohrenweiser, H.: Assembly and analysis of cosmid contigs in the CEA-gene family region of human chromosome 19. Nucleic Acids Res. 20:1629-1636, 1992.

Sheer, D.; Sheppard, D. M.; Le Beau, M.; Rowley, J. D.; San Roman, C.; Solomon, E.: Localization of the oncogene c-erbA1 immediately proximal to the acute promyelocytic leukaemia breakpoint on chromosome 17. Ann. Hum. Genet. 49:167-171, 1985.

Edelmann, W.; Zervas, M.; Costello, P.; Roback. L.; Fischer, I.; Hammarback, J. A.; Cowan, N.; Davies, P.; Wainer, B.; Kucherlapati, R.: Neuronal abnormalities in microtubule-associated protein 1B mutant mice. Proc. Nat. Acad. Sci. 93:1270-1275, 1996.

Hammarback, J. A.; Obar, R. A.; Hughes, S. M.; Vallee, R. B.:MAP1B is encoded as a polyprotein that is processed to form a complex N-terminal microtubule-binding domain. Neuron 7:129-139, 1991.

Lien, L. L.; Boyce, F. M.; Kleyn, P.; Brzustowicz, L. M.; Menninger, J.; Ward, D. C.; Gilliam, T. C.; Kunkel, L. M.: Mapping of human microtubule-associated protein 1B in proximity to the spinal muscular atrophy locus at 5q13. Proc. Nat. Acad. Sci. 88:7873-7876, 1991.

Lien, L. L.; Feener, C. A.; Fischbach, N.; Kunkel, L. M.: Cloning of human microtubule-associated protein 1B and the identification of a related gene on chromosome 15. Genomics 22:273-280, 1994.

Wirth, B.; Voosen, B.; Rohrig, D.; Knapp, M.; Piechaczek, B.; Rudnik-Schoneborn, S.; Zerres, K.: Fine mapping and narrowing of the genetic interval of the spinal muscular atrophy region by linkage studies. Genomics 15:113-118, 1993.

Zhang, Y. Q.; Bailey, A. M.; Matthies, H. J. G.; Renden, R. B.; Smith, M. A.; Speese, S. D.; Rubin, G. M.; Broadie, K.: Drosophila fragile X-related gene regulates the MAP1B homolog Futsch to control synaptic structure and function. Cell 107:591-603, 2001.

Garner, C. C.; Tucker, R. P.; Matus, A.: Selective localization of messenger RNA for cytoskeletal protein MAP2 in dendrites. Nature 336:674-677, 1988.

Kalcheva, N.; Albala, J.; O'Guin, K.; Rubino, H.; Garner, C.; Shafit-Zagardo, B.: Genomic structure of human microtubule-associated protein 2 (MAP-2) and characterization of additional MAP-2 isoforms. Proc. Nat. Acad. Sci. 92:10894-10898, 1995.

Kindler, S.; Garner, C. C.: Four repeat MAP2 isoforms in human and rat brain. Molec. Brain Res. 26:218-224, 1994.

Marsden, K. M.; Doll, T.; Ferralli, J.; Botteri, F.; Matus, A.: Transgenic expression of embryonic MAP2 in adult mouse brain: implications for neuronal polarization. J. Neurosci. 16:3265-3273, 1996.

Neve, R. L.; Harris, P.; Kosik, K. S.; Kurnit, D. M.; Donlon, T. A.: Identification of cDNA clones for the human microtubule-associated protein tau and chromosomal localization of the genes for tau and microtubule-associated protein 2. Molec. Brain Res. 1:271-280,1986.

Adriaansen, H. J.; Geurts Van Kessel, A. H. M.; Wijdenes-De Bresser, J. H. F. M.; Van Drunen-Schoenmaker, E.; Van Dongen, J. J. M.: Expression of the myeloid differentiation antigen CD33 depends on the presence of human chromosome 19 in human-mouse hybrids. Ann. Hum. Genet. 54:115-119, 1990.

Bonthron, D. T.; Dunlop, N.; Barr, D. G. D.; El Sanousi, A. A.; Al-Gazali, L. I.: Organisation of the human PAX4 gene and its exclusion as a candidate for the Wolcott-Rallison syndrome. J. Med. Genet. 35:288-292, 1998.

Inoue, H.; Nomiyama, J.; Nakai, K.; Matsutani, A.; Tanizawa, Y.; Oka, Y.: Isolation of full-length cDNA of mouse PAX4 gene and identification of its human homologue. Biochem. Biophys. Res. Commun. 243:628-633,1998.

Mansouri, A.; St-Onge, L.; Gruss, P.: Role of Pax genes in endoderm-derived organs. Trends Endocr. Metab. 10:164-167, 1999.

Matsushita, T.; Yamaoka, T.; Otsuka, S.; Moritani, M.; Matsumoto, T.; Itakura, M.: Molecular cloning of mouse paired-box-containing gene (Pax)-4 from an islet beta cell line and deduced sequence of human Pax-4. Biochem. Biophys. Res. Commun. 242:176-180, 1998.

Sosa-Pineda, B.; Chowdhury, K.; Torres, M.; Oliver, G.; Gruss, P.: The Pax4 gene is essential for differentiation of insulin-producing beta cells in the mammalian pancreas. Nature 386:399-402, 1997.

St-Onge, L.; Sosa-Pineda, B.; Chowdhury, K.; Mansouri, A.; Gruss, P.: Pax6 is required for differentiation of glucagon-producing alpha-cells in mouse pancreas. Nature 387:406-409, 1997.

Tamura, T.; Izumikawa, Y.; Kishino, T.; Soejima, H.; Jinno, Y.; Niikawa, N.: Assignment of the human PAX4 gene to chromosome band7q32 by fluorescence in situ hybridization. Cytogenet. Cell Genet. 66:132-134, 1994.

Adams, B.; Dorfler, P.; Aguzzi, A.; Kozmik, Z.; Urbanek, P.; Maurer-Fogy, I.; Busslinger, M.: Pax-5 encodes the transcription factor BSAP and is expressed in B lymphocytes, the developing CNS, and adult testis. Genes Dev. 6:1589-1607, 1992.

Busslinger, M.; Klix, N.; Pfeffer, P.; Graninger, P. G.; Kozmik, Z.: Deregulation of PAX-5 by translocation of the E-mu enhancer of the IgH locus adjacent to two alternative PAX-5 promoters in a diffuse large-cell lymphoma. Proc. Nat. Acad. Sci. 93:6129-6134, 1996.

Mikkola, I.; Heavey, B.; Horcher, M.; Busslinger, M.: Reversion of B cell commitment upon loss of Pax5 expression. Science 297:110-113, 2002.

Nutt, S. L.; Heavey, B.; Rolink, A. G.; Busslinger, M.: Commitment to the B-lymphoid lineage depends on the transcription factor Pax5. Nature 401:556-562, 1999.

Nutt, S. L.; Vambrie, S.; Steinlein, P.; Kozmik, Z.; Rolink, A.; Weith, A.; Busslinger, M.: Independent regulation of the two Pax5alleles during B-cell development. Nature Genet. 21:390-395, 1999.

Ohno, H.; Furukawa, T.; Fukuhara, S.; Zong, S. Q.; Kamesaki, H.; Shows, T. B.; Le Beau, M. M.; McKeithan, T. W.; Kawakami, T.; Honjo, T.: Molecular analysis of a chromosomal translocation, t (9;14)(p13; q32), in a diffuse large-cell lymphoma cell line expressing the Ki-1 antigen. Proc. Nat. Acad. Sci. 87:628-632, 1990.

Rolink, A. G.; Nutt, S. L.; Melchers, F.; Busslinger, M.: Long-term in vivo reconstitution of T-cell development by Pax5-deficient B-cell progenitors. Nature 401:603-606, 1999.

Vorechovsky, I.; Koskinen, S.; Paganelli, R.; Smith, C. I. E.; Busslinger, M.; Hammarstrom, L.: The PAX5 gene: a linkage and mutation analysis in candidate human primary immunodeficiencies. Immunogenetics 42:149-152, 1995.

Walther, C.; Guenet, J.-L.; Simon, D.; Deutsch, U.; Jostes, B.; Goulding, M. D.; Plachov, D.; Balling, R.; Gruss, P.: Pax: a murine multigene family of paired box containing genes. Genomics 11:424-434,1991.

Koseki, H.; Zachgo, J.; Mizutani, Y.; Simon-Chazottes, D.; Guenet, J.-L.; Balling, R.; Gossler, A.: Fine genetic mapping of the proximal part of mouse chromosome 2 excludes Pax-8 as a candidate gene for Danforth's short tail (Sd). Mammalian Genome 4:324-327, 1993.

Kroll, T. G.; Sarraf, P.; Pecciarini, L.; Chen, C.-J.; Mueller, E.; Splegelman, B. M.; Fletcher, J. A.: PAX8-PPAR-gamma-1 fusion in oncogene human thyroid carcinoma. Science 289:1357-1360, 2000.

Macchia, P. E.; Lapi, P.; Krude, H.; Pirro, M. T.; Missero, C.; Chiovato, L.; Souabni, A.; Baserga, M.; Tassi, V.; Pinchera, A.; Fenzi, G.; Gruters, A.; Busslinger, M.; Di Lauro, R.: PAX8 mutations associated with congenital hypothyroidism caused by thyroid dysgenesis. Nature Genet. 19:83-86, 1998.

Mansouri, A.; Chowdhury, K.; Gruss, P.: Follicular cells of the thyroid gland require Pax8 gene function. Nature Genet. 19:87-90,1998.

Pasca di Magliano, M.; Di Lauro, R.; Zannini, M.: Pax8 has a keyrole in thyroid cell differentiation. Proc. Nat. Acad. Sci. 97:13144-13149, 2000.

Plachov, D.; Chowdhury, K.; Walther, C.; Simon, D.; Guenet, J.-L.; Gruss, P.: Pax-8, a murine paired box gene expressed in the developing excretory system and thyroid gland. Development 110:643-651, 1990.

Tell, G.; Pellizzari, L.; Esposito, G.; Pucillo, C.; Macchia, P. E.; Di Lauro, R.; Damante, G.: Structural defects of a Pax8 mutant that give rise to congenital hypothyroidism. Biochem. J. 341:89-93,1999.

Bongarzone, I.; Vigano, E.; Alberti, L.; Borrello, M. G.; Pasini, B.; Greco, A.; Mondellini, P.; Smith, D. P.; Ponder, B. A. J.; Romeo, G.; Pierotti, M. A.: Full activation of MEN2B mutant RET by an additional MEN2A mutation or by ligand GDNF stimulation. Oncogene 16:2295-2301,1998.

Carlson, K. M.; Bracamontes, J.; Jackson, C. E.; Clark, R.; Lacroix, A.; Wells, S. A., Jr.; Goodfellow, P. J.: Parent-of-origin effects in multiple endocrine neoplasia type 2B. Am. J. Hum. Genet. 55:1076-1082, 1994.

Carlson, K. M.; Dou, S.; Chi, D.; Scavarda, N.; Toshima, K.; Jackson, C. E.; Wells, S. A., Jr.; Goodfellow, P. J.; Donis-Keller, H.: Single missense mutation in the tyrosine kinase catalytic domain of the RET proto-oncogene is associated with multiple endocrine neoplasia type2B. Proc. Nat. Acad. Sci. 91:1579-1583, 1994.

Mulligan, L. M.; Eng, C.; Healey, C. S.; Clayton, D.; Kwok, J. B. J.; Gardner, E.; Ponder, M. A.; Frilling, A.; Jackson, C. E.; Lehnert, H.; Neumann, H. P. H.; Thibodeau, S. N.; Ponder, B. A. J.: Specific mutations of the RET proto-oncogene are related to disease phenotype in MEN 2A and FMTC. Nature Genet. 6:70-74, 1994.

Bruss, M.; Kunz, J.; Lingen, B.; Bonisch, H.: Chromosomal mapping of the human gene for the tricyclic antidepressant-sensitive noradrenaline transporter. Hum. Genet. 91:278-280, 1993.

Esler, M.; Jennings, G.; Lambert, G.; Meredith, I.; Horne, M.; Eisenhofer, G.: Overflow of catecholamine neurotransmitters to the circulation: source, fate, and functions. Physiol. Rev. 70:963-985,1990.

Fritz, J. D.; Jayanthi, L. D.; Thoreson, M. A.; Blakely, R. D.: Cloning and chromosomal mapping of the murine norepinephrine transporter. J. Neurochem. 70:2241-2251, 1998.

Gelernter, J.; Kruger, S.; Kidd, K. K.; Amara, S.: TaqI RFLP at norepinephrine transporter protein (NET) locus. Hum. Molec. Genet. 2:820 only, 1993.

Gelernter, J.; Kruger, S.; Pakstis, A. J.; Pacholczyk, T.; Sparkes, R. S.; Kidd, K. K.; Amara, S.: Assignment of the norepinephrine transporter protein (NET1) locus to chromosome 16. Genomics 18:690-692, 1993.

Kaye, W. H.; Jimerson, D. C.; Lake, C. R.; Ebert, M. H.: Altered norepinephrine metabolism following long-term weight recovery in patients with anorexia nervosa. Psychiat. Res. 14:333-342, 1985.

Pacholczyk, T.; Blakely, R. D.; Amara, S. G.: Expression cloning of a cocaine- and antidepressant-sensitive human noradrenaline transporter. Nature 350:350-354, 1991.

Paczkowski, F. A.; Bonisch, H.; Bryan-Lluka, L. J.: Pharmacological properties of the naturally occurring ala457pro variant of the human norepinephrine transporter. Pharmacogenetics 12:165-173, 2002.

Pirke, K. M.; Kellner, M.; Philipp, E.; Laessle, R.; Krieg, J. C.; Fichter, M. M.: Plasma norepinephrine after a standardized test meal in acute and remitted patients with anorexia nervosa and in healthy controls. Biol. Psychiat. 31:1074-1077, 1992.

Porzgen, P.; Bonisch, H.; Bruss, M.: Molecular cloning and organization of the coding region of the human norepinephrine transporter gene. Biochem. Biophys. Res. Commun. 215:1145-1150, 1995. Notes: Erratum: Biochem. Biophys. Res. Commun. 227:642-643, 1996.

Shannon, J. R.; Flattem, N. L.; Jordan, J.; Jacob, G.; Black, B. K.; Biaggioni, I.; Blakely, R. D.; Robertson, D.: Orthostatic intolerance and tachycardia associated with norepinephrine-transporter deficiency. New Eng. J. Med. 342:541-549, 2000.

Urwin, R. E.; Bennetts, B.; Wilcken, B.; Lampropoulos, B.; Beumont, P.; Clarke, S.; Russell, J.; Tanner, S.; Nunn, K. P.: Anorexia nervosa (restrictive subtype) is associated with a polymorphism in the novel norepinephrine transporter gene promoter polymorphic region. Molec. Psychiat. 7:652-657, 2002.

Tomilin, A.; Remenyi, A.; Lins, K.; Bak, H.; Leidel, S.; Vriend, G.; Wilmanns, M.; Scholer, H. R.: Synergism with the coactivator OBF-1 (OCA-B, BOB-1) is mediated by a specific POU dimer configuration. Cell 103:853-864, 2000.

Ko, H.-S.; Fast, P.; McBride, W.; Staudt, L. M.: A human protein specific for the immunoglobulin octamer DNA motif contains a functional homeobox domain. Cell 55:135-144, 1988.

Schubart, K.; Massa, S.; Schubart, D.; Corcoran, L. M.; Rolink, A. G.; Matthias, P.: B cell development and immunoglobulin gene transcription in the absence of Oct-2 and OBF-1. Nature Immun. 2:69-74, 2001.

Staudt, L. M.; Clerc, R. G.; Singh, H.; LeBowitz, J. H.; Sharp, P. A.; Baltimore, D.: Cloning of a lymphoid-specific cDNA encoding a protein binding the regulatory octamer DNA motif. Science 241:577-580, 1988.

Parker, R. C.; Mardon, G.; Lebo, R. V.; Varmus, H. E.; Bishop, J. M.: Isolation of duplicated human c-src genes located on chromosomes 1 and 20. Molec. Cell. Biol. 5:831-838, 1985.

Tronick, S. R.; Popescu, N. C.; Cheah, M. S. C.; Swan, D. C.; Amsbaugh, S. C.; Lengel, C. R.; DiPaolo, J. A.; Robbins, K. C.: Isolation and chromosomal localization of the human fgr proto-oncogene, a distinct member of the tyrosine kinase gene family. Proc. Nat. Acad. Sci. 82:6595-6599, 1985.

Bork, P.: The modular architecture of a new family of growth regulators related to connective tissue growth factor. FEBS Lett. 327:125-130,1993.

Sugaya, K.; Fukagawa, T.; Matsumoto, K.; Mita, K.; Takahashi, E.; Ando, A.; Inoko, H.; Ikemura, T.: Three genes in the human MHC class III region near the junction with the class II: gene for receptor of advanced glycosylation end products, PBX2 homeobox gene and a Notch homolog, human counterpart of mouse mammary tumor gene int-3. Genomics 23:408-419, 1994.

Joliot, V.; Martinerie, C.; Dambrine, G.; Plassiart, G.; Brisac, M.; Crochet, J.; Perbal, B.: Proviral rearrangements and overexpression of a new cellular gene (nov) in myeloblastosis-associated virus type1-induced nephroblastomas. Molec. Cell. Biol. 12:10-21, 1992.

Kim, H.-S.; Nagalla, S. R.; Oh, Y.; Wilson, E.; Roberts, C. T., Jr.; Rosenfeld, R. G.: Identification of a family of low-affinity insulin-like growth factor binding proteins (IFGBPs): characterization of connective tissue growth factor as a member of the IGFBP superfamily. Proc. Nat. Acad. Sci. 94:12981-12986, 1997.

Martinerie, C.; Perbal, B.: Expression of a gene encoding a novel potential IGF binding protein in human tissues. C. R. Acad. Sci. (Paris) 313 (ser. 3):345-351, 1991.

Snaith, M. R.; Natarajan, D.; Taylor, L. B.; Choi, C.-P.; Martinerie, C.; Perbal, B.; Schofield, P. N.; Boulter, C. A.: Genomic structure and chromosomal mapping of the mouse nov gene. Genomics 38:425-428,1996.

Soret, J.; Dambrine, G.; Perbal, B.: Induction of nephroblastoma by myeloblastosis-associated virus type 1: state of proviral DNAs in tumor cells. J. Virol. 63:1803-1807, 1989.

Amson, R.; Sigaux, F.; Przedborski, S.; Flandrin, G.; Givol, D.; Telerman, A.: The human proto-oncogene product p33pim is expressed during fetal hematopoiesis and in diverse leukemias. Proc. Nat. Acad. Sci. 86:8857-8861, 1989.

Ark, B.; Gummere, G.; Bennett, D.; Artzt, K.: Mapping of the Pim-1oncogene in mouse t-haplotypes and its use to define the relative map positions of the tcl loci t-0(t-6) and t-w12 and the marker tf (tufted). Genomics 10:385-389, 1991.

Cuypers, H. T.; Selten, G.; Berns, A.; Geurts van Kessel, A. H. M.: Assignment of the human homologue of Pim-1, a mouse gene implicated in leukemogenesis, to the pter-q12 region of chromosome 6. Hum. Genet. 72:262-265, 1986.

Domen, J.; von Lindern, M.; Hermans, A.; Breuer, M.; Grosveld, G.; Berns, A.: Comparison of the human and mouse PIM-1 cDNAs: Nucleotide sequence and immunological identification of the in vitro synthesized PIM-1 protein. Oncogene Res. 1:103-112, 1987.

Ben Othmane, K.; Loeb, D.; Hayworth-Hodgte, R.; Hentati, F.; Rao, N.; Roses, A. D.; Ben Hamida, M.; Pericak-Vance, M. A.; Vance, J. M.: Physical and genetic mapping of the CMT4A locus and exclusion of PMP-2 as the defect in CMT4A. Genomics 28:286-290, 1995.

Hayasaka, K.; Himoro, M.; Takada, G.; Takahashi, E.; Minoshima, S.; Shimizu, N.: Structure and localization of the gene encoding human peripheral myelin protein 2 (PMP2). Genomics 18:244-248,1993.

Hayasaka, K.; Nanao, K.; Tahara, M.; Sato, W.; Takada, G.; Miura, M.; Uyemura, K.: Isolation and sequence determination of cDNA encoding P2 protein of human peripheral myelin. Biochem. Biophys. Res. Commun. 181:204-207, 1991.

Narayanan, V.; Ripepi, B.; Jabs, E. W.; Hawkins, A.; Griffin, C.; Tennekoon, G.: Partial structure and mapping of the human myelin P2 protein gene. J. Neurochem. 63:2010-2013, 1994.

Manser, E.; Loo, T.-H.; Koh, C.-G.; Zhao, Z.-S.; Chen, X.-Q.; Tan, L.; Tan, I.; Leung, T.; Lim, L.: PAK kinases are directly coupled to the PIX family of nucleotide exchange factors. Molec. Cell 1:183-192, 1998.

Nomura, N.; Miyajima, N.; Sazuka, T.; Tanaka, A.; Kawarabayashi, Y.; Sato, S.; Nagase, T.; Seki, N.; Ishikawa, K.; Tabata, S.: Prediction of the coding sequences of unidentified human genes. I. The coding sequences of 40 new genes (KIAA0001-KIAA0040) deduced by analysis of randomly sampled cDNA clones from human immature myeloid cell line, KG-1. DNA Res. 1:27-35, 1994.

Grozinger, C. M.; Hassig, C. A.; Schreiber, S. L.: Three proteins define a class of human histone deacetylases related to yeast Hda1p. Proc. Nat. Acad. Sci. 96:4868-4873, 1999.

Disteche, C. M.; Brannan, C. I.; Larsen, A.; Adler, D. A.; Schorderet, D. F.; Gearing, D.; Copeland, N. G.; Jenkins, N. A.; Park, L. S.: The human pseudoautosomal GM-CSF receptor alpha subunit gene is autosomal in mouse. Nature Genet. 1:333-336, 1992.

Sugarman, G. I.; Rimoin, D. L.; Lachman, R. S.: The facial-digital-genital (Aarskog) syndrome. Am. J. Dis. Child. 126:248-252, 1973.

Tsukahara, M.; Fernandez, G. I.: Umbilical findings in Aarskog syndrome. Clin. Genet. 45:260-265, 1994.

Tyrkus, M.; Bawle, E.; Lipman, S.; Bozimowski, D.; Woolley, P. V., Jr.: Aarskog-Scott syndrome inherited as an X-linked dominant with full male-female expression. (Abstract) Am. J. Hum. Genet. 32:134A only, 1980.

van den Bergh, P.; Fryns, J. P.; Wilms, G.; Piot, R.; Dralands, G.; van den Bergh, R.: Anomalous cerebral venous drainage in Aarskog syndrome. Clin. Genet. 25:288-294, 1984.

Zheng, Y.; Fischer, D. J.; Santos, M. F.; Tigyi, G.; Pasteris, N. G.; Gorski, J. L.; Xu, Y.: The faciogenital dysplasia gene product FGD1 functions as a Cdc42Hs-specific guanine-nucleotide exchange factor. J. Biol. Chem. 271:33169-33172, 1996.

Berra, B.; Gornati, R.; Rapelli, S.; Gatti, R.; Mancini, G. M. S.; Ciana, G.; Bembi, B.: Infantile sialic acid storage disease: biochemical studies. Am. J. Med. Genet. 58:24-31, 1995.

Cameron, P. D.; Dubowitz, V.; Besley, G. T. N.; Fensom, A. H.: Sialic acid storage disease. Arch. Dis. Child. 65:314-315, 1990.

Haataja, L.; Schleutker, J.; Laine, A.-P.; Renlund, M.; Savontaus, M.-L.; Dib, C.; Weissenbach, J.; Peltonen, L.; Aula, P.: The genetic locus for free sialic acid storage disease maps to the long arm of chromosome 6. Am. J. Hum. Genet. 54:1042-1049, 1994.

Fojo, A.; Lebo, R.; Shimizu, N.; Chin, J. E.; Roninson, I. B.; Merlino, G. T.; Gottesman, M. M.; Pastan, I.: Localization of multidrug resistance-associated DNA sequences to human chromosome 7. Somat. Cell Molec. Genet. 12:415-420, 1986.

Fojo, A. T.; Ueda, K.; Slamon, D. J.; Poplack, D. G.; Gottesman, M. M.; Pastan, I.: Expression of a multidrug-resistance gene in human tumors and tissues. Proc. Nat. Acad. Sci. 84:265-269, 1987.

Fujii, J.; Zarain-Herzberg, A.; Willard, H. F.; Tada, M.; MacLennan, D. H.: Structure of the rabbit phospholamban gene, cloning of the human cDNA, and assignment of the gene to human chromosome 6. J. Biol. Chem. 266:11669-11675, 1991.

McTiernan, C. F.; Frye, C. S.; Lemster, B. H.; Kinder, E. A.; Ogletree-Hughes, M. L.; Moravec, C. S.; Feldman, A. M.: The human phospholamban gene: structure and expression. J. Molec. Cell Cardiol. 31:679-692, 1999.

Otsu, K.; Fujii, J.; Periasamy, M.; Difilippantonio, M.; Uppender, M.; Ward, D. C.; MacLennan, D. H.: Chromosome mapping of five human cardiac and skeletal muscle sarcoplasmic reticulum protein genes. Genomics 17:507-509, 1993.

Barhanin, J.; Lesage, F.; Guillemare, E.; Fink, M.; Lazdunski, M.; Romey, G.: K(v)LQT1 and IsK (minK) proteins associate to form the I(Ks) cardiac potassium current. Nature 384:78-80, 1996.

Marx, S. O.; Kurokawa, J.; Reiken, S.; Motoike, H.; d'Armiento, J.; Marks, A. R.; Kass, R. S.: Requirement of a macromolecular signaling complex for beta adrenergic receptor modulation of the KCNQ1-KCNE1 potassium channel. Science 295:496-499, 2002.

Sanguinetti, M. C.; Curran, M. E.; Zou, A.; Shen, J.; Spector, P. S.; Atkinson, D. L.; Keating, M. T.: Coassembly of K(v)LQT1 and minK (IsK) proteins to form cardiac I(Ks) potassium channel. Nature 384:80-83, 1996.

Coleman, R. A.; Smith, W. L.; Narumiya, S.: VIII. International union of pharmacology classification of prostanoid receptors: properties, distribution, and structure of the receptors and their subtypes. Pharm. Rev. 46:205-229, 1994.

Duncan, A. M. V.; Anderson, L. L.; Funk, C. D.; Abramovitz, M.; Adam, M.: Chromosomal localization of the human prostanoid receptor gene family. Genomics 25:740-742, 1995.

White, D. M.; Mikol, D. D.; Espinosa, R.; Weimer, B.; Le Beau, M. M.; Stefansson, K.: Structure and chromosomal localization of the human gene for a brain form of prostaglandin D-2 synthase. J. Biol. Chem. 267:23202-23208, 1992.

Sales, K. J.; Katz, A. A.; Davis, M.; Hinz, S.; Soeters, R. P.; Hofmeyr, M. D.; Millar, R. P.; Jabbour, H. N.: Cyclooxygenase-2 expression and prostaglandin E2 synthesis are up-regulated in carcinomas of the cervix: a possible autocrine/paracrine regulation of neoplastic cell function via EP2/EP4 receptors. J. Clin. Endocr. Metab. 86:2243-2249,2001.

Smock, S. L.; Pan, L. C.; Castleberry, T. A.; Lu, B.; Mather, R. J.; Owen, T. A.: Cloning, structural characterization, and chromosomal localization of the gene encoding the human prostaglandin E2 receptor EP2 subtype. Gene 237:393-402, 1999.

Taketo, M.; Rochelle, J. M.; Sugimoto, Y.; Namba, T.; Honda, A.; Negishi, M.; Ichikawa, A.; Narumiya, S.; Seldin, M. F.: Mapping of the genes encoding mouse thromboxane A2 receptor and prostaglandin E receptor subtypes EP2 and EP3. Genomics 19:585-588, 1994.

Tilley, S. L.; Audoly, L. P.; Hicks, E. H.; Kim, H.-S.; Flannery, P. J.; Coffman, T. M.; Koller, B. H.: Reproductive failure and reduced blood pressure in mice lacking the EP2 prostaglandin E-2 receptor. J. Clin. Invest. 103:1539-1545, 1999.

Catella-Lawson, F.; Reilly, M. P.; Kapoor, S. C.; Cucchiara, A. J.; DeMarco, S.; Tournier, B.; Vyas, S. N.; FitzGerald, G. A.: Cyclooxygenase inhibitors and the antiplatelet effects of aspirin. New Eng. J. Med. 345:1809-1817, 2001.

Dube, J.-N.; Drouin, J.; Aminian, M.; Plant, M. H.; Laneuville, O.: Characterization of a partial prostaglandin endoperoxide H synthase-1 deficiency in a patient with a bleeding disorder. Brit. J. Haemat. 113:878-885, 2001.

Funk, C. D.; Funk, L. B.; Kennedy, M. E.; Pong, A. S.; Fitzgerald, G. A.: Human platelet/erythroleukemia cell prostaglandin G/H synthase: cDNA cloning, expression, and gene chromosomal assignment. FASEBJ. 5:2304-2312, 1991.

Gavett, S. H.; Madison, S. L.; Chulada, P. C.; Scarborough, P. E.; Qu, W.; Boyle, J. E.; Tiano, H. F.; Lee, C. A.; Langenbach, R.; Roggli, V. L.; Zeldin, D. C.: Allergic lung responses are increased in prostaglandin H synthase-deficient mice. J. Clin. Invest. 104:721-732, 1999.

Kirschenbaum, A.; Liotta, D. R.; Yao, S.; Liu, X.-H.; Klausner, A. P.; Unger, P.; Shapiro, E.; Leav, I.; Levine, A. C.: Immunohistochemical localization of cyclooxygenase-1 and cyclooxygenase-2 in the human fetal and adult male reproductive tracts. J. Clin. Endocr. Metab. 85:3436-3441, 2000.

Langenbach, R.; Morham, S. G.; Tiano, H. F.; Loftin, C. D.; Ghanayem, B. I.; Chulada, P. C.; Mahler, J. F.; Lee, C. A.; Goulding, E. H.; Kluckman, K. D.; Kim, H. S.; Smithies, O.: Prostaglandin synthase1 gene disruption in mice reduces arachidonic acid-induced inflammation and indomethacin-induced gastric ulceration. Cell 83:483-492, 1995.

Malkowski, M. G.; Ginell, S. L.; Smith, W. L.; Garavito, R. M.: The productive conformation of arachidonic acid bound to prostaglandin synthase. Science 289:1933-1937, 2000.

Pareti, F. I.; Manucci, P. M.; d'Angelo, A.; Smith, J. B.; Sautebin, L.; Galli, G.: Congenital deficiency of thromboxane and prostacyclin. Lancet I:898-900, 1980.

Picot, D.; Loll, P. J.; Garavito, R. M.: The x-ray crystal structure of the membrane protein prostaglandin H-2 synthase-1. Nature 367:243-249, 1994.

Niswender, K. D.; Morton, G. J.; Stearns, W. H.; Rhodes, C. J.; Myers, M. G., Jr.; Schwartz, M. W.: Key enzyme in leptin-induced anorexia. Nature 413:794-795, 2001.

Shimomura, I.; Matsuda, M.; Hammer, R. E.; Bashmakov, Y.; Brown, M. S.; Goldstein, J. L.: Decreased IRS-2 and increased SREBP-1c lead to mixed insulin resistance and sensitivity in livers of lipodystrophic and ob/ob mice. Molec. Cell 6:77-86, 2000.

Siracusa, L. D.; Rosner, M. H.; Vigano, M. A.; Gilbert, D. J.; Staudt, L. M.; Copeland, N. G.; Jenkins, N. A.: Chromosomal location of the octamer transcription factors, Otf-1, Otf-2, and Otf-3, defines multiple Otf-3-related sequences dispersed in the mouse genome. Genomics 10:313-326, 1991.

Sturm, R. A.; Eyre, H. J.; Baker, E.; Sutherland, G. R.: The human OTF1 locus which overlaps the CD3Z gene is located at 1q22-q23. Cytogenet. Cell Genet. 68:231-232, 1995.

Marshall, J. B.; Diaz-Arias, A. A.; Bochna, G. S.; Vogele, K. A.: Achalasia due to diffuse esophageal leiomyomatosis and inherited as an autosomal dominant disorder. Gastroenterology 98:1358-1365, 1990.

Mattei, M. G.; d'Auriol, L.; Andre, C.; Passage, E.; Mattei, J. F.; Galibert, F.: Assignment of the human c-kit proto-oncogene to the q11-q12 region of chromosome 4, using in situ hybridization. (Abstract) Cytogenet. Cell Genet. 46:657, 1987.

Nagata, H.; Worobec, A. S.; Oh, C. K.; Chowdhury, B. A.; Tannenbaum, S.; Suzuki, Y.; Metcalfe, D. D.: Identification of a point mutation in the catalytic domain of the proto-oncogene c-kit in peripheral blood mononuclear cells of patients who have mastocytosis with an associated hematologic disorder. Proc. Nat. Acad. Sci. 92:10560-10564, 1995.

Nishida, T.; Hirota, S.; Taniguchi, M.; Hashimoto, K.; Isozaki, K.; Nakamura, H.; Kanakura, Y.; Tanaka, T.; Takabayashi, A.; Matsuda, H.; Kitamura, Y.: Familial gastrointestinal stromal tumours with germline mutation of the KIT gene. (Letter) Nature Genet. 19:323-324, 1998.

Nocka, K.; Tan, J. C.; Chiu, E.; Chu, T. Y.; Ray, P.; Traktman, P.; Besmer, P.: Molecular bases of dominant negative and loss of function mutations at the murine c-kit/white spotting locus: W-37, W-v, W-41 and W. EMBO J. 9:1805-1813, 1990.

Nomura, K.; Hatayama, I.; Narita, T.; Kaneko, T.; Shiraishi, M.: A novel KIT gene missense mutation in a Japanese family with piebaldism. (Letter) J. Invest. Derm. 111:337-338, 1998.

Pignon, J.-M.; Giraudier, S.; Duquesnoy, P.; Jouault, H.; Imbert, M.; Vainchenker, W.; Vernant, J.-P.; Tulliez, M.: A new c-kit mutation in a case of aggressive mast cell disease. Brit. J. Haemat. 96:374-376, 1997.

Selmanowitz, V. J.; Rabinowitz, A. D.; Orentreich, N.; Wenk, E.: Pigmentary correction of piebaldism by autografts. I. Procedures and clinical findings. J. Derm. Surg. Oncol. 3:615-622, 1977.

Reinsch, N.; Thomsen, H.; Xu, N.; Brink, M.; Looft, C.; Kalm, E.; Brockmann, G. A.; Grupe, S.; Kuhn, C.; Schwerin, M.; Leyhe, B.; Hiendleder, S.; Erhardt, G.; Medjugorac, I.; Russ, I.; Forster, M.; Reents, R.; Averdunk, G.: A QTL for the degree of spotting in cattleshows synteny with the KIT locus on chromosome 6. J. Hered. 90:629-634, 1999.

Spritz, R. A.; Beighton, P.: Piebaldism with deafness: molecular evidence for an expanded syndrome. Am. J. Med. Genet. 75:101-103, 1998.

Spritz, R. A.; Droetto, S.; Fukushima, Y.: Deletion of the KIT and PDGFRA genes in a patient with piebaldism. Am. J. Med. Genet. 44:492-495, 1992.

Spritz, R. A.; Giebel, L. B.: Mutation of the c-kit (mast/stem cell growth factor receptor) proto-oncogene in human piebaldism. (Abstract) Am. J. Hum. Genet. 49 (suppl.):38, 1991.

Spritz, R. A.; Giebel, L. B.; Holmes, S. A.: Dominant negative and loss of function mutations of the c-kit (mast/stem cell growth factor receptor) proto-oncogene in human piebaldism. Am. J. Hum. Genet. 50:261-269, 1992.

Spritz, R. A.; Holmes, S. A.; Ramesar, R.; Greenberg, J.; Curtis, D.; Beighton, P.: Mutations of the KIT (mast/stem cell growth factor receptor) proto-oncogene account for a continuous range of phenotypes in human piebaldism. Am. J. Hum. Genet. 51:1058-1065, 1992.

Syrris, P.; Malik, N. M.; Murday, V. A.; Patton, M. A.; Carter, N. D.; Hughes, H. E.; Metcalfe, K.: Three novel mutations of the proto-oncogene KIT cause human piebaldism. (Letter) Am. J. Med. Genet. 95:79-81, 2000.

Tan, J. C.; Nocka, K.; Ray, P.; Traktman, P.; Besmer, P.: The dominant W42 spotting phenotype results from a missense mutation in the c-kit receptor kinase. Science 247:209-212, 1990.

Taylor, M. L.; Dastych, J.; Sehgal, D.; Sundstrom, M.; Nilsson, G.; Akin, C.; Mage, R. G.; Metcalfe, D. D.: The Kit-activating mutation D816V enhances stem cell factor-dependent chemotaxis. Blood 98:1195-1199, 2001.

Thomsen, L.; Robinson, T. L.; Lee, J. C. F.; Farraway, L. A.; Hughes, M. J. G.; Andrews, D. W.; Huizinga, J. D.: Interstitial cells of Cajal generate a rhythmic pacemaker current. Nature Med. 4:848-851,1998.

Tian, Q.; Frierson, H. F., Jr.; Krystal, G. W.; Moskaluk, C. A.: Activating c-kit gene mutations in human germ cell tumors. Am. J. Path. 154:1643-1647, 1999.

Tsujimura, T.; Furitsu, T.; Morimoto, M.; Isozaki, K.; Nomura, S.; Matsuzawa, Y.; Kitamura, Y.; Kanakura, Y.: Ligand-independent activation of c-kit receptor tyrosine kinase in a murine mastocytoma cell line P-815 generated by a point mutation. Blood 83:2619-2626,1994.

Vandenbark, G. R.; deCastro, C. M.; Taylor, H.; Dew-Knight, S.; Kaufman, R. E.: Cloning and structural analysis of the human c-kit gene. Oncogene 7:1259-1266, 1992.

Worobec, A. S.; Semere, T.; Nagata, H.; Metcalfe, D. D.: Clinical correlates of the presence of the asp816val c-kit mutation in the peripheral blood mononuclear cells of patients with mastocytosis. Cancer 83:2120-2129, 1998.

Yarden, Y.; Kuang, W.-J.; Yang-Feng, T.; Coussens, L.; Munemitsu, S.; Dull, T. J.; Chen, E.; Schlessinger, J.; Francke, U.; Ullrich, A.: Human proto-oncogene c-kit: a new cell surface receptor tyrosine kinase for an unidentified ligand. EMBO J. 6:3341-3351, 1987.

Cheah, M. S. C.; Ley, T. J.; Tronick, S. R.; Robbins, K. C.: Fgr proto-oncogene mRNA induced in B lymphocytes by Epstein-Barr virus infection. Nature 319:238-240, 1986.

Dracopoli, N. C.; Stanger, B. Z.; Lager, M.; Housman, D. E.: Localization of the FGR proto-oncogene on the genetic linkage map of human chromosome 1p. Genomics 3:124-128, 1988.

Le Beau, M. M.; Westbrook, C. A.; Diaz, M. O.; Rowley, J. D.: Evidence for two distinct c-src loci on human chromosomes 1 and 20. Nature 312:70-71, 1984.

Lebo, R. V.; Cheung, M.-C.; Bruce, B. D.: Rapid gene mapping by dual laser chromosome sorting and spot blot DNA analysis. (Abstract) Am. J. Hum. Genet. 36:101S, 1984.

Nishizawa, M.; Semba, K.;Yoshida, M. C.;Yamamoto, T.; Sasaki, M.; Toyoshima, K.: Structure, expression, and chromosomal location of the human c-fgr gene. Molec. Cell. Biol. 6:511-517, 1986.

Muyan, M.; Furuhashi, M.; Sugahara, T.; Boime, I.: The carboxy-terminal region of the beta-subunits of luteinizing hormone and chorionic gonadotropin differentially influence secretion and assembly of the heterodimers. Molec. Endocr. 10:1678-1687, 1996.

Tsujii, M.; Kawano, S.; Tsuji, S.; Sawaoka, H.; Hori, M.; DuBois, R. N.: Cyclooxygenase regulates angiogenesis induced by colon cancer cells. Cell 93:705-716, 1998.

Vane, J. R.; Mitchell, J. A.; Appleton, I.; Tomlinson, A.; Bishop-Bailey, D.; Croxtall, J.; Willoughby, D. A.: Inducible isoforms of cyclooxygenase and nitric-oxide synthase in inflammation. Proc. Nat. Acad. Sci. 91:2046-2050, 1994.

Yokoyama, C.; Tanabe, T.: Cloning of human gene encoding prostaglandin endoperoxide synthase and primary structure of the enzyme. Biochem. Biophys. Res. Commun. 165: 888-894, 1989.

Kaplan, R.; Morse, B.; Huebner, K.; Croce, C.; Howk, R.; Ravera, M.; Ricca, G.; Jaye, M.; Schlessinger, J.: Cloning of three human tyrosine phosphatases reveals a multigene family of receptor-linked protein-tyrosine-phosphatases expressed in brain. Proc. Nat. Acad. Sci. 87:7000-7004, 1990.

Jirik, F. R.; Anderson, L. L.; Duncan, A. M. V.: The human protein-tyrosine phosphatase PTP-alpha/LRP gene (PTPA) is assigned to chromosome 20p13. Cytogenet. Cell Genet. 60:117-118, 1992.

Jirik, F. R.; Janzen, N. M.; Melhado, I. G.; Harder, K. W.: Cloning and chromosomal assignment of a widely expressed human receptor-like protein-tyrosine phosphatase. FEBS Lett. 273:239-242, 1990.

Matthews, R. J.; Cahir, E. D.; Thomas, M. L.: Identification of an additional member of the protein-tyrosine-phosphatase family: evidence for alternative splicing in the tyrosine phosphatase domain. Proc. Nat. Acad. Sci. 87:4444-4448, 1990.

Rao, V. V. N. G.; Loffler, C.; Sap, J.; Schlessinger, J.; Hansmann, I.: The gene for receptor-linked protein-tyrosine-phosphatase (PTPA) is assigned to human chromosome 20p12-pter by in situ hybridization (ISH and FISH). Genomics 13:906-907, 1992.

Schnittger, S.; Rao, V. V. N. G.; Deutsch, U.; Gruss, P.; Balling, R.; Hansmann, I.: PAX1, a member of the paired box-containing class of developmental control genes, is mapped to human chromosome 20p11.2by in situ hybridization (ISH and FISH). Genomics 14:740-744, 1992.

Ahmad, F.; Azevedo, J. L., Jr.; Cortright, R.; Dohm, G. L.; Goldstein, B. J.: Alternations in skeletal muscle protein-tyrosine phosphatase activity and expression in insulin-resistant human obesity and diabetes. J. Clin. Invest. 100:449-458, 1997.

Brown-Shimer, S.; Johnson, K. A.; Lawrence, J. B.; Johnson, C.; Bruskin, A.; Green, N. R.; Hill, D. E.: Molecular cloning and chromosome mapping of the human gene encoding protein phosphotyrosyl phosphatase1B. Proc. Nat. Acad. Sci. 87:5148-5152, 1990.

Charbonneau, H.; Tonks, N. K.; Kumar, S.; Diltz, C. D.; Harrylock, M.; Cool, D. E.; Krebs, E. G.; Fischer, E. H.; Walsh, K. A.: human placenta protein-tyrosine-phosphatase: amino acid sequence and relationship to a family of receptor-like proteins. Proc. Nat. Acad. Sci. 86:5252-5256, 1989.

Chernoff, J.; Schievella, A. R.; Jost, C. A.; Erikson, R. L.; Neel, B. G.: Cloning of a cDNA for a major human protein-tyrosine-phosphatase. Proc. Nat. Acad. Sci. 87:2735-2739, 1990.

Cazzaniga, G.; Tosi, S.; Aloisi, A.; Giudici, G.; Daniotti, M.; Pioltelli, P.; Kearney, L.; Biondi, A.: The tyrosine kinase Abl-related gene ARG is fused to ETV6 in an AML-M4Eo patient with a t (1;12)(q25; p13):molecular cloning of both reciprocal transcripts. Blood 94:4370-4373,1999.

Iijima, Y.; Ito, T.; Oikawa, T.; Eguchi, M.; Eguchi-Ishimae, M.; Kamada, N.; Kishi, K.; Asano, S.; Sakaki, Y.; Sato, Y.: A new ETV6/TEL partner gene, ARG (ABL-related gene or ABL2), identified in an AML-M3cell line with a t (1;12)(q25; p13) translocation. Blood 95:2126-2131,2000.

Mastick, C. C.; Brady, M. J.; Saltiel, A. R.: Insulin stimulates the tyrosine phosphorylation of caveolin. J. Cell Biol. 129:1523-1531,1995.

Soubeyran, P.; Kowanetz, K.; Szymkiewicz, I.; Langdon, W. Y.; Dikic, I.: Cbl-CIN85-endophilin complex mediates ligand-induced down regulation of EGF receptors. Nature 416:183-187, 2002.

Cannizzaro, L. A.; Madaule, P.; Hecht, F.; Axel, R.; Croce, C. M.; Huebner, K.: Chromosome localization of human ARH genes, a ras-related gene family. Genomics 6:197-203, 1990.

Chardin, P.; Madaule, P.; Tavitian, A.: Coding sequence of human Rho cDNAs clone 6 and clone 9. Nucleic Acid Res. 16:2717 only,1988.

Madaule, P.; Axel, R.: A novel ras-related gene family. Cell 41:31-40, 1985.

Maekawa, M.; Ishizaki, T.; Boku, S.; Watanabe, N.; Fujita, A.; Iwamatsu, A.; Obinata, T.; Ohashi, K.; Mizuno, K.; Narumiya, S.: Signaling from Rho to the actin cytoskeleton through protein kinases ROCK and LIM-kinase. Science 285: 895-898, 1999.

Ridley, A. J.; Hall, A.: The small GTP-binding protein rho regulates the assembly of focal adhesions and actin stress fibers in response to growth factors. Cell 70:389-399, 1992.

Fagan, K. P.; Oliveira, L.; Pittler, S. J.: Sequence of rho small GTP-binding protein cDNAs from human retina and identification of novel 5-prime end cloning artifacts. Exp. Eye Res. 59:235-237,1994.

Morris, S. W.; Valentine, M. B.; Kirstein, M. N.; Huebner, K.: Reassignment of the human ARH9 RAS-related gene to chromosome 1p13-p21. Genomics 15:677-679, 1993.

Maesaki, R.; Ihara, K.; Shimizu, T.; Kuroda, S.; Kaibuchi, K.; Hakoshima, T.: The structural basis of Rho effector recognition revealed by the crystal structure of human RhoA complexed with the effector domain of PKN/PRK1. Molec. Cell 4:793-803, 1999.

Nakamura, M.; Nagano, T.; Chikama, T.; Nishida, T.: Role of the small GTP-binding protein Rho in epithelial cell migration in the rabbit cornea. Invest. Ophthal. Vis. Sci. 42:941-947, 2001.

Rao, P. V.; Deng, P.-F.; Kumar, J.; Epstein, D. L.: Modulation of aqueous humor outflow facility by the Rho kinase-specific inhibitor Y-27632. Invest. Ophthal. Vis. Sci. 42:1029-1037, 2001.

Bartoli, C.; Gharib, B.; Giorgi, D.; Sansonetti, A.; Dagorn, J.-C.; Berge-Lefranc, J.-L.: A gene homologous to the reg gene is expressed in human pancreas. FEBS Lett. 327:289-293, 1993.

Gharib, B.; Fox, M. F.; Bartoli, C.; Giorgi, D.; Sansonetti, A.; Swallow, D. M.; Dagorn, J. C.; Berge-Lefranc, J. L.: Human regeneration protein/lithostathine genes map to chromosome 2p12. Ann. Hum. Genet. 57:9-16, 1993.

Giorgi, D.; Bernard, J.-P.; Rouquier, S.; Iovanna, J.; Sarles, H.; Dagorn, J.-C.: Secretory pancreatic stone protein messenger RNA: nucleotide sequence and expression in chronic calcifying pancreatitis. J. Clin. Invest. 84:100-106, 1989.

Miyashita, H.; Nakagawara, K.; Mori, M.; Narushima, Y.; Noguchi, N.; Moriizumi, S.; Takasawa, S.; Yonekura, H.; Takeuchi, T.; Okamoto, H.: Human REG family genes are tandemly ordered in a 95-kilobase region of chromosome 2p12. FEBS Lett. 377:429-433, 1995.

Akiyama, T.; Takasawa, S.; Nata, K.; Kobayashi, S.; Abe, M.; Shervani, N. J.; Ikeda, T.; Nakagawa, K.; Unno, M.; Matsuno, S.; Okamoto, H.: Activation of Reg gene, a gene for insulin-producing beta-cell regeneration: poly (ADP-ribose) polymerase binds Reg promoter and regulates the transcription by autopoly (ADP-ribosyl)ation. Proc. Nat. Acad. Sci. 98:48-53,2001.

Perfetti, R.; Hawkins, A. L.; Griffin, C. A.; Egan, J. M.; Zenilman, M. E.; Shuldiner, A. R.: Assignment of the human pancreatic regenerating (REG) gene to chromosome 2p12. Genomics 20:305-307, 1994.

Sarles, H.; Dagorn, J. C.; Giorgi, D.; Bernard, J. P.: Renaming pancreatic stone protein as 'lithostathine'. (Letter) Gastroenterology 99:900-901, 1990.

Stewart, T. A.: The human REG gene encodes pancreatic stone protein. (Letter) Biochem. J. 260:622-623, 1989.

Terazono, K.; Yamamoto, H.; Takasawa, S.; Shiga, K.; Yonemura, Y.; Tochino, Y.; Okamoto, H.: A novel gene activated in regenerating islets. J. Biol. Chem. 263:2111-2114, 1988.

Unno, M.; Yonekura, H.; Nakagawara, K.; Watanabe, T.; Miyashita, H.; Moriizumi, S.; Okamoto, H.: Structure, chromosomal localization, and expression of mouse reg genes, reg I and reg II: a novel type of reg gene, reg II, exists in the mouse genome. J. Biol. Chem. 268:15974-15982, 1993.

Verdier, J. M.; Dussol, B.; Casanova, P.; Daudon, M.; Dupuy, P.; Berthezene, P.; Boistelle, R.; Berland, Y.; Dagorn, J. C.: Evidence that human kidney produces a protein similar to lithostathine, the pancreatic inhibitor of CaCO(3) crystal growth. Europ. J. Clin. Invest. 22:469-474, 1992.

Moriizumi, S.; Watanabe, T.; Unno, M.; Nakagawara, K.; Suzuki, Y.; Miyashita, H.; Yonekura, H.; Okamoto, H.: Isolation, structural determination and expression of a novel reg gene, human reg I-beta. Biochim. Biophys. Acta 1217:199-202, 1994.

Philipson, L. H.; Hice, R. E.; Schaefer, K.; LaMendola, J.; Bell, G. I.; Neldon, D. J.; Steiner, D. F.: Sequence and functional expression in Xenopus oocytes of a human insulinoma and islet potassium channel. Proc. Nat. Acad. Sci. 88:53-57, 1991.

Ghanshani, S.; Pak, M.; McPherson, J. D.; Strong, M.; Dethlefs, B.; Wasmuth, J. J.; Salkoff, L.; Gutman, G. A.; Chandy, K. G.: Genomic organization, nucleotide sequence, and cellular distribution of a Shaw-related potassium channel gene, Kv3.3, and mapping of Kv3.3 and Kv3.4 to human chromosomes 19 and 1. Genomics 12:190-196, 1992.

McPherson, J. D.; Wasmuth, J. J.; Chandy, K. G.; Swanson, R.; Dethlefs, B.; Chandy, G.; Wymore, R.; Ghanshani, S.: Chromosomal localization of 7 potassium channel genes. (Abstract) Cytogenet. Cell Genet. 58:1979 only, 1991.

Chen, K.; Yang, W.; Grimsby, J.; Shih, J. C.: The human 5-HT2receptor is encoded by a multiple intron-exon gene. Brain Res. Molec. Brain Res. 14:20-26, 1992.

Holmes, C.; Arranz, M. J.; Powell, J. F.; Collier, D. A.; Lovestone, S.:5-HT-2A and 5-HT-2C receptor polymorphisms and psychopathology in late onset Alzheimer's disease. Hum. Molec. Genet. 7:1507-1509,1998.

Hsieh, C.-L.; Bowcock, A. M.; Farrer, L. A.; Hebert, J. M.; Huang, K. N.; Cavalli-Sforza, L. L.; Julius, D.; Francke, U.: The serotonin receptor subtype 2 locus HTR2 is on human chromosome 13 near genes for esterase D and retinoblastoma-1 and on mouse chromosome 14. Somat. Cell Molec. Genet. 16:567-574, 1990.

Kato, M. V.; Shimizu, T.; Nagayoshi, M.; Kaneko, A.; Sasaki, M. S.; Ikawa, Y.: Genomic imprinting of the human serotonin-receptor (HTR2) gene involved in development of retinoblastoma. Am. J. Hum. Genet. 59:1084-1090, 1996.

Liu, J.; Chen, Y.; Kozak, C. A.; Yu, L.: The 5-HT(2) serotonin receptor gene Htr-2 is tightly linked to Es-10 on mouse chromosome 14. Genomics 11:231-234, 1991.

Peroutka, S. J.:5-Hydroxytryptamine receptor subtypes. Ann. Rev. Neurosci. 11:45-60, 1988.

Sparkes, R. S.; Lan, N.; Klisak, I.; Mohandas, T.; Diep, A.; Kojis, T.; Heinzmann, C.; Shih, J. C.: Assignment of a serotonin 5HT-2 receptor gene (HTR2) to human chromosome 13q14-q21 and mouse chromosome 14. Genomics 9:461-465, 1991.

Williams, J.; McGuffin, P.; Nothen, M.; Owen, M. J.; EMASS Collaborative Group: Meta-analysis of association between the 5-HT (2A) receptor T102C polymorphism and schizophrenia. (Letter) Lancet 349:1221only, 1997.

Williams, J.; Spurlock, G.; McGuffin, P.; Mallet, J.; Nothen, M. M.; Gill, M.; Aschauer, H.; Nylander, P. O.; Macciardi, F.; Owen, M. J.: Association between schizophrenia and T102C polymorphism of the 5-hydroxytryptophan type 2a-receptor gene. European Multicentre Association Study of Schizophrenia (EMASS) Group. Lancet 347:1294-1296,1996.

Tamkun, M. M.; Knoth, K. M.; Walbridge, J. A.; Kroemer, H.; Roden, D. M.; Glover, D. M.: Molecular cloning and characterization of two voltage-gated K+ channel cDNAs from human ventricle. FASEB J. 5:331-337, 1991.

Phromchotikul, T.; Browne, D. L.; Curran, M. E.; Keating, M. T.; Litt, M.: Dinucleotide repeat polymorphism at the KCNA5 locus. Hum. Molec. Genet. 2:1512 only, 1993.

Bardien-Kruger, S.; Wulff, H.; Arieff, Z.; Brink, P.; Chandy, K. G.; Corfield, V.: Characterisation of the human voltage-gated potassium channel gene, KCNA7, a candidate gene for inherited cardiac disorders, and its exclusion as cause of progressive familial heart block I (PFHBI). Europ. J. Hum. Genet. 10:36-43, 2002.

Barton, J. W.; Hart, I. M.; Patterson, D.: Mapping of a locus correcting lack of phosphoribosylaminoimidazole carboxylase activity in Chinese hamster ovary cell Ade (-)D mutants to human chromosome 4. Genomics 9:314-321, 1991.

Brayton, K. A.; Chen, Z.; Zhou, G.; Nagy, P. L.; Gavalas, A.; Trent, J. M.; Deaven, L. L.; Dixon, J. E.; Zalkin, H.: Two genes for de novo purine nucleotide synthesis on human chromosome 4 are closely linked and divergently transcribed. J. Biol. Chem. 269:5313-5321,1994.

Torban, E.; Pelletier, J.; Goodyer, P.: F329L polymorphism in the human PAX8 gene. Am. J. Med. Genet. 72:186-187, 1997.

Gartner, J.; Kearns, W.; Pearson, P.; Valle, D.: Characterization and localization of the human 70-kD peroxisomal membrane protein (PMP70) gene. (Abstract) Am. J. Hum. Genet. 51 (suppl.): A168, 1992.

Gartner, J.; Kearns, W.; Rosenberg, C.; Pearson, P.; Copeland, N. G.; Gilbert, D. J.; Jenkins, N. A.; Valle, D.: Localization of the 70-kDa peroxisomal membrane protein to human 1p21-p22 and mouse Genomics 15:412-414, 1993.3. Gartner, J.; Moser, H.; Valle, D.: Mutations in the 70K peroxisomal membrane protein gene in Zellweger syndrome. Nature Genet. 1:16-23, 1992.

Vilain, C.; Rydlewski, C.; Duprez, L.; Heinrichs, C.; Abramowicz, M.; Malvaux, P.; Renneboog, B.; Parma, J.; Costagliola, S.; Vassart, G.: Autosomal dominant transmission of congenital thyroid hypoplasia due to loss-of-function mutation of PAX8. J. Clin. Endocr. Metab. 86:234-238, 2001.

Walther, C.; Guenet, J.-L.; Simon, D.; Deutsch, U.; Jostes, B.; Goulding, M.; Plachov, D.; Balling, R.; Gruss, P.: Pax: a murine multigene family of paired box-containing genes. Genomics 11:424-434,1991.

Das, P.; Stockton, D. W.; Bauer, C.; Shaffer, L. G.; D'Souza, R. N.; Wright, J. T.; Patel, P. I.: Haploinsufficiency of PAX9 is associated with autosomal dominant hypodontia. Hum. Genet. 110:371-376, 2002.

Nieminen, P.; Arte, S.; Tanner, D.; Paulin, L.; Alaluusua, S.; Thesleff, I.; Pirinen, S.: Identification of a nonsense mutation in the PAX9 gene in molar oligodontia. Europ. J. Hum. Genet. 9:743-746, 2001.

Peters, H.; Neubuser, A.; Kratochwil, K.; Balling, R.: Pax9-deficient mice lack pharyngeal pouch derivatives and teeth and exhibit craniofacial and limb abnormalities. Genes Dev. 12:2735-2747, 1998.

Santagati, F.; Gerber, J.-K.; Blusch, J. H.; Kokubu, C.; Peters, H.; Adamski, J.; Werner, T.; Balling, R.; Imai, K.: Comparative analysis of the genomic organization of Pax9 and its conserved physical association with Nkx2-9 in the human, mouse, and pufferfish genomes. Mammalian Genome 12:232-237, 2001.

Stockton, D. W.; Das, P.; Goldenberg, M.; D'Souza, R. N.; Patel, P. I.: Mutation of PAX9 is associated with oligodontia. (Letter) Nature Genet. 24:18-19, 2000.

Wallin, J.; Mizutani, Y.; Imai, K.; Miyashita, N.; Moriwaki, K.; Taniguchi, M.; Koseki, H.; Balling, R.: A new Pax gene, Pax-9, maps to mouse chromosome 12. Mammalian Genome 4:354-358, 1993.

Grueneberg, D. A.; Natesan, S.; Alexandre, C.; Gilman, M. Z.: Human and Drosophila homeodomain proteins that enhance the DNA-binding activity of serum response factor. Science 257:1089-1095, 1992.

Kern, M. J.; Argao, E. A.; Birkenmeier, E. H.; Rowe, L. B.; Potter, S. S.: Genomic organization and chromosome localization of the murine homeobox gene Pmx. Genomics 19:334-340, 1994.

Nakamura, T.; Yamazaki, Y.; Hatano, Y.; Miura, I.: NUP98 is fused to PMX1 homeobox gene in human acute myelogenous leukemia with chromosome translocation t (1;11)(q23;p15). Blood 94:741-747, 1999.

Norris, R. A.; Scott, K. K.; Moore, C. S.; Stetten, G.; Brown, C. R.; Jabs, E. W.; Wulfsberg, E. A.; Yu, J.; Kern, M. J.: human PRRX1 and PRRX2 genes: cloning, expression, genomic localization, and exclusion as disease genes for Nager syndrome. Mammalian Genome 11:1000-1005, 2000.

Riazuddin, S.; Castelein, C. M.; Ahmed, Z. M.; Lalwani, A. K.; Mastroianni, M. A.; Naz, S.; Smith, T. N.; Liburd, N. A.; Friedman, T. B.; Griffith, A. J.; Riazuddin, S.; Wilcox, E. R.: Dominant modifier DFNM1 suppresses recessive deafness DFNB26. Nature Genet. 26:431-434,2000.

Stohl, W.; Crow, M. K.; Kunkel, H. G.: Systemic lupus erythematosus with deficiency of the T4 epitope on T helper/inducer cells. New Eng. J. Med. 312:1671-1678, 1985.

Theofilopoulos, A. N.; Dixon, F. J.: Murine models of systemic lupus erythematosus. Adv. Immun. 37:269-390, 1985.

Friedl, W.; Uhlhaas, S.; Schulmann, K.; Stolte, M.; Loff, S.; Back, W.; Mangold, E.; Stern, M.; Knaebel, H. P.; Sutter, C.; Weber, R. G.; Pistorius, S.; Burger, B.; Propping, P.: Juvenile polyposis: massive gastric polyposis is more common in MADH4 mutation carriers than in BMPR1A mutation carriers. Hum. Genet. 111:108-111, 2002.

Howe, J. R.; Ringold, J. C.; Summers, R. W.; Mitros, F. A.; Nishimura, D. Y.; Stone, E. M.: A gene for familial juvenile polyposis maps to chromosome 18q21.1. Am. J. Hum. Genet. 62:1129-1136, 1998.

Howe, J. R.; Roth, S.; Ringold, J. C.; Summers, R. W.; Jarvinen, H. J.; Sistonen, P.; Tomlinson, I. P. M.; Houlston, R. S.; Bevan, S.; Mitros, F. A.; Stone, E. M.; Aaltonen, L. A.: Mutations in the SMAD4/DPC4 gene in juvenile polyposis. Science 280:1086-1088, 1998.

Houlston, R.; Bevan, S.; Williams, A.; Young, J.; Dunlop, M.; Rozen, P.; Eng, C.; Markie, D.; Woodford-Richens, K.; Rodriguez-Bigas, M. A.; Leggett, B.; Neale, K.; Phillips, R.; Sheridan, E.; Hodgson, S.; Iwama, T.; Eccles, D.; Bodmer, W.; Tomlinson, I.: Mutations in DPC4(SMAD4) cause juvenile polyposis syndrome, but only account for a minority of cases. Hum. Molec. Genet. 7:1907-1912, 1998.

Berry, C.; Cree, J.; Mann, T.: Aarskog's syndrome. Arch. Dis. Child. 55:706-710, 1980.

Escobar, V.; Weaver, D. D.: Aarskog syndrome: new findings and genetic analysis. J. A. M. A. 240:2638-2641, 1978.

Hanley, W. B.; McKusick, V. A.; Barranco, F. T.: Osteochondritis dissecans and associated malformations in brothers: a review of familial aspects. J. Bone Joint Surg. 49A:925-937, 1967.

Nagase, T.; Seki, N.; Tanaka, A.; Ishikawa, K.; Nomura, N.: Prediction of the coding sequences of unidentified human genes. IV. The coding sequences of 40 new genes (KIAA0121-KIAA0160) deduced by analysis of cDNA clones from human cell line KG-1. DNA Res. 2:167-174, 1995.

Parrish, J. E.; Ciccodicola, A.; Wehnert, M.; Cox, G. F.; Chen, E.; Nelson, D. L.: A muscle-specific DNase I-like gene in human Xq28. Hum. Molec. Genet. 4:1557-1564, 1995.

Pergolizzi, R.; Appierto, V.; Bosetti, A.; DeBellis, G. L.; Rovida, E.; Biunno, I.: Cloning of a gene encoding a DNase I-like endonuclease in the human Xq28 region. Gene 168: 267-270, 1996.

Klink, A.; Schiebel, K.; Winkelmann, M.; Rao, E.; Horsthemke, B.; Ludecke, H.-J.; Claussen, U.; Scherer, G.; Rappold, G.: The human protein kinase gene PKX1 on Xp22.3 displays Xp/Yp homology and is a site of chromosomal instability. Hum. Molec. Genet. 4:869-878,1995.

Schiebel, K.; Mertz, A.; Winkelmann, B.; Glaser, B.; Schempp, W.; Rappold, G.: FISH localization of the human Y-homolog of protein kinase PRKX (PRKY) to Yp11.2 and two pseudogenes to 15q26 and Xq12-q13. Cytogenet. Cell Genet. 76:49-52, 1997.

Brown, C. J.; Carrel, L.; Willard, H. F.: Expression of genes from the human active and inactive X chromosomes. Am. J. Hum. Genet. 60:1333-1343, 1997.

Dong, B.; Horowitz, D. S.; Kobayashi, R.; Krainer, A. R.: Purification and cDNA cloning of HeLa cell p54(nrb), a nuclear protein with two RNA recognition motifs and extensive homology to human splicing factor PSF and Drosophila NONA/BJ6. Nucleic Acids Res. 21:4085-4092, 1993.

Nelson, D. L.; Ballabio, A.; Cremers, F.; Monaco, A. P.; Schlessinger, D.: Report of the sixth international workshop on X chromosome mapping 1995. Cytogenet. Cell Genet. 71:308-342, 1995.

Janssens, R.; Boeynaems, J.-M.; Godart, M.; Communi, D.: Cloning of a human heptahelical receptor closely related to the P2Y(5) receptor. Biochem. Biophys. Res. Commun. 236:106-112, 1997.

O'Dowd, B. F.; Nguyen, T.; Jung, B. P.; Marchese, A.; Cheng, R.; Heng, H. H. Q.; Kolakowski, L. F., Jr.; Lynch, K. R.; George, S. R.: Cloning and chromosomal mapping of four putative novel human G-protein-coupled receptor genes. Gene 187:75-81, 1997.

Knight, S. W.; Heiss, N. S.; Vulliamy, T. J.; Aalfs, C. M.; McMahon, C.; Richmond, P.; Jones, A.; Hennekam, R. C. M.; Poustka, A.; Mason, P. J.; Dokal, I.: Unexplained aplastic anaemia, immunodeficiency, and cerebellar hypoplasia (Hoyeraal-Hreidarsson syndrome) due to mutations in the dyskeratosis congenita gene, DKC1. Brit. J. Haemat. 107: 335-339, 1999.

Knight, S. W.; Heiss, N. S.; Vulliamy, T. J.; Greschner, S.; Stavrides, G.; Pai, G. S.; Lestringant, G.; Varma, N.; Mason, P. J.; Dokal, I.; Poustka, A.: X-linked dyskeratosis congenita is predominantly caused by missense mutations in the DKC1 gene. Am. J. Hum. Genet. 65:50-58,1999.

Knight, S. W.; Vulliamy, T. J.; Morgan, B.; Devriendt, K.; Mason, P. J.; Dokal, I.: Identification of novel DKC1 mutations in patients with dyskeratosis congenita: implications for pathophysiology and diagnosis. Hum. Genet. 108:299-303, 2001.

Luzzatto, L.; Karadimitris, A.: Dyskeratosis and ribosomal rebellion. Nature Genet. 19:6-7, 1998.

McGrath, J. A.: Dyskeratosis congenita: new clinical and molecular insights into ribosome function. Lancet 353:1204-1205, 1999.

Mitchell, J. R.; Wood, E.; Collins, K.: A telomerase component is defective in the human disease dyskeratosis congenita. Nature 402:551-555, 1999.

Salowsky, R.; Heiss, N. S.; Benner, A.; Wittig, R.; Poustka, A.: Basal transcription activity of the dyskeratosis congenita gene is mediated by Sp1 and Sp3 and a patient mutation in a Sp1 binding site is associated with decreased promoter activity. Gene 293:9-19,2002.

Vulliamy, T. J.; Knight, S. W.; Heiss, N. S.; Smith, O. P.; Poustka, A.; Dokal, I.; Mason, P. J.: Dyskeratosis congenita caused by a 3-prime deletion: germline and somatic mosaicism in a female carrier. Blood 94:1254-1260, 1999.

Yaghmai, R.; Kimyai-Asadi, A.; Rostamiani, K.; Heiss, N. S.; Poustka, A.; Eyaid, W.; Bodurtha, J.; Nousari, H. C.; Hamosh, A.; Metzenberg, A.: Overlap of dyskeratosis congenita with the Hoyeraal-Hreidarsson syndrome. J. Pediat. 136:390-393, 2000.

Greenfield, A.; Carrel, L.; Pennisi, D.; Philippe, C.; Quaderi, N.; Siggers, P.; Steiner, K.; Tam, P. P. L.; Monaco, A. P.; Willard, H. F.; Koopman, P.: The UTX gene escapes X inactivation in mice and human S. Hum. Molec. Genet. 7:737-742, 1998.

Lin, C.-S.; Aebersold, R. H.; Leavitt, J.: Correction of the N-terminal sequences of the human plastin isoforms by using anchored polymerase chain reaction: identification of a potential calcium-binding domain. Molec. Cell. Biol. 10:1818-1821, 1990.

Fukuda, M. N.; Sato, T.; Nakayama, J.; Klier, G.; Mikami, M.; Aoki, D.; Nozawa, S.: Trophinin and tastin, a novel cell adhesion molecule complex with potential involvement in embryo implantation. Genes Dev. 9:1199-1210, 1995.

Pack, S. D.; Tanigami, A.; Ledbetter, D. H.; Sato, T.; Fukuda, M. N.: Assignment of trophoblast/endometrial epithelium cell adhesion molecule trophinin gene TRO to human chromosome bands Xp11.22-p11.21by in situ hybridization. Cytogenet. Cell Genet. 79:123-124, 1997.

Suzuki, N.; Nakayama, J.; Shih, I. M.; Aoki, D.; Nozawa, S.; Fukuda, M. N.: Expression of trophinin, tastin, and bystin by trophoblast and endometrial cells in human placenta. Biol. Reprod. 60:621-627,1999.

Sana, T. R.; Debets, R.; Timans, J. C.; Bazan, J. F.; Kastelein, R. A.: Computational identification, cloning, and characterization of IL1R9, a novel interleukin-1 receptor-like gene encoded over an unusually large interval of human chromosome Xq22.2-q22.3. Genomics 69:252-262, 2000.

Bech-Hansen, N. T.; Naylor, M. J.; Maybaum, T. A.; Sparkes, R. L.; Koop, B.; Birch, D. G.; Bergen, A. A. B.; Prinsen, C. F. M.; Polomeno, R. C.; Gal, A.; Drack, A. V.; Musarella, M. A.; Jacobson, S. G.; Young, R. S. L.; Weleber, R. G.: Mutations in NYX, encoding the leucine-rich proteoglycan nyctalopin, cause X-linked complete congenital stationary night blindness. Nature Genet. 26:319-323, 2000.

Pusch, C. M.; Zeitz, C.; Brandau, O.; Pesch, K.; Achatz, H.; Feil, S.; Scharfe, C.; Maurer, J.; Jacobi, F. K.; Pinckers, A.; Andreasson, S.; Hardcastle, A.; Wissinger, B.; Berger, W.; Meindl, A.: The complete form of X-linked congenital stationary night blindness is caused by mutations in a gene encoding a leucine-rich repeat protein. Nature Genet. 26:324-327, 2000.

Isbrandt, D.; Leicher, T.; Waldschutz, R.; Zhu, X.; Luhmann, U.; Michel, U.; Sauter, K.; Pongs, O.: Gene structures and expression profiles of three human KCND (Kv4) potassium channels mediating A-type currents I(to) and I(sa). Genomics 64:144-154, 2000.

Davies, J. P.; Cotter, P. D.; Ioannou, Y. A.: Cloning and mapping of human Rab7 and Rab9 cDNA sequences and identification of a Rab9 pseudogene. Genomics 41:131-134, 1997.

Lahn, B. T.; Page, D. C.: Functional coherence of the human Y chromosome. Science 278:675-680, 1997.

Chung, J.; Lee, S.-G.; Song, K.: Identification of a human homolog of a putative RNA helicase gene (mDEAD3) expressed in mouse erythroid cells. Korean J. Biochem. 27:193-197, 1995.

Park, S. H.; Lee, S.-G.; Kim, Y.; Song, K.: Assignment of a human putative RNA helicase gene, DDX3, to human X chromosome bands p11.3-p11.23. Cytogenet. Cell Genet. 81:178-179, 1998.

Gasper, N. J.; Kinzy, T. G.; Scherer, B. J.; Humbelin, M.; Hershey, J. W. B.; Merrick, W. C.: Translation initiation factor eIF-2: cloning and expression of the human cDNA encoding the gamma-subunit. J. Biol. Chem. 269:3415-3422, 1994.

Ehrmann, I. E.; Ellis, P. S.; Mazeyrat, S.; Duthie, S.; Brockdorff, N.; Mattei, M. G.; Gavin, M. A.; Affara, N. A.; Brown, G. M.; Simpson, E.; Mitchell, M. J.; Scott, D. M.: Characterization of genes encoding translation initiation factor eIF-2-gamma in mouse and human: sex chromosome localization, escape from X-inactivation and evolution. Hum. Molec. Genet. 7:1725-1737, 1998.

Lee, S. M. Y.; Tsui, S. K. W.; Chan, K. K.; Garcia-Barcelo, M.; Waye, M. M. Y.; Fung, K. P.; Liew, C. C.; Lee, C. Y.: Chromosomal mapping, tissue distribution and cDNA sequence of four-and-a-half LIM domain protein 1 (FHL1). Gene 216:163-170, 1998.

Morgan, M. J.; Madgwick, A. J.; Charleston, B.; Pell, J. M.; Loughna, P. T.: The developmental regulation of a novel muscle LIM-protein. Biochem. Biophys. Res. Commun. 212: 840-846, 1995.

Morgan, M. J.; Madgwick, A. J. A.: Slim defines a novel family of LIM-proteins expressed in skeletal muscle. Biochem. Biophys. Res. Commun. 225:632-638, 1996.

Dougherty, K. M.; Brandriss, M. C.; Valle, D.: Cloning human pyrroline-5-carboxylate reductase cDNA by complementation in Saccharomyces cerevisiae. J. Biol. Chem. 267: 871-875, 1992.

Merrill, M. J.; Yeh, G. C.; Phang, J. M.: Purified human erythrocyte pyrroline-5-carboxylate reductase: preferential oxidation of NADPH. J. Biol. Chem. 264:9352-9358, 1989.

Barletta, C.; Druck, T.; LaForgia, S.; Calabretta, B.; Drabkin, H.; Patterson, D.; Croce, C. M.; Huebner, K.: Chromosome locations of the MYB related genes, AMYB and BMYB. Cancer Res. 51:3821-3824,1991.

Nomura, N.; Takahashi, M.; Matsui, M.; Ishii, S.; Date, T.; Sasamoto, S.; Ishizaki, R.: Isolation of human cDNA clones of MYB-related genes, A-MYB and B-MYB. Nucleic Acids Res. 16:11075-11089, 1988.

Takahashi, T.; Nakagoshi, H.; Sarai, A.; Nomura, N.; Yamamoto, T.; Ishii, S.: Human A-myb gene encodes a transcriptional activator containing the negative regulatory domains. FEBS Lett. 358:89-96,1995.

Boylan, K. B.; Takahashi, N.; Diamond, M.; Hood, L. E.; Prusiner, S. B.: DNA length polymorphism located 5-prime to the human myelin basic protein gene. Am. J. Hum. Genet. 40:387-400, 1987.

Dayhoff, M. O.: Atlas of Protein Sequence and Structure. Myelin membrane encephalitogenic protein. Washington: National Biomedical Research Foundation (pub.) 5:1972. Pp. D324 only.

Eylar, E. H.; Brostoff, S.; Hashim, G.; Westall, F. C.: Basic A1 protein of the myelin membrane: the complete amino acid sequence. J. Biol. Chem. 246:5770-5784, 1971.

Gomez, C. M.; Muggleton-Harris, A. L.; Whittingham, D. G.; Hood, L. E.; Readhead, C.: Rapid preimplantation detection of mutant (shiverer) and normal alleles of the mouse myelin basic protein gene allowing selective implantation and birth of live young. Proc. Nat. Acad. Sci. 87:4481-4484, 1990.

Kamholz, J.; de Ferra, F.; Puckett, C.; Lazzarini, R.: Identification of three forms of human myelin basic protein by cDNA cloning. Proc. Nat. Acad. Sci. 83:4962-4966, 1986.

Kamholz, J.; Spielman, R.; Gogolin, K.; Modi, W.; O'Brien, S.; Lazzarini, R.: The human myelin-basic-protein gene: chromosomal localization and RFLP analysis. Am. J. Hum. Genet. 40:365-373, 1987.

Lalley, P. A.; McKusick, V. A.: Report of the committee on comparative mapping (HGM8). Cytogenet. Cell Genet. 40:536-566, 1985.

Martensen, R. E.: Myelin basic protein speciation. Prog. Clin. Biol. Res. 146:511-521, 1984.

Marty, M. C.; Alliot, F.; Rutin, J.; Fritz, R.; Trisler, D.; Pessac, B.: The myelin basic protein gene is expressed in differentiated blood cell lineages and in hemopoietic progenitors. Proc. Nat. Acad. Sci. 99:8856-8861, 2002.

Molineaux, S. M.; Engh, H.; de Ferra, F.; Hudson, L.; Lazzarini, R. A.: Recombination within the myelin basic protein gene created the dysmyelinating shiverer mouse mutation. Proc. Nat. Acad. Sci. 83:7542-7546, 1986.

Popko, B.; Puckett, C.; Lai, E.; Shine, H. D.; Readhead, C.; Takahashi, N.; Hunt, S. W., III; Sidman, R. L.; Hood, L.: Myelin deficient mice: expression of myelin basic protein and generation of mice with varying levels of myelin. Cell 48:713-721, 1987.

Readhead, C.; Popko, B.; Takahashi, N.; Shine, H. D.; Saavedra, R. A.; Sidman, R. L.; Hood, L.: Expression of a myelin basic protein gene in transgenic shiverer mice: correction of the dysmyelinating phenotype. Cell 48:703-712, 1987.

Roach, A.; Boylan, K.; Horvath, S.; Prusiner, S. B.; Hood, L. E.: Characterization of cloned cDNA representing rat myelin basic protein: absence of expression in shiverer mutant mice. Cell 34:799-806, 1983.

Roach, A.; Takahashi, N.; Pravtcheva, D.; Ruddle, F.; Hood, L.: Chromosomal mapping of mouse myelin basic protein gene and structure and transcription of the partially deleted gene in shiverer mutant mice. Cell 42:149-155, 1985.

Saxe, D. F.; Takahashi, N.; Hood, L.; Simon, M. I.: Localization of the human myelin basic protein gene (MBP) to region 18q22-qter by in situ hybridization. Cytogenet. Cell Genet. 39:246-249, 1985.

Sheremata, W.; Cosgrove, J. B. R.; Hylar, E. H.: Cellular hypersensitivity to basic myelin (A1) protein and clinical multiple sclerosis. New Eng. J. Med. 291:14-17, 1974.

Sidman, R.: Personal Communication. Boston, Mass. 1983.

Sidman, R. L.; Conover, C. S.; Carson, J. H.: Shiverer gene maps near the distal end of chromosome 18 in the house mouse. Cytogenet. Cell Genet. 39:241-245, 1985.

Sparkes, R. S.; Mohandas, T.; Heinzmann, C.; Roth, H. J.; Klisak, I.; Campagnoni, A. T.: Assignment of the myelin basic protein gene to human chromosome 18q22-qter. Hum. Genet. 75:147-150, 1987.

Takahashi, N.; Roach, A.; Teplow, D. B.; Prusiner, S. B.; Hood, L.: Cloning and characterization of the myelin basic protein gene from mouse: one gene can encode both 14 kd and 18.5 kd MBPs by alternate use of exons. Cell 42:139-148, 1985.

Barouch, L. A.; Harrison, R. W.; Skaf, M. W.; Rosas, G. O.; Cappola, T. P.; Kobeissi, Z. A.; Hobai, I. A.; Lemmon, C. A.; Burnett, A. L.; O'Rourke, B.; Rodriguez, E. R.; Huang, P. L.; Lima, J. A. C.; Berkowitz, D. E.; Hare, J. M.: Nitric oxide regulates the heart by spatial confinement of nitric oxide synthase isoforms. Nature 416:337-340, 2002.

Dimmeler, S.; Fleming, I.; Fisslthaler, B.; Hermann, C.; Busse, R.; Zeiher, A. M.: Activation of nitric oxide synthase in endothelial cells by Akt-dependent phosphorylation. Nature 399:601-605, 1999.

Fulton, D.; Gratton, J.-P.; McCabe, T. J.; Fontana, J.; Fujio, Y.; Walsh, K.; Franke, T. F.; Papapetropoulos, A.; Sessa, W. C.: Regulation of endothelium-derived nitric oxide production by the protein kinase Akt. Nature 399:597-601, 1999.

Kruh, G. D.; King, C. R.; Kraus, M. H.; Popescu, N. C.; Amsbaugh, S. C.; McBride, W. O.; Aaronson, S. A.: A novel human gene closely related to the abl proto-oncogene. Science 234:1545-1548, 1986.

Arnaud, J.; Vavrusa, B.; Sevin, J.; Constans, J.: Human red-cell acid phosphatase (ACP1): a new mutant (ACP1*KUK) detected by isoelectric focusing, kinetics of thermostability and substrate activity. Hum. Hered. 39:288-293, 1989.

Arnaud, J.; Vavrusa, B.; Wiederanders, G.; Constans, J.: human red-cell acid phosphatase (ACP1): kinetic and thermodynamic characterization of the KUK variant. Hum. Hered. 42:140-142, 1992.

Beemer, F. A.; van der Heiden, C.; Van Hemel, J. O.; Jansen, M.: Letter to the editors. (Letter) Clin. Genet. 24:151, 1983.

Berg, K.: Close linkage between APOB and ACP1 excluded. (Abstract) Cytogenet. Cell Genet. 46:580, 1987.

Bottini, E.; Carapella, E.; Orzalesi, M.; Lucarelli, P.; Pascone, R.; Gloria-Bottini, F.; Coccia, M.: Is there a role of erythrocyte acid phosphatase polymorphism in intrauterine development? (Letter) Am. J. Hum. Genet. 32:764-767, 1980.

Seldin, M. F.; Kruh, G. D.: Mapping of Abll within a conserved linkage group on distal mouse chromosome 1 syntenic with human chromosome 1 using an interspecific cross. Genomics 4:221-223, 1989.

Bello, M. J.; Salagnon, N.; Rey, J. A.; Guichaoua, M. R.; Berge-Lefranc, J. L.; Jordan, B. R.; Luciani, J. M.: Precise in situ localization of NCAM, ETS1, and D11S29 on human meiotic chromosomes. Cytogenet. Cell Genet. 52:7-10, 1989.

Ohtani, N.; Zebedee, Z.; Huot, T. J. G.; Stinson, J. A.; Sugimoto, M.; Ohashi, Y.; Sharrocks, A. D.; Peters, G.; Hara, E.: Opposing effects of Ets and Id proteins on p16(INK4A) expression during cellular senescence. Nature 409:1067-1070, 2001.

Sacchi, N.; Watson, D. K.; Geurts van Kessel, A. H. M.; Hagemeijer, A.; Kersey, J.; Drabkin, H. D.; Patterson, D.; Papas, T. S.: Hu-ets-1and Hu-ets-2 genes are transposed in acute leukemias with (4;11) and (8;21) translocations. Science 231:379-382, 1986.

Watson, D. K.; McWilliams-Smith, M. J.; Kozak, C.; Reeves, R.; Gearhart, J.; Nunn, M. F.; Nash, W.; Fowle, J. R., III; Duesberg, P.; Papas, T. S.; O'Brien, S. J.: Conserved chromosomal positions of dual domains of the ets proto-oncogene in cats, mice, and human S. Proc. Nat. Acad. Sci. 83:1792-1796, 1986.

Watson, D. K.; McWilliams-Smith, M. J.; Nunn, M. F.; Duesberg, P. H.; O'Brien, S. J.; Papas, T. S.: The ets sequence from the transforming gene of avian erythroblastosis virus, E26, has unique domains on human chromosomes 11 and 21: both loci are transcriptionally active. Proc. Nat. Acad. Sci. 82:7294-7298, 1985.

Bellacosa, A.; Franke, T. F.; Gonzalez-Portal, M. E.; Datta, K.; Taguchi, T.; Gardner, J.; Cheng, J. Q.; Testa, J. R.; Tsichlis, P. N.: Structure, expression and chromosomal mapping of c-akt: relationship to v-akt and its implications. Oncogene 8:745-754, 1993.

Brunet, A.; Bonni, A.; Zigmond, M. J.; Lin, M. Z.; Juo, P.; Hu, L. S.; Anderson, M. J.; Arden, K. C.; Blenis, J.; Greenberg, M. E.: Akt promotes cell survival by phosphorylating and inhibiting a Forkhead transcription factor. Cell 96:857-868, 1999.

Chen, W. S.; Xu, P.-Z.; Gottlob, K.; Chen, M.-L.; Sokol, K.; Shiyanova, T.; Roninson, I.; Weng, W.; Suzuki, R.; Tobe, K.; Kadowaki, T.; Hay, N.: Growth retardation and increased apoptosis in mice with homozygous disruption of the akt1 gene. Genes Dev. 15:2203-2208, 2001.

Condorelli, G.; Drusco, A.; Stassi, G.; Bellacosa, A.; Roncarati, R.; Iaccarino, G.; Russo, M. A.; Gu, Y.; Dalton, N.; Chung, C.; Latronico, M. V. G.; Napoli, C.; Sadoshima, J.; Croce, C. M.; Ross, J., Jr.: Akt induces enhanced myocardial contractility and cell size in vivo in transgenic mice. Proc. Nat. Acad. Sci. 99:12333-12338, 2002.

Ellis, N. A.: Ecce Ohno. Nature Genet. 10:373-375, 1995.

Haldane, J. B. S.: Sex ratio and unisexual sterility in hybrid animals. J. Genet. 12:101-109, 1922.

Milatovich, A.; Kitamura, T.; Miyajima, A.; Francke, U.: Gene for the alpha-subunit of the human interleukin-3 receptor (IL3RA) localized to the X-Y pseudoautosomal region. Am. J. Hum. Genet. 53:1146-1153, 1993.

Ohno, S.: Sex Chromosomes and Sex-linked Genes. Berlin and New York: Springer (pub.) 1967.

Palmer, S.; Perry, J.; Ashworth, A.: A contravention of OhnO'slaw in mice. Nature Genet. 10:472-476, 1995.

Rugarli, E. I.; Adler, D. A.; Borsani, G.; Tsuchiya, K.; Franco, B.; Hauge, X.; Disteche, C.; Chapman, V.; Ballabio, A.: Different chromosomal localization of the Clcn4 gene in Mus spretus and C57BL/6J mice. Nature Genet. 10:466-471, 1995.

Schnur, R. E.; Wick, P. A.: Intragenic TaqI restriction fragment length polymorphism (RFLP) in CLCN4, between the loci for X-linked ocular albinism (OA1) and microphthalmia with linear skin defects syndrome (MLS). Hum. Genet. 95:594-595, 1995.

van Slegtenhorst, M. A.; Bassi, M. T.; Borsani, G.; Wapenaar, M. C.; Ferrero, G. B.; de Conciliis, L.; Rugarli, E. I.; Grillo, A.; Franco, B.; Zoghbi, H. Y.; Ballabio, A.: A gene from the Xp22.3 region shares homology with voltage-gated chloride channels. Hum. Molec. Genet. 3:547-552, 1994.

Maslen, G. L.; Boyd, Y.: Comparative mapping of the Grpr locuson the X chromosomes of man and mouse. Genomics 17:106-109, 1993.

Schantz, L. J.; Naylor, S. L.; Giladi, E.; Spindel, E. R.: Assignment of the GRP receptor gene to the human X chromosome. (Abstract) Cytogenet. Cell Genet. 58:2085-2086, 1991.

Shiraishi, M.; Alitalo, T.; Sekiya, T.: The chromosomal organization of the human endogenous retrovirus-like sequence HERV-H: clustering of the HERV-H sequences in a 300-kb region close to the GRPR locuson the X chromosome. DNA Res. 3:425-429, 1996.

Shriver, S. P.; Bourdeau, H. A.; Gubish, C. T.; Tirpak, D. L.; Davis, A. L. G.; Luketich, J. D.; Siegfried, J. M.: Sex-specific expression of gastrin-releasing peptide receptor: relationship to smoking history and risk of lung cancer. J. Nat. Cancer Inst. 92:24-33, 2000.

Spindel, E. R.; Giladi, E.; Brehm, P.; Goodman, R. H.; Segerson, T. P.: Cloning and functional characterization of a complementary DNA encoding the murine fibroblast bombesin/gastrin-releasing peptide receptor. Molec. Endocr. 4:1956-1963, 1990.

Ma, K.; Sharkey, A.; Kirsch, S.; Vogt, P.; Keil, R.; Hargreave, T. B.; McBeath, S.; Chandley, A. C.: Towards the molecular localisation of the AZF locus: mapping of microdeletions in azoospermic men within14 subintervals of interval 6 of the human Y chromosome. Hum. Molec. Genet. 1:29-33, 1992.

Adam, A.; Tippett, P.; Gavin, J.; Noades, J.; Sanger, R.; Race, R. R.: The linkage relation of Xg to G6PD in Israelis: the evidence of a second series of families. Am. J. Hum. Genet. 30:211-218,1966.

Ahluwalia, A.; Corcoran, C. M.; Vulliamy, T. J.; Ishwad, C. S.; Naidu, J. M.; Argusti, A.; Stevens, D. J.; Mason, P. J.; Luzzatto, L.: G6PD Kalyan and G6PD Kerala; two deficient variants in India caused by the same 317 glu-to-lys mutation. Hum. Molec. Genet. 3:209-210, 1992.

Aksoy, K.; Yuregir, G. T.; Dikmen, N.; Unlukurt, I.: Three new G6PD variants, G6PD Adana, G6PD Samandag, and G6PD Balcali in Cukurova, Turkey. Hum. Genet. 76:199-201, 1987.

Alfinito, F.; Cimmino, A.; Ferraro, F.; Cubellis, M. V.; Vitagliano, L.; Francese, M.; Zagari, A.; Rotoli, B.; Filosa, S.; Martini, G.: Molecular characterization of G6PD deficiency in Southern Italy: heterogeneity, correlation genotype-phenotype and description of a new variant (G6PD Neapolis). Brit. J. Haemat. 98:41-46, 1997.

Alperin, J. B.; Mills, G. C.: New variants of glucose-6-phosphate dehydrogenase (G6PD). Clin. Res. 20:76, 1972.

Azevedo, E.; Kirkman, H. N.; Morrow, A. C.; Motulsky, A. G.: Variants of red cell glucose-6-phosphate dehydrogenase among Asiatic Indians. Ann. Hum. Genet. 31:373-379, 1968.

Azevedo, E. S.; Yoshida, A.: Brazilian variant of glucose-6-phosphate dehydrogenase (GD Minas Gerais). Nature 222: 380-382, 1969.

Babalola, A. O. G.; Beetlestone, J. G.; Luzzatto, L.: Genetic variants of human erythrocyte glucose-6-phosphate dehydrogenase: kinetic and thermodynamic parameters of variants A, B, and A- in relation to quaternary structure. J. Biol. Chem. 251:2993-3002, 1976.

Balinsky, D.; Cayanis, E.; Carter, G.; Jenkins, T.; Bersohn, I.: A new variant of human erythrocyte glucose-6-phosphate dehydrogenase:G6PD Port Elizabeth. Int. J. Biochem. 4:235-244, 1973.

Balinsky, D.; Gomperts, E.; Cayanis, E.; Jenkins, T.; Bryer, D.; Bersohn, I.; Metz, J.: Glucose 6-phosphate dehydrogenase Johannesburg: a new variant with reduced activity in a patient with congenital non-spherocytic haemolytic anaemia. Brit. J. Haemat. 25:385-392, 1973.

Balinsky, D.; Rootman, A. J.; Nurse, G. T.; Cayanis, E.; Lane, A.; Jenkins, T.; Bersohn, I.: G6PD Kuanyama: a new variant of human erythrocyte glucose 6-phosphate dehydrogenase showing slower than normal electrophoretic mobility. S. Afr. J. Med. Sci. 39:5-13,1974.

Barretto, O. C.; Nonoyama, K.: Gd (+) Cuiaba, a new rare glucose-6-phosphate dehydrogenase variant presenting normal activity. Hum. Genet. 77:201-202, 1987.

Kornak, U.; Kasper, D.; Bosl, M. R.; Kaiser, E.; Schweizer, M.; Schulz, A.; Friedrich, W.; Delling, G.; Jentsch, T. J.: Loss of the ClC-7 chloride channel leads to osteopetrosis in mice and man. Cell 104:205-215, 2001.

Kornak, U.; Schulz, A.; Friedrich, W.; Uhlhaas, S.; Kremens, B.; Voit, T.; Hasan, C.; Bode, U.; Jentsch, T. J.; Kubisch, C.: Mutations in the a3 subunit of the vacuolar H(+)-ATPase cause infantile malignant osteopetrosis. Hum. Molec. Genet. 9:2059-2063, 2000.

Rosenberg, C. L.; Wong, E.; Petty, E. M.; Bale, A. E.; Tsujimoto, Y.; Harris, N. L.; Arnold, A.: PRAD1, a candidate BCL1 oncogene: mapping and expression in centrocytic lymphoma. Proc. Nat. Acad. Sci. 88:9638-9642, 1991.

Tsujimoto, Y.; Jaffe, E.; Cossman, J.; Gorham, J.; Nowell, P. C.; Croce, C. M.: Clustering of breakpoints on chromosome 11 in human B-cell neoplasms with the t (11;14) chromosome translocation. Nature 315:340-343, 1985.

Tsujimoto, Y.; Yunis, J.; Onorato-Showe, L.; Erikson, J.; Nowell, P. C.; Croce, C. M.: Molecular cloning of the chromosomal breakpoint of B-cell lymphomas and leukemias with the t (11;14) chromosome translocation. Science 224: 1403-1406, 1984.

Barbany, G.; Hoglund, M.; Simonsson, B.: Complete molecular remission in chronic myelogenous leukemia after imatinib therapy. (Letter) New Eng. J. Med. 347:539-540, 2002.

Budarf, M.; Canaani, E.; Emanuel, B. S.: Linear order of the four BCR-related loci in 22q11. Genomics 3:168-171, 1988.

Castellanos, A.; Pintado, B.; Weruaga, E.; Arevalo, R.; Lopez, A.; Orfao, A.; Sanchez-Garcia, I.: A BCR-ABL(p190) fusion gene made by homologous recombination causes B-cell acute lymphoblastic leukemias in chimeric mice with independence of the endogenous bcr product. Blood 90:2168-2174, 1997. 1. Brunning, R. D.: Philadelphia chromosome positive leukemia. Hum. Path. 11:307-309, 1980.

Chissoe, S. L.; Bodenteich, A.; Wang, Y.-F.; Wang, Y.-P.; Burian, D.; Clifton, S. W.; Crabtree, J.; Freeman, A.; Iyer, K.; Jian, L.; Ma, Y.; McLaury, H.-J.; Pan, H.-Q.; Sarhan, O. H.; Toth, S.; Wang, Z.; Zhang, G.; Heisterkamp, N.; Groffen, J.; Roe, B. A.: Sequence and analysis of the human ABL gene, the BCR gene, and regions involved in the Philadelphia chromosomal translocation. Genomics 27:67-82,1995.

Court Brown, W. M.; Doll, R.: Mortality from cancer and other causes after radiotherapy for ankylosing spondylitis. Brit. Med. J. 2:1327-1332, 1965.

Croce, C. M.; Huebner, K.; Isobe, M.; Fainstain, E.; Lifshitz, B.; Shtivelman, E.; Canaani, E.: Mapping of four distinct BCR-related loci to chromosome region 22q11: order of BCR loci relative to chronic myelogenous leukemia and acute lymphoblastic leukemia breakpoints. Proc. Nat. Acad. Sci. 84:7174-7178, 1987.

Daley, G. Q.; Van Etten, R. A.; Baltimore, D.: Induction of chronic myelogenous leukemia in mice by the P210(bcr/abl) gene of the Philadelphia chromosome. Science 247:824-830, 1990.

de Klein, A.; Geurts van Kessel, A.; Grosveld, G.; Bartram, C. R.; Hagemeijer, A.; Bootsma, D.; Spurr, N. K.; Heisterkamp, N.; Groffen, J.; Stephenson, J. R.: A cellular oncogene is translocated to the Philadelphia chromosome in chronic myelocytic leukaemia. Nature 300:765-767, 1982.

Diekmann, D.; Brill, S.; Garrett, M. D.; Totty, N.; Hsuan, J.; Monfries, C.; Hall, C.; Lim, L.; Hall, A.: Bcr encodes a GTPase-activating protein for p21(rac). Nature 351:400-402, 1991.

Druker, B. J.; Sawyers, C. L.; Kantarjian, H.; Resta, D. J.; Reese, S. F.; Ford, J. M.; Capdeville, R.; Talpaz, M.: Activity of a specific inhibitor of the BCR-ABL tyrosine kinase in the blast crisis of chronic myeloid leukemia and acute lymphoblastic leukemia with the Philadelphia chromosome. New Eng. J. Med. 344:1038-1042, 2001.

Druker, B. J.; Talpaz, M.; Resta, D. J.; Peng, B.; Buchdunger, E.; Ford, J. M.; Lydon, N. B.; Kantarjian, H.; Capdeville, R.; Ohno-Jones, S.; Sawyers, C. L.: Efficacy and safety of a specific inhibitor of the BCR-ABL tyrosine kinase in chronic myeloid leukemia. New Eng. J. Med. 344:1031-1037, 2001.

Emanuel, B. S.; Selden, J. R.; Wang, E.; Nowell, P. C.; Croce, C. M.: In situ hybridization and translocation breakpoint mapping. I. Non-identical 22q11 breakpoints for the t (9;22) of CML and the t (8;22) of Burkitt lymphoma. Cytogenet. Cell Genet. 38:127-131,1984.

Grandori, C.; Mac, J.; Siebelt, F.; Ayer, D. E.; Eisenman, R. N.: Myc-Max heterodimers activate a DEAD box gene and interact with multiple E box-related sites in vivo. EMBO J. 15:4344-4357, 1996.

Gallagher, A. R.; Cedzich, A.; Gretz, N.; Somlo, S.; Witzgall, R.: The polycystic kidney disease protein PKD2 interacts with Hax-1, a protein associated with the actin cytoskeleton. Proc. Nat. Acad. Sci. 97:4017-4022, 2000.

Cleutjens, K. B. J. M.; van Eekelen, C. C. E. M.; van der Korput, H. A. G. M.; Brinkmann, A. O.; Trapman, J.: Two androgen response regions cooperate in steroid hormone regulated activity of the prostate-specific antigen promoter. J. Biol. Chem. 271:6379-6388, 1996.

Evans, B. A.; Drinkwater, C. C.; Richards, R. I.: Mouse glandular kallikrein genes: structure and partial sequence analysis of the kallikrein gene locus. J. Biol. Chem. 262: 8027-8034, 1987.

Lundwall, A.; Lilja, H.: Molecular cloning of human prostate specific antigen cDNA. FEBS Lett. 214:317-322, 1987.

Melegos, D. N.; Yu, H.; Ashok, M.; Wang, C.; Stanczyk, F.; Diamandis, E. P.: Prostate-specific antigen in female serum, a potential new marker of androgen excess. J. Clin. Endocr. Metab. 82:777-780,1997.

Prendergast, G. C.; Lawe, D.; Ziff, E. B.: Association of Myn, the murine homolog of Max, with c-Myc stimulates methylation-sensitive DNA binding and Ras cotransformation. Cell 65:395-408, 1991.

Wagner, A. J.; Le Beau, M. M.; Diaz, M. O.; Hay, N.: Expression, regulation, and chromosomal localization of the Max gene. Proc. Nat. Acad. Sci. 89:3111-3115, 1992.

Zervos, A. S.; Faccio, L.; Gatto, J. P.; Kyriakis, J. M.; Brent, R.: Mxi2, a mitogen-activated protein kinase that recognizes and phosphorylates Max protein. Proc. Nat. Acad. Sci. 92:10531-10534,1995.

Emi, M.; Katagiri, T.; Harada, Y.; Saito, H.; Inazawa, J.; Ito, I.; Kasumi, F.; Nakamura, Y.: A novel metalloprotease/disintegrin-like gene at 17q21.3 is somatically rearranged in two primary breast cancers. Nature Genet. 5:151-157, 1993.

Katagiri, T.; Harada, Y.; Emi, M.; Nakamura, Y.: Human metalloprotease/disintegrin-like (MDC) gene: exon-intron organization and alternative splicing. Cytogenet. Cell Genet. 68:39-44, 1995.

Begley, C. G.; Lipkowitz, S.; Gobel, V.; Mahon, K. A.; Bertness, V.; Green, A. R.; Gough, N. M.; Kirsch, I. R.: Molecular characterization of NSCL, a gene encoding a helix-loop-helix protein expressed in the developing nervous system. Proc. Nat. Acad. Sci. 89:38-42, 1992.

Brown, L.; Espinosa, R., III; Le Beau, M. M.; Siciliano, M. J.; Baer, R.: HEN1 and HEN2: a subgroup of basic helix-loop-helix genes that are coexpressed in a human neuroblastoma. Proc. Nat. Acad. Sci. 89:8492-8496, 1992.

Cogliati, T.; Good, D. J.; Haigney, M.; Delgado-Romero, P.; Eckhaus, M. A.; Koch, W. J.; Kirsch, I. R.: Predisposition to arrhythmia and autonomic dysfunction in Nhlh1-deficient mice. Molec. Cell. Biol. 22:4977-4983, 2002.

Lipkowitz, S.; Gobel, V.; Varterasian, M. L.; Nakahara, K.; Tchorz, K.; Kirsch, I. R.: A comparative structural characterization of the human NSCL-1 and NSCL-2 genes: two basic helix-loop-helix genes expressed in the developing nervous system. J. Biol. Chem. 267:21065-21071,1992.

Mullick, A.; Groulx, N.; Trasler, D.; Gros, P.: Nhlh1, a basic helix-loop-helix transcription factor, is very tightly linked to the mouse looptail (Lp) mutation. Mammalian Genome 6:700-704, 1995.

Meeker, T. C.; Nagarajan, L.; ar-Rushdi, A.; Rovera, G.; Huebner, K.; Croce, C. M.: Characterization of the human PIM-1 gene: a putative proto-oncogene coding for a tissue specific member of the protein kinase family. Oncogene Res. 1:87-101, 1987.

Pasqualucci, L.; Neumeister, P.; Goossens, T.; Nanjangud, G.; Chaganti, R. S. K.; Kuppers, R.; Dalla-Favera, R.: Hypermutation of multiple proto-oncogenes in B-cell diffuse large-cell lymphomas. Nature 412:341-346, 2001.

Ragoussis, J.; Senger, G.; Mockridge, I.; Sanseau, P.; Ruddy, S.; Dudley, K.; Sheer, D.; Trowsdale, J.: A testis-expressed Zn finger gene (ZNF76) in human 6p21.3 centromeric to the MHC is closely linked to the human homolog of the t-complex gene tcp-11. Genomics 14:673-679, 1992.

Saris, C. J. M.; Domen, J.; Berns, A.: The pim-1 oncogene encodes two related protein-serine/threonine kinases by alternative initiation at AUG and CUG. EMBO J. 10:655-664, 1991.

Selten, G.; Cuypers, H. T.; Boelens, W.; Robanus-Maandag, E.; Verbeek, J.; Domen, J.; van Beveren, C.; Berns, A.: The primary structure of the putative oncogene pim-1 shows extensive homology with protein kinases. Cell 46:603-611, 1986.

Zoghbi, H. Y.; Ballantyne, C. M.; O'Brien, W. E.; McCall, A. E.; Kwiatkowski, T. J., Jr.; Ledbetter, S. A.; Beaudet, A. L.: Deletion and linkage mapping of eight markers from the proximal short arm of chromosome 6. Genomics 6:352-357, 1990.

Laird, P. W.; van der Lugt, N. M. T.; Clarke, A.; Domen, J.; Linders, K.; McWhir, J.; Berns, A.; Hooper, M.: In vivo analysis of Pim-1deficiency. Nucleic Acids Res. 21:4750-4755, 1993.

Gartner, J.; Obie, C.; Watkins, P.; Valle, D.: Restoration of peroxisome biogenesis in a peroxisome-deficient mammalian cell line by expression of either the 35 kDa or the 70 kDa peroxisomal membrane proteins. J. Inherit. Metab. Dis. 17:327-329, 1994.

Maric, S. C.; Crozat, A.; Janne, O. A.: Structure and organization of the human S-adenosylmethionine decarboxylase gene. J. Biol. Chem. 267:18915-18923, 1992.

Maric, S. C.; Crozat, A.; Louhimo, J.; Knuutila, S.; Janne, O. A.: The human S-adenosylmethionine decarboxylase gene: Nucleotide sequence of a pseudogene and chromosomal localization of the active gene (AMD1) and the pseudogene (AMD2). Cytogenet. Cell Genet. 70:195-199, 1995.

Abel, K. J.; Boehnke, M.; Prahalad, M.; Ho, P.; Flejter, W. L.; Watkins, M.; VanderStoep, J.; Chandrasekharappa, S. C.; Collins, F. S.; Glover, T. W.; Weber, B. L.: A radiation hybrid map of the BRCA1 region of chromosome 17q12-q21. Genomics 17:632-641, 1993.

Alonso, A. D. C.; Grundke-Iqbal, I.; Iqbal, K.: Alzheimer's disease hyperphosphorylated tau sequesters normal tau into tangles of filaments and disassembles microtubules. Nature Med. 2:783-787, 1996.

Arima, K.; Kowalska, A.; Hasegawa, M.; Mukoyama, M.; Watanabe, R.; Kawai, M.; Takahashi, K.; Iwatsubo, T.; Tabira, T.; Sunohara, N.: Two brothers with frontotemporal dementia and parkinsonism with an N279K mutation of the tau gene. Neurology 54:1787-1795, 2000.

Baker, M.; Litvan, I.; Houlden, H.; Adamson, J.; Dickson, D.; Perez-Tur, J.; Hardy, J.; Lynch, T.; Bigio, E.; Hutton, M.: Association of an extended haplotype in the tau gene with progressive supranuclear palsy. Hum. Molec. Genet. 8:711-715, 1999.

Brown, J.; Lantos, P. L.; Roques, P.; Fidani, L.; Rossor, M. N.: Familial dementia with swollen achromatic neurons and corticobasal inclusion bodies: a clinical and pathological study. J. Neurol. Sci. 135:21-30, 1996.

Clark, L. N.; Poorkaj, P.; Wszolek, Z.; Geschwind, D. H.; Nasreddine, Z. S.; Miller, B.; Li, D.; Payami, H.; Awert, F.; Markopoulou, K.; Andreadis, A.; D'Souza, I.; Lee, V. M.-Y.;

Reed, L.; Trojanowski, J. Q.; Zhukareva, V.; Bird, T.; Schellenberg, G.; Wilhelmsen, K. C.: Pathogenic implications of mutations in the tau gene in pallido-ponto-nigral degeneration and related neurodegenerative disorders linked to chromosome 17. Proc. Nat. Acad. Sci. 95:13103-13107, 1998.

Connell, J. W.; Gibb, G. M.; Betts, J. C.; Blackstock, W. P.; Gallo, J.-M.; Lovestone, S.; Hutton, M.; Anderton, B. H.: Effects of FTDP-17 mutations on the in vitro phosphorylation of tau by glycogen synthase kinase 3-beta identified by mass spectrometry demonstrate certain mutations exert long-range conformational changes. FEBS Lett. 493:40-44, 2001.

Conrad, C.; Andreadis, A.; Trojanowski, J. Q.; Dickson, D. W.; Kang, D.; Chen, X.; Weiderholt, W.; Hansen, L.; Masliah, E.; Thal, L. J.; Katzman, R.; Xia, Y.; Saitoh, T.: Genetic evidence for the involvement of tau in progressive supranuclear palsy. Ann. Neurol. 41:277-281,1997.

Conrad, C.; Vianna, C.; Freeman, M.; Davies, P.: A polymorphic gene nested within an intron of the tau gene: implications for Alzheimer's disease. Proc. Nat. Acad. Sci. 99:7751-7756, 2002.

Delisle, M. B.; Murrell, J. R.; Richardson, R.; Trofatter, J. A.; Rascol, O.; Soulages, X.; Mohr, M.; Calvas, P.; Ghetti, B.: A mutation at codon 279 (N279K) in exon 10 of the tau gene causes atauopathy with dementia and supranuclear palsy. Acta Neuropath. 98:62-77, 1999.

Donlon, T. A.; Harris, P.; Neve, R. L.: Localization of microtubule-associated protein tau (MTBT1) to chromosome 17q21. (Abstract) Cytogenet. Cell Genet. 46:607, 1987.

Goedert, M.; Crowther, R. A.; Spillantini, M. G.: Tau mutations cause frontotemporal dementias. Neuron 21:955-958, 1998.

Goedert, M.; Spillantini, M. G.; Potier, M. C.; Ulrich, J.; Crowther, R. A.: Cloning and sequencing of the cDNA encoding an isoform of microtubule-associated protein tau containing four tandem repeats: differential expression of tau protein mRNAs in human brain. EMBO J. 8:393-399, 1989.

Goedert, M.; Wischik, C. M.; Crowther, R. A.; Walker, J. E.; Klug, A.: Cloning and sequencing of the cDNA encoding a core protein of the paired helical filament of Alzheimer disease: identification as the microtubule-associated protein tau. Proc. Nat. Acad. Sci. 85:4051-4055, 1988.

Goode, B. L.; Chau, M.; Denis, P. E.; Feinstein, S. C.: Structural and functional differences between 3-repeat and 4-repeat tau isoforms: implications for normal tau function and the onset of neurodegenerative disease. J. Biol. Chem. 275:38182-38189, 2000.

Heutink, P.: Untangling tau-related dementia. Hum. Molec. Genet. 9:979-986, 2000.

Heutink, P.; Stevens, M.; Rizzu, P.; Bakker, E.; Kros, J. M.; Tibben, A.; Niermeijer, M. F.; van Duijn, C. M.; Oostra, B. A.; vanSwieten, J. C.: Hereditary frontotemporal dementia is linked to chromosome 17q21-q22: a genetic and clinicopathological study of three Dutch families. Ann. Neurol. 41:150-159, 1997.

Hiesberger, T.; Trommsdorff, M.; Howell, B. W.; Goffinet, A.; Mumby, M. C.; Cooper, J. A.; Herz, J.: Direct binding of reelin to VLDL receptor and apoE receptor 2 induces tyrosine phosphorylation of disabled-1 and modulates tau phosphorylation. Neuron 24:481-489,1999.

Hong, M.; Zhukareva, V.; Vogelsberg-Ragaglia, V.; Wszolek, Z.; Reed, L.; Miller, B. I.; Geschwind, D. H.; Bird, T. D.; McKeel, D.; Goate, A.; Morris, J. C.; Wilhelmsen, K. C.; Schellenberg, G. D.; Trojanowski, J. Q.; Lee, V. M.-Y.: Mutation-specific functional impairments in distinct tau isoforms of hereditary FTDP-17. Science 282:1914-1917,1998.

Hutton, M.: Missense and splice site mutations in tau associated with FTDP-17: multiple pathogenic mechanisms. Neurology 56 (suppl.4): S21-S25, 2001.

Hutton, M.; Lendon, C. L.; Rizzu, P.; Baker, M.; Froelich, S.; Houlden, H.; Pickering-Brown, S.; Chakraverty, S.; Isaacs, A.; Grover, A.; Hackett, J.; Adamson, J.; and 39 others: Association of missense and 5-prime-splice-site mutations in tau with the inherited dementia FTDP-17. Nature 393:702-705, 1998.

Iijima, M.; Tabira, T.; Poorkaj, P.; Schellenberg, G. D.; Trojanowski, J. Q.; Lee, V. M.; Schmidt, M. L.; Takahashi, K.; Nabika, T.; Matsumoto, T.; Yamashita, Y.; Yoshioka, S.; Ishino, H.: A distinct familial presenile dementia with a novel missense mutation in the tau gene. Neuroreport 10:497-501, 1999.

Ishihara, T.; Hong, M.; Zhang, B.; Nakagawa, Y.; Lee, M. K.; Trojanowski, J. Q.; Lee, V. M.-Y.: Age-dependent emergence and progression of a tauopathy in transgenic mice overexpressing the shortest human tau isoform. Neuron 24:751-762, 1999.

Janssen, J. C.; Warrington, E. K.; Morris, H. R.; Lantos, P.; Brown, J.; Revesz, T.; Wood, N.; Khan, M. N.; Cipolotti, L.; Fox, N. C.; Rossor, M. N.: Clinical features of frontotemporal dementia due to the intronic tau 10 +16 mutation. Neurology 58:1161-1168,2002.

Braun, T.; Grzeschik, K.-H.; Bober, E.; Arnold, H.-H.: The MYF genes, a group of human muscle determining factors, are localized on different human chromosomes. (Abstract) Cytogenet. Cell Genet. 51:969 only, 1989.

de la Serna, I. L.; Carlson, K. A.; Imbalzano, A. N.: Mammalian SWI/SNF complexes promote MyoD-mediated muscle differentiation. Nature Genet. 27:187-190, 2001.

Kim, Y.-J.; Noguchi, S.; Hayashi, Y. K.; Tsukahara, T.; Shimizu, T.; Arahata, K.: The product of an oculopharyngeal muscular dystrophy gene, poly (A)-binding protein 2, interacts with SKIP and stimulates muscle-specific gene expression. Hum. Molec. Genet. 10:1129-1139,2001.

Troger, J.; Neyer, S.; Heufler, C.; Huemer, H.; Schmid, E.; Griesser, U.; Kralinger, M.; Kremser, B.; Baldissera, I.; Kieselbach, G.: Substance P and vasoactive intestinal polypeptide in the streptozotocin-induced diabetic rat retina. Invest. Ophthal. Vis. Sci. 42:1045-1050, 2001.

Mattei, M.-G.; Riviere, M.; Krust, A.; Ingvarsson, S.; Vennstrom, B.; Islam, M. Q.; Levan, G.; Kautner, P.; Zelent, A.; Chambon, P.; Szpirer, J.; Szpirer, C.: Chromosomal assignment of retinoic acid receptor (RAR) genes in the human, mouse, and rat genomes. Genomics 10:1061-1069, 1991.

Abramson, D. H.; Ellsworth, R. M.; Zimmerman, L. E.: Monocular cancer in retinoblastoma survivors. Trans. Am. Acad. Ophthal. Otolaryng. 81:454-457, 1976.

Aherne, G. E. S.; Roberts, D. F.: Retinoblastoma--a clinical survey and its genetic implications. Clin. Genet. 8:275-290, 1975.

Alonso, J.; Garcia-Miguel, P.; Abelairas, J.; Mendiola, M.; Sarret, E.; Vendrell, M. T.; Navajas, A.; Pestana, A.: Spectrum of germline RB1 gene mutations in Spanish retinoblastoma patients: phenotypic and molecular epidemiological implications. Hum. Mutat. 17:412-422,2001.

Amoaku, W. M. K.; Willshaw, H. E.; Parkes, S. E.; Shah, K. J.; Mann, J. R.: Trilateral retinoblastoma: a report of five patients. Cancer 78:858-863, 1996.

Bader, J. L.; Meadows, A. T.; Zimmerman, L. E.; Rorke, L. B.; Voute, P. A.; Champion, L. A. A.; Miller, R. W.: Bilateral retinoblastoma with ectopic intracranial retinoblastoma: trilateral retinoblastoma. Cancer Genet. Cytogenet. 5:203-213, 1982.

Balaban-Malenbaum, G.; Gilbert, F.; Nichols, W. W.; Hill, R.; Shields, J.; Meadows, A. T.: A deleted chromosome no. 13 in human retinoblastoma cells: relevance to tumorigenesis. Cancer Genet. Cytogenet. 3:243-250,1981.

Bandara, L. R.; Adamczewski, J. P.; Hunt, T.; La Thangue, N. B.: Cyclin A and the retinoblastoma gene product complex with a common transcription factor. Nature 352:249-251, 1991.

Benedict, W. F.; Murphree, A. L.; Banerjee, A.; Spina, C. A.; Sparkes, M. C.; Sparkes, R. S.: Patient with 13 chromosome deletion: evidence that the retinoblastoma gene is a recessive cancer gene. Science 219:973-975, 1983.

Benedict, W. F.; Xu, H.-J.; Hu, S.-X.; Takahashi, R.: Role of the retinoblastoma gene in the initiation and progression of human cancer. J. Clin. Invest. 85:988-993, 1990.

Bia, B.; Cowell, J. K.: Independent constitutional germline mutations occurring in the RB1 gene in cousins with bilateral retinoblastoma. Oncogene 11:977-979, 1995.

Blanquet, V.; Turleau, C.; de Grouchy, J.; Creau-Goldberg, N.: Physical map around the retinoblastoma gene: possible genomic imprinting suggested by NruI digestion. Genomics 10:350-355, 1991.

Blanquet, V.; Turleau, C.; Gross-Morand, M. S.; Senamaud-Beaufort, C.; Doz, F.; Besmond, C.: Spectrum of germline mutations in the RB1gene: a study of 232 patients with hereditary and non hereditary retinoblastoma. Hum. Molec. Genet. 4:383-388, 1995.

Jiang, Z.; Cote, J.; Kwon, J. M.; Goate, A. M.; Wu, J. Y.: Aberrant splicing of tau pre-mRNA caused by intronic mutations associated with the inherited dementia frontotemporal dementia with Parkinsonism linked to chromosome 17. Molec. Cell. Biol. 20:4036-4048, 2000.

Trapani, J. A.; Browne, K. A.; Dawson, M. J.; Ramsay, R. G.; Eddy, R. L.; Shows, T. B.; White, P. C.; Dupont, B.: A novel gene constitutively expressed in human lymphoid cells is inducible with interferon-gamma in myeloid cells. Immunogenetics 36:369-376, 1992.

Funatsu, H.; Yamashita, H.; Noma, H.; Mimura, T.; Yamashita, T.; Hori, S.: Increased levels of vascular endothelial growth factor and interleukin-6 in the aqueous humor of diabetics with macular edema. Am. J. Ophthal. 133:70-77, 2002.

Lippa, C. F.; Zhukareva, V.; Kawarai, T.; Uryu, K.; Shafiq, M.; Nee, L. E.; Grafman, J.; Liang, Y.; St George-Hyslop, P. H.; Trojanowski, J. Q.; Lee, V. M.-Y.: Frontotemporal dementia with novel tau pathology and a glu342val tau mutation. Ann. Neurol. 48:850-858, 2000.

Litvan, I.; Baker, M.; Hutton, M.: Tau genotype: no effect on onset, symptom severity, or survival in progressive supranuclear palsy. Neurology 57:138-140, 2001.

Lewis, J.; McGowan, E.; Rockwood, J.; Melrose, H.; Nacharaju, P.; Van Slegtenhorst, M.; Gwinn-Hardy, K.; Murphy, M. P.; Baker, M.; Yu, X.; Duff, K.; Hardy, J.; Corral, A.; Lin, W.-L.; Yen, S.-H.; Dickson, D. W.; Davies, P.; Hutton, M.: Neurofibrillary tangles, amyotrophy and progressive motor disturbance in mice expressing mutant (P301L) tau protein. Nature Genet. 25:402-405, 2000. Note: Erratum: Nature Genet. 26:127 only, 2000.

Martin, E. R.; Scott, W. K.; Nance, M. A.; Watts, R. L.; Hubble, J. P.; Koller, W. C.; Lyons, K.; Pahwa, R.; Stern, M. B.; Colcher, A.; Hiner, B. C.; Jankovic, J.; and 20 others: Association of single-nucleotide polymorphisms of the Tau gene with late-onset Parkinson disease. J. A. M. A. 286:2245-2250, 2001.

Moser, A. B.; Rasmussen, M.; Naidu, S.; Watkins, P. A.; McGuinness, M.; Hajra, A. K.; Chen, G.; Raymond, G.; Liu, A.; Gordon, D.; Garnaas, K.; Walton, D. S.; Skjedal, O. H.; Guggenheim, M. A.; Jackson, L. G.; Elias, E. R.; Moser, H. W.: Phenotype of patients with peroxisomal disorders subdivided into sixteen complementation groups. J. Pediat. 127: 13-22, 1995.

Paton, B. C.; Heron, S. E.; Nelson, P. V.; Morris, C. P.; Poulos, A.: Absence of mutations raises doubts about the role of the 70-kD peroxisomal membrane protein in Zellweger syndrome. (Letter) Am. J. Hum. Genet. 60:1535-1539, 1997.

Nicklin, M. J. H.; Weith, A.; Duff, G. W.: A physical map of the region encompassing the human interleukin-1-alpha, interleukin-1-beta, and interleukin-1 receptor antagonist genes. Genomics 19:382-384,1994.

Samad, T. A.; Moore, K. A.; Sapirstein, A.; Billet, S.; Allchorne, A.; Poole, S.; Bonventre, J. V.; Woolf, C. J.: Interleukin-1-beta-mediated induction of Cox-2 in the CNS contributes to inflammatory pain hypersensitivity. Nature 410: 471-475, 2001.

Webb, A.; Collins, K.; Auron, P.; Eddy, R.; Nakai, H.; Byers, M.; Shows, T. B.: Genetics of acute phase response: a gene for interleukin-1is on chromosome 2. (Abstract) Am. J. Hum. Genet. 37: A142 only,1985.

Ames, G. F.-L.: The basis of multidrug resistance in mammalian cells: homology with bacterial transport. Cell 47:323-324, 1986.

Baldini, N.; Scotlandi, K.; Barbanti-Brodano, G.; Manara, M. C.; Maurici, D.; Bacci, G.; Bertoni, F.; Picci, P.; Sottili, S.; Campanacci, M.; Serra, M.: Expression of P-glycoprotein in high-grade osteosarcomas in relation to clinical outcome. New Eng. J. Med. 333:1380-1385,1995.

Bell, D. R.; Trent, J. M.; Willard, H. F.; Riordan, J. R.; Ling, V.: Chromosomal location of human P-glycoprotein gene sequences. Cancer Genet. Cytogenet. 25:141-148, 1987.

Callen, D. F.; Baker, E.; Simmers, R. N.; Seshadri, R.; Roninson, I. B.: Localization of the human multiple drug resistance gene, MDR1, to 7q21.1. Hum. Genet. 77:142-144, 1987.

Chan, H. S. L.; Haddad, G.; Thorner, P. S.; DeBoer, G.; Lin, Y. P.; Ondrusek, N.; Yeger, H.; Ling, V.: P-glycoprotein expression as a predictor of the outcome of therapy for neuroblastoma. New Eng. J. Med. 325:1608-1614, 1991.

Chang, G.; Roth, C. B.: Structure of MsbA from E. coli: a homolog of the multidrug resistance ATP binding cassette (ABC) transporters. Science 293:1793-1800, 2001.

Chen, C.; Chin, J. E.; Ueda, K.; Clark, D. P.; Pastan, I.; Gottesman, M. M.; Roninson, I. B.: Internal duplication and homology with bacterial transport proteins in the mdr1 (P-glycoprotein) gene from multidrug-resistant human cells. Cell 47:381-389, 1986.

Choi, K. H.; Chen, C.-J.; Kriegler, M.; Roninson, I. B.: An altered pattern of cross-resistance in multidrug-resistant human cells results from spontaneous mutations in the mdr1 (P-glycoprotein) gene. Cell 53:519-529, 1988.

Croop, J. M.; Gros, P.; Housman, D. E.: Genetics of multidrug resistance. J. Clin. Invest. 81:1303-1309, 1988.

de Lannoy, I. A. M.; Silverman, M.: The MDR1 gene product, P-glycoprotein, mediates the transport of the cardiac glycoside, digoxin. Biochem. Biophys. Res. Commun. 189: 551-557, 1992.

Cameron, P.; Limjuco, G.; Rodkey, J.; Bennett, C.; Schmidt, J. A.: Amino acid sequence analysis of human interleukin 1 (IL-1): evidence for biochemically distinct forms of IL-1. J. Exp. Med. 162:790-801,1985.

d'Eustachio, P.; Jadidi, S.; Fuhlbrigge, R. C.; Gray, P. W.; Chaplin, D. D.: Interleukin-1 alpha and beta genes: linkage on chromosome 2 in the mouse. Immunogenetics 26:339-343, 1987.

Dinarello, C. A.: An update on human interleukin-1: from molecular biology to clinical relevance. J. Clin. Immun. 5:287-297, 1985.

Furutani, Y.; Notake, M.; Yamayoshi, M.; Yamagishi, J.; Nomura, H.; Ohue, M.; Furuta, R.; Fukui, T.; Yamada, M.; Nakamura, S.: Cloning and characterization of the cDNAs for human and rabbit interleukin-1 precursor. Nucleic Acids Res. 13:5869-5882, 1985.

Hamajima, N.; Matsuo, K.; Saito, T.; Tajima, K.; Okuma, K.; Yamao, K.; Tominaga, S.: Interleukin 1 polymorphisms, lifestyle factors, and helicobacter pylori infection. Jpn. J. Cancer Res. 92:383-389,2001.

Le Beau, M. M.; Rowley, J. D.: Personal Communication. Chicago, Ill. Jun. 18, 1986.

March, C. J.; Mosley, B.; Larsen, A.; Cerretti, D. P.; Braedt, G.; Price, V.; Gillis, S.; Henney, C. S.; Kronheim, S. R.; Grabstein, K.; Conlon, P. J.; Hopp, T. P.; Cosman, D.: Cloning, sequence and expression of two distinct human interleukin-1 complementary DNAs. Nature 315:641-647, 1985.

El-Omar, E. M.; Carrington, M.; Chow, W.-H.; McColl, K. E. L.; Bream, J. H.; Young, H. A.; Herrera, J.; Lissowska, J.; Yuan, C.-C.; Rothman, N.; Lanyon, G.; Martin, M.; Fraumeni, J. F., Jr.; Rabkin, C. S.: Interleukin-1 polymorphisms associated with increased risk of gastric cancer. Nature 404: 398-402, 2000. Note: Erratum: Nature412:99 only, 2001.

Vidal-Vanaclocha, F.; Fantuzzi, G.; Mendoza, L.; Fuentes, A. M.; Anasagasti, M. J.; Martin, J.; Carrascal, T.; Walsh, P.; Reznikov, L. L.; Kim, S.-H.; Novick, D.; Rubinstein, M.; Dinarello, C. A.:IL-18 regulates IL-1-beta-dependent hepatic melanoma metastasis via vascular cell adhesion molecule-1. Proc. Nat. Acad. Sci. 97:734-739,2000.

Webb, A. C.; Collins, K. L.; Auron, P. E.; Eddy, R. L.; Nakai, H.; Byers, M.; Shows, T. B.: The gene for interleukin-1 (IL1) is on human chromosome 2. (Abstract) Cytogenet. Cell Genet. 40:774only, 1985.

Webb, A. C.; Collins, K. L.; Auron, P. E.; Eddy, R. L.; Nakai, H.; Byers, M. G.; Haley, L. L.; Henry, W. M.; Shows, T. B.: Interleukin-1gene (IL1) assigned to long arm of human chromosome 2. Lymphokine Res. 5:77-85, 1986.

Ansano, M.; Toda, M.; Sakaguchi, N.; Sakaguchi, S.: Autoimmune disease as a consequence of developmental abnormality of a T cell subpopulation. J. Exp. Med. 184:387-396, 1996.

Cosman, D.; Cerretti, D. P.; Larsen, A.; Park, L.; March, C.; Dower, S.; Gillis, S.; Urdal, D.: Cloning, sequence and expression of human interleukin-2 receptor. Nature 312:768-771, 1984.

Ferrari, S.; Cannizzaro, L. A.; Battini, R.; Huebner, K.; Baserga, R.: The gene encoding human vimentin is located on the short arm of chromosome 10. Am. J. Hum. Genet. 41:616-626, 1987.

Greene, W. C.; Leonard, W. J.; Depper, J. M.; Nelson, D. L.; Waldmann, T. A.: The human interleukin-2 receptor: normal and abnormal expression in T cells and in leukemias induced by the human T-lymphotropic retroviruses. Ann. Intern. Med. 105:560-572, 1986.

Hatakeyama, M.; Minamoto, S.; Taniguchi, T.: Intracytoplasmic phosphorylation sites of Tac antigen (p55) are not essential for the conformation, function, and regulation of the human interleukin 2receptor. Proc. Nat. Acad. Sci. 83:9650-9654, 1986.

Hatakeyama, M.; Minamoto, S.; Uchiyama, T.; Hardy, R. R.; Yamada, G.; Taniguchi, T.: Reconstitution of functional receptor for human interleukin-2 in mouse cells. Nature 318: 467-470, 1985.

Ihle, J. N.; Kerr, I. M.: Jaks and Stats in signaling by the cytokine receptor superfamily. Trends Genet. 11:69-74, 1995.

Ishida, N.; Kanamori, H.; Noma, T.; Nikaido, T.; Sabe, H.; Suzuki, N.; Shimizu, A.; Honjo, T.: Molecular cloning and structure of the human interleukin 2 receptor gene. Nucleic Acids Res. 13:7579-7589,1985.

Kondo, S.; Shimizu, A.; Maeda, M.; Tagaya, Y.; Yodoi, J.; Honjo, T.: Expression of functional human interleukin-2 receptor in mouse T cells by cDNA transfection. Nature 320: 75-77, 1986.

Leonard, W. J.; Depper, J. M.; Crabtree, G. R.; Rudikoff, S.; Pumphrey, J.; Robb, R. J.; Kronke, M.; Svetlik, P. B.; Peffer, N. J.; Waldmann, T. A.; Greene, W. C.: Molecular cloning and expression of cDNAs for the human interleukin-2 receptor. Nature 311:626-631,1984.

Dahia, P. L. M.; Aguiar, R. C. T.; Alberta, J.; Kum, J. B.; Caron, S.; Sill, H.; Marsh, D. J.; Ritz, J.; Freedman, A.; Stiles, C.; Eng, C.: PTEN is inversely correlated with the cell survival factor Akt/PKB and is inactivated via multiple mechanisms in haematological malignancies. Hum. Molec. Genet. 8:185-193, 1999.

Bryson, G. L. M.; Massa, H.; Trask, B. J.; Van Etten, R. L.: Gene structure, sequence, and chromosomal localization of the human red cell-type low molecular weight acid phosphotyrosyl phosphatase gene, ACP1. Genomics 30:133-140, 1995.

Chen, T.-R.; McMorris, F. A.; Creagan, R.; Ricciuti, F. C.; Tischfield, J.; Ruddle, F. H.: Assignment of the genes for malate oxidoreductase decarboxylating to chromosome 6 and peptidase B and lactate dehydrogenase B to chromosome 12 in man. Am. J. Hum. Genet. 25:200-207, 1973.

Hamerton, J. L.; Mohandas, T.; McAlpine, P. J.; Douglas, G. R.: Localization of human gene loci using spontaneous chromosome rearrangements in human-Chinese hamster somatic cell hybrids. Am. J. Hum. Genet. 27:595-608, 1975.

Herbschleb-Voogt, E.; Meera Khan, P.: Defining the locus of origin of a genetically determined electrophoretic variant of a multilocus enzyme system; the Calcutta-1 of human LDH system is a B-locus variant. Hum. Genet. 57:290-295, 1981.

Houki, N.; Matsushima, Y.; Kitamura, M.; Tukada, T.; Nishina, T.; Nakayama, T.: A case of deficiency of lactate dehydrogenase H-subunit. Jpn. J. Clin. Chem. 15:85-90, 1986.

Kitamura, M.; Iijima, N.; Hashimoto, F.; Hiratsuka, A.: Hereditary deficiency of subunit H of lactate dehydrogenase. Clin. Chim. Acta 34:419-423, 1971.

Maekawa, M.; Sudo, K.; Kitajima, M.; Matsuura, Y.; Li, S. S.-L.; Kanno, T.: Analysis of a genetic mutation in an electrophoretic variant of the human lactate dehydrogenase-B(H) subunit. Hum. Genet. 91:423-426, 1993.

Maekawa, M.; Sudo, K.; Nagura, K.; Li, S. S.-L.; Kanno, T.: Population screening of lactate dehydrogenase deficiencies in Fukuoka Prefecture in Japan and molecular characterization of three independent mutations in the lactate dehydrogenase-B(H) gene. Hum. Genet. 93:74-76, 1994.

Malpuech, G.; Kaplan, J. C.; Rethore, M. O.; Junien, C.; Geneix, A.: Une observation de deletion partielle du bras court du chromosome 12: localisation du gene de la lactico deshydrogenase B. Lyon Med. 233:275-279, 1975.

Mayeda, K.; Weiss, L.; Lindahl, R.; Dully, M.: Localization of the human lactate dehydrogenase B gene on the short arm of chromosome 12. Am. J. Hum. Genet. 26:59-64, 1974.

Miwa, S.; Nishima, T.; Kanehashi, Y.; Kitamura, M.; Hiratsuka, A.; Shizume, K.: Studies on erythrocyte metabolism in a case with hereditary deficiency of H-subunit of lactate dehydrogenase. Acta Haemat. Jpn. 34:228-232, 1971.

Dudek, H.; Datta, S. R.; Franke, T. F.; Birnbaum, M. J.; Yao, R.; Cooper, G. M.; Segal, R. A.; Kaplan, D. R.; Greenberg, M. E.: Regulation of neuronal survival by the serine-threonine protein kinase Akt. Science 275:661-663, 1997.

Franke, T. F.; Kaplan, D. R.; Cantley, L. C.; Toker, A.: Direct regulation of the Akt proto-oncogene product by phosphatidyl inositol-3,4-bisphosphate. Science 275:665-667, 1997.

Franke, T. F.; Yang, S.-I.; Chan, T. O.; Datta, K.; Kaziauskas, A.; Morrison, D. K.; Kaplan, D. R.; Tsichlis, P. N.: The protein kinase encoded by the Akt proto-oncogene is a target of the PDGF-activated phosphatidyl inositol 3-kinase. Cell 81:727-736, 1995.

Furnari, F. B.; Huang, H. J.; Cavenee, W. K.: The phosphoinositol phosphatase activity of PTEN mediates a serum-sensitive G1 growth arrest in glioma cells. Cancer Res. 58:5002-5008, 1998.

Hajduch, E.; Litherland, G. J.; Hundal, H. S.: Protein kinase B (PKB/Akt)--a key regulator of glucose transport? FEBS Lett. 492:199-203, 2001.

Hemmings, B. A.: Akt signaling: linking membrane events to life and death decisions. Science 275:628-630, 1997.

Jones, P. F.; Jakubowicz, T.; Pitossi, F. J.; Maurer, F.; Hemmings, B. A.: Molecular cloning and identification of a serine/threonine protein kinase of the second-messenger subfamily. Proc. Nat. Acad. Sci. 88:4171-4175, 1991.

Lee, M.-J.; Thangada, S.; Paik, J.-H.; Sapkota, G. P.; Ancellin, N.; Chae, S.-S.; Wu, M.; Morales-Ruiz, M.; Sessa, W. C.; Alessi, D. R.; Hla, T.: Akt-mediated phosphorylation of the G protein-coupled receptor EDG-1 is required for endothelial cell chemotaxis. Molec. Cell 8:693-704, 2001.

Maira, S.-M.; Galetic, I.; Brazil, D. P.; Kaech, S.; Ingley, E.; Thelen, M.; Hemmings, B. A.: Carboxyl-terminal modulator protein (CTMP), a negative regulator of PKB/Akt and v-Akt at the plasma membrane. Science 294:374-380, 2001.

Powell, D. W.; Rane, M. J.; Chen, Q.; Singh, S.; McLeish, K. R.: Identification of 14-3-3-zeta as a protein kinase B/Akt substrate. J. Biol. Chem. 277:21639-21642, 2002.

Staal, S. P.: Molecular cloning of the akt oncogene and its human homologues AKT1 and AKT2: amplification of AKT1 in a primary human gastric adenocarcinoma. Proc. Nat. Acad. Sci. 84:5034-5037, 1987.

Staal, S. P.; Huebner, K.; Croce, C. M.; Parsa, N. Z.; Testa, J. R.: The AKT1 proto-oncogene maps to human chromosome 14, bandq32. Genomics 2:96-98, 1988.

Vanhaesebroeck, B.; Alessi, D. R.: The PI3K-PDK1 connection: more than just a road to PKB. Biochem. J. 346:561-576, 2000.

Weng, L.-P.; Brown, J. L.; Eng, C.: PTEN induces apoptosis and cell cycle arrest through phosphoinositol-3-kinase/Akt-dependent and-independent pathways. Hum. Molec. Genet. 10:237-242, 2001.

Yang, J.; Cron, P.; Thompson, V.; Good, V. M.; Hess, D.; Hemmings, B. A.; Barford, D.: Molecular mechanism for the regulation of protein kinase B/Akt by hydrophobic motif phosphorylation. Molec. Cell 9:1227-1240, 2002.

Le Beau, M. M.; Rowley, J. D.; Sacchi, N.; Watson, D. K.; Papas, T. S.; Diaz, M. O.: Hu-ets-2 is translocated to chromosome 8 in the t (8;21) in acute myelogenous leukemia. Cancer Genet. Cytogenet. 23:269-274, 1986.

Mavrothalassitis, G. J.; Watson, D. K.; Papas, T. S.: Molecular and functional characterization of the promoter of ETS2, the human C-ets-2 gene. Proc. Nat. Acad. Sci. 87:1047-1051, 1990.

Sacchi, N.; Cheng, S. V.; Tanzi, R. E.; Gusella, J. F.; Drabkin, H. A.; Patterson, D.; Haines, J. H.; Papas, T. S.: The ETS genes on chromosome 21 are distal to the breakpoint of the acute myelogenous leukemia translocation (8;21). Genomics 3:110-116, 1988.

Sumarsono, S. H.; Wilson, T. J.; Tymms, M. J.; Venter, D. J.; Corrick, C. M.; Kola, R.; Lahoud, M. H.; Papas, T. S.; Seth, A.; Kola, I.:Down's syndrome-like skeletal abnormalities in Ets2 transgenic mice. Nature 379:534-540, 1996.

Chu, E. H. Y.; Chang, C. C.; Sun, N. C.: Synteny of the human genes for gal-1-PT, ACP-1, MDH-1, and gal-plus-activator and assignment to chromosome 2. Birth Defects Orig. Art. Ser. XI(3):103-106, 1975. Note: Alternate: Cytogenet. Cell Genet. 14:273-276, 1975..

Rasmussen, S. K.; Lautier, C.; Hansen, L.; Echwald, S. M.; Hansen, T.; Ekstrom, C. T.; Urhammer, S. A.; Borch-Johnsen, K.; Grigorescu, F.; Smith, R. J.; Pedersen, O.: Studies of the variability of the genes encoding the insulin-like growth factor I receptor and its ligand in relation to type 2 diabetes mellitus. J. Clin. Endocr. Metab. 85:1606-1610, 2000.

Dissing, J.; Johnsen, A. H.: Human red cell acid phosphatase (ACP1):the primary structure of the two pairs of isozymes encoded by the ACP1*A and ACP1*C alleles. Biochim. Biophys. Acta 1121:261-268,1992.

Dissing, J.; Johnsen, A. H.; Sensabaugh, G. F.: Human red cell acid phosphatase (ACP1): the amino acid sequence of the two isozymes Bf and Bs encoded by the ACP1*B allele. J. Biol. Chem. 266:20619-20625,1991.

Emanuel, B. S.; Zackai, E. H.; Van Dyke, D. C.; Swallow, D. M.; Allen, F. H.; Mellman, W. J.: Deletion mapping: further evidence for the location of acid phosphatase (ACP-1) within 2p23. Am. J. Med. Genet. 4:167-172, 1979.

Ferguson-Smith, M. A.; Newman, B. F.; Ellis, P. M.; Thomson, D. M. G.; Riley, I. D.: Assignment by deletion of human red cell acid phosphatase gene locus to the short arm of chromosome 2. Nature 243:271-273, 1973.

Fisher, R. A.; Harris, H.: Studies on the separate isoenzymes of red cell acid phosphatase phenotypes A and B: chromatographic separation of the isoenzymes. Ann. Hum. Genet. 34:431-438, 1971.

Fuhrmann, W.; Lichte, K. H.: Human red cell acid phosphatase polymorphism: a study on gene frequency and forensic use of the system in cases of disputed paternity. human genetik 3:121-126, 1966.

Giblett, E. R.; Scott, N. M.: Red cell acid phosphatase: racial distribution and report of a new phenotype. Am. J. Hum. Genet. 17:425-432, 1965.

Herbich, J.; Fisher, R. A.; Hopkinson, D. A.: Atypical segregation of human red cell acid phosphatase phenotypes: evidence for a rare'silent' allele P(O). Ann. Hum. Genet. 34:145-152, 1970.

Herbich, J.; Meinhart, K.: The rare 'silent' allele P(O) or P(V)(P Vienna) of human red cell acid phosphatase, typed in a second family. human genetik 15:345-348, 1972.

Hopkinson, D. A.; Spencer, N.; Harris, H.: Red cell acid phosphatase variants: a new human polymorphism. Nature 199:969-971, 1963.

Hulten, M.; Lindsten, J.; Pen-Ming, L. M.; Fraccaro, M.; Mannini, A.; Tiepolo, L.; Robson, E. B.; Heiken, A.; Tillinger, K. G.: Possible localization of the genes for the Kidd blood group on an autosome involved in a reciprocal translocation. Nature 211:1067-1068, 1966.

Junien, C.; Kaplan, J.-C.; Bernheim, A.; Berger, R.: Regional assignment of red cell acid phosphatase locus to band 2p25. Hum. Genet. 48:17-21, 1979.

Karp, G. W., Jr.; Sutton, H. E.: Some new phenotypes of human red cell acid phosphatase. Am. J. Hum. Genet. 19:54-62, 1967.

Lothe, R. A.; Gedde-Dahl, T.; Olaisen, B.; Bakker, E.; Pearson, P.: Very close linkage between D2S1 and ACP1 on chromosome 2p. Ann. Hum. Genet. 50:361-367, 1986.

Mace, M. A.; Cook, P. J. L.; Robson, E. B.: Linkage data on red cell acid phosphatase from family studies. Ann. Hum. Genet. 38:471-477, 1975.

Mace, M. A.; Robson, E. B.: Linkage data on ACP-1 and MNSs. Cytogenet. Cell Genet. 13:123-125, 1974.

Magenis, R. E.; Koler, R. D.; Lovrien, E. W.; Bigley, R. H.; Duval, M. C.; Overton, K. M.: Gene dosage: evidence for assignment of erythrocyte acid phosphatase locus to chromosome 2. Proc. Nat. Acad. Sci. 72:4526-4530, 1975.

Mayr, W. R.: No close linkage between MNSs and red cell acid phosphatase. Hum. Hered. 26:1-3, 1976.

Miller, S. A.; Nelson, M. S.; Dykes, D. D.; Polesky, H. F.: Comparison of acid phosphatase ACP1 variants by isoelectric focusing and conventional electrophoresis: identification of three new alleles, ACP1*N, ACP1*P and ACP1*S. Hum. Hered. 37:371-375, 1987.

Mohrenweiser, H. W.; Novotny, J. E.: ACP-1-GUA-1: a low-activity variant of human erythrocyte acid phosphatase: association with increased glutathione reductase activity. Am. J. Hum. Genet. 34:425-433,1982.

Nezbeda, P.: Occurrence of the ACP-1 null allele in Czechoslovakia. Hum. Genet. 46:227-229, 1979.

Palmarino, R.; Agostino, R.; Gloria, F.; Lucarelli, P.; Businco, L.; Antognoni, G.; Maggioni, G.; Workman, P. L.; Bottini, E.: Red cell acid phosphatase: another polymorphism correlated with malaria? Am. J. Phys. Anthrop. 43:177-186, 1975.

Povey, S.; Swallow, D. M.; Bobrow, M.; Craig, I.; Van Heyningen, V.: Probable assignment of the locus determining human red cell acid phosphatase ACP(1) to chromosome 2 using somatic cell hybrids. Ann. Hum. Genet. 38:1-5, 1974.

Renwick, J. H.: Assignment and map-positioning of human loci using chromosomal variation. Ann. Hum. Genet. 35:79-97, 1971.

Sensabaugh, G. F.; Golden, V. L.: Phenotype dependence in the inhibition of red cell acid phosphatase (ACP) by folates. Am. J. Hum. Genet. 30:553-560, 1978.

Swallow, D. M.; Povey, S.; Harris, H.: Activity of the 'red cell' acid phosphatase locus in other tissues. Ann. Hum. Genet. 37:31-38,1973.

Levy, J. B.; Canoll, P. D.; Silvennoinen, O.; Barnea, G.; Morse, B.; Honegger, A. M.; Huang, J.-T.; Cannizzaro, L. A.; Park, S.-H.; Druck, T.; Huebner, K.; Sap, J.; Ehrlich, M.; Musacchio, J. M.; Schlessinger, J.: The cloning of a receptor-type protein tyrosine phosphatase expressed in the central nervous system. J. Biol. Chem. 268:10573-10581,1993.

Berube, D.; Simard, J.; Sandberg, M.; Grzeschik, K.-H.; Gagne, R.; Hansson, V.; Jahnsen, T.: Assignment of the gene encoding the catalytic subunit C(beta) of cAMP-dependent protein kinase to the p36 band on chromosome 1. (Abstract) Cytogenet. Cell Genet. 58:1850 only, 1991.

Leonard, W. J.; Depper, J. M.; Kanehisa, M.; Kronke, M.; Peffer, N. J.; Svetlik, P. B.; Sullivan, M.; Greene, W. C.: Structure of the human interleukin-2 receptor gene. Science 230:633-639, 1985.

Leonard, W. J.; Depper, J. M.; Robb, R. J.; Waldmann, T. A.; Greene, W. C.: Characterization of the human receptor for T-cell growth factor. Proc. Nat. Acad. Sci. 80:6957-6961, 1983.

Marx, J. L.: The interleukin-2 receptor gene is cloned. Science 226:1064-1065, 1985.

Nikaido, T.; Shimizu, A.; Ishida, N.; Sabe, H.; Teshigawara, K.; Maeda, M.; Uchiyama, T.; Yodoi, J.; Honjo, T.: Molecular cloning of a cDNA encoding human interleukin-2 receptor. Nature 311:631-635,1984.

Robb, R. J.; Rusk, C. M.; Neeper, M. P.: Structure-function relationships for the interleukin 2 receptor: location of ligand and antibody binding sites on the Tac receptor chain by mutational analysis. Proc. Nat. Acad. Sci. 85:5654-5658, 1988.

Sharfe, N.; Dadi, H. K.; Shahar, M.; Roifman, C. M.: Human immune disorder arising from mutation of the alpha chain of the interleukin-2receptor. Proc. Nat. Acad. Sci. 94:3168-3171, 1997.

Shevach, E. M.: Certified professionals: CD4(+)CD25(+) suppressor T cells. J. Exp. Med. 193: F41-F45, 2001.

Tsudo, M.; Kozak, R. W.; Goldman, C. K.; Waldmann, T. A.: Demonstration of a non-Tac peptide that binds interleukin 2: a potential participant in a multichain interleukin 2 receptor complex. Proc. Nat. Acad. Sci. 83:9694-9698, 1986.

Urdal, D. L.; March, C. J.; Gillis, S.; Larsen, A.; Dower, S. K.: Purification and chemical characterization of the receptor for interleukin 2 from activated human T lymphocytes and from a human T-cell lymphoma cell line. Proc. Nat. Acad. Sci. 81:6481-6485,1984.

Mohrenweiser, H. W.; Neel, J. V.: Frequency of thermostability variants: estimation of total 'rare' variant frequency in human populations. Proc. Nat. Acad. Sci. 78:5729-5733, 1981.

Gervais, F. G.; Singaraja, R.; Xanthoudakis, S.; Gutekunst, C.-A.; Leavitt, B. R.; Metzler, M.; Hackam, A. S.; Tam, J.; Vaillancourt, J. P.; Houtzager, V.; Rasper, D. M.; Roy, S.; Hayden, M. R.; Nicholson, D. W.: Recruitment and activation of caspase-8 by the huntingtin-interacting protein Hip-1 and a novel partner Hippi. Nature Cell Biol. 4:95-105,2002.

Abbott, A. M.; Bueno, R.; Pedrini, M. T.; Murray, J. M.; Smith, R. J.: Insulin-like growth factor I receptor gene structure. J. Biol. Chem. 267:10759-10763, 1992.

All-Ericsson, C.; Girnita, L.; Seregard, S.; Bartolazzi, A.; Jager, M. J.; Larsson, O.: Insulin-like growth factor-1 receptor in uveal melanoma: a predictor for metastatic disease and a potential therapeautic target. Invest. Ophthal. Vis. Sci. 43:1-8, 2002.

Cooke, D. W.; Bankert, L. A.; Roberts, C. T., Jr.; LeRoith, D.; Casella, S. J.: Analysis of the human type I insulin-like growth factor receptor promoter region. Biochem. Biophys. Res. Commun. 177:1113-1120, 1991.

Dey, B. R.; Furlanetto, R. W.; Nissley, S. P.: Cloning of human P55-gamma, a regulatory subunit of phosphatidyl inositol 3-kinase, by a yeast two-hybrid library screen with the insulin-like growth factor-I receptor. Gene 209:175-183, 1998.

Fernandez, A. M.; Kim, J. K.; Yakar, S.; Dupont, J.; Hernandez-Sanchez, C.; Castle, A. L.; Filmore, J.; Shulman, G. I.; Le Roith, D.: Functional inactivation of the IGF-I and insulin receptors in skeletal muscle causes type 2 diabetes. Genes Dev. 15:1926-1934, 2001.

Flier, J. S.; Usher, P.; Moses, A. C.: Monoclonal antibody to the type I insulin-like growth factor (IGF-I) receptor blocks IGF-I receptor-mediated DNA synthesis: clarification of the mitogenic mechanisms of IGF-I and insulin in human skin fibroblasts. Proc. Nat. Acad. Sci. 83:664-668, 1986.

Francke, U.; Yang-Feng, T. L.; Brissenden, J. E.; Ullrich, A.:Chromosomal mapping of genes involved in growth control. Cold Spring Harbor Symp. Quant. Biol. 51:855-866, 1986.

Grant, E. S.; Ross, M. B.; Ballard, S.; Naylor, A.; Habib, F. K.: The insulin-like growth factor type I receptor stimulates growth and suppresses apoptosis in prostatic stromal cells. J. Clin. Endocr. Metab. 83:3252-3257, 1998.

Herskowitz, I.: Functional inactivation of genes by dominant negative mutations. Nature 329:219-222, 1987.

Howard, T. K.; Algar, E. M.; Glatz, J. A.; Reeve, A. E.; Smith, P. J.: The insulin-like growth factor 1 receptor gene is normally biallelically expressed in human juvenile tissue and tumours. Hum. Molec. Genet. 2:2089-2092, 1993.

Kulkarni, R. N.; Holzenberger, M.; Shih, D. Q.; Ozcan, U.; Stoffel, M.; Magnuson, M. A.; Kahn, C. R.: Beta-cell-specific deletion of the Igf1 receptor leads to hyperinsulinemia and glucose intolerance but does not alter beta-cell mass. Nature Genet. 31:111-115, 2002.

Maor, S. B.; Abramovitch, S.; Erdos, M. R.; Brody, L. C.; Werner, H.: BRCA1 suppresses insulin-like growth factor-I receptor promoter activity: potential interaction between BRCA1 and Sp1. Molec. Genet. Metab. 69:130-136, 2000.

Poduslo, S. E.; Dean, M.; Kolch, U.; O'Brien, S. J.: Detecting high-resolution polymorphisms in human coding loci by combining PCR and single-strand conformation polymorphism (SSCP) analysis. Am. J. Hum. Genet. 49:106-111, 1991.

Prager, D.; Yamasaki, H.; Weber, M. M.; Gebremedhin, S.; Melmed, S.: Human insulin-like growth factor I receptor function in pituitary cells is suppressed by a dominant negative mutant. J. Clin. Invest. 90:2117-2122, 1992.

Roback, E. W.; Barakat, A. J.; Dev, V. G.; Mbikay, M.; Chretien, M.; Butler, M. G.: An infant with deletion of the distal long arm of chromosome 15 (q26.1-qter) and loss of insulin-like growth factor1 receptor gene. Am. J. Med. Genet. 38:74-79, 1991.

Okumura, N.; Terasawa, F.; Ueno, I.; Oki, K.; Yamauchi, K.; Hidaka, H.; Tozuka, M.; Okura, M.; Katsuyama, T.: Genetic analyses in homozygous and heterozygous variants of lactate dehydrogenase-B (H) subunit: LD-B Matsumoto I and II (LD-B W323R). Clin. Chim. Acta 287:163-171,1999.

Rethore, M.-O.; Junien, C.; Malpuech, G.; Baccichetti, C.; Tenconi, R.; Kaplan, J. C.; de Romeuf, J.; Lejeune, J.: Localisation du genede la glyceraldehyde 3-phosphate dehydrogenase (G3PD) sur le segment distal du bras court du chromosome 12. Ann. Genet. 19:140-142,1976.

Rethore, M.-O.; Kaplan, J.-C.; Junien, C.; Cruveiller, J.; Dutrillaux, B.; Aurias, A.; Carpentier, S.; Lafourcade, J.; Lejeune, J.: Augmentation de l'activite de la LDH-B chez un garcon trisomique 12p par malsegregation d'une translocation maternelle t (12;14)(q12; p11). Ann. Genet. 18:81-87, 1975.

Sakai, I.; Sharief, F. S.; Pan, Y.-C. E.; Li, S. S.-L.: The cDNA and protein sequences of human lactate dehydrogenase B. Biochem. J. 248:933-936, 1987.

Santachiara, A. S.; Nabholz, M.; Miggiano, V.; Darlington, A. J.; Bodmer, W. F.: Linkage between human lactate dehydrogenase Band peptidase B genes. Nature 227:248-251, 1970.

Steinbach, P.; Rehder, H.: Tetrasomy for the short arm of chromosome 12 with accessory isochromosome (+i[12p]) and a marked LDH-B gene dosage effect. Clin. Genet. 32:1-4, 1987.

Sudo, K.: Personal Communication. Komae City, Japan Jul. 12, 1993.

Sudo, K.; Maekawa, M.; Ikawa, S.; Machida, K.; Kitamura, M.; Li, S. S.-L.: A missense mutation found in human lactate dehydrogenase-B(H) variant gene. Biochem. Biophys. Res. Commun. 168:672-676, 1990.

Sudo, K.; Maekawa, M.; Luedemann, M. M.; Deaven, L. L.; Li, S. S.-L.: Human lactate dehydrogenase-B processed pseudogene: Nucleotide sequence analysis and assignment to the X-chromosome. Biochem. Biophys. Res. Commun. 171: 67-74, 1990.

Sudo, K.; Maekawa, M.; Tomonaga, A.; Tsukada, T.; Nakayama, T.; Kitamura, M.; Li, S. S.-L.; Kanno, T.; Toriumi, J.: Molecular characterization of genetic mutations in human lactate dehydrogenase (LDH)B (H) variant. Hum. Genet. 89:158-162, 1992.

Van Someren, H.; Meera Khan, P.; Westerveld, A.; Bootsma, D.:Human genetics--two new linkage groups carrying different loci for LDH and glutamic-pyruvic transaminase found. Nature 240:221-222,1972.

Weiss, L.; Mayeda, K.; Lindahl, R.; Dully, M.: Localization of human LDH-B gene of the short arm of chromosome 12. (Abstract) Am. J. Hum. Genet. 25:85A only, 1973.

Zhong, S.; Delva, L.; Rachez, C.; Cenciarelli, C.; Gandini, D.; Zhang, H.; Kalantry, S.; Freedman, L. P.; Pandolfi, P. P.: A RA-dependent, tumour-growth suppressive transcription complex is the target of the PML-RAR-alpha and T18 oncoproteins. Nature Genet. 23:287-295, 1999.

Fukuyama, R.; Ichijoh, Y.; Minoshima, S.; Kitamura, N.; Shimizu, N.: Assignment of hepatocyte growth factor (HGF) gene to chromosome 7q21.1. (Abstract) Cytogenet. Cell Genet. 58:1921 only, 1991.

Fukuyama, R.; Ichijoh, Y.; Minoshima, S.; Kitamura, N.; Shimizu, N.: Regional localization of the hepatocyte growth factor (HGF) gene to human chromosome 7 band q21.1. Genomics 11:410-415, 1991.

Gherardi, E.; Stoker, M.: Hepatocytes and scatter factor. Nature 346:228 only, 1990.

Gohda, E.; Tsubouchi, H.; Nakayama, H.; Hirono, S.; Sakiyama, O.; Takahashi, K.; Miyazaki, H.; Hashimoto, S.; Daikuhara, Y.: Purification and partial characterization of hepatocyte growth factor from plasma of a patient with fulminant hepatic failure. J. Clin. Invest. 81:414-419, 1988.

Kilby, M. D.; Afford, S.; Li, X. F.; Strain, A. J.; Ahmed, A.; Whittle, M. J.: Localisation of hepatocyte growth factor and its receptor (c-met) protein and mRNA in human term placenta. growth factors 13:133-139, 1996.

Lai, L.; Goldschneider, I.: Cutting edge: identification of a hybrid cytokine consisting of IL-7 and the beta-chain of the hepatocyte growth factor/scatter factor. J. Immun. 167:3550-3554, 2001.

Maina, F.; Casagranda, F.; Audero, E.; Simeone, A.; Comoglio, P. M.; Klein, R.; Ponzetto, C.: Uncoupling of Grb2 from the Met receptor in vivo reveals complex roles in muscle development. Cell 87:531-542,1996.

Miyazawa, K.; Tsubouchi, H.; Naka, D.; Takahashi, K.; Okigaki, M.; Arakaki, N.; Nakayama, H.; Hirono, S.; Sakiyama, O.; Takahashi, K.; Gohda, E.; Daikuhara, Y.; Kitamura, N.: Molecular cloning and sequence analysis of cDNA for human hepatocyte growth factor. Biochem. Biophys. Res. Commun. 163:967-973, 1989.

Nakamura, T.; Nishizawa, T.; Hagiya, M.; Seki, T.; Shimonishi, M.; Sugimura, A.; Tashiro, K.; Shimizu, S.: Molecular cloning and expression of human hepatocyte growth factor. Nature 342:440-443,1989.

Noonan, F. P.; Recio, J. A.; Takayama, H.; Duray, P.; Anver, M. R.; Rush, W. L.; De Fabo, E. C.; Merlino, G.: Neonatal sunburn and melanoma in mice: severe sunburn in newborn, but not adult, mice is linked with melanoma in later life. Nature 413:271-272, 2001.

Powell, E. M.; Mars, W. M.; Levitt, P.: Hepatocyte growth factor/scatter factor is a motogen for interneurons migrating from the ventral to dorsal telencephalon. Neuron 30:79-89, 2001.

Rubin, J. S.; Chan, A. M.-L.; Bottaro, D. P.; Burgess, W. H.; Taylor, W. G.; Cech, A. C.; Hirschfield, D. W.; Wong, J.; Miki, T.; Finch, P. W.; Aaronson, S. A.: A broad-spectrum human lung fibroblast-derived mitogen is a variant of hepatocyte growth factor. Proc. Nat. Acad. Sci. 88:415-419, 1991.

Saccone, S.; Narsimhan, R. P.; Gaudino, G.; Dalpra, L.; Comoglio, P. M.; Della Valle, G.: Regional mapping of the human hepatocyte growth factor (HGF)-scatter factor gene to chromosome 7q21.1. Genomics 13:912-914, 1992.

Schmidt, C.; Bladt, F.; Goedecke, S.; Brinkmann, V.; Zschiesche, W.; Sharpe, M.; Gherardi, E.; Birchmeier, C.: Scatter factor/hepatocyte growth factor is essential for liver development. Nature 373:699-702,1995.

Uehara, Y.; Minowa, O.; Mori, C.; Shiota, K.; Kuno, J.; Noda, T.; Kitamura, N.: Placental defect and embryonic lethality in mice lacking hepatocyte growth factor/scatter factor. Nature 373:702-705,1995.

Weidner, K. M.; Arakaki, N.; Hartmann, G.; Vandekerckhove, J.; Weingart, S.; Rieder, H.; Fonatsch, C.; Tsubouchi, H.; Hishida, T.; Daikuhara, Y.; Birchmeier, W.: Evidence for the identity of human scatter factor and human hepatocyte growth factor. Proc. Nat. Acad. Sci. 88:7001-7005, 1991.

Zarnegar, R.; Petersen, B.; DeFrances, M. C.; Michalopoulos, G.: Localization of hepatocyte growth factor (HGF) gene on human chromosome 7. Genomics 12:147-150, 1992.

van den Boogaard, M.-J. H.; Dorland, M.; Beemer, F. A.; Ploosvan Amstel, H. K.: MSX1 mutation is associated with orofacial clefting and tooth agenesis in human S. (Letter) Nature Genet. 24:342-343,2000. Note: Erratum: Nature Genet. 25:125 only, 2000.

Del Campo, M.; Jones, M. C.; Veraksa, A. N.; Curry, C. J.; Jones, K. L.; Mascarello, J. T.; Ali-Kahn-Catts, Z.; Drumheller, T.; McGinnis, W.: Monodactylous limbs and abnormal genitalia are associated with hemizygosity for the human 2q31 region that includes the HOXD cluster. Am. J. Hum. Genet. 65:104-110, 1999.

Zakany, J.; Kmita, M.; Alarcon, P.; de la Pompa, J.-L.; Duboule, D.: Localized and transient transcription of Hox genes suggests a link between patterning and the segmentation clock. Cell 106:207-217,2001.

Rotem-Yehudar, R.; Galperin, E.; Horowitz, M.: Association of insulin-like growth factor 1 receptor with EHD1 and SNAP29. J. Biol. Chem. 276:33054-33060, 2001.

Scott, B. A.; Avidan, M. S.; Crowder, C. M.: Regulation of hypoxic death in C. elegans by the insulin/IGF receptor homolog DAF-2. Science 296:2388-2391, 2002.

Tatar, M.; Kopelman, A.; Epstein, D.; Tu, M.-P.; Yin, C.-M.; Garofalo, R. S.: A mutant Drosophila insulin receptor homolog that extends life-span and impairs neuroendocrine function. Science 292:107-110,2001.

Ullrich, A.; Gray, A.; Tam, A. W.; Yang-Feng, T.; Tsubokawa, M.; Collins, C.; Henzel, W.; Le Bon, T.; Kathuria, S.; Chen, E.; Jacobs, S.; Francke, U.; Ramachandran, J.; Fujita-Yamaguchi, Y.: Insulin-like growth factor I receptor primary structure: comparison with insulin receptor suggests structural determinants that define functional specificity. EMBO J. 5:2503-2512, 1986.

Werner, H.; Karnieli, E.; Rauscher, F. J., III; LeRoth, D.: Wild-type and mutant p53 differentially regulate transcription of the insulin-like growth factor I receptor gene. Proc. Nat. Acad. Sci. 93:8318-8323,1996.

Lafuse, W. P.; Zwilling, B. S.: Localization of the inhibin beta-B gene on mouse chromosome 1. Mammalian Genome 4:399-400, 1993.

Salmenkivi, K.; Arola, J.; Voutilainen, R.; Ilvesmaki, V.; Haglund, C.; Kahri, A. I.; Heikkila, P.; Liu, J.: Inhibin/activin beta-B-subunit expression in pheochromocytomas favors benign diagnosis. J. Clin. Endocr. Metab. 86:2231-2235, 2001.

Schrewe, H.; Gendron-Maguire, M.; Harbison, M. L.; Gridley, T.: Mice homozygous for a null mutation of activin beta B are viable and fertile. Mech. Dev. 47:43-51, 1994.

Nicoll, J. A. R.; Mrak, R. E.; Graham, D. I.; Stewart, J.; Wilcock, G.; MacGowan, S.; Esiri, M. M.; Murray, L. S.; Dewar, D.; Love, S.; Moss, T.; Griffin, W. S. T.: Association of interleukin-1 gene polymorphisms with Alzheimer's disease. Ann. Neurol. 47:365-368, 2000.

Rogers, J.: An IL-1-alpha susceptibility polymorphism in Alzheimer's disease: new fuel for the inflammation hypothesis. (Editorial) Neurology 55:464-465, 2000.

Sabatino, M.; Boyce, B.; Aufdemorte, T.; Bonewald, L.; Mundy, G. R.: Infusions of recombinant human interleukins 1 alpha and 1beta cause hypercalcemia in normal mice. Proc. Nat. Acad. Sci. 85:5235-5239, 1988.

Silver, A. R. J.; Masson, W. K.; George, A. M.; Adam, J.; Cox, R.: The Il-1 alpha and beta genes are closely linked (less than 70 kb) on mouse chromosome 2. Somat. Cell Molec. Genet. 16:549-556,1990.

Dickensheets, H. L.; Venkataraman, C.; Schindler, U.; Donnelly, R. P.: Interferons inhibit activation of STAT6 by interleukin 4 in human monocytes by inducing SOCS-1 gene expression. Proc. Nat. Acad. Sci. 96:10800-10805, 1999.

Kotanides, H.; Reich, N. C.: Interleukin-4-induced STAT6 recognizes and activates a target site in the promoter of the interleukin-4 receptor gene. J. Biol. Chem. 271:25555-25561, 1996.

Caggana, M.; Walker, K.; Reilly, A. A.; Conroy, J. M.; Duva, S.; Walsh, A. C.: Population-based studies reveal differences in the allelic frequencies of two functionally significant human interleukin-4receptor polymorphisms in several ethnic groups. Genet. Med. 1:267-271, 1999.

Deichmann, K. A.; Heinzmann, A.; Forster, J.; Dischinger, S.; Mehl, C.; Brueggenolte, E.; Hildebrandt, F.; Moseler, M.; Kuehr, J.: Linkage and allelic association of atopy and markers flanking the IL4-receptor gene. Clin. Exp. Allergy 28:151-155, 1998.

Gallin, J. I.: Personal Communication. Bethesda, Md. Oct. 12, 1990.

McCombs, J. L.; Teng, C. T.; Pentecost, B. T.; Magnuson, V. L.; Moore, C. M.; McGill, J. R.: Chromosomal localization of human lactotransferrin gene (LTF) by in situ hybridization. Cytogenet. Cell Genet. 47:16-17, 1988.

Moriuchi, M.; Moriuchi, H.: A milk protein lactoferrin enhances human T cell leukemia virus type I and suppresses HIV-1 infection. J. Immun. 166:4231-4236, 2001.

Naylor, S. L.; Marshall, A.; Solomon, A.; McGill, J. R.; McCombs, J.; Magnuson, V. L.; Moore, C. M.; Lalley, P. A.; Pentecost, B. T.; Teng, C.: Lactoferrin maps to human chromosome 3(q21-q23) and mouse chromosome 9. (Abstract) Cytogenet. Cell Genet. 46:669 only, 1987.

Powell, M. J.; Ogden, J. E.: Nucleotide sequence of human lactoferrin cDNA. Nucleic Acids Res. 18:4013 only, 1990.

Qiu, J.; Hendrixson, D. R.; Baker, E. N.; Murphy, T. F.; St. Geme, J. W., III; Plaut, A. G.: Human milk lactoferrin inactivates two putative colonization factors expressed by Haemophilus influenzae. Proc. Nat. Acad. Sci. 95:12641-12646, 1998.

Rado, T. A.; Wei, X.; Benz, E. J., Jr.: Isolation of lactoferrin cDNA from a human myeloid library and expression of mRNA during normal and leukemic myelopoiesis. Blood 70:989-993, 1987.

Singh, P. K.; Parsek, M. R.; Greenberg, E. P.; Welsh, M. J.: A component of innate immunity prevents bacterial biofilm development. Nature 417:552-555, 2002.

Teng, C. T.; Pentecost, B. T.; Marshall, A.; Solomon, A.; Bowman, B. H.; Lalley, P. A.; Naylor, S. L.: Assignment of the lactotransferrin gene to human chromosome 3 and to mouse chromosome 9. Somat. CellMolec. Genet. 13:689-693, 1987.

Yang, F.; Lum, J.; Baldwin, W. D.; Brune, J. L.; van Bragt, P.; Bowman, B. H.: Genetic analysis of human iron binding glycoproteins. (Abstract) Am. J. Hum. Genet. 35:184A only, 1983.

Tanaka, A. R.; Ikeda, Y.; Abe-Dohmae, S.; Arakawa, R.; Sadanami, K.; Kidera, A.; Nakagawa, S.; Nagase, T.; Aoki, R.; Kioka, N.; Amachi, T.; Yokoyama, S.; Ueda, K.: Human ABCA1 contains a large amino terminal extracellular domain homologous to an epitope of Sjogren's syndrome. Biochem. Biophys. Res. Commun. 283:1019-1025, 2001.

Xu, W.; Gelber, S.; Orr-Urtreger, A.; Armstrong, D.; Lewis, R. A.; Ou, C.-N.; Patrick, J.; Role, L.; De Biasi, M.; Beaudet, A. L.: Megacystis, mydriasis, and ion channel defect in mice lacking the alpha-3 neuronal nicotinic acetylcholine receptor. Proc. Nat. Acad. Sci. 96:5746-5751, 1999.

Sun, X.-H.: Constitutive expression of the Id1 gene impairs mouse B cell development. Cell 79:893-900, 1994.

Nowell, P. C.; Hungerford, D. A.: Chromosome studies on normal and leukemic human leukocytes. J. Nat. Cancer Inst. 25:85-109,1960.

Dowbenko, D. J.; Diep, A.; Taylor, B. A.; Lusis, A. J.; Lasky, L. A.: Characterization of the murine homing receptor gene reveals correspondence between protein domains and coding exons. Genomics 9:270-277, 1991.

Cooper, P. K.; Nouspikel, T.; Clarkson, S. G.; Leadon, S. A.: Defective transcription-coupled repair of oxidative base damage in Cockayne syndrome patients from XP group G. Science 275:990-993,1997.

Gersen, S.; Warburton, D.; Jackson, C. L.; Housman, D.: Regional localization of the excision repair gene ERCC5 on chromosome 13. (Abstract) Cytogenet. Cell Genet. 51:1003 only, 1989.

Habraken, Y.; Sung, P.; Prakash, L.; Prakash, S.: Human xerodermapigmentosum group G gene encodes a DNA endonuclease. Nucleic Acids Res. 22:3312-3316, 1994.

Habraken, Y.; Sung, P.; Prakash, S.; Prakash, L.: Transcription factor TFIIH and DNA endonuclease Rad2 constitute yeast nucleotide excision repair factor 3: implications for nucleotide excision repair and Cockayne syndrome. Proc. Nat. Acad. Sci. 93:10718-10722, 1996.

Hamel, B. C. J.; Raams, A.; Schuitema-Dijkstra, A. R.; Simons, P.; van der Burgt, I.; Jaspers, N. G. J.; Kleijer, W. J.: Xerodermapigmentosum-Cockayne syndrome complex: a further case. J. Med. Genet. 33:607-610, 1996.

Harada, Y.-N.; Matsuda, Y.; Shiomi, N.; Shiomi, T.: Complementary DNA sequence and chromosomal localization of xpg, the mouse counterpart of human repair gene XPG/ERCC5. Genomics 28:59-65, 1995.

Hori, T.; Shiomi, T.; Sato, K.: Human chromosome 13 compensates a DNA repair defect in UV-sensitive mouse cells by mouse-human cell hybridization. Proc. Nat. Acad. Sci. 80:5655-5659, 1983.

Jaeken, J.; Klocker, H.; Schwaiger, H.; Bellmann, R.; Hirsch-Kauffmann, M.; Schweiger, M.: Clinical and biochemical studies in three patients with severe early infantile Cockayne syndrome. Hum. Genet. 83:339-346,1989.

Lee, S.-K.; Yu, S.-L.; Prakash, L.; Prakash, S.: Requirement of yeast RAD2, a homolog of human XPG gene, for efficient RNA polymerase II transcription: implications for Cockayne syndrome. Cell 109:823-834, 2002.

Lehmann, A. R.; Bootsma, D.; Clarkson, S. G.; Cleaver, J. E.; McAlpine, P. J.; Tanaka, K.; Thompson, L. H.; Wood, R. D.: Nomenclature of human DNA repair genes. Mutat. Res. 315:41-42, 1994.

MacInnes, M. A.; Dickson, J. A.; Hernandez, R. R.; Learmonth, D.; Lin, G. Y.; Mudgett, J. S.; Park, M. S.; Schauer, S.; Reynolds, R. J.; Strniste, G. F.; Yu, J. Y.: Human ERCC5 cDNA-cosmid complementation for excision repair and bipartite amino acid domains conserved with RAD proteins of Saccharomyces cerevisiae and Schizosaccharomyces pombe. Molec. Cell. Biol. 13:6393-6402, 1993.

Mudgett, J. S.; MacInnes, M. A.: Isolation of the functional human excision repair gene ERCC5 by intercosmid recombination. Genomics 8:623-633, 1990.

Norris, P. G.; Hawk, J. L. M.; Avery, J. A.; Giannelli, F.: Xerodermapigmentosum complementation group G--report of two cases. Brit. J. Derm. 116:861-866, 1987.

Nouspikel, T.; Clarkson, S. G.: Mutations that disable the DNA repair gene XPG in a xeroderma pigmentosum group G patient. Hum. Molec. Genet. 3:963-967, 1994.

Nouspikel, T.; Lalle, P.; Leadon, S. A.; Cooper, P. K.; Clarkson, S. G.: A common mutational pattern in Cockayne syndrome patients from xeroderma pigmentosum group G: implications for a second XPG function. Proc. Nat. Acad. Sci. 94:3116-3121, 1997.

O'Donovan, A.; Davies, A. A.; Moggs, J. G.; West, S. C.; Wood, R. D.: XPG endonuclease makes the 3-prime incision in human DNA nucleotide excision repair. Nature 371:432-435, 1994.

O'Donovan, A.; Scherly, D.; Clarkson, S. G.; Wood, R. D.: Isolation of active recombinant XPG protein, a human DNA repair endonuclease. J. Biol. Chem. 269:15965-15968, 1994.

O'Donovan, A.; Wood, R. D.: Identical defects in DNA repair in xeroderma pigmentosum group G and rodent ERCC group 5. Nature 363:185-188, 1993.

Samec, S.; Jones, T. A.; Corlet, J.; Scherly, D.; Sheer, D.; Wood, R. D.; Clarkson, S. G.: The human gene for xeroderma pigmentosum complementation group G (XPG) maps to 13q33 by fluorescence in situ hybridization. Genomics 21:283-285, 1994.

Scherly, D.; Nouspikel, T.; Corlet, J.; Ucla, C.; Bairoch, A.; Clarkson, S. G.: Complementation of the DNA repair defect in xerodermapigmentosum group G cells by a human cDNA related to yeast RAD2. Nature 363:182-185, 1993.

Chesi, M.; Nardini, E.; Brents, L. A.; Schrock, E.; Ried, T.; Kuehl, W. M.; Bergsagel, P. L.: Frequent translocation t (4;14)(p16.3; q32.3) in multiple myeloma is associated with increased expression and activating mutations of fibroblast growth factor receptor 3. Nature Genet. 16:260-264, 1997.

Demiroglu, A.; Steer, E. J.; Heath, C.; Taylor, K.; Bentley, M.; Allen, S. L.; Koduru, P.; Brody, J. P.; Hawson, G.; Rodwell, R.; Doody, M.-L.; Carnicero, F.; Reiter, A.; Goldman, J. M.; Melo, J. V.; Cross, N. C. P.: The t (8;22) in chronic myeloid leukemia fuses BCR to FGFR1: transforming activity and specific inhibition of FGFR1 fusion proteins. Blood 98:3778-3783, 2001.

Guasch, G.; Mack, G. J.; Popovici, C.; Dastugue, N.; Birnbaum, D.; Rattner, J. B.; Pebusque, M.-J.: FGFR1 is fused to the centrosome-associated protein CEP110 in the 8p12 stem cell myeloproliferative disorder with t (8;9)(p12; q33). Blood 95:1788-1796, 2000.

Kelley, M. J.; Pech, M.; Seuanez, H. N.; Rubin, J. S.; O'Brien, S. J.; Aaronson, S. A.: Emergence of the keratinocyte growth factor multigene family during the great ape radiation. Proc. Nat. Acad. Sci. 89:9287-9291, 1992.

Mattei, M.-G.; deLapeyriere, O.; Bresnick, J.; Dickson, C.; Birnbaum, D.; Mason, I.: Mouse Fgf7 (fibroblast growth factor 7) and Fgf8 (fibroblast growth factor 8) genes map to chromosomes 2 and 19 respectively. Mammalian Genome 6:196-197, 1995.

Rubin, J. S.; Osada, H.; Finch, P. W.; Taylor, W. G.; Rudikoff, S.; Aaronson, S. A.: Purification and characterization of a newly identified growth factor specific for epithelial cells. Proc. Nat. Acad. Sci. 86:802-806, 1989.

Werner, S.; Smola, H.; Liao, X.; Longaker, M. T.; Krieg, T.; Hofschneider, P. H.; Williams, L. T.: The function of KGF in morphogenesis of epithelium and reepithelialization of wounds. Science 266:819-822, 1994.

Zimonjic, D. B.; Kelley, M. J.; Rubin, J. S.; Aaronson, S. A.; Popescu, N. C.: Fluorescence in situ hybridization analysis of keratinocyte growth factor gene amplification and dispersion in evolution of great apes and human S. Proc. Nat. Acad. Sci. 94:11461-11465, 1997.

Sparkes, R. S.; Zollman, S.; Klisak, I.; Kirchgessner, T. G.; Komaromy, M. C.; Mohandas, T.; Schotz, M. C.; Lusis, A. J.: human genes involved in lipolysis of plasma lipoproteins: mapping of loci for lipoprotein lipase to 8p22 and hepatic lipase to 15q21. Genomics 1:138-144, 1987.

Liu, Y.; Wu, Y.-P.; Wada, R.; Neufeld, E. B.; Mullin, K. A.; Howard, A. C.; Pentchev, P. G.; Vanier, M. T.; Suzuki, K.; Proia, R. L.: Alleviation of neuronal ganglioside storage does not improve the clinical course of the Niemann-Pick C disease mouse. Hum. Molec. Genet. 9:1087-1092, 2000.

Ito, M.; Yuan, C.-X.; Malik, S.; Gu, W.; Fondell, J. D.; Yamamura, S.; Fu, Z.-Y.; Zhang, X.; Qin, J.; Roeder, R. G.: Identity between TRAP and SMCC complexes indicates novel pathways for the function of nuclear receptors and diverse mammalian activators. Molec. Cell 3:361-370, 1999.

Nagase, T.; Seki, N.; Ishikawa, K.; Tanaka, A.; Nomura, N.: Prediction of the coding sequences of unidentified human genes. V. The coding sequences of 40 new genes (KIAA0161-KIAA0200) deduced by analysis of cDNA clones from human cell line KG-1. DNA Res. 3:17-24, 1996.

Makino, K.; Kuwahara, H.; Masuko, N.; Nishiyama, Y.; Morisaki, T.; Sasaki, J.; Nakao, M.; Kuwano, A.; Nakata, M.; Ushio, Y.; Saya, H.: Cloning and characterization of NE-dlg: a novel human homolog of the Drosophila discs large (dlg) tumor suppressor protein interacts with the APC protein. Oncogene 14:2425-2433, 1997.

Stathakis, D. G.; Lee, D.; Bryant, P. J.: DLG3, the gene encoding human neuroendocrine Dlg (NE-Dlg), is located within the 1.8-Mb dystonia-parkinsonism region at Xq13.1. Genomics 49:310-313, 1998.

Maeda, K.; Matsuhashi, S.; Hori, K.; Xin, Z.; Mukai, T.; Tabuchi, K.; Egashira, M.; Niikawa, N.: Cloning and characterization of a novel human gene, TM4SF6, encoding a protein belonging to the transmembrane4 superfamily, and mapped to Xq22. Genomics 52:240-242, 1998.

Todd, S. C.; Doctor, V. S.; Levy, S.: Sequences and expression of six new members of the tetraspanin/TM4SF family. Biochim. Biophys. Acta 1399:101-104, 1998.

Crew, A. J.; Clark, J.; Fisher, C.; Gill, S.; Grimer, R.; Chand, A.; Shipley, J.; Gusterson, B. A.; Cooper, C. S.: Fusion of SYT to two genes, SSX1 and SSX2, encoding proteins with homology to the Kruppel-associated box in human synovial sarcoma. EMBO J. 14:2333-2340, 1995.

Vaccari, T.; Beltrame, M.; Ferrari, S.; Bianchi, M. E.: Hmg4, a new member of the Hmg1/2 gene family. Genomics 49:247-252, 1998.

Wilke, K.; Wiemann, S.; Gaul, R.; Gong, W.; Poustka, A.: Isolation of human and mouse HMG2a cDNAs: evidence for an HMG2a-specific 3-prime untranslated region. Gene 198:269-274, 1997.

Anson, D. S.; Blake, D. J.; Winship, P. R.; Birnbaum, D.; Brownlee, G. G.: Nullisomic deletion of the mcf.2 transforming gene in two haemophilia B patients. EMBO J. 7:2795-2799, 1988.

Weiss, P.; Tietze, F.; Gahl, W. A.; Seppala, R.; Ashwell, G.: Identification of the metabolic defect in sialuria. J. Biol. Chem. 264:17635-17636, 1989.

Bassi, M. T.; Ramesar, R. S.; Caciotti, B.; Winship, I. M.; DeGrandi, A.; Riboni, M.; Townes, P. L.; Beighton, P.; Ballabio, A.; Borsani, G.: X-linked late-onset sensorineural deafness caused by a deletion involving OA1 and a novel gene containing WD-40 repeats. Am. J. Hum. Genet. 64:1604-1616, 1999.

Converse, P. J.: Personal Communication. Baltimore, Md. Aug. 24, 2001.

Disteche, C. M.; Dinulos, M. B.; Bassi, M. T.; Elliott, R. W.; Rugarli, E. I.: Mapping of the murine Tbl1 gene reveals a new rearrangement between mouse and human X chromosomes. Mammalian Genome 9:1062-1064,1998.

Dong, X.; Tsuda, L.; Zavitz, K. H.; Lin, M.; Li, S.; Carthew, R. W.; Zipursky, S. L.: ebi regulates epidermal growth factor receptor signaling pathways in Drosophila. Genes Dev. 13:954-965, 1999.

Matsuzawa, S.; Reed, J. C.: Siah-1, SIP, and Ebi collaborate in a novel pathway for beta-catenin degradation linked to p53 responses. Molec. Cell 7:915-926, 2001.

Zhang, J.; Kalkum, M.; Chait, B. T.; Roeder, R. G.: The N-CoR-HDAC3 nuclear receptor corepressor complex inhibits the JNK pathway through the integral subunit GPS2. Molec. Cell 9:611-623, 2002.

Mu, J.; Skurat, A. V.; Roach, P. J.: Glycogenin-2, a novel self-glucosylating protein involved in liver glycogen biosynthesis. J. Biol. Chem. 272:27589-27597, 1997.

Delbridge, M. L.; Lingenfelter, P. A.; Disteche, C. M.; MarshallGraves, J. A.: The candidate spermatogenesis gene RBMY has a homologue on the human X chromosome. (Letter) Nature Genet. 22:223-224, 1999.

Le Coniat, M.; Soulard, M.; Della Valle, V.; Larsen, C.-J.; Berger, R.: Localization of the human gene encoding heterogeneous nuclear RNA ribonucleoprotein G (hnRNP-G) to chromosome 6p12. Hum. Genet. 88:593-595, 1992.

Mazeyrat, S.; Saut, N.; Mattei, M.-G.; Mitchell, M. J.: RBMY evolved on the Y chromosome from a ubiquitously transcribed X-Y identical gene. (Letter) Nature Genet. 22:224-226, 1999.

Venables, J. P.; Elliott, D. J.; Makarova, O. V.; Makarov, E. M.; Cooke, H. J.; Eperon, I. C.: RBMY, a probable human spermatogenesis factor, and other hnRNP G proteins interact with Tra2-beta and affect splicing. Hum. Molec. Genet. 9:685-694, 2000.

Vogt, P. H.; Affara, N.; Davey, P.; Hammer, M.; Jobling, M. A.; Lau, Y. F.; Mitchell, M.; Schempp, W.; Tyler-Smith, C.; Williams, G.; Yen, P.; Rappold, G. A: Report of the Third International Workshop on Y Chromosome Mapping 1997. Heidelberg, Germany, April 13-16, 1997. Cytogenet. Cell Genet. 79:1-20, 1997.

Wilcken, B.; Don, N.; Greenaway, R.; Hammond, J.; Sosula, L.:Sialuria: a second case. J. Inherit. Metab. Dis. 10:97-102, 1987.

Gaedigk, R.; Duncan, A. M. V.; Miyazaki, I.; Robinson, B. H.; Dosch, H.-M.: ICA1 encoding p69, a protein linked to the development of type 1 diabetes, maps to human chromosome 7p22. Cytogenet. Cell Genet. 66:274-276, 1994.

Gaedigk, R.; Karges, W.; Hui, M. F.; Scherer, S. W.; Dosch, H.-M.: Genomic organization and transcript analysis of ICAp69, a target antigen in diabetic autoimmunity. Genomics 38:382-391, 1996.

Pietropaolo, M.; Castano, L.; Babu, S.; Buelow, R.; Kuo, Y.-L. S.; Martin, S.; Martin, A.; Powers, A. C.; Prochazka, M.; Naggert, J.; Leiter, E. H.; Eisenbarth, G. S.: Islet cell autoantigen 69 kD(ICA69): molecular cloning and characterization of a novel diabetes-associated autoantigen. J. Clin. Invest. 92:359-371, 1993.

Erikson, J.; Griffin, C.; ar-Rushdi, A.; Valtieri, M.; Hoxie, J.; Finan, J.; Emanuel, B. S.; Rovera, G.; Nowell, P. C.; Croce, C. M.: Heterogeneity of chromosome 22 breakpoint in Philadelphia-positive (Ph+) acute lymphocytic leukemia. Proc. Nat. Acad. Sci. 83:1807-1811,1986.

Fioretos, T.; Heisterkamp, N.; Groffen, J.: No evidence for genomic imprinting of the human BCR gene. Blood 83:3441-3444, 1994.

Fitzgerald, P. H.: Evidence that chromosome band 22q12 is concerned with cell proliferation in chronic myeloid leukemia. Hum. Genet. 33:269-274, 1976.

Ganesan, T. S.; Rassool, F.; Guo, A.-P.; Th'ng, K. H.; Dowding, C.; Hibbin, J. A.; Young, B. D.; White, H.; Kumaran, T. O.; Galton, D. A. G.; Goldman, J. M.: Rearrangement of the bcr gene in Philadelphia chromosome-negative chronic myeloid leukemia. Blood 68:957-960,1986.

Goldman, J. M.; Melo, J. V.: Targeting the BCR-ABL tyrosine kinase in chronic myeloid leukemia. (Editorial) New Eng. J. Med. 344:1084-1086,2001.

Gorre, M. E.; Mohammed, M.; Ellwood, K.; Hsu, N.; Paquette, R.; Rao, P. N.; Sawyers, C. L.: Clinical resistance to STI-571 cancer therapy caused by BCR-ABL gene mutation or amplification. Science 293:876-883, 2001.

Groffen, J.; Stephenson, J. R.; Heisterkamp, N.; de Klein, A.; Bartram, C. R.; Grosveld, G.: Philadelphia chromosomal breakpoints are clustered within a limited region, bcr, on chromosome 22. Cell 36:93-99, 1984.

Grossman, A.; Silver, R. T.; Arlin, Z.; Coleman, M.; Camposano, E.; Gascon, P.; Benn, P. A.: Fine mapping of chromosome 22 breakpoints within the breakpoint cluster region (bcr) implies a role for bcr exon 3 in determining disease duration in chronic myeloid leukemia. Am. J. Hum. Genet. 45:729-738, 1989.

Grosveld, G.; Verwoerd, T.; van Agthoven, T.; de Klein, A.; Ramachandran, K. L.; Heisterkamp, N.; Stam, K.; Groffen, J.: The chronic myelocytic cell line K562 contains a breakpoint in bcr and produces a chimeric bcr/c-abl transcript. Molec. Cell. Biol. 6:607-616, 1986.

Haas, O. A.: Are ABL and BCR imprinted? No definitive answers, but more questions. Leukemia 9:740-745, 1995.

Haas, O. A.; Argyriou-Tirita, A.; Lion, T.: Parental origin of chromosomes involved in the translocation t (9;22). Nature 359:414-416,1992.

Hariharan, I. K.; Adams, J. M.: cDNA sequence for human bcr, the gene that translocates to the abl oncogene in chronic myeloid leukaemia. EMBO J. 6:115-119, 1987.

Heisterkamp, N.; Jenster, G.; ten Hoeve, J.; Zovich, D.; Pattengale, P. K.; Groffen, J.: Acute leukaemia in bcr/abl transgenic mice. Nature 344:251-253, 1990.

Heisterkamp, N.; Stam, K.; Groffen, J.; de Klein, A.; Grosveld, G.: Structural organization of the bcr gene and its role in the Ph-1 translocation. Nature 315:758-761, 1985.

Hermans, A.; Heisterkamp, N.; von Lindern, M.; van Baal, S.; Meijer, D.; van der Plas, D.; Wiedemann, L. M.; Groffen, J.; Bootsma, D.; Grosveld, G.: Unique fusion of bcr and c-abl genes in Philadelphia chromosome positive acute lymphoblastic leukemia. Cell 51:33-40,1987.

Huettner, C. S.; Zhang, P.; Van Etten, R. A.; Tenen, D. G.: Reversibility of acute B-cell leukaemia induced by BCR-ABL1. Nature Genet. 24:57-60, 2000.

Jacobs, A.: Benzene and leukemia. Brit. J. Haemat. 72:119-121,1989.

Klein, G.: Specific chromosomal translocations and the genesis of the B-cell-derived tumors in mice and men. Cell 32:311-315,1983.

Koeffler, H. P.; Golde, D. W.: Chronic myelogenous leukemia--new concepts. New Eng. J. Med. 304:1201-1209 and 1269-1274, 1981.

Kohno, S.-I.; Sandberg, A. A.: Chromosomes and causation of human cancer and leukemia. XXXIX. Usual and unusual findings in Ph (1)-positive CML. Cancer 46:2227-2237, 1980.

Laurent, E.; Talpaz, M.; Kantarjian, H.; Kurzrock, R.: The BCR gene and Philadelphia chromosome-positive leukemogenesis. Cancer Res. 61:2343-2355, 2001.

Lillicrap, D. A.; Sterndale, H.: Familial chronic myeloid leukaemia. (Letter) Lancet II:699, 1984.

Lim, Y.-M.; Wong, S.; Lau, G.; Witte, O. N.; Colicelli, J.: BCR/ABL inhibition by an escort/phosphatase fusion protein. Proc. Nat. Acad. Sci. 97:12233-12238, 2000.

Litz, C. E.; Copenhaver, C. M.: Paternal origin of the rearranged major breakpoint cluster region in chronic myeloid leukemia. Blood 83:3445-3448, 1994.

Maru, Y.; Witte, O. N.: The BCR gene encodes a novel serine/threonine kinase activity within a single exon. Cell 67:459-468, 1991.

Melo, J. V.; Yan, X.-H.; Diamond, J.; Goldman, J. M.: Lack of imprinting of the ABL gene. (Letter) Nature Genet. 8:318-319, 1994.

Melo, J. V.; Yan, X.-H.; Diamond, J.; Goldman, J. M.: Balanced parental contribution to the ABL component of the BCR-ABL gene in chronic myeloid leukemia. Leukemia 9:734-745, 1995.

Mes-Masson, A.-M.; McLaughlin, J.; Daley, G. Q.; Paskind, M.; Witte, O. N.: Overlapping cDNA clones define the complete coding region for the P210(c-abl) gene product associated with chronic myelogeneous leukemia cells containing the Philadelphia chromosome. Proc. Nat. Acad. Sci. 83:9768-9772, 1986.

Mills, K. I.; MacKenzie, E. D.; Birnie, G. D.: The site of the breakpoint within the bcr is a prognostic factor in Philadelphia-positive CML patients. Blood 72:1237-1241, 1988.

Mittelman, F.; Levan, G.: Clustering of aberrations to specific chromosomes in human neoplasms. III. Incidence and geographic distribution of chromosome aberrations in 856 cases. Hereditas 89:207-232, 1978.

Nowell, P. C.; Hungerford, D. A.: A minute chromosome in human chronic granulocytic leukemia. Science 132:1497, 1960.

Kusari, J.; Takata, Y.; Hatada, E.; Freidenberg, G.; Kolterman, O.; Olefsky, J. M.: Insulin resistance and diabetes due to different mutations in the tyrosine kinase domain of both insulin receptor gene alleles. J. Biol. Chem. 266:5260-5267, 1991.

Lander, E. S.; Botstein, D.: Homozygosity mapping: a way to map human recessive traits with the DNA of inbred children. Science 236:1567-1570, 1987.

Sagane, K.; Ohya, Y.; Hasegawa, Y.; Tanaka, I.: Metalloproteinase-like, disintegrin-like, cysteine-rich proteins MDC2 and MDC3: novel human cellular disintegrins highly expressed in the brain. Biochem. J. 334:93-98, 1998.

Taira, M.; Yoshida, T.; Miyagawa, K.; Sakamoto, H.; Terada, M.; Sugimura, T.: cDNA sequence of human transforming gene hst and identification of the coding sequence required for transforming activity. Proc. Nat. Acad. Sci. 84:2980-2984, 1987.

Farndon, J. R.; Leight, G. S.; Dilley, W. G.; Baylin, S. B.; Smallridge, R. C.; Harrison, T. S.; Wells, S. A., Jr.: Familial medullary thyroid carcinoma without associated endocrinopathies: a distinct clinical entity. Brit. J. Surg. 73:278-281, 1986.

Wallis, D. E.; Roessler, E.; Hehr, U.; Nanni, L.; Wiltshire, T.; Richieri-Costa, A.; Gillessen-Kaesbach, G.; Zackai, E. H.; Rommens, J.; Muenke, M.: Mutations in the homeodomain of the human SIX3 gene cause holoprosencephaly. Nature Genet. 22:196-198, 1999.

Pisella, P.-J.; Brignole, F.; Debbasch, C.; Lozato, P.-A.; Creuzot-Garcher, C.; Bara, J.; Saiag, P.; Warnet, J.-M.; Baudouin, C.: Flow cytometric analysis of conjunctival epithelium in ocular rosacea and keratoconjunctivitis sicca. Ophthalmology 107:1841-1849, 2000.

Shackelford, D. A.; Mann, D. L.; van Rood, J. J.; Ferrara, G. B.; Strominger, J. L.: Human B-cell alloantigens DC1, MT1, and LB12 are identical to each other but distinct from the HLA-DR antigen. Proc. Nat. Acad. Sci. 78:4566-4570, 1981.

Tsubota, K.; Fukagawa, K.; Fujihara, T.; Shimmura, S.; Saito, I.; Saito, K.; Takeuchi, T.: Regulation of human leukocyte antigen expression in human conjunctival epithelium. Invest. Ophthal. Vis. Sci. 40:28-34, 1999.

Ellis, S. A.; Palmer, M. S.; McMichael, A. J.: Human trophoblast and the choriocarcinoma cell line BeWo express a truncated HLA class I molecule. J. Immun. 144:731-735, 1990.

Geraghty, D. E.; Koller, B. H.; Orr, H. T.: A human major histocompatibility complex class I gene that encodes a protein with a shortened cytoplasmic segment. Proc. Nat. Acad. Sci. 84:9145-9149, 1987.

Geraghty, D. E.; Pei, J.; Lipsky, B.; Hansen, J. A.; Taillon-Miller, P.; Bronson, S. K.; Chaplin, D. D.: Cloning and physical mapping of the HLA class I region spanning the HLA-E-to-HLA-F interval by using yeast artificial chromosomes. Proc. Nat. Acad. Sci. 89:2669-2673,1992.

Hurks, H. M. H.; Valter, M. M.; Wilson, L.; Hilgert, I.; van denElsen, P. J.; Jager, M. J.: Uveal melanoma: no expression of HLA-G. Invest. Ophthal. Vis. Sci. 42:3081-3084, 2001.

Kirszenbaum, M.; Moreau, P.; Gluckman, E.; Dausset, J.; Carosella, E.: An alternatively spliced form of HLA-G mRNA in human trophoblasts and evidence for the presence of HLA-G transcript in adult lymphocytes. Proc. Nat. Acad. Sci. 91:4209-4213, 1994.

Lila, N.; Carpentier, A.; Amrein, C.; Khalil-Daher, I.; Dausset, J.; Carosella, E. D.: Implication of HLA-G molecule in heart-graft acceptance. Lancet 355:2138 only, 2000.

McAlpine, P. J.: Personal Communication. Winnipeg, Manitoba, Canada Jun. 22, 1988.

Morales, P.; Corell, A.; Martinez-Laso, J.; Martin-Villa, J. M.; Varela, P.; Paz-Artal, E.; Allende, L.-M.; Arnaiz-Villena, A.: Three new HLA-G alleles and their linkage disequilibria with HLA-A. Immunogenetics 38:323-331, 1993.

Onno, M.; Guillaudeux, T.; Amiot, L.; Renard, I.; Drenou, B.; Hirel, B.; Girr, M.; Semana, G.; Le Bouteiller, P.; Fauchet, R.: The HLA-G gene is expressed at a low mRNA level in different human cells and tissues. Human Immun. 41:79-86, 1994.

Paul, P.; Rouas-Freiss, N.; Khalil-Daher, I.; Moreau, P.; Riteau, B.; Le Gal, F. A.; Avril, M. F.; Dausset, J.; Guillet, J. G.; Carosella, E. D.: HLA-G expression in melanoma: a way for tumor cells to escape from immunosurveillance. Proc. Nat. Acad. Sci. 95:4510-4515, 1998.

Rouas-Freiss, N.; Marchal, R. E.; Kirszenbaum, M.; Dausset, J.; Carosella, E. D.: The alpha1 domain of HLA-G1 and HLA-G2 inhibits cytotoxicity induced by natural killer cells: is HLA-G the public ligand for natural killer cell inhibitory receptors? Proc. Nat. Acad. Sci. 94:5249-5254, 1997.

Schmidt, C. M.; Orr, H. T.: A physical linkage map of HLA-A,-G, -7.5p, and -F. Hum. Immun. 31:180-185, 1991.

Farfel, Z.; Iiri, T.; Shapira, H.; Roitman, A.; Mouallem, M.; Bourne, H. R.: Pseudohypoparathyroidism, a novel mutation in the beta/gamma- contact region of Gs-alpha impairs receptor stimulation. J. Biol. Chem. 271:19653-19655, 1996.

Heisler, L. K.; Cowley, M. A.; Tecott, L. H.; Fan, W.; Low, M. J.; Smart, J. L.; Rubinstein, M.; Tatro, J. B.; Marcus, J. N.; Holstege, H.; Lee, C. E.; Cone, R. D.; Elmquist, J. K.: Activation of central melanocortin pathways by fenfluramine. Science 297:609-611, 2002.

Folster-Holst, R.; Moises, H. W.; Yang, L.; Fritsch, W.; Weissenbach, J.; Christophers, E.: Linkage between atopy and the IgE high-affinity receptor gene at 11q13 in atopic dermatitis families. Hum. Genet. 102:236-239, 1998.

Hill, M. R.; Cookson, W. O. C. M.: A new variant of the beta subunit of the high-affinity receptor for immunoglobulin E (Fc-epsilon-RI-betaE237G): associations with measures of atopy and bronchial hyper-responsiveness. Hum. Molec. Genet. 5:959-962, 1996.

Hupp, K.; Siwarski, D.; Mock, B. A.; Kinet, J.-P.: Gene mapping of the three subunits of the high affinity FcR for IgE to mouse chromosomes 1 and 19. J. Immun. 143:3787-3791, 1989.

Kuster, H.; Zhang, L.; Brini, A. T.; MacGlashan, D. W. J.; Kinet, J.-P.: The gene and cDNA for the human high affinity immunoglobulin E receptor beta chain and expression of the complete human receptor. J. Biol. Chem. 267:12782-12787, 1992.

Nagata, H.; Mutoh, H.; Kumahara, K.; Arimoto, Y.; Tomemori, T.; Sakurai, D.; Arase, K.; Ohno, K.; Yamakoshi, T.; Nakano, K.; Okawa, T.; Numata, T.; Konno, A.: Association between nasal allergy and a coding variant of the Fc-epsilon-RI-beta gene Glu237Gly in a Japanese population. Hum. Genet. 109:262-266, 2001.

Shirakawa, T.; Li, A.; Dubowitz, M.; Dekker, J. W.; Shaw, A. E.; Faux, J. A.; Ra, C.; Cookson, W. O. C. M.; Hopkin, J. M.: Association between atopy and variants of the beta subunit of the high-affinity immunoglobulin E receptor. Nature Genet. 7:125-130, 1994.

Shirakawa, T.; Mao, X.-Q.; Sasaki, S.; Enomoto, T.; Kawai, M.; Morimoto, K.; Hopkin, J.: Association between atopic asthma and a coding variant of Fc-epsilon-RI-beta in a Japanese population. Hum. Molec. Genet. 5:1129-1130, 1996.

Szepetowski, P.; Gaudray, P.: FCER1B, a candidate gene for atopy, is located in 11q13 between CD20 and TCN1. Genomics 19:399-400,1994.

Takayanagi, H.; Kim, S.; Matsuo, K.; Suzuki, H.; Suzuki, T.; Sato, K.; Yokochi, T.; Oda, H.; Nakamura, K.; Ida, N.; Wagner, E. F.; Taniguchi, T.: RANKL maintains bone homeostasis through c-Fos-dependent induction of interferon-B. Nature 416:744-749, 2002.

Appel, S.; Filter, M.; Reis, A.; Hennies, H. C.; Bergheim, A.; Ogilvie, E.; Arndt, S.; Simmons, A.; Lovett, M.; Hide, W.; Ramsay, M.; Reichwald, K.; Zimmermann, W.; Rosenthal, A.: Physical and transcriptional map of the critical region for keratolytic winter erythema (KWE) on chromosome 8p22-p23 between D8S550 and D8S1759. Europ. J. Hum. Genet. 10:17-25, 2002.

Olavarria, E.; Craddock, C.; Dazzi, F.; Marin, D.; Marktel, S.; Apperley, J. F.; Goldman, J. M.: Imatinib mesylate (STI571) in the treatment of relapse of chronic myeloid leukemia after allogeneic stem cell transplantation. Blood 99:3861-3862, 2002.

Pegoraro, L.; Matera, L.; Ritz, J.; Levis, A.; Palumbo, A.; Biagini, G.: Establishment of a Ph (1)-positive human cell line (BV173). J. Nat. Cancer Inst. 70:447-451, 1983.

Perrotti, D.; Cesi, V.; Trotta, R.; Guerzoni, C.; Santilli, G.; Campbell, K.; Iervolino, A.; Condorelli, F.; Gambacorti-Passerini, C.; Caligiuri, M. A.; Calabretta, B.: BCR-ABL suppresses C/EBP-alpha expression through inhibitory action of hnRNP E2. Nature Genet. 30:48-58, 2002.

Prakash, O.; Yunis, J. J.: High resolution chromosomes of the t (9;22) positive leukemias. Cancer Genet. Cytogenet. 11:361-367,1984.

Priest, J. R.; Robison, L. L.; McKenna, R. W.; Lindquist, L. L.; Warkentin, P. I.; LeBien, T. W.; Woods, W. G.; Kersey, J. H.; Coccia, P. F.; Nesbit, M. E., Jr.: Philadelphia chromosome positive childhood acute lymphoblastic leukemia. Blood 56:15-22, 1980.

Rowley, J. D.: A new consistent chromosomal abnormality in chronic myelogenous leukemia identified by quinacrine fluorescence and Giemsa staining. Nature 243:290-293, 1973.

Rubin, C. M.; Carrino, J. J.; Dickler, M. N.; Leibowitz, D.; Smith, S. D.; Westbrook, C. A.: Heterogeneity of genomic fusion of BCR and ABL in Philadelphia chromosome-positive acute lymphoblastic leukemia. Proc. Nat. Acad. Sci. 85:2795-2799, 1988.

Saglio, G.; Storlazzi, C. T.; Giugliano, E.; Surace, C.; Anelli, L.; Rege-Cambrin, G.; Zagaria, A.; Velasco, A. J.; Heiniger, A.; Scaravaglio, P.; Gomez, A. T.; Gomez, J. R.; Archidiacono, N.; Banfi, S.; Rocchi, M.: A 76-kb duplicon maps close to the BCR gene on chromosome 22and the ABL gene on chromosome 9: possible involvement in the genesis of the Philadelphia chromosome translocation. Proc. Nat. Acad. Sci. 99:9882-9887, 2002.

Savage, D. G.; Antman, K. H.: Imatinib mesylate--a new oral targeted therapy. New Eng. J. Med. 346:683-693, 2002.

Sawyers, C. L.: Chronic myeloid leukemia. New Eng. J. Med. 340:1330-1340, 1999.

Schaefer-Rego, K.; Dudek, H.; Popenoe, D.; Arlin, Z.; Mears, J. G.; Bank, A.; Leibowitz, D.: CML patients in blast crisis have breakpoints localized to a specific region of the BCR. Blood 70:448-455, 1987.

Shtivelman, E.; Gale, R. P.; Dreazen, O.; Berrebi, A.; Zaizov, R.; Kubonishi, I.; Miyoshi, I.; Canaani, E.: bcr-abl RNA in patients with chronic myelogenous leukemia. Blood 69:971-973, 1987.

Shtivelman, E.; Lifshitz, B.; Gale, R. P.; Canaani, E.: Fused transcript of abl and bcr genes in chronic myelogenous leukaemia. Nature 315:550-554, 1985.

Skorski, T.; Nieborowska-Skorska, M.; Nicolaides, N. C.; Szczylik, C.; Iversen, P.; Iozzo, R. V.; Zon, G.; Calabretta, B.: Suppression of Philadelphia-1 leukemia cell growth in mice by BCR-ABL antisense oligodeoxynucleotide. Proc. Nat. Acad. Sci. 91:4504-4508, 1994.

Stam, K.; Heisterkamp, N.; Grosveld, G.; de Klein, A.; Verma, R. S.; Coleman, M.; Dosik, H.; Groffen, J.: Evidence of a new chimeric bcr/c-abl mRNA in patients with chronic myelocytic leukemia and the Philadelphia chromosome. New Eng. J. Med. 313:1429-1433, 1985.

Stam, K.; Heisterkamp, N.; Reynolds, F. H., Jr.; Groffen, J.:Evidence that the phl gene encodes a 160,000-dalton phosphoprotein with associated kinase activity. Molec. Cell. Biol. 7:1955-1960,1987.

Swan, D. C.; McBride, O. W.; Robbins, K. C.; Keithley, D. A.; Reddy, E. P.; Aaronson, S. A.: Chromosomal mapping of the simian sarcoma virus onc gene analogue in human cells. Proc. Nat. Acad. Sci. 79:4691-4695, 1982.

Tanabe, T.; Kuwabara, T.; Warashina, M.; Tani, K.; Taira, K.; Asano, S.: Oncogene inactivation in a mouse model: tissue invasion by leukaemic cells is stalled by loading them with a designer ribozyme. Nature 406:473-474, 2000.

Teyssier, J. R.; Bartram, C. R.; Deville, J.; Potron, G.; Pigeon, F.: C-abl oncogene and chromosome 22 'bcr' juxtaposition in chronic myelogenous leukemia. New Eng. J. Med. 312:1393-1394, 1985.

Tkachuk, D. C.; Westbrook, C. A.; Andreeff, M.; Donlon, T. A.; Cleary, M. L.; Suryanarayan, K.; Homge, M.; Redner, A.; Gray, J.; Pinkel, D.: Detection of bcr-abl fusion in chronic myelogeneous leukemia by in situ hybridization. Science 250:559-562, 1990.

Verhest, A.; Monsieur, R.: Philadelphia chromosome-positive thrombocythemia with leukemic transformation. (Letter) New Eng. J. Med. 308:1603,1983.

Verma, R. S.; Dosik, H.: Heteromorphisms of the Philadelphia (Ph-1) chromosome in patients with chronic myelogenous leukaemia (CML). I. Classification and clinical significance. Brit. J. Haemat. 45:215-222, 1980.

Cockerham, G. C.; Hidayat, A. A.; Bijwaard, K. E.; Sheng, Z.-M.: Re-evaluation of 'reactive lymphoid hyperplasia of the uvea': an immunohistochemical and molecular analysis of 10 cases. Ophthalmology 107:151-158, 2000.

Guru, S. C.; Agarwal, S. K.; Manickam, P.; Olufemi, S.-E.; Crabtree, J. S.; Weisemann, J. M.; Kester, M. B.; Kim, Y. S.; Wang, Y.; Emmert-Buck, M. R.; Liotta, L. A.; Spiegel, A. M.; Boguski, M. S.; Roe, B. A.; Collins, F. S.; Marx, S. J.; Burns, L.; Chandrasekharappa, S. C.: A transcript map for the 2.8-Mb region containing the multiple endocrine neoplasia type 1 locus. Genome Res. 7:725-735, 1997.

Van Leeuwen, A.: Di-allelic allo-antigenic systems on human T-lymphocyte subsets. Thesis: London Hospital Medical College (pub.) 1982.

Walker, I. D.; Sandrin, M. S.; Hogarth, P. M.; Sutton, V. R.; McKenzie, I. F. C.: Expression of Qa alloantigens on peripheral T cells: the relationship of the Qa-m2, 7, 8, 9 specificities. Immunogenetics 24:90-94, 1986.

Yokoyama, W. M.: The mother-child union: the case of missing-self and protection of the fetus. Proc. Nat. Acad. Sci. 94:5998-6000,1997.

Glenn, C. L.; Wang, W. Y. S.; Benjafield, A. V.; Morris, B. J.: Linkage and association of tumor necrosis factor receptor 2 locus with hypertension, hypercholesterolemia and plasma shed receptor. Hum. Molec. Genet. 9:1943-1949, 2000.

Lasky, L. A.; Singer, M. S.; Dowbenko, D.; Imai, Y.; Henzel, W. J.; Grimley, C.; Fennie, C.; Gillett, N.; Watson, S. R.; Rosen, S. D.: An endothelial ligand for L-selectin is a novel mucin-like molecule. Cell 69:927-938, 1992.

Lasky, L. A.; Singer, M. S.; Yednock, T. A.; Dowbenko, D.; Fennie, C.; Rodriguez, H.; Nguyen, T.; Stachel, S.; Rosen, S. D.: Cloning of a lymphocyte homing receptor reveals a lectin domain. Cell 56:1045-1055, 1989.

Ord, D. C.; Ernst, T. J.; Zhou, L.-J.; Rambaldi, A.; Spertini, O.; Griffin, J.; Tedder, T. F.: Structure of the gene encoding the human leukocyte adhesion molecule-1 (TQ1, Leu-8) of lymphocytes and neutrophils. J. Biol. Chem. 265:7760-7767, 1990.

Siegelman, M. H.; Weissman, I. L.: Human homologue of mouse lymph node homing receptor: evolutionary conservation at tandem cell interaction domains. Proc. Nat. Acad. Sci. 86:5562-5566, 1989.

Sitrin, R. G.; Pan, P. M.; Blackwood, R. A.; Huang, J.; Petty, H. R.: Cutting edge: evidence for a signaling partnership between urokinase receptors (CD87) and L-selectin (CD62L) in human polymorphonuclear neutrophils. J. Immun. 166:4822-4825, 2001.

Tedder, T. F.; Isaacs, C. M.; Ernst, T. J.; Demetri, G. D.; Adler, D. A.; Disteche, C. M.: Isolation and chromosomal localization of cDNAs encoding a novel human lymphocyte cell surface molecule, LAM-1: homology with the mouse lymphocyte homing receptor and other human adhesion proteins. J. Exp. Med. 170:123-133, 1989.

Aizawa, S.; Nakano, H.; Ishida, T.; Horie, R.; Nagai, M.; Ito, K.; Yagita, H.; Okumura, K.; Inoue, J.; Watanabe, T.: Tumor necrosis factor receptor-associated factor (TRAF) 5 and TRAF2 are involved in CD30-mediated NF-kappa-B activation. J. Biol. Chem. 272:2042-2045,1997.

Durkop, H.; Latza, U.; Hummel, M.; Eitelbach, F.; Seed, B.; Stein, H.: Molecular cloning and expression of a new member of the nerve growth factor receptor family that is characteristic for Hodgkin's disease. Cell 68:421-427, 1992.

Kurts, C.; Carbone, F. R.; Krummel, M. F.; Koch, K. M.; Miller, J. F. A. P.; Heath, W. R.: Signalling through CD30 protects against autoimmune diabetes mediated by CD8 T cells. Nature 398:341-344,1999.

McClive, P. J.; Morahan, G.: Assignment of the mouse homologues of 6 loci from HSA1p to chromosomes 3 and 4. Genomics 23:243-246,1994.

Stein, H.; Gerdes, J.; Schwab, U.; Lemke, H.; Mason, D.Y.; Ziegler, A.; Schienle, W.; Diehl, V.: Identification of Hodgkin and Sternberg-Reed cells as a unique cell type derived from a newly detected small cell population. Int. J. Cancer 30:445-449, 1982.

de Lau, W.; Clevers, H.: LEF1 turns over a new leaf. Nature Genet. 28:3-5, 2001.

Hovanes, K.; Li, T. W. H.; Munguia, J. E.; Truong, T.; Milovanovic, T.; Marsh, J. L.; Holcombe, R. F.; Waterman, M. L.: Beta-catenin-sensitive isoforms of lymphoid enhancer factor-1 are selectively expressed in colon cancer. Nature Genet. 28:53-57, 2001.

Love, J. J.; Li, X.; Case, D. A.; Giese, K.; Grosschedl, R.; Wright, P. E.: Structural basis for DNA bending by the architectural transcription factor LEF-1. Nature 376:791-795, 1995.

Milatovich, A.; Travis, A.; Grosschedl, R.; Francke, U.: LEF1, the gene for lymphoid enhancer-binding factor 1, mapped to human chromosome 4 (q23-q25) and distal mouse chromosome 3 by Southern blot analysis and fluorescence in situ hybridization. (Abstract) Cytogenet. Cell Genet. 58:1888 only, 1991.

Milatovich, A.; Travis, A.; Grosschedl, R.; Francke, U.: Gene for lymphoid enhancer-binding factor 1 (LEF1) mapped to human chromosome 4 (q23-q25) and mouse chromosome 3 near Egf. Genomics 11:1040-1048,1991.

van Genderen, C.; Okamura, R. M.; Farinas, I.; Quo, R. G.; Parslow, T. G.; Bruhn, L.; Grosschedl, R.: Development of several organs that require inductive epithelial-mesenchymal interactions is impaired in LEF-1-deficient mice. Genes Dev. 8:2691-2703, 1994.

Waterman, M. L.; Fischer, W. H.; Jones, K. A.: A thymus-specific member of the HMG protein family regulates the human T cell receptor C alpha enhancer. Genes Dev. 5:656-669, 1991.

Zhou, P.; Byrne, C.; Jacobs, J.; Fuchs, E.: Lymphoid enhancer factor 1 directs hair follicle patterning and epithelial cell fate. Genes Dev. 9:700-713, 1995.

White, P. S.; Jensen, S. J.; Rajalingam, V.; Stairs, D.; Sulman, E. P.; Maris, J. M.; Biegel, J. A.; Wooster, R.; Brodeur, G. M.:Physical mapping of the CA6, ENO1, and SLC2A5 (GLUT5) genes and reassignment of SLC2A5 to 1p36.2. Cytogenet. Cell Genet. 81:60-64, 1998.

Champion, M. J.; Brown, J. A.; Shows, T. B.: Assignment of cytoplasmic alpha-mannosidase (MAN-A) and confirmation of the mitochondrial isocitrate dehydrogenase (IDH-M) genes to the q11--qter region of chromosome 15 in man. Cytogenet. Cell Genet. 22:498-502, 1978.

Ferguson-Smith, M. A.; Westerveld, A.: Report of the committee on the genetic constitution of chromosomes 13, 14, 15, 16, 17, 18,19, 20, 21, and 22 (HGM5). Cytogenet. Cell Genet. 25:59-73, 1979.

Neri, G.; Ricci, R.; Pelino, A.; Bova, R.; Tedeschi, B.; Serra, A.: A boy with ring chromosome 15 derived from a t (15q;15q) Robertsonian translocation in the mother: cytogenetic and biochemical findings. Am. J. Med. Genet. 14:307-314, 1983.

Chui, D.; Oh-Eda, M.; Liao, Y.-F.; Panneerselvam, K.; Lai, A.; Marek, K. W.; Freeze, H. H.; Moremen, K. W.; Fukuda, M. N.; Marth, J. D.: Alpha-mannosidase-II deficiency results in dyserythropoiesis and unveils an alternate pathway in oligosaccharide biosynthesis. Cell 90:157-167, 1997.

Chui, D.; Sellakumar, G.; Green, R. S.; Sutton-Smith, M.; McQuistan, T.; Marek, K. W.; Morris, H. R.; Dell, A.; Marth, J. D.: Genetic remodeling of protein glycosylation in vivo induces autoimmune disease. Proc. Nat. Acad. Sci. 98:1142-1147, 2001.

Gasparini, P.; del Giudice, E. M.; Delaunay, J.; Totaro, A.; Granatiero, M.; Melchionda, S.; Zelante, L.; Iolascon, A.: Localization of the congenital dyserythropoietic anemia II locus to chromosome 20q11.2 by genome wide search. Am. J. Hum. Genet. 61:1112-1116, 1997.

Misago, M.; Liao, Y.-F.; Kudo, S.; Eto, S.; Mattei, M.-G.; Moremen, K. W.; Fukuda, M. N.: Molecular cloning and expression of cDNAs encoding human alpha-mannosidase II and a previously unrecognized alpha-mannosidase II(X) isozyme. Proc. Nat. Acad. Sci. 92:11766-11770, 1995.

Moremen, K. W.; Robbins, P. W.: Isolation, characterization, and expression of cDNAs encoding murine alpha-mannosidase II, a Golgi enzyme that controls conversion of high mannose to complex N-glycans. J. Cell Biol. 115:1521-1534, 1991.

Wada, A.; Sakamoto, H.; Katoh, O.; Yoshida, T.; Yokota, J.; Little, P. F. R.; Sugimura, T.; Terada, M.: Two homologous oncogenes, HST1and INT2, are closely located in human genome. Biochem. Biophys. Res. Commun. 157:828-835, 1988.

Yoshida, T.; Tsutsumi, M.; Sakamoto, H.; Miyagawa, K.; Teshima, S.; Sugimura, T.; Terada, M.: Expression of the HST1 oncogene in human germ cell tumors. Biochem. Biophys. Res. Commun. 155:1324-1329,1988.

Nimmo, E.; Padua, R.-A.; Hughes, D.; Brook, J. D.; Williamson, R.; Johnson, K. J.: Confirmation and refinement of the localisation of the c-MEL locus on chromosome 19 by physical and genetic mapping. Hum. Genet. 81:382-384, 1989.

Nimmo, E.; Williamson, R.; Johnson, K.: Localization of the c-MEL gene to 19(cen-p13.2). (Abstract) Cytogenet. Cell Genet. 51:1053 only, 1989.

Nimmo, E. R.; Sanders, P. G.; Padua, R. A.; Hughes, D.; Williamson, R.; Johnson, K. J.: The MEL gene: a new member of the RAB/YPT class of RAS-related genes. Oncogene 6:1347-1351, 1991.

Padua, R. A.; Barrass, N.; Currie, G. A.: A novel transforming gene in a human malignant melanoma cell line. Nature 311:671-673,1984.

Spurr, N. K.; Hughes, D.; Goodfellow, P. N.; Brook, J. D.; Padua, R. A.: Chromosomal assignment of c-MEL, a human transforming oncogene, to chromosome 19(p13.2-q13.2). Somat. Cell Molec. Genet. 12:637-640,1986.

Eichbaum, Q.; Clerc, P.; Bruns, G.; McKeon, F.; Ezekowitz, R. A. B.: Assignment of the human macrophage mannose receptor gene (MRC1) to 10p13 by in situ hybridization and PCR-based somatic cell hybrid mapping. Genomics 22:656-658, 1994.

Harris, N.; Peters, L. L.; Eicher, E. M.; Rits, M.; Raspberry, D.; Eichbaum, Q. G.; Super, M.; Ezekowitz, R. A. B.: The exon-intron structure and chromosomal localization of the mouse macrophage mannose receptor gene, Mcr1: identification of a ricin-like domain at the N-terminus of the receptor. Biochem. Biophys. Res. Commun. 198:682-692, 1994.

Kim, S. J.; Ruiz, N.; Bezouska, K.; Drickamer, K.: Organization of the gene encoding the human macrophage mannose receptor (MRC1). Genomics 14:721-727, 1992.

Lee, S. J.; Evers, S.; Roeder, D.; Parlow, A. F.; Risteli, J.; Risteli, L.; Lee, Y. C.; Feizi, T.; Langen, H.; Nussenzweig, M. C.: Mannose receptor-mediated regulation of serum glycoprotein homeostasis. Science 295:1898-1901, 2002.

Fong, L. Y. Y.; Fidanza, V.; Zanesi, N.; Lock, L. F.; Siracusa, L. D.; Mancini, R.; Siprashvili, Z.; Ottey, M.; Martin, S. E.; Druck, T.; McCue, P. A.; Croce, C. M.; Huebner, K.: Muir-Torre-like syndrome in Fhit-deficient mice. Proc. Nat. Acad. Sci. 97:4742-4747, 2000.

Adkins, S.; Gan, K. N.; Mody, M.; La Du, B. N.: Molecular basis for the polymorphic forms of human serum paraoxonase/arylesterase:glutamine or arginine at position 191, for the respective A and B allozymes. Am. J. Hum. Genet. 52:598-608, 1993.

Antikainen, M.; Murtomaki, S.; Syvanne, M.; Pahlman, R.; Tahvanainen, E.; Jauhiainen, M.; Frick, M. H.; Ehnholm, C.: The gln-arg191 polymorphism of the human paraoxonase gene (HUMPONA) is not associated with the risk of coronary artery disease in Finns. J. Clin. Invest. 98:883-885,1996.

Augustinsson, K.-B.; Henricson, B.: A genetically controlled esterase in rat plasma. Biochim. Biophys. Acta 124: 323-331, 1966.

Barbieri, M.; Bonafe, M.; Marfella, R.; Ragno, E.; Giugliano, D.; Franceschi, C.; Paolisso, G.: LL-paraoxonase genotype is associated with a more severe degree of homeostasis model assessment IR in healthy subjects. J. Clin. Endocr. Metab. 87:222-225, 2002.

Brophy, V. H.; Jampsa, R. L.; Clendenning, J. B.; McKinstry, L. A.; Jarvik, G. P.; Furlong, C. E.: Effects of 5-prime regulatory-region polymorphisms on paraoxonase-gene (PON1) expression. Am. J. Hum. Genet. 68:1428-1436, 2001.

Cherry, N.; Mackness, M.; Durrington, P.; Povey, A.; Dippnall, M.; Smith, T.; Mackness, B.: Paraoxonase (PON1) polymorphisms in farmers attributing ill health to sheep dip. Lancet 359:763-764,2002.

Clendenning, J. B.; Humbert, R.; Green, E. D.; Wood, C.; Traver, D.; Furlong, C. E.: Structural organization of the human PON1 gene. Genomics 35:586-589, 1996.

Coates, P. M.; Mestriner, M. A.; Hopkinson, D. A.: A preliminary interpretation of the esterase isozymes of human tissues. Ann. Hum. Genet. 39:1-20, 1975.

Davies, H. G.; Richter, R. J.; Keifer, M.; Broomfield, C. A.; Sowalla, J.; Furlong, C. E.: The effect of the human serum paraoxonase polymorphism is reversed with diazoxon, soman and sarin. Nature Genet. 14:334-336,1996.

Deakin, S.; Leviev, I.; Nicaud, V.; Meynet, M.-C. B.; Tiret, L.; James, R. W.: Paraoxonase-1 L55M polymorphism is associated with an abnormal oral glucose tolerance test and differentiates high risk coronary disease families. J. Clin. Endocr. Metab. 87:1268-1273,2002.

Eckerson, H. W.; Romson, J.; Wyte, C.; La Du, B. N.: The human serum paraoxonase polymorphism: identification of phenotypes by their response to salts. Am. J. Hum. Genet. 35:214-227, 1983.

Eckerson, H. W.; Wyte, C. M.; La Du, B. N.: The human serum paraoxonase/arylesterase polymorphism. Am. J. Hum. Genet. 35:1126-1136, 1983.

Eiberg, H.; Mohr, J.: Linkage relations of the paraoxonase polymorphism with 43 marker systems. (Abstract) Cytogenet. Cell Genet. 25:150,1979.

Rey-Campos, J.; Chouard, T.; Yaniv, M.; Cereghini, S.: vHNF1is a homeoprotein that activates transcription and forms heterodimers with HNF1. EMBO J. 10:1445-1457, 1991.

Shih, D. Q.; Bussen, M.; Sehayek, E.; Ananthanarayanan, M.; Shneider, B. L.; Suchy, F. J.; Shefer, S.; Bollileni, J. S.; Gonzalez, F. J.; Breslow, J. L.; Stoffel, M.: Hepatocyte nuclear factor-1-alpha is an essential regulator of bile acid and plasma cholesterol metabolism. Nature Genet. 27:375-382, 2001.

Urhammer, S. A.; Hansen, T.; Ekstrom, C. T.; Eiberg, H.; Pederson, O.: The Ala/Val98 polymorphism of the hepatocyte nuclear factor-1-alpha gene contributes to the interindividual variation in serum C-peptide response during an oral glucose tolerance test: evidence from studies of 231 glucose-tolerant first degree relatives of type 2 diabetic probands. J. Clin. Endocr. Metab. 83:4506-4509, 1998.

Urhammer, S. A.; Moller, A. M.; Nyholm, B.; Ekstrom, C. T.; Eiberg, H.; Clausen, J. O.; Hansen, T.; Pedersen, O.; Schmitz, O.: The effect of two frequent amino acid variants of the hepatocyte nuclear factor-1-alpha gene on estimates of the pancreatic beta-cell function in Caucasian glucose-tolerant first-degree relatives of type 2 diabetic patients. J. Clin. Endocr. Metab. 83:3992-3995, 1998.

Urhammer, S. A.; Rasmussen, S. K.; Kaisaki, P. J.; Oda, N.; Yamagata, K.; Moller, A. M.; Fridberg, M.; Hansen, L.; Hansen, T.; Bell, G. I.; Pedersen, O.: Genetic variation in the hepatocyte nuclear factor-1-alpha gene in Danish Caucasians with late-onset NIDDM. Diabetologia 40:473-475, 1997.

Vaxillaire, M.; Rouard, M.; Yamagata, K.; Oda, N.; Kaisaki, P. J.; Boriraj, V. V.; Chevre, J.-C.; Boccio, V.; Cox, R. D.; Lathrop, G. M.; Dussoix, P.; Philippe, J.; Timsit, J.; Charpentier, G.; Velho, G.; Bell, G. I.; Froguel, P.: Identification of nine novel mutations in the hepatocyte nuclear factor 1 alpha gene associated with maturity-onset diabetes of the young (MODY3). Hum. Molec. Genet. 6:583-586, 1997.

Yamada, S.; Nishigori, H.; Onda, H.; Utsugi, T.; Yanagawa, T.; Maruyama, T.; Onigata, K.; Nagashima, K.; Nagai, R.; Morikawa, A.; Takeuchi, T.; Takeda, J.: Identification of mutations in the hepatocyte nuclear factor (HNF)-1-alpha gene in Japanese subjects with IDDM. Diabetes 46:1643-1647, 1997.

Yamagata, K.; Oda, N.; Kalsaki, P. J.; Menzel, S.; Furuta, H.; Vaxillaire, M.; Southam, L.; Cox, R. D.; Lathrop, G. M.; Borhaj, V. V.; Chen, X.; Cox, N. J.; Oda, Y.; Yano, H.; Le Beau, M. M.; Yamada, S.; Nishigori, H.; Takeda, J.; Fajans, S. S.; Hattersley, A. T.; Iwasaki, N.; Hansen, T.; Pedersen, O.; Polonsky, K. S.; Turner, R. C.; Velho, G.; Chevre, J.-C.; Froguel, P.; Bell, G. I.: Mutations in the hepatocyte nuclear factor-1-alpha gene in maturity-onset diabetes of the young (MODY3). Nature 384:455-457, 1996.

Yoshiuchi, I.; Yamagata, K.; Yoshimoto, M.; Zhu, Q.; Yang, Q.; Nammo, T.; Uenaka, R.; Kinoshita, E.; Hanafusa, T.; Miyagawa, J.; Matsuzawa, Y.: Analysis of a non-functional HNF-1-alpha (TCF1) mutation in Japanese subjects with familial type 1 diabetes. Hum. Mutat. 18:345-351, 2001.

Dhanasekaran, S. M.; Barrette, T. R.; Ghosh, D.; Shah, R.; Varambally, S.; Kurachi, K.; Pienta, K. J.; Rubin, M. A.; Chinnaiyan, A. M.: Delineation of prognostic biomarkers in prostate cancer. Nature 412:822-826, 2001.

Leytus, S. P.; Loeb, K. R.; Hagen, F. S.; Kurachi, K.; Davie, E. W.: A novel trypsin-like serine protease (hepsin) with a putative transmembrane domain expressed by human liver and hepatoma cells. Biochemistry 27:1067-1074, 1988.

Tsuji, A.; Torres-Rosado, A.; Arai, T.; Le Beau, M. M.; Lemons, R. S.; Chou, S.-H.; Kurachi, K.: Hepsin, a cell membrane-associated protease: characterization, tissue distribution, and gene localization. J. Biol. Chem. 266:16948-16953, 1991.

Wu, Q.; Yu, D.; Post, J.; Halks-Miller, M.; Sadler, J. E.; Morser, J.: Generation and characterization of mice deficient in hepsin, a hepatic transmembrane serine protease. J. Clin. Invest. 101:321-326,1998.

Cannella, B.; Hoban, C. J.; Gao, Y.-L.; Garcia-Arenas, R.; Lawson, D.; Marchionni, M.; Gwynne, D.; Raine, C. S.: The neuregulin, glial growth factor 2, diminishes autoimmune demyelination and enhances remyelination in a chronic relapsing model for multiple sclerosis. Proc. Nat. Acad. Sci. 95:10100-10105, 1998.

Falls, D. L.; Rosen, K. M.; Corfas, G.; Lane, W. S.; Fischbach, G. D.: ARIA, a protein that stimulates acetylcholine receptor synthesis, is a member of the Neu ligand family. Cell 72:801-815, 1993.

Fernandez, P.-A.; Tang, D. G.; Cheng, L.; Prochiantz, A.; Mudge, A. W.; Raff, M. C.: Evidence that axon-derived neuregulin promotes oligodendrocyte survival in the developing rat optic nerve. Neuron 28:81-90, 2000.

Holmes, W. E.; Sliwkowski, M. X.; Akita, R. W.; Henzel, W. J.; Lee, J.; Park, J. W.; Yansura, D.; Abadi, N.; Raab, H.; Lewis, G. D.; Shepard, H. M.; Kuang, W.-J.; Wood, W. I.; Goeddel, D. V.; Vandlen, R. L.: Identification of heregulin, a specific activator of p185(erbB2). Science 256:1205-1210, 1992.

Huang, Y. Z.; Won, S.; Ali, D. W.; Wang, Q.; Tanowitz, M.; Du, Q. S.; Pelkey, K. A.; Yang, D. J.; Xiong, W. C.; Salter, M. W.; Mei, L.: Regulation of neuregulin signaling by PSD-95 interacting with ErbB4 at CNS synapses. Neuron 26:443-455, 2000.

Lee, J.; Wood, W. I.: Assignment of heregulin (HGL) to human chromosome 8p22-p11 by PCR analysis of somatic cell hybrid DNA. Genomics 16:790-791, 1993.

Martinou, J.-C.; Falls, D. L.; Fischbach, G. D.; Merlie, J. P.: Acetylcholine receptor-inducing activity stimulates expression of the epsilon-subunit gene of the muscle acetylcholine receptor. Proc. Nat. Acad. Sci. 88:7669-7673, 1991.

Ni, C.-Y.; Murphy, M. P.; Golde, T. E.; Carpenter, G.: Gamma-secretase cleavage and nuclear localization of ErbB-4 receptor tyrosine kinase. Science 294:2179-2181, 2001.

Orr-Urtreger, A.; Trakhtenbrot, L.; Ben-Levy, R.; Wen, D.; Rechavi, G.; Lonai, P.; Yarden, Y.: Neural expression and chromosomal mapping of NEU differentiation factor to 8p12-p21. Proc. Nat. Acad. Sci. 90:1867-1871, 1993.

Boyd, D.; Jain, S. K.; Crampton, J.; Barrett, K. J.; Drysdale, J.: Isolation and characterization of a cDNA clone for human ferritin heavy chain. Proc. Nat. Acad. Sci. 81:4751-4755, 1984.

Caskey, J. H.; Jones, C.; Miller, Y. E.; Seligman, P. A.: human ferritin gene is assigned to chromosome 19. Proc. Nat. Acad. Sci. 80:482-486, 1983.

Costanzo, F.; Colombo, M.; Staempfli, S.; Santoro, C.; Marone, M.; Frank, R.; Delius, H.; Cortese, R.: Structure of gene and pseudogenes of human apoferritin H. Nucleic Acids Res. 14:721-736, 1986.

Cragg, S. J.; Drysdale, J.; Worwood, M.: Genes for the 'H' subunit of human ferritin are present on a number of human chromosomes. Hum. Genet. 71:108-112, 1985.

Eisenstein, R. S.: Iron regulatory proteins and the molecular control of mammalian iron metabolism. Annu. Rev. Nutr. 20:627-662,2000.

Ferreira, C.; Bucchini, D.; Martin, M.-E.; Levi, S.; Arosio, P.; Grandchamp, B.; Beaumont, C.: Early embryonic lethality of H ferritin gene deletion in mice. J. Biol. Chem. 275:3021-3024, 2000.

Ferreira, C.; Santambrogio, P.; Martin, M.-E.; Andrieu, V.; Feldmann, G.; Henin, D.; Beaumont, C.: H ferritin knockout mice: a model of hyperferritinemia in the absence of iron overload. Blood 98:525-532,2001.

Gailani, M. R.; Petty, E. M.; Horsthemke, B.; Arnold, A.; Marx, S. J.; Bale, A. E.: Physical mapping of chromosome 11q12-13 by pulsed field gel electrophoresis (PFGE). (Abstract) Cytogenet. Cell Genet. 58:1959 only, 1991.

Gatti, R. A.; Shaked, R.; Mohandas, T. K.; Salser, W.: human ferritin genes: chromosomal assignments and polymorphisms. Am. J. Hum. Genet. 41:654-667, 1987.

Harrison, P. M.; Arosio, P.: The ferritins: molecular properties, iron storage function and cellular regulation. Biochim. Biophys. Acta 1275:161-203, 1996.

Hentze, M. W.; Keim, S.; Papadopoulos, P.; O'Brien, S.; Modi, W.; Drysdale, J.; Leonard, W. J.; Harford, J. B.; Klausner, R. D.: Cloning, characterization, expression, and chromosomal localization of a human ferritin heavy-chain gene. Proc. Nat. Acad. Sci. 83:7226-7230, 1986.

Kato, J.; Fujikawa, K.; Kanda, M.; Fukuda, N.; Sasaki, K.; Takayama, T.; Kobune, M.; Takada, K.; Takimoto, R.; Hamada, H.; Ikeda, T.; Niitsu, Y.: A mutation, in the iron-responsive element of H ferritin mRNA, causing autosomal dominant iron overload. Am. J. Hum. Genet. 69:191-197, 2001.

Leibold, E. A.; Munro, H. N.: Cytoplasmic protein binds in vitro to a highly conserved sequence in the 5-prime untranslated region of ferritin heavy- and light-subunit mRNAs. Proc. Nat. Acad. Sci. 85:2171-2175, 1988.

Anderson, L. A.; Friedman, L.; Osborne-Lawrence, S.; Lynch, E.; Weissenbach, J.; Bowcock, A.; King, M.-C.: High-density genetic map of the BRCA1 region of chromosome 17q12-q21. Genomics 17:618-623,1993.

Zurawski, S. M.; Vega, F., Jr.; Huyghe, B.; Zurawski, G.: Receptors for interleukin-13 and interleukin-4 are complex and share a novel component that functions in signal transduction. EMBO J. 12:2663-2670,1993.

Koshland, M. E.: The coming of age of the immunoglobulin J chain. Annu. Rev. Immun. 3:425-453, 1985.

Max, E. E.; McBride, O. W.; Morton, C. C.; Robinson, M. A.: human J chain gene: chromosomal localization and associated restriction fragment length polymorphisms. Proc. Nat. Acad. Sci. 83:5592-5596,1986.

Galizzi, J.-P.; Zuber, C. E.; Harada, N.; Gorman, D. M.; Kastelein, R.; Banchereau, J.; Howard, M.; Miyajima, A.: Molecular cloning of a cDNA encoding the human interleukin 4 receptor. Int. Immun. 2:669-675, 1990.

Grimbacher, B.; Holland, S. M.; Puck, J. M.: The interleukin-4 receptor variant Q576R in hyper-IgE syndrome. (Letter) New Eng. J. Med. 338:1073-1074, 1998.

Idzerda, R. L.; March, C. J.; Mosley, B.; Lyman, S. D.; VandenBos, T.; Gimpel, S. D.; Din, W. S.; Grabstein, K. H.; Widmer, M. B.; Park, L. S.; Cosman, D.; Beckmann, M. P.: Human interleukin-4 receptor confers biological responsiveness and defines a novel receptor superfamily. J. Exp. Med. 171:861-873, 1990.

Khurana Hershey, G. K.; Friedrich, M. F.; Esswein, L. A.; Thomas, M. L.; Chatila, T. A.: The association of atopy with a gain-of-function mutation in the alpha subunit of the interleukin-4 receptor. New Eng. J. Med. 337:1720-1725, 1997.

Kruse, S.; Japha, T.; Tedner, M.; Sparholt, S. H.; Forster, J.; Kuehr, J.; Deichmann, K. A.; Abello, A.: The polymorphisms S503P and Q576R in the interleukin-4 receptor alpha gene are associated with atopy and influence the signal transduction. Immunology 96:365-371, 1999.

Mitsuyasu, H.; Izuhara, K.; Mao, X.-Q.; Gao, P.-S.; Arinobu, Y.; Enomoto, T.; Kawai, M.; Sasaki, S.; Dake, Y.; Hamasaki, N.; Shirakawa, T.; Hopkin, J. M.: Ile50val variant of IL4R-alpha upregulates IgE synthesis and associates with atopic asthma. (Letter) Nature Genet. 19:119-120, 1998.

Ober, C.; Leavitt, S. A.; Tsalenko, A.; Howard, T. D.; Hoki, D. M.; Daniel, R.; Newman, D. L.; Wu, X.; Parry, R.; Lester, L. A.; Solway, J.; Blumenthal, M.; King, R. A.; Xu, J.; Meyers, D. A.; Bleecker, E. R.; Cox, N. J.: Variation in the interleukin 4-receptor alphagene confers susceptibility to asthma and atopy in ethnically diverse populations. Am. J. Hum. Genet. 66:517-526, 2000.

Ober, C.; Tsalenko, A.; Willadsen, S.; Newman, D.; Daniel, R.; Wu, X.; Andal, J.; Hoki, D.; Schneider, D.; True, K.; Schou, C.; Parry, R.; Cox, N.: Genome-wide screen for atopy susceptibility alleles in the Hutterites. Clin. Exp. Allergy 29 (suppl. 4):11-15, 1999.

Patuzzo, C.; Trabetti, E.; Malerba, G.; Martinati, L. C.; Boner, A. L.; Pescollderungg, L.; Zanoni, G.; Pignatti, P. F.: No linkage or association of the IL-4R-alpha gene Q576R mutation with atopic asthma in Italian families. (Letter) J. Med. Genet. 37:382-384,2000.

Pritchard, M. A.; Baker, E.; Whitmore, S. A.; Sutherland, G. R.; Idzerda, R. L.; Park, L. S.; Cosman, D.; Jenkins, N. A.; Gilbert, D. J.; Copeland, N. G.; Beckmann, M. P.: The interleukin-4 receptor gene (IL4R) maps to 16p11.2-16p12.1 in human and to the distal region of mouse chromosome 7. Genomics 10:801-806, 1991.

Suzuki, H.; Chung, F.; Palmer, E.; Sasaki, T.; Ohara, N.; Taylor, B. A.; Ohara, J.-I.: Gene mapping of mouse IL-4 receptor: the loci of interleukin 4 (IL-4) receptor gene and lymphocyte function associated antigen 1 (LFA-1) gene are closely linked on chromosome 7. Immunogenetics 34:252-256, 1991.

Mezei, M. M.; Mankodi, A.; Brais, B.; Marineau, C.; Thornton, C. A.; Rouleau, G. A.; Karpati, G.: Minimal expansion of the GCG repeat in the PABP2 gene does not predispose to sporadic inclusion body myositis. Neurology 52:669-670, 1999.

Fajans, S. S.: Maturity-onset diabetes of the young (MODY). Diabetes Metab. Rev. 5:579-606, 1989.

Laroia, G.; Cuesta, R.; Brewer, G.; Schneider, R. J.: control of mRNA decay by heat shock-ubiquitin-proteasome pathway. Science 284:499-502, 1999.

Milner, C. M.; Campbell, R. D.: Polymorphic analysis of the three MHC-linked HSP70 genes. Immunogenetics 36:357-362, 1992.

Milner, C. M.; Campbell, R. D.: Structure and expression of the three MHC-linked HSP70 genes. Immunogenetics 32:242-251, 1990.

Sargent, C. A.; Dunham, I.; Trowsdale, J.; Campbell, R. D.: human major histocompatibility complex contains genes for the major heatshock protein HSP70. Proc. Nat. Acad. Sci. 86:1968-1972, 1989.

Wolpowitz, D.; Mason, T. B. A.; Dietrich, P.; Mendelsohn, M.; Talmage, D. A.; Role, L. W.: Cysteine-rich domain isoforms of the neuregulin-1 gene are required for maintenance of peripheral synapses. Neuron 25:79-91, 2000.

Bolton, P.; Powell, J.; Rutter, M.; Buckle, V.; Yates, J. R. W.; Ishikawa-Brush, Y.; Monaco, A. P.: Autism, mental retardation, multiple exostoses and short stature in a female with 46, X, t (X;8)(p22.13; q22.1). Psychiat. Genet. 5:51-55, 1995.

David, G.; van der Schueren, B.; Marynen, P.; Cassiman, J.-J.; van den Berghe, H.: Molecular cloning of amphiglycan, a novel integral membrane heparan sulfate proteoglycan expressed by epithelial and fibroblastic cells. J. Cell Biol. 118:961-969, 1992.

Ishikawa-Brush, Y.; Powell, J. F.; Bolton, P.; Miller, A. P.; Francis, F.; Willard, H. F.; Lehrach, H.; Monaco, A. P.: Autism and multiple exostoses associated with an X;8 translocation occurring within the GRPR gene and 3-prime to the SDC2 gene. Hum. Molec. Genet. 6:1241-1250,1997.

Spring, J.; Goldberger, O. A.; Jenkins, N. A.; Gilbert, D. J.; Copeland, N. G.; Bernfield, M.: Mapping of the syndecan genes in the mouse: linkage with members of the Myc gene family. Genomics 21:597-601, 1994.

Browner, M. F.; Nakano, K.; Bang, A. G.; Fletterick, R. J.: human muscle glycogen synthase cDNA sequence: a negatively charged protein with an asymmetric charge distribution. Proc. Nat. Acad. Sci. 86:1443-1447, 1989.

Groop, L. C.; Kankuri, M.; Schalin-Jantti, C.; Ekstrand, A.; Nikula-Ijas, P.; Widen, E.; Kuismanen, E.; Eriksson, J.; Franssila-Kallunki, A.; Saloranta, C.; Koskimies, S.: Association between polymorphism of the glycogen synthase gene and non-insulin-dependent diabetes mellitus. New Eng. J. Med. 328:10-14, 1993.

Huang, X.; Vaag, A.; Hansson, M.; Weng, J.; Laurila, E.; Groop, L.: Impaired insulin-stimulated expression of the glycogen synthase gene in skeletal muscle of type 2 diabetic patients is acquired rather than inherited. J. Clin. Endocr. Metab. 85:1584-1590, 2000.

Kadowaki, T.; Kadowaki, H.; Yazaki, Y.: Polymorphism of the glycogen synthase gene and non-insulin-dependent diabetes mellitus. (Letter) New Eng. J. Med. 328:1569, 1993.

Lehto, M.; Stoffel, M.; Groop, L.; Espinosa, R., III; Le Beau, M. M.; Bell, G. I.: Assignment of the gene encoding glycogen synthase (GYS) to human chromosome 19, band q13.3. Genomics 15:460-461,1993.

Seldin, M. F.; Mott, D.; Bhat, D.; Petro, A.; Kuhn, C. M.; Kingsmore, S. F.; Bogardus, C.; Opara, E.; Feinglos, M. N.; Surwit, R. S.: Glycogen synthase: a putative locus for diet-induced hyperglycemia. J. Clin. Invest. 94:269-276, 1994.

Zouali, H.; Velho, G.; Froguel, P.: Polymorphism of the glycogensynthase gene and non-insulin-dependent diabetes mellitus. (Letter) New Eng. J. Med. 328:1568, 1993.

Garland, D.; Rao, P. V.; Del Corso, A.; Mura, U.; Zigler, J. S., Jr.: Zeta-crystallin is a major protein in the lens of Camelus dromedarius. Arch. Biochem. Biophys. 285:134-136, 1991.

Gonzalez, P.; Rao, P. V.; Zigler, J. S., Jr.: Organization of the human zeta-crystallin/quinone reductase gene (CRYZ). Genomics 21:317-324, 1994.

Heinzmann, C.; Kojis, T. L.; Gonzalez, P.; Rao, P. V.; Zigler, J. S., Jr.; Polymeropoulos, M. H.; Klisak, I.; Sparkes, R. S.; Mohandas, T.; Bateman, J. B.: Assignment of the zeta-crystallin gene (CRYZ) to human chromosome 1p22-p31 and identification of restriction fragment length polymorphisms. Genomics 23:403-407, 1994.

Huang, Q.-L.; Russell, P.; Stone, S. H.; Zigler, J. S., Jr.: Zeta-crystallin, a novel lens protein from the guinea pig. Curr. Eye Res. 6:725-732,1987.

Rodriguez, I. R.; Gonzalez, P.; Zigler, J. S., Jr.; Borras, T.: A guinea-pig hereditary cataract contains a splice site deletion in a crystallin gene. Biochim. Biophys. Acta 1180:44-52, 1992.

Tabas, J. A.; Zasloff, M.; Wasmuth, J. J.; Emanuel, B. S.; Altherr, M. R.; McPherson, J. D.; Wozney, J. M.; Kaplan, F. S.: Bone morphogenetic protein: chromosomal localization of human genes for BMP1, BMP2A, and BMP3. Genomics 9:283-289, 1991.

Wozney, J. M.; Rosen, V.; Celeste, A. J.; Mitsock, L. M.; Whitters, M. J.; Kriz, R. W.; Hewick, R. M.; Wang, E. A.:

Novel regulators of bone formation: molecular clones and activities. Science 242:1528-1534, 1988.

Connor, J. M.: Fibrodysplasia ossificans progressiva: lessons from rare maladies. (Editorial) New Eng. J. Med. 335: 591-593, 1996.

Dooley, C. A.; Attia, G. R.; Rainey, W. E.; Moore, D. R.; Carr, B. R.: Bone morphogenetic protein inhibits ovarian androgen production. J. Clin. Endocr. Metab. 85:3331-3337, 2000.

McAlpine, P. J.: Personal Communication. Winnipeg, Manitoba, Canada Jul. 15, 1992.

Monsoro-Burq, A.-H.; le Douarin, N. M.: BMP4 plays a key role in left-right patterning in chick embryos by maintaining Sonic Hedgehog asymmetry. Molec. Cell 7:789-799, 2001.

Shafritz, A. B.; Shore, E. M.; Gannon, F. H.; Zasloff, M. A.; Taub, R.; Muenke, M.; Kaplan, F. S.: Overexpression of an osteogenic morphogen in fibrodysplasia ossificans progressiva. New Eng. J. Med. 335:555-561, 1996.

Tabas, J. A.; Hahn, G. V.; Cohen, R. B.; Seaunez, H. N.; Modi, W. S.; Wozney, J. M.; Zasloff, M.; Kaplan, F. S.: Chromosomal assignment of the human gene for bone morphogenetic protein 4. Clin. Orthop. Rel. Res. 293:310-316, 1993.

Tucker, A. S.; Matthews, K. L.; Sharpe, P. T.: Transformation of tooth type induced by inhibition of BMP signaling. Science 282:1136-1138, 1998.

van den Wijngaard, A.; Olde Weghuis, D.; Boersma, C. J. C.; vanZoelen, E. J. J.; Geurts van Kessel, A.; Olijve, W.: Fine mapping of the human bone morphogenetic protein-4 gene (BMP4) to chromosome 14q22-q23 by in situ hybridization. Genomics 27:559-560, 1995.

van den Wijngaard, A.; van Kraay, M.; van Zoelen, E. J. J.; Olijve, W.; Boersma, C. J. C.: Genomic organization of the human bone morphogenetic protein-4 gene: molecular basis for multiple transcripts. Biochem. Biophys. Res. Commun. 219:789-794, 1996.

Amano, S.; Scott, I. C.; Takahara, K.; Koch, M.; Champliaud, M.-F.; Gerecke, D. R.; Keene, D. R.; Hudson, D. L.; Nishiyama, T.; Lee, S.; Greenspan, D. S.; Burgeson, R. E.: Bone morphogenetic protein 1 is an extracellular processing enzyme of the laminin 5 gamma-2 chain. J. Biol. Chem. 275:22728-22735, 2000.

Bond, J. S.; Beynon, R. J.: The astacin family of metalloendopeptidases. Protein Sci. 4:1247-1261, 1995.

Ceci, J. D.; Kingsley, D. M.; Silan, C. M.; Copeland, N. G.; Jenkins, N. A.: An interspecific backcross linkage map of the proximal half of mouse chromosome 14. Genomics 6:673-678, 1990.

Kessler, E.; Takahara, K.; Biniaminov, L.; Brusel, M.; Greenspan, D.: Bone morphogenic protein-1: the type I procollagen C-proteinase. Science 271:360-362, 1996.

Donalies, M.; Cramer, M.; Ringwald, M.; Starzinski-Powitz, A.: Expression of M-cadherin, a member of the cadherin multigene family, correlates with differentiation of skeletal muscle cells. Proc. Nat. Acad. Sci. 88:8024-8028, 1991.

Kaupmann, K.; Becker-Follmann, J.; Scherer, G.; Jockusch, H.; Starzinski-Powitz, A.: The gene for the cell adhesion molecule M-cadherin maps to mouse chromosome 8 and human chromosome 16q24.1-qter and is near the E-cadherin (uvomorulin) locus in both species. Genomics 14:488-490, 1992.

Kremmidiotis, G.; Baker, E.; Crawford, J.; Eyre, H. J.; Nahmias, J.; Callen, D. F.: Localization of human cadherin genes to chromosome regions exhibiting cancer-related loss of heterozygosity. Genomics 49:467-471, 1998.

Garcia-Castro, M. I.; Vielmetter, E.; Bronner-Fraser, M.: N-cadherin, a cell adhesion molecule involved in establishment of embryonic left-right asymmetry. Science 288:1047-1051, 2000.

Hermiston, M. L.; Gordon, J. I.: Inflammatory bowel disease and adenomas in mice expressing a dominant negative N-cadherin. Science 270:1203-1206, 1995.

Miyatani, S.; Copeland, N. G.; Gilbert, D. J.; Jenkins, N. A.; Takeichi, M.: Genomic structure and chromosomal mapping of the mouse N-cadherin gene. Proc. Nat. Acad. Sci. 89:8443-8447, 1992.

Takeichi, M.: Cadherins: a molecular family essential for selective cell-cell adhesion and animal morphogenesis. Trends Genet. 3:213-217,1987.

Tanaka, H.; Shan, W.; Phillips, G. R.; Arndt, K.; Bozdagi, O.; Shapiro, L.; Huntley, G. W.; Benson, D. L.; Colman, D. R.: Molecular modification of N-cadherin in response to synaptic activity. Neuron 25:93-107, 2000.

Wallis, J.; Fox, M. F.; Walsh, F. S.: Structure of the human N-cadherin gene: YAC analysis and fine chromosomal mapping to 18q11.2. Genomics 22:172-179, 1994.

Walsh, F. S.; Barton, C. H.; Putt, W.; Moore, S. E.; Kelsell, D.; Spurr, N.; Goodfellow, P. N.: N-cadherin gene maps to human chromosome 18 and is not linked to the E-cadherin gene. J. Neurochem. 55:805-812,1990.

Claverie, J.-M.; Hardelin, J.-P.; Legouis, R.; Levilliers, J.; Bougueleret, L.; Mattei, M.-G.; Petit, C.: Characterization and chromosomal assignment of a human cDNA encoding a protein related to the murine102-kDa cadherin-associated protein (alpha-catenin). Genomics 15:13-20, 1993.

Cook, S. A.; Bronson, R. T.; Donahue, L. R.; Ben-Arie, N.; Davisson, M. T.: Cerebellar deficient folia (cdf): a new mutation on mouse chromosome 6. Mammalian Genome 8:108-112, 1997.

Herrenknecht, K.; Ozawa, M.; Eckerskorn, C.; Lottspeich, F.; Lenter, M.; Kemler, R.: The uvomorulin-anchorage protein alpha-catenin is a vinculin homologue. Proc. Nat. Acad. Sci. 88:9156-9160, 1991.

Park, C.; Falls, W.; Finger, J. H.; Longo-Guess, C. M.; Ackerman, S. L.: Deletion in Catna2, encoding alpha-N-catenin, causes cerebellar and hippocampal lamination defects and impaired startle modulation. Nature Genet. 31:279-284, 2002.

Hanson, I.; Churchill, A.; Love, J.; Axton, R.; Moore, T.; Clarke, M.; Meire, F.; van Heyningen, V.: Missense mutations in the most ancient residues of the PAX6 paired domain underlie a spectrum of human congenital eye malformations. Hum. Molec. Genet. 8:165-172,1999.

O'Farrell, P. H.: High resolution two-dimensional electrophoresis of proteins. J. Biol. Chem. 250:4007-4021, 1975.

Martin-Subero, J. I.; Gesk, S.; Harder, L.; Sonoki, T.; Tucker, P. W.; Schlegelberger, B.; Grote, W.; Novo, F. J.; Calasanz, M. J.; Hansmann, M. L.; Dyer, M. J. S.; Siebert, R.: Recurrent involvement of the REL and BCL11A loci in classical Hodgkin lymphoma. Blood 99:1474-1477, 2002.

Emi, M.; Asaoka, H.; Matsumoto, A.; Itakura, H.; Kurihara, Y.; Wada, Y.; Kanamori, H.; Yazaki, Y.; Takahashi, E.; Lepert, M.; Lalouel, J.-M.; Kodama, T.; Mukai, T.: Structure, organization, and chromosomal mapping of the human macrophage scavenger receptor gene. J. Biol. Chem. 268:2120-2125, 1993.

Latil, A.; Lidereau, R.: Genetic aspects of prostate cancer. Virchows Arch. 432:389-406, 1998.

Matsumoto, A.; Naito, M.; Itakura, H.; Ikemoto, S.; Asaoka, H.; Hayakawa, I.; Kanamori, H.; Aburatani, H.; Takaku, F.; Suzuki, H.; Kobari, Y.; Miyai, T.; Takahashi, K.; Cohen, E. H.; Wydro, R.; Housman, D. E.; Kodama, T.: Human macrophage scavenger receptors: primary structure, expression, and localization in atherosclerotic lesions. Proc. Nat. Acad. Sci. 87:9133-9137, 1990.

Xu, J.; Zheng, S. L.; Hawkins, G. A.; Faith, D. A.; Kelly, B.; Isaacs, S. D.; Wiley, K. E.; Chang, B.; Ewing, C. M.; Bujnovszky, P.; Carpten, J. D.; Bleecker, E. R.; Walsh, P. C.; Trent, J. M.; Meyers, D. A.; Isaacs, W. B.: Linkage and association studies of prostate cancer susceptibility: evidence for linkage at 8p22-23. Am. J. Hum. Genet. 69:341-350, 2001.

Xu, J.; Zheng, S. L.; Komiya, A.; Mychaleckyj, J. C.; Isaacs, S. D.; Hu, J. J.; Sterling, D.; Lange, E. M.; Hawkins, G. A.; Turner, A.; Ewing, C. M.; Faith, D. A.; and 19 others: Germline mutations and sequence variants of the macrophage scavenger receptor 1 gene are associated with prostate cancer risk. Nature Genet. 32:321-325,2002.

Chavrier, P.; Janssen-Timmen, U.; Mattei, M.-G.; Zerial, M.; Bravo, R.; Charnay, P.: Structure, chromosome location, and expression of the mouse zinc finger gene Krox-20: multiple gene products and coregulation with the proto-oncogene c-fos. Molec. Cell. Biol. 9:787-797, 1989.

Le Beau, M. M.; Espinosa, R., III; Neuman, W. L.; Stock, W.; Roulston, D.; Larson, R. A.; Keinanen, M.; Westbrook, C. A.: Cytogenetic and molecular delineation of the smallest commonly deleted region of chromosome 5 in malignant myeloid diseases. Proc. Nat. Acad. Sci. 90:5484-5488,1993.

Barrow, L. L.; Simin, K.; Jones, J. M.; Lee, D. C.; Meisler, M. H.: Conserved linkage of early growth response 4, annexin 4, and transforming growth factor alpha on mouse chromosome 6. Genomics 19:388-390, 1994.

Crosby, S. D.; Veile, R. A.; Donis-Keller, H.; Baraban, J. M.; Bhat, R. V.; Simburger, K. S.; Milbrandt, J.: Neural-specific expression, genomic structure, and chromosomal localization of the gene encoding the zinc-finger transcription factor NGFI-C. Proc. Nat. Acad. Sci. 89:4739-4743, 1992.

Boerkoel, C. F.; Takashima, H.; Bacino, C. A.; Daentl, D.; Lupski, J. R.: EGR2 mutation R359W causes a spectrum of Dejerine-Sottas neuropathy. Neurogenetics 3:153-157, 2001.

Andres, D. A.; Milatovich, A.; Ozcelik, T.; Wenzlau, J. M.; Brown, M. S.; Goldstein, J. L.; Francke, U.: cDNA cloning of the two subunits of human CAAX farnesyltransferase and chromosomal mapping of FNTA and FNTB loci and related sequences. Genomics 18:105-112, 1993.

Long, S. B.; Casey, P. J.; Beese, L. S.: Reaction path of protein farnesyltransferase at atomic resolution. Nature 419: 645-650, 2002.

Musaro, A.; McCullagh, K. J. A.; Naya, F. J.; Olson, E. N.; Rosenthal, N.: IGF-1 induces skeletal myocyte hypertrophy through calcineurin in association with GATA-2 and NF-ATc1. Nature 400:581-585, 1999.

Semsarian, C.; Wu, M.-J.; Ju, Y.-K.; Marciniec, T.; Yeoh, T.; Allen, D. G.; Harvey, R. P.; Graham, R. M.: Skeletal muscle hypertrophy is mediated by a Ca (2+)-dependent calcineurin signalling pathway. Nature 400:576-581, 1999.

Gough, N. M.; Rakar, S.; Harpur, A.; Wilks, A. F.: Localization of genes for two members of the JAK family of protein tyrosine kinases to murine chromosomes 4 and 19. Mammalian Genome 6:247-248, 1995.

Ihle, J. N.: Cytokine receptor signalling. Nature 377:591-594,1995.

Pritchard, M. A.; Baker, E.; Callen, D. F.; Sutherland, G. R.; Wilks, A. F.: Two members of the JAK family of protein tyrosine kinases map to chromosomes 1p31.3 and 9p24. Mammalian Genome 3:36-38, 1992.

Campbell, G. S.; Argetsinger, L. S.; Ihle, J. N.; Kelly, P. A.; Rillema, J. A.; Carter-Su, C.: Activation of JAK2 tyrosine kinase by prolactin receptors in Nb2 cells and mouse mammary gland explants. Proc. Nat. Acad. Sci. 91:5232-5236, 1994.

Huang, L. J.; Constantinescu, S. N.; Lodish, H. F.: The N-terminal domain of Janus kinase 2 is required for Golgi processing and cell surface expression of erythropoietin receptor. Molec. Cell 8:1327-1338,2001.

Neubauer, H.; Cumano, A.; Muller, M.; Wu, H.; Huffstadt, U.; Pfeffer, K.: Jak2 deficiency defines an essential developmental checkpoint in definitive hematopoiesis. Cell 93:397-409, 1998.

Parganas, E.; Wang, D.; Stravopodis, D.; Topham, D. J.; Marine, J.-C.; Teglund, S.; Vanin, E. F.; Bodner, S.; Colamonici, O. R.; vanDeursen, J. M.; Grosveld, G.; Ihle, J. N.: Jak2 is essential for signaling through a variety of cytokine receptors. Cell 93:385-395,1998.

Saltzman, A.; Stone, M.; Franks, C.; Searfoss, G.; Munro, R.; Jaye, M.; Ivashchenko, Y.: Cloning and characterization of human Jak-2kinase: high mRNA expression in immune cells and muscle tissue. Biochem. Biophys. Res. Commun. 246:627-633, 1998.

Schwaller, J.; Parganas, E.; Wang, D.; Cain, D.; Aster, J. C.; Williams, I. R.; Lee, C.-K.; Gerthner, R.; Kitamura, T.; Frantsve, J.; Anastasiadou, E.; Loh, M. L.; Levy, D. E.; Ihle, J. N.; Gilliland, D. G.: Stat5 is essential for the myelo- and lymphoproliferative disease induced by TEL/JAK2. Molec. Cell 6:693-704, 2000.

Watling, D.; Guschin, D.; Muller, M.; Silvennoinen, O.; Witthuhn, B. A.; Quelle, F. W.; Rogers, N. C.; Schindler, C.; Stark, G. R.; Ihle, J. N.; Kerr, I. M.: Complementation by the protein tyrosine kinase JAK2 of a mutant cell line defective in the interferon-gamma signal transduction pathway. Nature 366:166-170, 1993.

Okano, M.; Bell, D. W.; Haber, D. A.; Li, E.: DNA methyltransferases Dnmt3a and Dnmt3b are essential for de novo methylation and mammalian development. Cell 99:247-257, 1999.

Xu, G.-L.; Bestor, T. H.; Bourc'his, D.; Hsieh, C.-L.; Tommerup, N.; Bugge, M.; Hulten, M.; Qu, X.; Russo, J. J.; Viegas-Pequignot, E.: Chromosome instability and immunodeficiency syndrome caused by mutations in a DNA methyltransferase gene. Nature 402:187-191,1999.

Wijmenga, C.; van den Heuvel, L. P. W. J.; Strengman, E.; Luyten, J. A. F. M.; van der Burgt, I. J. A. M.; de Groot, R.; Smeets, D. F. C. M.; Draaisma, J. M. T.; van Dongen, J. J.; De Abreu, R. A.; Pearson, P. L.; Sandkuijl, L. A.; Weemaes, C. M. R.: Localization of the ICF syndrome to chromosome 20 by homozygosity mapping. Am. J. Hum. Genet. 63:803-809, 1998.

Pizarro, T. T.; Michie, M. H.; Bentz, M.; Woraratanadharm, J.; Smith, M. F., Jr.; Foley, E.; Moskaluk, C. A.; Bickston, S. J.; Cominelli, F.: IL-18, a novel immunoregulatory cytokine, is up-regulated in Crohn's disease: expression and localization in intestinal mucosal cells. J. Immun. 162:6829-6835, 1999.

Bailey, W. J.; Slightom, J. L.; Goodman, M.: Rejection of the 'flying primate' hypothesis by phylogenetic evidence from the epsilon-globin gene. Science 256:86-89, 1992.

Baralle, F. E.; Shoulders, C. C.; Proudfoot, N. J.: The primary structure of the human epsilon-globin gene. Cell 21:621-626, 1980.

Fritsch, E. F.; Lawn, R. M.; Maniatis, T.: Molecular cloning and characterization of the human beta-like globin gene cluster. Cell 19:959-972, 1980.

Gale, R. E.; Clegg, J. B.; Huehns, E. R.: Human embryonic haemoglobins Gower 1 and Gower 2. Nature 280:162-164, 1979.

Gilman, J. G.; Smithies, O.: Fetal hemoglobin variants in mice. Science 160:885-886, 1968.

He, Z.; Russell, J. E.: A human embryonic hemoglobin inhibits Hb S polymerization in vitro and restores a normal phenotype to mouse models of sickle cell disease. Proc. Nat. Acad. Sci. 99:10635-10640,2002.

Huehns, E. R.; Dance, N.; Beaven, G. H.; Hecht, F.; Motulsky, A. G.: Human embryonic hemoglobin. Nature 201: 1095-1097, 1964.

Huehns, E. R.; Flynn, F. V.; Butler, E. A.; Beaven, G. H.: Two new hemoglobin variants in a very young human embryo. Nature 189:496-497, 1961.

Raich, N.; Papayannopoulou, T.; Stamatoyannopoulos, G.; Enver, T.: Demonstration of a human epsilon-globin gene silencer with studies in transgenic mice. Blood 79:861-864, 1992.

Ramsay, M.; Thomson, J. A.; Jenkins, T.: A new epsilon globin HincII variant fragment length in a South African Negroid family. J. Med. Genet. 23:145-150, 1986.

Shen, S.-H.; Smithies, O.: Human globin psi-beta-2 is not a globin-related sequence. Nucleic Acids Res. 10:7809-7818, 1982.

't Hart, L. M.; Stolk, R. P.; Heine, R. J.; Grobbee, D. E.; vander Does, F. E. E.; Maassen, J. A.: Association of the insulin-receptor variant met-985 with hyperglycemia and non-insulin-dependent diabetes mellitus in the Netherlands: a population-based study. Am. J. Hum. Genet. 59:1119-1125, 1996.

Accili, D.; Drago, J.; Lee, E. J.; Johnson, M. D.; Cool, M. H.; Salvatore, P.; Asico, L. D.; Jose, P. A.; Taylor, S. I.; Westphal, H.: Early neonatal death in mice homozygous for a null allele of the insulin receptor gene. Nature Genet. 12:106-109, 1996.

Accili, D.; Frapier, C.; Mosthaf, L.; McKeon, C.; Elbein, S. C.; Permutt, M. A.; Ramos, E.; Lander, E.; Ullrich, A.; Taylor, S. I.: A mutation in the insulin receptor gene that impairs transport of the receptor to the plasma membrane and causes insulin-resistant diabetes. EMBO J. 8:2509-2517, 1989.

Al-Gazali, L. I.; Khalil, M.; Devadas, K.: A syndrome of insulin resistance resembling leprechaunism in five sibs of consanguineous parents. J. Med. Genet. 30:470-475, 1993.

Bar, R. S.; Muggeo, M.; Roth, J.; Kahn, C. R.; Havrankova, J.; Imperato-McGinley, J.: Insulin resistance, acanthosis nigricans, and normal insulin receptors in a young woman: evidence for a postreceptor defect. J. Clin. Endocr. Metab. 47:620-625, 1978.

Barbetti, F.; Gejman, P. V.; Taylor, S. I.; Raben, N.; Cama, A.; Bonora, E.; Pizzo, P.; Moghetti, P.; Muggeo, M.; Roth, J.: Detection of mutations in insulin receptor gene by denaturing gradient gel electrophoresis. Diabetes 41:408-415, 1992.

Barnes, N. D.; Palumbo, P. J.; Hayles, A. B.; Folgar, H.: Insulin resistance, skin changes, and virilization: a recessively inherited syndrome possibly due to pineal gland dysfunction. Diabetologia 10:285-289, 1974.

Benecke, H.; Flier, J. S.; Moller, D. E.: Alternatively spliced variants of the insulin receptor protein: expression in normal and diabetic human tissues. J. Clin. Invest. 89:2066-2070, 1992.

Bruning, J. C.; Gautam, D.; Burks, D. J.; Gillette, J.; Schubert, M.; Orban, P. C.; Klein, R.; Krone, W.; Muller-Wieland, D.; Kahn, C. R.: Role of brain insulin receptor in control of body weight and reproduction. Science 289:2122-2125, 2000.

Belke, D. D.; Betuing, S.; Tuttle, M. J.; Graveleau, C.; Young, M. E.; Pham, M.; Zhang, D.; Cooksey, R. C.; McClain, D. A.; Litwin, S. E.; Taegtmeyer, H.; Severson, D.; Kahn, C. R.; Abel, E. D.: Insulin signaling coordinately regulates cardiac size, metabolism, and contractile protein isoform expression. J. Clin. Invest. 109:629-639, 2002.

Bruning, J. C.; Michael, M. D.; Winnay, J. N.; Hayashi, T.; Horsch, D.; Accili, D.; Goodyear, L. J.; Kahn, C. R.: A muscle-specific insulin receptor knockout exhibits features of the metabolic syndrome of NIDDM without altering glucose tolerance. Molec. Cell 2:559-569, 1998.

Cama, A.; de la Luz Sierra, M.; Ottini, L.; Kadowaki, T.; Gorden, P.; Imperato-McGinley, J.; Taylor, S. I.: A mutation in the tyrosine kinase domain of the insulin receptor associated with insulin resistance in an obese woman. J. Clin. Endocr. Metab. 73:894-901, 1991.

Henry, I.; Humphries, S. E.; Tata, F.; Barichard, F.; Holm, M.; Williamson, R.; Junien, C.: The gene for HMG CoA reductase (HMGCR) is on human chromosome 5. (Abstract) Cytogenet. Cell Genet. 40:649-650, 1985.

Humphries, S. E.; Tata, F.; Henry, I.; Barichard, F.; Holm, M.; Junien, C.; Williamson, R.: The isolation, characterisation, and chromosomal assignment of the gene for human 3-hydroxy-3-methylglutaryl coenzyme A reductase, (HMG-CoA reductase). Hum. Genet. 71:254-258,1985.

Ragoussis, J.; Senger, G.; Trowsdale, J.; Campbell, I. G.: Genomic organization of the human folate receptor genes on chromosome 11q13. Genomics 14:423-430, 1992.

Barber, R. C.; Shaw, G. M.; Lammer, E. J.; Greer, K. A.; Biela, T. A.; Lacey, S. W.; Wasserman, C. R.; Finnell, R. H.: Lack of association between mutations in the folate receptor-alpha gene and spina bifida. Am. J. Med. Genet. 76:310-317, 1998.

Bowcock, A. M.; Lacey, S.; Saltman, D.; Mohandas, T. K.; Kamen, B. A.; Taggart, R. T.: Localization of the folate receptor gene to chromosome 11q13. (Abstract) Cytogenet. Cell Genet. 58:1955 only,1991.

Campbell, I. G.; Jones, T. A.; Foulkes, W. D.; Trowsdale, J.:Folate-binding protein is a marker for ovarian cancer. Cancer Res. 51:5329-5338, 1991.

Kranes, A.; Balogh, K., Jr.: Liver disease in a patient with von Hippel-Lindau disease. New Eng. J. Med. 275:950-959, 1966.

Lamiell, J. M.: Personal Communication. San Francisco, Calif. Sep. 1987.

Lamiell, J. M.; Salazar, F. G.; Hsia, Y. E.: Von Hippel-Lindau disease affecting 43 members of a single kindred. Medicine 68:1-29,1989.

Latif, F.; Tory, K.; Gnarra, J.; Yao, M.; Duh, F.-M.; Orcutt, M. L.; Stackhouse, T.; Kuzmin, I.; Modi, W.; Geil, L.; Schmidt, L.; Zhou, F.; Li, H.; Wei, M. H.; Chen, F.; Glenn, G.; Choyke, P.; Walther, M. M.; Weng, Y.; Duan, D.-S. R.; Dean, M.; Glavac, D.; Richards, F. M.; Crossey, P. A.; Ferguson-Smith, M. A.; Le Paslier, D.; Chumakov, I.; Cohen, D.; Chinault, A. C.; Maher, E. R.; Linehan, W. M.; Zbar, B.; Lerman, M. I.: Identification of the von Hippel-Lindau disease tumor suppressor gene. Science 260:1317-1320, 1993.

Lee, S.; Chen, D. Y. T.; Humphrey, J. S.; Gnarra, J. R.; Linehan, W. M.; Klausner, R. D.: Nuclear/cytoplasmic localization of the von Hippel-Lindau tumor suppressor gene product is determined by cell density. Proc. Nat. Acad. Sci. 93:1770-1775, 1996.

Lenz, T.; Thiede, H. M.; Nussberger, J.; Atlas, S. A.; Distler, A.; Schulte, K. L.: Hyperreninemia and secondary hyperaldosteronism in a patient with pheochromocytoma and von Hippel-Lindau disease. Nephron 62:345-350, 1992.

Lindau, A.: Zur Frage der Angiomatosis Retinae und Ihrer Hirncomplikation. ActaOphthal. 4:193-226, 1927.

Loeb, D. B.; Pericak-Vance, M. A.; Stajich, J. M.; Vance, J. M.: A novel mutation in the von Hippel-Lindau gene. Hum. Molec. Genet. 3:1423-1424, 1994.

Lui, W. O.; Chen, J.; Glasker, S.; Bender, B. U.; Madura, C.; Khoo, S. K.; Kort, E.; Larsson, C.; Neumann, H. P. H.; Teh, B. T.: Selective loss of chromosome 11 in pheochromocytomas associated with the VHL syndrome. Oncogene 21:1117-1122, 2002.

Maddock, I. R.; Moran, A.; Maher, E. R.; Teare, M. D.; Norman, A.; Payne, S. J.; Whitehouse, R.; Dodd, C.; Lavin, M.; Hartley, N.; Super, M.; Evans, D. G. R.: A genetic register for von Hippel-Lindau disease. J. Med. Genet. 33:120-127, 1996.

Maher, E. R.; Bentley, E.; Yates, J. R. W.; Barton, D.; Jennings, A.; Fellows, I. W.; Ponder, M. A.; Ponder, B. A. J.; Benjamin, C.; Harris, R.; Ferguson-Smith, M. A.: Mapping of von Hippel-Lindau disease to chromosome 3p confirmed by genetic linkage analysis. J. Neurol. Sci. 100:27-30, 1990.

Maher, E. R.; Bentley, E.; Yates, J. R. W.; Latif, F.; Lerman, M.; Zbar, B.; Affara, N. A.; Ferguson-Smith, M. A.: Mapping of the von Hippel-Lindau disease locus to a small region of chromosome 3p by genetic linkage analysis. Genomics 10:957-960, 1991.

Maher, E. R.; Iselius, L.; Yates, J. R. W.; Littler, M.; Benjamin, C.; Harris, R.; Sampson, J.; Williams, A.; Ferguson-Smith, M. A.; Morton, N.: Von Hippel-Lindau disease: a genetic study. J. Med. Genet. 28:443-447, 1991.

Maher, E. R.; Yates, J. R. W.; Ferguson-Smith, M. A.: Statistical analysis of the two stage mutation model in von Hippel-Lindau disease, and in sporadic cerebellar haemangioblastoma and renal cell carcinoma. J. Med. Genet. 27:311-314, 1990.

Mahon, P. C.; Hirota, K.; Semenza, G. L.: FIH-1: a novel protein that interacts with HIF-1-alpha and VHL to mediate repression of HIF-1transcriptional activity. Genes Dev. 15:2675-2686, 2001.100. Manski, T. J.; Heffner, D. K.; Glenn, G. M.; Patronas, N. J.; Pikus, A. T.; Katz, D.; Lebovics, R.; Sledjeski, K.; Choyke, P. L.; Zbar, B.; Linehan, W. M.; Oldfield, E. H.: Endolymphatic sac tumors: a source of morbid hearing loss in von Hippel-Lindau disease. J. A. M. A. 277:1461-1466, 1997.101. Maxwell, P. H.; Wiesener, M. S.; Chang, G.-W.; Clifford, S. C.; Vaux, E. C.; Cockman, M. E.; Wykoff, C. C.; Pugh, C. W.; Maher, E. R.; Ratcliffe, P. J.: The tumour suppressor protein VHL targets hypoxia-inducible factors for oxygen-dependent proteolysis. Nature 399:271-275, 1999.102. McCabe, C. M.; Flynn, H. W., Jr.; Shields, C. L.; Shields, J. A.; Regillo, C. D.; McDonald, H. R.; Berrocal, M. H.; Gass, J. D. M.; Mieler, W. F.: Juxtapapillary capillary hemangiomas: clinical features and visual acuity outcomes. Ophthalmology 107:2240-2249,2000.103. McKusick, V. A.; Abbey, H.; Bettersby, E. J.; Borhani, N. O.; Boyer, S. H., IV; Cohen, B. H.; Ferguson-Smith, M. A.; Franke, F. R.; Gordon, H.; Handmaker, S. D.; Harris, W. S.; Hawkins, M. R.; and 13 others: Medical genetics 1960. J. Chronic Dis. 14:1-198, 1961. FIG. 71.104. Melmon, K. L.; Rosen, S. W.: Lindau's disease: review of the literature and study of a large kindred. Am. J. Med. 36:595-617,1964.105. Min, J.-H.; Yang, H.; Ivan, M.; Gertler, F.; Kaelin, W. G., Jr.; Pavletich, N. P.: Structure of an HIF-1-alpha-pVHL complex: hydroxyproline recognition in signaling. Science 296:1886-1889, 2002.106. Mukhopadhyay, D.; Knebelmann, B.; Cohen, H. T.; Ananth, S.; Sukhatme, V. P.: The von Hippel-Lindau tumor suppressor gene product interacts with Sp1 to repress vascular endothelial growth factor promoter activity. Molec. Cell. Biol. 17:5629-5639, 1997.107. Neumann, H. P. H.; Berger, D. P.; Sigmund, G.; Blum, U.; Schmidt, D.; Parmer, R. J.; Volk, B.; Kirste, G.: Pheochromocytomas, multiple endocrine neoplasia type 2, and von Hippel-Lindau disease. New Eng. J. Med. 329:1531-1538, 1993.108. Neumann, H. P. H.; Eng, C.; Mulligan, L. M.; Glavac, D.; Zauner, I.; Ponder, B. A. J.; Crossey, P. A.; Maher, E. R.; Brauch, H.: Consequences of direct genetic testing for germline mutations in the clinical management of families with multiple endocrine neoplasia, type II. J. A. M. A. 274:1149-1151, 1995.109. Neumann, H. P. H.; Wiestler, O. D.: Clustering of features of von Hippel-Lindau syndrome: evidence for a complex genetic locus. Lancet 337: 1052-1054, 1991.110. Nibbelink, D. W.; Peters, B. H.; McCormick, W. F.: On the association of pheochromocytoma and cerebellar hemangioblastoma. Neurology 19:455-460, 1969.111. Oberstrass, J.; Reifenberger, G.; Reifenberger, J.; Wechsler, W.; Collins, V. P.: Mutation of the von Hippel-Lindau tumour suppressor gene in capillary haemangioblastomas of the central nervous system. J. Path. 179:151-156, 1996.112. Ohh, M.; Yauch, R. L.; Lonergan, K. M.; Whaley, J. M.; Stemmer-Rachamimov, A. O.; Louis, D. N.; Gavin, B. J.; Kley, N.; Kaelin, W. G., Jr.; Iliopoulos, O.: The von Hippel-Lindau tumor suppressor protein is required for proper assembly of an extracellular fibronectin matrix. Molec. Cell 1:959-968, 1998.113. Olschwang, S.; Richard, S.; Boisson, C.; Giraud, S.; Laurent-Puig, P.; Resche, F.; Thomas, G.: Germline mutation profile of the VHL gene in von Hippel-Lindau disease and in sporadic hemangioblastoma. Hum. Mutat. 12:424-430, 1998.114. Otenasek, F. J.; Silver, M. L.: Spinal hemangioma (hemangioblastoma) in Lindau's disease: report of six cases in a single family. J. Neurosurg. 18:295-300, 1961.115. Pack, S. D.; Zbar, B.; Pak, E.; Ault, D. O.; Humphrey, J. S.; Pham, T.; Hurley, K.; Weil, R. J.; Park, W.-S.; Kuzmin, I.; Stolle, C.; Glenn, G.; Liotta, L. A.; Lerman, M. I.; Klausner, R. D.; Linehan, W. M.; Zhuang, Z.: Constitutional von Hippel-Lindau (VHL) gene deletions detected in VHL families by fluorescence in situ hybridization. Cancer Res. 59:5560-5564, 1999.116. Pause, A.; Lee, S.; Lonergan, K. M.; Klausner, R. D.: The von Hippel-Lindau tumor suppressor gene is required for cell cycle exit upon serum withdrawal. Proc. Nat. Acad. Sci. 95:993-998, 1998.117. Price, E. B., Jr.: Papillary cystadenoma of the epididymis: a clinicopathologic analysis of 20 cases. Arch. Path. 91:456-470,1971.118. Probst, A.; Lotz, M.; Heitz, P.: Von Hippel-Lindau's disease, syringomyelia and multiple endocrine tumors: a complex neuroendocrinopathy. Virchows Arch. Path. Anat. Histol. 378:265-272, 1978.119. Prowse, A. H.; Webster, A. R.; Richards, F. M.; Richard, S.; Olschwang, S.; Resche, F.; Affara, N. A.; Maher, E. R.: Somatic inactivation of the VHL gene in Von Hippel-Lindau disease tumors. Am. J. Hum. Genet. 60:765-771, 1997.120. Rho, Y. M.: Von Hippel-Lindau's disease: a report of 5 cases. Canad. Med. Assoc. J. 101:135-142, 1969.121. Richard, S.; Croisille, L.; Yvart, J.; Casadeval, N.; Eschwege, P.; Aghakhani, N.; David, P.; Gaudric, A.; Scigalla, P.; Hermine, O.: Paradoxical secondary polycythemia in von Hippel-Lindau patients treated with anti-vascular endothelial growth factor receptor therapy. Blood 99:3851-3853, 2002.122. Richards, F. M.; Crossey, P. A.; Phipps, M. E.; Foster, K.; Latif, F.; Evans, G.; Sampson, J.; Lerman, M. I.; Zbar, B.; Affara, N. A.; Ferguson-Smith, M. A.; Maher, E. R.: Detailed mapping of germline deletions of the von Hippel-Lindau disease tumour suppressor gene. Hum. Molec. Genet. 3:595-598, 1994.123. Richards, F. M.; Maher, E. R.; Latif, F.; Phipps, M. E.; Tory, K.; Lush, M.; Crossey, P. A.; Oostra, B.; Gustavson, K. H.; Green, J.; Turner, G.; Yates, J. R. W.; Linehan, W. M.; Affara, N. A.; Lerman, M.; Zbar, B.; Ferguson-Smith, M. A.: Detailed genetic mapping of the von Hippel-Lindau disease tumour suppressor gene. J. Med. Genet. 30:104-107, 1993.124. Richards, F. M.; Phipps, M. E.; Latif, F.; Yao, M.; Crossey, P. A.; Foster, K.; Linehan, W. M.; Affara, N. A.; Lerman, M. I.; Zbar, B.; Ferguson-Smith, M. A.; Maher, E. R.: Mapping the von Hippel-Lindau disease tumour suppressor gene: identification of germline deletions by pulsed field gel electrophoresis. Hum. Molec. Genet. 2:879-882,1993.125. Richards, F. M.; Schofield, P. N.; Fleming, S.; Maher, E. R.: Expression of the von Hippel-Lindau disease tumour suppressor gene during human embryogenesis. Hum. Molec. Genet. 5:639-644, 1996.126. Rubenstein, J. L.; Yaari, H.: von Hippel-Lindau and the genetics of astrocytoma. J. Nat. Cancer Inst. 86:142-143, 1994.127. Sander, S.; Normann, T.; Mathisen, W.: Pheochromocytoma associated with von-Hippel-Lindau's disease in a family. Scand. J. Urol. Nephrol. 4:259-263, 1970.128. Schechterman, L.: Lindau's disease: report of an unusual case and two additional cases in a Negro family. Med. Ann. D. C. 30:64-76,1961.129. Schimke, R. N.; Collins, D. L.; Rothberg, P. G.: Functioning carotid paraganglioma in the von Hippel-Lindau syndrome. (Letter) Am. J. Med. Genet. 80:533-534, 1998.130. Schoenfeld, A.; Davidowitz, E. J.; Burk, R. D.: A second major native von Hippel-Lindau gene product, initiated from an internal translation start site, functions as a tumor suppressor. Proc. Nat. Acad. Sci. 95:8817-8822, 1998.131. Seizinger, B. R.; Farmer, G.; Haines, J.; Anderson, K.; Whaley, J.; Hettlich, C.; Decker, J.; Rouleau, G.; Smith, D.; Drabkin, H.; Filling-Katz, M.; Neumann, H.; Collins, D.; Hsia, E.; Green, J.; Waziri, M.; Gusella, J.; Li, F.: Isolating the gene (s) for von Hippel-Lindau disease and renal cell carcinoma. (Abstract) Am. J. Hum. Genet. 45(suppl.): A32, 1989.132. Seizinger, B. R.; Rouleau, G. A.; Ozelius, L. J.; Lane, A. H.; Farmer, G. E.; Lamiell, J. M.; Haines, J.; Yuen, J. W.; Collins, D.; Majoor-Krakauer, D.; et al.: Von Hippel-Lindau disease maps to the region of chromosome 3 associated with renal cell carcinoma. Nature 332:268-269, 1988.133. Seizinger, B. R.; Smith, D. I.; Filling-Katz, M. R.; Neumann, H.; Green, J. S.; Choyke, P. L.; Anderson, K. M.; Freiman, R. N.; Klauck, S. M.; Whaley, J.; Decker, H.-J. H.; Hsia, Y. E.; Collins, D.; Halperin, J.; Lamiell, J. M.; Oostra, B.; Waziri, M. H.; Gorin, M. B.; Scherer, G.; Drabkin, H. A.; Aronin, N.; Schinzel, A.; Martuza, R. L.; Gusella, J. F.; Haines, J. L.: Genetic flanking markers refine diagnostic criteria and provide insights into the genetics of Von Hippel Lindau disease. Proc. Nat. Acad. Sci. 88:2864-2868, 1991.134. Sgambati, M. T.; Stolle, C.; Choyke, P. L.; Walther, M. M.; Zbar, B.; Linehan, W. M.; Glenn, G. M.: Mosaicism in von Hippel-Lindau disease: lessons from kindreds with germline mutations identified in offspring with mosaic parents. Am. J. Hum. Genet. 66:84-91, 2000.135. Sharp, W. V.; Platt, R. L.: Familial pheochromocytoma: association with von-Hippel-Lindau's disease. Angiology 22:141-146, 1971.136. Shokeir, M. H. K.: Von Hippel-Lindau syndrome: a report on three kindreds. J. Med. Genet. 7:155-157, 1970.137. Silver, M. L.: Hereditary vascular tumors of the nervous system. J. A. M. A.156:1053-1056, 1954.138. Stolle, C.; Glenn, G.; Zbar, B.; Humphrey, J. S.; Choyke, P.; Walther, M.; Pack, S.; Hurley, K.; Audrey, C.; Klausner, R.; Linehan, W. M.: Improved detection of germline mutations in the von Hippel-Lindau disease tumor suppressor gene. Hum. Mutat. 12:417-423, 1998.139. Thomas, M.; Burnside, R. M.: Von Hippel-Lindau disease. Am. J. Ophthal. 51:140-146, 1961.140. Tisherman, S. E.; Gregg, F. J.; Danowski, T. S.: Familial pheochromocytoma. J. A. M. A. 182:152-156, 1962.141. Tisherman, S. E.; Tisherman, B. G.; Tisherman, S. A.; Dunmire, C.; Levey, G. S.; Mulvihill, J. J.: Three-decade investigation of familial pheochromocytoma: an allele of von Hippel-Lindau disease? Arch. Int. Med. 153: 2550-2556, 1993.142. Tory, K.; Brauch, H.; Linehan, M.; Barba, D.; Oldfield, E.; Filling-Katz, M.; Seizinger, B.; Nakamura, Y.; White, R.; Marshall, F. F.; Lerman, M. I.; Zbar, B.: Specific genetic change in tumors associated with von Hippel-Lindau disease. J. Nat. Cancer Inst. 81:1097-1101, 1989.143. Tsuda, H.; Fukushima, S.; Takahashi, M.; Hikosaka, Y.; Hayashi, K.: Familial bilateral papillary cystadenoma of the epididymis: report of three cases in siblings. Cancer 37:1831-1839, 1976.144. Tyers, M.; Willems, A. R.: One ring to rule a superfamily of E3 ubiquitin ligases. Science 284:602-604, 1999.145. Vance, J. M.; Small, K. W.; Jones, M. A.; Stajich, J. M.; Yamaoka, L. H.; Roses, A. D.; Hung, W.-Y.; Pericak-Vance, M. A.: Confirmation of linkage in von Hippel-Lindau disease. Genomics 6:565-567, 1990.146. van der Harst, E.; de Krijger, R. R.; Dinjens, W. N. M.; Weeks, L. E.; Bonjer, H. J.; Bruining, H. A.; Lamberts, S. W. J.; Koper, J. W.: Germline mutations in the vhl gene in patients presenting with phaeochromocytomas. Int. J. Cancer. 77:337-340, 1998.147. Versteeg, R.: Aberrant methylation in cancer. (Editorial) Am. J. Hum. Genet. 60:751-754, 1997.148. Vogelstein, B.: Personal Communication. Baltimore, Md. Jan. 6, 1995.149. von Hippel, E.: Ueber eine sehr seltene Erkrankung der Netzhaut. Albrechtvon Graefes Arch. Ophthal. 59:83-106, 1904.150. Webster, A. R.; Maher, E. R.; Bird, A. C.; Moore, A. T.: Risk of multisystem disease in isolated ocular angioma (haemangioblastoma). J. Med. Genet. 37:62-63, 2000.151. Webster, A. R.; Richards, F. M.; MacRonald, F. E.; Moore, A. T.; Maher, E. R.: An analysis of phenotypic variation in the familial cancer syndrome von Hippel-Lindau disease: evidence for modifier effects. Am. J. Hum. Genet. 63:1025-1035, 1998.152. Wells, R. A.; Reeders, S. T.; Green, J.; Johnson, G. J.; Robson, K. J. H.: Linkage studies of von Hippel-Lindau syndrome using multiple-locus hypervariable DNA probes. (Abstract) Cytogenet. Cell Genet. 46:714, 1987.153. Wesolowski, D. P.; Ellwood, R. A.; Schwab, R. E.; Farah, J.:Hippel-Lindau syndrome in identical twins. Brit. J. Radiol. 54:982-986, 1981.154. Wiesener, M. S.; Seyfarth, M.; Warnecke, C.; Jurgensen, J. S.; Rosenberger, C.; Morgan, N. V.; Maher, E. R.; Frei, U.; Eckardt, K.-U.: Paraneoplastic erythrocytosis associated with an inactivating point mutation of the von Hippel-Lindau gene in a renal cell carcinoma. Blood 99:3562-3565, 2002.155. Wise, K. S.; Gibson, J. A.: Von Hippel-Lindau's disease and phaeochromocytoma. Brit. Med. J. 1:441, 1971.156. Wyburn-Mason, R.: Arteriovenous aneurysm of mid-brain and retina, facial naevi and mental changes. Brain 66:163-203, 1943.157. Zatyka, M.; da Silva, N. F.; Clifford, S. C.; Morris, M. R.; Wiesener, M. S.; Eckardt, K.-U.; Houlston, R. S.; Richards, F. M.; Latif, F.; Maher, E. R.: Identification of cyclin D1 and other novel targets for the von Hippel-Lindau tumor suppressor gene by expression array analysis and investigation of cyclin D1 genotype as a modifier in von Hippel-Lindau disease. Cancer Res. 62:3803-3811, 2002.158. Zbar, B.; Kishida, T.; Chen, F.; Schmidt, L.; Maher, E. R.; Richards, F. M.; Crossey, P. A.; Webster, A. R.; Affara, N. A.; Ferguson-Smith, M. A.; Brauch, H.; Glavac, D.; and 14 others: Germline mutations in the Von Hippel-Lindau disease (VHL) gene in families from North America, Europe, and Japan. Hum. Mutat. 8:348-357, 1996.159. Zhuang, Z.; Emmert-Buck, M. R.; Roth, M. J.; Gnarra, J.; Linehan, W. M.; Liotta, L. A.; Lubensky, I. A.: Von Hippel-Lindau disease gene deletion detected in microdissected sporadic human colon carcinoma specimens. Hum. Path. 27:152-156, 1996.

Devlin, R. H.; Deeb, S.; Brunzell, J.; Hayden, M. R.: Partial gene duplication involving exon-Alu interchange results in lipoprotein lipase deficiency. Am. J. Hum. Genet. 46:112-119, 1990.

Dichek, H. L.; Fojo, S. S.; Beg, O. U.; Skarlatos, S. I.; Brunzell, J. D.; Cutler, G. B., Jr.; Brewer, H. B., Jr.: Identification of 2 separate allelic mutations in the lipoprotein lipase gene of a patient with the familial hyperchylomicronemia syndrome. J. Biol. Chem. 266:473-477, 1991.

Eckel, R. H.: Lipoprotein lipase: a multifunctional enzyme relevant to common metabolic diseases. New Eng. J. Med. 320:1060-1068, 1989.

Emi, M.; Hata, A.; Robertson, M.; Iverius, P.-H.; Hegele, R.; Lalouel, J.-M.: Lipoprotein lipase deficiency resulting from a nonsense mutation in exon 3 of the lipoprotein lipase gene. Am. J. Hum. Genet. 47:107-111, 1990.

Emi, M.; Wilson, D. E.; Iverius, P.-H.; Wu, L.; Hata, A.; Hegele, R.; Williams, R. R.; Lalouel, J.-M.: Missense mutation (gly-to-glu188) of human lipoprotein lipase imparting functional deficiency. J. Biol. Chem. 265:5910-5916, 1990.

Faustinella, F.; Chang, A.; Van Biervliet, J. P.; Rosseneu, M.; Vinaimont, N.; Smith, L. C.; Chen, S.-H.; Chan, L.: Catalytic triad residue mutation (asp156-to-gly) causing familial lipoprotein lipase deficiency: co-inheritance with a nonsense mutation (ser447-to-ter) in a Turkish family. J. Biol. Chem. 266:14418-14424, 1991.

Feoli-Fonseca, J. C.; Levy, E.; Godard, M.; Lambert, M.: Familial lipoprotein lipase deficiency in infancy: clinical, biochemical, and molecular study. J. Pediat. 133:417-423, 1998.

Fisher, R. M.; Humphries, S. E.; Talmud, P. J.: Common variation in the lipoprotein lipase gene: effects on plasma lipids and risk of atherosclerosis. Atherosclerosis 135:145-159, 1997.

Franklin, S. M.: Splenomegaly with lipaemia. Proc. Roy. Soc. Med. 30:711, 1937.

Funke, H.; Klug, J.; Assmann, G.: Hind III RFLP in the lipoprotein lipase gene, (LPL). Nucleic Acids Res. 15:9102, 1987.

Funke, H.; Reckwerth, A.; Stapenhorst, D.; Schulze Beiering, M.; Jansen, M.; Assmann, G.: Bst NI (Eco RII) RFLP in the lipoprotein lipase gene (LPL). Nucleic Acids Res. 16:2741, 1988.

Gagne, C.; Brun, L. D.; Julien, P.; Moorjani, S.; Lupien, P. J.: Primary lipoprotein lipase activity deficiency: clinical investigation of a French Canadian population. Canad. Med. Assoc. J. 140:405-411,1989.

Gilbert, B.; Rouis, M.; Griglio, S.; de Lumley, L.; Laplaud, P.-M.: Lipoprotein lipase (LPL) deficiency: a new patient homozygote for the preponderant mutation gly88-to-glu in the human LPL gene and review of reported mutations:75% are clustered in exons 5 and 6. Ann. Genet. 44:25-32, 2001.

Ginzinger, D. G.; Lewis, M. E. S.; Ma,Y.; Jones, B. R.; Liu, G.; Jones, S. D.; Hayden, M. R.: A mutation in the lipoprotein lipase gene is the molecular basis of chylomicronemia in a colony of domestic cats. J. Clin. Invest. 97:1257-1266, 1996.

Gotoda, T.; Yamada, N.; Kawamura, M.; Kozaki, K.; Mori, N.; Ishibashi, S.; Shimano, H.; Takaku, F.; Yazaki, Y.; Furuichi, Y.; Murase, T.: Heterogeneous mutations in the human lipoprotein lipase gene in patients with familial lipoprotein lipase deficiency. J. Clin. Invest. 88:1856-1864, 1991.

Gotoda, T.; Yamada, N.; Murase, T.; Miyake, S.; Murakami, R.; Kawamura, M.; Kozaki, K.; Mori, N.; Shimano, H.; Shimada, M.; Yazaki, Y.: A newly identified null allelic mutation in the human lipoprotein lipase (LPL) gene of a compound heterozygote with familial LPL deficiency. Biochim. Biophys. Acta 1138:353-356, 1992.

Hata, A.; Emi, M.; Luc, G.; Basdevant, A.; Gambert, P.; Iverius, P.-H.; Lalouel, J.-M.: Compound heterozygote for lipoprotein lipase deficiency: ser-to-thr (244) and transition in 3-prime splice site of intron 2 (AG-to-AA) in the lipoprotein lipase gene. Am. J. Hum. Genet. 47:721-726, 1990.

Hata, A.; Ridinger, D. N.; Sutherland, S. D.; Emi, M.; Kwong, L. K.; Shuhua, J.; Lubbers, A.; Guy-Grand, B.; Basdevant, A.; Iverius, P. H.; Wilson, D. E.; Lalouel, J.-M.: Missense mutations in exon5 of the human lipoprotein lipase gene: inactivation correlates with loss of dimerization. J. Biol. Chem. 267:20132-20139, 1992.

Haubenwallner, S.; Horl, G.; Shachter, N. S.; Presta, E.; Fried, S. K.; Hofler, G.; Kostner, G. M.; Breslow, J. L.; Zechner, R.: A novel missense mutation in the gene for lipoprotein lipase resulting in a highly conservative amino acid substitution (asp180-to-glu) causes familial chylomicronemia (type I hyperlipoproteinemia). Genomics 18:392-396, 1993.

Havel, R. J.; Gordon, R. S.: Idiopathic hyperlipemia: metabolic studies in an affected family. J. Clin. Invest. 39:1777-1790, 1960.

Heaney, A. P.; Sharer, N.; Rameh, B.; Braganza, J. M.; Durrington, P. N.: Prevention of recurrent pancreatitis in familial lipoprotein lipase deficiency with high-dose antioxidant therapy. J. Clin. Endocr. Metab. 84:1203-1205, 1999.

Heinzmann, C.; Ladias, J.; Antonarakis, S.; Kirchgessner, T.; Schotz, M.; Lusis, A. J.: RFLP for the human lipoprotein lipase (LPL) gene: Hind III. Nucleic Acids Res. 15:6763, 1987.

Heizmann, C.; Kirchgessner, T.; Kwiterovich, P. O.; Ladias, J. A.; Derby, C.; Antonarakis, S. E.; Lusis, A. J.: DNA polymorphism haplotypes of the human lipoprotein lipase gene: possible association with high density lipoprotein levels. Hum. Genet. 86:578-584, 1991.

Henderson, H.; Ma, Y.; Kastelein, J.; Roederer, G.; Julien, P.; Brunzell, J.; Hayden, M. R.: Identification of the molecular defects underlying chylomicronemia in the majority of 75 separate probands with LPL deficiency.(Abstract) Clin. Res. 39:336A, 1991.

Henderson, H. E.; Bijvoet, S. M.; Mannens, M. A. M. M.; Bruin, T.; Erkelens, D. W.; Hayden, M. R.; Kastelein, J. J. P.: Ile225-to-thr loop mutation in the lipoprotein lipase (LPL) gene is a de novo event. Am. J. Med. Genet. 78:313-316, 1998.

Sjalander, A.; Birgander, R.; Rannug, A.; Alexandrie, A.-K.; Tornling, G.; Beckman, G.: Association between the p21 codon 31A1 (arg) allele and lung cancer. Hum. Hered. 46:221-225, 1996.

Fryns, J. P.; van den Berghe, K.; van Assche, A.; van den Berghe, H.: Prenatal diagnosis of campomelic dwarfism. Clin. Genet. 19:199-201, 1981.

Mellows, H. J.; Pryse-Davies, J.; Bennett, M. J.; Carter, C. O.: The camptomelic syndrome in two female siblings. Clin. Genet. 18:137-141, 1980.

Millauer, B.; Shawver, L. K.; Plate, K. H.; Risau, W.; Ullrich, A.: Glioblastoma growth inhibited in vivo by a dominant-negative Flk-1 mutant. Nature 367:576-579, 1994.

Devor, E. J.; Grandy, D. K.; Civelli, O.; Litt, M.; Burgess, A. K.; Isenberg, K. E.; van de Wetering, B. J. M.; Oostra, B.: genetic linkage is excluded for the D2-dopamine receptor lambda-HD2G1 and flanking loci on chromosome 11q22-q23 in Tourette syndrome. Hum. Hered. 40:105-108, 1990.

Freemantle, S. J.; Taylor, S. M.; Krystal, G.; Moran, R. G.: Upstream organization of and multiple transcripts from the human folylpoly-gamma-glutamate synthetase gene. J. Biol. Chem. 270:9579-9584, 1995.

Garrow, T. A.; Admon, A.; Shane, B.: Expression cloning of a human CDNA encoding folylpoly (gamma-glutamate) synthetase and determination of its primary structure. Proc. Nat. Acad. Sci. 89:9151-9155, 1992.

Jones, C.; Kao, F.-T.: Regional mapping of the folylpolyglutamate synthetase gene (FPGS) to 9cen-q34. (Abstract) Cytogenet. Cell Genet. 37:499-500, 1984.

Jones, C.; Kao, F.-T.; Taylor, R. T.: Chromosomal assignment of the gene for folylpolyglutamate synthetase to human chromosome 9. Cytogenet. Cell Genet. 28:181-194, 1980.

Jones, C.; Kao, F. T.: Assignment of the human gene complementing the auxotrophic marker GAT-minus to chromosome 9. (Abstract) Cytogenet. Cell Genet. 25:168, 1979.

Kao, F. T.; Puck, T. T.: Genetics of somatic mammalian cells. VII. Induction and isolation of nutritional mutants in Chinese hamster cells. Proc. Nat. Acad. Sci. 60:1275-1281, 1968.

Sussman, D. J.; Milman, G.; Shane, B.: Characterization of human folylpolyglutamate synthetase expressed in Chinese hamster ovary cells. Somat. Cell Molec. Genet. 12:531-540, 1986.

Taylor, R. T.; Hanna, M. L.: Folate-dependent enzymes in cultured Chinese hamster cells: folylpolyglutamate synthetase and its absence in mutants auxotrophic for glycine, adenosine and thymidine. Arch. Biochem. Biophys. 181:331-344, 1977.

Taylor, S. M.; Freemantle, S. J.; Moran, R. G.: Structural organization of the human folylpoly-gamma-glutamate synthetase gene: evidence for a single genomic locus. Cancer Res. 55:6030-6034, 1995.

Buters, J. T. M.; Tang, B.-K.; Pineau, T.; Gelboin, H. V.; Kimura, S.; Gonzalez, F. J.: Role of CYP1A2 in caffeine pharmacokinetics and metabolism: studies using mice deficient in CYP1A2. Pharmacogenetics 6:291-296, 1996.

Butler, M. A.; Iwasaki, M.; Guengerich, F. P.; Kadlubar, F. F.: Human cytochrome P-450(PA) (P-450IA2), the phenacetin O-deethylase, is primarily responsible for the hepatic 3-demethylation of caffeine and N-oxidation of carcinogenic arylamines. Proc. Nat. Acad. Sci. 86:7696-7700, 1989.

Christiansen, L.; Bygum, A.; Jensen, A.; Thomsen, K.; Brandrup, F.; Horder, M.; Petersen, N. E.: Association between CYP1A2 polymorphism and susceptibility to porphyria cutanea tarda. Hum. Genet. 107:612-614, 2000.

Devonshire, H. W.; Kong, I.; Cooper, M.; Sloan, T. P.; Idle, J. R.; Smith, R. L.: The contribution of genetically determined oxidation status to inter-individual variation in phenacetin disposition. Brit. J. Clin. Pharm. 16:157-166, 1983.

Ikeya, K.; Jaiswal, A. K.; Owens, R. A.; Jones, J. E.; Nebert, D. W.; Kimura, S.: Human CYP1A2: sequence, gene structure, comparison with the mouse and rat orthologous gene, and differences in liver1A2 mRNA expression. Molec. Endocr. 3:1399-1408, 1989.

Jaiswal, A. K.; Nebert, D. W.; McBride, O. W.; Gonzalez, F. J.: Human P(3)450: cDNA and complete protein sequence, repetitive Alu sequences in the 3-prime nontranslated region, and localization of gene to chromosome 15. J. Exp. Path. 3:1-17, 1987.

Liang, H.-C. L.; Li, H.; McKinnon, R. A.; Duffy, J. J.; Potter, S. S.; Puga, A.; Nebert, D. W.: Cyp1a2(-/-) null mutant mice develop normally but show deficient drug metabolism. Proc. Nat. Acad. Sci. 93:1671-1676, 1996.

Nebert, D. W.: Personal Communication. Bethesda, Md. Feb. 3, 1988.

Sesardic, D.; Boobis, A. R.; Edwards, R. J.; Davies, D. S.: A form of cytochrome P450 in man, orthologous to form d in the rat, catalyses the O-deethylation of phenacetin and is inducible by cigarette smoking. Brit. J. Clin. Pharm. 26:363-372, 1988.

Tantcheva-Poor, I.; Zaigler, M.; Rietbrock, S.; Fuhr, U.: Estimation of cytochrome P-450 CYP1A2 activity in 863 healthy Caucasians using a saliva-based caffeine test. Pharmacogenetics 9:131-144, 1999.

Wooding, S. P.; Watkins, W. S.; Bamshad, M. J.; Dunn, D. M.; Weiss, R. B.; Jorde, L. B.: DNA sequence variation in a 3.7-kb noncoding sequence 5-prime of the CYP1A2 gene: implications for human population history and natural selection. Am. J. Hum. Genet. 71:528-542, 2002.

Thum, T.; Borlak, J.: Gene expression in distinct regions of the heart. Lancet 355:979-983, 2000.

Xu, L.; Xia, J.; Jiang, H.; Zhou, J.; Li, H.; Wang, D.; Pan, Q.; Long, Z.; Fan, C.; Deng, H.-X.: Mutation analysis of hereditary multiple exostoses in the Chinese. Hum. Genet. 105:45-50, 1999.

Joutel, A.; Favrole, P.; Labauge, P.; Chabriat, H.; Lescoat, C.; Andreux, F.; Domenga, V.; Cecillon, M.; Vahedi, K.; Ducros, A.; Cave-Riant, F.; Bousser, M. G.; Tournier-Lasserve, E.: Skin biopsy immunostaining with a Notch3 monoclonal antibody for CADASIL diagnosis. Lancet 358: 2049-2051, 2001.

Eubanks, J. H.; Djabali, M.; Selleri, L.; Grandy, D. K.; Civelli, O.; McElligott, D. L.; Evans, G. A.: Structure and linkage of the D2 dopamine receptor and neural cell adhesion molecule genes on human chromosome 11q23. Genomics 14:1010-1018, 1992.

Gejman, P. V.; Ram, A.; Gelernter, J.; Friedman, E.; Cao, Q.; Pickar, D.; Blum, K.; Noble, E. P.; Kranzler, H. R.; O'Malley, S.; Hamer, D. H.; Whitsitt, F.; Rao, P.; DeLisi, L. E.; Virkkunen, M.; Linnoila, M.; Goldman, D.; Gershon, E. S.: No structural mutation in the dopamine D2 receptor gene in alcoholism or schizophrenia: analysis using denaturing gradient gel electrophoresis. J. A. M. A. 271:204-208,1994.

Gelernter, J.; Grandy, D. K.; Bunzow, J.; Pakstis, A. J.; Civelli, O.; Retief, A. E.; Litt, M.; Kidd, K. K.: D(2) dopamine receptor locus (probe hD2G1) maps close to D11S29 (probe L7) and is also linked to PBGD (probe PBGD0.0) and D11S84 (probe p-2-7-ID6) on 11q. (Abstract) Cytogenet. Cell Genet. 51:1002 only, 1989.

Gelernter, J.; Pakstis, A. J.; Grandy, D.; Litt, M.; Retief, A. E.; Kennedy, J. L.; Hing-Loh, A.; Schoolfield, G.; Civelli, O.; Kidd, K. K.: Linkage map of eight human chromosome 11q markers, including DRD2, spanning 60 cM. Cytogenet. Cell Genet. 60:26-28, 1992.

Gelernter, J.; Pakstis, A. J.; Pauls, D. L.; Kurlan, R.; Gancher, S. T.; Civelli, O.; Grandy, D.; Kidd, K. K.: Gilles de la Tourette syndrome is not linked to D2-dopamine receptor. Arch. Gen. Psychiat. 47:1073-1077, 1990.

Giros, B.; Sokoloff, P.; Martres, M.-P.; Riou, J.-F.; Emorine, L. J.; Schwartz, J.-C.: Alternative splicing directs the expression of two D(2) dopamine receptor isoforms. Nature 342:923-926, 1989.

Grandy, D. K.; Litt, M.; Allen, L.; Bunzow, J. R.; Marchionni, M.; Makam, H.; Reed, L.; Magenis, R. E.; Civelli, O.: The human dopamine D(2) receptor gene is located on chromosome 11 at q22-q23 and identifies a TaqI RFLP. Am. J. Hum. Genet. 45:778-785, 1989.

Grandy, D. K.; Marchionni, M. A.; Makam, H.; Stofko, R. E.; Alfano, M.; Frothingham, L.; Fischer, J. B.; Burke-Howie, K. J.; Bunzow, J. R.; Server, A. C.; Civelli, O.: Cloning of the cDNA and gene for a human D2 dopamine receptor. Proc. Nat. Acad. Sci. 86:9762-9766,1989.

Klein, C.; Brin, M. F.; Kramer, P.; Sena-Esteves, M.; de Leon, D.; Doheny, D.; Bressman, S.; Fahn, S.; Breakefield, X. O.; Ozelius, L. J.: Association of a missense change in the D2 dopamine receptor with myoclonus dystonia. Proc. Nat. Acad. Sci. 96:5173-5176, 1999.

Maldonado, R.; Salardi, A.; Valverde, O.; Samad, T. A.; Roques, B. P.; Borrelli, E.: Absence of opiate rewarding effects in mice lacking dopamine D2 receptors. Nature 388: 586-589, 1997.

Milligan, G.: Receptors as kissing cousins. Science 288: 65-67,2000.

Monsma, F. J., Jr.; McVittie, L. D.; Gerfen, C. R.; Mahan, L. C.; Sibley, D. R.: Multiple D(2) dopamine receptors produced by alternative RNA splicing. Nature 342:926-929, 1989.

Oliveri, R. L.; Annesi, G.; Zappia, M.; Civitelli, D.; Montesanti, R.; Branca, D.; Nicoletti, G.; Spadafora, P.; Pasqua, A. A.; Cittadella, R.; Andreoli, V.; Gambardella, A.; Aguglia, U.; Quattrone, A.: Dopamine D2 receptor gene polymorphism and the risk of levodopa-induced dyskinesias in PD. Neurology 53:1425-1430, 1999.

Rocheville, M.; Lange, D. C.; Kumar, U.; Patel, S. C.; Patel, R. C.; Patel, Y. C.: Receptors for dopamine and somatostatin: formation of hetero-oligomers with enhanced functional activity. Science 288:154-157, 2000.

Smith, M.; Wasmuth, J.; McPherson, J. D.; Wagner, C.; Grandy, D.; Civelli, O.; Potkin, S.; Litt, M.: Cosegregation of an 11q22.3-9p22translocation with affective disorder: proximity of the dopamine D2receptor gene relative to the translocation breakpoint. (Abstract) Am. J. Hum. Genet. 45 (suppl.): A220 only, 1989.

St Clair, D.; Blackwood, D.; Muir, W.; Carothers, A.; Walker, M.; Spowart, G.; Gosden, C.; Evans, H. J.: Association within a family of a balanced autosomal translocation with major mental illness. Lancet 336:13-16, 1990.

Suarez, B. K.; Parsian, A.; Hampe, C. L.; Todd, R. D.; Reich, T.; Cloninger, C. R.: Linkage disequilibria at the D2 dopamine receptor locus (DRD2) in alcoholics and controls. Genomics 19:12-20, 1994.

Usiello, A.; Baik, J.-H.; Rouge-Pont, F.; Picetti, R.; Dierich, A.; LeMeur, M.; Piazza, P. V.; Borrelli, E.: Distinct functions of the two isoforms of dopamine D2 receptors. Nature 408:199-203, 2000.

Wang, J.; Liu, Z.-L.; Chen, B.: Association study of dopamineD2, D3 receptor gene polymorphisms with motor fluctuations in PD. Neurology 56:1757-1759, 2001.

Bevilacqua, M.; Butcher, E.; Furie, B.; Furie, B.; Gallatin, M.; Gimbrone, M.; Harlan, J.; Kishimoto, K.; Lasky, L.; McEver, R.; Paulson, J.; Rosen, S.; Seed, B.; Siegelman, M.; Springer, T.; Stoolman, L.; Tedder, T.; Varki, A.; Wagner, D.; Weissman, I.; Zimmerman, G.: Selectins: a family of adhesion receptors. (Letter) Cell 67:233 only, 1991.

Bevilacqua, M. P.; Stengelin, S.; Gimbrone, M. A., Jr.; Seed, B.: Endothelial leukocyte adhesion molecule 1: an inducible receptor for neutrophils related to complement regulatory proteins and lectins. Science 243:1160-1165, 1989.

Collins, T.; Williams, A.; Johnston, G. I.; Kim, J.; Eddy, R.; Shows, T.; Gimbrone, M. A., Jr.; Bevilacqua, M. P.: Structure and chromosomal location of the gene for endothelial-leukocyte adhesion molecule 1. J. Biol. Chem. 266:2466-2473, 1991.

DeLisser, H. M.; Christofidou-Solomidou, M.; Sun, J.; Nakada, M. T.; Sullivan, K. E.: Loss of endothelial surface expression of E-selectin in a patient with recurrent infections. Blood 94:884-894, 1999.

Wang, N.; Chintala, S. K.; Fini, M. E.; Schuman, J. S.: Activation of a tissue-specific stress response in the aqueous outflow pathway of the eye defines the glaucoma disease phenotype. Nature Med. 7:304-309, 2001.

Watson, M. L.; Kingsmore, S. F.; Johnston, G. I.; Siegelman, M. H.; Le Beau, M. M.; Lemons, R. S.; Bora, N. S.; Howard, T. A.; Weissman, I. L.; McEver, R. P.; Seldin, M. F.: Genomic organization of the selectin family of leukocyte adhesion molecules on human and mouse chromosome 1. J. Exp. Med. 172:263-272, 1990.

Wenzel, K.; Felix, S.; Kleber, F. X.; Brachold, R.; Menke, T.; Schattke, S.; Schulte, K. L.; Glaser, C.; Rohde, K.; Baumann, G.; Speer, A.: E-selectin polymorphism and atherosclerosis: an association study. Hum. Molec. Genet. 3:1935-1937, 1994.

Zheng, F.; Chevalier, J. A.; Zhang, L. Q.; Virgil, D.; Ye, S. Q.; Kwiterovich, P. O.: An HphI polymorphism in the E-selectin gene is associated with premature coronary artery disease. Clin. Genet. 59:58-64, 2001.

Burgess, W. H.; Mehlman, T.; Marshak, D. R.; Fraser, B. A.; Maciag, T.: Structural evidence that endothelial cell growth factor beta is the precursor of both endothelial cell growth factor alpha and acidic fibroblast growth factor. Proc. Nat. Acad. Sci. 83:7216-7220, 1986.

Eckenstein, F. P.: Fibroblast growth factors in the nervous system. J. Neurobiol. 25:1467-1480, 1994.

Gautschi-Sova, P.; Muller, T.; Bohlen, P.: Amino acid sequence of human acidic fibroblast growth factor. Biochem. Biophys. Res. Commun. 140:874-880, 1986.

Jaye, M.; Howk, R.; Burgess, W.; Ricca, G. A.; Chiu, I.-M.; Ravera, M. W.; O'Brien, S. J.; Modi, W. S.; Maciag, T.; Drohan, W. N.: human endothelial cell growth factor: cloning, nucleotide sequence, and chromosome localization. Science 233:541-545, 1986.

Jung, J.; Zheng, M.; Goldfarb, M.; Zaret, K. S.: Initiation of mammalian liver development from endoderm by fibroblast growth factors. Science 284:1998-2003, 1999.

Mergia, A.; Eddy, R.; Abraham, J. A.; Fiddes, J. C.; Shows, T. B.: The genes for basic and acidic fibroblast growth factors are on different human chromosomes. Biochem. Biophys. Res. Commun. 138:644-651, 1986.

Pellegrini, L.; Burke, D. F.; von Delft, F.; Mulloy, B.; Blundell, T. L.: Crystal structure of fibroblast growth factor receptor ectodomain bound to ligand and heparin. Nature 407:1029-1034, 2000.

Plotnikov, A. N.; Hubbard, S. R.; Schlessinger, J.; Mohammadi, M.: Crystal structures of two FGF-FGFR complexes reveal the determinants of ligand-receptor specificity. Cell 101:413-424, 2000.

Wang, W.-P.; Lehtoma, K.; Varban, M. L.; Krishnan, I.; Chiu, I.-M.: Cloning of the gene coding for human class 1 heparin-binding growth factor and its expression in fetal tissues. Molec. Cell. Biol. 9:2387-2395, 1989.

Cox, D. R.; Epstein, L. B.; Epstein, C. J.: Genes coding for sensitivity to interferon (IfRec) and soluble superoxide dismutase (SOD-1) are linked in mouse and man and map to mouse chromosome 16. Proc. Nat. Acad. Sci. 77:2168-2172, 1980.

De Clercq, E.; Edy, V. G.; Cassiman, J.-J.: Chromosome 21 does not code for an interferon receptor. Nature 264:249-251, 1976.

Epstein, L. B.; Epstein, C. J.: Localization of the gene AVG for the antiviral expression of immune and classical interferon to the distal portion of the long arm of chromosome 21. J. Infect. Dis. 133(suppl.): A56-A62, 1976.

Faltynek, C. R.; Branca, A. A.; McCandless, S.; Baglioni, C.: Characterization of an interferon receptor on human lymphoblastoid cells. Proc. Nat. Acad. Sci. 80:3269-3273, 1983.

Fournier, A.; Zhang, Z. Q.; Tan, Y. H.: Human beta: alpha but not gamma interferon binding site is a product of the chromosome 21 interferon action gene. Somat. Cell Molec. Genet. 11:291-295, 1985.

Lutfalla, G.; Gardiner, K.; Proudhon, D.; Vielh, E.; Uze, G.: The structure of the human interferon alpha/beta receptor gene. J. Biol. Chem. 267:2802-2809, 1992.

Lutfalla, G.; Roeckel, N.; Mogensen, K. E.; Mattei, M. G.; Uze, G.: Assignment of the human interferon-alpha receptor gene to chromosome 21q22.1 by in situ hybridization. J. Interferon Res. 10:515-517, 1990.

Maroun, L. E.: Interferon action and chromosome 21 trisomy. (Letter) J. Theor. Biol. 86:603-606, 1980.

Novick, D.; Cohen, B.; Rubinstein, M.: The human interferon alpha/beta receptor: characterization and molecular cloning. Cell 77:391-400,1994.

Raziuddin, A.; Sarkar, F. H.; Dutkowski, R.; Shulman, L.; Ruddle, F. H.; Gupta, S. L.: Receptors for human alpha and beta interferon but not for gamma interferon are specified by human chromosome 21. Proc. Nat. Acad. Sci. 81:5504-5508, 1984.

Revel, M.; Bash, D.; Ruddle, F. H.: Antibodies to a cell-surface component coded by human chromosome 21 inhibit action of interferon. Nature 260:139-141, 1976.

Calabrese, G.; Crescenzi, C.; Morizio, E.; Palka, G.; Guerra, E.; Alberti, S.: Assignment of TACSTD1 (alias TROP1, M4S1) to human chromosome 2p21 and refinement of mapping of TACSTD2 (alias TROP2, M1S1) to human chromosome 1p32 by in situ hybridization. Cytogenet. Cell Genet. 92:164-165, 2001.

Fornaro, M.; Dell'Arciprete, R.; Stella, M.; Bucci, C.; Nutini, M.; Capri, M. G.; Alberti, S.: Cloning of the gene encoding Trop-2, a cell-surface glycoprotein expressed by human carcinomas. Int. J. Cancer 62:610-618, 1995.

Linnenbach, A. J.; Seng, B. A.; Wu, S.; Robbins, S.; Scollon, M.; Pyrc, J. J.; Druck, T.; Huebner, K.: Retroposition in a family of carcinoma-associated antigen genes. Molec. Cell Biol. 13:1507-1515,1993.

Linnenbach, A. J.; Wojcierowski, J.; Wu, S.; Pyrc, J. J.; Ross, A. H.; Dietzschold, B.; Speicher, D.; Koprowski, H.: Sequence investigation of the major gastrointestinal tumor-associated antigen gene family, GA733. Proc. Nat. Acad. Sci. 86:27-31, 1989.

Ren, Z.; Lin, P.-Y.; Klintworth, G. K.; Iwata, F.; Munier, F. L.; Schorderet, D. F.; El Matri, L.; Theendakara, V.; Basti, S.; Reddy, M.; Hejtmancik, J. F.: Allelic and locus heterogeneity in autosomal recessive gelatinous drop-like corneal dystrophy. Hum. Genet. 110:568-577, 2002.

Tsujikawa, M.; Kurahashi, H.; Tanaka, T.; Nishida, K.; Shimomura, Y.; Tano, Y.; Nakamura, Y.: Identification of the gene responsible for gelatinous drop-like corneal dystrophy. Nature Genet. 21:420-423,1999.

Willecke, K.; Jungbluth, S.; Dahl, E.; Hennemann, H.; Heynkes, R.; Grzeschik, K.-H.: Six genes of the human connexin gene family coding for gap junctional proteins are assigned to four different human chromosomes. Europ. J. Cell Biol. 53:275-280, 1990.

Gelb, B. D.; Zhang, J.; Cotter, P. D.; Gershin, I. F.; Desnick, R. J.: Physical mapping of the human connexin 40 (GJA5) flavin-containing monooxygenase 5, and natriuretic peptide receptor A genes on 1q21. Genomics 39:409-411, 1997.

Kanter, H. L.; Saffitz, J. E.; Beyer, E. C.: Cardiac myocytes express multiple gap junction proteins. Circ. Res. 70:438-444,1992.

Kanter, H. L.; Saffitz, J. E.; Beyer, E. C.: Molecular cloning of two human cardiac gap junction proteins, connexin40 and connexin45. J. Molec. Cell. Cardiol. 26:861-868, 1994.

Oviedo-Orta, E.; Hoy, T.; Evans, W. H.: Intercellular communication in the immune system: differential expression of connexin40 and 43, and perturbation of gap junction channel functions in peripheral blood and tonsil human lymphocyte subpopulations. Immunology 99:578-590,2000.

Seul, K. H.; Tadros, P. N.; Beyer, E. C.: Mouse connexin40: gene structure and promoter analysis. Genomics 46:120-126, 1997.

Britz-Cunningham, S. H.; Shah, M. M.; Zuppan, C. W.; Fletcher, W. H.: Mutations of the Connexin 43 gap-junction gene in patients with heart malformations and defects of laterality. New Eng. J. Med. 332:1323-1329, 1995.

Brueckner, M.; d'Eustachio, P.; Horwich, A. L.: Linkage mapping of a mouse gene, iv, that controls left-right asymmetry of the heart and viscera. Proc. Nat. Acad. Sci. 86:5035-5038, 1989.

Burdine, R. D.; Schier, A. F.: Conserved and divergent mechanisms in left-right axis formation. Genes Dev. 14:763-776, 2000.

Casey, B.; Ballabio, A.: Connexin 43 mutations in sporadic and familial defects of laterality. (Letter) New Eng. J. Med. 333:941,1995.

Corcos, I. A.; Meese, E. U.; Loch-Caruso, R.: Human connexin 43gene locus, GJA1, sublocalized to band 6q21-q23.2. Cytogenet. Cell Genet. 64:31-32, 1993.

Debrus, S.; Tuffery, S.; Matsuoka, R.; Galal, O.; Sarda, P.; Sauer, U.; Bozio, A.; Tanman, B.; Toutain, A.; Claustres, M.; Le Paslier, D.; Bouvagnet, P.: Lack of evidence for connexin 43 gene mutations in human autosomal recessive lateralization defects. J. Molec. Cell. Cardiol. 29:1423-1431, 1997.

Barco, A.; Alarcon, J. M.; Kandel, E. R.: Expression of constitutively active CREB protein facilitates the late phase of long-term potentiation by enhancing synaptic capture. Cell 108:689-703, 2002.

Barton, C. H.; Ajioka, J. W.; Roach, T. I. A.; Blackwell, J. M.: Mapping Creb-1 to chromosome 1 in the mouse. Genomics 14:790-792,1992.

Barton, K.; Muthusamy, N.; Chanyangam, M.; Fischer, C.; Clendenin, C.; Leiden, J. M.: Defective thymocyte proliferation and IL-2 production in transgenic mice expressing a dominant-negative form of CREB. Nature 379:81-85, 1996.

Carlezon, W. A., Jr.; Thome, J; Olson, V. G.; Lane-Ladd, S. B.; Brodkin, E. S.; Hiroi, N.; Duman, R. S.; Neve, R. L.; Nestler, E. J.: Regulation of cocaine reward by CREB. Science 282:2272-2275,1998.

Cole, T. J.; Copeland, N. G.; Gilbert, D. J.; Jenkins, N. A.; Schutz, G.; Ruppert, S.: The mouse CREB (cAMP responsive element binding protein) gene: structure, promoter analysis, and chromosomal localization. Genomics 13:974-982, 1992.

Fentzke, R. C.; Korcarz, C. E.; Lang, R. M.; Lin, H.; Leiden, J. M.: Dilated cardiomyopathy in transgenic mice expressing a dominant-negative CREB transcription factor in the heart. J. Clin. Invest. 101:2415-2426,1998.

Herzig, S.; Long, F.; Jhala, U. S.; Hedrick, S.; Quinn, R.; Bauer, A.; Rudolph, D.; Schutz, G.; Yoon, C.; Puigserver, P.; Spiegelman, B.; Montminy, M.: CREB regulates hepatic gluconeogenesis through the coactivator PGC-1. Nature 413:179-183, 2001.

Benson, A. M.; Hunkeler, M. J.; Talalay, P.: Increase of NAD(P)H:quinone reductase by dietary antioxidants: possible role in protection against carcinogenesis and toxicity. Proc. Nat. Acad. Sci. 77:5216-5220,1980.

Chen, L. Z.; Harris, P. C.; Apostolou, S.; Baker, E.; Holman, K.; Lane, S. A.; Nancarrow, J. K.; Whitmore, S. A.; Stallings, R. L.; Hildebrand, C. E.; Richards, R. I.; Sutherland, G. R.; Callen, D. F.: A refined physical map of the long arm of human chromosome 16. Genomics 10:308-312, 1991.

Edwards, Y. H.; Hopkinson, D. A.; Carritt, B.: A genetic characterization of the human diaphorase-4 deficiency. Ann. Hum. Genet. 47:97-105,1983.

Grzeschik, K.-H.: Assignment of a structural gene for a fourth human diaphorase (DIA-4) to chromosome 16 in man-mouse somatic cell hybrids. Hum. Genet. 53:189-193, 1980.

Jaiswal, A. K.; McBride, O. W.; Adesnik, M.; Nebert, D. W.: human dioxin-inducible cytosolic NAD(P)H: menadione oxidoreductase: cDNA sequence and localization of gene to chromosome 16. J. Biol. Chem. 263:13572-13578, 1988.

Kelsey, K. T.; Ross, D.; Traver, R. D.; Christiani, D. C.; Zuo, Z. F.; Spitz, M. R.; Wang, M.; Xu, X.; Lee, B. K.; Schwartz, B. S.; Wiencke, J. K.: Ethnic variation in the prevalence of a common NAD(P)H quinone oxidoreductase polymorphism and its implications for anti-cancer chemotherapy. Brit. J. Cancer 76:852-854, 1997.

Lavinha, J.; Morrison, N.; Glasgow, L.; Ferguson-Smith, M. A.:Further evidence for the regional localization of human APRT and DIA4 on chromosome 16. (Abstract) Cytogenet. Cell Genet. 37:517 only,1984.

Moran, J. L.; Siegel, D.; Ross, D.: A potential mechanism underlying the increased susceptibility of individuals with a polymorphism in NAD(P)H: quinone oxidoreductase 1 (NQO1) to benzene toxicity. Proc. Nat. Acad. Sci. 96:8150-8155, 1999.

Povey, S.; Wilson, D.; Edwards, Y. H.: Assignment of a human diaphorase (DIA-4) to chromosome 16. Ann. Hum. Genet. 43:349-353, 1980.

Radjendirane, V.; Joseph, P.; Lee, Y.-H.; Kimura, S.; Klein-Szanto, A. J. P.; Gonzalez, F. J.; Jaiswal, A. K.: Disruption of the DT diaphorase (NQO1) gene in mice leads to increased menadione toxicity. J. Biol. Chem. 273:7382-7389, 1998.

Smith, M. T.: Benzene, NQO1, and genetic susceptibility to cancer.(Commentary) Proc. Nat. Acad. Sci. 96:7624-7626, 1999.

Traver, R. D.; Horikoshi, T.; Danenberg, K. D.; Stadlbauer, T. H.; Danenberg, P. V.; Ross, D.; Gibson, N. W.: NAD(P)H: quinone oxidoreductase gene expression in human colon carcinoma cells: characterization of a mutation which modulates DT-diaphorase activity and mitomycin sensitivity. Cancer Res. 52:797-802, 1992.

Traver, R. D.; Siegel, D.; Beall, H. D.; Phillips, R. M.; Gibson, N. W.; Franklin, W. A.; Ross, D.: Characterization of a polymorphismin NAD(P)H: quinone oxidoreductase (DT-diaphorase). Brit. J. Cancer 75:69-75, 1997.

Zhang, L.; Rothman, N.; Wang, Y.; Hayes, R. B.; Li, G.; Dosemeci, M.; Yin, S.; Kolachana, P.; Titenko-Holland, N.; Smith, M. T.: Increased aneusomy and long arm deletion of chromosomes 5 and 7 in the lymphocytes of Chinese workers exposed to benzene. Carcinogenesis 19:1955-1961,1998.

Zhang, L.; Wang, Y.; Shang, N.; Smith, M. T.: Benzene metabolites induce the loss of long arm deletion of chromosomes 5 and 7 in human lymphocytes. Leukemia Res. 22:105-113, 1998.

Rothman, N.; Smith, M. T.; Hayes, R. B.; Traver, R. D.; Hoener, B.; Campleman, S.; Li, G. L.; Dosemeci, M.; Linet, M.; Zhang, L.; Xi, L.; Wacholder, S.; Lu, W.; Meyer, K. B.; Titenko-Holland, N.; Stewart, J. T.;Yin, S.; Ross, D.: Benzene poisoning, a risk factor for hematological malignancy, is associated with the NQO1 609C-T mutation and rapid fractional excretion of chlorzoxazone. Cancer Res. 57:2839-2842, 1997.

Roychoudhury, A. K.; Nei, M.: Human Polymorphic Genes: World Distribution. New York: Oxford Univ. Press (pub.) 1988.

Campanelli, J. T.; Hoch, W.; Rupp, F.; Kreiner, T.; Scheller, R. H.: Agrin mediates cell contact-induced acetylcholine receptor clustering. Cell 67:909-916, 1991.

DeChiara, T. M.; Bowen, D. C.; Valenzuela, D. M.; Simmons, M. V.; Poueymirou, W. T.; Thomas, S.; Kinetz, E.; Compton, D. L.; Rojas, E.; Park, J. S.; Smith, C.; DiStefano, P. S.; Glass, D. J.; Burden, S. J.; Yancopoulos, G. D.: The receptor tyrosine kinase MuSK is required for neuromuscular junction formation in vivo. Cell 85:501-512,1996.

Chan, S.Y.; Empig, C. J.; Welte, F. J.; Speck, R. F.; Schmaljohn, A.; Kreisberg, J. F.; Goldsmith, M. A.: Folate receptor-alpha is a cofactor for cellular entry by Marburg and Ebola viruses. Cell 106:117-126, 2001.

Czeizel, A. E.; Dudas, I.: Prevention of the first occurrence of neural-tube defects by periconceptional vitamin supplementation. New Eng. J. Med. 327:1832-1835, 1992.

De Marco, P.; Moroni, A.; Merello, E.; de Franchis, R.; Andreussi, L.; Finnell, R. H.; Barber, R. C.; Cama, A.; Capra, V.: Folate pathway gene alterations in patients with neural tube defects. Am. J. Med. Genet. 95:216-223, 2000.

Elwood, P. C.: Molecular cloning and characterization of the human folate-binding protein cDNA from placenta and malignant tissue culture (KB) cells. J. Biol. Chem. 264: 14893-14901, 1989.

Elwood, P. C.; Nachmanoff, K.; Saikawa, Y.; Page, S. T.; Pacheco, P.; Roberts, S.; Chung, K.-N.: The divergent 5-prime termini of the alpha human folate receptor (hFR) mRNAs originate from two tissue-specific promoters and alternative splicing: characterization of the alpha hFR gene structure. Biochemistry 36:1467-1478, 1997.

Nadeau, J. H.; Eicher, E. M.: Conserved linkage of soluble aconitase and galactose-1-phosphate uridyl transferase in mouse and man: assignment of these genes to mouse chromosome 4. Cytogenet. Cell Genet. 34:271-281, 1982.

Albrecht, F. E.; Drago, J.; Felder, R. A.; Printz, M. P.; Eisner, G. M.; Robillard, J. E.; Sibley, D. R.; Westphal, H. J.; Jose, P. A.: Role of the D-1A dopamine receptor in the pathogenesis of genetic hypertension. J. Clin. Invest. 97:2283-2288, 1996.

Bermak, J. C.; Li, M.; Bullock, C.; Zhou, Q.-Y.: Regulation of transport of the dopamine D1 receptor by a new membrane-associated ER protein. Nature Cell Biol. 3:492-498, 2001.

Boultwood, J.; Lewis, M. S.; Wainscoat, J. S.: Physical linkage of glucocorticoid receptor (GRL) and dopamine D1 receptor (DRD1) on the long arm of chromosome 5.(Abstract) Cytogenet. Cell Genet. 58:1894 only, 1991.

Castner, S. A.; Williams, G. V.; Goldman-Rakic, P. S.: Reversal of antipsychotic-induced working memory deficits by short-term dopamine D1 receptor stimulation. Science 287:2020-2022, 2000.

Dearry, A.; Gingrich, J. A.; Falardeau, P.; Fremeau, R. T., Jr.; Bates, M. D.; Caron, M. G.: Molecular cloning and expression of the gene for a human D(1) dopamine receptor. Nature 347:72-76, 1990.

Grandy, D. K.; Zhou, Q.-Y.; Allen, L.; Litt, R.; Magenis, R. E.; Civelli, O.; Litt, M.: A human D(1) dopamine receptor gene is located on chromosome 5 at q35.1 and identifies an EcoRI RFLP. Am. J. Hum. Genet. 47:828-834, 1990.

Krushkal, J.; Xiong, M.; Ferrell, R.; Sing, C. F.; Turner, S. T.; Boerwinkle, E.: Linkage and association of adrenergic and dopamine receptor genes in the distal portion of the long arm of chromosome 5 with systolic blood pressure variation. Hum. Molec. Genet. 7:1379-1383, 1998.

Mayerhofer, A.; Hemmings, H. C., Jr.; Snyder, G. L.; Greengard, P.; Boddien, S.; Berg, U.; Brucker, C.: Functional dopamine-1 receptors and DARPP-32 are expressed in human ovary and granulosa luteal cells in vitro. J. Clin. Endocr. Metab. 84:257-264, 1999.

Sunahara, R. K.; Niznik, H. B.; Weiner, D. M.; Stormann, T. M.; Brann, M. R.; Kennedy, J. L.; Gelernter, J. E.; Rozmahel, R.; Yang, Y.; Israel, Y.; Seeman, P.; O'Dowd, B. F.: Human dopamine D1 receptor encoded by an intronless gene on chromosome 5. Nature 347:80-83,1990.

Wilkie, T. M.; Chen, Y.; Gilbert, D. J.; Moore, K. J.; Yu, L.; Simon, M. I.; Copeland, N. G.; Jenkins, N. A.: Identification, chromosomal location, and genome organization of mammalian G-protein-coupled receptors. Genomics 18:175-184, 1993.

Xu, M.; Moratalla, R.; Gold, L. H.; Hiroi, N.; Koob, G. F.; Graybiel, A. M.; Tonegawa, S.: Dopamine D1 receptor mutant mice are deficient in striatal expression of dynorphin and in dopamine-mediated behavioral responses. Cell 79:729-742, 1994.

Zhou, Q.-Y.; Grandy, D. K.; Thambi, L.; Kushner, J. A.; Van Tol, H. H. M.; Cone, R.; Pribnow, D.; Salon, J.; Bunzow, J. R.; Civelli, O.: Cloning and expression of human and rat D(1) dopamine receptors. Nature 347:76-80, 1990.

Balk, J.-H.; Picetti, R.; Salardi, A.; Thirlet, G.; Dierich, A.; Depaulls, A.; Le Meur, M.; Borrelli, E.: Parkinsonian-like locomotor impairment in mice lacking dopamine D2 receptors. Nature 377:424-428,1995.

Basu, S.; Nagy, J. A.; Pal, S.; Vasile, E.; Eckelhoefer, I. A.; Bliss, V. S.; Manseau, E. J.; Dasgupta, P. S.; Dvorak, H. F.; Mukhopadhyay, D.: The neurotransmitter dopamine inhibits angiogenesis induced by vascular permeability factor/vascular endothelial growth factor. NatureMed. 7:569-574, 2001.

Blum, K.; Noble, E. P.; Sheridan, P. J.; Montgomery, A.; Ritchie, T.; Jagadeeswaran, P.; Nogami, H.; Briggs, A. H.; Cohn, J. B.: Allelic association of human dopamine D(2) receptor gene in alcoholism. J. A. M. A. 263:2055-2060, 1990.

Bolos, A. M.; Dean, M.; Lucas-Derse, S.; Ramsburg, M.; Brown, G. L.; Goldman, D.: Population and pedigree studies reveal a lack of association between the dopamine D(2) receptor gene and alcoholism. J. A. M. A. 264:3156-3160, 1990.

Bunzow, J. R.; Van Tol, H. H.; Grandy, D. K.; Albert, P.; Salon, J.; Christie, M.; Machida, C. A.; Neve, K. A.; Civelli, O.: Cloning and expression of a rat D2 dopamine receptor cDNA. Nature 336:783-787,1988.

Dal Toso, R.; Sommer, B.; Ewert, M.; Herb, A.; Pritchett, D. B.; Bach, A.; Shivers, B. D.; Seeburg, P. H.: The dopamine D(2) receptor: two molecular forms generated by alternative splicing. EMBO J. 8:4025-4034, 1989.

Bain, G.; Robanus Maandag, E. C.; Izon, D. J.; Amsen, D.; Kruisbeek, A. M.; Weintraub, B. C.; Krop, I.; Schlissel, M. S.; Feeney, A. J.; van Roon, M.; van der Valk, M.; te Riele, H. P. J.; Berns, A.; Murre, C.: E2A proteins are required for proper B cell development and initiation of immunoglobulin gene rearrangements. Cell 79:885-892, 1994.

El Ghouzzi, V.; Legeai-Mallet, L.; Aresta, S.; Benoist, C.; Munnich, A.; de Gunzburg, J.; Bonaventure, J.: Saethre-Chotzen mutations cause TWIST protein degradation or impaired nuclear location. Hum. Molec. Genet. 9:813-819, 2000.

Henthorn, P.; Kiledjian, M.; Kadesch, T.: Two distinct transcription factors that bind the immunoglobulin enhancer mu-E5/kappa-E2 motif. Science 247:467-470, 1990.

Kamps, M. P.; Murre, C.; Sun, X.; Baltimore, D.: A new homeobox gene contributes the DNA binding domain of the t (1;19) translocation protein in pre-B ALL. Cell 60:547-555, 1990.

Mellentin, J. D.; Murre, C.; Donlon, T. A.; McCaw, P. S.; Smith, S. D.; Carroll, A. J.; McDonald, M. E.; Baltimore, D.; Cleary, M. L.: The gene for enhancer binding proteins E12/E47 lies at the t (1;19) breakpoint in acute leukemias. Science 246:379-382, 1989.

Murre, C.; McCaw, P. S.; Baltimore, D.:Cell 56:777-783, 1989.

Nourse, J.; Mellentin, J. D.; Galili, N.; Wilkinson, J.; Stanbridge, E.; Smith, S. D.; Cleary, M. L.: Chromosomal translocation t (1;19) results in synthesis of a homeobox fusion mRNA that codes for a potential chimeric transcription factor. Cell 60:535-545, 1990.

Fan, Y.-S.; Eddy, R. L.; Byers, M. G.; Haley, L. L.; Henry, W. M.; Kayano, T.; Shows, T. B.; Bell, G. I.: Assignment of genes encoding three human glucose transporter/transporter-like proteins (GLUT4, GLUT5 and GLUT6) to chromosomes 17, 1 and 5, respectively. (Abstract) Cytogenet. Cell Genet. 51:997 only, 1989.

Gould, G. W.; Holman, G. D.: The glucose transporter family: structure, function and tissue-specific expression. Biochem. J. 295:329-341,1993.

Hauguel-de Mouzon, S.; Challier, J. C.; Kacemi, A.; Cauzac, M.; Malek, A.; Girard, J.: The GLUT3 glucose transporter isoform is differentially expressed within human placental cell types. J. Clin. Endocr. Metab. 82:2689-2694, 1997.

Kayano, T.; Burant, C. F.; Fukumoto, H.; Gould, G. W.; Fan, Y. S.; Eddy, R. L.; Byers, M. G.; Shows, T. B.; Seino, S.; Bell, G. I.: Human facilitative glucose transporters: isolation, functional characterization, and gene localization of cDNAs encoding an isoform (GLUT5) expressed in small intestine, kidney, muscle, and adipose tissue and an unusual glucose transporter pseudogene-like sequence (GLUT6). J. Biol. Chem. 265:13276-13282, 1990.

Kayano, T.; Fukumoto, H.; Eddy, R. L.; Fan, Y.-S.; Byers, M. G.; Shows, T. B.; Bell, G. I.: Evidence for a family of human glucose transporter-like proteins: sequence and gene localization of a protein expressed in fetal skeletal muscle and other tissues. J. Biol. Chem. 263:15245-15248, 1988.

Aitken, D. A.; Ferguson-Smith, M. A.: Gene dosage evidence for the regional assignment of the GOT-S structural gene locus to 10q24-10q25. Cytogenet. Cell Genet. 22:468-471, 1978.

Creagan, R.; Tischfield, J.; McMorris, F. A.; Chen, S.-H.; Hirschi, M.; Chen, T.-T.; Ricciuti, F.; Ruddle, F. H.: Assignment of the genes for human peptidase A to chromosome 18 and cytoplasmic glutamic oxaloacetate transaminase to chromosome 10 using somatic-cell hybrids. Cytogenet. Cell Genet. 12:187-198, 1973.

Ford, G. C.; Eichele, G.; Jansonius, J. N.: Three-dimensional structure of a pyridoxal-phosphate-dependent enzyme, mitochondrial aspartate aminotransferase. Proc. Nat. Acad. Sci. 77:2559-2563,1980.

Gitelman, B. J.; Tomkins, D. J.; Partington, M. W.; Roberts, M. H.; Simpson, N. E.: Gene dosage studies of glutamic oxaloacetic transaminase (GOT) and hexokinase (HK) in two patients with possible partial trisomy10q. (Abstract) Am. J. Hum. Genet. 32:41A only, 1980.

Junien, C.; Despoisse, S.; Turleau, C.; de Grouchy, J.; Bucher, T.; Fundele, R.: Assignment of phosphoglycerate mutase (PGAMA) to human chromosome 10: regional mapping of GOT1 and PGAMA to subbands 10q26.1 (or q25.3). Ann. Genet. 25:25-27, 1982.

Overhauser, J.; Mewar, R.; Rojas, K.; Lia, K.; Kline, A. D.; Silverman, G. A.: STS map of genes and anonymous DNA fragments on human chromosome 18 using a panel of somatic cell hybrids. Genomics 15:387-391,1993.

Abdalla, S. A.; Pece-Barbara, N.; Vera, S.; Tapia, E.; Paez, E.; Bernabeu, C.; Letarte, M.: Analysis of ALK-1 and endoglin in newborns from families with hereditary hemorrhagic telangiectasia type 2. Hum. Molec. Genet. 9:1227-1237, 2000.

Grunder, S.; Geisler, H.-S.; Rainer, S.; Fink, J. K.: Acid-sensing ion channel (ASIC) 4 gene: physical mapping, genomic organisation, and evaluation as a candidate for paroxysmal dystonia. Europ. J. Hum. Genet. 9:672-676, 2001.

Koch, G.; Lalley, P. A.; McAvoy, M.; Shows, T. B.: Assignment of LIPA, associated with human acid lipase deficiency, to human chromosome 10 and comparative assignment to mouse chromosome 19. Somat. Cell Genet. 7:345-358, 1981.

Kadotani, H.; Hirano, T.; Masugi, M.; Nakamura, K.; Nakao, K.; Katsuki, M.; Nakanishi, S.: Motor discoordination results from combined gene disruption of the NMDA receptor NR2A and NR2C subunits, but not from single disruption of the NR2A or NR2C subunit. J. Neurosci. 16:7859-7867, 1996.

Lin, Y. J.; Bovetto, S.; Carver, J. M.; Giordano, T.: Cloning of the cDNA for the human NMDA receptor NR2C subunit and its expression in the central nervous system and periphery. Molec. Brain Res. 43:57-64, 1996.

Asada, H.; Kawamura, Y.; Maruyama, K.; Kume, H.; Ding, R.-G.; Ji, F. Y.; Kanbara, N.; Kuzume, H.; Sanbo, M.; Yagi, T.; Obata, K.: Mice lacking the 65 kDa isoform of glutamic acid decarboxylase (GAD65) maintain normal levels of GAD67 and GABA in their brains but are susceptible to seizures. Biochem. Biophys. Res. Commun. 229:891-895, 1996.

Bu, D.-F.; Erlander, M. G.; Hitz, B. C.; Tillakaratne, N. J. K.; Kaufman, D. L.; Wagner-McPherson, C. B.; Evans, G. A.; Tobin, A. J.: Two human glutamate decarboxylases, 65-kDa GAD and 67-kDa GAD, are each encoded by a single gene. Proc. Nat. Acad. Sci. 89:2115-2119,1992.

Edelhoff, S.; Grubin, C. E.; Karlsen, A. E.; Adler, D. A.; Foster, D.; Disteche, C. M.; Lernmark, A.: Mapping of glutamic acid decarboxylase (GAD) genes. Genomics 17:93-97, 1993.

McKusick, V. A.: The morbid anatomy of the human genome: a review of gene mapping in clinical medicine (part 1). Medicine 65:1-33,1986.

Panteghini, M.: Aspartate aminotransferase isoenzymes. Clin. Biochem. 23:311-319, 1990.

Pol, S.; Bousquet-Lemercier, B.; Pave-Preux, M.; Bulle, F.; Passage, E.; Hanoune, J.; Mattei, M. G.; Barouki, R.: Chromosomal localization of human aspartate aminotransferase genes by in situ hybridization. Hum. Genet. 83:159-164, 1989.

Scott, E. M.; Wright, R. C.: An alternate method for demonstration of erythrocytic aminotransferases on starch gels. Am. J. Hum. Genet. 33:561-563, 1981.

Spritz, R. A.; Emanuel, B. S.; Chern, C. J.; Mellman, W. J.: Gene dosage effect: intraband mapping of human soluble glutamic oxaloacetic transaminase. Cytogenet. Cell Genet. 23:149-156, 1979.

Tomkins, D. J.; Gitelman, B. J.; Roberts, M. H.: Confirmation of a de novo duplication, dup (10)(q24-q26), by GOT1 gene dosage studies. Hum. Genet. 63:369-373, 1983.

Wang, C.-Y.; Huang, Y.-Q.; Shi, J.-O.; Marron, M. P.; Ruan, Q.-G.; Hawkins-Lee, B.; Ochoa, B.; She, J.-X.: Genetic homogeneity, high-resolution mapping, and mutation analysis of the urofacial (Ochoa) syndrome and exclusion of the glutamate oxaloacetate transaminase gene (GOT1) in the critical region as the disease gene. Am. J. Med. Genet. 84:454-459, 1999.

Wurzinger, K. H.; Mohrenweiser, H. W.: Studies on the genetic and non-genetic (physiological) variation of human erythrocyte glutamic oxaloacetic transaminase. Ann. Hum. Genet. 46:191-201, 1982.

Chiang, S.-H.; Baumann, C. A.; Kanzaki, M.; Thurmond, D. C.; Watson, R. T.; Neudauer, C. L.; Macara, I. G.; Pessin, J. E.; Saltiel, A. R.: Insulin-stimulated GLUT4 translocation requires the CAP-dependent activation of TC10. Nature 410: 944-948, 2001.

Ribon, V.; Printen, J. A.; Hoffman, N. G.; Kay, B. K.; Saltiel, A. R.: A novel, multifunctional c-Cbl binding protein in insulin receptor signaling in 3T3-L1 adipocytes. Molec. Cell. Biol. 18:872-879, 1998.

Davignon, I.; Barnard, M.; Gavrilova, O.; Sweet, K.; Wilkie, T. M.: Gene structure of murine Gna11 and Gna15: tandemly duplicated Gq class G protein alpha subunit genes. Genomics 31:359-366, 1996.

Jiang, M.; Pandey, S.; Tran, V. T.; Fong, H. K.: Guanine nucleotide-binding regulatory proteins in retinal pigment epithelial cells. Proc. Nat. Acad. Sci. 88:3907-3911, 1991.

Offermanns, S.; Zhao, L.-P.; Gohla, A.; Sarosi, I.; Simon, M. I.; Wilkie, T. M.: Embryonic cardiomyocyte hypoplasia and craniofacial defects in G-alpha-q/G-alpha-11-mutant mice. EMBO J. 17:4304-4312,1998.

Strathmann, M. P.; Simon, M. I.: G-alpha-12 and G-alpha-13 subunits define a fourth class of G protein alpha subunits. Proc. Nat. Acad. Sci. 88:5582-5586, 1991.

Ahmed, S. F.; Barr, D. G. D.; Bonthron, D. T.: GNAS1 mutations and progressive osseous heteroplasia. (Letter) New Eng. J. Med. 346:1669-1670, 2002.

Ahmed, S. F.; Dixon, P. H.; Bonthron, D. T.; Stirling, H. F.; Barr, D. G. D.; Kelnar, C. J. H.; Thakker, R. V.: GNAS1 mutational analysis in pseudohypoparathyroidism. Clin. Endocr. 49:525-531, 1998.

Ahrens, W.; Hiort, O.; Staedt, P.; Kirschner, T.; Marschke, C.; Kruse, K.: Analysis of the GNAS1 gene in Albright's hereditary osteodystrophy. J. Clin. Endocr. Metab. 86:4630-4634, 2001.

Aldred, M. A.; Trembath, R. C.: Activating and inactivating mutations in the human GNAS1 gene. Hum. Mutat. 16:183-189, 2000.

Ashley, P. L.; Ellison, J.; Sullivan, K. A.; Bourne, H. R.; Cox, D. R.: Chromosomal assignment of the murine Gi and Gs genes. (Abstract) Am. J. Hum. Genet. 41: A155 only, 1987.

Ballare, E.; Mantovani, S.; Lania, A.; Di Blasio, A. M.; Vallar, L.; Spada, A.: Activating mutations of the GS-alpha gene are associated with low levels of GS-alpha protein in growth hormone-secreting tumors. J. Clin. Endocr. Metab. 83:4386-4390, 1998.

Bastepe, M; Pincus, J. E.; Sugimoto, T.; Tojo, K. Kanatani, M.; Azuma, Y.; Kruse, K.; Rosenbloom, A. L.; Koshiyama, H.; Juppner, H.: Positional dissociation between the genetic mutation responsible for pseudohypoparathyroidism type Ib and the associated methylation defect at exon A/B: evidence for a long-range regulatory element within the imprinted GNAS1 locus. Hum. Molec. Genet. 10:1231-1241, 2001.

Bastepe, M.; Juppner, H.: GNAS1 mutations and progressive osseous heteroplasia. (Letter) New Eng. J. Med. 346: 1671 only, 2002.

Bastepe, M.; Lane, A. H.; Juppner, H.: Parental uniparental isodisomy of chromosome 20q--and the resulting changes in GNAS1 methylation--as a plausible cause of pseudohypoparathyroidism. Am. J. Hum. Genet. 68:1283-1289, 2001.

Bianco, P.; Riminucci, M.; Majolagbe, A.; Kuznetsov, S. A.; Collins, M. T.; Mankani, M. H.; Corsi, A.; Bone, H. G.; Wientroub, S.; Spiegel, A. M.; Fisher, L. W.; Robey, P. G.: Mutations of the GNAS1 gene, stromal cell dysfunction, and osteomalacic changes in non-McCune-Albright fibrous dysplasia of bone. J. Bone Miner. Res. 15:120-128, 2000.

Billestrup, N.; Swanson, L. W.; Vale, W.: Growth hormone-releasing factor stimulates proliferation of somatotrophs in vitro. Proc. Nat. Acad. Sci. 83:6854-6857, 1986.

Candeliere, G. A.; Glorieux, F. H.; Prud'homme, J.; St.-Arnaud, R.: Increased expression of the c-fos proto-oncogene in bone from patients with fibrous dysplasia. New Eng. J. Med. 332:1546-1551,1995.

Candeliere, G. A.; Roughley, P. J.; Glorieux, F. H.: Polymerase chain reaction-based technique for the selective enrichment and analysis of mosaic arg201 mutations in G alpha s from patients with fibrous dysplasia of bone. Bone 21:201-206, 1997.

Carel, J. C.; Le Stunff, C.; Condamine, L.; Mallet, E.; Chaussain, J. L.; Adnot, P.; Garabedian, M.; Bougneres, P.: Resistance to the lipolytic action of epinephrine: a new feature of protein GS deficiency. J. Clin. Endocr. Metab. 84:4127-4131, 1999.

Carter, A.; Bardin, C.; Collins, R.; Simons, C.; Bray, P.; Spiegel, A.: Reduced expression of multiple forms of the alpha subunit of the stimulatory GTP-binding protein in pseudohypoparathyroidism type Ia. Proc. Nat. Acad. Sci. 84:7266-7269, 1987.

Cattanach, B. M.; Kirk, M.: Differential activity of maternally and paternally derived chromosome regions in mice. Nature 315:496-498,1985.

Coutant, R.; Lumbroso, S.; Rey, R.; Lahlou, N.; Venara, M.; Rouleau, S.; Sultan, C.; Limal, J.-M.: Macroorchidism due to autonomous hyperfunction of Sertoli cells and GS-alpha gene mutation: an unusual expression of McCune-Albright syndrome in a prepubertal boy. J. Clin. Endocr. Metab. 86:1778-1781, 2001.

Kim, H.-S.; Nagalla, S. R.; Oh, Y.; Wilson, E.; Roberts, C. T., Jr.; Rosenfeld, R. G.: Identification of a family of low-affinity insulin-like growth factor binding proteins (IGFBPs): characterization of connective tissue growth factor as a member of the IGFBP superfamily. Proc. Nat. Acad. Sci. 94:12981-12986, 1997.

Martinerie, C.; Viegas-Pequignot, E.; Guenard, I.; Dutrillaux, B.; Nguyen, V. C.; Bernheim, A.; Perbal, B.: Physical mapping of human loci homologous to the chicken nov proto-oncogene. Oncogene 7:2529-2534, 1992.

Nakanishi, T.; Yamaai, T.; Asano, M.; Nawachi, K.; Suzuki, M.; Sugimoto, T.; Takigawa, M.: Overexpression of connective tissue growth factor/hypertrophic chondrocyte-specific gene product 24 decreases bone density in adult mice and induces dwarfism. Biochem. Biophys. Res. Commun. 281:678-681, 2001.

O'Donovan, N.; Galvin, M.; Morgan, J. G.: Physical mapping of the CXC chemokine locus on human chromosome 4. Cytogenet. Cell Genet. 84:39-42, 1999.

McGill, J. R.; Boyd, D.; Barrett, K. J.; Drysdale, J. W.; Moore, C. M.: Localization of human ferritin H (heavy) and L (light) subunits by in situ hybridization. (Abstract) Am. J. Hum. Genet. 36:146Sonly, 1984.

Murray, M. T.; White, K.; Munro, H. N.: Conservation of ferritin heavy subunit gene structure: implications for the regulation of ferritin gene expression. Proc. Nat. Acad. Sci. 84:7438-7442, 1987.

Papadopoulos, P.; Bhavsar, D.; Zappone, E.; David, V.; Jones, C.; Worwood, M.; Drysdale, J.: A second human ferritin H locus on chromosome 11. Cytogenet. Cell Genet. 61:107-108, 1992.

Richard, C. W.; Withers, D. A.; Meeker, T. C.; Myers, R. M.: A radiation hybrid map of the proximal long arm of human chromosome 11 containing the MEN-1 and bcl-1 disease locus. (Abstract) Cytogenet. Cell Genet. 58:1970 only, 1991.

Worwood, M.; Brook, J. D.; Cragg, S. J.; Hellkuhl, B.; Jones, B. M.; Perera, P.; Roberts, S. H.; Shaw, D. J.: Assignment of human ferritin genes to chromosomes 11 and 19q13.3-19qter. Hum. Genet. 69:371-374, 1985.

Wu, K.-J.; Polack, A.; Dalla-Favera, R.: Coordinated regulation of iron-controlling genes, H-ferritin and IRP2, by c-MYC. Science 283:676-679, 1999.

Yachou, A.; Mattei, M. G.; Roeckel, N.; Grandchamp, B.; Beaumont, C.: Mouse ferritin H sequences map to chromosomes 3, 6, and 19. Genomics 9:204-206, 1991.

Yachou, A.-K.; Renaudie, F.; Guenet, J.-L.; Simon-Chazottes, D.; Jones, R.; Grandchamp, B.; Beaumont, C.: Mouse ferritin H multigene family is polymorphic and contains a single multiallelic functional gene located on chromosome 19. Genomics 10:531-538, 1991.

Youssoufian, H.; Chance, P.; Tuck-Muller, C. M.; Jabs, E. W.: Association of a new chromosomal deletion [del (1) (q32q42)] with diaphragmatic hernia: assignment of a human ferritin gene. Hum. Genet. 78:267-270,1988.

Aguilar-Martinez, P.; Biron, C.; Masmejean, C.; Jeanjean, P.; Schved, J.-F.: A novel mutation in the iron responsive element of ferritin L-subunit gene as a cause for hereditary hyperferritinemia-cataract syndrome. (Letter) Blood 88:1895-1903, 1996.

Beaumont, C.; Leneuve, P.; Devaux, I.; Scoazec, J.-Y.; Berthier, M.; Loiseau, M.-N.; Grandchamp, B.; Bonneau, D.: Mutation in the iron responsive element of the L ferritin mRNA in a family with dominant hyperferritinaemia and cataract. Nature Genet. 11:444-446, 1995.

Brown, A. J. P.; Leibold, E. A.; Munro, H. N.: Isolation of cDNA clones for the light subunit of rat liver ferritin: evidence that the light subunit is encoded by a multigene family. Proc. Nat. Acad. Sci. 80:1265-1269, 1983.

Camaschella, C.; Zecchina, G.; Lockitch, G.; Roetto, A.; Campanella, A.; Arosio, P.; Levi, S.: A new mutation (G51C) in the iron-responsive element (IRE) of L-ferritin associated with hyperferritinaemia-cataract syndrome decreases the binding affinity of the mutated IRE for iron-regulatory proteins. Brit. J. Haemat. 108:480-482, 2000.

Cazzola, M.; Bergamaschi, G.; Tonon, L.; Arbustini, E.; Grasso, M.; Vercesi, E.; Barosi, G.; Bianchi, P. E.; Cairo, G.; Arosio, P.: Hereditary hyperferritinemia-cataract syndrome: relationship between phenotypes and specific mutations in the iron-responsive element of ferritin light-chain mRNA. Blood 90:814-821, 1997.

Cazzola, M.; Foglieni, B.; Bergamaschi, G.; Levi, S.; Lazzarino, M.; Arosio, P.: A novel deletion of the L-ferritin iron-responsive element responsible for severe hereditary hyperferritinaemia-cataract syndrome. Brit. J. Haemat. 116:667-670, 2002.

Xu, W.; Gorman, P. A.; Rider, S. H.; Hedge, P. J.; Moore, G.; Prichard, C.; Sheer, D.; Solomon, E.: Construction of a genetic map of human chromosome 17 by use of chromosome-mediated gene transfer. Proc. Nat. Acad. Sci. 85:8563-8567, 1988.

Fishman, G. I.; Eddy, R. L.; Shows, T. B.; Rosenthal, L.; Leinwand, L. A.: The human connexin gene family of gap junction proteins: distinct chromosomal locations but similar structures. Genomics 10:250-256,1991.

Campbell, H. D.; Webb, G. C.; Kono, T.; Taniguchi, T.; Ford, J. H.; Young, I. G.: Assignment of the interleukin-2 receptor beta chain gene (Il-2rb) to band E on mouse chromosome 15. Genomics 12:179-180,1992.

Bonneau, D.; Huret, J. L.; Godeau, G.; Couet, D.; Putterman, M.; Tanzer, J.; Babin, P.; Larregue, M.: Recurrent ctb (7)(q31.3) and possible laminin involvement in a neonatal cutis laxa with a Marfan phenotype. Hum. Genet. 87:317-319, 1991.

Buchanan, R.; Wyatt, G. P.: Marfan's syndrome presenting as an intrapartum death. Arch. Dis. Child. 60:1074-1076, 1985.

Burgeson, R. E.; Chiquet, M.; Deutzmann, R.; Ekblom, P.; Engel, J.; Kleinman, H.; Martin, G. R.; Meneguzzi, G.; Paulsson, M.; Sanes, J.; Timpl, R.; Tryggvason, K.; Yamada, Y.; Yurchenco, P. D.: A new nomenclature for the laminins. Matrix Biol. 14:209-211, 1994.

Day, D. L.; Burke, B. A.: Pulmonary emphysema in a neonate with Marfan syndrome. Pediat. Radiol. 16:518-521, 1986.

Elliott, R. W.; Barlow, D.; Hogan, B. L. M.: Linkage of genes for laminin B1 and B2 subunits on chromosome 1 in mouse. In Vitro Cell Dev. Biol. 21:477-484, 1985.

Gross, D. M.; Robinson, L. K.; Smith, L. T.; Glass, N.; Rosenberg, H.; Duvic, M.: Severe perinatal Marfan syndrome. Pediatrics 84:83-89, 1989.

Hohn, A. R.; Webb, H. M.: Cardiac studies of infant twins with Marfan's syndrome. Am. J. Dis. Child. 122:526-528, 1971.

Hopker, V. H.; Shewan, D.; Tessier-Lavigne, M.; Poo, M.; Holt, C.: Growth-cone attraction to netrin-1 is converted to repulsion by laminin-1. Nature 401:69-73, 1999.

Huret, J.; Bonneau, D.; Godeau, G.; Leheup, B.; Larregue, M.: Neonatal cutis laxa with Marfan habitus: this syndrome maps with B1laminin at the junction 7q31.3-q32. (Abstract) Cytogenet. Cell Genet. 58:1922 only, 1991.

Iwamoto, Y.; Robey, F. A.; Graf, J.; Sasaki, M.; Kleinman, H. K.; Yamada, Y.; Martin, G. R.: YIGSR, a synthetic laminin pentapeptide, inhibits experimental metastasis formation. Science 238:1132-1134,1987.

Jaye, M.; Modi, W. S.; Ricca, G. A.; Mudd, R.; Chiu, I.-M.; O'Brien, S. J.; Drohan, W. N.: Isolation of a cDNA clone for the human laminin-B1chain and its gene localization. Am. J. Hum. Genet. 41:605-615,1987.

Kleinman, H. K.: Personal Communication. Bethesda, Md. Jan. 7, 1982.

Lababidi, Z.; Monzon, C.: Early cardiac manifestations of Marfan's syndrome in the newborn. Am. Heart J. 102:943-945, 1981.

Modi, W. S.; Jaye, M.; O'Brien, S. J.: Chromosomal localization of a cDNA clone for the human B1 laminin chain. (Abstract) Cytogenet. Cell Genet. 46:663 only, 1987.

Neimann, N.; Rauber, G.; Marchal, C.; Vidailhet, M.; Fall, M.: Maladie de Marfan chez un nouveau-ne avec atteintes polyviscerales: etude anatomo-clinique. Ann. Paediat. 15:619-624, 1968.

Pikkarainen, T.; Eddy, R.; Fukushima, Y.; Byers, M.; Shows, T.; Pihlajaniemi, T.; Saraste, M.; Tryggvason, K.: Human laminin B1 chain: a multidomain protein with gene (LAMB1) locus in the q22 region of chromosome 7. J. Biol. Chem. 262:10454-10462, 1987.

Pikkarainen, T.; Savolainen, E.-R.; Tryggvason, K.: Nhe I and Hinc II polymorphisms in the human laminin B1 chain gene on 7q22. Nucleic Acids Res. 17:4424 only, 1989.

Sasaki, M.; Kato, S.; Kohno, K.; Martin, G. R.; Yamada, Y.: Sequence of the cDNA encoding the laminin B1 chain reveals a multidomain protein containing cysteine-rich repeats. Proc. Nat. Acad. Sci. 84:935-939,1987.

Vuolteenaho, R.; Chow, L. T.; Tryggvason, K.: Structure of the human laminin B1 chain gene. J. Biol. Chem. 265:15611-15616, 1990.

Fukushige, S.; Murotsu, T.; Matsubara, K.: Chromosomal assignment of human genes for gastrin, thyrotropin (TSH)-beta subunit and C-erb-2 by chromosome sorting combined with velocity sedimentation and southern hybridization. Biochem. Biophys. Res. Commun. 134:477-483, 1986.

Justice, M. J.; Gilbert, D. J.; Kinzler, K. W.; Vogelstein, B.; Buchberg, A. M.; Ceci, J. D.; Matsuda, Y.; Chapman, V. M.; Patriotis, C.; Makris, A.; Tsichlis, P. N.; Jenkins, N. A.; Copeland, N. G.: A molecular genetic linkage map of mouse chromosome 18 reveals extensive linkage conservation with human chromosomes 5 and 18. Genomics 13:1281-1288, 1992.

Triantafilou, K.; Triantafilou, M.; Dedrick, R. L.: A CD14-independent LPS receptor cluster. Nature Immun. 2:338-345, 2001.

Saito, S.; Okui, K.; Tokino, T.; Oshimura, M.; Nakamura, Y.: Isolation and mapping of 68 RFLP markers on human chromosome 6. Am. J. Hum. Genet. 50:65-70, 1992.

Klinger, H. P.: Suppression of tumorigenicity in somatic cell hybrids. I. Suppression and reexpression of tumorigenicity in diploid human x D98/AH2 hybrids and independent segregation of tumorigenicity from other cell phenotypes. Cytogenet. Cell Genet. 27:254-266,1980.

Lichy, J. H.; Modi, W. S.; Seuanez, H. N.; Howley, P. M.: Identification of a human chromosome 11 gene which is differentially regulated in tumorigenic and nontumorigenic somatic cell hybrids of HeLa cells. Cell Growth Differ. 3:541-548, 1992.

Stanbridge, E. J.: Suppression of malignancy in human cells. Nature 260:17-20, 1976.

Corrigall, V. M.; Arastu, M.; Khan, S.; Shah, C.; Fife, M.; Smeets, T.; Tak, P.-P.; Panayi, G. S.: Functional IL-2 receptor beta (CD122) and gamma (CD132) chains are expressed by fibroblast-like synoviocytes: activation by IL-2 stimulates monocyte chemoattractant protein-1 production. J. Immun. 166:4141-4147, 2001.

Gnarra, J. R.; Otani, H.; Wang, M. G.; McBride, O. W.; Sharon, M.; Leonard, W. J.: Human interleukin 2 receptor beta-chain gene: chromosomal localization and identification of 5-prime regulatory sequences. Proc. Nat. Acad. Sci. 87:3440-3444, 1990.

Hatakeyama, M.; Tsudo, M.; Minamoto, S.; Kono, T.; Doi, T.; Miyata, T.; Miyasaka, M.; Taniguchi, T.: Interleukin-2 receptor beta chain gene: generation of three receptor forms by cloned human alpha and beta chain cDNA's. Science 244:551-556, 1989.

Lamaze, C.; Dujeancourt, A.; Baba, T.; Lo, C. G.; Benmerah, A.; Dautry-Varsat, A.: Interleukin 2 receptors and detergent-resistant membrane domains define a clathrin-independent endocytic pathway. Molec. Cell 7:661-671, 2001.

Shibuya, H.; Yoneyama, M.; Nakamura, Y.; Harada, H.; Hatakeyama, M.; Minamoto, S.; Kono, T.; Doi, T.; White, R.; Taniguchi, T.: The human interleukin-2 receptor beta-chain gene: genomic organization, promoter analysis and chromosomal assignment. Nucleic Acids Res. 18:3697-3703, 1990.

Suzuki, H.; Kundig, T. M.; Furlonger, C.; Wakeham, A.; Timms, E.; Matsuyama, T.; Schmits, R.; Simard, J. J. L.; Ohashi, P. S.; Griesser, H.; Taniguchi, T.; Paige, C. J.; Mak, T. W.: Deregulated T cell activation and autoimmunity in mice lacking interleukin-2 receptor beta. Science 268:1472-1476, 1995.

Tsudo, M.; Kitamura, F.; Miyasaka, M.: Characterization of the interleukin 2 receptor beta chain using three distinct monoclonal antibodies. Proc. Nat. Acad. Sci. 86:1982-1986, 1989.

Allander, S. V.; Larsson, C.; Ehrenborg, E.; Suwanichkul, A.; Weber, G.; Morris, S. L.; Bajalica, S.; Kiefer, M. C.; Luthman, H.; Powell, D. R.: Characterization of the chromosomal gene and promoter for human insulin-like growth factor binding protein-5. J. Biol. Chem. 269:10891-10898, 1994.

Eklund, L.; Piuhola, J.; Komulainen, J.; Sormunen, R.; Ongvarrasopone, C.; Fassler, R.; Muona, A.; Ilves, M.; Ruskoaho, H.; Takala, T. E. S.; Pihlajaniemi, T.: Lack of type XV collagen causes a skeletal myopathy and cardiovascular defects in mice. Proc. Nat. Acad. Sci. 98:1194-1199, 2001.

Hagg, P. M.; Hagg, P. O.; Peltonen, S.; Autio-Harmainen, H.; Pihlajaniemi, T.: Location of type XV collagen in human tissues and its accumulation in the interstitial matrix of the fibrotic kidney. Am. J. Path. 150:2075-2086, 1997.

Hagg, P. M.; Horelli-Kuitunen, N.; Eklund, L.; Palotie, A.; Pihlajaniemi, T.: Cloning of mouse type XV collagen sequences and mapping of the corresponding gene to 4B1-3: comparison of mouse and human alpha-1(XV) collagen sequences indicates divergence in the number of small collagenous domains. Genomics 45:31-41, 1997.

Hagg, P. M.; Muona, A.; Lietard, J.; Kivirikko, S.; Pihlajaniemi, T.: Complete exon-intron organization of the human gene for the alpha-1chain of type XV collagen (COL15A1) and comparison with the homologous Col18a1 gene. J. Biol. Chem. 273:17824-17831, 1998.

Huebner, K.; Cannizzaro, L. A.; Jabs, E. W.; Kivirikko, S.; Manzone, H.; Pihlajaniemi, T.; Myers, J. C.: Chromosomal assignment of a gene encoding a new collagen type (COL15A1) to 9q21-q22. Genomics 14:220-224, 1992.

Kivirikko, S.; Heinamaki, P.; Rehn, M.; Honkanen, N.; Myers, J. C.; Pihlajaniemi, T.: Primary structure of the alpha-1 chain of human type XV collagen and exon-intron organization in the 3-prime region of the corresponding gene. J. Biol. Chem. 269:4773-4779, 1994.

Muragaki, Y.; Abe, N.; Ninomiya, Y.; Olsen, B. R.; Ooshima, A.: The human alpha-1(XV) collagen chain contains a large amino-terminal non-triple helical domain with a tandem repeat structure and homology to alpha-1(XVIII) collagen. J. Biol. Chem. 269:4042-4046, 1994.

Myers, J. C.; Dion, A. S.; Abraham, V.; Amenta, P. S.: Type XV collagen exhibits a widespread distribution in human tissues but a distinct localization in basement membrane zones. Cell Tissue Res. 286:493-505, 1996.

Myers, J. C.; Kivirikko, S.; Gordon, M. K.; Dion, A. S.; Pihlajaniemi, T.: Identification of a previously unknown human collagen chain, alpha-1(XV), characterized by extensive interruptions in the triple-helical region. Proc. Nat. Acad. Sci. 89:10144-10148, 1992.

Ramchandran, R.; Dhanabal, M.; Volk, R.; Waterman, M. J. F.; Segal, M.; Lu, H.; Knebelmann, B.; Sukhatme, V. P.: Antiangiogenic activity of restin, NC10 domain of human collagen XV: comparison to endostatin. Biochem. Biophys. Res. Commun. 255:735-739, 1999.

Rehn, M.; Hintikka, E.; Pihlajaniemi, T.: Primary structure of the alpha 1 chain of mouse type XVIII collagen, partial structure of the corresponding gene, and comparison of the alpha 1(XVIII) chain with its homologue, the alpha 1(XV) collagen chain. J. Biol. Chem. 269:13929-13935, 1994.

Sasaki, T.; Larsson, H.; Tisi, D.; Claesson-Welsh, L.; Hohenester, E.; Timpl, R.: Endostatins derived from collagens XV and XVIII differ in structural and binding properties, tissue distribution and anti-angiogenic activity. J. Molec. Biol. 301:1179-1190, 2000.

Curtis, A. R. J.; Fey, C.; Morris, C. M.; Bindoff, L. A.; Ince, P. G.; Chinnery, P. F.; Coulthard, A.; Jackson, M. J.; Jackson, A. P.; McHale, D. P.; Hay, D.; Barker, W. A.; Markham, A. F.; Bates, D.; Curtis, A.; Burn, J.: Mutation in the gene encoding ferritin light polypeptide causes dominant adult-onset basal ganglia disease. Nature Genet. 28:350-354, 2001.

Eiberg, H.; Bisgaard, M. L.; Mohr, J.: Linkage between alpha-1-B-glycoprotein (A1BG) and Lutheran (LU) red blood group system: assignment to chromosome 19: new genetic variants of A1BG. Clin. Genet. 36:415-418, 1989.

Eiberg, H.; Nielsen, L. S.; Gahne, B.; Juneja, R. K.; Mohr, J.: Exclusion data for the alpha-1-B glycoprotein (A1BG) polymorphism.(Abstract) Cytogenet. Cell Genet. 51:994 only, 1989.

Gahne, B.; Juneja, R. K.; Stratil, A.: Genetic polymorphism of human plasma alpha-1-B-glycoprotein: phenotyping by immunoblotting or by a simple method of 2-D electrophoresis. Hum. Genet. 76:111-115,1987.

Ishioka, N.; Takahashi, N.; Putnam, F. W.: Amino acid sequence of human plasma alpha-1B-glycoprotein: homology to the immunoglobulin supergene family. Proc. Nat. Acad. Sci. 83:2363-2367, 1986.

Juneja, R. K.; Weitkamp, L. R.; Stratil, A.; Gahne, B.; Guttormsen, S. A.: Further studies of the plasma alpha-1-B-glycoprotein polymorphism: two new alleles and allele frequencies in Caucasians and in American blacks. Hum. Hered. 38:267-272, 1988.

Fajans, S. S.; Bell, G. I.; Polonsky, K. S.: Molecular mechanisms and clinical pathophysiology of maturity-onset diabetes of the young. New Eng. J. Med. 345:971-980, 2001.

Lindner, T.; Gragnoli, C.; Furuta, H.; Cockburn, B. N.; Petzold, C.; Rietzsch, H.; Weiss, U.; Schulze, J.; Bell, G. I.: Hepatic function in a family with a nonsense mutation (R154X) in the hepatocyte nuclear factor-4-alpha/MODY1 gene. J. Clin. Invest. 100:1400-1405, 1997.

Moller, A. M.; Dalgaard, L. T.; Ambye, L.; Hansen, L.; Schmitz, O.; Hansen, T.; Pedersen, O.: A novel Phe75fsdelT mutation in the hepatocyte nuclear factor-4-alpha gene in a Danish pedigree with maturity-onset diabetes of the young. J. Clin. Endocr. Metab. 84:367-369, 1999.

Thomas, H.; Jaschkowitz, K.; Bulman, M.; Frayling, T. M.; Mitchell, S. M. S.; Roosen, S.; Lingott-Frieg, A.; Tack, C. J.; Ellard, S.; Ryffel, G. U.; Hattersley, A. T.: A distant upstream promoter of the HNF-4-alpha gene connects the transcription factors involved in maturity-onset diabetes of the young. Hum. Molec. Genet. 10:2089-2097,2001.

Joseph, L. J.; Le Beau, M. M.; Jamieson, G. A., Jr.; Acharya, S.; Shows, T. B.; Rowley, J. D.; Sukhatme, V. P.: Molecular cloning, sequencing, and mapping of EGR2, a human early growth response gene encoding a protein with 'zinc-binding finger' structure. Proc. Nat. Acad. Sci. 85:7164-7168, 1988.

Nagarajan, R.; Svaren, J.; Le, N.; Araki, T.; Watson, M.; Milbrandt, J.: EGR2 mutations in inherited neuropathies dominant-negatively inhibit myelin gene expression. Neuron 30:355-368, 2001.

Timmerman, V.; De Jonghe, P.; Ceuterick, C.; De Vriendt, E.; Lofgren, A.; Nelis, E.; Warner, L. E.; Lupski, J. R.; Martin, J.-J.; Van Broeckhoven, C.: Novel missense mutation in the early growth response 2 gene associated with Dejerine-Sottas syndrome phenotype. Neurology 52:1827-1832,1999.

Warner, L. E.; Mancias, P.; Butler, I.; Lupski, J. R.: Mutation in the early growth response 2 (EGR2) transcription factor associated with recessive congenital hypomyelinating neuropathy (CHN). (Abstract) Am. J. Hum. Genet. 61 (suppl.): A350 only, 1997.

Warner, L. E.; Mancias, P.; Butler, I. J.; McDonald, C. M.; Keppen, L.; Koob, K. G.; Lupski, J. R.: Mutations in the early growth response2 (EGR2) gene are associated with hereditary myelinopathies. Nature Genet. 18:382-384, 1998.

Warner, L. E.; Svaren, J.; Milbrandt, J.; Lupski, J. R.: Functional consequences of mutations in the early growth response 2 gene (EGR2) correlate with severity of human myelinopathies. Hum. Molec. Genet. 8:1245-1251, 1999.

Wu, J.; Joseph, L.; Sukhatme, V. P.; Kidd, K. K.: A Hind III polymorphism identified by the human early growth response gene 2 (EGR2) on chromosome Nucleic Acids Res. 16:11855 only, 1988.

Hoeffler, J. P.; Meyer, T. E.; Yun, Y.; Jameson, J. L.; Habener, J. F.: Cyclic AMP-responsive DNA-binding protein: structure based on a cloned placental cDNA. Science 242:1430-1433, 1988.

Horelli-Kuitunen, N.; Kvist, A.-P.; Helaakoski, T.; Kivirikko, K.; Pihlajaniemi, T.; Palotie, A.: The order and transcriptional orientation of the human COL13A1 and P4HA genes on chromosome 10 long arm determined by high-resolution FISH. Genomics 46:299-302, 1997.

Pajunen, L.; Tamminen, M.; Solomon, E.; Pihlajaniemi, T.: Assignment of the gene coding for the alpha 1 chain of collagen type XIII (COL13A1) to human chromosome region 10q11-qter. Cytogenet. Cell Genet. 52:190-193, 1989.

Shows, T. B.; Tikka, L.; Byers, M. G.; Eddy, R. L.; Haley, L. L.; Henry, W. M.; Prockop, D. J.; Tryggvason, K.: Assignment of the human collagen alpha-1(XIII) chain gene (COL13A1) to the q22 region of chromosome 10. Genomics 5:128-133, 1989.

Tikka, L.; Pihlajaniemi, T.; Henttu, P.; Prockop, D. J.; Tryggvason, K.: Gene structure for the alpha-1 chain of a human short-chain collagen (type XIII) with alternatively spliced transcripts and translation termination codon at the 5-prime end of the last exon. Proc. Nat. Acad. Sci. 85:7491-7495, 1988.

Cunningham, B. A.; Hemperly, J. J.; Murray, B. A.; Prediger, E. A.; Brackenbury, R.; Edelman, G. M.: Neural cell adhesion molecule: structure, immunoglobulin-like domains, cell surface modulation, and alternative RNA splicing. Science 236:799-806, 1987.

d'Eustachio, P.; Davisson, M. T.: Resolution of the staggerer (sg) mutation from the neural cell adhesion molecule locus (Ncam) on mouse chromosome 9. Mammalian Genome 4:278-280, 1993.

d'Eustachio, P.; Owens, G. C.; Edelman, G. M.; Cunningham, B. A.: Chromosomal location of the gene encoding the neural cell adhesion molecule (N-CAM) in the mouse. Proc. Nat. Acad. Sci. 82:7631-7635,1985.

Lin, D. M.; Fetter, R. D.; Kopczynski, C.; Grenningloh, G.; Goodman, C. S.: Genetic analysis of fasciclin II in Drosophila: defasciculation, refasciculation, and altered fasciculation. Neuron 13:1055-1069,1994.

Kaplan, D. H.; Shankaran, V.; Dighe, A. S.; Stockert, E.; Aguet, M.; Old, L. J.; Schreiber, R. D.: Demonstration of an interferon gamma-dependent tumor surveillance system in immunocompetent mice. Proc. Nat. Acad. Sci. 95:7556-7561, 1998.

Deloukas, P.; Schuler, G. D.; Gyapay, G.; Beasley, E. M.; Soderlund, C.; Rodriguez-Tome, P.; Hui, L.; Matise, T. C.; McKusick, K. B.; Beckmann, J. S.; Bentolila, S.; Bihoreau, M.-T.; and 53 others: A physical map of 30,000 human genes. Science 282:744-746, 1998.

Davis, S. T.; Benson, B. G.; Bramson, H. N.; Chapman, D. E.; Dickerson, S. H.; Dold, K. M.; Eberwein, D. J.; Edelstein, M.; Frye, S. V.; Gampe, R. T., Jr.; Griffin, R. J.; Harris, P. A.; and 14 others: Prevention of chemotherapy-induced alopecia in rats by CDK inhibitors. Science 291:134-137, 2001.

De Bondt, H. L.; Rosenblatt, J.; Jancarik, J.; Jones, H. D.; Morgan, D. O.; Kim, S.-H.: Crystal structure of cyclin-dependent kinase 2. Nature 363:595-602, 1993.

Basu, S.; Binder, R. J.; Ramalingam, T.; Srivastava, P. K.: CD91 is a common receptor for heat shock proteins gp96, hsp90, hsp70, and calreticulin. Immunity 14:303-313, 2001.

Beisiegel, U.; Weber, W.; Ihrke, G.; Herz, J.; Stanley, K. K.: The LDL-receptor-related protein, LRP, is an apolipoprotein E-binding protein. Nature 341:162-164, 1989.

Binder, R. J.; Han, D. K.; Srivastava, P. K.: CD91: a receptor for heat shock protein gp96. Nature Immun. 1:151-155, 2000.

Forus, A.; Maelandsmo, G. M.; Fodstad, Y.; Myklebost, O.: The genes for the alpha-2-macroglobulin receptor/LDL receptor-related protein and GLI are located within a chromosomal segment of about 300 kilobases and are coamplified in a rhabdomyosarcoma cell line. (Abstract) Cytogenet. Cell Genet. 58:1977 only, 1991.

Forus, A.; Myklebost, O.: A physical map of a 1.3-Mb region on the long arm of chromosome 12, spanning the GLI and LRP loci. Genomics 14:117-120, 1992.

Hilliker, C.; Van Leuven, F.; Van Den Berghe, H.: Assignment of the gene coding for the alpha (2)-macroglobulin receptor to mouse chromosome 15 and to human chromosome 12q13-q14 by isotopic and nonisotopic in situ hybridization. Genomics 13:472-474, 1992.

Kristensen, T.; Moestrup, S. K.; Gliemann, J.; Bendtsen, L.; Sand, O.; Sottrup-Jensen, L.: Evidence that the newly cloned low-density-lipoprotein receptor related protein (LRP) is the alpha-2-macroglobulin receptor. FEBS Lett. 276:151-155, 1990.

Lendon, C. L.; Talbot, C. J.; Craddock, N. J.; Han, S. W.; Wragg, M.; Morris, J. C.; Goate, A. M.: Genetic association studies between dementia of the Alzheimer's type and three receptors for apolipoprotein E in a Caucasian population. Neurosci. Lett. 222:187-190, 1997.

Myklebost, O.; Arheden, K.; Rogne, S.; Geurts van Kessel, A.; Mandahl, N.; Herz, J.; Stanley, K.; Heim, S.; Mitelman, F.: The gene for the human putative apoE receptor is on chromosome 12 in the segment q13-14. Genomics 5:65-69, 1989.

Scott, W. K.; Yamaoka, L. H.; Bass, M. P.; Gaskell, P. C.; Conneally, P. M.; Small, G. W.; Farrer, L. A.; Auerbach, S. A.; Saunders, A. M.; Roses, A. D.; Haines, J. L.; Pericak-Vance, M. A.: No genetic association between the LRP receptor and sporadic or late-onset familial Alzheimer disease. Neurogenetics 1:179-183, 1998.

Strickland, D. K.; Ashcom, J. D.; Williams, S.; Burgess, W. H.; Migliorini, M.; Argraves, W. S.: Sequence identity between the alpha-2-macroglobulin receptor and low density lipoprotein receptor-related protein suggests that this molecule is a multifunctional receptor. J. Biol. Chem. 265:17401-17404, 1990.

Yochem, J.; Greenwald, I.: A gene for a low density lipoprotein receptor-related protein in the nematode Caenorhabditis elegans. Proc. Nat. Acad. Sci. 90:4572-4576, 1993.

Ladias, J. A. A.; Karathanasis, S. K.: Regulation of the apolipoprotein AI gene by ARP-1, a novel member of the steroid receptor superfamily. Science 251:561-565, 1991.

Pericak-Vance, M. A.; Bass, M. P.; Yamaoka, L. H.; Gaskell, P. C.; Scott, W. K.; Terwedow, H. A.; Menold, M. M.; Conneally, P. M.; Small, G. W.; Vance, J. M.; Saunders, A. M.; Roses, A. D.; Haines, J. L.: Complete genomic screen in late-onset familial Alzheimer disease: evidence for a new locus on chromosome 12. J. A. M. A. 278:1237-1241,1997.

Modi, W. S.; Seuanez, H.; Mietus-Snyder, M.; O'Brien, S. J.; Karathanasis, S. K.: Chromosomal localization of the ARP-1 gene to 15q26. (Abstract) Cytogenet. Cell Genet. 58:1995 only, 1991.

Pereira, F. A.; Qiu, Y.; Zhou, G.; Tsai, M.-J.; Tsai, S. Y.: The orphan nuclear receptor COUP-TFII is required for angiogenesis and heart development. Genes Dev. 13:1037-1049, 1999.

Widom, R. L.; Ladias, J. A. A.; Kouidou, S.; Karathanasis, S. K.: Synergistic interactions between transcription factors control expression of the apolipoprotein AI gene in liver cells. Molec. Cell. Biol. 11:677-687, 1991.

Ikeda, H.; Yamaguchi, M.; Sugai, S.; Aze, Y.; Narumiya, S.; Kakizuka, A.: Expanded polyglutamine in the Machado-Joseph disease protein induces cell death in vitro and in vivo. Nature Genet. 13:196-202,1996.

Kang, H.; Sun, L. D.; Atkins, C. M.; Soderling, T. R.; Wilson, M. A.; Tonegawa, S.: An important role of neural activity-dependent CaMKIV signaling in the consolidation of long-term memory. Cell 106:771-783, 2001.

Raman, V.; Blaeser, F.; Ho, N.; Engle, D. L.; Williams, C. B.; Chatila, T. A.: Requirement for Ca (2+)/calmodulin-dependent kinase type IV/Gr in setting the thymocyte selection threshold. J. Immun. 167:6270-6278, 2001.

Sikela, J. M.; Adamson, M. C.; Wilson-Shaw, D.; Kozak, C. A.: Genetic mapping of the gene for Ca (2+)/calmodulin-dependent protein kinase IV (Camk-4) to mouse chromosome 18. Genomics 8:579-582,1990.

Sikela, J. M.; Law, M. L.; Kao, F.-T.; Hartz, J. A.; Wei, Q.; Hahn, W. E.: Chromosomal localization of the human gene for brain Ca (2+)/calmodulin-dependent protein kinase type IV. Genomics 4:21-27, 1989.

Wei, F.; Qiu, C.-S.; Liauw, J.; Robinson, D. A.; Ho, N.; Chatila, T.; Zhuo, M.: Calcium-calmodulin-dependent protein kinase IV is required for fear memory. Nature Neurosci. 5:573-579, 2002.

Wu, H.; Kanatous, S. B.; Thurmond, F. A.; Gallardo, T.; Isotani, E.; Bassel-Duby, R.; Williams, R. S.: Regulation of mitochondrial biogenesis in skeletal muscle by CaMK. Science 296:349-352, 2002.

Wu, J. Y.; Ribar, T. J.; Cummings, D. E.; Burton, K. A.; McKnight, G. S.; Means, A. R.: Spermiogenesis and exchange of basic nuclear proteins are impaired in male germ cells lacking Camk4. Nature Genet. 25:448-452, 2000.

Brown, S.; Wiebel, F. J.; Gelboin, H. V.; Minna, J. D.: Assignment of a locus required for flavoprotein-linked monooxygenase expression to human chromosome 2. Proc. Nat. Acad. Sci. 73:4628-4632, 1976.

Chen, Y. T.; Tukey, R. H.; Swan, D. C.; Negishi, N.; Nebert, D. W.: Characterization of the human P1-450 genomic gene. (Abstract) Clin. Res. 31:456A, 1983.

Corchero, J.; Pimprale, S.; Kimura, S.; Gonzalez, F. J.: Organization of the CYP1A cluster on human chromosome 15: implications for gene regulation. Pharmacogenetics 11:1-6, 2001.

Gorman, C.; Padmanabhan, R.; Howard, B. H.: High efficiency DNA-mediated transformation of primate cells. Science 221:551-553, 1983.

Gorman, C. M.: CAT: an easy assay for gene expression (citation classic). Current Contents (Life Sciences) 36(22):8, 1993.

Hildebrand, C. E.; Gonzalez, F. J.; Kozak, C. A.; Nebert, D. W.: Regional linkage analysis of the dioxin-inducible P-450 gene family on mouse chromosome 9. Biochem. Biophys. Res. Commun. 130:396-406,1985.

Field, L. L.; Marazita, M. L.; Spence, M. A.; Crandall, B. F.; Sparkes, R. S.: Is JK linked to IGK on chromosome 2? (Abstract) Cytogenet. Cell Genet. 40:628-629, 1985.

Gedde-Dahl, T.: Personal Communication. Oslo, Norway Sep. 26, 1986.

Geitvik, G. A.; Hoyheim, B.; Gedde-Dahl, T.; Grzeschik, K. H.; Lothe, R.; Tomter, H.; Olaisen, B.: The Kidd (JK) blood group locus assigned to chromosome 18 by close linkage to a DNA-RFLP. Hum. Genet. 77:205-209, 1987.

Hulten, M.; Lindsten, J.; Pen-Ming, L. M.; Fraccaro, M.; Mannini, A.; Trepolo, L.; Robson, E. B.; Heiken, A.; Tellingen, K. G.: Possible localization of the genes for the Kidd blood group on an autosome involved in a reciprocal translocation. Nature 211:1067-1068, 1968.

Leppert, M.; Ferrell, R.; Kamboh, M. I.; Beasley, J.; O'Connell, P.; Lathrop, M.; Lalouel, J.-M.; White, R.: Linkage of the polymorphic protein markers F13B, C1S, C1R, and blood group antigen Kidd in CEPH reference families. (Abstract) Cytogenet. Cell Genet. 46:647, 1987.

Lucien, N.; Chiaroni, J.; Cartron, J.-P.; Bailly, P.: Partial deletion in the JK locus causing a Jk(null) phenotype. Blood 99:1079-1081, 2002.

Lucien, N.; Sidoux-Walter, F.; Olives, B.; Moulds, J.; Le Pennec, P.-Y.; Cartron, J.-P.; Bailly, P.: Characterization of the gene encoding the human kidd blood group/urea transporter protein: evidence for splice site mutations in Jk-null individuals. J. Biol. Chem. 273:12973-12980, 1998.

Olives, B.; Mattei, M.-G.; Huet, M.; Neau, P.; Martial, S.; Cartron, J.-P.; Bailly, P.: Kidd blood group and urea transport function of human erythrocytes are carried by the same protein. J. Biol. Chem. 270:15607-15610, 1995.

Muramatsu, T.; Zu-Cheng, W.; Yi-Ru, F.; Kou-Bao, H.; Heqin, Y.; Yamada, K.; Higuchi, S.; Harada, S.; Kono, H.: Alcohol and aldehyde dehydrogenase genotypes and drinking behavior of Chinese living in Shanghai. Hum. Genet. 96:151-154, 1995.

Womack, J. E.: Personal Communication. College Station, Texas Feb. 26, 1990.

Wunderle, V. M.; Critcher, R.; Hastie, N.; Goodfellow, P. N.; Schedl, A.: Deletion of long-range regulatory elements upstream of SOX9 causes campomelic dysplasia. Proc. Nat. Acad. Sci. 95:10649-10654,1998.

Young, I. D.; Zuccollo, J. M.; Maltby, E. L.; Broderick, N. J.: Campomelic dysplasia associated with a de novo 2q;17q reciprocal translocation. J. Med. Genet. 29:251-252, 1992.

Fornerod, M.; van Duersen, J.; van Baal, S.; Reynolds, A.; Davis, D.; Murti, K. G.; Fransen, J.; Grosveld, G.: The human homologue of yeast CRM1 is in a dynamic subcomplex with CAN/Nup214 and a novel nuclear pore component Nup88. EMBO J. 16:807-816, 1997.

Edenberg, H. J.: Regulation of the mammalian alcohol dehydrogenase genes. Prog. Nucleic Acids Res. Molec. Biol. 64:295-341, 2000.

Osier, M. V.; Pakstis, A. J.; Soodyall, H.; Comas, D.; Goldman, D.; Odunsi, A.; Okonofua, F.; Parnas, J.; Schulz, L. O.; Bertranpetit, J.; Bonne-Tamir, B.; Lu, R.-B.; Kidd, J. R.; Kidd, K. K.: A global perspective on genetic variation at the ADH genes reveals unusual patterns of linkage disequilibrium and diversity. Am. J. Hum. Genet. 71:84-99, 2002.

Smith, M.; Hopkinson, D. A.; Harris, H.: Studies on the subunit structure and molecular size of the human dehydrogenase isozymes determined by the different loci, ADH(1), ADH(2), and ADH(3). Ann. Hum. Genet. 36:401-414, 1973.

Comings, D. E.; Gade-Andavolu, R.; Gonzalez, N.; Blake, H.; Wu, S.; MacMurray, J. P.: Additive effect of three noradrenergic genes (ADRA2A, ADRA2C, DBH) on attention-deficit hyperactivity disorder and learning disabilities in Tourette syndrome subjects. Clin. Genet. 55:160-172, 1999.

Halperin, J. M.; Newcorn, J. H.; Koda, V. H.; Pick, L.; McKay, K. E.; Knott, P.: Noradrenergic mechanisms in ADHD children with and without reading disabilities: a replication and extension. J. Am. Acad. Child Adolesc. Psychiat. 36:1688-1697, 1997.

Hein, L.; Altman, J. D.; Kobilka, B. K.: Two functionally distinct alpha-2-adrenergic receptors regulate sympathetic neurotransmission. Nature 402:181-184, 1999.

Hoehe, M.; Berrettini, W.; Leppert, M.; Lalouel, J.-M.; Byerley, W.; Gershon, E.; White, R.: Genetic mapping of adrenergic receptor genes. (Abstract) Am. J. Hum. Genet. 45 (suppl.): A143 only, 1989.

Hoehe, M. R.; Berrettini, W. H.; Lentes, K.-U.: Dra I identifies a two allele DNA polymorphism in the human alpha-2-adrenergic receptor gene (ADRAR), using a 5.5 kb probe (p ADRAR). Nucleic Acids Res. 16:9070 only, 1988.

Kobilka, B. K.; Matsui, H.; Kobilka, T. S.; Yang-Feng, T. L.; Francke, U.; Caron, M. G.; Lefkowitz, R. J.; Regan, J. W.: Cloning, sequencing, and expression of the gene coding for the human platelet alpha-2-adrenergic receptor. Science 238: 650-656, 1987.

Oakey, R. J.; Caron, M. G.; Lefkowitz, R. J.; Seldin, M. F.: Genomic organization of adrenergic and serotonin receptors in the mouse: linkage mapping of sequence-related genes provides a method for examining mammalian chromosome evolution. Genomics 10:338-344, 1991.

Philipp, M.; Brede, M. E.; Hadamek, K.; Gessler, M.; Lohse, M. J.; Hein, L.: Placental alpha-2-adrenoceptors control vascular development at the interface between mother and embryo. Nature Genet. 31:311-315,2002.

Surprenant, A.; Horstman, D. A.; Akbarali, H.; Limbird, L. E.: A point mutation of the alpha-2-adrenoceptor that blocks coupling to potassium but not calcium currents. Science 257: 977-980, 1992.

Yang-Feng, T. L.; Kobilka, B. K.; Caron, M. G.; Lefkowitz, R. J.; Francke, U.: Chromosomal assignment of genes for an alpha-adrenergic receptor (ADRAR) and for another member of this receptor family coupled to guanine nucleotide regulatory proteins (RG21). (Abstract) Cytogenet. Cell Genet. 46:722-723, 1987.

Koch, G.; Shows, T. B.: Somatic cell genetics of adenosine deaminase expression and severe combined immune deficiency disease in man. Proc. Nat. Acad. Sci. 77:4211-4215, 1980.

Gautam, M.; Noakes, P. G.; Moscoso, L.; Rupp, F.; Scheller, R. H.; Merlie, J. P.; Sanes, J. R.: Defective neuromuscular synaptogenesis in agrin-deficient mutant mice. Cell 85:525-535, 1996.

Glass, D. J.; Bowen, D. C.; Stitt, T. N.; Radziejewski, C.; Bruno, J.; Ryan, T. E.; Gies, D. R.; Shah, S.; Mattsson, K.; Burden, S. J.; DiStefano, P. S.; Valenzuela, D. M.; DeChiara, T. M.; Yancopoulos, G. D.: Agrin acts via a MuSK receptor complex. Cell 85:513-523,1996.

Khan, A. A.; Bose, C.; Yam, L. S.; Soloski, M. J.; Rupp, F.: Physiological regulation of the immunological synapse by agrin. Science 292:1681-1686,2001.

Lin, W.; Burgess, R. W.; Dominguez, B.; Pfaff, S. L.; Sanes, J. R.; Lee, K.-F.: Distinct roles of nerve and muscle in postsynaptic differentiation of the neuromuscular synapse. Nature 410:1057-1064,2001.

McMahan, U. J.: The agrin hypothesis Cold Spring Harb. Symp. Quant. Biol. 50:407-418, 1990.

Rupp, F.; Ozcelik, T.; Linial, M.; Peterson, K.; Francke, U.; Scheller, R.: Structure and chromosomal localization of the mammalian agrin gene. J. Neurosci. 12:3535-3544, 1992.

Rupp, F.; Payan, D. G.; Magill-Solc, C.; Cowan, D. M.; Scheller, R. H.: Structure and expression of a rat agrin. Neuron 6:811-823,1991.

d'Alfonso, S.; Richiardi, P. M.: A polymorphic variation in a putative regulation box of the TNFA promoter region. Immunogenetics 39:150-154, 1994.

Mietus-Snyder, M.; Charmley, P.; Korf, B.; Ladias, J. A. A.: Gatti, R. A. and Karathanasis, S. K.: Genetic linkage of the human apolipoprotein AI-CIII-AIV gene cluster and the neural cell adhesion molecule (NCAM) gene. Genomics 7:633-637, 1990.

Mietus-Snyder, M.; Korf, B.; Ladias, J. A.; Karathanasis, S. K.: Linkage of the human apolipoproteins A1, C3, A4 and the neural cell adhesion molecule (NCAM) genes. (Abstract) Cytogenet. Cell Genet. 51:1044 only, 1989.

Nguyen, C.; Mattei, M. G.; Goridis, C.; Mattei, J. F.; Jordan, B. R.: Localization of the human N-CAM gene to chromosome 11 by in situ hybridization with a murine N-CAM cDNA probe. (Abstract) Cytogenet. Cell Genet. 40:713 only, 1985.

Nguyen, C.; Mattei, M. G.; Mattei, J.-F.; Santoni, M.-J.; Goridis, C.; Jordan, B. R.: Localization of the human NCAM gene to band q23of chromosome 11: the third gene coding for a cell interaction molecule mapped to the distal portion of the long arm of chromosome 11. J. Cell Biol. 102:711-715, 1986.

Rabinowitz, J. E.; Rutishauser, U.; Magnuson, T.: Targeted mutation of Ncam to produce a secreted molecule results in a dominant embryonic lethality. Proc. Nat. Acad. Sci. 93:6421-6424, 1996.

Rutishauser, U.; Acheson, A.; Hall, A. K.; Mann, D. M.; Sunshine, J.: The neural cell adhesion molecule (NCAM) as a regulator of cell-cell interactions. Science 240:53-57, 1988.

Rutishauser, U.; Goridis, C.: NCAM: the molecule and its genetics. Trends Genet. 2:72-76, 1986.

Telatar, M.; Lange, E.; Uhrhammer, N.; Gatti, R. A.: New localization of NCAM, proximal to DRD2 at chromosome 11q23. Mammalian Genome 6:59-60, 1995.

Agellon, L. B.; Drover, V. A. B.; Cheema, S. K.; Gbaguidi, G. F.; Walsh, A.: Dietary cholesterol fails to stimulate the human cholesterol 7-alpha-hydroxylase gene (CYP7A1) in transgenic mice. J. Biol. Chem. 277:20131-20134, 2002.

Angelin, B.; Einarsson, K.; Hellstrom, K.; Leijd, B.: Bile acid kinetics in relation to endogenous triglyceride metabolism in various types of hyperlipoproteinemia. J. Lipid Res. 19:1004-1016, 1978.

Angelin, B.; Hershon, K. S.; Brunzell, J. D.: Bile acid metabolismin hereditary forms of hypertriglyceridemia: evidence for an increased synthesis rate in monogenic familial hypertriglyceridemia. Proc. Nat. Acad. Sci. 84:5434-5438, 1987.

Cohen, J. C.; Cali, J. J.; Jelinek, D. F.; Mehrabian, M.; Sparkes, R. S.; Lusis, A. J.; Russell, D. W.; Hobbs, H. H.: Cloning of the human cholesterol 7-alpha-hydroxylase gene (CYP7) and localization to chromosome 8q11-q12. Genomics 14:153-161, 1992.

Drover, V. A. B.; Wong, N. C. W.; Agellon, L. B.: A distinct thyroid hormone response element mediates repression of the human cholesterol7-alpha-hydroxylase (CYP7A1) gene promoter. Molec. Endocr. 16:14-23,2002.

Goodwin, B.; Jones, S. A.; Price, R. R.; Watson, M. A.; McKee, D. D.; Moore, L. B.; Galardi, C.; Wilson, J. G.; Lewis, M. C.; Roth, M. E.; Maloney, P. R.; Willson, T. M.; Kliewer, S. A.: A regulatory cascade of the nuclear receptors FXR, SHP-1, and LRH-1 represses bile acid biosynthesis. Molec. Cell 6:517-526, 2000.

Molowa, D. T.; Chen, W. S.; Cimis, G. M.; Tan, C. P.: Transcriptional regulation of the human cholesterol 7 alpha-hydroxylase gene. Biochemistry 31:2539-2544, 1992.

Nitta, M.; Ku, S.; Brown, C.; Okamoto, A. Y.; Shan, B.: CPF: an orphan nuclear receptor that regulates liver-specific expression of the human cholesterol 7-alpha-hydroxylase gene. Proc. Nat. Acad. Sci. 96:6660-6665, 1999.

Noshiro, M.; Okuda, K.: Molecular cloning and sequence analysis of cDNA encoding human cholesterol 7 alpha-hydroxylase. FEBS Lett. 268:137-140, 1990.

Paumgartner, G.; Sauerbruch, T.: Gallstones: pathogenesis. Lancet 338:1117-1121, 1991.

Wang, J.; Freeman, D. J.; Grundy, S. M.; Levine, D. M.; Guerra, R.; Cohen, J. C.: Linkage between cholesterol 7-alpha-hydroxylase and high plasma low-density lipoprotein cholesterol concentrations. J. Clin. Invest. 101:1283-1291, 1998.

Hsieh, C.-L.; Kumar, N. M.; Gilula, N. B.; Francke, U.: Distribution of genes for gap junction membrane channel proteins on human and mouse chromosomes. Somat. Cell Molec. Genet. 17:191-200, 1991.

Spielman, R. S.; McGinnis, R. E.; Ewens, W. J.: Transmission test for linkage disequilibrium: the insulin gene region and insulin-dependent diabetes mellitus (IDDM). Am. J. Hum. Genet. 52:506-516, 1993.

DeStefano, A. L.; Baldwin, C. T.; Burzstyn, M.; Gavras, I.; Handy, D. E.; Joost, O.; Martel, T.; Nicolaou, M.; Schwartz, F.; Streeten, D. H. P.; Farrer, L. A.; Gavras, H.: Autosomal dominant orthostatic hypotensive disorder maps to chromosome 18q. Am. J. Hum. Genet. 63:1425-1430, 1998.

Barnett, T.; Zimmermann, W.: Workshop report: proposed nomenclature for the carcinoembryonic antigen (CEA) gene family. Tumor Biol. 11:59-63, 1990.

Boulton, I. C.; Gray-Owen, S. D.: Neisserial binding to CEACAM1 arrests the activation and proliferation of CD4+ T lymphocytes. Nature Immun. 3:229-236, 2002.

Ergun, S.; Kilic, N.; Ziegeler, G.; Hansen, A.; Nollau, P.; Gotze, J.; Wurmbach, J.-H.; Horst, A.; Weil, J.; Fernando, M.; Wagener, C.: CEA-related cell adhesion molecule 1: a potent angiogenic factor and a major effector of vascular endothelial growth factor. Molec. Cell 5:311-320, 2000.

Hinoda, Y.; Neumaier, M.; Hefta, S. A.; Drzeniek, Z.; Wagener, C.; Shively, L.; Hefta, L. J. F.; Shively, J. E.; Paxton, R. J.: Molecular cloning of a cDNA coding biliary glycoprotein I: primary structure of a glycoprotein immunologically crossreactive with carcinoembryonic antigen. Proc. Nat. Acad. Sci. 85:6959-6963, 1988.

Neumaier, M.; Paululat, S.; Chan, A.; Matthaes, P.; Wagener, C.: Biliary glycoprotein, a potential human cell adhesion molecule, is down-regulated in colorectal carcinomas. Proc. Nat. Acad. Sci. 90:10744-10748, 1993.

Poy, M. N.; Yang, Y.; Rezaei, K.; Fernstrom, M. A.; Lee, A. D.; Kido, Y.; Erickson, S. K.; Najjar, S. M.: CEACAM1 regulates insulin clearance in liver. Nature Genet. 30:270-276, 2002.

Robbins, J.; Robbins, P. F.; Kozak, C. A.; Callahan, R.: The mouse biliary glycoprotein gene (Bgp): partial nucleotide sequence, expression, and chromosomal assignment. Genomics 10:583-587, 1991.

Thompson, J. A.; Grunert, F.; Zimmermann, W.: Carcinoembryonic antigen gene family: molecular biology and clinical perspectives. J. Clin. Lab. Anal. 5:344-366, 1991.

Zneimer, S. M.; Womack, J. E.: Regional localization of the fibronectin and gamma crystallin genes to mouse chromosome 1 by in situ hybridization. Cytogenet. Cell Genet. 48:238-241, 1988.

Bierhuizen, M. F. A.; Mattei, M.-G.; Fukuda, M.: Expression of the developmental I antigen by a cloned human cDNA encoding a member of a beta-1,6-N-acetylglucosaminyl transferase gene family. Genes Dev. 7:468-478, 1993.

Lin-Chu, M.; Broadberry, R. E.; Okubo, Y.; Tanaka, M.: The i phenotype and congenital cataracts among Chinese in Taiwan (Letter) Transfusion 31:676-677, 1991.

Ogata, H.; Okubo, Y.; Akabane, T.: Phenotype i associated with congenital cataract in Japanese. Transfusion 19:166-168, 1979.

Yeh, J.-C.; Ong, E.; Fukuda, M.: Molecular cloning and expression of a novel beta-1,6-N-acetylglucosaminyl transferase that forms core2, core 4, and I branches. J. Biol. Chem. 274:3215-3221, 1999.

Yu, L.-C.; Twu, Y.-C.; Chang, C.-Y.; Lin, M.: Molecular basis of the adult i phenotype and the gene responsible for the expression of the human blood group I antigen. Blood 98:3840-3845, 2001.

Abdelhak, S.; Kalatzis, V.; Heilig, R.; Compain, S.; Samson, D.; Vincent, C.; Weil, D.; Cruaud, C.; Sahly, I.; Leibovici, M.; Bitner-Glindzicz, M.; Francis, M.; Lacombe, D.; Vigneron, J.; Charachon, R.; Boven, K.; Bedbeder, P.; Van Regemorter, N.; Weissenbach, J.; Petit, C.: A human homologue of the Drosophila eyes absent gene underlies branchio-oto-renal (BOR) syndrome and identifies a novel gene family. Nature Genet. 15:157-164, 1997.

Azuma, N.; Nishina, S.; Yanagisawa, H.; Okuyama, T.; Yamada, M.: PAX6 missense mutation in isolated foveal hypoplasia. (Letter) Nature Genet. 13:141-142, 1996.

Curran, R. E.; Robb, R. M.: Isolated foveal hypoplasia. Arch. Ophthal. 94:48-50, 1976.

O'Donnell, F. E., Jr.; Pappas, H. R.: Autosomal dominant foveal hypoplasia and presenile cataracts: a new syndrome. Arch. Ophthal. 100:279-281, 1982.

Tommerup, N.; Schempp, W.; Meinecke, P.; Pedersen, S.; Bolund, L.; Brandt, C.; Goodpasture, C.; Guldberg, P.; Held, K.; Reinwein, H.; Saugstad, O. D.; Scherer, G.; Skjeldal, O.; Toder, R.; Westvik, J.; van der Hagen, C. B.; Wolf, U.: Assignment of an autosomal sex reversal locus (SRA1) and campomelic dysplasia (CMPD1) to 17q24.3-q25.1. Nature Genet. 4:170-174, 1993.

Anderson, M. J.; Shelton, G. D.; Cavenee, W. K.; Arden, K. C.: Embryonic expression of the tumor-associated PAX3-FKHR fusion protein interferes with the developmental functions of Pax3. Proc. Nat. Acad. Sci. 98:1589-1594, 2001.

Anderson, M. J.; Viars, C. S.; Czekay, S.; Cavenee, W. K.; Arden, K. C.: Cloning and characterization of three human forkhead genes that comprise an FKHR-like gene subfamily. Genomics 47:187-199,1998.

Barr, F. G.; Galili, N.; Holick, J.; Biegel, J. A.; Rovera, G.; Emanuel, B. S.: Rearrangement of the PAX3 paired box gene in the paediatric solid tumor alveolar rhabdomyosarcoma. Nature Genet. 3:113-117, 1993.

Davis, R. J.; Barr, F. G.: Fusion genes resulting from alternative chromosomal translocations are overexpressed by gene-specific mechanisms in alveolar rhabdomyosarcoma. Proc. Nat. Acad. Sci. 94:8047-8051,1997.

Fredericks, W. J.; Galili, N.; Mukhopadhyay, S.; Rovera, G.; Bennicelli, J.; Barr, F. G.; Rauscher, F. J., III: The PAX3-FKHR fusion protein created by the t (2;13) translocation in alveolar rhabdomyosarcomas is a more potent transcriptional activator than PAX3. Molec. Cell. Biol. 15:1522-1535, 1995.

Galili, N.; Davis, R. J.; Fredericks, W. J.; Mukhopadhyay, S.; Rauscher, F. J., III; Emanuel, B. S.; Rovera, G.; Barr, F. G.: Fusion of a fork head domain gene to PAX3 in the solid tumour alveolar rhabdomyosarcoma. Nature Genet. 5:230-235, 1993.

Khan, J.; Bittner, M. L.; Saal, L. H.; Teichmann, U.; Azorsa, D. O.; Gooden, G. C.; Pavan, W. J.; Trent, J. M.; Meltzer, P. S.: cDNA microarrays detect activation of a myogenic transcription program by the PAX3-FKHR fusion oncogene. Proc. Nat. Acad. Sci. 96:13264-13269,1999.

Angle, C. R.: Congenital bowing and angulation of the long bones. Pediatrics 13:257-268, 1954.

Bain, A. D.; Barrett, H. S.: Congenital bowing of the long bones: report of a case. Arch. Dis. Child. 34:516-524, 1959.

Bell, D. M.; Leung, K. K. H.; Wheatley, S. C.; Ng, L. J.; Zhou, S.; Ling, K. W.; Sham, M. H.; Koopman, P.; Tam, P. P. L.; Cheah, K. S. E.: SOX9 directly regulates the type-II collagen gene. Nature Genet. 16:174-178, 1997.

Bi, W.; Huang, W.; Whitworth, D. J.; Deng, J. M.; Zhang, Z.; Behringer, R. R.; de Crombrugghe, B.: Haploinsufficiency of Sox9 results in defective cartilage primordia and premature skeletal mineralization. Proc. Nat. Acad. Sci. 98:6698-6703, 2001.

Bishop, C. E.; Whitworth, D. J.; Qin, Y.; Agoulnik, A. I.; Agoulnik, I. U.; Harrison, W. R.; Behringer, R. R.; Overbeek, P. A.: A transgenic insertion upstream of Sox9 is associated with dominant XX sex reversal in the mouse. Nature Genet. 26:490-494, 2000.

Caffey, J. P.: Prenatal bowing and thickening of tubular bones, with multiple cutaneous dimples in arms and legs: a congenital syndrome of mechanical origin. Am. J. Dis. Child. 74:543-562, 1947.

Cameron, F. J.; Hageman, R. M.; Cooke-Yarborough, C.; Kwok, C.; Goodwin, L. L.; Sillence, D. O.; Sinclair, A. H.: A novel germ line mutation in SOX9 causes familial campomelic dysplasia and sex reversal. Hum. Molec. Genet. 5:1625-1630, 1996.

Cameron, F. J.; Sinclair, A. H.: Mutations in SRY and SOX9: testis-determining genes. Hum. Mutat. 9:388-395, 1997.

Cooke, C. T.; Mulcahy, M. T.; Cullity, G. J.; Watson, M.; Sprague, P.: Campomelic dysplasia with sex reversal: morphological and cytogenetic studies of a case. Pathology 17:526-529, 1985.

Cremin, B. J.; Orsmond, G.; Beighton, P.: Autosomal recessive inheritance in camptomelic dwarfism.(Letter) Lancet I:488-489,1973.

Dagna Bricarelli, F.; Fraccaro, M.; Lindsten, J.; Muller, U.; Baggio, P.; Carbone, L. D. L.; Hjerpe, A.; Lindgren, F.; Mayerova, A.; Ringertz, H.; Ritzen, E. M.; Rovetta, D. C.; Sicchero, C.; Wolf, U.: Sex-reversed XY females with campomelic dysplasia are H-Y negative. Hum. Genet. 57:15-22, 1981.

Ebensperger, C.; Jager, R. J.; Lattermann, U.; Dagna Bricarelli, F.; Keutel, J.; Lindsten, J.; Rehder, H.; Muller, U.; Wolf, U.: No evidence of mutations in four candidate genes for male sex determination/differentiation in sex-reversed XY females with campomelic dysplasia. Ann. Genet. 34:233-238, 1991.

Fontaine, G.; Walbaum, R.; Farriaux, J. P.; Tilmont, P.; Peuzin, F.; Delecour, M.: Le conseil genetique dans la dysplasie campomelique (a propos de deux observations). J. Genet. Hum. 28:267-279, 1980.

Foster, J. W.; Dominguez-Steglich, M. A.; Guioli, S.; Kwok, C.; Weller, P. A.; Stevanovic, M.; Weissenbach, J.; Mansour, S.; Young, I. D.; Goodfellow, P. N.; Brook, J. D.; Schafer, A. J.: Campomelic dysplasia and autosomal sex reversal caused by mutations in an SRY-related gene. Nature 372:525-530, 1994.

Friedrich, U.; Schaefer, E.; Meinecke, P.: Campomelic dysplasia without overt campomelia. Clin. Dysmorph. 1:172-178, 1992.

Gasca, S.; Canizares, J.; de Santa Barbara, P.; Mejean, C.; Poulat, F.; Berta, P.; Boizet-Bonhoure, B.: A nuclear export signal within the high mobility group domain regulates the nucleocytoplasmic translocation of SOX9 during sexual determination. Proc. Nat. Acad. Sci. 99:11199-11204,2002.

Glass, R. B. J.; Rosenbaum, K. N.: A campomelic campomelic dysplasia: further radiographic variations. Am. J. Med. Genet. 69:29-32, 1997.

Hall, B.; Spranger, J. W.: Campomelic dysplasia: further elucidation of a distinct entity. Am. J. Dis. Child. 134:285-289, 1980.

Hoefnagel, D.; Wurster-Hill, D. H.; Dupree, W. B.; Benirschke, K.; Fuld, G. L.: Camptomelic dwarfism associated with XY-gonadal dysgenesis and chromosome anomalies. Clin. Genet. 13:489-499, 1978.

Houston, C. S.; Opitz, J. M.; Spranger, J. W.; Macpherson, R. I.; Reed, M. H.; Gilbert, E. F.; Herrmann, J.; Schinzel, A.: The campomelic syndrome: review, report of 17 cases, and follow-up on the currently 17-year-old boy first reported by Maroteaux et al in1971. Am. J. Med. Genet. 15:3-28, 1983.

Hovmoller, M. L.; Osuna, A.; Eklof, O.; Fredga, K.; Hjerpe, A.; Lindsten, J.; Ritzen, M.; Stanescu, V.; Svenningsen, N.: Camptomelic dwarfism. A genetically determined mesenchymal disorder combined with sex reversal. Hereditas 86:51-62, 1977.

Huang, W.; Chung, U.; Kronenberg, H. M.; de Crombrugghe, B.: The chondrogenic transcription factor Sox9 is a target of signaling by the parathyroid hormone-related peptide in the growth plate of endochondral bones. Proc. Nat. Acad. Sci. 98:160-165, 2001.

Kanai, Y.; Koopman, P.: Structural and functional characterization of the mouse Sox9 promoter: implications for campomelic dysplasia. Hum. Molec. Genet. 8:691-696, 1999.

Medema, R. H.; Kops, G. J. P. L.; Bos, J. L.; Burgering, B. M. T.: AFX-like forkhead transcription factors mediate cell-cycle regulation by Ras and PKB through p27(kip1). Nature 404:782-787, 2000.

Burant, C. F.; Takeda, J.; Brot-Laroche, E.; Bell, G. I.; Davidson, N. O.: Fructose transporter in human spermatozoa and small intestine is GLUT5. J. Biol. Chem. 267:14523-14526, 1992.

Davidson, N. O.; Hausman, A. M. L.; Ifkovits, C. A.; Buse, J. B.; Gould, G. W.; Burant, C. F.; Bell, G. I.: Human intestinal glucose transporter expression and localization of GLUT5. Am. J. Physiol. 262:C795-C800, 1992.

Cremonini, N.; Graziano, E.; Chiarini, V.; Sforza, A.; Zampa, G. A.: Atypical McCune-Albright syndrome associated with growth hormone-prolactin pituitary adenoma: natural history, long-term follow-up, and SMS 201-995--bromocriptine combined treatment results. J. Clin. Endocr. Metab. 75:1166-1169,1992.

DeChiara, T.; Robertson, E. J.; Efstratiadis, A.: Parental imprinting of the mouse insulin-like growth factor II gene. Cell 64:849-859,1991.

Eddy, M. C.; Jan de Beur, S. M.; Yandow, S. M.; McAlister, W. H.; Shore, E. M.; Kaplan, F. S.; Whyte, M. P.; Levine, M. A.: Deficiency of the alpha-subunit of the stimulatory G protein and severe extraskeletal ossification. J. Bone Miner. Res. 15:2074-2083, 2000.

Falconer, M. A.; Cope, C. L.; Robb-Smith, A. H. T.: Fibrous dysplasia of bone with endocrine disorders and cutaneous pigmentation (Albright's disease). Quart. J. Med. 11:121-154, 1942.

Albertsen, H. M.; Smith, S. A.; Mazoyer, S.; Fujimoto, E.; Stevens, J.; Williams, B.; Rodriguez, P.; Cropp, C. S.; Slijepcevic, P.; Carlson, M.; Robertson, M.; Bradley, P.; Lawrence, E.; Harrington, T.; MeiSheng, Z.; Hoopes, R.; Sternberg, N.; Brothman, A.; Callahan, R.; Ponder, B. A. J.; White, R.: A physical map and candidate genes in the BRCA1 region on chromosome 17q12-21. Nature Genet. 7:472-479, 1994.

Khatib, Z. A.; Inaba, T.; Valentine, M.; Look, A. T.: Chromosomal localization and cDNA cloning of the human DBP and TEF genes. Genomics 23:344-351, 1994.

Demange, P.; Voges, D.; Benz, J.; Liemann, S.; Gottig, P.; Berendes, R.; Burger, A.; Huber, R.: Annexin V: the key to understanding ion selectivity and voltage regulation? Trends Biochem. Sci. 19:272-276,1994.

Funakoshi, T.; Heimark, R. L.; Hendrickson, L. E.; McMullen, B. A.; Fujikawa, K.: Human placental anticoagulant protein: isolation and characterization. Biochemistry 26:5572-5578, 1987.

Grundmann, U.; Abel, K.-J.; Bohn, H.; Lobermann, H.; Lottspeich, F.; Kupper, H.: Characterization of cDNA encoding human placental anticoagulant protein (PP4): homology with the lipocortin family. Proc. Nat. Acad. Sci. 85:3708-3712, 1988.

Kaplan, R.; Jaye, M.; Burgess, W. H.; Schlaepfer, D. D.; Haigler, H. T.: Cloning and expression of cDNA for human endonexin II, a Ca (2+) and phospholipid binding protein. J. Biol. Chem. 263:8037-8043,1988.

Modi, W. S.; Seuanez, H.; Jaye, M.; Kaplan, R.; Haigler, H.; O'Brien, S. J.: Chromosomal mapping of the endonexin II gene. (Abstract) Cytogenet. Cell Genet. 51:1046, 1989.

Modi, W. S.; Seuanez, H. N.; Jaye, M.; Haigler, H. J.; Kaplan, R.; O'Brien, S. J.: The human endonexin II (ENX2) gene is located at 4q28-q32. Cytogenet. Cell Genet. 52:167-169, 1989.

Rodriguez-Garcia, M. I.; Kozak, C. A.; Morgan, R. O.; Fernandez, M. P.: Mouse annexin V chromosomal localization, cDNA sequence conservation, and molecular evolution. Genomics 31:151-157, 1996.

Tait, J. F.; Frankenberry, D. A.; Shiang, R.; Murray, J. C.; Adler, D. A.; Disteche, C. M.: Chromosomal localization of the human gene for annexin V (placental anticoagulant protein I) to 4q26-q28. Cytogenet. Cell Genet. 57:187-192, 1991.

Arinami, T.; Ishikawa, M.; Inoue, A.; Yanagisawa, M.; Masaki, T.; Yoshida, M. C.; Hamaguchi, H.: Chromosomal assignments of the human endothelin family genes: the endothelin-1 gene (EDN1) to 6p23-p24, the endothelin-2 gene (EDN2) to 1p34, and the endothelin-3 gene (EDN3) to 20q13.2-q13.3. Am. J. Hum. Genet. 48:990-996, 1991.

Benatti, L.; Bonecchi, L.; Cozzi, L.; Sarmientos, P.: Two preproendothelin1 mRNAs transcribed by alternative promoters. J. Clin. Invest. 91:1149-1156, 1993.

Berge, K. E.; Berg, K.: No effect of a TaqI polymorphism in DNA at the endothelin I (EDN1) locus on normal blood pressure level or variability. Clin. Genet. 41:90-95, 1992.

Bloch, K. D.; Friedrich, S. P.; Lee, M.-E.; Eddy, R. L.; Shows, T. B.; Quertermous, T.: Structural organization and chromosomal assignment of the gene encoding endothelin. J. Biol. Chem. 264:10851-10857,1989.

Bourgeois, C.; Robert, B.; Rebourcet, R.; Mondon, F.; Mignot, T.-M.; Duc-Goiran, P.; Ferre, F.: Endothelin-1 and ET(A) receptor expression in vascular smooth muscle cells from human placenta: a new ET(A) receptor messenger ribonucleic acid is generated by alternative splicing of exon 3. J. Clin. Endocr. Metab. 82:3116-3123, 1997.

Clouthier, D. E.; Hosoda, K.; Richardson, J. A.; Williams, S. C.; Yanagisawa, H.; Kuwaki, T.; Kumada, M.; Hammer, R. E.; Yanagisawa, M.: Cranial and cardiac neural crest defects in endothelin-A receptor-deficient mice. Development 125:813-824, 1998.

Giaid, A.; Gibson, S. J.; Ibrahim, N. B. N.; Legon, S.; Bloom, S. R.; Yanagisawa, M.; Masaki, T.; Varndell, I. M.; Polak, J. M.:Endothelin 1, an endothelium-derived peptide, is expressed in neurons of the human spinal cord and dorsal root ganglia. Proc. Nat. Acad. Sci. 86:7634-7638, 1989.

Inoue, A.; Yanagisawa, M.; Kimura, S.; Kasuya, Y.; Miyauchi, T.; Goto, K.; Masaki, T.: The human endothelin family: three structurally and pharmacologically distinct isopeptides predicted by three separate genes. Proc. Nat. Acad. Sci. 86:2863-2867, 1989.

Inoue, A.; Yanagisawa, M.; Takuwa, Y.; Mitsui, Y.; Kobayashi, M.; Masaki, T.: The human preproendothelin-1 gene: complete Nucleotide sequence and regulation of expression. J. Biol. Chem. 264:14954-14959,1989.

Halford, S.; Freedman, M. S.; Bellingham, J.; Inglis, S. L.; Poopalasundaram, S.; Soni, B. G.; Foster, R. G.; Hunt, D. M.: Characterization of a novel human opsin gene with wide tissue expression and identification of embedded and flanking genes on chromosome 1q43. Genomics 72:203-208, 2001.

Amato, F.; Warnes, G. M.; Kirby, C. A.; Norman, R. J.: Infertility caused by hCG autoantibody. J. Clin. Endocr. Metab. 87:993-997,2002.

Naylor, S. L.; Chin, W. W.; Goodman, H. M.; Lalley, P. A.; Grzeschik, K.-H.; Sakaguchi, A. Y.: Chromosome assignment of the genes encoding the alpha and beta subunits of the glycoprotein hormones in man and mouse. Somat. Cell Genet. 9:757-770, 1983.

Mammarella, S.; Romano, F.; Di Valerio, A.; Creati, B.; Esposito, D. L.; Palmirotta, R.; Capani, F.; Vitullo, P.; Volpe, G.; Battista, P.; Della Loggia, F.; Mariani-Costantini, R.; Cama, A.: Interaction between the G1057D variant of IRS-2 and overweight in the pathogenesis of type 2 diabetes. Hum. Molec. Genet. 9:2517-2521, 2000.

Triggs-Raine, B. L.; Kirkpatrick, R. D.; Kelly, S. L.; Norquay, L. D.; Cattini, P. A.; Yamagata, K.; Hanley, A. J. G.; Zinman, B.; Harris, S. B.; Barrett, P. H.; Hegele, R. A.: HNF1-alpha G319S, a transactivation-deficient mutant, is associated with altered dynamics of diabetes onset in an Oji-Cree community. Proc. Nat. Acad. Sci. 99:4614-4619, 2002.

Yuan, M.; Konstantopoulos, N.; Lee, J.; Hansen, L.; Li, Z.-W.; Karin, M.; Shoelson, S. E.: Reversal of obesity- and diet-induced insulin resistance with salicylates or targeted disruption of Ikk-beta. Science 293:1673-1677, 2001.

Barker, P. E.; Shipp, M. A.; d'Adamio, L.; Masteller, E. L.; Reinherz, E. L.: The common acute lymphoblastic leukemia antigen gene maps to chromosomal region 3(q21-q27). J. Immun. 142:283-287, 1989.

d'Adamio, L.; Shipp, M. A.; Masteller, E. L.; Reinherz, E. L.: Organization of the gene encoding common acute lymphoblastic leukemia antigen (neutral endopeptidase 24.11): multiple miniexons and separate5-prime untranslated regions. Proc. Nat. Acad. Sci. 86:7103-7107,1989.

Debiec, H.; Guigonis, V.; Mougenot, B.; Decobert, F.; Haymann, J.-P.; Bensman, A.; Deschenes, G.; Ronco, P. M.: Antenatal membranous glomerulonephritis due to anti-neutral endopeptidase antibodies. New Eng. J. Med. 346:2053-2060, 2002.

Letarte, M.; Vera, S.; Tran, R.; Addis, J. B. L.; Onizuka, R. J.; Quackenbush, E. J.; Jongeneel, C. V.; McInnes, R. R.: Common acute lymphocytic leukemia antigen is identical to neutral endopeptidase. J. Exp. Med. 168:1247-1253, 1988.

Shipp, M. A.; Vijayaraghavan, J.; Schmidt, E. V.; Masteller, E. L.; d'Adamio, L.; Hersh, L. B.; Reinherz, E. L.: Common acute lymphoblastic leukemia antigen (CALLA) is active neutral endopeptidase 24.11 ('enkephalinase'): direct evidence by cDNA transfection analysis. Proc. Nat. Acad. Sci. 86:297-301, 1989.

Tran-Paterson, R.; Willard, H. F.; Letarte, M.: The common acute lymphoblastic leukemia antigen (neutral endopeptidase--3.4.24.11) gene is located on human chromosome 3. Cancer Genet. Cytogenet. 42:129-134, 1989.

Lahn, B. T.; Page, D. C.: Four evolutionary strata on the human X chromosome. Science 286:964-967, 1999.

Lee, F. A.; Issacs, H.; Strauss, J.: The 'camptomelic' syndrome. Short life-span dwarfism with respiratory distress, hypotonia, peculiar facies, and multiple skeletal and cartilaginous deformities. Am. J. Dis. Child. 124:485-496, 1972.

Lynch, S. A.; Gaunt, M. L.; Minford, A. M. B.: Campomelic dysplasia: evidence of autosomal dominant inheritance. J. Med. Genet. 30:683-686,1993.

Macpherson, R. I.; Skinner, S. A.; Donnenfeld, A. E.: Acampomelic campomelic dysplasia. Pediat. Radiol. 20:90-93, 1989.

Mansour, S.; Hall, C. M.; Pembrey, M. E.; Young, I. D.: A clinical and genetic study of campomelic dysplasia. J. Med. Genet. 32:415-420,1995.

Maraia, R.; Saal, H. M.; Wangsa, D.: A chromosome 17q de novo paracentric inversion in a patient with campomelic dysplasia; case report and etiologic hypothesis. Clin. Genet. 39:401-408, 1991.

Maroteaux, P.; Spranger, J. W.; Opitz, J. M.; Kucera, J.; Lowry, R. B.; Schimke, R. N.; Kagan, S. M.: Le syndrome campomelique. Presse Med. 22:1157-1162, 1971.

Meyer, J.; Sudbeck, P.; Held, M.; Wagner, T.; Schmitz, M. L.; Bricarelli, F. D.; Eggermont, E.; Friedrich, U.; Haas, O. A.; Kobelt, A.; Leroy, J. G.; van Maldergem, L.; Michel, E.; Mitulla, B.; Pfeiffer, R. A.; Schinzel, A.; Schmidt, H.; Scherer, G.: Mutational analysis of the SOX9 gene in campomelic dysplasia and autosomal sex reversal: lack of genotype/phenotype correlations. Hum. Molec. Genet. 6:91-98, 1997.

Moedjono, S. J.; Crandall, B. F.; Sparkes, R. S.; Feldman, G. M.; Austin, G. E.; Perry, S.: The campomelic syndrome in a singleton and monozygotic twins. Clin. Genet. 18:397-401, 1980.

Moog, U.; Jansen, N. J. G.; Scherer, G.; Schrander-Stumpel, C. T. R. M.: A campomelic campomelic syndrome. Am. J. Med. Genet. 104:239-245, 2001.

Morais da Silva, S.; Hacker, A.; Harley, V.; Goodfellow, P.; Swain, A.; Lovell-Badge, R.: Sox9 expression during gonadal development implies a conserved role for the gene in testis differentiation in mammals and birds. Nature Genet. 14:62-68, 1996.

Murakami, S.; Kan, M.; McKeehan, W. L.; de Crombrugghe, B.: Up-regulation of the chondrogenic Sox9 gene by fibroblast growth factors is mediated by the mitogen-activated protein kinase pathway. Proc. Nat. Acad. Sci. 97:1113-1118, 2000.

Ninomiya, S.; Isomura, M.; Narahara, K.; Seino, Y.; Nakamura, Y.: Isolation of a testis-specific cDNA on chromosome 17q from a region adjacent to the breakpoint of t (12;17) observed in a patient with acampomelic campomelic dysplasia and sex reversal. Hum. Molec. Genet. 5:69-72, 1996.

Ninomiya, S.; Yokoyama, Y.; Teraoka, M.; Mori, R.; Inoue, C.; Yamashita, S.; Tamai, H.; Funato, M.; Seino, Y.: A novel mutation (296 del G) of the SOX9 gene in a patient with campomelic syndrome and sex reversal. Clin. Genet. 58:224-227, 2000.

Olney, P. N.; Kean, L. S.; Graham, D.; Elsas, L. J.; May, K. M.: Campomelic syndrome and deletion of SOX9. Am. J. Med. Genet. 84:20-24, 1999.

Ozkilic, A.; Seven, M.; Yuksel, A.: A case of acampomelic campomelic dysplasia. Genet. Counsel. 13:23-28, 2002.

Patel, M.; Dorman, K. S.; Zhang, Y.-H.; Huang, B.-L.; Arnold, A. P.; Sinsheimer, J. S.; Vilain, E.; McCabe, E. R. B.: Primate DAX1, SRY, and SOX9: evolutionary stratification of sex-determination pathway. Am. J. Hum. Genet. 68:275-280, 2001.

Pfeifer, D.; Kist, R.; Dewar, K.; Devon, K.; Lander, E. S.; Birren, B.; Korniszewski, L.; Back, E.; Scherer, G.: Campomelic dysplasia translocation breakpoints are scattered over 1 Mb proximal to SOX9: evidence for an extended control region. Am. J. Hum. Genet. 65:111-124, 1999.

Puck, S. M.; Haseltine, F. P.; Francke, U.: Absence of H-Y antigen in an XY female with campomelic dysplasia. Hum. Genet. 57:23-27,1981.

Rimoin, D. L.: Personal Communication. Torrance, Calif. Aug. 12, 1976.

Rodriguez, J. I.: Vascular anomalies in campomelic syndrome. Am. J. Med. Genet. 46:185-192, 1993.

Savarirayan, R.; Bankier, A.: Acampomelic campomelic dysplasia with de novo 5q;17q reciprocal translocation and severe phenotype. J. Med. Genet. 35:597-599, 1998.

Schimke, R. N.: XY sex-reversed campomelia--possibly an X-linked disorder? (Letter) Clin. Genet. 16:62-63, 1979.

Shafai, T.; Schwartz, L.: Camptomelic syndrome in siblings. J. Pediat. 89:512-513, 1976.

Spranger, J.: Advances in bone dysplasias. (Abstract) Sixth Int. Cong. Hum. Genet. Jerusalem, 1981.

Stuve, A.; Wiedemann, H.-R.: Congenital bowing of the long bones in two sisters. (Letter) Lancet I:495, 1971.

Sudbeck, P.; Schmitz, M. L.; Baeuerle, P. A.; Scherer, G.: Sex reversal by loss of the C-terminal transactivation domain of human SOX9. Nature Genet. 13:230-232, 1996.

Thong, M.-K.; Scherer, G.; Kozlowski, K.; Haan, E.; Morris, L.: Acampomelic campomelic dysplasia with SOX9 mutation. Am. J. Med. Genet. 93:421-425, 2000.

Thurmon, T. F.; De Fraites, E. B.; Anderson, E. E.: Familial campomelic dwarfism. J. Pediat. 83:841-843, 1973.

Vidal, V. P. I.; Chaboissier, M.-C.; de Rooij, D. G.; Schedl, A.: Sox9 induces testis development in XX transgenic mice. Nature Genet. 28:216-217, 2001.

Wagner, T.; Wirth, J.; Meyer, J.; Zabel, B.; Held, M.; Zimmer, J.; Pasantes, J.; Dagna Bricarelli, F.; Keutel, J.; Hustert, E.; Wolf, U.; Tommerup, N.; Schempp, W.; Scherer, G.: Autosomal sex reversal and campomelic dysplasia are caused by mutations in and around the SRY-related gene SOX9. Cell 79:1111-1120, 1994.

Weller, S. D. V.: Hypophosphatasia with congenital dimples. Proc. Roy. Soc. Med. 52:637, 1959.

Wirth, J.; Wagner, T.; Meyer, J.; Pfeiffer, R. A.; Tietze, H.-U.; Schempp, W.; Scherer, G.: Translocation breakpoints in three patients with campomelic dysplasia and autosomal sex reversal map more than 130 kb from SOX9. Hum. Genet. 97:186-193, 1996.

Wright, E.; Hargrave, M. R.; Christiansen, J.; Cooper, L.; Kun, J.; Evans, T.; Gangadharan, U.; Greenfield, A.; Koopman, P.: The Sry-related gene Sox9 is expressed during chondrogenesis in mouse embryos. Nature Genet. 9:15-20, 1995.

Cook, P. W.; Piepkorn, M.; Clegg, C. H.; Plowman, G. D.; DeMay, J. M.; Brown, J. R.; Pittelkow, M. R.: Transgenic expression of the human amphiregulin gene induces a psoriasis-like phenotype. J. Clin. Invest. 100:2286-2294, 1997.

Disteche, C. M.; Plowman, G. D.; Gronwald, R. G. K.; Kelly, J.; Bowen-Pope, D.; Adler, D. A.; Murray, J. C.: Mapping of the amphiregulin and the platelet-growth factor receptor alpha genes to the proximal long arm of chromosome 4. (Abstract) Cytogenet. Cell Genet. 51:990 only, 1989.

Kimura, H.; Fischer, W. H.; Schubert, D.: Structure, expression and function of a schwannoma-derived growth factor. Nature 348:257-260, 1990.

Gillessen-Kaesbach, G.; Demuth, S.; Thiele, H.; Theile, U.; Lich, C.; Horsthemke, B.: A previously unrecognised phenotype characterised by obesity, muscular hypotonia, and ability to speak in patients with Angelman syndrome caused by an imprinting defect. Europ. J. Hum. Genet. 7:638-644, 1999.

Acosta, J.; Hettinga, J.; Fluckiger, R.; Krumrei, N.; Goldfine, A.; Angarita, L.; Halperin, J.: Molecular basis for a link between complement and the vascular complications of diabetes. Proc. Nat. Acad. Sci. 97:5450-5455, 2000.

Bickmore, W. A.; Longbottom, D.; Oghene, K.; Fletcher, J. M.; vanHeyningen, V.: Colocalization of the human CD59 gene to 11p13 with the MIC11 cell surface antigen. Genomics 17:129-135, 1993.

Davies, A.; Simmons, D. L.; Hale, G.; Harrison, R. A.; Tighe, H.; Lachmann, P. J.; Waldmann, H.: CD59, an LY-6-like protein expressed in human lymphoid cells, regulates the action of the complement membrane attack complex on homologous cells. J. Exp. Med. 170:637-654, 1989.

Forsberg, U. H.; Bazil, V.; Stefanova, I.; Schroder, J.: Gene for human CD59 (likely Ly-6 homologue) is located on the short arm of chromosome 11. Immunogenetics 30:188-193, 1989.

Harada, R.; Okada, N.; Fujita, T.; Okada, H.: Purification of 1F5 antigen that prevents complement attack on homologous cell membranes. J. Immun. 144:1823-1828, 1990.

Heckl-Ostreicher, B.; Ragg, S.; Drechsler, M.; Scherthan, H.; Royer-Pokora, B.: Localization of the human CD59 gene by fluorescence in situ hybridization and pulsed-field gel electrophoresis. Cytogenet. Cell Genet. 63:144-146, 1993.

Holt, D. S.; Botto, M.; Bygrave, A. E.; Hanna, S. M.; Walport, M. J.; Morgan, B. P.: Targeted deletion of the CD59 gene causes spontaneous intravascular hemolysis and hemoglobinuria. Blood 98:442-449, 2001.

Holt, D. S.; Powell, M. B.; Rushmere, N. K.; Morgan, B. P.: Genomic structure and chromosome location of the gene encoding mouse CD59. Cytogenet. Cell Genet. 89:264-267, 2000.

Huppi, K.; Duncan, R.; Potter, M.: Myc-1 is centromeric to the linkage group Ly-6-Sis-Gdc-1 on mouse chromosome 15. Immunogenetics 27:215-219, 1988.

Kamiura, S.; Nolan, C. M.; Meruelo, D.: Long-range physical map of the Ly-6 complex: mapping the Ly-6 multigene family by field-inversion and two-dimensional gel electrophoresis. Genomics 12:89-105, 1992.

Low, M. G.; Saltiel, A. R.: Structural and functional roles of glycosyl-phosphatidyl inositol in membranes. Science 239:268-275,1988.

Mahoney, J. F.; Urakaze, M.; Hall, S.; DeGasperi, R.; Chang, H.-M.; Sugiyama, E.; Warren, C. D.; Borowitz, M.; Nicholson-Weller, A.; Rosse, W. F.; Yeh, E. T. H.: Defective glycosylphosphatidyl inositol anchor synthesis in paroxysmal nocturnal hemoglobinuria granulocytes. Blood 79:1400-1403, 1992.

Mao, M.; Yu, M.; Tong, J.-H.; Ye, J.; Zhu, J.; Huang, Q.-H.; Fu, G.; Yu, L.; Zhao, S.-Y.; Waxman, S.; Lanotte, M.; Wang, Z.-Y.; Tan, J.-Z.; Chan, S.-J.; Chen, Z.: RIG-E, a human homolog of the murine Ly-6 family, is induced by retinoic acid during the differentiation of acute promyelocytic leukemia cell. Proc. Nat. Acad. Sci. 93:5910-5914, 1996.

Meri, S.; Morgan, B. P.; Davies, A.; Daniels, R. H.; Olavesen, M. G.; Waldmann, H.; Lachmann, P. J.: Human protectin (CD59), an 18,000-20,000 MW complement lysis restricting factor, inhibits C5b-8 catalysed insertion of C9 into lipid bilayers. Immunology 71:1-9,1990.

Meri, S.; Morgan, B. P.; Wing, M.; Jones, J.; Davies, A.; Podack, E.; Lachmann, P. J.: Human protectin (CD59), an 18-20-kD homologous complement restriction factor, does not restrict perforin-mediated lysis. J. Exp. Med. 172:367-370, 1990.

Motoyama, N.; Okada, N.; Yamashina, M.; Okada, H.: Paroxysmal nocturnal hemoglobinuria due to hereditary nucleotide deletion in the HRF20 (CD59) gene. Europ. J. Immun. 22:2669-2673, 1992.

Okada, N.; Harada, R.; Fujiita, T.; Okada, H.: A novel membrane glycoprotein capable of inhibiting membrane attack by homologous complement. Int. Immun. 1:205-208, 1989.

Stubbs, L.; Carver, E.; Ashworth, L.; Lopez-Molina, L.: Location of the DBP transcription factor gene in human and mouse. Mammalian Genome 7:65-67, 1996.

Szpirer, C.; Riviere, M.; Cortese, R.; Nakamura, T.; Islam, M. Q.; Levan, G.; Szpirer, J.: Chromosomal localization in man and rat of the genes encoding the liver-enriched transcription factors C/EBP, DBP, and HNF1/LFB-1 (CEBP, DBP, and transcription factor 1, TCF1, respectively) and of the hepatocyte growth factor/scatter factor gene (HGF). Genomics 13:293-300, 1992.

Boorstein, W. R.; Vamvakopoulos, N. C.; Fiddes, J. C.: Human chorionic gonadotropin beta-subunit is encoded by at least eight genes arranged in tandem and inverted pairs. Nature 300:419-422, 1982.

Fiddes, J. C.; Goodman, H. M.: The cDNA for the beta-subunit of human chorionic gonadotropin suggests evolution of a gene by readthrough into the 3-prime-untranslated region. Nature 286:684-687, 1980.

Graham, M. Y.; Otani, T.; Boime, I.; Olson, M. V.; Carle, G. F.; Chaplin, D. D.: Cosmid mapping of the human chorionic gonadotropin beta subunit genes by field-inversion gel electrophoresis. Nucleic Acids Res. 15:4437-4448, 1987.

Julier, C.; Weil, D.; Couillin, P.; Cote, J. C.; Boue, A.; Thririon, J. P.; Kaplan, J. C.; Junien, C.: Confirmation of the assignment of the genes coding for human chorionic gonadotropin beta subunit to chromosome 19. (Abstract) Cytogenet. Cell Genet. 37:501-502,1984.

Julier, C.; Weil, D.; Couillin, P.; Cote, J. C.; Van Cong, N.; Foubert, C.; Boue, A.; Thirion, J. P.; Kaplan, J. C.; Junien, C.: The beta chorionic gonadotropin-beta luteinizing gene cluster maps to human chromosome 19. Hum. Genet. 67:174-177, 1984.

Lunardi-Iskander, Y.; Bryant, J. L.; Zeman, R. A.; Lam, V. H.; Samaniego, F.; Besnier, J. M.; Hermans, P.; Thierry, A. R.; Gill, P.; Gallo, R. C.: Tumorigenesis and metastasis of neoplastic Kaposi's sarcoma cell line in immunodeficient mice blocked by a human pregnancy hormone. Nature 375:64-68, 1995.

Policastro, P.; Ovitt, C. E.; Hoshina, M.; Fukuoka, H.; Boothby, M. R.; Biome, I.: The beta-subunit of human chorionic gonadotropin is encoded by multiple genes. J. Biol. Chem. 258:11492-11499, 1983.

Policastro, P. F.; Daniels-McQueen, S.; Carle, G.; Boime, I.: A map of the hCG-beta-LH-beta gene cluster. J. Biol. Chem. 261:5907-5916, 1986.

Talmadge, K.; Vamvakopoulos, N. C.; Fiddes, J. C.: Evolution of the genes for the beta subunits of human chorionic gonadotropin and luteinizing hormone. Nature 307:37-40, 1984.

Warburton, D.; Gersen, S.; Yu, M.-T.; Jackson, C.; Handelin, B.; Housman, D.: Monochromosomal rodent-human hybrids from microcell fusion of human lymphoblastoid cells containing an inserted dominant selectable marker. Genomics 6:358-366, 1990.

Angeletti, R. H.: Chromogranins and neuroendocrine secretion. (Editorial) Lab. Invest. 55:387-390, 1986.

Bhargava, G.; Russell, J.; Sherwood, L. M.: Phosphorylation of parathyroid secretory protein. Proc. Nat. Acad. Sci. 80:878-881,1983.

Cetin, Y.; Aunis, D.; Bader, M.-F.; Galindo, E.; Jorns, A.; Bargsten, G.; Grube, D.: Chromostatin, a chromogranin A-derived bioactive peptide, is present in human pancreatic insulin (beta) cells. Proc. Nat. Acad. Sci. 90:2360-2364, 1993.

Lu, Q.; Lemke, G.: Homeostatic regulation of the immune system by receptor tyrosine kinases of the Tyro 3 family. Science 293:306-311, 2001.

Galbraith, G. M. P.; Pandey, J. P.: Tumor necrosis factor alpha (TNF-alpha) gene polymorphism in alopecia areata. Hum. Genet. 96:433-436, 1995.

Tazi-Ahnini, R.; di Giovine, F. S.; McDonagh, A. J. G.; Messenger, A. G.; Amadou, C.; Cox, A.; Duff, G. W.; Cork, M. J.: Structure and polymorphism of the human gene for the interferon-induced p78 protein (MX1): evidence of association with alopecia areata in the Down syndrome region. Hum. Genet. 106:639-645, 2000.

Wilson, A. G.; di Giovine, F. S.; Blakemore, A. I. F.; Duff, G. W.: Single base polymorphism in the human tumour necrosis factor alpha (TNF-alpha) gene detectable by NcoI restriction of PCR product. Hum. Molec. Genet. 1:353 only, 1992.

Seri, M.; Celli, I.; Betsos, N.; Claudiani, F.; Camera, G.; Romeo, G.: A cys634gly substitution of the RET proto-oncogene in a family with recurrence of multiple endocrine neoplasia type 2A and cutaneous lichen amyloidosis. Clin. Genet. 51:86-90, 1997.

Kamal, A.; Almenar-Queralt, A.; LeBlanc, J. F.; Roberts, E. A.; Goldstein, L. S. B.: Kinesin-mediated axonal transport of a membrane compartment containing beta-secretase and presenilin-1 requires APP. Nature 414:643-648, 2001.

Hofstra, R. M. W.; Sijmons, R. H.; Stelwagen, T.; Stulp, R. P.; Kousseff, B. G.; Lips, C. J. M.; Steijlen, P. M.; Van Voorst Vader, P. C.; Buys, C. H. C. M.: RET mutation screening in familial cutaneous lichen amyloidosis and in skin amyloidosis associated with multiple endocrine neoplasia. J. Invest. Derm. 107:215-218, 1996.

Bordet, T.; Lesbordes, J.-C.; Rouhani, S.; Castelnau-Ptakhine, L.; Schmalbruch, H.; Haase, G.; Kahn, A.: Protective effects of cardiotrophin-1 adenoviral gene transfer on neuromuscular degeneration in transgenic ALS mice. Hum. Molec. Genet. 10:1925-1933, 2001.

Fantes, J. A.; Bickmore, W. A.; Fletcher, J. M.; Ballesta, F.; Hanson, I. M.; van Heyningen, V.: Submicroscopic deletions at the WAGR locus, revealed by nonradioactive in situ hybridization. Am. J. Hum. Genet. 51:1286-1294, 1992.

Glaser, T.; Jepeal, L.; Edwards, J. G.; Young, S. R.; Favor, J.; Maas, R. L.: PAX6 gene dosage effect in a family with congenital cataracts, aniridia, anophthalmia and central nervous system defects. Nature Genet. 7:463-471, 1994.

Glaser, T.; Lane, J.; Housman, D.: A mouse model of the aniridia-Wilms tumor deletion syndrome. Science 250:823-827, 1990.

Gronskov, K.; Olsen, J. H.; Sand, A.; Pedersen, W.; Carlsen, N.; Jylling, A. M. B.; Lyngbye, T.; Brondum-Nielsen, K.; Rosenberg, T.: Population-based risk estimates of Wilms tumor in sporadic aniridia: a comprehensive mutation screening procedure of PAX6 identifies 80% of mutations in aniridia. Hum. Genet. 109:11-18, 2001.

Hanson, I. M.; Seawright, A.; Hardman, K.; Hodgson, S.; Zaletayev, D.; Fekete, G.; van Heyningen, V.: PAX6 mutations in aniridia. Hum. Molec. Genet. 2:915-920, 1993.

Hill, R. E.; Favor, J.; Hogan, B. L. M.; Ton, C. C. T.; Saunders, G. F.; Hanson, I. M.; Prosser, J.; Jordan, T.; Hastie, N. D.; vanHeyningen, V.: Mouse small eye results from mutations in a paired-like homeobox-containing gene. Nature 354: 522-525, 1991.

Jordan, T.; Hanson, I.; Zaletayev, D.; Hodgson, S.; Prosser, J.; Seawright, A.; Hastie, N.; van Heyningen, V.: The human PAX6 gene is mutated in two patients with aniridia. Nature Genet. 1:328-332,1992.

Karpen, G. H.: Position effect variegation and the new biology of heterochromatin. Curr. Opin. Genet. Dev. 4:281-291, 1994.

Lyon, M. F.: Personal Communication. Harwell, England Jun. 9, 1988.

Martha, A.; Strong, L. C.; Ferrell, R. E.; Saunders, G. F.: Three novel aniridia mutations in the human PAX6 gene. Hum. Mutat. 6:44-49, 1995.

Matsuo, T.; Osumi-Yamashita, N.; Noji, S.; Ohuchi, H.; Koyama, E.; Myokai, F.; Matsuo, N.; Taniguchi, S.; Doi, H.; Iseki, S.; Ninomiya, Y.; Fujiwara, M.; Watanabe, T.; Eto, K.: A mutation in the Pax-6gene in rat small eye is associated with impaired migration of midbrain crest cells. Nature Genet. 3:299-304, 1993.

Oliver, M. D.; Dotan, S. A.; Chemke, J.; Abraham, F. A.: Isolated foveal hypoplasia. Brit. J. Ophthal. 71:926-930, 1987.

Prosser, J.; van Heyningen, V.: PAX6 mutations reviewed. Hum. Mutat. 11:93-108, 1998.

Quiring, R.; Walldorf, U.; Kloter, U.; Gehring, W. J.: Homology of the eyeless gene of Drosophila to the small eye gene in mice and aniridia in human S. Science 265:785-789, 1994.

Salvini-Plawen, L.; Mayr, E.: On the evolution of photoreceptors and eyes. In: Hecht, M. K.; Steere, W.; Wallace, B.: Evolutionary Biology. New York: Plenum Pub. (pub.) 10:1977. Pp. 207-263.

Schedl, A.; Ross, A.; Lee, M.; Engelkamp, D.; Rashbass, P.; vanHeyningen, V.; Hastie, N. D.: Influence of PAX6 gene dosage on development: overexpression causes severe eye abnormalities. Cell 86:71-82,1996.

Stone, D. L.; Kenyon, K. R.; Green, W. R.; Ryan, S. J.: Congenital central corneal leukoma (Peters' anomaly). Am. J. Ophthal. 81:173-193,1976.

van der Meer-de Jong, R.; Dickinson, M. E.; Woychik, R. P.; Stubbs, L.; Hetherington, C.; Hogan, B. L. M.: Location of the gene involving the small eye mutation on mouse chromosome 2 suggests homology with human aniridia 2 (AN2). Genomics 7:270-275, 1990.

Cowan, C. A.; Yokoyama, N.; Bianchi, L. M.; Henkemeyer, M.; Fritzsch, B.: EphB2 guides axons at the midline and is necessary for normal vestibular function. Neuron 26:417-430, 2000.

Ton, C. C. T.; Hirvonen, H.; Miwa, H.; Weil, M. M.; Monaghan, P.; Jordan, T.; van Heyningen, V.; Hastie, N. D.; Meijers-Heijboer, H.; Drechsler, M.; Royer-Pokora, B.; Collins, F.; Swaroop, A.; Strong, L. C.; Saunders, G. F.: Positional cloning and characterization of a paired box- and homeobox-containing gene from the aniridia region. Cell 67:1059-1074, 1991.

Shankaran, V.; Ikeda, H.; Bruce, A. T.; White, J. M.; Swanson, P. E.; Old, L. J.; Schreiber, R. D.: IFN-gamma and lymphocytes prevent primary tumour development and shape tumour immunogenicity. Nature 410:1107-1111, 2001.

Ahmad, I.: Mash-1 is expressed during ROD photoreceptor differentiation and binds an E-box, E(opsin-1), in the rat opsin gene. Brain Res. Dev. Brain Res. 90:184-189, 1995.

Ball, D. W.; Azzoli, C. G.; Baylin, S. B.; Chi, D.; Dou, S.; Donis-Keller, H.; Cumaraswamy, A.; Borges, M.; Nelkin, B. D.: Identification of a human achaete-scute homolog highly expressed in neuroendocrine tumors. Proc. Nat. Acad. Sci. 90:5648-5652, 1993.

Guillemot, F.; Lo, L.-C.; Johnson, J. E.; Auerbach, A.; Anderson, D. J.; Joyner, A. L.: Mammalian achaete-scute homolog 1 is required for the early development of olfactory and autonomic neurons. Cell 75:463-476, 1993.

Renault, B.; Lieman, J.; Ward, D.; Krauter, K.; Kucherlapati, R.: Localization of the human achaete-scute homolog gene (ASCL1) distal to phenylalanine hydroxylase (PAH) and proximal to tumor rejection antigen (TRA1) on chromosome 12q22-q23. Genomics 30:81-83, 1995.

Bunz, F.; Kobayashi, R.; Stillman, B.: cDNAs encoding the large subunit of human replication factor C. Proc. Nat. Acad. Sci. 90:11014-11018, 1993.

Lossie, A. C.; Haugen, B. R.; Wood, W. M.; Camper, S. A.; Gordon, D. F.: Chromosomal localization of the large subunit of mouse replication factor C in the mouse and human. Mammalian Genome 6:58-59, 1995.

Luckow, B.; Bunz, F.; Stillman, B.; Lichter, P.; Schutz, G.: Cloning, expression, and chromosomal localization of the 140-kilodalton subunit of replication factor C from mice and humans. Molec. Cell. Biol. 14:1626-1634, 1994.

Pennaneach, V.; Salles-Passador, I.; Munshi, A.; Brickner, H.; Regazzoni, K.; Dick, F.; Dyson, N.; Chen, T.-T.; Wang, J. Y. J.; Fotedar, R.; Fotedar, A.: The large subunit of replication factor C promotes cell survival after DNA damage in an LxCxE motif- and Rb-dependent manner. Molec. Cell 7:715-727, 2001.

Uchiumi, F.; Ohta, T.; Tanuma, S.: Replication factor C recognizes 5-prime-phosphate ends of telomeres. Biochem. Biophys. Res. Commun. 229:310-315, 1996.

Schmickel, R. D.: Contiguous gene syndromes: a component of recognizable syndromes. J. Pediat. 109:231-241, 1986.

Olson, E.; Srivastava, D.: Molecular pathways controlling heart development. Science 272:671-676, 1996.

Valent, A.; Danglot, G.; Bernheim, A.: Mapping of the tyrosine kinase receptors trkA (NTRK1), trkB (NTRK2) and trkC (NTRK3) to human chromosomes 1q22, 9q22 and 15q25 by fluorescence in situ hybridization. Europ. J. Hum. Genet. 5:102-104, 1997.

Cunningham, J. M.; Vanin, E. F.; Tran, N.; Valentine, M.; Jane, S. M.: The human transcription factor CP2 (TFCP2), a component of the human gamma-globin stage selector protein, maps to chromosome region 12q13 and is within 250 kb of the NF-E2 gene. Genomics 30:398-399, 1995.

Jane, S. M.; Nienhuis, A. W.; Cunningham, J. M.: Hemoglobin switching in man and chicken is mediated by a heteromeric complex between the ubiquitous transcription factor CP2 and a developmentally specific protein. EMBO J. 13:197-105, 1995.

Dean, M.; Park, M.; Vande Woude, G. F.: Characterization of the rearranged TPR-MET oncogene breakpoint. Molec. Cell. Biol. 7:921-924,1987.

Lambert, J.-C.; Goumidi, L.; Wavrant-De Vrieze, F.; Frigard, B.; Harris, J. M.; Cummings, A.; Coates, J.; Pasquier, F.; Cottel, D.; Gaillac, M.; St. Clair, D.; Mann, D. M. A.; Hardy, J.; Lendon, C. L.; Amouyel, P.; Chartier-Harlin, M.-C.: The transcriptional factor LBP-1c/CP2/LSF gene on chromosome 12 is a genetic determinant of Alzheimer's disease. Hum. Molec. Genet. 9:2275-2280, 2000.

Swendeman, S. L.; Spielholz, C.; Jenkins, N. A.; Gilbert, D. J.; Copeland, N. G.; Sheffery, M.: Characterization of the genomic structure, chromosomal location, promoter, and developmental expression of the alpha-globin transcription factor CP2. J. Biol. Chem. 269:11663-11671,1994.

Taylor, A. E.; Yip, A.; Brayne, C.; Easton, D.; Evans, J. G.; Xuereb, J.; Cairns, N.; Esiri, M. M.; Rubinsztein, D. C.: Genetic association of an LBP-1c/CP2/LSF gene polymorphism with late onset Alzheimer's disease. J. Med. Genet. 38:232-233, 2001.

Chen, C.-R.; Kang, Y.; Siegel, P. M.; Massague, J.: E2F4/5 and p107 as Smad cofactors linking the TGF-beta receptor to c-myc repression. Cell 110:19-32, 2002.

Zhang, Y.; Venkatraj, V. S.; Fischer, S. G.; Warburton, D.; Chellappan, S. P.: Genomic cloning and chromosomal assignment of the E2F dimerization partner TFDP gene family. Genomics 39:95-98, 1997.

Moloney, D. J.; Panin, V. M.; Johnston, S. H.; Chen, J.; Shao, L.; Wilson, R.; Wang, Y.; Stanley, P.; Irvine, K. D.; Haltiwanger, R. S.; Vogt, T. F.: Fringe is a glycosyltransferase that modifies Notch. Nature 406:369-375, 2000.

Sestan, N.; Artavanis-Tsakonas, S.; Rakic, P.: Contact-dependent inhibition of cortical neurite growth mediated by Notch signaling. Science 286:741-746, 1999.

Tanigaki, K.; Nogaki, F.; Takahashi, J.; Tashiro, K.; Kurooka, H.; Honjo, T.: Notch1 and Notch3 instructively restrict bFGF-responsive multipotent neural progenitor cells to an astroglial fate. Neuron 29:45-55, 2001.

Barton, D. E.; Foellmer, B. E.; Du, J.; Tamm, J.; Derynck, R.; Francke, U.: Chromosomal mapping of genes for transforming growth factors beta-2 and beta-3 in man and mouse: dispersion of TGF-beta gene family. Oncogene Res. 3:323-331, 1988.

Vidal, R.; Frangione, B.; Rostagno, A.; Mead, S.; Revesz, T.; Plant, G.; Ghiso, J.: A stop-codon mutation in the BRI gene associated with familial British dementia. Nature 399: 776-781, 1999.

Doniger, J.; DiPaolo, J. A.: Coordinate N-RAS mRNA up-regulation with mutational activation in tumorigenic guinea pig cells. Nucleic Acids Res. 16:969-980, 1988.

Jeffers, M.; Paciucci, R.; Pellicer, A.: Characterization of UNR: a gene closely linked to N-RAS. Nucleic Acids Res. 18:4891-4899,1990.

Mirnics, K.; Middleton, F. A.; Marquez, A.; Lewis, D. A.; Levitt, P.: Molecular characterization of schizophrenia viewed by microarray analysis of gene expression in prefrontal cortex. Neuron 28:53-67,2000.

Engelkamp, D.; Schafer, B. W.; Mattei, M. G.; Erne, P.; Heizmann, C. W.: Six S100 genes are clustered on human chromosome 1q21: identification of two genes coding for the two previously unreported calcium-binding proteins S100D and S100E. Proc. Nat. Acad. Sci. 90:6547-6551, 1993.

Morii, K.; Tanaka, R.; Takahashi, Y.; Minoshima, S.; Fukuyama, R.; Shimizu, N.; Kuwano, R.: Structure and chromosome assignment of human S100 alpha and beta subunit genes. Biochem. Biophys. Res. Commun. 175:185-191, 1991.

Asada, Y.; Nadeau, J. H.: Fert is on mouse chromosome 11, not chromosome 17. Mammalian Genome 5:830 only, 1994.

Hao, Q.-L.; Heisterkamp, N.; Groffen, J.: Isolation and sequence analysis of a novel human tyrosine kinase gene. Molec. Cell. Biol. 9:1587-1593, 1989.

Dryja, T. P.; Grondin, V. J.; Ringens, P.; Cotran, P.; Berson, E. L.; Travis, G.: Isolation of human retinal cDNA fragments homologous to the murine rds gene transcript. (Abstract) Invest. Ophthal. Vis. Sci. 30 (suppl.):43 only, 1989.

Farrar, G. J.; Jordan, S. A.; Kenna, P.; Humphries, M. M.; Kumar-Singh, R.; McWilliam, P.; Allamand, V.; Sharp, E.; Humphries, P.: Autosomal dominant retinitis pigmentosa: localization of a disease gene (RP6) to the short arm of chromosome 6. Genomics 11:870-874, 1991.

Farrar, G. J.; Kenna, P.; Jordan, S. A.; Kumar-Singh, R.; Humphries, M. M.; Sharp, E. M.; Sheils, D. M.; Humphries, P.: A three-base-pair deletion in the peripherin-RDS gene in one form of retinitis pigmentosa. Nature 354:478-480, 1991.

Feist, R. M.; White, M. F., Jr.; Skalka, H.; Stone, E. M.: Choroidal neovascularization in a patient with adult foveomacular dystrophy and a mutation in the retinal degeneration slow gene (pro210-to-arg). Am. J. Ophthal. 118:259-260, 1994.

Felbor, U.; Schilling, H.; Weber, B. H. F.: Adult vitelliform macular dystrophy is frequently associated with mutations in the peripherin/RDS gene. Hum. Mutat. 10:301-309, 1997.

Gass, J. D. M.: A clinicopathologic study of a peculiar foveomacular dystrophy. Trans. Am. Ophthal. Soc. 72:139-155, 1974.

Jackson, K. E.; Mitchell, E. B.; Stone, E. M.; Ferrell, R. E.; Gorin, M. B.: The identification of an exon-2 peripherin mutation in a family with heterogeneous manifestations of a butterfly pattern macular dystrophy. (Abstract) Am. J. Hum. Genet. 53 (suppl.):1177only, 1993.

Jordan, S. A.; Farrar, G. J.; Kumar-Singh, R.; Kenna, P.; Humphries, M. M.; Allamand, V.; Sharp, E. M.; Humphries, P.: Autosomal dominant retinitis pigmentosa (adRP; RP6): cosegregation of RP6 and the peripherin-RDS locus in a late-onset family of Irish origin. Am. J. Hum. Genet. 50:634-639, 1992.

Billingsley, G. D.; Walter, M. A.; Hammond, G. L.; Cox, D. W.: Physical mapping of four serpin genes: alpha-1-antitrypsin, alpha-1-antichymotrypsin, corticosteroid-binding globulin, and protein C inhibitor, within a 280-kb region on chromosome 14q32.1. Am. J. Hum. Genet. 52:343-353,1993.

Clifton-Bligh, R. J.; Wentworth, J. M.; Heinz, P.; Crisp, M. S.; John, R.; Lazarus, J. H.; Ludgate, M.; Chatterjee, V. K.: Mutation of the gene encoding human TTF-2 associated with thyroid agenesis, cleft palate and choanal atresia. Nature Genet. 19:399-401, 1998.

Greco, A.; Ittmann, M.; Barletta, C.; Basilico, C.; Croce, C. M.; Cannizzaro, L. A.; Huebner, K.: Chromosomal localization of human genes required for G(1) progression in mammalian cells. Genomics 4:240-245, 1989.

Ittmann, M.; Greco, A.; Basilico, C.: Isolation of the human gene that complements a temperature-sensitive cell cycle mutation in BHK cells. Molec. Cell. Biol. 7:3386-3393, 1987.

Ip, N. Y.; Stitt, T. N.; Tapley, P.; Klein, R.; Glass, D. J.; Fandl, J.; Greene, L. A.; Barbacid, M.; Yancopoulos, G. D.: Similarities and differences in the way neurotrophins interact with the Trk receptors in neuronal and nonneuronal cells. Neuron 10:137-149, 1993.

Barbosa, J.; Rich, S.; Dunsworth, T.; Swanson, J.: Linkage disequilibrium between insulin-dependent diabetes and the Kidd blood group Jk(b)allele. J. Clin. Endocr. Metab. 55:193-195, 1982.

Rousseau-Merck, M. F.; Pizon, V.; Tavitian, A.; Berger, R.: Chromosome mapping of the human RAS related RAP1A, RAP1B and RAP2 genes to chromosomes 1p13-12, 12q14 and 13q34, respectively. (Abstract) Cytogenet. CellGenet. 51:1070 only, 1989.

Rousseau-Merck, M. F.; Pizon, V.; Tavitian, A.; Berger, R.: Chromosome mapping of the human RAS-related RAP1A, RAP1B, and RAP2 genes to chromosomes1p12-p13, 12q14, and 13q34, respectively. Cytogenet. Cell Genet. 53:2-4, 1990.

Sebzda, E.; Bracke, M.; Tugal, T.; Hogg, N.; Cantrell, D. A.:Rap1a positively regulates T cells via integrin activation rather than inhibiting lymphocyte signaling. Nature Immun. 3:251-258,2002.

Takai, S.; Nishino, N.; Kitayama, H.; Ikawa, Y.; Noda, M.: mapping of the KREV1 transformation suppressor gene and its pseudogene (KREV1P) to human chromosome 1p13.3 and 14q24.3, respectively, by fluorescence in situ hybridization. Cytogenet. Cell Genet. 63:59-61, 1993.

Zhu, J. J.; Qin, Y.; Zhao, M.; Van Aelst, L.; Malinow, R.: Ras and Rap control AMPA receptor trafficking during synaptic plasticity. Cell 110:443-455, 2002.

Ahmad, F.; Goldstein, B. J.: Functional association between the insulin receptor and the transmembrane protein-tyrosine phosphatase LAR in intact cells. J. Biol. Chem. 272:448-457, 1997.

Disteche, C. M.; Adler, D. A.; Tedder, T. F.; Saito, H.: mapping of the genes for LYAM1, a new lymphocyte adhesion molecule, and for LAR, a new receptor-linked protein tyrosine phosphatase, to human chromosome 1 (Abstract) Cytogenet. Cell Genet. 51:990 only, 1989.

Harder, K. W.; Saw, J.; Miki, N.; Jirik, F.: Coexisting amplifications of the chromosome 1p32 genes (PTPRF and MYCL1) encoding protein tyrosine phosphatase LAR and L-myc in a small cell lung cancer line. Genomics 27:552-553, 1995.

Jirik, F. R.; Harder, K. W.; Melhado, I. G.; Anderson, L. L.; Duncan, A. M. V.: The gene for leukocyte antigen-related tyrosine phosphatase (LAR) is localized to human chromosome 1p32, a region frequently deleted in tumors of neuroectodermal origin. Cytogenet. Cell Genet. 61:266-268, 1992.

Nam, H.-J.; Poy, F.; Krueger, N. X.; Saito, H.; Frederick, C. A.: Crystal structure of the tandem phosphatase domains of RPTP LAR. Cell 97:449-457, 1999.

O'Grady, P.; Krueger, N. X.; Streuli, M.; Saito, H.: Genomic organization of the human LAR protein tyrosine phosphatase gene and alternative splicing in the extracellular fibronectin type-III domains. J. Biol. Chem. 269:25193-25199, 1994.

Schaapveld, R. Q.; Schepens, J. T.; Robinson, G. W.; Attema, J.; Oerlemans, F. T.; Fransen, J. A.; Streuli, M.; Wieringa, B.; Hennighausen, L.; Hendriks, W. J.: Impaired mammary gland development and function in mice lacking LAR receptor-like tyrosine phosphatase activity. Dev. Biol. 188:134-146, 1997.

Schaapveld, R. Q. J.; van den Maagdenberg, A. M. J. M.; Schepens, J. T. G.; Olde Weghuis, D.; Geurts van Kessel, A.; Wieringa, B.; Hendriks, W. J. A. J.: The mouse gene Ptprf encoding the leukocyte common antigen-related molecule LAR: cloning, characterization, and chromosomal localization. Genomics 27:124-130, 1995.

Tsujikawa, K.; Kawakami, N.; Uchino, Y.; Ichijo, T.; Furukawa, T.; Saito, H.; Yamamoto, H.: Distinct functions of the two protein tyrosine phosphatase domains of LAR (leukocyte common antigen-related) on tyrosine dephosphorylation of insulin receptor. Molec. Endocr. 15:271-280, 2001.

Ali, R. R.; Sarra, G.-M.; Stephens, C.; de Alwis, M.; Bainbridge, J. W. B.; Munro, P. M.; Fauser, S.; Reichell, M. B.; Kinnon, C.; Hunt, D. M.; Bhattacharya, S. S.; Thrasher, A. J.: Restoration of photoreceptor ultrastructure and function in retinal degeneration slow mice by gene therapy. Nature Genet. 25:306-310, 2000.

Bascom, R. A.; Connell, G.; Garcia-Heras, J.; Collins, L.; Ledbetter, D.; Molday, R. S.; Kalnins, V.; McInnes, R. R.: Molecular and ultrastructural characterization of the products of the human retinopathy candidate genes ROM1 and RDS. (Abstract) Am. J. Hum. Genet. 47 (suppl.): A101only, 1990.

Connell, G.; Bascom, R.; Molday, L.; Reid, D.; McInnes, R. R.; Molday, R. S.: Photoreceptor peripherin is the normal product of the gene responsible for retinal degeneration in the rds mouse. Proc. Nat. Acad. Sci. 88:723-726, 1991.

Demant, P.; Ivanyi, D.; van Nie, R.: The map position of the rds gene on the 17th chromosome of the mouse. Tissue Antigens 13:53-55,1979.

Inoue, C.; Shiga, K.; Takasawa, S.; Kitagawa, M.; Yamamoto, H.; Okamoto, H.: Evolutionary conservation of the insulinoma gene rig and its possible function. Proc. Nat. Acad. Sci. 84:6659-6662,1987.

Kitagawa, M.; Takasawa, S.; Kikuchi, N.; Itoh, T.; Teraoka, H.; Yamamoto, H.; Okamoto, H.: Rig encodes ribosomal protein S15: the primary structure of mammalian ribosomal protein S15. FEBS Lett. 283:210-214, 1991.

Shiga, K.; Yamamoto, H.; Okamoto, H.: Isolation and characterization of the human homologue of rig and its pseudogenes: the functional gene has features characteristic of housekeeping genes. Proc. Nat. Acad. Sci. 87:3594-3598, 1990.

Acker, J.; Mattei, M.-G.; Wintzerith, M.; Roeckel, N.; Depetris, D.; Vigneron, M.; Kedinger, C.: Chromosomal localization of human RNA polymerase II subunit genes. Genomics 20:496-499, 1994.

Bourquin, J.-P.; Stagljar, I.; Meier, P.; Moosmann, P.; Silke, J.; Baechi, T.; Georgiev, O.; Schaffner, W.: A serine/arginine-rich nuclear matrix cyclophilin interacts with the C-terminal domain of RNA polymerase II. Nucleic Acids Res. 25:2055-2061, 1997.

Schulze, A.; Hansen, C.; Skakkebaek, N. E.; Brondum-Nielsen, K.; Ledbetter, D. H.; Tommerup, N.: Exclusion of SNRPN as a major determinant of Prader-Willi syndrome by a translocation breakpoint. Nature Genet. 12:452-454, 1996.

Schweizer, J.; Zynger, D.; Francke, U.: In vivo nuclease hypersensitivity studies reveal multiple sites of parental origin-dependent differential chromatin conformation in the 150 kb SNRPN transcription unit. Hum. Molec. Genet. 8:555-566, 1999.

Shemer, R.; Hershko, A. Y.; Perk, J.; Mostoslavsky, R.; Tsuberi, B.; Cedar, H.; Buiting, K.; Razin, A.: The imprinting box of the Prader-Willi/Angelman syndrome domain. Nature Genet. 26:440-443,2000.

Sun, Y.; Nicholls, R. D.; Butler, M. G.; Saitoh, S.; Hainline, B. E.; Palmer, C. G.: Breakage in the SNRPN locus in a balanced 46, XY, t (15;19)Prader-Willi syndrome patient. Hum. Molec. Genet. 5:517-524, 1996.

Sutcliffe, J. S.; Nakao, M.; Christian, S.; Orstavik, K. H.; Tommerup, N.; Ledbetter, D. H.; Beaudet, A. L.: Deletions of a differentially methylated CpG island at the SNRPN gene define a putative imprinting control region. Nature Genet. 8:52-58, 1994.

Wirth, J.; Back, E.; Huttenhofer, A.; Nothwang, H.-G.; Lich, C.; Gross, S.; Menzel, C,; Schinzel, A.; Kioschis, P.; Tommerup, N.; Ropers, H.-H.; Horsthemke, B.; Buiting, K.: A translocation breakpoint cluster disrupts the newly defined 3-prime end of the SNURF-SNRPN transcription unit on chromosome 15. Hum. Molec. Genet. 10:201-210, 2001.

Critcher, R.; Stitson, R. N. M.; Wade-Martins, R.; Easty, D. J.; Farr, C. J.: Assignment of Sox4 to mouse chromosome 13 bands A3-A5by fluorescence in situ hybridization; refinement of the human SOX4location to 6p22.3 and of SOX20 to chromosome 17p12.3. Cytogenet. Cell Genet. 81:294-295, 1998.

Denny, P.; Swift, S.; Connor, F.; Ashworth, A.: An SRY-related gene expressed during spermatogenesis in the mouse encodes a sequence-specific DNA-binding protein. EMBO J. 11:3705-3712, 1992.

Farr, C. J.; Easty, D. J.; Ragoussis, J.; Collignon, J.; Lovell-Badge, R.; Goodfellow, P. N.: Characterization and mapping of the human SOX4 gene. Mammalian Genome 4:577-584, 1993.

Hansen, G. M.; Skapura, D.; Justice, M. J.: Genetic profile of insertion mutations in mouse leukemias and lymphomas. Genome Res. 10:237-243, 2000.

Li, J.; et al; et al: Leukaemia disease genes: large-scale cloning and pathway predictions. Nature Genet. 23:348-353, 1999.

Lund, A. H.; Turner, G.; Trubetskoy, A.; Verhoeven, E.; Wientjens, E.; Hulsman, D.; Russell, R.; DePinho, R. A.; Lenz, J.; van Lohuizen, M.: Genome-wide retroviral insertional tagging of genes involved in cancer in Cdkn2a-deficient mice. Nature Genet. 32:160-165, 2002.

Suzuki, T.; Shen, H.; Akagi, K.; Morse, H. C., III; Malley, J. D.; Naiman, D. Q.; Jenkins, N. A.; Copeland, N. G.: New genes involved in cancer identified by retroviral tagging. Nature Genet. 32:166-174,2002. Note: Erratum: Nature Genet. 32:331 only, 2002.

van de Wetering, M.; Oosterwegel, M.; van Norren, K.; Clevers, H.: Sox-4, an Sry-like HMG box protein, is a transcriptional activator is lymphocytes. EMBO J. 12:3847-3854, 1993.

Shoyab, M.; McDonald, V. L.; Bradley, J. G.; Todaro, G. J.: Amphiregulin: a bifunctional growth-modulating glycoprotein produced by the phorbol12-myristate 13-acetate-treated human breast adenocarcinoma cell line MCF-7. Proc. Nat. Acad. Sci. 85:6528-6532, 1988.

Shoyab, M.; Plowman, G. D.; McDonald, V. L.; Bradley, J. G.; Todaro, G. J.: Structure and function of human amphiregulin: a member of the epidermal growth factor family. Science 243:1074-1076, 1989.

Donahue, R. P.; Bias, W. B.; Renwick, J. H.; McKusick, V. A.: Probable assignment of the Duffy blood group locus to chromosome 1in man. Proc. Nat. Acad. Sci. 61:949-955, 1968.

Dracopoli, N. C.; Meisler, M. H.: Mapping the human amylase gene cluster on the proximal short arm of chromosome 1 using a highly informative (CA) n repeat. Genomics 7:97-102, 1990.

Ono, H.; Kuno, Y.; Tanaka, H.; Yamashina, M.; Tsuyoshi, T.; Kondo, N.; Orii, T.: A case of paroxysmal nocturnal hemoglobinuria without deficiency of decay-accelerating factor on erythrocytes. Blood 75:1746-1747, 1990.

Petranka, J. G.; Fleenor, D. E.; Sykes, K.; Kaufman, R. E.; Rosse, W. F.: Structure of the CD59-encoding gene: further evidence of a relationship to murine lymphocyte antigen Ly-6 protein. Proc. Nat. Acad. Sci. 89:7876-7879, 1992.

Rosse, W. F.: Personal Communication. Durham, N. C. Jun. 3, 1993.

Rosse, W. F.; Parker, C. J.: Paroxysmal nocturnal hemoglobinuria. Clin. Haemat. 14:105-125, 1985.

Rother, R. P.; Rollins, S. A.; Mennone, J.; Chodera, A.; Fidel, S. A.; Bessler, M.; Hillmen, P.; Squinto, S. P.: Expression of recombinant transmembrane CD59 in paroxysmal nocturnal hemoglobinuria B cells confers resistance to human complement. Blood 84:2604-2611, 1994.

Tone, M.; Walsh, L. A.; Waldmann, H.: Gene structure of human CD59 and demonstration that discrete mRNAs are generated by alternative polyadenylation. J. Molec. Biol. 227: 971-976, 1992.

Walsh, L. A.; Tone, M.; Thiru, S.; Waldmann, H.: The CD59 antigen--a multifunctional molecule. Tissue Antigens 40:213-220, 1992.

Yamashina, M.; Ueda, E.; Kinoshita, T.; Takami, T.; Ojima, A.; Ono, H.; Tanaka, H.; Kondo, N.; Orii, T.; Okada, N.; Okada, H.; Inoue, K.; Kitani, T.: Inherited complete deficiency of 20-kilodalton homologous restriction factor (CD59) as a cause of paroxysmal nocturnal hemoglobinuria. New Eng. J. Med. 323:1184-1189, 1990.

Cambiaggi, C.; Scupoli, M. T.; Cestari, T.; Gerosa, F.; Carra, G.; Tridente, G.; Accolla, R. S.: Constitutive expression of CD69in interspecies T-cell hybrids and locus assignment to human chromosome 12. Immunogenetics 36:117-120 , 1992.

Lopez-Cabrera, M.; Santis, A. G.; Fernandez-Ruiz, E.; Blacher, R.; Esch, F.; Sanchez-Mateos, P.; Sanchez-Madrid, F.: Molecular cloning, expression, and chromosomal localization of the human earliest lymphocyte activation antigen AIM/CD69, a new member of the C-type animal lectin superfamily of signal-transmitting receptors. J. Exp. Med. 178: 537-547, 1993.

Chandra, T.; Stackhouse, R.; Kidd, V. J.; Robson, K. J. H.; Woo, S. L. C.: Sequence homology between human alpha-1-antichymotrypsin, alpha-1-antitrypsin, and antithrombin III. Biochemistry 22:5055-5061,1983.

Eriksson, S.; Lindmark, B.; Lilia, H.: Familial alpha-1-antichymotrypsin deficiency. Acta Med. Scand. 220:447-453, 1986.

Gilfix, B. M.; Briones, L.: Absence of the A1252G mutation in alpha 1-antichymotrypsin in a North American population suffering from dementia. J. Cereb. Blood Flow Metab. 17:233-235, 1997.

Haines, J. L.; Pritchard, M. L.; Saunders, A. M.; Schildkraut, J. M.; Growdon, J. H.; Gaskell, P. C.; Farrer, L. A.; Auerbach, S. A.; Gusella, J. F.; Locke, P. A.; Rosi, B. L.; Yamaoka, L.; Small, G. W.; Conneally, P. M.; Roses, A. D.; Pericak-Vance, M. A.: No genetic effect of alpha-1-antichymotrypsin in Alzheimer disease. Genomics 33:53-56, 1996.

Haines, J. L.; Scott, W. K.; Pericak-Vance, M. A.: Reply to 'Genetic effect of alpha-1-antichymotrypsin on the risk of Alzheimer disease.'(Letter) Genomics 40:384-385, 1997.

Kamboh, M. I.; Aston, C. E.; Ferrell, R. E.; Dekosky, S. T.: Genetic effect of alpha-1-antichymotrypsin on the risk of Alzheimer disease.(Letter) Genomics 41:382-385, 1997.

Kamboh, M. I.; Sanghera, D. K.; Ferrell, R. E.; DeKosky, S. T.: APOE*4-associated Alzheimer's disease risk is modified by alpha-1-antichymotrypsin polymorphism. Nature Genet. 10:486-488, 1995.

Kelsey, G. D.; Abeliovich, D.; McMahon, C. J.; Whitehouse, D.; Corney, G.; Povey, S.; Hopkinson, D. A.; Wolfe, J.; Mieli-Vergani, G.; Mowat, A. P.: Cloning of the human alpha-1 antichymotrypsin gene and genetic analysis of the gene in relation to alpha-1 antitrypsin deficiency. J. Med. Genet. 25:361-368, 1988.

Morgan, K.; Licastro, F.; Tilley, L.; Ritchie, A.; Morgan, L.; Pedrini, S.; Kalsheker, N.: Polymorphism in the alpha-1-antichymotrypsin (ACT) gene promoter: effect on expression in transfected glial and liver cell lines and plasma ACT concentrations. Hum. Genet. 109:303-310, 2001.

Morgan, K.; Morgan, L.; Carpenter, K.; Lowe, J.; Lam, L.; Cave, S.; Xuereb, J.; Wischik, C.; Harrington, C.; Kalsheker, N. A.: Microsatellite polymorphism of the alpha-1-antichymotrypsin gene locus associated with sporadic Alzheimer's disease. Hum. Genet. 99:27-31, 1997.

Munoz, E.; Obach, V.; Oliva, R.; Marti, M. J.; Ezquerra, M.; Pastor, P.; Ballesta, F.; Tolosa, E.: Alpha-1-antichymotrypsin gene polymorphism and susceptibility to Parkinson's disease. Neurology 52:297-301,1999.

Poller, W.; Faber, J.-P.; Scholz, S.; Weidinger, S.; Bartholome, K.; Olek, K.; Eriksson, S.: Mis-sense mutation of alpha-1-antichymotrypsin gene associated with chronic lung disease. (Letter) Lancet 339:1538, 1992.

Poller, W.; Faber, J.-P.; Weidinger, S.; Tief, K.; Scholz, S.; Fischer, M.; Olek, K.; Kirchgesser, M.; Heidtmann, H.-H.: A leucine-to-proline substitution causes a defective alpha-1-antichymotrypsin allele associated with familial obstructive lung disease. Genomics 17:740-743, 1993.

Rabin, M.; Watson, M.; Breg, W. R.; Kidd, V.; Woo, S. L. C.; Ruddle, F. H.: Human alpha-1-antichymotrypsin and alpha-1-antitrypsin (PI) genes map to the same region on chromosome 14. (Abstract) Cytogenet. Cell Genet. 40:728, 1985.

Rabin, M.; Watson, M.; Kidd, V.; Woo, S. L. C.; Breg, W. R.; Ruddle, F. H.: Regional location of alpha-1-antichymotrypsin and alpha-1-antitrypsin genes on human chromosome 14. Somat. Cell Molec. Genet. 12:209-214,1986.

Han, P.; Fletcher, C. F.; Copeland, N. G.; Jenkins, N. A.; Yaremko, L. M.; Michaeli, T.: Assignment of the mouse Pde7A gene to the proximal region of chromosome 3 and of the human PDE7A gene to chromosome 8q13. Genomics 48:275-276, 1998.

Michaeli, T.; Bloom, T. J.; Martins, T.; Loughney, K.; Ferguson, K.; Riggs, M.; Rodgers, L.; Beavo, J. A.; Wigler, M.: Isolation and characterization of a previously undetected human cAMP phosphodiesterase by complementation of cAMP phosphodiesterase-deficient Saccharomyces cerevisiae. J. Biol. Chem. 268:12925-12932, 1993.

Milatovich, A.; Bolger, G.; Michaeli, T.; Francke, U.: Chromosome localizations of genes for five cAMP-specific phosphodiesterases in man and mouse. Somat. Cell Molec. Genet. 20:75-86, 1994.

Loughney, K.; Martins, T. J.; Harris, E. A. S.; Sadhu, K.; Hicks, J. B.; Sonnenburg, W. K.; Beavo, J. A.; Ferguson, K.: Isolation and characterization of cDNAs corresponding to two human calcium, calmodulin-regulated,3-prime,5-prime-cyclic nucleotide phosphodiesterases. J. Biol. Chem. 271: 796-806, 1996.

Wilson, D. E.; McKenna, L.: Assignment of the human gene for phosphodiesterase1A to chromosome 4. (Abstract) Am. J. Hum. Genet. 43: A162 only,1988.

Ritter, J. K.; Chen, F.; Sheen, Y. Y.; Tran, H. M.; Kimura, S.; Yeatman, M. T.; Owens, I. S.: A novel complex locus UGT1 encodes human bilirubin, phenol, and other UDP-glucuronosyl transferase isozymes with identical carboxyl termini. J. Biol. Chem. 267:3257-3261,1992.

Tukey, R. H.; Strassburg, C. P.: Human UDP-glucuronosyl transferases: metabolism, expression, and disease. Annu. Rev. Pharm. Toxicol. 40:581-616, 2000.

Gloor, S.; Antonicek, H.; Sweadner, K. J.; Pagliusi, S.; Frank, R.; Moos, M.; Schachner, M.: The adhesion molecule on glia (AMOG) is a homologue of the beta subunit of the Na, K-ATPase. J. Cell Biol. 110:165-174, 1990.

Hsieh, C.-L.; Cheng-Deutsch, A.; Gloor, S.; Schachner, M.; Francke, U.: Assignment of Amog (adhesion molecule on glia) gene to mouse chromosome 11 near Zfp-3 and Asgr-1,2 and to human chromosome 17. Somat. Cell Molec. Genet. 16:401-405, 1990.

Malo, D.; Schurr, E.; Levenson, R.; Gros, P.: Assignment of Na, K-ATPase beta-(2)-subunit gene (Atpb-2) to mouse chromosome 11. Genomics 6:697-699, 1990.

Martin-Vasallo, P.; Dackowski, P.; Emanuel, J. R.; Levenson, R.: Identification of a putative isoform of the Na, K-ATPase beta subunit: primary structure and tissue-specific expression. J. Biol. Chem. 164:4613-4618, 1989.

Pagliusi, S.; Antonicek, H.; Gloor, S.; Frank, R.; Moos, M.; Schachner, M.: Identification of a cDNA clone specific for the neural adhesion molecule AMOG. J. Neurosci. Res. 22:113-119, 1989.

Xiong, J.-P.; Stehle, T.; Diefenbach, B.; Zhang, R.; Dunker, R.; Scott, D. L.; Joachimiak, A.; Goodman, S. L.; Arnaout, M. A.: Crystal structure of the extracellular segment of integrin alpha-V-beta-3. Science 294:339-345, 2001.

Xiong, J.-P.; Stehle, T.; Zhang, R.; Joachimiak, A.; Frech, M.; Goodman, S. L.; Arnaout, M. A.: Crystal structure of the extracellular segment of integrin alpha-V-beta-3 in complex with an Arg-Gly-Asp ligand. Science 296:151-155, 2002.

Disteche, C. M.; Plowman, G. D.; Gronwald, R. G. K.; Kelly, J.; Bowen-Pope, D.; Adler, D. A.; Murray, J. C.: Mapping of the amphiregulin and the platelet-growth factor receptor alpha genes to the proximal long arm of chromosome 4. (Abstract) Cytogenet. Cell Genet. 51:990, 1989.

Gronwald, R. G. K.; Adler, D. A.; Kelly, J. D.; Disteche, C. M.; Bowen-Pope, D. F.: The human PDGF receptor alpha-subunit gene maps to chromosome 4 in close proximity to c-kit. Hum. Genet. 85:383-385,1990.

Hol, F. A.; Geurds, M. P. A.; Chatkupt, S.; Shugart, Y. Y.; Balling, R.; Schrander-Stumpel, C. T. R. M.; Johnson, W. G.; Hamel, B. C. J.; Mariman, E. C. M.: PAX genes and human neural tube defects: an amino acid substitution in PAX1 in a patient with spina bifida. J. Med. Genet. 8:655-660, 1996.

Hsieh, C.-L.; Navankasattusas, S.; Escobedo, J. A.; Williams, L. T.; Francke, U.: Chromosomal localization of the gene for AA-type platelet-derived growth factor receptor (PDGFRA) in humans and mice. Cytogenet. Cell Genet. 56:160-163, 1991.

Ikuno, Y.; Kazlauskas, A.: TGF-beta-1-dependent contraction of fibroblasts is mediated by th PDGF-alpha receptor. Invest. Ophthal. Vis. Sci. 43:41-46, 2002.

Joosten, P. H. L. J.; Hol, F. A.; van Beersum, S. E. C.; Peters, H.; Hamel, B. C. J.; Afink, G. B.; van Zoelen, E. J. J.; Mariman, E. C. M.: Altered regulation of platelet-derived growth factor receptor-alpha gene-transcription in vitro by spina bifida-associated mutant Pax1proteins. Proc. Nat. Acad. Sci. 95:14459-14463, 1998.

Kanzaki, T.; Olofsson, A.; Moren, A.; Wernstedt, C.; Hellman, U.; Miyazono, K.; Claesson-Welsh, L.; Heldin, C. H.: TGF-beta 1 binding protein: a component of the large latent complex of TGF-beta 1 with multiple repeat sequences. Cell 61:1051-1061, 1990.

Oklu, R.; Hesketh, R.: The latent transforming growth factor beta binding protein (LTBP) family. Biochem. J. 352:601-610, 2000.

Stenman, G.; Sahlin, P.; Olofsson, A.; Geurts van Kessel, A.; Miyazono, K.: Assignment of the gene encoding the latent TGF-beta-1-binding protein (LTBP1) to human chromosome 2, region p12-q22. Cytogenet. Cell Genet. 66:117-119, 1994.

Brodsky, G. L.; Muntoni, F.; Miocic, S.; Sinagra, G.; Sewry, C.; Mestroni, L.: Lamin A/C gene mutation associated with dilated cardiomyopathy with variable skeletal muscle involvement. Circulation 101:473-476,2000.

Cao, H.; Hegele, R. A.: Nuclear lamin A/C R482Q mutation in Canadian kindreds with Dunnigan-type familial partial lipodystrophy. Hum. Molec. Genet. 9:109-112, 2000.

De Sandre-Giovannoli, A.; Chaouch, M.; Kozlov, S.; Vallat, J.-M.; Tazir, M.; Kassouri, N.; Szepetowski, P.; Hammadouche, T.; Vandenberghe, A.; Stewart, C. L.; Grid, D.; Levy, N.: Homozygous defects in LMNA, encoding lamin A/C nuclear-envelope proteins, cause autosomal recessive axonal neuropathy in human (Charcot-Marie-Tooth disorder type 2) and mouse. Am. J. Hum. Genet. 70:726-736, 2002. Note: Erratum: Am. J. Hum. Genet. 70:1075 only, 2002.

Fatkin, D.; MacRae, C.; Sasaki, T.; Wolff, M. R.; Porcu, M.; Frenneaux, M.; Atherton, J.; Vidaillet, H. J., Jr.; Spudich, S.; De Girolami, U.; Seidman, J. G.; Seidman, C. E.: Missense mutations in the rod domain of the lamin A/C gene as causes of dilated cardiomyopathy and conduction-system disease. New Eng. J. Med. 341:1715-1724, 1999.

Fisher, D. Z.; Chaudhary, N.; Blobel, G.: cDNA sequencing of nuclear lamins A and C reveals primary and secondary structural homology to intermediate filament proteins. Proc. Nat. Acad. Sci. 83:6450-6454,1986.

Flier, J. S.: Pushing the envelope on lipodystrophy. Nature Genet. 24:103-104, 2000.

Garg, A.; Vinaitheerthan, M.; Weatherall, P. T.; Bowcock, A. M.: Phenotypic heterogeneity in patients with familial partial lipodystrophy (Dunnigan variety) related to the site of missense mutations in lamin A/C gene. J. Clin. Endocr. Metab. 86:59-65, 2001.

Genschel, J.; Schmidt, H. H.-J.: Mutations in the LMNA gene encoding lamin A/C. Hum. Mutat. 16:451-459, 2000.

Guilly, M. N.; Bensussan, A.; Bourge, J. F.; Bornens, M.; Courvalin, J. C.: A human T lymphoblastic cell line lacks lamins A and C. EMBO J. 6:3795-3799, 1987.

Hegele, R. A.; Cao, H.; Harris, S. B.; Zinman, B.; Hanley, A. J.; Anderson, C. M.: Genetic variation in LMNA modulates plasma leptin and indices of obesity in aboriginal Canadians. Physiol. Genomics 3:39-44, 2000.

Hegele, R. A.; Cao, H.; Huff, M. W.; Anderson, C. M.: LMNA R482Q mutation in partial lipodystrophy associated with reduced plasma leptin concentration. J. Clin. Endocr. Metab. 85:3089-3093, 2000.

Hegele, R. A.; Huff, M. W.; Young, T. K.: Common genomic variation in LMNA modulates indexes of obesity in Inuit. J. Clin. Endocr. Metab. 86:2747-2751, 2001.

Krohne, G.; Benavente, R.: The nuclear lamins: a multi-gene family of proteins in evolution and differentiation. Exp. Cell Res. 162:1-10, 1986.

Lebel, S.; Raymond, Y.: Lamin A is not synthesized as a larger precursor polypeptide. Biochem. Biophys. Res. Commun. 149:417-423,1987.

Lin, F.; Worman, H. J.: Structural organization of the human gene encoding nuclear lamin A and nuclear lamin C. J. Biol. Chem. 268:16321-16326, 1993.

Lloyd, D. J.; Trembath, R. C.; Shackleton, S.: A novel interaction between lamin A and SREBP1: implications for partial lipodystrophy and other laminopathies. Hum. Molec. Genet. 11:769-777, 2002.

McKeon, F. D.; Kirschner, M. W.; Caput, D.: Homologies in both primary and secondary structure between nuclear envelope and intermediate filament proteins. Nature 319:463-468, 1986.

Muchir, A.; Bonne, G.; van der Kooi, A. J.; van Meegen, M.; Baas, F.; Bolhuis, P. A.; de Visser, M.; Schwartz, K.: Identification of mutations in the gene encoding lamins A/C in autosomal dominant limb girdle muscular dystrophy with atrioventricular conduction disturbances (LGMD1B). Hum. Molec. Genet. 9:1453-1459, 2000.

Novelli, G.; Muchir, A.; Sangiuolo, F.; Helbling-Leclerc, A.; D'Apice, M. R.; Massart, C.; Capon, F.; Sbraccia, P.; Federici, M.; Lauro, R.; Tudisco, C.; Pallotta, R.; Scarano, G.; Dallapiccola, B.; Merlini, L.; Bonne, G.: Mandibuloacral dysplasia is caused by a mutation in LMNA-encoding lamin A/C. Am. J. Hum. Genet. 71:426-431, 2002.

Raffaele di Barletta, M.; Ricci, E.; Galluzzi, G.; Tonali, P.; Mora, M.; Morandi, L.; Romorini, A.; Voit, T.; Orstavik, K. H.; Merlini, L.; Trevisan, C.; Biancalana, V.; Housmanowa-Petrusewicz, I.; Bione, S.; Ricotti, R.; Schwartz, K.; Bonne, G.; Toniolo, D.: Different mutations in the LMNA gene cause autosomal dominant and autosomal recessive Emery-Dreifuss muscular dystrophy. Am. J. Hum. Genet. 66:1407-1412, 2000.

Schmidt, H. H.-J.; Genschel, J.; Baier, P.; Schmidt, M.; Ockenga, J.; Tietge, U. J. F.; Propsting, M.; Buttner, C.; Manns, M. P.; Lochs, H.; Brabant, G.: Dyslipemia in familial partial lipodystrophy caused by and R482W mutation in the LMNA gene. J. Clin. Endocr. Metab. 86:2289-2295, 2001.

Shackleton, S.; Lloyd, D. J.; Jackson, S. N. J.; Evans, R.; Niermeijer, M. F.; Singh, B. M.; Schmidt, H.; Brabant, G.; Kumar, S.; Durrington, P. N.; Gregory, S.; O'Rahilly, S.; Trembath, R. C.: LMNA, encoding lamin A/C, is mutated in partial lipodystrophy. Nature Genet. 24:153-156, 2000.

Wydner, K. L.; McNeil, J. A.; Lin, F.; Worman, H. J.; Lawrence, J. B.: Chromosomal assignment of human nuclear envelope protein genes LMNA, LMNB1, and LBR by fluorescence in situ hybridization. Genomics 32:474-478, 1996.

Garbarz, M.; Devaux, I.; Bournier, O.; Grandchamp, B.; Dhermy, D.: Protein 4.1 Lille, a novel mutation in the downstream initiation codon of protein 4.1 gene associated with heterozygous 4,1(-) hereditary elliptocytosis. Hum. Mutat. 5:339-340, 1995.

Garbarz, M.; Dhermy, D.; Lecomte, M. C.; Feo, C.; Chaveroche, I.; Galand, C.; Bournier, O.; Bertrand, O.; Boivin, P.: A variant of erythrocyte membrane skeletal protein band 4.1 associated with hereditary elliptocytosis. Blood 64:1006-1015, 1984.

Geerdink, R. A.; Nijenhuis, L. E.; Huizinga, J.: Hereditary elliptocytosis: linkage data in man. Ann. Hum. Genet. 30:363-378, 1967.

Jensson, O.; Jonasson, T.; Olafsson, O.: Hereditary elliptocytosis in Iceland. Brit. J. Haemat. 13:844-854, 1967.

Kan, Y.-W.: Personal Communication. San Francisco, Calif. Feb. 28, 1986.

Kuroda, S.; Takeuchi, T.; Nagamori, H.: Data on the linkage between elliptocytosis and Rh blood type. Jpn. J. Hum. Genet. 5:112-118,1960.

Lambert, S.; Conboy, J.; Zail, S.: A molecular study of heterozygous protein 4.1 deficiency in hereditary elliptocytosis. Blood 72:1926-1929,1988.

Lambert, S.; Zail, S.: Partial deficiency of protein 4.1 in hereditary elliptocytosis. Am. J. Hemat. 26:263-272, 1987.

Lipton, E. L.: Elliptocytosis with hemolytic anemia: the effects of splenectomy. Pediatrics 15:67-82, 1955.

Lux, S. E.; Wolfe, L. C.: Inherited disorders of the red cell membrane skeleton. Pediat. Clin. N. Am. 27:463-486, 1980.

Marchesi, S. L.; Conboy, J.; Agre, P.; Letsinger, J. T.; Marchesi, V. T.; Speicher, D. W.; Mohandas, N.: Molecular analysis of insertion/deletion mutations in protein 4.1 in elliptocytosis. I. Biochemical identification of rearrangements in the spectrin/actin binding domain and functional characterizations. J. Clin. Invest. 86:516-523, 1990.

McGuire, M.; Agre, P.: Three distinct variants of protein 4.1in Caucasian hereditary elliptocytosis. (Abstract) Clin. Res. 35:428A, 1987.

McGuire, M.; Smith, B. L.; Agre, P.: Distinct variants of erythrocyte protein 4.1 inherited in linkage with elliptocytosis and Rh type in three white families. Blood 72:287-293, 1988.

Morle, L.; Garbarz, M.; Alloisio, N.; Girot, R.; Chaveroche, I.; Boivin, P.; Delaunay, J.: The characterization of protein 4.1 Presles, a shortened variant of RBC membrane protein 4.1. Blood 65:1511-1517,1985.

Morle, L.; Pothier, B.; Alloisio, N.; Ducluzeau, M.-T.; Marques, S.; Olim, G.; Martins e Silva, J.; Feo, C.; Garbarz, M.; Chaveroche, I.; Boivin, P.; Delaunay, J.: Red cell membrane alteration involving protein 4.1 and protein 3 in a case of recessively inherited haemolytic anemia. Europ. J. Haemat. 38:447-455, 1987.

Morton, N. E.: The detection and estimation of linkage between the genes for elliptocytosis and the Rh blood type. Am. J. Hum. Genet. 8:80-96, 1956.

Nielsen, J. A.; Strunk, K. W.: Homozygous hereditary elliptocytosis as the cause of haemolytic anemia in infancy. Scand. J. Haemat. 5:486-496, 1968.

Parra, M.; Gascard, P.; Walensky, L. D.; Snyder, S. H.; Mohandas, N.; Conboy, J. G.: Cloning and characterization of 4.1G (EPB41L2), a new member of the skeletal protein 4.1 (EPB41) gene family. Genomics 49:298-306, 1998.

Peters, J. C.; Rowland, M.; Israels, L. G.; Zipursky, A.: Erythrocyte sodium transport in hereditary elliptocytosis. Canad. J. Physiol. Pharm. 44:817-827, 1966.

Roberts, J. A. F.: Genetic linkage in man, with particular reference to the usefulness of very small bodies of data. Quart. J. Med. 14:27-33, 1945.

Shi, Z.-T.; Afzal, V.; Coller, B.; Patel, D.; Chasis, J. A.; Parra, M.; Lee, G.; Paszty, C.; Stevens, M.; Walensky, L.; Peters, L. L.; Mohandas, N.; Rubin, E.; Conboy, J. G.: Protein 4.1R-deficient mice are viable but have erythroid membrane skeleton abnormalities. J. Clin. Invest. 103:331-340, 1999.

Takakuwa, Y.; Tchernia, G.; Rossi, M.; Benabadji, M.; Mohandas, N.: Restoration of normal membrane stability to unstable protein 4.1-deficient erythrocyte membranes by incorporation of purified protein 4.1. J. Clin. Invest. 78:80-85, 1986.

Tang, C.-J. C.; Tang, T. K.: Rapid localization of membrane skeletal protein 4.1 (EL1) to human chromosome 1p33-p34.2 by nonradioactive in situ hybridization. Cytogenet. Cell Genet. 57:119, 1991.

Tang, T. K.; Leto, T. L.; Correas, I.; Alonso, M. A.; Marchesi, V. T.; Benz, E. J., Jr.: Selective expression of an erythroid-specific isoform of protein 4.1. Proc. Nat. Acad. Sci. 85:3713-3717, 1988.

Tchernia, G.; Mohandas, N.; Shohet, S. B.: Deficiency of skeletal membrane protein band 4.1 in homozygous hereditary elliptocytosis: implications for erythrocyte membrane stability. J. Clin. Invest. 68:454-460, 1981.

Tomaselli, M. B.; John, K. M.; Lux, S. E.: Elliptical erythrocyte membrane skeletons and heat-sensitive spectrin in hereditary elliptocytosis. Proc. Nat. Acad. Sci. 78:1911-1915, 1981.

Cohen, A. J.; Li, F. P.; Berg, S.; Marchetto, D. J.; Tsai, S.; Jacobs, S. C.; Brown, R. S.: Hereditary renal-cell carcinoma associated with chromosomal translocation. New Eng. J. Med. 301:592-595, 1979.

Gemmill, R. M.; West, J. D.; Boldog, F.; Tanaka, N.; Robinson, L. J.; Smith, D. I.; Li, F.; Drabkin, H. A.: The hereditary renal cell carcinoma 3;8 translocation fuses FHIT to a patched-related gene, TRC8. Proc. Nat. Acad. Sci. 95:9572-9577, 1998.

Nakano, A.; Pulkkinen, L.; Murrell, D.; Rico, J.; Lucky, A. W.; Garzon, M.; Stevens, C. A.; Robertson, S.; Pfendner, E.; Uitto, J.: Epidermolysis bullosa with congenital pyloric atresia: novel mutations in the beta-4 integrin gene (ITGB4) and genotype/phenotype correlations. Pediat. Res. 49:618-626, 2001.

Pulkkinen, L.; Bruckner-Tuderman, L.; August, C.; Uitto, J.: Compound heterozygosity for missense mutation (L156P) and nonsense (R554X) mutations in the beta-4 integrin gene (ITGB4) underlies mild, nonlethal phenotype of epidermolysis bullosa with pyloric atresia. Am. J. Path. 152:935-941, 1998.

Pulkkinen, L.; Rouan, F.; Bruckner-Tuderman, L.; Wallerstein, R.; Garzon, M.; Brown, T.; Smith, L.; Carter, W.; Uitto, J.: Novel ITGB4mutations in lethal and nonlethal variants of epidermolysis bullosa with pyloric atresia: missense versus nonsense. Am. J. Hum. Genet. 63:1376-1387, 1998.

Shaw, L. M.; Rabinovitz, I.; Wang, H. H.-F.; Toker, A., Mercurio, A. M.: Activation of phosphoinositide 3-OH kinase by the alpha-6/beta-4integrin promotes carcinoma invasion. Cell 91:949-960, 1997.

Suzuki, S.; Naitoh, Y.: Amino acid sequence of a novel integrin beta-4 subunit and primary expression of the mRNA in epithelial cells. EMBO J. 9:757-763, 1990.

Vidal, F.; Aberdam, D.; Miquel, C.; Christiano, A. M.; Pulkkinen, L.; Uitto, J.; Ortonne, J.-P.; Meneguzzi, G.: Integrin beta-4 mutations associated with junctional epidermolysis bullosa with pyloric atresia. Nature Genet. 10:229-234, 1995.

Chany, C.; Vignal, M.; Couillin, P.; Van Cong, N.; Boue, J.; Boue, A.: Chromosomal localization of human genes governing the interferon-induced antiviral state. Proc. Nat. Acad. Sci. 72:3129-3133, 1975.

Aplin, H. M.; Hirst, K. L.; Crosby, A. H.; Dixon, M. J.: mapping of the human dentin matrix acidic phosphoprotein gene (DMP1) to the dentinogenesis imperfecta type II critical region at chromosome 4q21. Genomics 30:347-349, 1995.

Ho, A. S. Y.; Liu, Y.; Khan, T. A.; Hsu, D.-H.; Bazan, J. F.; Moore, K. W.: A receptor for interleukin 10 is related to interferon receptors. Proc. Nat. Acad. Sci. 90:11267-11271, 1993.

Liu, Y.; Wei, S. H.-Y.; Ho, A. S.-Y.; de Waal Malefyt, R.; Moore, K. W.: Expression cloning and characterization of a human Il-10 receptor. J. Immun. 152:1821-1829, 1994.

Blixt, A.; Mahlapuu, M.; Aitola, M.; Pelto-Huikko, M.; Enerback, S.; Carlsson, P.: A forkhead gene, FoxE3, is essential for lens epithelial proliferation and closure of the lens vesicle. Genes Dev. 14:245-254,2000.

Semina, E. V.; Brownell, I.; Mintz-Hittner, H. A.; Murray, J. C.; Jamrich, M.: Mutations in the human forkhead transcription factor FOXE3 associated with anterior segment ocular dysgenesis and cataracts. Hum. Molec. Genet. 10:231-236, 2001.

Siegelmann-Danieli, N.; Buetow, K. H.: Constitutional genetic variation at the human aromatase gene (Cyp19) and breast cancer risk. Brit. J. Cancer 79:456-463, 1999.

Simpson, E. R.; Michael, M. D.; Agarwal, V. R.; Hinshelwood, M. M.; Bulun, S. E.; Zhao, Y.: Expression of the CYP19 (aromatase) gene: an unusual case of alternative promoter usage. FASEB J. 11:29-36,1997.

Sparkes, R. S.; Mohandas, T.; Chen, S.; Besman, M. J.; Zollman, S.; Shively, J. E.: Assignment of the aromatase gene to human chromosome 15q21. (Abstract) Cytogenet. Cell Genet. 46:696-697, 1987.

Toda, K.; Merashima, M.; Kawamoto, T.; Sumimoto, H.; Yokoyama, Y.; Kuribayashi, I.; Mitsuuchi, Y.; Maeda, T.; Yamamoto, Y.; Sagara, Y.; Ikeda, H.; Shizuta, Y.: Structural and functional characterization of human aromatase P-450 gene. Europ. J. Biochem. 193:559-565,1990.

Wang, Z. J.; Jeffs, B.; Ito, M.; Achermann, J. C.; Yu, R. N.; Hales, D. B.; Jameson, J. L.: Aromatase (Cyp19) expression is up-regulated by targeted disruption of Dax1. Proc. Nat. Acad. Sci. 98:7988-7993,2001.

Whitlock, J. P., Jr.: The regulation of cytochrome P-450 gene expression. Annu. Rev. Pharm. Toxicol. 26:333-369, 1986.

Zhou, D.; Pompon, D.; Chen, S.: Structure-function studies of human aromatase by site-directed mutagenesis: kinetic properties of mutants pro308-to-phe, tyr361-to-phe, tyr361-to-leu, and phe406-to-arg. Proc. Nat. Acad. Sci. 88:410-414, 1991.

Luttrell, L. M.; Ferguson, S. S. G.; Daaka, Y.; Miller, W. E.; Maudsley, S.; Della Rocca, G. J.; Lin, F.-T.; Kawakatsu, H.; Owada, K.; Luttrell, D. K.; Caron, M. G.; Lefkowitz, R. J.: Beta-arrestin-dependent formation of beta-2 adrenergic receptor-Src protein kinase complexes. Science 283:655-661, 1999.

McDonald, P. H.; Chow, C.-W.; Miller, W. E.; Laporte, S. A.; Field, M. E.; Lin, F.-T.; Davis, R. J.; Lefkowitz, R. J.: Beta-arrestin2: a receptor-regulated MAPK scaffold for the activation of JNK3. Science 290:1574-1577, 2000.

Carrington, M.; Kissner, T.; Gerrard, B.; Ivanov, S.; O'Brien, S. J.; Dean, M.: Novel alleles of the chemokine-receptor gene CCR5. Am. J. Hum. Genet. 61:1261-1267, 1997.

Chaganti, R. S. K.: Personal Communication. New York, N. Y. Oct. 22, 1993.

Chaudhuri, A.; Polyakova, J.; Zbrzezna, V .; Pogo, A. O.: The coding sequence of Duffy blood group gene in human S and simians: restriction fragment length polymorphism, antibody and malarial parasite specificities, and expression in nonerythroid tissues in Duffy-negative individuals. Blood 85:615-621, 1995.

Chaudhuri, A.; Polyakova, J.; Zbrzezna, V.; Williams, K.; Gulati, S.; Pogo, A. O.: Cloning of glycoprotein D cDNA, which encodes the major subunit of the Duffy blood group system and the receptor for the Plasmodium vivax malaria parasite. Proc. Nat. Acad. Sci. 90:10793-10797, 1993.

Cook, P. J. L.; Page, B. M.; Johnston, A. W.; Stanford, W. K.; Gavin, J.: Four further families informative for 1q and the Duffy blood group. Cytogenet. Cell Genet. 22:378-380, 1978.

Cook, P. J. L.; Robson, E. B.; Buckton, K. E.; Jacobs, P. A.; Polani, P. E.: Segregation of genetic markers in families with chromosome polymorphisms and structural rearrangements involving chromosome no.1. Ann. Hum. Genet. 37:261-274, 1974.

Crawford, M. N.; Punnett, H. H.; Carpenter, G. G.: Deletion of the long arm of chromosome 16 and an unexpected Duffy blood group phenotype reveal a possible autosomal linkage. Nature 215:1075-1076,1967.

Gelpi, A. P.; King, M. C.: Association of Duffy blood groups with the sickle cell trait. Hum. Genet. 32:65-68, 1976.

Hadley, T. J.; David, P. H.; McGinniss, M. H.; Miller, L. H.: Identification of an erythrocyte component carrying the Duffy blood group Fy-a antigen. Science 223:597-599, 1984.

Hadley, T. J.; Peiper, S. C.: From malaria to chemokine receptor: the emerging physiologic role of the Duffy blood group antigen. Blood 89:3077-3091, 1997.

Hamblin, M. T.; Di Rienzo, A.: Detection of the signature of natural selection in humans: evidence from the Duffy blood group locus. Am. J. Hum. Genet. 66:1669-1679, 2000.

Hamblin, M. T.; Thompson, E. E.; Di Rienzo, A.: Complex signatures of natural selection at the Duffy blood group locus. Am. J. Hum. Genet. 70:369-383, 2002.

Hessner, M. J.; Pircon, R. A.; Johnson, S. T.; Luhm, R. A.: Prenatal genotyping of the Duffy blood group system by allele-specific polymerase chain reaction. Prenatal Diag. 19:41-45, 1999.

Horuk, R.; Chitnis, C. E.; Darbonne, W. C.; Colby, T. J.; Rybicki, A.; Hadley, T. J.; Miller, L. H.: A receptor for the malarial parasite Plasmodium vivax: the erythrocyte chemokine receptor. Science 261:1182-1184, 1993.

Howard, P. N.; Stoddard, G. R.; Goddard, M. W.; Seely, J. R.: Giemsa banding of chromosome 1qh+ and linkage analysis. J. Med. Genet. 12:44-48, 1975.

Iwamoto, S.; Li, J.; Sugimoto, N.; Okuda, H.; Kajii, E.: characterization of the Duffy gene promoter: evidence for tissue-specific abolishment of expression in Fy (a-b-) of black individuals. Biochem. Biophys. Res. Commun. 222:852-859, 1996.

Lautenberger, J. A.; Stephens, J. C.; O'Brien, S. J.; Smith, M. W.: Significant admixture linkage disequilibrium across 30 cM around the FY locus in African Americans. Am. J. Hum. Genet. 66:969-978,2000.

Lee, C. S. N.; Ying, K. L.; Bowen, P.: Position of the Duffy locus on chromosome 1 in relation to breakpoints for structural rearrangements. Am. J. Hum. Genet. 26:93-102, 1974.

Li, J.; Iwamoto, S.; Sugimoto, N.; Okuda, H.; Kajii, E.: Dinucleotide repeat in the 3-prime flanking region provides a clue to the molecular evolution of the Duffy gene. Hum. Genet. 99:573-577, 1997.

Braun, A.; Kammerer, S.; Bohme, E.; Muller, B.; Roscher, A. A.: Identification of polymorphic sites of the human bradykinin B(2) receptor gene. Biochem. Biophys. Res. Commun. 211:234-240, 1995.

Erdmann, J.; Hegemann, N.; Weidemann, A.; Kallisch, H.; Hummel, M.; Hetzer, R.; Fleck, E.; Regitz-Zagrosek, V.: Screening the human bradykinin B2 receptor gene in patients with cardiovascular diseases: identification of a functional mutation in the promoter and a new coding variant (T21M). Am. J. Med. Genet. 80:521-525, 1998.

Hess, J. F.; Borkowski, J. A.; Young, G. S.; Strader, C. D.; Ransom, R. W.: Cloning and pharmacological characterization of a human bradykinin (BK-2) receptor. Biochem. Biophys. Res. Commun. 184:260-268, 1992.

Kammerer, S.; Braun, A.; Arnold, N.; Roscher, A. A.: The human bradykinin B(2) receptor gene: full length cDNA, genomic organization and identification of the regulatory region. Biochem. Biophys. Res. Commun. 211:226-233, 1995.

Ma, J.; Wang, D.; Ward, D. C.; Chen, L.; Dessai, T.; Chao, J.; Chao, L.: Structure and chromosomal localization of the gene (BDKRB2) encoding human bradykinin B2 receptor. Genomics 23:362-369, 1994.

Powell, S. J.; Slynn, G.; Thomas, C.; Hopkins, B.; Briggs, I.; Graham, A.: Human bradykinin B2 receptor: nucleotide sequence analysis and assignment to chromosome 14. Genomics 15:435-438, 1993.

Taketo, M.; Yokoyama, S.; Rochelle, J.; Kimura, S.; Higashida, H.; Taketo, M.; Seldin, M. F.: Mouse B2 bradykinin receptor gene maps to distal chromosome 12. Genomics 27:222-223, 1995.

Lu, Q.; Sun, E. E.; Klein, R. S.; Flanagan, J. G.: Ephrin-B reverse signaling is mediated by a novel PDZ-RGS protein and selectively inhibits G protein-coupled chemoattraction. Cell 105:69-79, 2001.

Masi, L.; Becherini, L.; Colli, E.; Gennari, L.; Mansani, R.; Falchetti, A.; Becorpi, A. M.; Cepollaro, C.; Gonnelli, S.; Tanini, A.; Brandi, M. L.: Polymorphisms of the calcitonin receptor gene are associated with bone mineral density in postmenopausal Italian women. Biochem. Biophys. Res. Commun. 248:190-195, 1998.

Masi, L.; Becherini, L.; Gennari, L.; Colli, E.; Mansani, R.; Falchetti, A.; Cepollaro, C.; Gonnelli, S.; Tanini, A.; Brandi, M. L.: Allelic variants of human calcitonin receptor: distribution and association with bone mass in postmenopausal Italian women. Biochem. Biophys. Res. Commun. 245:622-626, 1998.

Nakamura, M.; Zhang, Z. Q.; Shan, L.; Hisa, T.; Sasaki, M.; Tsukino, R.; Yokoi, T.; Kaname, A.; Kakudo, K.: Allelic variants of human calcitonin receptor in the Japanese population. Hum. Genet. 99:38-41, 1997.

Perez Jurado, L. A.; Li, X.; Francke, U.: The human calcitonin receptor gene (CALCR) at 7q21.3 is outside the deletion associated with the Williams syndrome. Cytogenet. Cell Genet. 70:246-249,1995.

Taboulet, J.; Frendo, J. L.; Delage-Murroux, R.; Pichaud, F.; deVernejoul, M. C.; Jullienne, A.: Evidence for 2 allelic forms of calcitonin receptor gene: distribution in normal and osteoporotic women. (Abstract) J. Bone Miner. Res. 11 (suppl. 1): S204, 1996.

Taboulet, J.; Frenkian, M.; Frendo, J. L.; Feingold, N.; Jullienne, A.; de Vernejoul, M. C.: Calcitonin receptor polymorphism is associated with a decreased fracture risk in postmenopausal women. Hum. Molec. Genet. 7:2129-2133, 1998.

Ohno, S.; Minoshima, S.; Kudoh, J.; Fukuyama, R.; Ohmi-Imajoh, S.; Suzuki, K.; Shimizu, Y.; Shimizu, N.: Four genes for the calpain family locate on four distinct human chromosomes. (Abstract) Cytogenet. Cell Genet. 51:1054-1055, 1989.

Ohno, S.; Minoshima, S.; Kudoh, J.; Fukuyama, R.; Shimizu, Y.; Ohmi-Imajoh, S.; Shimizu, N.; Suzuki, K.: Four genes for the calpain family locate on four distinct human chromosomes. Cytogenet. Cell Genet. 53:225-229, 1990.

Berchtold, M. W.; Egli, R.; Rhyner, J. A.; Hameister, H.; Strehler, E. E.: Localization of the human bona fide calmodulin genes CALM1, CALM2, and CALM3 to chromosomes 14q24-q31, 2p21.1-p21.3, and 19q13.2-q13.3. Genomics 16:461-465, 1993.

Chin, D.; Winkler, K. E.; Means, A. R.: Characterization of substrate phosphorylation and use of calmodulin mutants to address implications from the enzyme crystal structure of calmodulin-dependent protein kinase I. J. Biol. Chem. 272: 31235-31240, 1997.

Drum, C. L.; Yan, S.-Z.; Bard, J.; Shen, Y.-Q.; Lu, D.; Soelaiman, S.; Grabarek, Z.; Bohm, A.; Tang, W.-J.: Structural basis for the activation of anthrax adenylyl cyclase exotoxin by calmodulin. Nature 415:396-402, 2002.

Koller, M.; Schnyder, B.; Strehler, E. E.: Structural organization of the human CaMIII calmodulin gene. Biochim. Biophys. Acta 1087:180-189, 1990.

Kretsinger, R. H.; Rudnick, S. E.; Weissman, L. J.: Crystal structure of calmodulin. J. Inorganic Biochem. 28:289-302, 1986.

McPherson, J. D.; Hickie, R. A.; Wasmuth, J. J.; Meyskens, F. L.; Perham, R. N.; Strehler, E. E.; Graham, M. T.: Chromosomal localization of multiple genes encoding calmodulin. (Abstract) Cytogenet. Cell Genet. 58:1951 only, 1991.

Pegues, J. C.; Friedberg, F.: Multiple mRNAs encoding human calmodulin. Biochem. Biophys. Res. Commun. 172: 1145-1149, 1990.

Rhyner, J. A.; Ottiger, M.; Wicki, R.; Greenwood, T. M.; Strehler, E. E.: Structure of the human CALM1 calmodulin gene and identification of two CALM1-related pseudogenes CALM1P1 and CALM1P2. Europ. J. Biochem. 225:71-82, 1994.

Scambler, P. J.; McPherson, M. A.; Bates, G.; Bradbury, N. A.; Dormer, R. L.; Williamson, R.: Biochemical and genetic exclusion of calmodulin as the site of the basic defect in cystic fibrosis. Hum. Genet. 76:278-282, 1987.

Schumacher, M. A.; Rivard, A. F.; Bachinger, H. P.; Adelman, J. P.: Structure of the gating domain of a Ca (2+)-activated K+ channel complexed with Ca (2+)/calmodulin. Nature 410:1120-1124, 2001.

Sen Gupta, B.; Detera-Wadleigh, S. D.; McBride, O. W.; Friedberg, F.: A calmodulin pseudogene on human chromosome 17. Nucleic Acids Res. 17:2868 only, 1989.

Loughlin, J.; Irven, C.; Sykes, B.: Exclusion of the cartilage link protein and the cartilage matrix protein genes as the mutant loci in several heritable chondrodysplasias. Hum. Genet. 94:698-700,1994.

Osborne-Lawrence, S. L.; Sinclair, A. K.; Hicks, R. C.; Lacey, S. W.; Eddy, R. L., Jr.; Byers, M. G.; Shows, T. B.; Duby, A. D.: Complete amino acid sequence of human cartilage link protein (CRTL1) deduced from cDNA clones and chromosomal assignment of the gene. Genomics 8:562-567, 1990.

Watanabe, H.; Yamada, Y.: Mice lacking link protein develop dwarfism and craniofacial abnormalities. Nature Genet. 21:225-229, 1999.

Deak, F.; Piecha, D.; Bachrati, C.; Paulsson, M.; Kiss, I.: Primary structure and expression of matrilin-2, the closest relative of cartilage matrix protein within the von Willebrand factor type A-like module superfamily. J. Biol. Chem. 272: 9268-9274, 1997.

Deak, F.; Wagener, R.; Kiss, I.; Paulsson, M.: The matrilins: a novel family of oligomeric extracellular matrix proteins. Matrix Biol. 18:55-64, 1999.

Hansson, A.-S.; Heinegard, D.; Holmdahl, R.: A new animal model for relapsing polychondritis, induced by cartilage matrix protein (matrilin-1). J. Clin. Invest. 104:589-598, 1999.

Jenkins, R. N.; Osborne-Lawrence, S. L.; Sinclair, A. K.; Eddy, R. L., Jr.; Byers, M. G.; Shows, T. B.; Duby, A. D.:

Structure and chromosomal location of the human gene encoding cartilage matrix protein. J. Biol. Chem. 265:19624-19631, 1990.

Lang, B.; Rothenfusser, A.; Lanchbury, J. S.; Rauh, G.; Breedveld, F. C.; Urlacher, A.; Albert, E. D.; Peter, H.-H.; Melchers, I.: Susceptibility to relapsing polychondritis is associated with HLA-DR4. Arthritis Rheum. 36:660-664, 1993.

Muratoglu, S.; Krysan, K.; Balazs, M.; Sheng, H.; Zakany, R.; Modis, L.; Kiss, I.; Deak, F.: Primary structure of human matrilin-2, chromosome location of the MATN2 gene and conservation of an AT-AC intron in matrilin genes. Cytogenet. Cell Genet. 90:323-327, 2000.

Wagener, R.; Kobbe, B.; Paulsson, M.: Primary structure of matrilin-3, a new member of a family of extracellular matrix proteins related to cartilage matrix protein (matrilin-1) and von Willebrand factor. FEBS Lett. 413:129-134, 1997.

Zeuner, M.; Straub, R. H.; Rauh, G.; Albert, E. D.; Scholmerich, J.; Lang, B.: Relapsing polychondritis: clinical and immunogenetic analysis of 62 patients. J. Rheum. 24:96-101, 1997.

Boldyreff, B.; Klett, C.; Gottert, E.; Geurts van Kessel, A.; Hameister, H.; Issinger, O.-G.: Assignment of casein kinase 2 alpha sequences to two different human chromosomes. Hum. Genet. 89:79-82, 1992.

Doray, B.; Ghosh, P.; Griffith, J.; Geuze, H. J.; Kornfeld, S.: Cooperation of GGAs and AP-1 in packaging MPRs at the trans-Golginet work. Science 297:1700-1703, 2002.

Meisner, H.; Heller-Harrison, R.; Buxton, J.; Czech, M. P.: molecular cloning of the human casein kinase II alpha subunit. Biochemistry 28:4072-4076, 1989.

Wirkner, U.; Voss, H.; Lichter, P.; Ansorge, W.; Pyerin, W.: The human gene (CSNK2A1) coding for the casein kinase II subunit alpha is located on chromosome 20 and contains tandemly arranged Alu repeats. Genomics 19:257-265, 1994.

Wirkner, U.; Voss, H.; Lichter, P.; Weitz, S.; Ansorge, W.; Pyerin, W.: Human casein kinase II subunit alpha: sequence of a processed (pseudo) gene and its localization on chromosome 11. Biochim. Biophys. Acta 1131:220-222, 1992.

Yang-Feng, T. L.; Zheng, K.; Kopatz, I.; Naiman, T.; Canaani, D.: Mapping of the human casein kinase II catalytic subunit genes: two loci carrying the homologous sequences for the alpha subunit. Nucleic Acids Res. 19:7125-7129, 1991.

Lozeman, F. J.; Litchfield, D. W.; Piening, C.; Takio, K.; Walsh, K. A.; Krebs, E. G.: Isolation and characterization of human cDNA clones encoding the alpha and the alpha-prime subunits of casein kinase II. Biochemistry 29:8436-8447, 1990.

Xu, X.; Toselli, P. A.; Russell, L. D.; Seldin, D. C.: Globozoospermia in mice lacking the casein kinase II alpha-prime catalytic subunit. Nature Genet. 23:118-121, 1999.

Abbott, C.; Piaggio, G.; Ammendola, R.; Solomon, E.; Povey, S.; Gounari, F.; De Simone, V.; Cortese, R.: Mapping of the gene TCF2 for the transcription factor LFB3 to human chromosome 17 by polymerase chain reaction. Genomics 8:165-167, 1990.

Bach, I.; Mattei, M.-G.; Cereghini, S.; Yaniv, M.: Two members of an HNF1 homeoprotein family are expressed in human liver. Nucleic Acids Res. 19:3553-3559, 1991.

Bingham, C.; Ellard, S.; Allen, L.; Bulman, M.; Shepherd, M.; Frayling, T.; Berry, P. J.; Clark, P. M.; Lindner, T.; Bell, G. I.; Ryffel, G. U.; Nicholls, A. J.; Hattersley, A. T.: Abnormal nephron development associated with a frameshift mutation in the transcription factor hepatocyte nuclear factor-1-beta. Kidney Int. 57:898-907, 2000.

Horikawa, Y.; Iwasaki, N.; Hara, M.; Furuta, H.; Hinokio, Y.; Cockburn, B. N.; Lindner, T.; Yamagata, K.; Ogata, M.; Tomonaga, O.; Kuroki, H.; Kasahara, T.; Iwamoto, Y.; Bell, G. I.: Mutation in hepatocyte nuclear factor-1-beta gene (TCF2) associated with MODY. (Letter) Nature Genet. 17:384-385, 1997.

Menzel, R.; Kaisaki, P. J.; Rjasanowski, I.; Heinke, P.; Kerner, W.; Menzel, S.: A low renal threshold for glucose in diabetic patients with a mutation in the hepatocyte nuclear factor-1-alpha (HNF-1-alpha) gene. Diabet. Med. 15:816-820, 1998.

Nishigori, H.; Yamada, S.; Kohama, T.; Tomura, H.; Sho, K.; Horikawa, Y.; Bell, G. I.; Takeuchi, T.; Takeda, J.: Frameshift mutation, A263fsinsGG, in the hepatocyte nuclear factor-1-beta gene associated with diabetes and renal dysfunction. Diabetes 47:1354-1355, 1998.

Wild, W.; Pogge von Strandmann, E.; Nastos, A.; Senkel, S.; Lingott-Frieg, A.; Bulman, M.; Bingham, C.; Ellard, S.; Hattersley, A. T.; Ryffel, G. U.: The mutated human gene encoding hepatocyte nuclear factor1-beta inhibits kidney formation in developing Xenopus embryos. Proc. Nat. Acad. Sci. 97:4695-4700, 2000.

Aplan, P. D.; Jones, C. A.; Chervinsky, D. S.; Zhao, X.; Ellsworth, M.; Wu, C.; McGuire, E. A.; Gross, K. W.: An scl gene product lacking the transactivation domain induces bony abnormalities and cooperates with LMO1 to generate T-cell malignancies in transgenic mice. EMBO J. 16:2408-2419, 1997.

Aplan, P. D.; Lombardi, D. P.; Ginsberg, A. M.; Cossman, J.; Bertness, V. L.; Kirsch, I. L.: Disruption of the human SCL locus by 'illegitimate' V-(D)-J recombinase activity. Science 250:1426-1429, 1990.

Aplan, P. D.; Lombardi, D. P.; Reaman, G. H.; Sather, H. N.; Hammond, G. D.; Kirsch, I. R.: Involvement of the putative hematopoietic transcription factor SCL in T-cell acute lymphoblastic leukemia. Blood 79:1327-1333,1992.

Brown, L.; Cheng, J.-T.; Chen, Q.; Siciliano, M. J.; Crist, W.; Buchanan, G.; Baer, R.: Site-specific recombination of the tal-1gene is a common occurrence in human T-cell leukemia. EMBO J. 9:3343-3351, 1990.

Collazo-Garcia, N.; Scherer, P.; Aplan, P. D.: Cloning and characterization of a murine SIL gene. Genomics 30:506-513, 1995.

Izraeli, S.; Lowe, L. A.; Bertness, V. L.; Good, D. J.; Dorward, D. W.; Kirsch, I. R.; Kuehn, M. R.: The SIL gene is required for mouse embryonic axial development and left-right specification. Nature 399:691-694, 1999.

Roy, A. L.; Du, H.; Gregor, P. D.; Novina, C. D.; Martinez, E.; Roeder, R. G.: Cloning of an Inr- and E-box binding protein, TFII-I, that interacts physically and functionally with USF1. EMBO J. 16:7091-7104, 1997.

Steingrimsson, E.; Sawadogo, M.; Gilbert, D. J.; Zervos, A. S.; Brent, R.; Blanar, M. A.; Fisher, D. E.; Copeland, N. G.; Jenkins, N. A.: Murine chromosomal location of five bHLH-Zip transcription factor genes. Genomics 28:179-183, 1995.

Zhong, G.; Fan, P.; Ji, H.; Dong, F.; Huang, Y.: Identification of a chlamydial protease-like activity factor responsible for the degradation of host transcription factors. J. Exp. Med. 193:935-942,2001.

Aasland, R.; Olsen, L. C.; Spurr, N. K.; Krokan, H. E.; Helland, D. E.: Chromosomal assignment of human uracil-DNA glycosylase to chromosome 12. Genomics 7:139-141, 1990.

Dinner, A. R.; Blackburn, G. M.; Karplus, M.: Uracil-DNA glycolase acts by substrate autocatalysis. Nature 413:752-755, 2001.

Haug, T.; Skorpen, F.; Kvaloy, K.; Eftedal, I.; Lund, H.; Krokan, H. E.: Human uracil-DNA glycosylase gene: sequence organization, methylation pattern, and mapping to chromosome 12q23-q24.1. Genomics 36:408-416, 1996.

Haug, T.; Skorpen, F.; Lund, H.; Krokan, H. E.: Structure of the gene for human uracil-DNA glycosylase and analysis of the promoter function. FEBS Lett. 353:180-184, 1994.

Meyer-Siegler, K.; Mauro, D. J.; Seal, G.; Wurzer, J.; deRiel, J. K.; Sirover, M. A.: A human nuclear uracil DNA glycosylase is the 37-kDa subunit of glyceraldehyde-3-phosphate dehydrogenase. Proc. Nat. Acad. Sci. 88:8460-8464, 1991.

Nilsen, H.; Rosewell, I.; Robins, P.; Skjelbred, C. F.; Andersen, S.; Slupphaug, G.; Daly, G.; Krokan, H. E.; Lindahl, T.; Barnes, D. E.: Uracil-DNA glycosylase (UNG)-deficient mice reveal a primary role of the enzyme during DNA replication. Molec. Cell 5:1059-1065,2000.

Olsen, L. C.; Aasland, R.; Wittwer, C. U.; Krokan, H. E.; Helland, D. E.: Molecular cloning of human uracil-DNA glycosylase, a highly conserved DNA repair enzyme. EMBO J. 8:3121-3125, 1989.

Vollberg, T. M.; Siegler, K. M.; Cool, B. L.; Sirover, M. A.: Isolation and characterization of the human uracil DNA glycosylase gene. Proc. Nat. Acad. Sci. 86:8693-8697, 1989.

Momeni, P.; Glockner, G.; Schmidt, O.; von Holtum, D.; Albrecht, B.; Gillessen-Kaesbach, G.; Hennekam, R.; Meinecke, P.; Zabel, B.; Rosenthal, A.; Horsthemke, B.; Ludecke, H.-J.: Mutations in a new gene, encoding a zinc-finger protein, cause tricho-rhino-phalangeal syndrome type I. Nature Genet. 24:71-74, 2000.

Andersson, S.; Russell, D. W.: Structural and biochemical properties of cloned and expressed human and rat steroid 5-alpha-reductases. Proc. Nat. Acad. Sci. 87:3640-3644, 1990.

Ellis, J. A.; Stebbing, M.; Harrap, S. B.: Genetic analysis of male pattern baldness and the 5-alpha-reductase genes. J. Invest. Derm. 110:849-853, 1998.

Harris, G.; Azzolina, B.; Baginsky, W.; Cimis, G.; Rasmusson, G. H.; Tolman, R. L.; Raetz, C. R. H.; Ellsworth, K.: Identification and selective inhibition of an isozyme of steroid 5-alpha-reductase in human scalp. Proc. Nat. Acad. Sci. 89:10787-10791, 1992.

Hsieh, C.-L.; Milatovich, A.; Russell, D.; Francke, U.: Chromosomal mapping of human steroid 5 alpha-reductase gene (SRD5A1) and pseudogene (SRD5AP1) in human and mouse. (Abstract) Cytogenet. Cell Genet. 58:1897 only, 1991.

Jenkins, E. P.; Andersson, S.; Imperato-McGinley, J.; Wilson, J. D.; Russell, D. W.: Genetic and pharmacological evidence for more than one human steroid 5-alpha-reductase. J. Clin. Invest. 89:293-300,1992.

Jenkins, E. P.; Hsieh, C.-L.; Milatovich, A.; Normington, K.; Berman, D. M.; Francke, U.; Russell, D. W.: Characterization and chromosomal mapping of a human steroid 5-alpha-reductase gene and pseudogene and mapping of the mouse homologue. Genomics 11:1102-1112, 1991.

Thigpen, A. E.; Silver, R. I.; Guileyardo, J. M.; Casey, M. L.; McConnell, J. D.; Russell, D. W.: Tissue distribution and ontogeny of steroid 5-alpha-reductase isozyme expression. J. Clin. Invest. 92:903-910, 1993.

He, Z.; Yamamoto, R.; Furth, E. E.; Schantz, L. J.; Naylor, S. L.; George, H.; Billheimer, J. T.; Strauss, J. F., III: cDNAs encoding members of a family of proteins related to human sterol carrier protein2 and assignment of the gene to human chromosome 1p21-pter. DNA Cell Biol. 10:559-569, 1991.

Vesa, J.; Hellsten, E.; Barnoski, B. L.; Emanuel, B. S.; Billheimer, J. T.; Mead, S.; Cowell, J. K.; Strauss, J. F., III; Peltonen, L.: Assignment of sterol carrier protein X/sterol carrier protein 2to 1p32 and its exclusion as the causative gene for infantile neuronalceroid lipofuscinosis. Hum. Molec. Genet. 3:341-346, 1994.

Welch, C. L.; Xia, Y.-R.; Billheimer, J. T.; Strauss, J. F., III; Lusis, A. J.: Assignment of the mouse sterol carrier protein gene (Scp2) to chromosome 4. Mammalian Genome 7:624-625, 1996.

Yamamoto, R.; Kallen, C. B.; Babalola, G. O.; Rennert, H.; Billheimer, J. T.; Strauss, J. F., III: Cloning and expression of a cDNA encoding human sterol carrier protein 2. Proc. Nat. Acad. Sci. 88:463-467,1991.

Yamamoto, R.; Naylor, S. L.; George, H.; Billheimer, J. T.; Strauss, J. F., III: Assignment of the gene encoding sterol carrier protein2 to human chromosome 1pter-p21. (Abstract) Cytogenet. Cell Genet. 58:1866-1867, 1991.

Tobe, K.; Suzuki, R.; Aoyama, M.; Yamauchi, T.; Kamon, J.; Kubota, N.; Terauchi, Y.; Matsui, J.; Akanuma, Y.; Kimura, S.; Tanaka, J.; Abe, M.; Ohsumi, J.; Nagai, R.; Kadowaki, T.: Increased expression of the sterol regulatory element-binding protein-1 gene in insulin receptor substrate-2 -/- mouse liver. J. Biol. Chem. 276:38337-38340,2001.

Joosten, P. H. L. J.; Toepoel, M.; Mariman, E. C. M.; Van Zoelen, E. J. J.: Promoter haplotype combinations of the platelet-derived growth factor alpha-receptor gene predispose to human neural tube defects. Nature Genet. 27:215-217, 2001.

Colombo, R.: Age and origin of the PRNP E200K mutation causing familial Creutzfeldt-Jacob disease in Libyan Jews. (Letter) Am. J. Hum. Genet. 67:528-531, 2000.

Cousens, J.; Smith, P. G.; Ward, H.; Everington, D.; Knight, R. S. G.; Zeidler, M.; Stewart, G.; Smith-Bathgate, E. A. B.; Macleod, M.-A.; Mackenzie, J.; Will, R. G.: Geographical distribution of variant Creutzfeldt-Jakob disease in Great Britain, 1994-2000. Lancet 357:1002-1007, 2001.

de Silva, R.; Ironside, J. W.; McCardle, L.; Esmonde, T.; Bell, J.; Will, R.; Windl, O.; Dempster, M.; Estibeiro, P.; Lathe, R.: Neuropathological phenotype and 'prion protein' genotype correlation in sporadic Creutzfeldt-Jakob disease. Neurosci. Lett. 179:50-52,1994.

Deslys, J.-P.; Jaegly, A.; d'Aignaux, J. H.; Mouthon, F.; de Villemeur, T. B.; Dormont, D.: Genotype at codon 129 and susceptibility to Creutzfeldt-Jakob disease. Lancet 351:1251 only, 1998.

Dlouhy, S. R.; Hsiao, K.; Farlow, M. F.; Foroud, T.; Conneally, P. M.; Johnson, P.; Prusiner, S. B.; Hodes, M. E.; Ghetti, B.: Linkage of the Indiana kindred of Gerstmann-Straussler-Scheinker disease to the prion protein gene. Nature Genet. 1:64-67, 1992.

Doh-ura, K.; Kitamoto, T.; Sakaki, Y.; Tateishi, J.: CJD discrepancy. (Letter) Nature 353:801-802, 1991.

Doh-ura, K.; Tateishi, J.; Sasaki, H.; Kitamoto, T.; Sakaki, Y.: Pro-to-leu change at position 102 of prion protein is the most common but not the sole mutation related to Gerstmann-Straussler syndrome. Biochem. Biophys. Res. Commun. 163: 974-979, 1989.

Duchen, L. W.; Poulter, M.; Harding, A. E.: Dementia associated with a 216 base pair insertion in the prion protein gene: clinical and neuropathological features. Brain 116:555-567, 1993.

Erginel-Unaltuna, N.; Peoc'h, K.; Komurcu, E.; Acuner, T. T.; Issever, H.; Laplanche, J.-L.: Distribution of the M129V polymorphism of the prion protein gene in a Turkish population suggests a high risk for Creutzfeldt-Jacob disease. Europ. J. Hum. Genet. 9:965-968,2001.

Farlow, M. R.; Yee, R. D.; Dlouhy, S. R.; Conneally, P. M.; Azzarelli, B.; Ghetti, B.: Gerstmann-Straussler-Scheinker disease. I. Extending the clinical spectrum. Neurology 39:1446-1452, 1989.

Flechsig, E.; Shmerling, D.; Hegyi, I.; Raeber, A. J.; Fischer, M.; Cozzio, A.; von Mering, C.; Aguzzi, A.; Weissmann, C.: Prion protein devoid of the octapeptide repeat region restores susceptibility to scrapie in PrP knockout mice. Neuron 27:399-408, 2000.

Forloni, G.; Angeretti, N.; Chiesa, R.; Monzani, E.; Salmona, M.; Bugiani, O.: Neurotoxicity of a prion protein fragment. (Letter) Nature 362:543-546, 1993.

Gabizon, R.; Rosenmann, H.; Meiner, Z.; Kahana, I.; Kahana, E.; Shugart, Y.; Ott, J.; Prusiner, S. B.: Mutation and polymorphism of the prion protein gene in Libyan Jews with Creutzfeldt-Jakob disease (CJD). Am. J. Hum. Genet. 53:828-835, 1993.

Gajdusek, D. C.: The transmissible amyloidoses: genetical control of spontaneous generation of infectious amyloid proteins by nucleation of configurational change in host precursors: kuru-CJD-GSS-scrapie-BSE. Europ. J. Epidemiol. 7:567-577, 1991.

Gambetti, P.; Petersen, R.; Monari, L.; Tabaton, M.; Autilio-Gambetti, L.: Fatal familial insomnia and the widening spectrum of prion diseases. Brit. Med. Bull. 49:980-994, 1993.

Ghetti, B.; Tagliavini, F.; Masters, C. L.; Beyreuther, K.; Giaccone, G.; Verga, L.; Farlow, M. R.; Conneally, P. M.; Dlouhy, S. R.; Azzarelli, B.; Bugiani, O.: Gerstmann-Straussler-Scheinker disease. II. Neurofibrillary tangles and plaques with PrP-amyloid coexist in an affected family. Neurology 39:1453-1461, 1989.

Giaccone, G.; Verga, L.; Bugiani, O.; Frangione, B.; Serban, D.; Prusiner, S. B.; Farlow, M. R.; Ghetti, B.; Tagliavini, F.: Prion protein preamyloid and amyloid deposits in Gerstmann-Straussler-Scheinker disease, Indiana kindred. Proc. Nat. Acad. Sci. 89:9349-9353, 1992.

Goldfarb, L. G.; Brown, P.; Cervenakova, L.; Gajdusek, D. C.: Molecular genetic studies of Creutzfeldt-Jakob disease. Molec. Neurobiol. 8:89-97, 1994.

Goldfarb, L. G.; Brown, P.; Haltia, M.; Cathala, F.; McCombie, W. R.; Kovanen, J.; Cervenakova, L.; Goldin, L.; Nieto, A.; Godec, M. S.; Asher, D. M.; Gajdusek, D. C.: Creutzfeldt-Jakob disease cosegregates with the codon 178-asn PRNP mutation in families of European origin. Ann. Neurol. 31:274-281, 1992.

Goldfarb, L. G.; Brown, P.; McCombie, W. R.; Goldgaber, D.; Swergold, G. D.; Wills, P. R.; Cervenakova, L.; Baron, H.; Gibbs, C. J., Jr.; Gajdusek, D. C.: Transmissible familial Creutzfeldt-Jakob disease associated with five, seven, and eight extra octapeptide coding repeats in the PRNP gene. Proc. Nat. Acad. Sci. 88:10926-10930, 1991.

Goldfarb, L. G.; Brown, P.; Mitrova, E.; Cervenakova, L.; Goldin, L.; Korczyn, A. D.; Chapman, J.; Galvez, S.; Cartier, L.; Rubenstein, R.; Gajdusek, D. C.: Creutzfeldt-Jacob disease associated with the PRNP codon 200-lys mutation: an analysis of 45 families. Europ. J. Epidemiol. 7:477-486, 1991.

Goldfarb, L. G.; Haltia, M.; Brown, P.; Nieto, A.; Kovanen, J.; McCombie, W. R.; Trapp, S.; Gajdusek, D. C.: New mutation in scrapie amyloid precursor gene (at codon 178) in Finnish Creutzfeldt-Jakob kindred. (Letter) Lancet 337:425, 1991.

Goldfarb, L. G.; Mitrova, E.; Brown, P.; Toh, B. H.; Gajdusek, D. C.: Mutation in codon 200 of scrapie amyloid protein gene in two clusters of Creutzfeldt-Jakob disease in Slovakia. (Letter) Lancet 336:514-515, 1990.

Travis, G. H.; Sutcliffe, J. G.; Bok, D.: The retinal degenerations low (rds) gene product is a photoreceptor disc membrane-associated glycoprotein. Neuron 6:61-70, 1991.

Morris, C.; Heisterkamp, N.; Hao, Q. L.; Testa, J. R.; Groffen, J.: The human tyrosine kinase gene (FER) maps to chromosome 5 and is deleted in myeloid leukemias with a del (5q). Cytogenet. Cell Genet. 53:196-200, 1990.

Williams, T. M.; Montoya, G.; Wu, Y.; Eddy, R. L.; Byers, M. G.; Shows, T. B.: The TCF8 gene encoding a zinc finger protein (Nil-2-a) resides on human chromosome 10p11.2. Genomics 14:194-196, 1992.

van Nie, R.; Ivanyi, D.; Demant, P.: A new H-2-linked mutation, rds, causing retinal degeneration in the mouse. Tissue Antigens 12:106-108, 1978.

Vine, A. K.; Schatz, H.: Adult-onset foveomacular pigment epithelial dystrophy. Am. J. Ophthal. 89:680-691, 1980.

Weleber, R. G.; Carr, R. E.; Murphey, W. H.; Sheffield, V. C.; Stone, E. M.: Phenotypic variation including retinitis pigmentosa, pattern dystrophy, and fundus flavimaculatus in a single family with a deletion of codon 153 or 154 of the peripherin/RDS gene. Arch. Ophthal. 111:1531-1542, 1993.

Wells, J.; Wroblewski, J.; Keen, J.; Inglehearn, C.; Jubb, C.; Eckstein, A.; Jay, M.; Arden, G.; Bhattacharya, S.; Fitzke, F.; Bird, A.: Mutations in the human retinal degeneration slow (RDS) gene can cause either retinitis pigmentosa or macular dystrophy. Nature Genet. 3:213-218, 1993.

Wroblewski, J. J.; Wells, J. A., III; Eckstein, A.; Fitzke, F.; Jubb, C.; Keen, J.; Inglehearn, C.; Bhattacharya, S.; Arden, G. B.; Jay, M.; Bird, A. C.: Macular dystrophy associated with mutations at codon 172 in the human retinal degeneration slow gene. Ophthalmology 101:12-22, 1994.

Hattori, M.; Osterfield, M.; Flanagan, J. G.: Regulated cleavage of a contact-mediated axon repellent. Science 289:1360-1365, 2000.

Boyd, A. W.; Ward, L. D.; Wicks, I. P.; Simpson, R. J.; Salvaris, E.; Wilks, A.; Welch, K.; Loudovaris, M.; Rockman, S.; Busmanis, I.: Isolation and characterization of a novel receptor-type protein tyrosine kinase (hek) from a human pre-B cell line. J. Biol. Chem. 267:3262-3267, 1992.

Fox, G. M.; Holst, P. L.; Chute, H. T.; Lindberg, R. A.; Janssen, A. M.; Basu, R.; Welcher, A. A.: cDNA cloning and tissue distribution of five human EPH-like receptor protein-tyrosine kinases. Oncogene 10:897-905, 1995.

Wicks, I. P.; Lapsys, N. M.; Baker, E.; Campbell, L. J.; Boyd, A. W.; Sutherland, G. R.: Localization of a human receptor tyrosine kinase (ETK1) to chromosome region 3p11.2. Genomics 19:38-41, 1994.

Wicks, I. P.; Wilkinson, D.; Salvaris, E.; Boyd, A. W.: molecular cloning of HEK, the gene encoding a receptor tyrosine kinase expressed by human lymphoid tumor cell lines. Proc. Nat. Acad. Sci. 89:1611-1615,1992.

Forsberg, E.; Hirsch, E.; Frohlich, L.; Meyer, M.; Ekblom, P.; Aszodi, A.; Werner, S.; Fassler, R.: Skin wounds and severed nerves heal normally in mice lacking tenascin-C. Proc. Nat. Acad. Sci. 93:6594-6599, 1996.

Gulcher, J. R.; Alexakos, M. J.; Le Beau, M. M.; Lemons, R. S.; Stefansson, K.: Chromosomal localization of the human hexabrachion (tenascin) gene and evidence for recent reduplication within the gene. Genomics 6:616-622, 1990.

Gulcher, J. R.; Nies, D. E.; Alexakos, M. J.; Ravikant, N. A.; Sturgill, M. E.; Marton, L. S.; Stefansson, K.: Structure of the human hexabrachion (tenascin) gene. Proc. Nat. Acad. Sci. 88:9438-9442,1991.

Mitrovic, N.; Schachner, M.: Detection of tenascin-C in the nervous system of the tenascin-C mutant mouse. J. Neurosci. Res. 42:710-717,1995.

Nies, D. E.; Hemesath, T. J.; Kim, J.-H.; Gulcher, J. R.; Stefansson, K.: The complete cDNA sequence of human hexabrachion (tenascin): a multidomain protein containing unique epidermal growth factor repeats. J. Biol. Chem. 266: 2818-2823, 1991.

Williams, T. M.; Moolten, D.; Burlein, J.; Romano, J.; Bhaerman, R.; Godillot, A.; Mellon, M.; Rauscher, F. J., III; Kant, J. A.: Identification of a zinc finger protein that inhibits IL-2 gene expression. Science 254:1791-1794, 1991.

Ludecke, H.-J.; Schaper, J.; Meinecke, P.; Momeni, P.; Gross, S.; von Holtum, D.; Hirche, H.; Abramowicz, M. J.; Albrecht, B.; Apacik, C.; Christen, H.-J.; Claussen, U.; and 28 others: Genotypic and phenotypic spectrum in tricho-rhino-phalangeal syndrome types I and III. Am. J. Hum. Genet. 68:81-91, 2001.

Vidal, R.; Revesz, T.; Rostagno, A.; Kim, E.; Holton, J. L.; Bek, T.; Bojsen-Moller, M.; Braendgaard, H.; Plant, G.; Ghiso, J.; Frangione, B.: A decamer duplication in the 3-prime region of the BRI gene originates an amyloid peptide that is associated with dementia in a Danish kindred. Proc. Nat. Acad. Sci. 97:4920-4925, 2000.

Fathallah-Shaykh, H.; Wolf, S.; Wong, E.; Posner, J. B.: Cloning of a leucine-zipper protein recognized by the sera of patients with antibody-associated paraneoplastic cerebellar degeneration. Proc. Nat. Acad. Sci. 88:3451-3454, 1991.

Gress, T.; Baldini, A.; Rocchi, M.; Furneaux, H.; Posner, J. B.; Siniscalco, M.: In situ mapping of the gene coding for a leucine zipper DNA binding protein (CDR 2) to the region between two rare fragile sites of autosome 16 (16p12-p13.1). (Abstract) Cytogenet. Cell Genet. 58:1999-2000, 1991.

Gress, T.; Baldini, A.; Rocchi, M.; Furneaux, H.; Posner, J. B.; Siniscalco, M.: In situ mapping of the gene coding for a leucine zipper DNA binding protein (CDR62) to 16p12-16p13.1. Genomics 13:1340-1342, 1992.

Raimondi, E.; Rubboli, F.; Moralli, D.; Chini, B.; Fornasari, D.; Tarroni, P.; De Carli, L.; Clementi, F.: Chromosomal localization and physical linkage of the genes encoding the human alpha-3, alpha-5, and beta-4 neuronal nicotinic receptor subunits. Genomics 12:849-850,1992.

Anand, R.; Lindstrom, J.: Nucleotide sequence of the human nicotinic acetylcholine receptor beta-2 subunit gene. Nucleic Acids Res. 18:4272, 1990.

De Fusco, M.; Becchetti, A.; Patrignani, A.; Annesi, G.; Gambardella, A.; Quattrone, A.; Ballabio, A.; Wanke, E.; Casari, G.: The nicotinic receptor beta-2 subunit is mutant in nocturnal frontal lobe epilepsy. Nature Genet. 26:275-276, 2000.

Lueders, K. K.; Elliott, R. W.; Marenholz, I.; Mischke, D.; DuPree, M.; Hamer, D.: Genomic organization and mapping of the human and mouse neuronal beta-1-nicotinic acetylcholine receptor genes. Mammalian Genome 10:900-905, 1999.

Phillips, H. A.; Favre, I.; Kirkpatrick, M.; Zuberi, S. M.; Goudie, D.; Heron, S. E.; Scheffer, I. E.; Sutherland, G. R.; Berkovic, S. F.; Bertrand, D.; Mulley, J. C.: CHRNB2 is the second acetylcholine receptor subunit associated with autosomal dominant nocturnal frontal lobe epilepsy. Am. J. Hum. Genet. 68:225-231, 2001.

Picciotto, M. R.; Zoli, M.; Lena, C.; Bessis, A.; Lallemand, Y.; LeNovere, N.; Vincent, P.; Pich, E. M.; Brulet, P.; Changeux, J.-P.: Abnormal avoidance learning in mice lacking functional high-affinity nicotine receptor in the brain. Nature 374:65-67, 1995.

Zoli, M.; Picciotto, M. R.; Ferrari, R.; Cocchi, D.; Changeux, J.-P.: Increased neurodegeneration during ageing in mice lacking high-affinity nicotine receptors. EMBO J. 18:1235-1244, 1999.

Tarroni, P.; Rubboli, F.; Chini, B.; Zwart, R.; Oortgiesen, M.; Sher, E.; Clementi, F.: Neuronal-type nicotinic receptors in human neuroblastoma and small-cell lung carcinoma cell lines. FEBS Lett. 312:66-70, 1992.

Bonner, T. I.; Buckley, N. J.; Young, A. C.; Brann, M. R.: Identification of a family of muscarinic acetylcholine receptor genes. Science 237:527-532, 1987.

Schwenk, W. F.; Rizza, R. A.; Mandarino, L. J.; Gerich, J. E.; Hayles, A. B.; Haymond, M. W.: Familial insulin resistance and acanthosis nigricans: presence of a postbinding defect. Diabetes 35:33-37,1986.

Speckman, R. A.; Garg, A.; Du, F.; Bennett, L.; Veile, R.; Arioglu, E.; Taylor, S. I.; Lovett, M.; Bowcock, A. M.: Mutational and haplotype analyses of families with familial partial lipodystrophy (Dunnigan variety) reveal recurrent missense mutations in the globular C-terminal domain of lamin A/C. Am. J. Hum. Genet. 66:1192-1198, 2000. Note: Erratum: Am. J. Hum. Genet. 67:775 only, 2000.

Chan, J.; Watt, V. M.: Eek and erk, new members of the eph subclass of receptor protein-tyrosine kinases. Oncogene 6:1057-1061, 1991.

Park, S.; Frisen, J.; Barbacid, M.: Aberrant axonal projections in mice lacking EphA8 (Eek) tyrosine protein kinase receptors. EMBO J. 16:3106-3114, 1997.

Ganju, P.; Shigemoto, K.; Brennan, J.; Entwistle, A.; Reith, A. D.: The Eck receptor tyrosine kinase is implicated in pattern formation during gastrulation, hindbrain segmentation and limb development. Oncogene 9:1613-1624, 1994.

Lindberg, R. A.; Hunter, T.: cDNA cloning and characterization of eck, an epithelial cell receptor-tyrosine kinase in the eph/elk family of protein kinases. Molec. Cell. Biol. 10:6316-6324, 1990.

Sulman, E. P.; Tang, X. X.; Allen, C.; Biegel, J. A.; Pleasure, D. E.; Brodeur, G. M.; Ikegaki, N.: ECK, a human EPH-related gene, maps to 1p36.1, a common region of alteration in human cancers. Genomics 40:371-374, 1997.

Colucci, F.; Schweighoffer, E.; Tomasello, E.; Turner, M.; Ortaldo, J. R.; Vivier, E.; Tybulewicz, V. L. J.; Di Santo, J. P.: Natural cytotoxicity uncoupled from the Syk and ZAP-70 intracellular kinases. Nature Immun. 3:288-294, 2002.

Naim, H. Y.; Sterchi, E. E.; Lentze, M. J.: Structure, biosynthesis, and glycosylation of human small intestinal maltase-glucoamylase. J. Biol. Chem. 263:19709-19717, 1988.

Nichols, B. L.; Eldering, J.; Avery, S.; Hahn, D.; Quaroni, A.; Sterchi, E.: Human small intestinal maltase-glucoamylase cDNA cloning: homology to sucrase-isomaltase. J. Biol. Chem. 273:3076-3081, 1998.

Schuler, G. D.; Boguski, M. S.; Stewart, E. A.; Stein, L. D.; Gyapay, G.; Rice, K.; White, R. E.; Rodriguez-Tome, P.; Aggarwal, A.; Bajorek, E.; Bentolila, S.; Birren, B. B.; Butler, A.; Castle, A. B.; Chiannilkulchai, N.; Chu, A.; Clee, C.; Cowles, S.; Day, P. J. R.; Dibling, T.; and84 others: A gene map of the human genome. Science 274:540-546,1996.

Levine, A.; Cantoni, G. L.; Razin, A.: Inhibition of promoter activity by methylation: possible involvement of protein mediators. Proc. Nat. Acad. Sci. 88:6515-6518, 1991.

Nan, X.; Meehan, R. R.; Bird, A.: Dissection of the methyl-CpG binding domain from the chromosomal protein MeCP2. Nucleic Acids Res. 21:4886-4892, 1993.

Ohki, I.; Shimotake, N.; Fujita, N.; Jee, J.-G.; Ikegami, T.; Nakao, M.; Shirakawa, M.: Solution structure of the methyl-CpG binding domain of human MBD1 in complex with methylated DNA. Cell 105:487-497,2001.

Carrera, C. J.; Eddy, R. L.; Shows, T. B.; Carson, D. A.: Assignment of the gene for methylthioadenosine phosphorylase to human chromosome 9 by mouse-human somatic cell hybridization. Proc. Nat. Acad. Sci. 81:2665-2668, 1984.

Chilcote, R. R.; Brown, E.; Rowley, J. D.: Lymphoblastic leukemia with lymphomatous features associated with abnormalities of the short arm of chromosome 9. New Eng. J. Med. 313:286-291, 1985.

Nobori, T.; Takabayashi, K.; Tran, P.; Orvis, L.; Batova, A.; Yu, A. L.; Carson, D. A.: Genomic cloning of methylthioadenosine phosphorylase: a purine metabolic enzyme deficient in multiple different cancers. Proc. Nat. Acad. Sci. 93:6203-6208, 1996.

Olopade, O. I.; Jenkins, R. B.; Ransom, D. T.; Malik, K.; Pomykala, H.; Nobori, T.; Cowan, J. M.; Rowley, J. D.; Diaz, M. O.: Molecular analysis of deletions of the short arm of chromosome 9 in human gliomas. Cancer Res. 52:2523-2529, 1992.

Olopade, O. I.; Pomykala, H. M.; Hagos, F.; Sveen, L. W.; Espinosa, R., III; Dreyling, M. H.; Gursky, S.; Stadler, W. M.; Le Beau, M. M.; Bohlander, S. K.: Construction of a 2.8-megabase yeast artificial chromosome contig and cloning of the human methylthioadenosine phosphorylase gene from the tumor suppressor region on 9p21. Proc. Nat. Acad. Sci. 92:6489-6493, 1995.

Ragione, F. D.; Takabayashi, K.; Mastropietro, S.; Mercurio, C.; Oliva, A.; Russo, G. L.; Pietra, V. D.; Borriello, A.; Nobori, T.; Carson, D. A.; Zappia, V.: Purification and characterization of recombinant human 5-prime-methylthioadenosine phosphorylase: definite identification of coding cDNA. Biochem. Biophys. Res. Commun. 223:514-519, 1996.

Williams-Ashman, H. G.; Seidenfeld, J.; Galletti, P.: Trends in the biochemical pharmacology of 5-prime-deoxy-5-prime-methylthioadenosine. Biochem. Pharm. 31:277-288, 1982.

Grewal, P. K.; Holzfeind, P. J.; Bittner, R. E.; Hewitt, J. E.: Mutant glycosyltransferase and altered glycosylation of alpha-dystroglycan in the myodystrophy mouse. Nature Genet. 28:151-154, 2001.

Bespalova, I. N.; Farjo, Q.; Mortlock, D. P.; Jackson, A. U.; Meisler, M. H.; Swaroop, A.; Burmeister, M.: Mapping of the neural retina leucine zipper gene, Nrl, to mouse chromosome 14. Mammalian Genome 4:618-620, 1993.

Bessant, D. A. R.; Payne, A. M.; Mitton, K. P.; Wang, Q.-L.; Swain, P. K.; Plant, C.; Bird, A. C.; Zack, D. J.; Swaroop, A.; Bhattacharya, S. S.: A mutation in NRL is associated with autosomal dominant retinitis pigmentosa. Nature Genet. 21:355-356, 1999.

Bessant, D. A. R.; Payne, A. M.; Plant, C.; Bird, A. C.; Swaroop, A.; Bhattacharya, S. S.: NRL S50T mutation and the importance of 'founder effects' in inherited retinal dystrophies. Europ. J. Hum. Genet. 8:783-787, 2000.

Dahl, S. P.; Jackson, A.; Kimberling, W. J.; Blackwood, D.; Swaroop, A.: Genetic mapping of NRL, a human retina-specific gene located on chromosome 14. (Abstract) Am. J. Hum. Genet. 51 (suppl.): A185only, 1992.

Farjo, Q.; Jackson, A.; Pieke-Dahl, S.; Scott, K.; Kimberling, W. J.; Sieving, P. A.; Richards, J. E.; Swaroop, A.: Human bZIP transcription factor gene NRL: structure, genomic sequence, and fine linkage mapping at 14q11.2 and negative mutation analysis in patients with retinal degeneration. Genomics 45:395-401, 1997.

Farjo, Q.; Jackson, A. U.; Xu, J.; Gryzenia, M.; Skolnick, C.; Agarwal, N.; Swaroop, A.: Molecular characterization of the murine neural retina leucine zipper gene, Nrl. Genomics 18:216-222, 1993.

Mears, A. J.; Kondo, M.; Swain, P. K.; Takada, Y.; Bush, R. A.; Saunders, T. L.; Sieving, P. A.; Swaroop, A.: Nrl is required for rod photoreceptor development. Nature Genet. 29:447-452, 2001.

Swaroop, A.; Xu, J.; Agarwal, N.; Weissman, S. M.: A simple and efficient cDNA library subtraction procedure: isolation of human retina-specific cDNA clones. Nucleic Acids Res. 19:1954 only, 1991.

Swaroop, A.; Xu, J.; Pawar, H.; Jackson, A.; Skolnick, C.; Agarwal, N.: A conserved retina-specific gene encodes a basic motif/leucine zipper domain. Proc. Nat. Acad. Sci. 89:266-270, 1992.

Wright, A. F.; Mansfield, D. C.; Bruford, E. A. Teague, P. W.; Thomson, K. L.; Riise, R.; Jay, M.; Patton, M. A.; Jeffery, S.; Schinzel, A.; Tommerup, N.: Fossarello, M.: Genetic studies in autosomal recessive forms of retinitis pigmentosa. In: Anderson, R. E.; LaVail, M. M.; Hollyfield, J. G. (eds.): Degenerative diseases of the retina. New York: Plenum Press (pub.) 1995. Pp. 293-302.

Yang-Feng, T. L.; Swaroop, A.: Neural retina-specific leucine zipper gene NRL (D14S46E) maps to human chromosome 14q11.1-q11.2. Genomics 14:491-492, 1992.

Jankovic, D.; Kullberg, M. C.; Hieny, S.; Caspar, P.; Collazo, C. M.; Sher, A.: In the absence of IL-12, CD4+ T cell responses to intracellular pathogens fail to default to a Th2 pattern and are host protective in an IL-10-/- setting. Immunity 16:429-439, 2002.

Anderson, S. K.; Gallinger, S.; Roder, J.; Frey, J.; Young, H. A.; Ortaldo, J. R.: A cyclophilin-related protein involved in the function of natural killer cells. Proc. Nat. Acad. Sci. 90:542-546,1993.

Frey, J. L.; Bino, T.; Kantor, R. R. S.; Segal, D. M.; Giardina, S. L.; Roder, J.; Anderson, S.; Ortaldo, J. R.: Mechanism of target cell recognition by natural killer cells: characterization of a novel triggering molecule restricted to CD3- large granular lymphocytes. J. Exp. Med. 174:1527-1536, 1991.

Rinfret, A.; Anderson, S. K.: IL-2 regulates the expression of the NK-TR gene via an alternate RNA splicing mechanism. Molec. Immun. 30:1307-1313, 1993.

Simons-Evelyn, M.; Young, H. A.; Anderson, S. K.: characterization of the mouse Nktr gene and promoter. Genomics 40:94-100, 1997.

Young, H. A.; Jenkins, N. A.; Copeland, N. G.; Simek, S.; Lerman, M. I.; Zbar, B.; Glenn, G.; Ortaldo, J. R.; Anderson, S. K.: Localization of a novel natural killer triggering receptor locus to human chromosome 3p23-p21 and mouse chromosome 9. Genomics 16:548-549, 1993.

Scott, I. C.; Halila, R.; Jenkins, J. M.; Mehan, S.; Apostolou, S.; Winqvist, R.; Callen, D. F.; Prockop, D. J.; Peltonen, L.; Kadler, K. E.: Molecular cloning, expression and chromosomal localization of a human gene encoding a 33 kDa putative metallopeptidase (PRSM1). Gene 174:135-143, 1996.

Mathew, S.; Murty, V. V. V. S.; Dalla-Favera, R.; Chaganti, R. S. K.: Chromosomal localization of genes encoding the transcription factors, c-rel, NF-kappa-Bp50, NF-kappa-Bp65, and lyt-10 by fluorescence in situ hybridization. Oncogene 8:191-193, 1993.

Ozes, O. N.; Mayo, L. D.; Gustin, J. A.; Pfeffer, S. R.; Pfeffer, L. M.; Donner, D. B.: NF-kappa-B activation by tumour necrosis factor requires the Akt serine-threonine kinase. Nature 401:82-85, 1999.

Romashkova, J. A.; Makarov, S. S.: NF-kappa-B is a target of AKT in anti-apoptotic PDGF signalling. Nature 401:86-90, 1999.

Zhong, H.; May, M. J.; Jimi, E.; Ghosh, S.: The phosphorylation status of nuclear NF-kappa-B determines its association with CBP/p300or HDAC-1. Molec. Cell 9:625-636, 2002.

Claudio, E.; Brown, K.; Park, S.; Wang, H.; Siebenlist, U.: BAFF-induced NEMO-independent processing of NF-kappa-B2 in maturing B cells. Nature Immun. 3:958-965, 2002.

Taparowsky, E.; Shimizu, K.; Goldfarb, M.; Wigler, M.: Structure and activation of the human N-ras gene. Cell 34:581-586, 1983.

Yuasa, Y.; Gol, R. A.; Chang, A.; Chiu, I.-M.; Reddy, E. P.; Tronick, S. R.; Aaronson, S. A.: Mechanism of activation of an N-ras oncogene of SW-1271 human lung carcinoma cells. Proc. Nat. Acad. Sci. 81:3670-3674, 1984.

Sanyal, S.; Sandstrom, D. J.; Hoeffer, C. A.; Ramaswami, M.:AP-1 function upstream of CREB to control synaptic plasticity in Drosophila. Nature 416:870-874, 2002.

Arheden, K.; Mandahl, N.; Strombeck, B.; Isaksson, M.; Mitelman, F.: Chromosome localization of the human oncogene INT1 to 12q13 by in situ hybridization. Cytogenet. Cell Genet. 47:86-87, 1988.

Gavin, B. J.; McMahon, J. A.; McMahon, A. P.: Expression of multiple novel Wnt-1/int-1-related genes during fetal and adult mouse development. Genes Dev. 4:2319-2332, 1990.

Kirikoshi, H.; Sekihara, H.; Katoh, M.: WNT10A and WNT6, clustered in human chromosome 2q35 region with head-to-tail manner, are strongly coexpressed in SW480 cells. Biochem. Biophys. Res. Commun. 283:798-805, 2001.

McMahon, A. P.: The Wnt family of developmental regulators. Trends Genet. 8:236-242, 1992.

Nusse, R.; Brown, A.; Papkoff, J.; Scambler, P.; Shackleford, G.; McMahon, A.; Moon, R.; Varmus, H.: A new nomenclature for int-1 and related genes: the Wnt gene family. (Letter) Cell 64:231-232, 1991.

Nusse, R.; van't Veer, L.; Geurts van Kessel, A.; van Agthoven, A.; Bootsma, D.; Varmus, H.: Chromosomal localization of a human homologue of a putative mammary tumor oncogene. (Abstract) Cytogenet. Cell Genet. 37:556-557, 1984.

Pellegrino, J. E.; Lensch, M. W.; Muenke, M.; Chance, P. F.: Clinical and molecular analysis in Joubert syndrome. Am. J. Med. Genet. 72:59-62, 1997.

Thomas, K. R.; Capecchi, M. R.: Targeted disruption of the murine int-1 proto-oncogene resulting in severe abnormalities in midbrain and cerebellar development. Nature 346:847-850, 1990.

Takahashi, E.; Hori, T.; O'Connell, P.; Leppert, M.; White, R.: R-banding and nonisotopic in situ hybridization: precise localization of the human type II collagen gene (COL2A1). Hum. Genet. 86:14-16,1990.

Takahashi, E.;Yamauchi, M.; Tsuji, H.; Hitomi, A.; Meuth, M.; Hori, T.: Chromosome mapping of the human cytidine-5-prime-triphosphate synthetase (CTPS) gene to band 1p34.1-p34.3 by fluorescence in situ hybridization. Hum. Genet. 88:119-121, 1991.

Takahashi, E.-I.; Yamauchi, M.; Ayusawa, D.; Kaneda, S.; Seno, T.; Meuth, M.; Hori, T.-A.: Chromosome mappings of the human cytidine-5-prime-triphosphate synthetase (CTPS) gene and the human ubiquitin-activating enzyme UBE1 gene by fluorescence in situ hybridization. (Abstract) Cytogenet. Cell Genet. 58:1864 only, 1991.

Thomas, P. E.; Sen, S.; Lamb, B. J.; Chu, E. H. Y.: Cloning and expression of mammalian CTP synthetase genes. (Abstract) Am. J. Hum. Genet. 45 (suppl.): A11 only, 1989.

Whelan, J.; Phear, G.;Yamauchi, M.; Meuth, M.: Clustered base substitutions in CTP synthetase conferring drug resistance in Chinese hamster ovary cells. Nature Genet. 3:317-322, 1993.

Yamauchi, M.; Takahashi, E.; Whelan, J.; Phear, G.; Meuth, M.:Mapping and functional analysis of the cytidine triphosphate synthetase (CTPS) gene. (Abstract) Human Genome Mapping Workshop 93 1 only,1993.

Nebert, D. W.; Gonzalez, F. J.: P450 genes: structure, evolution, and regulation. Annu. Rev. Biochem. 56:945-993, 1987.

Paolini, M.; Cantelli-Forti, G.; Perocco, P.; Pedulli, G. F.; Abdel-Rahman, S. Z.; Legator, M. S.: Co-carcinogenic effect of beta-carotene.(Letter) Nature 398:760-761, 1999.

Letinic, K.; Zoncu, R.; Rakic, P.: Origin of GABAergic neurons in the human neocortex. Nature 417:645-649, 2002.

Salvador, J. M.; Hollander, M. C.; Nguyen, A. T.; Kopp, J. B.; Barisoni, L.; Moore, J. K.; Ashwell, J. D.; Fornace, A. J., Jr.: Mice lacking the p53-effector gene Gadd45a develop a lupus-like syndrome. Immunity 16:499-508, 2002.

Dhermy, D.; Garbarz, M.; Lecomte, M. C.; Feo, C.; Bournier, O.; Chaveroche, I.; Gautero, H.; Galand, C.; Boivin, P.: Hereditary elliptocytosis: clinical, morphological and biochemical studies of 38 cases. Nouv. Rev. Franc. Hemat. 28:129-140, 1986.

Fairbanks, G.; Steck, T. L.; Wallach, D. F. H.: Electrophoretic analysis of the major polypeptides of the human erythrocyte membrane. Biochemistry 10:2606-2617, 1971.

Feo, C. J.; Fischer, S.; Piau, J. P.; Grange, M. J.; Tchernia, G.: Premiere observation de l∝absence d'une proteine de la membrane erythrocytaire (bande 4-1) dans un cas d'anemie elliptocytaire familiale. Nouv. Rev. Franc. Hemat. 22:315-325, 1980.

Eddy, R. L.; Mahnke-Zizelman, D. K.; Bausch-Jurken, M. T.; Sabina, R. L.; Shows, T. B.: Distribution of the AMP deaminase multigene family within the human genome: assignment of the AMPD2 to chromosome 1p21-p34 and AMPD3 to chromosome 11p13-pter. (Abstract) Human Genome Mapping Workshop 93 24 only, 1993.

Ogasawara, N.; Goto, H.; Yamada, Y.; Nishigaki, I.; Itoh, T.; Hasegawa, I.; Park, K. S.: Deficiency of AMP deaminase in erythrocytes. Hum. Genet. 75:15-18, 1987.

Sermsuvitayawong, K.; Wang, X.; Nagabukuro, A.; Matsuda, Y.; Morisaki, H.; Toyama, K.; Mukai, T.; Morisaki, T.: Genomic organization of Ampd3, heart-type AMPD gene, located in mouse chromosome 7. Mammalian Genome 8:767-769, 1997.

Yamada, Y.; Goto, H.; Ogasawara, N.: Cloning and nucleotide sequence of the cDNA encoding human erythrocyte-specific AMP deaminase. Biochim. Biophys. Acta 1171:125-128, 1992.

Yamada, Y.; Goto, H.; Ogasawara, N.: A point mutation responsible for human erythrocyte AMP deaminase deficiency. Hum. Molec. Genet. 3:331-334, 1994.

Allegrucci, C.; Liguori, L.; Mezzasoma, I.; Minelli, A.: A1 adenosine receptor in human spermatozoa: its role in the fertilization process. Molec. Genet. Metab. 71:381-386, 2000.

SEQUENCE LISTING (46764 sequences)

SEQ ID NO: 1 - DNA, 131 bp, Human herpesvirus 7
acagttaaaagtttagcttcgtcataactaacaattgaacaagtatcataaattagatttggcgtaataggtcgcacattcagcacatgttcactattgtattttggaatgaaatgtaaatccgttaccgt

SEQ ID NO: 2 - DNA, 78 bp, Human herpesvirus 7
ctatttgaaaatgactattaaatttttgtggaagatgtctattctgaatttccatgttagtagtaatacatcgaaaag

SEQ ID NO: 3 - DNA, 131 bp, ictalurid herpesvirus 1
gtggttcgtagtgactattggtgaaaaggatgatgtactcgggggggatgccttcctggttggtcgccactagtttcaccaatcgcccccctattttatcccacgacacaacggtcaccccgacgccccgc

SEQ ID NO: 4 - DNA, 71 bp, Invertebrate iridescent virus 6
aaagaggtgaggaaaatgaagatgtatacctttttttacaatatatttatcttcgctttcgttaattcttt

SEQ ID NO: 5 - DNA, 131 bp, Invertebrate iridescent virus 6
aaattttttatgacattgttgaattattacttgaagctaccaatgataaaaaagcatcttctatagattcaagatgcgttgtttgttatgaaaatgaaatttgtataaaaattcaaccatgtaatcatttt

SEQ ID NO: 6 - DNA, 102 bp, Invertebrate iridescent virus 6
aagatttggttatagatggatgagaaatataatttatagttgtgctcattaattttaatatggtatgcacttgttgttttttatcatttttaactttttctt

SEQ ID NO: 7 - DNA, 99 bp, Invertebrate iridescent virus 6
aataacatttgttttcatatttttcatttcttcttgtattgatggatataatttcaattcaggattagatgatgagaattcttgaataatgatattatt

SEQ ID NO: 8 - DNA, 118 bp, Invertebrate iridescent virus 6
aatatgctagagtttcacttgcatttactttagcttttcatcaaataaataacaataaggtgacacctttaatgttggatgaaagaacagctaatttagatcaagatcttagtacatt

SEQ ID NO: 9 - DNA, 130 bp, Invertebrate iridescent virus 6
aatggtaacagttgaaggactaagagtagctaaagatgtagcgtatttattttcaagtgattttaaataatcaaaagagatattttgttctgcaaatctatccctcttttttattctttcaaatgccatt

SEQ ID NO: 10 - DNA, 90 bp, Invertebrate iridescent virus 6
acagtttcctaaatttttaaattacttaaagtattcaaaatacgattattctatgcttgaaagtaataatagaattttgtttgtagctgt

SEQ ID NO: 11 - DNA, 83 bp, Invertebrate iridescent virus 6
acattcgttgtataaagaatcaattgcatttgaaaaatttgctaacgttggttttaaataacttttttctttagtaacgatgt

SEQ ID NO: 12 - DNA, 76 bp, Invertebrate iridescent virus 6
accatccatatgaacctcttagagatgttccaagtatattatatattggaataggttttggaattaaatatggggt

SEQ ID NO: 13 - DNA, 70 bp, Invertebrate iridescent virus 6
accgatgaaataattaaaacttgtggaacaaatggacttcctatgacacaaaacgaaattaaagattggt

SEQ ID NO: 14 - DNA, 63 bp, Invertebrate iridescent virus 6
agaagaatttttttctctccaatgtaatctccaaaagcattataaccagataaaaatttttct

SEQ ID NO: 15 - DNA, 63 bp, Invertebrate iridescent virus 6
agataacaatggtttgggtgaaatttttaactacgaaagtctattacccatactaaaagatct

SEQ ID NO: 16 - DNA, 74 bp, Invertebrate iridescent virus 6
agcttaccaatattagtattgtaccaactgcaagccctgctgctaaagttggtgctgctggtactggtcctgct

SEQ ID NO: 17 - DNA, 130 bp, Invertebrate iridescent virus 6
ataatatgaatttgaataatatgaatttacttaaagaagtatccgaagaaaatcgtttaatgttacttaaagactattttcaaacatcgggtcttgttaaacatcagttagaaacgtttgatcattttat

SEQ ID NO: 18 - DNA, 61 bp, Invertebrate iridescent virus 6
atagcggtgttgtaatttgtaatgtaagcgaaacacctatattacaatctttaccggttat

SEQ ID NO: 19 - DNA, 69 bp, Invertebrate iridescent virus 6
atgaaggaatgacaggaaaaacttctaaacaaaaatcttttggatgggatattcctaacatttctacat

SEQ ID NO: 20 - DNA, 104 bp, Invertebrate iridescent virus 6
atgatgttggcaattttaaaaccattacggataatctagaagtaacagatgccttttgttcctttaattgttgtctagcatggattcgagataataaacatgat

SEQ ID NO: 21 - DNA, 116 bp, Invertebrate iridescent virus 6
attctttctccaataacttcgtcctcaacctcttcatctcttctaatttcttcatctcttctgttggaaatttccggtggggggcattttgaatgtgttgatggtatagaaagaat

SEQ ID NO: 22 - DNA, 99 bp, Invertebrate iridescent virus 6
attgcaagaaacatgtgttattctacttttgtagacaatgatgatatacctgatgaaatgtgtcatgttatggaatgggatgatcatgttgcttgtagt

SEQ ID NO: 23 - DNA, 125 bp, Invertebrate iridescent virus 6
attttgtattacttgttcgaaagtgtcttttataatatcagtttcttctttaatttgttttgcaagtggagatgtaggtaaactttctgtaagagatttaactttaatttgcaaattagcaagat

SEQ ID NO: 24 - DNA, 122 bp, Invertebrate iridescent virus 6
caaattctacatttgtatcagttatgggagatccgtcaatacaggtttcgcttttaaaacattttgaaatagaaatttcttgttgattatgatccaaaatttttgatattttatatggtttg

SEQ ID NO: 25 - DNA, 93 bp, Invertebrate iridescent virus 6
caatgttgacaattaaatttaatattaacatagatttagaatggattagacatggttttgaaaaatgtaatatcaaatgggattgtgaaagtg

SEQ ID NO: 26 - DNA, 99 bp, Invertebrate iridescent virus 6
catggcttccattggatttggcaccgaagtttgacgttcctattaatagctcccttgaatgtcgaatggaatggcttgcgggatatttggatgcagatg

SEQ ID NO: 27 - DNA, 74 bp, Invertebrate iridescent virus 6
cggtgatggacttcttctcggtgatggacttcttctcggtgatggacttcttctcggtgatggacttcttctcg

SEQ ID NO: 28 - DNA, 62 bp, Invertebrate iridescent virus 6
cttggttgatattgtttgtaatggggttctgaaaacaagattctgaatggtttttaacgaag

SEQ ID NO: 29 - DNA, 92 bp, Invertebrate iridescent virus 6
gaaactatgatgtgtggatggaatggtaaaaaacttagagcagaaatcttctttggaccagtatattaccacagattgacgcacatggtatc

SEQ ID NO: 30 - DNA, 73 bp, Invertebrate iridescent virus 6
gatgttgaaattttaaatgttattattggaaggggacaatctgaccacatcgctaatttaaaaataacaactc

SEQ ID NO: 31 - DNA, 64 bp, Invertebrate iridescent virus 6
gcaagcattttgtacacatgatgaagattgtttagaaggacagtgttgtgtacaacgtatttgt

SEQ ID NO: 32 - DNA, 80 bp, Invertebrate iridescent virus 6
gctatcaatctacaagatctaagtagatatccaacagtgtatgattctatggaaatacatgcatcttgtatgttgggagt

SEQ ID NO: 33 - DNA, 62 bp, Invertebrate iridescent virus 6
gctatttttgtatttaattgattaacttgactatgagtataatacaaaatacctccaatagc

SEQ ID NO: 34 - DNA, 92 bp, Invertebrate iridescent virus 6
ggaggagattttgatttaggtattttaacattaggatggttatcttttaaccattttagacataatttgtttaaatcaacaacatttcctcc

SEQ ID NO: 35 - DNA, 83 bp, Invertebrate iridescent virus 6
ggttcattttgaattgttgtaataatatttttgagttgatctataccaccatatttattatcgcacccaatataattttcacc

SEQ ID NO: 36 - DNA, 98 bp, Invertebrate iridescent virus 6
gtatcaaaatgtaccattccgtaataagatttcataataaatagaccatatacatattggaatagtagatttataacggaaagtggatatttttgtgc

SEQ ID NO: 37 - DNA, 66 bp, Invertebrate iridescent virus 6
gtatgaaataaacaagaaggtcgttttaaagcatcggctttatgccttctaaatctattttcaagc

SEQ ID NO: 38 - DNA, 65 bp, Invertebrate iridescent virus 6
gttctacgatgttcagtagatatttttggtggtatagatggtctcaatgaacgtttagtagacac

SEQ ID NO: 39 - DNA, 75 bp, Invertebrate iridescent virus 6
gttgttaggtcatgtcagaggccctgaaattgatcaggagcgacctgaaaactctgacaccagacctgagacagc

SEQ ID NO: 40 - DNA, 68 bp, Invertebrate iridescent virus 6
gtttaggaatttgtttatgttatggggatatgtgtgcatgtataccagttcatgattaatttttaaac

SEQ ID NO: 41 - DNA, 81 bp, Invertebrate iridescent virus 6
gtttggaacggaaatgagttttcttctgtgactgttgtgaaaacaggaacagaaaaagaattattggaagttgaactaagc

SEQ ID NO: 42 - DNA, 85 bp, Invertebrate iridescent virus 6
taaaccaatatcaaataccgctataccattattacctattatattttttccaatacgtaatgaatgtataccttgattaggttta

SEQ ID NO: 43 - DNA, 99 bp, Invertebrate iridescent virus 6
taaagtagatgaaaaagaaagatatagaggtgcagaagtttttgatccagtgccaggattaaaaagaaatgttgttcctttagattttgcatcacttta

SEQ ID NO: 44 - DNA, 78 bp, Invertebrate iridescent virus 6
tatcaggaacttctcgtgttgcgcataattcatcaaacatatgtcttaatgttacaacattagtatccccttctgata

SEQ ID NO: 45 - DNA, 72 bp, Invertebrate iridescent virus 6
tcacccggatctgtaactggaggaccaggtggtaatattgcggctggtacagttacgggaggatcgggagga

SEQ ID NO: 46 - DNA, 78 bp, Invertebrate iridescent virus 6
tccattttatgtgaagtttcccattgttcaattgaaaaagaaattcattgtttttgggatcgtcataaaattactggg

SEQ ID NO: 47 - DNA, 130 bp, Invertebrate iridescent virus 6
tcgattttagattctgagactaaacgagcaatacaagatgcaatagattcatttgaaccatacaacaatacagtaaaaagaagagaatttgaagagcatttgttgaaacaaagtccgaatataaaattag

SEQ ID NO: 48 - DNA, 115 bp, Invertebrate iridescent virus 6
tgatggaagagccgtttatatttctgaaggtggtctttacagtcttattatgtctagcgaagctccgtttgctaaggactttagacgacttgtatgtaatgttattttaccgtca

SEQ ID NO: 49 - DNA, 70 bp, Invertebrate iridescent virus 6
tggaggtgctatcggtggaggcataagagtttttggattttgaggtcctaccaaagcattattttttcca

SEQ ID NO: 50 - DNA, 127 bp, Invertebrate iridescent virus 6
tggtgttgatggatcatcttatgtctggaacggttctgtatataataatgtttttgtaaaatcttattcaaagttttcatcacaaagcccattgtcagttcctccaggaagtaacatttcaatacca

SEQ ID NO: 51 - DNA, 107 bp, Invertebrate iridescent virus 6
tggtttgaggatgagaaagtgtggtttcttttatagctttttctggacttatttcatccataacacaaagaagagttgcagctattaaaccactacgtccgtgacca

SEQ ID NO: 52 - DNA, 68 bp, Invertebrate iridescent virus 6
tgttggatataattcaatttcttctttacttgttagttctttataaggaattgaatttcgttttaaca

SEQ ID NO: 53 - DNA, 72 bp, Invertebrate iridescent virus 6
ttgattgtgaaataacaccattacttaaatttgccatatcaaccttaatttctgggtaattttcacattcaa

SEQ ID NO: 54 - DNA, 122 bp, Invertebrate iridescent virus 6
ttgtgttttagatagttgatattttaatgcattttctaaattaagcatatcaactttatcaatatttaattggttgacttgattcataaaatgtttaaatttatcaacattactagaaccaa

SEQ ID NO: 55 - DNA, 66 bp, Invertebrate iridescent virus 6
ttgttgatcttgaacttctagaacttgaacttgcgcgtataggttcaacaggtttttgattaacaa

SEQ ID NO: 56 - DNA, 71 bp, Invertebrate iridescent virus 6
tttgtaaacggtctttttactaaacatggaggtcaacatgtagatgggtggacaaaaccgttttttgcaaa

SEQ ID NO: 57 - DNA, 114 bp, Invertebrate iridescent virus 6
ttttaattttaattgtcctgtttgttattaaatttaattcttcagaagtttcttctatattaacttcagaagttacttccgaaggtgatgatgaacatgaaacagaaactagag

SEQ ID NO: 58 - DNA, 73 bp, Invertebrate iridescent virus 6
ttttcatgtaacatccccatgtttaatccttctgaaataattgatggattgaaacaatggattaatatgagag

SEQ ID NO: 59 - DNA, 114 bp, Invertebrate iridescent virus 6
ttttcgattcatacttctttatttattgtattttaatgttacatcaaggtaataaaattgaaccttatcttcattataaatacaataaataagaatctaaaatggaattgaaaa

SEQ ID NO: 60 - DNA, 85 bp, Invertebrate iridescent virus 6
tttgagaatttccagaaagattagccatttttgttaatgttattgcacccgatgaaatgacaggtgagcttgcagttgttccaga

SEQ ID NO: 61 - DNA, 60 bp, Maize streak virus
ctgacttggcactctgaatatttgggtgaaacccatttatatcaaagaaccttgagtcag

SEQ ID NO: 62 - DNA, 61 bp, Murine adenovirus A
cctgctgacgtattgcgcaactgtgcaactaattgtgattgttttgtaataatggagcagg

SEQ ID NO: 63 - DNA, 131 bp, Murine adenovirus A
gggaactactctaacgacggaagcggagcaagagagctcagcttgagagttaatgaggaagttactgaacctccttacaattctattacttatgcggaggtgttgcgtctttatcgtcagaatgggttttc

SEQ ID NO: 64 - DNA, 85 bp, Plutella xylostella granulovirus
acaatatcataatccattgataaagtaccgataatagataactgttagcataatgcggactttttatcgattgattagatattgt

SEQ ID NO: 65 - DNA, 122 bp, Plutella xylostella granulovirus
actatgaatttagacgatttctttgtaattatactccgttggaacgaatctcaataaataaattttttaataagagaaatgtcgtttgagtacaattcagaacctatcgaagtgtttatagt

SEQ ID NO: 66 - DNA, 63 bp, Plutella xylostella granulovirus
agatagcaagctgttggctaaaaacggtttttatcagtggtacggccagattatttgctattt

SEQ ID NO: 67 - DNA, 122 bp, Plutella xylostella granulovirus
agtaagttttttttgtctagtagcgctgattgttttattaacgtcgtcgctaagttttcttttttcggccatcttcatattaatatcttcgtcggcggtactgtaactactggaaacttgct

SEQ ID NO: 68 - DNA, 64 bp, Plutella xylostella granulovirus
atctcgtctccgacgtttaacatcattacctggccgttgctgttcacgtcgagcgacacgagat

SEQ ID NO: 69 - DNA, 82 bp, Plutella xylostella granulovirus
caactctggaatggttgaatttgtggcgtcgaccagcgcgtaaaccatatcgttggcttcgtacctaaccattatattgttg

SEQ ID NO: 70 - DNA, 61 bp, Plutella xylostella granulovirus
cctgagctatcagtaagttgtaaattctattaattttattattaacatcgtcgagctgggg

SEQ ID NO: 71 - DNA, 68 bp, Plutella xylostella granulovirus
cggactcatcacgcaactgtgcgaaagtctcagatcgcaagatttttacacagacgacatgctgtccg

SEQ ID NO: 72 - DNA, 131 bp, Plutella xylostella granulovirus
cgtcgtacgtggaagtcgtcttaccggcgtccaggagccgtttacgctgatacttgtaaaacacgttgtcgtgcaacagcagcgttttgtttcccaattgggcggcggcggtgacggcgttggtgtacgcg

SEQ ID NO: 73 - DNA, 86 bp, Plutella xylostella granulovirus
cgtgtccgatagattggtgtcacctcaggcggtcgtatctatatttatattattatcactcgtttgtgtgacatggagcatgcacg

SEQ ID NO: 74 - DNA, 92 bp, Plutella xylostella granulovirus
ctcttgatcctggcaatctaaactagccatatttttatagttgattcctatctcgcctatatctttgctgtacgtgaccagattattgagag

SEQ ID NO: 75 - DNA, 60 bp, Plutella xylostella granulovirus
gagaggttatcgcagcttatcttgaacacgatattgggacagttgcgtttgtaatatttt

SEQ ID NO: 76 - DNA, 76 bp, Plutella xylostella granulovirus
gagagtcaaattgatttatataataacgagttgcgatttatattgttgcaagatattaaaattgattctgattttc

SEQ ID NO: 77 - DNA, 103 bp, Plutella xylostella granulovirus
gcgtccaaattttacagcgaaatattcgagagcttaaacaacatgaacagctggctgtacatggtgagctcggacaccttcgtcaacgtaagatgcggggagc

SEQ ID NO: 78 - DNA, 83 bp, Plutella xylostella granulovirus
ggaaaaagccaacaagtgccttaggatgggacgttacgtggtgtggcccaatcttagcgctgtgtttctcgggtggcgcatct

SEQ ID NO: 79 - DNA, 60 bp, Plutella xylostella granulovirus
ggattctagtctagaacaaattatatccgggttcaacaacaggagcagataccgaatacc

SEQ ID NO: 80 - DNA, 84 bp, Plutella xylostella granulovirus
ggctgcgataacatcaattttctagtagatattttcggagaacacatcaccgagaatgacaatcactcgtggtgtcacgtggcc

SEQ ID NO: 81 - DNA, 61 bp, Plutella xylostella granulovirus
ggggttggtggggttggggttagatatgattgctaaaatttgctgcaacagagccaaaacc

SEQ ID NO: 82 - DNA, 76 bp, Plutella xylostella granulovirus
ggtactgcagggaatcggggttcgctgtagtgtcggaagctctacacacactcttctccctgtccttgttgtaacc

SEQ ID NO: 83 - DNA, 76 bp, Plutella xylostella granulovirus
ggttgaggagattatgattgaggtcgcgcttatcttcaaaatcaaggaattcgcgcccgacgtacccctcttcacc

SEQ ID NO: 84 - DNA, 81 bp, Plutella xylostella granulovirus
gtaaaaatatcaaacatagcatgaattggctcgttttgcgcaacacttgggccaccgtcaagggacatgttttatttttat

SEQ ID NO: 85 - DNA, 63 bp, Plutella xylostella granulovirus
gtgacgtggtgcggcaaatcttgagtaaaagtgacgacgcctttaccgccgctcatcacgcac

SEQ ID NO: 86 - DNA, 76 bp, Plutella xylostella granulovirus
gttcattctagttctgtaaccgttttcgtctattatctcaacatactcttcgacaacttgcaaacgctggtcgaac

SEQ ID NO: 87 - DNA, 71 bp, Plutella xylostella granulovirus
taactccaggccgttgttgctatcactgataataaaacgatcattgtttagataacagttatctggaatta

SEQ ID NO: 88 - DNA, 70 bp, Plutella xylostella granulovirus
tcgtttcaaaattttccggcagcgcgtgacccgatgacatttgaatcacgggcgcctgataaaaatgcga

SEQ ID NO: 89 - DNA, 60 bp, Plutella xylostella granulovirus
tctaaaggtatctctctgatggacattgaattgcagaacggatgggatatatactttaga

SEQ ID NO: 90 - DNA, 75 bp, Plutella xylostella granulovirus
tgtcttcggtgaggggtagcgtcgtgttgggttccgtgcatacgggtatctcgacgcactcctcgccgtcaaaca

SEQ ID NO: 91 - DNA, 76 bp, Plutella xylostella granulovirus
ttggcggagtgaacgttgtggtgtttggtgatttgtttcaattaccgcccatcagcaacgataaagatgctgccaa

SEQ ID NO: 92 - DNA, 100 bp, Saimiriine herpesvirus 2
aaaatgtttgtgggagcagtaaatgtactatgactttatctggtcttgacaagaatctccagttatcaaagtggacatccatgtttctctcatgcgtttt

SEQ ID NO: 93 - DNA, 80 bp, Saimiriine herpesvirus 2
gagaaggctgttcatatcctcttacttttccagggtcttctaaagcaaaatggtgtctaggggatgattgtggtctactc

SEQ ID NO: 94 - DNA, 87 bp, Saimiriine herpesvirus 2
tgctctagtgtattaacaaatctgtgttggtgtttaaagagaaaagctttttcagcatctaatacagcagttgggcttacatgagca

SEQ ID NO: 95 - DNA, 68 bp, Saimiriine herpesvirus 2
ttctatgtcctgtaataggtacaatgtctttttttaaggctgtgcaagaagttatacaagggcatgaa

SEQ ID NO: 96 - DNA, 66 bp, shrimp white spot syndrome virus (white spot bacilliform virus)
aaagttgctgccattcttgccaacagaacagagtccctatatctgttgccagattctcccaacttt

SEQ ID NO: 97 - DNA, 130 bp, shrimp white spot syndrome virus (white spot bacilliform virus)
aaggaagattaggtgcacaatctattgtcataaaaatgtccaggtcaatttcttcaacaccttcctcaaagttatagaagaaacttgtttcatcatttttattagcaataaacaagtacgttttttcctt

SEQ ID NO: 98 - DNA, 64 bp, shrimp white spot syndrome virus (white spot bacilliform virus)
aagggattcaaaaagagttaaatatgaaaatgtggtcatttcaaaggcttattgtgatttcttt

SEQ ID NO: 99 - DNA, 108 bp, shrimp white spot syndrome virus (white spot bacilliform virus)
aagggtcggctccttaacgctgtcaaggaaaaacctgcagagtactttgagttgctaatatctgcagacactgaagcagcattaaaaactgccgaagaaacagccctt

SEQ ID NO: 100 - DNA, 78 bp, shrimp white spot syndrome virus (white spot bacilliform virus)
acaacatgtaagcgttgggtaagaagatctggatctggatgacccaccttgtccttcttatcctatccttatccttgt

SEQ ID NO: 101 - DNA, 76 bp, shrimp white spot syndrome virus (white spot bacilliform virus)
acacgtccgtgttagtgatgagtatatggacagatttggtagtctattacttggacgagaaaagaaatggacgtgt

SEQ ID NO: 102 - DNA, 75 bp, shrimp white spot syndrome virus (white spot bacilliform virus)
acctgattccttcttctgttgcagaataaaaggaaccatttccgttggttctgcatagcaaggagaaatctcggt

SEQ ID NO: 103 - DNA, 130 bp, shrimp white spot syndrome virus (white spot bacilliform virus)
acctgcactcaaaattacttctgggggtaacaatagtagcagtagtatcaataacgaagatgatggtgatgatgacgatgccgttgacgctactgcattatgcccccaaactgaagctacagtgaaaaat

SEQ ID NO: 104 - DNA, 80 bp, shrimp white spot syndrome virus (white spot bacilliform virus)
acgatacgaggatagattgtctagatgcagtagcaaatctcaccggacctgtgtatgttctcattttagatcttgtacgt

SEQ ID NO: 105 - DNA, 69 bp, shrimp white spot syndrome virus (white spot bacilliform virus)
acttctactgtttacacttctgtaaagtgttacctttcttccataatcaagagtgaaagtagtagaagt

SEQ ID NO: 106 - DNA, 64 bp, shrimp white spot syndrome virus (white spot bacilliform virus)
agaaaaagcaatgggtatcaatacagataatggaggatttgtttggaagaatggtgttttttct

SEQ ID NO: 107 - DNA, 61 bp, shrimp white spot syndrome virus (white spot bacilliform virus)
agaaagtactaccatttcctgttgacaagtatagagctgtggataaaaaggtggtaaatct

SEQ ID NO: 108 - DNA, 85 bp, shrimp white spot syndrome virus (white spot bacilliform virus)
agaaccgtatcttgttatcaaatttgaaaagaactcagaatcattacttgtttttccattcaaagctgtacgcatgatacattct

SEQ ID NO: 109 - DNA, 117 bp, shrimp white spot syndrome virus (white spot bacilliform virus)
agagggctagtgtctaaaacggataggtttttactaccaaacccaacaggccaccaagatgaagggggttgtttagtacggttgttagaccacaaaaacttggacgctttttccttt

SEQ ID NO: 110 - DNA, 64 bp, shrimp white spot syndrome virus (white spot bacilliform virus)
agctccttttactgtaaggtttggtaatgacaatgataataatgttatatgtgtaggaggagct

SEQ ID NO: 111 - DNA, 80 bp, shrimp white spot syndrome virus (white spot bacilliform virus)
aggtttatggaactcctggcaaggtattttgccctccctgtcctcttttagaggggcggccttacagcctccaaaaacct

SEQ ID NO: 112 - DNA, 126 bp, shrimp white spot syndrome virus (white spot bacilliform virus)
atataacaagggacagacttgtaatgttgtccaggagtggttcaagggatccttctctcttgcaaagcgtagaggaacagtccccaaattctgtagtaacatttcccacgctttcttttgtaatat

SEQ ID NO: 113 - DNA, 109 bp, shrimp white spot syndrome virus (white spot bacilliform virus)
atcgttcaattgtgtaaaaagtatggatgtgttgaatttgttatgatgttaaaaataataaaaatattgtacattttattacatttgtttgttttgacacctgagcggt

SEQ ID NO: 114 - DNA, 67 bp, shrimp white spot syndrome virus (white spot bacilliform virus)
atgacgaagaagacgaaaaagatgtcaagcaagaagtctcgaaccgtccccccattttttcgtacat

SEQ ID NO: 115 - DNA, 86 bp, shrimp white spot syndrome virus (white spot bacilliform virus)
attcactttttgtaaccctatcaacagatttgaatgataatagaatatgttcgtatttgtcagggttttcaccagaaatagtgaat

SEQ ID NO: 116 - DNA, 91 bp, shrimp white spot syndrome virus (white spot bacilliform virus)
attttcctccatgacgaaacactggtgatatgtctggagctctgatgaatgtcttgccagatgccatcctagtttttctcctggggaaggt

SEQ ID NO: 117 - DNA, 76 bp, shrimp white spot syndrome virus (white spot bacilliform virus)
caacaacagtgccaatgtaatggaagctgtggatagtttcaatactactcctttgctcgttaggcacatgatgttg

SEQ ID NO: 118 - DNA, 85 bp, shrimp white spot syndrome virus (white spot bacilliform virus)
caagtcccaccgtggttcctctggttctgcttcttcttctcattgtatgagtagtgatgaagaatcagaggatgaaagggatatg

SEQ ID NO: 119 - DNA, 95 bp, shrimp white spot syndrome virus (white spot bacilliform virus)
caatatggatagttgttgcctgatatcgaggataacaccagaactggctggcaagttaacctggatcttcataccagaaaacaacttcaagattg

SEQ ID NO: 120 - DNA, 82 bp, shrimp white spot syndrome virus (white spot bacilliform virus)
caatttgctaagggtttgttgtttgatgaggttgtcacatcaattgtggcacatcagatggctcaagatatttgcaagtctg

SEQ ID NO: 121 - DNA, 117 bp, shrimp white spot syndrome virus (white spot bacilliform virus)
cagacttgtcgaaagaggaccagaaactcttatcataatctacctccaccattgaagattcgtatgtagtggaacccatagaaaagataataagattgtccacatcgacaagtactg

SEQ ID NO: 122 - DNA, 85 bp, shrimp white spot syndrome virus (white spot bacilliform virus)
cagattgcaccagaaccgactgttgctccagaaatgtgcattaacctttgtgtgtttctggaacagacgtttctgggcatagctg

SEQ ID NO: 123 - DNA, 96 bp, shrimp white spot syndrome virus (white spot bacilliform virus)
catatgatttttcagtattgtacaagattcttcaactacaaaaacagaatatctctttacttttagagaagggtttcaatgcatgggaatcgtgtg

SEQ ID NO: 124 - DNA, 77 bp, shrimp white spot syndrome virus (white spot bacilliform virus)
catttcttccctgcaaacgtatggcggtatagaagagttgcctgaaaatgtactagtcggtttgtccggaggatttg

SEQ ID NO: 125 - DNA, 84 bp, shrimp white spot syndrome virus (white spot bacilliform virus)
ccttgccaagtgcgcatatcacgatcactgataaaacctcctcgtatattatttatcaccaattcctttgagtaccgggcaagg

SEQ ID NO: 126 - DNA, 61 bp, shrimp white spot syndrome virus (white spot bacilliform virus)
cgtctgggcggaagtgcagtttcctccccgggaggggcgaatctcataaacacgacagatg

SEQ ID NO: 127 - DNA, 91 bp, shrimp white spot syndrome virus (white spot bacilliform virus)
cgttacattattgcagttggtgtcctacatcaacgctctcttttccctcgagcgccgaaatgttttcaccgacggcttttttaatgcagcg

SEQ ID NO: 128 - DNA, 124 bp, shrimp white spot syndrome virus (white spot bacilliform virus)
ctaaaattgtccaatactttaaaggcaaattttggaaaatccatgtcggctatttttgctcaacatttagtggacatgacaaacgctaaacactttaaggacccaaagacaaagaagattttag

SEQ ID NO: 129 - DNA, 67 bp, shrimp white spot syndrome virus (white spot bacilliform virus)
ctaatactgttatccttcctacttctgagttgtttaactgcccaggagttgaaaatgacaaatttag

SEQ ID NO: 130 - DNA, 72 bp, shrimp white spot syndrome virus (white spot bacilliform virus)
ctccacctgaggatgaagaagaggatgatttctaccgcaaaaagcgtgccgcacctccacctgaggatgaag

SEQ ID NO: 131 - DNA, 71 bp, shrimp white spot syndrome virus (white spot bacilliform virus)
ctcttcataggaaacatttatgtgttattagtgataagaagaatggtacaatttcctattcacctgaagag

SEQ ID NO: 132 - DNA, 67 bp, shrimp white spot syndrome virus (white spot bacilliform virus)
ctgggtcggtctgatgtcaagttcggagggtggacctctgggtcgacccgatgtcagattacaccag

SEQ ID NO: 133 - DNA, 127 bp, shrimp white spot syndrome virus (white spot bacilliform virus)
ctgtttttggagtcagtacgcgtgtggattcacatattgtaggcccctttagtatacctgttgatttttcaagcgcaggactagataaggcctcatgtggcaaattgtacgttaacaccatagacgg

SEQ ID NO: 134 - DNA, 75 bp, shrimp white spot syndrome virus (white spot bacilliform virus)
cttcaaatgagatccttataaaaatgttccaaatggatagggttttggatggcatggatgatgatgatgatgaag

SEQ ID NO: 135 - DNA, 65 bp, shrimp white spot syndrome virus (white spot bacilliform virus)
cttcgtggagctgctttaaaggttgtagtgcttggaatctgcagcaaacgcagctctctacagag

SEQ ID NO: 136 - DNA, 131 bp, shrimp white spot syndrome virus (white spot bacilliform virus)
cttggacgtgaaaagcgcgaagcagctcccccacttaaaggtgcacttggacgtaagaggcgcgaagcagctcccccacttaaaggtgcgcttggacgtgaaaagcgcgaagcagctcccccacttaaagg

SEQ ID NO: 137 - DNA, 64 bp, shrimp white spot syndrome virus (white spot bacilliform virus)
cttggataatgttcttgtgaatatcaacaacaaggatgaagatcttacaaaactcgtatccgag

SEQ ID NO: 138 - DNA, 72 bp, shrimp white spot syndrome virus (white spot bacilliform virus)
gaagaggtgaagaataaggagaaggtacaggactagcatcatagtccctcacaatccttgttcttccccttc

SEQ ID NO: 139 - DNA, 74 bp, shrimp white spot syndrome virus (white spot bacilliform virus)
gaagtgagtgcagcgctataaacttctccggtgatttggcgagtgactggattacttagccctgcgtcaatttc

SEQ ID NO: 140 - DNA, 72 bp, shrimp white spot syndrome virus (white spot bacilliform virus)
gaggaggaacaacaacgacaccaactcaaccttcacctgacggtggagatggatacgtagatctttctcctc

SEQ ID NO: 141 - DNA, 131 bp, shrimp white spot syndrome virus (white spot bacilliform virus)
gaggctatccagatatctaggtcgggaagaatccagaaacgattctagccatttctggaacaatcatttctggaaagggttacaatttattgtatctggtgcattatttctggtaccatttctggcacctc

SEQ ID NO: 142 - DNA, 86 bp, shrimp white spot syndrome virus (white spot bacilliform virus)
gaggttgcaacagctgcagcatggaatacgttttcattattttcattaataaaggaaaaggccaagctgtttgttgttagaatttc

SEQ ID NO: 143 - DNA, 106 bp, shrimp white spot syndrome virus (white spot bacilliform virus)
gatagtgattacggcatctgtgaaaaatgtgcacgaaaaactcccaaatacaagctccgtatttttagggaacgaaaatgctgcgatagatgttgccgtctttatc

SEQ ID NO: 144 - DNA, 68 bp, shrimp white spot syndrome virus (white spot bacilliform virus)
gattagtgatgatgaggatgatattgcctttattgattccgaagaagagtctgaatcatctactgatt

SEQ ID NO: 145 - DNA, 92 bp, shrimp white spot syndrome virus (white spot bacilliform virus)
gcactacactgcactggtgacgtagtagtagaagtagtagtggtaatagtccactattgtcactgcactgcactagtagtagtagtagtagt

SEQ ID NO: 146 - DNA, 95 bp, shrimp white spot syndrome virus (white spot bacilliform virus)
gcatcatctccaacacatactttggatacgagaatgttgttgttcatcccaaacaactcaaaattatccccagtgtcgattttgatagctggtgc

SEQ ID NO: 147 - DNA, 81 bp, shrimp white spot syndrome virus (white spot bacilliform virus)
gcctagagaagttatgcaagtaattggtactctcttggacaagaaactagaaattgacgacggtatagcttctgtaaaggc

SEQ ID NO: 148 - DNA, 87 bp, shrimp white spot syndrome virus (white spot bacilliform virus)
gcgatagtaaggatcccaattttaaaatgtctgactggttgaggataaaaactgcattaacatttaaagttgggaaaattactgtgc

SEQ ID NO: 149 - DNA, 68 bp, shrimp white spot syndrome virus (white spot bacilliform virus)
gcgccttcatttattgtcgcagaatcggccgatattgttggcgaatctatgtctgtaaagcaaggcgt

SEQ ID NO: 150 - DNA, 117 bp, shrimp white spot syndrome virus (white spot bacilliform virus)
gctataatgggttgtggtattataaggtatactgtatttgtcaataaccttgcaagatcaacactcgataatgatgatgacaaggcagcaacctattataacacccctatatatggc

SEQ ID NO: 151 - DNA, 128 bp, shrimp white spot syndrome virus (white spot bacilliform virus)
gctcgtgtaatgaggatcctaaagtcacgtgaaggtgctcgtgtatggttggccaaggatgaaaatgccatcatctttgaaaacgttaaccacgatacggccatctctacggacgctatggagcgagc

SEQ ID NO: 152 - DNA, 114 bp, shrimp white spot syndrome virus (white spot bacilliform virus)
gcttcttctaggatctgtatctgccatctctgctcaaaaatctgccagtcacattaacgatcctactgctttgttgagcaccaacacgtctatccagaatctggtcaaggaagc

SEQ ID NO: 153 - DNA, 64 bp, shrimp white spot syndrome virus (white spot bacilliform virus)
ggaagaaagtctttccatttcccattcttcttgattcagatgggatatattgacaagttcttcc

SEQ ID NO: 154 - DNA, 67 bp, shrimp white spot syndrome virus (white spot bacilliform virus)
ggaagatgggtaaatagtccctataattggtgtacatgaagttgaggaaagactgtttgccctttcc

SEQ ID NO: 155 - DNA, 71 bp, shrimp white spot syndrome virus (white spot bacilliform virus)
ggacatacttgctagacttaacaattgacctatggccaattctcaactgttgacaggtatcataattgtcc

SEQ ID NO: 156 - DNA, 131 bp, shrimp white spot syndrome virus (white spot bacilliform virus)
ggataatactgtagttaatcgccatgaagcattcattctaacatcaaaacttttaccctcgaatgaaaatagaggacttaaaactgttgtagagtcattctttaaaaatttaacaattagtaacaaagtct

SEQ ID NO: 157 - DNA, 75 bp, shrimp white spot syndrome virus (white spot bacilliform virus)
ggatcgcctgctctcatgtgaaccgtctcggggaagattttaccctgggacgctattatgcccacagcatgatct

SEQ ID NO: 158 - DNA, 72 bp, shrimp white spot syndrome virus (white spot bacilliform virus)
ggcataagaagcagacacctttcgtcccaaaagtttagaaatttgaagggagagccagtctgccatgtagcc

SEQ ID NO: 159 - DNA, 96 bp, shrimp white spot syndrome virus (white spot bacilliform virus)
ggccctgttccagaaatggctgtccagaaatctgggtcggacagattccagaaacgtttctaaccatttctggaacagtcatttctggaaagggtt

SEQ ID NO: 160 - DNA, 95 bp, shrimp white spot syndrome virus (white spot bacilliform virus)
ggctagcgctagaagaaccttgccctccggagactctgggttccatcctcgaatcttcttttcgggagttctttttagtatagaaacagcctgcc

SEQ ID NO: 161 - DNA, 94 bp, shrimp white spot syndrome virus (white spot bacilliform virus)
ggggagggatttgtttaggggctggaggaggcttgttgatgttgttctcgtctccagaaccgccgccagatttccctccagatcctccttcctc

SEQ ID NO: 162 - DNA, 82 bp, shrimp white spot syndrome virus (white spot bacilliform virus)
gggtggagaagaagaggaacttccttcagcaatatctgaagtgtttgcttcattaccagctgataacgattcctcctcaccc

SEQ ID NO: 163 - DNA, 74 bp, shrimp white spot syndrome virus (white spot bacilliform virus)
ggtccgagctgggttagatggatttctaaggtgggttatctctgtggcgtttagaatcttgtaaccctcggatt

SEQ ID NO: 164 - DNA, 131 bp, shrimp white spot syndrome virus (white spot bacilliform virus)
gtaaaaagaaggagaaaaagaaggataaaaagaagggcggtggtggtggtgacgattctgattcagaaacagattcttcctcatcatcatcatcttcttcttcttcatcctcctcctcctcatccgaagac

SEQ ID NO: 165 - DNA, 80 bp, shrimp white spot syndrome virus (white spot bacilliform virus)
gtactccatgtacactggagaaggaaaaaggggtaaatttgtattagagccacctaaagaaagaagtgtacaaagggtgc

SEQ ID NO: 166 - DNA, 76 bp, shrimp white spot syndrome virus (white spot bacilliform virus)
gtgcagcattatgtatagtaaaaagcaaaccaggattttctttagccaaactctgtataacattagttgccgtcac

SEQ ID NO: 167 - DNA, 110 bp, shrimp white spot syndrome virus (white spot bacilliform virus)
gttcttcattatacatggaaattgcccttgacgtattgaaaatcatgcgtcgttctcgccgcaaacgcttccgttcgtcttcgggcaagttttcttcccttttgagtaac

SEQ ID NO: 168 - DNA, 85 bp, shrimp white spot syndrome virus (white spot bacilliform virus)
gttcttccgattatactggaaagggtattgatcaattggccaatatactaaagaccctgagagaaaatccagatgatagaaggat

SEQ ID NO: 169 - DNA, 103 bp, shrimp white spot syndrome virus (white spot bacilliform virus)
gttgttcgtcgtggctgtagtagcttccgtcgtttttacaactgaaggagctagtgtgagagtgaaacggtgtgctgttagcccgtgccccgacgttattgac

SEQ ID NO: 170 - DNA, 109 bp, shrimp white spot syndrome virus (white spot bacilliform virus)
gttgttgttgttgagtagtacttccaatggtatttaatttgtccaatattgaacgtaattctacaggcacccttctaccagttccaagagcacctccaccgccgatggc

SEQ ID NO: 171 - DNA, 65 bp, shrimp white spot syndrome virus (white spot bacilliform virus)
gtttgcgaaatacgggcaatgttttattatttatagataatgtcacatatggcaactacgcagat

SEQ ID NO: 172 - DNA, 115 bp, shrimp white spot syndrome virus (white spot bacilliform virus)
taatgttgttgtgttgtattttgtatatagagaaaagaataaaataaaaggttaatataatgttgtcttttacattttcctaaacttgatataataaactatatagcaaatatta

SEQ ID NO: 173 - DNA, 121 bp, shrimp white spot syndrome virus (white spot bacilliform virus)
taatttttgattactcttttctagcgtgtatacaactgcagcattgaaaaggcatgacatgtaatttccaatgcttttagctgacgggtgtgtgctgttgtagaaaagtaatccaagttta

SEQ ID NO: 174 - DNA, 93 bp, shrimp white spot syndrome virus (white spot bacilliform virus)
tagctaacccaaaaccttacaatttaactggaaatacatggtctgatgtagtttctgtattgacagataaccctattgtagatgcgggtgctg

SEQ ID NO: 175 - DNA, 84 bp, shrimp white spot syndrome virus (white spot bacilliform virus)
tatcatgactaatatatataggatcatttctctttagataatcacctatgttatcagaagaatcactatttcttagatttgata

SEQ ID NO: 176 - DNA, 102 bp, shrimp white spot syndrome virus (white spot bacilliform virus)
tatggtcaaatgtctgattgtaatgcaattcctctatctattaatattggagtacctctccataaatcgaggatgaacatgcaagacattgaaaagaccata

SEQ ID NO: 177 - DNA, 93 bp, shrimp white spot syndrome virus (white spot bacilliform virus)
tatgttttgtggatgaaatttcttataatgatgaagatgtagacgaaattttgtctgagaatagatcactaagaaatgtttctattagacata

SEQ ID NO: 178 - DNA, 93 bp, shrimp white spot syndrome virus (white spot bacilliform virus)
tcatggaataaatgtgcagtctttcccatattacgtactccgcacatggctaggagaaacagatatattggatgaagatactgtacatcctga

SEQ ID NO: 179 - DNA, 77 bp, shrimp white spot syndrome virus (white spot bacilliform virus)
tccaagaagcagagtcgtatgaccattgacgtcaatgcgtgggcagaggcggaggtggtgataaagcgtttctgaga

SEQ ID NO: 180 - DNA, 118 bp, shrimp white spot syndrome virus (white spot bacilliform virus)
tcctcgactaccagacgagatatgatgctctggggccctgcttcgtccttttataccgtcacttggttagaaaaaacgatagtgtagttcacagtatttgtcccttctggtcttggga

SEQ ID NO: 181 - DNA, 80 bp, shrimp white spot syndrome virus (white spot bacilliform virus)
tctatagtgtaccaagggcaatatcttatttactgttttatcatttttagcagaaggtttttcctttattactctatgga

SEQ ID NO: 182 - DNA, 100 bp, shrimp white spot syndrome virus (white spot bacilliform virus)
tctgttgacgtttttctttaagttccttctcagaaagcgattgattaaacactttagttggttttagaggatcaacaactgtagaacccagcacaacaga

SEQ ID NO: 183 - DNA, 70 bp, shrimp white spot syndrome virus (white spot bacilliform virus)
tcttggtgacgcacacatttataatacccacattgaggtgttaaagaagcagttgtgccgcgtccctaga

SEQ ID NO: 184 - DNA, 78 bp, shrimp white spot syndrome virus (white spot bacilliform virus)
tgaacgataaacttaaatcaattaaatccccttgagcagctccagggggagtgattgataacatgtgtttatcgttta

SEQ ID NO: 185 - DNA, 77 bp, shrimp white spot syndrome virus (white spot bacilliform virus)
tgacccgagccttccgcaagatgaacaacctagtcaatcgcagcttcattgacgttcaccgagtggtggccgagtta

SEQ ID NO: 186 - DNA, 74 bp, shrimp white spot syndrome virus (white spot bacilliform virus)
tgcaccagaaacgactgttgctccagaaacgtacattaacctttgcgtgtttctggaacaggcgtttctgggca

SEQ ID NO: 187 - DNA, 70 bp, shrimp white spot syndrome virus (white spot bacilliform virus)
tgcagcagaacggtctatatttttacgtggagttttaacagtcagtggagattacggatggttttctgta

SEQ ID NO: 188 - DNA, 131 bp, shrimp white spot syndrome virus (white spot bacilliform virus)
tgtatagaaattcctcatttgtgaatgatgttgaagaaataatgacgttttttccaagcaggggttgcctgctgagaggcgtattttattcacaatttcatccacctcatgttttggagtatttttatgca

SEQ ID NO: 189 - DNA, 100 bp, shrimp white spot syndrome virus (white spot bacilliform virus)
tgttctcctcccatatacttttcaatcaaagccgagtcttgttccttggataatttatccatgaccagcttagaatttctccagtacatgggacgaaaca

SEQ ID NO: 190 - DNA, 70 bp, shrimp white spot syndrome virus (white spot bacilliform virus)
tgttgttgtcgtatccagaaaaattgatcacatcttcttggcacaattcactctggttactgccactaca

SEQ ID NO: 191 - DNA, 100 bp, shrimp white spot syndrome virus (white spot bacilliform virus)
ttattgttaaaaaatatgattaaaatgagtagaaacaacccagaatatgcaagacatttttccagttctctcaaattaattggagtaactttggccataa

SEQ ID NO: 192 - DNA, 73 bp, shrimp white spot syndrome virus (white spot bacilliform virus)
ttccagaaatggctgtccagaaatcagattccagaaacgtctataaccatttctggaacagtcatttctggaa

SEQ ID NO: 193 - DNA, 85 bp, shrimp white spot syndrome virus (white spot bacilliform virus)
ttcggttaagtacatagccatcgtacgaaaacaagccactttctctgtcttcttcgtttctggcgtccatgtgtatctggctgaa

SEQ ID NO: 194 - DNA, 93 bp, shrimp white spot syndrome virus (white spot bacilliform virus)
ttgacgcaatttggagatgtaagaagagttgcggaattctgtatgattccgtatttgttgtttctttaatacatcataatagattggtgtcga

SEQ ID NO: 195 - DNA, 70 bp, shrimp white spot syndrome virus (white spot bacilliform virus)
ttgtgtgcgtaaggttgcagaatcagtagcgacaaaatatactgctgacttgactaccttattccaacga

SEQ ID NO: 196 - DNA, 83 bp, shrimp white spot syndrome virus (white spot bacilliform virus)
tttggcgaaatcgcaaatggactgattgggcgtaagaggcgtgaagcagtatctctaacaccagtccatgaagatatgccaga

SEQ ID NO: 197 - DNA, 113 bp, Simian virus 40
gcaggcagaagtatgcaaagcatgcatctcaattagtcagcaaccaggtgtggaaagtccccaggctccccagcaggcagaagtatgcaaagcatgcatctcaattagtcagc

SEQ ID NO: 198 - DNA, 73 bp, Simian virus 40
gtgttggtaaacagcccacaaatgtcaacagcagaaacatacaagctgtcagctttgcacaagggcccaacac

SEQ ID NO: 199 - DNA, 73 bp, Simian virus 40
tctaaggtaaatataaaatttttaagtgtataatgtgttaaactactgattctaattgtttgtgtattttaga

SEQ ID NO: 200 - DNA, 65 bp, Autographa californica nucleopolyhedrovirus
agtattttggcggtgaatcgtttgtttggcgccacggaaacgatcgactttcatcccaacctgct

SEQ ID NO: 201 - DNA, 108 bp, Autographa californica nucleopolyhedrovirus
tgcccgatgacgacggcgcgtgctgtcaccattttatttttgatgcccaacgtattattcaatgtattaaagagattgaaagcgcgtacggcgtgcgtgatcgcggca

SEQ ID NO: 202 - DNA, 70 bp, Avian leukosis virus
actgggtcgggtggtcgtgcccgagggctctgctacacttgtggatccccgggacattatcaggcgcagt

SEQ ID NO: 203 - DNA, 75 bp, Avian leukosis virus
tacagcttagcaccactgctgccttggaacgatgggaccctgccctgcctttggagggagcggtcgctaggtgtg

SEQ ID NO: 204 - DNA, 93 bp, Bovine leukemia virus
accctgagcctctctgagtacatgactgagtgtagcgcagagaggttgtcgcttctgcgtgtcactcagtcattttttatagccgattggggt

SEQ ID NO: 205 - DNA, 82 bp, Bovine leukemia virus
cacttctgcttcaccatccccctgccagcgttggtctagtggaaagaactaacgctgacgggggcgatttcttgcagctgtg

SEQ ID NO: 206 - DNA, 86 bp, Callitrichine herpesvirus 3
aagcgtttgcgtttgcaaactcttcgcatgtttcttgtgtttgtttcaatagaaacatgcgagggcttgctttacgaatttcgctt

SEQ ID NO: 207 - DNA, 78 bp, Callitrichine herpesvirus 3
acctgtcatggcacagactactccatcatgggtttcaataaggtgacactcagaggagccatcacatacatgataggt

SEQ ID NO: 208 - DNA, 78 bp, Callitrichine herpesvirus 3
acgcggggaggtgtatgataggctattaggacgtggatacctgtccgctcttcgttactatgatacatatctaaatgt

SEQ ID NO: 209 - DNA, 128 bp, Callitrichine herpesvirus 3
acgttgccgagaggcggccaacaaatgttggcaccaacaaacgttgcccaaaacccaatcacacagtctcaagggtcctcgtcaacaaatggtggtgcccacatttgttggccgccttctggcaacgt

SEQ ID NO: 210 - DNA, 93 bp, Callitrichine herpesvirus 3
agagtttcggtcctcttatctatgtttgttacttttagatgcctatgctggaaggtaaagtaatcaataacggtaagattttccaaaacgtct

SEQ ID NO: 211 - DNA, 123 bp, Callitrichine herpesvirus 3
aggccctaacaaatgacaagatatagattagttaaagcagaacgatttattgacttctctctgatatgagctgagtgtagttgatgatttgtaatcttaattcatcgctccagtctaggccct

SEQ ID NO: 212 - DNA, 100 bp, Callitrichine herpesvirus 3
aggtggcatatattagagggacccggtcgcataaatcttaccaagccttgaagttaaggactaagaatggcgactcactggtgcctcgcttgtgccgtct

SEQ ID NO: 213 - DNA, 71 bp, Callitrichine herpesvirus 3
agtttgacacgctatttgaaataataaatcaaaaatatttatttcatgatccgaccgcgatgttacaagct

SEQ ID NO: 214 - DNA, 112 bp, Callitrichine herpesvirus 3
agtttgttcacttctgagaattctactgtctacatacagaagggtcacacccattggctaaacttctgtgcgactagacagtcccgggggaagtctaaaaataccgaagact

SEQ ID NO: 215 - DNA, 127 bp, Callitrichine herpesvirus 3
catggtataagccaaaaatcattacttcctcttccaggggctagtctgccaattaactgtctgatcaagttactagaaataggatagcctctgtgggggactttacacaaatggctcaaacaccatg

SEQ ID NO: 216 - DNA, 63 bp, Callitrichine herpesvirus 3
catgttaatcacctataactgtacatcttataatcatataggacaggaggtatcaatgacatg

SEQ ID NO: 217 - DNA, 75 bp, Callitrichine herpesvirus 3
ccaagtttggataggtgaacacccactgacagtaagctttaaacttagactttactgcaccatccttaaacaggg

SEQ ID NO: 218 - DNA, 131 bp, Callitrichine herpesvirus 3
cccggccaccccttgggggttctggggacacggtggctggctgccccgacatctagttggccactagagggctgtctaagtgtcttggcagccagcaaccgtgtccccgaaacccccaaggggcggccggg

SEQ ID NO: 219 - DNA, 93 bp, Callitrichine herpesvirus 3
ccgtaaattcatcatcgttgtcattatcggagagttcatttgtgatttcgatctcattttcatcatcggcgataagacaaggtgtttccacgg

SEQ ID NO: 220 - DNA, 117 bp, Callitrichine herpesvirus 3
cgcccatacagcacacacccaacacaattacaactgcccgcccctctataactccacctggcacatgcggtgtagggcgtggtggtttcggcctgggggtactgtgctgtggcggtg

SEQ ID NO: 221 - DNA, 72 bp, Callitrichine herpesvirus 3
cggccgttgcgtcttttgtacagggtttagatggtgttcttctgactgttgtactcgcgatggcaatgggcg

SEQ ID NO: 222 - DNA, 130 bp, Callitrichine herpesvirus 3
ctcgaatcactaggtgtgaagcccatcacatgacctgtgtcattcggctggtcaaaacacttggtgttttgaccagccgtattcatgcatcttgtgtacattagtttcaggcaaatttaccacgattaag

SEQ ID NO: 223 - DNA, 130 bp, Callitrichine herpesvirus 3
cttgcaggctgagtaaatgtaaaggctggcggattctctggctgcggctgggatataggctgctgttgatttacagtaggcgcattcgtaaactggctgcagtgttccgtcggctgtggcacggctgagg

SEQ ID NO: 224 - DNA, 131 bp, Callitrichine herpesvirus 3
ctttactcgtctcttgttcatcatcaaggtgaagaatgttaaggacactaccactcaactttttgagctgtgctgcacttcttgacagttttgtgaattctccgcgtggtataggcagatgagtgagaaag

SEQ ID NO: 225 - DNA, 76 bp, Callitrichine herpesvirus 3
gacggacgatacaggcgcttgggcccaagaattgtccacatttttggcatctatggctcaacctgtcatacacgtt

SEQ ID NO: 226 - DNA, 83 bp, Callitrichine herpesvirus 3
gatgcgtgatttccttgatgttgacaacttttgttccaacagtatatggaaccctgtaaattagttgatatcttttacgcatt

SEQ ID NO: 227 - DNA, 66 bp, Callitrichine herpesvirus 3
gcaggtgagttgtggcagaggggactttagtttacataactgctcctctgaagctccggagcctgc

SEQ ID NO: 228 - DNA, 109 bp, Callitrichine herpesvirus 3
gctctttttgtgcactcggtgaggtttggtgaaggtctggagggggccatgtttggatcttaattaacgctgtgccttccagatccgccacccatggaggctccggagc

SEQ ID NO: 229 - DNA, 117 bp, Callitrichine herpesvirus 3
gcttttaagtttcagtgactttggagaggtggctgattttattggtatttgtaaccaaccaccaacatataccacctttaagatatttatcgaagtaacacttggacgacgcagagc

SEQ ID NO: 230 - DNA, 85 bp, Callitrichine herpesvirus 3
ggcacatttccatggtatccttattgagcttttttcttgtaaacgcgggaaagtaatcaagatccctagtccattgagatgtgcc

SEQ ID NO: 231 - DNA, 77 bp, Callitrichine herpesvirus 3
ggcgtccgaggtaggagattgatccaaagtgcaaattcacttcggtaaagtccactgtgtttggttcctgggccgcc

SEQ ID NO: 232 - DNA, 109 bp, Callitrichine herpesvirus 3
ggctttgtgccacgtagaaagagcagggcttcttggcgcggtagccttagtgggagaatctcgctgcatcgctgggacttggtcactcttttggtcggcagacaaagcc

SEQ ID NO: 233 - DNA, 81 bp, Callitrichine herpesvirus 3
gggcctcaaacggaaacccttgttcaggcttccgcctgttcatctcaacaattggagcctggcaaagttttcaccccgccc

SEQ ID NO: 234 - DNA, 103 bp, Callitrichine herpesvirus 3
gggtcgaagaatggttgtttggcagccttatatttcgagcatctccttttttctcgcgttgaccaatggaatggctgtagagcacatcattctcctttgaccc

SEQ ID NO: 235 - DNA, 122 bp, Callitrichine herpesvirus 3
gggttcctcatttctagctagtattttttgatagactattaggtggggcatctgcgtgcttttgtatgcagaaatttgtctgctgagttctgtagtgaatgacagttctgatatgggaaccc

SEQ ID NO: 236 - DNA, 72 bp, Callitrichine herpesvirus 3
ggtcccaccctacaggttaatcctcctggttcaatctgggctcctattggttaatacctgtaggttgtgacc

SEQ ID NO: 237 - DNA, 127 bp, Callitrichine herpesvirus 3
ggtggctgaactttaaaagcgtatgggggtgggggcgatgatcagaacacataatctactctgattctggggtggattcaactagcgccatcctttccattatatgccttggtggagttcaactact

SEQ ID NO: 238 - DNA, 97 bp, Callitrichine herpesvirus 3
ggtttgggtaaggttttgcgagttgaactctgtcgacggattattatcccggtaggacaaagacggccaaatctcaatcatatttctgccctaaacc

SEQ ID NO: 239 - DNA, 74 bp, Callitrichine herpesvirus 3
gtgatggtagccgatgtggtgcttgccgccattaacttatttgtgctgcttccattaatttggtatatcatcac

SEQ ID NO: 240 - DNA, 113 bp, Callitrichine herpesvirus 3
gtggctccaattattccggtgaacatcacattgcagattatgcgcatgcgcgtggaaaggcgcgtgtgccaaattttgtatgtgatgtagcacgtggctataattgttgctac

SEQ ID NO: 241 - DNA, 84 bp, Callitrichine herpesvirus 3
taattgcatgtctcatggcttgtcaataaacactttaagcatttatggtgtgttttctgttttattgcatatagattgtagtta

SEQ ID NO: 242 - DNA, 70 bp, Callitrichine herpesvirus 3
tagaggatgtagtagaaggtgatactacacagacataaacatggcgtagaggttttctggtactccttta

SEQ ID NO: 243 - DNA, 99 bp, Callitrichine herpesvirus 3
tatttcccattggttgcctctagttcataggaaatgtcttcgagaaacttaatcactgcctgagttcttggaaccgtttctgtaatgagtgagggaata

SEQ ID NO: 244 - DNA, 126 bp, Callitrichine herpesvirus 3
tcattcagccatgtgcttatcggttggctattattgccagagaacaaagtccactacacctatacccaagacgttctctgaaatgtttgatctgatgcctgccgccctggagtttataatgaatga

SEQ ID NO: 245 - DNA, 63 bp, Callitrichine herpesvirus 3
tgcagctgaaattgagaatgggcggagctagagacctgctgaagctccgccctgtgggttgta

SEQ ID NO: 246 - DNA, 131 bp, Callitrichine herpesvirus 3
tgctgggaattgatatcttatgatctgaccaacagaaggacacggggggagttcttgacatgtagcatcgagttccagaacttgtttgtttgttattttgacatgagatttgtatagttcatatttccaca

SEQ ID NO: 247 - DNA, 92 bp, Callitrichine herpesvirus 3
tgtaacatgtgccagaacctagctctatttcagggtgccacccatgtggcatgggatggggcctctcttagtaggtgggatgcgcagttaca

SEQ ID NO: 248 - DNA, 117 bp, Callitrichine herpesvirus 3
tgttcccaagatacgtttggcgaccgtgtctaatttgtagtctgacaggcttagtttttctttacaaactgaatacatgtctatgggaataacacccgatatgcgtattttggtgca

SEQ ID NO: 249 - DNA, 115 bp, Callitrichine herpesvirus 3
tgttgtgtgggataagcccaggaatagttgtctggttgctcttccagagatacaaacacgtccacttttaaagacagccataacttatcctggccgatatctaagcccacaaaca

SEQ ID NO: 250 - DNA, 104 bp, Callitrichine herpesvirus 3
ttatgtttgtgatgatcacagggaggaatttgacatgcaagactctatggtggcttgtccttgtttcagactgcgtattccctgctacatcaccctggacataa

SEQ ID NO: 251 - DNA, 123 bp, Callitrichine herpesvirus 3
ttttgctaccatatctatgtagaagttttaaccactgtgatgcgttttccgaaggcaggattggcgacagctcctccgtcgcagcctttccaccgcataacttattcactatgtgtgccaaaa

SEQ ID NO: 252 - DNA, 70 bp, Epiphyas postvittana nucleopolyhedrovirus
aaagaacgtttggcaacgtggtacaagtgcggcaatacaaaaggagtgtgccatgaagtttacgttgttt

SEQ ID NO: 253 - DNA, 85 bp, Epiphyas postvittana nucleopolyhedrovirus
acgtgccagtgggttgcgcgccacacggacgcgtcgccgacattaacagcggcgacattcgttgtgtgtgcgacgacgggtacgt

SEQ ID NO: 254 - DNA, 95 bp, Epiphyas postvittana nucleopolyhedrovirus
atcgccgttgtacgacaatttgattgggtcgttggtggcatgtaatctaaaatacacaccgtcaacttcatcaaaccgttcgtgaaacgcgcgat

SEQ ID NO: 255 - DNA, 114 bp, Epiphyas postvittana nucleopolyhedrovirus
atttgattcaaaaacgtgttggttgtcaaataagcgtagactagtttgcggcatcccaaagccggtccatagatatctagcgtttttttgcaaaaacttgtaatattttcaaat

SEQ ID NO: 256 - DNA, 130 bp, Epiphyas postvittana nucleopolyhedrovirus
caactcgttttgtctccgcttcattcgacaattctacggcggtgtgcgtgttatatgccgtcactgtgctaagcgtgttgcacgtcacgcgttggctcttttttgaatggacaattttgctagaacgttg

SEQ ID NO: 257 - DNA, 115 bp, Epiphyas postvittana nucleopolyhedrovirus
cagcttgaagattttgaatatttatagtgctagcatccatgttattttcgcgtaactggtcccaatgcgttttgatagcttgagtgtcgcgcactgtctcgactgctttaagatg

SEQ ID NO: 258 - DNA, 73 bp, Epiphyas postvittana nucleopolyhedrovirus
cgcaattgcagcgtgaatttgctcagctttatttaccgtggtggcagctgggcgtcgtgcgttggatgttgtg

SEQ ID NO: 259 - DNA, 109 bp, Epiphyas postvittana nucleopolyhedrovirus
cgcaatttcaggcggtaaacgcttcattgtgctttgcaacaactgacattagcttgtgaacatacagatttatatagcgtttacagttcgtctctcattttgaattgcg

SEQ ID NO: 260 - DNA, 82 bp, Epiphyas postvittana nucleopolyhedrovirus
cgcagactttgatttgaaacggacattccatcgtaagccttatacttatgaaattggcgttgacaaattatttaagtttgtg

SEQ ID NO: 261 - DNA, 123 bp, Epiphyas postvittana nucleopolyhedrovirus
cggtgccgtcgggaattgctttaagtattaacgacgctgacgccgatgaaccaattatatactttgaaaatattaaagaatgtttaggcgacgcgtcgtgtgacaagcttacctactttgccg

SEQ ID NO: 262 - DNA, 61 bp, Epiphyas postvittana nucleopolyhedrovirus
cgtcatgccacatcgtgttttacattttttgttgaaaatgtaaaacacgtgtgggatgatg

SEQ ID NO: 263 - DNA, 80 bp, Epiphyas postvittana nucleopolyhedrovirus
cgtgattcattaaacgggccactttttgcaatggcacgccgctgttgtacaaattgctgctcaaataatgccttatcatg

SEQ ID NO: 264 - DNA, 119 bp, Epiphyas postvittana nucleopolyhedrovirus
cgtgcacgcacatatgcttgaagatgattccggtgaaattaaagattatataagagcaaatttaagccgctttacagtaatcactggcaaatgttcgaagcgtaaggtgtgccatcacg

SEQ ID NO: 265 - DNA, 62 bp, Epiphyas postvittana nucleopolyhedrovirus
cgtgttggtagatttgaggttggaatatgacaaacagcaaccagcagattaatgccaacacg

SEQ ID NO: 266 - DNA, 60 bp, Epiphyas postvittana nucleopolyhedrovirus
cgttgtcggagccgagcactagcgggacaaaacgtaaaggcgcacccgattcggacaatg

SEQ ID NO: 267 - DNA, 131 bp, Epiphyas postvittana nucleopolyhedrovirus
ctgcacaaacgtatacggcgttgtgatttccatgtcaatgctctcttagtttaacacataatacaaatggccatttgtaattagtttttgttctaaattttttgataacgttcgctttgtaataaatgcag

SEQ ID NO: 268 - DNA, 76 bp, Epiphyas postvittana nucleopolyhedrovirus
gaagcattcgaattcagttatgccggcgctaacgaaattaatctaaacactggcaaagtgaaacccgacgtgtttc

SEQ ID NO: 269 - DNA, 105 bp, Epiphyas postvittana nucleopolyhedrovirus
gaagctatcctcaacgaatcgagtccaagtttcacgcagaaactctttgccgctccagttgacaatgagtttcatcgtgtcgggcttgacgttgcggatttcttt

SEQ ID NO: 270 - DNA, 86 bp, Epiphyas postvittana nucleopolyhedrovirus
gataaacttgtcgctgttcacgttcaatgttttaatatgctttagcacagttttaatgttgtcacgcacatcatcgcagtcgtatc

SEQ ID NO: 271 - DNA, 102 bp, Epiphyas postvittana nucleopolyhedrovirus
gatcccaacgcgtttgtattgacgggtgacaaaagcgaggttaaaatgcattgtccgcaacattttaactttgattataaccaattaaaatgcgtgccgatc

SEQ ID NO: 272 - DNA, 64 bp, Epiphyas postvittana nucleopolyhedrovirus
gatgtcgacacatttgatacaattttgttgaatatcactaacaagttgccagaagtgttacatc

SEQ ID NO: 273 - DNA, 130 bp, Epiphyas postvittana nucleopolyhedrovirus
gattgtgaacgcgtaaaatcaacttttagtaagcgttttaacactaagctaatcatataaattaaaccggtttgctgctttattttacagttgcttgttgtacaatattaaaaacatacgcgcgttgatc

SEQ ID NO: 274 - DNA, 70 bp, Epiphyas postvittana nucleopolyhedrovirus
gccaattgtgtaaagttgtcctgaccatgctcaccttggtggcaaacgtagttgactttacaagttcggc

SEQ ID NO: 275 - DNA, 98 bp, Epiphyas postvittana nucleopolyhedrovirus
gcgacacacaggtgttgttctattacaaatgctacatttgtacattgacttatcaaaaataatgttcgtgtagcatttaaaacacactgcgtgattgc

SEQ ID NO: 276 - DNA, 66 bp, Epiphyas postvittana nucleopolyhedrovirus
gctgtagtagtgatagtagctttactaattatttttattcaatctagcagcaacggtaacaacagc

SEQ ID NO: 277 - DNA, 95 bp, Epiphyas postvittana nucleopolyhedrovirus
ggcactggtaagcttgtagttactgtagcagagcacaggtaagactgatttacaagtttgttacaggcctttatatacccatgtttatcagcgct

SEQ ID NO: 278 - DNA, 69 bp, Epiphyas postvittana nucleopolyhedrovirus
gtatttattaacgaggcttatttaaaaggagcgcgaacaacgctcaaaaagcttttatttagtgataac

SEQ ID NO: 279 - DNA, 107 bp, Epiphyas postvittana nucleopolyhedrovirus
gtgtgcttctcaacaagaacatgacaaagagcgcgtttgtgaacgcgtaatggcacacaacggtggagaggatgcgctattgaattggaacttgttgtccgccacac

SEQ ID NO: 280 - DNA, 95 bp, Epiphyas postvittana nucleopolyhedrovirus
gttgacatgaatgttaacttttacgaattgctgtacccgttgactctctacaacgacgagtctagccgtatcataagttacatatttgcgtcggc

SEQ ID NO: 281 - DNA, 96 bp, Epiphyas postvittana nucleopolyhedrovirus
gtttttaaaatttccaacaggttttgtaactcattagccatgtgattttgatgtataaatttatcaccactcttgtttacattgttgtttaaaaac

SEQ ID NO: 282 - DNA, 82 bp, Epiphyas postvittana nucleopolyhedrovirus
tatctcatcatgagcaaaccttaaataaaaacaaattttttcatataaataacatttatttgcgtttgttttctttgttgta

SEQ ID NO: 283 - DNA, 128 bp, Epiphyas postvittana nucleopolyhedrovirus
tatttgtaaagcgagttcgcgaagcacatgagtcaccgagcattggcctcgcttttcaagtagcattatatttgtaaagcaggttcagagcacatgagtcaccgagcattggcctcgcttttcaagta

SEQ ID NO: 284 - DNA, 102 bp, Epiphyas postvittana nucleopolyhedrovirus
tgacattttaaaaagcaaatcgcaaaaagcgtttgacgttgctgttgaaactgacggcaaagatttaaatagcatgcaggatgtgctttcgttactatgtcg

SEQ ID NO: 285 - DNA, 89 bp, Epiphyas postvittana nucleopolyhedrovirus
tgatcgccaattaatgacttgtgtgcaagcgcacccatgcgcgtttaacggcgctgggcatacttacatcacagccgatattggcgaca

SEQ ID NO: 286 - DNA, 86 bp, Epiphyas postvittana nucleopolyhedrovirus
tgcgcgttgaggcggctacgcgcggtcaaagcaaaaatgacttgtggttttgtttgcgttccgatcgcagcaccgcgtcacgttca

SEQ ID NO: 287 - DNA, 67 bp, Epiphyas postvittana nucleopolyhedrovirus
tgtcaattggccaacagcgcgacttgttaaccaactgtgcttctgaaattgccaatttaaaaagaca

SEQ ID NO: 288 - DNA, 86 bp, Epiphyas postvittana nucleopolyhedrovirus
tgttgcccacggtgataataaagtaagtcaagtgtatgtggccgacaagccactgtcgatggatgatattgttaaacaaggcaaca

SEQ ID NO: 289 - DNA, 122 bp, Epiphyas postvittana nucleopolyhedrovirus
ttgaaaagcgaggccaatgctcggtgactcatgtgcttcgcgaactagctttacaaatataatgctatttgaaaagcgaggtcgatgctcggtgactcatgtgctctgaacttgctttacaa

SEQ ID NO: 290 - DNA, 74 bp, Equine herpesvirus 4
cggcttctatggtgagttgtcggttgggggacaacgaggacccctcccatatactcgagtagctatttaagtcg

SEQ ID NO: 291 - DNA, 74 bp, Equine herpesvirus 4
gggtgaggggggttgagttttcgggggtgagcaataaaacgtcgtctattgcccccgacgaacagtctttaccc

SEQ ID NO: 292 - DNA, 62 bp, Equine herpesvirus 4
ggtagcgtagagagtagcatccacaaacgataagtttactaatgttagcatcgagcgccacc

SEQ ID NO: 293 - DNA, 98 bp, Human adenovirus E
aatttcatcgcatgaatactggagataaagctgtgttgtgtgcactttgctatatgagagcttacaaccattgtgtttacagtaagtgtgattaagtt

SEQ ID NO: 294 - DNA, 64 bp, Paramecium bursaria Chlorella virus 1
tatcaagcgggttctaatatatcaaacgtgtatgacacgattataatcggaacgtcgagtggtg

SEQ ID NO: 295 - DNA, 74 bp, Human herpesvirus 6
ctttgacttttccttttgttccttgtcggatatttattatctgactggacctggcattctagagaaaatcacag

SEQ ID NO: 296 - DNA, 96 bp, Pothos latent virus
acttctctcgagagggtgcccactaagctgcggcctagactagcttgcaagattgctgtcagggctatagccaaagtgggattacttaagaggagt

SEQ ID NO: 297 - DNA, 101 bp, Pothos latent virus
ggagaaatcaacagtctcgctcgttatagtttttggttggcattcggtattacaccggatgaacaactcgctattgaacgtgacctgatgaattggactcc

SEQ ID NO: 298 - DNA, 109 bp, Pothos latent virus
taggggtgcctattacaacaccgtggttataacactgctatcattagcgccataccagatggagtgttattgaatcacgaagggatggtggtacgtaaaggagccccta

SEQ ID NO: 299 - DNA, 120 bp, porcine enteric calicivirus
gtcctcttttacacctcaggacaggctgccgtctgggccacacctgcgcgctttccaatagttacgccaggagaggcgtcagttggcaaggaggtttgttcagagtcctcctggtgggac

SEQ ID NO: 300 - DNA, 70 bp, Murine adenovirus A
gagctattgcacaagatgtgtttggtgttaaaagttgatggcaagcagtgtaccttcttgcccaatgctc

SEQ ID NO: 301 - DNA, 66 bp, Cryphonectria hypovirus 3
cagtgagcttcatctagataaagctagcctgaaggctggcttgcacaggatgattgaggctgactg

SEQ ID NO: 302 - DNA, 109 bp, Cryphonectria hypovirus 3
ggtaatcaagaagctacggaaaaaaggtttccaaaaacactctcaacgtgatgctatcgagagtgctattgatgcaacctatgacaatctcgttgcttcttggattatt

SEQ ID NO: 303 - DNA, 97 bp, Cryphonectria hypovirus 3
gtactctgcactgtttggtatgcacgtaggtgactttggtgacgagatggacgtcttcaagttcctagcaaatatagatctgatggtgtatgagtac

SEQ ID NO: 304 - DNA, 118 bp, Cryphonectria hypovirus 3
tcttactgtctaacggatctgaaagggtgtgctctgaagcaggttgggaaccatccgattatccaagctgctgcaaagaaacagaacacattttgtcatgcttctgaagatgttagga

SEQ ID NO: 305 - DNA, 66 bp, Myxoma virus
ataccatgtctaacacggcagatcgacagctgcataagaccgttgtgatcaacccaaacatcgtat

SEQ ID NO: 306 - DNA, 118 bp, Myxoma virus
gttttccgcggacgatataaaaaccatcctagaatcggacacgtttatgaagtacagcaagtctaaacctgccgcgatgtatcaatatctgattctttcgttcttcgtcagcggtaac

SEQ ID NO: 307 - DNA, 64 bp, Myxoma virus
ggggttgtttaacgcgagcaacgtcgattatctatataataaagctaagcaattatacagctcc

SEQ ID NO: 308 - DNA, 131 bp, Myxoma virus
aaatccgtcatcaaacccacgcgggacgagtcgttgacgtgtattcttccgacgtactacaatacagtcgcgaatgtatctatacccgtcaatacaaacaccgtaacgtgttggttttgtaaacaggattt

SEQ ID NO: 309 - DNA, 84 bp, Myxoma virus
tatataccctgttcgataacagacgagccgtgtacaagaatatcgtcgatgtagcccgatgtctgttatcaaacggggcagata

SEQ ID NO: 310 - DNA, 130 bp, Rabbit fibroma virus
acaacattaacggtcaacggcgtagaattagaatatattagagaaaaagaaacggaaggtatccgcggtgctaaagcgtctacggtctgtttttttgttttaatactagccgttagtgccttgttgttgt

SEQ ID NO: 311 - DNA, 65 bp, Rabbit fibroma virus
gatgaatgaactgggatacagtggatactttatacgagatcactggtgttccaactatcataatc

SEQ ID NO: 312 - DNA, 131 bp, Rabbit fibroma virus
tgtgttgattttggatcgtatcttatccctattaagttggatacggttacgttcttacctcaggctatacgccgagggacgggcgatgggtggatggtcaaaaaggcagataaagtggatccgtcggctca

SEQ ID NO: 313 - DNA, 93 bp, Rabbit fibroma virus
cgggttaacgagatgaaacacggactatggaacagagctagtcaatggatgtctggcaagttccctaacataacgtacttcctatcgcatccg

SEQ ID NO: 314 - DNA, 75 bp, Rabbit fibroma virus
aggtgcattggatatgattatcctgtttacggaagtgtatacgtcgatcatgccggaagaattacaattgcatct

SEQ ID NO: 315 - DNA, 131 bp, Rabbit fibroma virus
ttggaagttacaaaatttgtatctatcttttctgtaaaagagtgcaatgcccagcagaacaaagtgctcaggtgtatgagatcaaacttttctattacacgaacgaccgatacggataaaactagttttca

SEQ ID NO: 316 - DNA, 130 bp, Human herpesvirus 5
gtgctgctgacgatggtatggggtgccgcacccgtgataatgatgacgtggttctacgcattcttctactcaaccgtacagcgcacgtcacagaaacaaaggagtcgtaccttaacctttgttagcgtgc

SEQ ID NO: 317 - DNA, 93 bp, Human herpesvirus 5
cggcgttgtttttcctctttctgatactggatcgtctgtcggccatatcttacggccgtgatctctggcatcatgagacgcgcgaaaacgccg

SEQ ID NO: 318 - DNA, 94 bp, Human herpesvirus 3
tcgatacacaagcggctgccatttacgaatataactggccgactatcccaccccactgtgcggttccggttatagccgttctaacgcctatcga

SEQ ID NO: 319 - DNA, 118 bp, Human herpesvirus 3
cggttagctgccttaaccctggagttattgtctggaacaaacaaagcccccttacacgaagcagcggttaatggggcgggtgccgggattgactgtgatggtgcagctacttctgccg

SEQ ID NO: 320 - DNA, 85 bp, Human herpesvirus 3
ggatgatgtaatttttacggcacttaacgacgaggttattgacttggtatactgccagtacgaattttcctatcccaaatcatcc

SEQ ID NO: 321 - DNA, 107 bp, Saimiriine herpesvirus 2
aaacctcagaactgggcaagtgccggtagaggaattaacattttctacagaattgagtagacctatttcttcttacaaaactgaaaacttgcctcatttaactgttt

SEQ ID NO: 322 - DNA, 74 bp, Saimiriine herpesvirus 2
aagaccctgaggtaaaagcagctgctcagcttttgtcaacaaaagatccagactatgcttttagagaagggctt

SEQ ID NO: 323 - DNA, 82 bp, Saimiriine herpesvirus 2
agtaacttgtaatgctgtgtatgggtttacaggagttgcgtcaggcttgctgccatgcataagcattgcagagactgttact

SEQ ID NO: 324 - DNA, 109 bp, Saimiriine herpesvirus 2
attcagatttcatgtgtgttttggcacgctggggcgcttgatacaactagaaatatgctattatctttaggaacgtgctcagctgttgaaaatactgaagtttatgagt

SEQ ID NO: 325 - DNA, 85 bp, Saimiriine herpesvirus 2
cacattcaggcatctcttctatctaggctcttaactgtgtggctttctaagagaaaagctattaggcaaaagcttgctgaatgtg

SEQ ID NO: 326 - DNA, 65 bp, Tobacco mosaic virus
acccttgcatggcaagatcctgacttttacccaatcggataaagaagctctgctttcaagagggt

SEQ ID NO: 327 - DNA, 129 bp, Tobacco mosaic virus
agccgcggaaatgatcagaagacgtgcgaattcctcagggattattgtggccacgaaggacaacgttaaaaccgttgattctttcatgatgaattttgggaaaagcacacgctgtcagttcaagaggtt

SEQ ID NO: 328 - DNA, 73 bp, Tobacco mosaic virus
caagtactacactgttgttatggatcctttagttagtatcattagagatctagagaaacttagctcgtacttg

SEQ ID NO: 329 - DNA, 66 bp, Tobacco mosaic virus
ctactgaggcgaatgttgcgctagctttacaggatcaagagaaggcttcagaaggtgctttggtag

SEQ ID NO: 330 - DNA, 127 bp, Tobacco mosaic virus
ggcagattcgttaattcgtaagcagatgagctcgattgtgtacacgggtccgattaaagttcagcaaatgaaaaactttatcgatagcctggtagcatcactatctgctgcggtgtcgaatctcgtc

SEQ ID NO: 331 - DNA, 87 bp, Human adenovirus C
cagagctgtcctatcaactcttgcttgattccataggtgatagaaccagatatttttctatgtggaatcaggctgtagacagctatg

SEQ ID NO: 332 - DNA, 83 bp, Black beetle virus
acacaaggacccgcaatacacatccatgattgtccagtattatactggcaagaaggtagtgtcaccaattagtccaactgtgt

SEQ ID NO: 333 - DNA, 102 bp, Black beetle virus
ccgactgagatcgccgacggtgtttgtgagtttgttagtgaatgtgacgctgaagtcatagaaactgacttctccaatcttgatggcagggtttccagctgg

SEQ ID NO: 334 - DNA, 82 bp, Human enterovirus C
ccactgaggtacaaagatctgaagattgatgtgaagacagttcccccccctgagtgcatcagtgatttattacaagcagtgg

SEQ ID NO: 335 - DNA, 61 bp, Human enterovirus C
tcctggtgcatccagtgatgccaatgaaagaaattcacgaatcaatcagatggaccaagga

SEQ ID NO: 336 - DNA, 70 bp, Avian infectious bronchitis virus
aaacactggaaaggtttttgtgtacagttgaaaagagctaagctcattgtcaccgaaaccttctgtgttt

SEQ ID NO: 337 - DNA, 93 bp, Avian infectious bronchitis virus
actagttgttgttgtattaatctttgcaatggttataaagtttcaaggtgtttttaaagcttatgcaaccactgtttttataacaatgttagt

SEQ ID NO: 338 - DNA, 77 bp, Avian infectious bronchitis virus
caagatagtttttacagccgatgatgttgaggacaaagaaattctctacgtccccacgactgataaaagcattcttg

SEQ ID NO: 339 - DNA, 67 bp, Avian infectious bronchitis virus
cctgtgtctaagagtgttatagataaagtgtgtagcattttgtctagtataatatctgtagatactg

SEQ ID NO: 340 - DNA, 116 bp, Avian infectious bronchitis virus
cttttacatactttttacagcatgttgttcgggttattactatatggaggtgagtaaaagttttgttcaccccatgtatgatgtaaactccacactgcatgttgaaggttttaaag

SEQ ID NO: 341 - DNA, 65 bp, Avian infectious bronchitis virus
gatgaaatttttgaccccactgaaatactttggcttcaggtggctgcaaaaattcatgtttcatc

SEQ ID NO: 342 - DNA, 76 bp, Avian infectious bronchitis virus
gcaagaggttagcgtggttgttggtggacgcaagcagatagtgcatgtttacactaactctggctataacttttgt

SEQ ID NO: 343 - DNA, 125 bp, Avian infectious bronchitis virus
gcagaagatgtttggtcttcatttactgaaaagtcttttgaattctggaagcttgcatatggaaaagtgcgcaaccttgaagaatttgtgaagacctatgtttgtaaggctcaaatgtcgattgt

SEQ ID NO: 344 - DNA, 129 bp, Avian infectious bronchitis virus
gctatatgaattctttcaatacttctttgttaatgctgtatcagtttgtgaagttaggttttgttatttacacctcttctaatactcttactgcatacacagaaggtaattgggagttattcttcgagt

SEQ ID NO: 345 - DNA, 63 bp, Avian infectious bronchitis virus
ggtgatagtttcactatagcttgtgcttatggtggtacagttgtaggactctaccctgttact

SEQ ID NO: 346 - DNA, 131 bp, Avian infectious bronchitis virus
ggtgctatatctaatgttgttgtcttacagtctaaagggcatgaaacagaggaagtggatgctgttggcattctttcactatgttcatttgcagtagatcccgcggacacatattgtaaatatgtggcagc

SEQ ID NO: 347 - DNA, 101 bp, Avian infectious bronchitis virus
ggttttatagtgtgtaatacacagagtgctcatgcattagaggaagcaaagaatgcagccatctattatgcgcaatatctgtgtaagccaatacttatact

SEQ ID NO: 348 - DNA, 64 bp, Avian infectious bronchitis virus
gtggcgcaaataatacggatgaagtaatagaagcttcgttaccgtacttattgctttttgctac

SEQ ID NO: 349 - DNA, 60 bp, Avian infectious bronchitis virus
tggtttgtctacacaagtaacccagtaatgtttacaggaatacgtgtgttagattttcta

SEQ ID NO: 350 - DNA, 62 bp, Avian infectious bronchitis virus
tttgagtgagtattgtgatgacatacttaagaggtcaactgtattacaatcggttactcaag

SEQ ID NO: 351 - DNA, 63 bp, Avian infectious bronchitis virus
ctaatgtgaccgactcagctgttagttataattatctagcagacgcaggtttggctattttag

SEQ ID NO: 352 - DNA, 67 bp, Avian infectious bronchitis virus
ctattaggtactccttttgtggtaatggacgacatgttctaaccataccgcaaaatgcacctaatgg

SEQ ID NO: 353 - DNA, 90 bp, Avian infectious bronchitis virus
ctttatttaatgttactgaaaatgtgctcatacctaacagtttcaacttaactgttacagatgagtacatacaaacgcgtatggataagg

SEQ ID NO: 354 - DNA, 85 bp, Avian infectious bronchitis virus
gtgattcaagaaatctaccagcaatttgacgccatacaagcaaatgctcaagtggatcgtcttataactggtagattgtcatcac

SEQ ID NO: 355 - DNA, 77 bp, Avian infectious bronchitis virus
atgctatgaaccagagagcttaccgtatgcttggacttaatgttcaaacagtagattcttctcaaggttcagagtat

SEQ ID NO: 356 - DNA, 72 bp, Avian infectious bronchitis virus
cgcctgagggacttgtagatacttcaataggcaataattttgagcctgtgaattctaaagcacctccaggtg

SEQ ID NO: 357 - DNA, 80 bp, Avian infectious bronchitis virus
gcttacaagagctaagcgtggtatactagttgtcatgcgccagcgtgatgaattgtattctgctcttaagtttacagagc

SEQ ID NO: 358 - DNA, 74 bp, Avian infectious bronchitis virus
ggcacagagttacacccaacttctacaggtagtggattgacatactgtataagtggtgctaatatagcatggcc

SEQ ID NO: 359 - DNA, 78 bp, Avian infectious bronchitis virus
gtatttatgttaaacctggtggcactagcagtggtgatgctactactgcttatgcaaacagtgtttttaacataatac

SEQ ID NO: 360 - DNA, 66 bp, Avian infectious bronchitis virus
tcaaactggtaatgctgctataaacgattatgattattatcgttataacaggcctaccatgtttga

SEQ ID NO: 361 - DNA, 67 bp, Avian infectious bronchitis virus
tgatattgtagactatgtgtctgatgcacatgtttctgtgctttcagattgcaataaatataataca

SEQ ID NO: 362 - DNA, 81 bp, Eggplant mosaic virus
agcacgcttgggtcactccaaacgcgtgggacaatctgcagaccttgtctgtcaatgccccccaccgcccccaagtatgct

SEQ ID NO: 363 - DNA, 94 bp, Eggplant mosaic virus
caggcttacgcgcatgaatcttccatcacccatgccaaaaacctcatctccaacatgaagaatggttttgatggaatcatgtcttctctcactg

SEQ ID NO: 364 - DNA, 69 bp, Feline immunodeficiency virus
gatggtggaatcaaatggcctattataacagttgtaaatgggaagaggcaaaagtaaagtttcattgtc

SEQ ID NO: 365 - DNA, 67 bp, Feline immunodeficiency virus
ggaggaaaaatgttgtacaataaagttacaaaacaattaagctattgtacagacccattacaaatcc

SEQ ID NO: 366 - DNA, 79 bp, Feline immunodeficiency virus
tccctcctgagttgtggacaaggtataatatgactataaatcaaacaatatggaatcatggaaatataactttggggga

SEQ ID NO: 367 - DNA, 131 bp, Feline immunodeficiency virus
ttacaaaagtgggaagattgggtaggatggataggaaatattccacaatatttaaagggactattgggaggtatcttgggaataggattaggagtgttattattgattttatgtttacctacattggttga

SEQ ID NO: 368 - DNA, 78 bp, Hepatitis A virus
aaatcctcacaatgatatgttgaatgttaatttagctaaaacaaatgatgcaatcaaagatatgtcttgtgttgattt

SEQ ID NO: 369 - DNA, 60 bp, Hepatitis A virus
gatttctctgcttttgatgctagtcttagtccatttatgattagagaagcaggtagaatc

SEQ ID NO: 370 - DNA, 97 bp, Hepatitis A virus
gctggtaatgttgttattcaatctttggatgtgggattccaggatgttgttctgatgaaggttcctacaattcctaagtttagagatattactcagc

SEQ ID NO: 371 - DNA, 122 bp, Hepatitis A virus
ggaattttgctttatgtaatacaacaattgaatcaggatgaacattctcacataattggtttgttgagagtcatgaattatgcagatattggttgttcagttatttcatgtggcaaagtttt

SEQ ID NO: 372 - DNA, 72 bp, Hepatitis A virus
ggggattgatctgtgctatggttcctggtgaccagagctatggttctatagcatcattgactgtttatcctc

SEQ ID NO: 373 - DNA, 114 bp, Equine herpesvirus 1
ctggacttttagttaccctccgacccgccgcgtctgcgggtgaaggcggtggcgaccacgtctctccgcgggcggcgatcgtaaatgtgtcggtggaggtagacttggacccag

SEQ ID NO: 374 - DNA, 126 bp, Equine herpesvirus 1
ctgtgtcggcgcggtagcgactacaccgcagagttttgtcacgttcccgtctcgggcgaactcttgaaacgcggagctcgcgacgcatctctggtaacaccggcgcgcgttgccagcgccgcgcag

SEQ ID NO: 375 - DNA, 126 bp, Equine herpesvirus 1
gactgtatggtctatcttacgtccattttcaaaacttatctaagcatgttaaacagagcaatatctgcctcgtgcgacgcggatgaatctatgaatgtggactttccaatctctgattatgcattt

SEQ ID NO: 376 - DNA, 63 bp, Equine herpesvirus 1
gcgcgatgcaatggccgcctatagactgtccgacgggctgtggccggctctaggtatgagcgc

SEQ ID NO: 377 - DNA, 109 bp, Equine herpesvirus 1
tgctgtttcccgccaatgagcgcttggctgaggtggttagattgagggcacgtggccaacaccccacccttaagctcgccttggtatccttttttggggggctgcagca

SEQ ID NO: 378 - DNA, 131 bp, Equine herpesvirus 1
agcgccccggtctacccgtttgtggaggagctggcgcgcagaaagctacacgaaggaatcgcggaactctttggggccatgaacatgcctcgcatggttctgcgcgaccagcacgggttcatgtcggtgct

SEQ ID NO: 379 - DNA, 130 bp, Cryphonectria hypovirus 1
aagcaaaactggaggacaccgcgcgcaaggtgtgtagtgtatggcaatataacatcatgatcgcttcatctgtcgcgtttctagtgccattatacttcacactctatgtgccgtacctgcaattctactt

SEQ ID NO: 380 - DNA, 83 bp, Cryphonectria hypovirus 1
acgtgactgctaatgcagactgggttcggtcagagacgacgataaattttatctctgaccaacccggcaaggctcagtcacgt

SEQ ID NO: 381 - DNA, 130 bp, Cryphonectria hypovirus 1
catgatagataaggtgcgcatctaccaaggcatgactgtcatcatctcggccatgtatttcgcaatgcattgggtcgagctgtttattcagtcactgttcttgatagggccattatataatctattcatg

SEQ ID NO: 382 - DNA, 91 bp, Cryphonectria hypovirus 1
ccgaggacaaggaaatagcgcttcaggattacaatcacaagcagttgctgggtgagatgttcttgaagcttcctgactcctatgttgacgg

SEQ ID NO: 383 - DNA, 129 bp, Cryphonectria hypovirus 1
ccttgacagagattatcacacaatgcctacgcagaaagactttcaccaaccctccatactgccatacttcgcatggctgtggaggcaagggtttgatgttaaactgccacgcgtgttgctcgtcatagg

SEQ ID NO: 384 - DNA, 83 bp, Cryphonectria hypovirus 1
cggtgctgaggggttacaaagccgcgttcactccgcatgtcgagcttgacatgccgaacgcaacttcgtacaacttagcaccg

SEQ ID NO: 385 - DNA, 88 bp, Cryphonectria hypovirus 1
gaggtgtcggttgacggaaagagttttggccagggcggcaaccgttatagattcgtctttcgctatgactctttgctgtcgacacctt

SEQ ID NO: 386 - DNA, 86 bp, Cryphonectria hypovirus 1
gcctctattcatcagactgccaaaccgtttcagggccgtggctttgttaaacggtaggcagtctgattatgacaattatggttggc

SEQ ID NO: 387 - DNA, 122 bp, Cryphonectria hypovirus 1
gtacttctacaccagcgggaacatgcagagatcggcatgtggcaagcgcaggtcaacgagctcagagcccagaaccttgcccttcagtcacagctgagatcagcatgcacccgaagaagcac

SEQ ID NO: 388 - DNA, 130 bp, Cryphonectria hypovirus 1
gtagtcgaactggcttacacccagcttgtccaggacgaaaaggaacgcataccagaaccgaagggaactaagattctggacatgccgaattggaagcctggcaactgggccaagttaatagacgagacgc

SEQ ID NO: 389 - DNA, 129 bp, Cryphonectria hypovirus 1
gtcaacaagataggatgaagatgcaggttataaacgtgaacccgaactggaaacggaacttcaagttgtcaccaagacaagaagcattccttcggtggatcaggcaggccaagtttccatcttatcgac

SEQ ID NO: 390 - DNA, 103 bp, Cryphonectria hypovirus 1
gtccgattcgatacaagaaccctgtcatgtctcaccaggctgccgaaatctgtggattgaagcctggggagtatgaagtggatgataggtatcaggaaaggat

SEQ ID NO: 391 - DNA, 94 bp, Cryphonectria hypovirus 1
tgaaaccttccggaactacgatgaaatcaaagccgttctcgaggtcattcttgagaacgagcctgacatcctcgttggagctgaagaaggttca

SEQ ID NO: 392 - DNA, 131 bp, Cryphonectria hypovirus 1
tgacgaaatgccacacattaggagtgtgaggaacacgggcatccatgggctacctggggatttcttgtcgaattaccctagactgcctacgcctgtatttcatcgcctccgcgatttgtgggatgatgtca

SEQ ID NO: 393 - DNA, 130 bp, Melon necrotic spot virus
acttggtttcgtcggaaactccatagtattgtgggtactcattccagtattagtccaggtcagttcttggacttctatactggcaggaggcgcacgatttatgaaggtgctgtgaaatcgttggaggggt

SEQ ID NO: 394 - DNA, 96 bp, Melon necrotic spot virus
ccgccatagttgggattggttatcttggggttaggattggtgccgcttggtgccgccgtactcccggaataacgaattccataatcacctatgggg

SEQ ID NO: 395 - DNA, 88 bp, Melon necrotic spot virus
ggggtgcctggaggagctcgctgggttctgtacttcggtacggagagggacacacccagacatgaccgagtttcctcaggatcgtccc

SEQ ID NO: 396 - DNA, 73 bp, O'nyong-nyong virus
gaggtccacgaagagaaatgctatccacctaaattggatgagatcaaagagcaactactacttaagagacttc

SEQ ID NO: 397 - DNA, 60 bp, Igbo Ora virus
tcagatagtgcaagcttttaaagaagatagggcctactctccagaagttgcactgaatga

SEQ ID NO: 398 - DNA, 67 bp, O'nyong-nyong virus
tctactgcagggacaaggaatgggagaagaagatcactgaagccatatcactaagatcccaggtaga

SEQ ID NO: 399 - DNA, 64 bp, Pepper mottle virus
cccagggcaaatgaatttttccagcctaagatgtgggcgtatggaaagagtatgttgaataagg

SEQ ID NO: 400 - DNA, 73 bp, Pepper mottle virus
gaaagggtgttctcaacttggctcatttacttgaatacaaaccaagccaagttgacatatcgaacactcgttc

SEQ ID NO: 401 - DNA, 60 bp, Pepper mottle virus
gaatggatgaacgattatgttctaaatctatcaaaagttagcacatggggttcactattt

SEQ ID NO: 402 - DNA, 61 bp, Pepper mottle virus
gcatttgaggaagctatcgttagagttattgtatactcagatccacggctttcgcaaatgt

SEQ ID NO: 403 - DNA, 115 bp, Pepper mottle virus
gctgtatctgaatcaagatgtacaaatgatgagcttcaggtcttacctcaagtatttcgctgatgcagatgaagagtttgaatgcggtacatatgaagttcgtcatcagagcagc

SEQ ID NO: 404 - DNA, 94 bp, Pepper mottle virus
tgagaatgcgtggtaatagtgtgtttgggtcgtcgcctatttctgtaatgacaagtgggttcgctttgcatttctttgctaataacatcactca

SEQ ID NO: 405 - DNA, 79 bp, Pepper mottle virus
ttgaagatttactggcattcaagagtgaaagtgtgagggaacaagcacacacatcatcttggatgcttgaagtcttgaa

SEQ ID NO: 406 - DNA, 61 bp, Human papillomavirus type 39
agatgcattatttgatatatatgctgatgtggacaataacacatatttagatactgcattt

SEQ ID NO: 407 - DNA, 82 bp, Human papillomavirus type 39
gtacctgtccaccagacgttgttgataaagttgagggtactacacttgctgacaaaattttacagtggactagtttaggtat

SEQ ID NO: 408 - DNA, 70 bp, canine parvovirus
ctttaatatgtgcatggttagttaaacatggttatgaatcaaccatggctaactatacacatcattgggg

SEQ ID NO: 409 - DNA, 131 bp, canine parvovirus
gaattaatacttgaaaaagcagataatactaaactaactaactttgatcttgcaaattctagaacatgtcaaatttttagaatgcacggatggaattggattaaagtttgtcacgctatagcatgtgtttt

SEQ ID NO: 410 - DNA, 95 bp, Rabies virus
agggttgattatgataatgcatttggaaggtatcttgccaacacgtattcctcttacttgttcttccatgtaatcaccttatacatgaacgccct

SEQ ID NO: 411 - DNA, 112 bp, Rabies virus
agtcactaatgttcatgtggtgaagagagctctatcgttaaaagaatctataaactggttcattactagagattccaacttggctcaaactctaattaggaacattgtgtct

SEQ ID NO: 412 - DNA, 75 bp, Rabies virus
cttggcccatttctattccaagtcgtcccccatagagaagctgttaaatctcacgctaggaaatagagggctgag

SEQ ID NO: 413 - DNA, 102 bp, Rabies virus
ctttgatagaagatcctgctagactaatgttagaatggttaaaaacagggaatagaccttatcggatgactctaacagacaattgctccaggtctttcagag

SEQ ID NO: 414 - DNA, 61 bp, Rabies virus
ggagtgcttagcaagcgacctagccaggaggatccttagatggggttttgataagtactcc

SEQ ID NO: 415 - DNA, 118 bp, Rabbit hemorrhagic disease virus
aggtggatgagtttattgagcgagcggctgccgacgttttgggctacttgcgcttcctaaccaagggggagcgccaggcaaacctgaactttaaagctgcgttcaacactctagacct

SEQ ID NO: 416 - DNA, 130 bp, Rabbit hemorrhagic disease virus
cattggaacttgaatggcagcacatatggctggtcaagccctcggtttggcgacattgaccatcgaagaggcagtgcaagttactctgggagcaacgcaaccaacgtgcttcagttttggtatgccaatg

SEQ ID NO: 417 - DNA, 74 bp, Rabbit hemorrhagic disease virus
gctcgtcggtgcggaacccagacctcccgttagtggaaccaggtatgctaaggtcccgggtgtgcctgatgagt

SEQ ID NO: 418 - DNA, 67 bp, Rabbit hemorrhagic disease virus
gctggcgtatgacggttgcacacagaccacccacggggactgtgggctgccgttgtatgactccagc

SEQ ID NO: 419 - DNA, 88 bp, Rabbit hemorrhagic disease virus
ttgaaggtgtgaagagtttctgggacaaggtggtctgtgcaacggaccgctgctttgacttgctcaagaggctgtttgacacatttga

SEQ ID NO: 420 - DNA, 66 bp, Sendai virus
ctcttggcccatgcatcaactattataactcgggggtatactcttgtgatgtcaatgggcagagag

SEQ ID NO: 421 - DNA, 84 bp, Sendai virus
ggtgttgtatagggtaatgaatcaagagcctggtgattctagttttctagattgggcttcagatccttattcatgcaaccttcc

SEQ ID NO: 422 - DNA, 131 bp, Sendai virus
taccagtctaggtcagagggttaaggtattgttcaacgggaatcctggctcgacatggatcgggaatgatgaatgtgaggctttgatttggaatgaactacagaataattcgataggcctagtccactgtg

SEQ ID NO: 423 - DNA, 88 bp, Tomato bushy stunt virus
agcttaacccgttgaatggtacattgttctcttggttgccagcgatagcatccaattttgatcagtacacattcaacagcgttgtgct

SEQ ID NO: 424 - DNA, 104 bp, Tomato bushy stunt virus
gaagcgatgcttagggtacccaccgataagattaagagattttgtgatgacagttccacatctgatcacaaacttatcgacttgggtcaattgggcattgctac

SEQ ID NO: 425 - DNA, 74 bp, Tomato bushy stunt virus
gtagcagtgactagacaacttgtcggtagtaagcctaagtttactggcaggacgtctggctctgtcacagttac

SEQ ID NO: 426 - DNA, 101 bp, Vaccinia virus
tagcggatatcatttgatcggtgaatctaaatcgtattgtgaattaggatctactggatctatggtatggaatcccgaggcacctatttgtgaatctgtta

SEQ ID NO: 427 - DNA, 104 bp, Vaccinia virus
gccttgggcggatctgtaaacatttgggccattatacctctcagtgcatcagtgttctaccgaggagccgaaaacattgtgtttaatcttcctgtgtccaaggt

SEQ ID NO: 428 - DNA, 130 bp, Vaccinia virus
gttgtggtagaaccgtcattcatttagaatggttgttgggctttatcaagtgtattagtcagcatcagcatctggctattatgtttaaagatgacaatattattatgaagactcctggtaatactgatgc

SEQ ID NO: 429 - DNA, 130 bp, Vaccinia virus
ccaccgaaacaagataataaatgcagagaagagaatggagattttatcaatattagattgtgtgcctacgaaaaggaatattgcaatgacggatatctatctcctgcctattatatgttaaaacaggtgg

SEQ ID NO: 430 - DNA, 81 bp, Vaccinia virus
tagtgttagaaatagaagactttaatatcaagcatttatttatggcaggtgagatgtttgttagaagtcagtctagtacta

SEQ ID NO: 431 - DNA, 64 bp, Human papillomavirus type 17
agaagattttgtgtttgcctgttgcagtagttgtgcgtatgctacagcacagtatgaattttct

SEQ ID NO: 432 - DNA, 98 bp, Human papillomavirus type 17
tcagtgagtggaagggagttagaggaaatagagcacaagccaataggggaaatacctattcgctgcaagttttgtttaaagaaattggatttactaga

SEQ ID NO: 433 - DNA, 93 bp, Human papillomavirus type 40
gagctgtttaaatgcaaggacctaaatgctaagctgtatggtaagtttaaagagctttatggagtggggtttggagacctggtaagacagttt

SEQ ID NO: 434 - DNA, 90 bp, Human papillomavirus type 40
tacctaaaaaaaattgcatttgtattgtgggtcctccagacacaggaaagtcatgttttggaatgagcctgatgcactttatgcaaggta

SEQ ID NO: 435 - DNA, 63 bp, Human papillomavirus type 7
actggtgcagctgaagaaatacctatggacacatttgttgttcatagtgatccactgtccagt

SEQ ID NO: 436 - DNA, 71 bp, Cardamine chlorotic fleck virus
cgctcttttaccggagtttctcgcccacaagctttcgcgtttagtgctcaaatgctttggtataggtagtg

SEQ ID NO: 437 - DNA, 94 bp, Cardamine chlorotic fleck virus
gcaccccatgactggcagatcatggctacgggcgtggaggaggcttaccggccttcccgacgacgtggctgtgcaatttgtccgctaggggtgc

SEQ ID NO: 438 - DNA, 127 bp, Cardamine chlorotic fleck virus
ggggtccaaagaggtttctgaagcagctcggtactcattttacgtggctttcgggtacacccctgatgaacaaaggggactcgaaggctactatgataatctggcgttagaagcagcatgggacccc

SEQ ID NO: 439 - DNA, 96 bp, Borna disease virus
actgccatgctttaccacgtttattattcaagacaggttcaacccgccctattccctcagtggtgagcccgttgaagacggagttacatgcgcggt

SEQ ID NO: 440 - DNA, 99 bp, Borna disease virus
attagactcgacaggttagagtcagtttgttatgctcacccctgtttagaggaactagagtttaatgcatatctagactctgagttggttgacattagt

SEQ ID NO: 441 - DNA, 109 bp, Borna disease virus
tgagtatggaaagaagcttttcttccgtggtgtacctgtcccgggctgtttgaagcagctctcacgggtgacggattctactggagagctattcccaaacctatactca

SEQ ID NO: 442 - DNA, 94 bp, Variola virus
atgtatcgtaagttctctaagtgtactatagttgacagtatgataatagggcatataggtcatcattatatttggattaaaaatttagaaacat

SEQ ID NO: 443 - DNA, 68 bp, Variola virus
cgatgatgaatattacaagattagaagttataggattaactactcattgcacaaaattaagatcatcg

SEQ ID NO: 444 - DNA, 83 bp, Camelpox virus
gtattaatatgaattatagcgatgattatatgatgaacatctatttgaattttccttggctatcgcatgatttatatgattac

SEQ ID NO: 445 - DNA, 78 bp, Ectromelia virus
tactaatatccttgacgaatgaaatatatacatctataattaatagagatatcatagttatttacccaaactttagta

SEQ ID NO: 446 - DNA, 130 bp, Variola virus
ccaccaagacaagataataaatgcagagaagagaatggagattttatcaatattcgattgtgtgcctacgagaaggaatattgcaatgacggatatctatctcctgcctattatatgttaaaacaggtgg

SEQ ID NO: 447 - DNA, 66 bp, Variola virus
ggaagacacattatttgacgacgagttatactctattatagaacgctctttcgatgataattttcc

SEQ ID NO: 448 - DNA, 118 bp, Variola virus
gatacaacggttactatcaatattattcatttagcgattatgaaaattataatgaatattattatgatgattatgatagaactggtatgaatagcgagagtgagagtgataatatatc

SEQ ID NO: 449 - DNA, 129 bp, Variola virus
gcgtatcaaatgtaaatgacgcggaacacatatctcagataactaatgatgtatctacacaaacatgggaaaagaaatcagagttagatagatacatggaaatgtatcctcgtcatagatatagtaagc

SEQ ID NO: 450 - DNA, 70 bp, Variola virus
tcactgactaaccatataatagattatgttcttacagacaataaaaatattatttggcaaagtcaaatga

SEQ ID NO: 451 - DNA, 103 bp, Variola virus
cacttattactccattattggcggaggtctgagaatgaactttggattcaccaaatgtcctcagattaaatccatctcagaatccgctaatggaaacgcagtg

SEQ ID NO: 452 - DNA, 91 bp, Autographa californica nucleopolyhedrovirus
atattacgttcctgtcggcgacaaatttccccgcgctgtattatgtgatttagacggtacagtagctttgcccacaaatagatcgttttat

SEQ ID NO: 453 - DNA, 95 bp, Autographa californica nucleopolyhedrovirus
gccagcacccgaggaagtgcttttgcagaaaacctttgcgtgtcagacgtgacgtttaaacgtttagttttgcaagctcttcaacttgacgaggc

SEQ ID NO: 454 - DNA, 131 bp, Equine herpesvirus 2
ctcatgtggtacgagctgagcaagatcaaccccaccagcgtcatgagcgccatctatggcaggccagtgtctgccaagttgataggggacgtggtgtcagtgtcagattgtatcagtgttgaccaaaagag

SEQ ID NO: 455 - DNA, 73 bp, Equine herpesvirus 2
caccgaggtggtgactaatatcatgctgggaccggcctttgagctggcccagctccagatcaccgccgcggtg

SEQ ID NO: 456 - DNA, 60 bp, African swine fever virus
atgtctatgacatccttgacatgataattaacgttatcatggatgtattttacgagacat

SEQ ID NO: 457 - DNA, 81 bp, Human herpesvirus 6
gatgggttagtgaaaaaggtggcatcagaatccagaaacttgctcctggatttgagagctaatatgaacaatgacattatt

SEQ ID NO: 458 - DNA, 86 bp, Tick-borne encephalitis virus
cgttgcgggagcaatacagcgaaacctggcatatggacgaggaacacccgtaccggacatggcagtactggggcagctaccgcacg

SEQ ID NO: 459 - DNA, 89 bp, Tick-borne encephalitis virus
ggatggacgcaccctggtggtgccgtgccgagaccaagatgaactcgttgggagggcgcgcatctcaccggggtgcggctggagtgtcc

SEQ ID NO: 460 - DNA, 97 bp, Tick-borne encephalitis virus
gtctggtgttggccacagtgttgtgcctcatgtcggtggtcatgaaccgaacggtggcctccataacagaggcttcagcagtgggactggcagcagc

SEQ ID NO: 461 - DNA, 130 bp, Tick-borne encephalitis virus
tgatgattcactgtcctatgagtgtgtgaccatagatcaaggagaagagcctgttgacgtggattgtttttgccggaacgttgatggagtctatctggagtacggacgctgtgggaaacaggaaggctca

SEQ ID NO: 462 - DNA, 61 bp, Tick-borne encephalitis virus
tgcagccttgggagcttggtcagatgagcaaaacagatgggcaagtgcaagagaggctgta

SEQ ID NO: 463 - DNA, 106 bp, Hepatitis G virus
aggtctcagccgtgctccggcgcctgagcctcacccgcacagtggttgccctggtcaacagggagcctaaggtggatgaggtacaggtggggtatgtctgggacct

SEQ ID NO: 464 - DNA, 130 bp, Hepatitis G virus
aggttctgagcgacctcaagctccctggcttagcagtccaccgaaagaaggccggggcgttgcgaacacgcatgctccgctcgcgcggttgggctgagttggctaggggcttgttgtggcatccaggcct

SEQ ID NO: 465 - DNA, 131 bp, Hepatitis G virus
atgatacaactgctttcacaaggatcactgactcccccctgacgtattcaacctatgggaggtttttggccaaccctaggcagatgctacggggcgtttcggtggtcatttgtgatgagtgccacagtcat

SEQ ID NO: 466 - DNA, 125 bp, Hepatitis G virus
atgggcatggaatacccctcgagcggatgcgaaccggaaggcacctcgtgttctgccattctaaggctgagtgcgagcgccttgctggccagttctccgctaggggggtcaatgccattgcctat

SEQ ID NO: 467 - DNA, 130 bp, Hepatitis G virus
catctggccagatgctgtgatgatggtggtggttgccttggtccttctctttggcctgttcgacgcgttggattgggccttggaggagatcttggtgtcccggccctcgttgcggcgtttggctcgggtg

SEQ ID NO: 468 - DNA, 98 bp, Hepatitis G virus
ccgtccggctggtctccaagatgtgtgcgagaggagcttatttgttcgatcatatgggctctttttcgcgtgctgtcaaggagcgcctgttggaatgg

SEQ ID NO: 469 - DNA, 73 bp, Hepatitis G virus
cggctgatatcggagaagccgcggtgttcttctctgggctcgccccattgaggatgcaccctgatgtcagctg

SEQ ID NO: 470 - DNA, 64 bp, Hepatitis G virus
ctcagggccctctgccccgtggtgtcactacccttgtggcattgcggggaggggtggtccgggg

SEQ ID NO: 471 - DNA, 131 bp, Hepatitis G virus
cttggtttgcctccaccagtggtcgcgactcgaagatagatgtgtggagtttagtgccagttggctctgccacctgcaccatagccgcacttggatcatcggatcgcgacacggtgcctgggctctccgag

SEQ ID NO: 472 - DNA, 103 bp, Hepatitis G virus
gactcggtgtggcggagggttacgtccgctgcgacgctgggccgatcttgatgatcggtctagctatcgcggggggaatgatctacgcgtcatacaccgggtc

SEQ ID NO: 473 - DNA, 63 bp, Hepatitis G virus
gccagaggagtcgctggcggtggttggggttcttagccctgctcatcgtagccctcttcgggt

SEQ ID NO: 474 - DNA, 123 bp, Hepatitis G virus
ggcacggttggtcccgctgatcttgctgctgctatggtggtgggtgaaccagctggcagtcctagggctgccggctgtggaagccgccgtggcaggtgaggtcttcgcgggccctgccctgtc

SEQ ID NO: 475 - DNA, 90 bp, Hepatitis G virus
gggcacttgggaaatactatgcctcaggcaccatggtcaccccggaaggggtgcccgtcggtgagaggtattgcagatcctcgggtgtcc

SEQ ID NO: 476 - DNA, 129 bp, Hepatitis G virus
gtccgcggcccaactggtgggggagctgggtagcctatacgggcccctgtcggtctcggcctatgtggctgggatcctgggcctgggtgaggtgtactcgggtgtcctaacggtgggagtcgcgttgac

SEQ ID NO: 477 - DNA, 100 bp, Hepatitis G virus
gtcggcctgcctcctgcggcacctgtgtgagggactgctggcccgagaccgggtcggttaggttcccattccatcggtgcggcgtggggcctcggctgac

SEQ ID NO: 478 - DNA, 105 bp, Hepatitis G virus
gtgctgttaggcattgggagagtccgggagctggcgcgtgggtgcggggtgcaactagtgctctacgccaccgctacacctcccggatcccctatgacgcagcac

SEQ ID NO: 479 - DNA, 125 bp, Hepatitis G virus
tatttccacagagcgacgcgaccaggaagcttaccgtcaagatgtcgtgctgcgttgaaaagagcgtcacgcgctttttctcattggggttgacggtggctgatgttgctagcctgtgtgagatg

SEQ ID NO: 480 - DNA, 61 bp, Hepatitis G virus
tccctgcggacagtgcctgcgtcggctgaactgtcgatgcaaagacgaggacgcacgggta

SEQ ID NO: 481 - DNA, 113 bp, Hepatitis G virus
tcgcatcatacgggatgccgcgaggactttgtcctgcgggcagtgcgtcatgggtttacccgtggttgcgcgccgtggtgatgaggttctcatcggcgtcttccaggatgtga

SEQ ID NO: 482 - DNA, 72 bp, Human herpesvirus 7
atgacaaatttcaggaaaaacggtgttgtaataattcatttgtttaagacattatttgctgaactctgtcat

SEQ ID NO: 483 - DNA, 97 bp, Human herpesvirus 7
gttgacatcattgagaaagatttggatttttccacaaaacaatatggtcttgtaaaagagtatatggcgaaaatcacaaatatttttcaacagcaac

SEQ ID NO: 484 - DNA, 64 bp, Human herpesvirus 7
ctcacctgactgtctcatgtatccagctgaaacaaatcctggaatgagtactgaagaaagtgag

SEQ ID NO: 485 - DNA, 65 bp, Strawberry vein banding virus (SVBV)
ggacgaaagtctcagcaacatgtatccacagttttgtgctgtatatgttgatgacatcatcgtct

SEQ ID NO: 486 - DNA, 121 bp, Strawberry vein banding virus (SVBV)
ggattttggcaggtacgccttgctccagaaacaattcagctaaccgctttcagctgtccccaaggacactacgaatggttagtcatgccttttggattaaaacaagcccctgctattttcc

SEQ ID NO: 487 - DNA, 74 bp, Carrot mottle mimic virus
gcttggcgtttggattgtctattccaatgcaaatagcattggagggtatatatgacaatcttaagagaccaggt

SEQ ID NO: 488 - DNA, 90 bp, Carrot mottle mimic virus
tgccagtgtttggcagtttttaccgttggttgtgtagaattgggaaagctaatactaaagtgaccgagcatccactgtacaaatgcggca

SEQ ID NO: 489 - DNA, 79 bp, Molluscum contagiosum virus
tagctacgggcagaactaccagtgcgagtcagtgctcgtcccgctgacaagcgagtgctgcaatgtcctgtccgagcta

SEQ ID NO: 490 - DNA, 130 bp, Molluscum contagiosum virus
ttctagtaccggttcccgtgcggcctgcagcgggtgctcttgtcccgcggagccgcggcgcgccgtatacgccgtctgcttttgttcaggtcacgcccgcgtgggcaggccctgtcacgctggacatcta

SEQ ID NO: 491 - DNA, 92 bp, Molluscum contagiosum virus
cgcagcgcgactttcccgaggcgcactgcctgctccggcactccacggaggagcagtacgtcttcctggactttcgcaactttaactctgcg

SEQ ID NO: 492 - DNA, 121 bp, Saguaro cactus virus
aacaatggtgacgattgtgttctcatatgcgaaactcgtgacgtggggcgtgtcgtggataagttaacgacagcgtggctccactttggttttacatgtatcgcagaggaaccagtctatg

SEQ ID NO: 493 - DNA, 127 bp, Saguaro cactus virus
caaccgggcctattctgagatttccgatgctgccagatttagcttttggaaagccttcgacatcttaccagatgttcaggaggccaccgaagctgaactgcgtcgcacctggattagtctcgatttt

SEQ ID NO: 494 - DNA, 131 bp, Saguaro cactus virus
tggcatatttaaagcggcggcttgtgcgtatcgttgggctgcatacccggatctccgctgcgcaagtggtggattgttatcagggcaggaagcgcaccgtgtatcacaatgctcgcttatctcttgatgaa

SEQ ID NO: 495 - DNA, 70 bp, Papaya ringspot virus
gcaaagtggtggtcgttggctctttgacaaattacacggcaatttgaaaggagttagctccgctcctagc

SEQ ID NO: 496 - DNA, 111 bp, Papaya ringspot virus
tgattgcgtttatagaatcttaaacaagtttaaaggcgtgataaattctagcaacacaaatgtttatcaccagtctttagatgacattcgggatttctatgaagacaagca

SEQ ID NO: 497 - DNA, 73 bp, Cucumber green mottle mosaic virus
gtcttaaatctgccgtagaaggactaggtgattgcgtctatgatgctctagttcaaaccggctggtttgacac

SEQ ID NO: 498 - DNA, 115 bp, Cucumber green mottle mosaic virus
gttgtatgactgcgaaaagtgcaagtggttattgttgccagccgagaagaagcacgcatgggccgtggttctggcaagtgacgataccactcgcataatcttcctttcatatgac

SEQ ID NO: 499 - DNA, 104 bp, Cucumber green mottle mosaic virus
tcactccagtcgtttacactgggaccattcgagagaggcaaatgaagaattatattgattacttatcggcctctcttggttccacgctgggtaatctggagaga

SEQ ID NO: 500 - DNA, 90 bp, Cucumber green mottle mosaic virus
ttcgcagaaggctggggtaacagtaacgggtctgggcacgctctctcctgagatgggcgcttctgttgcgttatccagtacctctgtaga

SEQ ID NO: 501 - DNA, 63 bp, Cucumber green mottle mosaic virus
ttttggcttggatgtggtctatgggtcacaaaagaactatactgcaagatttccaagccggga

SEQ ID NO: 502 - DNA, 120 bp, Galinsoga mosaic virus
cgaccagtacagattcttaaaggtctggcttgaatatgccccattttgctcaaccactgaggctggcagggtggggttgtacttcgacaaagactcacaagatcctgagcctactgatcg

SEQ ID NO: 503 - DNA, 69 bp, Galinsoga mosaic virus
ggctctagtagtgccggccccactgtagccgctgtaacggctagcactggcaccagtactactcttacc

SEQ ID NO: 504 - DNA, 76 bp, Lymphocystis disease virus 1
gaagtttttctgaagtaaaatggttgttcctgaataagcaaaaatcgttaacgatctattattttaaatcaacttc

SEQ ID NO: 505 - DNA, 72 bp, Lymphocystis disease virus 1
gttgtacttattttaaaccatgtaaacaatgtcttcaatgtcttacattacaagatgagcaatttctacagc

SEQ ID NO: 506 - DNA, 130 bp, Lymphocystis disease virus 1
tgtttaaaccagcatttaaacttgttattatatattacatttgaagagagtttatacattacatctattgcactagagtacaaaccattttttaatgatatgaatatagtacaacgtttaagcttaaaca

SEQ ID NO: 507 - DNA, 110 bp, Lymphocystis disease virus 1
gtgttaaaaacaattgcgcgatttaacgattttttattaaaatggaaacaagatgtgattgtaaccagcgactatttaaaattaattaatacgtattgtgtttttgatac

SEQ ID NO: 508 - DNA, 68 bp, Lymphocystis disease virus 1
taccggtacattaaacattataaacgcatgtttattaaataacgttcgatgtttaatctacaacggta

SEQ ID NO: 509 - DNA, 115 bp, murid herpesvirus 4
aattggtctgggtcatatcatcagaccagaggggccagttgactggattgctgcttttcactatctgaggaggtgcacatttggcattctgcatgagataaatccagattcaatt

SEQ ID NO: 510 - DNA, 109 bp, murid herpesvirus 4
acagagagggcaagaattgaatgttgagcaggatattatgctcatggggctgtttatggcatatactcacaagcttggttcaatatttaatctgagtacgcggctctgt

SEQ ID NO: 511 - DNA, 69 bp, murid herpesvirus 4
gagggttaattgatggactgttgtatctaaactttacatgtggtataacacactgcgatgttagccctt

SEQ ID NO: 512 - DNA, 76 bp, murid herpesvirus 4
gttcactccagagaaaagggtaacaattttatctgaaagtgttcaagctttcgttgtgccttttctaagattggac

SEQ ID NO: 513 - DNA, 92 bp, murid herpesvirus 4
tccccaagagagtgcttccatatttgagatctgtggcaagacttactagagttgtcatagctatggatagatatggaggtctgcttggagga

SEQ ID NO: 514 - DNA, 84 bp, murid herpesvirus 4
tacaccctgatgatgtacaccacctctaagctcatagatgatccagacctggctgaaatcatcaccagtcggggacccaatgta

SEQ ID NO: 515 - DNA, 76 bp, murid herpesvirus 4
tctcgtgggtagctgacaggtgcctgagtacagatctcatctgttacatcctgcatatcatgcatgccccccggga

SEQ ID NO: 516 - DNA, 61 bp, Common chimpanzee papillomavirus 1
gccacattggaccacaggtggtgccaccattacaggtatcacagactaagggacatgaggc

SEQ ID NO: 517 - DNA, 76 bp, Equine herpesvirus 4
ccatgatgttgtttatatgaaatgcaatccaaagttattatttggaatgtgtgatgagcgatcaaatatattatgg

SEQ ID NO: 518 - DNA, 76 bp, Murine hepatitis virus
tggccccgtaagaggcagtcatagctatggccgtgttggtcctaaggctacattggctgctgtctttattggtcca

SEQ ID NO: 519 - DNA, 83 bp, Turnip vein-clearing virus
tagtctcgtacgaacctaaggtgagtgatttcctcaatctttcgaagaaggaagagatcttgccgaaggctctaacgaggtta

SEQ ID NO: 520 - DNA, 100 bp, Orgyia pseudotsugata single capsid nuclear polyhedrosis virus
tgcctcgcgggctgcacggttttcacgtgcacgaattcggcgacaccagcaacggctgcacgtccgctggcgagcactttaaccccacccgccagagaca

SEQ ID NO: 521 - DNA, 87 bp, Hendra virus
gtgggtgaggtattggataggggtgataaggtgccatcaatgtttatgaccaatgtttggacaccacccaatccaagcaccatccat

SEQ ID NO: 522 - DNA, 84 bp, Ateline herpesvirus 3
caggtatagcatacggtatcgaagttacatatatttttcttttattatattattgtttgttgccatttgtatttgctatgtttg

SEQ ID NO: 523 - DNA, 102 bp, Ateline herpesvirus 3
tggtatagctttgcggggccgcttctgttgactcttatatgctacactatgtcatgctataagatagttaagacgaagttgtccagaaaagcagagatacta

SEQ ID NO: 524 - DNA, 71 bp, Ateline herpesvirus 3
gctacttgatatgaatttgtacactttgtggaccctgctaagaaactataaaacaaaacagcgatcacagc

SEQ ID NO: 525 - DNA, 130 bp, Bovine respiratory syncytial virus
attccttttgccactgttatatgtacttatagacatgctccaccttacataagaaatcatataacagatcttaataaggttgatgagcaaagtggactgtatagatatcatatgggtggtatagaaggtt

SEQ ID NO: 526 - DNA, 98 bp, Bovine respiratory syncytial virus
cataaaatatatttatagaagtctaaaagattgtaatgatcatagtttaccaattgagtttctaagattatacaatggccatataagtatagattatg

SEQ ID NO: 527 - DNA, 69 bp, Bovine respiratory syncytial virus
tggttagatcatatattaaattttcgatctctagagttcagctataatcacttatatatgattgaatca

SEQ ID NO: 528 - DNA, 130 bp, Melanoplus sanguinipes entomopoxvirus
gatatatgtaataaatgtaacaaaattaattttgttcatgatggagtatgcggtgaatgttatgctaacaaaattgtatgtaatggtgataatacaaaatctacatgttatataattattataaatgatc

SEQ ID NO: 529 - DNA, 129 bp, Melanoplus sanguinipes entomopoxvirus
agtatcatgataaattacattgggaatatatatcacaatatcaagaattatcagaagatataattttacaatatcatgataaattacattgggaatatatagctaaacatcaaattttatcagaatact

SEQ ID NO: 530 - DNA, 58 bp, infectious spleen and kidney necrosis virus
acctgccactgtgtgtatgtgtttaaataaacatataacatgacattttttggctggt

SEQ ID NO: 531 - DNA, 86 bp, Melanoplus sanguinipes entomopoxvirus
atataaattagatgattcatttccattatttacaacaaaatcaatgttttggagaggaattgttgaagaattattatggtttatat

SEQ ID NO: 532 - DNA, 108 bp, Peanut stunt virus
ctgacacccggttagctgagagagcttccgccatgctggagtatgttgcgtatgaacgtcaattacatcagaatgttatttcgaatcttcagcggatttggtgttcag

SEQ ID NO: 533 - DNA, 97 bp, Peanut stunt virus
gatagctatgaggtgttacaatgataagaagacatggcaagaccaatttaaaatcattttaggtgtcttgtcatcaaaatcttccaccatagttatc

SEQ ID NO: 534 - DNA, 85 bp, tomato leaf curl virus
gtgtcggtaagcggttttgtgttaagtccgtttacatattagggaagatatggatggacgagaacatcaagctcaagaaccacac

SEQ ID NO: 535 - DNA, 131 bp, Leishmania RNA virus 1-1
atcttggcaactgctgcattggttcatctttctgatcctggaatgacagtgaatgacgtcacatatccgactacactcactacaaaagttgcatcagtagatggccgtaacagtgacatagcagcacagat

SEQ ID NO: 536 - DNA, 131 bp, Leishmania RNA virus 2-1
acgctgagagtgtgatgctgcgacaatacggtgctgacatagctgatatcatggcccagtcaagctggatgaaatccatggaggcaagctcacgagtcagtccttcaagtatgcgcgtcacgttgtcacgt

SEQ ID NO: 537 - DNA, 100 bp, Leishmania RNA virus 2-1
ggtcattcacgagcactagaacatgcacacccagaactgcgaactcgaaaagaagtccgagcgtatcgtaagtgtgtgctcgagcagtggcggaataacc

SEQ ID NO: 538 - DNA, 80 bp, Human adenovirus D
tttgtgttggacaatcctgaggtgcccgggcaaggctgtaaatcctgccagtaccaccgggataagaccggagacacgaa

SEQ ID NO: 539 - DNA, 107 bp, Bovine parainfluenza virus 3
attccatcgttagtaatcaatcatctaatctatgcttacacctctaatcttattacccagggctgtcaagatatagggaaatcttaccaagtactacaaatagggat

SEQ ID NO: 540 - DNA, 83 bp, Spodoptera exigua nucleopolyhedrovirus
atgaaagcgatctgtgtgttatcgggtgacgtgcatggtcgagtcattttcgaacaacaatcacccgaccatttgctccacat

SEQ ID NO: 541 - DNA, 88 bp, Spodoptera exigua nucleopolyhedrovirus
gagcgtcacgtaggcgatctgggtaacattgaagcgaaaaaatcaaacagtttgaccgaaatcgataagatcgacaacgtgatgagtc

SEQ ID NO: 542 - DNA, 62 bp, Spodoptera exigua nucleopolyhedrovirus
gcgacgacttgggtctcggcggtcatccattgagcaagaccaccggcaactcgggcggtcgc

SEQ ID NO: 543 - DNA, 85 bp, Spodoptera exigua nucleopolyhedrovirus
gatcgccgtctgctgatgtgcgtcgacgccgaaccgtgtagcgtccacggcgtcgactatacgtacattacggacgacatcggtc

SEQ ID NO: 544 - DNA, 86 bp, Spodoptera exigua nucleopolyhedrovirus
tcttttaattcattacgtctttgacggcatcagttatagcgagaacactaatgtaattaaagtatgcaaagttcgagtgaaaaaga

SEQ ID NO: 545 - DNA, 100 bp, Fowlpox virus
ggtgaaactattccttgattctggtattgatattaattctacaatatgtgaaaactcgcatactgcactatatcatgctgtagaacaagaaaacgttacc

SEQ ID NO: 546 - DNA, 112 bp, Fowlpox virus
atttaccaaactgataacgtgtttaatttattattacaaaaaggagcggatgtaaacgctaaaaactctgacgggaatactatattacacactttagcagcgtgttgtaaat

SEQ ID NO: 547 - DNA, 86 bp, Fowlpox virus
atagtgattggttaatatctatgtcaagcggttataataacaaagtttatataccttcggattatttcgttatactaacatactgt

SEQ ID NO: 548 - DNA, 75 bp, Fowlpox virus
ataatttactagctattatctgtttagtagaaaactataaccttatagactatgaaacaataagcgataaattat

SEQ ID NO: 549 - DNA, 67 bp, Fowlpox virus
gaagctattatataatataaccgataaacaaaatcacggtatattagttgtaggagatgttagtttt

SEQ ID NO: 550 - DNA, 106 bp, Fowlpox virus
gtatttcagattttgggttcgaaaaagatataaacgatggaattctagggatagcgcatttactagaacacatattaatatcattcgataacaagtattttaatgc

SEQ ID NO: 551 - DNA, 89 bp, Fowlpox virus
actacgtctaaagtagattacagactacctaaagtagaacatattacttacaaaggaagttcctgtaatgatatcactgtagatgaagt

SEQ ID NO: 552 - DNA, 72 bp, Fowlpox virus
gatgttagagatcgctgggtactggaaaatccttttgaaaggaacagtaaacaccggcagttatttacgttc

SEQ ID NO: 553 - DNA, 109 bp, Fowlpox virus
gactttagggacacaggcggtgaagtattacttactaagtacaatcaaagacagagcagtttgatgtttaatgtagacactagtacgagtatcgtaaaacctagacgtc

SEQ ID NO: 554 - DNA, 65 bp, Fowlpox virus
ggtaagttacgcggcttatatcaagcttacaaagagttgtacgaatacaccgacgggactctacc

SEQ ID NO: 555 - DNA, 73 bp, Fowlpox virus
gtctttgatggcagaagttgtaacccctcctaattcatatcttaatattattggaaatttctccattaaggat

SEQ ID NO: 556 - DNA, 128 bp, Fowlpox virus
tgatacggtcataaaacctaacgaaatatcaggccatgcgaagttttgcgccaatagacagtccaaccattgtcactggttcgacgtcatggtgctggatgatatttcatcctgtgaaaatcgtgtta

SEQ ID NO: 557 - DNA, 65 bp, Fowlpox virus
caaaaccgtaatttcagtgatatagtaataaaacctaatactgttcaaggacattctaaattttg

SEQ ID NO: 558 - DNA, 127 bp, Fowlpox virus
catattaactttgtatcccaagcgtacaacgagtctgttatattcatagacgagttcacgggtagagaacgagtatttgaagacatggcaaaactagggactatgccttggcggtctaggaaatgtg

SEQ ID NO: 559 - DNA, 62 bp, Fowlpox virus
gaattgatgtatgaattcgacatgaatataagtactatattaatgagacataacgtcagttc

SEQ ID NO: 560 - DNA, 90 bp, Fowlpox virus
gctaaaaatatgtatagaacgtatagttctatcgttttaattttaataccgtgtacgatgagagctaacatgctaatatataatactagc

SEQ ID NO: 561 - DNA, 60 bp, Fowlpox virus
gttttttataacggtgtggaaaacaccgtgttcaatctacccgttttaaaagtaaagaac

SEQ ID NO: 562 - DNA, 112 bp, Fowlpox virus
tctatgactgaatggtctcctactcttcagaattattctttcaaaatagcaattttctcgttgaataagctaagagggtttaagaaaagagtattagtattcgagtcaaaga

SEQ ID NO: 563 - DNA, 71 bp, Fowlpox virus
tcctgtaagtgctttaaagcgcgctacatttggcgataacaaagccatcattaacgcagcattatacaaga

SEQ ID NO: 564 - DNA, 123 bp, Fowlpox virus
tggagaacctattgatacaaaaatatatggaagagtactaccctatttcttacccgattctaaggaccctgaaggaaagggttacatactcaattctctcatacaaggattgacgggttccca

SEQ ID NO: 565 - DNA, 100 bp, Fowlpox virus
gttgataaagatacctcttcttataggttacggaaataaaaaccctcttgataattctaaatttgtatctcctaatattataggaggagtctttattaat

SEQ ID NO: 566 - DNA, 123 bp, Fowlpox virus
atcttgttattagattttgactgtcacataaaaactataggtaagatgatatacaacgtagaacctttttactgtaaaaaaactaaatacttatatgttggaggacagaatgatgaacaagat

SEQ ID NO: 567 - DNA, 87 bp, Fowlpox virus
ttcttacgtatatatgatttatgtttctatgatcatagagtactttaaagtatatcataactacatatttcctacactttgtgagaa

SEQ ID NO: 568 - DNA, 101 bp, Fowlpox virus
ccttctaatgcaatacaaagccgatgcctctatacgtgacagtaaaggaattactccattctgttatgccatgtatctaggatattacggcgttaataagg

SEQ ID NO: 569 - DNA, 64 bp, Fowlpox virus
tcccttgttaacagctatcaaaataggatcacacgatatagtaaaactgctgttgattaacgga

SEQ ID NO: 570 - DNA, 124 bp, Fowlpox virus
atatccaagaagttttcatctataataggtatgtattctcctaatacagatagtatcaacttttctaaagtaaaccataccatcagtattacggatgcttctatacctgttagcttctgggtat

SEQ ID NO: 571 - DNA, 74 bp, Gallid herpesvirus 2
ggatgtttaaggagatcctcgcaggtcgattaggatatactgatggccagggtatatataactccgtaagatct

SEQ ID NO: 572 - DNA, 96 bp, Gallid herpesvirus 2
tcagggtcatgaggtttcaatttcctactcgaacagtgcgataactttactactcgctccttactttttttccgtattgaatatttatgatattgg

SEQ ID NO: 573 - DNA, 61 bp, Gallid herpesvirus 2
tgttaaggtagcagaaaatgtttttgtaacatggcgcaaaactctgcaaactacattgata

SEQ ID NO: 574 - DNA, 87 bp, Gallid herpesvirus 2
ggtaacttatatatgtgacgaacatatgaagcatgtaacagattatacaaatgcgacatcatgttcctgttatgtattgaacaagcc

SEQ ID NO: 575 - DNA, 63 bp, Gallid herpesvirus 2
tgcgtgtggcgaattccataatatttcaagaatatgacgagatggaatgtgcagcccatcgca

SEQ ID NO: 576 - DNA, 93 bp, Gallid herpesvirus 2
ttgcaattccggtgcccagacgacatcagacagtgatgcctgccataggcatattacataactgctgcgatagtttgggtatttattctgcga

SEQ ID NO: 577 - DNA, 77 bp, Gallid herpesvirus 2
gaaagaggtacggtagatcaaatgcttagaattctactagagaaagctccaccagctcctctactgataccgctttc

SEQ ID NO: 578 - DNA, 74 bp, Gallid herpesvirus 2
ggggtgcagttttctcttacacaaccccgggccaacgttgacctgggtgtaggatatacagccacgtgtactcc

SEQ ID NO: 579 - DNA, 73 bp, Gallid herpesvirus 2
tagagagcgcattcccagtggaatatgtgatgcgtatgatgaatgactgggccaaaggcgaatgtaatcctta

SEQ ID NO: 580 - DNA, 72 bp, Northern cereal mosaic virus
acttggcagacggatcttacaaccccaagttcgacagtgacctacaatgggttgatgataaatctggtaagt

SEQ ID NO: 581 - DNA, 73 bp, Northern cereal mosaic virus
tgaggtgaatgtcagactgtgtcatgacatacttggggcgactctgtatggatactctgaatcaatctcttca

SEQ ID NO: 582 - DNA, 121 bp, Northern cereal mosaic virus
tgatgtattaccaatctggaacaacccgtatcttgcacaaatttgacttcaaggaattttctgagatagctgaattgattcaatgtatgaggcattgcttctcggattgggtgatatttca

SEQ ID NO: 583 - DNA, 70 bp, Transmissible gastroenteritis virus
ctaacaacctttctgcacctaagaacgcatatgacgctatgattcttagtgctaaattgattggtgttgg

SEQ ID NO: 584 - DNA, 99 bp, Transmissible gastroenteritis virus
gaatctgctgaaggctatgactacatggttattaagaatggaattgttcaaccttttgacgataccatttcatgtgttcataacacttataaaggattc

SEQ ID NO: 585 - DNA, 105 bp, Transmissible gastroenteritis virus
gcttgaagtctttaaatatttgctggttttatttatgtgtcttagaagtactaagatgcctaaagttaaagtcaaaccacctcttgcatttaaagattttggtgc

SEQ ID NO: 586 - DNA, 65 bp, Transmissible gastroenteritis virus
gtcatgatgcttataaatttgaagttgttacacatagcaatttcattgtgcataagcagactgac

SEQ ID NO: 587 - DNA, 104 bp, Transmissible gastroenteritis virus
gttgagaatactaacactatgtttttgcctgttgacatgcaaggtgtcatgctcacagtgttttgctttattgtctttgttacatatagtgttagattcttcac

SEQ ID NO: 588 - DNA, 82 bp, Transmissible gastroenteritis virus
tacaaaggattggatggttgtcattgcatcatacagaattgcatattatattgttgtatgtgtaatgccatctgcttttgta

SEQ ID NO: 589 - DNA, 89 bp, Transmissible gastroenteritis virus
tgatattatacctattgaacttgaagctccattgcgtttctatgttgacggcgctaatggtcctgaagtcaagtatttgtattttgtca

SEQ ID NO: 590 - DNA, 108 bp, Transmissible gastroenteritis virus
tggttaggagatgaagtcatttgccctagacatgttattgctagtgataccacacgtgttatcaactatgaaaatgaaatgtctagtgtgagacttcacaacttttca

SEQ ID NO: 591 - DNA, 116 bp, Transmissible gastroenteritis virus
ttcttggaacctgatgttattgttaatgctgctaatggtgatcttaaacacatgggtggtgtcgcaagagccatcgatgttttcactggtggcaaattaacagaacgttctaagga

SEQ ID NO: 592 - DNA, 70 bp, Transmissible gastroenteritis virus
ttttatttgtttgtcagtataccagtagtgcataaattaacatgtaacggtgctgtacaggcatataaaa

SEQ ID NO: 593 - DNA, 85 bp, Rice grassy stunt virus
actttgagctatcttcagtattaggtggatatctaggtagtttagatgatgacatagatctacctagcatgattgagctgaaggt

SEQ ID NO: 594 - DNA, 103 bp, Rice grassy stunt virus
atgaaactgagggatgaagctaaatactgtaggagagacattatggagaagataagaattggtaatctaggtctactaggtggctacgtccaaaagcaatcat

SEQ ID NO: 595 - DNA, 112 bp, Rice grassy stunt virus
ggtcagaatcctgaacttactaagaagcagaaacattttttattggactctgaaggaaacctatggggtgctgtaaaaagtggtttgccagtgacagttctcagagatgacc

SEQ ID NO: 596 - DNA, 77 bp, Rice grassy stunt virus
tgttattatagattgcatggagtcatcagatgatagctcaatgatgatatcattctcaactaaatctatgaatgaca

SEQ ID NO: 597 - DNA, 67 bp, Xestia c-nigrum granulovirus
cagtatagtgtgcacgtataacgtctgcaacgatatgcaaaaaacagtcggcacgctgcaagagctg

SEQ ID NO: 598 - DNA, 93 bp, Xestia c-nigrum granulovirus
cgcacgacgattacggtgatatggcgcctggtaccacgcttgtttacgaagctgaaaaaggttactcatatcgaccgtcgtcgtcgttcagtg

SEQ ID NO: 599 - DNA, 75 bp, Xestia c-nigrum granulovirus
ccaaaatgcacgagtgtgtacgcgtcaacgaagggtttgtgtccttggatgtcacgttcgtgcgattctacttgg

SEQ ID NO: 600 - DNA, 117 bp, Xestia c-nigrum granulovirus
tgcgtaaatttgtacaactgtccgactacacaaaagtgctaaaatttgtcgaaaactgcctatgggaacgaggttacgaagatttttacacgttgggtcaacaattgagcatacgta

SEQ ID NO: 601 - DNA, 79 bp, Xestia c-nigrum granulovirus
atgtaatggtggcgggtgtaaaagcggggttggccaaagaaaaaatgcgtagtcgactgtgttacgagtaccagtgcat

SEQ ID NO: 602 - DNA, 130 bp, Xestia c-nigrum granulovirus
gggttaataatagtttttacagtgacgacagattattgtacaaattgtgcgaggagtgtgtgataaatttgtgtctcacaaccaagttcactttgtacactgtaaaacaatgtgtcaaggcttgtgatct

SEQ ID NO: 603 - DNA, 98 bp, Xestia c-nigrum granulovirus
gccaggaagagttaatttttagagataaattaaagtattgcgttggtactcgagtaatgataacacacaatcttaaaggactggctttttgcaatggc

SEQ ID NO: 604 - DNA, 65 bp, rabbit oral papillomavirus
aggtttttagaggaggtaccgatacccagacatatgcaagtgtttgttgggaacttctttggctt

SEQ ID NO: 605 - DNA, 129 bp, Hepatitis GB virus C
aaggttctgagcgacctcaagctccctggtctagccgtccaccgcaagaaggccggggcattgcgaacacgcatgctccggtcgcgcggttgggcggagttggctaggggcctgttgtggcatccagga

SEQ ID NO: 606 - DNA, 76 bp, Hepatitis GB virus C
acgtcatggttttggggacggctacctcgcgcagcatgggaacgtgcttaaacgggttgctgttcacgacattcca

SEQ ID NO: 607 - DNA, 129 bp, Hepatitis GB virus C
agtccgccgcccagttggtgggggaactcggtagtctctacgggcccttgtcggtctcggcttatgtggccgggatcctggggcttggggaggtctactcgggggtcctcaccgtcggggtggcgttga

SEQ ID NO: 608 - DNA, 106 bp, Hepatitis GB virus C
caaggtctcggcaatcgtgcgccgcctgagccttactcgcaccgtggtggccctggtcaacagggagcctaaggtggatgaggtccaggtggggtacgtctgggat

SEQ ID NO: 609 - DNA, 96 bp, Hepatitis GB virus C
gcggcctgcctcgtgtggcacctgtgtgagggactgctggcccgagaccgggtcggtacgtttcccattccacaggtgtggcgcgggaccgaggct

SEQ ID NO: 610 - DNA, 60 bp, Hepatitis GB virus C
ggcccgaatcctgtcccactactgctgaggtggggcaatgatttgccatcaaaagtggcc

SEQ ID NO: 611 - DNA, 118 bp, Hepatitis GB virus C
ggtctacggtccgggccaaagtgttaccattgatggggagcgctacacccttccgcaccagttgcggatgcggaatgtggcgccctctgaggtttcatctgaggtcagcatcgagatc

SEQ ID NO: 612 - DNA, 129 bp, Hepatitis GB virus C
tcccaccggaacgtttgggttcttcccaggagtccccccccttaacaactgcatgcttctcggcactgaggtgtcagaggtattgggtggggcgggcctcactggggggttttacgaacctctggtgcg

SEQ ID NO: 613 - DNA, 131 bp, Hepatitis GB virus C
tcttggtttgcttccactgggggtcgcgactccaaggttgatgtgtggagtttggttccagttggctctgccagctgcaccatagccgcactgggatcttcggatcgcgacacagtggttgagctctccga

SEQ ID NO: 614 - DNA, 113 bp, Hepatitis GB virus C
tgtcgcatcatacgagacgccgccaggaccctgagctgcggccaatgcgtcatgggcttgcccgtggtggctaggcgcggcgatgaggtcctgattggggtctttcaggatgt

SEQ ID NO: 615 - DNA, 125 bp, Hepatitis GB virus C
ttatttccacagagcgatgccacacgaaagctaacggttaagatgtcttgctgtgttgagaagagcgtaacacgcttcttttctttagggttgaccgtggctgacgtggctagcctgtgtgagat

SEQ ID NO: 616 - DNA, 125 bp, Hepatitis GB virus C
ttttatgggcatggtatccccctcgagcgtatgaggactggtcgccaccttgtattctgccattccaaggcggagtgcgagagattggccggccagttctccgcgcggggggttaatgccatcgc

SEQ ID NO: 617 - DNA, 79 bp, Ovine astrovirus
atcttttgttagtggccgttacagagggtgtccgtgtggaggaccacatgacatactctgtggccactcgtaacgggat

SEQ ID NO: 618 - DNA, 107 bp, Ovine astrovirus
gttggttcggacgatgcagtcaagattaggtggggtgcccaagaagacatggcacgtgtcacatataggcatcccactaaggatattgcattgatggccttgccaac

SEQ ID NO: 619 - DNA, 86 bp, Turkey astrovirus
actaaggtatcacatgcagctattttgacagaattggataggatgagaactaaagttgaggaggtggcgcttgtgtctgctagagt

SEQ ID NO: 620 - DNA, 78 bp, Turkey astrovirus
tcaaaagtgagtcaacacaagtgaaagttaaagtcaagcgtgttattgacttgtttgaatgtgtggacacactggtgg

SEQ ID NO: 621 - DNA, 118 bp, Cherry mottle leaf virus
tatccctacatagcctgcttgagtattaaagcaaataaaatgagcaaaatggaaagaatgggagctcatagtgttaagaattatgatatatttaacaggcttgtaacttcaagggata

SEQ ID NO: 622 - DNA, 101 bp, Cherry mottle leaf virus
tgttcagagtgcaatttgctccattcagaaaactggaattgatgtggagataatattggttgctagcatgatagagaaagagctatattgcaatttgggca

SEQ ID NO: 623 - DNA, 73 bp, Frog adenovirus 1
cgcggaagcgtacggcttgaagacaaccaaaggaaattgtccttttaaagctgtaacagaattttattccgtg

SEQ ID NO: 624 - DNA, 102 bp, Turnip mosaic virus
acttccagaactccatcaattactttgctgctttcccagatgattttgccgagaagtatcttcataccattgaagcacacgagtgggtcaagcactggaagt

SEQ ID NO: 625 - DNA, 73 bp, Turnip mosaic virus
cttggtaatgtaacggtaaagcaggcacgaacaatgtctgtatttgagataacaccgttctacacaagccaag

SEQ ID NO: 626 - DNA, 81 bp, Turnip mosaic virus
gacatgagcttagctcgatacgcatttgatttctatgaaatgacttctaggactccaatacgtgcgagagaggcacacatc

SEQ ID NO: 627 - DNA, 67 bp, Rat cytomegalovirus
gatcatggacgagtaccgggacccggacatcgacgcccaagatgcgatcctgccgccgccgaagatc

SEQ ID NO: 628 - DNA, 81 bp, Rat cytomegalovirus
cgccacggtggcggacaacggcctgttcacgctcaacttcgtggacgaggacgcggtgaaggtcttccagctgccgcggtg

SEQ ID NO: 629 - DNA, 71 bp, Rat cytomegalovirus
ggtccaggacctgttccagatcttcccgatgcacgtgtaccgcaacgaggagatcgacgcgtgggtccgcc

SEQ ID NO: 630 - DNA, 97 bp, Parvovirus H1
cagagagtttgaaaccaaggcgggaaacggaagtgggcgtggctaactgtatataagcagtcactctggtcggttactcactctgctttcatttctg

SEQ ID NO: 631 - DNA, 118 bp, Parvovirus H1
catttttagaactgaccaaccatgttcacgcaagtgacgtgatgacgcgcgctgcgcgcgctgccttcggcagtcacacgtcactagcgtttcacatggttggtcagttctaaaaatg

SEQ ID NO: 632 - DNA, 86 bp, Lactate dehydrogenase-elevating virus
tccagacccagttctcctgcatcagtgagcccggctagcagtgttgatctcagcgctgctggcttgttgctgagcggtactgagtc

SEQ ID NO: 633 - DNA, 116 bp, acute bee paralysis virus
agacttttctaagcatgtaagtatagtttcttatggagatgataatgttattaactttagtgatgaagttagtgaatggttcaacatggaaactattactgaagcttttgagaagt

SEQ ID NO: 634 - DNA, 78 bp, acute bee paralysis virus
agctatttgtggaaatgattcaagtgaatttatatcagcaataaatagatctagttcaccgggtttcccatggatacg

SEQ ID NO: 635 - DNA, 111 bp, acute bee paralysis virus
ggtggatacattaaaggatgagagaagaccaattgaaaaagtagatcaactgaaaacacgtgtgttttctaatgggcctatggacttttctatcacttttagaatgtacta

SEQ ID NO: 636 - DNA, 87 bp, Saimiriine herpesvirus 2
ataaaagtttaagtaagatacttattttctagtagctagtacgttgcttgctcatttttctaatagtgtttattctaaaacttatat

SEQ ID NO: 637 - DNA, 77 bp, Meleagrid herpesvirus 1
gcaacttaattactgtcacctcattataaattctcgatcggtcgggcggtttatggcaagcatagataagtatttgc

SEQ ID NO: 638 - DNA, 94 bp, Meleagrid herpesvirus 1
accgcgacaagaatagattttgtgatcttttgcgccccatgggcacaattgtgaccatgctggggatcacagaatgtggtaaacgagtggcggt

SEQ ID NO: 639 - DNA, 76 bp, Meleagrid herpesvirus 1
tgaaattggatggatatggcatcgttaatcaaaaagggatgttcagggtttgggatgcaggtgccaatcagtttca

SEQ ID NO: 640 - DNA, 126 bp, Meleagrid herpesvirus 1
cagtctcggtgctgaaggaagcaatagcagatattaatacggtcgatgagacgatatctcaacaggatatagtcttatctactgaacgcgcggatatgttttcattcttacacgcattattgactg

SEQ ID NO: 641 - DNA, 82 bp, Meleagrid herpesvirus 1
ggatatgaaagagacgtctaaatttaaaatcgtacacaccgaacagctggaacgtatgaccagattactttcttccctgtcc

SEQ ID NO: 642 - DNA, 60 bp, Meleagrid herpesvirus 1
taatggatgtgtttaccaaattgtttaattacataatagagaatggtgcacagactgtta

SEQ ID NO: 643 - DNA, 67 bp, Meleagrid herpesvirus 1
ttatggacatcttccgttacttcagtgttggtcaatgctgaaataaaatcggaatttgatgccgtaa

SEQ ID NO: 644 - DNA, 87 bp, Meleagrid herpesvirus 1
cctgtgtgatagtttgttggaggaggccagtatgtttagcgatgccgctgcaagattcttctctgatctgggagctgattatgcggg

SEQ ID NO: 645 - DNA, 92 bp, Meleagrid herpesvirus 1
gcggatataatggctgctattagggactcgtataattcgtcaaacgctatgttggctgatatgaggctcaaagtggtaacgtttagaaccgt

SEQ ID NO: 646 - DNA, 61 bp, Meleagrid herpesvirus 1
gtggatgtcgataatagcgaaatggatatggtacacatagctataaatattcgatatccac

SEQ ID NO: 647 - DNA, 53 bp, Heliothis zea virus 1 (HZV-1)
actcttgtacaccattccatttatactaaatgtacccgttattttacaagtgt

SEQ ID NO: 648 - DNA, 87 bp, Vaccinia virus
gctgaagtaattaatttttctgcctcgtttttactacaactagttttcatcaatgtagtgacgatgtattgtttagttactcttggt

SEQ ID NO: 649 - DNA, 62 bp, Rachiplusia ou multiple nucleopolyhedrovirus
acgagttaaaaagggtcatatttaaatttagttgagtttatgagataagattaaaagcacgt

SEQ ID NO: 650 - DNA, 130 bp, Rachiplusia ou multiple nucleopolyhedrovirus
cgagttcggttttgaaaaacaaatgatgtcattcttgatcatgttttacgagcagaattctacccgtaaagcgagttcaggtttaaaaacaaatgacatcatttatataatgacatcatctctgatcgcg

SEQ ID NO: 651 - DNA, 53 bp, Rachiplusia ou multiple nucleopolyhedrovirus
tatgactcaagttatgagccgtgtgcaaaacatgacatagcctatgagtcata

SEQ ID NO: 652 - DNA, 74 bp, Yaba-like disease virus
tggataacgtaatagaaatactatctgtaataaaggattctcagaatacaatagcttttttagatatgttacca

SEQ ID NO: 653 - DNA, 130 bp, Fowlpox virus
ttacagcgttaggtgttatagtcttaatatttgtagtacctatattactataattgtttaaatagattaactattgttacgggtatatgatatatctactataattagtatgttataaaaaataaaaaca

SEQ ID NO: 654 - DNA, 109 bp, Fowlpox virus
ggtgataagtcttatatagcaatatagaagtaaacataggcaaaacaagtattctaatagatattttgctaactatgtagtacaatataagtatattaattttgttacc

SEQ ID NO: 655 - DNA, 84 bp, Yaba-like disease virus
cgcaaaatatgcctagtgctctggtgtcgttatatccgttcgataccgaatatataatgatagtgcttttttttggtatatgtg

SEQ ID NO: 656 - DNA, 96 bp, Yaba-like disease virus
ccgataatgtagaaaatataacgtatgatttacctcaggatagtataatttacgatttagatggaaaatcagatgttgctgtttatgatattccgg

SEQ ID NO: 657 - DNA, 87 bp, Yaba-like disease virus
gagtgtataaaagtaaaacaactgaacaaatacatggagtttttatacatcaaaaaattttatgggatgttttaacttggatatctc

SEQ ID NO: 658 - DNA, 62 bp, Yaba-like disease virus
tatatgtcaaaattacgacattttacacggagagtgttttaaagtcgttttaatgtcaaata

SEQ ID NO: 659 - DNA, 131 bp, Human coronavirus 229E
aaaagccaaaccaccgttaaaccgtaattctgtttttacatgcttccaaattacaaaagactccaagtttcaagttggtgagtttgtgtttgagaaagtagattacggttctgatacggttacttacaaat

SEQ ID NO: 660 - DNA, 130 bp, Human coronavirus 229E
agttatgactacgttagtttgctggttatgctactttgtgcaatttctaatgaatggtatattggtgctattatttttagaatttgtcgttttggtgttgcatttttaccagtggaatacgtgtcttact

SEQ ID NO: 661 - DNA, 112 bp, Human coronavirus 229E
caaccatggacggtttttgtcagtacaaaggcaagtgggtacaagtgcctataggtacaaatgaccctataagattttgtcttgaaaatactgtttgtaaagtttgtggttg

SEQ ID NO: 662 - DNA, 60 bp, Human coronavirus 229E
caagacttcaaaacttttgatttgttgaaatatgatttcacagaacataaggaggttttg

SEQ ID NO: 663 - DNA, 129 bp, Human coronavirus 229E
caccaattaaaaatacagttgatacaacacctaaggaagaatttgttgttaaagagaagttgaacgccttcctcgttcatgacaatgtagctttctaccaaggtgatgttgatactgttgttaatggtg

SEQ ID NO: 664 - DNA, 91 bp, Human coronavirus 229E
cagacatcagatactgctcatgcctgtaatgccaatcgttttaacgttgccattactagagcaaagaaaggtattttctgtattatgtctg

SEQ ID NO: 665 - DNA, 90 bp, Human coronavirus 229E
caggtgaacttgtgagatttgttaagtctatttgcaattcagctgttgctgtcgtgggtggtactatacaaattctcgctagtgtgcctg

SEQ ID NO: 666 - DNA, 105 bp, Human coronavirus 229E
cctgatggccgatgttgatgatcctaaattgatgggatgggactatcctaagtgtgatagagctatgccctcaatgattcgtatgttgtcggctatgatcttagg

SEQ ID NO: 667 - DNA, 108 bp, Human coronavirus 229E
gacatcttgtacacacctccgactgtcagttatggttctacattacaggctggtttgcgcaaaatggcacaaccatctggctttgtggagaaatgtgttgtccgtgtc

SEQ ID NO: 668 - DNA, 124 bp, Human coronavirus 229E
gatgtactacgtaatagctttggtaaagatcttaatgctaatatgtctttagccgagtgcaagagagctttaggcctgtctattagtgatcatgaatttactagtgctatttctaatgcacatc

SEQ ID NO: 669 - DNA, 72 bp, Human coronavirus 229E
gatgtttcaaaaactactctaggcggtttacacttgttgatttcacaagtacgtctgagtaaaatgggcatc

SEQ ID NO: 670 - DNA, 64 bp, Human coronavirus 229E
gcagaggatgtttgtacttgttacgataatagtatacaaggttcatacgaacgttttactctgt

SEQ ID NO: 671 - DNA, 131 bp, Human coronavirus 229E
ggagtttctgaaattgttaatactgtcgctggcattccatctaatgtgtatcttgttggtaaaactttaatttttacactacaagctgcttttggtaatgctggtgtttgttatgacatttttggagtcac

SEQ ID NO: 672 - DNA, 87 bp, Human coronavirus 229E
ggtggcgtctctttattagctactatgactacaagacagtttcatcagaaatgtctgaaatccatagtagctaccagaaatgccacc

SEQ ID NO: 673 - DNA, 117 bp, Human coronavirus 229E
gtctttaatatatttcaggctgtaagttctaacattaattgcgttttgagcgttaactcgtcaaattgcaataattttaatgttaagaagttacagagacaactttatgataattgc

SEQ ID NO: 674 - DNA, 94 bp, Human coronavirus 229E
gtgaaacattttggcgttacaactttgatataactgaaagcaagtattcttgcaaagaggtttttaaaaattgtaatgttttggatgatttcat

SEQ ID NO: 675 - DNA, 64 bp, Human coronavirus 229E
gtggtaagagtttgccggctattaaattgaattttggaatgcttaatggtaatgcaattgctac

SEQ ID NO: 676 - DNA, 106 bp, Human coronavirus 229E
gtgtcgaacagcttgaaccgtgtgctcagtctagacttttgagtggtgttgcttatactgctttttctggacctgttgacaaaggtcattatactgtttatgatac

SEQ ID NO: 677 - DNA, 118 bp, Human coronavirus 229E
gttacaacagacctactatgctggatattggacaagctcgcgtagcatatcaagtggcagctcgctattttgactgttacgagggtggctgtattacatctagagaggttgttgttac

SEQ ID NO: 678 - DNA, 119 bp, Human coronavirus 229E
gttaccaagagttaagtcaatttagccatttggatgttgtgtggaagcatataacagaccctttgtttagtaatatgcaacctttcattgtcatggttttgctgcttatatttggtgac

SEQ ID NO: 679 - DNA, 130 bp, Human coronavirus 229E
tatgcttactttggatgaccgtggtttagctctagacaatgcacttagtggtgtgcttagtgctgctattaaggattgtgttgacataaataaagctataccttctggtaatcttattaagtttgatata

SEQ ID NO: 680 - DNA, 98 bp, Human coronavirus 229E
tccgtggttcatttattaatggtgcgtgtggttcccctggctacaatcttaaaaatggcgaggtggaatttgtttatatgcatcaaattgaactcgga

SEQ ID NO: 681 - DNA, 100 bp, Human coronavirus 229E
tgcttacatgccaattgcagaccctacacattttgacattgaagaagttgaacttttagatgcagagtttgtagaaccaggctgtggtggtattttggca

SEQ ID NO: 682 - DNA, 60 bp, Human coronavirus 229E
tgggaataccctactgcacgtcatactattcttatatgatgcctgttatgggtatgacta

SEQ ID NO: 683 - DNA, 73 bp, Human coronavirus 229E
tgttttgtttgttaatgacaaaattactgaattccaattggattacagtattgatgtcattgataatgaaata

SEQ ID NO: 684 - DNA, 103 bp, Human coronavirus 229E
ttaatgcgttacctgaagttaatgcagacattgttgtcgtggatgaggtgtctatgtgcactaactatgacttgtctgtgattaaccagcgtatatcatataa

SEQ ID NO: 685 - DNA, 81 bp, Human coronavirus 229E
tttcattttctgatgacgttgaagtaaaagacattgaacctgtttacagagtcaagctttgctttgagtttgaagatgaaa

SEQ ID NO: 686 - DNA, 96 bp, Human coronavirus 229E
ttttatggctttaaagatgctgttacttttgcaacagttgatcatagtgcttttgcctatgaaagtgctgttgttaatggtattagagtgttaaaa

SEQ ID NO: 687 - DNA, 131 bp, Human coronavirus 229E
acagttcgtgagtttgttatttcacgcacaggacatttttatattaatggctatcgctatttcactttaggtaatgtagaagccgttaatttcaatgtcactactgcagaaaccactgatttttgtactgt

SEQ ID NO: 688 - DNA, 85 bp, Human coronavirus 229E
attatgttgcattgcagactgatgttttacaagaaaatcagaaaattcttgctgcatcttttaacaaagcaatgaccaacatagt

SEQ ID NO: 689 - DNA, 64 bp, Human coronavirus 229E
ctgcagatgttagtgagatgctcacttttgacaagaaagcgtttacacttgctaatgttagtag

SEQ ID NO: 690 - DNA, 116 bp, Human coronavirus 229E
gaaactaaagggcctttgtgtgttgacacatcacacttcactaccaaatacgttgctgtttatgccaatgttggtaggtggagtgctagtattaacacgggaaattgccctttttc

SEQ ID NO: 691 - DNA, 108 bp, Human coronavirus 229E
gtgcgttgatggtacaaacggttatgtgttgcgacaacctaatcttgctctttacaaagaaggcaattattatagaatcacatctcgcataatgtttgaaccacgtat

SEQ ID NO: 692 - DNA, 131 bp, Human coronavirus 229E
tggcagattttgttcaaattgaaaattgcaatgtcacatttgttaacatttctcgctctgagttgcaaaccattgtgccagagtatattgatgttaataagacgctgcaagaattaagttacaaattgcca

SEQ ID NO: 693 - DNA, 82 bp, Invertebrate iridescent virus 6
ggcaccaaattgatttgttgataacaaagttacagatggaattctcactcttagccaagtatataacaaataatctccggcc

SEQ ID NO: 694 - DNA, 58 bp, Potato virus V
ttggaattaatggggtggcttagcgaaacactcgctgaggtaaactcattgatttcaa

SEQ ID NO: 695 - DNA, 126 bp, Helicoverpa armigera nuclear polyhedrosis virus
gtgtctgaagcgtatgcgaaaatcattaattgtcaagtgccctctgtgcagatcgatcaatattaaatattcgtattactgtatcagcggcaatacagtgaatgttgtcagtacgatgtcgagcac

SEQ ID NO: 696 - DNA, 131 bp, pestivirus type 2
atcatagatgaaatagcaggagggaccaacttcatctcaagacttgtagccgctttgatcgaagccaattgggcctttgacaacgaagaagttaggggtttaaagaagttcttcctgttgtctagtagggt

SEQ ID NO: 697 - DNA, 66 bp, pestivirus type 2
cgagcgctgagggatttaaccagggtctggaatagcgcatcaaccacggcattcctcatctgcttg

SEQ ID NO: 698 - DNA, 112 bp, pestivirus type 2
ttccgtgacatttgagctcctgttcgacgggaccaacccatcaactgaggaaatgggagatgacttcgggttcgggctgtgcccgttcgatacgagtcctgttgtcaaggga

SEQ ID NO: 699 - DNA, 73 bp, Bovine herpesvirus 4
ggctttgactccatcaagaaacatcagcagatttatcatgctctcagatcaaaaatggaatgtctcaatggct

SEQ ID NO: 700 - DNA, 67 bp, Bovine herpesvirus 4
gtctgattatagcatcatatgtgaatcatcaatttatagcatgagaactgaaaataaatcatcagac

SEQ ID NO: 701 - DNA, 95 bp, Cercopithecine herpesvirus 7
aattgaggcattagaacatgctataagtttaattcgtaacaaacttgatactattcaattacccgacttgtcgtctgaaattcaaaaactcaatt

SEQ ID NO: 702 - DNA, 61 bp, Cercopithecine herpesvirus 7
caggcattggaagttacaaccaatttgatgagcaacttggtcctgcgtccggagtttcctg

SEQ ID NO: 703 - DNA, 88 bp, Cercopithecine herpesvirus 7
gaaatattttaaggcccgtggcagattttgtcggacttagatcttcagtagacatatttccggagatttgtgttgaacttaatatttc

SEQ ID NO: 704 - DNA, 121 bp, Cercopithecine herpesvirus 7
gaattgatgcattgtattcgttaagagttaagttagatgtacttgagaagcgcattgaagccgctgaaatatcttgggatacggcatggcaatcctttaaacaaaatacaggtgttaattc

SEQ ID NO: 705 - DNA, 113 bp, Ectocarpus siliculosus virus
gcgatggcacgggaccactcgataggtattttgttgtgtacagcgtattccctcttcgcatattcgaggtgcgcaacggagccgagtgtacggaagtccagagcgtgctgcgc

SEQ ID NO: 706 - DNA, 79 bp, Ectocarpus siliculosus virus
gttcttggagtacattctccgtccggtggagtcgtgggacaagcataactacgtcgtagacgtgaactactttgagaac

SEQ ID NO: 707 - DNA, 108 bp, Tomato mosaic virus
aaagatggaagaaactgaggaaatgtacaatgcactgtccgaactgtctgtacttaaaaattcagacaagttcgatgttgatgttttttcccagatgtgccaatcttt

SEQ ID NO: 708 - DNA, 90 bp, Tomato mosaic virus
accggaaactgatcaaaattacggagaatgcgttagagatcagggtgcccgatctttatgtcactttccatgataggttagtttctgagt

SEQ ID NO: 709 - DNA, 130 bp, Tomato mosaic virus
cagcaaaggtggttttggtggatggcgttccagggtgcgggaagacaaaggaaattctttcgagagttaatttcgaagaagatctaattcttgtccctggtcgtcaagctgccgagatgatcagaagaag

SEQ ID NO: 710 - DNA, 79 bp, Tomato mosaic virus
ctaaagtactacaccgttgtgatggatcctttagttagtatcattagagatttagaacgggttagtagttacttattag

SEQ ID NO: 711 - DNA, 130 bp, Tomato mosaic virus
gttacaacttttatcggtaataccgtcatcattgcttcgtgtcttgcatcaatgctcccgatggaaaaattgataaaaggagccttctgcggagatgacagtttgttgtactttcctaagggttgtgagt

SEQ ID NO: 712 - DNA, 71 bp, Tomato mosaic virus
aagtactacaccgttgtgatggatcctttagttagtatcattagagatttagaacgggttagtagttactt

SEQ ID NO: 713 - DNA, 63 bp, Aconitum latent virus
atagcgttagagctgggatgcttgctgatacctttcataaagctcaaaccggcgtattgcagt

SEQ ID NO: 714 - DNA, 99 bp, Aconitum latent virus
tggagttggtattcaaagcttttgacattgaagcatatgttactgaaaatgatgataccagagtgtacaatgcttcgggtacgcttcggaaaaacttca

SEQ ID NO: 715 - DNA, 84 bp, Cydia pomonella granulovirus
gcgagcgatattgtcattatgatgattaagcggagcggtcaactgcagaacgtgttaaacaatatagtggcgctgtccgagtgt

SEQ ID NO: 716 - DNA, 121 bp, Cydia pomonella granulovirus
gtataacaagttgaggcagcagtgtaatgtgtggtccgatttgctaattgtgcaccagcccggcgagaatatgtacgattggctcactcgcttctacattcgctccttcctcaacgattac

SEQ ID NO: 717 - DNA, 103 bp, Cydia pomonella granulovirus
gtgtgtattcgcacgagaaaaagtggtttgagtacatggtgaagacggagacgataagccggtgtgactttttgcccgagtaccagtttttgtgcgaccacat

SEQ ID NO: 718 - DNA, 62 bp, Cydia pomonella granulovirus
taagatattggttgacggatatgacagggcgtgcagcaatcgtataggacaaatgtattttg

SEQ ID NO: 719 - DNA, 64 bp, Barley yellow mosaic virus
agctcaaaagtgtacccaagtctgttatggagcataacaactcagttgcactcgaatctgagct

SEQ ID NO: 720 - DNA, 80 bp, Barley yellow mosaic virus
agtcggggtcgacgtcgcaactcgagttggaagaattagcattggtactttcaacatgaactgttacttctacaacgact

SEQ ID NO: 721 - DNA, 67 bp, Barley yellow mosaic virus
atggtacatactttggcgaacatgttgctatgctacgcgacttaaaacgttatatctatggtaccgt

SEQ ID NO: 722 - DNA, 68 bp, Barley yellow mosaic virus
catcaagagggatatggatgaagccgttgagagcaaactatgtggtttcacctttgtttttccagatg

SEQ ID NO: 723 - DNA, 83 bp, Barley yellow mosaic virus
gtcctgaagcagctaggaaatatcctttacatgttgaaactagcgtttgcgattcgtatcggaagttcattgcagctcaaggc

SEQ ID NO: 724 - DNA, 94 bp, Barley yellow mosaic virus
ttgctgacaaactgcgctcttttctcgacacaaagcttgttgttggacaccaccagcggaagctactagaagaaacagctcaggttgttatcaa

SEQ ID NO: 725 - DNA, 104 bp, Taura syndrome virus
gatattgtaatatgtgaaatgggaaattctatttcagcacgcaaggacataacttcatatttccctacggtgaaggaactcccaggattaacaggtatgatatc

SEQ ID NO: 726 - DNA, 130 bp, Taura syndrome virus
gatgcctgtgttcatgacgtaaagcgaattttgaatgctccaggagtgtctaatgcggagaagagagttttgacgcatgaggaatccattacgggtattgagaatcgtcagtacatgaatgcattgaatc

SEQ ID NO: 727 - DNA, 115 bp, Taura syndrome virus
tgcaacctcaaacgtaaatccaggcgcgtatgtccccaagtctattcatagtgcagatgcattcagacggcgtttagatctatgcgtttatgtagatgttaaagatgagtttgca

SEQ ID NO: 728 - DNA, 129 bp, Taura syndrome virus
ttgctaatgatgaatacgttattactatttcatgtagcctattagttgttgctgacgttggccccacccaagcagttgcacgagaaagagctgcaaagagatttttgaagatgtatgattattctgcaa

SEQ ID NO: 729 - DNA, 76 bp, Invertebrate iridescent virus 6
gtcaaaagttttgttaaaagaaatgatgttcttgttggtaaagttataacaaaaatatcaaaagacggaactagac

SEQ ID NO: 730 - DNA, 62 bp, Bovine coronavirus
aagattgtggttttgttatgcagtttggttatattgactgcgaacaagacttgtgtgatttt

SEQ ID NO: 731 - DNA, 74 bp, Bovine coronavirus
aagtattaatacctcttgtagggtcttgcagcgtgttatgcttaaagctgcaatgctctgcaacagatatactt

SEQ ID NO: 732 - DNA, 79 bp, Bovine coronavirus
aagtttgtggattttggcgggatggaagttgttcatgtgttagcactgacactactgttcagtcaaaagatactaattt

SEQ ID NO: 733 - DNA, 125 bp, Bovine coronavirus
accctgtatggccaaactgtagtttattttggaggttgtgtgtattggagtccagcacgtaatatatggattcctatattaaaatcttctgttaagtcttatgacggtttggtttatactggagt

SEQ ID NO: 734 - DNA, 85 bp, Bovine coronavirus
agattttcagttcatgctttggtgtaacgatgagaaagttatgactttctatcctcgtttgcaagctgcatctgactggaagcct

SEQ ID NO: 735 - DNA, 130 bp, Bovine coronavirus
agggtcaggatgtcatcttcagccaattcgacagcctgagagtcagctctaaccagagcccacaaggtaatctggggagtaatgaacccggtaatgtcggtggtaatgatgctctggcaacctccactat

SEQ ID NO: 736 - DNA, 88 bp, Bovine coronavirus
cagctttttaaaggtttagcacagcctgtggatttcttggcattgactgctagttctattgctggtgctatacttgctgtaattgttg

SEQ ID NO: 737 - DNA, 73 bp, Bovine coronavirus
gcttcaatgttgctattactcgagccaagaaaggtattctttgtgttatgagtaatatgcagttgtttgaagc

SEQ ID NO: 738 - DNA, 63 bp, Bovine coronavirus
gttaaacgcgtgcgtgcttgggttggctttgatgctgaaggcgctcatgccacgcgtgatagc

SEQ ID NO: 739 - DNA, 83 bp, Bovine coronavirus
tagttgctcctttgaggatgaattgacacctagcgatgtttatcaacaactcgctggtatcaagttacaatcaaagcgtacta

SEQ ID NO: 740 - DNA, 89 bp, Bovine coronavirus
tataataagcagatggctaatgtctctgttttaactacaccctttagtcttaaagggggtgcagtttttagttattttgtttatgtatg

SEQ ID NO: 741 - DNA, 110 bp, Bovine coronavirus
tattaaagcccaatttaaaacatttgagaaagtagatggtgtgtatactaattttaaattgataggacacaccatctgtgatattcttaatgctaagttgggttttgata

SEQ ID NO: 742 - DNA, 76 bp, Bovine coronavirus
tatttggagtatataaagaagttgtacaatgacctgggtaatcagatcttggatagctacagtgttattttaagta

SEQ ID NO: 743 - DNA, 69 bp, Bovine coronavirus
tcatgtgatggtggattgtcgccgacttcttaaacaagaatgttgtgtgcagtctagcctaatacgtga

SEQ ID NO: 744 - DNA, 70 bp, Bovine coronavirus
tcatttgaggagcaggatgaaatttacgcctatactaagcgcaatgtcctgccaacacttactcaaatga

SEQ ID NO: 745 - DNA, 108 bp, Bovine coronavirus
tctaaggttaagggtgtgcctaatatgcatgttgtggtagtggaaaatgatgccgataaagctaattttcttaatgctgctgtattttatgcacagtctttgtttaga

SEQ ID NO: 746 - DNA, 68 bp, Bovine coronavirus
tgctattagtgctaagaatagagcccgcactgtcgctggtgtttccatacttagtactatgactggca

SEQ ID NO: 747 - DNA, 94 bp, Bovine coronavirus
tggtacattgagtcgtgaagatcttgagattggttacaccgtggattgttcttgcggtaaaaagctaatccattgtgtacgatttgatgtacca

SEQ ID NO: 748 - DNA, 89 bp, Bovine coronavirus
tgtagttccacaaggtggttatgttgccgattttgcatattggttcttaaccttatgtgattggcagtgtgttgcatactggaaatgca

SEQ ID NO: 749 - DNA, 118 bp, Bovine coronavirus
tgttggcgccatagtgttacatgtgattacttgtataatccacttattgttgatattcaacagtggggatatattggatctttatcaagtaatcatgatttatattgtagtgtccaca

SEQ ID NO: 750 - DNA, 130 bp, Bovine coronavirus
tgttggtcgtgtgatttctgttgtctctttgtggtacatgggttctaacttagaggaagaaattcttcttatgttggcttctctttttggtacttacacatggacaacagctttatctatggctgcagca

SEQ ID NO: 751 - DNA, 108 bp, Bovine coronavirus
ttcagatgttgatactaagtgtttagctgattctgtcatgtctgctgtatcggcaggccttgaattgacggatgaaagttgtaataacttggtgccaacatatttgaa

SEQ ID NO: 752 - DNA, 109 bp, Bovine coronavirus
ttgatcaatggtatgagtctacatttggtctaagttattatagtaacagtatggcttgtcccattgttgttgctgtagtagaccaggatcttggctctactgtgtttaa

SEQ ID NO: 753 - DNA, 124 bp, Bovine coronavirus
ttgatttgttaaatttaagagagattaagcctgtttttaatgtggttaaagctgtgcgaaataaaatttctgcatgctttaattttattaaatggctttttgtcttattatttggctggattaa

SEQ ID NO: 754 - DNA, 76 bp, Bovine coronavirus
ttgtatatattgccgcgcacgagttgaacacccagatgttgatgggttgtgcaaattacgcggcaagtttgtacaa

SEQ ID NO: 755 - DNA, 69 bp, Bovine coronavirus
ttgtgaagatcataagccacaatattcgtttaagttggtaatgaatggtatggtttttggtctatataa

SEQ ID NO: 756 - DNA, 93 bp, Bovine coronavirus
gtttgtcaagtttgtggattttggcgggatggaagttgttcatgtgttagcactgacactactgttcagtcaaaagatactaattttttaaac

SEQ ID NO: 757 - DNA, 130 bp, Bovine coronavirus
catgatgttaatagtggtactacttgttctactgatttacaaaaatcaaacacagacataattcttggtgtttgtgttaattatgatctttatggtattactggccaaggtatttttgttgaggttaatg

SEQ ID NO: 758 - DNA, 87 bp, Bovine coronavirus
ctcacttctaaacaatatctactagctttcaatcaagatggtgttatttttaatgctgttgattgtaagagtgattttatgagtgag

SEQ ID NO: 759 - DNA, 114 bp, Bovine coronavirus
gttattaaagatggtgtaatgtatagtgagtttcctgctataactataggtagtacttttgtaaatacatcttatagtgtggtagtacaaccacatactaccattttgggtaat

SEQ ID NO: 760 - DNA, 68 bp, Bovine coronavirus
tgtttttgatacttttaatttccttaccaacggcttttgctgttataggagatttaaagtgtactaca

SEQ ID NO: 761 - DNA, 65 bp, Bovine coronavirus
ttcccgattgcaatattgaggcttggcttaatgataagtcggtgccctctccattaaattgggaa

SEQ ID NO: 762 - DNA, 62 bp, Culex nigripalpus baculovirus
gtcttggcggttcagtcggcaatattccacttcgcgtggatggctacagtaaaccggtggac

SEQ ID NO: 763 - DNA, 131 bp, Culex nigripalpus baculovirus
ccggtgcacagcgagccccagttgtccgcatatctgtacacaatacgaattgcaggtaagtttgtacgtgtgactcacgttcgcaacgagtattggtactgcgtggcggacctgaagctggcggtcgacgg

SEQ ID NO: 764 - DNA, 105 bp, Culex nigripalpus baculovirus
cgtgtatccgcgacgcacgccaagatggagtggtatcgtagtgagtccaagagcgccaagagccgctgtgatgccaaactgtcggtgaagggtatgcgggacgcg

SEQ ID NO: 765 - DNA, 75 bp, Spodoptera litura nucleopolyhedrovirus
tgcgtaccgtttgaattcggccatagtgcacgatcgtgactttaactatgactattttggatttaaaacgatgca

SEQ ID NO: 766 - DNA, 131 bp, Spodoptera litura nucleopolyhedrovirus
cgacgtgcgcgcctaccagagcttgatcgattcgtactttacgtttgaatattacaaccatctgttcggcggcggcaccgtgaacatgttcaacgtaaacaattcgatcaacattgcgggtagcagacgcg

SEQ ID NO: 767 - DNA, 73 bp, deer tick virus
aagggaaaatgcttgaggtggccggacactttcgtttgacggaggagaaaaggaaacatttcagacatctctt

SEQ ID NO: 768 - DNA, 77 bp, deer tick virus
gggaaactgaatcttgagggagggcgagtcatgggggccatcccaatagacttacctcgtggaacctcaggcagccc

SEQ ID NO: 769 - DNA, 104 bp, deer tick virus
tgcggattttttgggaaaggaagcatagtggcctgtgccaagtttgaatgcgaggaagcaaaaaaggcagtaggtcatgtttatgactcaacaaaaatcacgta

SEQ ID NO: 770 - DNA, 104 bp, deer tick virus
tgctgtcgtggctttggcttggctcatgctggatagttggatggctagggtgactgtgatccttctggcgctgagccttgggcctgtatacgccacgagatgca

SEQ ID NO: 771 - DNA, 64 bp, Zucchini yellow mosaic virus
ataaacccgtcactgttaatcaattggatcacgataaattcttggaagcagttgatggggttat

SEQ ID NO: 772 - DNA, 79 bp, Zucchini yellow mosaic virus
cggctcaggtgagaagacagtagcagctgtcacgaaggacaaggatgtgaacgctggttctcatgggaaaattgtgccg

SEQ ID NO: 773 - DNA, 130 bp, Zucchini yellow mosaic virus
tctcttgtggtttcaagatttttgcgcgatgctacagcgacattatataccttgtgaacgtgtgtttggtattctccttggtattacaaatgtctaatactgtacgcaacatgatagcggcgacaaggga

SEQ ID NO: 774 - DNA, 98 bp, Zucchini yellow mosaic virus
tgatccatacatattattgcttggcatgatctcacctaccattcttgtacacatgtataggatgcgtcattttgagcgaggtattgaaatatggatta

SEQ ID NO: 775 - DNA, 109 bp, shrimp white spot syndrome virus (white spot bacilliform virus)
agaagaagaggaagaagaagcggaagaagaagcgatggaccaggagcctgcagaagtagacttcctttcagtgcctcatttacgccgtaaaattcgtcaagctgtttct

SEQ ID NO: 776 - DNA, 75 bp, shrimp white spot syndrome virus (white spot bacilliform virus)
tccccctgcaagaagtgccaagataacggttgaaggagtcaagggatttttcagcggttttcgtgacattttgga

SEQ ID NO: 777 - DNA, 70 bp, shrimp white spot syndrome virus (white spot bacilliform virus)
tgctgctcaaggagaatgtggatcttgggcaacattcgacgacccgcattctgtattgccttgggtggca

SEQ ID NO: 778 - DNA, 75 bp, shrimp white spot syndrome virus (white spot bacilliform virus)
ccatgacagtagatgtggaaaattctgtatcgtctgctaaagactcggtggatattagatttttcactctcaggg

SEQ ID NO: 779 - DNA, 68 bp, shrimp white spot syndrome virus (white spot bacilliform virus)
gaggaggggttgcattcgtagaaggtttgacgttagaaaatggtatcttcactgaagtaattgtcctc

SEQ ID NO: 780 - DNA, 87 bp, shrimp white spot syndrome virus (white spot bacilliform virus)
tgggggtaacaatagtagcagtagtatcaataacgaagatgatggtgatgatgacgatgccgttgacgctactgcattatgccccca

SEQ ID NO: 781 - DNA, 128 bp, shrimp white spot syndrome virus (white spot bacilliform virus)
ggtacatgtggcccttctctgctttgcaagtggggacaaaaataagagacgctagaacgtttagtgttttatttggttctgatatgcatgaaggaagaaacaatgacaggatttgggaaaatatggcc

SEQ ID NO: 782 - DNA, 61 bp, shrimp white spot syndrome virus (white spot bacilliform virus)
ggtgtataattgtactctatgttgtctagctttaagaaaatgtagtgatagttatttgtcc

SEQ ID NO: 783 - DNA, 66 bp, shrimp white spot syndrome virus (white spot bacilliform virus)
ggatgaggcaaagtttgtgcctatacctttatttggcgtggaacctttacaccctttactcaattc

SEQ ID NO: 784 - DNA, 125 bp, shrimp white spot syndrome virus (white spot bacilliform virus)
tcttaaaaatgcaaaaaagcccccaactgatttaacgatgacggattttgacttttatgaaaaatacataaggtcagatattgtattgggaaaatcaaacaagttgtcgggtatgtttagtgaga

SEQ ID NO: 785 - DNA, 130 bp, shrimp white spot syndrome virus (white spot bacilliform virus)
aaggttaacaattttcttgaacataccaattgtactattaaattggccaaaagagttcactttgtcaaaagattataaagttcttcttttggatagtatttctagttgttcttctaaaatggctgtccct

SEQ ID NO: 786 - DNA, 103 bp, shrimp white spot syndrome virus (white spot bacilliform virus)
tagtaatcaaactcaagcaaatttgcacatggaactgataaatatactgaaagaagacgacgataatcaaccatgtcaaacgtataagcttggtcaaagactg

SEQ ID NO: 787 - DNA, 83 bp, murid herpesvirus 4
ctgaccatcgaggagcacgtgttattctagacctctcttccagctaagatagcatgtgccgtcctctttgtttcccaagtcag

SEQ ID NO: 788 - DNA, 63 bp, murid herpesvirus 4
gaagtagcgaacctctgctcactgcccgggccctccgggaggtgagcaggagttgcgcttttc

SEQ ID NO: 789 - DNA, 56 bp, murid herpesvirus 4
gaggaagtgggtccaactttatccctatagtgtgatagaaatggccgtacttcctt

SEQ ID NO: 790 - DNA, 80 bp, shrimp white spot syndrome virus (white spot bacilliform virus)
aatttactccctattttcggagtcaatacgggatagtaaatgttgaaaaaaatatccctggttacatatggggagaaatt

SEQ ID NO: 791 - DNA, 128 bp, Feline immunodeficiency virus
gaaatggtaggcaatgtggcatgtctgaaaaagaggaggaatgatgaagtatctcagacttattttataagggagatactgtgctgagttcttccctttgaggaaggtatgtcatatgaatccatttc

SEQ ID NO: 792 - DNA, 93 bp, shrimp white spot syndrome virus (white spot bacilliform virus)
tgttgaaattattctccagtaaatttctggtagcgcctctaatttctagcacagttgaagatgaggatggtgcattggggagtttttttacca

SEQ ID NO: 793 - DNA, 127 bp, Equine herpesvirus 2
cgccttgaccctggccaccctagcggcgagcgcgtttctcctgagacttgaagcaagccttcttgtttctctcaatgagtctctgtctacgcgcacgtagtgctttggacttggggaccagaaggcg

SEQ ID NO: 794 - DNA, 103 bp, Equine herpesvirus 2
cgcgttggtgatgaggtagacgatgtccctggcgccggggtcctgggcagaggcggcggtctgtttggtgttggggaacatgcccgcgtcgctcatgaccgcg

SEQ ID NO: 795 - DNA, 130 bp, Equine herpesvirus 2
gcggtctgggccccgatcaggccctgcacgtccctgaaggtcagcttctggttgaggacgtcaaagagctggtcgtactttttgccagacaggttgatgaggtgcccgccgagggtctggcccgacccgc

SEQ ID NO: 796 - DNA, 107 bp, Amsacta moorei entomopoxvirus
acagatgtagatattacacaaggtaatcttatagatagtttatcgtgttttttatttaacggatttaatatatcaatagtaacatctgttgtattatatatatttgt

SEQ ID NO: 797 - DNA, 78 bp, Melanoplus sanguinipes entomopoxvirus
tatattgatgtatataatgcatgtgttctaattctatcttcattaaaattattgccatctgttaatttacttaatata

SEQ ID NO: 798 - DNA, 84 bp, murid herpesvirus 4
acgtggtttcattgctgttgccaaaaagtttattcctatcaattaaattgtttgacacatcactgataaaatcttcaaccacgt

SEQ ID NO: 799 - DNA, 114 bp, murid herpesvirus 4
tcctctgatgtagttccctttttccatttttttctcatggtattgtgaaagttggcccagctggtaaacagggtctcataagtgcatgagtttagagcaaatctatacagatga

SEQ ID NO: 800 - DNA, 131 bp, murid herpesvirus 4
ttatcaggattagaacatttgggacagtgaggtgtttagtaaaaatggtgggcaagcacagaagtgtgaatgtccccgctgggttttgaaaatcatctatgttattgtccattctgtaagagtccaggtaa

SEQ ID NO: 801 - DNA, 78 bp, Macaca mulatta rhadinovirus
gatgtgacattcggataggttaatggttgggtcgcgcagaccggataaagcctgcaacgtattctgagtgagtatatt

SEQ ID NO: 802 - DNA, 52 bp, Macaca mulatta rhadinovirus
tgtctgtaggtgccgagataagcagccttatctccgttaaactccacagaca

SEQ ID NO: 803 - DNA, 101 bp, Monkeypox virus
tagcggatatcatttgatcggtgaatctaaatcgtattgtgaattaggatctactggatctatggtatggaatcctgaggcacctatttgcgaatctgtta

SEQ ID NO: 804 - DNA, 95 bp, Monkeypox virus
tagcgtataaaaatattcaaaatggggatgaggatgataatgataatattgtcttctcaccgtttgggtattcgttttctatgtttatgtcgcta

SEQ ID NO: 805 - DNA, 77 bp, Ateline herpesvirus 3
tgtttttttcttttaatgccatgcgtagtctccaaaaaaaggtcaaagttatgctgtgcaattaaaaacacaagata

SEQ ID NO: 806 - DNA, 55 bp, Saimiriine herpesvirus 2
accatagccccttgctgctttaatgctgccattaaagcaaattcatggctttggt

SEQ ID NO: 807 - DNA, 89 bp, Human herpesvirus 6
tatgggaatattctggtaaaagtgcatgtatcaattttagtcgtttttggatttctgtaatgttacgatttgctatgtgtattttcatg

SEQ ID NO: 808 - DNA, 58 bp, Human herpesvirus 6
ttaagcagccgcgaactcgttaatagttactttgatgttaactcaggtggtggcttgg

SEQ ID NO: 809 - DNA, 88 bp, African swine fever virus
gagaagagtctggactgtaatttttaaataataagatatttattaatatccaattattcgtttgactcgctatttccatgctctcttc

SEQ ID NO: 810 - DNA, 131 bp, African swine fever virus
ggatctgtcgtttttaaagataaaagagagacgtttgaattataaaaatctttaaatgataatatttctactaatatatcatgattcttttgttttgctaattctaagctctcttcgaaagcattagctcc

SEQ ID NO: 811 - DNA, 66 bp, Monkeypox virus
ccaccgcaatagatcctgttagatacatagatcctcgtcgtgatatcgcattttctaacgtgatgg

SEQ ID NO: 812 - DNA, 113 bp, Bovine herpesvirus 4
agatcagaggccataacctcacagtggcaaaaaaagcagctgtataagtgccaatgtatctatgggttcttgtattctgagactgagtcactgtatcaatattctcatgatct

SEQ ID NO: 813 - DNA, 130 bp, Bovine herpesvirus 4
tagaactatttgggggttgagtgtgagacaacagctgttgtaaatggtgtttgcgcctaatgccagtttttgatgccaaatacctatcataacactgttgtgctatcagaaaaacaaggtagttcctctg

SEQ ID NO: 814 - DNA, 60 bp, African swine fever virus
atgtaagttataaattggttccaaaacatattggccaatactcatgtttatggcttacat

SEQ ID NO: 815 - DNA, 109 bp, African swine fever virus
gaagcaatagatgatttctacgactgaaatatagaatagttcattttctatttgtaaaataatgatttatattctctcctaaaaatacgatcgatcctttatatgcttt

SEQ ID NO: 816 - DNA, 71 bp, African swine fever virus
ttgcgaaaaggcatacatatgatcaatatcagacctacaatgaatgtttccataatatccctttatcgcaa

SEQ ID NO: 817 - DNA, 70 bp, Human herpesvirus 6B
cggtaagttgacgtgcgtcggaatcggaagcaacaactgttgctcgaacagaaacatgtgcaactcattg

SEQ ID NO: 818 - DNA, 79 bp, Human herpesvirus 6B
tcctgaaatctgagtgatctgattcgacaaatcatcaccacgtatggtcgtcatttcaaatacacctcacgttttggga

SEQ ID NO: 819 - DNA, 123 bp, Monkeypox virus
agtattgacccacgagttataacaaagtcaaagacccattttcctactccattgagtgtaaaattcatggttgacaatttaggaaatggatatgacaaccctaattcattttgggaagatgct

SEQ ID NO: 820 - DNA, 67 bp, Monkeypox virus
gaaacgataccagttttaaacagaatacggatgcgatggctttgtatttcttagatgttatcgactc

SEQ ID NO: 821 - DNA, 63 bp, Monkeypox virus
gtggtttagcagcaacattggtgattaaaccgtacgaggtacccatcagtgatatgcaactac

SEQ ID NO: 822 - DNA, 76 bp, Monkeypox virus
tacatttaaatccgtaactagatcagatcatgagtgtgaatctagcttagatctgacgtctaaggaagtaactgtg

SEQ ID NO: 823 - DNA, 78 bp, Monkeypox virus
tgttttcaggacaggagaggccagtagatcctgttattaaattatttaataagtacgctggcttaatgtccgataata

SEQ ID NO: 824 - DNA, 116 bp, Monkeypox virus
tttgtatcacctagacggtgtagaagagcaagctctggagtcatatgtggtatgatacaatcaaaaccaaacgatgatacctattcacttcttcaacggccaaaaattgaaccaga

SEQ ID NO: 825 - DNA, 50 bp, Fowlpox virus
tgggactaacgtagtaagatgtataactatgactagatatggtagtccta

SEQ ID NO: 826 - DNA, 77 bp, ictalurid herpesvirus 1
ggagttcgggagtcggcagttgactgacagccacggaatcatcgggggtgtacacaacttccgaatccacggagtcc

SEQ ID NO: 827 - DNA, 130 bp, Equine herpesvirus 2
attacagcttaacaaccctagaaagttaccccattctttacagtgtgaaatcatgtgtgattagttctgcatgatttcacactgtaaagagtggcataattaaaaactttatgggtcggtaatctgtaat

SEQ ID NO: 828 - DNA, 121 bp, Equine herpesvirus 2
ggctccttacatttttggggattgtttgtgtggaatgtgtttttggaatatacaatgtgtctatcaccccaaacacaacacacaactttacattacagcagacctcaacacccccgggacc

SEQ ID NO: 829 - DNA, 86 bp, Monkeypox virus
agagattgatatcgcatagaaatagtaaagtttataatctcatcattgtagattactctgttaccattgtaataaattggtactct

SEQ ID NO: 830 - DNA, 128 bp, Monkeypox virus
gcctgaagctcatcttgtttagttacggatcctaatgagttattaagaaatacatcgaacggatgaacgaaggttgttttaagttgatcacatactttgtaatctagacatagatgtggaagaacggt

SEQ ID NO: 831 - DNA, 63 bp, Gallid herpesvirus 2
gatcaaggccctccgtataatgtaaatgttccaaaggtttgcataatacggagggttctgatc

SEQ ID NO: 832 - DNA, 95 bp, Gallid herpesvirus 2
gattcactacaggcggcatgaaaatgtgaaaacctctcccgctagaaatagaatctgctggggggttcacatttttaagttgtatgtagtgtatc

SEQ ID NO: 833 - DNA, 82 bp, Gallid herpesvirus 2
tcccctgtgaagtttaatgctgtatcggaacccttcgttcggtgaccacgaatggttctgacagcatgacctttctggggga

SEQ ID NO: 834 - DNA, 85 bp, Gallid herpesvirus 2
tctcctaaaagaaagttgtattctgcccggtagtccgtttgtaaggtcttgaacggactgccgcagaatagctttcttgagggga

SEQ ID NO: 835 - DNA, 95 bp, Lymphocystis disease virus 1
gaaaggcatgtgggttaatgattaaatcaggtactatgccatctttagtgaaaggcatgttttcttgggcataaatcataccacaggtacctttt

SEQ ID NO: 836 - DNA, 76 bp, Lymphocystis disease virus 1
ggcttgttttcccatattagattgatatgctatacgaggagattgtgtatgattataaaatgggatcacagaagcc

SEQ ID NO: 837 - DNA, 78 bp, Lymphocystis disease virus 1
ggttgtattaaaggcttaatttcagctttatcaatacctagtgtaaatctaacagataatgctgtatttaatacaact

SEQ ID NO: 838 - DNA, 130 bp, Molluscum contagiosum virus
ggacttgcgcagatcctcgggtccgatctcagtctcgtcgagagagcgcccgctgcgcttgacaatgtagagcagcgccttgatgtgttccagcgcgatgaggtccgcgtagagcgacttggacaggtcc

SEQ ID NO: 839 - DNA, 84 bp, Ectromelia virus
cgatgaatactttaatgacgttatacctctacataatgcttatagcgtgcaacgttgatataatgtcttatctcgtatatattg

SEQ ID NO: 840 - DNA, 87 bp, Amsacta moorei entomopoxvirus
cagtatctcgtgataatttttcattgacgaattgcgtctcatttatttctataactgcaatacgtttgaccaaagcaggatctactg

SEQ ID NO: 841 - DNA, 95 bp, African swine fever virus
ggaagcaatgatttttacatagtgttcctgcaaattttaatacctcttcaagttcactttgttggatagtatcgcaggaactcggtgttgtttct

SEQ ID NO: 842 - DNA, 90 bp, African swine fever virus
ggtttcagccgaggcaatgtttacatagtcctggtgcttaatttccattttaatgcttgtatactgtttgactgtctccagcttttcacc

SEQ ID NO: 843 - DNA, 107 bp, Ectromelia virus
ccattcttaataatcgtcagtatttaaactgttaaatgttggtatatcaacatctatcttatttcccgcagtataaggtttgttacatgtatgatgttcaggaatgg

SEQ ID NO: 844 - DNA, 70 bp, Ectromelia virus
gtttgtactgcaaaaataatatctatttttgttttcgaagatatggtaaaattaaatagtagtacacaac

SEQ ID NO: 845 - DNA, 65 bp, Camelpox virus
tgattttggtttacatgtaatacattttgaactctttgattttgtatcacatgcgccggcagtca

SEQ ID NO: 846 - DNA, 63 bp, Camelpox virus
tgtactgcaaaaataatatctatttttgttttcgaagatatggtaaaattaaatagtagtaca

SEQ ID NO: 847 - DNA, 86 bp, ictalurid herpesvirus 1
ccccgcgatgatttttccggtgatgccccggacaggctccacctcggggtctgcccggccgttatcgaaaaaacagaattgcgggg

SEQ ID NO: 848 - DNA, 59 bp, ictalurid herpesvirus 1
cgcttcagttgttcacatgtaccatttcgcaccgcgtggcacacgtgaacggtgaagtg

SEQ ID NO: 849 - DNA, 99 bp, ictalurid herpesvirus 1
tattcgagggatgacctattctcggcatttctccttgggacgagtatgatggggagaccggacgatgcaacagatgggttatttatagtgacttgagtg

SEQ ID NO: 850 - DNA, 131 bp, ictalurid herpesvirus 1
ttccacattgtggctcagtgctccttcctcgatcgtctcccatatctgccgatacttggtgcggtcctgtcgggtcacgccatttgatcgctgtatgatatcgatgacattgtggaacgacacgagcggag

SEQ ID NO: 851 - DNA, 112 bp, Swinepox virus
gtataaacggcaaatctaatggtatagtacctatgttaagaatatataataacacagttagatatattaatcagggaggtgataaaagaccaggagcaatgtcgatttatat

SEQ ID NO: 852 - DNA, 60 bp, Swinepox virus
tgtgtttatattattgggctatgcattcgatagcgaagaagcaaaaatattaaatataca

SEQ ID NO: 853 - DNA, 124 bp, turkey adenovirus 3
atttctcggttttctggtgttaaaattaattttgtgaagtaatctgtgagtgcaaataggatgttatttcttaattttctgaactccgtactaatgaagtttttaactttagaaaaccagaagt

SEQ ID NO: 854 - DNA, 75 bp, turkey adenovirus 3
gatatataaattttttatactttctggatgtggaattccttctttaatctgtgaaagtatttcacttttattatt

SEQ ID NO: 855 - DNA, 123 bp, Fowlpox virus
acgataataactccttcatgttaaaagggatttcgtttactacctgttcatatttatcttctttgtatgataaactcgtagtaaaacttctgtaattgatattaaagtcgttattaccttcgt

SEQ ID NO: 856 - DNA, 60 bp, Fowlpox virus
ctatataagaaaatatagctaccaaagatttatcatctatatctatgttttgttctatag

SEQ ID NO: 857 - DNA, 53 bp, Fowlpox virus
gctagtttatagtcgtgataaacgtatctatcgttatccacgacgtatctagt

SEQ ID NO: 858 - DNA, 55 bp, Fowlpox virus
tagacttatgtggtccgcgatgaagattttagtatcttccgtacatgttagtcta

SEQ ID NO: 859 - DNA, 73 bp, Fowlpox virus
tcttcctaggttcgaaggtgacttgttttatattaattaactccataaacaaatcacacaaaccatagttaga

SEQ ID NO: 860 - DNA, 64 bp, Swinepox virus
agtattatatgttggtaaaggtcaagatatacaacgtgcattatatctgacaccgtatggtact

SEQ ID NO: 861 - DNA, 107 bp, Human herpesvirus 5
gttgtaggtgcagatgctgccgacgaaacgcagcggctcggggcagcagaggtagctggccagacgctgtgcatcccgtccttcgtcgcgcaccaagcgccagcgac

SEQ ID NO: 862 - DNA, 108 bp, Human herpesvirus 5
gtttgaagtcctcgtccgtctcgatctcctgcagcactaggttccagcccggcggccagaccacgggcaacacctggcctgcgttgatgcgcacgtaagcttccagac

SEQ ID NO: 863 - DNA, 87 bp, Human herpesvirus 5
ttcccatagcctgtctaactagccttcccgtgagagtttatgaacatgtatctcaccagaatgctagtttgtagaggctatgcggga

SEQ ID NO: 864 - DNA, 99 bp, Swinepox virus
tatccgtgttaacgtcgatcactaacatttgtactaacgaatatctatatctagagaaacgtatatgtgaatatgtgagatcgtatgatgctacagata

SEQ ID NO: 865 - DNA, 54 bp, Amsacta moorei entomopoxvirus
taggagcattttccaaagaatttatatatattataatcttatttaatgtttctg

SEQ ID NO: 866 - DNA, 127 bp, Gallid herpesvirus 3
gttgcctctgcgtatcgctagttcgagctcgggtttccgaagcaacgtaacacacatatcctatagtgtacaatgtttcgatgcaactgaaagcaacgagctaaagcgaagatgttttgcaggcgac

SEQ ID NO: 867 - DNA, 73 bp, Gallid herpesvirus 3
tcgaaaccatatctgcgtgggcctttaattccatatccgaggcgttctgatatgttcccagtaggtatgtcga

SEQ ID NO: 868 - DNA, 65 bp, Meleagrid herpesvirus 1
gttagtgatccgtcatgcatttcatattctgttccggcatctgaaatgcatgacggatcactaat

SEQ ID NO: 869 - DNA, 110 bp, Gallid herpesvirus 3
ctcgcttcgacattccgggtaaaacgcgtatttggccctacactttatttcgtacgtttctatggagtggtcggggagggcaggcgtaaggattccgcgtgcgctgcgag

SEQ ID NO: 870 - DNA, 64 bp, Rat cytomegalovirus
gttgaagtagttcttgtacagggcgtacaccgggatcaggtgtctcgtgcaattgtggttcgac

SEQ ID NO: 871 - DNA, 76 bp, Human adenovirus E
ttgaagtcgatattgtcgcagcccccctgctcccagagctggaagtccgtgcgcttcttgtaggcggggttgggca

SEQ ID NO: 872 - DNA, 67 bp, Vaccinia virus
gagacttgatagatattagtgatgaattgaaaattatttttatcaccacgtgtgtttcaggatcatc

SEQ ID NO: 873 - DNA, 79 bp, Vaccinia virus
ggctattctggcggctagaatggcataatccggatgttgtgtagtacaagtggctgctatttcggctgccagagtgtcc

SEQ ID NO: 874 - DNA, 130 bp, Human herpesvirus 4
cagatatagattaggatagcatatgctacccagatatagattaggatagcctatgctacccagatatagattaggatagcatatgctacccagatatagattaggatagcatatgctatccagatatttg

SEQ ID NO: 875 - DNA, 53 bp, Human herpesvirus 4
gaagctgtaaaaatagaacgccctggaactgccccactgtgcaatgcagcttt

SEQ ID NO: 876 - DNA, 89 bp, Human herpesvirus 4
gcgacctcgtgaatatgaggaccaacaaccctgtgcttggcgctcaggcgcaagtgtgtgtaatttgtcctccagatcgcagcaatcgc

SEQ ID NO: 877 - DNA, 128 bp, Human herpesvirus 4
tagcatatactacccagatatagattaggatagcatatgctacccagatatagattaggatagcctatgctacccagatatagattaggatagcatatgctatccagatatttgggtagtatatgcta

SEQ ID NO: 878 - DNA, 63 bp, Periplaneta fuliginosa densovirus
gacgtcgctaaggtaccggcgaaaaggtccgaaaggcgttcttttaattcttgatacgatgtc

SEQ ID NO: 879 - DNA, 120 bp, Periplaneta fuliginosa densovirus
tggccatagcttcgctataccccaccacaaccaccaccaccacgaccggacacatggcctttggccgtgtccatggtgtggtggtggtggttgtggtggggtatagcgaagctatggcca

SEQ ID NO: 880 - DNA, 84 bp, Periplaneta fuliginosa densovirus
tgtagtgggagaacccatcttgacatatgtttatcaacctaaaattgctcctttgaaacctgttcagaaatatctgccaacaca

SEQ ID NO: 881 - DNA, 82 bp, Gallid herpesvirus 2
acaagtatgttataatagtatagatgaataaagtgagacttataatacttattgcatagatgtgttttattatgtgccttgt

SEQ ID NO: 882 - DNA, 118 bp, Gallid herpesvirus 2
gctcaccaagtacctcggcaacgtgaggttgtattttgcgtctaatcggttcatcggcaaatgcatttactcgagcaaatgtataacccatcaaagtgtagctgtctgtttgaagagc

SEQ ID NO: 883 - DNA, 93 bp, Gallid herpesvirus 2
gctgtcgacaacaatgagtgtacctaccggtcctcgttgtatgataaaattcgatgatggaatatggtcacatctagatagcttgccgacggc

SEQ ID NO: 884 - DNA, 80 bp, Cowpea mottle virus
ccccgagtgcaaatggtgcagtgctcgtttgctggccatagctagcaacaagtatcttcccagcatccacaagcttgggg

SEQ ID NO: 885 - DNA, 79 bp, Human herpesvirus 2
gggagctcgggcaggctcgcgttccgaggccggccgagcagataggtctttgggatgtaaagcagctgcccggggtccc

SEQ ID NO: 886 - DNA, 62 bp, Human herpesvirus 5
gctgagggagctcacccaacaccgtcgccacggagtccggcggatcgcggccctcccaaagc

SEQ ID NO: 887 - DNA, 96 bp, Sulfolobus virus SIRV-1
ctttcaaattcaatatttctagcaagataactttttctataacaaataccaacttcagatggaaaaatcgtatctgcaggatatttaactttaaag

SEQ ID NO: 888 - DNA, 78 bp, Sulfolobus virus SIRV-1
taaaaaagtgatataatgcatttttgtttgaattcgcaagatttacaaatataattgttaactcctggaactttttta

SEQ ID NO: 889 - DNA, 71 bp, Melanoplus sanguinipes entomopoxvirus
attaaatcattaatttctttatttgataatcgtttgactggcatatcaaataaattttttaatcctttagt

SEQ ID NO: 890 - DNA, 84 bp, Melanoplus sanguinipes entomopoxvirus
tatattcccaatgtaatttatcatgatattgtaaaattatatcttctgataattcttgatattgtgatatatattcccaatgta

SEQ ID NO: 891 - DNA, 50 bp, Saimiriine herpesvirus 2
atgtgatcttgtggagttgtttgcattaggcaatgacagaaaggtaacat

SEQ ID NO: 892 - DNA, 130 bp, Saimiriine herpesvirus 2
ctttttgcaatatgaaattttcatttgtgtctgctatgtcatatacagcttttaactgtttgaccttttcagggttgtgtgaatgataaagtagattgttgatatcaaatgaatccatgacatattgtag

SEQ ID NO: 893 - DNA, 130 bp, Saimiriine herpesvirus 2
gacgtctccaggcctgtactcttttagaattctcatgcagtgagaatacagctgtgtttcatttttggtgcaaattatggcagctggtaagcatactgcataagctaaaagcaatacaataggagatttt

SEQ ID NO: 894 - DNA, 100 bp, Saimiriine herpesvirus 2
tgatgggcgtctctgtgcagcagcttctcgcactctgtctgcccagcttgttttgcaagatctagatgtagagttgctgctgatacggggtcgcttacca

SEQ ID NO: 895 - DNA, 68 bp, Alcelaphine herpesvirus 1
gaattccacggtgttgtggtctgacatagatgcattagtgcacatgtccagagaaacaccaaaaattc

SEQ ID NO: 896 - DNA, 89 bp, Alcelaphine herpesvirus 1
tatagactggtagcggtggggttggtgtcttttcagtcagaagggcttcgccctctgaaaaggcttcaaagtcctctgcaatgtttata

SEQ ID NO: 897 - DNA, 104 bp, Human herpesvirus 8
ctggataggtaacactggaagaggacgcaagacggcttatagagatgcttacaaatgagtttgggtggcaccctgaagtcgtagcagtgttgcttaaaccccag

SEQ ID NO: 898 - DNA, 84 bp, Human herpesvirus 8
gtctacgggctgtgagggacgtttgcagatagataggagaaatcccatttgatatatggaaaggtgtccttcgcacttcttgac

SEQ ID NO: 899 - DNA, 101 bp, Pothos latent virus
ggagtccaattcatcaggtcacgttcaatagcgagttgttcatccggtgtaataccgaatgccaaccaaaaactataacgagcgagactgttgatttctcc

SEQ ID NO: 900 - DNA, 63 bp, Pothos latent virus
tagctaactctacccggtctgcaggttcaacatcttgttgatccttatcgaagtagatggcta

SEQ ID NO: 901 - DNA, 63 bp, Trichoplusia ni cytoplasmic polyhedrosis virus 15
ttaataagacagcagaattagttaatgatcagaatatagatgctgagtttgttgttttcctaa

SEQ ID NO: 902 - DNA, 102 bp, Trichoplusia ni cytoplasmic polyhedrosis virus 15
ttgagtgatcataagaatttatttgagtatatatttgttgaagatttagtagaagaagtttctcattcaggagtatgttctaatggattattgatgactcaa

SEQ ID NO: 903 - DNA, 74 bp, Vaccinia virus
ccgttataaatgtctttgtcgatgatatattcaacgcttccaattgtgatatatccagagatatcttgtaatgg

SEQ ID NO: 904 - DNA, 96 bp, Vaccinia virus
agagataaaacttttttacgactccatcagaaagaggtttaatatttttgtgagaccatcgaaggagactccatcagaaagaggtttaatattttt

SEQ ID NO: 905 - DNA, 128 bp, Vaccinia virus
cttttttacgactccatcagaaagaggtttaatatttttgtgagaccatcgaagagagaaagagataaaacttttttacgactccatcagaaagaggtttaatatttttgtgagaccatcgaagagag

SEQ ID NO: 906 - DNA, 131 bp, Vaccinia virus
cttttttacgactactccatcagaaagaggtttaatatttttgtgagaccatcgaagagagaaagagataaaacttttttacgactccatcagaaagaggtttaatatttttgtgagaccatcgaagagag

SEQ ID NO: 907 - DNA, 129 bp, Peanut clump virus
acactcaaaaaggaagtttctctcgtttttgtcgtgttggcatgagtgccactgcccagataaacttttgtatccacagtaggcgatccagaccattgacagtccgagcagacacaaccagaagagtgt

SEQ ID NO: 908 - DNA, 51 bp, Peanut clump virus
gctccctgaacaaaaaccataccaaaagggtttggttcaaaatcagcacgc

SEQ ID NO: 909 - DNA, 131 bp, Peanut clump virus
gtggaattgcagactattcctggctgaagtaagagaattgacttcgtactcagcgcggttcttttctgcactaagtttcagtctctctttctctatcatttcccaggcattcttaaacttttgagtttctc

SEQ ID NO: 910 - DNA, 87 bp, infectious spleen and kidney necrosis virus
atgtggcactatcgatgctgtcttcacgcacgcatgtgtcaaacgccgccggccgcctgtcgatcatatcgaatagatccaccacat

SEQ ID NO: 911 - DNA, 54 bp, infectious spleen and kidney necrosis virus
ctggagctgcgtggggccatagggtgagaccacgatggcactgagtagctccag

SEQ ID NO: 912 - DNA, 64 bp, infectious spleen and kidney necrosis virus
gactgtacaccggctgccagtggattgcaatgtgatgcatcagcagcgtgtccttatacatgtc

SEQ ID NO: 913 - DNA, 65 bp, infectious spleen and kidney necrosis virus
gggcacccggcgatgatgtgttgcaccaggcgtccccagacggtgtaatgccaaatgccaagtcc

SEQ ID NO: 914 - DNA, 123 bp, infectious spleen and kidney necrosis virus
gtcggtcagcggtaagttcagcagggtggccaccgcagtgtttccatgtgcgtccaccatgttccaatactggataggcacatagcgcttgaatgccgccaccgggaccatgccctggccgac

SEQ ID NO: 915 - DNA, 75 bp, infectious spleen and kidney necrosis virus
tccaatccatcatatgacacggccgcaaaatgagctgcgagctgctcggctgtggcgttgagtggtggcatggga

SEQ ID NO: 916 - DNA, 101 bp, Amsacta moorei entomopoxvirus
gtaaaaggattattgcatttattaagtattaaaacattatctatatattttgaattatttactaatgtttgaatatatttaatacaattttgtccttgtac

SEQ ID NO: 917 - DNA, 79 bp, African swine fever virus
ttcagtctccttaaattcttccacgatacggttgagactatttggctttagtttcaccagaatttcaatggtttctgaa

SEQ ID NO: 918 - DNA, 73 bp, Human herpesvirus 4
ctcctgtagcccccagtaaatggatttcagggagggaccgtccttgctgtcattctcttggactaacgaggag

SEQ ID NO: 919 - DNA, 91 bp, Human herpesvirus 4
gctggaggagttcgtcgggctcaactccgcagccatattcacatccatgttcctcaaatggctcgagggcctgtcgcagctcgtctctggc

SEQ ID NO: 920 - DNA, 130 bp, Human herpesvirus 4
ggggaggtgatcacagcgcgtcatgttctccggcagctttacatagagggtctccgtcatgtcatcaatgttggtcaccttcaggtgtttgtgctgaaaggtgaagtaatcaatgacagtcaccttcccc

SEQ ID NO: 921 - DNA, 94 bp, Melanoplus sanguinipes entomopoxvirus
gataacattccattttcaactgatcttttatttacaataacaccatcttcaatatttttattataactaaaaaatcctactaaaatatgttgtc

SEQ ID NO: 922 - DNA, 72 bp, Melanoplus sanguinipes entomopoxvirus
taataaatctgacttagttaaatatgtggatttagttaaaaattcatataattttaatatttcagattgtta

SEQ ID NO: 923 - DNA, 87 bp, Melanoplus sanguinipes entomopoxvirus
ttcattttttttaattttgggtatacgtacatttgttctattctacatgtaacaaattttgtaattcctttagataaaataaatgaa

SEQ ID NO: 924 - DNA, 67 bp, beet soil-borne mosaic virus
acgcgcctttaatgctgctcgaatatgtgccatagttcgagcagcatttaattgctaattggtgcgt

SEQ ID NO: 925 - DNA, 69 bp, beet soil-borne mosaic virus
gagttgagcaccaccttgtatacctgtgtgaatatatctttcagtcttcccgggcatacgctcaacctc

SEQ ID NO: 926 - DNA, 66 bp, beet soil-borne mosaic virus
tttgtacccatcctccaccaatgttttctcaataatagagaaaacatcatctgggtgggtgacaga

SEQ ID NO: 927 - DNA, 55 bp, infectious spleen and kidney necrosis virus
cagacatgatgacggtgatacttttttatatatgaccgggctcatttttcttctg

SEQ ID NO: 928 - DNA, 59 bp, infectious spleen and kidney necrosis virus
ccatagcttacaggatagggaagcctgcggcgccgtcagcaatcttcatgatgttgtgg

SEQ ID NO: 929 - DNA, 131 bp, infectious spleen and kidney necrosis virus
cggtggccaggggcatgccgatgagcaggcccgccagcacggcggccagctgccacaggtccacgccctgggccttggcggtggccagctgctgaagcttgttcaccacatcctgcatgctgctgctgctg

SEQ ID NO: 930 - DNA, 69 bp, Human herpesvirus 7
gccagaggtatttttttgttaggtctgatgttttcggaaccaaataatttacgttttactttacaaggc

SEQ ID NO: 931 - DNA, 85 bp, Human herpesvirus 7
gtgctcagctaaaactttgcaacaagcatctttatattctaaagggtatttgattggattcaaagtacaagcttcatttgagtac

SEQ ID NO: 932 - DNA, 56 bp, Human herpesvirus 6
gaacgattggattttcaaagtttccatttctacaatggctcgagttcgatatgttc

SEQ ID NO: 933 - DNA, 102 bp, Human herpesvirus 6
gagtggacgctgacattctagtatgctttacctctttagtgacttcagtgattgagtatgatgaattactagatggtaaagcgttgttagttatgtgtactt

SEQ ID NO: 934 - DNA, 59 bp, Carnation Italian ringspot virus
gcatcgagaccaatggcgacaggcttatgaaacctatcccacttctcccgaaaaattgc

SEQ ID NO: 935 - DNA, 65 bp, Carnation Italian ringspot virus
tctgcacctgcttaagatttctgcgttctagtataagaacacagtcatccccacagtttgccaga

SEQ ID NO: 936 - DNA, 100 bp, Tomato bushy stunt virus
agcaatgcccaattgacccaagtcgataagtttgtgatcagatgtggaactgtcatcacaaaatctcttaatcttatcggtgggtaccctaagcatcgct

SEQ ID NO: 937 - DNA, 108 bp, Tomato bushy stunt virus
ggaacagtgttgatcaaacctagatgcatcgagccctatggcgacaggcttatcaaacctgtcccatttagcccggaaaattgcacctacctcatcagctgtgtatcc

SEQ ID NO: 938 - DNA, 113 bp, Tomato bushy stunt virus
ggcacataatgtagcacaacgctgttgaatgtgtactgatcaaaattggatgctatcgctggcaaccaagagaacaatgtaccattcaacgggttaagctgtaacaaattgcc

SEQ ID NO: 939 - DNA, 61 bp, Tomato spotted wilt virus
gatagctttgttgatctatttccctatccgatggttagtgaacaagacgactaaacctctc

SEQ ID NO: 940 - DNA, 126 bp, Tomato spotted wilt virus
gtaatctgggtagacatctaagatgagaattctaaaactactagaactagtggtaaaagtgagtcttttcacaattgccctgagttctgttttgttggcattcttgatcttcagagccacagatgc

SEQ ID NO: 941 - DNA, 60 bp, Tomato spotted wilt virus
gtaggaggaaaattcttcatttcagaaagcctgacacaagataattatcctataacttac

SEQ ID NO: 942 - DNA, 100 bp, Tomato spotted wilt virus
tcagagtgtcccatactatccaaagaagcagatcatgactacaacaaacataagtggactagcatggaatggttccatctaatagtgaacactaagctga

SEQ ID NO: 943 - DNA, 57 bp, Tomato spotted wilt virus
tgtccaagaatacatgacactaccaaaagaaacccctttcttgtattcttggctaca

SEQ ID NO: 944 - DNA, 92 bp, Tomato spotted wilt virus
ttgcaggaaaaatcaagctttaacaggtttccaagatttttgtgtaacaccaacttcttattggggatgtgaagaagcttggtgttttgcaa

SEQ ID NO: 945 - DNA, 64 bp, lumpy skin disease virus
atcaggccctttagttgtcaatatccctaatacatcagtatatgttgtaactaatatactttgt

SEQ ID NO: 946 - DNA, 128 bp, lumpy skin disease virus
atcttaaaatttctttctctgttccatttgtcgtacgtataagatcacatatgtcaggataatctttatttgtctctattaaaggcttgtttctatacgataatttgttttttgaatcttttgagtat

SEQ ID NO: 947 - DNA, 119 bp, Goatpox virus
tttgataaattaatatatgtgcgcttaatcctctggaacttatctcatgaatatcggtttttgatttcattagtattgtatttgaaaaataagtatataaaatattattatttatcaaa

SEQ ID NO: 948 - DNA, 123 bp, Meleagrid herpesvirus 1
cccatgtggctttgagcaaagaaaccgcatgttcgatgttagatagctgattgcagtgcttgttgttcaagccgctcaatacatttttagtcgttatcacgggtcgcttcgtagccgtctggg

SEQ ID NO: 949 - DNA, 108 bp, Meleagrid herpesvirus 1
gcgtgtgtgtaaacaccttcaaggcgcatctggagatttatcccatctgggaaacgcagcccaattgatgtggtcagtctattagcgctttcattacacagaacacgc

SEQ ID NO: 950 - DNA, 96 bp, Meleagrid herpesvirus 1
tacaagctgtagcaatagtgaaggatctatactgcaattattcccctccagtgggtttatatgtagagaatctgcccatttgcaacaaagcctgta

SEQ ID NO: 951 - DNA, 103 bp, Meleagrid herpesvirus 1
tcgttagaaacgttgataaactttgaaaggatattgtgggtttaatgtatttgcgcacgaacactgcaacaacatcactgtcgagaatgtcaacctctaatgg

SEQ ID NO: 952 - DNA, 77 bp, Meleagrid herpesvirus 1
tgttaatgtccgtaccgaagccccatctatgatcagaggtttttctgccacgtggaatgcattatcggacacatgca

SEQ ID NO: 953 - DNA, 59 bp, sheeppox virus
taaaatttgataatagatgtattgattagaaaatcaatagttcgttttgtcgatttttg

SEQ ID NO: 954 - DNA, 98 bp, sheeppox virus
tattatagagtggaaattggatatgggttcatttagtgaataaatattagttatataattgcctaaaaatttatattcgataaaatctacaggtgata

SEQ ID NO: 955 - DNA, 89 bp, Goatpox virus
ttattataccaatcagtactaaatgtgtaatccgaaactaagtttgcgtttttttctaataatacatttatatcaattgtatctagtag

SEQ ID NO: 956 - DNA, 119 bp, sheeppox virus
tttgataaattaatatatgtgcacttaatcctctggaacttatctcatgaatatcggtttttgatttcattagtattgtatttgaaaaataagtatataaaatattattatttatcaaa

SEQ ID NO: 957 - DNA, 73 bp, Melanoplus sanguinipes entomopoxvirus
tgaatcatataatacaaatttaatattttggcctttcataccaagttttgataatgtatttaaccatggatca

SEQ ID NO: 958 - DNA, 61 bp, Melanoplus sanguinipes entomopoxvirus
ttgtggaaaaacaagttttaagtgtttcattatataaacacttgttaatgttttaccataa

SEQ ID NO: 959 - DNA, 69 bp, Equine herpesvirus 1
gctctcgaacgatgggactgtttagctctaccagtagtgccaatatctcatcgtgcgcaacaccggggc

SEQ ID NO: 960 - DNA, 113 bp, Melanoplus sanguinipes entomopoxvirus
accacgtctagtcgtatcagccataattttaagatttaatttatttaatacatcatttattcctgctaatgtatttaataaaaaattaatatggcttgtaatagatccttggt

SEQ ID NO: 961 - DNA, 82 bp, Variola virus
atgttttttatctctttcagtatgtgaatagataggtattttatctctattcatcatcgaatttaagagatccgataaacat

SEQ ID NO: 962 - DNA, 122 bp, Camelpox virus
cttcattatgaattgattcttgaggtataaacctaacacaaattatattattagacttttcgtatgtaatgtctttcatgttataagtttttaatcctggaatagaatctattttaatgagg

SEQ ID NO: 963 - DNA, 83 bp, Variola virus
gccatagtcatagcatccggcttatccgcctcagttgtcataaaccaacgaggaggaatatcgtcggagctgtacaccatagc

SEQ ID NO: 964 - DNA, 74 bp, Ectromelia virus
gttaatacgtcttgcacgtaatctattatagatgccaagatatctatataattattttgtaagatgatgttaac

SEQ ID NO: 965 - DNA, 71 bp, Camelpox virus
ttggtaactcattctatatatgctttccttgttgatgaaggataggatatactcaatagaatttgtaccaa

SEQ ID NO: 966 - DNA, 122 bp, Ectromelia virus
cttcattatgaattaattcttgaggtataaacctaacacaaattttattattagacttttcgtatgtaatgtctttcatgttataagtttttaatcctggaatagaatctatcttaatgagg

SEQ ID NO: 967 - DNA, 76 bp, Cowpox virus
gaactagatatattaataaagtactcattaggcagtttatggcagcttgataattagatatagtatattccagttc

SEQ ID NO: 968 - DNA, 124 bp, Ectromelia virus
gacattctattttttgtggattagtatactctcttccctctatcatgttcactactggtgtccacgatgacaaatatctagagggaatataatatagtccataggatgccaatctagcaatgtc

SEQ ID NO: 969 - DNA, 78 bp, Ectromelia virus
gatacgaatatgtctttgttaaaaacagttattttctgaatatttctagtttgtaattttaacatatgatattcgttc

SEQ ID NO: 970 - DNA, 53 bp, Cowpox virus
tgtgataatttatgtgtgaggcaaatttgtccacgttttttaattttgttata

SEQ ID NO: 971 - DNA, 81 bp, Human herpesvirus 3
ttgtactttttgttggatcgacggattattaatagtgacatttacgtattgtacccgcaacgattcatcccctctgaacaa

SEQ ID NO: 972 - DNA, 92 bp, Leishmania RNA virus 1-4
agtttggtatatcagccattttgctcaagaattgtatactcaaggtatgttcacgtggaattcttgggttaaagatggctggtatgatagct

SEQ ID NO: 973 - DNA, 68 bp, Leishmania RNA virus 1-4
cagctgagttacaactccgacgacttggttgaccctccaacaaccattcattgaaggggcgtaacctg

SEQ ID NO: 974 - DNA, 58 bp, Leishmania RNA virus 1-4
ctcaacccgggccgtagcagccgcaagtttgttaggatcaatacgcgtcggtgttgag

SEQ ID NO: 975 - DNA, 66 bp, Leishmania RNA virus 1-4
gcaacaacgccccagaatgtgcttaaattctccacgaatatgtcacagaatcgggttgcgctgtgc

SEQ ID NO: 976 - DNA, 65 bp, Leishmania RNA virus 1-4
tccgaatggtgcgtccttatacatatacattatgtattacttgtataacaactccaccacaagga

SEQ ID NO: 977 - DNA, 61 bp, Leishmania RNA virus 1-1
catcctgtccaagaattgtatactcagggtatgttcacgtggaattcttgggttgaggatg

SEQ ID NO: 978 - DNA, 58 bp, Leishmania RNA virus 1-1
cgtagcgcatattcgaaccacatgtatgataacgtatcacacgcgagtaacagcctcg

SEQ ID NO: 979 - DNA, 103 bp, Leishmania RNA virus 1-1
gtcgcgtgcctatatggaggtagtttctcttcagatctctctactcggcagttgatcctatagacttgaatgtaatttgtctgctctccatatacaacgccac

SEQ ID NO: 980 - DNA, 79 bp, Leishmania RNA virus 1-1
gtcttgctgaagacttgtttgctggcatttaacctgactcccttcctgttgagattagctatcaagttatcagcgtggc

SEQ ID NO: 981 - DNA, 69 bp, Leishmania RNA virus 1-1
tcaccaggtaggctcctgttgagaatgccacgacaacacactatggcattcatcaatgcctcctgctga

SEQ ID NO: 982 - DNA, 128 bp, Leishmania RNA virus 1-1
ttgggttgtgctgccactgttccatcacggcttttctgtatgcttgtccttctttccttgttgcaagttcaggatgggcatgttctaatgctcgtgaatgtgacccatttgcagcccacagccaacga

SEQ ID NO: 983 - DNA, 111 bp, Cowpox virus
acattttccatttataacacttatgtattaactttgatcatttatattttttcattattatgttgatattaacaaaagtgaatatatatgttaataattatggtgtggtgt

SEQ ID NO: 984 - DNA, 74 bp, Cowpox virus
atctaatgatgacgtaaccaagaagtgtatctacagccaatttagctgcattatttttagcatctcgtttagat

SEQ ID NO: 985 - DNA, 122 bp, Cowpox virus
cttcattatgaattaattcttgaggtataaacctaacacaaattatattattagacttttcgtatgtaatgtctttcatgttataagtttttaatcctggaatagaatctatcttaatgagg

SEQ ID NO: 986 - DNA, 63 bp, Cowpox virus
ggaagagatgtaacgggaactgggtttgttgattcacaaactattctaatacatagttcttct

SEQ ID NO: 987 - DNA, 95 bp, Cowpox virus
ttttgtggattagtgtactctcttccctctatcatgttcactactggtgtccacgatgacaaatatctagagggaatataatatagtccatagga

SEQ ID NO: 988 - DNA, 109 bp, Chimpanzee cytomegalovirus
acctcagtcggtgtccgacgccggcagttcccggggtagcatacgccacagttgcgttcggggaccgtggccgctgccgagcgtgagtacgagataccgacgccaaggt

SEQ ID NO: 989 - DNA, 130 bp, Chimpanzee cytomegalovirus
cgagtatagttcgttgaatcaaggctttgggatgaaatctaggtccgggttgccagtagtaggggatgtcttcgcgtggtccgaggagtatagtgttgtcgttgcgatgtttgagtttgaagcatgctcg

SEQ ID NO: 990 - DNA, 68 bp, Chimpanzee cytomegalovirus
gaagattatggccaacccaattcccatactccgtcgagtccgtggtagatgtaatgtccgtattcttc

SEQ ID NO: 991 - DNA, 69 bp, Chimpanzee cytomegalovirus
ggcgtccagcagcacgaaatgcggcgcgcggtatagatccgccggcccgtttcgtccgctgctggcgct

SEQ ID NO: 992 - DNA, 76 bp, Chimpanzee cytomegalovirus
gggtgaggccggggcggaaggcgggtcgtcgttcgtaacgacgtcgtcctccccttcttcaccgcctcgtctcccc

SEQ ID NO: 993 - DNA, 131 bp, Chimpanzee cytomegalovirus
tgtggaggtgtgttgtaatggtgttgagattgtgaaagtatagcccccctcctccgcgtccccccggggcccgtcctttctcctccttgcagtgcgttcattgtccgttcattgtccgttcattctccgca

SEQ ID NO: 994 - DNA, 119 bp, Chimpanzee cytomegalovirus
tgttgacgagcataccgtatctccctgacgtagacggtgtatgttgcaacgagtcctaaacagtaatggtgtgttgtacggttttggtatgttgcggctgaatggtgtgttgaacggcg

SEQ ID NO: 995 - DNA, 131 bp, Equine herpesvirus 4
cacgaggttttgtttggcctaccccgcaggtcaggtgcccactgatataacgcgttggtaaattctctgttatttagacgtgagggtgggcatctaggctcgcacggccggttggcaagttcctgaagcgg

SEQ ID NO: 996 - DNA, 70 bp, Equine herpesvirus 4
gtttcgtctctggccagcattccgcgcatatttaaaatggcgcggatgtctgcgtgccagggttcgaaat

SEQ ID NO: 997 - DNA, 83 bp, Equine herpesvirus 4
tgtcaaagtggtagtgcctgttgcacgcgtctttaaacatcaaaaatgggcttcctgtcattacagcacttctaactatgata

SEQ ID NO: 998 - DNA, 68 bp, Equine herpesvirus 1
gtaaataagcacgctttaaatcaaacaacaacaggttgtatggctgtaaagggtatgtttttatttac

SEQ ID NO: 999 - DNA, 123 bp, Equine herpesvirus 1
gtgtaagcttcagcgatgggttaaagcttgaaagcatccacgagttttgctctgagttgatggccgccgttatcacacccgcagatgaaatctggatgccgcccatgttgctgatcgttatac

SEQ ID NO: 1000 - DNA, 76 bp, Rana tigrina ranavirus
gagattatatcttacacctcagtctcgtcttagaaagtttctgagagagattacatcttaagatgtcttacatctc

SEQ ID NO: 1001 - DNA, 58 bp, Broad bean necrosis virus
tgactccttgaattaccatttatcacaatagcattgttcgtagaggccaagtaagtca

SEQ ID NO: 1002 - DNA, 89 bp, Broad bean necrosis virus
ttgtttctgcgatcaattgtttcttcgcctgctcagattgattctgccaccacctctgagaggcttcaatattactaatcggagaacaa

SEQ ID NO: 1003 - DNA, 53 bp, Beet western yellows virus
agaaggaggcattgtcaccagtcgtcttgatatgacaagtcaaatctccatct

SEQ ID NO: 1004 - DNA, 58 bp, Beet western yellows virus
cactggctgagggcgctgagcgcgtcgtgtttgcctgcgtggtcgtcttcttccattg

SEQ ID NO: 1005 - DNA, 66 bp, Beet western yellows virus
gatggaacccccggcgatgatagtagcggctgccacatctgctttggaatatccggggttcacatc

SEQ ID NO: 1006 - DNA, 98 bp, Cereal yellow dwarf virus - RPV
gaaggtgatacttccagaggagttgcccgcgagtgagtcctttgtgaaaacaaatgtctcgccacggccccctcctccgagtcctggagttcttcttc

SEQ ID NO: 1007 - DNA, 50 bp, Cereal yellow dwarf virus - RPV
gagaggttagttctgcggtggcgccaacggcgggccacccgaaacctttt

SEQ ID NO: 1008 - DNA, 55 bp, Cereal yellow dwarf virus - RPV
gagctggagagacttgatggcttcgaggaagtcaatccgaaagtcatcccagttc

SEQ ID NO: 1009 - DNA, 59 bp, Cereal yellow dwarf virus - RPV
gaggcctcgctgacgaactgtaagatacaacctgtgatcttatactcatggtaggcctt

SEQ ID NO: 1010 - DNA, 100 bp, Cereal yellow dwarf virus - RPV
tgccggcagagtaccaaaagtccacctcaatatcttgtaaatccagctcgttgtaataccgagcgatatgagagaggcgacctgtaagtagtagctggca

SEQ ID NO: 1011 - DNA, 57 bp, Cereal yellow dwarf virus - RPV
tgctcagttatcttttgtggttatgccagatactaaccacatatgcaataacgcgca

SEQ ID NO: 1012 - DNA, 53 bp, Cereal yellow dwarf virus - RPV
ttgctgagacatcccagaagggacacttgtgtccggggatgttgcaatagcaa

SEQ ID NO: 1013 - DNA, 58 bp, ictalurid herpesvirus 1
cgcgcgagaaactgtgttcgtgcagcgtattcgttagcacgggtacggacgccgcgcg

SEQ ID NO: 1014 - DNA, 74 bp, ictalurid herpesvirus 1
ggatgatgtactcgggggggatgccttcctggttggtcgccactagtttcaccaatcgcccccctattttatcc

SEQ ID NO: 1015 - DNA, 65 bp, Barley yellow dwarf virus - PAV
tattgtgaccgcttccctgcactataactaagagctaattgctgtgcagggtatgttttacagta

SEQ ID NO: 1016 - DNA, 92 bp, Beet mild yellowing virus
gaacgtgattgctccgctggaacttcccgcgagattgtcttttgagaaaacgaatgtctcgctcgaacctgttcctctggtagaaacagttc

SEQ ID NO: 1017 - DNA, 65 bp, Beet mild yellowing virus
ggagtggtaagcggccatcactcgaattctagagttagacgaggaggtgttgtagctgccactct

SEQ ID NO: 1018 - DNA, 60 bp, Cercopithecine herpesvirus 7
cctgcttgtcccgtgtgtcctcatcttctgacgaggatgaggacgacgatgacgaggagg

SEQ ID NO: 1019 - DNA, 97 bp, Cercopithecine herpesvirus 7
gcgctgccgggcctgcggccctcggggaggtagacgggtcgcaggggcgcgcccagtccccatctgttagccgccctgtggctgtatgccgcatcgt

SEQ ID NO: 1020 - DNA, 89 bp, Cercopithecine herpesvirus 7
ggaggccgattgtggcgaaagatgtggcgggcgggtttttacttattgttgaccgcagtcccccccgcttttgcatacgtatctcctcc

SEQ ID NO: 1021 - DNA, 88 bp, Cercopithecine herpesvirus 7
tgcacatcgcgtgaagcgcccccttccatacatgtaggtccacaaaggctctcacccggtagggggtcgtatattataacgagccgca

SEQ ID NO: 1022 - DNA, 67 bp, Cercopithecine herpesvirus 7
tgcatgtcacagaactgtttatccaataacgcactgtgtttcattttgaacactgatatgagatgca

SEQ ID NO: 1023 - DNA, 124 bp, Molluscum contagiosum virus
cagcaggttgaagatgcccagctccttgaggctcatgagctccacggtcatgcggaacatgcgccgcgtgctgtggaagtcgtcataggcctggtactcggaaatggggatcttgtacttgctg

SEQ ID NO: 1024 - DNA, 102 bp, Molluscum contagiosum virus
gcaggtcgcacggctggtagaggtagtccaggccctcgccgtaggtgcccagcagcgcctcgcacaggaagctcttggccgcctcgatgccgaagatctcgt

SEQ ID NO: 1025 - DNA, 92 bp, Molluscum contagiosum virus
gcggggttcaggtgcgtgaggaagacgtactcgatgaagtcgatgtccgagacgccgaagaagtagttctcgcgcacgtcctctaccaccgc

SEQ ID NO: 1026 - DNA, 112 bp, Molluscum contagiosum virus
tcgcgacgaaagcgcgagtgcgccacgggcccggcaagagcgcgcgtccctgttgtcctggcaagagcgcgcgtccctgttgtcctggcgagagcgcgcttcttttccgcgg

SEQ ID NO: 1027 - DNA, 131 bp, White clover mosaic virus
agcgaagctagccaaccagtctttactttgcttcttgagaagtgcgcctattcgtagattttttacatcagatccataggcgcgagctctgtggttgtcaagtgggacagtggttggctctctgtgtagtt

SEQ ID NO: 1028 - DNA, 115 bp, White clover mosaic virus
gcttgactgaggcaacgtaatcgatggacatatcatcgccagcatacacttgtgcggcatcgcatggtatgttgaatttggtgtgtgtataggcaatgtttgcttcagtgttggc

SEQ ID NO: 1029 - DNA, 55 bp, White clover mosaic virus
ggaggatttcgaagagtgttgggttgtcgcaacctgagatttcaatggaagctcc

SEQ ID NO: 1030 - DNA, 97 bp, Human herpesvirus 8
cctgggcagcctaagggccatgtgccttgggagtcagctgcgcctgttttcgtgccccacctccccgcgccgtgtggccgcgttggtgctgcctggg

SEQ ID NO: 1031 - DNA, 130 bp, Sulfolobus virus SIRV-1
tcgtttaacttttttcaaattcatttcctgtttcacctatctctaaaaatcaaaaattctatgacatttttatatctttattttttggaataagtaggattaatatttggaatttgagaaaaattatcga

SEQ ID NO: 1032 - DNA, 128 bp, Human herpesvirus 8
tctggtctgattacatgtctcagaacaggctgccaggccagctacgccagcgccaggggatgggtcctggcgctgtgtaacgaccctacctgtgcctccaccctgacagagtttctaaacagacccga

SEQ ID NO: 1033 - DNA, 114 bp, Strawberry mild yellow edge virus
catgagactttccacggcggatagctaattgcagggaggcgtagagtttcagaggatccttgatcactcccttcggcgttattatccagccgcaaaacgtggcaaagtctcctg

SEQ ID NO: 1034 - DNA, 63 bp, Strawberry mild yellow edge virus
cattgcaactgtccaggtgggcgactaccatgaagtagttgaccatgtgtgtcagttgcattg

SEQ ID NO: 1035 - DNA, 99 bp, Strawberry mild yellow edge virus
gcaggcagatgtgtaggtatgtcaggggtaggtccgggaccagagtagcaaatgcttttggttccgtcggaatacttccctccgtatggcagtgaatgc

SEQ ID NO: 1036 - DNA, 74 bp, Meleagrid herpesvirus 1
ggttggaaattacacgactggcgtaatttttggtatacattatggctgaaatgctatctcggtcatttctaacc

SEQ ID NO: 1037 - DNA, 67 bp, Meleagrid herpesvirus 1
gtagtccaattctaagcaatgagtattaaccatctactttattcattaacttagatttccggacagc

SEQ ID NO: 1038 - DNA, 90 bp, Meleagrid herpesvirus 1
tcccgctccattagcacagcttgttgaataattctagaaatgccccccaatgtagcactccctatcagcaggtaaggtggtgggacggga

SEQ ID NO: 1039 - DNA, 92 bp, Meleagrid herpesvirus 1
ttttattggcgtgtttatgattcctcccgcttcgcgccaaattactgagcgaaatgtggagtgcgaggttgaaatcgtcatgcaacataaaa

SEQ ID NO: 1040 - DNA, 60 bp, Melanoplus sanguinipes entomopoxvirus
tgatatattacacgtttttgagcaactttaactatattaaattcaggatgtgatgtgtta

SEQ ID NO: 1041 - DNA, 81 bp, Mayaro virus
cggtccgagccatgaactgcgccgtcggcaacatacccgtttcgatggatatcgccgacagcgccttcacaagattgaccg

SEQ ID NO: 1042 - DNA, 125 bp, Mayaro virus
tgtgaaccagacagttgaggcgtatgtgaacggtgaccatgccgtaacgattgccggaacaaaatttatttttgggccagtgtcaacgccttggacaccgttcgatacaaaaattctggtttaca

SEQ ID NO: 1043 - DNA, 67 bp, murid herpesvirus 4
ctactgattggttacgcccaaaaatccgacccagccattggataaaacgtgctagccaatcaggtgg

SEQ ID NO: 1044 - DNA, 64 bp, murid herpesvirus 4
ctgggcacagtttgataatgtaagatctccccacactgtccactgaaatgtcataattgcccag

SEQ ID NO: 1045 - DNA, 56 bp, murid herpesvirus 4
tttgaaatttgggtccgctgggatatttaaatagcaccagagggtcagttttcaga

SEQ ID NO: 1046 - DNA, 57 bp, Potato mop-top virus
cgcattcttaggagtctcacaagcaccgctgtgaaactgaccataaataaaatcgcg

SEQ ID NO: 1047 - DNA, 95 bp, Canine adenovirus type 1
agtaaaagtcccgtcttctaagtgtgcaggtgtgagtaactttgaaaaaagacccgcaaaactcacacttttgcattggggaaatgtcttttatt

SEQ ID NO: 1048 - DNA, 61 bp, Canine adenovirus type 1
ggtaagttaacagagttttttataaaaatctggtatgattctataagcttgttaactagct

SEQ ID NO: 1049 - DNA, 82 bp, Tulip virus X
aacccataggatacgtggagtggggaagggtttgaggaatacaccccaagcttgttggccagttctttcacgttcctatggg

SEQ ID NO: 1050 - DNA, 55 bp, Tulip virus X
acccagcgactcaggtccgcgggagtcctctcacagttaatcatgatgttgttgg

SEQ ID NO: 1051 - DNA, 83 bp, Tulip virus X
acgggttgccactgaagagccttgatcagtttcgtgtggtctgggctgcccttgaagaacctgactaaggcttgccagttaac

SEQ ID NO: 1052 - DNA, 131 bp, Tulip virus X
gcttcgtctttggcttgctggtgggagaagagttggacggtgagatcctcggtttggacgcagttggtgaagccgtggttggtgttgaggatttctctgtcgtacttgtcggccagggagtcctggatgag

SEQ ID NO: 1053 - DNA, 116 bp, porcine epidemic diarrhea virus
aaaattacaacactccttataaaacttacagctgcgtagtgagaggtgataagtgttgcatcacttgcaccttacagttcaaagcaccaagttatgtggaggatgctgttaatttt

SEQ ID NO: 1054 - DNA, 76 bp, porcine epidemic diarrhea virus
aaccaggattcatatggtggtgcttccgtgtgtctatattgtagagcacatgttgagcatccatctatggatggtt

SEQ ID NO: 1055 - DNA, 102 bp, porcine epidemic diarrhea virus
accagttttgcctaattttgaacctttcaggattgaaggtgctcatgctttctatgagtgcaaccctgaaggtttgatgtccttaggtgctgacaagctggt

SEQ ID NO: 1056 - DNA, 110 bp, porcine epidemic diarrhea virus
acctataggtagccccgtctgtgatgatgttgttgctggttatgctaattctagttttgacaagaatgagtactgcaacagtgttatttgtaaggtctgtctctatgggt

SEQ ID NO: 1057 - DNA, 130 bp, porcine epidemic diarrhea virus
catactgggtttacctttcctagcgaagttgttaacggtaggcgtgtgattaaaaccacagataataattgttgggttaatgtcacatgtttacaattacagtttgctagatttaggttcaagtcagcag

SEQ ID NO: 1058 - DNA, 91 bp, porcine epidemic diarrhea virus
cctggttatgttacacctatgtttgcgtgcttgtcattgctatcctcacttttgatgttcacactcaagcataagacattgtttttccagg

SEQ ID NO: 1059 - DNA, 71 bp, porcine epidemic diarrhea virus
ctgctttttggtatgttgagacgtttggatatgtcttctgtagacaccattctcaacttggcaaaggatgg

SEQ ID NO: 1060 - DNA, 71 bp, porcine epidemic diarrhea virus
ctttctattatgatggaacactatactatcccaccgatggtaatagtgttgtgcctatctgttttaagaag

SEQ ID NO: 1061 - DNA, 83 bp, porcine epidemic diarrhea virus
gagcattgtaatgtacatagaaacgagcatgtggcttctggtgatgccataatgactcgctgtctggccatacatgattgctt

SEQ ID NO: 1062 - DNA, 99 bp, porcine epidemic diarrhea virus
gcaattagggttttctaacggtgttgattttgttgtcagacctgaaggttgcgttgtaactgagtctggtgactacattaaacccgtcagagctcgtgc

SEQ ID NO: 1063 - DNA, 129 bp, porcine epidemic diarrhea virus
gccagtccttgtggcctcatgctctgctatgcctggttctgttgtggtcacacgcgctggtgctggcactggtgttaagtactacaacaacatgttcctgcgccatgtggctgacattgatggattggc

SEQ ID NO: 1064 - DNA, 93 bp, porcine epidemic diarrhea virus
ggtttcacagacccttgctactttttgaatgattcgagccttgctactaagcttaagttcgacatccttagtggcaagttttctgatgaagtc

SEQ ID NO: 1065 - DNA, 120 bp, porcine epidemic diarrhea virus
gtttttgatcatggcactggtatggtgcatgatggcgatgcttttgtaccgggtgatcttaatgtatctcctgttacaaatgttgttgtctcagagcagacggctgttgtgattaaagac

SEQ ID NO: 1066 - DNA, 87 bp, porcine epidemic diarrhea virus
tatagatgcctacccgttatctaagcatgaaaaccctgaatataagaaggtgttttatgtgcttttggattgggttaagcatctgta

SEQ ID NO: 1067 - DNA, 120 bp, porcine epidemic diarrhea virus
tccctgtcatggcccctggtccttgggtgtgagcgtattgttaagctccagaataatgagattattcctggtaagctgaagcagcgctccattaaggcagaaggagatggcatagttgga

SEQ ID NO: 1068 - DNA, 95 bp, porcine epidemic diarrhea virus
tccgattggactgatgtttctgactacaggttggcaaatgatgtcaaggactcattgcgtctatttgcagcggaaactatcaaggccaaggagga

SEQ ID NO: 1069 - DNA, 89 bp, porcine epidemic diarrhea virus
tgatatatttggtgaggattttaagtcatatgacctgctggaatatgatttcacggagcataagacagcactcttcaacaagtatttca

SEQ ID NO: 1070 - DNA, 130 bp, porcine epidemic diarrhea virus
tgctactaagcttaacattgttacctctgatatcgattcttataatcgtatccagcgtgagggatgtgtccactacgctggtaccatttggaatataattgatatcaaggacaatgatggcaaggtggta

SEQ ID NO: 1071 - DNA, 124 bp, porcine epidemic diarrhea virus
tgcttaagaaccttattgatggtgttgaaaatccgtgtcttatgggttgggattacccaaagtgcgatagagcactgcccaatatgatacgcatgatttcagccatgatcttaggctctaagca

SEQ ID NO: 1072 - DNA, 109 bp, porcine epidemic diarrhea virus
tgtactggtgatgttgctatgtttgtgcattggttgtactggcttactggtgttgacaaaggtcagcctagtgattcagaaaatgcacttaacatgttgtccaagtaca

SEQ ID NO: 1073 - DNA, 87 bp, porcine epidemic diarrhea virus
tgtccacatggtcttaactacattggcaaagttgttgtagttaaaggtactacaattgttgtcaatgtaggaaaacctgtagtggca

SEQ ID NO: 1074 - DNA, 101 bp, porcine epidemic diarrhea virus
tgtgaatctcgtcgtcgttgacgaggatgtaaccctcaacaccactggtcgtacagttgtcgttgatggacttgcattcttcgagagtgacgggttttaca

SEQ ID NO: 1075 - DNA, 112 bp, porcine epidemic diarrhea virus
tgttacggatgcaccaattgattccgagggtgatgaagtagactcctctgcacctgagaaggtggcagatgtggctaactctgaacctggggatgatggtcttcctgtggca

SEQ ID NO: 1076 - DNA, 128 bp, porcine epidemic diarrhea virus
ttttgagtgttttatgcctacaatcccacagtgtccagcagtgcttgaagagattgatggtggtagcatatggcggtcttttatcactggtcttaatacaatgtgggatttttgcaagcgtcttaaag

SEQ ID NO: 1077 - DNA, 81 bp, Poinsettia mosaic virus
cgatgacgggtgggttgacgaatgctggtggcctcggggagaagaacggcggctggcacgtcgaagctgacgaagtcattg

SEQ ID NO: 1078 - DNA, 65 bp, Poinsettia mosaic virus
ctaagagaggtgcggcaaccgtgtcgcggtggacggtgctggataggttgttgaaagcgtcttgg

SEQ ID NO: 1079 - DNA, 84 bp, Poinsettia mosaic virus
gagctctgcgagcaagcgagggtgatgtcctggggtgcgataaaggagctgaagcccacgtaaccttcgtgctcgtttgagctc

SEQ ID NO: 1080 - DNA, 57 bp, Poinsettia mosaic virus
ggagtcgacgtggttggattcgagctgtttgacgacttggtctgacatgtctgcacc

SEQ ID NO: 1081 - DNA, 77 bp, Poinsettia mosaic virus
gtgctctggcttgttggactgtgtgcgaacaaagccgactggatcggagatgcgcagagtccgaacggctcgagtgt

SEQ ID NO: 1082 - DNA, 77 bp, Strawberry mottle virus
accaagatgaagagggttagggaagtgccaaagactcgaatttttgagattttacccttccactataatatcctggt

SEQ ID NO: 1083 - DNA, 91 bp, Strawberry mottle virus
agagttgacgggggttggctgtgttaatctcctagcttcatattcttcaaatgacgctagttattacacaggcttagccatgttgactact

SEQ ID NO: 1084 - DNA, 60 bp, Strawberry mottle virus
ctcccatgtaaggtaggcctcaacgtttacagtaagagttgggatactatgcatgctgag

SEQ ID NO: 1085 - DNA, 90 bp, African swine fever virus
ctccttttgatattcaatcgtcttattcattgaatatttgtatataactataattacaaatgttcaatgaattgttattcatgtcgggag

SEQ ID NO: 1086 - DNA, 82 bp, Strawberry mottle virus
ggaaatcttgttaaatggatggaattttcagaacttgatttcctcaagaggagatgggttctttattccggacaaggttttc

SEQ ID NO: 1087 - DNA, 65 bp, African swine fever virus
ggatgaggccgtttgtctcggcctcgctgattttttgcacgaactgagatatatcgttctcattc

SEQ ID NO: 1088 - DNA, 68 bp, African swine fever virus
gtgtatacactttgtatttactttgagatatactttgtgtatcacaacgtgccctaagatgtgtgcac

SEQ ID NO: 1089 - DNA, 78 bp, Strawberry mottle virus
tcatggactcaagggtctcgctgatgggtacgagaaattcaaatctatcactgagaaactagctttctgggtttatga

SEQ ID NO: 1090 - DNA, 130 bp, Human herpesvirus 2
aacgtggtgggtttggcggtctcgtccccgacggcgttcaccaccttcgtgagctggggcttcgtgaggcgcagctggacgtcggggtcgccctgggggagtagtaccgcgaagctcgtcaactcgcgtt

SEQ ID NO: 1091 - DNA, 81 bp, Human herpesvirus 2
gcaccgatgccgtgccgctggcgttgcgccgagagaacgacacggagtcgcggtgccacgtcagctggcaggtgaaggtgc

SEQ ID NO: 1092 - DNA, 131 bp, Human herpesvirus 2
gtgggtgtggttcggggggcggatgcgttccgcggggacgcggagggggcggcattgctcgcgttcccccgcgggcccaccgttatcgtgcgtccgggggaggcattggccagcaccacgaccacacccac

SEQ ID NO: 1093 - DNA, 67 bp, Porcine adenovirus C
tcagattggagatgttgccggcgtggtccttcctggggttcatgttgtgcaacactaccaggactga

SEQ ID NO: 1094 - DNA, 117 bp, Chimpanzee cytomegalovirus
gtctgggcgtcacgcgttgtcgcatgagcgcgcggttgacgtagaaggccgactccgagatcggccggccgttggcgtcgcgctgcaggtccgcgcggttgccgtggcgcagctgac

SEQ ID NO: 1095 - DNA, 91 bp, Chimpanzee cytomegalovirus
tgacgaagccgttggcctcgtcggcctcggccacgttccacgaaccgaaggtgaaggtgcaggccggcgagccgcccagacggatcttgca

SEQ ID NO: 1096 - DNA, 59 bp, Duck adenovirus 1
gcgtacgtgcaggtaatgtatcaataaaacgttgtatactttgcccccggtttctacgc

SEQ ID NO: 1097 - DNA, 70 bp, Camelpox virus
ataataggaacatgatattttctgtaccatttcaccaacaagtatagaaatgcgaatctgtatctattat

SEQ ID NO: 1098 - DNA, 102 bp, Camelpox virus
atctatgattccggtattcatttagatatgtgatatcttctataaatatatgagcatatatttacggagatgaaatatcctctatgaatatatattgcagat

SEQ ID NO: 1099 - DNA, 64 bp, Camelpox virus
gaacaacaaagcgattattgttttacctgatcccataatatggaacaataacacgcttctgttc

SEQ ID NO: 1100 - DNA, 79 bp, Camelpox virus
tatgaaaacttgttttatctctatttgtagacttagttaatgaaaaattagatctcatggattttattacattttcatg

SEQ ID NO: 1101 - DNA, 88 bp, Camelpox virus
tttctcgaattggcggtctctagctgctggatgatatcccactatggtagttactggagattctaacttggcccgtatattcgagaaa

SEQ ID NO: 1102 - DNA, 69 bp, Monkeypox virus
atcgtattgtggttatatggctacaatttcataatgagttgaagtcagtgtcctatgatcaatgacgat

SEQ ID NO: 1103 - DNA, 130 bp, Monkeypox virus
atttggagctttaatagtaagaactcctaatatatccgtgtatgtggtcactaatacagattgtagttctataatcgtaaataatttacctatattatatgtttgagtttgtttagaaaagtagctaagt

SEQ ID NO: 1104 - DNA, 78 bp, Monkeypox virus
gatacgaatatgtctttgttaaaaacagttattttctgaatatttctagcttgtaattttaacatatgatattcgttc

SEQ ID NO: 1105 - DNA, 63 bp, Camelpox virus
ggaagagatgtaacgggaacagggtttgttgattcgcaaactattctaatacataattcttct

SEQ ID NO: 1106 - DNA, 95 bp, Monkeypox virus
ttttaggaactatgttcatggtatcctggcgaatattaaaactatcaatgatatgattatcgttttcatcttttatcaccatatagtttctaaga

SEQ ID NO: 1107 - DNA, 131 bp, Saimiriine herpesvirus 2
aaaatgctacaaataataattttaaatataatttattttacatttattatgtatggtacatgttgcgggtatctcaacaaataattagtattacatggtcgatctgaagttttaaaattgtagtttgtgtt

SEQ ID NO: 1108 - DNA, 66 bp, Saimiriine herpesvirus 2
aagcagtttcttggataatttccatagttgttgaatctatgacatgattgagtccagaagctactt

SEQ ID NO: 1109 - DNA, 77 bp, Saimiriine herpesvirus 2
atgaacagttggctgtccaatgaacacagatgtggaagctttagagctatacattatgtgttcagcaacaacttcat

SEQ ID NO: 1110 - DNA, 74 bp, Saimiriine herpesvirus 2
cgtagacaatttgatataaattcatggtgtgagcatcttctgatctgatgccgtaaatgtttaagttgtgcacg

SEQ ID NO: 1111 - DNA, 72 bp, Saimiriine herpesvirus 2
ttataataaattgtttttgcttttgtgggcggcgcccgtctccatgagcaattgtaggcacatttattttaa

SEQ ID NO: 1112 - DNA, 70 bp, Ononis yellow mosaic virus
cgaccatgctaggggattgttgtcctgggtttggagacagatgagtcccaggagcagagatggagggttg

SEQ ID NO: 1113 - DNA, 89 bp, Barley stripe mosaic virus
aagccatgtttggagactttctgtggtttgttccaaatactctctcgagtgtctggaagaacatgcgaaaatcactgatggaatggttt

SEQ ID NO: 1114 - DNA, 129 bp, Barley stripe mosaic virus
actatcaactgtgtagcgtgatttgtgaaagggctcagattttgagtgtcatcgaagactttcgtcagaatttgatattctcagataaagtggccgttccattgaacgctagattctacagttttcagt

SEQ ID NO: 1115 - DNA, 107 bp, Barley stripe mosaic virus
agcttattacttgctgaaggaccttgtgtaccgcaagctgataggtttcattttgatgaagctctaaaagttcattacggcgccataatgttctgtgctgataagct

SEQ ID NO: 1116 - DNA, 123 bp, Barley stripe mosaic virus
ctggagatgttgccttctatttgagtgctaaggaattttacaaagttaaaggaatacctcaaaaggttataacttctaacagtgtgaaacgttccttgtacgctagaggcgaaacgactccgg

SEQ ID NO: 1117 - DNA, 131 bp, Barley stripe mosaic virus
ggcccagaaggtaacagggacggtgaccgaatgcgagaaggacctgggacctcttgttcaaccgataaaagagatattggttcaacttgtgatgcccaatttggtcagagcgctgtgtagacctcgtagcc

SEQ ID NO: 1118 - DNA, 87 bp, Barley stripe mosaic virus
tcctgtttcctcctgctgtattgataggtcagaaggaaggcattttaccttccgtggacggtcattacttggtggagaatggcagga

SEQ ID NO: 1119 - DNA, 79 bp, maize rayado fino virus
atgcgggccaggtcagcgggtacggcggtggtgctggacagcataacaggcccgcccacggtgatctgacggcccccat

SEQ ID NO: 1120 - DNA, 64 bp, maize rayado fino virus
gcgttagccatgatggttgcctgggtcttggaagagagctgcgcaaactcgttgaggttgatgc

SEQ ID NO: 1121 - DNA, 128 bp, maize rayado fino virus
ggcggagtcggcaaagagcactggcgggcggcaggctggatgggtctcccaaagaaaccttggctcggggccatggaatgggagacgaggccagaacctccggccgatgatgtcgaagccgaacagcc

SEQ ID NO: 1122 - DNA, 65 bp, Beet mild yellowing virus
gcaccgcaagccacgtacattgtacctcaaaagaggaatatgacgaatggccgagatgctggtgc

SEQ ID NO: 1123 - DNA, 84 bp, Beet mild yellowing virus
ggcaaccttgaagttctgacgaactatcttgcagcttgtttctcaattttaaacgagctgagatccgatcaagaactcgttgcc

SEQ ID NO: 1124 - DNA, 66 bp, Beet mild yellowing virus
ggtgagctccccaagttttacttctctaaacaaaaaggatgctcggattggggcacgaagctcacc

SEQ ID NO: 1125 - DNA, 130 bp, Chayote mosaic tymovirus
gaatcatcacctgagacgaagactggttggtcggttatggcgtactgactaaaaatggtggccagattgtagtcagtgttgtcgtcataggtgccgggttcgccggtcagacgcatgcaggtgagtgggc

SEQ ID NO: 1126 - DNA, 72 bp, Chayote mosaic tymovirus
gctggttgtagctgccggcgtgatggctttcgggggtgtaatggagagacgagccggtcacttggaattggt

SEQ ID NO: 1127 - DNA, 95 bp, Chayote mosaic tymovirus
gcttgggacgttacccaagagtgctcgggtttgttgctgtgcatgcgaacgaagcctgcgggatccgagacgcgaagggttcggacggcccgagt

SEQ ID NO: 1128 - DNA, 57 bp, Bamboo mosaic virus
gaggtttttcgattgtctaatggcgaacgtcggtttggctaggtagtaggtgacctt

SEQ ID NO: 1129 - DNA, 54 bp, Bamboo mosaic virus
gcttcggtagttgctgcgtctgtgtaattgatgccgatgagcgactggacgagc

SEQ ID NO: 1130 - DNA, 119 bp, Bamboo mosaic virus
ggacgatcgtggcgagcagggtctctagttgtggggagcttgtgaaaatgtgctccagcacctcaggctggaagtaatgcaggctgtccccaataaaagccatctttgttgtgatttcc

SEQ ID NO: 1131 - DNA, 74 bp, Bamboo mosaic virus
tggtagcagttgcccctaatggatatagtgtgcccgtttattattatttcacatggtgggggcagatgctgttg

SEQ ID NO: 1132 - DNA, 61 bp, Fowlpox virus
gttaaatattgtccttatatattcatcttctatttcgtgaaggtatgaaaacaattcatac

SEQ ID NO: 1133 - DNA, 81 bp, Fowlpox virus
tagaaaattttaaaatatcgtatagcttgtagttatcttttgatactatatcttctatagcgaatgtatttttatattcta

SEQ ID NO: 1134 - DNA, 118 bp, Cercopithecine herpesvirus 7
gacgttcgtttccaggagccataaactgctgtgtggttaaatgtgattccaatgtccaagctggtgtagttggggtcatatctggccatagttccataaatcgttccatttgaatgtc

SEQ ID NO: 1135 - DNA, 74 bp, Cercopithecine herpesvirus 7
ggtcgtttaaattgatactctgtgtcggctggactttgagaacaaaccgcacgagattctaaaattaaacgatc

SEQ ID NO: 1136 - DNA, 69 bp, Cercopithecine herpesvirus 7
tcgttcaatagatctggcaacaatttttcctattaaatctcttgatagttgttgtggaattgttaacgg

SEQ ID NO: 1137 - DNA, 88 bp, Cowpox virus
ataaaaatatttttacgactccatcagaaagaggtttaatatttttgtgagaccattgaagagagaaagagaataaaaatatttttgt

SEQ ID NO: 1138 - DNA, 76 bp, Cowpox virus
atggttcatgcggtgttatatcgctgtttattatgattatacatgaaagcagcaatagcaatatatatgacttcat

SEQ ID NO: 1139 - DNA, 85 bp, Cowpox virus
tttgtggtgtgcctgaatcgctcgattaaccctactcatccaatttcagatgaatagggttatcgattcagacacacgctataag

SEQ ID NO: 1140 - DNA, 91 bp, Cowpox virus
tttttcttagtacaaaagtcaatgttttaaaatatatggacaagaatttgtctgtataaaaacttgtgtgaaattttgtaccaaagaaaaa

SEQ ID NO: 1141 - DNA, 51 bp, Cowpox virus
gagatggttttgatccaaggttgattaatgttggatctaactgtagtactc

SEQ ID NO: 1142 - DNA, 100 bp, Camelpox virus
gcaaaacaatattgaccgttataaatgtctttgtcgatgatatattcgacgcttccaattgtgatatatccagagatatcttgtaatggcgatatcttgt

SEQ ID NO: 1143 - DNA, 76 bp, Camelpox virus
ttggaaatcctgtttcaaagtaacttatatcatctttataatatgatctgatatactcacaaattttcttttccaa

SEQ ID NO: 1144 - DNA, 92 bp, Swinepox virus
tattatcattacatgtattaatatcaaaaaactgagaacacttacaattacttttattcttttcattgatatgatacaccaaaggattaata

SEQ ID NO: 1145 - DNA, 80 bp, Meleagrid herpesvirus 1
gatatcctagcattgtgaagtagaacattaaatgtattggggatcagattcctaccatttagtggatgcctgggatcttc

SEQ ID NO: 1146 - DNA, 87 bp, Meleagrid herpesvirus 1
gcttcgtatgcattgaattaccaatcgcatgagcagcccaaagttacgttcgctgccatgaattacggcttcgatgatatagaaagc

SEQ ID NO: 1147 - DNA, 61 bp, Meleagrid herpesvirus 1
ggccatggtgcaatgcaccatcgaacgttctcatgcgtctggtggatgcagatgcgccgcc

SEQ ID NO: 1148 - DNA, 73 bp, Ectromelia virus
aactgtagtgctcaaatactcatcagattttttaccggaaaagtaatttgcattagtgcctccatgtacagtt

SEQ ID NO: 1149 - DNA, 74 bp, Ectromelia virus
ccgttataaatgtctttgtagatgatatattcgatgcttccaattgtgatatatccagagatatcttgtaatgg

SEQ ID NO: 1150 - DNA, 72 bp, Camelpox virus
ggaaatcctgtttcaaagtaacttatatcatctttataatatgatctgatatactcacaaattttcttttcc

SEQ ID NO: 1151 - DNA, 95 bp, Ectromelia virus
ggaacgtctgatgaacaaaagtaaagatattgacttggatggtattttctgacagaaaacatctttgaaatctttacttgatcaggataaaatcc

SEQ ID NO: 1152 - DNA, 79 bp, Cucumber green mottle mosaic virus
acgggatttgcttagcatcaccaaagacgaaggcttttttacaacctgagatctttaacgcaaaattaagtaatcccgt

SEQ ID NO: 1153 - DNA, 115 bp, Cucumber green mottle mosaic virus
gtcatatgaaaggaagattatgcgagtggtatcgtcacttgccagaaccacggcccatgcgtgcttcttctcggctggcaacaataaccacttgcacttttcgcagtcatacaac

SEQ ID NO: 1154 - DNA, 91 bp, Rana tigrina ranavirus
gaggtgtaacttttgcagaatatcttacgatagtaacattaagatgttacaatcttaagtttctttatactttcagaagatatattccctc

SEQ ID NO: 1155 - DNA, 95 bp, Rana tigrina ranavirus
gtgatcaggacagacaggaggtcagtcaggacggccggggcgtccctgcgggccctggcaatcaccagcctcctccccctgctggtcctgatgac

SEQ ID NO: 1156 - DNA, 68 bp, Melanoplus sanguinipes entomopoxvirus
gatgagtaaccagtaataacttcatgaattaaatcagtttcaaataatttattacacaatactgtatc

SEQ ID NO: 1157 - DNA, 130 bp, Cucumber fruit mottle mosaic virus
aaatcctagcaagaatatcatctagacctaaacgttcccaaataagcatctccacagcctgatgaaaatcattctgtgatttatcatatttggaaacatctagctctagaatctcatactcctgcttatt

SEQ ID NO: 1158 - DNA, 86 bp, Cucumber fruit mottle mosaic virus
agaagtagagtaagacatcttgattatgaacttagtggctcagaagcgccgctatccgaaaaagattctgcctcactcttactttt

SEQ ID NO: 1159 - DNA, 128 bp, Cucumber fruit mottle mosaic virus
ctcttagacccttctttaaaatagaattggtggtagccaccaaagaggcaatctccagagttaacggagaaaaaccatctttgatcctaacaccagaaatcctaacaaacaaagaccagggtttggag

SEQ ID NO: 1160 - DNA, 98 bp, Rift Valley fever virus
actctgtagattagctgtagcttatagctctcactgtatggaccttgtagtatacagaatagaaagtgcttgagaatttcagctgacacactacgagt

SEQ ID NO: 1161 - DNA, 105 bp, Rift Valley fever virus
atagaatgtgtaggtcctgatgagaatggtgcttggtgtacaagttagagtagacctaccatgaaaagactccatctcgtaagggccactaacatccaactctat

SEQ ID NO: 1162 - DNA, 58 bp, Rift Valley fever virus
tctctggatagttctgcataagcagtttaataagtaaacttgcagctctgacctgaga

SEQ ID NO: 1163 - DNA, 121 bp, Odontoglossum ringspot virus
agtttctcccaaatgaagtactcaacagcacaatggaattcgttctgggatttgtcatactttgaaatgtctaacactagagcttccattggcaccgtcgagtccaaatctgagagaaact

SEQ ID NO: 1164 - DNA, 125 bp, Odontoglossum ringspot virus
ggataattttaaaggtgaatctcttcttgcaagcagatgtatgataagagccaagtgttgcttcattagctcttttcatgcgtttgtctacaagacagatactcacaccacctttgcaattgtcc

SEQ ID NO: 1165 - DNA, 100 bp, Odontoglossum ringspot virus
ggtctgtaatagtgtaagacatattcaatacgattcagattgtgcgtcaaatgactcacaatcatcatcaatacgaatatcactaacaccattaccaacc

SEQ ID NO: 1166 - DNA, 105 bp, Odontoglossum ringspot virus
gtgataacctcctaacctccctacgatgtaaacaagtgtggccaaaatgtttcggataagggaaatttgccactctgtttataaagggaatttgttcagtatcac

SEQ ID NO: 1167 - DNA, 90 bp, Odontoglossum ringspot virus
ttataattttatcaacctttggaatacgtaccgacttgacagccgttaaagctgacggtagtagtttttcaaaggctgataaattaataa

SEQ ID NO: 1168 - DNA, 65 bp, Human herpesvirus 4
aagaaggagaccacgttgagtccgtttgcgcagcggctgatgaccagctggttgctcccattctt

SEQ ID NO: 1169 - DNA, 60 bp, Cactus virus X
cgttgtcaaagcagtaattaactatttctagtgatagtggagtgaggttggtggcagacg

SEQ ID NO: 1170 - DNA, 69 bp, Cactus virus X
gaggccaatggttgctttggggcagagcggtttgagtccgtgcctgctcgcgagttggaagatggcttc

SEQ ID NO: 1171 - DNA, 109 bp, Cactus virus X
tctccatcagtcaaaagttgagaaaacacggcctccacctgctttgatgatctttcgaacggttaatttggtgggccatggattgctttctgagaagattgagtggaga

SEQ ID NO: 1172 - DNA, 65 bp, Human adenovirus C
cggtgataggtttttctcccaccataagcaccagtttttggcgctgggtgggtagcttgtagctg

SEQ ID NO: 1173 - DNA, 109 bp, Human adenovirus C
gctcttgggctaacggcggcggctgcttagacttaccggccctggttccagtggtgtcccatctacggttgggtcggcgaacaggcagtgccggcggcgcctgaggagc

SEQ ID NO: 1174 - DNA, 73 bp, Human adenovirus C
ggatcgcctgacggggcgtaaatgaagagcggccagcgccgccgatctgaaatgtcccgtccggacggagacc

SEQ ID NO: 1175 - DNA, 106 bp, Botrytis virus F
aattcaccgttgctgttagccaatggtatttcttcaagcggctcatcttcaacagttggtgagtggtacggtgaagctgcaggggggttgggcgggggcgggggtt

SEQ ID NO: 1176 - DNA, 126 bp, Botrytis virus F
atgctactaataggcagtcattgcgggtgggatatggtgggggagtatccttctttgcaagtgcggccgcgtagacttcttcagtgagatcgccttcctgcaggggattgtcttccggtacagtgt

SEQ ID NO: 1177 - DNA, 130 bp, Botrytis virus F
catgaggagggtttcaaagttgacaaaagttgcatcctgcgaagcgtcatacgcagtgtagtcgccatcggtcgattcccgtgtgtgatcccagtgggcagctacgaatttctcaaaatcttcattggtg

SEQ ID NO: 1178 - DNA, 74 bp, Cowpox virus
gtgatagtttataccattcaatataatcgcttcatcctttagatggtgatcctgaatgcgtttaaaaaaattat

SEQ ID NO: 1179 - DNA, 126 bp, Vaccinia virus
tagctttcatagttagatacatggtctcagaagtaggattatgtaacatcagcttcgataaaatgactgggttatttagtcttacacattcgctcatacatgtatgaccgttaactacagagtcta

SEQ ID NO: 1180 - DNA, 66 bp, Camelpox virus
tcgtaagatactccttcatgaacataatcagttacaaaacgtttatatgaagtaaagtatctacga

SEQ ID NO: 1181 - DNA, 85 bp, Equine herpesvirus 1
gccgcctgagagcctggacgtgctccagaaggtcgcggtagatagccgtgcactcctctggcagctcgccgtttcctaggtaggc

SEQ ID NO: 1182 - DNA, 66 bp, Equine herpesvirus 1
tgagcaggtttggtatcagcgagagcagcacaagcgatccctcgttcatggcaaaaatcatgttta

SEQ ID NO: 1183 - DNA, 58 bp, Equine herpesvirus 1
tggtgaggtacaatcgggtttctcttgttctctcctcgaatgggcctgttgtgcacca

SEQ ID NO: 1184 - DNA, 74 bp, Equine herpesvirus 1
tgtctgaacgagcgggtatacgcggtcgtaccgtactcccatggtacagcagttaccgcgcgagaatgcaggca

SEQ ID NO: 1185 - DNA, 84 bp, Avian nephritis virus
ggaagtagtcaccctgacctggttgtggaaagcctgcccaagaaggcatgtaccacgtagtgccagattggtttgctgctagcc

SEQ ID NO: 1186 - DNA, 68 bp, Avian nephritis virus
tattggtagtcataataagtgacccatcatccggagacggttgaatggtcacagtttgaccaccagta

SEQ ID NO: 1187 - DNA, 83 bp, Avian nephritis virus
tctcaagtgcagtagctgcaactttggacatttggagattggtaactccaaattttgcgagatttccagtaactcgcttgtga

SEQ ID NO: 1188 - DNA, 130 bp, Avian nephritis virus
ttctccaagtgttggtaaccaaactcaaaagcagtcaaccactcattaacaaggttgttgtcaactgttgttgaaaattgcccagatgggttgcctttcttgacatgagttacctctccagttggaagaa

SEQ ID NO: 1189 - DNA, 107 bp, Scallion virus X
cggcggggtcgtgctggagttgtgtgccatcgaaaccgtggctctggaggaggggcacccaactgacccatggtatggcacacgtggaattagcagtggccacgtcg

SEQ ID NO: 1190 - DNA, 108 bp, Scallion virus X
gcagaggcgtcctggaggccttgaggtggtgggaggcgaaattgactttaagtctaccttggcgctctgaataaacccccagcttgttggccaaagcttggacgttgc

SEQ ID NO: 1191 - DNA, 69 bp, Scallion virus X
tgggtaagcaacttgccagttctacaatttttgatgtcggaggcgtatgagctggctcgttggtggtca

SEQ ID NO: 1192 - DNA, 69 bp, Clover yellow mosaic virus
acggtcttgacgtacatgaatagttgcatgaccagggttttcttgatcggcactctgtggttaaactgt

SEQ ID NO: 1193 - DNA, 74 bp, Clover yellow mosaic virus
gaaccactgggtcatcggtttggacacaattagagtatccatggtctgagctgtataactccctttcgtgtttc

SEQ ID NO: 1194 - DNA, 121 bp, Clover yellow mosaic virus
tggtcgattctgtatggacaggggtacctgctggcctctttgagttgttctagcaagtgtggctccgggaggcgtccttcatactttggcagggatttgttgtccttgatgggaaagatta

SEQ ID NO: 1195 - DNA, 77 bp, Clover yellow mosaic virus
ttaaagtctccctaatcagtttagcagttgatgggccaagcctatggctggtggttttgatgaagtgggggctttga

SEQ ID NO: 1196 - DNA, 87 bp, Camelpox virus
atattgaccgttataaatgtctttgtcgatgatatattcgacgcttccaattgtgatatatccagagatatcttgtaatggcgatat

SEQ ID NO: 1197 - DNA, 105 bp, Camelpox virus
gaagaggttggaatatcaactagttgctgagaaagaaaaagttaagttctacaaaagataactagaacgtgatcggtatctttctagtagatatcttacctcttc

SEQ ID NO: 1198 - DNA, 56 bp, Camelpox virus
taatttctatagtttgtaatatggagctttttccacgcgttactatagagtgatta

SEQ ID NO: 1199 - DNA, 75 bp, Strawberry mottle virus
tctccgttaaagtgataagcaaacctattgtgctcagcatgcatagtatcccaactcttactgtaaacgttgagg

SEQ ID NO: 1200 - DNA, 81 bp, Tupaia herpesvirus
ggaaaacgtaaaggtgggcccggtcagctggacgtccgagtctccgatgcctaacctgatacctggatctacctatgttcc

SEQ ID NO: 1201 - DNA, 79 bp, Tupaia herpesvirus
ggtccaagtcccgggtcttgggagggatgtatttgggtggagccaagagtctctctggagtggtgactttctgtggact

SEQ ID NO: 1202 - DNA, 80 bp, Tupaia herpesvirus
gtccatgttgatcaggtcatcggccgtgggttcaaagtcatggttcccggggatgctcatctgatcaaaactcagtggac

SEQ ID NO: 1203 - DNA, 75 bp, Tupaia herpesvirus
tccgtcgacctgacttagagtctctgtctacacacttcacaggtatccaggggctcctgttgggataccgaggga

SEQ ID NO: 1204 - DNA, 130 bp, Fowlpox virus
ccgagcattcatccacttctaaactctgtacgttaatgatattattgataacagcatccgaattacatttttgctttatataggtttcaaagtcttgcgttatcgtactcacgttagtttgaatgttaag

SEQ ID NO: 1205 - DNA, 80 bp, Fowlpox virus
ttttaatgcgttcttgatctaacagtctttcctttaaccgattaaaacaggatactgcgttaggttcgtatgcattaaaa

SEQ ID NO: 1206 - DNA, 78 bp, Fowl adenovirus D
cgccgtcggactcgatcgcttcccgtgccgcgtacagcccgtctgtatggaagggagcgtcggtctcttccgacggcg

SEQ ID NO: 1207 - DNA, 58 bp, Fowl adenovirus D
gcgttccatgagttccagaagcgcggtaaaacgaactgccatggtaacaatggttcgt

SEQ ID NO: 1208 - DNA, 91 bp, Fowl adenovirus D
ggccacgtaccgttggatcgcgtccacgaagcgctgccaaccgattttttccttcgcggtattgatgacgagattcagaatgaccgtggcc

SEQ ID NO: 1209 - DNA, 87 bp, Equine herpesvirus 2
agcacgcagatggaggcggtcctgttgctcttttttagctgcagcgcttgagagagcatgcatggcccctggcaccggtctgcggtt

SEQ ID NO: 1210 - DNA, 81 bp, Equine herpesvirus 2
gcgaggggcgaggtattaaggggaaaaaaggaccgcgggctaatccctttttgatctttaataccccgcgcgcccgctcgc

SEQ ID NO: 1211 - DNA, 87 bp, Human herpesvirus 1
tgtgacgttcttctcgccgtccaggtggcgaatcaggcgcttgaaaaacaggtctggcatccagagggcgctgaagatattgtcgca

SEQ ID NO: 1212 - DNA, 131 bp, Tacaribe virus
acattaatactattggaaacatttgtgagggtcaatccagaagaatttgagagaaaatggaagagtgacatgacaaaactactaaatctcaaacaagaccttctgaggtcaggcatcacacttgttcctgt

SEQ ID NO: 1213 - DNA, 64 bp, Tacaribe virus
gctgaagttcttagatgtttgcatagcattggatttgatgaatgagaatctaggaatcgtcagc

SEQ ID NO: 1214 - DNA, 125 bp, Tacaribe virus
tcaatattttctgatgatgagatgacaggcttcattagaagctgtgctaaaagggtttttaatgatataaaaagaggcaaagtttttgaggaaaacctgatcagtcttattggtagagatggtga

SEQ ID NO: 1215 - DNA, 130 bp, Tacaribe virus
ttaggctttagatgggtgaatttgtcaagttttggtgacctaagactagtattgaggaccaagttaatgacgagcagaagggttcttgagagagaagaggtgccaacactgattaagacattgcagtcca

SEQ ID NO: 1216 - DNA, 74 bp, Equine herpesvirus 2
aaggagtaaagccagctggttatgctgataagaacacaggcatcttaaacactaactggctggttttactcctt

SEQ ID NO: 1217 - DNA, 83 bp, Equine herpesvirus 2
agtttatcaacagcattaacctatggactcttattactaacactataccaataaagcaccagcattaatcttttgacactact

SEQ ID NO: 1218 - DNA, 84 bp, Equine herpesvirus 2
ccaggtaagggagcgagctgttggattattgtttctgacatcaatctgctcaaagcttaatctaccaactccctcccttacagg

SEQ ID NO: 1219 - DNA, 79 bp, Equine herpesvirus 2
gtaagaggggtgcgatccggttatgctactcggaccagcatcatgctttaatcccagaacctgatcacacctctcttac

SEQ ID NO: 1220 - DNA, 81 bp, Equine herpesvirus 2
gtaaggagtggtgaggtcgggtatgctaatgggaccacagcatctagcctgatccagagacctgaccccagcgctctttac

SEQ ID NO: 1221 - DNA, 130 bp, Bovine herpesvirus 4
acatctgggagtgcttcaatctgttcagtgaagatatgttcaaatgtggatcctgccagggtcacttggttggatatggataggcatattaatgaactaccattcattttcagttctggagtcactctgt

SEQ ID NO: 1222 - DNA, 97 bp, Bovine herpesvirus 4
acatggtttgacaagttttagtaaaatgtttttttcaaagtgtagtgttcttctagtttctgaagaaaacctgttttccttaattgtcatccatagt

SEQ ID NO: 1223 - DNA, 53 bp, Bovine herpesvirus 4
cactatggtggcaagatgtctcccatctggggatgtgatgcccgccacgtgtg

SEQ ID NO: 1224 - DNA, 54 bp, Bovine herpesvirus 4
gacaggactctcctggcatttgatgctgttatagccaggctcaggcttcctgtt

SEQ ID NO: 1225 - DNA, 75 bp, Bovine herpesvirus 4
ggtctcattgtggccatctcaaaaaatatataaatttaaaaattatttattgtttacctgctagaagatatgacc

SEQ ID NO: 1226 - DNA, 130 bp, Bovine herpesvirus 4
tgtcctcgcacacaacttactactgaatgaaccacggatgctttccttctcagatctgtggatttatctgtccaatcggaagtgaaaccacatctttgtgtcatttttaatcagccccgttaaaggtaca

SEQ ID NO: 1227 - DNA, 86 bp, Gallid herpesvirus 3
gatatatgggcactattatccggtgacgtgcgcatagttgagcgacgtcgactcgacttacgtctatccgaatctcccattgtatc

SEQ ID NO: 1228 - DNA, 77 bp, Gallid herpesvirus 3
ggcggggagtcttgagtgaagtgcatagtgaagatggactgtccattagaggcaggcgcttcactggtctcgccccc

SEQ ID NO: 1229 - DNA, 92 bp, turkey adenovirus 3
caaggctggataagcaaattgagttacatgcttcagtttttctttcatggacattaatcttatgttatcagattgtaaattaaccaaccttg

SEQ ID NO: 1230 - DNA, 64 bp, turkey adenovirus 3
gaggcatgattgtaagtgtgtaagtgtgagtcctttttatactacacgctcagattcttggctc

SEQ ID NO: 1231 - DNA, 63 bp, turkey adenovirus 3
tacagctcactatattacttctcgctaaaataaatgttctaaagttattcaattgagtctgtg

SEQ ID NO: 1232 - DNA, 102 bp, turkey adenovirus 3
tgtgtttcgcgccacagcattactaatgagaaaattcacacttgtcttaacttgacattttaatagccaatcgtaaaggagttgtggttaaagccagacata

SEQ ID NO: 1233 - DNA, 70 bp, Monkeypox virus
aagttatgcagcatttcatatttaaactcgttaatcgttaactgagatttttgtttaatgtgttcagctt

SEQ ID NO: 1234 - DNA, 87 bp, Monkeypox virus
atattgaccgttataaatgtctttgtcgatgatatattagacgcttccaattgtgatatatccagagatatcttgtaatggcgatat

SEQ ID NO: 1235 - DNA, 73 bp, Monkeypox virus
gactgtagtgctcagatactcatcagactttttaccggaaaagtaatttgcattagtgcctccatgtacagtt

SEQ ID NO: 1236 - DNA, 53 bp, Camelpox virus
tgatacctttgtacgacattaatgctatagtaacatgttgtccgaagcaatta

SEQ ID NO: 1237 - DNA, 73 bp, Monkeypox virus
ttgtgattgttcatgatatcgtttcggatgttacctatgtaattctctaattcatcatgtgccaacgtctcaa

SEQ ID NO: 1238 - DNA, 92 bp, Human adenovirus D
caatgctttttaggagactttcatccatctggtcagaaaagactatttttttattgtcaagcttggtggcaaaggagccatagagggcgttg

SEQ ID NO: 1239 - DNA, 106 bp, Human adenovirus D
cctcgtagaggcgggtgagggcgtgcttgagatgcagatggtacttgatttctacgggtgagttggtggccgtgtccacgcattgcatgagcccgtagctgcgcgg

SEQ ID NO: 1240 - DNA, 79 bp, Human adenovirus D
gggcgttgcgggccgagaccgtgagctcgtcttccaggagcctgatgagctcggcgatggtggcgcgcacctcgcgctc

SEQ ID NO: 1241 - DNA, 80 bp, Human adenovirus D
gtgcgaggggtagcggtcgttgtccaccagggggtccaccttttccaccgtgtgcagacacatgtccccttcctccgcat

SEQ ID NO: 1242 - DNA, 80 bp, Human adenovirus D
tagcaccactgcatggcctcgtgctctggggtcgtgttgtagatgatccagtcatagcaggggcgctgggcgtggtgctg

SEQ ID NO: 1243 - DNA, 75 bp, Yaba-like disease virus
atcttttcaggctctaaagtgtagatacagtccttaaaaaaaaaggagttagcacttttttttagcctagcggat

SEQ ID NO: 1244 - DNA, 120 bp, Yaba-like disease virus
gtcggcaatagactgaactgttgatttacctccttgtaccgtatattctataatagctccattcattttgtttatgtaaatacattctttattaaaagttttttcctctatattgccgac

SEQ ID NO: 1245 - DNA, 87 bp, Blackcurrant reversion virus
ctcttgccttattaattggtagttgtggtttcttccggggcaatctcacagttgtcttggaatgggccaccttcctaaaggcaggag

SEQ ID NO: 1246 - DNA, 79 bp, Blackcurrant reversion virus
gattttcgtccacccgtggtgagaggctgcgactacgaaagtagagttaaagcttctatccaaaggaaaatcgagaatc

SEQ ID NO: 1247 - DNA, 99 bp, Blackcurrant reversion virus
gcctactgttgcgtttgttaatgttatggacacacgtattgaggatcctttgtattcttcattatgtgggtcctacattgatcttggaagggatcgggc

SEQ ID NO: 1248 - DNA, 69 bp, Blackcurrant reversion virus
gcgagtgacacgtggatgtgtctcgtcgagttgcatatgacgagactcgaatcatctacgttagcttgc

SEQ ID NO: 1249 - DNA, 104 bp, beet soil-borne mosaic virus
agctaaggctaagagagcttgaggttgagcgtatgcccgggaagactgaaagatatattcacacaggtatacaaggtggtgctcaactcgctggtgctttagct

SEQ ID NO: 1250 - DNA, 102 bp, beet soil-borne mosaic virus
gaggatgatggtgtttatactgatgctgagagtgctgtcattgtgggtactagtgctattgttaatgaccacgatcaatttgatctcaatactgtgattctt

SEQ ID NO: 1251 - DNA, 80 bp, beet soil-borne mosaic virus
gccgcaagcttacctgttattaaggccaattttagtagtctcggtgctaattggtctgaagatggtgatgtgtttgtggc

SEQ ID NO: 1252 - DNA, 118 bp, beet soil-borne mosaic virus
gtagtaggttagttgaactaaagagtctatggttttctaggggttctggtggcggcggtgatttcactgttgagttaccaactagaactactgatgcctttagtttaggtaccactat

SEQ ID NO: 1253 - DNA, 131 bp, beet soil-borne mosaic virus
tgaggcccttccttttgaaacatgggtttatttaaatctctctcgtgtgtattttagtatcgggtgttctgatctcttttatgcgactagagaatttgttactgtgtttaatggggagtttgagggtctta

SEQ ID NO: 1254 - DNA, 89 bp, Grapevine virus A
acgcttagcaaacgtggacctacccgtgagaaatgatgggtcatccatctatatctcaacagcctgctcgccgattgatgactgagcgt

SEQ ID NO: 1255 - DNA, 96 bp, Grapevine virus A
cctggtaggtagcatggttcatcatctgcgtggaatcctatactgccccctgccgtgtatctttggatcagacaatgatcgtagctatcatctagg

SEQ ID NO: 1256 - DNA, 97 bp, Grapevine virus A
ccttggaaagagtggacactgaactccataccatagcctgtaagaatttctcttaaggtatctggaatgtagtaatcaaatagtccatctagcctgg

SEQ ID NO: 1257 - DNA, 131 bp, Grapevine virus A
cttcttgctagctttaggacctactatatctacctccccataatgaatcgcctttttgcttgtcccgaccaaggcgatgtacccgaagagagtgttcaggtacatatttcggtcgtagccgctctcagaag

SEQ ID NO: 1258 - DNA, 84 bp, Grapevine virus A
tgctacccaatcatctctgagcactttccttgggctaatcacaagcactttctccacggaacagtgtttaagtatggtttggca

SEQ ID NO: 1259 - DNA, 67 bp, A-2 plaque virus
atcataccactcccgctcaagtgccttgaaagctggcaaattcaagcacttgccgactggtactgat

SEQ ID NO: 1260 - DNA, 70 bp, A-2 plaque virus
ccagtgtcaatacggtaatttcaagattgactccttctgggtcaaccaagtttactgcattgactactgg

SEQ ID NO: 1261 - DNA, 96 bp, A-2 plaque virus
ggaactatccagccccttcgtctgcaataatctcggacctcccctgagtcaacgctacagagaagatcagagattgcagatggggctggtgtttcc

SEQ ID NO: 1262 - DNA, 123 bp, A-2 plaque virus
tatgctatcatcctcaaatcagacaaagagattcgtttatacaccttgactaataatgtccgaattataagattatttatcattgtgttgaatatactggtccctgagcatcccgatggcata

SEQ ID NO: 1263 - DNA, 71 bp, Human enterovirus C
acggatcaatcacttttgaccgtgggtacagtctatatgatttcaccggggaaacagaagtgcttgttcgt

SEQ ID NO: 1264 - DNA, 117 bp, Human enterovirus C
ccaatgagtgtaataatttagaatttcacccaacatggtgtgactcagtcgtttgtcagaagcaggtgataaagatagacagaatataggtgccttgctcaaattgtcattcaatgg

SEQ ID NO: 1265 - DNA, 113 bp, Human enterovirus C
cccatatcttttagacaatctggtagcttccaccaccatccccttgaagtggtcttccaagacaccgattccagggtgtaaaaacggttgctactaacgtctggttcagtggg

SEQ ID NO: 1266 - DNA, 86 bp, Human enterovirus C
gtgttcattgttggcaacccttgatgtactgggatggtaatatttctcaacccattaaattctgtacacatgggtgcgatggtcac

SEQ ID NO: 1267 - DNA, 61 bp, Beet virus Q
actaatggtgacgtaaaagacaaagttcctcaatggagtatgaagtacgtcgaaagttggt

SEQ ID NO: 1268 - DNA, 75 bp, Beet virus Q
acttataggtcaccattggatgttgccgcatttttaactcgaaagggttattacggtaactcggtgattatgagt

SEQ ID NO: 1269 - DNA, 125 bp, Beet virus Q
ctatcggtcccaggacaggtatgacttccatctattctattccaaaagttgccaattgtcaatatttgacctttacgcaagctgaaaaagaagagatggagaaatacttgggcaaaggaaaatgg

SEQ ID NO: 1270 - DNA, 116 bp, Human enterovirus A
ctggcggcccgtcctgcatccaatctgcccaaatctgtcttgtatgagtctgtcacctcaatgtcacagtccatatagaatctgcggcggatggcatcagagtcggacaccgttgg

SEQ ID NO: 1271 - DNA, 76 bp, Beet virus Q
ggaggtaattgggcaacacacgctatgagaagtgataagcgtttcgtacattgctgttgtccgattttagacttcc

SEQ ID NO: 1272 - DNA, 131 bp, Human enterovirus A
tctgtagattgttcacctccaatatggtctctaccctgcaaatctccaacagattgcgcacttcaccaggtatgtgtatggctggagtagggtggaatccgggcaaaatgggagctgagacaccatcatca

SEQ ID NO: 1273 - DNA, 68 bp, Beet virus Q
tgttggtaggatgaaagagaatcaattaaatgtggaaacgatttttggttatcttgcatccactaata

SEQ ID NO: 1274 - DNA, 90 bp, Saimiriine herpesvirus 2
aataaacgttttttctaagatttgttgagctactgatccaaaaaggctataatctttttcagtagttaacagaaataagaaactattatt

SEQ ID NO: 1275 - DNA, 59 bp, Saimiriine herpesvirus 2
ccatgaggtacactgttattaggtaacaagtacacaattacagtatgaaacctgcatgg

SEQ ID NO: 1276 - DNA, 87 bp, Grapevine fleck virus
gtgcggtggaggaggtactgggtgtagaggatggccaggttgtagtcggtgttgtcgtcgtaggtgcctggttcaccggtgatgcgc

SEQ ID NO: 1277 - DNA, 86 bp, Swinepox virus
caacgataactgatgatgatgtttgtgatgtttcttcttacataacgaacaaggcatcacataatctattatcaatggtatcgttg

SEQ ID NO: 1278 - DNA, 64 bp, Swinepox virus
tccatactatgtgatcacctctatccgttaagtgaataacattagaatccattataagttgaga

SEQ ID NO: 1279 - DNA, 125 bp, Swinepox virus
ttctataaatatatattctagatattcgtcgttaatatttgcaaactttttatgtctattgataaaactttctatatcatgtccgtgagttcgtatattaaaatgtttagctagtttttgttgaa

SEQ ID NO: 1280 - DNA, 96 bp, Vaccinia virus
gatgtcggattctttgcgtatctcagtctgtggcgtttgcttcgtttaaataatatatcaaacatggagacgcctgatatgtaggcattcttcatt

SEQ ID NO: 1281 - DNA, 89 bp, Vaccinia virus
taataaatttcttttcacgatgcatcttattgaatgacgttttctcataagtggacatatagatgcagaagtaatgaagaaaagtatta

SEQ ID NO: 1282 - DNA, 100 bp, Vaccinia virus
tatctttattgtcttctacatgctccaattgaatgtcatgatacaacgcagtttttcttatgcatgtttcataacaccacgaacatgtcgcagtaagata

SEQ ID NO: 1283 - DNA, 59 bp, Yaba-like disease virus
actaaggtaataattccaaggaaatacaccttctattttatttaaattatatcctttgt

SEQ ID NO: 1284 - DNA, 91 bp, Yaba-like disease virus
atcgccaattgcagactgtaacagtctttttgtagtagattttcctgtagccgtttccccaaaaaagaaagttatacactgttttgtagat

SEQ ID NO: 1285 - DNA, 65 bp, Yaba-like disease virus
taatgttaattcgtgcggacttaagttgacaggaaggtaaactttttttgtaaatgttgacatta

SEQ ID NO: 1286 - DNA, 98 bp, Yaba-like disease virus
tctgaattaaataaatttacagcaacgtccatactgtaattaaatatttttaatatatttatgttaggaaccaaaatgtaaacttttttaaatctaga

SEQ ID NO: 1287 - DNA, 130 bp, Yaba-like disease virus
ttttaattacagtcattagttctccagtgttgttcccaaaaatattatgtgcctcatctataataaatattgcattattatatctagatagcccattgtaatttataacattgtcgttgtaattaagaga

SEQ ID NO: 1288 - DNA, 61 bp, Human herpesvirus 5
ccaggcgcaatggagtgagaggccggaccactggcgttttaaatccgagataattgcccgg

SEQ ID NO: 1289 - DNA, 92 bp, Human herpesvirus 5
ctggtgctagtagggacgtttgtgctgctggtcatatttgtagcgtcgctgaagtcgatgtgaagcagcaacccgaacgcgaccaggaccag

SEQ ID NO: 1290 - DNA, 78 bp, Human herpesvirus 5
gtttcatctgacgtgatagttacggtgattgttgtgttataagatgatgtagcgtttgctgttacgttggtaaaagat

SEQ ID NO: 1291 - DNA, 105 bp, Foot-and-mouth disease virus SAT 2 (FMDV-SAT2)
ccagaaaccaagtaccagtctcagtgttaccttaaagtgtgtttcatgacagtattaccgtgctggggttgcacacacgcaaggttcagagaacgtggctttcgg

SEQ ID NO: 1292 - DNA, 128 bp, Foot-and-mouth disease virus SAT 2 (FMDV-SAT2)
cgtcgatgtcaaagtgaaacctacggtttagtgcatcagggcaaaccatcgtacgtggggtgaacccagaatacaggttagaggttgcaatgatgaccttgctgttgaaaggcttccccttgtcctcg

SEQ ID NO: 1293 - DNA, 91 bp, Foot-and-mouth disease virus SAT 2 (FMDV-SAT2)
ggtctgtcatggccctgccgtcaatcatgatcttgtcatacttctcagcgaaaagatgacgaggcacgagataggcagtaccaaacactcc

SEQ ID NO: 1294 - DNA, 59 bp, Foot-and-mouth disease virus SAT 2 (FMDV-SAT2)
gttgcagtctcttcatttcaacagccatgccgttgagaagggcacaatcatactggaac

SEQ ID NO: 1295 - DNA, 87 bp, Human adenovirus D
gtctgtttttgttctgtttctttactatggtcttctaccttcatctcttctgattttggaaaaccatctgacactacaacctcatac

SEQ ID NO: 1296 - DNA, 74 bp, Human adenovirus D
tttgcgcaggtacgcggaagtccacaaccccggcgtgagtttcagcggagcggtggactcctgcggaccttgca

SEQ ID NO: 1297 - DNA, 68 bp, Foot-and-mouth disease virus C
cctgtacacttgttgtttcagccttgtgggacgcggtgtacgcgtagtcagcggccgagatgtacggg

SEQ ID NO: 1298 - DNA, 74 bp, Foot-and-mouth disease virus C
cgccgtcgtgtagcgtgaattccatttttcctgcagtccgtgataggaaaagtgctattacctctttgatggcg

SEQ ID NO: 1299 - DNA, 130 bp, Foot-and-mouth disease virus C
cgtcgatgtcaaagtgaaacctccggttcagagcatcaggacacaccatggtcttcggggtgaagcccgagtacaggttggtggttgcaatgatgaccttactgctgaagggtttgcctttgtcctcaag

SEQ ID NO: 1300 - DNA, 55 bp, Foot-and-mouth disease virus C
ctgaggcgatccatgccttaatccagtcgcggatggcaaggatcagcttgaccag

SEQ ID NO: 1301 - DNA, 86 bp, Foot-and-mouth disease virus C
gacaatgcgagtcttgccggcacgtactttctccatcgggcgaatttcgtccttcaggaaggtctggcaagcaaacttgtattctc

SEQ ID NO: 1302 - DNA, 65 bp, Foot-and-mouth disease virus C
gccaacacacggtgtggcgcggtgtatgggagagccagtcgagtcaccgggcccttgtggtaggc

SEQ ID NO: 1303 - DNA, 110 bp, Foot-and-mouth disease virus O
gaacagttggaggatggcgttcagccaacagttgtcgtggttgttgggtctggagtagaagaccttcttttcaccgttgtaaagtgtgaattccatcttcccttgtgttc

SEQ ID NO: 1304 - DNA, 65 bp, Foot-and-mouth disease virus O
gtgttcactagagtcttcagaatccactcggcgttcgggtggaatccgaactccgtgcggaacac

SEQ ID NO: 1305 - DNA, 83 bp, Foot-and-mouth disease virus O
tgtcaaggctctgccgtccaacatgatcttgtcgtacttttccgcgaagagatgacgaggcacgaggtaggcagtgccgaaca

SEQ ID NO: 1306 - DNA, 69 bp, Melanoplus sanguinipes entomopoxvirus
gaatttggaatccaacattgatatatattggaattagtattataagatataattaatgtttccaaattt

SEQ ID NO: 1307 - DNA, 130 bp, Melanoplus sanguinipes entomopoxvirus
ttagcatcaataaatttattacatgtaatacatctaactttaaaatatctttctatacattcaacacaatgtctatatccagattgacagtcaatgtattttttacatgttttacatttaaatgttaaaa

SEQ ID NO: 1308 - DNA, 67 bp, Garlic latent virus
atcttacagcccagatgcgttttaatatatttgtaatcatttattagagatctgggtagaccaagat

SEQ ID NO: 1309 - DNA, 95 bp, Garlic latent virus
gtgcgatttcgaaggccatgatgtattgatcttgggaggcatcaaaagcttcacagtcagactcagtgcagatcccatggaacttattgtcgcac

SEQ ID NO: 1310 - DNA, 111 bp, Garlic latent virus
tggcttttggagaacaccagaccaacgtcagccaaccagtcggaacaggatcgattagcgtgattctcaatgatggcggctgatttgctcacttttttttcctcaaaatca

SEQ ID NO: 1311 - DNA, 115 bp, Garlic latent virus
ttgtacttgtattctctcccttttagtagattacaaatgtccgattcataaccgaggaagacgtgcctatcgttcatactgtcataatcactgtggagtggatccccgagtatga

SEQ ID NO: 1312 - DNA, 83 bp, Myxoma virus
gagtcggttcactaacagcatgtaattgtccggtttaacctttttgaaatcgtataactgctgcaacaaagtgaaactatctc

SEQ ID NO: 1313 - DNA, 130 bp, Myxoma virus
ggaaaagtttagaaacttgtcgataaactccttgtccgcggaggtctttaatatggaaaactgaacattgttggagtccttccacgtaggggactttgtaacgtgtctgatatatgtcataaactcgtcc

SEQ ID NO: 1314 - DNA, 97 bp, Myxoma virus
tagatagtcgagcgacgataaagtgtacgtttacataccgccgatgttccggggtaagtacgtgactgtttaatcgaatggctcggcctataatctg

SEQ ID NO: 1315 - DNA, 91 bp, Garlic virus C
tctgggattcttgctaggcgtttgtgaacctggtccggatacaagtcccggtcttgatccctgggcagacgtggcctggttcaatccctga

SEQ ID NO: 1316 - DNA, 98 bp, Human adenovirus A
aggtggaaaaatttgtactactcttaaatcatagtaaatatttgtttcagaagcattgactgtatttttaacgttgtaaatagccgaattttccacct

SEQ ID NO: 1317 - DNA, 131 bp, Human adenovirus A
gcggtgagagcggcttgttctagcagtatttggttacgccgggctcgtaccccattcaccctggaaatcatgtggggtccggcgcttaaccaattcattttgctagaatagtcttgagccgcgccggccgc

SEQ ID NO: 1318 - DNA, 54 bp, Human adenovirus A
ggaacaggacaaatgcaatataaagttaatatagtatttccttgatctttttcc

SEQ ID NO: 1319 - DNA, 126 bp, Human adenovirus A
gtgaaattgctgtcagactgcggtccctgcatttcgaaggtaccaatgacttgactttcacttaatagttcagtattgcaaaccaaagaacggtggggggtgcaaagattgcagcggcagtgacac

SEQ ID NO: 1320 - DNA, 76 bp, Human adenovirus A
taattccataaacccagcctatgtagtttgtttctttagtataacaatctaaaaaattccatggtttatgtagttg

SEQ ID NO: 1321 - DNA, 131 bp, Human adenovirus A
ttactgtgcttactgtatgtgttaaactgtgttgagattgggatgtgggataatcacagagctcattaaaagggtaagtgtgattaaagcttttagtaatacctgaaacattaaagttagttataaagtag

SEQ ID NO: 1322 - DNA, 64 bp, sheeppox virus
taaagttaagtttaaatctggcaaatgttcgtaaaacggcaacagaatgtaaattccttcttta

SEQ ID NO: 1323 - DNA, 89 bp, sheeppox virus
tacgattcttttgtctgaatatttttaaccatgtacccgataaagctgagttcagttacgtaaataaaatctttaacaaaagattcgta

SEQ ID NO: 1324 - DNA, 63 bp, Variola virus
gcggatatcattagacaattgtagtatattctcacgtattacttgtttaatatctatatccgc

SEQ ID NO: 1325 - DNA, 101 bp, Fowlpox virus
tagtatcttagctgttaatgttgttttcttactaacggcatgatgtaaaggggataatcctttagaatcttgtacgttaacattagcaccgtgtaatatta

SEQ ID NO: 1326 - DNA, 63 bp, Garlic virus A
atcgtcgaagatcttgtaactaacagtggtagattgatcactgggtgtgacgcgaagttcaag

SEQ ID NO: 1327 - DNA, 131 bp, Garlic virus A
ctagtcgattgtgagtttgaatatagactgtcaactgtcctggtcaaatatgttagagccgcatggatttggcttaaggagttgttttgtgacggggagttgattggatttaaatttgttaaaatggagtc

SEQ ID NO: 1328 - DNA, 111 bp, Garlic virus A
tccaatcagtctctcagcatgcactttaatgggatttgctaaacgtttgggctgtctgtgagtggcgttgatgtagtagtcagtgtatggtgagaaatgggccacgttgga

SEQ ID NO: 1329 - DNA, 81 bp, Garlic virus A
tgagggctaggggtttctgaagtcgaagtttcggaggtttgagtcgtagcaaggcttggggcttcagattgttggttttcg

SEQ ID NO: 1330 - DNA, 118 bp, Macaca mulatta rhadinovirus
caccgtatagctgttgccgttggaggcctgcacggccagcggtaatatgttccgttgtaacgggagcatcaccgcggcgcatattgggtctctctcgggcaacggtctccaggcggtg

SEQ ID NO: 1331 - DNA, 115 bp, Bovine herpesvirus 1
gcgtcctcgatggtgagctcgaggatggggatggacacgatggagccttccggcggcggtgaagggggcgctgcatcggcctcatcagcgcctcgatagttttcgttgacgacgc

SEQ ID NO: 1332 - DNA, 55 bp, Fowlpox virus
agtctttcttctctaatttaatagtattctattagataagattcctgaactcact

SEQ ID NO: 1333 - DNA, 72 bp, Fowlpox virus
gccgtaatatcctagatacatggcataacagaatggagtaattcctttactgtcacgtatagaggcatcggc

SEQ ID NO: 1334 - DNA, 55 bp, Fowlpox virus
ggcagccaaatgcaagggtgtttgatttagattattacacgcatttatgttagct

SEQ ID NO: 1335 - DNA, 93 bp, Fowlpox virus
gtagtttttccataacgctattctatttttatcatatatgttgttataaactaatacttctgataccatggtagtgttatttaggctctctac

SEQ ID NO: 1336 - DNA, 66 bp, Fowlpox virus
tcgacattataggatagtaatagttttatagattctatgttccttcctctaaccgcatagtgcaga

SEQ ID NO: 1337 - DNA, 87 bp, Fowlpox virus
tgtgccagttcttagattctttgtagtattttacatgctttccattaacaatgaaataggatactataccataatctattaggtacg

SEQ ID NO: 1338 - DNA, 101 bp, Fowlpox virus
tgttatattttatttatgttctgaaaataatttataagctattaactaattgccttaatagatcataatcaggtttttcttcgtacgatagttttgtaaca

SEQ ID NO: 1339 - DNA, 91 bp, Fowlpox virus
ttctttttattatttagtagtatggtatatacatcgttaatatctctagtagttccgttaatagaattataccgtgttataatattaagaa

SEQ ID NO: 1340 - DNA, 130 bp, Triatoma virus
acacgatagacgtattcatctctaactatcttaccatccgaatccataacatcatcatacccaacaaagggatgaaatgtaatttggactcttccagaatgatagttagttttgacaaatctaaacgtat

SEQ ID NO: 1341 - DNA, 62 bp, Triatoma virus
caacgtactgtgggtctttgtgtatccttttcacaagattcacattttaccacaggtcgttg

SEQ ID NO: 1342 - DNA, 127 bp, Triatoma virus
cataagctggataaatcaaactcttctcgtcagaaacgtatcgccaagaatttctcttaatcaattcagaaaaagataagattctttcaccaatacattcttgagaaggctgttcatcaagttcatg

SEQ ID NO: 1343 - DNA, 127 bp, Triatoma virus
ctcgagtatttaaatctagaaaagtaattaggtatttttaaaacatactccagcgccacctcatcagaagatgttccggcaaaaggtgttttcaaaataacctcatttccatatttaagactcaaag

SEQ ID NO: 1344 - DNA, 99 bp, Triatoma virus
ctgtagcagaggatcccgtaaagttatctctaagagccgtagctgaaatagctaatggagctcccaagagaaatccaaaacggaaatcatcagcagcag

SEQ ID NO: 1345 - DNA, 105 bp, Triatoma virus
ggataagatagtgtacttttgcccacacccgtatctccagaaatataaatagtaactggaggattacgaatggtagactcagaaaaccctctattcttaaattcc

SEQ ID NO: 1346 - DNA, 67 bp, Triatoma virus
ggtgacataagtgcatcaggtaatttcaaggaaaagatttctttattttcaatatcacttgtgttcc

SEQ ID NO: 1347 - DNA, 85 bp, Triatoma virus
gtaggattccatatctcatctggagacagatcatctagtacaaaagccctagtatctgcccaatcatgaaatatagtagtcctac

SEQ ID NO: 1348 - DNA, 64 bp, Duck adenovirus 1
gaacaggtaatacctctgccggatatttcgttgtatctaacagtgctggaatattgccttgttc

SEQ ID NO: 1349 - DNA, 131 bp, Duck adenovirus 1
gaatgggtgtatgccatgttaggcattccagaggtgggcgccaaaggattgtaagctgtgccgcggtatggtttgaaagatggtcctctgtccaagatgccctggatgtcgaagtagctgctacccatatc

SEQ ID NO: 1350 - DNA, 70 bp, Duck adenovirus 1
gatgaagtttttgtgaccggtcagtggtaacaccgtttgtaggagccacatatggatcacgaaacttgtc

SEQ ID NO: 1351 - DNA, 98 bp, Duck adenovirus 1
tgtatcctgagtaaaagtgttagaatttgtaaatggagccagaaacagaattagaactcttgtatttgcagaaagtttgcttgttacattaggaggca

SEQ ID NO: 1352 - DNA, 111 bp, Human herpesvirus 6
ctgaggcagccgtagaggtattcaggatgtgagcatagtatcaaaagtgtgaattgcttgatgggtaattcgaacgctgtggaaacagtactgtcttcagaggctgtccag

SEQ ID NO: 1353 - DNA, 120 bp, Human herpesvirus 6
ggatcagaaataaagtcttgcagtttgatgttaatgaagtctgggatgtagagcctggaatctgaaacgaaggctgtccatttcgtatcgaatgaaagttttgttatatggttctgatcc

SEQ ID NO: 1354 - DNA, 80 bp, Human herpesvirus 6
ggtttacgtatttttggaggtagttggtatacgcgtttagtagaatgcttacgagaaggtttgtctccggggagtagatc

SEQ ID NO: 1355 - DNA, 115 bp, Human herpesvirus 6
gtagtcgatgtcgaatgtgcgtgctctgaggacagattggaagtctttatcgtggagtacgttttccaggtgtctcatgcaaagcaggtatgttttttcgatgatatcgatgtac

SEQ ID NO: 1356 - DNA, 76 bp, Human herpesvirus 6
gtttgttggaaggtatctttcataagtttggcgggttgccatagctgggtgtcgatacatatatttctcattaaat

SEQ ID NO: 1357 - DNA, 77 bp, Human herpesvirus 6
tatggtccagttgaaattagatttcattataggaaaagatttgagatcgtgaaataaagattgaaattgtgatcgta

SEQ ID NO: 1358 - DNA, 99 bp, Alcelaphine herpesvirus 1
gagtatgtgagttttgtgttgaggcaggccacttgcacttgcattgccttccaaatgcaggtgagagatagcctgctttaacacatatcccacaggttt

SEQ ID NO: 1359 - DNA, 87 bp, Alcelaphine herpesvirus 1
gcaagtctcttgcggaaaagctattttcaaatacattatttaattacaaacgtatttgaaacatagcttttccaacaagcaactagc

SEQ ID NO: 1360 - DNA, 84 bp, Alcelaphine herpesvirus 1
gcagatcttatgcttgtcagttaaagcccggaatgtttttttttaattaacaattcctgctgtaactgacacaacaaaatctgc

SEQ ID NO: 1361 - DNA, 70 bp, Alcelaphine herpesvirus 1
gtagctagggtggtgagtggcgctcgcagcagctagtgagctgctgagcaacactccctgccccagctac

SEQ ID NO: 1362 - DNA, 88 bp, Alcelaphine herpesvirus 1
tacccgctccgtggagtagtcagacgcgtcgtatctttaattttactgaaaataagactcgcctgaccactagcccggagtacaggta

SEQ ID NO: 1363 - DNA, 91 bp, Alcelaphine herpesvirus 1
tgcatgtctcttgctaggtagcctgtacaaaacagtccttttttaatgtaaaacagtgttttgtccagactagcctaacacgaaccaagca

SEQ ID NO: 1364 - DNA, 106 bp, Human herpesvirus 1
cgtctccccgggggaaaacaggatagcttccggagtctccatacgcacggtcaccccacgcacatgtgagacttcgggggcgctgggccaagacctcgggggggcg

SEQ ID NO: 1365 - DNA, 96 bp, Human herpesvirus 1
ggatccaaaggttgtgagctggcggcgagattgatgcccatcgctacgggggtatacagacggagccgttggtgataagatctcaaagccggatcc

SEQ ID NO: 1366 - DNA, 98 bp, Himetobi P virus
ctggatgactatcggcagacacttgtaccccagggtccactccaagtacatacttggagaagatcctgtaacacatagtataagtcgatttaatccag

SEQ ID NO: 1367 - DNA, 84 bp, Himetobi P virus
ggatttttcagtatttagggatatattcgatgagattccagttatatctttaatttctatcttatcttctaaataatcagatct

SEQ ID NO: 1368 - DNA, 86 bp, Himetobi P virus
ggttgcgaaaatagaccacaccaccctcatgctgttccttgaatttcttcaaagcagcaagaaagtgatgaggcattatcgcaatt

SEQ ID NO: 1369 - DNA, 90 bp, Himetobi P virus
tacacggcaacaaccacacgtccccacctatatcttccttcaattaaattgtaggcagagtagggggagatatatggtactcgcagtgta

SEQ ID NO: 1370 - DNA, 122 bp, Himetobi P virus
tgagattcacaaggatatccgatgctgctacctccaggccaagcatggtgtctgtatacaagctacaaacaccattacctatcctggaaacaacagaatcgatgtatccttttgtatcatca

SEQ ID NO: 1371 - DNA, 72 bp, Himetobi P virus
tggagaaggttgctgagtcgtaagagaacgttccatttgaaaaactcttatacggctcaccaagctcctcca

SEQ ID NO: 1372 - DNA, 129 bp, Himetobi P virus
ttccaagataatggagcccccaagtaaaacccgcaatcaaaatcatcagcagcagccatagcataagctgtagcgtactcactgatggttgtgatgcgtgcatacgttgtgggattcactagatcggaa

SEQ ID NO: 1373 - DNA, 93 bp, Himetobi P virus
ttgaattcgaataggaaaatgaatcaatgtaatttggtatgcgtttaacataatcaaatgacatttcatccatcttactaccagcgaaatcag

SEQ ID NO: 1374 - DNA, 80 bp, Cercopithecine herpesvirus 7
aatacaataacaaaacccccgcgtgtaagatatgtttggatatctccagttcttacatgcgaagagttgtattttgtatt

SEQ ID NO: 1375 - DNA, 69 bp, Cercopithecine herpesvirus 7
aatgctatctattgcatttaaagatccaagttctgttgaaaacgctctattaaaatgcaatggtgtatt

SEQ ID NO: 1376 - DNA, 65 bp, Cercopithecine herpesvirus 7
ttcatatgtaatatatatgccgtctaaacttccttttggtttgcaagttatattataattttgaa

SEQ ID NO: 1377 - DNA, 120 bp, Wheat streak mosaic virus
agcggtgtcacagacttttcagctaagaaatccatgacctcaatagttatcggtgtgaaataattctcacctttccctccaaggttatggaatcccacaacttttaggtctgctactgct

SEQ ID NO: 1378 - DNA, 94 bp, Wheat streak mosaic virus
cgcactcagtcgtgcctgtgcaaacagcttgttctgtattccgcgtagcctgtttactgcaacgctgttctgcacttgcacaaaatttggtgtg

SEQ ID NO: 1379 - DNA, 72 bp, Wheat streak mosaic virus
gagggcttgctgtgtttgcatgtcgccattaactgtgttgttcgtggctgttaacttgatgagcttgccctc

SEQ ID NO: 1380 - DNA, 65 bp, Wheat streak mosaic virus
gcactgtgttgactctgatggtatgcattcctgattgctttataccatatggtgttggcacgtgc

SEQ ID NO: 1381 - DNA, 100 bp, Cowpea aphid-borne mosaic virus
acatgagagagaaattgcccagcacttggtagatcttttgatcctttaatgaaaagatcatacatccggcaaatggtttgctcatctttctctcttttgt

SEQ ID NO: 1382 - DNA, 116 bp, Cowpea aphid-borne mosaic virus
atggttgtggaggttggttcatagcttgttgacacttcaaaatcaactgtgagtttcttgcactcttcaatatcattgagatcatccaggccctgaacgcgaacttcctcagccat

SEQ ID NO: 1383 - DNA, 116 bp, Cowpea aphid-borne mosaic virus
gtattaggacagttcaacagtaatgagtggagtggttctgctgcctctgaaattaatcccagttgctcaagcagaacgtctgttaccactaacttctttgttaactgctctaatat

SEQ ID NO: 1384 - DNA, 58 bp, Perina nuda picorna-like virus
accccgttgcttaaatacttttgttgaaacaaatcatcaaaagtaggaagctcggggt

SEQ ID NO: 1385 - DNA, 93 bp, Perina nuda picorna-like virus
atcgttggtgctgcagtctgcataactcgtagttgattctctacaaaaatagagacataaccgtaagccatgcaaactgcattaatcgatggt

SEQ ID NO: 1386 - DNA, 86 bp, Perina nuda picorna-like virus
gaacgaaagactttaatggtgtgacatcaaacgagtacaataaagtacccgaagcggcgtcactagtccattgaaagtaatcgctc

SEQ ID NO: 1387 - DNA, 126 bp, Perina nuda picorna-like virus
gactgtgcagctgggatcctaaaaggctcagccaactccccatgtataatactcttttctagattgctctttccagagtatcttacaggttcaatagctttacccaatgggatcacaactgctgtc

SEQ ID NO: 1388 - DNA, 91 bp, Perina nuda picorna-like virus
gctcttgtggtaaagtaattgaccatgtttcttccagctggtaaagttatgaattggtagaccgcatagtcaaaccctttaacacaggagt

SEQ ID NO: 1389 - DNA, 117 bp, Perina nuda picorna-like virus
ggaccaagcgccattactgtgtagcgaaatgccaaactcgccaggcacccaagcaagatgctgaggtgccagaacgaaatttgagcaaagtcgaatacccaacaagcgcattgatcc

SEQ ID NO: 1390 - DNA, 60 bp, Perina nuda picorna-like virus
gtcaataggaataaattggcgttttaagaaacttgtaacaccagatttatccctattgac

SEQ ID NO: 1391 - DNA, 103 bp, Perina nuda picorna-like virus
ttctcaattgatatatctgtaaattgaactctttgtattggtactgcatcaaatgcaggtaccggcacatgaaaaacggtcacatttacataaatattgggaa

SEQ ID NO: 1392 - DNA, 100 bp, Perina nuda picorna-like virus
ttggtgtatttggtgcttccgtcttctgatcgtaatctctagcttgtgcctccacgcattctgctgaattacgaatcaagcgatatactttataggccaa

SEQ ID NO: 1393 - DNA, 65 bp, acute bee paralysis virus
ctaattgtttcactgtctcgtgtagtcatattttgtactgtctgaacaacagtccccacatttgg

SEQ ID NO: 1394 - DNA, 110 bp, acute bee paralysis virus
ctgagcataaccattatatgtactgatatccaaacaatctccagtggccttctgataggccttagaaatcactttggaccacttatcaaatacatattcctcatgcatag

SEQ ID NO: 1395 - DNA, 122 bp, acute bee paralysis virus
tcgaaattttgacgcaatggttagattatgtcaagaagcttataattataagccctccatctagtgagtttgtcttataatgtcttctcgaaccatagtgctcctattgctcggtttttcgg

SEQ ID NO: 1396 - DNA, 88 bp, acute bee paralysis virus
tctccgtatcattagttagatccaagatgtatttgtaattgttatcagaaggcgctttaattccatctaactgagtcaagtccgggga

SEQ ID NO: 1397 - DNA, 130 bp, acute bee paralysis virus
ttcacacctgaactcactttaacataatatttcatttccttaatctgttcccattgttcttcgtagtttagtgtggctagtttaaatgctaatgatgttattttaacagctattccttcatacgtgtata

SEQ ID NO: 1398 - DNA, 131 bp, Bean yellow mosaic virus
aacctctagaaccatatccctcttctttacaatgctgagaagttccttcgccacataatgaattgtatgttggcctttcaggtctctctttttggcctgtatgcgaggttttctaatggttcttttgtaat

SEQ ID NO: 1399 - DNA, 53 bp, Bean yellow mosaic virus
ctattatgacaaacttatactctttcatcattgctggattgtttgcataatag

SEQ ID NO: 1400 - DNA, 68 bp, Bean yellow mosaic virus
gaccccacacaaaattggcatttttgtccagctggttgtcacacattaaatccaaattaacgtgggtc

SEQ ID NO: 1401 - DNA, 69 bp, Bean yellow mosaic virus
tggtgatttaggtctgttggtctattgtcaatgaatgtttgattatatcccttccagaataagtcacca

SEQ ID NO: 1402 - DNA, 61 bp, Ryegrass mosaic virus
agcttgcgacgtacactagaatgttattgccatactgtatgatatcgtacgtcgacttgct

SEQ ID NO: 1403 - DNA, 74 bp, Ryegrass mosaic virus
ggtctactcggacggctctgtcgcagttcaccatcgtgcgtcgggaatcctgcgatgttgttgctaagtcgacc

SEQ ID NO: 1404 - DNA, 129 bp, Ryegrass mosaic virus
gtcatacttaggtatatacaatgctaccttgtcgtacatcaattcctcaaatttctcgttggtcttctgcgctgtttgtttattcttgactaggtatgtgtgaagggttgtcattgtgctaagtaagat

SEQ ID NO: 1405 - DNA, 87 bp, Ryegrass mosaic virus
gttcgtggcgactatgaaatgcttaacttgagcggttccgtgtagctcaattccgtgtgtgttaagtttcatagttcgtccatcaac

SEQ ID NO: 1406 - DNA, 110 bp, Hepatitis GB virus A
accatcaagccacaatcagtaactgagtcaaagttgccagagtatccggtggaaagcgcgtctgtggcacaaacgcacacatcaccggctggaatttctgtttccctgcc

SEQ ID NO: 1407 - DNA, 55 bp, Hepatitis GB virus A
caggcgaaccttttggtagaacacgcaccaggtgcgataccacctaagcttcacc

SEQ ID NO: 1408 - DNA, 76 bp, Hepatitis GB virus A
cagttgtcgaagatgccaccctgtgcctcgcccaccactaaaagtagtaggaaagccattaggaggcgttgctcca

SEQ ID NO: 1409 - DNA, 87 bp, Hepatitis GB virus A
cgtcactagcggccgcgaagattgcagcttccacctgcatgtcatgttcgtcgattgacgaatcaaagcaagtggcatccacagtta

SEQ ID NO: 1410 - DNA, 81 bp, Clover yellow vein virus
catcatttgtcaggctaccatatcttaaaagcacctcatttatcttccttatgtggttaaatggagtctctgtaagtgatg

SEQ ID NO: 1411 - DNA, 72 bp, Clover yellow vein virus
gcgtctctttcgaaccatatggttaacaattatgtgcatgccataagttgagccatattttgagaaagttgc

SEQ ID NO: 1412 - DNA, 62 bp, Clover yellow vein virus
tatggtgcttggtcaagaacccataaataaaacctgcgtatgtgattgagcaagtcatcata

SEQ ID NO: 1413 - DNA, 60 bp, Clover yellow vein virus
tcatagttcaagcccaactctttgaaaagtgtagaaagttggtctagataccactcatga

SEQ ID NO: 1414 - DNA, 65 bp, Clover yellow vein virus
tgaacttacttaggtcattcctttggatggaatcagttctgtttcgaatgtacctagtaatttca

SEQ ID NO: 1415 - DNA, 88 bp, Clover yellow vein virus
tgttatgtcatcattattaaagtggcagtttggaactgttttagtttgcaacacaagtccactgtgcccctctcttaatgtgctaaca

SEQ ID NO: 1416 - DNA, 72 bp, Clover yellow vein virus
ttggtctcttgaggtataagtgctgtttgtcaagtaactccttgtcaaccatatcaagccttatgtcgccaa

SEQ ID NO: 1417 - DNA, 77 bp, Potato virus A
agtcgagattcgatccattcccttgagctttgacgaagtcctgaaaactcacttggtcctcaactcgaatctctact

SEQ ID NO: 1418 - DNA, 67 bp, Potato virus A
caatggtttcagtttccatcatgcttggtggtgtagttccagcaaatatgatggatgttaccagctg

SEQ ID NO: 1419 - DNA, 75 bp, Potato virus A
gtccagatcgaagtcgatggtcatgttcttctcctcgagagttggacctatgtcatctagactttgaaactgaac

SEQ ID NO: 1420 - DNA, 74 bp, Potato virus A
gttggttcaagcagtagaacggttcctttcttactgagatggtagggtagccctgttgatttgccagaaccaac

SEQ ID NO: 1421 - DNA, 81 bp, Potato virus A
gtttcaattggtgcagctgtgaatgttcgagtcttgttcagatcaactttttcctttggtcgcagctctgctttgagagac

SEQ ID NO: 1422 - DNA, 63 bp, Potato virus A
ttccaaaagtatgtgttttcctttggtattatatgggatgtttctgacaccatacttgaggaa

SEQ ID NO: 1423 - DNA, 123 bp, Potato virus A
ttgagtatttaaactgaatttgggtgtttgattgaacttgttcaagttttgattgtgtttaaaatgttgtgaactgcttgaagatttagaagattgattgctctaattcgtttgatttcttga

SEQ ID NO: 1424 - DNA, 111 bp, Bean common mosaic necrosis virus
acctttccttgtcaaatgagtccatgtcctggaagtagtcctgcttcttccctttatactgagcaccaaccgctgctttcatgttcaatgagtcatagatatcgtcagggt

SEQ ID NO: 1425 - DNA, 99 bp, Bean common mosaic necrosis virus
gaatctattgagtcctctcattctcagtgttacggcatgaaagaatgggtcccttccaagctgcttgctaacattttcagcaagaggacgtgtgggttc

SEQ ID NO: 1426 - DNA, 69 bp, Bean common mosaic necrosis virus
gccctgtgagtgaggagctaattgtgtcaaaatgatttttcttcatgatttcctcacttattaagtggt

SEQ ID NO: 1427 - DNA, 127 bp, Bean common mosaic necrosis virus
gctttgccttgtagacgaacagtgttcaacactccaagatcctcatagttttgcagattattgagatcgactgtattactattaaattcaaggagttgcgctcgtgcctgttgcaagattgcaatgt

SEQ ID NO: 1428 - DNA, 61 bp, Bean common mosaic necrosis virus
gtttagcataactggtttgttatacttgaagaaatctttcttaaaagcctctttgttgagc

SEQ ID NO: 1429 - DNA, 62 bp, Pepper mottle virus
aagataggctatcttcaaccactaatttcactgggaattgtgttgtgaactctacctctctt

SEQ ID NO: 1430 - DNA, 131 bp, Pepper mottle virus
ctcaaatgtatgcattgtgcgaacttgtggtattgtacaatttttaatcatgcttgtggagacgccactagacatgactggtaaattgtacgcaaagcaatacagagcagcttcagttgatatcatttgag

SEQ ID NO: 1431 - DNA, 109 bp, Pepper mottle virus
gatgactcacttcagacattttcgcggtgaaccacgtatacaatagccatgcaccaccacatgcaacaccggccgcaatgatcgcatcgcgaacaatgagtgatttatt

SEQ ID NO: 1432 - DNA, 110 bp, Pepper mottle virus
tactaagcaatactttcgcactaggaaatttgcgcatgagtgatcctacaaaataggttgaaatgcccaaacaccttgcgtcaataaaattcttagttccttgcttggtg

SEQ ID NO: 1433 - DNA, 60 bp, Pepper mottle virus
tccgatcttcatatgccaaataaccttttgatgggtctatttgttggaagaagttcagga

SEQ ID NO: 1434 - DNA, 55 bp, Pepper mottle virus
ttctgatttattcctcgtccgagatgagaaatcataattgagccctaaatcagaa

SEQ ID NO: 1435 - DNA, 71 bp, Equine herpesvirus 2
atggagactgatagtttaggcacttgaattctgcctaggtcatgaaaaggtgcttaaactatcgcttccgt

SEQ ID NO: 1436 - DNA, 85 bp, Equine herpesvirus 2
caggacttcaagtgctgtgttagtagcctagaggcgtttctgttaaaccagctcctaggcaactacacagctgcatggtgtcttg

SEQ ID NO: 1437 - DNA, 122 bp, Equine herpesvirus 2
cccccatcgtcctccagcagaggcgccgcgtgctgttctgtagtgaaattatgctggttatgtaatgcaaaatttcactacagcagcgcatcggcgccttatgaacacttggaagatggggg

SEQ ID NO: 1438 - DNA, 75 bp, Equine herpesvirus 2
ccccgtggcagagttctctgccagaaccaggatggtaaaaaaaaaccctggctctgcagcgaactctacccgggg

SEQ ID NO: 1439 - DNA, 88 bp, Equine herpesvirus 2
cctaggccccgagtggggtggttgggaaggcagttttgtatctctggcaaaaaagctggcttcccaaacactctgtttggtgtcttgg

SEQ ID NO: 1440 - DNA, 131 bp, Equine herpesvirus 2
cggttggtgggtgtgtgtgtccaaactataagccccgagtggagtgaatgagaaggcagttttgtgtatcagaaaagaaagctgccttctcagactccgctcggtgctctggaccaccacacccaccagag

SEQ ID NO: 1441 - DNA, 85 bp, Equine herpesvirus 2
gaaaaccccgcttcggagatttctctagtacttaggttcgtgtaattgattcctaatacttcagaagtctccggacggtgttttc

SEQ ID NO: 1442 - DNA, 108 bp, Equine herpesvirus 2
gagagctgcgtaatctgcagatactgtgtagaagagattgggaacttctgtcgttaaccctaagcaccgaagtttcggtctcttctgcatgctatctggcgggctctt

SEQ ID NO: 1443 - DNA, 130 bp, Equine herpesvirus 2
gaggtctagggtctgcagaatgccagagccccgagtgtaaggtttacgaggaacgtggttttgtttctaaaacacctagctcctcgtggatctttaaacggcgcctggcaaaatccacgagcagactctc

SEQ ID NO: 1444 - DNA, 83 bp, Equine herpesvirus 2
gcgaaacactgaatcaagatctcacctcactgtagttgtgcctgtgacaatccagtgctgtgagatcttgtgcagtgttttgt

SEQ ID NO: 1445 - DNA, 84 bp, Equine herpesvirus 2
gcgggataccgcgtaagatagaaagggttggctatgtgtctctggtaaacatagttacactttcctatcttcgcggtgttttgt

SEQ ID NO: 1446 - DNA, 70 bp, Equine herpesvirus 2
gcgtgagatattagggaacctggaccgctgtgtaagaaaagaccagttcaggtactctagtgtctcccgc

SEQ ID NO: 1447 - DNA, 83 bp, Equine herpesvirus 2
ggtatcgggtttcactatcccgtccacagttccttgtagatacatcttctcctgcttgttaacgctttttgaaagccgatacc

SEQ ID NO: 1448 - DNA, 96 bp, Equine herpesvirus 2
ggtggggggttcagagtgaacgaggagaggtattgcagtgattctctgtgagatatttcaacaccacccctcgttcagtccgagttcccaaacacc

SEQ ID NO: 1449 - DNA, 72 bp, Equine herpesvirus 2
gtatataccacacacccgtatagattgtgtttattttgctacacctaatcagtacggatgtgtggtgtctat

SEQ ID NO: 1450 - DNA, 84 bp, Equine herpesvirus 2
gtcacacccgaggtagtgatctgctgaaggctggggtgctcttgaggacctagctttggtcagaccattactgctcgtgtggac

SEQ ID NO: 1451 - DNA, 87 bp, Equine herpesvirus 2
tcaaaatcctgtgaatcgtccgagtggagtcagttgtgtgtaagccatactcacctggatcaaccctgacgatgcacagtgttttga

SEQ ID NO: 1452 - DNA, 70 bp, Equine herpesvirus 2
tggcttaagcagtctgtgacacttaagttttgtataaaaaataatttaagttcacagactcttaggacca

SEQ ID NO: 1453 - DNA, 83 bp, Equine herpesvirus 2
tgggcgtctgtgtagaggagaggaggacttgcgattagtcatggagtaatcgtaactacccctctcctccacaccgagtccca

SEQ ID NO: 1454 - DNA, 62 bp, Infectious flacherie virus
atgtcaattcattagctttcttgataatatcattaaccgtattcaaaagcgtaggattacgt

SEQ ID NO: 1455 - DNA, 74 bp, Infectious flacherie virus
cgaccagcctgcgcttgatttgaattaattttaagagtaatttccaagtcagttttcataagtgtaaacggtcg

SEQ ID NO: 1456 - DNA, 84 bp, Cocksfoot streak virus (CSV)
agatgtctgttatcaaccatttgttcgcgaatgtctgcgaagtgttccatgacaatcgttatatctgtttgaatgctctcatct

SEQ ID NO: 1457 - DNA, 66 bp, Cocksfoot streak virus (CSV)
caactgaagcgttctgagtgacgacagggagaccaaaggcgaaacaaaggaaagccgcttcagttg

SEQ ID NO: 1458 - DNA, 57 bp, Cocksfoot streak virus (CSV)
cgaccatcgattttgctgactgtgtaaccgcgttctatcagcagtttaccgagggcg

SEQ ID NO: 1459 - DNA, 62 bp, Cocksfoot streak virus (CSV)
ggctatgtatggggcttttccaatggaggccaaatgcttgaaaggctccattcctaatagcc

SEQ ID NO: 1460 - DNA, 106 bp, Cocksfoot streak virus (CSV)
gtcgattaaggatgtgattttgaaacgcactcgttggagggtctaaaccaactttgagcccagtttcatgacgtgtttcaaccttaaacacggacttccagttgac

SEQ ID NO: 1461 - DNA, 61 bp, Cocksfoot streak virus (CSV)
gtgttttagcttgatgcttgaccatcggatacgtcattaacatcgcagttgatttaagcgc

SEQ ID NO: 1462 - DNA, 59 bp, Cocksfoot streak virus (CSV)
gtttaaggaaaccttctccatcggacggatttctgctttcagagaggcgttccataaac

SEQ ID NO: 1463 - DNA, 89 bp, Cocksfoot streak virus (CSV)
ttaagtccaagtgctgttgaaagcttagaagaagtttgatgttgcacaatgttgagcacaccaaagttcctaagcatttctggatttga

SEQ ID NO: 1464 - DNA, 80 bp, Brome streak mosaic virus
agctcagtgatatcgtctcgctccatgaagtacaaccttattgttagaacagcattcatgagcaacggcgttattgagct

SEQ ID NO: 1465 - DNA, 95 bp, Brome streak mosaic virus
catgcgtgtccattagctgagacaacacaaatagcgttgatgggttacaaatcatatccacgagccattcgttgtcctggttaagtttttccatg

SEQ ID NO: 1466 - DNA, 121 bp, Brome streak mosaic virus
gaaagaaacgccatgaaacgtgcgcctccacaaaagtggcgaaacacgcgccctggaataacgcccgactttccattttgctgcgcttttgttacgctcgtttgatcaagtttgctctttc

SEQ ID NO: 1467 - DNA, 124 bp, Brome streak mosaic virus
gacgtagtgggactcttggtctgatgcgctttttcttctcgtagtcaacaaacactagcggaatggctttttctgcgcatatctgcgacgtttcggtcatcagatcgtagatttccactgtgtt

SEQ ID NO: 1468 - DNA, 68 bp, Brome streak mosaic virus
gttccacgagcgtcgtgaaggctttcgaaagttgattactttagaaggctttgtgtgagtttgtgagc

SEQ ID NO: 1469 - DNA, 130 bp, Brome streak mosaic virus
tccgaataagatgtcgatgggcgctgatgtgaatgttctcgtcttgttggctgcaaccttctcagctggacgtaactcagccttcaggagagctgaccacactccgtgcccatttgcacaaattttccca

SEQ ID NO: 1470 - DNA, 103 bp, Gallid herpesvirus 2
catattgatcgattagatcgagctttgaaaaggttaacatgtgtggccctatatttgccataatggtgaccattacatcggctggatccaatcgaacaacctg

SEQ ID NO: 1471 - DNA, 69 bp, Gallid herpesvirus 2
cattcaacagtttgcgagtccaactctttagtttcttcgactttagttaaaagcagtgctgcttgagtg

SEQ ID NO: 1472 - DNA, 91 bp, Gallid herpesvirus 2
gctcttctacgtgatcttttttcaattcttctgctatggacattatagtgtttacagatggaattataatagagaccccatattctagagc

SEQ ID NO: 1473 - DNA, 95 bp, Gallid herpesvirus 2
tggaatattatctttggatagttgtactgataagcaattcacaaacgctactgtggatatcgagtctgtcataacttcataaatagtcttgtcca

SEQ ID NO: 1474 - DNA, 97 bp, Plum pox virus
aggctgtaaaactgattattgaagtcatcaacgcacacttttccccccagaagggtatcaatcggtgctgctgtgaatgatcgagttttattagcct

SEQ ID NO: 1475 - DNA, 119 bp, Plum pox virus
gcctttcccttcacctttggcagagatagtttcgaagtcattgccttcaaacgtggcactgtaaaagttccagttgatcctgcatcgacatccctgtctctgtttgtgttgactagcgc

SEQ ID NO: 1476 - DNA, 82 bp, Plum pox virus
ggatcaacaaagcgaacaaagttgtagtctgtaggatcgtacccgtacatgttcacaaatttgcgtgttttcgttcccatcc

SEQ ID NO: 1477 - DNA, 79 bp, Plum pox virus
ggcgccaaagttgcggataagttcaggataacttggatcaatgttcaggttcttgaattctagcaactgagacttcgcc

SEQ ID NO: 1478 - DNA, 115 bp, Johnsongrass mosaic virus
aatgtgatatccagttgtaagtgagccaaaagtgtcaactacgtgcatagttttcgtgtcatgatccactaaaatttttggtatttccgcttgtaatgtttctggatagaatatt

SEQ ID NO: 1479 - DNA, 98 bp, Johnsongrass mosaic virus
cagttctccggtaatctcctcattaaggaatcccaacccttgtagaattttgagattcctactgtccagggtcctttgagatgattctggtagaactg

SEQ ID NO: 1480 - DNA, 79 bp, Johnsongrass mosaic virus
cctttgagaatgtttctaggtcctcgtcagttggttcttcgtacttgtctgctatcttgaggaccagcttctttacagg

SEQ ID NO: 1481 - DNA, 51 bp, Johnsongrass mosaic virus
gctgatatgctttggaaatgactatgcttaatctgttcctcttttatcagc

SEQ ID NO: 1482 - DNA, 64 bp, Alcelaphine herpesvirus 1
gtacaagtgcatgttaattagtttgtaaattcaatctgcattagtcgtcagctgtacattgtac

SEQ ID NO: 1483 - DNA, 82 bp, Alcelaphine herpesvirus 1
gtctagctgagccacgaggtcacagatcttagtgacgcatacgttgaggttagattcttccagggcctgaggttcaatagac

SEQ ID NO: 1484 - DNA, 75 bp, Alcelaphine herpesvirus 1
gtgtgcagcggcccactcctcatgtctgtaactgatgcctcctagtttcagatgagtaggagggctcctgtgtac

SEQ ID NO: 1485 - DNA, 60 bp, Alcelaphine herpesvirus 1
tgaaaatgcaacctacacatgtaaagtctctaggatgttattgttttggttggagtttca

SEQ ID NO: 1486 - DNA, 131 bp, Aphid lethal paralysis virus
cgtgtgagtcgattagtcgtttcagttcgggattcttgatgatagaaggcaaagtattactaatttgcttagtcatatcataaagatcggctgttttaaatccttgatagaaacgagtcaacagacacacg

SEQ ID NO: 1487 - DNA, 131 bp, Aphid lethal paralysis virus
gataatttattaatataaagcgtatttagatattgcaatgtctcactactgcctgactcagttatatcggcgtctgtagtgaaattgaatgcagtaacataaaatgcgaaaatcatatcaataaatgcgtt

SEQ ID NO: 1488 - DNA, 75 bp, Aphid lethal paralysis virus
gtaatttgtccgagatagcattagtcaaatctgcaaacatagttaaagatttgttaatagctagttctaagttat

SEQ ID NO: 1489 - DNA, 129 bp, Aphid lethal paralysis virus
tacaacgcgtaacaaagggtggacctaatagcccacagaaactgaaatcatcgcccacagctctataaaagagtgctttagtggtttcagcctctgtcaatatattgaccgatactaagttacgttgta

SEQ ID NO: 1490 - DNA, 89 bp, Aphid lethal paralysis virus
tgagatagtatcagacactgtggaagtggcacgtaattcattaagaatgagtacgtacaacctaccaacagagtgctgataatccttca

SEQ ID NO: 1491 - DNA, 67 bp, Aphid lethal paralysis virus
ttaggatctgcattgtctggtaatttatcatcatttgaatagtcaccaggaacaaataaaatcctaa

SEQ ID NO: 1492 - DNA, 131 bp, Aphid lethal paralysis virus
ttcgaaagttccttcaagatttcgtggcatatatacatcagcagctgttctagtctcatcgatgacagtattgtcttcttgaactggaccagcattagcttctgtagcgccattctctgggatcaatcgaa

SEQ ID NO: 1493 - DNA, 122 bp, Aphid lethal paralysis virus
tttgtgggtaattgtacaatggcaatgtctctacgaggatccttaacatggttttcttgttcaagaataaccgagcatgggatcaacggtgagatagcattactacaattctccaacacaaa

SEQ ID NO: 1494 - DNA, 127 bp, Potato virus V
acgatctcagtgtacaagttttgtaacatttgaaaaccaatatcccattcctccataaatgcatacctcacagctagaactgcattgatcagataaggtgtcaaagagctgtcgaactgagatccgt

SEQ ID NO: 1495 - DNA, 78 bp, Potato virus V
aggcatcaaactcctctgaacttgaatccacatttagatagagtttcttaagtgcaagctcagtaatgtatggtgcct

SEQ ID NO: 1496 - DNA, 79 bp, Potato virus V
tagtggttgcacttgcaatttcatcatgtttgagactttaaatgttccatggtgagatcgcactatgagtgttccatta

SEQ ID NO: 1497 - DNA, 80 bp, Potato virus V
tttgtgtggtatgcatgtatcagacttctaaaagccattgaagaggcgtccatgacatgacattcatcaattatcacaaa

SEQ ID NO: 1498 - DNA, 67 bp, Parsnip yellow fleck virus
gaagaattgaaaagagtcttgttttgggtttttcataaattttgtccaaggctcttctctcatcttt

SEQ ID NO: 1499 - DNA, 58 bp, Parsnip yellow fleck virus
gagagctttgaagagaaagatttgaagaatgaattctgtaatcgatgcaattgctttt

SEQ ID NO: 1500 - DNA, 71 bp, Parsnip yellow fleck virus
gtccttcactttaattaaaaagctcagttcgtatactaaccctattaactcagtttaaagccatgaagggc

SEQ ID NO: 1501 - DNA, 88 bp, Parsnip yellow fleck virus
gttgagtattaggattgtgccaaactgaaattgggctctgccatccatcgccaagagcctcctctttcaccacaaacctgtattcaat

SEQ ID NO: 1502 - DNA, 58 bp, Parsnip yellow fleck virus
ttgtgtgagttactatcatgcgcagaaaccgctttgtgtatcgacatgaactctatgg

SEQ ID NO: 1503 - DNA, 76 bp, Pea seed-borne mosaic virus
gatggattggtaagctatgtgtcttctcaatggtaaactgcccatgccttgacacaattcttgtttccccttcatt

SEQ ID NO: 1504 - DNA, 58 bp, Pea seed-borne mosaic virus
gtcactgaaatgcgccattatctgtctgaaagttggacgcgcattatccatcactggc

SEQ ID NO: 1505 - DNA, 104 bp, Pea seed-borne mosaic virus
ttgcgccattgttgtaaaaattgttctaacttttgataatgttgaaaatacagcatcactcctatcagagccaaacatcattgccaacaatgccatcaatgcaa

SEQ ID NO: 1506 - DNA, 54 bp, Ectromelia virus
aacatcaatgtcgcaatttgtattgtccaatacagaatgtcggtgattcgtgtt

SEQ ID NO: 1507 - DNA, 62 bp, Ectromelia virus
accattccaagtcactgtgtgtaagaagattatattctatcataagcttgactacatttggt

SEQ ID NO: 1508 - DNA, 83 bp, Ectromelia virus
ctccctgatctatgtatctagcggtgttattataaactctcaacattggaataataccattggatgcaccattggtcccggag

SEQ ID NO: 1509 - DNA, 91 bp, Cowpox virus
ctcgtttcataaagagatcaggaatccaaagagctataaatagatctctggttctatgctcctcgtttcctgtattctttttaagatcgag

SEQ ID NO: 1510 - DNA, 113 bp, Cowpox virus
gacatacatactatctttaatagaactcttttcatccagttgaatggattcgtccttaaccaactgattaatgagatcttctattttatcattttccagatgatatgtatgtc

SEQ ID NO: 1511 - DNA, 51 bp, Camelpox virus
gcgcaattcattttcgggtttaaattctttaatatcgacaatttcatacgc

SEQ ID NO: 1512 - DNA, 92 bp, Ectromelia virus
gctttccagacgactcgagcctttattatattcttgtatctcttttctctttcgtattgtgtatataatcgttcgaactcgtctccccaagc

SEQ ID NO: 1513 - DNA, 101 bp, Camelpox virus
gtggtaagaaccgataggttattgacattgtatggttttaaatattctataacttgagacttgatagatattaatgacgaattgaaaattatttttatcac

SEQ ID NO: 1514 - DNA, 103 bp, Ectromelia virus
gtgtagatttgatacggctattctggcggctagaatggcataatctggatgttgtgtagtacaagtggctgctatttctgctgccagagtgtccaattctacc

SEQ ID NO: 1515 - DNA, 102 bp, Ectromelia virus
tacaaaggagatgatttatcgatggtattaagaattcgtttttcgacatccgtcaaaaccaattcctttttgcctgtatcatccagttttccatcctttgta

SEQ ID NO: 1516 - DNA, 109 bp, Ectromelia virus
tcattaatagggacttgacgtacgtagcgtacaaaatgatcgttcctggtatatagataaagagtcctatatatttgaaaatcgttacggctcgattaaactttaatga

SEQ ID NO: 1517 - DNA, 60 bp, Ectromelia virus
tgatggctgatagtgtcactgcacaagatttccaatctttgacaattttcagcaccatta

SEQ ID NO: 1518 - DNA, 64 bp, Cowpox virus
aatggtagcgcatctttaactcgtcagttagctctttcttttgatcgagttcgtcgctactatt

SEQ ID NO: 1519 - DNA, 62 bp, Cowpox virus
gacttgatagatattagtgatgaattgaaaattatttttatcaccacgtgtgtttcaggatc

SEQ ID NO: 1520 - DNA, 79 bp, Cowpox virus
ggctattctggcggctaaaatggcataatctggatgttgtgtagtacaagtggctgctatttcggctgccagagtgtcc

SEQ ID NO: 1521 - DNA, 130 bp, Cowpox virus
gtgctgaggtctttcaacgatcttgttatttattttcaacaagtaagatttttccaaagttttaaaaccaaaatagttgtatgaaaagtctcgttcgtaaataataaccgagttgagtttatccttatat

SEQ ID NO: 1522 - DNA, 102 bp, Cowpox virus
tacaaaggagatgatttatcgatggtattaagaattcgtttttcgacatccgtcaaaaccaattcctttttgcctgtatcatccagtttgccatcctttgta

SEQ ID NO: 1523 - DNA, 116 bp, Cowpox virus
tcgcttctatcttgtttagatttatttttataaagtttagtctctccttccaacataataaacgtggaagtcatctgactagataaactatcagtaagttttatagagatagacga

SEQ ID NO: 1524 - DNA, 92 bp, Monkeypox virus
ggccatttttaatatttaagtgatacaaaactatctcgacttatttaactctttagtcgagatatatggacacagatagttatatgataacc

SEQ ID NO: 1525 - DNA, 102 bp, Monkeypox virus
tacaaaggagatgatttatcgatggtattaagaattcgtttttcgacatccgtcaaaaccaattcctttttgcctgtatcatccagtttgccattctttgta

SEQ ID NO: 1526 - DNA, 104 bp, Monkeypox virus
tatcttgtttagatttatttttataaagtttagtctctccttccaacataataaaagtggaagtcatctgactagataaactatcagtaagttttatagagata

SEQ ID NO: 1527 - DNA, 98 bp, Monkeypox virus
ttcactcgtttcataaagagatcaggaatccaaagagctataaatagatctcttgttctatgttcctcgtttcctgtattctttttaagatcgaggaa

SEQ ID NO: 1528 - DNA, 65 bp, Variola virus
caaacggagtaaaataaatatcattaatatatgctctagatattagtatttttattaatcctttg

SEQ ID NO: 1529 - DNA, 91 bp, Vaccinia virus
ctcgtttcataaagagatcaggaatccaaagagctataaatagatctctggttctatgttcctcgtttcctgtattctttttaagatcgag

SEQ ID NO: 1530 - DNA, 63 bp, Variola virus
ggacatgtaaacttgacaaaaattgtgactttgttattggtcaacctttgttgtacaaattcc

SEQ ID NO: 1531 - DNA, 93 bp, Variola virus
ggtctatgtctcttattagagatttcagcttctggaataggataataattaatatctataattttattgaggtttctgacaattactttgacc

SEQ ID NO: 1532 - DNA, 102 bp, Variola virus
tacaaaggagatgatttatcgacggtattaagaattcgtttttcaacatccgtcaaaaccaattcctttttgcctgtatcatccagtttgccattctttgta

SEQ ID NO: 1533 - DNA, 108 bp, Vaccinia virus
tctatcttgtttagatttatttttataaagtttagtctctccttccaacataataaaagtggaagtcatttgactagataaactatcagtaagttttatagagataga

SEQ ID NO: 1534 - DNA, 82 bp, Macaca mulatta rhadinovirus
atcgtaacgagacggaatccaaagaacacgcccgatcttaagaccacgggcacgtgtctttgggttccgggggcgttacgat

SEQ ID NO: 1535 - DNA, 121 bp, Macaca mulatta rhadinovirus
atgggattaaataccagggatacaggctgtaggttcggtaatgggtaccaggctggagtgactcataccatgggattaaataccagggatacaggctgtaggttcggtaatttaaacctat

SEQ ID NO: 1536 - DNA, 84 bp, Macaca mulatta rhadinovirus
ccgtttatcaaaatggaaaaattaaggctttgcgttaaaatctgctaacgcaaagggcacttaatttttccagtttggactcgg

SEQ ID NO: 1537 - DNA, 101 bp, Macaca mulatta rhadinovirus
gaagttacattccgacatacaagcggacccaaaaaaacaccccaacgcaaaacaactggagactgtgtctttgggtcccttccacgtcgcaatgagatttc

SEQ ID NO: 1538 - DNA, 123 bp, Macaca mulatta rhadinovirus
gaatacggccaacgcgccagcgtccaaccgccctccaaccgtgcagcgccgtatattcgaattgccttccgcacgaatacggggcgcagcatggtcgcgggaggctggcattgcgcaatattc

SEQ ID NO: 1539 - DNA, 107 bp, Macaca mulatta rhadinovirus
gacgccgttaataattggcagtaaactgcgaaagggcgtacatcgcagtagtgattttacgatgtgcacacctttccgcggttcaccgccaacaacaaaagcgggtc

SEQ ID NO: 1540 - DNA, 84 bp, Macaca mulatta rhadinovirus
ggcgggttcgacccattgaccgcatcctcggtggccgggcagaggccggccggccaaaggtgcgatcgcggggtctgacccacc

SEQ ID NO: 1541 - DNA, 81 bp, Macaca mulatta rhadinovirus
gggcgctgggggtgatatgttctgatgaccgccgccttacgtttgcagcggtgtcagcggaacatattctccccggctccc

SEQ ID NO: 1542 - DNA, 108 bp, Macaca mulatta rhadinovirus
taacggcgactttgggcagcgaatcagtgtctgtcgcaaaccctgttaaatttaaacacaacagggagcgcgactaaacacggactaactgctcatcgggccctgttg

SEQ ID NO: 1543 - DNA, 98 bp, Macaca mulatta rhadinovirus
tggtgttgcaatgcattagggaatctaaaaacgaaatcctgctcggtaacacggaaattgtctttagttccctacagcatcacaacaattgtaaacca

SEQ ID NO: 1544 - DNA, 77 bp, Bean common mosaic virus
agccgtgggacaaccttccctttggagcctgcgttcacatccttgtctctcattgttgaatctcctgcaccacggct

SEQ ID NO: 1545 - DNA, 58 bp, Bean common mosaic virus
caaatgctttgttttgttgtgctgacagaatcatgttgtgcattgttgacatcatttg

SEQ ID NO: 1546 - DNA, 65 bp, Bean common mosaic virus
cgatgaaataagcttgaattccaggtttgctcctgattagatttgcgtcaagttcgtcctcatcg

SEQ ID NO: 1547 - DNA, 61 bp, Bean common mosaic virus
gtgccaccaaaaagatctgaaatgagctttgagattttgaattcttcttttggttggtcac

SEQ ID NO: 1548 - DNA, 93 bp, Bean common mosaic virus
gtggaagatcaatgtatttaggatctccagatgtaccaaccacgaggtgtctcttagttggactcttgagttcagaatacattggtgttccat

SEQ ID NO: 1549 - DNA, 61 bp, Bean common mosaic virus
tctggctcgatccgatgttttggatgtcacctcatagaaatcaaaagcgtagcgagctaga

SEQ ID NO: 1550 - DNA, 50 bp, Human herpesvirus 5
cgttgaggtagaagacaaactcgcgtaaccgttgtccgttatacgtcacg

SEQ ID NO: 1551 - DNA, 58 bp, Human herpesvirus 5
ggattacagagtataacatagagtataatatagagtatacaatagtgacgtgggatcc

SEQ ID NO: 1552 - DNA, 65 bp, Human herpesvirus 5
tctggtatacacccgtctcgtggtacgaagtagagcgcggcaccaccggacggatgcagtccaga

SEQ ID NO: 1553 - DNA, 71 bp, Human herpesvirus 5
cagtgctccagcggcgtttcggtccacgtgtcctggagcagttgactgagattgagatcccgggagcgttg

SEQ ID NO: 1554 - DNA, 75 bp, Human herpesvirus 5
gccgtcgatatcggaactgacgaaagagctcatgtgccgcacgctgttcttgacgtagttttgaaactccacggc

SEQ ID NO: 1555 - DNA, 65 bp, Human herpesvirus 5
gcctgctgcgtctcatggatcagaagttgcggacccaaaatttggtccaagtggtttagcgaggc

SEQ ID NO: 1556 - DNA, 126 bp, Human herpesvirus 5
tgtaggcgctgctgcacttcgggtagctgcaggccgcctagcgcttccagctgagctagctgctcctgtaccaaggccagtgtcagcgccgagccgcggctgcccgggtcgcgcaccagcgtctcg

SEQ ID NO: 1557 - DNA, 75 bp, Rhopalosiphum padi virus
aaaggagccgtaattcctaatgagcagcatatagcgcggtgtgacgcggtgtgcgaagggattataggttctttt

SEQ ID NO: 1558 - DNA, 130 bp, Rhopalosiphum padi virus
atatttgagattaacttgtgctttttccatatgtaaagcgtaacaatggcattttgtataccatttcacgcacaaatcaacattcttatgcttgcattttttacaatttctacactcattatctaaacat

SEQ ID NO: 1559 - DNA, 130 bp, Rhopalosiphum padi virus
caaaattggtgttggctccaatttgccacagtgtttaatcaatgctaataactcaaccatatcaaatccttgtgataggcgagcacaaacacaaacacacggcatatcgtataccttcatcacattttcg

SEQ ID NO: 1560 - DNA, 130 bp, Rhopalosiphum padi virus
caacagcatggagcgcgtcaacgccagatttagcatatcctattaattgaccaacaccaggtattttggtgagtggttccatgatagtagaataagcttcagactggcgagtgacgaacccttgtttttg

SEQ ID NO: 1561 - DNA, 65 bp, Rhopalosiphum padi virus
cctgatactatttaacgtatctttaaataagggataaaccatattcaaaggtacaatagttcggg

SEQ ID NO: 1562 - DNA, 62 bp, Rhopalosiphum padi virus
gctgtcgttggtgttgttttttttcgtaatatgaaatataacgaaaaagcaccaattgcagc

SEQ ID NO: 1563 - DNA, 104 bp, Rhopalosiphum padi virus
gcttccggacaattcaatgattcaatctgtaaacgttgtaaattagaagtcaaacaaattaatttaggttctgcaaatgtgttgtttttgtccaacaaggaagc

SEQ ID NO: 1564 - DNA, 60 bp, Rhopalosiphum padi virus
ggcaatattttccgcaatctcatattagtgtcatcatcatgagattggtatcgtatagcc

SEQ ID NO: 1565 - DNA, 93 bp, Rhopalosiphum padi virus
gtacctattttgagtaggcggggttatggcactaaaacgcttaataagctgtctaaatgacgtaactttttcccccatcatcaacatagatgc

SEQ ID NO: 1566 - DNA, 131 bp, Rhopalosiphum padi virus
tagacatttcatcagaatcagtgcgaaagagagattggagatgttcaatttcattttggcttgttaaacccaaattagttgccatatccgaaccatctgaattacacatgaattttgatggggcttgttta

SEQ ID NO: 1567 - DNA, 70 bp, Saimiriine herpesvirus 2
aaattctgttgctactaagtgattcaacagaagagagtagcttgttgaatcagatgtgtttgcaggattt

SEQ ID NO: 1568 - DNA, 73 bp, Saimiriine herpesvirus 2
aagagagtcagtgcctggagttgttctttcaacaggatggttgaaaagggtgttgtcctctactgtctctgtt

SEQ ID NO: 1569 - DNA, 75 bp, Saimiriine herpesvirus 2
gattgcaagtatatatgcaggagctagcggaagcagactgtttatagcttctgacatatttgatatgatgtcttc

SEQ ID NO: 1570 - DNA, 65 bp, Saimiriine herpesvirus 2
gctggtgatatgtctgttttatcttgtttcatagtatgtaacaagtctgttaatacattattagc

SEQ ID NO: 1571 - DNA, 83 bp, Saimiriine herpesvirus 2
gctttaggtatgaaaaatgaaagcatgtttgcaagtttccaagaaaatttgtttgcatgactcaatgtttcactttctatagc

SEQ ID NO: 1572 - DNA, 60 bp, Saimiriine herpesvirus 2
ggctagatgtctgtttgagaatatttaaaaagtcagtgatattttgagctgactctagtt

SEQ ID NO: 1573 - DNA, 81 bp, Saimiriine herpesvirus 2
tcaagagtagatatagcattttgtaaaactgaaagatcatcagtggtgttagcggttttttctaagttgtaaaactgttgg

SEQ ID NO: 1574 - DNA, 129 bp, Saimiriine herpesvirus 2
tctagttgtatgaagcttatatctagcgtatcatcaatgtcatcatctgaatatgaccagtcgtgaatgttttcatcacctatcatgtatattgtttcttgatcactatgtgtagtttcagtatctagg

SEQ ID NO: 1575 - DNA, 131 bp, Ateline herpesvirus 3
agtagagatggttgttagtgtggttccacagagaatatccagagatgccaatatttgagaagattctgatatgttatctagcaaggctttcatttgttggagcttgaccttccaactatccttagtagcct

SEQ ID NO: 1576 - DNA, 131 bp, Ateline herpesvirus 3
atgttctgaaacaataatacttttagggtcatttgttttgttatgcactggggacaaaaaagtcttggtttttggtggctttggtgggtataacagtggtgtttctgcaatatgttttgtttcacttatgt

SEQ ID NO: 1577 - DNA, 109 bp, Ateline herpesvirus 3
gtgttgttttttgttgtatgtagctattagttcccataatatttcctgtttgtatgccatatgcgtacacagggtttgggttccctggctccaagaatgttgatggcac

SEQ ID NO: 1578 - DNA, 130 bp, Ateline herpesvirus 3
ttatgagtttaggccacatcgtaagtattatttgaatgagttttgtgtggtttacatatattggcactgtgtcgggatgcattgtttgtgggtgtaagtcattcataattatctttattatgtggcagta

SEQ ID NO: 1579 - DNA, 60 bp, Ateline herpesvirus 3
tttcagtaattatgaggttggttttaagaagagttttaagatcttttgtaggtattgaaa

SEQ ID NO: 1580 - DNA, 70 bp, Leek yellow stripe potyvirus
cctaatattcaaagtgtttataaggtggttgtaccacgctacaccagtaaataaaacttacgatattagg

SEQ ID NO: 1581 - DNA, 122 bp, Leek yellow stripe potyvirus
gattatatgatactgcaactggtgcgcctgtttgtctaagatctagcgtcctttctggaaagcccatcacgttatttgatctcccactcacccgcagtggattgtgcggagttaagtcaatc

SEQ ID NO: 1582 - DNA, 93 bp, Leek yellow stripe potyvirus
gttacgttcaatctgatttttccaccactgcgaaaatgtggcaccaggtattcgattaatggtgggatccgcatctgttaagttgaagtcaac

SEQ ID NO: 1583 - DNA, 67 bp, Leek yellow stripe potyvirus
tagtgagagcgtagttaaaagatgaacaggaactagatgtcacattagcgaaatatgctttcttctg

SEQ ID NO: 1584 - DNA, 124 bp, Human adenovirus E
agactgacacagtggccagtatttgactaccacatttagtcaagcaaagtgttagttttgcatcattttctgcgagtatttgacagtttggtgatggatcaggtgttgtccacaaagtgagttt

SEQ ID NO: 1585 - DNA, 91 bp, Human adenovirus E
agcctgaggcgctcggggaaaatgaggtcggccaggtccgaggcggtggtgcgctcgtcgaacccggtccacagacccttgagttcttctg

SEQ ID NO: 1586 - DNA, 107 bp, Human adenovirus E
agctcctcctcgtgctccgcgggcgtcacatagcccaggtcaatctcgatggattcctccatctcttgcatgtctgggacggccgcgtcggaggtggcggggctggg

SEQ ID NO: 1587 - DNA, 120 bp, Human adenovirus E
tctaaggtaagctttatgtttccatcagtatcaaatgtaagtggagagactaactgtactgccaaggcagagccacggagtcctaaacctgatccaaaacctaaagctagtgtgtttaga

SEQ ID NO: 1588 - DNA, 82 bp, Human adenovirus E
tggaacagccaggtgaggtacttcttgtggggcttacactggagctggagctcggtctcgttcccggtgaagaacaaagact

SEQ ID NO: 1589 - DNA, 71 bp, Taura syndrome virus
aaagtcctgatgggattccaccacagcagtcttagctctatagtcctgatgggattcaactacagcacttt

SEQ ID NO: 1590 - DNA, 53 bp, Taura syndrome virus
gacctgagcttttgcaattaagtccttaactgaattgcgtgcctccttgagtc

SEQ ID NO: 1591 - DNA, 96 bp, Taura syndrome virus
gataagtggattgagaacggaaatgacgattcggcctggggcacaatctgccgtgtacccaactttcgctggatcgtacactcgcatccacttatt

SEQ ID NO: 1592 - DNA, 93 bp, Taura syndrome virus
gcccgacacccaggaaacaggcttggcaattgtggatagaataggtactcctaccccatctactacatttgccaccgcaccaacggtgtctgc

SEQ ID NO: 1593 - DNA, 74 bp, Taura syndrome virus
tcatgaaactggttgcacaattctgcaaacgtggcttcacgtctgtatggaatgtgtgatttgtagcgtcgtga

SEQ ID NO: 1594 - DNA, 92 bp, Taura syndrome virus
ttgctgcgtctttcctggattctgatggagccatatcttctgttcacaagggaccttacgatgacccttagatccagctacgatgcgtgcaa

SEQ ID NO: 1595 - DNA, 109 bp, Chimpanzee cytomegalovirus
aacaagtgcgtactaatgggtctggtggtaactgtatctttatccggttgacaaactctagtgtaattggttatgtgggtggcatttaccgttagtataaagccttgtt

SEQ ID NO: 1596 - DNA, 61 bp, Chimpanzee cytomegalovirus
ccaccctccgccgccatgtgggtccgttcccgcgacgggatcctcatgtggctctgggtgg

SEQ ID NO: 1597 - DNA, 119 bp, Chimpanzee cytomegalovirus
cccctccccgtgtcattaaaacggtgtatgtacaggacaataaaatcacatcgggagactttttctgggacaaaatatatctttattatacatagacactgacgcgcgctagggagagg

SEQ ID NO: 1598 - DNA, 103 bp, Chimpanzee cytomegalovirus
ccgatatacgctttctctttctttattagtaggtagctgttagcaataaaatagaagtttgcatgcagtatcattgaactgaataatacctgcgtgtgtgtgg

SEQ ID NO: 1599 - DNA, 130 bp, Chimpanzee cytomegalovirus
cgagcgggacgcgggccgcgatgagcgaaccgccggcggcggtggcgccaggcatggacggtcgagcccccggccgtccctctgccttgtcgtcgttcggcgtcgctcgtcggctccgccgtccttctcg

SEQ ID NO: 1600 - DNA, 54 bp, Chimpanzee cytomegalovirus
cgccatgccctggtcgtgccggtgtttctcggccgtcatgaccgtcaatgagcg

SEQ ID NO: 1601 - DNA, 65 bp, Chimpanzee cytomegalovirus
cgcccaccgccatcccctgaggcgttcgtggtcgttgctgtgtgtctcatggcggtgtagcggcg

SEQ ID NO: 1602 - DNA, 129 bp, Chimpanzee cytomegalovirus
tcttgttcaattatcattctttttgctcatctccgtggcacccattacagcaacgttggactgccgaccccggcttttcatgatagtatgtgtatatatggttatagaaaaaagaaggtaaaatacaga

SEQ ID NO: 1603 - DNA, 92 bp, Fowl adenovirus D
cgacgtcgggatcgcccgtgagcatgaaacacaacataaaggggtgcatacgttttcctttattttcgaagacggtatacgtctcgatgtcg

SEQ ID NO: 1604 - DNA, 119 bp, Fowl adenovirus D
cgtctcggaaaagccgttcgatgagcgcgtccatctgcgacgccgacctgttggtctcctgagagtagcgggaaggagtctttttgttcggatcgggtgtgggcggagtttctgggacg

SEQ ID NO: 1605 - DNA, 98 bp, Fowl adenovirus D
ctctttttcgagcagctgatggaaccagttctcttcgggattgtagaaagcgagtctgagggactcgggttcctcgtagggcagttgggcgtagagag

SEQ ID NO: 1606 - DNA, 127 bp, Fowl adenovirus D
gtacgcggtgaaggtaagttgcttccaaaaggcgtgggtgttgctgggaatggtgggtcgcaggaaaatgttaaagtcgccgtgcatgccgagttcgtctttgaagtacttgtcgtaactgtcgtac

SEQ ID NO: 1607 - DNA, 91 bp, Fowl adenovirus D
tgttgggcgacgttggctatccgctctatgtcgttgagatcgctatctgagatggccattgggaagcaggaggcgaggacgttgtacagca

SEQ ID NO: 1608 - DNA, 70 bp, Bovine herpesvirus 4
aaagtgatatataggatgagttctttaattttcaaataaaatgatctgtctttatcttgtattttacttt

SEQ ID NO: 1609 - DNA, 84 bp, Bovine herpesvirus 4
ctggcacgtgattgaagctatctaatgtatctattagttcatctatttggagaaagatggatgcagagggtatagatgtggcag

SEQ ID NO: 1610 - DNA, 78 bp, Bovine herpesvirus 4
gaacatcatttttaaggagtgtgaaccatttctcttgtatagagatgaggtgcttctcattttctatgattgataatc

SEQ ID NO: 1611 - DNA, 70 bp, Bovine herpesvirus 4
gagtgtgttgaatgtctggttggggtaagggggtgtcttttgttctcagttttagggattcaatatattc

SEQ ID NO: 1612 - DNA, 63 bp, Bovine herpesvirus 4
gagtttggatgccagtttatcaatgtttgctaatgtatcattgggtggtggtatgccaaggtt

SEQ ID NO: 1613 - DNA, 72 bp, Bovine herpesvirus 4
gctgtgaatgctagcatgggtgtcatatcagcagtgggggtttggtgtgagaatatgctatatatttccagt

SEQ ID NO: 1614 - DNA, 130 bp, Bovine herpesvirus 4
gggcgaggtcaatattggcccccctaaggggttcataggagaatgctccatatctagatgttatgtagtgatgtgggttagtaaattctctgggaactatatataggaatgtaccagtgtattctgcacc

SEQ ID NO: 1615 - DNA, 131 bp, Bovine herpesvirus 4
ggtggtatatatattgacttgtgaatccatcctggggtggcagataagagttgatgacgtggttattgaggtcaagtgtcacaactataggtgttgttggggatggactctgtgtttgtgtaaatgctgtt

SEQ ID NO: 1616 - DNA, 130 bp, Bovine herpesvirus 4
gtatctgcaggtcagaattcagtagaagggttaaatcatgtgttgggatctctagtctttgtgcccaaaggataaagaattggaggagggtcttacattgagatattccatgaatggatttagaagatat

SEQ ID NO: 1617 - DNA, 52 bp, Bovine herpesvirus 4
tctgttgttacaattattgtatgtttgatcatatcaataaatgtaattaagg

SEQ ID NO: 1618 - DNA, 84 bp, Bovine herpesvirus 4
ttccagttgttgaaggctgtcttgattttcatccatgcattgtttgcattggcagttatttgggcatctatttgttttttggag

SEQ ID NO: 1619 - DNA, 67 bp, Bovine herpesvirus 4
ttgatgaggtctaggatgagattttcagaatttgtgagtttctggatactgtctctgagcctattaa

SEQ ID NO: 1620 - DNA, 131 bp, Bovine herpesvirus 4
ttggttatggtatcctctggagttggggggataaaaaaagaaagcacatgaatcagattccatgaaaatggaaattgataatagtttgatgtgatgatctctgagctttgctccatcatggccatatccag

SEQ ID NO: 1621 - DNA, 130 bp, Human herpesvirus 8
caaatttctataattggtgtcaccgcggcagctctagccctggaagatctggaagcttgcttcaatggctcagatcgacccggactacagttagcgaagtagacccattataatcttaatcttaaatctg

SEQ ID NO: 1622 - DNA, 116 bp, Human herpesvirus 8
gaaggagggttgaatacagttgggggtagtccgctggtattcccagctgaggttgccttatttggtaatgcttccggaaataccacctgagtaccccattggtttataccttgttt

SEQ ID NO: 1623 - DNA, 64 bp, Human herpesvirus 8
gcgggtctaagtgaagcaggtcgcgcaagaggtctctgcgacctgcacgaaacagacattccgc

SEQ ID NO: 1624 - DNA, 104 bp, Human herpesvirus 8
gggtcatcgtctggtgtattatctcctggtgggctactggcaatttgttcatgtgtgctaacaacagggtaatccacttccatttcgtcctcggatgacgaccc

SEQ ID NO: 1625 - DNA, 82 bp, Human herpesvirus 8
ggtagtataatcagctaggcctcagtattctatgtaacaaatgaatgccctagagtactgcggtttagctagttatactgcc

SEQ ID NO: 1626 - DNA, 105 bp, Human herpesvirus 8
ttgtttttgaacatgtggcacacgctgcaatgtactgccatgaaaggtggttctatatccaccacttggcgtctgccgaagtcagtgccacaatttcattaacaa

SEQ ID NO: 1627 - DNA, 74 bp, Cell fusing agent virus
accgtgccgctgccgtattttgagtgtgttcgtggaaacatggccacaatgttctgatatgccagtcgcatggt

SEQ ID NO: 1628 - DNA, 74 bp, Cell fusing agent virus
atacgcggtcgtaagttgcgattcttgaagagccgaataaaatgctttgtaatcgtcctgttgacccgccgtat

SEQ ID NO: 1629 - DNA, 70 bp, Cell fusing agent virus
tgtgagcggtatgtcgccaaccatctgttgtgtgtcactaacggagtggaagctagccgtaacgttcata

SEQ ID NO: 1630 - DNA, 79 bp, Dengue virus
agaacctgttgattcaacagcaccattccattttctggcgtcctgtgcctggaatgatgctgaggagacagcaggatct

SEQ ID NO: 1631 - DNA, 85 bp, Dengue virus
agccctgatagctggagtttggtatcttattggaagtcctctaagggcttcctccatttcagctgccacgactctagtgggggct

SEQ ID NO: 1632 - DNA, 97 bp, Dengue virus
cacactttgttccaaactgtcaacatgtcttccgtcgtcatccattcatggctggcgtgtatggaccaggttgtccggcttgttggaacccagtgtg

SEQ ID NO: 1633 - DNA, 84 bp, Human herpesvirus 8
acacaatggtgcggtagtggtttgcgatgtagtgctctgggctgatgtagtcatgtgggataaagtaaaggaagcacccggtgt

SEQ ID NO: 1634 - DNA, 84 bp, Human herpesvirus 8
acgggttgcgtgtcgggagggcgccggccttcgccctcagtccgggggggctggagcgccgtcctctcatatcgcgtgatcggt

SEQ ID NO: 1635 - DNA, 110 bp, Human herpesvirus 8
gccagcagtgtatccaagtttgtaaaatcgtatggcgagaccagggtgcccagcgattcctgactggcgctggcatacctgtccgcatccgtgcttgtggtcttgttggt

SEQ ID NO: 1636 - DNA, 81 bp, Human herpesvirus 8
gccccttcggatctgcggtgttccgggcagaccccgtccaggcacggggcccgctacggacaacgctaatcggatctgggc

SEQ ID NO: 1637 - DNA, 130 bp, Human herpesvirus 8
gtggacgttgggcacgttggtaaggtgatgctcagcagtggcagcgctctgtaggtatgcctgtagactttccaccgtttgcgttgtcacctgcgcctcaaccagggtcaggtgctccacgagcgtgcgc

SEQ ID NO: 1638 - DNA, 87 bp, Yellow fever virus
agtggttttgtgtttgtcatccaaaggtctgcttattcttgagcaaactgtgctcacagacctctggaggaaaagcagagaaccact

SEQ ID NO: 1639 - DNA, 84 bp, Yellow fever virus
atctcctctcccaacgataatgtagctgtctccaaaaggtgggttcacctcaatcagcacttcatcatcattggttgaggcgat

SEQ ID NO: 1640 - DNA, 70 bp, Yellow fever virus
gatgaccattcccgatgtcagtagtccagccagtataaacagcatgactattgtcattgcctcaggcatc

SEQ ID NO: 1641 - DNA, 94 bp, Yellow fever virus
tctcagcgatgtaactgttaccaaagtccaccgcagtttgcacctggcattccagtgtagcttttccatacccaatgaactcgacttcctggga

SEQ ID NO: 1642 - DNA, 123 bp, Molluscum contagiosum virus
cgcactgcatcggcgccacaagacacatggctgtttcttccgctgtcctccgttctgaagctaagatttcagttttggacactcgcgagcacgtacggcatggtctccaggctggtcagcgtg

SEQ ID NO: 1643 - DNA, 105 bp, Molluscum contagiosum virus
cgccgcgttcactagctcggacaggacattgcagcactcgcttgtcagcgggacgagcactgactcgcactggtagttctgcccgtagctacacatacgcgcgcg

SEQ ID NO: 1644 - DNA, 77 bp, Molluscum contagiosum virus
gcctcgtgctcctcgaacttggcagccgcggtcagcatgcgcgcgatgtccacggaaacaagagagttcacgagcgc

SEQ ID NO: 1645 - DNA, 109 bp, Molluscum contagiosum virus
gcttcgtccgctacgctgtgcacgcacgcggttgcgcctccgcgtacgaaacacaggtacgacaagtagcgcgcggccatgtgtacgcagtgccggatggcggggaagc

SEQ ID NO: 1646 - DNA, 125 bp, Molluscum contagiosum virus
gttgtgggcactttcacgttgagtagtagataacttttgtccgaggttcttccgtgcagcgtggagcgcagagaactcggaggaaagttcccagtgatccgaagctgagcgtcctggcccgcggc

SEQ ID NO: 1647 - DNA, 104 bp, Cercopithecine herpesvirus 7
aacaacgcgtaccttttccggtggacaaaagcgagtccaggcaaatatgtccttcttaatgggaaatatttcttcgccgttgtttacccgctgtctgtattgtt

SEQ ID NO: 1648 - DNA, 130 bp, Cercopithecine herpesvirus 7
atatttgaccgttcttccaattgtaaaaccgtttgtgagcaacttaaatcgcatgtatttaacatgttttgtatttgtaaatgttctccccaaccccactgtaatacagttaatattgatggcactatat

SEQ ID NO: 1649 - DNA, 55 bp, Cercopithecine herpesvirus 7
cgtttgtatacactaagacgttacatgttttttatgtcgtctatgtaagcgtgcg

SEQ ID NO: 1650 - DNA, 75 bp, Cercopithecine herpesvirus 7
tccctgcgcctgtctcgcgatgtccttacacccgtcgaacccgggtagcacgtattgccgatagtcccgtgggga

SEQ ID NO: 1651 - DNA, 103 bp, infectious spleen and kidney necrosis virus
cgtgtcgttgtgcaagtacaggccggcgcactgggcgtcgctcggcaccagcataaagtccaccgtgttcttgtgcaccggtttgtatttgataatctgcacg

SEQ ID NO: 1652 - DNA, 67 bp, infectious spleen and kidney necrosis virus
ggtcaagagactcttcagaacacagtgccaccaccatgtgcacagtgacctgcgggtcaggctgacc

SEQ ID NO: 1653 - DNA, 60 bp, infectious spleen and kidney necrosis virus
tggatgtcatggaccatcgtggctacggtgtcacagtggccagaatgtccatgacatccg

SEQ ID NO: 1654 - DNA, 103 bp, Human adenovirus D
ggactgttcgaggctgagacagcggtcgggcgaagaggccacggcgcttcggcgcagcatggcctcgtactcgaagctgtaaatctgcttgagccggcggtcc

SEQ ID NO: 1655 - DNA, 59 bp, Human adenovirus D
ggtgcctccaggtgtgtcaaagaaagccaaatctatgtcataatctttaggttgctgcc

SEQ ID NO: 1656 - DNA, 85 bp, Human adenovirus D
tcctcggtaattcggaacggggatgcgcaggcggcaagtgagagccatctctctgcaacagtatcacagcacacggattaaagga

SEQ ID NO: 1657 - DNA, 130 bp, Human adenovirus D
tctatggtcatggtctcggaaaagttgccctcgggcagggtaaactcaaaccactcatactctaagatatccttgcttaaatctgttgcttctaccccctgtgggtgttttctagccaccatcacccgcg

SEQ ID NO: 1658 - DNA, 61 bp, Tick-borne encephalitis virus
ctgctgagttaatggcaagcccgagcgtcctcaggtctcgtcggtggaagtagctcagcag

SEQ ID NO: 1659 - DNA, 72 bp, Tick-borne encephalitis virus
gagaagatgtcggaagtgctttcttttctcttcagtgagtcgaaagtgaccggccacctccggcatcttgtc

SEQ ID NO: 1660 - DNA, 86 bp, Tick-borne encephalitis virus
tctcgagctcagtcaagtgaaagttacccatcgcgtcctgccggacccgcaggctaacctctccaccctcattcactagttccgga

SEQ ID NO: 1661 - DNA, 52 bp, Viral hemorrhagic septicemia virus
agctgacctgttgtctttgggggcgttgtctagtctcttgtccaggtcagct

SEQ ID NO: 1662 - DNA, 131 bp, Viral hemorrhagic septicemia virus
cctcgggctccttgtggaccattgtggactcccctttctgaagaaggattccctgcgacctgacttgcctccgggtggcctcattctgaaaggggtattcccaccctttccacgtttgtctctgtgcgagg

SEQ ID NO: 1663 - DNA, 131 bp, Viral hemorrhagic septicemia virus
gatcgggttcaagggtctggcagatggccgtgagcaggagtgcttgtgccctttggttgatgattttgaagagggccaagtactccacatatgttactgcgccaagctttgcccccccaaggaactcattc

SEQ ID NO: 1664 - DNA, 88 bp, Viral hemorrhagic septicemia virus
gcctcggacctgtgtcaatgtggacatcctggaggatgatggcgtctgcgttgtgttcccagtctcctgattttagtcccctaagggc

SEQ ID NO: 1665 - DNA, 86 bp, Viral hemorrhagic septicemia virus
gctttgatcaaagagaaattcttataatcgtgccgtttttttctatctgtgttggttatgagacgggagtgccttttagtcagagt

SEQ ID NO: 1666 - DNA, 130 bp, Viral hemorrhagic septicemia virus
tggttccagtggagtgttgctgtctttcttcctcttctaattgtgtttaccctctgggcgaattgtcggggtccggtctcccggatggtgtgaacggaggtgaggttgcacacgttgtccattcttgcca

SEQ ID NO: 1667 - DNA, 83 bp, Vesicular stomatitis Indiana virus
gaatgccaggttgtagagttatggacagtggggcatatgtaattgctgcattttccgttgatgaactgtgaatcaacccattc

SEQ ID NO: 1668 - DNA, 77 bp, Vesicular stomatitis Indiana virus
gtacaggtttttccaggattcattgatggaagaccaatcgggattgggttcatcgattaatttcttcaaacctttac

SEQ ID NO: 1669 - DNA, 61 bp, Vesicular stomatitis Indiana virus
tcggcatgagtagattttctatacgccaagtctccatatagaaaacctatacatctgccga

SEQ ID NO: 1670 - DNA, 107 bp, Vesicular stomatitis Indiana virus
tgatatgattttcaaaatgagggaattgtgggactaaaggccttgattctcttgctaatttcatcagcttcaagttgcatatcggttccaccattttaatcaagtca

SEQ ID NO: 1671 - DNA, 87 bp, Vesicular stomatitis Indiana virus
tggcatcatgattatcagacattaaccaacttcccatccatttatgcatctgagatgttgagatgggattggcttgacatgatgtta

SEQ ID NO: 1672 - DNA, 87 bp, Vesicular stomatitis Indiana virus
tttcatagtctacagagaatatttgactctcgcctgattgtacaactttttgtatctcaggccgagcaggatggcctctttatgaga

SEQ ID NO: 1673 - DNA, 63 bp, Chimpanzee cytomegalovirus
cgtaggccacgcacgtgttcgacgtgtagcccagccccatgtcaacggtgttgatgttctgcg

SEQ ID NO: 1674 - DNA, 81 bp, Chimpanzee cytomegalovirus
ggaccctcgctgcggtcgcacgtcacgttgaaacgcaggacgcagtcctggtacagcgtgagcgacgacagcgtcaggtcc

SEQ ID NO: 1675 - DNA, 130 bp, Chimpanzee cytomegalovirus
ggtagttggcgttggtcacggtgctcttgaagagccgcagcgtctcctcgtagtcgggcggcggccgtagccgcacgtgctccatgatctgccaggcgcgcagctcgtggaagggccccggcgccagccc

SEQ ID NO: 1676 - DNA, 79 bp, Ectocarpus siliculosus virus
caaacgacgtcgtacggtaaatggcaagtgataccaccattccccacgttatttcttgccacatcacacgatttgtttg

SEQ ID NO: 1677 - DNA, 62 bp, Ectocarpus siliculosus virus
caagtggatggttctcgggtatttcgctgttcaagtcagatactcaagtaccaaacatgatg

SEQ ID NO: 1678 - DNA, 76 bp, Ectocarpus siliculosus virus
gtgagctacacacccttttgtcccgttgcagcacgataaatcgtattacgttgcagcacgatttagtgagctacgc

SEQ ID NO: 1679 - DNA, 73 bp, Ectocarpus siliculosus virus
gttgcagcacgatttagtgagctacaaacccttttgtccccttgcagcacgataaatcgtattacgttgcagc

SEQ ID NO: 1680 - DNA, 73 bp, Ectocarpus siliculosus virus
gttgcagcacgatttagtgagctacacacccttttgtccccttgcagcacgataaatcgtattacgttgcagc

SEQ ID NO: 1681 - DNA, 73 bp, Ectocarpus siliculosus virus
gttgcagcacgatttagtgagctacacacgcttttgtccccttgcagcacgataaatcgtattacgttgcagc

SEQ ID NO: 1682 - DNA, 130 bp, Ectocarpus siliculosus virus
gtttgtccccttgcagcacgataaatcgtattacgttgcagcacgatttagtgagctgcacacatttttgtccccttgcagcacgataaatcgtattacgttgcagcacgatttagtgagctgcacaccc

SEQ ID NO: 1683 - DNA, 94 bp, Ectocarpus siliculosus virus
taaatcgtattacgttgcagcacgatttagtgagctacacacccttttgtccccttgcagcacgataaatcgtattacgttgcagcacgattta

SEQ ID NO: 1684 - DNA, 94 bp, Ectocarpus siliculosus virus
taaatcgtattacgttgcagcacgatttagtgagctgcacaccctttcgtccccttgcagcacgataaatcgtattacgttgcagcacgatttg

SEQ ID NO: 1685 - DNA, 94 bp, Ectocarpus siliculosus virus
taaatcgtgttacgttgcagcacgatttagtgagctacacacccttttgtccccttgcagcacgataaatcgtgttacgttgcagcacgattta

SEQ ID NO: 1686 - DNA, 93 bp, Ectocarpus siliculosus virus
taaatcgtgttacgttgcagcacgatttagtgagctacacacctttttgtcctctgaagcacaataaatcgtgttacgttgcagcacgattta

SEQ ID NO: 1687 - DNA, 94 bp, Ectocarpus siliculosus virus
taaatcgtgttacgttgcagcacgatttagtgagctgcacatctttttgtccccttgcagcacgataaatcgtgttacgttgcagcacgattta

SEQ ID NO: 1688 - DNA, 74 bp, Ectocarpus siliculosus virus
tgagctacacacccttttgtccccttgcagcacgataaatcgtattacgttgcagcacgatttagtgagctacg

SEQ ID NO: 1689 - DNA, 113 bp, Ectocarpus siliculosus virus
tgcagcacaataaatcgtgttacgttgcagcacgatttagtgagctacacacccttttgtcctctgaagcacgataaatcgtgttacgttgcagcacgatttagtgagctgca

SEQ ID NO: 1690 - DNA, 114 bp, Ectocarpus siliculosus virus
tgcagcacgataaatcgtattacgttgcagcacgattaagtgagctgcacacatttttgtccccttgcagcacgataaatcgtattacgttgcagcacgatttagtgagctgca

SEQ ID NO: 1691 - DNA, 116 bp, Ectocarpus siliculosus virus
tgcagcacgataaatcgtattacgttgcagcacgatttagtgaactgcacacccttttgtccccctgcagcacgataaatcgtattacgttgcagcacgatttagtgagctatgca

SEQ ID NO: 1692 - DNA, 114 bp, Ectocarpus siliculosus virus
tgcagcacgataaatcgtattacgttgcagcacgatttagtgagctgcacacccttttgtccccctgcagcacaataaatcgtattacgttgcagcacgatttagtgagctgca

SEQ ID NO: 1693 - DNA, 115 bp, Ectocarpus siliculosus virus
tgttgagggaagaagcggggccgtggatttatgctgaaacgtaaactggaacgctgctgcaaagatgtcaaattttgaatttcgcactggatccaatctgtttgttcggtcaaca

SEQ ID NO: 1694 - DNA, 80 bp, Bovine adenovirus B
gagggagagtcagtggccgctaaacaaaaaacacaatcctgcttttttatgttctctttattaccgctgcgcgccccctc

SEQ ID NO: 1695 - DNA, 130 bp, Semliki forest virus
agcaactccacagccgtcctcatgtcaatggcttcctggattttcttctcccaacttttgtctctgcagtagatggtcacgtcagcgtccgtggcgtccattgctgtgaatagatggttgagggattgct

SEQ ID NO: 1696 - DNA, 122 bp, Semliki forest virus
atctaggaccgccgtagaggtgtataacaggtcctctcaatttcttaaacgccttaatgtccctcgccaaggtggtcatggctatgaggatacttttgcagccctctacctcatacctagat

SEQ ID NO: 1697 - DNA, 118 bp, Semliki forest virus
ggccctgcatacgccatcccctacagttccacgggcgttagctgcgttaaccacagccgcttctgtgcacgtggctatgtctgctctcttaactctgtaggatggtgcacacccggcc

SEQ ID NO: 1698 - DNA, 113 bp, Sindbis virus
aagtatcctttgtagctaagccttctacacggtcctgaggtgctaatcttgatgtcatccatggtgccttctttaacggtgtgatcctgcttaagcgacatgtagcggtactt

SEQ ID NO: 1699 - DNA, 81 bp, Sindbis virus
cgtggtgccagttatagaatccttcggggtgttcactggtgtaggtgaatgcctcacttctcatgttgactggcaactgtg

SEQ ID NO: 1700 - DNA, 56 bp, Sindbis virus
gatggtgtacacaggatggcgatggtagtaatgctgtactatttcgtgtggccatc

SEQ ID NO: 1701 - DNA, 67 bp, Sindbis virus
ggcgatgagatccttgctagtcaaggaggtagcttgaatgtctccaaacgctcctggtttcatcgct

SEQ ID NO: 1702 - DNA, 103 bp, Sindbis virus
gtcgtacactgtgcaaggaatttttttaccgtgaacgggaggtagatcatatttttcccgtcccacgaattttggttttatcttgcgggccagtgtacatgac

SEQ ID NO: 1703 - DNA, 67 bp, Molluscum contagiosum virus
cacggtgtgcaggcggcggccggagatatgcgtgacaaagtctatcccgtgcacgctggcgcatgtg

SEQ ID NO: 1704 - DNA, 80 bp, Molluscum contagiosum virus
gccgggcttgagcttgccggcctcgaagtagttgttctcgaccaggctcacgatgaggctggccagcacgccgtcgcggt

SEQ ID NO: 1705 - DNA, 111 bp, Rat cytomegalovirus
gcccttgaagatgcacacggcggatttgtcgtccggcgagatgtcgcacaccacgaacagcggctgctccgccacgatgtccgagatctgccggatcatcaccagcagggc

SEQ ID NO: 1706 - DNA, 66 bp, Rat cytomegalovirus
gtgtcccagccgctctttgctccgcgcgttgtacatcacgtcgcccagggagccccgctgggacgc

SEQ ID NO: 1707 - DNA, 66 bp, Myxoma virus
acgtcggttccagactgtattctgtgtatttaccaacccgggtcagtctggcccaagacacgacgt

SEQ ID NO: 1708 - DNA, 75 bp, Myxoma virus
agtacgggttgagagaaggcagataagagtacggacttcccacgacgaaccatatcattttcacgaccaggtatt

SEQ ID NO: 1709 - DNA, 58 bp, Myxoma virus
cgtacacaacgtgtttacggagtatgcgaaactgtgacttcgtacgcacgacgtgtcg

SEQ ID NO: 1710 - DNA, 89 bp, Rabies virus
actccctttggatgctctcttccctctactattggtaaaaatgtcacaagacatccctagtctcggattctcgggcatccaaatggtgt

SEQ ID NO: 1711 - DNA, 127 bp, Rabies virus
cccaacatctcagaagggtgaggaactgtcgtgcctaccacttttcttccccaagagatctccctaagtagatctgccctctctgaagagcaaggccacacccccccaaccctctgaggtgtctggg

SEQ ID NO: 1712 - DNA, 117 bp, Rabies virus
cccctgagatcaattcaagaggtctattaatattgatatttgtcattctcgtcaagaagcaaatcgaggatcctatcaatactccccttgcgagccctctcaaatagtctctagggg

SEQ ID NO: 1713 - DNA, 114 bp, Rabies virus
gagacacaatgttcctaattagagtttgagccaagttggaatctctagtaatgaaccagtttatagattcttttaacgatagagctctcttcaccacatgaacattagtgactt

SEQ ID NO: 1714 - DNA, 77 bp, Rabies virus
gattgtgttgtgtaggttccgatcgattgactcttctccagcatgtcatcaggaaaattatcaacatcaaggcagtc

SEQ ID NO: 1715 - DNA, 82 bp, Rabies virus
gcctttctgattgcatccttgagtagaatggtaggactggcccctcctctgatatttaaggtggtaggatcttctagaaggc

SEQ ID NO: 1716 - DNA, 83 bp, Rabies virus
gggttttgatataaggagtcaaggggtggtctcgggctaggaatcgtgaatccagataccacttggagtacttatcaaaaccc

SEQ ID NO: 1717 - DNA, 65 bp, Rabies virus
ggttggtgcatccttcgtcctccactaccaaattgtttgggcagctgaggtgatgtatgtcaatc

SEQ ID NO: 1718 - DNA, 89 bp, Rabies virus
ttttctgagggatagaaaatatctcttctctaaaagacggttctctgagcattatgtacaaggagggatggttatctagcctcaggaga

SEQ ID NO: 1719 - DNA, 58 bp, Human herpesvirus 3
actgtaaaaactgtcgttgccccggtttgaatataagcatctgtaattactttacggt

SEQ ID NO: 1720 - DNA, 72 bp, Human herpesvirus 3
cgtctggcataaccaagggccttgttacccaaatgggaacatttgtatgaccggtaataacagtatccaacg

SEQ ID NO: 1721 - DNA, 82 bp, Human herpesvirus 3
cgttattttaacattatcatgtaaaaacgttgcatttacattctcccatgttcctatattacattgtgaagttaaaaccgcg

SEQ ID NO: 1722 - DNA, 128 bp, Human herpesvirus 3
ctgtctttgtttttgcaacacaacatccaacgccgttttacgttcctgttgctttttttggagacggtttttcgtttccacaggcaataaaaaaaattcgggttcggaacaaagcatgtcaaccacag

SEQ ID NO: 1723 - DNA, 62 bp, Human herpesvirus 3
gggtgtgtacgggtaaaaggttctaatattgttataagagcagatagttttgtgcgatatcc

SEQ ID NO: 1724 - DNA, 89 bp, Human herpesvirus 3
tgtcggaatggaggtaatctcaagtattggtttactgaacgcttggtttaacgtttggttttgctgtggattatttttccaatccgaca

SEQ ID NO: 1725 - DNA, 76 bp, Human herpesvirus 3
ttatccaccctatctttataagtatgcagggggccggtaccgtctatacgcacacttagtggatgggagtcaataa

SEQ ID NO: 1726 - DNA, 70 bp, Human herpesvirus 3
tttaagccttgtttccaatcgtcttttaatcgaaggttgtaaaccggattggatcattggatcacttaaa

SEQ ID NO: 1727 - DNA, 94 bp, Cercopithecine herpesvirus 7
agatggaaatgaggtcaatatccccaaaagaggctccaataaggcagaaacaacgctctgggcgtctgtatgtgtgcgtgttccattttcaact

SEQ ID NO: 1728 - DNA, 75 bp, Cercopithecine herpesvirus 7
gctagcggtaataaatgttttggtgggttacttattacatattttttatcggaaggtttgagtgactgaaccagc

SEQ ID NO: 1729 - DNA, 50 bp, Cercopithecine herpesvirus 7
ggaggggtattggctaaaggtttgctagcaagcagcgccgatattttttc

SEQ ID NO: 1730 - DNA, 72 bp, Cercopithecine herpesvirus 7
ggattgtgccctaaaactgcattcagggctactaatgcacagttctcacatgcagatatagattggcgcgcc

SEQ ID NO: 1731 - DNA, 53 bp, Cercopithecine herpesvirus 7
tgttaatgctggaaccgacgatactaaagaggttgcacgttctaaaattgata

SEQ ID NO: 1732 - DNA, 126 bp, Cercopithecine herpesvirus 7
tgtttgttatattaactacagctgttttaaccgaagtgtagggcgacgtgttccaaggtataagaggatcactaaattttgctgatattttcacagttttccagtctgtataattaaaagcaaaca

SEQ ID NO: 1733 - DNA, 74 bp, Camelpox virus
acagatgatctgagtaatatacctctgttatatatttaatgttcacggtcttagtatttttagatatcaattgt

SEQ ID NO: 1734 - DNA, 114 bp, Camelpox virus
cgactccatcagaaagaggtttaatatttttgtgagaccatcgaagagagaaagagataaaactttttttacgactccatcagaaagaggtttaatatttttgtgagaccatcg

SEQ ID NO: 1735 - DNA, 58 bp, Camelpox virus
ctatcatggataatatttgtaatggttctttccgtacaacatactgtttagatgatag

SEQ ID NO: 1736 - DNA, 129 bp, Camelpox virus
cttttttacgactccatcagaaagaggtttaatatttttgtgagaccatcgaagagagaaagagataaaactttttttacgactccatcagaaagaggtttaatatttttgtgagaccatcgaagagag

SEQ ID NO: 1737 - DNA, 130 bp, Camelpox virus
ctttttttacgactccatcagaaagaggtttaatatttttgtgagaccatcgaagagagaaagagataaaactttttttacgactccatcagaaagaggtttaatatttttgtgagaccatcgaagagag

SEQ ID NO: 1738 - DNA, 77 bp, Camelpox virus
gcaaatcttatcattggtcggtgttttgtcttgctttgtgactttgataataacatcgattcccatatgatgtttgt

SEQ ID NO: 1739 - DNA, 72 bp, Camelpox virus
gtgtgcctgaatcgttcgattaaccctactcacccgaatctcggatgaatagagttatcgattcagacacac

SEQ ID NO: 1740 - DNA, 59 bp, Camelpox virus
tactgaaatctctctttgattgtagagtatatgcagtcagagcaagaaacactgcagta

SEQ ID NO: 1741 - DNA, 130 bp, Camelpox virus
ttagtatatcaaagaccttgttatcgattgatagtgaatgaatcagatagtggtgtagaggaatatgtcctttgttatccttgttatcaaagttattcacgccgttgtgtaacaatatctttaatacaga

SEQ ID NO: 1742 - DNA, 67 bp, Camelpox virus
ttatcgatgatgtagtggttatagtctctggaatcgtacgaagtaatactacgcattacgtcgataa

SEQ ID NO: 1743 - DNA, 126 bp, Camelpox virus
ttatgaatatataaagtagatggtgtccttcttccttttgtaatttcccgtatttttgttcgtgccaattgagtaacattatgagaatatgacctgttgcacaatcattctttatgtattccatga

SEQ ID NO: 1744 - DNA, 130 bp, Camelpox virus
ttttttacgactccatcagaaagaggtttaatatttttgtgagaccatcgaagagagaaagagataaaactttttttacgactccatcagaaagaggtttaatatttttgtgagaccatcgaagagagaa

SEQ ID NO: 1745 - DNA, 94 bp, Bovine viral diarrhea virus genotype 2 (BVDV-2)
acagctaaagtgcttagtgcattggaggtagtgttaaattagggtatctactatcactacattactatccaattacaataaatatcttagctgt

SEQ ID NO: 1746 - DNA, 64 bp, Bovine viral diarrhea virus genotype 2 (BVDV-2)
caccaaagttgcaaaagctgtttcatgccccagtctggctgccaagcttttgtagagtgctgtg

SEQ ID NO: 1747 - DNA, 83 bp, Bovine viral diarrhea virus genotype 2 (BVDV-2)
cttgagtgagggcacgacgctctggacggattcaccagcttccgctggccactgtcatcagcatcaccctcagtcttctcaag

SEQ ID NO: 1748 - DNA, 65 bp, Bovine viral diarrhea virus genotype 2 (BVDV-2)
gctctctggccccaataaccccatatatctgtctttcgatatggcatattggaagccctctttgc

SEQ ID NO: 1749 - DNA, 81 bp, Bovine viral diarrhea virus genotype 2 (BVDV-2)
ggattccatgagtacatcaaaaggaagctaaaggctacggccttctcataagctgtgctacccctctctccactggaatcc

SEQ ID NO: 1750 - DNA, 83 bp, Bovine viral diarrhea virus genotype 2 (BVDV-2)
tactactgctacagttatatcaatgctagcgggcagtaggaatcctgacgttcttatagctagcaatgatacaatcagtggta

SEQ ID NO: 1751 - DNA, 122 bp, Bovine viral diarrhea virus genotype 2 (BVDV-2)
taggggttcttccgcttggaaccaatctggtagttcctcctcaacctctggctccattaacctcctgatcattgctgttgtggttttcctcttaattggtttacctaagcttagggcttcta

SEQ ID NO: 1752 - DNA, 85 bp, Bovine viral diarrhea virus genotype 2 (BVDV-2)
tcatcagtcatcttattgttactatgacagacaaccctggtcctgcccatgctgtcacacactagtagatcctttccggctgtga

SEQ ID NO: 1753 - DNA, 58 bp, Rabbit fibroma virus
gatattccacgaagtcatcgacctccccggggtggttggtgtcgctgtacatgatatc

SEQ ID NO: 1754 - DNA, 116 bp, Rabbit fibroma virus
gtagaaaaacacggggaatatcgcgtctgtgatgacacgattgcttaattacatgccttgagtttaggcgtatgtatagaaaaggtgtcatcatcgagtagttcgccgttctttac

SEQ ID NO: 1755 - DNA, 129 bp, Rabbit fibroma virus
tagctgtagagaatatgtttacttctaccatgttagaggtgtagaaacacgtacccgttcattagaagcagacctactagaatcgcgtctacttatctccggtagaagtagaaaatagaaacgaggtta

SEQ ID NO: 1756 - DNA, 109 bp, Rabbit fibroma virus
tgatgtgagacgcacggtatctgtagatgtgactgtgaggaaccaaatgaaaaacagtcgctctttcatcttaatcattatcactctactctactctattactctttca

SEQ ID NO: 1757 - DNA, 130 bp, pestivirus type 1
acttcccctgatccatactgaatccctaaggccttctgttctgataagaccatgtatgtaaccagtaaccaaagtacatatctgccacccaagagggctactaccaccactaatatggactcagcgaagt

SEQ ID NO: 1758 - DNA, 82 bp, pestivirus type 1
tgtaggattaggtacattacactagctgtttccggtgcgaagtcggacagcaccactaaagaaagtagtagtacctccgaca

SEQ ID NO: 1759 - DNA, 90 bp, Cryphonectria hypovirus 1
accatatacgcgaatacaaaacctagtgcactacggtacatgatccccttgaggatcacggtcgtgcaattgtgattcgcgctgtaaggt

SEQ ID NO: 1760 - DNA, 62 bp, Cryphonectria hypovirus 1
agggatgccggccattccatgaagtgcaacaggagttgcactcatgaagatggttggtcctt

SEQ ID NO: 1761 - DNA, 82 bp, Cryphonectria hypovirus 1
attgtagcagcctaagatagtctgccacacgtacacaccaaccggtggtacgggcgacgcgccatcttgcgctgtctacaat

SEQ ID NO: 1762 - DNA, 130 bp, Cryphonectria hypovirus 1
catgaatagattatataatggccctatcaagaacagtgactgaataaacagctcgacccaatgcattgcgaaatacatggccgagatgatgacagtcatgccttggtagatgcgcaccttatctatcatg

SEQ ID NO: 1763 - DNA, 105 bp, Cryphonectria hypovirus 1
cgatggtgtttataccaggtagtcctttcccgggttccttgatgttggagacaaagttgtcataatcatcaaggaaattccctctgccctggtattccatcattg

SEQ ID NO: 1764 - DNA, 83 bp, Cryphonectria hypovirus 1
cggtggggatgtccttctcgttccagaacctcgcgtgctgtcggttggacaatagagaggttggaacggaggcatcgccatcg

SEQ ID NO: 1765 - DNA, 85 bp, Cryphonectria hypovirus 1
gacgtgactgagccttgccgggttggtcagagataaaatttatcgtcgtctctgaccgaacccagtctgcattagcagtcacgtt

SEQ ID NO: 1766 - DNA, 130 bp, Cryphonectria hypovirus 1
gcgtctcgtctattaacttggcccagttgccaggcttccaattcggcatgtccagaatcttagttcccttcggttctggtatgcgttccttttcgtcctggacaagctgggtgtaagccagttcgactac

SEQ ID NO: 1767 - DNA, 64 bp, Cryphonectria hypovirus 1
tcgtggtttccagcaacttgaggtatatgaatttctccacatactggttgtgagtgtgccacgg

SEQ ID NO: 1768 - DNA, 72 bp, Cryphonectria hypovirus 1
tcttgtacagtgcgggctggaatgccgtcacgagtgcgtgaccggcaccccgttcacacgaggtgtacagga

SEQ ID NO: 1769 - DNA, 102 bp, Fowlpox virus
agtttttaagtaagctacattagaagatgttttgtaaacattacgatagaaactcatactcgttactgtttctatatcttttattcttactctatgaagact

SEQ ID NO: 1770 - DNA, 103 bp, Fowlpox virus
cgctgcctttagaacatcataggatatagaatctattacaaaactttttcttggtttatttgtgttatattctatgatatagttctgtatcatattcaaagcg

SEQ ID NO: 1771 - DNA, 90 bp, Fowlpox virus
cttaatttcattaggtaaattgttccaagaggatgtattactgtcattatctagaaataaatcttctaatactttacttgctttattaag

SEQ ID NO: 1772 - DNA, 50 bp, Fowlpox virus
gataaaataacaattattatacttgatacgagtttgaattcttatttttc

SEQ ID NO: 1773 - DNA, 103 bp, Fowlpox virus
gcgtatttgcaattatttagataaggtaagttttctttatgtttatttatatcacatatatagcacttataattatcggtgtctaataatgtaacagatacgt

SEQ ID NO: 1774 - DNA, 70 bp, Fowlpox virus
gtctatgtcagttatcctaccaaaacgacatacaatattcggagaaataggtttagcatcgacatggtac

SEQ ID NO: 1775 - DNA, 89 bp, Fowlpox virus
tatgtaattgtaaaaactgtatttttctattatctttacgactattaaccataacgtaagagatattagagaataagaatgatcgcata

SEQ ID NO: 1776 - DNA, 76 bp, Rana tigrina ranavirus
agaggtttaaggatagtaaaaatatggatagtaatcttaagatagatattatcttaatatatagtctttaccctct

SEQ ID NO: 1777 - DNA, 78 bp, Rana tigrina ranavirus
cagactattccaggaggctcggcggagtgtggctccaccacgccaggttccccgagtacgctcccaagaggttgtttg

SEQ ID NO: 1778 - DNA, 88 bp, Rana tigrina ranavirus
cccgtctcgtactcggtgacgtggttctcgaaaaagtttgtcagatcggctccatctatgagccattttacccatggtatgggacagg

SEQ ID NO: 1779 - DNA, 64 bp, Rana tigrina ranavirus
cggacttgcgccggctacctcatgaccgaggagaggggacctctgaggtgctggcgcaaggacg

SEQ ID NO: 1780 - DNA, 70 bp, Rana tigrina ranavirus
gatgaggcacacggcagccgtcctggagtccaggaacctctccctggaaccctatggctccaaccccatc

SEQ ID NO: 1781 - DNA, 81 bp, Rana tigrina ranavirus
gcttttctgaaagagatatatatattaagagtactactatcttgcgatattagtcttgatatgtaacatctcctagaaagt

SEQ ID NO: 1782 - DNA, 88 bp, Rana tigrina ranavirus
gtcctgtagttaaagttggtggaacagtaggcgcacgtcatgtcgttgcacccgtcaatcttttccactctctttttgcactctggac

SEQ ID NO: 1783 - DNA, 67 bp, Rana tigrina ranavirus
gtctctcaagactattactatcgtaagatatctctcacaaagtatctcacaataatagtttcaggac

SEQ ID NO: 1784 - DNA, 116 bp, Rana tigrina ranavirus
tatcttaagatcttacatcttcttgtcctagaaatattcttgagagtatcttacaatattagtaaagatatcttctgaaagagtatcttactatagtagtaaagtatcttaagata

SEQ ID NO: 1785 - DNA, 68 bp, Tupaia herpesvirus
cagtatccgcgtatagttttcatttactccccttgtagataagacgatacgacacgggcggatagatg

SEQ ID NO: 1786 - DNA, 79 bp, Tupaia herpesvirus
gattaattgccataacctagtcgggttctccagaaacacgtccatctcgacagattcgactagtttagcgtagctactc

SEQ ID NO: 1787 - DNA, 122 bp, Tupaia herpesvirus
gcggcactgacgacccacgcaagaccggcaccgtttcggactccgttagcggtcttcgctgtaaccaggaaccgttggctgtccggaactggagttgaaaacacgcgtcgatacggtgccgt

SEQ ID NO: 1788 - DNA, 96 bp, Tupaia herpesvirus
gtggttgtaacagttgcttcgagttgtgaattagaatcgttacaaatcttacgtgcgacgttcagtccgatatcggagaaagtaccgtttgaccac

SEQ ID NO: 1789 - DNA, 81 bp, Tupaia herpesvirus
gttcgataaatatggtcacaccatcgacataaatacaggtatacttttattatgacgatattaactgtccgtagtccgaac

SEQ ID NO: 1790 - DNA, 58 bp, Tupaia herpesvirus
tgccgccaatcatccgtataagttgacgattcgttatccatgattggtcttaacggca

SEQ ID NO: 1791 - DNA, 81 bp, Tupaia herpesvirus
tggttggacaccatttatcctccacttgaataacagtcagactccactccccttccgtggtggagcgaataagtccaaccg

SEQ ID NO: 1792 - DNA, 68 bp, Tupaia herpesvirus
tgtctgaaatcgttcgtgtctacaaaagtatgcgatgcatacaacaaacacacgactcgaaaaagaca

SEQ ID NO: 1793 - DNA, 122 bp, Rana tigrina ranavirus
acatttttaggtctaaaagtttccgagatggtaaagactctgagataatatcgagagaataaataccctttcagagataatatcctaagatgtcgttacacctcattctcatcctaaaaagt

SEQ ID NO: 1794 - DNA, 58 bp, Rana tigrina ranavirus
agtctctgacatcaaggatgagcaggtcaacgatctggcatctgccatgtttaggact

SEQ ID NO: 1795 - DNA, 90 bp, Rana tigrina ranavirus
gagatttaatgctagtctaaatatttctatattaagatactatcttaagatatcggtactctgagatattttacgctgacatttttactc

SEQ ID NO: 1796 - DNA, 93 bp, Equine herpesvirus 1
ccccacggcacgcgggtgtgggctggcgttgtccatggtttcatctacgttgatgtttccgtaagcagtgagtccatgaatcatgccacaggg

SEQ ID NO: 1797 - DNA, 104 bp, Equine herpesvirus 1
ctgtttacggaagctgggtatatttaacatccttaaaggtcgagcgtaggcgagtcaagccgttctgtgcagactttttcagttccttcttccgacgcaagcag

SEQ ID NO: 1798 - DNA, 71 bp, Equine herpesvirus 1
gtagcagtcgcagtagctgtggtggtttccgctgatgtagacgcggctgtagtaacagctgtggttgtagc

SEQ ID NO: 1799 - DNA, 88 bp, Equine herpesvirus 1
gtcgtctacgcgggttgccggggctgctgcgctagcaaaaatcgtgtctgctggtacggctgccgcgatctcaggagcgagcgacgac

SEQ ID NO: 1800 - DNA, 71 bp, Equine herpesvirus 1
tgcgatagcttacatctatgggtggatctaataaaattagctcacaacccttggattcagctttaatcgca

SEQ ID NO: 1801 - DNA, 100 bp, Equine herpesvirus 1
tgcgctgttggcccggacacggtattgtggttgatttggtggtacatgagttgaggtccaccccatcgccggcgactagattcgtggggcaagcagcgca

SEQ ID NO: 1802 - DNA, 75 bp, Camelpox virus
aataactaatggcaaatgtataaaacaacaaaattatactagagttgttaaagttaatattttctattagttgtt

SEQ ID NO: 1803 - DNA, 121 bp, Variola virus
agtgacattagtagggatagaatgttgagctaatttttgtaaataactatctataaaaagattatacaaagttttaaactctttagtttctgccatttatccagtctgagaaaatgtccct

SEQ ID NO: 1804 - DNA, 80 bp, Variola virus
cacagtttttaatttctttggtaataaaattattcactatatcagtatcttctttatctaccagagattttactaacttg

SEQ ID NO: 1805 - DNA, 112 bp, Cryphonectria hypovirus
cgtcgaccgatcaagtattctcagcctgtgatgtctcaccaagccgccgcaatctgtggcttcaaggagggtgagtacatcgtggatgacgagtaccagaagaggatcgacg

SEQ ID NO: 1806 - DNA, 131 bp, Cryphonectria hypovirus
gcaggttcaggtatgccattgtcacaggccatggctcgcatctgggatgaactacacgacttacgtctccgcgaaggaggccagttcatcatagcagatgccaaggcatatgacagcaagtgcaagcctgc

SEQ ID NO: 1807 - DNA, 95 bp, Variola virus
gccaattccaattgctgtccgtattgtattagagtatcgatatgagtaatggtgtccttgcgtttttctgatagaatgcgagcagcgattttggc

SEQ ID NO: 1808 - DNA, 82 bp, Cryphonectria hypovirus
gctgtaatccaaacgaatcctaactggaaggtcaactactgttcgactccaaggcaggaagcgtttttgaaatggattaagc

SEQ ID NO: 1809 - DNA, 75 bp, Cryphonectria hypovirus
ggtcagttgtacaagccgatgatgaatacatttgcccatttgataatgtctcatcattgcctggacgttctgacc

SEQ ID NO: 1810 - DNA, 72 bp, Cryphonectria hypovirus
gtcgagggtgtagcggccggtcgttcaatgtatcctccgggatttttggtcggtcgttacgataccatcgat

SEQ ID NO: 1811 - DNA, 60 bp, Vaccinia virus
tggtgagttaatattcatgttgaacataaaactaatattttatttcaaaattatttacca

SEQ ID NO: 1812 - DNA, 99 bp, Variola virus
tgtccaagatagagagctcctttggtgaatccatctctatgtttcagtttaaccaagaaacagtcagctggtctaaaatttccatctctatctaataca

SEQ ID NO: 1813 - DNA, 60 bp, Rabbit fibroma virus
ctcgaagtctttgtttttatacacgcactaatcgcgtaatacaagtaatgttattcgtag

SEQ ID NO: 1814 - DNA, 128 bp, Rabbit fibroma virus
ggcgtatgccgatgcattctcgtttttgcgttaatatctactccgtggtctaataatagtttaatgatactcagcttgggataaggagatttcagatacagatgtagcagattgtgtccatatacgtc

SEQ ID NO: 1815 - DNA, 131 bp, Rabbit fibroma virus
tagagaacacattgatgcgttttgactttgttaatataatgtaagaacttacatgatccatagtgatacacttacaagtatagttcttttatttaagtttatgaagttatatgtataaaaattgttcttta

SEQ ID NO: 1816 - DNA, 80 bp, Camelpox virus
cacagtttttaatttctttggtaatgaaattattcactatatcagtatcttctttatctaccagagattttactaacttg

SEQ ID NO: 1817 - DNA, 95 bp, Camelpox virus
gccaaatccaattgttgtctgtattgtattagagtatcgatatgagcaatggtgtccttgtgtttctctgatagaatgcgagcagcgattttggc

SEQ ID NO: 1818 - DNA, 72 bp, Camelpox virus
gccgggcggagccgaacattctccaatattcaatttttgtatatctataatgttattaacctccgcatacgc

SEQ ID NO: 1819 - DNA, 63 bp, Camelpox virus
ggtggaacgtatattttatttaaggacttaacaattgtctgtaaaccacaatttgcttccgcc

SEQ ID NO: 1820 - DNA, 130 bp, Camelpox virus
tccagatgtcatgatattgaattggaaaaataacaaatctattttgattttttgcaaggattggttccataactaaattaacaatagtagtaattttttttcagttatcatctatatgaatgtatttgga

SEQ ID NO: 1821 - DNA, 115 bp, Fowlpox virus
aatcaatagtatagttttatttttattacgtatattcacttttctccattgtctaataatagttcaaatgtttctagaagaatgaaaaacgtagaatatcggcgtatcgttgatt

SEQ ID NO: 1822 - DNA, 99 bp, Fowlpox virus
agagaagctagtacatctgttataatagcttccatatttttcttatccgccaagaacatataatagctatttttatctattttagaaaacaagctctct

SEQ ID NO: 1823 - DNA, 130 bp, Fowlpox virus
agtaaattcgttaagcaaagaagtaaaatcttcgtctttagatatttctggatatactttaaatagtacatgcgagaaaaagtggaagtcgtaataccaattctgttctttgttaatagcggttacagct

SEQ ID NO: 1824 - DNA, 66 bp, Fowlpox virus
gatgttctataaataatttattcagataacatatattgtcgaataattttattttattaggccatt

SEQ ID NO: 1825 - DNA, 77 bp, Fowlpox virus
gctgtagatgtaaccgagtatgcgattgccataaataatcctagaaaatcaacgtatatttctttactttttacagc

SEQ ID NO: 1826 - DNA, 87 bp, Cowpea mottle virus
ctgaagaagattgtagggactcattccaggatcagcgacgacgctttcgttgctttgtatcatggcaggaggaacacaatctatcag

SEQ ID NO: 1827 - DNA, 109 bp, Cowpea mottle virus
ggcttccgcgtgtccaactaggggtgcctaaggcgtgtgccagggtttaatactagtatagttcgtggcgaacaccctgacatgctgatcacgcctaggacaggaagcc

SEQ ID NO: 1828 - DNA, 84 bp, Chimpanzee cytomegalovirus
ctgggtatgcagcatgaggtagttgttgatcactcgtctttaaggtgtgacgacggatcactcttctcatcgcccttgtcccgg

SEQ ID NO: 1829 - DNA, 50 bp, Chimpanzee cytomegalovirus
ctgttccgccacttatcgtacagtttctgtgggatacgtaggcaaaacag

SEQ ID NO: 1830 - DNA, 67 bp, Chimpanzee cytomegalovirus
ggcgcatctggaggccgttctgtaggatgttgtactgcatcactgtaaaattacgaatctccgtgcc

SEQ ID NO: 1831 - DNA, 109 bp, Chimpanzee cytomegalovirus
ggtgatgaggcaggtgaaacccgtgatgccgatgaaggacatttctgcgataaaggcaaagtaacgaacttcgtcgatcatcacggcctcgctgaagctgcatgtcacc

SEQ ID NO: 1832 - DNA, 94 bp, Chimpanzee cytomegalovirus
gttttaggcttagttaccggctcttgtggcctctttagagtagtcgtcctcttaggctttggcggtttaacgatggtaaccgtaagtttaaaac

SEQ ID NO: 1833 - DNA, 90 bp, Sonchus yellow net virus
aacaggatgtgcttcatggtcttaggatctaatcgcttatacatgacctctgccgttgcattttgaaccatcacggtgagcaagtctgtt

SEQ ID NO: 1834 - DNA, 61 bp, Sonchus yellow net virus
agcctgtcccgagcgttgatgtgattcctcctagtgatgtgacaccaacgttcgaattgct

SEQ ID NO: 1835 - DNA, 120 bp, Cowpea chlorotic mottle virus
atctctgtttaatatggaaattaaagttatggacccaagtttgccatacgtttgtagtaagtttcttttagaaactgaaatgaataacttggtgtctgtgcctgatcctatgagagagat

SEQ ID NO: 1836 - DNA, 97 bp, Sonchus yellow net virus
attgttcgctatggcatatatatttaacggtgaattatatcccacttccgtgctaattcccatatttatttcaatgtatgctaacatagcaatcaat

SEQ ID NO: 1837 - DNA, 103 bp, Sonchus yellow net virus
ccccttctataaacgcgatgtctgcgtctggcttcccctgtttcgcttttccgcaagcatcatcagtggacatcagagcttcttctgcatcatagaagaaagg

SEQ ID NO: 1838 - DNA, 130 bp, Sonchus yellow net virus
cttgtagcatactatgcagctcttccattactgctagtatatcatcctctaattctccatcacctgcatgatggattgcagacttgtacttgctggttagtacctcagagttcatcactgtgctcttaag

SEQ ID NO: 1839 - DNA, 67 bp, Sonchus yellow net virus
ggtgcaatttccgctcgtgcaatgtgtcgtgtggatggcttatggtattgcatcttgaaatagcacc

SEQ ID NO: 1840 - DNA, 91 bp, Cowpea chlorotic mottle virus
ggtgtgacagttttgtctgagattaatttgcagaggtatcagcacatgataaagtctgatattaaaccagttgtctcggatacgttacacc

SEQ ID NO: 1841 - DNA, 117 bp, Sonchus yellow net virus
gttgtttgcatcattatatagatcaggttggttgattctgtcatcttctatcaaattattcaaaaattctagaggattccatattctttgatcatcatatgttaatatgcaagcgac

SEQ ID NO: 1842 - DNA, 69 bp, Rice yellow stunt virus
atgtcatgaccctcttctcgtcacagtccagtgatctcatcaagactgagataataaatattatgatat

SEQ ID NO: 1843 - DNA, 55 bp, Rice yellow stunt virus
ctctagatctctggacatgcttgacatcttttcttgcatgtcgagcaaattagag

SEQ ID NO: 1844 - DNA, 114 bp, Rice yellow stunt virus
tagtggtaacatagaagctccaggtgtagtggcttcatgatcggggggcagtttccaataggaggtgacctgatgcatatccctgcacaaattgttgcagctatccctccacta

SEQ ID NO: 1845 - DNA, 55 bp, Rice yellow stunt virus
tatgtggagttgggtttttaaaatatgaacaatataaaacattgataaatacata

SEQ ID NO: 1846 - DNA, 84 bp, Rice yellow stunt virus
tccggtgttagatccctggttccatcagctatgtatagtatgctgtctcggaaaatctgatgagatctagaatatagccctgga

SEQ ID NO: 1847 - DNA, 70 bp, Rice yellow stunt virus
tgtctgtcttgattagatatcctcaccgttatgtgattgttgtcacagatatgttcgtcagtccaagata

SEQ ID NO: 1848 - DNA, 93 bp, Lactate dehydrogenase-elevating virus
cacttgaacagaatagccagtgaacacagaaaaacagggacaatgcaaaagagaacatcaaccttgctagcatcactggcagaatctcattca

SEQ ID NO: 1849 - DNA, 68 bp, Callitrichine herpesvirus 3
agggtctgaggggactaagtggaggcctgaagccgggttatgatgcagggtcctgggcctgagaccct

SEQ ID NO: 1850 - DNA, 131 bp, Callitrichine herpesvirus 3
cccggccgccccttgggggtttcggggacacggttgctggctgccaagacacttagacagccctctagtggccaactagatgtcggggcagccagccaccgtgtccccagaacccccaaggggtggccggg

SEQ ID NO: 1851 - DNA, 103 bp, Callitrichine herpesvirus 3
cctactatgttcttattggcttatggccatagacccctgcccatatccttgaaggcagtgggccgtggggttgctgtggaaacctgcccagtgacgtcttagg

SEQ ID NO: 1852 - DNA, 85 bp, Callitrichine herpesvirus 3
ggataatgggggaggtccgaatgggggtctgtgggctggcaggcgcggcctgggcccaattttcgcttcactccccttcttattc

SEQ ID NO: 1853 - DNA, 109 bp, Callitrichine herpesvirus 3
gtgagtcatggaagagggtctgaggggactaagtggaggcctgaagccgggttatgatgcagggtcctgggcctgagaccccaggcttcttcccttaggtgtgagtcat

SEQ ID NO: 1854 - DNA, 110 bp, Callitrichine herpesvirus 3
ttttttagctgatgacagacaaagcatgttcagatggtcaatatgtgcagttagaatacatgactagtgtgcgtctggaggtagcattgttaaactatcagtataagaaa

SEQ ID NO: 1855 - DNA, 131 bp, Equine herpesvirus 2
ggggcggaagaccctcatcgccctctgcctggctgttcgggccgctgaccgcctgctgtgcttgagacgagcgggcgctcacgggtacccgatggccgggcgaggcgccccgcccggcgtcctccgccccc

SEQ ID NO: 1856 - DNA, 74 bp, Fowlpox virus
aataatactatttagatgaaaaaaattagcttatcaacttctgtttccaatttttcatcgttcgattcattatt

SEQ ID NO: 1857 - DNA, 96 bp, Fowlpox virus
attaccgtgtatataaaatccttttatgtcattggaggtctctgaattataataatctgatctaactgatataacagcttttacatatttggtagt

SEQ ID NO: 1858 - DNA, 103 bp, Fowlpox virus
cgttagatggttgataatcaccgtgtgtttttgtatctttatcagataatgacatatttgatatttaacaaagtaaaaatcgacctttattatttatctaacg

SEQ ID NO: 1859 - DNA, 72 bp, Fowlpox virus
gataggcaaaaaatatgtttacaacttgggagaattccaaaatactgttcggaaatatgttttttgtttatt

SEQ ID NO: 1860 - DNA, 65 bp, Fowlpox virus
gattctggcatatgtcgaggctgggtttctttataaggaacacaatcatcatcgtagtcatagtc

SEQ ID NO: 1861 - DNA, 86 bp, Fowlpox virus
gttaatatcggtagggtgtagtatatatagaccacagatatcacattgatctccgtgtatatacttacattttttaccataatagc

SEQ ID NO: 1862 - DNA, 70 bp, Fowlpox virus
ttatatttaagttctataggtaaagcattccagtaaccatctgtagtgatattactcagaatagatatag

SEQ ID NO: 1863 - DNA, 61 bp, Fowlpox virus
ttatattttcatgtagtgtctgaacaacttgtgtattttaacgctaccctatgatgtataa

SEQ ID NO: 1864 - DNA, 96 bp, Bovine respiratory syncytial virus
aatgcaggtcttggcggatagaacttttgaatgtattagtaaatttagctcatcacatttatgattctgaggtttagattgtaaacattatgcatt

SEQ ID NO: 1865 - DNA, 96 bp, Bovine respiratory syncytial virus
aattagtgaattatacatatctttttaaataactatatatgaacataattgatattatatggaggtgtgttgttagatctgtgtagttgattgatt

SEQ ID NO: 1866 - DNA, 69 bp, Bovine respiratory syncytial virus
acaactatatagataatgtgagtttttaaataactatattgatattacattacatataatcatggttgt

SEQ ID NO: 1867 - DNA, 96 bp, Bovine respiratory syncytial virus
catgtggaggccattcaaagtaattatgactaaaatgacattttttaccatttaagcaatgtcccctaatctcatatttgcagggatttcttcgtg

SEQ ID NO: 1868 - DNA, 71 bp, Bovine respiratory syncytial virus
gataattgatttgaatatttagctaattctgaatcacttaaccttttagaaaatgttatttcacaattatc

SEQ ID NO: 1869 - DNA, 131 bp, Bovine respiratory syncytial virus
gcttgcaggatagtatacaccattatgctgaatggttttactcataaattgcatatcacgggatatatatgtctccgtacctttaagtttatgacctatactagcatattctttatacaacaacttaaggc

SEQ ID NO: 1870 - DNA, 100 bp, Bovine respiratory syncytial virus
tgattttgagaatacatattacatggatattgaaactgtaagtagtcaagaacattttgatgacttagtacaataacatcattttcattcttaattagca

SEQ ID NO: 1871 - DNA, 62 bp, Newcastle disease virus
cacggccaatgtggcttcattctgtttccctgcaagggcaacatggttcctcattacctgtg

SEQ ID NO: 1872 - DNA, 69 bp, Newcastle disease virus
cgggatgtgctatcgaatactgcagacgcagggttaagtcttgcttgttcaccatcaagcattgtcccg

SEQ ID NO: 1873 - DNA, 61 bp, Newcastle disease virus
cttagtagaggtaacctcgtggtcagcggtcactgcgacagcgcgttgggtacctgcttgg

SEQ ID NO: 1874 - DNA, 75 bp, Newcastle disease virus
gaaagtagaattcctggcatattcttgtataaatcacccatatataagacaatattgtctaggcctcttactctc

SEQ ID NO: 1875 - DNA, 82 bp, Newcastle disease virus
gaagacatgttggcagaaggcttcctcgagtttgtgcttcgggctcgcactcgagattcacaccttctacccgtgcgacttc

SEQ ID NO: 1876 - DNA, 98 bp, Newcastle disease virus
gcttcaatcagcgcagtgtcaatattcttcctcaagtactttattaatcttggtaaaggactggataggatgtctgtcacacgctgccgctgtgaggt

SEQ ID NO: 1877 - DNA, 55 bp, Newcastle disease virus
ggtaggataatctgatgctctgccctttcaggaccggagctcgccatgtcctacc

SEQ ID NO: 1878 - DNA, 67 bp, Newcastle disease virus
gtataaggagttcccgtgtcttgcacatcttacctcgggtacagaaaggagatgggatgccttatac

SEQ ID NO: 1879 - DNA, 57 bp, Newcastle disease virus
tggaaatgatccgcagaaacaggggtattgttttggctctgctttgatcggagacca

SEQ ID NO: 1880 - DNA, 64 bp, respiratory syncytial virus
atgatagagtaactttgctgtctaactatttgaacattgttggacattaactttttctgatcat

SEQ ID NO: 1881 - DNA, 88 bp, Garlic latent virus
cacagcgatgatgaggaactctttgagaaaaatagtaaaattcttaccatttgcattcaaggagattgtgaatttcgatttcgctgtg

SEQ ID NO: 1882 - DNA, 84 bp, respiratory syncytial virus
cagattggtgaatgctatgtattgactcgagctcttggtagctcaaaggttttgttatggaatacgttatattcacagagtttg

SEQ ID NO: 1883 - DNA, 72 bp, Garlic latent virus
ccctggctaacatgcttttcacgtttttgaggtatgatctcaatgggcaggaaagcatttgttttgctgggg

SEQ ID NO: 1884 - DNA, 72 bp, Garlic latent virus
gcactaaatgggacaatcgctttcgatcggcaaaagccgcccaaacaatcgtctgctttcaacattcagtgt

SEQ ID NO: 1885 - DNA, 77 bp, respiratory syncytial virus
gtccaacggcaattaatgataacaatattactataatcactataattatagtagttatcatgatatttatggtggat

SEQ ID NO: 1886 - DNA, 63 bp, respiratory syncytial virus
tccaagtaattcagataattgattcatataattggtcattgttgaatcacttagttttttgga

SEQ ID NO: 1887 - DNA, 118 bp, respiratory syncytial virus
tctattgagttgacagatatgatactatcttttttcttgggatctttaggtgatgtgaatttgccctttattgattctaggaatttggtagctctgttgtttgcatcttctccatgga

SEQ ID NO: 1888 - DNA, 81 bp, respiratory syncytial virus
tcttgtatgtcataagtaatgactgaaaataagtaggttcttctatttttatttcacctttatgatacttagacattaagg

SEQ ID NO: 1889 - DNA, 106 bp, respiratory syncytial virus
ttacatgcttgctccactctattataattttactccagttgactgttacaggcaattcagcatcacagacaaaaagactgataggttcagcaaactttatatgtaa

SEQ ID NO: 1890 - DNA, 69 bp, respiratory syncytial virus
ttgatgatgtggtaagcattaggattgagtgttatgacactaatatatatattgtgtatatatcatcag

SEQ ID NO: 1891 - DNA, 75 bp, Sendai virus
gtgctgatgttgccactccaagtgctatggtcccaatcacggcgccgaagaatcttgactgtgggacatcagcac

SEQ ID NO: 1892 - DNA, 87 bp, Sendai virus
tcatcaaaatctttacttctttggtgagaaatctatatgttatactatgtatagtattctcaaacctatctaatatagtttttgtga

SEQ ID NO: 1893 - DNA, 129 bp, Human parainfluenza virus 3
aagatccgacatctgttgtgtcaatgatattggtatataattctggacatgactctgaattgtaagaagccttgtgttcactcctgactgtattagatcattggtattatccgatgccatttggatctt

SEQ ID NO: 1894 - DNA, 78 bp, Human parainfluenza virus 3
actcaggatagagtatgtcagatacagtgccattgttagattcagtgtccattttccgagcacgctttgctcctaagt

SEQ ID NO: 1895 - DNA, 80 bp, Human parainfluenza virus 3
agttaataaagggagtctgacttggagggtgattgagtaatcattcaaatcaacatctataactctcacctttattgatt

SEQ ID NO: 1896 - DNA, 70 bp, Human parainfluenza virus 3
atgttctatctgctttaagtaataattcagtcactttactgttaataccaggtatatataatttgaacat

SEQ ID NO: 1897 - DNA, 106 bp, Human parainfluenza virus 3
tcccgtcacatactgttgcatggctctattttgtacaactgccactcccattgcatagctccatatggcaggatagttgcctggtgcgaactcaccatgtatggga

SEQ ID NO: 1898 - DNA, 108 bp, Human parainfluenza virus 3
tgagactatctagtgtaaaatttgcacgtgtttgtgctatctgtgaggcttccatccaagatatctcatcattaccaaatgcccatgtatatatcattgctattctta

SEQ ID NO: 1899 - DNA, 65 bp, Human parainfluenza virus 3
tgttatacatccatttggacatgaatgtccccatggacattcatcgtttcctggtcttgatagca

SEQ ID NO: 1900 - DNA, 73 bp, Human parainfluenza virus 3
tgttgaattgggattcccattgaacagtactttaaccctgttaagaatctgtgtcacatttcctaatttttta

SEQ ID NO: 1901 - DNA, 131 bp, Human parainfluenza virus 3
ttggcataagccattgataataaggacaccaggaaccctgccctttgtgcatgttgtttctcattatccagtgaatgagataaaaaaagaagagctaatgtcattttctcattatcatcagttattgtcgg

SEQ ID NO: 1902 - DNA, 64 bp, Human parainfluenza virus 1 strain Washington/1964
agagctaatgggtgtcattattgaggagtgtagacttatatcctcctgattttcccgatgcttt

SEQ ID NO: 1903 - DNA, 110 bp, Human parainfluenza virus 1 strain Washington/1964
ttcttatctgcgtcttttatccgagtccactcaaagattgtatctcttaatactctatcaaatgtgataatacaattttttgtgtctactatatttagtgtagataagaa

SEQ ID NO: 1904 - DNA, 131 bp, Human parainfluenza virus 1 strain Washington/1964
ttgtctgattaattctgtgattgtctctttgattattttggcactttcgttcatggaggatactgtcatgatgtttgtcttcatacaagtgtcttgttttataattaggtcaatgcataggatcatgataa

SEQ ID NO: 1905 - DNA, 68 bp, Equine herpesvirus 1
agatctcccccatgcaaatgttttagggtaggctgtacatggaataggtaaacgcttgggggtcttct

SEQ ID NO: 1906 - DNA, 127 bp, Canine distemper virus
agtggaaattggggtaatcattcgtaattcctcaagtgagatgtccgctctctgttttgccaaggtccaagcctcttgccaagattcgtcatcatcaccataggcccatgagtacacagttgctatt

SEQ ID NO: 1907 - DNA, 65 bp, Canine distemper virus
gatacctgatcctgacatgcaaagttgagtaacgttgatcaattgccatagcagtatcagtcatt

SEQ ID NO: 1908 - DNA, 72 bp, Canine distemper virus
ggtgcggggagaattgccatcttggtcaagagacagtgatcttgtaagaggggttctatcacatcccgtgtc

SEQ ID NO: 1909 - DNA, 84 bp, Canine distemper virus
gtctgatagtcgagtgatgctcatatataccaccctgaatctttgtgctatgtctaatggtattagattgactgtgttacagac

SEQ ID NO: 1910 - DNA, 84 bp, Canine distemper virus
gtgcagaaaagtgatttgggattgcttaggaccagtagctcgaattgtccggtcctctgttgtcttggatgctatttctgacac

SEQ ID NO: 1911 - DNA, 61 bp, Canine distemper virus
tgcagtgatttgtgcagctgtagccactcctaaagctacacctgcaagtaccactcctgca

SEQ ID NO: 1912 - DNA, 129 bp, Canine distemper virus
tggtaagccatccggagttcaaaagtgggctttcataataatccataccatctccattcagtataaccggaccgtatgtgaacgatatgttaagttgaaggtcaacacttgcatctagaggtaatgtca

SEQ ID NO: 1913 - DNA, 71 bp, Canine distemper virus
tgtgactggtgaggtcaataatacatacaaggtccctagagactaacacattcaatgattcaccttttaca

SEQ ID NO: 1914 - DNA, 79 bp, Canine distemper virus
ttctctataagtgaaacattaggcatcagttttatgaccaagtactggtgactgggcctagtcatgatcttgtaatgga

SEQ ID NO: 1915 - DNA, 105 bp, Simian hemorrhagic fever virus
ggtgaaaggttaaggcagctatgaagagggcatagacgtgctgatgagattcagcgagctgatcagtgaaattaaagatgccagttacagaccttggcctttccc

SEQ ID NO: 1916 - DNA, 58 bp, Human herpesvirus 4
atgtaggcaattgcgtgcctagaacattgctaatgtgccctgggtttcctgccttcat

SEQ ID NO: 1917 - DNA, 78 bp, Human herpesvirus 4
cccgtggggggtcttagtggaagtgacgtgctgtgaatacaggtccatagcaccgctatccactatgtctcgcccggg

SEQ ID NO: 1918 - DNA, 96 bp, Human herpesvirus 4
ccgagacgaaggcccgtctgtagaggaagtggttgcgcatgcgggccagctcccagtagaccacgtccccccagacgcgcaggcacagggtctcgg

SEQ ID NO: 1919 - DNA, 68 bp, Human herpesvirus 4
cgcgtggcatccacgttggcctcaaagatccgacacccgtgcttgtcttgcagccacgtggccacgtg

SEQ ID NO: 1920 - DNA, 112 bp, Human herpesvirus 4
gcgatgttttgcgcctggaagttgtactcccggaagatgccctccaggtcaaagacgttggaggcacgctgttcgtcccgtgagtacagctccagggaggcaaagtcaatgt

SEQ ID NO: 1921 - DNA, 80 bp, Human herpesvirus 4
gctgtagatgtgcctggctctgtccagaatgtagggccagtcaaagttggccacgttgtagccggtcacaatctccacgc

SEQ ID NO: 1922 - DNA, 61 bp, Human herpesvirus 4
ggcaggtggagtgggacacagttagagaacattagtcctctggtccctatctccacccgcc

SEQ ID NO: 1923 - DNA, 62 bp, Human herpesvirus 4
tctggttgttgccgttgacccccgtgtacttgttgatggtcactggcagcgtgacaaccgga

SEQ ID NO: 1924 - DNA, 78 bp, Human herpesvirus 4
tgtgccgcttggagggaaacatgaccacctgaagtctgttaaccaggtcagtggttttgtttccttgatagagacaca

SEQ ID NO: 1925 - DNA, 106 bp, Measles virus
acagatgattcaattatctgctgcttgatcttttcaggattcattagccggttagctttgagatctgtcataactaaataagattcagtagatatgaagttgctgt

SEQ ID NO: 1926 - DNA, 130 bp, Variola virus
acgatgaatgagtaataagaaatatgaaatctatcttatatacacataattattctatcaattttaccaattagttagtgtttaataaaaatatgggaatctaattaatttttccttacacaatcgacgt

SEQ ID NO: 1927 - DNA, 78 bp, Variola virus
acttagagttatgataaagatatttatccttagggtgcaggtaatggggattaatctttgttggatcagtctctaagt

SEQ ID NO: 1928 - DNA, 82 bp, Variola virus
atgatgatttatggtgaattgattccggaagatcgctattgtattttgtggttccacaattcatttccatacatgttattat

SEQ ID NO: 1929 - DNA, 129 bp, Variola virus
catttttggatttcatatagttgaatatattaaagttatttatgttgctaaatccagtggcttctagtagagccatcgctatatccttattaactttaacatgtctactatttgtgtattcttctaatg

SEQ ID NO: 1930 - DNA, 97 bp, Variola virus
gaaacgccatttagcgtagtgaggacacaagtgaacctataatgagcaaatttattagtatcggttacatgaaggactttacgtagagtggtgattc

SEQ ID NO: 1931 - DNA, 79 bp, Variola virus
gtcaatattatcagattctatatattcgaatatatcaaagtcattgatatttttataattggtagaagacaataatgac

SEQ ID NO: 1932 - DNA, 99 bp, Variola virus
tatatcaacggacacaaagtagctaacataaaccattgtataatttttatgttttatgtttattagcgtacacattttggaagttccggttgccatgta

SEQ ID NO: 1933 - DNA, 110 bp, Variola virus
tctgttcccgaaagataatatagaggcgttttatgctgtttatcgcacgcgtttggatctgcgccgtgcgtcaatagcatcgcaactattctattattattaattttaga

SEQ ID NO: 1934 - DNA, 117 bp, Avian paramyxovirus 6
acatatgccagtgggtccactgatgagattcagatgactactttgccgtcttgatgaagggattgaatccatctgttttctttttgtcagtggagatggctcccttggcttctatgt

SEQ ID NO: 1935 - DNA, 98 bp, Avian paramyxovirus 6
agattagtgatgaacggatttaatttgggtgaatcaaatatctgagatatccctgaacaacattcccgagttctgtgatctgtcgccatccacaattt

SEQ ID NO: 1936 - DNA, 81 bp, Avian paramyxovirus 6
cttataatttgggactatgatttctaattcataaccatctagtagttgtgcagtatattggtcataaccccatagtatgag

SEQ ID NO: 1937 - DNA, 86 bp, Avian paramyxovirus 6
gcagtggtgtcagtgagtgtgcatgcctgggtgtcaatctcttcaagaagctggccagattccacaacaaactgaggtactactgc

SEQ ID NO: 1938 - DNA, 89 bp, Avian paramyxovirus 6
tcactgtctccatacgcccagatgtaaacactcgctcctcttaatgccgccctaaggtgagttgacatccctttgattgttgtcagtga

SEQ ID NO: 1939 - DNA, 61 bp, Avian paramyxovirus 6
tcattgacagcaccgtacggctaactttgaaaaggctgctgcgatgtaagaaggtcaatga

SEQ ID NO: 1940 - DNA, 92 bp, Avian paramyxovirus 6
ttgtggctgagtgttagtgccattagtgttcttgcttggatataatgcaaccaggctaagaacgcacccacttattgagcaagtcagcgcaa

SEQ ID NO: 1941 - DNA, 66 bp, Macaca mulatta rhadinovirus
ccggttctataaactgcgtgtacccaaagagagccctggcttcctcgcatagttcgttaagaccgg

SEQ ID NO: 1942 - DNA, 75 bp, Macaca mulatta rhadinovirus
cctgaagagttcgccggtggccgaggcgctgcacacgcgaaacttaaacgcctcggccctaggtgggttctcggg

SEQ ID NO: 1943 - DNA, 70 bp, Macaca mulatta rhadinovirus
gaactaacacgacatgccttttccatttactcattgggggtgctattggtggattttgtggtggtggttt

SEQ ID NO: 1944 - DNA, 75 bp, Macaca mulatta rhadinovirus
gaccgtgcggccgacatcgcccaggtccgcgactatctcggacaggtcgcgggccaggcggtcgcggttcaggtc

SEQ ID NO: 1945 - DNA, 60 bp, Macaca mulatta rhadinovirus
gccgtgacgggcggtcacctcgcgaccgagacgcgttcgcaggtcttccgtcgtcagggc

SEQ ID NO: 1946 - DNA, 104 bp, Macaca mulatta rhadinovirus
ggatgctattgagtctggtgaacagctcgttttgttttcgcataacgttggtatagtttgcctgttgaaagaacgtcacggagcaatcccggctcagtgcgttt

SEQ ID NO: 1947 - DNA, 71 bp, Camelpox virus
acatgtgtacttatagtctactaatatgaagtacctgatacacatttctattaacgatttattatatatgt

SEQ ID NO: 1948 - DNA, 75 bp, Camelpox virus
ggtcttggatagaatatttgtatcgtttaatactcgtatatattatattaaacaatactaaaatatctttagacc

SEQ ID NO: 1949 - DNA, 79 bp, Camelpox virus
gtcgatattatcagattctatatattcgaatatatcaaagtcattgatatttttataattggtagaagacaataatgac

SEQ ID NO: 1950 - DNA, 70 bp, Rana tigrina ranavirus
agctgatctgtaaaactttaggataagactatatcttgtcctaatctctagcaacaatacatttcagact

SEQ ID NO: 1951 - DNA, 78 bp, Rana tigrina ranavirus
cccgaaatggtgtatagtttcatgttggggtccatttaaaatgcaatggatccagaaggaatgctgtacggtttcggg

SEQ ID NO: 1952 - DNA, 75 bp, Rana tigrina ranavirus
gacatcttaagattctttctatatcacggtaatagttctatgataagaaggaaatgtaacatcttaagatacgtc

SEQ ID NO: 1953 - DNA, 68 bp, Rana tigrina ranavirus
gcgcttggcctctggcatggtgtactcactccaggcgtccaggtatgccgtgttaaaggactgggcgc

SEQ ID NO: 1954 - DNA, 57 bp, Rana tigrina ranavirus
gttgacgaaggctctcttgaagctgccgggagaggcgctccaagaggccttgtcgat

SEQ ID NO: 1955 - DNA, 69 bp, Rana tigrina ranavirus
tacatgagcgtctcccagggtgtggacaaactctcccggttctagcccggtgacgtgagccatcatgta

SEQ ID NO: 1956 - DNA, 130 bp, Rana tigrina ranavirus
tcaatcatggtcctctcggttccgggtctgcaaccgcgtacaatctctatcagcctccttgtcatccagacctgaggctcagagtctggatcggtcagatcgaggtagcactggactatcctctccctga

SEQ ID NO: 1957 - DNA, 88 bp, Rana tigrina ranavirus
tctgggtgagcataatcttgagctggctagaaaacttccacctgtttggatcctccagggccatctcaaacagttggccccatctgga

SEQ ID NO: 1958 - DNA, 131 bp, Bovine herpesvirus 4
aatagatgaggtttgagatctctaagatatgctgggaaaccttttcaaaaatgttatgctggtctatggcttctatagatgcattttgtatcctagtatcactcgtttcaagttgtaccttgttatctgtt

SEQ ID NO: 1959 - DNA, 59 bp, Bovine herpesvirus 4
ccccatagaattgacaatattttcatatagttttggatattgtcttatcacaagtgggg

SEQ ID NO: 1960 - DNA, 73 bp, Bovine herpesvirus 4
gggaatgtacagactttatgtagaaagaccagagggaatctgtcttctaaaaaacatattttatttgtttcct

SEQ ID NO: 1961 - DNA, 66 bp, Bovine herpesvirus 4
ggtagagggatgggagatatattcctcaatgttcctaggaagtttatagtctcctccaacccttcc

SEQ ID NO: 1962 - DNA, 123 bp, Bovine herpesvirus 4
gttctcctgctcagaggctttgtcaatgtttggatagatcatttttatgggggcctcgttcatgttattggttctcctggagactataaaaacaacaaaaaccacaactatgagaaggaggat

SEQ ID NO: 1963 - DNA, 54 bp, Bovine herpesvirus 4
tcttataaggtatgaaattttatatatttttatatagagtccatgttttaagga

SEQ ID NO: 1964 - DNA, 92 bp, Bovine herpesvirus 4
tgtccttaactatgtgtatgtgtggtttttgtgttctacgtcctaaaaccttgtattggcacccatgaatagcacatccggccttaaggaca

SEQ ID NO: 1965 - DNA, 80 bp, Bovine herpesvirus 4
tgttttttatcttttgtatctggacatgtctgatcaaggtcaaatctgaatagttctccagaggaagatgatgcactgca

SEQ ID NO: 1966 - DNA, 104 bp, Bovine herpesvirus 4
ttcaagttctagggagagacaggaacactctgttctgttctgttccacaaggtgggagtatagagcatcaatgagaagtttaagtctcttcttatttctttgaa

SEQ ID NO: 1967 - DNA, 87 bp, Hendra virus
agtgtacagggtagcaagtttatcgctctttgatatttaggagttctataaagaattatacaaagagtcatatgatctctgtaaact

SEQ ID NO: 1968 - DNA, 123 bp, Hendra virus
atcgtaatcattgagatggtctgcatgataatttaacctatcagtgtcatggggtaagaaaagtgttagcaaaatcatctgatggcataatatattgtcatccagactatcttcgttgctggt

SEQ ID NO: 1969 - DNA, 90 bp, Hendra virus
atctgcatcgattttgaggtatactagaagattgaaagcaatagcgttgttccttctgaattctagcattgtccttgggatcatgtagat

SEQ ID NO: 1970 - DNA, 90 bp, Hendra virus
gcccaacagcaatgctctcagaattgtaatttattgatcccaaatattttccaaggcttatgattatgtttcctagaacaactgttgtgc

SEQ ID NO: 1971 - DNA, 118 bp, Hendra virus
ggagtctattttgttgatgatcttgggtatctctttcatctgttcctcaatgtgattcaacctcatatcaatgttgatgagtttgattgcgttaacgatgcccatcaatactgactcc

SEQ ID NO: 1972 - DNA, 124 bp, Hendra virus
gggaaacactgacggtttatgaatggttgagattaagacactggccattatgatgtgtacctctaatatatgatcttggtctgactgctactctatcaaattactgacatgtttagatgttccc

SEQ ID NO: 1973 - DNA, 127 bp, Hendra virus
ggttatgtctcaactgcgcatattctatagctgaaatcaatttccctgatactataggactgtcaaggtgacattcaggatagatgatatcagagatagataattcatgagccatgttgttatatcc

SEQ ID NO: 1974 - DNA, 57 bp, Hendra virus
tgagatagattgttggaagttgagacaggagttatagcttttaacacatctatatca

SEQ ID NO: 1975 - DNA, 127 bp, Hendra virus
tgtgcagtactctctttgatagcctttgcagctaatctggatctgagattcaatagagaatttgtcaatctcgttcctccggatgtactcactgaactgcttgggacactgtctgcgagagatgaca

SEQ ID NO: 1976 - DNA, 65 bp, Nipah virus
caatgttcttagcagtgtttcataatttccaccgaatgcctgagatatagcctgtatagtcattg

SEQ ID NO: 1977 - DNA, 55 bp, Nipah virus
cctgatgtgtaatcactccaccctctctcagggcttgaagtaaatccatatccgg

SEQ ID NO: 1978 - DNA, 100 bp, Nipah virus
cgggtgtaagataataacacttctttccagttttgtctgatttgaaaatgcagataagattcggatttaggattatttcagtacttttgtctcgcatgtg

SEQ ID NO: 1979 - DNA, 79 bp, Nipah virus
gagtctttgtcatgagcttcgatctgaaatctaagattagaacttttcttctgatgttatttttgatgtgataaagttc

SEQ ID NO: 1980 - DNA, 130 bp, Nipah virus
gattgggaatccaggggtgtatgctatcttggatactaatagtccgtcctccatcataacatttatcgcgatagatattagatgggaatgttctactagtatctcctctacatttttgtcaatcccagac

SEQ ID NO: 1981 - DNA, 77 bp, Nipah virus
ggatttggtggggtccagacattggtcataaataaagaaggaacttcatcacctctgtctagtacctctccaactcc

SEQ ID NO: 1982 - DNA, 91 bp, Nipah virus
gtataattgtaaggatattttcttggtcgaaatgctattgtagtatgaaactatatcataatccaatttgaatccttatttgtcattatat

SEQ ID NO: 1983 - DNA, 69 bp, Nipah virus
gtgtcgtattatgatagtgtactatagaaagatttttggatactgtagaatattggaaatagacgtcac

SEQ ID NO: 1984 - DNA, 122 bp, Nipah virus
tagaaattctgtgattaagctgttgatgttatcgtcagagtctattgcaaggtgttgctttaaaacatccttgtcagcctttgttataatctcaagaacggtctgagcaacagtcttagcta

SEQ ID NO: 1985 - DNA, 85 bp, Nipah virus
tcccaattactttcttactaatgatattgtatgctttgaatgactttttcatgatgttatcaagtttgctagtcatgccttggga

SEQ ID NO: 1986 - DNA, 103 bp, Nipah virus
tctaaagtgtacatataaagaattgattatcacttgatgaactatatgatatcattgttctcaaagatcaccgatcaagattatttattaacccagtttcaga

SEQ ID NO: 1987 - DNA, 76 bp, Nipah virus
tgactgctaagcttaataggagatcctagagtaaatctcttggatcctaagtttttcttaatgagttagtagtaca

SEQ ID NO: 1988 - DNA, 52 bp, Nipah virus
tgcagccagtcttgatctgaggtttagtaatgaattagtcaatctggtccca

SEQ ID NO: 1989 - DNA, 101 bp, Nipah virus
ttggggatgagaggcactcttaccaacacccagagggtaggcagcaattgtcctgatcttcttgcgtttccctgtctctggggttctctcaacatcttcaa

SEQ ID NO: 1990 - DNA, 82 bp, Chimpanzee cytomegalovirus
atggtagcggtcggttattggttttctattgcagcatgtagcccagctctgcgttgcacacgtccagtctccggcgggccat

SEQ ID NO: 1991 - DNA, 125 bp, Chimpanzee cytomegalovirus
gtattccaggctgatccagcggtacggtacgctgcccgtggcgcccaagatgtactggggctgttcttccttgaccttagcgcagcgcagcttaccgtctgattccaagtacagcctgcgggtac

SEQ ID NO: 1992 - DNA, 109 bp, Chimpanzee cytomegalovirus
gtgagcagaagcgcgcagacggcgtggaggaccaggctcatgggatagtgtcccttatcttcctcctgtctctctccctctcctttgcgtttctcgtccgcttcctcac

SEQ ID NO: 1993 - DNA, 81 bp, Reston Ebola virus (REBOV)
ccatgttgtataggtaatttggggaggtaagaaatagcagcttacaatccctgatttgaatgtgtccttgtatgactttgg

SEQ ID NO: 1994 - DNA, 121 bp, Reston Ebola virus (REBOV)
ctaaatagtctatcggcagtgttgctacaggtgtatcacttaggaatttggatactattgtgtcgaacttaagtcgatatatatgttttggtaatttacattgccttagttgaggatttag

SEQ ID NO: 1995 - DNA, 74 bp, Reston Ebola virus (REBOV)
gaacagagaataattcacaaaactgttgaggagataattgcaattgtaataatattttgtgaaaatctctaatc

SEQ ID NO: 1996 - DNA, 79 bp, Reston Ebola virus (REBOV)
ggagattctttgtagcatactgtgcgatgtgactcaaccagtacacgcctcgctggacttgtgcttgcaaagcatctct

SEQ ID NO: 1997 - DNA, 104 bp, Reston Ebola virus (REBOV)
gtctggctgaggttccatctaaggttgtggcttgccttgttaaataaatcttgattcttagatcttaagtccaagcgttttaccatcttgcatcttaaacaaac

SEQ ID NO: 1998 - DNA, 74 bp, Reston Ebola virus (REBOV)
gtgaatctacaatatatagtggtgtccaacatagaccttagctgatgtaggtactgtttaatattttgattcat

SEQ ID NO: 1999 - DNA, 89 bp, Reston Ebola virus (REBOV)
tccttggctgtcgaaatagtgcttggcaatattgtacttgaatacacaatatgtctcaaagatgacattaggtctgagagccttaagga

SEQ ID NO: 2000 - DNA, 52 bp, Reston Ebola virus (REBOV)
tgtttggaggattgtaacctagcacattgggttcaaagactgcatcccaaca

SEQ ID NO: 2001 - DNA, 74 bp, Kyuri green mottle mosaic virus
aacttcgacttctctgacttgccgccggtcgatatgtatacgcatatgatcaagcgacagccaaagtcgaagtt

SEQ ID NO: 2002 - DNA, 131 bp, Kyuri green mottle mosaic virus
agggacttttagagcgactcgcccaaaaagtgtctgaagcattcgaaggatgcaatgcgacgattcacgccgcgttaatgtccaccgggtggtttagatgccaggctgacgagttggtcgtagaagcccct

SEQ ID NO: 2003 - DNA, 90 bp, Zaire Ebola virus (ZEBOV)
atccaatgtagatgtgtatgttaaatactgagctggtacttcccgggtgcaacacttagttagatgaaggtgagcacgattatattggat

SEQ ID NO: 2004 - DNA, 70 bp, Zaire Ebola virus (ZEBOV)
cgattctccagtgtgaggttatgtggtggattataataatcactgacatgcatataacactgtgggattg

SEQ ID NO: 2005 - DNA, 89 bp, Kyuri green mottle mosaic virus
gactctgtgaccatgcggttagctgacaacgagtttaacctgcaaccttgcagattgactctgtctaaggccgacccggttgccgagtc

SEQ ID NO: 2006 - DNA, 120 bp, Zaire Ebola virus (ZEBOV)
gagataactagattgatgtcaaaccttgtttatgattaactgtgagtttaaaggagttagaatcacattggctatgtttaaagctccagtgtattatattatcatttgtcaagtaatctt

SEQ ID NO: 2007 - DNA, 58 bp, Zaire Ebola virus (ZEBOV)
gagcatcttgcattgtgtacttaatgatttcatctaagaactgttggcaccgcggctc

SEQ ID NO: 2008 - DNA, 59 bp, Zaire Ebola virus (ZEBOV)
gatgaaggttaatgaaaaaacactctctcagccgaggtaggtttttcttaatcttcatc

SEQ ID NO: 2009 - DNA, 122 bp, Zaire Ebola virus (ZEBOV)
gctggcttacagtgaggatttatctgtggttaaacaaattatcaagaaatatgagtatttatttattatgcttatatatctgattatgaaagcagagatgtcaagataactattgagtcagc

SEQ ID NO: 2010 - DNA, 66 bp, Kyuri green mottle mosaic virus
gggaatacctcatgatgcaagtgccgtacggttcgccgtgctatgatatcggaggaaactattccc

SEQ ID NO: 2011 - DNA, 96 bp, Kyuri green mottle mosaic virus
gttagacgtgtctaaatacgataagtctcagactgactttcatcaagctgttgagatgttaatctgggaaagattgggtttagacgacattctagc

SEQ ID NO: 2012 - DNA, 79 bp, Zaire Ebola virus (ZEBOV)
gttgtttattgagattagatcaatatgatgtatgagagcaatttatgagttttttataatctgtatgttaataaccaac

SEQ ID NO: 2013 - DNA, 81 bp, Kyuri green mottle mosaic virus
gtttatcattctaagttagttaatgcggttttcggtcctgtttttaggtacttaactagtgagtttcttagcatggtagat

SEQ ID NO: 2014 - DNA, 102 bp, Zaire Ebola virus (ZEBOV)
taacgcttgcatgtttgaatgttggcttaagtattcgcaatgagcgatgtggtagattatgaatttgagtagttaagtaatataaaaaattgtcaagtgtta

SEQ ID NO: 2015 - DNA, 77 bp, Zaire Ebola virus (ZEBOV)
tatggtgtaagatcaatttatatacagcttcgtacaatttcgatctgtttatattctctgttgtctctgcatccatg

SEQ ID NO: 2016 - DNA, 105 bp, Zaire Ebola virus (ZEBOV)
tcgaaaatcactatagggcgtaatgcttttagcaccgtagcatgttttttaactttttggattgctgtttcactatgtagcacaggatgcccccagtgtttttga

SEQ ID NO: 2017 - DNA, 98 bp, Zaire Ebola virus (ZEBOV)
tgctaaaaggagatgaagaatgcctcttggggcctaatctgaataataaggtttattcttatcagacctccgcattaatcttcatcattagtttagca

SEQ ID NO: 2018 - DNA, 69 bp, Kyuri green mottle mosaic virus
tggcaaactacttggattacttgtctgctagcttaacggctacgataggtaatctcgagcggattgtca

SEQ ID NO: 2019 - DNA, 124 bp, Zaire Ebola virus (ZEBOV)
tgggtgatagtgtatgaagcaagcatgatggcggccgtagttgagtcaaagctgtaggtcttttgatcagcgacacctagaggaagccaaattggaatttgcttcattagcactttggggcccg

SEQ ID NO: 2020 - DNA, 114 bp, Kyuri green mottle mosaic virus
tgtcgagaagcggtacacaagcaaacggtgtcctcgcgacgtgacgcattacctcaatgaggtatacgctgcgcctgtgacgacatcgagtgctgttgtgcactcggtctcgca

SEQ ID NO: 2021 - DNA, 77 bp, Zaire Ebola virus (ZEBOV)
ttttgatataagaattaagacccggtgttagattcctatctgaagtaacactgtaccaagatccttgactatcaaaa

SEQ ID NO: 2022 - DNA, 95 bp, Marburg virus
acctttgactgttggttcattatacgcagatatgtcaattattgcctctaaagtgaaagcatggcagacattccctttgaactgatcatctaggt

SEQ ID NO: 2023 - DNA, 119 bp, Marburg virus
agtggacttgtaatatctgtaatttggatagttaggttgttcaatattaatcttcttgattcaagcaaagcatttaacctatctatgttatataacattctcggtattacccggccact

SEQ ID NO: 2024 - DNA, 119 bp, Kyuri green mottle mosaic virus
cactggccccatccgcgtcaggcagatggcaaactacttggattacttgtctgctagcttaacggctacgataggtaatctcgagcggattgtcagatcctcgtggtccggggagaatg

SEQ ID NO: 2025 - DNA, 53 bp, Marburg virus
ctctctgaatcaagtcatgtttattaagttaaatcagatggcttgaaggagag

SEQ ID NO: 2026 - DNA, 74 bp, Marburg virus
gatatatgttagtaaatcaaagtaaaactaagcaagaattgtttataaaacattactatttcttttatataatc

SEQ ID NO: 2027 - DNA, 88 bp, Marburg virus
tcaagtttaagatagcttaagaatattttaatcgagtaatttacaatgaattggtgattattatcgtcgtagtcttcagtaaacttga

SEQ ID NO: 2028 - DNA, 104 bp, Human herpesvirus 5
ccatgagcagcttaaagcgtttcaaccattggaagagctgctgttcggccaccagcgcgtggctgcgatggagcggcacgatggtgaccgtcggcgactcatgg

SEQ ID NO: 2029 - DNA, 62 bp, Human herpesvirus 5
ccctgtctagactcaaaagctgtaaggctgtcttatagcatgtagtcttgcacgtcacgggg

SEQ ID NO: 2030 - DNA, 109 bp, Human herpesvirus 5
cgccgctgtcgaacatggtaaagtgcagacgcgccgcctcgcccatgtgtacgcagcctccgttgcgttccagcctggccgcgcgccgtagaccgtgttcgtagcggcg

SEQ ID NO: 2031 - DNA, 53 bp, Human herpesvirus 5
gccatcgtttttcataccacagcctgtagctgtcgtacatgaatgaggacggt

SEQ ID NO: 2032 - DNA, 83 bp, Human herpesvirus 5
gggatggggacctgtttcagcgtgtgtccgcgggcgtgcatggcttttgctcgccggccgcgctgtaaccaggcctctttctc

SEQ ID NO: 2033 - DNA, 56 bp, Human herpesvirus 5
gggtccatgaggcgggtgatgcgcccgagtgaacgggtgagcgtctcggtggagtc

SEQ ID NO: 2034 - DNA, 125 bp, Human herpesvirus 5
gtgggagtttgcggggacaacggtcgatcgacggaccgcgtagcagcaggaacaggcagccgacgggcacgacgaggctgagatgagaaagcggcggtgggtcgtcgtcccgtccccgctcgcat

SEQ ID NO: 2035 - DNA, 66 bp, Human herpesvirus 5
tgaacgctttcgtcgtgtttttcatgcagcttttacagaccatgacaagcctgacgagagcgttca

SEQ ID NO: 2036 - DNA, 127 bp, Ovine adenovirus A
ccttgatggatcttcagttattggacgaatagtggtggggtcattttcgtcataattctgtacatctagcagcgcaggaatgtttcccccaactaaatcttcataagtgatctgaaatccctcttgg

SEQ ID NO: 2037 - DNA, 101 bp, Ovine adenovirus A
gcagcaggttgaagagttagcagagtgttaatgctggggttaaaagaagagcggcttcctccagctagctgaaacactcgttctggcttcaaccgcgttgt

SEQ ID NO: 2038 - DNA, 65 bp, Ovine adenovirus A
tcaccgctagacgtgcggagctcgtgatccgaagggcaccccgctttgcaaggtggagatggtga

SEQ ID NO: 2039 - DNA, 55 bp, Ovine adenovirus A
tgctgtaatgctgcaatttaattcaacgttagaaccttgtgcagcatatacagta

SEQ ID NO: 2040 - DNA, 103 bp, Ectromelia virus
agcttggttatgatattgcgcataatttccggaggcaaatacgatagtctagattgaccatcgatgatagactctaatttattgagtgctttgtctacgagtt

SEQ ID NO: 2041 - DNA, 61 bp, peanut bud necrosis virus
aggcaaagtgaagtccattacatcaaaacagatgaacaagatgtgagaggttactatgttt

SEQ ID NO: 2042 - DNA, 72 bp, peanut bud necrosis virus
agttccagtctatgataacacaaatcataaagttaccaagctttgttagtgaaggatcattactcaagaatt

SEQ ID NO: 2043 - DNA, 102 bp, Ectromelia virus
atttatatctaagataacacagcaatagatcggatgatttactaaagtcatcaatgtggtccgttagtatatcaaagatcttgttatcgattgatagtgaat

SEQ ID NO: 2044 - DNA, 78 bp, peanut bud necrosis virus
gaagagggaaatccctatatgtgctggtggttggatgcatgcccctattgaactactgtctatcctgggtccgtcttc

SEQ ID NO: 2045 - DNA, 56 bp, Ectromelia virus
gacgtttcgcatactgcgttattatatctttctataatcgcacaatgatatacgtc

SEQ ID NO: 2046 - DNA, 98 bp, Ectromelia virus
ggtagagatactttcagtctgtggtggatgatgtcgtgaatatccgcattgtataagatgtttctgttttcaaacaccaagtcgaatactgtcttacc

SEQ ID NO: 2047 - DNA, 112 bp, Ectromelia virus
ggtttaatattttcttagtacaaaagtcaatgttttaaaatatatggatgagagaatatttgtctgtataaaaactgtgtgaaattttgtaccaaagaaaaaaacgtgagcc

SEQ ID NO: 2048 - DNA, 63 bp, peanut bud necrosis virus
gtccttgctgggagaagattgcattttgcacccaagcatagatccgatgttttcttaaaggac

SEQ ID NO: 2049 - DNA, 130 bp, Ectromelia virus
tatagcttattatctgtttgtgctaatataatatcaaatatactcttgttatcgttagttgggagattaatattacatccaatatatacgagataagacattatatcaacgttgcacgctataagcatta

SEQ ID NO: 2050 - DNA, 70 bp, peanut bud necrosis virus
tatgacttgatcaaagaattcaataagataacagaaattgatctggaatctctagaaaaattaggtcgtg

SEQ ID NO: 2051 - DNA, 54 bp, Ectromelia virus
tctatatagtatttttctgatattttctataatatcagaattgtcttccatagg

SEQ ID NO: 2052 - DNA, 71 bp, Ectromelia virus
tgatattaaacatggaatcagttgaaattaattctttgaatctagtatccttccacaatgtttcaatatca

SEQ ID NO: 2053 - DNA, 120 bp, Ectromelia virus
ttactttattaatatcagctccatattttaccaactctttaataaatttcttttcacgatgcatcttattgaatggcatcttattataagtggacatatagacgcagaagtaatgaagaa

SEQ ID NO: 2054 - DNA, 91 bp, Monkeypox virus
cggctgccatgtatttcctggagagcaagtagatgatgaggaaccagatagtttatatccatacttgcacttaaagtctacattgtagttg

SEQ ID NO: 2055 - DNA, 50 bp, Monkeypox virus
gataagatagtggtcagttcatcctttgataattttccaaattctggatc

SEQ ID NO: 2056 - DNA, 74 bp, Monkeypox virus
ggaagtcttttccatttcgaagtgccgtgtttcaaatattctgctatacccgttgaaatagaaaattctaatcc

SEQ ID NO: 2057 - DNA, 128 bp, Monkeypox virus
gtaaagtaatttcctgtccaatttgatgtacctatatacgccgttttatcggttaccatatattttgcatggtttaccctagaatacggaatgggaggatcagcatctggtacaataaatagctttac

SEQ ID NO: 2058 - DNA, 63 bp, Ectromelia virus
gtgctttaacgtcaatggtacaaattttatcctcgctttgtgtatcatattcgtctctagtat

SEQ ID NO: 2059 - DNA, 116 bp, Monkeypox virus
tgttctatatacggggatgagtagttctcttctttaattttatactttttactaatcatatttagactgatgtatgggtaatagtgtttgaagagctcgttctcatcatcagaata

SEQ ID NO: 2060 - DNA, 95 bp, Monkeypox virus
ttccagattaacagaatagatattaatgtcgtatttgaacagagcctgtaacatctcaatgtctttattatctatagccaatttgatgtccggaa

SEQ ID NO: 2061 - DNA, 94 bp, Variola virus
gtacggtttaattaccaatgttgctgctaaaccacatgtcaatctaataactggatgtttggatagtagcgttgccattctgataaacttgtat

SEQ ID NO: 2062 - DNA, 89 bp, Variola virus
gtgtcggatgaactagtccctgttagcattataacaatttcttcagaagtattgtttactaatgttattctaaaactagcatttgatac

SEQ ID NO: 2063 - DNA, 79 bp, Variola virus
tacttccttagccttcaaatctaaaatagattcacactcatgatcggatctatttacagatttaaatgtatagttggta

SEQ ID NO: 2064 - DNA, 77 bp, Variola virus
taggatttgatattttacacaactgtttaatagagtctacatttatatgttctctatcggtgagatacaaataccta

SEQ ID NO: 2065 - DNA, 55 bp, Variola virus
tatatttgactattggaatatgaaccatctcattaacctatggtacatacatatg

SEQ ID NO: 2066 - DNA, 83 bp, Variola virus
tcaatttttggtagttgaagaagtgaatatgtatcatcgtttggtcttgattgtatcataccacatacgactccagaggttga

SEQ ID NO: 2067 - DNA, 83 bp, Variola virus
tgttcttatgtcagatacaaagtttaggaatgtaggattctttgcgtatctcagtctgtgatgtctgttccatttaaagaata

SEQ ID NO: 2068 - DNA, 54 bp, Variola virus
ttggtgatggagtcacttttagttcttcagtagtactaacagtgctattatcga

SEQ ID NO: 2069 - DNA, 63 bp, Camelpox virus
tttaaactttggcatatacaagtctatacttttagtgtataacttaccacaccattttttaaa

SEQ ID NO: 2070 - DNA, 130 bp, Variola virus
ttttttaataactttttcgataagatcatgatatatattggaatttactgtattaattaattgtttgttgtttagacgatgtacaggaaactctgatgtattatttacaatagtgtcgtatagtgttaca

SEQ ID NO: 2071 - DNA, 59 bp, Fowlpox virus
gatattctacagcgggtgtaatttttgtagttactgataaacctggaaggtagaatatc

SEQ ID NO: 2072 - DNA, 96 bp, Fowlpox virus
ggaaatagagtagctgatttatttatgttttgtaaagtaatagtagaaggttcgtatttctctgttatcataagttctgaacctacgtctgtttct

SEQ ID NO: 2073 - DNA, 66 bp, Fowlpox virus
ggaggaagtactggtttatttcctaaatgttttctagcattagctgtaaatcctgtatctttttcc

SEQ ID NO: 2074 - DNA, 114 bp, Fowlpox virus
gtttggtatatcatttgagaaacatatgtagaatttattttcatatcatcaaatctctttactaaagtagcgtctgttctgaatatagattctatgtctcttcttatatcaaac

SEQ ID NO: 2075 - DNA, 85 bp, Fowlpox virus
tagactatgttctaatctatttctatctgtagtgaaatcatctttagataatactactgtagtactaatagatgattcgtgtcta

SEQ ID NO: 2076 - DNA, 87 bp, Fowlpox virus
tattcttgtatttcgtagttaaactattagtaaaatacctacatcttagggttaatctacagtaatttaactagaaaagctagaata

SEQ ID NO: 2077 - DNA, 82 bp, Fowlpox virus
tcctggtgtaaaaccaccgtcagaatttattatatttttacttattgtagacattatgctatttggtggtgtttcaacagga

SEQ ID NO: 2078 - DNA, 71 bp, Fowlpox virus
ttctagaacctatagtctcatatatgtggtcagaactatcgctactatcggatcttataggaattctagga

SEQ ID NO: 2079 - DNA, 61 bp, Camelpox virus
agacatttatgtaagtcaaaatctagactttgttttatgttttgtatttacgtgaacgttt

SEQ ID NO: 2080 - DNA, 125 bp, Camelpox virus
ataatcagaaactgtacacattttcttacatggattttcgtatttccatttatctgtttcgcagacagcatttggatccaaagaataatatcccgaatcacatgtaaatgtaactttctgtttat

SEQ ID NO: 2081 - DNA, 88 bp, Camelpox virus
atcatactttctacaaatattggtgcatatcccaagatcatcactgatccacatgcatcatatgcaggtggataattccaggtatgat

SEQ ID NO: 2082 - DNA, 59 bp, Camelpox virus
attatgccattaagtgtatctatcacccattgttgaacacatgattcatttggcataat

SEQ ID NO: 2083 - DNA, 73 bp, Camelpox virus
atttccattccatatcggtcaaccattcaggtgagagataattccatctgataaccggtagtatatctgaaat

SEQ ID NO: 2084 - DNA, 79 bp, Camelpox virus
gcgttagaagtcatttccatcaatctatcatactcgttatataacttcttgattttctgatacatagttctactagcgt

SEQ ID NO: 2085 - DNA, 56 bp, Camelpox virus
ggataatatttgtatacatctagtatttatagctgatctaaagacagatgttatct

SEQ ID NO: 2086 - DNA, 104 bp, Camelpox virus
gtaaatctataataatgtatttaggcaaatatataaaatctggatccttatatattaatagtatattatccaatatgaagtttcttacatcgttgtagatatac

SEQ ID NO: 2087 - DNA, 103 bp, Camelpox virus
gtcgccttgttcaaatttaacccagaaagatacgaaatcattctttggaaatccggatatgtcgtatgttccttctggtacatttgtatacattgtttgccac

SEQ ID NO: 2088 - DNA, 51 bp, Camelpox virus
tgtattatgttgtttatgtttagtaattgctatcatagacagtatcatata

SEQ ID NO: 2089 - DNA, 76 bp, Camelpox virus
tgttagtgtaagtaattaaagcaataaaactataggggtgagataccgctatatgtaaaaactatttatattttca

SEQ ID NO: 2090 - DNA, 67 bp, Camelpox virus
ttgaaagaatatatttcacgatatcgttagttaggctcaatggtatcccataaatgtaatcgatcaa

SEQ ID NO: 2091 - DNA, 95 bp, grapevine chrome mosaic virus
caacggtcacgaactatgtgaatgcgtttgccatcatgtgtgccactactggcatgcatgctgggaaatgcattctacatttttcctggacgttg

SEQ ID NO: 2092 - DNA, 64 bp, grapevine chrome mosaic virus
cactgggattggttaacctctctaacggtagatatccaagttctaccaggtttccgattctatg

SEQ ID NO: 2093 - DNA, 131 bp, grapevine chrome mosaic virus
cttgtgtccacatgttcatgtgttgcgagattccaaaaccagtgtttggactattgattttcacaagatttgtggtcaaagtcttaatttttctgggcgaggattctcaaaaccaacattgtgggttattg

SEQ ID NO: 2094 - DNA, 79 bp, grapevine chrome mosaic virus
gaaagacattgagataatgcttccccctcgccaaatggcaattgggaatgctggctcaataaattttccactgtctttc

SEQ ID NO: 2095 - DNA, 75 bp, Goatpox virus
gcaatagtttctacatatttttatttgataatatatagatgtatcaaataacgatattaaacttgttactatagc

SEQ ID NO: 2096 - DNA, 131 bp, grapevine chrome mosaic virus
ggaaccgagttcttctcttatggatttcaagcggaatcgcatgggtccttgccttcatatagttgaaaagagggtgaggaattcctatgtggctccaccttggaagccatggggggaggatattgatattc

SEQ ID NO: 2097 - DNA, 77 bp, sheeppox virus
taaaaacaatactgaacagataacaattaaaaacaccatctttatggctttcttattctttgtttgtgatgttttta

SEQ ID NO: 2098 - DNA, 108 bp, grapevine chrome mosaic virus
tggatagtctaagttcccaactagaggattttctagatgtcttctatgattgtgctgcacaatttgatggagagctagaattttctctatccaatgatagactatcca

SEQ ID NO: 2099 - DNA, 63 bp, sheeppox virus
tgtactaataattgtagtagctatagtggtaatattactgctactaactgttctaagagtata

SEQ ID NO: 2100 - DNA, 130 bp, Cowpox virus
acgaagttctttggcggttttcattgattcatttctgatgaaacagttaatgatccccacgcaattgtcgatattgtcccacggaagtgaatccgagaactccttcaactcgctaccaaagagctccgtt

SEQ ID NO: 2101 - DNA, 64 bp, Cowpox virus
ataattaatacaatatttagaagacttattcggaaagtattctaatacacgtatcattgattat

SEQ ID NO: 2102 - DNA, 59 bp, Cowpox virus
caatgttgctgctagaccacatgtcaatctaataactggatgtttggatagtagcgttg

SEQ ID NO: 2103 - DNA, 89 bp, Cowpox virus
gaataacggatgtcatcaaattcattgaacatttatcacaattagatgttacattcatattttgtgttatacttacatcactaatattc

SEQ ID NO: 2104 - DNA, 112 bp, Cowpox virus
gattttgtaatatgccatggaaacaaatgaaacacattatcactccatgataaattatttaatggagtaataaagtatttcgcgttgtatctccatgggtaatttcgaaatc

SEQ ID NO: 2105 - DNA, 89 bp, Cowpox virus
gtgtcggatgaactagtccctgttagcattagaacaatttcttcagaagtatcgtttactaatgttattctaaaactagcatttgatac

SEQ ID NO: 2106 - DNA, 79 bp, Cowpox virus
gtttccaaatagcttaagaaggcatttacgtatgacggagcacatgtaacacagttaccatcagaagctttaaggagac

SEQ ID NO: 2107 - DNA, 91 bp, Cowpox virus
tatctaagataacacagcaatagatctgatgatttactaaagtcatcgatgttgtccgttagtatatcaaagatcttgttatcgattgata

SEQ ID NO: 2108 - DNA, 131 bp, Cowpox virus
tatgttttatgaatagataaagtagatggtgtccttcttccttttgtaatttcccgtatttttgttcgtgccaattgagtaacagtatgagaatatgacaggcgacacaatcgttctttatgtattccatg

SEQ ID NO: 2109 - DNA, 80 bp, Cowpox virus
tcaatttttggtcgttgaagaagtgaataatcatcgtttggtcttgattgtatcataccacatacgactccagaggttga

SEQ ID NO: 2110 - DNA, 61 bp, Cowpox virus
tgttgtatatggagtaactgttggtagttcttccgtggaatcaatagtcatactaacagca

SEQ ID NO: 2111 - DNA, 62 bp, Ateline herpesvirus 3
aagcacccttcgtgttgggatttttgcaagtttggctatttcagaaatttcaacatgtgttt

SEQ ID NO: 2112 - DNA, 76 bp, Ateline herpesvirus 3
actgttgtttttaacgcatgtcatataggtgtctgatggtttgttataccctattgttttatgataaaacaacagt

SEQ ID NO: 2113 - DNA, 70 bp, Ateline herpesvirus 3
atcgcttatatgaaaatctggacatgtctcacagttagtgatcatagctgtgatgttagcatatgtagat

SEQ ID NO: 2114 - DNA, 58 bp, Ateline herpesvirus 3
atgagagctttatttgtcatagttaagccaataataaccggctcaaaaaagttcacat

SEQ ID NO: 2115 - DNA, 56 bp, Ateline herpesvirus 3
cctcactgaaagagtagtcatgtcaatctttttatggactgcttttacattaaagg

SEQ ID NO: 2116 - DNA, 58 bp, Ateline herpesvirus 3
ctttataaactctttattcaaagcatgtattttgtcccaatatgtggagtttataagg

SEQ ID NO: 2117 - DNA, 61 bp, Ateline herpesvirus 3
gactgacataaaacaactatcttttgtgtaaaatggggcatataggtcttttatgtcaatc

SEQ ID NO: 2118 - DNA, 120 bp, Ateline herpesvirus 3
gagatagtaactttaaagacctcatgttcatctggatcatacctggataagattttctttttaactaattctgtctggtaagagcatcgtgggcccaatttctcgtttaaagcctgtttc

SEQ ID NO: 2119 - DNA, 77 bp, Ateline herpesvirus 3
gtgtctgttatatgtataaaaattgcccagttgaaataaatatgttttttctctcaaagatgcttcggtggccgcac

SEQ ID NO: 2120 - DNA, 64 bp, Ateline herpesvirus 3
tggcctggcaactggagtggcaggaggtgctatttcttcgttgttgcttattgagaacaggcca

SEQ ID NO: 2121 - DNA, 96 bp, Ateline herpesvirus 3
tgtgtcgggtgttccaacttgccaaaagacacaagaaatttgaattattaaatctccttcatttttggcacatggaaatcctttttcgcctataca

SEQ ID NO: 2122 - DNA, 102 bp, Ectromelia virus
actgtcgagtactaaaaggaaacaataatgtagtgtgattttatcctacttagattttatattttaatagtgtttataagattttttagatatgtggacagt

SEQ ID NO: 2123 - DNA, 53 bp, Ectromelia virus
ggtataggatgttgattagatgaatgcatatgcacataacagcgttctttgcc

SEQ ID NO: 2124 - DNA, 75 bp, Ectromelia virus
gtagctatataatgtatggtaacatgataatcatattatatcaagatcataattaattacatttagatagtttac

SEQ ID NO: 2125 - DNA, 89 bp, Ectromelia virus
tagttattgtagcatttatactattaatgaacaaaactgtgagaattatagctctcatggtgttgtttgttatttgactacggtcactg

SEQ ID NO: 2126 - DNA, 60 bp, Ectromelia virus
tcaagtattatatcttaattagtgttaaaatacattctaatacggtcctgtagtatctga

SEQ ID NO: 2127 - DNA, 121 bp, Ectromelia virus
tcatatagataatattatccatgacagccactgcgaaactacacctatatccacgtgaagatatcatttcccatgtattttttttacgattgtagcagtttatggaaatcttatcacgtga

SEQ ID NO: 2128 - DNA, 68 bp, Ectromelia virus
tcctttttggtatacaatctcgacaatcttcagtctgtgaagaatcagtagcgcaataccaaccagga

SEQ ID NO: 2129 - DNA, 75 bp, Ectromelia virus
tgagagagtactggtttcatgtttctactaaagaaggcaaactcgttattttttttatgaacttgtactctttca

SEQ ID NO: 2130 - DNA, 86 bp, Ectromelia virus
tggggattgtggtatatgtatgaggtaggcagcgttcacattttgtgttatcactgccactacatctgaccttggcaaattctcca

SEQ ID NO: 2131 - DNA, 64 bp, Ectromelia virus
ttcagcagtggatccgttagctccataatacaatattgtcaatactgacgagattgacgctgaa

SEQ ID NO: 2132 - DNA, 97 bp, Rana tigrina ranavirus
aagtggaccgggaggaccgaggaagagtctttcctgatctctgacatgatgggtcagatcaagacaggttggattagatctgggcccccgtcctctt

SEQ ID NO: 2133 - DNA, 73 bp, Rana tigrina ranavirus
aggtccctgactgccgaggagcaggccgaggagagggcggccatggccttggacccttcggcgatgggggcct

SEQ ID NO: 2134 - DNA, 98 bp, Rana tigrina ranavirus
agtgagatactttctgagagataatacatcttactccacatttttactctcctaaaccattatagtgagatactttctgagagataatacatcttact

SEQ ID NO: 2135 - DNA, 65 bp, Rana tigrina ranavirus
ctatgggtcccctccctccgtctgtcacgtagaaaccgaggacagtgcccattgggttcttgtag

SEQ ID NO: 2136 - DNA, 106 bp, Rana tigrina ranavirus
gacaatgatcctgtcagattcagggtcgcagacaaacctgtccactggcgtaaacatgcctgcggtagagtcgtctctgacattgtagtctgaaggatctatagtc

SEQ ID NO: 2137 - DNA, 76 bp, Rana tigrina ranavirus
gcctgagggccatggtcaaggcgtctggaaactggccatccactttggccacagccgccgtcgccatccccgaggc

SEQ ID NO: 2138 - DNA, 64 bp, Rana tigrina ranavirus
gctttggtgtcccagacgccagctggcttactgctctcaccggcgattggcccgacgccaaggt

SEQ ID NO: 2139 - DNA, 54 bp, Rana tigrina ranavirus
gtaaacggcctccctgttcttggaatgcttcctcagaactcccaggtcgtccac

SEQ ID NO: 2140 - DNA, 68 bp, Rana tigrina ranavirus
gtggacttgtcctgaaactttctgagagattagacaacatttatagaatgtcttgagatatagtacac

SEQ ID NO: 2141 - DNA, 69 bp, Monkeypox virus
gaattttgtgttggtgcaagacttaagatatttatttatagtctgtgtatcaattctgacacatgattc

SEQ ID NO: 2142 - DNA, 72 bp, Monkeypox virus
ggtcgtgtagcgcgatagagatagtctaatattaatattagatattagatatcagatatccgtaacactacc

SEQ ID NO: 2143 - DNA, 54 bp, Monkeypox virus
gtcgaggtagtctcatcaccaggtttatacaccttgatgaatctacatgcgtac

SEQ ID NO: 2144 - DNA, 93 bp, Monkeypox virus
gtgattcatttggcatagtacgtactatatcatcgaactgtataacggtgcatcttgtaaatagcctgtatatattatgtaatatggtgttac

SEQ ID NO: 2145 - DNA, 75 bp, Monkeypox virus
tgagagagtactggtttcatgtttctactaaagaatgcaaactcgttattttttttatgaacttgtactctttca

SEQ ID NO: 2146 - DNA, 62 bp, Monkeypox virus
tgttactgaatttaatatatgtatgagatgatccaagacgtgtttgttgagtatcggtgata

SEQ ID NO: 2147 - DNA, 60 bp, Camelpox virus
aataggtaatatatatcttttgccgtatctattatacctgatataagcgatatacctatt

SEQ ID NO: 2148 - DNA, 57 bp, Camelpox virus
aatgttgctgctaaaccacatgtcaatctaataactggatgtttggatagtagcgtt

SEQ ID NO: 2149 - DNA, 87 bp, Camelpox virus
actatactttggtaggtggatacgatatattataaagatcgtaaattgtcaacatgtataatatttcatataatttctgaaggtagt

SEQ ID NO: 2150 - DNA, 118 bp, Parsnip yellow fleck virus
cataggacaaacggcagtgaaatgtgatgatcttgggcaggacttgtcgaaaggcttttctcctacctataaccagatcatacagatgaagaccaacaactgttttatagtgcctatg

SEQ ID NO: 2151 - DNA, 119 bp, Camelpox virus
cgaatgtataaggaggttgctgcaacactttagattctatccatatgtctctatattctatatgaatatatgacttacatggatcatagtcaggccagtcgcttttccaaatatcttcg

SEQ ID NO: 2152 - DNA, 86 bp, Camelpox virus
ggatacatttccatgtatctatctaactctgatttcttttcccatgtttgtgtagatacatcattagttatcggagacatgtgttc

SEQ ID NO: 2153 - DNA, 68 bp, Parsnip yellow fleck virus
ggtgttgagtattatgagccattgaatatgtccacaagtgaagggtatcctttgatactcaacaggcc

SEQ ID NO: 2154 - DNA, 105 bp, Parsnip yellow fleck virus
gtcaaaactctatgtgaattcaaggattatatttacaggatgatagttggggggataacaccaacttcttcatatgtgaaagtttctggtcttactggttttgac

SEQ ID NO: 2155 - DNA, 69 bp, Camelpox virus
tatatcgaagataggtagatatggaagttgatccaccaacgatcttatcacattcttatctacgatata

SEQ ID NO: 2156 - DNA, 115 bp, Parsnip yellow fleck virus
tctccctagccatgtaggtttgcttaaagaagccaccaagaaccatttttctgctttgacagggcaggaagaaataaaggctatttttgaggagattgacaatgggaatggggga

SEQ ID NO: 2157 - DNA, 130 bp, Parsnip yellow fleck virus
tgataccaggaagcacgaatcacatgaggttcacattgctaaatcctttgaatccggatgaaagaataatgaaatatccagcaagaatgaagtacgtggatttcctttgtgtttgtgttgccgaggcccg

SEQ ID NO: 2158 - DNA, 67 bp, Parsnip yellow fleck virus
tgatgaggaaataatggccaccacttttgagccattaaaagatagggctgagattactcctaccgca

SEQ ID NO: 2159 - DNA, 123 bp, Parsnip yellow fleck virus
tgtcaaccaagctaatagaggcttccacttcaatcttatccaatgcagcaacaagagcaatttcaactctttttgatgttatgatagggaaagtgaggggtgtcctttcttctctggtagaca

SEQ ID NO: 2160 - DNA, 128 bp, Rabbit fibroma virus
agatggaatccccacctaggtgttataaaacatattattggttatgatttctggatagttattttgtaaacatgttttactcttttcaccggattgtgttttcttaatacttaaacaacatccgtact

SEQ ID NO: 2161 - DNA, 105 bp, Rabbit fibroma virus
gaggttcatgacaaaattcctactgtattatgtacgatggattttaactagcacatgattcattagtatcgtactcgtttttcgtagagacatgttatgtacctt

SEQ ID NO: 2162 - DNA, 113 bp, Rabbit fibroma virus
gatgtgtggcggaggttgcgggtcatttcactttgtgtcattgtcgtcattcgttcgtttggaacacacagatagttcacggggaacttattcatcgtcaatcgatacacgtc

SEQ ID NO: 2163 - DNA, 65 bp, Rabbit fibroma virus
ggaacatcttaaactgataatctgttagattttctaacacggttataattacacctcggtgttcc

SEQ ID NO: 2164 - DNA, 68 bp, Rabbit fibroma virus
tacctgaaaaagagtgagtgatttattaaagagacgtgtatccgtttttctttcttctggttctggta

SEQ ID NO: 2165 - DNA, 121 bp, Rabbit fibroma virus
tcgttttcattttgttttgttttttatatcttgcccatttgatgatgaattccaatataacgtcttccttagagacgtttacctcgtcgtctttaagtatgttattcagttcgaaatacga

SEQ ID NO: 2166 - DNA, 91 bp, Yaba-like disease virus
agaatctgaataagtaacgttgtttataccctttacatatccacctaactttgtgtaatatttatagttattagttatttcttttccttct

SEQ ID NO: 2167 - DNA, 60 bp, Yaba-like disease virus
gaaactatagcagttgcctctttttgagatgcaaatctcacagaggttcttctagtgttc

SEQ ID NO: 2168 - DNA, 55 bp, Yaba-like disease virus
gagtgtgagatacccaaccatgttttgatagactttcaacacaatcaacacattc

SEQ ID NO: 2169 - DNA, 89 bp, Yaba-like disease virus
gctattaaacctaatacaaatataaaacaaattattgatagtaaaattattatagtgatgatgttttgttgtgtgttatagttagttgt

SEQ ID NO: 2170 - DNA, 87 bp, Monkeypox virus
atagtttacaacactttaattcttgtgtattataatatgagacacattgttcacatttcatagacacaacgaatttgtattaataat

SEQ ID NO: 2171 - DNA, 59 bp, Camelpox virus
caatgttgctgctaaaccacatgtcaatctaataactggatgtttggatagtagcgttg

SEQ ID NO: 2172 - DNA, 100 bp, Monkeypox virus
gaggatacctatcacagacatcggatggtatagatttagtggattctggttcaccaggcgtcgccatttttagtagttgcatatcactgatgggtacctc

SEQ ID NO: 2173 - DNA, 66 bp, Monkeypox virus
gatatcgggcgaactgtttagataattatcttcttcttttattataatagcacttacgtttttatc

SEQ ID NO: 2174 - DNA, 89 bp, Monkeypox virus
gcgatatctaacagattaccatctatattaacacttgctatttctctaccctctgaagtcaatgcctttgctaatctgtttatagacgc

SEQ ID NO: 2175 - DNA, 69 bp, Monkeypox virus
ggatatgtacaaatagtcgattatatcttttacaatactattagtccctattgtgttatctatatatcc

SEQ ID NO: 2176 - DNA, 89 bp, Monkeypox virus
gtgtcggatgaactagttcctgttagcattagcaaaatttcttcagaagtatcgtttactaatgttattctaaaactagcatctgacac

SEQ ID NO: 2177 - DNA, 67 bp, Monkeypox virus
gtgtctgaatcgttcgattaacccaactcatccattttcagatgaatagagttatcgattcagacac

SEQ ID NO: 2178 - DNA, 73 bp, Monkeypox virus
tacctgattactatcacatcttccgttacaacttagacaagcctgtaaatgattattgtgagatgtaaaggta

SEQ ID NO: 2179 - DNA, 66 bp, Cowpox virus
tctaatggaagttttgataggagattgtcatcagttgatacattgtttattatctcatctattaga

SEQ ID NO: 2180 - DNA, 95 bp, Monkeypox virus
tttttcttagtacaaaagtcaatgttttaaaatatatggacgagaattaatttgtctgtataaaaacttgtgtgaaattatgtactagagaaaaa

SEQ ID NO: 2181 - DNA, 81 bp, Yaba-like disease virus
gcagtatttgttaactttgtttaacgaaatgatcatggtagaaatattaggtctgttaattataagttcgttaaaaattgc

SEQ ID NO: 2182 - DNA, 97 bp, Yaba-like disease virus
taggcacgtttgggtaactttttttaaaaatattaacgtgctgtattacatcttgtatgtaaacgttaaaagaagttacacttagccgttttccctg

SEQ ID NO: 2183 - DNA, 87 bp, Yaba-like disease virus
tattgtaattttttaattgatatggagttacgccatatttgttaacgttatttatatcaactccttcttcaatcaaaaagttagata

SEQ ID NO: 2184 - DNA, 112 bp, Yaba-like disease virus
tccaagaagaaattaataatctaaccttaacacctctattaatagttgcacaaataatctcattataaatatctggccaatacgttgttttattatcttctcttattatggg

SEQ ID NO: 2185 - DNA, 122 bp, Yaba-like disease virus
tgatcattttacaaacttttgttgatactatgcttattatatcataaattaaacgtacattgcacccgtaaaattcttcgcgtaatatctttagtaattcgttaagatttggtcgttgatca

SEQ ID NO: 2186 - DNA, 126 bp, Cowpox virus
aaatagatgtttcgttgtatatagtacgatagttaatatcaataactcctttggataatagataatctaaagattcaacggcgtcaaaaattattaaatgacgaactatatgttcattatctattt

SEQ ID NO: 2187 - DNA, 109 bp, Cowpox virus
aaatgagtatttttctttaactggttgacacgatccgtgttctaatcgaagaggttggcattccgcattaggacacgtaacagtatcattccaagaagtatttccattt

SEQ ID NO: 2188 - DNA, 95 bp, Camelpox virus
ggatattttagctctggtatatcatatatccaagaatttgtacatgtattgtacgctataacctttgaacttctatacggggactgatcatatcc

SEQ ID NO: 2189 - DNA, 75 bp, Cowpox virus
tgagagagtactggtttcatgtttctactaaagaaggcaaactcgttattatttttatgaacttgtactctttca

SEQ ID NO: 2190 - DNA, 79 bp, Cowpox virus
ttgtctatatgatacacaaattgttagttattgtatatagttaccttaccctaattgtttagtcattgtctatagttaa

SEQ ID NO: 2191 - DNA, 72 bp, Cowpox virus
tttgattctacatatttcaatgtgtggaaatctagtccacttgcctcttgatcacaatatacagaaatcaaa

SEQ ID NO: 2192 - DNA, 124 bp, Cowpox virus
tttttttacgattgtagcagtttatggaaatcttatcatgcgaattacttataccgatagatatcaactcgatgctatggtatctaggaaatgattcatccaagaatgctatattgtttaagaa

SEQ ID NO: 2193 - DNA, 85 bp, Myxoma virus
accgatccaacgtgtcttgcctgacgacttgtatatcatactcgttttatatctcgtcgttggtataaaaaaatggatacgcggt

SEQ ID NO: 2194 - DNA, 68 bp, Myxoma virus
cggcgcggcttttccaatgctgaagatagtccattgtggacatgtcacgtacgaattttgccgcgtcg

SEQ ID NO: 2195 - DNA, 119 bp, Myxoma virus
gacggagagtcctcctccgacgatcgtgtggtaagtacttccgatcacgaaaccggttagaaacgattcgtcgttttcgtcgtactcgtattcctcgctaagatcgtcgggctgctccg

SEQ ID NO: 2196 - DNA, 55 bp, Myxoma virus
gatcgcctatggcgcgtttacgtatgtacgtcacgcgtttactccatagggtgtc

SEQ ID NO: 2197 - DNA, 68 bp, Myxoma virus
gattccgactcgtacgccgagtcaggagactcgtattcagaatcacctggttcgtagtagtcagaatc

SEQ ID NO: 2198 - DNA, 64 bp, Myxoma virus
gttgtcgctttcgttgtagacgtatcggaacgtccatagtccgatatctcgacacgcgcacgac

SEQ ID NO: 2199 - DNA, 76 bp, Myxoma virus
tcgggcgaggtaaagtctccattaaacagacgatagaagtaatccgagtgaagagataaaataactttatgcccga

SEQ ID NO: 2200 - DNA, 87 bp, Myxoma virus
tcgtccgtacacggaaacagtcgatcgcagtaatcgacgtaatccgttttcttatcgttcagtcgatgtattccgttaaatcgatga

SEQ ID NO: 2201 - DNA, 71 bp, Ectromelia virus
aacagattaccatctatattaacacttgctatttctctaccctctgaagtcaatgcctttgctaatctgtt

SEQ ID NO: 2202 - DNA, 70 bp, Ectromelia virus
acctataatgtatatgtattgatcgaatacacacatgccgtagctcgatattgcatcgggcatatcaggt

SEQ ID NO: 2203 - DNA, 55 bp, Ectromelia virus
cgcagttgatctaacctgttggttaatagcctgttgaccagttagtaacattgcg

SEQ ID NO: 2204 - DNA, 72 bp, Ectromelia virus
gatgactgtcgttagatgtatagttggctatccataagtcaccgtttttaacacgtctattaagaggtcgtc

SEQ ID NO: 2205 - DNA, 90 bp, Ectromelia virus
gtacttattaatcatttgactctgccaaataataggtctattgttcgtaagaacataatctattatatggttagtcagtgagcatatgac

SEQ ID NO: 2206 - DNA, 89 bp, Ectromelia virus
gtgtcggatgaactagtccctgttagcattagaacaatttcttcagaactatcgtttactaatgttattctaaaactagcatctgatac

SEQ ID NO: 2207 - DNA, 124 bp, Equine herpesvirus 2
acagattaccgacccataaagtttttaattatgccactctttacagtgtgaaatcatgcagaactaatcacacatgatttcacactgtaaagaatggggtaactttctagggttgttaagctgt

SEQ ID NO: 2208 - DNA, 130 bp, Equine herpesvirus 2
cacccgcttgcgcagttaagaggtagtggtgttaatccataaataaattatgtaaacagtagtagtgggtgagtagtgttttagaggttatttacattagtgtcaggtgaggtatgtgagtcgattggtg

SEQ ID NO: 2209 - DNA, 59 bp, Equine herpesvirus 2
ggggggtgcagtactattactctttactttgttgttgtttgaggagtattgcacaaccc

SEQ ID NO: 2210 - DNA, 83 bp, Equine herpesvirus 2
ggtaggattagtggggggtgcagtactattacttattatgctattatttagttagtattgcacaaccctcatctttttaggcc

SEQ ID NO: 2211 - DNA, 83 bp, Equine herpesvirus 2
gttaaaagaaatagcaagtcagatattgccaagtttaacagtaacatgttagtgaggtttttgatcttcatgtatcttatgac

SEQ ID NO: 2212 - DNA, 114 bp, Equine herpesvirus 2
ttaacaacattaggaacgaaaagatttaagtctgcaaggatactacaaattaattgtggtgaccttttgtagtatccttgcacagtttattctttttgttcttaatgatgttaa

SEQ ID NO: 2213 - DNA, 60 bp, Equine herpesvirus 2
ttgtgtgttgtgtttggggtgatagacacattgtatattccaaaaacacattccacacaa

SEQ ID NO: 2214 - DNA, 85 bp, Equine herpesvirus 2
ttttgtctcttacattagttacttcaatatagacttacttcaaatcctgaaaagtacctctaagaataattcctaaaagacaaga

SEQ ID NO: 2215 - DNA, 106 bp, Potato aucuba mosaic virus
gaatcgctaggcgcaaaccacttgtttatcatttccaagaagaatctgatcactccaaagattagatcctttaagaaagatagtcatgtgcttttgcctcagattt

SEQ ID NO: 2216 - DNA, 72 bp, Potato aucuba mosaic virus
gtggagcctgagaaggtgtctgaaatatgctaactgtagaagtgtagctattgctagacatttgggtaccac

SEQ ID NO: 2217 - DNA, 81 bp, Potato aucuba mosaic virus
ttgtatgatcctgatgaactaactcacattgcgaactacttctatgtagtatcccatctgagttgtgtcaatgatcatcaa

SEQ ID NO: 2218 - DNA, 116 bp, porcine epidemic diarrhea virus
aaaattaacagcatcctccacataacttggtgctttgaactgtaaggtgcaagtgatgcaacacttatcacctctcactacgcagctgtaagttttataaggagtgttgtaatttt

SEQ ID NO: 2219 - DNA, 67 bp, porcine epidemic diarrhea virus
acccaaccaacctctaacattgcgcatggcaaagtcgcgtgtgcaaaagagagtgtggtggttgggt

SEQ ID NO: 2220 - DNA, 81 bp, porcine epidemic diarrhea virus
agatgcttaacccaatccaaaagcacataaaacaccttcttatattcagggttttcatgcttagataacgggtaggcatct

SEQ ID NO: 2221 - DNA, 60 bp, porcine epidemic diarrhea virus
cgagggctaaaatcagcggttgttctaccttgggtaaaatagccatcaggatagtcctcg

SEQ ID NO: 2222 - DNA, 125 bp, porcine epidemic diarrhea virus
ctcataacatttgcgaaccattggaccaactctaccagcactaaaaagttccattgcagggtcatcaacgatgccaagcaattgtagctgcaccaaggtagaagtaacccaacaattgttatgag

SEQ ID NO: 2223 - DNA, 80 bp, porcine epidemic diarrhea virus
gacctattgttgccattgccacgactcctgctacgcgaatttgcacgtgaagcaggaggtgtgttaggttcaacaatctc

SEQ ID NO: 2224 - DNA, 58 bp, porcine epidemic diarrhea virus
gcaacagcagcattaaaggtatccaatggtacatcatcaaaacccaatgtgctcttgc

SEQ ID NO: 2225 - DNA, 112 bp, porcine epidemic diarrhea virus
gccatcattgtccttgatatcaattatattccaaatggtaccagcgtagtggacacatccctcacgctggatacgattataagaatcgatatcagaggtaacaatgttaagc

SEQ ID NO: 2226 - DNA, 79 bp, porcine epidemic diarrhea virus
gctagctcacgaacagccacattaccaccaaagagcaatgctgcaacatttggtgctaaactggcgatctgagcatagc

SEQ ID NO: 2227 - DNA, 122 bp, porcine epidemic diarrhea virus
gcttagagcctaagatcatggctgaaatcatgcgtatcatattgggcagtgctctatcgcactttgggtaatcccaacccataagacacggattttcaacaccatcaataaggttcttaagc

SEQ ID NO: 2228 - DNA, 104 bp, porcine epidemic diarrhea virus
gcttgcaaaaatcccacattgtattaagaccagtgataaaagaccgccatatgctaccaccatcaatctcttcaagcactgctggacactgtgggattgtaggc

SEQ ID NO: 2229 - DNA, 94 bp, porcine epidemic diarrhea virus
ggcttgaagttgtggataaaatgtctggagtttatgatccttacaccacaacatccacctccacattttacaatcaaccataacttcatgaacc

SEQ ID NO: 2230 - DNA, 70 bp, porcine epidemic diarrhea virus
gtaagcatagagttaacttcaacagactcaagcctagcgctgagttgtaatgctgactctatggtcttac

SEQ ID NO: 2231 - DNA, 120 bp, porcine epidemic diarrhea virus
tccaactatgccatctccttctgccttaatggagcgctgcttcagcttaccaggaataatctcattattctggagcttaacaatacgctcacacccaaggaccaggggccatgacaggga

SEQ ID NO: 2232 - DNA, 104 bp, porcine epidemic diarrhea virus
tgcccttggtataaacatcaatggcctttgctatgccgccaccatgagacaacttctcatttgcagcattaacaacaaagtcacatggaagtttaacaaggtca

SEQ ID NO: 2233 - DNA, 102 bp, Transmissible gastroenteritis virus
acattcaacttttgtgacttcttgatgagatctatcagtggcgtaaacagtttgtttaacactattactgagatcacgtacaatttcgtcacagatgaatgt

SEQ ID NO: 2234 - DNA, 59 bp, Transmissible gastroenteritis virus
caatcaatttagcactaagaatcatagcgtcatatgcgttcttaggtgcagaaaggttg

SEQ ID NO: 2235 - DNA, 98 bp, Transmissible gastroenteritis virus
cattgttgacagccatttcaaatgtagaaaatgaaacattaagattgcaagccctgtaacattcgtcaagatttttgcattctgagacatcaacattg

SEQ ID NO: 2236 - DNA, 99 bp, Transmissible gastroenteritis virus
ctatcattatgtgtacaacaaccaacatgcttagaacctaatatcatggcagaagccattctaatcatattaggtaaagcacggtcacacttaggatag

SEQ ID NO: 2237 - DNA, 68 bp, Transmissible gastroenteritis virus
gtaacattgacagggatagaacaagagaagaaattctcaatagtttgcctctcctggtcagtgtatac

SEQ ID NO: 2238 - DNA, 89 bp, Transmissible gastroenteritis virus
gtgaagtctcacactagacatttcattttcatagttgataacacgtgtggtatcactagcaataacatgtctagggcaaatgacttcat

SEQ ID NO: 2239 - DNA, 79 bp, Transmissible gastroenteritis virus
gttcaagaacaccagttacaatttcattgtcaaattcgaattcaagtttaacacgtgtaacaggtgcaatttcttgaac

SEQ ID NO: 2240 - DNA, 79 bp, Transmissible gastroenteritis virus
tgcagtcataatagggtagaagaaagattttactttaccagcctgaagatttacaccatacatttgccttatgacttca

SEQ ID NO: 2241 - DNA, 75 bp, Transmissible gastroenteritis virus
tggacatatcaagtttcttaagcataccaaaaagtaggctatgcatagcagaaacaatctttgactttctgtcca

SEQ ID NO: 2242 - DNA, 74 bp, Oat chlorotic stunt virus
agttttgtcagtgcaggccggtgtttgatggtgttaaatacaccatgtgccggaacccccgcactgccattgct

SEQ ID NO: 2243 - DNA, 93 bp, Oat chlorotic stunt virus
ctgttagtaccttttcttccctcgaccgctccgatgtcacatcagcaatttgttgatagcacgccgagccgcaagaggaaggtgtaccaacag

SEQ ID NO: 2244 - DNA, 61 bp, Oat chlorotic stunt virus
cttctcagaaggcttgtttgaatggttcctagaaatgggattcaacatggccatcgaggag

SEQ ID NO: 2245 - DNA, 125 bp, Alcelaphine herpesvirus 1
aaccatgcgtttttttgactcagtagctcaatcgagaaaggcactcctcaccggttgtaatatatttttcctgtgggtctagtgtccttccgagagctcctgagttcatattcatcagcatggtt

SEQ ID NO: 2246 - DNA, 81 bp, Alcelaphine herpesvirus 1
agttgcttgttggaaaagctatgtttcaaatacgtttgtaattaaataatgtatttgaaaatagcttttccgcaagagact

SEQ ID NO: 2247 - DNA, 69 bp, Alcelaphine herpesvirus 1
cagtataacagcaggccaactgccactggttcacaggtgcgcagcttcactggctggttgcttatattg

SEQ ID NO: 2248 - DNA, 64 bp, Alcelaphine herpesvirus 1
ccagtggttgccataccagtaaaagtccaccatttgtgagatagtattgtgcggttccatttgg

SEQ ID NO: 2249 - DNA, 81 bp, Alcelaphine herpesvirus 1
ctcatagtaaggtagcttgtgtgttgtgtctgtggacataaagaagaatagacacagcccgacaagctattttaaaatgag

SEQ ID NO: 2250 - DNA, 70 bp, Alcelaphine herpesvirus 1
gacactcaatatcaaatgagagaatgttgtattgtggccagtctagtctctcagcatggtattgaatgtc

SEQ ID NO: 2251 - DNA, 52 bp, Alcelaphine herpesvirus 1
gatagtttgggggaggcctttgttttacatataatggctcagccaaactatc

SEQ ID NO: 2252 - DNA, 84 bp, Alcelaphine herpesvirus 1
gcagattttgttgtgtcagttacagcaggaattgttaattaaaaaaaaacattccgggctttaactgacaagcataagatctgc

SEQ ID NO: 2253 - DNA, 81 bp, Alcelaphine herpesvirus 1
ggcaaactcatattagttacattgactggtaataatgtaattgtattgttaccagtttttgtaccagtacgagtcaatgcc

SEQ ID NO: 2254 - DNA, 88 bp, Alcelaphine herpesvirus 1
ggcgcacgcatgttgagcaccatcagtagttatgtgttggtgttaggaatacaataactgctgacagtgcaagtatgcgtgaaaagcc

SEQ ID NO: 2255 - DNA, 131 bp, Alcelaphine herpesvirus 1
gggtgggaaaatgtgaaagcgtgcgaactgagggaaaagtggttggttaaggtggctttttgaaagttttcctgccccctgcccccacagtgcctctgttaaacccttgcagtgtttcatgggtcctgctt

SEQ ID NO: 2256 - DNA, 131 bp, Alcelaphine herpesvirus 1
gtacctcaagctggatgtgaccatgttgcgtctattatgttggcacctgggttattacatgtatataagtgattccatgtaatagcactgtgtgctacatgaaattcgcacacttgcttctagagaggtat

SEQ ID NO: 2257 - DNA, 87 bp, Alcelaphine herpesvirus 1
gtgggatatgtgttaaagcaggctatctctcacctgcatttggaaggcaatgcaagtgcaagtggcctgcctcaacacaaaactcac

SEQ ID NO: 2258 - DNA, 94 bp, Alcelaphine herpesvirus 1
gttctcgtggcagatctcaacagctgtggtagtgagcaatatttcattgttgacacccaattggcccttgtagaggtggctgtcattgatgaac

SEQ ID NO: 2259 - DNA, 78 bp, Alcelaphine herpesvirus 1
gttctgtgtaagatagattgggttaggatctgtgtgtggtaaaacggagatccttgctcaatctgtcttgtgcagaat

SEQ ID NO: 2260 - DNA, 107 bp, Alcelaphine herpesvirus 1
gttttcccgccagttgaaaaaatgttaggaccactaccctctctttttagaagttgttggttgttatccaagtttattttttttactggtcatttttaagggactgc

SEQ ID NO: 2261 - DNA, 81 bp, Alcelaphine herpesvirus 1
tatgtagtctgtagacagacagtgagcgggtgcgggagtttaaggagcgcaatccactccctgtctgtcactagacacgta

SEQ ID NO: 2262 - DNA, 69 bp, Alcelaphine herpesvirus 1
tcctaatcagacggcttgtgcataagctttttattaattttaagcttatgcacggctacctggtaggga

SEQ ID NO: 2263 - DNA, 83 bp, Alcelaphine herpesvirus 1
tgctcatctcgtgctaagagctcttggcgaaggctctgtgtactaaaaagatctttgccaagtactctggtaggagactggca

SEQ ID NO: 2264 - DNA, 112 bp, Alcelaphine herpesvirus 1
tgttttgagtgggcctgctcattcacggtgcagtaactgatatagaagtaataaatgtcttctataacggaacacctgcatcggcatgcgcactgcccatggatcacctaca

SEQ ID NO: 2265 - DNA, 131 bp, Alcelaphine herpesvirus 1
ttacccaaaacccaccaggtagctttatgcatgtagacaacttcttgagattcttatctgagagtatacgagaaaaaaaatgtctttcagcgagcaaaaagtgagcattggcaatatgggttccaggggcg

SEQ ID NO: 2266 - DNA, 77 bp, Alcelaphine herpesvirus 1
ttcgtgttaggctagtctggacaaaacactgttttacattaaaaaaggactgttttgtacaggctacctagcaagag

SEQ ID NO: 2267 - DNA, 131 bp, Murine hepatitis virus
agaattgcattccttttgtttctctttcttcgtcaaattgggccacagtgcagtgcggaatccagtgtctggattgatctgccgtgcaaccccttctgcggagaatttcaacaatatcttcatgcaactct

SEQ ID NO: 2268 - DNA, 58 bp, Murine hepatitis virus
agtagcaccggttgtgtagccagagatctgactctctgacaacacaggaggtaatact

SEQ ID NO: 2269 - DNA, 92 bp, Murine hepatitis virus
atgtccccaggccttgtgaaacttcaacggtctcagtgctaatgcttggagcactaacattagcaccgtttgaattcacaagctggatacat

SEQ ID NO: 2270 - DNA, 91 bp, Murine hepatitis virus
caaatcaacacatacaacccttcattctacacacggtacgaaaatagatgctattatcgtgcacatgtctgaagaagtaggtgtttctttg

SEQ ID NO: 2271 - DNA, 60 bp, Murine hepatitis virus
gacagtattgcagagttggaggcatactcagttgccgtacccgcctgcaatctcactgtc

SEQ ID NO: 2272 - DNA, 83 bp, Murine hepatitis virus
gcagacagtccatattagcctgcacaaagacacgagcatcatcatccaattgtatatcatgtcgcagcgcttcaacttcctgc

SEQ ID NO: 2273 - DNA, 107 bp, Murine hepatitis virus
ggataatagacttgggcacgctcttaactagtttgtccacaaagcattggtcatagccggccttgtaagacaaccagagcttttgcatctccaagtctttaaattcc

SEQ ID NO: 2274 - DNA, 68 bp, Murine hepatitis virus
gttaaagtattgtctttgcaaatggaggcgggctttgcattacctccataggcataagacacattaac

SEQ ID NO: 2275 - DNA, 87 bp, Murine hepatitis virus
gtttgtaagagctaaatcagccatacgttccagcttacgagcaacagctctgtcgcgctcatatgctgacttagcaatattacacgc

SEQ ID NO: 2276 - DNA, 67 bp, Murine hepatitis virus
tctttatatattctaaatatacccggaacacattttgatactctgggttctcatggtatactaaagg

SEQ ID NO: 2277 - DNA, 76 bp, Murine hepatitis virus
tgataatgcctcataatagagcctggcctttccaaatttattaaatggatagccagcactcttatcataattatta

SEQ ID NO: 2278 - DNA, 94 bp, Murine hepatitis virus
tggtacgttaaattgggtgcaatgcacaagtttactaccgcacgtacatgcgatattataacccctgacaagatcacctttatccaacgtacca

SEQ ID NO: 2279 - DNA, 119 bp, Murine hepatitis virus
ttagcaaaaatttggcagcgatcattaacaaggcaggtatcatgtgaccatccaataaatgaattgttggcacagatacaacccttatgtggatcagcattgccacaattatcttctaa

SEQ ID NO: 2280 - DNA, 121 bp, Murine hepatitis virus
ttggtctccctcacccgtataattgtaaaaatcagtgaagtgaaaactcctaaagagagagttaccactctttgcggaaatctttcctgaattacacaactttgggtcgaggtcaagccaa

SEQ ID NO: 2281 - DNA, 83 bp, Ectromelia virus
aaatttagaaatatacagactctatcgcgtgtctatatcttctttttatatccaatgtatttatgtctgatttttcttcattt

SEQ ID NO: 2282 - DNA, 59 bp, Ectromelia virus
aagtcatgctattgtaggaattttttttcacagttgctcaaaaacgatggtagtgactt

SEQ ID NO: 2283 - DNA, 51 bp, Ectromelia virus
atcccaacaatgctatagcattgcgcatagcattagtcataaacttgggat

SEQ ID NO: 2284 - DNA, 130 bp, Ectromelia virus
cgcagcatattcctaaatacatctaaatttttactattatacttggcataaagatatagataatactcgtctgatataattttgtccattgtagtataaaaattaatatttctatttctgtatatttgcg

SEQ ID NO: 2285 - DNA, 61 bp, Ectromelia virus
gaatgttcgcggagtatagcctattattttctaaataacaaactgttttctttatatattc

SEQ ID NO: 2286 - DNA, 57 bp, Ectromelia virus
ggaagtggatatacatagttgtgatcatcattatcgctagccttatcctctatatcc

SEQ ID NO: 2287 - DNA, 95 bp, Ectromelia virus
ggacgttctcgtacaggacgtaactataaattggtttatatttgttcaagatagatacaaatccgataacttttttgacgaattctacgggatcc

SEQ ID NO: 2288 - DNA, 63 bp, Ectromelia virus
ggtggaacgtatattttatttaaggacttaacaattgtctgtaaaccacaatttgcgtccgcc

SEQ ID NO: 2289 - DNA, 65 bp, Ectromelia virus
tatttatgtcataaactgtaaatgattctgtagatgctgcaatatcatcacacatgatatttatg

SEQ ID NO: 2290 - DNA, 83 bp, Ectromelia virus
tcatttgtacactgtttcatattttttaatagtctacatcttttagtaggactagtatcgtataattcatagctgtattttga

SEQ ID NO: 2291 - DNA, 83 bp, Camelpox virus
tgttggccgggcggagccgaacattctccaatattcaatttttgtatatctataatgttattaacctccgcatacgcattaca

SEQ ID NO: 2292 - DNA, 61 bp, Ectromelia virus
ttaacttcgcaataatttctggttagataacgcactctaccagtcaagtcaatgatattag

SEQ ID NO: 2293 - DNA, 108 bp, lumpy skin disease virus
attagatgtagtgaatggttcagtcgtggtggtatcatccgaataataactaaatgcagtagtaaatgattcggtcatattatcatctgaataataactatatgtagt

SEQ ID NO: 2294 - DNA, 55 bp, Goatpox virus
ctattgtttcataatcactagatgaataccttctaagtgattgtttttttaatgg

SEQ ID NO: 2295 - DNA, 85 bp, lumpy skin disease virus
ggaagttgattcagagtatgataatgtatcgacgtaaatattatttaatgtttcttctatttccattttaactttctcagctttc

SEQ ID NO: 2296 - DNA, 80 bp, lumpy skin disease virus
gtatcaaagtatttagatgaatttgataaaattattttatgacctttaattttaatcacatcattaaaacatattgatac

SEQ ID NO: 2297 - DNA, 99 bp, lumpy skin disease virus
tggcttatacacaacaaacatatgaaagattactctaatatccctcaacgacatacagttaaagatattgtcttttatttcttcaggtaatatatccca

SEQ ID NO: 2298 - DNA, 82 bp, lumpy skin disease virus
ttattttcttcttctgtgcatctctttattgatattccgcttacactactagtaaaaatgaatagttgcaaaaagaaaatga

SEQ ID NO: 2299 - DNA, 96 bp, lumpy skin disease virus
ttggaaatataagaggtggagcatcttcccattttgatgatgttaaatcccaaaaactaacatctgatacaacggatccattttttattcctccaa

SEQ ID NO: 2300 - DNA, 67 bp, lumpy skin disease virus
ttgtaaaatgaacgggaaaaaagtctcttttaacccgaacttgttatttcctgtgcttatttttcaa

SEQ ID NO: 2301 - DNA, 127 bp, lumpy skin disease virus
ttttaaaccgtttaacttataacaatttttatttctatatctagagagacgcacaatggattggtcgcaatcattgtctcgttttctagtaatagtacatagatatttactgtttaacgtattaaga

SEQ ID NO: 2302 - DNA, 104 bp, Rana tigrina ranavirus
cactctgcgtcgttgtccctgcaccactctatcctcttttccaggtccgacaagtctcccctcacggggatgtagtgcgtccagggcttcaggacgctcgagtg

SEQ ID NO: 2303 - DNA, 97 bp, Rana tigrina ranavirus
ccacaggcaaaagcccacgttgagccaagtctgcctgtcgtcggcgaggtccgccgtgagcatggcagtgagctccgtcaccctctttagcctgtgg

SEQ ID NO: 2304 - DNA, 69 bp, Rana tigrina ranavirus
ccagggcctctgtccagtccccgaggcaagaagggtcgaaccagctggggaactctccgggggtcctgg

SEQ ID NO: 2305 - DNA, 55 bp, Rana tigrina ranavirus
cctatgacaacgagcttagttccgcctaggtcggtgtctatgctcttgtcgttgg

SEQ ID NO: 2306 - DNA, 55 bp, Rana tigrina ranavirus
ctaaaaatgttgtgatagaatctttagactaagattacatctcattctcttttgg

SEQ ID NO: 2307 - DNA, 81 bp, Rana tigrina ranavirus
gaccagggtgccctcggtgaaactgttgggcctcatctggttgttccagatggtccagcactcgtcctcgtcgcacttgtc

SEQ ID NO: 2308 - DNA, 62 bp, Rana tigrina ranavirus
gaggctgcaccagcagtgactgcaccaactgtaccagcagtgactgcaaaggcaccagcctt

SEQ ID NO: 2309 - DNA, 73 bp, Rana tigrina ranavirus
gccagatcgttgacctgctcatccttgatgtcagagacttttttggccgtcagggtgggcgtcatatcctggt

SEQ ID NO: 2310 - DNA, 86 bp, Rana tigrina ranavirus
taataatatcgagatggtaatatcttaagatatttagtctgaaagagaatgtctaaagatatttctctacatctcggataatgtta

SEQ ID NO: 2311 - DNA, 63 bp, Rana tigrina ranavirus
tgccaccagcccggtcactgcgctctccactcccatcgtgttgacagtaggcttgttgtggca

SEQ ID NO: 2312 - DNA, 87 bp, Rana tigrina ranavirus
tgggagactttctgggagactttctgggagactttctgggagactttctgggagactttctgggagactttctcccagcgcctccca

SEQ ID NO: 2313 - DNA, 89 bp, Rana tigrina ranavirus
ttgtcttgggagtatctcgctgtaaaacctgttgtgtgccatatttccatataacaggcagtagttttagagtaatttactccttgcaa

SEQ ID NO: 2314 - DNA, 117 bp, Rana tigrina ranavirus
tttttaggatgagaatgaggtgtaacgacatcttaggatattatctctgaaagggtatttattctctcgatattatctcagagtctttaccatctcggaaacttttagacctaaaaa

SEQ ID NO: 2315 - DNA, 77 bp, Equine herpesvirus 2
aaacactgcacaagatctcacagcactggattgtcacaggcacaactacagtgaggtgagatcttgattcagtgttt

SEQ ID NO: 2316 - DNA, 116 bp, Equine herpesvirus 2
aatagggttgtgaggtaggcggttgccaggcagattaggttaatgtggggggtgcggtactattacttacttactttgttattgttgggggtatactattacttacttactttgtt

SEQ ID NO: 2317 - DNA, 131 bp, Equine herpesvirus 2
acgtgtgtcgcctggtgcggtgtccacacgagcagtaatggtctgaccaaagctaggtcctcaagagcaccccagccttcagcagatcactacctcgggtgtgacggtccgggcgcgccggtggcccacct

SEQ ID NO: 2318 - DNA, 51 bp, Equine herpesvirus 2
acttgaggtcaggcctctccccggggtccccgaggggcgtgaagcccaggt

SEQ ID NO: 2319 - DNA, 81 bp, Equine herpesvirus 2
agttggagatgttgtagcccgtcacaaactccacgtccgcgtccctgatcatggtgaaaaagaggtagagcaggtccagct

SEQ ID NO: 2320 - DNA, 83 bp, Equine herpesvirus 2
ccatgcagctgtgtagttgcctaggagctggtttaacagaaacgcctctaggctactaacacagcacttgaagtcctgtgtgg

SEQ ID NO: 2321 - DNA, 131 bp, Equine herpesvirus 2
cccccagactctcgaagattcttcaaaacaccggtctagagttctgggagaagcgaggggtctctcaaatcgccagactcacttcccctacggaactcaagcgggattttgaatgaggttggagtcggggg

SEQ ID NO: 2322 - DNA, 122 bp, Equine herpesvirus 2
cccccatcttccaagtgttcataaggcgccgatgcgctgctgtagtgaaattttgcattacataaccagcataatttcactacagaacagcacgcggcgcctctgctggaggacgatggggg

SEQ ID NO: 2323 - DNA, 75 bp, Equine herpesvirus 2
ccccgggtagagttcgctgcagagccagggtttttttttaccatcctggttctggcagagaactctgccacgggg

SEQ ID NO: 2324 - DNA, 55 bp, Equine herpesvirus 2
cgtgtccagcttgtagttggacaggctcagcttgtccctgcacacctggtacatg

SEQ ID NO: 2325 - DNA, 126 bp, Equine herpesvirus 2
ctagcacgaggggttggcatttgaaaacaccgtccggagacttctgaagtattaggaatcaattacacgaacctaagtactagagaaatctccgaagcggggttttctggtgatcccctatcctag

SEQ ID NO: 2326 - DNA, 90 bp, Equine herpesvirus 2
ctctcaacaccatcttgagttctctagggaaacaggtgttttttaaatcacaatctgtgtcccgggggaacctcatgctggggtcgagag

SEQ ID NO: 2327 - DNA, 54 bp, Equine herpesvirus 2
gacagtttaagcactgaatgtatcaaggggcctcactcagttgccaaaactatc

SEQ ID NO: 2328 - DNA, 83 bp, Equine herpesvirus 2
gacgctgcgaagcagtgcatagagtgcctggagatccctccattaccagaactcagacactctatgcgctgtcccacagcatc

SEQ ID NO: 2329 - DNA, 130 bp, Equine herpesvirus 2
gagagtctgctcgtggattttgccaggcgccgtttaaagatccacgaggagctaggtgttttagaaacaaaaccacgttcctcgtaaaccttacactcggggctctggcattctgcagaccctagacctc

SEQ ID NO: 2330 - DNA, 54 bp, Equine herpesvirus 2
gatagtttaagcaccttttcatgacctaggcagaattcaagtgcctaaactatc

SEQ ID NO: 2331 - DNA, 92 bp, Equine herpesvirus 2
gcaagacctcgagggggccgtgcaaatagtgccggtgcttttatgagctacacacacctggcatctatctgtacggttactcgaggtgtcgc

SEQ ID NO: 2332 - DNA, 65 bp, Equine herpesvirus 2
gcaccctcgcggccttatcgctgtcgttctcaaacaggcactgcaggatgttggccgccccgtgt

SEQ ID NO: 2333 - DNA, 85 bp, Equine herpesvirus 2
gcagacaccgtgagagactctctaagctagttagtgataagtatatcacaactaacggctcagagggactcatgcgggatcttgc

SEQ ID NO: 2334 - DNA, 130 bp, Equine herpesvirus 2
gccatgttggtgggtgggccctatgatgtattagttgggtggccatcttggtggggtggccatcttggtggggtggccatcttggtggggtggccatcttaatgcacatcccctattactcaataagggt

SEQ ID NO: 2335 - DNA, 52 bp, Equine herpesvirus 2
gcccttccttacagcgaccacagaaaactctgactcctgagaggacagaggc

SEQ ID NO: 2336 - DNA, 69 bp, Equine herpesvirus 2
gcctgtaggtaagccccccatcctcacctttttcagggccagggtctggcagcgtccccctcagcaggc

SEQ ID NO: 2337 - DNA, 85 bp, Equine herpesvirus 2
ggcccccgggaagagctgcgagtggtaggtgcttaggaacctcatgtaggggccgcttaccacgcagctgtcccccttgggggtc

SEQ ID NO: 2338 - DNA, 123 bp, Equine herpesvirus 2
ggcggggttgggcaacactcgggcatttatatagactaagtcccacatggcctctggttaattaggcgggggccaatggggggcctgtgggtattactcaatgcccagtggggtctctctggt

SEQ ID NO: 2339 - DNA, 84 bp, Equine herpesvirus 2
gggtctgtaaagaggaagcgggcggggccgtcccttcccccccagcggcccgctggcatcttcctcttttttttgacagcaccc

SEQ ID NO: 2340 - DNA, 94 bp, Equine herpesvirus 2
ggtaaaggtgtgtgagagcgagagtagagattcacctttatccccaaaaaaggtaaaggtgcttatttctctctctcctccactctgccagacc

SEQ ID NO: 2341 - DNA, 74 bp, Equine herpesvirus 2
ggtggtcctaagagtctgtgaacttaaattattttttatacaaaacttaagtgtcacagactgcttaagccatc

SEQ ID NO: 2342 - DNA, 118 bp, Equine herpesvirus 2
ggtgtctctgttgatagggcgagatgtggttttaacagcctgtcaacttaaattctttctttaaacagacttaagtctccagactgcatattccatctcccgtacgcaaggggcaacc

SEQ ID NO: 2343 - DNA, 88 bp, Equine herpesvirus 2
gttgaatagagtgtggtcttttcaagattttctctggctctgtgccattttcttttaaaaagggcgacatctctatagtgtcaccaac

SEQ ID NO: 2344 - DNA, 110 bp, Equine herpesvirus 2
tacagaccctgcagcgctccagatgtgacacaggtagccctggatctccaggtgattgagaggctaaggtatcggctttcaaaaagcgttaacaagcaggagaagatgta

SEQ ID NO: 2345 - DNA, 130 bp, Equine herpesvirus 2
tagagcattctaatgggggcagagtatatgctcctggacctggtcataaacaggtacaccaccactaccccggctatgatgaggactatgagcagcatgcccccaaagggatttttgaaaaagcttatca

SEQ ID NO: 2346 - DNA, 87 bp, Equine herpesvirus 2
tcaaaacactgtgcatcgtcagggttgatccaggtgagtatggcttacacacaactgactccactcggacgattcacaggattttga

SEQ ID NO: 2347 - DNA, 79 bp, Equine herpesvirus 2
tctatcctggctatgggggccagggccaggctgaggacgctctcggctatggccatcttggccccggcctcggggtaga

SEQ ID NO: 2348 - DNA, 58 bp, Equine herpesvirus 2
tctgtgggattggcggggtaggccatggcgggcccgctggccacgtcgctcccgtaga

SEQ ID NO: 2349 - DNA, 83 bp, Equine herpesvirus 2
tgggactcggtgtggaggagaggggtagttacgattactccatgactaatcgcaagtcctcctctcctctacacagacgccca

SEQ ID NO: 2350 - DNA, 120 bp, Equine herpesvirus 2
ttcttgcagcccaccgtggggtgcctcaggatccccagcaggacctcccgggcgtccgaggggggcccggcgtcgctgctgttgtaggggaccctggagggcgcggtgggcctgtaggag

SEQ ID NO: 2351 - DNA, 77 bp, Rat cytomegalovirus
agacggctcgaccttctgggtctcggattcgagagaaacttaacctctctccagacacggtatttttgaaccgatct

SEQ ID NO: 2352 - DNA, 113 bp, Rat cytomegalovirus
agccggtcactaatactttttctggacgaataaggtccggtacatacgtgtctgggaccgagatcgtcacggcacccgagaccgtatttacccagaaacacgctaacaccgct

SEQ ID NO: 2353 - DNA, 55 bp, Rat cytomegalovirus
atcgtaattgtcttcgataaattactagggctgttattataagcgcaattacgat

SEQ ID NO: 2354 - DNA, 101 bp, Rat cytomegalovirus
ccgagaaggaccgtagaattgatcatcgagtagtttcgtacgagaatgtaacccgcgtacttgttacatctacatcggttttgcgtaaaacctttctcagg

SEQ ID NO: 2355 - DNA, 101 bp, Rat cytomegalovirus
cgatataaaaacgataataccacggagcctcggattctataacgcatacaactgtgtcattctgaatgtataaatcataggcattggtattgttattatcg

SEQ ID NO: 2356 - DNA, 93 bp, Rat cytomegalovirus
gatgacggccgataagacaatgatgactacgacgaggagtatgattatcacataacaacagtacactctcgaagtcaaatcggtcgattcatt

SEQ ID NO: 2357 - DNA, 58 bp, Rat cytomegalovirus
gcacgtctgtctgtgtacagtcttgtgaaaccactgacacatgacacaagaacgtcgc

SEQ ID NO: 2358 - DNA, 86 bp, Rat cytomegalovirus
gcagtacttttcggtggatacgatacagcgaaatcaaaaagatgagttttttgcatctcgcatattgtgtgtgctggtacgtctgt

SEQ ID NO: 2359 - DNA, 111 bp, Rat cytomegalovirus
gccggtactgacatctaacgtgacaccgtttctcggtccgatagtggttccatttatcgcgtggagcaaatgtggacccgagggacctgtctcgccaaccaagctgccggc

SEQ ID NO: 2360 - DNA, 100 bp, Rat cytomegalovirus
gctgcgttccgtcccaatagatatgtgcactggatttaacgtcgtcgttgatatcatagacaacttgacattttctgagacacgggacgaaatggcacgc

SEQ ID NO: 2361 - DNA, 84 bp, Rat cytomegalovirus
gtatatctaaatagaaataaagagtgttaatgctaaaacattgaaacattaactagaattctatcatatcatattcagacatac

SEQ ID NO: 2362 - DNA, 59 bp, Rat cytomegalovirus
gtcttccttccgcaaggacgccatatccctgctccgattcgttcttcggttggtaagat

SEQ ID NO: 2363 - DNA, 128 bp, Rat cytomegalovirus
gtgtaaaagtcgacgttccacgttcacgtgcggaaacttaacgtctttagacatcaaatttctgtaaattaacaatctagacgagcaaccccaagcgtgtgtgttattgaacgacatcgatttaacat

SEQ ID NO: 2364 - DNA, 130 bp, Rat cytomegalovirus
tagactatatattctaagaaattgtacgaggccgtgtctgacgacgatgaagacgacgatcagaatctcatgtattctacgccgttctctgtcagatctctcgctctcctgacatttctttctccgtcta

SEQ ID NO: 2365 - DNA, 67 bp, Rat cytomegalovirus
tttgcttaacagtggcatgtgacaattctacgtcgatcgttacataccacacaaggatcaaagcaga

SEQ ID NO: 2366 - DNA, 130 bp, Human herpesvirus 4
caaatatctggatagcatatgctatcctaatctatatctgggtagcatatgctatcctaatctatatctgggtagcataggctatcctaatctatatctgggtagcatatgctatcctaatctatatctg

SEQ ID NO: 2367 - DNA, 77 bp, Human herpesvirus 4
cccgtgttttccccaacaaagattgttagtggaattaatggagtgtctgacagttgttcctggtagggattcgaggg

SEQ ID NO: 2368 - DNA, 126 bp, Human herpesvirus 4
ccttctggatccaggaatgttgtcttcaattaatgtagaccagccgccctgttgatgaatccaaccatccaggccttcgctggcttctaacatcccacgaactgacaggtccacaacatagtaagg

SEQ ID NO: 2369 - DNA, 108 bp, Human herpesvirus 4
gacgaaaccttgacccttcttgtcaacctcttcaggcccggggttagtgatgaaacaggcaactccggggctgatcaggttaataaggagccgtccttattcttgctc

SEQ ID NO: 2370 - DNA, 51 bp, Human herpesvirus 4
ggcgttgggggccagaatcagaggtgatctctggacattaacttccacgcc

SEQ ID NO: 2371 - DNA, 130 bp, Human herpesvirus 4
gtagcatatactacccaaatatctggatagcatatgctatcctaatctatatctgggtagcataggctatcctaatctatatctgggtagcatatgctatcctaatctatatctgggtagtatatgctat

SEQ ID NO: 2372 - DNA, 51 bp, Human herpesvirus 4
taggcggggttaagcgtgcatcttctgggatgcaacgttaagccccgttta

SEQ ID NO: 2373 - DNA, 71 bp, Human herpesvirus 4
tcccagagggattagagaatcctgacttgcaaatgctctaggcgggaagcctctcttctcctcccccggga

SEQ ID NO: 2374 - DNA, 79 bp, Human herpesvirus 4
tgtgttattttaacgaagagcgtgaagcaccgcttgcaaattacgtgtgtgcttacacacttcccgttagaacaccaca

SEQ ID NO: 2375 - DNA, 99 bp, Goatpox virus
aaacataatattaattcttttgagttaaaatttataaatgatttaccaaaacttgtcatcatataaattgatggacctaatggagttattattgagttt

SEQ ID NO: 2376 - DNA, 126 bp, Goatpox virus
aaactagaggcagtaatgttaccttaggttcctcccttaacgctatatgagattttaccattgatgcaaaagaatctctgcatatagtggaacaaaaagtcccaacattatttccttttatggttt

SEQ ID NO: 2377 - DNA, 88 bp, Goatpox virus
aaattgcaatagtttctacatatttttatttgataatatatagatgtatcaaataacgatattaaacttgttactatagctgcatttt

SEQ ID NO: 2378 - DNA, 128 bp, Goatpox virus
aacagatgaagtaaaataatatgttaagttatgtacattacatgcatatattccagaatcatttttcgttatattatttatccacatgctatgcccaacagaatataaggatttttacatctcctgtt

SEQ ID NO: 2379 - DNA, 127 bp, Goatpox virus
aacttattattgttagatgatgaaataactgatagacctacttttggatatatgtgcatcgacattgtatctgtaactataaattctatacccgttattttgttataattattaacgaacattagtt

SEQ ID NO: 2380 - DNA, 63 bp, Goatpox virus
accgaaacaacttttcagatgatgacgatatcacaaccgccatctctgattatttgttttggt

SEQ ID NO: 2381 - DNA, 130 bp, Goatpox virus
actctagcacttgtttatttgtctttgattgtttattttacaataatgtaagtttaataagtttaccatttgttaataggagaaaaattattgttgataatatcaatgaaataaaaaataaggttatggt

SEQ ID NO: 2382 - DNA, 68 bp, Goatpox virus
aggttataatgtaacaaattatcatacatatgattttgaatcatattattctacttttgcattaacct

SEQ ID NO: 2383 - DNA, 63 bp, Goatpox virus
agtgttggtattgcttcgagacctcgtttctgacaacgatatttcgctagttaaatcagcact

SEQ ID NO: 2384 - DNA, 90 bp, Goatpox virus
ataaaatcaatccaatcaatgctctaatatcacttctcatgagaatattaggaaaaatatttttaaatgagtgatgttttgatattttat

SEQ ID NO: 2385 - DNA, 129 bp, Goatpox virus
ataaactaaacattttttgaatgggaaattgtaattgctagtatcaacagtgataatacgtttatcaatgtctataactgaatacataggcatgttattttttcttgtttgattactgataaagtttat

SEQ ID NO: 2386 - DNA, 89 bp, Goatpox virus
atattttgcaatatctctattatttcttcttcccgtttaatatattcttctgataatatagacttatacgaagatttgttgtctgatat

SEQ ID NO: 2387 - DNA, 93 bp, Goatpox virus
atcgcacacggtgcagcaaacacaataacagaagtattaaaagattcggaagaggactatcaagatgtgtatgtttgtgaaaactgtggagat

SEQ ID NO: 2388 - DNA, 85 bp, Goatpox virus
atctaatacagttaatgacagatcattatttatttctttactttctataagtttgtgattagtgtttgtttatattgttttggat

SEQ ID NO: 2389 - DNA, 88 bp, Goatpox virus
atttattttttgatgaaggatctagtgtacgtatgtcttgcaacgacaaatttacaaaatctaattttcctattaataaagaaaaagt

SEQ ID NO: 2390 - DNA, 131 bp, Goatpox virus
atttttaaatgcgttggaaaaataactaatttagtagcgtttgtgtcgttgtatctaatcaaaacttttaattcatcatcagatgttatctttttaaattgttcccacatttccttcgtatcgtttaaaat

SEQ ID NO: 2391 - DNA, 84 bp, Goatpox virus
ccacttttattaaaatgtccacttttaaacgaatataggttaaaatggccatatatggaaaaggatgattatgaaataaaatgg

SEQ ID NO: 2392 - DNA, 130 bp, Goatpox virus
ctgttttaatcatattaaatgattaggaaatattatgaatttaataaaacagtttcaaaagcagtctgtgttttgaaaggatataaacttcatggtgttattaattttgatcagttacaaaatggaatag

SEQ ID NO: 2393 - DNA, 89 bp, Goatpox virus
gagtggcagagaaatcattacaatctgatttagttgataaatttgttattaaatgaataaaattagattcatctatatcttcttcactc

SEQ ID NO: 2394 - DNA, 113 bp, Goatpox virus
gatacgtaattaataatatcatcattaggatacttttttattatttctatagcctttttcatattatttagttttaacaaagaaatatttgttggtggtacgttaagcgtatc

SEQ ID NO: 2395 - DNA, 71 bp, Goatpox virus
gatgatataaatgataaaatgttttgcgatacaattttatatgatcccgaaacagataaaccttattcgtc

SEQ ID NO: 2396 - DNA, 57 bp, Goatpox virus
gatggtaagatctctcttgttggagattattctattataggaagatcgttagttatt

SEQ ID NO: 2397 - DNA, 92 bp, Goatpox virus
gatttcatattaaatgttacaaaatttgtatctatattttcttctcgagaatgtagtacaaatcaaaatattgtgttaaaatgtatgagatc

SEQ ID NO: 2398 - DNA, 83 bp, Goatpox virus
gcatatgttccaggattgatgacagcggcattaaatatccaaacaagtgttaatactgtggttaaagattttgaaacgtatgt

SEQ ID NO: 2399 - DNA, 77 bp, Goatpox virus
gcgtctagatttaaaaaagtttatatattagtaccaaatataaatatactaaagatttttaattatagtatggacgt

SEQ ID NO: 2400 - DNA, 85 bp, Goatpox virus
gctatatcaatcaaaaatagttcttatttctgatgttagatccaaaagaggaggaaatgaacctagtacatttgatttattaagc

SEQ ID NO: 2401 - DNA, 93 bp, Goatpox virus
ggaacgctattcagtacataatctccattaaatgttacgtagctgttttcgtattcgttagaaaagtactgataataaataataaagtgtttc

SEQ ID NO: 2402 - DNA, 68 bp, Goatpox virus
ggtaaatatatttacatgggatcaaaagattttgcatctgatgataaaatatatttcaaatttatacc

SEQ ID NO: 2403 - DNA, 57 bp, Goatpox virus
gtaactgcgttaatgggcatcatttatttagtattaaatgacaactataccggttac

SEQ ID NO: 2404 - DNA, 83 bp, Goatpox virus
gtattaaaatattgtttgtgtttaatcctatcatgtattgtcctagtaacatgatcagagttataacaaatcctatgtaatat

SEQ ID NO: 2405 - DNA, 61 bp, Goatpox virus
gttagaaaatataaattgtttagataatccaaatatatctgcagtatatggtaactttaat

SEQ ID NO: 2406 - DNA, 108 bp, Goatpox virus
gttgaatgcatatattggaagtgctaatatggattggaggtctctttctcaagttaaagaacttggtataggtatttacaattcttcatgtttggtaatggatttaat

SEQ ID NO: 2407 - DNA, 90 bp, Goatpox virus
gtttaggaatcgaaacaagtgttggtttaaatcctactattgataatatagatgctattatttgttcttcgtccgacataacttctgaac

SEQ ID NO: 2408 - DNA, 64 bp, Goatpox virus
taaagttaagtttaaatctggcaaatgtttgtaaaacggcaacagaatgtaaattccttcttta

SEQ ID NO: 2409 - DNA, 71 bp, Goatpox virus
taatacattgggaagaaggattttgttattaggtttaagctttagtgaaattttaactaacttgtgtatta

SEQ ID NO: 2410 - DNA, 100 bp, Goatpox virus
tactgcgatgtatcaatatgttttaatgatgtgattaaaattaaaggccataaaataattttatcaaattcatccaaatactttgataccatgtttagta

SEQ ID NO: 2411 - DNA, 69 bp, Goatpox virus
tagattgctcagctgtaaaatttagtgaacatgtaaattatttaaaaacgtgcagtgttgggaaatttg

SEQ ID NO: 2412 - DNA, 55 bp, Goatpox virus
tatcatgttgtaagcgttgattgtaataaagaattaatgcctatacgaactgata

SEQ ID NO: 2413 - DNA, 69 bp, Goatpox virus
tcatatactgtgacggcgttgatgcagaatttgtgatgtgtcaagaagcaaaaaaaatagcatatatga

SEQ ID NO: 2414 - DNA, 109 bp, Goatpox virus
tcatatctccctctaaagaagagacgatgactggctttctatgtttgtttttggtgttttgacatatcctagaccagtatacggtttcaactttagtaaaatcagatga

SEQ ID NO: 2415 - DNA, 61 bp, Goatpox virus
tccatacgctataataagtaaagatgttgttttacgatataatacaactataaaatatgga

SEQ ID NO: 2416 - DNA, 86 bp, Goatpox virus
tccatataacaatcctaaattgtcgagaagaaatgctattaaaaaaaaagtattaaacgatggttatgaggaattcgttataagga

SEQ ID NO: 2417 - DNA, 71 bp, Goatpox virus
tctgagttaaatgtttatagatcatgtaaaggtattgtttatagcggatactgttacacttttaacttaga

SEQ ID NO: 2418 - DNA, 127 bp, Goatpox virus
tgaaaattcaaaaaaattactttaggtatgcatttttaaacttattagttaaatggtatcaaagatatcacattcctacaatgagattatttcctacacctgaagcaattccagattttgtatttca

SEQ ID NO: 2419 - DNA, 100 bp, Goatpox virus
tgaagaaacagaatatttcattaaagaatataatacttatctttatttaaaggaaaaggatccatatattttgtataatggaatgttaacaaatatatca

SEQ ID NO: 2420 - DNA, 91 bp, Goatpox virus
tggtcaaggtgggttcggtttcatatttttagcatattcacaaaataatgaagaatatgtagtaaaaattgaacctaagagcaatggacca

SEQ ID NO: 2421 - DNA, 58 bp, Goatpox virus
tgtaaatggaacaaatgacgataatggtgtctttgttattggaataagtttatttaca

SEQ ID NO: 2422 - DNA, 87 bp, Goatpox virus
tgtgaagttaacaatatttgataagttgtttgataaaacttatataagttattgcacaacatgttatataacagaaacaatatcgca

SEQ ID NO: 2423 - DNA, 87 bp, Goatpox virus
tgtttgtttatttctgcttctaatttattatttgcaacaaatacagatactaatgtttcaggtgataagtttccaaataaacataca

SEQ ID NO: 2424 - DNA, 60 bp, Goatpox virus
ttaatttaacttgccaatcattagttgatgctacttcatcaattggcacagttgtattgg

SEQ ID NO: 2425 - DNA, 68 bp, Goatpox virus
ttccattgatacgtactatatctagtaatgatgtgtttatatctagacatagtaggttgcataaggaa

SEQ ID NO: 2426 - DNA, 62 bp, Goatpox virus
ttgggtatcgtagatgaaaaacttactatagaatccatagaaaattattatttagatcccaa

SEQ ID NO: 2427 - DNA, 66 bp, Goatpox virus
ttgtaaaatgaacgggaaaaagtctcttttaacccgaacttgttatttcttgtgcttatttttcaa

SEQ ID NO: 2428 - DNA, 130 bp, Goatpox virus
tttctgatccattagatttaaacccaaacattgatacagaaacataatcattgtcaagtttgacacatctccacttttgtttagtatcataaatgtcatcgtttggatcttttatagttctatcaagaga

SEQ ID NO: 2429 - DNA, 86 bp, Mouse cytomegalovirus 1
aaggatatggtactactgctgctgctgaggagaggagtgacggtcagagatgctctcgaaggtacggctgtggtagcggggtcctt

SEQ ID NO: 2430 - DNA, 131 bp, Mouse cytomegalovirus 1
aaggtagccaaggttctgcctctggccagcatacaggtggtctctagatggtctttcatgttattacacatcatctgacacaccctgtgatattggtgtctctcataggcaatcgtttcctgcactgcctt

SEQ ID NO: 2431 - DNA, 56 bp, Mouse cytomegalovirus 1
aattataccagagtttggtatttttttaatctgagatgcgtcgtctgggtatagtt

SEQ ID NO: 2432 - DNA, 74 bp, Mouse cytomegalovirus 1
acaaaagacattgtaatagatttgatattattacttactagattgatgatgaaattttaacagagtgtccatgt

SEQ ID NO: 2433 - DNA, 62 bp, Mouse cytomegalovirus 1
acgagattcgtggcgtgttgtatatgtatcctcagtacaactacagtatcccaatcaaacgt

SEQ ID NO: 2434 - DNA, 85 bp, Mouse cytomegalovirus 1
acgcggatgtcatagggagcgtgatcgaggggggttggtttaacaaacccacggagaatgcgatctattttacgttcaaccgcgt

SEQ ID NO: 2435 - DNA, 62 bp, Mouse cytomegalovirus 1
actcgttcctggccgcggacgaagatacgaacggcgtcttcgccgcggactaaaagatgagt

SEQ ID NO: 2436 - DNA, 89 bp, Mouse cytomegalovirus 1
agaacaccacctccatcctccccgacgggcatattatccccagtctcgtcccagtaatactcgtcgtctttattatggggtggtggtct

SEQ ID NO: 2437 - DNA, 96 bp, Mouse cytomegalovirus 1
agatgatgaatcgagcggaggatcgcaagaggatgctgtccaaccagctgccttcgtgcatcaagtccaagtcgatcgccaactcgttcatcttct

SEQ ID NO: 2438 - DNA, 115 bp, Mouse cytomegalovirus 1
agctccacgatgcgcttcgtgttcatctcgtgccggctcgtggtcaccaccttgatcgggttggtgttcagcagctggcagatcttcttgtggatgcgcagctcgttgtgtcgtt

SEQ ID NO: 2439 - DNA, 131 bp, Mouse cytomegalovirus 1
agctcggggtcctccagcggcggcgaaggcgactcgtcggactcgtccacgggtggttctcggtcccacaccggttcaccgacgttatccgacaggggcaacacgccgccgctgccgccaccgccaccgtt

SEQ ID NO: 2440 - DNA, 66 bp, Mouse cytomegalovirus 1
agtgtagctgcggcggatcgacgaaggacgccgccggaggcgccttcgctgccgccgcagaccgct

SEQ ID NO: 2441 - DNA, 76 bp, Mouse cytomegalovirus 1
atcgtaatttgtagatgaataaatgtgtgataagttaacgaccgtgtctcttgttattcgtccattaattgcgcgt

SEQ ID NO: 2442 - DNA, 97 bp, Mouse cytomegalovirus 1
atcgtgcagcggttggaactcgctcccgttgtagcagctcgccagggcctcgcggcacttgtgttcgacggtggcgttgatgggctcgctgcgcggt

SEQ ID NO: 2443 - DNA, 73 bp, Mouse cytomegalovirus 1
atgtcgacgagccggaccgaaaccccgtccggccagctgaccggcaaggaggtaccggcgcgctcggagacat

SEQ ID NO: 2444 - DNA, 104 bp, Mouse cytomegalovirus 1
caatgtacttggctccaatgggactttcctgttgactcaccccctattgaccttatgtactgggcaaaacccaatggaaagtccctattgagtcagtgtacttg

SEQ ID NO: 2445 - DNA, 91 bp, Mouse cytomegalovirus 1
cacgtccaggctcaccgaggccgtcagcctgttgccgcggctgaacggccgccacgccaggttcgacgccgccacctctaggtccagcgtg

SEQ ID NO: 2446 - DNA, 119 bp, Mouse cytomegalovirus 1
caggaaaagtagcggcggacggacgcccgtcgagagactgtcgcctcctggatatcggggcaggtacgatggggtcgcaggtcgccgtgacggtcgtccgtctgccgcgcgacctcttg

SEQ ID NO: 2447 - DNA, 108 bp, Mouse cytomegalovirus 1
caggcaactttatcttctccagccatttgagttagcgtgttattaggaagactcccaggaatactaatagcatctgttgccacgatgatggctggatgcgatggcctg

SEQ ID NO: 2448 - DNA, 80 bp, Mouse cytomegalovirus 1
ccaagaagatgttcgtgccaaagcgttccgagaagttccccttttctgggaagattctggcgggaacttcccctttttgg

SEQ ID NO: 2449 - DNA, 126 bp, Mouse cytomegalovirus 1
ccagaggcagaggaggacagagaagctggccgcacgtagcctggcgactggcgatagctgttgaggaattgctggaagcgccatcccggatcgttagtgtccgccgccggagtcctctgtctctgg

SEQ ID NO: 2450 - DNA, 82 bp, Mouse cytomegalovirus 1
ccaggagaactggatcacgttctggtcttgggtatcgtacaggaagatcttgatgggctcgggacgcggacgctcctcctgg

SEQ ID NO: 2451 - DNA, 81 bp, Mouse cytomegalovirus 1
ccctgccgtgatgtgtttttgtttgatctttaagtgttattctctaagtaaagcagtacgaggcggcatcgacgtgcaggg

SEQ ID NO: 2452 - DNA, 113 bp, Mouse cytomegalovirus 1
ccgcagagggtctaggtcgctgtcggccgaggcactgctccttttgagcggtagtgcaaaatttagcagtgcctcgaccgtcagttgaaaaagatgacgtactctccctgtgg

SEQ ID NO: 2453 - DNA, 131 bp, Mouse cytomegalovirus 1
ccgttcaccccgaacagatctgtaccgaaaaatccggtaccgttctccattttgaccgtaacgttatcctttgcgtaaattgtagaacgtgcaccgagcgtcgagtttagcatccataagatggtgtatgg

SEQ ID NO: 2454 - DNA, 72 bp, Mouse cytomegalovirus 1
cctcccgctggccgccgacctggtctcggagttacgcaagtataccgagaagtcgcaggcggcgggcggagg

SEQ ID NO: 2455 - DNA, 72 bp, Mouse cytomegalovirus 1
cctgaagcaccatccgatctgacaccgtttcgatctcgaaccacgggcggaggtccggacttggtcttcggg

SEQ ID NO: 2456 - DNA, 79 bp, Mouse cytomegalovirus 1
cctggacaccgtgacggccgaggtcttccacggcgagccgtacacgtacgctcccgccgcgtcgccgtcgtcggacagg

SEQ ID NO: 2457 - DNA, 65 bp, Mouse cytomegalovirus 1
cgagagaagagaataaagtctgacagaactatgattaatcaccgttcgacgttattctcctcttg

SEQ ID NO: 2458 - DNA, 79 bp, Mouse cytomegalovirus 1
cgatctttctcgggcagaagaccttgtagccgttgtcgaacgcgtcgaagcgctgcaacgacttgtagggggaatgtcg

SEQ ID NO: 2459 - DNA, 108 bp, Mouse cytomegalovirus 1
cgattgtaatggaccaggcatttgagggtgctggtgaggtcggagaagaggtcgccgccggcggacccgttctcctcgtcatgacccgtctcgtcttttttacgatcg

SEQ ID NO: 2460 - DNA, 129 bp, Mouse cytomegalovirus 1
cgcgccaaggggtccactcccaactcgtacaccttcctcccctcctccagcatccgcttgccgatcttgcggcacatgttccagttgttgaaggagagccggtacaggttggggatgtgcccgaggccg

SEQ ID NO: 2461 - DNA, 102 bp, Mouse cytomegalovirus 1
cggacacggtctcagagggagagggacattctgtggtgttaatagccatgcctcgccgcgattctcctgtcccctctctcacagagagttctgttctgtccg

SEQ ID NO: 2462 - DNA, 130 bp, Mouse cytomegalovirus 1
cggctgcagtggcatgcggcgcgagaagatggtcatcgatggactccaggagcccgtctacgtgatgcgtctcctggcccccctcatccccgtcaagctaggattctcgccctacatgttgccgcctaag

SEQ ID NO: 2463 - DNA, 115 bp, Mouse cytomegalovirus 1
cggggtttatttttattgcattggccatctgactcttacacgcacacgcaaggcattggcgactttcgttgcatgtagatgagtgccagtacagtgagaataaataacaaacctg

SEQ ID NO: 2464 - DNA, 89 bp, Mouse cytomegalovirus 1
cgtccaggccgatgccgcacctctcacggagtccgcgccggcagaagtcggagaagccgcacttggtgagcaggtgcagcacggggacg

SEQ ID NO: 2465 - DNA, 104 bp, Mouse cytomegalovirus 1
cgtctgatgtgggtgctggcggggctgtcgttagtgtggtcaggtacgggatgctcgtcggcgggacggccgtgaccgtgctcggaacccgcgacgcgtcagtg

SEQ ID NO: 2466 - DNA, 90 bp, Mouse cytomegalovirus 1
cgtctggatatgaccgaccccctgacatcggcggcgcgagatttttatgccgcagaagtcgatgtcggggtctcggtcgtctccgtggcg

SEQ ID NO: 2467 - DNA, 62 bp, Mouse cytomegalovirus 1
cgtggtggagctcacggtcgaaggcgatttgctgctgtggtgaccgttagactcgcgctgcg

SEQ ID NO: 2468 - DNA, 79 bp, Mouse cytomegalovirus 1
ctgcgttctacggtggtcagaccgaagactgcgacggtaccgacgctggtcgcgcctcttatacccacgtagaacgcag

SEQ ID NO: 2469 - DNA, 112 bp, Mouse cytomegalovirus 1
cttggtgtggttgttacgtagcagcacgagcacggacagcacgggcggtgacacgtcgaggcccaacacgttctccgtgaacaggtcggtcgtgtagttcaaccgcatcagg

SEQ ID NO: 2470 - DNA, 129 bp, Mouse cytomegalovirus 1
gaatacaatggaaagtccctattgactcacccacattgaccttatatgcttgccaacaatggaaaaacccattggaaagtccctattgagtcagtgtacttggcagcaatgggtttttcccattggctc

SEQ ID NO: 2471 - DNA, 87 bp, Mouse cytomegalovirus 1
gacaatcgtagtcatatcacatgatttctcgacagatcgactacaccacgataatctgtcaggacatcatgtgtttaactcgatgtt

SEQ ID NO: 2472 - DNA, 83 bp, Mouse cytomegalovirus 1
gacgaggatacggagatggagatggagttctctccgcgtaacgcggcgcggagactgctgttgtctcgcgctctccgctcgtc

SEQ ID NO: 2473 - DNA, 54 bp, Mouse cytomegalovirus 1
gactgagttgaccgtgaatgagagatagtctttggcttgcgtgttctctttttc

SEQ ID NO: 2474 - DNA, 111 bp, Mouse cytomegalovirus 1
gagggctcgttcgcgcgggtgctcttctacatctggtcgggcacgaacgtgatgttcaacacgacgctgacggacctggcgatcaagaagagcaaggcgctgaaggcgctc

SEQ ID NO: 2475 - DNA, 115 bp, Mouse cytomegalovirus 1
gagttggcgggtgttgtgtgtgagtgagtgagtcccttcgatcgatcgatcgattgattagatcggtttgaagttgaaactcctctccggcgagcacatgtacacggccatgatc

SEQ ID NO: 2476 - DNA, 105 bp, Mouse cytomegalovirus 1
gatcccgatggtggtcaggctggtgtcgcagtcgtcgtcggaatcgtcgtccaccgacctcatgacgctgcgcatcccctcgagcgtggccttgatcacggggtc

SEQ ID NO: 2477 - DNA, 75 bp, Mouse cytomegalovirus 1
gcaccccgatcaacgaccacgagcagtgcaacgcgtccgacaccgcgttccagcaccgcttgaactcggggtcgc

SEQ ID NO: 2478 - DNA, 71 bp, Mouse cytomegalovirus 1
gcacgtcgtcgccccgtaccccaggcccatctccaccgtgttgatgttctggctcacgtggaacaccgtgt

SEQ ID NO: 2479 - DNA, 111 bp, Mouse cytomegalovirus 1
gcatataagatatacagagaaaggattttgctgtctaacgtcctatacagatgttagtcgtacactgtatcggcgcatcagatagagttctgtctgtaaggatatatacgc

SEQ ID NO: 2480 - DNA, 74 bp, Mouse cytomegalovirus 1
gcggtgtgtacaacgaggcatccgaccaactgcggtgcgaaatcgcactcgtatgtcacgttgtgaacagccgc

SEQ ID NO: 2481 - DNA, 74 bp, Mouse cytomegalovirus 1
gctggcgcagaactcgcaccgttcggtgaacgtgatgttattcatcacgatcaccgatccgcgttcgcggtagc

SEQ ID NO: 2482 - DNA, 76 bp, Mouse cytomegalovirus 1
gctgggttatctcgacgtggcggagaagctgcgcaaggaataccccatgtgcaacggtcccctcgaggttctcggc

SEQ ID NO: 2483 - DNA, 71 bp, Mouse cytomegalovirus 1
ggaagccacttcgatgtccgtgtagtagtccgcggacaaggctatcgcacgggagtcccggccggcgctcc

SEQ ID NO: 2484 - DNA, 104 bp, Mouse cytomegalovirus 1
ggacatgaatccgtgcggttctacggggagcagcggcctcttttgagcctgcctcgctttcgaggccgctaccatctcctcggagaaccgaagacggaccgtcc

SEQ ID NO: 2485 - DNA, 97 bp, Mouse cytomegalovirus 1
ggagaaggagtcgagggggcggggaggtcccgaatactcacaaccgagaccgtttgctgggaagttcgaactcgtcgtccccccgcacgtcgtcgcc

SEQ ID NO: 2486 - DNA, 63 bp, Mouse cytomegalovirus 1
ggaggtcggtcgatcacgtcgtttcgttaaatagatggcacgaattcgtcctcgtccacctcc

SEQ ID NO: 2487 - DNA, 79 bp, Mouse cytomegalovirus 1
ggcgacgcatgccctggaggtgagcctgctggacttctcgacgctgatggcggcgctgcacccggagtacgtgtacgcc

SEQ ID NO: 2488 - DNA, 59 bp, Mouse cytomegalovirus 1
ggctatcagtgccgtcgtggtgacggccgcgactatcgccgcgatggcgccccgatacc

SEQ ID NO: 2489 - DNA, 130 bp, Mouse cytomegalovirus 1
gggcagctggttctcggccgtgtccaccagtttgatcttgttctccgccgtgctgtaggcccggccgctcggcacgtgcaggccgaccggaaagtagaaggtgagctcgacgtcccgctccagcgggtcc

SEQ ID NO: 2490 - DNA, 95 bp, Mouse cytomegalovirus 1
ggggtgtttggtcttctgattggcagggcgctgtgtgaggcagtagttatacctgacatggaggccgctgctgtaacaatatctatgttcatctc

SEQ ID NO: 2491 - DNA, 116 bp, Mouse cytomegalovirus 1
ggtcctgatcccgcgagggagccgccggggaggaggtggaagtggaggtcggcgaggcggccgcgggctgattcttggccgcgcccccacctcctgcgtatcttcgcgtgagaacc

SEQ ID NO: 2492 - DNA, 106 bp, Mouse cytomegalovirus 1
gtatggatgatatacttactgttgttgttcacttactattatcacctatataaaacttgtattcatgatacttaccactgaaaaaattgtgtatgtctttttatac

SEQ ID NO: 2493 - DNA, 65 bp, Mouse cytomegalovirus 1
gtcgctgtcaccggagttgatgcccagcatgatcgtgctgcgctttgaactgtgtaacagtcgac

SEQ ID NO: 2494 - DNA, 107 bp, Mouse cytomegalovirus 1
gtgctagctgcggaggcagaagcggctgctggcgctggtgccgcgggcggagccggcgcggcgaccgtcgtctcgttgccgttcttgcccgcttgtgcggtttgtgc

SEQ ID NO: 2495 - DNA, 58 bp, Mouse cytomegalovirus 1
gttcggttgcgtgtatgtgttgtgatcaaaggtcccaacaccggaagcgcggaagaac

SEQ ID NO: 2496 - DNA, 62 bp, Mouse cytomegalovirus 1
gttctaccgccccgaaacgacgttgttatatacggaacctttgtttccacccacggtggaac

SEQ ID NO: 2497 - DNA, 66 bp, Mouse cytomegalovirus 1
gtttccataaccgtacgcgaaacacgccccccagatcaacgtcggcgatcgcgcatatatagacac

SEQ ID NO: 2498 - DNA, 65 bp, Mouse cytomegalovirus 1
tactggccacaaaagtagcagttaaactcttggaaacaaaatgatagctagtattggtgtcagta

SEQ ID NO: 2499 - DNA, 119 bp, Mouse cytomegalovirus 1
tcaacgtgttcttttctcgttcttctacgatgatgccgttctgaaacattagatctgttgtcgcaaagtgatgaaatggtgtgtataggatgggtcgttttgagcgattaacacgttga

SEQ ID NO: 2500 - DNA, 58 bp, Mouse cytomegalovirus 1
tcgaagctcaggttgtaccgttcggggtcgtccccgtagtacaggcgaaagttgttga

SEQ ID NO: 2501 - DNA, 79 bp, Mouse cytomegalovirus 1
tcggtgtcctggctgtgcacgtagcaacgatctccgccggtgtacaccgcgatcagatcgccgtgactcctggcaccga

SEQ ID NO: 2502 - DNA, 78 bp, Mouse cytomegalovirus 1
tcgtaggtaaattgcagttgagcataggtgatatcagtcacgacatcatctatatgatccaagctgcgtttccgacga

SEQ ID NO: 2503 - DNA, 61 bp, Mouse cytomegalovirus 1
tctcttacacccctattgcctaaaattatggaaaatcgtatatggaaaagggtagatgaga

SEQ ID NO: 2504 - DNA, 130 bp, Mouse cytomegalovirus 1
tctgacccctccaagacgggatgaattttacaccaagaatgagtcaccaaacacgatcgtgaccacgctcaccgtgatagtgactcttctttttgtcggactccttctcgtactgatttacttgtacgga

SEQ ID NO: 2505 - DNA, 74 bp, Mouse cytomegalovirus 1
tcttgacggagcgcacgcactcatcgagcatctgatccttcgtcggggtcatcatgagcggcgtctgctcgaga

SEQ ID NO: 2506 - DNA, 126 bp, Mouse cytomegalovirus 1
tgacggctccttaaatagcctagtttttcgacgatccggtcgaccgagggaaactgcctaggatcctatgggtttctcggaaatcggagacgtttctcgaaaacacggtaagatgaggcgccgtca

SEQ ID NO: 2507 - DNA, 79 bp, Mouse cytomegalovirus 1
tgggcaacagtccagacagaccaaccgttgaaaccgagcctctccgttcaacggcatctcgtgcgtcttaatttgccca

SEQ ID NO: 2508 - DNA, 93 bp, Mouse cytomegalovirus 1
tggtcctcgggtagctgctcgtcggccgagctcatccggcgaggggtggtcgccggaggtagctggtcggcgtcctgcggcggctcggggccg

SEQ ID NO: 2509 - DNA, 127 bp, Mouse cytomegalovirus 1
tgttgagctcctcggtgggggtgatgttgtagttggtcctcgagcgggccggcgggtcgttcctgtcgccgctgctgcccgcgccgacaccgacctggggcatccgccggccgaggatctcctgaca

SEQ ID NO: 2510 - DNA, 118 bp, Mouse cytomegalovirus 1
tgttggtgtctctgaagactcaggtaccacctggttgtcacttggtccaggctgggactcatcttcttcagcttcctcagtggcttcaccagcaggttcctcttgagtgacaccacca

SEQ ID NO: 2511 - DNA, 106 bp, Mouse cytomegalovirus 1
ttcatgctagtcgtgtatccctgcgtggtcaccgtagtggcgttggggctggagctcatactcgaagtgatcatcggtgtcgtgctaggtttcgaagatgtatgaa

SEQ ID NO: 2512 - DNA, 103 bp, Mouse cytomegalovirus 1
ttcccgaaccgaacgagatcagtagacacagacatgcacactctgtaaggatatttatctatgtcaacagaaaccatgttctccgtctcgttcacgaagggaa

SEQ ID NO: 2513 - DNA, 131 bp, Mouse cytomegalovirus 1
ttttggtggatgactcggttatggattgctgattgatgttcttcccgacgtgatgggttagaactgactcggttggtctacgtgtcgcggacgaaaagatcgagtgattatcggttggccggccgcggagg

SEQ ID NO: 2514 - DNA, 79 bp, Cowpox virus
ccgataacgatataagactagatgttattcagtgtctgctatccttgggtgctgatataacagccgtcaattgtttagg

SEQ ID NO: 2515 - DNA, 71 bp, Pepper ringspot virus
cgaagatcatcagcgatgtgagagaacttcatgagattgattactcgtcttatatgttcatgatcaagtcg

SEQ ID NO: 2516 - DNA, 131 bp, Pepper ringspot virus
gcgaacaatgttattaaaacgaagtatgagaatttccaaagcccaattgatgaacttaagactcctctgatccgaaagtctgagaatatcaaaggtgcaaagaaagacagaagcgtttgtaacttgttcgt

SEQ ID NO: 2517 - DNA, 118 bp, Pepper ringspot virus
ttcgtgctgggggaagaggttatccgaatggtttagatgtttgggatcttaagtttaagaaatgggtgattgaacctccaattctcaaccactcaaaggtttttgttccagatttgaa

SEQ ID NO: 2518 - DNA, 81 bp, Rio Bravo virus
aacagtgtcaatgatcgaattggcaagagtgaagagtggatagttaccaatgcttggaaaagtttggtcattgctattgtt

SEQ ID NO: 2519 - DNA, 85 bp, Rio Bravo virus
attaggaccctggaaaaatggggctcttgttcttgaaagaggagagtgtcctggaacaaaagtccaaattctagaggattgtgat

SEQ ID NO: 2520 - DNA, 88 bp, Rio Bravo virus
gattgaaccaaagggaactacattttggacccttccagtggttagtggattaacatcactggtccgaggagatttctttggtttgatt

SEQ ID NO: 2521 - DNA, 112 bp, Rio Bravo virus
tcaccactgacatttcggagatgggtgccaatttagatgttgatagggtaattgatccaaggacaactcttaaaccaatggaaaaaggcaatattgtggaggttagcggtga

SEQ ID NO: 2522 - DNA, 121 bp, pestivirus Reindeer-1
ccgctactgaaggctatcttaataagttgtgtgagtagtaaatggcaatgcttttacctcctgtatctggtcatagaactgtcatattatctccataaaaaaataatagaaaaaatagcgg

SEQ ID NO: 2523 - DNA, 96 bp, pestivirus Reindeer-1
gtgttaatcttgcccacatatgaactgaccaagctgtactatctaaaaggagtaaaacaagggatggaaagaaattggttggggaaggtaagctac

SEQ ID NO: 2524 - DNA, 75 bp, pestivirus Reindeer-1
tactcaacggtagtgcattccaattagtgtgcccatttgggtgggttggacgagtggaatgcactgctgtgagta

SEQ ID NO: 2525 - DNA, 130 bp, pestivirus Giraffe-1
cttgttccagccagtagccggggagaacatcacccagtggaatttgagtgacaatggcacgtcaggcatacaacacgccatgtatctcagaggggtgaacaggagcttacacggaatatggccagaaaag

SEQ ID NO: 2526 - DNA, 130 bp, pestivirus Giraffe-1
ttgtgtgagcagttactggcagaccttttatctaatgtacctagctatagatctcctatattatgtccacaggaagattatagaagaggtagcaggggggactaatctggcctctagactgttagcagca

SEQ ID NO: 2527 - DNA, 95 bp, Langat virus
agtttgggacgcctcatgcagtgaaaatggatgtgttcaatctgggagaccagacgggagtgttgttgaagtcactggctggggtccctgtagct

SEQ ID NO: 2528 - DNA, 130 bp, Langat virus
atctggtacatgtggctgggcagtcggttcctggagtttgaggccctcggtttcctcaatgaggatcactgggcgtccagggcttctagtggagctggagtggaaggaatcagcctcaactacctggggt

SEQ ID NO: 2529 - DNA, 87 bp, Langat virus
atgcacccacctggaaaacagagacttcgtcactggggtgcaggggacgacccgcctcacattggttctcgagctggggggctgcgt

SEQ ID NO: 2530 - DNA, 68 bp, Langat virus
atgccaaggtggtgagagtggctaggcccagccgtgaggggggctgtgtcatggacatcataacgcgt

SEQ ID NO: 2531 - DNA, 75 bp, Langat virus
ccattctggctcttttggtgacgggactagtctctgtggagagtctgtttcgttaccttgtagcagtcggtctgg

SEQ ID NO: 2532 - DNA, 131 bp, Langat virus
cggtcacatatcgcactgggactgattgttggtatgccatggagattaggccggtacacactcagggtggcctggtcagatccatggtagtggctgacaacggggctctactcagtgaaggtggagttccg

SEQ ID NO: 2533 - DNA, 119 bp, Langat virus
gtcagtaggatggtgttggggaccctagttctcgccacctcactgatcttcctgtgggccggaggtgttggctacgggaacatggctggggtggcactggtgttttacaccctactgac

SEQ ID NO: 2534 - DNA, 65 bp, Saccharomyces cerevisiae virus L-A
acagcgataaaagaacaactcgacaaacgtgtcactaagatattcggagttggtgatgacgttgt

SEQ ID NO: 2535 - DNA, 70 bp, Saccharomyces cerevisiae virus L-A
atgtgtgtagttgagctgctcgcgaacttacaagtagatcttgaagcagcagtagctactattctcgcat

SEQ ID NO: 2536 - DNA, 97 bp, Saccharomyces cerevisiae virus L-A
ggcagtctcatactatgctaacctgagcaaattcatgagtataccaccaatggcgaacattgaatttgggcaggctagatatgctatgcaagcagcc

SEQ ID NO: 2537 - DNA, 100 bp, Rice yellow stunt virus
agcacctttccgagctgtgacggacattgatcctcaaagaatggtgcaagagagtacagtaacaaagggagactatgatcacagaagaaagatggatgct

SEQ ID NO: 2538 - DNA, 122 bp, rice ragged stunt virus
gttcgcacaagagagtgctgtcagataaagcgatcatatcaaccccaatttcttatgagagacagagagccattgagtatatgttatcatcgcatggatttgattacaatttagtgctgaat

SEQ ID NO: 2539 - DNA, 86 bp, rice ragged stunt virus
tggctattccaagatatccactttacagctattatggtaatgatgatattgatgattatcatttagctgttgttaatcgtaagcca

SEQ ID NO: 2540 - DNA, 95 bp, Plautia stali intestine virus
acgttagctgatatggatggtaaagattcttattcttattattctatcgaacgaatgatttttgaggatcttcacaacccatatctaggtaatgt

SEQ ID NO: 2541 - DNA, 126 bp, Plautia stali intestine virus
atttagcaacttttgggcttgtggtaacggccttaggtgttggctacactatatatagatgtttctttaatggtgagactacaccactggcaaaatctgaaatagtattaccaaaatttcctgaat

SEQ ID NO: 2542 - DNA, 77 bp, Plautia stali intestine virus
ttgcagactgcgtcaggtacatgtggtgcccctgttattttaataggagccaaacaaggacctggtcgcatctgcgg

SEQ ID NO: 2543 - DNA, 103 bp, Himetobi P virus
acatgatattagatctgattatttagaagataagatagaaattaaagatataactggaatctcatcgaatatatccctaaatactgaaaaatccttatcctgt

SEQ ID NO: 2544 - DNA, 109 bp, Himetobi P virus
aggttctgatatcttgggtaatgttttaccgcagactaagagttttaccaacccagttgctaaaatttcagatgctgcgtttgacattatttccatgataccaggattt

SEQ ID NO: 2545 - DNA, 68 bp, Himetobi P virus
agtgccctaacagcaccggctggatgccaatacatagtattactccagccgctactggtagggacact

SEQ ID NO: 2546 - DNA, 120 bp, Himetobi P virus
gccttatgctgggactacccctttcaaacgcattagacctgaaatcaaccctctttcctcttctggaattagtgttgatgatttcaatgtgtttgcaacgggtgttcttggtgtaagagc

SEQ ID NO: 2547 - DNA, 62 bp, Himetobi P virus
tcgtgatttgattaagcgatttggttggtttaagaatcaatcggttgcttttacaaatacga

SEQ ID NO: 2548 - DNA, 91 bp, Himetobi P virus
tgatttcgctggtagtaagatggatgaaatgtcatttgattatgttaaacgcataccaaattacattgattcattttcctattcgaattca

SEQ ID NO: 2549 - DNA, 129 bp, Himetobi P virus
ttccgatctagtgaatcccacaacgtatgcacgcatcacaaccatcagtgagtacgctacagcttatgctatggctgctgctgatgattttgattgcgggttttacttgggggctccattatcttggaa

SEQ ID NO: 2550 - DNA, 104 bp, Triatoma virus
aatctctatgcgatgtatatgcctggtgttaggttgggacatgctctttttattaaagggtgtgttgcagcctttcccacgcattttatagctgcaatgaagtt

SEQ ID NO: 2551 - DNA, 108 bp, Triatoma virus
aatgggaaaagttctgattcaagctatcgttatttgtgttagtgttttatctgcagttttagcatataattacttaccatttaaggctgtttcaggattttgcctatt

SEQ ID NO: 2552 - DNA, 126 bp, Triatoma virus
agaaattttaagcttaaaagtcttagcgaatttgctcgctttattgcaattgttcctagagctattcagggaattgattgtataggcgagttgattagcaaagcttttgagttcgcaagaatctct

SEQ ID NO: 2553 - DNA, 123 bp, Triatoma virus
cattagcacctattagggtagcatggtctcataatgatattaccgacctatttgtttcggcaagtgaggttagtagagttatagaatctcctgctgtgttacctctaattatgtgtgataatg

SEQ ID NO: 2554 - DNA, 70 bp, Triatoma virus
cctctcaatgaaccaataacttggaatgataatttatctattcctggtgaatttggtttagttgggaagg

SEQ ID NO: 2555 - DNA, 97 bp, Triatoma virus
ggaacggtacaagaatgggcccttctatgcttgcatctaaattctttaaagaatttggttttgtggcatatggagatgaccatatttgtgccgttcc

SEQ ID NO: 2556 - DNA, 68 bp, Triatoma virus
ggagatgttgtaatgtggggtcatgcattgccttctgggcattatttgaccgctccttataactctct

SEQ ID NO: 2557 - DNA, 85 bp, Triatoma virus
gtaggactactatatttcatgattgggcagatactagggcttttgtactagatgatctgtctccagatgagatatggaatcctac

SEQ ID NO: 2558 - DNA, 131 bp, Triatoma virus
gtcgttttgaagacttggaaaatgaagaagtggtagcacaggtagggtatttacctggcgatgattcaaaatcaaaagttaggtacctatctgttgcaattccttctttaatagaatctcatgtttccgac

SEQ ID NO: 2559 - DNA, 100 bp, Triatoma virus
gtcttgtgaaaaagtggaacaacgacctgtggtaaaatgtgaatcttgtgaaaaggatacacaaagacccacagtacgttgtgaaacttctacattagat

SEQ ID NO: 2560 - DNA, 130 bp, Triatoma virus
gtgaagtacaaaaatattacatgaaatatttggaatctcaacttgtatatgatgaaattaatttcaatttattaggatcattgtatcaagaaggtattgtaatgttaaatagtcatatttttgtaacagc

SEQ ID NO: 2561 - DNA, 131 bp, Triatoma virus
tattgatggggatgaaactatcaattctataaaacgtaaatcttcgccaggtttcccttgggtttttaaaacttctagtggaactggtaagaaacagatttttggaaatgatggtgaattcctatttgata

SEQ ID NO: 2562 - DNA, 120 bp, Triatoma virus
tggctagatatcttaaatccaagtctgatggttttgtagcaggtgattttgagggatttgattcctctcaattggtgcctatactacgagaaattggaaatgtttttaatggtattgcca

SEQ ID NO: 2563 - DNA, 119 bp, Triatoma virus
ttgttattgatcgttatgaaagattgagaggatatccatgggaaagtgataaaattagttatactaattctttgcttgatctatgtttattttcttctctttctgagcgatctttacaa

SEQ ID NO: 2564 - DNA, 91 bp, Triatoma virus
ttttataaggtgcctttttctgaaatgatgtactgttcttgcttaaattgcgagaagacagaatatgattcggaaagagtatattatgaaa

SEQ ID NO: 2565 - DNA, 130 bp, Triatoma virus
atacgtttagatttgtcaaaactaactatcattctggaagagtccaaattacatttcatccctttgttgggtatgatgatgttatggattcggatggtaagatagttagagatgaatacgtctatcgtgt

SEQ ID NO: 2566 - DNA, 87 bp, Triatoma virus
caggtactcgtgatatccgttcttcttatgttgaggggaaatttattcctcaggatataactggaatgtctagaaatcatgaacttg

SEQ ID NO: 2567 - DNA, 130 bp, Triatoma virus
tagagaaaaattatctggttttacatcttttagtgctagtaccgtctttcatatacaagtaaatgctcatccatttcaatgtggaagattggttttagctgctgtacctgttccagatattttacctcta

SEQ ID NO: 2568 - DNA, 75 bp, Triatoma virus
tcaagaatgtattggtgaaagaatcttatctttttctgaattgattaagagaaattcttggcgatacgtttctga

SEQ ID NO: 2569 - DNA, 126 bp, Triatoma virus
tttgagtcttaaatatggaaatgaggttattttgaaaacaccttttgccggaacatcttctgatgaggtggcgctggagtatgttttaaaaatacctaattacttttctagatttaaatactcgag

SEQ ID NO: 2570 - DNA, 63 bp, Satsuma dwarf virus
agcttattgaaacgggcgatactattagtgacttgttatctaattcgaccgtttcgttgagct

SEQ ID NO: 2571 - DNA, 111 bp, Satsuma dwarf virus
gagcttaatatagctactgctctatgtgaggctttctttcatggtaaggagtatttttcctttctagaggggaaaattatagaagccatgcgcaagagcggcgtagctctc

SEQ ID NO: 2572 - DNA, 69 bp, Satsuma dwarf virus
gattttttgaagaggcaatttgttgcagactctggatccactgcaattctttgtcctctgaagaaaatc

SEQ ID NO: 2573 - DNA, 74 bp, Satsuma dwarf virus
ggtgctgagcttgatgcggctattcttgataggttttcaatacctatcagtgaatgtcgtaaagaactcacgcc

SEQ ID NO: 2574 - DNA, 63 bp, Satsuma dwarf virus
tacgaaaggcaaggtttatattatggagtgtttagaacttgttaaagccaaattgccttcgta

SEQ ID NO: 2575 - DNA, 75 bp, Apple latent spherical virus
attgatctgtggtggcatgttatggatcgttatgtgcgtaattacagagctaccaaatatgtcactaaagacaat

SEQ ID NO: 2576 - DNA, 109 bp, Apple latent spherical virus
attgccacagtgcactttctcgagctgccctctttgatatgcaaagagttcctcccttttggatacatttgtattcagagaatggcggcacaggaaagtccatggcaat

SEQ ID NO: 2577 - DNA, 75 bp, Apple latent spherical virus
cgagtctaggagcagttctaggggtcttttcactcttaagggtgaaggttggactccagctgctttgaaagctcg

SEQ ID NO: 2578 - DNA, 121 bp, Apple latent spherical virus
gaatgcgtttcaaatctcaaagataaatgtgttggtatgataaacgatcattggcttgcttttgcagcaggttcaacacttgttttgaccctcatatttctttttgcgatgatttgcattt

SEQ ID NO: 2579 - DNA, 62 bp, Apple latent spherical virus
ggatgagaaagttgattcttctaaagtgtacataaaacaaaaaactcgactttttactatcc

SEQ ID NO: 2580 - DNA, 70 bp, Apple latent spherical virus
tatagattgggtgaaggctggttatcgtaaatgtaaagaatactatgataacaccttctccaaatttgta

SEQ ID NO: 2581 - DNA, 103 bp, Apple latent spherical virus
tggtttaacccggagtcaaattgcaaaaattcttaatgcagtttttggtggtaaccccgaagtctgccaaagaattttccaatttttctctcaagtcgagcca

SEQ ID NO: 2582 - DNA, 131 bp, Tobacco rattle virus
agaacacataacgcgactgctaattcgatgacggtgaggaagattgtgtctaaagaacaggtttctttgaagcctggtgctcagtacataactttccttcagtctgagaagaaggagttggtaaatttgtt

SEQ ID NO: 2583 - DNA, 114 bp, Tobacco rattle virus
atggactggtgaaaaaactatgtgatatgtttgatatcaaacggggggcccatgtcttagacgttgagaatccgtgccgctattatgatatcaacgatttctttagcagtctgt

SEQ ID NO: 2584 - DNA, 130 bp, Tobacco rattle virus
cctgtttgtagagaaacaattcatggacaagtgtttggattacatagctaggttatctgaccagcagctgaccataagcaatgttaaatcatatttgagttcaaataattgggtcttattcataaacggg

SEQ ID NO: 2585 - DNA, 131 bp, Obuda pepper virus
cggtggatgtgacccatttcttaaatcaatgttacgatggtgctgtcacgacaacttctaaaactcagagatctgtaggtttggaagtggtaggtggtgctgctgtaatgaatccggtcactaagccgctg

SEQ ID NO: 2586 - DNA, 130 bp, Obuda pepper virus
ctgaatcacatcagaacatatcaggctaaagcactaacatacaataatgttttatccttcgtcgaatcaattagatcgagggtaatcattaatggagttactgcgagatctgaatgggatgtagataaag

SEQ ID NO: 2587 - DNA, 87 bp, Obuda pepper virus
gcgatgaggtagtatgcaataatactttccaatgctgtgaaagcaacaggtacagttcaggaggtagagtttatgctatttccttgc

SEQ ID NO: 2588 - DNA, 130 bp, Obuda pepper virus
gctgaatcagttattagtaacaagatggcatcgatagtatactccggaccgctacaagtgcaacaaatgcaaaactatgtagacagtctcgcagcatctctatcggccactgtttctaatctgaaaaagc

SEQ ID NO: 2589 - DNA, 91 bp, Sugarcane striate mosaic associated virus
ctgctgcgtgaggtttattcttaaaaattcaaaacttcttcgctctgatgtgaagaagttctttaaggacgggctccagcttacgcagtag

SEQ ID NO: 2590 - DNA, 131 bp, Sugarcane striate mosaic associated virus
gactggagagtttgatgactttcttcaacataggggctgaagtccaggaaaatggtcacaagtttattttgaacgagaatggcagtagggctcgaagcttcattctggagaataatcatattgaatttgtt

SEQ ID NO: 2591 - DNA, 64 bp, Salmon pancreas disease virus
tcgttgatgtgtatgacgctctgccgatttctgtagagattagcaccgtcgtaacatgcagcga

SEQ ID NO: 2592 - DNA, 131 bp, Salmon pancreas disease virus
tggtgccgtccccatgtccatcaacattccggacgcgaagtttacccgcaaattaaaggatccgaaaccatcggccctgaaatgcgtggtggacagctgcgagtacggggtggactacgggggcgccgcca

SEQ ID NO: 2593 - DNA, 70 bp, Ljungan virus
aatcaatggcgagtgtgcatgcaggactatgaagtggccctgcatcgcatgctacgctatgtttttgatt

SEQ ID NO: 2594 - DNA, 129 bp, Ljungan virus
cagcctttctgaacaactgatgagatatggagtggaaatacttgcctactgtcatgaacaaccagaggctgtaatgattcttcatgaacctgttataaactctcaacaccttgtgatggatgaaatctg

SEQ ID NO: 2595 - DNA, 62 bp, Ljungan virus
gagcaaatgacactttgtgtaccctattattctgaggttccattaagatgtgttaaaggttc

SEQ ID NO: 2596 - DNA, 69 bp, Ljungan virus
tttctgtttcatcccctttggatgctgaatacttggttcagagtgcagcccaaaattttggaatggaag

SEQ ID NO: 2597 - DNA, 99 bp, Equine rhinitis A virus
ctgtttccgccgggcctgacttctcgctccgacatcctgttgacttgcctgacaagcaggtcacaaatgtgggagaggatggcgagcccggtgagacag

SEQ ID NO: 2598 - DNA, 80 bp, Equine rhinitis A virus
gtacagaggatcattaaattttaactttattttcactggagctgcagctaccaaggcaaaatttttggttgcttttgtgc

SEQ ID NO: 2599 - DNA, 64 bp, Equine rhinitis A virus
ttcattgattgttattttttgtctggtgtactcaatgtatcagatttttaaaaccccagatgaa

SEQ ID NO: 2600 - DNA, 103 bp, Equine rhinitis B virus
ctcgggagtgaaaacttatcaggaattctcgcgcaaacacaaacctgtgcgccaaccggtgtacaacgcgtgggaagactttgatgaggattgcatttttgag

SEQ ID NO: 2601 - DNA, 98 bp, Equine rhinitis B virus
gaagattcaggtgcagtgcaatgccagccagttccacagtggctgccttttggttgccatgattcctgagtaccttagcactgcacaacaggattttc

SEQ ID NO: 2602 - DNA, 88 bp, Equine rhinitis B virus
gcagtatgagagtagtcagacatcccatgacagcgcgacgcgcccaacgcgtcattgacatgggatactctgattatgaaaccgctgt

SEQ ID NO: 2603 - DNA, 98 bp, Equine rhinitis B virus
gctgcgtgccgcagcgtatgatgtcttcaccaattacgaagagggcgatctcgcttttcttacgtatggtgatgatgtactactctgtgctaatcagc

SEQ ID NO: 2604 - DNA, 111 bp, Equine rhinitis B virus
gtgttgcattcctttctggcattcatggtcgaaagcaatccattcttaagaaaatcaaggagtggttcgcggacggcgtgcgtgtcagaaatcttcttggagatgcagcat

SEQ ID NO: 2605 - DNA, 69 bp, Equine rhinitis B virus
tttggctcaactttcttacaaaactttttggcaatatttgaccaaaccttttgcagatgctgggctgaa

SEQ ID NO: 2606 - DNA, 92 bp, Porcine enterovirus A (PEV8)
ggcaagtcaggaagtgatattacaaagtttaaagcttttacctattggagatttgatttggatgttgtagtaatgatactggaagataaacc

SEQ ID NO: 2607 - DNA, 107 bp, Porcine enterovirus A (PEV8)
gttgatttgcatgaagccatctttgcaaaatacaagggcaatgttgatgccacacttccagaagaggcccttatagcaatagaccatttggtttccaaatttaaggc

SEQ ID NO: 2608 - DNA, 71 bp, Porcine enterovirus A (PEV8)
tggtttctgtggagctggattaatatctaaaggtaaactgtatggtatagttacagctaagactgaaagca

SEQ ID NO: 2609 - DNA, 77 bp, A-2 plaque virus
acatgccagaggcagcaaggccatgtgatgaggagtgctacccttgtaattttaagagatgttgtccactggtatgt

SEQ ID NO: 2610 - DNA, 68 bp, A-2 plaque virus
cagtagtcaatgcagtaaacttggttgacccagaaggagtcaatcttgaaattaccgtattgacactg

SEQ ID NO: 2611 - DNA, 97 bp, A-2 plaque virus
tcagtatatggcagaagcaattgatgattatgccagtaatttattatcattaggaataaatactgaaccaaattcaatggagcaggctgtatatgga

SEQ ID NO: 2612 - DNA, 78 bp, Avian encephalomyelitis virus
agatgagtttcctaaagagaacattctatgtggatgagtggtccatctgtcatccgcgtatttctgaggagactgttt

SEQ ID NO: 2613 - DNA, 129 bp, Avian encephalomyelitis virus
caatgtagtaggatatggaagactgagtttgtggaagagaagatatctgtggggtctaaaacgaagtaccacaagtcccctttatatgatttttgtccacaggaggttattaaatgtcccactaagttg

SEQ ID NO: 2614 - DNA, 61 bp, Avian encephalomyelitis virus
cattgagagagcagggaccatttactcgaccaacatgaagatggtccaagttttgttcttg

SEQ ID NO: 2615 - DNA, 64 bp, Avian encephalomyelitis virus
tcactgacacatctagcaaaacagtgatgaatacatattggcttgatgatgacgagttggtaga

SEQ ID NO: 2616 - DNA, 130 bp, Tamana bat virus
ataaacaggggcctgtagggaacatcatgttggcattgggattaatttgtttgcttacctattactttgaagtggtagcagctgacaagtatgttctaatggttgatactgatgacatgtccttgagtgt

SEQ ID NO: 2617 - DNA, 95 bp, Tamana bat virus
attatggcatgttgccaggaaggcctcgttccgatggggaaggttaaagagcctttgatttggggcgaaccatggctggacagcatggacatagt

SEQ ID NO: 2618 - DNA, 129 bp, Tamana bat virus
gactttttgccatattgagcatgttgataggggttgggatagtggctgttttatatttggcaaaggagaagttgtcacttgtgcagcagtaacttactcgaaacctttttatgcttggatggttgattc

SEQ ID NO: 2619 - DNA, 67 bp, Tamana bat virus
gtcaattgtctcaataacagtgttcttttgcgggagcatgaagaatacgttggtaactgcaacagac

SEQ ID NO: 2620 - DNA, 106 bp, Tamana bat virus
tgggttgattgtaacactcatgattatgaattaagcttttggacatcagcattgatcacaacaaaaagccgaagttatgaacataaaccttgcaaaattcaaccta

SEQ ID NO: 2621 - DNA, 112 bp, Tamana bat virus
ttaaggatgtgactgaaaatgtcatgatacatgagagtggatttgagacatttaagaaagtggctaaaatgctcaccactccagtagtgggcttcttcaagagcatccttgg

SEQ ID NO: 2622 - DNA, 98 bp, sheeppox virus
tataattgatataataaaaggatctaaatattcacacccttcaaagatagaacatggcgttatttttaagatatcacctgtagattttatcgaatata

SEQ ID NO: 2623 - DNA, 63 bp, Goatpox virus
tattctagtagaggaactaatgtttttatatctttacttataagtaatttctttacaggaatg

SEQ ID NO: 2624 - DNA, 81 bp, Foot-and-mouth disease virus O
cgggaaagccgacggtgacgccctggtcgtgctagctagtgctggcaaagactttgacttgcgtctgccggtcgacgcccg

SEQ ID NO: 2625 - DNA, 84 bp, Foot-and-mouth disease virus O
gcccccaccaatgttcacgtcgcgggtgagctcccctctaaagaggggattttccccgtggcatgcagcgatggttacggtggc

SEQ ID NO: 2626 - DNA, 65 bp, Foot-and-mouth disease virus O
ggccgctgtggcagcacggtccaaggacccagtccttgtggccatcatgctggccgacaccggcc

SEQ ID NO: 2627 - DNA, 107 bp, Foot-and-mouth disease virus O
gtctggaacatcaagcacttgctctacaccggaatcggcaccgcttcgcgacccagcgaggtgtgcatggtggacggtacagacatgtgcttggctgacttccacgc

SEQ ID NO: 2628 - DNA, 70 bp, Foot-and-mouth disease virus O
ttgaccacccgtaacggccacacgacctcgacaacccagtctagcgtcggggtgacttacgggtacgcaa

SEQ ID NO: 2629 - DNA, 129 bp, Cowpea aphid-borne mosaic virus
cagaattcatagcaacagaggcagcttttctttcatttgcttatggattgccagtgaccacacaaaatgtaaccaccaacatcctaagtaaatgcactgtacagcaagcaaagaatgcgctcaattttg

SEQ ID NO: 2630 - DNA, 69 bp, Cowpea aphid-borne mosaic virus
gaatggggaggaagactcggaacttcattcacatgtatggagtcgagcctgaaaattattccaccattc

SEQ ID NO: 2631 - DNA, 98 bp, Cowpea aphid-borne mosaic virus
gccgtatttatcttgcgaataaggtagagcagttctcacataggcttataggtagtgtgtgtaatatgtttttgagatttgttcgtaggtgttatggt

SEQ ID NO: 2632 - DNA, 72 bp, Cowpea aphid-borne mosaic virus
gggtgagggtgtggcaagaaaaccactgacaaaagcatgtgtttcggttcttgagaaaaactttgtttaccc

SEQ ID NO: 2633 - DNA, 78 bp, Cowpea aphid-borne mosaic virus
tcaggagaggttagttttctttgctaatggtgatgatatcatattagccgcacaagaaaaggacattggcattcttga

SEQ ID NO: 2634 - DNA, 113 bp, Cowpea aphid-borne mosaic virus
tcttagaatgttctttatggaagattggtgggttggacaagagatgcttgaaaatctatatgcagagatagtgttcacacccatccttacaccagatggaactgttgttaaga

SEQ ID NO: 2635 - DNA, 70 bp, Cowpea aphid-borne mosaic virus
ttgttggaaaaattttcagtaacatggcaattgaagagattttcagatgttacggaaaatactttgacaa

SEQ ID NO: 2636 - DNA, 93 bp, Trichomonas vaginalis virus 3
gaacaaggaaatggagctcgaactcttcccacttaagaaggccccacaagccgatcttaaagtgaactgttacgcgcgaaacgtccttgcttc

SEQ ID NO: 2637 - DNA, 83 bp, Trichomonas vaginalis virus 3
gataccctaccctatgaattaaacaagagcaaacagagctttggacctaatgccgagttcttgcgcttgcataggcgtgcggg

SEQ ID NO: 2638 - DNA, 64 bp, Sorghum mosaic virus
aaccaattgtgcatcattgagaatcactcgaacgatgtgagacaatgtatgtatgcgataggtt

SEQ ID NO: 2639 - DNA, 71 bp, Sorghum mosaic virus
cttcaatttagcacgttatgcttttgatttctacgagatcacatcacgtacaacagcccgtgctaaggagg

SEQ ID NO: 2640 - DNA, 92 bp, Sorghum mosaic virus
gcagagttaatcgtacagcaaatgtccatactggagaaggcctcaacacagcttagattcgcagtatcagggattagccatgttgaccctgc

SEQ ID NO: 2641 - DNA, 75 bp, Sorghum mosaic virus
gcagccgtacaaaaagaatatgaacttgatgacacacaaatgacagttgttatgagcggactaatggtatggtgc

SEQ ID NO: 2642 - DNA, 73 bp, Potato virus A
caagtgtcaaacttcttaggattagaaggacactggaagaagtccctaatcacaaaggacttgttgatagttg

SEQ ID NO: 2643 - DNA, 114 bp, Potato virus A
cactggaggagcaagacagcgtctgtgcatacggcgttaatggtgatgatctgctaattgcaattaggccagatatggagcataagctagatggatttcaagctctatttagtg

SEQ ID NO: 2644 - DNA, 67 bp, Potato virus A
gacttgtcaaatgctagagccacccacgaacaattccaaaactggtatgatggcgttatggcaagtt

SEQ ID NO: 2645 - DNA, 77 bp, Potato virus A
gagagtattgtgcagaagtggttctgtttcaagcaaaggcgtctgagcaggttaattttgagcgcatcatagctttc

SEQ ID NO: 2646 - DNA, 69 bp, Potato virus A
gagattcgagttgaggaccaagtgagttttcaggacttcgtcaaagctcaagggaatggatcgaatctc

SEQ ID NO: 2647 - DNA, 79 bp, Potato virus A
gcgaacttctagaaaaaacttacttgagcctgttggaggattcatggcaagagttaagctattttggaagatttcaagc

SEQ ID NO: 2648 - DNA, 100 bp, Potato virus A
tgctgctggagaggcacttcttggttactaaagtggatggtcgatctatgaagcttggacaagttgagatcatcaccaagggcagtgctaacaaaaagca

SEQ ID NO: 2649 - DNA, 66 bp, Potato virus A
tggtaaagttcatcaatacaatgttagctataacagtggcactacaattgtacatagcatttgcca

SEQ ID NO: 2650 - DNA, 120 bp, Cryphonectria parasitica mitovirus 1-NB631
gtaaatctgttatctcaagtgaatttactgaatttgcaaagaagttgaaaggtcgaaataatttcgacattttctatcggagctggtttagtattattcactttgagaaacaaatattac

SEQ ID NO: 2651 - DNA, 76 bp, Cryphonectria parasitica mitovirus 1-NB631
tcatggcgttccttattacgtattaagtacaaaagcccacaaggctttctgacttatgcggtagggcaacccatgg

SEQ ID NO: 2652 - DNA, 130 bp, Cryphonectria parasitica mitovirus 1-NB631
ttcggttcatagagtattgcctactaaggtagttcctgattatagtactattgttgatccctttacaggggtttcaaagactatagatcagaagcttcttaggaaagcaatacatctattgaatatcaaa

SEQ ID NO: 2653 - DNA, 76 bp, Bean common mosaic necrosis virus
gagatgaggaattctgaagggttctacatgcctaggtatggacttcttcggaatttgagggataaaagcttggctc

SEQ ID NO: 2654 - DNA, 121 bp, Bean common mosaic necrosis virus
gggtttaaaaggaaaatgggatggaaagaagttctttaatgatgtcgtggttgccatcttcacattgattggtggtggctggatgttatgggattatttccgtcactatatgcaagaacct

SEQ ID NO: 2655 - DNA, 127 bp, Bean common mosaic necrosis virus
ggtgaatcgattaagagagaagatctgacgcttgcttgcgtatcaaagcaggatgggaattttgtatacccgtgctgttgtgtcacgcaggatgatggcagaccgttctattctgagttgaagagcc

SEQ ID NO: 2656 - DNA, 130 bp, Bean common mosaic necrosis virus
gtccgccttgccaaggactattgccattttggaccacttaataagtgaggaaatcatgaagaaaaatcattttgacacaattagctcctcactcacagggcattcattttcattggctggcatcgcagat

SEQ ID NO: 2657 - DNA, 82 bp, Ophiostoma mitovirus 3a
aatgccttgtgtacttaagttagagtcaatcacagatccttttaaagggatttctgatactcttcctaagtccgagatcatt

SEQ ID NO: 2658 - DNA, 77 bp, Ophiostoma mitovirus 3a
ctgaatagttgagtctttagtaaattaaaggaccttccaatggatggtacatttaatcaacaagctccactaaacag

SEQ ID NO: 2659 - DNA, 80 bp, Ophiostoma mitovirus 3a
cttacgaataatgatttatctaatgttggatatataactaaacagttatttcctcattgaataagattattagtatgaag

SEQ ID NO: 2660 - DNA, 82 bp, Ophiostoma mitovirus 3a
cttcttcaccgttatactctttcataagagggcagtttggaaacaaactttccgctcttgtgcaagataaaccggtgagaag

SEQ ID NO: 2661 - DNA, 74 bp, Ophiostoma mitovirus 3a
gactccctactataataccgggaaccttaagaactcttttgagatctaaggattctagtactataaggggagtc

SEQ ID NO: 2662 - DNA, 65 bp, Ophiostoma mitovirus 3a
gtaagtccgttattccctactcttctttcttttataggaaggatgaatagaggtaacgttcttat

SEQ ID NO: 2663 - DNA, 75 bp, Ophiostoma mitovirus 3a
tcatcatgtaattgtacaaatagctgcaatgagagttggtaaactcccattcactaattatgcgttacttggtga

SEQ ID NO: 2664 - DNA, 75 bp, Ophiostoma novo-ulmi mitovirus 4-Ld
aaggaatcttaactaatattagacatattcatgttgtatatatgaatatatttacatatttacaaagaattcctt

SEQ ID NO: 2665 - DNA, 81 bp, Ophiostoma novo-ulmi mitovirus 4-Ld
actgataatgatcattatctaagcataaaaggttctccaaatggaaaagcttcaatgtctagtctatattcaattatcagt

SEQ ID NO: 2666 - DNA, 93 bp, Ophiostoma novo-ulmi mitovirus 4-Ld
agaaaaagtaatggtttattatacactatcaagtatatgaaagctgcaaagcttcatataacaagatatatgtgtggtaaaccattatattct

SEQ ID NO: 2667 - DNA, 86 bp, Ophiostoma novo-ulmi mitovirus 4-Ld
agtctaatatgatgtctagaatttgagatatggccttgtcttataggacgagtccaatgtcatattctacactaacattcgagact

SEQ ID NO: 2668 - DNA, 86 bp, Ophiostoma novo-ulmi mitovirus 4-Ld
gatagatttccaatattcttacaacaaaaacttatatcattaatatttaatgattatgagtttggtaaaaattggagaaatctatt

SEQ ID NO: 2669 - DNA, 84 bp, Ophiostoma novo-ulmi mitovirus 4-Ld
gttttatatgatgcctagtatttgagatatggcctcgtcttcaacaacgggaccaaagccatttactactgcaacattcaaaac

SEQ ID NO: 2670 - DNA, 96 bp, Ophiostoma novo-ulmi mitovirus 5-Ld
ataatccagaattacaatgaagtagagatgatcattatttgagttttaaaagctcgcctaatggtcaatctacattacatagtagctatggattat

SEQ ID NO: 2671 - DNA, 87 bp, Ophiostoma novo-ulmi mitovirus 5-Ld
gttaagaggtattttaaataatctaaataactatggaattgtattccaagaattatttaaatttcattataaatacccacatttaac

SEQ ID NO: 2672 - DNA, 101 bp, Ophiostoma novo-ulmi mitovirus 5-Ld
tgagaaagataaatggtcttaaattcacaattaagtatatgaaagctgttaagcttcatattactaaatatattgcaaatgaaagattattatcgatttca

SEQ ID NO: 2673 - DNA, 115 bp, Southern bean mosaic virus
catagaagttcaagtaaacccctcatggattagcctcttaggtggctctctcaagataaacggagatgacgcctctaatgagtctgctgtgttgggaagcttttattcttctgtg

SEQ ID NO: 2674 - DNA, 119 bp, Southern bean mosaic virus
ctgggagttgtgggctgatgtagagatgagaattgttctggggggctttggccataaactggctaaagccgcccagaataggttttcgtgtttcatgaactcagtcttccagctctcgg

SEQ ID NO: 2675 - DNA, 74 bp, Southern bean mosaic virus
tctgctctggttgagcgcgtcattcgcgacatacctttataagtatgtgagaactcggctgctcccagaggaga

SEQ ID NO: 2676 - DNA, 77 bp, Phthorimaea operculella granulovirus
atttttatattgtattgaatagcgtgtgggtatattgttatacggcgcttaacatgaaatccatacaatatgaagat

SEQ ID NO: 2677 - DNA, 125 bp, Phthorimaea operculella granulovirus
gaatttgaatttgtaaatacattgggtgagagaatgagtcgttcgcaaatatatggagattacattgtatggccagatatgagcactacttttatcggatggatgttatatttgcgtttaaattt

SEQ ID NO: 2678 - DNA, 113 bp, Phthorimaea operculella granulovirus
gagtatgatcgattaaacaaattggtacaaaataatccgtctgtgtggcaagatttattgttggtgtgcacagatcgagacaatatgtacacatggatggtcagattttattt

SEQ ID NO: 2679 - DNA, 61 bp, Phthorimaea operculella granulovirus
gcgatttgttgttaattgttttgcgcaaagaacagacgtgtttacagttgattcaaaatgt

SEQ ID NO: 2680 - DNA, 93 bp, Phthorimaea operculella granulovirus
gcgtgagggagtttttggcaaacgttttgcgttacaattgcgacgatgagggacaattgcgctacaaacgtttgctgatcgacgaccccacgt

SEQ ID NO: 2681 - DNA, 63 bp, Fringilla coelebs papillomavirus (FPV)
gctctatagcttaccattatgctatacatgctgagcaagataataatgccaagctatggttgc

SEQ ID NO: 2682 - DNA, 79 bp, Paprika mild mottle virus
acgtcgatcctctaaagataatctctaagttaggtgctaagcatataacagatagggagcatctggaagagtttcgtgt

SEQ ID NO: 2683 - DNA, 123 bp, Paprika mild mottle virus
agtaatcttcttaaatatgtttgtaaaacttatttcccagcgtctagtagatatgtatatatgaaggaatttctagtaactagggtaaatacttggttttgcaaattcactaaactagatact

SEQ ID NO: 2684 - DNA, 129 bp, Paprika mild mottle virus
cttaatcacatcagaacctatcaggccaaagcactgacatacaataatgtgttatccttcgtcgaatcaattagatcgagggtaatcattaatggtgtcacagcgaggtcagaatgggacgtggataag

SEQ ID NO: 2685 - DNA, 98 bp, Paprika mild mottle virus
ggttattcatagacgaaggtttgatgttgcatccaggctgtgtttactttttagtaactctaagtctgtgtgatgaagcctttgtctttggagatacc

SEQ ID NO: 2686 - DNA, 131 bp, La Crosse virus
aaccttcaaactcatattgctttcaaagtccttacaaagcataaaaggtatatcaacttacacagaagcgttcaaatctttaggaaaaatgatggatattggagataaggctattgagtatgaagaattct

SEQ ID NO: 2687 - DNA, 93 bp, La Crosse virus
ggtgtattagatgctccattgtcaatgattagtacagttggattggaatctgggaatttatacttcttgataaagttgttgagcaaatatacc

SEQ ID NO: 2688 - DNA, 81 bp, La Crosse virus
ttctagatgcagagatggaccctagtgatattatgggtgagacaagcgacatgagagggaggtctattttgacacctagaa

SEQ ID NO: 2689 - DNA, 101 bp, Mamestra configurata nucleopolyhedrovirus B
ctgagctatagtaaaaacgaaacacccgttgtcaaatacaacaagagccataacaacaattgtgtgtttgtcgagggtggcaatatgctacatatggccgg

SEQ ID NO: 2690 - DNA, 89 bp, Mamestra configurata nucleopolyhedrovirus B
tttttcgtataccgtacatgttcttcaataacactccggacaacattttcaaagagtttattaaaggcaactatacgggacacgaaaaa

SEQ ID NO: 2691 - DNA, 127 bp, Heliothis zea virus 1 (HZV-1)
gattcgtaatgttcaaggctgtgctgtacaagtgcattcaactggaccgacagactgcatcgattgacgatcgcattctctccaagtttgagtgcatcttggacgatgccaccgagagctacgattc

SEQ ID NO: 2692 - DNA, 93 bp, Heliothis zea virus 1 (HZV-1)
atgccgcgtaccactgtctaaactctagtcaaaaggtggcctttcagattatacacaaacagattagcgatagctttagattggacacggcat

SEQ ID NO: 2693 - DNA, 109 bp, Heliothis zea virus 1 (HZV-1)
gtactgtagacgtaaagcgggaggctcctttgaagcggtagcgttgcctcaaaactacaagtttgcaccgctactcgtactcatacagggctactcgtacatcaagtac

SEQ ID NO: 2694 - DNA, 109 bp, Heliothis zea virus 1 (HZV-1)
cgagtccaatactattgttgaaaatgttggtgtagagggtgattttaacaaggagaatcttgctccttccggtaaagagtccaacattgaaacggtagcattgggctcg

SEQ ID NO: 2695 - DNA, 123 bp, Heliothis zea virus 1 (HZV-1)
gagcacggtaccatcaagactccatccgatggtaaactgaatgtaatcatttgtcgcaatgtgttggatttgaacaatattacatcggtggaccaagtgatggatgtcttgatggacgagttt

SEQ ID NO: 2696 - DNA, 88 bp, Heliothis zea virus 1 (HZV-1)
gttgttcttgttacgataatgtagagtccccggagcttacagtagagactccatccgagtctacatctaatgtaaatgctgagtcgac

SEQ ID NO: 2697 - DNA, 123 bp, Chikungunya virus
gatcgtctgacaaaatccgcgtgcgcagccttcatcggcgacgacaacataatacatggagtcgtctccgatgaattgatggcagccagatgcgccacttggatgaacatggaagtgaagatc

SEQ ID NO: 2698 - DNA, 80 bp, Chikungunya virus
tctggcaagtcagctattatcaagaacctagttaccaggcaagacctggtgactagcggaaagaaagaaaactgccaaga

SEQ ID NO: 2699 - DNA, 91 bp, Mammalian orthoreovirus 2
cctcacgatgagcgactcgggaagttgtatcaatctttcctgccacttgcgaaggatttactggccccagttgctcggcatttttatgagg

SEQ ID NO: 2700 - DNA, 85 bp, Mammalian orthoreovirus 2
gataggtgcagtgcttccaaaaggatctttcaaatcgacgattatgcgcgtgcttgatgagatggaagtgcttggtgtgcgtatt

SEQ ID NO: 2701 - DNA, 95 bp, Mammalian orthoreovirus 2
tttgatgcaagatgggtggtgcgggtgtgaggacggatttatcacgtacgttgttatccgagcgccgaagctggtcttagaggagttgcgtgaga

SEQ ID NO: 2702 - DNA, 112 bp, Tacaribe virus
tttctgatgatgagatgacaggcttcattagaagctgtgctaaaagggtttttaatgatataaaaagaggcaaagtttttgaggaaaacctgatcagtcttattggtagaga

SEQ ID NO: 2703 - DNA, 130 bp, Rachiplusia ou multiple nucleopolyhedrovirus
gatccggctttcaacagaaatttaaatgacgagcgattccaaaacttgaggcaacaatacgacgaaatgtctagtaaatattcagctttggaaacgactaaaattaaagagatggagaatatcgcagatc

SEQ ID NO: 2704 - DNA, 76 bp, Rachiplusia ou multiple nucleopolyhedrovirus
gcagaattgttagaaaatgttgctgtcacaagcgctgtaagcgctttagtacagcaatatgaacgatcagaaaagc

SEQ ID NO: 2705 - DNA, 131 bp, Aphid lethal paralysis virus
acacatcgcaaaccactctgacttaactggtgctgctttaatatattacgttcgcaacggaatcccctcaggatgccctgcaactgctatattgaacagtatcgttaatcattgttgtcttgctgattcgt

SEQ ID NO: 2706 - DNA, 130 bp, Aphid lethal paralysis virus
cactttgtgttggagaattgtagtaatgctatctcaccgttgatcccatgctcggttattcttgaacaagaaaaccatgttaaggatcctcgtagagacattgccattgtacaattacccacaaatattg

SEQ ID NO: 2707 - DNA, 131 bp, Aphid lethal paralysis virus
cgtgtgtctgttgactcgtttctatcaaggatttaaaacagccgatctttatgatatgactaagcaaattagtaatactttgccttctatcatcaagaatcccgaactgaaacgactaatcgactcacacg

SEQ ID NO: 2708 - DNA, 89 bp, Aphid lethal paralysis virus
cgtgttgatgctgtttatgaagcaatgagtgtattctaccaacgtgaatatattaactctcctgcacattataaactgccattaacgcg

SEQ ID NO: 2709 - DNA, 125 bp, Aphid lethal paralysis virus
ctcgaatggtgacaaaaataggagcacaggccccggtatacgataaccgtgtaacaattaagaagaacacaatcttagctgcacagaatctattacccgcttttgccaaaattgaaccaatcgag

SEQ ID NO: 2710 - DNA, 83 bp, Aphid lethal paralysis virus
gctcttggatccgcaggtattgcttctagtcttgttgcacaactcgtaacatcgcttagagcatattttgtggcaccaatagc

SEQ ID NO: 2711 - DNA, 128 bp, Aphid lethal paralysis virus
tacccgcatgtaaaggatgtgataactgctctcctatcgatgctcaacgatctttgcctgaacaagacaaaggttcgattgtcatcgctagagacgtagtttaccgcaatcttttcagattcacggtg

SEQ ID NO: 2712 - DNA, 106 bp, Aphid lethal paralysis virus
tatggtgatcaacgtgtatctaacaatcacgagctatctgtatcagatatggctgaaattatcaaccaagtcgcagattgtgattgtaatacatgtgattgctgta

SEQ ID NO: 2713 - DNA, 131 bp, Aphid lethal paralysis virus
tcagaatcgtggttcttatacatatcatgctgtaactttcttcggtgattgcggatcgatacttattgcatcgaacgctgctattactcagaaaattatgggcatgcatattgcaggaattacgcatatga

SEQ ID NO: 2714 - DNA, 76 bp, Aphid lethal paralysis virus
catatagcacgaacgccatgttttatcaaaaaattccaatggacttctaatggtaaagctggcgacgtactatatg

SEQ ID NO: 2715 - DNA, 61 bp, Aphid lethal paralysis virus
ttggtattagtgctattaatgagttggaagtaaatcctgcattaactcgcactgacatcga

SEQ ID NO: 2716 - DNA, 107 bp, Callitrichine herpesvirus 3
aaggcaccatgtttactttttactccgggcggcctctttctcaaaccagcgcttcactgtaaaagatctggaagaggcccttcgagtcttggaaacttcattgcctt

SEQ ID NO: 2717 - DNA, 66 bp, Callitrichine herpesvirus 3
ccggcgttcttttttatgactacatcttcgaggcgttactctgggatcaatcatacggagttccgg

SEQ ID NO: 2718 - DNA, 79 bp, Callitrichine herpesvirus 3
ccgatggtgatgacatagaatggtctatgctttgtctaaattcatgcctgactcaggttctctctcatcctactgttgg

SEQ ID NO: 2719 - DNA, 60 bp, Broad bean necrosis virus
cattctgaagtgcagaggagacaacaagaagctgtgctgaaagaattgcgcttgagagtg

SEQ ID NO: 2720 - DNA, 68 bp, Broad bean necrosis virus
gaccaaaggtgcgagttatttgacatttactcaaaccgagaaagatgagatgaagcagtatcttggtt

SEQ ID NO: 2721 - DNA, 66 bp, Broad bean necrosis virus
gtttgttgatgatgtgtgatactacttatttgatgaatgagatgattatctatcagaattgcatgc

SEQ ID NO: 2722 - DNA, 87 bp, Broad bean necrosis virus
tcttgagtatacgactgatgactttgaagaaaatgctgctgataactttgttggagcttttgataatattattcagcttgctgaaga

SEQ ID NO: 2723 - DNA, 95 bp, Broad bean necrosis virus
tgtatatgaagattacgacagtgtggagattgattttagaaaatttgacaaatctaaggtgtccctccatatcaaagttgtgattgaattgtaca

SEQ ID NO: 2724 - DNA, 82 bp, Broad bean necrosis virus
ttctccgattagtaatattgaagcctctcagaggtggtggcagaatcaatctgagcaggcgaagaaacaattgatcgcagaa

SEQ ID NO: 2725 - DNA, 111 bp, Broad bean necrosis virus
gtttttgaatgatcttgagtatacgactgatgactttgaagaaaatgctgctgataactttgttggagcttttgataatattattcagcttgctgaagaagaagaaaaagc

SEQ ID NO: 2726 - DNA, 24 bp, Human herpesvirus 7
tggaatgaaatgtaaatccgttac

SEQ ID NO: 2727 - DNA, 22 bp, Human herpesvirus 7
ttagtagtaatacatcgaaaag

SEQ ID NO: 2728 - DNA, 24 bp, ictalurid herpesvirus 1
tgatgtactcgggggggatgcctt

SEQ ID NO: 2729 - DNA, 24 bp, Invertebrate iridescent virus 6
tgaggaaaatgaagatgtatacct

SEQ ID NO: 2730 - DNA, 24 bp, Invertebrate iridescent virus 6
tgttatgaaaatgaaatttgtata

SEQ ID NO: 2731 - DNA, 24 bp, Invertebrate iridescent virus 6
tgagaaatataatttatagttgtg

SEQ ID NO: 2732 - DNA, 24 bp, Invertebrate iridescent virus 6
tgagaattcttgaataatgatatt

SEQ ID NO: 2733 - DNA, 24 bp, Invertebrate iridescent virus 6
ttggatgaaagaacagctaattta

SEQ ID NO: 2734 - DNA, 24 bp, Invertebrate iridescent virus 6
tgaaggactaagagtagctaaaga

SEQ ID NO: 2735 - DNA, 24 bp, Invertebrate iridescent virus 6
ttctatgcttgaaagtaataatag

SEQ ID NO: 2736 - DNA, 24 bp, Invertebrate iridescent virus 6
tataaagaatcaattgcatttgaa

SEQ ID NO: 2737 - DNA, 24 bp, Invertebrate iridescent virus 6
tattggaataggttttggaattaa

SEQ ID NO: 2738 - DNA, 24 bp, Invertebrate iridescent virus 6
tgacacaaaacgaaattaaagatt

SEQ ID NO: 2739 - DNA, 21 bp, Invertebrate iridescent virus 6
taaccagataaaaatttttct

SEQ ID NO: 2740 - DNA, 22 bp, Invertebrate iridescent virus 6
tattacccatactaaaagatct

SEQ ID NO: 2741 - DNA, 24 bp, Invertebrate iridescent virus 6
ttggtgctgctggtactggtcctg

SEQ ID NO: 2742 - DNA, 24 bp, Invertebrate iridescent virus 6
tcgggtcttgttaaacatcagtta

SEQ ID NO: 2743 - DNA, 22 bp, Invertebrate iridescent virus 6
tattacaatctttaccggttat

SEQ ID NO: 2744 - DNA, 24 bp, Invertebrate iridescent virus 6
ttggatgggatattcctaacattt

SEQ ID NO: 2745 - DNA, 24 bp, Invertebrate iridescent virus 6
tagcatggattcgagataataaac

SEQ ID NO: 2746 - DNA, 24 bp, Invertebrate iridescent virus 6
ttgaatgtgttgatggtatagaaa

SEQ ID NO: 2747 - DNA, 24 bp, Invertebrate iridescent virus 6
tggaatgggatgatcatgttgctt

SEQ ID NO: 2748 - DNA, 24 bp, Invertebrate iridescent virus 6
taagagatttaactttaatttgca

SEQ ID NO: 2749 - DNA, 24 bp, Invertebrate iridescent virus 6
tcagttatgggagatccgtcaata

SEQ ID NO: 2750 - DNA, 21 bp, Invertebrate iridescent virus 6
tcaaatgggattgtgaaagtg

SEQ ID NO: 2751 - DNA, 24 bp, Invertebrate iridescent virus 6
tggaatggcttgcgggatatttgg

SEQ ID NO: 2752 - DNA, 24 bp, Invertebrate iridescent virus 6
tgatggacttcttctcggtgatgg

SEQ ID NO: 2753 - DNA, 24 bp, Invertebrate iridescent virus 6
tattgtttgtaatggggttctgaa

SEQ ID NO: 2754 - DNA, 24 bp, Invertebrate iridescent virus 6
tattaccacagattgacgcacatg

SEQ ID NO: 2755 - DNA, 24 bp, Invertebrate iridescent virus 6
tttaaatgttattattggaagggg

SEQ ID NO: 2756 - DNA, 24 bp, Invertebrate iridescent virus 6
tgtacacatgatgaagattgttta

SEQ ID NO: 2757 - DNA, 24 bp, Invertebrate iridescent virus 6
tacaagatctaagtagatatccaa

SEQ ID NO: 2758 - DNA, 23 bp, Invertebrate iridescent virus 6
taatacaaaatacctccaatagc

SEQ ID NO: 2759 - DNA, 24 bp, Invertebrate iridescent virus 6
ttaggtattttaacattaggatgg

SEQ ID NO: 2760 - DNA, 24 bp, Invertebrate iridescent virus 6
tatcgcacccaatataattttcac

SEQ ID NO: 2761 - DNA, 24 bp, Invertebrate iridescent virus 6
taacggaaagtggatatttttgtg

SEQ ID NO: 2762 - DNA, 24 bp, Invertebrate iridescent virus 6
tgccttctaaatctattttcaagc

SEQ ID NO: 2763 - DNA, 24 bp, Invertebrate iridescent virus 6
tacgatgttcagtagatatttttg

SEQ ID NO: 2764 - DNA, 23 bp, Invertebrate iridescent virus 6
tctgacaccagacctgagacagc

SEQ ID NO: 2765 - DNA, 24 bp, Invertebrate iridescent virus 6
ttaggaatttgtttatgttatggg

SEQ ID NO: 2766 - DNA, 24 bp, Invertebrate iridescent virus 6
aggaacagaaaaagaattattgga

SEQ ID NO: 2767 - DNA, 24 bp, Invertebrate iridescent virus 6
cgtaatgaatgtataccttgatta

SEQ ID NO: 2768 - DNA, 24 bp, Invertebrate iridescent virus 6
tgaaaaagaaagatatagaggtgc

SEQ ID NO: 2769 - DNA, 24 bp, Invertebrate iridescent virus 6
tcaggaacttctcgtgttgcgcat

SEQ ID NO: 2770 - DNA, 24 bp, Invertebrate iridescent virus 6
tacagttacgggaggatcgggagg

SEQ ID NO: 2771 - DNA, 24 bp, Invertebrate iridescent virus 6
tatgtgaagtttcccattgttcaa

SEQ ID NO: 2772 - DNA, 24 bp, Invertebrate iridescent virus 6
tttgttgaaacaaagtccgaatat

SEQ ID NO: 2773 - DNA, 24 bp, Invertebrate iridescent virus 6
tggaagagccgtttatatttctga

SEQ ID NO: 2774 - DNA, 24 bp, Invertebrate iridescent virus 6
tgaggtcctaccaaagcattattt

SEQ ID NO: 2775 - DNA, 24 bp, Invertebrate iridescent virus 6
agcccattgtcagttcctccagga

SEQ ID NO: 2776 - DNA, 23 bp, Invertebrate iridescent virus 6
ttaaaccactacgtccgtgacca

SEQ ID NO: 2777 - DNA, 23 bp, Invertebrate iridescent virus 6
aggaattgaatttcgttttaaca

SEQ ID NO: 2778 - DNA, 24 bp, Invertebrate iridescent virus 6
tgtgaaataacaccattacttaaa

SEQ ID NO: 2779 - DNA, 24 bp, Invertebrate iridescent virus 6
tattttaatgcattttctaaatta

SEQ ID NO: 2780 - DNA, 24 bp, Invertebrate iridescent virus 6
taggttcaacaggtttttgattaa

SEQ ID NO: 2781 - DNA, 24 bp, Invertebrate iridescent virus 6
tgtaaacggtctttttactaaaca

SEQ ID NO: 2782 - DNA, 24 bp, Invertebrate iridescent virus 6
gtgatgatgaacatgaaacagaaa

SEQ ID NO: 2783 - DNA, 24 bp, Invertebrate iridescent virus 6
tggattgaaacaatggattaatat

SEQ ID NO: 2784 - DNA, 24 bp, Invertebrate iridescent virus 6
tacaataaataagaatctaaaatg

SEQ ID NO: 2785 - DNA, 24 bp, Invertebrate iridescent virus 6
tgaaatgacaggtgagcttgcagt

SEQ ID NO: 2786 - DNA, 21 bp, Maize streak virus
tatcaaagaaccttgagtcag

SEQ ID NO: 2787 - DNA, 24 bp, Murine adenovirus A
tgacgtattgcgcaactgtgcaac

SEQ ID NO: 2788 - DNA, 24 bp, Murine adenovirus A
tattacttatgcggaggtgttgcg

SEQ ID NO: 2789 - DNA, 24 bp, Plutella xylostella granulovirus
tatcataatccattgataaagtac

SEQ ID NO: 2790 - DNA, 24 bp, Plutella xylostella granulovirus
tgagtacaattcagaacctatcga

SEQ ID NO: 2791 - DNA, 24 bp, Plutella xylostella granulovirus
tagcaagctgttggctaaaaacgg

SEQ ID NO: 2792 - DNA, 24 bp, Plutella xylostella granulovirus
tactgtaactactggaaacttgct

SEQ ID NO: 2793 - DNA, 22 bp, Plutella xylostella granulovirus
ttcacgtcgagcgacacgagat

SEQ ID NO: 2794 - DNA, 24 bp, Plutella xylostella granulovirus
tcgttggcttcgtacctaaccatt

SEQ ID NO: 2795 - DNA, 24 bp, Plutella xylostella granulovirus
tgagctatcagtaagttgtaaatt

SEQ ID NO: 2796 - DNA, 22 bp, Plutella xylostella granulovirus
tacacagacgacatgctgtccg

SEQ ID NO: 2797 - DNA, 24 bp, Plutella xylostella granulovirus
caggagccgtttacgctgatactt

SEQ ID NO: 2798 - DNA, 24 bp, Plutella xylostella granulovirus
tcactcgtttgtgtgacatggagc

(The sequence listing continues in the following parts.)

What is claimed:

1. An isolated nucleic acid, wherein the sequence of the nucleic acid consists of:
   (a) SEQ ID NO:3588;
   (b) a RNA encoded by (a); or
   (c) the complement of (a) or (b), wherein the complement is identical in length to (a).

2. An isolated nucleic acid, wherein the sequence of the nucleic acid consists of:
   (a) SEQ ID NO:863;
   (b) a RNA encoded by (a); or
   (c) the complement of (a) or (b), wherein the complement is identical in length to (a).

3. A vector comprising a heterologous sequence, wherein the heterologous sequence consists of the sequence of the nucleic acid of claim 1 or 2.

4. A probe comprising a heterologous sequence, wherein the heterologous sequence consists of the sequence of the nucleic acid of claim 1 or 2.

* * * * *